US009249198B2

(12) United States Patent
Fraser et al.

(10) Patent No.: US 9,249,198 B2
(45) Date of Patent: Feb. 2, 2016

(54) *NEISSERIA MENINGITIDIS* ANTIGENS AND COMPOSITIONS

(71) Applicant: GlaxoSmithKline Biologicals SA, Rixensart (BE)

(72) Inventors: Claire Fraser, Potomac, MD (US); Cesira Galeotti, Poggibonsi (IT); Guido Grandi, Segrate (IT); Erin Hickey, Palatine, IL (US); Vega Masignani, Siena (IT); Marirosa Mora, Siena (IT); Jeremy Petersen, Arlington, VA (US); Mariagrazia Pizza, Siena (IT); Rino Rappuoli, Vagliagli (IT); Giulio Ratti, Siena (IT); Vincenzo Scarlato, Colle Val D'Elsa (IT); Maria Scarselli, Siena (IT); Herve Tettelin, Gaithersburg, MD (US); J. Craig Venter, Potomac, MD (US)

(73) Assignee: GlaxoSmithKline Biologicals SA, Rixensart (BE)

( * ) Notice: Subject to any disclaimer, the term of this patent is extended or adjusted under 35 U.S.C. 154(b) by 0 days.

(21) Appl. No.: 14/450,082

(22) Filed: Aug. 1, 2014

(65) Prior Publication Data
US 2015/0079124 A1    Mar. 19, 2015

Related U.S. Application Data

(60) Continuation of application No. 13/359,442, filed on Jan. 26, 2012, which is a continuation of application No. 13/070,448, filed on Mar. 23, 2011, which is a division of application No. 12/013,047, filed on Jan. 11, 2008, now Pat. No. 7,988,979, which is a continuation of application No. 09/674,546, filed as application No. PCT/US99/09346 on Apr. 30, 1999, now Pat. No. 7,576,176.

(60) Provisional application No. 60/121,528, filed on Feb. 25, 1999, provisional application No. 60/103,749, filed on Oct. 9, 1998, provisional application No. 60/103,794, filed on Oct. 9, 1998, provisional application No. 60/103,796, filed on Oct. 9, 1998, provisional application No. 60/098,994, filed on Sep. 2, 1998, provisional application No. 60/099,062, filed on Sep. 2, 1998, provisional application No. 60/094,869, filed on Jul. 31, 1998, provisional application No. 60/083,758, filed on May 1, 1998.

(51) Int. Cl.
| | |
|---|---|
| *C12P 21/00* | (2006.01) |
| *C12N 15/00* | (2006.01) |
| *C12N 15/09* | (2006.01) |
| *C07K 14/22* | (2006.01) |
| *A61K 38/00* | (2006.01) |
| *A61K 39/00* | (2006.01) |
| *A61K 39/095* | (2006.01) |

(52) U.S. Cl.
CPC .............. *C07K 14/22* (2013.01); *A61K 38/00* (2013.01); *A61K 39/00* (2013.01); *A61K 39/095* (2013.01); *Y10S 530/806* (2013.01); *Y10S 530/825* (2013.01)

(58) Field of Classification Search
None
See application file for complete search history.

(56) References Cited

U.S. PATENT DOCUMENTS

| | | | |
|---|---|---|---|
| 5,514,581 | A | 5/1996 | Ferrari et al. |
| 5,550,213 | A | 8/1996 | Anderson et al. |
| 5,554,372 | A | 9/1996 | Hunter |
| 5,668,004 | A | 9/1997 | O'Donnell |
| 6,060,065 | A | 5/2000 | Barney et al. |
| 6,214,566 | B1 | 4/2001 | Asa et al. |
| 6,472,518 | B1 | 10/2002 | Ribot et al. |
| 7,348,006 | B2 | 3/2008 | Contorni et al. |
| 7,576,176 | B1 | 8/2009 | Fraser et al. |
| 7,785,608 | B2 | 8/2010 | Zlotnick et al. |
| 7,862,827 | B2 | 1/2011 | Giuliani et al. |
| 8,101,194 | B2 | 1/2012 | Zlotnick et al. |
| 8,226,960 | B2 | 7/2012 | Masignani et al. |
| 8,273,360 | B2 | 9/2012 | Pizza et al. |
| 8,293,251 | B2 | 10/2012 | Scarlato et al. |
| 8,394,390 | B2 | 3/2013 | Galeotti et al. |
| 8,398,988 | B2 | 3/2013 | Contorni et al. |
| 8,398,999 | B2 | 3/2013 | Masignani et al. |
| 8,524,251 | B2 | 9/2013 | Fraser et al. |
| 8,563,007 | B1 | 10/2013 | Zlotnick et al. |
| 8,574,597 | B2 | 11/2013 | Zlotnick |
| 8,663,656 | B2 | 3/2014 | Pizza |
| 8,734,812 | B1 | 5/2014 | Galeotti et al. |
| 8,834,888 | B2 | 9/2014 | Contorni et al. |

(Continued)

FOREIGN PATENT DOCUMENTS

| | | |
|---|---|---|
| EP | 0467714 A1 | 1/1992 |
| EP | 0818465 A1 | 1/1998 |

(Continued)

OTHER PUBLICATIONS

Donnelly et al. (2010). "Qualitative and quantitative assessment of meningococcal antigens to evaluate the potential strain coverage of protein-based vaccines," Proc Natl Acad Sci U S A, 107(45):19490-5.
Plikaytis et al. (2012). "Interlaboratory standardization of the sandwich enzyme-linked immunosorbent assay designed for MATS, a rapid, reproducible method for estimating the strain coverage of investigational vaccines," Clin Vaccine Immunol, (10):1609-17.
Sandbu et al. (2007). "Immunogenicity and safety of a combination of two serogroup B meningococcal outer membrane vesicle vaccines," Clin Vaccine Immunol, 14(9):1062-9.

(Continued)

*Primary Examiner* — S. Devi
(74) *Attorney, Agent, or Firm* — Morrison & Foerster LLP

(57) ABSTRACT

The invention provides proteins from *Neisseria meningitidis*, including the amino acid sequences and the corresponding nucleotide sequences. The proteins are predicted to be useful antigens for vaccines and/or diagnostics.

14 Claims, 31 Drawing Sheets

(56) References Cited

U.S. PATENT DOCUMENTS

| | | | |
|---|---|---|---|
| 8,840,907 B2 | 9/2014 | Pizza | |
| 8,980,286 B2 | 3/2015 | Comanducci | |
| 9,011,869 B2 | 4/2015 | Pizza | |
| 9,056,075 B2 | 6/2015 | Pizza | |
| 9,067,987 B2 | 6/2015 | Galeotti et al. | |
| 2004/0033234 A1 | 2/2004 | Berinstein et al. | |
| 2004/0092711 A1 | 5/2004 | Arico | |
| 2004/0110670 A1 | 6/2004 | Arico et al. | |
| 2004/0167068 A1 | 8/2004 | Zlotnick et al. | |
| 2005/0222385 A1 | 10/2005 | Pizza | |
| 2006/0051840 A1 | 3/2006 | Arico et al. | |
| 2006/0171957 A1 | 8/2006 | Pizza | |
| 2006/0240045 A1 | 10/2006 | Berthet et al. | |
| 2006/0251670 A1 | 11/2006 | Comanducci et al. | |
| 2007/0026021 A1 | 2/2007 | Fraser et al. | |
| 2007/0082014 A1 | 4/2007 | Costantino | |
| 2007/0253984 A1 | 11/2007 | Khandke et al. | |
| 2008/0241180 A1 | 10/2008 | Contorni | |
| 2009/0285845 A1 | 11/2009 | Masignani et al. | |
| 2010/0015151 A1 | 1/2010 | Rappuoli et al. | |
| 2010/0267931 A1 | 10/2010 | Arico et al. | |
| 2011/0020390 A1 | 1/2011 | Pizza et al. | |
| 2012/0107339 A1 | 5/2012 | Granoff et al. | |
| 2014/0037668 A1 | 2/2014 | Giuliani et al. | |
| 2014/0363462 A1 | 12/2014 | Arico et al. | |
| 2015/0079124 A1 | 3/2015 | Fraser et al. | |
| 2015/0086582 A1 | 3/2015 | Fraser et al. | |

FOREIGN PATENT DOCUMENTS

| | | | |
|---|---|---|---|
| EP | 1645631 A2 | 4/2006 | |
| EP | 1790660 A2 | 5/2007 | |
| EP | 2351767 A2 | 8/2011 | |
| JP | 01-144977 A | 6/1989 | |
| WO | WO-92/13871 A1 | 8/1992 | |
| WO | WO-94/08013 A1 | 4/1994 | |
| WO | WO-96/01901 A1 | 1/1996 | |
| WO | WO-96/29412 A1 | 9/1996 | |
| WO | WO-96/33276 A1 | 10/1996 | |
| WO | WO-97/37044 A1 | 10/1997 | |
| WO | WO-98/17805 A2 | 4/1998 | |
| WO | WO-99/57280 A | 11/1999 | |
| WO | WO-00/22430 A2 | 4/2000 | |
| WO | WO-00/66791 A1 | 11/2000 | |
| WO | WO-01/31019 A2 | 5/2001 | |
| WO | WO-01/52885 A1 | 7/2001 | |
| WO | WO-01/64920 A | 9/2001 | |
| WO | WO-01/64922 A2 | 9/2001 | |
| WO | WO-03/009869 A1 | 2/2003 | |
| WO | WO-03/020756 A | 3/2003 | |
| WO | WO-03/063766 A2 | 8/2003 | |
| WO | WO-2004/032958 A1 | 4/2004 | |
| WO | WO-2004/048404 A2 | 6/2004 | |
| WO | WO-2004/065603 A2 | 8/2004 | |
| WO | WO-2004/094596 A2 | 11/2004 | |
| WO | WO-2006/024954 A2 | 3/2006 | |
| WO | WO-2006/081259 A2 | 8/2006 | |
| WO | WO-2007/060548 A2 | 5/2007 | |
| WO | WO-2007/127665 A2 | 11/2007 | |
| WO | WO-2008/125985 A2 | 10/2008 | |
| WO | WO-2008/149238 A2 | 12/2008 | |
| WO | WO-2009/104097 A2 | 8/2009 | |
| WO | WO-2010/028859 A1 | 3/2010 | |
| WO | WO-2010/046715 A1 | 4/2010 | |

OTHER PUBLICATIONS

Nov. 17, 1997—NM_shotgun.dbs and Dec. 15, 1997—NM.dbs, located at <ftp://ftp.sanger.ac.uk/pub/pathogens/nm/old data/>.

Adams (1996). "Should Non-Peer-Reviewed Raw DNA Sequence Data Release Be Forced on the Scientific Community?," Science, 274: 534-536.

Aderson et al. (2010). "Effectiveness of a bivalent factor H binding protein vaccine across Neisseria meningitidis serogroups," 17th International Pathogenic Neisseria Conference 2010, p. 196.

Ala'Aldeen et al. (2010) "Human antibody response to the meningococcal factor H binding protein (LP2086) during invasive disease, colonization and carriage," Vaccine 28:7667-75.

Ambrose et al. (2006). "Characterization of LP2086 expression in Neisseria meningitidis," 15th International Pathogenic Neisseria Conference 2006, p. 103.

Anderson et al. (2008). "Functional cross-reactive antibodies are elicited by a group B Neisseria meningitidis bivalent recombinant lipidated LP2086 vaccine in cynomolgusmacaques," 16th International Pathogenic Neisseria Conference (IPNC) P100, pp. 170-171.

Anderson et al. (2009). "Development of a factor H binding protein vaccine for borad protection against invasive Neisseria meningitidis serogroup B (MnB) disease," 10th European Meningococcal Disease Society Congress 2009, p. 39.

Anderson et al. (2009). "Epidemiology of the serogroup B Neisseria meningitidis (MnB) factor H binding protein and implications for vaccine development," European Society for Paediatric Infectious Disease Symposium 2009, p. 505.

Anderson et al. (2012). "Potential impact of the bivalent rLP2086 vaccine on Neisseria meningitidis invasive disease and carriage isolates in two adolescent populations," European Society for Paediatric Infectious Disease Symposium 2012, p. 807.

Anderson et al. (2013) "Potential impact of the bivalent rLP2086 vaccine on Neisseria meningitidis carriage and invasive serogroup B disease," Hum Vacc Immunotherap 9:471-9.

Appendix I to Statement of Grounds of Appeal filed by df-mp on Sep. 28, 2012, in relation to EP1645631, 1 pages.

Appendix II to Statement of Grounds of Appeal filed by df-mp on Sep. 28, 2012, in relation to EP1645631, 2 pages.

Baumler, A. J. and K. Hantke (1992). "A Lipoprotein of Yersinia enterocolitica Facilitates Ferrioxamine Uptake in Escherichia coli," Journal of Bacteriology 174(3): 1029-1035.

Baumler, A. J. et al. (1993). "Hypothetical 29.6 kD Protein in PCP 5' Region (ORF1)," Database Swissprot AC P31485.

Beernick (Jul. 2010) "Impaired immunogenicity of a meningococcal factor H-binding protein vaccine engineered to eliminate factor h binding," Clin Vac Immunol 17(7):1074-1078.

Beernink et al (Jul. 2006). "Rapid Genetic Grouping of Factor H-Binding Protein (Genome-Derived Neisserial Antigen 1870), a Promising Group B Meningococcal Vaccine Candidate," Clinical and Vaccine Immunology 13(7):758-763.

Beernink et al. (Jun. 2008). "Bactericidal antibody responses, induced by meningococcal recombinant chimeric factor H-binding protein vaccines," Infection and Immunity 76(6):2568-2575.

Beernink et al. (Sep. 2008). "Fine antigenic specificity and cooperative bactericidal activity of monoclonal antibodies directed at the meningococcal vaccine candidate factor h-binding protein," Infection and Immunity 76(9):4232-4240.

BenMohamed et al. (2002). "Lipopeptide vaccines—yesterday, today, and tomorrow," Lancet 2(7):425-431.

Bentley et al. (2004). "Identification of two immunologically distinct domains on the LP2086 outer membrane lipoprotein of Neisseria meningitidis," 14th International Pathogenic Neisseria Conference 2004, p. 144.

Bernfield L. et al. (Sep. 2002). "Identification of a novel vaccine candidate for group B Neisseria meningitidis," Thirteenth International Pathogenic Neisseria Conference, Norwegian Institute of Public Health, Oslo, Norway, pp. 116 and 124.

Biswas et al. (1995). "Characterization of IbpA, the structural gene for a lactoferrin receptor in Neisseria gonorrhoeae," Infection and Immunity, 63(8): 2958-2967.

Blake et al. (1995). "Vaccines for Gonorrhoea: Where are We on the Curve?" Trends in Microbiology 3(12):469-474.

Blattner et al. (1997). "The complete genome sequence of Escherichia coli K-12," Science 277 (5331): 1453-1474.

Boslego et al. (1991). "Gonorrhea Vaccines," Chapter 17 in Vaccines and Immunotherapy, Cryz S.J. (Ed.), Pergamon Press: New York, NY, pp. 211-223.

Bouvier et al. (1991). "A gene for a new lipoprotein in the dapA-purC interval of the Escherichia coli chromosome," J Bacteriol 173(17):5523-5531.

Burland, V. et al. (1994). "Escherichia coli K-12 Chromosomal Region From 92.8 to 00.1 Minutes," Database Emprol AC U14003.

(56) References Cited

OTHER PUBLICATIONS

Campbell AM (1984). Monoclonal Antibody Technology. Elsevier Science Publishers, The Netherlands, Chapter 1, pp. 1-32.
Cannon (1989). "Conserved Lipoproteins of Pathogenic *Neisseria* Species Bearing the H.8 Epitope: Lipid-Modified Azurin and H.8 Outer Membrane Protein," Clinical Microbiology Reviews 2(Suppl.):S1-S4.
Cantini et al. (Mar. 2006). "Solution Structure of the Immunodominant Domain of Protective Antigen GNA 1870 of *Neisseria meningitidis*," Journal of Biological Chemistry 281(11): 7220-7227.
Chen, et al. (1994). "Determination of the optimal aligned spacing between the Shine-Dalgarno sequence and the translation initiation codon of *Escherichia coli* mRNAs," Nucleic Acids Res. 22(23):4953-4957.
Clinical Trial No. NCT00500032, (2007). "Blood collection for use in serological assay development from healthy adult volunteers," U.S. National Institutes of Health, retrieved online at <http://clinicaltrials.gov/ct2/show/NCT00500032?term=NCT00500032&rank=1>.
Clinical Trial No. NCT00808028, (2008). "A study evaluating safety and immunogenicity of meningococcal B rlp2086 vaccine in adolescents," U.S. National Institutes of Health, retrieved online at <http://clinicaltrials.gov/ct2/show/NCT00808028?term=NCT00808028&rank=1>.
Cohn et al. (2010). "Potential Impact of Serogroup B Vaccines: Prevalence of candidate vaccine antigens among invasive *Neisseria meningitidis* isolates in the United States," 17th International Pathogenic *Neisseria* Conference 2010, p. 77.
Conlin, C. A. et al. (1992). "*Escherichia coli* prlC Encodes an Endopeptidase and is Homologous to the *Salmonella typhimurium* opdA Gene," Journal of Bacteriology 174(18): 5881-5997.
Cordis, "Preparation of meningococcal antigens," posted online on Feb. 2, 2005, 2 pages.
Cowdery et al., (1996) "Bacterial DNA Induces NK Cells to Produce IFN-y In Vivo and Increases the Toxicity of Lipopolysaccharides," J. Immunol. 156:4570-4575.
Cox et al, "Adjuvants—a classification and review of their modes of action" Vaccine, 1997, 15(3):248-256.
Cruse et al. (2003). Illustrated Dictionary of Immunology, 2$^{nd}$ Ed. CRC Press, pp. 46, 166, and 382.
Database accession No. NMB1994 (cf. XP2231040) (Tettelin et al.), uploaded Oct. 1, 2000.
Database UniProt (Oct. 1, 2000), "SubName: Full=Uncharacterized protein" retrieved from EBI, accession No. Q9JXV4 Database accession No. Q9JXV4.
Davis et al., (1998) "CpG DNA Is a Potent Enhancer of Specific Immunity in Mice Immunized with Recombinant Hepatitis B Surtace Antigen," J. Immunol, 160:870-876.
Decision revoking the European Patent, filed in opposition against EP1976990, dated Nov. 11, 2013, 15 pages.
Decision to refuse a patent application, filed in the Opposition against EP1645631, dated Apr. 28, 2009, 7 pages.
Declaration by Dr. Ellen Murphy, Ph.D., dated Sep. 14, 2011, submitted in opposition proceedings for EP1645631, 4 pages.
Declaration by Dr. Julian Parkhill dated Jun. 12, 2008, submitted in opposition proceedings for EP1645631, 2 pages.
Declaration by Dr. Julian Parkhill, filed in the Opposition against EP1645631, dated Jul. 10, 2014, 5 pages.
Declaration by E. Richard Moxon dated Feb. 16, 2013, submitted in opposition proceedings for EP1645631, 5 pages.
Declaration by Ellen Murphy, filed in the Opposition against EP1645631, dated May 12, 2014, 3 pages.
Declaration by Emilio A. Emini, Ph.D., dated Nov. 2, 2011, submitted in opposition proceedings for EP1645631, 5 pages.
Declaration by Isabel Delany, dated Feb. 18, 2013, submitted in opposition proceedings for EP1645631, 5 pages.
Declaration by Prof. Paul Dunman, Ph.D., dated Sep. 25, 2012, submitted in opposition proceedings for EP1645631, 14 pages.
Declaration by Rino Rappuoli, dated Oct. 13, 2011, submitted in opposition proceedings for EP1645631, 5 pages.
Declaration by Vega Masignani dated Feb. 18, 2013, submitted in opposition proceedings for EP1645631, 4 pages.
Delgado et al. (2007). "Lipoprotein NMB0928 from *Neisseria meningitidis* serogroup B as a novel vaccine candidate," Vaccine 25:8420-8431.
Dempsey J.A. et al. (Nov. 1995). "The physical map of the chromosome of a serogroup A strain of *Neisseria meningitidis* shows complex rearrangement relative to the chromosomes of the two mapped strains of the closely related species *N. gonorrhoeae*," Journal of Bacteriology 177(22):6390-6400.
Dillard, J. P. et al. (1997) "A Peptidoglcan Hydrolase Similar to Bacteriophage Endolysins Acts as an Autolysin in *Neisseria gonorrhoeae*," Molecular Microbiology 25(5): 893-907.
Dinthilhac and Claverys (1997). "The adc locus, which affects competence for genetic transformation in *Streptococcus pneumoniae*, encodes an ABC transporter with a putative lipoprotein homologous to a family of streptococcal adhesins," Res Microbiol 148:119-131.
Dlawer et al. (2010). "Human antibody responses to the meningococcal factor H binding protein LP2086 during invasive disease," 17th International Pathogenic *Neisseria* Conference 2010, p. 130.
Elzanowski et al. (2013). "The Genetic Codes, a compilation," Retrieved from http://www.bioinformatics.org/JaMBW/2/3/TranslationTables.html.
European Examination Report mailed on May 2, 2006 for EP Application No. 99922752.3, filed Apr. 30, 1999, 5 pages.
European Examination Report mailed on Nov. 20, 2006 for EP 05077865.3, filed Apr. 30, 1999, 8 pages.
European Search Report mailed on Mar. 3, 2006 for EP Application No. 05077865.3, filed Apr. 30, 1999, 8 pages.
Experimental data: expression of NspA, '287' and '741' on 3 strains of bacteria, filed in opposition against EP1534326, dated Aug. 4, 2010. 2 pages.
Facts and Submissions dated May 21, 2012, in relation to EP1645631, 30 pages.
Farley J. et al. (Sep. 2002). "Characterization, cloning and expression of different subfamilies of the ORF 2086 gene from *Neisseria meningitidis*," Thirteenth International Pathogenic *Neisseria* Conference, Norwegian Institute of Public Health, Oslo, Norway, p. 124.
Feavers et al. (2009). "Meningococcal protein antigens and vaccines," Vaccine 275:B42-B50.
Fleischmann et al. (1995). "Whole-Genome Random Sequencing and Assembly of *Haemophilus influenzae* Rd," Science 269:496-501.
Fleischmann, R. D. et al. (1995). "Hypothetical Protein HI0753," Database Swissprot AC P44861.
Fleischmann, R. D. et al. (1995). "Oligopeptidase A (EC 3.4.24.70)," Database Swissprot AC P44573.
Fletcher et al. (2004). "Vaccine Potential of the *Neisseria meningitidis* 2086 Lipoprotein," Infection and Immunity 72(4): 2088-2100.
Fontana et al. (2002). A genomic approach Abstract from the 13$^{th}$ International Pathogenic *Neisseria* Conference, Oslo, Norway, Sep. 1-6, 2002. p. 248.
Fraser et al. (1997). "Genomic sequence of a lyme disease spirochaete, *Borrelia burgdorferi*," Nature 390:580-586.
Fraser et al. (1998). "Complete genome sequence of *Treponema pallidum*, the syphilis spirochete," Science 281:375-388.
Gene Browser, Nature Technology Corporation, filed in the Opposition against EP1645631, dated Jun. 26, 2013, 6 pages.
GenPept accession No. AAF42204, "Hypothetical protein NMB1870 [*Neisseria meningitidis* MC58]," retrieved on Sep. 26, 2012, 2 pages.
Giuliani et al. (2006). "A universal vaccine for serogroup B meningococcus," PNAS 103(29):10834-10839.
Giuliani et al. (2010). "Measuring antigen-specific bactericidal responses to a multicomponent vaccine against serogroup B meningococcus," Vaccine 28:5023-5030.
Giuliani et al. (Feb. 2005). "The Region Comprising Amino Acids 100 to 255 of *Neisseria meningitidis* Lipoprotein GNA 1870 Elicits Bactericidal Antibodies," Infection and Immunity 73(2): 1151-1160.

(56) References Cited

OTHER PUBLICATIONS

Gold and Stormo (1987). "Translation Initiation", in *Escherichia* con and *Salmonella typhimurium*, Cellular and Molecular Biology, Ed. Neidhardt, pp. 1302-1307.
Gorringe et al. (2009). "16th International Pathogenic *Neisseria* Conference: recent progress towards effective meningococcal disease vaccines," Human Vaccines 5(2):53-56.
Grandi (2005). "Reverse vaccinology: a critical analysis," in Encyclopedia of Genetics, Genomics, Proteomics and Bioinformatics, pp. 1322-1326.
Granoff, DM. (2009). Relative importance of complement-mediated bactericidal and opsonic activity for protection against meningococcal disease. Vaccine 27(Supplement 2): B117-B125.
Greenspan et al. (1999). "Defining Epitopes: It's Not as Easy as It Seems," Nature Biotechnology 17:936-937.
Hacker, J. et al. (1993). "Immunophilins: structure-function relationship and possible role in microbial pathogenicity," Molecular Microbiology 10(3):445-456.
Harris et al. (2008). "Development and qualification of serum bactericidal assays for *Neisseria meningitidis* serogroup B," 16th International Pathogenic *Neisseria* Conference 2008, p. 268-269.
Harris et al. (2010). "Robustness of the Serum Bactericidal Activity (SBA) Assay for *Neisseria meningitidis* serogroup B," 17th International Pathogenic *Neisseria* Conference 2010, p. 169.
Harris et al. (2011) "Preclinical evidence for the potential of a bivalent fHBP vaccine to prevent *Neisseria meningitidis* serogroup C disease," Human Vaccines 7:1 (suppl) 1-7.
Hayashi and Wu, "Identification and characterization of lipid-modified proteins in bacteria," Chapter 10 in Lipid Modifications of Proteins: A Practical Approach, Hooper and Turner (eds.), published in 1992, 27 pages.
Hem et al. (1995). "Structure and properties of aluminum-containing adjuvants," Vaccine Design. Subunit and Juncture Approach, pp. 249-276.
Hodge et al. (2006). "Development of a luminex-based meningococcal rLP2086-specific human IgG assay," 15th International Pathogenic *Neisseria* Conference 2006, p. 113.
Hoiseth et al. (2008). "LP2086 and MLST distribution in epidemiologically relevant strains of serogroup B *Neisseria meningitidis*," 16th International Pathogenic *Neisseria* Conference 2008, p. 205.
Holst et al. (2014). "Variability of genes encoding surface proteins used as vaccine antigens in meningococcal endemic and epidemic strain panels from Norway," Vaccine 32:2722-2731.
Hou et al. (2005) "Protective antibody responses elicited by a meningococcal outer membrane vesicle vaccine with overexpressed genome-derived neisserial antigen 1870," J Infect Dis 192(4):580-90.
Houghten et al. (1986) New Approaches to Immunization, Vaccines 86, Cold Spring Harbor Laboratory, p. 21-25.
Huang, M. et al. (1995). "A Stomatin-Like Protein Necessary for Mechanosensation in *C. elegans*," Nature 378(6554):292-295.
Hung et al. (2011). "The *Neisseria meningitidis* macrophage infectivity potentiator protein induces cross-strain serum bactericidal sctivity and is a potential serogroup B vaccine candidate," Infect Immun 79(9):3784-3791.
Interlocutory decision in opposition proceedings, filed in the Opposition against EP1645631, dated May 21, 2012, 82 pages.
International Preliminary Examination Report mailed on Oct. 2, 2000 for PCT Application No. PCT/US99/09346 filed on Apr. 30, 1999, 11 pages.
International Search Report mailed on Jun. 15, 2000 for PCT Application No. PCT/US99/09346 filed on Apr. 30, 1999, 14 pages.
Jacobsson et al. (2009). "Prevalence and sequence variations of the genes encoding the five antigens included in the novel 5CVMB vaccine covering group B meningococcal disease" Vaccine. 27:1579-1584.
Jansen et al. (2008). "Bivalent recombinant LP2086 vaccine to provide broad protection against *Neisseria meningitidis* B disease: immunological correlates of protection and how to assess coverage against invasive MnB strains," 16th International Pathogenic *Neisseria* Conference 2008, p. 80-81.

Jansen et al. (2009). "Development of a bivalent factor H binding protein vaccine to broadly protect against invasive *Neisseria meningitides* serogroup B (MnB) disease," European Society for Paediatric Infectious Disease Symposium 2009, p. 311.
Jansen et al. (2010). "Estimating effectiveness for *Neisseria meningitidis* serogroup B (MnB) vaccine candidates composed of non-serogroup specific antigens," 17th International Pathogenic *Neisseria* Conference 2010, p. 37.
Jansen et al. (2011). "Monitoring the Breadth of Coverage of Meningococcal Vaccines: An Overview and Progress Update on the Pfizer Bivalent LP2086 Vaccine Program," 14th Annual Conference on Vaccine Research, 2011, p. 74.
JCVI-CMR website showing Z2491 Sanger sequence (http://cmr.jcvi.org/tigr-scripts/CMR/shared/Genomes.cgi and links). (2010).
Jiang et al. (2003). "Using rate of acid neutralization to characterize aluminum phosphate adjuvant," Pharma Dev Tech 8(4):349-356.
Jiang et al. (2006). "Serum IgG response induced by a bivalent recombinant LP2086 provides broad protection against serogroup B *Neisseria meningitidis*," 15th International Pathogenic *Neisseria* Conference 2006, p. 113.
Jiang et al. (2008). "Prediction of broad vaccine coverage for a bivalent rLP2086 based vaccine which elicits serum bactericidal activity against a diverse collection of serogroup B meningococci," 16th International Pathogenic *Neisseria* Conference 2008, p. 57-58.
Jiang et al., (2010) "Broad vaccine coverage predicted for a bivalent recombinant factor H binding protein based vaccine to prevent serogroup B meningococcal disease" Vaccine 28:6086-6093.
Johnson et al. (1999). "Analysis of the human Ig isotype response to lactoferrin binding protein A from *Neisseria meningitidis*," FEMS Immun. Med. Microbial. 25(4): 349-354.
Jones et al. (2009). "Generation of human serum complement lots that perform consistently for use in *Neisseria meningitidis* serogroup B (MnB) vaccine clinical trials," European Society for Paediatric Infectious Disease Symposium 2009, p. 566.
Juncker et al. (2003). "Prediction of lipoprotein signal peptides in gram-negative bacteria," Protein Sci 12:1652-1662.
Koeberling et al. (2007). "Improved immunogenicity of a H44/76 group B outer membrane vesicle vaccine with over-expressed genome-derived Neisserial antigen 1870," Vaccine 25(10):1912-1920.
Koeberling et al. (2008). "Bactericidal antibody responses elicited by a meningococcal outer membrane vesicle vaccine with overexpressed factor H-binding protein and genetically attenuated endotoxin," J. Infect. Dis., 198(2):262-270.
Koeberling et al. (2009). "Meningococcal outer membrane vesicle vaccines derived from mutant strains engineered to express factor H binding proteins from antigenic variant groups 1 and 2," Clin Vac Immunol, 16(2):156-162.
Kohara Y. (Aug. 12, 1994). "*Caenorhabditis elegans* cDNA clone yk26f2: 5' end, single read," Database accession No. D35881. Database EMBL [Online] EBI.
Kovacs-Simon et al. (2011). "Lipoproteins of Bacterial Pathogens," Infect Immun 79(2):548-561.
Lawrence, E. (1997). *Henderson's Dictionary of Biological Terms*, Eleventh Edition (1997). Longman Ltd. Defintion of "epitope," Cover pages, Table of Contents, and pp. 37 and 184.
Lewis et al. (2010). "The meningococcal vaccine candidate neisserial surface protein A (NspA) binds to factor H and enhances meningococcal resistance to complement," PLoS Pathogens 6(7):e1001027.
Liebl et al. (1997). "Properties and gene structure of the *Thermotoga maritima* alpha-amylase AmyA, a putative lipoprotein of a hyperthermophilic bacterium," J Bacteriol 179(3):941-948.
Liechti et al. (2012). "Outer membrane biogenesis in *Escherichia coli*, *Neisseria meningitidis*, and *Helicobacter pylori*: paradigm deviations in *H. pylori*," Front Cell and Infect Microbiol 2:article 29.
Lindblad, (2004). "Aluminium compounds for use in vaccines," Immunol Cell Biol.,82(5):497-505.
Lommatzsch et al. (1997). "Outer membrane localization of murine hydrolases: MltA, a third lipoprotein lytic transglycosylase in *Escherichia coli*," Journal of Bacteriology 179(17):5465-5470.
Lucidarme et al., (Sep. 16, 2009) "Characterization of fHbp, nhba (gna2132), nadA, porA, sequence type (ST), and genomic presence

(56) References Cited

OTHER PUBLICATIONS of IS1301 in group B meningococcal ST269 clonal complex isolates from England and Wales" Journal of Clinical Microbiology, 47(11):3577-85.

Lucidarme et al., 2010 "Characterization of fHbp, nhba (gna2132), nadA, porA, and sequence type in group B meningococcal case isolates collected in England and Wales during Jan. 2008 and potential coverage of an investigational group B meningococcal vaccine" Clinical and Vaccine Immunology 17(6):919-929.

Madico et al. (2006). "The meningococcal vaccine candidate GNA1870 binds the complement regulatory protein factor H and enhances serum resistance," J Immunol 177(1):501-510.

Cole et al. (1998). "Deciphering the biology of *Mycobacterium tuberculosis* from the complete genome sequence," Nature 394:651-653.

Malorny et al. (1998). "Sequence Diversity, Predicted Two-Dimensional Protein Structure, and Epitope Mapping of Neisserial Opa Proteins," J. Bacteriol, 180 (5):1323-1330.

Marshall et al. (2008). "A randomized, placebo-controlled, double-blind, phase 1 trial of ascending doses of meningococcal group B rLP2086 vaccine in healthy adults," 16th International Pathogenic *Neisseria* Conference 2008, p. 271-272.

Marshall et al. (2011). "Phase I randomised controlled clinical trial of safety and immunogenicity of a meningococcal B bivalent LP2086 vaccine in healthy toddlers," European Society for Paediatric Infectious Disease Symposium 2011, p. 189.

Marshall et al. (2012) "Safety and immunogenicity of a meningococcal B bivalent rLP2086 vaccine in healthy toddlers aged 18-36 months: A phase 1 randomized-controlled clinical trial," Ped Infect Dis J 31:1061-8.

Marshall et al. (2013) "A phase 2 open-label safety and immunogenicity study of a meningococcal B bivalent rLP2086 vaccine in healthy adults," Vaccine 31:1569-75.

Mascioni et al. (2008). "Determination of the domain and solution structure of rLP2086, a meningococcal vaccine candidate and human factor H binding protein," 16th International Pathogenic *Neisseria* Conference 2008, p. 77-78.

Mascioni et al. (2009) "Structural basis for the immunogenic properties of the meningococcal vaccine candidate LP2086," J Biol Chem 284:8738-46.

Mascioni et al. (2010) "NMR dynamics and antibody recognition of the meningococcal lipidated outer membrane protein LP2086 in micellar solution," Biochim Biophys Acta 1798:87-93.

Masignani V. (Mar. 17. 2003). "Vaccination against *Neisseria meningitidis* using three variants of the lipoprotein GNA1870," J. Exp. Med. 197(6):789-799.

McAllister, C. F. and D. S. Stephens. (1993). "Analysis in *Neisseria meningitidis* and other *Neisseria* species of genes homologous to the FKBP immunophilin family," Molecular Microbiology 10(1)13-23.

McAllister, C. F. et al. (1993). "*Neisseria elongata* NRL FKBP Immunophilin Homolog Gene," Database Empro2 AC U001198.

McGuinness et al. (Mar. 1991). "Point mutation in meningococcal porA gene associated with increased endemic disease," Lancet 337:514-517.

McNeil et al. (2009) "Detection of LP2086 on the cell surface of *Neisseria meningitidis* and its accessibility in the presence of serogroup B capsular polysaccharide," Vaccine 27:3417-21.

McNeil et al. (2010). "Anti-fHBP antibodies elicited after immunization with a recombinant fHBP vaccine candidate (rLP2086) can displace human Factor H from the surface of Serogroup B Meningococci," 17th International Pathogenic *Neisseria* Conference 2010, p. 94.

McNeil et al. (2013) "Role of factor H binding protein in *Neisseria meningitidis* virulence and its potential as a vaccine candidate to broadly protect against meningococcal disease," Microbiol Mol Biol Rev 77:234.

Meyer et al. (1984). "Pilus genes of *Neisseria gonorrheae*: Chromosomal organization and DNA sequence," Proc. Nail. Acad. Sci. USA 81: 6110-6114.

Milagres et al. (1998). "Specificity of bactericidal antibody response to serogroup B meningococcal strains in Brazilian children after immunization with an outer membrane vaccine," Infection and Immun. 66(10): 4755-4781.

Minutes of the oral proceedings, filed in the Opposition against EP1645631, dated Feb. 11, 2014, 4 pages.

Morley, S. et al. (Dec. 12, 2001). "Vaccine prevention of meningococcal disease, coming soon?" Vaccine 20(5-6):666-687.

Munkley, et al. (1991). "Blocking of bactericidal killing of *Neisseria meningitidis* by antibodies directed against slacc 4 outer membrane proteins," Microbial Pathogenesis 11: 447-452.

Murphy et al. (2008). "Sequence diversity of vaccine candidate LP2086 in *Neisseria meningitidis* serogroup B strains causing invasive disease," 16th International Pathogenic *Neisseria* Conference 2008, p. 61.

Murphy et al. (2010). "Prevalence of Factor H Binding Protein (fHBP) Variants in *N. meningitidis* Carriage Isolates," 17th International Pathogenic *Neisseria* Conference 2010, p. 96.

Murphy et al., (2009) "Sequence diversity of the factor H binding protein vaccine candidate in epidemiologically relevant strains of serogroup B *Neisseria meningitidis*" J Infect Dis 200:379-389.

Nassif (2000). "A Furtive Pathogen Revealed," Science 287:1767-1768.

Notice of Opposition against EP 1562983, filed on Jul. 1, 2014, 23 pages.

Notice of Opposition against EP1645631, filed in the Opposition against EP1645631, dated Jul. 23, 2008, 25 pages.

Notice of Opposition against European Patent EP 1645631, granted on Oct. 24, 2007. Opposition filed on Jul. 23, 2008. 20 pages.

Notice of Opposition filed May 24, 2012, filed in opposition against EP1976990, 19 pages.

Novartis (Jan. 22, 2013) "Novartis receives EU approval for Bexsero®, first vaccine to prevent the leading cause of life-threatening meningitis across Europe," Media Release, 3 pages.

Novartis (Jun. 9, 2011). "Novartis candidate vaccine Bexsero® shows significant potential in providing broad coverage against meningococcal serogroup B infections." Media Release, 6 pages.

Novartis (Oct. 9, 2008) "New Phase II data show Novartis investigational Meningitis B vaccine may also protect infants six months and older," Media Release, 4 pages.

Opponent's Further Submission in Preparation of the Oral Proceedings, filed in the Opposition against EP1645631, dated Nov. 3, 2011, 6 pages.

Opponent's Response to the Patentee's Submission dated Feb. 18, 2013, filed in the Opposition against EP1645631, dated Jul. 24 2014, 34 pages.

Opponents Final Written Submission in Preparation of Oral Proceedings, filed in the Opposition against EP1645631, dated Sep. 14, 2011, 28 pages.

ORF Finder (2013). "Bacterial Code," Retrieved from http://www.ncbi.nlm.nih.gov/gorf/gorf.html, 3 pages.

Pajon et al. (2010). "Frequency of factor H-binding protein modular groups and susceptibility to cross-reactive bactericidal activity in invasive meningococcal isolates" Vaccine 28:2122-2129.

Pajon et al. (2012). "Design of meningococcal factor H binding protein mutant vaccines that do not bind human complement factor H," Infect Immun 80:2667-2677.

Parkhill, "*Campylobacter jejuni* genome sequence at the Sanger Centre," Post on BIOSCI/Bionet of May 8, 1998.

Parkhill, J. et al. (Mar. 2000). "Complete DNA Sequence of a Serogroup A Strain of *Neisseria meningitides* Z2491," Nature 404 (6777):502-506.

Patentee's Submissions under Rule 116 EPC, filed in the Opposition against EP1645631, dated Sep. 13, 2011, 13 pages.

Patentees' Response to Opposition against European Patent EP 1645631, granted on Oct. 24, 2007. 13 pages.

Pettersson, et al. (2006). "Vaccine potential of the *Neisseria meningitidis* lactoferrin-binding proteins LbpA and LbpB," Vaccine 24(17):3545-3557.

Pillai et al. (2005) "Outer membrane protein (OMP) based vaccine for *Neisseria meningitidis* serogroup B," Vaccine 23(17-18):2206-2209.

(56) References Cited

OTHER PUBLICATIONS

Pizza et al. (2000). "Identification of Vaccine Candidates Against Serogroup B Meningococcus by Whole-Genome Sequencing," Science 287(5459):1816-1820.
Pizza et al. (2008) "Factor H-binding protein, a unique meningococcal vaccine antigen" Vaccine 26S:I46-8.
Poolman. (1995). "Development of a Meningococcal Vaccine," Infectious Agents and Disease 4:13-28.
Progress through the Sanger Institute FTP server (May 12, 2009), 15 pages.
Prosite, "ScanProsite Results Viewer: USERSEQ1 (280aa)," retrieved on Jun. 21, 2012, 1 page.
PSORT analysis of 200 of the sequences disclosed in PCT/US99/09346 (Jan. 1, 2010), 209 pages.
PSORT analysis of Seq ID Nos. 4 and 6, and of 'Contig295' 300mer (May 8, 2009), 5 pages.
PSORT prediction result for Seq ID No. 2 (Mar. 30, 2010), 1 page.
Pugsley (1993). "The complete general secretory pathway in gram-negative bacteria," Microbiological Rev 5(1):50-108.
Response to Appeal filed by Carpmaels & Ransford on Feb. 18, 2013, in relation to EP1645631, 21 pages.
Response to Appeal filed by df-mp on Feb. 18, 2013, in relation to EP1645631, 28 pages.
Response to Communication, filed in EP Application No. 07075161.5. Oct. 28, 2009.
Response to United States Office Action, filed on Oct. 28, 2014, for U.S. Appl. No. 13/359,442, filed Jan. 26, 2012, 15 pages.
Richard, M.E. (Oct. 25, 1997). "Applications of molecular microbiology to vaccinology," Lancet (North American Edition) 350(9086): 1240-1244.
Richmond et al. (2008). "A randomized, observer-blinded, active control, phase 1 trial of meningococcal serogroup B rLP2086 vaccine in healthy children and adolescents aged 8 to 14 years," 16th International Pathogenic *Neisseria* Conference 2008, p. 270-271.
Richmond et al. (2010). "Safety & immunogenicity of serogroup B *Neisseria meningitidis* (MnB) rLP2086 vaccine in adults and adolescent subjects: overview of 3 clinical trials," 17th International Pathogenic *Neisseria* Conference 2010, p. 37.
Richmond et al. (2011). "Phase II randomised controlled trial of safety and immunogenicity of a meningococcal B bivalent vaccine (rLP2086) in healthy adolescents," European Society for Paediatric Infectious Disease Symposium 2011, p. 192.
Richmond et al. (2012) "A bivalent *Neisseria meningitidis* recombinant lipidated factor H binding protein vaccine in young adults: Results of a randomized, controlled, dose-escalation phase 1 trial," Vaccine 30(43):6163-74.
Richmond et al. (2012a) "Safety, immunogenicity, and tolerability of meningococcal serogroup B bivalent recombinant lipoprotein 2086 vaccine in healthy adolescents: a randomized, single-blind, placebo-controlled, phase 2 trial," Lancet Infect Dis 12:597-607.
Rinaudo et al. (2009). "Vaccinology in the genome era", The Journal of Clinical Investigation, 119(9):2515-2525.
Rudinger et al. (Jun. 1976). Peptide Hormones. (Ed) JA Parsons, University Park Press. pp. 5-7.
Sambrook et al. (1989). *Molecular Cloning, A Laboratory Manual*. Second Edition, Cold Spring Harbor, pp. 17.1-17.44.
Sampson, B. and E. C. Gotschlich. (1992). "*Neisseria meningitidis* encodes an FK506-inhibitable rotamase," Proc. Natl. Acad. Sci. USA 89(4): 1164-1168.
Sanger Centre's "Projects" website as of Dec. 10, 1997 as retrievable via http://web.archive.org.
Scarselli et al. (Feb. 13, 2009). "Epitope Mapping of a Bactericidal Monoclonal Antibody against the Factor H Binding Protein of *Neisseria meningitides*," Journal of Molecular Biology 386(1):97-108.
Schneider et al. (Apr. 16, 2009) "*Neisseria meningitidis* recruits factor H using protein mimicry of host carbohydrates," Nature 458(7240):890-893.
Seeber et al. (1991). "Predicting the adsorption of proteins by aluminum-containing adjuvants," Vaccine 9(3):201-203.

Seib et al. (2010). "Influence of serogroup B meningococcal vaccine antigens on growth and survival of the mengococcus in vitro and in ex vivo and in vivo models of infection," Vaccine 28(12):2416-2427.
Seib et al. (2011). "Characterization of Diverse Subvariants of the Meningococcal Factor H (fH) Binding Protein for Their Ability to Bind fH, to Mediate Serum Resistance, and to Induce Bactericidal Antibodies," Infect Immun, 79(2):970-81.
Sequence for "Putative Lipoprotein [*Neisseria meningitidis*Z2491]," NCBI Reference Sequence: YP_002342062.1, Mar. 30, 2000.
Serruto et al. (2009). "Genome-based approaches to develop vaccines against bacterial pathogens," Vaccine 27:3245-3250.
Sheldon et al. (2011). "Phase 1, Randomized, Open-Label, Study to Assess the Safety and Immunogenicity of Serogroup B *Neisseria meningitidis* (Mnb) rLP2086 Vaccine in Healthy Adults," 14th Annual Conference on Vaccine Research, 2011, p. 59-60.
Sheldon et al. (2012) "A phase 1, randomized, open-label, active-controlled trial to assess the safety of a meningococcal serogroup B bivalent rLP2086 vaccine in healthy adults," Hum Vacc Immunotherap 8:1-8.
Shevchik et al. (1996). "Characterization of pectin methylesterase B, an outer membrane lipoprotein of *Erwinia chrysanthemi* 3937," Mole Microbiol 19(3):455-466.
Skolnick et al. "From genes to protein structure and function: novel applications of computational approaches in the genomic era." Trends in Biotechnology 18:34-39, 2000.
Smith C.J. et al. (1995). "Nucleotide sequence determination and genetic analysis of the *Bacteroides plasmid*, pBI143," Plasmid 34(3):211-222.
Sprengart et al. (1997). "Functional importance of RNA interactions in selection of translation initiation codons," Molecular Microbilogy, 24(1): 19-28.
Statement of Grounds of Appeal filed by Carpmaels & Ransford on Oct. 4, 2012, in relation to EP1645631, 9 pages.
Statement of Grounds of Appeal filed by df-mp on Sep. 28, 2012, in relation to EP1645631, 54 pages.
Submission of the Patentee of Jul. 6, 2012, filed Jun. 24, 2014, in the Opposition against EP1645631, 4 pages.
Summons to oral proceedings pursuant to Rule 115(1) EPC, filed in the Opposition against EP1645631, dated Nov. 11, 2013, 12 pages.
Supplemental Submissions in Opposition against European Patent EP 1645631, granted on Oct. 24, 2007. Opposition filed on May 25, 2010. 28 pages.
Supplementary Declaration by Dr. Julian Parkhill, dated May 10, 2010, submitted in opposition proceedings for EP1645631, 4 pages.
Supplementary declaration by Ellen Murphy dated Sep. 26, 2012, submitted in opposition proceedings for EP1645631, 3 pages.
Supplementary declaration by Prof. Paul Dunman, Ph.D., dated Sep. 25, 2012, submitted in opposition proceedings for EP1645631, 14 pages.
Supplementary Submission to the Grounds of Appeal, filed in the Opposition against EP1645631, dated Sep. 28, 2012, 2 pages.
Sutcliffe and Russell (1995). "Lipoproteins of gram-positive bacteria," J Bacteriol 177(5):1123-1128.
Swaminathan (1996). "Molecular cloning of the three base restriction endonuclease R.CviJI from eukaryotic *Chlorella* virus IL-3A," Nucleic Acids Research, 24(13): 2463-2469.
Tan et al. (2010). "Advances in the development of vaccines against *Neisseria meningitidis*," NEJM 362(16):1511-1520.
Teerlink et al. (1987). "Antigenic and Immunogenic Properties of Cyanogen Bromide Peptides from Gonococcal Outer Membrane Protein Ib," J. Exp. Med. 166: 63-76.
Telford et al. (2003). "Genomic and Proteomics in Vaccine Design", in *New Bacterial Vaccines*, edited by Ellis et al. Kleweur Academic/Plenum Publishers, USA. pp. 1-11.
Tettelin et al. (Mar. 10, 2000). "Complete Genome Sequence of *Neisseria meningitidis* Serogroup B Strain MC58," Science 287(5459):1809-1815.
The printed output from the NCBI open reading frame finder (Oct. 20, 2008), 12 pages.
TIGR Microbal Database, filed in the Opposition against EP1645631, dated Jun. 20, 2012, 14 pages.
TIGR website as of 1998, 8 pages.

(56) References Cited

OTHER PUBLICATIONS

United States Office Action mailed on Feb. 11, 2009, for U.S. Appl. No. 10/181,600, filed Jan. 17, 2001, 5 pages.
United States Office Action mailed on Jul. 24, 2008, for U.S. Appl. No. 10/181,600, filed Jan. 17, 2001, 23 pages.
United States Office Action mailed on Jul. 7, 2009, for U.S. Appl. No. 10/181,600, filed Jan. 17, 2001, 23 pages.
United States Office Action, mailed on Jul. 28, 2014, for U.S. Appl. No. 13/359,442, filed Jan. 26, 2012, 14 pages.
U.S. Appl. No. 60/098,685, "*Neisseria* Spp, Polypeptide, Gene Sequence and Uses Thereof," filed Sep. 1, 1998.
U.S. Appl. No. 60/647,911, "GNA 1870-based vesicle vaccines for broad spectrum protection against diseases caused by *Neisseria meningitidis*," filed Jan. 27, 2005.
Vesikari et al. (2013). "Immunogenicity and safety of an investigational multicomponent, recombinant, meningococcal serogroup B vaccine (4CMenB) administered concomitantly with routine infant and child vaccinations: results of two randomized trials," Lancet 381:625-35.
von Heijne (1989). "The structure of signal peptides from bacterial lipoproteins," Protein Engineering 2(7):531-534.
Voulhoux and Tommassen (2002). "Transport of lipoproteins to the cell surfac in *Neisseria meningitidis*," 13th International Pathogenic *Neisseria* Conference 2002, p. 31.
Wang et al. (2010). "Prevalence and genetic diversity of candidate vaccine antigens among invasive *Neisseria meningitidis* isolates in the United States," 17th International Pathogenic *Neisseria* Conference 2010, p. 122.
Welsch et al. (2004). "Protective Activity of Monclonal Antibodies to Genome-Derived Neisserial Antigen 1870, a *Neisseria meningitidis* Candidate Vaccine," *The Journal of Immunology* 172: 5606-5615.
Welsch et al. (2007) "A novel mechanism for complement-mediated killing of encapsulated *Neisseria meningitidis* elicited by monoclonal antibodies to factor H-binding protein (genome-derived *Neisserial* antigen 1870)" Molecular Immunology 44(1-3):256.
Welsch et al. (Apr. 1, 2008). "Complement-dependent synergistic bactericidal activity of antibodies against factor H-binding protein, a sparsely distributed meningococcal vaccine antigen," J Infect Dis 197(7):1053-1061.
Wong, C. Y. et al. (1997). "Cloning and characterization of two immunophilin-like genes, ilpA and fkpA, on a single 3.9-kilobase fragment of *Aeromonas hydrophila* genomic DNA," Journal of Bacteriology 179(11): 3397-3403.
Woods, et al. (1987). "Resistance to meningococcemia apparently conferred by anti-H.8 monoclonal antibody is due to contaminating endotoxin and not to specific immunoprotection," Infection and Immunity 55(8):1927-1928.
Written Submission to Oral Proceedings, filed in opposition against EP1976990, dated Jul. 24, 2013, 11 pages.
Wu et al. (1996). "A protein class database organized with ProSite protein groups and PIR superfamilies," J Comp Biol 3(4):547-561.
York et al. (2010). "fHBP epidemiology of invasive meningococcal B isolates from Spain and Germany: age based," 17th International Pathogenic *Neisseria* Conference 2010, p. 109.
You, Z. et al. (1997). "*Rhizobium etli* Stomatin like Protein (slp) gene, complete cds," Database Emprol AC AF034831.
You, Z. et al. (1998). "A Stomatin-Like Protein Encoded by the slp Gene of *Rhizobium etli* is Required for Nodulation Competitiveness on the Common Bean," Microbiology 144(9): 2619-2627.
Zhu et al. (2004). "Evaluation of the purified recombinant lipidated P2086 protein as a vaccine candidate for group B *Neisseria meningitidis* in a murine nasal challenge model," 14th International Pathogenic *Neisseria* Conference 2004, p. 199.
Zhu et al. (2005) "Evaluation of recombinant lipidated P2086 protein as a vaccine candidate for group B *Neisseria meningitidis* in a murine nasal challenge model," Infect Immun 73(10):6838-45.
Zhu et al. (2006) "Intranasal immunization of mice with recombinant lipidated P2086 protein reduces nasal colonization of group B *Neisseria meningitidis*," Vaccine 24:5420-5.
Zhu et al. (2006). "Effective immunization strategy against group B *Neisseria meningitidis* using purified recombinant lipidated P2086 protein," 15th International Pathogenic *Neisseria* Conference 2006, p. 47.
Zlotnick et al. (2009). "Epidemiology of the serogroup B *Neisseria meningitidis* (MnB) factor H binding protein in strains sampled from Spain and Germany in the years 2001-2006," 10th European Meningococcal Disease Society Congress 2009, p. 81.
Zlotnick et al. (2010). "Biochemical and biophysical analysis indicates conformation plays an important role in the binding of hfH and antibodies to the fHBP of *N. meningitidis*," 17th International Pathogenic *Neisseria* Conference 2010, p. 38.
Zollinger (1997). "New and Improved Vaccines Against Meningococcal Disease" in *New Generation Vaccines*, 2nd Ed., edited by Levine et al., Marcel Dekker, New York. pp. 469-488.
Zollinger et al. (2010). "Design and evaluation in mice of a broadly protective meningococcal group B native outer membrane vesicle vaccine," Vaccine, 28(31):5057-5067.
Alignment of SEQ ID No.: 19 of EP2327719 against SEQ ID Nos.: 92, 94, 96, 98, 100, 102, 104, 106, and 108 of WO/2003/063766, filed in opposition against EP2327719, submitted May 20, 2015, 9 pages.
Alignment of SEQ ID No.: 42 of EP2258716 against SEQ ID No.: 41 of EP2258716, filed in opposition against EP2258716, submitted Apr. 16, 2015, 1 page.
Alignment of SEQ ID No.: 42 of EP2258716 against SEQ ID Nos.: 50, 52, 54, 56, 58, 60, 62, 64, 66, 68, 70, and 72 of WO/2003/063766, filed in opposition against EP2258716, submitted Apr. 16, 2015, 12 pages.
Beernink et al. (2011). "A meningococcal factor H binding protein mutant that eliminates factor H binding enhances protective antibody responses to vaccination," J Immunol, 186(6):3606-14.
Brendish and Read. (2015). "Neisseria meningitidis serogroup B bivalent factor H binding protein vaccine," Expert Rev. Vaccines, 14(4):493-503.
CECMED (Dec. 2, 2011), "Resumen de las Caracteristicas del Producto: VA-MENGOC-BC," Ministerio de Salud Publica de Cuba, 4 pages. (3 page English translation included).
de Moraes JC, et al. (1992). Protective efficacy of a serogroup B meningococcal vaccine in Sao Paulo, Brazil. Lancet 340: 1074-1078.
Debbag et al. (1994). "Evaluacion de las reacciones adversas asociadas con la vacuna antimeningococcica BC. Informe perliminar sobre 8,117 vacunados." Rev Hosp Ninos BAires, No. 158/159, 6 pages. (6 page English translation included).
Experimental Report, Submitted on Mar. 23, 2015, filed in relation to EP2411048, 2 pages.
Galeano et al. (1995). "Efectividad de una vacuna antimeningococcica en una cohorte de itagui, Colombia, 1995," Epidemiologico de Antioquia 20(2), 8 pages. (9 page English translation included).
Gil et al. (2009). "Proteomic study via a non-gel based approach of meningococcal outer membrane vesicle vaccine obtained from strain CU385," Humman Vaccines 5(5):347-356.
International Preliminary Report on Patentability mailed Jan. 13, 2012, for PCT/IB2010/002260, 10 pages.
International Search Report mailed Apr. 13, 2011, for PCT/IB2010/002260, 7 pages.
Notice of opposition, filed in opposition against EP2258716, dated Apr. 16, 2015, 12 pages.
Notice of opposition, filed in opposition against EP2327719, dated May 20, 2015, 14 pages.
Novartis internal data, filed in relation to EP1902726, submitted on Apr. 13, 2015, 1 page.
Ochoa, Rolando (2008). "Main projects on research, development and manufacturing of human vaccines," excerpt from presentation at BioQatar Symposium 2008, 4 slides.
Patentee's response to notice of opposition, filed in opposition against EP1562983, dated Feb. 16, 2015, 9 pages.
Perez et al. (2010). "Community acquired bacterial meningitis in Cuba: a follow up of a decade," BMC Infectious Diseases 10:130, 9 pages.
Rodriguez et al. (1999). "The epidemiological impact of antimeningococal B vaccination in Cuba," Mem Inst Oswaldo Cruz 94(4):433-440.

(56) References Cited

OTHER PUBLICATIONS

Sierra GV, et al. (1991). Vaccine against group B Neisseria meningitidis: protection trial and mass vaccination results in Cuba. NIPH Ann 14: 195-207.

Statement of Grounds of Appeal, dated Mar. 23, 2015, filed in relation to EP2411048, 8 pages.

Statement of grounds of appeal, filed in relation to EP1902726, dated Apr. 13, 2015, 9 pages.

Submission in opposition proceedings by Carpmaels and Ransford filed in EP1737486 on Jun. 12, 2015, 2 pages.

Submission in opposition proceedings by Pfizer Inc. filed against EP1737486 on Jun. 12, 2015, 7 pages.

UniProt accession No. C0JF81, Murphy et al., Last modified on May 5, 2009. 4 pages.

U.S. Appl. No. 60/328,101, "Novel immunogenic compositions for the prevention and treatment of meningococcal disease," filed Oct. 11, 2001. 253 pages.

U.S. Appl. No. 60/406,934, "Novel immunogenic compositions for the prevention and treatment of meningococcal disease," filed Aug. 30, 2002. 190 pages.

Zollinger et al. (1983). "Importance of complement source in bactericidal activity of human antibody and murine monoclonal antibody to meningococcal group B polysaccharide," Infect Immun, 40(1):257-64.

Claimant's Amended Grounds of Invalidity under CPR 17.1 (2)(a) on Jul. 16, 2015, in respect of European Patent (UK) No. 2,343,308. In the High Court of Justice Chancery Division Patents Court, between GlaxoSmithKline UK Limited and Wyeth Holdings LLC. 9 pages.

919 (46 kDa)
Purification
M1 919

919 (46 kDa)
Expression
M1 919

919 (46 kDa)
Western Blot
OMV  TP  PP 919 (46 kDa)
FACS 919 (46 kDa)
Bactericidal Assay
- Preimmune
- GST
- 919

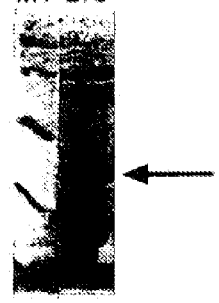
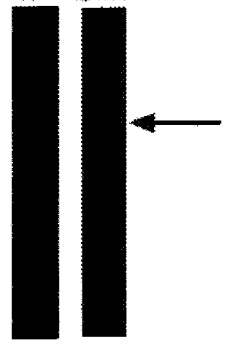
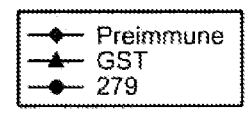
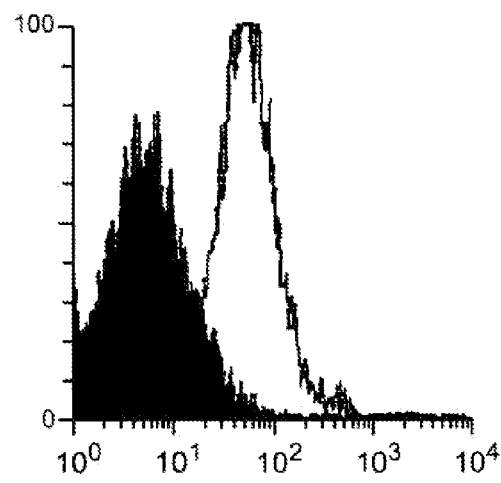
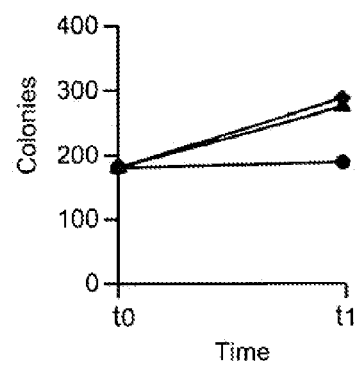
FIG. 2A 279 (10.5 kDa) Purification M1 279
FIG. 2B 279 (10.5 kDa) Western Blot TP OMV
FIG. 2C 279 (10.5 kDa) FACS
FIG. 2D 279 (10.5 kDa) Bactericidal Assay
Preimmune
GST
279

576 (27.8 kDa)
Purification
M1 576

576 (27.8 kDa)
Western Blot
TP  OMV 576 (27.8 kDa)
FACS 576 (27.8 kDa)
Bactericidal Assay
- Preimmune
- GST
- 576

519 (33 kDa)
Purification
M1  519

519 (33 kDa)
Western Blot
TP  OMV 519 (33 kDa)
FACS 519 (33 kDa)
Bactericidal Assay 121 (40 kDa)
Purification
M1  121

121 (40 kDa)
Western Blot
TP    OMV 121 (40 kDa)
FACS 121 (40 kDa)
Bactericidal Assay 128 (101 kDa)
Purification
M1  128

128 (101 kDa)
Western Blot
TP OMV 128 (101 kDa)
FACS 128 (101 kDa)
Bactericidal Assay 206 (17 kDa)
Purification 206 (17 kDa)
Western Blot
TP OMV 206 (17 kDa)
FACS 206 (17 kDa)
Bactericidal Assay 287 (78 kDa)
Purification 287 (78 kDa)
FACS 287 (78 kDa)
Bactericidal Assay 406 (33 kDa)
Purification 406 (33 kDa)
Western Blot 406 (33 kDa)
FACS 406 (33 kDa)
Bactericidal Assay

```
zo05_225   1  MDSFFKPAVWAVLWLMFAVRPALADELTNLLSSREQILRQFAEDEQPVLPINRAPARRAG
zo08_225   1  MDSFFKPAVWAVLWLMFAVRPALADELTNLLSSREQILRQFAEDEQPVLPINRAPARRAG
z2491      1  MDSFFKPAVWAVLWLMFAVRPALADELTNLLSSREQILRQFAEDEQPVLPINRAPARRAG
zo11_225   1  MDSFFKPAVWAVLWLMFAVRPALADELTNLLSSREQILRQFAEDEQPVLPINRAPARRAG
zo20_225   1  MDSFFKPAVWAVLWLMFAVRPALADELTNLLSSREQILRQFAEDEQPVLPINRAPARRAG
zo01_225   1  MDSFFKPAVWAVLWLMFAVRPALADELTNLLSSREQILRQFAEDEQPVLPINRAPARRAG
zo09_225   1  MDSFFKPAVWAVLWLMFAVRPALADELTNLLSSREQILRQFAEDEQPVLPINRAPARRAG
zo12_225   1  MDSFFKPAVWAVLWLMFAVRPALADELTNLLSSREQILRQFAEDEQPVLPINRAPARRAG
zo22_225   1  MDSFFKPAVWAVLWLMFAVRPALADELTNLLSSREQILRQFAEDEQPVLPINRAPARRAG
zo23_225   1  MDSFFKPAVWAVLWLMFAVRPALADELTNLLSSREQILRQFAEDEQPVLPINRAPARRAG
zo24_225   1  MDSFFKPAVWAVLWLMFAVRPALADELTNLLSSREQILRQFAEDEQPVLPINRAPARRAG
zo25_225   1  MDSFFKPAVWAVLWLMFAVRPALADELTNLLSSREQILRQFAEDEQPVLPINRAPARRAG
zo26_225   1  MDSFFKPAVWAVLWLMFAVRPALADELTNLLSSREQILRQFAEDEQPVLPINRAPARRAG
zo96_225   1  MDSFFKPAVWAVLWLMFAVRPALADELTNLLSSREQILRQFAEDEQPVLPINRAPARRAG
zo02_225   1  MDSFFKPAVWAVLWLMFAVRPALADELTNLLSSREQILRQFAEDEQPVLPINRAPARRAG
zo04_225   1  MDSFFKPAVWAVLWLMFAVRPALADELTNLLSSREQILRQFAEDEQPVLPINRAPARRAG
zo06_225   1  MDSFFKPAVWAVLWLMFAVRPALADELTNLLSSREQILRQFAEDEQPVLPINRAPARRAG
zo07_225   1  MDSFFKPAVWAVLWLMFAVRPALADELTNLLSSREQILRQFAEDEQPVLPINRAPARRAG
zo10_225   1  MDSFFKPAVWAVLWLMFAVRPALADELTNLLSSREQILRQFAEDEQPVLPINRAPARRAG
zo14_225   1  MDSFFKPAVWAVLWLMFAVRPALADELTNLLSSREQILRQFAEDEQPVLPINRAPARRAG
zo16_225   1  MDSFFKPAVWAVLWLMFAVRPALADELTNLLSSREQILRQFAEDEQPVLPINRAPARRAG
zo17_225   1  MDSFFKPAVWAVLWLMFAVRPALADELTNLLSSREQILRQFAEDEQPVLPINRAPARRAG
zo18_225   1  MDSFFKPAVWAVLWLMFAVRPALADELTNLLSSREQILRQFAEDEQPVLPINRAPARRAG
zo19_225   1  MDSFFKPAVWAVLWLMFAVRPALADELTNLLSSREQILRQFAEDEQPVLPINRAPARRAG
zo21_225   1  MDSFFKPAVWAVLWLMFAVRPALADELTNLLSSREQILRQFAEDEQPVLPINRAPARRAG
zo27_225   1  MDSFFKPAVWAVLWLMFAVRPALADELTNLLSSREQILRQFAEDEQPVLPINRAPARRAG
zo28_225   1  MDSFFKPAVWAVLWLMFAVRPALADELTNLLSSREQILRQFAEDEQPVLPINRAPARRAG
zo29_225   1  MDSFFKPAVWAVLWLMFAVRPALADELTNLLSSREQILRQFAEDEQPVLPINRAPARRAG
zo13_225   1  MDSFFKPAVWAVLWLMFAVRPALADELTNLLSSREQILRQFAEDEQPVLPVNRAPARRAG
zo03_225   1  MDSFFKPAVWAVLWLMFAVRPALADELTNLLSSREQILRQFAEDEQPVLPINRAPARRAG
zo15_225   1  MDSFFKPAVWAVLWLMFAVRPALADELTNLLSSREQILRQFAEDEQPVLPINRAPARRAG
fa1090     1  MDSFFKPAVWAVLWLMFAVRPALADELTNLLSSREQILRQFAEDEQPVLPVNRAPARRAG
zo32_225   1  MDSFFKPAVWAVLWLMFAVRPALADELTNLLSSREQILRQFAEDEQPVLPVNRAPARRAG
zo33_225   1  MDSFFKPAVWAVLWLMFAVRSALADELTNLLSSREQILRQFAEDEQPVLPVNRAPARRAG zo05_225  61  NADELIGSAMGLNE..............................QPVLPVNRVPARRAGNA
zo08_225  61  NADELIGSAMGLNE..............................QPVLPVNRVPARRAGNA
z2491     61  NADELIGSAMGLNEQPVLPVNRVPARRAGNADELIGNAMGLNEQPVLPVNRVPARRAGNA
zo11_225  61  NADELIGSAMGLNEQPVLPVNRVPARRAGNADELIGNAMGLNEQPVLPVNRAPARRAGNA
zo20_225  61  NADELIGSAMGLNEQPVLPINRAPARRAGNADELIGSAMGLNEQPVLPVNRVPARRAGNA
zo01_225  61  NADELIGSAMGLNE..............................QPVLPVNRVPARRAGNA
zo09_225  61  NADELIGSAMGLNE..............................QPVLPVNRVPARRAGNA
zo12_225  61  NADELIGSAMGLNE..............................QPVLPVNRVPARRAGNA
zo22_225  61  NADELIGSAMGLNE..............................QPVLPVNRVPARRAGNA
zo23_225  61  NADELIGSAMGLNE..............................QPVLPVNRVPARRAGNA
zo24_225  61  NADELIGSAMGLNE..............................QPVLPVNRVPARRAGNA
zo25_225  61  NADELIGSAMGLNE..............................QPVLPVNRVPARRAGNA
zo26_225  61  NADELIGSAMGLNE..............................QPVLPVNRVPARRAGNA
zo96_225  61  NADELIGSAMGLNE..............................QPVLPVNRVPARRAGNA
zo02_225  61  NADELIGSAMGLNE..............................QPVLPVNRVPARRAGNA
zo04_225  61  NADELIGSAMGLNE..............................QPVLPVNRVPARRAGNA
zo06_225  61  NADELIGSAMGLNE..............................QPVLPVNRVPARRAGNA
zo07_225  61  NADELIGSAMGLNE..............................QPVLPVNRVPARRAGNA
zo10_225  61  NADELIGSAMGLNE..............................QPVLPVNRVPARRAGNA
zo14_225  61  NADELIGSAMGLNE..............................QPVLPVNRVPARRAGNA
zo16_225  61  NADELIGSAMGLNE..............................QPVLPVNRVPARRAGNA
zo17_225  61  NADELIGSAMGLNE..............................QPVLPVNRVPARRAGNA
zo18_225  61  NADELIGSAMGLNE..............................QPVLPVNRVPARRAGNA
zo19_225  61  NADELIGSAMGLNE..............................QPVLPVNRVPARRAGNA
zo21_225  61  NADELIGSAMGLNE..............................QPVLPVNRVPARRAGNA
zo27_225  61  NADELIGSAMGLNE..............................QPVLPVNRVPARRAGNA
zo28_225  61  NADELIGSAMGLNE..............................QPVLPVNRVPARRAGNA
zo29_225  61  NADELIGSAMGLNE..............................QPVLPVNRVPARRAGNA
zo13_225  61  NADELIGSAMGLNE..............................QPVLPVNRVPARRAGNA
zo03_225  61  NADELIGSAMGLNE..............................QPVLPVNRVPARRAGNA
zo15_225  61  NADELIGSAMGLNE..................................................
fa1090    61  NADELIGSAMGLNE..................................................
zo32_225  61  NADELIGSAMGLNE..................................................
zo33_225  61  NADELIGSAMGLNE..................................................
```

FIG. 19A

```
zo05_225    92  DELIGSAMGLNEQPVLPVNRAPARRAGNADELIGNAMGLLGIAYRYGGTSISTGFDCSGF
zo08_225    92  DELIGSAMGLNEQPVLPVNRAPARRAGNADELIGNAMGLLGIAYRYGGTSISTGFDCSGF
z2491      121  DELIGNAMGLNEQPVLPVNRAPARRAGNADELIGNAMGLLGIAYRYGGTSISTGFDCSGF
zo11_225   121  DELIGNAMGLNEQPVLPVNRAPARRAGNADELIGNAMGLLGIAYRYGGTSVSTGFDCSGF
zo20_225   121  DELIGNAMGLNEQPVLPVNRAPARRAGNADELIGNAMGLLGIAYRYGGTSVSTGFDCSGF
zo01_225    92  DELIGNAMGLNEQPVLPVNRAPARRAGNADELIGNAMGLLGIAYRYGGTSISTGFDCSGF
zo09_225    92  DELIGNAMGLNEQPVLPVNRAPARRAGNADELIGNAMGLLGIAYRYGGTSISTGFDCSGF
zo12_225    92  DELIGNAMGLNEQPVLPVNRAPARRAGNADELIGNAMGLLGIAYRYGGTSISTGFDCSGF
zo22_225    92  DELIGNAMGLNEQPVLPVNRAPARRAGNADELIGNAMGLLGIAYRYGGTSISTGFDCSGF
zo23_225    92  DELIGNAMGLNEQPVLPVNRAPARRAGNADELIGNAMGLLGIAYRYGGTSISTGFDCSGF
zo24_225    92  DELIGNAMGLNEQPVLPVNRAPARRAGNADELIGNAMGLLGIAYRYGGTSISTGFDCSGF
zo25_225    92  DELIGNAMGLNEQPVLPVNRAPARRAGNADELIGNAMGLLGIAYRYGGTSISTGFDCSGF
zo26_225    92  DELIGNAMGLNEQPVLPVNRAPARRAGNADELIGNAMGLLGIAYRYGGTSISTGFDCSGF
zo96_225    92  DELIGNAMGLNEQPVLPVNRAPARRAGNADELIGNAMGLLGIAYRYGGTSISTGFDCSGF
zo02_225    92  DELIGNAMGLNEQPVLPVNRAPARRAGNADELIGNAMGLLGIAYRYGGTSVSTGFDCSGF
zo04_225    92  DELIGNAMGLNEQPVLPVNRAPARRAGNADELIGNAMGLLGIAYRYGGTSVSTGFDCSGF
zo06_225    92  DELIGNAMGLNEQPVLPVNRAPARRAGNADELIGNAMGLLGIAYRYGGTSVSTGFDCSGF
zo07_225    92  DELIGNAMGLNEQPVLPVNRAPARRAGNADELIGNAMGLLGIAYRYGGTSVSTGFDCSGF
zo10_225    92  DELIGNAMGLNEQPVLPVNRAPARRAGNADELIGNAMGLLGIAYRYGGTSVSTGFDCSGF
zo14_225    92  DELIGNAMGLNEQPVLPVNRAPARRAGNADELIGNAMGLLGIAYRYGGTSVSTGFDCSGF
zo16_225    92  DELIGNAMGLNEQPVLPVNRAPARRAGNADELIGNAMGLLGIAYRYGGTSVSTGFDCSGF
zo17_225    92  DELIGNAMGLNEQPVLPVNRAPARRAGNADELIGNAMGLLGIAYRYGGTSVSTGFDCSGF
zo18_225    92  DELIGNAMGLNEQPVLPVNRAPARRAGNADELIGNAMGLLGIAYRYGGTSVSTGFDCSGF
zo19_225    92  DELIGNAMGLNEQPVLPVNRAPARRAGNADELIGNAMGLLGIAYRYGGTSVSTGFDCSGF
zo21_225    92  DELIGNAMGLNEQPVLPVNRAPARRAGNADELIGNAMGLLGIAYRYGGTSVSTGFDCSGF
zo27_225    92  DELIGNAMGLNEQPVLPVNRAPARRAGNADELIGNAMGLLGIAYRYGGTSVSTGFDCSGF
zo28_225    92  DELIGNAMGLNEQPVLPVNRAPARRAGNADELIGNAMGLLGIAYRYGGTSVSTGFDCSGF
zo29_225    92  DELIGNAMGLNEQPVLPVNRAPARRAGNADELIGNAMGLLGIAYRYGGTSVSTGFDCSGF
zo13_225    92  DELIGNAMGLNEQPVLPVNRAPARRAGNADELIGNAMGLLGIAYRYGGTSVSTGFDCSGF
zo03_225    92  DELIGNAMGLNEQPVLPVNRAPARRAGNADELIGNAMGLLGIAYRYGGTSVSTGFDCSGF
zo15_225    75  ...........QPVLPVNRVPARRAGNADELIGNAMGLLGIAYRYGGTSVSTGFDCSGF
fa1090      75  ...........QPVLPVNRAPARRAGNADELIGSAMGLLGIAYRYGGTSVSTGFDCSGF
zo32_225    75  ...........QPVLPVNRAPARRAGNADELIGSAMGLLGIAYRYGGTSVSTGFDCSGF
zo33_225    75  ...........QPVLPVNRAPARRAGNADELIGSAMGLLGIAYRYGGTSVSTGFDCSGF zo05_225   152  MQHIFKRAMGINLPRTSAEQARMGTPVARSELQPGDMVFFRTLGGSRISHVGLYIGNNRF
zo08_225   152  MQHIFKRAMGINLPRTSAEQARMGTPVARSELQPGDMVFFRTLGGSRISHVGLYIGNNRF
z2491      181  MQHIFKRAMGINLPRTSAEQARMGTPVARSELQPGDMVFFRTLGGSRISHVGLYIGNNRF
zo11_225   181  MQHIFKRAMGINLPRTSAEQARMGTPVARSELQPGDMVFFRTLGGSRISHVGLYIGNNRF
zo20_225   181  MQHIFKRAMGINLPRTSAEQARMGTPVARSELQPGDMVFFRTLGGSRISHVGLYIGNNRF
zo01_225   152  MQHIFKRAMGINLPRTSAEQARMGTPVARSELQPGDMVFFRTLGGSRISHVGLYIGNNRF
zo09_225   152  MQHIFKRAMGINLPRTSAEQARMGTPVARSELQPGDMVFFRTLGGSRISHVGLYIGNNRF
zo12_225   152  MQHIFKRAMGINLPRTSAEQARMGTPVARSELQPGDMVFFRTLGGSRISHVGLYIGNNRF
zo22_225   152  MQHIFKRAMGINLPRTSAEQARMGTPVARSELQPGDMVFFRTLGGSRISHVGLYIGNNRF
zo23_225   152  MQHIFKRAMGINLPRTSAEQARMGTPVARSELQPGDMVFFRTLGGSRISHVGLYIGNNRF
zo24_225   152  MQHIFKRAMGINLPRTSAEQARMGTPVARSELQPGDMVFFRTLGGSRISHVGLYIGNNRF
zo25_225   152  MQHIFKRAMGINLPRTSAEQARMGTPVARSELQPGDMVFFRTLGGSRISHVGLYIGNNRF
zo26_225   152  MQHIFKRAMGINLPRTSAEQARMGTPVARSELQPGDMVFFRTLGGSRISHVGLYIGNNRF
zo96_225   152  MQHIFKRAMGINLPRTSAEQARMGTPVARSELQPGDMVFFRTLGGSRISHVGLYIGNNRF
zo02_225   152  MQHIFKRAMGINLPRTSAEQARMGTPVARSELQPGDMVFFRTLGGSRISHVGLYIGNNRF
zo04_225   152  MQHIFKRAMGINLPRTSAEQARMGTPVARSELQPGDMVFFRTLGGSRISHVGLYIGNNRF
zo06_225   152  MQHIFKRAMGINLPRTSAEQARMGTPVARSELQPGDMVFFRTLGGSRISHVGLYIGNNRF
zo07_225   152  MQHIFKRAMGINLPRTSAEQARMGTPVARSELQPGDMVFFRTLGGSRISHVGLYIGNNRF
zo10_225   152  MQHIFKRAMGINLPRTSAEQARMGTPVARSELQPGDMVFFRTLGGSRISHVGLYIGNNRF
zo14_225   152  MQHIFKRAMGINLPRTSAEQARMGTPVARSELQPGDMVFFRTLGGSRISHVGLYIGNNRF
zo16_225   152  MQHIFKRAMGINLPRTSAEQARMGTPVARSELQPGDMVFFRTLGGSRISHVGLYIGNNRF
zo17_225   152  MQHIFKRAMGINLPRTSAEQARMGTPVARSELQPGDMVFFRTLGGSRISHVGLYIGNNRF
zo18_225   152  MQHIFKRAMGINLPRTSAEQARMGTPVARSELQPGDMVFFRTLGGSRISHVGLYIGNNRF
zo19_225   152  MQHIFKRAMGINLPRTSAEQARMGTPVARSELQPGDMVFFRTLGGSRISHVGLYIGNNRF
zo21_225   152  MQHIFKRAMGINLPRTSAEQARMGTPVARSELQPGDMVFFRTLGGSRISHVGLYIGNNRF
zo27_225   152  MQHIFKRAMGINLPRTSAEQARMGTPVARSELQPGDMVFFRTLGGSRISHVGLYIGNNRF
zo28_225   152  MQHIFKRAMGINLPRTSAEQARMGTPVARSELQPGDMVFFRTLGGSRISHVGLYIGNNRF
zo29_225   152  MQHIFKRAMGINLPRTSAEQARMGTPVARSELQPGDMVFFRTLGGSRISHVGLYIGNNRF
zo13_225   152  IQHIFKRAMGINLPRTSAEQARMGTPVARSELQPGDMVFFRTLGGSRISHVGLYIGNNRF
zo03_225   152  MQHIFKRAMGINLPRTSAEQARMGTPVARSELQPGDMVFFRTLGGSRISHVGLYIGNNRF
zo15_225   123  MQHIFKRAMGINLPRTSAEQARMGTPVARSELQPGDMVFFRTLGGSRISHVGLYIGNNRF
fa1090     123  MQHIFKRAMGINLPRTSAEQARMGAPVARSELQPGDMVFFRTLGGSRISHVGLYIGNNRF
zo32_225   123  MQHIFKRAMGINLPRTSAEQARMGAPVARSELQPGDMVFFRTLGGSRISHVGLYIGNNRF
zo33_225   123  MQHIFKRAMGINLPRTSAEQARMGAPVARSELQPGDMVFFRTLGGSRISHVGLYIGNNRF
```

FIG. 19B

```
zo05_225  212  IHAPRTGKNIEITSLSHKYWSGKYAFARRVKKNDPSRFLN*IAYRYGGTSISTGFDCSGF
zo08_225  212  IHAPRTGKNIEITSLSHKYWSGKYAFARRVKKNDPSRFLN*IAYRYGGTSISTGFDCSGF
z2491     241  IHAPRTGKNIEITSLSHKYWSGKYAFARRVKKNDPSRFLN*IAYRYGGTSISTGFDCSGF
zo11_225  241  IHAPRTGKNIEITSLSHKYWSGKYAFARRVKKNDPSRFLN*IAYRYGGTSVSTGFDCSGF
zo20_225  241  IHAPRTGKNIEITSLSHKYWSGKYAFARRVKKNDPSRFLN*IAYRYGGTSVSTGFDCSGF
zo01_225  212  IHAPRTGKNIEITSLSHKYWSGKYAFARRVKKNDPSRFLN*IAYRYGGTSISTGFDCSGF
zo09_225  212  IHAPRTGKNIEITSLSHKYWSGKYAFARRVKKNDPSRFLN*IAYRYGGTSISTGFDCSGF
zo12_225  212  IHAPRTGKNIEITSLSHKYWSGKYAFARRVKKNDPSRFLN*IAYRYGGTSISTGFDCSGF
zo22_225  212  IHAPRTGKNIEITSLSHKYWSGKYAFARRVKKNDPSRFLN*IAYRYGGTSISTGFDCSGF
zo23_225  212  IHAPRTGKNIEITSLSHKYWSGKYAFARRVKKNDPSRFLN*IAYRYGGTSISTGFDCSGF
zo24_225  212  IHAPRTGKNIEITSLSHKYWSGKYAFARRVKKNDPSRFLN*IAYRYGGTSISTGFDCSGF
zo25_225  212  IHAPRTGKNIEITSLSHKYWSGKYAFARRVKKNDPSRFLN*IAYRYGGTSISTGFDCSGF
zo26_225  212  IHAPRTGKNIEITSLSHKYWSGKYAFARRVKKNDPSRFLN*IAYRYGGTSISTGFDCSGF
zo96_225  212  IHAPRTGKNIEITSLSHKYWSGKYAFARRVKKNDPSRFLN*IAYRYGGTSISTGFDCSGF
zo02_225  212  IHAPRTGKNIEITSLSHKYWSGKYAFARRVKKNDPSRFLN*IAYRYGGTSVSTGFDCSGF
zo04_225  212  IHAPRTGKNIEITSLSHKYWSGKYAFARRVKKNDPSRFLN*IAYRYGGTSVSTGFDCSGF
zo06_225  212  IHAPRTGKNIEITSLSHKYWSGKYAFARRVKKNDPSRFLN*IAYRYGGTSVSTGFDCSGF
zo07_225  212  IHAPRTGKNIEITSLSHKYWSGKYAFARRVKKNDPSRFLN*IAYRYGGTSVSTGFDCSGF
zo10_225  212  IHAPRTGKNIEITSLSHKYWSGKYAFARRVKKNDPSRFLN*IAYRYGGTSVSTGFDCSGF
zo14_225  212  IHAPRTGKNIEITSLSHKYWSGKYAFARRVKKNDPSRFLN*IAYRYGGTSVSTGFDCSGF
zo16_225  212  IHAPRTGKNIEITSLSHKYWSGKYAFARRVKKNDPSRFLN*IAYRYGGTSVSTGFDCSGF
zo17_225  212  IHAPRTGKNIEITSLSHKYWSGKYAFARRVKKNDPSRFLN*IAYRYGGTSVSTGFDCSGF
zo18_225  212  IHAPRTGKNIEITSLSHKYWSGKYAFARRVKKNDPSRFLN*IAYRYGGTSVSTGFDCSGF
zo19_225  212  IHAPRTGKNIEITSLSHKYWSGKYAFARRVKKNDPSRFLN*IAYRYGGTSVSTGFDCSGF
zo21_225  212  IHAPRTGKNIEITSLSHKYWSGKYAFARRVKKNDPSRFLN*IAYRYGGTSVSTGFDCSGF
zo27_225  212  IHAPRTGKNIEITSLSHKYWSGKYAFARRVKKNDPSRFLN*IAYRYGGTSVSTGFDCSGF
zo28_225  212  IHAPRTGKNIEITSLSHKYWSGKYAFARRVKKNDPSRFLN*IAYRYGGTSVSTGFDCSGF
zo29_225  212  IHAPRTGKNIEITSLSHKYWSGKYAFARRVKKNDPSRFLN*IAYRYGGTSVSTGFDCSGF
zo13_225  212  IHAPRTGKNIEITSLSHKYWSGKYAFARRVKKNDPSRFLN*IAYRYGGTSVSTGFDCSGF
zo03_225  212  IHAPRTGKNIEITSLSHKYWSGKYAFARRVKKNDPSRFLN*IAYRYGGTSVSTGFDCSGF
zo15_225  183  IHAPRTGKNIEITSLSHKYWSGKYAFARRVKKNDPSRFLN*IAYRYGGTSVSTGFDCSGF
fa1090    183  IHAPRTGKNIEITSLSHKYWSGKYAFARRVKKNDPSRFLN*IAYRYGGTSVSTGFDCSGF
zo32_225  183  IHAPRTGKNIEITSLSHKYWSGKYAFARRVKKNDPSRFLN*IAYRYGGTSVSTGFDCSGF
zo33_225  183  IHAPRTGKNIEITSLSHKYWSGKYAFARRIKKNDPSRFLN*IAYRYGGTSVSTGFDCSGF zo05_225  152  MQHIFKRAMGINLPRTSAEQARMGTPVARSELQPGDMVFFRTLGGSRISHVGLYIGNNRF
zo08_225  152  MQHIFKRAMGINLPRTSAEQARMGTPVARSELQPGDMVFFRTLGGSRISHVGLYIGNNRF
z2491     181  MQHIFKRAMGINLPRTSAEQARMGTPVARSELQPGDMVFFRTLGGSRISHVGLYIGNNRF
zo11_225  181  MQHIFKRAMGINLPRTSAEQARMGTPVARSELQPGDMVFFRTLGGSRISHVGLYIGNNRF
zo20_225  181  MQHIFKRAMGINLPRTSAEQARMGTPVARSELQPGDMVFFRTLGGSRISHVGLYIGNNRF
zo01_225  152  MQHIFKRAMGINLPRTSAEQARMGTPVARSELQPGDMVFFRTLGGSRISHVGLYIGNNRF
zo09_225  152  MQHIFKRAMGINLPRTSAEQARMGTPVARSELQPGDMVFFRTLGGSRISHVGLYIGNNRF
zo12_225  152  MQHIFKRAMGINLPRTSAEQARMGTPVARSELQPGDMVFFRTLGGSRISHVGLYIGNNRF
zo22_225  152  MQHIFKRAMGINLPRTSAEQARMGTPVARSELQPGDMVFFRTLGGSRISHVGLYIGNNRF
zo23_225  152  MQHIFKRAMGINLPRTSAEQARMGTPVARSELQPGDMVFFRTLGGSRISHVGLYIGNNRF
zo24_225  152  MQHIFKRAMGINLPRTSAEQARMGTPVARSELQPGDMVFFRTLGGSRISHVGLYIGNNRF
zo25_225  152  MQHIFKRAMGINLPRTSAEQARMGTPVARSELQPGDMVFFRTLGGSRISHVGLYIGNNRF
zo26_225  152  MQHIFKRAMGINLPRTSAEQARMGTPVARSELQPGDMVFFRTLGGSRISHVGLYIGNNRF
zo96_225  152  MQHIFKRAMGINLPRTSAEQARMGTPVARSELQPGDMVFFRTLGGSRISHVGLYIGNNRF
zo02_225  152  MQHIFKRAMGINLPRTSAEQARMGTPVARSELQPGDMVFFRTLGGSRISHVGLYIGNNRF
zo04_225  152  MQHIFKRAMGINLPRTSAEQARMGTPVARSELQPGDMVFFRTLGGSRISHVGLYIGNNRF
zo06_225  152  MQHIFKRAMGINLPRTSAEQARMGTPVARSELQPGDMVFFRTLGGSRISHVGLYIGNNRF
zo07_225  152  MQHIFKRAMGINLPRTSAEQARMGTPVARSELQPGDMVFFRTLGGSRISHVGLYIGNNRF
zo10_225  152  MQHIFKRAMGINLPRTSAEQARMGTPVARSELQPGDMVFFRTLGGSRISHVGLYIGNNRF
zo14_225  152  MQHIFKRAMGINLPRTSAEQARMGTPVARSELQPGDMVFFRTLGGSRISHVGLYIGNNRF
zo16_225  152  MQHIFKRAMGINLPRTSAEQARMGTPVARSELQPGDMVFFRTLGGSRISHVGLYIGNNRF
zo17_225  152  MQHIFKRAMGINLPRTSAEQARMGTPVARSELQPGDMVFFRTLGGSRISHVGLYIGNNRF
zo18_225  152  MQHIFKRAMGINLPRTSAEQARMGTPVARSELQPGDMVFFRTLGGSRISHVGLYIGNNRF
zo19_225  152  MQHIFKRAMGINLPRTSAEQARMGTPVARSELQPGDMVFFRTLGGSRISHVGLYIGNNRF
zo21_225  152  MQHIFKRAMGINLPRTSAEQARMGTPVARSELQPGDMVFFRTLGGSRISHVGLYIGNNRF
zo27_225  152  MQHIFKRAMGINLPRTSAEQARMGTPVARSELQPGDMVFFRTLGGSRISHVGLYIGNNRF
zo28_225  152  MQHIFKRAMGINLPRTSAEQARMGTPVARSELQPGDMVFFRTLGGSRISHVGLYIGNNRF
zo29_225  152  MQHIFKRAMGINLPRTSAEQARMGTPVARSELQPGDMVFFRTLGGSRISHVGLYIGNNRF
zo13_225  152  IQHIFKRAMGINLPRTSAEQARMGTPVARSELQPGDMVFFRTLGGSRISHVGLYIGNNRF
zo03_225  152  MQHIFKRAMGINLPRTSAEQARMGTPVARSELQPGDMVFFRTLGGSRISHVGLYIGNNRF
zo15_225  123  MQHIFKRAMGINLPRTSAEQARMGTPVARSELQPGDMVFFRTLGGSRISHVGLYIGNNRF
fa1090    123  MQHIFKRAMGINLPRTSAEQARMGAPVARSELQPGDMVFFRTLGGSRISHVGLYIGNNRF
zo32_225  123  MQHIFKRAMGINLPRTSAEQARMGAPVARSELQPGDMVFFRTLGGSRISHVGLYIGNNRF
zo33_225  123  MQHIFKRAMGINLPRTSAEQARMGAPVARSELQPGDMVFFRTLGGSRISHVGLYIGNNRF
```

FIG. 19C

```
gnmzq09   1  MKPLILGLAAALVLSACQVQKAPDFDYTSFKESKPASILVVPPLNESPDVNGTWGMLAST
gnmzq31   1  MKPLILGLAAVLALSACQVQKAPDFDYTAFKESKPASILVVPPLNESPDVNGTWGMLAST
fa1090    1  MKPLILGLAAVLALSACQVRKAPDLDYTSFKESKPASILVVPPLNESPDVNGTWGMLAST
gnmzq32   1  MKPLILGLAAVLALSACQVRKAPDLDYTSFKESKPASILVVPPLNESPDVNGTWGMLAST
gnmzq33   1  MKPLILGLAAVLALSACQVRKAPDLDYTSFKESKPASILVVPPLNESPDVNGTWGMLAST
gnmzq01   1  MKPLILGLAAVLALSACQVQKAPDFDYTSFKESKPASILVVPPLNESPDVNGTWGVLAST
gnmzq05   1  MKPLILGLAAVLALSACQVQKAPDFDYTSFKESKPASILVVPPLNESPDVNGTWGVLAST
gnmzq08   1  MKPLILGLAAVLALSACQVQKAPDFDYTSFKESKPASILVVPPLNESPDVNGTWGVLAST
gnmzq02   1  MKPLILGLAAVLALSACQVQKAPDFDYTSFKESKPASILVVPPLNESPDVNGTWGVLAST
gnmzq03   1  MKPLILGLAAVLALSACQVQKAPDFDYTSFKESKPASILVVPPLNESPDVNGTWGVLAST
gnmzq04   1  MKPLILGLAAVLALSACQVQKAPDFDYTSFKESKPASILVVPPLNESPDVNGTWGVLAST
gnmzq07   1  MKPLILGLAAVLALSACQVQKAPDFDYTSFKESKPASILVVPPLNESPDVNGTWGVLAST
gnmzq10   1  MKPLILGLAAVLALSACQVQKAPDFDYTSFKESKPASILVVPPLNESPDVNGTWGVLAST
gnmzq11   1  MKPLILGLAAVLALSACQVQKAPDFDYTSFKESKPASILVVPPLNESPDVNGTWGVLAST
gnmzq13   1  MKPLILGLAAVLALSACQVQKAPDFDYTSFKESKPASILVVPPLNESPDVNGTWGVLAST
gnmzq15   1  MKPLILGLAAVLALSACQVQKAPDFDYTSFKESKPASILVVPPLNESPDVNGTWGVLAST
gnmzq16   1  MKPLILGLAAVLALSACQVQKAPDFDYTSFKESKPASILVVPPLNESPDVNGTWGVLAST
gnmzq17   1  MKPLILGLAAVLALSACQVQKAPDFDYTSFKESKPASILVVPPLNESPDVNGTWGVLAST
gnmzq19   1  MKPLILGLAAVLALSACQVQKAPDFDYTSFKESKPASILVVPPLNESPDVNGTWGVLAST
gnmzq21   1  MKPLILGLAAVLALSACQVQKAPDFDYTSFKESKPASILVVPPLNESPDVNGTWGVLAST
gnmzq22   1  MKPLILGLAAVLALSACQVQKAPDFDYTSFKESKPASILVVPPLNESPDVNGTWGVLAST
gnmzq23   1  MKPLILGLAAVLALSACQVQKAPDFDYTSFKESKPASILVVPPLNESPDVNGTWGVLAST
gnmzq24   1  MKPLILGLAAVLALSACQVQKAPDFDYTSFKESKPASILVVPPLNESPDVNGTWGVLAST
gnmzq25   1  MKPLILGLAAVLALSACQVQKAPDFDYTSFKESKPASILVVPPLNESPDVNGTWGVLAST
gnmzq27   1  MKPLILGLAAVLALSACQVQKAPDFDYTSFKESKPASILVVPPLNESPDVNGTWGVLAST
gnmzq28   1  MKPLILGLAAVLALSACQVQKAPDFDYTSFKESKPASILVVPPLNESPDVNGTWGVLAST
gnmzq29   1  MKPLILGLAAVLALSACQVQKAPDFDYTSFKESKPASILVVPPLNESPDVNGTWGVLAST
z2491     1  MKPLILGLAAVLALSACQVQKAPDFDYTSFKESKPASILVVPPLNESPDVNGTWGVLAST
gnmzq14   1  MKPLILGLAAVLALSACQVQKAPDFDYTSFKESKPASILVVPPLNESPDVNGTWGVLAST
gnmzq18   1  MKPLILGLAAVLALSACQVQKAPDFDYTSFKESKPASILVVPPLNESPDVNGTWGVLAST
gnmzq26   1  MKPLILGLAAVLALSACQVQKAPDFDYTSFKESKPASILVVPPLNESPDVNGTWGMLAST gnmzq09  61  AEPLSEAGYYVFPAAVVEETFKQNGLTNAADIHAVQPEKLHQIFGNDAVLYITITEYGTS
gnmzq31  61  AEPLSEAGYYVFPAAVVEETFKQNGLTNAADIHAVRPEKLHQIFGNDAVLYITITEYGTS
fa1090   61  AAPISEAGYYVFPAAVVEETFKENGLTNAADIHAVRPEKLHQIFGNDAVLYITVTEYGTS
gnmzq32  61  AAPISEAGYYVFPAAVVEETFKENGLTNAADIHAVRPEKLHQIFGNDAVLYITVTEYGTS
gnmzq33  61  AAPISEAGYYVFPAAVVEETFKENGLTNAADIHAVRPEKLHQIFGNDAVLYITVTEYGTS
gnmzq01  61  AAPLSEAGYYVFPAAVVEETFKENGLTNAADIHAVRPEKLHQIFGNDAVLYITVTEYGTS
gnmzq05  61  AAPLSEAGYYVFPAAVVEETFKENGLTNAADIHAVRPEKLHQIFGNDAVLYITVTEYGTS
gnmzq08  61  AAPLSEAGYYVFPAAVVEETFKENGLTNAADIHAVRPEKLHQIFGNDAVLYITVTEYGTS
gnmzq02  61  AAPLSEAGYYVFPAAVVEETFKQNGLTNAADIHAVRPEKLHQIFGNDAVLYITVTEYGTS
gnmzq03  61  AAPLSEAGYYVFPAAVVEETFKQNGLTNAADIHAVRPEKLHQIFGNDAVLYITVTEYGTS
gnmzq04  61  AAPLSEAGYYVFPAAVVEETFKQNGLTNAADIHAVRPEKLHQIFGNDAVLYITVTEYGTS
gnmzq07  61  AAPLSEAGYYVFPAAVVEETFKQNGLTNAADIHAVRPEKLHQIFGNDAVLYITVTEYGTS
gnmzq10  61  AAPLSEAGYYVFPAAVVEETFKQNGLTNAADIHAVRPEKLHQIFGNDAVLYITVTEYGTS
gnmzq11  61  AAPLSEAGYYVFPAAVVEETFKQNGLTNAADIHAVRPEKLHQIFGNDAVLYITVTEYGTS
gnmzq13  61  AAPLSEAGYYVFPAAVVEETFKQNGLTNAADIHAVRPEKLHQIFGNDAVLYITVTEYGTS
gnmzq15  61  AAPLSEAGYYVFPAAVVEETFKQNGLTNAADIHAVRPEKLHQIFGNDAVLYITVTEYGTS
gnmzq16  61  AAPLSEAGYYVFPAAVVEETFKQNGLTNAADIHAVRPEKLHQIFGNDAVLYITVTEYGTS
gnmzq17  61  AAPLSEAGYYVFPAAVVEETFKQNGLTNAADIHAVRPEKLHQIFGNDAVLYITVTEYGTS
gnmzq19  61  AAPLSEAGYYVFPAAVVEETFKQNGLTNAADIHAVRPEKLHQIFGNDAVLYITVTEYGTS
gnmzq21  61  AAPLSEAGYYVFPAAVVEETFKQNGLTNAADIHAVRPEKLHQIFGNDAVLYITVTEYGTS
gnmzq22  61  AAPLSEAGYYVFPAAVVEETFKQNGLTNAADIHAVRPEKLHQIFGNDAVLYITVTEYGTS
gnmzq23  61  AAPLSEAGYYVFPAAVVEETFKQNGLTNAADIHAVRPEKLHQIFGNDAVLYITVTEYGTS
gnmzq24  61  AAPLSEAGYYVFPAAVVEETFKQNGLTNAADIHAVRPEKLHQIFGNDAVLYITVTEYGTS
gnmzq25  61  AAPLSEAGYYVFPAAVVEETFKQNGLTNAADIHAVRPEKLHQIFGNDAVLYITVTEYGTS
gnmzq27  61  AAPLSEAGYYVFPAAVVEETFKQNGLTNAADIHAVRPEKLHQIFGNDAVLYITVTEYGTS
gnmzq28  61  AAPLSEAGYYVFPAAVVEETFKQNGLTNAADIHAVRPEKLHQIFGNDAVLYITVTEYGTS
gnmzq29  61  AAPLSEAGYYVFPAAVVEETFKQNGLTNAADIHAVRPEKLHQIFGNDAVLYITVTEYGTS
z2491    61  AAPLSEAGYYVFPAAVVEETFKQNGLTNAADIHAVRPEKLHQIFGNDAVLYITVTEYGTS
gnmzq14  61  AAPLSEAGYYVFPAAVVEETFKQNGLTNAADIHAVRPEKLHQIFGNDAVLYITVTEYGTS
gnmzq18  61  AAPLSEAGYYVFPAAVVEETFKQNGLTNAADIHAVRPEKLHQIFGNDAVLYITVTEYGTS
gnmzq26  61  AAPLSEAGYYVFPAAVVEETFKQNGLTNAADIHAVRPEKLHQIFGNDAVLYITVTEYGTS
```

FIG. 20A

```
gnmzq09  121  YQILDSVTTVSAHARLVDSRNGKVLWSGSASIREGSNNSNSGLLGALVSAVVNQIANSLT
gnmzq31  121  YQILDSVTTVSAHARLVDSRNGKVLWSGSASIREGSNNSNSGLLGALVSAVVNQIANSLT
fa1090   121  YQILDSVTTVSAKARLVDSRNGKELWSGSASIREGSNNSNSGLLGALVGAVVNQIANSLT
gnmzq32  121  YQILDSVTTVSAKARLVDSRNGKELWSGSASIREGSNNSNSGLLGALVGAVVNQIANSLT
gnmzq33  121  YQILDSVTTVSAKARLVDSRNGKELWSGSASIREGSNNSNSGLLGALVGAVVNQIANSLT
gnmzq01  121  YQILDSVTTVSAKARLVDSRNGKELWSGSASIREGSNNSNSGLLGALVSAVVNQIANNLT
gnmzq05  121  YQILDSVTTVSAKARLVDSRNGKELWSGSASIREGSNNSNSGLLGALVSAVVNQIANNLT
gnmzq08  121  YQILDSVTTVSAKARLVDSRNGKELWSGSASIREGSNNSNSGLLGALVSAVVNQIANNLT
gnmzq02  121  YQILDSVTTVSAKARLVDSRNGKELWSGSASIREGSNNSNSGLLGALVSAVVNQIANSLT
gnmzq03  121  YQILDSVTTVSAKARLVDSRNGKELWSGSASIREGSNNSNSGLLGALVSAVVNQIANSLT
gnmzq04  121  YQILDSVTTVSAKARLVDSRNGKELWSGSASIREGSNNSNSGLLGALVSAVVNQIANSLT
gnmzq07  121  YQILDSVTTVSAKARLVDSRNGKELWSGSASIREGSNNSNSGLLGALVSAVVNQIANSLT
gnmzq10  121  YQILDSVTTVSAKARLVDSRNGKELWSGSASIREGSNNSNSGLLGALVSAVVNQIANSLT
gnmzq11  121  YQILDSVTTVSAKARLVDSRNGKELWSGSASIREGSNNSNSGLLGALVSAVVNQIANSLT
gnmzq13  121  YQILDSVTTVSAKARLVDSRNGKELWSGSASIREGSNNSNSGLLGALVSAVVNQIANSLT
gnmzq15  121  YQILDSVTTVSAKARLVDSRNGKELWSGSASIREGSNNSNSGLLGALVSAVVNQIANSLT
gnmzq16  121  YQILDSVTTVSAKARLVDSRNGKELWSGSASIREGSNNSNSGLLGALVSAVVNQIANSLT
gnmzq17  121  YQILDSVTTVSAKARLVDSRNGKELWSGSASIREGSNNSNSGLLGALVSAVVNQIANSLT
gnmzq19  121  YQILDSVTTVSAKARLVDSRNGKELWSGSASIREGSNNSNSGLLGALVSAVVNQIANSLT
gnmzq21  121  YQILDSVTTVSAKARLVDSRNGKELWSGSASIREGSNNSNSGLLGALVSAVVNQIANSLT
gnmzq22  121  YQILDSVTTVSAKARLVDSRNGKELWSGSASIREGSNNSNSGLLGALVSAVVNQIANSLT
gnmzq23  121  YQILDSVTTVSAKARLVDSRNGKELWSGSASIREGSNNSNSGLLGALVSAVVNQIANSLT
gnmzq24  121  YQILDSVTTVSAKARLVDSRNGKELWSGSASIREGSNNSNSGLLGALVSAVVNQIANSLT
gnmzq25  121  YQILDSVTTVSAKARLVDSRNGKELWSGSASIREGSNNSNSGLLGALVSAVVNQIANSLT
gnmzq27  121  YQILDSVTTVSAKARLVDSRNGKELWSGSASIREGSNNSNSGLLGALVSAVVNQIANSLT
gnmzq28  121  YQILDSVTTVSAKARLVDSRNGKELWSGSASIREGSNNSNSGLLGALVSAVVNQIANSLT
gnmzq29  121  YQILDSVTTVSAKARLVDSRNGKELWSGSASIREGSNNSNSGLLGALVSAVVNQIANSLT
z2491    121  YQILDSVTTVSAKARLVDSRNGKELWSGSASIREGSNNSNSGLLGALVSAVVNQIANSLT
gnmzq14  121  YQILDSVTTVSAKARLVDSRNGKELWSGSASIREGSNNSNSGLLGALVGAVVNQIANSLT
gnmzq18  121  YQILDSVTTVSAKARLVDSRNGKELWSGSASIREGSNNSNSGLLGALVGAVVNQIANSLT
gnmzq26  121  YQILDSVTTVSAKARLVDSRNGKELWSGSASIREGSNNSNSGLLGALVGAVVNQIANSLT gnmzq09  181  DRGYQVSKTAAYNLLSPYSHNGILKGFRFVEEQPK*PEKLHQIFGNDAVLYITITEYGTS
gnmzq31  181  DRGYQVSKAAAYDLLSPYSHNGILKGFRFVEEQPK*PEKLHQIFGNDAVLYITITEYGTS
fa1090   181  DRGYQVSKTAAYNLLSPYSRNGILKGFRFVEEQPK*PEKLHQIFGNDAVLYITVTEYGTS
gnmzq32  181  DRGYQVSKTAAYNLLSPYSRNGILKGFRFVEEQPK*PEKLHQIFGNDAVLYITVTEYGTS
gnmzq33  181  DRGYQVSKTAAYNLLSPYSRNGILKGFRFVEEQPK*PEKLHQIFGNDAVLYITVTEYGTS
gnmzq01  181  DRGYQVSKTAAYNLLSPYSHNGILKGFRFVEEQPK*PEKLHQIFGNDAVLYITVTEYGTS
gnmzq05  181  DRGYQVSKTAAYNLLSPYSHNGILKGFRFVEEQPK*PEKLHQIFGNDAVLYITVTEYGTS
gnmzq08  181  DRGYQVSKTAAYNLLSPYSHNGILKGFRFVEEQPK*PEKLHQIFGNDAVLYITVTEYGTS
gnmzq02  181  DRGYQVSKTAAYNLLSPYSHNGILKGFRFVEEQPK*PEKLHQIFGNDAVLYITVTEYGTS
gnmzq03  181  DRGYQVSKTAAYNLLSPYSHNGILKGFRFVEEQPK*PEKLHQIFGNDAVLYITVTEYGTS
gnmzq04  181  DRGYQVSKTAAYNLLSPYSHNGILKGFRFVEEQPK*PEKLHQIFGNDAVLYITVTEYGTS
gnmzq07  181  DRGYQVSKTAAYNLLSPYSHNGILKGFRFVEEQPK*PEKLHQIFGNDAVLYITVTEYGTS
gnmzq10  181  DRGYQVSKTAAYNLLSPYSHNGILKGFRFVEEQPK*PEKLHQIFGNDAVLYITVTEYGTS
gnmzq11  181  DRGYQVSKTAAYNLLSPYSHNGILKGFRFVEEQPK*PEKLHQIFGNDAVLYITVTEYGTS
gnmzq13  181  DRGYQVSKTAAYNLLSPYSHNGILKGFRFVEEQPK*PEKLHQIFGNDAVLYITVTEYGTS
gnmzq15  181  DRGYQVSKTAAYNLLSPYSHNGILKGFRFVEEQPK*PEKLHQIFGNDAVLYITVTEYGTS
gnmzq16  181  DRGYQVSKTAAYNLLSPYSHNGILKGFRFVEEQPK*PEKLHQIFGNDAVLYITVTEYGTS
gnmzq17  181  DRGYQVSKTAAYNLLSPYSHNGILKGFRFVEEQPK*PEKLHQIFGNDAVLYITVTEYGTS
gnmzq19  181  DRGYQVSKTAAYNLLSPYSHNGILKGFRFVEEQPK*PEKLHQIFGNDAVLYITVTEYGTS
gnmzq21  181  DRGYQVSKTAAYNLLSPYSHNGILKGFRFVEEQPK*PEKLHQIFGNDAVLYITVTEYGTS
gnmzq22  181  DRGYQVSKTAAYNLLSPYSHNGILKGFRFVEEQPK*PEKLHQIFGNDAVLYITVTEYGTS
gnmzq23  181  DRGYQVSKTAAYNLLSPYSHNGILKGFRFVEEQPK*PEKLHQIFGNDAVLYITVTEYGTS
gnmzq24  181  DRGYQVSKTAAYNLLSPYSHNGILKGFRFVEEQPK*PEKLHQIFGNDAVLYITVTEYGTS
gnmzq25  181  DRGYQVSKTAAYNLLSPYSHNGILKGFRFVEEQPK*PEKLHQIFGNDAVLYITVTEYGTS
gnmzq27  181  DRGYQVSKTAAYNLLSPYSHNGILKGFRFVEEQPK*PEKLHQIFGNDAVLYITVTEYGTS
gnmzq28  181  DRGYQVSKTAAYNLLSPYSHNGILKGFRFVEEQPK*PEKLHQIFGNDAVLYITVTEYGTS
gnmzq29  181  DRGYQVSKTAAYNLLSPYSHNGILKGFRFVEEQPK*PEKLHQIFGNDAVLYITVTEYGTS
z2491    181  DRGYQVSKTAAYNLLSPYSHNGILKGFRFVEEQPK*PEKLHQIFGNDAVLYITVTEYGTS
gnmzq14  181  DRGYQVSKTAAYNLLSPYSHNGILKGFRFVEEQPK*PEKLHQIFGNDAVLYITVTEYGTS
gnmzq18  181  DRGYQVSKTAAYNLLSPYSHNGILKGFRFVEEQPK*PEKLHQIFGNDAVLYITVTEYGTS
gnmzq26  181  DRGYQVSKTAAYNLLSPYSHNGILKGFRFVEEQPK*PEKLHQIFGNDAVLYITVTEYGTS
```

FIG. 20B

```
287_14    1   MFKRSVIAMACIFALSACGGGGGSPDVKSADTLSKPAAPVVSE...........KETEA
287_2     1   MFKRSVIAMACIFALSACGGGGGSPDVKSADTLSKPAAPVVSE...........KETEA
287_21    1   MFKRSVIAMACIFALSACGGGGGSPDVKSADTLSKPAAPVVSE...........KETEA
z2491     1   MFKRSVIAMACIFALSACGGGGGSPDVKSADTLSKPAAPVVSE...........KETEA
287_9     1   MFKRSVIAMACIVALSACGGGGGSPDVKSADTLSKPAAPVVTEDVGEEVLPKEKKDEEA
fal090    1   MFKRSVIAMACIFPLSACGGGGGSPDVKSADTPSKPAAPVVAENAGEGVLPKEKKDEEA 287_14    50  KEDAPQAGSQGQGAPSAQGGQDMAAVSEENTNGGAAATDKPKNEDEGAQNDMPQNAADT
287_2     50  KEDAPQAGSQGQGAPSAQGGQDMAAVSEENTNGGAAATDKPKNEDEGAQNDMPQNAADT
287_21    50  KEDAPQAGSQGQGAPSAQGSQDMAAVSEENTNGGAVTADNPKNEDEVAQNDMPQNAAGT
z2491     50  KEDAPQAGSQGQGAPSAQGSQDMAAVSEENTNGGAVTADNPKNEDEVAQNDMPQNAAGT
287_9     61  VSGAPQADT..QDATAGKGGQDMAAVSAENTNGGAATTDNPENKDEGPQNDMPQNAADT
fal090    61  AGGAPQADT..QDATAGEGSQDMAAVSAENTNGGAATTDNPKNEDAGAQNDMPQNAA..

287_14    110 DSLTPNHTPASNMPAGNMENQAPDAGESEQPANQPDMANTADGMQGDDPSAGGENAGNTA
287_2     110 DSLTPNHTPASNMPAGNMENQAPDAGESEQPANQPDMANTADGMQGDDPSAGGENAGNTA
287_21    110 DSSTPNHTPDPNMLAGNMENQATDAGESSQPANQPDMANAADGMQGDDPSAGGQNAGNTA
z2491     110 DSSTPNHTPDPNMLAGNMENQATDAGESSQPANQPDMANAADGMQGDDPSAGGQNAGNTA
287_9     119 DSSTPNHTPAPNMPTRDMGNQAPDAGESAQPANQPDMANAADGMQGDDPSA.GENAGNTA
fal090    117 ............................................................

287_14    170 AQGTNQAENNQTAGSQNPASSTNPSATNSGGDFGRTNVGNSVVIDGPSQNITLTHCKGDS
287_2     170 AQGTNQAENNQTAGSQNPASSTNPSATNSGGDFGRTNVGNSVVIDGPSQNITLTHCKGDS
287_21    170 AQGANQAGNNQAAGSSDPIPASNPAPANGGSNFGRVDLANGVLIDGPSQNITLTHCKGDS
z2491     170 AQGANQAGNNQAAGSSDPIPASNPAPANGGSNFGRVDLANGVLIDGPSQNITLTHCKGDS
287_9     178 DQAANQAENNQVGGSQNPASSTNPNATNGGSDFGRINVANGIKLDSGSENVTLTHCKDKV
fal090    117 .ESANQTGNNQPAGSSDSAPASNPAPANGGSDFGRTNVGNSVVIDGPSQNITLTHCKGDS 287_14    230 CSGNNFLDEEVQLKSEFEKLSDADKISNYKKDGKNDGKNDKFVGLVADSVQMKGINQYII
287_2     230 CSGNNFLDEEVQLKSEFEKLSDADKISNYKKDGKNDGKNDKFVGLVADSVQMKGINQYII
287_21    230 CSGNNFLDEEVQLKSEFEKLSDADKISNYKK....DGKNDKFVGLVADSVQMKGINQYII
z2491     230 CSGNNFLDEEVQLKSEFEKLSDADKISNYKK....DGKNDKFVGLVADSVQMKGINQYII
287_9     238 CDRD.FLDEEAPPKSEFEKLSDEEKINKYKK....DEQRENFVGLVADRVEKNGTNKYVI
fal090    176 CNGDNLLDEEAPSKSEFEKLSDEEKIKRYKK....DEQRENFVGLVADRVKKDGTNKYII 287_14    290 FYKPKP..TSFARFRRSARSRRSLPAEMPLIPVNQADTLIVDGEAVSLTGHSGNIFAPEG
287_2     290 FYKPKP..TSFARFRRSARSRRSLPAEMPLIPVNQADTLIVDGEAVSLTGHSGNIFAPEG
287_21    286 FYKPKP..TSFARFRRSARSRRSLPAEMPLIPVNQADTLIVDGEAVSLTGHSGNIFAPEG
z2491     286 FYKPKP..TSFARFRRSARSRRSLPAEMPLIPVNQADTLIVDGEAVSLTGHSGNIFAPEG
287_9     293 IYKDKSASSSARFRRSARSRRSLPAEMPLIPVNQADTLIVDGEAVSLTGHSGNIFAPEG
fal090    232 FYTDKEPT.......RSARSRRSLPAEIPLIPVNQADTLIVDGEAVSLTGHSGNIFAPEG 287_14    348 NYRYLTYGAEKLPGGSYALRVQGEPSKGEMLAGTAVYNGEVLHFHTENGRPSPSRGRFAA
287_2     348 NYRYLTYGAEKLPGGSYALRVQGEPSKGEMLAGTAVYNGEVLHFHTENGRPSPSRGRFAA
287_21    344 NYRYLTYGAEKLPGGSYALRVQGEPAKGEMLAGAAVYNGEVLHFHTENGRPYPTRGRFAA
z2491     344 NYRYLTYGAEKLPGGSYALRVQGEPAKGEMLAGAAVYNGEVLHFHTENGRPYPTRGRFAA
287_9     353 NYRYLTYGAEKLSGGSYALSVQGEPAKGEMLAGTAVYNGEVLHFHMENGRPSPSGGRFAA
fal090    285 NYRYLTYGAEKLPGGSYALRVQGEPAKGEMLVGTAVYNGEVLHFHMENGRPYPSGGRFAA 287_14    408 KVDFGSKSVDGIIDSGDGLHMGTQKFKAAIDGNGFKGTWTENGGGDVSGKFYGPAGEEVA
287_2     408 KVDFGSKSVDGIIDSGDGLHMGTQKFKAAIDGNGFKGTWTENGGGDVSGKFYGPAGEEVA
287_21    404 KVDFGSKSVDGIIDSGDDLHMGTQKFKAAIDGNGFKGTWTENGSGDVSGKFYGPAGEEVA
z2491     404 KVDFGSKSVDGIIDSGDDLHMGTQKFKAAIDGNGFKGTWTENGSGDVSGKFYGPAGEEVA
287_9     413 KVDFGSKSVDGIIDSGDDLHMGTQKFKAVIDGNGFKGTWTENGGGDVSGRFYGPAGEEVA
fal090    345 KVDFGSKSVDGIIDSGDDLHMGTQKFKAAIDGNGFKGTWTENGGGDVSGRFYGPAGEEVA
```

FIG. 21A

```
287_14   468  GKYSYRPTDAEKGGFGVFAGKKEQD*DVKSADTLSKPAAPVVSE..........KETEA
287_2    468  GKYSYRPTDAEKGGFGVFAGKKEQD*DVKSADTLSKPAAPVVSE..........KETEA
287_21   464  GKYSYRPTDAEKGGFGVFAGKKEQD*DVKSADTLSKPAAPVVSE..........KETEA
z2491    464  GKYSYRPTDAEKGGFGVFAGKKEQD*DVKSADTLSKPAAPVVSE..........KETEA
287_9    473  GKYSYRPTDAEKGGFGVFAGKKEQD*DVKSADTLSKPAAPVVEDVGEEVLPKEKKDEEA
fa1090   405  GKYSYRPTDAEKGGFGVFAGKKDRD*DVKSADTPSKPAAPVVAENAGEGVLPKEKKDEEA

287_14    50  KEDAPQAGSQGQGAPSAQGGQDMAAVSEENTGNGGAAATDKPKNEDEGAQNDMPQNAADT
287_2     50  KEDAPQAGSQGQGAPSAQGGQDMAAVSEENTGNGGAAATDKPKNEDEGAQNDMPQNAADT
287_21    50  KEDAPQAGSQGQGAPSAQGSQDMAAVSEENTGNGGAVTADNPKNEDEVAQNDMPQNAAGT
z2491     50  KEDAPQAGSQGQGAPSAQGSQDMAAVSEENTGNGGAVTADNPKNEDEVAQNDMPQNAAGT
287_9     61  VSGAPQADT..QDATAGKGGQDMAAVSAENTGNGGAATTDNPENKDEGPQNDMPQNAADT
fa1090    61  AGGAPQADT..QDATAGEGSQDMAAVSAENTGNGGAATTDNPKNEDAGAQNDMPQNAA..

287_14   110  DSLTPNHTPASNMPAGNMENQAPDAGESEQPANQPDMANTADGMQGDDPSAGGENAGNTA
287_2    110  DSLTPNHTPASNMPAGNMENQAPDAGESEQPANQPDMANTADGMQGDDPSAGGENAGNTA
287_21   110  DSSTPNHTPDPNMLAGNMENQATDAGESSQPANQPDMANAADGMQGDDPSAGGQNAGNTA
z2491    110  DSSTPNHTPDPNMLAGNMENQATDAGESSQPANQPDMANAADGMQGDDPSAGGQNAGNTA
287_9    119  DSSTPNHTPAPNMPTRDMGNQAPDAGESAQPANQPDMANAADGMQGDDPSA.GENAGNTA
fa1090   117  ............................................................

287_14   170  AQGTNQAENNQTAGSQNPASSTNPSATNSGGDFGRTNVGNSVVIDGPSQNITLTHCKGDS
287_2    170  AQGTNQAENNQTAGSQNPASSTNPSATNSGGDFGRTNVGNSVVIDGPSQNITLTHCKGDS
287_21   170  AQGANQAGNNQAAGGSDPIPASNPAPANGGSNFGRVDLANGVLIDGPSQNITLTHCKGDS
z2491    170  AQGANQAGNNQAAGGSDPIPASNPAPANGGSNFGRVDLANGVLIDGPSQNITLTHCKGDS
287_9    178  DQAANQAENNQVGGSQNPASSTNPNATNGGSDFGRINVANGIKLDSGSENVTLTHCKDKV
fa1090   117  .ESANQTGNNQPAGSSDSAPASNPAPANGGSDFGRTNVGNSVVIDGPSQNITLTHCKGDS

287_14   230  CSGNNFLDEEVQLKSEFEKLSDADKISNYKKDGKNDGKNDKFVGLVADSVQMKGINQYII
287_2    230  CSGNNFLDEEVQLKSEFEKLSDADKISNYKKDGKNDGKNDKFVGLVADSVQMKGINQYII
287_21   230  CSGNNFLDEEVQLKSEFEKLSDADKISNYKK....DGKNDKFVGLVADSVQMKGINQYII
z2491    230  CSGNNFLDEEVQLKSEFEKLSDADKISNYKK....DGKNDKFVGLVADSVQMKGINQYII
287_9    238  CDRD.FLDEEAPPKSEFEKLSDEEKINKYKK....DEQRENFVGLVADRVEKNGTNKYVI
fa1090   176  CNGDNLLDEEAPSKSEFEKLSDEEKIKRYKK....DEQRENFVGLVADRVKKDGTNKYII

287_14   290  FYKPKP..TSPARFRRSARSRRSLPAEMPLIPVNQADTLIVDGEAVSLTGHSGNIFAPEG
287_2    290  FYKPKP..TSPARFRRSARSRRSLPAEMPLIPVNQADTLIVDGEAVSLTGHSGNIFAPEG
287_21   286  FYKPKP..TSPARFRRSARSRRSLPAEMPLIPVNQADTLIVDGEAVSLTGHSGNIFAPEG
z2491    286  FYKPKP..TSPARFRRSARSRRSLPAEMPLIPVNQADTLIVDGEAVSLTGHSGNIFAPEG
287_9    293  IYKDKSASSSSARFRRSARSRRSLPAEMPLIPVNQADTLIVDGEAVSLTGHSGNIFAPEG
fa1090   232  FYTDKPPT.......RSARSRRSLPAEIPLIPVNQADTLIVDGEAVSLTGHSGNIFAPEG

287_14   348  NYRYLTYGAEKLPGGSYALRVQGEPSKGEMLAGTAVYNGEVLHFHTENGRPSPSRGRFAA
287_2    348  NYRYLTYGAEKLPGGSYALRVQGEPSKGEMLAGTAVYNGEVLHFHTENGRPSPSRGRFAA
287_21   344  NYRYLTYGAEKLPGGSYALRVQGEPAKGEMLAGAAVYNGEVLHFHTENGRPYPTRGRFAA
z2491    344  NYRYLTYGAEKLPGGSYALRVQGEPAKGEMLAGAAVYNGEVLHFHTENGRPYPTRGRFAA
287_9    353  NYRYLTYGAEKLSGGSYALSVQGEPAKGEMLAGTAVYNGEVLHFHMENGRPSPSGGRFAA
fa1090   285  NYRYLTYGAEKLPGGSYALRVQGEPAKGEMLVGTAVYNGEVLHFHMENGRPYPSGGRFAA

287_14   408  KVDFGSKSVDGIIDSGDGLHMGTQKFKAAIDGNGFKGTWTENGGGDVSGKFYGPAGEEVA
287_2    408  KVDFGSKSVDGIIDSGDGLHMGTQKFKAAIDGNGFKGTWTENGGGDVSGKFYGPAGEEVA
287_21   404  KVDFGSKSVDGIIDSGDDLHMGTQKFKAAIDGNGFKGTWTENGGGDVSGKFYGPAGEEVA
z2491    404  KVDFGSKSVDGIIDSGDDLHMGTQKFKAAIDGNGFKGTWTENGSGDVSGKFYGPAGEEVA
287_9    413  KVDFGSKSVDGIIDSGDDLHMGTQKFKAVIDGNGFKGTWTENGGGDVSGRFYGPAGEEVA
fa1090   345  KVDFGSKSVDGIIDSGDDLHMGTQKFKAAIDGNGFKGTWTENGGGDVSGRFYGPAGEEVA
```

FIG. 21B

```
z2491_519      1  MEFFIILLAAVVFGFKSFVVIPQQEVHVVERLGRFHRALTAGLNILIPFIDRVAYRHSL
zv26_519       1  MEFFIILLAAVVVFGFKSFVVIPQQEVHVVERLGRFHRALTAGLNILIPFIDRVAYRHSL
zv22_519ass    1  MEFFIILLAAVVVFGFKSFVVIPQQEVHVVERLGRFHRALTAGLNILIPFIDRVAYRHSL
fa1090_519     1  MEFFIILLAAVAVFGFKSFVVIPQQEVHVVERLGRFHRALTAGLNILIPFIDRVAYRHSL
zv32_519       1  MEFFIILLAAVAVFGFKSFVVIPQQEVHVVERLGRFHRALTAGLNILIPFIDRVAYRHSL
zv11_519       1  MEFFIILLAAVAVFGFKSFVVIPQQEVHVVERLGRFHRALTAGLNILIPFIDRVAYRHSL
zv28_519       1  MEFFIILLAAVAVFGFKSFVVIPQQEVHVVERLGRFHRALTAGLNILIPFIDRVAYRHSL
zv96_519       1  MEFFIILLAAVAVFGFKSFVVIPQQEVHVVERLGRFHRALTAGLNILIPFIDRVAYRHSL
zv02_519       1  MEFFIILLVAVAVFGFKSFVVIPQQEVHVVERLGRFHRALTAGLNILIPFIDRVAYRHSL
zv03_519       1  MEFFIILLVAVAVFGFKSFVVIPQQEVHVVERLGRFHRALTAGLNILIPFIDRVAYRHSL
zv04_519       1  MEFFIILLVAVAVFGFKSFVVIPQQEVHVVERLGRFHRALTAGLNILIPFIDRVAYRHSL
zv05_519       1  MEFFIILLVAVAVFGFKSFVVIPQQEVHVVERLGRFHRALTAGLNILIPFIDRVAYRHSL
zv01_519       1  MEFFIILLVAVAVFGFKSFVVIPQQEVHVVERLGRFHRALTAGLNILIPFIDRVAYRHSL
zv07_519       1  MEFFIILLVAVAVFGFKSFVVIPQQEVHVVERLGRFHRALTAGLNILIPFIDRVAYRHSL
zv12_519       1  MEFFIILLVAVAVFGFKSFVVIPQQEVHVVERLGRFHRALTAGLNILIPFIDRVAYRHSL
zv18_519       1  MEFFIILLVAVAVFGFKSFVVIPQQEVHVVERLGRFHRALTAGLNILIPFIDRVAYRHSL
zv19_519       1  MEFFIILLVAVAVFGFKSFVVIPQQEVHVVERLGRFHRALTAGLNILIPFIDRVAYRHSL
zv21_519ass    1  MEFFIILLVAVAVFGFKSFVVIPQQEVHVVERLGRFHRALTAGLNILIPFIDRVAYRHSL
zv27_519       1  MEFFIILLVAVAVFGFKSFVVIPQQEVHVVERLGRFHRALTAGLNILIPFIDRVAYRHSL
zv20_519ass    1  MEFFIILLVAVAVFGFKSFVVIPQQEVHVVERLGRFHRALTAGLNILIPFIDRVAYRHSL
zv06_519ass    1  MEFFIILLVAVAVFGFKSFVVIPQQEVHVVERLGRFHRALTAGLNILIPFIDRVAYRHSL
zv29_519ass    1  MEFFIILLAAVAVFGFKSFVVIPQQEVHVVERLGRFHRALTAGLNILIPFIDRVAYRHSL z2491_519     61  KEIPLDVPSQVCITRDNTQLTVDGIIYFQVTDPKLASYGSSNYIMAITQLAQTTLRSVIG
zv26_519      61  KEIPLDVPSQVCITRDNTQLTVDGIIYFQVTDPKLASYGSSNYIMAITQLAQTTLRSVIG
zv22_519ass   61  KEIPLDVPSQVCITRDNTQLTVDGIIYFQVTDPKLASYGSSNYIMAITQLAQTTLRSVIG
fa1090_519    61  KEIPLDVPSQVCITRDNTQLTVDGIIYFQVTDPKLASYGSSNYIMAITQLAQTTLRSVIG
zv32_519      61  KEIPLDVPSQVCITRDNTQLTVDGIIYFQVTDPKLASYGSSNYIMAITQLAQTTLRSVIG
zv11_519      61  KEIPLDVPSQVCITRDNTQLTVDGIIYFQVTDPKLASYGSSNYIMAITQLAQTTLRSVIG
zv28_519      61  KEIPLDVPSQVCITRDNTQLTVDGIIYFQVTDPKLASYGSSNYIMAITQLAQTTLRSVIG
zv96_519      61  KEIPLDVPSQVCITRDNTQLTVDGIIYFQVTDPKLASYGSSNYIMAITQLAQTTLRSVIG
zv02_519      61  KEIPLDVPSQVCITRDNTQLTVDGIIYFQVTDPKLASYGSSNYIMAITQLAQTTLRSVIG
zv03_519      61  KEIPLDVPSQVCITRDNTQLTVDGIIYFQVTDPKLASYGSSNYIMAITQLAQTTLRSVIG
zv04_519      61  KEIPLDVPSQVCITRDNTQLTVDGIIYFQVTDPKLASYGSSNYIMAITQLAQTTLRSVIG
zv05_519      61  KEIPLDVPSQVCITRDNTQLTVDGIIYFQVTDPKLASYGSSNYIMAITQLAQTTLRSVIG
zv01_519      61  KEIPLDVPSQVCITRDNTQLTVDGIIYFQVTDPKLASYGSSNYIMAITQLAQTTLRSVIG
zv07_519      61  KEIPLDVPSQVCITRDNTQLTVDGIIYFQVTDPKLASYGSSNYIMAITQLAQTTLRSVIG
zv12_519      61  KEIPLDVPSQVCITRDNTQLTVDGIIYFQVTDPKLASYGSSNYIMAITQLAQTTLRSVIG
zv18_519      61  KEIPLDVPSQVCITRDNTQLTVDGIIYFQVTDPKLASYGSSNYIMAITQLAQTTLRSVIG
zv19_519      61  KEIPLDVPSQVCITRDNTQLTVDGIIYFQVTDPKLASYGSSNYIMAITQLAQTTLRSVIG
zv21_519ass   61  KEIPLDVPSQVCITRDNTQLTVDGIIYFQVTDPKLASYGSSNYIMAITQLAQTTLRSVIG
zv27_519      61  KEIPLDVPSQVCITRDNTQLTVDGIIYFQVTDPKLASYGSSNYIMAITQLAQTTLRSVIG
zv20_519ass   61  KEIPLDVPSQVCITRDNTQLTVDGIIYFQVTDPKLASYGSSNYIMAITQLAQTTLRSVIG
zv06_519ass   61  KEIPLDVPSQVCITRDNTQLTVDGIIYFQVTDPKLASYGSSNYIMAITQLAQTTLRSVIG
zv29_519ass   61  KEIPLDVPSQVCITRDNTQLTVDGIIYFQVTDPKLASYGSSNYIMAITQLAQTTLRSVIG z2491_519    121  RMELDKTFEERDEINSTVVSALDEAAGAWGVKVLRYEIKDLVPPQEILRSMQAQITAERE
zv26_519     121  RMELDKTFEERDEINSTVVAALDEAAGAWGVKVLRYEIKDLVPPQEILRSMQAQITAERE
zv22_519ass  121  RMELDKTFEERDEINSTVVSALDEAAGAWGVKVLRYEIKDLVPPQEILRAMQAQITAERE
fa1090_519   121  RMELDKTFEERDEINSTVVSALDEAAGAWGVKVLRYEIKDLVPPQEILRAMQAQITAERE
zv32_519     121  RMELDKTFEERDEINSTVVAALDEAAGAWGVKVLRYEIKDLVPPQEILRSMQAQITAERE
zv11_519     121  RMELDKTFEERDEINSTVVAALDEAAGAWGVKVLRYEIKDLVPPQEILRSMQAQITAERE
zv28_519     121  RMELDKTFEERDEINSTVVAALDEAAGAWGVKVLRYEIKDLVPPQEILRSMQAQITAERE
zv96_519     121  RMELDKTFEERDEINSTVVSALDEAAGAWGVKVLRYEIKDLVPPQEILRSMQAQITAERE
zv02_519     121  RMELDKTFEERDEINSTVVSALDEAAGAWGVKVLRYEIKDLVPPQEILRSMQAQITAERE
zv03_519     121  RMELDKTFEERDEINSTVVSALDEAAGAWGVKVLRYEIKDLVPPQEILRSMQAQITAERE
zv04_519     121  RMELDKTFEERDEINSTVVSALDEAAGAWGVKVLRYEIKDLVPPQEILRSMQAQITAERE
zv05_519     121  RMELDKTFEERDEINSTVVSALDEAAGAWGVKVLRYEIKDLVPPQEILRSMQAQITAERE
zv01_519     121  RMELDKTFEERDEINSTVVAALDEAAGAWGVKVLRYEIKDLVPPQEILRSMQAQITAERE
zv07_519     121  RMELDKTFEERDEINSTVVAALDEAAGAWGVKVLRYEIKDLVPPQEILRSMQAQITAERE
zv12_519     121  RMELDKTFEERDEINSTVVAALDEAAGAWGVKVLRYEIKDLVPPQEILRSMQAQITAERE
zv18_519     121  RMELDKTFEERDEINSTVVAALDEAAGAWGVKVLRYEIKDLVPPQEILRSMQAQITAERE
zv19_519     121  RMELDKTFEERDEINSTVVAALDEAAGAWGVKVLRYEIKDLVPPQEILRSMQAQITAERE
zv21_519ass  121  RMELDKTFEERDEINSTVVAALDEAAGAWGVKVLRYEIKDLVPPQEILRSMQAQITAERE
zv27_519     121  RMELDKTFEERDEINSTVVAALDEAAGAWGVKVLRYEIKDLVPPQEILRSMQAQITAERE
zv20_519ass  121  RMELDKTFEERDEINSTVVAALDEAAGAWGVKVLRYEIKDLVPPQEILRSMQAQITAERE
zv06_519ass  121  RMELDKTFEERDEINSTVFSALDEAAGAWGVKVLRYEIKDLVPPQEILRSMQAQITAERK
zv29_519ass  121  RMELDKTFEERDEINSIVVSALDEAAGAWGVKVLRYEIKDLVPPQEILRSMQAQITAERE
```

FIG. 22A

```
z2491_519      181  KRARIAESEGRKIEQINLASGQREAEIQQSEGEAQAAVNASNAEKIARINRAKGEAESLR
zv26_519       181  KRARIAESEGRKIEQINLASGQREAEIQQSEGEAQAAVNASNAEKIARINRAKGEAESLR
zv22_519ass    181  KRARIAESEGRKIEQINLASGQREAKIQQSEGEAQAAVNASNAEKIARINRAKGEAESLR
fa1090_519     181  KRARIAESEGRKIEQINLASGQREAEIQQSEGEAQAAVNASNAEKIARINRAKGEAESLR
zv32_519       181  KRARIAESEGRKIEQINLASGQREAEIQQSEGEAQAAVNASNAEKIARINRAKGEAESLR
zv11_519       181  KRARIAESEGRKIEQINLASGQREAEIQQSEGEAQAAVNASNAEKIARINRAKGEAESLR
zv28_519       181  KRARIAESEGRKIEQINLASGQREAEIQQSEGEAQAAVNASNAEKIARINRAKGEAESLR
zv96_519       181  KRARIAESEGRKIEQINLASGQREAEIQQSEGEAQAAVNASNAEKIARINRAKGEAESLR
zv02_519       181  KRARIAESEGRKIEQINLASGQREAEIQQSEGEAQAAVNASNAEKIARINRAKGEAESLR
zv03_519       181  KRARIAESEGRKIEQINLASGQREAEIQQSEGEAQAAVNASNAEKIARINRAKGEAESLR
zv04_519       181  KRARIAESEGRKIEQINLASGQREAEIQQSEGEAQAAVNASNAEKIARINRAKGEAESLR
zv05_519       181  KRARIAESEGRKIEQINLASGQREAEIQQSEGEAQAAVNASNAEKIARINRAKGEAESLR
zv01_519       181  KRARIAESEGRKIEQINLASGQREAEIQQSEGEAQAAVNASNAEKIARINRAKGEAESLR
zv07_519       181  KRARIAESEGRKIEQINLASGQREAEIQQSEGEAQAAVNASNAEKIARINRAKGEAESLR
zv12_519       181  KRARIAESEGRKIEQINLASGQREAEIQQSEGEAQAAVNASNAEKIARINRAKGEAESLR
zv18_519       181  KRARIAESEGRKIEQINLASGQREAEIQQSEGEAQAAVNASNAEKIARINRAKGEAESLR
zv19_519       181  KRARIAESEGRKIEQINLASGQREAEIQQSEGEAQAAVNASNAEKIARINRAKGEAESLR
zv21_519ass    181  KRARIAESEGRKIEQINLASGQREAEIQQSEGEAQAAVNASNAEKIARINRAKGEAESLR
zv27_519       181  KRARIAESEGRKIEQINLASGQREAEIQQSEGEAQAAVNASNAEKIARINRAKGEAESLR
zv20_519ass    181  KRARIAESEGRKIEQINLASGQREAEIQQSEGEAQAAVNASNAEKIARINRAKGEAESLR
zv06_519ass    181  KRARIAESEGRKIEQINLASGQREAEIQQSEGEAQAAVNASNAEKIARINRAKGEAESLR
zv29_519ass    181  KRARIAESEGRKIEQINLASGQREPEIQQSEGEAQAAVNASNAEKIARINRAKGEAESLR z2491_519      241  LVAEANAEAIRQIAAALQTQGGADAVNLKIAEQYVAAFNNLAKESNTLIMPANVADIGSL
zv26_519       241  LVAEANAEAIRQIAAALQTQGGADAVNLKIAEQYVAAFNNLAKESNTLIMPANVADIGSL
zv22_519ass    241  LVAEANAEAIRQIAAALQTQGGADAVNLKIAEQYVAAFNNLAKESNTLIMPANVADIGSL
fa1090_519     241  LVAEANAEAIRQIAAALQTQGGADAVNLKIAEQYVAAFNNLAKESNTLIMPANVADIGSL
zv32_519       241  LVAEANAEAIRQIAAALQTQGGADAVNLKIAEQYVAAFNNLAKESNTLIMPANVADIGSL
zv11_519       241  LVAEANAEAIRQIAAALQTQGGADAVNLKIAEQYVAAFNNLAKESNTLIMPANVADIGSL
zv28_519       241  LVAEANAEAIRQIAAALQTQGGADAVNLKIAEQYVAAFNNLAKESNTLIMPANVADIGSL
zv96_519       241  LVAEANAEAIRQIAAALQTQGGADAVNLKIAEQYVAAFNNLAKESNTLIMPANVADIGSL
zv02_519       241  LVAEANAEAIRQIAAALQTQGGADAVNLKIAEQYVAAFNNLAKESNTLIMPANVADIGSL
zv03_519       241  LVAEANAEAIRQIAAALQTQGGADAVNLKIAEQYVAAFNNLAKESNTLIMPANVADIGSL
zv04_519       241  LVAEANAEAIRQIAAALQTQGGADAVNLKIAEQYVAAFNNLAKESNTLIMPANVADIGSL
zv05_519       241  LVAEANAEAIRQIAAALQTQGGADAVNLKIAEQYVAAFNNLAKESNTLIMPANVADIGSL
zv01_519       241  LVAEANAEAIRQIAAALQTQGGADAVNLKIAEQYVAAFNNLAKESNTLIMPANVADIGSL
zv07_519       241  LVAEANAEAIRQIAAALQTQGGADAVNLKIAEQYVAAFNNLAKESNTLIMPANVADIGSL
zv12_519       241  LVAEANAEAIRQIAAALQTQGGADAVNLKIAEQYVAAFNNLAKESNTLIMPANVADIGSL
zv18_519       241  LVAEANAEAIRQIAAALQTQGGADAVNLKIAEQYVAAFNNLAKESNTLIMPANVADIGSL
zv19_519       241  LVAEANAEAIRQIAAALQTQGGADAVNLKIAEQYVAAFNNLAKESNTLIMPANVADIGSL
zv21_519ass    241  LVAEANAEAIRQIAAALQTQGGADAVNLKIAEQYVAAFNNLAKESNTLIMPANVADIGSL
zv27_519       241  LVAEANAEAIRQIAAALQTQGGADAVNLKIAEQYVAAFNNLAKESNTLIMPANVADIGSL
zv20_519ass    241  LVAEANAEAIRQIAAALQTQGGADAVNLKIAEQYVAAFNNLAKESNTLIMPANVADIGSM
zv06_519ass    241  LVAEANAEAIRQIAAALQTQGGADAVNLKIAEQYVAAFNNLAKESNTLIMPANVADIGSL
zv29_519ass    241  LVAEANAEAIRQIAAALQTQGGADAVNLKIAEQYVAAFNNLAKESNTLIMPANVADIGSL z2491_519      301  ISAGMKIIDSSKTAK*TVVSALDEAAGAWGVKVLRYEIKDLVPPQEILRSMQAQITAERE
zv26_519       301  ISAGMKIIDSSKTAK*TVVAALDEAAGAWGVKVLRYEIKDLVPPQEILRSMQAQITAERE
zv22_519ass    301  ISAGMKIIDSSKTAK*TVVSALDEAAGAWGVKVLRYEIKDLVPPQEILRSMQAQITAERE
fa1090_519     301  ISAGMKIIDSSKTAK*TVVSALDEAAGAWGVKVLRYEIKDLVPPQEILRAMQAQITAERE
zv32_519       301  ISAGMKIIDSSKTAK*TVVSALDEAAGAWGVKVLRYEIKDLVPPQEILRAMQAQITAERE
zv11_519       301  ISAGMKIIDSSKTAK*TVVAALDEAAGAWGVKVLRYEIKDLVPPQEILRSMQAQITAERE
zv28_519       301  ISAGMKIIDSSKTAK*TVVAALDEAAGAWGVKVLRYEIKDLVPPQEILRSMQAQITAERE
zv96_519       301  ISAGMKIIDSSKTAK*TVVAALDEAAGAWGVKVLRYEIKDLVPPQEILRSMQAQITAERE
zv02_519       301  ISAGMKIIDSSKTAK*TVVSALDEAAGAWGVKVLRYEIKDLVPPQEILRSMQAQITAERE
zv03_519       301  ISAGMKIIDSSKTAK*TVVSALDEAAGAWGVKVLRYEIKDLVPPQEILRSMQAQITAERE
zv04_519       301  ISAGMKIIDSSKTAK*TVVSALDEAAGAWGVKVLRYEIKDLVPPQEILRSMQAQITAERE
zv05_519       301  ISAGMKIIDSSKTAK*TVVSALDEAAGAWGVKVLRYEIKDLVPPQEILRSMQAQITAERE
zv01_519       301  ISAGMKIIDSSKTAK*TVVAALDEAAGAWGVKVLRYEIKDLVPPQEILRSMQAQITAERE
zv07_519       301  ISAGMKIIDSSKTAK*TVVSALDEAAGAWGVKVLRYEIKDLVPPQEILRSMQAQITAERE
zv12_519       301  ISAGMKIIDSSKTAK*TVVAALDEAAGAWGVKVLRYEIKDLVPPQEILRSMQAQITAERE
zv18_519       301  ISAGMKIIDSSKTAK*TVVAALDEAAGAWGVKVLRYEIKDLVPPQEILRSMQAQITAERE
zv19_519       301  ISAGMKIIDSSKTAK*TVVAALDEAAGAWGVKVLRYEIKDLVPPQEILRSMQAQITAERE
zv21_519ass    301  ISAGMKIIDSSKTAK*TVVAALDEAAGAWGVKVLRYEIKDLVPPQEILRSMQAQITAERE
zv27_519       301  ISAGMKIIDSSKTAK*TVVAALDEAAGAWGVKVLRYEIKDLVPPQEILRSMQAQITAERE
zv20_519ass    301  ISAGMKIIDSSKTAK*TVVAALDEAAGAWGVKVLRYEIKDLVPPQEILRSMQAQITAERE
zv06_519ass    301  ISAGMKIIDSSKTAK*TVFSALDEAAGAWGVKVLRYEIKDLVPPQEILRSMQAQITAERK
zv29_519ass    301  ISAGMKIIDSNKTAK*IVVSALDEAAGAWGVKVLRYEIKDLVPPQEILRSMQAQITAERE
```

FIG. 22B

```
fa1090      1  MKKHLLRSALYGIAAAILAACQSRSIQTFPQPDTSVINGPDRPAGIPDPAGTTVAGGGAV
zm33asbc    1  MKKHLLRSALYGIAAAILAACQSRSIQTFPQPDTSVINGPDRPAGIPDPAGTTVAGGGAV
zm32asbc    1  MKKHLLRSALYGIAAAILAACQSRSIQTFPQPDTSVINGPDRPAGIPDPAGTTVAGGGAV
zm23asbc    1  MKKYLFRAALYGIAAAILAACQSKSIQTFPQPDTSVINGPDRPVGIPDPAGTTVGGGGAV
zm27bc      1  MKKYLFRAALYGISAAILAACQSKSIQTFPQPDTSVINGPDRPAGIPDPAGTTVAGGGAV
zm09        1  MKKYLFRAALCGIAAAILAACQSKSIQTFPQPDTSVINGPDRPVGIPAPAGTTVAGGGAV
zm10        1  MKKYLFRAALCGIAAAILAACQSKSIQTFPQPDTSVINGPDRPVGIPAPAGTTVAGGGAV
zm24        1  MKKYLFRAALCGIAAAILAACQSKSIQTFPQPDTSVINGPDRPVGIPAPAGTTVAGGGAV
zm25        1  MKKYLFRAALCGIAAAILAACQSKSIQTFPQPDTSVINGPDRPVGIPAPAGTTVAGGGAV
zm14        1  MKKYLFRAALCGIAAAILAACQSKSIQTFPQPDTSVINGPDRPVGIPAPAGTTVAGGGAV
zm04        1  MKKYLFRAALCGIAAAILAACQSKSIQTFPQPDTSVINGPDRPVGIPAPAGTTVAGGGAV
zm11asbc    1  MKKYLFRAALCGIAAAILAACQSKSIQTFPQPDTSVINGPDRPVGIPAPAGTTVGGGGAV
zm08n       1  MKKYLFRAALYGIAAAILAACQSKSIQTFPQPDTSVINGPDRPVGIPDPAGTTVGGGGAV
zm96        1  MKKYLFRAALYGIAAAILAACQSKSIQTFPQPDTSVINGPDRPVGIPDPAGTTVGGGGAV
zm01        1  MKKYLFRAALYGIAAAILAACQSKSIQTFPQPDTSVINGPDRPVGIPDPAGTTVGGGGAV
zm02        1  MKKYLFRAALYGIAAAILAACQSKSIQTFPQPDTSVINGPDRPVGIPDPAGTTVGGGGAV
zm03        1  MKKYLFRAALYGIAAAILAACQSKSIQTFPQPDTSVINGPDRPVGIPDPAGTTVGGGGAV
zm07        1  MKKYLFRAALYGIAAAILAACQSKSIQTFPQPDTSVINGPDRPVGIPDPAGTTVGGGGAV
zm12        1  MKKYLFRAALYGIAAAILAACQSKSIQTFPQPDTSVINGPDRPVGIPDPAGTTVGGGGAV
zm18        1  MKKYLFRAALYGIAAAILAACQSKSIQTFPQPDTSVINGPDRPVGIPDPAGTTVGGGGAV
zm19        1  MKKYLFRAALYGIAAAILAACQSKSIQTFPQPDTSVINGPDRPVGIPDPAGTTVGGGGAV
zm20        1  MKKYLFRAALYGIAAAILAACQSKSIQTFPQPDTSVINGPDRPVGIPDPAGTTVGGGGAV
zm21        1  MKKYLFRAALYGIAAAILAACQSKSIQTFPQPDTSVINGPDRPVGIPDPAGTTVGGGGAV
zm06        1  MKKYLFRAALYGIAAAILAACQSKSIQTFPQPDTSVINGPDRPVGIPDPAGTTVGGGGAV
zm17        1  MKKYLFRAALYGIAAAILAACQSKSIQTFPQPDTSVINGPDRPVGIPDPAGTTVGGGGAV
zm13        1  MKKYLFRAALYGIAAAILAACQSKSIQTFPQPDTSVINGPDRPVGIPDPAGTTVGGGGAV
zm05        1  MKKYLFRAALYGIAAAILAACQSKSIQTFPQPDTSVINGPDRPVGIPDPAGTTVGGGGAV
z2491       1  MKKYLFRAALCGIAAAILAACQSKSIQTFPQPDTSVINGPDRPVGIPDPAGTTVGGGGAV
zm22        1  MKKYLFRAALYGIAAAILAACQSKSIQTFPQPDTSVINGPDRPVGIPDPAGTTVGGGGAV
zm26        1  MKKYLFRAALYGIAAAILAACQSKSIQTFPQPDTSVINGPDRPVGIPDPAGTTVGGGGAV
zm28        1  MKKYLFRAALCGIAAAILAACQSKSIQTFPQPDTSVINGPDRPVGIPDPAGTTVGGGGAV
zm29asbc    1  MKKYLFRAALCGIAAAILAACQSKSIQTFPQPDTSVINGPDRPVGIPDPAGTTVGGGGAV
zm16        1  MKKYLFRAALCGIAAAILAACQSKSIQTFPQPDTSVINGPGRPVGIPDPAGTTVGGGGAV
zm15        1  MKKYLFRAALYGIAAAILAACQSKSIQTFPQPDTSVINGPDRPVGIPDLAGTTVGGGGAV
zm31asbc    1  MKRHLFRAALYGIAAAILAACQSKSIQTFPQPDTSIIKGPDRPAGIPDPAGTTVGGGGAV fa1090     61  YTVVPHLSMPHWAAQDFAKSLQSFRLGCANLKNRQGWQDVCAQAFQTPVHSFQAKRFFER
zm33asbc   61  YTVVPHLSMPHWAAQDFAKSLQSFRLGCANLKNRQGWQDVCAQAFQTPIHSFQAKRFFER
zm32asbc   61  YTVVPHLSMPHWAAQDFAKSLQSFRLGCANLKNRQGWQDVCAQAFQTPVHSFQAKQFFER
zm23asbc   61  YTVVPHLSLPHWAAQDFAKSLQSFRLGCANLKNRQGWQDVCAQAFQTPVHSFQAKQFFER
zm27bc     61  YTVVPHLSLPHWAAQDFAKSLQSFRLGCANLKNRQGWQDVCAQAFQTPVHSFQAKQFFER
zm09       61  YTVVPHLSLPHWAAQDFAKSLQSFRLGCANLKNRQGWQDVCAQAFQTPVHSFQAKQFFER
zm10       61  YTVVPHLSLPHWAAQDFAKSLQSFRLGCANLKNRQGWQDVCAQAFQTPVHSFQAKQFFER
zm24       61  YTVVPHLSLPHWAAQDFAKSLQSFRLGCANLKNRQGWQDVCAQAFQTPVHSFQAKQFFER
zm25       61  YTVVPHLSLPHWAAQDFAKSLQSFRLGCANLKNRQGWQDVCAQAFQTPVHSFQAKQFFER
zm14       61  YTVVPHLSLPHWAAQDFAKSLQSFRLGCANLKNRQGWQDVCAQAFQTPVHSFQAKQFFER
zm04       61  YTVVPHLSLPHWAAQDFAKSLQSFRLGCANLKNRQGWQDVCAQAFQTPVHSFQAKQFFER
zm11asbc   61  YTVVPHLSLPHWAAQDFAKSLQSFRLGCANLKNRQGWQDVCAQAFQTPVHSVQAKQFFER
zm08n      61  YTVVPHLSLPHWAAQDFAKSLQSFRLGCANLKNRQGWQDVCAQAFQTPVHSFQAKQFFER
zm96       61  YTVVPHLSLPHWAAQDFAKSLQSFRLGCANLKNRQGWQDVCAQAFQTPVHSFQAKQFFER
zm01       61  YTVVPHLSLPHWAAQDFAKSLQSFRLGCANLKNRQGWQDVCAQAFQTPVHSFQAKQFFER
zm02       61  YTVVPHLSLPHWAAQDFAKSLQSFRLGCANLKNRQGWQDVCAQAFQTPVHSFQAKQFFER
zm03       61  YTVVPHLSLPHWAAQDFAKSLQSFRLGCANLKNRQGWQDVCAQAFQTPVHSFQAKQFFER
zm07       61  YTVVPHLSLPHWAAQDFAKSLQSFRLGCANLKNRQGWQDVCAQAFQTPVHSFQAKQFFER
zm12       61  YTVVPHLSLPHWAAQDFAKSLQSFRLGCANLKNRQGWQDVCAQAFQTPVHSFQAKQFFER
zm18       61  YTVVPHLSLPHWAAQDFAKSLQSFRLGCANLKNRQGWQDVCAQAFQTPVHSFQAKQFFER
zm19       61  YTVVPHLSLPHWAAQDFAKSLQSFRLGCANLKNRQGWQDVCAQAFQTPVHSFQAKQFFER
zm20       61  YTVVPHLSLPHWAAQDFAKSLQSFRLGCANLKNRQGWQDVCAQAFQTPVHSFQAKQFFER
zm21       61  YTVVPHLSLPHWAAQDFAKSLQSFRLGCANLKNRQGWQDVCAQAFQTPVHSFQAKQFFER
zm06       61  YTVVPHLSLPHWAAQDFAKSLQSFRLGCANLKNRQGWQDVCAQAFQTPVHSFQAKQFFER
zm17       61  YTVVPHLSLPHWAAQDFAKSLQSFRLGCANLKNRQGWQDVCAQAFQTPVHSFQAKQFFER
zm13       61  YTVVPHLSLPHWAEQDFAKSLQSFRLGCANLKNRQGWQDVCAQAFQTPVHSFQAKQFFER
zm05       61  YTVVPHLSLPHWAAQDFAKSLQSFRLSCANLKNRQGWQDVCAQAFQTPVHSFQAKQFFER
z2491      61  YTVVPHLSLPHWAAQDFAKSLQSFRLGCANLKNRQGWQDVCAQAFQTPVHSVQAKQFFER
zm22       61  YTVVPHLSLPHWAAQDFAKSLQSFRLGCANLKNRQGWQDVCAQAFQTPVHSVQAKQFFER
zm26       61  YTVVPHLSLPHWAAQDFAKSLQSFRLGCANLKNRQGWQDVCAQAFQTPVHSFQAKQFFER
zm28       61  YTVVPHLSLPHWAAQDFAKSLQSFRLGCANLKNRQGWQDVCAQAFQTPVHSFQAKQFFER
zm29asbc   61  YTVVPHLSLPHWAAQDFAKSLQSFRLGCANLKNRQGWQDVCAQAFQTPVHSFQAKQFFER
zm16       61  YTVVPHLSLPHWAAQDFAKSLQSFRLGCANLKNRQGWQDVCAQAFQTPVHSFQAKQFFER
zm15       61  YTVVPHLSLPHWAAQDFAKSLQSFRLGCANLKNHQGWQDVCAQAFQTPVHSFQAKQFFER
zm31asbc   61  YTVVPHLSLPHWAAQDFAKSLQSFRLGCANLKNRQGWQDVCAQAFQTPVHSFQAKQFFER
```

FIG. 23A

```
fa1090     121 YFTPWQVAGNGSLAGTVTGYYEPVLKGDGRRTERARFPIYGIPDDFISVPLPAGLRGGKN
zm33asbc   121 YFTPWQVAGNGSLAGTVTGYYEPVLKGDGRRTERARFPIYGIPDDFISVPLPAGLRGGKN
zm32asbc   121 YFTPWQVAGNGSLAGTVTGYYEPVLKGDGRRTERARFPIYGIPDDFISVPLPAGLRGGKA
zm23asbc   121 YFTPWQVAGNGSLAGTVTGYYEPVLKGDDRRTAQARFPIYGIPDDFISVPLPAGLRSGKA
zm27bc     121 YFTPWQVAGNGSLAGTVTGYYEPVLKGDDRRTAQARFPIYGIPDDFISVPLPAGLRSGKA
zm09       121 YFTPWQVAGNGSLAGTVTGYYEPVLKGDDRRTAQARFPIYGIPDDFISVPLPAGLRSGKA
zm10       121 YFTPWQVAGNGSLAGTVTGYYEPVLKGDDRRTAQARFPIYGIPDDFISVPLPAGLRSGKA
zm24       121 YFTPWQVAGNGSLAGTVTGYYEPVLKGDDRRTAQARFPIYGIPDDFISVPLPAGLRSGKA
zm25       121 YFTPWQVAGNGSLAGTVTGYYEPVLKGDDRRTAQARFPIYGIPDDFISVPLPAGLRSGKA
zm14       121 YFTPWQVAGNGSLAGTVTGYYEPVLKGDDRRTAQARFPIYGIPDDFISVPLPAGLRSGKA
zm04       121 YFTPWQVAGNGSLAGTVTGYYEPVLKGDDRRTAQARFPIYGIPDDFISVPLPAGLRSGKA
zm11asbc   121 YFTPWQVAGNGSLAGTVTGYYEPVLKGDDRRTAQARFPIYGIPDDFISVPLPAGLRSGKA
zm08n      121 YFTPWQVAGNGSLAGTVTGYYEPVLKGDDRRTAQARFPIYGIPDDFISVPLPAGLRSGKA
zm96       121 YFTPWQVAGNGSLAGTVTGYYEPVLKGDDRRTAQARFPIYGIPDDFISVPLPAGLRSGKA
zm01       121 YFTPWQVAGNGSLAGTVTGYYEPVLKGDDRRTAQARFPIYGIPDDFISVPLPAGLRSGKA
zm02       121 YFTPWQVAGNGSLAGTVTGYYEPVLKGDDRRTAQARFPIYGIPDDFISVPLPAGLRSGKA
zm03       121 YFTPWQVAGNGSLAGTVTGYYEPVLKGDDRRTAQARFPIYGIPDDFISVPLPAGLRSGKA
zm07       121 YFTPWQVAGNGSLAGTVTGYYEPVLKGDDRRTAQARFPIYGIPDDFISVPLPAGLRSGKA
zm12       121 YFTPWQVAGNGSLAGTVTGYYEPVLKGDDRRTAQARFPIYGIPDDFISVPLPAGLRSGKA
zm18       121 YFTPWQVAGNGSLAGTVTGYYEPVLKGDDRRTAQARFPIYGIPDDFISVPLPAGLRSGKA
zm19       121 YFTPWQVAGNGSLAGTVTGYYEPVLKGDDRRTAQARFPIYGIPDDFISVPLPAGLRSGKA
zm20       121 YFTPWQVAGNGSLAGTVTGYYEPVLKGDDRRTAQARFPIYGIPDDFISVPLPAGLRSGKA
zm21       121 YFTPWQVAGNGSLAGTVTGYYEPVLKGDDRRTAQARFPIYGIPDDFISVPLPAGLRSGKA
zm06       121 YFTPWQVAGNGSLAGTVTGYYEPVLKGDDRRTAQARFPIYGIPDDFISVPLPAGLRSGKA
zm17       121 YFTPWQVAGNGSLAGTVTGYYEPVLKGDDRRTAQARFPIYGIPDDFISVPLPAGLRSGKA
zm13       121 YFTPWQVAGNGSLAGTVTGYYEPVLKGDDRRTAQARFPIYGIPDDFISVPLPAGLRSGKA
zm05       121 YFTPWQVAGNGSLAGTVTGYYEPVLKGDDRRTAQARFPIYGIPDDFISVPLPAGLRSGKA
z2491      121 YFTPWQVAGNGSLAGTVTGYYEPVLKGDDRRTAQARFPIYGIPDDFISVPLPAGLRSGKA
zm22       121 YFTPWQVAGNGSLAGTVTGYYEPVLKGDDRRTAQARFPIYGIPDDFISVPLPAGLRSGKA
zm26       121 YFTPWQVAGNGSLAGTVTGYYEPVLKGDDRRTAQARFPIYGIPDDFISVPLPAGLRSGKA
zm28       121 YFTPWQVAGNGSLAGTVTGYYEPVLKGDDRRTAQARFPIYGIPDDFISVPLPAGLRSGKA
zm29asbc   121 YFTPWQVAGNGSLAGTVTGYYEPVLKGDDRRTAQARFPIYGIPDDFISVPLPAGLRSGKA
zm16       121 YFTPWQVAGNGSLAGTVTGYYEPVLKGDDRRTAQARFPIYGIPDDFISVPLPAGLRSGKA
zm15       121 YFTPWQVAGNGSLAGTVTGYYEPVLKGDDRRTAQARFPIYGIPDDFISVPLPAGLRSGKA
zm31asbc   121 YFTPWQVAGNGSLAGTVTGYYEPVLKGDDRRTAQARFPIYGIPDDFISVPLPAGLRSGKA fa1090     181 LVRIRQTGKNSGTIDNAGGTHTADLSRFPITARTTAIKGRFEGSRFLPYHTRNQINGGAL
zm33asbc   181 LVRIRQTGKNSGTIDNAGGTHTADLSRFPITARTTAIKGRFEGSRFLPYHTRNQINGGAL
zm32asbc   181 LVRIRQTGKNSGTIDNAGGTHTADLSRFPITARTTAIKGRFEGSRFLPYHTRNQINGGAL
zm23asbc   181 LVRIRQTGKNSGTIDNAGGTHTADLSRFPITARTTAIKGRFEGSRFLPYHTRNQINGGAL
zm27bc     181 LVRIRQTGKNSGTIDNAGGTHTADLSRFPITARTTAIKGRFEGSRFLPYHTRNQINGGAL
zm09       181 LVRIRQTGKNSGTIDNTGGTHTADLSQFPITARTTAIKGRFEGSRFLPYHTRNQINGGAL
zm10       181 LVRIRQTGKNSGTIDNTGGTHTADLSQFPITARTTAIKGRFEGSRFLPYHTRNQINGGAL
zm24       181 LVRIRQTGKNSGTIDNTGGTHTADLSQFPITARTTAIKGRFEGSRFLPYHTRNQINGGAL
zm25       181 LVRIRQTGKNSGTIDNTGGTHTADLSQFPITARTTAIKGRFEGSRFLPYHTRNQINGGAL
zm14       181 LVRIRQTGKNSGTIDNAGGTHTADLSRFPITARTTAIKGRFEGSRFLPYHTRNQINGGAL
zm04       181 LVRIRQTGKNSGTIDNAGGTHTADLSRFPITARTTAIKGRFEGSRFLPYHTRNQINGGAL
zm11asbc   181 LVRIRQTGKNSGTIDNAGGTHTADLSRFPITARTTAIKGRFEGSRFLPYHTRNQINGGAL
zm08n      181 LVRIRQTGKNSGTIDNTGGTHTADLSRFPITARTTAIKGRFEGSRFLPYHTRNQINGGAL
zm96       181 LVRIRQTGKNSGTIDNTGGTHTADLSRFPITARTTAIKGRFEGSRFLPYHTRNQINGGAL
zm01       181 LVRIRQTGKNSGTIDNTGGTHTADLSRFPITARTTAIKGRFEGSRFLPYHTRNQINGGAL
zm02       181 LVRIRQTGKNSGTIDNTGGTHTADLSRFPITARTTAIKGRFEGSRFLPYHTRNQINGGAL
zm03       181 LVRIRQTGKNSGTIDNTGGTHTADLSRFPITARTTAIKGRFEGSRFLPYHTRNQINGGAL
zm07       181 LVRIRQTGKNSGTIDNTGGTHTADLSRFPITARTTAIKGRFEGSRFLPYHTRNQINGGAL
zm12       181 LVRIRQTGKNSGTIDNTGGTHTADLSRFPITARTTAIKGRFEGSRFLPYHTRNQINGGAL
zm18       181 LVRIRQTGKNSGTIDNTGGTHTADLSRFPITARTTAIKGRFEGSRFLPYHTRNQINGGAL
zm19       181 LVRIRQTGKNSGTIDNTGGTHTADLSRFPITARTTAIKGRFEGSRFLPYHTRNQINGGAL
zm20       181 LVRIRQTGKNSGTIDNTGGTHTADLSRFPITARTTAIKGRFEGSRFLPYHTRNQINGGAL
zm21       181 LVRIRQTGKNSGTIDNTGGTHTADLSRFPITARTTAIKGRFEGSRFLPYHTRNQINGGAL
zm06       181 LVRIRQTGKNSGTIDNTGGTHTADLSRFPITARTTAIKGRFEGSRFLPYHTRNQINGGAL
zm17       181 LVRIRQTGKNSGTIDNTGGTHTADLSRFPITARTTAIKGRFEGSRFLPYHTRNQINGGAL
zm13       181 LVRIRQTGKNSGTIDNTGGTHTADLSRFPITARTTAIKGRFEGSRFLPYHTRNQINGGAL
zm05       181 LVRIRQTGKNSGTIDNTGGTHTADLSRFPITARTTAIKGRFEGSRFLPYHTRNQINGGAL
z2491      181 LVRIRQTGKNSGTIDNTGGTHTADLSQPPITARTTAIKGRFEGSRFLPYHTRNQINGGAL
zm22       181 LVRIRQTGKNSGTIDNTGGTHTADLSQPPITARTTAIKGRFEGSRFLPYHTRNQINGGAL
zm26       181 LVRIRQTGKNSGTIDNTGGTHTADLSQFPITARTTAIKGRFEGSRFLPYHTRNQINGGAL
zm28       181 LVRIRQTGKNSGTIDNTGGTHTADLSQPPITARTTAIKGRFEGSRFLPYHTRNQINGGAL
zm29asbc   181 LVRIRQTGKNSGTIDNTGGTHTADLSQPPITARTTAIKGRFEGSRFLPYHTRNQINGGAL
zm16       181 LVRIRQTGKNSGTIDNTGGTHTADLSQPPITARTTAIKGRFEGSRFLPYHTRNQINGGAL
zm15       181 LVRIRQTGKNSGTIDNTGGTHTADLSRFPITARTTAIKGRFEGSRFLPYHTRNQINGGAL
zm31asbc   181 LVRIRQTGKNSGTIDNAGGTHTADLSRFPITARTTAIKGRFEGSRFLPYHTRNQINGGAL
```

FIG. 23B

```
fa1090     241  DGKAPILGYAEDPVELFFMHIQGSGRLKTPSGKYIRIGYADKNEHPYVSIGRYMADKGYL
zm33asbc   241  DGKAPILGYAEDPVELFFMHIQGSGRLKTPSGKYIRIGYADKNEHPYVSIGRYMADKGYL
zm32asbc   241  DGKAPILGYAEDPVELFFMHIQGSGRLKTPSGKYIRIGYADKNEHPYVSIGRYMADKGYL
zm23asbc   241  DGKAPILGYAEDPVELFFMHIQGSGRLKTPSGKYIRIGYADKNEHPYVSIGRYMADKGYL
zm27bc     241  DGKAPILGYAEDPVELFFMHIQGSGRLKTPSGKYIRIGYADKNEHPYVSIGKYMADKGYL
zm09       241  DGKAPILGYAEDPVELFFMHIQGSGRLKTPSGKYIRIGYADKNEHPYVSIGKYMADKGYL
zm10       241  DGKAPILGYAEDPVELFFMHIQGSGRLKTPSGKYIRIGYADKNEHPYVSIGKYMADKGYL
zm24       241  DGKAPILGYAEDPVELFFMHIQGSGRLKTPSGKYIRIGYADKNEHPYVSIGRYMADKGYL
zm25       241  DGKAPILGYAEDPVELFFMHIQGSGRLKTPSGKYIRIGYADKNEHPYVSIGKYMADKGYL
zm14       241  DGKAPILGYAEDPVELFFMHIQGSGRLKTPSGKYIRIGYADKNEHPYVSIGKYMADKGYL
zm04       241  DGKAPILGYAEDPVELFFMHIQGSGRLKTPSGKYIRIGYADKNEHPYVSIGRYMADKGYL
zm11asbc   241  DGKAPILGYAEDPVELFFMHIQGSGRLKTPSGKYIRIGYADKNEHPYVSIGKYMADKGYL
zm08n      241  DGKAPILGYAEDPVELFFMHIQGSGRLKTPSGKYIRIGYADKNEHPYVSIGRYMADKGYL
zm96       241  DGKAPILGYAEDPVELFFMHIQGSGRLKTPSGKYIRIGYADKNEHPYVSIGRYMADKGYL
zm01       241  DGKAPILGYAEDPVELFFMHIQGSGRLKTPSGKYIRIGYADKNEHPYVSIGRYMADKGYL
zm02       241  DGKAPILGYAEDPVELFFMHIQGSGRLKTPSGKYIRIGYADKNEHPYVSIGRYMADKGYL
zm03       241  DGKAPILGYAEDPVELFFMHIQGSGRLKTPSGKYIRIGYADKNEHPYVSIGRYMADKGYL
zm07       241  DGKAPILGYAEDPVELFFMHIQGSGRLKTPSGKYIRIGYADKNEHPYVSIGRYMADKGYL
zm12       241  DGKAPILGYAEDPVELFFMHIQGSGRLKTPSGKYIRIGYADKNEHPYVSIGRYMADKGYL
zm18       241  DGKAPILGYAEDPVELFFMHIQGSGRLKTPSGKYIRIGYADKNEHPYVSIGRYMADKGYL
zm19       241  DGKAPILGYAEDPVELFFMHIQGSGRLKTPSGKYIRIGYADKNEHPYVSIGRYMADKGYL
zm20       241  DGKAPILGYAEDPVELFFMHIQGSGRLKTPSGKYIRIGYADKNEHPYVSIGRYMADKGYL
zm21       241  DGKAPILGYAEDPVELFFMHIQGSGRLKTPSGKYIRIGYADKNEHPYVSIGRYMADKGYL
zm06       241  DGKAPILGYAEDPVELFFMHIQGSGRLKTPSGKYIRIGYADKNEHPYVSIGKYMADKGYL
zm17       241  DGKAPILGYAEDPVELFFMHIQGSGRLKTPSGKYIRIGYADKNEHPYVSIGKYMADKGYL
zm13       241  DGKAPILGYAEDPVELFFMHIQGSGRLKTPSGKYIRIGYADKNEHPYVSIGRYMADKGYL
zm05       241  DGKAPILGYAEDPVELFFMHIQGSGRLKTPSGKYIRIGYADKNEHPYVSIGRYMADKGYL
z2491      241  DGKAPILGYAEDPVELFFMHIQGSGRLKTPSGKYIRIGYADKNEHPYVSIGRYMADKGYL
zm22       241  DGKAPILGYAEDPVELFFMHIQGSGRLKTPSGKYIRIGYADKNEHPYVSIGRYMADKGYL
zm26       241  DGKAPILGYAEDPVELFFMHIQGSGRLKTPSGKYIRIGYADKNEHPYVSIGRYMADKGYL
zm28       241  DGKAPILGYAEDPVELFFMHIQGSGRLKTPSGKYIRIGYADKNEHPYVSIGRYMADKGYL
zm29asbc   241  DGKAPILGYAEDPVELFFMHIQGSGRLKTPSGKYIRIGYADKNEHPYVSIGRYMADKGYL
zm16       241  DGKAPILGYAEDPVELFFMHIQGSGRLKTPSGKYIRIGYADKNEHPYVSIGKYMADKGYL
zm15       241  DGKAPILGYAEDPVELFFMHIQGSGRLKTPSGKYIRIGYADKNEHPYVSIGRYMADKGYL
zm31asbc   241  DGKAPILGYAEDPVELFFMHIQGSGRLKTPSGKYIRIGYADKNEHPYVSIGRYMADKGYL fa1090     301  KLGQTSMQGIKAYMRQNPQRLAEVLGQNPSYIFFRELAGSCNEGPVGALGTPLMCEYACA
zm33asbc   301  KLGQTSMQGIKSYMRQNPEKLAEVLGQNPSYIFFRELAGSNEGPVGALGTPLMGEYAGA
zm32asbc   301  KLGQTSMQGIKAYMRQNPQRLAEVLGQNPSYIFFRELAGSGDGPVGALGTPLMGGYAGA
zm23asbc   301  KLGQTSMQGIKSYMRQNPQRLAEVLGQNPSYIFFRELAGSNDGPVGALGTPLMGEYAGA
zm27bc     301  KLGQTSMQGIKSYMRQNPQRLAEVLGQNPSYIFFRELTGSGNDGPVGALGTPLMGEYAGA
zm09       301  KLGQTSMQGIKSYMRQNPQRLAEVLGQNPSYIFFRELTGSCNDGPVGALGTPLMGEYAGA
zm10       301  KLGQTSMQGIKSYMRQNPQRLAEVLGQNPSYIFFRELTGSCNDGPVGALGTPLMGEYAGA
zm24       301  KLGQTSMQGIKSYMRQNPQRLAEVLGQNPSYIFFRELTGSCNDGPVGALGTPLMGEYAGA
zm25       301  KLGQTSMQGIKSYMRQNPQRLAEVLGQNPSYIFFRELTGSRNDGPVGALGTPLMGEYAGA
zm14       301  KLGQTSMQGIKSYMRQNPQRLAEVLGQNPSYIFFRELTGSRNDGPVGALGTPLMGEYAGA
zm04       301  KLGQTSMQGIKAYMQQNPQRLAEVLGQNPSYIFFRELTGSSNDGPVGALGTPLMGEYAGA
zm11asbc   301  KLGQTSMQGIKSYMRQNPQRLAEVLGQNPSYIFFRELTGSSNDGPVGALGTPLMGEYAGA
zm08n      301  KLGQTSMQGIKAYMRQNPQRLAEVLGQNPSYIFFRELAGSSNDGPVGALGTPLMGEYAGA
zm96       301  KLGQTSMQGIKAYMRQNPQRLAEVLGQNPSYIFFRELAGSSNDGPVGALGTPLMGEYAGA
zm01       301  KLGQTSMQGIKSYMRQNPQRLAEVLGQNPSYIFFRELAGSSNDGPVGALGTPLMGEYAGA
zm02       301  KLGQTSMQGIKSYMRQNPQRLAEVLGQNPSYIFFRELAGSSNDGPVGALGTPLMGEYAGA
zm03       301  KLGQTSMQGIKSYMRQNPQRLAEVLGQNPSYIFFRELAGSSNDGPVGALGTPLMGEYAGA
zm07       301  KLGQTSMQGIKSYMRQNPQRLAEVLGQNPSYIFFRELAGSSNDGPVGALGTPLMGEYAGA
zm12       301  KLGQTSMQGIKSYMRQNPQRLAEVLGQNPSYIFFRELAGSSNDGPVGALGTPLMGEYAGA
zm18       301  KLGQTSMQGIKSYMRQNPQRLAEVLGQNPSYIFFRELAGSSNDGPVGALGTPLMGEYAGA
zm19       301  KLGQTSMQGIKSYMRQNPQRLAEVLGQNPSYIFFRELAGSSNDGPVGALGTPLMGEYAGA
zm20       301  KLGQTSMQGIKSYMRQNPQRLAEVLGQNPSYIFFRELAGSSNDGPVGALGTPLMGEYAGA
zm21       301  KLGQTSMQGIKSYMRQNPQRLAEVLGQNPSYIFFRELAGSSNDGPVGALGTPLMGEYAGA
zm06       301  KLGQTSMQGIKSYMRQNPQRLAEVLGQNPSYIFFRELAGSSNDGPVGALGTPLMGEYAGA
zm17       301  KLGQTSMQGIKSYMRQNPQRLAEVLGQNPSYIFFRELTGSSNDGPVGALGTPLMGEYAGA
zm13       301  KLGQTSMQGIKAYMRQNPQRLAEVLGQNPSYIFFRELAGSSNDGPVGALGTPLMGEYAGA
zm05       301  KLGQTSMQGIKAYMRQNPQRLAEVLGQNPSYIFFRELAGSSNDGPVGALGTPLMGEYAGA
z2491      301  KLGQTSMQGIKAYMQQNPQRLAEVLGQNPSYIFFRELTGSSNDGPVGALGTPLMGEYAGA
zm22       301  KLGQTSMQGIKAYMQQNPQRLAEVLGQNPSYIFFRELTGSSNDGPVGALGTPLMGEYAGA
zm26       301  KLGQTSMQGIKAYMQQNPQRLAEVLGQNPSYIFFRELTGSSNDGPVGALGTPLMGEYAGA
zm28       301  KLGQTSMQGIKAYMRQNPQRLAEVLGQNPSYIFFRELAGSSNDGPVGALGTPLMGEYAGA
zm29asbc   301  KLGQTSMQGIKSYMRQNPQRLAEVLGQNPSYIFFRELTGSCNDGPVGALGTPLMGEYAGA
zm16       301  KLGQTSMQGIKSYMRQNPQRLAEVLGQNPSYIFFRELTGSSNDGPVGALGTPLMGEYAGA
zm15       301  KLGQTSMQGIKSYMRQNPQRLAEVLGQNPSYIFFRELTGSSNDGPVGALGTPLMGEYAGA
zm31asbc   301  KLGQTSMQGIKAYMRQNPQRLAEVLGQNPSYVFFRELAGSGNDGPVGALGTPLMGEYAGA
```

FIG. 23C

```
fa1090     361  IDRHYITLGAPLFVATAHPVTRKALNRLIMAQDTGSAIKGAVRVDYFWGYGDEAGELAGK
zm33asbc   361  IDRHYITLGAPLFVATAHPVTRKALNRLIMAQDTGSAIKGAVRVDYFWGYGDEAGELAGK
zm32asbc   361  IDRHYITLGAPLFVATAHPVTRKALNRLIMAQDTGSAIKGAVRVDYFWGYGDEAGELAGK
zm23asbc   361  VDRHYITLGAPLFVATAHPVTSKALNRLIMAQDTGSAIKGAVRVDYFWGYGDEAGETAGK
zm27bc     361  VDRHYITLGAPLFVATAHPVTRKALNRLIMAQDTGSAIKGAVRVDYFWGYGDEAGETAGK
zm09       361  VDRHYITLGAPLFVATAHPVTRKALNRLIMAQDTGSAIKGAVRVDYFWGYGDEAGELAGK
zm10       361  VDRHYITLGAPLFVATAHPVTRKALNRLIMAQDTGSAIKGAVRVDYFWGYGDEAGELAGK
zm24       361  VDRHYITLGAPLFVATAHPVTRKALNRLIMAQDTGSAIKGAVRVDYFWGYGDEAGELAGK
zm25       361  VDRHYITLGAPLFVATAHPVTRKALNRLIMAQDTGSAIKGAVRVDYFWGYGDEAGELAGK
zm14       361  VDRHYITLGAPLFVATAHPVTRKALNRLIMAQDTGSAIKGAVRVDYFWGYGDEAGELAGK
zm04       361  VDRHYITLGAPLFVATAHPVTRKALNRLIMAQDTGSAIKGAVRVDYFWGYGDEAGELAGK
zm11asbc   361  VDRHYITLGAPLFVATAHPVTRKALNRLIMAQDTGSAIKGAVRVDYFWGYGDEAGELAGK
zm08n      361  VDRHYITLGAPLFVATAHPVTRKALNRLIMAQDTGSAIKGAVRVDYFWGYGDEAGELAGK
zm96       361  VDRHYITLGAPLFVATAHPVTRKALNRLIMAQDTGSAIKGAVRVDYFWGYGDEAGELAGK
zm01       361  VDRHYITLGAPLFVATAHPVTRKALNRLIMAQDTGSAIKGAVRVDYFWGYGDEAGELAGK
zm02       361  VDRHYITLGAPLFVATAHPVTRKALNRLIMAQDTGSAIKGAVRVDYFWGYGDEAGELAGK
zm03       361  VDRHYITLGAPLFVATAHPVTRKALNRLIMAQDTGSAIKGAVRVDYFWGYGDEAGELAGK
zm07       361  VDRHYITLGAPLFVATAHPVTRKALNRLIMAQDTGSAIKGAVRVDYFWGYGDEAGELAGK
zm12       361  VDRHYITLGAPLFVATAHPVTRKALNRLIMAQDTGSAIKGAVRVDYFWGYGDEAGELAGK
zm18       361  VDRHYITLGAPLFVATAHPVTRKALNRLIMAQDTGSAIKGAVRVDYFWGYGDEAGELAGK
zm19       361  VDRHYITLGAPLFVATAHPVTRKALNRLIMAQDTGSAIKGAVRVDYFWGYGDEAGELAGK
zm20       361  VDRHYITLGAPLFVATAHPVTRKALNRLIMAQDTGSAIKGAVRVDYFWGYGDEAGELAGK
zm21       361  VDRHYITLGAPLFVATAHPVTRKALNRLIMAQDTGSAIKGAVRVDYFWGYGDEAGELAGK
zm06       361  VDRHYITLGAPLFVATAHPVTRKALNRLIMAQDTGSAIKGAVRVDYFWGYGDEAGELAGK
zm17       361  VDRHYITLGAPLFVATAHPVTRKALNRLIMAQDTGSAIKGAVRVDYFWGYGDEAGELAGK
zm13       361  VDRHYITLGAPLFVATAHPVTRKALNRLIMAQDTGSAIKGAVRVDYFWGYGDEAGELAGK
zm05       361  VDRHYITLGAPLFVATAHPVTRKALNRLIMAQDTGSAIKGAVRVDYFWGYGDEAGELAGK
z2491      361  VDRHYITLGAPLFVATAHPVTRKALNRLIMAQDTGSAIKGAVRVDYFWGYGDEAGELAGK
zm22       361  VDRHYITLGAPLFVATAHPVTRKALNRLIMAQDTGSAIKGAVRVDYFWGYGDEAGELAGK
zm26       361  VDRHYITLGAPLFVATAHPVTRKALNRLIMAQDTGSAIKGAVRVDYFWGYGDEAGELAGK
zm28       361  VDRHYITLGAPLFVATAHPVTRKALNRLIMAQDTGSAIKGAVRVDYFWGYGDEAGELAGK
zm29asbc   361  VDRHYITLGAPLFVATTHPITRKALNRLIMAQDTGSAIKGAVRVDYFWGYGDEAGELAGK
zm16       361  VDRHYITLGAPLFVATAHPVTRKALNRLIMAQDTGSAIKGAVRVDYFWGYGDEAGELAGK
zm15       361  VDRHYITLGAPLFVATAHPVTRKALNRLIMAQDTGSAIKGAVRVDYFWGYGDEAGELAGK
zm31asbc   361  VDRHYITLGAPLFVATAHPVTRKALNRLIMAQDTGSAIKGAVRVDYFWGYGDEAGELAGK fa1090     421  QKTTGYVWQLLPNGMKPEYRP*EVLGQNPSYIFFRELAGSCNEGPVGALGTPLMGEYAGA
zm33asbc   421  QKTTGYVWQLLPNGMKPEYRP*EVLGQNPSYIFFRELAGSCNEGPVGALGTPLMGEYAGA
zm32asbc   421  QKTTGYVWQLLPNGMKPEYRP*EVLGQNPSYIFFRELAGSGDGPVGALGTPLMGEYAGA
zm23asbc   421  MKEPGYVWQLLPNGMKPEYRP*EVLGQNPSYIFFRELAGSNDGPVGALGTPLMGEYAGA
zm27bc     421  MKEPGYVWQLLPNGMKPEYRP*EVLGQNPSYIFFRELTGSSNDGPVGALGTPLMGEYAGA
zm09       421  QKTTGYVWQLLPNGMKPEYRP*EVLGQNPSYIFFRELTGSCNDGPVGALGTPLMGEYAGA
zm10       421  QKTTGYVWQLLPNGMKPEYRP*EVLGQNPSYIFFRELTGSCNDGPVGALGTPLMGEYAGA
zm24       421  QKTTGYVWQLLPNGMKPEYRP*EVLGQNPSYIFFRELTGSCNDGPVGALGTPLMGEYAGA
zm25       421  QKTTGYVWQLLPNGMKPEYRP*EVLGQNPSYIFFRELTGSCNDGPVGALGTPLMGEYAGA
zm14       421  QKTTGYVWQLLPNGMKPEYRP*EVLGQNPSYIFFRELTGSRNDGPVGALGTPLMGEYAGA
zm04       421  QKTTGYVWQLLPNGMKPEYRP*EVLGQNPSYIFFRELTGSSNDGPVGALGTPLMGEYAGA
zm11asbc   421  QKTTGYVWQLLPNGMKPEYRP*EVLGQNPSYIFFRELTGSSNDGPVGALGTPLMGEYAGA
zm08n      421  QKTTGYVWQLLPNGMKPEYRP*EVLGQNPSYIFFRELAGSSNDGPVGALGTPLMGEYAGA
zm96       421  QKTTGYVWQLLPNGMKPEYRP*EVLGQNPSYIFFRELAGSSNDGPVGALGTPLMGEYAGA
zm01       421  QKTTGYVWQLLPNGMKPEYRP*EVLGQNPSYIFFRELAGSSNDGPVGALGTPLMGEYAGA
zm02       421  QKTTGYVWQLLPNGMKPEYRP*EVLGQNPSYIFFRELAGSSNDGPVGALGTPLMGEYAGA
zm03       421  QKTTGYVWQLLPNGMKPEYRP*EVLGQNPSYIFFRELAGSSNDGPVGALGTPLMGEYAGA
zm07       421  QKTTGYVWQLLPNGMKPEYRP*EVLGQNPSYIFFRELAGSSNDGPVGALGTPLMGEYAGA
zm12       421  QKTTGYVWQLLPNGMKPEYRP*EVLGQNPSYIFFRELAGSSNDGPVGALGTPLMGEYAGA
zm18       421  QKTTGYVWQLLPNGMKPEYRP*EVLGQNPSYIFFRELAGSSNDGPVGALGTPLMGEYAGA
zm19       421  QKTTGYVWQLLPNGMKPEYRP*EVLGQNPSYIFFRELAGSSNDGPVGALGTPLMGEYAGA
zm20       421  QKTTGYVWQLLPNGMKPEYRP*EVLGQNPSYIFFRELAGSSNDGPVGALGTPLMGEYAGA
zm21       421  QKTTGYVWQLLPNGMKPEYRP*EVLGQNPSYIFFRELAGSSNDGPVGALGTPLMGEYAGA
zm06       421  QKTTGYVWQLLPNGMKPEYRP*EVLGQNPSYIFFRELAGSSNDGPVGALGTPLMGEYAGA
zm17       421  QKTTGYVWQLLPNGMKPEYRP*EVLGQNPSYIFFRELTGSSNDGPVGALGTPLMGEYAGA
zm13       421  QKTTGYVWQLLPNGMKPEYRP*EVLGQNPSYIFFRELAGSSNDGPVGALGTPLMGEYAGA
zm05       421  QKTTGYVWQLLPNGMKPEYRP*EVLGQNPSYIFFRELAGSSNDGPVGALGTPLMGEYAGA
z2491      421  QKTTGYVWQLLPNGMKPEYRP*EVLGQNPSYIFFRELTGSSNDGPVGALGTPLMGEYAGA
zm22       421  QKTTGYVWQLLPNGMKPEYRP*EVLGQNPSYIFFRELTGSSNDGPVGALGTPLMGEYAGA
zm26       421  QKTTGYVWQLLPNGMKPEYRP*EVLGQNPSYIFFRELAGSSNDGPVGALGTPLMGEYAGA
zm28       421  QKTTGYVWQLLPNGMKPEYRP*EVLGQNPSYIFFRELAGSSNDGPVGALGTPLMGEYAGA
zm29asbc   421  QKTTGYVWQLLPNGMKPEYRP*EVLGQNPSYIFFRELTGSSNDGPVGALGTPLMGEYAGA
zm16       421  QKTTGYVWQLLPNGMKPEYRP*EVLGQNPSYIFFRELTGSCNDGPVGALGTPLMGEYAGA
zm15       421  QKTTGYVWQLLPNGMKPEYRP*EVLGQNPSYIFFRELTGSCNDGPVGALGTPLMGEYAGA
zm31asbc   421  QKTTGYVWQLLPNGMKPEYVFFRELAGSCNDGPVGALGTPLMGEYAGA
```

FIG. 23D

NEISSERIA MENINGITIDIS ANTIGENS AND COMPOSITIONS

RELATED APPLICATIONS

This application is a Continuation of U.S. patent application Ser. No. 13/359,442, filed Jan. 26, 2012, which is a Continuation of U.S. patent application Ser. No. 13/070,448, filed Mar. 23, 2011, which is a Divisional of U.S. patent application Ser. No. 12/013,047, filed Jan. 11, 2008, now U.S. Pat. No. 7,988,979, which is continuation of U.S. patent application Ser. No. 09/674,546, filed Nov. 4, 2002, now U.S. Pat. No. 7,576,176, which is the National Stage of International Application No. PCT/US99/09346, filed Apr. 30, 1999, which claims the benefit under 35 U.S.C. §119(e) of U.S. Provisional Patent Ser. No. 60/121,528, filed Feb. 25, 1999, Ser. No. 60/103,796, filed Oct. 9, 1998, Ser. No. 60/103,794, filed Oct. 9, 1998, Ser. No. 60/103,749, filed Oct. 9, 1998, Ser. No. 60/099,062, filed Sep. 2, 1998, Ser. No. 60/098,994, filed Sep. 2, 1998, Ser. No. 60/094,869, filed Jul. 31, 1998, and Ser. No. 60/083,758, filed May 1, 1998. Each of the foregoing patent applications is incorporated by reference in their entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 30382200040SubSeqList2.TXT, date recorded: Aug. 26, 2015, size: 6325 KB).

FIELD OF THE INVENTION

This invention relates to antigens from the bacterial species: *Neisseria meningitidis* and *Neisseria gonorrhoeae*.

BACKGROUND

*Neisseria meningitidis* is a non-motile, gram negative diplococcus human pathogen. It colonizes the pharynx, causing meningitis and, occasionally, septicaemia in the absence of meningitis. It is closely related to *N. gonorrhoea*, although one feature that clearly differentiates meningococcus from gonococcus is the presence of a polysaccharide capsule that is present in all pathogenic meningococci.

*N. meningitidis* causes both endemic and epidemic disease. In the United States the attack rate is 0.6-1 per 100,000 persons per year, and it can be much greater during outbreaks. (see Lieberman et al. (1996) Safety and Immunogenicity of a Serogroups A/C *Neisseria meningitidis* Oligosaccharide-Protein Conjugate Vaccine in Young Children. *JAMA* 275 (19):1499-1503; Schuchat et al (1997) Bacterial Meningitis in the United States in 1995. *N Engl J Med* 337(14):970-976). In developing countries, endemic disease rates are much higher and during epidemics incidence rates can reach 500 cases per 100,000 persons per year. Mortality is extremely high, at 10-20% in the United States, and much higher in developing countries. Following the introduction of the conjugate vaccine against *Haemophilus influenzae*, *N. meningitidis* is the major cause of bacterial meningitis at all ages in the United States (Schuchat et al (1997) supra).

Based on the organism's capsular polysaccharide, 12 serogroups of *N. meningitidis* have been identified. Group A is the pathogen most often implicated in epidemic disease in sub-Saharan Africa. Serogroups B and C are responsible for the vast majority of cases in the United States and in most developed countries. Serogroups W135 and Y are responsible for the rest of the cases in the United States and developed countries. The meningococcal vaccine currently in use is a tetravalent polysaccharide vaccine composed of serogroups A, C, Y and W135. Although efficacious in adolescents and adults, it induces a poor immune response and short duration of protection, and cannot be used in infants [eg. Morbidity and Mortality weekly report, Vol. 46, No. RR-5 (1997)]. This is because polysaccharides are T-cell independent antigens that induce a weak immune response that cannot be boosted by repeated immunization. Following the success of the vaccination against *H. influenzae*, conjugate vaccines against serogroups A and C have been developed and are at the final stage of clinical testing (Zollinger W D "New and Improved Vaccines Against Meningococcal Disease". In: *New Generation Vaccines*, supra, pp. 469-488; Lieberman et al (1996) supra; Costantino et al (1992) Development and phase I clinical testing of a conjugate vaccine against meningococcus A and C. *Vaccine* 10:691-698).

Meningococcus B (menB) remains a problem, however. This serotype currently is responsible for approximately 50% of total meningitis in the United States, Europe, and South America. The polysaccharide approach cannot be used because the menB capsular polysaccharide is a polymer of α(2-8)-linked N-acetyl neuraminic acid that is also present in mammalian tissue. This results in tolerance to the antigen; indeed, if an immune response were elicited, it would be anti-self, and therefore undesirable. In order to avoid induction of autoimmunity and to induce a protective immune response, the capsular polysaccharide has, for instance, been chemically modified substituting the N-acetyl groups with N-propionyl groups, leaving the specific antigenicity unaltered (Romero & Outschoorn (1994) Current status of Meningococcal group B vaccine candidates: capsular or non-capsular? *Clin Microbiol Rev* 7(4):559-575).

Alternative approaches to menB vaccines have used complex mixtures of outer membrane proteins (OMPs), containing either the OMPs alone, or OMPs enriched in porins, or deleted of the class 4 OMPs that are believed to induce antibodies that block bactericidal activity. This approach produces vaccines that are not well characterized. They are able to protect against the homologous strain, but are not effective at large where there are many antigenic variants of the outer membrane proteins. To overcome the antigenic variability, multivalent vaccines containing up to nine different porins have been constructed (eg. Poolman J T (1992) Development of a meningococcal vaccine. *Infect. Agents Dis.* 4:13-28). Additional proteins to be used in outer membrane vaccines have been the opa and opc proteins, but none of these approaches have been able to overcome the antigenic variability (eg. Ala'Aldeen & Borriello (1996) The meningococcal transferrin-binding proteins 1 and 2 are both surface exposed and generate bactericidal antibodies capable of killing homologous and heterologous strains. *Vaccine* 14(1):49-53).

A certain amount of sequence data is available for meningococcal and gonoccocal genes and proteins (eg. EP-A-0467714, WO96/29412), but this is by no means complete. The provision of further sequences could provide an opportunity to identify secreted or surface-exposed proteins that are presumed targets for the immune system and which are not antigenically variable. For instance, some of the identified proteins could be components of efficacious vaccines against meningococcus B, some could be components of vaccines against all meningococcal serotypes, and others could be components of vaccines against all pathogenic Neisseriae including *Neisseria meningitidis* or *Neisseria gonorrhoeae*. Those sequences specific to *N. meningitidis* or *N. gonorrhoeae* that are more highly conserved are further preferred sequences.

It is thus an object of the invention is to provide Neisserial DNA sequences which encode proteins that are antigenic or immunogenic.

BRIEF DESCRIPTION OF THE DRAWINGS

FIG. 2A through FIG. 2D illustrate the products of (FIG. 2A) protein expression and purification, (FIG. 2B) western blot, (FIG. 2C) FACs analysis, and (FIG. 2D) bactericidal assay. The result of the ELISA assay of the predicted ORF 279 as cloned and expressed in *E. coli* was positive.

FIG. 19A, FIG. 19B, and FIG. 19C show an alignment comparison of amino acid sequences for ORF 225 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3115; Z2491 SEQ ID 3116; ZO01_225 SEQ ID 3117; ZO02_225 SEQ ID 3118; ZO03_225 SEQ ID 3119; ZO04_225 SEQ ID 3120; ZO05_225 SEQ ID 3121; ZO06_225 SEQ ID 3122; ZO07_225 SEQ ID 3123; ZO08_225 SEQ ID 3124; ZO09_225 SEQ ID 3125; ZO10_225 SEQ ID 3126; ZO11_225 SEQ ID 3127; ZO12_225 SEQ ID 3128; ZO13_225 SEQ ID 3129; ZO14_225 SEQ ID 3130; ZO15_225<SEQ ID 3131; ZO16_225 SEQ ID 3132; ZO17_225 SEQ ID 3133; ZO18_225 SEQ ID 3134; ZO19_225 SEQ ID 3135; ZO20_225 SEQ ID 3136; ZO21_225 SEQ ID 3137; ZO22_225 SEQ ID 3138; ZO23_225 SEQ ID 3139; ZO24_225 SEQ ID 3140; ZO25_225 SEQ ID 3141; ZO26_225 SEQ ID 3142; ZO27_225 SEQ ID 3143; ZO28_225 SEQ ID 3144; ZO29_225 SEQ ID 3145; ZO32_225 SEQ ID 3146; ZO33_225 SEQ ID 3147; and ZO96_225 SEQ ID 3148.

FIG. 20A and FIG. 20B show an alignment comparison of amino acid sequences for ORF 235 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3149; GNMZQ01 SEQ ID 3150; GNMZQ02 SEQ ID 3151; GNMZQ03 SEQ ID 31521; GNMZQ04 SEQ ID 3153; GNMZQ05 SEQ ID 3154; GNMZQ07 SEQ ID 3155; GNMZQ08 SEQ ID 3156; GNMZQ09 SEQ ID 3157; GNMZQ10 SEQ ID 3158; GNMZQ11 SEQ ID 3159; GNMZQ13 SEQ ID 3160; GNMZQ14 SEQ ID 3161; GNMZQ15 SEQ ID 3162; GNMZQ16 SEQ ID 3163; GNMZQ17 SEQ ID 3164; GNMZQ18 SEQ ID 3165; GNMZQ19 SEQ ID 3166; GNMZQ21 SEQ ID 3166; GNMZQ22 SEQ ID 3167; GNMZQ23 SEQ ID 3168; GNMZQ24 SEQ ID 3169; GNMZQ25 SEQ ID 3170; GNMZQ26 SEQ ID 3171; GNMZQ27 SEQ ID 3172; GNMZQ28 SEQ ID 3173; GNMZQ29 SEQ ID 3174; GNMZQ31 SEQ ID 3175; GNMZQ32 SEQ ID 3176; GNMZQ33 SEQ ID 3177; and Z2491 SEQ ID 3178.

FIG. 21A and FIG. 21B show an alignment comparison of amino acid sequences for ORF 287 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: 287_14 SEQ ID 3179; 287_2 SEQ ID 3180; 287_21 SEQ ID 3181; 287_9 SEQ ID 3182; FA1090 SEQ ID 3183; and Z2491 SEQ ID 3184.

FIG. 22A and FIG. 22B show an alignment comparison of amino acid sequences for ORF 519 for several strains of Neisseria. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090_519 SEQ ID 3185; Z2491_519 SEQ ID 3186; ZV01_519 SEQ ID 3187; ZV02_519 SEQ ID 3188; ZV03_519 SEQ ID 3189; ZV04_519 SEQ ID 3190; ZV05_519 SEQ ID 3191; ZV06_519ASS SEQ ID 3192; ZV07_519 SEQ ID 3193; ZV11_519 SEQ ID 3194; ZV12_519 SEQ ID 3195; ZV18_519 SEQ ID 3196; ZV19_519 SEQ ID 3197; ZV20_519ASS SEQ ID 3198; ZV21_519ASS SEQ ID 3199; ZV22_519ASS SEQ ID 3200; ZV26_519 SEQ ID 3201; ZV27_519 SEQ ID 3202; ZV28_519 SEQ ID 3203; ZV29_519ASS SEQ ID 3204; ZV32_519 SEQ ID 3205; and ZV96_519 SEQ ID 3206.

FIG. 23A, FIG. 23B, FIG. 23C, and FIG. 23D show an alignment comparison of amino acid sequences for ORF 919 for several strains of Neisseria. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3207; Z2491<SEQ ID 3208; ZM01 SEQ ID 3209; ZM02 SEQ ID 3210; ZM03 SEQ ID 3211; ZM04 SEQ ID 3212; ZM05 SEQ ID 3213; ZM06 SEQ ID 3214; ZM07 SEQ ID 3215; ZM08N SEQ ID 3216; ZM09 SEQ ID 3217; ZM10 SEQ ID 3218; ZM11ASBC SEQ ID 3219; ZM12 SEQ ID 3220; ZM13 SEQ ID 3221; ZM14 SEQ ID 3222; ZM15 SEQ ID 3223; ZM16 SEQ ID 3224; ZM17 SEQ ID 3225; ZM18 SEQ ID 3226; ZM19 SEQ ID 3227; ZM20 SEQ ID 3228; ZM21 SEQ ID 3229; ZM22 SEQ ID 3230; ZM23ASBC SEQ ID 3231; ZM24 SEQ ID 3232; ZM25 SEQ ID 3233; ZM26 SEQ ID 3234; ZM27BC SEQ ID 3235; ZM28 SEQ ID 3236; ZM29ASBC SEQ ID 3237; ZM31ASBC SEQ ID 3238; ZM32ASBC SEQ ID 3239; ZM33ASBC SEQ ID 3240; ZM96 SEQ ID 3241.

THE INVENTION

Figure 1A:
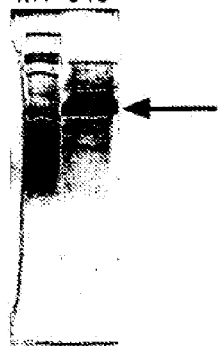
FIG. 1A through FIG 1E illustrate the products of (FIG. 1B) protein expression and (FIG. 1A) purification, (FIG. 1C) FACs analysis, (FIG. 1D) bactericidal assay, and (FIG. 1E) western blot. The result of the ELISA assay of the predicted ORF 919 as cloned and expressed in *E. coli* was positive.
Figure 1B:

The invention provides proteins comprising the N. meningitidis amino acid sequences and N. gonorrhoeae amino acid sequences disclosed in the examples.

It also provides proteins comprising sequences homologous (i.e., those having sequence identity) to the N. meningitidis amino acid sequences disclosed in the examples. Depending on the particular sequence, the degree of homology (sequence identity) is preferably greater than 50% (eg. 60%, 70%, 80%, 90%, 95%, 99% or more). These proteins include mutants and allelic variants of the sequences disclosed in the examples. Typically, 50% identity or more between two proteins is considered to be an indication of functional equivalence. Identity between proteins is preferably determined by the Smith-Waterman homology search algorithm as implemented in MPSRCH program (Oxford Molecular) using an affine gap search with parameters:gap penalty 12, gap extension penalty 1.

The invention further provides proteins comprising fragments of the N. meningitidis amino acid sequences and N. gonorrhoeae amino acid sequences disclosed in the examples. The fragments should comprise at least n consecutive amino acids from the sequences and, depending on the particular sequence, n is 7 or more (eg. 8, 10, 12, 14, 16, 18, 20 or more). Preferably the fragments comprise an epitope from the sequence.

The proteins of the invention can, of course, be prepared by various means (eg. recombinant expression, purification from cell culture, chemical synthesis etc.) and in various forms (eg. native, fusions etc.). They are preferably prepared in substantially pure or isolated form (ie. substantially free from other N. meningitidis or N. gonorrhoeae host cell proteins)

According to a further aspect, the invention provides antibodies which bind to these proteins. These may be polyclonal or monoclonal and may be produced by any suitable means.

According to a further aspect, the invention provides nucleic acid comprising the N. meningitidis nucleotide sequences and N. gonorrhoeae nucleotide sequences disclosed in the examples.

According to a further aspect, the invention comprises nucleic acids having sequence identity of greater than 50% (e.g., 60%, 70%, 80%, 90%, 95%, 99% or more) to the nucleic acid sequences herein. Sequence identity is determined as above-discussed.

According to a further aspect, the invention comprises nucleic acid that hybridizes to the sequences provided herein. Conditions for hybridization are set forth herein.

Nucleic acid comprising fragments of these sequences are also provided. These should comprise at least n consecutive nucleotides from the N. meningitidis sequences or N. gonorrhoeae sequences and depending on the particular sequence, n is 10 or more (eg 12, 14, 15, 18, 20, 25, 30, 35, 40 or more).

According to a further aspect, the invention provides nucleic acid encoding the proteins and protein fragments of the invention.

It should also be appreciated that the invention provides nucleic acid comprising sequences complementary to those described above (eg. for antisense or probing purposes).

Nucleic acid according to the invention can, of course, be prepared in many ways (eg. by chemical synthesis, in part or in whole, from genomic or cDNA libraries, from the organism itself etc.) and can take various forms (eg. single stranded, double stranded, vectors, probes etc.).

In addition, the term "nucleic acid" includes DNA and RNA, and also their analogues, such as those containing modified backbones, and also protein nucleic acids (PNA) etc.

According to a further aspect, the invention provides vectors comprising nucleotide sequences of the invention (eg. expression vectors) and host cells transformed with such vectors.

According to a further aspect, the invention provides compositions comprising protein, antibody, and/or nucleic acid according to the invention. These compositions may be suitable as vaccines, for instance, or as diagnostic reagents or as immunogenic compositions.

The invention also provides nucleic acid, protein, or antibody according to the invention for use as medicaments (eg. as vaccines) or as diagnostic reagents. It also provides the use of nucleic acid, protein, or antibody according to the invention in the manufacture of (I) a medicament for treating or preventing infection due to Neisserial bacteria (ii) a diagnostic reagent for detecting the presence of Neisserial bacteria or of antibodies raised against Neisserial bacteria or (iii) for raising antibodies. Said Neisserial bacteria may be any species or strain (such as *N. gonorrhoeae*) but are preferably *N. meningitidis*, especially strain B or strain C.

The invention also provides a method of treating a patient, comprising administering to the patient a therapeutically effective amount of nucleic acid, protein, and/or antibody according to the invention.

According to further aspects, the invention provides various processes.

A process for producing proteins of the invention is provided, comprising the step of culturing a host cell according to the invention under conditions which induce protein expression.

A process for detecting polynucleotides of the invention is provided, comprising the steps of: (a) contacting a nucleic probe according to the invention with a biological sample under hybridizing conditions to form duplexes; and (b) detecting said duplexes.

A process for detecting proteins of the invention is provided, comprising the steps of: (a) contacting an antibody according to the invention with a biological sample under conditions suitable for the formation of an antibody-antigen complexes; and (b) detecting said complexes.

A summary of standard techniques and procedures which may be employed in order to perform the invention (eg. to utilize the disclosed sequences for vaccination or diagnostic purposes) is attached as an Appendix to the application. This summary is not a limitation on the invention but, rather, gives examples that may be used, but are not required.

Having now generally described the invention, the same will be more readily understood through reference to the following examples which are provided by way of illustration, and are not intended to be limiting of the present invention, unless specified.

Methodology—Summary of Standard Procedures and Techniques.

General

This invention provides *Neisseria meningitidis* menB nucleotide sequences, amino acid sequences encoded therein. With these disclosed sequences, nucleic acid probe assays and expression cassettes and vectors can be produced. The expression vectors can be transformed into host cells to produce proteins. The purified or isolated polypeptides (which may also be chemically synthesized) can be used to produce antibodies to detect menB proteins. Also, the host cells or extracts can be utilized for biological assays to isolate agonists or antagonists. In addition, with these sequences one can search to identify open reading frames and identify amino acid sequences. The proteins may also be used in immunogenic compositions, antigenic compositions and as vaccine components.

The practice of the present invention will employ, unless otherwise indicated, conventional techniques of molecular biology, microbiology, recombinant DNA, and immunology, which are within the skill of the art. Such techniques are explained fully in the literature e.g., Sambrook *Molecular Cloning; A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

All publications, patents, and patent applications cited herein are incorporated in full by reference.

Expression Systems

The *Neisseria* menB nucleotide sequences can be expressed in a variety of different expression systems; for example those used with mammalian cells, plant cells, baculoviruses, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (e.g., structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation (Sambrook et al. (1989) "Expression of Cloned Genes in Mammalian Cells." In *Molecular Cloning: A Laboratory Manual,* 2nd ed.).

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallothionein gene, also provide useful promoter sequences. Expression may be either constitutive or regulated (inducible). Depending on the promoter selected, many promotes may be inducible using known substrates, such as the use of the mouse mammary tumor virus (MMTV) promoter with the glucocorticoid responsive element (GRE) that is induced by glucocorticoid in hormone-responsive transformed cells (see for example, U.S. Pat. No. 5,783,681).

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter (Maniatis et al. (1987) *Science* 236:1237; Alberts et al. (1989) *Molecular Biology of the Cell,* 2nd ed.). Enhancer elements derived from viruses may be particularly useful, because they usually have a broader host range. Examples include the SV40 early gene enhancer (Dijkema et al (1985) *EMBO J.* 4:761) and the enhancer/promoters derived from the long terminal repeat (LTR) of the Rous Sarcoma Virus (Gorman et al. (1982b)

*Proc. Natl. Acad. Sci.* 79:6777) and from human cytomegalovirus (Boshart et al. (1985) *Cell* 41:521). Additionally, some enhancers are regulatable and become active only in the presence of an inducer, such as a hormone or metal ion (Sassone-Corsi and Borelli (1986) *Trends Genet.* 2:215; Maniatis et al. (1987) Science 236:1237).

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus tripartite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation (Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105). These sequences direct the transcription of an mRNA which can be translated into the polypeptide encoded by the DNA. Examples of transcription terminator/polyadenylation signals include those derived from SV40 (Sambrook et al (1989) "Expression of cloned genes in cultured mammalian cells." In *Molecular Cloning: A Laboratory Manual*).

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (e.g., plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 (Gluzman (1981) *Cell* 23:175) or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 (Kaufman et al. (1989) *Mol. Cell. Biol.* 9:946) and pHEBO (Shimizu et al. (1986) *Mol. Cell. Biol.* 6:1074).

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (e.g., Hep G2), and a number of other cell lines.

ii. Plant Cellular Expression Systems

There are many plant cell culture and whole plant genetic expression systems known in the art. Exemplary plant cellular genetic expression systems include those described in patents, such as: U.S. Pat. No. 5,693,506; U.S. Pat. No. 5,659,122; and U.S. Pat. No. 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21-52. References that describe other metabolically-regulated genes: Sheen, *Plant Cell*, 2:1027-1038(1990); Maas et al., *EMBO J.* 9:3447-3452 (1990); Benkel and Hickey, *Proc. Natl. Acad. Sci.* 84:1337-1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for Agrobacterium transformations, T DNA sequences for Agrobacterium-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature,* 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MAXBAC™" kit). These techniques are generally known to those skilled in the art and fully described in Summers and Smith, *Texas Agricultural Experiment Station Bulletin No.* 1555 (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (e.g., plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus RNA polymerase and initiating the downstream (5' to 3') transcription of a coding sequence (e.g., structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene*, 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human (alpha) α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA*, 82:8404; mouse IL-3, (Miyajima et al., (1987) *Gene* 58:273; and human glucocerebrosidase, Martin et al. (1988) *DNA*, 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 µm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. *Current Protocols in Microbiology* Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda*, and *Tri-*

*choplusia ni* (PCT Pub. No. WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, e.g., Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, e.g., HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, e.g., proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iv. Bacterial Systems

Bacterial expression techniques are known in the art. A bacterial promoter is any DNA sequence capable of binding bacterial RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) (Raibaud et al. (1984) *Annu. Rev. Genet.* 18:173). Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) (Chang et al. (1977) *Nature* 198:1056), and maltose. Additional examples include promoter sequences derived from biosynthetic enzymes such as tryptophan (trp) (Goeddel et al. (1980) *Nuc. Acids Res.* 8:4057; Yelverton et al. (1981) *Nucl. Acids Res.* 9:731; U.S. Pat. No. 4,738,921; EPO Publ. Nos. 036 776 and 121 775). The beta-lactamase (bla) promoter system (Weissmann (1981) "The cloning of interferon and other mistakes." In *Interferon* 3 (ed. I. Gresser)), bacteriophage lambda PL (Shimatake et al. (1981) *Nature* 292:128) and T5 (U.S. Pat. No. 4,689,406) promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac promoter is a hybrid trp-lac promoter comprised of both trp promoter and lac operon sequences that is regulated by the lac repressor (Amann et al. (1983) *Gene* 25:167; de Boer et al. (1983) *Proc. Natl. Acad. Sci.* 80:21). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc Natl. Acad. Sci.* 82:1074). In addition, a hybrid promoter can also be comprised of a bacteriophage promoter and an *E. coli* operator region (EPO Publ. No. 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of *E. coli* 16S rRNA (Steitz et al. (1979) "Genetic signals and nucleotide sequences in messenger RNA." In *Biological Regulation and Development: Gene Expression* (ed. R. F. Goldberger)). To express eukaryotic genes and prokaryotic genes with weak ribosome-binding site, it is often necessary to optimize the distance between the SD sequence and the ATG of the eukaryotic gene (Sambrook et al. (1989) "Expression of cloned genes in *Escherichia coli*." In *Molecular Cloning: A Laboratory Manual*).

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo or in vitro incubation with a bacterial methionine N-terminal peptidase (EPO Publ. No. 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene (Nagai et al. (1984) *Nature* 309:810). Fusion proteins can also be made with sequences from the lacZ (Jia et al. (1987) *Gene* 60:197), trpE (Allen et al. (1987) *J. Biotechnol.* 5:93; Makoff et al. (1989) *J. Gen. Microbiol.* 135:11), and Chey (EPO Publ. No. 324 647) genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (e.g. ubiquitin specific processing-protease) to cleave the ubiquitin from the foreign protein. Through this method, native foreign protein can be isolated (Miller et al. (1989) *Bio/Technology* 7:698).

Alternatively, foreign proteins can also be secreted from the cell by creating chimeric DNA molecules that encode a fusion protein comprised of a signal peptide sequence fragment that provides for secretion of the foreign protein in bacteria (U.S. Pat. No. 4,336,336). The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) (Masui et al. (1983), in: *Experimental Manipulation of Gene Expression*; Ghrayeb et al. (1984) *EMBO J.* 3:2437) and the *E. coli* alkaline phosphatase signal sequence (phoA) (Oka et al. (1985) *Proc. Natl. Acad. Sci.* 82:7212). As an additional example, the signal sequence of the alpha-amylase gene from various *Bacillus* strains can be used to secrete heterologous proteins from *B. subtilis* (Palva et al. (1982) *Proc. Natl. Acad. Sci. USA* 79:5582; EPO Publ. No. 244 042).

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (e.g., plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EPO Publ. No. 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline (Davies et al. (1978) *Annu. Rev. Microbiol.* 32:469). Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* (Palva et al. (1982) *Proc. Natl. Acad. Sci. USA* 79:5582; EPO Publ. Nos. 036 259 and 063 953; PCT Publ. No. WO 84/04541), *Escherichia coli* (Shimatake et al. (1981) *Nature* 292:128; Amann et al. (1985) *Gene* 40:183; Studier et al. (1986) *J. Mol. Biol.* 189:113; EPO Publ. Nos. 036 776, 136 829 and 136 907), *Streptococcus cremoris* (Powell et al. (1988) *Appl. Environ. Microbiol.* 54:655); *Streptococcus lividans* (Powell et al. (1988) *Appl. Environ. Microbiol.* 54:655), *Streptomyces lividans* (U.S. Pat. No. 4,745,056).

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. (See e.g., use of *Bacillus*: Masson et al. (1989) *FEMS Microbiol. Lett.* 60:273; Palva et al. (1982) *Proc. Natl. Acad. Sci. USA* 79:5582; EPO Publ. Nos. 036 259 and 063 953; PCT Publ. No. WO 84/04541; use of *Campylobacter*: Miller et al. (1988) *Proc. Natl. Acad. Sci.* 85:856; and Wang et al. (1990) *J. Bacteriol.* 172:949; use of *Escherichia coli*: Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; use of *Lactobacillus*: Chassy et al. (1987) *FEMS Microbiol. Lett.* 44:173; use of *Pseudomonas*: Fiedler et al. (1988) *Anal. Biochem* 170:38; use of *Staphylococcus*: Augustin et al. (1990) *FEMS Microbiol. Lett.* 66:203; use of *Streptococcus*: Barany et al. (1980) *J. Bacteriol.* 144:698; Harlander (1987) "Transformation of *Streptococcus lactis* by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412.

v. Yeast Expression

Yeast expression systems are also known to one of ordinary skill in the art. A yeast promoter is any DNA sequence capable of binding yeast RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EPO Publ. No. 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO Publ. No. 329 203). The yeast PHO5 gene, encoding acid phosphatase, also provides useful promoter sequences (Myanohara et al. (1983) *Proc. Natl. Acad. Sci. USA* 80:1).

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876, 197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EPO Publ. No. 164 556). Furthermore, a yeast promoter can include naturally occurring promoters of non-yeast origin that have the ability to bind yeast RNA polymerase and initiate transcription. Examples of such promoters include, inter alia, (Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109;).

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, plant, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See e.g., EPO Publ. No. 196056. Another example is a ubiquitin fusion protein. Such a fusion protein is made with the ubiquitin region that preferably retains a site for a processing enzyme (e.g. ubiquitin-specific processing protease) to cleave the ubiquitin from the foreign protein. Through this method, therefore, native foreign protein can be isolated (e.g., WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EPO Publ. No. 012 873; JPO Publ. No. 62:096,086) and the A-factor gene (U.S. Pat. No. 4,588,684). Alternatively, leaders of non-yeast origin, such as an interferon leader, exist that also provide for secretion in yeast (EPO Publ. No. 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EPO Publ. No. 324 274). Additional leaders employing an alpha-factor leader fragment that provides for secretion include hybrid alpha-factor leaders made with a presequence of a first yeast, but a pro-region from a second yeast alphafactor. (See e.g., PCT Publ. No. WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 (Botstein et al. (1979) *Gene* 8:17-24), pCl/1 (Brake et al. (1984) *Proc. Natl. Acad. Sci USA* 81:4642-4646), and YRp17 (Stinchcomb et al. (1982) *J. Mol. Biol.* 158:157). In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See e.g., Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al. (1983) *Methods in Enzymol.* 101:228-245). An integrating vector may be directed to a specific locus in yeast by selecting the appropriate homologous sequence for inclusion in the vector. See Orr-Weaver et al., supra. One or more expression construct may integrate, possibly affecting levels of recombinant protein produced (Rine et al. (1983) *Proc. Natl. Acad. Sci. USA* 80:6750). The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions (Butt et al. (1987) *Microbiol, Rev.* 51:351).

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors and methods of introducing exogenous DNA into yeast hosts have been developed for, inter alia, the following yeasts: *Candida albicans* (Kurtz, et al. (1986) *Mol. Cell. Biol.* 6:142); *Candida maltosa* (Kunze, et al. (1985) *J. Basic Microbiol.* 25:141); *Hansenula polymorpha* (Gleeson, et al. (1986) *J. Gen. Microbiol.* 132:3459; Roggenkamp et al. (1986) *Mol. Gen. Genet.* 202:302); *Kluyveromyces fragilis* (Das, et al. (1984) *J. Bacteriol.* 158:1165); *Kluyveromyces lactis* (De Louvencourt et al. (1983) *J. Bacteriol.* 154:737; Van den Berg et al. (1990) *Bio/Technology* 8:135); *Pichia guillerimondii* (Kunze et al. (1985) *J. Basic Microbiol.* 25:141); *Pichia pastoris* (Cregg, et al. (1985) *Mol. Cell. Biol.* 5:3376; U.S. Pat. Nos. 4,837,148 and 4,929,555); *Saccharomyces cerevisiae* (Hinnen et al. (1978) *Proc. Natl. Acad. Sci. USA* 75:1929; Ito et al. (1983) *J. Bacteriol.* 153:163); *Schizosaccharomyces pombe* (Beach and Nurse (1981) *Nature* 300:706); and *Yarrowia lipolytica* (Davidow, et al. (1985) *Curr. Genet.* 10:380471 Gaillardin, et al. (1985) *Curr. Genet.* 10:49).

Methods of introducing exogenous DNA into yeast hosts are well-known in the art, and usually include either the transformation of spheroplasts or of intact yeast cells treated with alkali cations. Transformation procedures usually vary with the yeast species to be transformed. See e.g., [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol.* 154: 1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol.* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia*].

DEFINITIONS

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

A "conserved" *Neisseria* amino acid fragment or protein is one that is present in a particular Neisserial protein in at least x% of *Neisseria*. The value of x may be 50% or more, e.g., 66%, 75%, 80%, 90%, 95% or even 100% (i.e. the amino acid is found in the protein in question in all *Neisseria*). In order to determine whether an amino acid is "conserved" in a particular Neisserial protein, it is necessary to compare that amino acid residue in the sequences of the protein in question from a plurality of different *Neisseria* (a reference population). The reference population may include a number of different *Neisseria* species or may include a single species. The reference population may include a number of different serogroups of a particular species or a single serogroup. A preferred reference population consists of the 5 most common *Neisseria* The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a Neisserial sequence is heterologous to a mouse host cell.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as a DNA, RNA or amino acid sequence differing from but having homology with the native or disclosed sequence. Depending on the particular sequence, the degree of homology (sequence identity) between the native or disclosed sequence and the mutant sequence is preferably greater than 50% (e.g., 60%, 70%, 80%, 90%, 95%, 99% or more) which is calculated as described above. As used herein, an "allelic variant" of a nucleic acid molecule, or region, for which nucleic acid sequence is provided herein is a nucleic acid molecule, or region, that occurs at essentially the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions. (see, for example, U.S. Pat. No. 5,753,235).

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanized antibodies, altered antibodies, univalent antibodies, Fab proteins, and single domain antibodies.

Antibodies against the proteins of the invention are useful for affinity chromatography, immunoassays, and distinguishing/identifying Neisseria menB proteins. Antibodies elicited against the proteins of the present invention bind to antigenic polypeptides or proteins or protein fragments that are present and specifically associated with strains of Neisseria meningitidis menB. In some instances, these antigens may be associated with specific strains, such as those antigens specific for the menB strains. The antibodies of the invention may be immobilized to a matrix and utilized in an immunoassay or on an affinity chromatography column, to enable the detection and/or separation of polypeptides, proteins or protein fragments or cells comprising such polypeptides, proteins or protein fragments. Alternatively, such polypeptides, proteins or protein fragments may be immobilized so as to detect antibodies bindably specific thereto.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 µg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (e.g., 1,000 g for 10 minutes). About 20-50 ml per bleed may be obtained from rabbits.

Monoclonal antibodies are prepared using the standard method of Kohler & Milstein (Nature (1975) 256:495-96), or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells that express membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (e.g., hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (e.g., in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}$P and $^{125}$I), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Antigens, immunogens, polypeptides, proteins or protein fragments of the present invention elicit formation of specific binding partner antibodies. These antigens, immunogens, polypeptides, proteins or protein fragments of the present invention comprise immunogenic compositions of the present invention. Such immunogenic compositions may further comprise or include adjuvants, carriers, or other compositions that promote or enhance or stabilize the antigens, polypeptides, proteins or protein fragments of the present invention. Such adjuvants and carriers will be readily apparent to those of ordinary skill in the art.

Pharmaceutical Compositions

Pharmaceutical compositions can comprise (include) either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature, when given to a patient that is febrile. The precise effective amount for a subject will depend upon the subject's size and health, the nature and extent of the condition, and the therapeutics or combination of therapeutics selected for administration.

Thus, it is not useful to specify an exact effective amount in advance. However, the effective amount for a given situation can be determined by routine experimentation and is within the judgment of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal and transcutaneous applications, needles, and gene guns or hyposprays. Dosage treatment may be a single dose schedule or a multiple dose schedule.

Vaccines

Vaccines according to the invention may either be prophylactic (i.e., to prevent infection) or therapeutic (i.e., to treat disease after infection).

Such vaccines comprise immunizing antigen(s) or immunogen(s), immunogenic polypeptide, protein(s) or protein fragments, or nucleic acids (e.g., ribonucleic acid or deoxyribonucleic acid), usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the immunogen or antigen may be conjugated to a bacterial toxoid, such as a toxoid from diphtheria, tetanus, cholera, $H.\ pylori$, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59 (PCT Publ. No. WO 90/14837), containing 5% Squalene, 0.5% TWEEN 80™, and 0.5% SPAN 85™ (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% PLURONIC™-blocked polymer L121, and thr-MDP (see below) either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% TWEEN 80™, and one or more bacterial cell wall components from the group consisting of monophosphorylipid A (MPL), trehalose dimycolate (TDM), and cell wall skeleton (CWS), preferably MPL+CWS (DETOX™); (3) saponin adjuvants, such as STIMULON™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (e.g., IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; and (6) other substances that act as immunostimulating agents to enhance the effectiveness of the composition. Alum and MF59 are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-huydroxyphosphoryloxy)-ethylamine (MTP-PE), etc.

The vaccine compositions comprising immunogenic compositions (e.g., which may include the antigen, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles. Alternatively, vaccine compositions comprising immunogenic compositions may comprise an antigen, polypeptide, protein, protein fragment or nucleic acid in a pharmaceutically acceptable carrier.

More specifically, vaccines comprising immunogenic compositions comprise an immunologically effective amount of the immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (e.g., nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

Typically, the vaccine compositions or immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

The immunogenic compositions are conventionally administered parenterally, e.g., by injection, either subcutaneously or intramuscularly. Additional formulations suitable for other modes of administration include oral and pulmonary formulations, suppositories, and transdermal and transcutaneous applications. Dosage treatment may be a single dose schedule or a multiple dose schedule. The vaccine may be administered in conjunction with other immunoregulatory agents.

As an alternative to protein-based vaccines, DNA vaccination may be employed (e.g., Robinson & Torres (1997) *Seminars in Immunology* 9:271-283; Donnelly et al. (1997) *Annu Rev Immunol* 15:617-648).

Gene Delivery Vehicles

Gene therapy vehicles for delivery of constructs, including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art, including B, C and D type retroviruses, xenotropic retroviruses (for example, NZB-X1, NZB-X2 and NZB9-1 (see O'Neill (1985) *J. Virol.* 53:160) polytropic retroviruses e.g., MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (e.g., HT1080 cells) or mink parent cell lines, which eliminates inactivation in human serum.

Preferred retroviruses for the construction of retroviral gene therapy vectors include Avian Leukosis Virus, Bovine Leukemia Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") or isolated from known sources using commonly available techniques.

Exemplary known retroviral gene therapy vectors employable in this invention include those described in patent applications GB2200651, EPO415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. No. 4,405,712, U.S. Pat. No. 4,861,719, U.S. Pat. No. 4,980,289, U.S. Pat. No. 4,777,127, U.S. Pat. No. 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (i.e., there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. No. 5,354,678, U.S. Pat. No. 5,173,414, U.S. Pat. No. 5,139,941, and U.S. Pat. No. 5,252,479.

The gene therapy vectors comprising sequences of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. No. 5,091,309 and U.S. Pat. No. 5,217,879 are employable. Such alpha viruses may be obtained from depositories or collections such as the ATCC or isolated from known sources using commonly available techniques. Preferably, alphavirus vectors with reduced cytotoxicity are used (see U.S. Ser. No. 08/679,640).

DNA vector systems such as eukarytic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569: 86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and Nature (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed to transform a host cell. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033.

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a tumor or lesion. Other modes of administration include oral and pulmonary administration, suppositories, and transdermal applications, needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of plasmodium falciparum known as RH.

B. Hormones, Vitamins, Etc.

Other groups that can be included are, for example: hormones, steroids, androgens, estrogens, thyroid hormone, or vitamins, folic acid.

C. Polyalkylenes, Polysaccharides, etc.

Also, polyalkylene glycol can be included with the desired polynucleotides or polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotide or polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide or polypeptide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101: 512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA*

75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide or polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, and E, over time these lipoproteins lose A and acquire C and E apoproteins. VLDL comprises A, B, C, and E apoproteins, LDL comprises apoprotein B; and HDL comprises apoproteins A, C, and E.

The amino acid of these apoproteins are known and are described in, for example, Breslow (1985) *Annu Rev. Biochem* 54:699; Law (1986) *Adv. Exp Med. Biol.* 151:162; Chen (1986) *J Biol Chem* 261:12918; Kane (1980) *Proc Natl Acad Sci USA* 77:2465; and Utermann (1984) *Hum Genet* 65:232.

Lipoproteins contain a variety of lipids including, triglycerides, cholesterol (free and esters), and phopholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750.

Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443.

Lipoproteins can also be purchased from commercial suppliers, such as Biomedical Technologies, Inc., Stoughton, Mass., USA.

Further description of lipoproteins can be found in Zuckermann et al., PCT. Appln. No. US97/14465.

F. Polycationic Agents

Polycationic agents can be included, with or without lipoprotein, in a composition with the desired polynucleotide or polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic Polycationic Agents

Synthetic polycationic agents which are useful include, for example, DEAE-dextran, polybrene. LIPOFECTIN™, and LIPOFECTAMINE™ are monomers that form polycationic complexes when combined with polynucleotides or polypeptides.

Immunodiagnostic Assays

Neisserial antigens of the invention can be used in immunoassays to detect antibody levels (or, conversely, anti-Neisserial antibodies can be used to detect antigen levels). Immunoassays based on well defined, recombinant antigens can be developed to replace invasive diagnostics methods. Antibodies to Neisserial proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known;

examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 µg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 µg of yeast DNA, blotting for two hours, and hybridizing for 4-8 hours with a probe of $10^8$ cpm/µg. For a single-copy mammalian gene a conservative approach would start with 10 µg of DNA, blot overnight, and hybridize overnight in the presence of 10% dextran sulfate using a probe of greater than $10^8$ cpm/µg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10}Ci)+0.4[\%(G+C)]-0.6(\% \text{ formamide})-600/n-1.5(\% \text{ mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Neisserial nucleotide sequences of the invention (including both sense and antisense strands). Though many different nucleotide sequences will encode the amino acid sequence, the native Neisserial sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Neisserial sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional Neisserial sequence may also be helpful as a label to detect the formed duplex. For example, a non-complementary nucleotide sequence may be attached to the 5' end of the probe, with the remainder of the probe sequence being complementary to a Neisserial sequence. Alternatively, non-complementary bases or longer sequences can be interspersed into the probe, provided that the probe sequence has sufficient complementarity with the a Neisserial sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

One example of a nucleotide hybridization assay is described by Urdea et al. in international patent application WO92/02526 [see also U.S. Pat. No. 5,124,246].

Alternatively, the polymerase chain reaction (PCR) is another well-known means for detecting small amounts of target nucleic acids. The assay is described in: Mullis et al. [*Meth. Enzymol.* (1987) 155: 335-350]; U.S. Pat. No. 4,683, 195; and U.S. Pat. No. 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Neisserial sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the Neisserial sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

EXAMPLES

The examples describe nucleic acid sequences which have been identified in *N. meningitidis*, and *N. gonorrhoeae* along with their respective and putative translation products. Not all of the nucleic acid sequences are complete ie. they encode less than the full-length wild-type protein.

The examples are generally in the following format:
a nucleotide sequence which has been identified in *N. meningitidis* the putative translation product of said *N. meningitidis* sequence a computer analysis of said translation product based on database comparisons a corresponding nucleotide sequence identified from *N. gonorrhoeae* the putative translation product of said *N. gonorrhoeae* sequence a comparison of the percentage of identity between the translation product of the *N. meningitidis* sequence and the *N. gonorrhoeae* sequence a description of the characteristics of the protein which indicates that it might be suitably antigenic or immunogenic.

Sequence comparisons were performed at NCBI (ncbi.nlm.nih.gov) using the algorithms BLAST, BLAST2, BLASTn, BLASTp, tBLASTn, BLASTx, & tBLASTx [eg. see also Altschul et al. (1997) Gapped BLAST and PSI-BLAST: a new generation of protein database search programs. *Nucleic Acids Research* 25:2289-3402]. Searches were performed against the following databases: non-redundant GenBank+EMBL+DDBJ+PDB sequences and non-redundant GenBank CDS translations+PDB+SwissProt+SP-update+PIR sequences.

Dots within nucleotide sequences represent nucleotides which have been arbitrarily introduced in order to maintain a reading frame. In the same way, double-underlined nucleotides were removed. Lower case letters represent ambiguities which arose during alignment of independent sequencing reactions (some of the nucleotide sequences in the examples are derived from combining the results of two or more experiments).

Nucleotide sequences were scanned in all six reading frames to predict the presence of hydrophobic domains using an algorithm based on the statistical studies of Esposti et al. [Critical evaluation of the hydropathy of membrane proteins (1990) *Eur J Biochem* 190:207-219]. These domains represent potential transmembrane regions or hydrophobic leader sequences.

Open reading frames were predicted from fragmented nucleotide sequences using the program ORFFINDER (NCBI).

Underlined amino acid sequences indicate possible transmembrane domains or leader sequences in the ORFs, as predicted by the PSORT algorithm (psort.nibb.ac.jp). Functional domains were also predicted using the MOTIFS program (GCG Wisconsin & PROSITE).

For each of the following examples: based on the presence of a putative leader sequence and/or several putative transmembrane domains (single-underlined) in the gonococcal protein, it is predicted that the proteins from *N. meningitidis* and *N. gonorrhoeae*, and their respective epitopes, could be useful antigens or immunogenic compositions for vaccines or diagnostics.

The standard techniques and procedures which may be employed in order to perform the invention (e.g. to utilize the disclosed sequences for vaccination or diagnostic purposes) were summarized above. This summary is not a limitation on the invention but, rather, gives examples that may be used, but are not required.

In particular, the following methods were used to express, purify and biochemically characterize the proteins of the invention.

Chromosomal DNA Preparation

*N. meningitidis* strain 2996 was grown to exponential phase in 100 ml of GC medium, harvested by centrifugation, and resuspended in 5 ml buffer (20% Sucrose, 50 mM Tris- HCl, 50 mM EDTA, pH 8.0). After 10 minutes incubation on ice, the bacteria were lysed by adding 10 ml lysis solution (50 mM NaCl, 1% Na-SARKOSYL™, 50 μg/ml Proteinase K), and the suspension was incubated at 37° C. for 2 hours. Two phenol extractions (equilibrated to pH 8) and one CHCl$_3$/isoamylalcohol (24:1) extraction were performed. DNA was precipitated by addition of 0.3M sodium acetate and 2 volumes ethanol, and was collected by centrifugation. The pellet was washed once with 70% ethanol and redissolved in 4.0 ml TE buffer (10 mM Tris-HCl, 1 mM EDTA, pH 8). The DNA concentration was measured by reading the OD at 260 nm.

Oligonucleotide Design

Synthetic oligonucleotide primers were designed on the basis of the coding sequence of each ORF, using (a) the meningococcus B sequence when available, or (b) the gonococcus/meningococcus A sequence, adapted to the codon preference usage of meningococcus. Any predicted signal peptides were omitted, by deducing the 5'-end amplification primer sequence immediately downstream from the predicted leader sequence.

For most ORFs, the 5' primers included two restriction enzyme recognition sites (BamHI-NdeI, BamHI-NheI, EcoRI-NdeI or EcoRI-NheI), depending on the restriction pattern of the gene of interest. The 3' primers included a XhoI or a HindIII restriction site (table 1). This procedure was established in order to direct the cloning of each amplification product (corresponding to each ORF) into two different expression systems: pGEX-KG (using either BamHI-XhoI, BamHI-HindIII, EcoRI-XhoI, or EcoRI-HindIII), and pET21b+ (using either NdeI-XhoI, NheI-XhoI, NdeI-HindIII, or NheI-HindIII).

```
5'-end primer tail:
CGCGGATCCCATATG        (BamHI-NdeI)    (SEQ ID 3288)
CGCGGATCCGCTAGC        (BamHI-NheI)    (SEQ ID 3289)
CCGGAATTCTAGATATC      (EcoRI-NdeI)    (SEQ ID 3290)
CCGGAATTCTAGCTAGC      (EcoRI-NheI)    (SEQ ID 3291)

3'-end primer tail:
CCCGCTCGAG             (XhoI)          (SEQ ID 3292)
CCCGCTCGAG             (HindIII)       (SEQ ID 3293)
```

For cloning ORFs into the pGEX-His Vector, the 5' and 3' primers contained only one restriction enzyme site (EcoRI, KpnI or SalI for the 5' primers and PstI, XbaI, SphI or SalI for the 3' primers). Again restriction sites were chosen according to the particular restriction pattern of the gene (table 1).

```
5'-end primer tail:
(AAA)AAAGAATTC         (EcoRI)         (SEQ ID 3294)
(AAA)AAAGGATCC         (KpnI)          (SEQ ID 3295)

3'-end primer tail:
(AAA)AAACTGCAG         (PstI)          (SEQ ID 3296)
(AAA)AAATCTAGA         (XbaI)          (SEQ ID 3297)
AAAGCATGC              (SphI)          (SEQ ID 3298)

5' or 3'-end primer tail:
AAAAAAGAATCC           (PstI)          (SEQ ID 3299)
```

As well as containing the restriction enzyme recognition sequences, the primers included nucleotides which hybridized to the sequence to be amplified. The melting temperature depended on the number and type of hybridizing nucleotides in the whole primer, and was determined for each primer using the formulae:

$$T_m = 4(G+C) + 2(A+T) \text{(tail excluded)}$$

$$T_m = 64.9 + 0.41(\% \, GC) - 600/N \text{(whole primer)}$$

The melting temperature of the selected oligonucleotides were usually 65-70° C. for the whole oligo and 50-55° C. for the hybridising region alone.

Table 1 shows the forward and reverse primers used for each amplification. In certain cases, the sequences of the primer does not match exactly the sequence of the predicted ORF. This is because when initial amplifications were performed, the complete 5' and/or 3' sequences for some meningococcal B ORFs were not be known. However, the corresponding sequences had been identified in Gonococcus or in Meningococcus A. Hence, when the Meningococcus B sequence was incomplete or uncertain, Gonococcus or in Meningococcus A sequences were used as the basis for the primer design. These sequences were altered to take account of codon preference. It can be appreciated that, once the complete sequence is identified, this approach will no longer be necessary.

Oligonucleotides were synthesized using a Perkin Elmer 394 DNA/RNA SYNTHESIZER™, eluted from the columns in 2.0 ml NH$_4$OH, and deprotected by 5 hours incubation at 56° C. The oligos were precipitated by addition of 0.3M Na-Acetate and 2 volumes ethanol. The samples were centrifuged and the pellets resuspended in either 100 μl or 1.0 ml of water. The OD$_{260}$ was determined using a Perkin Elmer LAMBDA BIO™ spectophotometer and the concentration adjusted to 2-10 pmol/μl.

Amplification

The standard PCR protocol was as follows: 50-200 ng of genomic DNA was used as a template in the presence of 20-40 μM of each oligonucleotide primer, 400-800 μM dNTPs solution, 1x PCR buffer (including 1.5 mM MgCl$_2$), 2.5 units TaqI DNA polymerase (using Perkin-Elmer AMPLITAQ™, GIBCO Platinum, Pwo DNA polymerase, or Tahara Shuzo Taq polymerase). In some cases, PCR was optimised by the addition of 10 μl of DMSO or 50 μl of 2M Betaine.

After a hot start (adding the polymerase during a preliminary 3 minute incubation of the whole mix at 95° C.), each sample underwent a two-step amplification. The first 5 cycles were performed using the hybridization temperature that excluded the restriction enzyme tail of the primer (see above). This was followed by 30 cycles using the hybridization temperature calculated for the whole length oligos. The cycles were followed by a final 10 minute extension step at 72° C. The standard cycles were as follows:

|  | Denaturation | Hybridisation | Elongation |
| --- | --- | --- | --- |
| First 5 cycles | 30 seconds 95° C. | 30 seconds 50-55° C. | 30-60 seconds 72° C. |
| Last 30 cycles | 30 seconds 95° C. | 30 seconds 65-70° C. | 30-60 seconds 72° C. |

The elongation time varied according to the length of the ORF to be amplified. Amplifications were performed using either a 9600 or a 2400 Perkin Elmer GeneAmp PCR System. To check the results, 1/10 of the amplification volume was loaded onto a 1-1.5% (w/v) agarose gel and the size of each amplified fragment compared with a DNA molecular weight marker.

The amplified DNA was either loaded directly on a 1% agarose gel or first precipitated with ethanol and resuspended in a volume suitable to be loaded on a 1.0% agarose gel. The DNA fragment corresponding to the band of the correct size was purified using the Qiagen Gel Extraction Kit, following the manufacturer's protocol. DNA fragments were eluted in a volume of 30 μl or 50 μl of either H2O or 10 mM Tris, pH 8.5.

Digestion of PCR Fragments

The purified DNA corresponding to the amplified fragment was double-digested with the appropriate restriction enzymes for; cloning into pET-21b+ and expressing the protein as a C-terminus His-tagged fusion, for cloning into pGEX-KG and expressing the protein as a N-terminus GST-fusion, and for cloning into pGEX-His and expressing the protein as a N-terminus GST-his tagged fusion.

Each purified DNA fragment was incubated at 37° C. for 3 hours to overnight with 20 units of appropriate restriction enzyme (New England Biolabs) in a either 30 or 40 µl in the presence of suitable digestion buffer. Digested products were purified using the QIAquick PCR purification kit (following the manufacturer's instructions) and eluted in a final volume of 30 or 50 µl of either H2O or 10 mM Tris, pH 8.5. The DNA concentration was determined by quantitative agarose gel electrophoresis (1.0% gel) in the presence of a titrated molecular weight marker.

Digestion of the Cloning Vectors (pET22B, pGEX-KG, pTRC-His A, pET21b+, pGEX-KG, and pGEX-His)

The vector pGEX-His is a modified pGEX-2T vector carrying a region encoding six histidine residues upstream of the thrombin cleavage site and containing the multiple cloning site of the vector pTRC99 (Pharmacia). 10 µg plasmid was double-digested with 50 units of each restriction enzyme in 200 µl reaction volume in the presence of appropriate buffer by overnight incubation at 37° C. After loading the whole digestion on a 1% agarose gel, the band corresponding to the digested vector was purified from the gel using the Qiagen QIAquick Gel Extraction Kit and the DNA was eluted in 50 µl of 10 mM Tris-HCl, pH 8.5. The DNA concentration was evaluated by measuring $OD_{260}$ of the sample, and adjusted to 50 µg/µl of plasmid was used for each cloning procedure.

10 µg plasmid was double-digested with 50 units of each restriction enzyme in 200 µl reaction volume in the presence of appropriate buffer by overnight incubation at 37° C. The digest was loaded onto a 1% agarose gel and the band corresponding to the digested vector purified using the Qiagen QIAquick Gel Extraction Kit. DNA was eluted in 50 µl of 10 mM Tris-HCl, pH 8.5. The DNA concentration was evaluated by measuring $OD_{260}$ and the concentration adjusted to 50 µg/µl. 1 µl of plasmid was used for each cloning procedure.

Cloning

For some ORFs, the fragments corresponding to each ORF, previously digested and purified, were ligated in both pET22b and pGEX-KG. In a final volume of 20 µl, a molar ratio of 3:1 fragment/vector was ligated using 0.5 µl of NEB T4 DNA ligase (400 units/µl), in the presence of the buffer supplied by the manufacturer. The reaction was incubated at room temperature for 3 hours. In some experiments, ligation was performed using the Boheringer "Rapid Ligation Kit", following the manufacturer's instructions.

In order to introduce the recombinant plasmid in a suitable strain, 100 µl E. coli DH5 competent cells were incubated with the ligase reaction solution for 40 minutes on ice, then at 37° C. for 3 minutes, then, after adding 800 µl LB broth, again at 37° C. for 20 minutes. The cells were then centrifuged at maximum speed in an Eppendorf microfuge and resuspended in approximately 200 µl of the supernatant. The suspension was then plated on LB ampicillin (100 mg/ml).

The screening of the recombinant clones was performed by growing 5 randomly-chosen colonies overnight at 37° C. in either 2 ml (pGEX or pTC clones) or 5 ml (pET clones) LB broth+100 µg/ml ampicillin. The cells were then pelleted and the DNA extracted using the Qiagen QIAprep Spin Miniprep Kit, following the manufacturer's instructions, to a final volume of 30 µl. 5 µl of each individual miniprep (approximately 1 g) were digested with either NdeI/XhoI or BamHI/XhoI and the whole digestion loaded onto a 1-1.5% agarose gel (depending on the expected insert size), in parallel with the molecular weight marker (1 Kb DNA Ladder, GIBCO). The screening of the positive clones was made on the base of the correct insert size.

For other ORFs, the fragments corresponding to each ORF, previously digested and purified, were ligated in both pET21b+ and pGEX-KG. A molar ratio of 3:1 fragment/vector was used in a final volume of 20 µl, that included 0.5 µl of T4 DNA ligase (400 units/µl, NEB) and ligation buffer supplied by the manufacturer. The reaction was performed at room temperature for 3 hours. In some experiments, ligation was performed using the Boheringer "Rapid Ligation Kit" and the manufacturer's protocol.

Recombinant plasmid was transformed into 100 µl of competent E. coli DH5 or HB101 by incubating the ligase reaction solution and bacteria for 40 minutes on ice then at 37° C. for 3 minutes. This was followed by addition of 800 µl LB broth and incubation at 37° C. for 20 minutes. The cells were then centrifuged at maximum speed in an Eppendorf microfuge, resuspended in approximately 200 µl of the supernatant, and plated on LB ampicillin (100 mg/ml) agar.

Screening for recombinant clones was performed by growing 5 randomly selected colonies overnight at 37° C. in either 2.0 ml (pGEX-KG clones) or 5.0 ml (pET clones) LB broth+100 µg/ml ampicillin. Cells were pelleted and plasmid DNA extracted using the Qiagen QIAprep Spin Miniprep Kit, following the manufacturer's instructions. Approximately 1 µg of each individual miniprep was digested with the appropriate restriction enzymes and the digest loaded onto a 1-1.5% agarose gel (depending on the expected insert size), in parallel with the molecular weight marker (1 kb DNA Ladder, GIBCO). Positive clones were selected on the basis of the size of the insert.

ORFs were cloned in PGEX-His, by doubly-digesting the PC product and ligating into similarly digested vector. After cloning, recombinant plasmids were transformed into the E. coli host W3110. Individual clones were grown overnight at 37° C. in LB broth with 50 µg/ml ampicillin.

Certain ORFs may be cloned into the pGEX-HIS vector using EcoRI-PstI cloning sites, or EcoRI-SalI, or SalI-PstI. After cloning, the recombinant plasmids may be introduced in the E. coli host W3110.

Expression

Each ORF cloned into the expression vector may then be transformed into the strain suitable for expression of the recombinant protein product. 1 µl of each construct was used to transform 30 µl of E. coli BL21 (pGEX vector), E. coli TOP 10 (pTRC vector) or E. coli BL21-DE3 (pET vector), as described above. In the case of the pGEX-His vector, the same E. coli strain (W3110) was used for initial cloning and expression. Single recombinant colonies were inoculated into 2 ml LB+Amp (100 µg/ml), incubated at 37° C. overnight, then diluted 1:30 in 20 ml of LB+Amp (100 µs/ml) in 100 ml flasks, making sure that the $OD_{600}$ ranged between 0.1 and 0.15. The flasks were incubated at 30° C. into gyratory water bath shakers until OD indicated exponential growth suitable for induction of expression (0.4-0.8 OD for pET and pTRC vectors; 0.8-1 OD for pGEX and pGEX-His vectors). For the pET, pTRC and pGEX-His vectors, the protein expression was induced by addiction of 1 mM IPTG, whereas in the case of pGEX system the final concentration of IPTG was 0.2 mM. After 3 hours incubation at 30° C., the final concentration of the sample was checked by OD. In order to check expression, 1 ml of each sample was removed, centrifuged in a microfuge, the pellet resuspended in PBS, and analysed by 12% SDS- PAGE with Coomassie Blue staining. The whole sample was centrifuged at 6000 g and the pellet resuspended in PBS for further use.

GST-Fusion Proteins Large-Scale Purification.

For some ORFs, a single colony was grown overnight at 37° C. on LB+Amp agar plate. The bacteria were inoculated into 20 ml of LB+Amp liquid culture in a water bath shaker and grown overnight. Bacteria were diluted 1:30 into 600 ml of fresh medium and allowed to grow at the optimal temperature (20-37° C.) to $OD_{550}$ 0.8-1. Protein expression was induced with 0.2 mM IPTG followed by three hours incubation. The culture was centrifuged at 8000 rpm at 4° C. The supernatant was discarded and the bacterial pellet was resuspended in 7.5 ml cold PBS. The cells were disrupted by sonication on ice for 30 sec at 40 W using a Branson sonifier B-15, frozen and thawed two times and centrifuged again. The supernatant was collected and mixed with 150 µl GLUTATHIONE-SEPHAROSE 4B™ resin (Pharmacia) (previously washed with PBS) and incubated at room temperature for 30 minutes. The sample was centrifuged at 700 g for 5 minutes at 4 C. The resin was washed twice with 10 ml cold PBS for 10 minutes, resuspended in 1 ml cold PBS, and loaded on a disposable column. The resin was washed twice with 2 ml cold PBS until the flow-through reached $OD_{280}$ of 0.02-0.06. The GST-fusion protein was eluted by addition of 700 µl cold Glutathione elution buffer (10 mM reduced glutathione, 50 mM Tris-HCl) and fractions collected until the $OD_{280}$ was 0.1. 21 µl of each fraction were loaded on a 12% SDS gel using either Biorad SDS-PAGE Molecular weight standard broad range (M1) (200, 116.25, 97.4, 66.2, 45, 31, 21.5, 14.4, 6.5 kDa) or Amersham Rainbow Marker (M") (220, 66, 46, 30, 21.5, 14.3 kDa) as standards. As the MW of GST is 26 kDa, this value must be added to the MW of each GST-fusion protein.

For other ORFs, for each clone to be purified as a GST-fusion, a single colony was streaked out and grown overnight at 37° C. on LB/Amp (100 µg/ml) agar plate. An isolated colony from this plate was inoculated into 20 ml of LB/Amp (100 µg/ml) liquid medium and grown overnight at 37° C. with shaking. The overnight culture was diluted 1:30 into 600 ml of LB/Amp (100 µg/ml) liquid medium and allowed to grow at the optimal temperature (20-37° C.) until the $OD_{550}$ reached 0.6-0.8. Recombinant protein expression was induced by addition of IPTG (final concentration 0.2 mM) and the culture incubated for a further 3 hours. The bacteria were harvested by centrifugation at 8000×g for 15 min at 4° C.

The bacterial pellet was resuspended in 7.5 ml cold PBS. Cells were disrupted by sonication on ice for 30 sec at 40 W using a Branson sonifier 450 and centrifuged at 13 000×g for 30 min at 4° C. The supernatant was collected and mixed with 150 µl GLUTATHIONE-SEPHAROSE 4B™ resin (Pharmacia), previously equilibrated with PBS, and incubated at room temperature with gentle agitation for 30 min. The batch-wise preparation was centrifuged at 700×g for 5 min at 4° C. and the supernatant discarded. The resin was washed twice (batchwise) with 10 ml cold PBS for 10 min, resuspended in 1 ml cold PBS, and loaded onto a disposable column. The resin continued to be washed twice with cold PBS, until the $OD_{280nm}$ of the flow-through reached 0.02-0.01. The GST-fusion protein was eluted by addition of 700 µl cold glutathione elution buffer (10 mM reduced glutathione, 50 mM Tris-HCl pH 8.0) and fractions collected, until the $OD_{280nm}$ of the eluate indicated all the recombinant protein was obtained. 20 µl aliquots of each elution fraction were analyzed by SDS-PAGE using a 12% gel. The molecular mass of the purified proteins was determined using either the Bio-Rad broad range molecular weight standard (M1) (200, 116, 97.4, 66.2, 45.0, 31.0, 21.5, 14.4, 6.5 kDa) or the Amersham Rainbow Marker (M2) (220, 66.2, 46.0, 30.0, 21.5, 14.3 kDa). The molecular weights of GST-fusion proteins are a combination of the 26 kDa GST protein and its fusion partner. Protein concentrations were estimated using the Bradford assay.

His-Fusion Soluble Proteins Large-Scale Purification.

For some ORFs, a single colony was grown overnight at 37° C. on a LB+Amp agar plate. The bacteria were inoculated into 20 ml of LB+Amp liquid culture and incubated overnight in a water bath shaker. Bacteria were diluted 1:30 into 600 ml fresh medium and allowed to grow at the optimal temperature (20-37° C.) to $OD_{550}$ 0.6-0.8. Protein expression was induced by addition of 1 mM IPTG and the culture further incubated for three hours. The culture was centrifuged at 8000 rpm at 4° C., the supernatant was discarded and the bacterial pellet was resuspended in 7.5 ml cold 10 mM imidazole buffer (300 mM NaCl, 50 mM phosphate buffer, 10 mM imidazole, pH 8). The cells were disrupted by sonication on ice for 30 sec at 40 W using a Branson sonifier B-15, frozen and thawed two times and centrifuged again. The supernatant was collected and mixed with 150 µl $Ni^{2+}$-resin (Pharmacia) (previously washed with 10 mM imidazole buffer) and incubated at room temperature with gentle agitation for 30 minutes. The sample was centrifuged at 700 g for 5 minutes at 4° C. The resin was washed twice with 10 ml cold 10 mM imidazole buffer for 10 minutes, resuspended in 1 ml cold 10 mM imidazole buffer and loaded on a disposable column. The resin was washed at 4° C. with 2 ml cold 10 mM imidazole buffer until the flow-through reached the $O.D_{280}$ of 0.02-0.06. The resin was washed with 2 ml cold 20 mM imidazole buffer (300 mM NaCl, 50 mM phosphate buffer, 20 mM imidazole, pH 8) until the flow-through reached the $O.D_{280}$ of 0.02-0.06. The His-fusion protein was eluted by addition of 700 µl cold 250 mM imidazole buffer (300 mM NaCl, 50 mM phosphate buffer, 250 mM imidazole, pH 8) and fractions collected until the $O.D_{280}$ was 0.1. 21 µl of each fraction were loaded on a 12% SDS gel.

His-Fusion Insoluble Proteins Large-Scale Purification.

A single colony was grown overnight at 37° C. on a LB+Amp agar plate. The bacteria were inoculated into 20 ml of LB+Amp liquid culture in a water bath shaker and grown overnight. Bacteria were diluted 1:30 into 600 ml fresh medium and let to grow at the optimal temperature (37° C.) to $O.D_{550}$ 0.6-0.8. Protein expression was induced by addition of 1 mM IPTG and the culture further incubated for three hours. The culture was centrifuged at 8000 rpm at 4° C. The supernatant was discarded and the bacterial pellet was resuspended in 7.5 ml buffer B (urea 8M, 10 mM Tris-HCl, 100 mM phosphate buffer, pH 8.8). The cells were disrupted by sonication on ice for 30 sec at 40 W using a Branson sonifier B-15, frozen and thawed twice and centrifuged again. The supernatant was stored at −20° C., while the pellets were resuspended in 2 ml guanidine buffer (6M guanidine hydrochloride, 100 mM phosphate buffer, 10 mM Tris-HCl, pH 7.5) and treated in a homogenizer for 10 cycles. The product was centrifuged at 13000 rpm for 40 minutes. The supernatant was mixed with 150 µl $Ni^{2\pm}$-resin (Pharmacia) (previously washed with buffer B) and incubated at room temperature with gentle agitation for 30 minutes. The sample was centrifuged at 700 g for 5 minutes at 4° C. The resin was washed twice with 10 ml buffer B for 10 minutes, resuspended in 1 ml buffer B, and loaded on a disposable column. The resin was washed at room temperature with 2 ml buffer B until the flow-through reached the $OD_{280}$ of 0.02-0.06. The resin was washed with 2 ml buffer C (urea 8M, 10 mM Tris-HCl, 100 mM phosphate buffer, pH 6.3) until the flow-through reached the O.D.$_{280}$ of 0.02-0.06. The His-fusion protein was eluted by addition of 700 µl elution buffer (urea 8M, 10 mM Tris-HCl, 100 mM phosphate buffer, pH 4.5) and fractions collected until the OD$_{280}$ was 0.1. 21 µl of each fraction were loaded on a 12% SDS gel.

Purification of His-Fusion Proteins.

For each clone to be purified as a His-fusion, a single colony was streaked out and grown overnight at 37° C. on LB/Amp (100 µg/ml) agar plate. An isolated colony from this plate was inoculated into 20 ml of LB/Amp (100 µg/ml) liquid medium and grown overnight at 37° C. with shaking. The overnight culture was diluted 1:30 into 600 ml of LB/Amp (100 µg/ml) liquid medium and allowed to grow at the optimal temperature (20-37° C.) until the OD$_{550}$ reached 0.6-0.8. Expression of recombinant protein was induced by addition of IPTG (final concentration 1.0 mM) and the culture incubated for a further 3 hours. The bacteria were harvested by centrifugation at 8000×g for 15 min at 4° C.

The bacterial pellet was resuspended in 7.5 ml either (i) cold buffer A (300 mM NaCl, 50 mM phosphate buffer, 10 mM imidazole, pH 8.0) for soluble proteins or (ii) buffer B (8M urea, 10 mM TrisHCl, 100 mM phosphate buffer, pH 8.8) for insoluble proteins. Cells were disrupted by sonication on ice four times for 30 sec at 40 W using a Branson sonifier 450 and centrifuged at 13 000×g for 30 min at 4° C. For insoluble proteins, pellets were resuspended in 2.0 ml buffer C (6M guanidine hydrochloride, 100 mM phosphate buffer, 10 mM Tris-HCl, pH 7.5) and treated with a Dounce homogenizer for 10 cycles. The homogenate was centrifuged at 13 000×g for 40 min and the supernatant retained.

Supernatants for both soluble and insoluble preparations were mixed with 150 Ni$^{2+}$-resin (previously equilibrated with either buffer A or buffer B, as appropriate) and incubated at room temperature with gentle agitation for 30 min. The resin was CHELATING SEPHAROSE FAST FLOW™ (Pharmacia), prepared according to the manufacturers protocol. The batch-wise preparation was centrifuged at 700×g for 5 min at 4° C. and the supernatant discarded. The resin was washed twice (batch-wise) with 10 ml buffer A or B for 10 min, resuspended in 1.0 ml buffer A or B and loaded onto a disposable column. The resin continued to be washed with either (i) buffer A at 4° C. or (ii) buffer B at room temperature, the OD$_{280nm}$ of the flow-through reached 0.02-0.01. The resin was further washed with either (i) cold buffer C (300 mM NaCl, 50 mM phosphate buffer, 20 mM imidazole, pH 8.0) or (ii) buffer D (8M urea, 10 mM Tris-HCl, 100 mM phosphate buffer, pH 6.3) until OD$_{280nm}$ of the flow-through reached 0.02-0.01. The His-fusion protein was eluted by addition of 700 µl of either (1) cold elution buffer A (300 mM NaCl, 50 mM phosphate buffer, 250 mM imidazole, pH 8.0) or (ii) elution buffer B (8M urea, 10 mM Tris-HCl, 100 mM phosphate buffer, pH 4.5) and fractions collected until the O.D.$_{280nm}$ indicated all the recombinant protein was obtained. 20 µl aliquots of each elution fraction were analyzed by SDS-PAGE using a 12% gel. Protein concentrations were estimated using the Bradford assay.

His-Fusion Proteins Renaturation

In the cases where denaturation was required to solubilize proteins, a renaturation step was employed prior to immunization. Glycerol was added to the denatured fractions obtained above to a final concentration of 10%(v/v). The proteins were then diluted to 200 µg/ml using dialysis buffer I (10%(v/v) glycerol, 0.5M arginine, 50 mM phosphate buffer, 5 mM reduced glutathione, 0.5 mM oxidised glutathione, 2M urea, pH 8.8) and dialysed against the same buffer for 12-14 hours at 4° C. Further dialysis was performed with buffer II (10% (v/v) glycerol, 0.5M arginine, 50 mM phosphate buffer, 50 mM reduced glutathione, 5.0 mM oxidised glutathione, pH 8.8) for 12-14 hours at 4° C.

Alternatively, 10% glycerol was added to the denatured proteins. The proteins were then diluted to 20 µg/ml using dialysis buffer I (10% glycerol, 0.5M arginine, 50 mM phosphate buffer, 5 mM reduced glutathione, 0.5 mM oxidised glutathione, 2M urea, pH 8.8) and dialysed against the same buffer at 4° C. for 12-14 hours. The protein was further dialysed against dialysis buffer II (10% glycerol, 0.5M arginine, 50 mM phosphate buffer, 5 mM reduced glutathione, 0.5 mM oxidised glutathione, pH 8.8) for 12-14 hours at 4° C.

Protein concentration was evaluated using the formula:

$$\text{Protein(mg/ml)} = (1.55 \times OD_{280}) - (0.76 \times OD_{260})$$

Purification of Proteins

To analyse the solubility, pellets obtained from 3.0 ml cultures were resuspended in 500 µl buffer M1 (PBS pH 7.2). 25 µl of lysozyme (10 mg/ml) was added and the bacteria incubated for 15 min at 4° C. Cells were disrupted by sonication on ice four times for 30 sec at 40 W using a Branson sonifier 450 and centrifuged at 13 000×g for 30 min at 4° C. The supernatant was collected and the pellet resuspended in buffer M2 [8M urea, 0.5M NaCl, 20 mM imidazole and 0.1 M NaH$_2$PO$_4$] and incubated for 3 to 4 hours at 4° C. After centrifugation, the supernatant was collected and the pellet resuspended in buffer M3 [6M guanidinium-HCl, 0.5M NaCl, 20 mM imidazole and 0.1 M NaH$_2$PO$_4$] overnight at 4° C. The supernatants from all steps were analysed by SDS-PAGE. Some proteins were found to be soluble in PBS, others needed urea or guanidinium-HCl for solubilization.

For preparative scale purification, 500 ml cultures were induced and fusion proteins solubilized in either buffer M1, M2, or M3 using the procedure described above. Crude extracts were loaded onto a Ni-NTA superflow column (Qiagen) equilibrated with buffer M1, M2, or M3 depending on the solubilization buffer employed. Unbound material was eluted with the corresponding buffer containing 500 mM imidazole then dialysed against the same buffer in the absence of imidazole.

Mice Immunisations

20 µg of each purified protein are used to immunise mice intraperitoneally. In the case of some ORFs, Balb-C mice were immunised with Al(OH)$_3$ as adjuvant on days 1, 21 and 42, and immune response was monitored in samples taken on day 56. For other ORFs, CD1 mice could be immunised using the same protocol. For ORFs 25 and 40, CD1 mice were immunised using Freund's adjuvant, and the same immunisation protocol was used, except that the immune response was measured on day 42, rather than 56. Similarly, for still other ORFs, CD1 mice were immunised with Freund's adjuvant, but the immune response was measured on day 49. Alternatively, 20 µg of each purified protein was mixed with Freund's adjuvant and used to immunize CD1 mice intraperitoneally. For many of the proteins, the immunization was performed on days 1, 21 and 35, and immune response was monitored in samples taken on days 34 and 49. For some proteins, the third immunization was performed on day 28, rather than 35, and immune response was measured on days 20 and 42, rather than 34 and 49.

ELISA Assay (Sera Analysis)

The acapsulated MenB M7 strain was plated on chocolate agar plates and incubated overnight at 37° C. Bacterial colonies were collected from the agar plates using a sterile dracon swab and inoculated into 7 ml of Mueller-Hinton Broth (Difco) containing 0.25% Glucose. Bacterial growth was monitored every 30 minutes by following OD$_{620}$. The bacteria were let to grow until the OD reached the value of 0.3-0.4.

The culture was centrifuged for 10 minutes at 10000 rpm. The supernatant was discarded and bacteria were washed once with PBS, resuspended in PBS containing 0.025% formaldehyde, and incubated for 2 hours at room temperature and then overnight at 4° C. with stiffing. 100 µl bacterial cells were added to each well of a 96 well Greiner plate and incubated overnight at 4° C. The wells were then washed three times with PBT washing buffer (0.1% TWEEN-20™ in PBS). 200 µl of saturation buffer (2.7% Polyvinylpyrrolidone 10 in water) was added to each well and the plates incubated for 2 hours at 37° C. Wells were washed three times with PBT. 200 µl of diluted sera (Dilution buffer: 1% BSA, 0.1% TWEEN-20™, 0.1% NaN$_3$ in PBS) were added to each well and the plates incubated for 90 minutes at 37° C. Wells were washed three times with PBT. 100 µl of HRP-conjugated rabbit anti-mouse (Dako) serum diluted 1:2000 in dilution buffer were added to each well and the plates were incubated for 90 minutes at 37° C. Wells were washed three times with PBT buffer. 100 µl of substrate buffer for HRP (25 ml of citrate buffer pH5, 10 mg of 0-phenildiamine and 10 µl of H$_2$O) were added to each well and the plates were left at room temperature for 20 minutes. 100 µl H$_2$SO$_4$ was added to each well and OD$_{490}$ was followed. The ELISA was considered positive when OD490 was 2.5 times the respective pre-immune sera.

Alternatively, The acapsulated MenB M7 strain was plated on chocolate agar plates and incubated overnight at 37° C. Bacterial colonies were collected from the agar plates using a sterile dracon swab and inoculated into Mueller-Hinton Broth (Difco) containing 0.25% Glucose. Bacterial growth was monitored every 30 minutes by following OD$_{620}$. The bacteria were let to grow until the OD reached the value of 0.3-0.4. The culture was centrifuged for 10 minutes at 10 000 rpm. The supernatant was discarded and bacteria were washed once with PBS, resuspended in PBS containing 0.025% formaldehyde, and incubated for 1 hour at 37° C. and then overnight at 4° C. with stirring. 100 µl bacterial cells were added to each well of a 96 well Greiner plate and incubated overnight at 4° C. The wells were then washed three times with PBT washing buffer (0.1% TWEEN-20™ in PBS). 200 µl of saturation buffer (2.7% Polyvinylpyrrolidone 10 in water) was added to each well and the plates incubated for 2 hours at 37° C. Wells were washed three times with PBT. 200 µl of diluted sera (Dilution buffer: 1% BSA, 0.1% TWEEN-20™, 0.1% NaN$_3$ in PBS) were added to each well and the plates incubated for 2 hours at 37° C. Wells were washed three times with PBT. 100 µl of HRP-conjugated rabbit anti-mouse (Dako) serum diluted 1:2000 in dilution buffer were added to each well and the plates were incubated for 90 minutes at 37° C. Wells were washed three times with PBT buffer. 100 µl of substrate buffer for HRP (25 ml of citrate buffer pH5, 10 mg of 0-phenildiamine and 10 µl of H$_2$O$_2$) were added to each well and the plates were left at room temperature for 20 minutes. 100 µl H$_2$SO$_4$ was added to each well and OD$_{490}$ was followed. The ELISA titers were calculated arbitrarily as the dilution of sera which gave an OD$_{490}$ value of 0.4 above the level of preimmune sera. The ELISA was considered positive when the dilution of sera with OD$_{490}$ of 0.4 was higher than 1:400.

FACScan Bacteria Binding Assay Procedure.

The acapsulated MenB M7 strain was plated on chocolate agar plates and incubated overnight at 37° C. Bacterial colonies were collected from the agar plates using a sterile dracon swab and inoculated into 4 tubes containing 8 ml each Mueller-Hinton Broth (Difco) containing 0.25% glucose. Bacterial growth was monitored every 30 minutes by following OD$_{620}$. The bacteria were let to grow until the OD reached the value of 0.35-0.5. The culture was centrifuged for 10 minutes at 4000 rpm. The supernatant was discarded and the pellet was resuspended in blocking buffer (1% BSA, 0.4% NaN$_3$) and centrifuged for 5 minutes at 4000 rpm. Cells were resuspended in blocking buffer to reach OD$_{620}$ of 0.07. 100 µl bacterial cells were added to each well of a Costar 96 well plate. 100 µl of diluted (1:200) sera (in blocking buffer) were added to each well and plates incubated for 2 hours at 4° C. Cells were centrifuged for 5 minutes at 4000 rpm, the supernatant aspirated and cells washed by addition of 200 µl/well of blocking buffer in each well. 100 µl of R-Phicoerytrin conjugated F(ab)$_2$ goat anti-mouse, diluted 1:100, was added to each well and plates incubated for 1 hour at 4° C. Cells were spun down by centrifugation at 4000 rpm for 5 minutes and washed by addition of 200 µl/well of blocking buffer. The supernatant was aspirated and cells resuspended in 200 µl/well of PBS, 0.25% formaldehyde. Samples were transferred to FACScan tubes and read. The condition for FACScan setting were: FL1 on, FL2 and FL3 off; FSC-H Treshold: 92; FSC PMT Voltage: E 02; SSC PMT: 474; Amp. Gains 7.1; FL-2 PMT: 539. Compensation values: 0.

OMV Preparations

Bacteria were grown overnight on 5 GC plates, harvested with a loop and resuspended in 10 ml 20 mM Tris-HCl. Heat inactivation was performed at 56° C. for 30 minutes and the bacteria disrupted by sonication for 10' on ice (50% duty cycle, 50% output). Unbroken cells were removed by centrifugation at 5000 g for 10 minutes and the total cell envelope fraction recovered by centrifugation at 50000 g at 4° C. for 75 minutes. To extract cytoplasmic membrane proteins from the crude outer membranes, the whole fraction was resuspended in 2% sarkosyl (Sigma) and incubated at room temperature for 20 minutes. The suspension was centrifuged at 10000 g for 10 minutes to remove aggregates, and the supernatant further ultracentrifuged at 50000 g for 75 minutes to pellet the outer membranes. The outer membranes were resuspended in 10 mM Tris-HCl, pH8 and the protein concentration measured by the Bio-Rad Protein assay, using BSA as a standard.

Whole Extracts Preparation

Bacteria were grown overnight on a GC plate, harvested with a loop and resuspended in 1 ml of 20 mM Tris-HCl. Heat inactivation was performed at 56° C. for 30' minutes.

Western Blotting

Purified proteins (500 ng/lane), outer membrane vesicles (5 µg) and total cell extracts (25 µg) derived from MenB strain 2996 were loaded onto a 12% SDS-polyacrylamide gel and transferred to a nitrocellulose membrane. The transfer was performed for 2 hours at 150 mA at 4° C., using transfer buffer (0.3% Tris base, 1.44% glycine, 20% (v/v) methanol). The membrane was saturated by overnight incubation at 4° C. in saturation buffer (10% skimmed milk, 0.1% TRITON X100™ in PBS). The membrane was washed twice with washing buffer (3% skimmed milk, 0.1% TRITON X100™ in PBS) and incubated for 2 hours at 37° C. with mice sera diluted 1:200 in washing buffer. The membrane was washed twice and incubated for 90 minutes with a 1:2000 dilution of horseradish peroxidase labeled anti-mouse Ig. The membrane was washed twice with 0.1% TRITON X100™ in PBS and developed with the OPTI-4CN SUBSTRATE KIT™ (Bio-Rad). The reaction was stopped by adding water.

Bactericidal Assay

MC58 and 2996 strains were grown overnight at 37° C. on chocolate agar plates. 5-7 colonies were collected and used to inoculate 7 ml Mueller-Hinton broth. The suspension was incubated at 37° C. on a nutator and let to grow until OD$_{620}$ was in between 0.5-0.8. The culture was aliquoted into sterile 1.5 ml Eppendorf tubes and centrifuged for 20 minutes at maximum speed in a microfuge. The pellet was washed once in Gey's buffer (Gibco) and resuspended in the same buffer to an $OD_{620}$ of 0.5, diluted 1:20000 in Gey's buffer and stored at 25° C.

50 µl of Gey's buffer/1% BSA was added to each well of a 96-well tissue culture plate. 25 µl of diluted (1:100) mice sera (dilution buffer: Gey's buffer/0.2% BSA) were added to each well and the plate incubated at 4° C. 25 µl of the previously described bacterial suspension were added to each well. 25 µl of either heat-inactivated (56° C. waterbath for 30 minutes) or normal baby rabbit complement were added to each well. Immediately after the addition of the baby rabbit complement, 22 µl of each sample/well were plated on Mueller-Hinton agar plates (time 0). The 96-well plate was incubated for 1 hour at 37° C. with rotation and then 22 µl of each sample/well were plated on Mueller-Hinton agar plates (time 1). After overnight incubation the colonies corresponding to time 0 and time 1 h were counted.

Gene Variability

The ORF4 and 919 genes were amplified by PCR on chromosomal DNA extracted from various *Neisseria* strains (see list of strains). The following oligonucleotides used as PCR primers were designed in the upstream and downstream regions of the genes:

```
orf 4.1 (forward)
                              (SEQ ID NO: 3266)
CGAATCCGGACGGCAGGACTC orf 4.3 (reverse)
                              (SEQ ID NO: 3267)
GGCAGGGAATGGCGGATTAAAG 919.1 (forward)
                              (SEQ ID NO: 3268)
AAAATGCCTCTCCACGGCTG
or
                              (SEQ ID NO: 3269)
CTGCGCCCTGTGTTAAAATCCCCT 919.6 (reverse)
                              (SEQ ID NO: 3270)
CAAATAAGAAAGGAATTTTG
or
                              (SEQ ID NO: 3271)
GGTATCGCAAAACTTCGCCTTAATGCG
```

The PCR cycling conditions were:

| | |
|---|---|
| 1 cycle | 2 min. at 94° |
| 30 cycles | 30 sec. at 94° |
| | 30 sec. at ~54° or ~60° (in according to Tm of the primers) |
| | 40 sec. at 72° |
| 1 cycle | 7 min. at 72° |

The PCR products were purified from 1% agarose gel and sequenced using the following primers:

```
orf 4.1 (forward)
                              (SEQ ID NO: 3272)
CGAATCCGGACGGCAGGACTC orf 4.2 (forward)
                              (SEQ ID NO: 3273)
CGACCGCGCCTTTGGGACTG orf 4.3 (reverse)
                              (SEQ ID NO: 3274)
GGCAGGGAATGGCGGATTAAAG orf 4.4 (reverse)
                              (SEQ ID NO: 3275)
TCTTTGAGTTTGATCCAACC 919.1 (forward)
                              (SEQ ID NO: 3276)
AAAATGCCTCTCCACGGCTG
or
                              (SEQ ID NO: 3277)
CTGCGCCCTGTGTTAAAATCCCCT 919.2 (forward)
                              (SEQ ID NO: 3278)
ATCCTTCCGCCTCGGCTGCG 919.3 (forward)
                              (SEQ ID NO: 3279)
AAAACAGCGGCACAATCGAC 919.4 (forward)
                              (SEQ ID NO: 3280)
ATAAGGGCTACCTCAAACTC 919.5 (forward)
                              (SEQ ID NO: 3281)
GCGCGTGGATTATTTTTGGG 919.6 (reverse)
                              (SEQ ID NO: 3282)
CAAATAAGAAAGGAATTTTG
or
                              (SEQ ID NO: 3283)
GGTATCGCAAAACTTCGCCTTAATGCG 919.7 (reverse)
                              (SEQ ID NO: 3284)
CCCAAGGTAATGTAGTGCCG 919.8 (reverse)
                              (SEQ ID NO: 3285)
TAAAAAAAGTTCGACAGGG 919.9 (reverse)
                              (SEQ ID NO: 3286)
CCGTCCGCCTGTCGTCGCCC 919.10 (reverse)
                              (SEQ ID NO: 3287)
TCGTTCCGGCGGGGTCGGGG
```

All documents cited herein are incorporated by reference in their entireties.

The following Examples are presented to illustrate, not limit, the invention.

Example 1

Using the above-described procedures, the following oligonucleotide primers were employed in the polymerase chain reaction (PCR) assay in order to clone the ORFs as indicated:

TABLE 1

Oligonucleotides used for PCR for Examples 2-10

| ORF | Primer | Sequence | Restriction sites |
|---|---|---|---|
| 279 | Forward | CGC<u>GGATCCCATATG</u>-TTGCCTGCAATCACGATT <SEQ ID 3021> | BamHI-NdeI |
| | Reverse | CCCG<u>CTCGAG</u>-TTTAGAAGCGGGCGGCAA <SEQ ID 3022> | XhoI |
| 519 | Forward | CGC<u>GGATCCCATATG</u>-TTCAAATCCTTTGTCGTCA <SEQ ID 3023> | BamHI-NdeI |
| | Reverse | CCCG<u>CTCGAG</u>-TTTGGCGGTTTTGCTGC <SEQ ID 3024> | XhoI |
| 576 | Forward | CGC<u>GGATCCCATATG</u>-GCCGCCCCCGCATCT <SEQ ID 3025> | BamHI-NdeI |
| | Reverse | CCCG<u>CTCGAG</u>-ATTTACTTTTTTGATGTCGAC <SEQ ID 3026> | XhoI |
| 919 | Forward | CGC<u>GGATCCCATATG</u>-TGCCAAAGCAAGAGCATC <SEQ ID 3027> | BamHI-NdeI |
| | Reverse | CCCG<u>CTCGAG</u>-CGGGCGGTATTCGGG <SEQ ID 3028> | XhoI |
| 121 | Forward | CGC<u>GGATCCCATATG</u>-GAAACACAGCTTTACAT <SEQ ID 3029> | BamHI-NdeI |
| | Reverse | CCCG<u>CTCGAG</u>-ATAATAATATCCCGCGCCC <SEQ ID 3030> | XhoI |
| 128 | Forward | CGC<u>GGATCCCATATG</u>-ACTGACAACGCACT <SEQ ID 3031> | BamHI-NdeI |
| | Reverse | CCCG<u>CTCGAG</u>-GACCGCGTTGTCGAAA <SEQ ID 3032> | XhoI |
| 206 | Forward | CGC<u>GGATCCCATATG</u>-AAACACCGCCAACCGA <SEQ ID 3033> | BamHI-NdeI |
| | Reverse | CCCG<u>CTCGAG</u>-TTCTGTAAAAAAAGTATGTGC <SEQ ID 3034> | XhoI |
| 287 | Forward | CCG<u>GAATTCTAGCTAGC</u>-CTTTCAGCCTGCGGG <SEQ ID 3035> | EcoRI-NheI |
| | Reverse | CCCG<u>CTCGAG</u>-ATCCTGCTCTTTTTTGCC <SEQ ID 3036> | XhoI |
| 406 | Forward | CGC<u>GGATCCCATATG</u>-TGCGGGACACTGACAG <SEQ ID 3037> | BamHI-NdeI |
| | Reverse | CCCG<u>CTCGAG</u>-AGGTTGTCCTTGTCTATG <SEQ ID 3038> | XhoI |

Localization of the ORFs

The following DNA and amino acid sequences are identified by titles of the following form: [g, m, or a] [#].[seq or pep], where "g" means a sequence from *N. gonorrhoeae*, "m" means a sequence from *N. meningitidis* B, and "a" means a sequence from *N. meningitidis* A; "#" means the number of the sequence; "seq" means a DNA sequence, and "pep" means an amino acid sequence. For example, "g001.seq" refers to an *N. gonorrhoeae* DNA sequence, number 1. The presence of the suffix "−1" to these sequences indicates an additional sequence found for the same ORF, thus, data for an ORF having both an unsuffixed and a suffixed sequence designation applies to both such designated sequences. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a *N. gonorrhoeae* sequence or a *N. meningitidis* A sequence, respectively. The word "partial" before a sequence indicates that the sequence may be partial or a complete ORF. Computer analysis was performed for the comparisons that follow between "g", "m", and "a" peptide sequences; and therein the "pep" suffix is implied where not expressly stated. Further, in the event of a conflict between the text immediately preceding and describing which sequences are being compared, and the designated sequences being compared, the designated sequence controls and is the actual sequence being compared ORF: contig:

279 gnm4.seq

The following partial DNA sequence was identified in *N. meningitidis* <SEQ ID 3039>:

```
m279.seq
  1   ATAACGCGGA TTTGCGGCTG CTTGATTTCA ACGGTTTTCA GGGCTTCGGC

51   AAGTTTGTCG GCGGCGGGTT TCATCAGGCT GCAATGGGAA GGTACGGACA

101   CGGGCAGCGG CAGGGCGCGT TTGGCACCGG CTTCTTTGGC GGCAGCCATG
```

-continued

```
    151 GCGCGTCCGA CGGCGGCGGC GTTGCCTGCA ATCACGATTT GTCCGGGTGA

201 GTTGAAGTTG ACGGCTTCGA CCACTTCGCT TTGGGCGGCT TCGGCACAAA

251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCG GCAACGGCGG CAGGCGTTTT GCCGCCCGCT

451 TCTAAATAG
```

This corresponds to the amino acid sequence <SEQ ID 3040; ORF 279>:

```
m279.pep
      1 ITRICGCLIS TVFRASASLS AAGFIRLQWE GTDTGSGRAR LAPASLAAAM

51 ARPTAAALPA ITICPGELKL TASTTSLWAA SAQMALTCSS SKPRIAAIAP

101 TPCGTADCIS SARRRTSLTA SAKFNAPAAT SAVYSPRLCP ATAAGVLPPA

151 SK*
```

The following partial DNA sequence was identified in N. gonorrhoeae <SEQ ID 3041>:

```
g279.seq
      1 atgacgcgga tttgcggctg cttgatttca acggttttga gtgtttcggc 51 aagtttgtcg gcggcgggtt tcatcaggct gcaatgggaa ggaacggata 101 ccggcagcgg cagggcgcgt ttggctccgg cttctttggc ggcagccatg 151 gtgcgtccga cggcggcggc gttgcctgca atcacgactt gtccgggcga 201 gttgaagttg acggcttcga ccacttcgcc ctgtgcggat tcggcacaaa 251 tctgcctgac ctgttcatct tccaacccca aaatggccgc cattgcgcct 301 acgccttgcg gtacggcgga ctgcatcagt tcggcgcgca ggcggacgag 351 tttgacggca tcggcaaaat ccaatgcttc ggcggcgaca agcgcggtgt 401 attcgccgag gctgtgtccg gcaacggcgg caggcgtttt gccgcccact 451 tccaaatag
```

This corresponds to the amino acid sequence <SEQ ID 3042; ORF 279.ng>:

```
g279.pep
      1 MTRICGCLIS TVLSVSASL AAGFIRLQWE GTDTGSGRAR LAPASLAAAM

51 VRPTAAALPA ITTCPGELKL TASTTSPCAD SAQICLTCSS SKPKMAAIAP

101 TPCGTADCIS SARRRTSLTA SAKSNASAAT SAVYSPRLCP ATAAGVLPPT

151 SK*
```

ORF 279 shows 89.5% identity over a 152 aa overlap with a predicted ORF (ORF 279.ng) from N. gonorrhoeae:

```
                  10        20        30        40        50        60
m279.pep  ITRICGCLISTVFRASASLSAAGFIRLQWEGTDTGSGRARLAPASLAAAMARPTAAALPA
          :||||||||||:  :|||||||||||||||||||||||||||||||||||:||||||||
g279      MTRICGCLISTVLSVSASLSAAGFIRLQWEGTDTGSGRARLAPASLAAAMVRPTAAALPA
                  10        20        30        40        50        60

70        80        90       100       110       120
m279.pep  ITICPGELKLTASTTSLWAASAQMALTCSSSKPRIAAIAPTPCGTADCISSARRRTSLTA
          || |||||||||||||  | |||: ||||||||::|||||||||||||||||||||||||
g279      ITTCPGELKLTASTTSPCADSAQICLTCSSSKPKMAAIAPTPCGTADCISSARRRTSLTA
                  70        80        90       100       110       120

130       140       150
m279.pep  SAKFNAPAATSAVYSPRLCPATAAGVLPPASKX
          ||| || ||||||||||||||||||||||:|||
g279      SAKSNASAATSAVYSPRLCPATAAGVLPPTSKX
                 130       140       150
```

The following partial DNA sequence was identified in *N. meningitidis* <SEQ ID 3043>:

```
a279.seq
    1  ATGACNCNGA TTTGCGGCTG CTTGATTTCA ACGGTTTNNA GGGCTTCGGC
   51  GAGTTTGTCG GCGGCGGGTT TCATGAGGCT GCAATGGGAA GGTACNGACA
  101  CNGGCAGCGG CAGGGCGCGT TTGGCGCCGG CTTCTTTGGC GGCAAGCATA
  151  GCGCGCTCGA CGGCGGCGGC ATTGCCTGCA ATCACGACTT GTCCGGGCGA
  201  GTTGAAGTTG ACGGCTTCAA CCACTTCATC CTGTGCGGAT TCGGCGCAAA
  251  TTTGTTTTAC CTGTTCATCT TCCAAGCCGA GAATCGCCGC CATTGCGCCC
  301  ACGCCTTGCG GTACGGCGGA CTGCATCAGT TCGGCGCGCA NGCGCACGAG
  351  TTTGACCGCG TCGGCAAAAT CCAATGCGCC GGCGGCAACN AGTGCGGTGT
  401  ATTCGCCGAN GCTGTGTCCG GCAACGGCGG CAGGCGTTTT GCCGCCCGCT
  451  TCCGAATAG
```

This corresponds to the amino acid sequence <SEQ ID 3044; ORF 279.a>:

```
a279.pep
    1  MTXICGCLIS TVXRASASLS AAGFMRLQWE GTDTGSGRAR LAPASLAASI
   51  ARSTAAALPA ITTCPGELKL TASTTSSCAD SAQICFTCSS SKPRIAAIAP
  101  TPCGTADCIS SARXRTSLTA SAKSNAPAAT SAVYSPXLCP ATAAGVLPPA
  151  SE*
``` m279/a279 ORFs 279 and 279.a showed a 88.2% identity in 152 aa overlap

```
                  10        20        30        40        50        60
m279.pep  ITRICGCLISTVFRASASLSAAGFIRLQWEGTDTGSGRARLAPASLAAAMARPTAAALPA
          :| |||||||||| |||||||||||| ||||||||||||||||||||||::|| ||||||
a279      MTXICGCLISTVXRASASLSAAGFMRLQWEGTDTGSGRARLAPASLAASIARSTAAALPA
                  10        20        30        40        50        60

70        80        90       100       110       120
m279.pep  ITICPGELKLTASTTSLWAASAQMALTCSSSKPRIAAIAPTPCGTADCISSARRRTSLTA
          || |||||||||||||  | |||: :|||||||||||||||||||||||| || |||||
a279      ITTCPGELKLTASTTSSCADSAQICFTCSSSKPRIAAIAPTPCGTADCIGGARXRTSLTA
                  70        80        90       100       110       120

130       140       150
m279.pep  SAKFNAPAATSAVYSPRLCPATAAGVLPPASKX
          ||| |||||||||||| |||||||||||||:|
a279      SAKSNAPAATSAVYSPXLCPATAAGVLPPASEX
                 130       140       150
```

519 and 519-1 gnm7.seq
The following partial DNA sequence was identified in *N. meningitidis* <SEQ ID 3045>:

```
m519.seq (partial)
    1   ..TCCGTTATCG GGCGTATGGA GTTGGACAAA ACGTTTGAAG AACGCGACGA 51     AATCAACAGT ACTGTTGTTG CGGCTTTGGA CGAGGCGGCC GGGgCTTgGG

101     GTGTGAAGGT TTTGCGTTAT GAGATTAAAG ACTTGGTTCC GCCGCAAGAA

151     ATCCTTCGCT CAATGCAGGC GCAAATTACT GCCGAACGCG AAAAACGCGC

201     CCGTATCGCC GAATCCGAAG GTCGTAAAAT CGAACAAATC AACCTTGCCA

251     GTGGTCAGCG CGAAGCCGAA ATCCAACAAT CCGAAGGCGA GGCTCAGGCT

301     GCGGTCAATG CGTCAAATGC CGAGAAAATC GCCCGCATCA ACCGCGCCAA

351     AGGTGAAGCG GAATCCTTGC GCCTTGTTGC CGAAGCCAAT GCCGAAGCCA

401     TCCGTCAAAT TGCCGCCGCC CTTCAAACCC AAGGCGGTGC GGATGCGGTC

451     AATCTGAAGA TTGCGGAACA ATACGTCGCT GCGTTCAACA ATCTTGCCAA

501     AGAAAGCAAT ACGCTGATTA TGCCCGCCAA TGTTGCCGAC ATCGGCAGCC

551     TGATTTCTGC CGGTATGAAA ATTATCGACA GCAGCAAAAC CGCCAAaTAA
                                                           25
```

This corresponds to the amino acid sequence <SEQ ID 3046; ORF 519>:

```
m519.pep (partial)
    1   ..SVIGRMELDK TFEERDEINS TVVAALDEAA GAWGVKVLRY EIKDLVPPQE

51     ILRSMQAQIT AEREKRARIA ESEGRKIEQI NLASGQREAE IQQSEGEAQA

101     AVNASNAEKI ARINRAKGEA ESLRLVAEAN AEAIRQIAAA LQTQGGADAV

151     NLKIAEQYVA AFNNLAKESN TLIMPANVAD IGSLISAGMK IIDSSKTAK*
```

The following partial DNA sequence was identified in *N. gonorrhoeae* <SEQ ID 3047>:

```
g519.seq
    1   atggaatttt tcattatctt gttggcagcc gtcgccgttt tcggcttcaa 51     atcctttgtc gtcatccccc agcaggaagt ccacgttgtc gaaaggctcg 101     ggcgtttcca tcgcgccctg acggccggtt tgaatatttt gattcccttt 151     atcgaccgcg tcgcctaccg ccattcgctg aaagaaatcc ctttagacgt 201     acccagccag gtctgcatca cgcgcgataa tacgcaattg actgttgacg 251     gcatcatcta tttccaagta accgatccca aactcgcctc atacggttcg 301     agcaactaca ttatggcaat tacccagctt gcccaaacga cgctgcgttc 351     cgttatcggg cgtatggagt tggacaaaac gtttgaagaa cgcgacgaaa 401     tcaacagtac cgtcgtctcc gccctcgatg aagccgccgg ggcttggggt 451     gtgaaagtcc tccgttacga aatcaaggat ttggttccgc cgcaagaaat 501     ccttcgcgca atgcaggcac aaattaccgc cgaacgcgaa aaacgcgccc 551     gtattgccga atccgaaggc cgtaaaatcg aacaaatcaa ccttgccagt 601     ggtcagcgtg aagccgaaat ccaacaatcc gaaggcgagg ctcaggctgc 651     ggtcaatgcg tccaatgccg agaaaatcgc ccgcatcaac cgcgccaaag 701     gcgaagcgga atccctgcgc cttgttgccg aagccaatgc cgaagccaac 751     cgtcaaattg ccgccgccct tcaaacccaa agcggggcgg atgcggtcaa
```

-continued

```
801  tctgaagatt gcgggacaat acgttaccgc gttcaaaaat cttgccaaag 851  aagacaatac gcggattaag cccgccaagg ttgccgaaat cgggaaccct 901  aattttcggc ggcatgaaaa attttcgcca gaagcaaaaa cggccaaata 951  a
```

This corresponds to the amino acid sequence <SEQ ID 3048; ORF 519.ng>:

```
g519.pep
   1  MEFFIILLAA VAVFGFKSFV VIPQQEVHVV ERLGRFHRAL TAGLNILIPF

51  IDRVAYRHSL KEIPLDVPSQ VCITRDNTQL TVDGIIYFQV TDPKLASYGS

101  SNYIMAITQL AQTTLRSVIG RMELDKTFEE RDEINSTVVS ALDEAAGAWG

151  VKVLRYEIKD LVPPQEILRA MQAQITAERE KRARIAESEG RKIEQINLAS

201  GQREAEIQQS EGEAQAAVNA SNAEKIARIN RAKGEAESLR LVAEANAEAN

251  RQIAAALQTQ SGADAVNLKI AGQYVTAFKN LAKEDNTRIK PAKVAEIGNP

301  NFRRHEKFSP EAKTAK*
```

ORF 519 shows 87.5% identity over a 200 aa overlap with a predicted ORF (ORF 519.ng) from *N. gonorrhoeae*:

```
m519/g519
                               10         20         30
      m519.pep          SVIGRMELDKTFEERDEINSTVVAALDEAA
                        ||||||||||||||||||||||||:|||||
      g519     YFQVTDPKLASYGSSNYIMAITQLAQTTLRSVIGRMELDKTFEERDEINSTVVSALDEAA
               90        100       110       120       130       140
                        40         50         60         70         80         90
      m519.pep GAWGVKVLRYEIKDLVPPQEILRSMQAQITAEREKRARIAESEGRKIEQINLASGQREAE
               ||||||||||||||||||||||||:|||||||||||||||||||||||||||||||||||
      g519     GAWGVKVLRYEIKDLVPPQEILRAMQAQITAEREKRARIAESEGRKIEQINLASGQREAE
               150       160       170       180       190       200
                        100        110        120        130        140        150
      m519.pep IQQSEGEAQAAVNASNAEKIARINRAKGEAESLRLVAEANAEAIRQIAAALQTQGGADAV
               |||||||||||||||||||||||||||||||||||||||||||| ||||||||||:||||
      g519     IQQSEGEAQAAVNASNAEKIARINRAKGEAESLRLVAEANAEANRQIAAALQTQSGADAV
               210       220       230       240       250       260
                        160        170        180        190        200
      m519.pep NLKIAEQYVAAFNNLAKESNTLIMPANVADIGSL-ISAGMKIIDSSKTAK
               |||| |||:|:|||||||||:| | ||:||:|:  : : :  :   :||||
      g519     NLKIAGQYVTAFKNLAKEDNTRIKPAKVAEIGNPNFRRHEKFSPEAKTAK
               270       280       290       300       310
```

The following partial DNA sequence was identified in *N. meningitidis* <SEQ ID 3049>:

```
a519.seq
   1  ATGGAATTTT TCATTATCTT GCTGGCAGCC GTCGTTGTTT TCGGCTTCAA

51  ATCCTTTGTT GTCATCCCAC AGCAGGAAGT CCACGTTGTC GAAAGGCTCG

101  GGCGTTTCCA TCGCGCCCTG ACGGCCGGTT TGAATATTTT GATTCCCTTT

151  ATCGACCGCG TCGCCTACCG CCATTCGCTG AAAGAAATCC CTTTAGACGT

201  ACCCAGCCAG GTCTGCATCA CGCGCGACAA TACGCAGCTG ACTGTTGACG

251  GTATCATCTA TTTCCAAGTA ACCGACCCCA AACTCGCCTC ATACGGTTCG

301  AGCAACTACA TTATGGCGAT TACCCAGCTT GCCCAAACGA CGCTGCGTTC

351  CGTTATCGGG CGTATGGAAT TGGACAAAAC GTTTGAAGAA CGCGACGAAA

401  TCAACAGCAC CGTCGTCTCC GCCCTCGATG AAGCCGCCGG AGCTTGGGGT
```

```
451  GTGAAGGTTT TGCGTTATGA GATTAAAGAC TTGGTTCCGC CGCAAGAAAT

501  CCTTCGCTCA ATGCAGGCGC AAATTACTGC TGAACGCGAA AAACGCGCCC

551  GTATCGCCGA ATCCGAAGGT CGTAAAATCG AACAAATCAA CCTTGCCAGT

601  GGTCAGCGCG AAGCCGAAAT CCAACAATCC GAAGGCGAGG CTCAGGCTGC

651  GGTCAATGCG TCAAATGCCG AGAAAATCGC CCGCATCAAC CGCGCCAAAG

701  GTGAAGCGGA ATCCTTGCGC CTTGTTGCCG AAGCCAATGC CGAAGCCATC

751  CGTCAAATTG CCGCCGCCCT TCAAACCCAA GGCGGTGCGG ATGCGGTCAA

801  TCTGAAGATT GCGGAACAAT ACGTCGCCGC GTTCAACAAT CTTGCCAAAG

851  AAAGCAATAC GCTGATTATG CCCGCCAATG TTGCCGACAT CGGCAGCCTG

901  ATTTCTGCCG GTATGAAAAT TATCGACAGC AGCAAAACCG CCAAATAA
```

This corresponds to the amino acid sequence <SEQ ID 3050; ORF 519.a>:

```
a519.pep
    1   MEFFIILLAA VVVFGFKSFV VIPQQEVHVV ERLGRFHRAL TAGLNILIPF

51   IDRVAYRHSL KEIPLDVPSQ VCITRDNTQL TVDGIIYFQV TDPKLASYGS

101   SNYIMAITQL AQTTLRSVIG RMELDKTFEE RDEINSTVVS ALDEAAGAWG

151   VKVLRYEIKD LVPPQEILRS MQAQITAERE KRARIAESEG RKIEQINLAS

201   GQREAEIQQS EGEAQAAVNA SNAEKIARIN RAKGEAESLR LVAEANAEAI

251   RQIAAALQTQ GGADAVNLKI AEQYVAAFNN LAKESNTLIM PANVADIGSL

301   ISAGMKIIDS SKTAK*
``` m519/a519 ORFs 519 and 519.a showed a 99.5% identity in 199 aa overlap

```
                               10         20         30
    m519.pep                   SVIGRMELDKTFEERDEINSTVVAALDEAA
                               ||||||||||||||||||||||||:|||||
    a519     YFQVTDPKLASYGSSNYIMAITQLAQTTLRSVIGRMELDKTFEERDEINSTVVSALDEAA
              90        100       110       120       130       140

40         50         60         70         80         90
    m519.pep GAWGVKVLRYEIKDLVPPQEILRSMQAQITAEREKRARIAESEGRKIEQINLASGQREAE
             ||||||||||||||||||||||||||||||||||||||||||||||||||||||||||||
    a519     GAWGVKVLRYEIKDLVPPQEILRSMQAQITAEREKRARIAESEGRKIEQINLASGQREAE
              150       160       170       180       190       200

100       110       120       130       140       150
    m519.pep IQQSEGEAQAAVNASNAEKIARINRAKGEAESLRLVAEANAEAIRQIAAALQTQGGADAV
             ||||||||||||||||||||||||||||||||||||||||||||||||||||||||||||
    a519     IQQSEGEAQAAVNASNAEKIARINRAKGEAESLRLVAEANAEAIRQIAAALQTQGGADAV
              210       220       230       240       250       260

160       170       180       190       200
    m519.pep NLKIAEQYVAAFNNLAKESNTLIMPANVADIGSLISAGMKIIDSSKTAKX
             |||||||||||||||||||||||||||||||||||||||||||||||||
    a519     NLKIAEQYVAAFNNLAKESNTLIMPANVADIGSLISAGMKIIDSSKTAKX
              270       280       290       300       310
```

Further work revealed the DNA sequence identified in *N. meningitidis* <SEQ ID 3051>:

```
m519-1.seq
    1    ATGGAATTTT TCATTATCTT GTTGGTAGCC GTCGCCGTTT TCGGTTTCAA

51    ATCCTTTGTT GTCATCCCAC AACAGGAAGT CCACGTTGTC GAAAGGCTGG

101    GGCGTTTCCA TCGCGCCCTG ACGGcCGGTT TGAATATTTT GATTCCCTTT
```

```
         -continued
151    ATCGACCGCG TCGCCTACCG CCATTCGCTG AAAGAAATCC CTTTAGACGT

201    ACCCAGCCAG GTCTGCATCA CGCGCGACAA TACGCAGCTG ACTGTTGACG

251    GCATCATCTA TTTCCAAGTA ACCGACCCCA AACTCGCCTC ATACGGTTCG

301    AGCAACTACA TTATGGCGAT TACCCAGCTT GCCCAAACGA CGCTGCGTTC

351    CGTTATCGGG CGTATGGAGT TGGACAAAAC GTTTGAAGAA CGCGACGAAA

401    TCAACAGTAC TGTTGTTGCG GCTTTGGACG AGGCGGCCGG GGCTTGGGGT

451    GTGAAGGTTT TGCGTTATGA GATTAAAGAC TTGGTTCCGC CGCAAGAAAT

501    CCTTCGCTCA ATGCAGGCGC AAATTACTGC CGAACGCGAA AAACGCGCCC

551    GTATCGCCGA ATCCGAAGGT CGTAAAATCG AACAAATCAA CCTTGCCAGT

601    GGTCAGCGCG AAGCCGAAAT CCAACAATCC GAAGGCGAGG CTCAGGCTGC

651    GGTCAATGCG TCAAATGCCG AGAAAATCGC CCGCATCAAC CGCGCCAAAG

701    GTGAAGCGGA ATCCTTGCGC CTTGTTGCCG AAGCCAATGC CGAAGCCATC

751    CGTCAAATTG CCGCCGCCCT TCAAACCCAA GGCGGTGCGG ATGCGGTCAA

801    TCTGAAGATT GCGGAACAAT ACGTCGCTGC GTTCAACAAT CTTGCCAAAG

851    AAAGCAATAC GCTGATTATG CCCGCCAATG TTGCCGACAT CGGCAGCCTG

901    ATTTCTGCCG GTATGAAAAT TATCGACAGC AGCAAAACCG CCAAATAA
```

This corresponds to the amino acid sequence <SEQ ID 3052; ORF 519-1>:

```
m519-1.
    1    MEFFIILLVA VAVFGFKSFV VIPQQEVHVV ERLGRFHRAL TAGLNILIPF

51    IDRVAYRHSL KEIPLDVPSQ VCITRDNTQL TVDGIIYFQV TDPKLASYGS

101    SNYIMAITQL AQTTLRSVIG RMELDKTFEE RDEINSTVVA ALDEAAGAWG

151    VKVLRYEIKD LVPPQEILRS MQAQITAERE KRARIAESEG RKIEQINLAS

201    GQREAEIQQS EGEAQAAVNA SNAEKIARIN RAKGEAESLR LVAEANAEAI

251    RQIAAALQTQ GGADAVNLKI AEQYVAAFNN LAKESNTLIM PANVADIGSL

301    ISAGMKIIDS SKTAK*
```

The following partial DNA sequence was identified in *N. gonorrhoeae* <SEQ ID 3053>:

```
g519-1.seq
    1    ATGGAATTTT TCATTATCTT GTTGGCAGCC GTCGCCGTTT TCGGCTTCAA

51    ATCCTTTGTC GTCATCCCCC AGCAGGAAGT CCACGTTGTC GAAAGGCTCG

101    GGCGTTTCCA TCGCGCCCTG ACGGCCGGTT TGAATATTTT GATTCCCTTT

151    ATCGACCGCG TCGCCTACCG CCATTCGCTG AAAGAAATCC CTTTAGACGT

201    ACCCAGCCAG GTCTGCATCA CGCGCGATAA TACGCAATTG ACTGTTGACG

251    GCATCATCTA TTTCCAAGTA ACCGATCCCA AACTCGCCTC ATACGGTTCG

301    AGCAACTACA TTATGGCAAT TACCCAGCTT GCCCAAACGA CGCTGCGTTC

351    CGTTATCGGG CGTATGGAGT TGGACAAAAC GTTTGAAGAA CGCGACGAAA

401    TCAACAGTAC CGTCGTCTCC GCCCTCGATG AAGCCGCCGG GGCTTGGGGT

451    GTGAAAGTCC TCCGTTACGA AATCAAGGAT TTGGTTCCGC CGCAAGAAAT

501    CCTTCGCGCA ATGCAGGCAC AAATTACCGC CGAACGCGAA AAACGCGCCC
```

```
-continued
551    GTATTGCCGA ATCCGAAGGC CGTAAAATCG AACAAATCAA CCTTGCCAGT

601    GGTCAGCGTG AAGCCGAAAT CCAACAATCC GAAGGCGAGG CTCAGGCTGC

651    GGTCAATGCG TCCAATGCCG AGAAAATCGC CCGCATCAAC CGCGCCAAAG

701    GCGAAGCGGA ATCCCTGCGC CTTGTTGCCG AAGCCAATGC CGAAGCCATC

751    CGTCAAATTG CCGCCGCCCT TCAAACCCAA GGCGGGGCGG ATGCGGTCAA

801    TCTGAAGATT GCGGAACAAT ACGTAGCCGC GTTCAACAAT CTTGCCAAAG

851    AAAGCAATAC GCTGATTATG CCCGCCAATG TTGCCGACAT CGGCAGCCTG

901    ATTTCTGCCG GCATGAAAAT TATCGACAGC AGCAAAACCG CCAAATAA
```

This corresponds to the amino acid sequence <SEQ ID 3054; ORF 519-1.ng>:

```
g519-1.pep
  1    MEFFIILLAA VAVFGFKSFV VIPQQEVHVV ERLGRFHRAL TAGLNILIPF

51    IDRVAYRHSL KEIPLDVPSQ VCITRDNTQL TVDGIIYFQV TDPKLASYGS

101    SNYIMAITQL AQTTLRSVIG RMELDKTFEE RDEINSTVVS ALDEAAGAWG

151    VKVLRYEIKD LVPPQEILRA MQAQITAERE KRARIAESEG RKIEQINLAS

201    GQREAEIQQS EGEAQAAVNA SNAEKIARIN RAKGEAESLR LVAEANAEAI

251    RQIAAALQTQ GGADAVNLKI AEQYVAAFNN LAKESNTLIM PANVADIGSL

301    ISAGMKIIDS SKTAK*
``` m519-1/g519-1 99.0% identity in 315 aa overlap

```
                 10         20         30         40         50         60
g519-1.pep  MEFFIILLAAVAVFGFKSFVVIPQQEVHVVERLGRFHRALTAGLNILIPFIDRVAYRHSL
            ||||||||:||||||||||||||||||||||||||||||||||||||||||||||||||
m519-1      MEFFIILLVAVAVFGFKSFVVIPQQEVHVVERLGRFHRALTAGLNILIPFIDRVAYRHSL
                 10         20         30         40         50         60

70         80         90        100        110        120
g519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                 70         80         90        100        110        120

130        140        150        160        170        180
g519-1.pep  RMELDKTFEERDEINSTVVSALDEAAGAWGVKVLRYEIKDLVPPQEILRAMQAQITAERE
            ||||||||||||||||||||:|||||||||||||||||||||||||||||:|||||||||
m519-1      RMELDKTFEERDEINSTVVAALDEAAGAWGVKVLRYEIKDLVPPQEILRSMQAQITAERE
                130        140        150        160        170        180

190        200        210        220        230        240
g519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                190        200        210        220        230        240

250        260        270        280        290        300
g519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                250        260        270        280        290        300

310
g519-1.pep  ISAGMKIIDSSKTAKX
            |||||||||||||||
m519-1      ISAGMKIIDSSKTAK
                310
```

The following DNA sequence was identified in *N. meningitidis* <SEQ ID 3055>:

```
a519-1.seq
      1   ATGGAATTTT TCATTATCTT GCTGGCAGCC GTCGTTGTTT TCGGCTTCAA
     51   ATCCTTTGTT GTCATCCCAC AGCAGGAAGT CCACGTTGTC GAAAGGCTCG
    101   GGCGTTTCCA TCGCGCCCTG ACGGCCGGTT TGAATATTTT GATTCCCTTT
    151   ATCGACCGCG TCGCCTACCG CCATTCGCTG AAAGAAATCC CTTTAGACGT
    201   ACCCAGCCAG GTCTGCATCA CGCGCGACAA TACGCAGCTG ACTGTTGACG
    251   GTATCATCTA TTTCCAAGTA ACCGACCCCA AACTCGCCTC ATACGGTTCG
    301   AGCAACTACA TTATGGCGAT TACCCAGCTT GCCCAAACGA CGCTGCGTTC
    351   CGTTATCGGG CGTATGGAAT TGGACAAAAC GTTTGAAGAA CGCGACGAAA
    401   TCAACAGCAC CGTCGTCTCC GCCCTCGATG AAGCCGCCGG AGCTTGGGGT
    451   GTGAAGGTTT TGCGTTATGA GATTAAAGAC TTGGTTCCGC CGCAAGAAAT
    501   CCTTCGCTCA ATGCAGGCGC AAATTACTGC TGAACGCGAA AAACGCGCCC
    551   GTATCGCCGA ATCCGAAGGT CGTAAAATCG AACAAATCAA CCTTGCCAGT
    601   GGTCAGCGCG AAGCCGAAAT CCAACAATCC GAAGGCGAGG CTCAGGCTGC
    651   GGTCAATGCG TCAAATGCCG AGAAAATCGC CGCATCAAC CGCGCCAAAG
    701   GTGAAGCGGA ATCCTTGCGC CTTGTTGCCG AAGCCAATGC CGAAGCCATC
    751   CGTCAAATTG CCGCCGCCCT TCAAACCCAA GGCGGTGCGG ATGCGGTCAA
    801   TCTGAAGATT GCGGAACAAT ACGTCGCCGC GTTCAACAAT CTTGCCAAAG
    851   AAAGCAATAC GCTGATTATG CCCGCCAATG TTGCCGACAT CGGCAGCCTG
    901   ATTTCTGCCG GTATGAAAAT TATCGACAGC AGCAAAACCG CCAAATAA
```

This corresponds to the amino acid sequence <SEQ ID 3056; ORF 519-1.a>:

```
a519-1.pep.
      1   MEFFIILLAA VVVFGFKSFV VIPQQEVHVV ERLGRFHRAL TAGLNILIPF
     51   IDRVAYRHSL KEIPLDVPSQ VCITRDNTQL TVDGIIYFQV TDPKLASYGS
    101   SNYIMAITQL AQTTLRSVIG RMELDKTFEE RDEINSTVVS ALDEAAGAWG
    151   VKVLRYEIKD LVPPQEILRS MQAQITAERE KRARIAESEG RKIEQINLAS
    201   GQREAEIQQS EGEAQAAVNA SNAEKIARIN RAKGEAESLR LVAEANAEAI
    251   RQIAAALQTQ GGADAVNLKI AEQYVAAFNN LAKESNTLIM PANVADIGSL
    301   ISAGMKIIDS SKTAK*
``` m519-1/a519-1 ORFs 519-1 and 519-1.a showed a 99.0% identity in 315 aa overlap

```
                    10         20         30         40         50         60
a519-1.pep  MEFFIILLAAVVVFGFKSFVVIPQQEVHVVERLGRFHRALTAGLNILIPFIDRVAYRHSL
            ||||||||::||:|||||||||||||||||||||||||||||||||||||||||||||||
m519-1      MEFFIILLVAVAVFGFKSFVVIPQQEVHVVERLGRFHRALTAGLNILIPFIDRVAYRHSL
                    10         20         30         40         50         60

70         80         90        100        110        120
a519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70         80         90        100        110        120

130        140        150        160        170        180
a519-1.pep  RMELDKTFEERDEINSTVVSALDEAAGAWGVKVLRYEIKDLVPPQEILRSMQAQITAERE
            ||||||||||||||||||||:|||||||||||||||||||||||||||||||||||||||
m519-1      RMELDKTFEERDEINSTVVAALDEAAGAWGVKVLRYEIKDLVPPQEILRSMQAQITAERE
                   130        140        150        160        170        180
```

```
                190       200       210       220       230       240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                190       200       210       220       230       240

250       260       270       280       290       300
a519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                250       260       270       280       290       300

310
a519-1.pep  ISAGMKIIDSSKTAKX
            ||||||||||||||||
m519-1      ISAGMKIIDSSKTAKX
                310
```

15

576 and 576-1 gnm22.seq
The following partial DNA sequence was identified in N. meningitidis <SEQ ID 3057>:

```
m576.seq.. (partial)
    1    ..ATGCAGCAGG CAAGCTATGC GATGGGCGTG GACATCGGAC GCTCCCTGAA

51      GCAAATGAAG GAACAGGGCG CGGAAATCGA TTTGAAAGTC TTTACCGAAG

101      CCATGCAGGC AGTGTATGAC GGCAAAGAAA TCAAAATGAC CGAAGAGCAG

151      GCTCAGGAAG TCATGATGAA ATTCCTTCAG GAACAACAGG CTAAAGCCGT

201      AGAAAAACAC AAGGCGGACG CGAAGGCCAA TAAAGAAAAA GGCGAAGCCT

251      TTCTGAAAGA AAATGCCGCC AAAGACGGCG TGAAGACCAC TGCTTCCGGC

301      CTGCAATACA AAATCACCAA ACAGGGCGAA GGCAAACAGC CGACCAAAGA

351      CGACATCGTT ACCGTGGAAT ACGAAGGCCG CCTGATTGAC GGTACGGTAT

401      TCGACAGCAG CAAAGCCAAC GGCGGCCCGG TCACCTTCCC TTTGAGCCAA

451      GTGATTCCGG GTTGGACCGA AGgCGTACAG CTTCTGAAAG AAGGCGGCGA

501      AGCCACGTTC TACATCCCGT CCAACCTTGC CTACCGCGAA CAGGGTGCGG

551      GCGACAAAAT CGGTCCGAAC GCCACTTTGG TATTTGATGT GAAACTGGTC

601      AAAATCGGCG CACCCGAAAA CGCGCCCGCC AAGCAGCCGG CTCAAGTCGA

651      CATCAAAAAA GTAAATTAA
```

This corresponds to the amino acid sequence <SEQ ID 3058; ORF 576>:

```
m576.pep.. (partial)
    1    ..MQQASYAMGV DIGRSLKQMK EQGAEIDLKV FTEAMQAVYD GKEIKMTEEQ

51      AQEVMMKFLQ EQQAKAVEKH KADAKANKEK GEAFLKENAA KDGVKTTASG

101      LQYKITKQGE GKQPTKDDIV TVEYEGRLID GTVFDSSKAN GGPVTFPLSQ

151      VIPGWTEGVQ LLKEGGEATF YIPSNLAYRE QGAGDKIGPN ATLVFDVKLV

201      KIGAPENAPA KQPAQVDIKK VN*
```

The following partial DNA sequence was identified in N. gonorrhoeae <SEQ ID 3059>:

```
g576.seq..(partial)
    1    ..atgggcgtgg acatcggacg ctccctgaaa caaatgaagg aacagggcgc 51      ggaaatcgat ttgaaagtct taccgatgc catgcaggca gtgtatgacg 101      gcaaagaaat caaaatgacc gaagagcagg cccaggaagt gatgatgaaa
```

-continued

```
151    ttcctgcagg agcagcaggc taaagccgta gaaaaacaca aggcggatgc 201    gaaggccaac aaagaaaaag gcgaagcctt cctgaaggaa aatgccgccg 251    aagacggcgt gaagaccact gcttccggtc tgcagtacaa aatcaccaaa 301    cagggtgaag gcaaacagcc gacaaaagac gacatcgtta ccgtggaata 351    cgaaggccgc ctgattgacg gtaccgtatt cgacagcagc aaagccaacg 401    gcggcccggc caccttccct ttgagccaag tgattccggg ttggaccgaa 451    ggcgtacggc ttctgaaaga aggcggcgaa gccacgttct acatcccgtc 501    caaccttgcc taccgcgaac agggtgcggg cgaaaaaatc ggtccgaacg 551    ccactttggt atttgacgtg aaactggtca aaatcggcgc acccgaaaac 601    gcgcccgcca agcagccgga tcaagtcgac atcaaaaaag taaattaa
```

This corresponds to the amino acid sequence <SEQ ID 3060; ORF 576.ng>:

```
g576.pep..(partial)
    1    ..MGVDIGRSLK QMKEQGAEID LKVFTDAMQA VYDGKEIKMT EEQAQEVMMK

51    FLQEQQAKAV EKHKADAKAN KEKGEAFLKE NAAEDGVKTT ASGLQYKITK

101    QGEGKQPTKD DIVTVEYEGR LIDGTVFDSS KANGGPATFP LSQVIPGWTE

151    GVRLLKEGGE ATFYIPSNLA YREQGAGEKI GPNATLVFDV KLVKIGAPEN

201    APAKQPDQVD IKKVN*
```

Computer analysis of this amino acid sequence gave the following results:
Homology with a Predicted ORF from *N. Gonorrhoeae*
m576/g576 97.2% identity in 215 aa overlap

```
                  10         20         30         40         50         60
m576.pep  MQQASYAMGVDIGRSLKQMKEQGAEIDLKVFTEAMQAVYDGKEIKMTEEQAQEVMMKFLQ
                    ||||||||||||||||||||||||||:||||||||||||||||||||||||||
g576              MGVDIGRSLKQMKEQGAEIDLKVFTDAMQAVYDGKEIKMTEEQAQEVMMKFLQ
                          10         20         30         40         50
                  70         80         90        100        110        120
m576.pep  EQQAKAVEKHKADAKANKEKGEAFLKENAAKDGVKTTASGLQYKITKQGEGKQPTKDDIV
          ||||||||||||||||||||||||||||||:|||||||||||||||||||||||||||||
g576      EQQAKAVEKHKADAKANKEKGEAFLKENAAEDGVKTTASGLQYKITKQGEGKQPTKDDIV
                  60         70         80         90        100        110
                 130        140        150        160        170        180
m576.pep  TVEYEGRLIDGTVFDSSKANGGPVTFPLSQVIPGWTEGVQLLKEGGEATFYIPSNLAYRE
          |||||||||||||||||||||||:||||||||||||||:|||||||||||||||||||||
g576      TVEYEGRLIDGTVFDSSKANGGPATFPLSQVIPGWTEGVRLLKEGGEATFYIPSNLAYRE
                 120        130        140        150        160        170
                 190        200        210        220
m576.pep  QGAGDKIGPNATLVFDVKLVKIGAPENAPAKQPAQVDIKKVNX
          ||||:||||||||||||||||||||||||||||| ||||||||
g576      QGAGEKIGPNATLVFDVKLVKIGAPENAPAKQPDQVDIKKVNX
                 180        190        200        210
```

55
The following partial DNA sequence was identified in *N. meningitidis* <SEQ ID 3061>:

```
a576.seq
    1    ATGAACACCA TTTTCAAAAT CAGCGCACTG ACCCTTTCCG CCGCTTTGGC

51    ACTTTCCGCC TGCGGCAAAA AGAAGCCGC CCCCGCATCT GCATCCGAAC

101    CTGCCGCCGC TTCTTCCGCG CAGGGCGACA CCTCTTCGAT CGGCAGCACG

151    ATGCAGCAGG CAAGCTATGC GATGGGCGTG GACATCGGAC GCTCCCTGAA
```

-continued

```
 201   GCAAATGAAG GAACAGGGCG CGGAAATCGA TTTGAAAGTC TTTACCGAAG

251   CCATGCAGGC AGTGTATGAC GGCAAAGAAA TCAAAATGAC CGAAGAGCAG

301   GCTCAGGAAG TCATGATGAA ATTCCTTCAG GAACAACAGG CTAAAGCCGT

351   AGAAAAACAC AAGGCGGACG CGAAGGCCAA TAAAGAAAAA GGCGAAGCCT

401   TTCTGAAAGA AAATGCCGCC AAAGACGGCG TGAAGACCAC TGCTTCCGGC

451   CTGCAATACA AAATCACCAA ACAGGGCGAA GGCAAACAGC CGACCAAAGA

501   CGACATCGTT ACCGTGGAAT ACGAAGGCCG CCTGATTGAC GGTACGGTAT

551   TCGACAGCAG CAAAGCCAAC GGCGGCCCGG TCACCTTCCC TTTGAGCCAA

601   GTGATTCTGG GTTGGACCGA AGGCGTACAG CTTCTGAAAG AAGGCGGCGA

651   AGCCACGTTC TACATCCCGT CCAACCTTGC CTACCGCGAA CAGGGTGCGG

701   GCGACAAAAT CGGCCCGAAC GCCACTTTGG TATTTGATGT GAAACTGGTC

751   AAAATCGGCG CACCCGAAAA CGCGCCCGCC AAGCAGCCGG CTCAAGTCGA

801   CATCAAAAAA GTAAATTAA
```

This corresponds to the amino acid sequence <SEQ ID 3062; ORF 576.a>:

```
a576.pep
   1   MNTIFKISAL TLSAALALSA CGKKEAAPAS ASEPAAASSA QGDTSSIGST

51   MQQASYAMGV DIGRSLKQMK EQGAEIDLKV FTEAMQAVYD GKEIKMTEEQ

101   AQEVMMKFLQ EQQAKAVEKH KADAKANKEK GEAFLKENAA KDGVKTTASG

151   LQYKITKQGE GKQPTKDDIV TVEYEGRLID GTVFDSSKAN GGPVTFPLSQ

201   VILGWTEGVQ LLKEGGEATF YIPSNLAYRE QGAGDKIGPN ATLVFDVKLV

251   KIGAPENAPA KQPAQVDIKK VN*
``` m576/a576 99.5% identity in 222 aa overlap

```
                                      10         20         30
    m576.pep                   MQQASYAMGVDIGRSLKQMKEQGAEIDLKV
                               |||||||||||||||||||||||||||||
    a576     CGKKEAAPASASEPAAASSAQGDTSSIGSTMQQASYAMGVDIGRSLKQMKEQGAEIDLKV
                    30         40         50         60         70         80

40         50         60         70         80         90
    m576.pep FTEAMQAVYDGKEIKMTEEQAQEVMMKFLQEQQAKAVEKHKADAKANKEKGEAFLKENAA
             ||||||||||||||||||||||||||||||||||||||||||||||||||||||||||||
    a576     FTEAMQAVYDGKEIKMTEEQAQEVMMKFLQEQQAKAVEKHKADAKANKEKGEAFLKENAA
                    90        100        110        120        130        140

100        110        120        130        140        150
    m576.pep KDGVKTTASGLQYKITKQGEGKQPTKDDIVTVEYEGRLIDGTVFDSSKANGGPVTFPLSQ
             ||||||||||||||||||||||||||||||||||||||||||||||||||||||||||||
    a576     KDGVKTTASGLQYKITKQGEGKQPTKDDIVTVEYEGRLIDGTVFDSSKANGGPVTFPLSQ
                   150        160        170        180        190        200

160        170        180        190        200        210
    m576.pep VIPGWTEGVQLLKEGGEATFYIPSNLAYREQGAGDKIGPNATLVFDVKLVKIGAPENAPA
             || |||||||||||||||||||||||||||||||||||||||||||||||||||||||||
    a576     VILGWTEGVQLLKEGGEATFYIPSNLAYREQGAGDKIGPNATLVFDVKLVKIGAPENAPA
                   210        220        230        240        250        260

220
    m576.pep KQPAQVDIKKVNX
             |||||||||||||
    a576     KQPAQVDIKKVNX
                   270
```

The following partial DNA sequence was identified in *N. meningitidis* <SEQ ID 3063>:

```
m576-1.seq
      1     ATGAACACCA TTTTCAAAAT CAGCGCACTG ACCCTTTCCG CCGCTTTGGC
     51     ACTTTCCGCC TGCGGCAAAA AAGAAGCCGC CCCCGCATCT GCATCCGAAC
    101     CTGCCGCCGC TTCTTCCGCG CAGGGCGACA CCTCTTCGAT CGGCAGCACG
    151     ATGCAGCAGG CAAGCTATGC GATGGGCGTG GACATCGGAC GCTCCCTGAA
    201     GCAAATGAAG GAACAGGGCG CGGAAATCGA TTTGAAAGTC TTTACCGAAG
    251     CCATGCAGGC AGTGTATGAC GGCAAAGAAA TCAAAATGAC CGAAGAGCAG
    301     GCTCAGGAAG TCATGATGAA ATTCCTTCAG GAACAACAGG CTAAAGCCGT
    351     AGAAAAACAC AAGGCGGACG CGAAGGCCAA TAAAGAAAAA GGCGAAGCCT
    401     TTCTGAAAGA AAATGCCGCC AAAGACGGCG TGAAGACCAC TGCTTCCGGC
    451     CTGCAATACA AAATCACCAA ACAGGGCGAA GGCAAACAGC CGACCAAAGA
    501     CGACATCGTT ACCGTGGAAT ACGAAGGCCG CCTGATTGAC GGTACGGTAT
    551     TCGACAGCAG CAAAGCCAAC GGCGGCCCGG TCACCTTCCC TTTGAGCCAA
    601     GTGATTCCGG GTTGGACCGA AGGCGTACAG CTTCTGAAAG AAGGCGGCGA
    651     AGCCACGTTC TACATCCCGT CCAACCTTGC CTACCGCGAA CAGGGTGCGG
    701     GCGACAAAAT CGGTCCGAAC GCCACTTTGG TATTTGATGT GAAACTGGTC
    751     AAAATCGGCG CACCCGAAAA CGCGCCCGCC AAGCAGCCGG CTCAAGTCGA
    801     CATCAAAAAA GTAAATTAA
```

This corresponds to the amino acid sequence <SEQ ID 3064; ORF 576-1>:

```
m576-1.pep
      1     MNTIFKISAL TLSAALALSA CGKKEAAPAS ASEPAAASSA QGDTSSIGST
     51     MQQASYAMGV DIGRSLKQMK EQGAEIDLKV FTEAMQAVYD GKEIKMTEEQ
    101     AQEVMMKFLQ EQQAKAVEKH KADAKANKEK GEAFLKENAA KDGVKTTASG
    151     LQYKITKQGE GKQPTKDDIV TVEYEGRLID GTVFDSSKAN GGPVTFPLSQ
    201     VIPGWTEGVQ LLKEGGEATF YIPSNLAYRE QGAGDKIGPN ATLVFDVKLV
    251     KIGAPENAPA KQPAQVDIKK VN*
```

The following partial DNA sequence was identified in *N. gonorrhoeae* <SEQ ID 3065>:

```
g576-1.seq
      1     ATGAACACCA TTTTCAAAAT CAGCGCACTG ACCCTTTCCG CCGCTTTGGC
     51     ACTTTCCGCC TGCGGCAAAA AAGAAGCCGC CCCCGCATCT GCATCCGAAC
    101     CTGCCGCCGC TTCTGCCGCG CAGGGCGACA CCTCTTCAAT CGGCAGCACG
    151     ATGCAGCAGG CAAGCTATGC AATGGGCGTG GACATCGGAC GCTCCCTGAA
    201     ACAAATGAAG GAACAGGGCG CGGAAATCGA TTTGAAAGTC TTTACCGATG
    251     CCATGCAGGC AGTGTATGAC GGCAAAGAAA TCAAAATGAC CGAAGAGCAG
    301     GCCCAGGAAG TGATGATGAA ATTCCTGCAG GAGCAGCAGG CTAAAGCCGT
    351     AGAAAAACAC AAGGCGGATG CGAAGGCCAA CAAAGAAAAA GGCGAAGCCT
    401     TCCTGAAGGA AAATGCCGCC AAAGACGGCG TGAAGACCAC TGCTTCCGGT
    451     CTGCAGTACA AAATCACCAA ACAGGGTGAA GGCAAACAGC CGACAAAAGA
    501     CGACATCGTT ACCGTGGAAT ACGAAGGCCG CCTGATTGAC GGTACCGTAT
```

-continued

```
551   TCGACAGCAG CAAAGCCAAC GGCGGCCCGG CCACCTTCCC TTTGAGCCAA

601   GTGATTCCGG GTTGGACCGA AGGCGTACGG CTTCTGAAAG AAGGCGGCGA

651   AGCCACGTTC TACATCCCGT CCAACCTTGC CTACCGCGAA CAGGGTGCGG

701   GCGAAAAAAT CGGTCCGAAC GCCACTTTGG TATTTGACGT GAAACTGGTC

751   AAAATCGGCG CACCCGAAAA CGCGCCCGCC AAGCAGCCGG ATCAAGTCGA

801   CATCAAAAAA GTAAATTAA
```

This corresponds to the amino acid sequence <SEQ ID 3066; ORF 576-1.ng>:

```
g576-1.pep
    1   MNTIFKISAL TLSAALALSA CGKKEAAPAS ASEPAAASAA QGDTSSIGST

51   MQQASYAMGV DIGRSLKQMK EQGAEIDLKV FTDAMQAVYD GKEIKMTEEQ

101   AQEVMMKFLQ EQQAKAVEKH KADAKANKEK GEAFLKENAA KDGVKTTASG

151   LQYKITKQGE GKQPTKDDIV TVEYEGRLID GTVFDSSKAN GGPATFPLSQ

201   VIPGWTEGVR LLKEGGEATF YIPSNLAYRE QGAGEKIGPN ATLVFDVKLV

251   KIGAPENAPA KQPDQVDIKK VN*
``` g576-1/m576-1 ORFa 576-1 and 567-1.a showed a 97.8% identity in 272 aa overlap

```
                  10         20         30         40         50         60
g576-1.pep  MNTIFKISALTLSAALALSACGKKEAAPASASEPAAASAAQGDTSSIGSTMQQASYAMGV
            ||||||||||||||||||||||||||||||||||||:|||||||||||||||||||||||
m576-1      MNTIFKISALTLSAALALSACGKKEAAPASASEPAAASAQGDTSSIGSTMQQASYAMGV
                  10         20         30         40         50         60
                  70         80         90        100        110        120
g576-1.pep  DIGRSLKQMKEQGAEIDLKVFTDAMQAVYDGKEIKMTEEQAQEVMMKFLQEQQAKAVEKH
            ||||||||||||||||||||:|||||||||||||||||||||||||||||||||||||||
m576-1      DIGRSLKQMKEQGAEIDLKVFTEAMQAVYDGKEIKMTEEQAQEVMMKFLQEQQAKAVEKH
                  70         80         90        100        110        120
                 130        140        150        160        170        180
g576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                 130        140        150        160        170        180
                 190        200        210        220        230        240
g576-1.pep  GTVFDSSKANGGPATFPLSQVIPGWTEGVRLLKEGGEATFYIPSNLAYREQGAGEKIGPN
            ||||||||||||:|||||||||||||||:|||||||||||||||||||||||||:|||||
m576-1      GTVFDSSKANGGPVTFPLSQVIPGWTEGVQLLKEGGEATFYIPSNLAYREQGAGDKIGPN
                 190        200        210        220        230        240
                 250        260        270
g576-1.pep  ATLVFDVKLVKIGAPENAPAKQPDQVDIKKVNX
            |||||||||||||||||||||||| ||||||||
m576-1      ATLVFDVKLVKIGAPENAPAKQPAQVDIKKVNX
                 250        260        270
```

The following DNA sequence was identified in *N. meningitidis* <SEQ ID 3067>:

```
a576-1.seq
    1   ATGAACACCA TTTTCAAAAT CAGCGCACTG ACCCTTTCCG CCGCTTTGGC

51   ACTTTCCGCC TGCGGCAAAA AGAAGCCGC CCCCGCATCT GCATCCGAAC

101   CTGCCGCCGC TTCTTCCGCG CAGGGCGACA CCTCTTCGAT CGGCAGCACG

151   ATGCAGCAGG CAAGCTATGC GATGGGCGTG ACATCGGAC GCTCCCTGAA

201   GCAAATGAAG GAACAGGGCG CGGAAATCGA TTTGAAAGTC TTTACCGAAG
```

-continued

```
251   CCATGCAGGC AGTGTATGAC GGCAAAGAAA TCAAAATGAC CGAAGAGCAG

301   GCTCAGGAAG TCATGATGAA ATTCCTTCAG GAACAACAGG CTAAAGCCGT

351   AGAAAAACAC AAGGCGGACG CGAAGGCCAA TAAAGAAAAA GGCGAAGCCT

401   TTCTGAAAGA AAATGCCGCC AAAGACGGCG TGAAGACCAC TGCTTCCGGC

451   CTGCAATACA AAATCACCCAA ACAGGGCGAA GGCAAACAGC CGACCAAAGA

501   CGACATCGTT ACCGTGGAAT ACGAAGGCCG CCTGATTGAC GGTACGGTAT

551   TCGACAGCAG CAAAGCCAAC GGCGGCCCGG TCACCTTCCC TTTGAGCCAA

601   GTGATTCTGG GTTGGACCGA AGGCGTACAG CTTCTGAAAG AAGGCGGCGA

651   AGCCACGTTC TACATCCCGT CCAACCTTGC CTACCGCGAA CAGGGTGCGG

701   GCGACAAAAT CGGCCCGAAC GCCACTTTGG TATTTGATGT GAAACTGGTC

751   AAAATCGGCG CACCCGAAAA CGCGCCCGCC AAGCAGCCGG CTCAAGTCGA

801   CATCAAAAAA GTAAATTAA
```

This corresponds to the amino acid sequence <SEQ ID 3068; ORF 576-1.a>:

```
a576-1.pep
    1   MNTIFKISAL TLSAALALSA CGKKEAAPAS ASEPAAASSA QGDTSSIGST

51   MQQASYAMGV DIGRSLKQMK EQGAEIDLKV FTEAMQAVYD GKEIKMTEEQ

101   AQEVMMKFLQ EQQAKAVEKH KADAKANKEK GEAFLKENAA KDGVKTTASG

151   LQYKITKQGE GKQPTKDDIV TVEYEGRLID GTVFDSSKAN GGPVTFPLSQ

201   VILGWTEGVQ LLKEGGEATF YIPSNLAYRE QGAGDKIGPN ATLVFDVKLV

251   KIGAPENAPA KQPAQVDIKK VN*
``` a576-1/m576-1 99.6% identity in 272 aa overlap

```
                   10         20         30         40         50         60
a576-1.pep  MNTIFKISALTLSAALALSACGKKEAAPASASEPAAASSAQGDTSSIGSTMQQASYAMGV
            ||||||||||||||||||||||||||||||||||||||||||||||||||||||||||||
m576-1      MNTIFKISALTLSAALALSACGKKEAAPASASEPAAASSAQGDTSSIGSTMQQASYAMGV
                   10         20         30         40         50         60

70         80         90        100        110        120
a576-1.pep  DIGRSLKQMKEQGAEIDLKVFTEAMQAVYDGKEIKMTEEQAQEVMMKFLQEQQAKAVEKH
            ||||||||||||||||||||||||||||||||||||||||||||||||||||||||||||
m576-1      DIGRSLKQMKEQGAEIDLKVFTEAMQAVYDGKEIKMTEEQAQEVMMKFLQEQQAKAVEKH
                   70         80         90        100        110        120

130        140        150        160        170        180
a576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                  130        140        150        160        170        180

190        200        210        220        230        240
a576-1.pep  GTVFDSSKANGGPVTFPLSQVILGWTEGVQLLKEGGEATFYIPSNLAYREQGAGDKIGPN
            |||||||||||||||||||||||| |||||||||||||||||||||||||||||||||||
m576-1      GTVFDSSKANGGPVTFPLSQVIPGWTEGVQLLKEGGEATFYIPSNLAYREQGAGDKIGPN
                  190        200        210        220        230        240

250        260        270
a576-1.pep  ATLVFDVKLVKIGAPENAPAKQPAQVDIKKVNX
            |||||||||||||||||||||||||||||||||
m576-1      ATLVFDVKLVKIGAPENAPAKQPAQVDIKKVNX
                  250        260        270
```

919 gnm43.seq

The following partial DNA sequence was identified in *N. meningitidis* <SEQ ID 3069>:

```
m919.seq
   1 ATGAAAAAAT ACCTATTCCG CGCCGCCCTG TACGGCATCG CCGCCGCCAT
  51 CCTCGCCGCC TGCCAAAGCA AGAGCATCCA AACCTTTCCG CAACCCGACA
 101 CATCCGTCAT CAACGGCCCG GACCGGCCGG TCGGCATCCC CGACCCCGCC
 151 GGAACGACGG TCGGCGGCGG CGGGGCCGTC TATACCGTTG TACCGCACCT
 201 GTCCCTGCCC CACTGGGCGG CGCAGGATTT CGCCAAAAGC CTGCAATCCT
 251 TCCGCCTCGG CTGCGCCAAT TTGAAAAACC GCCAAGGCTG GCAGGATGTG
 301 TGCGCCCAAG CCTTTCAAAC CCCCGTCCAT TCCTTTCAGG CAAAACAGTT
 351 TTTTGAACGC TATTTCACGC CGTGGCAGGT TGCAGGCAAC GGAAGCCTTG
 401 CCGGTACGGT TACCGGCTAT TACGAACCGG TGCTGAAGGG CGACGACAGG
 451 CGGACGGCAC AAGCCCGCTT CCCGATTTAC GGTATTCCCG ACGATTTTAT
 501 CTCCGTCCCC CTGCCTGCCG GTTTGCGGAG CGGAAAAGCC CTTGTCCGCA
 551 TCAGGCAGAC GGGAAAAAAC AGCGGCACAA TCGACAATAC CGGCGGCACA
 601 CATACCGCCG ACCTCTCCcG ATTCCCCATC ACCGCGCGCA CAACAGCAAT
 651 CAAAGGCAGG TTTGAAGGAA GCCGCTTCCT CCCCTACCAC ACGCGCAACC
 701 AAATCAACGG CGGCGCGCTT GACGGCAAAG CCCCGATACT CGGTTACGCC
 751 GAAGACCCTG TCGAACTTTT TTTTATGCAC ATCCAAGGCT CGGGCCGTCT
 801 GAAAACCCCG TCCGGCAAAT ACATCCGCAT CGGCTATGCC GACAAAAACG
 851 AACATCCyTA CGTTTCCATC GGACGCTATA TGGCGGATAA GGGCTACCTC
 901 AAACTCGGAC AAACCTCCAT GCAGGGCATT AAGTCTTATA TGCGGCAAAA
 951 TCCGCAACGC CTCGCCGAAG TTTTGGGTCA AAACCCCAGC TATATCTTTT
1001 TCCGCGAGCT TGCCGGAAGC AGCAATGACG GCCCTGTCGG CGCACTGGGC
1051 ACGCCGCTGA TGGGGGAATA TGCCGGCGCA GTCGACCGGC ACTACATTAC
1101 CTTGGGTGCG CCCTTATTTG TCGCCACCGC CCATCCGGTT ACCCGCAAAG
1151 CCCTCAACCG CCTGATTATG GCGCAGGATA CCGGCAGCGC GATTAAAGGC
1201 GCGGTGCGCG TGGATTATTT TTGGGGATAC GGCGACGAAG CCGGCGAACT
1251 TGCCGGCAAA CAGAAAACCA CGGGATATGT CTGGCAGCTC CTACCCAACG
1301 GTATGAAGCC CGAATACCGc CCGTAA
```

This corresponds to the amino acid sequence <SEQ ID 3070; ORF 919>:

```
m919.pep
   1 MKKYLFRAAL YGIAAAILAA CQSKSIQTFP QPDTSVINGP DRPVGIPDPA
  51 GTTVGGGGAV YTVVPHLSLP HWAAQDFAKS LQSFRLGCAN LKNRQGWQDV
 101 CAQAFQTPVH SFQAKQFFER YFTPWQVAGN GSLAGTVTGY YEPVLKGDDR
 151 RTAQARFPIY GIPDDFISVP LPAGLRSGKA LVRIRQTGKN SGTIDNTGGT
 201 HTADLSRFPI TARTTAIKGR FEGSRFLPYH TRNQINGGAL DGKAPILGYA
 251 EDPVELFFMH IQGSGRLKTP SGKYIRIGYA DKNEHPYVSI GRYMADKGYL
 301 KLGQTSMQGI KSYMRQNPQR LAEVLGQNPS YIFFRELAGS SNDGPVGALG
 351 TPLMGEYAGA VDRHYITLGA PLFVATAHPV TRKALNRLIM AQDTGSAIKG
 401 AVRVDYFWGY GDEAGELAGK QKTTGYVWQL LPNGMKPEYR P*
```

The following partial DNA sequence was identified in *N. gonorrhoeae* <SEQ ID 3071>:

```
g919.seq
    1 ATGAAAAAAC ACCTGCTCCG CTCCGCCCTG TACGGcatCG CCGCCgccAT
   51 CctcgCCGCC TGCCAAAgca gGAGCATCCA AACCTTTCCG CAACCCGACA
  101 CATCCGTCAT CAACGGCCCG GACCGGCCGG CCGGCATCCC CGACCCCGCC
  151 GGAACGACGG TTGCCGGCGG CGGGGCCGTC TATACCGTTG TGCCGCACCT
  201 GTCCATGCCC CACTGGGCGG CGCaggATTT TGCCAAAAGC CTGCAATCCT
  251 TCCGCCTCGG CTGCGCCAAT TTGAAAAACC GCCAAGGCTG GCAGGATGTG
  301 TGCGCCCAAG CCTTTCAAAC CCCCGTGCAT TCCTTTCAGG CAAAGcGgTT
  351 TTTTGAACGC TATTTCACGC cgtGGCaggt tgcaggcaAC GGAAGcCTTG
  401 Caggtacggt TACCGGCTAT TACGAACCGG TGCTGAAGGG CGACGGCAGG
  451 CGGACGGAAC GGGCCCGCTT CCCGATTTAC GGTATTCCCG ACGATTTTAT
  501 CTCCGTCCCG CTGCCTGCCG GTTTGCGGGG CGGAAAAAAC CTTGTCCGCA
  551 TCAGGCAGac ggGGAAAAAC AGCGGCACGA TCGACAATGC CGGCGGCACG
  601 CATACCGCCG ACCTCTCCCG ATTCCCCATC ACCGCGCGCA CAACGGcaat
  651 caaaGGCAGG TTTGAaggAA GCCGCTTCCT CCCTTACCAC ACGCGCAACC
  701 AAAtcaacGG CGGCgcgcTT GACGGCAAag cccCCATCCT CggttacgcC
  751 GAagaccCcG tcgaacttTT TTTCATGCAC AtccaaggCT CGGGCCGCCT
  801 GAAAACCCcg tccggcaaat acatCCGCAt cggaTacgcc gacAAAAACG
  851 AACAtccgTa tgtttccatc ggACGctaTA TGGCGGACAA AGGCTACCTC
  901 AAGctcgggc agACCTCGAT GCAGGgcatc aaagcCTATA TGCGGCAAAA
  951 TCCGCAACGC CTCGCCGAAG TTTTGGGTCA AAACCCCAGC TATATCTTTT
 1001 TCCGCGAGCT TGCCGGAAGC GGCAATGAGG GCCCCGTCGG CGCACTGGGC
 1051 ACGCCACTGA TGGGGGAATA CGCCGGCGCA ATCGACCGGC ACTACATTAC
 1101 CTTGGGCGCG CCCTTATTTG TCGCCACCGC CCATCCGGTT ACCCGCAAAG
 1151 CCCTCAACCG CCTGATTATG GCGCAGGATA CAGGCAGCGC GATCAAAGGC
 1201 GCGGTGCGCG TGGATTATTT TTGGGGTTAC GGCGACGAAG CCGGCGAACT
 1251 TGCCGGCAAA CAGAAAACCA CGGGATACGT CTGGCAGCTC CTGCCCAACG
 1301 GCATGAAGCC CGAATACCGC CCGTGA
```

This corresponds to the amino acid sequence <SEQ ID 3072; ORF 919.ng>:

```
g919.pep
    1 MKKHLLRSAL YGIAAAILAA CQSRSIQTFP QPDTSVINGP DRPAGIPDPA
   51 GTTVAGGGAV YTVVPHLSMP HWAAQDFAKS LQSFRLGCAN LKNRQGWQDV
  101 CAQAFQTPVH SFQAKRFFER YFTPWQVAGN GSLAGTVTGY YEPVLKGDGR
  151 RTERARFPIY GIPDDFISVP LPAGLRGGKN LVRIRQTGKN SGTIDNAGGT
  201 HTADLSRFPI TARTTAIKGR FEGSRFLPYH TRNQINGGAL DGKAPILGYA
  251 EDPVELFFMH IQGSGRLKTP SGKYIRIGYA DKNEHPYVSI GRYMADKGYL
  301 KLGQTSMQGI KAYMRQNPQR LAEVLGQNPS YIFFRELAGS GNEGPVGALG
```

```
351  TPLMGEYAGA IDRHYITLGA PLFVATAHPV TRKALNRLIM AQDTGSAIKG

401  AVRVDYFWGY GDEAGELAGK QKTTGYVWQL LPNGMKPEYR P*
```

ORF 919 shows 95.9% identity over a 441 aa overlap with a predicted ORF (ORF 919.ng) from *N. gonorrhoeae*:

```
m919/g919
                   10         20         30         40         50         60
    m919.pep  MKKYLFRAALYGIAAAILAACQSKSIQTFPQPDTSVINGPDRPVGIPDPAGTTVGGGGAV
              |||:|:|:||||||||||||||||:||||||||||||||||||:||||||||||:||||
        g919  MKKHLLRSALYGIAAAILAACQSRSIQTFPQPDTSVINGPDRPAGIPDPAGTTVAGGGAV
                   10         20         30         40         50         60

70         80         90        100        110        120
    m919.pep  YTVVPHLSLPHWAAQDFAKSLQSFRLGCANLKNRQGWQDVCAQAFQTPVHSFQAKQFFER
              ||||||||:||||||||||||||||||||||||||||||||||||||||||||||:||||
        g919  YTVVPHLSMPHWAAQDFAKSLQSFRLGCANLKNRQGWQDVCAQAFQTPVHSFQAKRFFER
                   70         80         90        100        110        120

130        140        150        160        170        180
    m919.pep  YFTPWQVAGNGSLAGTVTGYYEPVLKGDDRRTAQARFPIYGIPDDFISVPLPAGLRSGKA
              ||||||||||||||||||||||||||||:|||||:|||||||||||||||||||||:||
        g919  YFTPWQVAGNGSLAGTVTGYYEPVLKGDGRRTERARFPIYGIPDDFISVPLPAGLRGGKN
                  130        140        150        160        170        180

190        200        210        220        230        240
    m919.pep  LVRIRQTGKNSGTIDNTGGTHTADLSRFPITARTTAIKGRFEGSRFLPYHTRNQINGGAL
              |||||||||||||||||:||||||||||||||||||||||||||||||||||||||||||
        g919  LVRIRQTGKNSGTIDNAGGTHTADLSRFPITARTTAIKGRFEGSRFLPYHTRNQINGGAL
                  190        200        210        220        230        240

250        260        270        280        290        300
    m919.pep  DGKAPILGYAEDPVELFFMHIQGSGRLKTPSGKYIRIGYADKNEHPYVSIGRYMADKGYL
              ||||||||||||||||||||||||||||||||||||||||||||||||||||||||||||
        g919  DGKAPILGYAEDPVELFFMHIQGSGRLKTPSGKYIRIGYADKNEHPYVSIGRYMADKGYL
                  250        260        270        280        290        300

310        320        330        340        350        360
    m919.pep  KLGQTSMQGIKSYMRQNPQRLAEVLGQNPSYIFFRELAGSSNDGPVGALGTPLMGEYAGA
              ||||||||||:|||||||||||||||||||||||||||:|:|||||||||||||||||
        g919  KLGQTSMQGIKAYMRQNPQRLAEVLGQNPSYIFFRELAGSGNEGPVGALGTPLMGEYAGA
                  310        320        330        340        350        360

370        380        390        400        410        420
    m919.pep  VDRHYITLGAPLFVATAHPVTRKALNRLIMAQDTGSAIKGAVRVDYFWGYGDEAGELAGK
              :|||||||||||||||||||||||||||||||||||||||||||||||||||||||||||
        g919  IDRHYITLGAPLFVATAHPVTRKALNRLIMAQDTGSAIKGAVRVDYFWGYGDEAGELAGK
                  370        380        390        400        410        420

430        440
    m919.pep  QKTTGYVWQLLPNGMKPEYRPX
              ||||||||||||||||||||||
        g919  QKTTGYVWQLLPNGMKPEYRPX
                  430        440
```

The following partial DNA sequence was identified in *N. meningitidis* <SEQ ID 3073>:

```
a919.seq
    1  ATGAAAAAAT ACCTATTCCG CGCCGCCCTG TGCGGCATCG CCGCCGCCAT

51  CCTCGCCGCC TGCCAAAGCA AGAGCATCCA AACCTTTCCG CAACCCGACA

101  CATCCGTCAT CAACGGCCCG GACCGGCCGG TCGGCATCCC CGACCCCGCC

151  GGAACGACGG TCGGCGGCGG CGGGGCCGTT TATACCGTTG TGCCGCACCT

201  GTCCCTGCCC CACTGGGCGG CGCAGGATTT CGCCAAAAGC CTGCAATCCT

251  TCCGCCTCGG CTGCGCCAAT TTGAAAAACC GCCAAGGCTG GCAGGATGTG

301  TGCGCCCAAG CCTTTCAAAC CCCCGTCCAT TCCGTTCAGG CAAAACAGTT

351  TTTTGAACGC TATTTCACGC CGTGGCAGGT TGCAGGCAAC GGAAGCCTTG

401  CCGGTACGGT TACCGGCTAT TACGAGCCGG TGCTGAAGGG CGACGACAGG

451  CGGACGGCAC AAGCCCGCTT CCCGATTTAC GGTATTCCCG ACGATTTTAT

501  CTCCGTCCCC CTGCCTGCCG GTTTGCGGAG CGGAAAAGCC CTTGTCCGCA
```

-continued

```
 551   TCAGGCAGAC GGGAAAAAAC AGCGGCACAA TCGACAATAC CGGCGGCACA
 601   CATACCGCCG ACCTCTCCCA ATTCCCCATC ACTGCGCGCA CAACGGCAAT
 651   CAAAGGCAGG TTTGAAGGAA GCCGCTTCCT CCCCTACCAC ACGCGCAACC
 701   AAATCAACGG CGGCGCGCTT GACGGCAAAG CCCCGATACT CGGTTACGCC
 751   GAAGACCCCG TCGAACTTTT TTTTATGCAC ATCCAAGGCT CGGGCCGTCT
 801   GAAAACCCCG TCCGGCAAAT ACATCCGCAT CGGCTATGCC GACAAAAACG
 851   AACATCCCTA CGTTTCCATC GGACGCTATA TGGCGGACAA AGGCTACCTC
 901   AAGCTCGGGC AGACCTCGAT GCAGGGCATC AAAGCCTATA TGCAGCAAAA
 951   CCCGCAACGC CTCGCCGAAG TTTTGGGGCA AAACCCCAGC TATATCTTTT
1001   TCCGAGAGCT TACCGGAAGC AGCAATGACG GCCCTGTCGG CGCACTGGGC
1051   ACGCCGCTGA TGGGCGAGTA CGCCGGCGCA GTCGACCGGC ACTACATTAC
1101   CTTGGGCGCG CCCTTATTTG TCGCCACCGC CCATCCGGTT ACCCGCAAAG
1151   CCCTCAACCG CCTGATTATG GCGCAGGATA CCGGCAGCGC GATTAAAGGC
1201   GCGGTGCGCG TGGATTATTT TTGGGGATAC GGCGACGAAG CCGGCGAACT
1251   TGCCGGCAAA CAGAAAACCA CGGGATATGT CTGGCAGCTT CTGCCCAACG
1301   GTATGAAGCC CGAATACCGC CCGTAA
```

This corresponds to the amino acid sequence <SEQ ID 3074; ORF 919.a>:

```
a919.pep
    1   MKKYLFRAAL CGIAAAILAA CQSKSIQTFP QPDTSVINGP DRPVGIPDPA

51   GTTVGGGGAV YTVVPHLSLP HWAAQDFAKS LQSFRLGCAN LKNRQGWQDV

101   CAQAFQTPVH SVQAKQFFER YFTPWQVAGN GSLAGTVTGY YEPVLKGDDR

151   RTAQARFPIY GIPDDFISVP LPAGLRSGKA LVRIRQTGKN SGTIDNTGGT

201   HTADLSQFPI TARTTAIKGR FEGSRFLPYH TRNQINGGAL DGKAPILGYA

251   EDPVELFFMH IQGSGRLKTP SGKYIRIGYA DKNEHPYVSI GRYMADKGYL

301   KLGQTSMQGI KAYMQQNPQR LAEVLGQNPS YIFFRELTGS SNDGPVGALG

351   TPLMGEYAGA VDRHYITLGA PLFVATAHPV TRKALNRLIM AQDTGSAIKG

401   AVRVDYFWGY GDEAGELAGK QKTTGYVWQL LPNGMKPEYR P*
```
                                                                50
m919/a919 98.6% identity in 441 aa overlap

```
                  10         20         30         40         50         60
  m919.pep  MKKYLFRAALYGIAAAILAACQSKSIQTFPQPDTSVINGPDRPVGIPDPAGTTVGGGGAV
            |||||||||| ||||||||||||||||||||||||||||||||||||||||||||||||
      a919  MKKYLFRAALCGIAAAILAACQSKSIQTFPQPDTSVINGPDRPVGIPDPAGTTVGGGGAV
                  10         20         30         40         50         60

70         80         90        100        110        120
  m919.pep  YTVVPHLSLPHWAAQDFAKSLQSFRLGCANLKNRQGWQDVCAQAFQTPVHSFQAKQFFER
            |||||||||||||||||||||||||||||||||||||||||||||||||| |||||||||
      a919  YTVVPHLSLPHWAAQDFAKSLQSFRLGCANLKNRQGWQDVCAQAFQTPVHSVQAKQFFER
                  70         80         90        100        110        120

130        140        150        160        170        180
  m919.pep  YFTPWQVAGNGSLAGTVTGYYEPVLKGDDRRTAQARFPIYGIPDDFISVPLPAGLRSGKA
            ||||||||||||||||||||||||||||||||||||||||||||||||||||||||||||
      a919  YFTPWQVAGNGSLAGTVTGYYEPVLKGDDRRTAQARFPIYGIPDDFISVPLPAGLRSGKA
                 130        140        150        160        170        180
```

-continued

```
              190        200        210        220        230        240
m919.pep  LVRIRQTGKNSGTIDNTGGTHTADLSRFPITARTTAIKGRFEGSRFLPYHTRNQINGGAL
          ||||||||||||||||||||||||||:|||||||||||||||||||||||||||||||||
a919      LVRIRQTGKNSGTIDNTGGTHTADLSQFPITARTTAIKGRFEGSRFLPYHTRNQINGGAL
              190        200        210        220        230        240

250        260        270        280        290        300
m919.pep  DGKAPILGYAEDPVELFFMHIQGSRLKTPSGKYIRIGYADKNEHPYVSIGRYMADKGYL
          ||||||||||||||||||||||||||||||||||||||||||||||||||||||||||||
a919      DGKAPILGYAEDPVELFFMHIQGSRLKTPSGKYIRIGYADKNEHPYVSIGRYMADKGYL
              250        260        270        280        290        300

310        320        330        340        350        360
m919.pep  KLGQTSMQGIKSYMRQNPQRLAEVLGQNPSYIFFRELAGSSNDGPVGALGTPLMGEYAGA
          ||||||||||:||:||||||||||||||||||||||||:|||||||||||||||||||||
a919      KLGQTSMQGIKAYMQQNPQRLAEVLGQNPSYIFFRELTGSSNDGPVGALGTPLMGEYAGA
              310        320        330        340        350        360

370        380        390        400        410        420
m919.pep  VDRHYITLGAPLFVATAHPVTRKALNRLIMAQDTGSAIKGAVRVDYFWGYGDEAGELAGK
          ||||||||||||||||||||||||||||||||||||||||||||||||||||||||||||
a919      VDRHYITLGAPLFVATAHPVTRKALNRLIMAQDTGSAIKGAVRVDYFWGYGDEAGELAGK
              370        380        390        400        410        420

430        440
m919.pep  QKTTGYVWQLLPNGMKPEYRPX
          ||||||||||||||||||||||
a919      QKTTGYVWQLLPNGMKPEYRPX
              430        440
```

121 and 121-1

The following partial DNA sequence was identified in *N. meningitidis* <SEQ ID 3075>:

```
m121.seq
     1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CCAATTGCTG

151  GATTTGCAGG ACACAGGCGC AGACGAACTG CACCGCAGCA GGATTTTGTC

201  GCAAGAACTC AGCCGCCTAT ATGCGCAAAC CGCCGCCGAA CTGCTGTGCA

251  GTCAAAACCT CGCACCGTCC GACATTACCG CCCTCGGCTG CCACGGGCAA

301  ACCGTCCGAC ACGCGCCGGA ACACGGTTAC AGCATACAGC TTGCCGATTT

351  GCCGCTGCTG GCGxxxxxxx xxxxxxxxxx xxxxxxxxxx xxxxxxxxxx 401  xxxxxxxxxx xxxxxxxxxx xxxxxxxxxx xxxxxxxxxx xxxxxxxxxx 451  xxxxxxxxxx xxxxxxxxxx xxxxxxxxxx xxxxxxxxxx xxxxxxxxxx 501  xxxxxxxxxx xxxxxxxxxx xxxxxxxxxx xxxxxxxxxx xxxxxxxxxx 551  xxxxxxxxxx xxxxxxxxxx xxxxxxxxxx xxxxxxxxxx xxxxxxxxxx 601  xxxxxxCAGC TTCCTTACGA CAAAAACGGT GCAAAGTCGG CACAAGGCAA

651  CATATTGCCG CAACTGCTCG ACAGGCTGCT CGCCCACCCG TATTTCGCAC

701  AACGCCACCC TAAAAGCACG GGGCGCGAAC TGTTTGCCAT AAATTGGCTC

751  GAAACCTACC TTGACGGCGG CGAAAACCGA TACGACGTAT TGCGGACGCT

801  TTCCCGTTTT ACCGCGCAAA CCGTTTGCGA CGCCGTCTCA CACGCAGCGG

851  CAGATGCCCG TCAAATGTAC ATTTGCGACG GCGGCATCCG CAATCCTGTT

901  TTAATGGCGG ATTTGGCAGA ATGTTTCGGC ACACGCGTTT CCCTGCACAG

951  CACCGCCGAC CTGAACCTCG ATCCGCAATG GGTGGAAGCC GCCGnATTTG

1001  CGTGGTTGGC GGCGTGTTGG ATTAATCGCA TTCCCGGTAG TCCGCACAAA

1051  GCAACCGGCG CATCCAAACC GTGTATTCTG AnCGCGGGAT ATTATTATTG

1101  A
```

This corresponds to the amino acid sequence <SEQ ID 3076; ORF 121>:

```
m121.pep
     1   METQLYIGIM SGTSMDGADA VLIRMDGGKW LGAEGHAFTP YPGRLRRQLL

51   DLQDTGADEL HRSRILSQEL SRLYAQTAAE LLCSQNLAPS DITALGCHGQ

101   TVRHAPEHGY SIQLADLPLL Axxxxxxxxx xxxxxxxxxx xxxxxxxxxx 151   xxxxxxxxxx xxxxxxxxxx xxxxxxxxxx xxxxxxxxxx xxxxxxxxxx 201   xxQLPYDKNG AKSAQGNILP QLLDRLLAHP YFAQRHPKST GRELFAINWL

251   ETYLDGGENR YDVLRTLSRF TAQTVCDAVS HAAADARQMY ICDGGIRNPV

301   LMADLAECFG TRVSLHSTAD LNLDPQWVEA AXFAWLAACW INRIPGSPHK

351   ATGASKPCIL XAGYYY*
```

The following partial DNA sequence was identified in *N. gonorrhoeae* <SEQ ID 3077>:

```
g121.seq
     1   ATGGAAACAC AGCTTTACAT CGGCATTATG TCGGGAACCA GTATGGACGG

51   GGCGGATGCC GTGCTGGTAC GGATGGACGG CGGCAAATGG CTGGGCGCGG

101   AAGGGCACGC CTTTACCCCC TACCCTGACC GGTTGCGCCG CAAATTGCTG

151   GATTTGCAGG ACACAGGCAC AGACGAACTG CACCGCAGCA GGATGTTGTC

201   GCAAGAACTC AGCCGCCTGT ACGCGCAAAC CGCCGCCGAA CTGCTGTGCA

251   GTCAAAACCT CGCTCCGTGC GACATTACCG CCCTCGGCTG CCACGGGCAA

301   ACCGTCCGAC ACGCGCCGGA ACACGGTtac AGCATACAGC TTGCCGATTT

351   GCCGCTGCTG GCGGAACTGa cgcggatttT TACCGTCggc gacttcCGCA

401   GCCGCGACCT TGCTGCCGGC GGacaAGGTG CGCCGCTCGT CCCCGCCTTT

451   CACGAAGCCC TGTTCCGCGA TGACAGGGAA ACACGCGTGG TACTGAACAT

501   CGGCGGGATT GCCAACATCA GCGTACTCCC CCCCGGCGCA CCCGCCTTCG

551   GCTTCGACAC AGGGCCGGGC AATATGCTGA TGGAcgcgtg gacgcaggca 601   cacTGGcagc TGCCTTACGA CAAAAacggt gcAAAGgcgg cacAAGGCAA 651   catatTGCcg cAACTGCTCG gcaggctGCT CGCCcaccCG TATTTCTCAC 701   AACCCcaccc aaAAAGCACG GGgcGCGaac TgtttgcccT AAattggctc 751   gaaacctAcc ttgacggcgg cgaaaaccga tacgacgtat tgcggacgct 801   ttcccgattc accgcgcaaA ccgTttggga cgccgtctca CACGCAGCGG

851   CAGATGCCCG TCAAATGTAC ATTTGCGGCG GCGGCATCCG CAATCCTGTT

901   TTAATGGCGG ATTTGGCAGA ATGTTTCGGC ACACGCGTTT CCCTGCACAG

951   CACCGCCGAA CTGAACCTCG ATCCTCAATG GGTGGAGGCG gccgCATTtg 1001   cgtggttggC GGCGTGTTGG ATTAACCGCA TTCCCGGTAG TCCGCACAAA

1051   GCGACCGGCG CATCCAAACC GTGTATTCTG GGCGCGGGAT ATTATTATTG

1101   A
```

This corresponds to the amino acid sequence <SEQ ID 3078; ORF 121.ng>:

```
g121.pep
    1   METQLYIGIM SGTSMDGADA VLVRMDGGKW LGAEGHAFTP YPDRLRRKLL

51   DLQDTGTDEL HRSRMLSQEL SRLYAQTAAE LLCSQNLAPC DITALGCHGQ

101   TVRHAPEHGY SIQLADLPLL AELTRIFTVG DFRSRDLAAG GQGAPLVPAF

151   HEALFRDDRE TRVVLNIGGI ANISVLPPGA PAFGFDTGPG NMLMDAWTQA

201   HWQLPYDKNG AKAAQGNILP QLLGRLLAHP YFSQPHPKST GRELFALNWL

251   ETYLDGGENR YDVLRTLSRF TAQTVWDAVS HAAADARQMY ICGGGIRNPV

301   LMADLAECFG TRVSLHSTAE LNLDPQWVEA AAFAWLAACW INRIPGSPHK

351   ATGASKPCIL GAGYYY*
                                                    15
```

ORF 121 shows 73.5% identity over a 366 aa overlap with a predicted ORF (ORF121.ng) from *N. gonorrhoeae*:

```
    m121/g121
                   10         20         30         40         50         60
       m121.pep   METQLYIGIMSGTSMDGADAVLIRMDGGKWLGAEGHAFTPYPGRLRRQLLDLQDTGADEL
                  ||||||||||||||||||||||:|||||||||||||||||||  ||||:||||||||:|||
           g121   METQLYIGIMSGTSMDGADAVLVRMDGGKWLGAEGHAFTPYPDRLRRKLLDLQDTGTDEL
                   10         20         30         40         50         60

70         80         90        100        110        120
       m121.pep   HRSRILSQELSRLYAQTAAELLCSQNLAPSDITALGCHGQTVRHAPEHGYSIQLADLPLL
                  ||||:|||||||||||||||||||||||||:  |||||||||||||||||||||||||||
           g121   HRSRMLSQELSRLYAQTAAELLCSQNLAPCDITALGCHGQTVRHAPEHGYSIQLADLPLL
                   70         80         90        100        110        120

130        140        150        160        170        180
       m121.pep   AXXXXXXXXXXXXXXXXXXXXXXXXXXXXXXXXXXXXXXXXXXXXXXXXXXXXXXXXXXX
                  | :   :                                                :
           g121   AELTRIFTVGDFRSRDLAAGGQGAPLVPAFHEALFRDDRETRVVLNIGGIANISVLPPGA
                  130        140        150        160        170        180

190        200        210        220        230        240
       m121.pep   XXXXXXXXXXXXXXXXXXXXXQLPYDKNGAKSAQGNILPQLLDRLLAHPYFAQRHPKST
                   :         : |||||||||:||||||||||| ||||||||:|  ||||||
           g121   PAFGFDTGPGNMLMDAWTQAHWLPYDKNGAKAAQGNILPQLLGRLLAHPYFSQPHPKST
                  190        200        210        220        230        240

250        260        270        280        290        300
       m121.pep   GRELFAINWLETYLDGGENRYDVLRTLSRFTAQTVCDAVSHAAADARQMYICDGGIRNPV
                  ||||||:|||||||||||||||||||||||||||| ||||||||||||||||| |||||
           g121   GRELFALNWLETYLDGGENRYDVLRTLSRFTAQTVWDAVSHAAADARQMYICGGGIRNPV
                  250        260        270        280        290        300

310        320        330        340        350        360
       m121.pep   LMADLAECFGTRVSLHSTADLNLDPQWVEAAXFAWLAACWINRIPGSPHKATGASKPCIL
                  ||||||||||||||||||:|||||||||||||  ||||||||||||||||||||||||||
           g121   LMADLAECFGTRVSLHSTAELNLDPQWVEAAAFAWLAACWINRIPGSPHKATGASKPCIL
                  310        320        330        340        350        360 m121.pep   XAGYYYX
                   ||||||
           g121   GAGYYYX
```

The following partial DNA sequence was identified in *N. meningitidis* <SEQ ID 3079>:

```
a121.seq
    1   ATGGAAACAC AGCTTTACAT CGGCATCATG TCGGGAACCA GCATGGACGG

51   GGCGGATGCC GTACTGATAC GGATGGACGG CGGCAAATGG CTGGGCGCGG

101   AAGGGCACGC CTTTACCCCC TACCCCGGCA GGTTACGCCG CAAATTGCTG

151   GATTTGCAGG ACACAGGCGC GGACGAACTG CACCGCAGCA GGATGTTGTC

201   GCAAGAACTC AGCCGCCTGT ACGCGCAAAC CGCCGCCGAA CTGCTGTGCA

251   GTCAAAACCT CGCGCCGTCC GACATTACCG CCCTCGGCTG CCACGGGCAA

301   ACCGTCAGAC ACGCGCCGGA ACACAGTTAC AGCGTACAGC TTGCCGATTT

351   GCCGCTGCTG GCGGAACGGA CTCAGATTTT TACCGTCGGC GACTTCCGCA
```

```
 401  GCCGCGACCT TGCGGCCGGC GGACAAGGCG CGCCGCTCGT CCCCGCCTTT
 451  CACGAAGCCC TGTTCCGCGA CGACAGGGAA ACACGCGCGG TACTGAACAT
 501  CGGCGGGATT GCCAACATCA GCGTACTCCC CCCCGACGCA CCCGCCTTCG
 551  GCTTCGACAC AGGACCGGGC AATATGCTGA TGGACGCGTG GATGCAGGCA
 601  CACTGGCAGC TTCCTTACGA CAAAAACGGT GCAAAGGCGG CACAAGGCAA
 651  CATATTGCCG CAACTGCTCG ACAGGCTGCT CGCCCACCCG TATTTCGCAC
 701  AACCCCACCC TAAAAGCACG GGGCGCGAAC TGTTTGCCCT AAATTGGCTC
 751  GAAACCTACC TTGACGGCGG CGAAAACCGA TACGACGTAT TGCGGACGCT
 801  TTCCCGATTC ACCGCGCAAA CCGTTTTCGA CGCCGTCTCA CACGCAGCGG
 851  CAGATGCCCG TCAAATGTAC ATTTGCGGCG GCGGCATCCG CAATCCTGTT
 901  TTAATGGCGG ATTTGGCAGA ATGTTTCGGC ACACGCGTTT CCCTGCACAG
 951  CACCGCCGAA CTGAACCTCG ATCCGCAATG GGTAGAAGCC GCCGCGTTCG
1001  CATGGATGGC GGCGTGTTGG GTCAACCGCA TTCCCGGTAG TCCGCACAAA
1051  GCAACCGGCG CATCCAAACC GTGTATTCTG GGCGCGGGAT ATTATTATTG
1101  A
```

This corresponds to the amino acid sequence <SEQ ID 3080; ORF 121.a>:

```
a121.pep
    1  METQLYIGIM SGTSMDGADA VLIRMDGGKW LGAEGHAFTP YPGRLRRKLL
   51  DLQDTGADEL HRSRMLSQEL SRLYAQTAAE LLCSQNLAPS DITALGCHGQ
  101  TVRHAPEHSY SVQLADLPLL AERTQIFTVG DFRSRDLAAG GQGAPLVPAF
  151  HEALFRDDRE TRAVLNIGGI ANISVLPPDA PAFGFDTGPG NMLMDAWMQA
  201  HWQLPYDKNG AKAAQGNILP QLLDRLLAHP YFAQPHPKST GRELFALNWL
  251  ETYLDGGENR YDVLRTLSRF TAQTVFDAVS HAAADARQMY ICGGGIRNPV
  301  LMADLAECFG TRVSLHSTAE LNLDPQWVEA AAFAWMAACW VNRIPGSPHK
  351  ATGASKPCIL GAGYYY*
``` m121/a121 74.0% identity in 366 aa overlap

```
                 10         20         30         40         50         60
   m121.pep  METQLYIGIMSGTSMDGADAVLIRMDGGKWLGAEGHAFTPYPGRLRRQLLDLQDTGADEL
              ||||||||||||||||||||||||||||||||||||||||||||||||:|||||||||||
   a121      METQLYIGIMSGTSMDGADAVLIRMDGGKWLGAEGHAFTPYPGRLRRKLLDLQDTGADEL
                 10         20         30         40         50         60

70         80         90        100        110        120
   m121.pep  HRSRILSQELSRLYAQTAAELLCSQNLAPSDITALGCHGQTVRHAPEHGYSIQLADLPLL
              ||||:|||||||||||||||||||||||||||||||||||||||||||||::||||||||
   a121      HRSRMLSQELSRLYAQTAAELLCSQNLAPSDITALGCHGQTVRHAPEHSYSVQLADLPLL
                 70         80         90        100        110        120

130        140        150        160        170        180
   m121.pep  AXXXXXXXXXXXXXXXXXXXXXXXXXXXXXXXXXXXXXXXXXXXXXXXXXXXXXXXXXXX
              |  :       :                                   :
   a121      AERTQIFTVGDFRSRDLAAGGQGAPLVPAFHEALFRDDRETRAVLNIGGIANISVLPPDA
                130        140        150        160        170        180

190        200        210        220        230        240
   m121.pep  XXXXXXXXXXXXXXXXXXXXXXXXXQLPYDKNGAKSAQGNILPQLLDRLLAHPYFAQRHPKST
                :           ||||||||||:||||||||||||||||||||||||||||| ||||
   a121      PAFGFDTGPGNMLMDAWMQAHWQLPYDKNGAKAAQGNILPQLLDRLLAHPYFAQPHPKST
                190        200        210        220        230        240
```

```
              250        260        270        280        290        300
m121.pep   GRELFAINWLETYLDGGENRYDVLRTLSRFTAQTVCDAVSHAAADARQMYICDGGIRNPV
           ||||||:|||||||||||||||||||||||||||| ||||||||||||||||| |||||||
a121       GRELFALNWLETYLDGGENRYDVLRTLSRFTAQTVFDAVSHAAADARQMYICGGGIRNPV
              250        260        270        280        290        300

310        320        330        340        350        360
m121.pep   LMADLAECFGTRVSLHSTADLNLDPQWVEAAXFAWLAACWINRIPGSPHKATGASKPCIL
           |||||||||||||||||||:||||||||||| |||:||||:|||||||||||||||||||
a121       LMADLAECFGTRVSLHSTAELNLDPQWVEAAAFAWMAACWVNRIPGSPHKATGASKPCIL
              310        320        330        340        350        360 m121.pep   XAGYYYX
           ||||||
a121       GAGYYYX
```

The following partial DNA sequence was identified in *N. meningitidis* <SEQ ID 3081>:

```
m121-1.seq
     1     ATGGAAACAC AGCTTTACAT CGGCATCATG TCGGGAACCA GCATGGACGG
    51     GGCGGATGCC GTACTGATAC GGATGGACGG CGGCAAATGG CTGGGCGCGG
   101     AAGGGCACGC CTTTACCCCC TACCCCGGCA GGTTACGCCG CCAATTGCTG
   151     GATTTGCAGG ACACAGGCGC AGACGAACTG CACCGCAGCA GGATTTTGTC
   201     GCAAGAACTC AGCCGCCTAT ATGCGCAAAC CGCCGCCGAA CTGCTGTGCA
   251     GTCAAAACCT CGCACCGTCC GACATTACCG CCCTCGGCTG CCACGGGCAA
   301     ACCGTCCGAC ACGCGCGGA ACACGGTTAC AGCATACAGC TTGCCGATTT
   351     GCCGCTGCTG GCGGAACGGA CGCGGATTTT TACCGTCGGC GACTTCCGCA
   401     GCCGCGACCT TGCGGCCGGC GGACAAGGCG CGCCACTCGT CCCCGCCTTT
   451     CACGAAGCCC TGTTCCGCGA CAACAGGGAA ACACGCGCGG TACTGAACAT
   501     CGGCGGGATT GCCAACATCA GCGTACTCCC CCCCGACGCA CCCGCCTTCG
   551     GCTTCGACAC AGGGCCGGGC AATATGCTGA TGGACGCGTG GACGCAGGCA
   601     CACTGGCAGC TTCCTTACGA CAAAAACGGT GCAAAGGCGG CACAAGGCAA
   651     CATATTGCCG CAACTGCTCG ACAGGCTGCT CGCCCACCCG TATTTCGCAC
   701     AACCCCACCC TAAAAGCACG GGGCGCGAAC TGTTTGCCCT AAATTGGCTC
   751     GAAACCTACC TTGACGGCGG CGAAAACCGA TACGACGTAT TGCGGACGCT
   801     TTCCCGTTTT ACCGCGCAAA CCGTTTGCGA CGCCGTCTCA CACGCAGCGG
   851     CAGATGCCCG TCAAATGTAC ATTTGCGGCG GCGGCATCCG CAATCCTGTT
   901     TTAATGGCGG ATTTGGCAGA ATGTTTCGGC ACACGCGTTT CCCTGCACAG
   951     CACCGCCGAC CTGAACCTCG ATCCGCAATG GGTGGAAGCC GCCGNATTTG
  1001     CGTGGTTGGC GGCGTGTTGG ATTAATCGCA TTCCCGGTAG TCCGCACAAA
  1051     GCAACCGGCG CATCCAAACC GTGTATTCTG ANCGCGGGAT ATTATTATTG
  1101     A
```

This corresponds to the amino acid sequence <SEQ ID 3082; ORF 121-1>:

```
m121-1.pep
     1     METQLYIGIM SGTSMDGADA VLIRMDGGKW LGAEGHAFTP YPGRLRRQLL
    51     DLQDTGADEL HRSRILSQEL SRLYAQTAAE LLCSQNLAPS DITALGCHGQ
   101     TVRHAPEHGY SIQLADLPLL AERTRIFTVG DFRSRDLAAG GQGAPLVPAF
   151     HEALFRDNRE TRAVLNIGGI ANISVLPPDA PAFGFDTGPG NMLMDAWTQA
```

-continued

```
201     HWQLPYDKNG AKAAQGNILP QLLDRLLAHP YFAQPHPKST GRELFALNWL

251     ETYLDGGENR YDVLRTLSRF TAQTVCDAVS HAAADARQMY ICGGGIRNPV

301     LMADLAECFG TRVSLHSTAD LNLDPQWVEA AXFAWLAACW INRIPGSPHK

351     ATGASKPCIL XAGYYY*
``` m121-1/g121 95.6% identity in 366 aa overlap

```
                      10        20        30        40        50        60
m121-1.pep    METQLYIGIMSGTSMDGADAVLIRMDGGKWLGAEGHAFTPYPGRLRRQLLDLQDTGADEL
              |||||||||||||||||||||:|||||||||||||||||| ||||:||||||||||:|||
g121          METQLYIGIMSGTSMDGADAVLVRMDGGKWLGAEGHAFTPYPDRLRRKLLDLQDTGTDEL
                      10        20        30        40        50        60

70        80        90       100       110       120
m121-1.pep    HRSRILSQELSRLYAQTAAELLCSQNLAPSDITALGCHGQTVRHAPEHGYSIQLADLPLL
              ||||:|||||||||||||||||||||||| ||||||||||||||||||||||||||||||
g121          HRSRMLSQELSRLYAQTAAELLCSQNLAPCDITALGCHGQTVRHAPEHGYSIQLADLPLL
                      70        80        90       100       110       120

130       140       150       160       170       180
m121-1.pep    AERTRIFTVGDFRSRDLAAGGQGAPLVPAFHEALFRDNRETRAVLNIGGIANISVLPPDA
              || ||||||||||||||||||||||||||||||||||:||||:||||||||||||||| |
g121          AELTRIFTVGDFRSRDLAAGGQGAPLVPAFHEALFRDDRETRVVLNIGGIANISVLPPGA
                     130       140       150       160       170       180

190       200       210       220       230       240
m121-1.pep    PAFGFDTGPGNMLMDAWTQAHWQLPYDKNGAKAAQGNILPQLLDRLLAHPYFAQPHPKST
              ||||||||||||||||||||||||||||||||||||||||||| ||||||||:|||||||
g121          PAFGFDTGPGNMLMDAWTQAHWQLPYDKNGAKAAQGNILPQLLGRLLAHPYFSQPHPKST
                     190       200       210       220       230       240

250       260       270       280       290       300
m121-1.pep    GRELFALNWLETYLDGGENRYDVLRTLSRFTAQTVCDAVSHAAADARQMYICGGGIRNPV
              ||||||||||||||||||||||||||||||||||| ||||||||||||||||||||||||
g121          GRELFALNWLETYLDGGENRYDVLRTLSRFTAQTVWDAVSHAAADARQMYICGGGIRNPV
                     250       260       270       280       290       300

310       320       330       340       350       360
m121-1.pep    LMADLAECFGTRVSLHGTADLNLDPQWVEAAXFAWLAACWINRIPGSPHKATGAGKPCIL
              |||||||||||||||||||:||||||||||| ||||||||||||||||||||||||||||
g121          LMADLAECFGTRVSLHGTAELNLDPQWVEAAAFAWLAACWINRIPGSPHKATGAGKPCIL
                     310       320       330       340       350       360 m121-1.pep    XAGYYYX
               ||||||
g121          GAGYYYX
```

The following partial DNA sequence was identified in *N. meningitidis* <SEQ ID 3083>:

```
a121-1.seq
      1     ATGGAAACAC AGCTTTACAT CGGCATCATG TCGGGAACCA GCATGGACGG

51     GGCGGATGCC GTACTGATAC GGATGGACGG CGGCAAATGG CTGGGCGCGG

101     AAGGGCACGC CTTTACCCCC TACCCCGGCA GGTTACGCCG CAAATTGCTG

151     GATTTGCAGG ACACAGGCGC GGACGAACTG CACCGCAGCA GGATGTTGTC

201     GCAAGAACTC AGCCGCCTGT ACGCGCAAAC CGCCGCCGAA CTGCTGTGCA

251     GTCAAAACCT CGCGCCGTCC GACATTACCG CCCTCGGCTG CCACGGGCAA

301     ACCGTCAGAC ACGCGCCGGA ACACAGTTAC AGCGTACAGC TTGCCGATTT

351     GCCGCTGCTG GCGGAACGGA CTCAGATTTT TACCGTCGGC GACTTCCGCA

401     GCCGCGACCT TGCGGCCGGC GGACAAGGCG CGCCGCTCGT CCCCGCCTTT

451     CACGAAGCCC TGTTCCGCGA CGACAGGGAA ACACGCGCGG TACTGAACAT

501     CGGCGGGATT GCCAACATCA GCGTACTCCC CCCCGACGCA CCCGCCTTCG

551     GCTTCGACAC AGGACCGGGC AATATGCTGA TGGACGCGTG GATGCAGGCA

601     CACTGGCAGC TTCCTTACGA CAAAAACGGT GCAAAGGCGG CACAAGGCAA
```

```
-continued
 651   CATATTGCCG CAACTGCTCG ACAGGCTGCT CGCCCACCCG TATTTCGCAC

701   AACCCCACCC TAAAAGCACG GGGCGCGAAC TGTTTGCCCT AAATTGGCTC

751   GAAACCTACC TTGACGGCGG CGAAAACCGA TACGACGTAT TGCGGACGCT

801   TTCCCGATTC ACCGCGCAAA CCGTTTTCGA CGCCGTCTCA CACGCAGCGG

851   CAGATGCCCG TCAAATGTAC ATTTGCGGCG GCGGCATCCG CAATCCTGTT

901   TTAATGGCGG ATTTGGCAGA ATGTTTCGGC ACACGCGTTT CCCTGCACAG

951   CACCGCCGAA CTGAACCTCG ATCCGCAATG GGTAGAAGCC GCCGCGTTCG

1001   CATGGATGGC GGCGTGTTGG GTCAACCGCA TTCCCGGTAG TCCGCACAAA

1051   GCAACCGGCG CATCCAAACC GTGTATTCTG GGCGCGGGAT ATTATTATTG

1101   A
```

This corresponds to the amino acid sequence <SEQ ID 3084; ORF 121-1.a>:

```
a121-1.pep
    1   METQLYIGIM SGTSMDGADA VLIRMDGGKW LGAEGHAFTP YPGRLRRKLL

51   DLQDTGADEL HRSRMLSQEL SRLYAQTAAE LLCSQNLAPS DITALGCHGQ

101   TVRHAPEHSY SVQLADLPLL AERTQIFTVG DFRSRDLAAG GQGAPLVPAF

151   HEALFRDDRE TRAVLNIGGI ANISVLPPDA PAFGFDTGPG NMLMDAWMQA

201   HWQLPYDKNG AKAAQGNILP QLLDRLLAHP YFAQPHPKST GRELFALNWL

251   ETYLDGGENR YDVLRTLSRF TAQTVFDAVS HAAADARQMY ICGGGIRNPV

301   LMADLAECFG TRVSLHSTAE LNLDPQWVEA AAFAWMAACW VNRIPGSPHK

351   ATGASKPCIL GAGYYY*
``` m121-1/a121-1 96.4% identity in 366 aa overlap

```
                  10         20         30         40         50         60
m121-1.pep  METQLYIGIMSGTSMDGADAVLIRMDGGKWLGAEGHAFTPYPGRLRRQLLDLQDTGADEL
            ||||||||||||||||||||||||||||||||||||||||||||||| :||||||||||
a121-1      METQLYIGIMSGTSMDGADAVLIRMDGGKWLGAEGHAFTPYPGRLRRKLLDLQDTGADEL
                  10         20         30         40         50         60

70         80         90        100        110        120
m121-1.pep  HRSRILSQELSRLYAQTAAELLCSQNLAPSDITALGCHGQTVRHAPEHGYSIQLADLPLL
            |||| :||||||||||||||||||||||||||||||||||||||||||: :||||||||
a121-1      HRSRMLSQELSRLYAQTAAELLCSQNLAPSDITALGCHGQTVRHAPEHSYSVQLADLPLL
                  70         80         90        100        110        120

130        140        150        160        170        180
m121-1.pep  AERTRIFTVGDFRSRDLAAGGQGAPLVPAFHEALFRDNRETRAVLNIGGIANISVLPPDA
            ||||:|||||||||||||||||||||||||||||||: ||||||||||||||||||||||
a121-1      AERTQIFTVGDFRSRDLAAGGQGAPLVPAFHEALFRDDRETRAVLNIGGIANISVLPPDA
                 130        140        150        160        170        180

190        200        210        220        230        240
m121-1.pep  PAFGFDTGPGNMLMDAWTQAHWQLPYDKNGAKAAQGNILPQLLDRLLAHPYFAQPHPKST
            |||||||||||||||||| ||||||||||||||||||||||||||||||||||||||||
a121-1      PAFGFDTGPGNMLMDAWMQAHWQLPYDKNGAKAAQGNILPQLLDRLLAHPYFAQPHPKST
                 190        200        210        220        230        240

250        260        270        280        290        300
m121-1.pep  GRELFALNWLETYLDGGENRYDVLRTLSRFTAQTVCDAVSHAAADARQMYICGGGIRNPV
            ||||||||||||||||||||||||||||||||||| ||||||||||||||||||||||
a121-1      GRELFALNWLETYLDGGENRYDVLRTLSRFTAQTVFDAVSHAAADARQMYICGGGIRNPV
                 250        260        270        280        290        300

310        320        330        340        350        360
m121-1.pep  LMADLAECFGTRVSLHSTADLNLDPQWVEAAXFAWLAACWINRIPGSPHKATGASKPCIL
            ||||||||||||||||||||:|||||||||||   |||:|||:||||||||||||||||
a121        LMADLAECFGTRVSLHSTAELNLDPQWVEAAAFAWMAACWVNRIPGSPHKATGASKPCIL
                 310        320        330        340        350        360
```

```
m121-1.pep  XAGYYYX
            ||||||
a121        GAGYYYX
```

128 and 128-1
The following partial DNA sequence was identified in *N. meningitidis* <SEQ ID 3085>:

```
m128.seq (partial)
    1  ATGACTGACA ACGCACTGCT CCATTTGGGC GAAGAACCCC GTTTTGATCA

51  AATCAAAACC GAAGACATCA AACCCGCCCT GCAAACCGCC ATCGCCGAAG

101  CGCGCGAACA AATCGCCGCC ATCAAAGCCC AAACGCACAC CGGCTGGGCA

151  AACACTGTCG AACCCCTGAC CGGCATCACC GAACGCGTCG GCAGGATTTG

201  GGGCGTGGTG TCGCACCTCA ACTGCGTCGC CGACACGCCC GAACTGCGCG

251  CCGTCTATAA CGAACTGATG CCCGAAATCA CCGTCTTCTT CACCGAAATC

301  GGACAAGACA TCGAGCTGTA CAACCGCTTC AAAACCATCA AAAATTCCCC

351  CGAATTCGAC ACCCTCTCCC CCGCACAAAA AACCAAACTC AACCAC

1  TACGCCAGCG AAAAACTGCG CGAAGCCAAA TACGCGTTCA GCGAAACCGA 51  wGTCAAAAAA TAyTTCCCyG TCGGCAAwGT ATTAAACGGA CTGTTCGCCC

101  AAmTCAAAAA ACTmTACGGC ATCGGATTTA CCGAAAAAAC yGTCCCCGTC

151  TGGCACAAAG ACGTGCGCTA TTkTGAATTG CAACAAAACG GCGAAmCCAT

201  AGGCGGCGTT TATATGGATT TGTACGCACG CGAAGGCAAA CGCGGCGGCG

251  CGTGGATGAA CGACTACAAA GGCCGCCGCC GTTTTTCAGA CGGCACGCTG

301  CAAyTGCCCA CCGCCTACCT CGTCTGCAAC TTCGCCCCAC CCGTCGGCGG

351  CAGGGAAGCC CGCyTGAGCC ACGACGAAAT CCTCATCCTC TTCCACGAAA

401  CCGGACACGG GCTGCACCAC CTGCTTACCC AAGTGGACGA ACTGGGCGTA

451  TCCGGCATCA ACGGCGTAkA ATGGGACGCG GTCGAACTGC CCAGCCAGTT

501  TATGGAAAAT TTCGTTTGGG AATACAATGT CTTGGCACAA mTGTCAGCCC

551  ACGAAGAAAC CGGcgTTCCC yTGCCGAAAG AACTCTTsGA CAAAwTGCTC

601  GCCGCCAAAA ACTTCCAAsG CGGCATGTTC yTsGTCCGGC AAwTGGAGTT

651  CGCCCTCTTT GATATGATGA TTTACAGCGA AGACGACGAA GGCCGTCTGA

701  AAAACTGGCA ACAGGTTTTA GACAGCGTGC GCAAAAAAGT CGCCGTCATC

751  CAGCCGCCCG AATACAACCG CTTCGCCTTG AGCTTCGGCC ACATCTTCGC

801  AGGCGGCTAT TCCGCAGCTn ATTACAGCTA CGCGTGGGCG GAAGTATTGA

851  GCGCGGACGC ATACGCCGCC TTTGAAGAAA GCGACGATGT CGCCGCCACA

901  GGCAAACGCT TTTGGCAGGA AATCCTCGCC GTCGGGGnAT CGCGCAGCGG 951  nGCAGAATCC TTCAAAGCCT TCCGCGGCCG CGAACCGAGC ATAGACGCAC

1001  TCTTGCGCCA CAGCGGTTTC GACAACGCGG TCTGA
```

This corresponds to the amino acid sequence <SEQ ID 3086; ORF 128>:

```
m128.pep (partial)
    1  MTDNALLHLG EEPRFDQIKT EDIKPALQTA IAEAREQIAA IKAQTHTGWA

51  NTVEPLTGIT ERVGRIWGVV SHLNCVADTP ELRAVYNELM PEITVFFTEI
```

```
101   GQDIELYNRF KTIKNSPEFD TLSPAQKTKL NH

//
  1   YASEKLREAK YAFSETXVKK YFPVGXVLNG LFAQXKKLYG IGFTEKTVPV

51   WHKDVRYXEL QQNGEXIGGV YMDLYAREGK RGGAWMNDYK GRRRFSDGTL

101   QLPTAYLVCN FAPPVGGREA RLSHDEILIL FHETGHGLHH LLTQVDELGV

151   SGINGVXWDA VELPSQFMEN FVWEYNVLAQ XSAHEETGVP LPKELXDKXL

201   AAKNFQXGMF XVRQXEFALF DMMIYSEDDE GRLKNWQQVL DSVRKKVAVI

251   QPPEYNRFAL SFGHIFAGGY SAAXYSYAWA EVLSADAYAA FEESDDVAAT

301   GKRFWQEILA VGXSRSGAES FKAFRGREPS IDALLRHSGF DNAV*
                                                        15
```

The following partial DNA sequence was identified in *N. gonorrhoeae* <SEQ ID 3087>:

```
g128.seq
    1   atgattgaca acgCActgct ccacttgggc gaagaaccCC GTTTTaatca 51   aatccaaacc gaagACAtca AACCCGCCGT CCAAACCGCC ATCGCCGAAG

101   CGCGCGGACA AATCGCCGCC GTCAAAGCGC AAACGCACAC CGGCTGGGCG

151   AACACCGTCG AGCGTCTGAC CGGCATCACC GAACGCGTCG GCAGGATTTG

201   GGGCGTCGTG TCCCATCTCA ACTCCGTCGT CGACACGCCC GAACTGCGCG

251   CCGTCTATAA CGAACTGATG CCTGAAATCA CCGTCTTCTT CACCGAAATC

301   GGACAAGACA TCGAACTGTA CAACCGCTTC AAAACCATCA AAAATTCCCC

351   CGAATTTGCA CGCTTTCCC CCGCACAAAA AACCAAGCTC GATCACGACC

401   TGCGCGATTT CGTATTGAGC GGCGCGGAAC TGCCGCCCGA ACGGCAGGCA

451   GAACTGGCAA AACTGCAAAC CGAAGGCGCG CAACTTTCCG CCAAATTCTC

501   CCAAAACGTC CTAGACGCGA CCGACGCGTT CGGCATTTAC TTTGACGATG

551   CCGCACCGCT TGCCGGCATT CCCGAAGACG CGCTCGCCAT GTTTGCCGCC

601   GCCGCGCAAA GCGAAGGCAA AACAGGTTAC AAAATCGGCT TGCAGATTCC

651   GCACTACCTT GCCGTTATCC AATACGCCGG CAACCGCGAA CTGCGCGAAC

701   AAATCTACCG CGCCTACGTT ACCCGTGCCA GCGAACTTTC AAACGACGGC

751   AAATTCGACA ACACCGCCAA CATCGACCGC ACGCTCGAAA ACGCATTGAA

801   AACCGccaaa cTGCTCGGCT TTAAAAATTA CGCCGAATTG TCGCTGGCAA

851   CCAAAATGGC GGACACGCCC GAACAGGTTT TAAACTTCCT GCACGACCTC

901   GCCCGCCGCG CCAAACCCTA CGCCGAAAAA GACCTCGCCG AAGTCAAAGC

951   CTTCGCCCGC GAACACCTCG GTCTCGCCGA CCCGCAGCCG TGGGACTTGA

1001   GCTACGCCGG CGAAAAACTG CGCGAAGCCA ATACGCATT CAGCGAAACC

1051   GAAGTCAAAA AATACTTCCC CGTCGGCAAA GTTCTGGCAG CCTGTTCGC

1101   CCAAATCAAA AAACTCTACG GCATCGGATT CGCCGAAAAA ACCGTTCCCG

1151   TCTGGCACAA AGACGTGCGC TATTTTGAAT TGCAACAAAA CGGCAAAACC

1201   ATCGGCGGCG TTTATATGGA TTTGTACGCA CGCGAAGGCA AACGCGGCGG

1251   CGCGTGGATG AACGACtaca AAGGCCGCCG CCGCTTTGCC GACGgcacGC

1301   TGCAACTGCC CACCGCCTAC CTCGTCTGCA ACTTCGCCCC GCCCGTCGGC

1351   GGCAAAGAAG CGCGTTTAAG CCACGACGAA ATCCTCACCC TCTTCCACGA

1401   AacCGGCCAC GGACTGCACC ACCTGCTTAC CCAAGTGGAC GAACTGGGCG
```

-continued

```
1451  TGTCCGGCAT CAAcggcgtA GAATGGGACG CGGTCGAACT GCCCAGCCAG

1501  TTTATGGAAA ACTTCGTTTG GGAATACAAT GTATTGGCAC AAATGTCCGC

1551  CCACGAAGAA AccgGCGAGC CCCTGCCGAA AGAACTCTTC GACAAAATGC

1601  TcgcCGCCAA AAACTTCCAG CGCGGTATGT TCCTCGTCCG GCAAATGGAG

1651  TTCGCCCTCT TCGATATGAT GATTTACAGT GAAAGCGACG AATGCCGTCT

1701  GAAAAACTGG CAGCAGGTTT TAGACAGCGT GCGCAAAGAA GTcGCCGTCA

1751  TCCAACCGCC CGAATACAAC CGCTTCGCCA ACAGCTTCGG CCacatctTC

1801  GCcggcGGCT ATTCCGCAGG CTATTACAGC TACGCATGGG CCGAAGTCCt 1851  cAGCACCGAT GCCTACGCCG CCTTTGAAGA AAGcGACGac gtcGCCGCCA 1901  CAGGCAAACG CTTCTGGCAA GAAAtccttg ccgtcggcgg ctCCCGCAGC 1951  gcgGCGGAAT CCTTCAAAGC CTTCCGCGGA CGCGAACCGA GCATAGACGC 2001  ACTGCTGCGC CAaagcggtT TCGACAACGC gGCttgA
```

This corresponds to the amino acid sequence <SEQ ID 3088; ORF 128.ng>:

```
g128.pep
    1  MIDNALLHLG EEPRFNQIQT EDIKPAVQTA IAEARGQIAA VKAQTHTGWA

51  NTVERLTGIT ERVGRIWGVV SHLNSVVDTP ELRAVYNELM PEITVFFTEI

101  GQDIELYNRF KTIKNSPEFA TLSPAQKTKL DHDLRDFVLS GAELPPERQA

151  ELAKLQTEGA QLSAKFSQNV LDATDAFGIY FDDAAPLAGI PEDALAMFAA

201  AAQSEGKTGY KIGLQIPHYL AVIQYAGNRE LREQIYRAYV TRASELSNDG

251  KFDNTANIDR TLENALKTAK LLGFKNYAEL SLATKMADTP EQVLNFLHDL

301  ARRAKPYAEK DLAEVKAFAR EHLGLADPQP WDLSYAGEKL REAKYAFSET

351  EVKKYFPVGK VLAGLFAQIK KLYGIGFAEK TVPVWHKDVR YFELQQNGKT

401  IGGVYMDLYA REGKRGGAWM NDYKGRRRFA DGTLQLPTAY LVCNFAPPVG

451  GKEARLSHDE ILTLFHETGH GLHHLLTQVD ELGVSGINGV EWDAVELPSQ

501  FMENFVWEYN VLAQMSAHEE TGEPLPKELF DKMLAAKNFQ RGMFLVRQME

551  FALFDMMIYS ESDECRLKNW QQVLDSVRKE VAVIQPPEYN RFANSFGHIF

601  AGGYSAGYYS YAWAEVLSTD AYAAFEESDD VAATGKRFWQ EILAVGGSRS

651  AAESFKAFRG REPSIDALLR QSGFDNAA*
```

ORF 128 shows 91.7% identity over a 475 aa overlap with a predicted ORF (ORF 128.ng) from *N. gonorrhoeae*:

```
m128/g128
                 10         20         30         40         50         60
g128.pep  MIDNALLHLGEEPRFNQIQTEDIKPAVQTAIAEARGQIAAVKAQTHTGWANTVERLTGIT
          ||||||||||||||||:||:|||||||:||||||||||:|||||||||||||||  |||||
m128      MTDNALLHLGEEPRFDQIKTEDIKPALQTAIAEAREQIAAIKAQTHTGWANTVEPLTGIT
                 10         20         30         40         50         60

70         80         90        100        110        120
g128.pep  ERVGRIWGVVSHLNSVVDTPELRAVYNELMPEITVFFTEIGQDIELYNRFKTIKNSPEFA
          ||||||||||||||:|||||||||||||||||||||||||||||||||||||||||||||
m128      ERVGRIWGVVSHLNCVADTPELRAVYNELMPEITVFFTEIGQDIELYNRFKTIKNSPEFD
                 70         80         90        100        110        120
```

-continued

```
                 130         140         150         160         170         180
g128.pep    TLSPAQKTKLDHDLRDFVLSGAELPPERQAELAKLQTEGAQLSAKFSQNVLDATDAFGIY
            ||||||||||:|
m128        TLSPAQKTKLNH
                 130
              //
                                                 340         350         360
g128.pep                                   YAGEKLREAKYAFSETEVKKYFPVGKVLAG
                                           ||:||||||||||||| |||||||| || |
m128                                       YASEKLREAKYAFSETXVKKYFPVGXVLNG
                                                   10          20          30

370         380         390         400         410         420
g128.pep    LFAQIKKLYGIGFAEKTVPVWHKDVRYFELQQNGKTIGGVYMDLYAREGKRGGAWMNDYK
            |||| ||||||||:||||||||||||| ||||||::||||||||||||||||||||||||
m128        LFAQXKKLYGIGFTEKTVPVWHKDVRYXELQQNGEXIGGVYMDLYAREGKRGGAWMNDYK
                    40          50          60          70          80          90

430         440         450         460         470         480
g128.pep    GRRRFADGTLQLPTAYLVCNFAPPVGGKEARLSHDEILTLFHETGHGLHHLLTQVDELGV
            |||||:|||||||||||||||||||||:|||||||||| ||||||||||||||||||||
m128        GRRRFSDGTLQLPTAYLVCNFAPPVGGREARLSHDEILILFHETGHGLHHLLTQVDELGV
                   100         110         120         130         140         150

490         500         510         520         530         540
g128.pep    SGINGVEWDAVELPSQFMENFVWEYNVLAQMSAHEETGEPLPKELFDKMLAAKNFQRGMF
            |||||| |||||||||||||||||||||| ||||||| |||||| || ||||||| |||
m128        SGINGVXWDAVELPSQFMENFVWEYNVLAQXSAHEETGVPLPKELXDKXLAAKNFQXGMF
                   160         170         180         190         200         210

550         560         570         580         590         600
g128.pep    LVRQMEFALFDMMIYSESDECRLKNWQQVLDSVRKEVAVIQPPEYNRFANSFGHIFAGGY
             ||| ||||||||||||:|| ||||||||||||||:|||||||||||||| ||||||||||
m128        XVRQXEFALFDMMIYSEDDEGRLKNWQQVLDSVRKKVAVIQPPEYNRFALSFGHIFAGGY
                   220         230         240         250         260         270

610         620         630         640         650         660
g128.pep    SAGYYSYAWAEVLSTDAYAAFEESDDVAATGKRFWQEILAVGGSRSAAESFKAFRGREPS
            ||: |||||||||:|||||||||||||||||||||||||| |||:|||||||||||||
m128        SAAXYSYAWAEVLSADAYAAFEESDDVAATGKRFWQEILAVGXSRSGAESFKAFRGREPS
                   280         290         300         310         320         330

670       679
g128.pep    IDALLRQSGFDNAAX
            ||||||:||||||:
m128        IDALLRHSGFDNAVX
                   340
```

The following partial DNA sequence was identified in *N. meningitidis* <SEQ ID 3089>:

```
a128.seq
     1   ATGACTGACA ACGCACTGCT CCATTTGGGC GAAGAACCCC GTTTTGATCA
    51   AATCAAAACC GAAGACATCA AACCCGCCCT GCAAACCGCC ATTGCCGAAG
   101   CGCGCGAACA AATCGCCGCC ATCAAAGCCC AAACGCACAC CGGCTGGGCA
   151   AACACTGTCG AACCCCTGAC CGGCATCACC GAACGCGTCG GCAGGATTTG
   201   GGGCGTGGTG TCGCACCTCA ACTCCGTCAC CGACACGCCC GAACTGCGCG
   251   CCGCCTACAA TGAATTAATG CCCGAAATTA CCGTCTTCTT CACCGAAATC
   301   GGACAAGACA TCGAGCTGTA CAACCGCTTC AAAACCATCA AAAACTCCCC
   351   CGAGTTCGAC ACCCTCTCCC ACGCGCAAAA AACCAAACTC AACCACGATC
   401   TGCGCGATTT CGTCCTCAGC GGCGCGGAAC TGCCGCCCGA ACAGCAGGCA
   451   GAATTGGCAA AACTGCAAAC CGAAGGCGCG CAACTTTCCG CCAAATTCTC
   501   CCAAAACGTC CTAGACGCGA CCGACGCGTT CGGCATTTAC TTTGACGATG
   551   CCGCACCGCT TGCCGGCATT CCCGAAGACG CGCTCGCCAT GTTTGCCGCT
   601   GCCGCGCAAA GCGAAGGCAA AACAGGCTAC AAAATCGGTT TGCAGATTCC
   651   GCACTACCTC GCCGTCATCC AATACGCCGA CAACCGCAAA CTGCGCGAAC
   701   AAATCTACCG CGCCTACGTT ACCCGCGCCA GCGAGCTTTC AGACGACGGC
   751   AAATTCGACA ACACCGCCAA CATCGACCGC ACGCTCGAAA ACGCCCTGCA
```

-continued

```
 801   AACCGCCAAA CTGCTCGGCT TCAAAAACTA CGCCGAATTG TCGCTGGCAA
 851   CCAAAATGGC GGACACCCCC GAACAAGTTT TAAACTTCCT GCACGACCTC
 901   GCCCGCCGCG CCAAACCCTA CGCCGAAAAA GACCTCGCCG AAGTCAAAGC
 951   CTTCGCCCGC GAAAGCCTCG GCCTCGCCGA TTTGCAACCG TGGGACTTGG
1001   GCTACGCCGG CGAAAAACTG CGCGAAGCCA AATACGCATT CAGCGAAACC
1051   GAAGTCAAAA AATACTTCCC CGTCGGCAAA GTATTAAACG GACTGTTCGC
1101   CCAAATCAAA AAACTCTACG GCATCGGATT TACCGAAAAA ACCGTCCCCG
1151   TCTGGCACAA AGACGTGCGC TATTTTGAAT TGCAACAAAA CGGCGAAACC
1201   ATAGGCGGCG TTTATATGGA TTTGTACGCA CGCGAAGGCA AACGCGGCGG
1251   CGCGTGGATG AACGACTACA AAGGCCGCCG CCGTTTTTCA GACGGCACGC
1301   TGCAACTGCC CACCGCCTAC CTCGTCTGCA ACTTCACCCC GCCCGTCGGC
1351   GGCAAAGAAG CCCGCTTGAG CCATGACGAA ATCCTCACCC TCTTCCACGA
1401   AACCGGACAC GGCCTGCACC ACCTGCTTAC CCAAGTCGAC GAACTGGGCG
1451   TATCCGGCAT CAACGGCGTA GAATGGGACG CAGTCGAACT GCCCAGTCAG
1501   TTTATGGAAA ATTTCGTTTG GGAATACAAT GTCTTGGCGC AAATGTCCGC
1551   CCACGAAGAA ACCGGCGTTC CCCTGCCGAA AGAACTCTTC GACAAAATGC
1601   TCGCCGCCAA AAACTTCCAA CGCGGAATGT TCCTCGTCCG CCAAATGGAG
1651   TTCGCCCTCT TTGATATGAT GATTTACAGC GAAGACGACG AAGGCCGTCT
1701   GAAAAACTGG CAACAGGTTT TAGACAGCGT GCGCAAAGAA GTCGCCGTCG
1751   TCCGACCGCC CGAATACAAC CGCTTCGCCA ACAGCTTCGG CCACATCTTC
1801   GCAGGCGGCT ATTCCGCAGG CTATTACAGC TACGCGTGGG CGGAAGTATT
1851   GAGCGCGGAC GCATACGCCG CCTTTGAAGA AAGCGACGAT GTCGCCGCCA
1901   CAGGCAAACG CTTTTGGCAG GAAATCCTCG CCGTCGGCGG ATCGCGCAGC
1951   GCGGCAGAAT CCTTCAAAGC CTTCCGCGGA CGCGAACCGA GCATAGACGC
2001   ACTCTTGCGC CACAGCGGCT TCGACAACGC GGCTTGA
```

This corresponds to the amino acid sequence <SEQ ID 3090; ORF 128.a>:

```
a128.pep
   1   MTDNALLHLG EEPRFDQIKT EDIKPALQTA IAEAREQIAA IKAQTHTGWA
  51   NTVEPLTGIT ERVGRIWGVV SHLNSVTDTP ELRAAYNELM PEITVFFTEI
 101   GQDIELYNRF KTIKNSPEFD TLSHAQKTKL NHDLRDFVLS GAELPPEQQA
 151   ELAKLQTEGA QLSAKFSQNV LDATDAFGIY FDDAAPLAGI PEDALAMFAA
 201   AAQSEGKTGY KIGLQIPHYL AVIQYADNRK LREQIYRAYV TRASELSDDG
 251   KFDNTANIDR TLENALQTAK LLGFKNYAEL SLATKMADTP EQVLNFLHDL
 301   ARRAKPYAEK DLAEVKAFAR ESLGLADLQP WDLGYAGEKL REAKYAFSET
 351   EVKKYFPVGK VLNGLFAQIK KLYGIGFTEK TVPVWHKDVR YFELQQNGET
 401   IGGVYMDLYA REGKRGGAWM NDYKGRRRFS DGTLQLPTAY LVCNFTPPVG
 451   GKEARLSHDE ILTLFHETGH GLHHLLTQVD ELGVSGINGV EWDAVELPSQ
 501   FMENFVWEYN VLAQMSAHEE TGVPLPKELF DKMLAAKNFQ RGMFLVRQME
 551   FALFDMMIYS EDDEGRLKNW QQVLDSVRKE VAVVRPPEYN RFANSFGHIF
```

```
601  AGGYSAGYYS YAWAEVLSAD AYAAFEESDD VAATGKRFWQ EILAVGGSRS

651  AAESFKAFRG REPSIDALLR HSGFDNAA*
``` m128/a128 66.0% identity in 677 aa overlap

```
                 10         20         30         40         50         60
m128.pep  MTDNALLHLGEEPRFDQIKTEDIKPALQTAIAEAREQIAAIKAQTHTGWANTVEPLTGIT
          ||||||||||||||||||||||||||||||||||||||||||||||||||||||||||||
a128      MTDNALLHLGEEPRFDQIKTEDIKPALQTAIAEAREQIAAIKAQTHTGWANTVEPLTGIT
                 10         20         30         40         50         60

70         80         90        100        110        120
m128.pep  ERVGRIWGVVSHLNCVADTPELRAVYNELMPEITVFFTEIGQDIELYNRFKTIKNSPEFD
          ||||||||||||| |:||||||:|||||||||||||||||||||||||||||||||||||
a128      ERVGRIWGVVSHLNSVTDTPELRAAYNELMPEITVFFTEIGQDIELYNRFKTIKNSPEFD
                 70         80         90        100        110        120

130
m128.pep  TLSPAQKTKLNH------------------------------------------------
          ||| ||||||||
a128      TLSHAQKTKLNHDLRDFVLSGAELPPEQQAELAKLQTEGAQLSAKFSQNVLDATDAFGIY
                130        140        150        160        170        180 m128.pep  ------------------------------------------------------------ a128      FDDAAPLAGIPEDALAMFAAAAQSEGKTGYKIGLQIPHYLAVIQYADNRKLREQIYRAYV
                190        200        210        220        230        240 m128.pep  ------------------------------------------------------------ a128      TRASELSDDGKFDNTANIDRTLENALQTAKLLGFKNYAELSLATKMADTPEQVLNFLHDL
                250        260        270        280        290        300

140        150
m128.pep  -------------------------------YASEKLREAKYAFSETXVKKYFPVGX
                                         ||:|||||||||||| |||||||||
a128      ARRAKPYAEKDLAEVKAFARESLGLADLQPWDLGYAGEKLREAKYAFSETEVKKYFPVGK
                310        320        330        340        350        360

160        170        180        190        200        210
m128.pep  VLNGLFAQXKKLYGIGFTEKTVPVWHKDVRYXELQQNGEXIGGVYMDLYAREGKRGGAWM
          ||||||||  |||||||||||||||||||||| |||||| :|||||||||||||||||||
a128      VLNGLFAQIKKLYGIGFTEKTVPVWHKDVRYFELQQNGETIGGVYMDLYAREGKRGGAWM
                370        380        390        400        410        420

220        230        240        250        260        270
m128.pep  NDYKGRRRFSDGTLQLPTAYLVCNFAPPVGGREARLSHDEILILFHETGHGLHHLLTQVD
          |||||||||||||||||||||||||| :||||| ||||||||||| ||||||||||||||
a128      NDYKGRRRFSDGTLQLPTAYLVCNFTPPVGGKEARLSHDEILTLFHETGHGLHHLLTQVD
                430        440        450        460        470        480

280        290        300        310        320        330
m128.pep  ELGVSGINGVXWDAVELPSQFMENFVWEYNVLAQXSAHEETGVPLPKELXDKXLAAKNFQ
          ||||||||||  ||||||||||||||||||||||  ||||||||||||||   ||||||||
a128      ELGVSGINGVEWDAVELPSQFMENFVWEYNVLAQMSAHEETGVPLPKELFDKMLAAKNFQ
                490        500        510        520        530        540

340        350        360        370        380        390
m128.pep  XGMFXVRQXEFALFDMMIYSEDDEGRLKNWQQVLDSVRKKVAVIQPPEYNRFALSFGHIF
            ||| ||| |||||||||||||||||||||||||||||||:|||:|||||||||| ||||||
a128      RGMFLVRQMEFALFDMMIYSEDDEGRLKNWQQVLDSVRKEVAVVRPPEYNRFANSFGHIF
                550        560        570        580        590        600

400        410        420        430        440        450
m128.pep  AGGYSAAXYSYAWAEVLSADAYAAFEESDDVAATGKRFWQEILAVGXSRSGAESFKAFRG
          ||||||: ||||||||||||||||||||||||||||||||||||||| |||:||||||||
a128      AGGYSAGYYSYAWAEVLSADAYAAFEESDDVAATGKRFWQEILAVGGSRSAAESFKAFRG
                610        620        630        640        650        660

460        470
m128.pep  REPSIDALLRHSGFDNAVX
          ||||||||||||||||||:
a128      REPSIDALLRHSGFDNAAX
                670
```

The following partial DNA sequence was identified in *N. meningitidis* <SEQ ID 3091>:

```
m128-1.seq
    1     ATGACTGACA ACGCACTGCT CCATTTGGGC GAAGAACCCC GTTTTGATCA

51     AATCAAAACC GAAGACATCA AACCCGCCCT GCAAACCGCC ATCGCCGAAG
```

```
 101    CGCGCGAACA AATCGCCGCC ATCAAAGCCC AAACGCACAC CGGCTGGGCA

151    AACACTGTCG AACCCCTGAC CGGCATCACC GAACGCGTCG GCAGGATTTG

201    GGGCGTGGTG TCGCACCTCA ACTCCGTCGC CGACACGCCC GAACTGCGCG

251    CCGTCTATAA CGAACTGATG CCCGAAATCA CCGTCTTCTT CACCGAAATC

301    GGACAAGACA TCGAGCTGTA CAACCGCTTC AAAACCATCA AAAATTCCCC

351    CGAATTCGAC ACCCTCTCCC CCGCACAAAA AACCAAACTC AACCACGATC

401    TGCGCGATTT CGTCCTCAGC GGCGCGGAAC TGCCGCCCGA ACAGCAGGCA

451    GAACTGGCAA ACTGCAAAC CGAAGGCGCG CAACTTTCCG CCAAATTCTC

501    CCAAAACGTC CTAGACGCGA CCGACGCGTT CGGCATTTAC TTTGACGATG

551    CCGCACCGCT TGCCGGCATT CCCGAAGACG CGCTCGCCAT GTTTGCCGCC

601    GCCGCGCAAA GCGAAAGCAA AACAGGCTAC AAAATCGGCT TGCAGATTCC

651    ACACTACCTC GCCGTCATCC AATACGCCGA CAACCGCGAA CTGCGCGAAC

701    AAATCTACCG CGCCTACGTT ACCCGCGCCA GCGAACTTTC AGACGACGGC

751    AAATTCGACA CACCGCCAA CATCGACCGC ACGCTCGCAA ACGCCCTGCA

801    AACCGCCAAA CTGCTCGGCT TCAAAAACTA CGCCGAATTG TCGCTGGCAA

851    CCAAAATGGC GGACACGCCC GAACAAGTTT AAACTTCCT GCACGACCTC

901    GCCCGCCGCG CCAAACCCTA CGCCGAAAAA GACCTCGCCG AAGTCAAAGC

951    CTTCGCCCGC GAAAGCCTGA ACCTCGCCGA TTTGCAACCG TGGGACTTGG

1001    GCTACGCCAG CGAAAAACTG CGCGAAGCCA AATACGCGTT CAGCGAAACC

1051    GAAGTCAAAA AATACTTCCC CGTCGGCAAA GTATTAAACG GACTGTTCGC

1101    CCAAATCAAA AAACTCTACG GCATCGGATT TACCGAAAAA ACCGTCCCCG

1151    TCTGGCACAA AGACGTGCGC TATTTTGAAT TGCAACAAAA CGGCGAAACC

1201    ATAGGCGGCG TTTATATGGA TTTGTACGCA CGCGAAGGCA AACGCGGCGG

1251    CGCGTGGATG AACGACTACA AAGGCCGCCG CCGTTTTTCA GACGGCACGC

1301    TGCAACTGCC CACCGCCTAC CTCGTCTGCA ACTTCGCCCC ACCCGTCGGC

1351    GGCAGGGAAG CCCGCCTGAG CCACGACGAA ATCCTCATCC TCTTCCACGA

1401    AACCGGACAC GGGCTGCACC ACCTGCTTAC CCAAGTGGAC GAACTGGGCG

1451    TATCCGGCAT CAACGGCGTA GAATGGGACG CGGTCGAACT GCCCAGCCAG

1501    TTTATGGAAA ATTTCGTTTG GAATACAAT GTCTTGGCAC AAATGTCAGC

1551    CCACGAAGAA ACCGGCGTTC CCCTGCCGAA AGAACTCTTC GACAAAATGC

1601    TCGCCGCCAA AAACTTCCAA CGCGGCATGT TCCTCGTCCG GCAAATGGAG

1651    TTCGCCCTCT TGATATGAT GATTTACAGC GAAGACGACG AAGGCCGTCT

1701    GAAAAACTGG CAACAGGTTT TAGACAGCGT GCGCAAAAAA GTCGCCGTCA

1751    TCCAGCCGCC CGAATACAAC CGCTTCGCCT TGAGCTTCGG CCACATCTTC

1801    GCAGGCGGCT ATTCCGCAGG CTATTACAGC TACGCGTGGG CGGAAGTATT

1851    GAGCGCGGAC GCATACGCCG CCTTTGAAGA AAGCGACGAT GTCGCCGCCA

1901    CAGGCAAACG CTTTTGGCAG GAAATCCTCG CCGTCGGCGG ATCGCGCAGC

1951    GCGGCAGAAT CCTTCAAAGC CTTCCGCGGC CGCGAACCGA GCATAGACGC

2001    ACTCTTGCGC CACAGCGGTT TCGACAACGC GGTCTGA
```

This corresponds to the amino acid sequence <SEQ ID 3092; ORF 128-1>:

```
m128-1.pep.
     1    MTDNALLHLG EEPRFDQIKT EDIKPALQTA IAEAREQIAA IKAQTHTGWA

51    NTVEPLTGIT ERVGRIWGVV SHLNSVADTP ELRAVYNELM PEITVFFTEI

101    GQDIELYNRF KTIKNSPEFD TLSPAQKTKL NHDLRDFVLS GAELPPEQQA

151    ELAKLQTEGA QLSAKFSQNV LDATDAFGIY FDDAAPLAGI PEDALAMFAA

201    AAQSESKTGY KIGLQIPHYL AVIQYADNRE LREQIYRAYV TRASELSDDG

251    KFDNTANIDR TLANALQTAK LLGFKNYAEL SLATKMADTP EQVLNFLHDL

301    ARRAKPYAEK DLAEVKAFAR ESLNLADLQP WDLGYASEKL REAKYAFSET

351    EVKKYFPVGK VLNGLFAQIK KLYGIGFTEK TVPVWHKDVR YFELQQNGET

401    IGGVYMDLYA REGKRGGAWM NDYKGRRRFS DGTLQLPTAY LVCNFAPPVG

451    GREARLSHDE ILILFHETGH GLHHLLTQVD ELGVSGINGV EWDAVELPSQ

501    FMENFVWEYN VLAQMSAHEE TGVPLPKELF DKMLAAKNFQ RGMFLVRQME

551    FALFDMMIYS EDDEGRLKNW QQVLDSVRKK VAVIQPPEYN RFALSFGHIF

601    AGGYSAGYYS YAWAEVLSAD AYAAFEESDD VAATGKRFWQ EILAVGGSRS

651    AAESFKAFRG REPSIDALLR HSGFDNAV*
```

The following partial DNA sequence was identified in *N. gonorrhoeae* <SEQ ID 3093>:

```
g128-1.seq (partial)
     1    ATGATTGACA ACGCACTGCT CCACTTGGGC GAAGAACCCC GTTTTAATCA

51    AATCAAAACC GAAGACATCA AACCCGCCGT CCAAACCGCC ATCGCCGAAG

101    CGCGCGGACA AATCGCCGCC GTCAAAGCGC AAACGCACAC CGGCTGGGCG

151    AACACCGTCG AGCGTCTGAC CGGCATCACC GAACGCGTCG GCAGGATTTG

201    GGGCGTCGTG TCCCATCTCA ACTCCGTCGT CGACACGCCC GAACTGCGCG

251    CCGTCTATAA CGAACTGATG CCTGAAATCA CCGTCTTCTT CACCGAAATC

301    GGACAAGACA TCGAACTGTA CAACCGCTTC AAAACCATCA AAAATTCCCC

351    CGAATTTGCA ACGCTTTCCC CCGCACAAAA AACCAAGCTC GATCACGACC

401    TGCGCGATTT CGTATTGAGC GGCGCGGAAC TGCCGCCCGA ACGGCAGGCA

451    GAACTGGCAA AACTGCAAAC CGAAGGCGCG CAACTTTCCG CCAAATTCTC

501    CCAAAACGTC CTAGACGCGA CCGACGCGTT CGGCATTTAC TTTGACGATG

551    CCGCACCGCT TGCCGGCATT CCCGAAGACG CGCTCGCCAT GTTTGCCGCC

601    GCCGCGCAAA GCGAAGGCAA ACAGGTTAC AAAATCGGCT TGCAGATTCC

651    GCACTACCTT GCCGTTATCC AATACGCCGG CAACCGCGAA CTGCGCGAAC

701    AAATCTACCG CGCCTACGTT ACCCGTGCCA GCGAACTTTC AAACGACGGC

751    AAATTCGACA ACACCGCCAA CATCGACCGC ACGCTCGAAA ACGCATTGAA

801    AACCGCCAAA CTGCTCGGCT TTAAAAATTA CGCCGAATTG TCGCTGGCAA

851    CCAAAATGGC GGACACGCCC GAACAGGTTT TAAACTTCCT GCACGACCTC

901    GCCCGCCGCG CCAAACCCTA CGCCGAAAAA GACCTCGCCG AAGTCAAAGC

951    CTTCGCCCGC GAACACCTCG GTCTCGCCGA CCCGCAGCCG TGGGACTTGA

1001    GCTACGCCGG CGAAAAACTG CGCGAAGCCA AATACGCATT CAGCGAAACC

1051    GAAGTCAAAA AATACTTCCC CGTCGGCAAA GTTCTGGCAG GCCTGTTCGC
```

-continued

```
1101    CCAAATCAAA AAACTCTACG GCATCGGATT CGCCGAAAAA ACCGTTCCCG

1151    TCTGGCACAA AGACGTGCGC TATTTTGAAT TGCAACAAAA CGGCAAAACC

1201    ATCGGCGGCG TTTATATGGA TTTGTACGCA CGCGAAGGCA AACGCGGCGG

1251    CGCGTGGATG AACGACTACA AAGGCCGCCG CCGCTTTGCC GACGGCACGC

1301    TGCAACTGCC CACCGCCTAC CTCGTCTGCA ACTTCGCCCC GCCCGTCGGC

1351    GGCAAAGAAG CGCGTTTAAG CCACGACGAA ATCCTCACCC TCTTCCACGA

1401    AACCGGCCAC GGACTGCACC ACCTGCTTAC CCAAGTGGAC GAACTGGGCG

1451    TGTCCGGCAT CAACGGCGTA AAA
```

This corresponds to the amino acid sequence <SEQ ID 3094; ORF 128-1.ng>:

```
g128-1.pep (partial)
    1   MIDNALLHLG EEPRFNQIKT EDIKPAVQTA IAEARGQIAA VKAQTHTGWA

51   NTVERLTGIT ERVGRIWGVV SHLNSVVDTP ELRAVYNELM PEITVFFTEI

101   GQDIELYNRF KTIKNSPEFA TLSPAQKTKL DHDLRDFVLS GAELPPERQA

151   ELAKLQTEGA QLSAKFSQNV LDATDAFGIY FDDAAPLAGI PEDALAMFAA

201   AAQSEGKTGY KIGLQIPHYL AVIQYAGNRE LREQIYRAYV TRASELSNDG

251   KFDNTANIDR TLENALKTAK LLGFKNYAEL SLATKMADTP EQVLNFLHDL

301   ARRAKPYAEK DLAEVKAFAR EHLGLADPQP WDLSYAGEKL REAKYAFSET

351   EVKKYFPVGK VLAGLFAQIK KLYGIGFAEK TVPVWHKDVR YFELQQNGKT

401   IGGVYMDLYA REGKRGGAWM NDYKGRRRFA DGTLQLPTAY LVCNFAPPVG

451   GKEARLSHDE ILTLFHETGH GLHHLLTQVD ELGVSGINGV K
``` m128-1/g128-1 94.5% identity in 491 aa overlap

```
                  10         20         30         40         50         60
g128-1.pep  MIDNALLHLGEEPRFNQIKTEDIKPAVQTAIAEARGQIAAVKAQTHTGWANTVERLTGIT
            | ||||||||||||||| ||||||||| ||||||| ||||:|||||||||||| |||||
m128-1      MTDNALLHLGEEPRFDQIKTEDIKPALQTAIAEAREQIAAIKAQTHTGWANTVEPLTGIT
                  10         20         30         40         50         60

70         80         90        100        110        120
g128-1.pep  ERVGRIWGVVSHLNSVVDTPELRAVYNELMPEITVFFTEIGQDIELYNRFKTIKNSPEFA
            ||||||||||||||:|||||||||||||||||||||||||||||||||||||||||||
m128-1      ERVGRIWGVVSHLNSVADTPELRAVYNELMPEITVFFTEIGQDIELYNRFKTIKNSPEFD
                  70         80         90        100        110        120

130        140        150        160        170        180
g128-1.pep  TLSPAQKTKLDHDLRDFVLSGAELPPERQAELAKLQTEGAQLSAKFSQNVLDATDAFGIY
            |||||||||| :|||||||||||||||| |||||||||||||||||||||||| |||||
m128-1      TLSPAQKTKLNHDLRDFVLSGAELPPEQQAELAKLQTEGAQLSAKFSQNVLDATDAFGIY
                 130        140        150        160        170        180

190        200        210        220        230        240
g128-1.pep  FDDAAPLAGIPEDALAMFAAAAQSEGKTGYKIGLQIPHYLAVIQYAGNRELREQIYRAYV
            ||||||||||||||||||||||||:|||||||||||||||||||||:|||||||||||
m128-1      FDDAAPLAGIPEDALAMFAAAAQSESKTGYKIGLQIPHYLAVIQYADNRELREQIYRAYV
                 190        200        210        220        230        240

250        260        270        280        290        300
g128-1.pep  TRASELSNDGKFDNTANIDRTLENALKTAKLLGFKNYAELSLATKMADTPEQVLNFLHDL
            ||||||| |||||||||||| ::|| ||||||||||||||||||||||||||||||||
m128-1      TRASELSDDGKFDNTANIDRTLANALQTAKLLGFKNYAELSLATKMADTPEQVLNFLHDL
                 250        260        270        280        290        300

310        320        330        340        350        360
g128-1.pep  ARRAKPYAEKDLAEVKAFAREHLGLADPQPWDLSYAGEKLREAKYAFSETEVKKYFPVGK
            ||||||||||||||||||||| :||| ||:|:|||||||||||||||||||||||||||
m128-1      ARRAKPYAEKDLAEVKAFARESLNLADLQPWDLGYASEKLREAKYAFSETEVKKYFPVGK
                 310        320        330        340        350        360
```

```
                   370        380        390        400        410        420
g128-1.pep  VLAGLFAQIKKLYGIGFAEKTVPVWHKDVRYFELQQNGKTIGGVYMDLYAREGKRGGAWM
            || ||||||||||||||:||||||||||||||||||||:|||||||||||||||||||||
m128-1      VLNGLFAQIKKLYGIGFTEKTVPVWHKDVRYFELQQNGETIGGVYMDLYAREGKRGGAWM
                   370        380        390        400        410        420

430        440        450        460        470        480
g128-1.pep  NDYKGRRRFADGTLQLPTAYLVCNFAPPVGGKEARLSHDEILTLFHETGHGLHHLLTQVD
            |||||||||:||||||||||||||||||||||:|||||||||| ||||||||||||||||
m128-1      NDYKGRRRFSDGTLQLPTAYLVCNFAPPVGGREARLSHDEILILFHETGHGLHHLLTQVD
                   430        440        450        460        470        480

490
g128-1.pep  ELGVSGINGVK
            ||||||||||:
m128-1      ELGVSGINGVEWDAVELPSQFMENFVWEYNVLAQMSAHEETGVPLPKELFDKMLAAKNFQ
                   490        500        510        520        530        540
```

15

The following partial DNA sequence was identified in *N. meningitidis* <SEQ ID 3095>:

```
a128-1.seq
      1    ATGACTGACA ACGCACTGCT CCATTTGGGC GAAGAACCCC GTTTTGATCA
     51    AATCAAAACC GAAGACATCA AACCCGCCCT GCAAACCGCC ATTGCCGAAG
    101    CGCGCGAACA AATCGCCGCC ATCAAAGCCC AAACGCACAC CGGCTGGGCA
    151    AACACTGTCG AACCCCTGAC CGGCATCACC GAACGCGTCG GCAGGATTTG
    201    GGGCGTGGTG TCGCACCTCA ACTCCGTCAC CGACACGCCC GAACTGCGCG
    251    CCGCCTACAA TGAATTAATG CCCGAAATTA CCGTCTTCTT CACCGAAATC
    301    GGACAAGACA TCGAGCTGTA CAACCGCTTC AAAACCATCA AAAACTCCCC
    351    CGAGTTCGAC ACCCTCTCCC ACGCGCAAAA AACCAAACTC AACCACGATC
    401    TGCGCGATTT CGTCCTCAGC GGCGCGGAAC TGCCGCCCGA ACAGCAGGCA
    451    GAATTGGCAA AACTGCAAAC CGAAGGCGCG CAACTTTCCG CCAAATTCTC
    501    CCAAAACGTC CTAGACGCGA CCGACGCGTT CGGCATTTAC TTTGACGATG
    551    CCGCACCGCT TGCCGGCATT CCCGAAGACG CGCTCGCCAT GTTTGCCGCT
    601    GCCGCGCAAA GCGAAGGCAA ACAGGCTAC AAAATCGGTT TGCAGATTCC
    651    GCACTACCTC GCCGTCATCC AATACGCCGA CAACCGCAAA CTGCGCGAAC
    701    AAATCTACCG CGCCTACGTT ACCCGCGCCA GCGAGCTTTC AGACGACGGC
    751    AAATTCGACA CACCGCCAA CATCGACCGC ACGCTCGAAA ACGCCCTGCA
    801    AACCGCCAAA CTGCTCGGCT TCAAAAACTA CGCCGAATTG TCGCTGGCAA
    851    CCAAAATGGC GGACACCCCC GAACAAGTTT TAAACTTCCT GCACGACCTC
    901    GCCCGCCGCG CCAAACCCTA CGCCGAAAAA GACCTCGCCG AAGTCAAAGC
    951    CTTCGCCCGC GAAAGCCTCG GCCTCGCCGA TTTGCAACCG TGGGACTTGG
   1001    GCTACGCCGG CGAAAAACTG CGCGAAGCCA ATACGCATT CAGCGAAACC
   1051    GAAGTCAAAA ATACTTCCC CGTCGGCAAA GTATTAAACG GACTGTTCGC
   1101    CCAAATCAAA AAACTCTACG GCATCGGATT TACCGAAAAA CCGTCCCCG
   1151    TCTGGCACAA AGACGTGCGC TATTTTGAAT TGCAACAAAA CGGCGAAACC
   1201    ATAGGCGGCG TTTATATGGA TTTGTACGCA CGCGAAGGCA AACGCGGCGG
   1251    CGCGTGGATG AACGACTACA AAGGCCGCCG CCGTTTTTCA GACGGCACGC
   1301    TGCAACTGCC CACCGCCTAC CTCGTCTGCA ACTTCACCCC GCCCGTCGGC
   1351    GGCAAAGAAG CCCGCTTGAG CCATGACGAA ATCCTCACCC TCTTCCACGA
   1401    AACCGGACAC GGCCTGCACC ACCTGCTTAC CCAAGTCGAC GAACTGGGCG
```

```
                                        -continued
1451    TATCCGGCAT CAACGGCGTA GAATGGGACG CAGTCGAACT GCCCAGTCAG

1501    TTTATGGAAA ATTTCGTTTG GGAATACAAT GTCTTGGCGC AAATGTCCGC

1551    CCACGAAGAA ACCGGCGTTC CCCTGCCGAA AGAACTCTTC GACAAAATGC

1601    TCGCCGCCAA AAACTTCCAA CGCGGAATGT TCCTCGTCCG CCAAATGGAG

1651    TTCGCCCTCT TTGATATGAT GATTTACAGC GAAGACGACG AAGGCCGTCT

1701    GAAAAACTGG CAACAGGTTT TAGACAGCGT GCGCAAAGAA GTCGCCGTCG

1751    TCCGACCGCC CGAATACAAC CGCTTCGCCA ACAGCTTCGG CCACATCTTC

1801    GCAGGCGGCT ATTCCGCAGG CTATTACAGC TACGCGTGGG CGGAAGTATT

1851    GAGCGCGGAC GCATACGCCG CCTTTGAAGA AGCGACGAT  GTCGCCGCCA

1901    CAGGCAAACG CTTTTGGCAG GAAATCCTCG CCGTCGGCGG ATCGCGCAGC

1951    GCGGCAGAAT CCTTCAAAGC CTTCCGCGGA CGCGAACCGA GCATAGACGC

2001    ACTCTTGCGC CACAGCGGCT TCGACAACGC GGCTTGA
```

This corresponds to the amino acid sequence <SEQ ID 3096; ORF 128-1.a>:

```
a128-1.pep
    1    MTDNALLHLG EEPRFDQIKT EDIKPALQTA IAEAREQIAA IKAQTHTGWA

51    NTVEPLTGIT ERVGRIWGVV SHLNSVTDTP ELRAAYNELM PEITVFFTEI

101    GQDIELYNRF KTIKNSPEFD TLSHAQKTKL NHDLRDFVLS GAELPPEQQA

151    ELAKLQTEGA QLSAKFSQNV LDATDAFGIY FDDAAPLAGI PEDALAMFAA

201    AAQSEGKTGY KIGLQIPHYL AVIQYADNRK LREQIYRAYV TRASELSDDG

251    KFDNTANIDR TLENALQTAK LLGFKNYAEL SLATKMADTP EQVLNFLHDL

301    ARRAKPYAEK DLAEVKAFAR ESLGLADLQP WDLGYAGEKL REAKYAFSET

351    EVKKYFPVGK VLNGLFAQIK KLYGIGFTEK TVPVWHKDVR YFELQQNGET

401    IGGVYMDLYA REGKRGGAWM NDYKGRRRFS DGTLQLPTAY LVCNFTPPVG

451    GKEARLSHDE ILTLFHETGH GLHHLLTQVD ELGVSGINGV EWDAVELPSQ

501    FMENFVWEYN VLAQMSAHEE TGVPLPKELF DKMLAAKNFQ RGMFLVRQME

551    FALFDMMIYS EDDEGRLKNW QQVLDSVRKE VAVVRPPEYN RFANSFGHIF

601    AGGYSAGYYS YAWAEVLSAD AYAAFEESDD VAATGKRFWQ EILAVGGSRS

651    AAESFKAFRG REPSIDALLR HSGFDNAA*
``` m128-1/a128-1 97.8% identity in 677 aa overlap

```
                   10         20         30         40         50         60
a128-1.pep  MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                   10         20         30         40         50         60

70         80         90        100        110        120
a128-1.pep  ERVGRIWGVVSHLNSVTDTPELRAAYNELMPEITVFFTEIGQDIELYNRFKTIKNSPEFD
            ||||||||||||||||:|||||||:|||||||||||||||||||||||||||||||||||
m128-1      ERVGRIWGVVSHLNSVADTPELRAVYNELMPEITVFFTEIGQDIELYNRFKTIKNSPEFD
                   70         80         90        100        110        120

130        140        150        160        170        180
a128-1.pep  TLSHAQKTKLNHDLRDFVLSGAELPPEQQAELAKLQTEGAQLSAKFSQNVLDATDAFGIY
            |||:||||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
                  130        140        150        160        170        180
```

-continued

```
                       190       200       210       220       230       240
a128-1.pep  FDDAAPLAGIPEDALAMFAAAAQSEGKTGYKIGLQIPHYLAVIQYADNRKLREQIYRAYV
            |||||||||||||||||||||||||:|||||||||||||||||||||||:||||||||||
m128-1      FDDAAPLAGIPEDALAMFAAAAQSESKTGYKIGLQIPHYLAVIQYADNRELREQIYRAYV
                       190       200       210       220       230       240

250       260       270       280       290       300
a128-1.pep  TRASELSDDGKFDNTANIDRTLENALQTAKLLGFKNYAELSLATKMADTPEQVLNFLHDL
            |||||||||||||||||||||| |||||||||||||||||||||||||||||||||||||
m128-1      TRASELSDDGKFDNTANIDRTLANALQTAKLLGFKNYAELSLATKMADTPEQVLNFLHDL
                       250       260       270       280       290       300

310       320       330       340       350       360
a128-1.pep  ARRAKPYAEKDLAEVKAFARESLGLADLQPWDLGYAGEKLREAKYAFSETEVKKYFPVGK
            |||||||||||||||||||||||:||||||||||||:|||||||||||||||||||||||
m128-1      ARRAKPYAEKDLAEVKAFARESLNLADLQPWDLGYASEKLREAKYAFSETEVKKYFPVGK
                       310       320       330       340       350       360

370       380       390       400       410       420
a128-1.pep  VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
                       370       380       390       400       410       420

430       440       450       460       470       480
a128-1.pep  NDYKGRRRFSDGTLQLPTAYLVCNFTPPVGGKEARLSHDEILTLFHETGHGLHHLLTQVD
            |||||||||||||||||||||||||:|||||:|||||||||| |||||||||||||||||
m128-1      NDYKGRRRFSDGTLQLPTAYLVCNFAPPVGGREARLSHDEILILFHETGHGLHHLLTQVD
                       430       440       450       460       470       480

490       500       510       520       530       540
a128-1.pep  ELGVSGINGVEWDAVELPSQFMENFVWEYNVLAQMSAHEETGVPLPKELFDKMLAAKNFQ
            ||||||||||||||||||||||||||||||||||||||||||||||||||||||||||||
m128-1      ELGVSGINGVEWDAVELPSQFMENFVWEYNVLAQMSAHEETGVPLPKELFDKMLAAKNFQ
                       490       500       510       520       530       540

550       560       570       580       590       600
a128-1.pep  RGMFLVRQMEFALFDMMIYSEDDEGRLKNWQQVLDSVRKEVAVVRPPEYNRFANSFGHIF
            ||||||||||||||||||||||||||||||||||||||||:|||::|||||||| |||||
m128-1      RGMFLVRQMEFALFDMMIYSEDDEGRLKNWQQVLDSVRKKVAVIQPPEYNRFALSFGHIF
                       550       560       570       580       590       600

610       620       630       640       650       660
a128-1.pep  AGGYSAGYYSYAWAEVLSADAYAAFEESDDVAATGKRFWQEILAVGGSRSAAESFKAFRG
            ||||||||||||||||||||||||||||||||||||||||||||||||||||||||||||
m128-1      AGGYSAGYYSYAWAEVLSADAYAAFEESDDVAATGKRFWQEILAVGGSRSAAESFKAFRG
                       610       620       630       640       650       660

670      679
a128-1.pep  REPSIDALLRHSGFDNAAX
            |||||||||||||||||:
m128-1      REPSIDALLRHSGFDNAVX
                       670
```

206
The following partial DNA sequence was identified in *N. meningitidis* <SEQ ID 3097>:

```
m206.seq
     1  ATGTTTCCCC CCGACAAAAC CCTTTTCCTC TGTCTCAGCG CACTGCTCCT

51  CGCCTCATGC GGCACGACCT CCGGCAAACA CCGCCAACCG AAACCCAAAC

101  AGACAGTCCG GCAAATCCAA GCCGTCCGCA TCAGCCACAT CGACCGCACA

151  CAAGGCTCGC AGGAACTCAT GCTCCACAGC CTCGGACTCA TCGGCACGCC

201  CTACAAATGG GGCGGCAGCA GCACCGCAAC CGGCTTCGAT TGCAGCGGCA

251  TGATTCAATT CGTTTACAAr AACGCCCTCA ACGTCAAGCT GCCGCGCACC

301  GCCCGCGACA TGGCGGCGGC AAGCCGsAAA ATCCCCGAcA GCCGCyTCAA

351  GGCCGGCGAC CTCGTATTCT TCAACACCGG CGGCGCACAC CGCTACTCAC

401  ACGTCGGACT CTACATCGGC AACGGCGAAT TCATCCATGC CCCCAGCAGC

451  GGCAAAACCA TCAAAACCGA AAAACTCTCC ACACCGTTTT ACGCCAAAAA

501  CTACCTCGGC GCACATACTT TTTTTACAGA ATGA
```

This corresponds to the amino acid sequence <SEQ ID 3098; ORF 206>:

```
m206.pep..
    1    MFPPDKTLFL CLSALLLASC GTTSGKHRQP KPKQTVRQIQ AVRISHIDRT

51    QGSQELMLHS LGLIGTPYKW GGSSTATGFD CSGMIQFVYK NALNVKLPRT

101    ARDMAAASRK IPDSRXKAGD LVFFNTGGAH RYSHVGLYIG NGEFIHAPSS

151    GKTIKTEKLS TPFYAKNYLG AHTFFTE*
```

The following partial DNA sequence was identified in *N. gonorrhoeae* <SEQ ID 3099>:

```
g206.seq
    1    atgttttccc ccgacaaaac ccttttcctc tgtctcggcg cactgctcct 51    cgcctcatgc ggcacgacct ccggcaaaca ccgccaaccg aaacccaaac 101    agacagtccg gcaaatccaa gccgtccgca tcagccacat cggccgcaca 151    caaggctcgc aggaactcat gctccacagc ctcggactca tcggcacgcc 201    ctacaaatgg ggcggcagca gcaccgcaac cggcttcgac tgcagcggca 251    tgattcaatt ggtttacaaa aacgccctca acgtcaagct gccgcgcacc 301    gcccgcgaca tggcggcggc aagccgcaaa atccccgaca gccgcctcaa 351    ggccggcgac atcgtattct tcaacaccgg cggcgcacac cgctactcac 401    acgtcggact ctacatcggc aacggcgaat tcatccatgc ccccggcagc 451    ggcaaaacca tcaaaaccga aaaactctcc acaccgtttt acgccaaaaa 501    ctaccttgga gcgcatacgt tttttacaga atga
```

This corresponds to the amino acid sequence <SEQ ID 3100; ORF 206.ng>:

```
g206.pep
    1    MFSPDKTLFL CLGALLLASC GTTSGKHRQP KPKQTVRQIQ AVRISHIGRT

51    QGSQELMLHS LGLIGTPYKW GGSSTATGFD CSGMIQLVYK NALNVKLPRT

101    ARDMAAASRK IPDSRLKAGD IVFFNTGGAH RYSHVGLYIG NGEFIHAPGS

151    GKTIKTEKLS TPFYAKNYLG AHTFFTE*
```

ORF 206 shows 96.0% identity over a 177 aa overlap with a predicted ORF (ORF 206.ng) from *N. gonorrhoeae*:

```
m206/g206
                  10         20         30         40         50         60
m206.pep  MFPPDKTLFLCLSALLLASCGTTSGKHRQPKPKQTVRQIQAVRISHIDRTQGSQELMLHS
          || ||||||||:|||||||||||||||||||||||||||||||||| ||||||||||||
g206      MFSPDKTLFLCLGALLLASCGTTSGKHRQPKPKQTVRQIQAVRISHIGRTQGSQELMLHS
                  10         20         30         40         50         60

70         80         90        100        110        120
m206.pep  LGLIGTPYKWGGSSTATGFDCSGMIQFVYKNALNVKLPRTARDMAAASRKIPDSRXKAGD
          ||||||||||||||||||||||||||||:||||||||||||||||||||||||||||||
g206      LGLIGTPYKWGGSSTATGFDCSGMIQLVYKNALNVKLPRTARDMAAASRKIPDSRLKAGD
                  70         80         90        100        110        120

130        140        150        160        170
m206.pep  LVFFNTGGAHRYSHVGLYIGNGEFIHAPSSGKTIKTEKLSTPFYAKNYLGAHTFFTEX
          :|||||||||||||||||||||||||||||:|||||||||||||||||||||||||
g206      IVFFNTGGAHRYSHVGLYIGNGEFIHAPGSGKTIKTEKLSTPFYAKNYLGAHTFFTE
                 130        140        150        160        170
```

The following partial DNA sequence was identified in *N. meningitidis* <SEQ ID 3101>:

```
a206.seq
    1   ATGTTTCCCC CCGACAAAAC CCTTTTCCTC TGTCTCAGCG CACTGCTCCT

51   CGCCTCATGC GGCACGACCT CCGGCAAACA CCGCCAACCG AAACCCAAAC

101   AGACAGTCCG GCAAATCCAA GCCGTCCGCA TCAGCCACAT CGACCGCACA

151   CAAGGCTCGC AGGAACTCAT GCTCCACAGC CTCGGACTCA TCGGCACGCC

201   CTACAAATGG GGCGGCAGCA GCACCGCAAC CGGCTTCGAT TGCAGCGGCA

251   TGATTCAATT CGTTTACAAA AACGCCCTCA ACGTCAAGCT GCCGCGCACC

301   GCCCGCGACA TGGCGGCGGC AAGCCGCAAA ATCCCCGACA GCCGCCTTAA

351   GGCCGGCGAC CTCGTATTCT TCAACACCGG CGGCGCACAC CGCTACTCAC

401   ACGTCGGACT CTATATCGGC AACGGCGAAT TCATCCATGC CCCCAGCAGC

451   GGCAAAACCA TCAAAACCGA AAAACTCTCC ACACCGTTTT ACGCCAAAAA

501   CTACCTCGGC GCACATACTT TCTTTACAGA ATGA
```

This corresponds to the amino acid sequence <SEQ ID 3102; ORF 206.a>:

```
a206.pep
    1   MFPPDKTLFL CLSALLLASC GTTSGKHRQP KPKQTVRQIQ AVRISHIDRT

51   QGSQELMLHS LGLIGTPYKW GGSSTATGFD CSGMIQFVYK NALNVKLPRT

101   ARDMAAASRK IPDSRLKAGD LVFFNTGGAH RYSHVGLYIG NGEFIHAPSS

151   GKTIKTEKLS TPFYAKNYLG AHTFFTE*
``` m206/a206 99.4% identity in 177 aa overlap

```
                 10         20         30         40         50         60
 m206.pep  MFPPDKTLFLCLSALLLASCGTTSGKHRQPKPKQTVRQIQAVRISHIDRTQGSQELMLHS
           ||||||||||||||||||||||||||||||||||||||||||||||||||||||||||||
 a206      MFPPDKTLFLCLSALLLASCGTTSGKHRQPKPKQTVRQIQAVRISHIDRTQGSQELMLHS
                 10         20         30         40         50         60
                 70         80         90        100        110        120
 m206.pep  LGLIGTPYKWGGSSTATGFDCSGMIQFVYKNALNVKLPRTARDMAAASRKIPDSRXKAGD
           |||||||||||||||||||||||||||||||||||||||||||||||||||||||| |||
 a206      LGLIGTPYKWGGSSTATGFDCSGMIQFVYKNALNVKLPRTARDMAAASRKIPDSRLKAGD
                 70         80         90        100        110        120
                130        140        150        160        170
 m206.pep  LVFFNTGGAHRYSHVGLYIGNGEFIHAPSSGKTIKTEKLSTPFYAKNYLGAHTFFTEX
           |||||||||||||||||||||||||||||||||||||||||||||||||||||||||
 a206      LVFFNTGGAHRYSHVGLYIGNGEFIHAPSSGKTIKTEKLSTPFYAKNYLGAHTFFTEX
                130        140        150        160        170
```

287

The following partial DNA sequence was identified in *N. meningitidis* <SEQ ID 3103>:

```
m287.seq
    1   ATGTTTAAAC GCAGCGTAAT CGCAATGGCT TGTATTTTTG CCCTTTCAGC

51   CTGCGGGGGC GGCGGTGGCG GATCGCCCGA TGTCAAGTCG GCGGACACGC

101   TGTCAAAACC TGCCGCCCCT GTTGTTTCTG AAAAAGAGAC AGAGGCAAAG

151   GAAGATGCGC CACAGGCAGG TTCTCAAGGA CAGGGCGCGC CATCCGCACA

201   AGGCAGTCAA GATATGGCGG CGGTTTCGGA AGAAAATACA GGCAATGGCG

251   GTGCGGTAAC AGCGGATAAT CCCAAAAATG AAGACGAGGT GGCACAAAAT

301   GATATGCCGC AAAATGCCGC CGGTACAGAT AGTTCGACAC CGAATCACAC
```

-continued

```
 351 CCCGGATCCG AATATGCTTG CCGGAAATAT GGAAAATCAA GCAACGGATG

401 CCGGGGAATC GTCTCAGCCG GCAAACCAAC CGGATATGGC AAATGCGGCG

451 GACGGAATGC AGGGGGACGA TCCGTCGGCA GGCGGGCAAA ATGCCGGCAA

501 TACGGCTGCC CAAGGTGCAA ATCAAGCCGG AAACAATCAA GCCGCCGGTT

551 CTTCAGATCC CATCCCCGCG TCAAACCCTG CACCTGCGAA TGGCGGTAGC

601 AATTTTGGAA GGGTTGATTT GGCTAATGGC GTTTTGATTG ACGGGCCGTC

651 GCAAAATATA ACGTTGACCC ACTGTAAAGG CGATTCTTGT AGTGGCAATA

701 ATTTCTTGGA TGAAGAAGTA CAGCTAAAAT CAGAATTTGA AAAATTAAGT

751 GATGCAGACA AAATAAGTAA TTACAAGAAA GATGGGAAGA ATGATAAATT

801 TGTCGGTTTG GTTGCCGATA GTGTGCAGAT GAAGGGAATC AATCAATATA

851 TTATCTTTTA TAAACCTAAA CCCACTTCAT TTGCGCGATT TAGGCGTTCT

901 GCACGGTCGA GGCGGTCGCT TCCGGCCGAG ATGCCGCTGA TTCCCGTCAA

951 TCAGGCGGAT ACGCTGATTG TCGATGGGGA AGCGGTCAGC CTGACGGGGC

1001 ATTCCGGCAA TATCTTCGCG CCCGAAGGGA ATTACCGGTA TCTGACTTAC

1051 GGGGCGGAAA AATTGCCCGG CGGATCGTAT GCCCTTCGTG TTCAAGGCGA

1101 ACCGGCAAAA GGCGAAATGC TTGCGGGCGC GGCCGTGTAC AACGGCGAAG

1151 TACTGCATTT CCATACGGAA AACGGCCGTC CGTACCCGAC CAGGGGCAGG

1201 TTTGCCGCAA AAGTCGATTT CGGCAGCAAA TCTGTGGACG GCATTATCGA

1251 CAGCGGCGAT GATTTGCATA TGGGTACGCA AAAATTCAAA GCCGCCATCG

1301 ATGGAAACGG CTTTAAGGGG ACTTGGACGG AAAATGGCAG CGGGGATGTT

1351 TCCGGAAAGT TTTACGGCCC GGCCGGCGAG GAAGTGGCGG GAAAATACAG

1401 CTATCGCCCG ACAGATGCGG AAAAGGGCGG ATTCGGCGTG TTTGCCGGCA

1451 AAAAGAGCA GGATTGA
```

This corresponds to the amino acid sequence <SEQ ID 3104; ORF 287>:

```
m287.pep
   1 MFKRSVIAMA CIFALSACGG GGGGSPDVKS ADTLSKPAAP VVSEKETEAK

51 EDAPQAGSQG QGAPSAQGSQ DMAAVSEENT GNGGAVTADN PKNEDEVAQN

101 DMPQNAAGTD SSTPNHTPDP NMLAGNMENQ ATDAGESSQP ANQPDMANAA

151 DGMQGDDPSA GGQNAGNTAA QGANQAGNNQ AAGSSDPIPA SNPAPANGGS

201 NFGRVDLANG VLIDGPSQNI TLTHCKGDSC SGNNFLDEEV QLKSEFEKLS

251 DADKISNYKK DGKNDKFVGL VADSVQMKGI NQYIIFYKPK PTSFARFRRS

301 ARSRRSLPAE MPLIPVNQAD TLIVDGEAVS LTGHSGNIFA PEGNYRYLTY

351 GAEKLPGGSY ALRVQGEPAK GEMLAGAAVY NGEVLHFHTE NGRPYPTRGR

401 FAAKVDFGSK SVDGIIDSGD DLHMGTQKFK AAIDGNGFKG TWTENGSGDV

451 SGKFYGPAGE EVAGKYSYRP TDAEKGGFGV FAGKKEQD*
```

The following partial DNA sequence was identified in *N. gonorrhoeae* <SEQ ID 3105>:

g287.seq
```
   1 atgtttaaac gcagtgtgat tgcaatggct tgtatttttc ccctttcagc
  51 ctgtgggggc ggcggtggcg gatcgcccga tgtcaagtcg gcggacacgc
 101 cgtcaaaacc ggccgccccc gttgttgctg aaaatgccgg ggaaggggtg
 151 ctgccgaaag aaaagaaaga tgaggaggca gcgggcggtg cgccgcaagc
 201 cgatacgcag gacgcaaccg ccggagaagg cagccaagat atggcggcag
 251 tttcggcaga aaatacaggc aatggcggtg cggcaacaac ggacaacccc
 301 aaaaatgaag acgcgggggc gcaaaatgat atgccgcaaa atgccgccga
 351 atccgcaaat caaacaggga acaaccaacc cgccggttct tcagattccg
 401 cccccgcgtc aaaccctgcc cctgcgaatg gcggtagcga ttttggaagg
 451 acgaacgtgg gcaattctgt tgtgattgac ggaccgtcgc aaaatataac
 501 gttgacccac tgtaaaggcg attcttgtaa tggtgataat ttattggatg
 551 aagaagcacc gtcaaaatca gaatttgaaa aattaagtga tgaagaaaaa
 601 attaagcgat ataaaaaaga cgagcaacgg gagaattttg tcggtttggt
 651 tgctgacagg gtaaaaaagg atggaactaa caaatatatc atcttctata
 701 cggacaaacc acctactcgt tctgcacggt cgaggaggtc gcttccggcc
 751 gagattccgc tgattcccgt caatcaggcc gatacgctga ttgtggatgg
 801 ggaagcggtc agcctgacgg ggcattccgg caatatcttc gcgcccgaag
 851 ggaattaccg gtatctgact acggggcgga aaaattgcc cggcggatcg
 901 tatgccctcc gtgtgcaagg cgaaccggca aaggcgaaa tgcttgttgg
 951 cacggccgtg tacaacggcg aagtgctgca tttccatatg gaaacggcc
1001 gtccgtaccc gtccggaggc aggtttgccg caaaagtcga tttcggcagc
1051 aaatctgtgg acggcattat cgacagcggc gatgatttgc atatgggtac
1101 gcaaaaattc aaagccgcca tcgatggaaa cggctttaag gggacttgga
1151 cggaaaatgg cggcgggat gtttccggaa ggttttacgg ccgggccggc
1201 gaggaagtgg cgggaaaata cagctatcgc ccgacagatg ctgaaaaggg
1251 cggattcggc gtgtttgccg gcaaaaaaga tcgggattga
```

This corresponds to the amino acid sequence <SEQ ID 3106; ORF 287.ng>:

g287.pep
```
   1 MFKRSVIAMA CIFPLSACGG GGGGSPDVKS ADTPSKPAAP VVAENAGEGV
  51 LPKEKKDEEA AGGAPQADTQ DATAGEGSQD MAAVSAENTG NGGAATTDNP
 101 KNEDAGAQND MPQNAAESAN QTGNNQPAGS SDSAPASNPA PANGGSDFGR
 151 TNVGNSVVID GPSQNITLTH CKGDSCNGDN LLDEEAPSKS EFEKLSDEEK
 201 IKRYKKDEQR ENFVGLVADR VKKDGTNKYI IFYTDKPPTR SARSRRSLPA
 251 EIPLIPVNQA DTLIVDGEAV SLTGHSGNIF APEGNYRYLT YGAEKLPGGS
 301 YALRVQGEPA KGEMLVGTAV YNGEVLHFHM ENGRPYPSGG RFAAKVDFGS
 351 KSVDGIIDSG DDLHMGTQKF KAAIDGNGFK GTWTENGGGD VSGRFYGPAG
 401 EEVAGKYSYR PTDAEKGGFG VFAGKKDRD*
``` m287/g287 70.1% identity in 499 aa overlap

```
                    10        20        30        40              49
m287.pep    MFKRSVIAMACIFALSACGGGGGSPDVKSADTLSKPAAPVVSE----------KETEA
            ||||||||||||| ||||||||||||||||| ||||||||||:          |: ||
g287        MFKRSVIAMACIFPLSACGGGGGSPDVKSADTPSKPAAPVVAENAGEGVLPKEKKDEEA
                    10        20        30        40        50        60

50        60        70        80        90       100       109
m287.pep    KEDAPQAGSQGQGAPSAQGSQDMAAVSEENTGNGGAVTADNPKNEDEVAQNDMPQNAAGT
             ||||  :|   :::||||||||||| |||||||||  ||||||||| |:|||||||||
g287        AGGAPQADTQD--ATAGEGSQDMAAVSAENTGNGGAATTDNPKNEDAGAQNDMPQNAA--
                    70        80        90       100       110

110       120       130       140       150       160       169
m287.pep    DSSTPNHTPDPNMLAGNMENQATDAGESSQPANQPDMANAADGMQGDDPSAGGQNAGNTA g287        ------------------------------------------------------------
                   170       180       190       200       210       220       229
m287.pep    AQGANQAGNNQAAGSSDPIPASNPAPANGGSNFGRVDLANGVLIDGPSQNITLTHCKGDS
             ::|||:||||  |||||  ||||||||||||:|| | |:::|:||||||||||||||||
g287        -ESANQTGNNQPAGSSDSAPASNPAPANGGSDFGRTNVGNSVVIDGPSQNITLTHCKGDS
                   120       130       140       150       160       170

230       240       250       260       270       280       289
m287.pep    CSGNNFLDEEVQLKSEFEKLSDADKISNYKKDGKNDKFVGLVADSVQMKGINQYIIFYKP
            |:|:|:|||| |||||||||||:|| |||| | ::|||||||:|:||||||:||||||
g287        CNGDNLLDEEAPSKSEFEKLSDEEKIKRYKKDEQRENFVGLVADRVKKDGTNKYIIFYTD
                   180       190       200       210       220       230

290       300       310       320       330       340       349
m287.pep    KPTSFARFRRSARSRRSLPAEMPLIPVNQADTLIVDGEAVSLTGHSGNIFAPEGNYRYLT
            || :     ||||||||||||:||||||||||||||||||||||||||||||||||||||
g287        KPPT-----RSARSRRSLPAEIPLIPVNQADTLIVDGEAVSLTGHSGNIFAPEGNYRYLT
                        240       250       260       270       280       290

350       360       370       380       390       400       409
m287.pep    YGAEKLPGGSYALRVQGEPAKGEMLAGAAVYNGEVLHFHTENGRPYPTRGRFAAKVDFGS
            |||||||||||||||||||||||||:|:|||||||||||:|||||||:||||||||||||
g287        YGAEKLPGGSYALRVQGEPAKGEMLVGTAVYNGEVLHFHMENGRPYPSGGRFAAKVDFGS
                   300       310       320       330       340       350

410       420       430       440       450       460       469
m287.pep    KSVDGIIDSGDDLHMGTQKFKAAIDGNGFKGTWTENGSGDVSGKFYGPAGEEVAGKYSYR
            ||||||||||||||||||||||||||||||||||||:||||:||||||||||||||||||
g287        KSVDGIIDSGDDLHMGTQKFKAAIDGNGFKGTWTENGGGDVSGRFYGPAGEEVAGKYSYR
                   360       370       380       390       400       410

470       480       489
m287.pep    PTDAEKGGFGVFAGKKEQDX
            |||||||||||||||::||
g287        PTDAEKGGFGVFAGKKDRDX
                   420       430
```

The following partial DNA sequence was identified in *N. meningitidis* <SEQ ID 3107>:

```
a287.seq
    1   ATGTTTAAAC GCAGTGTGAT TGCAATGGCT TGTATTGTTG CCCTTTCAGC

51   CTGTGGGGGC GGCGGTGGCG GATCGCCCGA TGTTAAGTCG GCGGACACGC

101   TGTCAAAACC TGCCGCCCCT GTTGTTACTG AAGATGTCGG GGAAGAGGTG

151   CTGCCGAAAG AAAAGAAAGA TGAGGAGGCG GTGAGTGGTG CGCCGCAAGC

201   CGATACGCAG GACGCAACCG CCGGAAAAGG CGGTCAAGAT ATGGCGGCAG

251   TTTCGGCAGA AAATACAGGC AATGGCGGTG CGGCAACAAC GGATAATCCC

301   GAAAATAAAG ACGAGGGACC GCAAAATGAT ATGCCGCAAA ATGCCGCCGA

351   TACAGATAGT TCGACACCGA ATCACACCCC TGCACCGAAT ATGCCAACCA

401   GAGATATGGG AAACCAAGCA CCGGATGCCG GGAATCGGC ACAACCGGCA

451   AACCAACCGG ATATGGCAAA TGCGGCGGAC GGAATGCAGG GGACGATCC

501   GTCGGCAGGG GAAAATGCCG GCAATACGGC AGATCAAGCT GCAAATCAAG

551   CTGAAAACAA TCAAGTCGGC GGCTCTCAAA ATCCTGCCTC TTCAACCAAT

601   CCTAACGCCA CGAATGGCGG CAGCGATTTT GGAAGGATAA ATGTAGCTAA
```

```
-continued
 651  TGGCATCAAG CTTGACAGCG GTTCGGAAAA TGTAACGTTG ACACATTGTA

701  AAGACAAAGT ATGCGATAGA GATTTCTTAG ATGAAGAAGC ACCACCAAAA

751  TCAGAATTTG AAAAATTAAG TGATGAAGAA AAAATTAATA AATATAAAAA

801  AGACGAGCAA CGAGAGAATT TTGTCGGTTT GGTTGCTGAC AGGGTAGAAA

851  AGAATGGAAC TAACAAATAT GTCATCATTT ATAAAGACAA GTCCGCTTCA

901  TCTTCATCTG CGCGATTCAG GCGTTCTGCA CGGTCGAGGC GGTCGCTTCC

951  GGCCGAGATG CCGCTGATTC CCGTCAATCA GGCGGATACG CTGATTGTCG

1001  ATGGGGAAGC GGTCAGCCTG ACGGGGCATT CCGGCAATAT CTTCGCGCCC

1051  GAAGGGAATT ACCGGTATCT GACTTACGGG GCGGAAAAAT TGTCCGGCGG

1101  ATCGTATGCC CTCAGTGTGC AAGGCGAACC GGCAAAAGGC GAATGCTTG

1151  CGGGCACGGC CGTGTACAAC GGCGAAGTGC TGCATTTCCA TATGGAAAAC

1201  GGCCGTCCGT CCCCGTCCGG AGGCAGGTTT GCCGCAAAAG TCGATTTCGG

1251  CAGCAAATCT GTGGACGGCA TTATCGACAG CGGCGATGAT TTGCATATGG

1301  GTACGCAAAA ATTCAAAGCC GTTATCGATG GAAACGGCTT TAAGGGGACT

1351  TGGACGGAAA ATGGCGGCGG GGATGTTTCC GGAAGGTTTT ACGGCCCGGC

1401  CGGCGAAGAA GTGGCGGGAA ATACAGCTA TCGCCCGACA GATGCGGAAA

1451  AGGGCGGATT CGGCGTGTTT GCCGGCAAAA AAGAGCAGGA TTGA
```

This corresponds to the amino acid sequence <SEQ ID 3108; ORF 287.a>:

```
a287.pep
   1  MFKRSVIAMA CIVALSACGG GGGGSPDVKS ADTLSKPAAP VVTEDVGEEV

51  LPKEKKDEEA VSGAPQADTQ DATAGKGGQD MAAVSAENTG NGGAATTDNP

101  ENKDEGPQND MPQNAADTDS STPNHTPAPN MPTRDMGNQA PDAGESAQPA

151  NQPDMANAAD GMQGDDPSAG ENAGNTADQA ANQAENNQVG GSQNPASSTN

201  PNATNGGSDF GRINVANGIK LDSGSENVTL THCKDKVCDR DFLDEEAPPK

251  SEFEKLSDEE KINKYKKDEQ RENFVGLVAD RVEKNGTNKY VIIYKDKSAS

301  SSSARFRRSA RSRRSLPAEM PLIPVNQADT LIVDGEAVSL TGHSGNIFAP

351  EGNYRYLTYG AEKLSGGSYA LSVQGEPAKG EMLAGTAVYN GEVLHFHMEN

401  GRPSPSGGRF AAKVDFGSKS VDGIIDSGDD LHMGTQKFKA VIDGNGFKGT

451  WTENGGGDVS GRFYGPAGEE VAGKYSYRPT DAEKGGFGVF AGKKEQD*
``` m287/a287 77.2% identity in 501 aa overlap

```
                10         20         30         40          49
m287.pep  MFKRSVIAMACIFALSACGGGGGSPDVKSADTLSKPAAPVVSE----------KETEA
          ||||||||||| ||||||||||||||||||||||||||||||           |: ||
a287      MFKRSVIAMACIVALSACGGGGGSPDVKSADTLSKPAAPVVTEDVGEEVLPKEKKDEEA
                10         20         30         40         50         60

50         60         70         80         90        100       109
m287.pep  KEDAPQAGSQGQGAPSAQGSQDMAAVSEENTGNGGAVTADNPKNEDEVAQNDMPQNAAGT
          ||||  :|       | : :|:|||||||| ||||||||:|:|||:|||  |||||||| |
a287      VSGAPQADTQ--DATAGKGGQDMAAVSAENTGNGGAATTDNPENKDEGPQNDMPQNAADT
                70         80         90        100        110

110        120        130        140        150        160       169
m287.pep  DSSTPNHTPDPNMLAGNMENQATDAGESSQPANQPDMANAADGMQGDDPSAGGQNAGNTA
          ||||||||| ||| : :| ||| ||||||:|||||||||||||||||||||| :||||||
a287      DSSTPNHTPAPNMPTRDMGNQAPDAGESAQPANQPDMANAADGMQGDDPSAG-ENAGNTA
                120        130        140        150        160        170
```

-continued

```
           170       180       190       200       210       220      229
m287.pep   AQGANQAGNNQAAGSSDPIPASNPAPANGGSNFGRVDLANGVLIDGPSQNITLTHCKGDS
            |:|||| |||::||::|  ::||  :||||:|||:::|||: :|: |:|:||||||   
a287       DQAANQAENNQVGGSQNPASSTNPNATNGGSDFGRINVANGIKLDSGSENVTLTHCKDKV
            180       190       200       210       220       230

230       240       250       260       270       280      289
m287.pep   CSGNNFLDEEVQLKSEFEKLSDADKISNYKKDGKNDKFVGLVADSVQMKGINQYIIFYKP
           |:  :|||||:  ||||||||| :||::|||| : ::||||||| |: :| |:|:|:|| 
a287       CD-RDFLDEEAPPKSEFEKLSDEEKINKYKKDEQRENFVGLVADRVEKNGTNKYVIIYKD
            240       250       260       270       280       290

290       300       310       320       330       340
m287.pep   KP--TSFARFRRSARSRRSLPAEMPLIPVNQADTLIVDGEAVSLTGHSGNIFAPEGNYRY
           |   :| |||||||||||||||||||||||||||||||||||||||||||||||||||||
a287       KSASSSSARFRRSARSRRSLPAEMPLIPVNQADTLIVDGEAVSLTGHSGNIFAPEGNYRY
            300       310       320       330       340       350

350       360       370       380       390       400
m287.pep   LTYGAEKLPGGSYALRVQGEPAKGEMLAGAAVYNGEVLHFHTENGRPYPTRGRFAAKVDF
           |||||||| |||||| |||||||||||||:||||||||||| ||||| |: |||||||||
a287       LTYGAEKLSGGSYALSVQGEPAKGEMLAGTAVYNGEVLHFHMENGRPSPSGGRFAAKVDF
            360       370       380       390       400       410

410       420       430       440       450       460
m287.pep   GSKSVDGIIDSGDDLHMGTQKFKAAIDGNGFKGTWTENGSGDVSGKFYGPAGEEVAGKYS
           ||||||||||||||||||||||||:||||||||||||||:|||||:||||||||||||||
a287       GSKSVDGIIDSGDDLHMGTQKFKAVIDGNGFKGTWTENGGGDVSGRFYGPAGEEVAGKYS
            420       430       440       450       460       470

470       480      489
m287.pep   YRPTDAEKGGFGVFAGKKEQDX
           ||||||||||||||||||||||
a287       YRPTDAEKGGFGVFAGKKEQDX
            480       490
```

406
The following partial DNA sequence was identified in *N. meningitidis* <SEQ ID 3109>:

```
m406.seq
     1  ATGCAAGCAC GGCTGCTGAT ACCTATTCTT TTTTCAGTTT TTATTTTATC

51  CGCCTGCGGG ACACTGACAG GTATTCCATC GCATGGCGGA GGTAAACGCT

101  TTGCGGTCGA ACAAGAACTT GTGGCCGCTT CTGCCAGAGC TGCCGTTAAA

151  GACATGGATT TACAGGCATT ACACGGACGA AAAGTTGCAT TGTACATTGC

201  CACTATGGGC GACCAAGGTT CAGGCAGTTT GACAGGGGGT CGCTACTCCA

251  TTGATGCACT GATTCGTGGC GAATACATAA ACAGCCCTGC CGTCCGTACC

301  GATTACACCT ATCCACGTTA CGAAACCACC GCTGAAACAA CATCAGGCGG

351  TTTGACAGGT TTAACCACTT CTTTATCTAC ACTTAATGCC CCTGCACTCT

401  CTCGCACCCA ATCAGACGGT AGCGGAAGTA AAAGCAGTCT GGGCTTAAAT

451  ATTGGCGGGA TGGGGGATTA TCGAAATGAA ACCTTGACGA CTAACCCGCG

501  CGACACTGCC TTTCTTTCCC ACTTGGTACA GACCGTATTT TTCCTGCGCG

551  GCATAGACGT TGTTTCTCCT GCCAATGCCG ATACAGATGT GTTTATTAAC

601  ATCGACGTAT TCGGAACGAT ACGCAACAGA ACCGAAATGC ACCTATACAA

651  TGCCGAAACA CTGAAAGCCC AAACAAAACT GGAATATTTC GCAGTAGACA

701  GAACCAATAA AAAATTGCTC ATCAAACCAA AAACCAATGC GTTTGAAGCT

751  GCCTATAAAG AAAATTACGC ATTGTGGATG GGGCCGTATA AAGTAAGCAA

801  AGGAATTAAA CCGACGGAAG GATTAATGGT CGATTTCTCC GATATCCGAC

851  CATACGGCAA TCATACGGGT AACTCCGCCC CATCCGTAGA GGCTGATAAC

901  AGTCATGAGG GGTATGGATA CAGCGATGAA GTAGTGCGAC AACATAGACA

951  AGGACAACCT TGA
```

This corresponds to the amino acid sequence <SEQ ID 3110; ORF 406>:

```
m406.pep
    1   MQARLLIPIL FSVFILSACG TLTGIPSHGG GKRFAVEQEL VAASARAAVK

51   DMDLQALHGR KVALYIATMG DQGSGSLTGG RYSIDALIRG EYINSPAVRT

101   DYTYPRYETT AETTSGGLTG LTTSLSTLNA PALSRTQSDG SGSKSSLGLN

151   IGGMGDYRNE TLTTNPRDTA FLSHLVQTVF FLRGIDVVSP ANADTDVFIN

201   IDVFGTIRNR TEMHLYNAET LKAQTKLEYF AVDRTNKKLL IKPKTNAFEA

251   AYKENYALWM GPYKVSKGIK PTEGLMVDFS DIRPYGNHTG NSAPSVEADN

301   SHEGYGYSDE VVRQHRQGQP *
```

The following partial DNA sequence was identified in *N. gonorrhoeae* <SEQ ID 3111>:

```
g406.seq
    1   ATGCGGGCAC GGCTGCTGAT ACCTATTCTT TTTTCAGTTT TTATTTTATC

51   CGCCTGCGGG ACACTGACAG GTATTCCATC GCATGGCGGA GGCAAACGCT

101   TCGCGGTCGA ACAAGAACTT GTGGCCGCTT CTGCCAGAGC TGCCGTTAAA

151   GACATGGATT TACAGGCATT ACACGGACGA AAAGTTGCAT TGTACATTGC

201   AACTATGGGC GACCAAGGTT CAGGCAGTTT GACAGGGGGT CGCTACTCCA

251   TTGATGCACT GATTCGCGGC GAATACATAA ACAGCCCTGC CGTCCGCACC

301   GATTACACCT ATCCGCGTTA CGAAACCACC GCTGAAACAA CATCAGGCGG

351   TTTGACGGGT TTAACCACTT CTTTATCTAC ACTTAATGCC CCTGCACTCT

401   CGCGCACCCA ATCAGACGGT AGCGGAAGTA GGAGCAGTCT GGGCTTAAAT

451   ATTGGCGGGA TGGGGGATTA TCGAAATGAA ACCTTGACGA CCAACCCGCG

501   CGACACTGCC TTTCTTTCCC ACTTGGTGCA GACCGTATTT TTCCTGCGCG

551   GCATAGACGT TGTTTCTCCT GCCAATGCCG ATACAGATGT GTTTATTAAC

601   ATCGACGTAT TCGGAACGAT ACGCAACAGA ACCGAAATGC ACCTATACAA

651   TGCCGAAACA CTGAAAGCCC AAACAAAACT GGAATATTTC GCAGTAGACA

701   GAACCAATAA AAAATTGCTC ATCAAACCCA AAACCAATGC GTTTGAAGCT

751   GCCTATAAAG AAAATTACGC ATTGTGGATG GGGCCGTATA AAGTAAGCAA

801   AGGAATCAAA CCGACGGAAG GATTGATGGT CGATTTCTCC GATATCCAAC

851   CATACGGCAA TCATACGGGT AACTCCGCCC CATCCGTAGA GGCTGATAAC

901   AGTCATGAGG GGTATGGATA CAGCGATGAA GCAGTGCGAC AACATAGACA

951   AGGGCAACCT TGA
```

This corresponds to the amino acid sequence <SEQ ID 3112; ORF 406>:

```
g406.pep
    1   MRARLLIPIL FSVFILSACG TLTGIPSHGG GKRFAVEQEL VAASARAAVK

51   DMDLQALHGR KVALYIATMG DQGSGSLTGG RYSIDALIRG EYINSPAVRT

101   DYTYPRYETT AETTSGGLTG LTTSLSTLNA PALSRTQSDG SGSRSSLGLN

151   IGGMGDYRNE TLTTNPRDTA FLSHLVQTVF FLRGIDVVSP ANADTDVFIN

201   IDVFGTIRNR TEMHLYNAET LKAQTKLEYF AVDRTNKKLL IKPKTNAFEA
```

```
                                                   -continued
 251    AYKENYALWM GPYKVSKGIK PTEGLMVDFS DIQPYGNHTG NSAPSVEADN

301    SHEGYGYSDE AVRQHRQGQP *
```

ORF 406 shows 98.8% identity over a 320 aa overlap with a predicted ORF (ORF406.a) from *N. gonorrhoeae*:

```
g406/m406
                   10         20         30         40         50         60
    g406.pep   MRARLLIPILFSVFILSACGTLTGIPSHGGGKRFAVEQELVAASARAAVKDMDLQALHGR
               |:||||||||||||||||||||||||||||||||||||||||||||||||||||||||
    m406       MQARLLIPILFSVFILSACGTLTGIPSHGGGKRFAVEQELVAASARAAVKDMDLQALHGR
                   10         20         30         40         50         60

70         80         90        100        110        120
    g406.pep   KVALYIATMGDQGSGSLTGGRYSIDALIRGEYINSPAVRTDYTYPRYETTAETTSGGLTG
               ||||||||||||||||||||||||||||||||||||||||||||||||||||||||||||
    m406       KVALYIATMGDQGSGSLTGGRYSIDALIRGEYINSPAVRTDYTYPRYETTAETTSGGLTG
                   70         80         90        100        110        120

130        140        150        160        170        180
    g406.pep   LTTSLSTLNAPALSRTQSDGSGSRSSLGLNIGGMGDYRNETLTTNPRDTAFLSHLVQTVF
               |||||||||||||||||||||||||:||||||||||||||||||||||||||||||||||
    m406       LTTSLSTLNAPALSRTQSDGSGSKSSLGLNIGGMGDYRNETLTTNPRDTAFLSHLVQTVF
                  130        140        150        160        170        180

190        200        210        220        230        240
    g406.pep   FLRGIDVVSPANADTDVFINIDVFGTIRNRTEMHLYNAETLKAQTKLEYFAVDRTNKKLL
               ||||||||||||||||||||||||||||||||||||||||||||||||||||||||||||
    m406       FLRGIDVVSPANADTDVFINIDVFGTIRNRTEMHLYNAETLKAQTKLEYFAVDRTNKKLL
                  190        200        210        220        230        240

250        260        270        280        290        300
    g406.pep   IKPKTNAFEAAYKENYALWMGPYKVSKGIKPTEGLMVDFSDIQPYGNHTGNSAPSVEADN
               |||||||||||||||||||||||||||||||||||||||||:||||||||||||||||||
    m406       IKPKTNAFEAAYKENYALWMGPYKVSKGIKPTEGLMVDFSDIRPYGNHTGNSAPSVEADN
                  250        260        270        280        290        300

310        320
    g406.pep   SHEGYGYSDEAVRQHRQGQPX
               ||||||||||:||||||||||
    m406       SHEGYGYSDEVVRQHRQGQPX
                  310        320
```

The following partial DNA sequence was identified in *N. meningitidis* <SEQ ID 3113>:

```
a406.seq
    1   ATGCAAGCAC GGCTGCTGAT ACCTATTCTT TTTTCAGTTT TTATTTTATC

51   CGCCTGCGGG ACACTGACAG GTATTCCATC GCATGGCGGA GGTAAACGCT

101   TCGCGGTCGA ACAAGAACTT GTGGCCGCTT CTGCCAGAGC TGCCGTTAAA

151   GACATGGATT TACAGGCATT ACACGGACGA AAAGTTGCAT TGTACATTGC

201   AACTATGGGC GACCAAGGTT CAGGCAGTTT GACAGGGGGT CGCTACTCCA

251   TTGATGCACT GATTCGTGGC GAATACATAA ACAGCCCTGC CGTCCGTACC

301   GATTACACCT ATCCACGTTA CGAAACCACC GCTGAAACAA CATCAGGCGG

351   TTTGACAGGT TTAACCACTT CTTTATCTAC ACTTAATGCC CCTGCACTCT

401   CGCGCACCCA ATCAGACGGT AGCGGAAGTA AAAGCAGTCT GGGCTTAAAT

451   ATTGGCGGGA TGGGGGATTA TCGAAATGAA ACCTTGACGA CTAACCCGCG

501   CGACACTGCC TTTCTTTCCC ACTTGGTACA GACCGTATTT TTCCTGCGCG

551   GCATAGACGT TGTTTCTCCT GCCAATGCCG ATACGGATGT GTTTATTAAC

601   ATCGACGTAT TCGGAACGAT ACGCAACAGA ACCGAAATGC ACCTATACAA

651   TGCCGAAACA CTGAAAGCCC AAACAAAACT GGAATATTTC GCAGTAGACA

701   GAACCAATAA AAAATTGCTC ATCAAACCAA AAACCAATGC GTTTGAAGCT

751   GCCTATAAAG AAAATTACGC ATTGTGGATG GGACCGTATA AAGTAAGCAA
```

```
-continued
801  AGGAATTAAA CCGACAGAAG GATTAATGGT CGATTTCTCC GATATCCAAC

851  CATACGGCAA TCATATGGGT AACTCTGCCC CATCCGTAGA GGCTGATAAC

901  AGTCATGAGG GGTATGGATA CAGCGATGAA GCAGTGCGAC GACATAGACA

951  AGGGCAACCT TGA
```

This corresponds to the amino acid sequence <SEQ ID 3114; ORF 406.a>:

```
a406.pep
   1   MQARLLIPIL FSVFILSACG TLTGIPSHGG GKRFAVEQEL VAASARAAVK

51   DMDLQALHGR KVALYIATMG DQGSGSLTGG RYSIDALIRG EYINSPAVRT

101   DYTYPRYETT AETTSGGLTG LTTSLSTLNA PALSRTQSDG SGSKSSLGLN

151   IGGMGDYRNE TLTTNPRDTA FLSHLVQTVF FLRGIDVVSP ANADTDVFIN

201   IDVFGTIRNR TEMHLYNAET LKAQTKLEYF AVDRTNKKLL IKPKTNAFEA

251   AYKENYALWM GPYKVSKGIK PTEGLMVDFS DIQPYGNHMG NSAPSVEADN

301   SHEGYGYSDE AVRRHRQGQP *
``` m406/a406 98.8% identity in 320 aa overlap

```
                 10         20         30         40         50         60
m406.pep  MQARLLIPILFSVFILSACGTLTGIPSHGGGKRFAVEQELVAASARAAVKDMDLQALHGR
          ||||||||||||||||||||||||||||||||||||||||||||||||||||||||||||
a406      MQARLLIPILFSVFILSACGTLTGIPSHGGGKRFAVEQELVAASARAAVKDMDLQALHGR
                 10         20         30         40         50         60

70         80         90        100        110        120
m406.pep  KVALYIATMGDQGSGSLTGGRYSIDALIRGEYINSPAVRTDYTYPRYETTAETTSGGLTG
          ||||||||||||||||||||||||||||||||||||||||||||||||||||||||||||
a406      KVALYIATMGDQGSGSLTGGRYSIDALIRGEYINSPAVRTDYTYPRYETTAETTSGGLTG
                 70         80         90        100        110        120

130        140        150        160        170        180
m406.pep  LTTSLSTLNAPALSRTQSDGSGSKSSLGLNIGGMGDYRNETLTTNPRDTAFLSHLVQTVF
          ||||||||||||||||||||||||||||||||||||||||||||||||||||||||||||
a406      LTTSLSTLNAPALSRTQSDGSGSKSSLGLNIGGMGDYRNETLTTNPRDTAFLSHLVQTVF
                130        140        150        160        170        180

190        200        210        220        230        240
m406.pep  FLRGIDVVSPANADTDVFINIDVFGTIRNRTEMHLYNAETLKAQTKLEYFAVDRTNKKLL
          ||||||||||||||||||||||||||||||||||||||||||||||||||||||||||||
a406      FLRGIDVVSPANADTDVFINIDVFGTIRNRTEMHLYNAETLKAQTKLEYFAVDRTNKKLL
                190        200        210        220        230        240

250        260        270        280        290        300
m406.pep  IKPKTNAFEAAYKENYALWMGPYKVSKGIKPTEGLMVDFSDIRPYGNHTGNSAPSVEADN
          |||||||||||||||||||||||||||||||||||||||||| :||||  |||||||||
a406      IKPKTNAFEAAYKENYALWMGPYKVSKGIKPTEGLMVDFSDIQPYGNHMGNSAPSVEADN
                250        260        270        280        290        300

310        320
m406.pep  SHEGYGYSDEVVRQHRQGQPX
          ||||||||||:||:|||||||
a406      SHEGYGYSDEAVRRHRQGQPX
                310        320
```

Example 2

Expression of ORF 919

Figure 10:
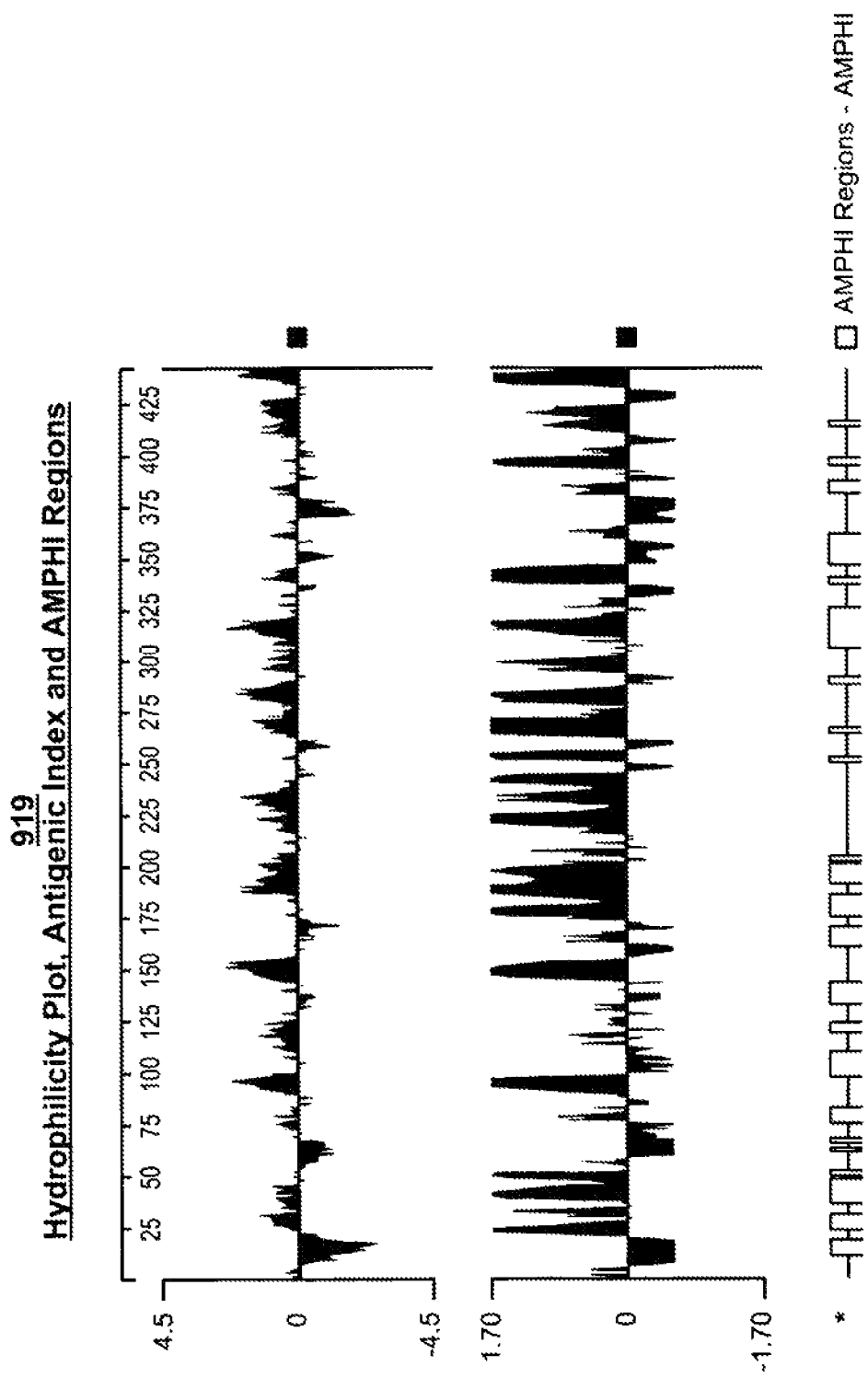
FIG. 10 illustrates the hydrophilicity plot, antigenic index and AMPHI regions of the products of protein expression the predicted ORF 919 as cloned and expressed in *E. coli*.

The primer described in Table 1 for ORF 919 was used to locate and clone ORF 919. The predicted gene 919 was cloned in pET vector and expressed in *E. coli*. The product of protein expression and purification was analyzed by SDS-PAGE. In panel A) is shown the analysis of 919-His fusion protein purification. Mice were immunized with the purified 919-His and sera were used for Western blot (panel B), FACS analysis (panel C), bactericidal assay (panel D), and ELISA assay (panel E). Symbols: M1, molecular weight marker; PP, purified protein; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 919 is a surface-exposed protein and that it is a useful immunogen. The hydrophilicity plots, antigenic index, and amphipatic regions of ORF 919 are provided in FIG. 10. The AMPHI program is used to predict putative T-cell epitopes (Gao et al 1989, *J. Immunol* 143: 3007; Roberts et al. 1996, *AIDS Res Human Retroviruses* 12:593; Quakyi et al. 1992, *Scand J Immunol Suppl* 11:9). The nucleic acid sequence of ORF 919 and the amino acid sequence encoded thereby is provided in Example 1.

Example 3

Expression of ORF 279

Figure 11:
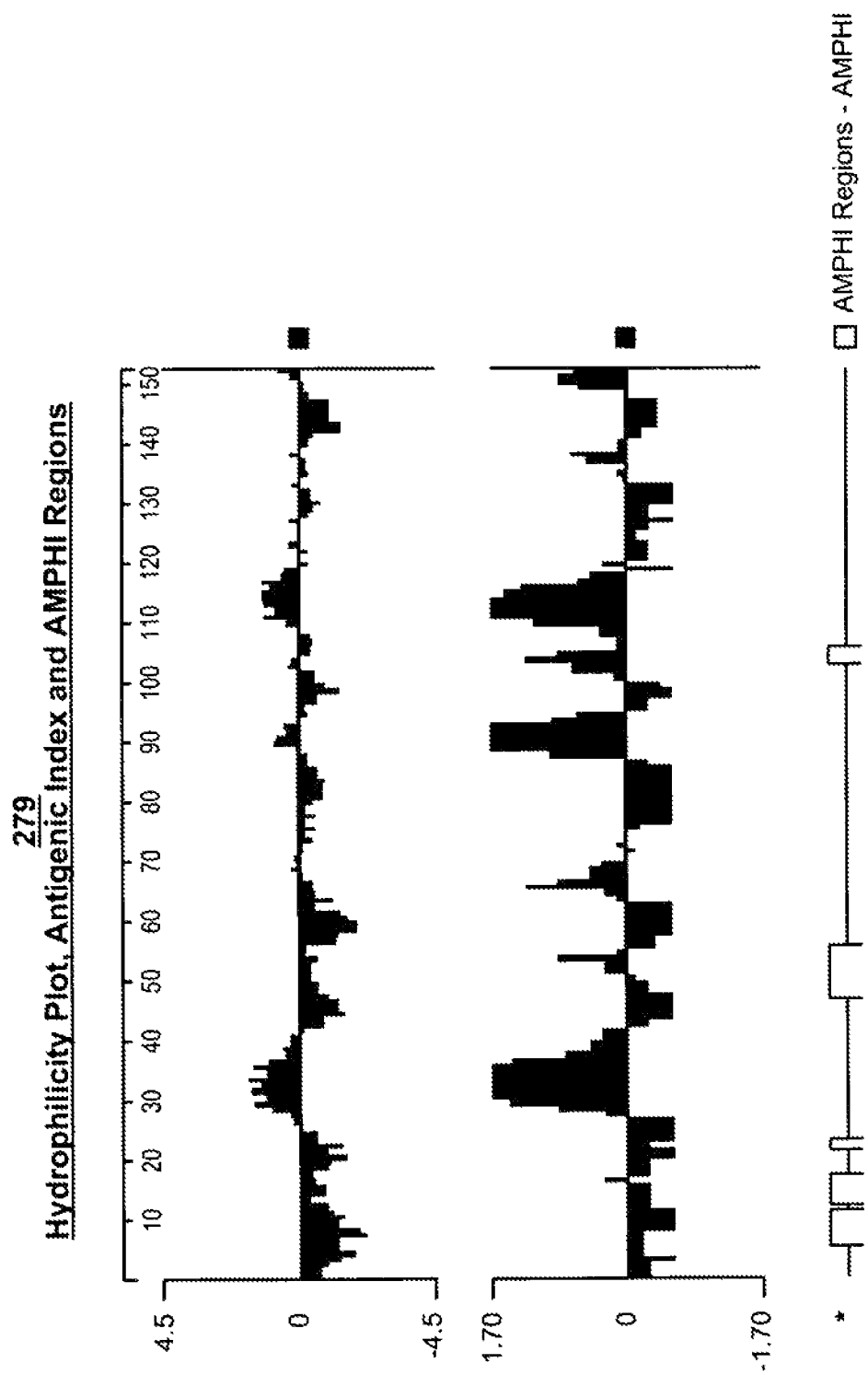
FIG. 11 illustrates the hydrophilicity plot, antigenic index and AMPHI regions of the products of protein expression the predicted ORF 279 as cloned and expressed in *E. coli*.

The primer described in Table 1 for ORF 279 was used to locate and clone ORF 279. The predicted gene 279 was cloned in pGex vector and expressed in *E. coli*. The product of protein expression and purification was analyzed by SDS-PAGE. In panel A) is shown the analysis of 279-GST purification. Mice were immunized with the purified 279-GST and sera were used for Western blot analysis (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 279 is a surface-exposed protein and that it is a useful immunogen. The hydrophilicity plots, antigenic index, and amphipatic regions of ORF 279 are provided in FIG. 11. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided in Example 1.

Example 4

Expression of ORF 576 and 576-1

Figure 12:
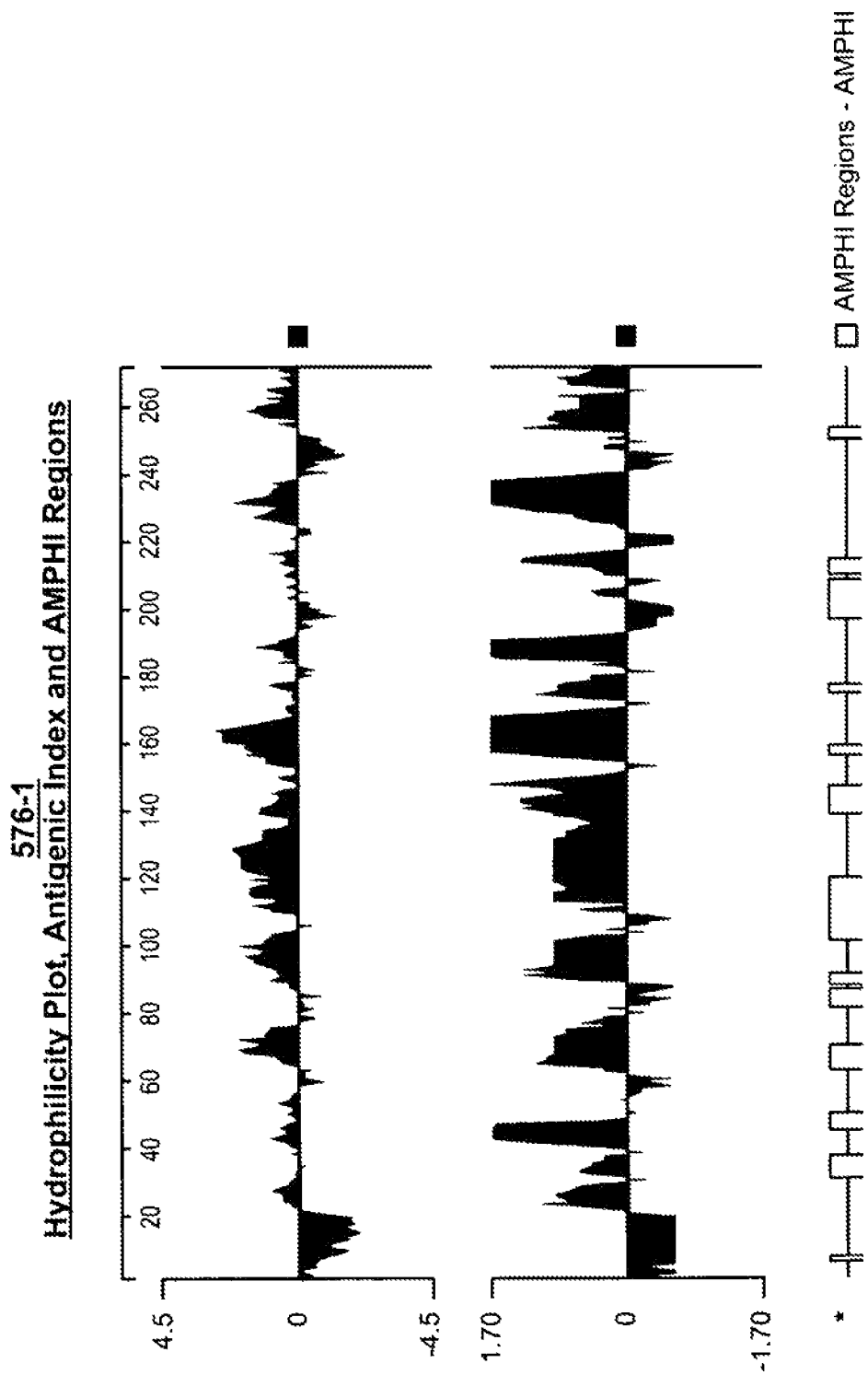
FIG. 12 illustrates the hydrophilicity plot, antigenic index and AMPHI regions of the products of protein expression the predicted ORF 576-1 as cloned and expressed in *E. coli*.

The primer described in Table 1 for ORF 576 was used to locate and clone ORF 576. The predicted gene 576 was cloned in pGex vector and expressed in *E. coli*. The product of protein purification was analyzed by SDS-PAGE. In panel A) is shown the analysis of 576-GST fusion protein purification. Mice were immunized with the purified 576-GST and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that ORF 576 is a surface-exposed protein and that it is a useful immunogen. The hydrophilicity plots, antigenic index, and amphipatic regions of ORF 576 are provided in FIG. 12. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

Example 5

Expression of ORF 519 and 519-1

Figure 13:
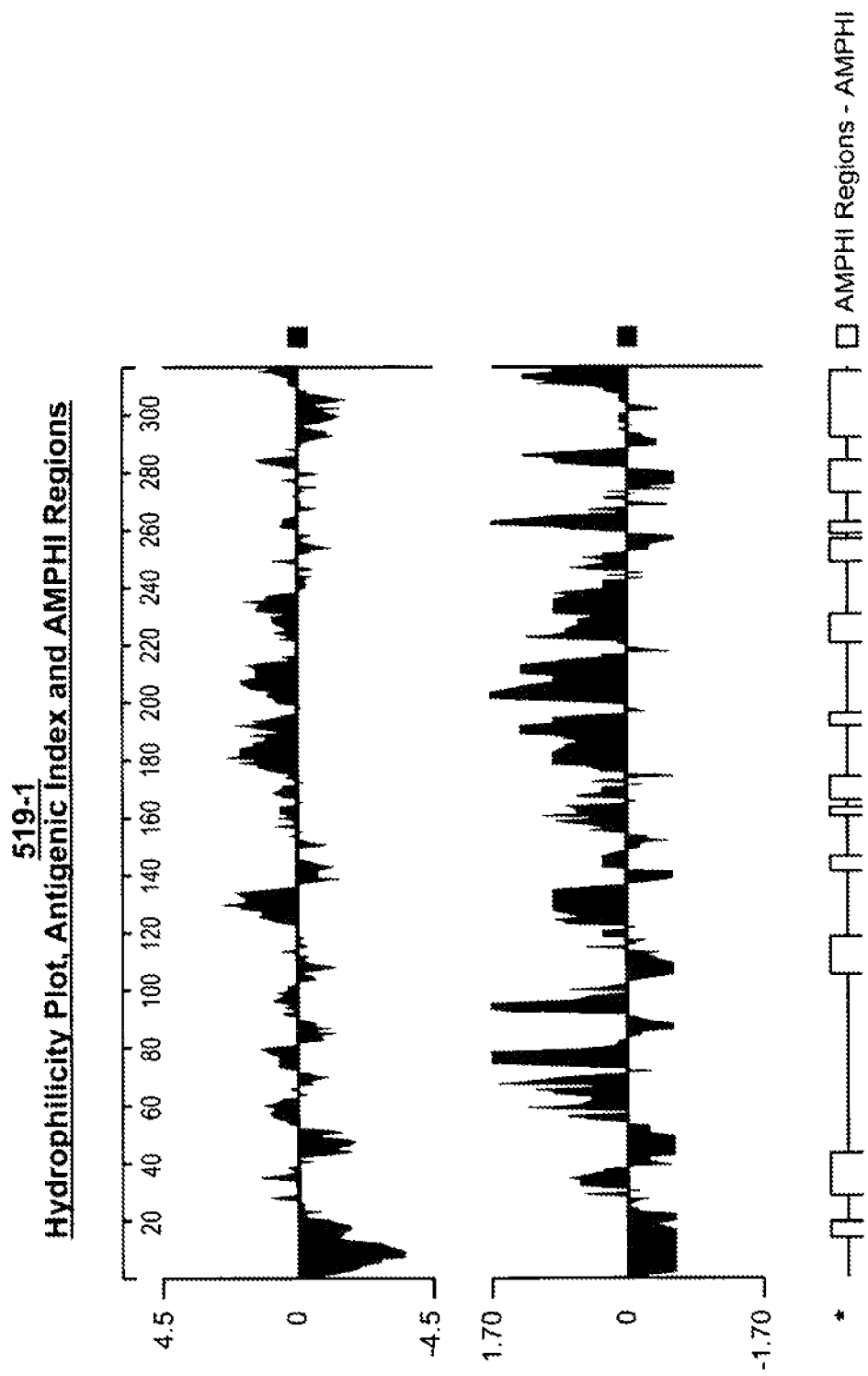
FIG. 13 illustrates the hydrophilicity plot, antigenic index and AMPHI regions of the products of protein expression the predicted ORF 519-1 as cloned and expressed in *E. coli*.

The primer described in Table 1 for ORF 519 was used to locate and clone ORF 519. The predicted gene 519 was cloned in pET vector and expressed in *E. coli*. The product of protein purification was analyzed by SDS-PAGE. In panel A) is shown the analysis of 519-His fusion protein purification. Mice were immunized with the purified 519-His and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 519 is a surface-exposed protein and that it is a useful immunogen. The hydrophilicity plots, antigenic index, and amphipatic regions of ORF 519 are provided in FIG. 13. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 519 and the amino acid sequence encoded thereby is provided in Example 1.

Example 6

Expression of ORF 121 and 121-1

Figure 14:
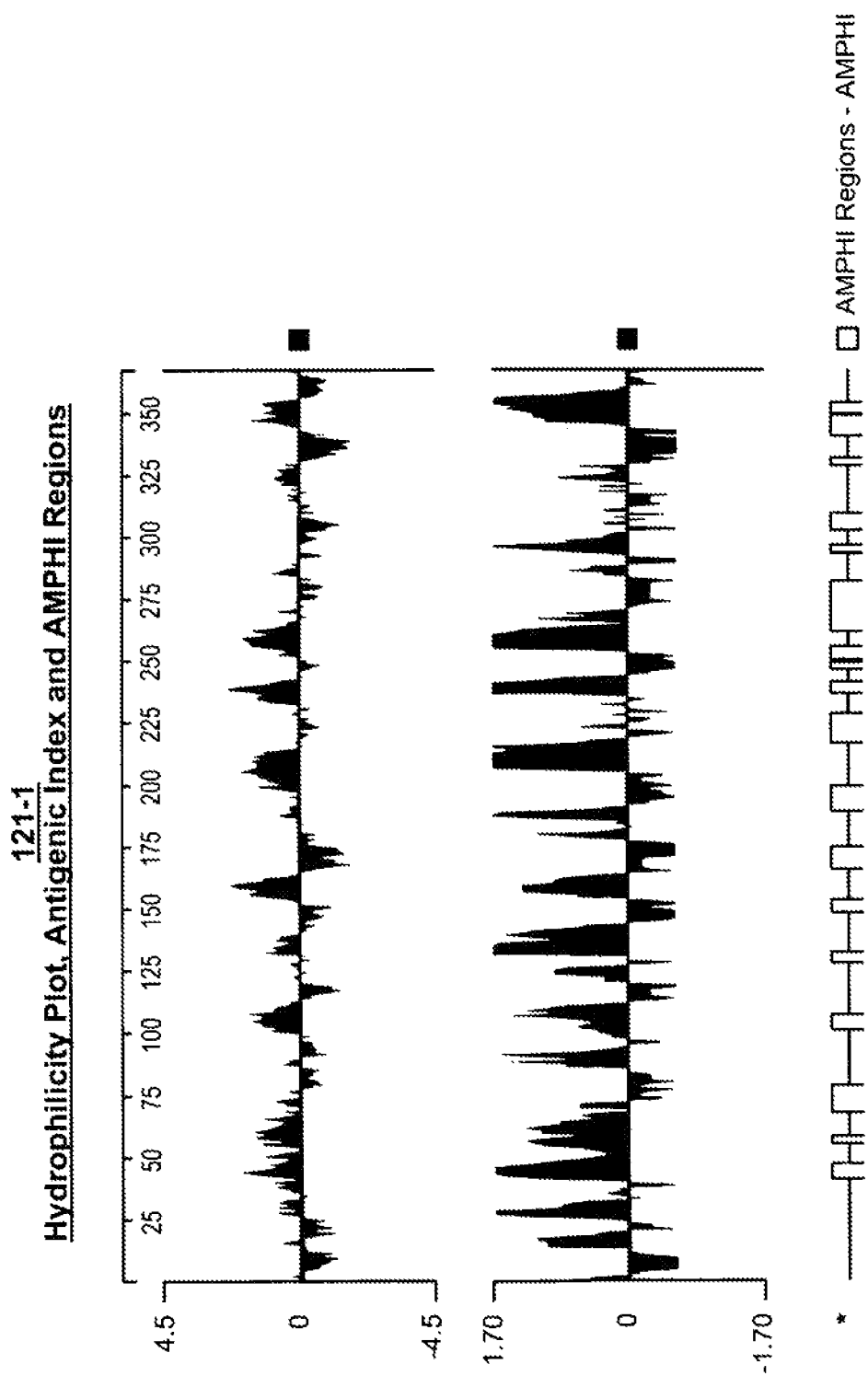
FIG. 14 illustrates the hydrophilicity plot, antigenic index and AMPHI regions of the products of protein expression the predicted ORF 121-1 as cloned and expressed in *E. coli*.

The primer described in Table 1 for ORF 121 was used to locate and clone ORF 121. The predicted gene 121 was cloned in pET vector and expressed in *E. coli*. The product of protein purification was analyzed by SDS-PAGE. In panel A) is shown the analysis of 121-His fusion protein purification. Mice were immunized with the purified 121-His and sera were used for Western blot analysis (panel B), FACS analysis (panel C), bactericidal assay (panel D), and ELISA assay (panel E). Results show that 121 is a surface-exposed protein. Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 121 is a surface-exposed protein and that it is a useful immunogen. The hydrophilicity plots, antigenic index, and amphipatic regions of ORF 121 are provided in FIG. 14. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 121 and the amino acid sequence encoded thereby is provided in Example 1.

Example 7

Expression of ORF 128 and 128-1

Figure 15:
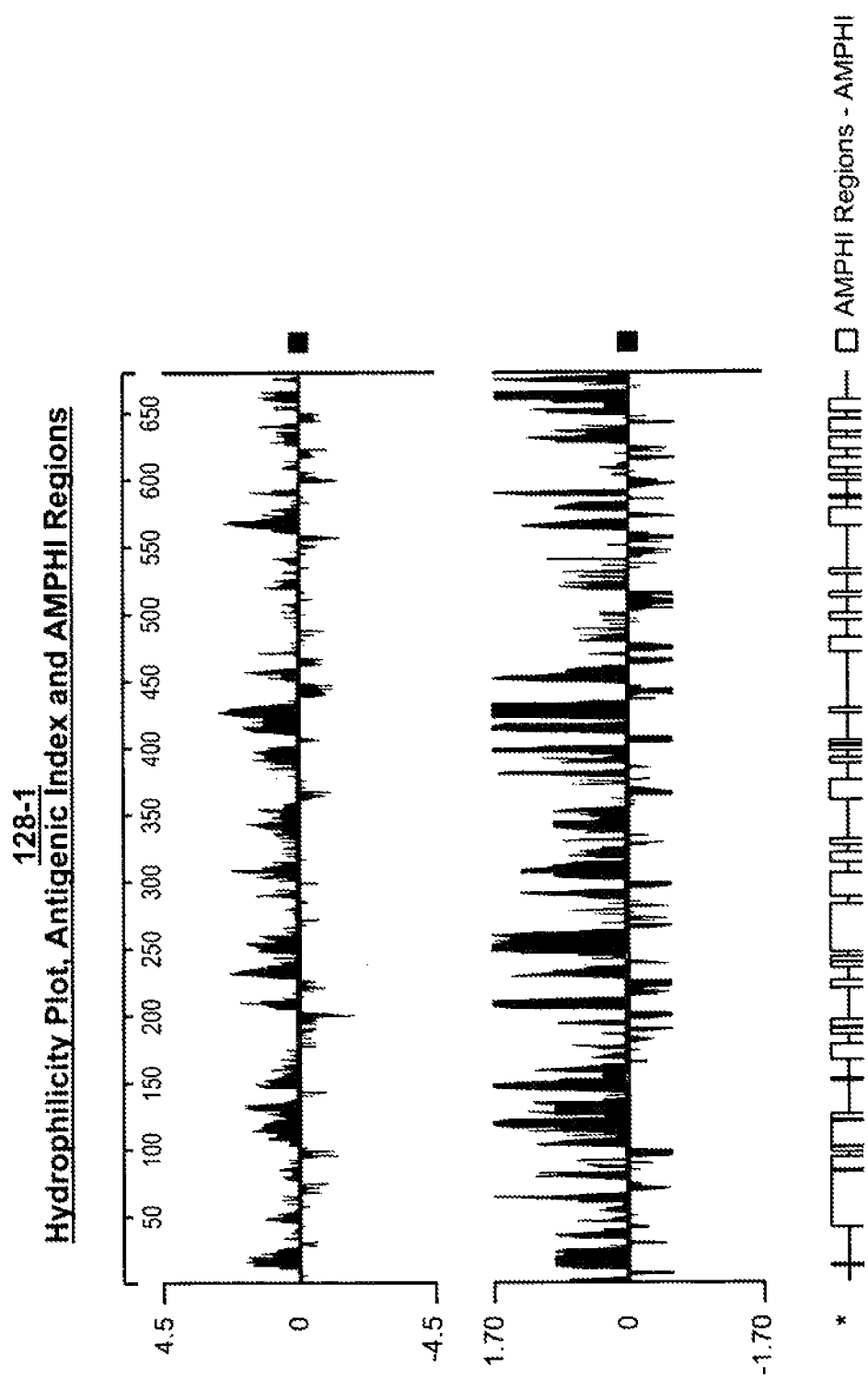
FIG. 15 illustrates the hydrophilicity plot, antigenic index and AMPHI regions of the products of protein expression the predicted ORF 128-1 as cloned and expressed in *E. coli*.

The primer described in Table 1 for ORF 128 was used to locate and clone ORF 128. The predicted gene 128 was cloned in pET vector and expressed in *E. coli*. The product of protein purification was analyzed by SDS-PAGE. In panel A) is shown the analysis of 128-His purification. Mice were immunized with the purified 128-His and sera were used for Western blot analysis (panel B), FACS analysis (panel C), bactericidal assay (panel D) and ELISA assay (panel E). Results show that 128 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 128 is a surface-exposed protein and that it is a useful immunogen. The hydrophilicity plots, antigenic index, and amphipatic regions of ORF 128 are provided in FIG. 15. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J*

*Immunol Suppl* 11:9). The nucleic acid sequence of ORF 128 and the amino acid sequence encoded thereby is provided in Example 1.

Example 8

Expression of ORF 206

Figure 16:
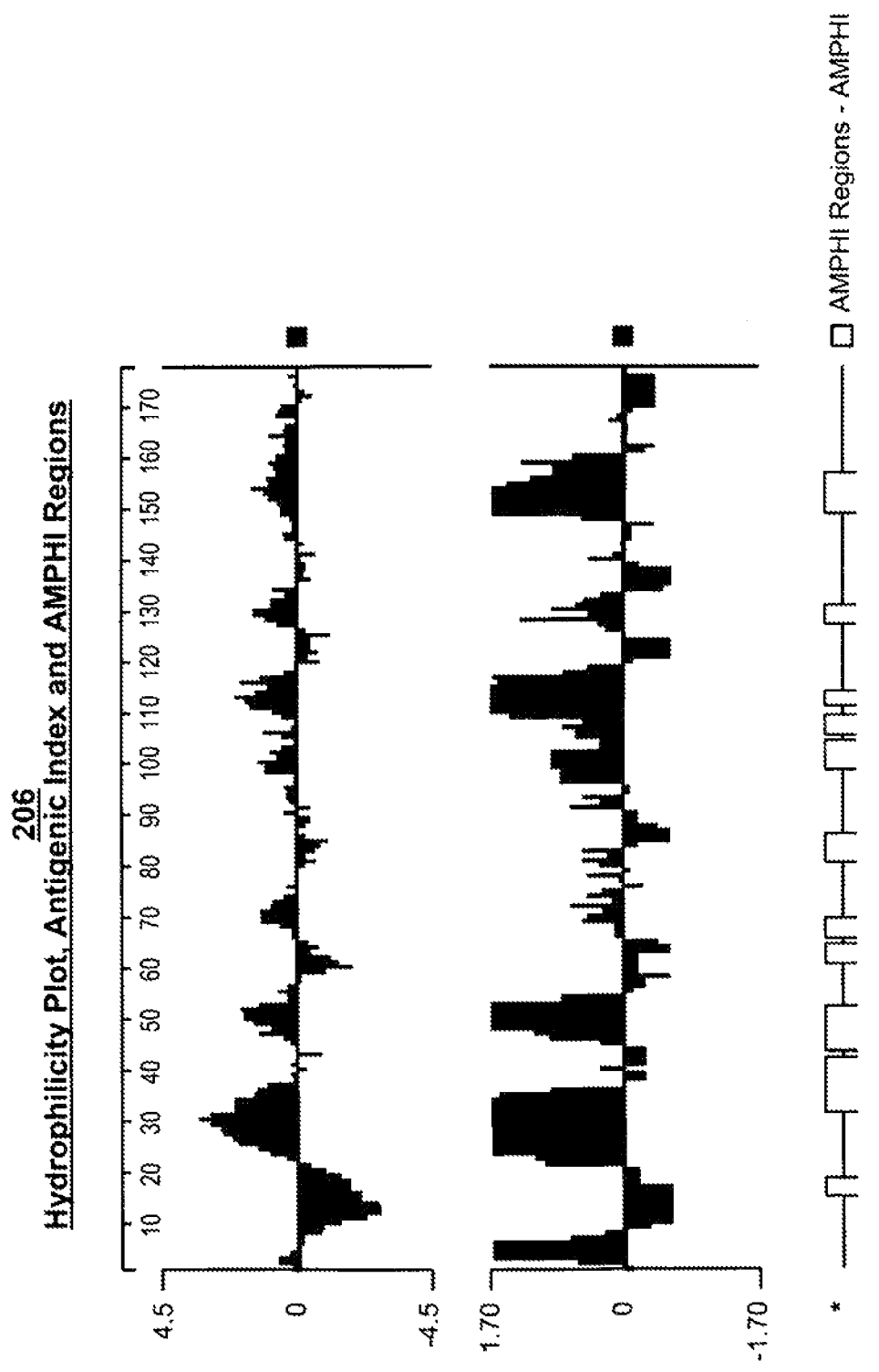
FIG. 16 illustrates the hydrophilicity plot, antigenic index and AMPHI regions of the products of protein expression the predicted ORF 206 as cloned and expressed in *E. coli*.

The primer described in Table 1 for ORF 206 was used to locate and clone ORF 206. The predicted gene 206 was cloned in pET vector and expressed in *E. coli*. The product of protein purification was analyzed by SDS-PAGE. In panel A) is shown the analysis of 206-His purification. Mice were immunized with the purified 206-His and sera were used for Western blot analysis (panel B). It is worth noting that the immunoreactive band in protein extracts from meningococcus is 38 kDa instead of 17 kDa (panel A). To gain information on the nature of this antibody staining we expressed ORF 206 in *E. coli* without the His-tag and including the predicted leader peptide. Western blot analysis on total protein extracts from *E. coli* expressing this native form of the 206 protein showed a reactive band at a position of 38 kDa, as observed in meningococcus. We conclude that the 38 kDa band in panel B) is specific and that anti-206 antibodies, likely recognize a multimeric protein complex. In panel C is shown the FACS analysis, in panel D the bactericidal assay, and in panel E) the ELISA assay. Results show that 206 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 206 is a surface-exposed protein and that it is a useful immunogen. The hydrophilicity plots, antigenic index, and amphipatic regions of ORF 519 are provided in FIG. 16. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 206 and the amino acid sequence encoded thereby is provided in Example 1.

Example 9

Expression of ORF 287

Figure 17:
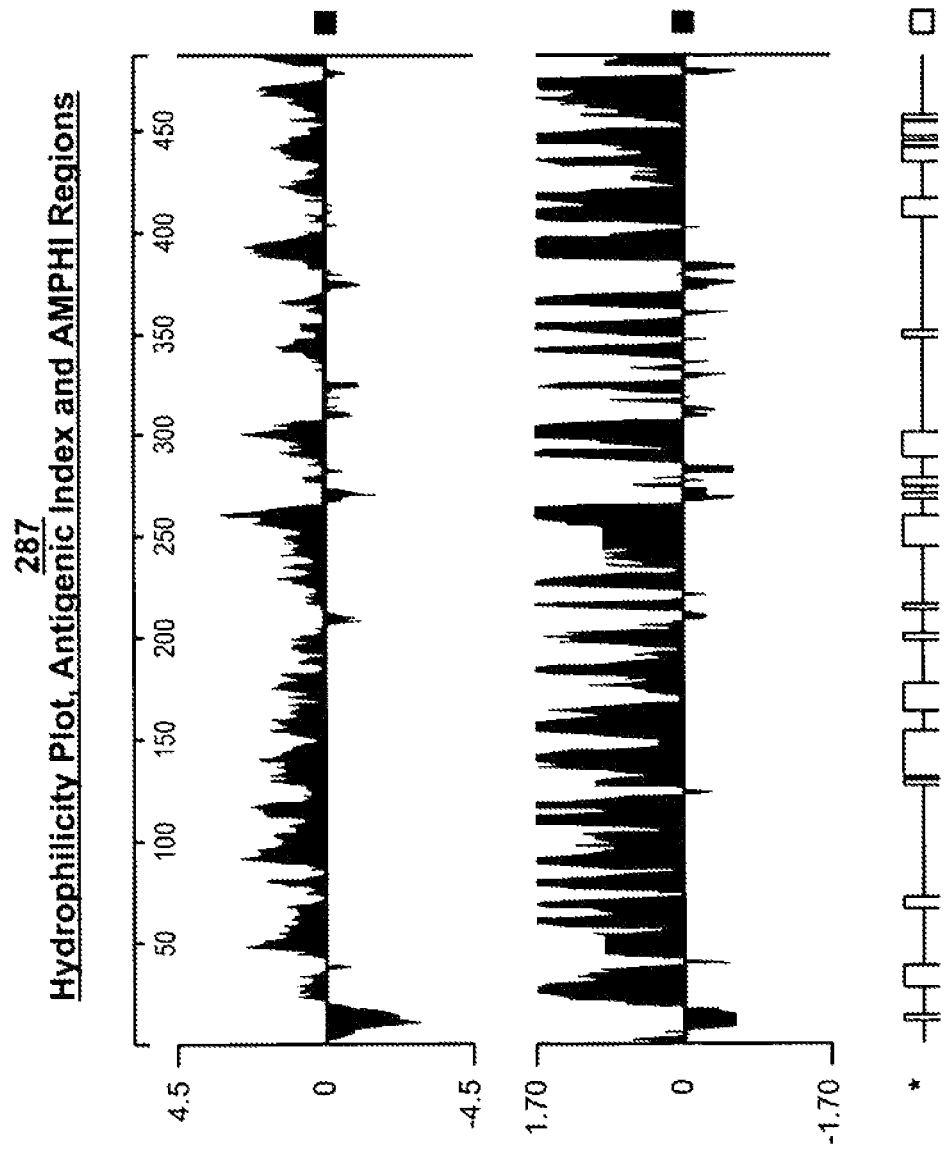
FIG. 17 illustrates the hydrophilicity plot, antigenic index and AMPHI regions of the products of protein expression the predicted ORF 287 as cloned and expressed in *E. coli*.

The primer described in Table 1 for ORF 287 was used to locate and clone ORF 287. The predicted gene 287 was cloned in pGex vector and expressed in *E. coli*. The product of protein purification was analyzed by SDS-PAGE. In panel A) is shown the analysis of 287-GST fusion protein purification. Mice were immunized with the purified 287-GST and sera were used for FACS analysis (panel B), bactericidal assay (panel C), and ELISA assay (panel D). Results show that 287 is a surface-exposed protein. Symbols: M1, molecular weight marker. Arrow indicates the position of the main recombinant protein product (A). These experiments confirm that 287 is a surface-exposed protein and that it is a useful immunogen. The hydrophilicity plots, antigenic index, and amphipatic regions of ORF 287 are provided in FIG. 17. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 287 and the amino acid sequence encoded thereby is provided in Example 1.

Example 10

Expression of ORF 406

Figure 18:
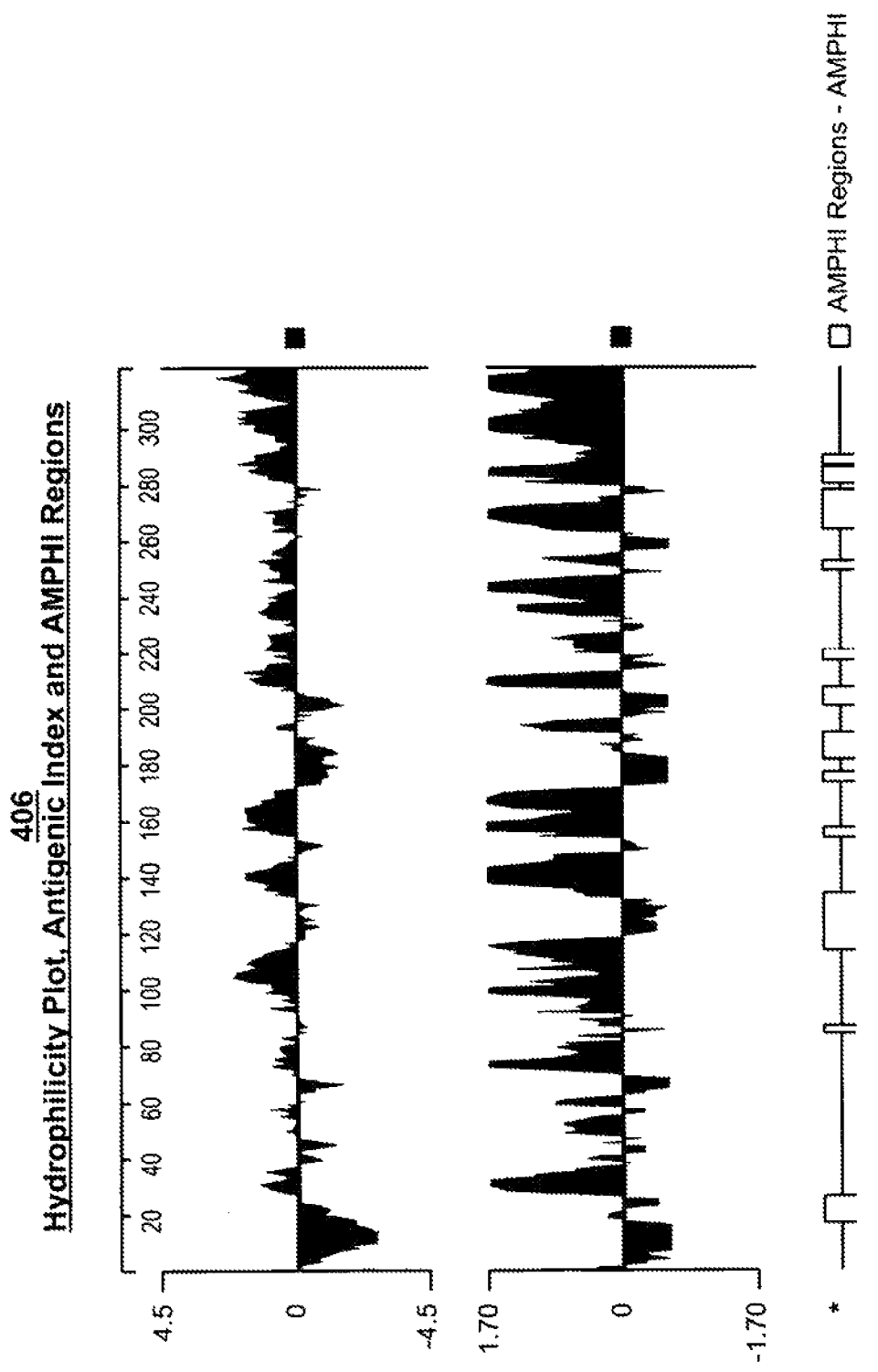
FIG. 18 illustrates the hydrophilicity plot, antigenic index and AMPHI regions of the products of protein expression the predicted ORF 406 as cloned and expressed in *E. coli*.

The primer described in Table 1 for ORF 406 was used to locate and clone ORF 406. The predicted gene 406 was cloned in pET vector and expressed in *E. coli*. The product of protein purification was analyzed by SDS-PAGE. In panel A) is shown the analysis of 406-His fusion protein purification. Mice were immunized with the purified 406-His and sera were used for Western blot analysis (panel B), FACS analysis (panel C), bactericidal assay (panel D), and ELISA assay (panel E). Results show that 406 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 406 is a surface-exposed protein and that it is a useful immunogen. The hydrophilicity plots, antigenic index, and amphipatic regions of ORF 406 are provided in FIG. 18. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 406 and the amino acid sequence encoded thereby is provided in Example 1.

Example 11

Table 2 lists several *Neisseria* strains which were used to assess the conservation of the sequence of ORF 225 among different strains.

TABLE 2

225 gene variability: List of used *Neisseria* strains

| Identification Strains number | Source/reference |
|---|---|
| Group B | |
| zo01_225 NG6/88 | R. Moxon/Seiler et al., 1996 |
| zo02_225 BZ198 | R. Moxon/Seiler et al., 1996 |
| zo03_225 NG3/88 | R. Moxon/Seiler et al., 1996 |
| zo04_225 297-0 | R. Moxon/Seiler et al., 1996 |
| zo05_225 1000 | R. Moxon/Seiler et al., 1996 |
| zo06_225 BZ147 | R. Moxon/Seiler et al., 1996 |
| zo07_225 BZ169 | R. Moxon/Seiler et al., 1996 |
| zo08_225 528 | R. Moxon/Seiler et al., 1996 |
| zo09_225 NGP165 | R. Moxon/Seiler et al., 1996 |
| zo10_225 BZ133 | R. Moxon/Seiler et al., 1996 |
| zo11_225 NGE31 | R. Moxon/Seiler et al., 1996 |
| zo12_225 NGF26 | R. Moxon/Seiler et al., 1996 |
| zo13_225 NGE28 | R. Moxon/Seiler et al., 1996 |
| zo14_225 NGH38 | R. Moxon/Seiler et al., 1996 |
| zo15_225 SWZ107 | R. Moxon/Seiler et al., 1996 |
| zo16_225 NGH15 | R. Moxon/Seiler et al., 1996 |
| zo17_225 NGH36 | R. Moxon/Seiler et al., 1996 |
| zo18_225 BZ232 | R. Moxon/Seiler et al., 1996 |
| zo19_225 BZ83 | R. Moxon/Seiler et al., 1996 |
| zo20_225 44/76 | R. Moxon/Seiler et al., 1996 |
| zo21_225 MC58 | R. Moxon |
| zo96_225 2996 | Our collection |
| Group A | |
| zo22_225 205900 | R. Moxon |
| zo23_225 F6124 | R. Moxon |
| z2491 Z2491 | R. Moxon/Maiden et al., 1998 |

TABLE 2-continued

225 gene variability: List of used Neisseria strains

| Identification Strains number | Source/reference |
|---|---|
| Group C | |
| zo24_225 90/18311 | R. Moxon |
| zo25_225 93/4286 | R. Moxon |
| Others | |
| zo26_225 A22 (group W) | R. Moxon/Maiden et al., 1998 |
| zo27_225 E26 (group X) | R. Moxon/Maiden et al., 1998 |
| zo28_225 860800 (group Y) | R. Moxon/Maiden et al., 1998 |
| zo29_225 E32 (group Z) | R. Moxon/Maiden et al., 1998 |
| Gonococcus | |
| zo32_225 Ng F62 | R. Moxon/Maiden et al., 1998 |
| zo33_225 Ng SN4 | R. Moxon |
| fa1090 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

```
>FA1090
                                                     <SEQ ID 3115>
MDSFFKPAVWAVLWLMFAVRPALADELTNLLSSREQILRQFAEDEQPVLPVNRAPARRAG
NADELIGSAMGLNEQPVLPVNRAPARRAGNADELIGSAMGLLGIAYRYGGTSVSTGFDCS
GFMQHIFKRAMGINLPRTSAEQARMGAPVARSELQPGDMVFFRTLGGSRISHVGLYIGNN
RFIHAPRTGKNIEITSLSHKYWSGKYAFARRVKKNDPSRFLN*

Z2491
                                                     <SEQ ID 3116>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRVPARRAGNA
DELIGNAMGLNEQPVLPVNRAPARRAGNADELIGNAMGLLGIAYRYGGTSISTGFDCSGF
MQHIFKRAMGINLPRTSAEQARMGTPVARSELQPGDMVFFRTLGGSRISHVGLYIGNNRF
IHAPRTGKNIEITSLSHKYWSGKYAFARRVKKNDPSRFLN*

ZO01_225
                                                     <SEQ ID 3117>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO02_225
                                                     <SEQ ID 3118>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO03_225
                                                     <SEQ ID 3119>
MDSFFKPAVWAVLWLMFAVRLALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO04_225
                                                     <SEQ ID 3120>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO05_225
                                                     <SEQ ID 3121>
MDSFFKPAVWAVLWLMFAVRPALADELTNLLSSREQILRQFAEDEQPVLPINRAPARRAG
NADELIGSAMGLNEQPVLPVNRVPARRAGNADELIGSAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO06_225
                                                     <SEQ ID 3122>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
```

-continued

SELQPGDMVFFRTLGGSRISHVGLYIGNNRFIHAPRTGKNIEITSLSHKYWSGKYAFARR
VKKNDPSRFLN*

ZO07_225
<SEQ ID 3123>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO08_225
<SEQ ID 3124>
MDSFFKPAVWAVLWLMFAVRPALADELTNLLSSREQILRQFAEDEQPVLPINRAPARRAG
NADELIGSAMGLNEQPVLPVNRVPARRAGNADELIGSAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO09_225
<SEQ ID 3125>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO10_225
<SEQ ID 3126>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO11_225
<SEQ ID 3127>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLNEQPVLPVNRAPARRAGNADELIGNAMGLLGIAYRYGGTSVSTGFDCSGF
MQHIFKRAMGINLPRTSAEQARMGTPVARSELQPGDMVFFRTLGGSRISHVGLYIGNNRF
IHAPRTGKNIEITSLSHKYWSGKYAFARRVKKNDPSRFLN*

ZO12_225
<SEQ ID 3128>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO13_225
<SEQ ID 3129>
MDSFFKPAVWAVLWLMFAVRPALADELTNLLSSREQILRQFAEDEQPVLPVNRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFIQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO14_225
<SEQ ID 3130>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO15_225
<SEQ ID 3131>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLLGIAYRYGGTSVSTGFDCS
GFMQHIFKRAMGINLPRTSAEQARMGTPVARSELQPGDMVFFRTLGGSRISHVGLYIGNN
RFIHAPRTGKNIEITSLSHKYWSGKYAFARRVKKNDPSRFLN*

ZO16_225
<SEQ ID 3132>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO17_225
<SEQ ID 3133>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO18_225
<SEQ ID 3134>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO19_225
<SEQ ID 3135>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO20_225
<SEQ ID 3136>
MDSFFKPAVWAVLWLMFAVRPALADELTNLLSSREQILRQFAEDEQPVLPINRAPARRAG
NADELIGSAMGLNEQPVLPINRAPARRAGNADELIGSAMGLNEQPVLPVNRVPARRAGNA
DELIGNAMGLNEQPVLPVNRAPARRAGNADELIGNAMGLLGIAYRYGGTSVSTGFDCSGF
MQHIFKRAMGINLPRTSAEQARMGTPVARSELQPGDMVFFRTLGGSRISHVGLYIGNNRF
IHAPRTGKNIEITSLSHKYWSGKYAFARRVKKNDPSRFLN*

ZO21_225
<SEQ ID 3137>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO22_225
<SEQ ID 3138>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO23_225
<SEQ ID 3139>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO24_225
<SEQ ID 3140>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO25_225
<SEQ ID 3141>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO26_225
<SEQ ID 3142>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

```
ZO27_225
                                                         <SEQ ID 3143>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO28_225
                                                         <SEQ ID 3144>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO29_225
                                                         <SEQ ID 3145>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO32_225
                                                         <SEQ ID 3146>
MDSFFKPAVWAVLWLMFAVRPALADELTNLLSSREQILRQFAEDEQPVLPVNRAPARRAG
NADELIGSAMGLNEQPVLPVNRAPARRAGNADELIGSAMGLLGIAYRYGGTSVSTGFDCS
GFMQHIFKRAMGINLPRTSAEQARMGAPVARSELQPGDMVFFRTLGGSRISHVGLYIGNN
RFIHAPRTGKNIEITSLSHKYWSGKYAFARRVKKNDPSRFLN*

ZO33_225
                                                         <SEQ ID 3147>
MDSFFKPAVWAVLWLMFAVRSALADELTNLLSSREQILRQFAEDEQPVLPVNRAPARRAG
NADELIGSAMGLNEQPVLPVNRAPARRAGNADELIGSAMGLLGIAYRYGGTSVSTGFDCS
GFMQHIFKRAMGINLPRTSAEQARMGAPVARSELQPGDMVFFRTLGGSRISHVGLYIGNN
RFIHAPRTGKNIEITSLSHKYWSGKYAFARRIKKNDPSRFLN*

ZO96_225
                                                         <SEQ ID 3148>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*
```

FIG. 19 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 12

Table 3 lists several *Neisseria* strains which were used to assess the conservation of the sequence of ORF 235 among different strains.

TABLE 3

235 gene variability: List of used *Neisseria* strains

| Identification Strains number | Reference |
|---|---|
| Group B | |
| gnmzq01 NG6/88 | Seiler et al., 1996 |
| gnmzq02 BZ198 | Seiler et al., 1996 |
| gnmzq03 NG3/88 | Seiler et al., 1996 |
| gnmzq04 1000 | Seiler et al., 1996 |
| gnmzq05 1000 | Seiler et al., 1996 |
| gnmzq07 BZ169 | Seiler et al., 1996 |
| gnmzq08 528 | Seiler et al., 1996 |
| gnmzq09 NGP165 | Seiler et al., 1996 |
| gnmzq10 BZ133 | Seiler et al., 1996 |
| gnmzq11 NGE31 | Seiler et al., 1996 |
| gnmzq13 NGE28 | Seiler et al., 1996 |
| gnmzq14 NGH38 | Seiler et al., 1996 |
| gnmzq15 SWZ107 | Seiler et al., 1996 |
| gnmzq16 NGH15 | Seiler et al., 1996 |
| gnmzq17 NGH36 | Seiler et al., 1996 |
| gnmzq18 BZ232 | Seiler et al., 1996 |
| gnmzq19 BZ83 | Seiler et al., 1996 |
| gnmzq21 MC58 | Virji et al., 1992 |
| Group A | |
| gnmzq22 205900 | Our collection |
| gnmzq23 F6124 | Our collection |
| z2491 Z2491 | Maiden et al., 1998 |

TABLE 3-continued

235 gene variability: List of used *Neisseria* strains

| Identification Strains number | Reference |
|---|---|
| Group C | |
| gnmzq24 90/18311 | Our collection |
| gnmzq25 93/4286 | Our collection |
| Others | |
| gnmzq26 A22 (group W) | Maiden et al., 1998 |
| gnmzq27 E26 (group X) | Maiden et al., 1998 |
| gnmzq28 860800 (group Y) | Maiden et al., 1998 |
| gnmzq29 E32 (group Z) | Maiden et al., 1998 |
| gnmzq31 *N. lactamica* | Our collection |
| Gonococcus | |
| gnmzq32 Ng F62 | Maiden et al., 1998 |
| gnmzq33 Ng SN4 | Our collection |
| fa1090 FA1090 | Dempsey et al. 1991 |

References:
Seiler A. et al., Mol. Microbiol., 1996, 19(4): 841-856.
Maiden R. et al., Proc. Natl. Acad. Sci. USA, 1998, 95: 3140-3145.
Virji M. et al., Mol. Microbiol., 1992, 6: 1271-1279
Dempsey J. F. et al., J. Bacteriol., 1991, 173: 5476-5486

The amino acid sequences for each listed strain are as follows:

FA1090
<SEQ ID 3149>
MKPLILGLAAVLALSACQVRKAPDLDYTSFKESKPASILVVPPLNESPDVNGTWGMLAST
AAPISEAGYYVFPAAVVEETFKENGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSRNGILKGPRFVEEQPK*

GNMZQ01
<SEQ ID 3150>
MKPLILGLAAVLALSACQVQKAPDFDYTSFKESKPASILVVPPLNESPDVNGTWGVLAST
AAPLSEAGYYVFPAAVVEETFKENGLTNAADIHAVRPEKLHQIFGNDAVLYITVTEYGTS
YQILDSVTTVSAKARLVDSRNGKELWSGSASIREGSNNSNSGLLGALVSAVVNQIANNLT
DRGYQVSKTAAYNLLSPYSHNGILKGPRFVEEQPK*

GNMZQ02
<SEQ ID 3151>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ03
<SEQ ID 3152>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ04
<SEQ ID 3153>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ05
<SEQ ID 3154>
MKPLILGLAAVLALSACQVQKAPDFDYTSFKESKPASILVVPPLNESPDVNGTWGVLAST
AAPLSEAGYYVFPAAVVEETFKENGLTNAADIHAVRPEKLHQIFGNDAVLYITVTEYGTS
YQILDSVTTVSAKARLVDSRNGKELWSGSASIREGSNNSNSGLLGALVSAVVNQIANNLT
DRGYQVSKTAAYNLLSPYSHNGILKGPRFVEEQPK*

GNMZQ07
<SEQ ID 3155>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ08
<SEQ ID 3156>
MKPLILGLAAVLALSACQVQKAPDFDYTSFKESKPASILVVPPLNESPDVNGTWGVLAST
AAPLSEAGYYVFPAAVVEETFKENGLTNAADIHAVRPEKLHQIFGNDAVLYITVTEYGTS
YQILDSVTTVSAKARLVDSRNGKELWSGSASIREGSNNSNSGLLGALVSAVVNQIANNLT
DRGYQVSKTAAYNLLSPYSHNGILKGPRFVEEQPK*

GNMZQ09
<SEQ ID 3157>
MKPLILGLAAALVLSACQVQKAPDFDYTSFKESKPASILVVPPLNESPDVNGTWGMLAST
AEPLSEAGYYVFPAAVVEETFKQNGLTNAADIHAVQPEKLHQIFGNDAVLYITITEYGTS
YQILDSVTTVSARARLVDSRNGKVLWSGSASIREGSNNSNSGLLGALVSAVVNQIANSLT
DRGYQVSKTAAYNLLSPYSHNGILKGPRFVEEQPK*

GNMZQ10
<SEQ ID 3158>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ11
<SEQ ID 3159>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ13
<SEQ ID 3160>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ14
<SEQ ID 3161>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSHNGILKGPRFVEEQPK*

GNMZQ15
<SEQ ID 3162>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ16
<SEQ ID 3163>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ17
<SEQ ID 3164>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ18
<SEQ ID 3165>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSHNGILKGPRFVEEQPK*

GNMZQ19
<SEQ ID 3166>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ21
<SEQ ID 3166>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ22
<SEQ ID 3167>
MKPLILGLAAVLALSACQVQKAPDFDYTSFKESKPASILVVPPLNESPDVNGTWGVLAST
AAPLSEAGYYVFPPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ23
<SEQ ID 3168>
MKPLILGLAAVLALSACQVQKAPDFDYTSFKESKPASILVVPPLNESPDVNGTWGVLAST
AAPLSEAGYYVFPPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ24
<SEQ ID 3169>
MKPLILGLAAVLALSACQVQKAPDFDYTSFKESKPASILVVPPLNESPDVNGTWGVLAST
AAPLSEAGYYVFPPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ25
<SEQ ID 3170>
MKPLILGLAAVLALSACQVQKAPDFDYTSFKESKPASILVVPPLNESPDVNGTWGVLAST
AAPLSEAGYYVFPPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ26
<SEQ ID 3171>
MKPLILGLAAVLALSACQVQKAPDFDYTSFKESKPASILVVPPLNESPDVNGTWGMLAST
AAPLSEAGYYVFPPAAVVEETFKQNGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSHNGILKGPRFVEEQPK*

GNMZQ27
<SEQ ID 3172>
MKPLILGLAAVLALSACQVQKAPDFDYTSFKESKPASILVVPPLNESPDVNGTWGVLAST
AAPLSEAGYYVFPPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ28
<SEQ ID 3173>
MKPLILGLAAVLALSACQVQKAPDFDYTSFKESKPASILVVPPLNESPDVNGTWGVLAST
AAPLSEAGYYVFPPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ29
<SEQ ID 3174>
MKPLILGLAAVLALSACQVQKAPDFDYTSFKESKPASILVVPPLNESPDVNGTWGVLAST
AAPLSEAGYYVFPPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ31
<SEQ ID 3175>
MKPLILGLAAVLALSACQVQKAPDFDYTAFKESKPASILVVPPLNESPDVNGTWGMLAST
AEPLSEAGYYVFPPAAVVEETFKQNGLTNAADIHAVRPEKLHQIFGNDAVLYITITEYGTS
YQILDSVTTVSARARLVDSRNGKVLWSGSASIREGSNNSNSGLLGALVGAVVNQIANSLT
DRGYQVSKAAAYDLLSPYSHNGILKGPRFVEEQPK*

GNMZQ32
<SEQ ID 3176>
MKPLILGLAAVLALSACQVRKAPDLDYTSFKESKPASILVVPPLNESPDVNGTWGMLAST
AAPISEAGYYVFPPAAVVEETFKENGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSRNGILKGPRFVEEQPK*

GNMZQ33
<SEQ ID 3177>
MKPLILGLAAVLALSACQVRKAPDLDYTSFKESKPASILVVPPLNESPDVNGTWGMLAST
AAPISEAGYYVFPPAAVVEETFKENGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSRNGILKGPRFVEEQPK*

```
Z2491
                                                              <SEQ ID 3178>
MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*
```

FIG. 20 shows the results of aligning the sequences of each of these strains. Dark shading indicates regions of homology, and gray shading indicates the conservation of amino acids with similar characteristics. As is readily discernible, there is significant conservation among the various strains of ORF 235, further confirming its utility as an antigen for both vaccines and diagnostics.

Example 13

Table 4 lists several *Neisseria* strains which were used to assess the conservation of the sequence of ORF 287 among different strains.

TABLE 4

**287 gene variability: List of used *Neisseria* strains**

| Identification Strains number | Reference |
|---|---|
| Group B | |
| 287_2 BZ198 | Seiler et al., 1996 |
| 287_9 NGP165 | Seiler et al., 1996 |
| 287_14 NGH38 | Seiler et al., 1996 |
| 287_21 MC58 | Virji et al., 1992 |
| Group A | |
| z2491 Z2491 | Maiden et al., 1998 |
| Gonococcus | |
| fa1090 FA1090 | Dempsey et al. 1991 |

References:
Seiler A. et al., Mol. Microbiol., 1996, 19(4): 841-856.
Maiden R. et al., Proc. Natl. Acad. Sci. USA, 1998, 95: 3140-3145.
Virji M. et al., Mol. Microbiol., 1992, 6: 1271-1279
Dempsey J. F. et al., J. Bacteriol., 1991, 173: 5476-5486

The amino acid sequences for each listed strain are as follows:

```
287_14
                                                              <SEQ ID 3179>
MFKRSVIAMACIFALSACGGGGGSPDVKSADTLSKPAAPVVSEKETEAKEDAPQAGSQG
QGAPSAQGGQDMAAVSEENTGNGGAAATDKPKNEDEGAQNDMPQNAADTDSLTPNHTPAS
NMPAGNMENQAPDAGESEQPANQPDMANTADGMQGDDPSAGGENAGNTAAQGTNQAENNQ
TAGSQNPASSTNPSATNSGGDFGRTNVGNSVVIDGPSQNITLTHCKGDSCSGNNFLDEEV
QLKSEFEKLSDADKISNYKKDGKNDGKNDKFVGLVADSVQMKGINQYIIFYKPKPTSFAR
FRRSARSRRSLPAEMPLIPVNQADTLIVDGEAVSLPGHSGNIFAPEGNYRYLTYGAEKLP
GGSYALRVQGEPSKGEMLAGTAVYNGEVLHFHTENGRPSPSRGRFAAKVDFGSKSVDGII
DSGDGLHMGTQKFKAAIDGNGFKGTWTENGGGDVSGKFYGPAGEEVAGKYSYRPTDAEKG
GFGVFAGKKEQD*

287_2
                                                              <SEQ ID 3180>
MFKRSVIAMACIFALSACGGGGGSPDVKSADTLSKPAAPVVSEKETEAKEDAPQAGSQG
QGAPSAQGGQDMAAVSEENTGNGGAAATDKPKNEDEGAQNDMPQNAADTDSLTPNHTPAS
NMPAGNMENQAPDAGESEQPANQPDMANTADGMQGDDPSAGGENAGNTAAQGTNQAENNQ
TAGSQNPASSTNPSATNSGGDFGRTNVGNSVVIDGPSQNITLTHCKGDSCSGNNFLDEEV
QLKSEFEKLSDADKISNYKKDGKNDGKNDKFVGLVADSVQMKGINQYIIFYKPKPTSFAR
FRRSARSRRSLPAEMPLIPVNQADTLIVDGEAVSLTGHSGNIFAPEGNYRYLTYGAEKLP
GGSYALRVQGEPSKGEMLAGTAVYNGEVLHFHTENGRPSPSRGRFAAKVDFGSKSVDGII
DSGDGLHMGTQKFKAAIDGNGFKGTWTENGGGDVSGKFYGPAGEEVAGKYSYRPTDAEKG
GFGVFAGKKEQD*

287_21.
                                                              <SEQ ID 3181>
MFKRSVIAMACIFALSACGGGGGSPDVKSADTLSKPAAPVVSEKETEAKEDAPQAGSQG
QGAPSAQGSQDMAAVSEENTGNGGAVTADNPKNEDEVAQNDMPQNAAGTDSSTPNHTPDP
NMLAGNMENQATDAGESSQPANQPDMANAADGMQGDDPSAGGQNAGNTAAQGANQAGNNQ
AAGSSDPIPASNPAPANGGSNFGRVDLANGVLIDGPSQNITLTHCKGDSCSGNNFLDEEV
QLKSEFEKLSDADKISNYKKDGKNDKFVGLVADSVQMKGINQYIIFYKPKPTSFARFRRS
ARSRRSLPAEMPLIPVNQADTLIVDGEAVSLTGHSGNIFAPEGNYRYLTYGAEKLPGGSY
ALRVQGEPAKGEMLAGAAVYNGEVLHFHTENGRPYPTRGRFAAKVDFGSKSVDGIIDSGD
DLHMGTQKFKAAIDGNGFKGTWTENGSGDVSGKFYGPAGEEVAGKYSYRPTDAEKGGFGV
FAGKKEQD*

287_9
                                                              <SEQ ID 3182>
MFKRSVIAMACIVALSACGGGGGSPDVKSADTLSKPAAPVVTEDVGEEVLPKEKKDEEA
VSGAPQADTQDATAGKGGQDMAAVSAENTGNGGAATTDNPENKDEGPQNDMPQNAADTDS
STPNHTPAPNMPTRDMGNQAPDAGESAQPANQPDMANAADGMQGDDPSAGENAGNTADQA
ANQAENNQVGGSQNPASSTNPNATNGGSDFGRINVANGIKLDSGSENVTLTHCKDKVCDR
DFLDEEAPPKSEFEKLSDEEKINKYKKDEQRENFVGLVADRVEKNGTNKYVIIYKDKSAS
```

-continued

```
SSSARFRRSARSRRSLPAEMPLIPVNQADTLIVDGEAVSLTGHSGNIFAPEGNYRYLTYG
AEKLSGGSYALSVQGEPAKGEMLAGTAVYNGEVLHFHMENGRPSPSGGRFAAKVDFGSKS
VDGIIDSGDDLHMGTQKFKAVIDGNGFKGTWTENGGGDVSGRFYGPAGEEVAGKYSYRPT
DAEKGGFGVFAGKKEQD*

FA1090
                                                    <SEQ ID 3183>
MFKRSVIAMACIFPLSACGGGGGSPDVKSADTPSKPAAPVVAENAGEGVLPKEKKDEEA
AGGAPQADTQDATAGEGSQDMAAVSAENTGNGGAATTDNPKNEDAGAQNDMPQNAAESAN
QTGNNQPAGSSDSAPASNPAPANGGSDFGRTNVGNSVVIDGPSQNITLTHCKGDSCNGDN
LLDEEAPSKSEFEKLSDEEKIKRYKKDEQRENFVGLVADRVKKDGTNKYIIFYTDKPPTR
SARSRRSLPAEIPLIPVNQADTLIVDGEAVSLTGHSGNIFAPEGNYRYLTYGAEKLPGGS
YALRVQGEPAKGEMLVGTAVYNGEVLHFHMENGRPYPSGGRFAAKVDFGSKSVDGIIDSG
DDLHMGTQKFKAAIDGNGFKGTWTENGGGDVSGRFYGPAGEEVAGKYSYRPTDAEKGGFG
VFAGKKDRD*

Z2491
                                                    <SEQ ID 3184>
MFKRSVIAMACIFALSACGGGGGGSPDVKSADTLSKPAAPVVSEKETEAKEDAPQAGSQG
QGAPSAQGSQDMAAVSEENTGNGGAVTADNPKNEDEVAQNDMPQNAAGTDSSTPNHTPDP
NMLAGNMENQATDAGESSQPANQPDMANAADGMQGDDPSAGGQNAGNTAAQGANQAGNNQ
AAGSSDPIPASNPAPANGGSNFGRVDLANGVLIDGPSQNITLTHCKGDSCSGNNFLDEEV
QLKSEFEKLSDADKISNYKKDGKNDKFVGLVADSVQMKGINQYIIFYKPKPTSFARFRRS
ARSRRSLPAEMPLIPVNQADTLIVDGEAVSLTGHSGNIFAPEGNYRYLTYGAEKLPGGSY
ALRVQGEPAKGEMLAGAAVYNGEVLHFHTENGRPYPTRGRFAAKVDFGSKSVDGIIDSGD
DLHMGTQKFKAAIDGNGFKGTWTENGSGDVSGKFYGPAGEEVAGKYSYRPTDAEKGGFGV
FAGKKEQD*
```

FIG. 21 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 14

Table 5 lists several *Neisseria* strains which were used to assess the conservation of the sequence of ORF 519 among different strains.

TABLE 5

519 gene variability: List of used *Neisseria* strains

| Identification Strains number | Source/reference |
| --- | --- |
| Group B | |
| zv01_519 NG6/88 | R. Moxon/Seiler et al., 1996 |
| zv02_519 BZ198 | R. Moxon/Seiler et al., 1996 |
| zv03_519ass NG3/88 | R. Moxon/Seiler et al., 1996 |
| zv04_519 297-0 | R. Moxon/Seiler et al., 1996 |
| zv05_519 1000 | R. Moxon/Seiler et al., 1996 |
| zv06_519ass BZ147 | R. Moxon/Seiler et al., 1996 |
| zv07_519 BZ169 | R. Moxon/Seiler et al., 1996 |
| zv11_519 NGE31 | R. Moxon/Seiler et al., 1996 |

TABLE 5-continued 519 gene variability: List of used *Neisseria* strains

| Identification Strains number | Source/reference |
| --- | --- |
| zv12_519 NGF26 | R. Moxon/Seiler et al., 1996 |
| zv18_519 BZ232 | R. Moxon/Seiler et al., 1996 |
| zv19_519 BZ83 | R. Moxon/Seiler et al., 1996 |
| zv20_519ass 44/76 | R. Moxon/Seiler et al., 1996 |
| zv21_519ass MC58 | R. Moxon |
| zv96_519 2996 | Our collection |
| Group A | |
| zv22_519ass 205900 | R. Moxon |
| z2491_519 Z2491 | R. Moxon/Maiden et al., 1998 |
| Others | |
| zv26_519 A22 (group W) | R. Moxon/Maiden et al., 1998 |
| zv27_519 E26 (group X) | R. Moxon/Maiden et al., 1998 |
| zv28_519 860800 (group Y) | R. Moxon/Maiden et al., 1998 |
| zv29_519ass E32 (group Z) | R. Moxon/Maiden et al., 1998 |
| Gonococcus | |
| zv32_519 Ng F62 | R. Moxon/Maiden et al., 1998 |
| fa1090_519 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

```
FA1090_519
                                                    <SEQ ID 3185>
MEFFIILLAAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRAMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

Z2491_519
                                                    <SEQ ID 3186>
MEFFIILLAAVVVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
```

-continued

KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV01_519
<SEQ ID 3187>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV02_519
<SEQ ID 3188>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV03_519
<SEQ ID 3189>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV04_519
<SEQ ID 3190>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV05_519
<SEQ ID 3191>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV06_519ASS
<SEQ ID 3192>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVFSALDEAAGAWGVKVLRYEIKDLVPPQEILRSMQAQITAERK
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV07_519
<SEQ ID 3193>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV11_519
<SEQ ID 3194>
MEFFIILLAAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV12_519
<SEQ ID 3195>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE

```
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV18_519
                                                    <SEQ ID 3196>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV19_519
                                                    <SEQ ID 3197>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV20_519ASS
                                                    <SEQ ID 3198>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSM
ISAGMKIIDSSKTAK*

ZV21_519ASS
                                                    <SEQ ID 3199>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV22_519ASS
                                                    <SEQ ID 3200>
MEFFIILLAAVVVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
KRARIAESEGRKIEQINLASGQREAKIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV26_519
                                                    <SEQ ID 3201>
MEFFIILLAAVVVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV27_519
                                                    <SEQ ID 3202>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV28_519
                                                    <SEQ ID 3203>
MEFFIILLAAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV29_519ASS
                                                    <SEQ ID 3204>
MEFFIILLAAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSIVVSALDEAAGAWGVKVLRYEIKDLVPPQEILRSMQAQITAERE
```

-continued

KRARIAESEGRKIEQINLASGQREPEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSNKTAK*

ZV32_519
<SEQ ID 3205>
MEFFIILLAAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRAMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV96_519
<SEQ ID 3206>
MEFFIILLAAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

FIG. 22 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 15

Table 6 lists several *Neisseria* strains which were used to assess the conservation of the sequence of ORF 919 among different strains.

TABLE 6

919 gene variability: List of used *Neisseria* strains

| Identification Strains number | Source/reference |
|---|---|
| Group B | |
| zm01 NG6/88 | R. Moxon/Seiler et al., 1996 |
| zm02 BZ198 | R. Moxon/Seiler et al., 1996 |
| zm03 NG3/88 | R. Moxon/Seiler et al., 1996 |
| zm04 297-0 | R. Moxon/Seiler et al., 1996 |
| zm05 1000 | R. Moxon/Seiler et al., 1996 |
| zm06 BZ147 | R. Moxon/Seiler et al., 1996 |
| zm07 BZ169 | R. Moxon/Seiler et al., 1996 |
| zm08n 528 | R. Moxon/Seiler et al., 1996 |
| zm09 NGP165 | R. Moxon/Seiler et al., 1996 |
| zm10 BZ133 | R. Moxon/Seiler et al., 1996 |
| zm11asbc NGE31 | R. Moxon/Seiler et al., 1996 |
| zm12 NGF26 | R. Moxon/Seiler et al., 1996 |
| zm13 NGE28 | R. Moxon/Seiler et al., 1996 |
| zm14 NGH38 | R. Moxon/Seiler et al., 1996 |
| zm15 SWZ107 | R. Moxon/Seiler et al., 1996 |

TABLE 6-continued 919 gene variability: List of used *Neisseria* strains

| Identification Strains number | Source/reference |
|---|---|
| zm16 NGH15 | R. Moxon/Seiler et al., 1996 |
| zm17 NGH36 | R. Moxon/Seiler et al., 1996 |
| zm18 BZ232 | R. Moxon/Seiler et al., 1996 |
| zm19 BZ83 | R. Moxon/Seiler et al., 1996 |
| zm20 44/76 | R. Moxon/Seiler et al., 1996 |
| zm21 MC58 | R. Moxon |
| zm96 2996 | Our collection |
| Group A | |
| zm22 205900 | R. Moxon |
| zm23asbc F6124 | R. Moxon |
| z2491 Z2491 | R. Moxon/Maiden et al., 1998 |
| Group C | |
| zm24 90/18311 | R. Moxon |
| zm25 93/4286 | R. Moxon |
| Others | |
| zm26 A22 (group W) | R. Moxon/Maiden et al., 1998 |
| zm27bc E26 (group X) | R. Moxon/Maiden et al., 1998 |
| zm28 860800 (group Y) | R. Moxon/Maiden et al., 1998 |
| zm29asbc E32 (group Z) | R. Moxon/Maiden et al., 1998 |
| zm31asbc *N. lactamica* | R. Moxon |
| Gonococcus | |
| zm32asbc Ng F62 | R. Moxon/Maiden et al., 1998 |
| zm33asbc Ng SN4 | R. Moxon |
| fa1090 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

FA1090
<SEQ ID 3207>
MKKHLLRSALYGIAAAILAACQSRSIQTFPQPDTSVINGPDRPAGIPDPAGTTVAGGGAV
YTVVPHLSMPHWAAQDFAKSLQSFRLGCANLKNRQGWQDVCAQAFQTPVHSFQAKRFFER
YFTPWQVAGNGSLAGTVTGYYEPVLKGDGRRTERARFPIYGIPDDFISVPLPAGLRGGKN
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSGNEGPVGALGTPLMGEYAGA
IDRHYITLGAPLFVATAHPVTRKALNRLIMAQDTGSAIKGAVRVDYFWGYGDEAGELAGK
QKTTGYVWQLLPNGMKPEYRP*

Z2491

<SEQ ID 3208>

MKKYLFRAALCGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSVQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMQQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM01

<SEQ ID 3209>

MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM02

<SEQ ID 3210>

MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM03

<SEQ ID 3211>

MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM04

<SEQ ID 3212>

MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMQQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM05

<SEQ ID 3213>

MKKYLFRAALYGIAAAILAACQSKSIQTFPQPDTSVINGPDRPVGIPDPAGTTVGGGGAV
YTVVPHLSLPHWAAQDFAKSLQSFRLSCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM06

<SEQ ID 3214>

MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM07
<SEQ ID 3215>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM08N
<SEQ ID 3216>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM09
<SEQ ID 3217>
MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSGNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM10
<SEQ ID 3218>
MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSGNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM11ASBC
<SEQ ID 3219>
MKKYLFRAALCGIAAAILAACQSKSIQTFPQPDTSVINGPDRPVGIPAPAGTTVGGGGAV
YTVVPHLSLPHWAAQDFAKSLQSFRLGCANLKNRQGWQDVCAQAFQTPVHSVQAKQFFER
YFTPWQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM12
<SEQ ID 3220>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM13
<SEQ ID 3221>
MKKYLFRAALYGIAAAILAACQSKSIQTFPQPDTSVINGPDRPVGIPDPAGTTVGGGGAV
YTVVPHLSLPHWAEQDFAKSLQSFRLGCANLKNRQGWQDVCAQAFQTPVHSFQAKQFFER
YFTPWQVAGNGSLAGTVTGYYEPVLKGDDRRTAQARFPIYGIPDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM14
<SEQ ID 3222>
MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSRNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM15
<SEQ ID 3223>
MKKYLFRAALYGIAAAILAACQSKSIQTFPQPDTSVINGPDRPVGIPDLAGTTVGGGGAV
YTVVPHLSLPHWAAQDFAKSLQSFRLGCANLKNHQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSGNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM16
<SEQ ID 3224>
MKKYLFRAALCGIAAAILAACQSKSIQTFPQPDTSVINGPGRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM17
<SEQ ID 3225>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM18
<SEQ ID 3226>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM19
<SEQ ID 3227>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM20
<SEQ ID 3228>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

-continued

ZM21
<SEQ ID 3229>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM22
<SEQ ID 3230>
MKKYLFRAALCGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSVQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMQQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM23ASBC
<SEQ ID 3231>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELAGSSNDGPVGALGTPLMGEYAGA
VDRHYITLGAPLFVATAHPVTSKALNRLIMAQDTGSAIKGAVRVDYFWGYGDEAGETAGK
MKEPGYVWQLLPNGMKPEYRP*

ZM24
<SEQ ID 3232>
MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM25
<SEQ ID 3233>
MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM26
<SEQ ID 3234>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSVQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMQQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM27BC
<SEQ ID 3235>
MKKYLFRAALYGISAAILAACQSKSIQTFPQPDTSVINGPDRPAGIPDPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGETAGK
MKEPGYVWQLLPNGMKPEYRP*

ZM28
<SEQ ID 3236>
MKKYLFRAALCGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM29ASBC
<SEQ ID 3237>
MKKYLFRAALCGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELTGSGNDGPVGALGTPLMGEYAGA
VDRHYITLGAPLFVATTHPITRKALNRLIMAQDTGSAIKGAVRVDYFWGYGDEAGELAGK
QKTTGYVWQLLPNGMKPEYRP*

ZM31ASBC
<SEQ ID 3238>
MKKHLFRAALYGIAAAILAACQSKSIQTFPQPDTSIIKGPDRPAGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYVFFRELAGSGNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM32ASBC
<SEQ ID 3239>
MKKHLLRSALYGIAAAILAACQSRSIQTFPQPDTSVINGPDRPAGIPDPAGTTVAGGGAV
YTVVPHLSMPHWAAQDFAKSLQSFRLGCANLKNRQGWQDVCAQAFQTPVHSFQAKRFFER
YFTPWQVAGNGSLAGTVTGYYEPVLKGDRRTERARFPIGIPDDFISVPLPAGLRGGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSGGDGPVGALGTPLMGGYAGA
IDRHYITLGAPLFVATAHPVTRKALNRLIMAQDTGSAIKGAVRVDYFWGYGDEAGELAGK
QKTTGYVWQLLPNGMKPEYRP*

ZM33ASBC
<SEQ ID 3240>
MKKHLLRSALYGIAAAILAACQSRSIQTFPQPDTSVINGPDRPAGIPDPAGTTVAGGGAV
YTVVPHLSMPHWAAQDFAKSLQSFRLGCANLKNRQGWQDVCAQAFQTPIHSFQAKRFFER
YFTPWQVAGNGSLAGTVTGYYEPVLKGDGRRTERARFPIYGIPDDFISVPLPAGLRGGKN
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPHKLAEVLGQNPSYIFFRELAGSGNEGPVGALGTPLMGEYAGA
IDRHYITLGAPLFVATAHPVTRKALNRLIMAQDTGSAIKGAVRVDYFWGYGDEAGELAGK
QKTTGYVWQLLPNGMKPEYRP*

ZM96
<SEQ ID 3241>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

FIG. 23 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 16

Using the above-described procedures, the following oligonucleotide primers were employed in the polymerase chain reaction (PCR) assay in order to clone the ORFs as indicated:

TABLE 7

Oligonucleotides used for PCR to amplify complete or partial ORFs

| ORF | SEQ ID | primer | Sequence | Restriction sites |
|---|---|---|---|---|
| 001 | 3300 | Forward | CGCGGATCCCATATG-TGGATGGTGCTGGTCAT | BamHI-NdeI |
| | 3301 | Reverse | CCCGCTCGAG-TGCCGTCTTGTCCCAC | XhoI |
| 003 | 3302 | Forward | CGCGGATCCCATATG-GTCGTATTCGTGGC | BamHI-NdeI |
| | 3303 | Reverse | CCCGCTCGAG-AAAATCATGAACACGCGC | XhoI |
| 005 | 3304 | Forward | CGCGGATCCCATATG-GACAATATTGACATGT | BamHI-NdeI |
| | 3305 | Reverse | CCCGCTCGAG-CATCACATCCGCCCG | XhoI |
| 006 | 3306 | Forward | CGCGGATCCCATATG-CTGCTGGTGCTGG | BamHI-NdeI |
| | 3307 | Reverse | CCCGCTCGAG-AGTTCCGGCTTTGATGT | XhoI |
| 007 | 3308 | Forward | CGCGGATCCCATATG-GCCGACAACAGCATCAT | BamHI-NdeI |
| | 3309 | Reverse | CCCGCTCGAG-AAGGCGTTCATGATATAAG | XhoI |
| 008 | 3310 | Forward | CGCGGATCCCATATG-AACAACAGACATTTTG | BamHI-NdeI |
| | 3311 | Reverse | CCCGCTCGAG-CCTGTCCGGTAAAAGAC | XhoI |
| 009 | 3312 | Forward | CGCGGATCCCATATG-CCCCGCGCTGCT | BamHI-NdeI |
| | 3313 | Reverse | CCCGCTCGAG-TGGCTTTTGCCACGTTTT | XhoI |
| 011 | 3314 | Forward | CGCGGATCCCATATG-AAGACACACCGCAAG | BamHI-NdeI |
| | 3315 | Reverse | CCCGCTCGAG-GGCGGTCAGTACGGT | XhoI |
| 012 | 3316 | Forward | CGCGGATCCCATATG-CTCGCCCGTTGCC | BamHI-NdeI |
| | 3317 | Reverse | CCCGCTCGAG-AGCGGGGAAGAGGCAC | XhoI |
| 013 | 3318 | Forward | CGCGGATCCCATATG-CCTTTGACCATGCT | BamHI-NdeI |
| | 3319 | Reverse | CCCGCTCGAG-CTGATTCGGCAAAAAATCT | XhoI |
| 018 | 3320 | Forward | CGCGGATCCCATATG-CAGCAGAGGCAGTT | BamHI-NdeI |
| | 3321 | Reverse | CCCGCTCGAG-GACGAGGCGAACGCC | XhoI |
| 019 | 3322 | Forward | AAAGAATTC-CTGCCAGCCGGCAAGACCCCGGC | Eco RI |
| | 3323 | Reverse | AAACTGCAG-TCAGCGGGCGGGACAATGCCCAT | Pst I |
| 023 | 3324 | Forward | AAAGAATTC-AAAGAATATTCGGCATGGCAGGC | Eco RI |
| | 3325 | Reverse | AAACTGCAG-TTACCCCCAAATCACTTTAACTGA | Pst I |
| 025 | 3326 | Forward | AAAGAATTC-TGCGCCACCCAACAGCCTGCTCC | Eco RI |
| | 3327 | Reverse | AAACTGCAG-TCAGAACGCGATATAGCTGTTCGG | Pst I |
| 031 | 3328 | Forward | CGCGGATCCCATATG-GTCTCCCTTCGCTT | BamHI-NdeI |
| | 3329 | Reverse | CCCGCTCGAG-ATGTAAGACGGGGACAAC | XhoI |
| 032 | 3330 | Forward | CGCGGATCCCATATG-CGGCGAAACGTGC | BamHI-NdeI |
| | 3331 | Reverse | CCCGCTCGAG-CTGGTTTTTTGATATTTGTG | XhoI |
| 033 | 3332 | Forward | CGCGGATCCCATATG-GCGGCGGCAGACA | BamHI-NdeI |
| | 3333 | Reverse | CCCGCTCGAG-ATTTGCCGCATCCGAT | XhoI |
| 034 | 3334 | Forward | CGCGGATCCCATATG-GCCGAAAACAGCTACGG | BamHI-NdeI |
| | 3335 | Reverse | CCCGCTCGAG-TTTGACGATTTGGTTCAATT | XhoI |
| 036 | 3336 | Forward | CGCGGATCCCATATG-CTGAAGCCGTGCG | BamHI-NdeI |
| | 3337 | Reverse | CCCGCTCGAG-CCGGACTGCGTATCGG | XhoI |
| 038 | 3338 | Forward | CGCGGATCCCATATG-ACCGATTTCCGCCA | BamHI-NdeI |
| | 3339 | Reverse | CCCGCTCGAG-TTCTACGCCGTACTGCC | XhoI |
| 039 | 3340 | Forward | CGCGGATCCCATATG-CCGTCCGAACCGC | BamHI-NdeI |
| | 3341 | Reverse | CCCGCTCGAG-TAGGATGACGAGGTAGG | XhoI |
| 041 | 3342 | Forward | CGCGGATCCCATATG-TTCGTGCGCGAACCGC | BamHI-NdeI |
| | 3343 | Reverse | CCCGCTCGAG-GCCCAAAAACTCTTTCAAA | XhoI |
| 042 | 3344 | Forward | CGCGGATCCCATATG-ACGATGATTTGCTTGC | BamHI-NdeI |
| | 3345 | Reverse | CCCGCTCGAG-TTTGCAGCCTGCATTTGAC | XhoI |
| 043 | 3346 | Forward | AAAAAAGGTACC-ATGGTTGTTTCAAATCAAAATATC | Kpn I |
| | 3347 | Reverse | AAACTGCAG-TTATTGCGCTTCACCTTCCGCGC | Pst I |
| 043a | 3348 | Forward | AAAAAAGGTACC-GCAAAAGTGCATGGCGGCTTGGACGGTGC | Kpn I |
| | 3349 | Reverse | AAAAAACTGCAG-TTAATCCTGCAACACGAATTCGCCCGTCCG | Pst I |
| 044 | 3350 | Forward | CGCGGATCCCATATG-CCGTCCGACTAGAG | BamHI-NdeI |
| | 3351 | Reverse | CCCGCTCGAG-ATGCGCTACGGTAGCCA | XhoI |

TABLE 7-continued

Oligonucleotides used for PCR to amplify complete or partial ORFs

| ORF | SEQ ID | primer | Sequence | Restriction sites |
|---|---|---|---|---|
| 046 | 3352 | Forward | AAAGAATTC-ATGTCGGCAATGCTCCCGACAAG | Eco RI |
|  | 3353 | Reverse | AAACTGCAG-TCACTCGGCGACCCACACCGTGAA | Pst I |
| 047 | 3354 | Forward | CGCGGATCCCATATG-GTCATCATACAGGCG | BamHI-NdeI |
|  | 3355 | Reverse | CCCGCTCGAG-TCCGAAAAAGCCCATTTTG | XhoI |
| 048 | 3356 | Forward | AAAGAATTC-ATGCTCAACAAAGGCGAAGAATTGCC | Eco RI |
|  | 3357 | Reverse | AAACTGCAG-TCAAGATTCGACGGGGATGATGCC | Pst I |
| 049 | 3358 | Forward | AAAGAATTC-ATGCGGGCGCAGGCGTTTGATCAGCC | Eco RI |
|  | 3359 | Reverse | AAACTGCAG-AAGGCGTATCTGAAAAAATGGCAG | Pst I |
| 050 | 3360 | Forward | CGCGGATCCCATATG-GGCGCGGGCTGG | BamHI-NdeI |
|  | 3361 | Reverse | CCCGCTCGAG-AATCGGGCCATCTTCGA | XhoI |
| 052 | 3362 | Forward | AAAAAGAATTC-ATGGCTTTGGTGGCGGAGGAAAC | Eco RI |
|  | 3363 | Reverse | AAAAAGTCGAC-TCAGGCGGCGTTTTTCACCTTCCT | Sal I |
| 052a | 3364 | Forward | AAAAAGAATTC-GTGGCGGAGGAAACGGAAATATCCGC | Eco RI |
|  | 3365 | Reverse | AAAAAACTGCAG-TTAGCTGTTTTTGGAAACGCCGTCCAACCC | Pst I |
| 073 | 3366 | Forward | CGCGGATCCCATATG-TGTATGCCATATAAGAT | BamHI-NdeI |
|  | 3367 | Reverse | CCCGCTCGAG-CACCGGATTGTCCGAC | XhoI |
| 075 | 3368 | Forward | CGCGGATCCCATATG-CCGTCTTACTTCATC | BamHI-NdeI |
|  | 3369 | Reverse | CCCGCTCGAG-ATCACCAATGCCGATTATTT | XhoI |
| 077a | 3370 | Forward | AAAAAGAATTC-GGCGGCATTTTCATCGACACCTTCCT | Eco RI |
|  | 3371 | Reverse | AAAAAACTGCAG-TCAGACGAACATCTGCACAAACGCAT | Pst I |
| 080 | 3372 | Forward | AAAGAATTC-GCGTCCGGGCTGGTTTGGTTTTACAATTC | Eco RI |
|  | 3373 | Reverse | AAACTGCAG-CTATTCTTCGGATTCTTTTCGGG | Pst I |
| 081 | 3374 | Forward | AAAGAATTC-ATGAAACCACTGGACCTAAATTTCATCTG | Eco RI |
|  | 3375 | Reverse | AAACTGCAG-TCACTTATCCTCCAATGCCTC | Pst I |
| 082 | 3376 | Forward | AAA GAATTC-ATGTGGTTGTTGAAGTTGCCTGC | Eco RI |
|  | 3377 | Reverse | AAACTGCAG-TTACGCGGATTCGGCAGTTGG | Pst I |
| 084 | 3378 | Forward | AAAGAATTC-TATCACCCAGAATATGAATACGGCTACCG | Eco RI |
|  | 3379 | Reverse | AAACTGCAG-TTATACTTGGGCGCAACATGA | Pst I |
| 085 | 3380 | Forward | CGCGGATCCCATATG-GGTAAAGGGCAGGACT | BamHI-NdeI |
|  | 3381 | Reverse | CCCGCTCGAG-CAAAGCCTTAAACGCTTCG | XhoI |
| 086 | 3382 | Forward | AAAAAGGTACC-TATTTGGCATCAAAAGAAGGCGG | Kpn I |
|  | 3383 | Reverse | AAACTGCAG-TTACTCCACCCGATAACCGCG | Pst I |
| 087 | 3384 | Forward | AAAGAATTC-ATGGGCGGTAAAACCTTTATGC | Eco RI |
|  | 3385 | Reverse | AAACTGCAG-TTACGCCGCACACGCAATCGC | Pst I |
| 087a | 3386 | Forward | AAAAAGAATTC-AAGCTATTAGGCGTGCCGATTGTGATTCA | Eco RI |
|  | 3387 | Reverse | AAAAAACTGCAG-TTACGCCTGCAAGATGCCCAGCTTGCC | Pst I |
| 088 | 3388 | Forward | AAAAAGAATTC-ATGTTTTTATGGCTCGCACATTTCAG | Eco RI |
|  | 3389 | Reverse | AAAAAACTGCAG-TCAGCGGATTTTGAGGGTACTCAAACC | Pst I |
| 089 | 3390 | Forward | CGCGGATCCCATATG-CCGCCCAAAATCAC | BamHI-NdeI |
|  | 3391 | Reverse | CCCGCTCGAG-TGCGCATACCAAAGCCA | XhoI |
| 090 | 3392 | Forward | CGCGGATCCCATATG-CGCATAGTCGAGCA | BamHI-NdeI |
|  | 3393 | Reverse | CCCGCTCGAG-AGCAAAACGGCGGTACG | XhoI |
| 091 | 3394 | Forward | AAAGAATTC-ATGGAAATACCCGTACCGCCGAGTCC | Eco RI |
|  | 3395 | Reverse | AAACTGCAG-TCAGCGCAGGGGTAGCCCAAGCC | Pst I |
| 092 | 3396 | Forward | AAAGAATTC-ATGTTTTTTATTTCAATCCG | Eco RI |
|  | 3397 | Reverse | AAACTGCAG-TCAAATCTGTTTCGACAATGC | Pst I |
| 093 | 3398 | Forward | AAAGAATTC-ATGCAGAATTTTGGCAAAGTGGC | Eco RI |
|  | 3399 | Reverse | AAACTGCAG-CTATGGCTCGTCATACCGGGC | Pst I |
| 094 | 3400 | Forward | AAAGAATTC-ATGCCGTCACGGAAGCGCATCAACTC | Eco RI |
|  | 3401 | Reverse | AAACTGCAG-TTATCCCGGCCATACCGCCGAACA | Pst I |
| 095 | 3402 | Forward | AAAGAATTC-ATGTCCTTTCATTTGAACATGGACGG | Eco RI |
|  | 3403 | Reverse | AAACTGCAG-TCAACGCCGCAGGCACTAACGCCC | Pst I |
| 096 | 3404 | Forward | AAAGAATTC-ATGGCTCGTCATACCGGGCAGGG | Eco RI |
|  | 3405 | Reverse | AAACTGCAG-TCAAAGGAAAAGGCCGTCTGAAAAGCG | Pst I |
| 097 | 3406 | Forward | AAAGAATTC-ATGGACACTTCAAAACAAACTGTTG | Eco RI |
|  | 3407 | Reverse | AAACTGCAG-TCAGCCCAAATACCAGAATTTCAG | Pst I |
| 098 | 3408 | Forward | AAAGAATTC-GATGAACGCAGCCCAGCATGGATACG | Eco RI |
|  | 3409 | Reverse | AAACTGCAG-TTACGACATTCTGATTTGGCA | Pst I |
| 102 | 3410 | Forward | AAAAAGAATTC-GGCCTGATGATTTTGGAAGTCAACAC | Eco RI |
|  | 3411 | Reverse | AAAAAACTGCAG-TTATCCTTTAAATACGGGGACGAGTTC | Pst I |
| 105 | 3412 | Forward | CGCGGATCCCATATG-TCCGCAAACGAATACG | BamHI-NdeI |
|  | 3413 | Reverse | CCCGCTCGAG-GTGTTCTGCCAGTTTCAG | XhoI |
| 107 | 3414 | Forward | AAAAAGAATTC-CTGATGATTTTGGAAGTCAACACCCATTATCC | Eco RI |
|  | 3415 | Reverse | AAAAAACTGCAG-TTATCCTTTAAATACGGGGACGAGTTC | Pst I |
| 107b | 3416 | Forward | AAAAAGAATTC-GATACCCAAGCCCCCGCCGGCACAAACTACTG | Eco RI |

TABLE 7-continued

Oligonucleotides used for PCR to amplify complete or partial ORFs

| ORF | SEQ ID | primer | Sequence | Restriction sites |
|---|---|---|---|---|
| | 3417 | Reverse | AAAAAACTGCAG-TTACGCGTCGCCTTTAAAGTATTTGAGCAGGCTGGAGAC | Pst I |
| 108 | 3418 | Forward | AAAGAATTC-ATGTTGCCGGGCTTCAACCG | Eco RI |
| | 3419 | Reverse | AAACTGCAG-TTAGCGGTACAGGTGTTTGAAGCA | Pst I |
| 108a | 3420 | Forward | AAAAAAGAATTC-GGTAACACATTCGGCAGCTTAGACGGTGG | Eco RI |
| | 3421 | Reverse | AAACTGCAG-TTAGCGGTACAGGTGTTTGAAGCA | Pst I |
| 109 | 3422 | Forward | AAAGAATTC-ATGTATTATCGCCGGGTTATGGG | Eco RI |
| | 3423 | Reverse | AAACTGCAG-CTAGCCCAAAGATTTGAAGTGTTC | Pst I |
| 111 | 3424 | Forward | CGCGGATCCCATATG-TGTTCGGAACAAACCGC | BamHI-NdeI |
| | 3425 | Reverse | CCCGCTCGAG-GCGGAGCAGTTTTTCAAA | XhoI |
| 114 | 3426 | Forward | CGCGGATCCCATATG-GCTTCCATCACTTCGC | BamHI-NdeI |
| | 3427 | Reverse | CCCGCTCGAG-CATCCGCGAAATCGTC | XhoI |
| 117 | 3428 | Forward | AAAAAAGGTACC-ATGGTCGAAGAACTGGAACTGCTG | Kpn I |
| | 3429 | Reverse | AAACTGCAG-TTAAAGCCGGGTAACGCTCAATAC | Pst I |
| 118 | 3430 | Forward | AAAGTCGACATGTGTGAGTTCAAGGATATTATAAG | Sal I |
| | 3431 | Reverse | AAAGCATGC-CTATTTTTTGTTGTAATAATCAAATC | Sph I |
| 121 | 3432 | Forward | CGCGGATCCCATATG-GAAACACAGCTTTACAT | BamHI-NdeI |
| | 3433 | Reverse | CCCGCTCGAG-ATAATAATATCCCGCGCCC | XhoI |
| 122 | 3434 | Forward | CGCGGATCCCATATG-GTCATGATTAAAATCCGCA | BamHI-NdeI |
| | 3435 | Reverse | CCCGCTCGAG-AATCTTGGTAGATTGGATTT | XhoI |
| 125 | 3436 | Forward | AAAGAATTC-ATGTCGGGCAATGCCTCCTCTCC | Eco RI |
| | 3437 | Reverse | AAACTGCAG-TCACGCCGTTTCAAGACG | Pst I |
| 125a | 3438 | Forward | AAAAAAGAATTC-ACGGCAGGCAGCACCGCCGCACAGGTTTC | Eco RI |
| | 3439 | Reverse | AAAAAACTGCAG-TTATTTTGCCACGTCGGTTTCTCCGGTGAACAACGC | Pst I |
| 126 | 3440 | Forward | CGCGGATCCCATATG-CCGTCTGAAACCC | BamHI-NdeI |
| | 3441 | Reverse | CCCGCTCGAG-ATATTCCGCCGAATGCC | XhoI |
| 127 | 3442 | Forward | AAAGAATTC-ATGGAAATATGGAATAGTTGGACACTTG | Eco RI |
| | 3443 | Reverse | AAACTGCAG-TTAAAGTGTTTCGGAGCCGGC | Pst I |
| 127a | 3444 | Forward | AAAAAAGAATTC-AAGGAACTGATTATGTGTCTGTCGGG | Eco RI |
| | 3445 | Reverse | AAACTGCAG-TTAAAGTGTTTCGGAGCCGGC | Pst I |
| 128 | 3446 | Forward | CGCGGATCCCATATG-ACTGACAACGCACT | BamHI-NdeI |
| | 3447 | Reverse | CCCGCTCGAG-GACCGCGTTGTCGAAA | XhoI |
| 130 | 3448 | Forward | CGCGGATCCCATATG-AAACAACTCCGCGA | BamHI-NdeI |
| | 3449 | Reverse | CCCGCTCGAG-GAATTTTGCACCGGATTG | XhoI |
| 132 | 3450 | Forward | AAAGAATTC-ATGGAACCCTTCAAAACCTTAATTTG | Eco RI |
| | 3451 | Reverse | AAAAAACTGCAG-TCACCATGTCGGCATTTGAAAAAC | Pst I |
| 134 | 3452 | Forward | CGCGGATCCCATATG-TCCCAAGAAATCCTC | BamHI-NdeI |
| | 3453 | Reverse | CCCGCTCGAG-CAGTTTGACCGAATGTT | XhoI |
| 135 | 3454 | Forward | CGCGGATCCCATATG-AAATACAAAAGAATCGTATT | BamHI-NdeI |
| | 3455 | Reverse | CCCGCTCGAG-AAATTCGGTCAGAAGCAGG | XhoI |
| 137 | 3456 | Forward | AAAAAAGGTACC-ATGATTACCCATCCCCAATTCGATCC | Kpn I |
| | 3457 | Reverse | AAAAAACTGCAG-TCAGTGCTGTTTTTTCATGCCGAA | Pst I |
| 137a | 3458 | Forward | AAAAAAGAATTC-GGCCGCAAACACGGCATCGGCTTCT | Eco RI |
| | 3459 | Reverse | AAAAAACTGCAG-TTAAGCGGGATGACGCGGCAGCATACC | Pst I |
| 138 | 3460 | Forward | AAAAAAGAATTC-AACTCAGGCGAAGGAGTGCTTGTGGC | Eco RI |
| | 3461 | Reverse | AAAAAATCTAGA-TCAGTTTAGGGATAGCAGGCGTAC | Xba I |
| 141 | 3462 | Forward | AAAGAATTC-ATGAGCTTCAAAACCGATGCCGAAATCGC | Eco RI |
| | 3463 | Reverse | AAACTGCAG-TCAGAACAAGCCGTGAATCACGCC | Pst I |
| 142 | 3464 | Forward | CGCGGATCCCATATG-CGTGCCGATTTCATG | BamHI-NdeI |
| | 3465 | Reverse | CCCGCTCGAG-AAACTGCTGCACATGGG | XhoI |
| 143 | 3466 | Forward | AAAAAAGAATTC-ATGCTCAGTTTCGGCTTTCTCGGCGTTCAGAC | Eco RI |
| | 3467 | Reverse | AAAAAACTGCAG-TCAAACCCCGCCGTGTGTTTCTTTAAT | Pst I |
| 144 | 3468 | Forward | AAAAAAGAATTC-GGTCTGATCGACGGGCGTGCCGTAAC | Eco RI |
| | 3469 | Reverse | AAAAAATCTAGA-TCGGCATCGGCCGGCATATGTCCG | Xba I |
| 146 | 3470 | Forward | AAAAAAGAATTC-CGCCAAGTCGTCATTGACCACGACAAAGTC | Eco RI |
| | 3471 | Reverse | AAAAAACTGCAG-TTAGGCATCGGCAAATAGGAAACTGGG | Pst I |
| 147 | 3472 | Forward | AAAAAAGAATTC-ACTGAGCAATCGGTGGATTTGGAAAC | Eco RI |
| | 3473 | Reverse | AAAAAATCTAGA-TTAGGTAAAGCTGCGGCCCATTTGCGG | Xba I |
| 148 | 3474 | Forward | AAAAAAGAATTC-ATGGCGTTAAAAACATCAAACTTGGAACACGC | Eco RI |
| | 3475 | Reverse | AAAAAATCTAGA-TCAGCCCTTCATACAGCCTTCGTTTTG | Xba I |

TABLE 7-continued

Oligonucleotides used for PCR to amplify complete or partial ORFs

| ORF | SEQ ID | primer | Sequence | Restriction sites |
|---|---|---|---|---|
| 149 | 3476 | Forward | CGCGGATCCCATATG-CTGCTTGACAACAAAGT | BamHI-NdeI |
|  | 3477 | Reverse | CCCGCTCGAG-AAACTTCACGTTCACGCC | XhoI |
| 150 | 3478 | Forward | CGCGGATCCCATATG-CAGAACACAAATCCG | BamHI-NdeI |
|  | 3479 | Reverse | CCCGCTCGAG-ATAAACATCACGCTGATAGC | XhoI |
| 151 | 3480 | Forward | AAAAAAGAATTC-ATGAAACAAATCCGCAACATCGCCATCATCGC | Eco RI |
|  | 3481 | Reverse | AAAAAACTGCAG-TCAATCCAGCTTTTTAAAGTGGCGGCG | Pst I |
| 152 | 3482 | Forward | AAAAAAGAATTC-ATGAAAAACAAAACCAAAGTCTGGGACCTCCC | Eco RI |
|  | 3483 | Reverse | AAAAAACTGCAG-TCAGGACAGGAGCAGGATGGCGGC | Pst I |
| 153 | 3484 | Forward | AAAAAAGAATTC-ATGGCGTTTGCTTACGGTATGAC | Eco RI |
|  | 3485 | Reverse | AAAAAACTGCAG-TCAGTCATGTTTTTCCGTTTCATT | Pst I |
| 153a | 3486 | Forward | AAAAAAGAATTC-CGGACTTCGGTATCGGTTCCCAGCATTG | Eco RI |
|  | 3487 | Reverse | AAAAAACTGCAG-TTACGCCGACGAAATACTCAGACTTTTCGG | Pst I |
| 154 | 3488 | Forward | CGCGGATCCCATATG-ACTGACAACAGCCC | BamHI-NdeI |
|  | 3489 | Reverse | CCCGCTCGAG-TCGGCTTCCTTTCGGG | XhoI |
| 155 | 3490 | Forward | AAAAAAGAATTC-ATGAAAATCGGTATCCCACGCGAGTC | Eco RI |
|  | 3491 | Reverse | AAAAAACTGCAG-TTACCCTTTCTTAAACATATTCAGCAT | Pst I |
| 156 | 3492 | Forward | AAAAAAGAATTC-GCACAGCAAAACGGTTTTGAAGC | Eco RI |
|  | 3493 | Reverse | AAAAAACTGCAG-TCAAGCAGCCGCGACAAACAGCCC | Pst I |
| 157 | 3494 | Forward | CGCGGATCCCATATG-AGGAACGAGGAAAAAC | BamHI-NdeI |
|  | 3495 | Reverse | CCCGCTCGAG-AAAACACAATATCCCCGC | XhoI |
| 158 | 3496 | Forward | AAAAAAGAATTC-GCGGAGCAGTTGGCGATGGCAAATTCTGC | Eco RI |
|  | 3497 | Reverse | AAAAAATCTAGA-TTATCCACAGAGATTGTTTCCCAGTTC | Xba I |
| 160 | 3498 | Forward | CGCGGATCCCATATG-GACATTCTGGACAAAC | BamHI-NdeI |
|  | 3499 | Reverse | CCCGCTCGAG-TTTTTGCCCGCCTTCTTT | XhoI |
| 163 | 3500 | Forward | AAAAAAGGTACC-ACCGTGCCGGATCAGGTGCAGATGTG | Kpn I |
|  | 3501 | Reverse | AAAAAATCTAGA-TTACTCTGCCAATTCCACCTGCTCGTG | Xba I |
| 163a | 3502 | Forward | AAAAAAGAATTC-CGGCTGGTGCAGATAATGAGCCAGAC | Eco RI |
|  | 3503 | Reverse | AAAAAATCTAGA-TTACTCTGCCAATTCCACCTGCTCGTG | Xba I |
| 164 | 3504 | Forward | CGCGGATCCCATATG-AACCGGACTTATGCC | BamHI-NdeI |
|  | 3505 | Reverse | CCCGCTCGAG-TTTGTTTCCGTCAAACTGC | XhoI |
| 165 | 3506 | Forward | CGCGGATCCGCTAGC-GCTGAAGCGACAGACG | BamHI-NheI |
|  | 3507 | Reverse | CCCGCTCGAG-AATATCCAATACTTTCGCG | XhoI |
| 206 | 3508 | Forward | CGCGGATCCCATATG-AAACACCGCCAACCGA | BamHI-NdeI |
|  | 3509 | Reverse | CCCGCTCGAG-TTCTGTAAAAAAGTATGTGC | XhoI |
| 209 | 3510 | Forward | CGCGGATCCCATATG-CTGCGGCATTTAGGA | BamHI-NdeI |
|  | 3511 | Reverse | CCCGCTCGAG-TACCCCTGAAGGCAAC | XhoI |
| 211 | 3512 | Forward | AAAAAAGAATTC-ATGTTGCAGGTTGCTGCTGC | Eco RI |
|  | 3513 | Reverse | AAAAAACTGCAG-CTATCCTGCGGATTGGCATTGAAA | Pst I |
| 212 | 3514 | Forward | CGCGGATCCCATATG-GACAATCTCGTATGG | BamHI-NdeI |
|  | 3515 | Reverse | CCCGCTCGAG-AGGGGTTAGATCCTTCC | XhoI |
| 215 | 3516 | Forward | CGCGGATCCCATATG-GCATGGTTGGGTCGT | BamHI-NdeI |
|  | 3517 | Reverse | CCCGCTCGAG-CATATCTTTTGTATCATAAATC | XhoI |
| 216 | 3518 | Forward | CGCGGATCCCATATG-GCAATGGCAGAAAACG | BamHI-NdeI |
|  | 3519 | Reverse | CCCGCTCGAG-TACAATCCGTGCCGCC | XhoI |
| 217 | 3520 | Forward | CGCGGATCCCATATG-GCGGATGACGGTGTG | BamHI-NdeI |
|  | 3521 | Reverse | CCCGCTCGAG-ACCCCGAATATCGAATCC | XhoI |
| 218 | 3522 | Forward | CGCGGATCCCATATG-GTCGCGGTCGATC | BamHI-NdeI |
|  | 3523 | Reverse | CCCGCTCGAG-TAACTCATAGAATCCTGC | XhoI |
| 219 | 3524 | Forward | CGCGGATCCGCTAGC-ACGGCAAGGTTAAG | BamHI-NheI |
|  | 3525 | Reverse | CCCGCTCGAG-TTTAAACCATCTCCTCAAAAC | XhoI |
| 223 | 3526 | Forward | CGCGGATCCCATATG-GAATTCAGGCACCAAGTA | BamHI-NdeI |
|  | 3527 | Reverse | CCCGCTCGAG-GGCTTCCCGCGTGTC | XhoI |
| 225 | 3528 | Forward | CGCGGATCCCATATG-GACGAGTTGACCAACC | BamHI-NdeI |
|  | 3529 | Reverse | CCCGCTCGAG-GTTCAGAAAGCGGGAC | XhoI |

TABLE 7-continued

Oligonucleotides used for PCR to amplify complete or partial ORFs

| ORF | SEQ ID | primer | Sequence | Restriction sites |
|---|---|---|---|---|
| 226 | 3530 | Forward | AAAGAATTC-CTTGCGATTATCGTGCGCACGCG | Eco RI |
|  | 3531 | Reverse | AAACTGCAG-TCAAAATCCCAAAACGGGGAT | Pst I |
| 228 | 3532 | Forward | CGCGGATCCCATATG-TCGCAAGAAGCCAAACAG | BamHI-NdeI |
|  | 3533 | Reverse | CCCGCTCGAG-TTTGGCGGCATCTTTCAT | XhoI |
| 229 | 3534 | Forward | CGCGGATCCCATATG-CAAGAGGTTTTGCCC | BamHI-NdeI |
|  | 3535 | Reverse | CCCGCTCGAG-ACACAATATAGCGGATGAAC | XhoI |
| 230 | 3536 | Forward | CGCGGATCCCATATG-CATCCGGGTGCCGAC | BamHI-NdeI |
|  | 3537 | Reverse | CCCGCTCGAG-AAGTTTGGCGGCTTCGG | XhoI |
| 232 | 3538 | Forward | AAAAAAGAATTC-ATGTACGCTAAAAAAGGCGGTTTGGG | Eco RI |
|  | 3539 | Reverse | AAAAAACTGCAG-TCAAGGTTTTTTCCTGATTGCCGCCGC | Pst I |
| 232a | 3540 | Forward | AAAAAAGAATTC-GCCAAGGCTGCCGATACACAAATTGA | Eco RI |
|  | 3541 | Reverse | AAAAAACTGCAG-TTAAACATTGTCGTTGCCGCCCAGATG | Pst I |
| 233 | 3542 | Forward | CGCGGATCCCATATG-GCGGACAAACCCAAG | BamHI-NdeI |
|  | 3543 | Reverse | CCCGCTCGAG-GACGGCATTGAGCAG | XhoI |
| 234 | 3544 | Forward | CGCGGATCCCATATG-GCCGTTTCACTGACCG | BamHI-NdeI |
|  | 3545 | Reverse | GCCCAAGCTT-ACGGTTGGATTGCCATG | Hind III |
| 235 | 3546 | Forward | CGCGGATCCCATATG-GCCTGCCAAGTTCAAA | BamHI-NdeI |
|  | 3547 | Reverse | CCCGCTCGAG-TTTGGGCTGCTCTTC | XhoI |
| 236 | 3548 | Forward | CGCGGATCCCATATG-GCGCGTTTCGCCTT | BamHI-NdeI |
|  | 3549 | Reverse | CCCGCTCGAG-ATGGGTCGCGCGCCGT | XhoI |
| 238 | 3550 | Forward | CGCGGATCCGCTAGC-AACGGTTTGGATGCCCG | BamHI-NheI |
|  | 3551 | Reverse | CCCGCTCGAG-TTTGTCTAAGTTCCTGATATG | XhoI |
| 239 | 3552 | Forward | CCGGAATTCTACATATG-CTCCACCATAAAGGTATTG | EcoRI-NdeI |
|  | 3553 | Reverse | CCCGCTCGAG-TGGTGAAGAGCGGTTTAG | XhoI |
| 240 | 3554 | Forward | CGCGGATCCCATATG-GACGTTGGACGATTTC | BamHI-NdeI |
|  | 3555 | Reverse | CCCGCTCGAG-AAACGCCATTACCCGATG | XhoI |
| 241 | 3556 | Forward | CCGGAATTCTACATATG-CCAACACGTCCAACT | EcoRI-NdeI |
|  | 3557 | Reverse | CCCGCTCGAG-GAATGCGCCTGTAATTAATC | XhoI |
| 242 | 3558 | Forward | CGCGGATCCCATATG-ATCGGCAAACTTGTTG | BamHI-NdeI |
|  | 3559 | Reverse | GCCCAAGCTT-ACCGATACGGTCGCAG | HindIII |
| 243 | 3560 | Forward | CGCGGATCCCATATG-ACGATTTTTTCGATGCTGC | BamHI-NdeI |
|  | 3561 | Reverse | CCCGCTCGAG-CGACTTGGTTACCGCG | XhoI |
| 244 | 3562 | Forward | CGCGGATCCCATATG-CCGTCTGAAGCCC | BamHI-NdeI |
|  | 3563 | Reverse | CCCGCTCGAG-TTTTTTCGGTAGGGGATTT | XhoI |
| 246 | 3564 | Forward | CGCGGATCCCATATG-GACATCGGCAGTGC | BamHI-NdeI |
|  | 3565 | Reverse | CCCGCTCGAG-CCCGCGCTGCTGGAG | XhoI |
| 247 | 3566 | Forward | CGCGGATCCCATATG-GTCGGATCGAGTTAC | BamHI-NdeI |
|  | 3567 | Reverse | CCCGCTCGAG-AAGTGTTCTGTTTGCGCA | XhoI |
| 248 | 3568 | Forward | CGCGGATCCCATATG-CGCAAACAGAACACT | BamHI-NdeI |
|  | 3569 | Reverse | CCCGCTCGAG-CTCATCATTATTGCTAACA | XhoI |
| 249 | 3570 | Forward | CGCGGATCCCATATG-AAGAATAATGATTGCTTC | BamHI-NdeI |
|  | 3571 | Reverse | CCCGCTCGAG-TTCCCGACCTCCGAC | XhoI |
| 251 | 3572 | Forward | CGCGGATCCCATATG-CGTGCTGCGGTAGT | BamHI-NdeI |
|  | 3573 | Reverse | CCCGCTCGAG-TACGAAAGCCGGTCGTG | XhoI |
| 253 | 3574 | Forward | AAAAAAGAATTC-ATGATTGACAGGAACCGTATGCTGCG | Eco RI |
|  | 3575 | Reverse | AAAAAACTGCAG-TTATTGGTCTTTCAAACGCCCTTCCTG | Pst I |
| 253a | 3576 | Forward | AAAAAAGAATTC-AAATCCTTTTGAAAACAAGCGAAAACGG | Eco RI |
|  | 3577 | Reverse | AAAAAACTGCAG-TTATTGGTCTTTCAAACGCCCTTCCTG | Pst I |
| 254 | 3578 | Forward | AAAAAAGAATTC-ATGTATACAGGCGAACGCTTCAATAC | Eco RI |
|  | 3579 | Reverse | AAAAAATCTAGA-TCAGATTACGTAACCGTACACGCTGAC | Xba I |
| 255 | 3580 | Forward | CGCGGATCCCATATG-GCCGCGTTGCGTTAC | BamHI-NdeI |
|  | 3581 | Reverse | CCCGCTCGAG-ATCCGCAATACCGACCAG | XhoI |
| 256 | 3582 | Forward | CGCGGATCCGCTAGC-TTTTAACACCGCCGGAC | BamHI-NheI |
|  | 3583 | Reverse | CCCGCTCGAG-ACGCCTGTTTGTGCGG | XhoI |

TABLE 7-continued

Oligonucleotides used for PCR to amplify complete or partial ORFs

| ORF | SEQ ID | primer | Sequence | Restriction sites |
|---|---|---|---|---|
| 257 | 3584 | Forward | CGCGGATCCCATATG-GCGGTTTCTTTCCTG | BamHI-NdeI |
|  | 3585 | Reverse | CCCGCTCGAG-GCGCGTGAATATCGCG | XhoI |
| 258 | 3586 | Forward | AAAAAAGAATTC-GATTATTTCTGGTGGATTGTTGCGTTCAG | Eco RI |
|  | 3587 | Reverse | AAAAAACTGCAG-CTACGCATAAGTTTTTACCGTTTTTGG | Pst I |
| 258a | 3588 | Forward | AAAAAGAATTC-GCGAAGGCGGTGGCGCAAGGCGA | Eco RI |
|  | 3589 | Reverse | AAAAAACTGCAG-CTACGCATAAGTTTTTACCGTTTTTGG | Pst I |
| 259 | 3590 | Forward | CGCGGATCCCATATG-GAAGAGCTGCCTCCG | BamHI-NdeI |
|  | 3591 | Reverse | CCCGCTCGAG-GGCTTTTCCGGCGTTT | XhoI |
| 260 | 3592 | Forward | CGCGGATCCCATATG-GGTGCGGGTATGGT | BamHI-NdeI |
|  | 3593 | Reverse | CCCGCTCGAG-AACAGGGCGACACCCT | XhoI |
| 261 | 3594 | Forward | AAAAAAGAATTC-CAAGATACAGCTCGGGCATTGC | Eco RI |
|  | 3595 | Reverse | AAAAAACTGCAG-TCAAACCAACAAGCCTTGGTCACT | Pst I |
| 263 | 3596 | Forward | CGCGGATCCCATATG-GCACGTTTAACCGTA | BamHI-NdeI |
|  | 3597 | Reverse | CCCGCTCGAG-GGCGTAAGCCTGCAATT | XhoI |
| 264 | 3598 | Forward | AAAAAAGGTACC-GCCGACGCAGTGGTCAAGGCAGAA | Kpn I |
|  | 3599 | Reverse | AAACTGCAG-TCAGCCGGCGGTCAATACCGCCG | Pst I |
| 265 | 3600 | Forward | AAAAAAGAATTC-GCGGAGGTCAAGAGAAGGTGTTTG | Eco RI |
|  | 3601 | Reverse | AAAAAACTGCAG-TTACGAATACGTCGTCAAAATGGG | Pst I |
| 266 | 3602 | Forward | AAAGAATTC-CTCATCTTTGCCAACGCCCCCTTC | Eco RI |
|  | 3603 | Reverse | AAACTGCAG-CTATTCCTGTTGCGCGTGTGCCA | Pst I |
| 267 | 3604 | Forward | AAAGAATTC-TTCTTCCGATTCGATGTTAATCG | Eco RI |
|  | 3605 | Reverse | AAACTGCAG-TTAGTAAAAACCTTTCTGCTTGGC | Pst I |
| 269 | 3606 | Forward | AAAGAATTC-TGCAAACCTTGCGCCACGTGCCC | Eco RI |
|  | 3607 | Reverse | AAACTGCAG-TTACGAAGACCGCAACGAAAGGCAGAG | Pst I |
| 269a | 3608 | Forward | AAAAAAGAATTC-GACTTTATCCAAAACACGGCTTCGCC | Eco RI |
|  | 3609 | Reverse | AAACTGCAG-TTACGAAGACCGCAACGAAAGGCAGAG | Pst I |
| 270 | 3610 | Forward | AAAGAATTC-GCCGTCAAGCTCGTTTTGTTGCAATG | Eco RI |
|  | 3611 | Reverse | AAACTGCAG-TTATTCGGCGGTAAATGCCGTCTG | Pst I |
| 271 | 3612 | Forward | CGCGGATCCCATATG-CCTGTGTGCAGCTCGAC | BamHI-NdeI |
|  | 3613 | Reverse | CCCGCTCGAG-TCCCAGCCCCGTGGAG | XhoI |
| 272 | 3614 | Forward | AAAGAATTC-ATGACCGCAAAGGAAGAACTGTTCGC | Eco RI |
|  | 3615 | Reverse | AAACTGCAG-TCAGAGCAGTTCCAAATCGGGGCT | Pst I |
| 273 | 3616 | Forward | AAAGAATTC-ATGAGTCTTCAGGCGGTATTTATATACCC | Eco RI |
|  | 3617 | Reverse | AAACTGCAG-TTACGCGTAAGAAAAAACTGC | Pst I |
| 274 | 3618 | Forward | CGCGGATCCCATATG-ACAGATTTGGTTACGGAC | BamHI-NdeI |
|  | 3619 | Reverse | CCCGCTCGAG-TTTGCTTTCAGTATTATTGAA | XhoI |
| 276 | 3620 | Forward | AAAAAAGAATTC-ATGATTTTGCCGTCGTCCATCACGATGATGCG | Eco RI |
|  | 3621 | Reverse | AAAAAACTGCAG-CTACACCACCATCGGCGAATTATGGC | Pst I |
| 277 | 3622 | Forward | AAAAAAGAATTC-ATGCCCCGCTTTGAGGACAAGCTCGTAGG | Eco RI |
|  | 3623 | Reverse | AAAAAACTGCAG-TCATAAGCCATGCTTACCTTCCAACAA | Pst I |
| 277a | 3624 | Forward | AAAAAAGAATTC-GGGGCGGCGGCTGGGTTGGACGTAGG | Eco RI |
|  | 3625 | Reverse | AAAAAACTGCAG-TCATAAGCCATGCTTACCTTCCAACAA | Pst I |
| 278 | 3626 | Forward | AAAAAAGGTACC-GTCAAAGTTGTATTAATCGGGCCTTTGCC | Kpn I |
|  | 3627 | Reverse | AAAAAACTGCAG-TCATTCAACCATATCAAATCTGCC | Pst I |
| 278a | 3628 | Forward | AAAAAAGAATTC-AAAACTCTCTAATTCGTCATAGTCG | Eco RI |
|  | 3629 | Reverse | AAAAAACTGCAG-TCATTCAACCATATCAAATCTGCC | Pst I |
| 279 | 3630 | Forward | CGCGGATCCCATATG-TTGCCTGCAATCACGATT | BamHI-NdeI |
|  | 3631 | Reverse | CCCGCTCGAG-TTTAGAAGCGGGCGGCAA | XhoI |
| 280 | 3632 | Forward | AAAAAAGGTACC-GCCCCCTGCCGGTTGTAACCAG | Kpn I |
|  | 3633 | Reverse | AAAAAACTGCAG-TTATTGCTTCATCGCGTTGGTCAAGGC | Pst I |
| 281 | 3634 | Forward | AAAAAAGAATTC-GCACCCGTCGGCGTATTCTCGTCATGCG | Eco RI |
|  | 3635 | Reverse | AAAAAATCTAGA-GGTCAGAATGCCGCCTTCTTTGCCGAG | Xba I |
| 281a | 3636 | Forward | AAAAAAGAATTC-TCCTACCACATCGAAATTCCTTCCGG | Eco RI |
|  | 3637 | Reverse | AAAAAATCTAGA-GGTCAGAATGCCGCCTTCTTTGCCGAG | Xba I |
| 282 | 3638 | Forward | AAAAAAGAATTC-CTTTACCTTGACCTGACCAACGGGCACAG | Eco RI |
|  | 3639 | Reverse | AAAAAACTGCAG-TCAACCTGCCAGTTGCGGGAATATCGT | Pst I |
| 283 | 3640 | Forward | CGCGGATCCCATATG-GCCGTCTTTACTTGGAAG | BamHI-NdeI |
|  | 3641 | Reverse | CCCGCTCGAG-ACGGCAGTATTTGTTTACG | XhoI |
| 284 | 3642 | Forward | CGCGGATCCCATATG-TTTGCCTGCAAAAGAATCG | BamHI-NdeI |
|  | 3643 | Reverse | CCCGCTCGAG-CCGACTTTGCAAAAACTG | XhoI |
| 286 | 3644 | Forward | CGCGGATCCCATATG-GCCGACCTTTCCGAAAA | BamHI-NdeI |
|  | 3645 | Reverse | CCCGCTCGAG-GAAGCGCGTTCCCAAG | XhoI |

TABLE 7-continued

Oligonucleotides used for PCR to amplify complete or partial ORFs

| ORF | SEQ ID | primer | Sequence | Restriction sites |
|---|---|---|---|---|
| 287 | 3646 | Forward | CCGGAATTCTAGCTAGC-CTTTCAGCCTGCGGG | EcoRI-NheI |
| | 3647 | Reverse | CCCGCTCGAG-ATCCTGCTCTTTTTTGCC | XhoI |
| 288 | 3648 | Forward | CGCGGATCCCATATG-CACACCGGACAGG | BamHI-NdeI |
| | 3649 | Reverse | CCCGCTCGAG-CGTATCAAAGACTTGCGT | XhoI |
| 290 | 3650 | Forward | CGCGGATCCCATATG-GCGGTTTGGGGCGGA | BamHI-NdeI |
| | 3651 | Reverse | CCCGCTCGAG-TCGGCGCGGCGGGC | XhoI |
| 292 | 3652 | Forward | CGCGGATCCCATATG-TGCGGGCAAACGCCC | BamHI-NdeI |
| | 3653 | Reverse | CCCGCTCGAG-TTGATTTTTGCGGATGATTT | XhoI |
| 294 | 3654 | Forward | AAAAAAGAATTC-GTCTGGTCGATTCGGGTTGTCAGAAC | Eco RI |
| | 3655 | Reverse | AAAAAACTGCAG-TTACCAGCTGATATAAAACATCGCTTT | Pst I |
| 295 | 3656 | Forward | CGCGGATCCCATATG-AACCGGCCGGCCTCC | BamHI-NdeI |
| | 3657 | Reverse | CCCGCTCGAG-CGATATTTGATTCCGTTGC | XhoI |
| 297 | 3658 | Forward | AAAAAAGAATTC-GCATACATTGCTTCGACAGAGAG | Eco RI |
| | 3659 | Reverse | AAAAAACTGCAG-TCAATCCGATTGCGACACGGT | Pst I |
| 298 | 3660 | Forward | AAAAAAGAATTC-CTGATTGCCGTGTGGTTCAGCCAAAACCC | Eco RI |
| | 3661 | Reverse | AAAAAACTGCAG-TCATGGCTGTGTACTTGATGGTTGCGT | Pst I |
| 299 | 3662 | Forward | CGCGGATCCGCTAGC-CTACCTGTCGCCTCCG | BamHI-NheI |
| | 3663 | Reverse | CCCGCTCGAG-TTGCCTGATTGCAGCGG | XhoI |
| 302 | 3664 | Forward | AAAAAAGAATTC-ATGAGTCAAACCGATACGCAACG | Eco RI |
| | 3665 | Reverse | AAAAAACTGCAG-TTAAGGTGCGGGATAGAATGTGGGCGC | Pst I |
| 305 | 3666 | Forward | AAAAAAGGTACC-GAATTTTTACCGATTTCCAGCACCGGA | Kpn I |
| | 3667 | Reverse | AAAAAACTGCAG-TCATTCCCAACTTATCCAGCCTGACAG | Pst I |
| 305a | 3668 | Forward | AAAAAAGGTACC-TCCCGTTCGGGCAGTACGATTATGGG | Kpn I |
| | 3669 | Reverse | AAAAAACTGCAG-TTACAAACCGACATCATGCAGGGTGAA | Pst I |
| 306 | 3670 | Forward | CGCGGATCCCATATG-TTTATGAACAAATTTTCCC | BamHI-NdeI |
| | 3671 | Reverse | CCCGCTCGAG-CCGCATCGGCAGAC | XhoI |
| 308 | 3672 | Forward | CGCGGATCCCATATG-TTAAATCGGGTATTTTATC | BamHI-NdeI |
| | 3673 | Reverse | CCCGCTCGAG-ATCCGCCATTCCCTGC | XhoI |
| 311 | 3674 | Forward | AAAAAAGGTACC-ATGTTCAGTTTTGGCTGGGTGTTT | Kpn I |
| | 3675 | Reverse | AAACTGCAG-ATGTTCATATTCCCTGCCTTCGGC | Pst I |
| 312 | 3676 | Forward | AAAAAAGGTACC-ATGAGTATCCCATCCGGCGAAATT | Kpn I |
| | 3677 | Reverse | AAACTGCAG-TCAGTTTTTCATCGATTGAACCGG | Pst I |
| 313 | 3678 | Forward | AAAAAAGAATTC-ATGGACGACCCGCGCACCTACGGATC | Eco RI |
| | 3679 | Reverse | AAAAAACTGCAG-TCAGCGGCTGCCGCCGATTTTGCT | Pst I |
| 401 | 3680 | Forward | CGCGGATCCCATATG-AAGGCGGCAACACAGC | BamHI-NdeI |
| | 3681 | Reverse | CCCGCTCGAG-CCTTACGTTTTTCAAAGCC | XhoI |
| 402 | 3682 | Forward | AAAAAAGAATTC-GTGCCTCAGGCATTTTCATTTACCCTTGC | Eco RI |
| | 3683 | Reverse | AAAAAATCTAGA-TTAAATCCCTCTGCCGTATTTGTATTC | Xba I |
| 402a | 3684 | Forward | AAAAAAGAATTC-AGGCTGATTGAAAACAAACACGG | Eco RI |
| | 3685 | Reverse | AAAAAATCTAGA-TTAAATCCCTCTGCCGTATTTGTATTC | Xba I |
| 406 | 3686 | Forward | CGCGGATCCCATATG-TGCGGGACACTGACAG | BamHI-NdeI |
| | 3687 | Reverse | CCCGCTCGAG-AGGTTGTCCTTGTCTATG | XhoI |
| 501 | 3688 | Forward | CGCGGATCCCATATG-GCAGGCGGAGATGGC | BamHI-NdeI |
| | 3689 | Reverse | CCCGCTCGAG-GGTGTGATGTTCACCC | XhoI |
| 502 | 3690 | Forward | CGCGGATCCCATATG-GTAGACGCGCTTAAGCA | BamHI-NdeI |
| | 3691 | Reverse | CCCGCTCGAG-AGCTGCATGGCGGCG | XhoI |
| 503 | 3692 | Forward | CGCGGATCCCATATG-TGTTCGGGGAAGGCG | BamHI-NdeI |
| | 3693 | Reverse | CCCGCTCGAG-CCGCGCATTCCTCGCA | XhoI |
| 504 | 3694 | Forward | CGCGGATCCCATATG-AGCGATATTGAAGTGACG | BamHI-NdeI |
| | 3695 | Reverse | GCCCAAGCTT-TGATTCAAGTCCTTGCCG | HindIII |
| 505 | 3696 | Forward | CGCGGATCCCATATG-TTTCGTTTACAATTCAGG | BamHI-NdeI |
| | 3697 | Reverse | CCCGCTCGAG-CGGCGTTTTATAGCGG | XhoI |
| 510 | 3698 | Forward | CGCGGATCCCATATG-CCTTCGCGGACAC | BamHI-NdeI |
| | 3699 | Reverse | CCCGCTCGAG-GCGCACTGGCAGCG | XhoI |
| 512 | 3700 | Forward | CGCGGATCCCATATG-GGACATGAAGTAACGGT | BamHI-NdeI |
| | 3701 | Reverse | CCCGCTCGAG-AGGAATAGCCTTTGACG | XhoI |

TABLE 7-continued

Oligonucleotides used for PCR to amplify complete or partial ORFs

| ORF | SEQ ID | primer | Sequence | Restriction sites |
|---|---|---|---|---|
| 515 | 3702 | Forward | CGC<u>GGATCCCATATG</u>-GAGGAAATAGCCTTCGA | BamHI-NdeI |
|  | 3703 | Reverse | CCC<u>GCTCGAG</u>-AAATGCCGCAAAGCATC | XhoI |
| 516 | 3704 | Forward | CGC<u>GGATCCCATATG</u>-TGTACGTTGATGTTGTGG | BamHI-NdeI |
|  | 3705 | Reverse | CCC<u>GCTCGAG</u>-TTTGCGGGCGGCATC | XhoI |
| 517 | 3706 | Forward | CGC<u>GGATCCCATATG</u>-GGTAAAGGTGTGGAAATA | BamHI-NdeI |
|  | 3707 | Reverse | CCC<u>GCTCGAG</u>-GTGCGCCCAGCCGT | XhoI |
| 518 | 3708 | Forward | AAA<u>GAATTC</u>-GCTTTTTTACTGCTCCGACCGGAAGG | Eco RI |
|  | 3709 | Reverse | AAA<u>CTGCAG</u>-TCAAATTTCAGACTCTGCCAC | Pst I |
| 519 | 3710 | Forward | CGC<u>GGATCCCATATG</u>-TTCAAATCCTTTGTCGTCA | BamHI-NdeI |
|  | 3711 | Reverse | CCC<u>GCTCGAG</u>-TTTGGCGGTTTTGCTGC | XhoI |
| 520 | 3712 | Forward | CGC<u>GGATCCCATATG</u>-CCTGCGCTTCTTTCA | BamHI-NdeI |
|  | 3713 | Reverse | CCC<u>GCTCGAG</u>-ATATTTACATTTCAGTCGGC | XhoI |
| 521 | 3714 | Forward | CGC<u>GGATCCCATATG</u>-GCCAAAATCTATACCTGC | BamHI-NdeI |
|  | 3715 | Reverse | CCC<u>GCTCGAG</u>-CATACGCCCCAGTTCC | XhoI |
| 522 | 3716 | Forward | CGC<u>GGATCCCATATG</u>-ACTGAGCCGAAACAC | BamHI-NdeI |
|  | 3717 | Reverse | GCCC<u>AAGCTT</u>-TTCTGATTTCAAATCGGCA | HindIII |
| 523 | 3718 | Forward | CGC<u>GGATCCCATATG</u>-GCTCTGCTTTCCGCG | BamHI-NdeI |
|  | 3719 | Reverse | CCC<u>GCTCGAG</u>-AGGGTGTGTGATAATAAGAAG | XhoI |
| 525 | 3720 | Forward | CGC<u>GGATCCCATATG</u>-GCCGAAATGGTTCAAATC | BamHI-NdeI |
|  | 3721 | Reverse | CCC<u>GCTCGAG</u>-GCCCGTGCATATCATAAA | XhoI |
| 527 | 3722 | Forward | AAA<u>GAATTC</u>-TTCCCTCAATGTTGCCGTTTTCG | Eco RI |
|  | 3723 | Reverse | AAA<u>CTGCAG</u>-TTATGCTAAACTCGAAACAAATTC | Pst I |
| 529 | 3724 | Forward | CGC<u>GGATCCGCTAGC</u>-TGCTCCGGCAGCAAAAC | BamHI-NheI |
|  | 3725 | Reverse | GCCC<u>AAGCTT</u>-ACGCAGTTCGGAATGGAG | HindIII |
| 530 | 3726 | Forward | CGC<u>GGATCCCATATG</u>-AGTGCGAGCGCGG | BamHI-NdeI |
|  | 3727 | Reverse | CCC<u>GCTCGAG</u>-ACGACCGACTGATTCCG | XhoI |
| 531 | 3728 | Forward | AAAAAA<u>GAATTC</u>-TATGCCGCCGCCTACCAAATCTACGG | Eco RI |
|  | 3729 | Reverse | AAAAAA<u>CTGCAG</u>-TTAAAACAGCGCCGTGCCGACGACAAG | Pst I |
| 532 | 3730 | Forward | AAAAAA<u>GAATTC</u>-ATGAGCGGTCAGTTGGGCAAAGGTGC | Eco RI |
|  | 3731 | Reverse | AAAAAA<u>CTGCAG</u>-TCAGTGTTCCAAGTGGTCGGTATCAA | Pst I |
| 532a | 3732 | Forward | AAAAAA<u>GAATTC</u>-TTGGGTGTCGCGTTTGAGCCGGAAGT | Eco RI |
|  | 3733 | Reverse | AAAAAA<u>CTGCAG</u>-TCAGTGTTCCAAGTGGTCGGTATCAAA | Pst I |
| 535 | 3734 | Forward | AAA<u>GAATTC</u>-ATGCCCTTTCCCGTTTTCAGAC | Eco RI |
|  | 3735 | Reverse | AAA<u>CTGCAG</u>-TCAGACGACCCCGCCTTCCCC | Pst I |
| 537 | 3736 | Forward | CGC<u>GGATCCCATATG</u>-CATACCCAAAACCAATCC | BamHI-NdeI |
|  | 3737 | Reverse | CCC<u>GCTCGAG</u>-ATCCTGCAAATAAAGGGTT | XhoI |
| 538 | 3738 | Forward | CGC<u>GGATCCCATATG</u>-GTCGAGCTGGTCAAAGC | BamHI-NdeI |
|  | 3739 | Reverse | CCC<u>GCTCGAG</u>-TGGCATTTCGGTTTCGTC | XhoI |
| 539 | 3740 | Forward | CGC<u>GGATCCGCTAGC</u>-GAGGATTTGCAGGAAA | BamHI-NheI |
|  | 3741 | Reverse | CCC<u>GCTCGAG</u>-TACCAATGTCGGCAAATC | XhoI |
| 542 | 3742 | Forward | AAA<u>GAATTC</u>-ATGCCGTCTGAAACCGTGTC | Eco RI |
|  | 3743 | Reverse | AAA<u>CTGCAG</u>-TTACCGCGAACCGGTCAGGAT | Pst I |
| 543 | 3744 | Forward | AAAAAA<u>GAATTC</u>-GCCTTCGATGGCGACGTTGTAGGTAC | Eco RI |
|  | 3745 | Reverse | AAAAAA<u>TCTAGA</u>-TTAATGAAGAAGAACATATTGGAATTTTGG | Xba I |
| 543a | 3746 | Forward | AAAAAA<u>GAATTC</u>-GGCAAAACTCGTCATGAATTTGC | Eco RI |
|  | 3747 | Reverse | AAAAAA<u>TCTAGA</u>-TTAATGAAGAAGAACATATTGGAATTTTGG | Xba I |
| 544 | 3748 | Forward | AAA<u>GAATTC</u>-GCGCCCGCCTTCTCCCTGCCCGACCTGCACGG | Eco RI |
|  | 3749 | Reverse | AAA<u>CTGCAG</u>-CTATTGCGCCACGCGCGTATCGAT | Pst I |
| 544a | 3750 | Forward | AAAAAA<u>GAATTC</u>-GCAAATGACTATAAAAACAAAAACTTCCAAGTACTTGC | Eco RI |
|  | 3751 | Reverse | AAA<u>CTGCAG</u>-CTATTGCGCCACGCGCGTATCGAT | Pst I |
| 547 | 3752 | Forward | AAA<u>GAATTC</u>-ATGTTCGTAGATAACGGATTTAATAAAAC | Eco RI |
|  | 3753 | Reverse | AAA<u>CTGCAG</u>-TTAACAACAAAAAACAAACCGCTT | Pst I |
| 548 | 3754 | Forward | AAA<u>GAATTC</u>-GCCTGCAAACCTCAAGACAACAGTGCGGC | Eco RI |
|  | 3755 | Reverse | AAA<u>CTGCAG</u>-TCAGAGCAGGGTCCTTACATCGGC | Pst I |
| 550 | 3756 | Forward | AAAAAA<u>GTCGAC</u>-ATGATAACGGACAGGTTTCATCTCTTTCATTTTCC | Sal I |
|  | 3757 | Reverse | AAA<u>CTGCAG</u>-TTACGCAAACGCTGCAAAATCCCC | Pst I |

TABLE 7-continued

Oligonucleotides used for PCR to amplify complete or partial ORFs

| ORF | SEQ ID | primer | Sequence | Restriction sites |
|---|---|---|---|---|
| 550a | 3758 | Forward | AAAAAAGAATTC-GTAAATCACGCCTTTGGAGTCGCAAACGG | Eco RI |
| | 3759 | Reverse | AAACTGCAG-TTACGCAAACGCTGCAAAATCCCC | Pst I |
| 552 | 3760 | Forward | AAAAAAGAATTC-TTGGCGCGTTGGCTGGATAC | Eco RI |
| | 3761 | Reverse | AAACTGCAG-TTATTTCTGATGCCTTTTCCCAAC | Pst I |
| 554 | 3762 | Forward | CGCGGATCCCATATG-TCGCCCGCGCCCAAC | BamHI-NdeI |
| | 3763 | Reverse | CCCGCTCGAG-CTGCCCTGTCAGACAC | XhoI |
| 556 | 3764 | Forward | AAAGAATTC-GCGGGCGGTTTTGTTTGGACATCCCG | Eco RI |
| | 3765 | Reverse | AAACTGCAG-TTAACGGTGCGGACGTTTCTGACC | Pst I |
| 557 | 3766 | Forward | CGCGGATCCCATATG-TGCGGTTTCCACCTGAA | BamHI-NdeI |
| | 3767 | Reverse | CCCGCTCGAG-TTCCGCCTTCAGAAAGG | XhoI |
| 558 | 3768 | Forward | AAAGAATTC-GAGCTTTATATGTTTCAACAGGGGACGGC | Eco RI |
| | 3769 | Reverse | AAACTGCAG-CTAAACAATGCCGTCTGAAAGTGGAGA | Pst I |
| 558a | 3770 | Forward | AAAAAAGAATTC-ATTAGATTCTATCGCCATAAACAGACGGG | Eco RI |
| | 3771 | Reverse | AAAAAACTGCAG-CTAAACAATGCCGTCTGAAAGTGGAGA | Pst I |
| 560 | 3772 | Forward | AAAAAGAATTC-TCGCCTTTCCGGGACGGGGCGCACAAGATGGC | Eco RI |
| | 3773 | Reverse | AAAAAACTGCAG-TCATGCGGTTTCAGACGGCATTTTGGC | Pst I |
| 561 | 3774 | Forward | CCGGAATTCTACATATG-ATACTGCCAGCCCGT | EcoRI-NdeI |
| | 3775 | Reverse | CCCGCTCGAG-TTTCAAGCTTTCTTCAGATG | XhoI |
| 562 | 3776 | Forward | CGCGGATCCCATATG-GCAAGCCCGTCGAG | BamHI-NdeI |
| | 3777 | Reverse | CCCGCTCGAG-AGACCAACTCCAACTCGT | XhoI |
| 565 | 3778 | Forward | CGCGGATCCCATATG-AAGTCGAGCGCGAAATAC | BamHI-NdeI |
| | 3779 | Reverse | CCCGCTCGAG-GGCATTGATCGGCGGC | XhoI |
| 566 | 3780 | Forward | CGCGGATCCCATATG-GTCGGTGGCGAAGAGG | BamHI-NdeI |
| | 3781 | Reverse | CCCGCTCGAG-CGCATGGGCGAAGTCA | XhoI |
| 567 | 3782 | Forward | CCGGAATTCTACATATG-AGTGCGAACATCCTTG | EcoRI-NdeI |
| | 3783 | Reverse | CCCGCTCGAG-TTTCCCCGACACCCTCG | XhoI |
| 568 | 3784 | Forward | CGCGGATCCCATATG-CTCAGGGTCAGACC | BamHI-NdeI |
| | 3785 | Reverse | CCCGCTCGAG-CGGCGCGGCGTTCAG | XhoI |
| 569 | 3786 | Forward | AAAAAAGAATTC-CTGATTGCCTTGTGGGAATATGCCCG | Eco RI |
| | 3787 | Reverse | AAAAAACTGCAG-TTATGCATAGACGCTGATAACGGCAAT | Pst I |
| 570 | 3788 | Forward | CGCGGATCCCATATG-GACACCTTCCAAAAAATCG | BamHI-NdeI |
| | 3789 | Reverse | CCCGCTCGAG-GCGGGCGTTCATTTCTTT | XhoI |
| 571 | 3790 | Forward | AAAAAAGAATTC-ATGGGTATTGCCGGCGCCGTAAATGTTTTGAACCC | Eco RI |
| | 3791 | Reverse | AAAAAACTGCAG-TTATGGCCGACGCGCGGCTACCTGACG | Pst I |
| 572 | 3792 | Forward | CGCGGATCCCATATG-GCGCAAAAGGCAAACC | BamHI-NdeI |
| | 3793 | Reverse | CCCGCTCGAG-GCGCAGTGTGCCGATA | XhoI |
| 573 | 3794 | Forward | CGCGGATCCCATATG-CCCTGTTTGTGCCG | BamHI-NdeI |
| | 3795 | Reverse | CCCGCTCGAG-GACGGTGTCATTTCGCC | XhoI |
| 574 | 3796 | Forward | CGCGGATCCCATATG-TGGTTTGCCGCCCGC | BamHI-NdeI |
| | 3797 | Reverse | CCCGCTCGAG-AACTTCGATTTTATTCGGG | XhoI |
| 575 | 3798 | Forward | CGCGGATCCCATATG-GTTTCGGGCGAGG | BamHI-NdeI |
| | 3799 | Reverse | CCCGCTCGAG-CATTCCGAATCTGAACAG | XhoI |
| 576 | 3800 | Forward | CGCGGATCCCATATG-GCCGCCCCCGCATCT | BamHI-NdeI |
| | 3801 | Reverse | CCCGCTCGAG-ATTTACTTTTTTGATGTCGAC | XhoI |
| 577 | 3802 | Forward | CGCGGATCCCATATG-GAAAGGAACGGTGTATTT | BamHI-NdeI |
| | 3803 | Reverse | CCCGCTCGAG-AGGCTGTTTGGTAGATTCG | XhoI |
| 578 | 3804 | Forward | CGCGGATCCCATATG-AGAAGGTTCGTACAG | BamHI-NdeI |
| | 3805 | Reverse | CCCGCTCGAG-GCCAACGCCTCCACG | XhoI |
| 579 | 3806 | Forward | CGCGGATCCCATATG-AGATTGGGCGTTTCCAC | BamHI-NdeI |
| | 3807 | Reverse | CCCGCTCGAG-AGAATTGATGATGTGTATGT | XhoI |
| 580 | 3808 | Forward | CGCGGATCCCATATG-AGGCAGACTTCGCCGA | BamHI-NdeI |
| | 3809 | Reverse | CCCGCTCGAG-CACTTCCCCCGAAGTG | XhoI |
| 581 | 3810 | Forward | CGCGGATCCCATATG-CACTTCGCCCAGC | BamHI-NdeI |

TABLE 7-continued

Oligonucleotides used for PCR to amplify complete or partial ORFs

| ORF | SEQ ID | primer | Sequence | Restriction sites |
|---|---|---|---|---|
| | 3811 | Reverse | CCCGCTCGAG-CGCCGTTTGGCTTTGG | XhoI |
| 582 | 3812 | Forward | AAAAAAGAATTC-TTTGGAGAGACCGCGCTGCAATGCGC | Eco RI |
| | 3813 | Reverse | AAAAAATCTAGA-TCAGATGCCGTCCCAGTCGTTGAA | Xba I |
| 583 | 3814 | Forward | AAAAAAGAATTC-ACTGCCGGCAATCGACTGCATAATCG | Eco RI |
| | 3815 | Reverse | AAAAAACTGCAG-TTAACGGAGGTCAATATGATGAAATTG | Pst I |
| 584 | 3816 | Forward | AAAAAAGAATTC-GCGGCTGAAGCATTGAATTACAATATTGTC | Eco RI |
| | 3817 | Reverse | AAAAAACTGCAG-TCAGAACTGAACCGTCCCATTGACGCT | Pst I |
| 585 | 3818 | Forward | AAAAAAGGTACC-TCTTTCTGGCTGGTGCAGAACACCCTTGC | Eco RI |
| | 3819 | Reverse | AAAAAACTGCAG-TCAGTTCGCACTTTTTTCTGTTTTGGA | Pst I |
| 586 | 3820 | Forward | CGCGGATCCCATATG-GCAGCCCATCTCG | BamHI-NdeI |
| | 3821 | Reverse | CCCGCTCGAG-TTTCAGCGAATCAAGTTTC | XhoI |
| 587 | 3822 | Forward | CGCGGATCCCATATG-GACCTGCCCTTGACGA | BamHI-NdeI |
| | 3823 | Reverse | CCCGCTCGAG-AAATGTATGCTGTACGCC | XhoI |
| 588 | 3824 | Forward | AAAAAAGAATTC-GCCGTCCTGACTTCCTATCAAGAACCAGG | Eco RI |
| | 3825 | Reverse | AAAAAACTGCAG-TTATTTGTTTTTGGGCAGTTTCACTTC | Pst I |
| 589 | 3826 | Forward | AAAAAAGAATTC-ATGCAACAAAAAATCCGTTTCCAAATCGAAGG | Eco RI |
| | 3827 | Reverse | AAAAAACTGCAG-CTAATCGATTTTTACCCGTTTCAGGCG | Pst I |
| 590 | 3828 | Forward | AAAAAAGAATTC-ATGAAAAAACCTTTGATTTCAGTTGCGGC | Eco RI |
| | 3829 | Reverse | AAAAAACTGCAG-TTACTGCTGCGGCTCTGAAACCAT | Pst I |
| 591 | 3830 | Forward | AAAAAAGAATTC-CACTACATCGTTGCCAGATTGTGCGG | Eco RI |
| | 3831 | Reverse | AAAAAACTGCAG-CTAACCGAGCAGCCGGGTAACGTCGTT | Pst I |
| 592a | 3832 | Forward | AAAAAAGAATTC-CGCGATTACACCGCCAAGCTGAAAATGGG | Eco RI |
| | 3833 | Reverse | AAAAAACTGCAG-TTACCAAACGTCGGATTTGATACG | Pst I |
| 593 | 3834 | Forward | CGCGGATCCGCTAGC-CTTGAACTGAACGGACTC | BamHI-NheI |
| | 3835 | Reverse | CCCGCTCGAG-GCGGAAGCGGACGATT | XhoI |
| 594a | 3836 | Forward | AAAAAAGAATTC-GGTAAGTTCGCCGTTCAGGCCTTTCA | Eco RI |
| | 3837 | Reverse | AAAAAACTGCAG-TTACGCCGCGTTTCCTGACACTCGCG | Pst I |
| 595 | 3838 | Forward | AAAAAAGAATTC-TGCCAGCCGCCGGAGGCGGAGAAAGC | Eco RI |
| | 3839 | Reverse | AAAAAACTGCAG-TTATTTCAAGCCGAGTATGCCGCG | Pst I |
| 596 | 3840 | Forward | CGCGGATCCCATATG-TCCCAACAATACGTC | BamHI-NdeI |
| | 3841 | Reverse | CCCGCTCGAG-ACGCGTTACCGGTTTGT | XhoI |
| 597 | 3842 | Forward | CGCGGATCCCATATG-CTGCTTCATGTCAGC | BamHI-NdeI |
| | 3843 | Reverse | GCCCAAGCTT-ACGTATCCAGCTCGAAG | HindIII |
| 601 | 3844 | Forward | CGCGGATCCCATATG-ATATGTTCCCAACCGGCAAT | BamHI-NdeI |
| | 3845 | Reverse | CCCGCTCGAG-AAAACAATCCTCAGGCAC | XhoI |
| 602 | 3846 | Forward | CGCGGATCCGCTAGC-TTGCTCCATCAATGC | BamHI-NheI |
| | 3847 | Reverse | CCCGCTCGAG-ATGCAGCTGCTAAAAGCG | XhoI |
| 603 | 3848 | Forward | AAAAAAGAATTC-CTGTCCTCGCGTAGGCGGGACGGGG | Eco RI |
| | 3849 | Reverse | AAAAAACTGCAG-CTACAAGATGCCGGCAAGTTCGGC | Pst I |
| 604 | 3850 | Forward | CGCGGATCCGCTAGC-CCCGAAGCGCACTT | BamHI-NheI |
| | 3851 | Reverse | CCCGCTCGAG-GACGGCATCTGCACGG | XhoI |
| 606a | 3852 | Forward | AAAAAAGAATTC-CGCGAATACCGCGCCGATGCGGGCGC | Eco RI |
| | 3853 | Reverse | AAAAAACTGCAG-TTAAAGCGATTTGAGGCGGGCGATACG | Pst I |
| 607 | 3854 | Forward | AAAAAAGAATTC-ATGCTGCTCGACCTCAACCGCTTTTC | Eco RI |
| | 3855 | Reverse | AAAAAACTGCAG-TCAGACGGCCTTATGCGATCTGAC | Pst I |
| 608 | 3856 | Forward | AAAAAAGAATTC-ATGTCCGCCCTCCTCCCCATCATCAACCG | Eco RI |
| | 3857 | Reverse | AAAAAACTGCAG-TTAGTCTATCCAAATGTCGCGTTC | Pst I |
| 609 | 3858 | Forward | CGCGGATCCCATATG-GTTGTGGATAGACTCG | BamHI-NdeI |
| | 3859 | Reverse | CCCGCTCGAG-CTGGATTATGATGTCTGTC | XhoI |
| 610 | 3860 | Forward | CGCGGATCCCATATG-ATTGGAGGGCTTATGCA | BamHI-NdeI |
| | 3861 | Reverse | CCCGCTCGAG-ACGCTTCAACATCTTTGCC | XhoI |
| 611 | 3862 | Forward | CGCGGATCCCATATG-CCGTCTCAAAACGGG | BamHI-NdeI |
| | 3863 | Reverse | CCCGCTCGAG-AACGACTTTGAACGCGCAA | XhoI |
| 613 | 3864 | Forward | CGCGGATCCCATATG-TCGCGTTCGAGCCG3 | BamHI-NdeI |
| | 3865 | Reverse | CCCGCTCGAG-AGCCTGTAAAATAAGCGGC | XhoI |
| 614 | 3866 | Forward | CGCGGATCCCATATG-TCCGTCGTGAGCGGC | BamHI-NdeI |
| | 3867 | Reverse | CCCGCTCGAG-CCATACTGCGGCGTTC | XhoI |
| 616 | 3868 | Forward | AAAAAAGAATTC-ATGTCAAACACAATCAAATGGTTGTCGG | Eco RI |
| | 3869 | Reverse | AAAAAATCTAGA-TTAGTCCGGGCGGCAGGCAGCTCG | Xba I |

TABLE 7-continued

Oligonucleotides used for PCR to amplify complete or partial ORFs

| ORF | SEQ ID | primer | Sequence | Restriction sites |
|---|---|---|---|---|
| 619a | 3870 | Forward | AAAAAAGAATTC-GGGCTTCTCGCCGCCTCGCTTGC | Eco RI |
| | 3871 | Reverse | AAAAAACTGCAG-TCATTTTTTGTGTTTAAAACGAGATA | Pst I |
| 622 | 3872 | Forward | CGCGGATCCCATATG-GCCGCCCTGCCTAAAG | BamHI-NdeI |
| | 3873 | Reverse | CCCGCTCGAG-TTTGTCCAAATGATAAATCTG | XhoI |
| 624 | 3874 | Forward | CGCGGATCCCATATG-TCCCCGCGCTTTTACCG | BamHI-NdeI |
| | 3875 | Reverse | CCCGCTCGAG-AGATTCGGGCCTGCGC | XhoI |
| 625 | 3876 | Forward | CGCGGATCCCATATG-TTTGCAACCAGGAAAATG | BamHI-NdeI |
| | 3877 | Reverse | CCCGCTCGAG-CGGCAAAATTACCGCCTT | XhoI |
| 627a | 3878 | Forward | AAAAAAGAATTC-AAAGCAGGCGAGGCAGGCGCGCTGGG | Eco RI |
| | 3879 | Reverse | AAAAAACTGCAG-TTACGAATGAAACAGGGTACCCGTCATCAAGGC | Pst I |
| 628 | 3880 | Forward | AAAAAAGGTACC-GCCTTACAAACATGGATTTTGCGTTC | Kpn I |
| | 3881 | Reverse | AAAAAACTGCAG-CTACGCACCTGAAGCGCTGGCAAA | Pst I |
| 629a | 3882 | Forward | AAAAAAGAATTC-GCCACCTTTATCGCGTATGAAAACGA | Eco RI |
| | 3883 | Reverse | AAAAAACTGCAG-TTACAACACCGCCGTCCGGTTCAAACC | Pst I |
| 630a | 3884 | Forward | AAAAAAGAATTC-GCGGCTTTGGGTATTTCTTTCGG | Eco RI |
| | 3885 | Reverse | AAAAAACTGCAG-TTAGGAGACTTCGCCAATGGAGCGGG | Pst I |
| 635 | 3886 | Forward | AAAAAAGAATTC-ATGACCCAGCGACGGGTCGGCAAGCAAAACCG | Eco RI |
| | 3887 | Reverse | AAAAAACTGCAG-TTAATCCACTATAATCCTGTTGCT | Pst I |
| 638 | 3888 | Forward | AAAAAAGAATTC-ATGATTGGCGAAAAGTTTATCGTAGTTGG | Eco RI |
| | 3889 | Reverse | AAAAAACTGCAG-TCACGAACCGATTATGCTGATCGG | Pst I |
| 639 | 3890 | Forward | CGCGGATCCCATATG-ATGCTTTATTTTGTTCG | BamHI-NdeI |
| | 3891 | Reverse | CCCGCTCGAG-ATCGCGGCTGCCGAC | XhoI |
| 642 | 3892 | Forward | CGCGGATCCCATATG-CGGTATCCGCCGCAAT | BamHI-NdeI |
| | 3893 | Reverse | CCCGCTCGAG-AGGATTGCGGGGCATTA | XhoI |
| 643 | 3894 | Forward | CGCGGATCCCATATG-GCTTCGCCGTCGGCAG | BamHI-NdeI |
| | 3895 | Reverse | CCCGCTCGAG-AACCGAAAACAGACCGC | XhoI |
| 644 | 3896 | Forward | AAAAAAGAATTC-ATGCCGTCTGAAAGGTCGGCGGATTGTTGCCC | Eco RI |
| | 3897 | Reverse | AAAAAACTAGA-CTACCCGCAATATCGGCAGTCCAATAT | Pst I |
| 645 | 3898 | Forward | AAAAAAGAATTC-GTGGAACAGAGCAACACGTTAAATCG | Eco RI |
| | 3899 | Reverse | AAAAAACTGCAG-CTACGAGGAAACCGAAGACCAGGCCGC | Pst I |
| 647 | 3900 | Forward | AAAAAAGAATTC-ATGCAAAGGCTCGCCGCAGACGG | Eco RI |
| | 3901 | Reverse | AAAAAACTGCAG-TTAGATTATCAGGGATATCCGGTAGAA | Pst I |
| 648 | 3902 | Forward | AAAAAAGAATTC-ATGAACAGGCGCGACGCGCGGATCGAACG | Eco RI |
| | 3903 | Reverse | AAAAAACTGCAG-TCAAGCTGTGTGCTGATTGAATGCGAC | Pst I |
| 649 | 3904 | Forward | AAAAAAGAATTC-GGTACGTCAGAACCCGCCCACCG | Eco RI |
| | 3905 | Reverse | AAAAAACTGCAG-TTAACGGCGGAAACTGCCGCCGTC | Pst I |
| 650 | 3906 | Forward | AAAAAAGAATTC-ATGTCCAAACTCAAAACCATCGC | Eco RI |
| | 3907 | Reverse | AAAAAACTGCAG-TCAGACGGCATGGCGGTCTGTTTT | Pst I |
| 652 | 3908 | Forward | AAAAAAGGTACC-GCTGCCGAAGACTCAGGCCTGCCGCTTTACCG | Kpn I |
| | 3909 | Reverse | AAAAAACTGCAG-TTATTTGCCCAGTTGGTAGAATGCGGC | Pst I |
| 653 | 3910 | Forward | AAAAAAGAATTC-GCGGCTTTGCCGGTAATTTTCATCGG | Eco RI |
| | 3911 | Reverse | AAAAAACTGCAG-CTATGCCGGTCTGGTTGCCGGCGGCGA | Pst I |
| 656a | 3912 | Forward | AAAAAAGAATTC-CGGCCGACGTCGTTGCGTCCTAAGTC | Eco RI |
| | 3913 | Reverse | AAAAAACTGCAG-CTACGATTTCGGCGATTTCCACATCGT | Pst I |
| 657 | 3914 | Forward | AAAAAAGAATTC-GCAGAATTTGCCGACCGCCATTTGTGCGC | Eco RI |
| | 3915 | Reverse | AAAAAACTGCAG-TTATAGGGACTGATGCAGTTTTTTTGC | Pst I |
| 658 | 3916 | Forward | CGCGGATCCCATATG-GTGTCCGGAATTGTG | BamHI-NdeI |
| | 3917 | Reverse | CCCGCTCGAG-GGCAGAATGTTTACCGTT | XhoI |
| 661 | 3918 | Forward | AAAAAAGAATTC-ATGCACATCGGCGGCTATTTTATCGACAACCC | Eco RI |
| | 3919 | Reverse | AAAAAACTGCAG-TCACGACGTGTCTGTTCGCCGTCGGGC | Pst I |
| 663 | 3920 | Forward | CGCGGATCCCATATG-TGTATCGAGATGAAATT | BamHI-NdeI |
| | 3921 | Reverse | CCCGCTCGAG-GTAAAAATCGGGGCTGC | XhoI |
| 664 | 3922 | Forward | CGCGGATCCCATATG-GCGGCTGGCGCGGT | BamHI-NdeI |
| | 3923 | Reverse | CCCGCTCGAG-AAATCGAGTTTTACACCAC | XhoI |
| 665 | 3924 | Forward | AAAAAAGAATTC-ATGAAATGGGACGAAACGCGCTTCGG | Eco RI |
| | 3925 | Reverse | AAAAAACTGCAG-TCAATCCAAAATTTTGCCGACGATTTC | Pst I |
| 666 | 3926 | Forward | AAAAAAGAATTC-AACTCAGGCGAAGGAGTGCTTGTGGC | Eco RI |
| | 3927 | Reverse | AAAAAATCTAGA-TCAGTTTAGGGATAGCAGGCGTAC | Xba I |

TABLE 7-continued

Oligonucleotides used for PCR to amplify complete or partial ORFs

| ORF | SEQ ID | primer | Sequence | Restriction sites |
|---|---|---|---|---|
| 667 | 3928 | Forward | AAAAAAGAATTC-CCGCATCCGTTTGATTTCCATTTCGTATTCGTCCG | Eco RI |
|  | 3929 | Reverse | AAAAAACTGCAG-TTAATGACACAATAGGCGCAAGTC | Pst I |
| 669 | 3930 | Forward | AAAAAAGAATTC-ATGCGCCGCATCATTAAAAAACACCAGCC | Eco RI |
|  | 3931 | Reverse | AAAAAACTGCAG-TTACAGTATCCGTTTGATGTCGGC | Pst I |
| 670a | 3932 | Forward | AAAAAAGAATTC-AAAAACGCTTCGGGCGTTTCGTCTTC | Eco RI |
|  | 3933 | Reverse | AAAAAACTGCAG-TTAGGAGCTTTTGGAACGCGTCGGACTGGC | Pst I |
| 671 | 3934 | Forward | CGCGGATCCCATATG-ACCAGCAGGGTAAC | BamHI-NdeI |
|  | 3935 | Reverse | CCCGCTCGAG-AGCAACTATAAAAACGCAAG | XhoI |
| 672 | 3936 | Forward | CGCGGATCCCATATG-AGGAAAATCCGCACC | BamHI-NdeI |
|  | 3937 | Reverse | CCCGCTCGAG-ACGGGATAGGCGGTTG | XhoI |
| 673 | 3938 | Forward | AAAAAAGAATTC-ATGGATATTGAAACCTTCCTTGCAGG | Eco RI |
|  | 3939 | Reverse | AAAAAACTGCAG-CTACAAACCCAGCTCGCGCAGGAA | Pst I |
| 674 | 3940 | Forward | AAAAAAGAATTC-ATGAAAACAGCCCGCCGCCGTTCCCG | Eco RI |
|  | 3941 | Reverse | AAAAAACTGCAG-TCAACGGCGTTTGGGCTCGTCGGG | Pst I |
| 675 | 3942 | Forward | CGCGGATCCCATATG-AACACCATCGCCCC | BamHI-NdeI |
|  | 3943 | Reverse | CCCGCTCGAG-TTCTTCGTCTTCAAACTGT | XhoI |
| 677a | 3944 | Forward | AAAAAAGAATTC-AGACGGCATTCCCGATCAGTCGATTTTGA | Eco RI |
|  | 3945 | Reverse | AAAAAACTGCAG-TTACGTATGCGCGAAATCGACCGCCGC | Pst I |
| 680 | 3946 | Forward | CGCGGATCCGCTAGC-ACGAAGGGCAGTTCGG | BamHI-NheI |
|  | 3947 | Reverse | CCCGCTCGAG-CATCAAAAACCTGCCGC | XhoI |
| 681 | 3948 | Forward | AAAAAAGAATTC-ATGACGACGCCGATGGCAATCAGTGC | Eco RI |
|  | 3949 | Reverse | AAAAAACTGCAG-TTACCGTCTTCCGCAAAAAACAGC | Pst I |
| 683 | 3950 | Forward | CGCGGATCCCATATG-TGCAGCACACCGGACAA | BamHI-NdeI |
|  | 3951 | Reverse | CCCGCTCGAG-GAGTTTTTTTCCGCATACG | XhoI |
| 684 | 3952 | Forward | CGCGGATCCCATATG-TGCGGTACTGTGCAAAG | BamHI-NdeI |
|  | 3953 | Reverse | CCCGCTCGAG-CTCGACCATCTGTTGCG | XhoI |
| 685 | 3954 | Forward | CGCGGATCCCATATG-TGTTTGCTTAATAATAAACATT | BamHI-NdeI |
|  | 3955 | Reverse | CCCGCTCGAG-CTTTTTCCCCGCCGCA | XhoI |
| 686 | 3956 | Forward | CGCGGATCCCATATG-TGCGGCGGTTCGGAAG | BamHI-NdeI |
|  | 3957 | Reverse | CCCGCTCGAG-CATTCCGATTCTGATGAAG | XhoI |
| 687 | 3958 | Forward | CGCGGATCCCATATG-TGCGACAGCAAAGTCCA | BamHI-NdeI |
|  | 3959 | Reverse | CCCGCTCGAG-CTGCGCGGCTTTTTGTT | XhoI |
| 690 | 3960 | Forward | CGCGGATCCCATATG-TGTTCTCCGAGCAAAGAC | BamHI-NdeI |
|  | 3961 | Reverse | CCCGCTCGAG-TATTCGCCCCGTGTTTGG | XhoI |
| 691 | 3962 | Forward | CGCGGATCCCATATG-GCCACGGCTTATATCCC | BamHI-NdeI |
|  | 3963 | Reverse | CCCGCTCGAG-TTTGAGGCAGGAAGAAAG | XhoI |
| 694 | 3964 | Forward | CGCGGATCCCATATG-TTGGTTTCCGCATCCGG | BamHI-NdeI |
|  | 3965 | Reverse | CCCGCTCGAG-TCTGCGTCGGTGCGGT | XhoI |
| 695 | 3966 | Forward | CGCGGATCCCATATG-TTGCCTCAAACTCGTCCG | BamHI-NdeI |
|  | 3967 | Reverse | CCCGCTCGAG-TCGTTTGCGCACGGCT | XhoI |
| 696 | 3968 | Forward | CGCGGATCCCATATG-TTGGGTTGCCGGCAGG | BamHI-NdeI |
|  | 3969 | Reverse | CCCGCTCGAG-TTGATTGCCGCAATGATG | XhoI |
| 700a | 3970 | Forward | AAAAAAGAATTC-GCATCGACAGACGGTGTGTCGTGGAC | Eco RI |
|  | 3971 | Reverse | AAAAAACTGCAG-TTACGCTACCGGCACGACTTCCAAACC | Pst I |
| 701 | 3972 | Forward | CGCGGATCCCATATG-AAGACTTGTTTGGATACTTC | BamHI-NdeI |
|  | 3973 | Reverse | CCCGCTCGAG-TGCCGACAACAGCCTC | XhoI |
| 702 | 3974 | Forward | AAAAAAGAATTC-ATGCCGTGTTCCAAAGCCAGTTGGATTTC | Eco RI |
|  | 3975 | Reverse | AAAAAACTGCAG-TTAACCCCATTCCACCCGGAGAACCGA | Pst I |
| 703 | 3976 | Forward | CGCGGATCCGCTAGC-CAAACGCTGGCAACCG | BamHI-NheI |
|  | 3977 | Reverse | CCCGCTCGAG-TTTTCAGGTTTGATGTTTG | XhoI |
| 704a | 3978 | Forward | AAAAAAGAATTC-GCTTCTACCGGTACGCTGGCGCG | Eco RI |
|  | 3979 | Reverse | AAAAAACTGCAG-TTAGTTTTGCCGGATAATATGGCGGGTGCG | Pst I |
| 707 | 3980 | Forward | CGCGGATCCGCTAGC-GAAATTATTAACGATGCAGA | BamHI-NheI |
|  | 3981 | Reverse | CCCGCTCGAG-GAAACTGTAATTCAAGTTGA | XhoI |

TABLE 7-continued

Oligonucleotides used for PCR to amplify complete or partial ORFs

| ORF | SEQ ID | primer | Sequence | Restriction sites |
|---|---|---|---|---|
| 708 | 3982 | Forward | CGCGGATCCGCTAGC-CCTTTTAAGCCATCCAAAA | BamHI-NheI |
|  | 3983 | Reverse | CCCGCTCGAG-TTGACCGGTGAGGACG | XhoI |
| 710 | 3984 | Forward | CGCGGATCCCATATG-GAAACCCACGAAAAAATC | BamHI-NdeI |
|  | 3985 | Reverse | CCCGCTCGAG-AACGGTTTCGGTCAG | XhoI |
| 714 | 3986 | Forward | CGCGGATCCCATATG-AGCTATCAAGACATCTT | BamHI-NdeI |
|  | 3987 | Reverse | CCCGCTCGAG-GCGGTAGGTAAATCGGAT | XhoI |
| 716 | 3988 | Forward | CGCGGATCCCATATG-GCCAACAAACCGGCAAG | BamHI-NdeI |
|  | 3989 | Reverse | CCCGCTCGAG-TTTAGAACCGCATTTGCC | XhoI |
| 718 | 3990 | Forward | CGCGGATCCCATATG-GAGCCGATAATGGCAAA | BamHI-NdeI |
|  | 3991 | Reverse | CCCGCTCGAG-GGCGCGGGCATGGTCTTGTCC | XhoI |
| 720 | 3992 | Forward | CGCGGATCCCATATG-AGCGGATGGCATACC | BamHI-NdeI |
|  | 3993 | Reverse | CCCGCTCGAG-TTTTGCATAGCTGTTGACCA | XhoI |
| 723 | 3994 | Forward | CGCGGATCCCATATG-CGACCCAAGCCCC | BamHI-NdeI |
|  | 3995 | Reverse | CCCGCTCGAG-AATGCGAATCCGCCGCC | XhoI |
| 725 | 3996 | Forward | CGCGGATCCCATATG-GTGCGCACGGTTAAA | BamHI-NdeI |
|  | 3997 | Reverse | CCCGCTCGAG-TTGCTTATCCTTAAGGGTTA | XhoI |
| 726 | 3998 | Forward | CGCGGATCCCATATG-ACCATCTATTTCAAAAAC | BamHI-NdeI |
|  | 3999 | Reverse | CCCGCTCGAG-GCCGATGTTTAGCGTCC | XhoI |
| 728 | 4000 | Forward | CGCGGATCCCATATG-TTTTGGCTGGGAACGGG | BamHI-NdeI |
|  | 4001 | Reverse | CCCGCTCGAG-GTGAGAAAGGTCGCGC | XhoI |
| 729 | 4002 | Forward | CGCGGATCCCATATG-TGCACCATGATTCCCCA | BamHI-NdeI |
|  | 4003 | Reverse | GCCCAAGCTT-TTTGTCGGTTTGGGTATC | HindIII |
| 731 | 4004 | Forward | CGCGGATCCGCTAGC-GCCGTGCCGGAGG | BamHI-NheI |
|  | 4005 | Reverse | CCCGCTCGAG-ACGGGCGCGGCAG | XhoI |
| 732 | 4006 | Forward | CCGGAATTCTACATATG-TCGAAACCTGTTTTTAAGAA | EcoRI-NdeI |
|  | 4007 | Reverse | CCCGCTCGAG-CTTCTTATCTTTTTTATCTTTC | XhoI |
| 733 | 4008 | Forward | CGCGGATCCCATATG-GCCTGCGGCGGCAA | BamHI-NdeI |
|  | 4009 | Reverse | CCCGCTCGAG-TCGCTTGCCTCCTTTAC | XhoI |
| 734 | 4010 | Forward | CGCGGATCCCATATG-GCCGATACTTACGGCTAT | BamHI-NdeI |
|  | 4011 | Reverse | CCCGCTCGAG-TTTGAGATTTTGAATCAAAGAG | XhoI |
| 735 | 4012 | Forward | CGCGGATCCCATATG-AAGCAGCAGGCGGTCA | BamHI-NdeI |
|  | 4013 | Reverse | CCCGCTCGAG-ATTTCCGTAGCCGAGGG | XhoI |
| 737 | 4014 | Forward | CGCGGATCCCATATG-CACCACGACGGACACG | BamHI-NdeI |
|  | 4015 | Reverse | CCCGCTCGAG-GTCGTCGCGGCGGGA | XhoI |
| 739 | 4016 | Forward | CGCGGATCCCATATG-GCAAAAAAACCGAACA | BamHI-NdeI |
|  | 4017 | Reverse | CCCGCTCGAG-GAAGAGTTTGTCGAGAATT | XhoI |
| 740 | 4018 | Forward | CGCGGATCCCATATG-GCCAATCCGCCCGAAG | BamHI-NdeI |
|  | 4019 | Reverse | CCCGCTCGAG-AAACGCGCCAAAATAGTG | XhoI |
| 741 | 4020 | Forward | CGCGGATCCCATATG-TGCAGCAGCGGAGGG | BamHI-NdeI |
|  | 4021 | Reverse | CCCGCTCGAG-TTGCTTGGCGGCAAGGC | XhoI |
| 743 | 4022 | Forward | CGCGGATCCCATATG-GACGGTGTTGTGCCTGTT | BamHI-NdeI |
|  | 4023 | Reverse | CCCGCTCGAG-CTTACGGATCAAATTGACG | XhoI |
| 745 | 4024 | Forward | CGCGGATCCCATATG-TTTTGGCAACTGACCG | BamHI-NdeI |
|  | 4025 | Reverse | CCCGCTCGAG-CAAATCAGATGCCTTTAGG | XhoI |
| 746 | 4026 | Forward | CGCGGATCCCATATG-TCCGAAAACAAACAAAAC | BamHI-NdeI |
|  | 4027 | Reverse | CCCGCTCGAG-TTCATTCGTTACCTGACC | XhoI |
| 747 | 4028 | Forward | CCGGAATTCTAGCTAGC-CTGACCCCTTGGG | EcoRI-NheI |
|  | 4029 | Reverse | GCCCAAGCTT-TTTGATTTTAATTGACTATAGAAC | HindIII |
| 749 | 4030 | Forward | CGCGGATCCCATATG-TGCCAGCCGCCG | BamHI-NdeI |
|  | 4031 | Reverse | CCCGCTCGAG-TTTCAAGCCGAGTATGC | XhoI |

TABLE 7-continued

Oligonucleotides used for PCR to amplify complete or partial ORFs

| ORF | SEQ ID | primer | Sequence | Restriction sites |
|---|---|---|---|---|
| 750 | 4032 | Forward | CGCGGATCCCATATG-TGTTCGCCCGAACCTG | BamHI-NdeI |
|  | 4033 | Reverse | CCCGCTCGAG-CTTTTTCCCCGCCGCAA | XhoI |
| 758 | 4034 | Forward | CGCGGATCCCATATG-AACAATCTGACCGTGTT | BamHI-NdeI |
|  | 4035 | Reverse | CCCGCTCGAG-TGGCTCAATCCTTTCTGC | XhoI |
| 759 | 4036 | Forward | CGCGGATCCGCTAGC-CGCTTCACACACACCAC | BamHI-NheI |
|  | 4037 | Reverse | CCCGCTCGAG-CCAGTTGTAGCCTATTTTG | XhoI |
| 763 | 4038 | Forward | CGCGGATCCCATATG-CTGCCTGAAGCATGGCG | BamHI-NdeI |
|  | 4039 | Reverse | CCCGCTCGAG-TTCCGCAAATACCGTTTCC | XhoI |
| 764 | 4040 | Forward | CGCGGATCCCATATG-TTTTTCTCCGCCCTGA | BamHI-NdeI |
|  | 4041 | Reverse | CCCGCTCGAG-TCGCTCCCTAAAGCTTTC | XhoI |
| 765 | 4042 | Forward | CGCGGATCCCATATG-TTAAGATGCCGTCCG | BamHI-NdeI |
|  | 4043 | Reverse | CCCGCTCGAG-ACGCCGACGTTTTTTATTAA | XhoI |
| 767 | 4044 | Forward | CGCGGATCCCATATG-CTGACGGAAGGGGAAG | BamHI-NdeI |
|  | 4045 | Reverse | CCCGCTCGAG-TTTCTGTACAGCAGGGG | XhoI |
| 768 | 4046 | Forward | CGCGGATCCCATATG-GCCCCGCAAAAACCCG | BamHI-NdeI |
|  | 4047 | Reverse | CCCGCTCGAG-TTTCATCCCTTTTTTGAGC | XhoI |
| 770 | 4048 | Forward | CGCGGATCCCATATG-TGCGGCAGCGGCGAA | BamHI-NdeI |
|  | 4049 | Reverse | CCCGCTCGAG-GCGTTTGTCGAGATTTTC | XhoI |
| 771 | 4050 | Forward | CGCGGATCCCATATG-TCCGTATATCGCACCTTC | BamHI-NdeI |
|  | 4051 | Reverse | CCCGCTCGAG-CGGTTCTTTAGGTTTGAG | XhoI |
| 772 | 4052 | Forward | CGCGGATCCCATATG-TTTGCGGCGTTGGTGG | BamHI-NdeI |
|  | 4053 | Reverse | CCCGCTCGAG-CAATGCCGACATCAAACG | XhoI |
| 774 | 4054 | Forward | CGCGGATCCCATATG-TCCGTTTCACCCGTTCC | BamHI-NdeI |
|  | 4055 | Reverse | CCCGCTCGAG-TCGTTTGCGCACGGCT | XhoI |
| 790 | 4056 | Forward | CGCGGATCCCATATG-GCAAGAAGGTCAAAAAC | BamHI-NdeI |
|  | 4057 | Reverse | CCCGCTCGAG-GGCGTTGTTCGGATTTCG | XhoI |
| 900 | 4058 | Forward | CGCGGATCCCATATG-CCGTCTGAAATGCCG | BamHI-NdeI |
|  | 4059 | Reverse | CCCGCTCGAG-ATATGGAAAAGTCTGTTGTC | XhoI |
| 901 | 4060 | Forward | CGCGGATCCCATATG-CCCGATTTTTCGATG | BamHI-NdeI |
|  | 4061 | Reverse | CCCGCTCGAG-AAAATGGAACAATACCAGG | XhoI |
| 902 | 4062 | Forward.2 | CCGGAATTCTACATATG-TTGCACTTTCAAAGGATAATC | EcoRI-NdeI |
|  | 4063 | Reverse | CCCGCTCGAG-AAAAATGTACAATGGCGTAC | XhoI |
| 903 | 4064 | Forward | CCGGAATTCTAGCTAGC-CAGCGTCAGCAGCACAT | EcoRI-NheI |
|  | 4065 | Reverse | CCCGCTCGAG-GAAACTGTAATTCAAGTTGAA | XhoI |
| 904 | 4066 | Forward | AAAAAAGGTACC-ATGATGCAGCACAATCGTTTC | Kpn I |
|  | 4067 | Reverse | AAACTGCAG-TTAATATCGATAGGTTATATG | Pst I |
| 904a | 4068 | Forward | AAAAAGAATTC-CGGCTCGGCATTGTGCAGATGTTGCA | Eco RI |
|  | 4069 | Reverse | AAACTGCAG-TTAATATCGATAGGTTATATG | Pst I |
| 905 | 4070 | Forward | CGCGGATCCCATATG-AACAAAATATACCGCATC | BamHI-NdeI |
|  | 4071 | Reverse | CCCGCTCGAG-CCACTGATAACCGACAGAT | XhoI |
| 907 | 4072 | Forward | CGCGGATCCCATATG-GGCGCGCAACGTGAG | BamHI-NdeI |
|  | 4073 | Reverse | CCCGCTCGAG-ACGCCACTGCCAGCG | XhoI |
| 908 | 4074 | Forward | AAAGAATTC-GCAGAGTTAGTAGGCGTTAATAAAAATAC | Eco RI |
|  | 4075 | Reverse | AAACTGCAG-TTAATATGGTTTTGTCGTTCG | Pst I |
| 909 | 4076 | Forward | CGCGGATCCCATATG-TGCGCGTGGGAAACTTAT | BamHI-NdeI |
|  | 4077 | Reverse | CCCGCTCGAG-TCGGTTTTGAAACTTTGGTTTT | XhoI |
| 910 | 4078 | Forward | AAAGAATTC-GCATTTGCCGGCGACTCTGCCGAGCG | Eco RI |
|  | 4079 | Reverse | AAACTGCAG-TCAGCGATCGAGCTGCCTTT | Pst I |
| 911 | 4080 | Forward | AAAGAATTC-GCTTTCCGCGTGGCCGGCGGTGC | Eco RI |
|  | 4081 | Reverse | AAAAACTGCAG-GTCGACTTATTCGGCGGCTTTTTCCGC | Pst I |
| 912 | 4082 | Forward | AAAAAAGAATTC-CAAATCCGTCAAAACGCCACTCAAGTATTGAG | Eco RI |
|  | 4083 | Reverse | AAAAAACTGCAG-TTACAGTCCGTCCACGCCTTTCGC | Pst I |

TABLE 7-continued

Oligonucleotides used for PCR to amplify complete or partial ORFs

| ORF | SEQ ID | primer | Sequence | Restriction sites |
|---|---|---|---|---|
| 913 | 4084 | Forward | CGCGGATCCCATATG-GAAACCCGCCCCGC | BamHI-NdeI |
| | 4085 | Reverse | CCCGCTCGAG-AGGTTGTGTTCCAGGTTG | XhoI |
| 915 | 4086 | Forward | CGCGGATCCCATATG-TGCCGGCAGGCGGAA | BamHI-NdeI |
| | 4087 | Reverse | CCCGCTCGAG-TTTGAAAATATAGGTATCAGG | XhoI |
| 914 | 4088 | Forward | AAAGAATTC-GACAGAATCGGCGATTTGGAAGCACG | Eco RI |
| | 4089 | Reverse | AAACTGCAG-CTATATGCGCGGCAGGACGCTCAACGG | Pst I |
| 916 | 4090 | Forward | CGCGGATCCCATATG-GCAATGATGGCGGCTG | BamHI-NdeI |
| | 4091 | Reverse | CCCGCTCGAG-TTTGGCGGCATCTTTCAT | XhoI |
| 917 | 4092 | Forward | AAAAAGAATTC-CCTGCCGAAAAACCGGCACCGGC | Eco RI |
| | 4093 | Reverse | AAAAAACTGCAG-TTATTTCCCCGCCTTCACATCCTG | Pst I |
| 919 | 4094 | Forward | CGCGGATCCCATATG-TGCCAAAGCAAGAGCATC | BamHI-NdeI |
| | 4095 | Reverse | CCCGCTCGAG-CGGGCGGTATTCGGG | XhoI |
| 920 | 4096 | Forward | CGCGGATCCCATATG-CACCGCGTCTGGGTC | BamHI-NdeI |
| | 4097 | Reverse | CCCGCTCGAG-ATGGTGCGAATGACCGA | XhoI |
| 921 | 4098 | Forward | AAAAAGAATTC-TTGACGGAAATCCCCGTGAATCC | Eco RI |
| | 4099 | Reverse | AAAAAACTGCAG-TCATTTCAAGGGCTGCATCTTCAT | Pst I |
| 922 | 4100 | Forward.2 | CGCGGATCCGCTAGC-TGTACGGCGATGGAGGC | BamHI-NheI |
| | 4101 | Reverse | CCCGCTCGAG-CAATCCCGGGCCGCC | XhoI |
| 923 | 4102 | Forward | CGCGGATCCCATATG-TGTTACGCAATATTGTCCC | BamHI-NheI |
| | 4103 | Reverse | CCCGCTCGAG-GGACAAGGCGACGAAG | XhoI |
| 925 | 4104 | Forward | CGCGGATCCCATATG-AAACAAATGCTTTTAGCCG | BamHI-NdeI |
| | 4105 | Reverse | CCCGCTCGAG-GCCGTTGCATTTGATTTC | XhoI |
| 926 | 4106 | Forward | CGCGGATCCCATATG-TGCGCGCAATTACCTC | BamHI-NdeI |
| | 4107 | Reverse | CCCGCTCGAG-TCTCGTGCGCGCCG | XhoI |
| 927 | 4108 | Forward | CGCGGATCCCATATG-TGCAGCCCCGCAGC | BamHI-NdeI |
| | 4109 | Reverse | CCCGCTCGAG-GTTTTTTGCTGACGTAGT | XhoI |
| 929a | 4110 | Forward | AAAAAAGAATTC-CGCGGTTTGCTCAAAACAGGGCTGGG | Eco RI |
| | 4111 | Reverse | AAAAAATCTAGA-TTAAGAAAGACGGAAACTACTGCC | Xba I |
| 931 | 4112 | Forward | AAAAAAGAATTC-GCAACCCATGTTTTGATGGAAAC | Eco RI |
| | 4113 | Reverse | AAAAAACTGCAG-TTACTGCCCGACAACAACGCGACG | Pst I |
| 935 | 4114 | Forward | AAAAAGAATTC-GCGGATGCGCCCGCGATTTTGGATGACAAGGC | Eco RI |
| | 4115 | Reverse | AAAAAACTGCAG-TCAAAACCGCCAATCCGCCGACAC | Pst I |
| 936 | 4116 | Forward | CGCGGATCCCATATG-GCCGCCGTCGGCGC | BamHI-NdeI |
| | 4117 | Reverse | CCCGCTCGAG-GCGTTGGACGTAGTTTTG | XhoI |
| 937 | 4118 | Forward | AAAAAAGAATTC-CCGGTTTACATTCAAACCGGCGCAAC | Eco RI |
| | 4119 | Reverse | AAAAAACTGCAG-TTAAAATGTATGCTGTACGCCAAA | Pst I |
| 939a | 4120 | Forward | AAAAAAGAATTC-GGTTCGGCAGCTGTGATGAAACC | Eco RI |
| | 4121 | Reverse | AAAAAACTGCAG-TTAACGCAAACCTTGGATAAAGTTGGC | Pst I |
| 950 | 4122 | Forward | CGCGGATCCCATATG-GCCAACAAACCGGCAAG | BamHI-NdeI |
| | 4123 | Reverse | CCCGCTCGAG-TTTAGAACCGCATTTGCC | XhoI |
| 953 | 4124 | Forward | CGCGGATCCCATATG-GCCACCTACAAAGTGGAC | BamHI-NdeI |
| | 4125 | Reverse | CCCGCTCGAG-TTGTTTGGCTGCCTCGAT | XhoI |
| 957 | 4126 | Forward | CGCGGATCCCATATG-TTTTGGCTGGGAACGGG | BamHI-NdeI |
| | 4127 | Reverse | CCCGCTCGAG-GTGAGAAAGGTCGCGC | XhoI |
| 958 | 4128 | Forward | CGCGGATCCCATATG-GCCGATGCCGTTGCG | BamHI-NdeI |
| | 4129 | Reverse | GCCCAAGCTT-GGGTCGTTTGTTGCGTC | HindIII |
| 959 | 4130 | Forward | CGCGGATCCCATATG-CACCACGACGGACACG | BamHI-NdeI |
| | 4131 | Reverse | CCCGCTCGAG-GTCGTCGCGGCGGGA | XhoI |
| 961 | 4132 | Forward | CGCGGATCCCATATG-GCCACAAGCGACGACG | BamHI-NdeI |
| | 4133 | Reverse | CCCGCTCGAG-CCACTCGTAATTGACGC | XhoI |

TABLE 7-continued

Oligonucleotides used for PCR to amplify complete or partial ORFs

| ORF | SEQ ID | primer | Sequence | Restriction sites |
|---|---|---|---|---|
| 972 | 4134 | Forward | AAAAAAGAATTC-TTGACTAACAGGGGGGGAGCGAAATTAAAAAC | Eco RI |
|  | 4135 | Reverse | AAAAAATCTAGA-TTAAAAATAATCATAATCTACATTTTG | Xba I |
| 973 | 4136 | Forward | AAAAAAGAATTC-ATGGACGGCGCACAACCGAAAAC | Eco RI |
|  | 4137 | Reverse | AAAAAACTGCAG-TTACTTCACGCGGGTCGCCATCAGCGT | Pst I |
| 982 | 4138 | Forward | CGCGGATCCCATATG-GCAGCAAAAGACGTAC | BamHI-NdeI |
|  | 4139 | Reverse | CCCGCTCGAG-CATCATGCCGCCCATCC | XhoI |
| 983 | 4140 | Forward | CGCGGATCCCATATG-TTAGCTGTTGCAACAACAC | BamHI-NdeI |
|  | 4141 | Reverse | CCCGCTCGAG-GAACCGGTAGCCTACG | XhoI |
| 987 | 4142 | Forward | CGCGGATCCCATATG-CCCCCACTGGAAGAAC | BamHI-NdeI |
|  | 4143 | Reverse | CCCGCTCGAG-TAATAAACCTTCTATGGGC | XhoI |
| 988 | 4144 | Forward | CGCGGATCCCATATG-TCTTTAAATTTACGGGAAAAAG | BamHI-NdeI |
|  | 4145 | Reverse | GCCCAAGCTT-TGATTTGCCTTTCCGTTTT | HindIII |
| 989 | 4146 | Forward | CCGGAATTCTACATATG-GTCCACGCATCCGGCTA | EcoRI-NdeI |
|  | 4147 | Reverse | CCCGCTCGAG-TTTGAATTTGTAGGTGTATTGC | XhoI |
| 990 | 4148 | Forward.2 | CGCGGATCCGCTAGC-TTCAGAGCTCAGCTT | BamHI-NheI |
|  | 4149 | Reverse | CCCGCTCGAG-AAACAGCCATTTGAGCGA | XhoI |
| 992 | 4150 | Forward | CGCGGATCCCATATG-GACGCGCCCGCCCG | BamHI-NdeI |
|  | 4151 | Reverse | CCCGCTCGAG-CCAAATGCCCAACCATTC | XhoI |
| 993 | 4152 | Forward | CGCGGATCCCATATG-GCAATGCTGATTGAAATCA | BamHI-NdeI |
|  | 4153 | Reverse | CCCGCTCGAG-GAACACATCGCGCCCG | XhoI |
| 996 | 4154 | Forward | CGCGGATCCCATATG-TGCGGCAGAAAATCCGC | BamHI-NdeI |
|  | 4155 | Reverse | CCCGCTCGAG-TCTAAACCCCTGTTTTCTC | XhoI |
| 997 | 4156 | Forward | CCGGAATTCTAGCTAGC-CGGCACGCCGACGTT | EcoRI-NheI |
|  | 4157 | Reverse | CCCGCTCGAG-GACGGCATCGCTCAGG | XhoI |

Underlined Sequences Indicate Restriction Recognition Sites.

The following DNA and amino acid sequences are identified by titles of the following form: [g, m, or a] [#].[seq or pep], where "g" means a sequence from *N. gonorrhoeae*, "m" means a sequence from *N. meningitidis* B, and "a" means a sequence from *N. meningitidis* A; "#" means the number of the sequence; "seq" means a DNA sequence, and "pep" means an amino acid sequence. For example, "g001.seq" refers to an *N. gonorrohoeae* DNA sequence, number 1. The presence of the suffix "−1" to these sequences indicates an additional sequence found for the same ORF. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a *N. gonorrhoeae* sequence or a *N. meningitidis* A sequence, respectively. Computer analysis was performed for the comparisons that follow between "g", "m", and "a" peptide sequences; and therein the "pep" suffix is implied where not expressly stated.

The following partial DNA sequence was identified in *N. gonorrhoeae* <SEQ ID 1>:

```
g001.seq
  1 ATGCTGCCGC AGGGGAAGGC GGCGCGGAGG GTGTCGGCGA ACGAGGTGTC

51 CGGCAGGGCT TGCGCCCGGA TGGTGCTGGT CATCTGCCAG ACGCTGCCGA

101 AACGCGATAC TTTAAACGGC TCGGGTACGC ATACTTTACC GGTTTGGGCG

151 ATTTTGCCGA GGTCGTTGCG CAGCAAATCG ACAATCATCA CGTTTTCGGC

201 GCGGTTTTTC GGGTCGGTTT GTAACTCGGC GGCGCGGCGT TCGTCTTGTC

251 CGTCGCCCAA AATCGGCGCG GTGCCTTTCA TCGGTTCGGT GCTGATGGTG

301 CCGTCTGAAG CGATGTTGAG GAAGAGTTCG GGCGAGAAAC ACAGCGTCCA

351 CGCGGATTGC CCGGCTTCAT CGGGCAGGTG GGACAATACG GCATAG
```

This corresponds to the amino acid sequence <SEQ ID 2; ORF 001.ng>:

```
g001.pep
    1    MLPQGKAARR VSANEVSGRA CARMVLVICQ TLPKRDTLNG SGTHTLPVWA

51    ILPRSLRSKS TIITFSARFF GSVCNSAARR SSCPSPKIGA VPFIGSVLMV

101    PSEAMLRKSS GEKHSVHADC PASSGRWDNT A*
```

The following partial DNA sequence was identified in *N. meningitidis* <SEQ ID 3>:

```
m001.seq
    1    ATGCTGCCGC AGGGGAAGGC GGCGCGGAGG ATGTCGGCGA ACGAGGTGTG

51    CGGcAssCTT ss.GCTTGGA yGGTGCTGGT CATCTGCCAA ACGCTGCCGA

101    AACGCGATAC TTTAAACGGT TCGGGTACGC ATACTGTGCC GGTTTGGGCG

151    ATTTTGCCGA GATCGTTACG CAGCAAATCG ACAATCATCA CGTTTTCGGC

201    GCGGTTTTTC GGGTCTGCTT GCAACTCGGC GGCGCGGCGT TCGTCTTGTC

251    CGTCGCCCAA AATCGGCGCG GTGCCTTTCA TCGGTTCGGT GCTGATGGTG

301    CCGTCCGAAC CGATTTTGAG GAAGAGTTCG GGCGAGAAAC ACAGCGTCCA

351    CGCGGATTGC CCCTCCGCAT CGGGCAGGTG GGACAAGACG GCATAG
```

This corresponds to the amino acid sequence <SEQ ID 4; ORF 001>:

```
m001.pep
    1    MLPQGKAARR MSANEVCGXL XAWXVLVICQ TLPKRDTLNG SGTHTVPVWA

51    ILPRSLRSKS TIITFSARFF GSACNSAARR SSCPSPKIGA VPFIGSVLMV

101    PSEPILRKSS GEKHSVHADC PSASGRWDKT A*
```

The following partial DNA sequence was identified in *N. meningitidis* <SEQ ID 5>:

```
a001.seq
    1    ATGCTGCCGC AGGGGAAGGC GGCGCGGAGG ATGTCGGCGA ACGAGGTGTG

51    CGGCAAGGCT TGGGCTTGGA TGGTGCTGGT CATCTGCCAA ACGCTGCCGA

101    AACGCGATAC TTTAAACGGT TCGGGTACGC ATACTGTGCC GGTTTGGGCG

151    ATTTTGCCGA GGTCGTTACG CAGCAAATCG ACAATCATCA CGTTTTCGGC

201    GCGGTTTTTC GGGTCTGCTT GCAACTCGGC GGCGCGGCGT TCGTCTTGTC

251    CGTCGCCCAA AATCGGCGCG GTGCCTTTCA TCGGTTCGGT GCTGATGGTG

301    CCGTCCGAAC CGATTTTGAG GAAGAGTTCG GGCGAGAAAC ACAGCGTCCA

351    CGCGGATTGC CCTTGTGCAT CGGGCAGGTG GGACAAAACG GCATAG
```

This corresponds to the amino acid sequence <SEQ ID 6; ORF 001.a>:

```
a001.pep
    1    MLPQGKAARR MSANEVCGKA WAWMVLVICQ TLPKRDTLNG SGTHTVPVWA

51    ILPRSLRSKS TIITFSARFF GSACNSAARR SSCPSPKIGA VPFIGSVLMV

101    PSEPILRKSS GEKHSVHADC PCASGRWDKT A*
``` m001/a001 96.2% identity over a 131 aa overlap

```
                  10         20         30         40         50         60
m001.pep  MLPQGKAARRMSANEVCGXLXAWXVLVICQTLPKRDTLNGSGTHTVPVWAILPRSLRSKS
          ||||||||||||||||||  ||  ||||||||||||||||||||||||||||||||||
a001.pep  MLPQGKAARRMSANEVCGKAWAWMVLVICQTLPKRDTLNGSGTHTVPVWAILPRSLRSKS
                  10         20         30         40         50         60

70         80         90        100        110        120
m001.pep  TIITFSARFFGSACNSAARRSSCPSPKIGAVPFIGSVLMVPSEPILRKSSGEKHSVHADC
          ||||||||||||||||||||  ||||||||||||||||||||||||||||||||||||
a001.pep  TIITFSARFFGSACNSAARRSSCPSPKIGAVPFIGSVLMVPSEPILRKSSGEKHSVHADC
                  70         80         90        100        110        120

130
m001.pep  PSASGRWDKTAX
          | |||||||||
a001.pep  PCASGRWDKTAX
                 130
```

Computer analysis of this amino acid sequence gave the following results:
Homology with a Predicted ORF from *N. gonorrhoeae*  20
ORF 001 shows 89.3% identity over a 131 aa overlap with a predicted ORF (ORF 001.ng) from *N. gonorrhoeae*:

```
m001/g001
                  10         20         30         40         50         60
m001.pep  MLPQGKAARRMSANEVCGXLXAWXVLVICQTLPKRDTLNGSGTHTVPVWAILPRSLRSKS
          ||||||||||:|||||  |    ||||||||||||||||||||:||||||||||||||
g001      MLPQGKAARRVSANEVSGRACARMVLVICQTLPKRDTLNGSGTHTLPVWAILPRSLRSKS
                  10         20         30         40         50         60

70         80         90        100        110        120
m001.pep  TIITFSARFFGSACNSAARRSSCPSPKIGAVPFIGSVLMVPSEPILRKSSGEKHSVHADC
          ||||||||||:|||||||||||||||||||||||||||||||:|||||||||||||||
g001      TIITFSARFFGSVCNSAARRSSCPSPKIGAVPFIGSVLMVPSEAMLRKSSGEKHSVHADC
                  70         80         90        100        110        120

130
m001.pep  PSASGRWDKTAX
          |::|||||:|||
g001      PASSGRWDNTAX
                 130
```

The following partial DNA sequence was identified in *N. gonorrhoeae* <SEQ ID 7>:

```
g003.seq
    1   ATGGTCGTAT TCGTGGCTGA AGGCGTATTC GGTCGCGCTG TTTTGGGTCA
   51   CTTGGTATTG CTCTTCGGTC AGGGTGCGTT TGAGTTCGGC GTCACTCGGT
  101   TTTTTATACG TTGCCGCGTC GAAGCCTTTG CCTTGCGGTG CGGCTTTGGT
  151   TTTGCCCGGC AGCGGTTCGT CGGCTTTGCG GATGTCGATG TGGCAGTAGC
  201   CGTTGGGGTT TTTAATCAGG TAGTCCTGAT GGTATTCCTC GGCGTCGTAG
  251   AAGTTTTTCA GCGGTTCGTT TTCAACAACG AGGGGCAGTT GGTATTTTTG
  301   CTGCTCGCGT TTGAGGGCGG CGGCGATGAC GGCTTTTTCG GCGGGGTCGG
  351   TGTAGTACAC GCCGCTGCGG TATTGCGTGC CGGTGTCGTT ACCCTGTTTG
  401   TTGAGGCTGG TCGGATCAAC GACGCGGAAA TAATATTGCA GGATGTCGTC
  451   CAGgCTGagt TTGTCGGCAT CGTaggtcac tTTGACGGTC TCGGCATGAC
  501   CCGTATGGCG GTaggacact tctTCgtanc TcGGGtTTTC CGTGttGCCG
  551   TTGGCgttac cGGATACCGC gtcaACCACG CCGTcgatgc gttggaAATa
  601   ggCTTCCAAg ccccaaaagc agccgccggc gaagtaaatg gtgcccgtgt
  651   tcatgattGC TGa
```

This corresponds to the amino acid sequence <SEQ ID 8; ORF 003.ng>:

```
g003.pep
    1   MVVFVAEGVF GRAVLGHLVL LFGQGAFEFG VTRFFIRCRV EAFALRCGFG

51   FARQRFVGFA DVDVAVAVGV FNQVVLMVFL GVVEVFQRFV FNNEGQLVFL

101   LLAFEGGGDD GFFGGVGVVH AAAVLRAGVV TLFVEAGRIN DAEIILQDVV

151   QAEFVGIVGH FDGLGMTRMA VGHFFVRVFR VAVGVTGYRV NHAVDALEIG

201   FQAPKAAAGE VNGARVHDC
```

The following partial DNA sequence was identified in *N. meningitidis* <SEQ ID 9>:

```
m003.seq
    1   ATGGTCGTAT TCGTGGCTGA AGGCATATTC GGTCGCGCTG TTTTGGGTAA

51   CTTGsTATTG CTCTTCGGTC AGGGTGCGTT TGAGTTCGGC GTCACTCGGT

101   TTTTTATACG TTGCCGCGTC GAAGCCTTTG CCTTGCGGGG CGGTCTTGGT

151   TTTGCCCGGC AGCGGTTCGT CAGCkTTGCG GATGTCGATG TGGCAGTAGC

201   CGTTGGGGTT TTTAATCAAG TAGTCCTGAT GGTATTCCTC GGCATCGTAG

251   AAGTTTTtCA GCGGCTCGTT TTCAACAACG AGGGGCAGTT GGTATTTTTG

301   CTGCTCGCGT TTGAGGGCGk CGGCGATGAC GGCTTTTTCG kCGGGGTCGG

351   TGTAGTACAC GCCGCTGCGG TATTGCGTAC CGGTGTCGTT GCCCTGTTTG

401   TTGAGGCTGG TCGGATCAAC GACGCGGAAG AAATATTGCA GGATGTCGTC

451   TAGGCTGAGT TTGTCGGCAT CGTAGGTCAC TTTGACGGTT TCGGCGTGGC

501   CCGTATGGCG GTAGGACACG TCTTCATAGC TCGGATTTTT CGTGTTGCCG

551   TTGGCGTAGC CGGATACCGC GTCAACCACG CCGTCGATGC GTTGGAAATA

601   GGCTTCCAAG CCCCAGAAGC AGCg.CCGGC GAGGTAAATG GTGCGCGTGT

651   TCATGATTTT TGA
                                                          40
```

This corresponds to the amino acid sequence <SEQ ID 10; ORF 003>:

```
m003.pep Length: 221
    1   MVVFVAEGIF GRAVLGNLXL LFGQGAFEFG VTRFFIRCRV EAFALRGGLG

51   FARQRFVSXA DVDVAVAVGV FNQVVLMVFL GIVEVFQRLV FNNEGQLVFL

101   LLAFEGXGDD GFFXGVGVVH AAAVLRTGVV ALFVEAGRIN DAEEILQDVV

151   *AEFVGIVGH FDGFGVARMA VGHVFIARIF RVAVGVAGYR VNHAVDALEI

201   GFQAPEAAXG EVNGARVHDF *
```

The following partial DNA sequence was identified in *N. meningitidis* <SEQ ID 11>:

```
a003.seq
    1   ATGGTCGTAT TCGTGGCTGA AGGCATATTC GGTCGCGCTG TTTTGGGTAA

51   CTTGGTATTG CTCTTCGGTC AGGGTGCGTT TGAGTTCGGC GTCACTCGGT

101   TTTTTATACG TTGCCGCGTC GAAGCCTTTG CCTTGCGGTG CGGTCTTGGT

151   TTTGCCCGGC AGCGGTTCGT CGGCTTTGCG GATATCGATG TGGCAGTAGC

201   CGTTGGGGTT TTTAATCAAG TAGTCCTGAT GGTATTCCTC GGCATCGTAG
```

-continued
```
251    AAGTTTTTCA GCGGCTCGTT TTCAACAACG AGGGGCAGTT GGTATTTTTG

301    CTGCTCGCGT TTGAGGGCGG CGGCGATGAC GGCTTTTTCG GCGGGGTCGG

351    TGTAGTACAC GCCGCTGCGG TATTGCGTAC CGGTGTCGTT GCCCTGTTTG

401    TTGAGGCTGG TCGGATCAAC GACGCGGAAG AAATATTGCA GGATGTCGTC

451    TAGGCTGAGT TTGTCGGCAT CGTAGGTCAC TTTGACGGTT TCGGCGTGGC

501    CCGTATGGCG GTAGGACACG TCTTCATAGC TCGGATTTTT CGTGTTGCCG

551    TTGGCGTAGC CGGATACCGC GTCAACCACG CCGTCGATGC GTTGGAAATA

601    GGCTTCCAAG CCCCAGAAGC AGCCGCCGGC GAGGTAGATG GTGCGCGTGT

651    TCATGATTTT TGA
```

This corresponds to the amino acid sequence <SEQ ID 12; ORF 003.a>:

```
a003.pep
  1    MVVFVAEGIF GRAVLGNLVL LFGQGAFEFG VTRFFIRCRV EAFALRCGLG

51    FARQRFVGFA DIDVAVAVGV FNQVVLMVFL GIVEVFQRLV FNNEGQLVFL

101    LLAFEGGGDD GFFGGVGVVH AAAVLRTGVV ALFVEAGRIN DAEEILQDVV

151    *AEFVGIVGH FDGFGVARMA VGHVFIARIF RVAVGVAGYR VNHAVDALEI

201    GFQAPEAAAG EVDGARVHDF *
``` m003/a003 95.9% identity over a 220 aa overlap

```
                 10         20         30         40         50         60
m003.pep MVVFVAEGIFGRAVLGNLXLLFGQGAFEFGVTRFFIRCRVEAFALRGGLGFARQRFVSXA
         ||||||||||||||||| ||||||||||||||||||||||||| |||||||||:|
a003     MVVFVAEGIFGRAVLGNLVLLFGQGAFEFGVTRFFIRCRVEAFALRCGLGFARQRFVGFA
                 10         20         30         40         50         60

70         80         90        100        110        120
m003.pep DVDVAVAVGVFNQVVLMVFLGIVEVFQRLVFNNEGQLVFLLLAFEGXGDDGFFXGVGVVH
         |:||||||||||||||||||||||||||||||||||||||||||| |||||  ||||||
a003     DIDVAVAVGVFNQVVLMVFLGIVEVFQRLVFNNEGQLVFLLLAFEGGGDDGFFGGVGVVH
                 70         80         90        100        110        120

130        140        150        160        170        180
m003.pep AAAVLRTGVVALFVEAGRINDAEEILQDVVXAEFVGIVGHFDGFGVARMAVGHVFIARIF
         ||||||||||||||||||||||||||||||||||||||||||||||||||||||||||||
a003     AAAVLRTGVVALFVEAGRINDAEEILQDVVXAEFVGIVGHFDGFGVARMAVGHVFIARIF
                130        140        150        160        170        180

190        200        210        220
m003.pep RVAVGVAGYRVNHAVDALEIGFQAPEAAXGEVNGARVHDFX
         ||||||||||||||||||||||||||| |:|||||||
a003     RVAVGVAGYRVNHAVDALEIGFQAPEAAAGEVDGARVHDFX
                190        200        210        220
```

Computer analysis of this amino acid sequence gave the following results:
Homology with a Predicted ORF from *N. gonorrhoeae*
ORF 003 shows 88.6% identity over a 219 aa overlap with a predicted ORF (ORF 003.ng) from *N. gonorrhoeae*:

```
m003/g003
                 10         20         30         40         50         60
m003.pep MVVFVAEGIFGRAVLGNLXLLFGQGAFEFGVTRFFIRCRVEAFALRGGLGFARQRFVSXA
         ||||||||:|||||||:|  ||||||||||||||||||||||||| |:||||||||:|
g003     MVVFVAEGVFGRAVLGHLVLLFGQGAFEFGVTRFFIRCRVEAFALRCGFGFARQRFVGFA
                 10         20         30         40         50         60

70         80         90        100        110        120
m003.pep DVDVAVAVGVFNQVVLMVFLGIVEVFQRLVFNNEGQLVFLLLAFEGXGDDGFFXGVGVVH
         ||||||||||||||||||||| |||||| |||||||||||||||||  ||||| ||||||
g003     DVDVAVAVGVFNQVVLMVFLGVVEVFQRFVFNNEGQLVFLLLAFEGGGDDGFFGGVGVVH
                 70         80         90        100        110        120
```

```
                       130        140        150        160        170        180
m003.pep   AAAVLRTGVVALFVEAGRINDAEEILQDVVXAEFVGIVGHFDGFGVARMAVGHVFIARIF
           ||||||:|||:||||||||||| ||||||  ||||||||||||||:::||||||  |: |:|
g003       AAAVLRAGVVTLFVEAGRINDAEIILQDVVQAEFVGIVGHFDGLGMTRMAVGHFFV-RVF
                       130        140        150        160        170        180

190        200        210        220
m003.pep   RVAVGVAGYRVNHAVDALEIGFQAPEAAXGEVNGARVHDFX
           ||||||:|||||||||||||||||||:|| ||||||||||
g003       RVAVGVTGYRVNHAVDALEIGFQAPKAAAGEVNGARVHDC
                       190        200        210
```

The following partial DNA sequence was identified in *N. gonorrhoeae* <SEQ ID 13>:

```
g004.seq
     1    ATGgtagAAC GGCATATCCA GCATTTGCGG AACGGTCATC TTCATTTGAT

51    GCGCCCATGC CAACAagtga gccaAAtgtT CGGCGGCAGG GCCTacgatT

101    TCCGCGCCGA TAAagcggcc gGTGgctTTT tcgGCataca ggcgcaTatg 151    gCCTTTGTTT ACCAgcatca cgcggctgcg accttgaTTT TTGAACGATA 201    CTTCGCCgaT GACAAATTCG TCGGCTTGGT ATTGCGCGGC AACCTGCGCG 251    TATTTCAAAC CGACAAAGCC GATTTGCgga ctggtaaACA CCACGCCAAT 301    GGTgctgcgg cGCAAACCGC TGCCGATATt cgGgtagcgg ccccgcgtta 351    ttgcccggca atcttaccTT ggtcggcggc ttcatGCAGC AGGGGCagtt 401    ggttggacgc gtcgcccgca ataAAGATAT GCGGAATgct ggtCTGCATg 451    gtCAGCGGAT CGGCAACGGG tacgccgcgc gcgtctttgT CGATATTGAT 501    GTTTTCCAAA CCGATATtgT CAACGTTCGG ACGGCgACCT ACGGCTGCCA

551    ACATATATTC GGCAACAAAT ACGCCTTTTT CGCCATCCTG CTCCCAATGG

601    ACTtctACAT TGCCGTCTGC GTCGAGTTTG ACCTCGGTTT TAGCATCCAG

651    ATGCAGTTTC AATtctTCTC CGAACACGGC TTTCGCCTCG TCTGAAACAA

701    CGGGGTCGGA AATGCCGCCG ATGATTCCGC CCAAACCGAA AATTTCAACT

751    TTCACACCCA AACGGTGCAA TGCCTGA
```

This corresponds to the amino acid sequence <SEQ ID 14; ORF 004.ng>:

```
g004.pep
     1    MVERHIQHLR NGHLHLMRPC QQVSQMFGGR AYDFRADKAA GGFFGIQAHM

51    AFVYQHHAAA TLIFERYFAD DKFVGLVLRG NLRVFQTDKA DLRTGKHHAN

101    GAAAQTAADI RVAAPRYCPA ILPWSAASCS RGSWLDASPA IKICGMLVCM

151    VSGSATGTPR ASLSILMFSK PILSTFGRRP TAANIYSATN TPFSPSCSQW

201    TSTLPSASSL TSVLASRCSF NSSPNTAFAS SETTGSEMPP MIPPKPKIST

251    FTPKRCNA*
```

The following partial DNA sequence was identified in *N. meningitidis* <SEQ ID 15>:

```
m004.seq
     1    ATGGTAGAAC GGCATATCCA GCATTTGCGG AACGGTCATC TTCATTTGAT

51    GTGCCCAAGC CAACAGGTGC GCCAAATGTT CGGCGGCAGG GCCTACGATT

101    TCCGCGCCGA TAAAGCGGCC GGTGGCTTTT TCGGCATACA GGCGCATATG
```

```
151   GCCTTTGTTC ACCAGCATCA CGCGGCTGCG GCCTTGGTTT TTGAACGATA

201   CTTCGCCGAT GACAAATTCG TCGGCTTGGT ATTGCGCGGC AACCTGCGCG

251   TATTTCAGAC CGACAAAGCC GATTTGCGGA CTGGTAAACA CCACGCCGAT

301   GGTGCTGCGC CGCAAACCGC CGCCGATATT CGGGTAGCGG CCGCGTTATC

351   GCCGGCAATC TTGCCTTGGT CGGCAGCTTC ATGCAGCAGA GGCAGTTGGT

401   TGGACGCATC GCCTGCGATG AAGATATGCG GAATACTGGT CTGCATGGTC

451   AGCGGGTCGG CAACAGGTAC GCCGCGCGCA TCTTTTTCGA TATTGATATT

501   TTCCAAACCG ATATTGTCAA CGTTCGGACG GCGGCCCACG GCTGCCAGCA

551   TATATTCGGC AACAAATACG CCTTTTTCGC CATCCTGCTC CCAATGGACT

601   TCTACATTGC CGTCTGCATC GAGTTTGACC TCGGTTTTAG CATCCAGATG

651   CAGTTTCAAT TCTTCGCCGA ACACGGCGTT CGCCTCGTCT GAAACGACGG

701   GGTCGGAAAT GCCGCCGATG ATTCCGCCCA AACCGAAAAT TCAACTTTC

751   ACGCCCAAAC GGTGCAATGC CTGA
```

This corresponds to the amino acid sequence <SEQ ID 16; ORF 004>:

```
m004.pep
    1   MVERHIQHLR NGHLHLMCPS QQVRQMFGGR AYDFRADKAA GGFFGIQAHM

51   AFVHQHHAAA ALVFERYFAD DKFVGLVLRG NLRVFQTDKA DLRTGKHHAD

101   GAAPQTAADI RVAAALSPAI LPWSAASCSR GSWLDASPAM KICGILVCMV

151   SGSATGTPRA SFSILIFSKP ILSTFGRRPT AASIYSATNT PFSPSCSQWT

201   STLPSASSLT SVLASRCSFN SSPNTAFASS ETTGSEMPPM IPPKPKISTF

251   TPKRCNA*
```

The following partial DNA sequence was identified in *N. meningitidis* <SEQ ID 17>:

```
a004.seq
    1   ATGGTAGAAC GGCATATCCA GCATTTGCGG AACGGTCATC TTCATTTGAT

51   GTGCCCAAGC CAACAGGTGC GCCAAATGTT CGGCGGCCGG ACCTACGATT

101   TCTGCGCCGA TGAAGCGGCC GGTGGCTTTT TCGGCATACA GGCGCATATG

151   GCCTTTGTTT ACCAGCATCA CGCGGCTGCG GCCTTGGTTT TTGAACGATA

201   CTTCGCCGAT GACAAATTCG TCGGCTTGGT ATTGCGCGGC AACCTGCGCG

251   TATTTCAAAC CGACAAAGCC GATTTGCGGA CTGGTGAACA CTACGCCGAT

301   GGTGCTGCGG CGCAAACCGC CGCCGATATT CGGGTAGCGG CCGCGTTATC

351   GCCGGCAATC TTGCCTTGGT CGGCGGCTTC ATGCAGCAGG GGCAGTTGGT

401   TGGACGCGTC GCCCGCAATA AAGATATGCG GAATACTGGT CTGCATAGTC

451   AGCGGATCGG CAACGGGTAC GCCGCGCGCA TCTTTTTCGA TATTGATGTT

501   TTCCAAACCG ATATTGTCAA CGTTCGGACG GCGGCCTACG GCTGCCAGCA

551   TATATTCGGC AACAAATACG CCTTTTTCGC CATCCTGCTC CCAATGGACT

601   TCTACATTGC CGTCTGCGTC GAGTTTGGCC TCGGTTTTAG CATCCAAATG

651   CAGTTTCAAT TCTTCACCGA ACACGGCTTT CGCCTCGTCT GAAACGACGG
```

-continued

```
701 GGTCGGAAAT GCCGCCGATG ATGCCACCCA AACCGAAAAT TTCAACTTTC

751 ACGCCCAAAC GGTGCAATGC CTGA
```

This corresponds to the amino acid sequence <SEQ ID 18; ORF 004.a>:

```
a004.pep
  1 MVERHIQHLR NGHLHLMCPS QQVRQMFGGR TYDFCADEAA GGFFGIQAHM

51 AFVYQHHAAA ALVFERYFAD DKFVGLVLRG NLRVFQTDKA DLRTGEHYAD

101 GAAAQTAADI RVAAALSPAI LPWSAASCSR GSWLDASPAI KICGILVCIV

151 SGSATGTPRA SFSILMFSKP ILSTFGRRPT AASIYSATNT PFSPSCSQWT

201 STLPSASSLA SVLASKCSFN SSPNTAFASS ETTGSEMPPM MPPKPKISTF

251 TPKRCNA*
``` m004/a004 94.9% identity over a 257 aa overlap

```
                   10         20         30         40         50         60
    m004.pep  MVERHIQHLRNGHLHLMCPSQQVRQMFGGRAYDFRADKAAGGFFGIQAHMAFVHQHHAAA
              ||||||||||||||||||||||||||||| ||| ||:||||||||||||||||:||||||
    a004      MVERHIQHLRNGHLHLMCPSQQVRQMFGGRTYDFCADEAAGGFFGIQAHMAFVYQHHAAA
                   10         20         30         40         50         60
                   70         80         90        100        110        120
    m004.pep  ALVFERYFADDKFVGLVLRGNLRVFQTDKADLRTGKHHADGAAPQTAADIRVAAALSPAI
              ||||||||||||||||||||||||||||||||||||||:|:|||||||||||||||||||
    a004      ALVFERYFADDKFVGLVLRGNLRVFQTDKADLRTGEHYADGAAAQTAADIRVAAALSPAI
                   70         80         90        100        110        120
                  130        140        150        160        170        180
    m004.pep  LPWSAASCSRGSWLDASPAMKICGILVCMVSGSATGTPRASFSILIFSKPILSTFGRRPT
              |||||||||||||||||||:|||||||:||||||||||||||||||:|||||||||||||
    a004      LPWSAASCSRGSWLDASPAIKICGILVCIVSGSATGTPRASFSILMFSKPILSTFGRRPT
                  130        140        150        160        170        180
                  190        200        210        220        230        240
    m004.pep  AASIYSATNTPFSPSCSQWTSTLPSASSLTSVLASRCSFNSSPNTAFASSETTGSEMPPM
              |||||||||||||||||||||||||||||::||||:||||||||||||||||||||||||
    a004      AASIYSATNTPFSPSCSQWTSTLPSASSLASVLASKCSFNSSPNTAFASSETTGSEMPPM
                  190        200        210        220        230        240
                  250
    m004.pep  IPPKPKISTFTPKRCNAX
              :|||||||||||||||||
    a004      MPPKPKISTFTPKRCNAX
                  250
```

Computer analysis of this amino acid sequence gave the following results:
Homology with a Predicted ORF from *N. gonorrhoeae*
ORF 004 shows 93.4% identity over a 258 aa overlap with a predicted ORF (ORF 004.ng) from *N. gonorrhoeae*:

```
m004/g004
                   10         20         30         40         50         60
    m004.pep  MVERHIQHLRNGHLHLMCPSQQVRQMFGGRAYDFRADKAAGGFFGIQAHMAFVHQHHAAA
              ||||||||||||||||| ||| ||| |||||||||||||||||||||||||||:||||||
    g004      MVERHIQHLRNGHLHLMRPCQQVSQMFGGRAYDFRADKAAGGFFGIQAHMAFVYQHHAAA
                   10         20         30         40         50         60
                   70         80         90        100        110        119
    m004.pep  ALVFERYFADDKFVGLVLRGNLRVFQTDKADLRTGKHHADGAAPQTAADIRVAAA-LSPA
              :|:|||||||||||| ||| |||||||||||||||||:||| ||||||||||||    ||
    g004      TLIFERYFADDKFVGLVLRGNLRVFQTDKADLRTGKHHANGAAAQTAADIRVAAPRYCPA
                   70         80         90        100        110        120
                  120        130        140        150        160        170        179
    m004.pep  ILPWSAASCSRGSWLDASPAMKICGILVCMVSGSATGTPRASFSILIFSKPILSTFGRRP
              |||||||||||||||||||:||||:||||||||||||||||||:|||:||||||||||||
    g004      ILPWSAASCSRGSWLDASPAIKICGMLVCMVSGSATGTPRASLSILMFSKPILSTFGRRP
                  130        140        150        160        170        180
```

```
                180       190       200       210       220       230    239
m004.pep   TAASIYSATNTPFSPSCSQWTSTLPSASSLTSVLASRCSFNSSPNTAFASSETTGSEMPP
           |||:||||||||||||||||||||||||||||||||||||||||||||||||||||||||
g004       TAANIYSATNTPFSPSCSQWTSTLPSASSLTSVLASRCSFNSSPNTAFASSETTGSEMPP
                190       200       210       220       230       240

240       250
m004.pep   MIPPKPKISTFTPKRCNAX
           ||||||||||||||||||
g004       MIPPKPKISTFTPKRCNA
                250
```

The following partial DNA sequence was identified in *N. gonorrhoeae* <SEQ ID 19>:

```
g005.seq
    1   ATGGGGATGG ACAATATTGA TATGTTCATG CCTGAACAAG AGGAAATCCA

51   ATCAATGTGG AAAGAAATTT TACTGAATTA CGGTATTTTC CTGCTCGAAC

101   TGCTTACCGT GTTCGGCGCA ATTGCGCTGA TTGTGTTGGC TATCGTACAG

151   AGTAAGAAAC AGTCGGAAAG CGGCAGTGTC GTACTGACAG ATTTTTCGGA

201   AAATTATAAA AACAGCGGC AATCGTTTGA ACATTCTTT TTAAGCGAGG

251   AAGAGACAAA ACATCAGGAA AAAAAGAAA AGAAAAGGA AAAGGCGGAA

301   GCCAAAGCAG AGAAAAAGCG TTTGAAGGAG GGCGGGGAGA AATCTGCCGA

351   AACGCAAAAA TCCCGCCTTT TGTGTTGGA TTTTGACGGC GATTTGTATG

401   CACACGCCGT AGAATCCTTG CGTCATGAGA TTACGGCGGT GCTTTTGATT

451   GCCAAGCCTG AAGATGAGGT TCTGCTCAGA TTGGAAAGTC CGGGCGGCGT

501   GGTTCACGGT TACGGTTTGG CGGCTTCGCA GCTTAGGCGT TTGCGCGAAC

551   GCAATATTCC GCTGAccgtc gccgTCGATA AGGTCGCGGC AAGCGgcggc 601   tatatgatgg cgtgtgtgGC GGATAAAATT GTTTCCGCtc cgtttgcggt 651   catcggttcg gtgggtgtgg tgGcggaagt gcCGAATATC CAccgCctGT

701   TGAAAAAACA TGATATTGAT GTGGATGTGA TGACGGCGGG CGAATTTAAG

751   CGCACGGTTA CTTTTATGGG TGAAAATACG GAAAAGGGCA AACAGAAATT

801   CCGGCAGGAA CTGGAGGAAA CGCATCAGTT GTTCAAGCAG TTTGTCAGTG

851   AAAACCGCCC CGGGTTGGAT ATTGAAAAAA TAGCGACGGG CGAGCATTGG

901   TTCGGCCGGC AGGCGTTGGC GTTGAACTTG ATTGACGAGA TTCGACCAG

951   TGATGATTTG TTGTTGAAAG CGTTTGAAAA CAAACAGGtt aTCGAAGTGA

1001   AATATCAGGA GAAGCGAAGC CTGATCCAGC GCATTGGTTT GCAGGCGGAA

1051   GCTTCCGTTG AAAAGTTGTT TGCCAAACTT GTCAACCGGC GAGCGGATGT

1101   GATGTAG
```

This corresponds to the amino acid sequence <SEQ ID 20; ORF 005.ng>:

```
g005.pep
    1   MGMDNIDMFM PEQEEIQSMW KEILLNYGIF LLELLTVFGA IALIVLAIVQ

51   SKKQSESGSV VLTDFSENYK KQRQSFETFF LSEEETKHQE KKEKKKEKAE

101   AKAEKKRLKE GGEKSAETQK SRLFVLDFDG DLYAHAVESL RHEITAVLLI

151   AKPEDEVLLR LESPGGVVHG YGLAASQLRR LRERNIPLTV AVDKVAASGG

201   YMMACVADKI VSAPFAVIGS VGVVAEVPNI HRLLKKHDID VDVMTAGEFK
```

```
251   RTVTFMGENT EKGKQKFRQE LEETHQLFKQ FVSENRPGLD IEKIATGEHW

301   FGRQALALNL IDEISTSDDL LLKAFENKQV IEVKYQEKRS LIQRIGLQAE

351   ASVEKLFAKL VNRRADVM*
```

The following partial DNA sequence was identified in *N. meningitidis* <SEQ ID 21>:

```
m005.seq
    1   ATGGACAATA TTGACATGTT CATGCCTGAA CAAGAGGAAA TCCAATCAAT

51   GTGGAAAGAA ATTTTACTGA ATTACGGTAT TTTCCTGCTC GAACTGCTTA

101   CCGTGTTCGG CGCAATTGCG CTGATTGTGT TGGCTATCGT ACAGAGTAAG

151   AAACAGTCGG AwAGCGGCAG TGTCGTACTG ACGGATTTTT CGGAAAATTA

201   TAAAAAACAG CGGCAATCGT TTGAAGCATT CTTTTTAAGC GGGGAAGAGG

251   CACAACATCA GGAAAAAGAG GAAAAGAAAA AGGAAAAGGC GGAAGCCAAA

301   GCAGAGAAAA A.CGTTTGAA GGAGGGTGGG GAGAAATCTG CCGAAACGCA 351   nAAATCACGC CTTTTTGTGT TGGANNNNNN NNNNNNNNNN NNNNNNNNNN

401   NNNNNNNNNN NNNNNNNNNN NNNNNNNNNN NNNNNNNNNN NNNNNNNNNN

451   NNNNNNNNNN NNNNNNNNNN NNNNNNNNNN NNNNNNNNNN NNNNNNNNNN

501   NNNNNNNNNN NNNNNNNNNN NNNNNNNNNN NNNNNNNNNN NNNNNNNNNN

551   NNNNNNNNNN NNNNNNNNNN NNNNNNNNNN NNGCGAGCGG CGGTTATATG

601   ATGGCGTGTG TGGCGGATAA AATTGCTTCC GCTCCGTTTG CGATTGTCGG

651   TTCGGTGGGT GTGGTGGCGG AAGTACCGAA TATCCACCGC CTGTTGAAAA

701   AACATGATAT TGATGTGGAT GTGATGACGG CGGGCGAATT TAAGCGCACG

751   GTTACTTTTA TGGGTGAAAA TACGGAAAAG GGCAAACAGA AATTCCGACA

801   GGAACTGGAG GAAACGCATC AGTTGTTCAA GCAGTTTGTC AGCGAGAACC

851   GCCCTCAATT GGATATTGAG GAAGTGGCAA CGGGCGAGCA TTGGTTCGGT

901   CGGCAGGCGT TGGCGTTGAA CTTGATTGAC GAGATTTCGA CCAGTGATGA

951   TTTGTTGTTG AAAGCGTTTG AAAACAAACA GGTTATCGAA GTGAAATATC

1001   AGGAGAAGCA AAGCCTGATC CAGCGCATTG GTTTGCAGGC GGAAGCTTCT

1051   GTTGAAAAGT TGTTTGCCAA ACTTGTCAAC CGGCGGGCGG ATGTGATGTA

1101   G
```

This corresponds to the amino acid sequence <SEQ ID 22; ORF 005>:

```
m005.pep
    1   MDNIDMFMPE QEEIQSMWKE ILLNYGIFLL ELLTVFGAIA LIVLAIVQSK

51   KQSXSGSVVL TDFSENYKKQ RQSFEAFFLS GEEAQHQEKE EKKKEKAEAK

101   AEKXRLKEGG EKSAETXKSR LFVLXXXXXX XXXXXXXXXX XXXXXXXXXX

151   XXXXXXXXXX XXXXXXXXXX XXXXXXXXXX XXXXXXXXXX XXXXASGGYM

201   MACVADKIAS APFAIVGSVG VVAEVPNIHR LLKKHDIDVD VMTAGEFKRT

251   VTFMGENTEK GKQKFRQELE ETHQLFKQFV SENRPQLDIE EVATGEHWFG

301   RQALALNLID EISTSDDLLL KAFENKQVIE VKYQEKQSLI QRIGLQAEAS

351   VEKLFAKLVN RRADVM*
```

The following partial DNA sequence was identified in *N. meningitidis* <SEQ ID 23>:

```
a005.seq
     1  ATGGACAATA TTGACATGTT CATGCCTGAA CAAGAGGAAA TCCAATCAAT
    51  GTGGAAAGAA ATTTTACTGA ATTACGGTAT TTTCCTGCTC GAACTGCTTA
   101  CCGTGTTCGG CGCAATTGCG CTGATTGTGT TGGCTATCGT ACAGAGTAAG
   151  AAACAGTCGG AAAGCGGCAG TGTCGTACTG ACGGATTTTT CGGAAAATTA
   201  TAAAAAACAG CGGCAATCGT TTGAAGCATT CTTTTTAAGC GGGGAAGAGG
   251  CAAAACATCA GGAAAAAGAG GAAAAGAAAA AGGAAAAGGC GGAAGCCAAA
   301  GCAGAGAAAA AGCGTTTGAA GGAGGGTGGG GAGAAATCTT CCGAAACGCA
   351  AAAATCCCGC CTTTTTGTGT TGGATTTTGA CGGCGATTTG TATGCACACG
   401  CCGTAGAATC CTTGCGTCAT GAGATTACGG CGGTGCTTTT GATTGCCAAG
   451  CCTGAAGATG AGGTTCTGCT TAGATTGGAA AGTCCGGGCG GCGTGGTTCA
   501  CGGTTACGGT TTGGCGGCTT CGCAGCTTAG GCGTTTGCGC GAACGCAATA
   551  TTCCGCTGAC CGTCGCCGTC GATAAGGTGG CGGCGAGCGG TGGTTATATG
   601  ATGGCGTGTG TGGCGGATAA AATTGTTTCC GCTCCGTTTG CGATTGTCGG
   651  TTCGGTGGGT GTTGTAGCGG AAGTACCGAA TATCCACCGC CTGTTGAAAA
   701  AACATGATAT TGATGTGGAT GTGATGACGG CGGGCGAATT TAAGCGCACG
   751  GTTACTTTTA TGGGTGAAAA TACGGAAAAG GGCAAACAGA AATTCCGACA
   801  GGAACTGGAG GAAACGCATC AGTTGTTCAA GCAGTTTGTC AGCGAGAACC
   851  GCCCTCAATT GGATATTGAG GAAGTGGCAA CGGGCGAGCA TTGGTTCGGT
   901  CGGCAGGCGT TGGCGTTGAA CTTGATTGAC GAGATTTCGA CCAGTGATGA
   951  TTTGTTGTTG AAAGCGTTTG AAAACAAACA GGTTATCGAA GTGAAATATC
  1001  AGGAGAAGCA AAGCCTGATC CAGCGCATTG GTTTGCAGGC GGAAGCTTCT
  1051  GTTGAAAAGT TGTTTGCCAA ACTTGTCAAC CGGCGGGCGG ATGTGATGTA
  1101  G
```

This corresponds to the amino acid sequence <SEQ ID 24; ORF 005.a>:

```
a005.pep
     1  MDNIDMFMPE QEEIQSMWKE ILLNYGIFLL ELLTVFGAIA LIVLAIVQSK
    51  KQSESGSVVL TDFSENYKKQ RQSFEAFFLS GEEAKHQEKE EKKKEKAEAK
   101  AEKKRLKEGG EKSSETQKSR LFVLDFDGDL YAHAVESLRH EITAVLLIAK
   151  PEDEVLLRLE SPGGVVHGYG LAASQLRRLR ERNIPLTVAV DKVAASGGYM
   201  MACVADKIVS APFAIVGSVG VVAEVPNIHR LLKKHDIDVD VMTAGEFKRT
   251  VTFMGENTEK GKQKFRQELE ETHQLFKQFV SENRPQLDIE EVATGEHWFG
   301  RQALALNLID EISTSDDLLL KAFENKQVIE VKYQEKQSLI QRIGLQAEAS
   351  VEKLFAKLVN RRADVM*
``` m005/a005 79.2% identity over a 366 aa overlap

```
                  10         20         30         40         50         60
m005.pep  MDNIDMFMPEQEEIQSMWKEILLNYGIFLLELLTVFGAIALIVLAIVQSKKQSXSGSVVL
          ||||||||||||||||||||||||||||||||||||||||||||||||||||| ||||||
a005      MDNIDMFMPEQEEIQSMWKEILLNYGIFLLELLTVFGAIALIVLAIVQSKKQSESGSVVL
                  10         20         30         40         50         60

70         80         90        100        110        120
m005.pep  TDFSENYKKQRQSFEAFFLSGEEAQHQEKEEKKKEKAEAKAEKXRLKEGGEKSAETXKSR
          ||||||||||||||||||||||||:||||||||||||||||||:||  |||||| | |||
a005      TDFSENYKKQRQSFEAFFLSGEEAKHQEKEEKKKEKAEAKAEKKRLKEGGEKSSETQKSR
                  70         80         90        100        110        120

130        140        150        160        170        180
m005.pep  LFVLXXXXXXXXXXXXXXXXXXXXXXXXXXXXXXXXXXXXXXXXXXXXXXXXXXXXXXXX
          ||||                                  :
a005      LFVLDFDGDLYAHAVESLRHEITAVLLIAKPEDEVLLRLESPGGVVHGYGLAASQLRRLR
                 130        140        150        160        170        180

190        200        210        220        230        240
m005.pep  XXXXXXXXXXXXXXASGGYMMACVADKIASAPFAIVGSVGVVAEVPNIHRLLKKHDIDVD
                    :         ||||||||||||:||||||||||||||||||||||||||||||
a005      ERNIPLTVAVDKVAASGGYMMACVADKIVSAPFAIVGSVGVVAEVPNIHRLLKKHDIDVD
                 190        200        210        220        230        240

250        260        270        280        290        300
m005.pep  VMTAGEFKRTVTFMGENTEKGKQKFRQELEETHQLFKQFVSENRPQLDIEEVATGEHWFG
          ||||||||||||||||||||||||||||||||||||||||||||||||||||||||||||
a005      VMTAGEFKRTVTFMGENTEKGKQKFRQELEETHQLFKQFVSENRPQLDIEEVATGEHWFG
                 250        260        270        280        290        300

310        320        330        340        350        360
m005.pep  RQALALNLIDEISTSDDLLLKAFENKQVIEVKYQEKQSLIQRIGLQAEASVEKLFAKLVN
          ||||||||||||||||||||||||||||||||||||||||||||||||||||||||||||
a005      RQALALNLIDEISTSDDLLLKAFENKQVIEVKYQEKQSLIQRIGLQAEASVEKLFAKLVN
                 310        320        330        340        350        360 m005.pep  RRADVMX
          |||||||
a005      RRADVMX
```

Computer analysis of this amino acid sequence gave the following results:
Homology with a Predicted ORF from N. gonorrhoeae
ORF 005 shows 77.0% identity over a 366 aa overlap with a predicted ORF (ORF 005.ng) from N. gonorrhoeae:

```
m005/g005
                   10         20         30         40         50
m005.pep     MDNIDMFMPEQEEIQSMWKEILLNYGIFLLELLTVFGAIALIVLAIVQSKKQSXSGSV
             |||||||||||||||||||||||||||||||||||||||||||||||||||||| |||
g005      MGMDNIDMFMPEQEEIQSMWKEILLNYGIFLLELLTVFGAIALIVLAIVQSKKQSESGCV
                   10         20         30         40         50         60

60         70         80         90        100        110
m005.pep  VLTDFSENYKKQRQSFEAFFLSGEEAQHQEKEEKKKEKAEAKAEKKRLKEGGEKSAETXK
          |||||||||||||||||||:||||  ||::||||:|||||||||||||||||||||||| |
g005      VLTDFSENYKKQRQSFETFFLSEEETKHQEKKEKKKEKAEAKAEKKRLKEGGEKSAETQK
                 70         80         90        100        110        120

120        130        140        150        160        170
m005.pep  SRLFVLXXXXXXXXXXXXXXXXXXXXXXXXXXXXXXXXXXXXXXXXXXXXXXXXXXXXX
          ||||||
g005      SRLFVLDFDGDLYAHAVESLRHEITAVLLIAKPEDEVLLRLESPGGVVHGYGLAASQLRR
                130        140        150        160        170        180

180        190        200        210        220        230
m005.pep  XXXXXXXXXXXXXXXASGGYMMACVADKIASAPFAIVGSVGVVAEVPNIHRLLKKHDID
                    :          ||||||||||||:||||:||||||||||||||||||||||
g005      LRERNIPLTVAVDKVAASGGYMMACVADKIVSAPFAVGSVGVVAEVPNIHRLLKKHDID
                190        200        210        220        230        240

240        250        260        270        280        290
m005.pep  VDVMTAGEFKRTVTFMGENTEKGKQXFRQELEETHQLFKQFVSENRPQLDIEEVATGEHW
          |||||||||||||||||||||||||:||||||||||||||||||||||||||::||||||
g005      VDVMTAGEFKRTVTFMGENTEKGKQKFRQELEETHQLFKQFVSENRPQLDIEKIATGEHW
                250        260        270        280        290        300

300        310        320        330        340        350
m005.pep  FGRQALALNLIDEISTSDDLLLKAFENKQVIEVKYQEKQSLIQRIGLQAEASVEKLFAKL
          ||||||||||||||||||||||||||||||||||||||:|||||||||||||||||||||
g005      FGRQALALNLIDEISTSDDLLLKAFENKQVIEVKYQEKRSLIQRIGLQAEASVEKLFAKL
                310        320        330        340        350        360
```

```
              360
m005.pep  VNRRADVMX
          |||||||||
    g005  VNRRADVMX
```

The following partial DNA sequence was identified in *N. gonorrhoeae* <SEQ ID 25>:

```
g006.seq
    1   ATGCTGCTGG TGCTggaatt ttggttCGGc gtGtCGGCGG TGGGCatact 51   tgCGTTGTTT TTATGGCttt TGCCACGTTT TGCCGCCATC AGCGAAAACC 101   TGTATTTCCG CCTGAACAAC AGCTTGGAAC gcgACAACCA CTTTATCCGA

151   AAAGGCGACG AGCGGCAGCT GTACCGCCAT TACGGACTGG TTTCGCGCCT

201   GCGTGTGCTG ATTTCCAACC GCGAAGCCTT CGGCTATCTC TGCGTCGGCG

251   CGGCGATGGG TATTTTGTTC GGCTTTGCTT TTGTGATGAT GACGCTCAAA

301   GGCTACGGCA GCGCGGGGCA TATTTATTCG GTCGGCACTT ATCTGTGGAT

351   GTTTGCCATG AGTTTGGACG ATGTGCCGCG ATTGGTCGAA CAATATTCCA

401   ATTTGAAAGA CATCGGACAA CGGATAGAGT GGTCGGAACG GAACATCAAA

451   GCCGGAACTT GA
```

This corresponds to the amino acid sequence <SEQ ID 26; ORF 006.ng>:

```
g006.pep
    1   MLLVLEFWFG VSAVGILALF LWLLPRFAAI SENLYFRLNN SLERDNHFIR

51   KGDERQLYRH YGLVSRLRVL ISNREAFGYL CVGAAMGILF GFAFVMMTLK

101   GYGSAGHIYS VGTYLWMFAM SLDDVPRLVE QYSNLKDIGQ RIEWSERNIK

151   AGT*
```

The following partial DNA sequence was identified in *N. meningitidis* <SEQ ID 27>:

```
m006.seq
    1   ATGCTGCTGG TGCTGGAATT TTGGGTCGGC GTGTCGGCGG TGGGCATACT

51   TGCGTTGTTT TTATGGCTTT TGCCACGTTT TGCCGCCATC AGCGAAAACC

101   TGTATTTCCG CCTGAACAAC AGCTTGGAAC GCGACAACCA CTTTATCCGA

151   AAAGGCGACC GGCGGCAGCT GTACCGCCAT TACGGACTGC TTGCGCGCCT

201   GCGTGTGCTG ATTTCCAACC GCGAAGCCTT CGGCTATCTC TGCGTCGGCA

251   CGGCGATGGG TATTTTGTTC GGCTTTGCTT TTGTGATGAT GACGCTCAAA

301   GGCTACAGCA GCGCGGGGCA TGTCTATTCG GTCGGCACTT ATCTGTGGAT

351   GTTTGCCATG AGTTTGGACG ACGTGCCGCG ATTGGTCGAA CAATATTCCA

401   ATTTGAAAGA CATCGGACAA CGGATAGAGT GGTCGGAACG GAACATCAAA

451   GCCGGAACTTGA
```

This corresponds to the amino acid sequence <SEQ ID 28; ORF 006>:

```
m006.pep
    1   MLLVLEFWVG VSAVGILALF LWLLPRFAAI SENLYFRLNN SLERDNHFIR

51   KGDRRQLYRH YGLLARLRVL ISNREAFGYL CVGTAMGILF GFAFVMMTLK

101   GYSSAGHVYS VGTYLWMFAM SLDDVPRLVE QYSNLKDIGQ RIEWSERNIK

151   AGT*
```

The following partial DNA sequence was identified in *N. meningitidis* <SEQ ID 29>:

```
a006.seq
    1   ATGCTGCTGG TGCTGGAATT TTGGGTCGGC GTGTCGGCGG TGGGCATACT

51   TGCGTTGTTT TTATGGCTTT TGCCACGTTT TGCCGCCATC AGCGAAAACC

101   TGTATTTCCG CCTGAAGAAC AGCTTGGAAC GCGACAACCA CTTTATCCGA

151   AAAGGCGACG AGCGGCAGCT GGACCGCCAT TACGGACTGC TTGCGCGCCT

201   GCGTGTGCTG ATTTCCAACC GCGAAGCCTT CGGCTATCTC TGCGTCGGCA

251   CGGCGATGGG TATTTTGTTC GGCTTTGCTT TTGTGATGAT GACGCTCAAA

301   GGCTACAGCA GCGCGGGGCA TGTCTATTCG GTCGGCACTT ATCTGTGGAT

351   GTTTGCCATA AGTTTGGACG ACGTGCCGCG ATTGGTCGAA CAATATTCCA

401   ATTTGAAAGA CATCGGACAA CGGATAGAGT GGTCGAAACG GAACATCAAA

451   GCCGGAACTT GA
```

This corresponds to the amino acid sequence <SEQ ID 30; ORF 006.a>:

```
a006.pep
    1   MLLVLEFWVG VSAVGILALF LWLLPRFAAI SENLYFRLKN SLERDNHFIR

51   KGDERQLDRH YGLLARLRVL ISNREAFGYL CVGTAMGILF GFAFVMMTLK

101   GYSSAGHVYS VGTYLWMFAI SLDDVPRLVE QYSNLKDIGQ RIEWSKRNIK

151   AGT*
``` m006/a006 96.7% identity over a 153 aa overlap

```
                  10         20         30         40         50         60
      m006.pep  MLLVLEFWVGVSAVGILALFLWLLPRFAAISENLYFRLNNSLERDNHFIRKGDRRQLYRH
                ||||||||||||||||||||||||||||||||||||||:|||||||||||:|||  ||
         a006  MLLVLEFWVGVSAVGILALFLWLLPRFAAISENLYFRLKNSLERDNHFIRKGDERQLDRH
                  10         20         30         40         50         60

70         80         90        100        110        120
      m006.pep  YGLLARLRVLISNREAFGYLCVGTAMGILFGFAFVMMTLKGYSSAGHVYSVGTYLWMFAM
                |||||||||||||||||||||||||||||||||||||||||||||||||||||||||||:
         a006  YGLLARLRVLISNREAFGYLCVGTAMGILFGFAFVMMTLKGYSSAGHVYSVGTYLWMFAI
                  70         80         90        100        110        120

130        140        150
      m006.pep  SLDDVPRLVEQYSNLKDIGQRIEWSERNIKAGTX
                ||||||||||||||||||||||||||:|||||||
         a006  SLDDVPRLVEQYSNLKDIGQRIEWSKRNIKAGTX
                 130        140        150
```

Computer analysis of this amino acid sequence gave the following results:

Homology with a Predicted ORF from *N. gonorrhoeae*

ORF 006 shows 95.4% identity over a 153 aa overlap with a predicted ORF (ORF 006.ng) from *N. gonorrhoeae*:

```
m006/g006
                  10         20         30         40         50         60
    m006.pep  MLLVLEFWVGVSAVGILALFLWLLPRFAAISENLYFRLNNSLERDNHFIRKGDRRQLYRH
              ||||||||| |||||||||||||||||||||||||||||||||||||||||||:||||||
        g006  MLLVLEFWFGVSAVGILALFLWLLPRFAAISENLYFRLNNSLERDNHFIRKGDERQLYRH
                  10         20         30         40         50         60

70         80         90        100        110        120
    m006.pep  YGLLARLRVLISNREAFGYLCVGTAMGILFGFAFVMMTLKGYSSAGHVYSVGTYLWMFAM
              |||::||||||||||||||||||||:|||||||||||||||||:||||:|||||||||||
        g006  YGLVSRLRVLISNREAFGYLCVGAAMGILFGFAFVMMTLKGYGSAGHIYSVGTYLWMFAM
                  70         80         90        100        110        120

130        140        150
    m006.pep  SLDDVPRLVEQYSNLKDIGQRIEWSERNIKAGTX
              ||||||||||||||||||||||||||||||||
        g118  SLDDVPRLVEQYSNLKDIGQRIEWSERNIKAGT
                 130        140        150
```

The following partial DNA sequence was identified in *N. gonorrhoeae* <SEQ ID 31>:

```
g006-1.seq
       1    ATGTGGAAAA TGTTGAAACA CATAGCCAAA ACCCACCGCA AGCGATTGAT

51    TGGCACATTT TCCCCGGTCG GACTGGAAAA CCTTTTGATG CTGGGGTATC

101    CGGTGTTTGG CGGCTGGGCG ATTAATGCCG TGATTGCGGG GAGGGTGTGG

151    CAGGCGTTGC TGTACGCTTT GGTTGTATTT TTGATGTGGC TGGTCGGTGC

201    GGCACGGCGG ATTGCCGATA CGCGCACGTT TACGCGGATT TATACCGAAA

251    TCGCCGTGCC GGTTGTGTTG GAACAACGGC AGCGGCAAGT CCCGCATTCA

301    GCGGTAACTG CACGGGTTGC CCTGTCGCGT GAATTTGTCA GCTTTTTTGA

351    AGAACACCTG CCGATTGCCG CGACATCCGT CGTATCCATA TTCGGCGCGT

401    GCATCATGCT GCTGGTGCTG GAATTTTGGG TCGGCGTGTC GGCGGTGGGC

451    ATACTTGCGT TGTTTTTATG GCTTTTGCCA CGTTTTGCCG CCATCAGCGA

501    AAACCTGTAT TTCCGCCTGA ACAACAGCTT GGAACGCGAC AACCACTTTA

551    TCCGAAAAGG CGACGAGCGG CAGCTGTACC GCCATTACGG ACTGGTTTCG

601    CGCCTGCGTG TGCTGATTTC CAACCGCGAA GCCTTCGGCT ATCTCTGCGT

651    CGGCGCGGCG ATGGGTATTT TGTTCGGCTT TGCTTTTGTG ATGATGACGC

701    TCAAAGGCTA CGGCAGCGCG GGGCATATTT ATTCGGTCGG CACTTATCTG

751    TGGATGTTTG CCATGAGTTT GGACGATGTG CCGCGATTGG TCGAACAATA

801    TTCCAATTTG AAAGACATCG GACAACGGAT AGAGTGGTCG GAACGGAACA

851    TCAAAGCCGG AACTTGA
```

This corresponds to the amino acid sequence <SEQ ID 32; ORF 006-1.ng>:

```
g006-1.pep
       1    MWKMLKHIAK THRKRLIGTF SPVGLENLLM LGYPVFGGWA INAVIAGRVW

51    QALLYALVVF LMWLVGAARR IADTRTFTRI YTEIAVPVVL EQRQRQVPHS

101    AVTARVALSR EFVSFFEEHL PIAATSVVSI FGACIMLLVL EFWVGSAVG

151    ILALFLWLLP RFAAISENLY FRLNNSLERD NHFIRKGDER QLYRHYGLVS

201    RLRVLISNRE AFGYLCVGAA MGILFGFAFV MMTLKGYGSA GHIYSVGTYL

251    WMFAMSLDDV PRLVEQYSNL KDIGQRIEWS ERNIKAGT*
```

The following partial DNA sequence was identified in *N. meningitidis* <SEQ ID 33>:

```
m006-1.seq
    1   ATGTGGAAAA TGTTGAAACA CATAGCCCAA ACCCACCGCA AGCGATTGAT

51   TGGCACATTT TCCCTGGTCG GACTGGAAAA CCTTTTGATG CTGGTGTATC

101   CGGTGTTTGG CGGCCGGGCG ATCAATGCCG TGATTGCGGG GGAGGTGTGG

151   CAGGCGTTGC TGTACGCTTT GGTTGTGCTT TTGATGTGGC TGGTCGGTGC

201   GGTGCGGCGG ATTGCCGATA CGCGCACGTT TACGCGGATT TATACCGAAA

251   TCGCCGTGCC GGTCGTGTTG AACAGCGGC AGCGACAAGT CCCGCATTCG

301   GCGGTAACTG CGCGGGTTGC CCTGTCGCGT GAGTTTGTCA GCTTTTTTGA

351   AGAACACCTG CCGATTGCCG CGACATCCGT CGTATCCATA TTCGGCGCGT

401   GCATCATGCT GCTGGTGCTG GAATTTTGGG TCGGCGTGTC GGCGGTGGGC

451   ATACTTGCGT TGTTTTTATG GCTTTTGCCA CGTTTTGCCG CCATCAGCGA

501   AAACCTGTAT TTCCGCCTGA ACAACAGCTT GGAACGCGAC AACCACTTTA

551   TCCGAAAAGG CGACCGGCGG CAGCTGTACC GCCATTACGG ACTGCTTGCG

601   CGCCTGCGTG TGCTGATTTC CAACCGCGAA GCCTTCGGCT ATCTCTGCGT

651   CGGCACGGCG ATGGGTATTT TGTTCGGCTT TGCTTTTGTG ATGATGACGC

701   TCAAAGGCTA CAGCAGCGCG GGGCATGTCT ATTCGGTCGG CACTTATCTG

751   TGGATGTTTG CCATGAGTTT GGACGACGTG CCGCGATTGG TCGAACAATA

801   TTCCAATTTG AAAGACATCG GACAACGGAT AGAGTGGTCG GAACGGAACA

851   TCAAAGCCGG AACTTGA
```

This corresponds to the amino acid sequence <SEQ ID 34; ORF 006-1>:

```
m006-1.pep
    1   MWKMLKHIAQ THRKRLIGTF SLVGLENLLM LVYPVFGGRA INAVIAGEVW

51   QALLYALVVL LMWLVGAVRR IADTRTFTRI YTEIAVPVVL EQRQRQVPHS

101   AVTARVALSR EFVSFFEEHL PIAATSVVSI FGACIMLLVL EFWVGVSAVG

151   ILALFLWLLP RFAAISENLY FRLNNSLERD NHFIRKGDRR QLYRHYGLLA

201   RLRVLISNRE AFGYLCVGTA MGILFGFAFV MMTLKGYSSA GHVYSVGTYL

251   WMFAMSLDDV PRLVEQYSNL KDIGQRIEWS ERNIKAGT*
``` m006-1/g006-3. 95.5% identity in 288 aa overlap

```
                    10         20         30         40         50         60
m006-1.pep   MWKMLKHIAQTHRKRLIGTFSLVGLENLLMLVYPVFGGRAINAVIAGEVWQALLYALVVL
             ||||||||| :|||||||||||:||||||||| ||||||||| ||||| :|||||||| :
g006-1       MWKMLKHIAKTHRKRLIGTFSPVGLENLLMLGYPVFGGWAINAVIAGRVWQALLYALVVF
                    10         20         30         40         50         60

70         80         90        100        110        120
m006-1.pep   LMWLVGAVRRIADTRTFTRIYTEIAVPVVLEQRQRQVPHSAVTARVALSREFVSFFEEHL
             ||||||| :|||||||||||||||||||||||||||||||||||||||||||||||||||
g006-1       LMWLVGAARRIADTRTFTRIYTEIAVPVVLEQRQRQVPHSAVTARVALSREFVSFFEEHL
                    70         80         90        100        110        120

130        140        150        160        170        180
m006-1.pep   PIAATSVVSIFGACIMLLVLEFWVGVSAVGILALFLWLLPRFAAISENLYFRLNNSLERD
             ||||||||||||||||||||||||||||||||||||||||||||||||||||||||||||
g006-1       PIAATSVVSIFGACIMLLVLEFWVGVSAVGILALFLWLLPRFAAISENLYFRLNNSLERD
                   130        140        150        160        170        180

190        200        210        220        230        240
m006-1.pep   NHFIRKGDRRQLYRHYGLLARLRVLISNREAFGYLCVGTAMGILFGFAFVMMTLKGYSSA
             ||||||||:|||||||||:::|||||||||||||||||| :||||||||||||||||:|
g006-1       NHFIRKGDERQLYRHYGLVSRLRVLISNREAFGYLCVGAAMGILFGFAFVMMTLKGYGSA
                   190        200        210        220        230        240
```

-continued

```
                     250        260        270        280      289
m006-1.pep   GHVYSVGTYLWMFAMSLDDVPRLVEQYSNLKDIGQRIEWSERNIKAGTX
             ||:|||||||||||||||||||||||||||||||||||||||||||||
g006-1       GHIYSVGTYLWMFAMSLDDVPRLVEQYSNLKDIGQRIEWSERNIKAGTX
                     250        260        270        280
```

The following partial DNA sequence was identified in *N. meningitidis* <SEQ ID 35>:

```
a006-1.seq (partial)
     1    ..AGCCAAAACC ACCGCAAGCG ATTGATTGGC ACATTTTTTC TGGTCGGACT
    51      GGAAAACCTT TTGATGCTGG TGTATCCGGT GTTTGGCGGC TGGGCGATTA
   101      ATGCCGTGAT TGCGGGGCAG GCGTGGCAGG CGTTGCTGTA CGCTTTGGTT
   151      GTGCTTTTGA TGTGGCTGGT CGGTGCGGCG CGGCGGATTG CCGATACGCG
   201      CACGTTTACG CGGATTTATA CCGAAATCGC CGTGCCGGTT GTGTTGGAAC
   251      AGCGGCAGCG GCAAGTCCCG CATTCGGCGG TAACTGCGCG GGTTGCCCTG
   301      TCGCGTGAGT TTGTCAGCTT TTTTGAAGAA CACCTGCCGA TTGCCGCGAC
   351      ATCCGTCGTA TCCATATTCG GCGCGTGCAT CATGCTGCTG GTGCTGGAAT
   401      TTTGGGTCGG CGTGTCGGCG GTGGGCATAC TTGCGTTGTT TTTATGGCTT
   451      TTGCCACGTT TTGCCGCCAT CAGCGAAAAC CTGTATTTCC GCCTGAAGAA
   501      CAGCTTGGAA CGCGACAACC ACTTTATCCG AAAAGGCGAC GAGCGGCAGC
   551      TGGACCGCCA TTACGGACTG CTTGCGCGCC TGCGTGTGCT GATTTCCAAC
   601      CGCGAAGCCT TCGGCTATCT CTGCGTCGGC ACGGCGATGG GTATTTTGTT
   651      CGGCTTTGCT TTTGTGATGA TGACGCTCAA AGGCTACAGC AGCGCGGGGC
   701      ATGTCTATTC GGTCGGCACT TATCTGTGGA TGTTTGCCAT AAGTTTGGAC
   751      GACGTGCCGC GATTGGTCGA ACAATATTCC AATTTGAAAG ACATCGGACA
   801      ACGGATAGAG TGGTCGAAAC GGAACATCAA AGCCGGAACT TGA
```

This corresponds to the amino acid sequence <SEQ ID 36; ORF 006-1.a>:

```
a006-1.pep (partial)
     1    ..SQNHRKRLIG TFFLVGLENL LMLVYPVFGG WAINAVIAGQ AWQALLYALV
    51      VLLMWLVGAA RRIADTRTFT RIYTEIAVPV VLEQRQRQVP HSAVTARVAL
   101      SREFVSFFEE HLPIAATSVV SIFGACIMLL VLEFWVGVSA VGILALFLWL
   151      LPRFAAISEN LYFRLKNSLE RDNHFIRKGD ERQLDRHYGL LARLRVLISN
   201      REAFGYLCVG TAMGILFGFA FVMMTLKGYS SAGHVYSVGT YLWMFAISLD
   251      DVPRLVEQYS NLKDIGQRIE WSKRNIKAGT *
``` a006-1/m006-1 95.7% identity in 280 aa overlap

```
                       10         20         30         40         50
a006-1.pep        SQNHRKRLIGTFFLVGLENLLMLVYPVFGGWAINAVIAGQAWQALLYALVVL
                  :|:||||||||||||||||||||||||||||:||||||||:|||||||||||
m006-1      MWKMLKHIAQTHRKRLIGTFSLVGLENLLMLVYPVFGGRAINAVIAGEVWQALLYALVVL
                       10         20         30         40         50         60

60         70         80         90        100        110
a006-1.pep  LMWLVGAARRIADTRTFTRIYTEIAVPVVLEQRQRQVPHSAVTARVALSREFVSFFEEHL
            |||||||:||||||||||||||||||||||||||||||||||||||||||||||||||||
m006-1      LMWLVGAVRRIADTRTFTRIYTEIAVPVVLEQRQRQVPHSAVTARVALSREFVSFFEEHL
                       70         80         90        100        110        120
```

```
               120        130        140        150        160        170
a006-1.pep  PIAATSVVSIFGACIMLLVLEFWVGVSAVGILALFLWLLPRFAAISENLYFRLKNSLERD
            ||||||||||||||||||||||||||||||||||||||||||||||||||||||:||||||
m006-1      PIAATSVVSIFGACIMLLVLEFWVGVSAVGILALFLWLLPRFAAISENLYFRLNNSLERD
               130        140        150        160        170        180

180        190        200        210        220        230
a006-1.pep  NHFIRKGDERQLDRHYGLLARLRVLISNREAFGYLCVGTAMGILFGFAFVMMTLKGYSSA
            ||||||||:|||  ||||||||||||||||||||||||||||||||||||||||||||||
m006-1      NHFIRKGDRRQLYRHYGLLARLRVLISNREAFGYLCVGTAMGILFGFAFVMMTLKGYSSA
               190        200        210        220        230        240

240        250        260        270        280
a006-1.pep  GHVYSVGTYLWMFAISLDDVPRLVEQYSNLKDIGQRIEWSKRNIKAGTX
            ||||||||||||||:|||||||||||||||||||||||||:||||||||
m006-1      GHVYSVGTYLWMFAMSLDDVPRLVEQYSNLKDIGQRIEWSERNIKAGTX
               250        260        270        280
```

The following partial DNA sequence was identified in *N. gonorrhoeae* <SEQ ID 37>:

```
g007.seq
    1   atgaACACAA CCCGACTGCC GACCGCCTTC ATCTTGTGCT GCCTCTGcgC

51   CGCcGCTTCT GCCGccgaca acAGCatcat gaCaAAAGGG CAAAAAGTGT

101   ACGAATCcAa ctGCATCGCC TGCCACGGCA AGAAAGGGGA AGGGCGCGGC

151   ACTGCGtTTC CTccgctTTT CCggtcgGac tgtattatga acaAACCGCa 201   cgTCCtgctg cacagcatgg tcaaaggcAt cgacgggaca ttcaaagtgg 251   agcggcaaaa cctacgacgg atttatgCcc gcaaccgcca tcagcgATGC

301   GGACATTGCC GCCGTCGCCA CTTATATCAT GAACGCCTTT GA
```

This corresponds to the amino acid sequence <SEQ ID 38; ORF 007.ng>:

```
g007.pep
    1   MNTTRLPTAF ILCCLCAAAS AADNSIMTKG QKVYESNCIA CHGKKGEGRG

51   TAFPPLFRSD CIMNKPHVLL HSMVKGIDGT FKVERQNLRR IYARNRHQRC

101   GHCRRRHLYH ERL*
```

The following partial DNA sequence was identified in *N. meningitidis* <SEQ ID 39>:

```
m007.seq
    1   ATGAACACAA CCCGACTGCC GACCGCCCTC GTCTTGGGCT GCTTCTGCGC

51   CGCCGCTTCT GCCGCCGACA ACAGCATCAT GACAAAAGGG CAAAAAGTGT

101   ACGAATCCAA CTGCGTCGCC TGCCACGGCA AAAAGGGCGA AGGCCGCGGA

151   ACCATGTTTC CGCCGCTCTA CCGCTCCGAC TTCATCATGA AAAAACCGCA

201   GGTGCTGCTG CACAGCATGG TCAAAGGCAT CAACGGTACA ATCAAAGTC.

251   AACGGCAAAA CCTACAACGG ATTCATGCCC GCAACCGCCA TCAGCGATGC

301   GGACATTGCC GCCGTCGCCA CTTATATCAT GAACGCCTTT GA
```

This corresponds to the amino acid sequence <SEQ ID 40; ORF 007>:

```
m007.pep
    1   MNTTRLPTAL VLGCFCAAAS AADNSIMTKG QKVYESNCVA CHGKKGEGRG

51   TMFPPLYRSD FIMKKPQVLL HSMVKGINGT IKVXRQNLQR IHARNRHQRC

101   GHCRRRHLYH ERL*
```

The following partial DNA sequence was identified in *N. meningitidis* <SEQ ID 41>:

```
a007.seq
    1   ATGAACACAA CCCGACTGCC GACCGCCCTC GTCTTGGGCT GCCTCTGCGC

51   CGCCGCTTCT GCCGCCGACA ACAGCATCAT GACAAAAGGG CAAAAAGTGT

101   ACGAATCCAA CTGCGTCGCC TGCCACGGCA AAAGGGCGA AGGCCGCGGA

151   ACCATGTTTC CGCCGCTCTA CCGCTCCGAC TTCATCATGA AAAAACCGCA

201   GGTGCTGCTG CACAGCATGG TCAAAGGCAT CAACGGTACA ATCAAAGTC.

251   AACGGCAAAA CCTACAACGG ATTCATGCCC GCCACTGCCA TCAGCGATGC

301   GGACATTGCC GCCGTCGCCA CTTATATCAT GAACGCCTTT GA
```

This corresponds to the amino acid sequence <SEQ ID 42; ORF 007.a>:

```
a007.pep
    1   MNTTRLPTAL VLGCLCAAAS AADNSIMTKG QKVYESNCVA CHGKKGEGRG

51   TMFPPLYRSD FIMKKPQVLL HSMVKGINGT IKVXRQNLQR IHARHCHQRC

101   GHCRRRHLYH ERL*
``` m007/a007 97.3% identity over a 113 aa overlap

```
                    10         20         30         40         50         60
    m007.pep  MNTTRLPTALVLGCFCAAASAADNSIMTKGQKVYESNCVACHGKKGEGRGTMFPPLYRSD
              ||||||||||||||:|||||||||||||||||||||||||||||||||||||||||||||
    a007      MNTTRLPTALVLGCLCAAASAADNSIMTKGQKVYESNCVACHGKKGEGRGTMFPPLYRSD
                    10         20         30         40         50         60

70         80         90        100        110
    m007.pep  FIMKKPQVLLHSMVKGINGTIKVXRQNLQRIHARNRHQRCGHCRRRHLYHERLX
              |||||||||||||||||||||||||||||||||||:|||||||||||||||||
    a007      FIMKKPQVLLHSMVKGINGTIKVXRQNLQRIHARHCHQRCGHCRRRHLYHERLX
                    70         80         90        100        110
```

Computer analysis of this amino acid sequence gave the following results:
Homology with a Predicted ORF from *N. gonorrhoeae*
ORF 007 shows 86.7% identity over a 113 aa overlap with a predicted ORF (ORF 007.ng) from *N. gonorrhoeae*:

```
    m007/g007
                    10         20         30         40         50         60
    m007.pep  MNTTRLPTALVLGCFCAAASAADNSIMTKGQKVYESNCVACHGKKGEGRGTMFPPLYRSD
              ||||||||::|  |:||||||||||||||||||||||||:|||||||||||| ||||:|||
    g007      MNTTRLPTAFILCCLCAAASAADNSIMTKGQKVYESNCIACHGKKGEGRGTAFPPLFRSD
                    10         20         30         40         50         60

70         80         90        100        110
    m007.pep  FIMKKPQVLLHSMVKGINGTIKVXRQNLQRIHARNRHQRCGHCRRRHLYHERLX
              ||:||:|||||||||||:||  ||||:||:||||||||||||||||||||||||
    g007      CIMNKPHVLLHSMVKGIDGTFKVERQNLRRIYARNRHQRCGHCRRRHLYHERL
                    70         80         90        100        110
```

The following partial DNA sequence was identified in *N. gonorrhoeae* <SEQ ID 43>:

```
g007-1.seq (partial)
    1     ATGAACACAA CCCGACTGCC GACCGCCTTC ATCTTGTGCT GCCTCTGCGC
   51     CGCCGCTTCT GCCGCCGACA CAGCATCAT GACAAAAGGG CAAAAAGTGT
  101     ACGAATCCAA CTGCATCGCC TGCCACGGCA AGAAAGGGGA AGGGCGCGGC
  151     ACTGCGTTTC CTCCGCTTTT CCGGTCGGAC TATATTATGA ACAAACCGCA
  201     CGTCCTGCTG CACAGCATGG TCAAAGGCAT CAACGGTACA ATCAAAGTCA
  251     ACGGCAAAAC CTACAACGGA TTCATGCCCG CAACCGCCAT CAGCGATGCG
  301     GACATTGCCG CCGTCGCCAC TTATATCATG AACGCCTTTG ACAACGGCGG
  351     CGGAAGCGTT ACCGAAAAAG ACGTAAAACA GGCAAAAGGC AAAAAAAC.
```

This corresponds to the amino acid sequence <SEQ ID 44; ORF 007-1.ng>:

```
g007-1.pep (partial)
    1     MNTTRLPTAF ILCCLCAAAS AADNSIMTKG QKVYESNCIA CHGKKGEGRG
   51     TAFPPLFRSD YIMNKPHVLL HSMVKGINGT IKVNGKTYNG FMPATAISDA
  101     DIAAVATYIM NAFDNGGGSV TEKDVKQAKG KKN...
```

The following partial DNA sequence was identified in *N. meningitidis* <SEQ ID 45>:

```
m007-1.seq
    1     ATGAACACAA CCCGACTGCC GACCGCCCTC GTCTTGGGCT GCTTCTGCGC
   51     CGCCGCTTCT GCCGCCGACA CAGCATCAT GACAAAAGGG CAAAAAGTGT
  101     ACGAATCCAA CTGCGTCGCC TGCCACGGCA AAAAGGGCGA AGGCCGCGGA
  151     ACCATGTTTC CGCCGCTCTA CCGCTCCGAC TTCATCATGA AAAAACCGCA
  201     GGTGCTGCTG CACAGCATGG TCAAAGGCAT CAACGGTACA ATCAAAGTCA
  251     ACGGCAAAAC CTACAACGGA TTCATGCCCG CAACCGCCAT CAGCGATGCG
  301     GACATTGCCG CCGTCGCCAC TTATATCATG AACGCCTTTG ACAACGGCGG
  351     CGGAAGCGTT ACCGAAAAAG ACGTAAAACA GGCAAAAAGC AAAAAAACT
  401     AA
```

This corresponds to the amino acid sequence <SEQ ID 46; ORF 007-1>:

```
m007-1.pep
    1     MNTTRLPTAL VLGCFCAAAS AADNSIMTKG QKVYESNCVA CHGKKGEGRG
   51     TMFPPLYRSD FIMKKPQVLL HSMVKGINGT IKVNGKTYNG FMPATAISDA
  101     DIAAVATYIM NAFDNGGGSV TEKDVKQAKS KKN*
``` m007-1/g007-1 91.7% identity in 133 aa overlap

```
                    10         20         30         40         50         60
   m007-1.pep  MNTTRLPTALVLGCFCAAASAADNSIMTKGQKVYESNCVACHGKKGEGRGTMFPPLYRSD
                ||||||||::| |:||||||||||||||||||||||||:||||||||||| ||||:|||
        g007-1  MNTTRLPTAFILCCLCAAASAADNSIMTKGQKVYESNCIACHGKKGEGRGTAFPPLFRSD
                    10         20         30         40         50         60

70         80         90        100        110        120
   m007-1.pep  FIMKKPQVLLHSMVKGINGTIKVNGKTYNGFMPATAISDADIAAVATYIMNAFDNGGGSV
                :||:||:|||||||||||||||||||||||||||||||||||||||||||||||||||
        g007-1  YIMNKPHVLLHSMVKGINGTIKVNGKTYNGFMPATAISDADIAAVATYIMNAFDNGGGSV
                    70         80         90        100        110        120
```

```
                      130
m007-1.pep  TEKDVKQAKSKKNX
            ||||||||||:|||
g007-1      TEKDVKQAKGKKN
                      130
```

The following partial DNA sequence was identified in *N. meningitidis* <SEQ ID 47>:

```
a007-1.seq (partial)
      1    ATGAACACAA CCCGACTGCC GACCGCCCTC GTCTTGGGCT GCCTCTGCGC

51    CGCCGCTTCT GCCGCCGACA ACAGCATCAT GACAAAAGGG CAAAAAGTGT

101    ACGAATCCAA CTGCGTCGCC TGCCACGGCA AAAGGGCGA AGGCCGCGGA

151    ACCATGTTTC CGCCGCTCTA CCGCTCCGAC TTCATCATGA AAAAACCGCA

201    GGTGCTGCTG CACAGCATGG TCAAAGGCAT CAACGGTACA ATCAAAGTCA

251    ACGGCAAAAC CTACAACGGA TTCATGCCCG CCACTGCCAT CAGCGATGCG

301    GACATTGCCG CCGTCGCCAC TTATATCATG AACGCCTTTG ACAACGGCGG

351    CGGAAGCGTT ACCGAAAAAG ACGTAAAACA GGCAAAAAAC AAAAAA..
                                                              25
```

This corresponds to the amino acid sequence <SEQ ID 48; ORF 007-1.a>:

```
a007-1.pep (partial)
      1    MNTTRLPTAL VLGCLCAAAS AADNSIMTKG QKVYESNCVA CHGKKGEGRG

51    TMFPPLYRSD FIMKKPQVLL HSMVKGINGT IKVNGKTYNG FMPATAISDA

101    DIAAVATYIM NAFDNGGGSV TEKDVKQAKN KK..
                                                 35
``` m007-1/a007-1 98.5% identity in 132 aa overlap

```
                    10        20        30        40        50        60
m007-1.pep  MNTTRLPTALVLGCFCAAASAADNSIMTKGQKVYESNCVACHGKKGEGRGTMFPPLYRSD
            ||||||||||||||:|||||||||||||||||||||||||||||||||||||||||||||
a007-1      MNTTRLPTALVLGCLCAAASAADNSIMTKGQKVYESNCVACHGKKGEGRGTMFPPLYRSD
                    10        20        30        40        50        60
                    70        80        90       100       110       120
m007.1.pep  FIMKKPQVLLHSMVKGINGTIKVNGKTYNGFMPATAISDADIAAVATYIMNAFDNGGGSV
            ||||||||||||||||||||||||||||||||||||||||||||||||||||||||||||
a007.1      FIMKKPQVLLHSMVKGINGTIKVNGKTYNGFMPATAISDADIAAVATYIMNAFDNGGGSV
                    70        80        90       100       110       120
                    130
m007-1.pep  TEKDVKQAKSKKNX
            ||||||||||:||
a007-1      TEKDVKQAKNKK
                    130
```

The following partial DNA sequence was identified in *N. gonorrhoeae* <SEQ ID 49>:

```
g008.seq
      1    ATGAACAACA GACATTTTGC CGTCAtcgCC TTGGGCAGCA ACCTTGACAA

51    CCCCGCACAA CAAATacgcg gcgcattaga cgcgctctcg tcccatcctg 101    acatccggct tgaaCaggtt tcctcactgt aTatgaccgc acctgtcggt 151    tacgAcaaTC agcccgATTT CATCaatgcc gTCTgcaccg TTTCCACCAC 201    CtTGGACGGC ATTGcccTGC TTGCCgaACT CAAccgTATC GAAGCCGATT 251    TCGGACGCGA aCGCAGTTTC CGCAATGCAC CGCGCACATT GGATTTGGAC
```

-continued

```
   301  ATTATCGACT TTGACGGCAT CTCCAGCGAC GACCCCCGCC TTACCCTGCC

351  GCATCCGCGC GCGCACGAAC GCAGTTTCGT CATACGCCCT TTGGCAGAAA

401  TCCTCCCTGA TTTTATTTTG GGAAAATACG GAAAGGTTGT CGAATTGTCA

451  AAACGGCTGG GCAATCAAGG CATCCGTCTT TTACCGGACA GGTAA
```

This corresponds to the amino acid sequence <SEQ ID 50; ORF 008.ng>:

```
g008.pep
     1  MNNRHFAVIA LGSNLDNPAQ QIRGALDALS SHPDIRLEQV SSLYMTAPVG

51  YDNQPDFINA VCTVSTTLDG IALLAELNRI EADFGRERSF RNAPRTLDLD

101  IIDFDGISSD DPRLTLPHPR AHERSFVIRP LAEILPDFIL GKYGKVVELS

151  KRLGNQGIRL LPDR*
```

The following partial DNA sequence was identified in *N. meningitidis* <SEQ ID 51>:

```
m008.seq
     1  ATGAACAACA GACATTTTGC CGTCATCGCC CTGGGCAGTA ATCTTGAAAA

51  CCCTGCTCAA CAGGTACGCG CCGCATTGGA CACGCTGTCG TCCCATCCTG

101  ACATCCGTCT TAAACAGGCT TCCTCACTGT ATATGACCGC GCCCGTCGGT

151  TACGACAATC AGCCCGATTT TGTCAATGCC GTCTGCACCG TTTCCACCAC

201  TCTGGACGGC ATTGCCyTGC TTGCCGAACT CAACCGTATC GAGGCTGATT

251  TCGGACGCGA ACGCAGCTTC CGCAACGCGC CGCGCACATT GkATTTGGAC

301  ATTATCGACT TTGACGGCAT CTCCAGCGAC GACACsCGAC TcACCtTGCC

351  GCATCCGCGC GCGCACGAAC GCAGTTTCGT CATCCGCCCT TTGGCAGAAA

401  TCCTCCCTGA TTTTGTTTTA GGAAAACACG GAAAGGTTGC CGAATTGTCA

451  AAACGGyTGG GCAATCAAGG TATCCGTCTT TTACCGGACA GGTAATT
```

This corresponds to the amino acid sequence <SEQ ID 52; ORF 008>:

```
m008.pep
     1  MNNRHFAVIA LGSNLENPAQ QVRAALDTLS SHPDIRLKQA SSLYMTAPVG

51  YDNQPDFVNA VCTVSTTLDG IALLAELNRI EADFGRERSF RNAPRTLXLD

101  IIDFDGISSD DTRLTLPHPR AHERSFVIRP LAEILPDFVL GKHGKVAELS

151  KRLGNQGIRL LPDR*
```

The following partial DNA sequence was identified in *N. meningitidis* <SEQ ID 53>:

```
a008.seq
     1  ATGAACAACA GACATTTTGC CGTCATCGCC CTGGGCAGTA ATCTTGAAAA

51  CCCTGCCCAA CAGGTACGCG CCGCATTGGA CACGCTGTCG TCCCATCCTG

101  ACATCCGTCT TAAACAGGCT TCCTCACTGT ATATGACCGC GCCCGTCGGT

151  TACGACAATC AGCCCGATTT CGTCAATGCC GTCTGCACCG TTTCCACCAC

201  CTTGGACGGC ATTGCCCTGC TTGCCGAACT CAACCGTATC GAAGCCGATT
```

```
-continued
251    TCGGACGCGA ACGCAGCTTC CGCAACGCGC CGCGCACATT GGATTTGGAC

301    ATTATCGACT TTGACGGCAT CTCCAGCGAC GACCCCCGAC TCACCCTGCC

351    GCATCCGCGC GCGCACGAAC GCAGTTTCGT CATACGCCCT TTGGCAGAAA

401    TCCTCCCTGA TTTTATTTTG GGAAAACACG GAAAGGTTGC CGAATTGTCA

451    AAACGGCTGG GCAATCAAGG CATCCGTCTT TTACCGGATA AGTAA
```

This corresponds to the amino acid sequence <SEQ ID 54; ORF 008.a>:

```
a008.pep
  1    MNNRHFAVIA LGSNLENPAQ QVRAALDTLS SHPDIRLKQA SSLYMTAPVG

51    YDNQPDFVNA VCTVSTTLDG IALLAELNRI EADFGRERSF RNAPRTLDLD

101    IIDFDGISSD DPRLTLPHPR AHERSFVIRP LAEILPDFIL GKHGKVAELS

151    KRLGNQGIRL LPDK*
``` m008/a008 97.6% identity over a 164 aa overlap

```
                 10         20         30         40         50         60
   m008.pep  MNNRHFAVIALGSNLENPAQQVRAALDTLSSHPDIRLKQASSLYMTAPVGYDNQPDFVNA
             ||||||||||||||||||||||||||||||||||||||||||||||||||||||||||||
       a008  MNNRHFAVIALGSNLENPAQQVRAALDTLSSHPDIRLKQASSLYMTAPVGYDNQPDFVNA
                 10         20         30         40         50         60

70         80         90        100        110        120
   m008.pep  VCTVSTTLDGIALLAELNRIEADFGRERSFRNAPRTLXLDIIDFDGISSDDTRLTLPHPR
             ||||||||||||||||||||||||||||||||||||||| ||||||||||||| ||||||||
       a008  VCTVSTTLDGIALLAELNRIEADFGRERSFRNAPRTLDLDIIDFDGISSDDPRLTLPHPR
                 70         80         90        100        110        120

130        140        150        160
   m008.pep  AHERSFVIRPLAEILPDFVLGKHGKVAELSKRLGNQGIRLLPDRX
             |||||||||||||||||||:|||||||||||||||||||||||:|
       a008  AHERSFVIRPLAEILPDFILGKHGKVAELSKRLGNQGIRLLPDKX
                130        140        150        160
```

Computer analysis of this amino acid sequence gave the following results:
Homology with a Predicted ORF from N. gonorrhoeae
ORF 008 shows 92.7% identity over a 164 aa overlap with a predicted ORF (ORF008.ng) from N. gonorrhoeae:

```
  m008/g008
                 10         20         30         40         50         60
   m008.pep  MNNRHFAVIALGSNLENPAQQVRAALDTLSSHPDIRLKQASSLYMTAPVGYDNQPDFVNA
             ||||||||||||||:||||:|||:||||||||||||||:|||||||||||||||||||:||
       g008  MNNRHFAVIALGSNLDNPAQQIRGALDALSSHPDIRLEQVSSLYMTAPVGYDNQPDFINA
                 10         20         30         40         50         60

70         80         90        100        110        120
   m008.pep  VCTVSTTLDGIALLAELNRIEADFGRERSFRNAPRTLXLDIIDFDGISSDDTRLTLPHPR
             ||||||||||||||||||||||||||||||||||||||| ||||||||||||| ||||||||
       g008  VCTVSTTLDGIALLAELNRIEADFGRERSFRNAPRTLDLDIIDFDGISSDDPRLTLPHPR
                 70         80         90        100        110        120

130        140        150        160
   m008.pep  AHERSFVIRPLAEILPDFVLGKHGKVAELSKRLGNQGIRLLPDRX
             |||||||||||||||||||:|||:|||:||||||||||||||||
       g008  AHERSFVIRPLAEILPDFILGKYGKVVELSKRLGNQGIRLLPDRX
                130        140        150        160
```

The following partial DNA sequence was identified in N. gonorrhoeae <SEQ ID 55>:

```
g009.seq
    1   ATGCCCCGCG CTGCCGTAGC CTTTGAGCGT CATCATCACA AAAGCAAAGC

51   CGAACAAAAT ACCCATCGCC GCGCCGACGC AGAGATAGCC GAAGGCTTCG

101   CGGTTGGAAA TCAGCACACG CAGGCGCGAA ACCAGTCCGT AATGGCGGTA

151   CAGCTGCCGC TCGTCGCCTT TTCGGATAAA GTGGTTGTcg cGTTCCAAGC

201   TGTTGTTCAG GCGGAAATAC AGGTTTTCGC TGATGGCGGC AAAACGTGGC

251   AaaaGCCATA A
```

This corresponds to the amino acid sequence <SEQ ID 56; ORF 009.ng>:

```
g009.pep
    1   MPRAAVAFER HHHKSKAEQN THRRADAEIA EGFAVGNQHT QARNQSVMAV

51   QLPLVAFSDK VVVAFQAVVQ AEIQVFADGG KTWQKP*
```

The following partial DNA sequence was identified in *N. meningitidis* <SEQ ID 57>:

```
m009.seq
    1   ATGCCCCGCG CTGCTGTAGC CTTTGAGCGT CATCATCACA AAAGCAAAGC

51   CGAACAAAAT ACCCATCGCC GTGCCGACGC AGAGATAGCC GAAGGCTTCG

101   CGGTTGGAAA TCAGCACACG CAGGCGCGCA AGCAGTCCGT AATGGCGGTA

151   CAGCTGCCGC CGGTCGCCTT TTCGGATAAA GTGGTTGTCG CGTTCCAAGC

201   TGTTGTTCAG GCGGAAATAC AGGTTTTCGC TGATGGCGGC AAAACGTGGC

251   AAAAGCCATA A
```

This corresponds to the amino acid sequence <SEQ ID 58; ORF 009>:

```
m009.pep
    1   MPRAAVAFER HHHKSKAEQN THRRADAEIA EGFAVGNQHT QARKQSVMAV

51   QLPPVAFSDK VVVAFQAVVQ AEIQVFADGG KTWQKP*
```

Computer analysis of this amino acid sequence gave the following results:
Homology with a Predicted ORF from *N. gonorrhoeae*
ORF 009 shows 97.7% identity over a 86 aa overlap with a predicted ORF (ORF 009.ng) from *N. gonorrhoeae*:

```
m009/g009
                  10         20         30         40         50         60
    m009.pep  MPRAAVAFERHHHKSKAEQNTHRRADAEIAEGFAVGNQHTQARKQSVMAVQLPPVAFSDK
              ||||||||||||||||||||||||||||||||||||||||||:|||||||| ||||||
    g009      MPRAAVAFERHHHKSKAEQNTHRRADAEIAEGFAVGNQHTQARNQSVMAVQLPLVAFSDK
                  10         20         30         40         50         60

70         80
    m009.pep  VVVAFQAVVQAEIQVFADGGKTWQKPX
              |||||||||||||||||||||||||||
    g009      VVVAFQAVVQAEIQVFADGGKTWQKPX
                  70         80
```

The following partial DNA sequence was identified in *N. meningitidis* <SEQ ID 59>:

```
a009.seq
    1   ATGCCCCGCG CTGCTGTAGC CTTTGAGCGT CATCATCACA AAAGCAAAGC

51   CGAACAAAAT ACCCATCGCC GTGCCGACGC AGAGATAGCC GAAGGCTTCG

101   CGGTTGGAAA TCAGCACACG CAGGCGCGCA AGCAGTCCGT AATGGCGGTC

151   CAGCTGCCGC TCGTCGCCTT TTCGGATAAA GTGGTTGTCG CGTTCCAAGC

201   TGTTCTTCAG GCGGAAATAC AGGTTTTCGC TGATGGCGGC AAAACGTGGC

251   AAAAGCCATA A
```

This corresponds to the amino acid sequence <SEQ ID 60; ORF 009.a>:

```
a009.pep
    1   MPRAAVAFER HHHKSKAEQN THRRADAEIA EGFAVGNQHT QARKQSVMAV

51   QLPLVAFSDK VVVAFQAVLQ AEIQVFADGG KTWQKP*
                                                  20
``` m005/a005 97.7% identity over a 86 aa overlap

```
                    10         20         30         40         50         60
    m009.pep   MPRAAVAFERHHHKSKAEQNTHRRADAEIAEGFAVGNQHTQARKQSVMAVQLPPVAFSDK
               ||||||||||||||||||||||||||||||||||||||||||||||||||| ||||||
    a009       MPRAAVAFERHHHKSKAEQNTHRRADAEIAEGFAVGNQHTQARKQSVMAVQLPLVAFSDK
                    10         20         30         40         50         60
                    70         80
    m009.pep   VVVAFQAVVQAEIQVFADGGKTWQKPX
               ||||||||:||||||||||||||||||
    a009       VVVAFQAVLQAEIQVFADGGKTWQKPX
                    70         80
```

The following partial DNA sequence was identified in *N. gonorrhoeae* <SEQ ID 61>:

```
g010.seq
    1   ATGGGTTTTC CTGTTCGCAA GTTTGATGCC GTGATTGTCG GCGGTGGCGG

51   TGCAGGTTTA CGTGCAGCCC TCCAATTATC CAAATCCGGT TTGAATTGTG

101   CCGTTTTGTC TAAAGTGTTC CCGACCCGCT CGCATACCGT AGCGGCGCAG

151   GGCGGTATTT CCGCCTCTCT GGGTAATGTG CAGGAGGACC GTTGGGACTG

201   GCACATGTAC GATACCGTGA AAGGTTCCGA CTGGCTGGGC GACCAAGATG

251   CGATTGAGTT TATGTGTCGC GCTGCGCCTG AAGCGGTGAT TGAGTTGGAA

301   CACATGGGTA TGCCTTTTGA CCGCGTTGAA AGCGGCAAAA TTTATCAGCG

351   TCCTTTCGGC GGACATACTG CCGAACATGG TAAACGTGCG GTAGAACGTG

401   CATGTGCGGT TGCCGACCGT ACCGGTCATG CGATGTTGCA TACTTTGTAC

451   CAACAAAACG TCCGTGCCAA TACACAATTC TTTGTGGAAT GGACGGCGCA

501   AGATTTGATT CGTGATGAAA ACGGCGATGT CGTCGGCGTA ACCGCCATGG

551   AAATGGAAAC GGGCGAAGTT TATATTTTCC ACGCCAAGGC CGTGATGTTT

601   GCTACCGGTG GCGGCGGTCG TATTTATGCT TCTTCTACCA ATGCTTATAT

651   GAATACCGGT GACGGTTTGG GCATTTGCGC CCGTGCGGGC ATTCCGTTGG

701   AAGATATGGA ATTCTGGCAA TTCCACCCGA CCGGCGTGGC GGGTGCGGGC

751   GTGTTGATTA CCGAAGGCGT ACGCGGCGAG GGCGGTATTC TGTTGAacgc
```

```
 801   cgacggcgaA cgcTTTATGG AAcgctatgc GCcgACCGta aAagaCTTGG

851   CTTCTCGCga cgtGGTTTCA CgcgcGatgG CGatggaAAt ctatgaaggt 901   cgcggctgTG GtaaAAAcaA agaCCacgtC TTACTGAAAA TCGACcAtAt 951   cggtGCAGAA AAAATTATGG AAAAACTGCC GGGCATCCGC GAGATTTCCA 1001   TTCagtttgc cGGTATCGAT CCGATTAAAG ACCCGATTcc ggttgTGCCG 1051   ACTACCCACT ATATGATGGG CGGCATTCcg aCCAATTATC ACGGTGAAGT

1101   TGTTGTTCCG CAAGGCGACG AGTACGAAGT ACCTGTAAAA GGCCTGTATG

1151   CCGCAGGTGA GTGCGCCTGT GCTTCCGTAC ACGGTGCGAA CCGTTTGGGT

1201   ACGAACTCCC TGCTGGACTT GGTGGTGTTC cgcccaaccc cccggtga
```

This corresponds to the amino acid sequence <SEQ ID 62; ORF 010.ng>:

```
g010.pep
   1   MGFPVRKFDA VIVGGGGAGL RAALQLSKSG LNCAVLSKVF PTRSHTVAAQ

51   GGISASLGNV QEDRWDWHMY DTVKGSDWLG DQDAIEFMCR AAPEAVIELE

101   HMGMPFDRVE SGKIYQRPFG GHTAEHGKRA VERACAVADR TGHAMLHTLY

151   QQNVRANTQF FVEWTAQDLI RDENGDVVGV TAMEMETGEV YIFHAKAVMF

201   ATGGGGRIYA SSTNAYMNTG DGLGICARAG IPLEDMEFWQ FHPTGVAGAG

251   VLITEGVRGE GGILLNADGE RFMERYAPTV KDLASRDVVS RAMAMEIYEG

301   RGCGKNKDHV LLKIDHIGAE KIMEKLPGIR EISIQFAGID PIKDPIPVVP

351   TTHYMMGGIP TNYHGEVVVP QGDEYEVPVK GLYAAGECAC ASVHGANRLG

401   TNSLLDLVVF RPTPR*
```

The following partial DNA sequence was identified in *N. meningitidis* <SEQ ID 63>:

```
m010.seq (PARTIAL)
   1   ..nTCCAATTAT CCAAATCCGG TCTGAATTGT GCCGTTTTGT CTAAAGTGTT 51   CCCGACCCGT TCGCATACCG TAGCGGCGCA GGGCGGTATT TCCGCCTCTn

101   TGGGTAATGT GCAGGAAGAC CGTTGGGACT GGCACATGTA CGATACCGTG

151   AAAGGTTCCG ACTGGTTGGG CGACCAAGAT GCGATTGAGT TTATGTGCCG

201   CGCCGCGCCT GAAGCCGTAA TTGAGTTGGA ACACATGGGT ATGCCTTTTG

251   ACCGTGTGGA AAGCGGTAAA ATTTATCAGC GTCCTTTCGG CGGCCATACT

301   GCCGAACACG GTAAACGCGC GGTAGAACGC GyCTGTGCGG TTGCCGACCG

351   TACAGGTCAT GCGATGCTGC ATACTTTGTA CCAACAAAAC GTCCGTGCCA

401   ATACGCAATT CTTTGTGGAA TGGACGGCAC AAGATTTGAT TCGTGATGAA

451   AACGGCGATG TCGTCGGCGT AACCGCCATG GAAATGGAAA CCGGCGAAgT

501   TTATATTTTC CACGCTAAAG CTGTGATGTT TGCTACCGGC GGCGGCGGTC

551   GTATTTATGC GTCTTCTACC AATGCCTATA TGAATACCGG CGATGGTTTG

601   GGTATTTGTG CGCGTGCAGG TATCCCGTTG GAAGACATGG AATTCTGGCA

651   ATTCCAGCCG ACCGGCGTGG CGGGTGCGGG CGTGTTGATT ACCGAA....
```

This corresponds to the amino acid sequence <SEQ ID 64; ORF 010>:

```
m010.pep (PARTIAL)
     1   ..XQLSKSGLNC AVLSKVFPTR SHTVAAQGGI SASXGNVQED RWDWHMYDTV

51     KGSDWLGDQD AIEFMCRAAP EAVIELEHMG MPFDRVESGK IYQRPFGGHT

101     AEHGKRAVER XCAVADRTGH AMLHTLYQQN VRANTQFFVE WTAQDLIRDE

151     NGDVVGVTAM EMETGEVYIF HAKAVMFATG GGGRIYASST NAYMNTGDGL

201     GICARAGIPL EDMEFWQFQP TGVAGAGVLI TE...
```

The following partial DNA sequence was identified in *N. meningitidis* <SEQ ID 65>:

```
a010.seq
     1  ATGGGCTTTC CTGTTCGCAA GTTTGATGCC GTGATTGTCG GCGGTGGTGG

51  TGCAGGTTTA CGCGCANCCC TCCAATTATC CAAATCCGGT CTGAATTGTG

101  CCGTTTTGTC TAAAGTGTTC CCGACCCGTT CGCATACCGT AGCGGCGCAG

151  GGCGGTATTT CCGCCTCTCT GGGTAATGTG CAGGAAGACC GTTGGGACTG

201  GCACATGTAC GATACCGTGA AAGGTTCCGA CTGGTTGGGC GACCAAGATG

251  CGATTGAGTT TATGTGCCGC GCCGCGCCTG AAGCCGTAAT TGAGTTGGAA

301  CACATGGGTA TGCCTTTTGA CCGTGTGGAA AGCGGTAAAA TTTATCAGCG

351  TCCTTTCGGC GGCCATACTG CCGAACACGG TAAACGCGCG GTAGAACGCG

401  CCTGTGCNGT TGCCGACCGT ACAGGTCATG CGATGCTGCA TACTTTGTAC

451  CAACAAAATG TCCGTGCCAA TACGCAATTC TTTGTGGAAT GGACGGCACA

501  AGATTTGATT CGTGATGAAA ACGGCGATGT CGTCGGCGTA ACCGCCATGG

551  AAATGGAAAC CGGCGAAGTT TATATTTTCC ACGCTAAAGC TGTGATGTTT

601  GCTACCGGCG GCGGCGGCCG TATTTATGCG TCTTCTACCA ATGCCTATAT

651  GAATACCGGC GATGGTTTGG GTATTTGTGC GCGTGCAGGT ATCCCGTTGG

701  AAGACATGGA ATTCTGGCAA TTCCACCCGA CCGGCGTGGC AGGTGCGGGC

751  GTGTTGATTA CCGAAGGCGT ACGCGGCGAG GGCGGTATTC TGTTGAATGC

801  CGACGGCGAA CGCTTTATGG AACGCTATGC GCCGACCGTA AAAGACTTGG

851  CTTCTCGCGA CGTTGTTTCC CGCGCGATGG CGATGGAAAT CTACGAAGGT

901  CGCGGCTGCG GTAAAAACAA AGACCATGTC TTACTGAAAA TCGACCATAT

951  CGGCGCAGAA AAAATTATGG AAAAACTGCC GGGCATCCGC GAGATTTCCA

1001  TTCAGTTCGC CGGTATCGAT CCGATTAAAG ACCCGATTCC CGTTGTGCCG

1051  ACTACCCACT ATATGATGGG CGGTATTCCG ACCAACTACC ATGGCGAAGT

1101  TGTCGTTCCT CAAGGCGACG AATACGAAGT GCCTGTAAAA GGTCTGTATG

1151  CGGCAGGTGA GTGCGCCTGT GCTTCCGTAC ACGGTGCGAA CCGCTTGGGT

1201  ACGAACTCCC TGCTGGACTT AGTGGTATTC GGTAAAGCTG CCGGCGACAG

1251  CATGATTAAA TTCATCAAAG AGCAAAGCGA CTGGAAACCT TTGCCTGCTA

1301  ATGCCGGCGA ACTGACCCGC CAACGTATCG AGCGTTTGGA CAATCAAACT

1351  GATGGTGAAA ACGTTGATGC ATTGCGCCGC GAACTGCAAC GCTCCGTACA

1401  ATTGCACGCC GGCGTGTTCC GTACTGATGA GATTCTGAGC AAAGGCGTTC

1451  GAGAAGTCAT GGCGATTGCC GAGCGTGTGA AACGTACCGA AATCAAAGAC

1501  AAGAGCAAAG TGTGGAATAC CGCGCGTATC GAGGCTTTGG AATTGGATAA

1551  CCTAATTGAA GTGGCGAAAG CGACTTTGGT GTCTGCCGAA GCACGTAAAG
```

-continued

```
1601  AATCACGCGG TGCGCACGCT TCAGACGACC ATCCTGAGCG CGATGATGAA

1651  AACTGGATGA ACATACGCT GTACCATTCA GATGCCAATA CCTTGTCCTA

1701  CAAACCGGTG CACACCAAGC CTTTGAGCGT GGAATACATC AAACCGGCCA

1751  AGCGCGTTTA TTGA
```

This corresponds to the amino acid sequence <SEQ ID 66; ORF 010.a>:

```
a010.pep
   1  MGFPVRKFDA VIVGGGGAGL RAXLQLSKSG LNCAVLSKVF PTRSHTVAAQ

51  GGISASLGNV QEDRWDWHMY DTVKGSDWLG DQDAIEFMCR AAPEAVIELE

101  HMGMPFDRVE SGKIYQRPFG GHTAEHGKRA VERACAVADR TGHAMLHTLY

151  QQNVRANTQF FVEWTAQDLI RDENGDVVGV TAMEMETGEV YIFHAKAVMF

201  ATGGGGRIYA SSTNAYMNTG DGLGICARAG IPLEDMEFWQ FHPTGVAGAG

251  VLITEGVRGE GGILLNADGE RFMERYAPTV KDLASRDVVS RAMAMEIYEG

301  RGCGKNKDHV LLKIDHIGAE KIMEKLPGIR EISIQFAGID PIKDPIPVVP

351  TTHYMMGGIP TNYHGEVVVP QGDEYEVPVK GLYAAGECAC ASVHGANRLG

401  TNSLLDLVVF GKAAGDSMIK FIKEQSDWKP LPANAGELTR QRIERLDNQT

451  DGENVDALRR ELQRSVQLHA GVFRTDEILS KGVREVMAIA ERVKRTEIKD

501  KSKVWNTARI EALELDNLIE VAKATLVSAE ARKESRGAHA SDDHPERDDE

551  NWMKHTLYHS DANTLSYKPV HTKPLSVEYI KPAKRVY*
``` m010/a010 98.7% identity over a 231 aa overlap

```
                       10         20         30
     m010.pep           XQLSKSGLNCAVLSKVFPTRSHTVAAQGGISASXGNV
                       |||||||||||||||||||||||||||||||| |||
     a010     MGFPVRKFDAVIVGGGGAGLRAXLQLSKSGLNCAVLSKVFPTRSHTVAAQGGISASLGNV
                     10        20        30        40        50        60
                   40         50         60         70         80         90
     m010.pep  QEDRWDWHMYDTVKGSDWLGDQDAIEFMCRAAPEAVIELEHMGMPFDRVESGKIYQRPFG
               ||||||||||||||||||||||||||||||||||||||||||||||||||||||||||||
     a010      QEDRWDWHMYDTVKGSDWLGDQDAIEFMCRAAPEAVIELEHMGMPFDRVESGKIYQRPFG
                       70        80        90       100       110       120
                  100        110        120        130        140        150
     m010.pep  GHTAEHGKRAVERXCAVADRTGHAMLHTLYQQNVRANTQFFVEWTAQDLIRDENGDVVGV
               |||||||||||| |||||||||||||||||||||||||||||||||||||||||||||||
     a010      GHTAEHGKRAVERACAVADRTGHAMLHTLYQQNVRANTQFFVEWTAQDLIRDENGDVVGV
                      130       140       150       160       170       180
                  160        170        180        190        200        210
     m010.pep  TAMEMETGEVYIFHAKAVMFATGGGGRIYASSTNAYMNTGDGLGICARAGIPLEDMEFWQ
               ||||||||||||||||||||||||||||||||||||||||||||||||||||||||||||
     a010      TAMEMETGEVYIFHAKAVMFATGGGGRIYASSTNAYMNTGDGLGICARAGIPLEDMEFWQ
                      190       200       210       220       230       240

220        230
     m010.pep  FQPTGVAGAGVLITE
               |:|||||||||||||
     a010      FHPTGVAGAGVLITEGVRGEGGILLNADGERFMERYAPTVKDLASRDVVSRAMAMEIYEG
                      250       260       270       280       290       300
```

Computer analysis of this amino acid sequence gave the following results:
Homology with a Predicted ORF from *N. gonorrhoeae*
ORF 010 shows 98.7% identity over a 231 aa overlap with a predicted ORF (ORF 010.ng) from *N. gonorrhoeae*:

```
m010.pep/g010.pep
                                      10        20        30
m010.pep                      XQLSKSGLNCAVLSKVFPTRSHTVAAQGGISASXGNV
                              |||||||||||||||||||||||||||||||| |||
g010     MGFPVRKFDAVIVGGGGAGLRAALQLSKSGLNCAVLSKVFPTRSHTVAAQGGISASLGNV
                 10        20        30        40        50        60
               40        50        60        70        80        90
m010.pep QEDRWDWHMYDTVKGSDWLGDQDAIEFMCRAAPEAVIELEHMGMPFDRVESGKIYQRPFG
         ||||||||||||||||||||||||||||||||||||||||||||||||||||||||||||
g010     QEDRWDWHMYDTVKGSDWLGDQDAIEFMCRAAPEAVIELEHMGMPFDRVESGKIYQRPFG
               70        80        90       100       110       120
              100       110       120       130       140       150
m010.pep GHTAEHGKRAVERXCAVADRTGHAMLHTLYQQNVRANTQFFVEWTAQDLIRDENGDVVGV
         ||||||||||||| ||||||||||||||||||||||||||||||||||||||||||||||
g010     GHTAEHGKRAVERACAVADRTGHAMLHTLYQQNVRANTQFFVEWTAQDLIRDENGDVVGV
              130       140       150       160       170       180
              160       170       180       190       200       210
m010.pep TAMEMETGEVYIFHAKAVMFATGGGGRIYASSTNAYMNTGDGLGICARAGIPLEDMEFWQ
         ||||||||||||||||||||||||||||||||||||||||||||||||||||||||||||
g010     TAMEMETGEVYIFHAKAVMFATGGGGRIYASSTNAYMNTGDGLGICARAGIPLEDMEFWQ
              190       200       210       220       230       240
              220       230
m010.pep FQPTGVAGAGVLITE
         |:|||||||||||||
g010     FHPTGVAGAGVLITEGVRGEGGILLNADGERFMERYAPTVKDLASRDVVSRAMAMEIYEG
              250       260       270       280       290       300
```

The following partial DNA sequence was identified in *N. gonorrhoeae* <SEQ ID 67>:

```
g010-1.seq..
    1    ATGGGTTTTC CTGTTCGCAA GTTTGATGCC GTGATTGTCG GCGGTGGCGG

51    TGCAGGTTTA CGTGCAGCCC TCCAATTATC CAAATCCGGT TTGAATTGTG

101    CCGTTTTGTC TAAAGTGTTC CCGACCCGCT CGCATACCGT AGCGGCGCAG

151    GGCGGTATTT CCGCCTCTCT GGGTAATGTG CAGGAGGACC GTTGGGACTG

201    GCACATGTAC GATACCGTGA AAGGTTCCGA CTGGCTGGGC GACCAAGATG

251    CGATTGAGTT TATGTGTCGC GCTGCGCCTG AAGCGGTGAT TGAGTTGGAA

301    CACATGGGTA TGCCTTTTGA CCGCGTTGAA AGCGGCAAAA TTTATCAGCG

351    TCCTTTCGGC GGACATACTG CCGAACATGG TAAACGTGCG GTAGAACGTG

401    CATGTGCGGT TGCCGACCGT ACCGGTCATG CGATGTTGCA TACTTTGTAC

451    CAACAAAACG TCCGTGCCAA TACACAATTC TTTGTGGAAT GGACGGCGCA

501    AGATTTGATT CGTGATGAAA ACGGCGATGT CGTCGGCGTA ACCGCCATGG

551    AAATGGAAAC GGGCGAAGTT TATATTTTCC ACGCCAAGGC CGTGATGTTT

601    GCTACCGGTG GCGGCGGTCG TATTTATGCT TCTTCTACCA ATGCTTATAT

651    GAATACCGGT GACGGTTTGG GCATTTGCGC CCGTGCGGGC ATTCCGTTGG

701    AAGATATGGA ATTCTGGCAA TTCCACCCGA CCGGCGTGGC GGGTGCGGGC

751    GTGTTGATTA CCGAAGGCGT ACGCGGCGAG GGCGGTATTC TGTTGAACGC

801    CGACGGCGAA CGCTTTATGG AACGCTATGC GCCGACCGTA AAAGACTTGG

851    CTTCTCGCGA CGTGGTTTCA CGCGCGATGG CGATGGAAAT CTATGAAGGT

901    CGCGGCTGTG GTAAAAACAA AGACCACGTC TTACTGAAAA TCGACCATAT

951    CGGTGCAGAA AAAATTATGG AAAAACTGCC GGGCATCCGC GAGATTTCCA

1001    TTCAGTTTGC CGGTATCGAT CCGATTAAAG ACCCGATTCC GGTTGTGCCG

1051    ACTACCCACT ATATGATGGG CGGCATTCCG ACCAATTATC ACGGTGAAGT
```

```
1101   TGTTGTTCCG CAAGGCGACG AGTACGAAGT ACCTGTAAAA GGCCTGTATG

1151   CCGCAGGTGA GTGCGCCTGT GCTTCCGTAC ACGGTGCGAA CCGTTTGGGT

1201   ACGAACTCCC TGCTGGACTT GGTGGTGTTC cgcccaaccc cccggtga
```

This corresponds to the amino acid sequence <SEQ ID 68; ORF 010-1.ng>:

```
g010-1.pep
     1     MGFPVRKFDA VIVGGGGAGL RAALQLSKSG LNCAVLSKVF PTRSHTVAAQ

51     GGISASLGNV QEDRWDWHMY DTVKGSDWLG DQDAIEFMCR AAPEAVIELE

101     HMGMPFDRVE SGKIYQRPFG GHTAEHGKRA VERACAVADR TGHAMLHTLY

151     QQNVRANTQF FVEWTAQDLI RDENGDVVGV TAMEMETGEV YIFHAKAVMF

201     ATGGGGRIYA SSTNAYMNTG DGLGICARAG IPLEDMEFWQ FHPTGVAGAG

251     VLITEGVRGE GGILLNADGE RFMERYAPTV KDLASRDVVS RAMAMEIYEG

301     RGCGKNKDHV LLKIDHIGAE KIMEKLPGIR EISIQFAGID PIKDPIPVVP

351     TTHYMMGGIP TNYHGEVVVP QGDEYEVPVK GLYAAGECAC ASVHGANRLG

401     TNSLLDLVVF RPTPR*
``` g010-1 (SEQ ID 68)/P10444 (SEQ ID 4156)

```
sp|P10444|DHSA_ECOLI SUCCINATE DEHYDROGENASE FLAVOPROTEIN SUBUNIT
gnl|PID|d1015210 (D90711) Succinate dehydrogenase, flavoprotein
[Escherichia coli] gi|1786942
(AE000175) succinate dehydrogenase flavoprotein subunit [Escherichia
coli] Length = 588
Score = 1073 (495.6 bits), Expect = 6.7e-169, Sum P(2) = 6.7e-169
Identities = 191/303 (63%), Positives = 238/303 (78%)
Query:    1MGFPVRKFDAVIVXXXXXXXXXXXXXXXSKSGLNCAVLSKVFPTRSHTVAAQGGISASLGNV    60
           M  PVR+FDAV++              S+SG  CA+LSKVFPTRSHTV+AQGGI+ +LGN
Sbjct:    1MKLPVREFDAVVIGAGGAGMRAALQISQSGQTCALLSKVFPTRSHTVSAQGGITVALGNT    60

Query:   61QEDRWDWHMYDTVKGSDWLGDQDAIEFMCRAAPEAVIELEHMGMPFDRVESGKIYQRPFG   120
            ED W+WHMYDTVKGSD++GDQDAIE+MC+  PEA++ELEHMG PF R++ G+IYQRPFG
Sbjct:   61HEDNWEWHMYDTVKGSDYIGDQDAIEYMCKTGPEAILELEHMGLPFSRLDDGRIYQRPFG   120

Query:  121GHTAEHGKRAVERACAVADRTGHAMLHTLYQQNVRANTQFFVEWTAQDLIRDENGDVVGV   180
               G + G    R A ADRTGHA+LHTLYQQN++ +T  F EW A DL+++++G VVG
Sbjct:  121GQSKNFGGEQAARTAAAADRTGHALLHTLYQQNLKNHTTIFSEWYALDLVKNQDGAVVGC   180

Query:  181TAMEMETGEVYIFHAKAVMFATGGGGRIYASSTNAYMNTGDGLGICARAGIPLEDMEFWQ   240
            TA+  +ETGEV  F A+A + ATGG GRIY S+TNA++NTGDG+G+  RAG+P++DME WQ
Sbjct:  181TALCIETGEVVYFKARATVLATGGAGRIYQSTTNAHINTGDGVGMAIRAGVPVQDMEMWQ   240

Query:  241FHPTGVAGAGVLITEGVRGEGGILLNADGERFMERYAPTVKDLASRDVVSRAMAMEIYEG   300
            FHPTG+AGAGVL+TEG RGEGG LLN  GERFMERYAP  KDLA RDVV+R++ +EI EG
Sbjct:  241FHPTGIAGAGVLVTEGCRGEGGYLLNKHGERFMERYAPNAKDLAGRDVVARSIMIEIREG   300

Query:  301RGC                                                          303
           RGC
Sbjct:  301RGC                                                          303

Score = 249 (115.0 bits), Expect = 6.7e-169, Sum P(2) = 6.7e-169
Identities = 53/102 (51%), Positives = 62/102 (60%)
Query:  309HVLLKIDHIGAEKIMEKLPGIREISIQFAGXXXXXXXXXXXXXTTHYMMGGIPTNYHGEVV   368
            H  LK+DH+G E +  +LPGI E+S  FA             T HYMMGGIPT  G+ +
Sbjct:  310HAKLKLDHLGKEVLESRLPGILELSRTFAHVDPVKEPIPVIPTCHYMMGGIPTKVTGQAL   369

Query:  369VPQGDEYEVPVKGLYAAGECACASVHGANRLGTNSLLDLVVF                   410
             +V V GL+A GE AC SVHGANRLG NSLLDLVVF
Sbjct:  370TVNEKGEDVVVPGLFAVGEIACVSVHGANRLGGNSLLDLVVF                   411
```

The following partial DNA sequence was identified in *N. meningitidis* <SEQ ID 69>:

```
m010-1.seq..
   1    ATGGGTTTTC CTGTTCGCAA GTTTGATGCC GTGATTGTCG GCGGTGGTGG
  51    TGCAGGTTTA CGCGCAGCCC TCCAATTATC AAATCCGGT  CTGAATTGTG
 101    CCGTTTTGTC TAAAGTGTTC CCGACCCGTT CGCATACCGT AGCGGCGCAg
 151    GGCGGTATTT CCGCCTCTCT GGGTAATGTG CAGGAAGACC GTTGGGACTG
 201    GCACATGTAC GATACCGTGA AAGGTTCCGA CTGGTTGGGC GACCAAGATG
 251    CGATTGAGTT TATGTGCCGC GCCGCGCCTG AAGCCGTAAT TGAGTTGGAA
 301    CACATGGGTA TGCCTTTTGA CCGTGTGGAA AGCGGTAAAA TTTATCAGCG
 351    TCCTTTCGGC GGCCATACTG CCGAACACGG TAAACGCGCG GTAGAACGCG
 401    CCTGTGCGGT TGCCGACCGT ACAGGTCATG CGATGCTGCA TACTTTGTAC
 451    CAACAAAACG TCCGTGCCAA TACGCAATTC TTTGTGGAAT GGACGGCACA
 501    AGATTTGATT CGTGATGAAA ACGGCGATGT CGTCGGCGTA ACCGCCATGG
 551    AAATGGAAAC CGGCGAAGTT TATATTTTCC ACGCTAAAGC TGTGATGTTT
 601    GCTACCGGCG GCGGCGGTCG TATTTATGCG TCTTCTACCA ATGCCTATAT
 651    GAATACCGGC GATGGTTTGG GTATTTGTGC GCGTGCAGGT ATCCCGTTGG
 701    AAGACATGGA ATTCTGGCAA TTCCACCCGA CCGGCGTGGC GGGTGCGGGC
 751    GTGTTGATTA CCGAAGGCGT ACGCGGCGAG GCGGTATTC  TGTTGAATGC
 801    CGACGGCGAA CGCTTTATGG AACGCTATGC GCCGACCGTA AAAGACTTGG
 851    CTTCTCGCGA CGTTGTTTCC CGCGCGATGG CGATGGAAAT CTACGAAGGT
 901    CGCGGCTGCG GTAAAAACAA AGACCATGTC TTACTGAAAA TCGACCATAT
 951    CGGCGCAGAA AAAATTATGG AAAAACTGCC GGGCATCCGC GAGATTTCCA
1001    TTCAGTTCGC CGGTATCGAT CCGATTAAAG ACCCGATTCC CGTTGTGCCG
1051    ACTACCCACT ATATGATGGG CGGCATTCCG ACCAATTACC ACGGCGAAGT
1101    TGTCGTTCCG CAAGGTGAAG ATTACGAAGT GCCTGTAAAA GGTCTGTATG
1151    CGGCAGGTGA GTGCGCTTGT GCTTCCGTAC ACGGTGCGAA CCGCTTGGGT
1201    ACCAACTCCC TGTTGGACTT GGTGGTATTC GGTAAAGCTG CCGGCGACAG
1251    CATGATTAAA TTCATCAAAG AGCAAAGCGA CTGGAAACCT TTGCCTGCTA
1301    ATGCAGGTGA GTTGACCCGC CAACGTATCG AGCGTTTGGA CAACCAAACC
1351    GATGGTGAAA ACGTTGATGC ATTGCGTCGC GAACTGCAAC GCTCTGTACA
1401    ACTGCACGCC GGCGTGTTCC GTACTGATGA GATTCTGAGC AAAGGCGTTC
1451    GAGAAGTCAT GGCGATTGCC GAGCGTGTGA AACGTACCGA AATCAAAGAC
1501    AAGAGCAAAG TGTGGAATAC CGCGCGTATC GAGGCTTTGG AATTGGATAA
1551    CCTGATTGAA GTGGCGAAAG CGACTTTGGT GTCTGCCGAA GCACGTAAAG
1601    AATCACGCGG TGCGCACGCT TCAGACGACC ATCCTGAGCG CGATGATGAA
1651    AACTGGATGA ACATACGCT  GTACCATTCA GATATCAATA CCTTGTCCTA
1701    CAAACCGGTG CACACCAAGC CTTTGAGCGT GGAATACATC AAACCGGCCA
1751    AGCGCGTTTA TTGATGA
```

This corresponds to the amino acid sequence <SEQ ID 70; ORF 010-1>:

```
m010-1.pep..
    1    MGFPVRKFDA VIVGGGGAGL RAALQLSKSG LNCAVLSKVF PTRSHTVAAQ

51    GGISASLGNV QEDRWDWHMY DTVKGSDWLG DQDAIEFMCR AAPEAVIELE

101    HMGMPFDRVE SGKIYQRPFG GHTAEHGKRA VERACAVADR TGHAMLHTLY

151    QQNVRANTQF FVEWTAQDLI RDENGDVVGV TAMEMETGEV YIFHAKAVMF

201    ATGGGGRIYA SSTNAYMNTG DGLGICARAG IPLEDMEFWQ FHPTGVAGAG

251    VLITEGVRGE GGILLNADGE RFMERYAPTV KDLASRDVVS RAMAMEIYEG

301    RGCGKNKDHV LLKIDHIGAE KIMEKLPGIR EISIQFAGID PIKDPIPVVP

351    TTHYMMGGIP TNYHGEVVVP QGEDYEVPVK GLYAAGECAC ASVHGANRLG

401    TNSLLDLVVF GKAAGDSMIK FIKEQSDWKP LPANAGELTR QRIERLDNQT

451    DGENVDALRR ELQRSVQLHA GVFRTDEILS KGVREVMAIA ERVKRTEIKD

501    KSKVWNTARI EALELDNLIE VAKATLVSAE ARKESRGAHA SDDHPERDDE

551    NWMKHTLYHS DINTLSYKPV HTKPLSVEYI KPAKRVY*
``` m010-1/g010-1 99.5% identity in 410 aa overlap

```
                  10         20         30         40         50         60
m020-1.pep  MGFPVRKFDAVIVGGGGAGLRAALQLSKSGLNCAVLSKVFPTRSHTVAAQGGISASLGNV
            ||||||||||||||||||||||||||||||||||||||||||||||||||||||||||||
g020-1      MGFPVRKFDAVIVGGGGAGLRAALQLSKSGLNCAVLSKVFPTRSHTVAAQGGISASLGNV
                  10         20         30         40         50         60

70         80         90        100        110        120
m010-1.pep  QEDRWDWHMYDTVKGSDWLGDQDAIEFMCRAAPEAVIELEHMGMPFDRVESGKIYQRPFG
            ||||||||||||||||||||||||||||||||||||||||||||||||||||||||||||
g010-1      QEDRWDWHMYDTVKGSDWLGDQDAIEFMCRAAPEAVIELEHMGMPFDRVESGKIYQRPFG
                  70         80         90        100        110        120

130        140        150        160        170        180
m010-1.pep  GHTAEHGKRAVERACAVADRTGHAMLHTLYQQNVRANTQFFVEWTAQDLIRDENGDVVGV
            ||||||||||||||||||||||||||||||||||||||||||||||||||||||||||||
g010-1      GHTAEHGKRAVERACAVADRTGHAMLHTLYQQNVRANTQFFVEWTAQDLIRDENGDVVGV
                 130        140        150        160        170        180

190        200        210        220        230        240
m010-1.pep  TAMEMETGEVYIFHAKAVMFATGGGGRIYASSTNAYMNTGDGLGICARAGIPLEDMEFWQ
            ||||||||||||||||||||||||||||||||||||||||||||||||||||||||||||
g010-1      TAMEMETGEVYIFHAKAVMFATGGGGRIYASSTNAYMNTGDGLGICARAGIPLEDMEFWQ
                 190        200        210        220        230        240

250        260        270        280        290        300
m010-1.pep  FHPTGVAGAGVLITEGVRGEGGILLNADGERFMERYAPTVKDLASRDVVSRAMAMEIYEG
            ||||||||||||||||||||||||||||||||||||||||||||||||||||||||||||
g010-1      FHPTGVAGAGVLITEGVRGEGGILLNADGERFMERYAPTVKDLASRDVVSRAMAMEIYEG
                 250        260        270        280        290        300

310        320        330        340        350        360
m010-1.pep  RGCGKNKDHVLLKIDHIGAEKIMEKLPGIREISIQFAGIDPIKDPIPVVPTTHYMMGGIP
            ||||||||||||||||||||||||||||||||||||||||||||||||||||||||||||
g010-1      RGCGKNKDHVLLKIDHIGAEKIMEKLPGIREISIQFAGIDPIKDPIPVVPTTHYMMGGIP
                 310        320        330        340        350        360

370        380        390        400        410        420
m010-1.pep  TNYHGEVVVPQGEDYEVPVKGLYAAGECACASVHGANRLGTNSLLDLVVFGKAAGDSMIK
            |||||||||||| ::|||||||||||||||||||||||||||||||||||||||
g010-1      TNYHGEVVVPQGDEYEVPVKGLYAAGECACASVHGANRLGTNSLLDLVVFRPTPRX
                 370        380        390        400        410

430        440        450        460        470        480
m010-1.pep  FIKEQSDWKPLPANAGELTRQRIERLDNQTDGENVDALRRELQRSVQLHAGVFRTDEILS
```

The following partial DNA sequence was identified in *N. meningitidis* <SEQ ID 71>:

```
a010-1.seq..
    1    ATGGGCTTTC CTGTTCGCAA GTTTGATGCC GTGATTGTCG GCGGTGGTGG

51    TGCAGGTTTA CGCGCANCCC TCCAATTATC C

-continued

```
 151    GGCGGTATTT CCGCCTCTCT GGGTAATGTG CAGGAAGACC GTTGGGACTG
 201    GCACATGTAC GATACCGTGA AAGGTTCCGA CTGGTTGGGC GACCAAGATG
 251    CGATTGAGTT TATGTGCCGC GCCGCGCCTG AAGCCGTAAT TGAGTTGGAA
 301    CACATGGGTA TGCCTTTTGA CCGTGTGGAA AGCGGTAAAA TTTATCAGCG
 351    TCCTTTCGGC GGCCATACTG CCGAACACGG TAAACGCGCG GTAGAACGCG
 401    CCTGTGCNGT TGCCGACCGT ACAGGTCATG CGATGCTGCA TACTTTGTAC
 451    CAACAAAATG TCCGTGCCAA TACGCAATTC TTTGTGGAAT GGACGGCACA
 501    AGATTTGATT CGTGATGAAA ACGGCGATGT CGTCGGCGTA ACCGCCATGG
 551    AAATGGAAAC CGGCGAAGTT TATATTTTCC ACGCTAAAGC TGTGATGTTT
 601    GCTACCGGCG GCGGCGGCCG TATTTATGCG TCTTCTACCA ATGCCTATAT
 651    GAATACCGGC GATGGTTTGG GTATTTGTGC GCGTGCAGGT ATCCCGTTGG
 701    AAGACATGGA ATTCTGGCAA TTCCACCCGA CCGGCGTGGC AGGTGCGGGC
 751    GTGTTGATTA CCGAAGGCGT ACGCGGCGAG GGCGGTATTC TGTTGAATGC
 801    CGACGGCGAA CGCTTTATGG AACGCTATGC GCCGACCGTA AAAGACTTGG
 851    CTTCTCGCGA CGTTGTTTCC CGCGCGATGG CGATGGAAAT CTACGAAGGT
 901    CGCGGCTGCG GTAAAAACAA AGACCATGTC TTACTGAAAA TCGACCATAT
 951    CGGCGCAGAA AAAATTATGG AAAAACTGCC GGGCATCCGC GAGATTTCCA
1001    TTCAGTTCGC CGGTATCGAT CCGATTAAAG ACCCGATTCC CGTTGTGCCG
1051    ACTACCCACT ATATGATGGG CGGTATTCCG ACCAACTACC ATGGCGAAGT
1101    TGTCGTTCCT CAAGGCGACG AATACGAAGT GCCTGTAAAA GGTCTGTATG
1151    CGGCAGGTGA GTGCGCCTGT GCTTCCGTAC ACGGTGCGAA CCGCTTGGGT
1201    ACGAACTCCC TGCTGGACTT AGTGGTATTC GGTAAAGCTG CCGGCGACAG
1251    CATGATTAAA TTCATCAAAG AGCAAAGCGA CTGGAAACCT TTGCCTGCTA
1301    ATGCCGGCGA ACTGACCCGC CAACGTATCG AGCGTTTGGA CAATCAAACT
1351    GATGGTGAAA ACGTTGATGC ATTGCGCCGC GAACTGCAAC GCTCCGTACA
1401    ATTGCACGCC GGCGTGTTCC GTACTGATGA GATTCTGAGC AAAGGCGTTC
1451    GAGAAGTCAT GGCGATTGCC GAGCGTGTGA ACGTACCGA AATCAAAGAC
1501    AAGAGCAAAG TGTGGAATAC CGCGCGTATC GAGGCTTTGG AATTGGATAA
1551    CCTAATTGAA GTGGCGAAAG CGACTTTGGT GTCTGCCGAA GCACGTAAAG
1601    AATCACGCGG TGCGCACGCT TCAGACGACC ATCCTGAGCG CGATGATGAA
1651    AACTGGATGA ACATACGCT GTACCATTCA GATGCCAATA CCTTGTCCTA
1701    CAAACCGGTG CACACCAAGC CTTTGAGCGT GGAATACATC AAACCGGCCA
1751    AGCGCGTTTA TTGA
```
                                           55

This corresponds to the amino acid sequence <SEQ ID 72; ORF 010-1.a>:

```
a010-1.pep..
       1    MGFPVRKFDA VIVGGGGAGL RAXLQLSKSG LNCAVLSKVF PTRSHTVAAQ

51    GGISASLGNV QEDRWDWHMY DTVKGSDWLG DQDAIEFMCR AAPEAVIELE

101    HMGMPFDRVE SGKIYQRPFG GHTAEHGKRA VERACAVADR TGHAMLHTLY

151    QQNVRANTQF FVEWTAQDLI RDENGDVVGV TAMEMETGEV YIFHAKAVMF
```

-continued

```
201    ATGGGGRIYA SSTNAYMNTG DGLGICARAG IPLEDMEFWQ FHPTGVAGAG

251    VLITEGVRGE GGILLNADGE RFMERYAPTV KDLASRDVVS RAMAMEIYEG

301    RGCGKNKDHV LLKIDHIGAE KIMEKLPGIR EISIQFAGID PIKDPIPVVP

351    TTHYMMGGIP TNYHGEVVVP QGDEYEVPVK GLYAAGECAC ASVHGANRLG

401    TNSLLDLVVF GKAAGDSMIK FIKEQSDWKP LPANAGELTR QRIERLDNQT

451    DGENVDALRR ELQRSVQLHA GVFRTDEILS KGVREVMAIA ERVKRTEIKD

501    KSKVWNTARI EALELDNLIE VAKATLVSAE ARKESRGAHA SDDHPERDDE

551    NWMKHTLYHS DANTLSYKPV HTKPLSVEYI KPAKRVY*
``` m010-1/a010-1 99.3% identity in 587 aa overlap

```
                  10         20         30         40         50         60
a010-1.pep  MGFPVRKFDAVIVGGGGAGLRAXLQLSKSGLNCAVLSKVFPTRSHTVAAQGGISASLGNV
            |||||||||||||||||||||| |||||||||||||||||||||||||||||||||||||
a010-1      MGFPVRKFDAVIVGGGGAGLRAALQLSKSGLNCAVLSKVFPTRSHTVAAQGGISASLGNV
                  10         20         30         40         50         60

70         80         90        100        110        120
a010-1.pep  QEDRWDWHMYDTVKGSDWLGDQDAIEFMCRAAPEAVIELEHMGMPFDRVESGKIYQRPFG
            ||||||||||||||||||||||||||||||||||||||||||||||||||||||||||||
m010-1      QEDRWDWHMYDTVKGSDWLGDQDAIEFMCRAAPEAVIELEHMGMPFDRVESGKIYQRPFG
                  70         80         90        100        110        120

130        140        150        160        170        180
a010-1.pep  GHTAEHGKRAVERACAVADRTGHAMLHTLYQQNVRANTQFFVEWTAQDLIRDENGDVVGV
            ||||||||||||||||||||||||||||||||||||||||||||||||||||||||||||
m010-1      GHTAEHGKRAVERACAVADRTGHAMLHTLYQQNVRANTQFFVEWTAQDLIRDENGDVVGV
                 130        140        150        160        170        180

190        200        210        220        230        240
a010-1.pep  TAMEMETGEVYIFHAKAVMFATGGGGRIYASSTNAYMNTGDGLGICARAGIPLEDMEFWQ
            ||||||||||||||||||||||||||||||||||||||||||||||||||||||||||||
m010-1      TAMEMETGEVYIFHAKAVMFATGGGGRIYASSTNAYMNTGDGLGICARAGIPLEDMEFWQ
                 190        200        210        220        230        240

250        260        270        280        290        300
a010-1.pep  FHPTGVAGAGVLITEGVRGEGGILLNADGERFMERYAPTVKDLASRDVVSRAMAMEIYEG
            ||||||||||||||||||||||||||||||||||||||||||||||||||||||||||||
m010-1      FHPTGVAGAGVLITEGVRGEGGILLNADGERFMERYAPTVKDLASRDVVSRAMAMEIYEG
                 250        260        270        280        290        300

310        320        330        340        350        360
a010-1.pep  RGCGKNKDHVLLKIDHIGAEKIMEKLPGIREISIQFAGIDPIKDPIPVVPTTHYMMGGIP
            ||||||||||||||||||||||||||||||||||||||||||||||||||||||||||||
m010-1      RGCGKNKDHVLLKIDHIGAEKIMEKLPGIREISIQFAGIDPIKDPIPVVPTTHYMMGGIP
                 310        320        330        340        350        360

370        380        390        400        410        420
a010-1.pep  TNYHGEVVVPQGDEYEVPVKGLYAAGECACASVHGANRLGTNSLLDLVVFGKAAGDSMIK
            ||||||||||| ::|||||||||||||||||||||||||||||||||||||||||||||
m010-1      TNYHGEVVVPQGDEDYEVPVKGLYAAGECACASVHGANRLGTNSLLDLVVFGKAAGDSMIK
                 370        380        390        400        410        420

430        440        450        460        470        480
a010-1.pep  FIKEQSDWKPLPANAGELTRQRIERLDNQTDGENVDALRRELQRSVQLHAGVFRTDEILS
            ||||||||||||||||||||||||||||||||||||||||||||||||||||||||||||
m010-1      FIKEQSDWKPLPANAGELTRQRIERLDNQTDGENVDALRRELQRSVQLHAGVFRTDEILS
                 430        440        450        460        470        480

490        500        510        520        530        540
a010-1.pep  KGVREVMAIAERVKRTEIKDKSKVWNTARIEALELDNLIEVAKATLVSAEARKESRGAHA
            ||||||||||||||||||||||||||||||||||||||||||||||||||||||||||||
m010-1      KGVREVMAIAERVKRTEIKDKSKVWNTARIEALELDNLIEVAKATLVSAEARKESRGAHA
                 490        500        510        520        530        480

550        560        570        580
a010-1.pep  SDDHPERDDENWMKHTLYHSDANTLSYKPVHTKPLSVEYIKPAKRVYX
            |||||||||||||||||||| |||||||||||||||||||||||||
m010-1      SDDHPERDDENWMKHTLYHSDINTLSYKPVHTKPLSVEYIKPAKRVYX
                 550        560        570        580
```

The following partial DNA sequence was identified in *N. gonorrhoeae* <SEQ ID 73>:

```
g011.seq
    1   ATGAAGACAC ACCGCAAGAC CTGCTCTGCG GTGTGTTTTG CTTTTCAGAC

51   GGCATCGAAA CCCGCCGTTT CCATCCGACA TCCCAGCGAG ACATCATGA

101   GCCTGAAAAC CCGCCTTACC GAAGATATGA AAACCGCGAT GCGCGCCAAA

151   GATCAAGTTT CCCTCGGCAC CATCCGCCTC ATCAATGCCG CCGTCAAACA

201   GTTTGAAGTA GACGAACGCA CCGAAGCCGA CGATGCCAAA ATCACCGCCA

251   TCCTGACCAA AATGGTCAAA CAGCGCAAAG ACGGCGCGAA AATCTACACT

301   GAAGCCGGCC GTCAGGATTT GGCAGACAAA GAAAACGCCG AAATCGACGT

351   GCTGCACCGC TACCTGCCGC AAATGCTCTC CGCCGGCGAA ATCCGCACCG

401   CCGTCGAAGC AGCCGTTGCC GAAACCGGCG CGGCAGGTAT GGCGGATATG

451   GGCAAAGTGA TGGTCGTATT GAAAcccGC CTCGCCGGCA AAGccgATAT

501   GGGCGAAGTC AACAAAATCT TGAAAAccGt aCTGACCGCC tga
                                                         20
```

This corresponds to the amino acid sequence <SEQ ID 74; ORF 011.ng>:

```
g011.pep
    1   MKTHRKTCSA VCFAFQTASK PAVSIRHPSE DIMSLKTRLT EDMKTAMRAK

51   DQVSLGTIRL INAAVKQFEV DERTEADDAK ITAILTKMVK QRKDGAKIYT

101   EAGRQDLADK ENAEIDVLHR YLPQMLSAGE IRTAVEAAVA ETGAAGMADM

151   GKVMVVLKTR LAGKADMGEV NKILKTVLTA *
```

The following partial DNA sequence was identified in *N. meningitidis* <SEQ ID 75>:

```
m011.seq(partial)
    1   ATGAGGACAC ACCGCAAGAC CTGCTCTGCG GTGTGTTTTG CTTTTCAGAC

51   GGCATCGAAA CCCGCCGTTT CCATCCGACA TCCCAGCGAG ACATCATGA

101   GCCTGAAAAT CCGCCTTACC GAAGACATGA AAACCGCGAT GCGCGCCAAA

151   GACCAAGTTT CCCTCGGCAC CATCCGCCTC ATCAACGCCG CCGTCAAACA

201   GTTTGAAGTG GACGAACGCA CCGAAGCCGA CGATGCCAAA ATCACCGCCA

251   TCCTGACCAA AATGGTCAAA CAGCGAAAAG ACAGCGCGAA AATCTACACT

301   GAAGCCGGCC GTCAGGATTT GGCAGACAAA GAAAACGCCG AAATCGAGGT

351   ACTGCACCGC TACCTTCCCC AAATGCTTTC CGCCGGCGAA ATCCGTACCG

401   AGGTCGAAGC TGCCGTTGCC GAAACCGGCG CGGCAGGTAT GGCGGATATG

451   GGTAAAGTCA TGGGGCTGCT GAAAACCCGC CTCGCAGGTA AAGCCGA...
```

This corresponds to the amino acid sequence <SEQ ID 76; ORF 011>:

```
m011.pep(partial)
    1   MRTHRKTCSA VCFAFQTASK PAVSIRHPSE DIMSLKIRLT EDMKTAMRAK

51   DQVSLGTIRL INAAVKQFEV DERTEADDAK ITAILTKMVK QRKDSAKIYT

101   EAGRQDLADK ENAEIEVLHR YLPQMLSAGE IRTEVEAAVA ETGAAGMADM

151   GKVMGLLKTR LAGKA.....
```

Computer analysis of this amino acid sequence gave the following results:
Homology with a Predicted ORF from *N. gonorrhoeae*
ORF 011 shows 95.8% identity over a 165 aa overlap with a predicted ORF (ORF 011.ng) from *N. gonorrhoeae*:

```
m011/g011
                   10        20        30        40        50        60
    m011.pep  MRTHRKTCSAVCFAFQTASKPAVSIRHPSEDIMSLKIRLTEDMKTAMRAKDQVSLGTIRL
              |:||||||||||||||||||||||||||||||:|||||||||||||||||||||||||||
        g011  MKTHRKTCSAVCFAFQTASKPAVSIRHPSEDIMSLKTRLTEDMKTAMRAKDQVSLGTIRL
                   10        20        30        40        50        60

70        80        90       100       110       120
    m011.pep  INAAVKQFEVDERTEADDAKITAILTKMVKQRKDSAKIYTEAGRQDLADKENAEIEVLHR
              |||||||||||||||||||||||||||||||||:||||||||||||||||||||:||||
        g011  INAAVKQFEVDERTEADDAKITAILTKMVKQRKDGAKIYTEAGRQDLADKENAEIDVLHR
                   70        80        90       100       110       120

130       140       150       160
    m011.pep  YLPQMLSAGEIRTEVEAAVAETGAAGMADMGKVMGLLKTRLAGKA
              ||||||||||||| ||||||||||||||||||| ||||||||||
        g011  YLPQMLSAGEIRTAVEAAVAETGAAGMADMGKVMVVLKTRLAGKADMGEVNKILKTVLTA
                  130       140       150       160       170       180 g011  X
```

The following partial DNA sequence was identified in *N. gonorrhoeae* <SEQ ID 77>:

```
g012.seq
     1    ATGCTCGCCC GTCGCTATTT TTTCAATATC CAACCCGGGG CGGTTTTCAC

51    TGACAAACTG CTTGAACAAC TGATGCGTTT CCTCCAGTTC CTGCCGGAAT

101    TTCTGTTTGC CCTTTTCCGT ATTTTCACCC ATAAAAGTAA CCGTGCGCTT

151    AAATTCGCCC GCCGTCATCA CATCCACATC AATATCATGT TTTTTCAACa 201    gGcggTGGAT ATTCGgcact tccgCcacca cacccaccga accgatgacc 251    gcaaacggaG CGGAAACAAT TTTATCCGCc acacacgcca tcatatagcc 301    gcCGCTTGCC GCGACCTTAT CGAcggcgac ggTCAGCGGA ATATTGCGTT

351    CGCGCAAACG CCTAAGCTGC GAAGCCGCCA AACCGTAACC GTGAACCACG

401    CCGCCCGGAC TTTCCAATCT GAGCAGAACC TCATCTTCAG GCTTGGCAAT

451    CAAAAGCACC GCCGTAATCT CATGACGCAA GGATTCTACG GCGTGTGCAT

501    ACAAATCGCC GTCAAAATCC AACACAAAAA GGCGGGATTT TTGCGTTTCG

551    GCAGATTTCT CCCCGCCCTC CTTCAAACGC TTTTTCTCTG CTTTGGCTTC

601    CGCCTTTTCC TTTTTCTTTT CTTTTTTTTC CTGATGTTTT GTCTCTTCCT

651    CGCTTAA
```

This corresponds to the amino acid sequence <SEQ ID 78; ORF 012.ng>:

```
g012.pep
     1    MLARRYFFNI QPGAVFTDKL LEQLMRFLQF LPEFLFALFR IFTHKSNRAL

51    KFARRHHIHI NIMFFQQAVD IRHFRHHTHR TDDRKRSGNN FIRHTRHHIA

101    AACRDLIDGD GQRNIAFAQT PKLRSRQTVT VNHAARTFQS EQNLIFRLGN

151    QKHRRNLMTQ GFYGVCIQIA VKIQHKKAGF LRFGRFLPAL LQTLFLCFGF

201    RLFLFLFFFF LMFCLFLA*
```

The following partial DNA sequence was identified in *N. meningitidis* <SEQ ID 79>:

```
m012.seq
    1   ATGCTCGCCC GTTGCCACTT CCTCAATATC CAATTGAGGG CGGTTCTCGC

51   TGACAAACTG CTTGAACAAC TGATGCGTTT CCTCCAGTTC CTGTCGGAAT

101   TTCTGTTTGC CCTTTTCCGT ATTTTCACCC ATAAAAGTAA CCGTGCGCTT

151   AAATTCGCCC GCCGTCATCA CATCCACATC AATATCATGT TTTTTCAACA

201   GGCGGTGGAT ATTCGGTACT TCCGCCACCA CACCCACCGA ACCGACAATC

251   GCAAACGGAG CGGAAGCAAT TTTATCCGCC ACACACGCCA TCATATAACC

301   GCCGCTCGCn nnnnnnnnnn nnnnnnnnnn nnnnnnnnnn nnnnnnnnnn 351   nnnnnnnnnn nnnnnnnnnn nnnnnnnnnn nnnnnnnnnn nnnnnnnnnn 401   nnnnnnnnnn nnnnnnnnnn nnnnnnnnnn nnnnnnnnnn nnnnnnnnnn 451   nnnnnnnnnn nnnnnnnnnn nnnnnnnnnn nnnnnnnnnn nnnnnnnnnn 501   nnnnnnnnnn nnnnnnnnnC AACACAAAAA GGCGTGATTT nTGCGTTTCG 551   GCAGATTTCT CCCCACCCTC CTTCAAACGT TTTTCcTCTG CTTTGGCTTC

601   CGCCTTTTCC TTTTTCTTTT CCTCTTTTTC CTGATGTTGT GCCTCTTCCC

651   CGCTTAA
```

This corresponds to the amino acid sequence <SEQ ID 80; ORF 012>:

```
m012.pep
    1   MLARCHFLNI QLRAVLADKL LEQLMRFLQF LSEFLFALFR IFTHKSNRAL

51   KFARRHHIHI NIMFFQQAVD IRYFRHHTHR TDNRKRSGSN FIRHTRHHIT

101   AARXXXXXXX XXXXXXXXXX XXXXXXXXXX XXXXXXXXXX XXXXXXXXXX

151   XXXXXXXXXX XXXXXXXXXX XXXQHKKA*F XRFGRFLPTL LQTFFLCFGF

201   RLFLFLFLFF LMLCLFPA*
```

The following partial DNA sequence was identified in *N. meningitidis* <SEQ ID 81>:

```
a012.seq
    1   ATGCTCGCCC GTTGCCACTT CCTCAATATC CAATTGAGGG CGGTTCTCGC

51   TGACAAACTG CTTGAACAAC TGATGCGTTT CCTCCAGTTC CTGTCGGAAT

101   TTCTGTTTGC CCTTTTCCGT ATTTTCACCC ATAAAAGTAA CCGTGCGCTT

151   AAATTCGCCC GCCGTCATCA CATCCACATC AATATCATGT TTTTTCAACA

201   GGCGGTGGAT ATTCGGTACT TCCGCTACAA CACCCACCGA ACCGACAATC

251   GCAAACGGAG CGGAAACAAT TTTATCCGCC ACACACGCCA TCATATAACC

301   ACCGCTCGCC GCCACCTTAT CGACGGCGAC GGTCAGCGGA ATATTGCGTT

351   CGCGCAAACG CCTAAGCTGC GAAGCCGCCA AACCGTAACC GTGAACCACG

401   CCGCCCGGAC TTTCCAATCT AAGCAGAACC TCATCTTCAG GCTTGGCAAT

451   CAAAAGCACC GCCGTAATCT CATGACGCAA GGATTCTACG GCGTGTGCAT

501   ACAAATCGCC GTCAAATCC AACACAAAAA GGCGGGATTT TTGCGTTTCG

551   GAAGATTTCT CCCCACCCTC CTTCAAACGC TTTTTCTCTG CTTTGGCTTC

601   CGCCTTTTCC TTTTTCTTTT CCTCTTTTTC CTGATGTTTT GCCTCTTCCC

651   CGCTTAA
```

This corresponds to the amino acid sequence <SEQ ID 82; ORF 012.a>:

```
a012.pep
    1   MLARCHFLNI QLRAVLADKL LEQLMRFLQF LSEFLFALFR IFTHKSNRAL

51   KFARRHHIHI NIMFFQQAVD IRYFRYNTHR TDNRKRSGNN FIRHTRHHIT

101   TARRHLIDGD GQRNIAFAQT PKLRSRQTVT VNHAARTFQS KQNLIFRLGN

151   QKHRRNLMTQ GFYGVCIQIA VKIQHKKAGF LRFGRFLPTL LQTLFLCFGF

201   RLFLFLFLFF LMFCLFPA*
```

```
                 10         20         30         40         50         60
   m012.pep   MLARCHFLNIQLRAVLADKLLEQLMRFLQFLSEFLFALFRIFTHKSNRALKFARRHHIHI
              ||||||||||||||||||||||||||||||||||||||||||||||||||||||||||||
   a012       MLARCHFLNIQLRAVLADKLLEQLMRFLQFLSEFLFALFRIFTHKSNRALKFARRHHIHI
                 10         20         30         40         50         60

70         80         90        100        110        120
   m012.pep   NIMFFQQAVDIRYFRHHTHRTDNRKRSGSNFIRHTRHHITAARXXXXXXXXXXXXXXXXX
              ||||||||||||||||::||||||||||||:||||||||||:||                :
   a012       NIMFFQQAVDIRYFRYNTHRTDNRKRSGNNFIRHTRHHITTARRHLIDGDGQRNIAFAQT
                 70         80         90        100        110        120

130        140        150        160        170        180
   m012.pep   XXXXXXXXXXXXXXXXXXXXXXXXXXXXXXXXXXXXXXXXXXXXXXXXXXXQHKKAXF
              : :             :                              :         ||||| |
   a012       PKLRSRQTVTVNHAARTFQSKQNLIFRLGNQKHRRNLMTQGFYGVCIQIAVKIQHKKAGF
                130        140        150        160        170        180

190        200        210      219
   m012.pep   XRFGRFLPTLLQTFFLCFGFRLFLFLFLFFLMLCLFPAX
              |||||||||||:||||||||||||||||:||||||
   a012       LRFGRFLPTLLQTLFLCFGFRLFLFLFLFFLMFCLFPAX
                190        200        210
```

Computer analysis of this amino acid sequence gave the following results:
Homology with a Predicted ORF from *N. gonorrhoeae*
ORF 012 shows 58.7% identity over a 218 aa overlap with a predicted ORF (ORF 012.ng) from *N. gonorrhoeae*:

```
   m012/g012
                 10         20         30         40         50         60
   m012.pep   MLARCHFLNIQLRAVLADKLLEQLMRFLQFLSEFLFALFRIFTHKSNRALKFARRHHIHI
              ||||  :|:|||   ||::|||||||||||| ||||||||||||||||||||||||||||
   g012       MLARRYFFNIQPGAVFTDKLLEQLMRFLQFLPEFLFALFRIFTHKSNRALKFARRHHIHI
                 10         20         30         40         50         60

70         80         90        100        110        120
   m012.pep   NIMFFQQAVDIRYFRHHTHRTDNRKRSGSNFIRHTRHHITAARXXXXXXXXXXXXXXXXX
              ||||||||||||:||||||||||:|||||:||||||||||:||                :
   g012       NIMFFQQAVDIRHFRHHTHRTDDRKRSGNNFIRHTRHHIAAACRDLIDGDGQRNIAFAQT
                 70         80         90        100        110        120

130        140        150        160        170        180
   m012.pep   XXXXXXXXXXXXXXXXXXXXXXXXXXXXXXXXXXXXXXXXXXXXXXXXXXXQHKKAXF
              : :             :                              :         ||||| |
   g012       PKLRSRQTVTVNHAARTFQSEQNLIFRLGNQKHRRNLMTQGFYGVCIQIAVKIQHKKAGF
                130        140        150        160        170        180

190        200        210      219
   m012.pep   XRFGRFLPTLLQTFFLCFGFRLFLFLFLFFLMLCLFPAX
              |||||||:||||:||||||||||||||:||||:||| ||
   g012       LRFGRFLPALLQTLFLCFGFRLFLFLFFFFLMFCLFLAX
                190        200        210
```

The following partial DNA sequence was identified in *N. meningitidis* <SEQ ID 83>:

```
m012-1.seq
     1      ATGCTCGCCC GTTGCCACTT CCTCAATATC CAATTGAGGG CGGTTCTCGC

51      TGACAAACTG CTTGAACAAC TGATGCGTTT CCTCCAGTTC CTGTCGGAAT

101      TTCTGTTTGC CCTTTTCCGT ATTTTCACCC ATAAAAGTAA CCGTGCGCTT

151      AAATTCGCCC GCCGTCATCA CATCCACATC AATATCATGT TTTTTCAACA

201      GGCGGTGGAT ATTCGGTACT TCCGCCACCA CACCCACCGA ACCGACAATC

251      GCAAACGGAG CGGAAGCAAT TTTATCCGCC ACACACGCCA TCATATAACC

301      GCCGCTCGCC GCCACCTTAT CGACGGCGAC GGTCAGCGGA ATATTGCGTT

351      CGCGCAAACG CyTAAGCTGC GAAGCCGCCA AACCGTAACC GTGAACCACG

401      CCGCCCGGAC TTTCCAATCT GAGCAGAACC TCATCTTCAG GCTTGGCAAT

451      CAAAAGCACC GCCGTAATCT CATGACGCAA GGATTCTACG GCGTGTGCAT

501      ACAAATCGCC GTCAAAATCC AACACAAAAA GGCGGGATTT TTGCGTTTCG

551      GCAGATTTCT CCCCACCCTC CTTCAAACGC TTTTTCTCTG CTTTGGCTTC

601      CGCCTTTTCC TTTTTCTTTT CCTCTTTTTC CTGATGTTTT GCCTCTTCCC

651      CGCTTAA
```

This corresponds to the amino acid sequence <SEQ ID 84; ORF 012-1>:

```
m012-1.pep
     1      MLARCHFLNI QLRAVLADKL LEQLMRFLQF LSEFLFALFR IFTHKSNRAL

51      KFARRHHIHI NIMFFQQAVD IRYFRHHTHR TDNRKRSGSN FIRHTRHHIT

101      AARRHLIDGD GQRNIAFAQT XKLRSRQTVT VNHAARTFQS EQNLIFRLGN

151      QKHRRNLMTQ GFYGVCIQIA VKIQHKKAGF LRFGRFLPTL LQTLFLCFGF

201      RLFLFLFLFF LMFCLFPA*
``` m012-1/g012 91.7% identity in 218 aa overlap

```
                    10         20         30         40         50         60
    m012-1.pep  MLARCHFLNIQLRAVLADKLLEQLMRFLQFLSEFLFALFRIFTHKSNRALKFARRHHIHI
                ||||  : :|||    || : :||||||||||||||  ||||||||||||||||||||||
         g012  MLARRYFFNIQPGAVFTDKLLEQLMRFLQFLPEFLFALFRIFTHKSNRALKFARRHHIHI
                    10         20         30         40         50         60

70         80         90        100        110        120
    m012-1.pep  NIMFFQQAVDIRYFRHHTHRTDNRKRSGSNFIRHTRHHITAARRHLIDGDGQRNIAFAQT
                ||||||||||||: ||||||||| |||||:|||||||||||   : ||||||||||||||
         g012  NIMFFQQAVDIRHFRHHTHRTDDRKRSGNNFIRHTRHHIAAACRDLIDGDGQRNIAFAQT
                    70         80         90        100        110        120

130        140        150        160        170        180
    m012-1.pep  XKLRSRQTVTVNHAARTFQSEQNLIFRLGNQKHRRNLMTQGFYGVCIQIAVKIQHKKAGF
                 ||||||||||||||||||||||||||||||||||||||||||||||||||||||||||||
         g012  PKLRSRQTVTVNHAARTFQSEQNLIFRLGNQKHRRNLMTQGFYGVCIQIAVKIQHKKAGF
                   130        140        150        160        170        180

190        200        210    219
    m012-1.pep  LRFGRFLPTLLQTLFLCFGFRLFLFLFLFFLMFCLFPAX
                ||||||||| ||||||||||||||||| :|||||||| ||
         g012  LRFGRFLPALLQTLFLCFGFRLFLFLFFFFLMFCLFLAX
                   190        200        210
```

The following partial DNA sequence was identified in *N. meningitidis* <SEQ ID 85>:

```
a012-1.seq
     1      ATGCTCGCCC GTTGCCACTT CCTCAATATC CAATTGAGGG CGGTTCTCGC

51      TGACAAACTG CTTGAACAAC TGATGCGTTT CCTCCAGTTC CTGTCGGAAT
```

-continued

```
101    TTCTGTTTGC CCTTTTCCGT ATTTTCACCC ATAAAAGTAA CCGTGCGCTT

151    AAATTCGCCC GCCGTCATCA CATCCACATC AATATCATGT TTTTTCAACA

201    GGCGGTGGAT ATTCGGTACT TCCGCTACAA CACCCACCGA ACCGACAATC

251    GCAAACGGAG CGGAAACAAT TTTATCCGCC ACACACGCCA TCATATAACC

301    ACCGCTCGCC GCCACCTTAT CGACGGCGAC GGTCAGCGGA ATATTGCGTT

351    CGCGCAAACG CCTAAGCTGC GAAGCCGCCA AACCGTAACC GTGAACCACG

401    CCGCCCGGAC TTTCCAATCT AAGCAGAACC TCATCTTCAG GCTTGGCAAT

451    CAAAAGCACC GCCGTAATCT CATGACGCAA GGATTCTACG GCGTGTGCAT

501    ACAAATCGCC GTCAAAATCC AACACAAAAA GGCGGGATTT TTGCGTTTCG

551    GAAGATTTCT CCCCACCCTC CTTCAAACGC TTTTTCTCTG CTTTGGCTTC

601    CGCCTTTTCC TTTTTCTTTT CCTCTTTTTC CTGATGTTTT GCCTCTTCCC

651    CGCTTAA
```

This corresponds to the amino acid sequence <SEQ ID 86; ORF 012-1.a>:

```
a012-1.pep
     1     MLARCHFLNI QLRAVLADKL LEQLMRFLQF LSEFLFALFR IFTHKSNRAL

51     KFARRHHIHI NIMFFQQAVD IRYFRYNTHR TDNRKRSGNN FIRHTRHHIT

101     TARRHLIDGD GQRNIAFAQT PKLRSRQTVT VNHAARTFQS KQNLIFRLGN

151     QKHRRNLMTQ GFYGVCIQIA VKIQHKKAGF LRFGRFLPTL LQTLFLCFGF

201     RLFLFLFLFF LMFCLFPA*
``` a012-1/m012-1 97.2% identity in 218 aa overlap

```
                  10         20         30         40         50         60
a012-1.pep  MLARCHFLNIQLRAVLADKLLEQLMRFLQFLSEFLFALFRIFTHKSNRALKFARRHHIHI
            ||||||||||||||||||||||||||||||||||||||||||||||||||||||||||||
m012-1      MLARCHFLNIQLRAVLADKLLEQLMRFLQFLSEFLFALFRIFTHKSNRALKFARRHHIHI
                  10         20         30         40         50         60

70         80         90        100        110        120
a012-1.pep  NIMFFQQAVDIRYFRYNTHRTDNRKRSGNNFIRHTRHHITTARRHLIDGDGQRNIAFAQT
            |||||||||||||:: ||||||||||:|||:|||||||:| ||||||||||||||||||
m012-1      NIMFFQQAVDIRYFRHHTHRTDNRKRSGSNFIRHTRHHITAARRHLIDGDGQRNIAFAQT
                  70         80         90        100        110        120

130        140        150        160        170        180
a012-1.pep  PKLRSRQTVTVNHAARTFQSKQNLIFRLGNQKHRRNLMTQGFYGVCIQIAVKIQHKKAGF
            :|||||||||||||||||||:|||||||||||||||||||||||||||||||||||||||
m012-1      XKLRSRQTVTVNHAARTFQSEQNLIFRLGNQKHRRNLMTQGFYGVCIQIAVKIQHKKAGF
                 130        140        150        160        170        180

190        200        210   219
a012-1.pep  LRFGRFLPTLLQTLFLCFGFRLFLFLFLFFLMFCLFPAX
            |||||||||||||||||||||||||||||||||||||||
m012-1      LRFGRFLPTLLQTLFLCFGFRLFLFLFLFFLMFCLFPAX
                 190        200        210
```

The following partial DNA sequence was identified in *N. gonorrhoeae* <SEQ ID 87>:

```
g013.seq
     1     aTgcctttga ccatgctgtg cagcaGGAcg tGCGGTTtgt tcataataca 51     gtCcgaccGG AAAagcggAG GAAaCGCAGT GCCGCGCCCT TCCCCTTTCT 101     TGCCGTGGCA GGCGATGCag tTgGATTCGT ACACTTTTTG CCCTTTTGtc 151     atgatGCTgt tgtcggCGGC AGAAGCgGCG GcgCAGAGGC AGCACAAGAT
```

```
      201   GAAGGCGGTC GGCAGTCGGG TTGTGTtcat tGgcgTTTCC cctaatgttt 251   tgaaaccttg tttttgatt Ttgcctttac ggggtgaaaa gttttttTtgg 301   cccaaatccg gaatttag
```

This corresponds to the amino acid sequence <SEQ ID 88; ORF 013.ng:

```
g013.pep
    1   MPLTMLCSRT CGLFIIQSDR KSGGNAVPRP SPFLPWQAMQ LDSYTFCPFV

51   MMLLSAAEAA AQRQHKMKAV GSRVVFIGVS PNVLKPCFLI LPLRGEKFFW

101   PKSGI*
```

The following partial DNA sequence was identified in *N. meningitidis* <SEQ ID 89>:

```
m013.seq
    1   ATGCCTTTGA CCATGCTGTG CAGCAGCACC TGCGGTTTTT TCATGATGAA

51   GTCGGAGCGG TAGAGCGGCG GAAACATGGT TCCGCGGCCT TCGCCCTTTT

101   TGCCGTGGCA GGCGACGCAG TTGGATTCGT ACACTTTTTG CCCTTTTGTC

151   ATGATGCTGT TGTCGGCGGC AGAAGCGGCG GCGCAGAAGC AGCCCAAGAC

201   GAGGGCGGTC GGCAGTCGGG TTGTGTTCAT TGGTGTTTCC TTCATGTTTG

251   AAACCTTGTT GTTGATTTTG CGTAGCGGGT GAAAGATTTT TTTGCCGAAT

301   CAGTAG
```

This corresponds to the amino acid sequence <SEQ ID 90; ORF 013>:

```
m013.pep
    1   MPLTMLCSST CGFFMMKSER XSGGNMVPRP SPFLPWQATQ LDSYTFCPFV

51   MMLLSAAEAA AQKQPKTRAV GSRVVFIGVS FMFETLLLIL RSGXKIFLPN

101   Q*
```

The following partial DNA sequence was identified in *N. meningitidis* <SEQ ID 91>:

```
a013.seq
    1   ATGCCTTTGA CCATGCTGTG CAGCAGCACC TGCGGTTTTT TCATGATGAA

51   GTCGGAGCGG TAGAGCGGCG GAAACATGGT TCCGCGGCCT TCGCCCTTTT

101   TGCCGTGGCA GGCGACGCAG TTGGATTCGT ACACTTTTTG CCCTTTTGTC

151   ATGATGCTGT TGTCGGCGGC AGAAGCGGCG GCGCAGAGGC AGCCCAAGAC

201   GAGGGCGGTC GGCAGTCGGG TTGTGTTCAT TGGTGTTTCC TTAATGTTTG

251   AAACCTTGTT GTTGATTTTG CGTAGCGGGT GAAAGATTTT CTTGCCGAAT

301   CGGTAG
```

This corresponds to the amino acid sequence <SEQ ID 92; ORF 013.a>:

```
a013.pep
    1   MPLTMLCSST CGFFMMKSER *SGGNMVPRP SPFLPWQATQ LDSYTFCPFV

51   MMLLSAAEAA AQRQPKTRAV GSRVVFIGVS LMFETLLLIL RSG*KIFLPN

101   R*
``` m013/a013 97.0% identity over a 101 aa overlap

```
                    10         20         30         40         50         60
   m013.pep   MPLTMLCSSTCGFFMMKSERXSGGNMVPRPSPFLPWQATQLDSYTFCPFVMMLLSAAEAA
              ||||||||||||||||||| ||||||||||||||||||||||||||||||||||||||||
   a013       MPLTMLCSSTCGFFMMKSERXSGGNMVPRPSPFLPWQATQLDSYTFCPFVMMLLSAAEAA
                    10         20         30         40         50         60
                    70         80         90        100
   m013.pep   AQKQPKTRAVGSRVVFIGVSFMFETLLLILRSGXKIFLPNQX
              ||:|||||||||||||||||:|||||||||||||||||||:|
   a013       AQRQPKTRAVGSRVVFIGVSLMFETLLLILRSGXKIFLPNRX
                    70         80         90        100
                                                            20
```

Computer analysis of this amino acid sequence gave the following results:
Homology with a Predicted ORF from *N. gonorrhoeae*
ORF 013 shows 73.3% identity over a 101 aa overlap with a predicted ORF (ORF 013.ng) from *N. gonorrhoeae*:

```
   m013/g013
                    10         20         30         40         50         60
   m013.pep   MPLTMLCSSTCGFFMMKSERXSGGNMVPRPSPFLPWQATQLDSYTFCPFVMMLLSAAEAA
              ||||||||| |||:|:::|:| |||| |||||||||||||| ||||||||||||||||||
   g013       MPLTMLCSRTCGLFIIQSDRKSGGNAVPRPSPFLPWQAMQLDSYTFCPFVMMLLSAAEAA
                    10         20         30         40         50         60
                    70         80         90        100
   m013.pep   AQKQPKTRAVGSRVVFIGVSF-MFETLLLILR-SGXKIFLPNQX
              ||:| :||||||||||||||  :::  :|||   | |:| |:
   g013       AQRQHKMKAVGSRVVFIGVSPNVLKPCFLILPLRGEKFFWPKSGIX
                    70         80         90        100
```

The following partial DNA sequence was identified in *N. gonorrhoeae* <SEQ ID 93>:

```
g015.seq
    1   ATGCAGTATC TGATTGTCAA ATACAGCCAT CAAATCTTCG TTACCATCAC

51   CATTTTGGTA TTCAACATCC GTTTTTTCCT ACTTTGGAAA AATCCAGAAA

101   AGCCCTTGGT CGGCTTTTGG AAAGCACTGC CCCACCTCAA CGACACGATG

151   CTGCTGTTTA CGGGATTGTG GCTGATGAAG ATTACCCATT TCTCCCCGTT

201   CAACGCGCCT TGGCTCGGCA CAAAATCCT GCTCCTGTTC GCCTACATCG

251   CACTGGGCAT GGTAATGATG CGCGCCCGTC CGCGTTCGAC CAAGTTCTAC

301   ACCGTTTACC TGCTCGCTAT GTGTTGCATC GCCTGCATCG TTTACCTTGC

351   CAAAACCAAA GTCCTGCCAT TCTGA
```

This corresponds to the amino acid sequence <SEQ ID 94; ORF 015.ng>:

```
g015.pep
    1   MQYLIVKYSH QIFVTITILV FNIRFFLLWK NPEKPLVGFW KALPHLNDTM

51   LLFTGLWLMK ITHFSPFNAP WLGTKILLLF AYIALGMVMM RARPRSTKFY

101   TVYLLAMCCI ACIVYLAKTK VLPF*
```

The following partial DNA sequence was identified in *N. meningitidis* <SEQ ID 95>:

```
m015.seq (partial)
     1    ..AAAATCAGAA AAGCCTTGGC GGGCTTTTGG AAGGCACTGC CCCACCTTAA

51    CGACACCATG CTGCTGTTTA CGGGATTGTG GCTGATGAAA ATTACCCATT

101    TCTCCCCGTT CAACGCGCCT TGGCTCGGTA CAAAAATCCT GCTTCTGCTC

151    GCCTATATCG CATTGGGTAT GATGATGATG CGCGCCCGTC CGCGTTCGAC

201    CAAGTTCTAC ACCGTTTACC TGCTCGCCAT GTGTTGCGTC GCCTGCATCG

251    TTTACCTTGC CAAAACCAAA GTCCTGCCTT TCTGA
```

This corresponds to the amino acid sequence <SEQ ID 96; ORF 015>:

```
m015.pep (partial)
     1    ..KIRKALAGFW KALPHLNDTM LLFTGLWLMK ITHFSPFNAP WLGTKILLLL

51    AYIALGMMMM RARPRSTKFY TVYLLAMCCV ACIVYLAKTK VLPF*
```

The following partial DNA sequence was identified in *N. meningitidis* <SEQ ID 97>:

```
a015.seq
     1    ATGCAGTATC TGATTGTCAA ATACAGCCAT CAAATCTTCG TTACCATCAC

51    CATTTTGGTA TTCAACATCC GTGTTTTCNT ACTTTGGAAA AATCCAGAAA

101    AGCCCTTGGC GGGCTTTTGG AAGGCACTGC CCCACCTTAA CGACACCATG

151    CTGCTGTTTA CGGGATTGTG GCTGATGAAA ATTACCCATT TCTCCCCGTT

201    CAACGCGCCT TGGCTCGGTA CAAAAATCCT GCTTCTGCTC GCCTATATCG

251    CATTGGGTAT GATGATGATG CGCGCCCGTC CGCGTTCGAC CAAGTTCTAC

301    ACCGTTTACC TGCTCGCCAT GTGTTGCCTC ACCTGCATCG TTTACCTTGC

351    CAAAACCAAA GTCCTGCCTT TCTGA
```

This corresponds to the amino acid sequence <SEQ ID 98; ORF 015.a>:

```
a015.pep
     1    MQYLIVKYSH QIFVTITILV FNIRVFXLWK NPEKPLAGFW KALPHLNDTM

51    LLFTGLWLMK ITHFSPFNAP WLGTKILLLL AYIALGMMMM RARPRSTKFY

101    TVYLLAMCCL TCIVYLAKTK VLPF*
``` m015/a015 96.7% identity over a 91 aa overlap

```
                              10         20         30
   m015.pep                   KIRKALAGFWKALPHLNDTMLLFTGLWLMKITH
                              ||||||||||||||||||||||||||||||||
      a015    LIVKYSHQIFVTITILVFNIRVFXLWKNPEKPLAGFWKALPHLNDTMLLFTGLWLMKITH
                 10        20        30        40        50        60

40        50        60        70        80        90
   m015.pep    FSPFNAPWLGTKILLLLAYIALGMMMMRARPRSTKFYTVYLLAMCCVACIVYLAKTKVLP
               ||||||||||||||||||||||||||||||||||||||||||||||::|||||||||||
      a015    FSPFNAPWLGTKILLLLAYIALGMMMMRARPRSTKFYTVYLLAMCCLTCIVYLAKTKVLP
                 70        80        90       100       110       120 m015.pep    FX
               ||
      a015    FX
```

Computer analysis of this amino acid sequence gave the following results:
Homology with a Predicted ORF from *N. gonorrhoeae*
ORF 015 shows 94.5% identity over a 91 aa overlap with a predicted ORF (ORF 015.ng) from *N. gonorrhoeae*:

```
m015/g015

10        20        30
   m015.pep                   KIRKALAGFWKALPHLNDTMLLFTGLWLMKITH
                              ||:||||||||||||||||||||||||||||||
       g015     LIVKYSHQIFVTITILVFNIRFFLLWKNPEKPLVGFWKALPHLNDTMLLFTGLWLMKITH
                    10        20        30        40        50        60

40        50        60        70        80        90
   m015.pep     FSPFNAPWLGTKILLLLAYIALGMMMMRARPRSTKFYTVYLLAMCCVACIVYLAKTKVLP
                ||||||||||||||||:||||||:|||||||||||||||||||||:||||||||||||||
       g015     FSPFNAPWLGTKILLLFAYIALGMVMMRARPRSTKFYTVYLLAMCCIACIVYLAKTKVLP
                    70        80        90       100       110       120 m015.pep     FX
                ||
       g015     FX
```

The following partial DNA sequence was identified in *N. gonorrhoeae* <SEQ ID 99>:

```
g018.seq
    1   atGCAGCAGG GGCagttggt tggacgcgtc gcccgcaata AAGATATGCG

51   GAATgctggt CTGCATggtC AGCGGATCGG CAACGGGtac gccgcgcgcg 101   tctttgTCGA TATTGATGTT TTCCAAACCG ATATtgTCAA CGTTCGGACG 151   GCgACCTACG GCTGCCAACA TATATTCGGC AACAAATACG CCTTTTTCGC 201   CATCCTGCTC CCAATGGACT tctACATTGC CGTCTGCGTC GAGTTTGACC 251   TCGGTTTTAG CATCCAGATG CAGTTTCAAT tctTCTCCGA ACACGGCTTT

301   CGCCTCGTCT GA
```

This corresponds to the amino acid sequence <SEQ ID 100; ORF 018.ng>:

```
g018.pep
    1   MQQGQLVGRV ARNKDMRNAG LHGQRIGNGY AARVFVDIDV FQTDIVNVRT

51   ATYGCQHIFG NKYAFFAILL PMDFYIAVCV EFDLGFSIQM QFQFFSEHGF

101   RLV*
```

The following partial DNA sequence was identified in *N. meningitidis* <SEQ ID 101>:

```
m018.seq
    1   ATGCAGCAGA GGCAGTTGGT TGGACGCATC GCCTGCGATG AAGATATGCG

51   GAATACTGGT CTGCATGGTC AGCGGGTCGG CAACAGGTAC GCCGCGCGCA

101   TCTTTTTCGA TATTGATATT TTCCAAACCG ATATTGTCAA CGTTCGGACG

151   GCGGCCCACG GCTGCCAGCA TATATTCGGC AACAAATACG CCTTTTTCGC

201   CATCCTGCTC CCAATGGACT TCTACATTGC CGTCTGCATC GAGTTTGACC

251   TCGGTTTTAG CATCCAGATG CAGTTTCAAT TCTTCGCCGA ACACGGCGTT

301   CGCCTCGTCT GA
```

This corresponds to the amino acid sequence <SEQ ID 102; ORF 018>:

```
m018.pep
    1    MQQRQLVGRI ACDEDMRNTG LHGQRVGNRY AARIFFDIDI FQTDIVNVRT

51    AAHGCQHIFG NKYAFFAILL PMDFYIAVCI EFDLGFSIQM QFQFFAEHGV

101    RLV*
```

The following partial DNA sequence was identified in *N. meningitidis* <SEQ ID 103>:

```
a018.seq
    1    ATGCAGCAGG GGCAGTTGGT TGGACGCGTC GCCCGCAATA AAGATATGCG

51    GAATACTGGT CTGCATAGTC AGCGGATCGG CAACGGGTAC GCCGCGCGCA

101    TCTTTTTCGA TATTGATGTT TTCCAAACCG ATATTGTCAA CGTTCGGACG

151    GCGGCCTACG GCTGCCAGCA TATATTCGGC AACAAATACG CCTTTTTCGC

201    CATCCTGCTC CCAATGGACT TCTACATTGC CGTCTGCGTC GAGTTTGGCC

251    TCGGTTTTAG CATCCAAATG CAGTTTCAAT TCTTCACCGA ACACGGCTTT

301    CGCCTCGTCT GA
```

This corresponds to the amino acid sequence <SEQ ID 104; ORF 018.a>:

```
a018.pep
    1    MQQGQLVGRV ARNKDMRNTG LHSQRIGNGY AARIFFDIDV FQTDIVNVRT

51    AAYGCQHIFG NKYAFFAILL PMDFYIAVCV EFGLGFSIQM QFQFFTEHGF

101    RLV*
``` m018/a018 86.4% identity over a 103 aa overlap

```
                    10         20         30         40         50         60
     m018.pep   MQQRQLVGRIACDEDMRNTGLHGQRVGNRYAARIFFDIDIFQTDIVNVRTAAHGCQHIFG
                ||| |||||:| ::||||||||:|:|| ||||||||:|||||||||||||:||||||
     a018       MQQGQLVGRVARNKDMRNTGLHSQRIGNGYAARIFFDIDVFQTDIVNVRTAAYGCQHIFG
                    10         20         30         40         50         60
                    70         80         90        100
     m018.pep   NKYAFFAILLPMDFYIAVCIEFDLGFSIQMQFQFFAEHGVRLVX
                ||||||||||||||||||||:|| ||||||||||||:||| ||||
     a018       NKYAFFAILLPMDFYIAVCVEFGLGFSIQMQFQFFTEHGFRLVX
                    70         80         90        100
```

Computer analysis of this amino acid sequence gave the following results:
Homology with a Predicted ORF from *N. gonorrhoeae*
ORF 018 shows 84.5% identity over a 103 aa overlap with a predicted ORF (ORF 018.ng) from *N. gonorrhoeae*:

```
    m018/g018
                    10         20         30         40         50         60
     m018.pep   MQQRQLVGRIACDEDMRNTGLHGQRVGNRYAARIFFDIDIFQTDIVNVRTAAHGCQHIFG
                ||| |||||:| ::||||:|||||:|| ||||:| |||:|||||||||||:||||||
     g018       MQQGQLVGRVARNKDMRNAGLHGQRIGNGYAARVFVDIDVFQTDIVNVRTATYGCQHIFG
                    10         20         30         40         50         60
                    70         80         90        100
     m018.pep   NKYAFFAILLPMDFYIAVCIEFDLGFSIQMQFQFFAEHGVRLVX
                ||||||||||||||||||||:||||||||||||||:||| ||||
     g018       NKYAFFAILLPMDFYIAVCVEFDLGFSIQMQFQFFSEHGFRLVX
                    70         80         90        100
```

The following partial DNA sequence was identified in *N. gonorrhoeae* <SEQ ID 105>:

```
g019.seq (partial)
    1    ..ctgctggcgg ccctggtgct tgccgcgtgt tcttcgACAA ACAcacTGCC
   51    AGCCGGCAAG ACCCCGGCAG ACAATATAGA AActgcCgAC CTTTCGGCAA
  101    GCGTTCCCAC ccgcCCTGCC GAACCGGAAG GAAAAACGCT GGCAGATTAC
  151    GGCGGCTACC CGTCCGCACT GGATGCAGTG AAACAGAACA ACGATGCGGC
  201    AGCCGCCGCC TATTTGGAAA Acgcaggaga cagCGcgatg gcGGAAAatg
  251    tccgcaagga gtgGCTGa
```

This corresponds to the amino acid sequence <SEQ ID 106; ORF 019.ng>:

```
g019.pep (partial)
    1    ..LLAALVLAAC SSTNTLPAGK TPADNIETAD LSASVPTRPA EPEGKTLADY
   51    GGYPSALDAV KQNNDAAAAA YLENAGDSAM AENVRKEWL*
                                                          20
```

The following partial DNA sequence was identified in *N. meningitidis* <SEQ ID 107>:

```
m019.seq (partial)
    1    ATGTACCTAC CCTCTATGAA GCATTCCCTG CCGCTGCTGG CGGCCCTGGT
   51    GCTTGCCGCG TGTTCTTCGA CAAACACACT GCCAGCCGGC AAGACCCCGG
  101    CAGACAATAT AGAAACTGCC GACCTTTCGG CAAGCGTTCC CACCCGCCCT
  151    GCCGAACCCG AAAGAAAAAC GCTGGCAGAT TACGGCGGCT ACCCGTCCGC
  201    ACTGGATGCA GTGAAACAGA AAAACGATGC CGCCGTCGCC GCCTATTTGG
  251    AAAACGCCGG CGACAGCGCG ATGGCGGAAA ATGTCCGCAA CGAGTGGCTG
  301    AAGTCTTTGG GCGCACGCAG ACAGTGGACG CTGTTTGCAC AGGAATACGC
  351    CAAACTCGAA CCGGCAGGGC GCGCCCAAGA AGTCGAATGC TACGCCGATT
  401    CGAGCCGCAA CGACTATACG CGTGCCGCTG AACTGGTCAA AAATACGGGC
  451    AAACTGCCTT CGGGCTGCAC CAAACTGTTG GAACAGGCAG CCGCATCCGG
  501    CTTGTTGGAC GGCAACGACG CCTGGAGGCG CGTGCGCGGA CTGCTGGCCG
  551    GCCGCCAAAC CACAGACGCA CGCAACCTTG CCGCCGCATT GGGCAGCCCG
  601    TTTGACGGCG GTACACAAGG TTCGCGCGAA TATGCCCTGT TGAACGTCAT
  651    CGGCAAAGAA GCACGCAAAT CGCCGAATGC CGCCGCCCTG CTGTCCGAAA
  701    TGGAAAGCGG TTTAAGCCTC GAACAACGCA GTTTCGCGTG GGGCGTATTG
  751    GGGCATTATC AGTCGCAAAA CCTCAATGTG CCTGCCGCCT TGGACTATTA
  801    CGGCAAGGTT GCCGACCGCC GCCAACTGAC CGACGACCAA ATCGAGTGGT
  851    ACGCCCGCGC CGCCTTGCGC GCCCGACGTT GGGACGAGCT GGCCTCCGTT
  901    ATCTCGCATA TGCCCGAAAA ACTGCAAAAA AGCCCGACCT GGCTCTACTG
  951    GCTGGCACGC AGCCGCGCCG CAACGGGCAA CACGCAAGAG GCGGAAAAAC
 1001    TTTACAAACA GGCGGCAGCG ACGGGCAGGA ATTTTTATGC GGTGCTGGCA
 1051    GGGGAAGAAT TGGGTCGGAA AATCGATACG CGCAACAATG TGCCCGATGC
 1101    CGGCAAAAAC AGCGTCCGCC GCATGGCGGA AGACGGTGCA GTCAAACGCG
 1151    CACTGGTACT GTTCCAAAAC AGCAATCTG CCGGTGATGC AAAAATGCGC
 1201    CGTCAGGCTC AGGCGGAATG GCGTTTTGCC ACACGCGGCT TTGACGAAGA
 1251    CAAGCTGCTG ACCGCCGCGC AAACCGCGTT CGACCACGGT TTTTACGATA
```

-continued

```
1301   TGGCGGTCAA CAGCGCGGAA CGCACCGACC GCAAACTCAA CTACACCTTG
1351   CGCTATATTT CGCCGTTTAA AGACACGGTA ATCCGCCACG CGCAAAATGT
1401   TAATGTCGAT CCGGCTTGGG TTTATGGGCT GATTCGTCAG GAAAGCCGCT
1451   TCGTTATAGG CGCGCAATCC CGCGTAGGCG CGCAGGGGCT GATGCAGGTT
1501   ATGCCTGCCA CCGCGCGCGA AATCGCCGGC AAAATCGGTA TGGATGCCGC
1551   ACAACTTTAC ACCGCCGACG GG...
```

This corresponds to the amino acid sequence <SEQ ID 108; ORF 019>:

```
m019.pep (partial)
    1   MYLPSMKHSL PLLAALVLAA CSSTNTLPAG KTPADNIETA DLSASVPTRP
   51   AEPERKTLAD YGGYPSALDA VKQKNDAAVA AYLENAGDSA MAENVRNEWL
  101   KSLGARRQWT LFAQEYAKLE PAGRAQEVEC YADSSRNDYT RAAELVKNTG
  151   KLPSGCTKLL EQAAASGLLD GNDAWRRVRG LLAGRQTTDA RNLAAALGSP
  201   FDGGTQGSRE YALLNVIGKE ARKSPNAAAL LSEMESGLSL EQRSFAWGVL
  251   GHYQSQNLNV PAALDYYGKV ADRRQLTDDQ IEWYARAALR ARRWDELASV
  301   ISHMPEKLQK SPTWLYWLAR SRAATGNTQE AEKLYKQAAA TGRNFYAVLA
  351   GEELGRKIDT RNNVPDAGKN SVRRMAEDGA VKRALVLFQN SQSAGDAKMR
  401   RQAQAEWRFA TRGFDEDKLL TAAQTAFDHG FYDMAVNSAE RTDRKLNYTL
  451   RYISPFKDTV IRHAQNVNVD PAWVYGLIRQ ESRFVIGAQS RVGAQGLMQV
  501   MPATAREIAG KIGMDAAQLY TADG...
```

The following partial DNA sequence was identified in *N. meningitidis* <SEQ ID 109>:

```
a019.seq
    1   ATGTACCCAC CCTCTCTGAA GCATTCCCTG CCGCTGCTGG TGGNCCTGGT
   51   GCTTGCCGCG TGTTCTTNGA CAAACACACT GTCAGCCGAC AAGACCCCGG
  101   CAGACAATAT AGAAACTGCC GACCTTTCGG CAAGCGTTCC CACCNGCCCT
  151   GCCGAACCCG AANGAAAAAC GTNGGCAGAT TACGGCGGCT ACCCGTCCGC
  201   ACTGGATGCA GTGAAACAGA AAAACGATGC CGCCGTCGCC GCCTATTTGG
  251   AAAACGCCGG CGACAGCGCG ATGGCGGAAA ATGTCCGCAA CGAGTGGCTG
  301   AAGTCTTTGG GCGCGCGCAG ACAGTGGACG CTGTNTGCAC ANGAATATGC
  351   NAAACTCGAA CCGGCANGGC GCGCCCAAGA AGTCGAATGC TACGCCGATT
  401   CGAGCCGCAA CGACTATACG CGTGCCGCCG AACTGGTCAA AAATACGGGC
  451   AAACTGCCTT CGGGCTGCAC CAAACTGTTG GAACAGGCAG CCGCATCCGG
  501   CTTGTTGGAC GGCAACGACG CCTGGAGGCG CGTGCGCGGA CTGCTGGCCG
  551   GCCGCCAAAC CACAGACGCA CGCAACCTTG CCGCCGCATT GGGCAGCCCG
  601   TTTGACGGCG GTACACAAGG TTCGCGCGAA TATGCCCTGT TGAACGTCAT
  651   CGGCAAAGAA GCACGCAAAT CGCCGAATGC CGCCGCCCTG CTGTCCGAAA
  701   TGGAAAGCGG TTTAAGCCTC GAACAACGCA GTTTCGCGTG GGCGTATTG
  751   GGGCATTATC AGTCGCAAAA CCTCAATGTG CCTGCCGCCT TGGACTATTA
  801   NGGCAAGGTT GCCGACCGCC GCCAACTGAC CGACGACCAA ATCGAGTGGT
```

```
 851  ACGCCCGCGC CGCNNTNNGC NNNCGNNGTT NGNANGANNT GGCNNCCGNN
 901  ANCNCGNNNN TGCNNGANAA ACNNNNNNAN AGNCNNANNT NGNTNNANTG
 951  NNTGGCACGC AGCCGCGCCG CNACGGGCAA CACGCAANAN GCGGANAAAC
1001  TNTACAAACA GGCGGCAGCA NCGGGCANGA ATTTTTATGC NGTGCTGNCN
1051  GGGGAAGAGT TGGGGCGCAN AATCGATACG CGCAACAATG TGCCCGATGC
1101  CGGCAAAANC AGCGTCCTCC GTATGGCGGA AGACGGCGCG ATTAAGCGCG
1151  CGCTGGTGCT GTTCCGAAAC AGCCGAACCG CCGGCGATGC GAAAATGCGC
1201  CGTCNGGCTC AGGCGGAATG GCGTTTCGCC ACACGCGGCT TCGATGAAGA
1251  CAAGCTGCTG ACCGCCGCGC AAACCGCGTT CGACCACGGT TTTTACGATA
1301  TGGCGGTCAA CAGCGCGGAA CGCACCGACC GCAAACTCAA CTACACCTTG
1351  CGCTACATTT CGNNNNNTNA NGACACGGTA ATCCGCCACG CGCAAAATGT
1401  TAATGTCGAT CCGGCGTGGG TTTACGGGCT GATTCGTCAG GAAAGCCGCT
1451  TCGTTATGGG CGCGCAATCC CGCGTAGGCG CGCAGGGGCT GATGCAGGTT
1501  ATGCCTGCCA CCGCGCGCGA AATCGCCGGC AAAATCGGTA TGGATGCCGC
1551  ACAACTTTAC ACCGCCGACG GCAATATCCG TATGGGACG TGGTATATGG
1601  CGGACACCAA ACGCCGCCTG CAAAACAACG AAGTCCTCGC CACCGCAGGC
1651  TATAACGCCG GTCCCGGCAG GGCGCGCCGA TGGCAGGCGG ACACGCCCCT
1701  CGAAGGCGCG GTATATGCCG AAACCATCCC GTTTTCCGAA ACGCGCGACT
1751  ATGTCAAAAA AGTGATGGCC AATGCCGCCT ACTACGCCTC CCTCTTCGGC
1801  GCGCCGCACA TCCCGCTCAA ACAGCGTATG GGCATTGTCC CCGCCCGCTG
1851  A
```

This corresponds to the amino acid sequence <SEQ ID 110; ORF 019.a>:

```
a019.pep
   1  MYPPSLKHSL PLLVXLVLAA CSXTNTLSAD KTPADNIETA DLSASVPTXP
  51  AEPEXKTXAD YGGYPSALDA VKQKNDAAVA AYLENAGDSA MAENVRNEWL
 101  KSLGARRQWT LXAXEYAKLE PAXRAQEVEC YADSSRNDYT RAAELVKNTG
 151  KLPSGCTKLL EQAAASGLLD GNDAWRRVRG LLAGRQTTDA RNLAAALGSP
 201  FDGGTQGSRE YALLNVIGKE ARKSPNAAAL LSEMESGLSL EQRSFAWGVL
 251  GHYQSQNLNV PAALDYXGKV ADRRQLTDDQ IEWYARAAXX XRXXXXXAXX
 301  XXXXXXKXXX XXXXXXXXAR SRAATGNTQX AXKLYKQAAA XGXNFYAVLX
 351  GEELGRXIDT RNNVPDAGKX SVLRMAEDGA IKRALVLFRN SRTAGDAKMR
 401  RXAQAEWRFA TRGFDEDKLL TAAQTAFDHG FYDMAVNSAE RTDRKLNYTL
 451  RYISXXXDTV IRHAQNVNVD PAWVYGLIRQ ESRFVMGAQS RVGAQGLMQV
 501  MPATAREIAG KIGMDAAQLY TADGNIRMGT WYMADTKRRL QNNEVLATAG
 551  YNAGPGRARR WQADTPLEGA VYAETIPFSE TRDYVKKVMA NAAYYASLFG
 601  APHIPLKQRM GIVPAR*
``` m019/a019 88.9% identity over a 524 aa overlap

```
                10         20         30         40         50         60
m019.pep  MYLPSMKHSLPLLAALVLAACSSTNTLPAGKTPADNIETADLSASVPTRPAEPERKTLAD
          || ||:||||||:  ||||||  |||| ||||||||||||||||||||| |||| || ||
a019      MYPPSLKHSLPLLVXLVLAACSXTNTLSADKTPADNIETADLSASVPTXPAEPEXKTXAD
                10         20         30         40         50         60

70         80         90        100        110        120
m019.pep  YGGYPSALDAVKQKNDAAVAAYLENAGDSAMAENVRNEWLKSLGARRQWTLFAQEYAKLE
          ||||||||||||||||||||||||||||||||||||||||||||||||||| ||||||
a019      YGGYPSALDAVKQKNDAAVAAYLENAGDSAMAENVRNEWLKSLGARRQWTLXAXEYAKLE
                70         80         90        100        110        120

130        140        150        160        170        180
m019.pep  PAGRAQEVECYADSSRNDYTRAAELVKNTGKLPSGCTKLLEQAAASGLLDGNDAWRRVRG
          || |||||||||||||||||||||||||||||||||||||||||||||||||||||||
a019      PAXRAQEVECYADSSRNDYTRAAELVKNTGKLPSGCTKLLEQAAASGLLDGNDAWRRVRG
               130        140        150        160        170        180

190        200        210        220        230        240
m019.pep  LLAGRQTTDARNLAAALGSPFDGGTQGSREYALLNVIGKEARKSPNAAALLSEMESGLSL
          ||||||||||||||||||||||||||||||||||||||||||||||||||||||||||
a019      LLAGRQTTDARNLAAALGSPFDGGTQGSREYALLNVIGKEARKSPNAAALLSEMESGLSL
               190        200        210        220        230        240

250        260        270        280        290        300
m019.pep  EQRSFAWGVLGHYQSQNLNVPAALDYYGKVADRRQLTDDQIEWYARAALRARRWDELASV
          ||||||||||||||||||||||||||| |||||||||||||||||||||||   |  |
a019      EQRSFAWGVLGHYQSQNLNVPAALDYXGKVADRRQLTDDQIEWYARAAXXXRXXXXXAXX
               250        260        270        280        290        300

310        320        330        340        350        360
m019.pep  ISHMPEKLQKSPTWLYWLARSRAATGNTQEAEKLYKQAAATGRNFYAVLAGEELGRKIDT
           |      :      |||||||||||| |||||||:| |||||||||| ||||||| ||
a019      XXXXXXKXXXXXXXXXXARSRAATGNTQXAXKLYKQAAAXGXNFYAVLXGEELGRXIDT
               310        320        330        340        350        360

370        380        390        400        410        420
m019.pep  RNNVPDAGKNSVRRMAEDGAVKRALVLFQNSQSAGDAKMRRQAQAEWRFATRGFDEDKLL
          |||||||||:|| ||||||||:||||||::| :|||||||:|||||||||||||||||
a019      RNNVPDAGKXSVLRMAEDGAIKRALVLFRNSRTAGDAKMRRXAQAEWRFATRGFDEDKLL
               370        380        390        400        410        420

430        440        450        460        470        480
m019.pep  TAAQTAFDHGFYDMAVNSAERTDRKLNYTLRYISPFKDTVIRHAQNVNVDPAWVYGLIRQ
          ||||||||||||||||||||||||||||||||||||  ||||||||||||||||||||
a019      TAAQTAFDHGFYDMAVNSAERTDRKLNYTLRYISXXXDTVIRHAQNVNVDPAWVYGLIRQ
               430        440        450        460        470        480

490        500        510        520
m019.pep  ESRFVIGAQSRVGAQGLMQVMPATAREIAGKIGMDAAQLYTADG
          |||||:|||||||||||||||||||||||||||||||||||||
a019      ESRFVMGAQSRVGAQGLMQVMPATAREIAGKIGMDAAQLYTADGNIRMGTWYMADTKRRL
               490        500        510        520        530        540 a019      QNNEVLATAGYNAGPGRARRWQADTPLEGAVYAETIPFSETRDYVKKVMANAAYYASLFG
               550        560        570        580        590        600
```

Computer analysis of this amino acid sequence gave the following results:
Homology with a Predicted ORF from *N. gonorrhoeae*
ORF 019 shows 95.5% identity over a 89 aa overlap with a predicted ORF (ORF 019.ng) from *N. gonorrhoeae*:

```
g019/m019
                         10         20         30         40       49
g019.pep        LLAALVLAACSSTNTLPAGKTPADNIETADLSASVPTRPAEPEGKTLAD
                ||||||||||||||||||||||||||||||||||||||||||| ||||
m019      MYLPSMKHSLPLLAALVLAACSSTNTLPAGKTPADNIETADLSASVPTRPAEPERKTLAD
                10         20         30         40         50         60

50         60         70         80       89
g019.pep  YGGYPSALDAVKQNNDAAAAYLENAGDSAMAENVRKEWL
          ||||||||||||:||| :||||||||||||||||:|||
m019      YGGYPSALDAVKQKNDAAVAAYLENAGDSAMAENVRNEWLKSLGARRQWTLFAQEYAKLE
                70         80         90        100        110        120
```

The following partial DNA sequence was identified in *N. gonorrhoeae* <SEQ ID 111>:

```
g023.seq
    1   ATGGTAGAAC GTAAATTGAC CGGTGCCCAT TACGGTTTGC GCGATTGGGT

51   AATGCAGCGT GCGACTGCGG TTATTATGTT GATTTATACC GTTGCACTTT

101   TAGTGGTTCT ATTTGCCCTG CCTAAAGAAT ATCCGGCATG GCAGGCATTT

151   TTTAGTCAAG CTTGGGTAAA AGTATTTACC CAAGTGAGCT TTATCGCCGT

201   ATTCTTGCAC GCTTGGGTGG GTATCCGCGA TTTGTGGATG GACTATATCA

251   AACCCTTCGG CGTGCGTTTG TTTTTGCAGG TTGCCACCAT TGtctGGCTG

301   GTCGGCTGCC TCGTGTATTC AGTTAAAGTG ATTTGGGGGT AA
```

This corresponds to the amino acid sequence <SEQ ID 112; ORF 023.ng>:

```
g023.pep
    1   MVERKLTGAH YGLRDWVMQR ATAVIMLIYT VALLVVLFAL PKEYPAWQAF

51   FSQAWVKVFT QVSFIAVFLH AWVGIRDLWM DYIKPFGVRL FLQVATIVWL

101   VGCLVYSVKV IWG*
```

The following partial DNA sequence was identified in *N. meningitidis* <SEQ ID 113>:

```
m023.seq
    1   ATGGTAGAAC GTAAATTGAC CGGTGCCCAT TACGGTTTGC GCGATTGGGT

51   GATGCAACGT GCGACTGCGG TTATTATGTT GATTTATACC GTTGCACTTT

101   TAGTGGTTCT ATTTTCCCTG CCTAAAGAAT ATTCGGCATG GCAGGCATTT

151   TTTAGTCAAA CTTGGGTAAA AGTATTTACC CAAGTGAGCT TCATCGCCGT

201   ATTCTTGCAC GCTTGGGTGG GTATCCGCGA TTTGTGGATG GACTATATCA

251   AACCCTTCGG CGTGCGTTTG TTTTTGCAGG TTGCCACCAT CGTTTGGCTG

301   GTCGGCTGTC TCGTGTATTC AGTTAAAGTG ATTTGGGGGT AA
```

This corresponds to the amino acid sequence <SEQ ID 114; ORF 023>:

```
m023.pep
    1   MVERKLTGAH YGLRDWVMQR ATAVIMLIYT VALLVVLFSL PKEYSAWQAF

51   FSQTWVKVFT QVSFIAVFLH AWVGIRDLWM DYIKPFGVRL FLQVATIVWL

101   VGCLVYSVKV IWG*
```

The following partial DNA sequence was identified in *N. meningitidis* <SEQ ID 115>:

```
a023.seq
    1   ATGGTAGAAC GTAAATTGAC CGGTGCCCAT TACGGTTTGC GGGATTGGGC

51   GATGCAACGT GCGACCGCGG TTATTATGTT GATTTATACC GTTGCACTTT

101   TAGTGGTTCT ATTTGCTCTG CCTAAAGAAT ATTCGGCATG GCAGGCATTT

151   TTTAGTCAAA CTTGGGTAAA AGTATTTACC CAAGTGAGCT TCATCGCCGT

201   ATTCTTGCAC GCTTGGGTGG GTATCCGCGA TTTGTGGATG GACTATATNA

251   AACCCTTCGG CGTGCGTTTG TTTTTGCAGG TTGCCACCAT CGTCTGGCTG

301   GTCGGCTGCT TGGTGTATTC AATTAAAGTA ATTTGGGGGT AA
```

This corresponds to the amino acid sequence <SEQ ID 116; ORF 023.a>:

```
a023.pep
    1   MVERKLTGAH YGLRDWAMQR ATAVIMLIYT VALLVVLFAL PKEYSAWQAF

51   FSQTWVKVFT QVSFIAVFLH AWVGIRDLWM DYXKPFGVRL FLQVATIVWL

101   VGCLVYSIKV IWG*
``` m023/a023 96.5% identity over a 113 aa overlap

```
                 10         20         30         40         50         60
    m023.pep MVERKLTGAHYGLRDWVMQRATAVIMLIYTVALLVVLFSLPKEYSAWQAFFSQTWVKVFT
             ||||||||||||||:||||||||||||||||||||||:||||||||||||||||||||||
    a023     MVERKLTGAHYGLRDWAMQRATAVIMLIYTVALLVVLFALPKEYSAWQAFFSQTWVKVFT
                 10         20         30         40         50         60
                 70         80         90        100        110
    m023.pep QVSFIAVFLHAWVGIRDLWMDYIKPFGVRLFLQVATIVWLVGCLVYSVKVIWGX
             |||||||||||||||||||||||||||||||||||||||||||||||:|||||
    a023     QVSFIAVFLHAWVGIRDLWMDYXKPFGVRLFLQVATIVWLVGCLVYSIKVIWGX
                 70         80         90        100        110
```

Computer analysis of this amino acid sequence gave the following results:
Homology with a Predicted ORF from *N. gonorrhoeae*
ORF 023 shows 97.3% identity over a 113 aa overlap with a predicted ORF (ORF 023.ng) from *N. gonorrhoeae*:

```
g023/m023
                 10         20         30         40         50         60
    g023.pep MVERKLTGAHYGLRDWVMQRATAVIMLIYTVALLVVLFALPKEYPAWQAFFSQAWVKVFT
             |||||||||||||||||||||||||||||||||||||||:|||| |||||||:||||||
    m023     MVERKLTGAHYGLRDWVMQRATAVIMLIYTVALLVVLFSLPKEYSAWQAFFSQTWVKVFT
                 10         20         30         40         50         60
                 70         80         90        100        110
    g023.pep QVSFIAVFLHAWVGIRDLWMDYIKPFGVRLFLQVATIVWLVGCLVYSVKVIWGX
             ||||||||||||||||||||||||||||||||||||||||||||||||||||||
    m023     QVSFIAVFLHAWVGIRDLWMDYIKPFGVRLFLQVATIVWLVGCLVYSVKVIWGX
                 70         80         90        100        110
```

The following partial DNA sequence was identified in *N. gonorrhoeae* <SEQ ID 117>:

```
g025.seq
    1   ATGTTGAAAC AAAcgACACT TTTGGCAGCT TGTACCGCCG TTGCCGCTCT

51   GTTGGGCGGT TGcgCCACCC AACAGCCTGC TccTGTCATT GCAGGCAATT

101   CAGGTATGCA GACCGTATCG TCTGCGCCGG TTTACAATCC TTATGGCGCA

151   ACGCCGTACA ATGCCGCTCC TGCCGCCAac gatgcGCCgT ATGTGCCGCC

201   CGTGCAAact gcgccggttT ATTCGCCTCC TGCTTATGTT CCGCcgtCTG

251   CACCTGCCGT TTCGGgtaca tatgtTCCTT CTTACGCACC CgtcgACATC 301   aacgCGGCGa cgCataCTAT TGTGCGTGGC GACACgGtgt acaACATTTc 351   caaAcgCtac CATATCTCTC AAGACGATTT CCGTGCGTGG AACGGCATGA 401   CCGACAATAC GTTGAGCATC GGTCAGATTG TTAAAGTCAA ACCGGCaggA

451   TATGCCGCAC CGAAAACCGC AGCCGTAGAA AGCAGGCCCG CCGTACCGGC

501   TGCCGCGCAA ACCCCTGTGA AACCCGCCGC gcaACCGCCC GTTCAGTCCG

551   CGCCGCAACC TGCCGCGCCC GCTGCGGAAA ATAAAGCGGT TCCCGCCCCC

601   GCGCCCGCCC CGCAATCTCC TGCCGCTTCG CCTTCCGGCA CGCGTTCGGT
```

-continued

```
 651   CGGCGGCATT GTTTGGCAGC GTCCGACCCA AGGTAAAGTG GTTGCCGATT

701   TCGGCGGCGG CAACAAGGGT GTCGATATTG CCGGCAATGC CGGACAACCC

751   GTTTTGGCGG CGGCTGACGG CAAAGTGGTT TATGCCGGTT CAGGTTTGAG

801   GGGATACGGA AACTTGGTCA TCATCCAGCA CAATTCCTCT TTCCTGACCG

851   CGTACGGGCA CAACCAAAAA TTGCTGGTCG GCGAAGGTCA GCAGGTCAAA

901   CGCGGTCAGC AGGTTGCTTT GATGGGTAAT ACCGATGCTT CCAGAACGCA

951   GCTTCATTTC GAGGTGCGTC AAAACGGCAA ACCGGTTAAC CCGAACAGCT

1001   ATATCGCGTT CTGA
```
15

This corresponds to the amino acid sequence <SEQ ID 118; ORF 025.ng>:

```
g025.pep
   1   MLKQTTLLAA CTAVAALLGG CATQQPAPVI AGNSGMQTVS SAPVYNPYGA

51   TPYNAAPAAN DAPYVPPVQT APVYSPPAYV PPSAPAVSGT YVPSYAPVDI

101   NAATHTIVRG DTVYNISKRY HISQDDFRAW NGMTDNTLSI GQIVKVKPAG

151   YAAPKTAAVE SRPAVPAAAQ TPVKPAAQPP VQSAPQPAAP AAENKAVPAP

201   APAPQSPAAS PSGTRSVGGI VWQRPTQGKV VADFGGGNKG VDIAGNAGQP

251   VLAAADGKVV YAGSGLRGYG NLVIIQHNSS FLTAYGHNQK LLVGEGQQVK

301   RGQQVALMGN TDASRTQLHF EVRQNGKPVN PNSYIAF*
```

The following partial DNA sequence was identified in *N. meningitidis* <SEQ ID 119>:

```
m025.seq (partial)
   1   ..GTGCCGCCGG TGCAAAGCGC GCCGGTTTAT ACGCCTCCTG CTTATGTTCC

51   GCCGTCTGCA CCTGCCGTTT CGGGTACATA CGTTCCTTCT TACGCACCCG

101   TCGACATCAA CGCGGCGACG CATACTATTG TGCGCGGCGA CACGGTGTAC

151   AACATTTCCA AACGCTACCA TATCTCTCAA GACGATTTCC GTGCGTGGAA

201   CGGCATGACC GACAATACGT TGAGCATCGG TCAGATTGTT AAAGTCAAAC

251   CGGCAGGATA TGCCGCACCG AAAGCCGCAG CCGTAAAAAG CAGGCCCGCC

301   GTACCGGCTG CCGCGCAACC GCCCGTACAG TCCGCACCCG TCGACATTAA

351   CGCGGCGACG CATACTATTG TGCGCGGCGA CACGGTGTAC AACATTTCCA

401   AACGCTACCA TATCTCTCAA GACGATTTCC GTGCGTGGAA CGGCATGACC

451   GACAATATGT TGAGCATCGG TCAGATTGTT AAAGTCAAAC CGGCAGGATA

501   TGCCGCACCG AAAACCGCAG CCGTAGAAAG CAGGCCCGCC GTACCGGCTG

551   CCGTGCAAAC CCCTGTGAAA CCCGCCGCGC AACCGCCTGT GCAGTCCGCG

601   CCGCAACCTG CCGCGCCCGC TGCGGAAAAT AAAGCGGTTC CCGCGCCCGC

651   CCCGCAATCT CCTGCCGCTT CGCCTTCCGG CACGCGTTCG GTCGGCGGCA

701   TTGTTTGGCA GCGTCCGACG CAAGGTAAAG TGGTTGCCGA TTTCGGCGGC

751   AACAACAAGG GTGTCGATAT TGCCGGTAAT GCGGACAGCC CGTTTTGGC

801   GGCGGCTGAC GGCAAAGTGG TTTATGCCGG TTCAGGTTTG AGGGGATACG

851   GAAACTTGGT CATCATCCAG CATAATTCTT CTTTCCTGAC CGCATACGGG

901   CACAACCAAA AATTGCTGGT CGGCGAGGGG CAGCAGGTCA AACGCGGTCA
```

-continued

```
 951   GCAGGTTGCT TTGATGGGCA ATACCGATGC TTCCAGAACG CAGCTTCATT
1001   TCGAGGTGCG TCAAAACGGC AAACCGGTTA ACCCGAACAG CTATATCGCG
1051   TTCTGA
```

This corresponds to the amino acid sequence <SEQ ID 110; ORF 025>:

```
m025.pep (partial)
   1    ..VPPVQSAPVY TPPAYVPPSA PAVSGTYVPS YAPVDINAAT HTIVRGDTVY
  51    NISKRYHISQ DDFRAWNGMT DNTLSIGQIV KVKPAGYAAP KAAAVKSRPA
 101    VPAAAQPPVQ SAPVDINAAT HTIVRGDTVY NISKRYHISQ DDFRAWNGMT
 151    DNMLSIGQIV KVKPAGYAAP KTAAVESRPA VPAAVQTPVK PAAQPPVQSA
 201    PQPAAPAAEN KAVPAPAPQS PAASPSGTRS VGGIVWQRPT QGKVVADFGG
 251    NNKGVDIAGN AGQPVLAAAD GKVVYAGSGL RGYGNLVIIQ HNSSFLTAYG
 301    HNQKLLVGEG QQVKRGQQVA LMGNTDASRT QLHFEVRQNG KPVNPNSYIA
 351    F*
```

25

The following partial DNA sequence was identified in *N. meningitidis* <SEQ ID 111>:

```
a025.seq
   1    ATGTTGACAC CAACAACACT TTAGGTAGCT TGTACCGCCC TTGCCGCTCA
  51    GTTGGGCGGA TGCCCCACCC AACACCCTTC TCCTGTCATT GCAGGCAATT
 101    CAGGTATGCA GACCGTACCG TCTGCGCCGG TTTACAATCC TTATGGCGCA
 151    ACGCCGTACA ATGCCGCTCC TGCCGCCAAC GATGCGCCGT ATGTGCCGCC
 201    GGTGCAAAGC GCGCCGGTTT ATANGCCTCC TGCTTATGTT CCGCCGTCTG
 251    CACCTGCCGT TTCGGGTACA TACGTTCCTT CTTACGCANC CGTCGACATC
 301    AACGCGGCGA CCCATACTAT TGTGCGCGGC GACACCGTGT ACAAGATTTC
 351    CAAATGCTAC CATATCTCTC AAGACGATTT CCGTGCGTGG AACGGCATGA
 401    CCGACAATAC GTTGAGCATC GGTCAGATTG TTAAAGTCAA ACCGGCAGGA
 451    TATGCCGCAC CGAAAGCCGC AGCCGTAAAA AGCAGGCCCG CCGTACCGGC
 501    TGCCGCGCAA CCGCTCGTAC AGTCCGCACC CGTCGACATC AACGCGGCGA
 551    CGCATACTAT TGTGCGCGGC GACACGGTGT ACAACATTTC CAAACGCTAC
 601    CATATCTCTC AAGACGATTT CCGTGCGTGG AACGGCATGA CCGACAATAC
 651    GTTGAGCATC GGTCAGATTG TTAAAGTCAA ACCGGCAGGA TATGCCGCAC
 701    CGAAAGCCGC AGCCGTAAAA AGCAGGCCCG CCGTACCGGC TGCCGTGCAA
 751    ACCCCTGTGA AACCCGCCGC GCAACCGCCT GTGCAGTCCG CGCCGCAACC
 801    TGCCGCGCCC GCTGCGGAAA ATAAAGCGGT TCCCGCGCCC GCCCCGCAAT
 851    CTCCTGCCGC TTCGCCTTCC GGCACGCGTT CGGTCGGCGG CATTGTTTGG
 901    CAGCGTCCGA CGCAAGGTAA AGTGGTTGCC GATTTCGGCG GCAACAACAA
 951    GGGTGTCGAT ATTGCAGGAA ATGCGGGACA GCCCGTTTTG GCGGCGGCTG
1001    ACGGCAAAGT GGTTTATGCA GGTTCCGGTT TGAGGGGATA CGGCAATTTG
1051    GTCATCATCC AGCATAATTC TTCCTTCCTG ACCGCATACG GCACAACCA
1101    AAAATTGCTG GTCGGCGAAG GCCAGCAGGT CAAACGCGGG CAGCAGGTCG
```

```
1151  CTTTGATGGG CAATACCGAG GCTTCTAGAA CGCAGCTTCA TTTCGAGGTG

1201  CGGCAAAACG GCAAACCGGT TAATCCGAAC AGCTATATCG CGTTCTGA
```

This corresponds to the amino acid sequence <SEQ ID 112; ORF 025.a>:

```
a025.pep
    1   MLTPTTL*VA CTALAAQLGG CPTQHPSPVI AGNSGMQTVP SAPVYNPYGA

51   TPYNAAPAAN DAPYVPPVQS APVYXPPAYV PPSAPAVSGT YVPSYAXVDI

101   NAATHTIVRG DTVYKISKCY HISQDDFRAW NGMTDNTLSI GQIVKVKPAG

151   YAAPKAAAVK SRPAVPAAAQ PLVQSAPVDI NAATHTIVRG DTVYNISKRY

201   HISQDDFRAW NGMTDNTLSI GQIVKVKPAG YAAPKAAAVK SRPAVPAAVQ

251   TPVKPAAQPP VQSAPQPAAP AAENKAVPAP APQSPAASPS GTRSVGGIVW

301   QRPTQGKVVA DFGGNNKGVD IAGNAGQPVL AAADGKVVYA GSGLRGYGNL

351   VIIQHNSSFL TAYGHNQKLL VGEGQQVKRG QQVALMGNTE ASRTQLHFEV

401   RQNGKPVNPN SYIAF*
``` m025/a025 97.4% identity over a 351 aa overlap

```
                          10         20         30
m025.pep                  VPPVQSAPVYTPPAYVPPSAPAVSGTYVPS
                          |||||||||:||||||||||||||||||||
a025      GMQTVPSAPVYNPYGATPYNAAPAANDAPYVPPVQSAPVYXPPAYVPPSAPAVSGTYVPS
              40         50         60         70         80         90

40         50         60         70         80         90
m025.pep  YAPVDINAATHTIVRGDTVYNISKRYHISQDDFRAWNGMTDNTLSIGQIVKVKPAGYAAP
          || |||||||||||||||:||| |||||||||||||||||||||||||||||||||||||
a025      YAXVDINAATHTIVRGDTVYKISKCYHISQDDFRAWNGMTDNTLSIGQIVKVKPAGYAAP
             100        110        120        130        140        150

100        110        120        130        140        150
m025.pep  KAAAVKSRPAVPAAAQPPVQSAPVDINAATHTIVRGDTVYNISKRYHISQDDFRAWNGMT
          ||||||||||||||||| ||||||||||||||||||||||||||||||||||||||||||
a025      KAAAVKSRPAVPAAAQPLVQSAPVDINAATHTIVRGDTVYNISKRYHISQDDFRAWNGMT
             160        170        180        190        200        210

160        170        180        190        200        210
m025.pep  DNMLSIGQIVKVKPAGYAAPKTAAVESRPAVPAAVQTPVKPAAQPPVQSAPQPAAPAAEN
          || ||||||||||||||||||:||:|||||||||||||||||||||||||||||||||||
a025      DNTLSIGQIVKVKPAGYAAPKAAAVKSRPAVPAAVQTPVKPAAQPPVQSAPQPAAPAAEN
             220        230        240        250        260        270

220        230        240        250        260        270
m025.pep  KAVPAPAPQSPAASPSGTRSVGGIVWQRPTQGKVVADFGGNNKGVDIAGNAGQPVLAAAD
          ||||||||||||||||||||||||||||||||||||||||||||||||||||||||||||
a025      KAVPAPAPQSPAASPSGTRSVGGIVWQRPTQGKVVADFGGNNKGVDIAGNAGQPVLAAAD
             280        290        300        310        320        330

280        290        300        310        320        330
m025.pep  GKVVYAGSGLRGYGNLVIIQHNSSFLTAYGHNQKLLVGEGQQVKRGQQVALMGNTDASRT
          |||||||||||||||||||||||||||||||||||||||||||||||||||||||:||||
a025      GKVVYAGSGLRGYGNLVIIQHNSSFLTAYGHNQKLLVGEGQQVKRGQQVALMGNTEASRT
             340        350        360        370        380        390

340        350
m025.pep  QLHFEVRQNGKPVNPNSYIAFX
          ||||||||||||||||||||||
a025      QLHFEVRQNGKPVNPNSYIAFX
             400        410
```

Computer analysis of this amino acid sequence gave the following results:

Homology with a Predicted ORF from *N. gonorrhoeae*

ORF 025 shows 75.6% identity over a 353 aa overlap with a predicted ORF (ORF 025.ng) from *N. gonorrhoeae*:

```
m025/g025

10        20        30
m025.pep                     VPPVQSAPVYTPPAYVPPSAPAVSGTYVPS
                             |||||:||||:||||||||||||||||||
g025     GMQTVSSAPVYNPYGATPYNAAPAANDAPYVPPVQTAPVYSPPAYVPPSAPAVSGTYVPS
         40        50        60        70        80        90

40        50        60        70        80        90
m025.pep YAPVDINAATHTIVRGDTVYNISKRYHISQDDFRAWNGMTDNTLSIGQIVKVKPAGYAAP
         ||||||||||||||||||||||||||||||||||||||||||||||||||||||||||||
g025     YAPVDINAATHTIVRGDTVYNISKRYHISQDDFRAWNGMTDNTLSIGQIVKVKPAGYAAP
              100       110       120       130       140       150

100       110       120       130       140       150
m025.pep KAAAVKSRPAVPAAAQPPVQSAPVDINAATHTIVRGDTVYNISKRYHISQDDFRAWNGMT
         |
g025     K-----------------------------------------------------------

160       170       180       190       200       210
m025.pep DNMLSIGQIVKVKPAGYAAPKTAAVESRPAVPAAVQTPVKPAAQPPVQSAPQPAAPAAEN
                              ||||||||||||:|||||||||||||||||||||||||
g025     --------------------TAAVESRPAVPAAAQTPVKPAAQPPVQSAPQPAAPAAEN
                              160       170       180       190

220       230       240       250       260
m025.pep KAVPAPAP--QSPAASPSGTRSVGGIVWQRPTQGKVVADFGGNNKGVDIAGNAGQPVLAA
         ||||||||  ||||||||||||||||||||||||||||:|||||||||||||||||||
g025     KAVPAPAPAPQSPAASPSGTRSVGGIVWQRPTQGKVVADFGGGNKGVDIAGNAGQPVLAA
             200       210       220       230       240       250

270       280       290       300       310       320
m025.pep ADGKVVYAGSGLRGYGNLVIIQHNSSFLTAYGHNQKLLVGEGQQVKRGQQVALMGNTDAS
         ||||||||||||||||||||||||||||||||||||||||||||||||||||||||||||
g025     ADGKVVYAGSGLRGYGNLVIIQHNSSFLTAYGHNQKLLVGEGQQVKRGQQVALMGNTDAS
             260       270       280       290       300       310

330       340       350
m025.pep RTQLHFEVRQNGKPVNPNSYIAFX
         ||||||||||||||||||||||||
g025     RTQLHFEVRQNGKPVNPNSYIAFX
             320       330
```

The following partial DNA sequence was identified in *N. gonorrhoeae* <SEQ ID 113>:

```
g031.seq
   1  ATGGTGTCCC TCCGCTTCAG ATTCGGCAAC CACTTTAAAC GCCGACATTC

51  TGACAATTTC CTTTTCCGCC AGCCAAATAT CATGCGTATC TTTCGGTTCG

101  GGCTTGTTGG CATGGCAAC  CTTCAACAGC CGCGCCATCA CAGGAATCGT

151  CGTTCCCTGA ATCAGCAGCG ACAGCACCAC CACGGCAAAC GCCACATCAA

201  ACAGCAGGTG CGAATTGGGA ACGCCCATCA CCAGCGGCAT CATCGCCAGC

251  GAAATCGGTA CGGCTCCTCG CAAGCCCAAC CAACTGATAT ACGCCTTTTC

301  ACGCAGGCTG TAATTGAATT CCACAAACC  GCCGAACACT GCCAGCGGAC

351  GCGCGACCAG CATCAGGAAC GCCGCAATCG CCAAGGCTTC CGCCGCCCTG

401  TCCAACACGC CGGCGGGAGA AACCAGCAGA CCGAGCATGA CGAACAAAGT

451  TGCCTGCGCC AGCCAAGCCA AACCGTCCAT CACACGCAAA ACGTGTTCCG

501  TcgcACGGTT GCGCTGGTTA CCGACAATGA TGCCGGCAAG GTAAACCGCC

551  AAAAAGCCGC TGCCGCCTAT GGTATTGGTA ACGCAAACA  CAAGCAGCCC

601  GCCCGACACA ATCATCAGCG CGTACAGACC TTCCGtacac acctccaatt 651  cccaatcaac gtcatagctg tctcccgtgt taaaatgttc ttcacttcag 701  aatccccccc ttcttcccag cccgaaacct tcatgtgtta naccctgggg 751  tgccccaacg gatttagtaa cctcccaatg actctgcttg tcgccccctt 801  cgcccgcttt ctccttccgg gaaaacttgt tgtcccgtc  ttacattaa
```

This corresponds to the amino acid sequence <SEQ ID 114; ORF 031.ng>:

```
g031.pep
     1   MVSLRFRFGN HFKRRHSDNF LFRQPNIMRI FRFGLVGHGN LQQPRHHRNR

51   RSLNQQRQHH HGKRHIKQQV RIGNAHHQRH HRQRNRYGSS QAQPTDIRLF

101   TQAVIEFPQT AEHCQRTRDQ HQERRNRQGF RRPVQHAGGR NQQTEHDEQS

151   CLRQPSQTVH HTQNVFRRTV ALVTDNDAGK VNRQKAAAAY GIGKRKHKQP

201   ARHNHQRVQT FRTHLQFPIN VIAVSRVKMF FTSESPPSSQ PETFMCXTLG

251   CPNGFSNLPM TLLVAPFARF LLPGKLVVPV LH*
```

The following partial DNA sequence was identified in *N. meningitidis* <SEQ ID 115>:

```
m031.seq (partial)
     1   ...CGCCTGAAGC ACGGTGTCGG ACTGCATTTC TATTCGGCTA TACGCCTTTT

51      CACGCAGGCT GTAATTGAAT TTCCACAAAC CGCCGAACAC TGCCGACGGA

101      CGCGCGACCA GCATCAGGAA CGCCGCAATC GCCAAgGCTT CCGCCGCCCT

151      GTCCAACACG TTGGCAGGAG AAACCAGCAG CAAAGGCATT CCCAAACGTG

201      CGGACAAAGT GGTCGAAACC ACGCTCAGAA ACAACAGTGC GCCACCCGGC

251      AG....
```

This corresponds to the amino acid sequence <SEQ ID 116; ORF 031>:

```
m031.pep (partial)
    1    ...RLKHGVGLHF YSAIRLFTQA VIEFPQTAEH CRRTRDQHQE RRNRQGFRRP

51       VQHVGRRNQQ QRHSQTCGQS GRNHAQKQQC ATRQ....
```

The following partial DNA sequence was identified in *N. meningitidis* <SEQ ID 117>:

```
a031.seq
     1   ATACGCCTTT TCACGCAGGC TGTAATTGAA TTTCCACAAA CCGCCGAACA

51   CTGCCGGCGG ACGCGCGACC AGCATCAGGA ACGCCGCAAT CGCCAAGGCT

101   TCCGCCGCCC CGTCCAACAC GTTGGCAGGA GAAACCAGCA GCAAAGGCAT

151   TCCCAAACGT GCGGACAAAG TGGTCGAAAC CACGCTCAGA AACAACAGTG

201   CGCCACCCGG CAG
```

This corresponds to the amino acid sequence <SEQ ID 118; ORF 031.a>:

```
a031.pep (partial)
    1    IRLFTQAVIE FPQTAEHCRR TRDQHQERRN RQGFRRPVQH VGRRNQQQRH

51    SQTCGQSGRN HAQKQQCATR Q
``` m031/a031 100.0% identity over a 71 aa overlap

```
                      10        20        30        40        50        60
m031.pep   RLKHGVGLHFYSAIRLFTQAVIEFPQTAEHCRRTRDQHQERRNRQGFRRPVQHVGRRNQQ
                          |||||||||||||||||||||||||||||||||||||||||||||
a031                      IRLFTQAVIEFPQTAEHCRRTRDQHQERRNRQGFRRPVQHVGRRNQQ
                                  10        20        30        40
```

```
                            70         80
m031.pep    QRHSQTCGQSGRNHAQKQQCATRQ
            |||||||||||||||||||||||
a031        QRHSQTCGQSGRNHAQKQQCATRQ
                    50        60        70
```

Computer analysis of this amino acid sequence gave the following results:
Homology with a Predicted ORF from *N. gonorrhoeae*
ORF 031 shows 60.0% identity over a 85 aa overlap with a predicted ORF (ORF 031.ng) from *N. gonorrhoeae*:

```
m031/g031
                                                  10         20         30
m031.pep                                    RLKHGVGLHFYSAIRLFTQAVIEFPQTAEH
                                            |  ::|  :     :  |||||||||||||||
g031        NQQRQHHHGKRHIKQQVRIGNAHHQRHHRQRNRYGSSQAQPTDIRLFTQAVIEFPQTAEH
                   60        70        80        90       100        10
                  40         50         60         70         80
m031.pep    CRRTRDQHQERRNRQGFRRPVQHVGRRNQQQRHS-QTCGQSGRNHAQKQQCATRQ
            |:|||||||||||||||||||||||:|  ||||   :|:  |:|   ::    :::   |   :  |:
g031        CQRTRDQHQERRNRQGFRRPVQHAGGRNQQTEHDEQSCLRQPSQTVHHTQNVFRRTVALV
                  120        130        140        150        160        170 g031        TDNDAGKVNRQKAAAAYGIGKRKHKQPARHNHQRVQTFRTHLQFPINVIAVSRVKMFFTS
                  180        190        200        210        220        230
```

The following partial DNA sequence was identified in *N. gonorrhoeae* <SEQ ID 119>:

```
g032.seq
    1   ATGCGGCGAA ACGTGCCTGC CGTCGCCGTA TTGCGCCGCC CACGATTCGA

51   GGCGTTTTTG GATTTGGCGT TGGCTCAGGC GCGTGCCGTT CCTGCCGGTA

101   AACAGGGCTT TGCCGTCCGA TGCCGTCTGA CGCAGCGGCA GATAGTTTTT

151   CAAGGCTTCC ACGCTTTTGC CGGTCAGCGG AACCTGACGC TGCTTGCGCC

201   CTTTGCCGGT AACGTGTACC CACGCTTCGT CCAAATATAC ATCATCTGCA

251   TTCAAGCCGT GTATCTCGCT CACGCGCAAA CCGCTGCCGT ACATCAGCTC

301   GAACAGCGCG TGGTCGCGCA CCGCCAGCGG GTCGCCGCCG TCCACGGGCA

351   AATCCAACAT CCGGTTCAGC CATTCCTGCG GCAGGGCTTT GGGTACGCGC

401   TCGGGCTGCT TCGGCGGTTT GATGTCGGCG GTCGGGTCGG CGCGCATCAG

451   CCCGCGTTTG ACCAGCCAGG CGCAATACTG CCGCCACGCC GACAGCTTGC

501   GCGCCAGCGT CCGACCGTCC AAACCGCGCT GCGACAGCCG CCGCAACGCC

551   GccgTAAAAT CGCGCCGCGA CAAGTCCTGC GGCACGCcgc ctgcaTCTTC

601   AGACGGCATT TGTGCCAACA GTGCAAACAG TTCTTCCAAA TCGCGCCGGT

651   ATGCCGCAAC CGTGTGCTCC GACTTGCCCT CGCGCACGAT GTTTTCCAAA

701   TAAGCGTCAA AATacgccgC AAACccgTCC AAAACCATAA CCGTCCCACA

751   CAAATATCAA AAAACCAGTG A
```

This corresponds to the amino acid sequence <SEQ ID 110; ORF 032.ng>:

g032.pep
1 MRRNVPAVAV LRRPRFEAFL DLALAQARAV PAGKQGFAVR CRLTQRQIVF

51 QGFHAFAGQR NLTLLAPFAG NVYPRFVQIY IICIQAVYLA HAQTAAVHQL

101 EQRVVAHRQR VAAVHGQIQH PVQPFLRQGF GYALGLLRRF DVGGRVGAHQ

151 PAFDQPGAIL PPRRQLARQR PTVQTALRQP PQRRRKIAPR QVLRHAACIF

201 RRHLCQQCKQ FFQIAPVCRN RVLRLALAHD VFQISVKIRR KPVQNHNRPT

251 QISKNQ*

The following partial DNA sequence was identified in *N. meningitidis* <SEQ ID 111>:

m032.seq (partial)
1 ATGCGGCGAA ACGTGCmTGC mGTCGCCGTT kTGCGCCGCC CATTGCGCCA

51 AACGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAGGGCTTCC ACGCTTTTGC CGACCAGCGG CACCTGCCGC TgTT.GCGCC

201 CTTTGCCGAT AAcGTGTACC CACGCyTCGT CCAAATAGAC ATCATCTGCA

251 TTCAAGCCGT GTATCTCGCT CACGCGCAAA CCGCTGCCGT ACATCAGTTC

301 GAACAGGGCG TGGTCGCGCA CCGCCAGCGG GTCGCCGCCG TCCACGGGCA

351 AATCCAGCAT CCGGTTCAGC CATTCCTGCG GCAGGGCTTT GGGTACGCGC

401 TCGGGCTGCT TCGGCGGTTT GATGTCGGCG GTCGGGTCGG CGTGCATCAG

451 GCCGCGCTTT ACCAGCCAAA CGCAATACTG CCGCCAAGAC GAAAGCTTGC

501 GAGCCAGCGT CCGTTCCCCC AAACCGCG...

This corresponds to the amino acid sequence <SEQ ID 112; ORF 032>:

m032.pep (partial)
1 MRRNVXAVAV XRRPLRQTFL DLALAQARAV PAGKQGFAVR CRLTQRQIVF

51 QGFHAFADQR HLPLXAPFAD NVYPRXVQID IICIQAVYLA HAQTAAVHQF

101 EQGVVAHRQR VAAVHGQIQH PVQPFLRQGF GYALGLLRRF DVGGRVGVHQ

151 AALYQPNAIL PPRRKLASQR PFPQTA...

The following partial DNA sequence was identified in *N. meningitidis* <SEQ ID 113>:

a032.seq
1 ATGCGGCGAA ACGTGCCTGC CGTCGCCGTT TTGCGCCGCC CATTGCGCCA

51 AACGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAGGGCTTCC ACGCTTTTGC CGGTCAGCGG AACCTGCCGC TGCTTGCGTC

201 CTTTGCCGGT AACGTGTACC CACGCCTCGT CCAAATATAC ATCATCTGCA

251 TTCAAGCCGT GTATCTCGCT CACGCGCAAA CCGCTGCCGT ACATCAGTTC

301 GAACAGCGCG TGATCGCGCA CCGCCAGCGG GTCGCCGCCG TCCACGGGCA

351 AATCCAGCAT CCGGTTCAGC CATTCCTGCG GCAGGGCTTT GGGTACGCGC

401 TCGGGCTGCT TCGGCGGTTT GATGTCGGCG GTCGGGTCGG TATGCAGCAG

451 ACCGCGTTTG ACCAGCCAGG CGCAATACTG CCGCCAAGAC GACAGCTTGC

-continued

```
501  GCGCCAGCGT CCGCGCATTC AAACCGCGCT GCGACAGCCG CCGCAACGCC

551  GCCGTAAAAT CGCGCTGCGA CAAGCCCTGC GGCACGCCGC CTGCATCTTC

601  AGACGGCATT TGTGCCAACA GCGCAAACAG TTCTTCCAAA TCGCGCCGGT

651  ATGCCGCCAC CGTGTGCTCC GACTTGCCCT CGCGCACGAT GTTTTCCAAA

701  TAAGCGTCAA AATGCGCCGC AAACCCGTCC AAAACCATAA CCGCCCCACA

751  CAAATATCAA AAAAACAGTG A
```

This corresponds to the amino acid sequence <SEQ ID 114; ORF 032.a>:

```
a032.pep
  1  MRRNVPAVAV LRRPLRQTFL DLALAQARAV PAGKQGFAVR CRLTQRQIVF

51  QGFHAFAGQR NLPLLASFAG NVYPRLVQIY IICIQAVYLA HAQTAAVHQF

101  EQRVIAHRQR VAAVHGQIQH PVQPFLRQGF GYALGLLRRF DVGGRVGMQQ

151  TAFDQPGAIL PPRRQLARQR PRIQTALRQP PQRRRKIALR QALRHAACIF

201  RRHLCQQRKQ FFQIAPVCRH RVLRLALAHD VFQISVKMRR KPVQNHNRPT

251  QISKKQ*
``` m032/a032 88.1% identity over a 176 aa overlap

```
                10         20         30         40         50         60
m032.pep  MRRNVXAVAVXRRPLRQTFLDLALAQARAVPAGKQGFAVRCRLTQRQIVFQGFHAFADQR
          ||||| ||||  ||||||||||||||||||||||||||||||||||||||||||||| ||
a032      MRRNVPAVAVLRRPLRQTFLDLALAQARAVPAGKQGFAVRCRLTQRQIVFQGFHAFAGQR
                10         20         30         40         50         60

70         80         90        100        110        120
m032.pep  HLPLXAPFADNVYPRXVQIDIICIQAVYLAHAQTAAVHQFEQGVVAHRQRVAAVHGQIQH
          :|||  | || ||||| ||| |||||||||||||||||||| :|||||||||||||||||
a032      NLPLLASFAGNVYPRLVQIYIICIQAVYLAHAQTAAVHQFEQRVIAHRQRVAAVHGQIQH
                70         80         90        100        110        120

130        140        150        160        170
m032.pep  PVQPFLRQGFGYALGLLRRFDVGGRVGVHQAALYQPNAILPPRRKLASQRPFPQTA
          |||||||||||||||||||||||||||:::|:|: ||:|||||||:|| ||| |||
a032      PVQPFLRQGFGYALGLLRRFDVGGRVGMQQTAFDQPGAILPPRRQLARQRPRIQTALRQP
               130        140        150        160        170        180 a032      PQRRRKIALRQALRHAACIFRRHLCQQRKQFFQIAPVCRHRVLRLALAHDVFQISVKMRR
               190        200        210        220        230        240
```

Computer analysis of this amino acid sequence gave the following results:
Homology with a Predicted ORF from *N. gonorrhoeae*
ORF 032 shows 86.4% identity over a 176 aa overlap with a predicted ORF (ORF 032.ng) from *N. gonorrhoeae*:

```
m032/g032
                10         20         30         40         50         60
m032.pep  MRRNVXAVAVXRRPLRQTFLDLALAQARAVPAGKQGFAVRCRLTQRQIVFQGFHAFADQR
          ||||| ||||  |||   :::||||||||||||||||||||||||||||||||||||| ||
g032      MRRNVPAVAVLRRPRFEAFLDLALAQARAVPAGKQGFAVRCRLTQRQIVFQGFHAFAGQR
                10         20         30         40         50         60

70         80         90        100        110        120
m032.pep  HLPLXAPFADNVYPRXVQIDIICIQAVYLAHAQTAAVHQFEQGVVAHRQRVAAVHGQIQH
          :|  |||| |||||| ||| |||||||||||||||||||:|| |||||||||||||||||
g032      NLTLLAPFAGNVYPRFVQIYIICIQAVYLAHAQTAAVHQLEQRVVAHRQRVAAVHGQIQH
                70         80         90        100        110        120
```

```
                130         140         150         160         170
m032.pep   PVQPFLRQGFGYALGLLRRFDVGGRVGVHQAALYQPNAILPPRRKLASQRPFPQTA
           ||||||||||||||||||||||||||||:||  |: ||:||||||||:|| ||| |||
g032       PVQPFLRQGFGYALGLLRRFDVGGRVGAHQPAFDQPGAILPPRRQLARQRPTVQTALRQP
                130         140         150         160         170         180 g032       PQRRRKIAPRQVLRHAACIFRRHLCQQCKQFFQIAPVCRNRVLRLALAHDVFQISVKIRR
                190         200         210         220         230         240
```

The following partial DNA sequence was identified in *N. gonorrhoeae* <SEQ ID 115>:

```
g033.seq
   1  ATGGCGGCGG CGGACAAACT CTTGGGCGGC GACCGCCGCA GCGTCGCCAT
  51  CATCGGAGAC GGCGCGATGA CGGCGGGGCA GGCGTTTGAA GCCTTGAATT
 101  GCGCGGGCGA TATGGATGTG GATTTGCTGG TCGTCCTCAA CGACAACGAA
 151  ATGTCGATTT CCCCCAACGT CGGCGCGTTG CCCAAATATC TTGCCAGCAA
 201  CGTCGTGCGC GATATGCACG GACTGTTGAG TACCGTCAAA GCGCAAAcgg
 251  GCAAGGTATT AGACAAAATA CCCGGCGCGA TGGagtTTGC CCAAAAAGTC
 301  GAACAcaaaA TCAAAACCCT TGCCGAAGAA GCCGAACACG CCAAACAGTC
 351  GCTGTCGCTG TTTGAAAATT TCGGCTTCCG CTACACCGGC CCCGTGGACG
 401  GACACAACGT CGAGAATCTG GTGGACGTAT TGAAAGACTT GCGCAGCCGC
 451  AAAGGCCCTC AGTTGCTGCA CGTCATCACC AAAAAGGGCA ACGGCTACAA
 501  ACTCGCCGAA AACGACCCcg tcaAATACCA CGCCGTCGCc aACCTGCcta
 551  AAGAAGGCGG GGCGCAAATg ccGTCTGAAA AGAACCCAA GCCCGCCgCc
 601  aaaccgACCT ATACCCAAGT ATTCGGCAAA TGGCTGTGCG ACCGGGCGGC
 651  GGCAGATTCC CGACTGGTTG CGATTACCCC CGCCATGCGC GAGGGCAGCG
 701  GACTGGTGGA GTTTGAACAA CGATTCCCCG ACCGCTATTT CGATGTCGGC
 751  ATCGCCGAGC AGCACGCCGT tacCTTTGCC GGCGGTTTGG CGTGCGAAGG
 801  CATGAAGCCC GTCGTGGCGA TTTATTCCAC CTTTTTACAA CGCGCCTACG
 851  ACCAACTGGT GCACGACATC GCCCTGCAAA ACCTGCCCGT TTTGTTTGCC
 901  GTCGACCGTG CGGGCATCGT CGGCGCGGAC GGTCCGACCC ATGCCGGCTT
 951  GTACGATTTG AGCTTCTTGC GCTGTGTGCC GAACATGATT GTTGCCGCGC
1001  CGAGCGATGA AAACGAATGC CGCCTGCTGC TTTCGACCTG CTATCAGGCG
1051  GATGCGCCCG CCGCCGTCCG CTATCCGCGC GGCACGGGTA CGGGCGCGCC
1101  GGTTTCAGAC GGCATGGAAA CCGTGGAAAT CGGCAAGGGC ATTATCCGCC
1151  GCGAAGGTGA GAAAACCGCC TTcatTGCCT TCGGCAGTAT GGTCGCCACC
1201  GCATTGGCGG TTGCCGAAAA ACTGAACGCC ACCGTCGCCG ATATGCGCTt
1251  cgtcaaacCG ATAGACGAAG AGTTGATTGT CCGCCTTGCC CGAAGCCAcg
1301  accGCATCGT TACCCTTGAA GAAAACGCCG AACAGGGCGG CGCAGGCGGC
1351  GCGGTCTTGG AAGTGTTGGC GAAACACGGC ATCTGCAAAC CCGTTTTGCT
1401  TTTGGGCGTT GCCGATACCG TAACCGAACA CGGCGATCCG AAAAAACTTT
1451  TGGACGATTT GGGTTTGAGT GCCGAAGCGG TGGAACGCCG GGTGCGCGAG
1501  TGGCTGCCGG ACCGTGATGC GGCAAATTAA
```

This corresponds to the amino acid sequence <SEQ ID 116; ORF 033.ng>:

```
g033.pep
     1   MAAADKLLGG DRRSVAIIGD GAMTAGQAFE ALNCAGDMDV DLLVVLNDNE

51   MSISPNVGAL PKYLASNVVR DMHGLLSTVK AQTGKVLDKI PGAMEFAQKV

101   EHKIKTLAEE AEHAKQSLSL FENFGFRYTG PVDGHNVENL VDVLKDLRSR

151   KGPQLLHVIT KKGNGYKLAE NDPVKYHAVA NLPKEGGAQM PSEKEPKPAA

201   KPTYTQVFGK WLCDRAAADS RLVAITPAMR EGSGLVEFEQ RFPDRYFDVG

251   IAEQHAVTFA GGLACEGMKP VVAIYSTFLQ RAYDQLVHDI ALQNLPVLFA

301   VDRAGIVGAD GPTHAGLYDL SFLRCVPNMI VAAPSDENEC RLLLSTCYQA

351   DAPAAVRYPR GTGTGAPVSD GMETVEIGKG IIRREGEKTA FIAFGSMVAT

401   ALAVAEKLNA TVADMRFVKP IDEELIVRLA RSHDRIVTLE ENAEQGGAGG

451   AVLEVLAKHG ICKPVLLLGV ADTVTEHGDP KKLLDDLGLS AEAVERRVRE

501   WLPDRDAAN*
```

The following partial DNA sequence was identified in *N. meningitidis* <SEQ ID 117>:

```
m033.seq
     1   ATGGCGGCGG CAGACAAACT CTTGGGCAGC GACCGCCGCA GCGTCGCCAT

51   CATCGGCGAC GGCGCGATGA CGGCGGGGCA GGCGTTTGAA GCCTTGAATT

101   GCGCaG.CGA TATGGATGTr GATTTGCTrG TCGTCCTCAA CGACAACGAA

151   ATGTCGATTT CCCCCAACGT CGGCGCGCTG CCGAAATACC TTGCCAGCAA

201   CGTCGTGCGC GATATGCACG GCCTGTTGAG TACCGTCAAA GCGCAAACGG

251   GCAAGGTATT AGACAAAATA CCCGGCGCGA TGGAGTTTGC CCAAAAAGTC

301   GAACACAAAA TCAAAACCCT TGCCGAAGAA GCCGAACACG CCAAACAGTC

351   GCTGTCTTTG TTTGAAAACT TCGGCTTCCG CTACACCGGC CCCGTGGACG

401   GACACAACGT CGAAAATCTG GTGGACGTAT TGAAAGACTT GCGCAGCCGC

451   AAAGGCCCTC AGTTGCTGCA CGTCATCACC AAAAAGGGCA ACGGCTACAA

501   ACTCGCCGAA AACGACCCCG TCAAATACCA CGCCGTCGCC AACCTGCCTA

551   AAGAAAGCGC GGCGCAAATG CCGTCTGAAA AAGAACCCAA GCCCGCCGCC

601   AAACCGACCT ATACCCAAGT GTTCGGCAAA TGGCTGTGCG ACCGGGCGGC

651   GGCAGATTCC CGACTGGTTG CGATTACCCC CGCCATGCGC GAGGGCAGCG

701   GCTTGGTTGA GTTTGAACAA CGATTCCCCG ACCGCTATTT CGATGTCGGC

751   ATCGCCGAGC AGCACGCCGT TACCTTTGCC GGCGGTTTGG CTTGCGAAGG

801   GATGAAGCCC GTCGTGGCGA TTTATTCCAC CTTTTTACAA CGCGCCTACG

851   ACCAACTGGT GCACGACATC GCCCTGCAAA ACCTACCCGT TTTGTTTGCC

901   GTCGACCGCG CGGGCATCGT CGGCGCGGAC GGCCCGACCC ATGCCGGTCT

951   GTACGATTTG AGCTTTTTGC GCTGCGTGCC GAACATGATT GTCGCCGCGC

1001   CGAGCGATGA AAACGAATGC CGCCTGTTGC TTTCGACCTG CTATCAGGCA

1051   GACGCGCCCG CCGCCGTCCG CTATCCGCGC GGCACGGGTA CGGGCGCGCC

1101   GGTTTCAGAC GGCATGGAAA CCGTGGAAAT CGGCAAGGGC ATTATCCGCC

1151   GCGAAGGTGA GAAAACCGCA TTCATTGCCT TCGGCAGTAT GGTCGCCCCC

1201   GCATTGGCGG TTGCCGAAAA ACTGAACGCC ACCGTCGCCG ATATGCGCTT

1251   CGTCAAACCG ATAGACGAAG AGTTGATTGT CCGCCTTGCC CGAAGCCACG
```

-continued

```
1301  ACCGCATCGT TACCCTTGAA GAAAACGCCG AACAGGGCGG CGCAGGCGGC

1351  GCGGTGCTGG AAGTATTGGC GAAACACGGC ATCTGCAAAC CCGTTTTGCT

1401  TTTGGGCGTT GCCGATACCG TAACCGGACA CGGCGATCCG AAAAAACTTT

1451  TAGACGATTT GGGCTTGAGT GCCGAAGCGG TGGAACGGCG TGTGCGCGCG

1501  TGGCTGTCGG ATCGGATGC GGCAAATTAA
```

This corresponds to the amino acid sequence <SEQ ID 118; ORF 033>:

```
m033.pep
    1  MAAADKLLGS DRRSVAIIGD GAMTAGQAFE ALNCAXDMDV DLLVVLNDNE

51  MSISPNVGAL PKYLASNVVR DMHGLLSTVK AQTGKVLDKI PGAMEFAQKV

101  EHKIKTLAEE AEHAKQSLSL FENFGFRYTG PVDGHNVENL VDVLKDLRSR

151  KGPQLLHVIT KKGNGYKLAE NDPVKYHAVA NLPKESAAQM PSEKEPKPAA

201  KPTYTQVFGK WLCDRAAADS RLVAITPAMR EGSGLVEFEQ RFPDRYFDVG

251  IAEQHAVTFA GGLACEGMKP VVAIYSTFLQ RAYDQLVHDI ALQNLPVLFA

301  VDRAGIVGAD GPTHAGLYDL SFLRCVPNMI VAAPSDENEC RLLLSTCYQA

351  DAPAAVRYPR GTGTGAPVSD GMETVEIGKG IIRREGEKTA FIAFGSMVAP

401  ALAVAEKLNA TVADMRFVKP IDEELIVRLA RSHDRIVTLE ENAEQGGAGG

451  AVLEVLAKHG ICKPVLLLGV ADTVTGHGDP KKLLDDLGLS AEAVERRVRA

501  WLSDRDAAN*
```

The following partial DNA sequence was identified in *N. meningitidis* <SEQ ID 119>:

```
a033.seq
    1  ATGGCGGCGG CGGACAAACA GTTGGGCAGC GACCGCCGCA GCGTCGCCAT

51  CATCGGCGAC GGCGCGATGA CGGCGGGTCA GGCGTTTGAA GCCTTGAACT

101  GCGCGGGCGA TATGGATGTG GATTTGCTGG TCGTCCTCAA CGACAACGAA

151  ATGTCGATTT CCCCCAACGT CGGTGCGTTG CCCAAATACC TTGCCAGCAA

201  CGTCGTGCGC GATATGCACG GACTGTTGAG TACCGTCAAA GCGCAAACGG

251  GCAAGGTATT AGACAAAATA CCCGGCGCGA TGGAGTTTGC CCAAAAAGTC

301  GAACATAAAA TCAAAACCCT TGCCGAAGAA GCCGAACACG CCAAACAGTC

351  ACTGTCTTTG TTTGAAAACT TCGGCTTCCG CTATACCGGC CCCGTGGACG

401  GACACAACGT CGAAAATCTG GTCGATGTAT TGAAGACCCT GCGCGGACGC

451  AAAGGCCCGC AGCTTCTGCA CGTCATCACC AAAAAGGGCA ACGGCTACAA

501  ACTCGCCGAA AACGATCCCG TCAAATACCA CGCCGTCGCC AACCTGCCTA

551  AAGAAAGCGC GGCGCAAATG CCGTCTGAAA AGAACCCAA GCCCGCCGCC

601  AAACCGACCT ATACCCAAGT GTTCGGCAAA TGGCTGTGCG ACCGGGCGGC

651  GGCAGATTCC CGACTGGTTG CGATTACCCC CGCCATGCGC GAGGGCAGCG

701  GCTTGGTTGA GTTTGAACAA CGATTCCCCG ACCGCTATTT CGATGTCGGC

751  ATCGCCGAGC AGCACGCCGT TACCTTTGCC GGCGGTTTGG CTTGCGAAGG

801  GATGAAGCCC GTCGTGGCGA TTTATTCCAC CTTTTTACAA CGCGCCTACG

851  ACCAACTGGT GCACGACATC GCCCTGCAAA ACCTGCCCGT TTTGTTTGCC
```

```
 901  GTCGACCGCG CGGGCATCGT CGGCGCGGAC GGCCCGACCC ATGCCGGTTT

951  GTACGATTTA AGCTTTTTGC GCTGCATTCC GAATATGATT GTCGCCGCGC

1001  CGAGCGATGA AAATGAATGC CGCCTGCTGC TTTCGACCTG CTATCAGGCA

1051  GACGCGCCCG CCGCCGTCCG CTATCCGCGC GGCACGGGTA CGGGCGTGCC

1101  GGTTTCAGAC GGCATGGAAA CCGTGGAAAT CGGCAAGGGC ATTATCCGCC

1151  GCGAAGGTGA GAAAACCGCA TTCATTGCCT TCGGCAGTAT GGTCGCCCCT

1201  GCATTGGCGG TCGCCGGAAA ACTGAACGCC ACCGTCGCCG ATATGCGCTT

1251  CGTCAAACCG ATAGACGAAG AGTTGATTGT CCGCCTTGCC CGAAGCCACG

1301  ACCGCATCGT TACCCTTGAA GAAAACGCCG AACAGGGCGG CGCAGGCAGC

1351  GCGGTGCTGG AAGTGTTGGC GAAACACGGC ATCTGCAAAC CCGTCTTGCT

1401  TTTGGGCGTT GCCGATACCG TAACCGGACA CGGCGATCCG AAAAAACTTT

1451  TAGACGATTT GGGCTTGAGT GCCGAAGCGG TGGAACGGCG TGTGCGCGCG

1501  TGGCTGTCGG ATCGGGATGC GGCAAATTAA
```

This corresponds to the amino acid sequence <SEQ ID 120; ORF 033.a>:

```
a033.pep
   1  MAAADKQLGS DRRSVAIIGD GAMTAGQAFE ALNCAGDMDV DLLVVLNDNE

51  MSISPNVGAL PKYLASNVVR DMHGLLSTVK AQTGKVLDKI PGAMEFAQKV

101  EHKIKTLAEE AEHAKQSLSL FENFGFRYTG PVDGHNVENL VDVLEDLRGR

151  KGPQLLHVIT KKGNGYKLAE NDPVKYHAVA NLPKESAAQM PSEKEPKPAA

201  KPTYTQVFGK WLCDRAAADS RLVAITPAMR EGSGLVEFEQ RFPDRYFDVG

251  IAEQHAVTFA GGLACEGMKP VVAIYSTFLQ RAYDQLVHDI ALQNLPVLFA

301  VDRAGIVGAD GPTHAGLYDL SFLRCIPNMI VAAPSDENEC RLLLSTCYQA

351  DAPAAVRYPR GTGTGVPVSD GMETVEIGKG IIRREGEKTA FIAFGSMVAP

401  ALAVAGKLNA TVADMRFVKP IDEELIVRLA RSHDRIVTLE ENAEQGGAGS

451  AVLEVLAKHG ICKPVLLLGV ADTVTGHGDP KKLLDDLGLS AEAVERRVRA

501  WLSDRDAAN*
``` m033/a033 98.4% identity over a 509 aa overlap

```
                10         20         30         40         50         60
m033.pep  MAAADKLLGSDRRSVAIIGDGAMTAGQAFEALNCAXDMDVDLLVVLNDNEMSISPNVGAL
          ||||||  ||||||||||||||||||||||||||| ||||||||||||||||||||||||
a033      MAAADKQLGSDRRSVAIIGDGAMTAGQAFEALNCAGDMDVDLLVVLNDNEMSISPNVGAL
                10         20         30         40         50         60

70         80         90        100        110        120
m033.pep  PKYLASNVVRDMHGLLSTVKAQTGKVLDKIPGAMEFAQKVEHKIKTLAEEAEHAKQSLSL
          ||||||||||||||||||||||||||||||||||||||||||||||||||||||||||||
a033      PKYLASNVVRDMHGLLSTVKAQTGKVLDKIPGAMEFAQKVEHKIKTLAEEAEHAKQSLSL
                70         80         90        100        110        120

130        140        150        160        170        180
m033.pep  FENFGFRYTGPVDGHNVENLVDVLKDLRSRKGPQLLHVITKKGNGYKLAENDPVKYHAVA
          |||||||||||||||||||||||||:|||:||||||||||||||||||||||||||||||
a033      FENFGFRYTGPVDGHNVENLVDVLEDLRGRKGPQLLHVITKKGNGYKLAENDPVKYHAVA
               130        140        150        160        170        180

190        200        210        220        230        240
m033.pep  NLPKESAAQMPSEKEPKPAAKPTYTQVFGKWLCDRAAADSRLVAITPAMREGSGLVEFEQ
          ||||||||||||||||||||||||||||||||||||||||||||||||||||||||||||
a033      NLPKESAAQMPSEKEPKPAAKPTYTQVFGKWLCDRAAADSRLVAITPAMREGSGLVEFEQ
               190        200        210        220        230        240
```

-continued

```
                   250        260        270        280        290        300
    m033.pep   RFPDRYFDVGIAEQHAVTFAGGLACEGMKPVVAIYSTFLQRAYDQLVHDIALQNLPVLFA
               ||||||||||||||||||||||||||||||||||||||||||||||||||||||||||||
    a033       RFPDRYFDVGIAEQHAVTFAGGLACEGMKPVVAIYSTFLQRAYDQLVHDIALQNLPVLFA
                   250        260        270        280        290        300

310        320        330        340        350        360
    m033.pep   VDRAGIVGADGPTHAGLYDLSFLRCVPNMIVAAPSDENECRLLLSTCYQADAPAAVRYPR
               ||||||||||||||||||||||||||||:|||||||||||||||||||||||||||||||
    g033       VDRAGIVGADGPTHAGLYDLSFLRCIPNMIVAAPSDENECRLLLSTCYQADAPAAVRYPR
                   310        320        330        340        350        360

370        380        390        400        410        420
    m033.pep   GTGTGAPVSDGMETVEIGKGIIRREGEKTAFIAFGSMVAPALAVAEKLNATVADMRFVKP
               |||||:||||||||||||||||||||||||||||||||||||||| ||||||||||||||
    g033       GTGTGVPVSDGMETVEIGKGIIRREGEKTAFIAFGSMVAPALAVAGKLNATVADMRFVKP
                   370        380        390        400        410        420

430        440        450        460        470        480
    m033.pep   IDEELIVRLARSHDRIVTLEENAEQGGAGGAVLEVLAKHGICKPVLLLGVADTVTGHGDP
               |||||||||||||||||||||||||||||:||||||||||||||||||||||||||||||
    g033       IDEELIVRLARSHDRIVTLEENAEQGGAGSAVLEVLAKHGICKPVLLLGVADTVTGHGDP
                   430        440        450        460        470        480

490        500        510
    m033.pep   KKLLDDLGLSAEAVERRVRAWLSDRDAANX
               ||||||||||||||||||||||||||||||
    g033       KKLLDDLGLSAEAVERRVRAWLSDRDAANX
                   490        500        510
```

Computer analysis of this amino acid sequence gave the following results:
Homology with a Predicted ORF from N. gonorrhoeae
ORF 033 shows 98.4% identity over a 509 aa overlap with a predicted ORF (ORF 033.ng) from N. gonorrhoeae:

```
    m033/g033
    m033.pep   MAAADKLLGSDRRSVAIIGDGAMTAGQAFEALNCAXDMDVDLLVVLNDNEMSISPNVGAL   60
               ||||||||||:|||||||||||||||||||||||||||||||||||||||||||||||||
    g033       MAAADKLLGGDRRSVAIIGDGAMTAGQAFEALNCAGDMDVDLLVVLNDNEMSISPNVGAL   60 m033.pep   PKYLASNVVRDMHGLLSTVKAQTGKVLDKIPGAMEFAQKVEHKIKTLAEEAEHAKQSILS  120
               ||||||||||||||||||||||||||||||||||||||||||||||||||||||||||||
    g033       PKYLASNVVRDMHGLLSTVKAQTGKVLDKIPGAMEFAQKVEHKIKTLAEEAEHAKQSILS  120 m033.pep   FENFGFRYTGPVDGHNVENLVDVLKDLRSRKGPQLLHVITKKGNGYKLAENDPVKYHAVA  180
               ||||||||||||||||||||||||||||||||||||||||||||||||||||||||||||
    g033       FENFGFRYTGPVDGHNVENLVDVLKDLRSRKGPQLLHVITKKGNGYKLAENDPVKYHAVA  180 m033.pep   NLPKESAAQMPSEKEPKPAAKPTYTQVFGKWLCDRAAADSRLVAITPAMREGSGLVEFEQ  240
               |||||::|||||||||||||||||||||||||||||||||||||||||||||||||||||
    g033       NLPKEGGAQMPSEKEPKPAAKPTYTQVFGKWLCDRAAADSRLVAITPAMREGSGLVEFEQ  240 m033.pep   RFPDRYFDVGIAEQHAVTFAGGLACEGMKPVVAIYSTFLQRAYDQLVHDIALQNLPVLFA  300
               ||||||||||||||||||||||||||||||||||||||||||||||||||||||||||||
    g033       RFPDRYFDVGIAEQHAVTFAGGLACEGMKPVVAIYSTFLQRAYDQLVHDIALQNLPVLFA  300 m033.pep   VDRAGIVGADGPTHAGLYDLSFLRCVPNMIVAAPSDENECRLLLSTCYQADAPAAVRYPR  360
               ||||||||||||||||||||||||||||||||||||||||||||||||||||||||||||
    g033       VDRAGIVGADGPTHAGLYDLSFLRCVPNMIVAAPSDENECRLLLSTCYQADAPAAVRYPR  360 m033.pep   GTGTGAPVSDGMETVEIGKGIIRREGEKTAFIAFGSMVAPALAVAEKLNATVADMRFVKP  420
               |||||||||||||||||||||||||||||||||||||| |||||||||||||||||||||
    g033       GTGTGAPVSDGMETVEIGKGIIRREGEKTAFIAFGSMVATALAVAEKLNATVADMRFVKP  420 m033.pep   IDEELIVRLARSHDRIVTLEENAEQGGAGGAVLEVLAKHGICKPVLLLGVADTVTGHGDP  480
               |||||||||||||||||||||||||||||||||||||||||||||||||||||||| |||
    g033       IDEELIVRLARSHDRIVTLEENAEQGGAGGAVLEVLAKHGICKPVLLLGVADTVTEHGDP  480 m033.pep   KKLLDDLGLSAEAVERRVRAWLSDRDAANX  510
               |||||||||||||||||||| || |||||||
    g033       KKLLDDLGLSAEAVERRVREWLPDRDAANX  510
```

The following partial DNA sequence was identified in N. gonorrhoeae <SEQ ID 121>:

```
    g034.seq
        1   ATGAGCCGTT TATGGTTTTT TGCCGTAAAA AACATTATAA TCCGCCTTAT

51   TTACCTATTG CCCAAGGAGA CACAAATGGC ACTCGTATCC ATGCGCCAAC

101   TGCTTGACCA CGCCGCCGAA AACAGCTACG GCCTGCCCGC GTTCAACGTC

151   AACAACCTCG AACAAATGCG CGCCATTATG GAAGCCGCCG ACCAAGTCAA
```

```
     201   CGCGCCCGTC ATCGTACAGG CGAGCGCAGG TGCGCGCAAA TACGcggGCG

251   CGCCGTTTTT GCGCCACCTG ATTCTGGCGG CAGTCGAAGA ATTTCCGCAC

301   ATCCCCGTCG TGATGCACCA AGACCACGGC GCATCGCCCG ACGTgtgCCA

351   ACGCTCCATC CAACTGGGCT TCTCCTCCGT GATGATGGAC GGCTCTTTGC

401   TCGAAGACGG CAAAACCCCT TCTTCTTACG AATACAACGT CAACGCCACC

451   CGTACCGTCG TCAACTTCTC CCACGCCTGC GGCGTGTCCG TCGAAGGCGA

501   AATCGGCGTA TTGGGCAACC TCGAAACCGG CGAAGCAGGC GAAGAAGACG

551   GAGTGGGCGC GGCAGGCAAA CTCTCACACG ACCAAATGCT CACCAGCGTT

601   GAAGATGCCG TGCGTTTCGT TAAAGATACC GGCGTTGACG CATTGGCGAT

651   TGCCGTCGGC ACCAGCCACG GCGCATACAA ATTCACCCGT CCGCCCACAG

701   GCGACGTATT GCGTATCGAC CGCATCAAGG AAATCCACCA AGCCCTGCCC

751   AATACACACA TCGTGATGCA CGgctCCAGC TCCGTTCCGC AAGAatgGCT

801   GAAAGTCATC AACGAATACG GCGGCAATAT CGGCGAAACC TACGGCGTGC

851   CGGTTGAAGA AATCGTCGAA GGCATCAAAC ACGGCGTGCG CAAAGTCAAC

901   ATCGATACCG ACCTGCGCCT CGCTTCCACC GGCGCGGGTAC GCCGCTACCT

951   TGCCGAAAAC CCGTCCGACT TTGATCCGCG CAAATACTTG GGCAAAACCA

1001   TTGAAGCGAT GAAGCAAATC TGCCTCGACC GTTATCTTGC GTTCGGTTGC

1051   GAAGGTCAGG CAGGCAAAAT CAAACCTGTT TCGTTGGAAA AATGGCAAG

1101   CCGTTATGCC AAGGGCGAAT TGAACCAAAT CGTCAAATAA
```

This corresponds to the amino acid sequence <SEQ ID 122; ORF 034.ng>:

```
g034.pep
       1   MSRLWFFAVK NIIIRLIYLL PKETQMALVS MRQLLDHAAE NSYGLPAFNV

51   NNLEQMRAIM EAADQVNAPV IVQASAGARK YAGAPFLRHL ILAAVEEFPH

101   IPVVMHQDHG ASPDVCQRSI QLGFSSVMMD GSLLEDGKTP SSYEYNVNAT

151   RTVVNFSHAC GVSVEGEIGV LGNLETGEAG EEDGVGAAGK LSHDQMLTSV

201   EDAVRFVKDT GVDALAIAVG TSHGAYKFTR PPTGDVLRID RIKEIHQALP

251   NTHIVMHGSS SVPQEWLKVI NEYGGNIGET YGVPVEEIVE GIKHGVRKVN

301   IDTDLRLAST GAVRRYLAEN PSDFDPRKYL GKTIEAMKQI CLDRYLAFGC

351   EGQAGKIKPV SLEKMASRYA KGELNQIVK*
```

50

The following partial DNA sequence was identified in *N. meningitidis* <SEQ ID 123>:

```
m034.seq (partial)
       1   ATGAGCTGTT TATGGTTTTT TGCTGTAAAA AACATTATAA TCCGCCTTAT

51   TTACCTATTG CCCAAGGAGA CACAAATGGC ACTCGTATCC ATGCGCCAAC

101   TGCTTGATCA TGCTGCCGAA wACAGCTACG GCyTGCCGGC GTTCAACGTC

151   AACAACCTCG wACAGATGCG CGCCATCATG GAGGCTGCAG ACCAAGTCGA

201   CGCCCCGTC ATCGTACAGG CGAGTGCCGG TGCGCGCAAA TATGCGGGTG

251   CGCCGTTTTT ACGCCACCTG ATTTTGGCGG CTGTCGAAGT ATTTCCACAC

301   ATCCCCGTCG TCATGCACCA AGACCACGGC GCATCACCCG ACGTGTGCCA
```

-continued

```
351    ACGCTCCATC CAACTGGGCT TCTCCTCTGT AATGATGGAC GGCTCGCTGA

401    TGGAAGACGG CAAAACCCCT TCTTCTTACG AATACAACGT CAACGCCACA

451    CGTACCGTGG TTAACTTCTC CCACGCTTGC GGCGTATCCG TTGAAGGCGA

501    AATCGGCGTA TTGGGCAACC TCGAAACCGG CGATGCAGGC GAAGAAGACG

551    GTGTAGGCGC AGTGGGCAAA CTTTCCCACG ACCAAATGCT GACCAGCGTC

601    GAAGATGCCG TATGTTTCGT TAAAGATACC GGCGTTGACG CATTGGCTAT

651    TGCCGTCGGC ACCAGCCACG GCGCATACAA ATTCACCCGT CCGCCCACAG

701    GCGATGTATT ACGTATCGAC CGCATCAAAG AAATCCACCA AGCCCTGCCC

751    AATACACACA TCGTGATGCA C...
```

This corresponds to the amino acid sequence <SEQ ID 124; ORF 034>:

```
m034.pep (partial)
  1    MSCLWFFAVK NIIIRLIYLL PKETQMALVS MRQLLDHAAE XSYGLPAFNV

51    NNLXQMRAIM EAADQVDAPV IVQASAGARK YAGAPFLRHL ILAAVEVFPH

101    IPVVMHQDHG ASPDVCQRSI QLGFSSVMMD GSLMEDGKTP SSYEYNVNAT

151    RTVVNFSHAC GVSVEGEIGV LGNLETGDAG EEDGVGAVGK LSHDQMLTSV

201    EDAVCFVKDT GVDALAIAVG TSHGAYKFTR PPTGDVLRID RIKEIHQALP

251    NTHIVMH...
```

The following partial DNA sequence was identified in *N. meningitidis* <SEQ ID 125>:

```
a034.seq
  1    ATGAGCCGTT TATGGTTTTT TGCCGCAAAA AACATTATAA TCCGCCTTAT

51    TTACCTATTG CCCAAGGAGA CACAAATGGC ACTCGTATCC ATGCGCCAAC

101    TGCTTGATCA TGCTGCCGAA AACAGCTACG GCCTGCCCGC GTTCAACGTC

151    AACAACCTCG AACAAATGCG CGCCATTATG GAAGCCGCCG ACCAAGTCAA

201    CGCGCCCGTC ATCGTACAGG CGAGCGCAGG TGCGCGCAAA TACGCGGGCG

251    CGCCGTTTTT GCGCCACCTG ATTTTGGCGG CTGTCGAAGA ATTTCCGCAC

301    ATCCCCGTCG TGATGCACCA AGACCACGGC GCATCGCCCG ACGTGTGCCA

351    ACGCTCCATC CAACTGGGCT TTTCCTCCGT GATGATGGAC GGCTCGCTGA

401    TGGAAGACGG CAAAACCCCT TCTTCTTATG AATACAACGT CAACGCCACC

451    CGTACCGTGG TTAATTTCTC CCACGCCTGC GGCGTATCCG TTGAAGGCGA

501    AATCGGCGTA TTGGGCAACC TCGAAACTGG CGAAGCCGGC GAAGAAGACG

551    GTGTAGGCGC AGTGGGCAAA CTTTCCCACG ACCAAATGCT CACCAGCGTC

601    GAAGATGCCG TGCGTTTCGT TAAAGATACC GGCGTTGACG CATTGGCGAT

651    TGCCGTCGGC ACCAGCCACG GCGCGTACAA ATTCACCCGT CCGCCCACAG

701    GCGACGTGTT GCGTATCGAC CGCATCAAAG AAATCCACCA AGCCCTGCCC

751    AATACACACA TCGTGATGCA CGGCTCCAGC TCCGTTCCGC AAGAATGGCT

801    GAAAGTCATC AACGAATACG GCGGCAATAT CGGCGAAACC TACGGCGTGC

851    CGGTTGAAGA AATCGTCGAA GGCATCAAAC ACGGCGTGCG TAAAGTCAAC

901    ATCGATACCG ACTTGCGCCT TGCTTCCACC GGCGCGGTAC GCCGCTACCT
```

```
 951  TGCCGAAAAC CCGTCCGACT TCGATCCGCG CAAATATTTG AGCAAAACCA

1001  TTGAAGCGAT GAAGCAAATC TGCCTCGACC GCTACCTCGC GTTCGGTTGC

1051  GAAGGTCAGG CAGGCAAAAT CAAACCGGTT TCCTTGGAAA AAATGGCAAA

1101  CCGTTATGCC AAGGGCGAAT TGAACCAAAT CGTCAAATAA
```

This corresponds to the amino acid sequence <SEQ ID 126; ORF 034.a>:

```
a034.pep
    1  MSRLWFFAAK NIIIRLIYLL PKETQMALVS MRQLLDHAAE NSYGLPAFNV

51  NNLEQMRAIM EAADQVNAPV IVQASAGARK YAGAPFLRHL ILAAVEEFPH

101  IPVVMHQDHG ASPDVCQRSI QLGFSSVMMD GSLMEDGKTP SSYEYNVNAT

151  RTVVNFSHAC GVSVEGEIGV LGNLETGEAG EEDGVGAVGK LSHDQMLTSV

201  EDAVRFVKDT GVDALAIAVG TSHGAYKFTR PPTGDVLRID RIKEIHQALP

251  NTHIVMHGSS SVPQEWLKVI NEYGGNIGET YGVPVEEIVE GIKHGVRKVN

301  IDTDLRLAST GAVRRYLAEN PSDFDPRKYL SKTIEAMKQI CLDRYLAFGC

351  EGQAGKIKPV SLEKMANRYA KGELNQIVK*
``` m034/a034 96.9% identity over a 257 aa overlap

```
                 10         20         30         40         50         60
 m034.pep  MSCLWFFAVKNIIRLIYLLPKETQMALVSMRQLLDHAAEXSYGLPAFNVNNLXQMRAIM
           ||  ||||| :||||||||||||||||||||||||||||| |||||||||||| ||||||
 a034      MSRLWFFAAKNIIIRLIYLLPKETQMALVSMRQLLDHAAENSYGLPAFNVNNLEQMRAIM
                 10         20         30         40         50         60

70         80         90        100        110        120
 m034.pep  EAADQVDAPVIVQASAGARKYAGAPFLRHLILAAVEVFPHIPVVMHQDHGASPDVCQRSI
           ||||||| :|||||||||||||||||||||||||||| |||||||||||||||||||||||
 a034      EAADQVNAPVIVQASAGARKYAGAPFLRHLILAAVEEFPHIPVVMHQDHGASPDVCQRSI
                 70         80         90        100        110        120

130        140        150        160        170        180
 m034.pep  QLGFSSVMMDGSLMEDGKTPSSYEYNVNATRTVVNFSHACGVSVEGEIGVLGNLETGDAG
           |||||||||||||||||||||||||||||||||||||||||||||||||||||||||:||
 a034      QLGFSSVMMDGSLMEDGKTPSSYEYNVNATRTVVNFSHACGVSVEGEIGVLGNLETGEAG
                130        140        150        160        170        180

190        200        210        220        230        240
 m034.pep  EEDGVGAVGKLSHDQMLTSVEDAVCFVKDTGVDALAIAVGTSHGAYKFTRPPTGDVLRID
           ||||||||||||||||||||||| |||||||||||||||||||||||||||||||||||
 a034      EEDGVGAVGKLSHDQMLTSVEDAVRFVKDTGVDALAIAVGTSHGAYKFTRPPTGDVLRID
                190        200        210        220        230        240

250
 m034.pep  RIKEIHQALPNTHIVMH
           |||||||||||||||||
 a034      RIKEIHQALPNTHIVMHGSSSVPQEWLKVINEYGGNIGETYGVPVEEIVEGIKHGVRKVN
                250        260        270        280        290        300
```

Computer analysis of this amino acid sequence gave the following results:
Homology with a Predicted ORF from *N. gonorrhoeae*
ORF 034 shows 96.5% identity over a 257 aa overlap with a predicted ORF (ORF 034.ng) from *N. gonorrhoeae*:

```
 m034/g034 m034.pep  MSCLWFFAVKNIIRLIYLLPKETQMALVSMRQLLDHAAEXSYGLPAFNVNNLXQMRAIM   60
           ||  |||||||||||||||||||||||||||||||||| ||||||||||||| ||||||
 g034      MSRLWFFAVKNIIIRLIYLLPKETQMALVSMRQLLDHAAENSYGLPAFNVNNLEQMRAIM   60 m034.pep  EAADQVDAPVIVQASAGARKYAGAPFLRHLILAAVEVFPHIPVVMHQDHGASPDVCQRSI  120
           |||||| :||||||||||||||||||||||||||||| |||||||||||||||||||||||
 g034      EAADQVNAPVIVQASAGARKYAGAPFLRHLILAAVEEFPHIPVVMHQDHGASPDVCQRSI  120
```

```
m034.pep  QLGFSSVMMDGSLMEDGKTPSSYEYNVNATRTVVNFSHACGVSVEGEIGVLGNLETGDAG 180
          ||||||||||||:|||||||||||||||||||||||||||||||||||||||||||:||
g034      QLGFSSVMMDGSLLEDGKTPSSYEYNVNATRTVVNFSHACGVSVEGEIGVLGNLETGEAG 180 m034.pep  EEDGVGAVGKLSHDQMLTSVEDAVCFVKDTGVDALAIAVGTSHGAYKFTRPPTGDVLRID 240
          ||||||||:||||||||||||||| |||||||||||||||||||||||||||||||||||
g034      EEDGVGAAGKLSHDQMLTSVEDAVRFVKDTGVDALAIAVGTSHGAYKFTRPPTGDVLRID 240 m034.pep  RIKEIHQALPNTHIVMH                                            257
          |||||||||||||||||
g034      RIKEIHQALPNTHIVMHGSSSVPQEWLKVINEYGGNIGETYGVPVEEIVEGIKHGVRKVN 300
```

The following partial DNA sequence was identified in *N. gonorrhoeae* <SEQ ID 127>:

```
g036.seq
    1    ATGCTGAAGC CGTGTTTGGT ATACAGTGCC TGTGCGGCGG cgttgcCTGC
   51    GCGGACTTCG AGCAGCAGGC GTTGCGTGCC TTCGGGCAGA TGTGCGTACC
  101    AATATTCGAG CAGGGCGGAC GCAACGCCCC GTCGGCGGCA TTCGGGCGCG
  151    GTGGCAATCA GGTGCAGTTC GGATTCGTCG GGCAGGTTCT GCCAAACGAT
  201    AAAGGCGGCA ATCCTGCCGT CTTTTTCCGC AAGGAAAACC TGTTCGGACG
  251    GCGAAACAAG CGCGGACTCA AATTGGCGTT GCGTCCACGC GGACGGGTTG
  301    CAGACGGTAT CGAGCGCGGC CAGTGCGGCG CAGTCGGACG GTGAGGCTGG
  351    GCGGATGTTC ATGTTCGTGC CTTCCGTTCC GCCTGTTCTT TGGCAGTCAG
  401    GGCGATTTTG TTGCGGACGT AGAGCAGTTC GGCGTGTGCC GCGCCAGTTG
  451    CGGGATAGCC GCCGCCGAGG GCGAGCGCGA GAAAATCGGC GGCGGTCGGC
  501    ATATCGGGTT TGCCTGAGAA GGGCGGACGG TTTTCCAGTG CGAACGCACT
  551    GCCGATGCCG TCTGAAAAGA CGTACCCCTC GGGGAGGGCA ATGTCTGCCG
  601    CCCTACCGAC TTGATAATCG CTCAAACGGC GGCGGTTCAG CGTGTCGAAC
  651    CACGCATAAA ACACTTCGCC CATACGCGCG TCCGCAGCGG CGAGTATGCA
  701    GCTTTGCGGC GGCGGCAGCG AGGCGGCGGC ATCGAGCGTG GGGATGCCGA
  751    TTAAAGGCGT GTCGAACGGC GTTGCCAAAC CTTGCGCCAC GCCGATGCCG
  801    ATACGCAGTC CGGTAA
```

This corresponds to the amino acid sequence <SEQ ID 128; ORF 036.ng>:

```
g036.pep
    1    MLKPCLVYSA CAAALPARTS SSRRCVPSGR CAYQYSSRAD ATPRRRHSGA
   51    VAIRCSSDSS GRFCQTIKAA ILPSFSARKT CSDGETSADS NWRCVHADGL
  101    QTVSSAASAA QSDGEAGRMF MFVPSVPPVL WQSGRFCCGR RAVRRVPRQL
  151    RDSRRRGRAR ENRRRSAYRV CLRRADGFPV RTHCRCRLKR RTPRGGQCLP
  201    PYRLDNRSNG GGSACRTTHK TLRPYARPQR RVCSFAAAAA RRRHRAWGCR
  251    LKACRTALPN LAPRRCRYAV R*
```

The following partial DNA sequence was identified in *N. meningitidis* <SEQ ID 129>:

```
m036.seq
    1    ATGCTGAAGC CGTGCGCCGT GTACAGTGCC TGTGCGGCGG TGTTGCCTGC
   51    ACGGACTTCG AGCAGCAGGC GTTGCGTGTC TTCGGGCAGA TGTGTGAACC
```

```
101    AATATTCGAG CAGGGCGGAC GCAATTCCTT GGCGGCGGCA TTCGGGCGCG

151    GTGGCAATCA GGTGCAGTTC GGATTCGTCG GGCAGGTTCT GCCAAACGAT

201    AAAGGCGGCA ATCCCg.CGT CTTTTTCCGC AAGGAAAACC TGTTCGGACG

251    GCGAAACCAG TGCGGACTCA AATTGGCGTT GCGTCCATGC GGACGGGTTG

301    CAGACGGCAT CGAGTGCGGC CAGCTCCTCA CAATCGGCAC AAACGGCACG

351    GCGGATGTTC ACGGGCGCGC TCTCCGTTCG GCCTGTTCTT TGGCAGTCAG

401    GGCGATTTTG TTGCGGACGT AGAGCAAACC GGCGTGTGCG GCATGGACGG

451    CAGGATAACC GCCCTTGGCT GCCAATGCGA GAAAGTCGGC GGCAGTCGGC

501    ATATCCGGTC TGCCTGAGAA CGGCGGAGCT TCTTCCAGCG CGAACGCGCT

551    GCCTATGCCG TCTGAAAAGG CGCATCCCTC CGGCAGCCGG ATGTCTGCCG

601    CCCGCCCGAC CTGATAATCG CTCAAACGGT GGCAGTTCAG CGTATCGAAC

651    CATGCATAAA ACACTTCGCC CATACGAGCG TCCGTAGCGG CAAGGATGCA

701    GCTTTGCGGC GGCGGCAGCG AGGCGGCGGC ATCGAGCGAG GGTACGCCGA

751    TTAAGGGGGT ATCAAACGGC GTTGCCAAAC CCTGAGCTAC ACCGATGCCG

801    ATACGCAGTC CGGTAA
```

This corresponds to the amino acid sequence <SEQ ID 130; ORF 036>:

```
m036.pep
  1    MLKPCAVYSA CAAVLPARTS SSRRCVSSGR CVNQYSSRAD AIPWRRHSGA

51    VAIRCSSDSS GRFCQTIKAA IPXSFSARKT CSDGETSADS NWRCVHADGL

101    QTASSAASSS QSAQTARRMF TGALSVRPVL WQSGRFCCGR RANRRVRHGR

151    QDNRPWLPMR ESRRQSAYPV CLRTAELLPA RTRCLCRLKR RIPPAAGCLP

201    PARPDNRSNG GSSAYRTMHK TLRPYERP*R QGCSFAAAAA RRRHRARVRR

251    LRGYQTALPN PELHRCRYAV R*
```

40

The following partial DNA sequence was identified in *N. meningitidis* <SEQ ID 131>:

```
a036.seq
  1    ATGCTGAAGC CGTGCGCCGT GTACAGTGCC TGTGCGGCGG TGTTGCCTGC

51    ACGGACTTCG AGCAGCAGGC GTTGCGTGTC TTCGGGCAGA TGTGTGAACC

101    AATATTCGAG CAGGGCGGAC GCAATTCCTT GGCGGCGGCA TTCGGGCGCG

151    GTGGCAATCA GGTGCAGTTC GGATTCGTCG GGCAGGTTCT GCCAAACGAT

201    AAAGGCGGCA ATCCCGCCGT CTTTTTCCGC AAGGAAAACC TGTTCGGACG

251    GCGAAACCAG TGCGGACTCA AATTGGCGTT GCGTCCACGC GGACGGGTTG

301    CAGACGGCAT CGAGCGCGGC GAGTGCGGCG CAATCGGCAT AAACGGCGCG

351    GCGGATGTTC ACAGGCGCGC CCTCCGTTCC GCCTGTTCTT TGGCAGTCAA

401    GGCGATTTTG TTGCGGACGT AGAGCAGCTC GGCGTGTGCC GCAGCGACGG

451    CGGGAAAACC GCCTTCAGCC GCCAGATTGA GGAAGTCGGC GGCGGTCGGC

501    ATATCGGGTT TGCCTGAGAA GGGCGGACGG TTTTCCAGCG CGAACGCATT

551    GCCGATGCCG TCTGAAAAGG CGCATCCTTC CGGCAGCCGG ATGTCTGCCG

601    CCCGACCGAC CTGATAATCG CTCAAACGGC GGCGGTTCAG CGTGTCGAAC
```

```
651  CATGCATAAA ACACTTCGCC CATACGTGCG TCCGCAGCGG CAAGGATGCA

701  GCTTTGCGGC GGCGGCAGCG AGGCGGCGGC ATCGAGCGAG GGTACGCCGA

751  TTAAAGGAGT ATCAAACGGC GTTGCCAAAC CTTGCGCCAC GCCGATGCCG

801  ATACGCAGTC CCGTAA
```

This corresponds to the amino acid sequence <SEQ ID 132; ORF 036.a>:

```
a036.pep
    1  MLKPCAVYSA CAAVLPARTS SSRRCVSSGR CVNQYSSRAD AIPWRRHSGA

51  VAIRCSSDSS GRFCQTIKAA IPPSFSARKT CSDGETSADS NWRCVHADGL

101  QTASSAASAA QSA*TARRMF TGAPSVPPVL WQSRRFCCGR RAARRVPQRR

151  RENRLQPPD* GSRRRSAYRV CLRRADGFPA RTHCRCRLKR RILPAAGCLP

201  PDRPDNRSNG GGSACRTMHK TLRPYVRPQR QGCSFAAAAA RRRHRARVRR

251  LKEYQTALPN LAPRRCRYAV P*
``` m036/a036 85.6% identity over a 270 aa overlap

```
                 10         20         30         40         50         60
    m036.pep  MLKPCAVYSACAAVLPARTSSSRRCVSSGRCVNQYSSRADAIPWRRHSGAVAIRCSSDSS
              ||||||||||||||||||||||||||||||||||||||||||||||||||||||||||||
        a036  MLKPCAVYSACAAVLPARTSSSRRCVSSGRCVNQYSSRADAIPWRRHSGAVAIRCSSDSS
                 10         20         30         40         50         60

70         80         90        100        110        120
    m036.pep  GRFCQTIKAAIPXSFSARKTCSDGETSADSNWRCVHADGLQTASSAASSSQSAQTARRMF
              ||||||||||| |||||||||||||||||||||||||||||||||||::|||  ||||||
        a036  GRFCQTIKAAIPPSFSARKTCSDGETSADSNWRCVHADGLQTASSAASAAQSAXTARRMF
                 70         80         90        100        110        120

130        140        150        160        170        180
    m036.pep  TGALSVRPVLWQSGRFCCGRRANRRVRHGRQDNRPWLPMRESRRQSAYPVCLRTAELLPA
              ||| || |||||| |||||||| |||   :  | :: ||     |   |||:||| | :  :||
        a036  TGAPSVPPVLWQSRRFCCGRRAARRVPQRRRENRLQPPDXGSRRRSAYRVCLRRADGFPA
                130        140        150        160        170        180

190        200        210        220        230        240
    m036.pep  RTRCLCRLKRRIPPAAGCLPPARPDNRSNGGSSAYRTMHKTLRPYERPXRQGCSFAAAAA
              ||:| ||||||||||||||||| ||||||||||:|| ||||||||||||| ||||||||||
        a036  RTHCRCRLKRRILPAAGCLPPDRPDNRSNGGGSACRTMHKTLRPYVRPQRQGCSFAAAAA
                190        200        210        220        230        240

250        260        270
    m036.pep  RRRHRARVRRLRGYQTALPNPELHRCYAVRX
              |||||||||||:|||||||   :|||||||
        a036  RRRHRARVRRLKEYQTALPNLAPRRCRYAVPX
                250        260        270
```

Computer analysis of this amino acid sequence gave the following results:

Homology with a Predicted ORF from *N. gonorrhoeae*

ORF 036 shows 74.9% identity over a 271 aa overlap with a predicted ORF (ORF 036.ng) from *N. gonorrhoeae*:

```
    m036/g036
                 10         20         30         40         50         60
    m036.pep  MLKPCAVYSACAAVLPARTSSSRRCVSSGRCVNQYSSRADAIPWRRHSGAVAIRCSSDSS
              ||||| |||||||:||||||||||||| |||| |||||||| | ||||||||||||||||
        g036  MLKPCLVYSACAAALPARTSSSRRCVPSGRCAYQYSSRADATPRRRHSGAVAIRCSSDSS
                 10         20         30         40         50         60

70         80         90        100        110        120
    m036.pep  GRFCQTIKAAIPXSFSARKTCSDGETSADSNWRCVHADGLQTASSAASSSQSAQTARRMF
              ||||||||||| |||||||||||||||||||||||||||||||:|||::||     |||||
        g036  GRFCQTIKAAILPSFSARKTCSDGETSADSNWRCVHADGLQTVSSAASAAQSDGEAGRMF
                 70         80         90        100        110        120
```

-continued

```
                 130       140       150       160       170       180
m036.pep   TGALSVRPVLWQSGRFCCGRRANRRVRHGRQDNRPWLPMRESRRQSAYPVCLRTAELLPA
             : || ||||||||||||||| ||| :  :|:|     ||:||:||| |||| |: :|:
g036       MFVPSVPPVLWQSGRFCCGRRAVRRVPRQLRDSRRRGRARENRRRSAYRVCLRRADGFPV
                 130       140       150       160       170       180

190       200       210       220       230       240
m036.pep   RTRCLCRLKRRIPPAAGCLPPARPDNRSNGGSSAYRTMHKTLRPYERPXRQGCSFAAAAA
           ||:| |||||| | :: |||| | |||||||:|| || ||||||| || |: ||||||||
g036       RTHCRCRLKRRTPRGGQCLPPYRLDNRSNGGGSACRTTHKTLRPYARPQRRVCSFAAAAA
                 190       200       210       220       230       240

250       260       270
m036.pep   RRRHRARVRRLRGYQTALPNPELHRCRYAVRX
           ||||||   ||:: :|||||   :||||||||
g036       RRRHRAWGCRLKACRTALPNLAPRRCRYAVRX
                 250       260       270
```

The following partial DNA sequence was identified in *N. meningitidis* <SEQ ID 133>:

```
m036-1.seq
  1   ATGCTGAAGC CGTGCGCCGT GTACAGTGCC TGTGCGGCGG TGTTGCCTGC

51   ACGGACTTCG AGCAGCAGGC GTTGCGTGTC TTCGGGCAGA TGTGTGAACC

101   AATATTCGAG CAGGGCGGAC GCAATTCCTT GGCGGCGGCA TTCGGGCGCG

151   GTGGCAATCA GGTGCAGTTC GGATTCGTCG GGCAGGTTCT GCCAAACGAT

201   AAAGGCGGCA ATCCCGCCGT CTTTTTCCGC AAGGAAAACC TGTTCGGACG

251   GCGAAACCAG TGCGGACTCA AATTGGCGTT GCGTCCATGC GGACGGGTTG

301   CAGACGGCAT CGAGTGCGGC CAGCTCCTCA CAATCGGCAC AAACGGCACG

351   GCGGATGTTC ACGGGCGCGC TCTCCGTTCG GCCTGTTCTT TGGCAGTCAG

401   GGCGATTTTG TTGCGGACGT AGAGCAAACC GGCGTGTGCG GCATGGACGG

451   CAGGATAACC GCCCTTGGCT GCCAATGCGA GAAAGTCGGC GGCAGTCGGC

501   ATATCCGGTC TGCCTGAGAA CGGCGGAGCT TCTTCCAGCG CGAACGCGCT

551   GCCTATGCCG TCTGAAAAGG CGCATCCCTC CGGCAGCCGG ATGTCTGCCG

601   CCCGCCCGAC CTGATAATCG CTCAAACGGT GGCAGTTCAG CGTATCGAAC

651   CATGCATAAA ACACTTCGCC CATACGAGCG TCCGTAG
```

This corresponds to the amino acid sequence <SEQ ID 134; ORF 0036-1>:

```
m036-1.pep
  1   MLKPCAVYSA CAAVLPARTS SSRRCVSSGR CVNQYSSRAD AIPWRRHSGA

51   VAIRCSSDSS GRFCQTIKAA IPPSFSARKT CSDGETSADS NWRCVHADGL

101   QTASSAASSS QSAQTARRMF TGALSVRPVL WQSGRFCCGR RANRRVRHGR

151   QDNRPWLPMR ESRRQSAYPV CLRTAELLPA RTRCLCRLKR RIPPAAGCLP

201   PARPDNRSNG GSSAYRTMHK TLRPYERP*
``` m036-1/g036 76.8% identity in 228 aa overlap

```
                    10        20        30        40        50        60
m036-1.pep   MLKPCAVYSACAAVLPARTSSSRRCVSSGRCVNQYSSRADAIPWRRHSGAVAIRCSSDSS
             ||||| |||||||:|||||||||||| ||||: |||||||| | ||||||||||||||||
g036         MLKPCLVYSACAAALPARTSSSRRCVPSGRCAYQYSSRADATPRRRHSGAVAIRCSSDSS
                    10        20        30        40        50        60
```

```
              70         80         90        100        110        120
m036-1.pep  GRFCQTIKAAIPPSFSARKTCSDGETSADSNWRCVHADGLQTASSAASSSQSAQTARRMF
            ||||||||||| ||||||||||||||||||||||||||||:|||||::||   |  |||
g036        GRFCQTIKAAILPSFSARKTCSDGETSADSNWRCVHADGLQTVSSAASAAQSDGEAGRMF
              70         80         90        100        110        120

130        140        150        160        170        180
m036-1.pep  TGALSVRPVLWQSGRFCCGRRANRRVRHGRQDNRPWLPMRESRRQSAYPVCLRTAELLPA
            : || |||||||||||||| |||  :  :|:|    ||:||:|||  |||| |: :|:
g036        MFVPSVPPVLWQSGRFCCGRRAVRRVPRQLRDSRRGRARENRRRSAYRVCLRRADGFPV
             130        140        150        160        170        180

190        200        210        220        229
m036-1.pep  RTRCLCRLKRRIPPAAGCLPPARPDNRSNGGSSAYRTMHKTLRPYERPX
            ||:| |||||| | ::  |||| ||||||||:|| || |||||||| ||
g036        RTHCRCRLKRRTPRGGQCLPPYRLDNRSNGGGSACRTTHKTLRPYARPQRRVCSFAAAAA
             190        200        210        220        230        240 g036        RRRHRAWGCRLKACRTALPNLAPRRCRYAVRX
             250        260        270
```

The following partial DNA sequence was identified in *N. gonorrhoeae* <SEQ ID 135>:

```
g038.seq
   1   ATGACTGATT TCCGCCAAGA TTTCCTCAAA TTCTCCCTCG CCCAAAATGT

51   TTTGAAATTC GGCGAATTTA CCACCAAAGC CGGACGGCGG TCGCCCTATT

101   TCTTCAATGC CGGCCTCTTC AACGACGGCG CGTCCACGCT GCAACTGGCA

151   AAATTCTATG CACAATCCAT CATTGAAAGC GGCATCCGAT TCGATATGCT

201   GTTCGGCCCC GCCTACAAAG GCATTATTTT GGCGGCGGCA ACCGCGATGA

251   TGCTGGCGGA AAAAGGCGTG AACGTCCCGT TTGCCTACAA CCGCAAAGAA

301   GCCAAAGACC GCGGCGAAGG CGGCGTGTTG GTCGGCGCGC CGCTTAAAGG

351   GCGCGTGCTG ATTATCGACG ACGTGATTTC CGCCGGCACA TCCGTACGCG

401   AATCAATCAA ACTGATTGAA GCGGAGGGTG CAACCCCCGC CGGTGTCGCC

451   ATCGCGCTCG ACCGCATGGA AAAAGGCACG GGTAAATTGT CCGCCGTTCA

501   GGAAGTGGAA AAACAATACG GCCTGCCCGT CGCCCCCATC GCCAGCCTGA

551   ACGATTTGTT TATCCTGTTG CAAAACAACC CCGAATTCGG ACAGTTCCTC

601   GAACCCGTCC GCACCTACCG CCGGCAGTAC GGCGTAGAAT AA
```

This corresponds to the amino acid sequence <SEQ ID 136; ORF 038.ng>:

```
g038.pep
   1   MTDFRQDFLK FSLAQNVLKF GEFTTKAGRR SPYFFNAGLF NDGASTLQLA

51   KFYAQSIIES GIRFDMLFGP AYKGIILAAA TAMMLAEKGV NVPFAYNRKE

101   AKDRGEGGVL VGAPLKGRVL IIDDVISAGT SVRESIKLIE AEGATPAGVA

151   IALDRMEKGT GKLSAVQEVE KQYGLPVAPI ASLNDLFILL QNNPEFGQFL

201   EPVRTYRRQY GVE*
```

The following partial DNA sequence was identified in *N. meningitidis* <SEQ ID 137>:

```
m038.seq
   1   ATGACCGATT TCCGCCAAGA TTTCCTCAAA TTCTCCCTCG CCCAAAATGT

51   TTTGAAATTC GGCGAATTTA CCACCAAGGC AGGACGGCGG TCGCCCTATT

101   TCTTCAATGC CGGCCTCTTT AACGACGGCT TGTCCACGCT GCAACTGGCA
```

```
151    AAATTTTACG CACAATCCAT CATTGAAAGC GGCATCCGAT TCGATATGCT

201    GTTCGGTCCC GCCTACAAAG GCATTATTTT GGCGGCGGCA ACCGCGATGA

251    TGCTGGCGGA AAAAGGCGTG AACGTCCCGT TTGCCTACAA CCGCAAAGAA

301    GCCAAAGACC ACGGCGAAGG CGGCGTGTTG GTCGGCGCGC CGCTTAAAGG

351    GCGCGTGCTG ATTATCGACG ACGTGATTTC CGCCGGCACA TCCGTACGCG

401    AATCGATCAA ACTGATTGAA GCGGAGGGTG CAACCCCcGC CGGTGTCGCC

451    ATCGCGCTCG ATCGCATGGA AAAAGGCACG GGTGAATTGA GCGCGGTTCA

501    GGAAGTGGAr AAACAATACG GkCTGCCCGT CGCCCCCATC GCCAGCCTGA

551    ACGATTTGTT TATTCTGTTG CAAAACAACC CCGAATTCGG ACAGTTCCTC

601    GAACCCGTCC GAGCCTACCG TCGGCAGTAC GGCGTAGAAT AA
```

This corresponds to the amino acid sequence <SEQ ID 138;
ORF 038>:

```
m038.pep
     1    MTDFRQDFLK FSLAQNVLKF GEFTTKAGRR SPYFFNAGLF NDGLSTLQLA

51    KFYAQSIIES GIRFDMLFGP AYKGIILAAA TAMMLAEKGV NVPFAYNRKE

101    AKDHGEGGVL VGAPLKGRVL IIDDVISAGT SVRESIKLIE AEGATPAGVA

151    IALDRMEKGT GELSAVQEVE KQYGLPVAPI ASLNDLFILL QNNPEFGQFL

201    EPVRAYRRQY GVE*
```

The following partial DNA sequence was identified in *N. meningitidis* <SEQ ID 139>:

```
a038.seq
     1    ATGACCGATT TCCGCCAAGA TTTCCTCAAA TTCTCCCTCG CCCAAAATGT

51    TTTGAAATTC GGCGAATTCA CCACCAAAGC CGGACGGCGG TCGCCCTATT

101    TCTTCAATGC CGGCCTCTTT AACGACGGCT TGTCCACGCT GCAACTGGCA

151    AAATTTTACG CACAATCCAT CATTGAAAGC GGCATCCGAT TCGATATGCT

201    GTTCGGCCCC GCCTACAAAG GCATTATTTT GGCGGCGGCA ACCGCGATGA

251    TGCTGGCGGA AAAAGGCGTG AACGTCCCGT TTGCCTACAA CCGCAAAGAA

301    GCCAAAGACC ACGGCGAAGG CGGCGTGTTG GTCGGCGCGC CGCTTAAAGG

351    GCGCGTGCTG ATTATCGACG ACGTGATTTC CGCCGGCACA TCCGTACGCG

401    AATCGATCAA ACTGATTGAA GCGGAGGGTG CAACCCCCGC CGGTGTCGCC

451    ATCGCGCTCG ACCGCATGGA AAAAGGCACG GGTGAATTGA GCGCGGTTCA

501    GGAAGTGGAA AAACAATACG GCCTGCCCGT CGCCCCCATC GCCAGCCTGA

551    ACGATTTGTT TATTCTGTTG CAAAACAACC CCGAATTCGG ACAGTTCCTC

601    GAACCCGTCC GAGCCTACCG TCGGCAGTAC GGCGTAGAAT AA
```

This corresponds to the amino acid sequence <SEQ ID 140;
ORF 038.a>:

```
a038.pep
     1    MTDFRQDFLK FSLAQNVLKF GEFTTKAGRR SPYFFNAGLF NDGLSTLQLA

51    KFYAQSIIES GIRFDMLFGP AYKGIILAAA TAMMLAEKGV NVPFAYNRKE

101    AKDHGEGGVL VGAPLKGRVL IIDDVISAGT SVRESIKLIE AEGATPAGVA
```

-continued

```
151   IALDRMEKGT GELSAVQEVE KQYGLPVAPI ASLNDLFILL QNNPEFGQFL

201   EPVRAYRRQY GVE*
``` m038/a038 100.0% identity over a 213 aa overlap

```
                  10         20         30         40         50         60
   m038.pep   MTDFRQDFLKFSLAQNVLKFGEFTTKAGRRSPYFFNAGLFNDGLSTLQLAKFYAQSIIES
              ||||||||||||||||||||||||||||||||||||||||||||||||||||||||||||
       a038   MTDFRQDFLKFSLAQNVLKFGEFTTKAGRRSPYFFNAGLFNDGLSTLQLAKFYAQSIIES
                  10         20         30         40         50         60

70         80         90        100        110        120
   m038.pep   GIRFDMLFGPAYKGIILAAATAMMLAEKGVNVPFAYNRKEAKDHGEGGVLVGAPLKGRVL
              ||||||||||||||||||||||||||||||||||||||||||||||||||||||||||||
       a038   GIRFDMLFGPAYKGIILAAATAMMLAEKGVNVPFAYNRKEAKDHGEGGVLVGAPLKGRVL
                  70         80         90        100        110        120

130        140        150        160        170        180
   m038.pep   IIDDVISAGTSVRESIKLIEAEGATPAGVAIALDRMEKGTGELSAVQEVEKQYGLPVAPI
              ||||||||||||||||||||||||||||||||||||||||||||||||||||||||||||
       a038   IIDDVISAGTSVRESIKLIEAEGATPAGVAIALDRMEKGTGELSAVQEVEKQYGLPVAPI
                 130        140        150        160        170        180

190        200        210
   m038.pep   ASLNDLFILLQNNPEFGQFLEPVRAYRRQYGVEX
              ||||||||||||||||||||||||||||||||||
       a038   ASLNDLFILLQNNPEFGQFLEPVRAYRRQYGVEX
                 190        200        210
```

Computer analysis of this amino acid sequence gave the following results:
Homology with a Predicted ORF from *N. gonorrhoeae*
ORF 038 shows 98.1% identity over a 213 aa overlap with a predicted ORF (ORF 038.ng) from *N. gonorrhoeae*:

```
   m038/g038
                  10         20         30         40         50         60
   m038.pep   MTDFRQDFLKFSLAQNVLKFGEFTTKAGRRSPYFFNAGLFNDGLSTLQLAKFYAQSIIES
              |||||||||||||||||||||||||||||||||||||||||| |||||||||||||||||
       g038   MTDFRQDFLKFSLAQNVLKFGEFTTKAGRRSPYFFNAGLFNDGASTLQLAKFYAQSIIES
                  10         20         30         40         50         60

70         80         90        100        110        120
   m038.pep   GIRFDMLFGPAYKGIILAAATAMMLAEKGVNVPFAYNRKEAKDHGEGGVLVGAPLKGRVL
              |||||||||||||||||||||||||||||||||||||||||:||||||||||||||||||
       g038   GIRFDMLFGPAYKGIILAAATAMMLAEKGVNVPFAYNRKEAKDRGEGGVLVGAPLKGRVL
                  70         80         90        100        110        120

130        140        150        160        170        180
   m038.pep   IIDDVISAGTSVRESIKLIEAEGATPAGVAIALDRMEKGTGELSAVQEVEKQYGLPVAPI
              |||||||||||||||||||||||||||||||||||||||||:||||||||||||||||||
       g038   IIDDVISAGTSVRESIKLIEAEGATPAGVAIALDRMEKGTGKLSAVQEVEKQYGLPVAPI
                 130        140        150        160        170        180

190        200        210
   m038.pep   ASLNDLFILLQNNPEFGQFLEPVRAYRRQYGVEX
              |||||||||||||||||||||||||:||||||||
       g038   ASLNDLFILLQNNPEFGQFLEPVRTYRRQYGVEX
                 190        200        210
```

The following partial DNA sequence was identified in *N. gonorrhoeae* <SEQ ID 141>:

```
g039.seq
     1   ATGCCGTCCG AACCACCTGC CGCTTCAGAC GGCATCAAAC CGACACACAC

51   CGAGAAAACA TCATGCCCGC CTGTTTCTGT CCGCACTGCA AAACCCGCCT

101   CTGGGTCAAA GAAAcccagC TCAAcgtCgC ccaagGCTTC GTCGTCTgcc 151   aaAAAtgcga agGGCTgttt aaAgccaaaG accAtctggc aaGcacGAAA 201   gaacctatat tcaacgattg gcccgaagct gtttcgggat gTcaaaCTCG 251   TCcaccgcaT cggcacgcac gccattagca aGAaacagat gtcccgcgac
```

-continued

```
   301   gaaatCgccg atatcctcaa cggcggtaca acCCTGCACG ATACGCCGCC

351   CGCAACCGCC GCTGCCGCac ctGCCGCCGC ACCGCaggTT TCCGTACCGC

401   CCGCCCGTCA GGAAGGGCTC AACTGGACTA TTGCAACCCT GTTCGCACTT

451   ATCGTCCTCA TTATGCAGCT TTCCTACCTC TTCATCCTAT GA
```

This corresponds to the amino acid sequence <SEQ ID 142; ORF 039.ng>:

```
g039.pep
     1   MPSEPPAASD GIKPTHTEKT SCPPVSVRTA KPASGSKKPS STSPKASSSA

51   KNAKGCLKPK TIWQARKNLY STIGPKLFRD VKLVHRIGTH AISKKQMSRD

101   EIADILNGGT TLHDTPPATA AAAPAAAPQV SVPPARQEGL NWTIATLFAL

151   IVLIMQLSYL FIL*
```

The following partial DNA sequence was identified in *N. meningitidis* <SEQ ID 143>:

```
m039.seq
     1   ATGCCGTCCG AACCGCCTTA CGCCTCAGAC GGCATCAAAC CTGACACACA

51   CGAGGAAATA CCATGCCCGC CTGTTTCTGC CCCCACTGCA AAACCCGTCT

101   CTGGGTCAAA GAAACCCAAC TCAATGTCGC CGnnnnnnnn nnnnnnnnnn 151   nnnnnnnnnn nnnnnnnnnn nnnnnnnnnn nnnnnnnnnn nnnnnnnnnn 201   nnnnnnnnnn nnnnnnnnnn nnnnnnnnnn nnnnnnnCCC GAGGCTGTTT

251   CGGATGTCAA ACTCGTTCAC CGTATCGGCA CGCGCGCCAT CGGCAAGAAA

301   CAGATTTCCC GTGACGAAAT CGCCGGCATC CTCAACGGCG GTACAACCCA

351   GCCCGATATT CCGCCCGCAA CCGCCGCCAC CCCTGCTGCC GCACCGCAGG

401   TTACCGTACC GCCCGCCGCG CCCGCCCGTC AGGATGGGTT CAACTGGACG

451   ATTGCAACCC TGTTTGCCCT TATCGTCCTC ATTATGCAGC TTTCCTACCT

501   CGTCATCCTA TGA
```

This corresponds to the amino acid sequence <SEQ ID 144; ORF 039>:

```
m039.pep
     1   MPSEPPYASD GIKPDTHEEI PCPPVSAPTA KPVSGSKKPN SMSPXXXXXX

51   XXXXXXXXXX XXXXXXXXXX XXXXXXXXP EAVSDVKLVH RIGTRAIGKK

101   QISRDEIAGI LNGGTTQPDI PPATAATPAA APQVTVPPAA PARQDGFNWT

151   IATLFALIVL IMQLSYLVIL *
```

The following partial DNA sequence was identified in *N. meningitidis* <SEQ ID 145>:

```
a039.seq
     1   ATGCCGTCTG AACCGCCTTA CGCCTCAGAC GGCATCAAAC CTGACACACA

51   CGAGGAAATA CCATGCCCGC CTGTTTCTGC CCCCACTGCA AAACCCGTCT

101   CTGGGTCAAA GAAACCCAAC TCAATGTCGC CCAAGGCTTC GTCGTCTGCC

151   AAAAATGCGA AGGAATGTTT AAAGCCAAAG ACCATCTGGC AAGCACGAAA
```

```
    -continued
201 GAACCCATAT TCAACGATT. TGCCCGAAGC TGTTTCGGAT GTCAAACTCG

251 TTCACCGCAT CGGCACGAGC GCCATCGGCA AGAAACAGAT TTCCCGTGAC

301 GAAATCGCCG GCATCCTCAA CGGCGGCACA ACCCAGCCCG ATATTCCGCC

351 CGCAACCGCC GCCACCCCTG CTGCCGCACC GCAGGTTACC GTACCGCCCG

401 CCGCGCCCGC CCGTCAGGAT GGGTTCAACT GGACGATTGC AACCCTGTTT

451 GCCCTTATCG TCCTCATTAT GCAGCTTTCC TACCTCGTCA TCCTATGA
```

This corresponds to the amino acid sequence <SEQ ID 146;
ORF 039.a>:

```
a039.pep
  1  MPSEPPYASD GIKPDTHEEI PCPPVSAPTA KPVSGSKKPN SMSPKASSSA

51  KNAKECLKPK TIWQARKNPY STIXPEAVSD VKLVHRIGTS AIGKKQISRD

101  EIAGILNGGT TQPDIPPATA ATPAAAPQVT VPPAAPARQD GFNWTIATLF

151  ALIVLIMQLS YLVIL*
``` m039/a039 79.4% identity over a 170 aa overlap

```
                 10         20         30         40         50         60
m039.pep  MPSEPPYASDGIKPDTHEEIPCPPVSAPTAKPVSGSKKPNSMSPXXXXXXXXXXXXXXXX
          ||||||||||||||||||||||||||||||||||||||||||||
a039      MPSEPPYASDGIKPDTHEEIPCPPVSAPTAKPVSGSKKPNSMSPKASSSAKNAKECLKPK
                 10         20         30         40         50         60

70         80         90        100        110        120
m039.pep  XXXXXXXXXXXXXXXXXXXPEAVSDVKLVHRIGTRAIGKKQISRDEIAGILNGGTTQPDI
                     :|     ||||||||||||| |||||||||||||||||||||||
a039      TIWQARKNPYSTIX-----PEAVSDVKLVHRIGTSAIGKKQISRDEIAGILNGGTTQPDI
                 70         80         90        100        110

130        140        150        160        170
m039.pep  PPATAATPAAAPQVTVPPAAPARQDGFNWTIATLFALIVLIMQLSYLVILX
          |||||||||||||||||||||||||||||||||||||||||||||||||
a039      PPATAATPAAAPQVTVPPAAPARQDGFNWTIATLFALIVLIMQLSYLVILX
                120        130        140        150        160
```

Computer analysis of this amino acid sequence gave the following results:
Homology with a Predicted ORF from *N. gonorrhoeae*
ORF 039 shows 60.8% identity over a 171 aa overlap with a predicted ORF (ORF 039.ng) from *N. gonorrhoeae*:

```
m039/g039
                 10         20         30         40         50         60
m039.pep  MPSEPPYASDGIKPDTHEEIPCPPVSAPTAKPVSGSKKPNSMSPXXXXXXXXXXXXXXXX
          ||||||  ||||||| |:   ||||| :||||| ||||||::| ||
g039      MPSEPPAASDGIKPTHTEKTSCPPVSVRTAKPASGSKKPSSTSPKASSSAKNAKGCLKPK
                 10         20         30         40         50         60

70         80         90        100        110        120
m039.pep  XXXXXXXXXXXXXXXXXXXPEAVSDVKLVHRIGTRAIGKKQISRDEIAGILNGGTTQPDI
                     :      |:    ||||||||||:||:|||:|||||| |||||||  |
g039      TIWQARKNLYSTIG-----PKLFRDVKLVHRIGTHAISKKQMSRDEIADILNGGTTLHDT
                 70         80         90        100        110

130        140        150        160        170
m039.pep  PPATAAT-PAAAPQVTVPPAAPARQDGFNWTIATLFALIVLIMQLSYLVILX
          ||||||: |||||||:|||   ||:|:||||||||||||||||||| |||
g039      PPATAAAAPAAAPQVSVPPA---RQEGLNWTIATLFALIVLIMQLSYLFILX
                120        130        140        150        160
```

The following partial DNA sequence was identified in *N. gonorrhoeae* <SEQ ID 147>:

```
g040.seq
   1  ATGAACGCGC CCGACAGCTT TGTCGCCCAC TTCCGCGAAG CCGCCCCTA
  51  CATCCGCCAA ATGCGCGGCA CGACACTGGT CGCCGGCATA GAcggCCGCC
 101  TGCTCGAAGG CGGCACCTTA AATAAGCTCG CCGCCGACAT CGGGCTGTTG
 151  TCGCAACTGG GCATCCGACT CGTCCTCATC CACGGCGCGT ACCACTTCCT
 201  CGAccgCCTC GCCGCCGCGC AAGgccGCAC GCCGCATTAT TGCCGgggtt
 251  tGCGCGTTAC CGACGaAACc tcGctcgGAC AGGCGCAGCA GtttGCCGGC
 301  AccgTCCGCA GCCGTTTTGA agcCGCATTG tgcggcagCG tttcaggatt
 351  cgcgCGCGCG CCTTCCGTCC CGCTCGTAtc gggcaacttc ctgacCGCCC
 401  GTCcgatggg cgtgattgac ggaACCGata tggaatacgc gggggttatc
 451  cgcaaaaccg ACACCGCCGC CCTCCGTTTC CAACTCGACG CGGGCAATAT
 501  CGTCTGGATG CCGCCGCTCG GGCATTCCTA CGGCGGCAAA ACCTTCAATC
 551  TCGATATGGT GCAGGCCGCC GCTTCCGTCG CCGTCTCGCT TCAGGCCGAA
 601  AAACTCGTTT ACCTGACCCT TTCAGACGGC ATTTCCCGCC CCGACGGCAC
 651  GCTCGCCGAA ACCCTCTCGG CACAGGAAGC GCAATCGCTG GCGGAACACG
 701  CCGCCAGCGA AACCCGACGA CTGATTTCGT CCGCCGTTGC CGCGCTCGAA
 751  GGCGGCGTGC ATCGCGTCCA AATCCTCAAC GGGGCCGCCG ACGGCAGCCT
 801  GCTGCAAGAA CTCTTCACCC GCAACGGCAT CGGCACGTCC ATTGCCAAAG
 851  AAGCCTTCGT CTCCATCCGG CAGGCGCACA GCGGCGACAT CCCGCACATC
 901  GCCGCCCTCA TCCGCCCGCT GGAAGAACAG GGCGTCCTAT TGCACCGCAG
 951  CCGCGAATAC CTCGAAAACC ACATTTCCGA ATTTTCCATC CTCGAACACG
1001  ACGGCGACCT GTACGGCTGT GCCGCACTCA AAACCTTTGC CGAAGCCGAT
1051  TGCGGCGAAA TCGCCTGCCT TGCCGTCTCG CCGCAGGCAC AGGACGGCGg
1101  ctACGGCGAA CGCCTGCTTG CCCACATTAT CGATAAGGCG CGCGGCATAG
1151  GCATAAGCAG GCTGTTCGCA CTGTCCACAA ATACCGGCGA ATGGTTTGCC
1201  GAACGCGGCT TTCAGACGGC ATCGGAAGAC GAGCTGCCCG AAACGCGGCG
1251  CAAAGACTAC CGCAGCAACG GACGAAACCC GCATATTCTG GTGCGTCGCC
1301  TGCACCGCTG A
```

This corresponds to the amino acid sequence <SEQ ID 148; ORF 040.ng>:

```
g040.pep
   1  MNAPDSFVAH FREAAPYIRQ MRGTTLVAGI DGRLLEGGTL NKLAADIGLL
  51  SQLGIRLVLI HGAYHFLDRL AAAQGRTPHY CRGLRVTDET SLGQAQQFAG
 101  TVRSRFEAAL CGSVSGFARA PSVPLVSGNF LTARPMGVID GTDMEYAGVI
 151  RKTDTAALRF QLDAGNIVWM PPLGHSYGGK TFNLDMVQAA ASVAVSLQAE
 201  KLVYLTLSDG ISRPDGTLAE TLSAQEAQSL AEHAASETRR LISSAVAALE
 251  GGVHRVQILN GAADGSLLQE LFTRNGIGTS IAKEAFVSIR QAHSGDIPHI
 301  AALIRPLEEQ GVLLHRSREY LENHISEFSI LEHDGDLYGC AALKTFAEAD
 351  CGEIACLAVS PQAQDGGYGE RLLAHIIDKA RGIGISRLFA LSTNTGEWFA
 401  ERGFQTASED ELPETRRKDY RSNGRNPHIL VRRLHR*
```

The following partial DNA sequence was identified in *N. meningitidis* <SEQ ID 149>:

```
m040.seq
     1  ATGAGCGCGC CCGACCTCTT TGTCGCCCAC TTCCGCGAAG CCGTCCCCTA
    51  CATCCGCCAA ATGCGCGGCA AAACGCTGGT CGCCGGCATA GACGACCGCC
   101  TGCTCGAAGG TGATACCTTA AACAAGCTCG CCGCCGACAT CGGGCTGTTG
   151  TCGCAACTGG GCATCAGGCT CGTCCTCATC CACGGCGCGC GCCACTTCCT
   201  CGACCGCCAC GCCGCCGCTC AAGGCCGCAC GCCGCATTAT TGCCGGGGCT
   251  TGCGCGTTAC CGACGAAACC TCGCTCGAAC AGGCGCAgCA GTTTGCCGGC
   301  ACCGTCCGCA GCCGTTTTGA AGCCGCATTG TGCGGCAGCG TTTCCGGGTT
   351  CGCGCGCGCG CCTTCCGTCC CGCTCGTATC GGGCAACTTC CTGACCGCCC
   401  GTCCGATAGG TGTGATTGAC GGAACCGATA TGGAATACGC GGGCGTTATC
   451  CGCAAAACCG ACACCGCCGC CCTCCGTTTC CAACTCGACG CGGGCAATAT
   501  CGTCTGGCTG CCGCCGCTCG GACATTCCTA CAGCGGCAAG ACCTTCTATC
   551  TCGATATGCT TCAAACCGCC GCCTCCGCCG CCGTCTCGCT TCAGGCCGAA
   601  AAACTCGTTT ACCTGACCCT TTCAGACGGC ATTTCCCGCC CCGACGGCAC
   651  GCTCGCCGAA ACCCTCTCGG CACAGGAAGC GCAATCGCTG GCGGAACACG
   701  CCGGCGGGCA AACGCGACGG CTGATTTCGT CCGCCGAACT CTTCACCCGC
   751  AACGGCATCG GCACGTCCAT TGCCAAAGAA GCCTTCGTCT CCATCCGGCA
   801  rGCGCAywgG G.CGACATCC CGCACATCGC CGCCCTCATC CGCCCGCTGG
   851  AAGAACAGGG CATCCTGCTG CACCGCAs.c GCGAATACCT CGAAAACCAC
   901  ATTTCCGAAT TTTCCATCCT CGAACACGAC GGCAACCTGT ACGGTTGCGC
   951  CGCCCTGAAA ACCTTTGCCG AAGCCGATTG CGGCGAAATC GCCTGCCTTG
  1001  CCGTCTCGCC GCag.cACAG GACGGCGGCT ACGGCGAACG CnTGCTTGCC
  1051  CACATTATCG ATAAGGCGCG CGGCATAGGC ATAAGCAGGC TGTTCGCACT
  1101  GTCCACAAAT ACCGGCGAAT GGTTTGCCGA ACGCGGCTTT CAGACGGCAT
  1151  CGGAAGACGA GTTGCCCGAA ACGCGGCGCA AAGACTACCG CAGCAACGGA
  1201  CGGAACTCGC ATATTCTGGT ACGTCGCCTG CACCGCTGA
```

This corresponds to the amino acid sequence <SEQ ID 150; ORF 040>:

```
m040.pep
     1  MSAPDLFVAH FREAVPYIRQ MRGKTLVAGI DDRLLEGDTL NKLAADIGLL
    51  SQLGIRLVLI HGARHFLDRH AAAQGRTPHY CRGLRVTDET SLEQAQQFAG
   101  TVRSRFEAAL CGSVSGFARA PSVPLVSGNF LTARPIGVID GTDMEYAGVI
   151  RKTDTAALRF QLDAGNIVWL PPLGHSYSGK TFYLDMLQTA ASAAVSLQAE
   201  KLVYLTLSDG ISRPDGTLAE TLSAQEAQSL AEHAGGQTRR LISSAELFTR
   251  NGIGTSIAKE AFVSIRQAHX XDIPHIAALI RPLEEQGILL HRXREYLENH
   301  ISEFSILEHD GNLYGCAALK TFAEADCGEI ACLAVSPQXQ DGGYGERXLA
   351  HIIDKARGIG ISRLFALSTN TGEWFAERGF QTASEDELPE TRRKDYRSNG
   401  RNSHILVRRL HR*
```

The following partial DNA sequence was identified in *N. meningitidis* <SEQ ID 151>:

a040.seq
```
   1 ATGATCGTGC CCGACCTCTT TGTCGCCCAC TTCCGCGAAG CCGCCCCTA
  51 CATCCGCCAA ATGCGCGGCA AAACGCTGGT CGCCGGCATA GACGACCGCC
 101 TGCTCGAAGG TGATACCTTA AACAAGTTCG CCGCCGACAT CGGGCTTTTG
 151 TCGCAACTGG GCATCAGGCT CGTCCTCATC CACGGCGCGC GCCACTTCCT
 201 CGACCGCCAC GCCGCCGCGC AAGGCCGCAC GCCGCATTAT TGCCGGGGCT
 251 TGCGCGTTAC CGACGAAACC TCGCTCGAAC AGGCGCAGCA GTTTGCCGGC
 301 ACCGTCCGCA GCCGTTTTGA AGCCGCATTG TGCGGCAGCG TTTCCGGGTT
 351 CGCGCGCGCG CCTTCCGTCC CGCTCGTATC GGGCAACTTC CTGACCGCCC
 401 GTCCGATAGG TGTGATTGAC GGAACCGATA TGGAATACGC GGGCGTTATC
 451 CGCAAAACCG ACACCGCCGC CCTCCGTTTC CAACTCGACG CGGGCAATAT
 501 CGTCTGGCTG CCGCCGCTCG GACATTCCTA CAGCGGCAAG ACCTTCCATC
 551 TCGATATGCT TCAAACCGCC GCCTCCGTCG CCGTCTCGCT TCAGGCCGAA
 601 AAACTCGTTT ACCTGACCCT TTCAGACGGC ATTTCCCGCC CCGACGGCAC
 651 GCTCGCCGTA ACCCTCTCGG CACAGGAAGC GCAATCGCTG GCGGAACACG
 701 CCGGCGGCGA AACGCGACGG CTGATTTCGT CCGCCGTTGC CGCGCTCGAA
 751 GGCGGCGTGC ATCGCGTCCA AATCCTCAAC GGAGCCGCCG ACGGCAGCCT
 801 GCTGCAAGAA CTCTTCACCC GCAACGGCAT CGGCACGTCC ATTGCCAAAG
 851 AAGCCTTCGT CTCCATCCGG CAGGCGCACA GCGGCGACAT CCCGCACATT
 901 GCCGCCCTCA TCCGCCCGCT GGAAGAACAG GGCATCCTGC TGCACCGCAG
 951 CCGCGAATAC CTCGAAAACC ACATTTCCGA ATTTTCCATC CTCGAACACG
1001 ACGGCAACCT GTACGGTTGC GCCGCCCTGA AAACCTTTGC CGAAGCCGAT
1051 TGCGGCGAAA TCGCCTGCCT TGCCGTCTCG CCGCAGGCAC AGGACGGCGG
1101 CTACGGCGAA CGCCTGCTTG CCCACATTAT CGATAAGGCG CGCGGCATAG
1151 GCATAAGCAG GCTGTTCGCA CTGTCCACAA ATACCGGCGA ATGGTTTGCC
1201 GAACGCGGCT TTCAGACGGC ATCGGAAGAC GAGTTGCCCG AAACGCGGCG
1251 CAAAGACTAC CGCAGCAACG GACGGAACTC GCATATTCTG GTGCGTCGCC
1301 TGCACCGCTG A
```

This corresponds to the amino acid sequence <SEQ ID 152; ORF 040.a>:

a040.pep
```
   1 MIVPDLFVAH FREAAPYIRQ MRGKTLVAGI DDRLLEGDTL NKFAADIGLL
  51 SQLGIRLVLI HGARHFLDRH AAAQGRTPHY CRGLRVTDET SLEQAQQFAG
 101 TVRSRFEAAL CGSVSGFARA PSVPLVSGNF LTARPIGVID GTDMEYAGVI
 151 RKTDTAALRF QLDAGNIVWL PPLGHSYSGK TFHLDMLQTA ASVAVSLQAE
 201 KLVYLTLSDG ISRPDGTLAV TLSAQEAQSL AEHAGGETRR LISSAVAALE
 251 GGVHRVQILN GAADGSLLQE LFTRNGIGTS IAKEAFVSIR QAHSGDIPHI
 301 AALIRPLEEQ GILLHRSREY LENHISEFSI LEHDGNLYGC AALKTFAEAD
 351 CGEIACLAVS PQAQDGGYGE RLLAHIIDKA RGIGISRLFA LSTNTGEWFA
 401 ERGFQTASED ELPETRRKDY RSNGRNSHIL VRRLHR*
``` m040/a040 91.5% identity in 436 aa overlap

```
             10        20        30        40        50        60
m040.pep  MSAPDLFVAHFREAVPYIRQMRGKTLVAGIDDRLLEGDTLNKLAADIGLLSQLGIRLVLI
          | :|||||||||:||||||||||||||||||||||||||:|||||||||||||||||||
a040      MIVPDLFVAHFREAAPYIRQMRGKTLVAGIDDRLLEGDTLNKFAADIGLLSQLGIRLVLI
             10        20        30        40        50        60

70        80        90       100       110       120
m040.pep  HGARHFLDRHAAAQGRTPHYCRGLRVTDETSLEQAQQFAGTVRSRFEAALCGSVSGFARA
          ||||||||||||||||||||||||||||||||||||||||||||||||||||||||||||
a040      HGARHFLDRHAAAQGRTPHYCRGLRVTDETSLEQAQQFAGTVRSRFEAALCGSVSGFARA
             70        80        90       100       110       120

130       140       150       160       170       180
m040.pep  PSVPLVSGNFLTARPIGVIDGTDMEYAGVIRKTDTAALRFQLDAGNIVWLPPLGHSYSGK
          ||||||||||||||||||||||||||||||||||||||||||||||||||||||||||||
a040      PSVPLVSGNFLTARPIGVIDGTDMEYAGVIRKTDTAALRFQLDAGNIVWLPPLGHSYSGK
            130       140       150       160       170       180

190       200       210       220       230       240
m040.pep  TFYLDMLQTAASAAVSLQAEKLVYLTLSDGISRPDGTLAETLSAQEAQSLAEHAGGQTRR
          ||:||||||||:|||||||||||||||||||||||||  |||||||||||||||:|||
a040      TFHLDMLQTAASVAVSLQAEKLVYLTLSDGISRPDGTLAVTLSAQEAQSLAEHAGGETRR
            190       200       210       220       230       240

250       260       270
m040.pep  LISSA----------------------ELFTRNGIGTSIAKEAFVSIRQAHXXDIPHI
          |||||                      |||||||||||||||||||||||||  |||||
a040      LISSAVAALEGGVHRVQILNGAADGSLLQELFTRNGIGTSIAKEAFVSIRQAHSGDIPHI
            250       260       270       280       290       300

280       290       300       310       320       330
m040.pep  AALIRPLEEQGILLHRXREYLENHISEFSILEHDGNLYGCAALKTFAEADCGEIACLAVS
          ||||||||||||||||| ||||||||||||||||||||||||||||||||||||||||||
a040      AALIRPLEEQGILLHRSREYLENHISEFSILEHDGNLYGCAALKTFAEADCGEIACLAVS
            310       320       330       340       350       360

340       350       360       370       380       390
m040.pep  PQXQDGGYGERXLAHIIDKARGIGISRLFALSTNTGEWFAERGFQTASEDELPETRRKDY
          || ||||||||| |||||||||||||||||||||||||||||||||||||||||||||||
a040      PQAQDGGYGERLLAHIIDKARGIGISRLFALSTNTGEWFAERGFQTASEDELPETRRKDY
            370       380       390       400       410       420

400       410
m040.pep  RSNGRNSHILVRRLHRX
          ||||||||||||||||
a040      RSNGRNSHILVRRLHRX
            430
```

Computer analysis of this amino acid sequence gave the following results:
Homology with a Predicted ORF from *N. gonorrhoeae* 40
ORF 040 shows 88.3% identity over a 436 aa overlap with a predicted ORF (ORF 040.ng) from *N. gonorrhoeae*:

```
m040/g040 m040.pep  MSAPDLFVAHFREAVPYIRQMRGKTLVAGIDDRLLEGDTLNKLAADIGLLSQLGIRLVLI   60
          |:|||  |||||||||:|||||||||||||||||| ||||||||||||||||||||||||
g040      MNAPDSFVAHFREAAPYIRQMRGTTLVAGIDGRLLEGGTLNKLAADIGLLSQLGIRLVLI   60 m040.pep  HGARHFLDRHAAAQGRTPHYCRGLRVTDETSLEQAQQFAGTVRSRFEAALCGSVSGFARA  120
          ||| ||||| |||||||||||||||||||||| |||||||||||||||||||||||||||
g040      HGAYHFLDRLAAAQGRTPHYCRGLRVTDETSLGQAQQFAGTVRSRFEAALCGSVSGFARA  120 m040.pep  PSVPLVSGNFLTARPIGVIDGTDMEYAGVIRKTDTAALRFQLDAGNIVWLPPLGHSYSGK  180
          ||||||||||||||||:|||||||||||||||||||||||||||||||:||||||:||
g040      PSVPLVSGNFLTARPMGVIDGTDMEYAGVIRKTDTAALRFQLDAGNIVWMPPLGHSYGGK  180 m040.pep  TFYLDMLQTAASAAVSLQAEKLVYLTLSDGISRPDGTLAETLSAQEAQSLAEHAGGQTRR  240
          ||  |||:|:|||:||||||||||||||||||||||||||||||||||||||||:::|||
g040      TFNLDMVQAAASVAVSLQAEKLVYLTLSDGISRPDGTLAETLSAQEAQSLAEHAASETRR  240 m040.pep  LISSA----------------------ELFTRNGIGTSIAKEAFVSIRQAHXXDIPHI   276
          |||||                      |||||||||||||||||||||||||  |||||
g040      LISSAVAALEGGVHRVQILNGAADGSLLQELFTRNGIGTSIAKEAFVSIRQAHSGDIPHI   300 m040.pep  AALIRPLEEQGILLHRXREYLENHISEFSILEHDGNLYGCAALKTFAEADCGEIACLAVS   336
          ||||||||||:|||||| ||||||||||||||||||:|||||||||||||||||||||||
g040      AALIRPLEEQGVLLHRSREYLENHISEFSILEHDGDLYGCAALKTFAEADCGEIACLAVS   360 m040.pep  PQXQDGGYGERXLAHIIDKARGIGISRLFALSTNTGEWFAERGFQTASEDELPETRRKDY   396
          || ||||||||| |||||||||||||||||||||||||||||||||||||||||||||||
g040      PQAQDGGYGERLLAHIIDKARGIGISRLFALSTNTGEWFAERGFQTASEDELPETRRKDY   420
```

-continued

```
m040.pep    RSNGRNSHILVRRLHRX   413
            ||||||  ||||||||||||
g040        RSNGRNPHILVRRLHRX   437
```

The following partial DNA sequence was identified in *N. gonorrhoeae* <SEQ ID 153>:

```
g041.seq
     1   ATGAGTTCGC CCAAACACAT CGGCTTGCAG GGCGGCAGCA ACGGCGGCCT

51   GATTACCGCC GCCGCCTTCG TGCGCGAACC GCAAAGCATC GGTGCGCTGG

101   TGTGCGAAGT ACCGCTGACC GATATGATCC GTTATCCGCT GCTGTCCGCC

151   GGTTCAAGTT GGACGGACGA ATACGGCAAT CCGCAGAAAT ACGAAGCCTG

201   CAAACGCCGG CTGGGCGAAT TGTCGCCGTA TCACAATCTT TCAGACGGCA

251   TCGATTATCC GCCCGCACTC ATTACCACCA GCCTCAGCGA CGACCGCGTC

301   CATCCCGCCC ACGCGCTCAA ATTCTACGCC AAACTGCGCG AAACCTCGCC

351   GCAATCTTGG CTCTACTCGC CTGACGGCGG CGGCCATACC GGCAACGGCA

401   CCCAACGCGA ATCCGCCGAC AAACTCGCCT GCGTGTTGCT GTTTTTGAAA

451   GAATTTTTGG GATAA
```

This corresponds to the amino acid sequence <SEQ ID 154; ORF 041.ng>:

```
g041.pep
     1   MSSPKHIGLQ GGSNGGLITA AAFVREPQSI GALVCEVPLT DMIRYPLLSA

51   GSSWTDEYGN PQKYEACKRR LGELSPYHNL SDGIDYPPAL ITTSLSDDRV

101   HPAHALKFYA KLRETSPQSW LYSPDGGGHT GNGTQRESAD KLACVLLFLK

151   EFLG*
```

The following partial DNA sequence was identified in *N. meningitidis* <SEQ ID 155>:

```
m041.seq
     1   ATCAGTTCGC CCGAACACAT CGGCTTGCAG GGCGGCAGCA ACGGCGGACT

51   GATTACTGCC GCCGCCTTCG TGCGCGAACC GCAAAGCATC GGCGCGCTGG

101   TGTGCGAAGT GCCGCTGACC GACATGATCC GTTATCCGCT GCTCTCCGCC

151   GGTTCAAGCT GGACAGACGA ATACGGCAAT CCGCAAAAAT ACGAAGTCTG

201   CAAACGCCGG TTGGGCGAAT TGTCGCCGTA TCACAATCTT TCAGACGGCA

251   TCGATTATCC GCCCGCGCTC ATTACCACCA GCCTGTCCGA CGATCGCGTC

301   CATCCCGCCC ACGCGCTCAA GTTCTACGCC AAACTGCGCG AAACCTCCGC

351   GCAATCTTGG CTCTACTCGC CTGACGGCGG CGGCCATACC GGCAACGGCA

401   CCCAACGCGA ATCCGCCGAC GAACTCGCCT GCGTCTTGCT GTTTTTGAAA

451   GAGTTTTTGG GCTAA
```

This corresponds to the amino acid sequence <SEQ ID 156; ORF 041>:

```
m041.pep
    1    ISSPEHIGLQ GGSNGGLITA AAFVREPQSI GALVCEVPLT DMIRYPLLSA

51    GSSWTDEYGN PQKYEVCKRR LGELSPYHNL SDGIDYPPAL ITTSLSDDRV

101    HPAHALKFYA KLRETSAQSW LYSPDGGGHT GNGTQRESAD ELACVLLFLK

151    EFLG*
```

The following partial DNA sequence was identified in *N. meningitidis* <SEQ ID 157>:

```
a041.seq
    1    ATCAGTTCGC CCGAACACAT CGGCTTGCAG GGCGGCAGCA ACGGCGGACT

51    GATTACTGCC GCCGCCTTCG TGCGCGAACC GCAAAGCATA GGCGCGCTGG

101    TGTGCGAAGT GCCGCTGACC GACATGATCC GTTATCCGCT GCTCTCCGCC

151    GGTTCAAGCT GGACAGACGA ATACGGCAAT CCGCAAAAAT ACGAAGTCTG

201    CAAACGCCGG TTGGGCGAAT TGTCGCCGTA TCACAATCTT TCAGACGGCA

251    TCGATTATCC GCCCGCGCTC ATTACCACCA GCCTGTCCGA CGATCGCGTC

301    CATCCCGCCC ACGCGCTCAA GTTCTACGCC AAACTGCGCG AAACCTCGCC

351    GCAATCTTGG CTCTACTCGC CTGACGGCGG CGGCCATACC GGCAACGGCA

401    CGCAGCGCGA AGCCGCCGAC GAACTCGCCT GCGTGTTGCT GTTTTTGAAA

451    GAGTTTTTGG GCTAA
```

This corresponds to the amino acid sequence <SEQ ID 158; ORF 041.a>:

```
a041.pep
    1    ISSPEHIGLQ GGSNGGLITA AAFVREPQSI GALVCEVPLT DMIRYPLLSA

51    GSSWTDEYGN PQKYEVCKRR LGELSPYHNL SDGIDYPPAL ITTSLSDDRV

101    HPAHALKFYA KLRETSPQSW LYSPDGGGHT GNGTQREAAD ELACVLLFLK

151    EFLG*
``` m041/a041 98.7% identity over a 154 aa overlap

```
                    10         20         30         40         50         60
    m041.pep  ISSPEHIGLQGGSNGGLITAAAFVREPQSIGALVCEVPLTDMIRYPLLSAGSSWTDEYGN
              ||||||||||||||||||||||||||||||||||||||||||||||||||||||||||||
    a041      ISSPEHIGLQGGSNGGLITAAAFVREPQSIGALVCEVPLTDMIRYPLLSAGSSWTDEYGN
                    10         20         30         40         50         60

70         80         90        100        110        120
    m041.pep  PQKYEVCKRRLGELSPYHNLSDGIDYPPALITTSLSDDRVHPAHALKFYAKLRETSAQSW
              |||||||||||||||||||||||||||||||||||||||||||||||||||||||| |||
    a041      PQKYEVCKRRLGELSPYHNLSDGIDYPPALITTSLSDDRVHPAHALKFYAKLRETSPQSW
                    70         80         90        100        110        120

130        140        150
    m041.pep  LYSPDGGGHTGNGTQRESADELACVLLFLKEFLGX
              |||||||||||||||||:|||||||||||||||||
    a041      LYSPDGGGHTGNGTQREAADELACVLLFLKEFLGX
                   130        140        150
```

Computer analysis of this amino acid sequence gave the following results:
Homology with a Predicted ORF from *N. gonorrhoeae*
ORF 041 shows 96.8% identity over a 154 aa overlap with a predicted ORF (ORF 041.ng) from *N. gonorrhoeae*:

```
m041/g041

10         20         30         40         50         60
   m041.pep   ISSPEHIGLQGGSNGGLITAAAFVREPQSIGALVCEVPLTDMIRYPLLSAGSSWTDEYGN
              :|||:||||||||||||||||||||||||||||||||||||||||||||||||||||||
   g041       MSSPKHIGLQGGSNGGLITAAAFVREPQSIGALVCEVPLTDMIRYPLLSAGSSWTDEYGN
                 10         20         30         40         50         60

70         80         90        100        110        120
   m041.pep   PQKYEVCKRRLGELSPYHNLSDGIDYPPALITTSLSDDRVHPAHALKFYAKLRETSAQSW
              |||||:||||||||||||||||||||||||||||||||||||||||||||||||| |||
   g041       PQKYEACKRRLGELSPYHNLSDGIDYPPALITTSLSDDRVHPAHALKFYAKLRETSPQSW
                 70         80         90        100        110        120

130        140        150
   m041.pep   LYSPDGGGHTGNGTQRESADELACVLLFLKEFLGX
              ||||||||||||||||||||||:||||||||||||
   g041       LYSPDGGGHTGNGTQRESADKLACVLLFLKEFLGX
                130        140        150
```

The following partial DNA sequence was identified in *N. gonorrhoeae* <SEQ ID 159>:

```
g041-1.seq
      1    ATGAAATCCT ACCCCGACCC TACCGCCAT TTTGAAAACC TCGATTCCGC
     51    CGAAACGCAA AACTTCGCTG CTGAAGCGAA TGCCGAAACG CGCGCGCGTT
    101    TTTTAAACAA CGACAAGGCG CGCGCACTTT CAGACGGCAT TTTGAATCAA
    151    ATGCAGGACA CGCGGCAGAT TCCGTTTTGT CAGGAACACC GCGCGCGGAT
    201    GTACCATTTC CATCAGAATG CGGAATATCC GAAGGGCGTG TACCGCATGT
    251    GTACGGCGGC GACCTACCGT TCCGGCTATC CCGAGTGGAA AATCCTGTTT
    301    TCGGTGGCGG ATTTCGATGA GTTGCTCGGC GACGATGTGT ATTTGGGCGG
    351    CGTGTCGCAC TTGGTGGAGC AGCCCAACCG CGCGCTGCTG ACTTTGAACA
    401    AATCGGGCGG CGATACGGCG TATACGCTGG AAGTGGATTT GGAAGCAGGG
    451    GAATTGGTAG AGGGCGGTTT TCACTTTCCG GCAGGCAAAA ACCATGTGTC
    501    GTGGCGCGAT GAAAACAGCG TGTGGGTGTG TCCGGCTTGG GACGAACGCC
    551    AGTTGACCGA ATCGGGCTAT CCGCGCGAAG TGTGGCTGGT GGAACGCGGC
    601    AAGAGTTTCG AGGAAAGCCT GCCGGCGTAC CAAATCGATA AAGGCGCGAT
    651    GATGGTAAAC GCGTGGCGTT ACCTCGATCC GCAGGGTTCG CCGATTGATT
    701    TGATTGAAGC GTCGGACGGT TTTTACACCA AGACGTATTT GCAGGTGTCG
    751    TCCGAAGGCG GGGCGAAACC GTTGAACCTG CCTAATGATT GCGATGTGGT
    801    CGGCTATCTG GCGGGACATC TTTTGCTGAC GCTGCGCAAG GACTGGCACC
    851    GCGCGAACCA AAGCTATCCG AGTGGCGCGT GGTGGCGGT GAAACTGAAT
    901    CGGGGCGAAC TCGGGGCGGC GCAGCTTTTG TTTGCGCCCG ATGAAACGCA
    951    GGCATTGGAA AGCGTGGAAA CGACCAAGCG TTTTGTGGTG GCAAGCCTGC
   1001    TGGAGAATGT ACAAGGCCGT CTGAAAGCGT GGCGGTTTGC CGACAGCAAA
   1051    TGGCAGGAAG CCGAGTTGCC GCACCTGCCC TCGGGCGCGT GGAAATGAC
   1101    CGACCAACCG TGGGGCGGCG ACGTGGTTTA TCTTGCCGCC AGCGATTTCA
   1151    CCACGCCGCT GACGCTGTTT GCGCTGGATT TGAACGTGAT GGAACTGACC
   1201    GTCATGCGCC TCCAGCCGCA GCAGTTTGTT TCAGACGGCA TCGAAGTGCG
   1251    GCAGTTTTGG GCGGTGTCGT CCGACGGCGA ACGCATTCCT TATTTCCACG
   1301    TCGGCAAAAA CGCCGCGCCC GACACGCCGA CCTTAGTCTA TGCTTACGGA
   1351    GGTTTCGGCA TTCCTGAATT GCCGCATTAT CTGGGCAGCG TCGGCAAATA
```

```
-continued
1401    TTGGCTGGAA GAGGGCAATG CCTTTGTATT GGCAAACATC CGCGGCGGCG

1451    GAGAATTCGG CCCGCGCTGG CATCAGGCGG CGCAGGGAAT CAGCAAACAC

1501    AAAAGCGTTG ATGATTTGTT GGCAGTCGTG CGTGATTTGT CCGAACGCGG

1551    CATGAGTTCG CCCAAACACA TCGGCTTGCA GGGCGGCAGC AACGGCGGCC

1601    TGATTACCGC CGCCGCCTTC GTGCGCGAAC CGCAAAGCAT CGGTGCGCTG

1651    GTGTGCGAAG TACCGCTGAC CGATATGATC CGTTATCCGC TGCTGTCCGC

1701    CGGTTCAAGT TGGACGGACG AATACGGCAA TCCGCAGAAA TACGAAGCCT

1751    GCAAACGCCG GCTGGGCGAA TTGTCGCCGT ATCACAATCT TTCAGACGGC

1801    ATCGATTATC CGCCCGCACT CATTACCACC AGCCTCAGCG ACGACCGCGT

1851    CCATCCCGCC CACGCGCTCA AATTCTACGC CAAACTGCGC GAAACCTCGC

1901    CGCAATCTTG GCTCTACTCG CCTGACGGCG GCGGCCATAC CGGCAACGGC

1951    ACCCAACGCG AATCCGCCGA CAAACTCGCC TGCGTGTTGC TGTTTTTGAA

2001    AGAATTTTTG GGATAA
```

This corresponds to the amino acid sequence <SEQ ID 160; ORF 041-1.ng>:

```
g041-1.pep
    1    MKSYPDPYRH FENLDSAETQ NFAAEANAET RARFLNNDKA RALSDGILNQ

51    MQDTRQIPFC QEHRARMYHF HQNAEYPKGV YRMCTAATYR SGYPEWKILF

101    SVADFDELLG DDVYLGGVSH LVEQPNRALL TLNKSGGDTA YTLEVDLEAG

151    ELVEGGFHFP AGKNHVSWRD ENSVWVCPAW DERQLTESGY PREVWLVERG

201    KSFEESLPAY QIDKGAMMVN AWRYLDPQGS PIDLIEASDG FYTKTYLQVS

251    SEGGAKPLNL PNDCDVVGYL AGHLLLTLRK DWHRANQSYP SGALVAVKLN

301    RGELGAAQLL FAPDETQALE SVETTKRFVV ASLLENVQGR LKAWRFADSK

351    WQEAELPHLP SGALEMTDQP WGGDVVYLAA SDFTTPLTLF ALDLNVMELT

401    VMRLQPQQFV SDGIEVRQFW AVSSDGERIP YFHVGKNAAP DTPTLVYAYG

451    GFGIPELPHY LGSVGKYWLE EGNAFVLANI RGGGEFGPRW HQAAQGISKH

501    KSVDDLLAVV RDLSERGMSS PKHIGLQGGS NGGLITAAAF VREPQSIGAL

551    VCEVPLTDMI RYPLLSAGSS WTDEYGNPQK YEACKRRLGE LSPYHNLSDG

601    IDYPPALITT SLSDDRVHPA HALKFYAKLR ETSPQSWLYS PDGGGHTGNG

651    TQRESADKLA CVLLFLKEFL G*
```

The following partial DNA sequence was identified in *N. meningitidis* <SEQ ID 161>:

```
m041-1.seq
    1    ATGAAATCCT ACCCCGACCC CTACCGCCAT TTTGAAAACC TCGATTCCGC

51    CGAAACGCAA AACTTCGCTG CTGAAGCGAA TGCCGAAACG CGCGCGCGTT

101    TTTTAGAAAA CGACAAGGCG CGCGCGCTTT CAGACGGCAT TTTGGCGCAG

151    TTGCAGGACA CGCGGCAGAT TCCGTTTTGT CAGGAACACC GCGCGCGGAT

201    GTACCATTTC CATCAGGACG CGGAGTATCC GAAGGGCGTG TACCGCGTGT

251    GTACCGCGGC GACGTATCGT TCCGGCTATC CGAGTGGAA ATCCTGTTTT

301    TCGGTGGCGG ATTTCGACGA ATTGCTTGGC GACGATGTGT ATTTGGGCGG
```

```
 351    CGTGTCGCAC TTGGTGGAAC AGCCCAACCG CGCGTTGTTA ACACTGAGCA

401    AATTGGGCAG CGATACGGCG TACACGCTGG AAGTGGATTT GGAAGCAGGG

451    GAGTTGGTCG AAGGCGGTTT TCACTTTCCG GCAGGCAAAA ACCATGTGTC

501    GTGGCGCGAT GAAAACAGCG TGTGGGTGTG TCCGGCTTGG AACGAACGCC

551    AGTTGACCCA ATCGGGCTAT CCGCGCGAAG TATGGCTGGT GGAACGCGGC

601    AAGAGTTTCG AGGAAAGCCT GCCTGTGTAT CAAATCGGCG AAGACGGCAT

651    GATGGTGAAC GCGTGGCGTT ATCTCGATCC GCAGGGTTCG CCGATTGATT

701    TGATTGAAGC GTCGGACGGT TTTTACACCA AAACCTATTT GCGGGTCTCA

751    GCCGAAGGCG AGGCGAAACC GTTAAACCTG CCCAACGATT GCGACGTGGT

801    CGGCTATCTG GCGGGGCATC TTTTGCTGAC GCTGCGCAAG GACTGGAACC

851    GCGCGAACCA AAGCTATCCG AGCGGCGCGC TGGTGGCGGT GAAGCTGAAT

901    CGGGGCGAAC TCGGGCGGC GCAGCTTTTG TTTGCGCCCG ATGAAACGCA

951    GGCATTGGAA AGCGTGGAAA CGACCAAGCG TTTTGTGGTG GCGAGCCTGT

1001    TGGAGAACGT ACAAGGCCGT CTGAAAGCAT GGCGGTTTGC CGACGGCAAA

1051    TGGCAGGAAG TCGAATTGCC GCGCCTGCCT TCGGGCGCGT TGGAAATGAC

1101    CGACCAACCT TGGGGCGGCG ACGTGGTTTA CCTTGCCGCC AGCGATTTCA

1151    CCACGCCGCT GACGCTGTTT GCGCTGGATT TGAACGTGAT GGAACTGACC

1201    GTCATGCGCC GCCAGCCGCA GCAGTTTGAT TCAGACGGCA TTAACGTGCA

1251    GCAGTTTTGG ACGACTTCGG CTGACGGCGA GCGCATTCCT TATTTCCACG

1301    TCGGCAAAAA CGCCGCGCCC GACATGCCGA CGCTGGTCTA TGCCTACGGC

1351    GGTTTCGGCA TTCCCGAATT GCCGCATTAT CTGGGCAGCA TTGGCAAATA

1401    TTGGCTGGAA GAGGGCAATG CCTTTGTATT GGCGAACATC CGCGGCGGCG

1451    GCGAGTTCGG CCCGCGCTGG CATCAGGCGG CGCAGGGAAT CAGCAAACAT

1501    AAAAGCGTTG ATGATTTATT GGCAGTCGTG CGCGATTTGT CCGAACGCGG

1551    TATCAGTTCG CCCGAACACA TCGGCTTGCA GGGCGGCAGC AACGGCGGAC

1601    TGATTACTGC CGCCGCCTTC GTGCGCGAAC CGCAAAGCAT CGGCGCGCTG

1651    GTGTGCGAAG TGCCGCTGAC CGACATGATC CGTTATCCGC TGCTCTCCGC

1701    CGGTTCAAGC TGGACAGACG AATACGGCAA TCCGCAAAAA TACGAAGTCT

1751    GCAAACGCCG GTTGGGCGAA TTGTCGCCGT ATCACAATCT TTCAGACGGC

1801    ATCGATTATC CGCCCGCGCT CATTACCACC AGCCTGTCCG ACGATCGCGT

1851    CCATCCCGCC CACGCGCTCA AGTTCTACGC CAAACTGCGC GAAACCTCCG

1901    CGCAATCTTG GCTCTACTCG CCTGACGGCG GCGGCCATAC CGGCAACGGC

1951    ACCCAACGCG AATCCGCCGA CGAACTCGCC TGCGTCTTGC TGTTTTTGAA

2001    AGAGTTTTTG GGCTAA
```

This corresponds to the amino acid sequence <SEQ ID 162; ORF 041-1>:

```
m041-1.pep
    1   MKSYPDPYRH FENLDSAETQ NFAAEANAET RARFLENDKA RALSDGILAQ

51   LQDTRQIPFC QEHRARMYHF HQDAEYPKGV YRVCTAATYR SGYPEWKILF

101   SVADFDELLG DDVYLGGVSH LVEQPNRALL TLSKLGSDTA YTLEVDLEAG
```

-continued

```
151    ELVEGGFHFP AGKNHVSWRD ENSVWVCPAW NERQLTQSGY PREVWLVERG

201    KSFEESLPVY QIGEDGMMVN AWRYLDPQGS PIDLIEASDG FYTKTYLRVS

251    AEGEAKPLNL PNDCDVVGYL AGHLLLTLRK DWNRANQSYP SGALVAVKLN

301    RGELGAAQLL FAPDETQALE SVETTKRFVV ASLLENVQGR LKAWRFADGK

351    WQEVELPRLP SGALEMTDQP WGGDVVYLAA SDFTTPLTLF ALDLNVMELT

401    VMRRQPQQFD SDGINVQQFW TTSADGERIP YFHVGKNAAP DMPTLVYAYG

451    GFGIPELPHY LGSIGKYWLE EGNAFVLANI RGGGEFGPRW HQAAQGISKH

501    KSVDDLLAVV RDLSERGISS PEHIGLQGGS NGGLITAAAF VREPQSIGAL

551    VCEVPLTDMI RYPLLSAGSS WTDEYGNPQK YEVCKRRLGE LSPYHNLSDG

601    IDYPPALITT SLSDDRVHPA HALKFYAKLR ETSAQSWLYS PDGGGHTGNG

651    TQRESADELA CVLLFLKEFL G*
``` m041-1/g041-1 94.6% identity in 671 aa overlap

```
                  10         20         30         40         50         60
m041-1.pep MKSYPDPYRHFENLDSAETQNFAAEANAETRARFLENDKARALSDGILAQLQDTRQIPFC
           ||||||||||||||||||||||||||||||||||||:|||||||||||||  |:||||||||
g041-1     MKSYPDPYRHFENLDSAETQNFAAEANAETRARFLNNDKARALSDGILNQMQDTRQIPFC
                  10         20         30         40         50         60

70         80         90        100        110        120
m041-1.pep QEHRARMYHFHQDAEYPKGVYRVCTAATYRSGYPEWKILFSVADFDELLGDDVYLGGVSH
           ||||||||||||:|||||||||||:|||||||||||||||||||||||||||||||||||
g041-1     QEHRARMYHFHQNAEYPKGVYRMCTAATYRSGYPEWKILFSVADFDELLGDDVYLGGVSH
                  70         80         90        100        110        120

130        140        150        160        170        180
m041-1.pep LVEQPNRALLTLSKLGSDTAYTLEVDLEAGELVEGGFHFPAGKNHVSWRDENSVWVCPAW
           ||||||||||||:| |:|||||||||||||||||||||||||||||||||||||||||||
g041-1     LVEQPNRALLTLNKSGGDTAYTLEVDLEAGELVEGGFHFPAGKNHVSWRDENSVWVCPAW
                 130        140        150        160        170        180

190        200        210        220        230        240
m041-1.pep NERQLTQSGYPREVWLVERGKSFEESLPVYQIGEDGMMVNAWRYLDPQGSPIDLIEASDG
           :|||||:|||||||||||||||||||||||:|||  : :|||||||||||||||||||||
g041-1     DERQLTESGYPREVWLVERGKSFEESLPAYQIDKGAMMVNAWRYLDPQGSPIDLIEASDG
                 190        200        210        220        230        240

250        260        270        280        290        300
m041-1.pep FYTKTYLRVSAEGEAKPLNLPNDCDVVGYLAGHLLLTLRKDWNRANQSYPSGALVAVKLN
           |||||||:||::||||||||||||||||||||||||||||||||:|||||||||||||||
g041-1     FYTKTYLQVSSEGGAKPLNLPNDCDVVGYLAGHLLLTLRKDWHRANQSYPSGALVAVKLN
                 250        260        270        280        290        300

310        320        330        340        350        360
m041-1.pep RGELGAAQLLFAPDETQALESVETTKRFVVASLLENVQGRLKAWRFADGKWQEVELPRLP
           ||||||||||||||||||||||||||||||||||||||||||||||||:|||:|||:||
g041-1     RGELGAAQLLFAPDETQALESVETTKRFVVASLLENVQGRLKAWRFADSKWQEAELPHLP
                 310        320        330        340        350        360

370        380        390        400        410        420
m041-1.pep SGALEMTDQPWGGDVVYLAASDFTTPLTLFALDLNVMELTVMRRQPQQFDSDGINVQQFW
           |||||||||||||||||||||||||||||||||||||||||||:|||||:|||:|||
g041-1     SGALEMTDQPWGGDVVYLAASDFTTPLTLFALDLNVMELTVMRLQPQQFVSDGIEVRQFW
                 370        380        390        400        410        420

430        440        450        460        470        480
m041-1.pep TTSADGERIPYFHVGKNAAPDMPTLVYAYGGFGIPELPHYLGSIGKYWLEEGNAFVLANI
           ::|:|||||||||||||||||:|||||||||||||||||||||:|||||||||||||||
g041-1     AVSSDGERIPYFHVGKNAAPDTPTLVYAYGGFGIPELPHYLGSVGKYWLEEGNAFVLANI
                 430        440        450        460        470        480

490        500        510        520        530        540
m041-1.pep RGGGEFGPRWHQAAQGISKHKSVDDLLAVVRDLSERGISSPEHIGLQGGSNGGLITAAAF
           |||||||||||||||||||||||||||||||||||:||||||||||||||||||||||||
g041-1     RGGGEFGPRWHQAAQGISKHKSVDDLLAVVRDLSERGMSSPKHIGLQGGSNGGLITAAAF
                 490        500        510        520        530        540

550        560        570        580        590        600
m041-1.pep VREPQSIGALVCEVPLTDMIRYPLLSAGSSWTDEYGNPQKYEVCKRRLGELSPYHNLSDG
           |||||||||||||||||||||||||||||||||:|||||||:||||||||||||||||||
g041-1     VREPQSIGALVCEVPLTDMIRYPLLSAGSSWTDETGNPQKYEACKRRLGELSPYHNLSDG
                 550        560        570        580        590        600
```

-continued

```
              610        620        630        640        650        660
m041-1.pep  IDYPPALITTSLSDDRVHPAHALKFYAKLRETSAQSWLYSPDGGHTGHGTQRESADELA
            |||||||||||||||||||||||||||||||||| ||||||||||||||||||||||:||
g041-1      IDYPPALITTSLSDDRVHPAHALKFYAKLRETSPQSWLYSPDGGHTGHGTQRESADKLA
              610        620        630        640        650        660

670
m041-1.pep  CVLLFLKEFLGX
            ||||||||||||
g041-1      CVLLFLKEFLGX
              670
``` m041-1 (SEQ ID 162)/P55577 (SEQ ID 4159)

```
sp|P55577|Y4NA_RHISN PROBABLE PEPTIDASE Y4NA >gi|2182536 (AE000086)
Y4nA [Rhizobium sp. NGR234] Length = 726
Score = 370 bits (940), Expect = e-101
Identities = 217/682 (31%), Positives = 331/682 (47%), Gaps = 22/682
(3%)
Query:   2 KSYPDPYRHFENLDSAETQNFAAEANAETRARFLENDKARALSDGILAQLQDTRQIPFCQ  61
           K  DP  +  +D +  +    N T +  ++ +       L  LQ T +I
Sbjct:  42 KDASDPRAYLNEIDGDKAMTWVEAHNLSTVDKLSKDPRYSEYQADALTILQATDRIASPS 101

Query:  62 EHRARMY-HFHQDAEYPKGVYRVCTAATYRSGYPEWKILFSVADFDELLGDDVYLGGVSH 120
             R  M  +F QD + +G++R  T  +YRSG P+W+ +   V   +    G        G
Sbjct: 102 FARDGMIDNFWQDGTHVQGLWRRTTWESYRSGNPQWRTILDVDALSKAEGKTWVFEGGDC 161

Query: 121 LVEQPNRALLTLSKLGSDTAYTLEVDLEAGELVEGGFHFPAGKNHVSWRDENSVWVCPAW 180
           L   N  L+ LS  G D     E D+  GE V+ GF  P GK  V+W DEN+++V  W
Sbjct: 162 LPPTSNLCLIRLSDGGKDADVVREFDIAKGEFVKEGFVLPEGKQSVTWVDENTIYVTREW 221

Query: 181 NERQLTQSGYPREVWLVERGKSFEESLPVYQ------IGEDGMM--VNAWRYLDPQGSPI 232
            ++T SGY   +V+RG+S ++++ +++         E G++  ++      +D    +
Sbjct: 222 TPGEVTSSGYAYVTKVVKRGQSLDQAVEIFRGQKKDVSAERGVLRDIDGKYVMDTSYRGL 281

Query: 233 DLIEASDGFYTKTYLRVSAEGEAKPLNLPNDCDVVGYLAGHLLLTLRKDWNRANQS-YPS 291
           D        FY +  +      L LP     GY G  + L+ DW  A  + +  + +
Sbjct: 282 DFFNTELAFYPNGH----PDTRKVVLPLPTTAVFSGYYKGQAIYWLKSDWTSAKGTVFHN 337

Query: 292 GALVAVKLNRGELGAAQL----LFAPDETQALESVETTKRFVVASLLENVQGRLKAWRFA 347
           GA++A L      A++   LF P+E Q++   TK +V S+L NV   ++++ F
Sbjct: 338 GAIIAFDLKAALADPARVEPLVLFMPNEHQSVAGTTQTKNRLVLSILSNVTSEVRSFDFG 397

Query: 348 DGKWQEVELPRLPSGALEMTDQPWGGDVVYLAASDFTTPLTLFALDLNVMELTVMRRQPQ 407
             G W    +L + L +T  D +++ +    F  P TLF  D     ++ +    P
Sbjct: 398 KGGWSSFKLALPENSTLSLTSSDDESDQLFVFSEGFLEPSTLFCADAATGQVEKITSTPA 457

Query: 408 QFDSDGINVQQFWTTSADGERIPYFHVGKNAAP---DMPTLVYAYGGFGIPELPHYLGSI 464
           +FD+G+  QQFW TS DG ++PYF V +          PT++YAYGGF IP  P Y  +
Sbjct: 458 RFDAGGLQAQQFWATSKDGTKVPYFLVARKDVKLDGTNPTILYAYGGFQIPMQPSYSAVL 517

Query: 465 GKYWLEEGNAFVLANIRGGGEFGPRWHQAAQGISKHKSVDDLLAVVRDLSERGISSPEHI 524
           GK WLE+G A+ LANIRGGGEFGP+WH A     ++  DD  AV +DL + ++S H+
Sbjct: 518 GKLWLEKGGAYALANIRGGGEFGPKWHDAGLKTNRQRVYDDFQAVAQDLIAKKVTSTPHL 577

Query: 525 GLQGGSNGGLITAAAFVREPQSIGALVCEVPLTDMIRYPLLSAGSSWTDEYGNPQKYEVC 584
           G+ GGSNGGL+    ++ P   A+V +VPL DM+ +  +SAG+SW  EYG P  V
Sbjct: 578 GIMGGSNGGLLMGVQMIQRPDLWNAVVIQVPLLDMVNFTRMSAGASWQAEYGSPDD-PVE 636

Query: 585 KRRLGELSPYHNLSDGIDYPPALITTSLSDDRVHPAHALKFYAKLRETSAQSWLYSPDGG 644
                  L +SPYHN+ G+ YP   TS DDRV PA+A K A  + Y G
Sbjct: 637 GAFLRSISPYHNVKAGVAYPEPFFETSTKDDRVGPVHARKMAALFEDMGLPFYYYENIEG 696

Query: 645 GHTGNGTQRESADELACVLLFL 666
           GH  +E A A +++
Sbjct: 697 GHAAAANLQEHARRYALEYIYM 718
```

The following partial DNA sequence was identified in *N. meningitidis* <SEQ ID 163>:

```
a041-1.seq
    1    ATGAAATCCT ACCCCGACCC CTACCGCCAT TTTGAAAACC TCGATTCCGC

51    CGAAACGCAA AACTTCGCTG CTGAAGCGAA TGCCGAAACG CGCGCGCGTT

101    TTTTAAACAA CGACAAGGCA CGCGCATTGT CTGACGGCAT TTTGGCGCAG
```

```
151   TTGCAGGACA CGCGGCAAAT TCCGTTTTGT CAGGAACACC GCGCGCGGAT

201   GTACCATTTC CATCAAGATG CGGAATATCC GAAAGGCGTG TACCGCGTGT

251   GTACCGCGGC GACTTACCGT TCGGGCTATC CTGAGTGGAA AATCCTGTTT

301   TCGGTGGCGG ATTTCGACGA ATTGCTCGGT GACGATGTAT ATCTAGGCGG

351   CGTGTCGCAC CTGGTGGAAC AGCCCAACCG CGCGTTGTTA ACACTGAGCA

401   AATCGGGCGG CGATACCGCG TACACGCTGG AAGTGGATTT GGAAGCAGGG

451   GAGTTGGTAG AAGGCGGTTT TCACTTTCCG GCAGGCAAAA ACCATGTGTC

501   GTGGCGCGAT GAAAACAGCG TGTGGGTGTG TCCGGCTTGG GACGAACGCC

551   AGTTGACCGA ATCGGGCTAT CCGCGCGAGG TGTGGCTGGT GGAACGCGGC

601   AAGAGTTTCG AGGAAAGCCT GCCGGTGTAC CAAATTGCTG AAGACGGCAT

651   GATGGTGAAC GCGTGGCGTT ACCTCGATCC GCAGGGTTCG CCGATTGATT

701   TGATTGAAGC GTCTGACGGT TTTTACACCA AAACCTATTT GCAGGTCTCA

751   GCCGAAGGCG AAGCGAAACC GTTAAACCTG CCCAACGATT GCGACGTAGT

801   CGGCTATCTG GCCGGACATC TTTTGCTGAC CTTGCGTAAA GACTGGCACC

851   GCGCGAACCA AAGCTATCCG AGTGGCGCAT GGTAGCAGT AAAATTAAAC

901   CGCGGCGAAT TGGGCGCGGC GCAGCTTTTG TTTGCGCCCA ATGAAACGCA

951   GGCATTGGAA AGCGTGGAAA CGACCAAGCG TTTTGTCGTG GCGAGCCTGC

1001  TGGAAAACGT ACAGGGTCGT CTGAAAGCGT GGCGTTTTAC TGATGGCAAA

1051  TGGCAGGAAA CCGAGTTGCC GCGCCTGCCT TCGGGCGCGT TGGAAATGAC

1101  CGACCAACCG TGGGGGGGCG ACGTAGTTTA CCTTGCCGCC AGCGATTTCA

1151  CCACGCCGCT GACGCTGTTT GCATTGGATT TGAACGTGAT GGAACTGACC

1201  GTCATGCGCC GCCAGCCGCA GCAGTTTGAT TCAGACGGCA TTAACGTGCA

1251  GCAGTTTTGG ACGACTTCGG CTGACGGCGA GCGCATTCCT TATTTCCACG

1301  TCGGCAAAAA CGCCGCGCCC GACATGCCGA CGCTGGTCTA TGCCTACGGC

1351  GGTTTCGGCA TTCCCGAATT GCCGCATTAT CTGGGCAGCA TTGGCAAATA

1401  TTGGCTGGAA GAGGGCAATG CCTTTGTATT GGCGAACATC CGCGGCGGCG

1451  GCGAGTTCGG CCCGCGCTGG CATCAGGCGG CGCAGGGAAT CAGCAAACAT

1501  AAAAGCGTTG ATGATTTATT GGCAGTCGTG AGCGATTTGT CCGAACGCGG

1551  TATCAGTTCG CCCGAACACA TCGGCTTGCA GGGCGGCAGC AACGGCGGAC

1601  TGATTACTGC CGCCGCCTTC GTGCGCGAAC CGCAAAGCAT AGGCGCGCTG

1651  GTGTGCGAAG TGCCGCTGAC CGACATGATC CGTTATCCGC TGCTCTCCGC

1701  CGGTTCAAGC TGGACAGACG AATACGGCAA TCCGCAAAAA TACGAAGTCT

1751  GCAAACGCCG GTTGGGCGAA TTGTCGCCGT ATCACAATCT TTCAGACGGC

1801  ATCGATTATC CGCGCGCGCT CATTACCACC AGCCTGTCCG ACGATCGCGT

1851  CCATCCCGCC CACGCGCTCA AGTTCTACGC CAAACTGCGC GAAACCTCGC

1901  CGCAATCTTG GCTCTACTCG CCTGACGGCG GCGGCCATAC CGGCAACGGC

1951  ACGCAGCGCG AAGCCGCCGA CGAACTCGCC TGCGTGTTGC TGTTTTTGAA

2001  AGAGTTTTTG GGCTAA
```

This corresponds to the amino acid sequence <SEQ ID 164; ORF 041-1.a>:

```
a041-1.pep
    1   MKSYPDPYRH FENLDSAETQ NFAAEANAET RARFLNNDKA RALSDGILAQ

51   LQDTRQIPFC QEHRARMYHF HQDAEYPKGV YRVCTAATYR SGYPEWKILF

101   SVADFDELLG DDVYLGGVSH LVEQPNRALL TLSKSGGDTA YTLEVDLEAG

151   ELVEGGFHFP AGKNHVSWRD ENSVWVCPAW DERQLTESGY PREVWLVERG

201   KSFEESLPVY QIAEDGMMVN AWRYLDPQGS PIDLIEASDG FYTKTYLQVS

251   AEGEAKPLNL PNDCDVVGYL AGHLLLTLRK DWHRANQSYP SGALVAVKLN

301   RGELGAAQLL FAPNETQALE SVETTKRFVV ASLLENVQGR LKAWRFTDGK

351   WQETELPRLP SGALEMTDQP WGGDVVYLAA SDFTTPLTLF ALDLNVMELT

401   VMRRQPQQFD SDGINVQQFW TTSADGERIP YFHVGKNAAP DMPTLVYAYG

451   GFGIPELPHY LGSIGKYWLE EGNAFVLANI RGGGEFGPRW HQAAQGISKH

501   KSVDDLLAVV SDLSERGISS PEHIGLQGGS NGGLITAAAF VREPQSIGAL

551   VCEVPLTDMI RYPLLSAGSS WTDEYGNPQK YEVCKRRLGE LSPYHNLSDG

601   IDYPPALITT SLSDDRVHPA HALKFYAKLR ETSPQSWLYS PDGGGHTGNG

651   TQREAADELA CVLLFLKEFL G*
```

25 a041-1/m041-1 97.9% identity in 671 aa overlap

```
                    10         20         30         40         50         60
a041-1.pep  MKSYPDPYRHFENLDSAETQNFAAEANAETRARFLNNDKARALSDGILAQLQDTRQIPFC
            |||||||||||||||||||||||||||||||||||:||||||||||||||||||||||||
m041-1      MKSYPDPYRHFENLDSAETQNFAAEANAETRARFLENDKARALSDGILAQLQDTRQIPFC
                    10         20         30         40         50         60

70         80         90        100        110        120
a041-1.pep  QEHRARMYHFHQDAEYPKGVYRVCTAATYRSGYPEWKILFSVADFDELLGDDVYLGGVSH
            ||||||||||||||||||||||||||||||||||||||||||||||||||||||||||||
m041-1      QEHRARMYHFHQDAEYPKGVYRVCTAATYRSGYPEWKILFSVADFDELLGDDVYLGGVSH
                    70         80         90        100        110        120

130        140        150        160        170        180
a041-1.pep  LVEQPNRALLTLSKSGGDTAYTLEVDLEAGELVEGGFHFPAGKNHVSWRDENSVWVCPAW
            ||||||||||||||:|:|||||||||||||||||||||||||||||||||||||||||||
m041-1      LVEQPNRALLTLSKLGSDTAYTLEVDLEAGELVEGGFHFPAGKNHVSWRDENSVWVCPAW
                   130        140        150        160        170        180

190        200        210        220        230        240
a041-1.pep  DERQLTESGYPREVWLVERGKSFEESLPVYQIAEDGMMVNAWRYLDPQGSPIDLIEASDG
            :||||:|||||||||||||||||||||||||||:||||||||||||||||||||||||||
m041-1      NERQLTQSGYPREVWLVERGKSFEESLPVYQIGEDGMMVNAWRYLDPQGSPIDLIEASDG
                   190        200        210        220        230        240

250        260        270        280        290        300
a041-1.pep  FYTKTYLQVSAEGEAKPLNLPNDCDVVGYLAGHLLLTLRKDWHRANQSYPSGALVAVKLN
            ||||||:|||||||||||||||||||||||||||||||||||:|||||||||||||||||
m041-1      FYTKTYLRVSAEGEAKPLNLPNDCDVVGYLAGHLLLTLRKDWNRANQSYPSGALVAVKLN
                   250        260        270        280        290        300

310        320        330        340        350        360
a041-1.pep  RGELGAAQLLFAPNETQALESVETTKRFVVASLLENVQGRLKAWRFTDGKWQETELPRLP
            ||||||||||||||:||||||||||||||||||||||||||||||||:|:|||:||||||
m041-1      RGELGAAQLLFAPDETQALESVETTKRFVVASLLENVQGRLKAWRFADGKWQEVELPRLP
                   310        320        330        340        350        360

370        380        390        400        410        420
a041-1.pep  SGALEMTDQPWGGDVVYLAASDFTTPLTLFALDLNVMELTVMRRQPQQFDSDGINVQQFW
            ||||||||||||||||||||||||||||||||||||||||||||||||||||||||||||
m041-1      SGALEMTDQPWGGDVVYLAASDFTTPLTLFALDLNVMELTVMRRQPQQFDSDGINVQQFW
                   370        380        390        400        410        420

430        440        450        460        470        480
a041-1.pep  TTSADGERIPYFHVGKNAAPDMPTLVYAYGGFGIPELPHYLGSIGKYWLEEGNAFVLANI
            ||||||||||||||||||||||||||||||||||||||||||||||||||||||||||||
m041-1      TTSADGERIPYFHVGKNAAPDMPTLVYAYGGFGIPELPHYLGSIGKYWLEEGNAFVLANI
                   430        440        450        460        470        480

490        500        510        520        530        540
a041-1.pep  RGGGEFGPRWHQAAQGISKHKSVDDLLAVVSDLSERGISSPEHIGLQGGSNGGLITAAAF
            ||||||||||||||||||||||||||||||||:|||||||||||||||||||||||||||
m041-1      RGGGEFGPRWHQAAQGISKHKSVDDLLAVVRDLSERGISSPEHIGLQGGSNGGLITAAAF
                   490        500        510        520        530        540
```

```
                    550        560        570        580        590        600
a041-1.pep  VREPQSIGALVCEVPLTDMIRYPLLSAGSSWTDEYGNPQKYEVCKRRLGELSPYHNLSDG
            ||||||||||||||||||||||||||||||||||||||||||||||||||||||||||||
m041-1      VREPQSIGALVCEVPLTDMIRYPLLSAGSSWTDEYGNPQKYEVCKRRLGELSPYHNLSDG
                    550        560        570        580        590        600

610        620        630        640        650        660
a041-1.pep  IDYPPALITTSLSDDRVHPAHALKFYAKLRETSPQSWLYSPDGGGHTGNGTQREAADELA
            ||||||||||||||||||||||||||||||||||||| ||||||||||||||||| ||||
m041-1      IDYPPALITTSLSDDRVHPAHALKFYAKLRETSAQSWLYSPDGGGHTGNGTQRESADELA
                    610        620        630        640        650        660

670
a041-1.pep  CVLLFLKEFLGX
            ||||||||||||
m041-1      CVLLFLKEFLGX
                    670
```

The following partial DNA sequence was identified in *N. gonorrhoeae* <SEQ ID 165>:

```
g042.seq
     1  ATGACGATGA TTTGCTTGCG CTTCCAagcG TTCGTGCCGC ATACCAGCGC

51  GTTATCCAAC ACTTCCACGG CAGCCGGCCC TTCCTGCCCG ATGGCGGCGG

101  TGCGGTCGAT GATGAAAATC CAGCCGGGGT TTTTCTCTTT GATGTATTCG

151  AAGGAAACGG GCTGCCCGTG CCCTTCGTTG CGTAAAGATT CGTCCACGGG

201  CGGCAGGCCG ATGTCGCCGT GTATCCAACT TGCCAACCGC GATTGCGTGC

251  CGAAGGCGGA CACCTTGTTG CCTGTAACCG ACAGCACCAG CCCGCGTCCT

301  TTGCCTTTGG cggCTTCGCG CTTTTGGGCG AACAGCGCGT CAATCTGCGC

351  ATTCAATTCC GCCACGCGCG CTTCCTTACC GAAAATCCGC GACAGGGTCT

401  CCATCTGCTT CTCGCCGCTG GTGCGGATAT TGCCGTTGTC CACCGTCAAA

451  TCTATGgtgG TCGCGTTTTT CGCCAACTGT TCATACGCTT CCGCACCCGG

501  CCCGCCGGTA ATGACAAACT GCGGATTGTG GCGGTGCAGG GATTCGCAAT

551  CGGGCTCAAA CAGCGTCCCC ACCGTTGCCG CCTTGTCAAA TGCAGGCTGC

601  AAATAG
```

This corresponds to the amino acid sequence <SEQ ID 166; ORF 042.ng>:

```
g042.pep
     1  MTMICLRFQA FVPHTSALSN TSTAAGPSCP MAAVRSMMKI QPGFFSLMYS

51  KETGCPCPSL RKDSSTGGRP MSPCIQLANR DCVPKADTLL PVTDSTSPRP

101  LPLAASRFWA NSASICAFNS ATRASLPKIR DRVSICFSPL VRILPLSTVK

151  SMVVAFFANC SYASAPGPPV MTNCGLWRCR DSQSGSNSVP TVAALSNAGC

201  K*
```

The following partial DNA sequence was identified in *N. meningitidis* <SEQ ID 167>:

```
m042.seq
     1  ATGACGATGA TTTGCTTGCG CTTCCAAGCG TTCGTGCCGC GTACCAGCGC

51  GTTATCCAmT ACTTCGACAG CCGcCGGCCy TTCyTGCCCG ATGGCGGCGG

101  TACGGTCGAT GATGAAAATC CAATCGGGGT TTTTCTCTTT GATGTATTCG

151  AAGGAAACAG GCTGCCCGTG CCCCTCGTTG CGTAAAGATT CGTCTACAGG
```

-continued

```
201    CGGTAGGCCG ATGTCGCCGT GTATCCAACT TGCCAACCGC GACTGCGTGC

251    CGAAGGCGGA CACCTTGTTG CCCGTAACCG ACAGCACCAG CCCGCGTCCT

301    TTGCCTTTGG CGGCTTCGCG CGTTTGGGCG AACAGCGCGT CAATCTGCGC

351    CTTCAATTCC GCCGCGCGCG CTTCCTTGCC GAAAATCCGC GCCAAGGTCT

401    CCATCTGCTT TTCGCCGCTG GTGCGGATAT TGCCGTTGTC CACCGTCAGA

451    TCTATGGTGG TCGCGTTTTT CGCTAACTGT TCATACGCTT CCGCGCCCGG

501    CCCGCCGGTA ATGACAAGCT GAGGATTGTA GCGGTGCAGG GCTTCGTAAT

551    CGGGCTCGAA CAGCGTCCCC ACCGTTGCCG CCTTGTCAAA TGCAGGCTGC

601    AAATAA
```

This corresponds to the amino acid sequence <SEQ ID 168; ORF 042>:

```
m042.pep
  1    MTMICLRFQA FVPRTSALSX TSTAAGXSCP MAAVRSMMKI QSGFFSLMYS

51    KETGCPCPSL RKDSSTGGRP MSPCIQLANR DCVPKADTLL PVTDSTSPRP

101    LPLAASRVWA NSASICAFNS AARASLPKIR AKVSICFSPL VRILPLSTVR

151    SMVVAFFANC SYASAPGPPV MTSXGLXRCR ASXSGSNSVP TVAALSNAGC

201    K*
```

The following partial DNA sequence was identified in *N. meningitidis* <SEQ ID 169>:

```
a042.seq
  1    ATGACGATGA TTTGCTTGCG CTTCCAAGCG TTCGTGCCGC GTACCAGCGC

51    GTTATCCAAT ACTTCGACAG CCGCCGGCCC TTCCTGCCCG ATGGCGGCGG

101    TACGGTCGAT GATGAAAATC CAATCGGGGT TTTTCTCTTT GATGTATTCG

151    AAGGAAACAG GCTGCCCGTG CCCCTCGTTG CGTAAAGATT CGTCTACAGG

201    CGGTAGGCCG ATGTCGCCGT GTATCCAACT TGCCAACCGC GACTGCGTGC

251    CGAAGGCGGA CACCTTGTTG CCCGTAACCG ACAGCACCAG CCCGCGTCCT

301    TTGCCTTTGG CGGCTTCGCG CGTTTGGGCG AACAGCGCGT CAATCTGCGC

351    CTTCAATTCC GCCGCGCGCG CTTCCTTGCC GAAAATCCGC GCCAAGGTCT

401    CCATCTGCTT TTCGCCGCTG GTGCGGATAT TGCCGTTGTC CACCGTCAGA

451    TCTATGGTGG TCGCGTTTTT CGCCAACTGT TCATACGCTT CCGCGCCCGG

501    CCCGCCGGTA ATGACAAGCT GAGGATTGTA GCGGTGCAGG GCTTCGTAAT

551    CGGGCTCGAA CAGCGTCCCC ACCGTTGCCG CCTTGTCAAA TGCAGGCTGC

601    AAATAA
```

This corresponds to the amino acid sequence <SEQ ID 170; ORF 042.a>:

```
a042.pep
  1    MTMICLRFQA FVPRTSALSN TSTAAGPSCP MAAVRSMMKI QSGFFSLMYS

51    KETGCPCPSL RKDSSTGGRP MSPCIQLANR DCVPKADTLL PVTDSTSPRP

101    LPLAASRVWA NSASICAFNS AARASLPKIR AKVSICFSPL VRILPLSTVR
```

151 SMVVAFFANC SYASAPGPPV MTS*GL*RCR AS*SGSNSVP TVAALSNAGC

201 K* m042/a042 99.0% identity over a 201 aa overlap

```
                    10         20         30         40         50         60
m042.pep    MTMICLRFQAFVPRTSALSXTSTAAGXSCPMAAVRSMMKIQSGFFSLMYSKETGCPCPSL
            ||||||||||||||||||| |||||| |||||||||||||||||||||||||||||||||
a042        MTMICLRFQAFVPRTSALSNTSTAAGPSCPMAAVRSMMKIQSGFFSLMYSKETGCPCPSL
                    10         20         30         40         50         60

70         80         90        100        110        120
m042.pep    RKDSSTGGRPMSPCIQLANRDCVPKADTLLPVTDSTSPRPLPLAASRVWANSASICAFNS
            ||||||||||||||||||||||||||||||||||||||||||||||||||||||||||||
a042        RKDSSTGGRPMSPCIQLANRDCVPKADTLLPVTDSTSPRPLPLAASRVWANSASICAFNS
                    70         80         90        100        110        120

130        140        150        160        170        180
m042.pep    AARASLPKIRAKVSICFSPLVRILPLSTVRSMVVAFFANCSYASAPGPPVMTSXGLXRCR
            ||||||||||||||||||||||||||||||||||||||||||||||||||||||||||||
a042        AARASLPKIRAKVSICFSPLVRILPLSTVRSMVVAFFANCSYASAPGPPVMTSXGLXRCR
                   130        140        150        160        170        180

190        200
m042.pep    ASXSGSNSVPTVAALSNAGCKX
            ||||||||||||||||||||||
a042        ASXSGSNSVPTVAALSNAGCKX
                   190        200
```

Computer analysis of this amino acid sequence gave the following results:
Homology with a Predicted ORF from *N. gonorrhoeae*
ORF 042 shows 93.0% identity over a 201 aa overlap with a predicted ORF (ORF 042.ng) from *N. gonorrhoeae*:

```
m042/g042
                    10         20         30         40         50         60
m042.pep    MTMICLRFQAFVPRTSALSXTSTAAGXSCPMAAVRSMMKIQSGFFSLMYSKETGCPCPSL
            |||||||||||||||:||||| |||||| |||||||||||||||:|||||||||||||||
g042        MTMICLRFQAFVPHTSALSNTSTAAGPSCPMAAVRSMMKIQPGFFSLMYSKETGCPCPSL
                    10         20         30         40         50         60

70         80         90        100        110        120
m042.pep    RKDSSTGGRPMSPCIQLANRDCVPKADTLLPVTDSTSPRPLPLAASRVWANSASICAFNS
            |||||||||||||||||||||||||||||||||||||||||||||| |||||||||||||
g042        RKDSSTGGRPMSPCIQLANRDCVPKADTLLPVTDSTSPRPLPLAASRFWANSASICAFNS
                    70         80         90        100        110        120

130        140        150        160        170        180
m042.pep    AARASLPKIRAKVSICFSPLVRILPLSTVRSMVVAFFANCSYASAPGPPVMTSXGLXRCR
            |:||||||| :|||||||||||||||||||:|||||||||||||||||||||:  || ||
g042        ATRASLPKIRDRVSICFSPLVRILPLSTVKSMVVAFFANCSYASAPGPPVMTNCGLWRCR
                   130        140        150        160        170        180

190        200
m042.pep    ASXSGSNSVPTVAALSNAGCKX
            |  |||||||||||||||||||
g042        DSQSGSNSVPTVAALSNAGCKX
                   190        200
```

The following partial DNA sequence was identified in *N. meningitidis* <SEQ ID 171>:

```
m042-1.seq
     1      ATGACGATGA TTTGCTTGCG CTTCCAAGCG TTCGTGCCGC GTACCAGCGC

51      GTTATCCAAT ACTTCGACAG CCGCCGGCCC TTCCTGCCCG ATGGCGGCGG

101      TACGGTCGAT GATGAAAATC CAATCGGGGT TTTTCTCTTT GATGTATTCG

151      AAGGAAACAG GCTGCCCGTG CCCCTCGTTG CGTAAAGATT CGTCTACAGG

201      CGGTAGGCCG ATGTCGCCGT GTATCCAACT TGCCAACCGC GACTGCGTGC

251      CGAAGGCGGA CACCTTGTTG CCCGTAACCG ACAGCACCAG CCCGCGTCCT
```

```
       301   TTGCCTTTGG CGGCTTCGCG CGTTTGGGCG AACAGCGCGT CAATCTGCGC

351   CTTCAATTCC GCCGCGCGCG CTTCCTTGCC GAAAATCCGC GCCAAGGTCT

401   CCATCTGCTT TTCGCCGCTG GTGCGGATAT TGCCGTTGTC CACCGTCAGA

451   TCTATGGTGG TCGCGTTTTT CGCTAACTGT TCATACGCTT CCGCGCCCGG

501   CCCGCCGGTA A
```

This corresponds to the amino acid sequence <SEQ ID 172; ORF 042-1>:

```
m042-1.pep
       1     MTMICLRFQA FVPRTSALSN TSTAAGPSCP MAAVRSMMKI QSGFFSLMYS

51     KETGCPCPSL RKDSSTGGRP MSPCIQLANR DCVPKADTLL PVTDSTSPRP

101     LPLAASRVWA NSASICAFNS AARASLPKIR AKVSICFSPL VRILPLSTVR

151     SMVVAFFANC SYASAPGPPV MTS*
``` m042-1/g042 95.4% identity in 173 aa overlap

```
                     10         20         30         40         50         60
   m042-1.pep  MTMICLRFQAFVPRTSALSNTSTAAGPSCPMAAVRSMMKIQSGFFSLMYSKETGCPCPSL
               ||||||||||||:|||||||||||||||||||||||||||:|||||||||||||||||||
   g042        MTMICLRFQAFVPHTSALSNTSTAAGPSCPMAAVRSMMKIQPGFFSLMYSKETGCPCPSL
                     10         20         30         40         50         60

70         80         90        100        110        120
   m042-1.pep  RKDSSTGGRPMSPCIQLANRDCVPKADTLLPVTDSTSPRPLPLAASRVWANSASICAFNS
               ||||||||||||||||||||||||||||||||||||||||||||||||:|||||||||||
   g042        RKDSSTGGRPMSPCIQLANRDCVPKADTLLPVTDSTSPRPLPLAASRFWANSASICAFNS
                     70         80         90        100        110        120

130        140        150        160        170
   m042-1.pep  AARASLPKIRAKVSICFSPLVRILPLSTVRSMVVAFFANCSYASAPGPPVMTSX
               |:||||||||| :||||||||||||||||:||||||||||||||||||||||||:
   g042        ATRASLPKIRDRVSICFSPLVRILPLSTVKSMVVAFFANCSYASAPGPPVMTNCGLWRCR
                    130        140        150        160        170        180 g042        DSQSGSNSVPTVAALSNAGCKX
                    190        200
```

The following partial DNA sequence was identified in N. meningitidis <SEQ ID 173>:

```
a042-1.seq
       1     ATGACGATGA TTTGCTTGCG CTTCCAAGCG TTCGTGCCGC GTACCAGCGC

51     GTTATCCAAT ACTTCGACAG CCGCCGGCCC TTCCTGCCCG ATGGCGGCGG

101     TACGGTCGAT GATGAAAATC CAATCGGGGT TTTTCTCTTT GATGTATTCG

151     AAGGAAACAG GCTGCCCGTG CCCCTCGTTG CGTAAAGATT CGTCTACAGG

201     CGGTAGGCCG ATGTCGCCGT GTATCCAACT TGCCAACCGC GACTGCGTGC

251     CGAAGGCGGA CACCTTGTTG CCCGTAACCG ACAGCACCAG CCCGCGTCCT

301     TTGCCTTTGG CGGCTTCGCG CGTTTGGGCG AACAGCGCGT CAATCTGCGC

351     CTTCAATTCC GCCGCGCGCG CTTCCTTGCC GAAAATCCGC GCCAAGGTCT

401     CCATCTGCTT TTCGCCGCTG GTGCGGATAT TGCCGTTGTC CACCGTCAGA

451     TCTATGGTGG TCGCGTTTTT CGCCAACTGT TCATACGCTT CCGCGCCCGG

501     CCCGCCGGTA A
```

This corresponds to the amino acid sequence <SEQ ID 174; ORF 042-1.a>:

```
a042-1.pep
      1   MTMICLRFQA FVPRTSALSN TSTAAGPSCP MAAVRSMMKI QSGFFSLMYS

51   KETGCPCPSL RKDSSTGGRP MSPCIQLANR DCVPKADTLL PVTDSTSPRP

101   LPLAASRVWA NSASICAFNS AARASLPKIR AKVSICFSPL VRILPLSTVR

151   SMVVAFFANC SYASAPGPPV MTS*
``` m042-1/a042-1 100.0% identity in 173 aa overlap

```
                       10         20         30         40         50         60
    m042-1.pep  MTMICLRFQAFVPRTSALSNTSTAAGPSCPMAAVRSMMKIQSGFFSLMYSKETGCPCPSL
                |||||||||||||||||||||||||||||||||||||||||||||||||||||||||||
    a042-1      MTMICLRFQAFVPRTSALSNTSTAAGPSCPMAAVRSMMKIQSGFFSLMYSKETGCPCPSL
                       10         20         30         40         50         60
                       70         80         90        100        110        120
    m042-1.pep  RKDSSTGGRPMSPCIQLANRDCVPKADTLLPVTDSTSPRPLPLAASRVWANSASICAFNS
                |||||||||||||||||||||||||||||||||||||||||||||||||||||||||||
    a042-1      RKDSSTGGRPMSPCIQLANRDCVPKADTLLPVTDSTSPRPLPLAASRVWANSASICAFNS
                       70         80         90        100        110        120
                      130        140        150        160        170
    m042-1.pep  AARASLPKIRAKVSICFSPLVRILPLSTVRSMVVAFFANCSYASAPGPPVMTSX
                |||||||||||||||||||||||||||||||||||||||||||||||||||||
    a042-1      AARASLPKIRAKVSICFSPLVRILPLSTVRSMVVAFFANCSYASAPGPPVMTSX
                      130        140        150        160        170
```

The following partial DNA sequence was identified in N. gonorrhoeae <SEQ ID 175>:

```
g043.seq
      1   ATGGTTGTTT CAAATCAAAA TATCTATGCC GTCGGCCCAT CAGCACTTTT

51   TCACATCCGA AGGCAAAAAT CCGTAATGCC GCCTGAACGC TTCgttgaAC

101   CGTCCCGCGT ggcggtagcc gcAAAAGTGC ATcGCGGCTT GGATGGTGCT

151   GCCCGATTCG ATGAGGGcga gcGCGTGTTC CAGCCGCAGG CGGCGCAGGC

201   GTCCGGCGAC GGTTTCGCCG GTTTGCGCTT TGAAATAGCG TTTCAGGTAG

251   CATTCGTTCA GCCCGACGCG GCGGGCGATT TCGGCGATGG TCAGCGGGCG

301   GGCGAATTCG CTGTTCAAAA TATCGGCGGC TTCGTCTATG CGCCGGCGGC

351   GGTAGCCGTT GTCGTGGCGG CGGAAGGTGA AGCGTAA
```

This corresponds to the amino acid sequence <SEQ ID 176; ORF 043.ng>:

```
g043.pep
      1   MVVSNQNIYA VGPSALFHIR RQKSVMPPER FVEPSRVAVA AKVHRGLDGA

51   ARFDEGERVF QPQAAQASGD GFAGLRFEIA FQVAFVQPDA AGDFGDGQRA

101   GEFAVQNIGG FVYAPAAVAV VVAAEGEA*
```

The following partial DNA sequence was identified in N. meningitidis <SEQ ID 177>:

```
m043.seq
      1   ATGGTTGTTT CAAATCAAAA TATCTATGCC GCCGGCCCCT CAGCACTTCT

51   TCACATCCGA AGGCAAAAAT CCGTAATGCC GTCTGAACGC TTCGTTGAAC

101   CGTCCCGCGT GGCGGTAGCC GCAAAAGTGC ATGGCGGCTT GGACGGTGCT

151   GCCGGATTCG ATGAGGGCGA GCGCGTGTTC CAGCCGCAGG CGGCGCAgGC

201   ATCCGGCGAC GGTTTCGCCG GTTTGCGCTT TGAAATAGCG TTTCAGGTAG
```

```
-continued
251   CATTCGTTCA GTCCGACGCG GCGGGCGATT TCGGCGATGG TCAGCGGACG

301   GGCGAATTCG TGTTGCAGGA TGTCGGCGGC TTCGTCTATG CGCCGACGGC

351   GGTAACCGTT GTCGTGGCGG CGGAAGGTGA AGCGCAATAA
```

This corresponds to the amino acid sequence <SEQ ID 178; ORF 043>:

```
m043.pep
  1   MVVSNQNIYA AGPSALLHIR RQKSVMPSER FVEPSRVAVA AKVHGGLDGA

51   AGFDEGERVF QPQAAQASGD GFAGLRFEIA FQVAFVQSDA AGDFGDGQRT

101   GEFVLQDVGG FVYAPTAVTV VVAAEGEAQ*
```

Computer analysis of the amino acid sequences gave the following results:
Homology with a Predicted ORF from *N. meningitidis* menA with menB
ORF 043 shows 89.8% identity over a 128 aa overlap with a predicted ORF (ORF043.a) from *N. gonorrhoeae*:

```
m043/g043
                     10         20         30         40         50         60
   m043.pep   MVVSNQNIYAAGPSALLHIRRQKSVMPSERFVEPSRVAVAAKVHGGLDGAAGFDEGERVF
              ||||||||||:|||||:||||||||||| ||||||||||||||||| ||||| ||||||||
   g043       MVVSNQNIYAVGPSALFHIRRQKSVMPPERFVEPSRVAVAAKVHRGLDGAARFDEGERVF
                     10         20         30         40         50         60

70         80         90        100        110        120
   m043.pep   QPQAAQASGDGFAGLRFEIAFQVAFVQSDAAGDFGDGQRTGEFVLQDVGGFVYAPTAVTV
              ||||||||||||||||||||||||||||:|||||||||||:|||::|::|||||||:||:|
   g043       QPQAAQASGDGFAGLRFEIAFQVAFVQPDAAGDFGDGQRAGEFAVQNIGGFVYAPAAVAV
                     70         80         90        100        110        120

130
   m043.pep   VVAAEGEAQX
              |||||||||
   g043       VVAAEGEAXX
                    130
```

The following partial DNA sequence was identified in *N. meningitidis* <SEQ ID 179>:

```
a043.seq
  1   ATGGTTGTTT CAAATCAAAA TATCTATGCC GCCGGCCCCT CAGCACTTCT

51   TCACATCCGA AGGCAAAAAT CCGTAATGCC GTCTGAACGC TTCGTTGAAC

101   CGTCCCGCGT GGCGGTAGCC GCAAAAGTGC ATGGCGGCTT GGACGGTGCT

151   GCCGGATTCG ATGAGGGCGA GCGCGTGTTC CAGCCGCAGG CGGCGCAGGC

201   ATCCGGCGAC GGTTTCGCCG GTTTGCGCTT TGAAATAGCG TTTCAGGTAG

251   CATTCGTTCA GTCCGACGCG GCGGGCGATT TCGGCGATGG TCAGCGGACG

301   GGCGAATTCG TGTTGCAGGA TGTCGGCGGC TTCGTCTATG CGCCGACGGC

351   GGTAACCGTT GTCGTGGCGG CGGAAGGTGA AGCGCAATAA
```

This corresponds to the amino acid sequence <SEQ ID 180; ORF 043.a>:

```
a043.pep
  1   MVVSNQNIYA AGPSALLHIR RQKSVMPSER FVEPSRVAVA AKVHGGLDGA

51   AGFDEGERVF QPQAAQASGD GFAGLRFEIA FQVAFVQSDA AGDFGDGQRT

101   GEFVLQDVGG FVYAPTAVTV VVAAEGEAQ*
``` m043/a043 100.0% identity in 129 aa overlap

```
                 10         20         30         40         50         60
m043.pep   MVVSNQNIYAAGPSALLHIRRQKSVMPSERFVEPSRVAVAAKVHGGLDGAAGFDEGERVF
           ||||||||||||||||||||||||||||||||||||||||||||||||||||||||||||
a043       MVVSNQNIYAAGPSALLHIRRQKSVMPSERFVEPSRVAVAAKVHGGLDGAAGFDEGERVF
                 10         20         30         40         50         60

70         80         90        100        110        120
m043.pep   QPQAAQASGDGFAGLRFEIAFQVAFVQSDAAGDFGDGQRTGEFVLQDVGGFVYAPTAVTV
           ||||||||||||||||||||||||||||||||||||||||||||||||||||||||||||
a043       QPQAAQASGDGFAGLRFEIAFQVAFVQSDAAGDFGDGQRTGEFVLQDVGGFVYAPTAVTV
                 70         80         90        100        110        120

130
m043.pep   VVAAEGEAQX
           ||||||||||
a043       VVAAEGEAQX
                130
```

The following partial DNA sequence was identified in *N. gonorrhoeae* <SEQ ID 181>:

```
g044.seq
    1   ATGCTGCCCG ACCAGAGCGT CGAGTTCTTG CCACAAGTCG TCGTTTTTGA

51   CGGGCTGTTT GGCGGCGGTT TTCCAGCCGT TGCGCTTCCA ACCGTGTATC

101   CAGTTTTCCA TGCCGTTTTT GACGTATTGC GAGTCGGTGC AGATGATGAC

151   GGTGCAGCGG CGTTTGAGCG ATTTCAGCCC TTCGATAACG GCGGTCAGCT

201   CCATGCGGTT GTTGGTGGTT TGCGCTTCGC CGCCGAAAAG TTCTTTTTCG

251   CGGCTGCCGT AGCGCATTAA
```

This corresponds to the amino acid sequence <SEQ ID 182; ORF 044.ng>:

```
g044.pep
    1   MLPDQSVEFL PQVVVFDGLF GGGFPAVALP TVYPVFHAVF DVLRVGADDD

51   GAAAFERFQP FDNGGQLHAV VGGLRFAAEK FFFAAAVAH*
```

The following partial DNA sequence was identified in *N. meningitidis* <SEQ ID 183>:

```
m044.seq
    1   ATGCCGTCCG ACTAGAGCGT CGAGTTCTTT CCAGAAGTCG TCGTTTTTGA

51   CGGGCTGTTT GGAGGCGGTT TTCCAGCCGT TGCGCTTCCA ACCGTGTATC

101   CAGTTTTCCA TGCCATTTTT GACGTATTGC GAGTCGGTGC AGATGATGAC

151   GGTGCAGCGG CGTTTGAGCG ATTTCAGTCC TTCGATGACG GCAGTCAGTT

201   CCATGCGGTT GTTGGTGGTT TGCGCTTCGC CGCCGAAAAG TTCTTTTTCG

251   TGGCTACCGT AGCGCAyTAa
```

This corresponds to the amino acid sequence <SEQ ID 184; ORF 044>:

```
m044.pep
    1   MPSDXSVEFF PEVVVFDGLF GGGFPAVALP TVYPVFHAIF DVLRVGADDD

51   GAAAFERFQS FDDGSQFHAV VGGLRFAAEK FFFVATVAH*
```

The following partial DNA sequence was identified in *N. meningitidis* <SEQ ID 185>:

```
a044.seq
    1   GTGCCGTCCG ACCAGCGCGT CGAGTTCTTT CCACAAGTCG TCGTTTTTGA

51   CGGGCTGTTT GGCGGCGGTT TTCCAGCCGT TGCGCTTCCA ACCGTGTATC

101   CAGTTTTCCA TGCCGTTTTT GACGTATTGC GAGTCGGTGC AGATGATGAC

151   GGTGCAGCGG CGTTTGAGCG ATTTCAGTCC TTCGATGACG GCGGTCAGTT

201   CCATACGGTT GTTGGTGGTT TGCGCTTCGC CGCCGAAAAG TTCTTTTTCG

251   TGGCTGCCGT AGCGCATTAA
```

This corresponds to the amino acid sequence <SEQ ID 186; ORF 044.a>:

```
a044.pep
    1   VPSDQRVEFF PQVVVFDGLF GGGFPAVALP TVYPVFHAVF DVLRVGADDD

51   GAAAFERFQS FDDGGQFHTV VGGLRFAAEK FFFVAAVAH*
``` m044/a044 91.0% identity over a 89 aa overlap

```
                    10         20         30         40         50         60
     m044.pep   MPSDXSVEFFPEVVVFDGLFGGGFPAVALPTVYPVFHAIFDVLRVGADDDGAAAFERFQS
                :|||  ||||:|||||||||||||||||||||||||||:||||||||||||||||||||
        a044   VPSDQRVEFFPQVVVFDGLFGGGFPAVALPTVYPVFHAVFDVLRVGADDDGAAAFERFQS
                    10         20         30         40         50         60

70         80         90
     m044.pep   FDDGSQFHAVVGGLRFAAEKFFFVATVAHX
                ||||:|||:|||||||||||||||:||||
        a044   FDDGGQFHTVVGGLRFAAEKFFFVAAVAHX
                    70         80         90
```

Computer analysis of this amino acid sequence gave the following results:
Homology with a Predicted ORF from *N. gonorrhoeae*
ORF 044 shows 86.5% identity over a 89 aa overlap with a predicted ORF (ORF 044.ng) from *N. gonorrhoeae*:

```
m044/g044
                    10         20         30         40         50         60
     m044.pep   MPSDXSVEFFPEVVVFDGLFGGGFPAVALPTVYPVFHAIFDVLRVGADDDGAAAFERFQS
                |   ||||:|:|||||||||||||||||||||||||||:||||||||||||||||||||
        g044   MLPDQSVEFLPQVVVFDGLFGGGFPAVALPTVYPVFHAVFDVLRVGADDDGAAAFERFQP
                    10         20         30         40         50         60

70         80         90
     m044.pep   FDDGSQFHAVVGGLRFAAEKFFFVATVAHX
                ||:|:|:|||||||||||||||:|||||
        g044   FDNGGQLHAVVGGLRFAAEKFFFAAAVAHX
                    70         80         90
```

The following partial DNA sequence was identified in *N. gonorrhoeae* <SEQ ID 187>:

```
g046.seq
    1   ATGTCGGCAA TGCTGCGTCC GACAAGCAGC CCGCCGCgcc gCGCCTGTAT

51   GATGACCATC CGCACGCGGT CGTCTGCAAA ACGTAAAACC TGCAATGCGC

101   CCGGGCAGTC TATCAGGCCG GCAAGCTGTT CGGTAACGAG CTGTTCGGGG

151   CTGATGGTTT CGGTTATGCC gaATATGGAA AGGCTGCCGt TTTcGTTGTT

201   TTCGAGCTTG GGGCTGAGGT ATTCGAGGTA TtcgctGGAA CGGACGCGCG

251   CGATGCGGCC GGGGATGTTG AACAGGTCGG CGGCAACTTT GCAGGCGACG
```

```
     -continued
301  ATGTTGGTTT CGTCGCTGCG GGagaGCGCG AGcagcaagt cggcatcttC

351  CgcgccggcG Cgttataatg tgAAGGGGGA TGCGccgttg ccgaAAACGG

401  TTTGGacatc gaggcggctg CCTGTTTCCT GCAATGCTTT TTCGTCGATG

451  TCGATAAcgg TTACGTCGTT GTTGGTGATG GCGGCAAGGT TTTGCGCGAC

501  GGTAGAACCT ACCTGCCCGT TGCCTAAAAT GAGGATTTTC ACGGTATGGG

551  TCGCCGGGTG A
```

This corresponds to the amino acid sequence <SEQ ID 188; ORF 046.ng>:

```
g046.pep
  1  MSAMLRPTSS PPRRACMMTI RTRSSAKRKT CNAPGQSIRP ASCSVTSCSG

51  LMVSVMPNME RLPFSLFSSL GLRYSRYSLE RTRAMRPGML NRSAATLQAT

101  MLVSSLRESA SSKSASSAPA RYNVKGDAPL PKTVWTSRRL PVSCNAFSSM

151  SITVTSLLVM AARFCATVEP TCPLPKMRIF TVWVAG*
```

The following partial DNA sequence was identified in *N. meningitidis* <SEQ ID 189>:

```
m046.seq
  1  ATGTCGGCAA TGCTGCGTCC GACAAGCAsT CCGC.r.sGC gCGcCTGTAT

51  GATGACCATC CGCACGCGGT CGTCTGCAAA ACGTAAAACC TGCAATGCGC

101  CCGGGCAGTC TATCAGGCCG GCAAGCTGTT CGGTAACGAG CTGTTCGGGG

151  CTGATGGTTT CGGTTATGCC GAATATGGAA AGGCTGCCGT TTTCGTTGTT

201  TTCGAGCTTG GGGCTGAGGT ATTCGAGGTA TTCGCTGGAA CGGACGCGCG

251  CGATGCGGCC GGGGATGTTG AACAGGTCGG CGGCAACTTT GCAGGCGACG

301  ATGTTGGTTT CGTCGCTGCG GGAGAGCGCG AGCAGCAAGT CGGCATCTTC

351  CGCGCCGGCG CGTTCTAATG TGAAGGGGGA TGCGCCGTTG CCGAAAACGG

401  TTTGGACATC GAGGCGGCTG CCTGTTTCCT GCAATGCTTT TTCGTCGATG

451  TCGATAACGG TTACGTCGTT GTTGGGTATG GCGGCAAGGT TTTGTGCGAC

501  GGTAGAACCT ACCTGTCCGT TGCCTAAAAT GAGGATTTTC ACGGTGTGGG

551  TCGCCGAGTG A
```

This corresponds to the amino acid sequence <SEQ ID 190; ORF 046>:

```
m046.pep
  1  MSAMLRPTSX PXXRACMMTI RTRSSAKRKT CNAPGQSIRP ASCSVTSCSG

51  LMVSVMPNME RLPFSLFSSL GLRYSRYSLE RTRAMRPGML NRSAATLQAT

101  MLVSSLRESA SSKSASSAPA RSNVKGDAPL PKTVWTSRRL PVSCNAFSSM

151  SITVTSLLGM AARFCATVEP TCPLPKMRIF TVWVAE*
```

The following partial DNA sequence was identified in *N. meningitidis* <SEQ ID 191>:

```
a046.seq
  1  ATGTCGGCAA TGCTGCGTCC GACAAGCAGT CCGCCGCGCC GCGCCTGTAT

51  GATGACCATC CGCACGCGGT CGTCTGCAAA ACGTAAAACC TGCAATGCGC
```

-continued

```
101   CCGGGCAGTC TATCAGGCCG GCAAGCTGTT CGGTAACGAG CTGTTCGGGG

151   CTGATGGTTT CGGTTATGCC GAATATGGAA AGGCTGCCGT TTTCGTTGTT

201   TTCGAGCTTG GGGCTGAGGT ATTCGAGGTA TTCGCTGGAA CGGACGCGCG

251   CGATGCGGCC GGGGATGTTG AACAGGTCGG CGGCAACTTT GCAGGCGACG

301   ATGTTGGTTT CGTCGCTGCG GGAGAGCGCG AGCAGCAAGT CGGCATCTTC

351   CGCGCCGGCG CGTTCTAATG TGAAGGGGGA TGCGCCGTTG CCGAAAACGG

401   TTTGGACATC GAGGCGGCTG CCTGTTTCCT GCAATGCTTT TTCGTCGATG

451   TCGATAACGG TTACGTCGTT GTTGGGTATG GCGGCAAGGT TTTGTGCGAC

501   GGTAGAACCT ACCTGTCCGT TGCCTAAAAT GAGGATTTTC ACGGTGTGGG

551   TCGCCGAGTG A
```

This corresponds to the amino acid sequence <SEQ ID 192; ORF 046.a>:

```
a046.pep
  1   MSAMLRPTSS PPRRACMMTI RTRSSAKRKT CNAPGQSIRP ASCSVTSCSG

51   LMVSVMPNME RLPFSLFSSL GLRYSRYSLE RTRAMRPGML NRSAATLQAT

101   MLVSSLRESA SSKSASSAPA RSNVKGDAPL PKTVWTSRRL PVSCNAFSSM

151   SITVTSLLGM AARFCATVEP TCPLPKMRIF TVWVAE*
``` m046/a046 98.4% identity over a 186 aa overlap

```
                 10         20         30         40         50         60
m046.pep  MSAMLRPTSXPXXRACMMTIRTRSSAKRKTCNAPGQSIRPASCSVTSCSGLMVSVMPNME
          ||||||||| |  |||||||||||||||||||||||||||||||||||||||||||||||
a046      MSAMLRPTSSPPRRACMMTIRTRSSAKRKTCNAPGQSIRPASCSVTSCSGLMVSVMPNME
                 10         20         30         40         50         60

70         80         90        100        110        120
m046.pep  RLPFSLFSSLGLRYSRYSLERTRAMRPGMLNRSAATLQATMLVSSLRESASSKSASSAPA
          ||||||||||||||||||||||||||||||||||||||||||||||||||||||||||||
a046      RLPFSLFSSLGLRYSRYSLERTRAMRPGMLNRSAATLQATMLVSSLRESASSKSASSAPA
                 70         80         90        100        110        120

130        140        150        160        170        180
m046.pep  RSNVKGDAPLPKTVWTSRRLPVSCNAFSSMSITVTSLLGMAARFCATVEPTCPLPKMRIF
          ||||||||||||||||||||||||||||||||||||||||||||||||||||||||||||
a046      RSNVKGDAPLPKTVWTSRRLPVSCNAFSSMSITVTSLLGMAARFCATVEPTCPLPKMRIF
                130        140        150        160        170        180 m046.pep  TVWVAEX
          |||||||
a046      TVWVAEX
```

Computer analysis of this amino acid sequence gave the following results:
Homology with a Predicted ORF from *N. gonorrhoeae*
ORF 046 shows 97.3% identity over a 185 aa overlap with a predicted ORF (ORF 046.ng) from *N. gonorrhoeae*:

```
m046/g046

10         20         30         40         50         60
m046.pep  MSAMLRPTSXPXXRACMMTIRTRSSAKRKTCNAPGQSIRPASCSVTSCSGLMVSVMPNME
          ||||||||| |  |||||||||||||||||||||||||||||||||||||||||||||||
g046      MSAMLRPTSSPPRRACMMTIRTRSSAKRKTCNAPGQSIRPASCSVTSCSGLMVSVMPNME
                 10         20         30         40         50         60

70         80         90        100        110        120
m046.pep  RLPFSLFSSLGLRYSRYSLERTRAMRPGMLNRSAATLQATMLVSSLRESASSKSASSAPA
          ||||||||||||||||||||||||||||||||||||||||||||||||||||||||||||
g046      RLPFSLFSSLGLRYSRYSLERTRAMRPGMLNRSAATLQATMLVSSLRESASSKSASSAPA
                 70         80         90        100        110        120
```

-continued

```
            130        140        150        160        170        180
m046.pep  RSNVKGDAPLPKTVWTSRRLPVSCNAFSSMSITVTSLLGMAARFCATVEPTCPLPKMRIF
          ||||||||||||||||||||||||||||||||||||| ||||||||||||||||||||||
g046      RYNVKGDAPLPKTVWTSRRLPVSCNAFSSMSITVTSLLVMAARFCATVEPTCPLPKMRIF
            130        140        150        160        170        180 m046.pep  TVWVAEX
          ||||| 
g046      TVWVAGX
```

The following partial DNA sequence was identified in *N. gonorrhoeae* <SEQ ID 193>:

```
g047.seq
   1  ATGGTCATCA TACAGGCGcg gcGCGGCGGG CTGCTTGTCG GACGCAGCAT
  51  TGCCGACATC GCCCAAGATT TGCCCGACGG GGCCGACTGC CAAATCTGCG
 101  CCGTTTACCG CAACAACCGC CTCATCGTCC CCGCGCCGCA AACCGTCATC
 151  ATCGAAGGCG ACGAAATCCT GTTTGCCGCC GCCGCCGAAA ACATCGGGGC
 201  GGTCATACCc gaATTGCGCC CCAAAGAAAC CAGCACCCGC CGCATCATGA
 251  TTGCCGGCGG CGGCAACATc tgctACCGCC TCGCCAAGCA GCTCGAACAC
 301  GCATAcaacG TCAAAATCAT CGAATGCCGG CCGCGCcgtg ccgaATGGAT
 351  AGCCGAAAAC ctcgAcaaCA CCCTCGTCCT GCAAGGTTCG Gcaaccgacg
 401  aAaccctgct cgAcaacgaa tacatcgacg aaatcgaCGT ATTCTGCGCC
 451  CTGACCAACG ACGACGAAAG CAACATTAtg tCCGCCCTTT GGCGAAAAA
 501  CCTcggcgCG AAGCgcgtca tcggCATCGT CAACCGCTCA AGCTACGTCG
 551  ATTTGCTCGA AGGCAACAAA ATCGACATCG TCGTCTCCCC CCACCTCATC
 601  ACCATCGGCT CGATACTCGC CCACATCCGG CGCGGCGACA TCGTTGCCGT
 651  CCACCCCATC CGGCGCGGCA CGGCGGAAGC CATCGAAGTC GTCGCGCACG
 701  GCGACAAAAA AACTTCCGCC ATCATCGGCA GGCGCATCAG CGGCATCAAA
 751  TGGCCCGAAG GCTGCCACAT TGCCGCCGTC GTCCGCGCCG GAACCGGCGA
 801  AACCATTATG GGACACCATA CCGAAACCGT CATCCAAGAC GGTGACCACA
 851  TCATCTTTTT CGTCTCGCGC CGGCGCATCC TGAACGAACT GGAGAAACTC
 901  ATCCAAGTCA AATGGCTT TTTCGGATAA
```

This corresponds to the amino acid sequence <SEQ ID 194; ORF 047.ng>:

```
g047.pep
   1  MVIIQARRGG LLVGRSIADI AQDLPDGADC QICAVYRNNR LIVPAPQTVI
  51  IEGDEILFAA AAENIGAVIP ELRPKETSTR RIMIAGGGNI CYRLAKQLEH
 101  AYNVKIIECR PRRAEWIAEN LDNTLVLQGS ATDETLLDNE YIDEIDVFCA
 151  LTNDDESNIM SALLAKNLGA KRVIGIVNRS SYVDLLEGNK IDIVVSPHLI
 201  TIGSILAHIR RGDIVAVHPI RRGTAEAIEV VAHGDKKTSA IIGRRISGIK
 251  WPEGCHIAAV VRAGTGETIM GHHTETVIQD GDHIIFFVSR RRILNELEKL
 301  IQVKMGFFG*
```

The following partial DNA sequence was identified in *N. meningitidis* <SEQ ID 195>:

```
m047.seq
    1    ATGGTCATCA TACAGgCGcG C..syGCGGA sTGCTTGTCG GACGCAGCAT
   51    TGCCGACATC GCCCAAGATT TGCCCGACGG GGCCGACTGC CAAATCTGCG
  101    CCGTTTACCG CAACAACCGC CTCATCGTCC CCGCGCCGCA AACCGTCATC
  151    ATCGAAGGCG ACGAAATCCT ATTTGCCGCC GCCGCCGAAA ACATCGGCGC
  201    GGTCATACCC GAATTGCGCC CCAAAGAAAC CCAAAGAAAC CAGCcCmgmm
  251    GcATCATGAT TkCCGGCGGC GGCAACATCG GCTACCGTCT CGCCAAGCAG
  301    CTCGAACACG CATACAACGT yAAAATCATC GAATGCCGGC CGCGCCGTGC
  351    CGAATGGATA GCCGAAAACC TCGACAACAC CCTCGTCyTG CAAGGTTCGG
  401    CAACCGACGA AACCCTGCTC GACAACGAAT ACATCGACGA AATCGACGTA
  451    TTCTGCGCCC TGACCAACGA CGACGAAAGC AACATTATGT CCGCCCTTTT
  501    GGCGAaAAAC CTCGGCGCGA AGCGCGTCAT CGGCATCGTC AACCGCTCAA
  551    GCTACGTCGA TTTGCTCGAA GGCAACAAAA TCGACATCGT CGTCTCCCCC
  601    CACCTCATCA CCATCGGCTC GATACTCGCC CACATCCGGC GCGGCGACAT
  651    CGTTGCCGTC CACCCCATCC GGCGCGGCAC GGCGGAAGCC ATCGAAGTCG
  701    TCGCACACGG CGACAAAAAA ACTTCCGCCA TCATCGGCAG GCGCATCAGC
  751    GGCATCAAAT GGCCCGAAGG CTGCCACATT GCCGCCGTCG TCCGCGCCGG
  801    AACCGGCGAA ACCATTATGG GACACCATAC CGAAACCGTC ATCCAAGACG
  851    GCGACCACAT CATCTTTTTC GTCTCGCGCC GGCGCATCCT GAACGAACTG
  901    GAAAAACTCA TCCAGGTCAA AATGGGCTTT TTCGGATAA
```

This corresponds to the amino acid sequence <SEQ ID 196; ORF 047>:

```
m047.pep
    1    MVIIQARXXG XLVGRSIADI AQDLPDGADC QICAVYRNNR LIVPAPQTVI
   51    IEGDEILFAA AAENIGAVIP ELRPKETQRN QPXXIMIXGG GNIGYRLAKQ
  101    LEHAYNVKII ECRPRRAEWI AENLDNTLVL QGSATDETLL DNEYIDEIDV
  151    FCALTNDDES NIMSALLAKN LGAKRVIGIV NRSSYVDLLE GNKID<u>IVVSP</u>
  201    <u>HLITIGSILA HI</u>RRGDIVAV HPIRRGTAEA IEVVAHGDKK TSAIIGRRIS
  251    GIKWPEGCHI AAVVRAGTGE TIMGHHTETV IQDGDHIIFF VSRRRILNEL
  301    EKLIQVKMGF FG*
```

The following partial DNA sequence was identified in *N. meningitidis* <SEQ ID 197>:

```
a047.seq
    1    ATGGTCATCA TACAGGCGCG GCGCGGCGGA CTGCTTGTCG GACGCAGCAT
   51    TGCCGACATC GCCCAAGATT TGCCCGACGG GGCCGACTGC CAAATCTGCG
  101    CCGTTTACCG CAACAACCGC CTCATCGTCC CCGCGCCGCA AACCGTCATC
  151    ATCGAAGGCG ACGAAATCCT ATTTGCCGCC GCCGCCGAAA ACATCGGCGC
  201    GGTCATACCC GAATTGCGCC CCAAAGAAAC CAGCACCCGC CGCATCATGA
  251    TTGCCGGCGG CGGCAACATC GGCTACCGTC TCGCCAAGCA GCTCGAACAC
  301    GCATACAACG TCAAAATCAT CGAATGCCGG CCGCGCCGTG CCGAATGGAT
  351    AGCCGAAAAC CTCGACAACA CCCTCGTCCT GCAAGGTTCG GCAACCGACG
```

-continued

```
401  AAACCCTGCT CGACAACGAA TACATCGACG AAATCGACGT ATTCTGCGCC
451  CTGACCAACG ACGACGAAAG CAACATTATG TCCGCCCTTT TGGCGAAAAA
501  CCTCGGCGCG AAGCGCGTCA TCGGCATCGT CAACCGCTCA AGCTACGTCG
551  ATTTGCTCGA AGGCAACAAA ATCGACATCG TCGTCTCCCC CCACCTCATC
601  ACCATCGGCT CGATACTCGC CCACATCCGG CGCGGCGACA TCGTTGCCGT
651  CCACCCCATC CGGCGCGGCA CGGCGGAAGC CATCGAAGTC GTCGCACACG
701  GCGACAAAAA AACTTCCGCC ATCATCGGCA GGCGCATCAG CGGCATCAAA
751  TGGCCCGAAG GCTGCCACAT TGCCGCCGTC GTCCGCGCCG GAACCGGCGA
801  AACCATTATG GGACACCATA CCGAAACCGT CATCCAAGAC GGCGACCACA
851  TCATCTTTTT CGTCTCGCGC CGGCGCATCC TGAACGAACT GGAAAAACTC
901  ATCCAAGTCA AATGGCTT TTTCGGATAA
```

20

This corresponds to the amino acid sequence <SEQ ID 198; ORF 047.a>:

```
a047.pep
     1  MVIIQARRGG LLVGRSIADI AQDLPDGADC QICAVYRNNR LIVPAPQTVI

51  IEGDEILFAA AAENIGAVIP ELRPKETSTR RIMIAGGGNI GYRLAKQLEH

101  AYNVKIIECR PRRAEWIAEN LDNTLVLQGS ATDETLLDNE YIDEIDVFCA

151  LTNDDESNIM SALLAKNLGA KRVIGIVNRS SYVDLLEGNK IDIVVSPHLI

201  TIGSILAHIR RGDIVAVHPI RRGTAEAIEV VAHGDKKTSA IIGRRISGIK

251  WPEGCHIAAV VRAGTGETIM GHHTETVIQD GDHIIFFVSR RRILNELEKL

301  IQVKMGFFG*
``` m047/a047 96.5% identity over a 312 aa overlap

```
                 10         20         30         40         50         60
m047.pep MVIIQARXXGXLVGRSIADIAQDLPDGADCQICAVYRNNRLIVPAPQTVIIEGDEILFAA
         ||||||| | |||||||||||||||||||||||||||||||||||||||||||||||||
a047     MVIIQARRGGLLVGRSIADIAQDLPDGADCQICAVYRNNRLIVPAPQTVIIEGDEILFAA
                 10         20         30         40         50         60

70         80         90        100        110        120
m047.pep AAENIGAVIPELRPKETQRNQPXXIMIXGGGNIGYRLAKQLEHAYNVKIIECRPRRAEWI
         |||||||||||||||||:  :  ||| |||||||||||||||||||||||||||||||
a047     AAENIGAVIPELRPKETSTRR---IMIAGGGNIGYRLAKQLEHAYNVKIIECRPRRAEWI
                 70         80         90        100        110        120

130        140        150        160        170        180
m047.pep AENLDNTLVLQGSATDETLLDNEYIDEIDVFCALTNDDESNIMSALLAKNLGAKRVIGIV
         ||||||||||||||||||||||||||||||||||||||||||||||||||||||||||||
a047     AENLDNTLVLQGSATDETLLDNEYIDEIDVFCALTNDDESNIMSALLAKNLGAKRVIGIV
                120        130        140        150        160        170

190        200        210        220        230        240
m047.pep NRSSYVDLLEGNKIDIVVSPHLITIGSILAHIRRGDIVAVHPIRRGTAEAIEVVAHGDKK
         ||||||||||||||||||||||||||||||||||||||||||||||||||||||||||||
a047     NRSSYVDLLEGNKIDIVVSPHLITIGSILAHIRRGDIVAVHPIRRGTAEAIEVVAHGDKK
                180        190        200        210        220        230

250        260        270        280        290        300
m047.pep TSAIIGRRISGIKWPEGCHIAAVVRAGTGETIMGHHTETVIQDGDHIIFFVSRRRILNEL
         ||||||||||||||||||||||||||||||||||||||||||||||||||||||||||||
a047     TSAIIGRRISGIKWPEGCHIAAVVRAGTGETIMGHHTETVIQDGDHIIFFVSRRRILNEL
                240        250        260        270        280        290

310
m047.pep EKLIQVKMGFFGX
         |||||||||||||
a047     EKLIQVKMGFFGX
                300        310
```

Computer analysis of this amino acid sequence gave the following results:
Homology with a Predicted ORF from *N. gonorrhoeae*
ORF 047 shows 96.2% identity over a 312 aa overlap with a predicted ORF (ORF 047.ng) from *N. gonorrhoeae*:

```
m047/g045
   m047.pep  MVIIQARXXGXLVGRSIADIAQDLPDGADCQICAVYRNNRLIVPAPQTVIIEGDEILFAA  60
             ||||||| | |||||||||||||||||||||||||||||||||||||||||||||||||
   g047      MVIIQARRGGLLVGRSIADIAQDLPDGADCQICAVYRNNRLIVPAPQTVIIEGDEILFAA  60 m047.pep  AAENIGAVIPELRPKETQRNQPXXIMIXGGGNIGYRLAKQLEHAYNVKIIECRPRRAEWI  120
             ||||||||||||||||: :   ||| ||||| ||||||||||||||||||||||||||||
   g047      AAENIGAVIPELRPKETSTRR---IMIAGGGNICYRLAKQLEHAYNVKIIECRPRRAEWI  117 m047.pep  AENLDNTLVLQGSATDETLLDNEYIDEIDVFCALTNDDESNIMSALLAKNLGAKRVIGIV  180
             ||||||||||||||||||||||||||||||||||||||||||||||||||||||||||||
   g047      AENLDNTLVLQGSATDETLLDNEYIDEIDVFCALTNDDESNIMSALLAKNLGAKRVIGIV  177 m047.pep  NRSSYVDLLEGNKIDIVVSPHLITIGSILAHIRRGDIVAVHPIRRGTAEAIEVVAHGDKK  240
             ||||||||||||||||||||||||||||||||||||||||||||||||||||||||||||
   g047      NRSSYVDLLEGNKIDIVVSPHLITIGSILAHIRRGDIVAVHPIRRGTAEAIEVVAHGDKK  237 m047.pep  TSAIIGRRISGIKWPEGCHIAAVVRAGTGETIMGHHTETVIQDGDHIIFFVSRRRILNEL  300
             ||||||||||||||||||||||||||||||||||||||||||||||||||||||||||||
   g047      TSAIIGRRISGIKWPEGCHIAAVVRAGTGETIMGHHTETVIQDGDHIIFFVSRRRILNEL  297 m047.pep  EKLIQVKMGFFGX  313
             |||||||||||||
   g047      EKLIQVKMGFFGX  310
```

The following partial DNA sequence was identified in *N. gonorrhoeae* <SEQ ID 199>:

```
g048.seq
    1    ATGCTCGACA AAGGCGAGGA GTTGCCCGTC GATTTCACCA ACCGCCTGAT

51    TTACTACGTc ggcCCcgTCG ATCCGGTCGG CGATGAAGTC GTCGGTCCCG

101    CAGGTCCGAC CACAGCCACC CGCATGGACA AATTTACCCG CCAAATGCTC

151    AAACAAACCG GCCTCTTGGG CATGATCGGC AAATCCGagc gcgGcgcggc 201    cacctGCGAA GCcatCGCCG ACAACAAGGC CGTGTACCTC ATGGCAGTCG

251    GCGGCGCGGC ATACCTCGTG GCAAAAGCCA TCAAATCTTC CAAAGTCTTG

301    GCGTTCCCCG AATTGGGTAT GGAAGCCGTT TACGAATTTG AAGTCAAAGA

351    TATGCCCGTA ACCGTCGCCG TGGACAGCAA AGGCGAATCC ATCCACGCCA

401    CCGCCCCGCG CAAATGGCAG GCGAAAATCG GCATCATCCC CGTCGAGTCT

451    TGA
```

This corresponds to the amino acid sequence <SEQ ID 200; ORF 048.ng>:

```
g048.pep
    1    MLDKGEELPV DFTNRLIYYV GPVDPVGDEV VGPAGPTTAT RMDKFTRQML

51    KQTGLLGMIG KSERGAATCE AIADNKAVYL MAVGGAAYLV AKAIKSSKVL

101    AFPELGMEAV YEFEVKDMPV TVAVDSKGES IHATAPRKWQ AKIGIIPVES

151    *
```

The following partial DNA sequence was identified in *N. meningitidis* <SEQ ID 201>:

```
m048.seq
    1    ATGCTCAACA AAGGCGAAGA ATTGCCCGTC GATTTCACCA ACCGCCTGAT

51    TTACTACGTC GGCCCCGTCG ATCCGGTCGG CGATGAAGTC GTCGGTCCGG

101    CAGGTCCGAC CACAGCCACC CGCATGGACA AATTCACCCG CCAAATGCTC
```

-continued

```
   151  GAACAAACCG ACCTCTTGGG CATGATCGGC AAATCCGAGC GCGGCGTGGC

201  CACCTGCGAA GCCATCGCCG ACAACAAAGC CGTGTACCTC ATGGCAGTCG

251  GCGGCGCGGC GTATCTCGTG GCAAAAGCCA TCAAATCTTC CAAAGTCTTG

301  GCGTTCCCCG AATTGGGCAT GGAAGCCATT TACGAATTTG AAGTCAAAGA

351  CATGCCCGTA ACCGTCGCCG TAGATAGCAA AGGCGAATCC ATCCACGCCA

401  CCGCCCCGCG CAAATGGCAG GCGAAAATCG GCATCATCCC CGTCGAATCT

451  TGA
```

This corresponds to the amino acid sequence <SEQ ID 202; ORF 048>:

```
m048.pep
     1  MLNKGEELPV DFTNRLIYYV GPVDPVGDEV VGPAGPTTAT RMDKFTRQML

51  EQTDLLGMIG KSERGVATCE AIADNKAVYL MAVGGAAYLV AKAIKSSKVL

101  AFPELGMEAI YEFEVKDMPV TVAVDSKGES IHATAPRKWQ AKIGIIPVES

151  *
```

The following partial DNA sequence was identified in *N. meningitidis* <SEQ ID 203>:

```
a048.seq
     1  ATGCTCGACA AAGGCGAAGA ATTGCCCGTC GATTTCACCA ACCGCCTGAT

51  TTACTACGTC GGCCCCGTCG ATCCGGTCGG CGACGAAATC GTCGGCCCAG

101  CAGGTCCGAC CACCGCCACC CGCATGGACA AATTCACCCG CCAAATGCTC

151  GAACAAACCG ACCTCTTGGG CATGATCGGC AAATCCGAGC GCGGCGCGGC

201  CACCTGCGAA GCCATCGCCG ACAACAAAGC CGTGTACCTC ATGGCAGTCG

251  GCGGCGCGGC GTATCTCGTG GCAAAAGCCA TCAAATCTTC CAAAGTCTTG

301  GCGTTCCCCG AATTGGGCAT GGAAGCCATT TACGAATTTG AAGTCAAAGA

351  CATGCCCGTA ACCGTCGCCG TAGACAGCAA AGGCGAATCC ATCCACGCCA

401  CCGCCCCGCC CCAATGGCAG GCGAAAATCG GCATCATCCC CGTCAAATCT

451  TGA
```

This corresponds to the amino acid sequence <SEQ ID 204; ORF 048.a>:

```
a048.pep
     1  MLDKGEELPV DFTNRLIYYV GPVDPVGDEI VGPAGPTTAT RMDKFTRQML

51  EQTDLLGMIG KSERGAATCE AIADNKAVYL MAVGGAAYLV AKAIKSSKVL

101  AFPELGMEAI YEFEVKDMPV TVAVDSKGES IHATAPPQWQ AKIGIIPVKS

151  *
``` m048/a048 96.0% identity over a 150 aa overlap

```
                    10         20         30         40         50         60
   m048.pep  MLNKGEELPVDFTNRLIYYVGPVDPVGDEVVGPAGPTTATRMDKFTRQMLEQTDLLGMIG
             ||:|||||||||||||||||||||||||||:|||||||||||||||||||||||||||||
   a048      MLDKGEELPVDFTNRLIYYVGPVDPVGDEIVGPAGPTTATRMDKFTRQMLEQTDLLGMIG
                    10         20         30         40         50         60
```

```
                  70         80         90        100        110        120
m048.pep  KSERGVATCEAIADNKAVYLMAVGGAAYLVAKAIKSSKVLAFPELGMEAIYEFEVKDMPV
          |||||:||||||||||||||||||||||||||||||||||||||||||||||||||||||
a048      KSERGAATCEAIADNKAVYLMAVGGAAYLVAKAIKSSKVLAFPELGMEAIYEFEVKDMPV
                  70         80         90        100        110        120

130        140        150
m048.pep  TVAVDSKGESIHATAPRKWQAKIGIIPVESX
          ||||||||||||||||:|||||||||||:||
a048      TVAVDSKGESIHATAPPQWQAKIGIIPVKSX
                 130        140        150
```

Computer analysis of this amino acid sequence gave the following results:

Homology with a Predicted ORF from *N. gonorrhoeae*
ORF 048 shows 96.4% identity over a 150 aa overlap with a predicted ORF (ORF 048.ng) from *N. gonorrhoeae*:

```
m048/g048
                  10         20         30         40         50         60
m048.pep  MLNKGEELPVDFTNRLIYYVGPVDPVGDEVVGPAGPTTATRMDKFTRQMLEQTDLLGMIG
          ||:|||||||||||||||||||||||||||||||||||||||||||||||:|| ||||||
g048      MLDKGEELPVDFTNRLIYYVGPVDPVGDEVVGPAGPTTATRMDKFTRQMLKQTGLLGMIG
                  10         20         30         40         50         60
                  70         80         90        100        110        120
m048.pep  KSERGVATCEAIADNKAVYLMAVGGAAYLVAKAIKSSKVLAFPELGMEAIYEFEVKDMPV
          |||||:|||||||||||||||||||||||||||||||||||||||||||:||||||||||
a048      KSERGAATCEAIADNKAVYLMAVGGAAYLVAKAIKSSKVLAFPELGMEAVYEFEVKDMPV
                  70         80         90        100        110        120
                 130        140        150
m048.pep  TVAVDSKGESIHATAPRKWQAKIGIIPVESX
          ||||||||||||||||||||||||||||||
a048      TVAVDSKGESIHATAPRKWQAKIGIIPVESX
                 130        140        150
```

The following partial DNA sequence was identified in *N. gonorrhoeae* <SEQ ID 205>:

```
g049.seq
    1   ATGCGGGCGC AGGCGTTTGA TCAACCGTTC GGTCAGCTCC TGTTCGGACA

51   GGCAGAACAC TTCGCGCCGG TTGACGGCTT TCGGGTTCAG GATATTGATT

101   TGGACGGGCA TCAACGCCTC TTCCGCACCG CCTTCGCCGT TTTCCGCAAC

151   CCCGTCTGCC GCCGTACCGG ATTCTGCCGC ATCGGCGTTT TCCCCGCCCT

201   CAATCTGTGC GGTTTCAAAT TCGGCACTGT CTTTTTTGGC ATCGAACCGG

251   ATTCTCCGCC GCGATTCGAT GTGTTTTTCC GAAAccggca tTTGCAGGGA

301   AGCCTgcgcg TTGAGCCAGT TTTCCTGAAG GACGATCATC GGGTCGGTTT

351   CGACTTCCTC GCCGCAATCG GCAACGGCgc tGTTGTGTTC TTCCTGCCAT

401   TTCTTCAGAT ACGCCTTTAA
```

This corresponds to the amino acid sequence <SEQ ID 206; ORF 049.ng>:

```
g049.pep
    1   MRAQAFDQPF GQLLFGQAEH FAPVDGFRVQ DIDLDGHQRL FRTAFAVFRN

51   PVCRRTGFCR IGVFPALNLC GFKFGTVFFG IEPDSPPRFD VFFRNRHLQG

101   SLRVEPVFLK DDHRVGFDFL AAIGNGAVVF FLPFLQIRL*
```

The following partial DNA sequence was identified in *N. meningitidis* <SEQ ID 207>:

m049.seq (partial)
```
  1  ATGCGGGCGC AGGCGTTTGA TCAGCCGTTC GGTCAGCTCC TGTTCGGACA
 51  GGCAGAACAC TTCGCGCCGG TTGACGGCTT TCGGGTTCAG GATATTGATT
101  TGGACGGGCA TCAACGTTTC TTCCGCATCG TTTTCCCCGT TTTCCGAAAC
151  CGCCGGCTCA TTCGTGCCGG ATTCTGCCTC GTCGGCGTTT TCCCCGCTTT
201  CAATCTGTCC GGTTTCAAAT TCGACACTGT CTTTTTTGGT ATCAAACCGG
251  ATTCTCCGCC GCGATTCGAT GTGTTTTTCC GAAACCGACA TTTGCAGGGA
301  AGCCTGCGCG TTGAGCCAGT TTTCCTGAAG GACGATCATC GGGTCGGTTT
351  CGACTTCCTC GCCGCAATCG GCAACGGCGG CATTGTGTTC CTCCTGCCAT
401  TTTTTCAGAT ACGCCTT...
```

This corresponds to the amino acid sequence <SEQ ID 208; ORF 049>:

m049.pep (partial)
```
  1  MRAQAFDQPF GQLLFGQAEH FAPVDGFRVQ DIDLDGHQRF FRIVFPVFRN
 51  RRLIRAGFCL VGVFPAFNLS GFKFDTVFFG IKPDSPPRFD VFFRNRHLQG
101  SLRVEPVFLK DDHRVGFDFL AAIGNGGIVF LLPFFQIRL...
```

The following partial DNA sequence was identified in *N. meningitidis* <SEQ ID 209>:

a049.seq
```
  1  ATGCGGGCGC AGGCGTTTGA TCAGCCGTTC GGTCAGCTCC TGTTCGGACA
 51  GGCAGAACAC TTCGCGCCGG TTGACGGCTT TCGGGTTCAG AATATTGATT
101  TGGACGGGCA TCAACGCTTC TTCCGCACCG CCTTCGCCGT TTTCCGCAAC
151  CCCGTCTGCC GCCGTACCCG ATTCTGCCGC ATCGGCGTTT TCCCCGCCTT
201  CAATCTGTCC GGTTTCAAAT TCGGCACTGT CTTTTTTGGC ATCAAACCGG
251  ATTCTCCGCC GCGATTCGAT GTGTTTTTCC GAAACCGACA TTTGCAGGGA
301  AGCCTGCGCG TTGAGCCAGT TTTCCTGAAG GACGATCATC GGGTCGGTTT
351  CGACTTCCTC GCCGCAATCG GCAACGGCGG CATTGTGTTC CTCCTGCCAT
401  TTTTTCAGAT ACGCCTT
```

This corresponds to the amino acid sequence <SEQ ID 210; ORF 049.a>:

a049.pep
```
  1  MRAQAFDQPF GQLLFGQAEH FAPVDGFRVQ NIDLDGHQRF FRTAFAVFRN
 51  PVCRRTRFCR IGVFPAFNLS GFKFGTVFFG IKPDSPPRFD VFFRNRHLQG
101  SLRVEPVFLK DDHRVGFDFL AAIGNGGIVF LLPFFQIRL
``` m049/a049 90.6% identity over a 139 aa overlap

```
                 10         20         30         40         50         60
m049.pep  MRAQAFDQPFGQLLFGQAEHFAPVDGFRVQDIDLDGHQRFFRIVFPVFRNRRLIRAGFCL
          ||||||||||||||||||||||||||||||:|||||||||||| :||||  |:  |  ||
a049      MRAQAFDQPFGQLLFGQAEHFAPVDGFRVQNIDLDGHQRFFRTAFAVFRNPVCRRTRFCR
                 10         20         30         40         50         60
```

```
                70        80        90        100       110       120
m049.pep  VGVFPAFNLSGFKFDTVFFGIKPDSPPRFDVFFRNRHLQGSLRVEPVFLKDDHRVGFDFL
          :|||||||||||| |||||||||||||||||||||||||||||||||||||||||||||
a049      IGVFPAFNLSGFKFGTVFFGIKPDSPPRFDVFFRNRHLQGSLRVEPVFLKDDHRVGFDFL
                70        80        90        100       110       120

130       139
m049.pep  AAIGNGGIVFLLPFFQIRL
          |||||||||||||||||||
a049      AAIGNGGIVFLLPFFQIRL
               130
```

Computer analysis of this amino acid sequence gave the following results:
Homology with a Predicted ORF from *N. gonorrhoeae*
ORF 049 shows 86.3% identity over a 139 aa overlap with a predicted ORF (ORF 049.ng) from *N. gonorrhoeae*:

```
m049/g049
                10        20        30        40        50        60
m049.pep  MRAQAFDQPFGQLLFGQAEHFAPVDGFRVQDIDLDGHQRFFRIVFPVFRNRRLIRAGFCL
          ||||||||||||||||||||||||||||||||||||||| :|| :|  ||||    |:|||
g049      MRAQAFDQPFGQLLFGQAEHFAPVDGFRVQDIDLDGHQRLFRTAFAVFRNPVCRRTGFCR
                10        20        30        40        50        60

70        80        90        100       110       120
m049.pep  VGVFPAFNLSGFKFDTVFFGIKPDSPPRFDVFFRNRHLQGSLRVEPVFLKDDHRVGFDFL
          :|||||:|| ||||  |||||||:|||||||||||||||||||||||||||||||||||
g049      IGVFPALNLCGFKFGTVFFGIEPDSPPRFDVFFRNRHLQGSLRVEPVFLKDDHRVGFDFL
                70        80        90        100       110       120

130       139
m049.pep  AAIGNGGIVFLLPFFQIRL
          ||||||::||:|||:||||
g049      AAIGNGAVVFFLPFLQIRLX
               130       140
```

The following partial DNA sequence was identified in *N. gonorrhoeae* <SEQ ID 211>:

```
g050.seq
    1   atgggcgCGG GCTGGTGTCC TCCCGGCATC TTGGGCATCG GCATCGGCGg 51   cacgcccGAA AAAGccgtgt TGATGGcaaA AGAATCCCTG ATGAGCCACA 101   TCGAcatCca aGaATTGCAG GAAAAAGCCG CGTccggggc ggaattgtcc 151   accaccgaAG ccCTGCGCCT cGAACTCTTT GAAAAGGTCA ACGCGCTGGG

201   CATCGGCGCG CAAGGCTTGG GCGGTCTGAC CACCGTGTTG GACGTGAAAA

251   TCCTCGATTA CCCGACCCAT GCCGCCTCCA AACCGATTGC CATGATTCCC

301   AACTGTGCCg ccacCCGcca cgtcgAATTT GAATTGgACG GCTCAGGtcc

351   TGTCGAactc acgccGCcgc gtgtCGAAGA CTGA
```

This corresponds to the amino acid sequence <SEQ ID 212; ORF 050.ng>:

```
g050.pep
    1   MGAGWCPPGI LGIGIGGTPE KAVLMAKESL MSHIDIQELQ EKAASGAELS

51   TTEALRLELF EKVNALGIGA QGLGGLTTVL DVKILDYPTH AASKPIAMIP

101   NCAATRHVEF ELDGSGPVEL TPPRVED*
```

The following partial DNA sequence was identified in *N. meningitidis* <SEQ ID 213>:

```
m050.seq
    1   ATGGGCGCGG GCTGGTGTCC TCCCGGCATC TTGGGTATCG GCATCGGCGG
   51   C..agCCgAA AAAGCCGTGC TGATGGCAAA AGAGTCCCTG ATGAGCCACA
  101   TCGACATTCA AGAATTGCAG GAAAAGGCCG CGTCCGGCGC GgAATTGTCC
  151   ACCACCGAAG CCCTGCGCCT CGAACTCTTT GAAAAAGTCA ACGCGCTGGG
  201   CATCGGCGCA CAAGGCTTGG GCGGACTGAC CACCGTGTTG GACGTGAAAA
  251   TCCTCGATTA TCCGACCCAC GCCGCCTCCA AACCGATTGC CATGATTCCG
  301   AACTGCGCCG CCACCCGCCA CGTCGAATTT GAATTGGACG GCTCAGGCCC
  351   TGTCGAACTC ACGCCGCCGC GCGTCGAAGA TGGCCCGATT TGA
```

This corresponds to the amino acid sequence <SEQ ID 214; ORF 050>:

```
m050.pep
    1   MGAGWCPPGI LGIGIGGXAE KAVLMAKESL MSHIDIQELQ EKAASGAELS
   51   TTEALRLELF EKVNALGIGA QGLGGLTTVL DVKILDYPTH AASKPIAMIP
  101   NCAATRHVEF ELDGSGPVEL TPPRVEDGPI *
```

The following partial DNA sequence was identified in *N. meningitidis* <SEQ ID 215>:

```
a050.seq
    1   ATGGGCGCGG GCTGGTGTCC TCCCGGCATC TTGGGCATCG GCATCGGCGG
   51   TACGCCCGAA AAAGCCGTGT TGATGGCGAA AGAATCCCTG ATGAGCCACA
  101   TCGACATCCA AGAATTGCAG GAAAAAGCCG CGTCCGGCGC GGAATTGTCC
  151   ACCACCGAAG CCCTGCGCCT CGAACTCTTT GAAAAAGTCA ACGCGCTAGG
  201   CATCGGCGCG CAAGGCTTGG GCGGTCTGAC CACCGTGTTG GACGTGAAAA
  251   TCCTCGATTA CCCGACCCAC GCCGCCTCCA AACCGATTGC CATGATTCCG
  301   AACTGCGCCG CCACCCGCCA CGTCGAATTT GAATTGGACG GCTCAGGCCC
  351   TGTCGAACTC ACGCCGCCGC GCGTCGAAGA CTGGCCC
```

This corresponds to the amino acid sequence <SEQ ID 216; ORF 050.a>:

```
a050.pep
    1   MGAGWCPPGI LGIGIGGTPE KAVLMAKESL MSHIDIQELQ EKAASGAELS
   51   TTEALRLELF EKVNALGIGA QGLGGLTTVL DVKILDYPTH AASKPIAMIP
  101   NCAATRHVEF ELDGSGPVEL TPPRVEDWP
``` m050/a050 97.7% identity over a 129 aa overlap

```
                    10         20         30         40         50         60
    m050.pep   MGAGWCPPGILGIGIGGXAEKAVLMAKESLMSHIDIQELQEKAASGAELSTTEALRLELF
               ||||||||||||||||:  ||||||||||||||||||||||||||||||||||||||||
    a050       MGAGWCPPGILGIGIGGTPEKAVLMAKESLMSHIDIQELQEKAASGAELSTTEALRLELF
                    10         20         30         40         50         60

70         80         90        100        110        120
    m050.pep   EKVNALGIGAQGLGGLTTVLDVKILDYPTHAASKPIAMIPNCAATRHVEFELDGSGPVEL
               ||||||||||||||||||||||||||||||||||||||||||||||||||||||||||||
    a050       EKVNALGIGAQGLGGLTTVLDVKILDYPTHAASKPIAMIPNCAATRHVEFELDGSGPVEL
                    70         80         90        100        110        120
```

-continued

```
                    130
m050.pep    TPPRVEDGPIX
            ||||||| |
a050        TPPRVEDWP
```

Computer analysis of this amino acid sequence gave the following results:

Homology with a Predicted ORF from *N. gonorrhoeae*
ORF 050 shows 98.4% identity over a 127 aa overlap with a predicted ORF (ORF 050.ng) from *N. gonorrhoeae*:

```
m050/g050
                    10        20        30        40        50        60
m050.pep    MGAGWCPPGILGIGIGGXAEKAVLMAKESLMSHIDIQELQEKAASGAELSTTEALRLELF
            |||||||||||||||||:||||||||||||||||||||||||||||||||||||||||||
g050        MGAGWCPPGILGIGIGGTPEKAVLMAKESLMSHIDIQELQEKAASGAELSTTEALRLELF
                    10        20        30        40        50        60

70        80        90        100       110       120
m050.pep    EKVNALGIGAQGLGGLTTVLDVKILDYPTHAASKPIAMIPNCAATRHVEFELDGSGPVEL
            ||||||||||||||||||||||||||||||||||||||||||||||||||||||||||||
g050        EKVNALGIGAQGLGGLTTVLDVKILDYPTHAASKPIAMIPNCAATRHVEFELDGSGPVEL
                    70        80        90        100       110       120

130
m050.pep    TPPRVEDGPIX
            |||||||
a050        TPPRVEDX
```

The following partial DNA sequence was identified in *N. gonorrhoeae* <SEQ ID 217>:

```
g050-1.seq
       1    ATGACCGTTA TCAAGCAAGA AGACTTTATT CAAAGTATCT GCGATGCCTT

51    CCAATTCATC AGCTACTACC ATCCAAAAGA CTACATCGAC GCGCTTTATA

101    AGGCGTGGCA GAAGGAAGAA AATCCCGCCG CCAAAGACGC GATGACGCAG

151    ATTTTGGTCA ACAGCCGTAT GTGTGCCGAA ACAACCGCC CCATCTGCCA

201    AGACACAGGT ATCGCAACCG TCTTCCTCAA AGTCGGTATG GATGTGCAAT

251    GGGATGCGGA CATGAGCGTG GAAAAGATGG TTAACGAAGG CGTACGCCGC

301    GCCTACACTT GGGAAGGCAA CACCCTGCGC GCTTCCGTCC TCGCCGATCC

351    GGCCGGCAAA CGCCAAAACA CCAAAGACAA CACCCCCGCC GTCATCCACA

401    TGAGCATCGT GCCGGGCGGT AAAGTCGAAG TAACCTGCGC GGCAAAGGC

451    GGCGGCTCTG AAAACAAATC CAAACTCGCT ATGCTCAACC CTTCCGACAA

501    CATCGTCGAT TGGGTATTGA AAACCATCCC GACGATGGGC GCGGGCTGGT

551    GTCCTCCCGG CATCTTGGGC ATCGGCATCG GCGGCAcgcC CGAAAAAGCC

601    GTGTTGATGG cgaAAGAATC CCTGATGAGC CACATCGACA TCCAAGAATT

651    GCAGGAAAAA GCCGCGTCCG GCGCGGAATT GTCCACCACC GAAGCCCTGC

701    GCCTCGAACT CTTTGAAAAG GTCAACGCGC TGGGCATCGG CGCGCAAGGC

751    TTGGGCGGTC TGACCACCGT GTTGGACGTG AAAATCCTCG ATTACCCGAC

801    CCATGCCGCC TCCAAACCGA TTGCCATGAT TCCCAACTGT GCCGCCACCC

851    GCCACGTCGA ATTTGAATTG GACGGCTCAG GTCCTGTCGA ACTCACGCCG

901    CCGCGCGTCG AAGACTGACC CGATCTGACT TACAGCCCCG ACAACGGCAA

951    ACGCGTCGAT GTCGATAAGC TGACCAAAGA AGAAGTGGCA AGCTGGAAAA

1001    CCGGCGACGT ATTGCTGTTG AACGGCAAAA TCCTCACCGG CCGCGATGCC
```

```
-continued
1051  GCGCACAAAC GCCTCGTCAA TATGCTCGAC AAAGGCGAGG AGTTGCCCGT

1101  CGATTTCACC AACCGCCTGA TTTACTACGT CGGCCCCGTC GATCCGGTCG

1151  GCGATGAAGT CGTCGGTCCC GCAGGTCCGA CCACAGCCAC CCGCATGGAC

1201  AAATTTACCC GCCAAATGCT CAAACAAACC GGCCTCTTGG GCATGATCGG

1251  CAAATCCGAG CGCGGCGCGG CCACCTGCGA AGCCATCGCC GACAACAAGG

1301  CCGTGTACCT CATGGCAGTC GGCGGCGCGG CATACCTCGT GGCAAAAGCC

1351  ATCAAATCTT CCAAAGTCTT GGCGTTCCCC GAATTGGGTA TGGAAGCCGT

1401  TTACGAATTT GAAGTCAAAG ATATGCCCGT AACCGTCGCC GTGGACAGCA

1451  AAGGCGAATC CATCCACGCC ACCGCCCCGC GCAAATGGCA GGCGAAAATC

1501  GGCATCATCC CCGTCGAGTC TTGA
```

This corresponds to the amino acid sequence <SEQ ID 218;
ORF 050-1.ng>:

```
g050-1.pep
    1  MTVIKQEDFI QSICDAFQFI SYYHPKDYID ALYKAWQKEE NPAAKDAMTQ

51  ILVNSRMCAE NNRPICQDTG IATVFLKVGM DVQWDADMSV EKMVNEGVRR

101  AYTWEGNTLR ASVLADPAGK RQNTKDNTPA VIHMSIVPGG KVEVTCAAKG

151  GGSENKSKLA MLNPSDNIVD WVLKTIPTMG AGWCPPGILG IGIGGTPEKA

201  VLMAKESLMS HIDIQELQEK AASGAELSTT EALRLELFEK VNALGIGAQG

251  LGGLTTVLDV KILDYPTHAA SKPIAMIPNC AATRHVEFEL DGSGPVELTP

301  PRVED*PDLT YSPDNGKRVD VDKLTKEEVA SWKTGDVLLL NGKILTGRDA

351  AHKRLVNMLD KGEELPVDFT NRLIYYVGPV DPVGDEVVGP AGPTTATRMD

401  KFTRQMLKQT GLLGMIGKSE RGAATCEAIA DNKAVYLMAV GGAAYLVAKA

451  IKSSKVLAFP ELGMEAVYEF EVKDMPVTVA VDSKGESIHA TAPRKWQAKI

501  GIIPVES*
``` g050-1 (SEQ ID 218)/p14407 (SEQ ID 4160)

```
sp|P14407|FUMB_ECOLI FUMARATE HYDRATASE CLASS I, ANAEROBIC (FUMARASE)
>gi|280063|pir||B44511 fumarate hydratase (EC 4.2.1.2) fumB,
iron-dependent - Escherichia coli>gi|146048 (M27058) anaerobic class I
fumarase (EC 4.2.1.2) [Escherichia coli] Length = 548
Score = 172 bits (432), Expect = 4e-42
Identities = 138/488 (28%), Positives = 216/488 (43%), Gaps = 22/488 (4%)
Query:  11 QSICDAFQFISYYHPKDYIDALYKAWQKEENPAAKDAMTQILVNSRMCAENNRPICQDTG   70
           Q+    DA   + H K   L+   E +   K   Q L NS + A+   P CQDTG
Sbjct:  53 QAFHDASFMLRPAHQKQVAAILHDPEASEND---KYVALQFLRNSEIAAKGVLPTCQDTG  109

Query:  71 IATVFLKVGMDVQWDADMSVEKMVNEGVRRAYTWEGNTLRASVLADPAGKRQNTKDNTPA  130
           A+  K G V W      E+ +++GV  Y EN   +  A  K NT  N PA
Sbjct: 110 TAIIVGKKGQRV-WTGGGD-EETLSKGVYNTYI-EDNLRYSQNAALDMYKEVNTGTNLPA  166

Query: 131 VIHMSIVPGGKVEVTCAAKGGGSENKSKL-----AMLNPSDNIVDWVLKTIPTMGAGWCP  185
             I +  V G + +  C AKGGGS NK+ L    A+L P  + +++++ + T+G    CP
Sbjct: 167 QIDLYAVDGDEYKFLCVAKGGSANKTYLYQETKALLTPG-KLKNFLVEKMRTLGTAACP  225

Query: 186 PXXXXXXXXXTPEKAVLMAKESLMSHIDIQELQEKAASGAELSTTEALRLELFEKVNXXX  245
           P         T + L + +H EL +   +     L  EL E+
Sbjct: 226 PYHIAFVIGGTSAETNLKTVKLASAHY-YDELPTEGNEHGQAFRDVQLEQELLEEAQKLG  284

Query: 246 XXXXXXXXXTTVLDVKILDYPTHAASKPIAMIPNCAATRHVEFELDGSG----PVELTPP  301
                      D++++  P H AS P+ M +C+A R+++ +++ G     +E P
Sbjct: 285 LGAQFGGKYFAH-DIRVIRLPRHGASCPVGMGVSCSADRNIKAKINREGIWIEKLEHNPG  343 uery:  302 RVEDXPDLTYSPDNGKRVDVDKLTKE---EVASWKTGDVLLLNGKILTGRDAAHKRLVNM  358
             +              +VD+++ KE    +++ +        L L G I+ GRD AH +L +
```

-continued

```
Sbjct: 344 QYIPQELRQAGEGEAVKVDLNRPMKEILAQLSQYPVSTRLSLTGTIIVGRDIAHAKLKEL  403

Query: 359 LDKGEELPVDFTNRLIYYXXXXXXXXXXXXXXXXXTTATRMDKFTRQMLKQTGLLGMIGK  418
           +D G+ELP    +  IYY                  TTA RMD +    +    G + M+ K
Sbjct: 404 IDAGKELPQYIKDHPIYYAGPAKTPAGYPSGSLGPTTAGRMDSYVDLLQSHGGSMIMLAK  463

Query: 419 SERGAATCEAIADNKAVYLMAVGG-AAYLVAKAIKSSKVLAFPELGMEAVYEFEVKDMPV  477
             R     +A    +    YL ++GG AA L   ++IK   + +A+PELGMEA+++ EV+D P
Sbjct: 464 GNRSQQVTDACHKHGGFYLGSIGGPAAVLAQQSIKHLECVAYPELGMEAIWKIEVEDFPA  523

Query: 478 TVAVDSKG 485
            + VD KG
Sbjct: 524 FILVDDKG 531
```

The following partial DNA sequence was identified in *N. meningitidis* <SEQ ID 219>:

```
m050-1.seq
   1  ATGACCGTCA TCAAACAGGA AGACTTTATC CAAAGCATTT GCGATGCCTT
  51  CCAATTCATC AGCTACTATC ATCCCAAAGA CTACATCGAC GCGCTTTATA
 101  AGGCGTGGCA GAAGGAAGAA AATCCTGCCG CCAAAGACGC GATGACGCAG
 151  ATTTTGGTCA ACAGCCGTAT GTGTGCGGAA AACAACCGCC CCATCTGCCA
 201  AGACACAGGT ATCGCAACCG TCTTCCTCAA AGTCGGTATG AACGTCCAAT
 251  GGGATGCGGA CATGAGCGTG GAAGAGATGG TTAACGAAGG CGTACGCCGC
 301  GCCTACACTT GGGAAGGCAA TACGCTGCGC GCTTCCGTCC TCGCCGATCC
 351  GGCCGGCAAA CGCCAAAACA CCAAAGACAA CACCCCCGCC GTCATCCATA
 401  TGAGCATCGT GCCGGGCGGT AAAGTCGAAG TAACCTGCGC GGCAAAAGGC
 451  GGCGGCTCTG AAAACAAATC CAAACTCGCC ATGCTCAATC CTTCCGACAA
 501  CATCGTCGAT TGGGTATTGA AAACCATCCC GACCATGGGC GCGGGCTGGT
 551  GTCCTCCCGG CATCTTGGGT ATCGGCATCG GCGGCACGCC CGAAAAAGCC
 601  GTGCTGATGG CAAAAGAGTC CCTGATGAGC CACATCGACA TTCAAGAATT
 651  GCAGGAAAAG GCCGCGTCCG GCGCGGAATT GTCCACCACC GAAGCCCTGC
 701  GCCTCGAACT CTTTGAAAAA GTCAACGCGC TGGGCATCGG CGCACAAGGC
 751  TTGGGCGGAC TGACCACCGT GTTGGACGTG AAAATCCTCG ATTATCCGAC
 801  CCACGCCGCC TCCAAACCGA TTGCCATGAT TCCGAACTGC GCCGCCACCC
 851  GCCACGTCGA ATTTGAATTG GACGGCTCAG GCCCTGTCGA ACTCACGCCG
 901  CCGCGCGTCG AAGACTGGCC CGATTTGACT TACAGCCCCG ACAACGGCAA
 951  ACGCGTCGAT GTCGACAAGC TGACCAAAGA AGAAGTGGCA AGCTGGAAAA
1001  CCGGCGACGT ATTGCTGTTG AACGGCAAAA TCCTCACCGG CCGCGATGCC
1051  GCACACAAAC GCCTCGTCGA TATGCTCAAC AAAGGCGAAG AATTGCCCGT
1101  CGATTTCACC AACCGCCTGA TTTACTACGT CGGCCCCGTC GATCCGGTCG
1151  GCGATGAAGT CGTCGGTCCG GCAGGTCCGA CCACAGCCAC CCGCATGGAC
1201  AAATTCACCC GCCAAATGCT CGAACAAACC GACCTCTTGG GCATGATCGG
1251  CAAATCCGAG CGCGGCGTGG CCACCTGCGA AGCCATCGCC GACAACAAAG
1301  CCGTGTACCT CATGGCAGTC GGCGGCGCGG CGTATCTCGT GGCAAAAGCC
1351  ATCAAATCTT CCAAAGTCTT GGCGTTCCCC GAATTGGGCA TGGAAGCCAT
1401  TTACGAATTT GAAGTCAAAG ACATGCCCGT AACCGTCGCC GTAGATAGCA
```

```
                                              -continued
       1451  AAGGCGAATC CATCCACGCC ACCGCCCCGC GCAAATGGCA GGCGAAAATC

1501  GGCATCATCC CCGTCGAATC TTGA
```

This corresponds to the amino acid sequence <SEQ ID 220; ORF 050-1>:

```
m050-1.pep
     1    MTVIKQEDFI QSICDAFQFI SYYHPKDYID ALYKAWQKEE NPAAKDAMTQ

51    ILVNSRMCAE NNRPICQDTG IATVFLKVGM NVQWDADMSV EEMVNEGVRR

101    AYTWEGNTLR ASVLADPAGK RQNTKDNTPA VIHMSIVPGG KVEVTCAAKG

151    GGSENKSKLA MLNPSDNIVD WVLKTIPTMG AGWCPPGILG IGIGGTPEKA

201    VLMAKESLMS HIDIQELQEK AASGAELSTT EALRLELFEK VNALGIGAQG

251    LGGLTTVLDV KILDYPTHAA SKPIAMIPNC AATRHVEFEL DGSGPVELTP

301    PRVEDWPDLT YSPDNGKRVD VDKLTKEEVA SWKTGDVLLL NGKILTGRDA

351    AHKRLVDMLN KGEELPVDFT NRLIYYVGPV DPVGDEVVGP AGPTTATRMD

401    KFTRQMLEQT DLLGMIGKSE RGVATCEAIA DNKAVYLMAV GGAAYLVAKA

451    IKSSKVLAFP ELGMEAIYEF EVKDMPVTVA VDSKGESIHA TAPRKWQAKI

501    GIIPVES*
``` m050-1/g050-1 98.2% identity in 507 aa overlap

```
                    10         20         30         40         50         60
m050-1.pep  MTVIKQEDFIQSICDAFQFISYYHPKDYIDALYKAWQKEENPAAKDAMTQILVNSRMCAE
            ||||||||||||||||||||||||||||||||||||||||||||||||||||||:||||
g050-1      MTVIKQEDFIQSICDAFQFISYYHPKDYIDALYKAWQKEENPAAKDAMTQILVNGRMCAE
                    10         20         30         40         50         60

70         80         90        100        110        120
m050-1.pep  NNRPICQDTGIATVFLKVGMNVQWDADMSVEEMVNEGVRRAYTWEGNTLRASVLADPAGK
            |||||||||||||||||||||:||||||||||:|||||||||||||||||||||||||||
g050-1      NNRPICQDTGIATVFLKVGMDVQWDADMSVEKMVNEGVRRAYTWEGNTLRASVLADPAGK
                    70         80         90        100        110        120

130        140        150        160        170        180
m050-1.pep  RQNTKDNTPAVIHMSIVPGGKVEVTCAAKGGGSENKSKLAMLNPSDNIVDWVLKTIPTMG
            ||||||||||||||||||||||||||||||||||||||||||||||||||||||||||||
g050-1      RQNTKDNTPAVIHMSIVPGGKVEVTCAAKGGGSENKSKLAMLNPSDNIVDWVLKTIPTMG
                   130        140        150        160        170        180

190        200        210        220        230        240
m050-1.pep  AGWCPPGILGIGIGGTPEKAVLMAKESLMSHIDIQELQEKAASGAELSTTEALRLELFEK
            ||||||||||||||||||||||||||||||||||||||||||||||||||||||||||||
g050-1      AGWCPPGILGIGIGGTPEKAVLMAKESLMSHIDIQELQEKAASGAELSTTEALRLELFEK
                   190        200        210        220        230        240

250        260        270        280        290        300
m050-1.pep  VNALGIGAQGLGGLTTVLDVKILDYPTHAASKPIAMIPNCAATRHVEFELDGSGPVELTP
            ||||||||||||||||||||||||||||||||||||||||||||||||||||||||||||
g050-1      VNALGIGAQGLGGLTTVLDVKILDYPTHAASKPIAMIPNCAATRHVEFELDGSGPVELTP
                   250        260        270        280        290        300

310        320        330        340        350        360
m050-1.pep  PRVEDWPDLTYSPDNGKRVDVDKLTKEEVASWKTGDVLLLNGKILTGRDAAHKRLVDMLN
            |||||:||||||||||||||||||||||||||||||||||||||||||||||||||:||:
g050-1      PRVEDXPDLTYSPDNGKRVDVDKLTKEEVASWKTGDVLLLNGKILTGRDAAHKRLVNMLD
                   310        320        330        340        350        360

370        380        390        400        410        420
m050-1.pep  KGEELPVDFTNRLIYYVGPVDPVGDEVVGPAGPTTATRMDKFTRQMLEQTDLLGMTGKGE
            |||||||||||||||||||||||||||||||||||||||||||||||:||:||||||:|
g050-1      KGEELPVDFTNRLIYYVGPVDPVGDEVVGPAGPTTATRMDKFTRQMLKQTGLLGMIGKSE
                   370        380        390        400        410        420

430        440        450        460        470        480
m050-1.pep  RGVATCEAIADNKAVYLMAVGGAAYLVAKAIKSSKVLAFPELGMEAIYEFEVKDMPVTVA
            ||:|||||||||||||||||||||||||||||||||||||||||||:|||||||||||||
g050-1      RGAATCEAIADNKAVYLMAVGGAAYLVAKAIKSSKVLAFPELGMEAVYEFEVKDMPVTVA
                   430        440        450        460        470        480
```

```
                              -continued
                        490        500
     m050-1.pep    VDSKGESIHATAPRKWQAKIGIIPVESX
                   ||||||||||||||||||||||||||||
     gC50-1        VDSKGESIHATAPRKWQAKIGIIPVESX
                        490        500
```

The following partial DNA sequence was identified in *N. meningitidis* <SEQ ID 221>:

```
a050-1.seq
       1    ATGACCGTCA TCAAACAGGA AGACTTTATC CAAAGCATTT GCGATGCCTT
      51    CCAATTCATC AGCTACTACC ATCCCAAAGA CTACATCGAC GCGCTTTATA
     101    AGGCGTGGCA GAAGGAAGAA AACCCCGCCG CCAAAGACGC GATGACGCAG
     151    ATTTTGGTCA ACAGCCGCAT GTGTGCCGAA ACAACCGCC CCATCTGCCA
     201    AGATACCGGT ATCGCGACCG TGTTTTTGAA AGTCGGTATG GATGTGCAAT
     251    GGGATGCAGA CATGAGCGTC GAAGAGATGG TTAACGAAGG CGTGCGCCGC
     301    GCCTACACTT GGGAAGGCAA TACGCTGCGC GCTTCCGTTC TCGCCGACCC
     351    CGCCGGCAAA CGCCAAAATA CCAAAGACAA CACGCCCGCC GTCATCCATA
     401    TGAGCATCGT GCCGGGCGAC AAAGTCGAAG TAACCTGCGC GGCAAAAGGC
     451    GGCGGTTCTG AAAACAAATC CAAACTCGCC ATGCTCAACC CTTCCGACAA
     501    CATCGTCGAT TGGGTATTGA AACCATTCC GACCATGGGC GCGGGCTGGT
     551    GTCCTCCCGG CATCTTGGGC ATCGGCATCG GCGGTACGCC CGAAAAAGCC
     601    GTGTTGATGG CGAAAGAATC CCTGATGAGC ACATCGACA TCCAAGAATT
     651    GCAGGAAAAA GCCGCGTCCG GCGCGGAATT GTCCACCACC GAAGCCCTGC
     701    GCCTCGAACT CTTTGAAAAA GTCAACGCGC TAGGCATCGG CGCGCAAGGC
     751    TTGGGCGGTC TGACCACCGT GTTGGACGTG AAAATCCTCG ATTACCCGAC
     801    CCACGCCGCC TCCAAACCGA TTGCCATGAT TCCGAACTGC GCCGCCACCC
     851    GCCACGTCGA ATTTGAATTG GACGGCTCAG GCCCTGTCGA ACTCACGCCG
     901    CCGCGCGTCG AAGACTGGCC CGATTTGACT TACAGCCCCG ACAACGGCAA
     951    ACGCGTCGAT GTCGACAAGC TGACCAAAGA AGAAGTGGCA AGCTGGAAAA
    1001    CCGGCGACGT ATTGCTGTTG AACGGCAAAA TCCTCACCGG CCGCGATGCC
    1051    GCACACAAAC GCCTCGTCGA TATGCTCGAC AAAGGCGAAG AATTGCCCGT
    1101    CGATTTCACC AACCGCCTGA TTTACTACGT CGGCCCCGTC GATCCGGTCG
    1151    GCGACGAAAT CGTCGGCCCA GCAGGTCCGA CCACCGCCAC CCGCATGGAC
    1201    AAATTCACCC GCCAAATGCT CGAACAAACC GACCTCTTGG GCATGATCGG
    1251    CAAATCCGAG CGCGGCGCGG CCACCTGCGA AGCCATCGCC GACAACAAAG
    1301    CCGTGTACCT CATGGCAGTC GGCGGCGCGG CGTATCTCGT GGCAAAAGCC
    1351    ATCAAATCTT CCAAAGTCTT GGCGTTCCCC GAATTGGGCA TGGAAGCCAT
    1401    TTACGAATTT GAAGTCAAAG ACATGCCCGT AACCGTCGCC GTAGACAGCA
    1451    AAGGCGAATC CATCCACGCC ACCGCCCCGC CCCAATGGCA GGCGAAAATC
    1501    GGCATCATCC CCGTCAAATC TTGA
```

This corresponds to the amino acid sequence <SEQ ID 222; ORF 050-1.a>:

```
a050-1.pep
     1    MTVIKQEDFI QSICDAFQFI SYYHPKDYID ALYKAWQKEE NPAAKDAMTQ

51    ILVNSRMCAE NNRPICQDTG IATVFLKVGM DVQWDADMSV EEMVNEGVRR

101    AYTWEGNTLR ASVLADPAGK RQNTKDNTPA VIHMSIVPGD KVEVTCAAKG

151    GGSENKSKLA MLNPSDNIVD WVLKTIPTMG AGWCPPGILG IGIGGTPEKA

201    VLMAKESLMS HIDIQELQEK AASGAELSTT EALRLELFEK VNALGIGAQG

251    LGGLTTVLDV KILDYPTHAA SKPIAMIPNC AATRHVEFEL DGSGPVELTP

301    PRVEDWPDLT YSPDNGKRVD VDKLTKEEVA SWKTGDVLLL NGKILTGRDA

351    AHKRLVDMLD KGEELPVDFT NRLIYYVGPV DPVGDEIVGP AGPTTATRMD

401    KFTRQMLEQT DLLGMIGKSE RGAATCEAIA DNKAVYLMAV GGAAYLVAKA

451    IKSSKVLAFP ELGMEAIYEF EVKDMPVTVA VDSKGESIHA TAPPQWQAKI

501    GIIPVKS*
``` a050-1/m050-1 98.4% identity in 507 aa overlap

```
                  10         20         30         40         50         60
a050-1.pep  MTVIKQEDFIQSICDAFQFISYYHPKDYIDALYKAWQKEENPAAKDAMTQILVNSRMCAE
            ||||||||||||||||||||||||||||||||||||||||||||||||||||||||||||
m050-1      MTVIKQEDFIQSICDAFQFISYYHPKDYIDALYKAWQKEENPAAKDAMTQILVNGRMCAE
                  10         20         30         40         50         60

70         80         90        100        110        120
a050-1.pep  NNRPICQDTGIATVFLKVGMDVQWDADMSVEEMVNEGVRRAYTWEGNTLRASVLADPAGK
            ||||||||||||||||||||||:|||||||||||||||||||||||||||||||||||||
m050-1      NNRPICQDTGIATVFLKVGMNVQWDADMSVEKMVNEGVRRAYTWEGNTLRASVLADPAGK
                  70         80         90        100        110        120

130        140        150        160        170        180
a050-1.pep  RQNTKDNTPAVIHMSIVPGDKVEVTCAAKGGGSENKSKLAMLNPSDNIVDWVLKTIPTMG
            |||||||||||||||||||| |||||||||||||||||||||||||||||||||||||||
m050-1      RQNTKDNTPAVIHMSIVPGGKVEVTCAAKGGGSENKSKLAMLNPSDNIVDWVLKTIPTMG
                 130        140        150        160        170        180

190        200        210        220        230        240
a050-1.pep  AGWCPPGILGIGIGGTPEKAVLMAKESLMSHIDIQELQEKAASGAELSTTEALRLELFEK
            ||||||||||||||||||||||||||||||||||||||||||||||||||||||||||||
m050-1      AGWCPPGILGIGIGGTPEKAVLMAKESLMSHIDIQELQEKAASGAELSTTEALRLELFEK
                 190        200        210        220        230        240

250        260        270        280        290        300
a050-1.pep  VNALGIGAQGLGGLTTVLDVKILDYPTHAASKPIAMIPNCAATRHVEFELDGSGPVELTP
            ||||||||||||||||||||||||||||||||||||||||||||||||||||||||||||
m050-1      VNALGIGAQGLGGLTTVLDVKILDYPTHAASKPIAMIPNCAATRHVEFELDGSGPVELTP
                 250        260        270        280        290        300

310        320        330        340        350        360
a050-1.pep  PRVEDWPDLTYSPDNGKRVDVDKLTKEEVASWKTGDVLLLNGKILTGRDAAHKRLVDMLD
            |||||||||||||||||||||||||||||||||||||||||||||||||||||||||||:
m050-1      PRVEDWPDLTYSPDNGKRVDVDKLTKEEVASWKTGDVLLLNGKILTGRDAAHKRLVDMLN
                 310        320        330        340        350        360

370        380        390        400        410        420
a050-1.pep  KGEELPVDFTNRLIYYVGPVDPVGDEIVGPAGPTTATRMDKFTRQMLEQTDLLGMTGKGE
            ||||||||||||||||||||||||||||:|||||||||||||||||||||||||||:|||
m050-1      KGEELPVDFTNRLIYYVGPVDPVGDEVVGPAGPTTATRMDKFTRQMLEQTDLLGMIGKSE
                 370        380        390        400        410        420

430        440        450        460        470        480
a050-1.pep  RGAATCEAIADNKAVYLMAVGGAAYLVAKAIKSSKVLAFPELGMEAIYEFEVKDMPVTVA
            ||:|||||||||||||||||||||||||||||||||||||||||||||||||||||||||
m050-1      RGVATCEAIADNKAVYLMAVGGAAYLVAKAIKSSKVLAFPELGMEAIYEFEVKDMPVTVA
                 430        440        450        460        470        480

490        500
a050-1.pep  VDSKGESIHATAPPQWQAKIGIIPVKSX
            |||||||||||:|||||||||||:|:||
mC50-1      VDSKGESIHATAPRKWQAKIGIIPVESX
                 490        500
```

The following partial DNA sequence was identified in *N. gonorrhoeae* <SEQ ID 223>:

```
g052.seq
    1   ATGGCTTTGG TGGCGGAGGA AACGGAAATA TCCGCGCCGT GTTTCAAAGG
   51   CTGCGAGCCG ACGGGCGACA GCAGGCTGTT GTCCACCACC AAGAGCGCGC
  101   CGATGCCGTG CGCCAATTCC GCCAAGGCTT CCAAGTCGGC CACTTCGCCC
  151   AAGGGGTTGG ACGGCGTTTC CAAAAACAGC AGTTTGGTGT TGGCTTTGAC
  201   GGCGGCTTTC CATTCATTTA TATCAGTCGG CGACACGCGG CTCACTCCGA
  251   TGCCGAATTT GGTAACGATG TTATTGATAA AGCCGACGGT CGTGCCGAAC
  301   AGGCTGCGGC TGGAAACCAC ATGGTCGCCC GCCTGCAGGA AGGTGAAAAA
  351   CGCCGCCTGA
```

This corresponds to the amino acid sequence <SEQ ID 224; ORF 052.ng>:

```
g052.pep
    1   MALVAEETEI SAPCFKGCEP TGDSRLLSTT KSAPMPCANS AKASKSATSP
   51   KGLDGVSKNS SLVLALTAAF HSFISVGDTR LTPMPNLVTM LLIKPTVVPN
  101   RLRLETTWSP ACRKVKNAA*
```

The following partial DNA sequence was identified in *N. meningitidis* <SEQ ID 225>:

```
m052.seq
    1   ATGGCTTTGG TGGCGGAGGA AACGGAAATA TCCGCGCCGT GTTTCAAAGG
   51   CTGCGAGCCG ACGGGCGACA GCAGGCTGTT GTCCACCACC AAGAGCGCGC
  101   CGATGCCGTG CGCCAATTCC GCCAAGGCTT CCAAGTCGGC CACTTCGCCC
  151   AAGGGGTTGG ACGGCGTTTC CAAAAACAGC AGTTTGGTGT TGGCTTTGAC
  201   GGCGGCTTTC CATTCATTTA TATCAGTCGG CGACACGCGG CTCACTCCGA
  251   TGCCGAATTT GGTAACGATG TTATTGATAA AGCCGACGGT CGTGCCGAAC
  301   AGGCTGCGGC TGGAAACCAC ATGGTCGCCC GCCTGCAGGA AGGTGAAAAA
  351   CGCCGCCTGA
```

This corresponds to the amino acid sequence <SEQ ID 226; ORF 052>:

```
m052.pep
    1   MALVAEETEI SAPCFKGCEP TGDSRLLSTT KSAPMPCANS AKASKSATSP
   51   KGLDGVSKNS SLVLALTAAF HSFISVGDTR LTPMPNLVTM LLIKPTVVPN
  101   RLRLETTWSP ACRKVKNAA*
```

The following partial DNA sequence was identified in *N. meningitidis* <SEQ ID 227>:

```
a052.seq
    1   ATGGCTTTGG TCGCGGAGGA AACGGAAATA TCCGCGCCGT GTTTCAAAGG
   51   CTGAGAGCCG ACAGGCGACA GCAGGCTGTT GTCCACCACC AAGAGCGCGC
  101   CGATGCCGTG CGCCAATTCC GCCAAGGCTT CCAAGTCGGC CACTTCTCCC
  151   AAGGGATTGG ACGGCGTTTC CAAAAACAGC AGTTTGGTGT TGGCTTTGAC
  201   GGCGGCTTTC CATTCGTTTA TATCAGTCGG CGACACGTGA CTCACTTCGA
```

```
251  TGCCGAATTT GGTAACGATG TTATTGATAA AGCCGACGGT CGTGCCGAAC

301  AGGCTGCGGC TGGAAATCAC ATGGTCGCCC GCCTGCAAAA AGGTGAAAAA

351  CGCCGCCTGA
```

This corresponds to the amino acid sequence <SEQ ID 228; ORF 052.a>:

```
a052.pep
  1  MALVAEETEI SAPCFKG*EP TGDSRLLSTT KSAPMPCANS AKASKSATSP

51  KGLDGVSKNS SLVLALTAAF HSFISVGDT* LTSMPNLVTM LLIKPTVVPN

101  RLRLEITWSP ACKKVKNAA*
``` m052/a052 95.8% identity over a 119 aa overlap

```
                    10         20         30         40         50         60
   m052.pep  MALVAEETEISAPCFKGCEPTGDSRLLSTTKSAPMPCANSAKASKSATSPKGLDGVSKNS
             ||||||||||||||| ||||||||||||||||||||||||||||||||||||||||||||
       a052  MALVAEETEISAPCFKGXEPTGDSRLLSTTKSAPMPCANSAKASKSATSPKGLDGVSKNS
                    10         20         30         40         50         60

70         80         90        100        110        120
   m052.pep  SLVLALTAAFHSFISVGDTRLTPMPNLVTMLLIKPTVVPNRLRLETTWSPACRKVKNAAX
             ||||||||||||||||||| || |||||||||||||||||||| ||||||:||||||||
       a052  SLVLALTAAFHSFISVGDTXLTSMPNLVTMLLIKPTVVPNRIRLEITWSPACKKVKNAAX
                    70         80         90        100        110        120
```

Computer analysis of this amino acid sequence gave the following results:
Homology with a Predicted ORF from *N. gonorrhoeae*
ORF 052 shows 95.8% identity over a 119 aa overlap with a predicted ORF (ORF 052.ng) from *N. gonorrhoeae*:

```
   m052/g052
                    10         20         30         40         50         60
   m052.pep  MALVAEETEISAPCFKGCEPTGDSRLLSTTKSAPMPCANSAKASKSATSPKGLDGVSKNS
             ||||||||||||||||||||||||||||||||||||||||||||||||||||||||||||
       g052  MALVAEETEISAPCFKGCEPTGDSRLLSTTKSAPMPCANSAKASKSATSPKGLDGVSKNS
                    10         20         30         40         50         60

70         80         90        100        110        120
   m052.pep  SLVLALTAAFHSFISVGDTWLTSMPNLATMLLIKPTVVPNRLRLEITWSPACKKVKNAAX
             ||||||||||||||||||| || ||||:|||||||||||||| ||||||:||||||||
       g052  SLVLALTAAFHSFISVGDTRLTPMPNLVTMLLIKPTVVPNRLRLETTWSPACRKVKNAAX
                    70         80         90        100        110        120
```

The following partial DNA sequence was identified in *N. gonorrhoeae* <SEQ ID 229>:

```
g073.seq
  1  ATGTGTATGC CATACGCAAT AAGGGTTTCA GACGGCATCT GCCGCATTTT

51  TCCGCCGATG CCGTCTGAAA CACGCAATCA GCGCGCGAGT GCCTGTTTCA

101  AATCGTCAAT CAAATCGCCA ACATATTCCA AACCGACCGA CAGGCGCACC

151  AGTCCGGGGC GGatacCGGC GGCGAGTTTT TCTTCGGGCT GCATCCTGCC

201  GTGCGTGGTT GTCCACGGAT TGGTGATGGT CGAGCGCACG TCGCCGAGGT

251  TGGCGGTACG GGAAAAGAGT TCCACGACTT TCCACGCGGC TGCTTGGTCG

301  GCGACTTCAA AACCGATGAC GATGCCGCCG CCGTTTTGCT GTTTGCGGAT

351  AAGCTCCGCC TGCGGATGGT CGGGCAATCC GGTGTAG
```

This corresponds to the amino acid sequence <SEQ ID 230; ORF 073.ng>:

```
g073.pep
    1   MCMPYAIRVS DGICRIFPPM PSETRNQRAS ACFKSSIKSP TYSKPTDRRT

51   SPGRIPAASF SSGCILPCVV VHGLVMVERT SPRLAVREKS STTFHAAAWS

101   ATSKPMTMPP PFCCLRISSA CGWSGNPV*
```

The following partial DNA sequence was identified in *N. meningitidis* <SEQ ID 231>:

```
m073.seq
    1   ATGTGTATGC CATATAAGAT AAGGGTTTCA GACGGCATCT GCTGTCCAAT

51   GCCGTCTGAA ACACGCAATC AGCGTGCGAG TGCCTGTTTC AAATCGTCAA

101   TCAAATCGCC AACATATTCC AAACCGACCG ACAGGCGCAC CAATCCGGGG

151   CGGATGTTGG CGGCGAGTTT TCTTCGGGC TGCATCCTGC CGTGCGTGGT

201   TGTCCACGGG TGGGTAATGG TCGAGCGCAC GTCACCGAGG TTGGCGGTGC

251   GGGAAAAGAG TTCCACGCCG TCCACAACTT TCCACGCCGC TTCTTGATCG

301   GCAACTTCAA AGCCGATGAC GATGCCGCCG CCGTTTTGCT GTTTGCGGAT

351   AAGCGCCGCC TGAGGATGGT CGGACAATCC GGTGTAG
```

This corresponds to the amino acid sequence <SEQ ID 232; ORF 073>:

```
m073.pep
    1   MCMPYKIRVS DGICCPMPSE TRNQRASACF KSSIKSPTYS KPTDRRTNPG

51   RMLAASFSSG CILPCVVVHG WVMVERTSPR LAVREKSSTP STTFHAASXS

101   ATSKPMTMPP PFCCLRISAA XGWSDNPV*
```

The following partial DNA sequence was identified in *N. meningitidis* <SEQ ID 233>:

```
a073.seq
    1   ACGTGTATGT CATATAAGAT AAGGGTTTCA GACGGCATTT GCGGTGTTTT

51   TCCGCCGATG CCGTCTGAA. CACGCAATCA GCGCGCGAGT GCCTGTTTCA

101   AATCGTCAAT CAAATCGCCA ACATATTCCA AACCGACCGA CAGGCGCACC

151   AATCCGGGGC GGATGTTGGC GGCGAGTTTT CTTCGGGCT GCATCCTGCC

201   GTGCGTGGTT GTCCACGGAT GGGTAATGGT CGAGCGCACG TCGCCGAGGT

251   TGGCGGTACG GGAGAAAAGT TCGACGCCGT CCACGACTTT CCACGCGGCT

301   GCTTGGTCGG CGACTTCAAA GCCGATGACG ATGCCGCCGC CGTTTTGCTG

351   TTTGCGGATA AGCTCCGCCT GAGGATGGTC GGGTAATCCG GTGTAA
```

This corresponds to the amino acid sequence <SEQ ID 234; ORF 073.a>:

```
a073.pep
    1   TCMSYKIRVS DGICGVFPPM PSEXRNQRAS ACFKSSIKSP TYSKPTDRRT

51   NPGRMLAASF SSGCILPCVV VHGWVMVERT SPRLAVREKS STPSTTFHAA

101   AWSATSKPMT MPPPFCCLRI SSA*GWSGNP V*
``` m073/a073 92.3% identity over a 130 aa overlap

```
                 10        20        30        40        50
m073.pep  MCMPYKIRVSDGICC---PMPSETRNQRASACFKSSIKSPTYSKPTDRRTNPGRMLAASF
          ||  |||||||||||       ||||:||||||||||||||||||||||:|||:||||
a073      TCMSYKIRVSDGICGVFPPMPSEXRNQRASACFKSSIKSPTYSKPTDRRTNPGRMLAASF
                 10        20        30        40        50        60

60        70        80        90       100       110
m073.pep  SSGCILPCVVVHGWVMVERTSPRLAVREKSSTPSTTFHAASXSATSKPMTMPPPFCCLRI
          ||||||||||||||||||||||||||||||||||||||||:|||||||||||||||||||
a073      SSGCILPCVVVHGWVMVERTSPRLAVREKSSTPSTTFHAAAWSATSKPMTMPPPFCCLRI
                 70        80        90       100       110       120

120       129
m073.pep  SAAXGWSDNPVX
          |:|||| ||||
a073      SSAXGWSGNPVX
                130
```

Computer analysis of this amino acid sequence gave the following results:
Homology with a Predicted ORF from N. gonorrhoeae
ORF 073 shows 87.0% identity over a 131 aa overlap with a predicted ORF (ORF 073.ng) from N. gonorrhoeae:

```
m073/g073
                 10        20        30        40        50
m073.pep  MCMPYKIRVSDGICC---PMPSETRNQRASACFKSSIKSPTYSKPTDRRTNPGRMLAASF
          ||||| |||||||||      |||||||||||||||||||||||||||:|||:  |||
g073      MCMPYAIRVSDGICRIFPPMPSETRNQRASACFKSSIKSPTYSKPTDRRTSPGRIPAASF
                 10        20        30        40        50        60

60        70        80        90       100       110
m073.pep  SSGCILPCVVVHGWVMVERTSPRLAVREKSSTPSTTFHAASXSATSKPMTMPPPFCCLRI
          |||||||||||||| ||||||||||||||||||   |||||: |||||||||||||||||
g073      SSGCILPCVVVHGLVMVERTSPRLAVREKSST---TFHAAAWSATSKPMTMPPPFCCLRI
                 70        80        90       100       110

120       129
m073.pep  SAAXGWSDNPVX
          |:| ||| ||||
g073      SSACGWSGNPVX
                120
```

The following partial DNA sequence was identified in N. gonorrhoeae <SEQ ID 235>:

```
g075.seq
    1   ATGCCGCCTT ACTTCATCAC CCTCTTAACG ATGGAAAATA CAAAAAGCGC

51   GGCGAAAACG CCCACTACAA TCCAACCGGC TTCCATACCG TCCGCTTTTG

101   CGGCTTCCAA AGCGTTTTTT GCCGTTTCGG GCAACGCTGC GTTTGCCTGT

151   GCCGCCAAAG CCAGCGGGGC GGCTGTTACA ACAGCCAGTT TTGCGCCGTA

201   TTTACGGCAG GTGTTAATAA ATTTCATGAT ATTTTCCTTT ACGAAATTTT

251   TAAAAAAATG TGTTTGCGGG CTTTGTGAAG GTTTTAGAGA CCGCCTGCCG

301   GGCCTCTTAA ACTTAATCTT CTTTTTCGTA GAATCCGAAA ATTACAAATT

351   CCCCGCCTAT CTCTTCCAAT GCCGAGCTAA AAGCGTCTTC ATAGCTGTCA

401   TATTTACCGG CTGA
```

This corresponds to the amino acid sequence <SEQ ID 236; ORF 075.ng>:

```
g075.pep
   1   MPPYFITLLT MENTKSAAKT PTTIQPASIP SAFAASKAFF AVSGNAAFAC

51   AAKASGAAVT TASFAPYLRQ VLINFMIFSF TKFLKKCVCG LCEGFRDRLP

101   GLLNLIFFFV ESENYKFPAY LFQCRAKSVF IAVIFTG*
```

The following partial DNA sequence was identified in *N. meningitidis* <SEQ ID 237>:

```
m075.seq
   1   ATGCCGTCTT ACTTCATCAC TCTCTTAACG ATGGAAAATA CAAAAAGCGC

51   GGCGAAAATG CCCACTACAA TCCAACCGGC TTCCATACCG TCCGCTTTTG

101   CGGCTTCCAA AGCGTTTTTT GCCGTATCGG GCAACGTTGC ATTTGCATGT

151   GCGGCCAAAG CCAGGGGAGC AGCTGTTACA ACAGCCAGTT TTGCGCCGTA

201   TTTACGGCAG GTGTTAATAA ATTTCATGAT ATTTTCCTTC AAAAAGTGTT

251   TGGCGGTAAT GGATGGAGCG TTTTTCAGAC GACCGCCGAA CATCCGAAAA

301   TCAGTCTTTC AAAAATCCGA ATACGACAAA TTCGTATTGG TTGCCGATTT

351   CTTCCAAACC TGCGTTAATC GCTTCTTCGA AGTCGTAGAA ATAATCGGCA

401   TTGGTGATTA A
```

This corresponds to the amino acid sequence <SEQ ID 238; ORF 075>:

```
m075.pep
   1   MPSYFITLLT MENTKSAAKM PTTIQPASIP SAFAASKAFF AVSGNVAFAC

51   AAKARGAAVT TASFAPYLRQ VLINFMIFSF KKCLAVMDGA FFRRPPNIRK

101   SVFQKSEYDK FVLVADFFQT CVNRFFEVVE IIGIGD*
```

Computer analysis of this amino acid sequence gave the following results:
Homology with a Predicted ORF from *N. gonorrhoeae*
ORF 075 shows 65.7% identity over a 137 aa overlap with a predicted ORF (ORF 075.ng) from *N. gonorrhoeae*:

```
m075/g075
                  10         20         30         40         50         60
m075.pep  MPSYFITLLTMENTKSAAKMPTTIQPASIPSAFAASKAFFAVSGNVAFACAAKARGAAVT
          ||  ||||||||||||||||| |||||||||||||||||||||||||:||||||| |||||
g075      MPPYFITLLTMENTKSAAKTPTTIQPASIPSAFAASKAFFAVSGNAAFACAAKASGAAVT
                  10         20         30         40         50         60

70         80         90        100        110
m075.pep  TASFAPYLRQVLINFMIFSF----KKCLAVMDGAFFRRPPNIRKSVFQKSEYDKFVLVAD
          ||||||||||||||||||||    |||:  :  :|  | |::  :|   | ::: :  |
g075      TASFAPYLRQVLINFMIFSFTKFLKKCVCGLCEGFRDRLPGLLNLIFFFVESENYKFPAY
                  70         80         90        100        110        120

120        130
m075.pep  FFQTCVNRFFEVVEIIGIGDX
          :||  ::    |  :|  : |
g075      LFQCRAKSVFIAVIFTGX
                 130
```

The following partial DNA sequence was identified in *N. meningitidis* <SEQ ID 239>:

```
a075.seq
   1   ATGCCGTCTT ACTTCATCAC TCTCTTAACG ATGGAAAAGA CAAAAAGCGC

51   GGCGAAAACG CCCACTACAA TCCAACCGGC TTCCATACCG TCCGCTTTTG
```

```
         -continued
101    CGGCTTCCAA AGCGTTTTTT GCTGTATCGG GCAACGTTGC ATTTGCATGT

151    GCGGCCAAAG CCAGGGGAGC AGCTGTTACA ACAGCCAGTT TTGCGCCGTA

201    TTTACGGCAG GTGTTAATAA ATTTCATGAT ATTTTCCTTC AAAAAGTGTT

251    TGGCGGTAAT GGATGGAGCG TTTTTCAGAC GACCGCCGAA CATCCGAAAA

301    TCAGTCTTTC AAAAATCCGA ATACGACAAA TTCGTATTGG TTGCCGATTT

351    CTTCCAAACC TGCGTTAATC GCTTCTTCGA AGTCGTAGAA ATAATCGGCA

401    TTGGTGATTA A
```

This corresponds to the amino acid sequence <SEQ ID 240; ORF 075.a>:

```
a075.pep
    1   MPSYFITLLT MEKTKSAAKT PTTIQPASIP SAFAASKAFF AVSGNVAFAC

51   AAKARGAAVT TASFAPYLRQ VLINFMIFSF KKCLAVMDGA FFRRPPNIRK

101   SVFQKSEYDK FVLVADFFQT CVNRFFEVVE IIGIGD*
``` m075/a075 98.5% identity over a 136 aa overlap

```
                 10         20         30         40         50         60
    m075.pep  MPSYFITLLTMENTKSAAKMPTTIQPASIPSAFAASKAFFAVSGNVAFACAAKARGAAVT
              ||||||||||:|||||  ||||||||||||||||||||||||||||||||||||||||||
    a075      MPSYFITLLTMEKTKSAAKTPTTIQPASIPSAFAASKAFFAVSGNVAFACAAKARGAAVT
                 10         20         30         40         50         60

70         80         90        100        110        120
    m075.pep  TASFAPYLRQVLINFMIFSFKKCLAVMDGAFFRRPPNIRKSVFQKSEYDKFVLVADFFQT
              ||||||||||||||||||||||||||||||||||||||||||||||||||||||||||||
    a075      TASFAPYLRQVLINFMIFSFKKCLAVMDGAFFRRPPNIRKSVFQKSEYDKFVLVADFFQT
                 70         80         90        100        110        120

130
    m075.pep  CVNRFFEVVEIIGIGDX
              |||||||||||||||||
    a075      CVNRFFEVVEIIGIGDX
                130
```

The following partial DNA sequence was identified in *N. gonorrhoeae* <SEQ ID 241>:

```
g080.seq
    1   ATGTGGGATA ATGCCGAAGC GATGGAACGG CTGACGCGCT GGCTGCTTGT

51   CATGATGGCG ATGCTGCTTG CTGCGTCCGG GCTGGTTTGG TTTTACAATT

101   CGAATCATCT GCCCGTCAAG CAGGTGTCGC TGAAGGGCAA CCTGGTTTAT

151   TCCGATAAGA AGGCATTGGG CAGTTTGGCG AAAGAATACA TCCATGGGAA

201   TATTTTGAGG ACGGACATCA ATGGCGCACA GGAAGCCTAC CGCCGGTATC

251   CGTGGATTGC GTCGGTCATG GTGCGCCGCC GTTTTCCCGA TACGGTTGAG

301   GTCGTCCTGA CCGAGCGCAA GCCGGTTGCA CGTTGGGGCG ACCATGCCTT

351   GGTGGACGGC GAAGGCAATG TTTTTGAAGC CCGCTTGGAC AGACCCGGAA

401   TGCCGGTATT CAGAGGCGCG GAAGGAACGT CTGCCGAAAT GCTCCGCCGT

451   TATGACGAAT TTTCGACTGT TTTGGCAAAA CAGGGTTTGG GCATCAAAGA

501   GATGACCTAT ACGGCACGTT CGGCGTGGAA TGTCGTTTTG GACAACGGCA

551   TCACCGTCAG GCTCGGACGG GAAAAcgaGA TGAAACGCCT CCgGCTTTTT

601   ACcgAAGCGT GGCAGCATCT gttgcGTAAG AATAAAAATC GGTTATCCTA

651   TGTGGATATG Aggtataagg acggattTC agtcccccat gctCCCGACG
```

-continued

```
701  GTTTACCCGA AAAAGAATcc gAAGAATatt gggaacaggt ttgggacata 751  ttacggcctg gcgtcggaaa cggttcgacg caaatttcaa tcagttatAA 801  GGGCAGacga acaatggaac AGcagtaa
```

This corresponds to the amino acid sequence <SEQ ID 242; ORF 080.ng>:

```
g080.pep
  1   MWDNAEAMER LTRWLLVMMA MLLAASGLVW FYNSNHLPVK QVSLKGNLVY

51   SDKKALGSLA KEYIHGNILR TDINGAQEAY RRYPWIASVM VRRRFPDTVE

101   VVLTERKPVA RWGDHALVDG EGNVFEARLD RPGMPVFRGA EGTSAEMLRR

151   YDEFSTVLAK QGLGIKEMTY TARSAWNVVL DNGITVRLGR ENEMKRLRLF

201   TEAWQHLLRK NKNRLSYVDM RYKDGFSVPH APDGLPEKES EEYWEQVWDI

251   LRPGVGNGST QISISYKGRR TMEQQ*
```

The following partial DNA sequence was identified in *N. meningitidis* <SEQ ID 243>:

```
m080.seq
  1   ATGTGGGATA ATGCCGAAGC GATGGAACGG CTGACGCGCT GGCTGCTTGT

51   CATGATGGCG ATGCTGCTTG CTGCGTCCGG GCTGGTTTGG TTTTACAATT

101   CGAATCATCT GCCCGTCAAG CAGGTGTCGC TGAAGGGCAA CCTGGTTTAT

151   TCCGATAAGA AGACATTGGG CAGTTTGGCG AAAGAATACA TCCATGGGAA

201   TATTTTGAGG ACGGACATCA ATGGCGCACA GGAGGCCTAC CGCCGGTATC

251   CGTGGATTGC GTCGGTCATG GTGCGCCGCC GTTTTCCCGA CACGGTTGAG

301   GTCGTCCTGA CCGAGCGCAA GCCGGTCGCG CGTTGGGCG ACCATGCCTT

351   GGTGGACGGC GAAGGCAATG TTTTTGAAGC CCGCTTGGAC AGACCCGGAA

401   TGCCGGTATT CAGAGGCGCG GAAGGAACGT CTGCCGAAAT GCTCCGCCGT

451   TATGACGAAT TTTCGACTGT TTTGGCAAAA CAGGGTTTGG GCATCAAAGA

501   GATGACCTAT ACGGCACGTT CGGCGTGGAT TGTCGTTTTG GACAACGGCA

551   TCACCGTCAG GCTCGGACGG GAAAACGAGA TGAAACGCCT CCGGCTTTTT

601   ACCGAAGCGT GGCAGCATCT GTTGCGTAAA AATAAAAATC GGTTATCCTA

651   TGTGGATATG AGGTATAAGG ACGGATTTTC AGTCCGCTAT GCTTCCGACG

701   GTTTACCCGA AAAGAATCC GAAGAATAG
```

This corresponds to the amino acid sequence <SEQ ID 2441; ORF 080>:

```
m080.pep
  1   MWDNAEAMER LTRWLLVMMA MLLAASGLVW FYNSNHLPVK QVSLKGNLVY

51   SDKKTLGSLA KEYIHGNILR TDINGAQEAY RRYPWIASVM VRRRFPDTVE

101   VVLTERKPVA RWGDHALVDG EGNVFEARLD RPGMPVFRGA EGTSAEMLRR

151   YDEFSTVLAK QGLGIKEMTY TARSAWIVVL DNGITVRLGR ENEMKRLRLF

201   TEAWQHLLRK NKNRLSYVDM RYKDGFSVRY ASDGLPEKES EE*
```

Computer analysis of this amino acid sequence gave the following results:
Homology with a Predicted ORF from *N. gonorrhoeae*
ORF 080 shows 97.9% identity over a 242 aa overlap with a predicted ORF (ORF 080.ng) from *N. gonorrhoeae*:

```
m080/g080
                  10         20         30         40         50         60
     m080.pep  MWDNAEAMERLTRWLLVMMAMLLAASGLVWFYNSNHLPVKQVSLKGNLVYSDKKTLGSLA
               ||||||||||||||||||||||||||||||||||||||||||||||||||||:|||||
     080       MWDNAEAMERLTRWLLVMMAMLLAASGLVWFYNSNHLPVKQVSLKGNLVYSDKKALGSLA
                  10         20         30         40         50         60

70         80         90        100        110        120
     m080.pep  KEYIHGNILRTDINGAQEAYRRYPWIASVMVRRRFPDTVEVVLTERKPVARWGDHALVDG
               ||||||||||||||||||||||||||||||||||||||||||||||||||||||||||||
     080       KEYIHGNILRTDINGAQEAYRRYPWIASVMVRRRFPDTVEVVLTERKPVARWGDHALVDG
                  70         80         90        100        110        120

130        140        150        160        170        180
     m080.pep  EGNVFEARLDRPGMPVFRGAEGTSAEMLRRYDEFSTVLAKQGLGIKEMTYTARSAWIVVL
               |||||||||||||||||||||||||||||||||||||||||||||||||||||||||:|||
     080       EGNVFEARLDRPGMPVFRGAEGTSAEMLRRYDEFSTVLAKQGLGIKEMTYTARSAWNVVL
                 130        140        150        160        170        180

190        200        210        220        230        240
     m080.pep  DNGITVRLGRENEMKRLRLFTEAWQHLLRKNKNRLSYVDMRYKDGFSVRYASDGLPEKES
               |||||||||||||||||||||||||||||||||||||||||||||||:| |||||||||
     080       DNGITVRLGRENEMKRLRLFTEAWQHLLRKNKNRLSYVDMRYKDGFSVPHAPDGLPEKES
                 190        200        210        220        230        240 m080.pep  EEX
               ||
     080       EEYWEQVWDILRPGVGNGSTQISISYKGRRTMEQQX
                       250        260        270
```

The following partial DNA sequence was identified in *N. meningitidis* <SEQ ID 245>:

```
a080.seq
    1    ATGTGGGATA ATGCCGAAGC GATGGAACGG CTGACGCGCT GGCTGCTTGT

51    CATGATGGCG ATGCTGCTTG CTGCGTCCGG GCTGGTTTGG TTTTACAATT

101    CGAATCATCT GCCCGTCAAG CAGGTGTCGC TGAAGGGCAA CCTAGTTTAT

151    TCCGATAAGA AAGCATTGGG CAGTTTGGCG AAAGAATACA TCCATGGGAA

201    TATTTTGAGG ACGGACATCA ATGGCGCACA GGAGGCCTAC CGCCGGTATC

251    CGTGGATTGC GTCGGTCATG GTGCGCCGCC GTTTTCCCGA CACGGTTGAG

301    GTCGTCCTGA CCGAGCGCAA GCCGGTCGCG CGTTGGGGCG ACCATGCCTT

351    GGTGGACGGC GAAGGCAATG TTTTTGAAGC CCGTTTGGAC AGACCCGGAA

401    TGCCGGTATT CAGAGGCGCG GAAGGAACGT CTGCCGAAAT GCTCCGCCGT

451    TATGACGAAT TTTCGACTGT TTTGGCAAAA CAGGGTTTGG GCATCAAAGA

501    GATGACCTAT ACGGCACGTT CGGCGTGGAT TGTCGTTTTG GACAACGGCA

551    TCACCGTCAG GCTCGGACGG GAAAACGAGA TGAAACGCCT CCGGCTTTTT

601    ACCGAAGCGT GGCAACATCT GTTGCGTAAA AATAAAAATC GGTTATCCTA

651    TGTGGATATG AGGTATAAGG ACGGATTTTC AGTCCGCTAT GCTCCCGACG

701    GTTTACCCGA AAAAGAATCC GAAGAATAG
```

This corresponds to the amino acid sequence <SEQ ID 246; ORF 080.a>:

```
a080.pep
    1    MWDNAEAMER LTRWLLVMMA MLLAASGLVW FYNSNHLPVK QVSLKGNLVY

51    SDKKALGSLA KEYIHGNILR TDINGAQEAY RRYPWIASVM VRRRFPDTVE
```

```
101  VVLTERKPVA RWGDHALVDG EGNVFEARLD RPGMPVFRGA EGTSAEMLRR

151  YDEFSTVLAK QGLGIKEMTY TARSAWIVVL DNGITVRLGR ENEMKRLRLF

201  TEAWQHLLRK NKNRLSYVDM RYKDGFSVRY APDGLPEKES EE*
``` m080/a080 99.2% identity over a 242 aa overlap

```
                     10         20         30         40         50         60
m080.pep   MWDNAEAMERLTRWLLVMMAMLLAASGLVWFYNSNHLPVKQVSLKGNLVYSDKKTLGSLA
           ||||||||||||||||||||||||||||||||||||||||||||||||||||:|||||
a080       MWDNAEAMERLTRWLLVMMAMLLAASGLVWFYNSNHLPVKQVSLKGNLVYSDKKALGSLA
                     10         20         30         40         50         60

70         80         90        100        110        120
m080.pep   KEYIHGNILRTDINGAQEAYRRYPWIASVMVRRRFPDTVEVVLTERKPVARWGDHALVDG
           ||||||||||||||||||||||||||||||||||||||||||||||||||||||||||||
a080       KEYIHGNILRTDINGAQEAYRRYPWIASVMVRRRFPDTVEVVLTERKPVARWGDHALVDG
                     70         80         90        100        110        120

130        140        150        160        170        180
m080.pep   EGNVFEARLDRPGMPVFRGAEGTSAEMLRRYDEFSTVLAKQGLGIKEMTYTARSAWIVVL
           ||||||||||||||||||||||||||||||||||||||||||||||||||||||||||||
a080       EGNVFEARLDRPGMPVFRGAEGTSAEMLRRYDEFSTVLAKQGLGIKEMTYTARSAWIVVL
                    130        140        150        160        170        180

190        200        210        220        230        240
m080.pep   DNGITVRLGRENEMKRLRLFTEAWQHLLRKNKNRLSYVDMRYKDGFSVRYASDGLPEKES
           |||||||||||||||||||||||||||||||||||||||||||||||||||| |||||||
a080       DNGITVRLGRENEMKRLRLFTEAWQHLLRKNKNRLSYVDMRYKDGFSVRYAPDGLPEKES
                    190        200        210        220        230        240 m080.pep   EEX
           |||
a080       EEX
```

The following partial DNA sequence was identified in *N. gonorrhoeae* <SEQ ID 247>:

```
g081.seq
    1  ATGAAACCAC TGGACCTAAA TTTCATCTGC CAAGCCCTCA AGCTTCCGAT

51  GCCGTCTGAA AACAAACCCG TGTCGCGCAT CGTAACCGAC AGCCGCGATA

101  TTCGGGAAGG CGATGTGTTT TTCGCATTGG CGGGCGGGCG GTTTGACGCG

151  CATGATTTTG TTGGAGGCGT ATTGTCTGCG GCGCGGCGG CGGTTGTGGT

201  TTCGCGCGAA GATTGCGCGG CTTTGGGCGG CGCGTTGAAA GTCGATGACA

251  CGCTTGCCGC GTTGCAAACG TTGGCGAAGG CGTGGCGCGA TAATGTGAAC

301  CCGTTTGTGT TCGGCATTAC CGGTTCGGGC GGCAAGACGA CGGTGAAGGA

351  GATGCTGGCT GCGGTATTGC CCGCCGTTT CGGCGATGAT GCCGTTTCGG

401  CGACGGCAGG CAACTTCAAC AACCACAtcg gaTTGCCGCT GACTTTATTG

451  AAATtaaAcg aAAAACACCG CTATGCCGTG ATTGAAATGG CATGAACCA

501  TTTTGGCgaa ctggcggtTt taacgcaaaT CGCCAAACCC GATGCCGCTT

551  TGGtcaACAA CGCCCTGCGC GCCCATGTCG GATGCGGTTt cgacggagtg

601  GGCGATATTG CCAAAGcgaa aagcGAGATT TatgcagGct tATGTTCAGA

651  CGGCATGGCA CTGATTCCTC AAGAAGATGC CAATATGGCT GTCTTCAAAA

701  CGGCAACGTT TAATTTGAAT ACGTGCACTT TCGGCGTCGA TAGCGGCGAT

751  GTCCGCGCGG AAAATATCGT GCTGAAACCT TTGTCGTGCG AATTTGATTT

801  GGTGTGCGGC GACGAGCGCA CTGCCGTGGT GCTGCCTGTT CCCGGCCGCC

851  ACAATGTCCA CAACGCCGCC GCTGCCGCCG CGCTGGCTTT GGCTGCCGGT

901  TTGAGTTTGA ACGATGTGGC GGAAGGTTTG CAAGGCTTCA GCAACATCAA

951  AGGCCGTCTG AACGTCAAAG CCGGCATCAA GGGCGCAACC CTGATTGACG
```

-continued

```
1001  ATACTTATAA TGCGAATCCC GACAGTATGA AAGCCGCGGT TGACGTGTTG

1051  GCGCGTATGC CTGCGCCGCG CATTTTCGTG ATGGGCGATA TGGGCGAACT

1101  GGGCGAGGAc gaAGCCGCCG CCATGCACGC CGAagtcgGC GCGTACGCCC

1151  GCGACCAAGG CATCGAAGCG GCTTATTTTG TCGGCGACAA CAGCGTCGAA

1201  GCGGcggaAA AATTTGGCGC GGACGGTTTG TGGTTCGCCG CCAAAGACCC

1251  GTTGATTCAA GTGTTGAGCC ACGATTTGCC CGAACGCGCC ACCGTGTTGG

1301  TGAAAGGTTC GCGCTTTATG CAGAtggAAG AAGTGGTCGA GGCATTGGAG

1351  GATAAGTga
```

15

This corresponds to the amino acid sequence <SEQ ID 248; ORF 081.ng>:

```
g081.pep
  1  MKPLDLNFIC QALKLPMPSE NKPVSRIVTD SRDIREGDVF FALAGGRFDA

51  HDFVGGVLSA GAAAVVVSRE DCAALGGALK VDDTLAALQT LAKAWRDNVN

101  PFVFGITGSG GKTTVKEMLA AVLRRRFGDD AVSATAGNFN NHIGLPLTLL

151  KLNEKHRYAV IEMGMNHFGE LAVLTQIAKP DAALVNNALR AHVGCGFDGV

201  GDIAKAKSEI YAGLCSDGMA LIPQEDANMA VFKTATFNLN TCTFGVDSGD

251  VRAENIVLKP LSCEFDLVCG DERTAVVLPV PGRHNVHNAA AAAALALAAG

301  LSLNDVAEGL QGFSNIKGRL NVKAGIKGAT LIDDTYNANP DSMKAAVDVL

351  ARMPAPRIFV MGDMGELGED EAAAMHAEVG AYARDQGIEA AYFVGDNSVE

401  AAEKFGADGL WFAAKDPLIQ VLSHDLPERA TVLVKGSRFM QMEEVVEALE

451  DK*
```

The following partial DNA sequence was identified in *N. meningitidis* <SEQ ID 249>:

```
m081.seq
  1  ATGAAACCAC TGGACCTAAA TTTCATCTGC CAAGCCCTCA AGCTTCCGAT

51  GCCGTCTGAA AGCAAACCCG TGTCGCGCAT CGTAACCGAC AGCCGCGACA

101  TCCGCGCGGG CGATGTGTTT TTCGCATTGG CGGGCGAGCG GTTTGACGCG

151  CATGATTTTG TTGAAGACGT ATTGGCTGCT GGTGCGGCGG CGGTTGTGGT

201  TTCGCGCGAA GATTGTGCTG CAATGGATGG CGCGTTGAAA GTCGATGACA

251  CGCTTGCCGC ATTGCAAACG CTGGCAAAGG CGTGGCGTGA AAATGTGAAT

301  CCGTTTGTGT TCGGCATTAC CGGTTCGGGC GGCAAGACGA CGGTGAAGGA

351  AATGCTGGCT GCGGTATTGC GCCgCCGTTT CGGCGATGAT GCCGTGTTGG

401  CGACGGCAGG CAACTTCAAC AACCATATCG GATTGCCGCT GACTTTGTTG

451  AAGTTAAACG AAAAACACCG CTATGCCGTG ATTGAAATGG CATGAACCA

501  TTTCGGCGAA CTGGCGGTTT TAACGCAmAT CGCCAAACCA AATGCCGCAT

551  TGGTCAACAA CGCCATGCGC GCCCATGTCG GCTGCGGTTT CGACGGAGTG

601  GGCGATATTG CCAAAGCGAA AAGCGAGATT TACCAAGGTT TATGTTCAGA

651  CGGCATTGCA CTGATTCCTC AAGAAGATGC CAATATGGCT GTCTTCAAAA

701  CGGCAACGCT TAATTTGAAT ACGCGCACTT TCGGCATCGA TAGCGGCGAT

751  GTTCACGCGG AAAATATTGT GCTGAAACCG TTGTCGTGCG AATTTGATTT
```

-continued

```
 801  GGTGTGCGGC GATGAGCGCG CCGCCGTGGT GCTGCCTGTT CCCGGCCGCC
 851  ACAATGTCCA CAACGCCGCC GCTGCCGCCG CGCTGGCTTT GGCTGCGGGT
 901  TTGAGTTTGA ACGATGTGGC GGAAGGTTTG AAAGGCTTCA GCAATATCAA
 951  AGGCCGTCTG AACGTCAAAT CCGGAATCAA GGGCGCAACC CTGATTGACG
1001  ATACTTATAA TGCGAACCCT GACAGCATGA AAGCTGCGAT TGACGTGTTG
1051  GCGCGTATGC CTGCGCCGCG TATTTTCGTG ATGGGCGATA TGGGCGAACT
1101  GGGCGAACTG GGCGAGGACG AAGCCGCCGC TATGCACGCC GAAGTCGGCG
1151  CGTATGCCCG CGACCAAGGC ATCGAAGCGG CTTATTTTGT CGGCGACAAC
1201  AGCGTCGAAG CGGCGGAAAA ATTTGGCGCG GACGGTTTGT GGTTCGCCGC
1251  CAAAGACCCG TTGATTCAAG TGTTGCGCCA CGATTTGCCC GAACGCGCCA
1301  CCGTGTTGGT GAAAGGTTCG CGCTTTATGC AGATGGAAGA AGTGGTCGAG
1351  GCATTGGAGG ATAAGTGA
```

This corresponds to the amino acid sequence <SEQ ID 250;
ORF 081>:

```
m081.pep
  1  MKPLDLNFIC QALKLPMPSE SKPVSRIVTD SRDIRAGDVF FALAGERFDA

51  HDFVEDVLAA GAAAVVVSRE DCAAMDGALK VDDTLAALQT LAKAWRENVN

101  PFVFGITSGG GKTTVKEMLA AVLRRRFGDD AVLATAGNFN NHIGLPLTLL

151  KLNEKHRYAV IEMGMNHFGE LAVLTXIAKP NAALVNNAMR AHVGCGFDGV

201  GDIAKAKSEI YQGLCSDGIA LIPQEDANMA VFKTATLNLN TRTFGIDSGD

251  VHAENIVLKP LSCEFDLVCG DERAAVVLPV PGRHNVHNAA AAAALALAAG

301  LSLNDVAEGL KGFSNIKGRL NVKSGIKGAT LIDDTYNANP DSMKAAIDVL

351  ARMPAPRIFV MGDMGELGEL GEDEAAAMHA EVGAYARDQG IEAAYFVGDN

401  SVEAAEKFGA DGLWFAAKDP LIQVLRHDLP ERATVLVKGS RFMQMEEVVE

451  ALEDK*
```

Computer analysis of this amino acid sequence gave the following results:
Homology with a Predicted ORF from *N. gonorrhoeae*
ORF 081 shows 94.1% identity over a 455 aa overlap with a predicted ORF (ORF 081.ng) from *N. gonorrhoeae*:

```
m081/g081
                 10         20         30         40         50         60
   m081.pep  MKPLDLNFICQALKLPMPSESKPVSRIVTDSRDIRAGDVFFALAGERFDAHDFVEDVLAA
             ||||||||||||||||||||:|||||||||||||| |||||||||| ||||||  ||:|
       g081  MKPLDLNFICQALKLPMPSENKPVSRIVTDSRDIREGDVFFALAGGRFDAHDFVGGVLSA
                 10         20         30         40         50         60

70         80         90        100        110        120
   m081.pep  GAAAVVVSREDCAAMDGALKVDDTLAALQTLAKAWRENVNPFVFGITSGGKTTVKEMLA
             ||||||||||||:|||||||||||||||||||||:|||||||||||||||||||||||
       g081  GAAAVVVSREDCAALGGALKVDDTLAALQTLAKAWRDNVNPFVFGITSGGKTTVKEMLA
                 70         80         90        100        110        120

130        140        150        160        170        180
   m081.pep  AVLRRRFGDDAVLATAGNFNNHIGLPLTLLKLNEKHRYAVIEMGMNHFGELAVLTXIAKP
             |||||||||||| |||||||||||||||||||||||||||||||||||||||||| |||
       g081  AVLRRRFGDDAVSATAGNFNNHIGLPLTLLKLNEKHRYAVIEMGMNHFGELAVLTQIAKP
                130        140        150        160        170        180
```

-continued

```
                     190       200       210       220       230       240
m081.pep      NAALVNNAMRAHVGCGFDGVGDIAKAKSEIYQGLCSDGIALIPQEDANMAVFKTATLNLN
              :|||||||:||||||||||||||||||||||| ||||||:|||||||||||||||||:|||
gC81          DAALVNNALRAHVGCGFDGVGDIAKAKSEIYAGLCSDGMALIPQEDANMAVFKTATFNLN
                     190       200       210       220       230       240

250       260       270       280       290       300
m081.pep      TRTFGIDSGDVHAENIVLKPLSCEFDLVCGDERAAVVLPVPGRHNVHNAAAAAALALAAG
              | |||:|||||:|||||||||||||||||||||:|||||||||||||||||||||||||
g081          TCTFGVDSGDVRAENIVLKPLSCEFDLVCGDERTAVVLPVPGRHNVHNAAAAAALALAAG
                     250       260       270       280       290       300

310       320       330       340       350       360
m081.pep      LSLNDVAEGLKGFSNIKGRLNVKSGIKGATLIDDTYNANPDSMKAAIDVLARMPAPRIFV
              ||||||||||:||||||||||||:||||||||||||||||||||||:|||||||||||||
gC81          LSLNDVAEGLQGFSNIKGRLNVKAGIKGATLIDDTYNANPDSMKAAVDVLARMPAPRIFV
                     310       320       330       340       350       360

370       380       390       400       410       420
m081.pep      MGDMGELGELGEDEAAAMHAEVGAYARDQGIEAAYFVGDNSVEAAEKFGADGLWFAAKDP
              |||||||||   ||||||||||||||||||||||||||||||||||||||||||||||||
g081          MGDMGELGE---DEAAAMHAEVGAYARDQGIEAAYFVGDNSVEAAEKFGADGLWFAAKDP
                        370       380       390       400       410

430       440       450
m081.pep      LIQVLRHDLPERATVLVKGSRFMQMEEVVEALEDKX
              ||||| ||||||||||||||||||||||||||||||
g081          LIQVLSHDLPERATVLVKGSRFMQMEEVVEALEDKX
              420       430       440       450
```

The following partial DNA sequence was identified in *N. meningitidis* <SEQ ID 251>:

```
a081.seq
   1  ATGAAACCAC TGGACCTAAA TTTCATCTGC CAAGCCCTCA AGCTTCCGAT

51  GCCGTCTGAA AGCAAACCCG TGTCGCGCAT CGTAACCGAC AGCCGCGACA

101  TCCGCGCGGG CGATGTGTTT TTCGCATTGG CGGGCGGGCG GTTTGATGCG

151  CATGATTTTG TTGAAGACGT ATTGGCTGCG GGTGCGGCGG CGGTTGTGGT

201  TTCGCGCGAA GATTGCGTTG CAATGGATGG CGCGTTGAAA GTCGATGACA

251  CGCTTACCGC GTTGCAAATG TTGGCGAAGG CGTGGCGCGA GAATGTGAAC

301  CCGTTTGTGT TCGGTATTAC CGGCTCGGGC GGCAAGACGA CGGTGAAGGA

351  AATGTTGGCT GCGGTATTGC GCCGCCGTTT CGGCGATAAT GCCGTTTTGG

401  CGACGGCAGG CAACTTCAAC AACCACATCG GATTGCCGTT GACTTTGTTG

451  AAATTAAACG AAAAACACCG CTATGCCGTG ATTGAAATGG GTATGAACCA

501  TTTTGGCGAA CTGGCGGTTT TGACACAAAT CGCCAAACCC GATGCCGCAT

551  TGGTCAACAA CGCCATGCGC GCCCATGTCG GCTGCGGTTT CGACGGAGTG

601  GGCGATATTG CCAAAGCGAA AAGCGAGATT TATCAAGGCT TATGTTCAGA

651  CGGCATGGCG CTGATTCCTC AAGAAGATGC CAATATGGCT GTCTTCAAAA

701  CGGCAACGCT TAATTTGAAT ACGCGCACTT TCGGCATCGA TAGCGGCGAT

751  GTCCACGCGG AAAATATCGT GCTGAAACCG TTGTCGTGCG AATTTGATTT

801  GGTGTGCGGC AACGAGTGCG CAGCCGTGGT TCTGCCCGTT CCCGGCCGCC

851  ACAATGTCCA CAACGCCGCC GCCGCCGCCG CGCTGTCTTT GGCTGCAGGT

901  TTGAGTTTGA ACGATGTGGC GGAAGGTTTG AAAGGCTTCA GCAATATCAA

951  AGGCCGTCTG AACGTCAAAT CCGGAATCAA GGGCGCAACC CTGATTGACG

1001  ATACTTATAA TGCGAACCCT GACAGCATGA AAGCTGCGGT TGACGTGTTG

1051  GCGCGTATGC CTGCGCCGCG TATTTTCGTG ATGGGCGATA TGGGCGAACT

1101  GGGTGAGGAC GAAGCCGCCG CCATGCACGC CGAAGTCGGC GCGTACGCCC

1151  GCGACCAAGG CATCGAAGCG GCTTATTTTG TCGGCGACAA CAGCGTCGAA
```

-continued

```
1201  GCGGCGGAAA AATTTGGCGC GGACGGTTTG TGGTTCGCCG CCAAAGACCC

1251  GTTGATTCAA GTGTTGCGCC ACGATTTGCC CGAACGCGCC ACCGTGTTGG

1301  TGAAAGGTTC GCGCTTTATG CAGATGGAAG AAGTGGTCGA GGCATTGGAG

1351  GATAAGTGA
```

This corresponds to the amino acid sequence <SEQ ID 252; ORF 081.a>:

```
a081.pep
   1   MKPLDLNFIC QALKLPMPSE SKPVSRIVTD SRDIRAGDVF FALAGGRFDA

51   HDFVEDVLAA GAAAVVVSRE DCVAMDGALK VDDTLTALQM LAKAWRENVN

101   PFVFGITGSG GKTTVKEMLA AVLRRRFGDN AVLATAGNFN NHIGLPLTLL

151   KLNEKHRYAV IEMGMNHFGE LAVLTQIAKP DAALVNNAMR AHVGCGFDGV

201   GDIAKAKSEI YQGLCSDGMA LIPQEDANMA VFKTATLNLN TRTFGIDSGD

251   VHAENIVLKP LSCEFDLVCG NECAAVVLPV PGRHNVHNAA AAAALSLAAG

301   LSLNDVAEGL KGFSNIKGRL NVKSGIKGAT LIDDTYNANP DSMKAAVDVL

351   ARMPAPRIFV MGDMGELGED EAAAMHAEVG AYARDQGIEA AYFVGDNSVE

401   AAEKFGADGL WFAAKDPLIQ VLRHDLPERA TVLVKGSRFM QMEEVVEALE

451   DK*
``` m081/a081 96.7% identity over a 455 aa overlap

```
                 10         20         30         40         50         60
    m081.pep  MKPLDLNFICQALKLPMPSESKPVSRIVTDSRDIRAGDVFFALAGERFDAHDFVEDVLAA
              |||||||||||||||||||||||||||||||||||||||||||| |||||||||||||||
    a081      MKPLDLNFICQALKLPMPSESKPVSRIVTDSRDIRAGDVFFALAGGRFDAHDFVEDVLAA
                 10         20         30         40         50         60

70         80         90        100        110        120
    m081.pep  GAAAVVVSREDCAAMDGALKVDDTLAALQTLAKAWRENVNPFVFGITGSGGKTTVKEMLA
              |||||||||||:|||||||||||||||:||| ||||||||||||||||||||||||||||
    a081      GAAAVVVSREDCVAMDGALKVDDTLTALQMLAKAWRENVNPFVFGITGSGGKTTVKEMLA
                 70         80         90        100        110        120

130        140        150        160        170        180
    m081.pep  AVLRRRFGDDAVLATAGNFNNHIGLPLTLLKLNEKHRYAVIEMGMNHFGELAVLTXIAKP
              ||||||||:|||||||||||||||||||||||||||||||||||||||||||||| ||||
    a081      AVLRRRFGDNAVLATAGNFNNHIGLPLTLLKLNEKHRYAVIEMGMNHFGELAVLTQIAKP
                130        140        150        160        170        180

190        200        210        220        230        240
    m081.pep  NAALVNNAMRAHVGCGFDGVGDIAKAKSEIYQGLCSDGIALIPQEDANMAVFKTATLNLN
              :|||||||||||||||||||||||||||||||||||||:|||||||||||||||||||||
    a081      DAALVNNAMRAHVGCGFDGVGDIAKAKSEIYQGLCSDGMALIPQEDANMAVFKTATLNLN
                190        200        210        220        230        240

250        260        270        280        290        300
    m081.pep  TRTFGIDSGDVHAENIVLKPLSCEFDLVCGDERAAVVLPVPGRHNVHNAAAAAALALAAG
              ||||||||||||||||||||||||||||||:|||||||||||||||||||||||| ||||
    a081      TRTFGIDSGDVHAENIVLKPLSCEFDLVCGNECAAVVLPVPGRHNVHNAAAAAALSLAAG
                250        260        270        280        290        300

310        320        330        340        350        360
    m081.pep  LSLNDVAEGLKGFSNIKGRLNVKSGIKGATLIDDTYNANPDSMKAAIDVLARMPAPRIFV
              ||||||||||||||||||||||||||||||||||||||||||||||:|||||||||||||
    a081      LSLNDVAEGLKGFSNIKGRLNVKSGIKGATLIDDTYNANPDSMKAAVDVLARMPAPRIFV
                310        320        330        340        350        360

370        380        390        400        410        420
    m081.pep  MGDMGELGELGEDEAAAMHAEVGAYARDQGIEAAYFVGDNSVEAAEKFGADGLWFAAKDP
              |||||||||   |||||||||||||||||||||||||||||||||||||||||||||||
    a081      MGDMGELGE---DEAAAMHAEVGAYARDQGIEAAYFVGDNSVEAAEKFGADGLWFAAKDP
                370        380        390        400        410

430        440        450
    m081.pep  LIQVLRHDLPERATVLVKGSRFMQMEEVVEALEDKX
              |||||||||||||||||||||||||||||||||||
    a081      LIQVLRHDLPERATVLVKGSRFMQMEEVVEALEDKX
                420        430        440        450
```

The following partial DNA sequence was identified in *N. gonorrhoeae* <SEQ ID 253>:

```
g082.seq
    1   aTGTGGTTGT TGAAGTTGCC TGCCGTCGCC GAAACGGCAT CATCGCCGAA
   51   ACGGCGGCGC AATACCGCAG CCAGCATCTC CTTCACCGTC GTCTTGCCGC
  101   CCGAACCGGT AATGCCGAAC ACAAACGGGT TCACATTATC GCGCCACGCC
  151   TTCGCCAACG TTTGCAACGC GGCAAGCGTG TCATCGACTT CAACGCGCC
  201   GCCCAAAGCC GCGCAATCTT CGCGCGAAAC CACAACCGCC GCCGCGCCCG
  251   CAGACAATAC GCCTCCAACA AAATCATGCG CGTCAAACCG CCCGCCCGCC
  301   AATGCGAAAA ACACATCGCC TTCCCGAATA TCGCGGCTGT CGGTTACGAT
  351   GCGCGACACG GGTTTGTTTT CAGACGGCAT CGGAAGCTTG AGGGCTTGGC
  401   AGATGAAATT TAGGTCCAGT GGTTTCATAT TTGCTTTCGT TAATATTCGG
  451   GCGGCGGACA CATCGGTAGC GGCTGATTTT TTTATCGCCT GTTTTGCTGT
  501   GGTAAAACAC AGATTATTTT CCCATTCTCA TTCGGCATTT TTTCTGTACG
  551   TATCATTTTT TAGACGTATT TTTAGCCGAT TTGCCTTTTC CCGCATACCA
  601   CGGCGCGGGG TCGTCGGACT GTCTGTCGAT AAAGGCAAGG TTATTGCCTT
  651   CGCCCGGCAC ATCGGGGACA TTCCCCCAAA AATCATAGCC GTCATCGGGC
  701   AACTCGTCGG TTTCGATACC CGTCCAACTG CCGAATCCGC GTAA
```

This corresponds to the amino acid sequence <SEQ ID 254; ORF 082.ng>:

```
g082.pep
    1   MWLLKLPAVA ETASSPKRRR NTAASISFTV VLPPEPVMPN TNGFTLSRHA
   51   FANVCNAASV SSTFNAPPKA AQSSRETTTA AAPADNTPPT KSCASNRPPA
  101   NAKNTSPSRI SRLSVTMRDT GLFSDGIGSL RAWQMKFRSS GFIFAFVNIR
  151   AADTSVAADF FIACFAVVKH RLFSHSHSAF FLYVSFFRRI FSRFAFSRIP
  201   RRGVVGLSVD KGKVIAFARH IGDIPPKIIA VIGQLVGFDT RPTAESA*
```

The following partial DNA sequence was identified in *N. meningitidis* <SEQ ID 255>:

```
m082.seq
    1   ATGnnGTTGT TGAAGTTGCC TGCCGTCGCC AACACGGCAT CATCGCCGAA
   51   ACGGcGGCGC AATACCGCAG CCAGCATTTC CTTCACCGTC GTCTTGCCGC
  101   CCGAACCGGT AATGCCGAAC ACAAACGGAT TCACATTTTC ACGCCACGCC
  151   TTTGCCAGCG TTTGCAATGC GGCAAGCGTG TCATCGACTT CAACGCGCC
  201   ATCCATTGCA GCACAATCTT CGCGCGAAAC CACAACCGCC GCCGCACCAG
  251   CAGCCAATAC GTCTTCAACA AAATCATGCG CGTCAAACCG CTCGCCCGCC
  301   AATGCGAAAA ACACATCGCC CGCGCGGATG TCGCGGCTGT CGGTTACGAT
  351   GCGCGACACG GGTTTGCTTT CAGACGGCAT CGGAAGCTTG AGGGCTTGGC
  401   AGATGAAATT TAGGTCCAGT GGTTTCATAT TTACTTTCGT TAATATTCGG
  451   GCGGCGGACA CATCGGTAGC GGCTGATTTT TTTATCGCCT GTTTTGCTGT
  501   GGTAAAACAC AGATTATTTT CCCATTCTCA TTCGGsATTT TTTCTGTACG
  551   TATCATTTTT TAGACGTATT TTTAGTCGAT TTGCCTTTTC CCGCATACCA
```

```
              -continued
601  CGGCGCGGGG TCGTCGGGCA GTCCGTCGAT AAAGGCAAGG TTATTGCCTT

651  CGCCCTGCAC ATCGGGAACA TTCCCCCAAA AATCATAGCC GTCATCGGGC

701  AACTCGTCGG TTTCGATACC CGTCCAACTG CCGAATCCGC GTAA
```

This corresponds to the amino acid sequence <SEQ ID 256; ORF 082>:

```
m082.pep
   1   MXLLKLPAVA NTASSPKRRR NTAASISFTV VLPPEPVMPN TNGFTFSRHA

51   FASVCNAASV SSTFNAPSIA AQSSRETTTA AAPAANTSST KSCASNRSPA

101   NAKNTSPARM SRLSVTMRDT GLLSDGIGSL RAWQMKFRSS GFIFTFVNIR

151   AADTSVAADF FIACFAVVKH RLFSHSHSXF FLYVSFFRRI FSRFAFSRIP

201   RRGVVGQSVD KGKVIAFALH IGNIPPKIIA VIGQLVGFDT RPTAESA*
```

Computer analysis of this amino acid sequence gave the following results:
Homology with a Predicted ORF from *N. gonorrhoeae*
ORF 082 shows 92.7% identity over a 247 aa overlap with a predicted ORF (ORF 082.ng) from *N. gonorrhoeae*:

```
m082/g082
                    10         20         30         40         50         60
   m082.pep   MXLLKLPAVANTASSPKRRRNTAASISFTVVLPPEPVMPNTNGFTFSRHAFASVCNAASV
              | |||||||||:||||||||||||||||||||||||||||||||:||||||:||||||||
   g082       MWLLKLPAVAETASSPKRRRNTAASISFTVVLPPEPVMPNTNGFTLSRHAFANVCNAASV
                    10         20         30         40         50         60

70         80         90        100        110        120
   m082.pep   SSTFNAPSIAAQSSRETTTAAAPAANTSSTKSCASNRSPANAKNTSPARMSRLSVTMRDT
              |||||||  ||||||||||||||||  ||  |||||||  |||||||||:|:||||||||
   g082       SSTFNAPPKAAQSSRETTTAAAPADNTPPTKSCASNRPPANAKNTSPSRISRLSVTMRDT
                    70         80         90        100        110        120

130        140        150        160        170        180
   m082.pep   GLLSDGIGSLRAWQMKFRSSGFIFTFVNIRAADTSVAADFFIACFAVVKHRLFSHSHSXF
              ||:|||||||||||||||||||||:|||||||||||||||||||||||||||||||| |
   g082       GLFSDGIGSLRAWQMKFRSSGFIFAFVNIRAADTSVAADFFIACFAVVKHRLFSHSHSAF
                   130        140        150        160        170        180

190        200        210        220        230        240
   m082.pep   FLYVSFFRRIFSRFAFSRIPRRGVVGQSVDKGKVIAFALHIGNIPPKIIAVIGQLVGFDT
              |||||||||||||||||||||||||||| ||||||||||  |||:|||||||||||||||
   g082       FLYVSFFRRIFSRFAFSRIPRRGVVGLSVDKGKVIAFARHIGDIPPKIIAVIGQLVGFDT
                   190        200        210        220        230        240 m082.pep   RPTAESAX
              ||||||||
   g082       RPTAESAX
```

The following partial DNA sequence was identified in *N. meningitidis* <SEQ ID 257>:

```
a082.seq
   1  ATGTGGTTGT TGAAGTTGCC TGCCGTCGCC AAAACGGCAT TATCGCCGAA

51  ACGGCGGCGC AATACCGCAG CCAACATTTC CTTCACCGTC GTCTTGCCGC

101  CCGAGCCGGT AATACCGAAC ACAAACGGGT TCACATTCTC GCGCCACGCC

151  TTCGCCAACA TTTGCAACGC GGTAAGCGTG TCATCGACTT TCAACGCGCC

201  ATCCATTGCA ACGCAATCTT CGCGCGAAAC CACAACCGCC GCCGCACCCG

251  CAGCCAATAC GTCTTCAACA AAATCATGCG CATCAAACCG CCCGCCCGCC

301  AATGCGAAAA ACACATCGCC CGCGCGGATG TCGCGGCTGT CGGTTACGAT

351  GCGCGACACG GGTTTGCTTT CAGACGGCAT CGGAAGCTTG AGGGCTTGGC

401  AGATGAAATT TAGGTCCAGT GGTTTCATAT TTACTTTCGT TAATATTCGG
```

-continued

```
451   GCGGCGGACA CATCGGTAGC GGCTGATTTT TTTATCGCCT GTTTTGCTGT

501   GGTAAAACAC AGATTATTTT CCCATTCTCA TTCGGCATTT TTTCTGTACG

551   TATCATTTTT TAGACGTATT TTTAGTCGAT TTGCCTTTTC CCGCATACCA

601   CGGCGCGGGG TCGTCGGGCA GTCCGTCGAT AAAGGCAAGG TTATTGCCTT

651   CGCCCTGCAC ATCGGGAACA TTCCCCCAAA AATCATAGCC GTCATCGGGC

701   AACTCGTCGG TTTCGATACC CGTCCAACTG CCGAATCCGC GTAA
```

This corresponds to the amino acid sequence <SEQ ID 258; ORF 082.a>:

```
a082.pep
  1   MWLLKLPAVA KTALSPKRRR NTAANISFTV VLPPEPVIPN TNGFTFSRHA

51   FANICNAVSV SSTFNAPSIA TQSSRETTTA AAPAANTSST KSCASNRPPA

101   NAKNTSPARM SRLSVTMRDT GLLSDGIGSL RAWQMKFRSS GFIFTFVNIR

151   AADTSVAADF FIACFAVVKH RLFSHSHSAF FLYVSFFRRI FSRFAFSRIP

201   RRGVVGQSVD KGKVIAFALH IGNIPPKIIA VIGQLVGFDT RPTAESA*
                                                       25
```
m082/a082 95.5% identity over a 247 aa overlap

```
                  10         20         30         40         50         60
m082.pep  MXLLKLPAVANTASSPKRRRNTAASISFTVVLPPEPVMPNTNGFTFSRHAFASVCNAASV
          | ||||||||:|| |||||||||||:|||||||||||:|||||||||||::|||:||
a082      MWLLKLPAVAKTALSPKRRRNTAANISFTVVLPPEPVIPNTNGFTFSRHAFANICNAVSV
                  10         20         30         40         50         60

70         80         90        100        110        120
m082.pep  SSTFNAPSIAAQSSRETTTAAAPAANTSSTKSCASNRSPANAKNTSPARMSRLSVTMRDT
          ||||||||||:|||||||||||||||||||||||||| ||||||||||||||||||||
a082      SSTFNAPSIATQSSRETTTAAAPAANTSSTKSCASNRPPANAKNTSPARMSRLSVTMRDT
                  70         80         90        100        110        120

130        140        150        160        170        180
m082.pep  GLLSDGIGSLRAWQMKFRSSGFIFTFVNIRAADTSVAADFFIACFAVVKHRLFSHSHSAF
          |||||||||||||||||||||||||||||||||||||||||||||||||||||||||| |
a082      GLLSDGIGSLRAWQMKFRSSGFIFTFVNIRAADTSVAADFFIACFAVVKHRLFSHSHSAF
                 130        140        150        160        170        180

190        200        210        220        230        240
m082.pep  FLYVSFFRRIFSRFAFSRIPRRGVVGQSVDKGKVIAFALHIGNIPPKIIAVIGQLVGFDT
          ||||||||||||||||||||||||||||||||||||||||||||||||||||||||||
a082      FLYVSFFRRIFSRFAFSRIPRRGVVGQSVDKGKVIAFALHIGNIPPKIIAVIGQLVGFDT
                 190        200        210        220        230        240 m082.pep  RPTAESAX
          ||||||||
a082      RPTAESAX
```

The following partial DNA sequence was identified in *N. gonorrhoeae* <SEQ ID 259>:

```
g084.seq
  1   ATGAAacaAT CCGcccgaat aAAAAATATG GATCAGACAT TAAAAAATAc 51   attgggcatt tGCGCGctt  tagcctTTTG TTTTggcgcG gccaTCGCAT

101   CAGGTTATCA CTTGGAATAT GAATACGGCT ACCGTTATTC TGCCGTGGGC

151   GCTTTGGCTT CGGTTGTATT TTTATTATTA TTGGCACGCG GCTTCCCGCG

201   CGTTTCTTCA GTTGTTTTAC TGATTTACGT CGGCACAACC GCCCTATATT

251   TGCCGGTCGG CTGGCTGTAT GGTGCGCCTT CTTATCAGAT AGTCGGTTCG

301   ATATTGGAAA GCAATCCTGC CGAGGCGCGT GAATTTGTCG GCAATCTTCC

351   CGGGTCGCTT TATTTTGTGC AGGCATTATT TTTCATTTTT GGCTTGACAG
```

-continued

```
401  TTTGGAAATA TTGTGTATCT GTGGGGGTAT TTGCTGACGT AAAAAACTAT

451  AAACGTCGCA GCAAAATATG GCTGACCATA TTATTGACTT TGATTTTGTC

501  CTGCGCGGTG ATGGAGAAAA TCGccggcga taaAGATTGG CGAGaacctg 551  atgccggcct gttgttgaat ATTTTcgacc tgtattaCga cttggctttc 601  cgcgccggca cAATATGCCG CCAAGCGCGC CCAcattttg gaagCagcaa 651  aaaaagcgtC AACATGGCAt atccgccaac ttgcgcccaa gTAtaa
```

This corresponds to the amino acid sequence <SEQ ID 260; ORF 084.ng>:

```
g084.pep
  1  MKQSARIKNM DQTLKNTLGI CALLAFCFGA AIASGYHLEY EYGYRYSAVG

51  ALASVVFLLL LARGFPRVSS VVLLIYVGTT ALYLPVGWLY GAPSYQIVGS

101  ILESNPAEAR EFVGNLPGSL YFVQALFFIF GLTVWKYCVS VGVFADVKNY

151  KRRSKIWLTI LLTLILSCAV MEKIAGDKDW REPDAGLLLN IFDLYYDLAF

201  RAGTICRQAR PHFGSSKKSV NMAYPPTCAQ V*
```

25

The following partial DNA sequence was identified in *N. meningitidis* <SEQ ID 261>:

```
m084.seq
  1  ATGAAACAAT CCGCCcGAAT AAAa.ATATG AATCAGACAT TACTTTATAC

51  ATTGGGCATT TGCGCGCTTT TAACCTTTnn nnnnnnnnnn nnnnnnnnnn 101  nnnnnTATCA CCCnGAATAT GAATACGGCT ACCGTTATTC TGCCGTGGGT

151  GCTTTGGCTT CGGTTGTATT TTTATTATTA TTGGCACGCG GTTTCCCGCG

201  CGTTTCTTCA GTTGTTTTAC TGATTTACGT CGGCACAACC GCCCTATATT

251  TGCCGGTCGG CTGGCTGTAT GGTGCGCCGT CTTATCAGAT AGTCGGTTCG

301  ATATTGGAAA GCAATCCTGC CGAGGCGCGT GAATTTGTCG GCAATCTTCC

351  CGGGTCGCTT TATTTTGTGC AGGCATTATT TTTCATTTTT GGCTTGACAG

401  TTTGGAAATA TTGTGTATCG GGGGGGGTAT TTGCTGACGT AAAAAACTAT

451  AAACGCCGCA GCAAAATATG GCTGACTATA TTATTGACTT TGATTTTGTC

501  CTGCGCGGTG ATGGATAAAA TCGCCAGCGA TAAAGATTTG CGAGAACCTG

551  ATGCCGGCCT GTTGTTGAAT ATTTTCGACC TGTATTACGA TTTGGCT.TC

601  CGCGCCGGCA CAATATGCCG CCAAGCGCGC CCACATTTTG GAAGCAGCAA

651  AAAAAGCGTC AACATGGCAT ATCCGTCATG TTGCGCCCAA GTATAA
```

This corresponds to the amino acid sequence <SEQ ID 262; ORF 084>:

```
m084.pep
  1  MKQSARIKXM NQTLLYTLGI CALLTFXXXX XXXXXYHPEY EYGYRYSAVG

51  ALASVVFLLL LARGFPRVSS VVLLIYVGTT ALYLPVGWLY GAPSYQIVGS

101  ILESNPAEAR EFVGNLPGSL YFVQALFFIF GLTVWKYCVS GGVFADVKNY

151  KRRSKIWLTI LLTLILSCAV MDKIASDKDL REPDAGLLLN IFDLYYDLAX

201  RAGTICRQAR PHFGSSKKSV NMAYPSCCAQ V*
```

Computer analysis of this amino acid sequence gave the following results:
Homology with a Predicted ORF from *N. gonorrhoeae*
ORF 084 shows 90.5% identity over a 231 aa overlap with a predicted ORF (ORF 084.ng) from *N. gonorrhoeae*:

```
   m084/g084
                      10         20         30         40         50
     m084.pep  MKQSARIKXMNQTLLYTLGICALLTF---------YHPEYEYGYRYSAVGALASVVFLLL
               ||||||||| :|||  ||||||||:|         ||||||||||||||||||||||||||
         g084  MKQSARIKNMDQTLKNTLGICALLAFCFGAAIASGYHLEYEYGYRYSAVGALASVVFLLL
                      10         20         30         40         50         60
                      60         70         80         90        100        110
     m084.pep  LARGFPRVSSVVLLIYVGTTALYLPVGWLYGAPSYQIVGSILESNPAEAREFVGNLPGSL
               ||||||||||||||||||||||||||||||||||||||||||||||||||||||||||||
         g084  LARGFPRVSSVVLLIYVGTTALYLPVGWLYGAPSYQIVGSILESNPAEAREFVGNLPGSL
                      70         80         90        100        110        120
                     120        130        140        150        160        170
     m084.pep  YFVQALFFIFGLTVWKYCVSGGVFADVKNYKRRSKIWLTILLLTLILSCAVMDKIASDKDL
               ||||||||||||||||||||||  ||||||||||||||||||||||||||||:|||:|||
         g084  YFVQALFFIFGLTVWKYCVSVGVFADVKNYKRRSKIWLTILLLTLILSCAVMEKIAGDKDW
                     130        140        150        160        170        180
                     180        190        200        210        220
     m084.pep  REPDAGLLLNIFDLYYDLAXRAGTICRQARPHFGSSKKSVNMAYPSCCAQVX
               |||||||||||||||||||| ||||||||||||||||||||||||| ||||
         g084  REPDAGLLLNIFDLYYDLAFRAGTICRQARPHFGSSKKSVNMAYPPTCAQVX
                     190        200        210        220        230
```

25

The following partial DNA sequence was identified in *N. meningitidis* <SEQ ID 263>:

```
a084.seq
     1   ATGAAACAAT CCGCCCGAAT AAAAAATATG GATCAGACAT TAAAAAATAC

51   ATTGGGCATT TGCGCGCTTT TAGCCTTTTG TTTTGGCGCG GCCATCGCAT

101   CAGGTTATCA CTTGGAATAT GAATACGGCT ACCGTTATTC TGCCGTGGGT

151   GCTTTGGCTT CGGTTGTATT TTTATTATTA TTGGCACGCG GTTTCCCGCG

201   CGTTTCTTCA GTTGTTTTAC TGATTTACGT CGGCACAACC GCCCTATATT

251   TGCCGGTCGG CTGGCTGTAT GGTGCGCCGT CTTATCAGAT AGTCGGTTCG

301   ATATTGGAAA GCAATCCTGC CGAGGCGCGT GAATTTGTCG GCAATCTTCC

351   CGGGTCGCTT TATTTTGTGC AGGCATTATT TTTCATTTTT GGCTTGACAG

401   TTTGGAGATA TTGTGTATCG GGGGGGGTAT TTGCTGACGT AAAAAACTAT

451   AAACGCCGCA GCAAAATATG GCTGACTATA TTATTGACTT TGATTTTGTC

501   CTGCGCGGTG ATGGATAAAA TCGCCAGCGA TAAAGATTTG CGAGAACCTG

551   ATGCCGGCCT GTTGTTGAAT ATTTTCGACC TGTATTACGA TTTGGCTTCC

601   .GCGCCGGCA CAATATGCCG CCAAGCGCGC CCACATTTTG GAAGCAGCAA

651   AAAAAGCGTC AACATGGCAT ATCCGTCATG TTGCGCCCAA GTATAA
```

This corresponds to the amino acid sequence <SEQ ID 264; ORF 084.a>:

```
a084.pep
     1   MKQSARIKNM DQTLKNTLGI CALLAFCFGA AIASGYHLEY EYGYRYSAVG

51   ALASVVFLLL LARGFPRVSS VVLLIYVGTT ALYLPVGWLY GAPSYQIVGS

101   ILESNPAEAR EFVGNLPGSL YFVQALFFIF GLTVWRYCVS GGVFADVKNY

151   KRRSKIWLTI LLTLILSCAV MDKIASDKDL REPDAGLLLN IFDLYYDLAS

201   XAGTICRQAR PHFGSSKKSV NMAYPSCCAQ V*
``` m084/a084 92.2% identity over a 231 aa overlap

```
                 10        20        30        40        50        60
m084.pep  MKQSARIKXMNQTLLYTLGICALLTFXXXXXXXXXXYHPEYEYGYRYSAVGALASVVFLLL
          ||||||||| :|||  ||||||||| : |        ||  |||||||||||||||||||
a084      MKQSARIKNMDQTLKNTLGICALLAFCFGAAIASGYHLEYEYGYRYSAVGALASVVFLLL
                 10        20        30        40        50        60

70        80        90       100       110       120
m084.pep  LARGFPRVSSVVLLIYVGTTALYLPVGWLYGAPSYQIVGSILESNPAEAREFVGNLPGSL
          ||||||||||||||||||||||||||||||||||||||||||||||||||||||||||||
a084      LARGFPRVSSVVLLIYVGTTALYLPVGWLYGAPSYQIVGSILESNPAEAREFVGNLPGSL
                 70        80        90       100       110       120

130       140       150       160       170       180
m084.pep  YFVQALFFIFGLTVWKYCVSGGVFADVKNYKRRSKIWLTILLTLILSCAVMDKIASDKDL
          ||||||||||||||| :|||||||||||||||||||||||||||||||||||||||||||
a084      YFVQALFFIFGLTVWRYCVSGGVFADVKNYKRRSKIWLTILLTLILSCAVMDKIASDKDL
                130       140       150       160       170       180

190       200       210       220       230
m084.pep  REPDAGLLLNIFDLYYDLAXRAGTICRQARPHFGSSKKSVNMAYPSCCAQVX
          |||||||||||||||||||| ||||||||||||||||||||||||||||||
a084      REPDAGLLLNIFDLYYDLASXAGTICRQARPHFGSSKKSVNMAYPSCCAQVX
                190       200       210       220       230
```

The following partial DNA sequence was identified in *N. gonorrhoeae* <SEQ ID 265>:

```
g085.seq
    1  ATGGGCAAAG GGCAGGACTT CACGCCCCTG CGCGACGCGT TGAAAGATAA

51  GGCAAAAGGC GTGTTCCTGA TCGGCGTCGA TGCGCCGCAA ATCCGCCGCG

101  ATTTGGACGG CTGCGGCTTG AACCTGACCG ACTGCGTCAC TTTGGAAGAG

151  GCGGTTCAGA CGGCATACGC CCAAGCCGAA GCGGGCGATA TTGTCTTGCT

201  CAGCCCCGCC TGCGCGAGTT TCGATATGTT TAAAGGCTAC GCGCACCGTT

251  CGGAAGTGTT tatCGAAGCG TTTAAGGCTT TGTGA
```

This corresponds to the amino acid sequence <SEQ ID 266; ORF 085.ng>:

```
g085.pep
    1  MGKGQDFTPL RDALKDKAKG VFLIGVDAPQ IRRDLDGCGL NLTDCVTLEE

51  AVQTAYAQAE AGDIVLLSPA CASFDMFKGY AHRSEVFIEA FKAL*
```

The following partial DNA sequence was identified in *N. meningitidis* <SEQ ID 267>:

```
m085.seq
    1  ATGGGTAAAG GGCAGGACTT CACGCCCCTG CGCGATGCAC TGGTAGGCAA

51  GGCAAAAGGC GTGTTCTTGA TTGGTGTCGA TGCGCCGCAA ATCCGCCGCG

101  ATTTGGACGG CTGCGGCTTG AATATGACCG ACTGCGCCAC TTTGGGAGAA

151  GCCGTTCAGA CGGCATATGC CCAAGCCGAA GCAGGCGATA TTGTGTTGCT

201  CAGCCCCGCC TGCGCGAGCT TGATATGTT CAAAGGCTAC GCGCACCGTT

251  CGGAAGTGTT TATCGAAGCG TTTAAGGCTT TGTGA
```

This corresponds to the amino acid sequence <SEQ ID 268; ORF 085>:

```
m085.pep
    1  MGKGQDFTPL RDALVGKAKG VFLIGVDAPQ IRRDLDGCGL NMTDCATLGE

51  AVQTAYAQAE AGDIVLLSPA CASFDMFKGY AHRSEVFIEA FKAL*
```

Computer analysis of this amino acid sequence gave the following results:
Homology with a Predicted ORF from *N. gonorrhoeae*
ORF 085 shows 94.7% identity over a 94 aa overlap with a predicted ORF (ORF 085.ng) from *N. gonorrhoeae*:

```
    m085/g085
                       10        20        30        40        50        60
        m085.pep  MGKGQDFTPLRDALVGKAKGVFLIGVDAPQIRRDLDGCGLNMTDCATLGEAVQTAYAQAE
                  ||||||||||||| |||||||||||||||||||||||||:|||:|| |||||||||||
        g085      MGKGQDFTPLRDALKDKAKGVFLIGVDAPQIRRDLDGCGLNLTDCVTLEEAVQTAYAQAE
                       10        20        30        40        50        60

70        80        90
        m085.pep  AGDIVLLSPACASFDMFKGYAHRSEVFIEAFKALX
                  |||||||||||||||||||||||||||||||||||
        g085      AGDIVLLSPACASFDMFKGYAHRSEVFIEAFKALX
                       70        80        90
```

The following partial DNA sequence was identified in *N. meningitidis* <SEQ ID 269>:

```
a085.seq
    1   ATGGGCAAAG GGCAGGACTT CACGCCCCTG CGCGACGCGC TTGCCGGCAA

51   GGCAAAAGGC GTGTTCCTGA TCGGTGTCGA TGCGCCGCAA ATCCGCCGCG

101   ATTTGGACGG CTGCGATCTG AATATGACCG ACTGCGCCAC TTTGGAAGAA

151   GCGGTTCAGA AGGCATATGC CCAAGCCGAA GCGGGCGATA TCGTGCTGCT

201   CAGCCCCGCC TGCGCGAGTT TCGATATGTT TAAAGGCTAC GCGCACCGTT

251   CGGAAGTGTT TATCGGGGCG TTTAAGGCTT TGTGA
```

This corresponds to the amino acid sequence <SEQ ID 270; ORF 085.a>:

```
a085.pep
    1   MGKGQDFTPL RDALAGKAKG VFLIGVDAPQ IRRDLDGCDL NMTDCATLEE

51   AVQKAYAQAE AGDIVLLSPA CASFDMFKGY AHRSEVFIGA FKAL*
                                                       40
``` m085/a085 94.7% identity over a 94 aa overlap

```
                       10        20        30        40        50        60
        m085.pep  MGKGQDFTPLRDALVGKAKGVFLIGVDAPQIRRDLDGCGLNMTDCATLGEAVQTAYAQAE
                  |||||||||||||:||||||||||||||||||||||| ||||||||||| |||| |||||
        a085      MGKGQDFTPLRDALAGKAKGVFLIGVDAPQIRRDLDGCDLNMTDCATLEEAVQKAYAQAE
                       10        20        30        40        50        60

70        80        90
        m085.pep  AGDIVLLSPACASFDMFKGYAHRSEVFIEAFKALX
                  ||||||||||||||||||||||||||||| |||||
        a085      AGDIVLLSPACASFDMFKGYAHRSEVFIGAFKALX
                       70        80        90
```

The following partial DNA sequence was identified in *N. gonorrhoeae* <SEQ ID 271>:

```
g086.seq
    1   ATGGTGGTGC TGATGACGGC GTTCGGCCTG CTGATGATTT ATTCGGCTTC

51   TGTGTATTTG GCATCGAAGG AAGGCGGCGA TCAGTTTTTC TATTTGACCA

101   GGCAGGCGGG GTTCGTCGTT GCCGGCCTTA TAGCGAGCGG TTTTTTATGG

151   TTTCTTTGCA GGATGAGGAC ATGGCGGCGG CTTGTGCCGT GGATTTTTGC

201   CTTATCCGGC TGTTGCTGG TAGCCGTATT GATTGCCGGG CGCGAAATCA
```

-continued

```
 251  ATGGCGCGAC CCGTTGGATA CCTTTGGGTC CGTTGAATTT CCAGCCGACC

301  GAGCTGTTCA AGCTGGCAGT CATCCTTTAT TTGGCAAGCC TGTTCACGCG

351  CCGTGAAGAA GTGTTGCGCA GCATGGAAAG TTTGGGTTGG CAGTCGATTT

401  GGCGGGGGAC GGCCAACCTG ATTATGTCCG CCACCAATCC GCAGGCACGT

451  CGTGAAACAT TAGAAATGTA CGgcCGTTTC CGGGCGATCA TCCTGCCGAT

501  TATGCTGGTG GCGTTCGGTT TGGTGCTGAT AATGGTACAG CCGGATTTCG

551  GTTCGTTTGT CGTCATTACC GTCATTACCG TTGGAATGCT GTTTCTGGCA

601  GGATTGCCGT GGAAATATTT TTTTGTCCTG GTAGGCAGCG TCTTGGGTGG

651  GATGGTGCTG ATGATTACCG CCGCTCCCTA CCGTGTGCAG CGGGTAGTGG

701  CATTTTTGGA CCCGTGGAAA GACCCGCAGG GTGCCGGCTA CCAGCTTACC

751  CACTCTCTGA TGGCAATCGG GCGCGGAGAG TGGTTCGGTA TGGGTTTGGG

801  TGCGAGTTTG AGCAAACGCG GCTTTCTGCC GGAAGCGCAT ACCGATTTTA

851  TTTTTGCCAT CATCGCTGAA GAATTCGGCT TCTTCGGGAT GTGCGTGCTG

901  ATATTCTGTT ACGGCTGGCT GGTGGTGCGG GCGTTTTCCA TCGGCAAGCA

951  GTCGCGCGAT TTGGGtttgA CTTTCAACGC CTATATCGCT TCGGGTATCG

1001  GCATTTGGAT CGGTATCCAA AGTTTCTTCA ATATCGGTGT GAACATCGGT

1051  GCTTTGCCGA CCAAAGGTCT GACGctgCcg tTGATGTCCT ATGGcggTTC

1101  GTCAGTCTTT TTCATGCTGA TCAGCATGAT GCTGCTGTTG CGTATCGATT

1151  ATGAAAACCG CCAGAAAATG CGCGGTTACC GGGTGGAGTA AA
```

This corresponds to the amino acid sequence <SEQ ID 272; ORF 086.ng>:

```
g086.pep
   1  MVVLMTAFGL LMIYSASVYL ASKEGGDQFF YLTRQAGFVV AGLIASGFLW

51  FLCRMRTWRR LVPWIFALSG LLLVAVLIAG REINGATRWI PLGPLNFQPT

101  ELFKLAVILY LASLFTRREE VLRSMESLGW QSIWRGTANL IMSATNPQAR

151  RETLEMYGRF RAIILPIMLV AFGLVLIMVQ PDFGSFVVIT VITVGMLFLA

201  GLPWKYFFVL VGSVLGGMVL MITAAPYRVQ RVVAFLDPWK DPQGAGYQLT

251  HSLMAIGRGE WFGMGLGASL SKRGFLPEAH TDFIFAIIAE EFGFFGMCVL

301  IFCYGWLVVR AFSIGKQSRD LGLTFNAYIA SGIGIWIGIQ SFFNIGVNIG

351  ALPTKGLTLP LMSYGGSSVF FMLISMMLLL RIDYENRQKM RGYRVE*
```
                                                            50

The following partial DNA sequence was identified in *N. meningitidis* <SEQ ID 273>:

```
m086.seq
   1  ATGGTGGTGC TGATGACGGC GTTCAGCCTG CTGATGATTT ATTCGGCTTC

51  TGTGTATTTG GCATCAAAAG AAGGCGGCGA TCAGTTTTTC TATTTGACCA

101  GACAGGCGGG GTTCGTCGTT GCCGGCTTGA TAGCGAGCGG TTTGTTATGG

151  TTTCTTTGCA GGATGAGGAC ATGGCGGCGG CTTGTGCCGT GGATTTTTGC

201  CCTATCCGGC CTGTTGCTGG TAGTCGTATT GATTGCCGGG CGCGAAATCA

251  ATGGCGCGAC CCGTTGGATA CCTTTGGGTC CGTTGAATTT CCAGCCGACc

301  GAGCTGTTCA AGCtGGCGGT CATCCTTTAT TTGGCAAGCC TGTTCACGCG
```

```
 351  CCGTGAAGAA GTGTTGcGCA GCATGGAAAG TTTGGGTTGG CAGTCGATTT

401  GGCGGGGGAC GGCCAATCTG ATCATGTCCG CCACCAATCC GCAGrCACGT

451  CGTGAaACAT TAGAAATGTA CGGCCGTwTC CGGGCGATCA TCCTGCCGAT

501  TATGCTGGTG GCGTTCGGTT TGGTGCTGAT AATGGTACAG CCGGATTTCG

551  GTTCGTTTGT CGTCATTACC GTCATTGCCG TTGGAATGCT GTTTTTGGCA

601  GGATTGCCGT GGAAATATTT TTTCGTCCTG GTAGGCAGCG TCTTGGGCGG

651  GATGGTGCTG ATGATTACCG CCGCTCCCTA CCGTGTGCAG CGGGTAGTGG

701  CATTTTTGGA CCCGTGGAAA GACCCGCAGG GTGCCGGCTA CCAGCTTACC

751  CACTCTCTGA TGGCAATCGG GCGCGGAGAG TGGTTCGGTA TGGGTTTGGG

801  TGCGAGTTTG AGCAAACGCG GCTTTCTGCC GGAAGCGCAT ACCGATTTTA

851  TTTTTGCCAT CATCGCCGAA GAATTCGGTT TCTTCGGTAT GTGCGTGCTG

901  ATATTCTGTT ACGGCTGGCT GGTGGTGCGG GCGTTTTCCA TCGGCAAGCA

951  GTCGCGCGAT TTGGGTTTGA CTTTCAACGC CTATATCGCT TCGGGTATCG

1001  GCATTTGGAT CGGkrTCCAA AGTTTCTTCA ATATCGGTGT GAACATCGGT

1051  GCTTTGCCGA mCAAAgGyCT GACGCyGCCG Tg.AtGTCCw ATGGCGGTTC

1101  GTCAGTCTTT TTCATGCTGA TCAGCATGAT GCTGCTGTkG CGTATAGATT

1151  ATGAAAACCG CCGGAAAATG CGCGGTTATC GGGTGGAGTA A
```

This corresponds to the amino acid sequence <SEQ ID 274; ORF 086>:

```
m086.pep
  1  MVVLMTAFSL LMIYSASVYL ASKEGGDQFF YLTRQAGFVV AGLIASGLLW

51  FLCRMRTWRR LVPWIFALSG LLLVVVLIAG REINGATRWI PLGPLNFQPT

101  ELFKLAVILY LASLFTRREE VLRSMESLGW QSIWRGTANL IMSATNPQXR

151  RETLEMYGRX RAIILPIMLV AFGLVLIMVQ PDFGSFVVIT VIAVGMLFLA

201  GLPWKYFFVL VGSVLGGMVL MITAAPYRVQ RVVAFLDPWK DPQGAGYQLT

251  HSLMAIGRGE WFGMGLGASL SKRGFLPEAH TDFIFAIIAE EFGFFGMCVL

301  IFCYGWLVVR AFSIGKQSRD LGLTFNAYIA SGIGIWIGXQ SFFNIGVNIG

351  ALPXKGLTXP XMSXGGSSVF FMLISMMLLX RIDYENRRKM RGYRVE*
```

Computer analysis of this amino acid sequence gave the following results:
Homology with a Predicted ORF from *N. gonorrhoeae*
ORF 086 shows 96.7% identity over a 396 aa overlap with a predicted ORF (ORF 086.ng) from *N. gonorrhoeae*:

```
m086/g086
                 10         20         30         40         50         60
m086.pep  MVVLMTAFSLLMIYSASVYLASKEGGDQFFYLTRQAGFVVAGLIASGLLWFLCRMRTWRR
          ||||||||:||||||||||||||||||||||||||||||||||||:|||||||||||||
g086      MVVLMTAFGLLMIYSASVYLASKEGGDQFFYLTRQAGFVVAGLIASGFLWFLCRMRTWRR
                 10         20         30         40         50         60

70         80         90        100        110        120
m086.pep  LVPWIFALSGLLLVVVLIAGREINGATRWIPLGPLNFQPTELFKLAVILYLASLFTRREE
          ||||||||||||:|||||||||||||||||||||||||||||||||||||||||||||||
g086      LVPWIFALSGLLLVAVLIAGREINGATRWIPLGPLNFQPTELFKLAVILYLASLFTRREE
                 70         80         90        100        110        120
```

-continued

```
                    130       140       150       160       170       180
m086.pep    VLRSMESLGWQSIWRGTANLIMSATNPQXRRETLEMYGRXRAIILPIMLVAFGLVLIMVQ
            |||||||||||||||||||||||||||| |||||||||| ||||||||||||||||||||
g086        VLRSMESLGWQSIWRGTANLIMSATNPQARRETLEMYGRFRAIILPIMLVAFGLVLIMVQ
                    130       140       150       160       170       180

190       200       210       220       230       240
m086.pep    PDFGSFVVITVIAVGMLFLAGLPWKYFFVLVGSVLGGMVLMITAAPYRVQRVVAFLDPWK
            ||||||||||||:|||||||||||||||||||||||||||||||||||||||||||||||
g086        PDFGSFVVITVITVGMLFLAGLPWKYFFVLVGSVLGGMVLMITAAPYRVQRVVAFLDPWK
                    190       200       210       220       230       240

250       260       270       280       290       300
m086.pep    DPQGAGYQLTHSLMAIGRGEWFGMGLGASLSKRGFLPEAHTDFIFAIIAEEFGFFGMCVL
            ||||||||||||||||||||||||||||||||||||||||||||||||||||||||||||
g086        DPQGAGYQLTHSLMAIGRGEWFGMGLGASLSKRGFLPEAHTDFIFAIIAEEFGFFGMCVL
                    250       260       270       280       290       300

320       320       330       340        350      360
m086.pep    IFCYGWLVVRAFSIGKQSRDLGLTFNAYIASGIGIWIGXQSFFNIGVNIGALPXKGLTXP
            |||||||||||||||||||||||||||||||||||||| ||||||||||||||:|||| |
g086        IFCYGWLVVRAFSIGKQSRDLGLTFNAYIASGIGIWIGIQSFFNIGVNIGALPTKGLTLP
                    320       320       330       340        350      360

370       380       390
m086.pep    XMSXGGSSVFFMLISMMLLXRIDYENRRKMRGYRVEX
             || ||||||||||||||| |||||||:|||||||||
g086        LMSYGGSSVFFMLISMMLLLRIDYENRQKMRGYRVEX
                    370       380       390
```

The following partial DNA sequence was identified in *N. meningitidis* <SEQ ID 275>:

```
a086.seq
     1  ATGGTGGTGC TGATGACGGC GTTCAGCCTG CTGATGATTT ATTCGGCTTC
    51  TGTGTATTTG GCATCAAAAG AAGGCGGCGA TCAGTTTTTC TATTTGACCA
   101  GACAGGCGGG GTTCGTCGTT GCCGGCTTGA TAGCGAGCGG TTTGTTATGG
   151  TTTCTTTGCA GGATGAGGAC ATGGCGGCGG CTTGTGCCGT GGATTTTTGC
   201  CCTATCCGGC CTGTTGCTGG TAGTCGTATT GATTGCCGGG CGCGAAATCA
   251  ATGGCGCGAC CCGTTGGATA CCTTTGGGTC CGTTGAATTT CCAGCCGACC
   301  GAGCTGTTCA AGCTGGCGGT CATCCTTTAT TTGGCAAGCC TGTTCACGCG
   351  CCGTGAAGAA GTGTTGCGCA GCATGGAAAG TTTGGGTTGG CAGTCGATTT
   401  GGCGGGGGAC GGCCAATCTG ATCATGTCCG CCACCAATCC GCAGGCACGT
   451  CGTGAAACAT TAGAAATGTA CGGCCGTTTC CGGGCGATCA TCCTGCCGAT
   501  TATGCTGGTG GCGTTCGGTT TGGTGCTGAT AATGGTACAG CCGGATTTCG
   551  GTTCGTTTGT CGTCATTACC GTCATTGCCG TTGGAATGCT GTTTTTGGCA
   601  GGATTGCCGT GGAAATATTT TTTCGTCCTG GTAGGCAGCG TCTTGGGCGG
   651  GATGGTGCTG ATGATTACCG CCGCTCCCTA CCGTGTGCAG CGGGTAGTGG
   701  CATTTTTGGA CCCGTGGAAA GACCCGCAGG GTGCCGGCTA CCAGCTTACC
   751  CACTCTCTGA TGGCAATCGG GCGCGGAGAG TGGTTCGGTA TGGGTTTGGG
   801  TGCGAGTTTG AGCAAACGCG GCTTTCTGCC GGAAGCGCAT ACCGATTTTA
   851  TTTTTGCCAT CATCGCCGAA GAATTCGGTT TCTTCGGTAT GTGCGTGCTG
   901  ATATTCTGTT ACGGCTGGCT GGTGGTGCGG GCGTTTTCCA TCGGCAAGCA
   951  GTCGCGCGAT TTGGGTTTGA CTTTCAACGC CTATATCGCT TCGGGTATCG
  1001  GCATTTGGAT CGGTATCCAA AGTTTCTTCA ATATCGGTGT GAACATCGGT
  1051  GCTTTGCCGA CCAAAGGTCT GACGCTGCCG TTGATGTCCT ATGGCGGTTC
  1101  GTCAGTCTTT TTCATGCTGA TCAGCATGAT GCTGCTGTTG CGTATAGATT
  1151  ATGAAAACCG CCGGAAAATG CGCGGTTACC GGGTGGAGTA A
```

This corresponds to the amino acid sequence <SEQ ID 276; ORF 086.a>:

```
a086.pep
     1   MVVLMTAFSL LMIYSASVYL ASKEGGDQFF YLTRQAGFVV AGLIASGLLW

51   FLCRMRTWRR LVPWIFALSG LLLVVVLIAG REINGATRWI PLGPLNFQPT

101   ELFKLAVILY LASLFTRREE VLRSMESLGW QSIWRGTANL IMSATNPQAR

151   RETLEMYGRF RAIILPIMLV AFGLVLIMVQ PDFGSFVVIT VIAVGMLFLA

201   GLPWKYFFVL VGSVLGGMVL MITAAPYRVQ RVVAFLDPWK DPQGAGYQLT

251   HSLMAIGRGE WFGMGLGASL SKRGFLPEAH TDFIFAIIAE EFGFFGMCVL

301   IFCYGWLVVR AFSIGKQSRD LGLTFNAYIA SGIGIWIGIQ SFFNIGVNIG

351   ALPTKGLTLP LMSYGGSSVF FMLISMMLLL RIDYENRRKM RGYRVE*
``` m086/a086 98.0% identity over a 396 aa overlap

```
                   10         20         30         40         50         60
    m086.pep   MVVLMTAFSLLMIYSASVYLASKEGGDQFFYLTRQAGFVVAGLIASGLLWFLCRMRTWRR
               ||||||||||||||||||||||||||||||||||||||||||||||||||||||||||||
    a086       MVVLMTAFSLLMIYSASVYLASKEGGDQFFYLTRQAGFVVAGLIASGLLWFLCRMRTWRR
                   10         20         30         40         50         60

70         80         90        100        110        120
    m086.pep   LVPWIFALSGLLLVVVLIAGREINGATRWIPLGPLNFQPTELFKLAVILYLASLFTRREE
               ||||||||||||||||||||||||||||||||||||||||||||||||||||||||||||
    a086       LVPWIFALSGLLLVVVLIAGREINGATRWIPLGPLNFQPTELFKLAVILYLASLFTRREE
                   70         80         90        100        110        120

130        140        150        160        170        180
    m086.pep   VLRSMESLGWQSIWRGTANLIMSATNPQXRRETLEMYGRXRAIILPIMLVAFGLVLIMVQ
               |||||||||||||||||||||||||||| |||||||||| ||||||||||||||||||||
    a086       VLRSMESLGWQSIWRGTANLIMSATNPQARRETLEMYGRFRAIILPIMLVAFGLVLIMVQ
                  130        140        150        160        170        180

190        200        210        220        230        240
    m086.pep   PDFGSFVVITVIAVGMLFLAGLPWKYFFVLVGSVLGGMVLMITAAPYRVQRVVAFLDPWK
               ||||||||||||||||||||||||||||||||||||||||||||||||||||||||||||
    a086       PDFGSFVVITVIAVGMLFLAGLPWKYFFVLVGSVLGGMVLMITAAPYRVQRVVAFLDPWK
                  190        200        210        220        230        240

250        260        270        280        290        300
    m086.pep   DPQGAGYQLTHSLMAIGRGEWFGMGLGASLSKRGFLPEAHTDFIFAIIAEEFGFFGMCVL
               ||||||||||||||||||||||||||||||||||||||||||||||||||||||||||||
    a086       DPQGAGYQLTHSLMAIGRGEWFGMGLGASLSKRGFLPEAHTDFIFAIIAEEFGFFGMCVL
                  250        260        270        280        290        300

310        320        330        340        350        360
    m086.pep   IFCYGWLVVRAFSIGKQSRDLGLTFNAYIASGIGIWIGXQSFFNIGVNIGALPXKGLTXP
               |||||||||||||||||||||||||||||||||||||| ||||||||||||| :|||| |
    a086       IFCYGWLVVRAFSIGKQSRDLGLTFNAYIASGIGIWIGIQSFFNIGVNIGALPTKGLTLP
                  310        320        330        340        350        360

370        380        390
    m086.pep   XMSXGGSSVFFMLISMMLLXRIDYENRRKMRGYRVEX
                || |||||||||||||||| ||||||||||||||||
    a086       LMSYGGSSVFFMLISMMLLLRIDYENRRKMRGYRVEX
                  370        380        390
```

The following partial DNA sequence was identified in *N. gonorrhoeae* <SEQ ID 277>:

```
g087.seq
     1   ATGGGCGGTA AAACCTTTAT GCTGATGGCG GCGGAACGG GCGGACACAT

51   TTTCCCAGCT CTGGCTGTGG CGGATTCATT GCGCGTGCGC GGTCATCATG

101   TAATTTGGCT GGGCAGCAAG GATTCGATGG AAGAGCGCAT CGTGCCGCAA

151   TACGGCATAC GCTTGGAAAC GCTGGCGATT AAAGGAATAC GCGGCAACGG

201   CATCAAACGC AAGCTGATGC TTCCGTTTAC TCTGTACAAA ACCGTCCGCG

251   AAGCGCAGCG GATTATCCGC AAACACCGTG TCGAGTGCGT CATCGGCTTC

301   GGCGGTTTTG TTACCTTTCC CGGCGGTCTG GCGGCGAAAC TCTTGGGCGT
```

-continued

```
 351   GCCGATTGTG ATTCACGAGC AAAACGCCGT GGCAGGCTTG TCCAACCGCC
 401   AccTGTCGCg ctGGGCGAAA CGGGTGTTGT ACGCTTTTCC GAAAGCGTTC
 451   AGCCACGAAG GCGGTTTGGT CGGCAACCCC GTCCGCGCCG ATATTAGCAA
 501   CCTGCCCGTG CCTGCCGAAC GCTTCCAAGG GCGCGAAGGC CGTCTGAAAA
 551   TTTTGGTGGT CGGCGGCAGT TTGGGTGCGG ACGTTTTGAA CAAAACCGTA
 601   CCGCAGGCGT TGGCACTGCT GCCTGAAGAG GTGCGCCCGC AGATGTACCA
 651   CCAGTCGGGG CGTAACAAGC TGGGCAATCT TCAGGCGGAT TATGACGCGT
 701   TGGGCGTGAA AGCGGAATGC GTGGAATTTA TTACCGACAT GGTGTCCGCC
 751   TACCGTGATG CCGATTTGGT GATTTGCCGT GCCGGCGCGC TGACGATTGC
 801   CGAGTTGACG GCGGCGGGGC TGGGCGCGTT GTTAGTGCCG TATCCTCACG
 851   CCGTTGATGA CCATCAAACC GCCAACGCGC GTTTCATGGT GCAGGCAGAA
 901   GCGGGGCTGC TGTTGCCGCA AACCCAGTTG ACGGCGGAAA AACTCGCCGA
 951   AATCCTCGGC AGCCTCAACC GCGAAAAATG CCTCAAATGG GCGGAAAACG
1001   CCCGTACGTT GGCATTGCCG CACAGCGCGG ATGACGTTGC CGAAGCCGCG
1051   ATTGCGTGTG CGGCGTAAA
```

This corresponds to the amino acid sequence <SEQ ID 278; ORF 087.ng>:

```
g087.pep
   1   MGGKTFMLMA GGTGGHIFPA LAVADSLRVR GHHVIWLGSK DSMEERIVPQ
  51   YGIRLETLAI KGIRGNGIKR KLMLPFTLYK TVREAQRIIR KHRVECVIGF
 101   GGFVTFPGGL AAKLLGVPIV IHEQNAVAGL SNRHLSRWAK RVLYAFPKAF
 151   SHEGGLVGNP VRADISNLPV PAERFQGREG RLKILVVGGS LGADVLNKTV
 201   PQALALLPEE VRPQMYHQSG RNKLGNLQAD YDALGVKAEC VEFITDMVSA
 251   YRDADLVICR AGALTIAELT AAGLGALLVP YPHAVDDHQT ANARFMVQAE
 301   AGLLLPQTQL TAEKLAEILG SLNREKCLKW AENARTLALP HSADDVAEAA
 351   IACAA*
```

The following partial DNA sequence was identified in N. meningitidis <SEQ ID 279>:

```
m087.seq
   1   ATGGGCGGTA AAACCTTTAT GCTGAwkkCG GCGGAACGG GCGGACATAT
  51   TTTCCCCGCG CTGGCGGTGG CGGATTCATT GCGCGCGCGC GGCCATCATG
 101   TGATTTGGCT GGGCAGCAAG GATTCGATGG AAGAGCGTAT CGTGCCGCAA
 151   TACGGCATAC GCTTGGAAAC GCTGGCGATT AAAGGCGTGC GCGGCAACGG
 201   CATCAAACGC AAACTGATGC TGCCGGTTAC TTTGTATCAA ACCGTCCGCG
 251   AAGCGCAGCG GATTATCCGC AAACACCGTG TCGAGTGCGT CATCGGCTTC
 301   GGCGGCTTCG TTACCTTCCC CGGCGGTTTG GCGGCGAAGC TATTArGCGT
 351   GCCGATTGTG ATTCACGAGC AAAACGCCGT GGCAGGTTTG TCCAACCGCC
 401   ACCTGTCGCG CTGGGCGAAG CGGGTGTTGT ACGCTTTTCC GAAAGCGTTC
 451   AGCCACGAAG GCGGCTTGGT CGGCAACCCC GTCCGCGCCG ATATTAGCAA
 501   CCTGCCCGTG CCTGCCGAAC GCTTCCAAGG GCGTGAAGGC CGTCTGAAAA
```

```
 551  TTTTGGTGGT CGGCGGCAGT TTGGGCGCGG ACGTTTTGAA CAAAACCGTA

601  CCGCATGCAT TGGCTTTGCT GCCCGACAAT GCGCGTCCGC ATATGTACCA

651  CCAATCGGGA CGGGGCAAGC TGGGCATCTT GCAGGCGnnn nnnnnnnnnn 701  nnnnnnnnnn nnnnnnnnnn nnnnnnnnnn nnnnnnnnnn nnnnnnnnnn 751  nnnGCGGGAT TGGGTGCGTT GTTAGTGCCG TATCCTCACG CGGTTGACGA

801  TCACCAAACC GCCAACGCGC GTTTTATGGT GCAGGCGGAG GCGGGATTGC

851  TGTTGCCGCA AACCCAGTTG ACGGCGGAAA AACTCGCCGA GATTCTCGGC

901  GGCTTAAACC GCGAAAAATG CCTCAAATGG GCAGAAAACG CCCGTACGTT

951  GGCACTGCCG CACAGTGCGG ACGACGTGGC GGAAGCCGCG ATTGCGTGTG

1001  CGGCGTAA
```

This corresponds to the amino acid sequence <SEQ ID 280; ORF 087>:

```
m087.pep
    1  MGGKTFMLXX GGTGGHIFPA LAVADSLRAR GHHVIWLGSK DSMEERIVPQ

51  YGIRLETLAI KGVRGNGIKR KLMLPVTLYQ TVREAQRIIR KHRVECVIGF

101  GGFVTFPGGL  AAKLLXVPIV IHEQNAVAGL SNRHLSRWAK RVLYAFPKAF

151  SHEGGLVGNP VRADISNLPV PAERFQGREG RLKILVVGGS LGADVLNKTV

201  PHALALLPDN ARPHMYHQSG RGKLGILQAX XXXXXXXXXX XXXXXXXXXX

251  XAGLGALLVP YPHAVDDHQT ANARFMVQAE AGLLLPQTQL TAEKLAEILG

301  GLNREKCLKW AENARTLALP HSADDVAEAA IACAA*
```

Computer analysis of this amino acid sequence gave the following results:
Homology with a Predicted ORF from *N. gonorrhoeae*
ORF 087 shows 83.9% identity over a 355 aa overlap with a predicted ORF (ORF 087.ng) from *N. gonorrhoeae*:

```
   m087/g087
                      10         20         30         40         50         60
       m087.pep  MGGKTFMLXXGGTGGHIFPALAVADSLRARGHHVIWLGSKDSMEERIVPQYGIRLETLAI
                 ||||||||  |||||||||||||||||||| |||||||||||||||||||||||||||||
           g087  MGGKTFMLMAGGTGGHIFPALAVADSLRVRGHHVIWLGSKDSMEERIVPQYGIRLETLAI
                      10         20         30         40         50         60

70         80         90        100        110        120
       m087.pep  KGVRGNGIKRKLMLPVTLYQTVREAQRIIRKHRVECVIGFGGFVTFPGGLAAKLLXVPIV
                 || :||||||||||||| ||| :||||||||||||||||||||||||||||||||  |||
           g087  KGIRGNGIKRKLMLPFTLYKTVREAQRIIRKHRVECVIGFGGFVTFPGGLAAKLLGVPIV
                      70         80         90        100        110        120

130        140        150        160        170        180
       m087.pep  IHEQNAVAGLSNRHLSRWAKRVLYAFPKAFSHEGGLVGNPVRADISNLPVPAERFQGREG
                 ||||||||||||||||||||||||||||||||||||||||||||||||||||||||||||
           g087  IHEQNAVAGLSNRHLSRWAKRVLYAFPKAFSHEGGLVGNPVRADISNLPVPAERFQGREG
                     130        140        150        160        170        180

190        200        210        220        229
       m087.pep  RLKILVVGGSLGADVLNKTVPHALALLPDNARPHMYHQSGRGKLGILQA-----------
                 |||||||||||||||||||||:||||||:::||:||||||:|||||| :|||
           g087  RLKILVVGGSLGADVLNKTVPQALALLPEEVRPQMYHQSGRNKLGNLQADYDALGVKAEC
                     190        200        210        220        230        240

230        240        250
       m087.pep  ----------------------------AGLGALLVPYPHAVDDHQTANARFMVQAE
                                             ||||||||||||||||||||||||||||
           g087  VEFITDMVSAYRDADLVICRAGALTIAELTAAGLGALLVPYPHAVDDHQTANARFMVQAE
                     250        260        270        280        290        300
```

-continued

```
             260       270       280       290       300       310
m087.pep  AGLLLPQTQLTAEKLAEILGGLNREKCLKWAENARTLALPHSADDVAEAAIACAAX
          ||||||||||||||||||||:|||||||||||||||||||||||||||||||||||
g087      AGLLLPQTQLTAEKLAEILGSLNREKCLKWAENARTLALPHSADDVAEAAIACAAX
                    310       320       330       340       350
```

The following partial DNA sequence was identified in *N. meningitidis* <SEQ ID 281>:

```
a087.seq
     1  ATGGGCGGTA AAACCTTTAT GCTGATGGCG GGCGGAACGG GCGGACATAT

51  TTTCCCCGCG CTGGCGGTGG CGGATTCATT GCGCGCGCGC GGCCATCATG

101  TAATTTGGCT GGGCAGCAAG GATTCGATGG AAGAGCGCAT CGTGCCGCAA

151  TACGACATCC TGCTCGAAAC GCTGGCGATT AAAGGCGTGC GCGGCAACGG

201  CATCAAACGC AAGCTGATGC TGCCGTTTAC TTTGTATCAA ACTGTCCGCG

251  AAGCGCAGCA GATTATCCGC AAACACCGTG TCGAGTGCGT CATCGGCTTC

301  GGCGGCTTCG TTACCTTTCC CGGCGGTTTG GCGGCGAAGT TATTAGGCGT

351  GCCGATTGTG ATTCACGAGC AAAACGCCGT GGCAGGTTTG TCCAACCGCC

401  ACCTGTCGCG CTGGGCGAAG CGGGTGTTGT ACGCTTTTCC GAAAGCGTTC

451  AGCCACGAAG GCGGCTTGGT CGGCAACCCC GTCCGCGCCG ATATTAGCAA

501  CCTGCCCGTG CCTGCCGAAC GCTTCCAAGG GCGTGAAGGC CGTCTGAAAA

551  TTTTGGTGGT CGGCGGCAGT TTGGGCGCGG ACGTTTTGAA CAAAACCGTA

601  CCGCAGGCAT TGGCTTTGCT GCCCGACAAT GCGCGTCCGC AGATGTACCA

651  CCAATCGGGA CGGGGCAAGC TGGGCAGCTT GCAGGCGGAT TACGACGCGC

701  TGGGCGTGCA AGCGGAATGC GTGGAATTTA TTACCGATAT GGTGTCCGCC

751  TACCGCGATG CCGATTTGGT GATTTGCCGT GCCGGCGCGC TGACGATTGC

801  CGAGTTGACG GCGGCGGGAT TGGGTGCGTT GTTAGTGCCG TATCCTCACG

851  CCGTTGATGA CCATCAAACC GCCAACGCGC GTTTTATGGT GCAGGCGGAG

901  GCGGGATTGC TGTTGCCGCA AACCCAGTTG ACGGCGGAAA AACTCGCCGA

951  GATTCTCGGC GGCTTAAACC GCGAAAAATG CCTCAAATGG GCAGAAAACG

1001  CCCGTACGTT GGCACTGCCG CACAGTGCGG ACGACGTTGC CGAAGCCGCG

1051  ATTGCGTGTG CGGCGTAA
```

This corresponds to the amino acid sequence <SEQ ID 282; ORF 087.a>:

```
a087.pep
     1  MGGKTFMLMA GGTGGHIFPA LAVADSLRAR GHHVIWLGSK DSMEERIVPQ

51  YDILLETLAI KGVRGNGIKR KLMLPFTLYQ TVREAQQIIR KHRVECVIGF

101  GGFVTFPGGL AAKLLGVPIV IHEQNAVAGL SNRHLSRWAK RVLYAFPKAF

151  SHEGGLVGNP VRADISNLPV PAERFQGREG RLKILVVGGS LGADVLNKTV

201  PQALALLPDN ARPQMYHQSG RGKLGSLQAD YDALGVQAEC VEFITDMVSA

251  YRDADLVICR AGALTIAELT AAGLGALLVP YPHAVDDHQT ANARFMVQAE

301  AGLLLPQTQL TAEKLAEILG GLNREKCLKW AENARTLALP HSADDVAEAA

351  IACAA*
``` m087/a087 85.4% identity over a 355 aa overlap

```
                10         20         30         40         50         60
m087.pep  MGGKTFMLXXGGTGGHIFPALAVADSLRARGHHVIWLGSKDSMEERIVPQYGIRLETLAI
          ||||||||  ||||||||||||||||||||||||||||||||||||||||| ||||||
a087      MGGKTFMLMAGGTGGHIFPALAVADSLRARGHHVIWLGSKDSMEERIVPQYDILLETLAI
                10         20         30         40         50         60

70         80         90        100        110        120
m087.pep  KGVRGNGIKRKLMLPVTLYQTVREAQRIIRKHRVECVIGFGGFVTFPGGLAAKLLXVPIV
          ||||||||||||||| ||||||||||| ||||||||||||||||||||||||||| ||||
a087      KGVRGNGIKRKLMLPFTLYQTVREAQQIIRKHRVECVIGFGGFVTFPGGLAAKLLGVPIV
                70         80         90        100        110        120

130        140        150        160        170        180
m087.pep  IHEQNAVAGLSNRHLSRWAKRVLYAFPKAFSHEGGLVGNPVRADISNLPVPAERFQGREG
          ||||||||||||||||||||||||||||||||||||||||||||||||||||||||||||
a087      IHEQNAVAGLSNRHLSRWAKRVLYAFPKAFSHEGGLVGNPVRADISNLPVPAERFQGREG
               130        140        150        160        170        180

190        200        210        220        230        240
m087.pep  RLKILVVGGSLGADVLNKTVPHALALLPDNARPHMYHQSGRGKLGILQAXXXXXXXXXXX
          ||||||||| ||||||||||||| |||||||||| ||||||||||| | |||
a087      RLKILVVGGCLGADVLNKTVPQALALLPDNARPQMYHQSGRGKLGSLQADYDALGVQAEC
               190        200        210        220        230        240

250        260        270        280
m087.pep  XX-------------------XXXXXXXXXXAGLGALLVPYPHAVDDHQTANARFMVQAE
                              :      : ||||||||||||||||||||||||||||||
a087      VEFITDMVSAYRDADLVICRAGALTIAELTAAGLGALLVPYPHAVDDHQTANARFMVQAE
               250        260        270        280        290        300

290        300        310        320        330
m087.pep  AGLLLPQTQLTAEKLAEILGGLNREKCLKWAENARTLALPHSADDVAEAAIACAAX
          |||||||||||||||||||||||||||||||||||||||||||||||||||||||
a087      AGLLLPQTQLTAEKLAEILGGLNREKCLKWAENARTLALPHSADDVAEAAIACAAX
               310        320        330        340        350
```

The following partial DNA sequence was identified in *N. gonorrhoeae* <SEQ ID 283>:

```
g088.seq
    1  ATGTTTTTAT GGCTCGCACA TTTCAGCAAC TGGTTAACCG GTCTGAATAT
   51  TTTTCAATAC ACCACATTCC GCGCCGTTAT GGCGGCGTTG ACCGCCTTGG
  101  CGTTTTCCCT GATGTTCGGC CCGTGGACGA TACGCAGGCT GACCGCGCTC
  151  AAATGCGGGC AGGCAGTGCG TACCGACGGC CCGCAAACCC ACCTCGTCAA
  201  AAACGGCACG CCGACGATGG GCGGTTCGCT GATTCTGACC GCCATTACCG
  251  TGTCCACCCT GTTGTGGGGC AACTGGGCGA ACCCGTATAT CTGGATTCTC
  301  TTGGGCGTAC TGCTTGCCAC CGGTGCGCTC GGTTTTTACG ACGACTGGCG
  351  CAAAGTCGTT TATAAAGACC CCAACGGCGT GTCCGCCAAA TTCAAAATGG
  401  TGTGGCAGTC AAGCGTTGCC GTTatcgcCG GTttggcaTT GTTTTACctt
  451  gCcgcCAATT CCGCCAACAA TATTTTGATT GTCCCGtttT TCAAACAAAT
  501  CGCCCTGCCG CTGGGCGTGG TCGGCTTttt gGtgttgTCT TACCTGACCA
  551  TCGTCGGCAC ATCCAACGCC GTCAACCTCA CcgaCGGCTT GGACGGCCTT
  601  GCCGCcttcc cgttcgtcct cgttgccgcC GGGCTCGCCA ttttcgccTA
  651  CGTCAGCGGA CACTACCAAT TTTCCCAATA CCTCCAGCTT CCCTATGTCG
  701  CCGGCGCGAA CGAAGTCGCT ATATTCTGCA CCGCCATGTG CGGCGCGTGC
  751  CTCGGATTTT TGTGGTTCAA CGCCTATCCC GCGCAAGTCT TTATGGGCGA
  801  TGTCGGCGCG CTGGCATTGG GTGCCGCGCT CGGTaccGtt gCCGTcaTcg
  851  tCCGCCAAGA ATTTGTcctc gtcattaTGG GCGGTCTGTT cgtcgtagaa
  901  gccgtgTCCG TTATGCTTCa tgtcggCTGG TACAAGAAAA Ccaaaaaacg
  951  CATCTTcCTg acgGcaccga ttcatcacca ttaCCaactt cgatgCTGGa
```

-continued
```
1001  aagaaacgca agtcgtcgtc CGTTtCTGGA TTAtTAccat cgtcgtggtt 1051  tTgataggtt tGagtacccT caAAattcgc ggaaactatg ccgTCCGAAC

1101  ACCTTTCAGA CGGCATTTGA ACGCGCAATA A
```

This corresponds to the amino acid sequence <SEQ ID 284; ORF 088.ng>:

```
g088.pep
  1   MFLWLAHFSN WLTGLNIFQY TTFRAVMAAL TALAFSLMFG PWTIRRLTAL

51   KCGQAVRTDG PQTHLVKNGT PTMGGSLILT AITVSTLLWG NWANPYIWIL

101   LGVLLATGAL GFYDDWRKVV YKDPNGVSAK FKMVWQSSVA VIAGLALFYL

151   AANSANNILI VPFFKQIALP LGVVGFLVLS YLTIVGTSNA VNLTDGLDGL

201   AAFPFVLVAA GLAIFAYVSG HYQFSQYLQL PYVAGANEVA IFCTAMCGAC

251   LGFLWFNAYP AQVFMGDVGA LALGAALGTV AVIVRQEFVL VIMGGLFVVE

301   AVSVMLHVGW YKKTKKRIFL TAPIHHHYQL RCWKETQVVV RFWIITIVVV

351   LIGLSTLKIR GNYAVRTPFR RHLNAQ*
```

The following partial DNA sequence was identified in *N. meningitidis* <SEQ ID 285>:

```
m088.seq
   1  ATGTTTTTAT GGCTCGCACA TTTCAGCAnC TGGTTAACCG GTCTGAATnn 51  nnnnnnnnnn nnnnnnnnnn nnnnnnnnnn nnnnnnnnnn nnnnnnnnnn 101  nnnnnnnnnn nnnnnnnnnn nnnnnnnnnn nnnnnnnnnn nnnnnnnnnn 151  nnnnnnnnnn nnnnnnnnnn nnnnnnnnnn nnnnnnnnnn nnnnnnnnnn 201  nnnnnnnnnn nnnnnnnnnn nnnnnnnnnn nnnnnnnnnn nnnnnnnnnn 251  nnnnnnnnnn nnnnnnnnnn nnnnnnnnnn nnnnnnnnnn nnnnnnnnnn 301  nnnnnnnnnn nnnnnnnnnn nnnnnnnnnn nnnnnnnnnn nnnnnnnnnn 351  nnnnnnnnnn nnnnnnnnnn nnnnnnnnnn nnnnnnnnnn nnnnnnnnnn 401  nnnnnnnnnn nnnnnnnnnn nnnnnnnnnn nnnnnnnnnn nnnnnnnnnn 451  nnnnnnnnnn nnnnnnnnnn nnnnnnnnnn nnnnnnnnnn nnnnnnnnnn 501  nnnnnnnnnn nnnGGCGTGG TCGGCTTTTT GGTGTTGTCT TACCTGACCA

551  TCGTCGGCAC ATCCAATGCC GTCAACCTCA CCGACGGCTT GGACGGCCTT

601  GCGACCTTCC CCGTCGTCCT CGTTGCCGCC GGCCTCGCCA TCTTCGCCTA

651  TGCCAGCGGC CACTCACAAT TTGCCCAATA CCTGCAATTA CCTTACGTTG

701  CCGGCGCAAA CGAAGTGGTG ATTTTCTGTA CCGCCATGTG CGGCGCGTGC

751  CTCGGTTTCT TGTGGTTTAA CGCCTATCCC GCGCAAGTCT TTATGGGCGA

801  TGTCGGTGCA TTGGCATTGG GTGCCGCGCT CGGTACCGTC GCCGTTATCG

851  TCCGCCAAGA GTTTGTCCTC GTCATTATGG GCGGATTATT TGTCGTAGAA

901  GCCGTATCCG TTATGCTTCA GGTTGGCTGG TATAAGAAAA CCAAAAAACG

951  CATCTTCCTG ATGGCGCCCA TCCATCACCA CTACGAACAA AAAGGCTGGA

1001  AAGAAACCCA AGTCGTCGTC CGCTTTTGGA TTATTACCAT CGTCTTGGTG

1051  TTGATCGGTT TGAGTACCCT CAAAATCCGC TGAACCTATG CCGTCTGAAC

1101  ATCTTTCAGA CGGCATTTGA ACGCGCAATA A
```

-continued
```
  1  MFLWLAHFSN WLTGLNIFQY TTFRAVMAAL TALAFSLMFG PWTIRRLTAL

51  KCGQAVRTDG PQTHLVKNGT PTMGGSLILT AITVSTLLWG NWANPYIWIL

101  LGVLLATGAL GFYDDWRKVV YKDPNGVSAK FKMVWQSSVA VIAGLALFYL

151  AANSANNILI VPFFKQIALP LGVVGFLVLS YLTIVGTSNA VNLTDGLDGL

201  AAFPFVLVAA GLAIFAYVSG HYQFSQYLQL PYVAGANEVA IFCTAMCGAC

251  LGFLWFNAYP AQVFMGDVGA LALGAALGTV AVIRQEFVL VIMGGLFVVE

301  AVSVMLHVGW YKKTKKRIFL TAPIHHHYQL RCWKETQVVV RFWIITIVVV

351  LIGLSTLKIR GNYAVRTPFR RHLNAQ*
```

This corresponds to the amino acid sequence <SEQ ID 286; ORF 088>:

```
m088.pep
  1  MFLWLAHFSX WLTGLNXXXX XXXXXXXXXX XXXXXXXXXX XXXXXXXXXX

51  XXXXXXXXXX XXXXXXXXXX XXXXXXXXXX XXXXXXXXXX XXXXXXXXXX

101  XXXXXXXXXX XXXXXXXXXX XXXXXXXXXX XXXXXXXXXX XXXXXXXXXX

151  XXXXXXXXXX XXXXXXXXXX XGVVGFLVLS YLTIVGTSNA VNLTDGLDGL

201  ATFPVVLVAA GLAIFAYASG HSQFAQYLQL PYVAGANEVV IFCTAMCGAC

251  LGFLWFNAYP AQVFMGDVGA LALGAALGTV AVIRQEFVL VIMGGLFVVE

301  AVSVMLQVGW YKKTKKRIFL MAPIHHHYEQ KGWKETQVVV RFWIITIVLV

351  LIGLSTLKIR XTYAVXTSFR RHLNAQ*
```

Computer analysis of this amino acid sequence gave the following results:
Homology with a Predicted ORF from *N. gonorrhoeae*
ORF 088 shows 91.7% identity over a 205 aa overlap with a predicted ORF (ORF 088.ng) from *N. gonorrhoeae*:

```
m088/g088
                              10         20         30
  m088.pep             GVVGFLVLSYLTIVGTSNAVNLTDGLDGLA
                       ||||||||||||||||||||||||||||||
  g088      IAGLALFYLAANSANNILIVPFFKQIALPLGVVGFLVLSYLTIVGTSNAVNLTDGLDGLA
                150       160       170       180       190       200

40         50         60         70         80         90
  m088.pep    TFPVVLVAAGLAIFAYASGHSQFAQYLQLPYVAGANEVVIFCTAMCGACLGFLWFNAYPA
              :||  ||||||||||||:|||  ||:||||||||||||||:|||||||||||||||||||
  g088        AFPFVLVAAGLAIFAYVSGHYQFSQYLQLPYVAGANEVAIFCTAMCGACLGFLWFNAYPA
                210       220       230       240       250       260

100        110        120        130        140        150
  m088.pep    QVFMGDVGALALGAALGTVAVIRQEFVLVIMGGLFVVEAVSVMLQVGWYKKTKKRIFLM
              ||||||||||||||||||||||||||||||||||||||||||||:|||||||||||||:
  g088        QVFMGDVGALALGAALGTVAVIRQEFVLVIMGGLFVVEAVSVMLHVGWYKKTKKRIFLT
                270       280       290       300       310       320

160        170        180        190        200
  m088.pep    APIHHHYEQKGWKETQVVVRFWIITIVLVLIGLSTLKIRXTYAVXTSFRRHLNAQX
              ||||||:  :|||||||||||||||||:|||||||||||  :||| |||||||||||
  g088        APIHHHYQLRCWKETQVVVRFWIITIVVVLIGLSTLKIRGNYAVRTPFRRHLNAQX
                330       340       350       360       370
```

The following partial DNA sequence was identified in *N. meningitidis* <SEQ ID 287>:

```
a088.seq
  1  ATGTTTTTAT GGCTCGCACA TTTCAGCAAC TGGTTAACCG GTCTGAATAT

51  TTTTCAATAC ACCACATTCC GCGCCGTCAT GGCGGCGTTG ACCGCCTTGG
```

```
 101  CGTTTTCCCT GATGTTCGGC CGTGGACGA TACGCAGGCT GACCGCGCTC

151  AAATGCGGGC AGGCAGTGCG TACCGACGGT CCGCAAACCC ACCTCGTCAA

201  AAACGGCACG CCGACGATGG GCGGTTCGCT GATTCTGACC GCCATTACCG

251  TGTCCACCCT GTTGTGGGGC AACTGGGCAA ACCCGTATAT CTGGATTCTC

301  TTGGGCGTAT TGCTCGCCAC GGGCGCACTC GGTTTTTACG ACGACTGGCG

351  CAAAGTCGTC TATAAAGACC CCAACGGCGT GTCCGCCAAA TTCAAAATGG

401  TGTGGCAGTC AAGCGTTGCC ATTATCGCCG GTTTGGCATT GTTTTACCTT

451  GCCGCCAATT CCGCCAACAA TATTTTGATT GTCCCGTTCT TCAAACAAAT

501  CGCCCTGCCG CTGGGCGTGG TCGGCTTTTT GGTGTTGTCT TACCTGACCA

551  TCGTCGGCAC ATCCAATGCC GTCAACCTCA CCGACGGCTT GGACGGCCTT

601  GCGACCTTCC CCGTCGTCCT CGTTGCCGCC GGCCTCGCCA TCTTCGCCTA

651  TGCCAGCGGC CACTCACAAT TTGCCCAATA CCTGCAATTA CCTTACGTTG

701  CCGGCGCAAA CGAAGTGGTG ATTTTCTGTA CCGCCATGTG CGGCGCGTGC

751  CTCGGTTTCT TGTGGTTTAA CGCCTATCCC GCGCAAGTCT TTATGGGCGA

801  TGTCGGTGCA TTGGCATTGG GTGCCGCGCT CGGTACCGTC GCCGTCATCG

851  TCCGCCAAGA GTTTGTCCTC GTCATTATGG GCGGATTATT TGTCGTAGAA

901  GCCGTATCCG TTATGCTTCA GGTCGGCTGG TATAAGAAAA CCAAAAAACG

951  CATCTTCCTG ATGGCGCCCA TCATCACCA CTACGAACAA AAAGGCTGGA

1001  AAGAAACCCA AGTCGTCGTC CGCTTTTGGA TTATTACCAT CGTCTTGGTG

1051  TTGATCGGTT TGAGTACCCT CAAAATCCGC TGAACCTATG CCGTCTGAAC

1101  ACCTTTCAGA CGGCATTTGA ACGCGCAATA A
                                                              35
```

This corresponds to the amino acid sequence <SEQ ID 288; ORF 088.a>:

```
a088.pep
   1  MFLWLAHFSN WLTGLNIFQY TTFRAVMAAL TALAFSLMFG PWTIRRLTAL

51  KCGQAVRTDG PQTHLVKNGT PTMGGSLILT AITVSTLLWG NWANPYIWIL

101  LGVLLATGAL GFYDDWRKVV YKDPNGVSAK FKMVWQSSVA IIAGLALFYL

151  AANSANNILI VPFFKQIALP LGVVGFLVLS YLTIVGTSNA VNLTDGLDGL

201  ATFPVVLVAA GLAIFAYASG HSQFAQYLQL PYVAGANEVV IFCTAMCGAC

251  LGFLWFNAYP AQVFMGDVGA LALGAALGTV AVIVRQEFVL VIMGGLFVVE

301  AVSVMLQVGW YKKTKKRIFL MAPIHHHYEQ KGWKETQVVV RFWIITIVLV

351  LIGLSTLKIR *TYAV*TPFR RHLNAQ*
``` m088/a088 99.5% identity over a 205 aa overlap

```
                  150        160        170        180        190        200
    m088.pep  XXXXXXXXXXXXXXXXXXXXXXXXXXXXXGVVGFLVLSYLTIVGTSNAVNLTDGLDGLA
                                           |||||||||||||||||||||||||||||
        a088  IAGLALFYLAANSANNILIVPFFKQIALPLGVVGFLVLSYLTIVGTSNAVNLTDGLDGLA
                  150        160        170        180        190        200

210        220        230        240        250        260
    m088.pep  TFPVVLVAAGLAIFAYASGHSQFAQYLQLPYVAGANEVVIFCTAMCGACLGFLWFNAYPA
              ||||||||||||||||||||||||||||||||||||||||||||||||||||||||||||
        a088  TFPVVLVAAGLAIFAYASGHSQFAQYLQLPYVAGANEVVIFCTAMCGACLGFLWFNAYPA
                  210        220        230        240        250        260
```

```
               270        280        290        300        310        320
m088.pep   QVFMGDVGALALGAALGTVAVIVRQEFVLVIMGGLFVVEAVSVMLQVGWYKKTKKRIFLM
           ||||||||||||||||||||||||||||||||||||||||||||||||||||||||||||
a088       QVFMGDVGALALGAALGTVAVIVRQEFVLVIMGGLFVVEAVSVMLQVGWYKKTKKRIFLM
               270        280        290        300        310        320

330        340        350        360        370
m088.pep   APIHHHYEQKGWKETQVVVRFWIITIVLVLIGLSTLKIRXTYAVXTSFRRHLNAQX
           |||||||||||||||||||||||||||||||||||||||||||| |||||||||||
a088       APIHHHYEQKGWKETQVVVRFWIITIVLVLIGLSTLKIRXTYAVXTPFRRHLNAQX
               330        340        350        360        370
```

The following partial DNA sequence was identified in *N. gonorrhoeae* <SEQ ID 289>:

```
g089.seq
     1    ATGCCGCCCA AAATCACGAA GAGCGGGTTT TGCAAACCGG CAATCGCGGC

51    GGCGGTCGCG CCGACATTCG TGCCTTTGCT GTCGTCGATG AATACCACGC

101    CGTTTTTCTC GCCGATTTTT TCCACACGGT GCGGCAAGCC TTGGAAGGTT

151    TTGACGTGTT CCAGCAATGC TTCGCGCGGC AAACCGACGG CCTCGCACAA

201    AGCCACGGCA GCCATAACGT TGGCGGCGTT GTGCAAACCT TGCAGCGGGA

251    TGTCTTGCGT AGAAATCAAA TCTTCATTGC CTTGTTTTAA ACAGCCCGTC

301    CCGCGTTCCA ACCAAAAATC GGCTTCGTGT TCCAAGGAAA ACCGTTTCAC

351    TTCACGCCCT GCCCGTTTCA TGGCGCGGCA GAACACGTCG TCCGCATTCA

401    AAACCTGCAC TCCATCGCCA CGGAAAATCT CGGCTTTGGT ATGCGCGTAG
```

This corresponds to the amino acid sequence <SEQ ID 290; ORF 089.ng>:

```
g089.pep
     1    MPPKITKSGF CKPAIAAAVA PTFVPLLSSM NTTPFFSPIF STRCGKPWKV

51    LTCSSNASRG KPTASHKATA AITLAALCKP CSGMSCVEIK SSLPCFKQPV

101    PRSNQKSASC SKENRFTSRP ARFMARQNTS SAFKTCTPSP RKISALVCA*
```

The following partial DNA sequence was identified in *N. meningitidis* <SEQ ID 291>:

```
m089.seq
     1    ATGCCGCCCA AAATCACkAw GAGCGGATTT TGCAAACCGG CAATCGCGGC

51    GGCAGTCGCG CCGACATTCG TGCCTTTGCT GTCGTCGATA AACACCACGC

101    CGTTTTTCTC GCCGATTTTT TCCACGCGGT GCGGCAGGCC TTGGAAGGTT

151    TTGACGTGTT CGAGCAATGC TTCGCGCGAC AAACCGATGG CCTCACACAA

201    AGCCACkGCA GCCATGACGT TAGCGGCGTT GTGCAkACCT TGCAACGGwA

251    TGTCTTGCGT GACAATCAAA TCTTCATTGC CTTGTTTCAG GCGGCCTGTC

301    TCGCGTTCCA ACCAGAAATC AGCTTCGTGT TCCAACGAAA ACCATTTTAC

351    CTCGCGCCCG GCACGCTTCA TCGCGCGGCA GAACGCATCG TCCGCATTCA

401    AAACCTGCAC GCCGTCGCCA CGGAAAATCT TGGCTTTGGT ATGCGCATAG
```

This corresponds to the amino acid sequence <SEQ ID 292; ORF 089>:

```
m089.pep
    1    MPPKITXSGF CKPAIAAAVA PTFVPLLSSI NTTPFFSPIF STRCGRPWKV

51    LTCSSNASRD KPMASHKATA AMTLAALCXP CNGMSCVTIK SSLPCFRRPV

101    SRSNQKSASC SNENHFTSRP ARFIARQNAS SAFKTCTPSP RKILALVCA*
```

Computer analysis of this amino acid sequence gave the following results:
Homology with a Predicted ORF from *N. gonorrhoeae*
ORF 089 shows 88.6% identity over a 149 aa overlap with a predicted ORF (ORF 089.ng) from *N. gonorrhoeae*:

```
    m089/g089
                      10         20         30         40         50         60
    m089.pep   MPPKITXSGFCKPAIAAAVAPTFVPLLSSINTTPFFSPIFSTRCGRPWKVLTCSSNASRD
               ||||| ||||||||||||||||||||||:||||||||||||||||:||||||||||||
    g089       MPPKITKSGFCKPAIAAAVAPTFVPLLSSMNTTPFFSPIFSTRCGKPWKVLTCSSNASRG
                      10         20         30         40         50         60
                      70         80         90        100        110        120
    m089.pep   KPMASHKATAAMTLAALCXPCNGMSCVTIKSSLPCFRRPVSRSNQKSASCSNENHFTSRP
               || |||||||:||||||  ||:||||| ||||||||::|| |||||||||:||:|||||
    g089       KPTASHKATAAITLAALCKPCSGMSCVEIKSSLPCFKQPVPRSNQKSASCSKENRFTSRP
                      70         80         90        100        110        120
                     130        140        150
    m089.pep   ARFIARQNASSAFKTCTPSPRKILALVCAX
               |||:||||:|||||||||||||||||||
    g089       ARFMARQNTSSAFKTCTPSPRKISALVCAX
                     130        140        150
```

The following partial DNA sequence was identified in *N. meningitidis* <SEQ ID 293>:

```
a089.seq
    1    ATGCCGCCTA AAATCACGAA GAGCGGATTT TGCAAACCGG CAATCGCGGC

51    GGCGGTCGCA CCGACGTTCG TGCCTTTGCT GTCGTCGATG AACACCACGC

101    CATTTTTCTC GCCGATTTTT TCCACGCGGT GCGGCAGGCC TTGAAAGGTT

151    TTGACGTGTT CGAGCAATGC TTCGCGCGGC AAACCGACGG CTTCGCACAA

201    GGCAACGGCA GCCATCACGT TAGTGGCGTT GTGCAAGCCT TGCAGCGGAA

251    TATCTTGCGT GGCAATCAAA TCTTCATTGC CTTGTTTCAG GCGACCTGTC

301    TCACGTTCCA ACCAAAAATC GGCTTCGTAT CCAACGAAA ACCATTTCAC

351    CTCGCGCCCG GCGCGCTTCA TCGCACGACA GAACGCATCG TCCGCATTCA

401    AAACCTGCAC ACCGTCGCCA CGGAAAATCT TGGCTTTGGT ATGCGCGTAG
```

This corresponds to the amino acid sequence <SEQ ID 294; ORF 089.a>:

```
a089.pep
    1    MPPKITKSGF CKPAIAAAVA PTFVPLLSSM NTTPFFSPIF STRCGRP*KV

51    LTCSSNASRG KPTASHKATA AITLVALCKP CSGISCVAIK SSLPCFRRPV

101    SRSNQKSASY SNENHFTSRP ARFIARQNAS SAFKTCTPSP RKILALVCA*
``` m089/a089 91.9% identity over a 149 aa overlap

```
                      10         20         30         40         50         60
    m089.pep   MPPKITXSGFCKPAIAAAVAPTFVPLLSSINTTPFFSPIFSTRCGRPWKVLTCSSNASRD
               ||||| ||||||||||||||||||||||:|||||||||||||||| ||||||||||||
    a089       MPPKITKSGFCKPAIAAAVAPTFVPLLSSMNTTPFFSPIFSTRCGRPXKVLTCSSNASRG
                      10         20         30         40         50         60
```

-continued

```
              70         80         90        100        110        120
m089.pep  KPMASHKATAAMTLAALCXPCNGMSCVTIKSSLPCFRRPVSRSNQKSASCSNENHFTSRP
          ||  ||||||||| ||:||| ||:: ||| :||||||||||||||||||| ||||||||
a089      KPTASHKATAAITLVALCKPCSGISCVAIKSSLPCFRRPVSRSNQKSASYSNENHFTSRP
              70         80         90        100        110        120

130        140        150
m089.pep  ARFIARQNASSAFKTCTPSPRKILALVCAX
          |||||||||||||||||||||||||||||
a089      ARFIARQNASSAFKTCTPSPRKILALVCAX
             130        140        150
```

The following partial DNA sequence was identified in *N. gonorrhoeae* <SEQ ID 295>:

```
g090.seq
    1   ATGCGCGTAG TCGAGCAAAT CGTCGTAGCG GTCGAGATGG TCTTCGGAAA

51   TGTTCATCAC CGTCGCCGCA GTCGGGCGCA GGCTTTCGGT GTTTTCCAGT

101   TGGAAGCTGG AAAGCTCcca CACCCACACG TCCGCCTTTT TGCCTTCgcg 151   ctgCAATtct gcctccaaga cgggcgtacc gatATTGCCC GCAATGAcgg 201   tatccagccc gcacttgatg CAGAGatagc ggaccaggct ggttaccgTG 251   GTTttgccgt tgctgCcggt aatcgCaatc accttgtcgC CGCGGCGGtt 301   cAcaaTGTCc gccaGCAATt ggATGTCGCC TAgCACGCGC .ccgccgTTT 351   TGCttga
```

This corresponds to the amino acid sequence <SEQ ID 296; ORF 090.ng>:

```
g090.pep
    1   MRVVEQIVVA VEMVFGNVHH RRRSRAQAFG VFQLEAGKLP HPHVRLFAFA

51   LQFCLQDGRT DIARNDGIQP ALDAEIADQA GYRGFAVAAG NRNHLVAAAV

101   HNVRQQLDVA XHAXRRFA*
```

The following partial DNA sequence was identified in *N. meningitidis* <SEQ ID 297>:

```
m090.seq
    1   ATGCGCATAG TCGAGCAAGT CGTCGTAGCG GTCGAGATGG TCTTCGGAAA

51   TGTTCAGCAC CGTCGCCGCA GTCGGACGCA GGCTTTCGGT GTTTTCCAGT

101   TGGAAGCTGG AAAGCTCCAA CACCCACACG TCCGCCTTTT TGCCTTCGCG

151   CTGCCATTCC GCCTCCAAAA CCGGCGTGCC GATATTGCCC GCGATAACGG

201   TATCCAGCCC GCACTTGATA CAGAGATAGC CGACCAGGCT CGTTACCGTG

251   GTTTTGCCGT TGCTGCCGGT AATCGCAATT ACCTTGTCGT CCCGGCGGTT

301   CACAATGTCC GCCAGCAATT CGATGTCGCC CAACACGCGT .CCGCCGTTT

351   TGCTTGA
```

This corresponds to the amino acid sequence <SEQ ID 298; ORF 090>:

```
m090.pep
    1   MRIVEQVVVA VEMVFGNVQH RRRSRTQAFG VFQLEAGKLQ HPHVRLFAFA

51   LPFRLQNRRA DIARDNGIQP ALDTEIADQA RYRGFAVAAG NRNYLVVPAV

101   HNVRQQFDVA QHAXRRFA*
```

Computer analysis of this amino acid sequence gave the following results:
Homology with a Predicted ORF from N. gonorrhoeae
ORF 090 shows 83.9% identity over a 118 aa overlap with a predicted ORF (ORF 090.ng) from N. gonorrhoeae:

```
m090/g090
                    10        20        30        40        50        60
    m090.pep  MRIVEQVVVAVEMVFGNVQHRRRSRTQAFGVFQLEAGKLQHPHVRLFAFALPFRLQNRRA
              ||:|||:||||||||||:||||||:||||||||||| ||||||||||| | ||: |:
    g090      MRVVEQIVVAVEMVFGNVHHRRRSRAQAFGVFQLEAGKLPHPVRLFAFALQFCLQDGRT
                    10        20        30        40        50        60

70        80        90       100       110     119
    m090.pep  DIARDNGIQPALDTEIADQARYRGFAVAAGNRNYLVVPAVHNVRQQFDVAQHAXRRFAX
              ||||::|||||:||||| |||||||||||||||:||: ||||||||:|||  ||||||
    g090      DIARNDGIQPALDAEIADQAGYRGFAVAAGNRNHLVAAAVHNVRQQLDVAXHAXRRFAX
                    70        80        90       100       110
```

The following partial DNA sequence was identified in N. meningitidis <SEQ ID 299>:

```
a090.seq
     1  ATGCGCGTAG TCGAGCAAGT CGTCGTAGCG GTCGAGATGG TCTTCGGAAA

51  TGTTCAGCAC TGTCGCCGCA GTCGGGCGCA GGCTTTCGGT GTTTTCCAGT

101  TGGAAACTGG AAAGCTCCAA CACCCACACG TCCGCCTTTT TGCCTTCGCG

151  CTGCAATTCC GCCTCCAAAA CCGGCGCGCC GATATTGCCC GCGATAACGG

201  TATCCAGCCC ACACTTGATG CAGAGATAGC CGACCAGGCT CGTTACCGTG

251  GTTTTGCCGT TGCTGCCGGT AATCGCAATC ACCTTGTCGC CGCGGCGGTT

301  CACAATGTCC GCCAGCAATT CGATGTCGCC CAACACGCGT C.CGCCGTTT

351  CGCTTAA
```

This corresponds to the amino acid sequence <SEQ ID 300; ORF 090.a>:

```
a090.pep
     1  MRVVEQVVVA VEMVFGNVQH CRRSRAQAFG VFQLETGKLQ HPHVRLFAFA

51  LQFRLQNRRA DIARDNGIQP TLDAEIADQA RYRGFAVAAG NRNHLVAAAV

101  HNVRQQFDVA QHAXRRFA*
``` m09/a090 91.5% identity over a 117 aa overlap

```
                    10        20        30        40        50        60
    m090.pep  MRIVEQVVVAVEMVFGNVQHRRRSRTQAFGVFQLEAGKLQHPHVRLFAFALPFRLQNRRA
              ||:|||||||||||||||||  ||||:|||||||||:||||||||||||||  |||||||
    a090      MRVVEQVVVAVEMVFGNVQHCRRSRAQAFGVFQLETGKLQHPHVRLFAFALQFRLQNRRA
                    10        20        30        40        50        60

70        80        90       100       110     119
    m090.pep  DIARDNGIQPALDTEIADQARYRGFAVAAGNRNYLVVPAVHNVRQQFDVAQHAXRRFAX
              ||||||||||:|:|||||||||||||||||||:||: ||||||||||||||||||||||
    a090      DIARDNGIQPTLDAEIADQARYRGFAVAAGNRNHLVAAAVHNVRQQFDVAQHAXRRFAX
                    70        80        90       100       110
```

The following partial DNA sequence was identified in N. gonorrhoeae
g090-1.seq This sequence contains multiple stop codons (not shown)

This corresponds to the amino acid sequence <ORF 090-1.ng>:
g090-1.pep (not shown)
The following partial DNA sequence was identified in *N. meningitidis* <SEQ ID 2>:
m090-1.seq

```
m090-1.seq
   1    ATGACGGCGT TTGCATTTCA GACGGCATCA CAAAGCCTTA AACGCTTCGA
  51    TAAACACTTC CGAACGGTGC GCGTAGCCTT TGAACATATC AAAGCTCGCG
 101    CAGGCGGGGC TGAGCAACAC AATATCGCCT GCTTCGGCTT GGGCATATGC
 151    CGTCTGAACG GCTTCTCCCA AAGTGGCGCA GTCGGTCATA TTCAAGCCGC
 201    AGCCGTCCAA ATCGCGGCGG ATTTGCGGCG CATCGACACC AATCAAGAAC
 251    ACGCCTTTTG CCTTGCCTAC CAGTGCATCG CGCAGGGGCG TGAAGTCCTG
 301    CCCTTTACCC ATGCCGCCCA AAATCACGAA GAGCGGATTT GCAAACCGG
 351    CAATCGCGGC GGCAGTCGCG CCGACATTCG TGCCTTTGCT GTCGTCGATA
 401    AACACCACGC CGTTTTTCTC GCCGATTTTT TCCACGCGGT GCGGCAGGCC
 451    TTGGAAGGTT TTGACGTGTT CGAGCAATGC TTCGCGCGAC AAACCGATGG
 501    CCTCACACAA AGCCACGGCA GCCATGACGT TAGCGGCGTT GTGCAGACCT
 551    TGCAACGGAA TGTCTTGCGT GACAATCAAA TCTTCATTGC CTTGTTTCAG
 601    GCGGCCTGTC TCGCGTTCCA ACCAGAAATC AGCTTCGTGT TCCAACGAAA
 651    ACCATTTTAC CTCGCGCCCG GCACGCTTCA TCGCGCGGCA GAACGCATCG
 701    TCCGCATTCA AAACCTGCAC GCCGTCGCCA CGGAAAATCT TGGCTTTGGT
 751    ATGCGCATAG TCGAGCAAGT CGTCGTAGCG GTCGAGATGG TCTTCGGAAA
 801    TGTTCAGCAC CGTCGCCGCA GTCGGACGCA GGCTTTCGGT GTTTTCCAGT
 851    TGGAAGCTGG AAAGCTCCAA CACCCACACG TCCGCCTTTT TGCCTTCGCG
 901    CTGCCATTCC GCCTCCAAAA CCGGCGTGCC GATATTGCCC GCGATAACGG
 951    TATCCAGCCC GCACTTGATA CAGAGATAGC CGACCAGGCT CGTTACCGTG
1001    GTTTTGCCGT TGCTGCCGGT AATCGCAATT ACCTTGTCGT CCCGGCGGTT
1051    CACAATGTCC GCCAGCAATT CGATGTCGCC CAACACGCGT CCGCCGTTTT
1101    GCTTGAACGC CTCAATATCC GGCTGCCGCT CGCTGATGCC GGGACTGAGA
1151    GCCAGAATAT CGAAACCGTT GTCCAGCGCA TCTTTCAGAC GGCCCGTGTA
1201    AAACACCAAC CCGTCAAACA TCTTACCGAT TGCGACACG CGTTCCGGCT
1251    TCAGCTCCGC ATCATACGCA GCAACCTCCG CGCCGTTTTT GCGCAGGTAG
1301    GCAATCATGG AAATACCCGT ACCGCCGAGT CCGGCGACGA GGATTTTTTT
1351    GTTTTGAAAA GTCATTTTGG TTTGTCCTAA
```

This corresponds to the amino acid sequence <SEQ ID 3; ORF 090-1>:

```
m090-1.pep
   1    MTAFAFQTAS QSLKRFDKHF RTVRVAFEHI KARAGGAEQH NIACFGLGIC
  51    RLNGFSQSGA VGHIQAAAVQ IAADLRRIDT NQEHAFCLAY QCIAQGREVL
 101    PFTHAAQNHE ERILQTGNRG GSRADIRAFA VVDKHHAVFL ADFFHAVRQA
 151    LEGFDVFEQC FARQTDGLTQ SHGSHDVSGV VQTLQRNVLR DNQIFIALFQ
 201    AACLAFQPEI SFVFQRKPFY LAPGTLHRAA ERIVRIQNLH AVATENLGFG
```

```
251  MRIVEQVVVA VEMVFGNVQH RRRSRTQAFG VFQLEAGKLQ HPHVRLFAFA

301  LPFRLQNRRA DIARDNGIQP ALDTEIADQA RYRGFAVAAG NRNYLVVPAV

351  HNVRQQFDVA QHASAVLLER LNIRLPLADA GTESQNIETV VQRIFQTARV

401  KHQPVKHLTD LRHAFRLQLR IIRSNLRAVF AQVGNHGNTR TAESGDEDFF

451  VLKSHFGLS*
```

The following partial DNA sequence was identified in *N. gonorrhoeae* <SEQ ID 303>:

```
g091.seq
    1  ATGGAAATAC CCGTGCCGCC AAGTCCGGCG ACGAGGATTT TTTTGTTTGA

51  AAGTCATTTT GGTTTTGTCC TAAAACAAAT CATATTGGGC AGGAGACGTC

101  CGCCCTTGCC CAAGCCGCTT TCAGACGGCA TCGCGAGCCG ATTAATAACC

151  CGCCTTCAGG CGTTGGTCAT TGTCGCAGCT GTTTTGGTCT CCGTTTTGAC

201  AAGCCTTGCC AAGCCATTGT TGAGCGAGCG CAAGGTCTTG GCGCACGCCG

251  CGTCCATCGT AATACATCAA GCCCAAATTG TATTGGGCTT GGGCATCCCC

301  TTGTTCTGA
```

This corresponds to the amino acid sequence <SEQ ID 304; ORF 091.ng>:

```
g091.pep
    1  MEIPVPPSPA TRIFLFESHF GFVLKQIILG RRRPPLPKPL SDGIASRLIT

51  RLQALVIVAA VLVSVLTSLA KPLLSERKVL AHAASIVIHQ AQIVLGLGIP

101  LF*
```

The following partial DNA sequence was identified in *N. meningitidis* <SEQ ID 305>:

```
m091.seq
    1  ATGGAAATAC CCGTACCGCC GAGTCCGGCG ACGAGGATTT TTTTGTTTGA

51  AAAGTCATTT TGGTTTGTCC TAAAACAAAT CATATTGAGC AGGAGATGTC

101  CGCCCCTGCC CAAGCCGCTT TCAGACGGCA TCGCGAGCTG TTCAATAACC

151  CGCCTTCAGG CGTTGGTCAT TGTCGCAGCC GTCTTGGTCT CCGTTTTGAC

201  AAGCCTTGCC AAACCATTCT TGTGCAAGGG CGCGGTCTTG GCGCACGCCG

251  CGTCTTTCGG CATACATCAC GCCCAAATTG TTTTGGGCTT GGGCTACCCC

301  CTGCGC...
```

This corresponds to the amino acid sequence <SEQ ID 306; ORF 091>:

```
m091.pep
    1  MEIPVPPSPA TRIFLFEKSF WFVLKQIILS RRCPPLPKPL SDGIASCSIT

51  RLQALVIVAA VLVSVLTSLA KPFLCKGAVL AHAASFGIHH AQIVLGLGYP

101  LR.
```

Computer analysis of this amino acid sequence gave the following results:
Homology with a Predicted ORF from *N. gonorrhoeae*
ORF 091 shows 84.2% identity over a 101 aa overlap with a predicted ORF (ORF 091.ng) from *N. gonorrhoeae*:

```
m091/g091
                   10         20         30         40         50         60
    m091.pep   MEIPVPPSPATRIFLFEKSFWFVLKQIILSRRCPPLPKPLSDGIASCSITRLQALVIVAA
               ||||||||||||||||:|||||||||:|||||||||||||||| ||||||||||||||
    g091       MEIPVPPSPATRIFLFESHPGFVLKQIILGRRRPPLPKPLSDGIASRLITRLQALVIVAA
                   10         20         30         40         50         60
                   70         80         90        100
    m091.pep   VLVSVLTSLAKPFLCKGAVLAHAASFGIHHAQIVLGLGYPLR
               |||||||||||||:|:||||||||:||:||||||||||
    g091       VLVSVLTSLAKPLLSERKVLAHAASIVIHQAQIVLGLGIPLFX
                   70         80         90        100
```

The following partial DNA sequence was identified in *N. meningiditis* <SEQ ID 307>:

```
a091.seq
   1   ATGGAAATAC CCGTGCCGCC AAGTCCGGCG ACGAGGATTT TTTTGTTTTG
  51   GAAATCATTT TGGTTTGTCC TAAAACAAAT CATATTGAGC AGGGGATGTC
 101   TGATCCTGCT CAAGCCGCTT TCAGACGGCA TCGCGAGCTG TTCAATAACC
 151   CGCTTTCAGG CGTTGGTCAT TGTCGCAGCT GTCTTGGTAT CCGTTTTGAC
 201   AAGCCTTGCC AAGCCATTCT TGTGCAAGGG CGCGGTCTTG GCGCACGCCG
 251   CGTCTTTCGG CATACATCAC GCCCAAATTG TTTTGGGC
```

This corresponds to the amino acid sequence <SEQ ID 308; ORF 091.a>:

```
a091.pep
   1   MEIPVPPSPA TRIFLFWKSF WFVLKQIILS RGCLILLKPL SDGIASCSIT
  51   RFQALVIVAA VLVSVLTSLA KPFLCKGAVL AHAASFGIHH AQIVLG
                                                        35
``` m091/a091 93.8% identity over a 96 aa overlap

```
                   10         20         30         40         50         60
    m091.pep   MEIPVPPSPATRIFLFEKSFWFVLKQIILSRRCPPLPKPLSDGIASCSITRLQALVIVAA
               |||||||||||||||||  |||||||||||||| | |||||||||||||:|||||||
    a091       MEIPVPPSPATRIFLFWKSFWFVLKQIILSRGCLILLKPLSDGIASCSITRFQALVIVAA
                   10         20         30         40         50         60
                   70         80         90        100
    m091.pep   VLVSVLTSLAKPFLCKGAVLAHAASFGIHHAQIVLGLGYPLR
               ||||||||||||||||||||||||||||||||||||
    a091       VLVSVLTSLAKPFLCKGAVLAHAASFGIHHAQIVLG
                   70         80         90
```

The following partial DNA sequence was identified in *N. gonorrhoeae* <SEQ ID 309>:

```
g092.seq
   1   ATGTTTTTTA TTTCAATCCG CTATATATTT GTCAGAAAAC TATGGTGCGC
  51   AAACGGTCAG ACCTTTAAAA TAACGCCTTT ACGCACTAAA AACCAACCGG
 101   AACGCAACAT TATGATGAAA ATCGAGTAA GCAACATCCA TTTTGTCGGT
 151   ATCGGCGGCG TCGGCATGAG CGGTATCGCC GAAGTCTTGC ACAAATTGGG
 201   CTTTAAAGTT TCCGGTTCGG ATCAGGCGCG AAATGCCGCT ACCGAGCATT
 251   TGAGCAGCCT GGGCATTCAA GTTTATCCCG GCCATACCGC AGAACACGTT
 301   AACGGTgcgg ATGTCGTCGT TGCCTCTACC GCCGTCAAGA AAGAAaatcC
 351   CGAAGTtgtc gcTGCGTTGG AGCGGCAAAT TCCCGTTATT CCGCGCGCCT
```

```
-continued
 401 TGATGCTGGC AGAGCTGATG CGCTTCCGTG ACGgcatcgc cattgccggT

451 ACGCACGGCA AAACCACGAC CACCAGCCTG ACCGCCTCCA TCCTCGGCGC

501 GGCAGGACTC GACCCCACTT TCGTTATCGG CGGCAAACTC AACGCCGCAG

551 GCACCAACGC CCGCTTGGGC AAAGGCGAAT ACATCGTTGC CGAAGCCGAC

601 GAATCCGATG CCTCTTTCCT ACATCTGACC CCGATTATGT CCGTCGTTAC

651 CAATATCGAC GAAGACCATA TGGATACCTA CGGGCACAGC GTCGAAAAAC

701 TGCATCAGGC GTTTATCGAT TTCATCCACC GTATGCCCTT CTACGGCAAA

751 GCCTTTTTGT GTGTTGACAG CGAACACGTC CGCGCGATTT TGCCCAAAGT

801 GAGCAAACCT TATGCTACTT ACGGTTTGGA CGATACCGCC GACATCTACG

851 CCACCGACAT CGAAAACGTC GGCGCGCAAA TGAAATTCAC CGTCCATGTT

901 CAAATGAAAG GACATGAGCA GGGGTCGTTT GAAGTCGTGC TGAATATGCC

951 CGGCAGACAC AACGTGCTGA ACGCATTGGC AGCCATCGGc gtggcGCTgg 1001 aagtcGgCGC ATcggttgAA GCGAtcCAAA AaggCTTGCT CGGCTTTGAA 1051 GGCGTCGGCC GCCGCTTCCA AAAATAcggc gacatCAagt tgccaaacgg 1101 cggGaccgCT TTgctGGTGG ACGATTAcgg ACACCACCCC GTCGAAATGG 1151 CGGcaaccct tgccgcTGCA CGCGGCGCGT ATCCGGAAAA acgtTTGGTG 1201 CtcgCCTTCC AGCCGCACCG CTATACCCGC ACGCGCGATT TGTTTGAAGA 1251 CTTTACCAAA GTACTCAATA CCGTTGatgC GCTGGTACTG ACCGAAGTTT 1301 AtgccgccgG CGAAGAGCCG GTTGCCGCCG CCGactcCCG CGCCTTGGCG 1351 CGTGCTATCC GCGTATTGGG CAAACTTGAG CCGATTTACT GCGAAAatgt 1401 cgccgACCTG CCGCAAATGC TGATGAATGT TTTACAGGAT Ggcgatgttg 1451 tgttgAATAT GggTgcggga agcatcaacc gcgttccttc cgcgctgttg 1501 gaattgtcga AACAGAtttg A
```

This corresponds to the amino acid sequence <SEQ ID 310; ORF 092.ng>:

```
g092.pep
   1 MFFISIRYIF VRKLWCANGQ TFKITPLRTK NQPERNIMMK NRVSNIHFVG

51 IGGVGMSGIA EVLHNLGFKV SGSDQARNAA TEHLSSLGIQ VYPGHTAEHV

101 NGADVVVAST AVKKENPEVV AALERQIPVI PRALMLAELM RFRDGIAIAG

151 THGKTTTTSL TASILGAAGL DPTFVIGGKL NAAGTNARLG KGEYIVAEAD

201 ESDASFLHLT PIMSVVTNID EDHMDTYGHS VEKLHQAFID FIHRMPFYGK

251 AFLCVDSEHV RAILPKVSKP YATYGLDDTA DIYATDIENV GAQMKFTVHV

301 QMKGHEQGSF EVVLNMPGRH NVLNALAAIG VALEVGASVE AIQKGLLGFE

351 GVGRRFQKYG DIKLPNGGTA LLVDDYGHHP VEMAATLAAA RGAYPEKRLV

401 LAFQPHRYTR TRDLFEDFTK VLNTVDALVL TEVYAAGEEP VAAADSRALA

451 RAIRVLGKLE PIYCENVADL PQMLMNVLQD GDVVLNMGAG SINRVPSALL

501 ELSKQI*
```

The following partial DNA sequence was identified in *N. meningitidis* <SEQ ID 311>:

```
m092.seq
    1   ATGTTTTTTA TTTCAATCCG CTATATATTT GTCAGAAAAC TATGGCGCGC
   51   AAACGGTCAG CCCTTTAAAA TAACGCCTTT ACGCATCGAA AATCCACCGG
  101   AACGCAACAT TATGATGAAA AATCGAGTTA CCAACATCCA TTTTGTCGGT
  151   ATCGGCGGCG TCGGCATGAG CGGCATCGCC GAAGTCTTGC ACAATTTGGG
  201   CTTTAAAGTT TCCGGTTCGG ATCAgGCGCG AAATGCCGCT ACCGAGCATT
  251   TGGGCAGCCT GGGCATTCAA GTTTATCCCG GCCATACCGC CGAACACGTT
  301   AACGGTGCGG ATGTCGTCGT TACCTCTACC GCCGTCAAAA AGAAAATCC
  351   CGAAGTTGTC GCTGCGTTGG AGCAGCAAAT TCCCGTTATT CCGCGCGCCC
  401   TGATGTTGGC GGAGTTGATG CGCTTCCGTG ACGGCATCGC CATTGCCGGC
  451   ACGCACGGCA AAACCACGAC CACCAGCCTG ACCGCCTCCA TCCTCGGCGC
  501   GGCAGGACTT GACCCGACTT TCGTTATCGG CGGCAAACTC AACGCCGCAG
  551   GCACTAACGC CCGCTTGGGC AAAGGCGAAT ACATCGTTGC CGAAGCCGAC
  601   GAGTCGGATG CATCCTTTCT GCACCTGACA CCGATTATGT CCGTCGTTAC
  651   CAATATCGAC GAAGACCATA TGGATACCTA CGGGCACAGC GTCGAAAAAC
  701   TGCATCAGGC GTTTATCGAT TTCATCCACC GTATGCCCTT CTACGGCAAA
  751   GCCTTTTTGT GTATTGACAG CGAACACGTC CGCGCGATTT TGCCCAAAGT
  801   GAGCAAACCT TATGCTACTT ACGGTTTGGA CGATACCGCC GACATCTACG
  851   CCACCGACAT CGAAAACGTC GGCGCGCAAA TGAAATTCAC CGTCCATGTT
  901   CAAATGAAAG ACATGAGCA GGGGTCGTTT GAAGTCGTGC TGAATATGCC
  951   CGGCAGACAC AACGTGCTGA ACGCATTGGC AGCCATCGGC GTGGCGCTGG
 1001   AAGTCGGCGC ATCGGTTGAA GCGATCCAAA AAGGCTTGCT CGGCTTTGAA
 1051   GGCGTCGGCC GCCGCTTCCA AAAATACGGC GACATCAAGT TGCCAAACGG
 1101   CGGGACCGCG CTCTTGGTGG ACGACTACGG ACACCACCCC GTCGAAATGG
 1151   CGGCGACCCT TGCCGCCGCA CGCGGCGCGT ATCTGGAAAA ACGTTTGGTA
 1201   CTCGCCTTCC AGCCGCACCG CTATACCCGC ACGCGCGATT TGTTTGAAGA
 1251   CTTTACCAAA GTCCTCAATA CCGTTGACGC GCTGGTGCTG ACCGAAGTTT
 1301   ATGCCGCCGG TGAAGAGCCG ATTGCCGCCG CCGATTCCCG CGCTCTTGCC
 1351   CGCGCCATCC GCGTGTTGGG CAAACTCGAG CCGATTTACT GCGAAAACGT
 1401   TGCCGATCTG CCCGAAATGC TGTTGAACGT TTTGCAGGAC GGCGACATCG
 1451   TGTTGAATAT GGGCGCGGGA AGCATCAACC GCGTCCCCGC CGCGCTGCTG
 1501   GCATTGTCGA AACAGATTTG A
```

This corresponds to the amino acid sequence <SEQ ID 312; ORF 092>:

```
m092.pep
    1   MFFISIRYIF VRKLWRANGQ PFKITPLRIE NPPERNIMMK NRVTNIHFVG
   51   IGGVGMSGIA EVLHNLGFKV SGSDQARNAA TEHLGSLGIQ VYPGHTAEHV
  101   NGADVVVTST AVKKENPEVV AALEQQIPVI PRALMLAELM RFRDGIAIAG
  151   THGKTTTTSL TASILGAAGL DPTFVIGGKL NAAGTNARLG KGEYIVAEAD
  201   ESDASFLHLT PIMSVVTNID EDHMDTYGHS VEKLHQAFID FIHRMPFYGK
  251   AFLCIDSEHV RAILPKVSKP YATYGLDDTA DIYATDIENV GAQMKFTVHV
```

```
301  QMKGHEQGSF EVVLNMPGRH NVLNALAAIG VALEVGASVE AIQKGLLGFE

351  GVGRRFQKYG DIKLPNGGTA LLVDDYGHHP VEMAATLAAA RGAYLEKRLV

401  LAFQPHRYTR TRDLFEDFTK VLNTVDALVL TEVYAAGEEP IAAADSRALA

451  RAIRVLGKLE PIYCENVADL PEMLLNVLQD GDIVLNMGAG SINRVPAALL

501  ALSKQI*
```

Computer analysis of this amino acid sequence gave the following results:
Homology with a Predicted ORF from *N. gonorrhoeae*
ORF 092 shows 96.6% identity over a 506 aa overlap with a predicted ORF (ORF 092.ng) from *N. gonorrhoeae*:

```
m092/g092
                    10         20         30         40         50         60
   m092.pep  MFFISIRYIFVRKLWRANGQPFKITPLRIENPPERNIMMKNRVTNIHFVGIGGVGMSGIA
             |||||||||||||| |||| ||||||| :| |||||||||||:||||||||||||||||
       g092  MFFISIRYIFVRKLWCANGQTFKITPLRTKNQPERNIMMKNRVSNIHFVGIGGVGMSGIA
                    10         20         30         40         50         60

70         80         90        100        110        120
   m092.pep  EVLHNLGFKVSGSDQARNAATEHLGSLGIQVYPGHTAEHVNGADVVVTSTAVKKENPEVV
             |||||||||||||||||||||||||||:||||||||||||||||||||:|||||||||||
       g092  EVLHNLGFKVSGSDQARNAATEHLSSLGIQVYPGHTAEHVNGADVVVASTAVKKENPEVV
                    70         80         90        100        110        120

130        140        150        160        170        180
   m092.pep  AALEQQIPVIPRALMLAELMRFRDGIAIAGTHGKTTTTSLTASILGAAGLDPTFVIGGKL
             ||||:|||||||||||||||||||||||||||||||||||||||||||||||||||||||
       g092  AALERQIPVIPRALMLAELMRFRDGIAIAGTHGKTTTTSLTASILGAAGLDPTFVIGGKL
                   130        140        150        160        170        180

190        200        210        220        230        240
   m092.pep  NAAGTNARLGKGEYIVAEADESDASFLHLTPIMSVVTNIDEDHMDTYGHSVEKLHQAFID
             ||||||||||||||||||||||||||||||||||||||||||||||||||||||||||||
       g092  NAAGTNARLGKGEYIVAEADESDASFLHLTPIMSVVTNIDEDHMDTYGHSVEKLHQAFID
                   190        200        210        220        230        240

250        260        270        280        290        300
   m092.pep  FIHRMPFYGKAFLCIDSEHVRAILPKVSKPYATYGLDDTADIYATDIENVGAQMKFTVHV
             ||||||||||||||:|||||||||||||||||||||||||||||||||||||||||||||
       g092  FIHRMPFYGKAFLCVDSEHVRAILPKVSKPYATYGLDDTADIYATDIENVGAQMKFTVHV
                   250        260        270        280        290        300

310        320        330        340        350        360
   m092.pep  QMKGHEQGSFEVVLNMPGRHNVLNALAAIGVALEVGASVEAIQKGLLGFEGVGRRFQKYG
             ||||||||||||||||||||||||||||||||||||||||||||||||||||||||||||
       g092  QMKGHEQGSFEVVLNMPGRHNVLNALAAIGVALEVGASVEAIQKGLLGFEGVGRRFQKYG
                   310        320        330        340        350        360

370        380        390        400        410        420
   m092.pep  DIKLPNGGTALLVDDYGHHPVEMAATLAAARGAYLEKRLVLAFQPHRYTRTRDLFEDFTK
             |||||||||||||||||||||||||||||||||| |||||||||||||||||||||||||
       g092  DIKLPNGGTALLVDDYGHHPVEMAATLAAARGAYPEKRLVLAFQPHRYTRTRDLFEDFTK
                   370        380        390        400        410        420

430        440        450        460        470        480
   m092.pep  VLNTVDALVLTEVYAAGEEPIAAADSRALARAIRVLGKLEPIYCENVADLPEMLLNVLQD
             ||||||||||||||||||||:|||||||||||||||||||||||||||||:||:|||||
       g092  VLNTVDALVLTEVYAAGEEPVAAADSRALARAIRVLGKLEPIYCENVADLPQMLMNVLQD
                   430        440        450        460        470        480

490        500
   m092.pep  GDIVLNMGAGSINRVPAALLALSKQIX
             ||:|||||||||||||:||| ||||||
       g092  GDVVLNMGAGSINRVPSALLELSKQIX
                   490        500
```

The following partial DNA sequence was identified in *N. meningitidis* <SEQ ID 313>:

```
a092.seq
     1  ATGTTTTTTA TTTCAATCCG CTATATATTT GTCAGAAAAC TATGGCGCGC

51  AAACGGTCAG CCCTTTAAAA TAACGCCTTT ACGCATCGAA AATCCACCGG

101  AACGCAACAT TATGATGAAA AATCGAGTGA CCAACATCCA TTTTGTCGGT
```

```
 151    ATCGGCGGCG TCGGCATGAG CGGTATCGCC GAAGTCTTGC ACAATTTGGG

201    TTTTAAAGTT TCCGGTTCGG ATCAGGCGCG AAATGCCGCT ACCGAGCATT

251    TGGGCAGCCT GGGCATTCAA GTTTATCCCG GCCATACCGC AGAACACGTT

301    AACGGTGCGG ATGTCGTCGT TACCTCTACC GCCGTCAAAA AAGAAAATCC

351    CGAAGTTGTC GCTGCGTTGG AGCAGCAAAT TCCCGTTATT CCGCGCGCCC

401    TGATGTTGGC GGAGTTGATG CGCTTCCGTG ACGGCATCGC CATTGCCGGC

451    ACGCACGGCA AAACCACGAC CACCAGCCTG ACCGCCTCCA TCCTCGGCGC

501    GGCAGGACTT GACCCGACTT TCGTTATCGG CGGCAAACTC AACGCCGCAG

551    GCACCAACGC CCGCTTGGGC AAAGGCGAAT ACATCGTTGC CGAAGCCGAC

601    GAGTCGGATG CATCCTTTCT GCACCTGACA CCGATTATGT CCGTCGTTAC

651    CAATATCGAC GAAGACCATA TGGATACCTA CGGGCACAGT GTTGAGAAGC

701    TGCATCAGGC GTTTATCGAT TTCATCCACC GTATGCCCTT CTACGGCAAA

751    GCCTTTTTGT GTATTGACAG CGAACACGTC CGCGCGATTT TGCCCAAAGT

801    GAGCAAACCT TATGCTACTT ACGGTTTGGA CGATACCGCC GACATCTACG

851    CCACCGACAT CGAAAACGTC GGCGCGCAAA TGAAATTCAC CGTCCATGTT

901    CAAATGAAAG GACATGAGCA GGGGTCGTTT GAAGTCGTGC TGAATATGCC

951    CGGCAGACAC AACGTGCTGA ACGCATTGGC AGCCATCGGC GTGGCGCTGG

1001    AAGTCGGCGC ATCGGTTGAA GCGATCCAAA AAGGCTTGCT CGGCTTTGAA

1051    GGTGTCGGCC GCCGCTTCCA AAAATACGGC GACATCAAGT TGCCAAACGG

1101    TGGAACCGCG CTCTTGGTGG ACGACTACGG ACACCACCCC GTCGAAATGG

1151    CGGCGACCCT TTCCGCCGCA CGCGGCGCGT ATCCGGAAAA ACGTTTGGTA

1201    CTCGCCTTCC AGCCGCACCG CTATACCCGC ACGCGCGATT TGTTTGAAGA

1251    CTTTACCAAA GTCCTCAATA CCGTTGACGC GCTGGTGCTG ACCGAAGTTT

1301    ATGCCGCCGG TGAAGAGCCG ATTGCCGCCG CTGATTCCCG CGCTCTTGCC

1351    CGCGCCATCC GCGTGTTGGG CAAACTCGAG CCGATTTACT GCGAAAACGT

1401    TGCCGATCTG CCCGAAATGC TGTTGAACGT TTTGCAGGAC GGCGACATCG

1451    TGTTGAATAT GGGTGCGGGA AGCATCAACC GCGTCCCCGC CGCGCTGCTG

1501    GAATTGTCGA AACAGATTTG A
```

This corresponds to the amino acid sequence <SEQ ID 314; ORF 092.a>:

```
a092.pep
   1    MFFISIRYIF VRKLWRANGQ PFKITPLRIE NPPERNIMMK NRVTNIHFVG

51    IGGVGMSGIA EVLHNLGFKV SGSDQARNAA TEHLGSLGIQ VYPGHTAEHV

101    NGADVVVTST AVKKENPEVV AALEQQIPVI PRALMLAELM RFRDGIAIAG

151    THGKTTTTSL TASILGAAGL DPTFVIGGKL NAAGTNARLG KGEYIVAEAD

201    ESDASFLHLT PIMSVVTNID EDHMDTYGHS VEKLHQAFID FIHRMPFYGK

251    AFLCIDSEHV RAILPKVSKP YATYGLDDTA DIYATDIENV GAQMKFTVHV

301    QMKGHEQGSF EVVLNMPGRH NVLNALAAIG VALEVGASVE AIQKGLLGFE

351    GVGRRFQKYG DIKLPNGGTA LLVDDYGHHP VEMAATLSAA RGAYPEKRLV

401    LAFQPHRYTR TRDLFEDFTK VLNTVDALVL TEVYAAGEEP IAAADSRALA
```

-continued

```
451    RAIRVLGKLE PIYCENVADL PEMLLNVLQD GDIVLNMGAG SINRVPAALL

501    ELSKQI*
``` m092/a092 99.4% identity over a 506 aa overlap

```
                   10         20         30         40         50         60
m092.pep   MFFISIRYIFVRKLWRANGQPFKITPLRIENPPERNIMMKNRVTNIHFVGIGGVGMSGIA
           ||||||||||||||||||||||||||||||||||||||||||||||||||||||||||||
a092       MFFISIRYIFVRKLWRANGQPFKITPLRIENPPERNIMMKNRVTNIHFVGIGGVGMSGIA
                   10         20         30         40         50         60

70         80         90        100        110        120
m092.pep   EVLHNLGFKVSGSDQARNAATEHLGSLGIQVYPGHTAEHVNGADVVVTSTAVKKENPEVV
           ||||||||||||||||||||||||||||||||||||||||||||||||||||||||||||
a092       EVLHNLGFKVSGSDQARNAATEHLGSLGIQVYPGHTAEHVNGADVVVTSTAVKKENPEVV
                   70         80         90        100        110        120

130        140        150        160        170        180
m092.pep   AALEQQIPVIPRALMLAELMRFRDGIAIAGTHGKTTTTSLTASILGAAGLDPTFVIGGKL
           ||||||||||||||||||||||||||||||||||||||||||||||||||||||||||||
a092       AALEQQIPVIPRALMLAELMRFRDGIAIAGTHGKTTTTSLTASILGAAGLDPTFVIGGKL
                  130        140        150        160        170        180

190        200        210        220        230        240
m092.pep   NAAGTNARLGKGEYIVAEADESDASFLHLTPIMSVVTNIDEDHMDTYGHSVEKLHQAFID
           ||||||||||||||||||||||||||||||||||||||||||||||||||||||||||||
a092       NAAGTNARLGKGEYIVAEADESDASFLHLTPIMSVVTNIDEDHMDTYGHSVEKLHQAFID
                  190        200        210        220        230        240

250        260        270        280        290        300
m092.pep   FIHRMPFYGKAFLCIDSEHVRAILPKVSKPYATYGLDDTADIYATDIENVGAQMKFTVHV
           ||||||||||||||||||||||||||||||||||||||||||||||||||||||||||||
a092       FIHRMPFYGKAFLCIDSEHVRAILPKVSKPYATYGLDDTADIYATDIENVGAQMKFTVHV
                  250        260        270        280        290        300

310        320        330        340        350        360
m092.pep   QMKGHEQGSFEVVLNMPGRHNVLNALAAIGVALEVGASVEAIQKGLLGFEGVGRRFQKYG
           ||||||||||||||||||||||||||||||||||||||||||||||||||||||||||||
a092       QMKGHEQGSFEVVLNMPGRHNVLNALAAIGVALEVGASVEAIQKGLLGFEGVGRRFQKYG
                  310        320        330        340        350        360

370        380        390        400        410        420
m092.pep   DIKLPNGGTALLVDDYGHHPVEMAATLAAARGAYLEKRLVLAFQPHRYTRTRDLFEDFTK
           |||||||||||||||||||||||||||||||:||||||||||||||||||||||||||||
a092       DIKLPNGGTALLVDDYGHHPVEMAATLSAARGAYPEKRLVLAFQPHRYTRTRDLFEDFTK
                  370        380        390        400        410        420

430        440        450        460        470        480
m092.pep   VLNTVDALVLTEVYAAGEEPIAAADSRALARAIRVLGKLEPIYCENVADLPEMLLNVLQD
           ||||||||||||||||||||||||||||||||||||||||||||||||||||||||||||
a092       VLNTVDALVLTEVYAAGEEPIAAADSRALARAIRVLGKLEPIYCENVADLPEMLLNVLQD
                  430        440        450        460        470        480

490        500
m092.pep   GDIVLNMGAGSINRVPAALLALSKQIX
           |||||||||||||||||||| ||||||
a092       GDIVLNMGAGSINRVPAALLELSKQIX
                  490        500
```

The following partial DNA sequence was identified in *N. gonorrhoeae* <SEQ ID 315>:

```
g093.seq
    1   aTGCAGAATt ttgGCAAAGT ggccgtATTG ATGGGtggtT TTTCCAGCGA

51   ACGAGAaatc tcgcTGGACA GCgGTACCGC CATTTTGAAC GCCTTAAAAA

101   GCAAAGGCAT AGACGCATAC GCCTTCGACC CTAAGGAAAC GCCGTTATCC

151   GAACTGAAGG AGCGGGGCTT TCAGACGGCA TTCAACATCC TTCACGGTAC

201   TTACGGCGAA GACGGGGCTG TTCAGGGTGC ATTGGAACTG TTGGGCATTC

251   CCTATACCGG CAGCGGTGTC GCCGCCTCCG CCATCGGCAT GGACAAATAC

301   CGCTGCAAAC TGATTTGGCA GGCATTGGGA TTACCCGTTC CCGAGTTCGC

351   CGTACTGTAC GATGATACCG ATTTCGATGC CGTCGAAGAA AAATTGGGTC

401   TGCCGATGTT TGTGAAGCCG GCGGCCGAAG CAGCAGCgt cggcgtggta 451   aAAGTCAAAG AAAaaggccg TCTGAAAAGC GTTtacgaag aatTGAaacA
```

-continued

```
501   CCTTcagggg cgaAAtcatt gccgAacgTT TTATCGGCGG CGGCGAATAT
551   TCCTGCCCCG TCCTGAACGG CAAAGGGCTG CCCGGCATAC ACATCATCCC
601   CGCAACCGAG TTTTACGAct acgaagccaa GtacaaCCGA GACGAcacca
651   tttaTCAATG TCCTTCGGAA GATTTGACCG AAGCCGAAGA AAGCCTGATG
701   CGCGAACTGG CGGTTCGCGG CGCACAGGCA ATCGGTGCGG AAGGCTGCGT
751   GCGCGTCGAT TTCCTCAAAG ATACCGACGG CAAACTCTAT CTGTTGGAAA
801   TCAACACCCT GCCCGGTATG ACCGGCCATA G
```

This corresponds to the amino acid sequence <SEQ ID 316; ORF 093.ng>:

```
g093.pep
   1   MQNFGKVAVL MGGFSSEREI SLDSGTAILN ALKSKGIDAY AFDPKETPLS
  51   ELKERGFQTA FNILHGTYGE DGAVQGALEL LGIPYTGSGV AASAIGMDKY
 101   RCKLIWQALG LPVPEFAVLY DDTDFDAVEE KLGLPMFVKP AAEGSSVGVV
 151   KVKEKGRLKS VYEELKHLQG RNHCRTFYRR RRIFLPRPER QRAARHTHHP
 201   RNRVLRLRSQ VQPRRHHLSM SFGRFDRSRR KPDARTGGSR RTGNRCGRLR
 251   ARRFPQRYRR QTLSVGNQHP ARYDRP*
```

The following partial DNA sequence was identified in *N. meningitidis* <SEQ ID 317>:

```
m093.seq
   1   ATGCAGAATT TTGGCAAAGT GGCCGTATTG ATGGGCGGTT TTTCCAGCGA
  51   ACGAGAAATC TCGCTGGACA GCGGCACCGC CATTTTGAAT GCTTTAAAAA
 101   GCAAAGGCAT AGACGCATAC GCCTTCGATC CTAAAGAAAC CCCATTGTCT
 151   GAATTGAAGG CACAAGGTTT TCAGACGGCA TTCAACATCC TTCACGGTAC
 201   TTACGGCrAA GACGGGGCGG TTCAGGGTGC ATTGGAACTG TTGGGCATTC
 251   CCTATACCGG CAGCGGTGTC GCCGCATCCG CCATCGGCAT GGACAAATAC
 301   CGCTGCAAAC TGATTTGGCA GGCATTGGGA TTGCCCGTTC CCGAGTTCGC
 351   CGTCCTGCAC GACGACACTG ATTTCGATGC CGTCGAAGAA AAATTGGGCC
 401   TGCCGATGTT TGTGAAACCG GCGGCCGAAG GCAGCAGCGT AGGCGTGGTA
 451   AAAGTCAAAG GAAAAGGCCG TCTGAAAAGC GTTTACGAAG AATTGAAACA
 501   CCTTCAGGG. CGAAATCATT GCCGAACGTT TATCGGCGG CGGCGAATAT
 551   TCCTGCCCCG TCCTGAACGG CAAAGGGCTG CCCGGCATAC ACATCATTCC
 601   CGCAACCGAG TTTTACGACT ACGAAGCCAA GTACAACCGC GACGACACCA
 651   TTTATCAATG TCCTTCGGAA GATTTGACCG AAGCCGAAGA AAGCCTGATG
 701   CGCGAACTGG CGGTTCGCGG CGCGCAGGCA ATCGGTGCGG AAGGCTGCGT
 751   GCGCGTCGAT TTCCTCAAAG ATACCGACGG CAAACTCTAT CTGTTGGAAA
 801   TCAACACCCT GCCCGGTATG ACGAGCCATA G
```

This corresponds to the amino acid sequence <SEQ ID 318; ORF 093>:

```
m093.pep
    1   MQNFGKVAVL MGGFSSEREI SLDSGTAILN ALKSKGIDAY AFDPKETPLS

51   ELKAQGFQTA FNILHGTYGX DGAVQGALEL LGIPYTGSGV AASAIGMDKY

101   RCKLIWQALG LPVPEFAVLH DDTDFDAVEE KLGLPMFVKP AAEGSSVGVV

151   KVKGKGRLKS VYEELKHLQX RNHCRTFYRR RRIFLPRPER QRAARHTHHS

201   RNRVLRLRSQ VQPRRHHLSM SFGRFDRSRR KPDARTGGSR RAGNRCGRLR

251   ARRFPQRYRR QTLSVGNQHP ARYDEP*
```

Computer analysis of this amino acid sequence gave the following results:

Homology with a Predicted ORF from *N. gonorrhoeae*
ORF 093 shows 96.7% identity over a 276 aa overlap with a predicted ORF (ORF 093.ng) from *N. gonorrhoeae*:

```
m093/g093
                    10         20         30         40         50         60
     m093.pep  MQNFGKVAVLMGGFSSEREISLDSGTAILNALKSKGIDAYAFDPKETPLSELKAQGFQTA
               ||||||||||||||||||||||||||||||||||||||||||||||||||| :||||||
         g093  MQNFGKVAVLMGGFSSEREISLDSGTAILNALKSKGIDAYAFDPKETPLSELKERGFQTA
                    10         20         30         40         50         60

70         80         90        100        110        120
     m093.pep  FNILHGTYGXDGAVQGALELLGIPYTGSGVAASAIGMDKYRCKLIWQALGLPVPEFAVLH
               ||||||||| ||||||||||||||||||||||||||||||||||||||||||||||||:
         g093  FNILHGTYGEDGAVQGALELLGIPYTGSGVAASAIGMDKYRCKLIWQALGLPVPEFAVLY
                    70         80         90        100        110        120

130        140        150        160        170        180
     m093.pep  DDTDFDAVEEKLGLPMFVKPAAEGSSVGVVKVKGKGRLKSVYEELKHLQXRNHCRTFYRR
               |||||||||||||||||||||||||||||||||| |||||||||||||||| ||||||||
         g093  DDTDFDAVEEKLGLPMFVKPAAEGSSVGVVKVKEKGRLKSVYEELKHLQGRNHCRTFYRR
                   130        140        150        160        170        180

190        200        210        220        230        240
     m093.pep  RRIFLPRPERQRAARHTHHSRNRVLRLRSQVQPRRHHLSMSFGRFDRSRRKPDARTGGSR
               ||||||||||||||||||||| ||||||||||||||||||||||||||||||||||||||
         g093  RRIFLPRPERQRAARHTHHPRNRVLRLRSQVQPRRHHLSMSFGRFDRSRRKPDARTGGSR
                   190        200        210        220        230        240

250        260        270
     m093.pep  RAGNRCGRLRARRFPQRYRRQTLSVGNQHPARYDEPX
               |:||||||||||||||||||||||||||||||:||
         g093  RTGNRCGRLRARRFPQRYRRQTLSVGNQHPARYDRPX
                   250        260        270
```

The following partial DNA sequence was identified in *N. meningitidis* <SEQ ID 319>:

```
a093.seq
    1   ATGCAGAATT TTGGCAAAGT GGCCGTATTG ATGGGCGGTT TTTCCAGCGA

51   ACGAGAAATC TCGCTGGACA GCGGCACCGC CATTTTGAAT GCTTTAAAAA

101   GCAAAGGCAT AGACGCATAC GCCTTCGATC CAAGGAAAC CCCATTGTCT

151   GAATTGAAGG CACAAGGTTT TCAGACGGCA TTCAACATCC TTCACGGTAC

201   TTACGGCGAA GACGGGGCTG TTCAGGGTGC ATTGGAACTG TTGGGCATTC

251   CCTATACCGG CAGCGGTGTC GCCGCATCCG CCATCGGCAT GGACAAATAC

301   CGCTGCAAAC TGATTTGGCA GGCATTGGGA TTGCCCGTTC CCGAGTTCGC

351   CGTCCTGCAC GACGACACTG ATTTCGATGC CGTCGAAGAA AAATTGGGCC

401   TGCCGATGTT TGTGAAACCG GCGGCCGAAG GCAGCAGCGT AGGCGTGGTA

451   AAAGTCAAAG GAAAAGGCCG TCTGAAAAGC GTTTACGAAG AATTGAAACA

501   CTTTCAGGG. CGAAATCATT GCCGAACGGT TTATCGGCGG CGGCGAATAT

551   TCCTGCCCTG TGTTGAACGG CAAAGGCCTG CCCGGCATAC ACATCATCCC
```

```
-continued
601    CGCGACCGAG TTTTATGACT ACGAAGCCAA GTACAACCGC AACGACACCA

651    TTTATCAATG TCCTTCGGAA GATCTGACCG AAGCCGAAGA AAGCCTGATG

701    CGCGAACTGG CGGTTCGCGG CGCGCAGGCA ATCGGTGCGG AAGGCTGCGT

751    GCGCGTCGAT TTCCTCAAAG ATACCGACGG CAAACTCTAT CTGTTGGAAA

801    TCAACACCCT GCCCGGTATG ACCGGCCATA G
```

This corresponds to the amino acid sequence <SEQ ID 320; ORF 093.a>:

```
a093.pep
  1    MQNFGKVAVL MGGFSSEREI SLDSGTAILN ALKSKGIDAY AFDPKETPLS

51    ELKAQGFQTA FNILHGTYGE DGAVQGALEL LGIPYTGSGV AASAIGMDKY

101    RCKLIWQALG LPVPEFAVLH DDTDFDAVEE KLGLPMFVKP AAEGSSVGVV

151    KVKGKGRLKS VYEELKHFQX RNHCRTVYRR RRIFLPCVER QRPARHTHHP

201    RDRVL*LRSQ VQPQRHHLSM SFGRSDRSRR KPDARTGGSR RAGNRCGRLR

251    ARRFPQRYRR QTLSVGNQHP ARYDRP*
``` m093/a093 95.7% identity over a 276 aa overlap

```
                 10         20         30         40         50         60
m093.pep  MQNFGKVAVLMGGFSSEREISLDSGTAILNALKSKGIDAYAFDPKETPLSELKAQGFQTA
          ||||||||||||||||||||||||||||||||||||||||||||||||||||||||||||
a093      MQNFGKVAVLMGGFSSEREISLDSGTAILNALKSKGIDAYAFDPKETPLSELKAQGFQTA
                 10         20         30         40         50         60

70         80         90        100        110        120
m093.pep  FNILHGTYGXDGAVQGALELLGIPYTGSGVAASAIGMDKYRCKLIWQALGLPVPEFAVLH
          |||||||||| |||||||||||||||||||||||||||||||||||||||||||||||||
a093      FNILHGTYGEDGAVQGALELLGIPYTGSGVAASAIGMDKYRCKLIWQALGLPVPEFAVLH
                 70         80         90        100        110        120

130        140        150        160        170        180
m093.pep  DDTDFDAVEEKLGLPMFVKPAAEGSSVGVVKVKGKGRLKSVYEELKHLQXRNHCRTFYRR
          |||||||||||||||||||||||||||||||||||||||||||||||:|||||||| |||
a093      DDTDFDAVEEKLGLPMFVKPAAEGSSVGVVKVKGKGRLKSVYEELKHFQXRNHCRTVYRR
                130        140        150        160        170        180

190        200        210        220        230        240
m093.pep  RRIFLPRPERQRAARHTHHSRNRVLRLRSQVQPRRHHLSMSFGRFDRSRRKPDARTGGSR
          |||||| |||| |||||| |:||| ||||||||||:||||||||||| |||||||||||
a093      RRIFLPCVERQRPARHTHHPRDRVLXLRSQVQPQRHHLSMSFGRSDRSRRKPDARTGGSR
                190        200        210        220        230        240

250        260        270
m093.pep  RAGNRCGRLRARRFPQRYRRQTLSVGNQHPARYDEPX
          ||||||||||||||||||||||||||||||||||:||
a093      RAGNRCGRLRARRFPQRYRRQTLSVGNQHPARYDRPX
                250        260        270
```

The following partial DNA sequence was identified in *N. gonorrhoeae* <SEQ ID 321>:

```
g094.seq
  1    ATGTATTCGC CTTTGCCCAA GCGGGCGTTG GTGCCTGCGG CGTTGAGTTT

51    GCCGCCGATA ACGAAAGTGG GGTCGAGTCC TGCCGCGCCG AGGATGGAGG

101    CGGTCAGGCT GGTGGTCGTG GTTTTGCCGT GCGTAccggc aatggcgatg 151    cCGTCACGGA AGCGCATCAG CTCTGCCAGC ATCAAGGCGC GCGGAATAAC 201    GGGAATTTGC CGCTCCAACG CAgcgacaAC TTCGGgattT TCTTTCTTGA 251    CGGCGGTAGA GGCAACGACG ACATccgcAC CGTTAACGTG TTCTGCGGTA

301    TGGCCGGGAT AA
```

This corresponds to the amino acid sequence <SEQ ID 322; ORF 094.ng>:

```
g094.pep
    1   MYSPLPKRAL VPAALSLPPI TKVGSSPAAP RMEAVRLVVV VLPCVPAMAM

51   PSRKRISSAS IKARGITGIC RSNAATTSGF SFLTAVEATT TSAPLTCSAV

101   WPG*
```

The following partial DNA sequence was identified in *N. meningitidis* <SEQ ID 323>:

```
m094.seq
    1   ATGTATTCGC CTTTGCCCAA GCGGGCGTTA GTGCCTGCGG CGTTGAGTTT

51   GCCGCCGATA ACGAAAGTCG GGTCAAGTCC TGCCGCGCCG AGGATGGAGG

101   CGGTCAGGCT GGTGGTCGTG GTTTTGCCGT GCGTGCCGGC AATGGCGATG

151   CCGTCACGGA AGCGCATCAA CTCCGCCAAC ATCAGGGCGC GCGGAATAAC

201   GGGAATTTGC TGCTCCAACG CAGCGACAAC TTCGGGATTT TCTTTTTTGA

251   CGGCGGTAGA GGTAACGACG ACATCCGCAC CGTTAACGTG TTCGGCGGTA

301   TGGCCGGGAT AA
```

This corresponds to the amino acid sequence <SEQ ID 324; ORF 094>:

```
m094.pep
    1   MYSPLPKRAL VPAALSLPPI TKVGSSPAAP RMEAVRLVVV VLPCVPAMAM

51   PSRKRINSAN IRARGITGIC CSNAATTSGF SFLTAVEVTT TSAPLTCSAV

101   WPG*
```

Computer analysis of this amino acid sequence gave the following results:
Homology with a Predicted ORF from *N. gonorrhoeae*
ORF 094 shows 95.1% identity over a 103 aa overlap with a predicted ORF (ORF 094.ng) from *N. gonorrhoeae*:

```
m094/g094
                 10         20         30         40         50         60
    m094.pep   MYSPLPKRALVPAALSLPPITKVGSSPAAPRMEAVRLVVVVLPCVPAMAMPSRKRINSAN
               ||||||||||||||||||||||||||||||||||||||||||||||||||||||||:||:
    g094       MYSPLPKRALVPAALSLPPITKVGSSPAAPRMEAVRLVVVVLPCVPAMAMPSRKRISSAS
                 10         20         30         40         50         60

70         80         90        100
    m094.pep   IRARGITGICCSNAATTSGFSFLTAVEVTTTSAPLTCSAVWPGX
               |:|||||||| ||||||||||||||||:|||||||||||||||
    g094       IKARGITGICRSNAATTSGFSFLTAVEATTTSAPLTCSAVWPGX
                 70         80         90        100
```

The following partial DNA sequence was identified in *N. meningitidis* <SEQ ID 325>:

```
a094.seq
    1   ATGTATTCGC CTTTGCCCAA GCGGGCGTTG GTGCCTGCGG CGTTGAGTTT

51   GCCGCCGATA ACGAAAGTCG GGTCAAGTCC TGCCGCGCCG AGGATGGAGG

101   CGGTCAGGCT GGTGGTCGTG GTTTTGCCGT GCGTGCCGGC AATGGCGATG

151   CCGTCACGGA AGCGCATCAA CTCCGCCAAC ATCAGGGCGC GCGGAATAAC

201   GGGAATTTGC TGCTCCAACG CAGCGACAAC TTCGGGATTT TCTTTTTTGA
```

```
-continued
251   CGGCGGTAGA GGTAACGACG ACATCCGCAC CGTTAACGTG TTCTGCGGTA

301   TGGCCGGGAT AA
```

This corresponds to the amino acid sequence <SEQ ID 326; ORF 094.a>:

```
a094.pep
    1   MYSPLPKRAL VPAALSLPPI TKVGSSPAAP RMEAVRLVVV VLPCVPAMAM

51   PSRKRINSAN IRARGITGIC CSNAATTSGF SFLTAVEVTT TSAPLTCSAV

101   WPG*
``` m094/a094 100.0% identity over a 103 aa overlap

```
                    10         20         30         40         50         60
    m094.pep MYSPLPKRALVPAALSLPPITKVGSSPAAPRMEAVRLVVVVLPCVPAMAMPSRKRINSAN
             ||||||||||||||||||||||||||||||||||||||||||||||||||||||||||||
    a094     MYSPLPKRALVPAALSLPPITKVGSSPAAPRMEAVRLVVVVLPCVPAMAMPSRKRINSAN
                    10         20         30         40         50         60

70         80         90        100
    m094.pep IRARGITGICCSNAATTSGFSFLTAVEVTTTSAPLTCSAVWPGX
             |||||||||||||||||||||||||||||||||||||||||||
    a094     IRARGITGICCSNAATTSGFSFLTAVEVTTTSAPLTCSAVWPGX
                    70         80         90        100
```

The following partial DNA sequence was identified in *N. gonorrhoeae* <SEQ ID 327>:

```
g095.seq
    1   ATGTCCTTTC ATTTGAACAT GGACGGTGAA TTTCATTTGC GCGCCGACGT

51   TTTCGATGTC GGTGGCGTAG ATGTCGGCGG TATCGTCCAA ACCGTAAGTA

101   GCATAAGGTT TGCTCACTTT GGGCAAAATC GCGCGGACGT GTTCGCTGTC

151   AACACACAAA AAGGCTTTGC CGTAGAAGGG CATACGGTGG ATGAAATCGA

201   TAAACGCCTG ATGCAGTTTT TCGACGCTGT GCCCGTAGGT ATCCATATGG

251   TCTTCGTCGA TATTGGTAAC GACGGACATA ATCGGGGTCA GTGTAGGAAA

301   GAGGCATCGG ATCGTCGGCT TCGGCAACGA TGTATTCGCC TTTGCCCAAG

351   CGGGCGTTGG TGCCTGCGGC GTTGA
```

This corresponds to the amino acid sequence <SEQ ID 328; ORF 095.ng>:

```
g095.pep
    1   MSFHLNMDGE FHLRADVFDV GGVDVGGIVQ TVSSIRFAHF GQNRADVFAV

51   NTQKGFAVEG HTVDEIDKRL MQFFDAVPVG IHMVFVDIGN DGHNRGQCRK

101   EASDRRLRQR CIRLCPSGRW CLRR*
```

The following partial DNA sequence was identified in *N. meningitidis* <SEQ ID 329>:

```
m095.seq
    1   ATGTCCTTTC ATTTGAACAT GGACGGTGAA TTTCATTTGC GCGCCGACGT

51   TTTCGATGTC GGTGGCGTAG ATGTCGGCGG TATCGTCCAA ACCGTAAGTA

101   GCATAAGGTT TGCTCACTTT GGGCAAAATC GCGCGGACGT GTTCGCTGTC

151   AATACACAAA AAGGCTTTGC CGTAGAAGGG CATACGGTGG ATGAAATCGA
```

-continued

```
   201   TAAACGCCTG ATGCAGTTTT TCGACGCTGT GCCCGTAGGT ATCCATATGG
   251   TCTTCGTCGA TATTGGTAAC GACGGACATA ATCGGTGTCA GTGCAGAAAG
   301   GATGCATCCG ACCGTCGGCT TCGGCAACGA TGTATTCGCC TTTGCCCAAG
   351   CGGGCGTTAG TGCCTGCGGC GTTGA
```

This corresponds to the amino acid sequence <SEQ ID 330; ORF 095>:

```
m095.pep
    1   MSFHLNMDGE FHLRADVFDV GGVDVGGIVQ TVSSIRFAHF GQNRADVFAV
   51   NTQKGFAVEG HTVDEIDKRL MQFFDAVPVG IHMVFVDIGN DGHNRCQCRK
  101   DASDRRLRQR CIRLCPSGRX CLRR*
```

Computer analysis of this amino acid sequence gave the following results:
Homology with a Predicted ORF from *N. gonorrhoeae*
ORF 095 shows 97.6% identity over a 124 aa overlap with a predicted ORF (ORF 095.ng) from *N. gonorrhoeae*:

```
m095/g095
                    10         20         30         40         50         60
m095.pep  MSFHLNMDGEFHLRADVFDVGGVDVGGIVQTVSSIRFAHFGQNRADVFAVNTQKGFAVEG
          ||||||||||||||||||||||||||||||||||||||||||||||||||||||||||||
g095      MSFHLNMDGEFHLRADVFDVGGVDVGGIVQTVSSIRFAHFGQNRADVFAVNTQKGFAVEG
                    10         20         30         40         50         60

70         80         90        100        110        120
m095.pep  HTVDEIDKRLMQFFDAVPVGIHMVFVDIGNDGHNRCQCRKDASDRRLRQRCIRLCPSGRX
          ||||||||||||||||||||||||||||||||||||||||:|||||||||||||||||||
g095      HTVDEIDKRLMQFFDAVPVGIHMVFVDIGNDGHNRGQCRKEASDRRLRQRCIRLCPSGRW
                    70         80         90        100        110        120 m095.pep  CLRRX
          |||||
g095      CLRRX
```

The following partial DNA sequence was identified in *N. meningitidis* <SEQ ID 331>:

```
a095.seq
    1   ATGTCCTTTC ATTTGAACAT GGACGGTGAA TTTCATTTGC GCGCCGACGT
   51   TTTCGATGTC GGTGGCGTAG ATGTCGGCGG TATCGTCCAA ACCGTAAGTA
  101   GCATAAGGTT TGCTCACTTT GGGCAAAATC GCGCGGACGT GTTCGCTGTC
  151   AATACACAAA AAGGCTTTGC CGTAGAAGGG CATACGGTGG ATGAAATCGA
  201   TAAACGCCTG ATGCAGCTTC TCAACACTGT GCCCGTAGGT ATCCATATGG
  251   TCTTCGTCGA TATTGGTAAC GACGGACATA ATCGGTGTCA GTGCAGAAAG
  301   GATGCATCCG ACCGTCGGCT TCGGCAACGA TGTATTCGCC TTTGCCCAAG
  351   CGGGCGTTGG TGCCTGCGGC GTTGA
```

This corresponds to the amino acid sequence <SEQ ID 332; ORF 095.a>:

```
a095.pep
    1   MSFHLNMDGE FHLRADVFDV GGVDVGGIVQ TVSSIRFAHF GQNRADVFAV
   51   NTQKGFAVEG HTVDEIDKRL MQLLNTVPVG IHMVFVDIGN DGHNRCQCRK
  101   DASDRRLRQR CIRLCPSGRW CLRR*
``` m095/a095 96.0% identity in 124 aa overlap

```
                10         20         30         40         50         60
m095.pep    MSFHLNMDGEFHLRADVFDVGGVDVGGIVQTVSSIRFAHFGQNRADVFAVNTQKGFAVEG
            ||||||||||||||||||||||||||||||||||||||||||||||||||||||||||||
a0 95       MSFHLNMDGEFHLRADVFDVGGVDVGGIVQTVSSIRFAHFGQNRADVFAVNTQKGFAVEG
                10         20         30         40         50         60

70         80         90        100        110        120
m095.pep    HTVDEIDKRLMQFFDAVPVGIHMVFVDIGNDGHNRCQCRKDASDRRLRQRCIRLCPSGRX
            ||||||||||||::::||||||||||||||||||||||||||||||||||||||||||||
a095        HTVDEIDKRLMQLLNTVPVGIHMVFVDIGNDGHNRCQCRKDASDRRLRQRCIRLCPSGRW
                70         80         90        100        110        120 m095.pep    CLRRX
            |||||
a095        CLRRX
```

The following partial DNA sequence was identified in *N. gonorrhoeae* <SEQ ID 333>:

```
g096.seq
    1   ATGGCCGGTC ATACCGGGCA GGGTGTTGAT TTCCAACAGA TAGAGTTTGC

51   CGTCGGTATC TTTGAGGAAA TCGACGCGCA CGCAGCCTTC CGCACCGATT

101   GCCTGTGCGC CGCGAACCGC CAGTTCGCGC ATCAGGCTTT CTTCGGCTTC

151   GGTCAAATCT TCCGAAGGAC ATTGAtaaat ggtgTCGTCT CGGttgtaCt 201   tggcttcgta gTCGTAAAAC TCGGTTGCGG GGATGATGTG TATGCCGGGC

251   AGCCCTTTGC CGTTCAGGAC GGGGCAGGAA TATTCGCCGC CGCCGATAAA

301   AcgtTcggca atgaTTtcgc ccctgAAGGT GttTCAattc ttcgtaAACG

351   CTTTTCAGAc ggcctTTTTC TTTGA
```

This corresponds to the amino acid sequence <SEQ ID 334; ORF 096.ng>:

```
g096.pep
    1   MAGHTGQGVD FQQIEFAVGI FEEIDAHAAF RTDCLCAANR QFAHQAFFGF

51   GQIFRRTLIN GVVSVVLGFV VVKLGCGDDV YAGQPFAVQD GAGIFAAADK

101   TFGNDFAPEG VSILRKRFSD GLFL*
```

The following partial DNA sequence was identified in *N. meningitidis* <SEQ ID 335>:

```
m096.seq
    1   ATGGCTCGTC ATACCGGGCA GGGTGTTGAT TTCCAACAGA TAGAGTTTGC

51   CGTCGGTATC TTTGAGGAAA TCGACGCGCA CGCAGCCTTC CGCACCGATT

101   GCCTGCGCGC CGCGAACCGC CAGTTCGCGC ATCAGGCTTT CTTCGGCTTC

151   GGTCAAATCT TCCGAAGGAC ATTGATAAAT GGTGTCGTCG CGGTTGTACT

201   TGGCTTCGTA GTCGTAAAAC TCGGTTGCGG GAATGATGTG TATGCCGGGC

251   AGCCCTTTGC CGTTCAGGAC GGGGCAGGAA TATTCGCCGC CGCCGATAAA

301   ACGTTCGGCA ATGATTTCGC CC.TGAAGGT GTTTCAATTC TTCGTAAACG

351   CTTTTCAGAC GGCCTTTTCC TTTGA
```

This corresponds to the amino acid sequence <SEQ ID 336; ORF 096>:

```
m096.pep
    1   MARHTGQGVD FQQIEFAVGI FEEIDAHAAF RTDCLRAANR QFAHQAFFGF

51   GQIFRRTLIN GVVAVVLGFV VVKLGCGNDV YAGQPFAVQD GAGIFAAADK

101   TFGNDFAXEG VSILRKRFSD GLFL*
``` m096/g096 96.0% identity in 124 aa overlap

```
                   10         20         30         40         50         60
    m096.pep   MARHTGQGVDFQQIEFAVGIFEEIDAHAAFRTDCLRAANRQFAHQAFFGFGQIFRRTLIN
               || |||||||||||||||||||||||||||||| |||||||||||||||||||||||||||
    g096       MAGHTGQGVDFQQIEFAVGIFEEIDAHAAFRTDCLCAANRQFAHQAFFGFGQIFRRTLIN
                   10         20         30         40         50         60
                   70         80         90        100        110        120
    m096.pep   GVVAVVLGFVVVKLGCGNDVYAGQPFAVQDGAGIFAAADKTFGNDFAXEGVSILRKRFSD
               |||:|||||||||||||||:|||||||||||||||||||||||||||||:||||||||||
    g096       GVVSVVLGFVVVKLGCGDDVYAGQPFAVQDGAGIFAAADKTFGNDFAPEGVSILRKRFSD
                   70         80         90        100        110        120 m096.pep   GLFLX
               |||||
    g096       GLFLX
```

The following partial DNA sequence was identified in *N. meningitidis* <SEQ ID 337>:

```
a096.seq
    1   ATGGCCGGTC ATACCGGGCA GGGTGTTGAT TTCCAACAGA TAGAGTTTGC

51   CGTCGGTATC TTTGAGGAAA TCGACGCGCA CGCAGCCTTC CGCACCGATT

101   GCCTGCGCGC CGCGAACCGC CAGTTCGCGC ATCAGGCTTT CTTCGGCTTC

151   GGTCAGATCT TCCGAAGGAC ATTGATAAAT GGTGTCGTTG CGGTTGTACT

201   TGGCTTCGTA GTCATAAAAC TCGGTCGCGG GGATGATGTG TATGCCGGGC

251   AGGCCTTTGC CGTTCAACAC AGGGCAGGAA TATTCGCCGC CGCCGATAAA

301   CCGTTCGGCA ATGATTTCGC CCT.GAAAGT GTTTCAATTC TTCGTAAACG

351   CTTTTCAGAC GGCCTTTTCC TTTGA
```

This corresponds to the amino acid sequence <SEQ ID 338; ORF 096.ng>:

```
a096.pep
    1   MAGHTGQGVD FQQIEFAVGI FEEIDAHAAF RTDCLRAANR QFAHQAFFGF

51   GQIFRRTLIN GVVAVVLGFV VIKLGRGDDV YAGQAFAVQH RAGIFAAADK

101   PFGNDFAXES VSILRKRFSD GLFL*
``` m096/a096 92.7% identity in 124 aa overlap

```
                   10         20         30         40         50         60
    m096.pep   MARHTGQGVDFQQIEFAVGIFEEIDAHAAFRIDCLRAANRQFAHQAFFGFGQIFRRTLIN
               || |||||||||||||||||||||||||||||||||||||||||||||||||||||||||
    a096       MAGHTGQGVDFQQIEFAVGIFEEIDAHAAFRIDCLRAANRQFAHQAFFGFGQIFRRTLIN
                   10         20         30         40         50         60
                   70         80         90        100        110        120
    m096.pep   GVVAVVLGFVVVKLGCGNDVYAGQPFAVQDGAGIFAAADKTFGNDFAXEGVSILRKRFSD
               ||||||||||||:|||:||||||  |||||||||  |||||||||||||:||||||||||
    a096       GVVAVVLGFVVIKLGRGDDVYAGQAFAVQHRAGIFAAADKPFGNDFAXESVSILRKRFSD
                   70         80         90        100        110        120 m096.pep   GLFLX
               |||||
    a096       GLFLX
```

The following partial DNA sequence was identified in *N. gonorrhoeae* <SEQ ID 339>:

```
g097.seq
     1  ATGGATATTT CAAAACAAAC ATTGCTGGAT AGGGTTTTTA ACCTGAAGGC
    51  AAACGGTACG ACGGTACGTA CCGAGTTGAT GGCGGGTTTG ACGACCTTTT
   101  TGACGATGTG CTACATCGTT ATCGTCAATC CCCTGATTTT GGGCGAGACC
   151  GGAATGGATA TGGGGGCGGT ATTCGTCGCT ACCTGTATCG CATCCGCCAT
   201  CGGCTGTTTT GTCATGGGTT TTATCGGCAA CTATCCGATT GCGCTTGCCC
   251  CGGGGATGGG GCTGAATGCC TATTTCACCT TTGCCGTCGT TAAGGGTATG
   301  GGCGTGCCTT GGCAGGTGGC GTTGGGTGCG GTGTTCATTT CCGGTCTGAT
   351  TTTCATCCTG TTCAGCTTTT TTAAAGTCAG GGAAATGCTG GTCAACGCAC
   401  TGCCTATGGG TTTGAAAATG TCGATTGCCG CCGGTATCGG TTTGTTTTTG
   451  GCACTGATTT CCCTGAAAGG CGCAGGCATT ATCGTTGCCA ATCCGGCAAC
   501  CTTGGTCGGC TTGGGCGATA TTCATCAGCC CAGCGCACTG TTGGCATTGT
   551  TCGGTTTTGT CATGGTGGTC GTATTGGGGT ATTTCCGCGT TCAAGGCGCA
   601  ATCATCATCA CCATTCTGAC GATTACCGTC ATTGCCAGCC TGATGGGTTT
   651  GAACGAGTTT CACGGCGTGG TCGGCGAAGT ACCGGGCATT GCGCCGACCT
   701  TTATGCAGAT GGATTTTAAA GGTCTGTTTA CCGTCAGCAT GGTCAGCGTG
   751  ATTTTCGTCT TCTTCTTGGT CGATTTGTTC GACAGTACCG GAACGCTGGT
   801  CGGCGTATCC CACCGTGCCG GACTGCTGGT GGACGGTAAG CTGCCCCGCC
   851  TGAAACGCGC ACTGCTTGCA GACTCTACCG CCATTGTGGC AGGTGCGGCT
   901  TTGGGTACTT CTTCAACCAC GCCTTATGTG GAAAGCGCGG CGGGCGTATC
   951  GGCAGGCGGA CGGACCGGCC TGACGGCGGT TACCGTCGGC GTATTGATGC
  1001  TGGCGTGTCT GATGTTCTCC CCATTGGCGA AAAGTGTTCC GGTATTTGCC
  1051  ACCGCGCCCG CACTGCTTTA TGTCGGCACG CAGATGCTCC GCAGTGCGAG
  1101  GGACATTGAT TGGGACGATA TGACTGAAGC CGCGCCCGCG TTCCTGACCA
  1151  TTGTCTTCAT GCCGTTTACC TATTCGATTG CAGACGGCAT CGCCTTCGGC
  1201  TTCATCAGCT ATGCCGTGGT CAAACTTTTG TGTCGCCGGA CTGGGGACGT
  1251  GCCGCCTATG GTATGGGTTG TTGCCGTATT GTGGGCATTG AAATTCTGGT
  1301  ATTTGGGCTG A
```

This corresponds to the amino acid sequence <SEQ ID 340; ORF 097.ng>:

```
g097.pep
     1  MDISKQTLLD RVFNLKANGT TVRTELMAGL TTFLTMCYIV IVNPLILGET
    51  GMDMGAVFVA TCIASAIGCF VMGFIGNYPI ALAPGMGLNA YFTFAVVKGM
   101  GVPWQVALGA VFISGLIFIL FSFFKVREML VNALPMGLKM SIAAGIGLFL
   151  ALISLKGAGI IVANPATLVG LGDIHQPSAL LALFGFVMVV VLGYFRVQGA
   201  IIITILTITV IASLMGLNEF HGVVGEVPGI APTFMQMDFK GLFTVSMVSV
   251  IFVFFLVDLF DSTGTLVGVS HRAGLLVDGK LPRLKRALLA DSTAIVAGAA
   301  LGTSSTTPYV ESAAGVSAGG RTGLTAVTVG VLMLACLMFS PLAKSVPVFA
```

-continued

```
351   TAPALLYVGT QMLRSARDID WDDMTEAAPA FLTIVFMPFT YSIADGIAFG

401   FISYAVVKLL CRRTGDVPPM VWVVAVLWAL KFWYLG*
```

The following partial DNA sequence was identified in *N. meningitidis* <SEQ ID 341>:

```
m097.seq
   1   ATGGACACTT CAAAACAAAC ACTGTTGGAC GGGATTTTTA AGCTGAAGGC

51   AAACGGTACk ACGGTGCGTA CCGAGTTGAT GGCGGGTTTG ACAACTTTTT

101   TGACGATGTG CTACATCGTT ATCGTCAACC CTCyGATTTT GGGCGAGACC

151   GGCATGGATA TGGGGGCGGT ATTCGTCGCT ACCTGTATCG CGTCTGCCAT

201   CGGCTGTTTT GTTATGGGTT TTGTCGGCAA CTATCCGATT GCACTCGCAC

251   CGGGGATGGG GCTGAATGCC TATTTCACCT TTGCCGTCGT TAAGGGTATG

301   GGCGTGCCTT GGCAGGTTGC GTTGGGTGCG GTGTTCATCT CCGGTCTGAT

351   TTTTATCCTG TTCAGCTTTT TTAAAGTCAG GGAAATGCTG GTCAACGCAC

401   TGCCTATGGG TTTGAAAATG TCGATTGCTG CCGGTATCGG TTTGTTTTTG

451   GCACTGATTT CCCTGAAAGG CGCAGGCATT ATCGTTGCCA ATCCGGCAAC

501   CTTGGTCGGT TTGGGCGATA TTCATCAGCC GTCCGCGTTG TTGGCATTGT

551   TCGGTTTTGC TATGGTGGTC GTATTGGGAC ATTTCCGCGT TCAAGGCGCA

601   ATCATCATCA CCATCTTGAC CATTACCGTC ATTGCCAGCC TGATGGGTTT

651   GAATGAATTT CACGGCATCA TCGGCGAAGT ACCGAGCATT GCGCCGACTT

701   TTATGCAGAT GGATTTTGAA GGCCTGTTTA CCGTCAGCAT GGTCAGTGTG

751   ATTTTCGTCT TCTTCTTGGT CGATCTATTT GACAGTACCG GAACGCTGGT

801   CGGCATATCC CACCGTGCCG GGCTGCTGGT GGACGGTAAG CTGCCCCGCC

851   TGAAACGCGC ACTGCTTGCA GACTCTACCG CCATTGTGGC AGGTGCGGCT

901   TTGGGTACTT CTTCCACCAC GCCTTATGTG GAAAGCGCGG CGGGCGTATC

951   GGCAGGCGGA CGGACCGGCC TGACGGCGGT TACCGTCGGC GTATTGATGC

1001   TCGCCTGCCT GATGTTTTCA CCTTTGGCGA AAAGTGTTCC CGCTTTTGCC

1051   ACCGCGCCCG CCCTGCTTTA TGTCGGCACG CAGATGCTCC GCAGTGCGAG

1101   GGATATTGAT TGGGACGATA TGACGGAAGC CGCACCTGCG TTCCTGACCA

1151   TTGTTTTCAT GCCGTTTACT TATTCGATTG CAGACGGCAT CGCTTTCGGC

1201   TTCATCAGTT ATGCCGTGGT TAAACTTTTA TGCCGCCGCA CCAAAGACGT

1251   TCCGCCTATG GTATGGATTG TTGCCGTATT GTGGGCACTG AAATTCTGGT

1301   ATTTGGGCTG A
```

This corresponds to the amino acid sequence <SEQ ID 342; ORF 097>:

```
m097.pep
   1   MDTSKQTLLD GIFKLKANGT TVRTELMAGL TTFLTMCYIV IVNPXILGET

51   GMDMGAVFVA TCIASAIGCF VMGFVGNYPI ALAPGMGLNA YFTFAVVKGM

101   GVPWQVALGA VFISGLIFIL FSFFKVREML VNALPMGLKM SIAAGIGLFL

151   ALISLKGAGI IVANPATLVG LGDIHQPSAL LALFGFAMVV VLGHFRVQGA

201   IIITILTITV IASLMGLNEF HGIIGEVPSI APTFMQMDFE GLFTVSMVSV
```

```
251  IFVFFLVDLF DSTGTLVGIS HRAGLLVDGK LPRLKRALLA DSTAIVAGAA

301  LGTSSTTPYV ESAAGVSAGG RTGLTAVTVG VLMLACLMFS PLAKSVPAFA

351  TAPALLYVGT QMLRSARDID WDDMTEAAPA FLTIVFMPFT YSIADGIAFG

401  FISYAVVKLL CRRTKDVPPM VWIVAVLWAL KFWYLG*
```

Computer analysis of this amino acid sequence gave the following results:
Homology with a Predicted ORF from *N. gonorrhoeae*
ORF 097 shows 96.3% identity over a 436 aa overlap with a predicted ORF (ORF 097.ng) from *N. gonorrhoeae*:

```
    m097/g097
                       10         20         30         40         50         60
       m097.pep  MDTSKQTLLDGIFKLKANGTTVRTELMAGLTTFLTMCYIVIVNPXILGETGMDMGAVFVA
                 ||  |||||| :|:||||||||||||||||||||||||||||||| |||||||||||||
           g097  MDISKQTLLDRVFNLKANGTTVRTELMAGLTTFLTMCYIVIVNPLILGETGMDMGAVFVA
                       10         20         30         40         50         60

70         80         90        100        110        120
       m097.pep  TCIASAIGCFVMGFVGNYPIALAPGMGLNAYFTFAVVKGMGVPWQVALGAVFISGLIFIL
                 ||||||||||||||:|||||||||||||||||||||||||||||||||||||||||||||
           g097  TCIASAIGCFVMGFIGNYPIALAPGMGLNAYFTFAVVKGMGVPWQVALGAVFISGLIFIL
                       70         80         90        100        110        120

130        140        150        160        170        180
       m097.pep  FSFFKVREMLVNALPMGLKMSIAAGIGLFLALISLKGAGIIVANPATLVGLGDIHQPSAL
                 ||||||||||||||||||||||||||||||||||||||||||||||||||||||||||||
           g097  FSFFKVREMLVNALPMGLKMSIAAGIGLFLALISLKGAGIIVANPATLVGLGDIHQPSAL
                      130        140        150        160        170        180

190        200        210        220        230        240
       m097.pep  LALFGFAMVVVLGHFRVQGAIIITILTITVIASLMGLNEFHGIIGEVPSIAPTFMQMDFE
                 ||||||:||||||:||||||||||||||||||||||||||||::||||:|||||||||:
           g097  LALFGFVMVVVLGYFRVQGAIIITILTITVIASLMGLNEFHGVVGEVPGIAPTFMQMDFK
                      190        200        210        220        230        240

250        260        270        280        290        300
       m097.pep  GLFTVSMVSVIFVFFLVDLFDSTGTLVGISHRAGLLVDGKLPRLKRALLADSTAIVAGAA
                 |||||||||||||||||||||||||||||:||||||||||||||||||||||||||||||
           g097  GLFTVSMVSVIFVFFLVDLFDSTGTLVGVSHRAGLLVDGKLPRLKRALLADSTAIVAGAA
                      250        260        270        280        290        300

310        320        330        340        350        360
       m097.pep  LGTSSTTPYVESAAGVSAGGRTGLTAVTVGVLMLACLMFSPLAKSVPAFATAPALLYVGT
                 |||||||||||||||||||||||||||||||||||||||||||||||:||||||||||||
           g097  LGTSSTTPYVESAAGVSAGGRTGLTAVTVGVLMLACLMFSPLAKSVPVFATAPALLYVGT
                      310        320        330        340        350        360

370        380        390        400        410        420
       m097.pep  QMLRSARDIDWDDMTEAAPAFLTIVFMPFTYSIADGIAFGFISYAVVKLLCRRTKDVPPM
                 ||||||||||||||||||||||||||||||||||||||||||||||||||||||| ||||
           g097  QMLRSARDIDWDDMTEAAPAFLTIVFMPFTYSIADGIAFGFISYAVVKLLCRRTGDVPPM
                      370        380        390        400        410        420

430
       m097.pep  VWIVAVLWALKFWYLGX
                 ||:||||||||||||||
           g097  VWVVAVLWALKFWYLGX
                      430
```

The following partial DNA sequence was identified in *N. meningitidis* <SEQ ID 343>:

```
    a097.seq
       1  ATGGACACTT CAAAACAAAC ACTGTTGGAC GGGATTTTTA AGCTGAAGGC

51  AAACGGTACG ACGGTGCGTA CCGAGTTGAT GGCGGGTTTG ACAACTTTTT

101  TGACGATGTG CTACATCGTT ATCGTCAACC CTCTGATTTT GGGCGAGACC

151  GGCATGGATA TGGGGCGGT ATTCGTCGCT ACCTGTATCG CGTCTGCCAT

201  CGGCTGTTTT GTTATGGGTT TTGTCGGCAA CTATCCGATT GCACTCGCAC

251  CGGGGATGGG GCTGAATGCC TATTTCACCT TTGCCGTCGT TAAGGGTATG

301  GGCGTGCCTT GGCAGGTTGC GTTGGGTGCG GTGTTCATCT CCGGTCTGAT
```

-continued

```
 351   TTTCATCCTG TTCAGCTTTT TTAAAGTCAG GGAAATGCTG GTCAACGCAC
 401   TGCCTATGGG TTTGAAAATG TCGATTGCTG CCGGTATCGG TTTGTTTTTG
 451   GCACTGATTT CCCTGAAAGG CGCAGGCATT ATCGTTGCCA ATCCGGCAAC
 501   CTTGGTCGGC TTGGGCGATA TTCATCAGCC GTCCGCGTTG TTGGCACTGT
 551   TCGGTTTTGC CATGGTGGTC GTATTGGGAC ATTTCCGCGT TCAAGGCGCA
 601   ATCATCATCA CCATTTTGAC GATTACCGTC ATTGCCAGCC TGATGGGTTT
 651   GAACGAATTT CACGGCATCA TCGGCGAAGT GCCGAGCATT GCGCCGACTT
 701   TTATGCAGAT GGATTTTAAA GGGTTGTTTA CCGTCAGCAT GGTCAGCGTG
 751   ATTTTCGTCT TTTTCCTAGT CGATCTGTTC GACAGTACCG AACACTGGT
 801   CGGTGTATCG CATCGTGCCG GACTGCTGGT GGACGGTAAG CTGCCCCGCC
 851   TGAAACGCGC ACTGCTTGCA GACTCTACCG CTATTGTGGC AGGTGCGGCT
 901   TTGGGTACTT CTTCAACCAC GCCTTATGTG GAAAGTGCGG CGGGCGTATC
 951   GGCAGGCGGG CGGACAGGTC TGACGGCGGT TACCGTCGGC GTATTGATGC
1001   TCGCCTGCCT GATGTTTTCA CCTTTGGCGA AAAGTGTTCC CGCTTTTGCC
1051   ACCGCGCCCG CCCTGCTTTA TGTCGGCACG CAGATGCTCC GCAGTGCGAG
1101   GGACATCGAT TGGGACGATA TGACGGAAGC CGCACCCGCA TTCCTGACCA
1151   TTGTCTTCAT GCCGTTTACC TATTCGATTG CAGACGGCAT CGCTTTCGGC
1201   TTCATCAGTT ATGCCGTGGT TAAACTTTTA TGCCGCCGCA CCAAAGACGT
1251   TCCGCCTATG GTATGGATTG TTGCCGTATT GTGGGCACTG AAATTCTGGT
1301   ATTTGGGCTG A
```

This corresponds to the amino acid sequence <SEQ ID 344; ORF 097.a>:

```
a097.pep
    1   MDTSKQTLLD GIFKLKANGT TVRTELMAGL TTFLTMCYIV IVNPLILGET
   51   GMDMGAVFVA TCIASAIGCF VMGFVGNYPI ALAPGMGLNA YFTFAVVKGM
  101   GVPWQVALGA VFISGLIFIL FSFFKVREML VNALPMGLKM SIAAGIGLFL
  151   ALISLKGAGI IVANPATLVG LGDIHQPSAL LALFGFAMVV VLGHFRVQGA
  201   IIITILTITV IASLMGLNEF HGIIGEVPSI APTFMQMDFK GLFTVSMVSV
  251   IFVFFLVDLF DSTGTLVGVS HRAGLLVDGK LPRLKRALLA DSTAIVAGAA
  301   LGTSSTTPYV ESAAGVSAGG RTGLTAVTVG VLMLACLMFS PLAKSVPAFA
  351   TAPALLYVGT QMLRSARDID WDDMTEAAPA FLTIVFMPFT YSIADGIAFG
  401   FISYAVVKLL CRRTKDVPPM VWIVAVLWAL KFWYLG*
``` m097/a097 99.3% identity in 436 aa overlap

```
                   10         20         30         40         50         60
   m097.pep  MDTSKQTLLDGIFKLKANGTTVRTELMAGLTTFLTMCYIVIVNPXILGETGMDMGAVFVA
             ||||||||||||||||||||||||||||||||||||||||||| |||||||||||||||
   a097      MDTSKQTLLDGIFKLKANGTTVRTELMAGLTTFLTMCYIVIVNPLILGETGMDMGAVFVA
                   10         20         30         40         50         60

70         80         90        100        110        120
   m097.pep  TCIASAIGCFVMGFVGNYPIALAPGMGLNAYFTFAVVKGMGVPWQVALGAVFISGLIFIL
             ||||||||||||||||||||||||||||||||||||||||||||||||||||||||||||
   a097      TCIASAIGCFVMGFVGNYPIALAPGMGLNAYFTFAVVKGMGVPWQVALGAVFISGLIFIL
                   70         80         90        100        110        120
```

-continued

```
                130        140        150        160        170        180
m097.pep    FSFFKVREMLVNALPMGLKMSIAAGIGLFLALISLKGAGIIVANPATLVGLGDIHQPSAL
            ||||||||||||||||||||||||||||||||||||||||||||||||||||||||||||
a097        FSFFKVREMLVNALPMGLKMSIAAGIGLFLALISLKGAGIIVANPATLVGLGDIHQPSAL
                130        140        150        160        170        180

190        200        210        220        230        240
m097.pep    LALFGFAMVVVLGHPRVQGAIIITILTITVIASLMGLNEFHGIIGEVPSIAPTFMQMDFE
            |||||||||||||||||||||||||||||||||||||||||||||||||||||||||||:
a097        LALFGFAMVVVLGHPRVQGAIIITILTITVIASLMGLNEFHGIIGEVPSIAPTFMQMDFK
                190        200        210        220        230        240

250        260        270        280        290        300
m097.pep    GLFTVSMVSVIFVFFLVDLFDSTGTLVGISHRAGLLVDGKLPRLKRALLADSTAIVAGAA
            |||||||||||||||||||||||||||||||:||||||||||||||||||||||||||||
a097        GLFTVSMVSVIFVFFLVDLFDSTGTLVGVSHRAGLLVDGKLPRLKRALLADSTAIVAGAA
                250        260        270        280        290        300

310        320        330        340        350        360
m097.pep    LGTSSTTPYVESAAGVSAGGRTGLTAVTVGVLMLACLMFSPLAKSVPAFATAPALLYVGT
            ||||||||||||||||||||||||||||||||||||||||||||||||||||||||||||
a097        LGTSSTTPYVESAAGVSAGGRTGLTAVTVGVLMLACLMFSPLAKSVPAFATAPALLYVGT
                310        320        330        340        350        360

370        380        390        400        410        420
m097.pep    QMLRSARDIDWDDMTEAAPAFLTIVFMPFTYSIADGIAFGFISYAVVKLLCRRTKDVPPM
            ||||||||||||||||||||||||||||||||||||||||||||||||||||||||||||
a097        QMLRSARDIDWDDMTEAAPAFLTIVFMPFTYSIADGIAFGFISYAVVKLLCRRTKDVPPM
                370        380        390        400        410        420

430
m097.pep    VWIVAVLWALKFWYLGX
            |||||||||||||||||
a097        VWIVAVLWALKFWYLGX
                430
```

The following partial DNA sequence was identified in *N. gonorrhoeae* <SEQ ID 345>:

```
g098.seq
    1   ATGACCGCCG ACGGTCTCTT CGTCGCTTTC AACTTCAATA CGTTTGCCGT

51   TGTGCGAATA TTGATACCAG TACAGCAGGA TGCTGCCCAG GCTGGCGATC

101   AGTTTGTCGG CGATGTCGCG CGCTTCGCTG TCGGGATGGC TTTCGCGTTC

151   GGGATGAACG CAGCCGAGCA TGGACACGCC GGTACGCATC ACGTCCATCG

201   GATGGGTATG TGCAGGCAGG CTTTCCAAAA CTTTAATCAC ACGGATAGGC

251   AGGCCGCGCA TGGATTTGAG CTTGGTTTTA TAAGCGGCCA GCTCGAATTT

301   GTTGGGCAGA TGGCCGTGAA TCAGCAAGTG TGCGACTTCT TCAAACTCGC

351   ATTTTTGTGC CAAATTAGAA TGTCGTAA
                                        45
```

This corresponds to the amino acid sequence <SEQ ID 346; ORF 098.ng>:

```
g098.pep
    1   MTADGLFVAF NFNTFAVVRI LIPVQQDAAQ AGDQFVGDVA RFAVGMAFAF

51   GMNAAEHGHA GTHHVHRMGM CRQAFQNFNH TDRQAAHGFE LGFISGQLEF

101   VGQMAVNQQV CDFFKLAFLC QIRMS*
                                        55
```

The following partial DNA sequence was identified in *N. meningitidis* <SEQ ID 347>:

```
m098.seq
    1   ATGACCGCCG ATGGTCTCTT CGTCGCTTTC AACCTCAATG CGTTTGCCGT

51   TGTGCGAATA TTGATACCAG TACAAGAGGA TGCTGCCGAG GCTGGCGATC

101   AGTTTGTCGG CGATGTCGCG CGCTTCACTT TCCGGATGGC TTTCACGTTC

151   AGGATGAACG CAGCCCAGCA TGGATACGCC GGTACGCATT ACGTCCATCG
```

-continued

```
   201   GATGGGTATG TGCAGGCAGG CTTTCCAAAA CTTTAATCAC ACGGATAGGC

251   AGGCCGCGCA TGGATTTGAG CTTGGTTTTA TAAGCGGCCA GCTCGAATTT

301   GTTGGGCAGA TGGCCGTGAA TCAGCAGGTG GGCGACTTCT TCAAACTCGC

351   ATTTTTGTGC CAAATCAGAA TGTCGTAA
```

This corresponds to the amino acid sequence <SEQ ID 348; ORF 098>:

```
m098.pep
     1   MTADGLFVAF NLNAFAVVRI LIPVQEDAAE AGDQFVGDVA RFTFRMAFTF

51   RMNAAQHGYA GTHYVHRMGM CRQAFQNFNH TDRQAAHGFE LGFISGQLEF

101   VGQMAVNQQV GDFFKLAFLC QIRMS*
```

Computer analysis of this amino acid sequence gave the following results:
Homology with a Predicted ORF from *N. gonorrhoeae*
ORF 098 shows 89.6% identity over a 125 aa overlap with a predicted ORF (ORF 098.ng) from *N. gonorrhoeae*:

```
   m098/g098
                       10         20         30         40         50         60
      m098.pep  MTADGLFVAFNLNAFAVVRILIPVQEDAAEAGDQFVGDVARFTFRMAFTFRMNAAQHGYA
                ||||||||||:|:|||||||||||:|||:||||||||||||:  |||:| ||||:||:|
          g098  MTADGLFVAFNFNTFAVVRILIPVQQDAAQAGDQFVGDVARFAVGMAFAFGMNAAEHGHA
                       10         20         30         40         50         60

70         80         90        100        110        120
      m098.pep  GTHYVHRMGMCRQAFQNFNHTDRQAAHGFELGFISGQLEFVGQMAVNQQVGDFFKLAFLC
                |||:||||||||||||||||||||||||||||||||||||||||||||||| |||||||
          g098  GTHHVHRMGMCRQAFQNFNHTDRQAAHGFELGFISGQLEFVGQMAVNQQVCDFFKLAFLC
                       70         80         90        100        110        120 m098.pep  QIRMSX
                ||||||
          g098  QIRMSX
```

The following partial DNA sequence was identified in *N. meningitidis* <SEQ ID 349>:

```
a098.seq
     1   ATGACCGCCG ATGGTCTCTT CGTCGCTTTC AACCTCAATG CGTTTGCCGT

51   TGTGCGAATA TTGATACCAG TACAAGAGGA TGCTGCCGAG GCTGGCGATC

101   AGTTTGTCGG CGATGTCGCG CGCTTCACTT TCCGGATGGC TTTCACGTTC

151   AGGATGAACG CAGCCCAGCA TGGATACGCC GGTACGCATT ACGTCCATCG

201   GATGGGTATG TGCAGGCAGG CTTTCCAAAA CTTTAATCAC ACGGATAGGC

251   AGGCCGCGCA TGGATTTGAG CTTGGTTTTA TAAGCGGCCA GCTCGAATTT

301   GTTGGGCAGA TGGCCGTGAA TCAGCAGGTG GGCGACTTCT TCAAACTCGC

351   ATTTTTGTGC CAAATCAGAA TGTCGTAA
```

This corresponds to the amino acid sequence <SEQ ID 350; ORF 098.a>:

```
a098.pep
     1   MTADGLFVAF NLNAFAVVRI LIPVQEDAAE AGDQFVGDVA RFTFRMAFTF

51   RMNAAQHGYA GTHYVHRMGM CRQAFQNFNH TDRQAAHGFE LGFISGQLEF

101   VGQMAVNQQV GDFFKLAFLC QIRMS*
``` m098/a098 100.0% identity in 125 aa overlap

```
              10        20        30        40        50        60
m098.pep  MTADGLFVAFNLNAFAVVRILIPVQEDAAEAGDQFVGDVARFTFRMAFTFRMNAAQHGYA
          ||||||||||||||||||||||||||||||||||||||||||||||||||||||||||||
a098      MTADGLFVAFNLNAFAVVRILIPVQEDAAEAGDQFVGDVARFTFRMAFTFRMNAAQHGYA
              10        20        30        40        50        60

70        80        90       100       110       120
m098.pep  GTHYVHRMGMCRQAFQNFNHTDRQAAHGFELGFISGQLEFVGQMAVNQQVGDFFKLAFLC
          ||||||||||||||||||||||||||||||||||||||||||||||||||||||||||||
a098      GTHYVHRMGMCRQAFQNFNHTDRQAAHGFELGFISGQLEFVGQMAVNQQVGDFFKLAFLC
              70        80        90       100       110       120 m098.pep  QIRMSX
          ||||||
a098      QIRMSX
```

The following partial DNA sequence was identified in *N. gonorrhoeae* <SEQ ID 351>:

```
g099.seq
   1  ATGCTGGGAC GCGCGTCCAT GATGCGCCTG CCCGATATTG TCGGCGTGGA
  51  GCTGACGGGC AAACGGCAGG CGGGCATTAC TGCCACAGAC ATCGTGTTGG
 101  CACTGACCGA ATTCTTGCGT AAAGAGCGCG TGGTCGGGGC GTTTGTCGAA
 151  TTTTTCGGCG AGGGCGCGAG AAGCCTGTCT ATCGGCGACC GCGCGACCAT
 201  TTCCAACATG ACGCCGGAGT TCGGCGCGAC TGCCGCCATG TTCGCCATCG
 251  ACGCGCAAAC TATTGATTAT TTGAAACTGA CCGGACGTGA CGACGCGCAG
 301  GTGAAATTGG TGGAAACCTA CGCCAAAACC GCAGGCTTAT GGGCAGGTGG
 351  CTTGAAAACC GCCGTTTATC CGCGCGTTTT GAAATTTGAT TTGAGCAGCG
 401  TAACGCGCAA TATGGCAGGC CCGAGCAACC CGCACGCGCG TTTTGCCACC
 451  GCCGATTTGG CGGCGAAAGG CTGGCGAAG CCTTACGAAG AGCCTTCAGA
 501  CGGCCAAATG CCTGACGGTG CAGTGATTAT TGCCGCGATT ACTTCGTGTA
 551  CCAATACTTC CAACCCGCGC AACGTTGTCG CCGCCGCACT GTTGGCACGC
 601  AATGCCAACC GCCTCGGCTT GAAACGCAAA CCTTGGGTGA AATCTTCGTT
 651  TGCCCCGGGT TCAAAAGTAG CCGGAATCTA TTTGAAAGAA GCAGGCTTGT
 701  TGCCCGAAAT GGAAAAACTC GGCTTCGGTA TCGTCGCCTT CGCATGTACC
 751  ACCTGTAACG GCATGAgcgG CGCGCTcgaC CCGAAAATCC AACAAGAAAT
 801  CATCGACCGC GAtttgtacg cCACCGCCGT ATTGTCAGGC AACCGCAACT
 851  TCGACGGCCG TATCCATCCG TATGCGAAAC AGGCTTTCCT CGCTTCGCCT
 901  CCTTTGGTCG TTGCCTACGC ATTGGCAGGT AGCATCCGTT TCGATATTGA
 951  AAACGACGTA CTCGGCGTTG CAGACGGCCG CGAAATCCGC CTGAAAGATA
1001  TCTGGCCGAC AGACGAAGAA ATCGATGCCA TCGTTGCCGA ATATGTGAAA
1051  CCGCAACAAT TCCGCGACAT TTATATCCCG ATGTCCGACA CCGGCACAGC
1101  GCAAAAAGCA CCAAGCCCGC TGTACGACTG GCGACCGATG TCCACCTACA
1151  TCCGCCGTCC GCCCTATTGG AAGGCGCAC TGGCAGGGGA ACGTACATTA
1201  AGAGGTATGC GTCCGCCGGC GATTTTGCCC GACAACATCA CCACCGACCA
1251  CATCTCGcca tCCAATGCGA TTTTGGCCGG cagTGCcgca ggtgaATATT
1301  TGGCGAAAAT GGGTTTGCCT GAAGAagaCT TCAACTCTTA CGCAACCCAC
1351  CGCGGCGACC ACTTGACCGC CCAACGCGCA ACCTTCGCCA ATCCGAAACT
1401  GTTTAACGAA ATGGTGAGAA ACGAAGACGG CAGCGTACGC CAAGGTtcgt
```

-continued

```
1451  tggcacgcgT tgaacCAGAA GGCCAAACCA TGCGCATGTG GGAAGCCATC

1501  GAAACCTATA TGAACCGCAA ACAGCCGCTT ATCATCATTG CCGGTGCGGA

1551  CTATGGTCAA GGCTCAAGCC GCGACTGGGC GGCGAAGGGC GTGCGGCTGG
1601  CGGGTGTGGA AGCCATCGCC GCCGAAGGTT TCGAGCGCAT CCACCGCACC
1651  AACCTCATCG GCATGGGCGT CTTGCCGCTG CAATTCAAAC CCGGCACCAA

1701  CCGCCATACC CTGCAACTGG ACGGTACGGA AACCTACGAC GTTGTCGGCG

1751  AACGCACACC GCGCTGCGGC CTGACCCTCG TGATTCACCG TAAAAACGGA

1801  GAAACCGTCG AAGTTCCGGT TACCTGCCGC CCCGATACCG CAGAAGAAGC

1851  ATTGGTATAT GAAGCCGGCG GCGTATTGCA ACGGTTTGCA CAGGACTTTT

1901  TGGAAGGGAA CGCGGCTTAG
```

This corresponds to the amino acid sequence <SEQ ID 352; ORF 099.ng>:

```
g099.pep
    1  MLGRASMMRL PDIVGVELTG KRQAGITATD IVLALTEFLR KERVVGAFVE
   51  FFGEGARSLS IGDRATISNM TPEFGATAAM FAIDAQTIDY LKLTGRDDAQ
  101  VKLVETYAKT AGLWAGGLKT AVYPRVLKFD LSSVTRNMAG PSNPHARFAT
  151  ADLAAKGLAK PYEEPSDGQM PDGAVIIAAI TSCTNTSNPR NVVAAALLAR
  201  NANRLGLKRK PWVKSSFAPG SKVAGIYLKE AGLLPEMEKL GFGIVAFACT
  251  TCNGMSGALD PKIQQEIIDR DLYATAVLSG NRNFDGRIHP YAKQAFLASP
  301  PLVVAYALAG SIRFDIENDV LGVADGREIR LKDIWPTDEE IDAIVAEYVK
  351  PQQFRDIYIP MSDTGTAQKA PSPLYDWRPM STYIRRPPYW EGALAGERTL
  401  RGMRPPAILP DNITTDHISP SNAILAGSAA GEYLAKMGLP EEDFNSYATH
  451  RGDHLTAQRA TFANPKLFNE MVRNEDGSVR QGSLARVEPE GQTMRMWEAI
  501  ETYMNRKQPL IIIAGADYGQ GSSRDWAAKG VRLAGVEAIA AEGFERIHRT
  551  NLIGMGVLPL QFKPGTNRHT LQLDGTETYD VVGERTPRCG LTLVIHRKNG
  601  ETVEVPVTCR PDTAEEALVY EAGGVLQRFA QDFLEGNAA*
```

The following partial DNA sequence was identified in *N. meningitidis* <SEQ ID 353>:

```
m099.seq
    1  ATGCTGGGAC GCGCGTCCAT GATGCGCCTG CCCGATATTG TCGGCGTTGA
   51  GCTGAACGGC AAACGGCAGG CGGGCATTAC GGCGACGGAT ATTGTGTTGG
  101  CACTGACCGA GTTTCTGCGC AAAGAACGCG TGGTCGGGGC GTTTGTCGAA
  151  TTCTTCGGCG AGGGCGCGAG AAGCCTGTCT ATCGGCGACC GCGCGACCAT
  201  TTCCAACATG ACGCCGGAGT TCGGCGCGAC TGCCGCGATG TTCGCTATTG
  251  ATGAGCAAAC CATTGATTAT TTGAAACTGA CCGGACGCGA CGACGCGCAG
  301  GTGAAATTGG TGGAAACCTA CGCCAAAACC GCAGGCTTGT GGGCAGATGC
  351  CTTGAAAACC GCCGTTTATC CTCGCGTTTT GAAATTTGAT TTGAGCAGCG
  401  TAACGCGCAA TATGGCAGGC CCAAGTAACC CGCATGCCCG TTTTGCGACC
  451  GCCGATTTGG CGGCGAAAGG GCTGGCGAAG CCTTACGAAG AGCCTTCGGA
  501  CGGCCAAATG CCCGACGGCT CGGTCATCAT CGCCGCGATT ACCAGTTGCA
```

```
 551  CCAACACTTC CAACCCGCGC AACGTTGTTG CCGCCGCGCT CTTGGCACGC

601  AATGCCAACC GTCTCGGCTT GAAACGCAAA CCTTGGGTGA AATCTTCGTT

651  TGCCCCGGGT TCAAAAGTAG CCGAAATCTA TTTGAAAGAA GCGGGCCTGT

701  TGCCCGAAAT GGAAAAACTC GGCTTCGGTA TCGTCGCCTT CGCCTGCACC

751  ACCTGCAACG GCATGAGTGG CGCGCTGGAT CCGAAAATCC AGAAAGAAAT

801  CATCGACCGC GATTTGTACG CCACCGCCGT ATTATCAGGC AACCGCAACT

851  TCGACGGCCG TATCCACCCG TATGCGAAAC AGGCTTTCCT CGCTTCGCCT

901  CCGTTGGTCG TTGCCTACGC GCTGGCAGGC AGTATCCGTT TCGATATTGA

951  AAACGACGTA CTCGGCGTTG CAGACGGCAA GGAAATCCGC CTGAAAGACA

1001  TTTGGCCTGC CGATGAAGAA ATCGATGCCG TCGTTGCCGA ATATGTGAAA

1051  CCGCAGCAGT TCCGCGATGT GTATGTACCG ATGTTCGACA CCGGCACAGC

1101  GCAAAAGCA CCCAGTCCGC TGTACGATTG GCGTCCGATG TCCACCTACA

1151  TCCGCCGTCC GCCTTACTGG GAAGGCGCGC TGGCAGGGGA ACGCACATTA

1201  AGAGGTATGC GTCCGCTGGC GATTTTGCCC GACAACATCA CCACCGACCA

1251  CCTCTCGCCG TCCAATGCGA TTTTGGCCGT CAGTGCCGCA GGCGAGTATT

1301  TGGCGAAAAT GGGTTTGCCT GAAGAAGACT TCAACTCTTA CGCAACCCAC

1351  CGCGGCGACC ACTTGACCGC CCAACGCGCT ACCTTCGCCA ATCCGAAACT

1401  GTTTAACGAA ATGGTGAAAA ACGAAGACGG CAGCGTGCGC CAAGGCTCGT

1451  TCGCCCGCGT CGAACCCGAA GGCGAAACCA TGCGCATGTG GGAAGCCATC

1501  GAAACCTATA TGAACCGCAA ACAGCCGCTC ATCATCATTG CCGGTGCGGA

1551  CTATGGTCAA GGCTCAAGCC GCGACTGGGC TGCAAAAGGC GTACGCCTCG

1601  CCGGCGTAGA AGCGATTGTT GCCGAAGGCT CGAGCGTAT CCACCGCACC

1651  AACCTTATCG GCATGGGCGT GTTGCCGCTG CAGTTCAAAC CCGACACCAA

1701  CCGCCATACC CTGCAACTGG ACGGTACGGA AACCTACGAC GTGGTCGGCG

1751  AACGCACACC GCGCTGCGAC CTGACCCTCG TGATTCACCG TAAAAACGGC

1801  GAAACCGTTG AAGTTCCCGT TACCTGCTGC CTCGATACTG CAGAAGAAGT

1851  ATTGGTATAT GAAGCCGGCG GCGTGTTGCA ACGGTTTGCA CAGGATTTTT

1901  TGGAAGGGAA CGCGGCTTAG
```

This corresponds to the amino acid sequence <SEQ ID 354; ORF 099>:

```
m099.pep
   1  MLGRASMMRL PDIVGVELNG KRQAGITATD IVLALTEFLR KERVVGAFVE

51  FFGEGARSLS IGDRATISNM TPEFGATAAM FAIDEQTIDY LKLTGRDDAQ

101  VKLVETYAKT AGLWADALKT AVYPRVLKFD LSSVTRNMAG PSNPHARFAT

151  ADLAAKGLAK PYEEPSDGQM PDGSVIIAAI TSCTNTSNPR NVVAAALLAR

201  NANRLGLKRK PWVKSSFAPG SKVAEIYLKE AGLLPEMEKL GFGIVAFACT

251  TCNGMSGALD PKIQKEIIDR DLYATAVLSG NRNFDGRIHP YAKQAFLASP

301  PLVVAYALAG SIRFDIENDV LGVADGKEIR LKDIWPADEE IDAVVAEYVK

351  PQQFRDVYVP MFDTGTAQKA PSPLYDWRPM STYIRRPPYW EGALAGERTL

401  RGMRPLAILP DNITTDHLSP SNAILAVSAA GEYLAKMGLP EEDFNSYATH
```

```
451    RGDHLTAQRA TFANPKLFNE MVKNEDGSVR QGSFARVEPE GETMRMWEAI

501    ETYMNRKQPL IIIAGADYGQ GSSRDWAAKG VRLAGVEAIV AEGFERIHRT

551    NLIGMGVLPL QFKPDTNRHT LQLDGTETYD VVGERTPRCD LTLVIHRKNG

601    ETVEVPVTCC LDTAEEVLVY EAGGVLQRFA QDFLEGNAA*
```

Computer analysis of this amino acid sequence gave the following results:
Homology with a Predicted ORF from *N. gonorrhoeae*
ORF 099 shows 96.2% identity over a 639 aa overlap with a predicted ORF (ORF 099.ng) from *N. gonorrhoeae*:

```
m099/g099
                   10         20         30         40         50         60
    m099.pep  MLGRASMMRLPDIVGVELNGKRQAGITATDIVLALTEFLRKERVVGAFVEFFGEGARSLS
              ||||||||||||||||||||:|||||||||||||||||||||||||||||||||||||||
    g099      MLGRASMMRLPDIVGVELTGKRQAGITATDIVLALTEFLRKERVVGAFVEFFGEGARSLS
                   10         20         30         40         50         60

70         80         90        100        110        120
    m099.pep  IGDRATISNMTPEFGATAAMFAIDEQTIDYLKLTGRDDAQVKLVETYAKTAGLWADALKT
              |||||||||||||||||||||||| |||||||||||||||||||||||||||||||:|||
    g099      IGDRATISNMTPEFGATAAMFAIDAQTIDYLKLTGRDDAQVKLVETYAKTAGLWAGGLKT
                   70         80         90        100        110        120

130        140        150        160        170        180
    m099.pep  AVYPRVLKFDLSSVTRNMAGPSNPHARFATADLAAKGLAKPYEEPSDGQMPDGSVIIAAI
              |||||||||||||||||||||||||||||||||||||||||||||||||||||:||||||
    g099      AVYPRVLKFDLSSVTRNMAGPSNPHARFATADLAAKGLAKPYEEPSDGQMPDGAVIIAAI
                  130        140        150        160        170        180

190        200        210        220        230        240
    m099.pep  TSCTNTSNPRNVVAALLARNANRLGLKRKPWVKSSFAPGSKVAEIYLKEAGLLPEMEKL
              ||||||||||||||||||||||||||||||||||||||||||| ||||||||||||||||
    g099      TSCTNTSNPRNVVAALLARNANRLGLKRKPWVKSSFAPGSKVAGIYLKEAGLLPEMEKL
                  190        200        210        220        230        240

250        260        270        280        290        300
    m099.pep  GFGIVAFACTTCNGMSGALDPKIQKEIIDRDLYATAVLSGNRNFDGRIHPYAKQAFLASP
              |||||||||||||||||||||||:||||||||||||||||||||||||||||||||||||
    g099      GFGIVAFACTTCNGMSGALDPKIQQEIIDRDLYATAVLSGNRNFDGRIHPYAKQAFLASP
                  250        260        270        280        290        300

310        320        330        340        350        360
    m099.pep  PLVVAYALAGSIRFDIENDVLGVADGKEIRLKDIWPADEEIDAVVAEYVKPQQFRDVYVP
              ||||||||||||||||||||||||||||:|||||||||:||||||:|||||||||:|:|
    g099      PLVVAYALAGSIRFDIENDVLGVADGREIRLKDIWPTDEEIDAIVAEYVKPQQFRDIYIP
                  310        320        330        340        350        360

370        380        390        400        410        420
    m099.pep  MFDTGTAQKAPSPLYDWRPMSTYIRRPPYWEGALAGERTLRGMRPLAILPDNITTDHLSP
              | ||||||||||||||||||||||||||||||||||||||||||  ||||||||||||:||
    g099      MSDTGTAQKAPSPLYDWRPMSTYIRRPPYWEGALAGERTLRGMRPPAILPDNITTDHISP
                  370        380        390        400        410        420

430        440        450        460        470        480
    m099.pep  SNAILAVSAAGEYLAKMGLPEEDFNSYATHRGDHLTAQRATFANPKLFNEMVKNEDGSVR
              ||||||  ||||||||||||||||||||||||||||||||||||||||||||:|||||||
    g099      SNAILAGSAAGEYLAKMGLPEEDFNSYATHRGDHLTAQRATFANPKLFNEMVRNEDGSVR
                  430        440        450        460        470        480

490        500        510        520        530        540
    m099.pep  QGSFARVEPEGETMRMWEAIETYMNRKQPLIIIAGADYGQGSSRDWAAKGVRLAGVEAIV
              |||:||||||:|||||||||||||||||||||||||||||||||||||||||||||||:
    g099      QGSLARVEPEGQTMRMWEAIETYMNRKQPLIIIAGADYGQGSSRDWAAKGVRLAGVEAIA
                  490        500        510        520        530        540

550        560        570        580        590        600
    m099.pep  AEGFERIHRTNLIGMGVLPLQFKPDTNRHTLQLDGTETYDVVGERTPRCDLTLVIHRKNG
              |||||||||||||||||||||||||| ||||||||||||||||||||||| |||||||||
    g099      AEGFERIHRTNLIGMGVLPLQFKPGTNRHTLQLDGTETYDVVGERTPRCGLTLVIHRKNG
                  550        560        570        580        590        600

610        620        630        640
    m099.pep  ETVEVPVTCCLDTAEEVLVYEAGGVLQRFAQDFLEGNAAX
              |||||||||  |||||:||||||||||||||||||||||
    g099      ETVEVPVTCRPDTAEEALVYEAGGVLQRFAQDFLEGNAAX
                  610        620        630        640
```

The following partial DNA sequence was identified in *N. meningitidis* <SEQ ID 355>:

```
a099.seq
    1 ATGCTGGGAC GCGCGTCCAT GATGCGCCTG CCCGATATTG TCGGCGTTGA
   51 GCTGAACGGC AAACGGAAGG CGGGCATTAC GGCGACGGAT ATTGTGTTGG
  101 CACTGACCGA GTTTCTGCGC AAAGAACGCG TGGTCGGGGC GTTTGTCGAA
  151 TTCTTCGGCG AGGGCGCGAG AAGCCTGTCT ATCGGCGACC GCGCGACCAT
  201 TTCCAACATG ACGCCGGAGT TCGGCGCGAC TGCCGCGATG TTCGCTATTG
  251 ATGAGCAAAC CATTGATTAT TTGAAACTGA CCGGACGCGA CGACGCGCAG
  301 GTGAAATTGG TGGAAACCTA CGCCAAAACC GCAGGCTTGT GGGCAGATGC
  351 CTTGAAAACC GCCGTTTATC CGCGCGTTTT GAAATTTGAT TTGAGCAGCG
  401 TAACGCGCAA TATGGCAGGC CCGAGCAACC CGCACGCGCG TTTTGCGACC
  451 GCCGATTTGG CCGGCAAAGG CTTGGCTAAA CCTTACGAAG AGCCTTCAGA
  501 CGGCCAAATG CCTGACGGTG CAGTGATTAT TGCCGCGATT ACTTCCTGTA
  551 CCAATACTTC CAATCCGCGC AACGTTGTCG CCGCCGCGCT GTTGGCACGC
  601 AATGCCAACC GCCTCGGCTT GCAACGCAAA CCTTGGGTGA AATCTTCGTT
  651 TGCCCCGGGT TCAAAAGTAG CCGAAATCTA TTTGAAAGAA GCAGATCTGC
  701 TGCCCGAAAT GGAAAAACTC GGCTTCGGTA TCGTTGCCTT CGCATGTACC
  751 ACCTGTAACG GCATGAGCGG CGCGCTGGAT CCGAAAATCC AGAAAGAAAT
  801 CATCGACCGC GATTTGTACG CCACCGCCGT ATTGTCAGGC AACCGCAACT
  851 TTGACGGCCG TATCCATCCG TATGCGAAAC AGGCTTTCCT CGCTTCGCCT
  901 CCGTTGGTCG TTGCCTACGC GCTGGCAGGC AGCATCCGTT TCGATATTGA
  951 AAACGACGTA CTCGGCGTTG CAGACGGCAA AGAAATCCGC CTGAAAGACA
 1001 TTTGGCCTAC CGATGAAGAA ATCGATGCCA TCGTTGCCGA ATATGTGAAA
 1051 CCGCAGCAAT TTCGCGACGT TTATATCCCG ATGTTCGACA CCGGCACAGC
 1101 GCAAAAAGCA CCAAGCCCGC TGTACGACTG GCGTCCAATG TCTACCTATA
 1151 TCCGCCGCCC ACCTTACTGG GAAGGCGCAC TGGCAGGGGA ACGCACATTA
 1201 AGCGGTATGC GTCCGCTGGC GATTTTGCCC GACAACATCA CCACCGACCA
 1251 TCTCTCGCCA TCCAATGCGA TTTTGGCAAG CAGTGCCGCA GGCGAATATT
 1301 TGGCAAAAAT GGGTTTGCCT GAAGAAGACT TCAACTCTTA CGCAACCCAC
 1351 CGTGGCGACC ACTTGACCGC CCAACGCGCA ACCTTCGCCA ATCCGAAACT
 1401 GTTTAACGAA ATGGTGAGAA ACGAAGACGG CAGCGTACGC CAAGGTTCGC
 1451 TGGCACGCGT TGAACCCGAA GGCCAAACCA TGCGCATGTG GAAGCCATC
 1501 GAAACCTATA TGAACCGCAA ACAGCCGCTC ATCATCATTG CCGGCGCGGA
 1551 CTACGGTCAA GGCTCAAGCC GCGACTGGGC TGCAAAAGGC GTACGCCTCG
 1601 CCGGCGTGGA AGCGATTGTT GCCGAAGGCT TCGAGCGTAT CCACCGCACC
 1651 AACTTGATCG GTATGGGCGT GTTGCCGCTG CAGTTCAAAC CGGGTACCAA
 1701 CCGCCACACC CTGCAACTGG ACGGTACGGA AACCTACGAC GTTGTCGGCG
 1751 AACGCACACC GCGCTGCGAC CTGACCCTTG TGATTCACCG TAAAAACGGC
 1801 GAGACCGTCG AAGTCCCCAT TACCTGCCGC CTCGATACCG CAGAAGAAGT
 1851 GTTGGTATAT GAAGCCGGTG GCGTATTGCA ACGGTTTGCA CAGGATTTTT
 1901 TGGAAGGGAA CGCGGCTTAG
```

This corresponds to the amino acid sequence <SEQ ID 356; ORF 099.a>:

```
a099.pep
    1   MLGRASMMRL PDIVGVELNG KRKAGITATD IVLALTEFLR KERVVGAFVE

51   FFGEGARSLS IGDRATISNM TPEFGATAAM FAIDEQTIDY LKLTGRDDAQ

101   VKLVETYAKT AGLWADALKT AVYPRVLKFD LSSVTRNMAG PSNPHARFAT

151   ADLAGKGLAK PYEEPSDGQM PDGAVIIAAI TSCTNTSNPR NVVAAALLAR

201   NANRLGLQRK PWVKSSFAPG SKVAEIYLKE ADLLPEMEKL GFGIVAFACT

251   TCNGMSGALD PKIQKEIIDR DLYATAVLSG NRNFDGRIHP YAKQAFLASP

301   PLVVAYALAG SIRFDIENDV LGVADGKEIR LKDIWPTDEE IDAIVAEYVK

351   PQQFRDVYIP MFDTGTAQKA PSPLYDWRPM STYIRRPPYW EGALAGERTL

401   SGMRPLAILP DNITTDHLSP SNAILASSAA GEYLAKMGLP EEDFNSYATH

451   RGDHLTAQRA TFANPKLFNE MVRNEDGSVR QGSLARVEPE GQTMRMWEAI

501   ETYMNRKQPL IIIAGADYGQ GSSRDWAAKG VRLAGVEAIV AEGFERIHRT

551   NLIGMGVLPL QFKPGTNRHT LQLDGTETYD VVGERTPRCD LTLVIHRKNG

601   ETVEVPITCR LDTAEEVLVY EAGGVLQRFA QDFLEGNAA*
``` m099/a099 97.5% identity in 639 aa overlap

```
                  10         20         30         40         50         60
     m099.pep  MLGRASMMRLPDIVGVELNGKRQAGITATDIVLALTEFLRKERVVGAFVEFFGEGARSLS
               |||||||||||||||||||||:||||||||||||||||:|||||||||||||||||||||
         a099  MLGRASMMRLPDIVGVELNGKRKAGITATDIVLALTEFLRKERVVGAFVEFFGEGARSLS
                  10         20         30         40         50         60

70         80         90        100        110        120
     m099.pep  IGDRATISNMTPEFGATAAMFAIDEQTIDYLKLTGRDDAQVKLVETYAKTAGLWADALKT
               ||||||||||||||||||||||||||||||||||||||||||||||||||||||||||||
         a099  IGDRATISNMTPEFGATAAMFAIDEQTIDYLKLTGRDDAQVKLVETYAKTAGLWADALKT
                  70         80         90        100        110        120

130        140        150        160        170        180
     m099.pep  AVYPRVLKFDLSSVTRNMAGPSNPHARFATADLAAKGLAKPYEEPSDGQMPDGSVIIAAI
               |||||||||||||||||||||||||||||||||:|||||||||||||||||||:||||||
         a099  AVYPRVLKFDLSSVTRNMAGPSNPHARFATADLAGKGLAKPYEEPSDGQMPDGAVIIAAI
                 130        140        150        160        170        180

190        200        210        220        230        240
     m099.pep  TSCTNTSNPRNVVAAALLARNANRLGLRKPWVKSSFAPGSKVAEIYLKEAGLLPEMEKL
               |||||||||||||||||||||||||||||:|||||||||||||||||||||:||||||||
         a099  TSCTNTSNPRNVVAAALLARNANRLGLQRKPWVKSSFAPGSKVAEIYLKEADLLPEMEKL
                 190        200        210        220        230        240

250        260        270        280        290        300
     m099.pep  GFGIVAFACTTCNGMSGALDPKIQKEIIDRDLYATAVLSGNRNFDGRIHPYAKQAFLASP
               ||||||||||||||||||||||||||||||||||||||||||||||||||||||||||||
         a099  GFGIVAFACTTCNGMSGALDPKIQKEIIDRDLYATAVLSGNRNFDGRIHPYAKQAFLASP
                 250        260        270        280        290        300

310        320        330        340        350        360
     m099.pep  PLVVAYALAGSIRFDIENDVLGVADGKEIRLKDIWPADEEIDAVVAEYVKPQQFRDVYVP
               ||||||||||||||||||||||||||||||||||||:|||||:|||||||||||||||:|
         a099  PLVVAYALAGSIRFDIENDVLGVADGKEIRLKDIWPTDEEIDAIVAEYVKPQQFRDVYIP
                 310        320        330        340        350        360

370        380        390        400        410        420
     m099.pep  MFDTGTAQKAPSPLYDWRPMSTYIRRPPYWEGALAGERTLRGMRPLAILPDNITTDHLSP
               ||||||||||||||||||||||||||||||||||||||||| ||||||||||||||||||
         a099  MFDTGTAQKAPSPLYDWRPMSTYIRRPPYWEGALAGERTLSGMRPLAILPDNITTDHLSP
                 370        380        390        400        410        420

430        440        450        460        470        480
     m099.pep  SNAILAVSAAGEYLAKMGLPEEDFNSYATHRGDHLTAQRATFANPKLFNEMVKNEDGSVR
               ||||||:|||||||||||||||||||||||||||||||||||||||||||||:|||||||
         a099  SNAILASSAAGEYLAKMGLPEEDFNSYATHRGDHLTAQRATFANPKLFNEMVRNEDGSVR
                 430        440        450        460        470        480

490        500        510        520        530        540
     m099.pep  QGSFARVEPEGETMRMWEAIETYMNRKQPLIIIAGADYGQGSSRDWAAKGVRLAGVEAIV
               |||:||||||:|||||||||||||||||||||||||||||||||||||||||||||||||
         a099  QGSLARVEPEGQTMRMWEAIETYMNRKQPLIIIAGADYGQGSSRDWAAKGVRLAGVEAIV
                 490        500        510        520        530        540
```

-continued

```
                  550        560        570        580        590        600
m099.pep  AEGFERIHRTNLIGMGVLPLQFKPDTNRHTLQLDGTETYDVVGERTPRCDLTLVIHRKNG
          ||||||||||||||||||||||||| ||||||||||||||||||||| ||||||||||||
a099      AEGFERIHRTNLIGMGVLPLQFKPGTNRHTLQLDGTETYDVVGSRTPRCDLTLVIHRKNG
                  550        560        570        580        590        600

610        620        630        640
m099.pep  ETEVPVTCCLDTAEEVLVYEAGGVLQRFAQDFLEGNAAX
          ||||| :|| ||||||||||||||||||||||||||||
a099      ETEVPITCRLDTAEEVLVYEAGGVLQRFAQDFLEGNAAX
                  610        620        630        640
```

The following partial DNA sequence was identified in *N. gonorrhoeae* <SEQ ID 357>:

```
g102.seq
    1  AtgtCCGCCA AAactccgtc gctcttcggc ggcgcgatga Ttatcgccgg
   51  gaaggttatc ggcgcAGgta tgttccccaa ccccaccgcc aacttggggg
  101  acgggttaat aggctcgctg attgtgctgc tgtacacctg gtttccattc
  151  tcctccggcg ccctcatgat tttggaagtc aacacccata acCCccgagg
  201  ggcaAGtttt gacaccATGg tcAAagacct gctcgGaCGc ggctggaaca
  251  tcatcaacgg catcgccgtc gctttggTCc tatacggctc gacctacgcg
  301  tacattttag tcggcggtga cctGACCGCC AAAGGCAtcg GCAgCGCAGT
  351  AGGCGGCAAA ATTTCgctca CCGTCGGACA actcgtcttc tTCGGCATCC
  401  TCGCCTTTTG CGTATGGGCA TCCGCACGCT TGGTCGACCG CTTTACCGGC
  451  GTCCTCATCG GCGGCATGGT ATTAACCTTT ATTTGGGCAA CCGGCGGCCT
  501  GGTTGCCGAT GCCAAACCGT CCGTCCTCTT CGACACCCAA GCCCCCGTCG
  551  GCACCGGCTA CTGGATTTAC GCCGCCACCG CCCTGCCCGT CTGCCTCGCT
  601  TCCTTCGGCT TCCACGGCAA CGTTTCCAGC CTGCTCAAAT ACTTTAAAGG
  651  CGACGcgCc aaagtGgCGA aATCcatctg gGcaggtaca ttggTTGCCt
  701  tggtaattta cgtccTCTgg caaaccgcca tCcaaagcaa ccTGCcgcgc
  751  aacgagttcg cCCCcgtgat tgccgccgag aggcaactCT CCGTCCTgaa
  801  tgaaacccTG tccaaattcg cccaaaccgg cgatatggat aAaatattgt
  851  ccctatttcc ctacatggca atcgccacct ccttttaagg cgTAACctta
  901  ggcctgtttg acaacatcgc cgacatcttc aaatggaacg acagtatgtc
  951  cgggcggggc accaaaaccg tcgcgctgaa cttcctgccg CCCCtgattt
 1001  cctggctgct cctccccacc ggcttcttta ccgccattgg tgcgtccggc
 1051  ctggcggcaa ccgtctggga ccaagGcatc atccccgcca tgctgctcta
 1101  cgtttccccc caaaaaattG gcGcaggcaa gacttataAa gtttaCGGCG
 1151  gcttgtggct gatgttagtc ttccttttcg gcatcgccaa catcgccgca
 1201  CAGGTATTGA GccaAatgGa ACtcgtCccc GTATTTAAAG GATAA
```

This corresponds to the amino acid sequence <SEQ ID 358; ORF 102.ng>:

```
g102.pep
    1  MSAKTPSLFG GAMIIAGKVI GAGMFPNPTA NLGDGLIGSL IVLLYTWFPF
   51  SSGALMILEV NTHNPRGASF DTMVKDLLGR GWNIINGIAV ALVLYGSTYA
  101  YILVGGDLTA KGIGSAVGGK ISLTVGQLVF FGILAFCVWA SARLVDRFTG
```

-continued

```
151   VLIGGMVLTF IWATGGLVAD AKPSVLFDTQ APVGTGYWIY AATALPVCLA

201   SFGFHGNVSS LLKYFKGDAP KVAKSIWAGT LVALVIYVLW QTAIQSNLPR

251   NEFAPVIAAE RQLSVLNETL SKFAQTGDMD KILSLFPYMA IATSFLGVTL

301   GLFDNIADIF KWNDSMSGRG TKTVALNFLP PLISWLLLPT GFFTAIGASG

351   LAATVWDQGI IPAMLLYVSP QKIGAGKTYK VYGGLWLMLV FLFGIANIAA

401   QVLSQMELVP VFKG*
```

The following partial DNA sequence was identified in *N. meningitidis* <SEQ ID 359>:

```
m102.seq
   1   ATGCCCAACA AAACCCCTTC ACTGTTCGGC GGCGCGATGA TTATCGCCGG

51   CACGGTCATC GGCGCAGGCA TGCTCGCCAA CCCGACCGCC ACATCCGGCG

101   TATGGTTTAC CGGCTCGCTG GCCGTGTTGC TGTACACCTG GTTTTCTATG

151   CTTTCCAGCG GCCTGATGAT TTTGGAAGTC AACACCCATT ATCCGCACGG

201   CGCAAGTTTC GACACGATGG TCAAAGACCT GCTCGGACGC GGCTGGAACA

251   TCATCAACGG CATCGCCGTC GCCTTCGTTT TATACCTGCT TACTTACGCT

301   TATATCTTCG TCGGCGGCGA CCTGACCGCC AAAGGCTTAG GCAGCGCGGC

351   AGGCGGCGAC GTTTCACTCA CCGTCGGACA ACTCGTCTTC TTCGGCATCC

401   TCGCCTTTTG CGTATGGGCA TCCGCACGCT TGGTCGACCG CTTCACCGGC

451   GTCCTTATCG GCGGCATGGT ATTGACCTTT ATTTGGGCGG CCGGCGGGCT

501   GATTGCCGAT GCCAAGCCGT CCGTCCTCTT CGATACCCAA GCCCCCGCCG

551   GCACAAACTA CTGGATTTAC GCCGCCACCG CCCTGCCCGT CTGCCTCGCT

601   TCCTTCGGCT TCCACGGCAA CGTCTCCAGC CTGCTCAAAT ACTTTAAAGG

651   CGACGCGCCC AAAGTGGCTA AATCCATCTG GACGGGCACA CTGATTGCGC

701   TGGTAATTTA CGTCCTCTGG CAAACCGCCA TCCAAGGCAA CCTGCCGCGC

751   AACGAGTTCG CCCCCGTCAT CGCCGCCGAA GGGCAAGTCT CCGTCCTCAT

801   CGAAACCCTG TCCAAATTCG CCCAAACCGG CAATATGGAC AAAATATTGT

851   CCCTGTTTTC CTATATGGCG ATCGCCACCT CGTTTTTAGG CGTAACGCTC

901   GGACTCTTCG ACTACATCGC CGACATCTTC AAATGGAACG ACAGCATCTC

951   CGGCCGCACC AAAACCGCCG CGCTGACCTT CCTGCCGCCC CTGATTTCCT

1001   GCCTGCTCTT CCCCACCGGC TTCGTTACCG CCATCGGCTA CGTCGGCCTG

1051   GCGGCAACCG TCTGGACAGG CATCATCCCC GCCATGCTGC TCTACCGTTC

1101   GCGCAAAAAA TTCGGCGCAG GCAAAACCTA TAAAGTTTAC GGCGGCTTGT

1151   GGCTGATGGT TTGGGTCTTC CTTTTCGGCA TCGTCAACAT CGCCGCACAG

1201   GTATTGAGCC AAATGGAACT CGTCCCCGTA TTTAAAGGAT AA
```

This corresponds to the amino acid sequence <SEQ ID 360; ORF 102>:

```
m102.pep..
  1    MPNKTPSLFG GAMIIAGTVI GAGMLANPTA TSGVWFTGSL AVLLYTWFSM

51    LSSGLMILEV NTHYPHGASF DTMVKDLLGR GWNIINGIAV AFVLYLLTYA

101    YIFVGGDLTA KGLGSAAGGD VSLTVGQLVF FGILAFCVWA SARLVDRFTG
```

-continued

```
151     VLIGGMVLTF IWAAGGLIAD AKPSVLFDTQ APAGTNYWIY AATALPVCLA

201     SFGFHGNVSS LLKYFKGDAP KVAKSIWTGT LIALVIYVLW QTAIQGNLPR

251     NEFAPVIAAE GQVSVLIETL SKFAQTGNMD KILSLFSYMA IATSFLGVTL

301     GLFDYIADIF KWNDSISGRT KTAALTFLPP LISCLLFPTG FVTAIGYVGL

351     AATVWTGIIP AMLLYRSRKK FGAGKTYKVY GGLWLMVWVF LFGIVNIAAQ

401     VLSQMELVPV FKG*
``` m102/g102 86.0% identity in 415 aa overlap

```
                    10         20         30         40         50         60
m102.pep    MPNKTPSLFGGAMIIAGTVIGAGMLANPTATSGVWFTGSLAVLLYTWFSMLSSGLMILEV
            |  ||||||||||||:  ||||:  | : |||  ||||||  |:::|||||
g102        MSAKTPSLFGGAMIIAGKVIGAGMFPNPTANLGDGLIGSLIVLLYTWFPFSSGALMILEV
                    10         20         30         40         50         60

70         80         90        100        110        120
m102.pep    NTHYPHGASFDTMVKDLLGRGWNIINGIAVAFVLYLLTYAYIFVGGDLTAKGLGSAAGGD
            ||| |:|||||||||||||||||||||||||||:|||    ||||||||||||:|||:||
g102        NTHNPRGASFDTMVKDLLGRGWNIINGIAVALVLYGSTYAYILVGGDLTAKGIGSAVGGK
                    70         80         90        100        110        120

130        140        150        160        170        180
m102.pep    VSLTVGQLVFFGILAFCVWASARLVDRFTGVLIGGMVLTFIWAAGGLIADAKPSVLFDTQ
            :|||||||||||||||||||||||||||||||||||||||||||:|||:||||||||||
g102        IALTVGQLVFFGILAFCVWASARLVDRFTGVLIGGMVLTFIWATGGLVADAKPSVLFDTQ
                   130        140        150        160        170        180

190        200        210        220        230        240
m102.pep    APAGTNYWIYAATALPVCLASFGFHGNVSSLLKYFKGDAPKVAKSIWTGTLIALVIYVLW
            ||:|:||||||||||||||||||||||||||||||||||||||||:|||:||||||||
g102        APVGTYYWIYAATALPVCLASFGFHGNVSSLLKYFKGDAPKVAKSIWAGTLVALVIYVLW
                   190        200        210        220        230        240

250        260        270        280        290        300
m102.pep    QTAIQGNLPRNEFAPVIAAEGQVSVLIETLSKFAQTGNMDKILSLFSYMAIATSFLGVTL
            |||||:|||||||||||||| |:||||||||||||||:||||||||:|||||||||||
g102        QTAIQSNLPRNEFAPVIAAERQLSVLNETLSKFAQTGDMDKILSLFPYMAIATSFLGVTL
                   250        260        270        280        290        300

310        320        330        340        350
m102.pep    GLFDYIADIFKWNDSISGR-TKTAALTFLPPLISCLLFPTGFVTAIGYVGLAATVWT-GI
            ||||:||||||||||:||| ||| |::||||||| ||| ||||||| : |||||| ||
g102        GLFDNIADIFKWNDSMSGRGTKTVALNFLPPLISWLLLPTGFFTAIGASGLAATVWDQGI
                   310        320        330        340        350        360

360        370        380        390        400        410
m102.pep    IPAMLLYRSRKKFGAGKTYKVYGGLWLMVWVFLFGIVNIAAQVLSQMELVPVFKGX
            ||||||| :|::||||||||||||||||: |||||:|||||||||||||||||||
g102        IPAMLLYVSPQKIGAGKTYKVYGGLWLML-VFLFGIANIAAQVLSQMELVPVFKGX
                   370        380        390        400        410
```

The following partial DNA sequence was identified in *N. meningitidis* <SEQ ID 361>:

```
a102.seq
    1   ATGCCCACCA AAACCCCTTC ACTGTTCGGC GGCGCGATGA TTATCGCCGG

51   CACGNTCATC GGCGCAGGTA TGCTCGCCAA CCCGACCGCC ACATCCGGCG

101   TATGGTTTAC CGGCTCGCTG GCCGTGTTGC TGTACACCTG GTTTTCCATG

151   CTCTCCAGCG GCCTGATGAT TTTGGAAGTC AACACCCACT ACCCCCACGG

201   CGCGANCTTC GACACCATGG TTAAAGACCT GCTCGGACGG AGCTGGAACA

251   TCATCAACGG CATCGCCGTC GCCTTCGTTT TATACCTGCT TACTTACGCT

301   TATATCTTCG TCGGCGGCGA CCTGACCGCC AAAGGCTTAG GCAGCGCGGC

351   AGGCGGCAAT GTTTCACTCA CCGTCGGACA ACTCGTCTTC TTCGGCATTC

401   TCGCCTTTTG CGTATGGGCA TCCGCACGCT TGGTCGACCG ATTCACCAGC

451   GTCCTCATCG GCGGCATGGT ATTAACCTTT ATTTGGGCAA CCGGCGGCCT

501   GATTGCCGAT GCCAAACTGC CCGTCCTCTT CGACACCCAA GCCCCTACCG
```

```
 551  GCACCAACTA CTGGATTTAT GTCGCCACCG CCCTGCCCGT CTGCCTTGCG

601  TCATTCGGTT TCCACGGCAA CGTCTCCAGC CTGCTCAAAT ACTTTAAAGG

651  CGACGCGCCC AAAGTGGCTA AATCCATCTG GACGGGCACA CTGATTGCGC

701  TGGTAATTTA CGTCCTCTGG CAAACCGCCA TCCAANGCAA CCTGCCGCGC

751  AACGAGTTCG CCCCCGTGAT TGCCGCCGAA GGGCAAGTCT CCGTCNTGAT

801  TGAAACCCTG TCCAAATTCG CCCAAACCGG CAATATGGAC AAAATATTGT

851  CCCTGTTTTC CTATATGGCG ATCGCCACCT CGTTTTTAGG CGTAACGCTC

901  GGACTCTTCG ACTACATCGC CGACATCTTC AAATGGAACG ACAGCGTGTC

951  CGGCCGCACC AAAACCGCCG CGCTGACCTT CCTGCCGCCT NTAATTTCCT

1001  GCCTGCTCTT CCCCACCGGC TTTGTTACCG CCATCGGNTA CGTCGGCCTG

1051  GCGGCAACCG TCTGGACAGG CATCATCCCC GCCATGCTGC TNTACCGTTC

1101  GCGCAAAAAA TTCGGCGCAG GCAAAACCTA TAAAGTTTAC GGCGGCTTGT

1151  GGCTGATGGT TTGGGTCTTC CTTTTCGGCA TCNTCAACAT CGCCGCACAN

1201  GTATTGAGCC AAATGGAACT CGTCCCCGTA TTTAAAGGAT AA

1202
```

This corresponds to the amino acid sequence <SEQ ID 362; ORF 102.a>:

```
a102.pep
    1  MPTKTPSLFG GAMIIAGTXI GAGMLANPTA TSGVWFTGSL AVLLYTWFSM

51  LSSGLMILEV NTHYPHGAXF DTMVKDLLGR SWNIINGIAV AFVLYLLTYA

101  YIFVGGDLTA KGLGSAAGGN VSLTVGQLVF FGILAFCVWA SARLVDRFTS

151  VLIGGMVLTF IWATGGLIAD AKLPVLFDTQ APTGTNYWIY VATALPVCLA

201  SFGFHGNVSS LLKYFKGDAP KVAKSIWTGT LIALVIYVLW QTAIQXNLPR

251  NEFAPVIAAE GQVSVXIETL SKFAQTGNMD KILSLFSYMA IATSFLGVTL

301  GLFDYIADIF KWNDSVSGRT KTAALTFLPP XISCLLFPTG FVTAIGYVGL

351  AATVWTGIIP AMLLYRSRKK FGAGKTYKVY GGLWLMVWVF LFGIXNIAAX

401  VLSQMELVPV FKG*
``` m102/a102 95.9% identity in 413 aa overlap

```
                  10         20         30         40         50         60
     m102.pep  MPNKTPSLFGGAMIIAGTVIGAGMLANPTATSGVWFTGSLAVLLYTWFSMLSSGLMILEV
               ||:||||||||||||||| ||||||||||||||||||||||||||||||||||||||||
     a102      MPTKTPSLFGGAMIIAGTXIGAGMLANPTATSGVWFTGSLAVLLYTWFSMLSSGLMILEV
                  10         20         30         40         50         60

70         80         90        100        110        120
     m102.pep  NTHYPHGASFDTMVKDLLGRGWNIINGIAVAFVLYLLTYAYIFVGGDLTAKGLGSAAGGD
               |||||||| ||||||||||| :|||||||||||||||||||||||||||||||||||||:
     a102      NTHYPHGAXFDTMVKDLLGRSWNIINGIAVAFVLYLLTYAYIFVGGDLTAKGLGSAAGGN
                  70         80         90        100        110        120

130        140        150        160        170        180
     m102.pep  VSLTVGQLVFFGILAFCVWASARLVDRFTGVLIGGMVLTFIWAAGGLIADAKPSVLFDTQ
               ||||||||||||||||||||||||||||||:||||||||||:||||||||||   |||||
     a102      VSLTVGQLVFFGILAFCVWASARLVDRFTSVLIGGMVLTFIWATGGLIADAKLPVLFDTQ
                 130        140        150        160        170        180

190        200        210        220        230        240
     m102.pep  APAGTNYWIYAATALPVCLASFGFHGNVSSLLKYFKGDAPKVAKSIWTGTLIALVIYVLW
               ||:||||||:||||||||||||||||||||||||||||||||||||||||||||||||||
     a102      APTGTNYWIYVATALPVCLASFGFHGNVSSLLKYFKGDAPKVAKSIWTGTLIALVIYVLW
                 190        200        210        220        230        240
```

-continued

```
              250        260        270        280        290        300
m102.pep  QTAIQGNLPRNEFAPVIAAEGQVSVLIETLSKFAQTGNMDKILSLFSYMAIATSFLGVTL
          |||||  |||||||||||||||||||| |||||||||||||||||||||||||||||||
a102      QTAIQXNLPRNEFAPVIAAEGQVSVXIETLSKFAQTGNMDKILSLFSYMAIATSFLGVTL
              250        260        270        280        290        300

310        320        330        340        350        360
m102.pep  GLFDYIADIFKWNDSISGRTKTAALTFLPPLISCLLFPTGFVTAIGYVGLAATVWTGIIP
          |||||||||||||||:||||||||||||||| ||||||||||||||||||||||||||||
a102      GLFDYIADIFKWNDSVSGRTKTAALTFLPPXISCLLFPTGFVTAIGYVGLAATVWTGIIP
              310        320        330        340        350        360

370        380        390        400        410
m102.pep  AMLLYRSRKKFGAGKTYKVYGGLWLMVWVPLFGIVNIAAQVLSQMELVPVFKGX
          |||||||||||||||||||||||||||||||||| |||| |||||||||||||
a102      AMLLYRSRKKFGAGKTYKVYGGLWLMVWVPLFGIXNIAAXVLSQMELVPVFKGX
              370        380        390        400        410
```

The following partial DNA sequence was identified in *N. gonorrhoeae* <SEQ ID 363>:

```
g105.seq
    1  Atgtccgcag aaaCATACAc acAAAtcggc tGGgtaggct taggGcaaat
   51  gGgtctgcct atgGTAACGC GGCTCTTGGA CGGCGGCATC GAAGTCGGCG
  101  TATACAACCG CTCGCCCGAC AAAACTGCCC CCATCTCcgc CAAAGGAGCA
  151  AAAGTTTACG GCagcACCGC CGAACTCGTC CGCGCCTGCC CCGTCATTTT
  201  CCTGATGGTT TCCGACTATG CCGCCGTGTG CGACATCCTG AACGGAGTCC
  251  GCGACGGATT GGCCGGCAAA ATCATCGTCA ACATGAGCAC CATCTCCCCG
  301  ACCGAAAACC TCGCCGTCAA AGCACTTGTC GAAGCCGCAG GCGGACAGTT
  351  TGCCGAAGCA CCCGTTTCCG GATCGGTCGG ACCCGCCACC AACGGCACAC
  401  TGCTGATTCT GTTCGGCGGC AGCGAAGCCG TTTTAAACCC GCTGCAAAAA
  451  ATATTTTCCC TTGTCGGCAA AAAAACCTTC CATTTCGGCG ATGTCGGCAA
  501  AGGCTCGGGC GCGAAACTCG TCTTGAACTC GCTCTTAGGC ATTTTCGGCG
  551  AAGCGTACAG CGAAGCGATG CTGATGGCGC GGCAGTTCGG CATCGATACC
  601  GACACCATCG TCGAAGCCAT CGGCGGCTCG GCAATGGACT CGCCTATGTT
  651  TCAAACAAAA AAATCACTAT GGGCAAACCG TGAGTTCCCC CCTGCCTTTG
  701  CACTCAAACA CGCTTCCAAA GAcctTAACC TCGccgtcAA AGAGCTTGAA
  751  CAGGCAGGCA ACACCCTGCC CGCCGTCGAA ACCGTTGCTG CCAGCTACCG
  801  CAAAGCAGTT GAAGCCGGCT ACGGCGAACA GGACGTTTCC GGCGTTTACC
  851  TGAAATTGGC AGAACACTGA
```

This corresponds to the amino acid sequence <SEQ ID 364; ORF 105.ng>:

```
g105.pep
    1  MSAETYTQIG WVGLGQMGLP MVTRLLDGGI EVGVYNRSPD KTAPISAKGA
   51  KVYGSTAELV RACPVIFLMV SDYAAVCDIL NGVRDGLAGK IIVNMSTISP
  101  TENLAVKALV EAAGGQFAEA PVSGSVGPAT NGTLLILFGG SEAVLNPLQK
  151  IFSLVGKKTF HFGDVGKGSG AKLVLNSLLG IFGEAYSEAM LMARQFGIDT
  201  DTIVEAIGGS AMDSPMFQTK KSLWANREFP PAFALKHASK DLNLAVKELE
  251  QAGNTLPAVE TVAASYRKAV EAGYGEQDVS GVYLKLAEH
```

The following partial DNA sequence was identified in *N. meningitidis* <SEQ ID 365>:

```
m105.seq
    1   ATGTCCGCAA ACGAATACGC ACAAATCGGC TGGaTAGGCT TAGGGCAAAT
   51   GGGTCTGCCT ATGGTAACGC GGCTCTTGGA CGGCGGCATC GAAGTCGGCG
  101   TATACAACCG CTCGCCCGAC AAAACTGCCC CCATCTCCGC CAAAGGCGCA
  151   AAAGTTTACG GCAACACCGC CGAACTCGTC CGCGACTATC CCGTCATTTT
  201   CCTGATGGTT TCCGACTATG CCGCCGTGTG CGACATCCTG AACGGAGTCC
  251   GCGACGGATT GGCCGGCAAm ATCATCGTCA ACATGAGCAC CATCTCCCCG
  301   ACCGAAAaGC TCGCCGTCAA AGCACTTGTC GAAGCGCAGm GaCAGTTTGC
  351   CGAAGCACCC GTTTCCGGAT CGGTCGGGCC CGCCACCAAC GGCACGCTGC
  401   TGATTCTGTT CGGCGGCAGC GAAcCGtTTT AAACCCGCTG CAAAAAATAT
  451   TTTCCCTCGT CGGCAAAAAA ACCTTCCATT TCGGCGATGT CGGCAAAGGT
  501   TCGGGCGCGA AACTCGTCTT GAACTCGCTC TTGGGCATTT TCGGCGAaCG
  551   TAcAGCGAAs GmTgCTGATG GCGCGGCAGT TCGGCATCGA TACCGACACC
  601   ATCGTCGAAG CCATCGGsGA CTCGGCAATG GACTCGCCCA TGTTCCAAAC
  651   CAAAAAATCC CTGTGGGCAA ACCGCGAATT CCCGmCCGmC TTCGCCCTCA
  701   AACACGCCTC CAAAGACCTC AACCTCGCCG TCAAAGAGCT TGAACAGGCA
  751   GGCAACACCC TGCCCGCCGT CGAAACCGTT GCTGCCAGCT ACCGCAAAGC
  801   AGTCGAAGCC GGCTACGGGA CACAGGACGT TTCCGGCGTT TACCTGAAAC
  851   TGGCAGAACA CTGA
```

This corresponds to the amino acid sequence <SEQ ID 366; ORF 105>:

```
m105.pep
    1   MSANEYAQIG WIGLGQMGLP MVTRLLDGGI EVGVYNRSPD KTAPISAKGA
   51   KVYGNTAELV RDYPVIFLMV SDYAAVCDIL NGVRDGLAGX IIVNMSTISP
  101   TEKLAVKALV EAQRQFAEAP VSGSVGPATN GTLLILFGGS EPFXTRCKKY
  151   FPSSAKKPSI SAMSAKVRAR NSSXTRSWAF SANVQRXXLM ARQFGIDTDT
  201   IVEAIGDSAM DSPMFQTKKS LWANREFPXX FALKHASKDL NLAVKELEQA
  251   GNTLPAVETV AASYRKAVEA GYGTQDVSGV YLKLAEH
```

Computer analysis of this amino acid sequence gave the following results:
Homology with a Predicted ORF from *N. gonorrhoeae*
ORF 105 shows 79.9% identity over a 289 aa overlap with a predicted ORF (ORF 105.ng) from *N. gonorrhoeae*:

```
m105/g105
                  10         20         30         40         50         60
   g105.pep  MSAETYTQIGWVGLGQMGLPMVTRLLDGGIEVGVYNRSPDKTAPISAKGAKVYGSTAELV
             |||: |:||||:||||||||||||||||||||||||||||||||||||||||||:|||||
   m105      MSANEYAQIGWIGLGQMGLPMVTRLLDGGIEVGVYNRSPDKTAPISAKGAKVYGNTAELV
                  10         20         30         40         50         60

70         80         90        100        110        120
   g105.pep  RACPVIFLMVSDYAAVCDILNGVRDGLAGKIIVNMSTISPTENLAVKALVEAAGGQFAEA
             |  ||||||||||||||||||||| |||||||||||||||:||||||||||:|   ||||
   m105      RDYPVIFLMVSDYAAVCDILNGVRDGLAGXIIVNMSTISPTEKLAVKALVEAQR-QFAEA
                  70         80         90        100        110

130        140        150        160        170        180
   g105.pep  PVSGSVGPATNGTLLILFGGSEAVLNPLQKIFSLVGKKTFHFGDVGKGSGAKLVLNSLLG
             |||||||||||||||||||||  : :||   :||  :: ::    |:    :
   m105      PVSGSVGPATNGTLLILFGGSEPFXTRCKKYFPSSAKKP-SISAMSAKVRARNSSXTRSW
              120        130        140        150        160        170
```

-continued

```
                    190       200       210       220       230       240
g105.pep  IFGEAYSEAMLMARQFGIDTDTIVEAIGGSAMDSPMFQTKKSLWANREFPPAFALKHASK
           |:  ::   |||||||||||||||||| |||||||||||||||||||||  ||||||||
m105      AFSANVQRXXLMARQFGIDTDTIVEAIGDSAMDSPMFQTKKSLWANREFPXXFALKHASK
        180       190       200       210       220       230

250       260       270       280      289
g105.pep  DLNLAVKELEQAGNTLPAVETVAASYRKAVEAGYGEQDVSGVYLKLAEH
          ||||||||||||||||||||||||||||||||||| |||||||||||||
m105      DLNLAVKELEQAGNTLPAVETVAASYRKAVEAGYGTQDVSGVYLKLAEH
        240       250       260       270       280
```

The following partial DNA sequence was identified in *N. meningitidis* <SEQ ID 367>:

```
a105.seq
     1  ATGTCCGCAA ACGAATACAC ACAAATCGGC TGGATAGGCT TAGGGCAAAT

51  GGGTCTGCCT ATGGTAACGC GGCTCTTGGA CGGCGGCATC GAAGTCGGCG

101  TATACAACCG CTCGCCCGAC AAAACTGCCC CCATCTCCGC CAAAGGCGCA

151  AAAGTTTACG GCAACACCGC CGAACTCGTC CGCGACTATC CCGTCATTTT

201  CCTGATGGTT TCCGACTATG CCGCCGTGTG CGACATCCTG AACGGAGTCC

251  GCGACGGATT GGCCGGCAAA ATCATCGTCA ACATGAGCAC CATCTCCCCG

301  ACCGAAAACC TCGCCGTCAA AGCACTTGTC GAAGCCGCAG GCGGACAGTT

351  TGCCGAAGCA CCCGTTTCCG GATCGGTCGG GCCCGCCACC AACGGCACGC

401  TGCTGATTCT GTTCGGCGGC AGCGAAGCCG TTTTAAACCC GCTGCAAAAA

451  ATATTTTCCC TCGTCGGCAA AAAAACCTTC CATTTCGGCG ATGTCGGCAA

501  AGGTTCGGGC GCGAAACTCG TCTTGAACTC GCTCTTGGGC ATTTTCGGCG

551  AAGCGTACAG CGAAGCGATG CTGATGGCGC GGCAGTTCGG CATCGATACC

601  GACACCATCG TCGAAGCCAT CGGCGGCTCG GCAATGGACT CGCCCATGTT

651  CCAAACCAAA AAATCCCTGT GGGCAAACCG CGAATTCCCA CCCGCCTTCG

701  CCCTCAAACA CGCCTCCAAA GACCTCAACC TCGCCGTCAA AGAGCTTGAA

751  CAGGCAGGCA ACACCCTGCC CGCCGTCGAA ACCGTTGCTG CCAGCTACCG

801  CAAAGCAGTC GAAGCCGGCT ACGGCGAACA GGACGTTTCC GGCGTTTACC

851  TGAAATTGGC AGAACACTGA
```

This corresponds to the amino acid sequence <SEQ ID 368; ORF 105.a>:

a105.pep

1 MSANEYTQIG WIGLGQMGLP MVTRLLDGGI EVGVYNRSPD KTAPISAKGA

51 KVYGNTAELV RDY<u>PVIFLMV SDYAAVCDIL</u> NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH* m105/a105 96.5% identity in 289 aa overlap

```
                 10         20         30         40         50         60
    m105.pep  MSANEYAQIGWIGLGQMGLPMVTRLLDGGIEVGVYNRSPDKTAPISAKGAKVYGNTAELV
              ||||||:|||||||||||||||||||||||||||||||||||||||||||||||||||||
    a105      MSANEYTQIGWIGLGQMGLPMVTRLLDGGIEVGVYNRSPDKTAPISAKGAKVYGNTAELV
                 10         20         30         40         50         60

70         80         90        100        110        119
    m105.pep  RDYPVIFLMVSDYAAVCDILNGVRDGLAGKIIVNMSTISPTENLAVKALVEAAG-QFAEA
              |||||||||||||||||||||||||||||||||||||||||||||||||||||| |||||
    a105      RDYPVIFLMVSDYAAVCDILNGVRDGLAGKIIVNMSTISPTENLAVKALVEAAGGQFAEA
                 70         80         90        100        110        120

120        130        140        150        160        170        179
    m105.pep  PVSGSVGPATNGTLLILFGGSEAVLNPLQKIFSLVGKKTFHFGDVGKGSGAKLVLNSLLG
              ||||||||||||||||||||||||||||||||||||||||||||||||||||||||||||
    a105      PVSGSVGPATNGTLLILFGGSEAVLNPLQKIFSLVGKKTFHFGDVGKGSGAKLVLNSLLG
                180        190        200        210        220        230

180        190        200        210        220        230
    m105.pep  IFGDV-QRXMLMARQFGIDTDTIVEAIGDSAMDSPMFQTKKSLWANREFPXAFALKHASK
              |||::  ::  |||||||||||||||||| |||||| ||||||||  ||||||| |||||
    a105      IFGEAYSEAMLMARQFGIDTDTIVEAIGGSAMDGPMFQTKKGLWANREFPPAFALXHASK
                190        200        210        220        230        240

240        250        260        270        280
    m105.pep  DLNLAVKELEQAGNTLPAVETVAASYRKAVEAGYGEQDVSGVYLKLAEHX
              ||||||||||||||||||||||||||||||||||||||||||||||||||
    a105      DLNLAVKELEQAGNTLPAVETVAASYRKAVEAGYGEQDVSGVYLKLAEHX
                250        260        270        280        290
```

The following partial DNA sequence was identified in *N. gonorrhoeae* <SEQ ID 369>:

```
g105-1.seq
      1    ATGTCCGCAG AAACATACAC ACAAATCGGC TGGGTAGGCT TAGGGCAAAT

51    GGGTCTGCCT ATGGTAACGC GGCTCTTGGA CGGCGGCATC GAAGTCGGCG

101    TATACAACCG CTCGCCCGAC AAAACTGCCC CCATCTCCGC CAAAGGAGCA

151    AAAGTTTACG GCAGCACCGC CGAACTCGTC CGCGCCTGCC CCGTCATTTT

201    CCTGATGGTT TCCGACTATG CCGCCGTGTG CGACATCCTG AACGGAGTCC

251    GCGACGGATT GGCCGGCAAA ATCATCGTCA ACATGAGCAC CATCTCCCCG

301    ACCGAAAACC TCGCCGTCAA AGCACTTGTC GAAGCCGCAG GCGGACAGTT

351    TGCCGAAGCA CCCGTTTCCG GATCGGTCGG ACCCGCCACC AACGGCACAC

401    TGCTGATTCT GTTCGGCGGC AGCGAAGCCG TTTTAAACCC GCTGCAAAAA

451    ATATTTTCCC TTGTCGGCAA AAAAACCTTC CATTTCGGCG ATGTCGGCAA

501    AGGCTCGGGC GCGAAACTCG TCTTGAACTC GCTCTTAGGC ATTTTCGGCG

551    AAGCGTACAG CGAAGCGATG CTGATGGCGC GGCAGTTCGG CATCGATACC

601    GACACCATCG TCGAAGCCAT CGGCGGCTCG GCAATGGACT CGCCTATGTT

651    TCAAACAAAA AAATCACTAT GGGCAAACCG TGAGTTCCCC CCTGCCTTTG

701    CACTCAAACA CGCTTCCAAA GACCTTAACC TCGCCGTCAA AGAGCTTGAA

751    CAGGCAGGCA ACACCCTGCC CGCCGTCGAA ACCGTTGCTG CCAGCTACCG

801    CAAAGCAGTT GAAGCCGGCT ACGGCGAACA GGACGTTTCC GGCGTTTACC

851    TGAAATTGGC AGAACACTGA
```

This corresponds to the amino acid sequence <SEQ ID 370; ORF 105-1.ng>:

```
g105-1.pep
      1    MSAETYTQIG WVGLGQMGLP MVTRLLDGGI EVGVYNRSPD KTAPISAKGA

51    KVYGSTAELV RACPVIFLMV SDYAAVCDIL NGVRDGLAGK IIVNMSTISP
```

-continued

```
101     TENLAVKALV EAAGGQFAEA PVSGSVGPAT NGTLLILFGG SEAVLNPLQK

151     IFSLVGKKTF HFGDVGKGSG AKLVLNSLLG IFGEAYSEAM LMARQFGIDT

201     DTIVEAIGGS AMDSPMFQTK KSLWANREFP PAFALKHASK DLNLAVKELE

251     QAGNTLPAVE TVAASYRKAV EAGYGEQDVS GVYLKLAEH*
```

The following partial DNA sequence was identified in *N. meningitidis* <SEQ ID 371>:

```
m105-1.seq
  1     ATGTCCGCAA ACGAATACGC ACAAATCGGC TGGATAGGCT TAGGGCAAAT

51     GGGTCTGCCT ATGGTAACGC GGCTCTTGGA CGGCGGCATC GAAGTCGGCG

101     TATACAACCG CTCGCCCGAC AAAACTGCCC CCATCTCCGC CAAAGGCGCA

151     AAAGTTTACG GCAACACCGC CGAACTCGTC CGCGACTATC CCGTCATTTT

201     CCTGATGGTT TCCGACTATG CCGCCGTGTG CGACATCCTG AACGGAGTCC

251     GCGACGGATT GGCCGGCAAA ATCATCGTCA ACATGAGCAC CATCTCCCCG

301     ACCGAAAACC TCGCCGTCAA AGCACTTGTC GAAGCCGCAG GCGGACAGTT

351     TGCCGAAGCA CCCGTTTCCG GATCGGTCGG GCCCGCCACC AACGGCACGC

401     TGCTGATTCT GTTCGGCGGC AGCGAAGCcG TTTTAAACCC GCTGCAAAAA

451     ATATTTTCCC TCGTCGGCAA AAAAACCTTC CATTTCGGCG ATGTCGGCAA

501     AGGTTCGGGC GCGAAACTCG TCTTGAACTC GCTCTTGGGC ATTTTCGGCG

551     AAGCGTACAG CGAAnCGATG CTGATGGCGC GGCAGTTCGG CATCGATACC

601     GACACCATCG TCGAAGCCAT CGGsGACTCG GCAATGGACT CGCCCATGTT

651     CCAAACCAAA AAATCCCTGT GGGCAAACCG CGAATTCCCG CCCGCCTTCG

701     CCCTCAAACA CGCCTCCAAA GACCTCAACC TCGCCGTCAA AGAGCTTGAA

751     CAGGCAGGCA ACACCCTGCC CGCCGTCGAA ACCGTTGCTG CCAGCTACCG

801     CAAAGCAGTC GAAGCCGGCT ACGGCGAACA GGACGTTTCC GGCGTTTACC

851     TGAAACTGGC AGAACACTGA
```

This corresponds to the amino acid sequence <SEQ ID 372; ORF 105-1>:

```
m105-1.pep
  1     MSANEYAQIG WIGLGQMGLP MVTRLLDGGI EVGVYNRSPD KTAPISAKGA

51     KVYGNTAELV RDYPVIFLMV SDYAAVCDIL NGVRDGLAGK IIVNMSTISP

101     TENLAVKALV EAAGGQFAEA PVSGSVGPAT NGTLLILFGG SEAVLNPLQK

151     IFSLVGKKTF HFGDVGKGSG AKLVLNSLLG IFGEAYSEXM LMARQFGIDT

201     DTIVEAIGDS AMDSPMFQTK KSLWANREFP PAFALKHASK DLNLAVKELE

251     QAGNTLPAVE TVAASYRKAV EAGYGEQDVS GVYLKLAEH*
``` m105-1/g105-1 96.9% identity in 289 aa overlap

```
                    10        20        30        40        50        60
m105-1.pep  MSANEYAQIGWIGLGQMGLPMVTRLLDGGIEVGVYNRSPDKTAPISAKGAKVYGNTAELV
            |||: |:||||:||||||||||||||||||||||||||||||||||||||||||:|||||
g105-1      MSAETYTQIGWVGLGQMGLPMVTRLLDGGIEVGVYNRSPDKTAPISAKGAKVYGSTAELV
                    10        20        30        40        50        60
```

```
              70         80         90        100        110        120
m105-1.pep  RDYPVIFLMVSDYAAVCDILNGVRDGLAGKIIVNMSTISPTENLAVKALVEAAGGQFAEA
            | |||||||||||||||||||||||||||||||||||||||||||||||||||||||||
g105-1      RACPVIFLMVSDYAAVCDILNGVRDGLAGKIIVNMSTISPTENLAVKALVEAAGGQFAEA
              70         80         90        100        110        120

130        140        150        160        170        180
m105-1.pep  PVSGSVGPATNGTLLILFGGSEAVLNPLQKIFSLVGKKTFHFGDVGKGSGAKLVLNSLLG
            ||||||||||||||||||||||||||||||||||||||||||||||||||||||||||||
g105-1      PVSGSVGPATNGTLLILFGGSEAVLNPLQKIFSLVGKKTFHFGDVGKGSGAKLVLNSLLG
             130        140        150        160        170        180

190        200        210        220        230        240
m105-1.pep  IFGEAYSEXMLMARQFGIDTDTIVEAIGDSAMDSPMFQTKKSLWANREFPPAFALKHASK
            ||||||||  ||||||||||||||||||| ||||||||||||||||||||||||||||||
g105-1      IFGEAYSEAMLMARQFGIDTDTIVEAIGGSAMDSPMFQTKKSLWANREFPPAFALKHASK
             190        200        210        220        230        240

250        260        270        280        290
m105-1.pep  DLNLAVKELEQAGNTLPAVETVAASYRKAVEAGYGEQDVSGVYLKLAEHX
            ||||||||||||||||||||||||||||||||||||||||||||||||||
g105-1      DLNLAVKELEQAGNTLPAVETVAASYRKAVEAGYGEQDVSGVYLKLAEHX
             250        260        270        280        290
```

The following partial DNA sequence was identified in *N. meningitidis* <SEQ ID 373>:

```
a105-1.seq
    1    ATGTCCGCAA ACGAATACAC ACAAATCGGC TGGATAGGCT TAGGGCAAAT

51    GGGTCTGCCT ATGGTAACGC GGCTCTTGGA CGGCGGCATC GAAGTCGGCG

101    TATACAACCG CTCGCCCGAC AAAACTGCCC CCATCTCCGC CAAAGGCGCA

151    AAAGTTTACG GCAACACCGC CGAACTCGTC CGCGACTATC CCGTCATTTT

201    CCTGATGGTT TCCGACTATG CCGCCGTGTG CGACATCCTG AACGGAGTCC

251    GCGACGGATT GGCCGGCAAA ATCATCGTCA ACATGAGCAC CATCTCCCCG

301    ACCGAAAACC TCGCCGTCAA AGCACTTGTC GAAGCCGCAG GCGGACAGTT

351    TGCCGAAGCA CCCGTTTCCG GATCGGTCGG GCCCGCCACC AACGGCACGC

401    TGCTGATTCT GTTCGGCGGC AGCGAAGCCG TTTTAAACCC GCTGCAAAAA

451    ATATTTTCCC TCGTCGGCAA AAAAACCTTC CATTTCGGCG ATGTCGGCAA

501    AGGTTCGGGC GCGAAACTCG TCTTGAACTC GCTCTTGGGC ATTTTCGGCG

551    AAGCGTACAG CGAAGCGATG CTGATGGCGC GGCAGTTCGG CATCGATACC

601    GACACCATCG TCGAAGCCAT CGGCGGCTCG GCAATGGACT CGCCCATGTT

651    CCAAACCAAA AAATCCCTGT GGGCAAACCG CGAATTCCCA CCCGCCTTCG

701    CCCTCAAACA CGCCTCCAAA GACCTCAACC TCGCCGTCAA AGAGCTTGAA

751    CAGGCAGGCA ACACCCTGCC CGCCGTCGAA ACCGTTGCTG CCAGCTACCG

801    CAAAGCAGTC GAAGCCGGCT ACGGCGAACA GGACGTTTCC GGCGTTTACC

851    TGAAATTGGC AGAACACTGA
```

This corresponds to the amino acid sequence <SEQ ID 374; ORF 105-1.a>:

```
a105-1.pep
    1    MSANEYTQIG WIGLGQMGLP MVTRLLDGGI EVGVYNRSPD KTAPISAKGA

51    KVYGNTAELV RDYPVIFLMV SDYAAVCDIL NGVRDGLAGK IIVNMSTISP

101    TENLAVKALV EAAGGQFAEA PVSGSVGPAT NGTLLILFGG SEAVLNPLQK

151    IFSLVGKKTF HFGDVGKGSG AKLVLNSLLG IFGEAYSEAM LMARQFGIDT
```

```
   201   DTIVEAIGGS AMDSPMFQTK KSLWANREFP PAFALKHASK DLNLAVKELE

251   QAGNTLPAVE TVAASYRKAV EAGYGEQDVS GVYLKLAEH*
``` a105-1/m105-1 99.0% identity in 289 aa overlap

```
                   10         20         30         40         50         60
   a105-1.pep  MSANEYTQIGWIGLGQMGLPMVTRLLDGGIEVGVYNRSPDKTAPISAKGAKVYGNTAELV
               ||||||:|||||||||||||||||||||||||||||||||||||||||||||||||||||
   m105-1      MSANEYAQIGWIGLGQMGLPMVTRLLDGGIEVGVYNRSPDKTAPISAKGAKVYGNTAELV
                   10         20         30         40         50         60

70         80         90        100        110        120
   a105-1.pep  RDYPVIFLMVSDYAAVCDILNGVRDGLAGKIIVNMSTISPTENLAVKALVEAAGGQFAEA
               ||||||||||||||||||||||||||||||||||||||||||||||||||||||||||||
   m105-1      RDYPVIFLMVSDYAAVCDILNGVRDGLAGKIIVNMSTISPTENLAVKALVEAAGGQFAEA
                   70         80         90        100        110        120

130        140        150        160        170        180
   a105-1.pep  PVSGSVGPATNGTLLILFGGSEAVLNPLQKIFSLVGKKTFHFGDVGKGSGAKLVLNSLLG
               ||||||||||||||||||||||||||||||||||||||||||||||||||||||||||||
   m105-1      PVSGSVGPATNGTLLILFGGSEAVLNPLQKIFSLVGKKTFHFGDVGKGSGAKLVLNSLLG
                  130        140        150        160        170        180

190        200        210        220        230        240
   a105-1.pep  IFGEAYSEAMLMARQFGIDTDTIVEAIGGSAMDSPMFQTKKSLWANREFPPAFALKHASK
               ||||||||| |||||||||||||||||||| |||||||||||||||||||||||||||||
   m105-1      IFGEAYSEXMLMARQFGIDTDTIVEAIGDSAMDSPMFQTKKSLWANREFPPAFALKHASK
                  190        200        210        220        230        240

250        260        270        280        290
   a105-1.pep  DLNLAVKELEQAGNTLPAVETVAASYRKAVEAGYGEQDVSGVYLKLAEHX
               ||||||||||||||||||||||||||||||||||||||||||||||||||
   m105-1      DLNLAVKELEQAGNTLPAVETVAASYRKAVEAGYGEQDVSGVYLKLAEHX
                  250        260        270        280        290
```

The following partial DNA sequence was identified in *N. gonorrhoeae* <SEQ ID 375>:

```
g107.seq
     1   ATGGTATTAA CCTTTATTTG GCAACCGGC GGCCTGGTTG CCGATGCCAA

51   ACCGTCCGTC CTCTTCGACA CCCAAGCCCC CGTCGGCACC GGCTACTGGA

101   TTTACGCCGC CACCGCCCTG CCCGTCTGCC TCGCTTCCTT CGGCTTCCAC

151   GGCAACGTTT CCAGCCTGCT CAAATACTTT AAAGGCGACG cgCCaaagt

201   GgCGAaATCc atctggGcag gtacattggT TGCCttggta atttacgtcc

251   TCTggcaaac cgccatCcaa agcaaccTGC cgcgcaacga gttcgcCCCc 301   gtgattgccg ccgagaggca actCTCCGTC CTgaatgaaa cccTGtccaa 351   attcgcccaa accggcgata tggataAaat attgtcccta tttccctaca 401   tggcaatcgc cacctccttt ttaggcgTAA Ccttaggcct gtttgacaac 451   atcgccggac atcttcaaat ggaacgacag tatgtccggg cggcaccaaa 501   accgtcgcgc tga
```

This corresponds to the amino acid sequence <SEQ ID 376; ORF 107.ng>:

```
g107.pep
     1   MVLTFIWATG GLVADAKPSV LFDTQAPVGT GYWIYAATAL PVCLASFGFH

51   GNVSSLLKYF KGDAPKVAKS IWAGTLVALV IYVLWQTAIQ SNLPRNEFAP

101   VIAAERQLSV LNETLSKFAQ TGDMDKILSL FPYMAIATSF LGVTLGLFDN

151   IAGHLQMERQ YVRAAPKPSR *
```

The following partial DNA sequence was identified in *N. meningitidis* <SEQ ID 377>:

```
m107.seq
    1   ATGGTATTGA CCTTTATTTG GGCGGCCGGC GGGCTGATTG CCGATGCCAA

51   GCCGTCCGTC CTCTTCGATA CCCAAGCCCC CGCCGGCACA AACTACTGGA

101   TTTACGCCGs CACCGCCCTG CCCGTCTGCC TCGCTTCCTT CGGCTTCCAC

151   GGCAACGTCT CCAGCCTGCT CAAATACTTT AAAGGCGACG CGCCCAAAGT

201   GGCTAAATCC ATCTGGACGG GCACACTGAT TGCGCTGGTA ATTTACGTCC

251   TCTGGCAAAC CGCCATCCAA GGCAACCTGC CGCGCAACGA GTTCGCCCCC

301   GTCATCGCCG CCGAAGGGCA AGTCTCCGTC CTCATCGAAA CCCTGTCCAA

351   ATTCGCCCAA ACCGGCAATA TGGACAAAAT ATTGTCCCTG TTTTCCTATA

401   TGGCGATCGC CACCTCGTTT TTAGGCGTAA CGCTCGGACT CTTCGACTAC

451   ATCGCCCATC TTCAAATGGA ACGACAGCAT CTCCGGgCCG CACCAAAACC

501   GCCGCGCTGA
```

This corresponds to the amino acid sequence <SEQ ID 378; ORF 107>:

```
m107.pep..
    1   MVLTFIWAAG GLIADAKPSV LFDTQAPAGT NYWIYAXTAL PVCLASFGFH

51   GNVSSLLKYF KGDAPKVAKS IWTGTLIALV IYVLWQTAIQ GNLPRNEFAP

101   VIAAEGQVSV LIETLSKFAQ TGNMDKILSL FSYMAIATSF LGVTLGLFDY

151   IAHLQMERQH LRAAPKPPR*
```

Computer analysis of this amino acid sequence gave the following results:
Homology with a Predicted ORF from *N. gonorrhoeae*
ORF 107 shows 89.4% identity over a 170 aa overlap with a predicted ORF (ORF 107.ng) from *N. gonorrhoeae*:

```
m107/g107
                   10         20         30         40         50         60
    m107.pep  MVLTFIWAAGGLIADAKPSVLFDTQAPAGTNYWIYAXTALPVCLASFGFHGNVSSLLKYF
              ||||||||:|||:||||||||||||||:||:|||| ||||||||||||||||||||||||
        g107  MVLTFIWATGGLVADAKPSVLFDTQAPVGTGYWIYAATALPVCLASFGFHGNVSSLLKYF
                   10         20         30         40         50         60

70         80         90        100        110        120
    m107.pep  KGDAPKVAKSIWTGTLIALVIYVLWQTAIQGNLPRNEFAPVIAAEGQVSVLIETLSKFAQ
              ||||||||||:|||:||||||||||||||:|||||||||||||||:|||  |||||||||
        g107  KGDAPKVAKSIWAGTLVALVIYVLWQTAIQSNLPRNEFAPVIAAERQLSVLNETLSKFAQ
                   70         80         90        100        110        120

130        140        150        160        170
    m107.pep  TGNMDKILSLFSYMAIATSFLGVTLGLFDYIA-HLQMERQHLRAAPKPPR
              ||:|||||||| ||||||||||||||||||:| ||||||:|||||||:|
        g107  TGDMDKILSLFPYMAIATSFLGVTLGLFDNIAGHLQMERQYVRAAPKPSR
                  130        140        150        160        170
```

The following partial DNA sequence was identified in *N. meningitidis* <SEQ ID 379>:

```
a107.seq
    1   ATGGTATTAA CCTTTATTTG GGCAACCGGC GGCCTGATTG CCGATGCCAA

51   ACTGCCCGTC CTCTTCGACA CCCAAGCCCC TACCGGCACC AACTACTGGA

101   TTTATGTCGC CACCGCCCTG CCCGTCTGCC TTGCGTCATT CGGTTTCCAC

151   GGCAACGTCT CCAGCCTGCT CAAATACTTT AAAGGCGACG CGCCCAAAGT

201   GGCTAAATCC ATCTGGACGG GCACACTGAT TGCGCTGGTA ATTTACGTCC
```

```
-continued
251  TCTGGCAAAC CGCCATCCAA GGCAACCTGC CGCGCAACGA GTTCGCCCCC

301  GTGATTGCCG CCGAAGGGCA AGTCTCCGTC CTGATTGAAA CCCTGTCCAA

351  ATTCGCCCAA ACCGGCAATA TGGACAAAAT ATTGTCCCTG TTTTCCTATA

401  TGGCGATCGC CACCTCGTTT TTAGGCGTAA CGCTCGGACT CTTCGACTAC

451  ATCGCCGACA TCTTCAAATG GAACGACAGC GTGTCCGGCC GCACCAAAAC

501  CGCCGCGCTG ACCTTCCTGC CGCCTCTAAT TTCCTGCCTG CTCTTCCCCA

551  CCGGCTTTGT TACCGCCATC GGCTACGTCG GCCTGGCGGC AACCGTCTGG

601  ACAGGCATCA TCCCCGCCAT GCTGCTCTAC CGTTCGCGCA AAAAATTCGG

651  CGCAGGCAAA ACCTATAAAG TTTACGGCGG CTTGTGGCTG ATGGTTTGGG

701  TCTTCCTTTT CGGCATCGTC AACATCGCCG CACAGGTATT GAGCCAAATG

751  GAACTCGTCC CCGTATTTAA AGGATAA
```

This corresponds to the amino acid sequence <SEQ ID 380; ORF 107.a>:

```
a107.pep
   1  MVLTFIWATG GLIADAKLPV LFDTQAPTGT NYWIYVATAL PVCLASFGFH

51  GNVSSLLKYF KGDAPKVAKS IWTGTLIALV IYVLWQTAIQ GNLPRNEFAP

101  VIAAEGQVSV LIETLSKFAQ TGNMDKILSL FSYMAIATSF LGVTLGLFDY

151  IADIFKWNDS VSGRTKTAAL TFLPPLISCL LFPTGFVTAI GYVGLAATVW

201  TGIIPAMLLY RSRKKFGAGK TYKVYGGLWL MVWVFLFGIV NIAAQVLSQM

251  ELVPVFKG*
``` m107/a107 94.8% identity in 154 aa overlap

```
                10         20         30         40         50         60
m107.pep  MVLTFIWAAGGLIADAKPSVLFDTQAPAGTNYWIYAXTALPVCLASFGFHGNVSSLLKYF
          ||||||||:|||||||| ||||||||:||||||| :|||||||||||||||||||||||
a107      MVLTFIWATGGLIADAKLPVLFDTQAPTGTNYWIYVATALPVCLASFGFHGNVSSLLKYF
                10         20         30         40         50         60

70         80         90        100        110        120
m107.pep  KGDAPKVAKSIWTGTLIALVIYVLWQTAIQGNLPRNEFAPVIAAEGQVSVLIETLSKFAQ
          ||||||||||||||||||||||||||||||||||||||||||||||||||||||||||||
a107      KGDAPKVAKSIWTGTLIALVIYVLWQTAIQGNLPRNEFAPVIAAEGQVSVLIETLSKFAQ
                70         80         90        100        110        120

130        140        150        160        170
m107.pep  TGNMDKILSLFSYMAIATSFLGVTLGLFDYIAHLQMERQHLRAAPKPPRX
          |||||||||||||||||||||||||||||| :
a107      TGNMDKILSLFSYMAIATSFLGVTLGLFDYIADIFKWNDSVSGRTKTAALTFLPPLISCL
                130        140        150        160        170        180 a107      LFPTGFVTAIGYVGLAATVWTGIIPAMLLYRSRKKFGAGKTYKVYGGLWLMVWVFLFGIV
                190        200        210        220        230        240
```

The following partial DNA sequence was identified in N. gonorrhoeae <SEQ ID 381>:

```
g108.seq
   1  ATGttgccgg gCTTCAACCG GATATTCAaa cggTTTGCTC CAACACTCGG

51  AAcggCGCAT AAAACGCCgc ccTTCGCGTT ATCCCGAACG GGCGGCTAA

101  TCAGATCCTA TCGCCATAAA AGGCGGGGTT CAACCGAAA AGGAATTGAG

151  ATGAATAAAA CCTTGTCTAT TTTGCCGGCG GCAATCTTAC TCGGCGGGTG

201  CGCCGCCGGC GGCAACACAT TCGGCAGCTT AGACGGCGGC ACGGGTATGG
```

-continued

```
251   GTGGCAGCAT CGTCAAAATG ACGGTAGAAA gccAATGCCG TGCGGAATTG

301   GACAGGCGCA GCGAATGGCG TTTGACCGCG CTGGCGATGA GTGCCGAAAA

351   ACAGGCGGAA TGGGAAAACA AGATTTGCGG CTGCGCTACC GAAGAAGCAC

401   CTAACCAGCT GACCGGCAAC GATGTGATGC AGATGCTGAa ccagtccacG

451   CGCaatcagg cacTtgccgc CCtgaccgTC AAAacggtTT CcgcctgcTT

501   CAaacgcctg tACCGCTAa
```

This corresponds to the amino acid sequence <SEQ ID 382; ORF 108.ng>:

```
g108.pep
  1   MLPGFNRIFK RFAPTLGTAH KTPPFALSRT GRLIRSYRHK RRGFNRKGIE

51   MNKTLSILPA AILLGGCAAG GNTFGSLDGG TGMGGSIVKM TVESQCRAEL

101   DRRSEWRLTA LAMSAEKQAE WENKICGCAT EEAPNQLTGN DVMQMLNQST

151   RNQALAALTV KTVSACFKRL YR*
```

The following partial DNA sequence was identified in *N. meningitidis* <SEQ ID 383>:

```
m108.seq
  1   ATGTTGCCGG GCTTCAACCG GATATTCAAA CGGTTTGTTC CAACACTCGG

51   AACGGCGCAT AAAACGCCGC CCTTCGCGTT ATCCCGAACG GGGCGGCTAA

101   TCAGATTCTA TCGCCATAAA AGGCGGGGTT TCAACCGAAA AGGAATTGAG

151   ATGAATAAAA CCTTGTCTAT TTTGCCGGTG GCAATCTTAC TCGGCGGCTG

201   CGCCGCCGGA GGCGGTAACA CATTCGGCAG CTTAGACGGT GGCACAGGCA

251   TGGGCGGCAG CATCGTCAAA ATGGCGGTTG GGAGCCAATG CCGTGCGGAA

301   TTGGACAAAC GCAGCGAATG GCGTTTGACC GCGCTGGCGA TGAGTGCCGA

351   AAAACAGGCG GAGTGGGAAA ACAAGATTTG CGCTTGCGTC GCCCAAGAAG

401   CACCCGAACG GATGACCGGC AACGATGTGA TGCAGATGCT GGCTCCGTCC

451   ACGCGCAATC AGGCACTTGC CGCCCTGACC GCCAAAACGG TTTCCGCCTG

501   CTTCAAACAC CTGTACCGCT AA
```

This corresponds to the amino acid sequence <SEQ ID 384; ORF 108>:

```
m108.pep
  1   MLPGFNRIFK RFVPTLGTAH KTPPFALSRT GRLIRFYRHK RRGFNRKGIE

51   MNKTLSILPV AILLGGCAAG GNTFGSLDG GTGMGGSIVK MAVGSQCRAE

101   LDKRSEWRLT ALAMSAEKQA EWENKICACV AQEAPERMTG NDVMQMLAPS

151   TRNQALAALT AKTVSACFKH LYR*
```

Computer analysis of this amino acid sequence gave the following results:

Homology with a Predicted ORF from *N. gonorrhoeae*

ORF 108 shows 89.6% identity over a 173 aa overlap with a predicted ORF (ORF 108.ng) from *N. gonorrhoeae*:

```
m108/g108
                   10        20        30        40        50        60
m108.pep   MLPGFNRIFKRFVPTLGTAHKTPPFALSRTGRLIRFYRHKRRGFNRKGIEMNKTLSILPV
           ||||||||||||:||||||||||||||||||||| ||||||||||||||||||||||||:
g108       MLPGFNRIFKRFAPTLGTAHKTPPFALSRTGRLIRSYRHKRRGFNRKGIEMNKTLSILPA
                   10        20        30        40        50        60

70        80        90       100       110       120
m108.pep   AILLGGCAAGGGNTFGSLDGGTGMGGSIVKMAVGSQCRAELDKRSEWRLTALAMSAEKQA
           |||||||||| ||||||||||||||||||:| |||||||:|||||||||||||||||
g108       AILLGGCAAGG-NTFGSLDGGTGMGGSIVKMTVESQCRAELDRRSEWRLTALAMSAEKQA
                   70        80        90       100       110

130       140       150       160       170
m108.pep   EWENKICACVAQEAPERMTGNDVMQMLAPSTRNQALAALTAKTVSACFKHLYRX
           ||||||:|:::|||:::|||||||||  |||||||||||:||||||||:|||
g108       EWENKICGCATEEAPNQLTGNDVMQMLNQSTRNQALAALTVKTVSACFKRLYRX
         120       130       140       150       160       170
```

The following partial DNA sequence was identified in *N. meningitidis* <SEQ ID 385>:

```
a108.seq
    1   ATGTTGCCGG GCTTCAACCG GATATTCAAA CGGTTTGTTC CAACACTCGG

51   AACGGCGCAT AAAACGCCGC CCTTCGCGTT ATCCCGAACG GGGCGGCTAA

101   TCAGATTCTA TCGCCATAAA AGGCGGGGTT TCAACCGAAA AGGAATTGAG

151   ATGAATAAAA CCTTGTCTAT TTTGCCGGTG GCAATCTTAC TCGGCGGCTG

201   CGCCGCCGGG GGCGGTAACA CATTCGGCAG CTTAGACGGC GGCACAGGTA

251   TGGGCGGCAG CATCGTCAAA ATGGCGGTAG AAAGCCAATG CCGTGCGGAA

301   TTGAACAAAC GCAGCGAATG GCGTTTGACC GCGCTGGCGA TGAGTGCCGA

351   AAAACAGGCG GAATGGGAAA ACAAGATTTG CGCTTGCGTC GCCCAAGAAG

401   CACCCAACCA GCTGACCGGC AACGATGTGA TGCAGATGCT GGATCCGTCC

451   ACGCGCAATC AGGCACTTGC CGCCCTGACC GCCAAAACGG TTTCCGCCTG

501   CTTCAAACAC CTGTACCGCT AA
```

This corresponds to the amino acid sequence <SEQ ID 386; ORF 108.a>:

```
a108.pep
    1   MLPGFNRIFK RFVPTLGTAH KTPPFALSRT GRLIRFYRHK RRGFNRKGIE

51   MNKTLSILPV AILLGGCAAG GGNTFGSLDG GTGMGGSIVK MAVESQCRAE

101   LNKRSEWRLT ALAMSAEKQA EWENKICACV AQEAPNQLTG NDVMQMLDPS

151   TRNQALAALT AKTVSACFKH LYR*
``` m108/a108 96.5% identity in 173 aa overlap

```
                   10        20        30        40        50        60
m108.pep   MLPGFNRIFKRFVPTLGTAHKTPPFALSRTGRLIRFYRHKRRGFNRKGIEMNKTLSILPV
           ||||||||||||||||||||||||||||||||||||||||||||||||||||||||||||
a108       MLPGFNRIFKRFVPTLGTAHKTPPFALSRTGRLIRFYRHKRRGFNRKGIEMNKTLSILPV
                   10        20        30        40        50        60

70        80        90       100       110       120
m108.pep   AILLGGCAAGGGNTFGSLDGGTGMGGSIVKMAVGSQCRAELDKRSEWRLTALAMSAEKQA
           |||||||||||||||||||||||||||||||| |||||||:|||||||||||||||||
a108       AILLGGCAAGGGNTFGSLDGGTGMGGSIVKMAVESQCRAELNKRSEWRLTALAMSAEKQA
                   70        80        90       100       110       120
```

```
                      130        140        150        160        170
m108.pep  EWENKICACVAQEAPERMTGNDVMQMLAPSTRNQALAALTAKTVSACFKHLYRX
          |||||||||||||||:::||||||||| ||||||||||||||||||||||||
a108      EWENKICACVAQEAPNQLTGNDVMQMLDPSTRNQALAALTAKTVSACFKHLYRX
                      130        140        150        160        170
```

The following partial DNA sequence was identified in *N. gonorrhoeae* <SEQ ID 387>:

```
g109.seq
    1   ATGTATTATC GCCGGGTTGT GGGGCTATCC GATGGACTTG GCGATTTGGC
   51   AGCCGGTATT GATCGTAGGC GTATGCTTAC CGCTTTTGGA AGCGGGCATG
  101   GAAATGACGC GCAAAGGCAA AACCACCCAA TCCGCCGCCA TCGTGGTGTT
  151   CTCTTCCGTC TGGTCAATCC GGTTTTCGGC TGGGCGTTGA CGATGCTGTT
  201   GGATAATTTG GCTTAATCG GCTGCAAAGA ACGCAGCGCG CAATTAGGTT
  251   TTGTCGGACG AGTATTGATA CCCGCAGTAG GTTTCTTAAT CTTGTGTGTG
  301   GCGATGGGTG CGGTCGGGAT GCTGCCCGGT ATCCCTCCGT TTTTGGAGCA
  351   GTTCAAATCT TTGGGCTAG
```

This corresponds to the amino acid sequence <SEQ ID 388; ORF 109.ng>:

```
g109.pep
    1   MYYRRVVGLS DGLGDLAAGI DRRRMLTAFG SGHGNDAQRQ NHPIRRHRGV
   51   LFRLVNPVFG WALTMLLDNL GLIGCKERSA QLGFVGRVLI PAVGFLILCV
  101   AMGAVGMLPG IPPFLEQFKS LG
```

The following partial DNA sequence was identified in *N. meningitidis* <SEQ ID 389>:

```
m109.seq
    1   ATGTATTATC GCCGGGTTAT GGGGCTATCC GATGGACTTG GCGATTTGGC
   51   AGCCGGTATT GAGCGTAGCC TTGGTCGTAG GCGTATACTT ACCGCTTTTG
  101   GAAGCGGGCA TGGAAATGAC GCGCAAAGGC AAAACCACCC AATCCGCCGC
  151   CATCGTGGTG TTCTCTTCCG CCTTGTCAAT CCGGTTTTCG GCTGGGCGTT
  201   GACGATGCTG TTGGATAATT TGGGCTTAAT CGGCTGCAAA GAGCGCAGTG
  251   CGCAATTAGG TTTCGCCGGA CGCGTGTTGA TACCCGCAGT AGGTTTCTTG
  301   ATCTTGTGTG TGGCGATGGG TGCGGTCGGG ATGCTGCCCG GTATCCCGCC
  351   GTTTTTGGAA CACTTCAAAT CTTTGGGCTA G
```

This corresponds to the amino acid sequence <SEQ ID 4; ORF 109>:

```
m109.pep
    1   MYYRRVMGLS DGLGDLAAGI ERSLGRRRIL TAFGSGHGND AQRQNHPIRR
   51   HRGVLFRLVN PVFGWALTML LDNLGLIGCK ERSAQLGFAG RVLIPAVGFL
  101   ILCVAMGAVG MLPGIPPFLE HFKSLG*
```

Computer analysis of this amino acid sequence gave the following results:
Homology with a Predicted ORF from *N. gonorrhoeae*
ORF 109 shows 92.9% identity over a 126 aa overlap with a predicted ORF (ORF 109.ng) from *N. gonorrhoeae*:

```
         m109/g109
                          10        20        30        40        50        60
         m109.pep  MYYRRVMGLSDGLGDLAAGIERSLGRRRILTAFGSGHGNDAQRQNHPIRRHRGVLFRLVN
                   ||||||:|||||||||||||:|   ||:|||||||||||||||||||||||||||||||
         g109      MYYRRVVGLSDGLGDLAAGIDR----RRMLTAFGSGHGNDAQRQNHPIRRHRGVLFRLVN
                          10        20            30        40        50

70        80        90       100       110       120
         m109.pep  PVFGWALTMLLDNLGLIGCKERSAQLGFAGRVLIPAVGFLILCVAMGAVGMLPGIPPFLE
                   |||||||||||||||||||||||||||||:||||||||||||||||||||||||||||||
         g109      PVFGWALTMLLDNLGLIGCKERSAQLGFVGRVLIPAVGFLILCVAMGAVGMLPGIPPFLE
                          60        70        80        90       100       110 m109.pep  HFKSLGX
                   :|||||
         g109      QFKSLGX
                          120
```

The following partial DNA sequence was identified in *N. meningitidis* <SEQ ID 391>:

```
a109.seq
    1   ATGTATTATC GCCGGGTTGT GGGGCTATCC GATGGACTTG GCGATTTGGC

51   AGCCGGTATT GAGCGTAGCC TTGGTCGTAG GCGTATACTT ACCGCTTTTG

101   GAAGCGGGCA TGGAAATGAC GCGCAAAGGC AAAACCACCC AATCCGCCGC

151   CACCGTGGTG TTCTCTTCCG CTTGGTCAAT CCGGTTTTCG GCTGGGCGTT

201   GACGATGCTG TTGGATAATT TGGGCTTAAT CGGCTGCAAA GAGCGCAGCG

251   CGCAATTAGG TTTCACCGGA CGCGTATTGA TACCCGTAGT AGGTTTCTTG

301   ATCTTGTGTG TGGCGATGGG TGCGGTCGGG ATGCTGCCCG GTATCCCGCC

351   GTTTTTGGAG CACTTCAAAT CTTTGGGCTA G
```

This corresponds to the amino acid sequence <SEQ ID 392; ORF 109>:

```
a109.pep
    1   MYYRRVVGLS DGLGDLAAGI ERSLGRRRIL TAFGSGHGND AQRQNHPIRR

51   HRGVLFRLVN PVFGWALTML LDNLGLIGCK ERSAQLGFTG RVLIPVVGFL

101   ILCVAMGAVG MLPGIPPFLE HFKSLG*
``` m109/a109 97.6% identity in 126 aa overlap

```
                          10        20        30        40        50        60
         m109.pep  MYYRRVMGLSDGLGDLAAGIERSIGRRRILTAFGSGHGNDAQRQNHPIRRHRGVLFRLVN
                   ||||||:|||||||||||||||||||||||||||||||||||||||||||||||||||||
         a109      MYYRRVVGLSDGLGDLAAGIERSLGRRRILTAFGSGHGNDAQRQNHPIRRHRGVLFRLVN
                          10        20        30        40        50        60

70        80        90       100       110       120
         m109.pep  PVFGWALTMLLDNLGLIGCKERSAQLGFAGRVLIPAVGFLILCVAMGAVGMLPGIPPFLE
                   ||||||||||||||||||||||||||||:||||||:|||||||||||||||||||||||
         a109      PVFGWALTMLLDNLGLIGCKERSAQLGFTGRVLIPVVGFLILCVAMGAVGMLPGIPPFLE
                          70        80        90       100       110       120 m109.pep  HFKSLGX
                   |||||||
         a109      HFKSLGX
```

The following partial DNA sequence was identified in *N. gonorrhoeae* <SEQ ID 393>:

```
g111.seq
    1   ATGCCGTCTG AAACACGCCT GCCGAACCTT ATCCGCGCCT TGATATTTGC
   51   CCTGGGTTTC ATCTTCCTGA ACGCCTGTTC GGaacaaacC GCGCAaaccg
  101   TTACCCTGCA AGGCGAAACG ATGGGTACGA CCtATACCGT CAAATACCTT
  151   TCAAATAATC GGGACAAACT CCCCTCCCCT GCCAAAATAC AAAAGCGCAT
  201   TGATGATGCG CTTAAAGAAG TCAACCGGCA GATGtccaCC TACCAGACCG
  251   ATTCCGAAAT CAGCCGGTTt atacagacan atgctggaga gctcttcgcg
  301   tntcatgcag nttctataac tgattccgcc gaagactgtc tgcctaatac
  351   gcctatctca tcggcgctct ga
```

This corresponds to the amino acid sequence <SEQ ID 394; ORF 111.ng>:

```
g111.pep
    1   MPSETRLPNL IRALIFALGF IFLNACSEQT AQTVTLQGET MGTTYTVKYL
   51   SNNRDKLPSP AKIQKRIDDA LKEVNRQMST YQTDSEISRF IQTAGELFAH
  101   ASITDSAEDC LPNTPISSAL *
```

The following partial DNA sequence was identified in *N. meningitidis* <SEQ ID 395>:

```
m111.seq
    1   ATGCCGTCTG AAACACGCCT GCCGAACTTT ATCCGCGTCT TGATATTTGC
   51   CCTGGGTTTC ATCTTCCTGA ACGCCTGTTC GGAACAAACC GCGCAAACCG
  101   TTACCCTGCA AGGCGAAACG ATGGGCACGA CCTATAyCGT CAAATACCTT
  151   TCAAATAATC GGGACAAACT CCCCTCACCT GCCGAAATAC AwAAACGCAT
  201   CGATGACGCG CTTAAAGAAk TCAACCGGyA GATGTCCACC TATCAGCCCG
  251   ACTCCGAAAT CAGCCGGTTC AACCAACACA CAGCCGGCAA GCCCCTCCGC
  301   ATTTCAAGCG ACTTCGCACA CGTTACTGCC GAAGCCGTCC GCCTGAACCG
  351   CCTGACACAC GGCGCGCTGG ACGTAACCGT CGGCCCCTTG GTCAACCTTT
  401   GGGGATTCGG CCCCGACAAA TCCGTTACCC GTGAACCGTC GCCGGAACAA
  451   ATCAAACAGG CGGCATCTTA TACGGGCATA GACAAAATCA TTTTGAAACA
  501   AGGCAAAGAT TACGCTTCCT TGAGCAAAAC CCACCCCAAG GCCTATTTGG
  551   ATTTATCTTC GATTGCCAAA GGCTTCGGCG TTGATAAAGT TGCGGGCGAA
  601   CTGGAAAAAT ACGGCATTCA AAATTATCTG GTCGAAATCG GCGGCGAGTT
  651   GCACGGCAAA GGCAAAAACG CGCGCGGCGA ACCGTGGCGC ATCGGTATCG
  701   AGCAGCCCAA TATCGTCCAA GGCGGCAATA CGCAGATTAT CGTCCCGCTG
  751   AACAACCGTT CGCTTGCCAC TTCCGGCGAT TACCGTATTT CCACGTCGA
  801   TAAAAACGGC AAACGCCTCT CCCATATCAT CAACCCGAAC AACAAACGAC
  851   CCATCAGCCA CAACCTCGCC TCCATCAGCG TGGTCGCAGA CAGTGCGATG
  901   ACGGCGGACG GCTTGTCCAC AGGATTATTC GTATTGGGCG AAACCGAAGC
  951   CTTAAAGCTG GCAGAGCGCG AAAAACTCGC TGTTTTCCTG ATTGTCAGGG
 1001   ATAAAGGCGG cTACCGCACC GCCATGTCTT CCGAATTTGA AAAACTGcTC
 1051   CGCTAA
```

This corresponds to the amino acid sequence <SEQ ID 396; ORF 111>:

```
m111.pep
    1   MPSETRLPNF IRVLIFALGF IFLNACSEQT AQTVTLQGET MGTTYXVKYL

51   SNNRDKLPSP AEIXKRIDDA LKEXNRXMST YQPDSEISRF NQHTAGKPLR

101   ISSDFAHVTA EAVRLNRLTH GALDVTGPL VNLWGFGPDK SVTREPSPEQ

151   IKQAASYTGI DKIILKQGKD YASLSKTHPK AYLDLSSIAK GFGVDKVAGE

201   LEKYGIQNYL VEIGGELHGK GKNARGEPWR IGIEQPNIVQ GGNTQIIVPL

251   NNRSLATSGD YRIFHVDKNG KRLSHIINPN NKRPISHNLA SISVVADSAM

301   TADGLSTGLF VLGETEALKL AEREKLAVFL IVRDKGGYRT AMSSEFEKLL

351   R*
```

ORF 111 shows 88.7% identity over a 97 aa overlap with a predicted ORF (ORF 111.ng) from *N. gonorrhoeae*:

```
    m111.pep/g111.pep
                  10         20         30         40         50         60
    m111.pep   MPSETRLPNFIRVLIFALGFIFLNACSEQTAQTVTLQGETMGTTYXVKYLSNNRDKLPSP
               ||||||||||:||:||||||||||||||||||||||||||||||:|||||||||||||||
    g111       MPSETRLPNLIRALIFALGFIFLNACSEQTAQTVTLQGETMGTTYTVKYLSNNRDKLPSP
                  10         20         30         40         50         60

70         80         90        100        110        120
    m111.pep   AEIXKRIDDALKEXNRXMSTYQPDSEISRFNQHTAGKPLRISSDFAHVTAEAVRLNRLTH
               |:| ||||||||| || ||||| |||||| ||||||| | |  :||:
    g111       AKIQKRIDDALKEVNRQMSTYQTDSEISRFIQTXAGELFAXHAXSITDSAEDCLPNTPIS
                  70         80         90        100        110        120

130        140        150        160        170        180
    m111.pep   GALDVTVGPLVNLWGFGPDKSVTREPSPEQIKQAASYTGIDKIILKQGKDYASLSTHPK g111       SALX
```

The following partial DNA sequence was identified in *N. meningitidis* <SEQ ID 397>:

```
a111.seq
    1   ATGCCGTCTG AAACACGCCT GCCGAACTTT ATCCGCACCT TGATATTTGC

51   CCTGAGTTTT ATCTTCCTGA ACGCCTGTTC GGAACAAACC GCGCAAACCG

101   TTACCCTGCA AGGTGAAACG ATGGGCACGA CCTATACCGT CAAATACCTT

151   TCAAATAATC GGGACAAACT CCCCTCACCT GCCGAAATAC AAAAGCGCAT

201   CGATGACGCG CTTAAAGAAG TCAACCGGCA GATGTCCACC TATCAGCCCG

251   ACTCCGAAAT CAGCCGGTTC AACCAACACA CAGCCGGCAA GCCCCTCCGC

301   ATTTCAAGCG ACTTCGCACA CGTTACTGCC GAAGCCGTCC ACCTGAACCG

351   CCTGACACAC GGCGCGCTGG ACGTAACCGT CGGCCCCTTG GTCAACCTTT

401   GGGGATTCGG CCCCGACAAA TCCGTTACCC GTGAACCGTC GCCGGAACAA

451   ATCAAACAAG CAGCATCTTA TACGGGCATA GACAAAATCA TTTTGAAACA

501   AGGCAAAGAT TACGCTTCCT TGAGCAAAAC CCACCCCAAG GCCTATTTGG

551   ATTTATCTTC GATTGCCAAA GGCTTCGGCG TTGATAAAGT TGCGGGCGAA

601   CTGGAAAAAT ACGGCATTCA AAATTATCTG GTCGAAATCG GCGGCGAGTT

651   GCACGGCAAA GGCAAAAACG CGCGCGGCGA ACCTTGGCGC ATCGGCATCG

701   AACAGCCCAA CATCGTCCAA GGCGGCAATA CGCAGATTAT CGTCCCGCTG

751   AACAACCGTT CGCTTGCCAC TTCCGGCGAT TACCGTATTT TCCACGTCGA
```

```
 801  TAAAAGCGGC AAACGCCTCT CCCATATCAT TAATCCGAAC AACAAACGAC

851  CCATCAGCCA CAACCTCGCC TCCATCAGCG TGGTCGCAGA CAGTGCGATG

901  ACGGCGGACG GCTTGTCCAC AGGATTATTC GTATTGGGCG AAACCGAAGC

951  CTTAAAGCTG GCAGAGCGCG AAAAACTCGC TGTTTTCCTG ATTGTCAGGG

1001  ATAAAGGCGG CTACCGCACC GCCATGTCTT CCGAATTTGA AAAACTGCTC

1051  CGCTAA
```

This corresponds to the amino acid sequence <SEQ ID 398; ORF 111.a>:

```
a111.pep
    1  MPSETRLPNF IRTLIFALSF IFLNACSEQT AQTVTLQGET MGTTYTVKYL

51  SNNRDKLPSP AEIQKRIDDA LKEVNRQMST YQPDSEISRF NQHTAGKPLR

101  ISSDFAHVTA EAVHLNRLTH GALDVTVGPL VNLWGFGPDK SVTREPSPEQ

151  IKQAASYTGI DKIILKQGKD YASLSKTHPK AYLDLSSIAK GFGVDKVAGE

201  LEKYGIQNYL VEIGGELHGK GKNARGEPWR IGIEQPNIVQ GGNTQIIVPL

251  NNRSLATSGD YRIFHVDKSG KRLSHIINPN NKRPISHNLA SISVVADSAM

301  TADGLSTGLF VLGETEALKL AEREKLAVFL IVRDKGGYRT AMSSEFEKLL

351  R*
``` m111/a111 97.7% identity in 351 aa overlap

```
                 10         20         30         40         50         60
m111.pep  MPSETRLPNFIRVLIFALGFIFLNACSEQTAQTVTLQGETMGTTYXVKYLSNNRDKLPSP
          ||||||||||| |||| ||||||||||||||||||||||||||||| ||||||||||||
a111      MPSETRLPNFIRTLIFALSFIFLNACSEQTAQTVTLQGETMGTTYTVKYLSNNRDKLPSP
                 10         20         30         40         50         60

70         80         90        100        110        120
m111.pep  AEIXKRIDDALKEXNRXMSTYQPDSEISRFNQHTAGKPLRISSDFAHVTAEAVRLNRLTH
          ||| ||||||||||  ||  |||||||||||||||||||||||||||||||| ||||||
a111      AEIQKRIDDALKEVNRQMSTYQPDSEISRFNQHTAGKPLRISSDFAHVTAEAVHLNRLTH
                 70         80         90        100        110        120

130        140        150        160        170        180
m111.pep  GALDVTVGPLVNLWGFGPDKSVTREPSPEQIKQAASYTGIDKIILKQGKDYASLSKTHPK
          ||||||||||||||||||||||||||||||||||||||||||||||||||||||||||||
a111      GALDVTVGPLVNLWGFGPDKSVTREPSPEQIKQAASYTGIDKIILKQGKDYASLSKTHPK
                130        140        150        160        170        180

190        200        210        220        230        240
m111.pep  AYLDLSSIAKGFGVDKVAGELEKYGIQNYLVEIGGELHGKGKNARGEPWRIGIEQPNIVQ
          ||||||||||||||||||||||||||||||||||||||||||||||||||||||||||||
a111      AYLDLSSIAKGFGVDKVAGELEKYGIQNYLVEIGGELHGKGKNARGEPWRIGIEQPNIVQ
                190        200        210        220        230        240

250        260        270        280        290        300
m111.pep  GGNTQIIVPLNNRSLATSGDYRIFHVDKNGKRLSHIINPNNKRPISHNLASISVVADSAM
          |||||||||||||||||||||||||||| |||||||||||||||||||||||||||||||
a111      GGNTQIIVPLNNRSLATSGDYRIFHVDKSGKRLSHIINPNNKRPISHNLASISVVADSAM
                250        260        270        280        290        300

310        320        330        340        350
m111.pep  TADGLSTGLFVLGETEALKLAEREKLAVFLIVRDKGGYRTAMSSEFEKLLRX
          |||||||||||||||||||||||||||||||||||||||||||||||||||
a111      TADGLSTGLFVLGETEALKLAEREKLAVFLIVRDKGGYRTAMSSEFEKLLRX
                310        320        330        340        350
```

The following partial DNA sequence was identified in *N. gonorrhoeae* <SEQ ID 399>:

```
g111-1.seq
    1    ATGCCGTCTG AAACACGCCT GCCGAACCTT ATCCGCGCCT TGATATTTGC

51    CCTGGGTTTC ATCTTCCTGA ACGCCTGTTC GGAACAAACC GCGCAAacCG
```

```
                         -continued
101    TTACCCTGCA AGGCGAAACG ATGGGTACGA CCTATACCGT CAAATACCTT

151    TCAAATAATC GGGACAAACT CCCCTCCCCT GCCAAAATAC AAAAGCGCAT

201    TGATGATGCG CTTAAAGAAG TCAACCGGCA GATGTCCACC TACCAGACCG

251    ATTCCGAAAT CAGCCGGTTC AACCAACACA CAGCCGGCAA GCCCCTCCGC

301    ATTTCAAGCG ATTTCGCACA CGTTACCGCC GAAGCCGTCC GCCTGAACCG

351    CCTGACTCAC GGCGCACTGG ACGTAACCGT CGGCCCTTTG GTCAACCTTT

401    GGGGGTTCGG CCCCGACAAA TCCGTTACCC GTGAACCGTC GCCGGAACAA

451    ATCAAACAGG CGGCATCTTA TACGGGCATA GACAAAATCA TTTTGCAACA

501    AGGCAAAGAT TACGCTTCCT TGAGCAAAAC CCACCCCAAA GCCTATTTGG

551    ATTTATCTTC GATTGCCAAA GGCTTCGGCG TTGATAAAGT TGCGGGCGAA

601    CTGGAAAAAT ACGGCATTCA AAATTATCTG GTCGAAATCG GCggcGAGTT

651    GCACGGCAAA GGCAAAAATG CGCACGGCGA ACCGTGGCGC ATCGGTATAG

701    AGCAACCCAA TATcatccaa ggcggcaata cgcAGattat cgtcccgctg 751    aaCaaccgtt cgcttgccac ttccggcgAT taccgtaTTT tccacgtcgA 801    TAAAAACGGC Aaacgcctt cccacATCAT CAATCCCAAC AACAAACGAC 851    CCATCAGcCA CAAcctcgcc tcCATCAgCg TGGTCTCAGA CAGTGCAATG

901    ACGGCGGACG GTTTATCCAC AGGATTATTT GTTTAGGCG AAACCGAAGC

951    CTTAAGGCTG GCAGAACAAG AAAAACTCGC TGTTTTCCTA ATTGTCCGGG

1001   ATAAGGACGG CTACCGCACC GCCATGTCTT CCGAATTTGC CAAGCTGCTC

1051   CGCTAA
```

This corresponds to the amino acid sequence <SEQ ID 400; ORF 111-1.ng>:

```
g111-1.pep
     1    MPSETRLPNL IRALIFALGF IFLNACSEQT AQTVTLQGET MGTTYTVKYL

51    SNNRDKLPSP AKIQKRIDDA LKEVNRQMST YQTDSEISRF NQHTAGKPLR

101    ISSDFAHVTA EAVRLNRLTH GALDVTVGPL VNLWGFGPDK SVTREPSPEQ

151    IKQAASYTGI DKIILQQGKD YASLSKTHPK AYLDLSSIAK GFGVDKVAGE

201    LEKYGIQNYL VEIGGELHGK GKNAHGEPWR IGIEQPNIIQ GGNTQIIVPL

251    NNRSLATSGD YRIFHVDKNG KRLSHIINPN NKRPISHNLA SISVVSDSAM

301    TADGLSTGLF VLGETEALRL AEQEKLAVFL IVRDKDGYRT AMSSEFAKLL

351    R*
```

The following partial DNA sequence was identified in *N. meningitidis* <SEQ ID 401>:

```
m111-1.seq
     1    ATGCCGTCTG AAACACGCCT GCCGAACTTT ATCCGCGTCT TGATATTTGC

51    CCTGGGTTTC ATCTTCCTGA ACGCCTGTTC GGAACAAACC GCGCAAACCG

101    TTACCCTGCA AGGCGAAACG ATGGGCACGA CCTATACCGT CAAATACCTT

151    TCAAATAATC GGGACAAACT CCCCTCACCT GCCGAAATAC AAAAACGCAT

201    CGATGACGCG CTTAAAGAAG TCAACCGGCA GATGTCCACC TATCAGCCCG

251    ACTCCGAAAT CAGCCGGTTC AACCAACACA CAGCCGGCAA GCCCCTCCGC
```

-continued

```
 301    ATTTCAAGCG ACTTCGCACA CGTTACTGCC GAAGCCGTCC GCCTGAACCG
 351    CCTGACACAC GGCGCGCTGG ACGTAACCGT CGGCCCCTTG GTCAACCTTT
 401    GGGGATTCGG CCCCGACAAA TCCGTTACCC GTGAACCGTC GCCGGAACAA
 451    ATCAACAGG CGGCATCTTA TACGGGCATA GACAAAATCA TTTTGAAACA
 501    AGGCAAAGAT TACGCTTCCT TGAGCAAAAC CCACCCCAAG GCCTATTTGG
 551    ATTTATCTTC GATTGCCAAA GGCTTCGGCG TTGATAAAGT TGCGGGCGAA
 601    CTGGAAAAAT ACGGCATTCA AAATTATCTG GTCGAAATCG GCGGCGAGTT
 651    GCACGGCAAA GGCAAAAACG CGCGCGGCGA ACCGTGGCGC ATCGGTATCG
 701    AGCAGCCCAA TATCGTCCAA GGCGGCAATA CGCAGATTAT CGTCCCGCTG
 751    AACAACCGTT CGCTTGCCAC TTCCGGCGAT TACCGTATTT TCCACGTCGA
 801    TAAAAACGGC AAACGCCTCT CCCATATCAT CAACCCGAAC AACAAACGAC
 851    CCATCAGCCA CAACCTCGCC TCCATCAGCG TGGTCGCAGA CAGTGCGATG
 901    ACGGCGGACG GCTTGTCCAC AGGATTATTC GTATTGGGCG AAACCGAAGC
 951    CTTAAAGCTG GCAGAGCGCG AAAAACTCGC TGTTTTCCTG ATTGTCAGGG
1001    ATAAAGGCGG CTACCGCACC GCCATGTCTT CCGAATTTGA AAAACTGCTC
1051    CGCTAA
```

This corresponds to the amino acid sequence <SEQ ID 402; ORF 111-1>:

```
m111-1.pep
    1   MPSETRLPNF IRVLIFALGF IFLNACSEQT AQTVTLQGET MGTTYTVKYL
   51   SNNRDKLPSP AEIQKRIDDA LKEVNRQMST YQPDSEISRF NQHTAGKPLR
  101   ISSDFAHVTA EAVRLNRLTH GALDVTVGPL VNLWGFGPDK SVTREPSPEQ
  151   IKQAASYTGI DKIILKQGKD YASLSKTHPK AYLDLSSIAK GFGVDKVAGE
  201   LEKYGIQNYL VEIGGELHGK GKNARGEPWR IGIEQPNIVQ GGNTQIIVPL
  251   NNRSLATSGD YRIFHVDKNG KRLSHIINPN NKRPISHNLA SISVVADSAM
  301   TADGLSTGLF VLGETEALKL AEREKLAVFL IVRDKGGYRT AMSSEFEKLL
  351   R*
```

45 m111-1/g111-1 96.6% identity in 351 aa overlap

```
                       10         20         30         40         50         60
m111-1.pep  MPSETRLPNFIRVLIFALGFIFLNACSEQTAQTVTLQGETMGTTYTVKYLSNNRDKLPSP
            ||||||||||:||:||||||||||||||||||||||||||||||||||||||||||||||
g111-1      MPSETRLPNLIRALIFALGFIFLNACSEQTAQTVTLQGETMGTTYTVKYLSNNRDKLPSP
                       10         20         30         40         50         60

70         80         90        100        110        120
m111-1.pep  AEIQKRIDDALKEVNRQMSTYQPDSEISRFNQHTAGKPLRISSDFAHVTAEAVRLNRLTH
            |:||||||||||||||||||||:|||||||||||||||||||||||||||||||||||||
g111-1      AKIQKRIDDALKEVNRQMSTYQTDSEISRFNQHTAGKPLRISSDFAHVTAEAVRLNRLTH
                       70         80         90        100        110        120

130        140        150        160        170        180
m111-1.pep  GALDVTVGPLVNLWGFGPDKSVTREPSPEQIKQAASYTGIDKIILKQGKDYASLSKTHPK
            ||||||||||||||||||||||||||||||||||||||||||||||:|||||||||||||
g111-1      GALDVTVGPLVNLWGFGPDKSVTREPSPEQIKQAASYTGIDKIILQQGKDYASLSKTHPK
                      130        140        150        160        170        180

190        200        210        220        230        240
m111-1.pep  AVLDLSSIAKGFGVDKVAGELEKYGIQNYLVEIGGELHGKGKNARGEPWRIGIEQPNIVQ
             ||||||||||||||||||||||||||||||||||||||||||:||||||||||||||:|
g111-1      AYLDLSSIAKGFGVDKVAGELEKYGIQNYLVEIGGELHGKGKNAHGEPWRIGIEQPNIIQ
                      190        200        210        220        230        240
```

-continued

```
             250        260        270        280        290        300
m111-1.pep   GGNTQIIVPLNNRSLATSGDYRIFHVDKNGKRLSHIINPNNKRPISHNLASISVVADSAM
             ||||||||||||||||||||||||||||||||||||||||||||||||||||||||:|||
g111-1       GGNTQIIVPLNNRSLATSGDYRIFHVDKNGKRLSHIINPNNKRPISHNLASISVVSDSAM
             250        260        270        280        290        300

310        320        330        340        350
m111-1.pep   TADGLSTGLFVLGETEALKLAEREKLAVFLIVRDKGGYRTAMSSEFEKLLRX
             ||||||||||||||||||||:|||:|||||||||||| ||||||||||:|||
g111-1       TADGLSTGLFVLGETEALRLAEQEKLAVFLIVRDKDGYRTAMSSEFAKLLRX
             310        320        330        340        350
``` g111-1 (SEQ ID 400)/p44550 (SEQ ID 4161)

```
sp|P44550|YOJL_HAEIN HYPOTHETICAL LIPOPROTEIN HI0172 PRECURSOR
>gI|1074292|pir||C64144
hypothetical protein HI0172 - Haemophilus influenzae (strain Rd KW20)
>gi|1573128 (U32702) lipoprotein, putative [Haemophilus influenzae
Rd] Length = 346
Score = 349 bits (885), Expect = 2e-95
Identities = 177/328 (53%), Positives = 240/328 (72%), Gaps = 4/328 (1%)
Query:   23 LNACSEQTAQTVTLQGETMGTTYXVKYLSNNRDKLPSPAEIXKRIDDALKEXNRXMSTYQ   82
            L AC ++T + ++L G+TMGTTY VKYL +    S +  + I+  LK+ N  MSTY+
Sbjct:   17 LAACQKET-KVISLSGKTMGTTYHVKYLDDGSITATS-EKTHEEIEAILKDVNAKMSTYK   74

Query:   83 PDSEISRFNQHT-AGKPLRISSDFAHVTAEAVRLNRLTHGALDVTVGPLVNLWGFGPDKS  141
               DSE+SRFNQ+T    P+ IS+DFA V AEA+RLN++T GALDVTVGP+VNLWGFGP+K
Sbjct:   75 KDSELSRFNQNTQVNTPIEISADFAKVLAEAIRLNKVTEGALDVTVGPVVNLWGFGPEKR  134

Query:  142 VTREPSPEQIKQAASYTGIDKIILKQGKDYASLSKTHPKAYLDLSSIAKGFGVDKVAGEL  201
               ++P+PEQ+ +  ++ GIDKI L   K+ A+LSK  P+ Y+DLSSIAKGFGVD+VA +L
Sbjct:  135 PEKQPTPEQLAERQAWVGIDKITLDTNKEKATLSKALPQVYVDLSSIAKGFGVDQVAEKL  194

Query:  202 EKYGIQNYLVEIGGELHGKGKNARGEPWRIGIEQPNIVQGGNTQIIVPLNNRSLATSGDY  261
            E+  QNY+VEIGGE+  KGKN  G+PW+I IE+P     +  ++ LNN +A+SGDY
Sbjct:  195 EQLNAQNYMVEIGGEIRAKGKNIEGKPWQIAIEKPTTTGERAVEAVIGLNNMGMASSGDY  254

Query:  262 RIFHVDKNGKRLSHIINPNNKRPISHNLASISVVADSAMTADGLSTGLFVLGETEALKLA  321
            RI+  ++NGKR +H I+P     PI H+LASI+V+A ++TADGLSTGLFVLGE +AL++A
Sbjct:  255 RIY-FEENGKRFAHEIDPKTGYPIQHHLASITVLAPTSMTADGLSTGLFVLGEDKALEVA  313

Query:  322 EREKLAVFLIVRDKGGYRTAMSSEFEKL  349
            E+  LAV+LI+R  G+ T SS F+KL
Sbjct:  314 EKNNLAVYLIIRTDNGFVTKSSSAFKKL  341
```

The following partial DNA sequence was identified in *N. meningitidis* <SEQ ID 403>:

```
a111-1.seq
     1      ATGCCGTCTG AAACACGCCT GCCGAACTTT ATCCGCACCT TGATATTTGC

51      CCTGAGTTTT ATCTTCCTGA CGCCTGTTC GGAACAAACC GCGCAAACCG

101      TTACCCTGCA AGGTGAAACG ATGGGCACGA CCTATACCGT CAAATACCTT

151      TCAAATAATC GGGACAAACT CCCCTCACCT GCCGAAATAC AAAAGCGCAT

201      CGATGACGCG CTTAAAGAAG TCAACCGGCA GATGTCCACC TATCAGCCCG

251      ACTCCGAAAT CAGCCGGTTC AACCAACACA CAGCCGGCAA GCCCCTCCGC

301      ATTTCAAGCG ACTTCGCACA CGTTACTGCC GAAGCCGTCC ACCTGAACCG

351      CCTGACACAC GGCGCGCTGG ACGTAACCGT CGGCCCCTTG GTCAACCTTT

401      GGGGATTCGG CCCCGACAAA TCCGTTACCC GTGAACCGTC GCCGGAACAA

451      ATCAAACAAG CAGCATCTTA TACGGGCATA GACAAAATCA TTTTGAAACA

501      AGGCAAAGAT TACGCTTCCT TGAGCAAAAC CCACCCCAAG GCCTATTTGG

551      ATTTATCTTC GATTGCCAAA GGCTTCGGCG TTGATAAAGT TGCGGGCGAA

601      CTGGAAAAAT ACGGCATTCA AAATTATCTG GTCGAAATCG GCGGCGAGTT

651      GCACGGCAAA GGCAAAAACG CGCGCGGCGA ACCTTGGCGC ATCGGCATCG
```

```
         -continued
 701  AACAGCCCAA CATCGTCCAA GGCGGCAATA CGCAGATTAT CGTCCCGCTG

751  AACAACCGTT CGCTTGCCAC TTCCGGCGAT TACCGTATTT TCCACGTCGA

801  TAAAAGCGGC AAACGCCTCT CCCATATCAT TAATCCGAAC AACAAACGAC

851  CCATCAGCCA CAACCTCGCC TCCATCAGCG TGGTCGCAGA CAGTGCGATG

901  ACGGCGGACG GCTTGTCCAC AGGATTATTC GTATTGGGCG AAACCGAAGC

951  CTTAAAGCTG GCAGAGCGCG AAAAACTCGC TGTTTTCCTG ATTGTCAGGG

1001  ATAAAGGCGG CTACCGCACC GCCATGTCTT CCGAATTTGA AAAACTGCTC

1051  CGCTAA
```

This corresponds to the amino acid sequence <SEQ ID 404; ORF 111-1.a>:

```
a111-1.pep
    1     MPSETRLPNF IRTLIFALSF IFLNACSEQT AQTVTLQGET MGTTYTVKYL

51     SNNRDKLPSP AEIQKRIDDA LKEVNRQMST YQPDSEISRF NQHTAGKPLR

101     ISSDFAHVTA EAVHLNRLTH GALDVTVGPL VNLWGFGPDK SVTREPSPEQ

151     IKQAASYTGI DKIILKQGKD YASLSKTHPK AYLDLSSIAK GFGVDKVAGE

201     LEKYGIQNYL VEIGGELHGK GKNARGEPWR IGIEQPNIVQ GGNTQIIVPL

251     NNRSLATSGD YRIFHVDKSG KRLSHIINPN NKRPISHNLA SISVVADSAM

301     TADGLSTGLF VLGETEALKL AEREKLAVFL IVRDKGGYRT AMSSEFEKLL

351     R*
``` a111-1/m111-1 98.9% identity in 351 aa overlap

```
                    10         20         30         40         50         60
a111-1.pep  MPSETRLPNFIRTLIFALSFIFLNACSEQTAQTVTLQGETMGTTYTVKYLSNNRDKLPSP
            ||||||||||:|||||:|||||||||||||||||||||||||||||||||||||||||||
m111-1      MPSETRLPNFIRVLIFALGFIFLNACSEQTAQTVTLQGETMGTTYTVKYLSNNRDKLPSP
                    10         20         30         40         50         60

70         80         90        100        110        120
a111-1.pep  AEIQKRIDDALKEVNRQMSTYQPDSEISRFNQHTAGKPLRISSDFAHVTAEAVHLNRLTH
            |||||||||||||||||||||||||||||||||||||||||||||||||||||:||||||
m111-1      AEIQKRIDDALKEVNRQMSTYQPDSEISRFNQHTAGKPLRISSDFAHVTAEAVRLNRLTH
                    70         80         90        100        110        120

130        140        150        160        170        180
a111-1.pep  GALDVTVGPLVNLWGFGPDKSVTREPSPEQIKQAASYTGIDKIILKQGKDYASLSKTHPK
            ||||||||||||||||||||||||||||||||||||||||||||||||||||||||||||
m111-1      GALDVTVGPLVNLWGFGPDKSVTREPSPEQIKQAASYTGIDKIILKQGKDYASLSKTHPK
                   130        140        150        160        170        180

190        200        210        220        230        240
a111-1.pep  AYLDLSSIAKGFGVDKVAGELEKYGIQNYLVEIGGELHGKGKNARGEPWRIGIEQPNIVQ
            ||||||||||||||||||||||||||||||||||||||||||||||||||||||||||||
m111-1      AYLDLSSIAKGFGVDKVAGELEKYGIQNYLVEIGGELHGKGKNARGEPWRIGIEQPNIVQ
                   190        200        210        220        230        240

250        260        270        280        290        300
a111-1.pep  GGNTQIIVPLNNRSLATSGDYRIFHVDKSGKRLSHIINPNNKRPISHNLASISVVADSAM
            |||||||||||||||||||||||||||||:||||||||||||||||||||||||||||||
m111-1      GGNTQIIVPLNNRSLATSGDYRIFHVDKNGKRLSHIINPNNKRPISHNLASISVVADSAM
                   250        260        270        280        290        300

310        320        330        340        350
a111-1.pep  TADGLSTGLFVLGETEALKLAEREKLAVFLIVRDKGGYRTAMSSEFEKLLRX
            ||||||||||||||||||||||||||||||||||||||||||||||||||||
m111-1      TADGLSTGLFVLGETEALKLAEREKLAVFLIVRDKGGYRTAMSSEFEKLLRX
                   310        320        330        340        350
```

The following partial DNA sequence was identified in *N. gonorrhoeae* <SEQ ID 405>:

```
g114.seq
    1   ATGGCTTCCA TCACTTCGCC GCTGCACGGG GCGCAGCAGG AATGCAGCAA
   51   GACTTTTTTA TGTCCGCCGG GCGGGACGAG TATGGGCGG TCAATGTCGG
  101   TAACGGTAGG TTTGTTTTGT GTTTCCATTA ACTTAACAAT ATCTGTCGAA
  151   TACGGTCAAA GCGGCTATTT TACCAGAGCC GCCGAATGTA AACAGGGTG
  201   TCAGGGCATC AGCCCGAGCT GCCTGAACGA ACGGACGGTT TGCGAGGTAA
  251   CGATAAAATG GTCGAGCAGC GAAACATCAA CCAGCGACAT GGCCTGTGCC
  301   AGCCGCCTTG TGAACATGAT GTCTTCCTGC GAAGGTTCAG GCGAGCCGCC
  351   CGGATGGTTG TGCGCGATAA TCAGGCTGTC GGCATATTCG TCCAATGCCA
  401   GTTTGACGAT TTCGCGGATG TAA
```

This corresponds to the amino acid sequence <SEQ ID 406; ORF 114.ng>:

```
g114.pep
    1   MASITSPLHG AQQECSKTFL CPPGGTSMGR SMSVTVGLFC VSINLTISVE
   51   YGQSGYFTRA AECKTGCQGI SPSCLNERTV CEVTIKWSSS ETSTSDMACA
  101   SRLVNMMSSC EGSGEPPGWL CAIIRLSAYS SNASLTISRM *
```

The following partial DNA sequence was identified in *N. meningitidis* <SEQ ID 407>:

```
m114.seq
    1   ATGGCTTCCA TCACTTCGCC GCTGCACGGG GCGCACAGAG AATGCAGCAA
   51   GACTTTTTTA TGTCCACCGG GCGGGACGAG TATAGGGCGG TCAATGTCGG
  101   TAACGGTAGG TTTGTTTTGT GTTTCCATTA ACTTAACAAT ATCTGTTGAA
  151   TACGGTTGAA GCGGCTATTT TATCAGAGCC GCCGCATGTA AACAGAGTG
  201   TCAGGGCATC AACCCGAGCT GTCTGAACGA ACAGACGCTT TGCGAkGTAA
  251   CGATAAAATG GTCGAGCAGC GACACATCGA CCAGCGACAT TGCCTGTGCC
  301   AGCCGCCTTG TGAACATGAT GTCTTCCTGC GAArGTTCsG GCGAGCCGcC
  351   CGgATGGTTG TGCGCAATAA TCAGGCTGTC GGCATATTCG TCCAATGCCA
  401   GTTTGACGAT TTCGCGGATG TAA
```

This corresponds to the amino acid sequence <SEQ ID 408; ORF 114>:

```
m114.pep
    1   MASITSPLHG AHRECSKTFL CPPGGTSIGR SMSVTVGLFC VSINLTISVE
   51   YGXSGYFIRA AACKTECQGI NPSCLNEQTL CXVTIKWSSS DTSTSDIACA
  101   SRLVNMMSSC EXSGEPPGWL CAIIRLSAYS SNASLTISRM *
``` m114/g114 90.0% identity over a 140 aa overlap

```
                 10         20         30         40         50         60
   m114.pep  MASITSPLHGAHRECSKTFLCPPGGTSIGRSMSVTVGLFCVSINLTISVEYGXSGYFIRA
             ||||||||||::||||||||||||||||:|||||||||||||||||||||||| |||| |
   g114      MASITSPLHGAQQECSKTFLCPPGGTSMGRSMSVTVGLFCVSINLTISVEYGQSGYFTRA
                 10         20         30         40         50         60
```

-continued

```
              70         80         90        100        110        120
m114.pep  AACKTECQGINPSCLNEQTLCXVTIKWSSSDTSTSDIACASRLVNMMSSCEXSGEPPGWL
          | ||| ||||:|||||||:|:| ||||||||||:|||| |||||||||||||| ||||||||
g114      AECKTGCQGISPSCLNERTVCEVTIKWSSSETSTSDMACASRLVNMMSSCEGSGEPPGWL
              70         80         90        100        110        120

130        140
m114.pep  CAIIRLSAYSSNASLTISRMX
          |||||||||||||||||||||
g114      CAIIRLSAYSSNASLTISRMX
             130        140
```

The following partial DNA sequence was identified in *N. gonorrhoeae* <SEQ ID 409>:

```
a114.seq
    1   ATGCCGGAGG CAAGCATCGC CTCCATCACT TCGCCGCTGC ACGGGGCGCA

51   ACAGGAATGC AGCAAGACTT TTTTATGTCC GCCGGGCGGG ACGAGTATGG

101   GGCGGTCAAT GTCGGTAACG GTAGGTTTGT TTTGTGTTTC CATTAACTTA

151   ACGATATCTG TCGAATACGG TTGAAGCGGC TATTTTATCA GAGCCGCCGC

201   ATGTAAAACA GGGTGTCAGG GCATCAGCCC GAGCTGCCTG AACGAACGGA

251   CGGTTTGCGC CGTTACGATA AAATGGTCGA GCAGCGACAC ATCGACCAGC

301   GACATTGCCT GTGCCAGCCG CCTTGTGAAC ATGATGTCTT CCTGCGAAGG

351   TTCGGGCGAG CCGCCCGGAT GGTTGTGCGC GATAATCAGG CTGTCGGCAT

401   ATTCGTCCAA TGCCAGTTTG ACAATTTCAC GGATGTAA
```

This corresponds to the amino acid sequence <SEQ ID 410; ORF 114.a>:

```
a114.pep
    1   MPEASIASIT SPLHGAQQEC SKTFLCPPGG TSMGRSMSVT VGLFCVSINL

51   TISVEYG*SG YFIRAAACKT GCQGISPSCL NERTVCAVTI KWSSSDTSTS

101   DIACASRLVN MMSSCEGSGE PPGWLCAIIR LSAYSSNASL TISRM*
``` m114/a114 92.9% identity in 140 aa overlap

```
              10         20         30         40         50
m114.pep      MASITSPLHGAHRECSKTFLCPPGGTSIGRSMSVTVGLFCVSINLTISVEYGXSG
              :|||||||||::||||||||||||||:|||||||||||||||||||||||||||
a114      MPEASIASITSPLHGAQQECSKTFLCPPGGTSMGRSMSVTVGLFCVSINLTISVEYGXSG
              10         20         30         40         50         60

60         70         80         90        100        110
m114.pep  YFIRAAACKTECQGINPSCLNEQTLCXVTIKWSSSDTSTSDIACASRLVNMMSSCEXSGE
          |||||||||| |||| |||||||:|:| |||||||||||||||||||||||||||| |||
a114      YFIRAAACKTGCQGISPSCLNERTVCAVTIKWSSSDTSTSDIACASRLVNMMSSCEGSGE
              70         80         90        100        110        120

120        130        140
m114.pep  PPGWLCAIIRLSAYSSNASLTISRMX
          ||||||||||||||||||||||||||
a114      PPGWLCAIIRLSAYSSNASLTISRMX
             130        140
```

The following partial DNA sequence was identified in *N. gonorrhoeae* <SEQ ID 411>:

```
g117.seq
    1   atggtcgacg aactcgacCT GCTGCCCGAT GCCGTCGCCG CCACCCTGCT

51   TGCCGACATC GGACGCTACG TCCCCGATTG GAACCTATTG GTTTCCGAGC
```

```
 101    GCTGCAACAG CACCGTCGCC GAGCTGGTCA AAGGTGtgga CGAAGTGCAG

151    AAACTTACCC ACTTCGCCCG GGTGGACAGC CTCGCCACGC CGGAAGAACG

201    CGCACAGCAA GCGGAAACCA TGCGGAAAAT GCTGCTGGCg atggttaccg

251    Acatccgcgt cgtaTTAATC AAACTGGCGA TGCGTacgcg caccCTGcta 301    ttTTTaaGCA ACGCCCCGA CAGCCCTGAA AAACgcgccG TCgccaaAga 351    aacccTCGAC ATCTTCGCCC CGCTCGCCAA CCGCTTGGGC GTGTGGCAGC

401    TCAAATGGCA GCTCGAAGAT TTGGGCTTCC GCCATCAAGA ACCCGAAAAA

451    TACCGCGAAA TCGCCCTGCT TTTGGACGAA AAACGCACCG AACGCCTCGA

501    ATACATCGAA AACTTCCTCG ATATCCTGCG TACGGAACTC AAAAAATACA

551    ATATCCACTT TGAAGTCGCC GGCCGTCCGA ACACATCTA CTCCATTTAC

601    AAAAAAATGG TGAAGAAAAA ACTCAGCTTC GACGgccTGT TCGACATCCG

651    CGCCGTGCGG ATTCTGGTCG ATACCGTCCC CGaGTGTTAC ACCACGCTGG 701    gcaTCGTCCA CAGCCTCTGG CAGCCCATTC CCGGCGagtt CGAcgactAC 751    ATCGCCAACC CCAAAGgcaA CGgttATAAA AGtTTGCACA CCGTCATCGT 801    cggcccGGAa gacaaaggtg tggaaGtgCA AATCCGCACC TTCGAtatGC 851    accAATTCaa CgaatTcggT gtcgccgCCC ACTGGCGtta caaagaaggc 901    ggcaaaggcg attccGCCtA cgaacaaAAA ATcgccTggt TGCgccaACT

951    CTTGGACTGG CGCGAAAATA TGGCGGAAAG CGGCAAGGAA GACCTCGCCG

1001    CCGCCTTCAA AACCGAGCTT TTCAACGACA CGATTTATGT TTTGACCCCG

1051    CACGGCAAAG TCCTCTCTCT GCCAACGGGC GCAACCCCCA TCGACTTCGC

1101    CTACGCCCTG CACAGCAGCA TcggCGACCG CTGCCGGGGC GCGAAAGTCG

1151    AaggGCAGAT TGTGCCGCTG TCCACCCCGC TCGAAAACGG ACAGCGCGTC

1201    GAAATcatta cCGCcaaAGA AGGGCATCCT TCCGTCAACT GGCTTTACGA

1251    AGGctgGGtc aAATCCGGCA AGGCCATCGG caaAATCCGC GCCTAcatCC

1301    GCCAGcaaAa cgCcgaCACC GTGCGCGAAG AAGGCCGTGT CCAACTCGAC

1351    AAGCAGCTTG CCAAACTCAC GCCCAAACCC AACCTGCAAG AGCTTgccga 1401    aaATCTCGGC tacaaAAAGC cagaagacct ctacacCGCc gtcggacaag 1451    gcgaaatttc caaccgcgcc atCcaaaaag cctgcggcac GCTgaacgaa 1501    ccgccccCCG TGCCCGTCAG CGCAACCACC ATCGTCAAAC AGTCCAAAAT

1551    CAAAAAAGGT GGCAAAACCG GCGTGCTCAT CGACGGCGAA GACGGCTTGA

1601    TGACCACGCT TGCCAAATGC TGCAAACCCG CGCCGCCCGA CGATATTGCC

1651    GGCTTCGTTA CCCGCGAGCG CGGCATTTCC GTCCACCGCA AAACCTGCCC

1701    CTCTTTCCGA CACCTTGCCG AACACGCGCC CGAAAAGTA CTGGACGCAA

1751    GTTGGGCGGC GTTGCAGGAA GGGCAAGTGT TCGCCGTCGA TATCGAAATC

1801    CGCGCCCAAG ACCGCTCCGG GCTTTTGCGC GACGTATCCG ACGCGCTCGC

1851    CCGCCACAAA CTCAACGTTA CCGCCGTGCA ACCCAGTCC CGCGACTTGG

1901    AAGCCAGCAT GAGGTTCACG CTCGAAGTCA ACAAGtCAA CGacCTCCCG

1951    CGCGTCCTCG CCCGGCCTCGG CGATGTCAAA GGCGTATTGA GCGTTACCCG

2001    GCTTTAA
```

This corresponds to the amino acid sequence <SEQ ID 412; ORF 117.ng>:

```
g117.pep
    1   MVDELDLLPD AVAATLLADI GRYVPDWNLL VSERCNSTVA ELVKGVDEVQ

51   KLTHFARVDS LATPEERAQQ AETMRKMLLA MVTDIRVVLI KLAMRTRTLL

101   FLSNAPDSPE KRAVAKETLD IFAPLANRLG VWQLKWQLED LGFRHQEPEK

151   YREIALLLDE KRTERLEYIE NFLDILRTEL KKYNIHFEVA GRPKHIYSIY

201   KKMVKKKLSF DGLFDIRAVR ILVDTVPECY TTLGIVHSLW QPIPGEFDDY

251   IANPKGNGYK SLHTVIVGPE DKGVEVQIRT FDMHQFNEFG VAAHWRYKEG

301   GKGDSAYEQK IAWLRQLLDW RENMAESGKE DLAAAFKTEL FNDTIYVLTP

351   HGKVLSLPTG ATPIDFAYAL HSSIGDRCRG AKVEGQIVPL STPLENGQRV

401   EIITAKEGHP SVNWLYEGWV KSGKAIGKIR AYIRQQNADT VREEGRVQLD

451   KQLAKLTPKP NLQELAENLG YKKPEDLYTA VGQGEISNRA IQKACGTLNE

501   PPPVPVSATT IVKQSKIKKG GKTGVLIDGE DGLMTTLAKC CKPAPPDDIA

551   GFVTRERGIS VHRKTCPSFR HLAEHAPEKV LDASWAALQE GQVFAVDIEI

601   RAQDRSGLLR DVSDALARHK LNVTAVQTQS RDLEASMRFT LEVKQVNDLP

651   RVLAGLGDVK GVLSVTRL*
```

The following partial DNA sequence was identified in *N. meningitidis* <SEQ ID 413>:

```
m117.seq (partial)
    1   ..GTGAAACTCA AGAAATACAA TGTCCATTTC GAAGTCGCCG GCCGCCCGAA

51   ACACATCTAC TCCATTTACA AAAAATGGT GAAGAAAAAA CTCAGCTTCG

101   ACGGCCTCTT TGACATCCGC GCCGTGCGAA TTCTGGTTGA TACCGTCCCC

151   GAGTGTTACA CCACGCTGGG TATCGTCCAC AGCCTCTGGC AGCCCATTCC

201   CGGCGAGTTC GACGACTACA TCGCCAATCC CAAAGGCAAC GGCTATAAAA

251   GTTTGCACAC CGTCATCGTC GGCCCGGAAG ACAAAGGCGT GGAAGTACAA

301   ATCCGCACCT TCGATATGCA CCAATTCAAC GAATTCGGTG TCGCCGCCCA

351   CTGgCGTTAC AAAGAGGGCG GCAAGGGCGA TTCCGCCTAC GAACAGAAAA

401   TCGCCTGGTT GCGCCAACTC TTGGACTGGC GCGAAAACAT GGCGGAAAGC

451   GGCAAGGAAG ACCTCGCCGC CGCCTTCAAA ACCGAGCTTT TCAACGACAC

501   GATTTATGTT TTGACCCCGC ACGGCAAAGT CCTCTCCCTG CCCACGGGCG

551   CGACCCCCAT CGACTTCGCC TACGCCCTGC ACAGCAGCAT CGGCGACCGT

601   TGCCGCGGTG CGAAAGTCGA AGGGCAGATT GTGCCGCTGT CCACCCCGCT

651   CGAAAACGGA CAGCGCGTCG AAATCATTAC CGCCAAAGAA GGGCATCCTT

701   CCGTCAACTG GCTTTACGAA GGCTGGGTCA AATCCAACAA GGCAATCGGC

751   AAAATCCGCG CCTACATCCG CCAGCAAAAC GCCGACACCG TGCGCGAAGA

801   AGGCCGCGTC CAACTCGACA AACAGCTTGC CAAACTCACG CCCAAACCCA

851   ACCTGCAAGA GCTTGCCGAA ATCTCGGCT ACAAAAAGCC AGAAGACCTC

901   TACACCGCCG TCGGACAAGG CGAAATTTCC AACCGCGCCA TCCAAAAAGC

951   CTGCGGCACg CTGAACGAAC CGCCGCCCGT ACCCGTCAGC GAAACCACCA

1001   TCGTCAAACA GTCCAAAATC AAAAAGGCG GCAAAAACGG CGTGCTCATC

1051   GACGGCGAAG ACGGTCTGAT GACCACGCTT GCCAAATGCT GCAAACCCGC

1101   GCCGCCCGAC GATATTATCG GCTTCGTTAC CCGCGAGCGC GgCATTTCAG
```

```
1151   TGCACCGCAA AwyyTkCyCG TCTTTCCAAC ACCTCGCCGA ACACGCGCCC

1201   GAwAAAGTGC TGGACGCAAG CTGGGCGGCA TTGCAGGAAG GACAAGTATT

1251   CGCCGTCGAT ATCGAAATCC GCGCCCAAGA CCGCTCCGGG CTTTTGCGCG

1301   ACGTATCCGA CGCGCTCGCC CGCCACAAAC TCAACGTTAC CGCCGTGCAA

1351   ACCCAGTCCC GCGACTTGGA AGCCAGCATG AGGTTCACGC TCGAAGTCAA

1401   ACAAGTCAAC GACCTCCCGC GCGTCCTCGC CAGCCTCGGC GACGTCAAAG

1451   GCGTATTGAG CGTTACCCGG CTTTAA
```

This corresponds to the amino acid sequence <SEQ ID 414; ORF 117>:

```
m117.pep (partial)
     1    ....VKLKKYNVHF EVAGRPKHIY SIYKKMVKKK LSFDGLFDIR AVRILVDTVP

51        ECYTTLGIVH SLWQPIPGEF DDYIANPKGN GYKSLHTVIV GPEDKGVEVQ

101        IRTFDMHQFN EFGVAAHWRY KEGGKGDSAY EQKIAWLRQL LDWRENMAES

151        GKEDLAAAFK TELFNDTIYV LTPHGKVLSL PTGATPIDFA YALHSSIGDR

201        CRGAKVEGQI VPLSTPLENG QRVEIITAKE GHPSVNWLYE GWVKSNKAIG

251        KIRAYIRQQN ADTVREEGRV QLDKQLAKLT PKPNLQELAE NLGYKKPEDL

301        YTAVGQGEIS NRAIQKACGT LNEPPPVPVS ETTIVKQSKI KKGGKNGVLI

351        DGEDGLMTTL AKCCKPAPPD DIIGFVTRER GISVHRKXXX SFQHLAEHAP

401        XKVLDASWAA LQEGQVFAVD IEIRAQDRSG LLRDVSDALA RHKLNVTAVQ

451        TQSRDLEASM RFTLEVKQVN DLPRVLASLG DVKGVLSVTR L*
```

Computer analysis of this amino acid sequence gave the following results:
Homology with a Predicted ORF from *N. gonorrhoeae*
ORF 117 shows 97.6% identity over a 490 aa overlap with a predicted ORF (ORF 117.ng) from *N. gonorrhoeae*:

```
m117/g117
                                        10        20        30
    m117.pep                      VKLKKYNVHFEVAGRPKHIYSIYKKMVKKKL
                                 :||||:||||||||||||||||||||||||||
    g117     EKYREIALLLDEKRTERLEYIENFLDILRTELKKYNIHFEVAGRPKHIYSIYKKMVKKKL
             150       160       170       180       190       200

40        50        60        70        80        90
    m117.pep SFDGLFDIRAVRILVDTVPECYTTLGIVHSLWQPIPGEFDDYIANPKGNGYKSLHTVIVG
             ||||||||||||||||||||||||||||||||||||||||||||||||||||||||||||
    g117     SFDGLFDIRAVRILVDTVPECYTTLGIVHSLWQPIPGEFDDYIANPKGNGYKSLHTVIVG
             210       220       230       240       250       260

100       110       120       130       140       150
    m117.pep PEDKGVEVQIRTFDMHQFNEFGVAAHWRYKEGGKGDSAYEQKIAWLRQLLDWRENMAESG
             ||||||||||||||||||||||||||||||||||||||||||||||||||||||||||||
    g117     PEDKGVEVQIRTFDMHQFNEFGVAAHWRYKEGGKGDSAYEQKIAWLRQLLDWRENMAESG
             270       280       290       300       310       320

160       170       180       190       200       210
    m117.pep KEDLAAAFKTELFNDTIYVLTPHGKVLSLPTGATPIDFAYALHSSIGDRCRGAKVEGQIV
             ||||||||||||||||||||||||||||||||||||||||||||||||||||||||||||
    g117     KEDLAAAFKTELFNDTIYVLTPHGKVLSLPTGATPIDFAYALHSSIGDRCRGAKVEGQIV
             330       340       350       360       370       380

220       230       240       250       260       270
    m117.pep PLSTPLENGQRVEIITAKEGHPSVNWLYEGWVKSNKAIGKIRAYIRQQNADTVREEGRVQ
             |||||||||||||||||||||||||||||||||:||||||||||||||||||||||||||
    g117     PLSTPLENGQRVEIITAKEGHPSVNWLYEGWVKSGKAIGKIRAYIRQQNADTVREEGRVQ
             390       400       410       420       430       440
```

```
               280        290        300        310        320        330
m117.pep  LDKQLAKLTPKPNLQELAENLGYKKPEDLYTAVGQGEISNRAIQKACGTLNEPPPVPVSE
          ||||||||||||||||||||||||||||||||||||||||||||||||||||||||||
g117      LDKQLAKLTPKPNLQELAENLGYKKPEDLYTAVGQGEISNRAIQKACGTLNEPPPVPVSA
               450        460        470        480        490        500
               340        350        360        370        380        390
m117.pep  TTIVKQSKIKKGGKNGVLIDGEDGLMTTLAKCCKPAPPDDIIGFVTRERGISVHRKXXXS
          ||||||||||||||:|||||||||||||||||||||||| ||||||||||||||||: |
g117      TTIVKQSKIKKGGKTGVLIDGEDGLMTTLAKCCKPAPPDDIAGFVTRERGISVHRKTCPS
               510        520        530        540        550        560
               400        410        420        430        440        450
m117.pep  FQHLAEHAPXKVLDASWAALQEGQVFAVDIEIRAQDRSGLLRDVSDALARHKLNVTAVQT
          |:||||||| |||||||||||||||||||||||||||||||||||||||||||||||||
g117      FRHLAEHAPEKVLDASWAALQEGQVFAVDIEIRAQDRSGLLRDVSDALARHKLNVTAVQT
               570        580        590        600        610        620
               460        470        480        490
m117.pep  QSRDLEASMRFTLEVKQVNDLPRVLASLGDVKGVLSVTRLX
          |||||||||||||||||||||||||:||||||||||||||
g117      QSRDLEASMRFTLEVKQVNDLPRVLAGLGDVKGVLSVTRLX
               630        640        650        660
```

The following partial DNA sequence was identified in *N. meningitidis* <SEQ ID 415>:

```
a117.seq
    1  ATGGTTCATG AACTCGACCT GCTCCCCGAT GCCGTCGCCG CCACCCTGCT

51  TGCCGACATC GGACGCTACG TCCCCGACTG GAACCTATTG GTTTCCGAAC

101  GCTGCAACAG TACCGTCGCC GAGCTGGTCA AAGGTGTGGA CGAAGTGCAG

151  AAACTCACCC ACTTCGCCCG GGTGGACAGC CTCGCCACGC CGGAAGAACG

201  CGCCCAGCAG GCAGAAACTA TGCGGAAAAT GCTGCTGGCG ATGGTTACCG

251  ACATCCGCGT CGTGTTAATC AAACTGGCGA TGCGTACGCG CACCCTGCAA

301  TTTTTAAGCA ACGCCCCCGA CAGCCCCGAA AAACGCGCCG TCGCCAAAGA

351  AACCCTCGAC ATCTTCGCCC CGCTCGCCAA CCGTTTGGGC GTGTGGCAGC

401  TCAAATGGCA GCTCGAAGAT TTGGGCTTCC GCCATCAAGA ACCCGAAAAA

451  TACCGCGAAA TCGCCCTGCT TTTGGACGAA AAACGCACCG AACGCCTCGA

501  ATACATCGAA AACTTCCTTA ATATCCTGCG TACGGAACTC AAAAAATACA

551  ATATCCACTT TGAAGTCGCC GGCCGTCCGA ACACATCTA CTCCATTTAC

601  AAAAAAATGG TGAAGAAAAA ACTCAGCTTC GACGGGTTGT TCGACATCCG

651  CGCCGTGCGG ATTCTGGTTG ATACCGTCCC CGAGTGTTAC ACCACACTGG

701  GCATTGTCCA CAGCCTCTGG CAGCCCATTC CCGGCGAGTT CGACGACTAC

751  ATCGCCAACC CGAAAGGCAA CGGCTATAAA AGTTTGCACA CCGTCATCGT

801  CGGCCCGGAA GACAAAGGCG TGGAAGTGCA AATCCGCACC TTCGATATGC

851  ACCAATTCAA CGAATTCGGT GTCGCCGCGC ACTGGCGTTA CAAAGAGGGC

901  GGCAAAGGCG ATTCCGCCTA CGAACAAAAA ATCGCCTGGT ACGCCAACT

951  TTTGGACTGG CGCGAAAACA TGGCGGAAAG CGGCAAGGAA GACCTCGCCG

1001  CCGCCTTCAA AACCGAGCTT TTCAACGACA CGATTTATGT TTTGACCCCG

1051  CACGGCAAAG TCCTCTCCCT GCCCACAGGC GCGACCCCCA TCGACTTCGC

1101  CTACGCCCTG CACAGCAGCA TCGGCGACCG TTGCCGCGGT GCGAAAGTCG

1151  AAGGGCAGAT TGTGCCGCTG TCCACCCCGC TCGAAAACGG ACAGCGTGTC

1201  GAAATCATTA CCGCCAAAGA AGGGCATCCT TCCGTCAACT GGCTTTACGA

1251  AGGCTGGGTC AAATCCAACA AGGCAATCGG CAAAATCCGC GCCTACATCC
```

```
1301  GCCAGCAAAA CGCCGACACC GTGCGCGAAG AAGGCCGCGT CCAACTCGAC

1351  AAACAGCTTG CCAAACTCAC GCCCAAACCC AACCTGCAAG AGCTTGCCGA

1401  AAATCTCGGC TACAAAAAGC CAGAAGACCT CTACACCGCC GTCGGACAAG

1451  GCGAAATTTC CAACCGCGCC ATCCAAAAAG CCTGCGGCAC GCTGAACGAA

1501  CCGCCGCCCG TACCCGTCAG CGAAACCACC ATCGTCAAAC AGTCCAAAAT

1551  CAAAAAGGC GGCAAAAACG GCGTGCTCAT CGACGGCGAA GACGGTCTGA

1601  TGACCACGCT TGCCAAATGC TGCAAACCCG CGCCGCCCGA CGACATTGTC

1651  GGCTTCGTTA CCCGCGATCG CGGCATTTCG GTACACCGCA AAACCTGCCC

1701  CTCTTTCCGA CACCTCGCCG AACACGCGCC CGAAAAAGTA CTGGACGCAA

1751  GTTGGGCGGC GTTGCAGGAA GGACAAGTGT TCGCCGTCGA TATCGAAATC

1801  CGCGCCCAAG ACCGCTCCGG GCTTTTGCGC GACGTATCCG ACGCGCTCGC

1851  CCGCCACAAA CTCAACGTTA CCGCCGTGCA AACCCAGTCC CGCGACTTGG

1901  AAGCCAGCAT GAGGTTCACG CTCGAAGTCA AACAAGTTAC CGACCTCCCA

1951  CGCGTCCTCG CCAGCCTCGG CGACGTCAAA GGCGTATTGA GCGTTACCCG

2001  GCTTTAA
```

This corresponds to the amino acid sequence <SEQ ID 416; ORF 117.a>:

```
a117.pep
  1  MVHELDLLPD AVAATLLADI GRYVPDWNLL VSERCNSTVA ELVKGVDEVQ

51  KLTHFARVDS LATPEERAQQ AETMRKMLLA MVTDIRVVLI KLAMRTRTLQ

101  FLSNAPDSPE KRAVAKETLD IFAPLANRLG VWQLKWQLED LGFRHQEPEK

151  YREIALLLDE KRTERLEYIE NFLNILRTEL KKYNIHFEVA GRPKHIYSIY

201  KKMVKKKLSF DGLFDIRAVR ILVDTVPECY TTLGIVHSLW QPIPGEFDDY

251  IANPKGNGYK SLHTVIVGPE DKGVEVQIRT FDMHQFNEFG VAAHWRYKEG

301  GKGDSAYEQK IAWLRQLLDW RENMAESGKE DLAAAFKTEL FNDTIYVLTP

351  HGKVLSLPTG ATPIDFAYAL HSSIGDRCRG AKVEGQIVPL STPLENGQRV

401  EIITAKEGHP SVNWLYEGWV KSNKAIGKIR AYIRQQNADT VREEGRVQLD

451  KQLAKLTPKP NLQELAENLG YKKPEDLYTA VGQGEISNRA IQKACGTLNE

501  PPPVPVSETT IVKQSKIKKG GKNGVLIDGE DGLMTTLAKC CKPAPPDDIV

551  GFVTRDRGIS VHRKTCPSFR HLAEHAPEKV LDASWAALQE GQVFAVDIEI

601  RAQDRSGLLR DVSDALARHK LNVTAVQTQS RDLEASMRFT LEVKQVTDLP

651  RVLASLGDVK GVLSVTRL*
``` m117/a117 98.0% identity in 490 aa overlap

```
                           10         20         30
       m117.pep            VKLKKYNVHFEVAGRPKHIYSIYKKMVKKKL
                           :||||:||||||||||||||||||||||||
       a117      EKYREIALLLDEKRTERLEYIENFLNILRTELKKYNIHFEVAGRPKHIYSIYKKMVKKKL
                 150       160       170       180       190       200

40         50         60         70         80         90
       m117.pep  SFDGLFDIRAVRILVDTVPECYTTLGIVHSLWQPIPGEFDDYIANPKGNGYKSLHTVIVG
                 ||||||||||||||||||||||||||||||||||||||||||||||||||||||||||||
       a117      SFDGLFDIRAVRILVDTVPECYTTLGIVHSLWQPIPGEFDDYIANPKGNGYKSLHTVIVG
                 210       220       230       240       250       260
```

```
              100       110       120       130       140       150
m117.pep  PEDKGVEVQIRTFDMHQFNEFGVAAHWRYKEGGKGDSAYEQKIAWLRQLLDWRENMAESG
          ||||||||||||||||||||||||||||||||||||||||||||||||||||||||||||
a117      PEDKGVEVQIRTFDMHQFNEFGVAAHWRYKEGGKGDSAYEQKIAWLRQLLDWRENMAESG
              270       280       290       300       310       320

160       170       180       190       200       210
m117.pep  KEDLAAAFKTELFNDTIYVLTPHGKVLSLPTGATPIDFAYALHSSIGDRCRGAKVEGQIV
          ||||||||||||||||||||||||||||||||||||||||||||||||||||||||||||
a117      KEDLAAAFKTELFNDTIYVLTPHGKVLSLPTGATPIDFAYALHSSIGDRCRGAKVEGQIV
              330       340       350       360       370       380

220       230       240       250       260       270
m117.pep  PLSTPLENGQRVEIITAKEGHPSVNWLYEGWVKSNKAIGKIRAYIRQQNADTVREEGRVQ
          ||||||||||||||||||||||||||||||||||||||||||||||||||||||||||||
a117      PLSTPLENGQRVEIITAKEGHPSVNWLYEGWVKSNKAIGKIRAYIRQQNADTVREEGRVQ
              390       400       410       420       430       440

280       290       300       310       320       330
m117.pep  LDKQLAKLTPKPNLQELAENLGYKKPEDLYTAVGQGEISNRAIQKACGTLNEPPPVPVSE
          ||||||||||||||||||||||||||||||||||||||||||||||||||||||||||||
a117      LDKQLAKLTPKPNLQELAENLGYKKPEDLYTAVGQGEISNRAIQKACGTLNEPPPVPVSE
              450       460       470       480       490       500

340       350       360       370       380       390
m117.pep  TTIVKQSIKKGGKNGVLIDGEDGLMTTLAKCCKPAPPDDIIGFVTRERGISVHRKXXXS
          |||||||||||||||||||||||||||||||||||||||||:|||||:|||||||:  |
a117      TTIVKQSIKKGGKNGVLIDGEDGLMTTLAKCCKPAPPDDIVGFVTRDRGISVHRKTCPS
              510       520       530       540       550       560

400       410       420       430       440       450
m117.pep  FQHLAEHAPXKVLDASWAALQEGQVFAVDIEIRAQDRSGLLRDVSDALARHKLNVTAVQT
          |:||||||| |:||||||||||||||||||||||||||||||||||||||||||||||||
a117      FRHLAEHAPEKVLDASWAALQEGQVFAVDIEIRAQDRSGLLRDVSDALARHKLNVTAVQT
              570       580       590       600       610       620

460       470       480       490
m117.pep  QSRDLEASMRFTLEVKQVNDLPRVLASLGDVKGVLSVTRLX
          ||||||||||||||||||||:|||||||||||||||||||
a117      QSRDLEASMRFTLEVKQVTDLPRVLASLGDVKGVLSVTRLX
              630       640       650       660
```

The following partial DNA sequence was identified in *N. gonorrhoeae* <SEQ ID 417>:

```
g117-1.seq
     1    ATGACCGCCA TCAGCCCGAT TCAAGACACG CAAAGCGCGA CCCTGCAAGA

51    ATTGCGCGAA TGGTTCGACA GCTACTGCGC CGCTCTGCCG GACAACGATA

101    AAAACCTCAT CGGTACCGCA TGGTCGCTGG CGCAGGAACA TTATCCTGCC

151    GATGCCGCCA CGCCGTATGG CGAGCCGCTG CCCGACCACT TCCTCGGCGC

201    GGCGCAAATG GTCGACGAAC TCGACCTGCT GCCCGATGCC GTCGCCGCCA

251    CCCTGCTTGC CGACATCGGA CGCTACGTCC CCGATTGGAA CCTATTGGTT

301    TCCGAGCGCT GCAACAGCAC CGTCGCCGAG CTGGTCAAAG GTGTGGACGA

351    AGTGCAGAAA CTTACCCACT TCGCCCGGGT GGACAGCCTC GCCACGCCGG

401    AAGAACGCGC ACAGCAAGCG GAAACCATGC GGAAAATGCT GCTGGCGATG

451    GTTACCGACA TCCGCGTCGT ATTAATCAAA CTGGCGATGC GTACGCGCAC

501    CCTGCAATTT TTAAGCAACG CCCCCGACAG CCCTGAAAAA CGCGCCGTCG

551    CCAAAGAAAC CCTCGACATC TTCGCCCCGC TCGCCAACCG CTTGGGCGTG

601    TGGCAGCTCA AATGGCAGCT CGAAGATTTG GCTTCCGCC ATCAAGAACC

651    CGAAAAATAC CGCGAAATCG CCCTGCTTTT GGACGAAAAA CGCACCGAAC

701    GCCTCGAATA CATCGAAAAC TTCCTCGATA TCCTGCGTAC GGAACTCAAA

751    AAATACAATA TCCACTTTGA AGTCGCCGGC CGTCCGAAAC ACATCTACTC

801    CATTTACAAA AAAATGGTGA AGAAAAAACT CAGCTTCGAC GGCCTGTTCG

851    ACATCCGCGC CGTGCGGATT CTGGTCGATA CCGTCCCCGA GTGTTACACC

901    ACGCTGGGCA TCGTCCACAG CCTCTGGCAG CCCATTCCCG GCGagttCGA
```

```
 951   cgactACATC GCCAACCCCA AAGgcaACGg ttATAAAAGt TTGCACACCG
1001   TCATCGTcgg cccGGAagaa aaaggtgtgg aagtgcAAAT CCGCACCTTC
1051   GATATGCacc AATTCaaCga ATTCGGTGTC GCCGCCCACT GGCGTTACAA
1101   AGAAGGCGGC AAAGGCGATT CCGCCTACGA ACAAAAAATC GCCTGGTTGC
1151   GCCAACTCTT GGACTGGCGC GAAAATATGG CGGAAAGCGG CAAGGAAGAC
1201   CTCGCCGCCG CCTTCAAAAC CGAGCTTTTC AACGACACGA TTTATGTTTT
1251   GACCCCGCAC GGCAAAGTCC TCTCTCTGCC AACGGGCGCA ACCCCCATCG
1301   ACTTCGCCTA CGCCCTGCAC AGCAGCATCG GCGACCGCTG CCGGGGCGCG
1351   AAAGTCGAAG GCAGATTGT GCCGCTGTCC ACCCCGCTCG AAAACGGACA
1401   GCGCGTCGAA ATCATTACCG CCAAAGAAGG GCATCCTTCC GTCAACTGGC
1451   TTTACGAAGG CTGGGTCAAA TCCGGCAAGG CCATCGGCAA AATCCGCGCC
1501   TACATCCGCC AGCAAAACGC CGACACCGTG CGCGAAGAAG GCCGTGTCCA
1551   ACTCGACAAG CAGCTTGCCA AACTCACGCC CAAACCCAAC CTGCAAGAGC
1601   TTGCCGAAAA TCTCGGCTAC AAAAAGCCAG AAGACCTCTA CACCGCCGTC
1651   GGACAAGGCG AAATTTCCAA CCGCGCCATC CAAAAAGCCT GCGGCACGCT
1701   GAACGAACCG CCGCCCGTGC CCGTCAGCGC AACCACCATC GTCAAACAGT
1751   CCAAAATCAA AAAGGTGGC AAAACCGGCG TGCTCATCGA CGGCGAAGAC
1801   GGCTTGATGA CCACGCTTGC CAAATGCTGC AAACCCGCGC CGCCCGACGA
1851   TATTGCCGGC TTCGTTACCC GCGAGCGCGG CATTTCCGTC CACCGCAAAA
1901   CCTGCCCCTC TTTCCGACAC CTTGCCGAAC ACGCGCCCGA AAAAGTACTG
1951   GACGCAAGTT GGGCGGCGTT GCAGGAAGGG CAAGTGTTCG CCGTCGATAT
2001   CGAAATCCGC GCCCAAGACC GCTCCGGGCT TTTGCGCGAC GTATCCGACG
2051   CGCTCGCCCG CCACAAACTC AACGTTACCG CCGTGCAAAC CCAGTCCCGC
2101   GACTTGGAAG CCAGCATGAG GTTCACGCTC GAAGTCAAAC AAGTCAACGA
2151   CCTCCCGCGC GTCCTCGCCG GCCTCGGCGA TGTCAAAGGC GTATTGAGCG
2201   TTACCCGGCT TTAA
```

This corresponds to the amino acid sequence <SEQ ID 418; ORF 117-1.ng>:

```
g117-1.pep
   1   MTAISPIQDT QSATLQELRE WFDSYCAALP DNDKNLIGTA WSLAQEHYPA
  51   DAATPYGEPL PDHFLGAAQM VDELDLLPDA VAATLLADIG RYVPDWNLLV
 101   SERCNSTVAE LVKGVDEVQK LTHFARVDSL ATPEERAQQA ETMRKMLLAM
 151   VTDIRVVLIK LAMRTRTLQF LSNAPDSPEK RAVAKETLDI FAPLANRLGV
 201   WQLKWQLEDL GFRHQEPEKY REIALLLDEK RTERLEYIEN FLDILRTELK
 251   KYNIHFEVAG RPKHIYSIYK KMVKKKLSFD GLFDIRAVRI LVDTVPECYT
 301   TLGIVHSLWQ PIPGEFDDYI ANPKGNGYKS LHTVIVGPEE KGVEVQIRTF
 351   DMHQFNEFGV AAHWRYKEGG KGDSAYEQKI AWLRQLLDWR ENMAESGKED
 401   LAAAFKTELF NDTIYVLTPH GKVLSLPTGA TPIDFAYALH SSIGDRCRGA
 451   KVEGQIVPLS TPLENGQRVE IITAKEGHPS VNWLYEGWVK SGKAIGKIRA
 501   YIRQQNADTV REEGRVQLDK QLAKLTPKPN LQELAENLGY KKPEDLYTAV
```

-continued

551 GQGEISNRAI QKACGTLNEP PPVPVSATTI VKQSKIKKGG KTGVLIDGED

601 GLMTTLAKCC KPAPPDDIAG FVTRERGISV HRKTCPSFRH LAEHAPEKVL

651 DASWAALQEG QVFAVDIEIR AQDRSGLLRD VSDALARHKL NVTAVQTQSR

701 DLEASMRFTL EVKQVNDLPR VLAGLGDVKG VLSVTRL*

The following partial DNA sequence was identified in *N. meningitidis* <SEQ ID 419>:

m117-1.seq

1 ATGACCGCCA TCAGCCCGAT TCAAGACACG CAAAGCGCGA CTCTGCAAGA

51 ATTGCGCGAA TGGTTCGACA GCTACTGCGC CGCTCTGCCG GACAACGATA

101 AAAACCTCAT CGGTACCGCA TGGTTGCTGG CGCAGGAACA TTACCCCGCC

151 GATGCCGCCA CGCCGTATGG CGAGCCGCTG CCCGACCACT TCCTCGGCGC

201 GGCGCAAATG GTTCATGAAC TCGACCTGCT CCCCGATGCC GTCGCCGCCA

251 CCCTGCTTGC CGACATCGGA CGCTACGTCC CCGACTGGAA CCTATTGGTT

301 TCCGAACGCT GCAACAGTAC CGTCGCCGAG CTGGTCAAAG GTGTGGACGA

351 AGTGCAGAAA CTCACCCACT TCGCCCGGGT GGACAGCCTC GCCACGCCGG

401 AAGAACGCGC CCAGCAGGCA GAAACTATGC GGAAAATGCT GCTGGCGATG

451 GTTACCGACA TCCGCGTCGT GTTAATCAAA CTGGCGATGC GTACGCGCAC

501 CCTGCAATTT TTAAGCAACG CCCCCGACAG CCCCGAAAAA CGCGCCGTCG

551 CCAAAGAAAC CCTCGACATC TTCGCCCCGC TCGCCAACCG TTTGGGCGTG

601 TGGCAGCTCA AATGGCAGCT CGAAGATTTG GGCTTCCGCC ATCAAAAGCC

651 CGAAAAATAC CGCGAAATCG CGCTGCTTTT GGACGAAAAA CGCACCGAAC

701 GCCTCGAATA CATCGAAAAC TTCCTCAACA TCCTGCGCGG TGAACTCAAG

751 AAATACAATG TCCATTTCGA AGTCGCCGGC CGCCCGAAAC ACATCTACTC

801 CATTTACAAA AAAATGGTGA AGAAAAAACT CAGCTTCGAC GGCCTCTTTG

851 ACATCCGCGC CGTGCGAATT CTGGTTGATA CCGTCCCCGA GTGTTACACC

901 ACGCTGGGTA TCGTCCACAG CCTCTGGCAG CCCATTCCCG GCGAGTTCGA

951 CGACTACATC GCCAATCCCA AAGGCAACGG CTATAAAAGT TTGCACACCG

1001 TCATCGTCGG CCCGGAAGAC AAAGGCGTGG AAGTACAAAT CCGCACCTTC

1051 GATATGCACC AATTCAACGA ATTCGGTGTC GCCGCCCACT GGCGTTACAA

1101 AGAGGGCGGC AAGGGCGATT CCGCCTACGA ACAGAAAATC GCCTGGTTGC

1151 GCCAACTCTT GGACTGGCGC GAAAACATGG CGGAAAGCGG CAAGGAAGAC

1201 CTCGCCGCCG CCTTCAAAAC CGAGCTTTTC AACGACACGA TTTATGTTTT

1251 GACCCCGCAC GGCAAAGTCC TCTCCCTGCC CACGGGCGCG ACCCCCATCG

1301 ACTTCGCCTA CGCCCTGCAC AGCAGCATCG GCGACCGTTG CCGCGGTGCG

1351 AAAGTCGAAG GCAGATTGT GCCGCTGTCC ACCCCGCTCG AAAACGGACA

1401 GCGCGTCGAA ATCATTACCG CCAAAGAAGG GCATCCTTCC GTCAACTGGC

1451 TTTACGAAGG CTGGGTCAAA TCCAACAAGG CAATCGGCAA AATCCGCGCC

1501 TACATCCGCC AGCAAAACGC CGACACCGTG CGCGAAGAAG GCCGCGTCCA

1551 ACTCGACAAA CAGCTTGCCA AACTCACGCC CAAACCCAAC CTGCAAGAGC

1601 TTGCCGAAAA TCTCGGCTAC AAAAAGCCAG AAGACCTCTA CACCGCCGTC

-continued

```
1651   GGACAAGGCG AAATTTCCAA CCGCGCCATC CAAAAAGCCT GCGGCACGCT

1701   GAACGAACCG CCGCCCGTAC CCGTCAGCGA AACCACCATC GTCAAACAGT

1751   CCAAAATCAA AAAGGCGGC AAAACGGCG TGCTCATCGA CGGCGAAGAC

1801   GGTCTGATGA CCACGCTTGC CAAATGCTGC AAACCCGCGC CGCCCGACGA

1851   TATTATCGGC TTCGTTACCC GCGAGCGCGG CATTTCAGTG CACCGCAAAA

1901   CCTGCCCGTC TTTCCAACAC CTCGCCGAAC ACGCGCCCGA AAAAGTGCTG

1951   GACGCAAGCT GGGCGGCATT GCAGGAAGGA CAAGTATTCG CCGTCGATAT

2001   CGAAATCCGC GCCCAAGACC GCTCCGGGCT TTTGCGCGAC GTATCCGACG

2051   CGCTCGCCCG CCACAAACTC AACGTTACCG CCGTGCAAAC CCAGTCCCGC

2101   GACTTGGAAG CCAGCATGAG GTTCACGCTC GAAGTCAAAC AAGTCAACGA

2151   CCTCCCGCGC GTCCTCGCCA GCCTCGGCGA CGTCAAAGGC GTATTGAGCG

2201   TTACCCGGCT TTAA
```

This corresponds to the amino acid sequence <SEQ ID 420;
ORF 117-1>:

```
m117-1.pep
    1    MTAISPIQDT QSATLQELRE WFDSYCAALP DNDKNLIGTA WLLAQEHYPA

51    DAATPYGEPL PDHFLGAAQM VHELDLLPDA VAATLLADIG RYVPDWNLLV

101    SERCNSTVAE LVKGVDEVQK LTHFARVDSL ATPEERAQQA ETMRKMLLAM

151    VTDIRVVLIK LAMRTRTLQF LSNAPDSPEK RAVAKETLDI FAPLANRLGV

201    WQLKWQLEDL GFRHQKPEKY REIALLLDEK RTERLEYIEN FLNILRGELK

251    KYNVHFEVAG RPKHIYSIYK KMVKKKLSFD GLFDIRAVRI LVDTVPECYT

301    TLGIVHSLWQ PIPGEFDDYI ANPKGNGYKS LHTVIVGPED KGVEVQIRTF

351    DMHQFNEFGV AAHWRYKEGG KGDSAYEQKI AWLRQLLDWR ENMAESGKED

401    LAAAFKTELF NDTIYVLTPH GKVLSLPTGA TPIDFAYALH SSIGDRCRGA

451    KVEGQIVPLS TPLENGQRVE IITAKEGHPS VNWLYEGWVK SNKAIGKIRA

501    YIRQQNADTV REEGRVQLDK QLAKLTPKPN LQELAENLGY KKPEDLYTAV

551    GQGEISNRAI QKACGTLNEP PPVPVSETTI VKQSKIKKGG KNGVLIDGED

601    GLMTTLAKCC KPAPPDDIIG FVTRERGISV HRKTCPSFQH LAEHAPEKVL

651    DASWAALQEG QVFAVDIEIR AQDRSGLLRD VSDALARHKL NVTAVQTQSR

701    DLEASMRFTL EVKQVNDLPR VLASLGDVKG VLSVTRL*
``` m117-1/g117-1 98.2% identity in 737 aa overlap

```
                10         20         30         40         50         60
m117-1.pep  MTAISPIQDTQSATLQELREWFDSYCAALPDNDKNLIGTAWLLAQEHYPADAATPYGEPL
            ||||||||||||||||||||||||||||||||||||||| ||||||||||||||||||||
g117-1      MTAISPIQDTQSATLQELREWFDSYCAALPDNDKNLIGTAWSLAQEHYPADAATPYGEPL
                10         20         30         40         50         60

70         80         90        100        110        120
m117-1.pep  PDHFLGAAQMVHELDLLPDAVAATLLADIGRYVPDWNLLVSERCNSTVAELVKGVDEVQK
            |||||||||| ||||||||||||||||||||||||||||||||||||||||||||||||
g117-1      PDHFLGAAQMVDELDLLPDAVAATLLADIGRYVPDWNLLVSERCNSTVAELVKGVDEVQK
                70         80         90        100        110        120

130        140        150        160        170        180
m117-1.pep  LTHFARVDSLATPEERAQQAETMRKMLLAMVTDIRVVLIKLAMRTRTLQFLSNAPDSPEK
            ||||||||||||||||||||||||||||||||||||||||||||||||||||||||||||
g117-1      LTHFARVDSLATPEERAQQAETMRKMLLAMVTDIRVVLIKLAMRTRTLQFLSNAPDSPEK
               130        140        150        160        170        180
```

-continued

```
              190       200       210       220       230       240
m117-1.pep  RAVAKETLDIFAPLANRLGVWQLKWQLEDLGFRHQKPEKYREIALLLDEKRTERLEYIEN
            ||||||||||||||||||||||||||||||||:|||||||||||||||||||||||||||
g117-1      RAVAKETLDIFAPLANRLGVWQLKWQLEDLGFRHQEPEKYREIALLLDEKRTERLEYIEN
              190       200       210       220       230       240

250       260       270       280       290       300
m117-1.pep  FLNILRGELKKYNVHFEVAGRPKHIYSIYKKMVKKKLSFDGLFDIRAVRILVDTVPECYT
            ||:|||·||||||:||||||||||||||||||||||||||||||||||||||||||||||
g117-1      FLDILRTELKKYNIHFEVAGRPKHIYSIYKKMVKKKLSFDGLFDIRAVRILVDTVPECYT
              250       260       270       280       290       300

310       320       330       340       350       360
m117-1.pep  TLGIVHSLWQPIPGEFDDYIANPKGNGYKSLHTVIVGPEDKGVEVQIRTFDMHQFNEFGV
            ||||||||||||||||||||||||||||||||||||||:|||||||||||||||||||||
g117-1      TLGIVHSLWQPIPGEFDDYIANPKGNGYKSLHTVIVGPEEKGVEVQIRTFDMHQFNEFGV
              310       320       330       340       350       360

370       380       390       400       410       420
m117-1.pep  AAHWRYKEGGKGDSAYEQKIAWLRQLLDWRENMAESGKEDLAAAFKTELFNDTIYVLTPH
            ||||||||||||||||||||||||||||||||||||||||||||||||||||||||||||
g117-1      AAHWRYKEGGKGDSAYEQKIAWLRQLLDWRENMAESGKEDLAAAFKTELFNDTIYVLTPH
              370       380       390       400       410       420

430       440       450       460       470       480
m117-1.pep  GKVLSLPTGATPIDFAYALHSSIGDRCRGAKVEGQIVPLSTPLENGQRVEIITAKEGHPS
            ||||||||||||||||||||||||||||||||||||||||||||||||||||||||||||
g117-1      GKVLSLPTGATPIDFAYALHSSIGDRCRGAKVEGQIVPLSTPLENGQRVEIITAKEGHPS
              430       440       450       460       470       480

490       500       510       520       530       540
m117-1.pep  VNWLYEGWVKSNKAIGKIRAYIRQQNADTVREEGRVQLDKQLAKLTPKPNLQELAENLGY
            ||||||||||||:|||||||||||||||||||||||||||||||||||||||||||||||
g117-1      VNWLYEGWVKSGKAIGKIRAYIRQQNADTVREEGRVQLDKQLAKLTPKPNLQELAENLGY
              490       500       510       520       530       540

550       560       570       580       590       600
m117-1.pep  KKPEDLYTAVGQGEISNRAIQKACGTLNEPPPVPVSETTIVKQSKIKKGGKNGVLIDGED
            ||||||||||||||||||||||||||||||||||||·|||||||||||||||:|||||||
g117-1      KKPEDLYTAVGQGEISNRAIQKACGTLNEPPPVPVSATTIVKQSKIKKGGKTGVLIDGED
              550       560       570       580       590       600

610       620       630       640       650       660
m117-1.pep  GLMTTLAKCCKPAPPDDIIGFVTRERGISVHRKTCPSFQHLAEHAPEKVLDASWAALQEG
            |||||||||||||||||||·||||||||||||||||||:|||||||||||||||||||||
g117-1      GLMTTLAKCCKPAPPDDIAGFVTRERGISVHRKTCPSFRHLAEHAPEKVLDASWAALQEG
              610       620       630       640       650       660

670       680       690       700       710       720
m117-1.pep  QVFAVDIEIRAQDRSGLLRDVSDALARHKLNVTAVQTQSRDLEASMRFTLEVKQVNDLPR
            ||||||||||||||||||||||||||||||||||||||||||||||||||||||||||||
g117-1      QVFAVDIEIRAQDRSGLLRDVSDALARHKLNVTAVQTQSRDLEASMRFTLEVKQVNDLPR
              670       680       690       700       710       720

730
m117-1.pep  VLASLGDVKGVLSVTRLX
            |||:||||||||||||||
g117-1      VLAGLGDVKGVLSVTRLX
              730
``` m117-1 (SEQ ID 420)/RelA (SEQ ID 4162)

```
5sp|P55133|RELA_VIBSS GTP PYROPHOSPHOKINASE (ATP:GTP
3'-PYROPHOSPHOTRANSFERASE) (PPGPP SYNTHETASE I)
>gi|537617 (U13769) ppGpp synthetase I [Vibrio sp.]
Length = 744  Score = 536 bits (1366), Expect = e-151
Identities = 288/685 (42%), Positives = 432/685 (63%), Gaps = 31/685 (4%)
Query:  74 LDLLPDAVAATLLADI---GRYVPDWNLLVSERCNSTVAELVKGVDEVQKLTHFARVDSL  130
           L + D+A LL +      GY D   + E + T+  LV+GV+++   ++   ++   S
Sbjct:  68 LSMDADTLIAALLYPLVEGGCYSTDALKEEYSGTILHLVQGVEQMCAISQLKST        121

Query: 131 ATPEERAQQAETMRKMLLAMVTDIRVVLIKLAMRTRTLQFLSNAPDSPEKRAVAKETLDI  190
           A    +A Q + +R+MLL+MV D R V+IKLA R    L+ + + PD    +RA A+E +I
Sbjct: 122 AEETAQAAQVDNIRRMLLSMVDDFRCVVIKLAERICNLREVKDQPDEV--RRAAAQECANI  180

Query: 191 FAPLANRLGVWQLKWQLEDLGFRHQKPEKYREIALLLDEKRTERLEYIENFLNILRGELK  250
           +APLANRLG+ QLKW++ED FR+Q P+ Y++IA  L E+R +YI +F++    L    +K
Sbjct: 181 YAPLANRLGIGQLKWEIEDYAFRYQHPDTYKQIAKQLSERRIDREDYITHFVDDLSDAMK   240

Query: 251 KYNVHFEVAGRPKHIYSIYKKMVKKKLSFDGLFDIRAVRILVDTVPECYTTLGIVHSLWQ  310
            N+  EV GRPKHIYSI++KM KK L FD LFD+RAVRI+   +  CY  LG+VH+ ++
Sbjct: 241 ASNIRAEVQGRPKHIYSIWRKMQKKSLEFDELFDVRAVRIVAEELQDCYAALGVVHTKYR   300

Query: 311 PIPGEFDDYIANPKGNGYKSLHTVIVGPEDKGVEVQIRTFDMHQFNEFGVAAHWRYKEG-  369
            +P EFDDY+ANPK NGY+S+HTV++GPE K +E+QIRT  MH++ +E GVAAHW+YKEG
Sbjct: 301 HLPKEFDDYVANPKPNGYQSIHTVVLGPEGKTIEIQIRTKQMHEESELGVAAHWYKEGT    360
```

-continued

```
Query: 370 --GKGDSAYEQKIAWLRQLLDWRENMAESGKEDLAAAFKTELFNDTIYVLTPHGKVLSLP   427
           G   SAY++KI WLR+LL W+E M++SG  ++     ++++F+D +Y  TP G V+ LP
Sbjct: 361 ASGGAQSAYDEKINWLRKLLAWQEEMSDSG--EMLDELRSQVFDDRVYAFTPKGDVVDLP   418

Query: 428 TGATPIDFAYALHSSIGDRCRGAKVEGQIVPLSTPLENGQRVEIITAKEGHPSVNWLYE-   486
           + ATP+DFAY +HS +G RC GAKVEG+IVP +  L+ G +VEIIT KE +PS +WL
Sbjct: 419 SNATPLDFAYHIHSEVGHRCIGAKVEGRIVPFTYHLQMGDQVEIITQKEPNPSRDWLNPN   478

Query: 487 -GWVKSNKAIGKIRAYIRQQNADTVREEGRVQLDKQLAKL--TPKPNLQELAENLGYKKP   543
           G+V S++A  K+ A+ R+Q+ D     G+  L+ +L K+  T K      A+    K P
Sbjct: 479 LGFVTSSRARAKVHAWFRKQDRDKNIIAGKEILEAELVKIHATLKDAQYYAAKRFNVKSP   538

Query: 544 EDLYTAVGQGEIS-NRAIQKACGTLNEPPPVPVSETTIVKQSKIKKGGKNGV           594
           E+LY  +G G++  N+ I      +N+P      +  + K S+         KK  ++ V
Sbjct: 539 EELYAGIGSGDLRINQVINHINALVNKPTAEEEDQQLLEKLSEASNKQATSHKKPQRDAV   598

Query: 595 LIDGEDGLMTTLAKCCKPAPPDDIIGFVTRERGISVHRKTCPSFQHLAEHAPEKVLDASW   654
           +++G D LMT LA+CC+P P DDI GFVT+ RGISVHR  C   + L  HAPE++D  W
Sbjct: 599 VVEGVDNLMTHLARCCQP IPGDDIQGFVTQGRGISVHRMDCEQLEELRHHAPERIIDTVW  658

Query: 655 AALQEGQVFAVDIEIRAQDRSGLLRDVSDALARHKLNVTAVQTQ--SRDLEASMRFTLEV   712
                G  + + + + A +R+GLL+++++ L   K+ V  ++++   +   + M F LE+
Sbjct: 659 GGGFVGN-YTITVRVTASERNGLLKELTNTLMNEKVKVAGMKSRVDYKKQMSIMDFELEL   717

Query: 713 KQVNDLPRVLASLGDVKGVLSVTRL                                     737
             +  L RVL  +  VK V    RL
Sbjct: 718 TDLEVLGRVLKRIEQVKDVAEAKRL                                     742
```

The following partial DNA sequence was identified in *N. meningitidis* <SEQ ID 421>:

```
a117-1.seq
   1   ATGACCGCCA TCAGCCCGAT TCAAGACACG CAAAGCGCGA CTCTGCAAGA
  51   ATTGCGCGAA TGGTTCGACA GCTACTGCAC CGCGCTGCCG AACAACGATA
 101   AAAAACTTGT CTTAGCCGCC CGTTCGCTGG CGGAAGCACA TTACCCCGCC
 151   GATGCCGCCA CGCCGTATGG CGAACCGCTG CCCGACCACT TCCTCGGCGC
 201   GGCGCAAATG GTTCATGAAC TCGACCTGCT CCCCGATGCC GTCGCCGCCA
 251   CCCTGCTTGC CGACATCGGA CGCTACGTCC CCGACTGGAA CCTATTGGTT
 301   TCCGAACGCT GCAACAGTAC CGTCGCCGAG CTGGTCAAAG GTGTGGACGA
 351   AGTGCAGAAA CTCACCCACT TCGCCCGGGT GGACAGCCTC GCCACGCCGG
 401   AAGAACGCGC CCAGCAGGCA GAAACTATGC GGAAAATGCT GCTGGCGATG
 451   GTTACCGACA TCCGCGTCGT GTTAATCAAA CTGGCGATGC GTACGCGCAC
 501   CCTGCAATTT TTAAGCAACG CCCCCGACAG CCCCGAAAAA CGCGCCGTCG
 551   CCAAAGAAAC CCTCGACATC TTCGCCCCGC TCGCCAACCG TTTGGGCGTG
 601   TGGCAGCTCA AATGGCAGCT CGAAGATTTG GGCTTCCGCC ATCAAGAACC
 651   CGAAAAATAC CGCGAAATCG CCCTGCTTTT GGACGAAAAA CGCACCGAAC
 701   GCCTCGAATA CATCGAAAAC TTCCTTAATA TCCTGCGTAC GGAACTCAAA
 751   AAATACAATA TCCACTTTGA AGTCGCCGGC CGTCCGAAAC ACATCTACTC
 801   CATTTACAAA AAAATGGTGA AGAAAAAACT CAGCTTCGAC GGGTTGTTCG
 851   ACATCCGCGC CGTGCGGATT CTGGTTGATA CCGTCCCCGA GTGTTACACC
 901   ACACTGGGCA TTGTCCACAG CCTCTGGCAG CCCATTCCCG GCGAGTTCGA
 951   CGACTACATC GCCAACCCGA AAGGCAACGG CTATAAAAGT TTGCACACCG
1001   TCATCGTCGG CCCGGAAGAC AAAGGCGTGG AAGTGCAAAT CCGCACCTTC
1051   GATATGCACC AATTCAACGA ATTCGGTGTC GCCGCGCACT GGCGTTACAA
1101   AGAGGGCGGC AAAGGCGATT CCGCCTACGA ACAAAAAATC GCCTGGTTAC
```

```
1151    GCCAACTTTT GGACTGGCGC GAAAACATGG CGGAAAGCGG CAAGGAAGAC

1201    CTCGCCGCCG CCTTCAAAAC CGAGCTTTTC AACGACACGA TTTATGTTTT

1251    GACCCCGCAC GGCAAAGTCC TCTCCCTGCC CACAGGCGCG ACCCCCATCG

1301    ACTTCGCCTA CGCCCTGCAC AGCAGCATCG GCGACCGTTG CCGCGGTGCG

1351    AAAGTCGAAG GCAGATTGT  GCCGCTGTCC ACCCCGCTCG AAAACGGACA

1401    GCGTGTCGAA ATCATTACCG CCAAAGAAGG CATCCTTCC  GTCAACTGGC

1451    TTTACGAAGG CTGGGTCAAA TCCAACAAGG CAATCGGCAA ATCCGCGCC

1501    TACATCCGCC AGCAAAACGC CGACACCGTG CGCGAAGAAG GCCGCGTCCA

1551    ACTCGACAAA CAGCTTGCCA AACTCACGCC CAAACCCAAC CTGCAAGAGC

1601    TTGCCGAAAA TCTCGGCTAC AAAAAGCCAG AAGACCTCTA CACCGCCGTC

1651    GGACAAGGCG AAATTTCCAA CCGCGCCATC CAAAAAGCCT GCGGCACGCT

1701    GAACGAACCG CCGCCCGTAC CCGTCAGCGA AACCACCATC GTCAAACAGT

1751    CCAAAATCAA AAAGGCGGC  AAAAACGGCG TGCTCATCGA CGGCGAAGAC

1801    GGTCTGATGA CCACGCTTGC CAAATGCTGC AAACCCGCGC CGCCCGACGA

1851    CATTGTCGGC TTCGTTACCC GCGATCGCGG CATTTCGGTA CACCGCAAAA

1901    CCTGCCCCTC TTTCCGACAC CTCGCCGAAC ACGCGCCCGA AAAAGTACTG

1951    GACGCAAGTT GGGCGGCGTT GCAGGAAGGA CAAGTGTTCG CCGTCGATAT

2001    CGAAATCCGC GCCCAAGACC GCTCCGGGCT TTTGCGCGAC GTATCCGACG

2051    CGCTCGCCCG CCACAAACTC AACGTTACCG CCGTGCAAAC CCAGTCCCGC

2101    GACTTGGAAG CCAGCATGAG GTTCACGCTC GAAGTCAAAC AAGTTACCGA

2151    CCTCCCACGC GTCCTCGCCA GCCTCGGCGA CGTCAAAGGC GTATTGAGCG

2201    TTACCCGGCT TTAA
```

This corresponds to the amino acid sequence <SEQ ID 422; ORF 117-1.a>:

```
a117-1.pep
    1   MTAISPIQDT QSATLQELRE WFDSYCTALP NNDKKLVLAA RSLAEAHYPA

51   DAATPYGEPL PDHFLGAAQM VHELDLLPDA VAATLLADIG RYVPDWNLLV

101   SERCNSTVAE LVKGVDEVQK LTHFARVDSL ATPEERAQQA ETMRKMLLAM

151   VTDIRVVLIK LAMRTRTLQF LSNAPDSPEK RAVAKETLDI FAPLANRLGV

201   WQLKWQLEDL GFRHQEPEKY REIALLLDEK RTERLEYIEN FLNILRTELK

251   KYNIHFEVAG RPKHIYSIYK KMVKKKLSFD GLFDIRAVRI LVDTVPECYT

301   TLGIVHSLWQ PIPGEFDDYI ANPKGNGYKS LHTVIVGPED KGVEVQIRTF

351   DMHQFNEFGV AAHWRYKEGG KGDSAYEQKI AWLRQLLDWR ENMAESGKED

401   LAAAFKTELF NDTIYVLTPH GKVLSLPTGA TPIDFAYALH SSIGDRCRGA

451   KVEGQIVPLS TPLENGQRVE IITAKEGHPS VNWLYEGWVK SNKAIGKIRA

501   YIRQQNADTV REEGRVQLDK QLAKLTPKPN LQELAENLGY KKPEDLYTAV

551   GQGEISNRAI QKACGTLNEP PPVPVSETTI VKQSIKKGG  KNGVLIDGED

601   GLMTTLAKCC KPAPPDDIVG FVTRDRGISV HRKTCPSFRH LAEHAPEKVL

651   DASWAALQEG QVFAVDIEIR AQDRSGLLRD VSDALARHKL NVTAVQTQSR

701   DLEASMRFTL EVKQVTDLPR VLASLGDVKG VLSVTRL*
``` a117-1/m117-1 97.7% identity in 737 aa overlap

```
                    10         20         30         40         50         60
m117-1.pep  MTAISPIQDTQSATLQELREWFDSYCAALPDNDKNLIGTAWLLAQEHYPADAATPYGEPL
            ||||||||||||||||||||||||:|||:|||:|   ||: ||||:|||||||||||||
a117-1      MTAISPIQDTQSATLQELREWFDSYCTALPNNDKKLVLAARSLAEAHYPADAATPYGEPL
                    10         20         30         40         50         60

70         80         90        100        110        120
m117-1.pep  PDHFLGAAQMVHELDLLPDAVAATLLADIGRYVPDWNLLVSERCNSTVAELVKGVDEVQK
            ||||||||||||||||||||||||||||||||||||||||||||||||||||||||||||
a117-1      PDHFLGAAQMVHELDLLPDAVAATLLADIGRYVPDWNLLVSERCNSTVAELVKGVDEVQK
                    70         80         90        100        110        120

130        140        150        160        170        180
m117-1.pep  LTHFARVDSLATPEERAQQAETMRKMLLAMVTDIRVVLIKLAMRTRTLQFLSNAPDSPEK
            ||||||||||||||||||||||||||||||||||||||||||||||||||||||||||||
a117-1      LTHFARVDSLATPEERAQQAETMRKMLLAMVTDIRVVLIKLAMRTRTLQFLSNAPDSPEK
                   130        140        150        160        170        180

190        200        210        220        230        240
m117-1.pep  RAVAKETLDIFAPLANRLGVWQLKWQLEDLGFRHQKPEKYREIALLLDEKRTERLEYIEN
            |||||||||||||||||||||||||||||||||||:||||||||||||||||||||||||
a117-1      RAVAKETLDIFAPLANRLGVWQLKWQLEDLGFRHQEPEKYREIALLLDEKRTERLEYIEN
                   190        200        210        220        230        240

250        260        270        280        290        300
m117-1.pep  FLNILRGELKKYNVHFEVAGRPKHIYSIYKKMVKKKLSFDGLFDIRAVRILVDTVPECYT
            ||||||:||||||||:||||||||||||||||||||||||||||||||||||||||||||
a117-1      FLNILRTELKKYNIHFEVAGRPKHIYSIYKKMVKKKLSFDGLFDIRAVRILVDTVPECYT
                   250        260        270        280        290        300

310        320        330        340        350        360
m117-1.pep  TLGIVHSLWQPIPGEFDDYIANPKGNGYKSLHTVIVGPEDKGVEVQIRTFDMHQFNEFGV
            ||||||||||||||||||||||||||||||||||||||||||||||||||||||||||||
a117-1      TLGIVHSLWQPIPGEFDDYIANPKGNGYKSLHTVIVGPEDKGVEVQIRTFDMHQFNEFGV
                   310        320        330        340        350        360

370        380        390        400        410        420
m117-1.pep  AAHWRYKEGGKGDSAYEQKIAWLRQLLDWRENMAESGKEDLAAAFKTELFNDTIYVLTPH
            ||||||||||||||||||||||||||||||||||||||||||||||||||||||||||||
a117-1      AAHWRYKEGGKGDSAYEQKIAWLRQLLDWRENMAESGKEDLAAAFKTELFNDTIYVLTPH
                   370        380        390        400        410        420

430        440        450        460        470        480
m117-1.pep  GKVLSLPTGATPIDFAYALHSSIGDRCRGAKVEGQIVPLSTPLENGQRVEIITAKEGHPS
            ||||||||||||||||||||||||||||||||||||||||||||||||||||||||||||
a117-1      GKVLSLPTGATPIDFAYALHSSIGDRCRGAKVEGQIVPLSTPLENGQRVEIITAKEGHPS
                   430        440        450        460        470        480

490        500        510        520        530        540
m117-1.pep  VNWLYEGWVKSNKAIGKIRAYIRQQNADTVREEGRVQLDKQLAKLTPKPNLQELAENLGY
            ||||||||||||||||||||||||||||||||||||||||||||||||||||||||||||
a117-1      VNWLYEGWVKSNKAIGKIRAYIRQQNADTVREEGRVQLDKQLAKLTPKPNLQELAENLGY
                   490        500        510        520        530        540

550        560        570        580        590        600
m117-1.pep  KKPEDLYTAVGQGEISNRAIQKACGTLNEPPPVPVSETTIVKQSKIKKGGKNGVLIDGED
            ||||||||||||||||||||||||||||||||||||||||||||||||||||||||||||
a117-1      KKPEDLYTAVGQGEISNRAIQKACGTLNEPPPVPVSETTIVKQSKIKKGGKNGVLIDGED
                   550        560        570        580        590        600

610        620        630        640        650        660
m117-1.pep  GLMTTLAKCCKPAPPDDIIGFVTRERGISVHRKTCPSFQHLAEHAPEKVLDASWAALQEG
            |||||||||||||||||||:||||:|||||||||||||:|||||||||||||||||||||
a117-1      GLMTTLAKCCKPAPPDDIVGFVTRDRGISVHRKTCPSFRHLAEHAPEKVLDASWAALQEG
                   610        620        630        640        650        660

670        680        690        700        710        720
m117-1.pep  QVFAVDIEIRAQDRSGLLRDVSDALARHKLNVTAVQTQSRDLEASMRFTLEVKQVNDLPR
            ||||||||||||||||||||||||||||||||||||||||||||||||||||||||:|||
a117-1      QVFAVDIEIRAQDRSGLLRDVSDALARHKLNVTAVQTQSRDLEASMRFTLEVKQVTDLPR
                   670        680        690        700        710        720

730
m117-1.pep  VLASLGDVKGVLSVTRLX
            ||||||||||||||||||
a117-1      VLASLGDVKGVLSVTRLX
                   730
```

The following partial DNA sequence was identified in *N. gonorrhoeae* <SEQ ID 423>:

```
g118.seq
     1   ATGTGCGAGT TCAAGGATTT TAGAAGAAAC ATCCCTTGTT TTGAAGAGTA

51   TGACGAAAAT TCATTTATTG GCAAATGGTA TGATGACGGG GTGTGGGATG

101   ATGAAGAATA TTGGAAGCTG GAGAATGATT TAATcgaGGT TAGGAGAAAA
```

-continued

```
    151    TATCCTTATC CGATGGATAT ACCAAGGGAT ATTGTGATTG GAATCGGTAC

201    CATTATTGAT TTTTTAATGG TTCCAAATTG GGAGCTTTTT GAAATTAAAG

251    CTTCCCCTTG GTTGCCTGAT AGCGTGGGAA TTCATGAACG TTATGAAAGA

301    TTCACAACGA TGCTCCGTTA TATTTTTACC GAGAAAGACA TAGTCAACGT

351    GCGATTTGAT TATTACAaCA AAAAATAG
```

This corresponds to the amino acid sequence <SEQ ID 424; ORF 118.ng>:

```
g118.pep
     1    MCEFKDFRRN IPCFEEYDEN SFIGKWYDDG VWDDEEYWKL ENDLIEVRRK

51    YPYPMDIPRD IVIGIGTIID FLMVPNWELF EIKASPWLPD SVGIHERYER

101   FTTMLRYIFT EKDIVNVRFD YYNKK*
```

The following partial DNA sequence was identified in *N. meningitidis* <SEQ ID 425>:

```
m118.seq
     1    ATGTGTGAGT TCAAGGATAT TATAAGAAAC GTTCCTTATT TTGAGGGGTA

51    TGACGAAAAT TCATTTATTG GCAAATGGTA TGATGACGGG GTGTGGGATG

101   ATGAAGAATA TTGGAAGTTG GAGAATGATT TAATCGAGGT TAGAAAAAAA

151   TATCCTTATC CGATGGACAT ACCAAGATAT GTTGTCATTG GAATCGGTAC

201   CATTATTGAT TTCTTAATGG TTCCAAATTG GAAACTTTTT GAAATTAAAG

251   CTTCCCCTTG GTTGCCTGAT AGTGTGGGAA TTCATGAACG TTATGAAAGA

301   TTCACAACGA TGCTCCGTTA TATTTTTACC GAGAAAGACA TAGTCAACGT

351   GCGATTTGAT TATTACAACA AAAAATAG
```

This corresponds to the amino acid sequence <SEQ ID 426; ORF 118>:

```
m118.pep
     1    MCEFKDIIRN VPYFEGYDEN SFIGKWYDDG VWDDEEYWKL ENDLIEVRKK

51    YPYPMDIPRY VVIGIGTIID FLMVPNWKLF EIKASPWLPD SVGIHERYER

101   FTTMLRYIFT EKDIVNVRFD YYNKK*
```

Computer analysis of this amino acid sequence gave the following results:
Homology with a Predicted ORF from *N. gonorrhoeae*
ORF 118 shows 92.8% identity over a 125 aa overlap with a predicted ORF (ORF 118.ng) from *N. gonorrhoeae*:

```
    m118/g118
                    10         20         30         40         50         60
    m118.pep  MCEFKDIIRNVPYFEGYDENSFIGKWYDDGVWDDEEYWKLENDLIEVRKKYPYPMDIPRY
              ||||||:||:|||||||||||||||||||||||||||||||||||:||||||||||
    g118      MCEFKDFRRNIPCFEEYDENSFIGKWYDDGVWDDEEYWKLENDLIEVRRKYPYPMDIPRD
                    10         20         30         40         50         60

70         80         90        100        110        120
    m118.pep  VVIGIGTIIDFLMVPNWKLFEIKASPWLPDSVGIHERYERFTTMLRYIFTEKDIVNVRFD
              :|||||||||||||||||:|||||||||||||||||||||||||||||||||||||||||
    g118      IVIGIGTIIDFLMVPNWELFEIKASPWLPDSVGIHERYERFTTMLRYIFTEKDIVNVRFD
                    70         80         90        100        110        120
```

```
m118.pep  YYNKKX
          ||||||
    g118  YYNKKX
```

The following partial DNA sequence was identified in *N. meningitidis* <SEQ ID 427>:

```
a118.seq
    1  ATGTGTGAGT TCAAGGATTT TAGAAGAAAC ATCCCTTGTT TTGAAGAGTA

51  TGACGAAAAT TCATTTATTG GCAAATGGTA TGATGACGGG GTGTGGGATG

101  ATGAAGAATA TTGGAAATTG GAGAATGATT TAATCGAGGT TAGAAAAAAA

151  TATCCTTATC CGATGGATAT ACCAAGGGAT ATTGTGATTG GAATCGGTAC

201  CATTATTGAT TTTTTAATGG TTCCAAATTG GGAGCTTTTT GAAATTAAAG

251  CTTCCCCTTG GTTGCCTGAT AGTGTGGGAA TTCATGAACG TTATGAAAGA

301  TTCACAACGA TGCTCCGTTA TATTTTTACC GAGAAAGACA TAGTCAACGT

351  GCGATTTGAT TATTACAACA AAAAATAG
```

This corresponds to the amino acid sequence <SEQ ID 428; ORF 118.a>:

```
a118.pep
    1  MCEFKDFRRN IPCFEEYDEN SFIGKWYDDG VWDDEEYWKL ENDLIEVRKK

51  YPYPMDIPRD IVIGIGTIID FLMVPNWELF EIKASPWLPD SVGIHERYER

101  FTTMLRYIFT EKDIVNVRFD YYNKK*
``` m118/a118 93.6% identity in 125 aa overlap

```
                   10         20         30         40         50         60
 m118.pep  MCEFKDIIRNVPYFEGYDENSFIGKWYDDGVWDDEEYWKLENDLIEVRKKYPYPMDIPRY
           ||||||: ||:| || |||||||||||||||||||||||||||||||||||||||||||
     a118  MCEFKDFRRNIPCFEEYDENSFIGKWYDDGVWDDEEYWKLENDLIEVRKKYPYPMDIPRD
                   10         20         30         40         50         60

70         80         90        100        110        120
 m118.pep  VVIGIGTIIDFLMVPNWKLFEIKASPWLPDSVGIHERYERFTTMLRYIFTEKDIVNVRFD
           :|||||||||||||||||:|||||||||||||||||||||||||||||||||||||||||
     a118  IVIGIGTIIDFLMVPNWELFEIKASPWLPDSVGIHERYERFTTMLRYIFTEKDIVNVRFD
                   70         80         90        100        110        120 m118.pep  YYNKKX
           ||||||
     a118  YYNKKX
```

The following partial DNA sequence was identified in *N. gonorrhoeae* <SEQ ID 429>:

```
g120.seq
    1  ATGATGAAGA CTTTTAAAAA TATATTTTCC GCCGCCATTT TGTCCGCCGC

51  CCTGCCGTGC GCGTATGCGG CAAGGCTACC CCAATCCGCC GTGCTGCACT

101  ATTCCGGCAG CTACGGCATT CCCGCCACGA TGACATTTGA ACGCAGCGGC

151  AATGCTTACA AAATCGTTTC GACGATTAAA GTGCCGCTAT ACAATATCCG

201  TTTCGAATCC GGCGGTACGG TTGTCGGCAA TACCCTGCAC CCTGCCTACT

251  ATAAAGACAT ACGCAGGGGC AAACTGTATG CGGAAGCCAA ATTCGCCGAC

301  GGCAGCGTAA CCTACGGCAA AGCGGGCGAG AGCAAAACCG AGCAAAGCCC

351  CAAGGCTATG GATTTGTTCA CGCTTGCCTG GCAGTTGGCG GCAAATGACG
```

```
401  CGAAACTCCC CCCGGGTCTG AAAATCACCA ACGGCAAAAA ACTTTATTCC

451  GTCGGCGGCC TGAATAAGGC GGGTACGGGA AAATACAGCA Taggcggcgt 501  gGAAACCGAA GTCGTCAAAT ATCGGGTGCG GCGCGGCGAC GATACGGTAA

551  CGTATTTCTT CGCACCGTCC CTGAACAATA TTCCGGCACA AATCGGCTAT

601  ACCGAcgaCG GCAAAACCTA TACGCTGAAG CTCAAATCGG TGCAGATCAA

651  CGGACAGGCC GCCAAACCGT AA
```

This corresponds to the amino acid sequence <SEQ ID 430; ORF 120.ng>:

```
g120.pep
  1  MMKTFKNIFS AAILSAALPC AYAARLPQSA VLHYSGSYGI PATMTFERSG

51  NAYKIVSTIK VPLYNIRFES GGTVVGNTLH PAYYKDIRRG KLYAEAKFAD

101  GSVTYGKAGE SKTEQSPKAM DLFTLAWQLA ANDAKLPPGL KITNGKKLYS

151  VGGLNKAGTG KYSIGGVETE VVKYRVRRGD DTVTYFFAPS LNNIPAQIGY

201  TDDGKTYTLK LKSVQINGQA AKP*
```

The following partial DNA sequence was identified in *N. meningitidis* <SEQ ID 431>:

```
m120.seq
  1  ATGATGAAGA CTTTTAAAAA TATATTTTCC GCCGCCATTT TGTCCGCCGC

51  CCTGCCGTGC GCGTATGCGG CAGGGCTGCC CCAATCCGCC GTGCTGmACT

101  ATTCCGGCAG CTACGGCATT CCCGCCACGA TGACATTTGA ACGCAGCGGC

151  AATGCTTACA AAATCGTTTC GACGATTAAA GTGCCGCTAT ACAATATCCG

201  TTTCGAGTCC GGCGGTACGG TTGTCGGCAA TACCCTGCAC CCTACCTACT

251  ATAGAGACAT ACGCAGGGGC AAACTGTATG CGGAAGCcAA ATTCGCCGAC

301  GGCAGCGTAA CTTACGGCAA AGCGGGCGAG AGCAAAACCG AGCAAAGCCC

351  CAAGGCTATG GATTTGTTCA CGCTTGCCTG GCAGTTGGCG GCAAATGACG

401  CGAAACTCCC CCCGGGGCTG AAAATCACCA ACGGCAAAAA ACTTTATTCC

451  GTCGGCGGTT TGAATAAGGC GGGTACAGGA AAATACAGCA TAGGCGGCGT

501  GGAAACCGAA GTCGTCAAAT ATCGGGTGCG GCGCGGCGAC GATGCGGTAA

551  TGTATTTCTT CGCACCGTCC CTGAACAATA TTCCGGCACA AATCGGCTAT

601  ACCGACGACG GCAAAACCTA TACGCTGAAA CTCAAATCGG TGCAGATCAA

651  CGGCCAGGCA GCCAAACCG
```

This corresponds to the amino acid sequence <SEQ ID 432; ORF 120>:

```
m120.pep
  1  MMKTFKNIFS AAILSAALPC AYAAGLPQSA VLXYSGSYGI PATMTFERSG

51  NAYKIVSTIK VPLYNIRFES GGTVVGNTLH PTYYRDIRRG KLYAEAKFAD

101  GSVTYGKAGE SKTEQSPKAM DLFTLAWQLA ANDAKLPPGL KITNGKKLYS

151  VGGLNKAGTG KYSIGGVETE VVKYRVRRGD DAVMYFFAPS LNNIPAQIGY

201  TDDGKTYTLK LKSVQINGQA AKP
```

Computer analysis of this amino acid sequence gave the following results:
Homology with a Predicted ORF from *N. gonorrhoeae*
ORF 120 shows 97.3% identity over a 223 aa overlap with a predicted ORF (ORF 120.ng) from *N. gonorrhoeae*:

```
    m120/g120
                      10        20        30        40        50        60
    m120.pep  MMKTFKNIFSAAILSAALPCAYAAGLPQSAVLXYSGSYGIPATMTFERSGNAYKIVSTIK
              |||||||||||||||||||||||||| ||||||| |||||||||||||||||||||||||
    g120      MMKTFKNIFSAAILSAALPCAYAARLPQSAVLHYSGSYGIPATMTFERSGNAYKIVSTIK
                      10        20        30        40        50        60

70        80        90       100       110       120
    m120.pep  VPLYNIRFESGGTVVGNTLHPTYYRDIRRGKLYAEAKFADGSVTYGKAGESKTEQSPKAM
              |||||||||||||||||||||||||:||:|||||||||||||||||||||||||||||||
    g120      VPLYNIRFESGGTVVGNTLHPAYYKDIRRGKLYAEAKFADGSVTYGKAGESKTEQSPKAM
                      70        80        90       100       110       120

130       140       150       160       170       180
    m120.pep  DLFTLAWQLAANDAKLPPGLKITNGKKLYSVGGLNKAGTGKYSIGGVETEVVKYRVRRGD
              ||||||||||||||||||||||||||||||||||||||||||||||||||||||||||||
    g120      DLFTLAWQLAANDAKLPPGLKITNGKKLYSVGGLNKAGTGKYSIGGVETEVVKYRVRRGD
                     130       140       150       160       170       180

190       200       210       220
    m120.pep  DAVMYFFAPSLNNIPAQIGYTDDGKTYTLKLKSVQINGQAAKP
              |:| ||||||||||||||||||||||||||||||||||||||
    g120      DTVTYFFAPSLNNIPAQIGYTDDGKTYTLKLKSVQINGQAAKPX
                     190       200       210       220
```

The following partial DNA sequence was identified in *N. meningitidis* <SEQ ID 433>:

```
a120.seq
     1    ATGATGAAGA CTTTTAAAAA TATATTTTCC GCCGCCATTT TGTCCGCCGC

51    CCTGCCGTGC GCGTATGCGG CAGGGCTGCC CCAATCCGCC GTGCTGCACT

101    ATTCCGGCAG CTACGGCATT CCCGCCACGA TGACATTTGA ACGCAGCGGC

151    AATGCTTACA AAATCGTTTC GACGATTAAA GTGCCGCTAT ACAATATCCG

201    TTTCGAGTCC GGCGGTACGG TTGTCGGCAA TACCCTGCAC CCTACCTACT

251    ATAGAGACAT ACGCAGGGGC AAACTGTATG CGGAAGCCAA ATTCGCCGAC

301    GGCAGCGTAA CCTACGGCAA AGCGGGCGAG AGCAAAACCG AGCAAAGCCC

351    CAAGGCTATG GATTTGTTCA CGCTTGCCTG GCAGTTGGCG GCAAATGACG

401    CGAAACTCCC CCCGGGGCTG AAAATCACCA ACGGCAAAAA ACTTTATTCC

451    GTCGGCGGTT TGAATAAGGC GGGTACAGGA AAATACAGCA TAGGCGGCGT

501    GGAAACCGAA GTCGTCAAAT ATCGGGTGCG GCGCGGCGAC GATGCGGTAA

551    TGTATTTCTT CGCACCGTCC CTGAACAATA TTCCGGCACA AATCGGCTAT

601    ACCGACGACG GCAAAACCTA TACGCTGAAA CTCAAATCGG TGCAGATCAA

651    CGGCCAGGCA GCCAAACCGT AA
```

This corresponds to the amino acid sequence <SEQ ID 434; ORF 120.a>:

```
a120.pep
     1    MMKTFKNIFS AAILSAALPC AYAAGLPQSA VLHYSGSYGI PATMTFERSG

51    NAYKIVSTIK VPLYNIRFES GGTVVGNTLH PTYYRDIRRG KLYAEAKFAD

101    GSVTYGKAGE SKTEQSPKAM DLFTLAWQLA ANDAKLPPGL KITNGKKLYS

151    VGGLNKAGTG KYSIGGVETE VVKYRVRRGD DAVMYFFAPS LNNIPAQIGY

201    TDDGKTYTLK LKSVQINGQA AKP*
``` m120/a120 99.6% identity in 223 aa overlap

```
              10        20        30        40        50        60
m120.pep  MMKTFKNIFSAAILSAALPCAYAAGLPQSAVLXYSGSYGIPATMTFERSGNAYKIVSTIK
          ||||||||||||||||||||||||||||||| ||||||||||||||||||||||||||||
a120      MMKTFKNIFSAAILSAALPCAYAAGLPQSAVLHYSGSYGIPATMTFERSGNAYKIVSTIK
              10        20        30        40        50        60

70        80        90       100       110       120
m120.pep  VPLYNIRFESGGTVVGNTLHPTYYRDIRRGKLYAEAKFADGSVTYGKAGESKTEQSPKAM
          ||||||||||||||||||||||||||||||||||||||||||||||||||||||||||||
a120      VPLYNIRFESGGTVVGNTLHPTYYRDIRRGKLYAEAKFADGSVTYGKAGESKTEQSPKAM
              70        80        90       100       110       120

130       140       150       160       170       180
m120.pep  DLFTLAWQLAANDAKLPPGLKITNGKKLYSVGGLNKAGTGKYSIGGVETEVVKYRVRRGD
          ||||||||||||||||||||||||||||||||||||||||||||||||||||||||||||
a120      DLFTLAWQLAANDAKLPPGLKITNGKKLYSVGGLNKAGTGKYSIGGVETEVVKYRVRRGD
             130       140       150       160       170       180

190       200       210       220
m120.pep  DAVMYFFAPSLNNIPAQIGYTDDGKTYTLKLKSVQINGQAAKPX
          |||||||||||||||||||||||||||||||||||||||||||
a120      DAVMYFFAPSLNNIPAQIGYTDDGKTYTLKLKSVQINGQAAKPX
             190       200       210       220
```

The following partial DNA sequence was identified in *N. gonorrhoeae* <SEQ ID 435>:

```
g121.seq
    1  ATGGAAACAC AGCTTTACAT CGGCATTATG TCGGGAACCA GTATGGACGG

51  GGCGGATGCC GTGCTGGTAC GGATGGACGG CGGCAAATGG CTGGGCGCGG

101  AAGGGCACGC CTTTACCCCC TACCCTGACC GGTTGCGCCG CAAATTGCTG

151  GATTTGCAGG ACACAGGCAC AGACGAACTG CACCGCAGCA GGATGTTGTC

201  GCAAGAACTC AGCCGCCTGT ACGCGCAAAC CGCCGCCGAA CTGCTGTGCA

251  GTCAAAACCT CGCTCCGTGC GACATTACCG CCCTCGGCTG CCACGGGCAA

301  ACCGTCCGAC ACGCGCCGGA ACACGGTtac AGCATACAGC TTGCCGATTT

351  GCCGCTGCTG GCGGAACTGa cgcggatttT TACCGTCggc gacttcCGCA

401  GCCGCGACCT TGCTGCCGGC GGacaAGGTG CGCCGCTCGT CCCCGCCTTT

451  CACGAAGCCC TGTTCCGCGA TGACAGGGAA ACACGCGTGG TACTGAACAT

501  CGGCGGGATT GCCAACATCA GCGTACTCCC CCCCGGCGCA CCCGCCTTCG

551  GCTTCGACAC AGGGCCGGGC AATATGCTGA TGGAcgcgtg gacgcaggca 601  cacTGGcagc TGCCTTACGA CAAAAacggt gcAAAGgcgg cacAAGGCAA 651  catatTGCcg cAACTGCTCG gcaggctGCT CGCCcaccCG TATTTCTCAC 701  AACCCcaccc aaAAAGCACG GGgcGCGaac TgtttgcccT AAattggctc 751  gaaacctAcc ttgacggcgg cgaaaaccga tacgacgtat tgcggacgct 801  ttcccgattc accgcgcaaA ccgTttggga cgccgtctca CACGCAGCGG

851  CAGATGCCCG TCAAATGTAC ATTTGCGGCG GCGGCATCCG CAATCCTGTT

901  TTAATGGCGG ATTTGGCAGA ATGTTTCGGC ACACGCGTTT CCCTGCACAG

951  CACCGCCGAA CTGAACCTCG ATCCTCAATG GGTGGAGGCG gccgCATTtg 1001  cgtggttggC GGCGTGTTGG ATTAACCGCA TTCCCGGTAG TCCGCACAAA

1051  GCGACCGGCG CATCCAAACC GTGTATTCTG GGCGCGGGAT ATTATTATTG

1101  A
```

This corresponds to the amino acid sequence <SEQ ID 436; ORF 121.ng>:

```
g121.pep
    1   METQLYIGIM SGTSMDGADA VLVRMDGGKW LGAEGHAFTP YPDRLRRKLL

51   DLQDTGTDEL HRSRMLSQEL SRLYAQTAAE LLCSQNLAPC DITALGCHGQ

101   TVRHAPEHGY SIQLADLPLL AELTRIFTVG DFRSRDLAAG GQGAPLVPAF

151   HEALFRDDRE TRVVLNIGGI ANISVLPPGA PAFGFDTGPG NMLMDAWTQA

201   HWQLPYDKNG AKAAQGNILP QLLGRLLAHP YFSQPHPKST GRELFALNWL

251   ETYLDGGENR YDVLRTLSRF TAQTVWDAVS HAAADARQMY ICGGGIRNPV

301   LMADLAECFG TRVSLHSTAE LNLDPQWVEA AAFAWLAACW INRIPGSPHK

351   ATGASKPCIL GAGYYY*
                                                           15
```

The following partial DNA sequence was identified in *N. meningitidis* <SEQ ID 437>:

```
m121.seq
    1   ATGGAAACAC AGCTTTACAT CGGCATCATG TCGGGAACCA GCATGGACGG

51   GGCGGATGCC GTACTGATAC GGATGGACGG CGGCAAATGG CTGGGCGCGG

101   AAGGGCACGC CTTTACCCCC TACCCCGGCA GGTTACGCCG CCAATTGCTG

151   GATTTGCAGG ACACAGGCGC AGACGAACTG CACCGCAGCA GGATTTTGTC

201   GCAAGAACTC AGCCGCCTAT ATGCGCAAAC CGCCGCCGAA CTGCTGTGCA

251   GTCAAAACCT CGCACCGTCC GACATTACCG CCCTCGGCTG CCACGGGCAA

301   ACCGTCCGAC ACGCGCCGGA ACACGGTTAC AGCATACAGC TTGCCGATTT

351   GCCGCTGCTG GCGxxxxxxx xxxxxxxxxx xxxxxxxxxx xxxxxxxxxx 401   xxxxxxxxxx xxxxxxxxxx xxxxxxxxxx xxxxxxxxxx xxxxxxxxxx 451   xxxxxxxxxx xxxxxxxxxx xxxxxxxxxx xxxxxxxxxx xxxxxxxxxx 501   xxxxxxxxxx xxxxxxxxxx xxxxxxxxxx xxxxxxxxxx xxxxxxxxxx 551   xxxxxxxxxx xxxxxxxxxx xxxxxxxxxx xxxxxxxxxx xxxxxxxxxx 601   xxxxxxCAGC TTCCTTACGA CAAAAACGGT GCAAAGTCGG CACAAGGCAA

651   CATATTGCCG CAACTGCTCG ACAGGCTGCT CGCCCACCCG TATTTCGCAC

701   AACGCCACCC TAAAAGCACG GGGCGCGAAC TGTTTGCCAT AAATTGGCTC

751   GAAACCTACC TTGACGGCGG CGAAAACCGA TACGACGTAT TGCGGACGCT

801   TTCCCGTTTT ACCGCGCAAA CCGTTTGCGA CGCCGTCTCA CACGCAGCGG

851   CAGATGCCCG TCAAATGTAC ATTTGCGACG GCGGCATCCG CAATCCTGTT

901   TTAATGGCGG ATTTGGCAGA ATGTTTCGGC ACACGCGTTT CCCTGCACAG

951   CACCGCCGAC CTGAACCTCG ATCCGCAATG GGTGGAAGCC GCCGnATTTG

1001   CGTGGTTGGC GGCGTGTTGG ATTAATCGCA TTCCCGGTAG TCCGCACAAA

1051   GCAACCGGCG CATCCAAACC GTGTATTCTG AnCGCGGGAT ATTATTATTG

1101   A
```

This corresponds to the amino acid sequence <SEQ ID 438; ORF 121>:

```
m121.pep
    1   METQLYIGIM SGTSMDGADA VLIRMDGGKW LGAEGHAFTP YPGRLRRQLL

51   DLQDTGADEL HRSRILSQEL SRLYAQTAAE LLCSQNLAPS DITALGCHGQ

101   TVRHAPEHGY SIQLADLPLL Axxxxxxxxx xxxxxxxxxx xxxxxxxxxx
```

```
151  xxxxxxxxxx xxxxxxxxxx xxxxxxxxxx xxxxxxxxxx xxxxxxxxxx 201  xxQLPYDKNG AKSAQGNILP QLLDRLLAHP YFAQRHPKST GRELFAINWL

251  ETYLDGGENR YDVLRTLSRF TAQTVCDAVS HAAADARQMY ICDGGIRNPV

301  LMADLAECFG TRVSLHSTAD LNLDPQWVEA AXFAWLAACW INRIPGSPHK

351  ATGASKPCIL XAGYYY*
```

Computer analysis of the amino acid sequences gave the following results:
Homology with a Predicted ORF from *N. meningitidis* menA with menB
ORF 121 shows 73.5% identity over a 366 aa overlap with a predicted ORF (ORF121.ng) from *N. gonorrhoeae*:

```
                   10         20         30         40         50         60
m121.pep  METQLYIGIMSGTSMDGADAVLIRMDGGKWLGAEGHAFTPYPGRLRRQLLDLQDTGADEL
          ||||||||||||||||||||||:||||||||||||||||||| ||||:||||||||:|||
g121      METQLYIGIMSGTSMDGADAVLVRMDGGKWLGAEGHAFTPYPDRLRRKLLDLQDTGTDEL
                   10         20         30         40         50         60

70         80         90        100        110        120
m121.pep  HRSRILSQELSRLYAQTAAELLCSQNLAPSDITALGCHGQTVRHAPEHGYSIQLADLPLL
          ||||:||||||||||||||||||||||||||| |||||||||||||||||||||||||||
g121      HRSRMLSQELSRLYAQTAAELLCSQNLAPCDITALGCHGQTVRHAPEHGYSIQLADLPLL
                   70         80         90        100        110        120

130        140        150        160        170        180
m121.pep  AXXXXXXXXXXXXXXXXXXXXXXXXXXXXXXXXXXXXXXXXXXXXXXXXXXXXXXXXXX
          |  :   :                                 :
g121      AELTRIFTVGDFRSRDLAAGGQGAPLVPAFHEALFRDDRETRVVLNIGGIANISVLPPGA
                  130        140        150        160        170        180

190        200        210        220        230        240
m121.pep  XXXXXXXXXXXXXXXXXXXXXXXQLPYDKNGAKSAQGNILPQLLDRLLAHPYFAQRHPKST
             :           :         |||||||||||:||||||||||| |||||||:| |||||
g121      PAFGFDTGPGNMLMDAWTQAHWQLPYDKNGAKAAQGNILPQLLGRLLAHPYFSQHPKST
                  190        200        210        220        230        240

250        260        270        280        290        300
m121.pep  GRELFAINWLETYLDGGENRYDVLRTLSRFTAQTVCDAVSHAAADARQMYICDGGIRNPV
          ||||||:|||||||||||||||||||||||||||| |||||||||||||||| |||||||
g121      GRELFALNWLETYLDGGENRYDVLRTLSRFTAQTVWDAVSHAAADARQMYICGGGIRNPV
                  250        260        270        280        290        300

310        320        330        340        350        360
m121.pep  LMADLAECFGTRVSLHSTADLNLDPQWVEAAXFAWLAACWINRIPGSPHKATGASKPCIL
          ||||||||||||||||||:|||||||||||| ||||||||||||||||||||||||||||
g121      LMADLAECFGTRVSLHSTAELNLDPQWVEAAAFAWLAACWINRIPGSPHKATGASKPCIL
                  310        320        330        340        350        360 m121.pep  XAGYYYX
          ||||||
g121      GAGYYYX
```

The following partial DNA sequence was identified in *N. meningitidis* <SEQ ID 439>:

```
a121.seq
    1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CAAATTGCTG

151  GATTTGCAGG ACACAGGCGC GGACGAACTG CACCGCAGCA GGATGTTGTC

201  GCAAGAACTC AGCCGCCTGT ACGCGCAAAC CGCCGCCGAA CTGCTGTGCA

251  GTCAAAACCT CGCGCCGTCC GACATTACCG CCCTCGGCTG CCACGGGCAA

301  ACCGTCAGAC ACGCGCCGGA ACACAGTTAC AGCGTACAGC TTGCCGATTT

351  GCCGCTGCTG GCGGAACGGA CTCAGATTTT TACCGTCGGC GACTTCCGCA

401  GCCGCGACCT TGCGGCCGGC GGACAAGGCG CGCCGCTCGT CCCCGCCTTT
```

```
 451 CACGAAGCCC TGTTCCGCGA CGACAGGGAA ACACGCGCGG TACTGAACAT

501 CGGCGGGATT GCCAACATCA GCGTACTCCC CCCCGACGCA CCCGCCTTCG

551 GCTTCGACAC AGGACCGGGC AATATGCTGA TGGACGCGTG GATGCAGGCA

601 CACTGGCAGC TTCCTTACGA CAAAAACGGT GCAAAGGCGG CACAAGGCAA

651 CATATTGCCG CAACTGCTCG ACAGGCTGCT CGCCCACCCG TATTTCGCAC

701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGATTC ACCGCGCAAA CCGTTTTCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 440; ORF 121.a>:

```
a121.pep
    1 METQLYIGIM SGTSMDGADA VLIRMDGGKW LGAEGHAFTP YPGRLRRKLL

51 DLQDTGADEL HRSRMLSQEL SRLYAQTAAE LLCSQNLAPS DITALGCHGQ

101 TVRHAPEHSY SVQLADLPLL AERTQIFTVG DFRSRDLAAG GQGAPLVPAF

151 HEALFRDDRE TRAVLNIGGI ANISVLPPDA PAFGFDTGPG NMLMDAWMQA

201 HWQLPYDKNG AKAAQGNILP QLLDRLLAHP YFAQPHPKST GRELFALNWL

251 ETYLDGGENR YDVLRTLSRF TAQTVFDAVS HAAADARQMY ICGGGIRNPV

301 LMADLAECFG TRVSLHSTAE LNLDPQWVEA AFAWMAACW VNRIPGSPHK

351 ATGASKPCIL GAGYYY*
``` m121/a121 74.0% identity in 366 aa overlap

```
                10         20         30         40         50         60
m121.pep METQLYIGIMSGTSMDGADAVLIRMDGGKWLGAEGHAFTPYPGRLRRQLLDLQDTGADEL
         ||||||||||||||||||||||||||||||||||||||||||||||||:||||||||||
a121     METQLYIGIMSGTSMDGADAVLIRMDGGKWLGAEGHAFTPYPGRLRRKLLDLQDTGADEL
                10         20         30         40         50         60

70         80         90        100        110        120
m121.pep HRSRILSQELSRLYAQTAAELLCSQNLAPSDITALGCHGQTVRHAPEHGYSIQLADLPLL
         ||||:|||||||||||||||||||||||||||||||||||||||||||:||:||||||||
a121     HRSRMLSQELSRLYAQTAAELLCSQNLAPSDITALGCHGQTVRHAPEHSYSVQLADLPLL
                70         80         90        100        110        120

130        140        150        160        170        180
m121.pep AXXXXXXXXXXXXXXXXXXXXXXXXXXXXXXXXXXXXXXXXXXXXXXXXXXXXXXXXXXX
         | :         :                                              :
a121     AERTQIFTVGDFRSRDLAAGGQGAPLVPAFHEALFRDDRETRAVLNIGGIANISVLPPDA
                130        140        150        160        170        180

190        200        210        220        230        240
m121.pep XXXXXXXXXXXXXXXXXXXXXXQLPYDKNGAKSAQGNILPQLLDRLLAHPYFAQRHPKST
                               :|||||||||:||||||||||||||||||||:|||||
a121     PAFGFDTGPGNMLMDAWMQAHWQLPYDKNGAKAAQGNILPQLLDRLLAHPYFAQPHPKST
                190        200        210        220        230        240

250        260        270        280        290        300
m121.pep GRELFAINWLETYLDGGENRYDVLRTLSRFTAQTVCDAVSHAAADARQMYICDGGIRNPV
         ||||||:||||||||||||||||||||||||||||:|||||||||||||||| ||||||
a121     GRELFALNWLETYLDGGENRYDVLRTLSRFTAQTVFDAVSHAAADARQMYICGGGIRNPV
                250        260        270        280        290        300
```

```
                 310        320        330        340        350        360
m121.pep    LMADLAECFGTRVSLHSTADLNLDPQWVEAAXFAWLAACWINRIPGSPHKATGASKPCIL
            ||||||||||||||||||||:||||||||||   :||||:||||||||||||||||||||
a121        LMADLAECFGTRVSLHSTAELNLDPQWVEAAAFAWMAACWVNRIPGSPHKATGASKPCIL
                 310        320        330        340        350        360 m121.pep    XAGYYYX
            ||||||
a121        GAGYYYX
```

The following partial DNA sequence was identified in *N. meningitidis* <SEQ ID 441>:

```
m121-1.seq
      1    ATGGAAACAC AGCTTTACAT CGGCATCATG TCGGGAACCA GCATGGACGG
     51    GGCGGATGCC GTACTGATAC GGATGGACGG CGGCAAATGG CTGGGCGCGG
    101    AAGGGCACGC CTTTACCCCC TACCCCGGCA GGTTACGCCG CCAATTGCTG
    151    GATTTGCAGG ACACAGGCGC AGACGAACTG CACCGCAGCA GGATTTTGTC
    201    GCAAGAACTC AGCCGCCTAT ATGCGCAAAC CGCCGCCGAA CTGCTGTGCA
    251    GTCAAAACCT CGCACCGTCC GACATTACCG CCCTCGGCTG CCACGGGCAA
    301    ACCGTCCGAC ACGCGCCGGA ACACGGTTAC AGCATACAGC TTGCCGATTT
    351    GCCGCTGCTG GCGGAACGGA CGCGGATTTT TACCGTCGGC GACTTCCGCA
    401    GCCGCGACCT TGCGGCCGGC GGACAAGGCG CGCCACTCGT CCCCGCCTTT
    451    CACGAAGCCC TGTTCCGCGA CAACAGGGAA ACACGCGCGG TACTGAACAT
    501    CGGCGGGATT GCCAACATCA GCGTACTCCC CCCCGACGCA CCCGCCTTCG
    551    GCTTCGACAC AGGGCCGGGC AATATGCTGA TGGACGCGTG GACGCAGGCA
    601    CACTGGCAGC TTCCTTACGA CAAAAACGGT GCAAAGGCGG CACAAGGCAA
    651    CATATTGCCG CAACTGCTCG ACAGGCTGCT CGCCCACCCG TATTTCGCAC
    701    AACCCCACCC TAAAAGCACG GGGCGCGAAC TGTTTGCCCT AAATTGGCTC
    751    GAAACCTACC TTGACGGCGG CGAAAACCGA TACGACGTAT TGCGGACGCT
    801    TTCCCGTTTT ACCGCGCAAA CCGTTTGCGA CGCCGTCTCA CACGCAGCGG
    851    CAGATGCCCG TCAAATGTAC ATTTGCGGCG GCGGCATCCG CAATCCTGTT
    901    TTAATGGCGG ATTTGGCAGA ATGTTTCGGC ACACGCGTTT CCCTGCACAG
    951    CACCGCCGAC CTGAACCTCG ATCCGCAATG GGTGGAAGCC GCCGNATTTG
   1001    CGTGGTTGGC GGCGTGTTGG ATTAATCGCA TTCCCGGTAG TCCGCACAAA
   1051    GCAACCGGCG CATCCAAACC GTGTATTCTG ANCGCGGGAT ATTATTATTG
   1101    A
```

This corresponds to the amino acid sequence <SEQ ID 442; ORF 121-1>:

```
m121-1.pep
      1    METQLYIGIM SGTSMDGADA VLIRMDGGKW LGAEGHAFTP YPGRLRRQLL
     51    DLQDTGADEL HRSRILSQEL SRLYAQTAAE LLCSQNLAPS DITALGCHGQ
    101    TVRHAPEHGY SIQLADLPLL AERTRIFTVG DFRSRDLAAG GQGAPLVPAF
    151    HEALFRDNRE TRAVLNIGGI ANISVLPPDA PAFGFDTGPG NMLMDAWTQA
    201    HWQLPYDKNG AKAAQGNILP QLLDRLLAHP YFAQPHPKST GRELFALNWL
    251    ETYLDGGENR YDVLRTLSRF TAQTVCDAVS HAAADARQMY ICGGGIRNPV
```

-continued

```
301     LMADLAECFG TRVSLHSTAD LNLDPQWVEA AXFAWLAACW INRIPGSPHK

351     ATGASKPCIL XAGYYY*
``` m121-1/g121 95.6% identity in 366 aa overlap

```
                    10        20        30        40        50        60
m121-1.pep  METQLYIGIMSGTSMDGADAVLIRMDGGKWLGAEGHAFTPYPGRLRRQLLDLQDTGADEL
            ||||||||||||||||||||||:||||||||||||||||||| ||||:||||||||:|||
g121        METQLYIGIMSGTSMDGADAVLVRMDGGKWLGAEGHAFTPYPDRLRRKLLDLQDTGTDEL
                    10        20        30        40        50        60

70        80        90       100       110       120
m121-1.pep  HRSRILSQELSRLYAQTAAELLCSQNLAPSDITALGCHGQTVRHAPEHGYSIQLADLPLL
            ||||:|||||||||||||||||| ||||||||||||||||||||||||||||||||||||
g121        HRSRMLSQELSRLYAQTAAELLCSQNLAPCDITALGCHGQTVRHAPEHGYSIQLADLPLL
                    70        80        90       100       110       120

130       140       150       160       170       180
m121-1.pep  AERTRIFTVGDFRSRDLAAGGQGAPLVPAFHEALFRDNRETRAVLNIGGIANISVLPPDA
            || ||||||||||||||||||||||||||||||||||:||||:||||||||||||||| |
g121        AELTRIFTVGDFRSRDLAAGGQGAPLVPAFHEALFRDDRETRVVLNIGGIANISVLPPGA
                   130       140       150       160       170       180

190       200       210       220       230       240
m121-1.pep  PAFGFDTGPGNMLMDAWTQAHWQLPYDKNGAKAAQGNILPQLLDRLLAHPYFAQPHPKST
            ||||||||||||||||||||||||||||||||||||||||||| ||||||||:|||||||
g121        PAFGFDTGPGNMLMDAWTQAHWQLPYDKNGAKAAQGNILPQLLGRLLAHPYFSQPHPKST
                   190       200       210       220       230       240

250       260       270       280       290       300
m121-1.pep  GRELFALNWLETYLDGGENRYDVLRTLSRFTAQTVCDAVSHAAADARQMYICGGGIRNPV
            ||||||||||||||||||||||||||||||||||| ||||||||||||||||||||||||
g121        GRELFALNWLETYLDGGENRYDVLRTLSRFTAQTVWDAVSHAAADARQMYICGGGIRNPV
                   250       260       270       280       290       300

310       320       330       340       350       360
m121-1.pep  LMADLAECFGTRVSLHSTADLNLDPQWVEAAXFAWLAACWINRIPGSPHKATGASKPCIL
            |||||||||||||||||||:||||||||||| ||||||||||||||||||||||||||||
g121        LMADLAECFGTRVSLHSTAELNLDPQWVEAAAFAWLAACWINRIPGSPHKATGASKPCIL
                   310       320       330       340       350       360 m121-1.pep  XAGYYYX
             ||||||
g121        GAGYYYX
```

The following partial DNA sequence was identified in *N. meningitidis* <SEQ ID 443>:

```
a121-1.seq
      1     ATGGAAACAC AGCTTTACAT CGGCATCATG TCGGGAACCA GCATGGACGG

51     GGCGGATGCC GTACTGATAC GGATGGACGG CGGCAAATGG CTGGGCGCGG

101     AAGGGCACGC CTTTACCCCC TACCCCGGCA GGTTACGCCG CAAATTGCTG

151     GATTTGCAGG ACACAGGCGC GGACGAACTG CACCGCAGCA GGATGTTGTC

201     GCAAGAACTC AGCCGCCTGT ACGCGCAAAC CGCCGCCGAA CTGCTGTGCA

251     GTCAAAACCT CGCGCCGTCC GACATTACCG CCCTCGGCTG CCACGGGCAA

301     ACCGTCAGAC ACGCGCCGGA ACACAGTTAC AGCGTACAGC TTGCCGATTT

351     GCCGCTGCTG GCGGAACGGA CTCAGATTTT TACCGTCGGC GACTTCCGCA

401     GCCGCGACCT TGCGGCCGGC GGACAAGGCG CGCCGCTCGT CCCCGCCTTT

451     CACGAAGCCC TGTTCCGCGA CGACAGGGAA ACACGCGCGG TACTGAACAT

501     CGGCGGGATT GCCAACATCA GCGTACTCCC CCCCGACGCA CCCGCCTTCG

551     GCTTCGACAC AGGACCGGGC AATATGCTGA TGGACGCGTG GATGCAGGCA

601     CACTGGCAGC TTCCTTACGA CAAAAACGGT GCAAAGGCGG CACAAGGCAA

651     CATATTGCCG CAACTGCTCG ACAGGCTGCT CGCCCACCCG TATTTCGCAC

701     AACCCCACCC TAAAAGCACG GGGCGCGAAC TGTTTGCCCT AAATTGGCTC

751     GAAACCTACC TTGACGGCGG CGAAAACCGA TACGACGTAT TGCGGACGCT
```

```
-continued
 801    TTCCCGATTC ACCGCGCAAA CCGTTTTCGA CGCCGTCTCA CACGCAGCGG

851    CAGATGCCCG TCAAATGTAC ATTTGCGGCG GCGGCATCCG CAATCCTGTT

901    TTAATGGCGG ATTTGGCAGA ATGTTTCGGC ACACGCGTTT CCCTGCACAG

951    CACCGCCGAA CTGAACCTCG ATCCGCAATG GGTAGAAGCC GCCGCGTTCG

1001    CATGGATGGC GGCGTGTTGG GTCAACCGCA TTCCCGGTAG TCCGCACAAA

1051    GCAACCGGCG CATCCAAACC GTGTATTCTG GGCGCGGGAT ATTATTATTG

1101    A
```

This corresponds to the amino acid sequence <SEQ ID 444; ORF 121-1.a>:

```
a121-1.pep
     1      METQLYIGIM SGTSMDGADA VLIRMDGGKW LGAEGHAFTP YPGRLRRKLL

51      DLQDTGADEL HRSRMLSQEL SRLYAQTAAE LLCSQNLAPS DITALGCHGQ

101      TVRHAPEHSY SVQLADLPLL AERTQIFTVG DFRSRDLAAG GQGAPLVPAF

151      HEALFRDDRE TRAVLNIGGI ANISVLPPDA PAFGFDTGPG NMLMDAWMQA

201      HWQLPYDKNG AKAAQGNILP QLLDRLLAHP YFAQPHPKST GRELFALNWL

251      ETYLDGGENR YDVLRTLSRF TAQTVFDAVS HAAADARQMY ICGGGIRNPV

301      LMADLAECFG TRVSLHSTAE LNLDPQWVEA AAFAWMAACW VNRIPGSPHK

351      ATGASKPCIL GAGYYY*
``` m121-1/a121-1 96.4% identity in 366 aa overlap

```
                     10         20         30         40         50         60
m121-1.pep  METQLYIGIMSGTSMDGADAVLIRMDGGKWLGAEGHAFTPYPGRLRRQLLDLQDTGADEL
            ||||||||||||||||||||||||||||||||||||||||||||||:|||||||||||||
a121-1      METQLYIGIMSGTSMDGADAVLIRMDGGKWLGAEGHAFTPYPGRLRRKLLDLQDTGADEL
                     10         20         30         40         50         60

70         80         90        100        110        120
m121-1.pep  HRSRILSQELSRLYAQTAAELLCSQNLAPSDITALGCHGQTVRHAPEHGYSIQLADLPLL
            ||||:|||||||||||||||||||||||||||||||||||||||||||:||:||||||||
a121-1      HRSRMLSQELSRLYAQTAAELLCSQNLAPSDITALGCHGQTVRHAPEHSYSVQLADLPLL
                     70         80         90        100        110        120

130        140        150        160        170        180
m121-1.pep  AERTRIFTVGDFRSRDLAAGGQGAPLVPAFHEALFRDNRETRAVLNIGGIANISVLPPDA
            ||||:|||||||||||||||||||||||||||||||:|||||||||||||||||||||||
a121-1      AERTQIFTVGDFRSRDLAAGGQGAPLVPAFHEALFRDDRETRAVLNIGGIANISVLPPDA
                    130        140        150        160        170        180

190        200        210        220        230        240
m121-1.pep  PAFGFDTGPGNMLMDAWTQAHWQLPYDKNGAKAAQGNILPQLLDRLLAHPYFAQPHPKST
            |||||||||||||||||||||||||||||||||||||||||||||||||||||||||||||
a121-1      PAFGFDTGPGNMLMDAWMQAHWQLPYDKNGAKAAQGNILPQLLDRLLAHPYFAQPHPKST
                    190        200        210        220        230        240

250        260        270        280        290        300
m121-1.pep  GRELFALNWLETYLDGGENRYDVLRTLSRFTAQTVCDAVSHAAADARQMYICGGGIRNPV
            |||||||||||||||||||||||||||||||||||||:||||||||||||||||||||||
a121-1      GRELFALNWLETYLDGGENRYDVLRTLSRFTAQTVFDAVSHAAADARQMYICGGGIRNPV
                    250        260        270        280        290        300

310        320        330        340        350        360
m121-1.pep  LMADLAECFGTRVSLHSTADLNLDPQWVEAAXFAWLAACWINRIPGSPHKATGASKPCIL
            |||||||||||||||||||:|||||||||||   |:|||:||||||||||||||||||||
a121         LMADLAECFGTRVSLHSTAELNLDPQWVEAAAFAWMAACWVNRIPGSPHKATGASKPCIL
                    310        320        330        340        350        360 m121-1.pep  XAGYYYX
            ||||||
a121        GAGYYYX
```

The following partial DNA sequence was identified in *N. gonorrhoeae* <SEQ ID 445>:

```
g122.seq
    1   ATGGCTTTAC TGAGCATCCG CAAGCTGCAC AAACAATACG GCAGCGTAAC
   51   CGCCATCCAA TCCTTAGACT TGGACTTGGA AAAAGGCGAA GtcatCGTAC
  101   TGCTGGGCCC gTccggctgc ggCAAATCCA CCCTcctgcg ctgcgtcaaC
  151   GGTTTGGAGC CGCACCAagg cgGCAGCATC GTGATGGACG GTgtcgGCGA
  201   ATTCggcAAA GACGTTTCCT GGCAAACCGC CCGGCAAAAa gtcggtatgg
  251   tctttcaaag taacgAactg Tttgcccaca tgaccgtcat cgAaaacatc
  301   ttcttAggcC CGGTAAagga aCAAAAcCgc gaccgtgccg aagcaGAGGC
  351   gCAAGCCGGC AAactGttgg aacgcgTCGG actgctAGAC CGCAAAAACG
  401   CCTATCCGCG CGAACTTTCC GGCGGTCAGA ACAGCGCAT CGCCATTGTC
  451   CGCGCCCTGT GCCTGAATCC GGAAGTCATC CTGCTGGACG AAATCACCGC
  501   CGCACTTGAC CCCGAAATGG TGCGCGAAGT CTTGGAAGTG GTTTTGGAAC
  551   TCGCCCGCGA AGGGATGAGT ATGCTCATCG TAACCCACGA AATGGGGTTC
  601   GCACGCAAAG TTGCCGACCG CATCGTCTTT ATGGACAAAG GCGGCATCGT
  651   CGAATCGTCC GACCCCGAAA CCTTTTTTTC CGCACCAAAA AGCGAACGCG
  701   CCCGCCAATT TCTGGCAGGT ATGGACTACT GA
```

This corresponds to the amino acid sequence <SEQ ID 446; ORF 122.ng>:

```
g122.pep
    1   MALLSIRKLH KQYGSVTAIQ SLDLDLEKGE VIVLLGPSGC GKSTLLRCVN
   51   GLEPHQGGSI VMDGVGEFGK DVSWQTARQK VGMVFQSNEL FAHMTVIENI
  101   FLGPVKEQNR DRAEAEAQAG KLLERVGLLD RKNAYPRELS GGQKQRIAIV
  151   RALCLNPEVI LLDEITAALD PEMVREVLEV VLELAREGMS MLIVTHEMGF
  201   ARKVADRIVF MDKGGIVESS DPETFFSAPK SERARQFLAG MDY*
```

The following partial DNA sequence was identified in *N. meningitidis* <SEQ ID 447>:

```
m122.seq
    1   GTTGTCATGA TTAAAATCCG CAATATCCAT AAGACCTTTG GCGAAAACAC
   51   TATTTTGCGC GGCATCGATT TGGATGTGTG CAAAGGGCAG GTGGTCGTCA
  101   TCCTCGGGcC TTCCGGCTCA GGCAAAACGA CGTTTCTGCG ATGCCTAAAC
  151   GCGTTGGAAA TGCCCGAAGA CGGACAAATC GAGTTCGACA ACGAGCGACC
  201   GCTGAAAATC GATTTTTCTA AAAAACCAAG CAAACACGAT ATTTTGGCAC
  251   TGCGCCGCAA ATCAkGCATG GTGTTTCAAC AATACAAyCT CTTTCCGCAC
  301   AAAACCGCCT TGGAAAACGT AATGGAAGGA CCGGTTGCCG TACAgGGCAA
  351   GCCTGCCGCC CAAGCGCGCG AAGAGGCTCT GAAACTGCTG GAAAAAGTCG
  401   GCTTGGGCGA CAAAGTGGAT TTGTATCCCT ACCAGCTTTC CGGCGGTCAG
  451   CAGCAGCGCG TCGGCATTGC CCGCGCATTG GCGATTCAGC CTGAACTGAT
  501   GCTGTTTGAC GAACCGACTT CCGCGCTCGA TCCTGAATTG GTGCAAGATG
  551   TTTTGGATmC CATGAAGGAA TTGGCGCAAG AAGGCTGGAC CATGGTTGTC
  601   GTTACGCATG AAATCAAGTT CGCCTTAGAA GTGGCAACCA CCGwCGTCGT
  651   GATGGAcCrGC GGCGTTATTG TCGAACAAGG CAGCCCGCAA GATTTGTTCG
```

```
701  ACCACCCCAA ACACGAACGG ACGCGGAGAT TTTTAAGCCA AATCCAATCT

751  ACCAAGATTT GA
```

This corresponds to the amino acid sequence <SEQ ID 448; ORF 122>:

```
m122.pep
   1   VVMIKIRNIH KTFGENTILR GIDLDVCKGQ VVVILGPSGS GKTTFLRCLN

51   ALEMPEDGQI EFDNERPLKI DFSKKPSKHD ILALRRKSXM VFQQYNLFPH

101   KTALENVMEG PVAVQGKPAA QAREEALKLL EKVGLGDKVD LYPYQLSGGQ

151   QQRVGIARAL AIQPELMLFD EPTSALDPEL VQDVLDXMKE LAQEGWTMVV

201   VTHEIKFALE VATTXVVMDX GVIVEQGSPQ DLFDHPKHER TRRFLSQIQS

251   TKI*
```

Computer analysis of this amino acid sequence gave the following results:
Homology with a Predicted ORF from *N. gonorrhoeae*
ORF 122 shows 47.2% identity over a 246 aa overlap with a predicted ORF (ORF 122.ng) from *N. gonorrhoeae*:

```
    m122/g122
                  10         20         30         40         50         60
    m122.pep  VVMIKIRNIHKTFGENTILRGIDLDVCKGQVVVILGPSGSGKTTFLRCLNALEMPEDGQI
              : : : :||: :||   : |    | : : : ||| :  || : | : ||||| || : ||||: :||    : |:|
    g122      MALLSIRKLHKQYGSVTAIQSLDLDLEKGEVIVLLGPSGCGKSTLLRCVNGLEPHQGGSI
                  10         20         30         40         50         60
                  70         80         90        100        110        120
    m122.pep  EFDNERPLKIDFSKKPSKHDILALRRKSXMVFQQYNLFPHKTALENVMEGPVAVQGKPAA
              : | :    :  | |  : :          | : |   |||| : || |    | : :|| : :  |||    | : :  |
    g122      VMDGVGEFGKDVSWQTA-------RQKVGMVFQSNELFAHMTVIENIFLGPVKEQNRDRA
                  70                     80         90        100        110
                 130        140        150        160        170        180
    m122.pep  QAREEALKLLEKVGLGDKVDLYPYQLSGGQQQRVGIARALAIQPELMLFDEPTSALDPEL
              : | :  : |    ||||:|||   | :   : ||    :|||||| :|::: |:|||     : :| : :: |: ||    |: ||||| :
    g122      EAEAQAGKLLERVGLLDRKNAYPRELSGGQKQRIAIVRALCLNPEVILLDEITAALDPEM
                 120        130        140        150        160        170
                 190        200        210        220        230        240
    m122.pep  VQDVLDXMKELAQEGWTMVVVTHEIKFALEVATTXVVMDXGVIVEQGSPQDLFDHPKHER
              | : :|| : :    ||| : ||    :|: : |||||     ||   : ||         |    ||| |     ||| | | : : : | :   : | :    || ||
    g122      VREVLEVVLELAREGMSMLIVTHEMGFARKVADRIVFMDKGGIVESSDPETFFSAPKSER
                 180        190        200        210        220        230

250
    m122.pep  TRRFLSQIQSTKIX
              : | : | | | :
    g122      ARQFLAGMDYX
                 240
```

The following partial DNA sequence was identified in *N. meningitidis* <SEQ ID 449>:

```
a122.seq
   1   GTTGTCATGA TTAAAATCCG CAATATCCAT AAGACCTTCG GCAAAAATAC

51   CATTTTGCGC GGCATCAATT TGGATGTGTG CAAAGGGCAG GTGGTCGTCA

101   TCCTCGGGCC TTCCGGCTCA GGCAAAACGA CGTTTCTGCG ATGCCTAAAC

151   GCGTTGGAAA TGCCCGAAGA CGGACAAATC GAGTTCGACA ACGAGCGACC

201   GCTGAAAATC GATTTTTCTA AAAAACCAAG CAAACACGAT ATTTTGGCAC

251   TGCGCCGCAA ATCAGGCATG GTGTTTCAAC AATACAACCT CTTTCCGCAC

301   AAAACCGCCT TGGAAAACGT GATGGAAGGA CCGGTTGCCG TACAGGGCAA
```

```
351   GCCTGCCGCC CAAGCGCGCG AAGAGGCTCT GAAACTGCTG GAAAAAGTCG

401   GCTTGGGCGA CAAAGTGGAT TTGTATCCCT ACCAGCTTTC CGGCGGTCAG

451   CAGCAGCGCG TCGGCATTGC CCGAGCATTG GCGATTCAGC CCGAGCTGAT

501   GTTGTTTGAC GAACCCACTT CCGCGCTTGA CCCCGAGTTG GTGCAAGACG

551   TGTTGAACGC CATGAAGGAA TTGGCGCGGG AAGGTTGGAC GATGGTCGTC

601   GTTACCCACG AAATCAAGTT CGCGCTGGAA GTTGCCACGA CCGTTGTCGT

651   GATGGACGGC GGCGTTATCG TAGAGCAGGG CAGCCCGAAA GAGTTGTTCG

701   ACCACCCCAA ACACGAACGG ACGCGGAGAT TTTTAAGCCA AATCCAATCT

751   ACCAAGATTT GA
```

This corresponds to the amino acid sequence <SEQ ID 450; ORF 122.a>:

```
a122.pep
  1   VVMIKIRNIH KTFGKNTILR GINLDVCKGQ VVVILGPSGS GKTTFLRCLN

51   ALEMPEDGQI EFDNERPLKI DFSKKPSKHD ILALRRKSGM VFQQYNLFPH

101   KTALENVMEG PVAVQGKPAA QAREEALKLL EKVGLGDKVD LYPYQLSGGQ

151   QQRVGIARAL AIQPELMLFD EPTSALDPEL VQDVLNAMKE LAREGWTMVV

201   VTHEIKFALE VATTVVVMDG GVIVEQGSPK ELFDHPKHER TRRFLSQIQS

251   TKI*
``` m122/a122 96.0% identity in 253 aa overlap

```
                10         20         30         40         50         60
m122.pep  VVMIKIRNIHKTFGENTILRGIDLDVCKGQVVVILGPSGSGKTTFLRCLNALEMPEDGQI
          ||||||||||||||:|||||||:|||||||||||||||||||||||||||||||||||||
a122      VVMIKIRNIHKTFGKNTILRGINLDVCKGQVVVILGPSGSGKTTFLRCLNALEMPEDGQI
                10         20         30         40         50         60

70         80         90        100        110        120
m122.pep  EFDNERPLKIDFSKKPSKHDILALRRKSXMVFQQYNLFPHKTALENVMEGPVAVQGKPAA
          ||||||||||||||||||||||||||||| ||||||||||||||||||||||||||||||
a122      EFDNERPLKIDFSKKPSKHDILALRRKSGMVFQQYNLFPHKTALENVMEGPVAVQGKPAA
                70         80         90        100        110        120

130        140        150        160        170        180
m122.pep  QAREEALKLLEKVGLGDKVDLYPYQLSGGQQQRVGIARALAIQPELMLFDEPTSALDPEL
          ||||||||||||||||||||||||||||||||||||||||||||||||||||||||||||
a122      QAREEALKLLEKVGLGDKVDLYPYQLSGGQQQRVGIARALAIQPELMLFDEPTSALDPEL
               130        140        150        160        170        180

190        200        210        220        230        240
m122.pep  VQDVLDXMKELAQEGWTMVVVTHEIKFALEVATTXVVMDXGVIVEQGSPQDLFDHPKHER
          |||||: ||||| |||||||||||||||||||||| |||| ||||||||  ::|||||||
a122      VQDVLNAMKELAREGWTMVVVTHEIKFALEVATTVVVMDGGVIVEQGSPKELFDHPKHER
               190        200        210        220        230        240

250
m122.pep  TRRFLSQIQSTKIX
          ||||||||||||||
a122      TRRFLSQIQSTKIX
               250
```

The following partial DNA sequence was identified in *N. gonorrhoeae* <SEQ ID 451>:

```
g122-1.seq
   1      ATGATTAAAA TCCGCAATAT CCATAAGACC TTTGGCGAAA ACACCATTTT

51      GCGCGGCATC GATTTGGATG TGGGCAAAGG CAGGTGGTC GTCATCCTCG

101      GGCCTTCCGG CTCGGGTAAA CAACATTTC TGCGCTGCCT AAACGCGTTG

151      GAAATGCCCG AAGACGGACA AATCGAGTTC GACAACGCGC GGCCGTTACG
```

-continued

```
201    CATTGATTTT TCCAAAAAAA CAAGCAAACA CGATATTTTG GCACTGCGCC

251    GCAAGTCCGG AATGGTATTC CAACAATACA ACCTCTTCCC GCATAAAACC

301    GTGTTGGAAA ACGTGATGGA AGGGCCGGTT GCCGTACAGG GCAAGCCTGC

351    CGCCCAAGCG CGCGAAGAGG CTTTGAAACT GCTGGAAAAA GTCGGCTTGG

401    GCGATAAAGT GGATTTGTAT CCCTACCAGC TTTCCGGCGG TCAGCAGCAG

451    CGTGTCGGTA TCGCCCGCGC ACTGGCGATT CAGCCTGAAT TGATGCTGTT

501    TGACGAACCC ACTTCCGCGC TGGACCCCGA GTTGGTGCAA GACGTGTTGG

551    ACGCCATGAA GGAATTGGCG CGGGAAGGTT GGACGATGGT CGTCGTTACC

601    CACGAAATCA AGTTCACGCT GGAAGTTGCC ACGAACGTCG TCGTGATGGA

651    CGGCGGCGTT ATCGTAGAGC AGGGCAGCCC GAAAGAGTTG TTCGACCACC

701    TCAAACACGA ACGGACGCGG AGATTTTTAA GCCAAATCCA ATCTGCCAAG

751    ATTTGA
```

This corresponds to the amino acid sequence <SEQ ID 452; ORF 122-1.ng>:

```
g122-1.pep
    1      MIKIRNIHKT FGENTILRGI DLDVGKGQVV VILGPSGSGK TTFLRCLNAL

51      EMPEDGQIEF DNARPLRIDF SKKTSKHDIL ALRRKSGMVF QQYNLFPHKT

101      VLENVMEGPV AVQGKPAAQA REEALKLLEK VGLGDKVDLY PYQLSGGQQQ

151      RVGIARALAI QPELMLFDEP TSALDPELVQ DVLDAMKELA REGWTMVVVT

201      HEIKFTLEVA TNVVVMDGGV IVEQGSPKEL FDHLKHERTR RFLSQIQSAK

251      I*
```

The following partial DNA sequence was identified in N. meningitidis <SEQ ID 453>:

```
m122-1.seq
    1      ATGATTAAAA TCCGCAATAT CCATAAGACC TTTGGCGAAA ACACTATTTT

51      GCGCGGCATC GATTTGGATG TGTGCAAAGG CAGGTGGTC GTCATCCTCG

101      GGCCTTCCGG CTCAGGCAAA ACGACGTTTC TGCGATGCCT AAACGCGTTG

151      GAAATGCCCG AAGACGGACA AATCGAGTTC GACAACGAGC GACCGCTGAA

201      AATCGATTTT TCTAAAAAAC CAAGCAAACA CGATATTTTG GCACTGCGCC

251      GCAAATCAGG CATGGTGTTT CAACAATACA ACCTCTTTCC GCACAAAACC

301      GCCTTGGAAA ACGTAATGGA AGGACCGGTT GCCGTACAGG GCAAGCCTGC

351      CGCCCAAGCG CGCGAAGAGG CTCTGAAACT GCTGGAAAAA GTCGGCTTGG

401      GCGACAAAGT GGATTTGTAT CCCTACCAGC TTTCCGGCGG TCAGCAGCAG

451      CGCGTCGGCA TTGCCCGCGC ATTGGCGATT CAGCCTGAAC TGATGCTGTT

501      TGACGAACCG ACTTCCGCGC TCGATCCTGA ATTGGTGCAA GATGTTTTGG

551      ATACCATGAA GGAATTGGCG CAAGAAGGCT GGACCATGGT TGTCGTTACG

601      CATGAAATCA AGTTCGCCTT AGAAGTGGCA ACCACCGTCG TCGTGATGGA

651      CGGCGGCGTT ATTGTCGAAC AAGGCAGCCC GCAAGATTTG TTCGACCACC

701      CCAAACACGA ACGGACGCGG AGATTTTTAA GCCAAATCCA ATCTACCAAG

751      ATTTGA
```

This corresponds to the amino acid sequence <SEQ ID 454; ORF 122-1>:

```
m122-1.pep
      1    MIKIRNIHKT FGENTILRGI DLDVCKGQVV VILGPSGSGK TTFLRCLNAL

51    EMPEDGQIEF DNERPLKIDF SKKPSKHDIL ALRRKSGMVF QQYNLFPHKT

101    ALENVMEGPV AVQGKPAAQA REEALKLLEK VGLGDKVDLY PYQLSGGQQQ

151    RVGIARALAI QPELMLFDEP TSALDPELVQ DVLDTMKELA QEGWTMVVVT

201    HEIKFALEVA TTVVVMDGGV IVEQGSPQDL FDHPKHERTR RFLSQIQSTK

251    I*
``` m122-1/g122-1 94.8% identity in 251 aa overlap

```
                   10         20         30         40         50         60
   m122-1.pep  MIKIRNIHKTFGENTILRGIDLDVCKGQVVVILGPSGSGKTTFLRCLNALEMPEDGQIEF
               ||||||||||||||||||||||| |||||||||||||||||||||||||||||||||||
   g122-1      MIKIRNIHKTFGENTILRGIDLDVGKGQVVVILGPSGSGKTTFLRCLNALEMPEDGQIEF
                   10         20         30         40         50         60
                   70         80         90        100        110        120
   m122-1.pep  DNERPLKIDFSKKPSKHDILALRRKSGMVFQQYNLFPHKTALENVMEGPVAVQGKPAAQA
               || |||:|||||| ||||||||||||||||||||||||||| :|||||||||||||||||
   g122-1      DNARPLRIDFSKKTSKHDILALRRKSGMVFQQYNLFPHKTVLENVMEGPVAVQGKPAAQA
                   70         80         90        100        110        120
                  130        140        150        160        170        180
   m122-1.pep  REEALKLLEKVGLGDKVDLYPYQLSGGQQQRVGIARALAIQPELMLFDEPTSALDPELVQ
               ||||||||||||||||||||||||||||||||||||||||||||||||||||||||||||
   g122-1      REEALKLLEKVGLGDKVDLYPYQLSGGQQQRVGIARALAIQPELMLFDEPTSALDPELVQ
                  130        140        150        160        170        180
                  190        200        210        220        230        240
   m122-1.pep  DVLDTMKELAQEGWTMVVVTHEIKFALEVATTVVVMDGGVIVEQGSPQDLFDHPKHERTR
               ||||:|||||:|||||||||||||:|||||||:||||||||||||||||::|||  ||||||
   g122-1      DVLDAMKELAREGWTMVVVTHEIKFTLEVATNVVVMDGGVIVEQGSPKELFDHLKKERTR
                  190        200        210        220        230        240
                  250
   m122-1.pep  RFLSQIQSTKIX
               |||||||||:|||
   g122-1      RFLSQIQSAKIX
                  250
```

The following partial DNA sequence was identified in *N. meningitidis* <SEQ ID 455>:

```
a122-1.seq
      1    ATGATTAAAA TCCGCAATAT CCATAAGACC TTCGGCAAAA ATACCATTTT

51    GCGCGGCATC AATTTGGATG TGTGCAAAGG CAGGTGGTC GTCATCCTCG

101    GGCCTTCCGG CTCAGGCAAA ACGACGTTTC TGCGATGCCT AAACGCGTTG

151    GAAATGCCCG AAGACGGACA AATCGAGTTC GACAACGAGC GACCGCTGAA

201    AATCGATTTT TCTAAAAAAC CAAGCAAACA CGATATTTTG GCACTGCGCC

251    GCAAATCAGG CATGGTGTTT CAACAATACA ACCTCTTTCC GCACAAAACC

301    GCCTTGGAAA ACGTGATGGA AGGACCGGTT GCCGTACAGG GCAAGCCTGC

351    CGCCCAAGCG CGCGAAGAGG CTCTGAAACT GCTGGAAAAA GTCGGCTTGG

401    GCGACAAAGT GGATTTGTAT CCCTACCAGC TTTCCGGCGG TCAGCAGCAG

451    CGCGTCGGCA TTGCCCGAGC ATTGGCGATT CAGCCCGAGC TGATGTTGTT

501    TGACGAACCC ACTTCCGCGC TTGACCCCGA GTTGGTGCAA GACGTGTTGA

551    ACGCCATGAA GGAATTGGCG CGGGAAGGTT GGACGATGGT CGTCGTTACC

601    CACGAAATCA AGTTCGCGCT GGAAGTTGCC ACGACCGTTG TCGTGATGGA

651    CGGCGGCGTT ATCGTAGAGC AGGGCAGCCC GAAAGAGTTG TTCGACCACC
```

-continued

```
701   CCAAACACGA ACGGACGCGG AGATTTTTAA GCCAAATCCA ATCTACCAAG

751   ATTTGA
```

This corresponds to the amino acid sequence <SEQ ID 456; ORF 122-1.a>:

```
a122-1.pep
    1   MIKIRNIHKT FGKNTILRGI NLDVCKGQVV VILGPSGSGK TTFLRCLNAL

51   EMPEDGQIEF DNERPLKIDF SKKPSKHDIL ALRRKSGMVF QQYNLFPHKT

101   ALENVMEGPV AVQGKPAAQA REEALKLLEK VGLGDKVDLY PYQLSGGQQQ

151   RVGIARALAI QPELMLFDEP TSALDPELVQ DVLNAMKELA REGWTMVVVT

201   HEIKFALEVA TTVVVMDGGV IVEQGSPKEL FDHPKHERTR RFLSQIQSTK

251   I*
``` a122-1/m122-1 97.2% identity in 251 aa overlap

```
                  10         20         30         40         50         60
   a122-1.pep  MIKIRNIHKTFGKNTILRGINLDVCKGQVVVILGPSGSGKTTFLRCLNALEMPEDGQIEF
               ||||||||||||:||||||:||||||||||||||||||||||||||||||||||||||||
   m122-1      MIKIRNIHKTFGENTILRGIDLDVCKGQVVVILGPSGSGKTTFLRCLNALEMPEDGQIEF
                  10         20         30         40         50         60

70         80         90        100        110        120
   a122-1.pep  DNERPLKIDFSKKPSKHDILALRRKSGMVFQQYNLFPHKTALENVMEGPVAVQGKPAAQA
               ||||||||||||||||||||||||||||||||||||||||||||||||||||||||||||
   m122-1      DNERPLKIDFSKKPSKHDILALRRKSGMVFQQYNLFPHKTALENVMEGPVAVQGKPAAQA
                  70         80         90        100        110        120

130        140        150        160        170        180
   a122-1.pep  REEALKLLEKVGLGDKVDLYPYQLSGGQQQRVGIARALAIQPELMLFDEPTSALDPELVQ
               ||||||||||||||||||||||||||||||||||||||||||||||||||||||||||||
   m122-1      REEALKLLEKVGLGDKVDLYPYQLSGGQQQRVGIARALAIQPELMLFDEPTSALDPELVQ
                 130        140        150        160        170        180

190        200        210        220        230        240
   a122-1.pep  DVLNAMKELAREGWTMVVVTHEIKFALEVATTVVVMDGGVIVEQGSPKELFDHPKHERTR
               |||::|||||:||||||||||||||||||||||||||||||||||||::|||||||:|||
   m122-1      DVLDTMKELAQEGWTMVVVTHEIKFALEVATTVVVMDGGVIVEQGSPQDLFDHPKKERTR
                 190        200        210        220        230        240

250
   a122-1.pep  RFLSQIQSTKIX
               ||||||||||||
   m122-1      RFLSQIQSTKIX
                 250
```

The following partial DNA sequence was identified in *N. gonorrhoeae* <SEQ ID 457>:

```
g125.seq
    1   ATGTCGGGCA ATGCCTCCTC TCCTTCATCT TCCGCCGCCA TCGGGCTGGT

51   TTGGTTCGGC GCGGCGGTAT CGATTGCCGA AATCAGCACG GGTACGCTGC

101   TCGCCCCCTT GGGCTGGCAG CGCGGTCTGG CGGCCCTGCT TTTGGGTCAT

151   GCCGTCGGCG GCGCGCTGTT TTTTGCGGCG GCGTATATCG GCGCACTGAC

201   CGGACGCAGC TCGATGGAAA GTGTGCGCCT GTCGTTCGGC AAATGCGGTT

251   CAGTGCTGTT TTCCGTGGCG AATATGCTGC AACTGGCCGG CTGGACGGCG

301   GTGATGATTT ACGTCGGCGC AacggTCAGC TCCGCTTTGG GCAAAGTGTT

351   GTGGGACggc gaATCCTTTG TCTGGTGGGC ATTGGCAAAC GGCGCACTGA

401   TCGTGCTGTG GCTGGTTTTC GGCGCACGCA GAACGGGCGG GCTGAAAACC

451   GTTTCGATGC TGCTGATGCT GCTTGCCGTG TTGTGGTTGA GCGTCGAAGT
```

```
-continued
 501   GTTCGCTTCG TCCGGCACAA ACGCCGCGCC CGCCGTTTCA GACGGCATGA

551   CCTTCGGAAC GGCAGTCGAA CTGTCCGCCG TCATGCCGCT TTCCTGGCTG

601   CCGCTGGCCG CCGACTACAC GCGCCAAGCA CGCCGCCCGT TGCGGCAAC

651   CCTGACGGCA ACGCTCGCCT ATACGCTGAC GGGCTGCTGG ATGTATGCCT

701   TGGGTTTGGC GGCGGCTCTG TTTACCGGAG AAACCGACGT GGCGAAAATC

751   CTGTTGGGCG CGGGCTTGGG CATAACGGGC ATTCTGGCAG TCGTCCTCTC

801   CACCGTTACC ACAACGTTTC TCGATACCTA TTCCGCCGGC GCGAGTGCGA

851   ACAACATTTC CGCGCGTTTT GCGGAAATAC CCGTCGCTGT CGGCGTTACC

901   CTGatccgca ccgtgcttgc cgtcatgctg cccgttaccg aatataaaaa 951   cttcctgctg cttatccgct cggtatttgg gccgatggcg ggtggttttg 1001   attgccgaCT TTTttgtctt AAAACGGCGT GA
```

This corresponds to the amino acid sequence <SEQ ID 458; ORF 125.ng>:

The following partial DNA sequence was identified in *N. meningitidis* <SEQ ID 459>:

```
m125.seq
    1   ATGTCGGGCA ATGCCTCCTC TCCTTCATCT TCCTCCGCCA TCGGGCTGAT

51   TTGGTTCGGC GCGGCGGTAT CGATTGCCGA AATCAGCACG GGTACGCTGC

101   TTGCGCCTTT GGGCTGGCAG CGCGGTCTGG CGGCTCTACT TTTGGGTCAT

151   GCCGTCGGCG GCGCGCTGTT TTTTGCGGCG GCGTATATCG GCGCACTGAC

201   CGGACGCAGC TCGATGGAAA GCGTGCGCCT GTCGTTCGGC AAACGCGGTT

251   CAGTGCTGTT TTCCGTGGCG AATATGCTGC AACTGGCCGG CTGGACGGCG

301   GTGATGATTT ACGCCGGCGC AACGGTCAGC TCCGCTTTGG CAAAGTGTT

351   GTGGGACGGC GAATCTTTTG TCTGGTGGGC ATTGGCAAAC GGCGCGCTGA

401   TTGTGCTGTG GCTGGTTTTC GGCGCACGCA AAACAGGCGG GCTGAAAACC

451   GTTTCGATGC TGCTGATGCT GTTGGCGGTT CTGTGGCTGA GTGCCGAAGT

501   CTTTTCCACG GCAGGCAGCA CCGCCGCACA GGTTTCAGAC GGCATGAGTT

551   TCGGAACGGC AGTCGAGCTG TCCGCCGTGA TGCCGCTTTC CTGGCTGCCG

601   CTTGCCGCCG ACTACACGCG CCACGCGCGC CGCCCGTTTG CGGCAACCCT

651   GACGGCAACG CTCGCCTACA CGCTGACCGG CTGCTGGATG TATGCCTTGG

701   GTTTGGCAGC GGCGTTGTTC ACCGGAGAAA CCGACGTGGC AAAAATCCTG

751   CTGGGCGCAr GTTTGgGTGC GGCAGGCATT TTGGCGGTCG TCCTCTCCAC

801   CGTTACCACA ACGTTTCTCG ATGCCTATTC CGCCGGCGCG AGTGCGAACA

851   ACATTTCCGC GCGTTTTGCG GAAACACCCG TCGCTGTCrG CGTTACCCTG

901   ATCGGCACGG TACTTGCCGT CATGCTGCCC GTTACCGAAT ATGAAAACTT

951   CCTGCTGCTT ATCGGCTCGG TATTTGCGCC GATGGCGGgC GGTTTTGATT

1001   GCCGACTTTT TCGTCTTGAA ACGGCGTGA
```

This corresponds to the amino acid sequence <SEQ ID 460; ORF 125>:

```
m125.pep
    1   MSGNASSPSS SSAIGLIWFG AAVSIAEIST GTLLAPLGWQ RGLAALLLGH

51   AVGGALFFAA AYIGALTGRS SMESVRLSFG KRGSVLFSVA NMLQLAGWTA

101   VMIYAGATVS SALGKVLWDG ESFVWWALAN GALIVLWLVF GARKTGGLKT

151   VSMLLMLLAV LWLSAEVFST AGSTAAQVSD GMSFGTAVEL SAVMPLSWLP

201   LAADYTRHAR RPFAATLTAT LAYTLTGCWM YALGLAAALF TGETDVAKIL

251   LGAXLGAAGI LAVVLSTVTT TFLDAYSAGA SANNISARFA ETPVAVXVTL

301   IGTVLAVMLP VTEYENFLLL IGSVFAPMAG GFDCRLFRLE TA*
```

Computer analysis of this amino acid sequence gave the following results:
Homology with a Predicted ORF from *N. gonorrhoeae*
ORF 125 shows 92.1% identity over a 343 aa overlap with a predicted ORF (ORF 125.ng) from *N. gonorrhoeae*:

```
m125/g125
                    10         20         30         40         50         60
m125.pep   MSGNASSPSSSSAIGLIWFGAAVSIAEISTGTLLAPLGWQRGLAALLLGHAVGGALFFAA
           ||||||||||:||||:||||||||||||||||||||||||||||||||||||||||||||
g125       MSGNASSPSSSAAIGLVWFGAAVSIAEISTGTLLAPLGWQRGLAALLLGHAVGGALFFAA
                    10         20         30         40         50         60

70         80         90        100        110        120
m125.pep   AYIGALTGRSSMESVRLSFGKRGSVLFSVANMLQLAGWTAVMIYAGATVSSALGKVLWDG
           ||||||||||||||||||||| |||||||||||||||||||||:||||||||||||||||
g125       AYIGALTGRSSMESVRLSFGKCGSVLFSVANMLQLAGWTAVMIYVGATVSSALGKVLWDG
                    70         80         90        100        110        120

130        140        150        160        170        179
m125.pep   ESFVWWALANGALIVLWLVFGARKTGGLKTVSMLLMLLAVLWLSAEVFSTAGSTAAQ-VS
           ||||||||||||||||||||||:|||||||||||||||||||||:|||:::|::||  ||
g125       ESFVWWALANGALIVLWLVFGARRTGGLKTVSMLLMLLAVLWLSVEVFASSGTNAAPAVS
                   130        140        150        160        170        180

180        190        200        210        220        230        239
m125.pep   DGMSFGTAVELSAVMPLSWLPLAADYTRHARRPFAATLTATLAYTLTGCWMYALGLAAAL
           |||:||||||||||||||||||||||||:|||||||||||||||||||||||||||||||
g125       DGMTFGTAVELSAVMPLSWLPLAADYTRQARRPFAATLTATLAYTLTGCWMYALGLAAAL
                   190        200        210        220        230        240

240        250        260        270        280        290        299
m125.pep   FTGETDVAKILLGAXLGAAGILAVVLSTVTTTFLDAYSAGASANNISARFAETPVAVXVT
           ||||||||||||||  ||:||||||||||||||||:||||||||||||||||||:|| ||
g125       FTGETDVAKILLGAGLGITGILAVVLSTVTTTFLDTYSAGASANNISARFAEIPVAVGVT
                   250        260        270        280        290        300

300        310        320        330        340
m125.pep   LIGTVLAVMLPVTEYENFLLLIGSVFAPMAGGFDCRLFRLETAX
           || |||||||||||||:||||| |||:||||||||||| |:|||
g125       LIRTVLAVMLPVTEYKNFLLLIRSVFGPMAGGFDCRLFCLKTAX
                   310        320        330        340
```

The following partial DNA sequence was identified in *N. meningitidis* <SEQ ID 461>:

```
a125.seq
    1   ATGTCGGGCA ATGCCTCCTC TCCTTCATCT TCCGCCGCCA TCGGGCTGAT

51   TTGGTTCGGC GCGGCGGTAT CGATTGCCGA AATCAGCACG GGTACACTGC

101   TTGCGCCTTT GGGCTGGCAG CGCGGTCTGG CGGCTCTGCT TTTGGGTCAT

151   GCCGTCGGCG GCGCGCTGTT TTTTGCGGCG GCGTATATCG GCGCACTGAC

201   CGGACGCAGC TCGATGGAAA GCGTGCGCCT GTCGTTCGGC AAACGCGGTT

251   CAGTGCTGTT TTCCGTGGCG AATATGCTGC AACTGGCCGG CTGGACGGCG

301   GTGATGATTT ACGCCGGCGC AACGGTCAGC TCCGCTTTGG GCAAAGTGTT

351   GTGGGACGGC GAATCTTTTG TCTGGTGGGC ATTGGCAAAC GGCGCGCTGA

401   TTGTGCTGTG GCTGGTTTTC GGCGCACGCA AAACAGGCGG GCTGAAAACC
```

```
 451  GTTTCGATGC TGCTGATGCT GTTGGCGGTT CTGTGGCTGA GTGCCGAAGT

501  CTTTTCCACG GCAGGCAGCA CCGCCGCACA GGTTTCAGAC GGCATGAGTT

551  TCGGAACGGC AGTCGAGCTG TCCGCCGTGA TGCCGCTTTC TTGGCTGCCG

601  CTGGCCGCCG ACTACACGCG CCACGCGCGC CGCCCGTTTG CGGCAACCCT

651  GACGGCAACG CTCGCCTACA CGCTGACCGG CTGCTGGATG TATGCCTTGG

701  GTTTGGCAGC GGCGTTGTTC ACCGGAGAAA CCGACGTGGC AAAAATCCTG

751  CTGGGCGCAG GTTTGGGTGC GGCAGGCATT TTGGCGGTCG TCCTGTCGAC

801  CGTTACCACC ACTTTTCTCG ATGCCTACTC CGCCGGCGTA AGTGCCAACA

851  ATATTTCCGC CAAACTTTCG GAAATACCCA TCGCCGTTGC CGTCGCCGTT

901  GTCGGCACAC TGCTTGCCGT CCTCCTGCCC GTTACCGAAT ATGAAAACTT

951  CCTGCTGCTT ATCGGCTCGG TATTTGCGCC GATGGCG.GC GGTTTTGATT

1001  GCCGACTTTT TCGTCTTGAA ACGGCGTGA
```

This corresponds to the amino acid sequence <SEQ ID 462; ORF 125.a>:

```
a125.pep
    1  MSGNASSPSS SAAIGLIWFG AAVSIAEIST GTLLAPLGWQ RGLAALLLGH

51  AVGGALFFAA AYIGALTGRS SMESVRLSFG KRGSVLFSVA NMLQLAGWTA

101  VMIYAGATVS SALGKVLWDG ESFVWWALAN GALIVLWLVF GARKTGGLKT

151  VSMLLMLLAV LWLSAEVFST AGSTAAQVSD GMSFGTAVEL SAVMPLSWLP

201  LAADYTRHAR RPFAATLTAT LAYTLTGCWM YALGLAAALF TGETDVAKIL

251  LGAGLGAAGI LAVVLSTVTT TFLDAYSAGV SANNISAKLS EIPIAVAVAV

301  VGTLLAVLLP VTEYENFLLL IGSVFAPMAX GFDCRLFRLE TA*
``` m125/a125 95.6% identity in 342 aa overlap

```
                  10         20         30         40         50         60
m125.pep  MSGNASSPSSSSAIGLIWFGAAVSIAEISTGTLLAPLGWQRGLAALLLGHAVGGALFFAA
          ||||||||||:|||||||||||||||||||||||||||||||||||||||||||||||||
a125      MSGNASSPSSSAAIGLIWFGAAVSIAEISTGTLLAPLGWQRGLAALLLGHAVGGALFFAA
                  10         20         30         40         50         60

70         80         90        100        110        120
m125.pep  AYIGALTGRSSMESVRLSFGKRGSVLFSVANMLQLAGWTAVMIYAGATVSSALGKVLWDG
          ||||||||||||||||||||||||||||||||||||||||||||||||||||||||||||
a125      AYIGALTGRSSMESVRLSFGKRGSVLFSVANMLQLAGWTAVMIYAGATVSSALGKVLWDG
                  70         80         90        100        110        120

130        140        150        160        170        180
m125.pep  ESFVWWALANGALIVLWLVFGARKTGGLKTVSMLLMLLAVLWLSAEVFSTAGSTAAQVSD
          ||||||||||||||||||||||||||||||||||||||||||||||||||||||||||||
a125      ESFVWWALANGALIVLWLVFGARKTGGLKTVSMLLMLLAVLWLSAEVFSTAGSTAAQVSD
                 130        140        150        160        170        180

190        200        210        220        230        240
m125.pep  GMSFGTAVELSAVMPLSWLPLAADYTRHARRPFAATLTATLAYTLTGCWMYALGLAAALF
          ||||||||||||||||||||||||||||||||||||||||||||||||||||||||||||
a125      GMSFGTAVELSAVMPLSWLPLAADYTRHARRPFAATLTATLAYTLTGCWMYALGLAAALF
                 190        200        210        220        230        240

250        260        270        280        290        300
m125.pep  TGETDVAKILLGAXLGAAGILAVVLSTVTTTFLDAYSAGASANNISARFAETPVAVXVTL
          ||||||||||||| |||||||||||||||||||||||||:|||||||||:::| |:|| |::
a125      TGETDVAKILLGAGLGAAGILAVVLSTVTTTFLDAYSAGVSANNISAKLSEIPIAVAVAV
                 250        260        270        280        290        300

310        320        330        340
m125.pep  IGTVLAVMLPVTEYENFLLLIGSVFAPMAGGFDCRLFRLETAX
          :||:|||:|||||||||||||||||||||| ||||||||||||
a125      VGTLLAVLLPVTEYENFLLLIGSVFAPMAXGFDCRLFRLETAX
                 310        320        330        340
```

The following partial DNA sequence was identified in *N. gonorrhoeae* <SEQ ID 463>:

```
g126.seq
      1   AtgccgtcTG AAaccCcaaa ggcACGCCGC CGGCTTTCAG ACGGCATCGC
     51   GTCCGACAAC CATACCAAAG AATCCATCAT GCTCACCctg tacggcGAAA
    101   CTTTCCCTTC GCGGCTGCTg ctcggcacgG cggcctacCC GACCCCTGAA
    151   ATCCTCAAAC AATCCGTCCG AACCGCCCGG CCCGCGATGA ttaccGTCTC
    201   GCTGCGCCGC ACGGGATGCG GCGGCGAGGC GCACGGTCAG GGGTTTTGGT
    251   CGCTGCTTCA AGAAACCGGC GTTCCCGTCC TGCCGAACAC GGCAGGCTGC
    301   CAAAGCGTGC AGGAAGCGGT AACGACGGCG CAAATGGCGC GCGAAGTGTT
    351   TGAAACCGAT TGGATAAAAT TGGAACTCAT CGGCGACGAC GACACCTTGC
    401   AGCCGGACGT GTTCCAACTC GTCGAAGCGG CGGAAATCCT GATTAAAGAC
    451   GGCTTCAAAG TGCTGCCTTA TTGCACCGAA GACCTGATTG CCTGCCGCCG
    501   CCTGCTCGAT GCGGGCTGTC AGGCGTTGAT GCCGTGGGCG GCTCCCATCG
    551   GCACGGGTTT GGGGGCGGTT CACGCCTATG CGCTCAAAAT CCTGCGCGAA
    601   CGCCTGCCCG ACACGCCGCT GATTATCGAC GCGGGCTTGG GTTTGCCTTC
    651   CCAAGCGGCA CAAGTGATGG AATGGGGTTT TGACGGCGTA TTGTTAAACA
    701   CCGCCGTTTC CCGCAGCGGC GACCCCGTCA ACATGGCGCG CGCCTTCGCA
    751   CTCGCCGTCG AATCCGGACG GCTGGCATTT GAAGCCGGGC CGGTCGAAGC
    801   GCGAACCAAA GCCCAAGCCA GCACGCCGAC AGTCGGACAA CCGTTTTGGC
    851   ATTCGGCGGA ATATTGA
```

This corresponds to the amino acid sequence <SEQ ID 464; ORF 126.ng>:

```
g126.pep
      1   MPSETPKARR RLSDGIASDN HTKESIMLTL YGETFPSRLL LGTAAYPTPE
     51   ILKQSVRTAR PAMITVSLRR TGCGGEAHGQ GFWSLLQETG VPVLPNTAGC
    101   QSVQEAVTTA QMAREVFETD WIKLELIGDD DTLQPDVFQL VEAAEILIKD
    151   GFKVLPYCTE DLIACRRLLD AGCQALMPWA APIGTGLGAV HAYALKILRE
    201   RLPDTPLIID AGLGLPSQAA QVMEWGFDGV LLNTAVSRSG DPVNMARAFA
    251   LAVESGRLAF EAGPVEARTK AQASTPTVGQ PFWHSAEY*
```

The following partial DNA sequence was identified in *N. meningitidis* <SEQ ID 465>:

```
m126.seq (partial)
      1   ..CACTATACAA AGGAACCCAT TATGCTCACC CTATACGGCG AAACTTTCCC
     51      CTCGCGGCTG CTGCTCGGCA CGGCTGCCTA CCCGACCCCC GAAATCCTCA
    101      AACAATCCAT CCAAACCGCC CAGCCTGCGA TGATTACCGT CTCGCTGCGC
    151      CGCGCGGGAA GCGGCGGCGA GGCGCACGGT CAGGGGTTTT GGTCGCTGCT
    201      TCAAGAAACC GGCGTTCCCG TCCTGCCGAA CACGGCAGGC TGCCAAAGCG
    251      TGCAGGAAGC GGTAACGACG GCGCAAATGG CGCGCGAAGT GTTTGAAACC
    301      GATTGGATAA AATTGGAACT CATCGGAGAT GACGACACCT TGCAGCCGGA
    351      TGTGTTCCAG CTTGTCGAAG CGGCGGAAAT CCTGATTAAA GACGGCTTCA
```

-continued

```
401    AAGTGCTGCC TTATTGCACC GAAGACCTGA TTGCCTGCCG CCGCCTGCTC

451    GACGCGGGCT GTCAGGCGTT GATGCCGTGG GCGGCCCCGA TCGGCACGGG

501    TTTGGGCGCG GTTCACGCCT ACGCGTTGAA CGTCCTGCGC GAACGCCTGC

551    CCGACACGCC GCTGATTATC GACGCGGGCT TGGGTTTGCC CTCACAGGCG

601    GCACAAGTGA TGGAATGGGG CTTTGACGGC GTGCTTTTGA ATACTGCCGT

651    TTCCCGCAGC GGCGATCCGG TCAATATGGC ACGCGCCTTC GCACTCGCCG

701    TCGAATCCGG ACGGCTGGCA TTTGAAGCCG GACCGGTCGA AGCACGCGAC

751    AAAGCGCAAG CCAGCACGCC GACAGTCGGA CAACCGTTTT GGCATTCGGC

801    GGAATATTGA
```

This corresponds to the amino acid sequence <SEQ ID 466; ORF 126>:

```
m126.pep (partial)
  1    ..HYTKEPIMLT LYGETFPSRL LLGTAAYPTP EILKQSIQTA QPAMITVSLR

51    RAGSGGEAHG QGFWSLLQET GVPVLPNTAG CQSVQEAVTT AQMAREVFET

101    DWIKLELIGD DDTLQPDVFQ LVEAAEILIK DGFKVLPYCT EDLIACRRLL

151    DAGCQALMPW AAPIGTGLGA VHAYALNVLR ERLPDTPLII DAGLGLPSQA

201    AQVMEWGFDG VLLNTAVSRS GDPVNMARAF ALAVESGRLA FEAGPVEARD

251    KAQASTPTVG QPFWHSAEY*
```

Computer analysis of this amino acid sequence gave the following results:
Homology with a Predicted ORF from *N. gonorrhoeae*
ORF 126 shows 95.9% identity over a 269 aa overlap with a predicted ORF (ORF 126.ng) from *N. gonorrhoeae*:

```
m126/g126
                          10         20         30         40
     m126.pep             HYTKEPIMLTLYGETFPSRLLLGTAAYPTPEILKQSIQTAQ
                          ::|||||||||||||||||||||||||||||||||::||:
     g126    MPSETPKARRRLSDGIASDNHTKESIMLTLYGETFPSRLLLGTAAYPTPEILKQSVRTAR
                 10         20         30         40         50         60

50         60         70         80         90        100
     m126.pep PAMITVSLRRAGSGGEAHGQGFWSLLQETGVPVLPNTAGCQSVQEAVTTAQMAREVFETD
             |||||||||:|||||||||||||||||||||||||||||||||||||||||||||||||
     g126    PAMITVSLRRTGCGGEAHGQGFWSLLQETGVPVLPNTAGCQSVQEAVTTAQMAREVFETD
                 70         80         90        100        110        120

110        120        130        140        150        160
     m126.pep WIKLELIGDDDTLQPDVFQLVEAAEILIKDGFKVLPYCTEDLIACRRLLDAGCQALMPWA
             ||||||||||||||||||||||||||||||||||||||||||||||||||||||||||||
     g126    WIKLELIGDDDTLQPDVFQLVEAAEILIKDGFKVLPYCTEDLIACRRLLDAGCQALMPWA
                130        140        150        160        170        180

170        180        190        200        210        220
     m126.pep APIGTGLGAVHAYALNVLRERLPDTPLIIDAGLGLPSQAAQVMEWGFDGVLLNTAVSRSG
             ||||||||||||||||::||||||||||||||||||||||||||||||||||||||||||
     g126    APIGTGLGAVHAYALKILRERLPDTPLIIDAGLGLPSQAAQVMEWGFDGVLLNTAVSRSG
                190        200        210        220        230        240

230        240        250        260        270
     m126.pep DPVNMARAFALAVESGRLAFEAGPVEARDKAQASTPTVGQPFWHSAEYX
             ||||||||||||||||||||||||||||| |||||||||||||||||||
     g126    DPVNMARAFALAVESGRLAFEAGPVEARTKAQASTPTVGQPFWHSAEYX
                250        260        270        280
```

The following partial DNA sequence was identified in *N. meningitidis* <SEQ ID 467>:

a126.seq
```
  1   TTGTTAATCC ACTATACAAA GGAACCCATT ATGCTCACCC TGTACAGCGA
 51   AACTTTCCCT TCGCGGCTGC TGCTCGGCAC AGCCGCCTAC CCGACCCCTG
101   AAATCCTCAA ACAATCCGTC CGAACCGCCC GGCCCGCGAT GATTACCGTC
151   TCGCTGCGCC GCGCGGGATG CGGCGGCGAG GCGCACGGTC AGGGGTTTTG
201   GTCGCTGCTT CAAGAAACCG GCGTTCCCGT CCTGCCGAAC ACGGCAGGCT
251   GCCAAAGCGT GCAGGAAGCG GTAACGACGG CGCAAATGGC GCGCGAAGTG
301   TTTGAAACCG ATTGGATTAA ACTCGAACTC ATCGGCGACG ACGACACCTT
351   GCAGCCGGAT GTGTTCCAAC TTGTCGAAGC GGCGGAAATC CTGATTAAAG
401   ACGGCTTCAA AGTGCTGCCT TATTGCACCG AAGACCTGAT TGCCTGCCGC
451   CGCCTGCTCG ACGCGGGCTG TCAGGCGTTG ATGCCGTGGG CGGCCCCGAT
501   CGGCACGGGT TTGGGCGCGG TTCACGCCTA CGCGTTGAAC GTCCTGCGCG
551   AACGCCTGCC CGACACGCCG CTGATTATCG ACGCGGGCTT GGGTTTGCCC
601   TCACAGGCGG CACAAGTGAT GGAATGGGGC TTTGACGGCG TGCTTTTGAA
651   TACTGCCGTT TCCCGCAGCG GCGATCCGGT CAATATGGCA CGCGCCTTCG
701   CACTCGCCGT CGAATCCGGA CGGCTGGCAT TTGAAGCCGG ACCGGTCGAA
751   GCACGCGACA AAGCGCAAGC CAGCACGCCG ACAGTCGGAC AACCGTTTTG
801   GCATTCGGCG GAATATTGA
```

This corresponds to the amino acid sequence <SEQ ID 468; ORF 126.a>:

a126.pep
```
  1   LLIHYTKEPI MLTLYSETFP SRLLLGTAAY PTPEILKQSV RTARPAMITV
 51   SLRRAGCGGE AHGQGFWSLL QETGVPVLPN TAGCQSVQEA VTTAQMAREV
101   FETDWIKLEL IGDDDTLQPD VFQLVEAAEI LIKDGFKVLP YCTEDLIACR
151   RLLDAGCQAL MPWAAPIGTG LGAVHAYALN VLRERLPDTP LIIDAGLGLP
201   SQAAQVMEWG FDGVLLNTAV SRSGDPVNMA RAFALAVESG RLAFEAGPVE
251   ARDKAQASTP TVGQPFWHSA EY*
``` m126/a126 98.1% identity in 269 aa overlap

```
                  10         20         30         40         50
    m126.pep  HYTKEPIMLTLYGETFPSRLLLGTAAYPTPEILKQSIQTAQPAMITVSLRRAGSGGE
              |||||||||||| :||||||||||||||||||||| ::||:|||||||||||| |||
    a126      LLIHYTKEPIMLTLYSETFPSRLLLGTAAYPTPEILKQSVRTARPAMITVSLRRAGCGGE
                   10         20         30         40         50         60

60         70         80         90        100        110
    m126.pep  AHGQGFWSLLQETGVPVLPNTAGCQSVQEAVTTAQMAREVFETDWIKLELIGDDDTLQPD
              ||||||||||||||||||||||||||||||||||||||||||||||||||||||||||||
    a126      AHGQGFWSLLQETGVPVLPNTAGCQSVQEAVTTAQMAREVFETDWIKLELIGDDDTLQPD
                   70         80         90        100        110        120

120        130        140        150        160        170
    m126.pep  VFQLVEAAEILIKDGFKVLPYCTEDLIACRRLLDAGCQALMPWAAPIGTGLGAVHAYALN
              ||||||||||||||||||||||||||||||||||||||||||||||||||||||||||||
    a126      VFQLVEAAEILIKDGFKVLPYCTEDLIACRRLLDAGCQALMPWAAPIGTGLGAVHAYALN
                  130        140        150        160        170        180

180        190        200        210        220        230
    m126.pep  VLRERLPDTPLIIDAGLGLPSQAAQVMEWGFDGVLLNTAVSRSGDPVNMARAFALAVESG
              ||||||||||||||||||||||||||||||||||||||||||||||||||||||||||||
    a126      VLRERLPDTPLIIDAGLGLPSQAAQVMEWGFDGVLLNTAVSRSGDPVNMARAFALAVESG
                  190        200        210        220        230        240
```

```
                240        250        260        270
m126.pep    RLAFEAGPVEARDKAQASTPTVGQPFWHSAEYX
            ||||||||||||||||||||||||||||||||
a126        RLAFEAGPVEARDKAQASTPTVGQPFWHSAEYX
                   250        260        270
```

The following partial DNA sequence was identified in *N. gonorrhoeae* <SEQ ID 469>:

```
g126-1.seq
      1    ATGCTCACCC TGTACGGCGA AACTTTCCCT TCGCGGCTGC TGCTCGGCAC

51    GGCCGCCTAC CCGACCCCTG AAATCCTCAA ACAATCCGTC CGAACCGCCC

101    GGCCCGCGAT GATTACCGTC TCGCTGCGCC GCACGGGATG CGGCGGCGAG

151    GCGCACGGTC AGGGGTTTTG GTCGCTGCTT CAAGAAACCG GCGTTCCCGT

201    CCTGCCGAAC ACGGCAGGCT GCCAAAGCGT GCAGGAAGCG GTAACGACGG

251    CGCAAATGGC GCGCGAAGTG TTTGAAACCG ATTGGATAAA ATTGGAACTC

301    ATCGGCGACG ACGACACCTT GCAGCCGGAC GTGTTCCAAC TCGTCGAAGC

351    GGCGGAAATC CTGATTAAAG ACGGCTTCAA AGTGCTGCCT TATTGCACCG

401    AAGACCTGAT TGCCTGCCGC CGCCTGCTCG ATGCGGGCTG TCAGGCGTTG

451    ATGCCGTGGG CGGCTCCCAT CGGCACGGGT TTGGGGGCGG TTCACGCCTA

501    TGCGCTCAAA ATCCTGCGCG AACGCCTGCC CGACACGCCG CTGATTATCG

551    ACGCGGGCTT GGGTTTGCCT TCCCAAGCGG CACAAGTGAT GGAATGGGGT

601    TTTGACGGCG TATTGTTAAA CACCGCCGTT TCCCGCAGCG GCGACCCCGT

651    CAACATGGCG CGCGCCTTCG CACTCGCCGT CGAATCCGGA CGGCTGGCAT

701    TTGAAGCCGG GCCGGTCGAA GCGCGAACCA AAGCCCAAGC CAGCACGCCG

751    ACAGTCGGAC AACCGTTTTG GCATTCGGCG GAATATTGA
```

This corresponds to the amino acid sequence <SEQ ID 470; ORF 126-1.ng>:

```
g126-1.pep
      1    MLTLYGETFP SRLLLGTAAY PTPEILKQSV RTARPAMITV SLRRTGCGGE

51    AHGQGFWSLL QETGVPVLPN TAGCQSVQEA VTTAQMAREV FETDWIKLEL

101    IGDDDTLQPD VFQLVEAAEI LIKDGFKVLP YCTEDLIACR RLLDAGCQAL

151    MPWAAPIGTG LGAVHAYALK ILRERLPDTP LIIDAGLGLP SQAAQVMEWG

201    FDGVLLNTAV SRSGDPVNMA RAFALAVESG RLAFEAGPVE ARTKAQASTP

251    TVGQPFWHSA EY*
```

The following partial DNA sequence was identified in *N. meningitidis* <SEQ ID 471>:

```
m126-1.seq
      1    ATGCTCACCC TATACGGCGA AACTTTCCCC TCGCGGCTGC TGCTCGGCAC

51    GGCTGCCTAC CCGACCCCCG AAATCCTCAA ACAATCCATC CAAACCGCCC

101    AGCCTGCGAT GATTACCGTC TCGCTGCGCC GCGCGGGAAG CGGCGGCGAG

151    GCGCACGGTC AGGGGTTTTG GTCGCTGCTT CAAGAAACCG GCGTTCCCGT

201    CCTGCCGAAC ACGGCAGGCT GCCAAAGCGT GCAGGAAGCG GTAACGACGG

251    CGCAAATGGC GCGCGAAGTG TTTGAAACCG ATTGGATAAA ATTGGAACTC
```

-continued

```
301    ATCGGAGATG ACGACACCTT GCAGCCGGAT GTGTTCCAGC TTGTCGAAGC

351    GGCGGAAATC CTGATTAAAG ACGGCTTCAA AGTGCTGCCT TATTGCACCG

401    AAGACCTGAT TGCCTGCCGC CGCCTGCTCG ACGCGGGCTG TCAGGCGTTG

451    ATGCCGTGGG CGGCCCCGAT CGGCACGGGT TTGGGCGCGG TTCACGCCTA

501    CGCGTTGAAC GTCCTGCGCG AACGCCTGCC CGACACGCCG CTGATTATCG

551    ACGCGGGCTT GGGTTTGCCC TCACAGGCGG CACAAGTGAT GGAATGGGGC

601    TTTGACGGCG TGCTTTTGAA TACTGCCGTT TCCCGCAGCG GCGATCCGGT

651    CAATATGGCA CGCGCCTTCG CACTCGCCGT CGAATCCGGA CGGCTGGCAT

701    TTGAAGCCGG ACCGGTCGAA GCACGCGACA AAGCGCAAGC CAGCACGCCG

751    ACAGTCGGAC AACCGTTTTG GCATTCGGCG GAATATTGA
```

This corresponds to the amino acid sequence <SEQ ID 5; ORF 126-1>:

```
m126-1.pep
  1    MLTLYGETFP SRLLLGTAAY PTPEILKQSI QTAQPAMITV SLRRAGSGGE

51    AHGQGFWSLL QETGVPVLPN TAGCQSVQEA VTTAQMAREV FETDWIKLEL

101    IGDDDTLQPD VFQLVEAAEI LIKDGFKVLP YCTEDLIACR RLLDAGCQAL

151    MPWAAPIGTG LGAVHAYALN VLRERLPDTP LIIDAGLGLP SQAAQVMEWG

201    FDGVLLNTAV SRSGDPVNMA RAFALAVESG RLAFEAGPVE ARDKAQASTP

251    TVGQPFWHSA EY*
``` m126-1/g126-1 96.9% identity in 262 aa overlap

```
                    10         20         30         40         50         60
m126-1.pep  MLTLYGETFPSRLLLGTAAYPTPEILKQSIQTAQPAMITVSLRRAGSGGEAHGQGFWSLL
            |||||||||||||||||||||||||||||::||:||||||||||::||||||||||||||
g126-1      MLTLYGETFPSRLLLGTAAYPTPEILKQSVRTARPAMITVSLRRTGCGGEAHGQGFWSLL
                    10         20         30         40         50         60

70         80         90        100        110        120
m126-1.pep  QETGVPVLPNTAGCQSVQEAVTTAQMAREVFETDWIKLELIGDDDTLQPDVFQLVEAAEI
            ||||||||||||||||||||||||||||||||||||||||||||||||||||||||||||
g126-1      QETGVPVLPNTAGCQSVQEAVTTAQMAREVFETDWIKLELIGDDDTLQPDVFQLVEAAEI
                    70         80         90        100        110        120

130        140        150        160        170        180
m126-1.pep  LIKDGFKVLPYCTEDLIACRRLLDAGCQALMPWAAPIGTGLGAVHAYALNVLRERLPDTP
            |||||||||||||||||||||||||||||||||||||||||||||||||::|||||||||
g126-1      LIKDGFKVLPYCTEDLIACRRLLDAGCQALMPWAAPIGTGLGAVHAYALKILRERLPDTP
                   130        140        150        160        170        180

190        200        210        220        230        240
m126-1.pep  LIIDAGLGLPSQAAQVMEWGFDGVLLNTAVSRSGDPVNMARAFALAVESGRLAFEAGPVE
            ||||||||||||||||||||||||||||||||||||||||||||||||||||||||||||
g126-1      LIIDAGLGLPSQAAQVMEWGFDGVLLNTAVSRSGDPVNMARAFALAVESGRLAFEAGPVE
                   190        200        210        220        230        240

250        260
m126-1.pep  ARDKAQASTPTVGQPFWHSAEYX
            ||  |||||||||||||||||||
g126-1      ARTKAQASTPTVGQPFWHSAEYX
                   250        260
```

The following partial DNA sequence was identified in *N. meningitidis* <SEQ ID 473>:

```
a126-1.seq
  1    ATGCTCACCC TGTACAGCGA AACTTTCCCT TCGCGGCTGC TGCTCGGCAC

51    AGCCGCCTAC CCGACCCCTG AAATCCTCAA ACAATCCGTC CGAACCGCCC
```

-continued

```
101     GGCCCGCGAT GATTACCGTC TCGCTGCGCC GCGCGGGATG CGGCGGCGAG

151     GCGCACGGTC AGGGGTTTTG GTCGCTGCTT CAAGAAACCG GCGTTCCCGT

201     CCTGCCGAAC ACGGCAGGCT GCCAAAGCGT GCAGGAAGCG GTAACGACGG

251     CGCAAATGGC GCGCGAAGTG TTTGAAACCG ATTGGATTAA ACTCGAACTC

301     ATCGGCGACG ACGACACCTT GCAGCCGGAT GTGTTCCAAC TTGTCGAAGC

351     GGCGGAAATC CTGATTAAAG ACGGCTTCAA AGTGCTGCCT TATTGCACCG

401     AAGACCTGAT TGCCTGCCGC CGCCTGCTCG ACGCGGGCTG TCAGGCGTTG

451     ATGCCGTGGG CGGCCCCGAT CGGCACGGGT TTGGGCGCGG TTCACGCCTA

501     CGCGTTGAAC GTCCTGCGCG AACGCCTGCC CGACACGCCG CTGATTATCG

551     ACGCGGGCTT GGGTTTGCCC TCACAGGCGG CACAAGTGAT GGAATGGGGC

601     TTTGACGGCG TGCTTTTGAA TACTGCCGTT TCCCGCAGCG GCGATCCGGT

651     CAATATGGCA CGCGCCTTCG CACTCGCCGT CGAATCCGGA CGGCTGGCAT

701     TTGAAGCCGG ACCGGTCGAA GCACGCGACA AAGCGCAAGC CAGCACGCCG

751     ACAGTCGGAC AACCGTTTTG GCATTCGGCG GAATATTGA
```

This corresponds to the amino acid sequence <SEQ ID 474; ORF 126-1.a>:

```
a126-1.pep
    1   MLTLYSETFP SRLLLGTAAY PTPEILKQSV RTARPAMITV SLRRAGCGGE

51   AHGQGFWSLL QETGVPVLPN TAGCQSVQEA VTTAQMAREV FETDWIKLEL

101   IGDDDTLQPD VFQLVEAAEI LIKDGFKVLP YCTEDLIACR RLLDAGCQAL

151   MPWAAPIGTG LGAVHAYALN VLRERLPDTP LIIDAGLGLP SQAAQVMEWG

201   FDGVLLNTAV SRSGDPVNMA RAFALAVESG RLAFEAGPVE ARDKAQASTP

251   TVGQPFWHSA EY*
``` a126-1/m126-1 98.1% identity in 262 aa overlap

```
                  10         20         30         40         50         60
a126-1.pep  MLTLYSETFPSRLLLGTAAYPTPEILKQSVRTARPAMITVSLRRAGCGGEAHGQGFWSLL
            |||||:||||||||||||||||||||||||:::||:||||||||||:||||||||||||
m126-1      MLTLYGETFPSRLLLGTAAYPTPEILKQSIQTAQPAMITVSLRRAGSGGEAHGQGFWSLL
                  10         20         30         40         50         60

70         80         90        100        110        120
a126-1.pep  QETGVPVLPNTAGCQSVQEAVTTAQMAREVFETDWIKLELIGDDDTLQPDVFQLVEAAEI
            ||||||||||||||||||||||||||||||||||||||||||||||||||||||||||||
m126-1      QETGVPVLPNTAGCQSVQEAVTTAQMAREVFETDWIKLELIGDDDTLQPDVFQLVEAAEI
                  70         80         90        100        110        120

130        140        150        160        170        180
a126-1.pep  LIKDGFKVLPYCTEDLIACRRLLDAGCQALMPWAAPIGTGLGAVHAYALNVLRERLPDTP
            ||||||||||||||||||||||||||||||||||||||||||||||||||||||||||||
m126-1      LIKDGFKVLPYCTEDLIACRRLLDAGCQALMPWAAPIGTGLGAVHAYALNVLRERLPDTP
                 130        140        150        160        170        180

190        200        210        220        230        240
a126-1.pep  LIIDAGLGLPSQAAQVMEWGFDGVLLNTAVSRSGDPVNMARAFALAVESGRLAFEAGPVE
            ||||||||||||||||||||||||||||||||||||||||||||||||||||||||||||
m126-1      LIIDAGLGLPSQAAQVMEWGFDGVLLNTAVSRSGDPVNMARAFALAVESGRLAFEAGPVE
                 190        200        210        220        230        240

250        260
a126-1.pep  ARDKAQASTPTVGQPFWHSAEYX
            |||||||||||||||||||||||
m126-1      ARDKAQASTPTVGQPFWHSAEYX
                 250        260
```

The following partial DNA sequence was identified in *N. gonorrhoeae* <SEQ ID 475>:

g127.seq
1 ATGGAAATAT GGAATATGTT GAACACTTGG CCCGATGCCG TCCCGATACG
51 CGCGGAGGCG GCCGAATCCG TGGCGGCGGT CGCGGCTTTG CTGCTGGCGC
101 GCGCCCTTCT GTTGAATATC CACTTCAGAC GGCATCCGGA TTTCGGCATC
151 GAAAGCAAGC GGCGGTTTTT GGTTGCCAGC CGCAATATAA CGCTGCTTTT
201 GGTGCTGTTT TCGCTGGCAT TTATCTGGTC GGCGCAAATT CAAACGCTGG
251 CTTTGTCGAT GTTTGCGGTG GCGGCGGCGG TCGTCGTGGC GACAAAAGAA
301 CTGATTATGT GTCTGTCGGG CAGTATTTTA aggtctGCCA CCCAGCAATA
351 CTCGGTCGGC GACTATATCG AAATCAACGG CCTGCGCGGG CGCGTGGTCG
401 ACATCAATCT GTTGAACACG CTGATGATGC AGGTCGGTCC GAACCCCTTG
451 GTCGGACAGC TTGCGGGAAC CACCGTTTCT TTCCCCAACA GCCTGTTGTT
501 GAGCCACCCC GTGCGCCGCG ACAATATTTT GGGCGACTAT GTCATCCATA
551 CGGTCGAAAT CCCCGTTCCC ATCCATTTGG ATTCGGATGA AGCCGTATGC
601 CGTCTGAAAG CCGTACTCGA GCCCTTGTGC GCGCCCTACA TCCCCGCCAT
651 TCAGCGGTAT TTGGAAAACG TGCAGGCGGA AAAACTGTTT ATCACGCCCG
701 CCGCCAGGCC GCGCGTTACC CGCGTACCGT ACGACGACAA GGCATACCGC
751 ATCATCGTCC GCTTCGCCTC CCCCGTTTCA AAGCGGCTGG AAATCCAACA
801 GGCGGTTATG GACGAATTTT TGCGCGTACA ATACCGCCTG TTAAATCATC
851 CCGCCGgctc cgAAACACTT TAA This corresponds to the amino acid sequence <SEQ ID 476; ORF 127.ng>:

g127.pep
1 MEIWNMLNTW PDAVPIRAEA AESVAAVAAL LLARALLLNI HFRRHPDFGI
51 ESKRRFLVAS RNITLLLVLF SLAFIWSAQI QTLALSMFAV AAAVVVATKE
101 LIMCLSGSIL RSATQQYSVG DYIEINGLRG RVVDINLLNT LMMQVGPNPL
151 VGQLAGTTVS FPNSLLLSHP VRRDNILGDY VIHTVEIPVP IHLDSDEAVC
201 RLKAVLEPLC APYIPAIQRY LENVQAEKLF ITPAARPRVT RVPYDDKAYR
251 IIVRFASPVS KRLEIQQAVM DEFLRVQYRL LNHPAGSETL *

The following partial DNA sequence was identified in *N. meningitidis* <SEQ ID 477>:

m127.seq
1 ATGGAAATAT GGAATATGTT GGACACTTGG CTCGGTGCCG TCCCGATACG
51 TGCGGAGGCG GTCGAATCCG TGGCGGCGGT TGCGGCTTTG CTGCTGGCGC
101 GCGCCCTTCT GTTGAATATC CACTTCAAAC GGCATCCGGA TTTCGGCATC
151 GAAAGCAAGC GGCGGTTTTT GGTTGCCAGC CGCAATATAA CGCTGCTTTT
201 GGTGCTGTTT TCGCTGGCAT TTATCTGGTC GGCGCAAATC CAAACGCTGG
251 CTTTGTCGAT GTTTGCGGTG GCGGCGGCGG TCGTCGTGGC GACGAAGGAA
301 CTGATTATGT GTCTGTCGGG CAGTATTTTA AGGTCTGCCA CCCAGCAATA
351 CTCGGTCGGC GACTATATCG AAATCAACGG CCTGCGCGGG CGCGTGGTCG
401 ACATCAACCT GTTGAACACG CTGATGATGC AGGTCGGTCC GAACCCCTTG
451 GTCGGACAGC TTGCGGGAAC CACCGTTTCT TTCCCCAACA GCCTGTTGTT -continued

```
501  GAGCCACCCC GTGCGCCGCG ACAATATTTT GGGCGACTAT GTCATCCATA
551  CGGTCGAAAT CCCCGTTCCC ATCCATTTGG ATTCGGATGA AGCCGTATGC
601  CGTCTGAAAG CCGTACTCGA GCCCTTGTGC GCGCCCTACA TCCCCGCCAT
651  CCAACGGsAT TTGGAAAACG TGCAGGCGGA AAAACTGTTT ATCACGCCCG
701  CCGCCAGACC GCGCGTTACC CGCGTGCCGT ACGATGACAA GGCATACCGC
751  ATCATCGTCC GCTTCGCTTC CCCCGTTTCA AAGCGGCTGG AAATCCAACA
801  GGCGGTTATG GACGAATTTT TGCGCGTACA ATACCGCCTG TTAAATCACC
851  CCGCCGGCTC CGAAACACTT TAA
```

This corresponds to the amino acid sequence <SEQ ID 478; ORF 127>:

```
m127.pep
  1  MEIWNMLDTW LGAVPIRAEA VESVAAVAAL LLARALLLNI HFKRHPDFGI
 51  ESKRRFLVAS RNITLLLVLF SLAFIWSAQI QTLALSMFAV AAAVVATKE
101  LIMCLSGSIL RSATQQYSVG DYIEINGLRG RVVDINLLNT LMMQVGPNPL
151  VGQLAGTTVS FPNSLLLSHP VRRDNILGDY VIHTVEIPVP IHLDSDEAVC
201  RLKAVLEPLC APYIPAIQRX LENVQAEKLF ITPAARPRVT RVPYDDKAYR
251  IIVRFASPVS KRLEIQQAVM DEFLRVQYRL LNHPAGSETL *
```

Computer analysis of this amino acid sequence gave the following results:
Homology with a Predicted ORF from *N. gonorrhoeae*
ORF 127 shows 97.9% identity over a 290 aa overlap with a predicted ORF (ORF 127.ng) from *N. gonorrhoeae*:

```
m127/g127
                   10         20         30         40         50         60
  m127.pep  MEIWNMLDTWLGAVPIRAEAVESVAAVAALLLARALLLNIHFKRHPDFGIESKRRFLVAS
            ||||||| ||  ||||||||||| |||||||||||||||||||| ||||||||||||||
      g127  MEIWNMLNTWPDAVPIRAEAAESVAAVAALLLARALLLNIHFRRHPDFGIESKRRFLVAS
                   10         20         30         40         50         60

70         80         90        100        110        120
  m127.pep  RNITLLLVLFSLAFIWSAQIQTLALSMFAVAAAVVATKELIMCLSGSILRSATQQYSVG
            ||||||||||||||||||||||||||||||||||||||||||||||||||||||||||||
      g127  RNITLLLVLFSLAFIWSAQIQTLALSMFAVAAAVVATKELIMCLSGSILRSATQQYSVG
                   70         80         90        100        110        120

130        140        150        160        170        180
  m127.pep  DYIEINGLRGRVVDINLLNTLMMQVGPNPLVGQLAGTTVSFPNSLLLSHPVRRDNILGDY
            ||||||||||||||||||||||||||||||||||||||||||||||||||||||||||||
      g127  DYIEINGLRGRVVDINLLNTLMMQVGPNPLVGQLAGTTVSFPNSLLLSHPVRRDNILGDY
                  130        140        150        160        170        180

190        200        210        220        230        240
  m127.pep  VIHTVEIPVPIHLDSDEAVCRLKAVLEPLCAPYIPAIQRXLENVQAEKLFITPAARPRVT
            ||||||||||||||||||||||||||||||||||||||| ||||||||||||||||||||
      g127  VIHTVEIPVPIHLDSDEAVCRLKAVLEPLCAPYIPAIQRYLENVQAEKLFITPAARPRVT
                  190        200        210        220        230        240

250        260        270        280        290
  m127.pep  RVPYDDKAYRIIVRFASPVSKRLEIQQAVMDEFLRVQYRLLNHPAGSETLX
            ||||||||||||||||||||||||||||||||||||||||||||||||||
      g127  RVPYDDKAYRIIVRFASPVSKRLEIQQAVMDEFLRVQYRLLNHPAGSETLX
                  250        260        270        280        290
```

The following partial DNA sequence was identified in *N. meningitidis* <SEQ ID 479>:

```
a127.seq
    1   ATGGAAATAT GGAATATGTT GGACACTTGG CTCGGTGCCG TCCCGATACG

51   TGCGGAGGCG GTCGAATCCG TGGCGGTGGT CGCGGCTTTG CTGCTGGCGC

101   GCGCCCTTCT GTTGAATATC CACTTCAAAC GGCATCCGGA TTTCGGCATC

151   GAAAGCAAGC GGCGGTTTTT GGTTGCCAGC CGCAATATAA CGCTGCTTTT

201   GGTGCTGTTT TCGCTGGCAT TTATCTGGTC GGCGCAAATC CAAACGCTGG

251   CTTTGTCGAT GTTTGCGGTG GCGGCGGCGG TCGTCGTGGC GACGAAGGAA

301   CTGATTATGT GTCTGTCGGG CAGCATTTTA AGGTCTGCCA CCCAGCAATA

351   CTCGGTCGGC GACTATATCG AAATCAACGG CCTGCGCGGG CGCGTGGTCG

401   ACATCAACCT GTTGAACACG CTGATGATGC AGGTCGGTCC GAACCCCTTG

451   GTCGGACAGC TTGCGGGAAC CACCGTTTCT TTCCCCAACA GCCTGTTGTT

501   GAGCCACCCC GTGCGCCGCG ACAATATTTT GGGCGACTAC GTCATCCATA

551   CGGTCGAAAT CCCGGTTCCC ATCCATTTGG ATTCGGATGA AGCCGTATGC

601   CGTCTGAAAG CCGTACTCGA GCCCTTGTGC GCGCCCTACA TCCCCGCCAT

651   CCAACGGCAT TTGGAAAACG TGCAGGCGGA AAAACTGTTT ATCACGCCCG

701   CCGCCAAACC GCGCGTTACC CGCGTGCCGT ACGATGACAA GGCATACCGC

751   ATCATCGTCC GCTTCGCCTC CCCCGTTTCA AAGCGGCTGG AAATCCAACA

801   GGCGGTTATG GACGAATTTT TGCGCGTACA ATACCGCCTG TTAAATTACC

851   CCGCCGGCTC CGAAACACTT TAA
```

This corresponds to the amino acid sequence <SEQ ID 480; ORF 127.a>:

```
a127.pep
    1   MEIWNMLDTW LGAVPIRAEA VESVAVVAAL LLARALLLNI HFKRHPDFGI

51   ESKRRFLVAS RNITLLLVLF SLAFIWSAQI QTLALSMFAV AAAVVVATKE

101   LIMCLSGSIL RSATQQYSVG DYIEINGLRG RVVDINLLNT LMMQVGPNPL

151   VGQLAGTTVS FPNSLLLSHP VRRDNILGDY VIHTVEIPVP IHLDSDEAVC

201   RLKAVLEPLC APYIPAIQRH LENVQAEKLF ITPAAKPRVT RVPYDDKAYR

251   IIVRFASPVS KRLEIQQAVM DEFLRVQYRL LNYPAGSETL *
``` m127/a127 98.6% identity in 290 aa overlap

```
                 10         20         30         40         50         60
    m127.pep  MEIWNMLDTWLGAVPIRAEAVESVAAVAALLLARALLLNIHFKRHPDFGIESKRRFLVAS
              ||||||||||||||||||||||:|||||||||||||||||||||||||||||||||||||
    a127      MEIWNMLDTWLGAVPIRAEAVESVAVVAALLLARALLLNIHFKRHPDFGIESKRRFLVAS
                 10         20         30         40         50         60

70         80         90        100        110        120
    m127.pep  RNITLLLVLFSLAFIWSAQIQTLALSMFAVAAAVVVATKELIMCLSGSILRSATQQYSVG
              ||||||||||||||||||||||||||||||||||||||||||||||||||||||||||||
    a127      RNITLLLVLFSLAFIWSAQIQTLALSMFAVAAAVVVATKELIMCLSGSILRSATQQYSVG
                 70         80         90        100        110        120

130        140        150        160        170        180
    m127.pep  DYIEINGLRGRVVDINLLNTLMMQVGPNPLVGQLAGTTVSFPNSLLLSHPVRRDNILGDY
              ||||||||||||||||||||||||||||||||||||||||||||||||||||||||||||
    a127      DYIEINGLRGRVVDINLLNTLMMQVGPNPLVGQLAGTTVSFPNSLLLSHPVRRDNILGDY
                130        140        150        160        170        180

190        200        210        220        230        240
    m127.pep  VIHTVEIPVPIHLDSDEAVCRLKAVLEPLCAPYIPAIQRXLENVQAEKLFITPAARPRVT
              |||||||||||||||||||||||||||||||||||||||| |||||||||||||:||||
    a127      VIHTVEIPVPIHLDSDEAVCRLKAVLEPLCAPYIPAIQRHLENVQAEKLFITPAAKPRVT
                190        200        210        220        230        240
```

```
                        250        260        270        280        290
m127.pep    RVPYDDKAYRIIVRFASPVSKRLEIQQAVMDEFLRVQYRLLNHPAGSETLX
            |||||||||||||||||||||||||||||||||||||||||:||||||||
a127        RVPYDDKAYRIIVRFASPVSKRLEIQQAVMDEFLRVQYRLLNYPAGSETLX
                        250        260        270        280        290
```

The following partial DNA sequence was identified in *N. gonorrhoeae* <SEQ ID 481>:

```
g128.seq
    1  atgattgaca acgCActgct ccacttgggc gaagaaccCC GTTTTaatca
   51  aatccaaacc gaagACAtca AACCCGCCGT CCAAACCGCC ATCGCCGAAG
  101  CGCGCGGACA AATCGCCGCC GTCAAAGCGC AAACGCACAC CGGCTGGGCG
  151  AACACCGTCG AGCGTCTGAC CGGCATCACC GAACGCGTCG GCAGGATTTG
  201  GGGCGTCGTG TCCCATCTCA ACTCCGTCGT CGACACGCCC GAACTGCGCG
  251  CCGTCTATAA CGAACTGATG CCTGAAATCA CCGTCTTCTT CACCGAAATC
  301  GGACAAGACA TCGAACTGTA CAACCGCTTC AAAACCATCA AAAATTCCCC
  351  CGAATTTGCA ACGCTTTCCC CCGCACAAAA AACCAAGCTC GATCACGACC
  401  TGCGCGATTT CGTATTGAGC GGCGCGGAAC TGCCGCCCGA ACGGCAGGCA
  451  GAACTGGCAA AACTGCAAAC CGAAGGCGCG CAACTTTCCG CCAAATTCTC
  501  CCAAAACGTC CTAGACGCGA CCGACGCGTT CGGCATTTAC TTTGACGATG
  551  CCGCACCGCT TGCCGGCATT CCCGAAGACG CGCTCGCCAT GTTTGCCGCC
  601  GCCGCGCAAA GCGAAGGCAA AACAGGTTAC AAAATCGGCT TGCAGATTCC
  651  GCACTACCTT GCCGTTATCC AATACGCCGG CAACCGCGAA CTGCGCGAAC
  701  AAATCTACCG CGCCTACGTT ACCCGTGCCA GCGAACTTTC AAACGACGGC
  751  AAATTCGACA ACACCGCCAA CATCGACCGC ACGCTCGAAA ACGCATTGAA
  801  AACCGccaaa cTGCTCGGCT TTAAAAATTA CGCCGAATTG TCGCTGGCAA
  851  CCAAAATGGC GGACACGCCC GAACAGGTTT TAAACTTCCT GCACGACCTC
  901  GCCCGCCGCG CCAAACCCTA CGCCGAAAAA GACCTCGCCG AAGTCAAAGC
  951  CTTCGCCCGC GAACACCTCG GTCTCGCCGA CCCGCAGCCG TGGGACTTGA
 1001  GCTACGCCGG CGAAAAACTG CGCGAAGCCA AATACGCATT CAGCGAAACC
 1051  GAAGTCAAAA AATACTTCCC CGTCGGCAAA GTTCTGGCAG CCTGTTCGC
 1101  CCAAATCAAA AAACTCTACG GCATCGGATT CGCCGAAAAA ACCGTTCCCG
 1151  TCTGGCACAA AGACGTGCGC TATTTTGAAT GCAACAAAA CGGCAAAACC
 1201  ATCGGCGGCG TTTATATGGA TTTGTACGCA CGCGAAGGCA AACGCGGCGG
 1251  CGCGTGGATG AACGACtaca AAGGCCGCCG CCGCTTTGCC GACGgcacGC
 1301  TGCAACTGCC CACCGCCTAC CTCGTCTGCA ACTTCGCCCC GCCCGTCGGC
 1351  GGCAAAGAAG CGCGTTTAAG CCACGACGAA ATCCTCACCC TCTTCCACGA
 1401  AacCGGCCAC GGACTGCACC ACCTGCTTAC CCAAGTGGAC GAACTGGGCG
 1451  TGTCCGGCAT CAAcggcgtA GAATGGGACG CGGTCGAACT GCCCAGCCAG
 1501  TTTATGGAAA ACTTCGTTTG GGAATACAAT GTATTGGCAC AAATGTCCGC
 1551  CCACGAAGAA AccgGCGAGC CCCTGCCGAA AGAACTCTTC GACAAAATGC
 1601  TcgcCGCCAA AAACTTCCAG CGCGGTATGT TCCTCGTCCG GCAAATGGAG
 1651  TTCGCCCTCT TCGATATGAT GATTTACAGT GAAAGCGACG AATGCCGTCT
```

-continued

```
1701  GAAAAACTGG CAGCAGGTTT TAGACAGCGT GCGCAAAGAA GTcGCCGTCA

1751  TCCAACCGCC CGAATACAAC CGCTTCGCCA ACAGCTTCGG CCacatctTC

1801  GCcggcGGCT ATTCCGCAGG CTATTACAGC TACGCATGGG CCGAAGTCCt 1851  cAGCACCGAT GCCTACGCCG CCTTTGAAGA AAGcGACGac gtcGCCGCCA 1901  CAGGCAAACG CTTCTGGCAA GAAAtccttg ccgtcggcgg ctCCCGCAGC 1951  gcgGCGGAAT CCTTCAAAGC CTTCCGCGGA CGCGAACCGA GCATAGACGC 2001  ACTGCTGCGC CAaagcggtT TCGACAACGC gGCttgA
```

This corresponds to the amino acid sequence <SEQ ID 482; ORF 128.ng>:

```
g128.pep
    1  MIDNALLHLG EEPRFNQIQT EDIKPAVQTA IAEARGQIAA VKAQTHTGWA

51  NTVERLTGIT ERVGRIWGVV SHLNSVVDTP ELRAVYNELM PEITVFFTEI

101  GQDIELYNRF KTIKNSPEFA TLSPAQKTKL DHDLRDFVLS GAELPPERQA

151  ELAKLQTEGA QLSAKFSQNV LDATDAFGIY FDDAAPLAGI PEDALAMFAA

201  AAQSEGKTGY KIGLQIPHYL AVIQYAGNRE LREQIYRAYV TRASELSNDG

251  KFDNTANIDR TLENALKTAK LLGFKNYAEL SLATKMADTP EQVLNFLHDL

301  ARRAKPYAEK DLAEVKAFAR EHLGLADPQP WDLSYAGEKL REAKYAFSET

351  EVKKYFPVGK VLAGLFAQIK KLYGIGFAEK TVPVWHKDVR YFELQQNGKT

401  IGGVYMDLYA REGKRGGAWM NDYKGRRRFA DGTLQLPTAY LVCNFAPPVG

451  GKEARLSHDE ILTLFHETGH GLHHLLTQVD ELGVSGINGV EWDAVELPSQ

501  FMENFVWEYN VLAQMSAHEE TGEPLPKELF DKMLAAKNFQ RGMFLVRQME

551  FALFDMMIYS ESDECRLKNW QQVLDSVRKE VAVIQPPEYN RFANSFGHIF

601  AGGYSAGYYS YAWAEVLSTD AYAAFEESDD VAATGKRFWQ EILAVGGSRS

651  AAESFKAFRG REPSIDALLR QSGFDNAA*
```

The following partial DNA sequence was identified in *N. meningitidis* <SEQ ID 483>:

```
m128.seq (partial)
    1  ATGACTGACA ACGCACTGCT CCATTTGGGC GAAGAACCCC GTTTTGATCA

51  AATCAAAACC GAAGACATCA AACCCGCCCT GCAAACCGCC ATCGCCGAAG

101  CGCGCGAACA AATCGCCGCC ATCAAAGCCC AAACGCACAC CGGCTGGGCA

151  AACACTGTCG AACCCCTGAC CGGCATCACC GAACGCGTCG GCAGGATTTG

201  GGGCGTGGTG TCGCACCTCA ACTGCGTCGC CGACACGCCC GAACTGCGCG

251  CCGTCTATAA CGAACTGATG CCCGAAATCA CCGTCTTCTT CACCGAAATC

301  GGACAAGACA TCGAGCTGTA CAACCGCTTC AAAACCATCA AAATTCCCC

351  CGAATTCGAC ACCCTCTCCC CCGCACAAAA AACCAAACTC AACCAC

1  TACGCCAGCG AAAAACTGCG CGAAGCCAAA TACGCGTTCA GCGAAACCGA 51  wGTCAAAAAA TAyTTCCCyG TCGGCAAwGT ATTAAACGGA CTGTTCGCCC

101  AAmTCAAAAA ACTmTACGGC ATCGGATTTA CCGAAAAAAC yGTCCCCGTC

151  TGGCACAAAG ACGTGCGCTA TTkTGAATTG CAACAAAACG GCGAAmCCAT

201  AGGCGGCGTT TATATGGATT TGTACGCACG CGAAGGCAAA CGCGGCGGCG
```

-continued

```
 251  CGTGGATGAA CGACTACAAA GGCCGCCGCC GTTTTTCAGA CGGCACGCTG
 301  CAAyTGCCCA CCGCCTACCT CGTCTGCAAC TTCGCCCCAC CCGTCGGCGG
 351  CAGGGAAGCC CGCyTGAGCC ACGACGAAAT CCTCATCCTC TTCCACGAAA
 401  CCGGACACGG GCTGCACCAC CTGCTTACCC AAGTGGACGA ACTGGGCGTA
 451  TCCGGCATCA ACGGCGTAkA ATGGGACGCG GTCGAACTGC CCAGCCAGTT
 501  TATGGAAAAT TCGTTTGGG AATACAATGT CTTGGCACAA mTGTCAGCCC
 551  ACGAAGAAAC CGGcgTTCCC yTGCCGAAAG AACTCTTsGA CAAAwTGCTC
 601  GCCGCCAAAA ACTTCCAAsG CGGCATGTTC yTsGTCCGGC AAwTGGAGTT
 651  CGCCCTCTTT GATATGATGA TTTACAGCGA AGACGACGAA GGCCGTCTGA
 701  AAAACTGGCA ACAGGTTTTA GACAGCGTGC GCAAAAAAGT CGCCGTCATC
 751  CAGCCGCCCG AATACAACCG CTTCGCCTTG AGCTTCGGCC ACATCTTCGC
 801  AGGCGGCTAT TCCGCAGCTn ATTACAGCTA CGCGTGGGCG GAAGTATTGA
 851  GCGCGGACGC ATACGCCGCC TTTGAAGAAA GCGACGATGT CGCCGCCACA
 901  GGCAAACGCT TTTGGCAGGA ATCCTCGCC GTCGGGGnAT CGCGCAGCGG
 951  nGCAGAATCC TTCAAAGCCT TCCGCGGCCG CGAACCGAGC ATAGACGCAC
1001  TCTTGCGCCA CAGCGGTTTC GACAACGCGG TCTGA
```

This corresponds to the amino acid sequence <SEQ ID 484; ORF 128>:

```
m128.pep (partial)
     1  MTDNALLHLG EEPRFDQIKT EDIKPALQTA IAEAREQIAA IKAQTHTGWA
    51  NTVEPLTGIT ERVGRIWGVV SHLNCVADTP ELRAVYNELM PEITVFFTEI
   101  GQDIELYNRF KTIKNSPEFD TLSPAQKTKL NH
//
     1  YASEKLREAK YAFSETXVKK YFPVGXVLNG LFAQXKKLYG IGFTEKTVPV
    51  WHKDVRYXEL QQNGEXIGGV YMDLYAREGK RGGAWMNDYK GRRRFSDGTL
   101  QLPTAYLVCN FAPPVGGREA RLSHDEILIL FHETGHGLHH LLTQVDELGV
   151  SGINGVXWDA VELPSQFMEN FVWEYNVLAQ XSAHEETGVP LPKELXDKXL
   201  AAKNFQXGMF XVRQXEFALF DMMIYSEDDE GRLKNWQQVL DSVRKKVAVI
   251  QPPEYNRFAL SFGHIFAGGY SAAXYSYAWA EVLSADAYAA FEESDDVAAT
   301  GKRFWQEILA VGXSRSGAES FKAFRGREPS IDALLRHSGF DNAV*
```
50

Computer analysis of this amino acid sequence gave the following results:
Homology with a Predicted ORF from *N. gonorrhoeae*
ORF 128 shows 91.7% identity over a 475 aa overlap with a predicted ORF (ORF 128.ng) from *N. gonorrhoeae*:

```
m128/g128
                  10         20         30         40         50         60
 g128.pep MIDNALLHLGEEPRFNQIQTEDIKPAVQTAIAEARGQIAAVKAQTHTGWANTVERLTGIT
          | |||||||||||||:||:||||||||:|||||||| ||||:|||||||||||| ||||
 m128     MTDNALLHLGEEPRFDQIKTEDIKPALQTAIAEAREQIAAIKAQTHTGWANTVEPLTGIT
                  10         20         30         40         50         60

70         80         90        100        110        120
 g128.pep ERVGRIWGVVSHLNSVVDTPELRAVYNELMPEITVFFTEIGQDIELYNRFKTIKNSPEFA
          |||||||||||||| |:||||||||||||||||||||||||||||||||||||||||||
 m128     ERVGRIWGVVSHLNCVADTPELRAVYNELMPEITVFFTEIGQDIELYNRFKTIKNSPEFD
                  70         80         90        100        110        120
```

-continued

```
                 130       140       150       160       170       180
g128.pep   TLSPAQKTKLDHDLRDFVLSGAELPPERQAELAKLQTEGAQLSAKFSQNVLDATDAFGIY
           ||||||||||:|
m128       TLSPAQKTKLNH
                 130
             //
                                               340       350       360
g128.pep                                 YAGEKLREAKYAFSETEVKKYFPVGKVLAG
                                         ||:||||||||||||| |||||||||| |
m128                                     YASEKLREAKYAFSETXVKKYFPVGXVLNG
                                                 10        20        30

370       380       390       400       410       420
g128.pep   LFAQIKKLYGIGFAEKTVPVWHKDVRYFELQQNGKTIGGVYMDLYAREGKRGGAWMNDYK
           |||| ||||||||:|||||||||||||| ||||||::||||||||||||||||||||||||
m128       LFAQXKKLYGIGFTEKTVPVWHKDVRYXELQQNGEXIGGVYMDLYAREGKRGGAWMNDYK
                 40        50        60        70        80        90

430       440       450       460       470       480
g128.pep   GRRRFADGTLQLPTAYLVCNFAPPVGGKEARLSHDEILTLFHETGHGLHHLLTQVDELGV
           |||||:||||||||||||||||||||:|||||||||| ||||||||||||||||||||||
m128       GRRRFSDGTLQLPTAYLVCNFAPPVGGREARLSHDEILILFHETGHGLHHLLTQVDELGV
                 100       110       120       130       140       150

490       500       510       520       530       540
g128.pep   SGINGVEWDAVELPSQFMENFVWEYNVLAQMSAHEETGEPLPKELFDKMLAAKNFQRGMF
           |||||| ||||||||||||||||||||||| ||||||| |||||| || ||||||| |||
m128       SGINGVXWDAVELPSQFMENFVWEYNVLAQXSAHEETGVPLPKELXDKXLAAKNFQXGMF
                 160       170       180       190       200       210

550       560       570       580       590       600
g128.pep   LVRQMEFALFDMMIYSESDECRLKNWQQVLDSVRKEVAVIQPPEYNRFANSFGHIFAGGY
            ||| ||||||||||||:|| ||||||||||||||:||||||||||||| ||||||||||
m128       XVRQXEFALFDMMIYSEDDEGRLKNWQQVLDSVRKKVAVIQPPEYNRFALSFGHIFAGGY
                 220       230       240       250       260       270

610       620       630       640       650       660
g128.pep  SAGYYSYAWAEVLSTDAYAAFEESDDVAATGKRFWQEILAVGGSRSAAESFKAFRGREPS
          ||: ||||||||||:|||||||||||||||||||||||||| |||:|||||||||||||
m128      SAAXYSYAWAEVLSADAYAAFEESDDVAATGKRFWQEILAVGXSRSGAESFKAFRGREPS
                280       290       300       310       320       330

670       679
g128.pep   IDALLRQSGFDNAAX
           ||||||:||||||:
m128       IDALLRHSGFDNAVX
                 340
```

The following partial DNA sequence was identified in *N. meningitidis* <SEQ ID 485>:

```
a128.seq
     1  ATGACTGACA ACGCACTGCT CCATTTGGGC GAAGAACCCC GTTTTGATCA

51  AATCAAAACC GAAGACATCA AACCCGCCCT GCAAACCGCC ATTGCCGAAG

101  CGCGCGAACA AATCGCCGCC ATCAAAGCCC AAACGCACAC CGGCTGGGCA

151  AACACTGTCG AACCCCTGAC CGGCATCACC GAACGCGTCG GCAGGATTTG

201  GGGCGTGGTG TCGCACCTCA ACTCCGTCAC CGACACGCCC GAACTGCGCG

251  CCGCCTACAA TGAATTAATG CCCGAAATTA CCGTCTTCTT CACCGAAATC

301  GGACAAGACA TCGAGCTGTA CAACCGCTTC AAAACCATCA AAAACTCCCC

351  CGAGTTCGAC ACCCTCTCCC ACGCGCAAAA AACCAAACTC AACCACGATC

401  TGCGCGATTT CGTCCTCAGC GGCGCGGAAC TGCCGCCCGA ACAGCAGGCA

451  GAATTGGCAA AACTGCAAAC CGAAGGCGCG CAACTTTCCG CCAAATTCTC

501  CCAAAACGTC CTAGACGCGA CCGACGCGTT CGGCATTTAC TTTGACGATG

551  CCGCACCGCT TGCCGGCATT CCCGAAGACG CGCTCGCCAT GTTTGCCGCT

601  GCCGCGCAAA GCGAAGGCAA AACAGGCTAC AAAATCGGTT TGCAGATTCC

651  GCACTACCTC GCCGTCATCC AATACGCCGA CAACCGCAAA CTGCGCGAAC

701  AAATCTACCG CGCCTACGTT ACCCGCGCCA GCGAGCTTTC AGACGACGGC

751  AAATTCGACA ACACCGCCAA CATCGACCGC ACGCTCGAAA ACGCCCTGCA
```

```
 801   AACCGCCAAA CTGCTCGGCT TCAAAAACTA CGCCGAATTG TCGCTGGCAA

851   CCAAAATGGC GGACACCCCC GAACAAGTTT TAAACTTCCT GCACGACCTC

901   GCCCGCCGCG CCAAACCCTA CGCCGAAAAA GACCTCGCCG AAGTCAAAGC

951   CTTCGCCCGC GAAAGCCTCG GCCTCGCCGA TTTGCAACCG TGGGACTTGG

1001   GCTACGCCGG CGAAAAACTG CGCGAAGCCA ATACGCATT  CAGCGAAACC

1051   GAAGTCAAAA AATACTTCCC CGTCGGCAAA GTATTAAACG GACTGTTCGC

1101   CCAAATCAAA AAACTCTACG GCATCGGATT TACCGAAAAA ACCGTCCCCG

1151   TCTGGCACAA AGACGTGCGC TATTTTGAAT TGCAACAAAA CGGCGAAACC

1201   ATAGGCGGCG TTTATATGGA TTTGTACGCA CGCGAAGGCA AACGCGGCGG

1251   CGCGTGGATG AACGACTACA AAGGCCGCCG CCGTTTTTCA GACGGCACGC

1301   TGCAACTGCC CACCGCCTAC CTCGTCTGCA ACTTCACCCC GCCCGTCGGC

1351   GGCAAAGAAG CCCGCTTGAG CCATGACGAA ATCCTCACCC TCTTCCACGA

1401   AACCGGACAC GGCCTGCACC ACCTGCTTAC CCAAGTCGAC GAACTGGGCG

1451   TATCCGGCAT CAACGGCGTA GAATGGGACG CAGTCGAACT GCCCAGTCAG

1501   TTTATGGAAA ATTTCGTTTG GGAATACAAT GTCTTGGCGC AAATGTCCGC

1551   CCACGAAGAA ACCGGCGTTC CCCTGCCGAA AGAACTCTTC GACAAAATGC

1601   TCGCCGCCAA AAACTTCCAA CGCGGAATGT TCCTCGTCCG CCAAATGGAG

1651   TTCGCCCTCT TTGATATGAT GATTTACAGC GAAGACGACG AAGGCCGTCT

1701   GAAAAACTGG CAACAGGTTT TAGACAGCGT GCGCAAAGAA GTCGCCGTCG

1751   TCCGACCGCC CGAATACAAC CGCTTCGCCA ACAGCTTCGG CCACATCTTC

1801   GCAGGCGGCT ATTCCGCAGG CTATTACAGC TACGCGTGGG CGGAAGTATT

1851   GAGCGCGGAC GCATACGCCG CCTTTGAAGA AAGCGACGAT GTCGCCGCCA

1901   CAGGCAAACG CTTTTGGCAG GAAATCCTCG CCGTCGGCGG ATCGCGCAGC

1951   GCGGCAGAAT CCTTCAAAGC CTTCCGCGGA CGCGAACCGA GCATAGACGC

2001   ACTCTTGCGC CACAGCGGCT TCGACAACGC GGCTTGA
```

This corresponds to the amino acid sequence <SEQ ID 486; ORF 128.a>:

```
a128.pep
    1   MTDNALLHLG EEPRFDQIKT EDIKPALQTA IAEAREQIAA IKAQTHTGWA

51   NTVEPLTGIT ERVGRIWGVV SHLNSVTDTP ELRAAYNELM PEITVFFTEI

101   GQDIELYNRF KTIKNSPEFD TLSHAQKTKL NHDLRDFVLS GAELPPEQQA

151   ELAKLQTEGA QLSAKFSQNV LDATDAFGIY FDDAAPLAGI PEDALAMFAA

201   AAQSEGKTGY KIGLQIPHYL AVIQYADNRK LREQIYRAYV TRASELSDDG

251   KFDNTANIDR TLENALQTAK LLGFKNYAEL SLATKMADTP EQVLNFLHDL

301   ARRAKPYAEK DLAEVKAFAR ESLGLADLQP WDLGYAGEKL REAKYAFSET

351   EVKKYFPVGK VLNGLFAQIK KLYGIGFTEK TVPVWHKDVR YFELQQNGET

401   IGGVYMDLYA REGKRGGAWM NDYKGRRRFS DGTLQLPTAY LVCNFTPPVG

451   GKEARLSHDE ILTLFHETGH GLHHLLTQVD ELGVSGINGV EWDAVELPSQ

501   FMENFVWEYN VLAQMSAHEE TGVPLPKELF DKMLAAKNFQ RGMFLVRQME

551   FALFDMMIYS EDDEGRLKNW QQVLDSVRKE VAVVRPPEYN RFANSFGHIF
```

-continued

```
601    AGGYSAGYYS YAWAEVLSAD AYAAFEESDD VAATGKRFWQ EILAVGGSRS

651    AAESFKAFRG REPSIDALLR HSGFDNAA*
``` m128/a128 66.0% identity in 677 aa overlap

```
                10         20         30         40         50         60
m128.pep   MTDNALLHLGEEPRFDQIKTEDIKPALQTAIAEAREQIAAIKAQTHTGWANTVEPLTGIT
           ||||||||||||||||||||||||||||||||||||||||||||||||||||||||||||
a128       MTDNALLHLGEEPRFDQIKTEDIKPALQTAIAEAREQIAAIKAQTHTGWANTVEPLTGIT
                10         20         30         40         50         60

70         80         90        100        110        120
m128.pep   ERVGRIGVVSHLNCVADTPELRAVYNELMPEITVFFTEIGQDIELYNRFKTIKNSPEFD
           ||||||||||| |:|||||||:||||||||||||||||||||||||||||||||||||
a128       ERVGRIGVVSHLNSVTDTPELRAAYNELMPEITVFFTEIGQDIELYNRFKTIKNSPEFD
                70         80         90        100        110        120

130
m128.pep   TLSPAQKTKLNH------------------------------------------------
           ||| ||||||||
a128       TLSHAQKTKLNHDLRDFVLSGAELPPEQQAELAKLQTEGAQLSAKFSQNVLDATDAFGIY
               130        140        150        160        170        180 m128.pep   ------------------------------------------------------------
a128       FDDAAPLAGIPEDALAMFAAAAQSEGKTGYKIGLQIPHYLAVIQYADNRKLREQIYRAYV
               190        200        210        220        230        240 m128.pep   ------------------------------------------------------------
a128       TRASELSDDGKFDNTANIDRTLENALQTAKLLGFKNYAELSLATKMADTPEQVLNFLHDL
               250        260        270        280        290        300

140        150
m128.pep   --------------------------------YASEKLREAKYAFSETXVKKYFPVGX
                                           ||:|||||||||||| ||||||||
a128       ARRAKPYAEKDLAEVKAFARESLGLADLQPWDLGYAGEKLREAKYAFSETEVKKYFPVGK
               310        320        330        340        350        360

160        170        180        190        200        210
m128.pep   VLNGLFAQXKKLYGIGFTEKTVPVWHKDVRYXELQQNGEXIGGVYMDLYAREGKRGGAWM
           ||||||| ||||||||||||||||||||||||| |||||| ||||||||||||||||||
a128       VLNGLFAQIKKLYGIGFTEKTVPVWHKDVRYFELQQNGETIGGVYMDLYAREGKRGGAWM
               370        380        390        400        410        420

220        230        240        250        260        270
m128.pep   NDYKGRRRFSDGTLQLPTAYLVCNFAPPVGGREARLSHDEILILFHETGHGLHHLLTQVD
           |||||||||||||||||||||||||:|||||:||||||||||| ||||||||||||||||
a128       NDYKGRRRFSDGTLQLPTAYLVCNFTPPVGGKEARLSHDEILTLFHETGHGLHHLLTQVD
               430        440        450        460        470        480

280        290        300        310        320        330
m128.pep   ELGVSGINGVXWDAVELPSQFMENFVWEYNVLAQXSAHEETGVPLPKELXDKXLAAKNFQ
           ||||||||||| ||||||||||||||||||||| ||||||||||||||| || ||||||
a128       ELGVSGINGVEWDAVELPSQFMENFVWEYNVLAQMSAHEETGVPLPKELFDKMLAAKNFQ
               490        500        510        520        530        540

340        350        360        370        380        390
m128.pep   XGMFXVRQXEFALFDMMIYSEDDEGRLKNWQQVLDSVRKKVAVIQPPEYNRFALSFGHIF
            ||| ||| ||||||||||||||||||||||||||||||:|||::|||||||| ||||||
a128       RGMFLVRQMEFALFDMMIYSEDDEGRLKNWQQVLDSVRKEVAVVRPPEYNRFANSFGHIF
               550        560        570        580        590        600

400        410        420        430        440        450
m128.pep   AGGYSAAXYSYAWAEVLSADAYAAFEESDDVAATGKRFWQEILAVGXSRSGAESFKAFRG
           ||||||: ||||||||||||||||||||||||||||||||||||||   ||:||||||||
a128       AGGYSAGYYSYAWAEVLSADAYAAFEESDDVAATGKRFWQEILAVGGSRSAAESFKAFRG
               610        620        630        640        650        660

460        470
m128.pep   REPSIDALLRHSGFDNAVX
           ||||||||||||||||||:
a128       REPSIDALLRHSGFDNAAX
               670
```

The following partial DNA sequence was identified in *N. gonorrhoeae* <SEQ ID 487>:

```
g128-1.seq (partial)
     1    ATGATTGACA ACGCACTGCT CCACTTGGGC GAAGAACCCC GTTTTAATCA

51    AATCAAAACC GAAGACATCA AACCCGCCGT CCAAACCGCC ATCGCCGAAG
```

```
-continued
 101    CGCGCGGACA AATCGCCGCC GTCAAAGCGC AAACGCACAC CGGCTGGGCG

151    AACACCGTCG AGCGTCTGAC CGGCATCACC GAACGCGTCG GCAGGATTTG

201    GGGCGTCGTG TCCCATCTCA ACTCCGTCGT CGACACGCCC GAACTGCGCG

251    CCGTCTATAA CGAACTGATG CCTGAAATCA CCGTCTTCTT CACCGAAATC

301    GGACAAGACA TCGAACTGTA CAACCGCTTC AAAACCATCA AAAATTCCCC

351    CGAATTTGCA ACGCTTTCCC CCGCACAAAA AACCAAGCTC GATCACGACC

401    TGCGCGATTT CGTATTGAGC GGCGCGGAAC TGCCGCCCGA ACGGCAGGCA

451    GAACTGGCAA AACTGCAAAC CGAAGGCGCG CAACTTTCCG CCAAATTCTC

501    CCAAAACGTC CTAGACGCGA CCGACGCGTT CGGCATTTAC TTTGACGATG

551    CCGCACCGCT TGCCGGCATT CCCGAAGACG CGCTCGCCAT GTTTGCCGCC

601    GCCGCGCAAA GCGAAGGCAA ACAGGTTAC AAAATCGGCT TGCAGATTCC

651    GCACTACCTT GCCGTTATCC AATACGCCGG CAACCGCGAA CTGCGCGAAC

701    AAATCTACCG CGCCTACGTT ACCCGTGCCA GCGAACTTTC AAACGACGGC

751    AAATTCGACA ACACCGCCAA CATCGACCGC ACGCTCGAAA ACGCATTGAA

801    AACCGCCAAA CTGCTCGGCT TTAAAAATTA CGCCGAATTG TCGCTGGCAA

851    CCAAAATGGC GGACACGCCC GAACAGGTTT TAAACTTCCT GCACGACCTC

901    GCCCGCCGCG CCAAACCCTA CGCCGAAAAA GACCTCGCCG AAGTCAAAGC

951    CTTCGCCCGC GAACACCTCG GTCTCGCCGA CCCGCAGCCG TGGGACTTGA

1001    GCTACGCCGG CGAAAAACTG CGCGAAGCCA AATACGCATT CAGCGAAACC

1051    GAAGTCAAAA AATACTTCCC CGTCGGCAAA GTTCTGGCAG CCTGTTCGC

1101    CCAAATCAAA AAACTCTACG GCATCGGATT CGCCGAAAAA ACCGTTCCCG

1151    TCTGGCACAA AGACGTGCGC TATTTTGAAT TGCAACAAAA CGGCAAAACC

1201    ATCGGCGGCG TTTATATGGA TTTGTACGCA CGCGAAGGCA ACGCGGCGG

1251    CGCGTGGATG AACGACTACA AAGGCCGCCG CCGCTTTGCC GACGGCACGC

1301    TGCAACTGCC CACCGCCTAC CTCGTCTGCA ACTTCGCCCC GCCCGTCGGC

1351    GGCAAAGAAG CGCGTTTAAG CCACGACGAA ATCCTCACCC TCTTCCACGA

1401    AACCGGCCAC GGACTGCACC ACCTGCTTAC CCAAGTGGAC GAACTGGGCG

1451    TGTCCGGCAT CAACGGCGTA AAA
```

This corresponds to the amino acid sequence <SEQ ID 488;
ORF 128-1.ng>:

```
g128-1.pep (partial)
   1    MIDNALLHLG EEPRFNQIKT EDIKPAVQTA IAEARGQIAA VKAQTHTGWA

51    NTVERLTGIT ERVGRIWGVV SHLNSVVDTP ELRAVYNELM PEITVFFTEI

101    GQDIELYNRF KTIKNSPEFA TLSPAQKTKL DHDLRDFVLS GAELPPERQA

151    ELAKLQTEGA QLSAKFSQNV LDATDAFGIY FDDAAPLAGI PEDALAMFAA

201    AAQSEGKTGY KIGLQIPHYL AVIQYAGNRE LREQIYRAYV TRASELSNDG

251    KFDNTANIDR TLENALKTAK LLGFKNYAEL SLATKMADTP EQVLNFLHDL

301    ARRAKPYAEK DLAEVKAFAR EHLGLADPQP WDLSYAGEKL REAKYAFSET

351    EVKKYFPVGK VLAGLFAQIK KLYGIGFAEK TVPVWHKDVR YFELQQNGKT
```

-continued

```
401     IGGVYMDLYA REGKRGGAWM NDYKGRRRFA DGTLQLPTAY LVCNFAPPVG

451     GKEARLSHDE ILTLFHETGH GLHHLLTQVD ELGVSGINGV K
```

The following partial DNA sequence was identified in *N. meningitidis* <SEQ ID 489>:

```
m128-1.seq
   1    ATGACTGACA ACGCACTGCT CCATTTGGGC GAAGAACCCC GTTTTGATCA

51    AATCAAAACC GAAGACATCA AACCCGCCCT GCAAACCGCC ATCGCCGAAG

101    CGCGCGAACA AATCGCCGCC ATCAAAGCCC AAACGCACAC CGGCTGGGCA

151    AACACTGTCG AACCCCTGAC CGGCATCACC GAACGCGTCG GCAGGATTTG

201    GGGCGTGGTG TCGCACCTCA ACTCCGTCGC CGACACGCCC GAACTGCGCG

251    CCGTCTATAA CGAACTGATG CCCGAAATCA CCGTCTTCTT CACCGAAATC

301    GGACAAGACA TCGAGCTGTA CAACCGCTTC AAAACCATCA AAAATTCCCC

351    CGAATTCGAC ACCCTCTCCC CCGCACAAAA AACCAAACTC AACCACGATC

401    TGCGCGATTT CGTCCTCAGC GGCGCGGAAC TGCCGCCCGA ACAGCAGGCA

451    GAACTGGCAA AACTGCAAAC CGAAGGCGCG CAACTTTCCG CCAAATTCTC

501    CCAAAACGTC CTAGACGCGA CCGACGCGTT CGGCATTTAC TTTGACGATG

551    CCGCACCGCT TGCCGGCATT CCCGAAGACG CGCTCGCCAT GTTTGCCGCC

601    GCCGCGCAAA GCGAAAGCAA AACAGGCTAC AAAATCGGCT TGCAGATTCC

651    ACACTACCTC GCCGTCATCC AATACGCCGA CAACCGCGAA CTGCGCGAAC

701    AAATCTACCG CGCCTACGTT ACCCGCGCCA GCGAACTTTC AGACGACGGC

751    AAATTCGACA ACACCGCCAA CATCGACCGC ACGCTCGCAA ACGCCCTGCA

801    AACCGCCAAA CTGCTCGGCT TCAAAAACTA CGCCGAATTG TCGCTGGCAA

851    CCAAAATGGC GGACACGCCC GAACAAGTTT TAAACTTCCT GCACGACCTC

901    GCCCGCCGCG CCAAACCCTA CGCCGAAAAA GACCTCGCCG AAGTCAAAGC

951    CTTCGCCCGC GAAAGCCTGA ACCTCGCCGA TTTGCAACCG TGGGACTTGG

1001    GCTACGCCAG CGAAAAACTG CGCGAAGCCA AATACGCGTT CAGCGAAACC

1051    GAAGTCAAAA AATACTTCCC CGTCGGCAAA GTATTAAACG GACTGTTCGC

1101    CCAAATCAAA AAACTCTACG GCATCGGATT TACCGAAAAA ACCGTCCCCG

1151    TCTGGCACAA AGACGTGCGC TATTTTGAAT TGCAACAAAA CGGCGAAACC

1201    ATAGGCGGCG TTTATATGGA TTTGTACGCA CGCGAAGGCA AACGCGGCGG

1251    CGCGTGGATG AACGACTACA AAGGCCGCCG CCGTTTTTCA GACGGCACGC

1301    TGCAACTGCC CACCGCCTAC CTCGTCTGCA ACTTCGCCCC ACCCGTCGGC

1351    GGCAGGGAAG CCCGCCTGAG CCACGACGAA ATCCTCATCC TCTTCCACGA

1401    AACCGGACAC GGGCTGCACC ACCTGCTTAC CCAAGTGGAC GAACTGGGCG

1451    TATCCGGCAT CAACGGCGTA GAATGGGACG CGGTCGAACT GCCCAGCCAG

1501    TTTATGGAAA ATTTCGTTTG GGAATACAAT GTCTTGGCAC AAATGTCAGC

1551    CCACGAAGAA ACCGGCGTTC CCCTGCCGAA AGAACTCTTC GACAAAATGC

1601    TCGCCGCCAA AAACTTCCAA CGCGGCATGT TCCTCGTCCG GCAAATGGAG

1651    TTCGCCCTCT TTGATATGAT GATTTACAGC GAAGACGACG AAGGCCGTCT

1701    GAAAAACTGG CAACAGGTTT TAGACAGCGT GCGCAAAAAA GTCGCCGTCA
```

```
1751    TCCAGCCGCC CGAATACAAC CGCTTCGCCT TGAGCTTCGG CCACATCTTC

1801    GCAGGCGGCT ATTCCGCAGG CTATTACAGC TACGCGTGGG CGGAAGTATT

1851    GAGCGCGGAC GCATACGCCG CCTTTGAAGA AAGCGACGAT GTCGCCGCCA

1901    CAGGCAAACG CTTTTGGCAG GAAATCCTCG CCGTCGGCGG ATCGCGCAGC

1951    GCGGCAGAAT CCTTCAAAGC CTTCCGCGGC CGCGAACCGA GCATAGACGC

2001    ACTCTTGCGC CACAGCGGTT TCGACAACGC GGTCTGA
```

This corresponds to the amino acid sequence <SEQ ID 490; ORF 128-1>:

```
m128-1.pep.
  1     MTDNALLHLG EEPRFDQIKT EDIKPALQTA IAEAREQIAA IKAQTHTGWA

51     NTVEPLTGIT ERVGRIWGVV SHLNSVADTP ELRAVYNELM PEITVFFTEI

101     GQDIELYNRF KTIKNSPEFD TLSPAQKTKL NHDLRDFVLS GAELPPEQQA

151     ELAKLQTEGA QLSAKFSQNV LDATDAFGIY FDDAAPLAGI PEDALAMFAA

201     AAQSESKTGY KIGLQIPHYL AVIQYADNRE LREQIYRAYV TRASELSDDG

251     KFDNTANIDR TLANALQTAK LLGFKNYAEL SLATKMADTP EQVLNFLHDL

301     ARRAKPYAEK DLAEVKAFAR ESLNLADLQP WDLGYASEKL REAKYAFSET

351     EVKKYFPVGK VLNGLFAQIK KLYGIGFTEK TVPVWHKDVR YFELQQNGET

401     IGGVYMDLYA REGKRGGAWM NDYKGRRRFS DGTLQLPTAY LVCNFAPPVG

451     GREARLSHDE ILILFHETGH GLHHLLTQVD ELGVSGINGV EWDAVELPSQ

501     FMENFVWEYN VLAQMSAHEE TGVPLPKELF DKMLAAKNFQ RGMFLVRQME

551     FALFDMMIYS EDDEGRLKNW QQVLDSVRKK VAVIQPPEYN RFALSFGHIF

601     AGGYSAGYYS YAWAEVLSAD AYAAFEESDD VAATGKRFWQ EILAVGGSRS

651     AAESFKAFRG REPSIDALLR HSGFDNAV*
``` m128-1/g128-1 94.5% identity in 491 aa overlap

```
                  10         20         30         40         50         60
g128-1.pep  MIDNALLHLGEEPRFNQIKTEDIKPAVQTAIAEARGQIAAVKAQTHTGWANTVERLTGIT
            ||:||||||||||||:|||||||||:||||||||:||||:|||||||||||||:|||||
m128-1      MTDNALLHLGEEPRFDQIKTEDIKPALQTAIAEAREQIAAIKAQTHTGWANTVEPLTGIT
                  10         20         30         40         50         60

70         80         90        100        110        120
g128-1.pep  ERVGRIWGVVSHLNSVVDTPELRAVYNELMPEITVFFTEIGQDIELYNRFKTIKNSPEFA
            ||||||||||||||||:|||||||||||||||||||||||||||||||||||||||||:
m128-1      ERVGRIWGVVSHLNSVADTPELRAVYNELMPEITVFFTEIGQDIELYNRFKTIKNSPEFD
                  70         80         90        100        110        120

130        140        150        160        170        180
g128-1.pep  TLSPAQKTKLDHDLRDFVLSGAELPPERQAELAKLQTEGAQLSAKFSQNVLDATDAFGIY
            |||||||||:||||||||||||||||:|||||||||||||||||||||||||||||||
m128-1      TLSPAQKTKLNHDLRDFVLSGAELPPEQQAELAKLQTEGAQLSAKFSQNVLDATDAFGIY
                 130        140        150        160        170        180

190        200        210        220        230        240
g128-1.pep  FDDAAPLAGIPEDALAMFAAAAQSEGKTGYKIGLQIPHYLAVIQYAGNRELREQIYRAYV
            |||||||||||||||||||||||||:||||||||||||||||||||:||||||||||||
m128-1      FDDAAPLAGIPEDALAMFAAAAQSESKTGYKIGLQIPHYLAVIQYADNRELREQIYRAYV
                 190        200        210        220        230        240

250        260        270        280        290        300
g128-1.pep  TRASELSNDGKFDNTANIDRTLENALKTAKLLGFKNYAELSLATKMADTPEQVLNFLHDL
            ||||||:||||||||||||||||:||:|||||||||||||||||||||||||||||||
m128-1      TRASELSDDGKFDNTANIDRTLANALQTAKLLGFKNYAELSLATKMADTPEQVLNFLHDL
                 250        260        270        280        290        300
```

-continued

```
                     310       320       330       340       350       360
g128-1.pep   ARRAKPYAEKDLAEVKAFAREHLGLADPQPWDLSYAGEKLREAKYAFSETEVKKYFPVGK
             ||||||||||||||||||||| |:||| |||||:||:|||||||||||||||||||||||
m128-1       ARRAKPYAEKDLAEVKAFARESLNLADLQPWDLGYASEKLREAKYAFSETEVKKYFPVGK
                     310       320       330       340       350       360

370       380       390       400       410       420
g128-1.pep   VLAGLFAQIKKLYGIGFAEKTVPVWHKDVRYFELQQNGKTIGGVYMDLYAREGKRGGAWM
             || ||||||||||||||:||||||||||||||||||||:|||||||||||||||||||||
m128-1       VLNGLFAQIKKLYGIGFTEKTVPVWHKDVRYFELQQNGETIGGVYMDLYAREGKRGGAWM
                     370       380       390       400       410       420

430       440       450       460       470       480
g128-1.pep   NDYKGRRRFADGTLQLPTAYLVCNFAPPVGGKEARLSHDEILTLFHETGHGLHHLLTQVD
             |||||||||:|||||||||||||||||||||:|||||||||| |||||||||||||||||
m128-1       NDYKGRRRFSDGTLQLPTAYLVCNFAPPVGGREARLSHDEILILFHETGHGLHHLLTQVD
                     430       440       450       460       470       480

490
g128-1.pep   ELGVSGINGVK
             ||||||||||:
m128-1       ELGVSGINGVEWDAVELPSQFMENFVWEYNVLAQMSAHEETGVPLPKELFDKMLAAKNFQ
                     490       500       510       520       530       540
```

The following partial DNA sequence was identified in *N. meningitidis* <SEQ ID 491>:

```
a128-1.seq
   1   ATGACTGACA ACGCACTGCT CCATTTGGGC GAAGAACCCC GTTTTGATCA

51   AATCAAAACC GAAGACATCA AACCCGCCCT GCAAACCGCC ATTGCCGAAG

101   CGCGCGAACA AATCGCCGCC ATCAAAGCCC AAACGCACAC CGGCTGGGCA

151   AACACTGTCG AACCCCTGAC CGGCATCACC GAACGCGTCG GCAGGATTTG

201   GGGCGTGGTG TCGCACCTCA ACTCCGTCAC CGACACGCCC GAACTGCGCG

251   CCGCCTACAA TGAATTAATG CCCGAAATTA CCGTCTTCTT CACCGAAATC

301   GGACAAGACA TCGAGCTGTA CAACCGCTTC AAAACCATCA AAAACTCCCC

351   CGAGTTCGAC ACCCTCTCCC ACGCGCAAAA AACCAAACTC AACCACGATC

401   TGCGCGATTT CGTCCTCAGC GGCGCGGAAC TGCCGCCCGA ACAGCAGGCA

451   GAATTGGCAA AACTGCAAAC CGAAGGCGCG CAACTTTCCG CCAAATTCTC

501   CCAAAACGTC CTAGACGCGA CCGACGCGTT CGGCATTTAC TTTGACGATG

551   CCGCACCGCT TGCCGGCATT CCCGAAGACG CGCTCGCCAT GTTTGCCGCT

601   GCCGCGCAAA GCGAAGGCAA AACAGGCTAC AAAATCGGTT TGCAGATTCC

651   GCACTACCTC GCCGTCATCC AATACGCCGA CAACCGCAAA CTGCGCGAAC

701   AAATCTACCG CGCCTACGTT ACCCGCGCCA GCGAGCTTTC AGACGACGGC

751   AAATTCGACA ACACCGCCAA CATCGACCGC ACGCTCGAAA ACGCCCTGCA

801   AACCGCCAAA CTGCTCGGCT TCAAAAACTA CGCCGAATTG TCGCTGGCAA

851   CCAAAATGGC GGACACCCCC GAACAAGTTT TAAACTTCCT GCACGACCTC

901   GCCCGCCGCG CCAAACCCTA CGCCGAAAAA GACCTCGCCG AAGTCAAAGC

951   CTTCGCCCGC GAAAGCCTCG GCCTCGCCGA TTTGCAACCG TGGGACTTGG

1001   GCTACGCCGG CGAAAAACTG CGCGAAGCCA AATACGCATT CAGCGAAACC

1051   GAAGTCAAAA AATACTTCCC CGTCGGCAAA GTATTAAACG GACTGTTCGC

1101   CCAAATCAAA AAACTCTACG GCATCGGATT TACCGAAAAA ACCGTCCCCG

1151   TCTGGCACAA AGACGTGCGC TATTTTGAAT TGCAACAAAA CGGCGAAACC

1201   ATAGGCGGCG TTTATATGGA TTTGTACGCA CGCGAAGGCA AACGCGGCGG

1251   CGCGTGGATG AACGACTACA AAGGCCGCCG CCGTTTTTCA GACGGCACGC
```

```
                       -continued
1301    TGCAACTGCC CACCGCCTAC CTCGTCTGCA ACTTCACCCC GCCCGTCGGC

1351    GGCAAAGAAG CCCGCTTGAG CCATGACGAA ATCCTCACCC TCTTCCACGA

1401    AACCGGACAC GGCCTGCACC ACCTGCTTAC CCAAGTCGAC GAACTGGGCG

1451    TATCCGGCAT CAACGGCGTA GAATGGGACG CAGTCGAACT GCCCAGTCAG

1501    TTTATGGAAA ATTTCGTTTG GGAATACAAT GTCTTGGCGC AAATGTCCGC

1551    CCACGAAGAA ACCGGCGTTC CCCTGCCGAA AGAACTCTTC GACAAAATGC

1601    TCGCCGCCAA AAACTTCCAA CGCGGAATGT TCCTCGTCCG CCAAATGGAG

1651    TTCGCCCTCT TTGATATGAT GATTTACAGC GAAGACGACG AAGGCCGTCT

1701    GAAAAACTGG CAACAGGTTT TAGACAGCGT GCGCAAAGAA GTCGCCGTCG

1751    TCCGACCGCC CGAATACAAC CGCTTCGCCA ACAGCTTCGG CCACATCTTC

1801    GCAGGCGGCT ATTCCGCAGG CTATTACAGC TACGCGTGGG CGGAAGTATT

1851    GAGCGCGGAC GCATACGCCG CCTTTGAAGA AAGCGACGAT GTCGCCGCCA

1901    CAGGCAAACG CTTTTGGCAG GAAATCCTCG CCGTCGGCGG ATCGCGCAGC

1951    GCGGCAGAAT CCTTCAAAGC CTTCCGCGGA CGCGAACCGA GCATAGACGC

2001    ACTCTTGCGC CACAGCGGCT TCGACAACGC GGCTTGA
```

This corresponds to the amino acid sequence <SEQ ID 492;
ORF 128-1.a>:

```
a128-1.pep
     1   MTDNALLHLG EEPRFDQIKT EDIKPALQTA IAEAREQIAA IKAQTHTGWA

51   NTVEPLTGIT ERVGRIWGVV SHLNSVTDTP ELRAAYNELM PEITVFFTEI

101   GQDIELYNRF KTIKNSPEFD TLSHAQKTKL NHDLRDFVLS GAELPPEQQA

151   ELAKLQTEGA QLSAKFSQNV LDATDAFGIY FDDAAPLAGI PEDALAMFAA

201   AAQSEGKTGY KIGLQIPHYL AVIQYADNRK LREQIYRAYV TRASELSDDG

251   KFDNTANIDR TLENALQTAK LLGFKNYAEL SLATKMADTP EQVLNFLHDL

301   ARRAKPYAEK DLAEVKAFAR ESLGLADLQP WDLGYAGEKL REAKYAFSET

351   EVKKYFPVGK VLNGLFAQIK KLYGIGFTEK TVPVWHKDVR YFELQQNGET

401   IGGVYMDLYA REGKRGGAWM NDYKGRRRFS DGTLQLPTAY LVCNFTPPVG

451   GKEARLSHDE ILTLFHETGH GLHHLLTQVD ELGVSGINGV EWDAVELPSQ

501   FMENFVWEYN VLAQMSAHEE TGVPLPKELF DKMLAAKNFQ RGMFLVRQME

551   FALFDMMIYS EDDEGRLKNW QQVLDSVRKE VAVVRPPEYN RFANSFGHIF

601   AGGYSAGYYS YAWAEVLSAD AYAAFEESDD VAATGKRFWQ EILAVGGSRS

651   AAESFKAFRG REPSIDALLR HSGFDNAA*
``` m128-1/a128-1 97.8% identity in 677 aa overlap

```
                  10         20         30         40         50         60
a128-1.pep  MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                  10         20         30         40         50         60

70         80         90        100        110        120
a128-1.pep  ERVGRIWGVVSHLNSVTDTPELRAAYNELMPEITVFFTEIGQDIELYNRFKTIKNSPEFD
            ||||||||||||||||||:||||||:||||||||||||||||||||||||||||||||||
m128-1      ERVGRIWGVVSHLNSVADTPELRAVYNELMPEITVFFTEIGQDIELYNRFKTIKNSPEFD
                  70         80         90        100        110        120
```

```
                    130       140       150       160       170       180
a128-1.pep  TLSHAQKTKLNHDLRDFVLSGAELPPEQQAELAKLQTEGAQLSAKFSQNVLDATDAFGIY
            ||| ||||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
                    130       140       150       160       170       180

190       200       210       220       230       240
a128-1.pep  FDDAAPLAGIPEDALAMFAAAAQSEGKTGYKIGLQIPHYLAVIQYADNRKLREQIYRAYV
            |||||||||||||||||||||||||:||||||||||||||||||||||||||:|||||||
m128-1      FDDAAPLAGIPEDALAMFAAAAQSESKTGYKIGLQIPHYLAVIQYADNRELREQIYRAYV
                    190       200       210       220       230       240

250       260       270       280       290       300
a128-1.pep  TRASELSDDGKFDNTANIDRTLENALQTAKLLGFKNYAELSLATKMADTPEQVLNFLHDL
            ||||||||||||||||||||||||:|||||||||||||||||||||||||||||||||||
m128-1      TRASELSDDGKFDNTANIDRTLANALQTAKLLGFKNYAELSLATKMADTPEQVLNFLHDL
                    250       260       270       280       290       300

310       320       330       340       350       360
a128-1.pep  ARRAKPYAEKDLAEVKAFARESLGLADLQPWDLGYAGEKLREAKYAFSETEVKKYFPVGK
            |||||||||||||||||||||||:||||||||||||||:|||||||||||||||||||||
m128-1      ARRAKPYAEKDLAEVKAFARESLNLADLQPWDLGYASEKLREAKYAFSETEVKKYFPVGK
                    310       320       330       340       350       360

370       380       390       400       410       420
a128-1.pep  VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
                    370       380       390       400       410       420

430       440       450       460       470       480
a128-1.pep  NDYKGRRRFSDGTLQLPTAYLVCNFTPPVGGKEARLSHDEILTLFHETGHGLHHLLTQVD
            |||||||||||||||||||||||||||:||||||:||||||||:||||||||||||||||
m128-1      NDYKGRRRFSDGTLQLPTAYLVCNFAPPVGGREARLSHDEILILFHETGHGLHHLLTQVD
                    430       440       450       460       470       480

490       500       510       520       530       540
a128-1.pep  ELGVSGINGVEWDAVELPSQFMENFVWEYNVLAQMSAHEETGVPLPKELFDKMLAAKNFQ
            ||||||||||||||||||||||||||||||||||||||||||||||||||||||||||||
m128-1      ELGVSGINGVEWDAVELPSQFMENFVWEYNVLAQMSAHEETGVPLPKELFDKMLAAKNFQ
                    490       500       510       520       530       540

550       560       570       580       590       600
a128-1.pep  RGMFLVRQMEFALFDMMIYSEDDEGRLKNWQQVLDSVRKEVAVVRPPEYNRFANSFGHIF
            |||||||||||||||||||||||||||||||||||||||:|||::|||||||||:|||||
m128-1      RGMFLVRQMEFALFDMMIYSEDDEGRLKNWQQVLDSVRKKVAVIQPPEYNRFALSFGHIF
                    550       560       570       580       590       600

610       620       630       640       650       660
a128-1.pep  AGGYSAGYYSYAWAEVLSADAYAAFEESDDVAATGKRFWQEILAVGGSRSAAESFKAFRG
            ||||||||||||||||||||||||||||||||||||||||||||||||||||||||||||
m128-1      AGGYSAGYYSYAWAEVLSADAYAAFEESDDVAATGKRFWQEILAVGGSRSAAESFKAFRG
                    610       620       630       640       650       660

670       679
a128-1.pep  REPSIDALLRHSGFDNAAX
            ||||||||||||||||||:
m128-1      REPSIDALLRHSGFDNAVX
                    670
``` a128-1 (SEQ ID 492)/P44573 (SEQ ID 4163)

```
sp|P44573|OPDA_HAEIN OLIGOPEPTIDASE A >gi|1075082|pir||C64055 oligopeptidase
A
(prlC) homolog - Haemophilus influenzae (strain Rd KW20)
>gi|1573174 (U32706) oligopeptidase A (prlC) [Haemophilus influenzae Rd]
Length = 681 Score = 591 bits (1507), Expect = e-168
Identities = 309/677 (45%), Positives = 415/677 (60%), Gaps = 4/677 (0%)
Query:   4 NALLHLGEEPRFDQIKTEDIKPALQTXXXXXXXXXXXXXXXTHTGWANTVEPLTGITERV    63
           N LL++   P F QIK E I+PA++               H W N + PLT  +R+
Sbjct:   5 NPLLNIQGLPPFSQIKPEHIRPAVEKLIQDCRNTIEQVLKQPHFTWENFILPLTETNDRL    64

Query:  64 GRIWGVVSHLNSVTDTPELRAAYNELMPEITVFFTEIGQDIELYNRFKTIKNSPEFDTLS   123
            R W  VSHLNSV ++ ELR AY  +P ++ + T +GQ   LYN   +KNS EF    S
Sbjct:  65 NRAWSPVSHLNSVKNSTELREAYQTCLPLLSEYSTWVGQHKGLYNAYLALKNSAEFADYS   124

Query: 124 HAQKTKLNHDLRDFVLSGAELPPEQQAELAKLQTEGAQLSAKFSQNVLDATDAFGIYFDD   183
             AQK  + + LRDF LSG L E+Q    ++L+++FS NVLDAT  +  ++
Sbjct: 125 IAQKKAIENSLRDFELSGIGLSEEKQQRYGEIVARLSELNSQFSNNVLDATMGWEKLIEN   184

Query: 184 AAPLAGIPEDALAMFAAAAQSEGKTGYKIGLQIPHYLAVIQYADNRKLREQTYRAYVTRA   243
             A LAG+PE AL     +A+S+G  GY+  L+IP YL V +Y +NR LRE++YRAY TRA
Sbjct: 185 EAELAGLPESALQAAQQSAESKGLKGYRFTLEIPSYLPVMTYCENRALRE EMYRAYATRA   244
```

-continued

```
Query: 244 SELSDD-GKFDNTANIDRTLENALQTAKLLGFKNYAELSLATKMADTPEQVLNFLHDLAR  302
            SE   + GK+DN+  ++  L    ++ AKLLGF Y ELSLATKMA+ P+QVL+FL   LA
Sbjct: 245 SEQGPNAGKWDNSKVMEEILTLRVELAKLLGFNTYTELSLATKMAENPQQVLDFLDHLAE  304

Query: 303 RAKPYAEKDLAEVKAFARESLGLADLQPWDLGYAGEKLREAKYAFSETEVKKYFPVGKVL  362
            RAKP  EK+L E+K  +   + G+ +L PWD+G+ EK ++   YA ++ E++ YFP +V+
Sbjct: 305 RAKPQGEKELQELKGYCEKEFGVTELAPWDIGFYSEKQKQHLYAINDEELRPYFPENRVI  364

Query: 363 NGLFAQIKKLYGIGFTE-KTVPVWHKDVRYFEL-QQNGETIGGVYMDLYAREGKRGGAWM  420
            +GLF  IK+++ I   E K V  WHKDVR+F+L  +N   G Y+DLYARE KRGGAWM
Sbjct: 365 SGLFELIKRIFNIRAVERKGVDTWHKDVRFFDLIDENDQLRGSFYLDLYAREHKRGGAWM  424

Query: 421 NDYKGRRRFSDGTLQLPTAYLVCNFTPPVGGKEARLSHDEIXXXXXXXXXXXXXXXXQVD  480
            +D  GR+R  DG+++ P AYL CNF P+G K A  +H+E+                Q+D
Sbjct: 425 DDCIGRKRKLDGSIETPVAYLTCNFNAPIGNKPALFTHNEVTTLFHEFGHGIHHMLTQID  484

Query: 481 ELGVSGINGVEWDAVELPSQFMENFVWEYNVLAQMSAHEETGVPLPKELFDKMLAAKNFQ  540
               V+GINGV WDAVELPSQFMEN+ WE   LA +S H ETG PLPKE    ++L AKNFQ
Sbjct: 485 VSDVAGINGVPWDAVELPSQFMENWCWEEEALAFISGHYETGEPLPKEKLTQLLKAKNFQ  544

Query: 541 RGMFLVRQMEFALFDMMIYSEDDEGRLKNWQQVLDSVRKEVAVVRPPEYNRFANSFGHIF  600
            MF++RQ+EF +FD ++   D +         L SV+ +VAV++  ++ R  +SF HIF
Sbjct: 545 AAMFILRQLE FGIFDFRLHHTFDAEKTNQILDTLKSVKSQVAVIKGVDWARAPHSFSHIF  604

Query: 601 XXXXXXXXXXXXWAEVLSADAYAAFEESDDV-AATGKRFWQEILAVGGSRSAAESFKAFR  659
                        WAEVLSADAY+ FEE       TGK F  EIL  GGS    E FK FR
Sbjct: 605 AGGYAAGYYSYLWAEVLSADAYSRFEEEGIFNPITGKSFLDEILTRGGSEEPMELFKRFR  664

Query: 660 GREPSIDALLRHSGFDN                                             676
            GREP +DALLRH G  N
Sbjct: 665 GREPQLDALLRHKGIMN                                             681
```

The following partial DNA sequence was identified in *N. gonorrhoeae* <SEQ ID 493>:

```
g129.seq
    1   ATGCTTTCAC CTCCTCGGCG TAAAACGGCG GCACATCAAT CAAGCCGTCT

51   TTCATTTGCG TGCGGAAAAA ATGCGGCGTG TTGCCGTGAT CAAAATCAAT

101   ATCGTGCAGC ATCCAGCCCA ATCGCGGTT TGCCTCGCTT TCCGATAACG

151   CCGACGGCGG CAGCGGTTCA CCCTTATCCG CGCTTTCGCC ATTTGCCCTT

201   TCAGGCTGCG GGCATAGGGG CGGAACAGGC GGCGGTCGAA TCCTGTTTCA

251   TCCGGACAAA CGCGTTGGCA GTCGGAAAAT CCGGCCGGCC GTGTCAAATA

301   ATGCGTTACT TTGGCCGGGT CTTGTCCTTT GTAAGCGGCG GTCTTTTTTT

351   GCGCGCCATC CGCATCTGTT TGGGCGCATG GCAAACGGCG GCTGCCGTAC

401   AATCAAAATG TTTGGCGATT TCATGCAGAC AGGCATCCGG ATGCCGCCCG

451   ACATATCGAG CCGGTTTTTG CCTATCCGAT TTGGCGGCAT TTAGGCCGGT

501   AACTTGA
```

This corresponds to the amino acid sequence <SEQ ID 494; ORF 129.ng>:

```
g129.pep
    1   MLSPPRRKTA AHQSSRLSFA CGKNAACCRD QNQYRAASSP NRGLPRFPIT

51   PTAAAVHPYP RFRHLPFQAA GIGAEQAAVE SCFIRTNALA VGKSGRPCQI

101   MRYFGRVLSF VSGGLFLRAI RICLGAWQTA AAVQSKCLAI SCRQASGCRP

151   TYRAGFCLSD LAAFRPVT*
```

The following partial DNA sequence was identified in *N. meningitidis* <SEQ ID 495>:

m129.seq (partial)
```
    1    ..TATCTGCGCT TTCACTATTT GCCCTTTCAG GCTGCGGGCA TAGGGACGGA
   51      ACAGGTAGCG GTCAAATCCT GTTTCATCCA AATAAACACG TTGGTAGTCG
  101      GAAAATTCGG CCGGCTGTGT CAAATAATGC GTTACTTTGG CCGGGTCTTG
  151      TTCTTTGTAA GTGGTGGTCT TTTTTTGCGC GTTATCCCCA TCTGTTTGAG
  201      TGCATAGCAA ATGGTGGCTG CCGTACAATC AAAATGTTTG GCGATTTCAT
  251      GCAGATAGGC ATCCGGGTGT TGCCCAACAT ATTGAGCCGG TTTTTGCCTA
  301      TCCGATTTGA CGGCATTTAG ACCGGTAACT TGA
```

This corresponds to the amino acid sequence <SEQ ID 496; ORF 129>:

m129.pep (partial)
```
    1    ..YLRFHYLPFQ AAGIGTEQVA VKSCFIQINT LVVGKFGRLC QIMRYFGRVL
   51      FFVSGGLFLR VIPICLSAXQ MVAAVQSKCL AISCRXASGC CPTYXAGFCL
  101      SDLTAFRPVT *
```

Computer analysis of this amino acid sequence gave the following results:

Homology with a Predicted ORF from *N. gonorrhoeae*
ORF 129 shows 79.1% identity over a 110 aa overlap with a predicted ORF (ORF 129.ng) from *N. gonorrhoeae*:

```
        m129/g129
                                          10        20        30
        m129.pep                  YLRFHYLPFQAAGIGTEQVAVKSCFIQINT
                                  | ||::||||||||||:||:||:|||: |:
        g129     RDQNQYRAASSPNRGLPRFPITPTAAAVHPYPRFRHLPFQAAGIGAEQAAVESCFIRTNA
                      30        40        50        60        70        80

40        50        60        70        80        90
        m129.pep LVVGKFGRLCQIMRYFGRVLFFVSGGLFLRVIPICLSAXQMVAAVQSKCLAISCRXASGC
                |:||| || |||||||||| ||||||||||:  |||:|  | :||||||||||| ||||
        g129    LAVGKSGRPCQIMRYFGRVLSFVSGGLFLRAIRICLGAWQTAAAVQSKCLAISCRQASGC
                      90       100       110       120       130       140

100       110
        m129.pep CPTYXAGFCLSDLTAFRPVTX
                ||| |||||||||:|||||||
        g129    RPTYRAGFCLSDLAAFRPVTX
                     150       160
```

The following partial DNA sequence was identified in *N. meningitidis* <SEQ ID 497>:

a129.seq (partial)
```
    1    TATCTGCGCT TTCACTATTT GCCCTTTCAG GCTGCGGGCA TAGGGACGGA
   51    ACAGGTAGCG GTCAAATCCT GTTTCATCCA AATAAACACG TTGGTAGTCG
  101    GAAAATTCGG CCAGCTGTGT CAAATAATGC GTTACTTTGG CCGGGTCTTG
  151    TTCTTTGTAA GTGGTGGTCT TTTTTTGCGC GTTATCCCCA TCTGTTTGAG
  201    TGCATAGCAA ATGGTGGCTG CCGTACAATC AAAATGTTTG GCGATTTCAT
  251    GCAGATAGGC ATCCTGGTGT TGCCCAACAT ATTGAGCCGG TTTTTGCCTA
  301    TCCGATTTGA CGGCATTTAG ACCGGTAACT TGA
```

This corresponds to the amino acid sequence <SEQ ID 498; ORF 129.a>:

```
a129.pep (partial)
    1   YLRFHYLPFQ AAGIGTEQVA VKSCFIQINT LVVGKFGQLC QIMRYFGRVL

51   FFVSGGLFLR VIPICLSA*Q MVAAVQSKCL AISCR*ASWC CPTY*AGFCL

101   SDLTAFRPVT *
``` m129/a129 98.2% identity in 110 aa overlap

```
                      10         20         30         40         50         60
m129.pep      YLRFHYLPFQAAGIGTEQVAVKSCFIQINTLVVGKFGRLCQIMRYFGRVLFFVSGGLFLR
              ||||||||||||||||||||||||||||||||||||:|||||||||||||||||||||||
a129          YLRFHYLPFQAAGIGTEQVAVKSCFIQINTLVVGKFGQLCQIMRYFGRVLFFVSGGLFLR
                      10         20         30         40         50         60

70         80         90        100        110
m129.pep      VIPICLSAXQMVAAVQSKCLAISCRXASGCCPTYXAGFCLSDLTAFRPVTX
              |||||||||||||||||||||||||||||||| ||||||||||||||||||
a129          VIPICLSAXQMVAAVQSKCLAISCRXASWCCPTYXAGFCLSDLTAFRPVTX
                      70         80         90        100        110
```

20

The following partial DNA sequence was identified in *N. gonorrhoeae* <SEQ ID 499>:

```
g130.seq
    1   ATGAAACAAC TCCGCGACAA CAAAGCCCAA GGCTCTGCAC TGTTTACCCT

51   TGTGAGCGGT ATCGTTATTG TTATTGCAGT CCTTTATTTC CTGATTAAGC

101   TGGCGGGCAG TGGATCGTTC GGCGATGTCG ATGCCACTAC GGAAGCGGCA

151   ACGCAGACCC GCATCCAGCC TGTCGGACAA TTGACGATGG GTGACGGCAT

201   CCCCGTCGGC GAACGCCAAG GCGAACAGAT TTTCGGCAAA ATCTGTATCC

251   AATGCCACGC GGCGGACAGC AATGTGCCGA ACGCTCCGAA ACTGGAACAC

301   AACGGCGACT GGGCGCCGCG TATCGCGCAA GGCTTCGATA CCTTGTTCCA

351   ACACGCGCTG AACGGCTTTA ACGCCATGCC TGCCAAAGGC GGTGCGGCAG

401   ACCTGACCGA TCAGGAACTC AAACGGGCGA TTACCTACAT GGCGAATAAA

451   AGCGGCGGTT CTTTCCCGAA TCCTGATGAG GCTGCGCCTG CCGACAATGC

501   CGCTTCAGGA ACAGCTTCTG CTCCTGCCGA TAGTGCAGCT CCGGCAGAAG

551   CGAAGGCAGA AGACAAGGGT GCGGCAGCCC CTGCGGTCGG CGTTGACGGT

601   AAAAAGTCT TCGAAGCAAC TGTGTCAGGTG TGCCACGGCG GTTCGATTCC

651   CGGTATTCCC GGCATAGGCA AAAAAGACGA TTGGGCACCG CGTATCAAAA

701   AAGGCAAAGA AACCTTGCAC AAACATGCCC TTGAAGGCTT TAACGCGATG

751   CCGGCCAAAG GCGGCAATGC AGGTTTGAGC GATGACGAAG TCAAAGCGGC

801   TGTTGACTAT ATGGCAAACC AATCCGGTGC AAAATTCTAA
```

This corresponds to the amino acid sequence <SEQ ID 500; ORF 130.ng>:

```
g130.pep
    1   MKQLRDNKAQ GSALFTLVSG IVIVIAVLYF LIKLAGSGSF GDVDATTEAA

51   TQTRIQPVGQ LTMGDGIPVG ERQGEQIFGK ICIQCHAADS NVPNAPKLEH

101   NGDWAPRIAQ GFDTLFQHAL NGFNAMPAKG GAADLTDQEL KRAITYMANK

151   SGGSFPNPDE AAPADNAASG TASAPADSAA PAEAKAEDKG AAAPAVGVDG

201   KKVFEATCQV CHGGSIPGIP GIGKKDDWAP RIKKGKETLH KHALEGFNAM

251   PAKGGNAGLS DDEVKAAVDY MANQSGAKF*
```

The following partial DNA sequence was identified in *N. meningitidis* <SEQ ID 501>:

```
m130.seq (partial)
    1   ..GGCGAACAGA TTTTCGGCAA AATCTGTATC CAATGCCACG CGGCGGACAG 51   CAATGTGCCG AACGCTCCGA AACTGGAACA CAACGGCGAT TrGGCACCGC 101   GTATCGgCAA GGCTTCGATA CCTTGTTCCA ACACGCGCTG AACGGCTTTA

151   ACGCCATGCC TGCAAAAGGC GGTGCGGCAG ACCTGACCGA TCAGGAACTT

201   AAACGGGCGA TTACTTACAT GGCGAACAAA AGCGGCGGTT CTTTCCCGAA

251   TCCTGATGAG GCTGCGCCTG CCGACAATGC CGCTTCAGGA ACAGCTTCTG

301   CTCCTGCCGA TAGTGCAGCT CCGGCAGAAG CGAAGGCAGA AGACAAGGGT

351   GCGGCAcCCC TGCGGTCGGC GTTGACGGTA AAAAAGTCTT CGAAGCAACC

401   TGTCAGGTGT GCCACGGCGG TTCGATTCCC GGTATTCCCG GCATAGGCAA

451   AAAAGACGAT TGGGCACCGC GTATCAAAAA AGGCAAAGAA ACCTTGCACA

501   AACACGCCCT TGAAGGCTTT AACGCGATGC CTGCCAAArG CGgCAATGCA

551   GGTTTGAGCG ATGACGAAgT CAAAGCGGCT GTTGACTATA TGGCAAACCA

601   ATCCGGTGCA AAATTCTAA
```

This corresponds to the amino acid sequence <SEQ ID 502; ORF 130>:

```
m130.pep (partial)
    1   ..GEQIFGKICI QCHAADSNVP NAPKLEHNGD XAPRIQGFDT LFQHALNGFN

51   AMPAKGGAAD LTDQELKRAI TYMANKSGGS FPNPDEAAPA DNAASGTASA

101   PADSAAPAEA KAEDKGAAPA VGVDGKKVFE ATCQVCHGGS IPGIPGIGKK

151   DDWAPRIKKG KETLHKHALE GFNAMPAKXG NAGLSDDEVK AAVDYMANQS

201   GAKF*
```

Computer analysis of this amino acid sequence gave the following results:
Homology with a Predicted ORF from *N. gonorrhoeae*
ORF 130 shows 98.1% identity over a 206 aa overlap with a predicted ORF (ORF 130.ng) from *N. gonorrhoeae*:

```
m130/g130
                                              10        20        30
   m130.pep                          GEQIFGKICIQCHAADSNVPNAPKLEHNGD
                                     ||||||||||||||||||||||||||||||
   g130     DATTEAATQTRIQPVGQLTMGDGIPVGERQGEQIFGKICIQCHAADSNVPNAPKLEHNGD
                50        60        70        80        90       100
                  40        50        60        70        80        89
   m130.pep   XAPRI-QGFDTLFQHALNGFNAMPAKGGAADLTDQELKRAITYMANKSGGSFPNPDEAAP
              |||| |||||||||||||||||||||||||||||||||||||||||||||||||||||||
   g130       WAPRIAQGFDTLFQHALNGFNAMPAKGGAADLTDQELKRAITYMANKSGGSFPNPDEAAP
                  110       120       130       140       150       160
              90        100       110       120       130       140
   m130.pep   ADNAASGTASAPADSAAPAEAKAEDKGAA-PAVGVDGKKVFEATCQVCHGGSIPGIPGIG
              ||||||||||||||||||||||||||||| ||||||||||||||||||||||||||||||
   g130       ADNAASGTASAPADSAAPAEAKAEDKGAAAPAVGVDGKKVFEATCQVCHGGSIPGIPGIG
                  170       180       190       200       210       220
              150       160       170       180       190       200
   m130.pep   KKDDWAPRIKKGKETLHKHALEGFNAMPAKXGNAGLSDDEVKAAVDYMANQSGAKFX
              ||||||||||||||||||||||||||||||| |||||||||||||||||||||||||
   g130       KKDDWAPRIKKGKETLHKHALEGFNAMPAKGGNAGLSDDEVKAAVDYMANQSGAKFX
                  230       240       250       260       270       280
```

The following partial DNA sequence was identified in *N. meningitidis* <SEQ ID 503>:

```
a130.seq
   1    ATGAAACAAC TCCGCGACAA CAAAGCCCAA GGCTCTGCAC TGTTTACCCT
  51    TGTGAGCGGT ATCGTTATTG TTATTGCAGT CCTTTATTTC CTGATTAAGC
 101    TGGCGGGCAG CGGCTCGTTC GGCGATGTCG ATGCCACTAC GGAAGCAGCA
 151    ACGCAGACCC GTATCCAGCC TGTCGGACAA TTGACGATGG CGACGGCAT
 201    CCCCGTCGGC GAACGCCAAG GCGAACAGAT TTTCGGCAAA ATCTGTATCC
 251    AATGCCACGC GGCGGACAGC AATGTGCCGA ACGCTCCGAA ACTGGAACAC
 301    AACGGCGATT GGGCGCCGCG TATCGCGCAA GGCTTCGATA CCTTGTTCCA
 351    ACACGCGCTG AACGGCTTTA ACGCCATGCC TGCCAAAGGC GGTGCGGTAG
 401    ACCTGACCGA TCAGGAACTC AAACGGGCGA TTACTTACAT GGCGAACAAA
 451    AGCGGCGGTT CTTTCCCGAA TCCTGATGAG GCTGCGCCTG CCGACAATGC
 501    CGCTTCAGGA ACAGCTTCTG CTCCTGCCGA TAGTGCAGCT CCGGCAGAAG
 551    CGAAGGCAGA AGACAAGGGT GCGGCAGCCC CTGCGGTCGG CGTTGACGGT
 601    AAAAAAGTCT TCGAAGCAAC CTGTCAGGTG TGCCACGGCG GTTCGATTCC
 651    CGGTATTCCC GGCATAGGCA AAAAAGACGA TTGGGCACCG CGTATCAAAA
 701    AAGGCAAAGA AACCTTGCAC AAACACGCCC TTGAAGGCTT TAACGCGATG
 751    CCTGCCAAAG GCGGCAATGC AGGTTTGAGC GATGACGAAG TCAAAGCGGC
 801    TGTTGACTAT ATGGCAAACC AATCCGGTGC AAAATTCTAA
```

This corresponds to the amino acid sequence <SEQ ID 504; ORF 130.a>:

```
a130.pep
   1    MKQLRDNKAQ GSALFTLVSG IVIVIAVLYF LIKLAGSGSF GDVDATTEAA
  51    TQTRIQPVGQ LTMGDGIPVG ERQGEQIFGK ICIQCHAADS NVPNAPKLEH
 101    NGDWAPRIAQ GFDTLFQHAL NGFNAMPAKG GAVDLTDQEL KRAITYMANK
 151    SGGSFPNPDE AAPADNAASG TASAPADSAA PAEAKAEDKG AAAPAVGVDG
 201    KKVFEATCQV CHGGSIPGIP GIGKKDDWAP RIKKGKETLH KHALEGFNAM
 251    PAKGGNAGLS DDEVKAAVDY MANQSGAKF*
``` m130/a130 97.6% identity in 206 aa overlap

```
                              10         20         30
   m130.pep                   GEQIFGKICIQCHAADSNVPNAPKLEHNGD
                              |||||||||||||||||||||||||||||
   a130     DATTEAATQTRIQPVGQLTMGDGIPVGERQGEQIFGKICIQCHAADSNVPNAPKLEHNGD
                   50         60         70         80         90        100

40         50         60         70         80        89
   m130.pep   XAPRI-QGFDTLFQHALNGFNAMPAKGGAADLTDQELKRAITYMANKSGGSFPNPDEAAP
              ||||  |||||||||||||||||||||||| :|||||||||||||||||||||||||||
   a130       WAPRIAQGFDTLFQHALNGFNAMPAKGGAVDLTDQELKRAITYMANKSGGSFPNPDEAAP
                   110        120        130        140        150       160

90        100        110        120        130       140
   m130.pep   ADNAASGTASAPADSAAPAEAKAEDKGAA-PAVGVDGKKVFEATCQVCHGGSIPGIPGIG
              ||||||||||||||||||||||||||||| ||||||||||||||||||||||||||||||
   a130       ADNAASGTASAPADSAAPAEAKAEDKGAAAPAVGVDGKKVFEATCQVCHGGSIPGIPGIG
                   170        180        190        200        210       220

150        160        170        180        190       200
   m130.pep   KKDDWAPRIKKGKETLHKHALEGFNAMPAKXGNAGLSDDEVKAAVDYMANQSGAKFX
              |||||||||||||||||||||||||||||| |||||||||||||||||||||||||
   a130       KKDDWAPRIKKGKETLHKHALEGFNAMPAKGGNAGLSDDEVKAAVDYMANQSGAKFX
                   230        240        250        260        270       280
```

The following partial DNA sequence was identified in *N. gonorrhoeae* <SEQ ID 505>:

```
g132.seq
    1  ATGGAAGCCT TCAAAACCCT AATTTGGATT ATTAATATTA TTTCCGCTTT
   51  GGCCGTCATC GTGTTAGTAT TGCTCCAACA CGGCAAAGGC GCGGATGCCG
  101  GCGCGACCTT CGGATCGGGA AGCGGCAGCG CGCAAGGCGT ATTCGGCTCT
  151  GCCGGCAACG CCAACTTcct CAgccGCTCG AccGccGTTG CAGCAACAtt
  201  tttcttTGca acctgcAtgg gctatggTgt atattcacac CCACACGACA
  251  AAACACGGTT TGGACTtcag caacataCGA CAGACTCAGC AagcACCCAA
  301  ACCcgtAAGC AATACCGAAC CTTCTGCCCC TGTTCCTCAG CAGCAGAAAT
  351  AACagtTTTT CAAATgccga caTGgtga
```

This corresponds to the amino acid sequence <SEQ ID 506; ORF 132.ng>:

```
g132.pep
    1  MEAFKTLIWI INIISALAVI VLVLLQHGKG ADAGATFGSG SGSAQGVFGS
   51  AGNANFLSRS TAVAATFFFA TCMGYGVYSH PHDKTRFGLQ QHTTDSASTQ
  101  TRKQYRTFCP CSSAAEITVF QMPTW*
```

The following partial DNA sequence was identified in *N. meningitidis* <SEQ ID 507>:

```
m132.seq (partial)
    1  ATGGAACCCT TCAAAACCTT AATTTGGATT GTTAATTTAA TTTCCGCTTT
   51  GGCCGTCTTC GTGTTAGTAT TGCTCCAACA CGGCAAAGGC GCGGATGCCG
  101  GCGCGACTTT CGGA...
```

This corresponds to the amino acid sequence <SEQ ID 508; ORF 132>:

```
m132.pep  (partial)
    1  MEPFKTLIWI VNLISALAVF VLVLLQHGKG
       ADAGATFG...
```

Computer analysis of this amino acid sequence gave the following results:

Homology with a Predicted ORF from *N. gonorrhoeae*

ORF 132 shows 89.5% identity over a 38 aa overlap with a predicted ORF (ORF 132.ng) from *N. gonorrhoeae*:

```
m132/g132
                  10        20        30
m132.pep  MEPFKTLIWIVNLISALAVFVLVLLQHGKGADAGATFG
          || ||||||||:|:||||||:||||||||||||||||||
g132      MEAFKTLIWIINIISALAVIVLVLLQHGKGADAGATFGSGSGSAQGVFGSAGNANFLSRS
                  10        20        30        40        50        60
```

The following partial DNA sequence was identified in *N. meningitidis* <SEQ ID 509>:

```
a132.seq
    1  ATGGAAGCCT TCAAAACCCT AATTTGGATT GTTAATATAA TTTCCGCTTT
   51  GGCCGTCATC GTGTTAGTAT TGCTCCAACA CGGCAAAGGC GCGGATGCCG
```

-continued

```
101   GCGCGACTTT CGGATCGGGA AGCGGCAGCG CGCAAGGCGT ATTCGGCTCT

151   GCCGGCAACG CTAACTTCCT CAGCCGCTCG ACCGCCGTTG CAGCAACATT

201   TTTCTTTGCA ACCTGCATGg GCTATGGTGT ATATTCACAC CCACACGACA

251   AAACACGGTT TGGACTTCAG CAACGTACAA CAAACTCAGC AAGCACCCAA

301   ACCCGTAAGC AATACCGAAC CTTCTGCCCC TGTTCCTCAG CAGCAGAAAT

351   AACAGTTTTT CAAATGCCGA CATGGTGA
```

This corresponds to the amino acid sequence <SEQ ID 510; ORF 132.a>:

```
a132.pep
  1   MEAFKTLIWI VNIISALAVI VLVLLQHGKG ADAGATFGSG SGSAQGVFGS

51   AGNANFLSRS TAVAATFFFA TCMGYGVYSH PHDKTRFGLQ QRTTNSASTQ

101   TRKQYRTFCP CSSAAEITVF QMPTW*
``` m132/a132 92.1% identity in 38 aa overlap

```
              10         20         30
m132.pep   MEPFKTLIWIVNLISALAVFVLVLLQHGKGADAGATFG
           ||  ||||||||:||||||:||||||||||||||||||
    g132   MEAFKTLIWIVNIISALAVIVLVLLQHGKGADAGATFGSGSGSAQGVFGSAGNANFLSRS
              10         20         30         40         50         60
```

The following partial DNA sequence was identified in *N. gonorrhoeae* <SEQ ID 511>:

```
g134.seq
  1   ATGTCCCAAG AAATCCTCGA CCAAGTGCGC CGCCGCCGCA CGTTTGCCAT

51   CATCTCCCAC CCCGATGCGG GTAAAACCAC GCTGACCGAA AAACTGCTGC

101   TGTTTTCGGG CGCGATTCAA AGCGCAGGCA CGGTGAAAGG TAAGAAAACC

151   GGCAAATTCG CCACCTCCGA CTGGATGGAC ATCGAGAAGC AGCGCGGCAT

201   TTCCGTGGCA TCAAGCGTGA TGCAGTTCGA CTACAAAGAC CACACCGTCA

251   ACCTCTTGGA CACGCCGGGA CACCAAGACT TCTCCGAAGA CACCTACCGC

301   GTTTTAACCG CAGTGGACAG CGCCTTGATG GTCATCGACG CGGCAAAAGG

351   CGTGGAAGCG CAAACCATCA AACTCTTGAA CGTCTGCCGC CTGCGCGATA

401   CGCCGATTGT TACCTTCATG AACAAATACG ACCGCGAAGT GCGCGATTCT

451   TTGGAACTCT TGGACGAAGT GGAAGACATC CTGCAAATCC GCTGCGCGCC

501   CGTTACCTGG CCGATCGGTA TGGGCAAAAA CTTCAAGGGC GTGTACCACA

551   TCCTGAACGA CGAAATCTAT CTCTTTGAAG CGGGCGGCGA ACGCCTGCCG

601   CACGAGTTCG ACATCATCAA AGGCATAAAC AATCCCGAAT TGGAACAACG

651   CTTTCCGTTG GAAATCCAGC AGTTGCGCGA CGAAATCGAA TTGGTGCAGG

701   CGGCTTCCAA CGAATTTAAT CTCGacgaAT TTCTCGccgG CGAACTCACG

751   CCAGTGTTCT TCGGCTCTGC GATTAACAAC TTCGGCATTC AGGAAATCCT

801   CAATTCATTG ATTGACTGGG CACCCGCACC GAAACCGCGC GACGCGACCA

851   TGCGCATGGT CGGGCCGGAC GAGCCGAAAT TTTCCGGATT TATCTTTAAA

901   ATCCAAGCCA ATATGGACCC GAAACACCGC GACCGTATCG CCTTCTTGCG
```

```
-continued
 951   CGTCTGCTCC GGTAAATTCG AGCGCGGCAT GAAGATGAAA CACCTGCGTA

1001   TCAACCGCGA AATCGCCGCC TCCAGCGTAG TAACCTTCAT GTCGCACGAC

1051   CGCGAACTGG CGGAAGAAGC CTACGCCGGC GACATCATCG GCATCCCGAA

1101   CCACGGCAAC ATCCAAATCG GCGACAGCTT CTCCGAAGGC GAACAACTGG

1151   CGTTTACCGG CATCCCATTC TTCGCGCCCG AACTGTTCCG CAGCGTCCGC

1201   ATCAAAAACC CGCTGAAAAT CAAACAACTG CAAAAAGGTT TGCAACAACT

1251   CGGCGAAGAA GGTGCGGTTC AAGTATTCAA ACCGATGAGC GGCGCGGATT

1301   TGATTTTGGG TGCGGTCGGC GTGTTGCAGT TTGAAGTCGT AACCTCACGC

1351   CTCGCCAACG AATACGGCGT GGAAGCCGTG TTCGACAGCG CATCCATCTG

1401   GTCGGCGCGC TGGGTATCGT GCGACGACAA GAAAAAACTG GCGGAATTTG

1451   AAAAAGCCAA CGCAGGCAAC CTCGCCATCG ACGCAGGCGG CAACCTCGCC

1501   TACCTCGCCC CCAACCGCGT GAATTTGGGG TTGACGCAAG AACGCTGGCC

1551   GGACATCGTG TTCCACGAAA CGCGCGAACA TTCGGTCAAA CTCTAA
```

This corresponds to the amino acid sequence <SEQ ID 512; ORF 134.ng>:

```
g134.pep
   1   MSQEILDQVR RRRTFAIISH PDAGKTTLTE KLLLFSGAIQ SAGTVKGKKT

51   GKFATSDWMD IEKQRGISVA SSVMQFDYKD HTVNLLDTPG HQDFSEDTYR

101   VLTAVDSALM VIDAAKGVEA QTIKLLNVCR LRDTPIVTFM NKYDREVRDS

151   LELLDEVEDI LQIRCAPVTW PIGMGKNFKG VYHILNDEIY LFEAGGERLP

201   HEFDIIKGIN NPELEQRFPL EIQQLRDEIE LVQAASNEFN LDEFLAGELT

251   PVFFGSAINN FGIQEILNSL IDWAPAPKPR DATMRMVGPD EPKFSGFIFK

301   IQANMDPKHR DRIAFLRVCS GKFERGMKMK HLRINREIAA SSVVTFMSHD

351   RELAEEAYAG DIIGIPNHGN IQIGDSFSEG EQLAFTGIPF FAPELFRSVR

401   IKNPLKIKQL QKGLQQLGEE GAVQVFKPMS GADLILGAVG VLQFEVVTSR

451   LANEYGVEAV FDSASIWSAR WVSCDDKKKL AEFEKANAGN LAIDAGGNLA

501   YLAPNRVNLG LTQERWPDIV FHETREHSVK L*
                                                     45
```

The following partial DNA sequence was identified in *N. meningitidis* <SEQ ID 513>:

```
m134.seq
   1   ATGTCCCAAG AAATCCTCGA CCAAGTGCGC CGCCGCCGCA CGTTTGCCAT

51   CATCTCCCAC CCTGACGCAG GTAAAACCAC GTTGACTGAA AAACTCTTGC

101   TGTTTTCGGG CGCGATTCAG AGCGCGGGTA CGGTAAAAGG CAAGAAAACC

151   GGCAAATTCG CCACTTCCGA CTGGATGGAA ATCGAGAAGC AGCGCGGCAT

201   TTCCGTGGCA TCAAGTGTGA TGCAGTTCGA TTACAAAGAC CACACCGTCA

251   ACCTCTTGGA CACGCCGGGA CACCAAGACT TCTCCGAAGA CACCTACCGC

301   GTTTTAACCG CCGTGGACAG CGCATTAATG GTCATCGACG CGGCAAAAGG

351   CGTGGAAGCG CAAACCATCA AGCTCTTAAA CGTCTGCCGC CTGCGCGATA

401   CACCGATTGT TACGTTTATG AACAAATACG ACCGCGAAGT GCGCGATTCC

451   CTGGAACTTT TGGACGAAGT GGAAACATTT TTAAAAATCC GCTGCGCGCC
```

```
 501  CGTTACCTGG CCGATCGGTA TGGGCAAAAA CTTCAAGGGC GTGTACCACA

551  TCCTGAACGA TGAAATTTAT CTCTTTGAAG CTGGCGGCGA ACGCCTGCCG

601  CACGAGTTCG ACATCATCAA AGGCATCGAT AATCCTGAAT GGAACAACG

651  CTTTCCGTTG GAAATCCAGC AGTTGCGCGA CGAAATCGAA TTGGTGCAGG

701  CGGCTTCCAA CGAGTTTAAT CTCGACGAAT TCCTCGCCGG CGAACTCACG

751  CCCGTATTCT TCGGCTCTGC GATTAACAAC TTCGGTATTC AGGAAATCCT

801  CAATTCATTG ATTGACTGGG CGCCCGCGCC GAAACCGCGC GACGCGACCG

851  TACGTATGGT CGAGCCGGAC GAGCCGAAGT TTTCCGGATT TATCTTCAAA

901  ATCCAAGCCA ATATGGACCC GAAACACCGC GACCGTATTG CCTTCTTGCG

951  CGTCTGCTCC GGCAAATTCG AGCGCGGCAT GAAGATGAAA CACCTGCGTA

1001  TCAACCGCGA AATCGCCGCC TCCAGCGTGG TTACCTTCAT GTCGCACGAC

1051  CGCGAGCTGG TTGAAGAAGC CTACGCCGGC GACATTATCG GCATCCCGAA

1101  CCACGGCAAC ATCCAAATCG GCGACAGCTT CTCCGAAGGC GAACAACTGG

1151  CGTTCACCGG CATCCCATTC TTCGCACCCG AACTGTTCCG CAGCGTACGC

1201  ATCAAAAACC CGCTGAAAAT CAAACAACTG CAAAAAGGCT TGCAACAGCT

1251  CGGCGAAGAA GGCGCGGTGC AGGTGTTCAA ACCGATGAGC GGCGCGGATT

1301  TGATTTTGGG CGCGGTCGGC GTGTTGCAGT TTGAAGTCGT TACCTCGCGC

1351  CTCGCCAACG AATACGGCGT AGAAGCCGTG TTCGACAGCG CATCCATCTG

1401  GTCGGCGCGC TGGGTATCGT GCGACGACAA GAAAAAACTG GCTGAATTTG

1451  AAAAAGCCAA CGCGGGCAAC CTCGCCATCG ACGCAGGCGG CAACCTCGCC

1501  TACCTCGCCC CCAACCGCGT GAATTTGGGA CTCACGCAAG AACGTTGGCC

1551  GGACATCGTG TTCCACGAAA CACGCGAACA TTCGGTCAAA CTGTAA
```

This corresponds to the amino acid sequence <SEQ ID 514; ORF 134>:

```
m134.pep
   1  MSQEILDQVR RRRTFAIISH PDAGKTTLTE KLLLFSGAIQ SAGTVKGKKT

51  GKFATSDWME IEKQRGISVA SSVMQFDYKD HTVNLLDTPG HQDFSEDTYR

101  VLTAVDSALM VIDAAKGVEA QTIKLLNVCR LRDTPIVTFM NKYDREVRDS

151  LELLDEVENI LKIRCAPVTW PIGMGKNFKG VYHILNDEIY LFEAGGERLP

201  HEFDIIKGID NPELEQRFPL EIQQLRDEIE LVQAASNEFN LDEFLAGELT

251  PVFFGSAINN FGIQEILNSL IDWAPAPKPR DATVRMVEPD EPKFSGFIFK

301  IQANMDPKHR DRIAFLRVCS GKFERGMKMK HLRINREIAA SSVVTFMSHD

351  RELVEEAYAG DIIGIPNHGN IQIGDSFSEG EQLAFTGIPF FAPELFRSVR

401  IKNPLKIKQL QKGLQQLGEE GAVQVFKPMS GADLILGAVGVLQFEVVTSR

451  LANEYGVEAV FDSASIWSAR WVSCDDKKKL AEFEKANAGN LAIDAGGNLA

501  YLAPNRVNLG LTQERWPDIV FHETREHSVK L*
```

Computer analysis of this amino acid sequence gave the following results:

Homology with a Predicted ORF from *N. gonorrhoeae*

ORF 134 shows 98.7% identity over a 531 aa overlap with a predicted ORF (ORF 134.ng) from *N. gonorrhoeae*:

```
m134/g134
                   10        20        30        40        50        60
m134.pep  MSQEILDQVRRRRTFAIISHPDAGKTTLTEKLLLFSGAIQSAGTVKGKKTGKFATSDWME
          |||||||||||||||||||||||||||||||||||||||||||||||||||||||||||:
g134      MSQEILDQVRRRRTFAIISHPDAGKTTLTEKLLLFSGAIQSAGTVKGKKTGKFATSDWMD
                   10        20        30        40        50        60

70        80        90       100       110       120
m134.pep  IEKQRGISVASSVMQFDYKDHTVNLLDTPGHQDFSEDTYRVLTAVDSALMVIDAAKGVEA
          ||||||||||||||||||||||||||||||||||||||||||||||||||||||||||||
g134      IEKQRGISVASSVMQFDYKDHTVNLLDTPGHQDFSEDTYRVLTAVDSALMVIDAAKGVEA
                   70        80        90       100       110       120

130       140       150       160       170       180
m134.pep  QTIKLLNVCRLRDTPIVTFMNKYDREVRDSLELLDEVENILKIRCAPVTWPIGMGKNFKG
          ||||||||||||||||||||||||||||||||||||||:||:||||||||||||||||||
g134      QTIKLLNVCRLRDTPIVTFMNKYDREVRDSLELLDEVEDILQIRCAPVTWPIGMGKNFKG
                  130       140       150       160       170       180

190       200       210       220       230       240
m134.pep  VYHILNDEIYLFEAGGERLPHEFDIIKGIDNPELEQRFPLEIQQLRDEIELVQAASNEFN
          |||||||||||||||||||||||||||||:||||||||||||||||||||||||||||||
g134      VYHILNDEIYLFEAGGERLPHEFDIIKGINNPELEQRFPLEIQQLRDEIELVQAASNEFN
                  190       200       210       220       230       240

250       260       270       280       290       300
m134.pep  LDEFLAGELTPVFFGSAINNFGIQEILNSLIDWAPAPKPRDATVRMVEPDEPKFSGFIFK
          ||||||||||||||||||||||||||||||||||||||||||||:||| |||||||||||
g134      LDEFLAGELTPVFFGSAINNFGIQEILNSLIDWAPAPKPRDATMRMVGPDEPKFSGFIFK
                  250       260       270       280       290       300

310       320       330       340       350       360
m134.pep  IQANMDPKHRDRIAFLRVCSGKFERGMKMKHLRINREIAASSVVTFMSHDRELVEEAYAG
          |||||||||||||||||||||||||||||||||||||||||||||||||||||:||||||
g134      IQANMDPKHRDRIAFLRVCSGKFERGMKMKHLRINREIAASSVVTFMSHDRELAEEAYAG
                  310       320       330       340       350       360

370       380       390       400       410       420
m134.pep  DIIGIPNHGNIQIGDSFSEGEQLAFTGIPFFAPELFRSVRIKNPLKIKQLQKGLQQLGEE
          ||||||||||||||||||||||||||||||||||||||||||||||||||||||||||||
g134      DIIGIPNHGNIQIGDSFSEGEQLAFTGIPFFAPELFRSVRIKNPLKIKQLQKGLQQLGEE
                  370       380       390       400       410       420

430       440       450       460       470       480
m134.pep  GAVQVFKPMSGADLILGAVGVLQFEVVTSRLANEYGVEAVFDSASIWSARWVSCDDKKKL
          ||||||||||||||||||||||||||||||||||||||||||||||||||||||||||||
g134      GAVQVFKPMSGADLILGAVGVLQFEVVTSRLANEYGVEAVFDSASIWSARWVSCDDKKKL
                  430       440       450       460       470       480

490       500       510       520       530
m134.pep  AEFEKANAGNLAIDAGGNLAYLAPNRVNLGLTQERWPDIVFHETREHSVKLX
          ||||||||||||||||||||||||||||||||||||||||||||||||||||
g134      AEFEKANAGNLAIDAGGNLAYLAPNRVNLGLTQERWPDIVFHETREHSVKLX
                  490       500       510       520       530
```

The following partial DNA sequence was identified in *N. meningitidis* <SEQ ID 515>:

```
a134.seq
    1  ATGTCCCAAG AAATCCTCGA CCAAGTGCGC CGCCGCCGCA CGTTTGCCAT

51  CATCTCCCAC CCTGACGCAG GTAAAACCAC GTTGACTGAA AAACTCTTGC

101  TGTTTTCAGG TGCGATTCAA AGCGCGGGTA CGGTAAAAGG CAAGAAAACC

151  GGCAAATTCG CCACCTCCGA CTGGATGGAC ATCGAGAAGC AGCGCGGCAT

201  TTCCGTGGCA TCAAGCGTGA TGCAGTTCGA CTATAAAGAC CACACCGTCA

251  ACCTTTTGGA CACGCCGGGA CACCAAGACT TCTCCGAAGA CACCTACCGC

301  GTTTTGACCG CCGTCGATAG TGCCTTGATG GTCATCGACG CGGCAAAAGG

351  CGTGGAAGCG CAAACCATCA AACTCTTGAA CGTCTGCCGC CTGCGCAATA

401  CGCCGATTGT TACGTTCATG AACAAATACG ACCGCGAAGT GCGCGATTCC

451  CTGGAATTGC TGGACGAAGT GGAAAACATC CTGCAAATCC GCTGCGCGCC

501  CGTAACCTGG CCGATCGGCA TGGGCAAAAA CTTCAAAGGC GTGTACCACA

551  TCCTGAACGA CGAAATCTAT CTCTTTGAAG CGGGCGGCGA ACGCTTGCCG

601  CACGAGTTCG ACATCATCAA AGGCATCGAT AATCCCGAAT TGGAACAACG
```

```
 651  CTTTCCGTTA GAAATACAGC AGTTGCGCGA CGAAATCGAA TTGGTGCAGG

701  CGGCTTCCAA CGAGTTCAAT CTCGACGAAT TCCTCGCCGG CGAACTCACG

751  CCCGTATTCT TCGGCTCTGC GATTAACAAC TTCGGTATTC AGGAAATCCT

801  CAATTCATTG ATTGAATGGG CGCCCGCGCC GAAACCACGC GATGCGACCG

851  TGCGTATGGT CGAGCCGGAC GAGCCGAAGT TTTCCGGATT TATCTTCAAA

901  ATCCAAGCCA ATATGGACCC GAAACACCGC GACCGTATTG CCTTCTTGCG

951  CGTCTGCTCC GGCAAATTCG AGCGCGGCAT GAAAATGAAA CACCTGCGTA

1001  TCAACCGCGA AATCGCCGCC TCCAGCGTGG TAACCTTCAT GTCCCACGAC

1051  CGCGAGCTGG TTGAAGAAGC CTACGCCGGC GACATTATCG GTATCCCAAA

1101  CCACGGCAAC ATCCAAATCG GCGACAGCTT CTCCGAAGGC GAACAACTGA

1151  CGTTTACCGG CATCCCATTC TTCGCGCCCG AACTGTTCCG CAGCGTTCGC

1201  ATCAAAAACC CGCTGAAAAT CAAGCAACTG CAAAAGGTT TGCAACAGCT

1251  TGGCGAAGAA GGTGCGGTGC AGGTGTTCAA ACCAATGAGC GGCGCGGATT

1301  TGATTTTGGG CGCGGTCGGC GTGTTGCAGT TTGAAGTCGT TACCTCGCGC

1351  CTTGCCAACG AATACGGCGT GGAAGCCGTG TTCGACAACG CATCCATCTG

1401  GTCGGCGCGC TGGGTATCGT GCGACGACAA GAAAAAACTG GCGGAATTTG

1451  AAAAAGCCAA CGCGGGCAAC CTCGCCATCG ACGCGGGCGG CAACCTCGCC

1501  TACCTCGCCC CTAACCGCGT GAATCTGGGA CTCACGCAAG AACGCTGGCC

1551  GGACATCGTG TTCCACGAAA CGCGCGAGCA TTCGGTCAAA CTTTAA
```

This corresponds to the amino acid sequence <SEQ ID 516; ORF 134.a>:

```
a134.pep
   1  MSQEILDQVR RRRTFAIISH PDAGKTTLTE KLLLFSGAIQ SAGTVKGKKT

51  GKFATSDWMD IEKQRGISVA SSVMQFDYKD HTVNLLDTPG HQDFSEDTYR

101  VLTAVDSALM VIDAAKGVEA QTIKLLNVCR LRNTPIVTFM NKYDREVRDS

151  LELLDEVENI LQIRCAPVTW PIGMGKNFKG VYHILNDEIY LFEAGGERLP

201  HEFDIIKGID NPELEQRFPL EIQQLRDEIE LVQAASNEFN LDEFLAGELT

251  PVFFGSAINN FGIQEILNSL IEWAPAPKPR DATVRMVEPD EPKFSGFIFK

301  IQANMDPKHR DRIAFLRVCS GKFERGMKMK HLRINREIAA SSVVTFMSHD

351  RELVEEAYAG DIIGIPNHGN IQIGDSFSEG EQLTFTGIPF FAPELFRSVR

401  IKNPLKIKQL QKGLQQLGEE GAVQVFKPMS GADLILGAVG VLQFEVVTSR

451  LANEYGVEAV FDNASIWSAR WVSCDDKKKL AEFEKANAGN LAIDAGGNLA

501  YLAPNRVNLG LTQERWPDIV FHETREHSVK L*
``` m134/a134 98.9% identity in 531 aa overlap

```
                    10         20         30         40         50         60
m134.pep   MSQEILDQVRRRRTFAIISHPDAGKTTLTEKLLLFSGAIQSAGTVKGKKTGKFATSDWME
           ||||||||||||||||||||||||||||||||||||||||||||||||||||||||||| :
a134       MSQEILDQVRRRRTFAIISHPDAGKTTLTEKLLLFSGAIQSAGTVKGKKTGKFATSDWMD
                    10         20         30         40         50         60
```

```
                       70        80        90       100       110       120
m134.pep   IEKQRGISVASSVMQFDYKDHTVNLLDTPGHQDFSEDTYRVLTAVDSALMVIDAAKGVEA
           ||||||||||||||||||||||||||||||||||||||||||||||||||||||||||||
a134       IEKQRGISVASSVMQFDYKDHTVNLLDTPGHQDFSEDTYRVLTAVDSALMVIDAAKGVEA
                       70        80        90       100       110       120

130       140       150       160       170       180
m134.pep   QTIKLLNVCRLRDTPIVTFMNKYDREVRDSLELLDEVENILKIRCAPVTWPIGMGKNFKG
           ||||||||||||:|||||||||||||||||||||||||||||:|||||||||||||||||
a134       QTIKLLNVCRLRNTPIVTFMNKYDREVRDSLELLDEVENILQIRCAPVTWPIGMGKNFKG
                      130       140       150       160       170       180

190       200       210       220       230       240
m134.pep   VYHILNDEIYLFEAGGERLPHEFDIIKGIDNPELEQRFPLEIQQLRDEIELVQAASNEFN
           ||||||||||||||||||||||||||||||||||||||||||||||||||||||||||||
a134       VYHILNDEIYLFEAGGERLPHEFDIIKGIDNPELEQRFPLEIQQLRDEIELVQAASNEFN
                      190       200       210       220       230       240

250       260       270       280       290       300
m134.pep   LDEFLAGELTPVFFGSAINNFGIQEILNSLIDWAPAPKPRDATVRMVEPDEPKFSGFIFK
           |||||||||||||||||||||||||||||||:||||||||||||||||||||||||||||
a134       LDEFLAGELTPVFFGSAINNFGIQEILNSLIEWAPAPKPRDATVRMVEPDEPKFSGFIFK
                      250       260       270       280       290       300

310       320       330       340       350       360
m134.pep   IQANMDPKHRDRIAFLRVCSGKFERGMKMKHLRINREIAASSVVTFMSHDRELVEEEAYAG
           ||||||||||||||||||||||||||||||||||||||||||||||||||||||||||||
a134       IQANMDPKHRDRIAFLRVCSGKFERGMKMKHLRINREIAASSVVTFMSHDRELVEEEAYAG
                      310       320       330       340       350       360

370       380       390       400       410       420
m134.pep   DIIGIPNHGNIQIGDSFSEGEQLAFTGIPFFAPELFRSVRIKNPLKIKQLQKGLQQLGEE
           ||||||||||||||||||||||||:|||||||||||||||||||||||||||||||||||
a134       DIIGIPNHGNIQIGDSFSEGEQLTFTGIPFFAPELFRSVRIKNPLKIKQLQKGLQQLGEE
                      370       380       390       400       410       420

430       440       450       460       470       480
m134.pep   GAVQVFKPMSGADLILGAVGVLQFEVVTSRLANEYGVEAVFDSASIWSARWVSCDDKKKL
           |||||||||||||||||||||||||||||||||||||||||:||||||||||||||||||
a134       GAVQVFKPMSGADLILGAVGVLQFEVVTSRLANEYGVEAVFDNASIWSARWVSCDDKKKL
                      430       440       450       460       470       480

490       500       510       520       530
m134.pep   AEFEKANAGNLAIDAGGNLAYLAPNRVNLGLTQERWPDIVFHETREHSVKLX
           |||||||||||||||||||||||||||||||||||||||||||||||||||
a134       AEFEKANAGNLAIDAGGNLAYLAPNRVNLGLTQERWPDIVFHETREHSVKLX
                      490       500       510       520       530
```

The following partial DNA sequence was identified in *N. gonorrhoeae* <SEQ ID 517>:

```
g135.seq
    1   ATGAAATACA AAAGAATCGT ATTTAAAGTC GGCACATCTT CGATTACCCG

51   TTCGGAcgGC AGCCTCTCGC GCGGCAAAAT CCAAACCATC ACCCGCCAGC

101   TTGCCGCATT GCATCATGCG GGACACGAGC TGGTCTTGGT GTCTTCCGGC

151   GCGGTTGCTG CAGGGTTCGG CGCGCTGGGT TTCAAAAAAC GTCCGGTCAA

201   AATCGCCGAC AAACAGGCTT CCGCCGCCGT CGGGCAGGGG CTGCTGATGG

251   AAGAATATAC GGCAAACCTG TCTTCAGACG GCATCGTGTC CGCACAAATC

301   CTGCTCAGCC GTGCCGACTT TGCCGACAAA CGCCGCTACC AAAATGCCGG

351   CGGCGCACTT TCCGTGCTGC TGCAACGCCG CGCGATTCCC ATCATCAATG

401   AAAACGACAC GGTTTCGGTT GAGGAGTTGA AAATCGGCGA CAACGACACA

451   TTGAGTGCGC AAGTGGCGGC GATGATACAG GCAGACCTCT TGGTGCTGCT

501   GACCGACATA GACGGTCTTT ACACCGGCAA CCCGAACAGC AATCCCGATG

551   CCGTACGGCT GGACAAAATC GAACACATCA ACCATGAAAT CATCGAAATG

601   GCGGGCGGCT CGGGTTCGGC AAACGGCACG GCGGTATGC TGACCAAAAT

651   CAAAGCGGCA ACCATCGCCG CCGAATCCGG CGTACCGGTG TATATCTGTT

701   CCTCACTCAA ACCCGATTCA TTGGCCGAAG CCGCCGAACA TCAGGCGGAC

751   GGCTCGTTTT TCGTcccCcg tgCCAAAGGT TTGCGGACAC AGAAGCAATG
```

```
    801   GctggCGTTC TATTCcgaaa gcggGGgcag cgttTAtgtg gacgaaagtg 851   cggaacacgc tTtgtccgaa caagggaaag cctgCTGA
```

This corresponds to the amino acid sequence <SEQ ID 518; ORF 135.ng>:

```
g135.pep
      1   MKYKRIVFKV GTSSITRSDG SLSRGKIQTI TRQLAALHHA GHELVLVSSG

51   AVAAGFGALG FKKRPVKIAD KQASAAVGQG LLMEEYTANL SSDGIVSAQI

101   LLSRADFADK RRYQNAGGAL SVLLQRRAIP IINENDTVSV EELKIGDNDT

151   LSAQVAAMIQ ADLLVLLTDI DGLYTGNPNS NPDAVRLDKI EHINHEIIEM

201   AGGSGSANGT GGMLTKIKAA TIAAESGVPV YICSSLKPDS LAEAAEHQAD

251   GSFFVPRAKG LRTQKQWLAF YSESGGSVYV DESAEHALSE QGKAC*
```

The following partial DNA sequence was identified in *N. meningitidis* <SEQ ID 519>:

```
m135.seq
      1   ATGAAATACA AAAGAATCGT ATTTAAAGTC GGCACATCTT CGATTACCCA

51   TTCGGACGGC AGTCTCTCGC GCGGCAAAAT CCAAACCATC ACCTGCCAGC

101   TTGCCGCATT GCATCATGCG GGACACGAGC TGGTCTTGGT GTCTTCCGGC

151   GCGGTTGCGG CAGGGTTCGG TGCGCTGGGT TTCAAAAAAC GTCCGGTCAA

201   AATCGCCGAC AAACAGGCTT CCGCCGCCGT CGGGCAGGGG CTGCTGATGG

251   AAGAATATAC GGCAAACCTG TCTTCAGACG GCATCGTGTC CGCGCAAATC

301   CTGCTCAGCC GCGCCGACTT TGCCGACAAA CGCCGCTACC AAAATGCCGG

351   CGGCGCACTT TCCGTGCTGC TGCAACGCCG CGCCGTCCCC ATCATCAATG

401   AAAACGATAC GGTTTCGGTT GAGGAATTGA AAATCGGCGA CAACGACACA

451   TTGAGTGCGC AAGTGGCGGC GATGATACAG GCAGACCTCT TGGTGCTGCT

501   GACCGACATA GACGGTCTTT ACACGGGCAA CCCGAACAGC AATCCCGATG

551   CCGTACGGCT GGACAAAATC GAACACATCA ACCATGAAAT CATCGAAATG

601   GCGGGCGGCT CGGGTTCGGC AAACGGCACG GCGGTATGC TGACCAAAAT

651   CAAAGCGGCA ACCATCGCCG CCGAATCCGG CGTACCGGTG TATATCTGTT

701   CCTCGCTCAA ACCCGATGCA CTTGCCGAAG CTGCCGAACA TCAGGCGGAC

751   GGCTCGTTTT TCGTCCCCCG TGCCAAAGGT TTGCGGACGC AGAAGCAATG

801   GCTGGCGTTC TATTCCGAAA GCCGGGGCAG CGTTTATGTG GACGAAGGTG

851   CGGAACACGC TTTGTCCGAA CAGGGGAAAA GCCTGCTGAT GTCGGGCATT

901   GCCGGAATCG AAGGGCATTT TTCCCGTATG GACACCGTAA CCGTGTACAG

951   CAAGGCAACC AAACAGCCCC TGGGCAAAGG GCGCGTCCTG TTCGGCTCTG

1001   CCGCCGCCGA AGACCTGCTC AAATCGCGTA AGGCGAAAGG CGTGTTCATC

1051   CATCGGGACG ACTGGATTTC CATCACGCCC GAAATACGCC TGCTTCTGAC

1101   CGAATTTTAG
```

This corresponds to the amino acid sequence <SEQ ID 520; ORF 135>:

```
m135.pep
    1   MKYKRIVFKV GTSSITHSDG SLSRGKIQTI TCQLAALHHA GHELVLVSSG

51   AVAAGFGALG FKKRPVKIAD KQASAAVGQG LLMEEYTANL SSDGIVSAQI

101   LLSRADFADK RRYQNAGGAL SVLLQRRAVP IINENDTVSV EELKIGDNDT

151   LSAQVAAMIQ ADLLVLLTDI DGLYTGNPNS NPDAVRLDKI EHINHEIIEM

201   AGGSGSANGT GGMLTKIKAA TIAAESGVPV YICSSLKPDA LAEAAEHQAD

251   GSFFVPRAKG LRTQKQWLAF YSESRGSVYV DEGAEHALSE QGKSLLMSGI

301   AGIEGHFSRM DTVTVYSKAT KQPLGKGRVL FGSAAAEDLL KSRKAKGVFI

351   HRDDWISITP EIRLLLTEF*
```

15

Computer analysis of this amino acid sequence gave the following results:
Homology with a Predicted ORF from *N. gonorrhoeae*
ORF 135 shows 97.6% identity over a 294 aa overlap with a predicted ORF (ORF 135.ng) from *N. gonorrhoeae*:

```
m135/g135
                    10         20         30         40         50         60
     m135.pep  MKYKRIVFKVGTSSITHSDGSLSRGKIQTITCQLAALHHAGHELVLVSSGAVAAGFGALG
               ||||||||||||||||:||||||||||||||||:|||||||||||||||||||||||||
     g135      MKYKRIVFKVGTSSITRSDGSLSRGKIQTITRQLAALHHAGHELVLVSSGAVAAGFGALG
                    10         20         30         40         50         60

70         80         90        100        110        120
     m135.pep  FKKRPVKIADKQASAAVGQGLLMEEYTANLSSDGIVSAQILLSRADFADKRRYQNAGGAL
               ||||||||||||||||||||||||||||||||||||||||||||||||||||||||||||
     g135      FKKRPVKIADKQASAAVGQGLLMEEYTANLSSDGIVSAQILLSRADFADKRRYQNAGGAL
                    70         80         90        100        110        120

130        140        150        160        170        180
     m135.pep  SVLLQRRAVPIINENDTVSVEELKIGDNDTLSAQVAAMIQADLLVLLTDIDGLYTGNPNS
               ||||||||:|||||||||||||||||||||||||||||||||||||||||||||||||||
     g135      SVLLQRRAIPIINENDTVSVEELKIGDNDTLSAQVAAMIQADLLVLLTDIDGLYTGNPNS
                   130        140        150        160        170        180

190        200        210        220        230        240
     m135.pep  NPDAVRLDKIEHINHEIIEMAGGSGSANGTGGMLTKIKAATIAAESGVPVYICSSLKPDA
               |||||||||||||||||||||||||||||||||||||||||||||||||||||||||||:
     g135      NPDAVRLDKIEHINHEIIEMAGGSGSANGTGGMLTKIKAATIAAESGVPVYICSSLKPDS
                   190        200        210        220        230        240

250        260        270        280        290        300
     m135.pep  LAEAAEHQADGSFFVPRAKGLRTQKQWLAFYSESRGSVYVDEGAEHALSEQGKSLLMSGI
               |||||||||||||||||||||||||||||||||||||:||||||:|||||||:
     g135      LAEAAEHQADGSFFVPRAKGLRTQKQWLAFYSESGGSVYVDESAEHALSEQGKACX
                   250        260        270        280        290

310        320        330        340        350        360
     m135.pep  AGIEGHFSRMDTVTVYSKATKQPLGKGRVLFGSAAAEDLLKSRKAKGVFIHRDDWISITP
```

The following partial DNA sequence was identified in *N. meningitidis* <SEQ ID 521>:

```
a135.seq
    1   ATGAAATACA AAAGAATCGT ATTTAAAGTC GGCACATCTT CGATTACCCA

51   TTCGGACGGC AGTCTCTCGC GCGGCAAAAT CCAAACCATC ACCCGCCAGC

101   TTGCCGCATT GCATCATGCG GGACACGAGC TGGTCTTGGT GTCTTCCGGC

151   GCGGTTGCGG CAGGGTTCGG TGCGCTGGGT TTCAAAAAAC GTCCGGTCAA

201   AATCGCCGAC AAACAGGCTT CCGCCGCCGT CGGGCAGGGG CTGCTGATGG

251   AAGAATATAC GGCAAACCTG TCTTCAGACG GCATCGTGTC CGCACAAATC

301   CTGCTCAGCC GCGCCGACTT TGCCGACAAA CGCCGCTACC AAAATGCCGG

351   CGGCGCACTT TCCGTGCTGC TGCAACGCCG CGCCGTCCCC ATCATCAATG

401   AAAACGATAC GGTTTCGGTT GAGGAATTGA AAATCGGCGA CAACGACACA
```

```
 451  TTGAGTGCGC AAGTGGCGGC GATGATACAG GCAGACCTCT TGGTGCTGCT

501  GACCGACATA GACGGTCTTT ACACCGGCAA CCCGAACAGC AATCCCGATG

551  CCGTACGGCT GGACAAAATC GAACACATCA ACCATGAAAT CATCGAAATG

601  GCGGGCGGCT CGGGTTCGGC AAACGGCACA GGCGGTATGC TGACTAAAAT

651  CAAAGCGGCG ACGATTGCGA CCGAGTCCGG CGTACCGGTC TATATCTGTT

701  CCTCGCTCAA ACCCGATGCA CTTGCCGAAG CGGCAGATAA TCAGGCGGAC

751  GGCTCGTTTT TCGTCCCCCG TGCCAAAGGT TTGCGGACGC AGAAGCAATG

801  GCTGGCGTTC TATTCCGAAA GCAGGGGCGG CGTTTATGTG GACGAAGGTG

851  CGGAACACGC TTTGTCCGAA CAGGGAAAAA GCCTGCTGAT GTCGGGCATT

901  GCCGGAATCG AAGGGCATTT TTCCCGTATG GACACCGTAA CCGTGTACAG

951  CAAGGCAACC AAACAGCCTT TGGGCAAAGG GCGAGTCCTG TTCGGCTCTG

1001  CCGCCGCCGA AGACCTGCTC AAATTGCGTA AGGCGAAAGG CGTGTTCATC

1051  CATCGGGACG ACTGGATTTC CATCACGCCC GAAATACGCC TGCTTCTGAC

1101  CGAATTTTAG
```

This corresponds to the amino acid sequence <SEQ ID 522; ORF 135.a>:

```
a135.pep
   1  MKYKRIVFKV GTSSITHSDG SLSRGKIQTI TRQLAALHHA GHELVLVSSG

51  AVAAGFGALG FKKRPVKIAD KQASAAVGQG LLMEEYTANL SSDGIVSAQI

101  LLSRADFADK RRYQNAGGAL SVLLQRRAVP IINENDTVSV EELKIGDNDT

151  LSAQVAAMIQ ADLLVLLTDI DGLYTGNPNS NPDAVRLDKI EHINHEIIEM

201  AGGSGSANGT GGMLTKIKAA TIATESGVPV YICSSLKPDA LAEAADNQAD

251  GSFFVPRAKG LRTQKQWLAF YSESRGGVYV DEGAEHALSE QGKSLLMSGI

301  AGIEGHFSRM DTVTVYSKAT KQPLGKGRVL FGSAAAEDLL KLRKAKGVFI

351  HRDDWISITP EIRLLLTEF*
``` m135/a135 98.4% identity in 369 aa overlap

```
                 10         20         30         40         50         60
m135.pep MKYKRIVFKVGTSSITHSDGSLSRGKIQTITCQLAALHHAGHELVLVSSGAVAAGFGALG
         ||||||||||||||||||||||||||||||| ||||||||||||||||||||||||||||
a135     MKYKRIVFKVGTSSITHSDGSLSRGKIQTITRQLAALHHAGHELVLVSSGAVAAGFGALG
                 10         20         30         40         50         60

70         80         90        100        110        120
m135.pep FKKRPVKIADKQASAAVGQGLLMEEYTANLSSDGIVSAQILLSRADFADKRRYQNAGGAL
         ||||||||||||||||||||||||||||||||||||||||||||||||||||||||||||
a135     FKKRPVKIADKQASAAVGQGLLMEEYTANLSSDGIVSAQILLSRADFADKRRYQNAGGAL
                 70         80         90        100        110        120

130        140        150        160        170        180
m135.pep SVLLQRRAVPIINENDTVSVEELKIGDNDTLSAQVAAMIQADLLVLLTDIDGLYTGNPNS
         ||||||||||||||||||||||||||||||||||||||||||||||||||||||||||||
a135     SVLLQRRAVPIINENDTVSVEELKIGDNDTLSAQVAAMIQADLLVLLTDIDGLYTGNPNS
                130        140        150        160        170        180

190        200        210        220        230        240
m135.pep NPDAVRLDKIEHINHEIIEMAGGSGSANGTGGMLTKIKAATIAAESGVPVYICSSLKPDA
         ||||||||||||||||||||||||||||||||||||||||||:|||||||||||||||||
a135     NPDAVRLDKIEHINHEIIEMAGGSGSANGTGGMLTKIKAATIATESGVPVYICSSLKPDA
                190        200        210        220        230        240

250        260        270        280        290        300
m135.pep LAEAAEHQADGSFFVPRAKGLRTQKQWLAFYSESRGSVYVDEGAEHALSEQGKSLLMSGI
         |||::|||||||||||||||||||||||||||||||:|||||||||||||||||||||||
a135     LAEAADNQADGSFFVPRAKGLRTQKQWLAFYSESRGGVYVDEGAEHALSEQGKSLLMSGI
                250        260        270        280        290        300
```

```
                      310        320        330        340        350        360
m135.pep  AGIEGHFSRMDTVTVYSKATKQPLGKGRVLFGSAAAEDLLKSRKAKGVFIHRDDWISITP
          |||||||||||||||||||||||||||||||||||||||| |||||||||||||||||||
a135      AGIEGHFSRMDTVTVYSKATKQPLGKGRVLFGSAAAEDLLKLRKAKGVFIHRDDWISITP
                      310        320        330        340        350        360
                      370
m135.pep  EIRLLLTEFX
          ||||||||||
a135      EIRLLLTEFX
                      370
```

The following partial DNA sequence was identified in *N. gonorrhoeae* <SEQ ID 523>:

```
g136.seq
     1    ATGGAAATCC GGTTTCAGAC AGCATTTTTA CGTTTGGTTC AGatgaAAAC

51    AAACGCTtca aTTCTtaccg caACACGCCT TGTATTTCCT GccgCTGCCG

101    CACGGACAGG GATCGTTCCT GCCGgtTTTT TCCCCTTCCC TGCGGACGGT

151    TTGCGGTTTG TTGATGACCG CCTGCCAGTA GCGGTAGATG TCtgccagcg 201    cgTAAGGCag tTCGGAcgca agttccgcca gctcgccttc ggTGAATTGC 251    AGgcggataa cgccgttttC CTCTTCGTCg taaatgccgc ccactgccat 301    cacgGGGTAA AACAGCTCTT CAAACGCTTC ATCATCGGCG GCTTCAAACC

351    AATCGGTCGG CACAATGTCC AAACCGTAAA GATAGGCGTT GCACCAAGTG

401    TAAAAATCGC TGCCGCCCTC GCCGTCGTCG TAGAGCCACA AATCGGGCAG

451    CTTTTTATCC GACATCGCGG CGGTTGTTTC CATCGCCATT GCCAAAACCA

501    GCCGTTCGAT TCGGAACGT TCGGCGGCGG TAAATTGCGA TTCGTCGCCC

551    AACACTTCGG GCAGCCAGTC GAGCGGTGCC AATTTGTCCG GCCCGCTCAA

601    CAGCGCCGTC ATAAAACCTT GAACCTCGTC GCAACGCATC GTGTTGCCTT

651    GTTCGCTTTT GGCATCCAAT AA
```

This corresponds to the amino acid sequence <SEQ ID 524; ORF 136.ng>:

```
g136.pep
     1    MEIRFQTAFL RLVQMKTNAS ILTATRLVFP AAAARTGIVP AGFFPFPADG

51    LRFVDDRLPV AVDVCQRVRQ FGRKFRQLAF GELQADNAVF LFVVNAAHCH

101    HGVKQLFKRF IIGGFKPIGR HNVQTVKIGV APSVKIAAAL AVVVEPQIGQ

151    LFIRHRGGCF HRHCQNQPFD FGTFGGGKLR FVAQHFGQPV ERCQFVRPAQ

201    QRRHKTLNLV ATHRVALFAF GIQ*
```

The following partial DNA sequence was identified in *N. meningitidis* <SEQ ID 525>:

```
m136.seq
     1    ATGGAAACAA ACGCTTCAAT TCTTACCGCA ACACGCCTTG TATTTCTGC

51    CGCTGCCGCA CGGACAGGGA TCGTTCCTGC CTGTTTTTTC GCCTTCCCTG

101    CGGACGGTTT GCGGTTTGTT GATGACTGCC TGCCAGTAGC GGTAGATATC

151    CGCCAATGCA TAAGGCAACT CGGATTCCAG TTCCGCCAGC TCGCCTTCTG

201    TGAATTGCAG ACGGATAGCG CCGTTTTCCT CTTCGTCGTA AATACCGCCC

251    AATGCCATGA TGGGATAAAA CAACTCTTCA AACGCTTCAT CATCGACGGC
```

```
301  TTCAAACCAA TCGGTCGGCA CAATATCCAA ACCGTAAAGA TAAGCATTGC

351  ACCATGTGTA AAAATCGCTG CCGCCGTCTT CGTTTTCATA CAGCCACAAA

401  TCGGGCAGTT TTTTATCCGA CATCGCGGCG GTTGTTTCCA TCGCCATTGC

451  CAAAACCAGC CGTTCGATTT CGGAACGTTC GGCGGCGGTA AATTGCGATT

501  CGTCGCCCAA CACTTCGGGC AGCCAGTCGA GCGGTGTCAA TTTGTCCGGC

551  CCGCTCAACA GCGCCGTCAT AAAACCTTGA ACCTCGTCGC AACGCATCGT

601  GTTGCCTTGT TCGCTTTTGG CATCCAACAA TTCGCTCAAC CGCCGTTTGG

651  ATGCTTCGGT AAATTTTCGG GAATCCATCA TTTTCCTTTT CAAATGGGTT

701  TTGCGCCCTA TTATCGCCGC AATGCCGTCT GA
```

This corresponds to the amino acid sequence <SEQ ID 526; ORF 136>:

```
m136.pep
    1  METNASILTA TRLVFSAAAA RTGIVPACFF AFPADGLRFV DDCLPVAVDI

51  RQCIRQLGFQ FRQLAFCELQ TDSAVFLFVV NTAQCHDGIK QLFKRFIIDG

101  FKPIGRHNIQ TVKISIAPCV KIAAAVFVFI QPQIGQFFIR HRGGCFHRHC

151  QNQPFDFGTF GGGKLRFVAQ HFGQPVERCQ FVRPAQQRRH KTLNLVATHR

201  VALFAFGIQQ FAQPPFGCFG KFSGIHHFPF QMGFAPYYRR NAV*
```

Computer analysis of this amino acid sequence gave the following results:
Homology with a Predicted ORF from *N. gonorrhoeae*
ORF 136 shows 85.6% identity over a 209 aa overlap with a predicted ORF (ORF 136.ng) from *N. gonorrhoeae*:

```
m136/g136
                         10         20         30         40
    m136.pep             METNASILTATRLVFSAAAARTGIVPACFFAFPADGLRFVDDCLPV
                         |:|||||||||||| ||||||||||| |||||||| |||||| ||
         g136  MEIRFQTAFLRLVQMKTNASILTATRLVFPAAAARTGIVPAGFFPFPADGLRFVDDRLPV
                         10         20         30         40         50         60

50         60         70         80         90        100
    m136.pep  AVDIRQCIRQLGFQFRQLAFCELQTDSAVFLFVVNTAQCHDGIKQLFKRFIIDGFKPIGR
              |||: |  :||:| :|||||||| |||:||||||||::|| |:||||||||||:||||||
         g136  AVDVCQRVRQFGRKFRQLAFGELQADNAVFLFVVNAAHCHHGVKQLFKRFIIGGFKPIGR
                 70         80         90        100        110        120

110        120        130        140        150        160
    m136.pep  HNIQTVKISIAPCVKIAAAVFVFIQPQIGQFFIRHRGGCFHRHCQNQPFDFGTFGGGKLR
              ||:|||||: ||  ||||||:|||:||||||||::||||||||||||||||||||||||
         g136  HNVQTVKIGVAPSVKIAAALAVVVEPQIGQLFIRHRGGCFHRHCQNQPFDFGTFGGGKLR
                130        140        150        160        170        180

170        180        190        200        210        220
    m136.pep  FVAQHFGQPVERCQFVRPAQQRRHKTLNLVATHRVALFAFGIQQFAQPPFGCFGKFSGIH
              ||||||||||||||||||||||||||||||||||||||||||||
         g136  FVAQHFGQPVERCQFVRPAQQRRHKTLNLVATHRVALFAFGIQX
                190        200        210        220

230        240
    m136.pep  HFPFQMGFAPYYRRNAVX
```

The following partial DNA sequence was identified in *N. meningitidis* <SEQ ID 527>:

```
a136.seq
    1  ATGGAAACAA ACGCTTCAAT TCTTACCGCA ACACGCCTTG TATTTTCTGC

51  CGCTGCCGCA CGGACAGGGA TCGTTCCTGC CTGTTTTTTC GCCTTCCCTG

101  CGGACGGTTT GCGGCTTGTT GATGACCGCC TGCCAGTAGC GGTAGATATC
```

```
-continued
151  CGCCAATGCA TAAGGCAACT CGGATTCCAG TTCCGCCAGC TCGCCTTCTG

201  TGAATTGCAG ACGGATAGTG CCGTTGTCCT CTTCGTCGTA AATACCGCCC

251  AATGCCATGA TGGGATAAAA CAACTCTTCA AACGCTTCAT CATCGACGGC

301  TTCAAACCAA TCGGTCGGCA CAATATCCAA ACCGTAAAGA TAAGCATTGC

351  ACCATGTGTA AAAATCGCTG CCGCCGTCTT CGTTTTCATA CAGCCACAAA

401  TCGGGCAGTT TTTTATCCGA CATCGCGGCG GTTGTTTCCA TCGCCATTGC

451  CAAAACCAGC CGTTCGATTT CGGAACGTTC GGCGGCGGTA AATTGCGATT

501  CGTCGCCCAA CACTTCGGGC AGCCAGTCGA GCGGTGTCAA TTTGTCCGGC

551  CCGCTCAACA GCGCCGTCAT AAAACCTTGA ACCTCGTCGC AACGCATCGT

601  GTTGCCTTGT TCGCTTTTGG CATCCAACAA TTCGCTCAAC CGCCGTTTGG

651  ATGCTTCGGT AAATTTTCGG GAATCCATCA TTTTCCTTTT CCAATGGGTT

701  TTGCGCCCTA TTATAGTGGA TTAAATTTAA ATCAGGACAA GGCGACGAAG

751  CCGCAGACAG TACAAATAGT ACGGCAAGGC GAGGCAACGC CGTACTGGTT

801  TAAATTTAAT CCACTATATC GCCGCAATGC CGTCTGA
```

This corresponds to the amino acid sequence <SEQ ID 528; ORF 136.a>:

```
a136.pep
  1  METNASILTA TRLVFSAAAA RTGIVPACFF AFPADGLRLV DDRLPVAVDI

51  RQCIRQLGFQ FRQLAFCELQ TDSAVVLFVV NTAQCHDGIK QLFKRFIIDG

101  FKPIGRHNIQ TVKISIAPCV KIAAAVFVFI QPQIGQFFIR HRGGCFHRHC

151  QNQPFDFGTF GGGKLRFVAQ HFGQPVERCQ FVRPAQQRRH KTLNLVATHR

201  VALFAFGIQQ FAQPPFGCFG KFSGIHHFPF PMGFAPYYSG LNLNQDKATK

251  PQTVQIVRQG EATPYWFKFN PLYRRNAV*
``` m136/a136 98.3% identity in 238 aa overlap

```
                 10         20         30         40         50         60
m136.pep METNASILTATRLVFSAAAARTGIVPACFFAFPADGLRFVDDCLPVAVDIRQCIRQLGFQ
         ||||||||||||||||||||||||||||||||||||||:|||  |||||||||||||||
a136     METNASILTATRLVFSAAAARTGIVPACFFAFPADGLRLVDDRLPVAVDIRQCIRQLGFQ
                 10         20         30         40         50         60

70         80         90        100        110        120
m136.pep FRQLAFCELQTDSAVFLFVVNTAQCHDGIKQLFKRFIIDGFKPIGRHNIQTVKISIAPCV
         |||||||||||||||  |||||||||||||||||||||||||||||||||||||||||
a136     FRQLAFCELQTDSAVVLFVVNTAQCHDGIKQLFKRFIIDGFKPIGRHNIQTVKISIAPCV
                 70         80         90        100        110        120

130        140        150        160        170        180
m136.pep KIAAAVFVFIQPQIGQFFIRHRGGCFHRHCQNQPFDFGTFGGGKLRFVAQHFGQPVERCQ
         ||||||||||||||||||||||||||||||||||||||||||||||||||||||||||
a136     KIAAAVFVFIQPQIGQFFIRHRGGCFHRHCQNQPFDFGTFGGGKLRFVAQHFGQPVERCQ
                130        140        150        160        170        180

190        200        210        220        230        240
m136.pep FVRPAQQRRHKTLNLVATHRVALFAFGIQQFAQPPFGCFGKFSGIHHFPFQMGFAPYYRR
         |||||||||||||||||||||||||||||||||||||||||||||||||| |||||||
a136     FVRPAQQRRHKTLNLVATHRVALFAFGIQQFAQPPFGCFGKFSGIHHFPFPMGFAPYYSG
                190        200        210        220        230        240 m136.pep NAVX a136     LNLNQDKATKPQTVQIVRQGEATPYWFKFNPLYRRNAVX
                250        260        270
```

The following partial DNA sequence was identified in *N. gonorrhoeae* <SEQ ID 529>:

```
g137.seq
    1   ATGATTATCC ATCACcaaTT CGATCCCGTC CTCATCAGTA TCGGCCCGCT
   51   TGCCGTCCGC TGGTATGCCT TAAGCTACAT CCTCGGATTT ATTCTTTTTA
  101   CCTTTCTCGG CAGAAGGCGC ATCGCGCAAG GCTTGTCCGT TTTTACCAAA
  151   GAATCGCTCG ACGACTTCCT GACATGGGGC ATTTTGGGCG TGATTTTGGG
  201   CGGACGCTTG GGCTATGTCC TGTTTTACAA ATTCTCCGAC TACCTCGCCC
  251   ATCCGCTTGA TATTTTCAAG GTATGGGAAG GCGGAATGTC GTTCCACGGC
  301   GGCTTTTTGG GTGTAGTTAT TGCCATATGG TTGTTCAGCC GCAAGCACGG
  351   CATCGGCTTC CTCAAACTGA TGGACACGGT CGCGCCGCTC GTTCCGCTGG
  401   GTCTCGCTTC GGGACGTATC GGCAACTTTA TCAACGGCGA ACTTTGGGGA
  451   CGCATTACCG ACATTAACGC ATTTTGGGCA ATGGGCTTCC CGCAAGCGCA
  501   TTACGAAGAT GCCGAAGCCG CCGCGCACAA TCCGCTTTGG GCAGAATGGC
  551   TGCAACAATA CGGTATGCTG CCGCGTCATC CCTCGCAGCT TTATCAGTTT
  601   GCCCTTGAAG GCATCTGCCT GTTCGCCGTC GTTTGGCTGT TTTCCAAAAA
  651   ACCGCGCCCG ACCGGGCAGA CTGCCGCGCT TTTTCTCGGC GGCTACGGCG
  701   TGTTCCGCTT TATTGCCGAA TTTGCGCGCC AACCCGACGA CTATCTCGGG
  751   CTGCTGACCT TGGGGCTGTC GATGGGGCAA TGGTTGAGCG TCCCGATGAT
  801   TGTTTTGGGT ATCGTCGGCT TTGTCCGGTT CGGCATGAAA AACAGCACT
  851   GA
```

This corresponds to the amino acid sequence <SEQ ID 530; ORF 137.ng>:

```
g137.pep
    1   MIIHHQFDPV LISIGPLAVR WYALSYILGF ILFTFLGRRR IAQGLSVFTK
   51   ESLDDFLTWG ILGVILGGRL GYVLFYKFSD YLAHPLDIFK VWEGGMSFHG
  101   GFLGVVIAIW LFSRKHGIGF LKLMDTVAPL VPLGLASGRI GNFINGELWG
  151   RITDINAFWA MGFPQAHYED AEAAAHNPLW AEWLQQYGML PRHPSQLYQF
  201   ALEGICLFAV VWLFSKKPRP TGQTAALFLG GYGVFRFIAE FARQPDDYLG
  251   LLTLGLSMGQ WLSVPMIVLG IVGFVRFGMK KQH*
```

The following partial DNA sequence was identified in *N. meningitidis* <SEQ ID 531>:

```
m137.seq
    1   ATGATTACCC ATCCCCAATT CGATCCCGTC CTTATCAGTA TCGGCCCGCT
   51   TGCCGTCCGC TGGTATGCCC TAAGCTACAT CCTCGGATTT ATTCTTTTTA
  101   CCTTTCTCGG CAGAAGGCGC ATCGCGCAAG GCTTGTCCGT TTTTACCAAA
  151   GAATCGCTCG ACGACTTCCT GACATGGGGC ATTTTGGGCG TAATTTTGGG
  201   CGGGCGTTTG GGTTACGTCC TGTTTTACAA GTTTTCCGAC TACCTCGCCC
  251   ATCCGCTTGA TATTTTCAAG GTATGGGAAG GCGGAATGTC GTTCCACGGC
  301   GGCTTTTTGG GTGTAGTTAT TGCCATACGG TTGTTCGGCC GCAAACACGG
  351   CATCGGCTTC CTCAAACTGA TGGATACGGT CGCACCGCTC GTTCCGCTGG
  401   GTCTCGCTTC GGGACGTATC GGCAACTTCA TCAACGGCGA ACTTTGGGGA
  451   CGCGTTACCG ACATCAACGC ATTTTGGGCA ATGGGCTTCC CGCAGGCGCG
```

-continued

```
501   TTACGAAGAT GCCGAAGCCG CCGCGCACAA TCCGCTTTGG GCAGAATGGC

551   TGCAACAATA CGGTATGCTG CCGCGTCATC CCTCGCAGCT TTATCAGTTT

601   GCACTTGAAG GCATCTGCCT GTTCACCGTC ATTTGGCTGT TCTCTAAAAA

651   ACAGCGGTCG ACCGGACAAG TCGCCTCGCT CTTCCTCGGC GGCTACGGCA

701   TATTCCGCTT CATTGCCGAA TTCGCACGCC AACCCGACGA CTATCTCGGG

751   CTGCTGACCT TGGGGCTGTC GATGGGGCAA TGGTTGAGCG TCCCGATGAT

801   TGTTTTGGGT ATCGTCGGCT TTGTCCGGTT CGGCATGAAA AAACAGCACT

851   GA
```

This corresponds to the amino acid sequence <SEQ ID 532; ORF 137>:

```
m137.pep
    1   MITHPQFDPV LISIGPLAVR WYALSYILGF ILFTFLGRRR IAQGLSVFTK

51   ESLDDFLTWG ILGVILGGRL GYVLFYKFSD YLAHPLDIFK VWEGGMSFHG

101   GFLGVVIAIR LFGRKHGIGF LKLMDTVAPL VPLGLASGRI GNFINGELWG

151   RVTDINAFWA MGFPQARYED AEAAAHNPLW AEWLQQYGML PRHPSQLYQF

201   ALEGICLFTV IWLFSKKQRS TGQVASLFLG GYGIFRFIAE FARQPDDYLG

251   LLTLGLSMGQ WLSVPMIVLG IVGFVRFGMK KQH*
```

Computer analysis of this amino acid sequence gave the following results:
Homology with a Predicted ORF from *N. gonorrhoeae*
ORF 137 shows 95.4% identity over a 283 aa overlap with a predicted ORF (ORF 137.ng) from *N. gonorrhoeae*:

```
m137/g137
                  10         20         30         40         50         60
    m137.pep  MITHPQFDPVLISIGPLAVRWYALSYILGFILFTFLGRRRIAQGLSVFTKESLDDFLTWG
              || | |||||||||||||||||||||||||||||||||||||||||||||||||||||||
        g137  MIIHHQFDPVLISIGPLAVRWYALSYILGFILFTFLGRRRIAQGLSVFTKESLDDFLTWG
                  10         20         30         40         50         60

70         80         90        100        110        120
    m137.pep  ILGVILGGRLGYVLFYKFSDYLAHPLDIFKVWEGGMSFHGGFLGVVIAIRLFGRKHGIGF
              |||||||||||||||||||||||||||||||||||||||||||||||||| ::||||||
        g137  ILGVILGGRLGYVLFYKFSDYLAHPLDIFKVWEGGMSFHGGFLGVVIAIWLFSRKHGIGF
                  70         80         90        100        110        120

130        140        150        160        170        180
    m137.pep  LKLMDTVAPLVPLGLASGRIGNFINGELWGRVTDINAFWAMGFPQARYEDAEAAAHNPLW
              ||||||||||||||||||||||||||||||||:||||||||||||||:||||||||||||
        g137  LKLMDTVAPLVPLGLASGRIGNFINGELWGRITDINAFWAMGFPQAHYEDAEAAAHNPLW
                 130        140        150        160        170        180

190        200        210        220        230        240
    m137.pep  AEWLQQYGMLPRHPSQLYQFALEGICLFTVIWLFSKKQRSTGQVASLFLGGYGIFRFIAE
              |||||||||||||||||||||||||||||:|:||||| | |||:|:||||||:||||||
        g137  AEWLQQYGMLPRHPSQLYQFALEGICLFAVVWLFSKKPRPTGQTAALFLGGYGVFRFIAE
                 190        200        210        220        230        240

250        260        270        280
    m137.pep  FARQPDDYLGLLTLGLSMGQWLSVPMIVLGIVGFVRFGMKKQHX
              ||||||||||||||||||||||||||||||||||||||||||||
        g137  FARQPDDYLGLLTLGLSMGQWLSVPMIVLGIVGFVRFGMKKQHX
                 250        260        270        280
```

The following partial DNA sequence was identified in *N. meningitidis* <SEQ ID 533>:

```
a137.seq
    1   ATGATTACCC ATCCCCAATT CGACCCCGTC CTTATCAGTA TCGGCCCGCT
   51   TGCCGTCCGC TGGTATGCCC TAAGCTACAT CCTCGGATTT ATTCTTTTTA
  101   CCTTTCTCGG CAGAAGGCGC ATCGCGCAAG GCTTGTCCGT TTTTACCAAA
  151   GAATCGCTCG ACGACTTCCT GACATGGGGC ATTTTGGGCG TAATTTTGGG
  201   CGGGCGTTTG GGTTACGTCC TGTTTTACAA GTTTTCCGAC TACCTCGCCC
  251   ATCCGCTTGA TATTTTCAAG GTATGGGAAG GCGGAATGTC GTTCCACGGC
  301   GGCTTTTTGG GTGTAGTTAT TGCCATATGG TTGTTCGGTC GCAAACACGG
  351   CATCGGCTTC CTCAAACTGA TGGACACGGT CGCACCGCTC GTTCCACTGG
  401   GTCTCGCTTC GGGACGTATC GGCAACTTCA TCAACGGCGA ACTTTGGGGA
  451   CGCGTTACCG ACATCAACGC ATTTTGGGCA ATGGGCTTCC CGCAGGCGCG
  501   TTACGAAGAC CTCGAAGCCG CCGCGCACAA TCCGCTTTGG GCAGAATGGC
  551   TGCAACAATA CGGTATGCTG CCGCGTCATC CCTCGCAGCT TTATCAGTTT
  601   GCACTTGAAG GCATCTGCCT GTTCGCCGTC GTTTGGCTGT CTCTAAAAA
  651   ACAGCGGCCG ACCGGACAAG TCGCCTCACT CTTCCTCGGC GGCTACGGCA
  701   TATTCCGCTT CATTGCCGAA TTTGCACGCC AACCCGACGA CTATCTCGGG
  751   CTGCTGACCT TGGGGCTGTC GATGGGGCAA TGGTTGAGCG TCCCGATGAT
  801   TGTTTTGGGT ATCGTCGGCT TTGTCCGGTT CGGCATGAAA AAACAGCACT
  851   GA
```

This corresponds to the amino acid sequence <SEQ ID 534; ORF 137.a>:

```
a137.pep
    1   MITHPQFDPV LISIGPLAVR WYALSYILGF ILFTFLGRRR IAQGLSVFTK
   51   ESLDDFLTWG ILGVILGGRL GYVLFYKFSD YLAHPLDIFK VWEGGMSFHG
  101   GFLGVVIAIW LFGRKHGIGF LKLMDTVAPL VPLGLASGRI GNFINGELWG
  151   RVTDINAFWA MGFPQARYED LEAAAHNPLW AEWLQQYGML PRHPSQLYQF
  201   ALEGICLFAV VWLFSKKQRP TGQVASLFLG GYGIFRFIAE FARQPDDYLG
  251   LLTLGLSMGQ WLSVPMIVLG IVGFVRFGMK KQH*
``` m137/a137 98.2% identity in 283 aa overlap

```
                 10         20         30         40         50         60
m137.pep  MITHPQFDPVLISIGPLAVRWYALSYILGFILFTFLGRRRIAQGLSVFTKESLDDFLTWG
          ||||||||||||||||||||||||||||||||||||||||||||||||||||||||||||
a137      MITHPQFDPVLISIGPLAVRWYALSYILGFILFTFLGRRRIAQGLSVFTKESLDDFLTWG
                 10         20         30         40         50         60

70         80         90        100        110        120
m137.pep  ILGVILGGRLGYVLFYKFSDYLAHPLDIFKVWEGGMSFHGGFLGVVIAIRLFGRKHGIGF
          |||||||||||||||||||||||||||||||||||||||||||||||||| |||||||||
a137      ILGVILGGRLGYVLFYKFSDYLAHPLDIFKVWEGGMSFHGGFLGVVIAIWLFGRKHGIGF
                 70         80         90        100        110        120

130        140        150        160        170        180
m137.pep  LKLMDTVAPLVPLGLASGRIGNFINGELWGRVTDINAFWAMGFPQARYEDAEAAAHNPLW
          |||||||||||||||||||||||||||||||||||||||||||||||||| |||||||||
a137      LKLMDTVAPLVPLGLASGRIGNFINGELWGRVTDINAFWAMGFPQARYEDLEAAAHNPLW
                130        140        150        160        170        180

190        200        210        220        230        240
m137.pep  AEWLQQYGMLPRHPSQLYQFALEGICLFTVIWLFSKKQRSTGQVASLFLGGYGIFRFIAE
          ||||||||||||||||||||||||||||:|:||||||||| |||||||||||||||||||
a137      AEWLQQYGMLPRHPSQLYQFALEGICLFAVVWLFSKKQRPTGQVASLFLGGYGIFRFIAE
                190        200        210        220        230        240
```

```
                        250        260        270        280
m137.pep    FARQPDDYLGLLTLGLSMGQWLSVPMIVLGIVGFVRFGMKKQHX
            |||||||||||||||||||||||||||||||||||||||||||
a137        FARQPDDYLGLLTLGLSMGQWLSVPMIVLGIVGFVRFGMKKQHX
                        250        260        270        280
```

The following partial DNA sequence was identified in *N. gonorrhoeae* <SEQ ID 535>:

```
g138.seq
     1   ATGGAGTTTG AAAACATTAT TCCGCCGCc gaCAAGGCGC GTATCCTTGC

51   CGAAGCACTG CCTTACAtcc gccgGTTTTC CGGTTCGGTC GCCGTCATCA

101   AGTATGGCGG CAACGCGATG ACCGAACCTG CCTTGAAAGA AGGGTTTGCC

151   CGCGATGTCG TGCTGCTGAA GCTGGTCGGC ATTCATCCCG TCATCGTTCA

201   CGGCGGCGGG CCGCAGATCA ATGCGATGCT TGAAAAAGTC GGCAAAAAGG

251   GCGAATTTGT CCAAGGAATG CGCGTTACCG ACAAAGAGAC GATGGATATT

301   GTCGAAATGG TATTGGGCGG GCACGTCAAC AAGGAAATCG TGTCGATGAT

351   TAACACATAT GGAGGGCACG CGGTCGGCGT GAGCGGGCGC GACGACCATT

401   TCATTAAGGC GAAGAAACTT TTGGTCGATA CGCCCGAACA GAATAGCGTG

451   GACATCGGAC AGGTCGGTAC GGTGGAAAGC ATCGATACCG GTTTGGTTAA

501   AGGGCTGATA GAACGCGGCT GCATTCCCGT CGTCGCCCCC GTCGGCGTAG

551   GTGAAAAAGG CGAAGCGTTC AACATCAACG CCGATTTGGT GGCAGGCAAA

601   TTGGCGGAAG AATTGAACGC CGAAAAACTC TTGATGATGA CGAAtatcgc 651   cgGTGTGATG GACAAAACGG GCAATCTGCT GACCAAACTC acgCCGAAAC

701   GGATTGATGG GCTGATTGCC GACGGCACGC TGTATGGCGG TATGCTGCCG

751   AAAATCGCTT CTGCGGTCGA AGCcgccgtc aACGGTGTGA AAGCCACGCA

801   CATCATCGAC GGCAGGTTGC CCAACGCGCT TTTGCTGGAA ATCTTTACCG

851   ATGCCGGTAT CGGGTCGATG ATTTTAGGCA GAGGGGAAGA TGCCTGA
```

This corresponds to the amino acid sequence <SEQ ID 536; ORF 138.ng>:

```
g138.pep
     1   MEFENIISAA DKARILAEAL PYIRRFSGSV AVIKYGGNAM TEPALKEGFA

51   RDVVLLKLVG IHPVIVHGGG PQINAMLEKV GKKGEFVQGM RVTDKETMDI

101   VEMVLGGHVN KEIVSMINTY GGHAVGVSGR DDHFIKAKKL LVDTPEQNSV

151   DIGQVGTVES IDTGLVKGLI ERGCIPVVAP VGVGEKGEAF NINADLVAGK

201   LAEELNAEKL LMMTNIAGVM DKTGNLLTKL TPKRIDGLIA DGTLYGGMLP

251   KIASAVEAAV NGVKATHIID GRLPNALLLE IFTDAGIGSM ILGRGEDA*
```

The following partial DNA sequence was identified in *N. meningitidis* <SEQ ID 537>:

```
m138.seq
     1   ATGGAGTCTG AAAACATTAT TCCGCCGCC GACAAGGCGC GTATCCTTGC

51   CGAAGCGCTG CCTTACATCC GCCGGTTTTC CGGTTCGGTC GCCGTCATCA

101   AATACGGCGG CAACGCGATG ACCGAACCTG CCTTGAAAGA AGGGTTTGCC

151   CGCGATGTCG TGCTGCTGAA GCTGGTCGGC ATTCATCCCG TCATCGTTCA
```

```
201  CGGCGGCGGG CCGCAGATCA ATGCGATGCT TGAAAAAGTC GGCAAAAAGG

251  GTGAGTTTGT CCAAGGAATG CGCGTTACCG ACAAAGAGGC GATGGATATT

301  GTCGAAATGG TGTTGGGCGG GCATGTCAAT AAAGAAATCG TGTCGATGAT

351  TAACACATAT GGCGGACACG CGGTCGGCGT AAGCGGACGC GACGACCATT

401  TCATTAAGGC GAAGAAACTT TTGATCGATA CGCCCGAACA GAATGGCGTG

451  GACATCGGAC AGGTCGGTAC GGTGGAAAGC ATCGATACCG GTTTGGTTAA

501  AGGGCTGATA GAACGTGGCT GCATTCCCGT CGTCGCCCCC GTCGGCGTAG

551  GTGAAAAAGG CGAAGCGTTC AACATCAACG CCGATTTGGT AGCAGGCAAA

601  TTGGCGGAAG AATTGAACGC CGAAAAACTC TTGATGATGA CGAATATCGC

651  CGGTGTGATG GACAAAACGG GCAATCTGCT GACCAAACTC ACGCCGAAAC

701  GGATTGATGA ACTGATTGCC GACGGCACGC TGTATGGCGG TATGCTGCCG

751  AAAATCGCTT CTGCGGTCGA AGCCGCCGTC AACGGTGTGA AGCCACGCA

801  TATCATCGAC GGCAGGTTGC CCAACGCGCT TTTGCTGGAA ATCTTTACCG

851  ATGCCGGTAT CGGTTCGATG ATTTTGGGCG GTGGGGAAGA TGCCTGA
```

This corresponds to the amino acid sequence <SEQ ID 538; ORF 138>:

```
m138.pep
    1  MESENIISAA DKARILAEAL PYIRRFSGSV AVIKYGGNAM TEPALKEGFA

51  RDVVLLKLVG IHPVIVHGGG PQINAMLEKV GKKGEFVQGM RVTDKEAMDI

101  VEMVLGGHVN KEIVSMINTY GGHAVGVSGR DDHFIKAKKL LIDTPEQNGV

151  DIGQVGTVES IDTGLVKGLI ERGCIPVVAP VGVGEKGEAF NINADLVAGK

201  LAEELNAEKL LMMTNIAGVM DKTGNLLTKL TPKRIDELIA DGTLYGGMLP

251  KIASAVEAAV NGVKATHIID GRLPNALLLE IFTDAGIGSM ILGGGEDA*
```

Computer analysis of this amino acid sequence gave the following results:
Homology with a Predicted ORF from *N. gonorrhoeae*
ORF 138 shows 98.0% identity over a 298 aa overlap with a predicted ORF (ORF 138.ng) from *N. gonorrhoeae*:

```
       m138/g138
                     10         20         30         40         50         60
       m138.pep  MESENIISAADKARILAEALPYIRRFSGSVAVIKYGGNAMTEPALKEGFARDVVLLKLVG
                 ||  |||||||||||||||||||||||||||||||||||||||||||||||||||||||
       g138      MEFENIISAADKARILAEALPYIRRFSGSVAVIKYGGNAMTEPALKEGFARDVVLLKLVG
                     10         20         30         40         50         60

70         80         90        100        110        120
       m138.pep  IHPVIVHGGGPQINAMLEKVGKKGEFVQGMRVTDKEAMDIVEMVLGGHVNKEIVSMINTY
                 |||||||||||||||||||||||||||||||||||||:||||||||||||||||||||||
       g138      IHPVIVHGGGPQINAMLEKVGKKGEFVQGMRVTDKETMDIVEMVLGGHVNKEIVSMINTY
                     70         80         90        100        110        120

130        140        150        160        170        180
       m138.pep  GGHAVGVSGRDDHFIKAKKLLIDTPEQNGVDIGQVGTVESIDTGLVKGLIERGCIPVVAP
                 ||||||||||||||||||||:||||||:||||||||||||||||||||||||||||||||
       g138      GGHAVGVSGRDDHFIKAKKLLVDTPEQNSVDIGQVGTVESIDTGLVKGLIERGCIPVVAP
                    130        140        150        160        170        180

190        200        210        220        230        240
       m138.pep  VGVGEKGEAFNINADLVAGKLAEELNAEKLLMMTNIAGVMDKTGNLLTKLTPKRIDELIA
                 |||||||||||||||||||||||||||||||||||||||||||||||||||||||||:||
       g138      VGVGEKGEAFNINADLVAGKLAEELNAEKLLMMTNIAGVMDKTGNLLTKLTPKRIDGLIA
                    190        200        210        220        230        240
```

```
               250        260        270        280        290      299
m138.pep   DGTLYGGMLPKIASAVEAAVNGVKATHIIDGRLPNALLLEIFTDAGIGSMILGGGEDAX
           ||||||||||||||||||||||||||||||||||||||||||||||||||| |||||
g138       DGTLYGGMLPKIASAVEAAVNGVKATHIIDGRLPNALLLEIFTDAGIGSMILGRGEDAX
               250        260        270        280        290
```

The following partial DNA sequence was identified in *N. meningitidis* <SEQ ID 539>:

```
a138.seq
    1   ATGGAGTCTG AAAACATTAT TCCGCCGCC GACAAGGCGC GTATCCTTGC

51   CGAAGCGCTG CCTTACATCC GCCGGTTTTC CGGTTCGGTC GCCGTCATCA

101   AATACGGCGG CAACGCGATG ACCGAACCTG CCTTGAAAGA AGGGTTTGCC

151   CGCGATGTCG TGCTGCTGAA GCTGGTCGGC ATTCATCCCG TCATCGTTCA

201   CGGCGGCGGG CCGCAGATCA ATGCGATGCT TGAAAAAGTC GGCAAAAAGG

251   GTGAGTTTGT CCAAGGAATG CGCGTTACCG ACAAAGAGGC GATGGATATT

301   GTCGAAATGG TGTTGGGCGG GCATGTCAAT AAAGAAATCG TGTCGATGAT

351   TAACACATAT GGCGGACACG CGGTCGGCGT AAGCGGACGC GACGACCATT

401   TCATTAAGGC GAAGAAACTT TTGATCGATA CGCCCGAACA GAATGGCGTG

451   GACATCGGAC AGGTCGGTAC GGTGGAAAGC ATCGATACCG GTTTGGTTAA

501   AGGGCTGATA GAACGTGGCT GCATTCCCGT CGTCGCCCCC GTCGGCGTAG

551   GTGAAAAAGG CGAAGCGTTC AACATCAACG CCGATTTGGT AGCAGGCAAA

601   TTGGCGGAAG AATTGAACGC CGAAAAACTC TTGATGATGA CGAATATCGC

651   CGGTGTGATG GACAAAACGG GCAATCTGCT GACCAAACTC ACGCCGAAAC

701   GGATTGATGA ACTGATTGCC GACGGCACGC TGTATGGCGG TATGCTGCCG

751   AAAATCGCTT CTGCGGTCGA AGCCGCCGTC AACGGCGTGA AGCCACGCA

801   TATCATCGAC GGCAGGGTGC CCAACGCGCT TTTGCTGGAA ATCTTTACCG

851   ATGCCGGTAT CGGTTCGATG ATTTTGGGCG GTGGGGAAGA TGCCTGA
```

This corresponds to the amino acid sequence <SEQ ID 540; ORF 138.a>:

```
a138.pep
    1   MESENIISAA DKARILAEAL PYIRRFSGSV AVIKYGGNAM TEPALKEGFA

51   RDVVLLKLVG IHPVIVHGGG PQINAMLEKV GKKGEFVQGM RVTDKEAMDI

101   VEMVLGGHVN KEIVSMINTY GGHAVGVSGR DDHFIKAKKL LIDTPEQNGV

151   DIGQVGTVES IDTGLVKGLI ERGCIPVVAP VGVGEKGEAF NINADLVAGK

201   LAEELNAEKL LMMTNIAGVM DKTGNLLTKL TPKRIDELIA DGTLYGGMLP

251   KIASAVEAAV NGVKATHIID GRVPNALLLE IFTDAGIGSM ILGGGEDA*
``` m138/a138 99.7% identity in 298 aa overlap

```
               10         20         30         40         50         60
m138.pep   MESENIISAADKARILAEALPYIRRFSGSVAVIKYGGNAMTEPALKEGFARDVVLLKLVG
           ||||||||||||||||||||||||||||||||||||||||||||||||||||||||||||
a138       MESENIISAADKARILAEALPYIRRFSGSVAVIKYGGNAMTEPALKEGFARDVVLLKLVG
               10         20         30         40         50         60
```

```
                 70         80         90        100        110        120
m138.pep  IHPVIVHGGGPQINAMLEKVGKKGEFVQGMRVTDKEAMDIVEMVLGGHVNKEIVSMINTY
          ||||||||||||||||||||||||||||||||||||||||||||||||||||||||||||
a138      IHPVIVHGGGPQINAMLEKVGKKGEFVQGMRVTDKEAMDIVEMVLGGHVNKEIVSMINTY
                 70         80         90        100        110        120

130        140        150        160        170        180
m138.pep  GGHAVGVSGRDDHFIKAKKLLIDTPEQNGVDIGQVGTVESIDTGLVKGLIERGCIPVVAP
          ||||||||||||||||||||||||||||||||||||||||||||||||||||||||||||
a138      GGHAVGVSGRDDHFIKAKKLLIDTPEQNGVDIGQVGTVESIDTGLVKGLIERGCIPVVAP
                130        140        150        160        170        180

190        200        210        220        230        240
m138.pep  VGVGEKGEAFNINADLVAGKLAEELNAEKLLMMTNIAGVMDKTGNLLTKLTPKRIDELIA
          ||||||||||||||||||||||||||||||||||||||||||||||||||||||||||||
a138      VGVGEKGEAFNINADLVAGKLAEELNAEKLLMMTNIAGVMDKTGNLLTKLTPKRIDELIA
                190        200        210        220        230        240

250        260        270        280        290     299
m138.pep  DGTLYGGMLPKIASAVEAAVNGVKATHIIDGRLPNALLLEIFTDAGIGSMILGGGEDAX
          |||||||||||||||||||||||||||||||||:||||||||||||||||||||||||
a138      DGTLYGGMLPKIASAVEAAVNGVKATHIIDGRVPNALLLEIFTDAGIGSMILGGGEDAX
                250        260        270        280        290
```

The following partial DNA sequence was identified in *N. gonorrhoeae* <SEQ ID 541>:

```
g139.seq
    1   ATGCGAACCA CCTCAACCTT CCCTACAAAA ACTTTCAAAC CGGCTGCCAT

51   GGCGTTAGCT GTTGCAACAA CACTTTCTGC CTGCTTAggc ggcggcggag 101   gcGGCACTTC TGCTCCCGAC TTTAATGCAG GCGGCACCGG TATCGGCAGC

151   AACAGCAGGG CAACGATAGC GGAATCAGCA GCAGTATCTT ACGCCGGTAT

201   AAAAAACGAA ATGTGCAAAG ACAGAAGCAT GCTCTGTGCC GGTCGGGATG

251   ACGTTGCGGT TACAGACAGG GATGCCAAAA TCAAAGCCCC CCGAATCTGC

301   ATACCGGAGA CTTTTCAAAC CCAAATGACC AATATTAAGA ATATGATCAA

351   CCTCAAACCT GCAATTGAAG CAGGCTATAC AGGACGCGGG GTAGAGGTAG

401   GTATCGTCGA TACAGGCGAA TCCGTCGGCA GCATATCCTT TCCCGAACTG

451   TATGGCAGAA AGAACACGG CTATAACGAA AATTACAAAA ACAAATTACA

501   AAAACTATAC GGCGTATATG CGGAAGGAAG CGCCTGA
```

This corresponds to the amino acid sequence <SEQ ID 542; ORF 138.ng>:

```
g139.pep
    1   MRTTSTFPTK TFKPAAMALA VATTLSACLG GGGGGTSAPD FNAGGTGIGS

51   NSRATIAESA AVSYAGIKNE MCKDRSMLCA GRDDVAVTDR DAKIKAPRIC

101   IPETFQTQMT NIKNMINLKP AIEAGYTGRG VEVGIVDTGE SVGSISFPEL

151   YGRKEHGYNE NYKNKLQKLY GVYAEGSA*
```

The following partial DNA sequence was identified in *N. meningitidis* <SEQ ID 543>:

```
m139.seq
    1   ATGCGAACGA CCCCAACCTT CCCTACAAAA ACTTTCAAAC CGACTGCCAT

51   GGCGTTAGCT GTTGCAACAA CACTTTCTGC CTGCTTAGGC GGCGGCGGAG

101   GCGGCACTTC TGCGCCCGAC TTCAATGCAG GCGGTACCGG TATCGGCAGC

151   AACAGCAGAG CAACAACAGC GAAATCAGCA GCAGTATCTT ACGCCGGTAT

201   CAAGAACGAA ATGTGCAAAG ACAGAAGCAT GCTCTGTGCC GGTCGGGATG
```

-continued

```
251  ACGTTGCGGT TACAGACAGG GATGCCAAAA TCAATGCCCC CCCCCGAATC

301  TGCATACCGG AGACTTTCCA AACCCAAATG ACGCATtACA AGAATTTGAT

351  CAACCTCAAA CCTGCAATTG AAGCAGGCTA TACAGGACGC GGGGTAGAGG

401  TAGGTATCGT CGACACAGGC GAATCCGTCG GCAGCATATC CTTTCCCGAA

451  CTGTATGGCA GAAAGAACA CGGCTATAAC GAAAATTACG AAAAACTATA

501  CGGCGTATAT GCGGAAGGAA GCGCCTGA
```

This corresponds to the amino acid sequence <SEQ ID 544; ORF 138>:

```
m139.pep
   1   MRTTPTFPTK TFKPTAMALA VATTLSACLG GGGGGTSAPD FNAGGTGIGS

51   NSRATTAKSA AVSYAGIKNE MCKDRSMLCA GRDDVAVTDR DAKINAPPRI

101   CIPETFQTQM THYKNLINLK PAIEAGYTGR GVEVGIVDTG ESVGSISFPE

151   LYGRKEHGYN ENYEKLYGVY AEGSA*
```

Computer analysis of this amino acid sequence gave the following results:
Homology with a Predicted ORF from *N. gonorrhoeae*
ORF 138 shows 92.2% identity over a 179 aa overlap with a predicted ORF (ORF 138.ng) from *N. gonorrhoeae*:

```
    m139/g139
                10         20         30         40         50         60
    m139.pep  MRTTPTFPTKTFKPTAMALAVATTLSACLGGGGGGTSAPDFNAGGTGIGSNSRATTAKSA
              ||||  |||||||||||:||||||||||||||||||||||||||||||||||| |:||
    g139      MRTTSTFPTKTFKPAAMALAVATTLSACLGGGGGGGTSAPDFNAGGTGIGSNSRATIAESA
                10         20         30         40         50         60

70         80         90        100        110        120
    m139.pep  AVSYAGIKNEMCKDRSMLCAGRDDVAVTDRDAKINAPPRICIPETFQTQMTHYKNLINLK
              |||||||||||||||||||||||||||||||||||:|| ||||||||||||: ||:||||
    g139      AVSYAGIKNEMCKDRSMLCAGRDDVAVTDRDAKIKAP-RICIPETFQTQMTNIKNMINLK
                70         80         90        100        110

130        140        150        160        170
    m139.pep  PAIEAGYTGRGVEVGIVDTGESVGSISFPELYGRKEHGYNENY----EKLYGVYAEGSAX
              ||||||||||||||||||||||||||||||||||||||||||||    :|||||||||||
    g139      PAIEAGYTGRGVEVGIVDTGESVGSISFPELYGRKEHGYNENYKNKLQKLYGVYAEGSAX
               120        130        140        150        160        170
```

The following partial DNA sequence was identified in *N. meningitidis* <SEQ ID 545>:

```
a139.seq
   1  ATGCGAACGA CCCCAACCTT CCCTACAAAA ACTTTCAAAC CGGCTGCCAT

51  GGCGTTAGCT GTTGCAACAA CACTTTCTGC CTGCTTAGGC GGCGGCGGAG

101  GCGGCACTTC TGCGCCCGAC TTCAATGCAG GCGGCACCGG TATCGGCAGC

151  AACAGCAGGG CAACAACAGC GAAATCAGCA GCAATATCTT ACGCCGGTAT

201  CAAGAACGAA ATGTGCAAAG ACAGAAGCAT GCTCTGTGCC GGTCGGGATG

251  ACGTTGCGGT TACAGACAGG GATGCCAAAA TCAATGCCCC CCCCCGAATC

301  TGCATACCGG AGACTTTACA AACCCAAATG ACGCAT.ACA AGAATTTGAT

351  CAACCTCAAA CCTGCAATTG AAGCAGGCTA TACAGGACGC GGGGTAGAGG

401  TAGGTATCGT CGACACAGGC GAATCCGTCG GCAGCATATC CTTTCCCGAA
```

-continued

```
   451  CTGTATGGCA GAAAAGAACA CGGCTATAAC GAAAATTAC. AAAAACTATA

501  CGGCGTATAT GCGGAAGGAA GCGCCTGA
```

This corresponds to the amino acid sequence <SEQ ID 546; ORF 139.a>:

```
a139.pep
     1  MRTTPTFPTK TFKPAAMALA VATTLSACLG GGGGGTSAPD FNAGGTGIGS

51  NSRATTAKSA AISYAGIKNE MCKDRSMLCA GRDDVAVTDR DAKINAPPRI

101  CIPETLQTQM THXKNLINLK PAIEAGYTGR GVEVGIVDTG ESVGSISFPE

151  LYGRKEHGYN ENYXKLYGVY AEGSA*
``` m139/a139 97.1% identity in 175 aa overlap

```
                  10         20         30         40         50         60
    m139.pep  MRTTPTFPTKTFKPTAMALAVATTLSACLGGGGGGTSAPDFNAGGTGIGSNSRATTAKSA
              ||||||||||||||:||||||||||||||||||||||||||||||||||||||||||||
    a139      MRTTPTFPTKTFKPAAMALAVATTLSACLGGGGGGTSAPDFNAGGTGIGSNSRATTAKSA
                  10         20         30         40         50         60

70         80         90        100        110        120
    m139.pep  AVSYAGIKNEMCKDRCMLCAGRDDVAVTDRDAKINAPPRICIPETFQTQMTHYKNLINLK
              |:||||||||||||||||||||||||||||||||||||||||||||:||||| ||||||
    a139      AISYAGIKNEMCKDRCMLCAGRDDVAVTDRDAKINAPPRICIPETLQTQMTHXKNLINLK
                  70         80         90        100        110        120

130        140        150        160        170
    m139.pep  PAIEAGYTGRGVEVGIVDTGESVGSISFPELYGRKEHGYNENYEKLYGVYAEGSAX
              ||||||||||||||||||||||||||||||||||||||||||||:||||||||||
    a139      PAIEAGYTGRGVEVGIVDTGESVGSISFPELYGRKEHGYNENYXKLYGVYAEGSAX
                 130        140        150        160        170
```

The following partial DNA sequence was identified in *N. gonorrhoeae* <SEQ ID 547>:

```
g140.seq
     1  Atgtcggcac gCGGCAAGGG GGCAGgctat ctcAACAGTA CCGGACGACa

51  TGTTCCCTTC CTGAGTGCCG CCAAAATCGG GCAGGATTAT TCTTTCTTCA

101  AAAATATCAA AACCGACGGC GGTCTGCTGG CTTCCCTCGA CAGCGTCGAA

151  AAAACAGCGG GCAGTGAAGG CGACACGCCG TCCTATTATG TCCGTCGCGG

201  CAATGCGGCA CGGACTGCTT CGGCAGCGGC ACATTCCGCG CCCGCCGGTC

251  TGAAACACGC CGTAGAACAG GGCGGCAGCA ATCGGAAAA CCTGATGGTC

301  GAGCTGGATG CCTCCGAATC ATCCGCAACA CCCGAGACGG TTGAAACTGC

351  GGTCGCCGAC CGCACAGATA TGCCGGGCAT CCGCCTACGG CGCACAACTT

401  TCCGCACAGC GGCAGCCGTA CAGCATGCGA ATACCGCCGA CGGCGTACGc 451  aTCTTcaaCA GTCTCGCCGC TAccgTCTAt GccgACAGTG CCGCCGCCCA 501  TGccgATATG CAGGGACGCC GCCTGAAAGC CGTATCGGAC GGGTTGGACC

551  ACAACGGTAC GGGTCTGCGC GTCATCGCGC AAACCCAACA GGACGGTGGA

601  ACGTGGGAAC AGGGCGGTGT CGAAGGCAAA ATGCGCGGCA GTACCCAAAC

651  TATCGGCATT GCCGCGAAAA CCGGCGAAAA TACGACAGCA GCCGCCACAC

701  TGGGCATAGG ACGCAGCACA TGGAGCGAAA ACAGTGCAAA TGCAAAAACC

751  GACAGCATTA GTCTGTTTGC AGGCATACGG CACGATGTGG GCGATATCGG

801  CTATCTCAAA GGCCTGTTCT CctaCGGACG CTACAAAAAC AGCATCAGCC
```

-continued

```
 851   GCAGCACCGG TGCGGATGAA TATGCGGAAG GCAGCGTCAA CGGCACGCTG

901   ATGCAGCTGG GCGCACTGGG TGGTGTCAAC GTTCCGTTTG CCGCAACGGG

951   AGATTTGACG GTTGAAGGCG GTCTGCGCCA CGACCTGCTC AAACAGGATG

1001   CATTCGCCGA AAAAGGCagt GCTTTGGGCT GGAGCGGCAA CAGCCTCACT

1051   GAAGGCACAC TGGTCGGACT CGCGGGTCTG AAACTGTCGC AACCCTTGAG

1101   CGATAAAGCC GTCCTGTCTG CGACGGCGGG CGTGGAACGC GACCTGAACG

1151   GACGCGACTA CGCGGTAACG GGCGGCTTTA CCGGCGCGGC TGCAGCAACC

1201   GGCAAGACGG GTGCACGCAA TATGCCGCAC ACCCGCCGGG TTGCCGGTCT

1251   GGGGGTGGAT GTCGAATTCG GCAACGGCTG GAACGGCTTG GCACGTTACA

1301   GCTACACCGG TTCCAAACAG TACGGCAACC ACAGCGGACA AATCGGCGTA

1351   GGCTACCGGT TCTGA
```

This corresponds to the amino acid sequence <SEQ ID 548; ORF 140.ng>:

```
g140.pep
  1   MSARGKGAGY LNSTGRHVPF LSAAKIGQDY SFFKNIKTDG GLLASLDSVE

51   KTAGSEGDTP SYYVRRGNAA RTASAAAHSA PAGLKHAVEQ GGSNLENLMV

101   ELDASESSAT PETVETAVAD RTDMPGIRLR RTTFRTAAAV QHANTADGVR

151   IFNSLAATVY ADSAAAHADM QGRRLKAVSD GLDHNGTGLR VIAQTQQDGG

201   TWEQGGVEGK MRGSTQTIGI AAKTGENTTA AATLGIGRST WSENSANAKT

251   DSISLFAGIR HDVGDIGYLK GLFSYGRYKN SISRSTGADE YAEGSVNGTL

301   MQLGALGGVN VPFAATGDLT VEGGLRHDLL KQDAFAEKGS ALGWSGNSLT

351   EGTLVGLAGL KLSQPLSDKA VLSATAGVER DLNGRDYAVT GGFTGAAAAT

401   GKTGARNMPH TRRVAGLGVD VEFGNGWNGL ARYSYTGSKQ YGNHSGQIGV

451   GYRF*
```

The following partial DNA sequence was identified in *N. meningitidis* <SEQ ID 549>:

```
m140.seq
  1   ATGTCGGCAC GCGGCAAGGG GGCAGGCTAT CTCAACAGTA CCGGACGACG

51   TGTTCCCTTC CTGAGTGCCG CCAAAATCGG GCAGGATTAT TCTTTCTTCA

101   CAAACATCGA AACCGACGGC GGCCTGCTGG CTTCCCTCGA CAGCGTCGAA

151   AAAACAGCGG GCAGTGAAGG CGACACGCTG TCCTATTATG TCCGTCGCGG

201   CAATGCGGCA CGGACTGCTT CGGCAGCGGC ACATTCCGCG CCCGCCGGTC

251   TGAAACACGC CGTAGAACAG GGCGGCAGCA ATCTGGAAAA CCTGATGGTC

301   GAACTGGATG CCTCCGAATC ATCCGCAACA CCCGAGACGG TTGAAACTGC

351   GGCAGCCGAC CGCACAGATA TGCCGGGCAT CCGCCCCTAC GGCGCAACTT

401   TCCGCGCAGC GGCAGCCGTA CAGCATGCGA ATGCCGCCGA CGGTGTACGC

451   ATCTTCAACA GTCTCGCCGC TACCGTCTAT GCCGACAGTA CCGCCGCCCA

501   TGCCGATATG CAGGGACGCC GCCTGAAAGC CGTATCGGAC GGGTTGGACC

551   ACAACGGCAC GGGTCTGCGC GTCATCGCGC AAACCCAACA GGACGGTGGA

601   ACGTGGGAAC AGGGCGGTGT TGAAGGCAAA ATGCGCGGCA GTACCCAAAC
```

```
 651  CGTCGGCATT GCCGCGAAAA CCGGCGAAAA TACGACAGCA GCCGCCACAC

701  TGGGCATGGG ACGCAGCACA TGGAGCGAAA ACAGTGCAAA TGCAAAAACC

751  GACAGCATTA GTCTGTTTGC AGGCATACGG CACGATGCGG GCGATATCGG

801  CTATCTCAAA GGCCTGTTCT CCTACGGACG CTACAAAAAC AGCATCAGCC

851  GCAGCACCGG TGCGGACGAA CATGCGGAAG GCAGCGTCAA CGGCACGCTG

901  ATGCAGCTGG GCGCACTGGG CGGTGTCAAC GTTCCGTTTG CCGCAACGGG

951  AGATTTGACG GTCGAAGGCG GTCTGCGCTA CGACCTGCTC AAACAGGATG

1001  CATTCGCCGA AAAAGGCAGT GCTTTGGGCT GGAGCGGCAA CAGCCTCACT

1051  GAAGGCACGC TGGTCGGACT CGCGGGTCTG AAGCTGTCGC AACCCTTGAG

1101  CGATAAAGCC GTCCTGTTTG CAACGGCGGG CGTGGAACGC GACCTGAACG

1151  GACGCGACTA CACGGTAACG GGCGGCTTTA CCGGCGCGAC TGCAGCAACC

1201  GGCAAGACGG GGGCACGCAA TATGCCGCAC ACCCGTCTGG TTGCCGGCCT

1251  GGGCGCGGAT GTCGAATTCG GCAACGGCTG GAACGGCTTG GCACGTTACA

1301  GCTACGCCGG TTCCAAACAG TACGGCAACC ACAGCGGACG AGTCGGCGTA

1351  GGCTACCGGT TCTGA
```

This corresponds to the amino acid sequence <SEQ ID 550; ORF 140>:

```
m140.pep
   1  MSARGKGAGY LNSTGRRVPF LSAAKIGQDY SFFTNIETDG GLLASLDSVE

51  KTAGSEGDTL SYYVRRGNAA RTASAAAHSA PAGLKHAVEQ GGSNLENLMV

101  ELDASESSAT PETVETAAAD RTDMPGIRPY GATFRAAAAV QHANAADGVR

151  IFNSLAATVY ADSTAAHADM QGRRLKAVSD GLDHNGTGLR VIAQTQQDGG

201  TWEQGGVEGK MRGSTQTVGI AAKTGENTTA AATLGMGRST WSENSANAKT

251  DSISLFAGIR HDAGDIGYLK GLFSYGRYKN SISRSTGADE HAEGSVNGTL

301  MQLGALGGVN VPFAATGDLT VEGGLRYDLL KQDAFAEKGS ALGWSGNSLT

351  EGTLVGLAGL KLSQPLSDKA VLFATAGVER DLNGRDYTVT GGFTGATAAT

401  GKTGARNMPH TRLVAGLGAD VEFGNGWNGL ARYSYAGSKQ YGNHSGRVGV

451  GYRF*
```

Computer analysis of this amino acid sequence gave the following results:
Homology with a Predicted ORF from *N. gonorrhoeae*
ORF 140 shows 94.5% identity over a 454 aa overlap with a predicted ORF (ORF 140.ng) from *N. gonorrhoeae*:

```
m140/g140
                 10         20         30         40         50         60
   m140.pep  MSARGKGAGYLNSTGRRVPFLSAAKIGQDYSFFTNIETDGGLLASLDSVEKTAGSEGDTL
             |||||||||||||||||||:||||||||||||||||| ||:|||||||||||||||||||
       g140  MSARGKGAGYLNSTGRHVPFLSAAKIGQDYSFFKNIKTDGGLLASLDSVEKTAGSEGDTP
                 10         20         30         40         50         60

70         80         90        100        110        120
   m140.pep  SYYVRRGNAARTASAAAHSAPAGLKHAVEQGGSNLENLMVELDASESSATPETVETAAAD
             ||||||||||||||||||||||||||||||||||||||||||||||||||||||||||:||
       g140  SYYVRRGNAARTASAAAHSAPAGLKHAVEQGGSNLENLMVELDASESSATPETVETAVAD
                 70         80         90        100        110        120
```

-continued

```
                     130       140       150       160       170       180
m140.pep      RTDMPGIRPYGATFRAAAAVQHANAADGVRIFNSLAATVYADSTAAHADMQGRRLKAVSD
              ||||||||   :|||:||||||||:||||||||||||||||||:||||||||||||||||
g140          RTDMPGIRLRRTTFRTAAAVQHANTADGVRIFNSLAATVYADSAAAHADMQGRRLKAVSD
                     130       140       150       160       170       180

190       200       210       220       230       240
m140.pep      GLDHNGTGLRVIAQTQQDGGTWEQGGVEGKMRGSTQTVGIAAKTGENTTAAATLGMGRST
              |||||||||||||||||||||||||||||||||||||:|||||||||||||||||:||||
g140          GLDHNGTGLRVIAQTQQDGGTWEQGGVEGKMRGSTQTIGIAAKTGENTTAAATLGIGRST
                     190       200       210       220       230       240

250       260       270       280       290       300
m140.pep      WSENSANAKTDSISLFAGIRHDAGDIGYLKGLFSYGRYKNSISRSTGADEHAEGSVNGTL
              ||||||||||||||||||||||:|||||||||||||||||||||||||||:|||||||||
g140          WSENSANAKTDSISLFAGIRHDVGDIGYLKGLFSYGRYKNSISRSTGADEYAEGSVNGTL
                     250       260       270       280       290       300

310       320       330       340       350       360
m140.pep      MQLGALGGVNVPFAATGDLTVEGGLRYDLLKQDAFAEKGSALGWSGNSLTEGTLVGLAGL
              ||||||||||||||||||||||||||:|||||||||||||||||||||||||||||||||
g140          MQLGALGGVNVPFAATGDLTVEGGLRHDLLKQDAFAEKGSALGWSGNSLTEGTLVGLAGL
                     310       320       330       340       350       360

370       380       390       400       410       420
m140.pep      KLSQPLSDKAVLFATAGVERDLNGRDYTVTGGFTGATAATGKTGARNMPHTRLVAGLGAD
              |||||||||||| ||||||||||||||:||||||||:||||||||||||||| |||||:|
g140          KLSQPLSDKAVLSATAGVERDLNGRDYAVTGGFTGAAAATGKTGARNMPHTRRVAGLGVD
                     370       380       390       400       410       420

430       440       450
m140.pep      VEFGNGWNGLARYSYAGSKQYGNHSGRVGVGYRFX
              |||||||||||||||:||||||||||::|||||||
g140          VEFGNGWNGLARYSYTGSKQYGNHSGQIGVGYRFX
                     430       440       450
```

The following partial DNA sequence was identified in *N. meningitidis* <SEQ ID 551>:

```
a140.seq
     1  ATGTCGGCAG GCGGTAAGGG GGCAGGCTAT CTCAACCGTA CCGGACAACG

51  TGTTCCCTTC CTGAGTGCCG CCAAAATCGG GCGGGATTAT TCTTTCTTCA

101  CAAACATCGA AACCGACGGC GGTCTGCTGG CTTCCCTCGA CAGCGTCGAA

151  AAAACAGCGG GTAGTGAAGG CGACACGCTG TCCTATTATG TCCGTCGCGG

201  CAATGCGGCA CGGACTGCTT CGGCAGCGGC ACATTCCGCG CCCGCCGGTC

251  TGAAACACGC CGTAGAACAG GGCGGCAGCA ATCTGGAAAA CCTGATGGTC

301  GAACTGGATG CCTCCGAATC ATCCGCAACA CCCGAGACGG TTGAAACTGC

351  GGCCGCCGAC CGCACAGATA TGCCGGGCAT CCGCCCCTAC GGCGCAACTT

401  TCCGCGCAGC GGCAGCCGTA CAGCATGCGA ATGCCGCCGA CGGTGTACGC

451  ATCTTCAACA ATCTCGCCGC TACCGTCTAT GCCGACAGTA CCGCCGCCCA

501  TGCCGATATG CAGGGACGCC GCCTGAAAGC CGTATCGGAC GGGTTGGACC

551  ACAACGCTAC GGGTCTGCGC GTCATCGCGC AAACCCAACA GGACGGTGGA

601  ACGTGGGAAC AGGGCGGTGT TGAAGGCAAA ATGCGCGGCA GTACCCAAAC

651  CGTCGGCATT GCCGCGAAAA CCGGCGAAAA TACGACAGCA GCCGCCACAC

701  TGGGCATGGG ACACAGCACA TGGAGCGAAA ACAGTGCAAA TGCAAAAACC

751  GACAGCATTA GTCTGTTTGC AGGCATACGG CACGATGCGG GCGATATCGG

801  CTATCTCAAA GGCCTGTTCT CCTACGGACG CTACAAAAAC AGCATCAGCC

851  GCAGCACCGG TGCGGACGAA CATGCGGAAG GCAGCGTCAA CGGCACGCTG

901  ATGCAGCTGG GCGCACTGGG CGGTGTCAAC GTTCCGTTTG CCGCAACGGG

951  AGATTTGACG GTCGAAGGCG GTCTGCGCTA CGACCTGCTC AAACAGGATG

1001  CATTCGCCGA AAAAGGCAGT GCTTTGGGCT GGAGCGGCAA CAGCATCACT
```

```
-continued
1051  GAAGGCACAC TGGTCGGACT CGCGGGTCTG AAGCTGTCGC AACCCTTGAG

1101  CGATAAAGCC GTCCTGTTTG CAACGGCGGG CGTGGAACGC GACCTGAACG

1151  GACGCGACTA CACGGTAACG GGCGGCTTTA CCGGCGCGAC TGCAGCAACC

1201  GGCAAGACGG GGGCACGCAA TATGCCGCAC ACCCGCCTGG TTGCCGGTCT

1251  GGGCGCGGAT GTCGAATTCG GCAACGGCTG GAACGGCTTG GCACGTTACA

1301  GCTACGCCGG TTCCAAACAG TACGGCAACC ACAGCGGACG AGTCGGCGTA

1351  GGCTACCGGT TCTGA
```

This corresponds to the amino acid sequence <SEQ ID 552; ORF 140.a>:

```
a140.pep
   1  MSAGGKGAGY LNRTGQRVPF LSAAKIGRDY SFFTNIETDG GLLASLDSVE

51  KTAGSEGDTL SYYVRRGNAA RTASAAAHSA PAGLKHAVEQ GGSNLENLMV

101  ELDASESSAT PETVETAAAD RTDMPGIRPY GATFRAAAAV QHANAADGVR

151  IFNNLAATVY ADSTAAHADM QGRRLKAVSD GLDHNATGLR VIAQTQQDGG

201  TWEQGGVEGK MRGSTQTVGI AAKTGENTTA AATLGMGHST WSENSANAKT

251  DSISLFAGIR HDAGDIGYLK GLFSYGRYKN SISRSTGADE HAEGSVNGTL

301  MQLGALGGVN VPFAATGDLT VEGGLRYDLL KQDAFAEKGS ALGWSGNSIT

351  EGTLVGLAGL KLSQPLSDKA VLFATAGVER DLNGRDYTVT GGFTGATAAT

401  GKTGARNMPH TRLVAGLGAD VEFGNGWNGL ARYSYAGSKQ YGNHSGRVGV

451  GYRF*
``` m140/a140 98.2% identity in 454 aa overlap

```
                 10         20         30         40         50         60
m140.pep MSARGKGAGYLNSTGRRVPFLSAAKIGQDYSFFTNIETDGGLLASLDSVEKTAGSEGDTL
         ||| ||||||||| || |||||||||| :||||||||||||||||||||||||||||||
a140     MSAGGKGAGYLNRTGQRVPFLSAAKIGRDYSFFTNIETDGGLLASLDSVEKTAGSEGDTL
                 10         20         30         40         50         60

70         80         90        100        110        120
m140.pep SYYVRRGNAARTASAAAHSAPAGLKHAVEQGGSNLENLMVELDASESSATPETVETAAAD
         ||||||||||||||||||||||||||||||||||||||||||||||||||||||||||||
a140     SYYVRRGNAARTASAAAHSAPAGLKHAVEQGGSNLENLMVELDASESSATPETVETAAAD
                 70         80         90        100        110        120

130        140        150        160        170        180
m140.pep RTDMPGIRPYGATFRAAAAVQHANAADGVRIFNSLAATVYADSTAAHADMQGRRLKAVSD
         ||||||||||||||||||||||||||||||||:|||||||||||||||||||||||||||
a140     RTDMPGIRPYGATFRAAAAVQHANAADGVRIFNSLAATVYADSTAAHADMQGRRLKAVSD
                130        140        150        160        170        180

190        200        210        220        230        240
m140.pep GLDHNGTGLRVIAQTQQDGGTWEQGGVEGKMRGSTQTVGIAAKTGENTTAAATLGMGRST
         |||||:||||||||||||||||||||||||||||||||||||||||||||||||||:||
a140     GLDHNATGLRVIAQTQQDGGTWEQGGVEGKMRGSTQTVGIAAKTGENTTAAATLGMGHST
                190        200        210        220        230        240

250        260        270        280        290        300
m140.pep WSENSANAKTDSISLFAGIRHDAGDIGYLKGLFSYGRYKNSISRSTGADEHAEGSVNGTL
         ||||||||||||||||||||||||||||||||||||||||||||||||||||||||||||
a140     WSENSANAKTDSISLFAGIRHDAGDIGYLKGLFSYGRYKNSISRSTGADEHAEGSVNGTL
                250        260        270        280        290        300

310        320        330        340        350        360
m140.pep MQLGALGGVNVPFAATGDLTVEGGLRYDLLKQDAFAEKGSALGWSGNSLTEGTLVGLAGL
         ||||||||||||||||||||||||||||||||||||||||||||||||:|||||||||||
a140     MQLGALGGVNVPFAATGDLTVEGGLRYDLLKQDAFAEKGSALGWSGNSITEGTLVGLAGL
                310        320        330        340        350        360

370        380        390        400        410        420
m140.pep KLSQPLSDKAVLFATAGVERDLNGRDYTVTGGFTGATAATGKTGARNMPHTRLVAGLGAD
         ||||||||||||||||||||||||||||||||||||||||||||||||||||||||||||
a140     KLSQPLSDKAVLFATAGVERDLNGRDYTVTGGFTGATAATGKTGARNMPHTRLVAGLGAD
                370        380        390        400        410        420
```

```
                           430        440        450
    m140.pep   VEFGNGWNGLARYSYAGSKQYGNHSGRVGVGYRFX
               ||||||||||||||||||||||||||||||||||
    a140       VEFGNGWNGLARYSYAGSKQYGNHSGRVGVGYRFX
                           430        440        450
```

The following partial DNA sequence was identified in *N. gonorrhoeae* <SEQ ID 553>:

```
g141.seq
    1    atgagcttca aAAccgATGC CGAAACCGCC CAATCCTCCA CCATGCGCCC
   51    GATTGGCGAA ATTGCCGCCA AGCTGGGTTT GAACGTTGAC AACATTGAGC
  101    CTTACGGTCA TTACAAAGCC AAAATCAATC CTGCCGAAGC GTTCAAGCTG
  151    CCGCAAAAAC AAGGCAGGCT GATTTTGGTT ACCGCCATCA ACCCGACTCC
  201    GGCGGGCGAA GGCAAAACCA CCGTAACCAT CGGTTTGGCG GACGCATTGC
  251    GCCATATCGG CAAAGACTCT GTGATTGCTT TGCGCGAGCC TTCTTTGGGT
  301    CCGGTGTTCG GCGTGAAAGG CGGCGCGGCA GGCGGCGGCT ACGCGCAAGT
  351    TTTGCCGATG GAAGACATCA ACCTGCACTT CACCGGCGAC TTCCACGCCA
  401    TCGGTGCGGC GAATAACCTC CTCGCCGCCA TGCTCGACAA CCATATCTAC
  451    CAAGGTAACG AGTTGAACAT CGACCCCAAA CGCGTGCTGT GGCGGCGCGT
  501    GGTCGATATG AACGACCGCC AGTTGCGCAA CATCATCGAC GGTATGGGCA
  551    AGCCTGTtga cggCGTGATG CGtcccGACG GCTTCGACAT CACCGTCGCC
  601    TCCGAAGTGa tggcgGTATT CTGCCTTGCC AAAGACATCA GCGATTTGAA
  651    AGAGCGTTtt gGCAATATTC TCGTCGCCTA CGCCAAAGAC GGCAGCCCCG
  701    TTTACGCCAA AGATTTGAAG GCACACGGCG CGATGGCGGC ATTGCTAAAA
  751    GATGCGATTA AGCCCAATTT GGTGCAAACC ATCGAAGGCA CTCCGGCCTT
  801    TGTACACGGC GGCCCGTTCG CCAACATCGC CCACGGCTGC AACTCCGTTA
  851    CCGCAACCCG TCTGGCGAAA CACCTTGCCG ATTACGCCGT AACCGAAGCA
  901    GGCTTCGGCG CGGACTTGGG TGCGGAAAAA TTCTGCGACA TCAAATGCCG
  951    CCTTGCCGGT TTGAAACCTG ATGCGGCAGT CGTCGTGGCG ACTGTCCGCG
 1001    CCCTGAAATA CAACGGCGGC GTGGAACGCG CCAACCTTGG TGAAGAAAAC
 1051    CTCGAAGCCT TGGCAAAAGG TTTGCCCAAC CTGTTGAAAC ACATTTCCAA
 1101    CCTGAAAAAC GTATTCGGAC TGCCCGTCGT CGTTGCGCTC AACCGCTTCG
 1151    TGTCCGACTC CGATGCCGAG TTGGCGATGA TTGAAAAAGC CTGTGCCGAA
 1201    CACGGCGTTG AAGTTTCCCT GACCGAAGTG TGGGGCAAAG GCGGCGCGGG
 1251    CGGCGCGGAT TGGCGCGCA AAGTCGTCAA TGCCATCGAC AACCAACCTA
 1301    ATAACTTCGG TTTCGCCTAC GATGTCGAGT TGGGCATCAA AGACAAAATC
 1351    CGTGCGATTG CCCAAAAAGT GTACGGCGCG GAAGATGTCG ATTTCAGCGC
 1401    GGAAGCGTCT GCCGAAATCG CCTCGCTGGA AAAACTGGGC TTGGACAAAA
 1451    TGCCGATCTG CATGGCGAAA ACCCAATATT CATTGAGCGA CAACGCCAAA
 1501    CTCTTGGGCT GCCCCGAAGG CTTCCGCATC GCCGTACGCG GTATCACTGT
 1551    TTCCGCCGGC GCGGGCTTCA TCGTTGCGTT GTGCGGCAAT ATGATGAAAA
 1601    TGCCGGGCCT GCCGAAAGTT CCGGCTGCCG AGAAAATCGA TGTGGACGAA
 1651    CACGGCGTGA TTCACGGCTT GTTCTGA
```

This corresponds to the amino acid sequence <SEQ ID 554; ORF 141.ng>:

```
g141.pep
     1  MSFKTDAETA QSSTMRPIGE IAAKLGLNVD NIEPYGHYKA KINPAEAFKL
    51  PQKQGRLILV TAINPTPAGE GKTTVTIGLA DALRHIGKDS VIALREPSLG
   101  PVFGVKGGAA GGGYAQVLPM EDINLHFTGD FHAIGAANNL LAAMLDNHIY
   151  QGNELNIDPK RVLWRRVVDM NDRQLRNIID GMGKPVDGVM RPDGFDITVA
   201  SEVMAVFCLA KDISDLKERF GNILVAYAKD GSPVYAKDLK AHGAMAALLK
   251  DAIKPNLVQT IEGTPAFVHG GPFANIAHGC NSVTATRLAK HLADYAVTEA
   301  GFGADLGAEK FCDIKCRLAG LKPDAAVVVA TVRALKYNGG VERANLGEEN
   351  LEALAKGLPN LLKHISNLKN VFGLPVVVAL NRFVSDSDAE LAMIEKACAE
   401  HGVEVSLTEV WGKGGAGGAD LARKVVNAID NQPNNFGFAY DVELGIKDKI
   451  RAIAQKVYGA EDVDFSAEAS AEIASLEKLG LDKMPICMAK TQYSLSDNAK
   501  LLGCPEGFRI AVRGITVSAG AGFIVALCGN MMKMPGLPKV PAAEKIDVDE
   551  HGVIHGLF*
```

The following partial DNA sequence was identified in *N. meningitidis* <SEQ ID 555>:

```
m141.seq
     1  ATGAGCTTCA AAACCGATGC CGAAATCGCC CAATCCTCCA CCATGCGCCC
    51  GATTGGCGAA ATTGCCGCCA AGCTTGGTCT GAATGCCGAC AACATTGAGC
   101  CTTACGGTCA TTACAAGGCG AAAATCAATC CTGCCGAAGC GTTCAAACTG
   151  CCGCAAAAAC AGGGCAGGCT GATTTTGGTT ACCGCCATCA ACCCGACTCC
   201  GGCGGGCGAA GGCAAAACCA CCGTAACCAT CGGTTTGGCG GACGCGTTGC
   251  GCCACATCGG CAAAGATGCC GTGATTGCCC TGCGCGAACC TTCTCTGGGG
   301  CCGGTGTTCG GCGTGAAAGG CGGCGCGGCA GGCGGCGGCT ATGCCCAAGT
   351  TTTGCCGATG GAAGACATCA ACCTGCACTT CACCGGAGAT TTTCACGCCA
   401  TCGGTGCGGC AAATAATCTG CTTGCCGCGA TGCTCGACAA CCATATCTAC
   451  CAAGGCAACG AGTTGAACAT CGACCCCAAA CGCGTGCTGT GGCGGCGCGT
   501  GGTCGATATG AACGACCGCC AGTTGCGCAA CATCATCGAC GGCATGGGTA
   551  AACCCGTTGA CGGCGTGATG CGTCCTGACG GTTTCGATAT TACCGTTGCT
   601  TCCGAAGTGA TGGCGGTATT CTGTCTTGCC AAAGACATCA GCGATTTGAA
   651  AGAGCGTTTG GGCAACATCC TTGTCGCCTA CGCCAAAGAC GGCAGCCCCG
   701  TTTACGCCAA AGATTTGAAA GCGAATGGCG CGATGGCGGC ATTGCTTAAA
   751  GATGCGATTA AGCCCAACTT GGTGCAAACC ATCGAAGGCA CGCCCGCCTT
   801  CGTACACGGC GGCCCGTTCG CCAACATCGC CCACGGCTGC AACTCCGTAA
   851  CCGCAACCCG TCTGGCGAAA CACCTTGCCG ATTACGCCGT AACCGAAGCA
   901  GGCTTCGGCG CGGACTTGGG CGCGGAAAAA TTCTGCGACA TCAAATGCCG
   951  CCTTGCCGGT TTGAAACCTG ATGCGGCTGT TGTCGTGGCG ACTGTCCGCG
  1001  CGTTGAAATA TAACGGCGGC GTGGAACGCG CCAACCTCGG CGAAGAAAAT
  1051  TTAGACGCTT TGGAAAAAGG TTTGCCCAAC CTGCTGAAAC ACATTTCCAA
  1101  CCTGAAAAAC GTATTCGGAC TGCCCGTCGT CGTTGCGCTC AACCGCTTCG
```

-continued

```
1151  TGTCCGACGC CGATGCCGAG TTGGCGATGA TTGAAAAAGC CTGTGCCGAA

1201  CACGGCGTTG AAGTTTCCCT GACCGAAGTG TGGGGCAAAG GTGGTGCGGG

1251  CGGCGCGGAT TTGGCGCGCA AAGTCGTCAA CGCCATTGAA AGTCAAACCA

1301  ATAACTTCGG TTTCGCCTAC GATGTCGAGT TGGGCATCAA AGACAAAATC

1351  CGTGCGATTG CCCAAAAAGT GTACGGCGCG GAAGATGTTG ATTTCAGCGC

1401  GGAAGCGTCT GCCGAAATCG CTTCACTGGA AAAACTGGGC TTGGACAAAA

1451  TGCCGATCTG CATGGCGAAA ACCCAATACT CTTTGAGCGA CAACGCCAAA

1501  CTGTTGGGCT GCCCCGAAGA CTTCCGCATC GCCGTGCGCG GCATCACCGT

1551  TTCCGCAGGC GCAGGTTTCA TCGTCGCCCT GTGCGGCAAC ATGATGAAAA

1601  TGCCCGGCCT GCCCAAAGTT CCGGCTGCCG AGAAAATCGA TGTGGACGCA

1651  GAAGGCGTGA TTCACGGCTT GTTCTGA
```

This corresponds to the amino acid sequence <SEQ ID 556; ORF 141>:

```
m141.pep
   1  MSFKTDAEIA QSSTMRPIGE IAAKLGLNAD NIEPYGHYKA KINPAEAFKL

51  PQKQGRLILV TAINPTPAGE GKTTVTIGLA DALRHIGKDA VIALREPSLG

101  PVFGVKGGAA GGGYAQVLPM EDINLHFTGD FHAIGAANNL LAAMLDNHIY

151  QGNELNIDPK RVLWRRVVDM NDRQLRNIID GMGKPVDGVM RPDGFDITVA

201  SEVMAVFCLA KDISDLKERL GNILVAYAKD GSPVYAKDLK ANGAMAALLK

251  DAIKPNLVQT IEGTPAFVHG GPFANIAHGC NSVTATRLAK HLADYAVTEA

301  GFGADLGAEK FCDIKCRLAG LKPDAAVVVA TVRALKYNGG VERANLGEEN

351  LDALEKGLPN LLKHISNLKN VFGLPVVVAL NRFVSDADAE LAMIEKACAE

401  HGVEVSLTEV WGKGGAGGAD LARKVVNAIE SQTNNFGFAY DVELGIKDKI

451  RAIAQKVYGA EDVDFSAEAS AEIASLEKLG LDKMPICMAK TQYSLSDNAK

501  LLGCPEDFRI AVRGITVSAG AGFIVALCGN MMKMPGLPKV PAAEKIDVDA

551  EGVIHGLF*
```

Computer analysis of this amino acid sequence gave the following results:
Homology with a Predicted ORF from *N. gonorrhoeae*
ORF 141 shows 97.5% identity over a 558 aa overlap with a predicted ORF (ORF 141.ng) from *N. gonorrhoeae*:

```
m141/g141
                 10         20         30         40         50         60
   m141.pep  MSFKTDAEIAQSSTMRPIGEIAAKLGLNADNIEPYGHYKAKINPAEAFKLPQKQGRLILV
             |||||||| ||||||||||||||||||||:||||||||||||||||||||||||||||||
       g141  MSFKTDAETAQSSTMRPIGEIAAKLGLNVDNIEPYGHYKAKINPAEAFKLPQKQGRLILV
                 10         20         30         40         50         60

70         80         90        100        110        120
   m141.pep  TAINPTPAGEGKTTVTIGLADALRHIGKDAVIALREPSLGPVFGVKGGAAGGGYAQVLPM
             ||||||||||||||||||||||||||||||:|||||||||||||||||||||||||||||
       g141  TAINPTPAGEGKTTVTIGLADALRHIGKDSVIALREPSLGPVFGVKGGAAGGGYAQVLPM
                 70         80         90        100        110        120

130        140        150        160        170        180
   m141.pep  EDINLHFTGDFHAIGAANNLLAAMLDNHIYQGNELNIDPKRVLWRRVVDMNDRQLRNIID
             ||||||||||||||||||||||||||||||||||||||||||||||||||||||||||||
       g141  EDINLHFTGDFHAIGAANNLLAAMLDNHIYQGNELNIDPKRVLWRRVVDMNDRQLRNIID
                130        140        150        160        170        180
```

-continued

```
                    190        200        210        220        230        240
m141.pep    GMGKPVDGVMRPDGFDITVASEVMAVFCLAKDISDLKERLGNILVAYAKDGSPVYAKDLK
            |||||||||||||||||||||||||||||||||||||||:||||||||||||||||||||
g141        GMGKPVDGVMRPDGFDITVASEVMAVFCLAKDISDLKERFGNILVAYAKDGSPVYAKDLK
                    190        200        210        220        230        240

250        260        270        280        290        300
m141.pep    ANGAMAALLKDAIKPNLVQTIEGTPAFVHGGPFANIAHGCNSVTATRLAKHLADYAVTEA
            |:||||||||||||||||||||||||||||||||||||||||||||||||||||||||||
g141        AHGAMAALLKDAIKPNLVQTIEGTPAFVHGGPFANIAHGCNSVTATRLAKHLADYAVTEA
                    250        260        270        280        290        300

310        320        330        340        350        360
m141.pep    GFGADLGAEKFCDIKCRLAGLKPDAAVVVATVRALKYNGGVERANLGEENLDALEKGLPN
            |||||||||||||||||||||||||||||||||||||||||||||||||||:|| |||||
g141        GFGADLGAEKFCDIKCRLAGLKPDAAVVVATVRALKYNGGVERANLGEENLEALAKGLPN
                    310        320        330        340        350        360

370        380        390        400        410        420
m141.pep    LLKHISNLKNVFGLPVVVALNRFVSDADAELAMIEKACAEHGVEVSLTEVWGKGGAGGAD
            ||||||||||||||||||||||||||:|||||||||||||||||||||||||||||||||
g141        LLKHISNLKNVFGLPVVVALNRFVSDSDAELAMIEKACAEHGVEVSLTEVWGKGGAGGAD
                    370        380        390        400        410        420

430        440        450        460        470        480
m141.pep    LARKVVNAIESQTNNFGFAYDVELGIKDKIRAIAQKVYGAEDVDFSAEASAEIASLEKLG
            |||||||||::| |||||||||||||||||||||||||||||||||||||||||||||||
g141        LARKVVNAIDNQPNNFGFAYDVELGIKDKIRAIAQKVYGAEDVDFSAEASAEIASLEKLG
                    430        440        450        460        470        480

490        500        510        520        530        540
m141.pep    LDKMPICMAKTQYSLSDNAKLLGCPEDFRIAVRGITVSAGAGFIVALCGNMMKMPGLPKV
            |||||||||||||||||||||||||| |||||||||||||||||||||||||||||||||
g141        LDKMPICMAKTQYSLSDNAKLLGCPEGFRIAVRGITVSAGAGFIVALCGNMMKMPGLPKV
                    490        500        510        520        530        540

550       559
m141.pep    PAAEKIDVDAEGVIHGLFX
            ||||||||| :||||||||
g141        PAAEKIDVDEHGVIHGLFX
                    550
```

The following partial DNA sequence was identified in *N. meningitidis* <SEQ ID 557>:

```
a141.seq
      1  ATGAGTTTCA AAACCGATGC CGAAATCGCC CAATCCTCCA CCATGCGCCC

51  GATTGGCGAA ATTGCCGCCA AGCTGGGTTT GAACGTTGAC AACATTGAGC

101  CTTACGGTCA TTACAAAGCC AAAATCAATC CTGCCGAAGC GTTCAAACTG

151  CCGCAAAAAC AGGGCAGGCT GATTTTGGTT ACCGCCATCA ACCCGACTCC

201  GGCGGGCGAA GGTAAAACCA CCGTAACCAT CGGTTTGGCG GACGCATTGC

251  GCCATATCGG CAAAGACTCT GTGATTGCTT TGCGCGAGCC TTCTTTGGGT

301  CCGGTGTTCG GCGTGAAAGG CGGCGCGGCA GGCGGCGGCT ATGCCCAAGT

351  TTTGCCGATG GAAGACATCA ACCTGCACTT CACCGGAGAT TTTCACGCCA

401  TCGGTGCGGC AAATAATCTG CTTGCCGCGA TGCTCGACAA CCATATCTAC

451  CAAGGCAACG AGTTGAACAT CGACCCCAAA CGCGTGCTGT GGCGGCGCGT

501  GGTCGATATG AACGACCGCC AGTTGCGCAA CATCATCGAC GGCATGGGCA

551  AGCCTGTTGA CGGCGTGATG CGTCCTGACG GTTTCGATAT TACCGTTGCT

601  TCCGAAGTGA TGGCGGTATT CTGTCTTGCC AAAGACATCA GCGATTTGAA

651  AGAGCGTTTG GGCAACATCC TTGTCGCCTA CGCCAAAGAC GGCAGCCCCG

701  TTTACGCCAA AGATTTGAAA GCGAATGGCG CGATGGCGGC ATTGCTTAAA

751  GATGCGATTA AGCCCAACTT GGTGCAAACC ATCGAAGGCA CGCCCCGCCTT

801  CGTACACGGC GGCCCGTTCG CCAACATCGC CCACGGCTGC AACTCCGTAA

851  CCGCAACCCG TCTGGCGAAA CACCTTGCCG ATTACGCCGT AACCGAAGCA

901  GGCTTCGGCG CGGACTTGGG CGCGGAAAAA TTCTGCGACA TCAAATGCCG
```

-continued

```
 951   CCTTGCCGGT TTGAAACCTG ATGCGGCTGT TGTCGTGGCG ACTGTCCGCG
1001   CGTTGAAATA TAACGGCGGC GTGGAACGCG CCAACCTCGG CGAAGAAAAT
1051   TTAGACGCTT TGGAAAAAGG TTTGCCCAAC CTGCTGAAAC ACATTTCCAA
1101   CCTGAAAAAC GTATTCGGAC TGCCCGTCGT CGTTGCGCTC AACCGCTTCG
1151   TGTCCGACTC CGATGCCGAG TTGGCGATGA TTGAAAAAGC CTGTGCCGAA
1201   CACGGCGTTG AAGTTTCCCT GACCGAAGTG TGGGGCAAAG GTGGTGCGGG
1251   CGGCGCGGAT TTGGCGCGCA AAGTCGTCAA CGCCATTGAA AGTCAAACCA
1301   ATAACTTCGG TTTCGCCTAC GATGTCGAGT TGGGCATCAA AGACAAAATC
1351   CGTGCGATTG CCCAAAAAGT GTACGGCGCG GAAGATGTTG ATTTCAGCGC
1401   GGAAGCGTCT GCCGAAATCG CTTCACTGGA AAAACTGGGC TTGGACAAAA
1451   TGCCGATCTG CATGGCGAAA ACCCAATACT CTTTGAGCGA CAACGCCAAA
1501   CTGTTGGGCT GCCCCGAAGA CTTCCGCATC GCCGTGCGCG GCATCACCGT
1551   TTCCGCAGGC GCAGGTTTCA TCGTCGCCCT GTGCGGCAAC ATGATGAAAA
1601   TGCCCGGCCT GCCCAAAGTT CCGGCTGCCG AGAAAATCGA TGTGGACGCA
1651   GAAGGCGTGA TTCACGGCTT GTTCTGA
```

This corresponds to the amino acid sequence <SEQ ID 558;
ORF 141.a>:

```
a141.pep
  1   MSFKTDAEIA QSSTMRPIGE IAAKLGLNVD NIEPYGHYKA KINPAEAFKL
 51   PQKQGRLILV TAINPTPAGE GKTTVTIGLA DALRHIGKDS VIALREPSLG
101   PVFGVKGGAA GGGYAQVLPM EDINLHFTGD FHAIGAANNL LAAMLDNHIY
151   QGNELNIDPK RVLWRRVVDM NDRQLRNIID GMGKPVDGVM RPDGFDITVA
201   SEVMAVFCLA KDISDLKERL GNILVAYAKD GSPVYAKDLK ANGAMAALLK
251   DAIKPNLVQT IEGTPAFVHG GPFANIAHGC NSVTATRLAK HLADYAVTEA
301   GFGADLGAEK FCDIKCRLAG LKPDAAVVVA TVRALKYNGG VERANLGEEN
351   LDALEKGLPN LLKHISNLKN VFGLPVVVAL NRFVSDSDAE LAMIEKACAE
401   HGVEVSLTEV WGKGGAGGAD LARKVVNAIE SQTNNFGFAY DVELGIKDKI
451   RAIAQKVYGA EDVDFSAEAS AEIASLEKLG LDKMPICMAK TQYSLSDNAK
501   LLGCPEDFRI AVRGITVSAG AGFIVALCGN MMKMPGLPKV PAAEKIDVDA
551   EGVIHGLF*
``` m141/a141 99.5% identity in 558 aa overlap

```
                10         20         30         40         50         60
m141.pep  MSFKTDAEIAQSSTMRPIGEIAAKLGLNADNIEPYGHYKAKINPAEAFKLPQKQGRLILV
          |||||||||||||||||||||||||||||:||||||||||||||||||||||||||||||
a141      MSFKTDAEIAQSSTMRPIGEIAAKLGLNVDNIEPYGHYKAKINPAEAFKLPQKQGRLILV
                10         20         30         40         50         60

70         80         90        100        110        120
m141.pep  TAINPTPAGEGKTTVTIGLADALRHIGKDAVIALREPSLGPVFGVKGGAAGGGYAQVLPM
          |||||||||||||||||||||||||||||:||||||||||||||||||||||||||||||
a141      TAINPTPAGEGKTTVTIGLADALRHIGKDSVIALREPSLGPVFGVKGGAAGGGYAQVLPM
                70         80         90        100        110        120

130        140        150        160        170        180
m141.pep  EDINLHFTGDFHAIGAANNLLAAMLDNHIYQGNELNIDPKRVLWRRVVDMNDRQLRNIID
          ||||||||||||||||||||||||||||||||||||||||||||||||||||||||||||
a141      EDINLHFTGDFHAIGAANNLLAAMLDNHIYQGNELNIDPKRVLWRRVVDMNDRQLRNIID
               130        140        150        160        170        180
```

```
              190        200        210        220        230        240
m141.pep  GMGKPVDGVMRPDGFDITVASEVMAVFCLAKDISDLKERLGNILVAYAKDGSPVYAKDLK
          ||||||||||||||||||||||||||||||||||||||||||||||||||||||||||||
a141      GMGKPVDGVMRPDGFDITVASEVMAVFCLAKDISDLKERLGNILVAYAKDGSPVYAKDLK
              190        200        210        220        230        240

250        260        270        280        290        300
m141.pep  ANGAMAALLKDAIKPNLVQTIEGTPAFVHGGPFANIAHGCNSVTATRLAKHLADYAVTEA
          ||||||||||||||||||||||||||||||||||||||||||||||||||||||||||||
a141      ANGAMAALLKDAIKPNLVQTIEGTPAFVHGGPFANIAHGCNSVTATRLAKHLADYAVTEA
              250        260        270        280        290        300

310        320        330        340        350        360
m141.pep  GFGADLGASKFCDIKCRLAGLKPDAAVVVATVRALKYNGGVERANLGEENLDALEKGLPN
          ||||||||| ||||||||||||||||||||||||||||||||||||||||||||||||||
a141      GFGADLGAEKFCDIKCRLAGLKPDAAVVVATVRALKYNGGVERANLGEENLDALEKGLPN
              310        320        330        340        350        360

370        380        390        400        410        420
m141.pep  LLKHISNLKNVFGLPVVVALNRFVSDADAELAMIEKACAEHGVEVSLTEVWGKGGAGGAD
          |||||||||||||||||||||||||||:||||||||||||||||||||||||||||||||
a141      LLKHISNLKNVFGLPVVVALNRFVSDSDAELAMIEKACAEHGVEVSLTEVWGKGGAGGAD
              370        380        390        400        410        420

430        440        450        460        470        480
m141.pep  LARKVVNAIESQTNNFGFAYDVELGIKDKIRAIAQKVYGAEDVDFSAEASAEIASLEKLG
          ||||||||||||||||||||||||||||||||||||||||||||||||||||||||||||
a141      LARKVVNAIESQTNNFGFAYDVELGIKDKIRAIAQKVYGAEDVDFSAEASAEIASLEKLG
              430        440        450        460        470        480

490        500        510        520        530        540
m141.pep  LDKMPICMAKTQYSLSDNAKLLGCPEDFRIAVRGITVSAGAGFIVALCGNMMKMPGLPKV
          ||||||||||||||||||||||||||||||||||||||||||||||||||||||||||||
a141      LDKMPICMAKTQYSLSDNAKLLGCPEDFRIAVRGITVSAGAGFIVALCGNMMKMPGLPKV
              490        500        510        520        530        540

550        559
m141.pep  PAAEKIDVDAEGVIHGLFX
          |||||||||||||||||||
a141      PAAEKIDVDAEGVIHGLFX
              550
```

The following partial DNA sequence was identified in *N. gonorrhoeae* <SEQ ID 559>:

```
g142.seq
    1  ATGCGTGCCG ATTTCATGTT TGCCGACAAT ATGCCCGTGC AGGTGCGCCA

51  ACGCGCCTTC TATTTCAAGT TGTCCCGTTT TGCCGCGATG CCAAATATGG

101  TAGGCAAACC GCTCTTCGGG CGACAGGCCG GTCAGCCCGG CAAAATGTTC

151  GGCAACATCC TGATGTTCGT CCGCCAGCAT ATTGATGCAG AGgCTGCCGT

201  TTTCCGACAG GATCggaATG AttcgCGCAC TCCGGTTTAT GCACAGCATC

251  ACGGTCGGCG GCTCGTCGGT AACCGGCGCA ACCGCCGTCA TTGTAATGCC

301  GTAACGCCCT GCCGCACCGT CTGTCGTGAT GACATGAACG CCTGCCGCAC

351  AGGATGCCAT CGCATCACGG AACGAAGTTT GAAAAGTTTT CTGCAAATCC

401  GCCATTTTTC CCCTTTAAAC CGTCCCCTAT ATAAGAATGC TGCACACAAG

451  GCATCCCCCC ATGTGCAGCA GTTCTGA
```

This corresponds to the amino acid sequence <SEQ ID 560; ORF 142.ng>:

```
g142.pep
    1  MRADFMFADN MPVQVRQRAF YFKLSRFAAM PNMVGKPLFG RQAGQPGKMF

51  GNILMFVRQH IDAEAAVFRQ DRNDSRTPVY AQHHGRRLVG NRRNRRHCNA

101  VTPCRTVCRD DMNACRTGCH RITERSLKSF LQIRHFSPLN RPLYKNAAHK

151  ASPHVQQF*
```

The following partial DNA sequence was identified in *N. meningitidis* <SEQ ID 561>:

```
m142.seq
    1   ATGCGTGCCG ATTTCATGTT TGCCGACAAT ATGCCCGTGC AGGTGCGCCA

51   ACGCGCCCTC TATTTCAAGT TGTCCCGTTT TGCCGCGATG CCAGATGTGG

101   TAGGCAAACC GCTCTTCGGG CGACAGGCCG GTCAGCCCGG CAAAATGTTC

151   GGCAACATCC TGATGTTCGT CCGCCAGCGT ATTGATGCAG AGGCTGCCGT

201   TTTCCGACAG GATCGGAATG ATTCGCGCAC TCCGGTTGAT GCACAGCATC

251   ACGGTCGGCG GCTCGTCGGT AACCGGCGCG ACCGCCGTCA TTGTAATGCC

301   GTAACGCCCT GCCGCACCGT CTGTCGTGAT GACATGAACG CCTGCCGCGC

351   AAGATGCCAT CGCATCACGG AACGAAGTTT GAAAATTTTT CTGCAAATCC

401   GCCATTTTTC CCCTTTAAAC TGTCCCCTAT ATAAGAATGC TGCACACAAG

451   GCATCCCCcC ATGTGCAGCA GTTTTGA
```

This corresponds to the amino acid sequence <SEQ ID 562; ORF 142>:

```
m142.pep
    1   MRADFMFADN MPVQVRQRAL YFKLSRFAAM PDVVGKPLFG RQAGQPGKMF

51   GNILMFVRQR IDAEAAVFRQ DRNDSRTPVD AQHHGRRLVG NRRDRRHCNA

101   VTPCRTVCRD DMNACRARCH RITERSLKIF LQIRHFSPLN CPLYKNAAHK

151   ASPHVQQF*
```

Computer analysis of this amino acid sequence gave the following results:
Homology with a Predicted ORF from *N. gonorrhoeae*
ORF 142 shows 93.7% identity over a 158 aa overlap with a predicted ORF (ORF 142.ng) from *N. gonorrhoeae*:

```
m142/g142
                   10         20         30         40         50         60
    m142.pep  MRADFMFADNMPVQVRQRALYFKLSRFAAMPDVVGKPLFGRQAGQPGKMFGNILMFVRQR
              ||||||||||||||||||||:||||||||||::|||||||||||||||||||||||||:
    g142      MRADFMFADNMPVQVRQRAFYFKLSRFAAMPNMVGKPLFGRQAGQPGKMFGNILMFVRQH
                   10         20         30         40         50         60
                   70         80         90        100        110        120
    m142.pep  IDAEAAVFRQDRNDSRTPVDAQHHGRRLVGNRRDRRHCNAVTPCRTVCRDDMNACRARCH
              ||||||||||||||||||| |||||||||||||||:||||||||||||||||||||:||
    g142      IDAEAAVFRQDRNDSRTPVYAQHHGRRLVGNRRNRRHCNAVTPCRTVCRDDMNACRTGCH
                   70         80         90        100        110        120
                  130        140        150        159
    m142.pep  RITERSLKIFLQIRHFSPLNCPLYKNAAHKASPHVQQFX
              |||||||| |||||||||| ||||||||||||||||||
    g142      RITERSLKSFLQIRHFSPLNRPLYKNAAHKASPHVQQFX
                  130        140        150
```

The following partial DNA sequence was identified in *N. meningitidis* <SEQ ID 563>:

```
a142.seq
    1   ATGCGTGCCG ATTTCATGTT TGCCGACAAT ATGCCCGTGC AGGTGCGCCA

51   ACGCGCCCTC TATTTCAAGT TGTCCCGTTT TGCCGCGATG CCAGATGTGG

101   TAGGCAAACC GCTCTTCGGG CGACAGGCCG GTCAGCCCGG CAAAATGTTC

151   GGCAACATCC TGATGTTCGT CCGCCAGCGT ATTGATGCAG AGGCTGCCGT

201   TTTCCGACAG GATCGGAATG ATTCGCGCAC TCCGGTTGAT GCACAGCATC

251   ACGGTCGGCG GCTCGTCCGT AACCGGCGCA ACCGCCGTCA TTGTAATGCC
```

```
301   GTAACGCCCT GCCGCACCGT CTGTCGTGAT GACATGAACG CCTGCCGCAC

351   AGGATGCCAT CGCATCACGG AACGAAGTTT GAAAAGTTTT CTGCAAATCC

401   GCCATTTTTC CCCTTTAAAC TGTCCCCTAT ATAAGAATGC TGCACACAAG

451   GCACCCCCCA TGTGCAGCAG TTCTGATTCA AAAAGCCGTC GGTCGGACAT

501   TTCCGCGCGT TACGGCGTAT TACGAGTTCA ACGCATCCTC GATTTTGGCA

551   AGTTCTGCCA ACAGGTCTTT AAGCAGCAGC ATTTTCTCGC GGCCCAGCAC

601   TTCCTCGATA GCGTCGTAAC GCTCGTCCAC TTCTTCGCCG ATTTCCTCAT

651   ACAGCTTCTC GCCCTCGGCA GTCAGCTTCA GAAAAACACG TCGTTGGTCG

701   TTGGAAGGTT TCAGGCGGAC AACCAAACCC GCTTTTTCAA GGCGGGTCAG

751   GATACCGGTC AGGCTGGGGC GCAAAATGCA CGCCTGATTC GCCAAATCTT

801   GAAAGTCCAG CGTGCCGTTT TCCGCCAAAA GACGGATAAT CCGCCATTGC

851   TGATCGGTAA TATTCGCCTG ATTCAGAATA GGCCTGAATT GGGTCATCAG

901   GGCTTCCCTT GCCTGTATCA GACCGATATT GATAGACGCA TGTTTTGA
```

This corresponds to the amino acid sequence <SEQ ID 564; ORF 142.a>:

```
a142.pep
  1   MRADFMFADN MPVQVRQRAL YFKLSRFAAM PDVVGKPLFG RQAGQPGKMF

51   GNILMFVRQR IDAEAAVFRQ DRNDSRTPVD AQHHGRRLVR NRRNRRHCNA

101   VTPCRTVCRD DMNACRTGCH RITERSLKSF LQIRHFSPLN CPLYKNAAHK

151   APPMCSSSDS KSRRSDISAR YGVLRVQRIL DFGKFCQQVF KQQHFLAAQH

201   FLDSVVTLVH FFADFLIQLL ALGSQLQKNT SLVVGRFQAD NQTRFFKAGQ

251   DTGQAGAQNA RLIRQILKVQ RAVFRQKTDN PPLLIGNIRL IQNRPELGHQ

301   GFPCLYQTDI DRRMF*
``` m142/a142 96.1% identity in 153 aa overlap

```
                 10         20         30         40         50         60
m142.pep  MRADFMFADNMPVQVRQRALYFKLSRFAAMPDVVGKPLFGRQAGQPGKMFGNILMFVRQR
          ||||||||||||||||||||||||||||||||||||||||||||||||||||||||||||
a142      MRADFMFADNMPVQVRQRALYFKLSRFAAMPDVVGKPLFGRQAGQPGKMFGNILMFVRQR
                 10         20         30         40         50         60

70         80         90        100        110        120
m142.pep  IDAEAAVFRQDRNDSRTPVDAQHHGRRLVGNRRDRRHCNAVTPCRTVCRDDMNACRARCH
          |||||||||||||||||||||||||||||||  :||||||||||||||||||||||: ||
a142      IDAEAAVFRQDRNDSRTPVDAQHHGRRLVRNRRNRRHCNAVTPCRTVCRDDMNACRTGCH
                 70         80         90        100        110        120

130        140        150       159
m142.pep  RITERSLKIFLQIRHFSPLNCPLYKNAAHKASPHVQQFX
          |||||||| ||||||||||||||||||||||||      |
a142      RITERSLKSFLQIRHFSPLNCPLYKNAAHKAPPMCSSSDSKSRRSDISARYGVLRVQRIL
                130        140        150        160        170        180 a142      DFGKFCQQVFKQQHFLAAQHFLDSVVTLVHFFADFLIQLLALGSQLQKNTSLVVGRFQAD
                190        200        210        220        230        240
```

The following partial DNA sequence was identified in *N. gonorrhoeae* <SEQ ID 565>:

```
g143.seq
  1   ATGTTGAGCT TCGGCTATCT CGGCGTTCAG ACGGCCTTTA CCCTGCAAAG

51   CTCGCAGATG AGCCGCATTT TTCAAACGCT AGGCGCAGAC CCGCACAATT
```

```
 101   TGGGCTGGTT TTTCATCCTG CCGCCGCTGG CGGGGATGCT GGTTCAGCCG

151   ATAGTGgGCT ACTACTCAGA CCGCACTTGG AAGCCGCGCT GGGCGGCCG

201   CCGCCTGCCG TATCTGCTTT ACGGCACGCT GATTGCGGTC ATCGTGATGA

251   TTTTGATGCC GAACTCGGGC AGCTTCGGTT TCGGCTATGC GTCGCTGGCG

301   GCCTTGTCGT TCGGCGCGCT GATGATTGCG CTGTTGGACG TGTCGTCGAA

351   TATGGCGATG CAGCCGTTTA AGATGATGGT CGGCGATATG GTCAACGAGG

401   AGCAGAAAAG CTACGCCTAC GGGATTCAAA GTTTCTTAGC GAATACGGAC

451   GCGGTTGTGG CAGCGATTCT GCCGTTTGTG TTcgcgtata TCGGTTTGGC

501   GAACACTGCC GAGAAAGGCG TTGTGCCACA AACCGTGGTC GTAGCATTCT

551   ATGTGGGTGC GGCGTTACTG ATTATTACCA GTGCGTTCAC AATCTCCAAA

601   GTCAAAGAAT ACGACCCGGA AACCTACGCC CGTTACCACG GCATCGATGT

651   CGCCGCGAAT CAGGAAAAAG CCAACTGGTT CGAACTCTTA AAAACCGCGC

701   CTAAAGTGTT TTGGACGGTT ACTCCGGTAC AGTTTTTCTG CTGGTTCGCC

751   TTCCGGTATA TGTGGACTTA CTCGGCAGGC GCGATTGCAG AAAACGTCTG

801   GCACACTACC GATGCGTCTT CCGTAGGCCA TCAGGAGGCG GGCAACCGGT

851   ACGGCGTTTT GGCGGCGGTG TAGTCGGTTG CGGCGGTGAT TTGTTCGTTT

901   ATTCTGGCAA AAGTACCGAA TAAATACCAT AAGGCGGGTT ATTTCGGCTG

951   TTTGGCTTTG GGCGCGCTCG GTTTCTTCTC TATCTTCTTC ATCTACAATC

1001   AATACGCACT CATCCTGTCT TATATCTTAA TCGGCATCGC TTGGGCGGGC

1051   ATTATCACTT ATCCGCTGAC GATTGTGGCC AACGCTTTGT CGGGCAAACA

1101   CATGGATACT TATTTGGGCC TGTttaacgg ctctgtCTGT ATGCcgcaaa 1151   tcgTcgctTC GctgttgAGT TTCGTGCTTT TCCCGATGCT GGGCGGCCAT

1201   CAGGCAACCA TGTTCTTGGT TGCAGGCGCA GTCTTGCTGC TGGGAGCCTT

1251   CTCAGTCTGT CTGATTAAAG AGATCCACGG CGGGGTTTGA
                                                            45
```

This corresponds to the amino acid sequence <SEQ ID 566; ORF 143.ng>:

```
g143.pep
   1   MLSFGYLGVQ TAFTLQSSQM SRIFQTLGAD PHNLGWFFIL PPLAGMLVQP

51   IVGYYSDRTW KPRLGGRRLP YLLYGTLIAV IVMILMPNSG SFGFGYASLA

101   ALSFGALMIA LLDVSSNMAM QPFKMMVGDM VNEEQKSYAY GIQSFLANTD

151   AVVAAILPFV FAYIGLANTA EKGVVPQTVV VAFYVGAALL IITSAFTISK

201   VKEYDPETYA RYHGIDVAAN QEKANWFELL KTAPKVFWTV TPVQFFCWFA

251   FRYMWTYSAG AIAENVWHTT DASSVGHQEA GNRYGVLAAV *SVAAVICSF

301   ILAKVPNKYH KAGYFGCLAL GALGFFSIFF IYNQYALILS YILIGIAWAG

351   IITYPLTIVA NALSGKHMDT YLGLFNGSVC MPQIVASLLS FVLFPMLGGH

401   QATMFLVAGA VLLLGAFSVC LIKEIHGGV*
                                                            65
```

The following partial DNA sequence was identified in *N. meningitidis* <SEQ ID 567>:

m143.seq
```
    1 ATGCTCAGTT TCGGCTTTCT CGGCGTTCAG ACGGCCTTTA CCCTGCAAAG
   51 CTCGCAAATG AGCCGCATTT TTCAAACGCT AGGCGCAGAC CCGCACAATT
  101 TGGGCTGGTT TTTCATCCTG CCGCCGCTGG CGGGGATGCT GGTGCAGCCG
  151 ATTGTCGGCC ATTACTCCGA CCGCACTTGG AAGCCGCGTT TGGGCGGCCG
  201 CCGTCTGCCG TATCTGCTTT ATGGCACGCT GATTGCGGTT ATTGTGATGA
  251 TTTTGATGCC GAACTCGGGC AGCTTCGGTT TCGGCTATGC GTCGCTGGCG
  301 GCTTTGTCGT TCGGCGCGCT GATGATTGCG CTGTTAGACG TGTCGTCAAA
  351 TATGGCGATG CAGCCGTTTA AGATGATGGT CGGCGACATG GTCAACGAGG
  401 AGCAGAAAGG CTACGCCTAC GGGATTCAAA GTTTCTTAGC AAATACGGGC
  451 GCGGTCGTGG CGGCGATTCT GCCGTTTGTG TTTGCGTATA TCGGTTTGGC
  501 GAACACCGCC GAGAAAGGCG TTGTGCCGCA GACCGTGGTC GTGGCGTTTT
  551 ATGTGGGTGC GGCGTTGCTG GTGATTACCA GCGCGTTCAC GATTTTCAAA
  601 GTGAAGGAAT ACGATCCGGA AACCTACGCC CGTTACCACG GCATCGATGT
  651 CGCCGCGAAT CAGGAAAAAG CCAACTGGAT CGAACTCTTG AAAACCGCGC
  701 CTAAGGCGTT TTGGACGGTT ACTTTGGTGC AATTCTTCTG CTGGTTCGCC
  751 TTCCAATATA TGTGGACTTA CTCGGCAGGC GCGATTGCGG AAAACGTCTG
  801 GCACACCACC GATGCGTCTT CCGTAGGTTA TCAGGAGGCG GGTAACTGGT
  851 ACGGCGTTTT GGCGGCGGTG CAGTCGGTTG CGGCGGTGAT TTGTTCGTTT
  901 GTATTGGCGA AAGTGCCGAA TAAATACCAT AAGGCGGGTT ATTTCGGCTG
  951 TTTGGCTTTG GGCGCGCTCG GCTTTTTCTC CGTTTTCTTC ATCGGCAACC
 1001 AATACGCGCT GGTGTTGTCT TATACCTTAA TCGGCATCGC TTGGGCGGGC
 1051 ATTATCACTT ATCCGCTGAC GATTGTGACC AACGCCTTGT CGGGCAAGCA
 1101 TATGGGCACT TACTTGGGCT TGTTTAACGG CTCTATCTGT ATGCCTCAAA
 1151 TCGTCGCTTC GCTGTTGAGT TTCGTGCTTT TCCCTATGCT GGGCGGCTTG
 1201 CAGGCCACTA TGTTCTTGGT AGGGGGCGTC GTCCTGCTGC TGGGCGCGTT
 1251 TTCCGTGTTC CTGATTAAAG AAACACACGG CGGGGTTTGA
```

This corresponds to the amino acid sequence <SEQ ID 568; ORF 143>:

m143.pep
```
    1 MLSFGFLGVQ TAFTLQSSQM SRIFQTLGAD PHNLGWFFIL PPLAGMLVQP
   51 IVGHYSDRTW KPRLGGRRLP YLLYGTLIAV IVMILMPNSG SFGFGYASLA
  101 ALSFGALMIA LLDVSSNMAM QPFKMMVGDM VNEEQKGYAY GIQSFLANTG
  151 AVVAAILPFV FAYIGLANTA EKGVVPQTVV VAFYVGAALL VITSAFTIFK
  201 VKEYDPETYA RYHGIDVAAN QEKANWIELL KTAPKAFWTV TLVQFFCWFA
  251 FQYMWTYSAG AIAENVWHTT DASSVGYQEA GNWYGVLAAV QSVAAVICSF
  301 VLAKVPNKYH KAGYFGCLAL GALGFFSVFF IGNQYALVLS YTLIGIAWAG
  351 IITYPLTIVT NALSGKHMGT YLGLFNGSIC MPQIVASLLS FVLFPMLGGL
  401 QATMFLVGGV VLLLGAFSVF LIKETHGGV*
```

Computer analysis of this amino acid sequence gave the following results:

Homology with a Predicted ORF from *N. gonorrhoeae*
m143/g143 93.9% identity in 429 aa overlap

```
              10        20        30        40        50        60
m143.pep  MLSFGFLGVQTAFTLQSSQMSRIFQTLGADPHNLGWFFILPPLAGMLVQPIVGHYSDRTW
          |||||:||||||||||||||||||||||||||||||||||||||||||||||:||||||
g143      MLSFGYLGVQTAFTLQSSQMSRIFQTLGADPHNLGWFFILPPLAGMLVQPIVGYYSDRTW
              10        20        30        40        50        60

70        80        90       100       110       120
m143.pep  KPRLGGRRLPYLLYGTLIAVIVMILMPNSGSFGFGYASLAALSFGALMIALLDVSSNMAM
          ||||||||||||||||||||||||||||||||||||||||||||||||||||||||||||
g143      KPRLGGRRLPYLLYGTLIAVIVMILMPNSGSFGFGYASLAALSFGALMIALLDVSSNMAM
              70        80        90       100       110       120

130       140       150       160       170       180
m143.pep  QPFKMMVGDMVNEEQKGYAYGIQSFLANTGAVVAAILPFVFAYIGLANTAEKGVVPQTVV
          |||||||||||||||||:||||||||||||| ||||||||||||||||||||||||||||
g143      QPFKMMVGDMVNEEQKSYAYGIQSFLANTDAVVAAILPFVFAYIGLANTAEKGVVPQTVV
             130       140       150       160       170       180

190       200       210       220       230       240
m143.pep  VAFYVGAALLVITSAFTIFKVKEYDPETYARYHGIDVAANQEKANWIELLKTAPKAFWTV
          ||||||||||:|||||||  |||||||||||||||||||||||||||:||||||||:||||
g143      VAFYVGAALLIITSAFTISKVKEYDPETYARYHGIDVAANQEKANWFELLKTAPKVFWTV
             190       200       210       220       230       240

250       260       270       280       290       300
m143.pep  TLVQFFCWFAFQYMWTYSAGAIAENVWHTTDASSVGYQEAGNWYGVLAAVQSVAAVICSF
          | |||||||||:||||||||||||||||||||||||:|||||:|||||||||:|||||||
g143      TPVQFFCWFAFRYMWTYSAGAIAENVWHTTDASSVGHQEAGNRYGVLAAVXSVAAVICSF
             250       260       270       280       290       300

310       320       330       340       350       360
m143.pep  VLAKVPNKYHKAGYFGCLALGALGFFSVFFIGNQYALVLSYTLIGIAWAGIITYPLTIVT
          :|||||||||||||||||||||||||||| |||||| |||:|||||||||||||||||:
g143      ILAKVPNKYHKAGYFGCLALGALGFFSIFFIYNQYALILSYILIGIAWAGIITYPLTIVA
             310       320       330       340       350       360

370       380       390       400       410       420
m143.pep  NALSGKHMGTYLGLFNGSICMPQIVASLLSFVLFPMLGGLQATMFLVGGVVLLLGAFSVF
          |||||||| |||||||||:|||||||||||||||||||||||||||||||:|:||||||||:
g143      NALSGKHMDTYLGLFNGSVCMPQIVASLLSFVLFPMLGGHQATMFLVAGAVLLLGAFSVC
             370       380       390       400       410       420

430
m143.pep  LIKETHGGVX
          ||||  |||||
g143      LIKEIHGGVX
             430
```

40

The following partial DNA sequence was identified in *N. meningitidis* <SEQ ID 569>:

```
a143.seq
    1   ATGCTCAGTT TCGGCTTTCT CGGCGTTCAG ACGGCCTTTA CCCTGCAAAG

51   CTCGCAGATG AGCCGCATCT TCCAGACGCT CGGTGCCGAT CCGCACAGCC

101   TCGGCTGGTT CTTTATCCTG CCGCCGCTGG CGGGGATGCT GGTGCAGCCG

151   ATTGTCGGCC ATTACTCCGA CCGCACTTGG AAGCCGCGTT GGGCGGCCG

201   CCGTCTGCCG TATCTGCTTT ATGGCACGCT GATTGCGGTT ATTGTGATGA

251   TTTTGATGCC GAACTCGGGC AGCTTCGGTT TCGGCTATGC GTCGCTGGCG

301   GCTTTGTCGT TCGGCGCGCT GATGATTGCG CTGTTAGACG TGTCGTCAAA

351   TATGGCGATG CAGCCGTTTA AGATGATGGT CGGCGACATG GTCAACGAGG

401   AGCAGAAAGG CTACGCCTAC GGGATTCAAA GTTTCTTAGC GAATACGGGC

451   GCGGTCGTGG CGGCGATTCT GCCGTTTGTG TTTGCGTATA TCGGTTTGGC

501   GAACACCGCC GAGAAGGCG TTGTGCCGCA GACCGTGGTC GTGGCGTTTT

551   ATGTGGGTGC GGCGTTGCTG GTGATTACCA GCGCGTTCAC GATTTTCAAA

601   GTGAAGGAAT ACAATCCGGA AACCTACGCC CGTTACCACG GCATCGATGT

651   CGCCGCGAAT CAGGAAAAAG CCAACTGGAT CGAACTCTTG AAAACCGCGC
```

-continued

```
 701  CTAAGGCGTT TTGGACGGTT ACTTTGGTGC AATTCTTCTG CTGGTTCGCC
 751  TTCCAATATA TGTGGACTTA CTCGGCAGGC GCGATTGCGG AAAACGTCTG
 801  GCACACCACC GATGCGTCTT CCGTAGGTTA TCAGGAGGCG GGTAACTGGT
 851  ACGGCGTTTT GGCGGCGGTG CAGTCGGTTG CGGCGGTGAT TTGTTCGTTT
 901  GTATTGGCGA AAGTGCCGAA TAAATACCAT AAGGCGGGTT ATTTCGGCTG
 951  TTTGGCTTTG GGCGCGCTCG GCTTTTTCTC CGTTTTCTTC ATCGGCAACC
1001  AATACGCGCT GGTGTTGTCT TATACCTTAA TCGGCATCGC TTGGGCGGGC
1051  ATTATCACTT ATCCGCTGAC GATTGTGACC AACGCCTTGT CGGGCAAGCA
1101  TATGGGCACT TACTTGGGCC TGTTTAACGG CTCTATCTGT ATGCCGCAAA
1151  TCGTCGCTTC GCTGTTGAGT TTCGTGCTTT TCCCTATGCT GGGCGGCTTG
1201  CAGGCCACTA TGTTCTTGGT AGGGGGCGTC GTCCTGCTGC TGGGCGCGTT
1251  TTCCGTGTTC CTGATTAAAG AAACACACGG CGGGGTTTGA
```

This corresponds to the amino acid sequence <SEQ ID 570; ORF 143.a>:

```
a143.pep
    1  MLSFGFLGVQ TAFTLQSSQM SRIFQTLGAD PHSLGWFFIL PPLAGMLVQP

51  IVGHYSDRTW KPRLGGRRLP YLLYGTLIAV IVMILMPNSG SFGFGYASLA

101  ALSFGALMIA LLDVSSNMAM QPFKMMVGDM VNEEQKGYAY GIQSFLANTG

151  AVVAAILPFV FAYIGLANTA EKGVVPQTVV VAFYVGAALL VITSAFTIFK

201  VKEYNPETYA RYHGIDVAAN QEKANWIELL KTAPKAFWTV TLVQFFCWFA

251  FQYMWTYSAG AIAENVWHTT DASSVGYQEA GNWYGVLAAV QSVAAVICSF

301  VLAKVPNKYH KAGYFGCLAL GALGFFSVFF IGNQYALVLS YTLIGIAWAG

351  IITYPLTIVT NALSGKHMGT YLGLFNGSIC MPQIVASLLS FVLFPMLGGL

401  QATMFLVGGV VLLLGAFSVF LIKETHGGV*
``` m143/a143 99.5% identity in 429 aa overlap

```
                   10         20         30         40         50         60
  m143.pep MLSFGFLGVQTAFTLQSSQMSRIFQTLGADPHNLGWFFILPPLAGMLVQPIVGHYSDRTW
           ||||||||||||||||||||||||||||||:||||||||||||||||||||||||||||
      a143 MLSFGFLGVQTAFTLQSSQMSRIFQTLGADPHSLGWFFILPPLAGMLVQPIVGHYSDRTW
                   10         20         30         40         50         60

70         80         90        100        110        120
  m143.pep KPRLGGRRLPYLLYGTLIAVIVMILMPNSGSFGFGYASLAALSFGALMIALLDVSSNMAM
           ||||||||||||||||||||||||||||||||||||||||||||||||||||||||||||
      a143 KPRLGGRRLPYLLYGTLIAVIVMILMPNSGSFGFGYASLAALSFGALMIALLDVSSNMAM
                   70         80         90        100        110        120

130        140        150        160        170        180
  m143.pep QPFKMMVGDMVNEEQKGYAYGIQSFLANTGAVVAAILPFVFAYIGLANTAEKGVVQTVV
           ||||||||||||||||||||||||||||||||||||||||||||||||||||||||||||
      a143 QPFKMMVGDMVNEEQKGYAYGIQSFLANTGAVVAAILPFVFAYIGLANTAEKGVVQTVV
                  130        140        150        160        170        180

190        200        210        220        230        240
  m143.pep VAFYVGAALLVITSAFTIFKVKEYDPETYARYHGIDVAANQEKANWIELLKTAPKAFWTV
           ||||||||||||||||||||||||:|||||||||||||||||||||||||||||||||||
      a143 VAFYVGAALLVITSAFTIFKVKEYNPETYARYHGIDVAANQEKANWIELLKTAPKAFWTV
                  190        200        210        220        230        240

250        260        270        280        290        300
  m143.pep TLVQFFCWFAFQYMWTYSAGAIAENVWHTTDASSVGYQEAGNWYGVLAAVQSVAAVICSF
           ||||||||||||||||||||||||||||||||||||||||||||||||||||||||||||
      a143 TLVQFFCWFAFQYMWTYSAGAIAENVWHTTDASSVGYQEAGNWYGVLAAVQSVAAVICSF
                  250        260        270        280        290        300
```

-continued

```
             310        320        330        340        350        360
m143.pep    VLAKVPNKYHKAGYFGCLALGALGFFSVFFIGNQYALVLSYTLIGIAWAGIITYPLTIVT
            ||||||||||||||||||||||||||||||||||||||||||||||||||||||||||||
a143        VLAKVPNKYHKAGYFGCLALGALGFFSVFFIGNQYALVLSYTLIGIAWAGIITYPLTIVT
             310        320        330        340        350        360

370        380        390        400        410        420
m143.pep    NALSGKHMGTYLGLFNGSICMPQIVASLLSFVLFPMLGGLQATMFLVGGVVLLLGAFSVF
            ||||||||||||||||||||||||||||||||||||||||||||||||||||||||||||
a143        NALSGKHMGTYLGLFNGSICMPQIVASLLSFVLFPMLGGLQATMFLVGGVVLLLGAFSVF
             370        380        390        400        410        420

430
m143.pep    LIKETHGGVX
            ||||||||||
a143        LIKETHGGVX
             430
```

The following partial DNA sequence was identified in *N. gonorrhoeae* <SEQ ID 571>:

```
g144.seq
      1    ATGAGCGATA CCCCCGCTAC CCGCGATTTC GGCCTGATCG ACGGGCGGGC

51    CGTAACCGGC TATGTGCTGT CCAACCGGCG TGGTACGTGC GTCTTCGTGC

101    TGGACTTGGG CGGGATTGTG CAGGAATTTT CCGTTTTGGC AGACGGCGTG

151    CGCGAAAACC CCGTGGTGTC GTTCGACGAT GCGGCTTCCT ATGCGGACAA

201    TCCGTTTCAG ATTAACAAGC AGATAGGGCG CGTGGCCGGA CGCATCCGCG

251    GTGCGGCGTT CGACATCAAC GGTAGGACTT ACCGCGTGGA GGCCAACGAA

301    GGCAGGAACG CGCTGCACGG CGGTTCGCAC GGGCTGGCCG TTACCcgtTT

351    CAACGCGGTG GCGGCAGACG GccgacggTt atCCCAACGA TTTGGatatT

401    TCctaccgCT TGGACGAGGA CGGCCGGCTT ACCGTtaccT ATCGCGCCAC

451    CGCgctCGGC GACACGGTGT TCGACCCGAC GCTGCACATT TACTGGCGGC

501    TGGACGCGGG CCTGCACGAT GCGGTTCTGC ATATTCCGCA GGGCGGACAT

551    ATTCCGGCCG ATGCCGAAAA ACTGCCCGTC TTAACGGTTT CAGACGGCCT

601    CGAAGTATTT GA
```

This corresponds to the amino acid sequence <SEQ ID 572; ORF 144.ng>:

```
g144.pep
      1    MSDTPATRDF GLIDGRAVTG YVLSNRRGTC VFVLDLGGIV QEFSVLADGV

51    RENPVVSFDD AASYADNPFQ INKQIGRVAG RIRGAAFDIN GRTYRVEANE

101    GRNALHGGSH GLAVTRFNAV AADGRRLSQR FGYFLPLGRG RPAYRYLSRH

151    RARRHGVRPD AAHLLAAGRG PARCGSAYSA GRTYSGRCRK TARLNGFRRP

201    RSI*
```

The following partial DNA sequence was identified in *N. meningitidis* <SEQ ID 573>:

```
m144.seq
      1    ATGAGCGATA CCCCCGCTAC CCGCGATTTC GGTCTGATCG ACGGGCGTGC

51    CGTAACCGGC TATGTGCTGT CCAACCGGCG TGGTACGCGT GTCTGCGTGC

101    TGGACTTGGG CGGGATTGTG CAGGAATTTT CCGTTTTGGC AGACGGCGTG

151    CGCGAAAACC TCGTGGTGTC GTTCGATGAT GCGGCTTCCT ATGCGGACAA

201    TCCGTTTCAG ATTAACAAAC AGATAGGGCG CGTGGCCGGA CGCATCCGCG
```

-continued

```
251  GTGCGGCGTT CGACATCAAC GGCAGGACTT ACCGCGTGGA GGCCAACGAA

301  GGCAGGAACG CGCTGCACGG CGGTTCGCAC GGGCTGGCCG TTACCCGTTT

351  CAACGCGGTG GCGGCAGACG GCCGTTCGGT GGTGCTGCGC AGCCGCCTGg

401  CAACAGTCGG CCGACGGTTA TCCCAACGAT TTGGATTTGG ATATTTCCTA

451  CCGCTTGGAC GAGGACGACC GGCTTACCGT TAcCTATCGC GCCACCGCGC

501  TCGGCGACAC GGTGTTCGAC CCGACGCTGC ACATTTACTG GCGGCTGGAC

551  GCGGGCCTGC ACGATGCGGT TCTGCATATT CCGCAGGGCG GACATATGCC

601  GGCCGATGCC GAAAAACTGC CCGTCTCAAC GGTTTCAGAC GACCTCGAAG

651  TATTTGA
```

This corresponds to the amino acid sequence <SEQ ID 574; ORF 144>:

```
m144.pep
    1    MSDTPATRDF GLIDGRAVTG YVLSNRRGTR VCVLDLGGIV QEFSVLADGV

51    RENLVVSFDD AASYADNPFQ INKQIGRVAG RIRGAAFDIN GRTYRVEANE

101    GRNALHGGSH GLAVTRFNAV AADGRSVVLR SRLATVGRRL SQRFGFGYFL

151    PLGRGRPAYR YLSRHRARRH GVRPDAAHLL AAGRGPARCG SAYSAGRTYA

201    GRCRKTARLN GFRRPRSI*
```

Computer analysis of this amino acid sequence gave the following results:
Homology with a Predicted ORF from *N. gonorrhoeae*
m144/g144 91.3% identity in 218 aa overlap

```
                   10         20         30         40         50         60
m144.pep    MSDTPATRDFGLIDGRAVTGYVLSNRRGTRVCVLDLGGIVQEFSVLADGVRENLVVSFDD
            |||||||||||||||||||||||||||| | ||||||||||||||||||||||| ||||||
g144        MSDTPATRDFGLIDGRAVTGYVLSNRRGTCVFVLDLGGIVQEFSVLADGVRENPVVSFDD
                   10         20         30         40         50         60

70         80         90        100        110        120
m144.pep    AASYADNPFQINKQIGRVAGRIRGAAFDINGRTYRVEANEGRNALHGGSHGLAVTRFNAV
            ||||||||||||||||||||||||||||||||||||||||||||| ||| ||||||||||
g144        AASYADNPFQINKQIGRVAGRIRGAAFDINGRTYRVEANEGRNAIHGGGHGLAVTRFNAV
                   70         80         90        100        110        120

130        140        150        160        170        180
m144.pep    AADGRSVVLRSRLATVGRRLSQRFGFGYFLPLGRGRPAYRYLSRHRARRHGVRPDAAHLL
            |||            ||||||||||  ||||||||||||||||||||||||||||||||
g144        AAD------------GRRLSQRFG--YFLPLGRGRPAYRYLSRHRARRHGVRPDAAHLL
                                  130        140        150        160

190        200        210    219
m144-pep    AAGRGPARCGSAYSAGRTYAGRCRKTARLNGFRRPRSIX
            |||||||||||||||||||||:|||||||||||||||||
g144        AAGRGPARCGSAYSAGRTYSGRCRKTARLNGFRRPRSIX
                  170        180        190        200
```

The following partial DNA sequence was identified in *N. meningitidis* <SEQ ID 575>:

```
a144.seq
    1    ATGAGCGATA CCCCCGCTAC CCGCGATTTC GGCCTGATCG ACGGGCGTGC

51    CGTAACCGGC TATGTGCTGT CCAACCGGCG TGGTACGCGT GTCTGCGTGC

101    TGGACTTGGG CGGGATTGTG CAGGAATTTT CCGTTTTGGC AGACGGCGTG

151    CGCGAAAACC TCGTGGTGTC GTTCGACGAT GCGGCTTCCT ATGCGGACAA

201    TCCGTTTCAG ATTAACAAGC AGATAGGGCG CGTGGCCGGA CGCATCCGCG
```

```
-continued
251  GTGCGGCGTT CGACATCAAC GGCAGGACTT ACCGCGTGGA GGCCAACGAA

301  GGCAGGAACG CGCTGCACGG CGGTTCGCAC GGGCTGGCCG TTACCCGTTT

351  CAACGCGGTG GCGGCAGACG GCCGTTCGGT GGTGCTGCGC AGCCGCCTG.

401  CAACAGTCGG CCGACGGTTA TCCCAACGAT TTGGATTTGG ATATTTCCTA

451  CCGCTTGGAC GAGGACGACC GGCTTACCGT TACCTATCGC GCCACCGCGC

501  TCGGCGACAC GGTGTTCGAC CCGACGCTGC ACATTTACTG GCGGCTGGAC

551  GCGGGCCTGC ACGATGCGGT TCTGCATATT CCGCAGGGCG GACATATTCC

601  GGCCGATGCC GAAAAACTGC CCGTCTCAAC GGTTTCAGAC GACCTCGAAG

651  TATTTGA
```

This corresponds to the amino acid sequence <SEQ ID 576; ORF 144.a>:

```
a144.pep
    1  MSDTPATRDF GLIDGRAVTG YVLSNRRGTR VCVLDLGGIV QEFSVLADGV

51  RENLVVSFDD AASYADNPFQ INKQIGRVAG RIRGAAFDIN GRTYRVEANE

101  GRNALHGGSH GLAVTRFNAV AADGRSVVLR SRLXTVGRRL SQRFGFGYFL

151  PLGRGRPAYR YLSRHRARRH GVRPDAAHLL AAGRGPARCG SAYSAGRTYS

201  GRCRKTARLN GFRRPRSI*
``` m144/a144 99.1% identity in 218 aa overlap

```
                  10         20         30         40         50         60
m144.pep  MSDTPATRDFGLIDGRAVTGYVLSNRRGTRVCVLDLGGIVQEFSVLADGVRENLVVSFDD
          ||||||||||||||||||||||||||||||||||||||||||| |||||||||||||||
a144      MSDTPATRDFGLIDGRAVTGYVLSNRRGTRVCVLDLGGIVQEFSVIADGVRENLVVSFDD
                  10         20         30         40         50         60

70         80         90        100        110        120
m144.pep  AASYADNPFQINKQIGRVAGRIRGAAFDINGRTYRVEANEGRNALHGGSHGLAVTRFNAV
          ||||||||||||||||||||||||||||||||||||||||||||||||||||||||||||
a144      AASYADNPFQINKQIGRVAGRIRGAAFDINGRTYRVEANEGRNALHGGSHGLAVTRFNAV
                  70         80         90        100        110        120

130        140        150        160        170        180
m144.pep  AADGRSVVLRSRLATVGRRLSQRFGFGYFLPLGRGRPAYRYLSRHRARRHGVRPDAAHLL
          |||||||||||| |||||||||||||||||||||||||||||||||||||||||||||||
a144      AADGRSVVLRSRLXTVGRRLSQRFGFGYFLPLGRGRPAYRYLSRHRARRHGVRPDAAHLL
                 130        140        150        160        170        180

190        200        210   219
m144.pep  AAGRGPARCGSAYSAGRTYAGRCRKTARLNGFRRPRSIX
          ||||||||||||||||||||:||||||||||||||||||
a144      AAGRGPARCGSAYSAGRTYSGRCRKTARLNGFRRPRSIX
                 190        200        210
```

The following partial DNA sequence was identified in N. gonorrhoeae <SEQ ID 577>:

```
g146.seq
    1  ATGAAGCAAA TCCCCCTCCG CCTTCTCCAG GTCGTCATTG ACCACGACAA

51  AGTCGAACAA TACGGACTGT TCGATTTCAT GCCTTGCCTT CGACAGCCTC

101  CTTTGGATAa ctTCCCGACT GTCCGTCCCG CGCcctTTGA GGCGCGCGGC

151  AAGCACGTCG AAAGAAGGCG GCAGGATAAA GATACCGACA GCTTCCGGCA

201  GCGCGTTGCG AACCTGCGCC GCGCCCTGAA CGTCGATTTC CAAAATCACG

251  TCATAGCCTG CCGCCGCCAA CGCATTCACG CCCTCCGTGC TTGTGCCGTA

301  ATAGTTGCCG AATACGTCTG CGTATTCCAA AAAGCCTCC  TGCGCGATAA
```

-continued

```
351  GCGATTCAAA CTCTTCTTTG GAAACAAAGT GATAATGTAC GCCGTTTGCT

401  TCGCCTTCAC GCGGCGGGCG CGTCGTATGC GACACGGAAA CGCGCAAACC

451  GTTATGGTTT GCCAACAGCC GCGACACCAG CGTGGTTTTG CCCGTGCCGG

501  AAGCGGCCGA AATGATAAAG ATGTTGCCTT TTCGATAAGC GGACATATTT

551  TTTACCTGTA TATTTTCCAA CCGATTGTAT CACAACGGAC ACCCTATTTC

601  ATATTTGCCG ATGCCCATAT TTTGCCGCTA TTGTTTTGA
```

This corresponds to the amino acid sequence <SEQ ID 578; ORF 146.ng>:

```
g146.pep
  1   MKQIPLRLLQ VVIDHDKVEQ YGLFDFMPCL RQPPLDNFPT VRPAPFEARG

51   KHVERRRQDK DTDSFRQRVA NLRRALNVDF QNHVIACRRQ RIHALRACAV

101   IVAEYVCVFQ KSLLRDKRFK LFFGNKVIMY AVCFAFTRRA RRMRHGNAQT

151   VMVCQQPRHQ RGFARAGSGR NDKDVAFSIS GHIFYLYIFQ PIVSQRTPYF

201   IFADAHILPL LF*
```

The following partial DNA sequence was identified in *N. meningitidis* <SEQ ID 579>:

```
m146.seq
  1   ATGGCGCAAA TCCTCCTCCG CTCGCGCCAA GTCGTCATTG ACCACGACAA

51   AGTCAAACAA TACGGACTGC TCGATTTCAT GCCTTGCCTT CGACAGCCTC

101   CTTTGGATAA CTTCCCGACT GTCCGTCCCG CGTCCGTTGA GGCGCGCGGC

151   AAGTACGTCG AAAGAAGGCG GCAGGATAAA GATGCCGACG GCTTCGGGCA

201   GCGCGTCGCG AACCTGCGCC GCGCCCTGAA CGTCGATTTC CAAAATCACG

251   TCATAGCCTG CCGCCGCCAA CGCATTCACA CCCTCCGCGC CTGTGCCGTA

301   ATAGTTGCCA AATACGTCGG CGTATTCCAA AAAAGCTTCC TGCGCGATAA

351   GCGACTCAAA CTCTTCTTTG GAAACAAAGT GATAATGTAC GCCGTTTGCT

401   TCGCCTTCAC GCGGCGGGCG CGTCGTGTGC GACACGGAAA CGCGCAAACC

451   GTTATGGTTT GCCAACAGCC GCGACACCAG CGTGGTTTTG CCCGTGCCGG

501   AAGCGGCCGA AATGATAAAG ATGTTGCCTT TTCGATAAGC GGACATATTT

551   TTTACCTGTA TATTTTCCAG CCGATTGTAT CACAATGGAC ACCCAGTTTC

601   CTATTTGCCG ATGCCCATAT TTTGCCGCTA TTGTTTTGA
```

This corresponds to the amino acid sequence <SEQ ID 580; ORF 146>:

```
m146.pep
  1   MAQILLRSRQ VVIDHDKVKQ YGLLDFMPCL RQPPLDNFPT VRPASVEARG

51   KYVERRRQDK DADGFGQRVA NLRRALNVDF QNHVIACRRQ RIHTLRACAV

101   IVAKYVGVFQ KSFLRDKRLK LFFGNKVIMY AVCFAFTRRA RRVRHGNAQT

151   VMVCQQPRHQ RGFARAGSGR NDKDVAFSIS GHIFYLYIFQ PIVSQWTPSF

201   LFADAHILPL LF*
```

Computer analysis of this amino acid sequence gave the following results:
Homology with a Predicted ORF from *N. gonorrhoeae*
m146/g146 90.1% identity in 212 aa overlap

```
              10         20         30         40         50         60
m146.pep  MAQILLRSRQVVIDHDKVKQYGLLDFMPCLRQPPLDNFPTVRPASVEARGKYVERRRQDK
          | || ||  |||||||||:||||:|||||||||||||||||||  |||||:|||||||||
g146      MKQIPLRLLQVVIDHDKVEQYGLFDFMPCLRQPPLDNFPTVRPAPFEARGKHVERRRQDK
              10         20         30         40         50         60

70         80         90        100        110        120
m146.pep  DADGFGQRVANLRRALNVDFQNHVIACRRQRIHTLRACAVIVAKYVGVFQKSFLRDKRLK
          |:|:|  |||||||||||||||||||||||||:|||||||||:|| |||||:|||| :|
g146      DTDSFRQRVANLRRALNVDFQNHVIACRRQRIHALRACAVIVAEYVCVFQKSLLRDKRFK
              70         80         90        100        110        120

130        140        150        160        170        180
m146.pep  LFFGNKVIMYAVCFAFTRRARRVRHGNAQTVMVCQQPRHQRGFARAGSGRNDKDVAFSIS
          |||||||||||||||||||||||:||||||||||||||||||||||||||||||||||||
g146      LFFGNKVIMYAVCFAFTRRARRMRHGNAQTVMVCQQPRHQRGFARAGSGRNDKDVAFSIS
             130        140        150        160        170        180

190        200        210
m146.pep  GHIFYLYIFQPIVSQWTPSFLFADAHILPLLFX
          ||||||||||||||| || |:||||||||||||
g146      GHIFYLYIFQPIVSQRTPYFIFADAHILPLLFX
             190        200        210
```

The following partial DNA sequence was identified in *N. meningitidis* <SEQ ID 581>:

```
a146.seq
    1   ATGGCGCAAA TCCTCCTCCG CCCGCGCCAA GTCATCATTG ACCACGACAA

51   AATCGAACAA TACGGACTGT TCGATTTCAT GCCTTGCCTT CGACAGCCTC

101   CTTTGGATAA CTTCCCGACT GTCCGTCCCG CGTCCGTTGA GACGCGCAGC

151   AAGCACATCG AAAGACGGCG GCAGGATAAA GATGCCGACG GCTTCGGGCA

201   GCGCATCTCG AACCTGAGCC GCGCCCTGAA CGTCGATTTC CAAAATCACG

251   TCATAACCTG CCGCCGCCAA CGCATTCACA CCCTCCGCGC TTGTGCCGTA

301   ATAGTTGCCG AACACGTCCG CGTATTCCAA AAAGCCTCC TGCGCGATAA

351   GCGACTCAAA CTCTTCTTTG GAAACAAAGT GATAATGTAC GCCGTTTGCT

401   TCGCCTTCAC GCGGCGGACG CGTCGTGTGC GACACGGAAA CGCGCAAACC

451   GTTATGGTTT GCCAACAGCC GCGACACCAG CGTGGTTTTG CCCGTGCCGG

501   AAGCGGCCGA AATGATAAAG ATGTTGCCTT TTCGATAAGC GGACATATTT

551   TTTACCTGTA TATTTTCCAG CCGATTGTAT CACAACGGAC ACCCGGTTTC

601   CTATTTGCCG ATGCCCATAT TTTGCCGCTA TTGTTTTGA
```

This corresponds to the amino acid sequence <SEQ ID 582; ORF 146.a>:

```
a146.pep
    1   MAQILLRPRQ VIIDHDKIEQ YGLFDFMPCL RQPPLDNFPT VRPASVETRS

51   KHIERRRQDK DADGFGQRIS NLSRALNVDF QNHVITCRRQ RIHTLRACAV

101   IVAEHVRVFQ KSLLRDKRLK LFFGNKVIMY AVCFAFTRRT RRVRHGNAQT

151   VMVCQQPRHQ RGFARAGSGR NDKDVAFSIS GHIFYLYIFQ PIVSQRTPGF

201   LFADAHILPL LF*
``` m146/a146 90.6% identity in 212 aa overlap

```
              10        20        30        40        50        60
m146.pep  MAQILLRSRQVVIDHDKVKQYGLLDFMPCLRQPPLDNFPTVRPASVEARGKYVERRRQDK
          ||||||| |||:|||||::||||:|||||||||||||||||||||:|:|::|||||||
a146      MAQILLRPRQVIIDHDKIEQYGLFDFMPCLRQPPLDNFPTVRPASVETRSKHIERRRQDK
              10        20        30        40        50        60

70        80        90       100       110       120
m146.pep  DADGFGQRVANLRRALNVDFQNHVIACRRQRIHTLRACAVIVAKYVGVFQKSFLRDKRLK
          ||||||||::||||||||||||||||:||||||||||||||||:::|||||:|||||||
a146      DADGFGQRISNLSRALNVDFQNHVITCRRQRIHTLRACAVIVAEHVRVFQKSLLRDKRLK
              70        80        90       100       110       120

130       140       150       160       170       180
m146.pep  LFFGNKVIMYAVCFAFTRRARRVRHGNAQTVMVCQQPRHQRGFARAGSGRNDKDVAFSIS
          |||||||||||||||||||:||||||||||||||||||||||||||||||||||||||||
a146      LFFGNKVIMYAVCFAFTRRTRRVRHGNAQTVMVCQQPRHQRGFARAGSGRNDKDVAFSIS
             130       140       150       160       170       180

190       200       210
m146.pep  GHIFYLYIFQPIVSQWTPSFLFADAHILPLLFX
          |||||||||||||||| ||:||||||||||||
a146      GHIFYLYIFQPIVSQRTPGFLFADAHILPLLFX
```

The following partial DNA sequence was identified in *N. gonorrhoeae* <SEQ ID 583>:

```
g147.seq (partial)
    1   ..ATGCGACGAG AAGCCAAAAT GGCACAAATC ACACTCAAAC CCATTGTTTT
   51     ATCAATTCTT TTAATCAACA CACCCCTCCT CGCCCAAGCG CATGAAACTG
  101     AGCAATCGGT GGGCTTGGAA ACGGTCAGCG TCGTCGGCAA AAGCCGTCCG
  151     CGCGCGACTT CGGGGCTGCT GCACACTTCG ACCGCCTCCG ACAAAATCAT
  201     CTCCGGCGAT ACTTTGCGCC AAAAAGCCGT CAACTTGGGC GACGCTTTGG
  251     ACGGCGTACC GGGCATCCAC GCTTCGCAAT ACGGCGGCGG CGCATCCGCT
  301     CCCGTTATTC GCGGTCAAAC GGGCAGACGG ATTAAAGTAT TGAACCATCA
  351     CGGCGAAACG GGCGATATGG CGGACTTTTC TCCCGATCAC GCCATTATGG
  401     TAGATACCGC CTTGTCGCAA CAGGTTGAAA TCCTGCGCGG GCCGGTTACG
  451     CTCTTGTACA GCTCGGcaa tgtggccgGG GCTGGtcaat gttgccgatg
  501     gAAAAAtccc ccaaaaAAtg cc..
```

This corresponds to the amino acid sequence <SEQ ID 584; ORF 147.ng>:

```
g147.pep (partial)
    1   ..MRREAKMAQI TLKPIVLSIL LINTPLLAQA HETEQSVGLE TVSVVGKSRP
   51     RATSGLLHTS TASDKIISGD TLRQKAVNLG DALDGVPGIH ASQYGGGASA
  101     PVIRGQTGRR IKVLNHHGET GDMADFSPDH AIMVDTALSQ QVEILRGPVT
  151     LLYSSGNVAG AGQCCRWKNP PKNA..
```

The following partial DNA sequence was identified in *N. meningitidis* <SEQ ID 585>:

```
m147.seq (partial)
    1   ..CCGCATAAAA CTGAGCAATC GGTGGATTTG GAAACGGTCA GCGTCGTCGG
   51     CAAAAGCCGT CCGCGCGCCA CGTCGGGGCT GTTGCACACT TCGACCGCCT
  101     CCGACAAAAT CATCTCCGGC GATACCTTGC GCCAAAAAGC CGTCAACTTG
  151     GGCGACGCTT TAGACGGCGT ACCGGGCATC CACGCTTCGC AATACGGCGG
```

-continued

```
 201   CGGCGCGTCT GCTCCCGTCA TTCGCGGTCA AACAGGCAGG CGGATTAAAG
 251   TGTTGAACCA TCACGGCGAA ACAGGCGATA TGGCGGATTT TTCGCCCGAT
 301   CACGCCATTA TGGTAGATAC CGCCTTGTCG CAACAGGTCG AAATCCTGCG
 351   CGGGCCGGTT ACGCTCTTGT ACAGCTCGGG CAATGTGGCG GGGCTGGTCG
 401   ATGTTGCCGA TGGCAAAATC CCCGAAAAAA TGCCTGAAAA CGGCGTATCG
 451   GGCGAACTCG GATTGCGTTT GAGCAGCGGC AATCTGGAAA AACTCACGTC
 501   CGGCGGCATC AATATCGGTT TGGGCAAAAA CTTTGTATTG CACACGGAAG
 551   GGCTGTACCG CAAATCGGGG GATTACGCCG TACCGCGTTA CCGCAATCTG
 601   AAACGCCTGC CCGACAGCCA CGCCGATTCG CAAACGGGCA GCATCGGGCT
 651   GTCTTGGGTT GGCGAAAAAG GTTTTATCGG CGTAGCGTAC AGCGACCGTC
 701   GCGACCAATA TGGTCTGCCT GCCCACAGCC ACGAATACGA TGATTGCCAC
 751   GCCGACATCA TCTGGCAAAA GAGCTTGATT AACAAACGCT ATTTACAGCT
 801   TTATCCGCAC CTGTTGACCG AAGAAGACAT CGATTACGAC AATCCGGGCT
 851   TGAGCTGCGG CTTCCACGAC GACGATAATG CACACGCACA CACCCACAGC
 901   GGCAGACCGT GGATAGACCT GCGCAACAAA CGCTACGAAC TCCGTGCCGA
 951   ATGGAAGCAA CCGTTCCCCG GTTTTGAAGC CCTGCGCGTA CACCTGAACC
1001   GCAACGACTA CCGCCACGAC GAAAAAGCAG GCGATGCAGT CGAAAACTTT
1051   TTTAACAACC AAACGCAAAA CGGCGGCATC GAGTTGCGCC ACCAACCCAT
1101   AGGTCGTCTG AAAGGCAGCT GGGGCGTGCA ATATTTACAA CAAAAATCCA
1151   GTGCTTTATC TGCCATATCC GAAGCGGTTA ACAACCGAT GCTGCTTGAC
1201   AACAAAGTGC AACATTACAG CTTTTTCGGT GTAGAACAGG CAAACTGGGA
1251   CAACTTCACG CTTGAAGGAG CGTACGCGT GGAAAAACAA AAAGCCTCCA
1301   TTCAGTACGA CAAAGCATTG ATTGATCGGG AAAACTACTA CAACCACCCC
1351   CTGCCCGACC TCGGCGCGCA CCGCCAAACC GCCCGCTCAT TCGCACTTTC
1401   GGGCAACTGG TATTTCACGC CACAACACAA ACTCAGCCTG ACCGCCTCCC
1451   ATCAGGAACG CCTGCCGTCA ACGCAAGAGC TGTACGCACA CGGCAAACAC
1501   GTCGCCACCA ACACCTTTGA AGTCGGCAAC AAACACCTCA ACAAAGAGCG
1551   TTCCAACAAT ATCGAACTCG CGCTGGGCTA CGAAGGCGAC CGCTGGCAAT
1601   ACAATCTGGC ACTCTACCGC AACCGCTTCG GTAACTACAT TTACGCCCAA
1651   ACCTTAAACG ACGGACGCGG CCCCAAATCC ATCGAAGACG ACAGCGAAAT
1701   GAAGCTCGTG CGCTACAACC AATCCGGCGC CGACTTCTAC GGCGCGGAAG
1751   GCGAAATCTA CTTCAAACCG ACACCGCGCT ACCGCATCGG CGTTTCCGGC
1801   GACTATGTAC GAGGCCGTCT GAAAAACCTG CCTTCCCTAC CCGGCAGAGA
1851   AGATGCCTAC GGCAACCGTC CTTTCATCGC ACAGGACGAC CAAAATGCCC
1901   CCCGTGTTCC GGCTGCGCGC CTCGGCTTCC ACCTGAAAGC CTCGCTGACC
1951   GACCGTATCG ATGCCAATTT GGACTACTAC CGCGTGTTCG CCCAAAACAA
2001   ACTCGCCCGC TACGAAACGC GCACGCCCGG ACACCATATG CTCAACCTCG
2051   GCGCAAACTA CCGCCGCAAT ACGCGCTATG GCGAGTGGAA TTGGTACGTC
2101   AAAGCCGACA ACCTGCTCAA CCAATCCGTT TACGCCCACA GCAGCTTTCT
2151   CTCTGATACG CCGCAAATGG GCCGCAGCTT TACCGGCGGC GTGAACGTGA
2201   AGTTTTAA
```

This corresponds to the amino acid sequence <SEQ ID 586; ORF 147>:

```
m147.pep (partial)
    1    ..PHKTEQSVDL ETVSVVGKSR PRATSGLLHT STASDKIISG DTLRQKAVNL

51    GDALDGVPGI HASQYGGGAS APVIRGQTGR RIKVLNHHGE TGDMADFSPD

101    HAIMVDTALS QQVEILRGPV TLLYSSGNVA GLVDVADGKI PEKMPENGVS

151    GELGLRLSSG NLEKLTSGGI NIGLGKNFVL HTEGLYRKSG DYAVPRYRNL

201    KRLPDSHADS QTGSIGLSWV GEKGFIGVAY SDRRDQYGLP AHSHEYDDCH

251    ADIIWQKSLI NKRYLQLYPH LLTEEDIDYD NPGLSCGFHD DDNAHAHTHS

301    GRPWIDLRNK RYELRAEWKQ PFPGFEALRV HLNRNDYRHD EKAGDAVENF

351    FNNQTQNARI ELRHQPIGRL KGSWGVQYLQ QKSSALSAIS EAVKQPMLLD

401    NKVQHYSFFG VEQANWDNFT LEGGVRVEKQ KASIQYDKAL IDRENYYNHP

451    LPDLGAHRQT ARSFALSGNW YFTPQHKLSL TASHQERLPS TQELYAHGKH

501    VATNTFEVGN KHLNKERSNN IELALGYEGD RWQYNLALYR NRFGNYIYAQ

551    TLNDGRGPKS IEDDSEMKLV RYNQSGADFY GAEGEIYFKP TPRYRIGVSG

601    DYVRGRLKNL PSLPGREDAY GNRPFIAQDD QNAPRVPAAR LGFHLKASLT

651    DRIDANLDYY RVFAQNKLAR YETRTPGHHM LNLGANYRRN TRYGEWNWYV

701    KADNLLNQSV YAHSSFLSDT PQMGRSFTGG VNVKF*
```

Computer analysis of this amino acid sequence gave the following results:
Homology with a Predicted ORF from *N. gonorrhoeae*
  m147/g147 92.3% identity in 142 aa overlap

```
                                         10         20         30
     m147.pep                   PHKTEQSVDLETVSVVGKSRPRATSGLLHTS
                                |:|||| ||||||||||||||||||||||||
     g147     MRREAKMAQITLKPIVLSILLINTPLLAQAHETEQSVGLETVSVVGKSRPRATSGLLHTS
                      10        20        30        40        50        60

40        50        60        70        80        90
     m147.pep TASDKIISGDTLRQKAVNLGDALDGVPGIHASQYGGGASAPVIRGQTGRRIKVLNHHGET
              ||||||||||||||||||||||||||||||||||||||||||||||||||||||||||||
     g147     TASDKIISGDTLRQKAVNLGDALDGVPGIHASQYGGGASAPVIRGQTGRRIKVLNHHGET
                      70        80        90       100       110       120

100       110       120       130       140       150
     m147.pep GDMADFSPDHAIMVDTALSQQVEILRGPVTLLYSSGNVAGLVDVADGKIPEKMPENGVSG
              ||||||||||||||||||||||||||||||||||||||||||  :     |  |
     g147     GDMADFSPDHAIMVDTALSQQVEILRGPVTLLYSSGNVAGAGQCCRWKNPPKNA
```

The following partial DNA sequence was identified in *N. meningitidis* <SEQ ID 587>:

```
a147.seq
    1    ATGCGACGAG AAGCCAAAAT GGCACAAACT ACACTCAAAC CCATTGTTTT

51    ATCAATTCTT TTAATCAACA CACCCCTCCT CTCCCAAGCG CATGGAACTG

101    AGCAATCAGT GGGCTTGGAA ACGGTCAGCG TCGTCGGCAA AAGCCGTCCG

151    CGCGCCACTT CGGGGCTGCT GCACACTTCT ACCGCCTCCG ACAAAATCAT

201    CAGCGGCGAC ACCTTGCGAC AAAAAGCCGT CAACTTGGGT GATGCTTTAG

251    ACGGCGTACC GGGCATTCAT GCCTCGCAAT ACGGCGGCGG CGCATCCGCT

301    CCCGTTATTC GCGGTCAAAC AGGCAGACGG ATTAAAGTGT TGAACCATCA

351    CGGCGAAACG GGCGACATGG CGGACTTCTC TCCAGACCAT GCAATCATGG
```

-continued

```
 401 TGGACAGCGC CTTGTCGCAA CAGGTCGAAA TCCTGCGCGG TCCGGTTACG

451 CTCTTGTACA GCTCGGGCAA TGTGGCGGGG CTGGTCGATG TTGCCGATGG

501 CAAAATCCCC GAAAAATGC  CTGAAAACGG CGTATCGGGC GAACTCGGAT

551 TGCGTTTGAG CAGCGGCAAT CTGGAAAAAC TCACGTCCGG CGGCATCAAT

601 ATCGGTTTGG GCAAAAACTT TGTATTGCAC ACGGAAGGGC TGTACCGCAA

651 ATCGGGGGAT TACGCCGTAC CGCGTTACCG CAATCTGAAA CGCCTGCCCG

701 ACAGCCACGC CGATTCGCAA ACGGGCAGCA TCGGGCTGTC TTGGGTTGGC

751 GAAAAAGGCT TTATCGGCGC AGCATACAGC GACCGTCGCG ACCAATATGG

801 TCTGCCTGCC CACAGCCACG AATACGATGA TTGCCACGCC GACATCATCT

851 GGCAAAAGAG TTTGATTAAC AAACGCTATT TGCAGCTTTA TCCGCACCTG

901 TTGACCGAAG AAGACATCGA TTACGACAAT CCGGGCTTGA GCTGCGGCTT

951 TCACGACGAC GATGATGCAC ACGCCCATGC CCACAACGGC AAACCTTGGA

1001 TAGACCTGCG CAACAAACGC TACGAACTCC GCGCCGAATG GAAGCAACCG

1051 TTCCCCGGTT TTGAAGCCCT GCGCGTACAC CTGAACCGCA ACGACTACCG

1101 CCACGACGAA AAAGCAGGCG ATGCAGTAGA AAACTTTTTT AACAACCAAA

1151 CGCAAAACGC CCGTATCGAG TTGCGCCACC AACCCATAGG CCGTCTGAAA

1201 GGCAGCTGGG GCGTGCAATA TTTGGGACAA AAATCCAGTG CTTTATCTGC

1251 CACATCCGAA GCGGTCAAAC AACCGATGCT GCTTGACAAT AAAGTGCAAC

1301 ATTACAGCTT TTTCGGTGTA GAACAGGCAA ACTGGGACAA CTTCACGCTT

1351 GAAGGCGGCG TACGCGTGGA AAAACAAAAA GCCTCCATCC GCTACGACAA

1401 AGCATTGATT GATCGGGAAA ACTACTACAA CCATCCCCTG CCCGACCTCG

1451 GCGCGCACCG CCAAACCGCC CGCTCATTCG CACTTTCGGG CAACTGGTAT

1501 TTCACGCCAC AACACAAACT CAGCCTGACC GCCTCCCATC AGGAACGCCT

1551 GCCGTCAACG CAAGAGCTGT ACGCACACGG CAAACACGTC GCCACCAACA

1601 CCTTTGAAGT CGGCAACAAA CACCTCAACA AAGAGCGTTC CAACAATATC

1651 GAACTCGCGC TGGGCTACGA AGGCGACCGC TGGCAATACA ATCTGGCACT

1701 CTACCGCAAC CGCTTCGGCA ACTACATTTA CGCCCAAACC TTAAACGACG

1751 GACGCGGCCC CAAATCCATC GAAGACGACA GCGAAATGAA GCTCGTGCGC

1801 TACAACCAAT CCGGTGCGGA CTTCTACGGC GCGGAAGGCG AAATCTACTT

1851 CAAACCGACA CCGCGCTACC GCATCGGCGT TTCCGGCGAC TATGTACGAG

1901 GCCGTCTGAA AAACCTGCCT TCCCTACCCG GCAGGGAAGA CGCCTACGGC

1951 AACCGCCCAC TCATTGCCCA AGCCGACCAA AACGCCCCTC GCGTTCCGGC

2001 TGCGCGCCTC GGCGTCCACC TGAAAGCCTC GCTGACCGAC CGCATCGATG

2051 CCAATTTGGA CTACTACCGC GTGTTCGCCC AAAACAAACT CGCCCGCTAC

2101 GAAACGCGCA CGCCCGGACA CCATATGCTC AACCTCGGCG CAAACTACCG

2151 CCGCAATACG CGCTATGGCG AGTGGAATTG GTACGTCAAA GCCGACAACC

2201 TGCTCAACCA ATCCGTTTAC GCCCACAGCA GCTTCCTCTC TGATACGCCG

2251 CAAATGGGCC GCAGCTTTAC CGGCGGCGTG AACGTGAAGT TTTAA
```

This corresponds to the amino acid sequence <SEQ ID 588; ORF 147.a>:

```
a147.pep
    1 MRREAKMAQT TLKPIVLSIL LINTPLLSQA HGTEQSVGLE TVSVVGKSRP

51 RATSGLLHTS TASDKIISGD TLRQKAVNLG DALDGVPGIH ASQYGGGASA

101 PVIRGQTGRR IKVLNHHGET GDMADFSPDH AIMVDSALSQ QVEILRGPVT

151 LLYSSGNVAG LVDVADGKIP EKMPENGVSG ELGLRLSSGN LEKLTSGGIN

201 IGLGKNFVLH TEGLYRKSGD YAVPRYRNLK RLPDSHADSQ TGSIGLSWVG

251 EKGFIGAAYS DRRDQYGLPA HSHEYDDCHA DIIWQKSLIN KRYLQLYPHL

301 LTEEDIDYDN PGLSCGFHDD DDAHAHAHNG KPWIDLRNKR YELRAEWKQP

351 FPGFEALRVH LNRNDYRHDE KAGDAVENFF NNQTQNARIE LRHQPIGRLK

401 GSWGVQYLGQ KSSALSATSE AVKQPMLLDN KVQHYSFFGV EQANWDNFTL

451 EGGVRVEKQK ASIRYDKALI DRENYYNHPL PDLGAHRQTA RSFALSGNWY

501 FTPQHKLSLT ASHQERLPST QELYAHGKHV ATNTFEVGNK HLNKERSNNI

551 ELALGYEGDR WQYNLALYRN RFGNYIYAQT LNDGRGPKSI EDDSEMKLVR

601 YNQSGADFYG AEGEIYFKPT PRYRIGVSGD YVRGRLKNLP SLPGREDAYG

651 NRPLIAQADQ NAPRVPAARL GVHLKASLTD RIDANLDYYR VFAQNKLARY

701 ETRTPGHHML NLGANYRRNT RYGEWNWYVK ADNLLNQSVY AHSSFLSDTP

751 QMGRSFTGGV NVKF*
``` m147/a147 98.1% identity in 734 aa overlap

```
                            10         20         30
m147.pep             PHKTEQSVDLETVSVVGKSRPRATSGLLHTS
                       ||||| |||||||||||||||||||||||
a147    MRREAKMAQTTLKPIVLSILLINTPLLSQAHGTEQSVGLETVSVVGKSRPRATSGLLHTS
                 10         20         30         40         50         60

40         50         60         70         80         90
m147.pep TASDKIISGDTLRQKAVNLGDALDGVPGIHASQYGGGASAPVIRGQTGRRIKVLNHHGET
         ||||||||||||||||||||||||||||||||||||||||||||||||||||||||||||
a147    TASDKIISGDTLRQKAVNLGDALDGVPGIHASQYGGGASAPVIRGQTGRRIKVLNHHGET
                 70         80         90        100        110        120

100        110        120        130        140        150
m147.pep GDMADFSPDHAIMVDTALSQQVEILRGPVTLLYSSGNVAGLVDVADGKIPEKMPENGVSG
         |||||||||||||||| :||||||||||||||||||||||||||||||||||||||||||
a147    GDMADFSPDHAIMVDSALSQQVEILRGPVTLLYSSGNVAGLVDVADGKIPEKMPENGVSG
                130        140        150        160        170        180

160        170        180        190        200        210
m147.pep ELGLRLSSGNLEKLTSGGINIGLGKNFVLHTEGLYRKSGDYAVPRYRNLKRLPDSHADSQ
         ||||||||||||||||||||||||||||||||||||||||||||||||||||||||||||
a147    ELGLRLSSGNLEKLTSGGINIGLGKNFVLHTEGLYRKSGDYAVPRYRNLKRLPDSHADSQ
                190        200        210        220        230        240

220        230        240        250        260        270
m147.pep TGSIGLSWVGEKGFIGVAYSDRRDQYGLPAHSHEYDDCHADIIWQKSLINKRYLQLYPHL
         ||||||||||||||||:|||||||||||||||||||||||||||||||||||||||||||
a147    TGSIGLSWVGEKGFIGAAYSDRRDQYGLPAHSHEYDDCHADIIWQKSLINKRYLQLYPHL
                250        260        270        280        290        300

280        290        300        310        320        330
m147.pep LTEEDIDYDNPGLSCGFHDDDNAHAHTHSGRPWIDLRNKRYELRAEWKQPFPGFEALRVH
         ||||||||||||||||||||| ::||||:|:|:|||||||||||||||||||||||||||
a147    LTEEDIDYDNPGLSCGFHDDDDAHAHAHNGKPWIDLRNKRYELRAEWKQPFPGFEALRVH
                310        320        330        340        350        360

340        350        360        370        380        390
m147.pep LNRNDYRHDEKAGDAVENFFNNQTQNARIELRHQPIGRLKGSWGVQYLQQKSSALSAISE
         |||||||||||||||||||||||||||||||||||||||||||||||||:|||||||:||
a147    LNRNDYRHDEKAGDAVENFFNNQTQNARIELRHQPIGRLKGSWGVQYLGQKSSALSATSE
                370        380        390        400        410        420

400        410        420        430        440        450
m147.pep AVKQPMLLDNKVQHYSFFGVEQANWDNFTLEGGVRVEKQKASIQYDKALIDRENYYNHPL
         ||||||||||||||||||||||||||||||||||||||||||:|||||||||||||||||
a147    AVKQPMLLDNKVQHYSFFGVEQANWDNFTLEGGVRVEKQKASIRYDKALIDRENYYNHPL
                430        440        450        460        470        480
```

```
                460        470        480        490        500        510
m147.pep  PDLGAHRQTARSFALSGNWYFTPQHKLSLTASHQERLPSTQELYAHGKHVATNTFEVGNK
          ||||||||||||||||||||||||||||||||||||||||||||||||||||||||||||
a147      PDLGAHRQTARSFALSGNWYFTPQHKLSLTASHQERLPSTQELYAHGKHVATNTFEVGNK
                490        500        510        520        530        540

520        530        540        550        560        570
m147.pep  HLNKERSNNIELALGYEGDRWQYNLALYRNRFGNYIYAQTLNDGRGPKSIEDDSEMKLVR
          ||||||||||||||||||||||||||||||||||||||||||||||||||||||||||||
a147      HLNKERSNNIELALGYEGDRWQYNLALYRNRFGNYIYAQTLNDGRGPKSIEDDSEMKLVR
                550        560        570        580        590        600

580        590        600        610        620        630
m147.pep  YNQSGADFYGAEGEIYFKPTPRYRIGVSGDYVRGRLKNLPSLPGREDAYGNRPFIAQDDQ
          ||||||||||||||||||||||||||||||||||||||||||||||:|||  ||
a147      YNQSGADFYGAEGEIYFKPTPRYRIGVSGDYVRGRLKNLPSLPGREDAYGNRPLIAQADQ
                610        620        630        640        650        660

640        650        660        670        680        690
m147.pep  NAPRVPAARLGFHLKASLTCRIDANLDYYRVFAQNKLARYETRTPGHHMLNLGANYRRNT
          |||||||||||| ||||||| |||||||||||||||||||||||||||||||||||||||
a147      NAPRVPAARLGVHLKASLTDRIDANLDYYRVFAQNKLARYETRTPGHHMLNLGANYRRNT
                670        680        690        700        710        720

700        710        720        730
m147.pep  RYGEWNWYVKADNLLNQSVYAHSSFLSDTPQMGRSFTGGVNVKFX
          |||||||||||||||||||||||||||||||||||||||||||||
a147      RYGEWNWYVKADNLLNQSVYAHSSFLSDTPQMGRSFTGGVNVKFX
                730        740        750        760
```

The following partial DNA sequence was identified in *N. gonorrhoeae* <SEQ ID 589>:

```
g148.seq
    1    ATGGCGTTAA AAACATCAAA CTTGGAACAC GCAATGctgg ttcaTCCCGA

51    AgctATgagt gtcggcgCGC TTGccgAcaa AATCCGCAAA AtcgaAAact 101    gGCCGCAAAA AGgcaTCTTA TTCCACGACA TCACGCCCGT CCTGCAAAGT

151    GCGGAATACT TCCGCCTTTT GGTCGATTTG CTGGTTTACC GCTATATGGA

201    TCAGAAAATC GACATCGTTG CCGGCTTGGA CGCGCGCGGC TTCATTATCG

251    GCGCGGCACT CGCCTACCAG CTCAaCGtcg gctTCGTCCC CATCCGCAAA

301    AAAGGCAAGC TGCCTTTTGA AACCGTATCG CAAAGCTAcg cgcTCGAATA

351    CGGGGAAGCT GCGGTGGAAA TCCACACCGa tgccgTCAAA CCCGGTTCGC

401    GCGTCCTGCT GGTCGATGAT TTGGTTGCCA CGGGCGGCAC AATGCTTGCC

451    GGGCTGGAAC TGATCCGCAA ACTCGGCGGG GAAATTGTCG AAgccgccgC

501    CATTTTGGAA TTTACCGACC TTCAAGGCGG CAAGAATATC CGCGCAAGTG

551    GCGCGCCCTT ATTTACCCTG CTTCAAAACG AAGGCTGCAT GAAAGGCTGA
```

This corresponds to the amino acid sequence <SEQ ID 590; ORF 148.ng>:

```
g148.pep
    1    MALKTSNLEH AMLVHPEAMS VGALADKIRK IENWPQKGIL FHDITPVLQS

51    AEYFRLLVDL LVYRYMDQKI DIVAGLDARG FIIGAALAYQ LNVGFVPIRK

101    KGKLPFETVS QSYALEYGEA AVEIHTDAVK PGSRVLLVDD LVATGGTMLA

151    GLELIRKLGG EIVEAAAILE FTDLQGGKNI RASGAPLFTL LQNEGCMKG*
```

The following partial DNA sequence was identified in *N. meningitidis* <SEQ ID 591>:

```
m148.seq
    1   ATGGCGTTAA AAACATCAAA CTTGGAACAC GCAATGCTGG TTCATCCCGA

51   AGCTATGAGT GTCGGCGCGC TTGCCGACAA AATCCGCAAA ATCGAAAACT

101   GGCCGCAAAA AGGCATCTTA TTCCACGACA TCACGCCCGT CCTTCAAAGC

151   GCGGAATACT TCCGCCTTTT GGTTGATTTA TTGGTTTACC GCTATATGGA

201   TCAGAAAATC GACATCGTTG CCGGTTTGGA CGCGCGCGGC TTCATTATCG

251   GCGCGGCACT CGCCTACCAG CTCAACGTCG GTTTCGTCCC CATCCGCAAA

301   AAAGGCAAGC TGCCTTTTGA AACCGTATCG CAAAGCTACG CGCTCGAATA

351   CGGGGAAGCT GCGGTGGAAA TCCACACCGA TGCCGTCAAA CTCGGTTCGC

401   GCGTGCTGCT GGTCGATGAT TTGATTGCCA CGGGCGGCAC GATGCTTGCC

451   GGACTGGAAC TGATCCGCAA ACTCGGCGGA GAAATTGTCG AAGCCGCCGC

501   CATTTTGGAA TTTACCGACC TTCAAGGCGG CAAGAATATC CGTGCAAGCG

551   GCGCGCCCTT ATTTACCCTG CTTCAAAACG AAGGCTGTAT GAAGGGCTGA
```

This corresponds to the amino acid sequence <SEQ ID 592; ORF 148>:

```
m148.pep
    1   MALKTSNLEH AMLVHPEAMS VGALADKIRK IENWPQKGIL FHDITPVLQS

51   AEYFRLLVDL LVYRYMDQKI DIVAGLDARG FIIGAALAYQ LNVGFVPIRK

101   KGKLPFETVS QSYALEYGEA AVEIHTDAVK LGSRVLLVDD LIATGGTMLA

151   GLELIRKLGG EIVEAAAILE FTDLQGGKNI RASGAPLFTL LQNEGCMKG*
```

Computer analysis of this amino acid sequence gave the following results:
Homology with a Predicted ORF from *N. gonorrhoeae*
m148/g148 99.0% identity in 199 aa overlap

```
                   10         20         30         40         50         60
m148.pep   MALKTSNLEHAMLVHPEAMSVGALADKIRKIENWPQKGILFHDITPVLQSAEYFRLLVDL
           ||||||||||||||||||||||||||||||||||||||||||||||||||||||||||||
g148       MALKTSNLEHAMLVHPEAMSVGALADKIRKIENWPQKGILFHDITPVLQSAEYFRLLVDL
                   10         20         30         40         50         60

70         80         90        100        110        120
m148.pep   LVYRYMDQKIDIVAGLDARGFIIGAALAYQLNVGFVPIRKKGKLPFETVSQSYALEYGEA
           ||||||||||||||||||||||||||||||||||||||||||||||||||||||||||||
g148       LVYRYMDQKIDIVAGLDARGFIIGAALAYQLNVGFVPIRKKGKLPFETVSQSYALEYGEA
                   70         80         90        100        110        120

130        140        150        160        170        180
m148.pep   AVEIHTDAVKLGSRVLLVDDLIATGGTMLAGLELIRKLGGEIVEAAAILEFTDLQGGKNI
           ||||||||||| ||||||||||:|||||||||||||||||||||||||||||||||||||
g148       AVEIHTDAVKPGSRVLLVDDLVATGGTMLAGLELIRKLGGEIVEAAAILEFTDLQGGKNI
                  130        140        150        160        170        180

190        200
m148.pep   RASGAPLFTLLQNEGCMKGX
           ||||||||||||||||||||
g148       RASGAPLFTLLQNEGCMKGX
                  190        200
```

The following partial DNA sequence was identified in *N. meningitidis* <SEQ ID 593>:

```
a148.seq
    1   ATGGCGTTAA AAACATCAAA CTTGGAACAC GCAATGCTGG TTCATCCCGA

51   AGCTATGAGT GTCGGTGCGC TTGCCGACAA AATCCGCAAA ATCGAAAACT

101   GGCCGCAAAA AGGCATCTTA TTCCACGACA TCACGCCCGT CCTGCAAAGC
```

-continued

```
    151 GCGGAATACT TCCGACTTTT GGTTGATTTA TTGGTTTACC GCTATATGGA

201 TCAGAAAATC GACATCGTTG CCGGTTTGGA CGCGCGCGGC TTCATTATCG

251 GCGCGGCACT CGCCTACCAG CTCAACGTCG GTTTCGTCCC CATCCGCAAA

301 AAAGGCAAGC TGCCTTTTGA AACCGTATCG CAAAGCTACG CGCTCGAATA

351 CGGGGAAGCT GCGGTGGAAA TCCACACCGA TGCCGTCAAA CTCGGTTCGC

401 GCGTGCTGCT GGTCGATGAT TTGGTTGCCA CGGGCGGCAC GATGCTTGCC

451 GGACTGGAGC TGATCCGCAA ACTCGGCGGG GAAATTGTCG AAGCCGCCGC

501 CATTTTGGAA TTTACCGACC TTCAAGGCGG CAAGAATATC CGTGCAAGCG

551 GCGCGCCCTT ATTTACCCTG CTTCAAAACG AAGGCTGTAT GAAGGGCTGA
```

This corresponds to the amino acid sequence <SEQ ID 594; ORF 148.a>:

```
a148.pep
      1 MALKTSNLEH AMLVHPEAMS VGALADKIRK IENWPQKGIL FHDITPVLQS

51 AEYFRLLVDL LVYRYMDQKI DIVAGLDARG FIIGAALAYQ LNVGFVPIRK

101 KGKLPFETVS QSYALEYGEA AVEIHTDAVK LGSRVLLVDD LVATGGTMLA

151 GLELIRKLGG EIVEAAAILE FTDLQGGKNI RASGAPLFTL LQNEGCMKG*
``` m148/a148 99.5% identity in 199 aa overlap

```
                   10         20         30         40         50         60
   m148.pep  MALKTSNLEHAMLVHPEAMSVGALADKIRKIENWPQKGILFHDITPVLQSAEYFRLLVDL
             ||||||||||||||||||||||||||||||||||||||||||||||||||||||||||||
       a148  MALKTSNLEHAMLVHPEAMSVGALADKIRKIENWPQKGILFHDITPVLQSAEYFRLLVDL
                   10         20         30         40         50         60

70         80         90        100        110        120
   m148.pep  LVYRYMDQKIDIVAGLDARGFIIGAALAYQLNVGFVPIRKKGKLPFETVSQSYALEYGEA
             ||||||||||||||||||||||||||||||||||||||||||||||||||||||||||||
       a148  LVYRYMDQKIDIVAGLDARGFIIGAALAYQLNVGFVPIRKKGKLPFETVSQSYALEYGEA
                   70         80         90        100        110        120

130        140        150        160        170        180
   m148.pep  AVSIHTDAVKLGSRVLLVDDLIATGGTMLAGLELIRKLGGEIVEAAAILEFTDLQGGKNI
             ||||||||||||||||||||:|||||||||||||||||||||||||||||||||||||||
       a148  AVEIHTDAVKLGSRVLLVDDLVATGGTMLAGLELIRKLGGEIVEAAAILEFTDLQGGKNI
                  130        140        150        160        170        180

190        200
   m148.pep  RASGAPLFTLLQNEGCMKGX
             ||||||||||||||||||||
       a148  RASGAPLFTLLQNEGCMKGX
                  190        200
```

The following partial DNA sequence was identified in *N. gonorrhoeae* <SEQ ID 595>:

```
g149.seq
      1 ATGTTGATTG ACAACAATGT CCGCCATTAC AGCTTTTTCG GTGTAGAACA

51 GGCAAATTGG GACAACTTCA CGCTTGAAGG CGGCGTACGC GTGGAAAAAC

101 AAAAAGCCTC CATCCGGTAC GACAAAGCAT TGATTGATCG AGAAAACTAC

151 TACAACCAGC CCCTGCCCGA CCTCGGCGCG CACCGCCAAA CCGCCCGCTC

201 GTTCGCACTT TCGGGCAACT GGTATTTCAC GCCACACCAC AAACTCAGCC

251 TGACCGCCTC CCATCAGGAa cgCCTGCCGT CAACGCaagA actGtACgca 301 cacggcAAGC ACGtcgccac CAACACCTTT GAagtcggca acaaACACCT 351 CAACAAAGaG CgttccaacA atatcgaACT CGCGCTGGgc tAcaaaggcg
```

-continued

```
 401   accGCTGGCA ATACAATCTG GCAGCCTACC GCAACCGAtT CGGCAACTAC
 451   ATTTACGCCC AAACCTTAaa cgacggacgC GGCCCCAAAT CCATCgaaga
 501   cgacagcgaA ATGaagcTCG TGCGCTACAA CCAATCCGGT GCCGACTTCT
 551   ACGgcgcggA aggcgaaatc tACTTcaaaC CGAcACCGCG CTACCGCATC
 601   GGTGTTTCCG GCGACTatgt acgaggccgT CTGAAAAACC TGCCGTCCCT
 651   ACCCGGCAGG gaagatccCT AcggcAAACG TCccttcaTC GCACAAGCCG
 701   ACCAAAACGC CCCCCGCATT ccggctGCGC GCCTCGGCTT CCACCTGAAA
 751   ACCTCGCTAA CCGACCGTAT CGATGCCAAT TTGGACTACT ACCGCGTGTT
 801   CGCCCAAAAC AAACTCGCCC GCTACGAAAC GCGTACGCCC GGACACCATA
 851   TGCTCAACCT CGGTGCAAAC TACCGCCGCA ATACGCGCTA TGGCGAGTGG
 901   AATTGGTACG TCAAAGCCGA CAACCTGCtc aACcaatCcg tTTACGCCCa
 951   cAGCAGCTTC CTCTCTGATA CGCCGCAAAt gGGCCGCAGC TTtgccgGCg
1001   gcgtaAACGT GaAGTTttaA
```

This corresponds to the amino acid sequence <SEQ ID 596; ORF 149.ng>:

```
g149.pep
   1   MLIDNNVRHY SFFGVEQANW DNFTLEGGVR VEKQKASIRY DKALIDRENY
  51   YNQPLPDLGA HRQTARSFAL SGNWYFTPHH KLSLTASHQE RLPSTQELYA
 101   HGKHVATNTF EVGNKHLNKE RSNNIELALG YKGDRWQYNL AAYRNRFGNY
 151   IYAQTLNDGR GPKSIEDDSE MKLVRYNQSG ADFYGAEGEI YFKPTPRYRI
 201   GVSGDYVRGR LKNLPSLPGR EDPYGKRPFI AQADQNAPRI PAARLGFHLK
 251   TSLTDRIDAN LDYYRVFAQN KLARYETRTP GHHMLNLGAN YRRNTRYGEW
 301   NWYVKADNLL NQSVYAHSSF LSDTPQMGRS FAGGVNVKF*
```

The following partial DNA sequence was identified in *N. meningitidis* <SEQ ID 597>:

```
m149.seq
   1   ATGCTGCTTG ACAACAAAGT GCAACATTAC AGCTTTTTCG GTGTAGAACA
  51   GGCAAACTGG GACAACTTCA CGCTTGAAGG AGGCGTACGC GTGGAAAAAC
 101   AAAAAGCCTC CATTCAGTAC GACAAAGCAT TGATTGATCG GGAAAACTAC
 151   TACAACCACC CCCTGCCCGA CCTCGGCGCG CACCGCCAAA CCGCCCGCTC
 201   ATTCGCACTT TCGGGCAACT GGTATTTCAC GCCACAACAC AAACTCAGCC
 251   TGACCGCCTC CCATCAGGAA CGCCTGCCGT CAACGCAAGA GCTGTACGCA
 301   CACGGCAAAC ACGTCGCCAC CAACACCTTT GAAGTCGGCA ACAAACACCT
 351   CAACAAAGAG CGTTCCAACA ATATCGAACT CGCGCTGGGC TACGAAGGCG
 401   ACCGCTGGCA ATACAATCTG GCACTCTACC GCAACCGCTT CGGTAACTAC
 451   ATTTACGCCC AAACCTTAAA CGACGGACGC GGCCCCAAAT CCATCGAAGA
 501   CGACAGCGAA ATGAAGCTCG TGCGCTACAA CCAATCCGGC GCCGACTTCT
 551   ACGGCGCGGA AGGCGAAATC TACTTCAAAC CGACACCGCG CTACCGCATC
 601   GGCGTTTCCG GCGACTATGT ACGAGGCCGT CTGAAAAACC TGCCTTCCCT
 651   ACCCGGCAGA GAAGATGCCT ACGGCAACCG TCCTTTCATC GCACAGGACG
```

-continued

```
 701   ACCAAAATGC CCCCCGTGTT CCGGCTGCGC GCCTCGGCTT CCACCTGAAA

751   GCCTCGCTGA CCGACCGTAT CGATGCCAAT TTGGACTACT ACCGCGTGTT

801   CGCCCAAAAC AAACTCGCCC GCTACGAAAC GCGCACGCCC GGACACCATA

851   TGCTCAACCT CGGCGCAAAC TACCGCCGCA ATACGCGCTA TGGCGAGTGG

901   AATTGGTACG TCAAAGCCGA CAACCTGCTC AACCAATCCG TTTACGCCCA

951   CAGCAGCTTT CTCTCTGATA CGCCGCAAAT GGGCCGCAGC TTTACCGGCG

1001   GCGTGAACGT GAAGTTTTAA
```

This corresponds to the amino acid sequence <SEQ ID 598; ORF 149>:

```
m149.pep
    1    MLLDNKVQHY SFFGVEQANW DNFTLEGGVR VEKQKASIQY DKALIDRENY

51    YNHPLPDLGA HRQTARSFAL SGNWYFTPQH KLSLTASHQE RLPSTQELYA

101    HGKHVATNTF EVGNKHLNKE RSNNIELALG YEGDRWQYNL ALYRNRFGNY

151    IYAQTLNDGR GPKSIEDDSE MKLVRYNQSG ADFYGAEGEI YFKPTPRYRI

201    GVSGDYVRGR LKNLPSLPGR EDAYGNRPFI AQDDQNAPRV PAARLGFHLK

251    ASLTDRIDAN LDYYRVFAQN KLARYETRTP GHHMLNLGAN YRRNTRYGEW

301    NWYVKADNLL NQSVYAHSSF LSDTPQMGRS FTGGVNVKF*
```

Computer analysis of this amino acid sequence gave the following results:
Homology with a Predicted ORF from *N. gonorrhoeae*
ORF 149 shows 95.9% identity over a 339 aa overlap with a predicted ORF (ORF 149.ng) from *N. gonorrhoeae*:

```
   m149/g149
                      10         20         30         40         50         60
        m149.pep  MLLDNKVQHYSFFGVEQANWDNFTLEGGVRVEKQKASIQYDKALIDRENYYNHPLPDLGA
                  ||:||:|:|||||||||||||||||||||||||||||:|||||||||||||:|||||||
            g149  MLIDNNVRHYSFFGVEQANWDNFTLEGGVRVEKQKASIRYDKALIDRENYYNQPLPDLGA
                      10         20         30         40         50         60
                      70         80         90        100        110        120
        m149.pep  HRQTARSFALSGNWYFTPQHKLSLTASHQERLPSTQELYAHGKHVATNTFEVGNKHLNKE
                  ||||||||||||||||||||:|||||||||||||||||||||||||||||||||||||||
            g149  HRQTARSFALSGNWYFTPHHKLSLTASHQERLPSTQELYAHGKHVATNTFEVGNKHLNKE
                      70         80         90        100        110        120
                     130        140        150        160        170        180
        m149.pep  RSNNIELALGYEGDRWQYNLALYRNRFGNYIYAQTLNDGRGPKSIEDDSEMKLVRYNQSG
                  ||||||||||:|||||||||  |||||||||||||||||||||||||||||||||||||
            g149  RSNNIELALGYKGDRWQYNLAAYRNRFGNYIYAQTLNDGRGPKSIEDDSEMKLVRYNQSG
                     130        140        150        160        170        180
                     190        200        210        220        230        240
        m149.pep  ADFYGAEGEIYFKPTPRYRIGVSGDYVRGRLKNLPSLPGREDAYGNRPFIAQDDQNAPRV
                  |||||||||||||||||||||||||||||||||||||||||| |:||||||  |||||:
            g149  ADFYGAEGEIYFKPTPRYRIGVSGDYVRGRLKNLPSLPGREDPYGKRPFIAQADQNAPRI
                     190        200        210        220        230        240
                     250        260        270        280        290        300
        m149.pep  PAARLGFHLKASLTDRIDANLDYYRVFAQNKLARYETRTPGHHMLNLGANYRRNTRYGEW
                  ||||||||||:|||||||||||||||||||||||||||||||||||||||||||||||||
            g149  PAARLGFHLKTSLTDRIDANLDYYRVFAQNKLARYETRTPGHHMLNLGANYRRNTRYGEW
                     250        260        270        280        290        300
                     310        320        330        340
        m149.pep  NWYVKADNLLNQSVYAHSSFLSDTPQMGRSFTGGVNVKFX
                  |||||||||||||||||||||||||||||||:||||||||
            g149  NWYVKADNLLNQSVYAHSSFLSDTPQMGRSFAGGVNVKFX
                     310        320        330        340
```

The following partial DNA sequence was identified in *N. meningitidis* <SEQ ID 599>:

a149.seq
```
   1 ATGCTGCTTG ACAATAAAGT GCAACATTAC AGCTTTTTCG GTGTAGAACA
  51 GGCAAACTGG ACAACTTCA CGCTTGAAGG CGGCGTACGC GTGGAAAAAC
 101 AAAAAGCCTC CATCCGCTAC GACAAAGCAT TGATTGATCG GGAAAACTAC
 151 TACAACCATC CCCTGCCCGA CCTCGGCGCG CACCGCCAAA CCGCCCGCTC
 201 ATTCGCACTT TCGGGCAACT GGTATTTCAC GCCACAACAC AAACTCAGCC
 251 TGACCGCCTC CCATCAGGAA CGCCTGCCGT CAACGCAAGA GCTGTACGCA
 301 CACGGCAAAC ACGTCGCCAC CAACACCTTT GAAGTCGGCA ACAAACACCT
 351 CAACAAAGAG CGTTCCAACA ATATCGAACT CGCGCTGGGC TACGAAGGCG
 401 ACCGCTGGCA ATACAATCTG GCACTCTACC GCAACCGCTT CGGCAACTAC
 451 ATTTACGCCC AAACCTTAAA CGACGGACGC GGCCCCAAAT CCATCGAAGA
 501 CGACAGCGAA ATGAAGCTCG TGCGCTACAA CCAATCCGGT GCGGACTTCT
 551 ACGGCGCGGA AGGCGAAATC TACTTCAAAC CGACACCGCG CTACCGCATC
 601 GGCGTTTCCG GCGACTATGT ACGAGGCCGT CTGAAAAACC TGCCTTCCCT
 651 ACCCGGCAGG GAAGACGCCT ACGGCAACCG CCCACTCATT GCCCAAGCCG
 701 ACCAAAACGC CCCTCGCGTT CCGGCTGCGC GCCTCGGCGT CCACCTGAAA
 751 GCCTCGCTGA CCGACCGCAT CGATGCCAAT TTGGACTACT ACCGCGTGTT
 801 CGCCCAAAAC AAACTCGCCC GCTACGAAAC GCGCACGCCC GGACACCATA
 851 TGCTCAACCT CGGCGCAAAC TACCGCCGCA ATACGCGCTA TGGCGAGTGG
 901 AATTGGTACG TCAAAGCCGA CAACCTGCTC AACCAATCCG TTTACGCCCA
 951 CAGCAGCTTC CTCTCTGATA CGCCGCAAAT GGGCCGCAGC TTTACCGGCG
1001 GCGTGAACGT GAAGTTTTAA
```

This corresponds to the amino acid sequence <SEQ ID 600; ORF 149.a>:

a149.pep
```
   1 MLLDNKVQHY SFFGVEQANW DNFTLEGGVR VEKQKASIRY DKALIDRENY
  51 YNHPLPDLGA HRQTARSFAL SGNWYFTPQH KLSLTASHQE RLPSTQELYA
 101 HGKHVATNTF EVGNKHLNKE RSNNIELALG YEGDRWQYNL ALYRNRFGNY
 151 IYAQTLNDGR GPKSIEDDSE MKLVRYNQSG ADFYGAEGEI YFKPTPRYRI
 201 GVSGDYVRGR LKNLPSLPGR EDAYGNRPLI AQADQNAPRV PAARLGVHLK
 251 ASLTDRIDAN LDYYRVFAQN KLARYETRTP GHHMLNLGAN YRRNTRYGEW
 301 NWYVKADNLL NQSVYAHSSF LSDTPQMGRS FTGGVNVKF*
``` m149/a149 98.8% identity in 339 aa overlap

```
                  10         20         30         40         50         60
m149.pep  MLLDNKVQHYSFFGVEQANWDNFTLEGGVRVEKQKASIQYDKALIDRENYYNHPLPDLGA
          ||||||||||||||||||||||||||||||||||||||:|||||||||||||||||||||
a149      MLLDNKVQHYSFFGVEQANWDNFTLEGGVRVEKQKASIRYDKALIDRENYYNHPLPDLGA
                  10         20         30         40         50         60

70         80         90        100        110        120
m149.pep  HRQTARSFALSGNWYFTPQHKLSLTASHQERLPSTQELYAHGKHVATNTFEVGNKHLNKE
          ||||||||||||||||||||||||||||||||||||||||||||||||||||||||||||
a149      HRQTARSFALSGNWYFTPQHKLSLTASHQERLPSTQELYAHGKHVATNTFEVGNKHLNKE
                  70         80         90        100        110        120
```

```
                130       140       150       160       170       180
m149.pep  RSNNIELALGYEGDRWQYNLALYRNRFGNYIYAQTLNDGRGPKSIEDDSEMKLVRYNQSG
          ||||||||||||||||||||||||||||||||||||||||||||||||||||||||||||
a149      RSNNIELALGYEGDRWQYNLALYRNRFGNYIYAQTLNDGRGPKSIEDDSEMKLVRYNQSG
                130       140       150       160       170       180

190       200       210       220       230       240
m149.pep  ADFYGAEGEIYFKPTPRYRIGVSGDYVRGRLKNLPSLPGREDAYGNRPFIAQDDQNAPRV
          |||||||||||||||||||||||||||||||||||||||||||||||:|||  ||||||
a149      ADFYGAEGEIYFKPTPRYRIGVSGDYVRGRLKNLPSLPGREDAYGNRPLIAQADQNAPRV
                190       200       210       220       230       240

250       260       270       280       290       300
m149.pep  PAARLGFHLKASLTDRIDANLDYYRVFAQNKLARYETRTPGHHMLNLGANYRRNTRYGEW
          ||||| || ||||||||||||||||||||||||||||||||||||||||||||||||||
a149      PAARLGVHLKASLTDRIDANLDYYRVFAQNKLARYETRTPGHHMLNLGANYRRNTRYGEW
                250       260       270       280       290       300

310       320       330       340
m149.pep  NWYVKADNLLNQSVYAHSSFLSDTPQMGRSFTGGVNVKFX
          ||||||||||||||||||||||||||||||||||||||||
a149      NWYVKADNLLNQSVYAHSSFLSDTPQMGRSFTGGVNVKFX
                310       320       330       340
```

The following partial DNA sequence was identified in *N. gonorrhoeae* <SEQ ID 601>:

```
g149-1.seq
      1    ATGGCACAAA TCACACTCAA ACCCATTGTT TTATCAATTC TTTTAATCAA
     51    CACACCCCTC CTCGCCCAAG CGCATGAAAC TGAGCAATCG GTGGGCTTGG
    101    AAACGGTCAG CGTCGTCGGC AAAAGCCGTC CGCGCGCGAC TTCGGGGCTG
    151    CTGCACACTT CGACCGCCTC CGACAAAATC ATCTCCGGCG ATACTTTGCG
    201    CCAAAAAGCC GTCAACTTGG GCGACGCTTT GGACGGCGTA CCGGGCATCC
    251    ACGCTTCGCA ATACGGCGGC GGCGCATCCG CTCCCGTTAT TCGCGGTCAA
    301    ACGGGCAGAC GGATTAAAGT ATTGAACCAT CACGGCGAAA CGGGCGATAT
    351    GGCGGACTTT TCTCCCGATC ACGCCATTAT GGTAGATACC GCCTTGTCGC
    401    AACAGGTTGA AATCCTGCGC GGGCCGGTTA CGCTCTTGTA CAGCTCGGGC
    451    AATGTGGCGG GGCTGGTCGA TGTTGCCGAT GGAAAAATCC CCGAAAAAAT
    501    GCCTGAAAAC GGCGTATCGG GCGaagccgG ATTGCGTTTG AGCAGCGGCA
    551    ATTTAGAAAA ACTGACATCC GCAGGCATCA ATATCGGACT GGGCAAAAAC
    601    TTCGTGCTGC ATACCGAAGG CTTGTACCGC AAATCGGGCG ATTACGCCGT
    651    ACCGCGTTAC CGCAATCTGA AACGCCTGCC CGACAGCCAT GCCGATTCGC
    701    AAACGGGCAG CATCGGGCTG TCTTGGGTGG GCGAAAAAGG CTTTATCGGC
    751    GCAGCATACA GCGACCGTCG CGACCGCTAC GGCCTGCCTG CCCACAGCCA
    801    CGAATACGAT GATTGCCACG CCGACATCAT CTGGCAAAAG AGTTTGATCA
    851    ACAAACGCTA TTTGCAGCTT TATCCGCACT TGTTGACCGA AGAAGACATC
    901    GATTACGACA ATCCGGGCTT GAGCTGCGGC TTCCACGACG GCGACGGTGC
    951    ACACGCACAC ACCCACAACG GCAAACCGTG GATAGACCTG CGCAACAAAC
   1001    GCTACGAACT CCGCGCCGAA TGGAAGCAGC CATTCCCCGG TTTTGAAGCC
   1051    CTGCGCGTAC ATCTGAACCG CAATGACTAC CACCACGACG AAAAAGCAGG
   1101    CGATGCAGTA GAAAACTTCT TCAACAACAA AACACACAAC GCCCGTATCG
   1151    AGTTGCGCCA CCAACCCATA GGCCGTCTGA AGGCAGCTG GGGCGTGCAA
   1201    TATTTGGGAC AAAAATCCAG CGCGCTTTCC GCCATTCCCG AAACCGTCCA
   1251    ACAACCGATG TTGATTGACA ACAATGTCCG CCATTACAGC TTTTTCGGTG
```

```
                           -continued
1301    TAGAACAGGC AAATTGGGAC AACTTCACGC TTGAAGGCGG CGTACGCGTG

1351    GAAAAACAAA AAGCCTCCAT CCGGTACGAC AAAGCATTGA TTGATCGAGA

1401    AAACTACTAC AACCAGCCCC TGCCCGACCT CGGCGCGCAC CGCCAAACCG

1451    CCCGCTCGTT CGCACTTTCG GGCAACTGGT ATTTCACGCC ACACCACAAA

1501    CTCAGCCTGA CCGCCTCCCA TCAGGAACGC CTGCCGTCAA CGCAAGAACT

1551    GTACGCACAC GGCAAGCACG TCGCCACCAA CACCTTTGAA GTCGGCAACA

1601    AACACCTCAA CAAAGAGCGT TCCAACAATA TCGAACTCGC GCTGGGCTAC

1651    GAAGGCGACC GCTGGCAATA CAATCTGGCA GCCTACCGCA ACCGATTCGG

1701    CAACTACATT TACGCCCAAA CCTTAAACGA CGGACGCGGC CCCAAATCCA

1751    TCGAAGACGA CAGCGAAATG AAGCTCGTGC GCTACAACCA ATCCGGTGCC

1801    GACTTCTACG GCGCGGAAGG CGAAATCTAC TTCAAACCGA CACCGCGCTA

1851    CCGCATCGGT GTTTCCGGCG ACTATGTACG AGGCCGTCTG AAAAACCTGC

1901    CGTCCCTACC CGGCAGGGAA GATCCCTACG GCAAACGTCC CTTCATCGCA

1951    CAAGCCGACC AAAACGCCCC CCGCATTCCG GCTGCGCGCC TCGGCTTCCA

2001    CCTGAAAACC TCGCTAACCG ACCGTATCGA TGCCAATTTG GACTACTACC

2051    GCGTGTTCGC CCAAAACAAA CTCGCCCGCT ACGAAACGCG TACGCCCGGA

2101    CACCATATGC TCAACCTCGG TGCAAACTAC CGCCGCAATA CGCGCTATGG

2151    CGAGTGGAAT TGGTACGTCA AGCCGACAA CCTGCTCAAC CAATCCGTTT

2201    ACGCCCACAG CAGCTTCCTC TCTGATACGC CGCAAATGGG CCGCAGCTTT

2251    ACCGGCGGCG TAAACGTGAA GTTTTAA
```

This corresponds to the amino acid sequence <SEQ ID 602; ORF 149-1.ng>:

```
g149-1.pep
    1   MAQITLKPIV LSILLINTPL LAQAHETEQS VGLETVSVVG KSRPRATSGL

51   LHTSTASDKI ISGDTLRQKA VNLGDALDGV PGIHASQYGG GASAPVIRGQ

101   TGRRIKVLNH HGETGDMADF SPDHAIMVDT ALSQQVEILR GPVTLLYSSG

151   NVAGLVDVAD GKIPEKMPEN GVSGEAGLRL SSGNLEKLTS AGINIGLGKN

201   FVLHTEGLYR KSGDYAVPRY RNLKRLPDSH ADSQTGSIGL SWVGEKGFIG

251   AAYSDRRDRY GLPAHSHEYD DCHADIIWQK SLINKRYLQL YPHLLTEEDI

301   DYDNPGLSCG FHDGDGAHAH THNGKPWIDL RNKRYELRAE WKQPFPGFEA

351   LRVHLNRNDY HHDEKAGDAV ENFFNNKTHN ARIELRHQPI GRLKGSWGVQ

401   YLGQKSSALS AIPETVQQPM LIDNNVRHYS FFGVEQANWD NFTLEGGVRV

451   EKQKASIRYD KALIDRENYY NQPLPDLGAH RQTARSFALS GNWYFTPHHK

501   LSLTASHQER LPSTQELYAH GKHVATNTFE VGNKHLNKER SNNIELALGY

551   EGDRWQYNLA AYRNRFGNYI YAQTLNDGRG PKSIEDDSEM KLVRYNQSGA

601   DFYGAEGEIY FKPTPRYRIG VSGDYVRGRL KNLPSLPGRE DPYGKRPFIA

651   QADQNAPRIP AARLGFHLKT SLTDRIDANL DYYRVFAQNK LARYETRTPG

701   HHMLNLGANY RRNTRYGEWN WYVKADNLLN QSVYAHSSFL SDTPQMGRSF

751   TGGVNVKF*
```

The following partial DNA sequence was identified in *N. meningitidis* <SEQ ID 603>:

m149-1.seq

```
   1 ATGGCACAAA CTACACTCAA ACCCATTGTT TTATCAATTC TTTTAATCAA
  51 CACACCCCTC CTCGCCCAAG CGCATGAAAC TGAGCAATCG GTGGATTTGG
 101 AAACGGTCAG CGTCGTCGGC AAAAGCCGTC CGCGCGCCAC GTCGGGGCTG
 151 TTGCACACTT CGACCGCCTC CGACAAAATC ATCTCCGGCG ATACCTTGCG
 201 CCAAAAAGCC GTCAACTTGG GCGACGCTTT AGACGGCGTA CCGGGCATCC
 251 ACGCTTCGCA ATACGGCGGC GGCGCGTCTG CTCCCGTCAT TCGCGGTCAA
 301 ACAGGCAGGC GGATTAAAGT GTTGAACCAT CACGGCGAAA CAGGCGATAT
 351 GGCGGATTTT TCGCCCGATC ACGCCATTAT GGTAGATACC GCCTTGTCGC
 401 AACAGGTCGA AATCCTGCGC GGGCCGGTTA CGCTCTTGTA CAGCTCGGGC
 451 AATGTGGCGG GGCTGGTCGA TGTTGCCGAT GGCAAAATCC CCGAAAAAAT
 501 GCCTGAAAAC GGCGTATCGG GCGAACTCGG ATTGCGTTTG AGCAGCGGCA
 551 ATCTGGAAAA ACTCACGTCC GGCGGCATCA ATATCGGTTT GGGCAAAAAC
 601 TTTGTATTGC ACACGGAAGG GCTGTACCGC AAATCGGGGG ATTACGCCGT
 651 ACCGCGTTAC CGCAATCTGA AACGCCTGCC CGACAGCCAC GCCGATTCGC
 701 AAACGGGCAG CATCGGGCTG TCTTGGGTTG GCGAAAAAGG TTTTATCGGC
 751 GTAGCGTACA GCGACCGTCG CGACCAATAT GGTCTGCCTG CCCACAGCCA
 801 CGAATACGAT GATTGCCACG CCGACATCAT CTGGCAAAAG AGCTTGATTA
 851 ACAAACGCTA TTTACAGCTT TATCCGCACC TGTTGACCGA AGAAGACATC
 901 GATTACGACA ATCCGGGCTT GAGCTGCGGC TTCCACGACG ACGATAATGC
 951 ACACGCACAC ACCCACAGCG GCAGACCGTG GATAGACCTG CGCAACAAAC
1001 GCTACGAACT CCGTGCCGAA TGGAAGCAAC CGTTCCCCGG TTTTGAAGCC
1051 CTGCGCGTAC ACCTGAACCG CAACGACTAC CGCCACGACG AAAAAGCAGG
1101 CGATGCAGTC GAAAACTTTT TTAACAACCA AACGCAAAAC GCCCGCATCG
1151 AGTTGCGCCA CCAACCCATA GGTCGTCTGA AAGGCAGCTG GGGCGTGCAA
1201 TATTTACAAC AAAAATCCAG TGCTTTATCT GCCATATCCG AAGCGGTTAA
1251 ACAACCGATG CTGCTTGACA ACAAAGTGCA ACATTACAGC TTTTTCGGTG
1301 TAGAACAGGC AAACTGGGAC AACTTCACGC TTGAAGGAGG CGTACGCGTG
1351 GAAAAACAAA AAGCCTCCAT TCAGTACGAC AAAGCATTGA TTGATCGGGA
1401 AAACTACTAC AACCACCCCC TGCCCGACCT CGGCGCGCAC CGCCAAACCG
1451 CCCGCTCATT CGCACTTTCG GGCAACTGGT ATTTCACGCC ACAACACAAA
1501 CTCAGCCTGA CCGCCTCCCA TCAGGAACGC CTGCCGTCAA CGCAAGAGCT
1551 GTACGCACAC GGCAAACACG TCGCCACCAA CACCTTTGAA GTCGGCAACA
1601 AACACCTCAA CAAAGAGCGT TCCAACAATA TCGAACTCGC GCTGGGCTAC
1651 GAAGGCGACC GCTGGCAATA CAATCTGGCA CTCTACCGCA ACCGCTTCGG
1701 TAACTACATT TACGCCCAAA CCTTAAACGA CGGACGCGGC CCCAAATCCA
1751 TCGAAGACGA CAGCGAAATG AAGCTCGTGC GCTACAACCA ATCCGGCGCC
1801 GACTTCTACG GCGCGGAAGG CGAAATCTAC TTCAAACCGA CACCGCGCTA
1851 CCGCATCGGC GTTTCCGGCG ACTATGTACG AGGCCGTCTG AAAAACCTGC
1901 CTTCCCTACC CGGCAGAGAA GATGCCTACG GCAACCGTCC TTTCATCGCA
1951 CAGGACGACC AAAATGCCCC CCGTGTTCCG GCTGCGCGCC TCGGCTTCCA
```

```
-continued
2001  CCTGAAAGCC TCGCTGACCG ACCGTATCGA TGCCAATTTG GACTACTACC

2051  GCGTGTTCGC CCAAAACAAA CTCGCCCGCT ACGAAACGCG CACGCCCGGA

2101  CACCATATGC TCAACCTCGG CGCAAACTAC CGCCGCAATA CGCGCTATGG

2151  CGAGTGGAAT TGGTACGTCA AAGCCGACAA CCTGCTCAAC CAATCCGTTT

2201  ACGCCCACAG CAGCTTTCTC TCTGATACGC CGCAAATGGG CCGCAGCTTT

2251  ACCGGCGGCG TGAACGTGAA GTTTTAA
```

This corresponds to the amino acid sequence <SEQ ID 604; ORF 149-1>:

```
m149-1.pep
     1  MAQTTLKPIV LSILLINTPL LAQAHETEQS VDLETVSVVG KSRPRATSGL

51  LHTSTASDKI ISGDTLRQKA VNLGDALDGV PGIHASQYGG GASAPVIRGQ

101  TGRRIKVLNH HGETGDMADF SPDHAIMVDT ALSQQVEILR GPVTLLYSSG

151  NVAGLVDVAD GKIPEKMPEN GVSGELGLRL SSGNLEKLTS GGINIGLGKN

201  FVLHTEGLYR KSGDYAVPRY RNLKRLPDSH ADSQTGSIGL SWVGEKGFIG

251  VAYSDRRDQY GLPAHSHEYD DCHADIIWQK SLINKRYLQL YPHLLTEEDI

301  DYDNPGLSCG FHDDDNAHAH THSGRPWIDL RNKRYELRAE WKQPFPGFEA

351  LRVHLNRNDY RHDEKAGDAV ENFFNNQTQN ARIELRHQPI GRLKGSWGVQ

401  YLQQKSSALS AISEAVKQPM LLDNKVQHYS FFGVEQANWD NFTLEGGVRV

451  EKQKASIQYD KALIDRENYY NHPLPDLGAH RQTARSFALS GNWYFTPQHK

501  LSLTASHQER LPSTQELYAH GKHVATNTFE VGNKHLNKER SNNIELALGY

551  EGDRWQYNLA LYRNRFGNYI YAQTLNDRG  PKSIEDDSEM KLVRYNQSGA

601  DFYGAEGEIY FKPTPRYRIG VSGDYVRGRL KNLPSLPGRE DAYGNRPFIA

651  QDDQNAPRVP AARLGFHLKA SLTDRIDANL DYYRVFAQNK LARYETRTPG

701  HHMLNLGANY RRNTRYGEWN WYVKADNLLN QSVYAHSSFL SDTPQMGRSF

751  TGGVNVKF*
``` m149-1/g149-1 96.2% identity in 758 aa overlap

```
                    10         20         30         40         50         60
m149-1.pep  MAQTTLKPIVLSILLINTPLLAQAHETEQSVDLETVSVVGKSRPRATSGLLHTSTASDKI
            ||| ||||||||||||||||||||||||| |||||||||||||||||||||||||||||
g149-1      MAQITLKPIVLSILLINTPLLAQAHETEQSVGLETVSVVGKSRPRATSGLLHTSTASDKI
                    10         20         30         40         50         60

70         80         90        100        110        120
m149-1.pep  ISGDTLRQKAVNLGDALDGVPGIHASQYGGGASAPVIRGQTGRRIKVLNHHGETGDMADF
            ||||||||||||||||||||||||||||||||||||||||||||||||||||||||||||
g149-1      ISGDTLRQKAVNLGDALDGVPGIHASQYGGGASAPVIRGQTGRRIKVLNHHGETGDMADF
                    70         80         90        100        110        120

130        140        150        160        170        180
m149-1.pep  SPDHAIMVDTALSQQVEILRGPVTLLYSSGNVAGLVDVADGKIPEKMPENGVSGELGLRL
            ||||||||||||||||||||||||||||||||||||||||||||||||||||||||| ||
g149-1      SPDHAIMVDTALSQQVEILRGPVTLLYSSGNVAGLVDVADGKIPEKMPENGVSGEAGLRL
                   130        140        150        160        170        180

190        200        210        220        230        240
m149-1.pep  SSGNLEKLTSGGINIGLGKNFVLHTEGLYRKSGDYAVPRYRNLKRLPDSHADSQTGSIGL
            ||||||||||:|||||||||||||||||||||||||||||||||||||||||||||||||
g149-1      SSGNLEKLTSAGINIGLGKNFVLHTEGLYRKSGDYAVPRYRNLKRLPDSHADSQTGSIGL
                   190        200        210        220        230        240

250        260        270        280        290        300
m149-1.pep  SWVGEKGFIGVAYSDRRDQYGLPAHSHEYDDCHADIIWQKSLINKRYLQLYPHLLTEEDI
            |||||||||||:||||||:|||||||||||||||||||||||||||||||||||||||||
g149-1      SWVGEKGFIGAAYSDRRDRYGLPAHSHEYDDCHADIIWQKSLINKRYLQLYPHLLTEEDI
                   250        260        270        280        290        300
```

-continued

```
                      310       320       330       340       350       360
m149-1.pep     DYDNPGLSCGFHDDDNAHAHTHSGRPWIDLRNKRYELRAEWKQPFPGFEALRVHLNRNDY
               ||||||||||||| |:||||||:|:|||||||||||||||||||||||||||||||||||
g149-1         DYDNPGLSCGFHDGDGAHAHTHNGKPWIDLRNKRYELRAEWKQPFPGFEALRVHLNRNDY
                      310       320       330       340       350       360

370       380       390       400       410       420
m149-1.pep     RHDEKAGDAVENFFNNQTQNARIELRHQPIGRLKGSWGVQYLQQKSSALSAISEAVKQPM
               :|||||||||||||||:|:||||||||||||||||||||||| ||||||||| |:|:|||
g149-1         HHDEKAGDAVENFFNNKTHNARIELRHQPIGRLKGSWGVQYLGQKSSALSAIPETVQQPM
                      370       380       390       400       410       420

430       440       450       460       470       480
m149-1.pep     LLDNKVQHYSFFGVEQANWDNFTLEGGVRVEKQKASIQYDKALIDRENYYNHPLPDLGAH
               |:||:|:||||||||||||||||||||||||||||||:|||||||||||||:||||||||
g149-1         LIDNNVRHYSFFGVEQANWDNFTLEGGVRVEKQKASIRYDKALIDRENYYNQPLPDLGAH
                      430       440       450       460       470       480

490       500       510       520       530       540
m149-1.pep     RQTARSFALSGNWYFTPQHKLSLTASHQERLPSTQELYAHGKHVATNTFEVGNKHLNKER
               |||||||||||||||||:||||||||||||||||||||||||||||||||||||||||||
g149-1         RQTARSFALSGNWYFTPHHKLSLTASHQERLPSTQELYAHGKHVATNTFEVGNKHLNKER
                      490       500       510       520       530       540

550       560       570       580       590       600
m149-1.pep     SNNIELALGYEGDRWQYNLALYRNRFGNYIYAQTLNDGRGPKSIEDDSEMKLVRYNQSGA
               |||||||||||||||||||| |||||||||||||||||||||||||||||||||||||||
g149-1         SNNIELALGYEGDRWQYNLAAYRNRFGNYIYAQTLNDGRGPKSIEDDSEMKLVRYNQSGA
                      550       560       570       580       590       600

610       620       630       640       650       660
m149-1.pep     DFYGAEGEIYFKPTPRYRIGVSGDYVRGRLKNLPSLPGREDAYGNRPFIAQDDQNAPRVP
               ||||||||||||||||||||||||||||||||||||||||| ||:|||||| ||||||:|
g149-1         DFYGAEGEIYFKPTPRYRIGVSGDYVRGRLKNLPSLPGREDPYGKRPFIAQADQNAPRIP
                      610       620       630       640       650       660

670       680       690       700       710       720
m149-1.pep     AARLGFHLKASLTDRIDANLDYYRVFAQNKLARYETRTPGHHMLNLGANYRRNTRYGEWN
               |||||||||:||||||||||||||||||||||||||||||||||||||||||||||||||
g149-1         AARLGFHLKTSLTDRIDANLDYYRVFAQNKLARYETRTPGHHMLNLGANYRRNTRYGEWN
                      670       680       690       700       710       720

730       740       750       759
m149-1.pep     WYVKADNLLNQSVYAHSSFLSDTPQMGRSFTGGVNVKFX
               ||||||||||||||||||||||||||||||||||||||
g149-1         WYVKADNLLNQSVYAHSSFLSDTPQMGRSFTGGVNVKFX
                      730       740       750
```

The following partial DNA sequence was identified in *N. meningitidis* <SEQ ID 605>:

```
a149-1.seq
     1   ATGGCACAAA CTACACTCAA ACCCATTGTT TTATCAATTC TTTTAATCAA

51   CACACCCCTC CTCTCCCAAG CGCATGGAAC TGAGCAATCA GTGGGCTTGG

101   AAACGGTCAG CGTCGTCGGC AAAAGCCGTC CGCGCGCCAC TTCGGGGCTG

151   CTGCACACTT CTACCGCCTC CGACAAAATC ATCAGCGGCG ACACCTTGCG

201   ACAAAAAGCC GTCAACTTGG GTGATGCTTT AGACGGCGTA CCGGGCATTC

251   ATGCCTCGCA ATACGGCGGC GGCGCATCCG CTCCCGTTAT TCGCGGTCAA

301   ACAGGCAGAC GGATTAAAGT GTTGAACCAT CACGGCGAAA CGGGCGACAT

351   GGCGGACTTC TCTCCAGACC ATGCAATCAT GGTGGACAGC GCCTTGTCGC

401   AACAGGTCGA AATCCTGCGC GGTCCGGTTA CGCTCTTGTA CAGCTCGGGC

451   AATGTGGCGG GGCTGGTCGA TGTTGCCGAT GGCAAAATCC CCGAAAAAAT

501   GCCTGAAAAC GGCGTATCGG GCGAACTCGG ATTGCGTTTG AGCAGCGGCA

551   ATCTGGAAAA ACTCACGTCC GGCGGCATCA ATATCGGTTT GGGCAAAAAC

601   TTTGTATTGC ACACGGAAGG GCTGTACCGC AAATCGGGGG ATTACGCCGT

651   ACCGCGTTAC CGCAATCTGA AACGCCTGCC CGACAGCCAC GCCGATTCGC

701   AAACGGGCAG CATCGGGCTG TCTTGGGTTG GCGAAAAAGG CTTTATCGGC

751   GCAGCATACA GCGACCGTCG CGACCAATAT GGTCTGCCTG CCCACAGCCA
```

```
-continued
 801    CGAATACGAT GATTGCCACG CCGACATCAT CTGGCAAAAG AGTTTGATTA
 851    ACAAACGCTA TTTGCAGCTT TATCCGCACC TGTTGACCGA AGAAGACATC
 901    GATTACGACA ATCCGGGCTT GAGCTGCGGC TTTCACGACG ACGATGATGC
 951    ACACGCCCAT GCCCACAACG GCAAACCTTG GATAGACCTG CGCAACAAAC
1001    GCTACGAACT CCGCGCCGAA TGGAAGCAAC CGTTCCCCGG TTTTGAAGCC
1051    CTGCGCGTAC ACCTGAACCG CAACGACTAC CGCCACGACG AAAAAGCAGG
1101    CGATGCAGTA GAAAACTTTT TTAACAACCA AACGCAAAAC GCCCGTATCG
1151    AGTTGCGCCA CCAACCCATA GGCCGTCTGA AAGGCAGCTG GGGCGTGCAA
1201    TATTTGGGAC AAAAATCCAG TGCTTTATCT GCCACATCCG AAGCGGTCAA
1251    ACAACCGATG CTGCTTGACA ATAAAGTGCA ACATTACAGC TTTTTCGGTG
1301    TAGAACAGGC AAACTGGGAC AACTTCACGC TTGAAGGCGG CGTACGCGTG
1351    GAAAACAAA AAGCCTCCAT CCGCTACGAC AAAGCATTGA TTGATCGGGA
1401    AAACTACTAC AACCATCCCC TGCCCGACCT CGGCGCGCAC CGCCAAACCG
1451    CCCGCTCATT CGCACTTTCG GGCAACTGGT ATTTCACGCC ACAACACAAA
1501    CTCAGCCTGA CCGCCTCCCA TCAGGAACGC CTGCCGTCAA CGCAAGAGCT
1551    GTACGCACAC GGCAAACACG TCGCCACCAA CACCTTTGAA GTCGGCAACA
1601    AACACCTCAA CAAAGAGCGT TCCAACAATA TCGAACTCGC GCTGGGCTAC
1651    GAAGGCGACC GCTGGCAATA CAATCTGGCA CTCTACCGCA ACCGCTTCGG
1701    CAACTACATT TACGCCCAAA CCTTAAACGA CGGACGCGGC CCCAAATCCA
1751    TCGAAGACGA CAGCGAAATG AAGCTCGTGC GCTACAACCA ATCCGGTGCG
1801    GACTTCTACG GCGCGGAAGG CGAAATCTAC TTCAAACCGA CACCGCGCTA
1851    CCGCATCGGC GTTTCCGGCG ACTATGTACG AGGCCGTCTG AAAAACCTGC
1901    CTTCCCTACC GGCAGGGAA GACGCCTACG GCAACCGCCC ACTCATTGCC
1951    CAAGCCGACC AAAACGCCCC TCGCGTTCCG GCTGCGCGCC TCGGCGTCCA
2001    CCTGAAAGCC TCGCTGACCG ACCGCATCGA TGCCAATTTG GACTACTACC
2051    GCGTGTTCGC CCAAAACAAA CTCGCCCGCT ACGAAACGCG CACGCCCGGA
2101    CACCATATGC TCAACCTCGG CGCAAACTAC CGCCGCAATA CGCGCTATGG
2151    CGAGTGGAAT TGGTACGTCA AGCCGACAA CCTGCTCAAC CAATCCGTTT
2201    ACGCCCACAG CAGCTTCCTC TCTGATACGC CGCAAATGGG CCGCAGCTTT
2251    ACCGGCGGCG TGAACGTGAA GTTTTAA
```

This corresponds to the amino acid sequence <SEQ ID 606; ORF 149-1.a>:

```
a149-1.pep
    1   MAQTTLKPIV LSILLINTPL LSQAHGTEQS VGLETVSVVG KSRPRATSGL

51   LHTSTASDKI ISGDTLRQKA VNLGDALDGV PGIHASQYGG GASAPVIRGQ

101   TGRRIKVLNH HGETGDMADF SPDHAIMVDS ALSQQVEILR GPVTLLYSSG

151   NVAGLVDVAD GKIPEKMPEN GVSGELGLRL SSGNLEKLTS GGINIGLGKN

201   FVLHTEGLYR KSGDYAVPRY RNLKRLPDSH ADSQTGSIGL SWVGEKGFIG

251   AAYSDRRDQY GLPAHSHEYD DCHADIIWQK SLINKRYLQL YPHLLTEEDI

301   DYDNPGLSCG FHDDDDAHAH AHNGKPWIDL RNKRYELRAE WKQPFPGFEA
```

```
351    LRVHLNRNDY RHDEKAGDAV ENFFNNQTQN ARIELRHQPI GRLKGSWGVQ

401    YLGQKSSALS ATSEAVKQPM LLDNKVQHYS FFGVEQANWD NFTLEGGVRV

451    EKQKASIRYD KALIDRENYY NHPLPDLGAH RQTARSFALS GNWYFTPQHK

501    LSLTASHQER LPSTQELYAH GKHVATNTFE VGNKHLNKER SNNIELALGY

551    EGDRWQYNLA LYRNRFGNYI YAQTLNDGRG PKSIEDDSEM KLVRYNQSGA

601    DFYGAEGEIY FKPTPRYRIG VSGDYVRGRL KNLPSLPGRE DAYGNRPLIA

651    QADQNAPRVP AARLGVHLKA SLTDRIDANL DYYRVFAQNK LARYETRTPG

701    HHMLNLGANY RRNTRYGEWN WYVKADNLLN QSVYAHSSFL SDTPQMGRSF

751    TGGVNVKF*
``` a149-1/m149-1 98.0% identity in 758 aa overlap

```
                    10        20        30        40        50        60
a149-1.pep  MACTTLKPIVLSILLINTPLLSQAHGTEQSVGLETVSVVGKSRPRATSGLLHTSTASDKI
            |||||||||||||||||||||||:|||  ||||  |||||||||||||||||||||||||
m149-1      MACTTLKPIVLSILLINTPLLAQAHETEQSVDLETVSVVGKSRPRATSGLLHTSTASDKI
                    10        20        30        40        50        60

70        80        90       100       110       120
a149-1.pep  ISGDTLRQKAVNLGDALDGVPGIHASQYGGGASAPVIRGQTGRRIKVLNHHGETGDMADF
            ||||||||||||||||||||||||||||||||||||||||||||||||||||||||||||
m149-1      ISGDTLRQKAVNLGDALDGVPGIHASQYGGGASAPVIRGQTGRRIKVLNHHGETGDMADF
                    70        80        90       100       110       120

130       140       150       160       170       180
a149-1.pep  SPCHAIMVDSALSQQVEILRGPVTLLYSSGNVAGLVDVADGKIPEKMPENGVSGELCLRL
            ||||:|||||:|||||||||||||||||||||||||||||||||||||||||||||:|||
m149-1      SPCKAIMVDTALSQQVEILRGPVTLLYSSGNVAGLVDVADGKIPEKMPENGVSGELGLRL
                   130       140       150       160       170       180

190       200       210       220       230       240
a149-1.pep  SSGNLEKLTSGGINIGLGKNFVLHTEGLYRKSGDYAVPRYRNLKRLPDSHADSQTGSIGL
            ||||||||||||||||||||||||||||||||||||||||||||||||||||||||||||
m149-1      SSGNLEKLTSGGINIGLGKNFVLHTEGLYRKSGDYAVPRYRNLKRLPDSHADSQTGSIGL
                   190       200       210       220       230       240

250       260       270       280       290       300
a149-1.pep  SWVGEKGFIGAAYSDRRDQYGLPAHSHEYDDCHADIIWQKSLINKRYLQLYPHLLTEEDI
            ||||||||||:|||:|||||||||||||||||||||||||||||||||||||||||||||
m149-1      SWVGEKGFIGVAYGDRRDQYGLPAHSHEYDDCHADIIWQKSLINKRYLQLYPHLLTEEDI
                   250       260       270       280       290       300

310       320       330       340       350       360
a149-1.pep  DYCNPGLSCGFHDDDDAHAHAHNGKPWIDLRNKRYELRAEWKQPFPGFEALRVHLNRNDY
            |||||||||||||||:||||:|:|:|||||||||||||||||||||||||||||||||||
m149-1      DYCNPGLSCGFHDDDNAHAHTHSGRPWIDLRNKRYELRAEWKQPFPGFEALRVHLNRNDY
                   310       320       330       340       350       360

370       380       390       400       410       420
a149-1.pep  RHDEKAGDAVENFFNNQTQNARIELRHQPIGRLKGSWGVQYLGQKSSALSATSEAVKQPM
            ||||||||||||||||||||||||||||||||||||||||||:|||||||:|||||||||
m149-1      RHDEKAGDAVENFFNNQTQNARIELRHQPIGRLKGSWGVQYLQQKSSALSAISEAVKQPM
                   370       380       390       400       410       420

430       440       450       460       470       480
a149-1.pep  LLDNKVQHYSFFGVEQANWDNFTLEGGVRVEKQKASIRYDKALIDRENYYNHPLPDLGAH
            |||||||||||||||||||| :||||||||||||||| |||||||||||||||||||||
m149-1      LLDNKVQHYSFFGVEQANWCNFTLEGGVRVEKQKASIQYDKALIDRENYYNHPLPDLGAH
                   430       440       450       460       470       480

490       500       510       520       530       540
a149-1.pep  RQTARSFALSGNWYFTPQHKLSLTASHQERLPSTQELYAHGKHVATNTFEVGNKHLNKER
            ||||||||||||||||||||||||||||||||||||||||||||||||||||||||||||
m149-1      RQTARSFALSGNWYFTPQHKLSLTASHQERLPSTQELYAHGKHVATNTFEVGNKHLNKER
                   490       500       510       520       530       540

550       560       570       580       590       600
a149-1.pep  SNNIELALGYEGDRWQYNLALYRNRFGNYIYAQTLNDGRGPKSIEDDSEMKLVRYNQSGA
            ||||||||||||||||||||||||||||||||||||||||||||||||||||||||||||
m149-1      SNNIELALGYEGDRWQYNLALYRNRFGNYIYAQTLNDGRGPKSIEDDSEMKLVRYNQSGA
                   550       560       570       580       590       600

610       620       630       640       650       660
a149-1.pep  DFYGAEGEIYFKPTPRYRIGVSGDYVRGRLKNLPSLPGREDAYGNRPLIAQDQNAPRVP
            |||||||||||||||||||||||||||||||||||||||||:|||||||:|||||||||
m149-1      DFYGAEGEIYFKPTPRYRIGVSGDYVRGRLKNLPSLPGRECAYGNRPIAQDCQNAPRVP
                   610       620       630       640       650       660
```

```
                  670        680        690        700        710        720
a149-1.pep  AARLGVHLKASLTDRIDANLDYYRVFAQNKLARYETRTPGHHMLNLGANYRRNTRYGEWN
            |||||  ||| ||||||||||||||||||||||||||||||||||||||||||||||||
m149-1      AABLGFHLKASLTDRIDANLDYYRVFAQNKLARYETRTPGHHMLNLGANYRRNTRYGEWN
                  670        680        690        700        710        720

730        740        750    759
a149-1.pep  WYVKADNLLNQSVYAHSSFLSDTPQMGRSFTGGVNVKFX
            ||||||||||||||||||||||||||||||||||||||
m149-1      WYVKADNLLNQSVYAHSSFLSDTPQMGRSFTGGVNVKFX
                  730        740        750
```

The following partial DNA sequence was identified in *N. gonorrhoeae* <SEQ ID 607>:

```
g150.seq (partial)
    1   ..TACTGCAAGG CAGACCCCTT TCCCGCCGCC CTGCTGGCCA ATCAGAAAAT

51   CACCGCCCGC CAATCCGATA AAGACGTGCG CCACATCGAA ATCGATTTGA

101   GCGGTTCGGA TTTGCACTAC CTCCCGGGCG ACGCGCTCGG CGTTTGGTTT

151   GACAACGATC CGGCACTGGT CGGGGAAATC CTAGACCTGC TCGGCATCAA

201   TCCGGCAACG GAAATACAGG CGGGCGGAAA AACCCTGCCG GTTGCCTCCG

251   CACTGTTATC CCATTTCGAA CTCACGCAAA CACCCCCGC CTTTGTCAAA

301   GGCTATGCCA CGTTCGCCGA TAATGACGAA CTCGACCGTA TTGCTGCCGA

351   CAACGCCGTT TTGCAAGGCT TTGTGCAAAG CACGCCGATT GCCGGTGTGC

401   TGCACCGCTT CCCGGCAAAA CTGACGGCGG AACAATTCGC CGGCCTGCTG

451   CGCCCGCTTG CGCCGCGCCT GTATTCGATT TCCTCGTCGC AGGCGGAAGC

501   GGGGGACGAA GTGCACCTGA CCGTCGGCGC AGTGCGTTTC GAACACGAAG

551   GGCGCGCCAG GCGGGCGGC GCATCGGGTT TCTTTGCCGA CCGGCTGGAA

601   GAGGACGGCA CGGTGCGCGT GTTTGCGGAA CGCAACGACG GCTTCAGGCT

651   GCCCGAAGAC AGCCGCAAGC CGATTGTGAT GATCGGCTCC GGTACCGGCG

701   TCGCACCGTT CCGCGCCTTC GTCCAACAAC GTGCCGCAGA AAATGCGGAA

751   GGCAGAAACT GGCTGATTTT CGGCAATCCG CATTTTGCCG CCGACTTCCT

801   CTATCAGACC GAATGGCAGC AGTTTGCCAA AGACGGCTTC CTGCACAGAT

851   ATGACTTCGC CTGGTCGCGC GATCAGGAAG AAAAAATCTA TGTGCAGGAC

901   AAAATCCGCG AACAGGCGGA AGGACTTTGG CAATGGCTGC AGGAAGGCGC

951   GCATATCTAT GTGTGCGGCG ATGCGGCAAA AATGGCAAAA GAAGTGGAAG

1001   CCGCCTTGCT GGATGTGATT ATCGGGGCAG GGCATTCGGA CGAAGACGGC

1051   GCAGAAGGAT ATTTGGATAT GCTGCGCGAA GAAAACGCT ATCAGCGTGA

1101   TGTTTATTGA
```

This corresponds to the amino acid sequence <SEQ ID 608; ORF 150.ng>:

```
g150.pep (partial)
    1   ..YCKADPFPAA LLANQKITAR QSDKDVRHIE IDLSGSDLHY LPGDALGVWF

51   DNDPALVGEI LDLLGINPAT EIQAGGKTLP VASALLSHFE LTQNTPAFVK

101   GYATFADNDE LDRIAADNAV LQGFVQSTPI AGVLHRFPAK LTAEQFAGLL

151   RPLAPRLYSI SSSQAEAGDE VHLTVGAVRF EHEGRARAGG ASGFFADRLE

201   EDGTVRVFAE RNDGFRLPED SRKPIVMIGS GTGVAPFRAF VQQRAAENAE
```

```
251   GRNWLIFGNP HFAADFLYQT EWQQFAKDGF LHRYDFAWSR DQEEKIYVQD

301   KIREQAEGLW QWLQEGAHIY VCGDAAKMAK EVEAALLDVI IGAGHSDEDG

351   AEGYLDMLRE EKRYQRDVY*
```

The following partial DNA sequence was identified in *N. meningitidis* <SEQ ID 609>:

```
m150.seq
   1   ATGCAGAACA CAAATCCGCC ATTACCGCCT CTGCCGCCCG AAATCACGCA

51   GCTCCTGTCG GGGCTGGACG CGGCACAATG GGCGTGGCTG TCCGGCTACG

101   CTTGGGCAAA AGCAGGAAAC GGGGCATCTG CAGGACTGCC CGCGCTTCAG

151   ACGGCATTGC CGGCGGCAGA ACCTTTTTCC GTAACCGTCC TTTCCGCCTC

201   GCAAACCGGC AATGCGAAAT CCGTTGCCGA CAAAGCGGCG GACAGCCTGG

251   AAGCCGCCGG CATCCAAGTC AGTCGCGCCG AACTGAAAGA CTATAAGGCG

301   AAAAACATCG CCGGCGAACG CCGCCTGCTG CTGGTTACCT CCACCCAAGG

351   CGAAGGCGAA CCGCCGAAAG AAGCCGTCGT GCTGCACAAA CTGCTGAACG

401   GCAAAAAAGC CCCGAAATTG GACAAACTCC AATTTGCCGT ACTGGGTTTG

451   GGCGACAGTT CCTATCCGAA TTTCTGTCAG GCAGGTAAAG ATTTCGACCG

501   GCGTTTTGAA GAATTGGGCG CAAAACGGCT GCTCGAACGC GTTGATGCGG

551   ATTTGGACTT TACCGCCTCC GCAAACGCCT GGACAGATAA TATCGCCGCA

601   CTCTTAAAAG AAGAAGCCGC AAAAAACCGG GCAACGCCCG CGCCGCAGAC

651   AACGCCCCCC GCCGGCCTTC AGACGGCACC GGATGGCAGG TACTGCAAGG

701   CAGCCCCCTT TCCCGCCGCC CTGCTGGCCA ATCAGAAAAT CACCGCCCGC

751   CAATCCGATA AAGACGTGCG CCACATCGAA ATCGATTTGA GCGGTTCGGA

801   TTTGCACTAC CTCCCGGGCG ACGCGCTCGG CGTTTGGTTT GACAACGATC

851   CGGCACTGGT CAGGGAAATC CTAGACCTGC TCGGCATCGA TCCGGCAACG

901   GAAATACAGG CGGGCGGAAA GATGATGCCG GTTGCGCGCG CACTTTCATC

951   TCATTTCGAA CTCACGCAAA ACACTCCGGC TTTCGTCAAA GGCTATGCCG

1001   CGTTCGCCCA TTATGAAGAA CTCGATAAAA TCATTGCCGA TAACGCCGTT

1051   TTGCAGGATT TCGTGCAAAA CACGCCTATT GTCGATGTGC TGCACCGCTT

1101   CCCGGCAAGC CTGACGGCAG AACAATTCAT CCGTTTACTG CGTCCGCTTG

1151   CACCCCGTTT GTATTCGATT TCTTCAGCAC AGGCGGAAGT GGGCGATGAA

1201   GTGCATTTAA CTGTCGGCGT GGTTCGTTTT GAACACGAAG CCGCGCCAG

1251   AACGGGCGGC GCATCGGGTT TCCTTGCCGA CCGGCTGGAA GAGGACGGCA

1301   CGGTGCGCGT GTTTGTGGAA CGCAACGACG GCTTCAGGCT GCCCGAAGAC

1351   AGCCGCAAGC CGATTGTGAT GATCGGCTCG GCACCGGCG TCGCACCGTT

1401   CCGCGCTTTC GTCCAACAAC GTGCCGCAGA AAATGCGGAA GGCAAAAACT

1451   GGCTGATTTT CGGCAATCCG CATTTTGCCC GTGATTTTCT CTATCAAACC

1501   GAATGGCAGC AGTTTGCCAA AGACGGCTTC CTGCACAGGT ACGATTTCGC

1551   CTGGTCCCGC GATCAGGAAG AAAAAATCTA TGTGCAGGAC AAAATCCGCG

1601   AACAGGCGGA AGGACTTTGG CAATGGCTGC AGGAAGGCGC GCATATCTAT

1651   GTGTGCGGCG ATGCGGCAAA AATGGCAAAA GACGTGGAAG CCGCCTTGCT
```

```
1701  GGATGTGATT ATCGGGGCAG GACATTTGGA CGAAGAGGGC GCAGAAGAAT

1751  ATTTGGATAT GCTGCGCGAA GAAAAACGCT ATCAGCGTGA TGTTTATTGA
```

This corresponds to the amino acid sequence <SEQ ID 610; ORF 150>:

```
m150.pep
    1   MQNTNPPLPP LPPEITQLLS GLDAAQWAWL SGYAWAKAGN GASAGLPALQ

51   TALPAAEPFS VTVLSASQTG NAKSVADKAA DSLEAAGIQV SRAELKDYKA

101   KNIAGERRLL LVTSTQGEGE PPKEAVVLHK LLNGKKAPKL DKLQFAVLGL

151   GDSSYPNFCQ AGKDFDRRFE ELGAKRLLER VDADLDFTAS ANAWTDNIAA

201   LLKEEAAKNR ATPAPQTTPP AGLQTAPDGR YCKAAPFPAA LLANQKITAR

251   QSDKDVRHIE IDLSGSDLHY LPGDALGVWF DNDPALVREI LDLLGIDPAT

301   EIQAGGKMMP VARALSSHFE LTQNTPAFVK GYAAFAHYEE LDKIIADNAV

351   LQDFVQNTPI VDVLHRFPAS LTAEQFIRLL RPLAPRLYSI SSAQAEVGDE

401   VHLTVGVVRF EHEGRARTGG ASGFLADRLE EDGTVRVFVE RNDGFRLPED

451   SRKPIVMIGS GTGVAPFRAF VQQRAAENAE GKNWLIFGNP HFARDFLYQT

501   EWQQFAKDGF LHRYDFAWSR DQEEKIYVQD KIREQAEGLW QWLQEGAHIY

551   VCGDAAKMAK DVEAALLDVI IGAGHLDEEG AEEYLDMLRE EKRYQRDVY*
```

Computer analysis of this amino acid sequence gave the following results:

Homology with a Predicted ORF from *N. gonorrhoeae*

ORF 150 shows 91.3% identity over a 369 aa overlap with a predicted ORF (ORF 150.ng) from *N. gonorrhoeae*:

```
                    210        220        230        240        250        260
    m150.pep  LLKEEAAKNRATPAPQTTPPAGLQTAPDGRYCKAAPFPAALLANQKITARQSDKDVRHIE
                                      ||||  |||||||||||||||||||||||||||
    g150                              YCKADPFPAALLANQKITARQSDKDVRHIE
                                             10         20         30

270        280        290        300        310        320
    m150.pep  IDLSGSDLHYLPGDALGVWFDNDPALVREILDLLGIDPATEIQAGGKMMPVARALSSHFE
              ||||||||||||||||||||||||||||| ||||||||:|||||||||:|||  ||||||
    g150      IDLSGSDLHYLPGDALGVWFDNDPALVGEILDLLGINPATEIQAGGKTLPVASALLSHFE
                    40         50         60         70         80         90

330        340        350        360        370        380
    m150.pep  LTQNTPAFVKGYAAFAHYEELDKIIADNAVLQDFVQNTPIVDVLHRFPASLTAEQFIRLL
              |||||||||||||:||  :|||:|  ||||||| |||:||:  |||||||:|||||  ||
    g150      LTQNTPAFVKGYATFADNDELDRIAADNAVLQGFVQSTPIAGVLHRFPAKLTAEQFAGLL
                    100        110        120        130        140        150

390        400        410        420        430        440
    m150.pep  RPLAPRLYSISSAQAEVGDEVHLTVGVVRFEHEGRARTGGASGFLADRLEEDGTVRVFVE
              ||||||||||:|||:|||||||||||||||||||||:|||||:|||||||||||||||:|
    g150      RPLAPRLYSISSSQAEAGDEVHLTVGAVRFEHEGRAAGGASGFFADRLEEDGTVRVFAE
                    160        170        180        190        200        210

450        460        470        480        490        500
    m150.pep  RNDGFRLPEDSRKPIVMIGSGTGVAPFRAFVQQRAAENAEGKNWLIFGNPHFARDFLYQT
              ||||||||||||||||||||||||||||||||||||||||||:|||||||||||||||||
    g150      RNDGFRLPEDSRKPIVMIGSGTGVAPFRAFVQQRAAENAEGRNWLIFGNPHFAADFLYQT
                    220        230        240        250        260        270

510        520        530        540        550        560
    m150.pep  EWQQFAKDGFLHRYDFAWSRDQEEKIYVQDKIREQAEGLWQWLQEGAHIYVCGDAAKMAK
              ||||||||||||||||||||||||||||||||||||||||||||||||||||||||||||
    g150      EWQQFAKDGFLHRYDFAWSRDQEEKIYVQDKIREQAEGLWQWLQEGAHIYVCGDAAKMAK
                    280        290        300        310        320        330

570        580        590        600
    m150.pep  DVEAALLDVIIGAGHLDEEGAEEYLDMLREEKRYQRDVYX
              :||||||||||||||| ||:|||||||||||||||||||
    g150      EVEAALLDVIIGAGHSDEDGAEGYLDMLREEKRYQRDVYX
                    340        350        360        370
```

The following partial DNA sequence was identified in *N. meningitidis* <SEQ ID 611>:

```
a150.seq
     1  ATGCAGAACA CAAATCCGCC ATTACCGCCT ATGCCGCCCG AAATCACGCA
    51  GCTCCTGTCG GGGCTGGACG CGGCACAATG GGCGTGGCTG TCCGGCTACG
   101  CTTGGGCAAA AGCAGGAAAC GGGGCATCTG CAGGACTGCC CGCGCTTCAG
   151  ACGGCATTGC CGACGGCAGA ACCTTTTTCC GTAACCGTCC TTTCCGCCTC
   201  GCAAACCGGC AATGCGAAAT CCGTTGCCGA CAAAGCGGCG GACAGCCTGG
   251  AAGCCGCCGG CATCCAAGTC AGTCGCGCCG AACTGAAAGA CTATAAGGCG
   301  AAAAACATCG CCGGCGAACG CCGCCTGCTG CTGGTTACCT CCACCCAAGG
   351  CGAAGGCGAA CCGCCGGAAG AAGCCGTCGT GCTGCACAAA CTGCTGAACG
   401  GCAAAAAAGC CCCGAAATTG GACAAACTCC AATTTGCCGT ACTGGGTTTG
   451  GGCGACAGCT CCTATCCGAA TTTCTGCCGG GCGGGCAAAG ATTTCGACAA
   501  ACGTTTTGAA GAATTGGGCG CAAAACGCCT GCTCGAACGC GTTGATGCGG
   551  ATTTGGACTT TGCCGCCGCC GCAGACGGAT GGACAGATAA TATCGCCGCA
   601  CTCTTAAAAG AAGAAGCCGC AAAAAACCGG GCAACGCCCG CGCCGCAGAC
   651  AACGCCCCCC GCCGGCCTTC AGACGGCACC GGATGGCAGG TACTGCAAGG
   701  CAGACCCCTT TGCCGCCGCC CTGCTGGCCA ATCAGAAAAT CACCGCCCGC
   751  CAATCCGATA AAGACGTGCG CCACATCGAA ATCGATTTGA GCGGTTCGGA
   801  TTTGCACTAC CTCCCGGGCG ACGCGCTCGG CGTTTGGTTT GACAACGATC
   851  CGGCACTGGT CAGGGAAATC CTAGACCTGC TCGGCATCGA TCAGGCAACG
   901  GAAATACAGG CGGGCGGAAA AACCCTGCCG GTTGCCTCCG CACTGTTATC
   951  CCATTTTGAA CTCACGCAAA ACACCCCCGC CTTTGTCAAA GGCTATGCCC
  1001  CGTTCGCCGA TGATGACGAA CTCGACCGTA TTGCTGCCGA CAACGCCGTT
  1051  TTGCAAGGCT TTGTGCAAAG CACGCCGATT GCCGATGTGC TGCACCGCTT
  1101  CCCGGCAAAA CTGACAGCGG AACAATTCGC CGGCCTACTG CGCCCGCTTG
  1151  CGCCGCGCCT GTATTCGATT TCCTCGTCGC AGGCGGAAGT GGGGGACGAA
  1201  GTGCACCTGA CCGTCGGCGC GGTGCGTTTC GAACACGAAG GGCGCGCCAG
  1251  GGCGGGCGGC GCATCGGGTT TCCTTGCCGA CCGGCTGGAA GAGGACGGCA
  1301  CGGTGCGCGT GTTTGTGGAA CGCAACGACG GCTTCAGGCT GCCCGAAGAC
  1351  AGCCGCAAGC CGATTGTGAT GATCGGCTCG GGCACCGGCG TCGCACCGTT
  1401  CCGCGCTTTC GTCCAACAAC GTGCCGCAGA AAATGCGGAA GGCAAAAACT
  1451  GGCTGTTTTT CGGCAATCCG CATTTTGCCC GTGATTTTCT CTATCAAACC
  1501  GAATGGCAGC AGTTTGCCAA AGACGGCTTC CTGCACAGAT ACGATTTCGC
  1551  CTGGTCGCGC GATCAGGAAG AAAAAATCTA TGTGCAGGAC AAAATCCGCG
  1601  AACAGGCGGA AGGACTTTGG CAATGGCTGC AGGAAGGCGC GCATATCTAT
  1651  GTGTGCGGCG ATGCGGCAAA AATGGCAAAA GACGTGGAAG CCGCCTTGCT
  1701  GGATGTGATT ATCGGGGCAG GACATTTGGA CGAAGAGGGC GCAGAAGAAT
  1751  ATTTGGATAT GCTGCGCGAA GAAAAACGCT ATCAGCGTGA TGTTTATTGA
```

This corresponds to the amino acid sequence <SEQ ID 612; ORF 150.a>:

```
a150.pep
    1 MQNTNPPLPP MPPEITQLLS GLDAAQWAWL SGYAWAKAGN GASAGLPALQ

51 TALPTAEPFS VTVLSASQTG NAKSVADKAA DSLEAAGIQV SRAELKDYKA

101 KNIAGERRLL LVTSTQGEGE PPEEAVVLHK LLNGKKAPKL DKLQFAVLGL

151 GDSSYPNFCR AGKDFDKRFE ELGAKRLLER VDADLDFAAA ADGWTDNIAA

201 LLKEEAAKNR ATPAPQTTPP AGLQTAPDGR YCKADPFPAA LLANQKITAR

251 QSDKDVRHIE IDLSGSDLHY LPGDALGVWF DNDPALVREI LDLLGIDQAT

301 EIQAGGKTLP VASALLSHFE LTQNTPAFVK GYAPFADDDE LDRIAADNAV

351 LQGFVQSTPI ADVLHRFPAK LTAEQFAGLL RPLAPRLYSI SSSQAEVGDE

401 VHLTVGAVRF EHEGRARAGG ASGFLADRLE EDGTVRVFVE RNDGFRLPED

451 SRKPIVMIGS GTGVAPFRAF VQQRAAENAE GKNWLFFGNP HFARDFLYQT

501 EWQQFAKDGF LHRYDFAWSR DQEEKIYVQD KIREQAEGLW QWLQEGAHIY

551 VCGDAAKMAK DVEAALLDVI IGAGHLDEEG AEEYLDMLRE EKRYQRDVY*
``` m150/a150 94.8% identity in 599 aa overlap

```
                 10         20         30         40         50         60
m150.pep MQNTNPPLPPLPPEITQLLSGLDAAQWAWLSGYAWAKAGNGASAGLPALQTALPAAEPFS
         ||||||||||:|||||||||||||||||||||||||||||||||||||||||||:||||
a150     MQNTNPPLPPMPPEITQLLSGLDAAQWAWLSGYAWAKAGNGA3AGLPALQTALPTAEPFS
                 10         20         30         40         50         60

70         80         90        100        110        120
m150.pep VTVLSASQTGNAKSVADKAADSLEAAGIQVSRAELKDYKAKNIAGERRLLLVTSTQGEGE
         ||||||||||||||||||||||||||||||||||||||||||||||||||||||||||||
a150     VTVLSASQTGNAKSVADKAADSLEAAGIQVSRAELKDYKAKNIAGERRLLLVTSTQGEGE
                 70         80         90        100        110        120

130        140        150        160        170        180
m150.pep PPKEAVVLHKLLNGKKAPKLDKLQFAVLGLGDSSYPNFCQAGKDFDRRFEELGAKRLLER
         ||:|||||||||||||||||||||||||||||||||||||:||||||:|:|||||||||
a150     PPEEAVVLHKLLNGKKAPKLDKLQFAVLGLGDSSYPNFCRAGKDFDKRFEELGAKRLLER
                130        140        150        160        170        180

190        200        210        220        230        240
m150.pep VDADLDFTASANAWTDNIAALLKEEAAKNRATPAPQTTPPAGLQTAPDGRYCKAAPFPAA
         |||||||:|:|::|||||||||||||||||||||||||||||||||||||||| ||||
a150     VDADLDFAAAADGWTDNIAALLKEEAAKNRATPAPQTTPPAGLQTAPDGRYCKADPFPAA
                190        200        210        220        230        240

250        260        270        280        290        300
m150.pep LLANQKITARQSDKDVRHIEIDLSGSDLHYLPGDALGVWFDNDPALVREILDLLGIDPAT
         |||||||||||||||||||||||||||||||||||||||||||||||||||||||| ||
a150     LLANQKITARQSDKDVRHIEIDLSGSDLHYLPGDALGVWFDNDPALVREILDLLGIDQAT
                250        260        270        280        290        300

310        320        330        340        350        360
m150.pep EIQAGGKMMPVARALSSHFELTQNTPAFVKGYAAFAHYEELDKIIADNAVLQDFVQNTPI
         ||||||| :||| || |||||||||||||||| :||:|| ||:||||||||:|:|:|||
a150     EIQAGGKTLPVASALLSHFELTQNTPAFVKGYAPFADDDELDRIAADNAVLQGFVQSTPI
                310        320        330        340        350        360

370        380        390        400        410        420
m150.pep VDVLHRFPASLTAEQFIRLLRPLAPRLYSISSAQAEVGDEVHLTVGVVRFEHEGRARTGG
         :||||||||:|||||| ||||||||||||| |||||||||||||||:||||||||| ||
a150     ADVLHRFPAKLTAEQFAGLLRPLAPRLYSISSSQAEVGDEVHLTVGAVRFEHEGRARAGG
                370        380        390        400        410        420

430        440        450        460        470        480
m150.pep ASGFLADRLEEDGTVRVFVERNDGFRLPEDSRKPIVMIGSGTGVAPFRAFVQQRAAENAE
         ||||||||||||||||||||||||||||||||||||||||||||||||||||||||||||
a150     ASGFLADRLEEDGTVRVFVERNDGFRLPEDSRKPIVMIGSGTGVAPFRAFVQQRAAENAE
                430        440        450        460        470        480

490        500        510        520        530        540
m150.pep GKNWLIFGNPHFARDFLYQTEWQQFAKDGFLHRYDFAWSRDQEEKIYVQDKIREQAEGLW
         ||||| ||||||||||||||||||||||||||||||||||||||||||||||||||||||
a150     GKNWLFFGNPHFARDFLYQTEWQQFAKDGFLHRYDFAWSRDQEEKIYVQDKIREQAEGLW
                490        500        510        520        530        540

550        560        570        580        590        600
m150.pep QWLQEGAHIYVCGDAAKMAKDVEAALLDVIIGAGHLDEEGAEEYLDMLREEKRYQRDVYX
         ||||||||||||||||||||||||||||||||||||||||||||||||||||||||||||
a150     QWLQEGAHIYVCGDAAKMAKDVEAALLDVIIGAGHLDEEGAEEYLDMLREEKRYQRDVYX
                550        560        570        580        590        600
```

The following partial DNA sequence was identified in *N. gonorrhoeae* <SEQ ID 613>:

```
g151.seq
       1 ATGAAACAAA TCCGCAACAT CGCCATCATC GCACACGTCG ACCACGGCAA
      51 AACCACATTG GTCGACCAAC TGCTGCGCCA ATCCGGCACA TTCCGCGCCA
     101 ACCAGCAGGT TGACGAGCGC GTGATGGACA GCAACGACCT TGAAAAAGAA
     151 CGCGGCATCA CCATCCTCGC CAAAAACACC GCCATCGATT ACGAAGGCTG
     201 CCACATCAAT ATCGTCGACA CGCCGGGACA CGCCGACTTC GGCGGCGAAG
     251 TGGAGCGCGT TTTGGGGATG GTGGATTGCG TCGTCTTGTT GGTGGACGCA
     301 CAGGAAGGTC CGATGCCGCA AACCCGTTTC GTGACCAAAA AAGCCTTGGC
     351 TTTGGGGCTG AAACCGATTG TCGTCATCAA CAAAATCGAC AAACCGTCCG
     401 CCCGTCCGAG CTGGGTTATC GACCAGACTT TCGAGTTGTT CGACAACTTG
     451 GGTGCGACCG ACGAGCAGTT GGATTTCCCG ATTGTTTACG CTTCAGGTTT
     501 GAGCGGCTTT GCCAAGCTGG AAGAAAccga CGAGAGCAGC GATATGCGCC
     551 CGCtgttcgA CACCATCCTA AAATACAcgc ctgCACCGAG CGGCAGCGCG
     601 GACGAGCCGC TGCAACTGCA AATTTCCCAA CTCGACTACG ACAACTACAC
     651 CGGCCGCCTC GGTATCGGTC GTATCTTGAA CGGACGCATC AAACCCGGCC
     701 AAACCGTTGC CGTGATGAAC CACGAGCAGC AAATCGCCCA AGGCCGCATC
     751 AACCAGCTTT TGGGTTTCAA AGGCTTGGAA CGCGTGCCGC TTGAAGAAGC
     801 CGAAGCCGGC GACATTGTGA TTATTTCCGG TATCGAAGAC ATCGGCATCG
     851 GCGTAACCAT CACCGACAAA GACAACCCCA AAGGCCTGCC GATGTTGAGC
     901 GTGGACGAAC CGACGCTGAC GATGGACTTT ATGGTAAACA CCAGCCCGCT
     951 CGCAGGTACA GAAGGCAAAT TCGTGACCAG CCGCCAAATC CGCGACCGCC
    1001 TGCAAAAAGA ATTGCTGACC AACGTTGCCC TGCGCGTGGA AGACACCGCC
    1051 GatgCCGACG TGTTCCGCGT ATCcGGCGC GGCGAACTGC ACCTGACGAT
    1101 TTTGCTGGAA AATATGCGCC GCGAAGGCTA CGAACTCGCC GTCGGCAAGC
    1151 CGCGCGTCGT GTACCGAGAC ATCGACGGTC AAAAATGCGA ACCTTATGAA
    1201 AACCTGACTG TGGACGTACc cgacgacAAC CAAGGCGCGG TAATGGAAGA
    1251 ACTCGGCCGC CGCCGTGGCG AACTGACCAA TATGGAAAGC GACGGCAACG
    1301 GacgCACCCG CCTCGAATAC CATATTCCAG CGCGCGGCTT GATCGGTTTC
    1351 CAAGGCGAAT TCATGACCCT GACGCGCGGC GTCGGGCTGA TGAgccacGT
    1401 GTTcgacgac tacgcgcccg tcaAACCCGA TATGCCCGGC CGCCACAACG
    1451 GCGTactggt GtcccaAGAG CAGGGCGAGG CGGTTGCTTA CGCCTTGTGG
    1501 AATCTTGAAG ACCGCGGCCG TATGTTCGTA TCGCCCAACG ACAAAATCTA
    1551 CGAAGGTATG ATTATCGGCA TCCACAGCCG CGACAACGAT TTGGTGGTCA
    1601 ACCCGCTCAA AGGCAAAAAA CTCACCAATA TCCGTGCCAG CGGTACCGAC
    1651 GAAGCGGTGC GCCTGACCAC GCCGATCAAA CTGAcgcTGG AAGGCGCGGT
    1701 CGAGTTTATC GACGATGACG AGCTGGTGGA AATCACGCCG CAAtccatcc
    1751 gcctgcgcat gcgttacctG AGCGaattgg aacgccgccg tcaTTTTAAA
    1801 AagctgGATT AA
```

This corresponds to the amino acid sequence <SEQ ID 614; ORF 151.ng>:

```
g151.pep
     1  MKQIRNIAII AHVDHGKTTL VDQLLRQSGT FRANQQVDER VMDSNDLEKE

51  RGITILAKNT AIDYEGCHIN IVDTPGHADF GGEVERVLGM VDCVVLLVDA

101  QEGPMPQTRF VTKKALALGL KPIVVINKID KPSARPSWVI DQTFELFDNL

151  GATDEQLDFP IVYASGLSGF AKLEETDESS DMRPLFDTIL KYTPAPSGSA

201  DEPLQLQISQ LDYDNYTGRL GIGRILNGRI KPGQTVAVMN HEQQIAQGRI

251  NQLLGFKGLE RVPLEEAEAG DIVIISGIED IGIGVTITDK DNPKGLPMLS

301  VDEPTLTMDF MVNTSPLAGT EGKFVTSRQI RDRLQKELLT NVALRVEDTA

351  DADVFRVSGR GELHLTILLE NMRREGYELA VGKPRVVYRD IDGQKCEPYE

401  NLTVDVPDDN QGAVMEELGR RRGELTNMES DGNGRTRLEY HIPARGLIGF

451  QGEFMTLTRG VGLMSHVFDD YAPVKPDMPG RHNGVLVSQE QGEAVAYALW

501  NLEDRGRMFV SPNDKIYEGM IIGIHSRDND LVVNPLKGKK LTNIRASGTD

551  EAVRLTTPIK LTLEGAVEFI DDDELVEITP QSIRLRMRYL SELERRRHFK

601  KLD*
```

The following partial DNA sequence was identified in *N. meningitidis* <SEQ ID 615>:

```
m151.seq
     1  ATGAAACAAA TCCGCAACAT CGCCATCATC GCCCACGTCG ACCACGGCAA

51  AACCACATTG GTCGACCAAC TGCTGCGCCA ATCCGGCACA TTCCGCGCCA

101  ACCAGCAGGT TGACGAGCGC GTGATGGACA GCAACGACCT TGAAAAAGAA

151  CGCGGCATCA CCATCCTCGC CAAAAACACC GCCATCGATT ACGAAGGCTA

201  CCACATCAAT ATCGTCGACA CGCCGGGACA CGCCGACTTC GGCGGCGAAG

251  TAGAGCGCGT TTTGGGGATG GTGGACTGCG TCGTCTTGTT GGTGGACGCG

301  CAGGAAGGCC CGATGCCGCA AACCCGTTTC GTGACCAAAA AAGCCTTGGC

351  TTTGGGGCTG AAACCGATTG TCGTCATCAA CAAAATCGAC AAGCCGTCCG

401  CTCGTCCGAG CTGGGTTATC GACCAAACTT TCGAGCTGTT CGACAACTTG

451  GGCGCGACCG ACGAGCAGTT GGATTTCCCG ATTGTTTACG CTTCAGGGTT

501  GAGCGGTTTC GCCAAATTGG AAGAAACCGA CGAGAGCAAC GACATGCGTC

551  CGCTGTTCGA TACTATCTTA AAATATACGC CTGCACCGAG CGGCAGCGCG

601  GACGAAACGC TGCAACTGCA AATTTCCCAA CTCGACTACG ACAACTACAC

651  CGGCCGCCTC GGTATCGGTC GTATCTTGAA CGGACGCATC AAACCCGGCC

701  AAACCGTTGC CGTCATGAAC CACGATCAGC AAATCGCCCA AGGCCGCATC

751  AACCAGCTTT TGGGTTTCAA AGGTTTGGAA CGCGTGCCGC TTGAAGAAGC

801  CGAAGCCGGC GACATCGTGA TTATTTCCGG TATCGAAGAC ATCGGTATCG

851  GCGTAACCAT CACCGACAAA GACAATCCCA AAGGCCTACC GATGTTGAGC

901  GTGGACGAAC CGACGCTGAC GATGGACTTT ATGGTCAACA CCAGCCCGCT

951  GGCGGGTACG GAAGGCAAAT TCGTAACCAG CCGCCAAATC CGCGACCGCC

1001  TGCAAAAAGA ATTGCTGACC AACGTCGCCC TGCGCGTGGA AGATACCGCC

1051  GATGCCGACG TGTTCCGCGT ATCCGGGCGC GGCGAGCTGC ACCTGACCAT

1101  TTTGCTGGAA AACATGCGCC GCGAAGGCTA CGAACTCGCC GTCGGCAAAC

1151  CGCGCGTCGT GTACCGCGAC ATCGACGGTC AAAAATGCGA ACCGTATGAA
```

-continued

```
1201 AACCTGACCG TGGATGTACC CGACGACAAC CAAGGCGCGG TAATGGAAGA

1251 ACTCGGCCGC CGCCGTGGCG AACTGACTAA TATGGAAAGC GACGGCAACG

1301 GACGCACCCG CCTCGAATAC CATATTCCAG CGCGCGGCTT GATCGGTTTC

1351 CAAGGCGAAT TTATGACCCT GACGCGCGGG GTCGGGCTGA TGAGCCACGT

1401 GTTCGACGAT TACGCGCCCG TCAAACCCGA TATGCCCGGC CGCCACAACG

1451 GCGTGCTGGT GTCCCAAGAG CAGGGCGAGG CAGTCGCTTA CGCCTTGTGG

1501 AATCTGGAAG ACCGCGGCCG TATGTTCGTA TCGCCCAACG ACAAAATCTA

1551 CGAAGGCATG ATTATCGGCA TCCACAGTCG CGACAACGAT TTGGTGGTCA

1601 ACCCGCTCAA AGGCAAAAAA CTTACCAACA TCCGTGCCAG CGGTACCGAC

1651 GAAGCCGTTC GCCTGACCAC GCCAATCAAG CTGACGCTGG AAGGTGCGGT

1701 TGAGTTTATC GACGATGACG AACTCGTTGA AATCACGCCG CAATCCATCC

1751 GTCTGCGCAA GCGTTACTTG AGCGAATTGG AACGCCGCCG CCACTTTAAA

1801 AAGCTGGATT GA
```

This corresponds to the amino acid sequence <SEQ ID 616; ORF 151>:

```
m151.pep
    1 MKQIRNIAII AHVDHGKTTL VDQLLRQSGT FRANQQVDER VMDSNDLEKE

51 RGITILAKNT AIDYEGYHIN IVDTPGHADF GGEVERVLGM VDCVVLLVDA

101 QEGPMPQTRF VTKKALALGL KPIVVINKID KPSARPSWVI DQTFELFDNL

151 GATDEQLDFP IVYASGLSGF AKLEETDESN DMRPLFDTIL KYTPAPSGSA

201 DETLQLQISQ LDYDNYTGRL GIGRILNGRI KPGQTVAVMN HDQQIAQGRI

251 NQLLGFKGLE RVPLEEAEAG DIVIISGIED IGIGVTITDK DNPKGLPMLS

301 VDEPTLTMDF MVNTSPLAGT EGKFVTSRQI RDRLQKELLT NVALRVEDTA

351 DADVFRVSGR GELHLTILLE NMRREGYELA VGKPRVVYRD IDGQKCEPYE

401 NLTVDVPDDN QGAVMEELGR RRGELTNMES DGNGRTRLEY HIPARGLIGF

451 QGEFMTLTRG VGLMSHVFDD YAPVKPDMPG RHNGVLVSQE QGEAVAYALW

501 NLEDRGRMFV SPNDKIYEGM IIGIHSRDND LVVNPLKGKK LTNIRASGTD

551 EAVRLTTPIK LTLEGAVEFI DDDELVEITP QSIRLRKRYL SELERRRHFK

601 KLD*
```

Computer analysis of this amino acid sequence gave the following results:
Homology with a Predicted ORF from *N. gonorrhoeae*
ORF 151 shows 99.2% identity over a 603 aa overlap with a predicted ORF (ORF 151.ng) from *N. gonorrhoeae*:

```
m151/g151
                  10         20         30         40         50         60
    m151.pep  MKQIRNIAIIAHVDHGKTTLVDQLLRQSGTFRANQQVDERVMDSNDLEKERGITILAKNT
              ||||||||||||||||||||||||||||||||||||||||||||||||||||||||||||
        g151  MKQIRNIAIIAHVDHGKTTLVDQLLRQSGTFRANQQVDERVMDSNDLEKERGITILAKNT
                  10         20         30         40         50         60

70         80         90        100        110        120
    m151.pep  AIDYEGYHINIVDTPGHADFGGEVERVLGMVDCVVLLVDAQEGPMPQTRFVTKKALALGL
              ||||||  ||||||||||||||||||||||||||||||||||||||||||||||||||||
        g151  AIDYEGCHINIVDTPGHADFGGEVERVLGMVDCVVLLVDAQEGPMPQTRFVTKKALALGL
                  70         80         90        100        110        120
```

-continued

```
                 130        140        150        160        170        180
m151.pep    KPIVVINKIDKPSARPSWVIDQTFELFDNLGATDEQLDFPIVYASGLSGFAKLEETDESN
            |||||||||||||||||||||||||||||||||||||||||||||||||||||||||||:
g151        KPIVVINKIDKPSARPSWVIDQTFELFDNLGATDEQLDFPIVYASGLSGFAKLEETDESS
                 130        140        150        160        170        180

190        200        210        220        230        240
m151.pep    DMRPLFDTILKYTPAPSGSADETLQLQISQLDYDNYTGRLGIGRILNGRIKPGQTVAVMN
            |||||||||||||||||||||| |||||||||||||||||||||||||||||||||||||
g151        DMRPLFDTILKYTPAPSGSADEPLQLQISQLDYDNYTGRLGIGRILNGRIKPGQTVAVMN
                 190        200        210        220        230        240

250        260        270        280        290        300
m151.pep    HDQQIAQGRINQLLGFKGLERVPLEEAEAGDIVIISGIEDIGIGVTITDKDNPKGLPMLS
            |:||||||||||||||||||||||||||||||||||||||||||||||||||||||||||
g151        HEQQIAQGRINQLLGFKGLERVPLEEAEAGDIVIISGIEDIGIGVTITDKDNPKGLPMLS
                 250        260        270        280        290        300

310        320        330        340        350        360
m151.pep    VDEPTLTMDFMVNTSPLAGTEGKFVTSRQIRDRLQKELLTNVALRVEDTADADVFRVSGR
            ||||||||||||||||||||||||||||||||||||||||||||||||||||||||||||
g151        VDEPTLTMDFMVNTSPLAGTEGKFVTSRQIRDRLQKELLTNVALRVEDTADADVFRVSGR
                 310        320        330        340        350        360

370        380        390        400        410        420
m151.pep    GELHLTILLENMRREGYELAVGKPRVVYRDIDGQKCEPYENLTVDVPDDNQGAVMEELGR
            ||||||||||||||||||||||||||||||||||||||||||||||||||||||||||||
g151        GELHLTILLENMRREGYELAVGKPRVVYRDIDGQKCEPYENLTVDVPDDNQGAVMEEIGR
                 370        380        390        400        410        420

430        440        450        460        470        480
m151.pep    RRGELTNMESDGNGRTRLEYHIPARGLIGFQGEFMTLTRGVGLMSHVFDDYAPVKPDMPG
            ||||||||||||||||||||||||||||||||||||||||||||||||||||||||||||
g151        RRGELTNMESDGNGRTRLEYHIPARGLIGFQGEFMTLTRGVGLMSHVFDDYAPVKPDMPG
                 430        440        450        460        470        480

490        500        510        520        530        540
m151.pep    RHNGVLVSQEQGEAVAYALWNLEDRGRMFVSPNDKIYEGMIIGIHSRDNDLVVNPLKGKK
            ||||||||||||||||||||||||||||||||||||||||||||||||||||||||||||
g151        RHNGVLVSQEQGEAVAYALWNLEDRGRMFVSPNDKIYEGMIIGIHSRDNDLVVNPLKGKK
                 490        500        510        520        530        540

550        560        570        580        590        600
m151.pep    LTNIRASGTDEAVRLTTPIKLTLEGAVEFIDDDELVEITPQSIRIRKRYLSELERRRHFK
            ||||||||||||||||||||||||||||||||||||||||||||| ||||||||||||||
g151        LTNIRASGTDEAVRLTTPIKLTLEGAVEFIDDDELVEITPQSIRLRMRYLSELERRRHFK
                 550        560        570        580        590        600 m151.pep    KLDX
            ||||
g151        KLDX
```

The following partial DNA sequence was identified in *N. meningitidis* <SEQ ID 617>:

```
a151.seq
   1  ATGAAACAAA TCCGCAACAT CGCCATCATC GCCCACGTCG ACCACGGCAA

51  AACCACATTG GTCGACCAAC TGCTGCGCCA ATCCGGCACA TTCCGCGCCA

101  ACCAGCAGGT TGACGAGCGC GTGATGGACA GCAACGACCT TGAAAAAGAA

151  CGCGGCATCA CCATCCTCGC CAAAAACACC GCCATCGATT ACGAAGGCTA

201  CCACATCAAT ATCGTCGACA CGCCGGGACA CGCCGACTTC GGCGGCGAAG

251  TAGAGCGAGT TTTGGGGATG GTGGACTGCG TCGTCTTGTT GGTGGACGCG

301  CAGGAAGGCC CGATGCCGCA AACCCGTTTC GTGACCAAAA AAGCCTTGGC

351  TTTGGGGCTG AAACCGATTG TCGTCATCAA TAAAATCGAC AAACCGTCCG

401  CCCGTCCGAG CTGGGTCATC GACCAAACTT TCGAGCTGTT CGACAACTTG

451  GGCGCGACCG ACGAGCAGTT GGATTTCCCG ATTGTTTATG CTTCCGGTCT

501  GTCCGGTTTC GCCAAATTGG AAGAAACCGA CGAGAGCAAC GACATGCGTC

551  CGCTGTTCGA TACTATCTTA AAATATACGC CTGCACCGAG CGGCAGCGCG

601  GACGAAACGC TGCAACTGCA AATTTCCCAA CTCGACTACG ACAACTACAC

651  CGGCCGCCTC GGTATCGGTC GTATCTTGAA CGGACGTATC AAGCCCGGTC

701  AAGTTGTTGC CGTCATGAAC CACGATCAAC AAATCGCCCA AGGCCGCATC
```

```
 751    AACCAGCTTT TGGGTTTCAA AGGTTTAGAA CGCGTGCCGC TTGAAGAAGC

801    CGAAGCCGGC GACATCGTGA TTATTTCCGG TATTGAAGAC ATCGGCATCG

851    GCGTAACCAT CACCGACAAA GACAACCCCA AAGGCCTGCC GATGTTGAGC

901    GTGGACGAAC CGACGCTGAC GATGGACTTT ATGGTCAACA CCAGCCCGTT

951    GGCAGGTACG GAAGGCAAAT TCGTAACCAG CCGCCAAATC CGCGACCGCC

1001    TGCAAAAAGA ATTGCTGACC AACGTCGCCC TGCGCGTGGA AGATACCGCC

1051    GATGCCGACG TGTTCCGCGT ATCCGGGCGC GGCGAGCTGC ACCTGACCAT

1101    TTTGCTGGAA AACATGCGCC GCGAAGGCTA CGAACTCGCC GTCGGCAAAC

1151    CGCGCGTCGT GTACCGCGAC ATCGACGGTC AAAAATGCGA ACCGTATGAA

1201    AACCTGACCG TGGACGTACC CGACGACAAC CAAGGCGCGG TAATGGAAGA

1251    ACTCGGCCGC CGCCGTGGCG AACTGACTAA TATGGAAAGC GACGGCAACG

1301    GACGCACCCG CCTCGAATAC CATATTCCAG CGCGCGGCTT GATCGGCTTC

1351    CAAGGCGAAT TTATGACCCT GACGCGCGGG GTCGGGCTGA TGAGCCACGT

1401    GTTCGACGAT TACGCGCCCG TCAAACCCGA TATGCCTGGC CGCCACAACG

1451    GCGTGCTGGT GTCCCAAGAG CAGGGCGAGG CAGTCGCTTA CGCCTTGTGG

1501    AATCTGGAAG ACCGCGGCCG TATGTTCGTA TCGCCCAACG ACAAAATCTA

1551    CGAAGGTATG ATTATCGGCA TCCACAGTCG CGACAACGAT TTGGTGGTCA

1601    ACCCGCTCAA AGGCAAAAAA CTTACCAACA TCCGTGCCAG CGGTACCGAC

1651    GAAGCCGTTC GCCTGACCAC GCCGATTAAG CTGACGCTGG AAGGTGCGGT

1701    CGAGTTTATC GACGATGATG AGCTGGTAGA AATCACGCCG CAATCCATCC

1751    GTCTGCGCAA GCGTTACTTG AGCGAATTGG AACGCCGCCG CCATTTCAAA

1801    AAGCTAGATT GA
```

This corresponds to the amino acid sequence <SEQ ID 618; ORF 151.a>:

```
a151.pep
   1    MKQIRNIAII AHVDHGKTTL VDQLLRQSGT FRANQQVDER VMDSNDLEKE

51    RGITILAKNT AIDYEGYHIN IVDTPGHADF GGEVERVLGM VDCVVLLVDA

101    QEGPMPQTRF VTKKALALGL KPIVVINKID KPSARPSWVI DQTFELFDNL

151    GATDEQLDFP IVYASGLSGF AKLEETDESN DMRPLFDTIL KYTPAPSGSA

201    DETLQLQISQ LDYDNYTGRL GIGRILNGRI KPGQVVAVMN HDQQIAQGRI

251    NQLLGFKGLE RVPLEEAEAG DIVIISGIED IGIGVTITDK DNPKGLPMLS

301    VDEPTLTMDF MVNTSPLAGT EGKFVTSRQI RDRLQKELLT NVALRVEDTA

351    DADVFRVSGR GELHLTILLE NMRREGYELA VGKPRVVYRD IDGQKCEPYE

401    NLTVDVPDDN QGAVMEELGR RRGELTNMES DGNGRTRLEY HIPARGLIGF

451    QGEFMTLTRG VGLMSHVFDD YAPVKPDMPG RHNGVLVSQE QGEAVAYALW

501    NLEDRGRMFV SPNDKIYEGM IIGIHSRDND LVVNPLKGKK LTNIRASGTD

551    EAVRLTTPIK LTLEGAVEFI DDDELVEITP QSIRLRKRYL SELERRRHFK

601    KLD*
``` m151/a151 99.8% identity in 603 aa overlap

```
              10        20        30        40        50        60
m151.pep  MKQIRNIAIIAHVDHGKTTLVDQLLRQSGTFRANQQVDERVMDSNDLEKERGITILAKNT
          ||||||||||||||||||||||||||||||||||||||||||||||||||||||||||||
a151      MKQIRNIAIIAHVDHGKTTLVDQLLRQSGTFRANQQVDERVMDSNDLEKERGITILAKNT
              10        20        30        40        50        60

70        80        90       100       110       120
m151.pep  AIDYEGYHINIVDTPGHADFGGEVERVLGMVDCVVLLVDAQEGPMPQTRFVTKKALALGL
          ||||||||||||||||||||||||||||||||||||||||||||||||||||||||||||
a151      AIDYEGYHINIVDTPGHADFGGEVERVLGMVDCVVLLVDAQEGPMPQTRFVTKKALALGL
              70        80        90       100       110       120

130       140       150       160       170       180
m151.pep  KPIVVINKIDKPSARPSWVIDQTFELFDNLGATDEQLDFPIVYASGLSGFAKLEETDESN
          ||||||||||||||||||||||||||||||||||||||||||||||||||||||||||:
a151      KPIVVINKIDKPSARPSWVIDQTFELFDNLGATDEQLDFPIVYASGLSGFAKLEETDESS
             130       140       150       160       170       180

190       200       210       220       230       240
m151.pep  DMRPLFDTILKYTPAPSGSADETLQLQISQLDYDNYTGRLGIGRILNGRIKPGQTVAVMN
          ||||||||||||||||||||||||||||||||||||||||||||||||||||:|||||
a151      DMRPLFDTILKYTPAPSGSADETLQLQISQLDYDNYTGRLGIGRILNGRIKPGQVVAVMN
             190       200       210       220       230       240

250       260       270       280       290       300
m151.pep  HDQQIAQGRINQLLGFKGLERVPLEEAEAGDIVIISGIEDIGIGVTITDKDNPKGLPMLS
          ||||||||||||||||||||||||||||||||||||||||||||||||||||||||||||
a151      HDQQIAQGRINQLLGFKGLERVPLEEAEAGDIVIISGIEDIGIGVTITDKDNPKGLPMLS
             250       260       270       280       290       300

310       320       330       340       350       360
m151.pep  VDEPTLTMDFMVNTSPLAGTEGKFVTSRQIRDRLQKELLTNVALRVEDTADADVFRVSGR
          ||||||||||||||||||||||||||||||||||||||||||||||||||||||||||||
a151      VDEPTLTMDFMVNTSPLAGTEGKFVTSRQIRDRLQKELLTNVALRVEDTADADVFRVSGR
             310       320       330       340       350       360

370       380       390       400       410       420
m151.pep  GELHLTILLENMRREGYELAVGKPRVVYRDIDGQKCEPYENLTVDVPDDNQGAVMEELGR
          |||||||||||||||||||||||||||||||||||||||||||||||||||||||:|||
a151      GELHLTILLENMRREGYELAVGKPRVVYRDIDGQKCEPYENLTVDVPDDNQGAVMEEIGR
             370       380       390       400       410       420

430       440       450       460       470       480
m151.pep  RRGELTNMESDGNGRTRLEYHIPARGLIGFQGEFMTLTRGVGLMSHVFDDYAPVKPDMPG
          ||||||||||||||||||||||||||||||||||||||||||||||||||||||||||||
a151      RRGELTNMESDGNGRTRLEYHIPARGLIGFQGEFMTLTRGVGLMSHVFDDYAPVKPDMPG
             430       440       450       460       470       480

490       500       510       520       530       540
m151.pep  RHNGVLVSQEQGEAVAYALWNLEDRGRMFVSPNDKIYEGMIIGIHSRDNDLVVNPLKGKK
          ||||||||||||||||||||||||||||||||||||||||||||||||||||||||||||
a151      RHNGVLVSQEQGEAVAYALWNLEDRGRMFVSPNDKIYEGMIIGIHSRDNDLVVNPLKGKK
             490       500       510       520       530       540

550       560       570       580       590       600
m151.pep  LTNIRASGTDEAVRLTTPIKLTLEGAVEFIDDDELVEITPQSIRIRKRYLSELERRRHFK
          |||||||||||||||||||||||||||||||||||||||||||||||||||||||||||
a151      LTNIRASGTDEAVRLTTPIKLTLEGAVEFIDDDELVEITPQSIRIRKRYLSELERRRHFK
             550       560       570       580       590       600 m151.pep  KLDX
          ||||
a151      KLDX
```

The following partial DNA sequence was identified in *N. gonorrhoeae* <SEQ ID 619>:

```
g152.seq
    1  ATGAAAAaca aAACCaaagt ctgGGacttc cCcacccgcc ttTTCCactG

51  GctgcttgCC gCATCCctgc CCTTTATGTG gtatagCGCA AAAGCCGGCG

101  GcgataTGCT GcaatgGCAC ACGCGCGTCG GGCTGCTCGT CCTTTTCCTG

151  CTCGTATTCC GCCTCTGCTG GGGCATTTGG GGCAgcgATA CCGCCCGTTT

201  CTCccgTtTC GTCCGAGGTT GGGCAGGTAT ACGCGGCTAT CTGAAAAAcg 251  gCATTCCCGA ACAtatcCAG CCCGGACACA ACCCCTTGGG CGCACTgatg 301  gtcGTTGCGC TTTTGgccgc cgtcTCATTT CAagtcggcA CGGGGCTTTT 351  Tgccgccaat gaaaacacct tcagcaCCAa cggctacctc aaccatttgg 401  tttccgaaca tacgGGCAGC CTTATACGGA AAATCCACCT CAACTTTTTC
```

-continued

```
    451   AAGCTGCTCG CCGTTTTTTC CGCAGTCCAC ATCGCCGCCG TCGCCGCATA

501   CCGCATATTC AAAAAGAAAA ACCTCGTCCG CCCGATGATA ACCGGCTTCA

551   AATACATCGA AGGCAAAACC TCAATCCGCT TGCCGGCAA AGCCGCGCTT

601   GCCGCCGCAT TATCGGTTGC CGCGCTTGCC GCAGCCGCCA TCCTGCTCCT

651   GTCCTGA
```

This corresponds to the amino acid sequence <SEQ ID 620; ORF 152.ng>:

```
g152.pep
    1   MKNKTKVWDF PTRLFHWLLA ASLPFMWYSA KAGGDMLQWH TRVGLLVLFL

51   LVFRLCWGIW GSDTARFSRF VRGWAGIRGY LKNGIPEHIQ PGHNPLGALM

101   VVALLAAVSF QVGTGLFAAN ENTFSTNGYL NHLVSEHTGS LIRKIHLNFF

151   KLLAVFSAVH IAAVAAYRIF KKKNLVRPMI TGFKYIEGKT SIRFAGKAAL

201   AAALSVAALA AAILLLS*
```

The following partial DNA sequence was identified in N. meningitidis <SEQ ID 621>:

```
m152.seq
    1   ATGAAAAACA AAACCAAAGT CTGGGACCTC CCCACCCGCC TTTTCCACTG

51   GCTGCTTGCC GCGTCCCTGC CCTTTATGTG GTATAGCGCG AAAGCCGGCG

101   GCGATATGCT GCAATGGCAC ACGCGCGTCG GGCTGTTCGT CCTTTTCCTG

151   CTCGTATTTC GCCTCTGCTG GGGCATTTGG GGCAGCGATA CCGCCCGTTT

201   TTCCCGTTTC GTCCAAGGCT GGGCAGGCAT ACGCGGCTAT CTGAAAAACG

251   GTATTCCCGA ACACATCCAG CCCGGACACA ACCCCTTGGG CGCACTGATG

301   GTCGTTGCGC TTTTGGCCGC CGTGTCCTTC CAAGTCGGCA CCGGGCTTTT

351   TGCCGCCGAT GAAAACACCT TCAGCACCAA CGGCTACCTC AACCATTTGG

401   TTTCCGAACA TACGGGCAGC CTTATGCGGA AAATCCACCT CAACTTTTTC

451   AAGCTGCTCG CCGTTTTTTC TGCAATCCAC ATCGCCGCCG TCGCCGCATA

501   CCGCGTATTC AAAAAGAAAA ACCTCATCCT CCCGATGATA ACCGGCTTCA

551   AATACATCGA AGGCAAAACC TCAATCCGCT TGCAGGCAA AGCCGCGCTT

601   GCCGCCGCAT TATCGGTTGC CTCGCTTGCC GCAGCCGCCA TCCTGCTCCT

651   GTCCTGA
```

This corresponds to the amino acid sequence <SEQ ID 622; ORF 152>:

```
m152.pep
    1   MKNKTKVWDL PTRLFHWLLA ASLPFMWYSA KAGGDMLQWH TRVGLFVLFL

51   LVFRLCWGIW GSDTARFSRF VQGWAGIRGY LKNGIPEHIQ PGHNPLGALM

101   VVALLAAVSF QVGTGLFAAD ENTFSTNGYL NHLVSEHTGS LMRKIHLNFF

151   KLLAVFSAIH IAAVAAYRVF KKKNLILPMI TGFKYIEGKT SIRFAGKAAL

201   AAALSVASLA AAILLLS*
```

Computer analysis of this amino acid sequence gave the following results:
Homology with a Predicted ORF from *N. gonorrhoeae*
ORF 152 shows 95.4% identity over a 218 aa overlap with a predicted ORF (ORF 152.ng) from *N. gonorrhoeae*:

```
m152/g152
                  10         20         30         40         50         60
m152.pep  MKNKTKVWDLPTRLFHWLLAASLPFMWYSAKAGGDMLQWHTRVGLFVLFLLVFRLCWGIW
          ||||||||:||||||||||||||||||||||||||||||||:||||||||||||||||
g152      MKNKTKVWDFPTRLFHWLLAASLPFMWYSAKAGGDMLQWHTRVGLLVLFLLVFRLCWGIW
                  10         20         30         40         50         60
                  70         80         90        100        110        120
m152.pep  GSDTARFSRFVQGWAGIRGYLKNGIPEHIQPGHNPLGALMVVALLAAVSFQVGTGLFAAD
          ||||||||||:|||||||||||||||||||||||||||||||||||||||||||||||:
g152      GSDTARFSRFVRGWAGIRGYLKNGIPEHIQPGHNPLGALMVVALLAAVSFQVGTGLFAAN
                  70         80         90        100        110        120
                 130        140        150        160        170        180
m152.pep  ENTFSTNGYLNHLVSEHTGSLMRKIHLNFFKLLAVFSAIHIAAVAAYRVFKKKNLILPMI
          ||||||||||||||||||||:|||||||||||||||:||||||||||:|||||||:|||
g152      ENTFSTNGYLNHLVSEHTGSLIRKIHLNFFKLLAVFSAVHIAAVAAYRIFKKKNLVRPMI
                 130        140        150        160        170        180
                 190        200        210    219
m152.pep  TGFKYIEGKTSIRFAGKAALAAALSVASLAAAAILLLSX
          |||||||||||||||||||||||||:|||||||||||||
g152      TGFKYIEGKTSIRFAGKAALAAALSVAALAAAAILLLSX
                 190        200        210
```

The following partial DNA sequence was identified in *N. meningitidis* <SEQ ID 623>:

```
a152.seq
    1   ATGAAAAACA AAACCAAAGT CTGGGACTTC CCCACCCGCC TTTTCCACTG
   51   GCTGCTTGCC GCATCCCTAC CCTTTATGTG GTATAGCGCG AAAACCGGCG
  101   GCGATATGCT GCAATGGCAC ACGCGCGTCG GGCTGTTTAT CCTTTTCCTG
  151   CTCGTATTCC GCCTCTGCTG GGGCATTTGG GGCAGCGATA CCGCCCGTTT
  201   CTCCCGTTTC GTCCGCGGAT GGTCGGGTAT CAGAGAGTAT ATGAAAAACG
  251   GTATTCCCGA ACACGTCCAA CCCGGACACA ACCCCTTGGG CGCACTGATG
  301   GTCGTTGCGC TTTTGGCCGC CGTGTCGTTC CAAGTCGGCA CAGGGCTTTT
  351   TGCCGCCGAT GTAAACACCT TCAGCACCAA CGGCTACCTC AACCATTTGG
  401   TTTCCGAACA TACGGGCAGC CTTATGCGGA AAATCCATCT CAACTTTTTC
  451   AAACTGCTCG CCGTTTTTTC CGCAGTCCAC ATCGCCGNCG TCGCCGCATA
  501   CCGCGTGTTC AAAAAGAAAA ACCTCGTCCT CCCGATGATA ACCGGCTTCA
  551   AATACATCGA AGGCAAAACC TCAATCCGCT TTGCCGGCAA AGCCGCGCTT
  601   GCCGCCGCAT TATCGGTTGC CGCGCTTGCC GCAGCCGCCA TCCTGCTCCT
  651   GTCCTGA
```

This corresponds to the amino acid sequence <SEQ ID 624; ORF 152.a>:

```
a152.pep
    1   MKNKTKVWDF PTRLFHWLLA ASLPFMWYSA KTGGDMLQWH TRVGLFILFL

51   LVFRLCWGIW GSDTARFSRF VRGWSGIREY MKNGIPEHVQ PGHNPLGALM

101   VVALLAAVSF QVGTGLFAAD VNTFSTNGYL NHLVSEHTGS LMRKIHLNFF

151   KLLAVFSAVH IAXVAAYRVF KKKNLVLPMI TGFKYIEGKT SIRFAGKAAL

201   AAALSVAALA AAILLLS*
``` m152/a152 94.0% identity in 218 aa overlap

```
              10         20         30         40         50         60
m152.pep  MKNKTKVWDLPTRLFHWLLAASLPFMWYSAKAGGDMLQWHTRVGLFVLFLLVFRLCWGIW
          ||||||||||:|||||||||||||||||||:||||||||||||||:||||||||||||||
a152      MKNKTKVWDPPTRLFHWLLAASLPFMWYSAKTGGDMLQWHTRVGLFILFLLVFRLCWGIW
              10         20         30         40         50         60

70         80         90        100        110        120
m152.pep  GSDTARFSRFVQGWAGIRGYLKNGIPEHIQPGHNPLGALMVVALLAAVSFQVGTGLFAAD
          ||||||||||||:||:|||||:||:|||||:|||||||||||||||||||||||||||||
a152      GSDTARFSRFVRGWSGIREYMKNGIPEHVQPGHNPLGALMVVALLAAVSFQVGTGLFAAD
              70         80         90        100        110        120

130        140        150        160        170        180
m152.pep  ENTFSTNGYLNHLVSEHTGSLMRKIHLNFFKLLAVFSAIHIAAVAAYRVFKKKNLILPMI
          :|||||||||||||||||||||||||||||||||||||:|||  |||||||||||:|||
a152      VNTFSTNGYLNHLVSEHTGSLMRKIHLNFFKLLAVFSAVHIAXVAAYRVFKKKNLVLPMI
             130        140        150        160        170        180

190        200        210   219
m152.pep  TGFKYIEGKTSIRFAGKAALAAALSVASLAAAAILLLSX
          |||||||||||:|||||||||||| :|||||||||||||
a152      TGFKYIEGKTGIRFAGKAALAAA1GVAAIAAAAILLLSX
             190        200        210
```

The following partial DNA sequence was identified in *N. gonorrhoeae* <SEQ ID 625>:

```
g153.seq
   1  atggggtttg cttaCAgtat gacgtatatc gaggtCGGGa taccggaggc 51  ggcatccgtc ctttCgctGC CCGAGATgat gcgcctgatG GTGTTtCagg 101  attATGGTTT TtttggcCGAA GTGATGTTTG TGctgaCTTT cGGCGcgcCG 151  GTTCTGTTtc TGCTGCTGTG CCTGTATGTC TATGCCGCGC TGATACGGAA

201  ACAGGCGTAT CCTGCGCTGC GTTTGGCAAC GCGTGTGATG GTGCGCTTGA

251  GGCAGGCGAT GATGGTGGAT GTGTTTTTTG TTTCCACTCT GGTGGCGTAT

301  ATCAAGCTCT CGTCTGTGGC AAAGGTTCGC TTCGGGCCGG CGTTTTATCT

351  GATGTTCGCG CTGTCGGTTA TGCTGATTCG GACTTCGGTA TCGGTTCCCC

401  AGCATTGGGT GTATTTCCAA ATCGGGCGGC TGACGGGGAA TAATGCGGTT

451  CAGACGGCAT CGGAAGGCAA AACCTGTTGC AGCCGCTGCC TGTATTTccg 501  cgacAGTgcc gaatccCCCT GCGGGGTGTg cgGCGcggaA CTgtacggcg 551  gacggccgaa aagtCTGAGt atttCgtCGG CGTTTCTgac ggcggcggTT 601  GTTTTGTATT TCCctgCcaa TATCctgccg attaTGAttt cgtccAATCc 651  tgccgccacg GAGGcCAACA CCATCTTTAG CGGCATCGCT TATATGTGGG 701  ACGagggcgA CAGGCTGATT GCGGCGGTTA TTTTCAGCGC GAGTATTTTG

751  GTGCCGGTGC TGAAGATTGC GGCAATGTCG GTTTTGATTG CGGCGGCACG

801  GTTCGCTTTG CCGGCGGGCG CAAAGAAATT GTCGCACCTC tacCGCATCA

851  CCGAAGCGGT CGGCCGCTGG TCGATGATTG ATATTTTTGT GATTATTATT

901  TTGATGTGTT CGTTCCacaC TTATGCCGCG CGCGTCATTC CGGGCAGTGC

951  GGCAGTCTAT TTCTGCCTGG TCGTGATTTT GACGATGCTG TCCGCCTATT

1001  ATTTCGACCC GCGCCTGCTT TGGGACAAAC GCGCTTCAGA CGGCATTGCT

1051  TTCAACGAAA CGGAAAAATA TGACTGA
```

This corresponds to the amino acid sequence <SEQ ID 626; ORF 153.ng>:

```
g153.pep
    1   MGFAYSMTYI EVGIPEAASV LSLPEMMRLM VFQDYGFLAE VMFVLTFGAP

51   VLFLLLCLYV YAALIRKQAY PALRLATRVM VRLRQAMMVD VFFVSTLVAY

101   IKLSSVAKVR FGPAFYLMFA LSVMLIRTSV SVPQHWVYFQ IGRLTGNNAV

151   QTASEGKTCC SRCLYFRDSA ESPCGVCGAE LYGGRPKSLS ISSAFLTAAV

201   VLYFPANILP IMISSNPAAT EANTIFSGIA YMWDEGDRLI AAVIFSASIL

251   VPVLKIAAMS VLIAAARFAL PAGAKKLSHL YRITEAVGRW SMIDIFVIII

301   LMCSFHTYAA RVIPGSAAVY FCLVVILTML SAYYFDPRLL WDKRASDGIA

351   FNETEKYD*
```
15
The following partial DNA sequence was identified in *N. meningitidis* <SEQ ID 627>:

```
m153.seq
    1   ATGGCGTTTG CTTACGGTAT GACGTATATC GAGGTCGGGA TACCGGGTGC

51   GGCATCCGTC CTTTCGCTGC CCGAGATGAT GCGCCTGATG GTGTTTCAGG

101   ATTATGGTTT TTTGGCCGAA GTGATGTTTG TGCTGACTTT CGGCGCGCCG

151   GTTCTGTTTC TGCTGCTGTG CCTGTATGTC TATGCCGCGC TGATACGGAA

201   ACAGGCGTAT CCTGCGCTGC GTTTGGCAAC GCGTGTGATG GTGCGCTTGA

251   GACAGGCGAT GATGGTGGAT GTGTTTTTTG TTTCCACTTT GGTGGCGTAT

301   ATCAAGCTCT CGTCTGTGGC AGAGGTTCGC TTCGGGCCGG CGTTTTATCT

351   GATGTTCGCG CTGTCAGTTA TGCTGATTCG GACTTCGGTA TCGGTTCCCC

401   AGCATTGGGT GTATTTTCAA ATCGGGCGGC TGACGGGGGA TAATGCGGTT

451   CAGACGGCAT CGGAAGGTAA AACCTGTTGC AGCCGCTGCC TGTATTTCCG

501   CGACAGTGCC GAATCCCCCT GCGGCGTGTG CGGTGCGGAA CTGTACCGCC

551   GACGGCCGAA AAGTCTGAGT ATTTCGTCGG CGTTTCTGAC GGCGGCGGTT

601   ATTTTGTATT TCCCTGCCAA TATCCTGCCG ATTATGATTT CGTCCAATCC

651   TGCCGCCACG GAGGTCAATA CCATCCTTAA CGGCATCGCT TATATGTGGG

701   ACGAGGGCGA CAGGCTGATT GCGGCGGTTA TTTTCAGCGC GAGTATTTTG

751   GTGCCGGTAC TGAAGATTGC GGCAATGTCG GTTTTGATTG CGTCCGCCCG

801   CTTCGCTTTG CCAACGGGTG CAAAGAAATT GTCGCACCTC TACCGCATCA

851   CCGAAGCGGT CGGCCGCTGG TCGATGATTG ATATTTTTGT GATTATTATT

901   TTGATGTGTT CGTTCCACAC TTATGCCGCG CGCGTCATTC CGGGCAGTGC

951   GGCAGTCTAT TTCTGCCTGG TCGTGATTCT GACGATGCTG TCCGCCTATT

1001   ATTTCGACCC GCGCCTGCTT TGGGACAAAC GCGCTTCAGA CGGCATTGCT

1051   TTCAATGAAA CGGAAAAACA TGACTGA
```

This corresponds to the amino acid sequence <SEQ ID 628; ORF 153>:

```
m153.pep
    1   MAFAYGMTYI EVGIPGAASV LSLPEMMRLM VFQDYGFLAE VMFVLTFGAP

51   VLFLLLCLYV YAALIRKQAY PALRLATRVM VRLRQAMMVD VFFVSTLVAY

101   IKLSSVAEVR FGPAFYLMFA LSVMLIRTSV SVPQHWVYFQ IGRLTGDNAV

151   QTASEGKTCC SRCLYFRDSA ESPCGVCGAE LYRRRPKSLS ISSAFLTAAV
```

-continued

```
201    ILYFPANILP IMISSNPAAT EVNTILNGIA YMWDEGDRLI AAVIFSASIL

251    VPVLKIAAMS VLIASARFAL PTGAKKLSHL YRITEAVGRW SMIDIFVIII

301    LMCSFHTYAA RVIPGSAAVY FCLVVILTML SAYYFDPRLL WDKRASDGIA

351    FNETEKHD*
``` m153/g153 96.1% identity in 358 aa overlap

```
                  10         20         30         40         50         60
m153.pep  MAFAYGMTYIEVGIPGAASVLSLPEMMRLMVFQDYGFLAEVMFVLTFGAPVLFLLLCLYV
          |:|||:||||||||| ||||||||||||||||||||||||||||||||||||||||||||
g153      MGFAYSMTYIEVGIPEAASVLSLPEMMRLMVFQDYGFLAEVMFVLTFGAPVLFLLLCLYV
                  10         20         30         40         50         60

70         80         90        100        110        120
m153.pep  YAALIRKQAYPALRLATRVMVRLRQAMMVDVFFVSTLVAYIKLSSVAEVRFGPAFYLMFA
          ||||||||||||||||||||||||||||||||||||||||||||||:|||||||||||||
g153      YAALIRKQAYPALRLATRVMVRLRQAMMVDVFFVSTLVAYIKLSSVAKVRFGPAFYLMFA
                  70         80         90        100        110        120

130        140        150        160        170        180
m153.pep  LSVMLIRTSVSVPQHWVYFQIGRLTGDNAVQTASEGKTCCSRCLYFRDSAESPCGVCGAE
          ||||||||||||||||||||||||||||:|||||||||||||||||||||||||||||||
g153      LSVMLIRTSVSVPQHWVYFQIGRLTGNNAVQTASEGKTCCSRCLYFRDSAESPCGVCGAE
                 130        140        150        160        170        180

190        200        210        220        230        240
m153.pep  LYRRRPKSLSISSAFLTAAVILYFPANILPIMISSNPAATEVNTILNGIAYMWDEGDRLI
          || |||||||||||||||||:||||||||||||||||||||| ||::|||||||||||||
g153      LYGGRPKSLSISSAFLTAAVVLYFPANILPIMISSNPAATEANTIFSGIAYMWDEGDRLI
                 190        200        210        220        230        240

250        260        270        280        290        300
m153.pep  AAVIFSASILVPVLKIAAMSVLIASARFALPTGAKKLSHLYRITEAVGRWSMIDIFVIII
          ||||||||||||||||||||||||:|||||| ||||||||||||||||||||||||||||
g153      AAVIFSASILVPVLKIAAMSVLIAAARFALPAGAKKLSHLYRITEAVGRWSMIDIFVIII
                 250        260        270        280        290        300

310        320        330        340        350      359
m153.pep  LMCSFHTYAARVIPGSAAVYFCLVVILTMLSAYYFDPRLLWDKRASDGIAFNETEKHDX
          |||||||||||||||||||||||||||||||||||||||||||||||||||||||:||
g153      LMCSFHTYAARVIPGSAAVYFCLVVILTMLSAYYFDPRLLWDKRASDGIAFNETEKYDX
                 310        320        330        340        350
```

The following partial DNA sequence was identified in *N. meningitidis* <SEQ ID 629>:

```
a153.seq
     1  ATGGCGTTTG CTTACGGTAT GACGTATATC GAGGTCGGGA TACCGGGTGC

51  GGCATCCGTC CTTTCGCTGC CCGAGATGAT GCGCCTGATG GTGTTTCAGG

101  ATTATGGTTT TTTGGCCGAA GTGATGTTTG TGCTGACCTT CGGCGCGCCG

151  GTTCTGTTTC TGCTGCTGTG CCTGTATGTC TATGCCGCGC TGATACGGAA

201  ACAGGCGTAT CCTGCGCTGC GTTTGGCAAC GCGTGTGATG GTGCGCTTGA

251  GACAGGCGAT GATGGTGGAT GTGTTTTTTG TTTCCACTTT GGTGGCGTAT

301  ATCAAGCTCT CGTCTGTGGC AGAGGTTCGC TTCGGATCGG CGTTTTATCT

351  GATGTTCGCG CTGTCGGTTA TGCTGATTCG GACTTCGGTA TCGGTTCCCC

401  AGCATTGGGT GTATTTTCAA ATCGGGCGGC TGACGGGGGA TAATGCGGTT

451  CAGACGGCAT CGGAAGGTAA AACCTGTTGC AGCCGCTGCC TGTATTTCCG

501  CGACAGTGCC GAATCCCCCT GCGGCGTGTG CGGTGCGGAA CTGTACCGCC

551  GACGGCCGAA AAGTCTGAGT ATTTCGTCGG CGTTTCTGAC GGCGGCGGTT

601  ATTTTGTATT TCCCTGCCAA TATCCTGCCG ATTATGATTT CGTCCAATCC

651  TGCCGCCACG GAGGTCAATA CCATCCTTAA CGGCATCGCT TATATGTGGG

701  ACGAGGGCGA CAGGCTGATT GCGGCGGTTA TTTTCAGCGC GAGTATTTTG
```

-continued

```
 751  GTGCCGGTAC TGAAGATTGC GGCAATGTCG GTTTTGATTG CGTCCGCCCG

801  CTTCGCTTTG CCAACGGGTG CAAAGAAATT GTCGCACCTC TACCGCATCA

851  CCGAAGCGGT CGGCCGCTGG TCGATGATTG ATATTTTTGT GATTATTATT

901  TTGATGTGTT CGTTCCACAC TTATGCCGCG CGCGTCATTC CGGGCAGTGC

951  GGCAGTCTAT TTCTGCCTGG TCGTGATTCT GACGATGCTG TCCGCCTATT

1001  ATTTCGACCC GCGCCTGCTT TGGGACAAAC GCGCTTCAGA CGGCATTGCT

1051  TTCAATGAAA CGGAAAAACA TGACTGA
```

This corresponds to the amino acid sequence <SEQ ID 630; ORF 153.a>:

```
a153.pep
   1  MAFAYGMTYI EVGIPGAASV LSLPEMMRLM VFQDYGFLAE VMFVLTFGAP

51  VLFLLLCLYV YAALIRKQAY PALRLATRVM VRLRQAMMVD VFFVSTLVAY

101  IKLSSVAEVR FGSAFYLMFA LSVMLIRTSV SVPQHWVYFQ IGRLTGDNAV

151  QTASEGKTCC SRCLYFRDSA ESPCGVCGAE LYRRRPKSLS ISSAFLTAAV

201  ILYFPANILP IMISSNPAAT EVNTILNGIA YMWDEGDRLI AAVIFSASIL

251  VPVLKIAAMS VLIASARFAL PTGAKKLSHL YRITEAVGRW SMIDIFVIII

301  LMCSFHTYAA RVIPGSAAVY FCLVVILTML SAYYFDPRLL WDKRASDGIA

351  FNETEKHD*
``` m153/a153 99.7% identity in 358 aa overlap

```
                  10         20         30         40         50         60
   m153.pep  MAFAYGMTYIEVGIPGAASVLSLPSMMRLMVFQDYGFLAEVMFVLTFGAPVLFLLLCLYV
              ||||||||||||||||||||||||||||||||||||||||||||||||||||||||||||
       a153  MAFAYGMTYIEVGIPGAASVISLPSMMRLMVFQDYGFLAEVMFVLTFGAPVLFLLLCLYV
                  10         20         30         40         50         60

70         80         90        100        110        120
   m153.pep  YAALIRKQAYPALRLATRVMVRLRQAMMVDVFFVSTLVAYIKLSSVAEVRFGPAFYLMFA
              |||||||||||||||||||||||||||||||||||||||||||||||||||| ||||||
       a153  YAALIRKQAYPALRLATRVMVRLRQAMMVDVFFVSTLVAYIKLSSVAEVRFGSAFYLMFA
                  70         80         90        100        110        120

130        140        150        160        170        180
   m153.pep  LSVMLIRTSVSVPQHWVYFQIGRLTGDNAVQTASEGKTCCSRCLYFRDSAESPCGVCGAE
              ||||||||||||||||||||||||||||||||||||||||||||||||||||||||||||
       a153  LSVMLIRTSVSVPQHWVYFQIGRLTGDNAVQTASEGKTCCSRCLYFRDSAESPCGVCGAE
                 130        140        150        160        170        180

190        200        210        220        230        240
   m153.pep  LYRRRPKSLSISSAFLTAAVILYFPANILPIMISSNPAATEVNTILNGIAYMWDEGDRLI
              ||||||||||||||||||||||||||||||||||||||||||||||||||||||||||||
       a153  LYRRRPKSLSISSAFLTAAVILYFPANILPIMISSNPAATEVNTILNGIAYMWDEGDRLI
                 190        200        210        220        230        240

250        260        270        280        290        300
   m153.pep  AAVIFSASILVPVLKIAAMSVLIASARFALPTGAKKLSHLYRITEAVGRWSMIDIFVIII
              ||||||||||||||||||||||||||||||||||||||||||||||||||||||||||||
       a153  AAVIFSASILVPVLKIAAMSVLIASARFALPTGAKKLSHLYRITEAVGRWSMIDIFVIII
                 250        260        270        280        290        300

310        320        330        340        350      359
   m153.pep  LMCSFHTYAARVIPG3AAVYFCLVVILTMLSAYYFDPRLLWDKRASDGIAFNETEKHDX
              |||||||||||||||  ||||||||||||||||||||||||||||||||||||||||||
       a153  LMCSFHTYAARVIPGSAAVYFCLVVILTMLSAYYFDPRLLWDKRASDGIAFNETEKHDX
                 310        320        330        340        350
```

The following partial DNA sequence was identified in *N. gonorrhoeae* <SEQ ID 631>:

g154.seq
```
   1 ATGACTGACA ACAGCCCTCC TCCAAACGGA CACGCTCAAG CACGCGTCCG
  51 CAAAAACAAC accttcctCT CCGCCGTCTG GCTGGTCCCG CTGATCGCGC
 101 TGATTGCCGG CGGCTGGCTT TGGGTTAAGG AAATCCGCAA CAGGGGGCCT
 151 GTGGTTACGC TCTTGATGGA CAGCGCGGAA GGCATCGAAG TCAACAATAC
 201 GGTCATTAAG GTATTGAGCA TCGATGTCGG ACGCGTTACC CGAATCAAAC
 251 TGCGCGACGA CCAAAAAGGC GTGGAAGTTA CTGCCCAACT CAATGCGGAC
 301 GTATCCGGCC TCATCCGCAG CGATACCCAG TTTTGGGTGG TCAAGCCGCG
 351 TATCGACCAA AGCGGcgtAA CCGGTTTGGG TACGCTGCTT TCGGGTTCGT
 401 ACATCGCTTT TACACCCGGC AAAAGCGGCG AGGCAAAAGA CGTGTTCCAA
 451 GTGCAGGACA TTCCGCCCGT TACCGCCATC GGGCAAAgcg GGCTGCGCTT
 501 GAATTTGATT GGTAAAAACG AccgCATCCT CAACGTcaaC AGCCCTGTTT
 551 TGTATGAAAA CTTTATGGTC GGGCAAATCG AAAGCGCGCA TTTCGAcccG
 601 TCCGACCAAA GCGTGCATTA CACCATCTTC ATCCAAAGCC CAACGACAA
 651 ACTGATTCAT TCCGCCAGCC GTTTTTGGCT GGAAAGCGGC ATCAATATCG
 701 AAACCACAGG CAGCGGCATC AAACTCAATT CCGCCCCTCT GCCTGCCCTG
 751 CTGTCAGGCG CGATTTCATT TGATTCGCCG AAAACCAAAA ACAGTAAAAA
 801 CGTCAAAAGC GAGGACAGCT TCACGCTTTA CGACAGCCGC AGCGAAATCG
 851 CCAACCTGCC TGACGACCGC TCGCTGTACT ACACCGCGTT TTTCAAACAA
 901 TCCGTGCGCG GACTGACCGT cggTTCGCCT GTcgaATACA AAGGGCtgaA
 951 TGTcggCATG GTTTCCGATG TCCCTTATTT TGACCGCAAt gacagCCTGC
1001 ACCtgtTTGA aaacggctgg aTTcccGtac gCATCCGCAT cgagccTTCC
1051 CGTTTGGAAA TCAATGCCGA CGAGCAAAGC AAAGAGCATT GGAAACAACA
1101 ATTCCAGACG GCCTTAAACA AAGGCCTGAC CGCCACCATC TCCAGCAACA
1151 ACCTGCTGAC CGGCGGCAAA ATGATTGAGT TGAACGATCA GCCTTCCGCC
1201 TCGCCCAAGC TGCGACCGCA TACCGTTTAT GCAGGCGATA CCGTCATCGC
1251 CACACGGGGC GGCGGTTTGG ATGACTTGCA GGTCAAATTG GCGGATTTGC
1301 TGGACAaaatT CAACAATCTG CCATTggata aAACCGTTGC CGAATTGAAC
1351 GGCTCGCTCG CCGAACTCAA GTCCGCACTC AAATCCGCCA ATGCCGCCCT
1401 AAGCTCCATT GacaAACTGG TCGgcaaTCC GCAGACGCAA AACATCCCGA
1451 ACGAACTGAA CCAAACTCTG AAAGAGTTGC GCATAACCCT GCAAGGCGTA
1501 TCGcctCAAT CGCCTATCTa cgGAgacgta caAAAATAcgc tgCaAAGTTT
1551 GGACAAAACC TTAAAagacg TtcaACCCGT CATTAACACT TTGAaAGAAa
1601 aacCCaaCgc actGATTTtc aacaACAGCA GCAAAGAccc tATCCCGAAA
1651 GGAAGCCGAT AA
```

This corresponds to the amino acid sequence <SEQ ID 632; ORF 154.ng>:

g154.pep
```
   1 MTDNSPPPNG HAQARVRKNN TFLSAVWLVP LIALIAGGWL WVKEIRNRGP
  51 VVTLLMDSAE GIEVNNTVIK VLSIDVGRVT RIKLRDDQKG VEVTAQLNAD
 101 VSGLIRSDTQ FWVVKPRIDQ SGVTGLGTLL SGSYIAFTPG KSGEAKDVFQ
```

```
-continued
151  VQDIPPVTAI GQSGLRLNLI GKNDRILNVN SPVLYENFMV GQIESAHFDP

201  SDQSVHYTIF IQSPNDKLIH SASRFWLESG INIETTGSGI KLNSAPLPAL

251  LSGAISFDSP KTKNSKNVKS EDSFTLYDSR SEIANLPDDR SLYYTAFFKQ

301  SVRGLTVGSP VEYKGLNVGM VSDVPYFDRN DSLHLFENGW IPVRIRIEPS

351  RLEINADEQS KEHWKQQFQT ALNKGLTATI SSNNLLTGGK MIELNDQPSA

401  SPKLRPHTVY AGDTVIATRG GGLDDLQVKL ADLLDKFNNL PLDKTVAELN

451  GSLAELKSAL KSANAALSSI DKLVGNPQTQ NIPNELNQTL KELRITLQGV

501  SPQSPIYGDV QNTLQSLDKT LKDVQPVINT LKEKPNALIF NNSSKDPIPK

551  GSR*
```

The following partial DNA sequence was identified in *N. meningitidis* <SEQ ID 633>:

```
m154.seq
    1  ATGACTGACA ACAGCCCTCC TCCAAACGGA CACGCCCAAG CACGCGTCCG
   51  CAAAAACAAC ACCTTCCTCT CTGCCGTCTG GCTGGTTCCG CTGATCGCGC
  101  TGATTGCCGG CGGCTGGCTT TGGGTTAAGG AAATCCGCAA CAGGGGGCCT
  151  GTGGTTACGC TCTTGATGGA CAGCGCGGAA GGCATTGAGG TCAACAATAC
  201  GGTCATCAAA GTATTGAGCA TCGATGTCGG ACGCGTTACC CGAATCAAAC
  251  TGCGCGACGA CCAAAAAGGC GTGGAAGTAA CCGCCCAACT CAATGCGGAC
  301  GTATCCGGCC TCATCCGCAG CGATACCCAG TTTTGGGTGG TCAAGCCGCG
  351  TATCGACCAA AGCGGCGTAA CCGGTTTGGG TACGCTGCTT TCGGGTTCGT
  401  ACATCGCCTT TACACCCGGC AAAAGCGACG AGGCAAAAGA CGTGTTCCAA
  451  GTGCAGGACA TTCCGCCCGT TACCGCCATC GGGCAAAGCG GCTGCGCTT
  501  GAATTTGATT GGTAAAAACG ACCGCATCCT CAACGTCAAC AGCCCTGTTT
  551  TGTATGAAAA TTTTATGGTC GGGCAAGTCG AAAGCGCGCA TTTCGACCCG
  601  TCCGACCAAA GCGTGCATTA CACCATCTTC ATCCAAAGCC CCAACGACAA
  651  ACTGATTCAT TCCGCCAGCC GTTTTTGGCT GGAAAGCGGC ATCAATATCG
  701  AAACCACAGG CAGCGGCATC AAACTCAATT CCGCCCCTCT GCCTGCCCTG
  751  CTGTCGGGCG CGATTTCATT TGATTCGCCG AAAACCAAAA ACAGTAAAAA
  801  CGTCAAAAGC GAAGACAGCT TCACGCTTTA CGACAGCCGC AGCGAAGTCG
  851  CCAACCTGCC TGACGACCGC TCGCTGTACT ACACCGCGTT TTTCAAACAA
  901  TCCGTGCGCG GCCTGACCGT CGGTTCGCCC GTCGAGTACA AAGGGCTGAA
  951  TGTCGGCGTG GTTTCCGACG TTCCTTATTT CGACCGCAAC GACAGCCTGC
 1001  ACCTGTTTGA AAACGGCTGG ATACCCGTAC GCATCCGCAT TGAACCTTCC
 1051  CGTTTGGAAA TCAATGCCGA CGAACAAAGC AAAGAACATT GGAAACAACA
 1101  ATTTCAGACG GCCTTAAACA AAGGCCTGAC CGCCACCATC TCCAGCAACA
 1151  ACCTGCTGAC CGGAAGCAAA ATGATTGAGT TGAACGATCA GCCTTCCGCA
 1201  TCACCTAAGC TGCGACCGCA TACCGTTTAT GCAGGCGATA CCGTTATCGC
 1251  GACCCAGGGC GGCGGTTTGG ACGATTTGCA GGTCAAATTG GCGGATTTGC
 1301  TGGACAAGTT CGACAAACTG CCTTTAGATA AGACGGTTGC CGAATTGAAC
 1351  GGTTCGCTTG CCGAGCTCAA ATCCACACTC AAATCTGCCA ATGCCGCCCT
```

-continued

```
1401  AAGCTCCATC GACAAACTGG TCGGCAAACC GCAGACACAA AACATTCCGA

1451  ACGAACTGAA CCAAACCCTG AAAGAGTTGC GCACAACCCT GCAAGGCGTA

1501  TCGCCGCAAT CGCCTATCTA CGGCGACGTA CAAAATACGC TGCAAAGTTT

1551  GGACAAAACT TTAAAAGACG TTCAACCCGT GATTAATACT TTGAAAGAAA

1601  AACCCAACGC GCTGATTTTC AACAGCAGCA GCAAAGACCC TATCCCGAAA

1651  GGAAGCCGAT AA
```

This corresponds to the amino acid sequence <SEQ ID 634
ORF 154.a>:

```
m154.pep
  1   MTDNSPPPNG HAQARVRKNN TFLSAVWLVP LIALIAGGWL WVKEIRNRGP

51   VVTLLMDSAE GIEVNNTVIK VLSIDVGRVT RIKLRDDQKG VEVTAQLNAD

101   VSGLIRSDTQ FWVVKPRIDQ SGVTGLGTLL SGSYIAFTPG KSDEAKDVFQ

151   VQDIPPVTAI GQSGLRLNLI GKNDRILNVN SPVLYENFMV GQVESAHFDP

201   SDQSVHYTIF IQSPNDKLIH SASRFWLESG INIETTGSGI KLNSAPLPAL

251   LSGAISFDSP KTKNSKNVKS EDSFTLYDSR SEVANLPDDR SLYYTAFFKQ

301   SVRGLTVGSP VEYKGLNVGV VSDVPYFDRN DSLHLFENGW IPVRIRIEPS

351   RLEINADEQS KEHWKQQFQT ALNKGLTATI SSNNLLTGSK MIELNDQPSA

401   SPKLRPHTVY AGDTVIATQG GGLDDLQVKL ADLLDKFDKL PLDKTVAELN

451   GSLAELKSTL KSANAALSSI DKLVGKPQTQ NIPNELNQTL KELRTTLQGV

501   SPQSPIYGDV QNTLQSLDKT LKDVQPVINT LKEKPNALIF NSSSKDPIPK

551   GSR*
``` m154/g154 97.8% identity in 553 aa overlap

```
                 10         20         30         40         50         60
m154.pep  MTDNSPPPNGHAQARVRKNNTFLSAVWLVPLIALIAGGWLWVKEIEWRGPVVTLLMDSAE
          ||||||||||||||||||||||||||||||||||||||||||||| ||||||||||||||
g154      MTDNSPPPNGHAQARVRKNNTFLSAVWLVPLIALIAGGWLWVKEIRNRGPVVTLLMDSAE
                 10         20         30         40         50         60

70         80         90        100        110        120
m154.pep  GIEVNNTVIKVLSIDVGRVTRIKLRDDQKGVEVTAQLNADVSGLIRSDTQFWVVKPRIDQ
          ||||||||||||||||||||||||||||||||||||||||||||||||||||||||||||
g154      GIEVNNTVIKVLSIDVGRVTRIKLRDDQKGVEVTAQLNADVSGLIRSDTQFWVVKPRIDQ
                 70         80         90        100        110        120

130        140        150        160        170        180
m154.pep  SGVTGLGTLLSGSYIAFTPGKSDEAKDVFQVQDIPPVTAIGQSGLRLNLIGKNDRILNVN
          |||||||||||||||||||||||:||||||||||||||||||||||||||||||||||||
g154      SGVTGLGTLLSGSYIAFTPGKSGEAKDVFQVQDIPPVTAIGQSGLRLNLIGKNDRILNVN
                130        140        150        160        170        180

190        200        210        220        230        240
m154.pep  SPVLYENFMVGQVESAHFDPSDQSVHYTIFIQSPNDKLIHSASRFWLESGINIETTGSGI
          |||||||||||||:||||||||||||||||||||||||||||||||||||||||||||||
g154      SPVLYENFMVGQIESAHFDPSDQSVHYTIFIQSPNDKLIHSASRFWLESGINIETTGSGI
                190        200        210        220        230        240

250        260        270        280        290        300
m154.pep  KLNSAPLPALLSGAISFDSPKTKNSKNVKSEDSFTLYDSRSEVANLPDDRSLYYTAFFKQ
          ||||||||||||||||||||||||||||||||||||||||||:|||||||||||||||||
g154      KLNSAPLPALLSGAISFDSPKTKNSKNVKSEDSFTLYDSRSEIANLPDDRSLYYTAFFKQ
                250        260        270        280        290        300

310        320        330        340        350        360
m154.pep  SVRGLTVGSPVEYKGLNVGVVSDVPYFDRNDSLHLFENGWIPVRIRIEPSRLEINADEQS
          ||||||||||||||||||||:|||||||||||||||||||||||||||||||||||||||
g154      SVRGLTVGSPVEYKGLNVGMVSDVPYFDRNDSLHLFENGWIPVRIRIEPSRLEINADEQS
                310        320        330        340        350        360
```

-continued

```
                  370        380        390        400        410        420
m154.pep   KEHWKQQFQTALNKGLTATISSNNLLTGSKMIELNDQPSASPKLRPHTVYAGDTVIATQG
           ||||||||||||||||||||||||||||:|||||||||||||||||||||||||||||:|
g154       KEHWKQQFQTALNKGLTATISSNNLLTGGKMIELNDQPSASPKLRPHTVYAGDTVIATRG
                  370        380        390        400        410        420

430        440        450        460        470        480
m154.pep   GGLDDLQVKLADLLDKFDKLPLDKTVAELNGSLAELKSTLKSANAALSSIDKLVGKPQTQ
           |||||||||||||||||::|||||||||||||||||||:||||||||||||||||:||||
g154       GGLDDLQVKLADLLDKFNNLPLDKTVAELNGSLAELKSALKSANAALSSIDKLVGNPQTQ
                  430        440        450        460        470        480

490        500        510        520        530        540
m154.pep   NIPNELNQTLKELRTTLQGVSPQSPIYGDVQNTLQSLDKTLKDVQPVINTLKEKPNALIF
           |||||||||||||| |||||||||||||||||||||||||||||||||||||||||||||
g154       NIPNELNQTLKELRITLQGVSPQSPIYGDVQNTLQSLDKTLKDVQPVINTLKEKPNALIF
                  490        500        510        520        530        540

550
m154.pep   NSSSKDPIPKGSRX
           |:||||||||||||
g154       NNSSKDPIPKGSRX
                  550
```

The following partial DNA sequence was identified in *N. meningitidis* <SEQ ID 635>:

```
a154.seq
     1  ATGACTGACA ACAGCCCTCC TCCAAACGGA CACGCCCAAG CACGCGTCCG

51  CAAAAACAAC ACCTTCCTCT CTGCCGTCTG GCTGGTTCCG CTGATCGCGC

101  TGATTGCCGG CGGCTGGCTT TGGGTTAAGG AAATCCGCAA CAGGGGGCCT

151  GTGGTTACGC TCTTGATGGA CAGCGCGGAA GGCATTGAGG TCAACAATAC

201  GGTCATCAAA GTATTGAGCA TCGATGTCGG ACGCGTTACC CGAATCAAAC

251  TGCGCGACGA CCAAAAAGGC GTGGAAGTAA CCGCCCAACT CAATGCGGAC

301  GTATCCGGCC TCATCCGCAG CGATACCCAG TTTTGGGTGG TCAAGCCGCG

351  TATCGACCAA AGCGGCGTAA CCGGTTTGGG TACGCTGCTT TCGGGTTCGT

401  ACATCGCCTT TACACCCGGC AAAAGCGACG AGGCAAAAGA CGTGTTCCAA

451  GTGCAGGACA TTCCGCCCGT TACCGCCATC GGGCAAAGCG GGCTGCGCTT

501  GAATTTGATT GGTAAAAACG ACCGCATCCT CAACGTCAAC AGCCCTGTTT

551  TGTATGAAAA CTTTATGGTC GGGCAAGTCG AAAGCGCGCA TTTCGACCCG

601  TCCGACCAAA GCGTGCATTA CACCATCTTC ATCCAAAGCC CCAACGACAA

651  ACTGATTCAT TCCGCCAGCC GTTTCTGGCT GGAAAGCGGC ATCAATATCG

701  AAACCACAGG CAGCGGCATC AAACTCAATT CCGCCCCTCT GCCTGCCCTG

751  CTGTCGGGCG CGATTTCATT TGATTCGCCG AAAACCAAAA ACAGTAAAAA

801  CGTCAAAAGC GAAGACAGCT TCACGCTTTA CGACAGCCGC AGCGAAGTCG

851  CCAACCTGCC TGATGACCGT TCGCTGTACT ACACCGCGTT TTTCAAACAA

901  TCCGTGCGCG GACTGACCGT CGGTTCGCCT GTCGAGTACA AAGGGCTGAA

951  TGTCGGCGTG GTTTCCGATG TTCCTTATTT CGACCGCAAC GACAGCCTGC

1001  ACCTGTTTGA AAACGGCTGG ATTCCCGTAC GCATCCGTAT TGAGCCTTCC

1051  CGTTTGGAAA TCAATGCCGA CGAACAAAGC AAAGAACATT GGAAACAACA

1101  ATTTCAGACG GCCTTAAACA AAGGCCTGAC CGCCACCATC TCCAGCAACA

1151  ACCTGCTGAC CGGCAGCAAA ATGATTGAGT TGAACGATCA GCCTTCCGCC

1201  TCGCCCAAGC TGCGACCGCA TACCGTTTAT GCAGGCGATA CCGTTATCGC

1251  GACCCAGGGC GGCGGTTTGG ACGATTTGCA GGTCAAATTG GCGGATTTGC
```

```
-continued
1301  TGGACAAGTT CGACAAACTG CCTTTAGATA AGACGGTTGC CGAATTGAAC

1351  GGTTCGCTTG CCGAGCTCAA ATCCACACTC AAATCTGCCA ATGCCGCCCT

1401  AAGCTCCATC GACAAACTGG TCGGCAAACC GCAGACACAA AACATTCCGA

1451  ACGAACTGAA CCAAACCCTG AAAGAGTTGC GCACAACCCT GCAAGGCGTA

1501  TCGCCTCAAT CGCCTATCTA CGGCGACGTA CAAAATACGC TGCAAAGTTT

1551  GGACAAAACC TTAAAAGACG TTCAACCCGT CATTAACACT TTGAAAGAAA

1601  AACCCAACGC GCTGATTTTC AACAGCAGCA GCAAAGACCC TATCCCGAAA

1651  GGAAGCCGAT AA
```

This corresponds to the amino acid sequence <SEQ ID 636; ORF 154.a>:

```
a154.pep
    1  MTDNSPPPNG HAQARVRKNN TFLSAVWLVP LIALIAGGWL WVKEIRNRGP

51  VVTLLMDSAE GIEVNNTVIK VLSIDVGRVT RIKLRDDQKG VEVTAQLNAD

101  VSGLIRSDTQ FWVVKPRIDQ SGVTGLGTLL SGSYIAFTPG KSDEAKDVFQ

151  VQDIPPVTAI GQSGLRLNLI GKNDRILNVN SPVLYENFMV GQVESAHFDP

201  SDQSVHYTIF IQSPNDKLIH SASRFWLESG INIETTGSGI KLNSAPLPAL

251  LSGAISFDSP KTKNSKNVKS EDSFTLYDSR SEVANLPDDR SLYYTAFFKQ

301  SVRGLTVGSP VEYKGLNVGV VSDVPYFDRN DSLHLFENGW IPVRIRIEPS

351  RLEINADEQS KEHWKQQFQT ALNKGLTATI SSNNLLTGSK MIELNDQPSA

401  SPKLRPHTVY AGDTVIATQG GGLDDLQVKL ADLLDKFDKL PLDKTVAELN

451  GSLAELKSTL KSANAALSSI DKLVGKPQTQ NIPNELNQTL KELRTTLQGV

501  SPQSPIYGDV QNTLQSLDKT LKDVQPVINT LKEKPNALIF NSSSKDPIPK

551  GSR*
``` m154/a154 100.0% identity in 553 an overlap

```
                  10         20         30         40         50         60
  m154.pep  MTDNSPPPNGHAQARVRKNNTFLSAVWLVPLIALIAGGWLWVKEIEWRGPVVTLLMDSAE
            ||||||||||||||||||||||||||||||||||||||||||||||  ||||||||||||
       a154 MTDNSPPPNGHAQARVRKNNTFLSAVWLVPLIALIAGGWLWVKEIRNRGPVVTLLMDSAE
                  10         20         30         40         50         60

70         80         90        100        110        120
  m154.pep  GIEVNNTVIKVLSIDVGRVTRIKLRDDQKGVEVTAQLNADVSGLIRSDTQFWVVKPRIDQ
            ||||||||||||||||||||||||||||||||||||||||||||||||||||||||||||
       a154 GIEVNNTVIKVLSIDVGRVTRIKLRDDQKGVEVTAQLNADVSGLIRSDTQFWVVKPRIDQ
                  70         80         90        100        110        120

130        140        150        160        170        180
  m154.pep  SGVTGLGTLLSGSYIAFTPGKSDEAKDVFQVQDIPPVTAIGQSGLRLNLIGKNDRILNVN
            |||||||||||||||||||||| |||||||||||||||||||||||||||||||||||||
       a154 SGVTGLGTLLSGSYIAFTPGKSGEAKDVFQVQDIPPVTAIGQSGLRLNLIGKNDRILNVN
                 130        140        150        160        170        180

190        200        210        220        230        240
  m154.pep  SPVLYENFMVGQVESAHFDPSDQSVHYTIFIQSPNDKLIHSASRFWLESGINIETTGSGI
            ||||||||||||||||||||||||||||||||||||||||||||||||||||||||||||
       a154 SPVLYENFMVGQVESAHFDPSDQSVHYTIFIQSPNDKLIHSASRFWLESGINIETTGSGI
                 190        200        210        220        230        240

250        260        270        280        290        300
  m154.pep  KLNSAPLPALLSGAISFDSPKTKNSKNVKSEDSFTLYDSRSEVANLPDDRSLYYTAFFKQ
            ||||||||||||||||||||||||||||||||||||||||||||||||||||||||||||
       a154 KLNSAPLPALLSGAISFDSPKTKNSKNVKSEDSFTLYDSRSEVANLPDDRSLYYTAFFKQ
                 250        260        270        280        290        300

310        320        330        340        350        360
  m154.pep  SVRGLTVGSPVEYKGLNVGVVSDVPYFDRNDSLHLFENGWIPVRIRIEPSRLEINADEQS
            ||||||||||||||||||||||||||||||||||||||||||||||||||||||||||||
       a154 SVRGLTVGSPVEYKGLNVGVVSDVPYFDRNDSLHLFENGWIPVRIRIEPSRLEINADEQS
                 310        320        330        340        350        360
```

-continued

```
                  370        380        390        400        410        420
m154.pep  KEHWKQQFQTALNKGLTATISSNNLLTGSKMIELNDQPSASPKLRPHTVYAGDTVIATQG
          ||||||||||||||||||||||||||||||||||||||||||||||||||||||||||||
a154      KEHWKQQFQTALNKGLTATISSNNLLTGSKMIELNDQPSASPKLRPHTVYAGDTVIATQG
                  370        380        390        400        410        420

430        440        450        460        470        480
m154.pep  GGLDDLQVKLADLLDKFDKLPLDKTVAELNGSLAELKSTLKSANAALSSIDKLVGKPQTQ
          ||||||||||||||||||||||||||||||||||||||||||||||||||||||||||||
a154      GGLDDLQVKLADLLDKFDKLPLDKTVAELNGSLAELKSTLKSANAALSSIDKLVGKPQTQ
                  430        440        450        460        470        480

490        500        510        520        530        540
m154.pep  NIPNELNQTLKELRTTLQGVSPQSPIYGDVQNTLQSLDKTLKDVQPVINTLKEKPNALIF
          ||||||||||||||| ||||||||||||||||||||||||||||||||||||||||||||
a154      NIPNELNQTLKELRITLQGVSPQSPIYGDVQNTLQSLDKTLKDVQPVINTLKEKPNALIF
                  490        500        510        520        530        540

550
m154.pep  NSSSKDPIPKGSRX
          ||||||||||||||
a154      NSSSKDPIPKGSRX
                  550
```

The following partial DNA sequence was identified in *N. gonorrhoeae* <SEQ ID 637>:

```
g155.seq
    1   atGAAaatcg GtatcCCACG CGAGTCAtta tcCGGCGAAA cccgcgtagc 51   ctgcAcgccc gCCACCGTTG CCctgctggg caAactAGGC TTTGAAACCG 101   TTGtcgaAAG CGGTGCAggt TTGGCGGCAA GTTTggaCGA TGCCGCTTAC

151   CAAACAGCAG GCGCAACCGT TGCCGACAAA GCGGCGGTTT GGGCCTGCCC

201   TTTAATTTAT AAGGTCAACG CGCCGTCCGA AGGCGAGCTG CCGCTGCTCA

251   AAGAAGGTCA AACCATCGTC AGCTTCCTGT GGCCGCGCCA AAACGAGGCT

301   TTGGTCGAGG CCTTGCGCGC CAAGAAAGTC AACGCGCTGG CGATGGACAT

351   GGTTCCCCGC ATTTCCCGCG CTCAGGCCTT GGACGCTTTG TCTTCAATGG

401   CAAACATCAG CGGCTACCGC GCCGTGATTG AAGCCGCCAA CGCCTTCGGC

451   CGTTTCTTCA CCGGTCAAAT CACTGCCGCC GGCAAAGTGC CGCCTGCGCA

501   GGTTTTGGTG ATTGGCGCCG GTGTGGCGGG TTTGGCGGCA ATCGGTACGG

551   CAAATTCGCT CGGCGCAGTG GTGCGCGCGT TCGATACCCG CTTGGAAGTG

601   GCGGAACAAA TCGAATCGAT GGGCGGTAAG TTcctGAAAC TCGACTTCCT

651   GCAAGAATCG GGCGGCAGCG GAGACGgctA CGCCAAAGTG ATGAGCGACG

701   AATTTATCGC CGCCGAAATG AAGCTCTTTG CCGAACAGGC GAAAGAAGTG

751   GACATCATCA TCACCACCGC CGCCATTCCG GGCAAACCCG CTCCCAAGCT

801   GATTACCAAA GAAATGGTGG AAAGCATGAA ATCCGGATCC GTCATCGTCG

851   ATTTGGCGGC GACGGGCGGC AACTGCGAAC TCACCCGACC GGGCGAATTG

901   TCCGTAACCG GCAACGGCGT GAAAATCATC GGCTACACCG ACATGGCAAA

951   CCGCCTTGCC GGACAGTCTT CCCAGCTTTA CGCCACCAAC TTGGTGAACC

1001   TGACCAAGCT GTTAAGCCCG AACAAAGAcg gcgaAATCAC GCTGGACTTC

1051   GAAGacgtGA TTATCCGCAA TATGACCGTT ACCCGcgacg gcgaaATCAC

1101   CTTCCCGCCT CCGccgaTTc aggtTTCcgc ccggccgCAG CAAAcgccgt 1151   ctgaAAAagc cgcGCCTGCC GCCAagcccg AgccGaaacc tgttCCcctg 1201   tggaAAAaac tcgCGCCCGC CGCcatcgCC GCCGTATTGG tgctgtGgGt 1251   cggCgcggtc gcacccgcag CATTCTTGAA CCACTTTATC GTCTTCGTCC
```

-continued
```
1301    TCGCCTGCGT CATCGGCTAC CATGTCGTTT GgaacgTCAG CCACTCGCTG

1351    CACACACCGC TGAtgtcggt aaccaaCgcc atctccGGCA tcatggtcgt 1401    cggCGCGCTG CTGCAAATCG GTCAGGGcaa cggcttcgtT TCgctGCTGT

1451    CGTTTGTTGC CATCCTGATT GCCGGCATCA ATATCTTCGG CGGCTTTGCG

1501    GTTACACGGC GTATGCTGAA TATGTTTAAG AAAGGGTAA
```

This corresponds to the amino acid sequence <SEQ ID 638; ORF 155.ng>:

```
g155.pep
      1    MKIGIPRESL SGETRVACTP ATVALLGKLG FETVVESGAG LAASLDDAAY

51    QTAGATVADK AAVWACPLIY KVNAPSEGEL PLLKEGQTIV SFLWPRQNEA

101    LVEALRAKKV NALAMDMVPR ISRAQALDAL SSMANISGYR AVIEAANAFG

151    RFFTGQITAA GKVPPAQVLV IGAGVAGLAA IGTANSLGAV VRAFDTRLEV

201    AEQIESMGGK FLKLDFLQES GGSGDGYAKV MSDEFIAAEM KLFAEQAKEV

251    DIIITTAAIP GKPAPKLITK EMVESMKSGS VIVDLAATGG NCELTRPGEL

301    SVTGNGVKII GYTDMANRLA GQSSQLYATN LVNLTKLLSP NKDGEITLDF

351    EDVIIRNMTV TRDGEITFPP PPIQVSARPQ QTPSEKAAPA AKPEPKPVPL

401    WKKLAPAAIA AVLVLWVGAV APAAFLNHFI VFVLACVIGY HVVWNVSHSL

451    HTPLMSVTNA ISGIMVVGAL LQIGQGNGFV SLLSFVAILI AGINIFGGFA

501    VTRRMLNMFK KG*
```

The following partial DNA sequence was identified in *N. meningitidis* <SEQ ID 639>:

```
m155.seq
      1    ATGAAAATCG GTATCCCACG CGAGTCATTA TCCGGCGAAA CCCGCGTCGC

51    CTGTACGCCC GCCACCGTCG CCCTGCTGGG CAAACTGGGC TTTGAAACCG

101    TTGTCGAAAG CGGTGCAGGT TTGGCGGCAA GTTTGGACGA TGCCGCTTAC

151    CAAACAGCAG GCGCAACCGT TGCCGACAAA GCGGCGGTTT GGGTCTGCCC

201    TTTGATTTAT AAGGTCAACG CGCCGTCCGA ACAGGAACTG CCGCTTTTGA

251    ACGAAGGTCA AACCATCGTC AGCTTCCTGT GGCCGCGCCA AAACGAGGCT

301    TTGGTCGAAG CCTTGCGCGC CAAGAAAGTG AACGCGCTGG CGATGGATAT

351    GGTGCCCCGC ATTTCGCGCG CGCAGGCTTT GGACGCTTTG TCTTCGATGG

401    CAAACATCAG CGGCTACCGC GCCGTAATTG AAGCCGCCAA CGCCTTCGGC

451    CGTTTCTTCA CCGGTCAAAT TACCGCCGCC GGCAAAGTGC CGCCCGCGCA

501    GGTTTTGGTG ATTGGTGCAG GTGTGGCAGG TTTGGCGGCG ATCGGTACGG

551    CAAACTCGCT CGGCGCAGTG GTACGCGCGT TCGATACCCG CTTGGAAGTG

601    GCGGAACAAA TCGAATCGAT GGGCGGCAAG TTCCTGAAAC TCGACTTCCC

651    ACAAGAATCG GGCGGCAGCG GAGACGGCTA CGCCAAAGTG ATGAGCGACG

701    AATTTATCGC AGCCGAGATG AAGCTCTTTG CCGAGCAGGC GAAAGAAGTG

751    GACATCATCA TCACCACCGC CGCCATTCCG GGCAAACCCG CGCCCAAGCT

801    GATTACCAAA GAAATGGTGG AAAGCATGAA ATCCGGCTCC GTCATCGTCG

851    ATTTGGCGGC GGCGACGGGC GGCAACTGCG AACTCACCCG CCCGGGCGAA
```

```
-continued
 901  TTGTCCGTAA CCGGCAACGG CGTGAAAATC ATCGGCTACA CCGACATGGC

951  AAACCGCCTT GCCGGACAGT CTTCCCAGCT TTACGCCACC AACTTGGTCA

1001  ACCTGACCAA GCTGTTAAGC CCGAACAAAG ACGGCGAAAT CACGTTGGAC

1051  TTCGAAGACG TGATTATCCG CAACATGACC GTTACCCACG ACGGCGAAAT

1101  CACCTTCCCG CCTCCGCCGA TTCAAGTTTC CGCCCAGCCG CAGCAAACGC

1151  CGTCTGAAAA AGCCGTGCCT GCCGCCAAGC CCGAGCCAAA ACCCGTTCCC

1201  CTGTGGAAAA AACTCGCGCC CGCCGTCATC GCCGCCGTCT TGGTACTGTG

1251  GGTCGGCGCG GTCGCACCCG CAGCATTCCT GAACCACTTT ATCGTGTTCG

1301  TTCTCGCCTG CGTCATCGGC TACTACGTCG TCTGGAACGT CAGCCACTCG

1351  CTGCACACAC CGCTGATGTC GGTAACCAAC GCCATCTCCG GCATCATCGT

1401  CGTCGGCGCG CTGCTGCAAA TCGGTCAGGG CAACGGCTTC GTTTCGCTGC

1451  TGTCGTTTGT TGCCATCCTG ATTGCCGGCA TCAACATCTT CGGCGGCTTT

1501  GCGGTAACAC GGCGTATGCT GAATATGTTT AAGAAAGGGT AA
```

This corresponds to the amino acid sequence <SEQ ID 640; ORF 155>:

```
m155.pep
   1  MKIGIPRESL SGETRVACTP ATVALLGKLG FETVVESGAG LAASLDDAAY

51  QTAGATVADK AAVWVCPLIY KVNAPSEQEL PLLNEGQTIV SFLWPRQNEA

101  LVEALRAKKV NALAMDMVPR ISRAQALDAL SSMANISGYR AVIEAANAFG

151  RFFTGQITAA GKVPPAQVLV IGAGVAGLAA IGTANSLGAV VRAFDTRLEV

201  AEQIESMGGK FLKLDFPQES GGSGDGYAKV MSDEFIAAEM KLFAEQAKEV

251  DIIITTAAIP GKPAPKLITK EMVESMKSGS VIVDLAAATG GNCELTRPGE

301  LSVTGNGVKI IGYTDMANRL AGQSSQLYAT NLVNLTKLLS PNKDGEITLD

351  FEDVIIRNMT VTHDGEITFP PPIQVSAQP QQTPSEKAVP AAKPEPKPVP

401  LWKKLAPAVI AAVLVLWVGA VAPAAFLNHF IVFVLACVIG YYVVWNVSHS

451  LHTPLMSVTN AISGIIVVGA LLQIGQGNGF VSLLSFVAIL IAGINIFGGF

501  AVTRRMLNMF KKG*
```

Computer analysis of this amino acid sequence gave the following results:

Homology with a Predicted ORF from *N. gonorrhoeae*
ORF 155 shows 97.9% identity over a 513 aa overlap with a predicted ORF (ORF 155.ng) from *N. gonorrhoeae*:
m155/g155 97.9% identity in 513 aa overlap

```
                  10         20         30         40         50         60
   m155.pep  MKIGIPRESLSGETRVACTPATVALLGKLGFETVVESGAGLAASLDDAAYQTAGATVADK
             ||||||||||||||||||||||||||||||||||||||||||||||||||||||||||||
   g155      MKIGIPRESLSGETRVACTPATVALLGKLGFETVVESGAGLAASLDDAAYQTAGATVADK
                  10         20         30         40         50         60

70         80         90        100        110        120
   m155.pep  AAVWVCPLIYKVNAPSEQELPLLNEGQTIVSFLWPRQNEALVEALRAKKVNALAMDMVPR
             ||||:|||||||||||| ||||||:|||||||||||||||||||||||||||||||||||
   g155      AAVWACPLIYKVNAPSEGELPLLKEGQTIVSFLWPRQNEALVEALRAKKVNALAMDMVPR
                  70         80         90        100        110        120

130        140        150        160        170        180
   m155.pep  ISRAQALDALSSMANISGYRAVIEAANAFGRFFTGQITAAGKVPPAQVLVIGAGVAGLAA
             ||||||||||||||||||||||||||||||||||||||||||||||||||||||||||||
   g155      ISRAQALDALSSMANISGYRAVIEAANAFGRFFTGQITAAGKVPPAQVLVIGAGVAGLAA
                 130        140        150        160        170        180
```

```
               190        200        210        220        230        240
m155.pep  IGTANSLGAVVRAFDTRLEVAEQIESMGGKFLKLDFPQESGGSGDGYAKVMSDEFIAAEM
          ||||||||||||||||||||||||||||||||||||| ||||||||||||||||||||||
g155      IGTANSLGAVVRAFDTRLEVAEQIESMGGKFLKLDFLQESGGSGDGYAKVMSDEFIAAEM
               190        200        210        220        230        240

250        260        270        280        290        300
m155.pep  KLFAEQAKEVDIIITTAAIPGKPAPKLITKEMVESMKSGSVIVDLAAATGGNCELTRPGE
          |||||||||||||||||||||||||||||||||||||||||||||| |||||||||||||
g155      KLFAEQAKEVDIIITTAAIPGKPAPKLITKEMVESMKSGSVIVDLAA-TGGNCELTRPGE
               250        260        270        280        290        300

310        320        330        340        350        360
m155.pep  LSVTGNGVKIIGYTDMANRLAGQSSQLYATNLVNLTKLLSPNKDGEITLDFEDVIIRNMT
          ||||||||||||||||||||||||||||||||||||||||||||||||||||||||||||
g155      LSVTGNGVKIIGYTDMANRLAGQSSQLYATNLVNLTKLLSPNKDGEITLDFEDVIIRNMT
           300        310        320        330        340        350

370        380        390        400        410        420
m155.pep  VTHDGEITFPPPPIQVSAQPQQTPSEKAVPAAKPEPKPVPLWKKLAPAVIAAVLVLWVGA
          ||:|||||||||||||||||:||||||||||||:|||||||||||||||:||||||||||
g155      VTRDGEITFPPPPIQVSARPQQTPSEKAAPAAKPEPKPVPLWKKLAPAAIAAVLVLWVGA
           360        370        380        390        400        410

430        440        450        460        470        480
m155.pep  VAPAAFLNHFIVFVLACVIGYYVVWNVSHSLHTPLMSVTNAISGIIVVGALLQIGQGNGF
          |||||||||||||||||||||:||||||||||||||||||||||||:|||||||||||||
g155      VAPAAFLNHFIVFVLACVIGYHVVWNVSHSLHTPLMSVTNAISGIMVVGALLQIGQGNGF
           420        430        440        450        460        470

490        500        510
m155.pep  VSLLSFVAILIAGINIFGGFAVTRRMLNMFKKGX
          ||||||||||||||||||||||||||||||||||
g155      VSLLSFVAILIAGINIFGGFAVTRRMLNMFKKGX
           480        490        500        510
```

The following partial DNA sequence was identified in *N. meningitidis* <SEQ ID 641>:

```
a155.seq
     1  ATGAAAATCG GTATCCCACG TGAGTCATTA TCCGGCGAAA CCCGCGTCGC
    51  CTGTACGCCC GCCACCGTCG CCCTGCTGGG CAAACTGGGC TTTGAAACCG
   101  TTGTCGAAAG CGGCGCAGGT TTGGCGGCAA GTTTGGACGA TGCCGCTTAC
   151  CAAGCAGCAG GCGCAACCGT TGCCGACAAA GCAGCGGTTT GGGCATACCC
   201  TTTAATTTAT AAGGTTAACG CGCCGTCCGA AGACGAGCTG CCGCTGCTCA
   251  AAGAAGGACA GACCATCGTC AGCTTCCTGT GGCCGCGCCA AAACGAGGCT
   301  TTGGTCGAAG CCTTGCGCGC CAAGAAAGTG AACGCGCTGG CAATGGACAT
   351  GGTGCCCCGC ATTTCGCGCG CGCAGGCTTT GGACGNTTTG TCTTNGATGG
   401  CAAACATCAG CGGCTACCGC GCCGTGATTG AAGCCGCCAA CGCCTTCGGC
   451  CGTTTNTTCA CCGGCCAAAT TACTGCCGCA GGCAAAGTGC CGCCCGCGCA
   501  GGTTTTGGTG ATTGGTGCAG GTGTGGCAGG TTTGGCGGCG ATCGGTACGG
   551  CAAACTCGCT CGGCGCAGTG GTACGCGTGT TCGATACCCG CCTG.AAGTG
   601  GCGGAACAAT TAGAATCGAT GGGCGGCAAG TTCCTGAAAC TCGACTTCCC
   651  GCAAGAATCG GGCGGCAGCG GCGACGGCTA CGCCAAAGTG ATGAGCGACG
   701  AATTTATCGC CGCCGAGATG AAGCTTTTTG CCGAGCAGGC GAAAGAAGTG
   751  GACATCATCA TCACCACCGC CGCCATTCCG GGCAAACCCG CGCCCAAGCN
   801  NNTNANCAAA GAAATGGTCG AAAGCATGAA ACCCGGCTCC GTCATCGTCG
   851  ATTTGGCGGC GGCGACGGGC GGCAACTGCG AACTCACCAA ACAGGGCGAA
   901  TTGTTCGTAA CCGGCAACGG CGTGAAAATC ATCGGCTACA CCGACATGGC
   951  AAACCGCCTT GCCGGACAGT CTTCGCAGCT TTACGCCACC AACTTGGTCA
  1001  ACCTGACCAA GCTGTTAAGC CCGAACAAAG ACGGCGAAAT CACGCTGGAC
```

```
1051  TTCGAAGACG TGATTATCCG CAACATGACC GTTACCCGCG ACGGCGAAAT

1101  CACCTTCCCG CCTCCGCCGA TTCAAGTTTC CGCCCAACCG CAGCAAACGC

1151  CGTCTGAAAA AGCCGCGCCT GCCGCCAAGC CCGAACCGAA ACCCGTTCCC

1201  CTGTGGAAAA AACTCGCGCC CGCCNTNATC GCCGCCGTGT TGGTACTGTG

1251  GGTCGGCGCG GTCGCACCCG CAGCATTCCT GAACCACTTT ATCGTCTTCG

1301  TCCTCGCCTG CGTCATCGGC TACTATGTCG TTTGGAACGT CAGCCACTCG

1351  CTGCACACAC CGCTGATGTC GGTGACCAAC GCCATTTCCG GCATCATCGT

1401  CGTCGGCGCG CTGCTGCAAA TCGGTCAGGG CAACGGCTTC GTTTCGCTGC

1451  TGTCGTTTGT TGCCATCCTG ATTGCCAGCA TCAACATCTT CGGCGGCTTC

1501  TTTGTAACGC GGCGGATGCT GAATATGTTT AGGAAAGGGT AA
```

This corresponds to the amino acid sequence <SEQ ID 642; ORF 155.a>:

```
a155.pep
    1  MKIGIPRESL SGETRVACTP ATVALLGKLG FETVVESGAG LAASLDDAAY

51  QAAGATVADK AAVWAYPLIY KVNAPSEDEL PLLKEGQTIV SFLWPRQNEA

101  LVEALRAKKV NALAMDMVPR ISRAQALDXL SXMANISGYR AVIEAANAFG

151  RXFTGQITAA GKVPPAQVLV IGAGVAGLAA IGTANSLGAV VRVFDTRLXV

201  AEQLESMGGK FLKLDFPQES GGSGDGYAKV MSDEFIAAEM KLFAEQAKEV

251  DIIITTAAIP GKPAPKXXXK EMVESMKPGS VIVDLAAATG GNCELTKQGE

301  LFVTGNGVKI IGYTDMANRL AGQSSQLYAT NLVNLTKLLS PNKDGEITLD

351  FEDVIIRNMT VTRDGEITFP PPPIQVSAQP QQTPSEKAAP AAKPEPKPVP

401  LWKKLAPAXI AAVLVLWVGA VAPAAFLNHF IVFVLACVIG YYVVWNVSHS

451  LHTPLMSVTN AISGIIVVGA LLQIGQGNGF VSLLSFVAIL IASINIFGGF

501  FVTRRMLNMF RKG*
```
                                                                 40
m155/a155 95.3% identity in 513 aa overlap

```
                 10         20         30         40         50         60
m155.pep  MKIGIPRESLSGETRVACTPATVALLGKLGFETVVESGAGLAASLDDAAYQTAGATVADK
          |||||||||||||||||||||||||||||||||||||||||||||||||:|||||||||
a155      MKIGIPRESLSGETRVACTPATVALLGKLGFETVVESGAGLAASLDDAAYQAAGATVADK
                 10         20         30         40         50         60

70         80         90        100        110        120
m155.pep  AAVWVCPLIYKVNAPSEQELPLLNEGQTIVSFLWPRQNEALVEALRAKKVNALAMDMVPR
          ||||:|||||||||||||:||||:||||||||||||||||||||||||||||||||||||
a155      AAVWAYPLIYKVNAPSEDELPLLKEGQTIVSFLWPRQNEALVEALRAKKVNALAMDMVPR
                 70         80         90        100        110        120

130        140        150        160        170        180
m155.pep  ISRAQALDALSSMANISGYRAVIEAANAFGRFFTGQITAAGKVPPAQVLVIGAGVAGLAA
          |||||||| || ||||||||||||||||||| ||||||||||||||||||||||||||||
a155      ISRAQALDXLSXMANISGYRAVIEAANAFGRXFTGQITAAGKVPPAQVLVIGAGVAGLAA
                130        140        150        160        170        180

190        200        210        220        230        240
m155.pep  IGTANSLGAVVRAFDTRLEVAEQIESMGGKFLKLDFPQESGGSGDGYAKVMSDEFIAAEM
          ||||||||||||:|||||||:|||||||||||||||||||||||||||||||||||||||
a155      IGTANSLGAVVRVFDTRLXVAEQLESMGGKFLKLDFPQESGGSGDGYAKVMSDEFIAAEM
                190        200        210        220        230        240

250        260        270        280        290        300
m155.pep  KLFAEQAKEVDIIITTAAIPGKPAPKLITKEMVESMKSGSVIVDLAAATGGNCELTRPGE
          ||||||||||||||||||||||||||||:|||||||||:||||||||||||||||:||
a155      KLFAEQAKEVDIIITTAAIPGKPAPKXXXKEMVESMKPGSVIVDLAAATGGNCELTKQGE
                250        260        270        280        290        300
```

-continued

```
             310        320        330        340        350        360
m155.pep  LSVTGNGVKIIGYTDMANRLAGQSSQLYATNLVNLTKLLSPNKDGEITLDFEDVIIRNMT
          | ||||||||||||||||||||||||||||||||||||||||||||||||||||||||||
a155      LFVTGNGVKIIGYTDMANRLAGQSSQLYATNLVNLTKLLSPNKDGEITLDFEDVIIRNMT
             310        320        330        340        350        360

370        380        390        400        410        420
m155.pep  VTHDGEITFPPPPIQVSAQPQQTPSEKAVPAAKPEPKPVPLWKKLAPAVIAAVLVLWVGA
          ||:|||||||||||||||||||||||||:|||||||||||||||||||| ||||||||||
a155      VTRDGEITFPPPPIQVSAQPQQTPSEKAAPAAKPEPKPVPLWKKLAPAXIAAVLVLWVGA
             370        380        390        400        410        420

430        440        450        460        470        480
m155.pep  VAPAAFLNHFIVFVLACVIGYYVVWNVSHSLHTPLMSVTNAISGIIVVGALLQIGQGNGF
          ||||||||||||||||||||||||||||||||||||||||||||||||||||||||||||
a155      VAPAAFLNHFIVFVLACVIGYYVVWNVSHSLHTPLMSVTNAISGIIVVGALLQIGQGNGF
             430        440        450        460        470        480

490        500        510
m155.pep  VSLLSFVAILIAGINIFGGFAVTRRMLNMFKKGX
          |||||||||||||:|||||||:|||||||:|||
a155      VSLLSFVAILIASINIFGGFFVTRRMLNMFRKGX
             490        500        510
```

The following partial DNA sequence was identified in *N. gonorrhoeae* <SEQ ID 643>:

```
g156.seq
    1  ATGACTTTCG CCTATTGGTG CATTCTGATT GCCTGCCTAT TGCCGCTTTT
   51  TTGTGCGGCG TATGCCAAAA AAGCGGGCGG ATTCCGGTTT AAAGACAACC
  101  ACAATCCTCG CGGTTTTCTG GCACATACGC AAGGCGCAGC CGCCCGTGCC
  151  CACGCCGCGC AGCAAAACGG TTTTGAAGCC TTTGCACCGT TTGCCGCCGC
  201  CGTTTTGACG GCACACGCAA CCGGCAATGC CGGACAAGCA ACCGTCAACA
  251  CGCTTGCCGG ATTGTTCATC CTGTTCCGCC TCGCCTTTAT CTGGTGCTAC
  301  ATCGCAGACA AAGCAGCATT GCGCTCGCTG ATGTGGGCGG GCGGATTTGC
  351  CTGCACCGTC GGACTGTTTG TCGCGGCTGC TTGA
```

This corresponds to the amino acid sequence <SEQ ID 644; ORF 156.ng>:

```
g156.pep
    1  MTFAYWCILI ACLLPLFCAA YAKKAGGFRF KDNHNPRGFL AHTQGAAARA
   51  HAAQQNGFEA FAPFAAAVLT AHATGNAGQA TVNTLAGLFI LFRLAFIWCY
  101  IADKAALRSL MWAGGFACTV GLFVAAA*
```

The following partial DNA sequence was identified in *N. meningitidis* <SEQ ID 645>:

```
m156.seq
    1  ATGACTTTCG CCTATTGGTG TATTCTGATT GCCTGCCTAT TGCCGCTTTT
   51  TTGTGCGGCG TATGCCAAAA AAGCGGGCGG ATTCCGGTTT AAAGACAACC
  101  ACAATCCGCG CGGTTTTCTA GCGCACACGC AAGGCGCAGC CGCCCGTGCC
  151  CACGCCGCAC AGCAAAACGG TTTTGAAGCC TTTGCACCGT TTGCCGCCGC
  201  CGTTTTGACG GCACACGCAA CCGGCAATGC GGCGCAATCG ACCATCAACA
  251  CGCTTGCCTG CCTGTTCATC CTGTTCCGCC TCGCCTTTAT CTGGTGCTAT
  301  ATCGCCGACA AAGCCGCTAT GCGCTCACTG ATGTGGGCAG GCGGATTTGC
  351  CTGCACCGTC GGGCTGTTTG TCGCGGCTGC TTGA
```

This corresponds to the amino acid sequence <SEQ ID 646; ORF 156>:

```
m156.pep
    1    MTFAYWCILI ACLLPLFCAA YAKKAGGFRF KDNHNPRGFL AHTQGAAARA

51    HAAQQNGFEA FAPFAAAVLT AHATGNAAQS TINTLACLFI LFRLAFIWCY

101    IADKAAMRSL MWAGGFACTV GLFVAAA*
```

Computer analysis of this amino acid sequence gave the following results:
Homology with a Predicted ORF from *N. gonorrhoeae*
   m156/g156 96.1% identity in 127 aa overlap

```
                10         20         30         40         50         60
    m156.pep    MTFAYWCILIACLLPLFCAAYAKKAGGFRFKDNHNPRGFLAHTQGAAARAHAAQQNGFEA
                ||||||||||||||||||||||||||||||||||||||||||||||||||||||||||||
    g156        MTFAYWCILIACLLPLFCAAYAKKAGGFRFKDNHNPRGFLAHTQGAAARAHAAQQNGFEA
                10         20         30         40         50         60
                70         80         90        100        110        120
    m156.pep    FAPFAAAVLTAHATGNAAQSTINTLACLFILFRLAFIWCYIADKAAMRSLMWAGGFACTV
                ||||||||||||||||||:|:|:||||||||||||||||||||||:||||||||||||||
    g156        FAPFAAAVLTAHATGNAGQATVNTLAGLFILFRLAFIWCYIADKAALRSLMWAGGFACTV
                70         80         90        100        110        120 m156.pep    GLFVAAX
                |||||||
    g156        GLFVAAX
```

The following partial DNA sequence was identified in *N. meningitidis* <SEQ ID 647>:

```
a156.seq
    1    ATGACTTTCG CCTATTGGTG TATTCTGATT GCCTACCTAT TGCCGCTTTT

51    TTGTGCGGCG TATGCCAAAA AAGCGGGCGG ATTCCGGTTT AAAGACAACC

101    ACAATCCGCG CGATTTTCTG GCGCGCACGC AAGGCACAGC CGCCCGTGCC

151    CACGCCGCGC AGCAAAACGG TTTTGAAGCC TTTGCACCGT TTGCAGCCGC

201    CGTTTTGACG GCACACGCAA CCGGCAATGC CGGACAAGCA ACCGTCAACA

251    CGCTTGCCGG CCTGTTCATC CTGTTCCGCC TCGCCTTTAT CTGGTGCTAC

301    ATCGCAGACA AAGCAGCATT ACGCTCGCTG ATGTGGGTGG GCGGATTTGT

351    CTGCACCGTC GGGCTGTTTG TCGTGGCTGC TTGA
```

This corresponds to the amino acid sequence <SEQ ID 648; ORF 156.a>:

```
a156.pep
    1    MTFAYWCILI AYLLPLFCAA YAKKAGGFRF KDNHNPRDFL ARTQGTAARA

51    HAAQQNGFEA FAPFAAAVLT AHATGNAGQA TVNTLAGLFI LFRLAFIWCY

101    IADKAALRSL MWVGGFVCTV GLFVVAA*
``` m156/a156 90.6% identity in 127 aa overlap

```
                10         20         30         40         50         60
    m156.pep    MTFAYWCILIACLLPLFCAAYAKKAGGFRFKDNHNPRGFLAHTQGAAARAHAAQQNGFEA
                ||||||||||| |||||||||||||||||||||||||||| |||:|||:|||||||||||
    a156        MTFAYWCILIAYLLPLFCAAYAKKAGGFRFKDNHNPRDFLARTQGTAARAHAAQQNGFEA
                10         20         30         40         50         60
                70         80         90        100        110        120
    m156.pep    FAPFAAAVLTAHATGNAAQSTINTLACLFILFRLAFIWCYIADKAAMRSLMWAGGFACTV
                ||||||||||||||||||:|:|:||||||||||||||||||||||:|||||||:|||:||
    a156        FAPFAAAVLTAHATGNAGQATVNTLAGLFILFRLAFIWCYIADKAALRSLMWVGGFVCTV
                70         80         90        100        110        120
```

```
m156.pep  GLFVAAAX
          ||||:|||
a156      GLFVVAAX
```

The following partial DNA sequence was identified in *N. gonorrhoeae* <SEQ ID 649>:

```
g157.seq
    1   atgaggaacg aggAAAAACg cgccctgcgc cgcgaattgC gCgGgcggcg
   51   ttcgcAAATg GGgcgagacg tGCGggCGGC GGCGgCgatA Aaaatcaacc
  101   gcctgctcaa aCGTtatatc AAGCGCggtc gGaAaatcgG CGTGTATTgg
  151   cCGATGGGCA AGGAATTGcg TTTGGGCGgc tTtgtcCGCG CGGCGCAAAA
  201   ACGCgGCGCA AAactctatc tgccttATAT CGAACCGCAC ACGCGGCGGA
  251   TGTGGTTTAC GCCGTATCCT GAACGCGGAA TGGAACGGGA ACGCAAGCGC
  301   GGTAGGGCGA AGCTGCATGT CCCTCAGTTT GCAGGGCGCA AAATCCGCGT
  351   GCACGGTTTG TCGGTATTGC TCGTCCCGCT TGTCGGCATA GACCGCGAAG
  401   GCTACCGTTT GGGGCAGGCA GGCGGCTATT ACGATGCGAC GCTTTCGGCG
  451   ATGAAATACC GTTTGCAGGC GAAAACCGTG GGCGTGGGCT TTGCCTGCCA
  501   GTTGGTGGAC AGGCTCCCAC GCGAGGCGCA CGACCTGCCG CTGGACGGTT
  551   TTGTATCGGA AGCGGGGATA TTGTGTTTTT AG
```

This corresponds to the amino acid sequence <SEQ ID 650; ORF 157.ng>:

```
g157.pep
    1   MRNEEKRALR RELRGRRSQM GRDVRAAAAI KINRLLKRYI KRGRKIGVYW
   51   PMGKELRLGG FVRAAQKRGA KLYLPYIEPH TRRMWFTPYP ERGMERERKR
  101   GRAKLHVPQF AGRKIRVHGL SVLLVPLVGI DREGYRLGQA GGYYDATLSA
  151   MKYRLQAKTV GVGFACQLVD RLPREAHDLP LDGFVSEAGI LCF*
```

The following partial DNA sequence was identified in *N. meningitidis* <SEQ ID 651>:

```
m157.seq
    1   ATGAGGAACG AGGAAAAACG CGCCCTGCGC CGCGAATTGC GCGGGCGGCG
   51   TTCGCAAATG GGGCGGGACG TGCGGGCGGC GGCAACGGTA AAAATCAACC
  101   ACCTGCTCAA ACGTTATATT AAAAAAGGGC GGAAAATCGG CGTGTATTGG
  151   CCGATGGGCA AGGAATTGCG TTTGGACGGC TTTGTCCGCG CGGCGCAAAA
  201   ACGCGGTGCG GAACTCTACC TGCCTTATAT CGAACCGCGT TCGCGGCGGA
  251   TGTGGTTTAC GCCGTATCCT GCCGATGGAG TAAAACAAGA ACGCAAGCGC
  301   GGTAGGGCGA AGCTGCATGT CCCTCAGTTT GCAGGTCGGA AAAAGCGTGT
  351   GCATGATTTG AACCTCCTGC TTGTGCCAGT GGTCGGTATG GACAGGCTGG
  401   GCTACCGCTT GGGACAGGCA GGCGGCTATT ACGATGCGAC GCTTTCAGCG
  451   ATGAAATACC GTTTGCAGGC AAAAACCGTG GGCGTGGGCT TTGCCTGCCA
  501   GTTGGTGGAC AGGCTGCCGG TCGAGGCGCA CGACCGGTCT TTGGACGGTT
  551   TTGTGTCGGA GGCGGGGATA TTGTGTTTTT AG
```

This corresponds to the amino acid sequence <SEQ ID 652; ORF 157>:

```
m157.pep
    1   MRNEEKRALR RELRGRRSQM GRDVRAAATV KINHLLKRYI KKGRKIGVYW

51   PMGKELRLDG FVRAAQKRGA ELYLPYIEPR SRRMWFTPYP ADGVKQERKR

101   GRAKLHVPQF AGRKKRVHDL NLLLVPVVGM DRLGYRLGQA GGYYDATLSA

151   MKYRLQAKTV GVGFACQLVD RLPVEAHDRS LDGFVSEAGI LCF*
```

Computer analysis of this amino acid sequence gave the following results:
Homology with a Predicted ORF from *N. gonorrhoeae*
m157/g157 88.1% identity in 193 aa overlap

```
                  10        20        30        40        50        60
m157.pep  MRNEEKRALRRELRGRRSQMGRDVRAAATVKINHLLKRYIKKGRKIGVYWPMGKELRLDG
          ||||||||||||||||||||||||||||::|||:||||||:||||||||||||||||| |
g157      MRNEEKRALRRELRGRRSQMGRDVRAAAAIKINRLLKRYIKRGRKIGVYWPMGKELRLGG
                  10        20        30        40        50        60
                  70        80        90       100       110       120
m157.pep  FVRAAQKRGAELYLPYIEPRSRRMWFTPYPADGVKQERKRGRAKLHVPQFAGRKKRVHDL
          ||||||||||:||||||||::||||||||| |:::|||||||||||||||||||||| |
g157      FVRAAQKRGAKLYLPYIEPHTRRMWFTPYPERGMERERKRGRAKLHVPQFAGRKIRVHGL
                  70        80        90       100       110       120
                 130       140       150       160       170       180
m157.pep  NLLLVPVVGMDRLGYRLGQAGGYYDATLSAMKYRLQAKTVGVGFACQLVDRLPVEAHDRS
          ::||||:||:|| |||||||||||||||||||||||||||||||||||||||||| ||||
g157      SVLLVPLVGIDREGYRLGQAGGYYDATLSAMKYRLQAKTVGVGFACQLVDRLPREAHDLP
                 130       140       150       160       170       180
                 190
m157.pep  LDGFVSEAGILCFX
          ||||||||||||||
g157      LDGFVSEAGILCFX
                 190
```

The following partial DNA sequence was identified in *N. meningitidis* <SEQ ID 653>:

```
a157.seq
    1   ATGAGGAACG AGGAAAAACA CGCCTTGCGC CGAGAGTTGC GCCGCGCCCG

51   CGCGCAGATG GGGCATCAAG GGCGGTTGGC GGCGGGGCAA ACGATTAACC

101   GCCTGCTCAA ACGTTATATC AAGCGTGGTC GGAAAATCGG CGTGTATTGG

151   CCGATGGGCA AGGAATTGCG TTTGGACGGC TTTGTCCGCG CGGCGCAAAA

201   ACGCGGTGCA AAACTTTATC TGCCTTATAT CGAACCGCGT TCGCGGCGGA

251   TGTGGTTTAC GCCGTATCCT GAAAGCGGAA TGGAACGGGA GCGCATACGG

301   GGCAGGGCGA AGTTGAACGT GCCGCAGTTT GCAGGGCGCA AAATCCGCGT

351   GCACGGTTTG TCGGTATTGC TCGTCCCGCT TGTCGGCATA GACCGCGAGG

401   GCTACCGCTT AGGACAGGCA GGCGGCTATT ACGATGCGAC GCTTGCGGCG

451   ATGAAATACC GTTTGCAGGC AAAAACCGTG GGCGTGGGCT TTGCCTGCCA

501   GTTTGTGGAC AGGCTGCCGC GCGAACCGCA CGATCTGCTG CTGGACGGTT

551   TTGTGTCGGA GGCGGGGATA TTGTGCTTTT AG
```

This corresponds to the amino acid sequence <SEQ ID 654; ORF 157.a>:

```
a157.pep
    1   MRNEEKHALR RELRRARAQM GHQGRLAAGQ TINRLLKRYI KRGRKIGVYW

51   PMGKELRLDG FVRAAQKRGA KLYLPYIEPR SRRMWFTPYP ESGMERERIR

101   GRAKLNVPQF AGRKIRVHGL SVLLVPLVGI DREGYRLGQA GGYYDATLAA

151   MKYRLQAKTV GVGFACQFVD RLPREPHDLL LDGFVSEAGI LCF*
``` m157/a157 82.4% identity in 193 aa overlap

```
                  10         20         30         40         50         60
m157.pep  MRNEEKRALRRELRGRRSQMGRDVRAAATVKINHLLKRYIKKGRKIGVYWPMGKELRLDG
          ||||||:||||||  |:|||::  |  ||    ||:|||||||:||||||||||||||||
a157      MRNEEKHALRRELRRARAQMGHQGRLAAGQTINRLLKRYIKRGRKIGVYWPMGKELRLDG
                  10         20         30         40         50         60

70         80         90        100        110        120
m157.pep  FVRAAQKRGAELYLPYIEPRSRRMWFTPYPADGVKQERKRGRAKLHVPQFAGRKKRVHDL
          ||||||||||:|||||||||||||||||||| :|:::||  ||||||:||||||  ||| |
a157      FVRAAQKRGAKLYLPYIEPRSRRMWFTPYPESGMERERIRGRAKLNVPQFAGRKIRVHGL
                  70         80         90        100        110        120

130        140        150        160        170        180
m157.pep  NLLLVPVVGMDRLGYRLGQAGGYYDATLSAMKYRLQAKTVGVGFACQLVDRLPVEAHDRS
          ::||||:||:|| ||||||||||||||||:||||||||||||||||| |||||:|||||  ||
a157      SVLLVPLVGIDREGYRLGQAGGYYDATLAAMKYRLQAKTVGVGFACQFVDRLPREPHDLL
                 130        140        150        160        170        180

190
m157.pep  LDGFVSEAGILCFX
          ||||||||||||||
a157      LDGFVSEAGILCFX
                 190
```

The following partial DNA sequence was identified in *N. gonorrhoeae* <SEQ ID 655>:

```
g158.seq
    1   ATGAAAACCA ATTCAGAAGA ACTGACCGTA TTTGTTCAAG TGGTGGAAAG

51   CGGCAGCTTC AGCCGTGCGG CGgagcAGTT GGAGAtggCA AATTCTGCCG

101   TAAGCCGCAT CGTCAAACGG CTGGAGGAAA AGTTGGGCGT GAAcCTGCtc 151   aACCGCACCA CGCGGCAACT CAATCTGACG GAAGAAGGCG CGCAATATTT

201   CCGCCGCGCG CAGAGAATCC TGCAAGAAAT GGCAGCGGCG GAAACCGAAA

251   TGCTGGCAGT GCACGAAGTA CCGCAAGGCG TGTTGCGCGT GGATTCCGCG

301   ATGCCgatgg TGCTGCATCT GCTGGCGCCG CTGGCAGCAA AATTCAACGA

351   ACGCTATCCG CATATCcgaC TTTCGCTCGT TTCTTCCGAa ggctatatca 401   atctGattGA Acgcaaagtc gAtatTGCCT TACGGGCCGG AGAATTGGAC 451   GATTCCGGGC TGCGTGCACG CCATCTGTTT GACAGCCACT TCCGCGtagt 501   cgCCAGTCCT GAATATTTAG CAAAACACGG CACGCCACAA TCTGCAGAAG 551   atcTTGCCAA CCATCAATGT TTAGGCTTCA CAGAACCCGG TTCTCTAAAT 601   ACATGGGCGG TTTTAGAtgC GCAGGGAAAT CCCTATAAAA TTTCACCGCA 651   CTTTACCGCC AGCAGCGGTG AAATCTTACG CTCGTTGTGC CTTTCAAGtt 701   gCGGTATTGC TTGCTTATCA GATTTTTTGG TTGACAACGA CATCACTGAA 751   GGAAAGTTAA TTCCcctatt cgCCGAACAA ACCTCCAATA AAACACACCC

801   CTTTAATGCT GTTTATTACA GCGATAAAGC CGTCAACCTC CGCTTACGCG

851   TATTTTTGGA TTTTTTAGTG AAGGAACTGG GAAAAAATAT GAATAGAACG

901   AATACCAAAT AA
```

This corresponds to the amino acid sequence <SEQ ID 656; ORF 158.ng>:

```
g158.pep
    1  MKTNSEELTV FVQVVESGSF SRAAEQLEMA NSAVSRIVKR LEEKLGVNLL

51  NRTTRQLNLT EEGAQYFRRA QRILQEMAAA ETEMLAVHEV PQGVLRVDSA

101  MPMVLHLLAP LAAKFNERYP HIRLSLVSSE GYINLIERKV DIALRAGELD

151  DSGLRARHLF DSHFRVVASP EYLAKHGTPQ SAEDLANHQC LGFTEPGSLN

201  TWAVLDAQGN PYKISPHFTA SSGEILRSLC LSSCGIACLS DFLVDNDITE

251  GKLIPLFAEQ TSNKTHPFNA VYYSDKAVNL RLRVFLDFLV KELGKNMNRT

301  NTK*
```

The following partial DNA sequence was identified in *N. meningitidis* <SEQ ID 657>:

```
m158.seq
    1  ATGAAAACCA ATTCAGAAGA ACTGACCGTA TTTGTTCAAG TGGTGGAAAG

51  CGGCAGCTTC AGCCGTGCGG CGGAGCAGTT GGCGATGGCA AATTCTGCCG

101  TAAGCCGCAT CGTCAAACGG CTGGAGGAAA AGTTGGGTGT GAACCTGCTC

151  AACCGCACCA CGCGGCAACT CAGTCTGACG GAAGAAGGCG CGCAATATTT

201  CCGCCGCGCG CAGAGAATCC TGCAAGAAAT GGCAGCGGCG GAAACCGAAA

251  TGCTGGCAGT GCACGAAATA CCGCAAGGCG TGTTGAGCGT GGATTCCGCG

301  ATGCCGATGG TGCTGCATCT GCTGGCGCCG CTGGCAGCAA AATTCAACGA

351  ACGCTATCCG CATATCCGAC TTTCGCTCGT TTCTTCCGAA GGCTATATCA

401  ATCTGATTGA ACGCAAAGTC GATATTGCCT TACGGGCCGG AGAATTGGAC

451  GATTCCGGGC TGCGTGCACG CCATCTGTTT GACAGCCGCT TCCGCGTAAT

501  CGCCAGTCCT GAATACCTGG CAAAACACGG CACGCCGCAA TCTACAGAAG

551  AGCTTGCCGG CCACCAATGT TTAGGCTTCA CCGAACCCGG TTCTCTAAAT

601  ACATGGGCGG TTTTAGATGC GCAGGGAAAT CCCTATAAGA TTTCACCGCA

651  CTTTACCGCC AGCAGCGGTG AAATCTTACG CTCGTTGTGC CTTTCAGGTT

701  GCGGTATTGT TTGCTTATCA GATTTTTTGG TTGACAACGA CATCGCTGAA

751  GGAAAGTTAA TTCCCCTGCT CGCCGAACAA ACCTCCGATA AACACACCCC

801  CTTTAATGCT GTTTATTACA GCGATAAAGC CGTCAATCTC CGCTTACGCG

851  TATTTTTGGA TTTTTTAGTG GAGGAACTGG GAAACAATCT CTGTGGATAA
                                                                50
```

This corresponds to the amino acid sequence <SEQ ID 658; ORF 158>:

```
m158.pep
    1  MKTNSEELTV FVQVVESGSF SRAAEQLAMA NSAVSRIVKR LEEKLGVNLL

51  NRTTRQLSLT EEGAQYFRRA QRILQEMAAA ETEMLAVHEI PQGVLSVDSA

101  MPMVLHLLAP LAAKFNERYP HIRLSLVSSE GYINLIERKV DIALRAGELD

151  DSGLRARHLF DSRFRVIASP EYLAKHGTPQ STEELAGHQC LGFTEPGSLN

201  TWAVLDAQGN PYKISPHFTA SSGEILRSLC LSGCGIVCLS DFLVDNDIAE

251  GKLIPLLAEQ TSDKTHPFNA VYYSDKAVNL RLRVFLDFLV EELGNNLCG*
```

Computer analysis of this amino acid sequence gave the following results:
Homology with a Predicted ORF from *N. gonorrhoeae* m158/g158 94.3% identity in 297 aa overlap

```
                 10        20        30        40        50        60
m158.pep  MKTNSEELTVFVQVVESGSFSRAAEQLAMANSAVSRIVKRLEEKLGVNLLNRTTRQLSLT
          ||||||||||||||||||||||||||||:|||||||||||||||||||||||||||||:||
g158      MKTNSEELTVFVQVVESGSFSRAAEQLEMANSAVSRIVKRLEEKLGVNLLNRTTRQLNLT
                 10        20        30        40        50        60

70        80        90       100       110       120
m158.pep  EEGAQYFRRAQRILQEMAAAETEMLAVHEIPQGVLSVDSAMPMVLHLLAPLAAKFNERYP
          |||||||||||||||||||||||||||||||:|||||||||||||||||||||||||||
g158      EEGAQYFRRAQRILQEMAAAETEMLAVHEVPQGVLRVDSAMPMVLHLLAPLAAKFNERYP
                 70        80        90       100       110       120

130       140       150       160       170       180
m158.pep  HIRLSLVSSEGYINLIERKVDIALRAGELDDSGLRARHLFDSRFRVIASPEYLAKHGTPQ
          ||||||||||||||||||||||||||||||||||||||||||:|||:||||||||||||
g158      HIRLSLVSSEGYINLIERKVDIALRAGELDDSGLRARHLFDSHFRVVASPEYLAKHGTPQ
                130       140       150       160       170       180

190       200       210       220       230       240
m158.pep  STEELAGHQCLGFTEPGSLNTWAVLDAQGNPYKISPHFTASSGEILRSLCLSGCGIVCLS
          |:|:|||||||||||||||||||||||||||||||||||||||||||||||:|:|||
g158      SAEDLANHQCLGFTEPGSLNTWAVLDAQGNPYKISPHFTASSGEILRSLCLSSCGIACLS
                190       200       210       220       230       240

250       260       270       280       290       300
m158.pep  DFLVDNDIAEGKLIPLLAEQTSDKTHPFNAVYYSDKAVNLRLRVFLDFLVEELGNNLCGX
          ||||||||:|||||:||||:||||||||||||||||||||||||||||||:|||:|:
g158      DFLVDNDITEGKLIPLFAEQTSNKTHPFNAVYYSDKAVNLRLRVFLDFLVKELGKNMNRT
                250       260       270       280       290       300 g158      NTKX
```

The following partial DNA sequence was identified in *N. meningitidis* <SEQ ID 659>:

```
a158.seq
    1  ATGAAAACCA ATTCAGAAGA ACTGACCGTA TTTGTTCAAG TGGTGGAAAG
   51  CGGCAGCTTC AGCCGTGCGG CGGAGCAGTT GGCGATGGCA AATTCTGCCG
  101  TAAGCCGCAT CGTCAAACGG CTGGAGGAAA AGTTGGGTGT GAACCTGCTC
  151  AACCGCACCA CGCGGCAACT CAGTCTGACG GAAGAAGGCG CGCAATATTT
  201  CCGCCGCGCG CAGAGAATCC TGCAAGAAAT GGCAGCGGCG GAAACCGAAA
  251  TGCTGGCAGT GCACGAAATA CCGCAAGGCG TGTTGCGCGT GGATTCCGCG
  301  ATGCCGATGG TGCTGCATCT GCTGGCGCCG CTGGCAGCAA AATTCAACGA
  351  ACGCTATCCG CATATCCGAC TTTCGCTCGT TTCTTCCGAA GGCTATATCA
  401  ATCTGATTGA ACGCAAAGTC GATATTGCCT TACGGGCCGG AGAATTGGAC
  451  GATTCCGGGC TGCGTGCACG CCATCTGTTT GACAGCCGCT TCCGCGTAAT
  501  CGCCAGTCCT GAATACCTGG CAAAACACGG CACGCCGCAA TCTACAGAAG
  551  AGCTTGCCGG CCACCAATGT TTAGGCTTCA CCGAACCCGG TTCTCTAAAT
  601  ACATGGGCGG TTTTAGATGC GCAGGGAAAT CCCTATAAGA TTTCACCGCA
  651  CTTTACCGCC AGCAGCGGTG AAATCTTACG CTCGTTGTGC CTTTCAGGTT
  701  GCGGTATTGC TTGCTTATCA GATTTTTTGG TTGACAACGA CATCGCTGAA
  751  GGAAAGTTAA TTCCCCTGCT CGCCGAACAA ACCTCCAATA AAACGCACCC
  801  CTTTAATGCT GTTTATTACA GCGATAAAGC CGTCAACCTC CGCTTACGCG
  851  TATTTTTGGA TTTTTTAGTG GAGGAACTGG GAAACAATCT CTGTGGATAA
```

This corresponds to the amino acid sequence <SEQ ID 660; ORF 158.a>:

```
a158.pep
    1   MKTNSEELTV FVQVVESGSF SRAAEQLAMA NSAVSRIVKR LEEKLGVNLL

51   NRTTRQLSLT EEGAQYFRRA QRILQEMAAA ETEMLAVHEI PQGVLRVDSA

101   MPMVLHLLAP LAAKFNERYP HIRLSLVSSE GYINLIERKV DIALRAGELD

151   DSGLRARHLF DSRFRVIASP EYLAKHGTPQ STEELAGHQC LGFTEPGSLN

201   TWAVLDAQGN PYKISPHFTA SSGEILRSLC LSGCGIACLSDFLVDNDIAE

251   GKLIPLLAEQ TSNKTHPFNA VYYSDKAVNL RLRVFLDFLV EELGNNLCG*
``` m158/a158 99.0% identity in 299 aa overlap

```
                10         20         30         40         50         60
m158.pep   MKTNSEELTVFVQVVESGSFSRAAEQLAMANSAVSRIVKRLEEKLGVNLLNRTTRQLSLT
           ||||||||||||||||||||||||||||||||||||||||||||||||||||||||||||
a158       MKTNSEELTVFVQVVESGSFSRAAEQLAMANSAVSRIVKRLEEKLGVNLLNRTTRQLSLT
                10         20         30         40         50         60
                70         80         90        100        110        120
m158.pep   EEGAQYFRRAQRILQEMAAAETEMLAVHEIPQGVLSVDSAMPMVLHLLAPLAAKFNERYP
           |||||||||||||||||||||||||||||||||||| |||||||||||||||||||||||
a158       EEGAQYFRRAQRILQEMAAAETEMLAVHEIPQGVLRVDSAMPMVLHLLAPLAAKFNERYP
                70         80         90        100        110        120
               130        140        150        160        170        180
m158.pep   HIRLSLVSSEGYINLIERKVDIALRAGELDDSGLRARHLFDSRFRVIASPEYLAKHGTPQ
           ||||||||||||||||||||||||||||||||||||||||||||||||||||||||||||
a158       HIRLSLVSSEGYINLIERKVDIALRAGELDDSGLRARHLFDSRFRVIASPEYLAKHGTPQ
               130        140        150        160        170        180
               190        200        210        220        230        240
m158.pep   STEELAGHQCLGFTEPGSLNTWAVLDAQGNPYKISPHFTASSGEILRSLCLSGCGIVCLS
           ||||||||||||||||||||||||||||||||||||||||||||||||||||||||:|||
a158       STEELAGHQCLGFTEPGSLNTWAVLDAQGNPYKISPHFTASSGEILRSLCLSGCGIACLS
               190        200        210        220        230        240
               250        260        270        280        290        300
m158.pep   DFLVDNDIAEGKLIPLLAEQTSDKTHPFNAVYYSDKAVNLRLRVFLDFLVEELGNNLCGX
           |||||||||||||||||||||:||||||||||||||||||||||||||||||||||||||
a158       DFLVDNDIAEGKLIPLLAEQTSNKTHPFNAVYYSDKAVNLRLRVFLDFLVEELGNNLCGX
               250        260        270        280        290        300
```

The following partial DNA sequence was identified in *N. gonorrhoeae* <SEQ ID 661>:

```
g160.seq
    1   ATGGAcattc tgGACAAact ggtcgatCTC GCccaATTGA CGGGCAGTGC

51   GGATGTGCAG TgcctTTTGG GCGGACAATG gcATGaaacc TTGCAACGCG

101   AAGGGCTGGT ACACATTGTT ACGGCGGGCA GCGGTTATCT CTGCATCGAC

151   GGCGAAACTT CCCCGCGTCC GGTCGGCACG GGCGATATTG TATTTTTCCC

201   GCGCGGCTTG GGTCATGTGT TGAGCCACGA CGGAAAATAC GGAGAAAGTT

251   TACAACCGGA CATACGACAA AACGGCACAT TTATGGTCAA ACAGTGCGGC

301   AACGGGCTGG ATATGAGCCT GTTTTGCGCC CGTTTCCGCT ACGACACCCA

351   CGCCGATTTG ATGAACGGGC TGCCGGAAAC CGTTTTTCTG AACATTGCCC

401   ATCCAAGTTT GCAGTATGTG GTTTCAATGC TGCAACTGGA AAGCGAAAAA

451   CCTTTGACGG GGACGGTTTC CGTGGTCAAC GCATTACCGT CCGTCCTGCT

501   GGTGCTTATC CTGCGCGCCT ATCTCGAACA GGATAAGGAT GTCGAACTCT

551   CGGGCGTATT GAAAGGTTGG CAGGACAAAC GTTTGGGACA TTTGATCCAA

601   AAGGTGATAG ACAAACCGGA AGACGAATGG AATATTGACA AAATGGTTGC

651   CGCCGCCAAT ATGTCGCGCG CGCAACTGAT GCGCCGCTTC AAAAGCCAAG

701   TCGGACTCAG CCCGCACGCC TTTGTGAACC ATATCCGCCT GCAAAAAGGC
```

-continued
```
751  GCATTGCTGC TGAAGAAAAC CCCGGATTCG GTTTTGGAGG TCGCGCTGTC

801  GGTGGGCTTT CAGTCGGAAA CGCATTTCGG CAAGGCGTTC AAACGGCAAT

851  ATCACGTTTC GCCGGGGCAA TACCGAAAG AAGGCGGGCA AAAATAA
```

This corresponds to the amino acid sequence <SEQ ID 662; ORF 160.ng>:

```
g160.pep
   1  MDILDKLVDL AQLTGSADVQ CLLGGQWHET LQREGLVHIV TAGSGYLCID

51  GETSPRPVGT GDIVFFPRGL GHVLSHDGKY GESLQPDIRQ NGTFMVKQCG

101  NGLDMSLFCA RFRYDTHADL MNGLPETVFL NIAHPSLQYV VSMLQLESEK

151  PLTGTVSVVN ALPSVLLVLI LRAYLEQDKD VELSGVLKGW QDKRLGHLIQ

201  KVIDKPEDEW NIDKMVAAAN MSRAQLMRRF KSQVGLSPHA FVNHIRLQKG

251  ALLLKKTPDS VLEVALSVGF QSETHFGKAF KRQYHVSPGQ YRKEGGQK*
```

The following partial DNA sequence was identified in *N. meningitidis* <SEQ ID 663>:

```
m160.seq
   1  ATGGACATTC TGGACAAACT GGTCGATTTC GCCCAATTGA CGGGCAGTGT

51  GGATGTGCAG TGCCTTTTGG GCGGACAATG GTCGGTACGG CATGAAACCT

101  TGCAACGCGA AGGATTGGTA CACATTGTTA CATCGGGCAG CGGCTATCTC

151  TGCATCGACG GCGAAACTTC CCCGCGTCCG GTCAGTACAG GGGATATTGT

201  ATTTTTCCCG CGCGGCTTGG GTCATGTGTT GAGCCACGAC GGAAAATGCG

251  GAGAAAGTTT ACAACCGGAT ATGCGGCAGC ACGGTGCGTT TACGGTCAAG

301  CAGTGCGGCA ACGGACAGGA TATGAGCCTG TTTTGCGCCC GTTTCCGCTA

351  CGACACCCAC GCCGATTTGA TGAACGGGCT GCCTGAAACC GTTTTTCTGA

401  ACATTGCCCA TCCGAGTTTA CAGTATGTGG TTTCAATGCT GCAACTGGAA

451  AGCAAAAAAC CTTTGACGGG GACGGTTTCC ATGGTCAACG CATTGTCGTC

501  CGTCCTGCTG GTGCTTATCC TGCGCGCCTA TCTCGAACAG GATAAGGATG

551  TCGAACTCTC GGGCGTATTG AAAGGTTGGC AGGACAAACG TTTGGGACAT

601  TTAATCCAAA AGGTGATAGA CAAACCGGAA GACGAATGGA ATGTCGACAA

651  AATGGTGGCG GCTGCCAATA TGTCGCGCGC GCAACTGATG CGCCGTTTCA

701  AAAGCCGGGT CGGACTCAGC CCGCACGCCT TTGTGAACCA TATCCGCCTG

751  CAAAAAGGCG CGTTGCTGCT GAAAAAAAAC CCGGATTCGG TTTTGTCGGT

801  CGCACTGTCG GTAGGCTTTC AGTCGGAAAC GCACTTCGGC AAGGCGTTCA

851  AACGGCAATA TCACGTTTCG CCGGGTCAAT ACCGGAAAGA AggCGGGCAA

901  AAATAA
```

This corresponds to the amino acid sequence <SEQ ID 664; ORF 160>:

```
m160.pep
   1  MDILDKLVDF AQLTGSVDVQ CLLGGQWSVR HETLQREGLV HIVTSGSGYL

51  CIDGETSPRP VSTGDIVFFP RGLGHVLSHD GKCGESLQPD MRQHGAFTVK

101  QCGNGQDMSL FCARFRYDTH ADLMNGLPET VFLNIAHPSL QYVVSMLQLE
```

-continued

```
151   SKKPLTGTVS MVNALSSVLL VLILRAYLEQ DKDVELSGVL KGWQDKRLGH

201   LIQKVIDKPE DEWNVDKMVA AANMSRAQLM RRFKSRVGLS PHAFVNHIRL

251   QKGALLLKKN PDSVLSVALS VGFQSETHFG KAFKRQYHVS PGQYRKEGGQ

301   K*
```

Computer analysis of this amino acid sequence gave the following results:
Homology with a Predicted ORF from *N. gonorrhoeae*
m160/g160 93.4% identity in 301 aa overlap

```
                  10         20         30         40         50         60
m160.pep  MDILDKLVDFAQLTGSVDVQCLLGGQWSVRHETLQREGLVHIVTSGSGYLCIDGETSPRP
          ||||||||| :|||||  :||||||||||     |||||||||||| :||||||||||||
g160      MDILDKLVDLAQLTGSADVQCLLGGQW---HETLQREGLVHIVTAGSGYLCIDGETSPRP
                  10         20         30            40         50

70         80         90        100        110        120
m160.pep  VSTGDIVFFPRGLGHVLSHDGKCGESLQPDMRQHGAFTVKQCGNGQDMSLFCARFRYDTH
          |:||||||||||||||||||||  ||||||||:||:|:| ||||||| ||||||||||||
g160      VGTGDIVFFPRGLGHVLSHDGKYGESLQPDIRQNGTFMVKQCGNGLDMSLFCARFRYDTH
                  60         70         80         90        100        110

130        140        150        160        170        180
m160.pep  ADLMNGLPETVFLNIAHPSLQYVVSMLQLESKKPLTGTVSMVNALSSVLLVLILRAYLEQ
          |||||||||||||||||||||||||||||||: |||||||:|||| ||||||||||||||
g160      ADLMNGLPETVFLNIAHPSLQYVVSMLQLESEKPLTGTVSVVNALPSVLLVLILRAYLEQ
                 120        130        140        150        160        170

190        200        210        220        230        240
m160.pep  DKDVELSGVLKGWQDKRLGHLIQKVIDKPEDEWNVDKMVAAANMSRAQLMRRFKSRVGLS
          ||||||||||||||||||||||||||||||||||:|||||||||||||||||||| :||
g160      DKDVELSGVLKGWQDKRLGHLIQKVIDKPEDEWNIDKMVAAANMSRAQLMRRFKSQVGLS
                 180        190        200        210        220        230

250        260        270        280        290        300
m160.pep  PHAFVNHIRLQKGALLLKKNPDSVLSVALSVGFQSETHFGKAFKRQYHVSPGQYRKEGGQ
          ||||||||||||||||||:|||||  |||||||||||||||||||||||||||||||||
g160      PHAFVNHIRLQKGALLLKTPDSVLEVALSVGFQSETHFGKAFKRQYHVSPGQYRKEGGQ
                 240        250        260        270        280        290 m160.pep  KX
          ||
g160      KX
```

The following partial DNA sequence was identified in *N. meningitidis* <SEQ ID 665>:

```
a160.seq
    1   ATGGACATTC TGGACAAACT GGTCGATTTC GCCCAATTGA CGGGCAGTGT

51   GGATGTGCAG TGCCTTTTGG GCGGACAATG GTCGGTACGG CATGAAACCT

101   TGCAACGCGA AGGATTGGTA CACATTGTTA CATCGGGCAG CGGCTATCTC

151   TGCATCGACG GCGAAACTTC CCCGCGTCCG GTCAGTACAG GGGATATTGT

201   ATTTTTCCCG CGCGGCTTGG GTCATGTGTT GAGCCACGAC GGAAAATGCG

251   GAGAAAGTTT ACAACCGGAT ATGCGGCAGC ACGGTGCGTT TACGGTCAAG

301   CAGTGCGGCA ACGGACAGGA TATGAGCCTG TTTTGCGCCC GTTTCCGCTA

351   CGACACCCAC GCCGATTTGA TGAACGGGCT GCCTGAAACC GTTTTTCTGA

401   ACATTGCCCA TCCGAGTTTA CAGTATGTGG TTTCAATGCT GCAACTGGAA

451   AGCAAAAAAC CTTTGACGGG GACGGTTTCC ATGGTCAACG CATTGTCGTC

501   CGTCCTGCTG GTGCTTATCC TGCGCGCCTA TCTCGAACAG GATAAGGATG

551   TCGAACTCTC GGGCGTATTG AAAGGTTGGC AGGACAAACG TTTGGGACAT

601   TTAATCCAAA AGGTGATAGA CAAACCGGAA GACGAATGGA ATGTCGACAA

651   AATGGTGGCG GCTGCCAATA TGTCGCGCGC GCAACTGATG CGCCGTTTCA
```

-continued

```
701   AAAGCCGGGT CGGACTCAGC CCGCACGCCT TTGTGAACCA TATCCGCCTG

751   CAAAAAGGCG CGTTGCTGCT GAAAAAAAAC CCGGATTCGG TTTTGTCGGT

801   CGCACTGTCG GTAGGCTTTC AGTCGGAAAC GCACTTCGGC AAGGCGTTCA

851   AACGGCAATA TCACGTTTCG CCGGGTCAAT ACCGGAAAGA AGGCGGGCAA

901   AAATAA
```

This corresponds to the amino acid sequence <SEQ ID 666; ORF 160.a>:

```
a160.pep
    1   MDILDKLVDF AQLTGSVDVQ CLLGGQWSVR HETLQREGLV HIVTSGSGYL

51   CIDGETSPRP VSTGDIVFFP RGLGHVLSHD GKCGESLQPD MRQHGAFTVK

101   QCGNGQDMSL FCARFRYDTH ADLMNGLPET VFLNIAHPSL QYVVSMLQLE

151   SKKPLTGTVS MVNALSSVLL VLILRAYLEQ DKDVELSGVL KGWQDKRLGH

201   LIQKVIDKPE DEWNVDKMVA AANMSRAQLM RRFKSRVGLS PHAFVNHIRL

251   QKGALLLKKN PDSVLSVALS VGFQSETHFG KAFKRQYHVS PGQYRKEGGQ

301   K*
``` m160/a160 100.0% identity in 301 aa overlap

```
                 10         20         30         40         50         60
    m160.pep  MDILDKLVDFAQLTGSVDVQCLLGGQWSVRHETLQREGLVHIVTSGSGYLCIDGETSPRP
              ||||||||||||||||||||||||||||||||||||||||||||||  |||||||| |||
    a160      MDILDKLVDFAQLTGSVDVQCLLGGQWSVRHETLQREGLVHIVTSGCGYLCIDGETCPRP
                 10         20         30         40         50         60

70         80         90        100        110        120
    m160.pep  VSTGDIVFFPRGLGHVLSHDGKCGESLQPDMRQHGAFTVKQCGNGQDMSLFCARFRYDTH
              ||||||||||||||||||||||||||||||||||||||||||||||||||||||||||||
    a160      VSTGDIVFFPRGLGHVLSHDGKCGESLQPDMRQHGAFTVKQCGNGQDMSLFCARFRYDTH
                 70         80         90        100        110        120

130        140        150        160        170        180
    m160.pep  ADLMNGLPETVFLNIAHPSLQYVVSMLQLESKKPLTGTVSMVNALSSVLLVLILRAYLEQ
              ||||||||||||||||||||||||||||||||||||||||||||||||||||||||||||
    a160      ADLMNGLPETVFLNIAHPSLQYVVSMLQLESKKPLTGTVSMVNALSSVLLVLILRAYLEQ
                130        140        150        160        170        180

190        200        210        220        230        240
    m160.pep  DKDVELSGVLKGWQDKRLGHLIQKVIDKPEDEWNVDKMVAAANMSRAQLMRRFKSRVGLS
              |||||||||||||||||||||||||||||||||||| |||||||||||||||||||||||
    a160      DKDVELSGVLKGWQDKRLGHLIQKVIDKPEDEWMVDKMVAAANMSRAQLMRRFKSRVGLS
                190        200        210        220        230        240

250        260        270        280        290        300
    m160.pep  PHAFVNHIRLQKGALLLKKNPDSVLSVALSVGFQSETHFGKAFKRQYHVSPGQYRKEGGQ
              ||||||||||||||||||||||||||||||||||||||||||||||||||||||||||||
    a160      PHAFVNHIRLQKGALLLKKNPDSVLSVALSVGFQSETHFGKAFKRQYHVSPGQYRKEGGQ
                250        260        270        280        290        300 m160.pep  KX
              ||
    a160      KX
```

The following partial DNA sequence was identified in *N. gonorrhoeae* <SEQ ID 667>:

```
g161.seq
    1   ATGGATACCG CAAAAAAAGA CATTTTAGGA TCGGGCTGGA TGCTGGTGGC

51   GGCGGCCTGC TTCACCGTTA TGAACGTATT GATTAAAGAG GCATCGGCAA

101   AATTTGCCCT CGGCAGCGGC GAATTGGTCT TTTGGCGCAT GCTGTTTTCA

151   ACCGTTACGC TCGGTGCTGC CGCCGTATTG CGGCGCGACA CCTTCCGCAC

201   GCCCCATTGG AAAAACCACT TAAACCGCAG TATGGTCGGG ACGGGGGCGA
```

-continued

```
251  TGCTGCTGCT GTTTTACGCG GTAACGCATC TGCCTTTGAC AACCGGCGTT

301  ACCCTGAGTT ACACCTCGTC GATTTTTttg GCGGTATTTT CCTTCCTGAT

351  TTTGAAAGAA CGGATTTCCG TTTACACGCA GGCGGTGCTG CTCCTTGGTT

401  TTGCCGGCGT GGTATTGCTG CTTAATCCCT CGTTCCGCAG CGGTCAGGAA

451  CCGGCGGCAC TCGCCGGGCT GGCGGGCGGC GCGATGTCCG GCTGGGCGTA

501  TTTGAAAGTG CGCGAACTGT CTTTGGCGGG CGAACCCGGC TGGCGCGTCG

551  TGTTTTACCT TTCCGCAACC GGCGTGGCGA TGTCGTCggt ttgggcgacg

601  Ctgaccggct ggCACAcccT GTCCTTTcca tcggcagttt ATCtgtCGGG

651  CATCGGCGTG tccgcgCtgA TTGCCCAaCT GtcgatgAcg cGCGcctaca 701  aaGTCGGCGA CAAATTCACG GTTGCCTCGC tttcctaTAt gaccgtcGTC 751  TTTTCCGCCC TGTCTGCCGC ATTTTTTCTg ggcgaagagc ttttctggCA 801  GGAAATACTC GGTATGTGCA TCATTATcct CAGCGGCATT TTGAGCAGCA

851  TCCGCCCCAT TGCCTTCAAA CAGCGGCTGC AAGCCCTCTT CCGCCAAAGA

901  TAA
```

This corresponds to the amino acid sequence <SEQ ID 668; ORF 161.ng>:

```
g161.pep
   1  MDTAKKDILG SGWMLVAAAC FTVMNVLIKE ASAKFALGSG ELVFWRMLFS

51  TVTLGAAAVL RRDTFRTPHW KNHLNRSMVG TGAMLLLFYA VTHLPLTTGV

101  TLSYTSSIFL AVFSFLILKE RISVYTQAVL LLGFAGVVLL LNPSFRSGQE

151  PAALAGLAGG AMSGWAYLKV RELSLAGEPG WRVVFYLSAT GVAMSSVWAT

201  LTGWHTLSFP SAVYLSGIGV SALIAQLSMT RAYKVGDKFT VASLSYMTVV

251  FSALSAAFFL GEELFWQEIL GMCIIILSGI LSSIRPIAFK QRLQALFRQR

301  *
```

The following partial DNA sequence was identified in N. meningitidis <SEQ ID 669>:

```
m161.seq
   1  ATGGATACCG CAAAAAAAGA CATTTTAGGA TCGGGCTGGA TGCTGGTGGC

51  GGCGGCCTGC TTTACCATTA TGAACGTATT GATTAAAGAG GCATCGGCAA

101  AATTTGCCCT CGGCAGCGGC GAATTGGTCT TTTGGCGCAT GCTGTTTTCA

151  ACCGTTGCGC TCGGGGCTGC CGCCGTATTG CGTCGGGACA mCTTCCGCAC

201  GCCCCATTGG AAAAACCACT TAAACCGCAG TATGGTCGGG ACGGGGCGA

251  TGCTGCTGCT GTTTTACGCG GTAACGCATC TGCCTTTGGC CACTGGCGTT

301  ACCCTGAGTT ACACCTCGTC GATTTTTTTG GCGGTATTTT CCTTCCTGAT

351  TTTGAAAGAA CGGATTTCCG TTTACACGCA GGCGGTGCTG CTCCTTGGTT

401  TTGCCGGCGT GGTATTGCTG CTTAATCCCT CGTTCCGCAG CGGTCAGGAA

451  ACGGCGGCAC TCGCCGGGCT GGCGGGCGGC GCGATGTCCG GCTGGGCGTA

501  TTTGAAAGTG CGCGAACTGT CTTTGGCGGG CGAACCCGGC TGGCGCGTCG

551  TGTTTTACCT TTCCGTGACA GGTGTGGCGA TGTCGTCGGT TTGGGCGACG

601  CTGACCGGCT GGCACACCCT GTCCTTTCCA TCGGCAGTTT ATCTGTCGTG
```

-continued

```
651  CATCGGCGTG TCCGCGCTGA TTGCCCAACT GTCGATGACG CGCGCCTACA

701  AAGTCGGCGA CAAATTCACG GTTGCCTCGC TTTCCTATAT GACCGTCGTT

751  TTTTCCGCTC TGTCTGCCGC ATTTTTTCTG GGCGAAGAGC TTTTCTGGCA

801  GGAAATACTC GGTATGTGCA TCATCATCCT CAGCGGTATT TTGAGCAGCA

851  TCCGCCCCAC TGCCTTCAAA CAGCGGCTGC AATCCCTGTT CCGCCAAAGA

901  TAA
```

This corresponds to the amino acid sequence <SEQ ID 670; ORF 161>:

```
m161.pep
    1   MDTAKKDILG SGWMLVAAAC FTIMNVLIKE ASAKFALGSG ELVFWRMLFS

51   TVALGAAAVL RRDXFRTPHW KNHLNRSMVG TGAMLLLFYA VTHLPLATGV

101   TLSYTSSIFL AVFSFLILKE RISVYTQAVL LLGFAGVVLL LNPSFRSGQE

151   TAALAGLAGG AMSGWAYLKV RELSLAGEPG WRVVFYLSVT GVAMSSVWAT

201   LTGWHTLSFP SAVYLSCIGV SALIAQLSMT RAYKVGDKFT VASLSYMTVV

251   FSALSAAFFL GEELFWQEIL GMCIIILSGI LSSIRPTAFK QRLQSLFRQR

301   *
```

Computer analysis of this amino acid sequence gave the following results:
Homology with a Predicted ORF from *N. gonorrhoeae*
  m161/g161 97.0% identity in 300 aa overlap

```
                  10        20        30        40        50        60
    m161.pep  MDTAKKDILGSGWMLVAAACFTIMNVLIKEASAKFALGSGELVFWRMLFSTVALGAAAVL
              ||||||||||||||||||||||:|||||||||||||||||||||||||:||||||
    g161      MDTAKKDILGSGWMLVAAACFTVMNVLIKEASAKFALGSGELVFWRMIFSTVTLGAAAVL
                  10        20        30        40        50        60

70        80        90       100       110       120
    m161.pep  RRDXFRTPHWKNHLNRSMVGTGAMLLLFYAVTHLPLATGVTLSYTSSIFLAVFSFLILKE
              |||:||||||||||||||||||||||||||||||||:|||||||||||||||||||||
    g161      RRDTFRTPHWKNHLNRSMVGTGAMLLLFYAVTHLPLTTGVTLSYTSSIFLAVFSFLILKE
                  70        80        90       100       110       120

130       140       150       160       170       180
    m161.pep  RISVYTQAVLLLGFAGVVLLLNPSFRSGQSTAALAGLAGGAMSGWAYLKVRELSLAGEPG
              ||||||||||||||||||||||||||||| |||||||||||||||||||||||||||||
    g161      RISVYTQAVLLLGFAGVVLLLNPSFRSGQEPAALAGLAGGAMSGWAYLKVRELSLAGEPG
                 130       140       150       160       170       180

190       200       210       220       230       240
    m161.pep  WRVVFYLSVTGVAMSSVWATLTGWHTLSFPSAVYLSCIGVSALIAQLSMTRAYKVGDKFT
              ||||||||:||||||||||||||||||||||||||| |||||||||||||||||||||
    g161      WRVVFYLSATGVAMSSVWATLTGWHTLSFPSAVYLSGIGVSALIAQLSMTRAYKVGDKFT
                 190       200       210       220       230       240

250       260       270       280       290       300
    m161.pep  VASLSYMTVVFSALSAAFFLGEELFWQEILGMCIIILSGILSSIRPTAFKQRLQSLFRQR
              |||||||||| ||||||||||||||||||||||||||||||||||| |||||:|||||
    g161      VASLSYMTVVSALFSAAFFLGEELFWQEILGMCIIILSGILSSIRPIAFKQRLQALFRQR
                 250       260       270       280       290       300 m161.pep  X
              |
    g161      X
```

The following partial DNA sequence was identified in *N. meningitidis* <SEQ ID 671>:

```
a161.seq
    1   ATGGATACCG CAAAAAAGA CATTTTAGGA TCGGGCTGGA TGCTGGTGGC

51   GGCGGCCTGC TTTACCATTA TGAACGTATT GATTAAAGAG GCATCGGCAA
```

-continued

```
101    AATTTGCCCT CGGCAGCGGC GAATTGGTCT TTTGGCGCAT GCTGTTTTCA

151    ACCGTTGCGC TCGGGGCTGC CGCCGTATTG CGTCGGGACA CCTTCCGCAC

201    GCCCCATTGG AAAAACCACT TAAACCGCAG TATGGTCGGG ACGGGGGCGA

251    TGCTGCTGCT GTTTTACGCG GTAACGCATC TGCCTTTGGC CACCGGCGTT

301    ACCCTGAGTT ACACCTCGTC GATTTTTTTG GCGGTATTTT CCTTCCTGAT

351    TTTGAAAGAA CGGATTTCCG TTTACACGCA GGCGGTGCTG CTCCTTGGTT

401    TTGCCGGCGT GGTATTGCTG CTTAATCCCT CGTTCCGCAG CGGTCAGGAA

451    ACGGCGGCAC TCGCCGGGCT GGCGGGCGGC GCGATGTCCG GCTGGGCGTA

501    TTTGAAAGTG CGCGAACTGT CTTTGGCGGG CGAACCCGGC TGGCGCGTCG

551    TGTTTTACCT TTCCGTGACA GGTGTGGCGA TGTCATCGGT TTGGGCGACG

601    CTGACCGGCT GGCACACCCT GTCCTTTCCA TCGGCAGTTT ATCTGTCGTG

651    CATCGGCGTG TCCGCGCTGA TTGCCCAACT GTCGATGACG CGCGCCTACA

701    AAGTCGGCGA CAAATTCACG GTTGCCTCGC TTTCCTATAT GACCGTCGTT

751    TTTTCCGCTC TGTCTGCCGC ATTTTTTCTG GCCGAAGAGC TTTTCTGGCA

801    GGAAATACTC GGTATGTGCA TCATCATCCT CAGCGGTATT TTGAGCAGCA

851    TCCGCCCCAC TGCCTTCAAA CAGCGGCTGC AATCCCTGTT CCGCCAAAGA

901    TAA
```

This corresponds to the amino acid sequence <SEQ ID 672; ORF 161.a>:

```
a161.pep
  1    MDTAKKDILG SGWMLVAAAC FTIMNVLIKE ASAKFALGSG ELVFWRMLFS

51    TVALGAAAVL RRDTFRTPHW KNHLNRSMVG TGAMLLLFYA VTHLPLATGV

101    TLSYTSSIFL AVFSFLILKE RISVYTQAVL LLGFAGVVLL LNPSFRSGQE

151    TAALAGLAGG AMSGWAYLKV RELSLAGEPG WRVVFYLSVT GVAMSSVWAT

201    LTGWHTLSFP SAVYLSCIGV SALIAQLSMT RAYKVGDKFT VASLSYMTVV

251    FSALSAAFFL AEELFWQEIL GMCIIILSGI LSSIRPTAFK QRLQSLFRQR

301    *
``` m161/a161 99.3% identity in 300 aa overlap

```
                10         20         30         40         50         60
m161.pep  MDTAKKDILGSGWMLVAAACFTIMNVLIKEASAKFALGSGELVFWRMLFSTVALGAAAVL
          ||||||||||||||||||||||||||||||||||||||||||||||||||||||||||||
a161      MDTAKKDILGSGWMLVAAACFTIMNVLIKEASAKFALGSGELVFWRMLFSTVALGAAAVL
                10         20         30         40         50         60

70         80         90        100        110        120
m161.pep  RRDXFRTPHWKNHLNRSMVGTGAMLLLFYAVTHLPLATGVTLSYTSSIFLAVFSFLILKE
          |||:||||||||||||||||||||||||||||||||||||||||||||||||||||||||
a161      RRDTFRTPHWKNHLNRSMVGTGAMLLLFYAVTHLPLATGVTLSYTSSIFLAVFSFLILKE
                70         80         90        100        110        120

130        140        150        160        170        180
m161.pep  RISVYTQAVLLLGFAGVVLLLNPSFRSGQETAALAGLAGGAMSGWAYLKVRELSLAGEPG
          ||||||||||||||||||||||||||||||||||||||||||||| ||||||||||||||
a161      RISVYTQAVLLLGFAGVVLLLNPSFRSGQETAALAGLAGGAMSGWAYIKVRELSLAGEPG
               130        140        150        160        170        180

190        200        210        220        230        240
m161.pep  WRVVFYLSVTGVAMSSVWATLTGWHTLSFPPSAVYLSCIGVSALIAQLSMTRAYKVGDKFT
          ||||||||||||||||||||||||||||||||||||||||||||||||||||||||||||
a161      WRVVFYLSVTGVAMSSVWATLTGWHTLSFPPSAVYLSCIGVSALIAQLSMTRAYKVGDKFT
               190        200        210        220        230        240
```

```
                250       260       270       280       290       300
m161.pep  VASLSYMTVVFSALSAAFFLGEELFWQEILGMCIIILSGILSSIRPTAFKQRLQSLFRQR
          ||||||||||||||||||||||:|||||||||||||||||||||||||||||||||||||
a161      VASLSYMTVVFSALSAAFFLAEELFWQEILGMCIIILSGILSSIRPTAFKQRLQSLFRQR
                250       260       270       280       290       300 m161.pep  X
          |
a161      X
```

The following partial DNA sequence was identified in *N. gonorrhoeae* <SEQ ID 673>:

```
g163.seq
    1  ATGGTTATTT TGACGACTTT GTTTTTTGTG TGTGTTTTGG TGGTATTGGT
   51  TTTAACCGTG CCGGATCAGG TGCAGATGTG gctCGACCGG GCAAAAGAAG
  101  TCATTTTTAC CGAGTTCAGC TGGTTTTATG TTTTAACGTT TTCCATTTTt
  151  ctgGGTTTtc tgctGATACT CTCGGTCAGC GGTTTGGGAA ACATcagGCT
  201  AGGACGGGAT GAAGATGTGC CGGAATTCGG CTTCCTGTCG TGGCTGGCGA
  251  TGCTGTTTGC GGCCGGGATG GGCGTGGGCC TGATGTTTTT CGGCGTGGCA
  301  GAGCCGTTGA TGCATTATTT TTCGGACATT ACGGTCGGCG CGCCGGAACA
  351  CAGGCAGCAG CAGGCATTGC TGCACACGGT GTTCCATTGG GGCGTTCACG
  401  CCTGGTCGGT GTACGGTACG ATTGCATTGG CTTTGGCTTA TTTCGGTTTC
  451  CGCTACAAAC TGCCGCTTGC CCTGCGTTCT TGTTTTTACC CCCTGTTGAA
  501  AGAAAAAATT TCCGGAAGGT TCGGCGATGC CATTGATATT ATGGCGTTGC
  551  TTGCTACTTT TTTCGGCATC ATCACCACAT TGGGGTTCGG GGCTTCGCAA
  601  CTGGGCGCCG GATTGCAGGA AATGGGCTGG ATTGCCGAAA ACAGCTTCGG
  651  CGTGCAGGTC TTGATTATCG CCGCCGTAAT GTCCCTCGCC GTCGTTTCGG
  701  CAATATCCGG CGTGGGGAAG GGCGTGAAGG TGTTGAGCGA GTTGAACCTG
  751  GGCCTTGCGT TTTTGCTGCT GTTTTTTGTT TTGGCGGCGG ACCCCACTGT
  801  TTACCTGTTG TCGGCATTCG GCGACAACAT AGGGAACTAC CTCGGAAATC
  851  TGGTGCGCCT CAGTTTGAAA ACTTATGCGT ACGAACGGGA ACACAAGCCG
  901  TGGTTTGAAT CTTGGACGGT GCTTTATTGG GCGTGGTGGT GTTCTTGGgc
  951  gcCGTTTGTG GGTTTGTTTA TCGCGCGCAT TTCAAAGGGg cgcaccatCc
 1001  gcgagtttgt CTTCGGGGTT TTGCTCATCC CCGGCCTGTT CGGCGTTTTG
 1051  TGGTTTACCG TCTTCGGCAA TACGGCGATT TGGCTGAATG ACGGGGTTGC
 1101  GGGGGGAATG CTCGAAAAGA TGACCTCCTC TCCGGAAACG CTGCTTTTTA
 1151  AATTCTTTAA TTACCTCCCC CTGCCCGAAC TGACGAGCAT CGTCAGCCTG
 1201  CTGGTCATTT CCCTGTTTTT TGTAACTTCT GCCGACTCCG GGATTTATGT
 1251  CCTGAACAAT ATTACCTCTC GGGACAAAGG CTTGAGCGCG CCACGGTGGC
 1301  AGGCGGTTAT GTGGGGCGTG CTGatgtcTG CCGTTGCCGT TTTGCTGATG
 1351  CGCTCGGGCG GACTCGGCAA CCTGCAGTCT ATGACCCTGA TTGTTTCCCT
 1401  GCCGTTTGCC CTGCTGATGC TGATAATGTG TTTCAGCCTG TGGAAAGGCT
 1451  TGAGTGCGGA TAAGAAATAT TTTGAGACCC GGGTCAACCC TACCAGTGTA
 1501  TTTTGGACGG GCGGCAAGTG GAAAGAACGG CTGGTGCGGA TAATGAGCCA
 1551  GACGCAGGAG CAGGATATTT TAAAATTCCT CAAACATACC GCATCGCCCG
```

-continued

```
1601   CTATGCACGA GTTGCAACGG GAGCTTTCGG AAGAATACGG CTTGAGCGTC

1651   CGGGTCGATA AGATGTTTCA TCAGGACGAG CCCGCAATCG AGTTCGTCAT

1701   TCGGAAAGAG ACGATGCGCG ATTTTATGTA CGGGATTAAG TCTGTCGGGC

1751   AGGATGTATC CGACCAGTTG ATTAACGACG GCAAGCTGCC GCATATCCGG

1801   CACCAGACAA CTTACAAACC CTACGCTTAT TTTTTCGACG GGCGCGTCGG

1851   GTACGATGTG CAGTATATGA ACAAGGACGA GCTGATTGCC GACATTTTGA

1901   AAAACTACGA ACGTTATTTG ATGTTGTTGG ATGATGTCGG TCAGGAACTG

1951   ATGGCGCACG AGCAGGTGGA ATTGGCAGAG TAA
```

This corresponds to the amino acid sequence <SEQ ID 674; ORF 163.ng>:

```
g163.pep
   1   MVILTTLFFV CVLVVLVLTV PDQVQMWLDR AKEVIFTEFS WFYVLTFSIF

51   LGFLLILSVS GLGNIRLGRD EDVPEFGFLS WLAMLFAAGM GVGLMFFGVA

101   EPLMHYFSDI TVGAPEHRQQ QALLHTVFHW GVHAWSVYGT IALALAYFGF

151   RYKLPLALRS CFYPLLKEKI SGRFGDAIDI MALLATFFGI ITTLGFGASQ

201   LGAGLQEMGW IAENSFGVQV LIIAAVMSLA VVSAISGVGK GVKVLSELNL

251   GLAFLLLFFV LAADPTVYLL SAFGDNIGNY LGNLVRLSLK TYAYEREHKP

301   WFESWTVLYW AWWCSWAPFV GLFIARISKG RTIREFVFGV LLIPGLFGVL

351   WFTVFGNTAI WLNDGVAGGM LEKMTSSPET LLFKFFNYLP LPELTSIVSL

401   LVISLFFVTS ADSGIYVLNN ITSRDKGLSA PRWQAVMWGV LMSAVAVLLM

451   RSGGLGNLQS MTLIVSLPFA LLMLIMCFSL WKGLSADKKY FETRVNPTSV

501   FWTGGKWKER LVRIMSQTQE QDILKFLKHT ASPAMHELQR ELSEEYGLSV

551   RVDKMFHQDE PAIEFVIRKE TMRDFMYGIK SVGQDVSDQL INDGKLPHIR

601   HQTTYKPYAY FFDGRVGYDV QYMNKDELIA DILKNYERYL MLLDDVGQEL

651   MAHEQVELAE *
```

The following partial DNA sequence was identified in *N. meningitidis* <SEQ ID 675>:

```
m163.seq
   1   ATGGTTATTT TGACGACTTT GTTTTTTGTG TGTGTTTTGG TGGTATTGGT

51   TTTAACCGTG CCGGATCAGG TGCAGATGTG GCTCGATCGG GCAAAAGAAG

101   TCATTTTTAC CGAGTTCAGC TGGTTTTATG TTTTAACGTT TTCCATTTTT

151   CTGGGTTTCC TGCTGATACT CTCGGTCAGC AGTTTGGGAA ACATCAGGCT

201   CGGACGGGAT GAAGATGTGC CGGAATTCGG CTTCCTGTCG TGGCTGGCGA

251   TGCTGTTTGC GGCCGGGATG GGCGTGGGTC TGATGTTTTT CGGCGTGGCA

301   GAGCCGTTGA TGCATTATTT TTCGGACATT ACGGCCGGCA CGCCGGAACA

351   CAGGCAGCAG CAGGCATTGC TGCACACGGT GTTCCATTGG GGCGTTCACG

401   CTTGGTCGGT GTACGGTACG ATTGCATTGG CTTTGGCTTA TTTCGGTTTC

451   CGCTACAAGC TGCCGCTTGC CCTGCGTTCT TGTTTTTACC CCCTGTTGAA

501   AGAAAAAATT TCCGGAAGGT TCGGCGATGC CATTGATATT ATGGCGTTGC

551   TTGCTACTTT TTTCGGCATC ATCACCACAT TGGGGTTCGG GGCTTCGCAA
```

```
-continued
 601  CTGGGCGCCG GATTGCAGGA AATGGGCTGG ATTGCCGAAA ACAGCTTCAG

651  CGTGCAGGTT TTGATTATCG CCGCCGTCAT GTCCCTCGCC GTCGTTTCGG

701  CAATATCCGG CGTGGGGAAG GGCGTGAAGG TGTTGAGCGA GTTGAACCTG

751  GGCCTTGCGT TTTTGCTGCT GTTTTTTGTT TTGGCGGCGG GACCCACTGT

801  TTACCTGTTG TCGGCATTCG GCGACAACAT AGGGAACTAC CTCGGAAATC

851  TGGTGCGCCT CAGTTTTAAA ACTTATGCGT ACGAACGGGA ACACAAGCCG

901  TGGTTTGAAT CTTGGACGGT GCTTTATTGG GCGTGGTGGT GTTCTTGGGC

951  GCCGTTTGTG GGTTTGTTTA TCGCGCGCAT TTCAAAGGGG CGCACCATCC

1001  GCGAGTTTGT CTTCGGGGTT TTGCTCATCC CCGGCCTGTT CGGCGTTTTG

1051  TGGTTTACCG TCTTCGGCAA TACGGCGATT TGGCTGAATG ACGGGGTTGC

1101  GGGGGGAATG CTCGAAAAGA TGACCTCCTC TCCGGAAACG CTGCTTTTTA

1151  AATTCTTTAA TTACCTCCCC CTGCCCGAAT TGACGAGCAT CGTCAGCCTG

1201  CTGGTCATTT CTCTGTTTTT TGTAACTTCT GCCGATTCCG GGATTTATGT

1251  CCTGAACAAT ATTACCTCTC GGGACAAAGG CTTGAGCGCG CCACGGTGGC

1301  AGGCGGTTAT GTGGGGCGTG CTGATGTCTG CCGTTGCCGT TTTGCTGATG

1351  CGCTCGGGCG GACTCGGCAA CCTGCAGTCT ATGACCCTGA TTGTTTCCCT

1401  GCCGTTTGCC CTGCTGATGC TGATAATGTG TTTCAGCCTG TGGAAAGGCT

1451  TGAGTGCGGA TAAGAAATAT TTTGAGACCC GGGTTAACCC TACCAGTGTA

1501  TTTTGGACGG GCGGCAAGTG GAAAGAACGG CTGGTGCAGA TAATGAGCCA

1551  GACGCAGGAG CAGGATATTT TAAAATTCCT CAAACAGACT GCATCGCCCG

1601  CTATGCACGA GTTGCAACGG GAGCTTTCGG AAGAATACGG CTTGAGCGTC

1651  CGGGTCGATA AAATGTTTCA TCGGGACGAG CCCGCAATCG AGTTCGTCAT

1701  TCGGAAAGAG ACGATGCGCG ATTTTATGTA CGGGATTAAG TCTGTCGGGC

1751  AGGATGTATC CGACCAGTTG ATTAACGACG GCAAGCTGCC GCATATCCGG

1801  CATCAGACAA CTTACAAACC CTACGCTTAT TTTTTCGACG GGCGCGTCGG

1851  GTACGATGTG CAGTATATGA ACAAGGACGA GCTGATTGCC GACATTTTGA

1901  AAAACTACGA ACGTTATTTG ATGTTGTTGG ATGATGTCGG TCAGGAACTG

1951  ATGGCGCACG AGCAGGTGGA ATTGGCAGAG TAA
```

This corresponds to the amino acid sequence <SEQ ID 676; ORF 163>:

```
m163.pep
   1  MVILTTLFFV CVLVVLVLTV PDQVQMWLDR AKEVIFTEFS WFYVLTFSIF

51  LGFLLILSVS SLGNIRLGRD EDVPEFGFLS WLAMLFAAGM GVGLMFFGVA

101  EPLMHYFSDI TAGTPEHRQQ QALLHTVFHW GVHAWSVYGT IALALAYFGF

151  RYKLPLALRS CFYPLLKEKI SGRFGDAIDI MALLATFFGI ITTLGFGASQ

201  LGAGLQEMGW IAENSFSVQV LIIAAVMSLA VVSAISGVGK GVKVLSELNL

251  GLAFLLLFFV LAAGPTVYLL SAFGDNIGNY LGNLVRLSFK TYAYEREHKP

301  WFESWTVLYW AWWCSWAPFV GLFIARISKG RTIREFVFGV LLIPGLFGVL

351  WFTVFGNTAI WLNDGVAGGM LEKMTSSPET LLFKFFNYLP LPELTSIVSL

401  LVISLFFVTS ADSGIYVLNN ITSRDKGLSA PRWQAVMWGV LMSAVAVLLM
```

```
451  RSGGLGNLQS MTLIVSLPFA LLMLIMCFSL WKGLSADKKY FETRVNPTSV

501  FWTGGKWKER LVQIMSQTQE QDILKFLKQT ASPAMHELQR ELSEEYGLSV

551  RVDKMFHRDE PAIEFVIRKE TMRDFMYGIK SVGQDVSDQL INDGKLPHIR

601  HQTTYKPYAY FFDGRVGYDV QYMNKDELIA DILKNYERYL MLLDDVGQEL

651  MAHEQVELAE *
```

Computer analysis of this amino acid sequence gave the following results:
Homology with a Predicted ORF from *N. gonorrhoeae*
m163/g163 98.6% identity in 660 aa overlap

```
                 10        20        30        40        50        60
m163.pep  MVILTTLFFVCVLVVLVLTVPDQVQMWLDRAKEVIFTEFSWFYVLTFSIFLGFLLILSVS
          :|||||||||||||||||||||||||||||||||||||||||||||||||||||||||||
g163      MVILTTLFFVCVLVVLVLTVPDQVQMWLDRAKEVIFTEFSWFYVLTFSIFLGFLLILSVS
                 10        20        30        40        50        60

70        80        90       100       110       120
m163.pep  SLGNIRLGRDEDVPEFGFLSWLAMLFAAGMGVGLMFFGVAEPLMHYFSDITAGTPEHRQQ
          :|||||||||||||||||||||||||||||||||||||||||||||||||:|:||||||
g163      GLGNIRLGRDEDVPEFGFLSWLAMLFAAGMGVGLMFFGVAEPLMHYFSDITVGAPEHRQQ
                 70        80        90       100       110       120

130       140       150       160       170       180
m163.pep  QALLHTVFHWGVHAWSVYGTIALALAYFGFRYKLPLALRSCFYPLLKEKISGRFGDAIDI
          ||||||||||||||||||||||||||||||||||||||||||||||||||||||||||||
g163      QALLHTVFHWGVHAWSVYGTIALALAYFGFRYKLPLALRSCFYPLLKEKISGRFGDAIDI
                130       140       150       160       170       180

190       200       210       220       230       240
m163.pep  MALLATFFGIITTLGFGASQLGAGLQEMGWIAENSFSVQVLIIAAVMSLAVVSAISGVGK
          ||||||||||||||||||||||||||||||||||||||:|||||||||||||||:|||||
g163      MALLATFFGIITTLGFGASQLGAGLQEMGWIAENSFGVQVLIIAAVMSLAVVSAIGGVGK
                190       200       210       220       230       240

250       260       270       280       290       300
m163.pep  GVKVLSELNLGLAFLLLFFVLAAGPTVYLLSAFGDNIGNYLGNLVRLSFKTYAYEREHKP
          |||||||||||||||||||||||:||||||||||||||||||||||||:|||||||||||
g163      GVKVLSELNLGLAFLLLFFVLAADPTVYLLSAFGDNIGNYLGNLVRLSLKTYAYEREHKP
                250       260       270       280       290       300

310       320       330       340       350       360
m163.pep  WFESWTVLYWAWWCSWAPFVGLFIARISKGRTIREFVFGVLLIPGLFGVLWFTVFGNTAI
          ||||||||||||||||||||||||||||||||||||||||||||||||||||||||||||
g163      WFESWTVLYWAWWCSWAPFVGLFIARISKGRTIREFVFGVLLIPGLFGVLWFTVFGNTAI
                310       320       330       340       350       360

370       380       390       400       410       420
m163.pep  WLNDGVAGGMLEKMTSSPETLLFKFFNYLPLPELTSIVSLLVISLFFVTSADSGIYVLNN
          ||||||||||||||||||||||||||||||||||||||||||||||||||||||||||||
g163      WLNDGVAGGMLEKMTSSPETLLFKFFNYLPLPELTSIVSLLVISLFFVTSADSGIYVLNN
                370       380       390       400       410       420

430       440       450       460       470       480
m163.pep  ITSRDKGLSAPRWQAVMWGVLMSAVAVLLMRSGGLGNLQSMTLIVSLPFALLMLIMCFSL
          ||||||||||||||||||||||||||||||||||||||||||||||||||||||||||||
g163      ITSRDKGLSAPRWQAVMWGVLMSAVAVLLMRSGGLGNLQSMTLIVSLPFALLMLIMCFSL
                430       440       450       460       470       480

490       500       510       520       530       540
m163.pep  WKGLSADKKYFETRVNPTSVFWTGGKWKERLVQIMSQTQEQDILKFLKQTASPAMHELQR
          |||||||||||||||||||||||||||||||:|||||||||||||||:||||||||||||
g163      WKGLSADKKYFETRVNPTSVFWTGGKWKERLVRIMSQTQEQDILKFLKHTASPAMHELQR
                490       500       510       520       530       540

550       560       570       580       590       600
m163.pep  ELSEEYGLSVRVDKMFHRDEPAIEFVIRKETMRDFMYGIKSVGQDVSDQLINDGXLPHIR
          |||||||||||||||||||:||||||||||||||||||||||||||||||||||||||||
g163      ELSEEYGLSVRVDKMFHQDEPAIEFVIRKETMRDFMYGIKSVGQDVSDQLINDGKLPHIR
                550       560       570       580       590       600

610       620       630       640       650       660
m163.pep  HQTTYKPYAYFFDGRVGYDVQYMNKDELIADILKNYERYLMLLDDVGQELMAHEQVELAE
          ||||||||||||||||||||||||||||||||||||||||||||||||||||||||||||
g163      HQTTYKPYAYFFDGRVGYDVQYMNKDELIADILKNYERYLMLLDDVGQELMAHEQVELAE
                610       620       630       640       650       660 m163.pep  X
          |
g163      X
```

The following partial DNA sequence was identified in *N. meningitidis* <SEQ ID 677>:

a163.seq
```
   1 ATGGTTATTT TGACGACTTT GTTTTTGTG TGTGTTTTGG TGGTATTGGT
  51 TTTAACCGTG CCGGATCAGG TGCAGATGTG GCTCGATCGG GCAAAAGAAG
 101 TCATTTTTAC CGAGTTCAGC TGGTTTTATG TTTTAACGTT TTCCATTTTT
 151 CTGGGTTTCC TGCTGATACT CTCGGTCAGC AGTTTGGGAA ACATCAGGCT
 201 CGGACGGGAT GAAGATGTGC CGGAATTCGG CTTCCTGTCG TGGCTGGCGA
 251 TGCTGTTTGC GGCCGGGATG GGCGTGGGTC TGATGTTTTT CGGCGTGGCA
 301 GAGCCGTTGA TGCATTATTT TTCGGACATT ACGGCCGGCA CGCCGGAACA
 351 CAGGCAGCAG CAGGCATTGC TGCACACGGT GTTCCATTGG GGCGTTCACG
 401 CTTGGTCGGT GTACGGTACG ATTGCATTGG CTTTGGCTTA TTTCGGTTTC
 451 CGCTACAAGC TGCCGCTTGC CCTGCGTTCT TGTTTTTACC CCCTGTTGAA
 501 AGAAAAAATT TCCGGAAGGT TCGGCGATGC CATTGATATT ATGGCGTTGC
 551 TTGCTACTTT TTTCGGCATC ATCACCACAT TGGGGTTCGG GGCTTCGCAA
 601 CTGGGCGCCG GATTGCAGGA AATAGGCTGG ATTGCCGAAA ACAGCTTCAG
 651 CGTGCAGGTT TTGATTATCG CCGCCGTCAT GTCCCTCGCC GTCGTTTCGG
 701 CAATATCCGG CGTGGGGAAG GGTGTGAAGG TGTTGAGCGA GTTGAACCTG
 751 GGTCTTGCGT TTTTGCTGCT GTTTTTTGTT TTGGCGGCGG GTCCCACTGT
 801 TTACCTGTTG TCGGCATTCG GCGACAACAT AGGGAACTAC CTCGGAAATC
 851 TGGTGCGCCT CAGTTTTAAA ACTTATGCGT ACGAACGGGA ACACAAGCCG
 901 TGGTTTGAAT CTTGGACGGT GCTTTATTGG GCGTGGTGGT GTTCTTGGGC
 951 GCCGTTTGTG GGTTTGTTTA TCGCGCGCAT TTCAAAGGGG CGCACCATCC
1001 GCGAGTTTGT CTTCGGGGTT TTGCTCATCC CCGGCCTGTT CGGCGTTTTG
1051 TGGTTTACCG TCTTCGGCAA TACGCCGATT TGGCTGAATG ACGGGGTTGC
1101 GGGGGGAGTG CTCGAAAAGA TGACCTCCTC TCCGGAAACG CTGCTTTTTA
1151 AATTCTTTAA TTACCTCCCC CTGCCCGAAT TGACGAGCAT CGTCAGCCTG
1201 CTGGTCATTT CTCTGTTTTT TGTAACTTCT GCCGATTCCG GGATTTATGT
1251 CCTGAACAAT ATTACCTCTC GGGACAAAGG CTTGAGCGCG CCACGGTGGC
1301 AGGCGGTTAT GTGGGCGTG CTGATGTCTG CCGTTGCCGT TTTGCTGATG
1351 CGCTCGGGCG GACTCGGCAA CCTGCAGTCT ATGACCCTGA TTGTTTCCCT
1401 GCCGTTTGCC CTGCTGATGC TGATAATGTG TTTCAGCCTG TGGAAAGGAT
1451 TGAGTGCGGA TAAGAAATAT TTTGAGACCC GGGTTAACCC TACCAGTGTA
1501 TTTTGGACGG GCGGCAAGTG GAAAGAACGG CTGGTGCAGA TAATGAGCCA
1551 GACGCAGGAG CAGGATATTT TAAAATTCCT CAAACATACC GCATCGCCCG
1601 CTATGCACGA GTTACAACGG GAGCTTTCGG AAGAATACGG CTTGAGCGTC
1651 CGGGTCGATA AGATGTTTCA TCAGGACGAG CCCGCAATCG AGTTCGTCAT
1701 TCGGAAAGAG ACGATGCGCG ATTTTATGTA CGGGATTAAG TCTGTCGGGC
1751 AGGATGTATC CGACCAGTTG ATTAACGACG GCAAGCTGCC GCATATCCGG
1801 CATCAGACAA CTTACAAACC CTACGCTTAT TTTTTCGACG GGCGCGTCGG
1851 GTACGATGTG CAGTATATGA ACAAGGACGA GCTGATTGCC GACATTTTGA
1901 AAAACTACGA ACGTTATTTG ATGTTGTTGG ATGATGTCGG TCAGGAACTG
1951 ATGGCGCACG AGCAGGTGGA ATTGGCAGAG TAA
```

This corresponds to the amino acid sequence <SEQ ID 678; ORF 163.a>:

```
a163.pep
    1   MVILTTLFFV CVLVVLVLTV PDQVQMWLDR AKEVIFTEFS WFYVLTFSIF

51   LGFLLILSVS SLGNIRLGRD EDVPEFGFLS WLAMLFAAGM GVGLMFFGVA

101   EPLMHYFSDI TAGTPEHRQQ QALLHTVFHW GVHAWSVYGT IALALAYFGF

151   RYKLPLALRS CFYPLLKEKI SGRFGDAIDI MALLATFFGI ITTLGFGASQ

201   LGAGLQEIGW IAENSFSVQV LIIAAVMSLA VVSAISGVGK GVKVLSELNL

251   GLAFLLLFFV LAAGPTVYLL SAFGDNIGNY LGNLVRLSFK TYAYEREHKP

301   WFESWTVLYW AWWCSWAPFV GLFIARISKG RTIREFVFGV LLIPGLFGVL

351   WFTVFGNTAI WLNDGVAGGV LEKMTSSPET LLFKFFNYLP LPELTSIVSL

401   LVISLFFVTS ADSGIYVLNN ITSRDKGLSA PRWQAVMWGV LMSAVAVLLM

451   RSGGLGNLQS MTLIVSLPFA LLMLIMCFSL WKGLSADKKY FETRVNPTSV

501   FWTGGKWKER LVQIMSQTQE QDILKFLKHT ASPAMHELQR ELSEEYGLSV

551   RVDKMFHQDE PAIEFVIRKE TMRDFMYGIK SVGQDVSDQL INDGKLPHIR

601   HQTTYKPYAY FFDGRVGYDV QYMNKDELIA DILKNYERYL MLLDDVGQEL

651   MAHEQVELAE *
``` m163/a163 99.4% identity in 660 aa overlap

```
                  10         20         30         40         50         60
m163.pep  MVILTTLFFVCVLVVLVLTVPDQVQMWLDRAKEVIFTEFSWFYVLTFSIFLGFLLILSVG
          ||||||||||||||||||||||||||||||||||||||||||||||||||||||||||||
a163      MVILTTLFFVCVLVVLVLTVPDQVQMWLDRAKEVIFTEFSWFYVLTFSIFLGFLLILSVG
                  10         20         30         40         50         60

70         80         90        100        110        120
m163.pep  SLGNIRLGRDEDVPEFGFLSWLAMLFAAGMGVGLMFFGVAEPLMHYFSDITAGTPEHRQQ
          ||||||||||||||||||||||||||||||||||||||||||||||||||||||||||||
a163      SLGNIRLGRDEDVPEFGFLSWLAMLFAAGMGVGLMFFGVAEPLMHYFSDITAGTPEHRQQ
                  70         80         90        100        110        120

130        140        150        160        170        180
m163.pep  QALLHTVFHWGVHAWSVYGTIALALAYFGFRYKLPLALRSCFYPLLKEKISGRFGDAIDI
          ||||||||||||||||||||||||||||||||||||||||||||||||||||||||||||
a163      QALLHTVFHWGVHAWSVYGTIALALAYFGFRYKLPLALRSCFYPLLKEKISGRFGDAIDI
                 130        140        150        160        170        180

190        200        210        220        230        240
m163.pep  MALLATFFGIITTLGFGASQLGAGLQEMGWIAENSFSVQVLIIAAVMSLAVVSAISGVGK
          ||||||||||||||||||||||||||||||:||||||||||||||||||||||||||||||
a163      MALLATFFGIITTLGFGASQLGAGLQEIGWIAENSFSVQVLIIAAVMSLAVVSAIGGVGK
                 190        200        210        220        230        240

250        260        270        280        290        300
m163.pep  GVKVLSELNLGLAFLLLFFVLAAGPTVYLLSAFGDNIGNYLGNLVRLSFKTYAYEREHKP
          |||||||||||||||||||||||    ||||||||||||||||||||||||||||||||||
a163      GVKVLSELNLGLAFLLLFFVLAADPTVYLLSAFGDNIGNYLGNLVRLSFKTYAYEREHKP
                 250        260        270        280        290        300

310        320        330        340        350        360
m163.pep  WFESWTVLYWAWWCSWAPFVGLFIARISKGRTIREFVFGVLLIPGLFGVLWFTVFGNTAI
          ||||||||||||||||||||||||||||||||||||||||||||||||||||||||||||
a163      WFESWTVLYWAWWCSWAPFVGLFIARISKGRTIREFVFGVLLIPGLFGVLWFTVFGNTAI
                 310        320        330        340        350        360

370        380        390        400        410        420
m163.pep  WLNDGVAGGMLEKMTSSPETLLFKFFNYLPLPELTSIVSLLVISLFFVTSADSGIYVLNN
          ||||||||||:|||||||||||||||||||||||||||||||||||||||||||||||||
a163      WLNDGVAGGVLEKMTSSPETLLFKFFNYLPLPELTSIVSLLVISLFFVTSADSGIYVLNN
                 370        380        390        400        410        420

430        440        450        460        470        480
m163.pep  ITSRDKGLSAPRWQAVMWGVLMSAVAVLLMRSGGLGNLQSMTLIVSLPFALLMLIMCFSL
          ||||||||||||||||||||||||||||||||||||||||||||||||||||||||||||
a163      ITSRDKGLSAPRWQAVMWGVLMSAVAVLLMRSGGLGNLQSMTLIVSLPFALLMLIMCFSL
                 430        440        450        460        470        480
```

```
                  490        500        510        520        530        540
m163.pep   WKGLSADKKYFETRVNPTSVFWTGGKWKERLVQIMSQTQEQDILKFLKQTASPAMHELQR
           ||||||||||||||||||||||||||||||||||||||||||:|||||||||||||
a163       WKGLSADKKYFETRVNPTSVFWTGGKWKERLVQIMSQTQEQDILKFLKHTASPAMHELQR
                  490        500        510        520        530        540

550        560        570        580        590        600
m163.pep   ELSEEYGLSVRVDKMFHRDEPAIEFVIRKETMRDFMYGIKSVGQDVSDQLINDGXLPHIR
           ||||||||||||||||:|||||||||||||||||||||||||||||||||||| ||||
a163       ELSEEYGLSVRVDKMFHQDEPAIEFVIRKETMRDFMYGIKSVGQDVSDQLINDGKLPHIR
                  550        560        570        580        590        600

610        620        630        640        650        660
m163.pep   HQTTYKPYAYFFDGRVGYDVQYMNKDELIADILKNYERYLMLLDDVGQELMAHEQVELAE
           ||||||||||||||||||||||||||||||||||||||||||||||||||||||||||||
a163       HQTTYKPYAYFFDGRVGYDVQYMNKDELIADILKNYERYLMLLDDVGQELMAHEQVELAE
                  610        620        630        640        650        660 m163.pep   X
           |
a163       X
```

The following partial DNA sequence was identified in *N. gonorrhoeae* <SEQ ID 679>:

```
g164.seq (partial)
   1   ..ATGAACACAT TTTTGAAAAA CAGCGAATAC GCGTATATCC TGAACGACTG

51     CAAGGCGCGC TTCCTGTTCG CCTCGGCCGG CCTGTCAAAA GAATTGGCGG

101     GCCTGAAGGC GCAAACGCCC GTCGAAAAAA TCATTTGGAC GGACAAAAGC

151     CGGCCGGCCG GCGAAACGGC GGAAGGCGAT GCCTTTTTTG AAAACGTGCG

201     CCGCTTCCCC GAAAAACCCG ACTTGGGCCG CCAACCCCGG ATAAATGATT

251     TGGCACACAT CATCTACACC TCCGGCACGA CGGGGCATCC CAAAGGCGCG

301     CTAATCAGTT ACGCCAACCT GTTCGCCAAC CTGAACGGCA TCGAACGCAT

351     CTTtaaAATT TCCAAACGCG ACCGCTTTAT CGTTTTCctg ccgatgTTCC

401     ACAGCTTCAC GCTGACGGCT ATGGTGCTGC TGCCGATTTA TATGGCGTGT

451     TCGATTATTT TGGTCAAAtc cgttttCCCc ttttccaacG TTTTGAAACA

501     GGCCCTGCTC AAACGCGCAA CCGTGTTTTT GGGCGTACCC GCGATTTACA

551     CCGCGATGAG CAAGGCAAAA ATCCCTTGGT ATTTCAGATG GTTCAACCGC

601     ATCCGCCTGT TTATCAGCGG CGGCGCGCCT TTGGCGGAAC AAACCATCCT

651     CGATTTTAAA GCCAAGTTCC CCCGCGCCAA ATTGCTGGAA GGCTACGGAC

701     TGAGCGAAGC CTCGCCCGTC GTCGCCGTCA ATACGCCCGA ACGGCAAAAA

751     GCCCGCAGCG TCGGCATCCC CCTGCCCGGT TTGGAAGCCA AAGCCGTCGA

801     TGAAGAATTG GTCGAAGTGC CGCGCGGCGA AGTGGGCGAA CTGATCGTCA

851     GGGGCGGTTC GGTGATGCGG GGCTACCTCA ATATGCCTGC CGCCACCGAT

901     GAAACCATCG TCAACGGCTG GTTGAAAACG GCGATTTCG TTACCATAGA

951     CGAGGACGGC TTTATCTTTA TCGTCGACCG CAAAAAAGAT TTGATTATTT

1001     CCAAGGTCA AAACGTCTAT CCGCGCGAGA TCGAAGAAGA AATCCACAAA

1051     CTCGATGCCG TCGAAGCCGC CGCCGTCATC GGCGTGAAAG ACCGTTATGC

1101     CGACGAGGAA ATCGTCGCCT TCGTCCAATT GAAGGAAGGT ATGGATTTGG

1151     GCGAGGACGA aatccgccgc caccTGCGTA CCGTGCTGGC AAATTTCAAA

1201     ATCCCCAAAC AGATCCACTT TAAAGACGGG CTGCCGCGCA ACGCTACGGG

1251     CAAAGTATTG AAACGGGTGC TGAAGGAGCA GTTTGAAGGA AACAAATGA
```

This corresponds to the amino acid sequence <SEQ ID 680; ORF 164.ng>:

g164.pep (partial)
```
  1   ..MNTFLKNSEY AYILNDCKAR FLFASAGLSK ELAGLKAQTP VEKIIWTDKS
 51   RPAGETAEGD AFFENVRRFP EKPDLGRQPR INDLAHIIYT SGTTGHPKGA
101   LISYANLFAN LNGIERIFKI SKRDRFIVFL PMFHSFTLTA MVLLPIYMAC
151   SIILVKSVFP FSNVLKQALL KRATVFLGVP AIYTAMSKAK IPWYFRWFNR
201   IRLFISGGAP LAEQTILDFK AKFPRAKLLE GYGLSEASPV VAVNTPERQK
251   ARSVGIPLPG LEAKAVDEEL VEVPRGEVGE LIVRGGSVMR GYLNMPAATD
301   ETIVNGWLKT GDFVTIDEDG FIFIVDRKKD LIISKGQNVY PREIEEEIHK
351   LDAVEAAAVI GVKDRYADEE IVAFVQLKEG MDLGEDEIRR HLRTVLANFK
401   IPKQIHFKDG LPRNATGKVL KRVLKEQFEG NK*
```

The following partial DNA sequence was identified in *N. meningitidis* <SEQ ID 681>:

m164.seq
```
   1  ATGAACCGGA CTTATGCCAA TTTCTACGAA ATGCTCGCCG CCGCCTGCCG
  51  CAAAAACGGA AACGGCACGG CAGTGTTCGA CGGCAAGGAA AAAACCGCCT
 101  ACCGCGCGCT CAAGCAGGAG GCCGAAGCCG TCGCGGCGTA TCTGCAAAAT
 151  ATCGGCGTGA AGTTCGGCGA CACGGTCGCG CTGGCGGTTT CCAATTCCAC
 201  AGAATTTATT ACCGCCTATT TCGCCATCTC CGCCATCGGC GCGGTCGCCG
 251  TACCGATGAA CACATTTTTG AAAAACAGCG AATACGCGTA TATCCTGAAC
 301  GACTGCAAGG CGCGCTTCCT GTTCGCCTCG GCCGGCCTGT CAAAAGAATT
 351  GGCGGGCTTG AAGGCGCAAA CGCCCGTCGA AAAAATCATT TGGACGGACA
 401  AAAGCCGTCC GACCGGCGAA ACGGCGGAAG GCGATGCCTT TTTTGAAGAC
 451  GTGCGCCGCT TCCCCGAAAA ACCCGACTTG GGCCGCCAAC CCCGGATAAA
 501  TGATTTGGCA CACATCATCT ACACCTCCGG CACGACGGGG CATCCCAAAG
 551  GCGCGCTAAT CAGTTACGCC AACCTGTTCG CCAACCTGAA CGGCATCGAA
 601  CGCATCTTTA AAATTTCCAA GCGCGACCGC TTTATCGTTT TCCTGCCGAT
 651  GTTCCACAGC TTCACGCTGA CGGCTATGGT GCTGCTGCCG ATTTATATGG
 701  CGTGTTCGAT TATTTTGGTC AAATCCGTTT TTCCGTTTTC CAACGTTTTG
 751  AAACAGACAC TGCTCAAACG CGCGACCGTG TTTTTGGGCG TACCCGCGAT
 801  TTACACCGCG ATGAGCAAGG CGAAAATCCC TTGGTATTTC AGATGGTTCA
 851  ACCGCATTCG CCTGTTTATC AGCGGCGGCG CGCCTTTGGC GGAACAAACC
 901  ATCCTCGATT TCAAAGCCAA GTTCCCCCGC GCCAAATTGC TGGAAGGCTA
 951  CGGACTGAGC GAAGCCTCTC CCGTCGTCGC CGTCAATACG CCCGAGAGGC
1001  AAAAAGCCCG CAGCGTCGGC ATCCCCCTGC CCGGTTTGGA AGCCAAAGCC
1051  GTCGATGAAG AATTGGTCGA AGTGCCGCGC GGCGAAGTGG GCGAACTGAT
1101  CGTCAGGGGC GGTTCGGTGA TGCGGGGCTA CCTCAATATG CCTGCCGCCA
1151  CCGATGAAAC CATCGTCAAC GGCTGGTTGA AAACGGGCGA TTTCGTTACC
1201  ATAGACGAAG ACGGCTTTAT CTTTATCGTC GACCGCAAAA AAGATTTGAT
1251  TATTTCCAAA GGTCAAAATG TCTATCCGCG CGAGATTGAA GAAGAAATCT
1301  ACAAACTCGA TGCCGTCGAA GCCGCCGCCG TCATCGGCGT GAAAGACCGT
1351  TATGCCGACG AGGAAATCGT CGCCTTCGTC CAATTGAAGG AAGGTATGGA
```

```
-continued
1401  TTTGGGCGAG AACGAAATCC GCCGCCACCT GCGTACCGTG CTGGCAAATT

1451  TCAAAATCCC CAAACAAATC CACTTTAAAG ACGGGCTGCC GCGCAACGCT

1501  ACGGGCAAGG TATTGAAACG GGTGTTGAAG GAGCAGTTTG ACGGAAACAA

1551  ATGA
```

This corresponds to the amino acid sequence <SEQ ID 682; ORF 164>:

```
m164.pep
   1   MNRTYANFYE MLAAACRKNG NGTAVFDGKE KTAYRALKQE AEAVAAYLQN

51   IGVKFGDTVA LAVSNSTEFI TAYFAISAIG AVAVPMNTFL KNSEYAYILN

101   DCKARFLFAS AGLSKELAGL KAQTPVEKII WTDKSRPTGE TAEGDAFFED

151   VRRFPEKPDL GRQPRINDLA HIIYTSGTTG HPKGALISYA NLFANLNGIE

201   RIFKISKRDR FIVFLPMFHS FTLTAMVLLP IYMACSIILV KSVFPFSNVL

251   KQTLLKRATV FLGVPAIYTA MSKAKIPWYF RWFNRIRLFI SGGAPLAEQT

301   ILDFKAKFPR AKLLEGYGLS EASPVVAVNT PERQKARSVG IPLPGLEAKA

351   VDEELVEVPR GEVGELIVRG GSVMRGYLNM PAATDETIVN GWLKTGDFVT

401   IDEDGFIFIV DRKKDLIISK GQNVYPREIE EEIYKLDAVE AAAVIGVKDR

451   YADEEIVAFV QLKEGMDLGE NEIRRHLRTV LANFKIPKQI HFKDGLPRNA

501   TGKVLKRVLK EQFDGNK*
```

Computer analysis of this amino acid sequence gave the following results:
Homology with a Predicted ORF from *N. gonorrhoeae* m164/g164 98.6% identity in 432 aa overlap

```
                      60         70         80         90        100        110
         m164.pep  GDTVALAVSNSTEFITAYFAISAIGAVAVPMNTFLKNSEYAYILNDCKARFLFASAGLSK
                                                 ||||||||||||||||||||||||||||||
         g164                                    MNTFLKNSEYAYILNDCKARFLFASAGLSK
                                                          10         20         30
                     120        130        140        150        160        170
         m164.pep  ELAGLKAQTPVEKIIWTDKSRPTGETAEGDAFFEDVRRFPEKPDLGRQPRINDLAHIIYT
                   ||||||||||||||||||||||||||:||||||||||:||||||||||||||||||||||
         g164     ELAGLKAQTPVEKIIWTDKSRPAGETAEGDAFFENVRRFPEKPDLGRQPRINDLAHIIYT
                           40         50         60         70         80         90
                     180        190        200        210        220        230
         m164.pep  SGTTGHPKGALISYANLFANLNGIERIFKISKRDRFIVFLPMFHSFTLTAMVLLPIYMAC
                   ||||||||||||||||||||||||||||||||||||||||||||||||||||||||||||
         g164     SGTTGHPKGALISYANLFANLNGIERIFKISKRDRFIVFLPMFHSFTLTAMVLLPIYMAC
                          100        110        120        130        140        150
                     240        250        260        270        280        290
         m164.pep  SIILVKSVFPFSNVLKQTLLKRATVFLGVPAIYTAMSKAKIPWYFRWFNRIRLFISGGAP
                   |||||||||||||||||:||||||||||||||||||||||||||||||||||||||||||
         g164     SIILVKSVFPFSNVLKQALLKRATVFLGVPAIYTAMSKAKIPWYFRWFNRIRLFISGGAP
                          160        170        180        190        200        210
                     300        310        320        330        340        350
         m164.pep  LAEQTILDFKAKFPRAKLLEGYGLSEASPVVAVNTPERQKARSVGIPLPGLEAKAVDEEL
                   ||||||||||||||||||||||||||||||||||||||||||||||||||||||||||||
         g164     LAEQTILDFKAKFPRAKLLEGYGLSEASPVVAVNTPERQKARSVGIPLPGLEAKAVDEEL
                          220        230        240        250        260        270
                     360        370        380        390        400        410
         m164.pep  VEVPRGEVGELIVRGGSVMRGYLNMPAATDETIVNGWLKTGDFVTIDEDGFIFIVDRKKD
                   ||||||||||||||||||||||||||||||||||||||||||||||||||||||||||||
         g164     VEVPRGEVGELIVRGGSVMRGYLNMPAATDETIVNGWLKTGDFVTIDEDGFIFIVDRKKD
                          280        290        300        310        320        330
                     420        430        440        450        460        470
         m164.pep  LIISKGQNVYPREIEEEIYKLDAVEAAAVIGVKDRYADEEIVAFVQLKEGMDLGENEIRR
                   ||||||||||||||||:|||||||||||||||||||||||||||||||||||||||:||||
         g164     LIISKGQNVYPREIEEEIHKLDAVEAAAVIGVKDRYADEEIVAFVQLKEGMDLGEDEIRR
                          340        350        360        370        380        390
```

```
                         480        490        500        510
m164.pep    HLRTVLANFKIPKQIHFKDGLPRNATGKVLKRVLKEQFDGNKX
            ||||||||||||||||||||||||||||||||||||:|||
g164        HLRTVLANFKIPKQIHFKDGLPRNATGKVLKRVLKEQFEGNKX
                         400        410        420        430
```

The following partial DNA sequence was identified in *N. meningitidis* <SEQ ID 683>:

```
a164.seq
    1  ATGAACCGGA CTTATGCCAA TTTCTACGAA ATGCTGACCG CCGCCTGCCG
   51  CAAAAACGGC AACGGCACGG CAGTGTTCGA CGGCAAGGAA AAAACCGCCT
  101  ACCGCGCGCT CAAGCAGGAA GCCGAAGCCG TTGCGGCGTA TCTGCAAAAT
  151  ATCGGCGTGA AGTTCGGCGA CACGGTCGCG CTGGCGGTTT CCAATTCCAC
  201  GGAATTTATT ACCGCCTATT TCGCCGTATC CGCCATCGGC GCGGTTGCCG
  251  TACCGATGAA CACATTTTTG AAAAACAGCG AATACGCGTA TATCCTGAAC
  301  GACTGCAAGG CGCGCTTCCT GTTCGCCTCG GCCGGCCTGT CAAAAGAATT
  351  GGCGGGCTTG AAGGCGCAAA CGCCCGTCGA AAAAATCATT TGGACGGGCC
  401  AAAGCCGTCC GGACGGCGAA ATGGCGGAAG GCGATGCCTT TTTTGAAGAC
  451  GTGCGCCGCT TCCCCGAAAA ACCCGACTTG GGCCGCCAAC CCCGGATAAA
  501  TGATTTGGCA CACATCATCT ACACCTCCGG CACGACGGGG CATCCCAAAG
  551  GTGCGCTAAT CAGCTACGCC AACCTGTTCG CCAACCTGAA CGGCATCGAA
  601  CGCATCTTTA AAATCTCCAA GCGCGACCGC TTTATCGTTT TCCTGCCGAT
  651  GTTCCACAGC TTCACGCTGA CGGCTATGGT GCTGCTGCCG ATTTATATGG
  701  CGTGTTCGAT TATTTTGGTC AAATCCGTTT TCCCCTTTTC CAACGTTTTG
  751  AAACAGGCAC TGCTCAAACG CGCGACCGTG TTTTTGGGCG TGCCCGCGAT
  801  TTACACCGCG ATGAGCAAGA CGAAAATCCC TTGGTATTTC AGATGGTTCA
  851  ACCGCATCCG CCTGTTTATC AGCGGCGGAG CACCTTTGGC GGAACAAACC
  901  ATCCTCGATT TCAAAGCCAA GTTCCCCCGC GCCAAATTGC TGGAAGGCTA
  951  CGGACTGAGC GAAGCCTCGC CCGTCGTCGC CGTCAATACG CCCGAGAGGC
 1001  AAAAAGCCCG CAGCGTCGGC ATCCCCCTGC CCGGTTTGGA AGTCAAAGCC
 1051  GTCGATGAAG AATTGGTCGA AGTGCCGCGC GGCGAAGTGG GCGAACTGAT
 1101  CGTCAGGGGC GGTTCGGTGA TGCGGGGCTA CCTCAATATG CCTGCCGCCA
 1151  CCGATGAAAC CATCGTCAAC GGCTGGTTGA AAACGGGCGA TTTCGTTACC
 1201  ATAGACGAAG ACGGCTTTAT CTTTATCGTC GACCGCAAAA AAGATTTGAT
 1251  TATTTCCAAA GGTCAAAATG TCTATCCGCG CGAAATCGAA GAAGAAATCT
 1301  ACAAACTCGA TGCCGTCGAA GCCGCCGCCG TCATCGGCGT GAAAGACCGT
 1351  TATGCCGACG AGGAAATCGT CGCCTTCGTC CAATTGAAGG AAGGTATGGA
 1401  TTTGGGCGAG AACGAAATCC GCCGCCACCT GCGTACCGTG CTGGCAAATT
 1451  TCAAAATCCC CAAACAAATC CACTTTAAAG ACGGGCTGCC GCGCAACGCT
 1501  ACGGGCAAGG TATTGAAACG GGTGTTGAAG GAGCAGTTTG ACGGAAACAA
 1551  ATGA
```

This corresponds to the amino acid sequence <SEQ ID 684; ORF 164.a>:

```
a164.pep
   1 MNRTYANFYE MLTAACRKNG NGTAVFDGKE KTAYRALKQE AEAVAAYLQN

51 IGVKFGDTVA LAVSNSTEFI TAYFAVSAIG AVAVPMNTFL KNSEYAYILN

101 DCKARFLFAS AGLSKELAGL KAQTPVEKII WTGQSRPDGE MAEGDAFFED

151 VRRFPEKPDL GRQPRINDLA HIIYTSGTTG HPKGALISYA NLFANLNGIE

201 RIFKISKRDR FIVFLPMFHS FTLTAMVLLP IYMACSIILV KSVFPFSNVL

251 KQALLKRATV FLGVPAIYTA MSKTKIPWYF RWFNRIRLFI SGGAPLAEQT

301 ILDFKAKFPR AKLLEGYGLS EASPVVAVNT PERQKARSVG IPLPGLEVKA

351 VDEELVEVPR GEVGELIVRG GSVMRGYLNM PAATDETIVN GWLKTGDFVT

401 IDEDGFIFIV DRKKDLIISK GQNVYPREIE EEIYKLDAVE AAAVIGVKDR

451 YADEEIVAFV QLKEGMDLGE NEIRRHLRTV LANFKIPKQI HFKDGLPRNA

501 TGKVLKRVLK EQFDGNK*
``` m164/a164 98.3% identity in 517 aa overlap

```
                10         20         30         40         50         60
m164.pep MNRTYANFYEMLAAACRKNGNGTAVFDGKEKTAYRALKQEAEAVAAYLQNIGVKFGDTVA
         |||||||||||:|||||||||||||||||||||||||||||||||||||||||||||||
a164     MNRTYANFYEMLTAACRKNGNGTAVFDGKEKTAYRALKQEAEAVAAYLQNIGVKFGDTVA
                10         20         30         40         50         60

70         80         90        100        110        120
m164.pep LAVSNSTEFITAYFAISAIGAVAVPMNTFLKNSEYAYILNDCKARFLFASAGLSKELAGL
         ||||||||||||||:|||||||||||||||||||||||||||||||||||||||||||||
a164     LAVSNSTEFITAYFAVSAIGAVAVPMNTFLKNSEYAYILNDCKARFLFASAGLSKELAGL
                70         80         90        100        110        120

130        140        150        160        170        180
m164.pep KAQTPVEKIIWTDKSRPTGETAEGDAFFEDVRRFPEKPDLGRQPRINDLAHIIYTSGTTG
         |||||||||||:|||  ||||||||||||||||||||||||||||||||||||||||||
a164     KAQTPVEKIIWTDQSRPTGEMAEGDAFFEDVRRFPEKPDLGRQPRINDLAHIIYTSGTTG
               130        140        150        160        170        180

190        200        210        220        230        240
m164.pep HPKGALISYANLFANLNGIERIFKISKRDRFIVFLPMFHSFTLTAMVLLPIYMACSIILV
         ||||||||||||||||||||||||||||||||||||||||||||||||||||||||||||
a164     HPKGALISYANLFANLNGIERIFKISKRDRFIVFLPMFHSFTLTAMVLLPIYMACSIILV
               190        200        210        220        230        240

250        260        270        280        290        300
m164.pep KSVFPFSNVLKQTLLKRATVFLGVPAIYTAMSKAKIPWYFRWFNRIRLFISGGAPLAEQT
         |||||||||||:|||||||||||||||||||:||||||||||||||||||||||||||||
a164     KSVFPFSNVLKQALLKRATVFLGVPAIYTAMSKTKIPWYFRWFNRIRLFISGGAPLAEQT
               250        260        270        280        290        300

310        320        330        340        350        360
m164.pep ILDFKAKFPRAKLLEGYGLSEASPVVAVNTPERQKARSVGIPLPGLEAKAVDEELVEVPR
         |||||||||||||||||||||||||||||||||||||||||||||||:||||||||||||
a164     ILDFKAKFPRAKLLEGYGLSEASPVVAVNTPERQKARSVGIPLPGLEVKAVDEELVEVPR
               310        320        330        340        350        360

370        380        390        400        410        420
m164.pep GEVGELIVRGGSVMRGYLNMPAATDETIVNGWLKTGDFVTIDEDGFIFIVDRKKDLIISK
         ||||||||||||||||||||||||||||||||||||||||||||||||||||||||||||
a164     GEVGELIVRGGSVMRGYLNMPAATDETIVNGWLKTGDFVTIDEDGFIFIVDRKKDLIISK
               370        380        390        400        410        420

430        440        450        460        470        480
m164.pep GQNVYPREIEEEIYKLDAVEAAAVIGVKDRYADEEIVAFVQLKEGMDLGENEIRRHLRTV
         ||||||||||||||||||||||||||||||||||||||||||||||||||||||||||||
a164     GQNVYPREIEEEIYKLDAVEAAAVIGVKDRYADEEIVAFVQLKEGMDLGENEIRRHLRTV
               430        440        450        460        470        480

490        500        510
m164.pep LANFKIPKQIHFKDGLPRNATGKVLKRVLKEQFDGNKX
         |||||||||||||||||||||||||||||||||||||
a164     LANFKIPKQIHFKDGLPRNATGKVLKRVLKEQFDGNKX
               490        500        510
```

The following partial DNA sequence was identified in *N. gonorrhoeae* <SEQ ID 685>:

```
g165.seq
     1  ATGGCTGAAG CGACAGACGT TGTCTTGGTG GGCGGCGGCA TTATGAGCGC
    51  GACTTTGGGC GTTTTGCTCA AAGAACTCGA ACCGTCTTGG GAAATCACCC
   101  TGATTGAACG CTTGGAagat gTGGCGTTGG AATCGTCAAA cGCGTGGAAC
   151  AACGcCGgca CGGGGCATTC CGcGCTGTGc GAATTGAACT AtgcgccGCT
   201  GGGtgcggac ggcgtcatCA ATCCGGCGCg cgCCCTGAAT ATTGCCGAAC
   251  AGTTTCATGT CAGCCGCCAG TTTTGGGcga cgctgGTCGC GGAAGGCAAG
   301  TTGGAagaCA ATTCCTTCAT CAATGCcgtg ccgcatatGT Ctttggtgat
   351  gAacgaagac cactgCCgtt acCTGCAAAA ACGCTATGAT GTGTTTAAAA
   401  CGCAGAAACT TTTTGAAAAT ATGGAATTTT CCACCGATCG GAACAAAATT
   451  TCCGATTGGG CtccgCTGAT TATGCGCGGC CGGgacgaaA ACCAACCCGT
   501  CGCCGCCAAC TATTCCGCCG Aaggcacgga tgtcgATTTC GGACGGCTGA
   551  CGCGCCAGAT GGTGAAATAT TTGCAGGGCA AGGGCGTAAA AACCGAGTTC
   601  AACCGCCACG TCGAAGACAT CAAACGCGAA TCCGACGGCG CGTGGGTGCT
   651  CAAAACCGCC GATACCCGCA ACCCAGACTG GCAGCTCACC CTCCGCACCC
   701  GCTTCCTCTT CCTCGGCGCG GGCGGCGGCG CACTGACCCT GCTGCAAAAA
   751  TCCGGCATCC CCGAAGGCAA AGGCTACGGC GGCTTACCCG TGTCCGGCCT
   801  GTTCTTCCGC AACAGCAACC CCGAAACCGC CGAACAACAC AACGCCAAAG
   851  TGTACGGGCA GGCTTCCGTC GGCGCGCCGC CGATGTCCGT CCCGCACCTC
   901  GACACACGCA ACGTAGACGG CAAACGACAC CTTATGTTCG GTCCTTACGC
   951  AGGTTTCCGT TCCAACTTCC TCAAGCAAGG CTCGTTTATG GATTTGCCGC
  1001  TGTCCATCCA TATGGACAAC CTCTATCCTA TGCTGCGCGC CGGCTGGGCG
  1051  AATATGCCGC TGACCAAATA CcTGCTGGgC gAaTTGCgtt aa
```

This corresponds to the amino acid sequence <SEQ ID 686; ORF 165.ng>:

```
g165.pep
     1  MAEATDVVLV GGGIMSATLG VLLKELEPSW EITLIERLED VALESSNAWN
    51  NAGTGHSALC ELNYAPLGAD GVINPARALN IAEQFHVSRQ FWATLVAEGK
   101  LEDNSFINAV PHMSLVMNED HCRYLQKRYD VFKTQKLFEN MEFSTDRNKI
   151  SDWAPLIMRG RDENQPVAAN YSAEGTDVDF GRLTRQMVKY LQGKGVKTEF
   201  NRHVEDIKRE SDGAWVLKTA DTRNPDWQLT LRTRFLFLGA GGGALTLLQK
   251  SGIPEGKGYG GLPVSGLFFR NSNPETAEQH NAKVYGQASV GAPPMSVPHL
   301  DTRNVDGKRH LMFGPYAGFR SNFLKQGSFM DLPLSIHMDN LYPMLRAGWA
   351  NMPLTKYLLG ELR*
```

The following partial DNA sequence was identified in *N. meningitidis* <SEQ ID 687>:

```
m165.seq (partial)
     1  ATGGCTGAAG CGACAGACGT TGTCTTGGTG GGCGGCGGCA TTATGAGCGC
    51  GACTTTGGGC GTTTTGCTCA AAGAACTCGA ACCGTCTTGG GAAATCACCC
   101  TGATTGAACG CTTGGAAGAT GTGGCGTTGG AATCGTCAAA CGCGTGGAAC
   151  AACGCCGGCA CGGGGCATTC CGCGCTGTGC GAATTGAACT ATGCGCCGTT
```

```
 201   GGGTGCAAAT GGGATTATCG ATCCGGCGCG CGCCCTCAAT ATTGCCGAAC

251   AGTTTCATGT CAGCCGCCAG TTTTGGGCGA CGCTGGTCGC GGAAGGCAAG

301   TTGGAAGACA ATTCCTTCAT CAATGCCGTG CCGCATATGT CTTTGGTGAT

351   GAATGAAGAC CATTGTTCTT ATCTTCAAAA ACGTTATGAC GCGTTTAAAA

401   CCCAAAAACT TTTTGAAAAT ATGGAATTTT CCACCGATCG GAACAAAATT

451   TCCGATTGGG CTCCGCTGAT GATGCGCGGC CGGGACGAAA ACCAACCCGT

501   CGCCGCCAAC TACTCCGCCG AAGgTACGGA TGTCGATTTC GGACGGCTGA

551   CGCGCCAAAT GGTGAAATAT TTGCAGGGCA AGGGCGTAAA AACCGAGTTC

601   AACCGCCACG TCGAAGACAT CAAACGCGAA TCCGACGGCG CGTGGGTGCT

651   CAAAACCGCC GATACCCGCA ACCCCGACGG GCAGCTCACC CTCCGTACCC

701   GCTTCCTCTT CCTCGGCGCG GGCGGCGGCG CGCTGACCCT GCTGCAAAAA

751   TCCGGCATCC CCGAAGGCAA AGGCTACGGC GGCTTCCCCG TGTCCGGCCT

801   GTTCTTCCGC AACAGCAACC CCGAAACCGC CGAACAACAC AACGCCAAAG

851   TGTACGGGCA GGCTTCCGTC GGCGCGCCGC CGATGTCCGT CCCGCACCTC

901   GACACACGCA ACGTGGACGG CAAACGCCAC CTTATGTTCG GCCCTTACGC

951   AGGCTTCCGT TCCAACTTCC TCAAGCAAGG CTCGCTTATG GATTTGCCGC

1001   TGTCCATCCA TATGGACAAC CTCTATCCTA TGCTGTGCGC CGGCTGGGCG

1051   AATATGCCGC TGACCAAA...
```

This corresponds to the amino acid sequence <SEQ ID 688; ORF 165>:

```
m165.pep (partial)
     1   MAEATDVVLV GGGIMSATLG VLLKELEPSW EITLIERLED VALESSNAWN

51   NAGTGHSALC ELNYAPLGAN GIIDPARALN IAEQFHVSRQ FWATLVAEGK

101   LEDNSFINAV PHMSLVMNED HCSYLQKRYD AFKTQKLFEN MEFSTDRNKI

151   SDWAPLMMRG RDENQPVAAN YSAEGTDVDF GRLTRQMVKY LQGKGVKTEF

201   NRHVEDIKRE SDGAWVLKTA DTRNPDGQLT LRTRFLFLGA GGGALTLLQK

251   SGIPEGKGYG GFPVSGLFFR NSNPETAEQH NAKVYGQASV GAPPMSVPHL

301   DTRNVDGKRH LMFGPYAGFR SNFLKQGSLM DLPLSIHMDN LYPMLCAGWA

351   NMPLTK...
```

Computer analysis of this amino acid sequence gave the following results:
Homology with a Predicted ORF from *N. gonorrhoeae*
  m165/g165 97.2% identity in 356 aa overlap

```
                 10         20         30         40         50         60
m165.pep  MAEATDVVLVGGGIMSATLGVLLKELEPSWEITLIERLEDVALESSNAWNNAGTGHSALC
          ||||||||||||||||||||||||||||||||||||||||||||||||||||||||||||
    g165  MAEATDVVLVGGGIMSATLGVLLKELEPSWEITLIERLEDVALESSNAWNNAGTGHSALC
                 10         20         30         40         50         60

70         80         90        100        110        120
m165.pep  ELNYAPLGANGIIDPARALNIAEQFHVSRQFWATLVAEGKLEDNSFINAVPHMSLVMNED
          ||||||||||:|:|:|||||||||||||||||||||||||||||||||||||||||||||
    g165  ELNYAPLGADGVINPARALNIAEQFHVSRQFWATLVAEGKLEDNSFINAVPHMSLVMNED
                 70         80         90        100        110        120
```

-continued

```
                 130       140       150       160       170       180
m165.pep  HCSYLQKRYDAFKTQKLFENMEFSTDRNKISDWAPLMMRGRDENQPVAANYSAEGTDVDF
          || |||||||:|||||||||||||||||||||||||:|||||||||||||||||||||||
g165      HCRYLQKRYDVFKTQKLFENMEFSTDRNKISDWAPLIMRGRDENQPVAANYSAEGTDVDF
                 130       140       150       160       170       180

190       200       210       220       230       240
m165.pep  GRLTRQMVKYLQGKGVKTEFNRHVEDIKRESDGAWVLKTADTRNPDGQLTLRTRFLFLGA
          |||||||||||||||||||||||||||||||||||||||||||||| |||||||||||||
g165      GRLTRQMVKYLQGKGVKTEFNRHVEDIKRESDGAWVLKTADTRNPDWQLTLRTRFLFLGA
                 190       200       210       220       230       240

250       260       270       280       290       300
m165.pep  GGGALTLLQKSGIPEGKYGGFPVSGLFFRNSNPETAEQHNAKVYGQASVGAPPMSVPHL
          |||||||||||||||||||||:||||||||||||||||||||||||||||||||||||||
g165      GGGALTLLQKSGIPEGKYGGLPVSGLFFRNSNPETAEQHNAKVYGQASVGAPPMSVPHL
                 250       260       270       280       290       300

310       320       330       340       350
m165.pep  DTRNVDGKRHLMFGPYAGFRSNFLKQGSLMDLPLSIHMDNLYPMLCAGWANMPLTK
          ||||||||||||||||||||||||||||:|||||||||||||||| ||||||||||
g165      DTRNVDGKRHLMFGPYAGFRSNFLKQGSFMDLPLSIHMDNLYPMLRAGWANMPLTKYLLG
                 310       320       330       340       350       360 g165      ELRX
```

The following partial DNA sequence was identified in *N. meningitidis* <SEQ ID 689>:

```
a165.seq
     1  ATGGCTGAAG CGACAGACGT TGTCTTGGTG GGCGGCGGCA TTATGAGCGC

51  GACTTTGGGC GTTTTGCTCA AAGAACTCGA ACCGTCTTGG GAAATCACCC

101  TGATTGAACG CTTGGAAGAT GTGGCGTTGG AATCGTCAAA CGCGTGGAAC

151  AACGCCGGCA CGGGGCATTC CGCGCTGTGC GAATTGAACT ATGCGCCGTT

201  GGGTGCAAAT GGGATTATCG ATCCGGCGCG CGCCCTCAAT ATTGCCGAAC

251  AGTTTCATGT CAGCCGCCAG TTTTGGGCGA CGTTGGTCGC GGAAGGCAAG

301  TTGGAAGACA ATTCCTTCAT CAATGCCGTG CCGCATATGT CTTTGGTGAT

351  GAATGAAGAC CATTGTTCTT ATCTTCAAAA ACGTTATGAC GCGTTTAAAA

401  CCCAAAAACT TTTTGAAAAT ATGGAATTTT CCACCGATCG GAACAAAATT

451  TCCGATTGGG CTCCGCTGAT GATGCGCGGC CGGGACGAAA ACCAACCCGT

501  CGCCGCCAAC TACTCCGCCG AAGGCACGGA TGTCGATTTC GGACGGCTGA

551  CGCGCCAAAT GGTGAAATAT TTGCAGGGCA AGGGCGTAAA AACCGAGTTC

601  AACCGCCACG TCGAAGACAT CAAACGCGAA TCCGACGGCG CGTGGGTGCT

651  CAAAACCGCC GATACCCGCA ACCCCGACGG GCAGCTCACC CTCCGTACCC

701  GCTTCCTCTT CCTCGGCGCG GGCGGCGGCG CGCTGACCCT GCTGCAAAAA

751  TCCGGCATCC CCGAAGGCAA AGGCTACGGT GGCTTTCCCG TGTCCGGCCT

801  GTTCTTCCGC AACAGCAACC CCGAAACCGC CGAACAACAC AACGCCAAAG

851  TGTACGGGCA GGCTTCCGTC GGCGCGCCGC CGATGTCCGT CCCGCACCTC

901  GACACACGCA ACGTGGACGG CAAACGCCAC CTTATGTTCG GCCCTTACGC

951  AGGCTTCCGT TCCAACTTCC TCAAGCAAGG CTCACTTATG GATTTGCCGC

1001  TGTCCATCCA TATGGACAAC CTCTATCCTA TGCTGCGCGC CGGCTGGGCG

1051  AATATGCCGC TGACCAAATA CCTGCTGGGC GAATTGCGTA AAACCAAAGA

1101  AGAACGCTTC GCCTCCCTGC TGGAATACTA CCCCGAGGCA AACCCCGACG

1151  ACTGGGAACT CATCACCGCA GGGCAACGCG TTCAAATCAT TAAAAAAGAC

1201  TCCGAAAAAG GCGGCGTGTT GCAGTTTGGT ACGGAGATTG TCGCACACGC
```

```
1251 CGACGGCTCG CTCGCCGCAT TGCTGGGCGC GTCGCCGGGC GCATCGACCG

1301 CCGTGCCGCT GATGATCCGG CTGATGCACC AATGCTTCCC CGAACGCACC

1351 CCGTCTTGGG AAGGCCGTCT GAAAGAGCTG GTACCGGGTT ACGGCATCAA

1401 GTTGAACGAA AACCCCGAAA GGGCGGATGA AATTATCGCC TATACCGCGA

1451 AAGTGTTGGA TATTTAA
```

This corresponds to the amino acid sequence <SEQ ID 690; ORF 165.a>:

```
a165.pep
   1  MAEATDVVLV GGGIMSATLG VLKELEPSW  EITLIERLED  VALESSNAWN

51  NAGTGHSALC ELNYAPLGAN GIIDPARALN IAEQFHVSRQ FWATLVAEGK

101  LEDNSFINAV PHMSLVMNED HCSYLQKRYD AFKTQKLFEN MEFSTDRNKI

151  SDWAPLMMRG RDENQPVAAN YSAEGTDVDF GRLTRQMVKY LQGKGVKTEF

201  NRHVEDIKRE SDGAWVLKTA DTRNPDGQLT LRTRFLFLGA GGGALTLLQK

251  SGIPEGKGYG GFPVSGLFFR NSNPETAEQH NAKVYGQASV GAPPMSVPHL

301  DTRNVDGKRH LMFGPYAGFR SNFLKQGSLM DLPLSIHMDN LYPMLRAGWA

351  NMPLTKYLLG ELRKTKEERF ASLLEYYPEA NPDDWELITA GQRVQIIKKD

401  SEKGGVLQFG TEIVAHADGS LAALLGASPG ASTAVPLMIR LMHQCFPERT

451  PSWEGRLKEL VPGYGIKLNE NPERADEIIA YTAKVLDI*
``` m165/a165 99.7% identity in 356 aa overlap

```
                 10         20         30         40         50         60
    m165.pep  MAEATDVVLVGGGIMSATLGVLLKELEPSWEITLIERLEDVALESSNAWNNAGTGHSALC
              ||||||||||||||||||||||||||||||||||||||||||||||||||||||||||||
        a165  MAEATDVVLVGGGIMSATLGVLLKELEPSWEITLIERLEDVALESSNAWNNAGTGHSALC
                 10         20         30         40         50         60

70         80         90        100        110        120
    m165.pep  ELNYAPLGANGIIDPARALNIAEQFHVSRQFWATLVAEGKLEDNSFINAVPHMSLVMNED
              ||||||||||||||||||||||||||||||||||||||||||||||||||||||||||||
        a165  ELNYAPLGANGIIDPARALNIAEQFHVSRQFWATLVAEGKLEDNSFINAVPHMSLVMNED
                 70         80         90        100        110        120

130        140        150        160        170        180
    m165.pep  HCSYLQKRYDAFKTQKLFENMEFSTDRNKISDWAPLMMRGRDENQPVAANYSAEGTDVDF
              ||||||||||||||||||||||||||||||||||||||||||||||||||||||||||||
        a165  HCSYLQKRYDAFKTQKLFENMEFSTDRNKISDWAPLMMRGRDENQPVAANYSAEGTDVDF
                130        140        150        160        170        180

190        200        210        220        230        240
    m165.pep  GRLTRQMVKYLQGKGVKTEFNRHVEDIKRESDGAWVLKTADTRNPDGQLTLRTRFLFLGA
              ||||||||||||||||||||||||||||||||||||||||||||||||||||||||||||
        a165  GRLTRQMVKYLQGKGVKTEFNRHVEDIKRESDGAWVLKTADTRNPDGQLTLRTRFLFLGA
                190        200        210        220        230        240

250        260        270        280        290        300
    m165.pep  GGGALTLLQKSGIPEGKGYGGFPVSGLFFRNSNPETAEQHNAKVYGQASVGAPPMSVPHL
              ||||||||||||||||||||||||||||||||||||||||||||||||||||||||||||
        a165  GGGALTLLQKSGIPEGKGYGGFPVSGLFFRNSNPETAEQHNAKVYGQASVGAPPMSVPHL
                250        260        270        280        290        300

310        320        330        340        350
    m165.pep  DTRNVDGKRHLMFGPYAGFRSNFLKQGSLMDLPLSIHMDNLYPMLCAGWANMPLTK
              |||||||||||||||||||||||||||||||||||||||||||| |||||||||||
        a165  DTRNVDGKRHLMFGPYAGFRSNFLKQGSLMDLPLSIHMDNLYPMLRAGWANMPLTKYLLG
                310        320        330        340        350        360

ELRKTKEERFASLLEYYPEANPDDWELITAGQRVQIIKKDSEKGGVLQFGTEIVAHADGS
                370        380        390        400        410        420
```

The following partial DNA sequence was identified in *N. gonorrhoeae* <SEQ ID 691>:

```
g165-1.seq
       1    ATGGCTGAAG CGACAGACGT TGTCTTGGTG GGCGGCGGCA TTATGAGCGC
      51    GACTTTGGGC GTTTTGCTCA AGAACTCGA ACCGTCTTGG GAAATCACCC
     101    TGATTGAACG CTTGGAagat gTGGCGTTGG AATCGTCAAA cGCGTGGAAC
     151    AACGcCGgca CGGGGCATTC CGcGCTGTGc GAATTGAACT AtgcgccGCT
     201    GGGtgcggac ggcgtcatCA ATCCGGCGCg cgCCCTGAAT ATTGCCGAAC
     251    AGTTTCATGT CAGCCGCCAG TTTTGGGcga cgctggTCGC GGAAGGCAAG
     301    TTGGAAGACA ATTCCTTCAT CAATGCCGTG CCGCATATGT CTTTGGTGAT
     351    GAACGAAGAC CACTGCCGTT ACCTGCAAAA ACGCTATGAT GTGTTTAAAA
     401    CGCAGAAACT TTTTGAAAAT ATGGAATTTT CCACCGATCG GAACAAAATT
     451    TCCGATTGGG CtccgCTGAT TATGCGCGGC CGGGACGAAA ACCAACCCGT
     501    CGCCGCCAAC TATTCCGCCG AAGGCACGGA TGTCGATTTC GGACGGCTGA
     551    CGCGCCAGAT GGTGAAATAT TTGCAGGGCA AGGGCGTAAA AACCGAGTTC
     601    AACCGCCACG TCGAAGACAT CAAACGCGAA TCCGACGGCG CGTGGGTGCT
     651    CAAAACCGCC GATACCCGCA ACCCAGACTG GCAGCTCACC CTCCGCACCC
     701    GCTTCCTCTT CCTCGGCGCG GGCGGCGGCG CACTGACCCT GCTGCAAAAA
     751    TCCGGCATCC CCGAAGGCAA AGGCTACGGC GGCTTACCCG TGTCCGGCCT
     801    GTTCTTCCGC AACAGCAACC CCGAAACCGC CGAACAACAC AACGCCAAAG
     851    TGTACGGGCA GGCTTCCGTC GGCGCGCCGC CGATGTCCGT CCCGCACCTC
     901    GACACACGCA ACGTAGACGG CAAACGACAC CTTATGTTCG GTCCTTACGC
     951    AGGTTTCCGT TCCAACTTCC TCAAGCAAGG CTCGTTTATG GATTTGCCGC
    1001    TGTCCATCCA TATGGACAAC CTCTATCCTA TGCTGCGCGC CGGCTGGGCG
    1051    AATATGCCGC TGACCAAATA CCTGCTGGGC GAATTGCGTA AAACCAAAGA
    1101    AGAACGCTtt gCCTCCCTGC TGgaatacta cccGaggcag acccGACGAc
    1151    tggtactcat cacgcaggnc acGCGTcata tcattanata tgactCgaaa
    1201    ctgcgcgtgc tgcagttgta cgagattgtg ccaCGCGacg ctcgctcgcg
    1251    cattctggag cgtcgcggcg catcacgctn tgcgctgata tccgctgatg
    1301    acactgctcc gaGCGcgccc gtcttggaaa gtgtctga
```

This corresponds to the amino acid sequence <SEQ ID 692; ORF 165-1.ng>:

```
g165-1.pep
       1    MAEATDVVLV GGGIMSATLG VLLKELEPSW EITLIERLED VALESSNAWN
      51    NAGTGHSALC ELNYAPLGAD GVINPARALN IAEQFHVSRQ FWATLVAEGK
     101    LEDNSFINAV PHMSLVMNED HCRYLQKRYD VFKTQKLFEN MEFSTDRNKI
     151    SDWAPLIMRG RDENQPVAAN YSAEGTDVDF GRLTRQMVKY LQGKGVKTEF
     201    NRHVEDIKRE SDGAWVLKTA DTRNPDWQLT LRTRFLFLGA GGGALTLLQK
     251    SGIPEGKGYG GLPVSGLFFR NSNPETAEQH NAKVYGQASV GAPPMSVPHL
     301    DTRNVDGKRH LMFGPYAGFR SNFLKQGSFM DLPLSIHMDN LYPMLRAGWA
     351    NMPLTKYLLG ELRKTKEERF ASLLEYYPRQ TRRLVLITQX TRHIIXYDSK
     401    LRVLQLYEIV PRDARSRILE RRGASRXALI SADDTAPSAP VLESV*
```

The following partial DNA sequence was identified in *N. meningitidis* <SEQ ID 693>:

```
m165-1.seq
       1   ATGGCTGAAG CGACAGACGT TGTCTTGGTG GGCGGCGGCA TTATGAGCGC
      51   GACTTTGGGC GTTTTGCTCA AAGAACTCGA ACCGTCTTGG GAAATCACCC
     101   TGATTGAACG CTTGGAAGAT GTGGCGTTGG AATCGTCAAA CGCGTGGAAC
     151   AACGCCGGCA CGGGGCATTC CGCGCTGTGC GAATTGAACT ATGCGCCGTT
     201   GGGTGCAAAT GGGATTATCG ATCCGGCGCG CGCCCTCAAT ATTGCCGAAC
     251   AGTTTCATGT CAGCCGCCAG TTTTGGGCGA CGCTGGTCGC GGAAGGCAAG
     301   TTGGAAGACA ATTCCTTCAT CAATGCCGTG CCGCATATGT CTTTGGTGAT
     351   GAATGAAGAC CATTGTTCTT ATCTTCAAAA ACGTTATGAC GCGTTTAAAA
     401   CCCAAAAACT TTTTGAAAAT ATGGAATTTT CCACCGATCG GAACAAAATT
     451   TCCGATTGGG CTCCGCTGAT GATGCGCGGC CGGGACGAAA ACCAACCCGT
     501   CGCCGCCAAC TACTCCGCCG AAGGTACGGA TGTCGATTTC GGACGGCTGA
     551   CGCGCCAAAT GGTGAAATAT TTGCAGGGCA AGGGCGTAAA AACCGAGTTC
     601   AACCGCCACG TCGAAGACAT CAAACGCGAA TCCGACGGCG CGTGGGTGCT
     651   CAAAACCGCC GATACCCGCA ACCCCGACGG GCAGCTCACC CTCCGTACCC
     701   GCTTCCTCTT CCTCGGCGCG GGCGGCGGCG CGCTGACCCT GCTGCAAAAA
     751   TCCGGCATCC CCGAAGGCAA AGGCTACGGC GGCTTCCCCG TGTCCGGCCT
     801   GTTCTTCCGC AACAGCAACC CCGAAACCGC CGAACAACAC AACGCCAAAG
     851   TGTACGGGCA GGCTTCCGTC GGCGCGCCGC CGATGTCCGT CCCGCACCTC
     901   GACACACGCA ACGTGGACGG CAAACGCCAC CTTATGTTCG GCCCTTACGC
     951   AGGCTTCCGT TCCAACTTCC TCAAGCAAGG CTCGCTTATG GATTTGCCGC
    1001   TGTCCATCCA TATGGACAAC CTCTATCCTA TGCTGTGCGC CGGCTGGGCG
    1051   AATATGCCGC TGACCAAATA CCTGCTGGGC GAATTGCGTA AAACCAAAGA
    1101   AGAACGCTTC GCCTCCCTGC TGGAATACTA CCCCGAGGCA ACCCCGACGG
    1151   ACTGGGAACT CATCACCGCA GGGCAACGCG TCCAAATCAT TAAAAAAGAC
    1201   TCCGAAAAAG GCGGCGTGCT CCAGTTTGGT ACGGAGATTG TCGCCCACGC
    1251   CGACGGCTCA CTCGCCGCAT TGCTGGGCGC GTCGCCGGGC GCATCGACCG
    1301   CTGTGCCGCT GATGATCCGG CTGATGCACC AATGCTTCCC CGAGCGCGCC
    1351   CCGTCTTGGG AAGACCGTCT GAAAGAGCTG GTACCGGGTT ACGGCATCAA
    1401   GTTGAACGAA AACCCTGAAA GGGCGGATGA AATTATCGCC TATACCGCGA
    1451   AAGTATTGGA TATTTAA
```

This corresponds to the amino acid sequence <SEQ ID 694; ORF 165-1>:

```
m165-1.pep
       1   MAEATDVVLV GGGIMSATLG VLLKELEPSW EITLIERLED VALESSNAWN
      51   NAGTGHSALC ELNYAPLGAN GIIDPARALN IAEQFHVSRQ FWATLVAEGK
     101   LEDNSFINAV PHMSLVMNED HCSYLQKRYD AFKTQKLFEN MEFSTDRNKI
     151   SDWAPLMMRG RDENQPVAAN YSAEGTDVDF GRLTRQMVKY LQGKGVKTEF
     201   NRHVEDIKRE SDGAWVLKTA DTRNPDGQLT LRTRFLFLGA GGGALTLLQK
```

-continued

```
251     SGIPEGKGYG GFPVSGLFFR NSNPETAEQH NAKVYGQASV GAPPMSVPHL

301     DTRNVDGKRH LMFGPYAGFR SNFLKQGSLM DLPLSIHMDN LYPMLCAGWA

351     NMPLTKYLLG ELRKTKEERF ASLLEYYPEA NPDDWELITA GQRVQIIKKD

401     SEKGGVLQFG TEIVAHADGS LAALLGASPG ASTAVPLMIR LMHQCFPERA

451     PSWEDRLKEL VPGYGIKLNE NPERADEIIA YTAKVLDI*
``` m165-1/g165-1 89.7% identity in 428 aa overlap

```
                    10         20         30         40         50         60
m165-1.pep  MAEATDVVLVGGGIMSATLGVLLKELEPSWEITLIERLEDVALESSNAWNNAGTGHSALC
            ||||||||||||||||||||||||||||||||||||||||||||||||||||||||||||
g165-1      MAEATDVVLVGGGIMSATLGVLLKELEPSWEITLIERLEDVALESSNAWNNAGTGHSALC
                    10         20         30         40         50         60
                    70         80         90        100        110        120
m165-1.pep  ELNYAPLGANGIIDPARALNIAEQFHVSRQFWATLVAEGKLEDNSFINAVPHMSLVMNED
            |||||||||:|:|||||||||||||||||||||||||||||||||||||||||||||||
g165-1      ELNYAPLGADGVINPARALNIAEQFHVSRQFWATLVAEGKLEDNSFINAVPHMSLVMNED
                    70         80         90        100        110        120
                   130        140        150        160        170        180
m165-1.pep  HCSYLQKRYDAFKTQKLFENMEFSTDRNKISDWAPLMMRGRDENQPVAANYSAEGTDVDF
            ||:|||||||:|||||||||||||||||||||||||:|||||||||||||||||||||
g165-1      HCRYLQKRYDVFKTQKLFENMEFSTDRNKISDWAPLIMRGRDENQPVAANYSAEGTDVDF
                   130        140        150        160        170        180
                   190        200        210        220        230        240
m165-1.pep  GRLTRQMVKYLQGKGVKTEFNRHVEDIKRESDGAWVLKTADTRNPDGQLTLRTRFLFLGA
            |||||||||||||||||||||||||||||||||||||||||||||| |||||||||||||
g165-1      GRLTRQMVKYLQGKGVKTEFNRHVEDIKRESDGAWVLKTADTRNPDWQLTLRTRFLFLGA
                   190        200        210        220        230        240
                   250        260        270        280        290        300
m165-1.pep  GGGALTLLQKSGIPEGKGYGGFPVSGLFFRNSNPETAEQHNAKVYGQASVGAPPMSVPHL
            ||||||||||||||||||||||:|||||||||||||||||||||||||||||||||||||
g165-1      GGGALTLLQKSGIPEGKGYGGLPVSGLFFRNSNPETAEQHNAKVYGQASVGAPPMSVPHL
                   250        260        270        280        290        300
                   310        320        330        340        350        360
m165-1.pep  DTRNVDGKRHLMFGPYAGFRSNFLKQGSLMDLPLSIHMDNLYPMLCAGWANMPLTKYLLG
            |||||||||||||||||||||||||||||:||||||||||||||||| ||||||||||||
g165-1      DTRNVDGKRHLMFGPYAGFRSNFLKQGSFMDLPLSIHMDNLYPMLRAGWANMPLTKYLLG
                   310        320        330        340        350        360
                   370        380        390        400        410        420
m165-1.pep  ELRKTKEERFASLLEYYPEANPDDWELITAGQRVQIIKKDSEKGGVLQFGTEIVAHADGS
            |||||||||||||||||:  :|||  | |:||  ||  |||:   : :   | :
g165-1      ELRKTKEERFASLLEYYPR-QTRRLVLITQXTR-HIIXYDS-KLRVLQLYEIVPRDARSR
                   370        380        390        400        410        420
                   430        440        450        460        470        480
m165-1.pep  LAALLGASPGASTAVPLMIRLMHQCFPERAPSWEDRLKELVPGYGIKLNENPERADEIIA
            :          |||
g165-1      ILERRGASRXALISADDTAPSAPVLESVX
                   420        430        440
```

The following partial DNA sequence was identified in *N. meningitidis* <SEQ ID 695>:

```
a165-1.seq
     1     ATGGCTGAAG CGACAGACGT TGTCTTGGTG GGCGGCGGCA TTATGAGCGC

51     GACTTTGGGC GTTTTGCTCA AGAACTCGA ACCGTCTTGG GAAATCACCC

101     TGATTGAACG CTTGGAAGAT GTGGCGTTGG AATCGTCAAA CGCGTGGAAC

151     AACGCCGGCA CGGGGCATTC CGCGCTGTGC GAATTGAACT ATGCGCCGTT

201     GGGTGCAAAT GGGATTATCG ATCCGGCGCG CGCCCTCAAT ATTGCCGAAC

251     AGTTTCATGT CAGCCGCCAG TTTTGGGCGA CGTTGGTCGC GGAAGGCAAG

301     TTGGAAGACA ATTCCTTCAT CAATGCCGTG CCGCATATGT CTTTGGTGAT

351     GAATGAAGAC CATTGTTCTT ATCTTCAAAA ACGTTATGAC GCGTTTAAAA

401     CCCAAAAACT TTTTGAAAAT ATGGAATTTT CCACCGATCG GAACAAAATT
```

```
 451   TCCGATTGGG CTCCGCTGAT GATGCGCGGC CGGGACGAAA ACCAACCCGT

501   CGCCGCCAAC TACTCCGCCG AAGGCACGGA TGTCGATTTC GGACGGCTGA

551   CGCGCCAAAT GGTGAAATAT TTGCAGGGCA AGGGCGTAAA AACCGAGTTC

601   AACCGCCACG TCGAAGACAT CAAACGCGAA TCCGACGGCG CGTGGGTGCT

651   CAAAACCGCC GATACCCGCA ACCCCGACGG GCAGCTCACC CTCCGTACCC

701   GCTTCCTCTT CCTCGGCGCG GGCGGCGGCG CGCTGACCCT GCTGCAAAAA

751   TCCGGCATCC CCGAAGGCAA AGGCTACGGT GGCTTTCCCG TGTCCGGCCT

801   GTTCTTCCGC AACAGCAACC CCGAAACCGC CGAACAACAC AACGCCAAAG

851   TGTACGGGCA GGCTTCCGTC GGCGCGCCGC CGATGTCCGT CCCGCACCTC

901   GACACACGCA ACGTGGACGG CAAACGCCAC CTTATGTTCG GCCCTTACGC

951   AGGCTTCCGT TCCAACTTCC TCAAGCAAGG CTCACTTATG GATTTGCCGC

1001   TGTCCATCCA TATGGACAAC CTCTATCCTA TGCTGCGCGC CGGCTGGGCG

1051   AATATGCCGC TGACCAAATA CCTGCTGGGC GAATTGCGTA AAACCAAAGA

1101   AGAACGCTTC GCCTCCCTGC TGGAATACTA CCCCGAGGCA AACCCCGACG

1151   ACTGGGAACT CATCACCGCA GGGCAACGCG TTCAAATCAT TAAAAAAGAC

1201   TCCGAAAAAG GCGGCGTGTT GCAGTTTGGT ACGGAGATTG TCGCACACGC

1251   CGACGGCTCG CTCGCCGCAT TGCTGGGCGC GTCGCCGGGC GCATCGACCG

1301   CCGTGCCGCT GATGATCCGG CTGATGCACC AATGCTTCCC CGAACGCACC

1351   CCGTCTTGGG AAGGCCGTCT GAAAGAGCTG GTACCGGGTT ACGGCATCAA

1401   GTTGAACGAA AACCCCGAAA GGGCGGATGA AATTATCGCC TATACCGCGA

1451   AAGTGTTGGA TATTTAA
                                                    35
```

This corresponds to the amino acid sequence <SEQ ID 696; ORF 165-1.a>:

```
a165-1.pep
     1    MAEATDVVLV GGGIMSATLG VLLKELEPSW EITLIERLED VALESSNAWN

51    NAGTGHSALC ELNYAPLGAN GIIDPARALN IAEQFHVSRQ FWATLVAEGK

101    LEDNSFINAV PHMSLVMNED HCSYLQKRYD AFKTQKLFEN MEFSTDRNKI

151    SDWAPLMMRG RDENQPVAAN YSAEGTDVDF GRLTRQMVKY LQGKGVKTEF

201    NRHVEDIKRE SDGAWVLKTA DTRNPDGQLT LRTRFLFLGA GGGALTLLQK

251    SGIPEGKGYG GFPVSGLFFR NSNPETAEQH NAKVYGQASV GAPPMSVPHL

301    DTRNVDGKRH LMFGPYAGFR SNFLKQGSLM DLPLSIHMDN LYPMLRAGWA

351    NMPLTKYLLG ELRKTKEERF ASLLEYYPEA NPDDWELITA GQRVQIIKKD

401    SEKGGVLQFG TEIVAHADGS LAALLGASPG ASTAVPLMIR LMHQCFPERT

451    PSWEGRLKEL VPGYGIKLNE NPERADEIIA YTAKVLDI*
``` a165-1/m165-1 99.4% identity in 488 aa overlap

```
                   10         20         30         40         50         60
a165-1.pep    MAEATDVVLVGGGIMSATLGVLLKELEPSWEITLIERLEDVALESSNAWNNAGTGHSALC
              ||||||||||||||||||||||||||||||||||||||||||||||||||||||||||||
m165-1        MAEATDVVLVGGGIMSATLGVLLKELEPSWEITLIERLEDVALESSNAWNNAGTGHSALC
                   10         20         30         40         50         60
```

```
                 70        80        90       100       110       120
a165-1.pep  ELNYAPLGANGIIDPARALNIAEQFHVSRQFWATLVAEGKLEDNSFINAVPHMSLVMNED
            ||||||||||||||||||||||||||||||||||||||||||||||||||||||||||||
m165-1      ELNYAPLGANGIIDPARALNIAEQFHVSRQFWATLVAEGKLEDNSFINAVPHMSLVMNED
                 70        80        90       100       110       120

130       140       150       160       170       180
a165-1.pep  HCSYLQKRYDAFKTQKLFENMEFSTDRNKISDWAPLMMRGRDENQPVAANYSAEGTDVDF
            ||||||||||||||||||||||||||||||||||||||||||||||||||||||||||||
m165-1      HCSYLQKRYDAFKTQKLFENMEFSTDRNKISDWAPLMMRGRDENQPVAANYSAEGTDVDF
                130       140       150       160       170       180

190       200       210       220       230       240
a165-1.pep  GRLTRQMVKYLQGKGVKTEFNRHVEDIKRESDGAWVLKTADTRNPDGQLTLRTRFLFLGA
            ||||||||||||||||||||||||||||||||||||||||||||||||||||||||||||
m165-1      GRLTRQMVKYLQGKGVKTEFNRHVEDIKRESDGAWVLKTADTRNPDGQLTLRTRFLFLGA
                190       200       210       220       230       240

250       260       270       280       290       300
a165-1.pep  GGGALTLLQKSGIPEGKGYGGFPVSGLFFRNSNPETAEQHNAKVYGQASVGAPPMSVPHL
            ||||||||||||||||||||||||||||||||||||||||||||||||||||||||||||
m165-1      GGGALTLLQKSGIPEGKGYGGFPVSGLFFRNSNPETAEQHNAKVYGQASVGAPPMSVPHL
                250       260       270       280       290       300

310       320       330       340       350       360
a165-1.pep  DTRNVDGKRHLMFGPYAGFRSNFLKQGSLMDLPLSIHMDNLYPMLRAGWANMPLTKYLLG
            |||||||||||||||||||||||||||||||||||||||||||||| |||||||||||||
m165-1      DTRNVDGKRHLMFGPYAGFRSNFLKQGSLMDLPLSIHMDNLYPMLCAGWANMPLTKYLLG
                310       320       330       340       350       360

370       380       390       400       410       420
a165-1.pep  ELRKTKEERFASLLEYYPEANPDDWELITAGQRVQIIKKDSEKGGVLQFGTEIVAHADGS
            ||||||||||||||||||||||||||||||||||||||||||||||||||||||||||||
m165-1      ELRKTKEERFASLLEYYPEANPDDWELITAGQRVQIIKKDSEKGGVLQFGTEIVAHADGS
                370       380       390       400       410       420

430       440       450       460       470       480
a165-1.pep  LAALLGASPGASTAVPLMIRLMHQCFPPERTPSWEGRLKELVPGYGIKLNENPERADEIIA
            |||||||||||||||||||||||||||||||:|||| |||||||||||||||||||||||
m165-1      LAALLGASPGASTAVPLMIRLMHQCFPERAPSWEDRLKELVPGYGIKLNENPERADEIIA
                430       440       450       460       470       480

489
a165-1.pep  YTAKVLDIX
            |||||||||
m165-1      YTAKVLDIX
```

35
a165-1 (SEQ ID 696)/p33940 (SEQ ID 4164)

```
sp|P33940|YOJH_ECOLI HYPOTHETICAL 60.2 KD PROTEIN
IN ECO-ALKB INTERGENIC REGION
>gi|1736851|gnl|PID|d1016718 (D90850) ORF_ID:
o372#5; similar to [SwissProt Accession Number
P33940] [Escherichia coli] >gi|1788539 (AE000310) f548;
This 548 aa ORF is 100 pct identical to 490 residues of YOJH_ECOLI SW:
P33940 (492 aa) but contains 56 additional N-ter aa; 100 pct
identical to GB: ECOHU49_33
ACCESSION: U00008 (490 aa) but contains 58 aditional N-term resi...
Length = 548
Score = 458 bits (1167), Expect = e-128
Identities = 233/490 (47%), Positives = 303/490 (61%), Gaps = 5/490 (1%)
Query:   3 EATDVVLVGGGIMSATLGVLLKELEPSWEITLIERLEDVALESSNAWNNAGTGHSALCEL   62
           + TDV+L+GGGIMSATLG L+ELEP W +T+++ERLE VA ESSN WNNAGTGHSAL EL
Sbjct:  30 QETDVLLIGGGIMSATLGTYLRELEPEWSMTMVERLEGVAQESSNGWNNAGTGHSALMEL   89

Query:  63 NYAPLGANGIIDPARALNIAEQFHVSRQFWATLVAEGKLED-NSFINAVPHMSLVMNEDH  121
           NY P  A+G I  +A+ I E F +SRQFWA  V G L    SFIN VPHMS V  ED+
Sbjct:  90 NYTPQNADGSISIEKAVAINEAFQISRQFWAHQVERGVLRTPRSFINTVPHMSFVWGEDN  149

Query: 122 CSYLQKRYDAFKTQKLFENMEFSTDRNKISDWAPLMMRGRDENQPVAANYSAEGTDVDFG  181
           ++L+ RY A +    LF M +S D  +I +WAPL+M GRD  Q VAA    GTDV++G
Sbjct: 150 VNFLRARYAALQQSSLFRGMRYSEDHAQIKEWAPLVMEGRDPQQKVAATRTEIGTDVNYG  209

Query: 182 RLTRQMVKYLQGKG-VKTEFNRHVEDIKRESDGAWVLKTADTRNPDGQLTXXXXXXXXXX  240
           +TRQ++   LQ K     + +  V  +KR  D  W   AD +N    Q
Sbjct: 210 EITRQLIASLQKKSNFSLQSSEVRALKRNDDNTWTVTVADLKNGTAQ-NIRAKFVFIGA  268

Query: 241 XXXXXXXXQKSGIPEGKGYGGFPVSGLFFRNSNPETAEQHNAKVYGQASVGAPPMSVPHL  300
                   Q+SGIPE K Y GFPV G F + NP+    H AKVYG+ASVGAPPMSVPH+
Sbjct: 269 GGAALKLLQESGIPEAKDYAGFPVGGQFLVSENPDVVNHHLAKVYGKASVGAPPMSVPHI  328

Query: 301 DTRNVDGKRHLMFGPYAGFRSNFLKQGSLMDLPLSIHMDNLYPMLRAGWANMPLTKYLLG  360
           DTR +DGKR ++FGP+A F + FLK GSL DL  S   N+ PM+  G N L KYL+
Sbjct: 329 DTRVLDGKRVVLFGPFATFSTKFLKNGSLWDLMSSTTTSNVMPMHHVGLDNFDLVKYLVS  388
```

```
Query:  361 ELRKTKEERFASLLEYYPEANPDDWELITAGQRVQIIKKDSEKGGVLQFGTEIVXXXXXX  420
            ++   ++E+RF +L EYYP+A  +DW L  AGQRVQIIK+D+EKGGVL+ GTE+V
Sbjct:  389 QVMLSEEDRFEALKEYYPQAKKEDWRLWQAGQRVQIIKRDAEKGGVLRLGTEVVSDQQGT  448

Query:  421 XXXXXXXXXXXXXXXVPLMIRLMHQCFPER--TPSWEGRLKELVPGYGIKLNENPERADEI  478
                           P+M+ L+ + F +R  +P W+  LK +VP YG KLN +     +
Sbjct:  449 IAALLGASPGASTAAPIMLNLLEKVFGDRVSSPQWQATLKAIVPSYGRKLNGDVAATERE  508

Query:  479 IAYTAKVLDI  488
            + YT++VL +
Sbjct:  509 LQYTSEVLGL  518
```

The following partial DNA sequence was identified in *N. gonorrhoeae* <SEQ ID 697>:

```
g204.seq
    1   atggcggcgg cggaaataaa acgcccctc gctgtcgatt tccagcacat
   51   agcgtccgtt ctgcacggcg gcatagccgc ttttgcctgc ctgatagggt
  101   tgcagggcgg aatgcgaaat caggtaatca gtcagtttgc cgccgtcttc
  151   ggcgatattg cccaccagtt tggcaaacaa ggtatggcac acgccgtttt
  201   ccgcccagcc cgaaggcgcg tcctttccgt cggtttccat acatttgccg
  251   acgacggctt ccaagtcgtt gggatgcttt ccggtcagcc ggacggcgtt
  301   ttgttccggc aagcctttaa tcggataact gatttgtttt ttgccgtcgt
  351   tggttttgcc ttcgctactt tgtcccaaag ccaaaccggc aatcgccgta
  401   ttgtcgatgt atttgacttt gaaaaccggt tcggcgcgc tttgtgccgc
  451   attttgcggc tgttccgccg tattttcgga tttgccgcag gcggcaagca
  501   gcaggcagcc gcccaacacg gcaaaggta ttttcagcat tccgcactcc
  551   tgatggtttc aaaatgccgt ctgaaatgcc gtctgaaacg tggcaggcgg
  601   aggttcggac ggcattgggt ttatttcaac gggcggatgc cgaccgcatc
  651   gcgtacttta tccaacaatt cgcgcgcttc tttgcgcgct ttttgcgcgc
  701   ctgcctgcaa aatctcttcg atttgcgaag gattagaggt caatgcgttg
  751   tag
```

This corresponds to the amino acid sequence <SEQ ID 698; ORF 204.ng>:

```
g204.pep
    1   MAAAEIKRPL AVDFQHIASV LHGGIAAFAC LIGLQGGMRN QVISQFAAVF
   51   GDIAHQFGKQ GMAHAVFRPA RRRVLSVGFH TFADDGFQVV GMLSGQPDGV
  101   LFRQAFNRIT DLFFAVVGFA FATLSQSQTG NRRIVDVFDF ENRFRRALCR
  151   ILRLFRRIFG FAAGGKQQAA AQHGKRYFQH SALLMVSKCR LKCRLKRGRR
  201   RFGRHWVYFN GRMPTASRTL SNNSRASLRA FCAPACKISS ICEGLEVNAL
  251   *
```

The following partial DNA sequence was identified in *N. meningitidis* <SEQ ID 699>:

```
m204.seq
    1   ATGGCGGCGG CGGAAATAAA ACGCCCCTTC GCTGTCGATT TCCAGCACAT
   51   AGCGTCCGTT CTGCACGGCG GCATAGCCGC TTTTGCCTGC CTGATAGGGT
  101   TGCAGGGCGG CATGCGAAAC TAGGTAATCC GTCAGTTTGC CGCCGTCTTC
```

```
151  GGCGATATTG CCCACCAGTT TGGCAAACAA GGTATGGCAC ACGCCGTTTT

201  CTGCCCAACC TGCCGGACTG TCCTTATCAT CGGTTTCCAT ACATTTGCCG

251  CTGACGGCTT CCAAGTCGCC GGGATGCTTG CCGATCAGTC GGATAACATT

301  TTGTTCCGGC AAGCCTTTAA TCGGATAACT GATTTGTTTT TTGCCGTCGT

351  TGGTTTTGCC TTCGCTGCTT TGTCCCAAAT CCAAACCGGC AATCGCCGTA

401  TTGTCGATAT ATATGACTTT GAAAACCGGT TTCGGCGCGC TTTGTACCGC

451  GTTTTGCGGC TGTACCGCCG TATTTwCGGA TTTGCCGCaC GGCaArGCAG

501  CAGGCAGCCG CCCAATACGG CAAAArAwGT wTTCAGCATT CCACAyTCCT

551  GATGGTTTCA AAATGCCGTC TGAAACGCGG CAGGCGGAGG TTCGGACGGC

601  ATCGGGTTCA TTTCAACGGG CGGATGcCGA CCGCATCgGT ACTTTGTCCA

651  ATAATTCGCG TGCTTCTTTA CGCGCTTTCG CCGCGCCTGC CTGCAAAATC

701  TCTTCGATTT GCGAAGGGTC GGCGGTCAGC TCGTTGTAG
```

This corresponds to the amino acid sequence <SEQ ID 700; ORF 204>:

```
m204.pep
   1  MAAAEIKRPF AVDFQHIASV LHGGIAAFAC LIGLQGGMRN *VIRQFAAVF

51  GDIAHQFGKQ GMAHAVFCPT CRTVLIIGFH TFAADGFQVA GMLADQSDNI

101  LFRQAFNRIT DLFFAVVGFA FAALSQIQTG NRRIVDIYDF ENRFRRALYR

151  VLRLYRRIXG FAATAXQQAA AQYGKXXXQH STXLMVSKCR LKRGRRRFGR

201  HRVHFNGRMP TASGTLSNNS RASLRAFAAP ACKISSICEG SAVSSL*
```

Computer analysis of this amino acid sequence gave the following results:
Homology with a Predicted ORF from *N. gonorrhoeae*
ORF 204 shows 82.0% identity over a 250 aa overlap with a predicted ORF (ORF 204.ng) from *N. gonorrhoeae*:

```
m204/g204
                  10         20         30         40         50         60
m204.pep  MAAAEIKRPFAVDFQHIASVLHGGIAAFACLIGLQGGMRNXVIRQFAAVFGDIAHQFGKQ
          ||||||||:||||||||||||||||||||||||||||||| ||:||||||||||||||||
g204      MAAAEIKRPLAVDFQHIASVLHGGIAAFACLIGLQGGMRNQVISQFAAVFGDIAHQFGKQ
                  10         20         30         40         50         60

70         80         90        100        110        120
m204.pep  GMAHAVFCPTCRTVLIIGFHTFAADGFQVAGMLADQSDNILFRQAFNRITDLFFAVVGFA
          ||||||| |: || :|||| |||||:|||| | |::|||||||||||||||||||||||
g204      GMAHAVFRPARRRVLSVGFHTFADDGFQVVGMLSGQPDGVLFRQAFNRITDLFFAVVGFA
                  70         80         90        100        110        120

130        140        150        160        170        180
m204.pep  FAALSQIQTGNRRIVDIYDFENRFRRALYRVLRLYRRIXGFAATAXQQAAAQYGKXXXQH
          ||:|||  ||||||||:|:|||||||||| :|||:|||:||| : ||||||:||::| ||
g204      FATLSQSQTGNRRIVDVFDFENRFRRALCRILRLFRRIFGFAAGGKQQAAAQHGKRYFQH
                 130        140        150        160        170        180

190        200        210        220        230
m204.pep  STXLMVSKCRLK----RGRRRFGRHRVHFNGRMPTASGTLSNNSRASLRAFAAPACKISS
          |:||||||||||    |||||||||:|| |||||||||:|||||||||||| |||||||
g204      SALLMVSKCRLKCRLKRGRRRFGRHWVYFNGRMPTASRTLSNNSRASLRAFCAPACKISS
                 190        200        210        220        230

240
m204.pep  ICEGSAVSSLX
          ||||   |::|
g204      ICEGLEVNAL
                 250
```

The following partial DNA sequence was identified in *N. meningitidis* <SEQ ID 701>:

```
a204.seq
    1  ATGGCGGCGG CGGAAATAAA ACGCCCCCTC GCTGTCGATT TCCAGCACAT

51  AGCGTCCGTT CTGCACGGCG GCATAGCCGC TTTTGCCTGC CTGATAGGGT

101  TGCAGGGCGG AATGCGAAAT CAGGTAATCC GTCAGTTTGC CGCCGTCTTC

151  GGCGATATTG CCCACCAGTT TGGCAAACAA GGTATGGCAC ACGCCGTTTG

201  CCGCCCAGCC CGAAGGCGCG CCCTTTCCGT CGGTTTCCAT ACATTTGCCG

251  ACGACGGCTT CCAAGTCGTT GGGATGCTTG CCGGTCAGCC GGACGACGTT

301  TTGTTCCGGC AAGCCTTT.. .......... .......... ..........

351  .......... .......... .......... .......... ..........

401  .......... .......... .......... .......... ..........

451  .......... .......... .......... .......... ..........

501  .......... .......... .......... .......... ..........

551  .......... .......... .......... .....AAGAG GTTCGGACGG

601  CATTGGGTTT ATTTCAACGG GCGGATACCG ACCGCATCAC GTACTTTGCC

651  CAATAATTCG CGTGCTTCTT TACGCGCTTT TTGCGCGCCT GCCTGCAAAA

701  TCTCTTCGAT TGCGAAGGG TCGGCGGTCA GCTCGTTGTA G
```

This corresponds to the amino acid sequence <SEQ ID 702; ORF 204.a>:

```
a204.pep
    1  MAAAEIKRPL AVDFQHIASV LHGGIAAFAC LIGLQGGMRN QVIRQFAAVF

51  GDIAHQFGKQ GMAHAVCRPA RRRALSVGFH TFADDGFQVV GMLAGQPDDV

101  LFRQAF.... .......... .......... .......... ..........

151  .......... .......... .......... .......... .....KRFGR

201  HWVYFNGRIP TASRTLPNNS RASLRAFCAP ACKISSICEG SAVSSL*
``` m204/a204 54.5% identity in 246 aa overlap

```
                10         20         30         40         50         60
  m204.pep  MAAAEIKRPFAVDFQHIASVLHGGIAAFACLIGLQGGMRNXVIRQFAAVFGDIAHQFGKQ
            ||||||||:||||||||||||||||||||||||||||| |||||||||||||||||||||
  a204      MAAAEIKRPLAVDFQHIASVLHGGIAAFACLIGLQGGMRNQVIRQFAAVFGDIAHQFGKQ
                10         20         30         40         50         60

70         80         90        100        110        120
  m204.pep  GMAHAVFCPTCRTVLIIGFHTFAADGFQVAGMLADQSDNILFRQAFNRITDLFFAVVGFA
            ||||||  |:  :|  :||||||  ||||:|||  |::  | ::||||||
  a204      GMAHAVCRPARRRALSVGFHTFADDGFQVVGMLAGQPDDVLFRQAF--------------
                70         80         90        100

130        140        150        160        170        180
  m204.pep  FAALSQIQTGNRRIVDIYDFENRFRRALYRVLRLYRRIXGFAATAXQQAAAQYGKXXXQH a204      ------------------------------------------------------------

190        200        210        220        230        240
  m204.pep  STXLMVSKCRLKRGRRRFGRHRVHFNGRMPTASGTLSNNSRASLRAFAAPACKISSICEG
                          :||||  |:|||| ||  ||||||||||||||  ||||||||||||
  a204      --------------KRFGRHWVYFNGRIPTASRTLPNNSRASLRAFCAPACKISSICEG
                          110        120        130        140        150 m204.pep  SAVSSLX
            |||||||
  a204      SAVSSLX
```

The following partial DNA sequence was identified in *N. gonorrhoeae* <SEQ ID 703>:

g205.seq
```
  1    atgctgaaaa tacctttgc cgtgttgggc ggctgcctgc tgcttgccgc
 51    ctgcggcaaa tccgaaaata cggcggaaca gccgcaaaat gcggcacaaa
101    gcgcgccgaa accggttttc aaagtcaaat acatcgacaa tacggcgatt
151    gccggtttgg ctttgggaca agtagcgaa ggcaaaacca acgacggcaa
201    aaaacaaatc agttatccga ttaaaggctt gccggaacaa aacgccgtcc
251    ggctgaccgg aaagcatccc aacgacttgg aagccgtcgt cggcaaatgt
301    atggaaaccg acggaaagga cgcgccttcg ggctgggcgg aaaacggcgt
351    gtgccatacc ttgtttgcca aactggtggg caatatcgcc gaagacggcg
401    gcaaactgac tgattacctg atttcgcatt ccgccctgca accctatcag
451    gcaggcaaaa gcggctatgc cgccgtgcag aacggacgct atgtgctgga
501    aatcgacagc gagggggcgt tttatttccg ccgccgccat tattga
```

This corresponds to the amino acid sequence <SEQ ID 704; ORF 205.ng>:

g205.pep
```
  1    MLKIPFAVLG GCLLLAACGK SENTAEQPQN AAQSAPKPVF KVKYIDNTAI
 51    AGLALGQSSE GKTNDGKKQI SYPIKGLPEQ NAVRLTGKHP NDLEAVVGKC
101    METDGKDAPS GWAENGVCHT LFAKLVGNIA EDGGKLTDYL ISHSALQPYQ
151    AGKSGYAAVQ NGRYVLEIDS EGAFYFRRRH Y
```

The following partial DNA sequence was identified in N. meningitidis <SEQ ID 705>:

m205.seq
```
  1    ATGCTGAAwA CwTyTTTTGC CGTATTGGGC GGCTGCCTGC TGCyTtGCCG
 51    tGCGGCAAAT CCGwAAATAC GGCGGTACAG CCGCAAAACG CGGTACAAAG
101    CGCGCCGAAA CCGGTTTTCA AAGTCATATA TATCGACAAT ACGGCGATTG
151    CCGGTTTGGA TTTGGGACAA AGCAGCGAAG GCAAAACCAA CGACGGCAAA
201    AAACAAATCA GTTATCCGAT TAAAGGCTTG CCGGAACAAA ATGTTATCCG
251    ACTGATCGGC AAGCATCCCG GCGACTTGGA AGCCGTCAGC GGCAAATGTA
301    TGGAAACCGA TGATAAGGAC AGTCCGGCAG GTTGGGCAGA AAACGGCGTG
351    TGCCATACCT TGTTTGCCAA ACTGGTGGGC AATATCGCCG AAGACGGCGG
401    CAAACTGACG GATTACCTAG TTTCGCATGC CGCCCTGCAA CCCTATCAGG
451    CAGGCAAAAG CGGCTATGCC GCCGTGCAGA ACGGACGCTA TGTGCTGGAA
501    ATCGACAGCG AAGGGGCGTT TTATTTCCGC CGCCGCCATT ATTGA
```

This corresponds to the amino acid sequence <SEQ ID 706; ORF 205>:

m205.pep
```
  1    MLXTXFAVLG GCLLXCRCGK SXNTAVQPQN AVQSAPKPVF KVIYIDNTAI
 51    AGLDLGQSSE GKTNDGKKQI SYPIKGLPEQ NVIRLIGKHP GDLEAVSGKC
101    METDDKDSPA GWAENGVCHT LFAKLVGNIA EDGGKLTDYL VSHAALQPYQ
151    AGKSGYAAVQ NGRYVLEIDS EGAFYFRRRH Y*
```

Computer analysis of this amino acid sequence gave the following results:
Homology with a Predicted ORF from *N. gonorrhoeae*
ORF 205 shows 88.4% identity over a 181 aa overlap with a predicted ORF (ORF 205.ng) from *N. gonorrhoeae*:

```
    m205/g205
                    10        20        30        40        50        60
    m205.pep  MLXTXFAVLGGCLLXCRCGKSXNTAVQPQNAVQSAPKPVFKVIYIDNTAIAGLDLGQSSE
              ||  ||||||||||   ||| ||| |||||:|||||||||| |||||||||| ||||||
    g205      MLKIPFAVLGGCLLLAACGKSENTAEQPQNAAQSAPKPVFKVKYIDNTAIAGLALGQSSE
                    10        20        30        40        50        60

70        80        90       100       110       120
    m205.pep  GKTNDGKKQISYPIKGLPEQNVIRLIGKHPGDLEAVSGKCMETDDKDSPAGWAENGVCHT
              ||||||||||||||||||||||::||  ||||:||||| ||||||| ||:|||||||||
    g205      GKTNDGKKQISYPIKGLPEQNAVRLTGKHPNDLEAVVGKCMETDGKDAPSGWAENGVCHT
                    70        80        90       100       110       120

130       140       150       160       170       180
    m205.pep  LFAKLVGNIAEDGGKLTDYLVSHAALQPYQAGKSGYAAVQNGRYVLEIDSEGAFYFRRRH
              |||||||||||||||||||||:||:|||||||||||||||||||||||||||||||||||
    g205      LFAKLVGNIAEDGGKLTDYLISHSALQPYQAGKSGYAAVQNGRYVLEIDSEGAFYFRRRH
                   130       140       150       160       170       180 m205.pep  YX
              |
    g205      Y
```

The following partial DNA sequence was identified in *N. meningitidis* <SEQ ID 707>:

```
    a205.seq (partial)
         1    TCCGAACCTC TTAAAGGCTT GCCGGAACAA AACGTCGTCC GGCTGACCGG

51    CAAGCATCCC AACGACTTGG AAGCCGTCGT CGGCAAATGT ATGGAAACCG

101    ACGGAAAGGG CGCGCCTTCG GGCTGGGCGG CAAACGGCGT GTGCCATACC

151    TTGTTTGCCA AACTGGTGGG CAATATCGCC GAAGACGGCG GCAAACTGAC

201    GGATTACCTG ATTTCGCATT CCGCCCTGCA ACCCTATCAG GCAGGCAAAA

251    GCGGCTATGC CGCCGTGCAG AACGGACGCT ATGTGCTGGA AATCGACAGC

301    GAGGGGGCGT TTTATTTCCG CCGCCGCCAT TATTGA
```

This corresponds to the amino acid sequence <SEQ ID 708; ORF 205.a>:

```
    a205.pep (partial)
         1    SEPLKGLPEQ NVVRLTGKHP NDLEAVVGKC METDGKGAPS GWAANGVCHT

51    LFAKLVGNIA EDGGKLTDYL ISHSALQPYQ AGKSGYAAVQ NGRYVLEIDS

101    EGAFYFRRRH Y*
``` m205/a205 88.3% identity in 111 aa overlap

```
                    50        60        70        80        90       100
    m205.pep  KVIYIDNTAIAGLDLGQSSEGKTNDGKKQISYPIKGLPEQNVIRLIGKHPGDLEAVSGKC
                                                  | |:||||||||:|||| :||||  |||
    a205                                          SEPLKGLPEQNVVRLTGKHPNDLEAVVGKC
                                                          10        20        30

110       120       130       140       150       160
    m205.pep  METDDKDSPAGWAENGVCHTLFAKLVGNIAEDGGKLTDYLVSHAALQPYQAGKSGYAAVQ
              ||||  |:|:||| |||||||||||||||||||||||||||:||:|||||||||||||||
    a205      METDGKGAPSGWAANGVCHTLFAKLVGNIAEDGGKLTDYLISHSALQPYQAGKSGYAAVQ
                    40        50        60        70        80        90

170       180
    m205.pep  NGRYVLEIDSEGAFYFRRRHYX
              ||||||||||||||||||||||
    a205      NGRYVLEIDSEGAFYFRRRHYX
                   100       110
```

The following partial DNA sequence was identified in *N. gonorrhoeae* <SEQ ID 709>:

```
g205-1.seq (partial)
    1    ATGCTGAAAA TAcCTTTTGC CGTGTTGGGC GGCTGCCTGC TGCTTGCCGC
   51    CTGCGGCAAA TCCGAAAATA CGGCGGAACA GCCGCAAAAT GCGGCACAAA
  101    GCGCGCCGAA ACCGGTTTTC AAAGTCAAAT ACATCGACAA TACGGCGATT
  151    GCCGGTTTGG CTTTGGGACA AAGTAGCGAA GGCAAAACCA ACGACGGCAA
  201    AAAACAAATC AGTTATCCGA TTAAAGGCTT GCCGGAACAA AACGCCGTCC
  251    GGCTGACCGG AAAGCATCCC AACGACTTGG AAGCCGTCGT CGGCAAATGT
  301    ATGGAAACCG ACGGAAAGGA CGCGCCTTCG GGCTGGGCGG AAAACGGCGT
  351    GTGCCATACC TTGTTTGCCA AACTGGTGGG CAATATCGCC GAAGACGGCG
  401    GCAAACTGAC TGATTACCTG ATTTCGCATT CCGCCCTGCA ACCCTATCAG
  451    GCAGGCAAAA GCGGCTATGC CGCCGTGCAG AACGGACGCT ATGTGCTGGA
  501    AATCGACAGC GAGGGGCGT TTTA
```

This corresponds to the amino acid sequence <SEQ ID 710; ORF 205-1.ng>:

```
g205-1.pep (partial).
    1    MLKIPFAVLG GCLLLAACGK SENTAEQPQN AAQSAPKPVF KVKYIDNTAI
   51    AGLALGQSSE GKTNDGKKQI SYPIKGLPEQ NAVRLTGKHP NDLEAVVGKC
  101    METDGKDAPS GWAENGVCHT LFAKLVGNIA EDGGKLTDYL ISHSALQPYQ
  151    AGKSGYAAVQ NGRYVLEIDS EGAF
```

The following partial DNA sequence was identified in *N. meningitidis* <SEQ ID 711>:

```
m205-1.seq..
    1    ATGCTGAAAA CATCTTTTGC CGTATTGGGC GGCTGCCTGC TGCTTGCCGC
   51    CTGCGGCAAA TCCGAAAATA CGGCGGAACA GCCGCAAAAC GCGGTACAAA
  101    GCGCGCCGAA ACCGGTTTTC AAAGTCAAAT ATATCGACAA TACGGCGATT
  151    GCCGGTTTGG ATTTGGGACA AAGCAGCGAA GGCAAAACCA ACGACGGCAA
  201    AAAACAAATC AGTTATCCGA TTAAAGGCTT GCCGGAACAA AATGTTATCC
  251    GACTGATCGG CAAGCATCCC GGCGACTTGG AAGCCGTCAG CGGCAAATGT
  301    ATGGAAACCG ATGATAAGGA CAGTCCGGCA GGTTGGGCAG AAAACGGCGT
  351    GTGCCATACC TTGTTTGCCA AACTGGTGGG CAATATCGCC GAAGACGGCG
  401    GCAAACTGAC GGATTACCTA GTTTCGCATG CCGCCCTGCA ACCCTATCAG
  451    GCAGGCAAAA GCGGCTATGC CGCCGTGCAG AACGGACGCT ATGTGCTGGA
  501    AATCGACAGC GAAGGGGCGT TTATTTCCG CCGCCGCCAT TATTGA
```

This corresponds to the amino acid sequence <SEQ ID 712; ORF 205-1>:

```
m205-1.pep
    1    MLKTSFAVLG GCLLLAACGK SENTAEQPQN AVQSAPKPVF KVKYIDNTAI
   51    AGLDLGQSSE GKTNDGKKQI SYPIKGLPEQ NVIRLIGKHP GDLEAVSGKC
```

```
101    METDDKDSPA GWAENGVCHT LFAKLVGNIA EDGGKLTDYL VSHAALQPYQ

151    AGKSGYAAVQ NGRYVLEIDS EGAFYFRRRH Y*
``` m205-1/g205-1 92.0% identity in 174 aa overlap

```
                  10        20        30        40        50        60
g205-1.pep  MLKIPFAVLGGCLLLAACGKSENTAEQPQNAAQSAPKPVFKVKYIDNTAIAGLALGQSSE
            |||  |||||||||||||||||||||||||||:||||||||||||||||||||:||||||
m205-1      MLKTSFAVLGGCLLLAACGKSENTAEQPQNAVQSAPKPVFKVKYIDNTAIAGLDLGQSSE
                  10        20        30        40        50        60

70        80        90       100       110       120
g205-1.pep  GKTNDGKKQISYPIKGLPEQNAVRLTGKHPNDLEAVVGKCMETDGKDAPSGWAENGVCHT
            ||||||||||||||||||||||||:||||||||:||||||||||||  ||::||||||||
m205-1      GKTNDGKKQISYPIKGLPEQNVIRLIGKHPGDLEAVSGKCMETDDKDSPAGWAENGVCHT
                  70        80        90       100       110       120

130       140       150       160       170
g205-1.pep  LFAKLVGNIAEDGGKLTDYLISHSALQPYQAGKSGYAAVQNGRYVLEIDSEGAF
            ||||||||||||||||||||||:||||||||||||||||||||||||||||||
m205-1      LFAKLVGNIAEDGGKLTDYLVSHAALQPYQAGKSGYAAVQNGRYVLEIDSEGAFYFRRRH
                 130       140       150       160       170       180 m205-1      YX
```

The following partial DNA sequence was identified in *N. meningitidis* <SEQ ID 713>:

```
a205-1.seq (partial)
    1      CCTCTTAAAG GCTTGCCGGA ACAAAACGTC GTCCGGCTGA CCGGCAAGCA

51      TCCCAACGAC TTGGAAGCCG TCGTCGGCAA ATGTATGGAA ACCGACGGAA

101      AGGGCGCGCC TTCGGGCTGG GCGGCAAACG GCGTGTGCCA TACCTTGTTT

151      GCCAAACTGG TGGGCAATAT CGCCGAAGAC GGCGGCAAAC TGACGGATTA

201      CCTGATTTCG CATTCCGCCC TGCAACCCTA TCAGGCAGGC AAAAGCGGCT

251      ATGCCGCCGT GCAGAACGGA CGCTATGTGC TGGAAATCGA CAGCGAGGGG

301      GCGTTTTATT TCCGCCGCCG CCATTATTGA
```

This corresponds to the amino acid sequence <SEQ ID 714; ORF 205-1.a>:

```
a205-1.pep (partial)
    1      PLKGLPEQNV VRLTGKHPND LEAVVGKCME TDGKGAPSGW AANGVCHTLF

51      AKLVGNIAED GGKLTDYLIS HSALQPYQAG KSGYAAVQNG RYVLEIDSEG

101      AFYFRRRHY*
``` m205-1/a205-1 89.0% identity in 109 aa overlap

```
                  50        60        70        80        90       100
m205-1.pep  KYIDNTAIAGLDLGQSSEGKTNDGKKQISYPIKGLPEQNVIRLIGKHPGDLEAVSGKCME
                                                 |:||||||||:|| ||||:|||| |||||
a205-1                                           PLKGLPEQNVVRLTGKHPNDLEAVVGKCME
                                                         10        20        30

110       120       130       140       150       160
m205-1.pep  TDDKDSPAGWAENGVCHTLFAKLVGNIAEDGGKLTDYLVSHAALQPYQAGKSGYAAVQNG
            || | :|:||| ||||||||||||||||||||||||||:||||||||||||||||||||||
a205-1      TDGKGAPSGWAANGVCHTLFAKLVGNIAEDGGKLTDYLISHSALQPYQAGKSGYAAVQNG
                    40        50        60        70        80        90

170       180
m205-1.pep  RYVLEIDSEGAFYFRRRHYX
            ||||||||||||||||||||
a205-1      RYVLEIDSEGAFYFRRRHYX
                   100       110
```

The following partial DNA sequence was identified in *N. gonorrhoeae* <SEQ ID 715>:

```
g206.seq
    1   atgttttccc ccgacaaaac ccttttcctc tgtctcggcg cactgctcct
   51   cgcctcatgc ggcacgacct ccggcaaaca ccgccaaccg aaacccaaac
  101   agacagtccg gcaaatccaa gccgtccgca tcagccacat cggccgcaca
  151   caaggctcgc aggaactcat gctccacagc ctcggactca tcggcacgcc
  201   ctacaaatgg ggcggcagca gcaccgcaac cggcttcgac tgcagcggca
  251   tgattcaatt ggtttacaaa aacgccctca acgtcaagct gccgcgcacc
  301   gcccgcgaca tggcggcggc aagccgcaaa atccccgaca gccgcctcaa
  351   ggccggcgac atcgtattct caacaccgg cggcgcacac cgctactcac
  401   acgtcggact ctacatcggc aacggcgaat tcatccatgc ccccggcagc
  451   ggcaaaacca tcaaaaccga aaaactctcc acaccgtttt acgccaaaaa
  501   ctaccttgga gcgcatacgt tttttacaga atga
```

This corresponds to the amino acid sequence <SEQ ID 716; ORF 206.ng>:

```
g206.pep
    1   MFSPDKTLFL CLGALLLASC GTTSGKHRQP KPKQTVRQIQ AVRISHIGRT
   51   QGSQELMLHS LGLIGTPYKW GGSSTATGFD CSGMIQLVYK NALNVKLPRT
  101   ARDMAAASRK IPDSRLKAGD IVFFNTGGAH RYSHVGLYIG NGEFIHAPGS
  151   GKTIKTEKLS TPFYAKNYLG AHTFFTE*
```

The following partial DNA sequence was identified in *N. meningitidis* <SEQ ID 717>:

```
m206.seq
    1   ATGTTTCCCC CCGACAAAAC CCTTTTCCTC TGTCTCAGCG CACTGCTCCT
   51   CGCCTCATGC GGCACGACCT CCGGCAAACA CCGCCAACCG AAACCCAAAC
  101   AGACAGTCCG GCAAATCCAA GCCGTCCGCA TCAGCCACAT CGACCGCACA
  151   CAAGGCTCGC AGGAACTCAT GCTCCACAGC CTCGGACTCA TCGGCACGCC
  201   CTACAAATGG GGCGGCAGCA GCACCGCAAC CGGCTTCGAT TGCAGCGGCA
  251   TGATTCAATT CGTTTACAAr AACGCCCTCA ACGTCAAGCT GCCGCGCACC
  301   GCCCGCGACA TGGCGGCGGC AAGCCGsAAA ATCCCCGAcA GCCGCyTCAA
  351   GGCCGGCGAC CTCGTATTCT TCAACACCGG CGGCGCACAC CGCTACTCAC
  401   ACGTCGGACT CTACATCGGC AACGGCGAAT TCATCCATGC CCCCAGCAGC
  451   GGCAAAACCA TCAAAACCGA AAAACTCTCC ACACCGTTTT ACGCCAAAAA
  501   CTACCTCGGC GCACATACTT TTTTTACAGA ATGA
```

This corresponds to the amino acid sequence <SEQ ID 718; ORF 206>:

```
m206.pep..
    1   MFPPDKTLFL CLSALLLASC GTTSGKHRQP KPKQTVRQIQ AVRISHIDRT
   51   QGSQELMLHS LGLIGTPYKW GGSSTATGFD CSGMIQFVYK NALNVKLPRT
```

```
    101    ARDMAAASRK IPDSRXKAGD LVFFNTGGAH RYSHVGLYIG NGEFIHAPSS

151    GKTIKTEKLS TPFYAKNYLG AHTFFTE*
```

Computer analysis of this amino acid sequence gave the following results:
Homology with a Predicted ORF from *N. gonorrhoeae*
ORF 206 shows 96.0% identity over a 177 aa overlap with a predicted ORF (ORF 206.ng) from *N. gonorrhoeae*:

```
    m206/g206
                    10         20         30         40         50         60
      m206.pep  MFPPDKTLFLCLSALLLASCGTTSGKHRQPKPKQTVRQIQAVRISHIDRTQGSQELMLHS
                || |||||||||:||||||||||||||||||||||||||||||||| ||||||||||||
          g206  MFSPDKTLFLCLGALLLASCGTTSGKHRQPKPKQTVRQIQAVRISHIGRTQGSQELMLHS
                    10         20         30         40         50         60

70         80         90        100        110        120
      m206.pep  LGLIGTPYKWGGSSTATGFDCSGMIQFVYKNALNVKLPRTARDMAAASRKIPDSRXKAGD
                |||||||||||||||||||||||||||:||||||||||||||||||||||||||| ||||
          g206  LGLIGTPYKWGGSSTATGFDCSGMIQLVYKNALNVKLPRTARDMAAASRKIPDSRLKAGD
                    70         80         90        100        110        120

130        140        150        160        170
      m206.pep  LVFFNTGGAHRYSHVGLYIGNGEFIHAPSSGKTIKTEKLSTPFYAKNYLGAHTFFTEX
                :||||||||||||||||||||||||||||:|||||||||||||||||||||||||||
          g206  IVFFNTGGAHRYSHVGLYIGNGEFIHAPGSGKTIKTEKLSTPFYAKNYLGAHTFFTE
                   130        140        150        160        170
```

The following partial DNA sequence was identified in *N. meningitidis* <SEQ ID 719>:

```
    a206.seq
       1    ATGTTTCCCC CCGACAAAAC CCTTTTCCTC TGTCTCAGCG CACTGCTCCT

51    CGCCTCATGC GGCACGACCT CCGGCAAACA CCGCCAACCG AAACCCAAAC

101    AGACAGTCCG GCAAATCCAA GCCGTCCGCA TCAGCCACAT CGACCGCACA

151    CAAGGCTCGC AGGAACTCAT GCTCCACAGC CTCGGACTCA TCGGCACGCC

201    CTACAAATGG GGCGGCAGCA GCACCGCAAC CGGCTTCGAT TGCAGCGGCA

251    TGATTCAATT CGTTTACAAA AACGCCCTCA ACGTCAAGCT GCCGCGCACC

301    GCCCGCGACA TGGCGGCGGC AAGCCGCAAA ATCCCCGACA GCCGCCTTAA

351    GGCCGGCGAC CTCGTATTCT TCAACACCGG CGGCGCACAC CGCTACTCAC

401    ACGTCGGACT CTATATCGGC AACGGCGAAT TCATCCATGC CCCCAGCAGC

451    GGCAAAACCA TCAAAACCGA AAAACTCTCC ACACCGTTTT ACGCCAAAAA

501    CTACCTCGGC GCACATACTT TCTTTACAGA ATGA
```

This corresponds to the amino acid sequence <SEQ ID 720; ORF 206.a>:

```
    a206.pep
       1    MFPPDKTLFL CLSALLLASC GTTSGKHRQP KPKQTVRQIQ AVRISHIDRT

51    QGSQELMLHS LGLIGTPYKW GGSSTATGFD CSGMIQFVYK NALNVKLPRT

101    ARDMAAASRK IPDSRLKAGD LVFFNTGGAH RYSHVGLYIG NGEFIHAPSS

151    GKTIKTEKLS TPFYAKNYLG AHTFFTE*
``` m206/a206 99.4% identity in 177 aa overlap

```
               10         20         30         40         50         60
m206.pep  MFPPDKTLFLCLSALLLASCGTTSGKHRQPKPKQTVRQIQAVRISHIDRTQGSQELMLHS
          ||||||||||||||||||||||||||||||||||||||||||||||||||||||||||||
a206      MFPPDKTLFLCLSALLLASCGTTSGKHRQPKPKQTVRQIQAVRISHIDRTQGSQELMLHS
               10         20         30         40         50         60

70         80         90        100        110        120
m206.pep  LGLIGTPYKWGGSSTATGFDCSGMIQFVYKNALNVKLPRTARDMAAASRKIPDSRXKAGD
          |||||||||||||||||||||||||||||||||||||||||||||||||||||||| |||
a206      LGLIGTPYKWGGSSTATGFDCSGMIQFVYKNALNVKLPRTARDMAAASRKIPDSRLKAGD
               70         80         90        100        110        120

130        140        150        160        170
m206.pep  LVFFNTGGAHRYSHVGLYIGNGEFIHAPSSGKTIKTEKLSTPFYAKNYLGAHTFFTEX
          |||||||||||||||||||||||||||||||||||||||||||||||||||||||||
a206      LVFFNTGGAHRYSHVGLYIGNGEFIHAPSSGKTIKTEKLSTPFYAKNYLGAHTFFTEX
              130        140        150        160        170
```

The following partial DNA sequence was identified in *N. gonorrhoeae* <SEQ ID 721>:

```
g209.seq
   1  atgctgcggc atttaggaaa cgacttcgcc ttgggcgcgt tgtttttcga
  51  tgctgcggtt gatgtgccac tgctgggcga tggtcaggag gttgttgacc
 101  acccagtaga gaaccaaacc ggcagggaag aagaagaaca tgacggagaa
 151  aaccaacggc atgattttca tcattttcgc ctgcatcggg tcggtcggcg
 201  gcgggttcag ataggtttgg gcgaacatcg ttgccgccat aatgatgggc
 251  aggatgtagt aggggtcggc gcggctgagg tcggtaatcc agcccagcca
 301  aggtgcctgg cgcaattcta cggaggcgaa caatgcccag tacaagccga
 351  tgaagacggg gatttgcaac agcataggca gacagccgcc cagcgggttg
 401  atttcctcgt cttcgaaaag ctgcatcatc gcttgctgtt gcgccatacg
 451  gtcgtcgccg tattttttctt tgatggtctg cagttcgggt gcggcggcac
 501  gcattttcgc catcgaacgg taggaggcgt tggtcaatgg atacagtacg
 551  gctttgacga tgatggtcaa acgacgatt gcccagcccc agttgccgat
 601  aatgttgtgc agttggttca ggagccagaa gagcggcgat gcgaaccagt
 651  gtactttacc gtagtctttt gccagttgca ggttgtcggc gatgtttgcg
 701  ataacggatg tggtttgcgg accggcatac aggttgaccg ccattttcgg
 751  ttttggcccc cgggttggga tagcggttaa
```

This corresponds to the amino acid sequence <SEQ ID 722; ORF 209.ng>:

```
g209.pep
   1  MLRHLGNDFA LGALFFDAAV DVPLLGDGQE VVDHPVENQT GREEEEHDGE
  51  NQRHDFHHFR LHRVGRRRVQ IGLGEHRCRH NDGQDVVGVG AAEVGNPAQP
 101  RCLAQFYGGE QCPVQADEDG DLQQHRQTAA QRVDFLVFEK LHHRLLLRHT
 151  VVAVFFFDGL QFGCGGTHFR HRTVGGVGQW IQYGFDDDGQ NDDCPAPVAD
 201  NVVQLVQEPE ERRCEPVYFT VVFCQLQVVG DVCDNGCGLR TGIQVDRHFR
 251  FWPPGWDSG*
```

The following partial DNA sequence was identified in *N. meningitidis* <SEQ ID 723>:

```
m209.seq
    1  ATGCTGCGGC ATTTAGGAAA CGACTTCGCC TTGGgGCGTT GTTTTTCGAT
   51  GCTGCGGTTG ATGTGCCATT GCTGGGCGAT GGTCAGGAGG TTGTTGACTA
  101  CCCAGTACAA TACCAGACCG GCAGGGAAGA AGAAGAACAT GACGGAGAAA
  151  ACCAACGGCA TGATTTTCAT CATTTTCGCC TGCATCGGGT CGGTCGGCGG
  201  CGGGTTCAGA TAAGTTTGGG CGAACATCGT TGCCGCCATA ATGATGGGCA
  251  GGATGTAGTA GGGGTCGGCG CGGCTGAGGT CGGTAATCCA ACCCAGCCAA
  301  GGTGCCTGGC GCAATTCTAC GGAGGCGAAC AATGCCCAAT ACAATCCGAT
  351  GAAGACGGGG ATTTGCAACA GCATAGGCAG GCAGCCGCCC AGCGGGTTGA
  401  TTTTCTCGTC TGTGTAAAGC TGCATCATCG CCTGTTGTTG CGCCATACGG
  451  TCGTCGCCGT ATTTCTCTTT GATGGCTTGC AGTTTGGGTG CGGCGGCACG
  501  CATTTTCGCC ATAGAGCGGT AAGAGGCGTT GGTCAATGGA TACAGTACGG
  551  CTTTGACGAT GATGGTTAAA ACGATAATCG CCCAGCCCCA GTTGCCGATG
  601  ATGTTGTGCA GTTGGTTCAG GAGCCAGAAG AGCGGGGAGG CGAACCAGTG
  651  TACTTTGCCG TAGTCTTTGG CCAGTTGCAG GTTGTCGGCG ATGTTTGCGA
  701  TGACGGATGT GGTCTGCGGG CCGGCGTAGA GGTTGATGGA GGCTTCGgTT
  751  TCGCGCCGTT TTGGATGGCG GCTAAAGGCA CGCTGACGCT GGTGCTGTAC
  801  AGCTTGTCGT TGCGGCGTTT GATGTCGATG TTGCACTCGC CTGCGGCGCA
  851  AACGCTTTGT CTGCCTTTAG GTTGGAGAAT CCAGGTGGAC ATGAAGTGGT
  901  GTTCAATCAT GCCGAGCCAG CCGGTCGGGG TTTTGCGGAT GTATTCGGCC
  951  TCGGATTTGC CGGATTTGGC ATCGTCGTCC AAGTCGGAAA AGCTGACTTT
 1001  TTGGAAGTTG CCTTCAGGGG TATAA
```

This corresponds to the amino acid sequence <SEQ ID 724; ORF 209>:

```
m209.pep
    1  MLRHLGNDFA LGALFFDAAV DVPLLGDGQE VVDYPVQYQT GREEEEHDGE
   51  NQRHDFHHFR LHRVGRRRVQ ISLGEHRCRH NDGQDVVGVG AAEVGNPTQP
  101  RCLAQFYGGE QCPIQSDEDG DLQQHRQAAA QRVDFLVCVK LHHRLLLRHT
  151  VVAVFLFDGL QFGCGGTHFR HRAVRGVGQW IQYGFDDDG* NDNRPAPVAD
  201  DVVQLVQEPE ERGGEPVYFA VVFGQLQVVG DVCDDGCGLR AGVEVDGGFG
  251  FAPFWMAAKG TLTLVLYSLS LRRLMSMLHS PAAQTLCLPL GWRIQVDMKW
  301  CSIMPSQPVG VLRMYSASDL PDLASSSKSE KLTFWKLPSG V*
```

Computer analysis of this amino acid sequence gave the following results:
Homology with a Predicted ORF from *N. gonorrhoeae*
ORF 209 shows 88.5% identity over a 253 aa overlap with a predicted ORF (ORF 209.ng) from *N. gonorrhoeae*:

```
m209/g209
                    10         20         30         40         50         60
    m209.pep  MLRHLGNDFALGALFFDAAVDVPLLGDGQEVVDYPVQYQTGREEEEHDGENQRHDFHHFR
              ||||||||||||||||||||||||||||||||:||:|||||||||||||||||||||||
        g209  MLRHLGNDFALGALFFDAAVDVPLLGDGQEVVDHPVENQTGREEEEHDGENQRHDFHHFR
                    10         20         30         40         50         60
```

-continued

```
                 70        80        90       100       110       120
m209.pep  LHRVGRRRVQISLGEHRCRHNDGQDVVGVGAAEVGNPTQPRCLAQFYGGEQCPIQSDEDG
          |||||||||||:|||||||||||||||||||||||||:|||||||||||||||:|:||||
g209      LHRVGRRRVQIGLGEHRCRHNDGQDVVGVGAAEVGNPAQPRCLAQFYGGEQCPVQADEDG
                 70        80        90       100       110       120

130       140       150       160       170       180
m209.pep  DLQQHRQAAAQRVDFLVCVKLHHRLLLRHTVVAVFLFDGLQFGCGGTHFRHRAVRGVGQW
          |||||||:|||||||||  ||||||||||||||||:||||||||||||||||:| |||||
g209      DLQQHRQTAAQRVDFLVFEKLHHRLLLRHTVVAVFFFDGLQFGCGGTHFRHRTVGGVGQW
                130       140       150       160       170       180

190       200       210       220       230       240
m209.pep  IQYGFDDDGXNDNRPAPVADDVVQLVQEPEERGGEPVYFAVVFGQLQVVGDVCDDGCGLR
          ||||||||| ||: ||||||:|||||||||||  |||||:||| ||||||||||:|||||
g209      IQYGFDDDGQNDDCPAPVADNVVQLVQEPEERRCEPVYFTVVFCQLQVVGDVCDNGCGLR
                190       200       210       220       230       240

250        260       270       280       290      299
m209.pep  AGVEVDGGFGF-APFWMAAKGTLTLVLYSLSLRRLMSMLHSPAAQTLCLPLGWRIQVDMK
          :|::||  | |  | |
g209      TGIQVDRHFRFWPPGWDSG
                250
```

The following partial DNA sequence was identified in *N. meningitidis* <SEQ ID 725>:

```
a209.seq
     1  ATGCTGCGGC ATTTAGGAAA CGACTTCGCC TTGGGCGCGT TGTTTTTCGA

51  TGCTGCGGTT GATGTGCCAT TGCTGGGCGA TGGTCAGGAG GTTGTTGATC

101  ACCCAGTACA ATACCAGACC GGCAGGGAAG AAGAAGAACA TGACGGAGAA

151  AACCAAAGGC ATGATTTTCA TCATTTTCGC CTGCATCGGG TCGGTCGGCG

201  GCGGGTTCAG ATAGGTTTGG GCGAACATCG TTGCCGCCAT AATGATGGGC

251  AGGATGTAGT AGGGGTCGGC GCGGCTGAGG TCGGTAATCC AACCCAGCCA

301  AGGTGCCTGG CGCAATTCTA CGGAGGCGAA CAATGCCCAA TACAATCCGA

351  TGAAGACGGG GATTTGCAAC AGCATAGGCA GGCAGCCGCC CAGCGGGTTG

401  ATTTTCTCGT CTGTGTAAAG CTGCATCATG GCTTGTTGCT GCGCCATACG

451  GTCGTCGCCG TATTTCTCTT TGATGGCTTG CAGTTTGGGC GCGGCGGCAC

501  GCATTTTCGC CATCGAACGG TAAGAGGCGT TGGTCAATGG ATACAGTACG

551  GCTTTGACGA TGATGGTTAA AACGATAATC GCCCAGCCCC AGTTGCCGAT

601  GATGTTGTGC AGTTGGTTCA AAAGCCAAAA GAGGGGGGAG GCGAACCAGT

651  GTACTTTGCC GTAGTCTTTG GCCAGTTGCA GGTTGTCGGC GATGTTTGCG

701  ATAACGGATG TGGTCTGTGG GCCGGCGTAG AGGTTGATGG AGGCTTCGGT

751  TTCGCACCGT TTTGGATAGC GGCTAAAGGC ACGCTGACGC TGGTGCTGTA

801  CAGCTTGTCG TTGCGGCGTT TGATGTCGAT ACGGCAGTCG CCAGCGGCGC

851  AAACGCTTTG TCCGCCTTTG GGTTGGAGGA TCCAGGTGGA CATGAAGTGG

901  TGTTCAATCA TGCCGAGCCA GCCGGTCGGG GTTTTGCGGA TGTATTCGGC

951  CTCGGATTTG CCGGATTTGG CATCGTCGTC CAAGTCGGAG AAGCTGACTT

1001  TTTGGAAGTT GCCTTCAGGG GTATAA
```

This corresponds to the amino acid sequence <SEQ ID 726; ORF 209.a>:

```
a209.pep
     1  MLRHLGNDFA LGALFFDAAV DVPLLGDGQE VVDHPVQYQT GREEEEHDGE

51  NQRHDFHHFR LHRVGRRRVQ IGLGEHRCRH NDGQDVVGVG AAEVGNPTQP
```

(In a209.pep line 1, "FA LGALFFDAAV DVPLL" is underlined on the page.)

```
-continued
101  RCLAQFYGGE QCPIQSDEDG DLQQHRQAAA QRVDFLVCVK LHHGLLLRHT

151  VVAVFLFDGL QFGRGGTHFR HRTVRGVGQW IQYGFDDDG* NDNRPAPVAD

201  DVVQLVQKPK EGGGEPVYFA VVFGQLQVVG DVCDNGCLW  AGVEVDGGFG

251  FAPFWIAAKG TLTLVLYSLS LRRLMSIRQS PAAQTLCPPL GWRIQVDMKW

301  CSIMPSQPVG VLRMYSASDL PDLASSSKSE KLTFWKLPSG V*
``` m209/a209 95.6% identity in 341 aa overlap

```
                  10         20         30         40         50         60
m209.pep  MLRHLGNDFALGALFFDAAVDVPLLGDGQEVVDYPVQYQTGREEEEHDGENQRHDFHHFR
          ||||||||||||||||||||||||||||||||:|||||||||||||||||||||||||||
a209      MLRHLGNDFALGALFFDAAVDVPLLGDGQEVVDHPVQYQTGREEEEHDGENQRHDFHHFR
                  10         20         30         40         50         60

70         80         90        100        110        120
m209.pep  LHRVGRRRVQISLGEHRCRHNDGQDVVGVGAAEVGNPTQPRCLAQFYGGEQCPIQSDEDG
          |||||||||||:||||||||||||||||||||||||||||||||||||||||||||||||
a209      LHRVGRRRVQIGLGEHRCRHNDGQDVVGVGAAEVGNPTQPRCLAQFYGGEQCPIQSDEDG
                  70         80         90        100        110        120

130        140        150        160        170        180
m209.pep  DLQQHRQAAAQRVDFLVCVKLHHRLLLRHTVVAVFLFDGLQFGCGGTHFRHRAVRGVGQW
          |||||||||||||||||||||| |||||||||||||||||| |||||||:||||||
a209      DLQQHRQAAAQRVDFLVCVKLHHGLLLRHTVVAVFLFDGLQFGRGGTHFRHRTVRGVGQW
                 130        140        150        160        170        180

190        200        210        220        230        240
m209.pep  IQYGFDDDGXNDNRPAPVADDVVQLVQEPEERGGEPVYFAVVFGQLQVVGDVCDDGCLR
          |||||||||||||||||||||||||||:|:||||||||||||||||||||||:|||||
a209      IQYGFDDDGXNDNRPAPVADDVVQLVQKPKEGGGEPVYFAVVFGQLQVVGDVCDNGCLW
                 190        200        210        220        230        240

250        260        270        280        290        300
m209.pep  AGVEVDGGFGFAPFWMAAKGTLTLVLYSLSLRRLMSMLHSPAAQTLCLPLGWRIQVDMKW
          ||||||||||||||||:|||||||||||||||||||| : ||||||||| ||||||||||
a209      AGVEVDGGFGFAPFWIAAKGTLTLVLYSLSLRRLMSIRQSPAAQTLCPPLGWRIQVDMKW
                 250        260        270        280        290        300

310        320        330        340
m209.pep  CSIMPSQPVGVLRMYSASDLPDLASSSKSEKLTFWKLPSGVX
          |||||||||||||||||||||||||||||||||||||||||
a209      CSIMPSQPVGVLRMYSASDLPDLASSSKSEKLTFWKLPSGVX
                 310        320        330        340
```

The following partial DNA sequence was identified in *N. gonorrhoeae* <SEQ ID 727>:

```
g211.seq
   1  atgttgcgga ttgctgctgc caatcagttg ggcggtcgaa atggtgcggc 51  ggtgggaaac ggggtcgata agtttgggcg tggtgctgat aatcaggttg 101  agtttttgga aggaaacctg attgtagtcg gcgcgtccgg gcgtgccgct 151  gtaacggtag ccgtggcgca attcgagcgt gcgtttgttg tccttcagcg 201  agaagttacc ttctttggcg aagatgatgt tgtcgccgcc gtttttgtcc 251  tgttcgcgca ggaacaggtt tttcatgatg ccggattcgg tgtcaaaggt 301  ttcgacgaaa taaaccctgc cgttgcgctt gcccaagtta ttgaactcgc 351  cggcttccac caaagacaat tcctgcttct gcttcaaaat ttcggcatat 401  tcgcggctgc gcagctctgc ccacggtatc acccaaagct gcatgacggc 451  aatcaggatg gcaaacggca cggcaaactg catgacgggg cgtatccact 501  gtttcaacgc caatccgcag gatag
```

This corresponds to the amino acid sequence <SEQ ID 728; ORF 211.ng>:

```
g211.pep
     1  MLRIAAANQL GGRNGAAVGN GVDKFGRGAD NQVEFLEGNL IVVGASGRAA

51  VTVAVAQFER AFVVLQREVT FFGEDDVVAA VFVLFAQEQV FHDAGFGVKG

101  FDEINPAVAL AQVIELAGFH QRQFLLLLQN FGIFAAAQLC PRYHPKLHDG

151  NQDGKRHGKL HDGAYPLFQR QSAG*
```

The following partial DNA sequence was identified in *N. meningitidis* <SEQ ID 729>:

```
m211.seq
     1  ATGTTGCGGG TTGCTGCTGC CAATCAGTTG GGCGGTCGGA ATGGTACGGC

51  GGTGGGAAAC GGGGTCGATG AGTTTGGGCG TGGTGCTGAT AATCAGGTTG

101  AGTTTTTGGA AGGAAACCTG ATTGTAGTCG GCGCGTCCGG GCGTGCCGCT

151  GTAACGGTAG CCGTGGCGCA ATTCGAGCGT GCGTTTGTTG TCGTTCAGCG

201  AGAAGTTACC TTCTTTGGCG AAGATGATGT TGTCGCCGCC GTTTTTGTCC

251  TGTTCGCGCA GGAACAGGTT TTTCATGATG CCGGATTCGG TATCGAAGGT

301  TTCGACAAAA TAAACCCTGC CGTTGCGCTT GCCCAAACTG TTGAACTCGC

351  CTGCCTCCAC CAAAGACAAT TCCTGCTTCT GCTTCAGGAT TTCAGCGTAT

401  TCGCGGCTGC GTAGCTCTGC CCACGGTATC ACCCAAAGCT GCATGACGGC

451  AACCAAAACG GCAAACGGCA CGGCAAACTG CATCACCGGG CGTATCCATT

501  GTTTCAATGC CAATCCGCAg GATAG
```

This corresponds to the amino acid sequence <SEQ ID 730; ORF 211>:

```
m211.pep
     1  MLRVAAANQL GGRNGTAVGN GVDEFGRGAD NQVEFLEGNL IVVGASGRAA

51  VTVAVAQFER AFVVVQREVT FFGEDDVVAA VFVLFAQEQV FHDAGFGIEG

101  FDKINPAVAL AQTVELACLH QRQFLLLLQD FSVFAAAXLC PRYHPKLHDG

151  NQNGKRHGKL HHRAYPLFQC QSAG*
```

Computer analysis of this amino acid sequence gave the following results:

Homology with a Predicted ORF from *N. gonorrhoeae*

ORF 211 shows 89.1% identity over a 174 aa overlap with a predicted ORF (ORF 211.ng) from *N. gonorrhoeae*:

```
m211/g211
                    10        20        30        40        50        60
m211.pep    MLRVAAANQLGGRNGTAVGNGVDEFGRGADNQVEFLEGNLIVVGASGRAAVTVAVAQFER
            |||:|||||||||||:|||||||:||||||||||||||||||||||||||||||||||||
g211        MLRIAAANQLGGRNGAAVGNGVDKFGRGADNQVEFLEGNLIVVGASGRAAVTVAVAQFER
                    10        20        30        40        50        60

70        80        90       100       110       120
m211.pep    AFVVVQREVTFFGEDDVVAAVFVLFAQEQVFHDAGFGIEGFDKINPAVALAQTVELACLH
            ||||:||||||||||||||||||||||||||||||||::|||:|||||||||::||| :|
g211        AFVVLQREVTFFGEDDVVAAVFVLFAQEQVFHDAGFGVKGFDEINPAVALAQVIELAGFH
                    70        80        90       100       110       120

130       140       150       160       170
m211.pep    QRQFLLLLQDFSVFAAAXLCPRYHPKLHDGNQNGKRHGKLHHRAYPLFQCQSAGX
            |||||||||:|::|||| ||||||||||||||:||||||||  |||||| ||||
g211        QRQFLLLLQNFGIFAAAQLCPRYHPKLHDGNQDGKRHGKLHDGAYPLFQRQSAG
                   130       140       150       160       170
```

The following partial DNA sequence was identified in *N. meningitidis* <SEQ ID 731>:

a211.seq
```
    1  ATGTTGCGGG TTGCTGCTGC CAATCAGTTG GGCGGTCGGA ATGGTACGGC

51  GGTGGGAAAC GGGGTCGATG AGTTTGGGCG TGGTGCTGAT AATCAGGTTG

101  AGTTTTTGGA AGGAAACCTG ATTGTAGTCG GCGCGTCCGG GCGTGCCGCT

151  GTAACGGTAG CCGTGGCGCA ATTCGAGCGT GCGTTTGTTG TCGTTCAGCG

201  AGAAGTTACT TTCTTTGGCG AAGATGATGT TGTCGCCGCC GTTTTTGTCC

251  TGTTCGCGCA GGAACAGGTT TTTCATGATG CCGGATTCGG TATCGAAGGT

301  TTCGACAAAA TAAACCCTGC CGTTGCGCTT GCCCAAACTG TTGAACCCGC

351  CTGCCTCCAC CAAAGACAAT TCCTGCTTCT GCTTCAGGAT TTCAGCGTAT

401  TCGCGGCTGC GTAGCTCTGC CCACGGTATC ACCCAAAGCT GCATGACGGC

451  AACCAAAACG GCAAACGGCA CGGCAAACTG CATCACCGGG CGTATCCATT

501  GTTTCAATGC CAATCCGCAG GATAG
```

This corresponds to the amino acid sequence <SEQ ID 732; ORF 211.a>:

a211.pep
```
    1  MLRVAAANQL GGRNGTAVGN GVDEFGRGAD NQVEFLEGNL IVVGASGRAA

51  VTVAVAQFER AFVVVQREVT FFGEDDVVAA VFVLFAQEQV FHDAGFGIEG

101  FDKINPAVAL AQTVEPACLH QRQFLLLLQD FSVFAAA*LC PRYHPKLHDG

151  NQNGKRHGKL HHRAYPLFQC QSAG*
``` m211/a211 99.4% identity in 174 aa overlap

```
                10         20         30         40         50         60
m211.pep  MLRVAAANQLGGRNGTAVGNGVDEFGRGADNQVEFLEGNLIVVGASGRAAVTVAVAQFER
          ||||||||||||||||||||||||||||||||||||||||||||||||||||||||||||
a211      MLRVAAANQLGGRNGTAVGNGVDEFGRGADNQVEFLEGNLIVVGASGRAAVTVAVAQFER
                10         20         30         40         50         60

70         80         90        100        110        120
m211.pep  AFVVVQREVTFFGEDDVVAAVFVLFAQEQVFHDAGFGIEGFDKINPAVALAQTVELACLH
          ||||||||||||||||||||||||||||||||||||||||||||||||||||||||||||
a211      AFVVVQREVTFFGEDDVVAAVFVLFAQEQVFHDAGFGIEGFDKINPAVALAQTVEPACLH
                70         80         90        100        110        120

130        140        150        160        170
m211.pep  QRQFLLLLQDFSVFAAAXLCPRYHPKLHDGNQNGKRHGKLHHRAYPLFQCQSAGX
          ||||||||||||||||||||||||||||||||||||||||||||||||||||||
a211      QRQFLLLLQDFSVFAAAXLCPRYHPKLHDGNQNGKRHGKLHHRAYPLFQCQSAGX
               130        140        150        160        170
```

The following partial DNA sequence was identified in *N. gonorrhoeae* <SEQ ID 733>:

g212.seq (partial)
```
    1  atggacaatc tcgtatggga cggcattccc gacatccgca cactcgacca 51  aaccatccgc aaacacgcac acccgctcaa cctgattgtc tgcctccccg 101  ataatcagat tcccgatttt caaaccgcac aagatgcttc ggactcggaa 151  tgccgtctga agcaccgttt ggatcaggca acccagtgcc tccagttcga 201  cagcatcaac ctcatcgaac acatcctgcc cgatgtccgc ttctggctgg 251  ttccccttc acgcacccgc cgcctgcacg aacacttcca ccacatttcc 301  tggcagaccg aagccatccc gcaaaccgaa agcaagtccg acaaaccctg 351  gtttgcactt ccacaaacat ccgaacggaa aaaaccggaa cacgtcctcg
```

-continued

```
 401   tcatcggtgc aggcattgcc ggcgcatcga ccgcccacgc cttagcatca 451   cacggcattt ccgttaccgt attggaagcc cgaaaagccg ctcaagccgc 501   cagcggcaac cggcaagggc tgctttacgc caaaatctcg ccgcacgaca 551   ccggacagac cgaactgctg cttgccggct acggctacac caaacgcctg 601   ctcggacaca tcctgcccga ctccgacact tggggcggca acggcatcat 651   ccacctcaat tacagccgca ccgaacaaca cgcaatcac gaattgggtt 701   tgcaaaaaca ccataaccac ctctaccgca gcatcacgtc tgcagaagcc 751   gaaaaaatcg ccggcatccc gctgaacacg ccctacgccg aaccattatg 801   cggactctac tggcaacacg gcgtatggct caatccgccc gcattcgtcc 851   gcaccctcct cagccatccg ctgatcgaac tatatgaaaa cacaacgtta 901   accggcattt cccacgacgg agaaaagtgg attgcaagca cgccaaacgg 951   cacatttacc gccacacaca tcatctactg caccggcgcg cacagcccct 1001   gcctgcccga aaccaacctc gccgccctac ccctcaggca aatacgcgga 1051   caaaccggcc tcacaccgtc caccccgttt tccgaacaac tgcgttgcgc 1101   cgtttcaggc gaaagctaca tcagcccgtc gtggcacgga ctgcactgct 1151   acggcgcgag ttttattccc aacagcagca ataccggatg gaacgaagcc 1201   gaagaagcct caaaccgcca agcattggca caccttaacc ccgcccttgc 1251   cgaatcattg ttt...
```

This corresponds to the amino acid sequence <SEQ ID 734; ORF 212.ng>:

```
g212.pep (partial)
     1  MDNLVWDGIP DIRTLDQTIR KHAHPLNLIV CLPDNQIPDF QTAQDASDSE

51  CRLKHRLDQA TQCLQFDSIN LIEHILPDVR FWLVPPSRTR RLHEHFHHIS

101  WQTEAIPQTE SKSDKPWFAL PQTSERKKPE HVLVIGAGIA GASTAHALAS

151  HGISVTVLEA RKAAQAASGN RQGLLYAKIS PHDTGQTELL LAGYGYTKRL

201  LGHILPDSDT WGGNGIIHLN YSRTEQQRNH ELGLQKHHNH LYRSITSAEA

251  EKIAGIPLNT PYAEPLCGLY WQHGVWLNPP AFVRTLLSHP LIELYENTTL

301  TGISHDGEKW IASTPNGTFT ATHIIYCTGA HSPCLPETNL AALPLRQIRG

351  QTGLTPSTPF SEQLRCAVSG ESYISPSWHG LHCYGASFIP NSSNTGWNEA

401  EEASNRQALA HLNPALAESL F...
```

50

The following partial DNA sequence was identified in *N. meningitidis* <SEQ ID 735>:

```
m212.seq
     1  ATGGACAATC TCGTATGGGA CGGCATTCCC GACATCCGCA CACTCGACCA

51  AGCCATCCGC AAACACGCAC CCCCGCTCAA CCTGATTATC TGCCTCCCCG

101  ATAATCAGAT TCCCGATTTT CAAACCGCAC AAGATGCTTC GGACGCGGAA

151  TGCCGTCTGA AGCACCGTTT GGATCAGGCA ATGCAGTGCC TCCAGTTCGA

201  CAGCATCAAC CTCATCGAAC ACATCCTGCC CGATGTCCGC TTCTGGCTGG

251  TTCCCCCTTC ACGCACCCAC CACCTGCACG AACATTTCCA CCACATTTCC

301  TGGCAGACCG AAGCCATCCC GCAAACCGAA AGCAAGCCCG ACAAACCCTG
```

-continued

```
 351    GTTTGCACTT CCACAAACAT CCGAACGGCA AAAACCGGAA CACATCCTCG

401    TTATCGGCGC GGGCATATCC GGCGCGGCAA CCGCCCACGC CTTAGCATCA

451    CACGGCATTT CCGTTACCGT ATTGGAAGCC CGAAAAGCCG CCCAAGCCGC

501    CAGCGGCAAC CGCCAAGGGC TGCTCTACGC CAAAATCTCG CCGCACGACA

551    CCGAACAGAC CGAACTTTTG CTTGCCGGCT ACGGCTACAC CAAACGCCTG

601    CTCGGACACA TCCTGCCCGA ATCCGAAACC TGGGGCGGCA ACGGCATCAT

651    CCACCTCAAT TACAGCCGCA CCGAACAACA ACGCAATCAC GAATTGGGTT

701    TGCAAAAACA CCATAACCAC CTCTACCGCA GCATCACATC TGCAGAAGCC

751    GAAAAAATCG CCGGTATCCC ACTGTCCGTC CCATACGACC ACCCTTCATG

801    CGGACTCTAC TGGCAACACG GCGTATGGCT CAATCCACCC GCATTCGTCC

851    GCACCCTCCT CAACCATCCG CTCATTGGAC TACACGAAGA CACACCCTTG

901    ACCGACATTT CCCACGACGG GGaAAAGTGG ATTGCAAGCA CGCCAAACGG

951    CACATTTACC GCCACACACA TCATCTACTG CACCGGTGCG AACAGCCCCT

1001    ACCTACCCGA AACCAACCTC GCCGCCCTGC CTCTCAGGCA AATACGCGGA

1051    CAAACCGGCC TCACACCGTC CACCCCGTTT CCGAACAAC  TGCGTTGCGC

1101    CGTTTCAGGC GAAAGCTACA TCAGCCCGTC GTGGCACGGA CTGCACTGCT

1151    ACGGCGCGAG TTTTATTCCC AACAGCAGCC ATACCGGATG GAACGAAGCC

1201    GAAGAAGCCT CAAACCGCCA AGCATTGGCA CACCTTAACC CCGCCCTTTC

1251    CGAATCATTG TTTGCCGCCA ACCCAAACCC CCAAAAACAC CAAGGGCACG

1301    CCGCCATACG CTGCGACAGC CCCGACCACC TTCCCCTAGT CGGCGCACTC

1351    GGCGACATTG CCGCCATGCG GCAGACCTAC ACCAAACTCG CGCTGGACAA

1401    AAACTACCGC ATCGACACCC CATGCCCATA CCTGCCTAAT GCCTACGTCA

1451    ACACCGCGCA CGGCACCCGC GGACTCGCCA CCGCCCCCAT CTGCGCCGCC

1501    GmCAwTGCAG CCCAAATCsT AGGCyTGCCC CATCCCTTTT yAcAAcGCCT 1551    gCGCCACGCC cTAcACCCCA ACCGCACCAT CATCCGCGCC ATCGTCAGAA

1601    GGAAGGATCT AACCCCTTAA
```

This corresponds to the amino acid sequence <SEQ ID 736; ORF 212>:

```
m212.pep
   1   MDNLVWDGIP DIRTLDQAIR KHAPPLNLII CLPDNQIPDF QTAQDASDAE

51   CRLKHRLDQA MQCLQFDSIN LIEHILPDVR FWLVPPSRTH HLHEHFHHIS

101   WQTEAIPQTE SKPDKPWFAL PQTSERQKPE HILVIGAGIS GAATAHALAS

151   HGISVTVLEA RKAAQAASGN RQGLLYAKIS PHDTEQTELL LAGYGYTKRL

201   LGHILPESET WGGNGIIHLN YSRTEQQRNH ELGLQKHHNH LYRSITSAEA

251   EKIAGIPLSV PYDHPSCGLY WQHGVWLNPP AFVRTLLNHP LIGLHEDTPL

301   TDISHDGEKW IASTPNGTFT ATHIIYCTGA NSPYLPETNL AALPLRQIRG

351   QTGLTPSTPF SEQLRCAVSG ESYISPSWHG LHCYGASFIP NSSHTGWNEA

401   EEASNRQALA HLNPALSESL FAANPNPQKH QGHAAIRCDS PDHLPLVGAL

451   GDIAAMRQTY TKLALDKNYR IDTPCPYLPN AYVNTAHGTR GLATAPICAA

501   XXAAQIXGLP HPFXQRLRHA LHPNRTIIRA IVRRKDLTP*
```

Computer analysis of this amino acid sequence gave the following results:
Homology with a Predicted ORF from *N. gonorrhoeae*
ORF 212 shows 92.9% identity over a 421 aa overlap with a predicted ORF (ORF 212.ng) from *N. gonorrhoeae*:

```
m212/g212

10        20        30        40        50        60
   m212.pep    MDNLVWDGIPDIRTLDQAIRKHAPPLNLIICLPDNQIPDFQTAQDASDAECRLKHRLDQA
               ||||||||||||||||||:|||||||||||:|||||||||||||||:|||||||||||||
   g212        MDNLVWDGIPDIRTLDQTIRKHAPPLNLIVCLPDNQIPDFQTAQDASDSECRLKHRLDQA
                  10        20        30        40        50        60

70        80        90       100       110       120
   m212.pep    MQCLQFDSINLIEHILPDVRFWLVPPSRTHHLHEHFHHISWQTEAIPQTESKPDKPWFAL
               :|||||||||||||||||||||||||||||::|||||||||||||||||||||:||||||
   g212        TQCLQFDSINLIEHILPDVRFWLVPPSRTRRLHEHFHHISWQTEAIPQTESKSDKPWFAL
                  70        80        90       100       110       120

130       140       150       160       170       180
   m212.pep    PQTSERQKPEHILVIGAGISGAATAHALASHGISVTVLEARKAAQAASGNRQGLLYAKIS
               ||||||:||||:||||||:|:|||||||||||||||||||||||||||||||||||||||
   g212        PQTSERKKPEHVLVIGAGIAGASTAHALASHGISVTVLEARKAAQAASGNRQGLLYAKIS
                 130       140       150       160       170       180

190       200       210       220       230       240
   m212.pep    PHDTEQTELLLAGYGYTKRLLGHILPESETWGGNGIIHLNYSRTEQQRNHELGLQKHHNH
               ||||  ||||||||||||||||||||||:|:|||||||||||||||||||||||||||||
   g212        PHDTGQTELLLAGYGYTKRLLGHILPDSDTWGGNGIIHLNYSRTEQQRNHELGLQKHHNH
                 190       200       210       220       230       240

250       260       270       280       290       300
   m212.pep    LYRSITSAEAEKIAGIPLSVPYDHPSCGLYWQHGVWLNPPAFVRTLLNHPLIGLHEDTPL
               ||||||||||||||||||:::||  :|||||||||||||||||||||||:||||  |:|:|  |
   g212        LYRSITSAEAEKIAGIPLNTPYAEPLCGLYWQHGVWLNPPAFVRTLLSHPLIELYENTTL
                 250       260       270       280       290       300

310       320       330       340       350       360
   m212.pep    TDISHDGEKWIASTPNGTFTATHIIYCTGANSPYLPETNLAALPLRQIRGQTGLTPSTPF
               | |||||||||||||||||||||||||||::||  |||||||||||||||||||||||||
   g212        TGISHDGEKWIASTPNGTFTATHIIYCTGAHSPCLPETNLAALPLRQIRGQTGLTPSTPF
                 310       320       330       340       350       360

370       380       390       400       410       420
   m212.pep    SEQLRCAVSGESYISPSWHGLHCYGASFIPNSSHTGWNEAEEASNRQALAHLNPALSESL
               |||||||||||||||||||||||||||||||||:||||||||||||||||||||||:|||
   g212        SEQLRCAVSGESYISPSWHGLHCYGASFIPNSSNTGWNEAEEASNRQALAHLNPALAESL
                 370       380       390       400       410       420

430       440       450       460       470       480
   m212.pep    FAANPNPQKHQGHAAIRCDSPDHLPLVGALGDIAAMRQTYTKLALDKNYRIDTPCPYLPN
               |
   g212        F
```

The following partial DNA sequence was identified in *N. meningitidis* <SEQ ID 737>:

```
a212.seq
    1    ATGGACAATC TCGCATGGAA CGGCATTCCC GACATCCGCA CACTCGACCA

51    AACCATCCGC AAACACGCAC ACCCGCTCAA CCTGATTGTC TGCCTCCCCG

101    ATAATCAGAT TCCCAATTTT CAAACCGCAC AAGATGCTTC GGACGCGGAA

151    TGCCGTCTGA AGCACCGTTT GGATCAGGCA ACCCAGTGCC TCCAGTTCGA

201    CAGCATCAAC CTGATTGAAC ACATCCTGCC CGATGTCCGC TTCTGGCTGG

251    TTCCCCCTTC ACGCACCCGC CGCCTGCACG AACACTTCCA CCACATTTCC

301    TGGCAGACCG AAGCCATCCC GCAAACCGAA AGTAAGCCCG ACAAACCCTG

351    GTTTGCACTT CCACAAACAT CCGAACGGCA AAAACCGGAA CACATCCTCG

401    TTATCGGAGC GGGCATATCC GGCGCGGCAA CCGCCCACGC CTTAGCATCA

451    TACGGCATTT CCGTTACCGT ATTGGAAGCC CGAAAAGCCG CCCAAGCCGC

501    CAGCGGCAAC CGCCAAGGGC TGCTCTACGC CAAAATCTCG CCGCACGACA

551    CCGAACAAAC CGAACTGCTG CTTGCCGGCT ACGGCTACAC CAAACGCCTG
```

```
-continued
 601 CTCGGACATA TCCTGCCCGA ATCCGAAACC TGGGGCGGCA ACGGCATCAT

651 CCACCTCAAT TACAGCCGCA CCGAACAACA ACGCAATCAC GAATTGGGTT

701 TGCAAAAACA CCATAACCAC CTCTACCGCA GCATCACGCA GGCAGAAGCC

751 GAAAAAATCG CCGGCATCCC TCTGAACACG CCCTACGCCG AACCATTATG

801 CGGACTGTTT TGGCAGTACG GCGTATGGCT CAATCCTCCC ACATTCGTCC

851 GCGCCCTCCT CAGCCATCCG CTCATTGGAC TACACGAAGA CACACCGTTA

901 ACCGACATTT CCCACGACGG GGAAAAGTGG ATTGCAAGCA CGCCAAACGG

951 CACATTTACC GCCACACACA TCATCTACTG CACCGGTGCG AACAGCCCCT

1001 ACCTACCCGA AACCAACCTC GCCACCCTGC CCCTCAGGCA AATACGCGGA

1051 CAAACCGGCC TCACACCGTC CACCCCGTTT TCCGAACAAC TGCGTTGCGC

1101 CGTTTCAGGC GAAAGCTACA TCAGCCCGTC GTGGCACGGA CTGCACTGCT

1151 ACGGCGCGAG TTTTATTCCC AACAGCAGCC ATACCGGATG GAACGAAGCC

1201 GAAGAAGCCT CAAACCGCCA AGCATTGGCA CACCTTAACC CCGCCCTTTC

1251 CGAATCATTG TTTGCCGCCA ACCCAAACCC CCAAAAACAC CAAGGGCACG

1301 CCGCCATACG CTGCGACAGC CCCGACCACC TTCCCCTAGT CGGCGCACTC

1351 GGCGACATTG CCGCTATGCA ACAAACTTAC GCCAAACTCG CGCTGGACAA

1401 AAACTATCGC ATCGATGCCC CCTGCCCGTA CCTGCCCAAT GCCTACGCCA

1451 ACACCGCCCA CGGCACACGC GGGCTTGCCA CCGCCCCCAT CTGCGCCGCC

1501 GCCGTTGCAG CCGAAATCCT AGGCTTGCCC CATCCCCTCT CAAAACGCCT

1551 GCGCCACGCC CTACACCCCA ACCGCGCCAT CATCCGCGCC ATCGTCAGAA

1601 GGAAGGATCT AACCCCTTAA
                                                     35
```

This corresponds to the amino acid sequence <SEQ ID 738; ORF 212.a>:

```
a212.pep
    1 MDNLAWNGIP DIRTLDQTIR KHAHPLNLIV CLPDNQIPNF QTAQDASDAE

51 CRLKHRLDQA TQCLQFDSIN LIEHILPDVR FWLVPPSRTR RLHEHFHHIS

101 WQTEAIPQTE SKPDKPWFAL PQTSERQKPE HILVIGAGIS GAATAHALAS

151 YGISVTVLEA RKAAQAASGN RQGLLYAKIS PHDTEQTELL LAGYGYTKRL

201 LGHILPESET WGGNGIIHLN YSRTEQQRNH ELGLQKHHNH LYRSITQAEA

251 EKIAGIPLNT PYAEPLCGLF WQYGVWLNPP TFVRALLSHP LIGLHEDTPL

301 TDISHDGEKW IASTPNGTFT ATHIIYCTGA NSPYLPETNL ATLPLRQIRG

351 QTGLTPSTPF SEQLRCAVSG ESYISPSWHG LHCYGASFIP NSSHTGWNEA

401 EEASNRQALA HLNPALSESL FAANPNPQKH QGHAAIRCDS PDHLPLVGAL

451 GDIAAMQQTY AKLALDKNYR IDAPCPYLPN AYANTAHGTR GLATAPICAA

501 AVAAEILGLP HPLSKRLRHA LHPNRAIIRA IVRRKDLTP*
``` m212/a212 93.7% identity in 539 aa overlap

```
                  10         20         30         40         50         60
      m212.pep   MDNLVWDGIPDIRTLDQAIRKHAPPLNLIICLPDNQIPDFQTAQDASDAECRLKHRLDQA
                 ||||:|:|||||||||||:|||:|||||||:|||||||:||||||||||||||||||||
      a212       MDNLAWNGIPDIRTLDQTIRKHAHPLNLIVCLPDNQIPNFQTAQDASDAECRLKHRLDQA
                  10         20         30         40         50         60
```

```
            70         80         90        100        110        120
m212.pep  MQCLQFDSINLIEHILPDVRFWLVPPSRTHHLHEHFHHISWQTEAIPQTESKPDKPWFAL
          ||||||||||||||||||||||||||||::|||||||||||||||||||||||||||||
a212      TQCLQFDSINLIEHILPDVRFWLVPPSRTRRLHEHFHHISWQTEAIPQTESKPDKPWFAL
            70         80         90        100        110        120

130        140        150        160        170        180
m212.pep  PQTSERQKPEHILVIGAGISGAATAHALASHGISVTVLEARKAAQAASGNRQGLLYAKIS
          ||||||||||||||||||||||||||||||:|||||||||||||||||||||||||||||
a212      PQTSERQKPEHILVIGAGISGAATAHALASYGISVTVLEARKAAQAASGNRQGLLYAKIS
           130        140        150        160        170        180

190        200        210        220        230        240
m212.pep  PHDTEQTELLLAGYGYTKRLLGHILPESETWGGNGIIHLNYSRTEQQRNHELGLQKHHNH
          ||||||||||||||||||||||||||||||||||||||||||||||||||||||||||||
a212      PHDTEQTELLLAGYGYTKRLLGHILPESETWGGNGIIHLNYSRTEQQRNHELGLQKHHNH
           190        200        210        220        230        240

250        260        270        280        290        300
m212.pep  LYRSITSAEAEKIAGIPLSVPYDHPSCGLYWQHGVWLNPPAFVRTLLNHPLIGLHEDTPL
          ||||||:|||||||||||::||:|||:|||:|||||||||:|||:||||||||||||||
a212      LYRSITQAEAEKIAGIPLNTPYAEPLCGLFWQYGVWLNPPTFVRALLSHPLIGLHEDTPL
           250        260        270        280        290        300

310        320        330        340        350        360
m212.pep  TDISHDGEKWIASTPNGTFTATHIIYCTGANSPYLPETNLAALPLRQIRGQTGLTPSTPF
          ||||||||||||||||||||||||||||||||||||||||:|||||||||||||||||||
a212      TDISHDGEKWIASTPNGTFTATHIIYCTGANSPYLPETNLATLPLRQIRGQTGLTPSTPF
           310        320        330        340        350        360

370        380        390        400        410        420
m212.pep  SEQLRCAVSGESYISPSWHGLHCYGASFIPNSSHTGWNEAEEASNRQALAHLNPALSESL
          ||||||||||||||||||||||||||||||||||||||||||||||||||||||||||||
a212      SEQLRCAVSGESYISPSWHGLHCYGASFIPNSSHTGWNEAEEASNRQALAHLNPALSESL
           370        380        390        400        410        420

430        440        450        460        470        480
m212.pep  FAANPNPQKHQGHAAIRCDSPDHLPLVGALGDIAAMRQTYTKLALDKNYRIDTPCPYLPN
          ||||||||||||||||||||||||||||||||||||:|||:|||||||||||:||||||
a212      FAANPNPQKHQGHAAIRCDSPDHLPLVGALGDIAAMQQTYAKLALDKNYRIDAPCPYLPN
           430        440        450        460        470        480

490        500        510        520        530        540
m212.pep  AYVNTAHGTRGLATAPICAAXXAAQIXGLPHPFXQRLRHALHPNRTIIRAIVRRKDLTPX
          ||:|||||||||||||||||  ||:||||||: :|||||||||:||||||||||||||||
a212      AYANTAHGTRGLATAPICAAAVAAEILGLPHPLSKRLRHALHPNRAIIRAIVRRKDLTPX
           490        500        510        520        530        540
```

The following partial DNA sequence was identified in *N. gonorrhoeae* <SEQ ID 739>:

```
g214.seq
    1  atgatacaaa agatatgtaa gctatttgtt ttaattgtaa tttttgcaac 51  ttctcccgct tttgcccttc aaagcgacag cagacggccc atccaaatcg 101  aagccgacca aggttcgctc gatcaagcca accaaggac cacatttagc 151  ggcaatgtca tcatcagaca gggtacgctc aacatttccg cctcgtgtgt 201  caacgtcaca cgcggcaggc aaaggcggcg aatccgtgag gcggaaggt 251  tcgcccgtcc gcttcagcca acgttggac gggggcaaag gacggtgcg 301  cggtcaggca acaacgtta cctattcctc gcaggaagc actgtcgttc 351  tgaccggcaa tgccaaagtg cagcgcggcg cgacgttgc cgaaggtgcg 401  gtcattacct acaacaccaa aaccgaagtc tataccatca acggcagcac 451  gaaatcgggt gcgaaatccg cttccaaaac cggcagggtc agcgtcgtca 501  tccagccttc aagcacacaa aaaaccgaat aaccccgatg ccgtctgaaa 551  cggaaacgca gttcagacgg catttgccga ccgaaatgcc gagaagagat 601  tattga
```

This corresponds to the amino acid sequence <SEQ ID 740; ORF 214.ng>:

```
g214.pep
     1  MIQKICKLFV LIVIFATSPA FALQSDSRRP IQIEADQGSL DQANQRTTFS

51  GNVIIRQGTL NISASCVNVT RGRQRRRIRE GGRFARPLQP NVGRGQRDGA

101  RSGKQRYLFL RRKHCRSDRQ CQSAARRRRC RRCGHYLQHQ NRSLYHQRQH

151  EIGCEIRFQN RQGQRRHPAF KHTKNRITPM PSETETQFRR HLPTEMPRRD

201  Y
```

The following partial DNA sequence was identified in *N. meningitidis* <SEQ ID 741>:

```
m214.seq (partial)
     1  ATGATACAAA AGATATGTAA GCTATTTGTT TTAATAGCAT TTTTTTCGGC

51  GTCCCCCGCT TTTGCCCTTC AAAGCGACAG CAGGCAGCCT ATTCAGATTG

101  AGGCCGACCA AGGTTCGCTC GATCAAGCCA ACCAAAGCAC CACATTCAGC

151  GGAAACGTCG TCATCAGACA GGGTACGCTC AATATTTCCG CCGCCCGCGT

201  CAATGTTACA CGCGGCGGCA AAGGCGGCGA ATCCGTGAGG GCGGAAGGTT

251  CGCCAGTCCG CTTCAGCCAG ACATTGGACG GCGGCAAAGG CACGGTGCGC

301  GGACAGGCAA ACAACGTTGC TTATTCATCT GCAGGCAGCA CCGTAGTCTT

351  AACCGGTAAT GCCAAAGTAC AGCGCGGCGG CGATGTCGCC GAAGGTGCGG

401  TGATTACATA CAACACCAAA ACCGAAGTCT ATACCATCAG CGGCAGCACA

451  AAATT...
```

This corresponds to the amino acid sequence <SEQ ID 742; ORF 214>:

```
m214.pep (partial)
     1  MIQKICKLFV LIAFFSASPA FALQSDSRQP IQIEADQGSL DQANQSTTFS

51  GNVVIRQGTL NISAARVNVT RGRQRRRIRE GGRFASPLQP DIGRRQRHGA

101  RTGKQRCLFI CRQHRSLNR* CQSTARRRCR RRCGDYIQHQ NRSLYHQRQH

151  KI...
```

Computer analysis of this amino acid sequence gave the following results:

Homology with a Predicted ORF from *N. gonorrhoeae*

ORF 214 shows 80.3% identity over a 152 aa overlap with a predicted ORF (ORF 214.ng) from *N. gonorrhoeae*:

```
m214/g214
                    10        20        30        40        50        60
m214.pep   MIQKICKLFVLIAFFSASPAFALQSDSRQPIQIEADQGSLDQANQSTTFSGNVVIRQGTL
           ||||||||||||::|::|||||||||||:|||||||||||||||| |||||||:||||||
g214       MIQKICKLFVLIVIFATSPAFALQSDSRRPIQIEADQGSLDQANQRTTFSGNVIIRQGTL
                    10        20        30        40        50        60

70        80        90       100       110       120
m214.pep   NISAARVNVTRGRQRRRIREGGRFASPLQPDIGRRQRHGARTGKQRCLFICRQHRSLNRX
           ||||: ||||||||||||||||||| ||||::|| || |||:|||| ||: |:|   :|
g214       NISASCVNVTRGRQRRRIREGGRFARPLQPNVGRGQRDGARSGKQRYLFLRRKHCRSDRQ
                    70        80        90       100       110       120

130       140       150
m214.pep   CQSTARRRCRRRCGDYIQHQNRSLYHQRQHKI
           |||:||||  |||| |:|||||||||||||:|
g214       CQSAARRRRCRRCGHYLQHQNRSLYHQRQHEIGCEIRFQNRQGQRRHPAFKHTKNRITPM
                   130       140       150       160       170       180 g214       PSETETQFRRHLPTEMPRRDY
                   190       200
```

The following partial DNA sequence was identified in *N. meningitidis* <SEQ ID 743>:

```
a214.seq
    1   ATGATACAAA AGATATGTAA GCTATTTGTT TTAATAGCAT TTTTTTCGGC

51   GTCCCCCGCT TTTGCCCTTC AAAGCGACAG CAGGCAGCCT ATTCAGATTG

101   AGGCCGACCA AGGTTCGCTC GATCAAGCCA ACCAAAGCAC CACATTCAGC

151   GGAAACGTCG TCATCAGACA GGGTACGCTC AATATTTCCG CCGCCCGCGT

201   CAATGTTACA CGCGGC.GGC AAAGGCGGCG AATCCGTGAG GCGGAAGGT

251   TCGCCAGTCC GCTTCAGCCA GACATTGGAC GGCGGCAAAG GCACGGTGCG

301   CGGACAGGCA ACAACGTTG CTTATTCATC TGCAGGCAGC ACCGTAGTCT

351   TAACCGGTAA TGCCAAAGTA CAGCGCGGCG GCGATGTCGC CGAAGGTGCG

401   GTGATTACAT ACAACACCAA AACCGAAGTC TATACCATCA GCGGCAGCAC

451   AAAATCCGGC GCAAAATCCG CTTCCAAATC CGGCAGGGTC AGCGTCGTTA

501   TCCAGCCTTC GAGTACGCAA AAATCCGAAT AATCCCAATG CCGTCTGAAA

551   CATAAACCTG GTTCGGACGG CATTTGCCGA CCGAAATATT GAAGAGATAT

601   TTATGA
```

This corresponds to the amino acid sequence <SEQ ID 744; ORF 214.a>:

```
a214.pep
    1   MIQKICKLFV LIAFFSASPA FALQSDSRQP IQIEADQGSL DQANQSTTFS

51   GNVVIRQGTL NISAARVNVT RGXQRRRIRE GGRFASPLQP DIGRRQRHGA

101   RTGKQRCLFI CRQHRSLNR* CQSTARRRCR RRCGDYIQHQ NRSLYHQRQH

151   KIRRKIRFQI RQGQRRYPAF EYAKIRIIPM PSET*TWFGR HLPTEILKRY

201   L*
``` m214/a214 99.3% identity in 152 aa overlap

```
                   10         20         30         40         50         60
   m214.pep   MIQKICKLFVLIAFFSASPAFALQSDSRQPIQIEADQGSLDQANQSTTFSGNVVIRQGTL
              ||||||||||||||||||||||||||||||||||||||||||||||||||||||||||||
       a214   MIQKICKLFVLIAFFSASPAFALQSDSRQPIQIEADQGSLDQANQSTTFSGNVVIRQGTL
                   10         20         30         40         50         60

70         80         90        100        110        120
   m214.pep   NISAARVNVTRGRQRRIREGGRFASPLQPDIGRRQRHGARTGKQRCLFICRQHRSLNRX
              ||||||||||| |||||||||||||||||||||||||||||||||||||||||||||||
       a214   NISAARVNVTRGXQRRRIREGGRFASPLQPDIGRRQRHGARTGKQRCLFICRQHRSLNRX
                   70         80         90        100        110        120

130        140        150
   m214.pep   CQSTARRRCRRRCGDYIQHQNRSLYHQRQHKI
              |||||||||||||||||||||||||||||||
       a214   CQSTARRRCRRRCGDYIQHQNRSLYHQRQHKIRRKIRFQIRQGQRRYPAFEYAKIRIIPM
                  130        140        150        160        170        180 a214   PSETXTWFGRHLPTEILKRYLX
                  190        200
```

The following partial DNA sequence was identified in *N. gonorrhoeae* <SEQ ID 745>:

```
g214-1.seq
    1   ATGATACAAA AGATATGTAA GCTATTTGTT TTAATTGTAA TTTTTGCAAC

51   TTCTCCCGCT TTTGCCCTTC AAAGCGACAG CAGACGGCCC ATCCAAATCG
```

-continued

```
101    AAGCCGACCA AGGTTCGCTC GATCAAGCCA ACCAAAGTAC CACATTTAGC

151    GGCAATGTCA TCATCAGACA GGGTACGCTC AACATTTCCG CCTCGCGCGT

201    CAACGTCACA CGCGGCGGCA AAGGCGGCGA ATCCGTGAGG GCGGAAGGTT

251    CGCCCGTCCG CTTCAGCCAA ACGTTGGACG GGGGCAAAGG GACGGTGCGC

301    GGTCAGGCAA ACAACGTTAC CTATTCCTCC GCAGGAAGCA CCGTCGTTCT

351    GACCGGCAAT GCCAAAGTGC AGCGCGGCGG CGACGTTGCC GAAGGTGCGG

401    TCATTACCTA CAACACCAAA ACCGAAGTCT ATACCATCAA CGGCAGCACG

451    AAATCGGGTG CGAAATCCGC TTCCAAAACC GGCAGGGTCA GCGTCGTCAT

501    CCAGCCTTCA AGCACACAAA AAACCGAATA A
```

This corresponds to the amino acid sequence <SEQ ID 746; ORF 214-1.ng>:

```
g214-1.pep
  1    MIQKICKLFV LIVIFATSPA FALQSDSRRP IQIEADQGSL DQANQSTTFS

51    GNVIIRQGTL NISASRVNVT RGGKGGESVR AEGSPVRFSQ TLDGGKGTVR

101    GQANNVTYSS AGSTVVLTGN AKVQRGGDVA EGAVITYNTK TEVYTINGST

151    KSGAKSASKT GRVSVVIQPS STQKTE*
```

The following partial DNA sequence was identified in *N. meningitidis* <SEQ ID 747>:

```
m214-1.seq
  1    ATGATACAAA AGATATGTAA GCTATTTGTT TTAATAGCAT TTTTTTCGGC

51    GTCCCCCGCT TTTGCCCTTC AAAGCGACAG CAGGCAGCCT ATTCAGATTG

101    AGGCCGACCA AGGTTCGCTC GATCAAGCCA ACCAAAGCAC CACATTCAGC

151    GGAAACGTCG TCATCAGACA GGGTACGCTC AATATTTCCG CCGCCCGCGT

201    CAATGTTACA CGCGGCGGCA AAGGCGGCGA ATCCGTGAGG GCGGAAGGTT

251    CGCCAGTCCG CTTCAGCCAG ACATTGGACG GCGGCAAAGG CACGGTGCGC

301    GGACAGGCAA ACAACGTTGC TTATTCATCT GCAGGCAGCA CCGTAGTCTT

351    AACCGGTAAT GCCAAAGTAC AGCGCGGCGG CGATGTCGCC GAAGGTGCGG

401    TGATTACATA CAACACCAAA ACCGAAGTCT ATACCATCAG CGGCAGCACA

451    AAATCCGGCG CAAAATCCGC TTCCAAATCC GGCAGGGTCA GCGTCGTTAT

501    CCAGCCTTCG AGTACGCAAA AATCCGAATA A
```

This corresponds to the amino acid sequence <SEQ ID 748; ORF 214-1>:

```
m214-1.pep
  1    MIQKICKLFV LIAFFSASPA FALQSDSRQP IQIEADQGSL DQANQSTTFS

51    GNVVIRQGTL NISAARVNVT RGGKGGESVR AEGSPVRFSQ TLDGGKGTVR

101    GQANNVAYSS AGSTVVLTGN AKVQRGGDVA EGAVITYNTK TEVYTISGST

151    KSGAKSASKS GRVSVVIQPS STQKSE*
``` m214-1/g214-1 93.8% identity in 176 aa overlap

```
                     10        20        30        40        50        60
m214-1.pep   MIQKICKLFVLIAFFSASPAFALQSDSRQPIQIEADQGSLDQANQSTTFSGNVVIRQGTL
             |||||||||||::|::||||||||||||:||||||||||||||||||||||:|||||
g214-1       MIQKICKLFVLIVIFATSPAFALQSDSRRPIQIEADQGSLDQANQSTTFSGNVIIRQGTL
                     10        20        30        40        50        60

70        80        90       100       110       120
m214-1.pep   NISAARVNVTRGGKGGESVRAEGSPVRFSQTLDGGKGTVRGQANNVAYSSAGSTVVLTGN
             ||||:||||||||||||||||||||||||||||||||||||||||:||||||||||||||
g214-1       NISASRVNVTRGGKGGESVRAEGSPVRFSQTLDGGKGTVRGQANNVTYSSAGSTVVLTGN
                     70        80        90       100       110       120

130       140       150       160       170
m214-1.pep   AKVQRGGDVAEGAVITYNTKTEVYTISGSTKSGAKSASKSGRVSVVIQPSSTQKSEX
             ||||||||||||||||||||||||||||:|||||||||:|||||||||||||||:||
g214-1       AKVQRGGDVAEGAVITYNTKTEVYTINGSTKSGAKSASKTGRVSVVIQPSSTQKTEX
                    130       140       150       160       170
``` g214-1 (SEQ ID 746)/p38685 (SEQ ID 4165)

```
sp|P38685|YHBN_ECOLI 17.3 KD PROTEIN IN MURA-RPON
INTERGENIC REGION PRECURSOR (ORF185)
>gi|551336 (U12684) orf185 [Escherichia coli] >gi|606139
(U18997) ORF_o185 [Escherichia coli]
>gi|1789592 (AE000399) orf, hypothetical protein
[Escherichia coli] Length = 185
Score = 97.1 bits (238), Expect = 6e-20
Identities = 57/126 (45%), Positives = 74/126 (58%), Gaps = 3/126 (2%)
Query:   19 PAFALQSDSRQPIQIEADQGSLDQANQSTTFSGNVVIRQGTLNISAARVNVTR--GGKGG    76
            PAFA+++D+ QPI IE+DQ SLD      TF+GNV++ QGT+ I+A +V VTR  G +G
Sbjct:   24 PAFAVTGDTDQPIHIESDQQSLDMQGNVVTFTGNVIVTQGTIKINADKVVVTRPGGEQGK    83

Query:   77 ESVRAEGSPVRFSQTLDGGKGTVRGQANNVAYSSAGSTVVLTGNAKVQRGGDVAEGAVIT   136
               E +   +G P  F Q  D GK  V GA+ + Y A    VVLTGNA +Q+     +G  IT
Sbjct:   84 EVIDGYGKPATFYQMQDNGK-PVEGHASQMHYELAKDFVVLTGNAYLQQVDSNIKGDKIT   142

Query:  137 YNTKTE 142
            Y  K +
Sbjct:  143 YLVKEQ 148
```

The following partial DNA sequence was identified in N. meningitidis <SEQ ID 749>:

```
a214-1.seq
      1    ATGATACAAA AGATATGTAA GCTATTTGTT TTAATAGCAT TTTTTTCGGC

51    GTCCCCCGCT TTTGCCCTTC AAAGCGACAG CAGGCAGCCT ATTCAGATTG

101    AGGCCGACCA AGGTTCGCTC GATCAAGCCA ACCAAAGCAC CACATTCAGC

151    GGAAACGTCG TCATCAGACA GGGTACGCTC AATATTTCCG CCGCCCGCGT

201    CAATGTTACA CGCGGCGGCA AAGGCGGCGA ATCCGTGAGG CGGAAGGTT

251    CGCCAGTCCG CTTCAGCCAG ACATTGGACG GCGGCAAAGG CACGGTGCGC

301    GGACAGGCAA ACAACGTTGC TTATTCATCT GCAGGCAGCA CCGTAGTCTT

351    AACCGGTAAT GCCAAAGTAC AGCGCGGCGG CGATGTCGCC GAAGGTGCGG

401    TGATTACATA CAACACCAAA ACCGAAGTCT ATACCATCAG CGGCAGCACA

451    AAATCCGGCG CAAAATCCGC TTCCAAATCC GGCAGGGTCA GCGTCGTTAT

501    CCAGCCTTCG AGTACGCAAA ATCCGAATA A
```

This corresponds to the amino acid sequence <SEQ ID 750; ORF 214-1.a>:

```
a214-1.pep
      1    MIQKICKLFV LIAFFSASPA FALQSDSRQP IQIEADQGSL DQANQSTTFS

51    GNVVIRQGTL NISAARVNVT RGGKGGESVR AEGSPVRFSQ TLDGGKGTVR
```

-continued

```
101       GQANNVAYSS AGSTVVLTGN AKVQRGGDVA EGAVITYNTK TEVYTISGST

151       KSGAKSASKS GRVSVVIQPS STQKSE*
``` a214-1/m214-1 100.0% identity in 176 aa overlap

```
                     10         20         30         40         50         60
    a214-1.pep  MIQKICKLFVLIAFFSASPAFALQSDSRQPIQIEADQGSLDQANQSTTFSGNVVIRQGTL
                ||||||||||||||||||||||||||||||||||||||||||||||||||||||||||||
    m214-1      MIQKICKLFVLIAFFSASPAFALQSDSRQPIQIEADQGSLDQANQSTTFSGNVVIRQGTL
                     10         20         30         40         50         60
                     70         80         90        100        110        120
    a214-1.pep  NISAARVNVTRGGKGGESVRAEGSPVRFSQTLDGGKGTVRGQANNVAYSSAGSTVVLTGN
                ||||||||||||||||||||||||||||||||||||||||||||||||||||||||||||
    m214-1      NISAARVNVTRGGKGGESVRAEGSPVRFSQTLDGGKGTVRGQANNVAYSSAGSTVVLTGN
                     70         80         90        100        110        120
                    130        140        150        160        170
    a214-1.pep  AKVQRGGDVAEGAVITYNTKTEVYTISGSTKSGAKSASKSGRVSVVIQPSSTQKSEX
                |||||||||||||||||||||||||||||||||||||||||||||||||||||||||
    m214-1      AKVQRGGDVAEGAVITYNTKTEVYTISGSTKSGAKSASKSGRVSVVIQPSSTQKSEX
                    130        140        150        160        170
```

The following partial DNA sequence was identified in *N. gonorrhoeae* <SEQ ID 751>:

```
g215.seq
    1     atgaaagtaa gatggcggta cggaattgcg ttcccattga tattggcggt 51     tgccttgggc agcctgtcgg catggttggg ccgtatcagc gaagtcgaaa 101     tcgaggaagt caggctcaat cccgacgaac ctcaatacac aatggacggc 151     ttggacggaa ggcggtttga cgaacaggga tacttgaaag aacatttgag 201     cgcgaaaggt gcgaaacagt ttcccgaaaa cagcgacatc cattttgatt 251     cgccgcatct cgtgttcttc caagaaggca ggctgttgta cgaagtcggc 301     agcgatgaag ccgtttacca taccgaaaac aaacaggttc tttttaaaaa 351     caacgttgtg ctgaccaaaa ccgccgacgg caggcggcag gcgggtaaag 401     tcgaaaccga aaaactgcac gtcgataccg aatctcaata tgcccaaacc 451     gatacgcctg tcagtttcca atatggcgcg tcgcacggtc aggcgggcgg 501     tatgacctac aaccacaaaa caggcatgtt gaacttctca tctaaagtga 551     aagccgcgat ttatgataca aaagatatgt aa
```

This corresponds to the amino acid sequence <SEQ ID 752; ORF 215.ng>:

```
g215.pep
    1     MKVRWRYGIA FPLILAVALG SLSAWLGRIS EVEIEEVRLN PDEPQYTMDG

51     LDGRRFDEQG YLKEHLSAKG AKQFPENSDI HFDSPHLVFF QEGRLLYEVG

101     SDEAVYHTEN KQVLFKNNVV LTKTADGRRQ AGKVETEKLH VDTESQYAQT

151     DTPVSFQYGA SHGQAGGMTY NHKTGMLNFS SKVKAAIYDT KDM*
```

The following partial DNA sequence was identified in *N. meningitidis* <SEQ ID 753>:

```
m215.seq (partial)
    1     ..AGCCTGTCGG CATGGTTGGG TCGTATCAGC GAAGTCGAGA TTGAAGAAGT

51        CAGGCTCAAT CCCGACGAAC CGCAATACAC AATGGACAGC TTGGACGGCA
```

```
101    GGCGGTTTGA CGAACAGGGA TACTTGAAAG AACATTTGAG CGCGAAGGGC

151    GCGAAACAGT TTCCGGAAAG CAGCGACATC CATTTTGATT CGCCGCATCT

201    CGTGTTCTTC CAAGAAGGCA GGTTGTTGTA CGAAGTCGGC AGCGACGAAG

251    CCGTTTACCA TACCGAAAAC AAACAGGTTC TTTTTAAAAA CAACGTTGTG

301    CTGACCAAAA CCGCCGACGG CAAACGGCAG GCGGGTAAAG TTGAAGCCGA

351    AAAGCTGCAC GTCGATACCG AATCTCAATA TGCCCAAACC GATACGCCTG

401    CAGTTTCCA ATATGGTGCA TCGCACGGTC AGGCGGGCGG CATGACTTAC

451    GACCACAwwA CAGGCATGTT GAACTTCTCA TCTAAAGTGA AAGCCACGAT

501    TTATGATACA AAAGATATGT AA
```

This corresponds to the amino acid sequence <SEQ ID 754; ORF 215>:

```
m215.pep (partial)
     1   ..SLSAWLGRIS EVEIEEVRLN PDEPQYTMDS LDGRRFDEQG YLKEHLSAKG

51   AKQFPESSDI HFDSPHLVFF QEGRLLYEVG SDEAVYHTEN KQVLFKNNVV

101   LTKTADGKRQ AGKVEAEKLH VDTESQYAQT DTPVSFQYGA SHGQAGGMTY

151   DHXTGMLNFS SKVKATIYDT KDM*
```

Computer analysis of this amino acid sequence gave the following results:
Homology with a Predicted ORF from *N. gonorrhoeae*
ORF 215 shows 96.0% identity over a 173 aa overlap with a predicted ORF (ORF 215.ng) from *N. gonorrhoeae*:

```
m215/g215
                                  10         20         30         40
    m215.pep               SLSAWLGRISEVEIEEVRLNPDEPQYTMDSLDGRRFDEQG
                           ||||||||||||||||||||||||||||:|||||||||||
    g215       MKVRWRYGIAFPLILAVALGSLSAWLGRISEVEIEEVRLNPDEPQYTMDGLDGRRFDEQG
                       10         20         30         40         50         60

50         60         70         80         90        100
    m215.pep    YLKEHLSAKGAKQFPESSDIHFDSPHLVFFQEGRLLYEVGSDEAVYHTENKQVLFKNNVV
                ||||||||||||||:|||||||||||||||||||||||||||||||||||||||||||||
    g215        YLKEHLSAKGAKQFPENSDIHFDSPHLVFFQEGRLLYEVGSDEAVYHTENKQVLFKNNVV
                        70         80         90        100        110        120

110        120        130        140        150        160
    m215.pep    LTKTADGKRQAGKVEAEKLHVDTESQYAQTDTPVSFQYGASHGQAGGMTYDHXTGMLNFS
                ||||||||:|||||||:|||||||||||||||||||||||||||||||||||:|||||||
    g215        LTKTADGRRQAGKVETEKLHVDTESQYAQTDTPVSFQYGASHGQAGGMTYNHKTGMLNFS
                        130        140        150        160        170        180

170
    m215.pep    SKVKATIYDTKDMX
                |||||:||||||||
    g215        SKVKAAIYDTKDM
                        190
```

The following partial DNA sequence was identified in *N. meningitidis* <SEQ ID 755>:

```
a215.seq
     1    ATGAAAGTAA GATGGCGGTA CGGAATTGCG TTCCCATTGA TATTGGCGGT

51    TGCCTTGGGC AGCCTGTCGG CATGGTTGGG ACGCATCAGC GAAGTCGAGA

101    TTGAAGAAGT CAGGCTCAAT CCCGACGAAC CGCAATACAC AATGGACGGA

151    TTGGATGGCA GGCGGTTTGA CGAACAGGGA TACTTGAAAG AACATTTGAG

201    TTCGAAGGGC GCGAAACAGT TTCCCGAAAG CAGCGACATT CATTTCGACT
```

-continued

```
251  CACCGCATCT CGTGTTCTTC CAAGAAGGCA GGTTGTTGTA CGAAGTCGGC

301  AGCGATGAAG CCGTTTACCA TACCGAAAAC AAACAGGTTC TTTTTAAAAA

351  CAACGTTGTG CTGACCAAAA CCGCCGACGG CAAACGGCAG GCGGGTAAAG

401  TTGAAGCCGA AAAGCTGCAC GTCGATACCG AATCTCAATA TGCCCAAACC

451  GATACGCCTG TCAGTTTCCA ATATGGTGCA TCGCACGGTC AGGCGGGCGG

501  CATGACTTAC GACCACAAAA CAGGCATGTT GAACTTCTCA TCTAAAGTGA

551  AAGCCACGAT TTATGATACA AAGATATGT AA
```

This corresponds to the amino acid sequence <SEQ ID 756; ORF 215.a>:

```
a215.pep
    1  MKVRWRYGIA FPLILAVALG SLSAWLGRIS EVEIEEVRLN PDEPQYTMDG

51  LDGRRFDEQG YLKEHLSSKG AKQFPESSDI HFDSPHLVFF QEGRLLYEVG

101  SDEAVYHTEN KQVLFKNNVV LTKTADGKRQ AGKVEAEKLH VDTESQYAQT

151  DTPVSFQYGA SHGQAGGMTY DHKTGMLNFS SKVKATIYDT KDM*
```
                                                        25 m215/a215 98.3% identity in 173 aa overlap

```
                         10         20         30         40
    m215.pep                     SLSAWLGRISEVEIEEVRLNPDEPQYTMDSLDGRRFDEQG
                                 ||||||||||||||||||||||||||||:|||||||||||
    a215     MKVRWRYGIAFPLILAVALGSLSAWLGRISEVEIEEVRLNPDEPQYTMDGLDGRRFDEQG
                    10         20         30         40         50         60

50         60         70         80         90        100
    m215.pep  YLKEHLSAKGAKQFPESSDIHFDSPHLVFFQEGRLLYEVGSDEAVYHTENKQVLFKNNVV
              |||||||:||||||||||||||||||||||||||||||||||||||||||||||||||||
    a215      YLKEHLSSKGAKQFPESSDIHFDSPHLVFFQEGRLLYEVGSDEAVYHTENKQVLFKNNVV
                    70         80         90        100        110        120

110        120        130        140        150        160
    m215.pep  LTKTADGKRQAGKVEAEKLHVDTESQYAQTDTPVSFQYGASHGQAGGMTYDHXTGMLNFS
              ||||||||||||||||||||||||||||||||||||||||||||||||||||||| ||||||
    a215      LTKTADGKRQAGKVEAEKLHVDTESQYAQTDTPVSFQYGASHGQAGGMTYDHKTGMLNFS
                    130        140        150        160        170        180

170
    m215.pep  SKVKATIYDTKDMX
              ||||||||||||||
    a215      SKVKATIYDTKDMX
                    190
```

The following partial DNA sequence was identified in *N. gonorrhoeae* <SEQ ID 757>:

```
g216.seq (partial)
    1  ..atgatatcga tttcgagctc ggtacccagc gacgaaatca ccgccatcat 51  ccccgcactc aaacgcaaag acattaccct cgtctgcatc accgcccgcc 101  ccgattcaac catggcgcgc catgccgata tccacatcac cgcatcggtt 151  tcgcaagaag cctgcccgtt ggggcttgcc ccgaccacca gcaccaccgc 201  cgttatggct ttgggcgacg cgttggcggt cgtcctgctg cgcgcccgcg 251  cgttcacgcc cgacgacttc gccttgatcc accctgccgg cagcctcggc 301  aaacgcctgc ttttgcgcgt tgccgacatt atgcacaaag gcggcggcct 351  gcccgccgtc cgactcggca cgcccttgaa aggagccatc gtcagcatga 401  gcgagaaagg tttgggcatg tgggcgggaa cggacgggca aaggctgtct 451  gaaaggcctt tttactga
```

This corresponds to the amino acid sequence <SEQ ID 758; ORF 216.ng>:

```
g216.pep (partial)
    1  ..MISISSSVPS DEITAIIPAL KRKDITLVCI TARPDSTMAR HADIHITASV

51     SQEACPLGLA PTTSTTAVMA LGDALAVVLL RARAFTPDDF ALIHPAGSLG

101     KRLLLRVADI MHKGGGLPAV RLGTPLKGAI VSMSEKGLGM WAGTDGQRLS

151     ERPFY*
```

The following partial DNA sequence was identified in *N. meningitidis* <SEQ ID 759>:

```
m216.seq
    1   ATGGCAATGG CAGAAAACGG AAAATATCTC GACTGGGCAC GCGAAGTGTT

51   GCACGCCGAA GCGGAAGGCT TGCGCGAAAT TGCAGCGGAA TTGsACAAAA

101   ACTTCGTCCT TGCGGCAGAC GCGTTGTTGC ACTGCAAGGG CAGGGTCGTT

151   ATCACGGGCA TGGTCAAGTC GGGACATATC GGGCGCAAAA TGGCGGCAAC

201   TATGGCCTCG ACCGGCACGC CTGCGTTTTT CGTCCACCCT GCGGAAGCGG

251   CACACGgCGA TTTGGGTATG ATTGTGGACA rCGACGTGGT CGTCGCGATT

301   TCCAATTCCG GCGAAAGCGA CGAAATCGCC GCCATCATCC CCGCACTCAA

351   ACGCAAAGAC ATCACGCTTG TCTGCATCAC CGCCCGCCCC GATTCAACCA

401   TGGCGCGCCA TGCCGACATC CACATCACGG CGTCGGTTTC CAAAGAAGCC

451   TGCCCGCTGG GCTTGCCCC GACCACCAGC ACCACCGCCG TCATGGCTTT

501   GGGCGATGCG TTGGCGGTCG TCCtGCTGCG CgcACGCGCG TTCACGCCCG

551   ACGATTTCGC CTTGAGCCAT CCTGCCGGCA GCCTCGGCAA ACGCCTACTT

601   TTGCGCGTTG CCGACATTAT GCACAAAGGC GGCGGCCTGC CTGCCGTCCG

651   ACTCGGCACG CCCTTGAAAG AAGCCATCGT CAGCATGAGT GAAAAAGGGC

701   TGGGCATGTT GGCGGTAACG GACGGGCAAG GCCGTCTGAA AGGCGTATTC

751   ACCGACGGCG ATTTGCGCCG CCTGTTTCAA GAATGCGACA ATTTTACCGG

801   TCTTTCGATA GACGAAGTCA TGCATACGCA TCCTAAAACC ATCTCCGCCG

851   AACGTCTCGC CACCGAAGCC CTGAAAGTCA TGCAGGCAAA CCATGTGAAC

901   GGGCTTCTGG TTACCGATGC AGATGGCGTG CTGATCGGCG CGCTGAATAT

951   GCACGACCTG CTGGCGGCAC GGATTGTATA G
```

This corresponds to the amino acid sequence <SEQ ID 760; ORF 216>:

```
m216.pep
    1   MAMAENGKYL DWAREVLHAE AEGLREIAAE LXKNFVLAAD ALLHCKGRVV

51   ITGMVKSGHI GRKMAATMAS TGTPAFFVHP AEAAHGDLGM IVDXDVVAI

101   SNSGESDEIA AIIPALKRKD ITLVCITARP DSTMARHADI HITASVSKEA

151   CPLGLAPTTS TTAVMALGDA LAVVLLRARA FTPDDFALSH PAGSLGKRLL

201   LRVADIMHKG GGLPAVRLGT PLKEAIVSMS EKGLGMLAVT DGQGRLKGVF

251   TDGDLRRLFQ ECDNFTGLSI DEVMHTHPKT ISAERLATEA LKVMQANHVN

301   GLLVTDADGV LIGALNMHDL LAARIV*
```

Computer analysis of this amino acid sequence gave the following results:
Homology with a Predicted ORF from *N. gonorrhoeae*
ORF 216 shows 91.8% identity over a 147 aa overlap with a predicted ORF (ORF 216.ng) from *N. gonorrhoeae*:

```
m216/g216
                 70        80        90       100       110       120
    m216.pep  TMASTGTPAFFVHPAEAAHGDLGMIVDXDVVVAISNSGESDEIAAIIPALKRKDITLVCI
                                          :::||:|  ||||:|||||||||||||||
    g216                                  MISISSSVPSDEITAIIPALKRKDITLVCI
                                                  10        20        30

130       140       150       160       170       180
    m216.pep  TARPDSTMARHADIDITASVSKEACPLGLAPTTSTTAVMALGDALAVVLLRARAFTPDDF
              ||||||||||||||||||||:|||||||||||||||||||||||||||||||||||||||
    g216      TARPDSTMARHADIHITASVSQEACPLGLAPTTSTTAVMALGDALAVVLLRARAFTPDDF
                       40        50        60        70        80        90

190       200       210       220       230       240
    m216.Pep  ALSHPAGSLGKRLLLRVADIMHKGGGLPAVRLGTPLKEAIVSMSEKGLGMLAVTDGQGRL
              || ||||||||||||||||||||||||||||||||||||| |||||||||| | ||||
    g216      ALIHPAGSLGKRLLLRVADIMHKGGGLPAVRLGTPLKGAIVSMSEKGLGMWAGTDGQRLS
                      100       110       120       130       140       150
```

The following partial DNA sequence was identified in *N. meningitidis* <SEQ ID 761>:

```
a216.seq
    1   ATGGCGATGG CAGGAAACGA AAAATATCTT GATTGGGCAC GCGAAGTGTT

51   GCACACCGAA GCGGAAGGCT TGCGCGAAAT TGCGGCGGAT TTGGACGAAA

101   ACTTCGCCCT TGCGGCGGAC GCGTTGTTGC ACTGCAAAGG CAGGGTCGTT

151   ATCACGGGCA TGGGCAAGTC GGGACATATC GGGCGCAAAA TGGCGGCAAC

201   CATGGCCTCG ACCGGCACGC CCGCGTTTTT CGTCCACCCT GCGGAAGCGG

251   CACACGGCGA TTTGGGCATG ATTGTGGACA ACGACGTGGT CGTCGCGATT

301   TCCAATTCCG GTGAAAGCGA CGAAATCGCC GCCATCATCC CCGCGCTCAA

351   ACGCAAAGAT ATCACGCTTG TCTGCATCAC CGCCCGCCCC GATTCAACCA

401   TGGCGCGCCA TGCCGACATC CACATCACGG CGTCGGTTTC CAAAGAAGCC

451   TGCCCGCTGG GGCTTGCCCC GACCACCAGC ACCACCGCCG TTATGGCTTT

501   GGGCGATGCG TTGGCGGTTG TCCTGCTGCG CGCCCGCGCG TTCACGCCCG

551   ACGACTTCGC CTTGAGCCAC CCTGCCGGCA GCCTCGGCAA ACGCCTACTT

601   TTGCGCGTTG CCGACATTAT GCACAAAGGC GGCGGCCTGC CTGCCGTCCG

651   ACTCGGCACG CCCTTGAAAG AAGCCATCGT CAGCATGAGT GAAAAAGGGC

701   TGGGCATGTT GGCGGTAACG GACGGGCAAG GCCGTCTGAA AGGCGTATTC

751   ACCGACGGCG ATTTGCGCCG CCTGTTTCAA GAATGCGACA ATTTTACCGG

801   TCTTTCGATA GACGAAGTCA TGCATACGCA TCCTAAAACC ATCTCCGCCG

851   AACGTCTCGC CACCGAAGCC CTGAAAGTCA TGCAGGCAAA CCATGTGAAC

901   GGGCTTCTGG TTACCGATGC AGATGGCGTG CTGATCGGCG CGCTGAATAT

951   GCACGACCTT TTGGCGGCGC GGATTGTATA G
```

This corresponds to the amino acid sequence <SEQ ID 762; ORF 216.a>:

```
a216.pep
    1   MAMAGNEKYL DWAREVLHTE AEGLREIAAD LDENFALAAD ALLHCKGRVV

51   ITGMGKSGHI GRKMAATMAS TGTPAFFVHP AEAAHGDLGM IVDNDVVVAI
```

```
101  SNSGESDEIA AIIPALKRKD ITLVCITARP DSTMARHADI HITASVSKEA

151  CPLGLAPTTS TTAVMALGDA LAVVLLRARA FTPDDFALSH PAGSLGKRLL

201  LRVADIMHKG GGLPAVRLGT PLKEAIVSMS EKGLGMLAVT DGQGRLKGVF

251  TDGDLRRLFQ ECDNFTGLSI DEVMHTHPKT ISAERLATEA LKVMQANHVN

301  GLLVTDADGV LIGALNMHDL LAARIV*
``` m216/a216 97.2% identity in 326 aa overlap

```
                    10         20         30         40         50         60
    m216.pep MAMAENGKYLDWAREVLHAEAEGLREIAAELXKNFVLAADALLHCKGRVVITGMVKSGHI
             ||||  |  |||||||||||| :||||||||| :|  : ||||||||||||||||| |||
    a216     MAMAGNEKYLDWAREVLHTEAEGLREIAADLDENFALAADALLHCKGRVVITGMGKsGHI
                    10         20         30         40         50         60

70         80         90        100        110        120
    m216.pep GRKMAATMASTGTPAFFVHPAEAAHGDLGMIVDXDVVVAISNSGESDEIAAIIPALKRKD
             ||||||||||||||||||||||||||||||| ||||||||||||||||||||||||||||
    a216     GRKMAATMASTGTPAFFVHPAEAAHGDLGMIVDNDVVVAISNSGESDEIAAIIPALKRKD
                    70         80         90        100        110        120

130        140        150        160        170        180
    m216.pep ITLVCITARPDSTMARHADIHITASVSKEACPLGLAPTTSTTAVMALGDALAWLLRARA
             ||||||||||||||||||||||||||||||||||||||||||||||||||||||||||
    a216     ITLVCITARPDSTMARHADIHITASVSKEACPLGLAPTTSTTAVMALGDALAWLLRARA
                   130        140        150        160        170        180

190        200        210        220        230        240
    m216.pep FTPDDFALSHPAGSLGKRLLLRVADIMHKGGGLPAVRLGTPLKEAIVSMSEKGLGMLAVT
             ||||||||||||||||||||||||||||||||||||||||||||||||||||||||||||
    a216     FTPDDFALSHPAGSLGKRLLLRVADIMHKGGGLPAVRLGTPLKEAIVSMSEKGLGMLAVT
                   190        200        210        220        230        240

250        260        270        280        290        300
    m216.pep DGQGRLKGVFTDGDLRRLFQECDNFTGLSIDEVMHTHPKTISAERLATEALKVMQANHVN
             ||||||||||||||||||||||||||||||||||||||||||||||||||||||||||||
    a216     DGQGRLKGVFTDGDLRRLFQECDNFTGLSIDEVMHTHPKTISAERLATEALKVMQANHVN
                   250        260        270        280        290        300

310        320
    m216.pep GLLVTDADGVLIGALNMHDLLAARIVX
             |||||||||||||||||||||||||||
    a216     GLLVTDADGVLIGALNMHDLLAARIVX
                   310        320
```

The following partial DNA sequence was identified in *N. gonorrhoeae* <SEQ ID 763>:

```
g217.seq
    1  atggcggatg acggtttgtt gcggcaactg tccgaaaaac ccagccaaag 51  tgctctcttc ctgccatttg acccattcgt tttcgaggtt ttggactgcc 101  ttttggtcat cgggcccggc ttgaaacaat gtttcaagca aatcccggca 151  acgcgccacc cattcgccga ccgtcgcagg ttgccgccat atccgggcaa 201  tatccgacag ggtttcgagg aaggcggcaa aacgtccgaa catggcggtt 251  tgattcacgt cggcatacca cgcgctgaca tcctgccaca tcgggttgcc 301  gccttcgggc agcatccagc ccaatatcat acggtctgcc gcctgcttcc 351  aggtaaacag ctgatccgtg ccgccgcgca tttctccgtc aatccccaa 401  tggacgttca atcggcaac catatcgtgc aaaagcggca aatcgtcccc 451  ggtcagtccg aaacggcgca acacgggcgc ggtttccaaa agcgcgagca 501  ctttgccgac ttcaaaacgg ctttccagca agtcggacac gcactccaac 551  gcataaaaaa acggttgccg gcggctgatt ttcacgtccg aaacggaata 601  cggcaatgcc tgcgcgccgg gttgcgcctg tccgaacacg gcttccataa 651  aaggcgtata gggttcgata ttcggggtta a
```

This corresponds to the amino acid sequence <SEQ ID 764; ORF 217.ng>:

```
g217.pep..
    1    MADDGLLRQL SEKPSQSALF LPFDPFVFEV LDCLLVIGPG LKQCFKQIPA

51    TRHPFADRRR LPPYPGNIRQ GFEEGGKTSE HGGLIHVGIP RADILPHRVA

101    AFGQHPAQYH TVCRLLPGKQ LIRAAAHFSV QSPMDVQIGN HIVQKRQIVP

151    GQSETAQHGR GFQKREHFAD FKTAFQQVGH ALQRIKKRLP AADFHVRNGI

201    RQCLRAGLRL SEHGFHKRRI GFDIRG*
```

The following partial DNA sequence was identified in *N. meningitidis* <SEQ ID 765>:

```
m217.seq
    1    ATGGCGGATG ACGGTGTGCG GCGGCAACTG TCCGGAAAAT TGCGCCAATT

51    CGGTTTCCGC CTrCCATTTG ACCCATTCGT TTTCAAGGTT TTGGACTGAC

101    TTTTGGTCAT CGGCTTCAGC TTGGAACAAT GTTTCAAGCA AATCCCGGCA

151    ACGCGCCACC CATTCGCCGA CCGTTGCGGG CTGCCGCCAT ATCCGTACAA

201    TATCCGTCAG GGTTTCGAGG AAGGCGGCAA AACGTCCGAA CATGGCGGTT

251    TGATTCACGT CGGCATACCA CGCGCTGACA TCCTGCCACA TCGGATTGCC

301    GCCTTTGGGC AGCATCCAGC CCAATATCAT GCGTTCTACC GCCTGCTTCC

351    AGGTGAACAG CTGATCCGTG CCGCCGCGCA TTTCTCCGTC CAAACCCCAG

401    TGGACGTTCA AATCGGCAAC CATGTCGTGC AAAAGCGGTA AATCGTCCTC

451    AGTCAGTCCG AAACGGCGCA ACACGGGCGC GGTTTCTAAA AGCACAAGCA

501    CTTTATCGAC TTCAAATCGG CTTTCCAACA AGTCGAACAG GCATGACAAA

551    GCATGAAACA GCGGTTGGCG GCGGCTGATT TTCACGTCTG ACACGGAATA

601    CGGCAATGCC TGCGCACCgG GctGCGCCTG TCCGAACACG GCTTCGATAA

651    AAGGCGTATA GGATTCGATA TTCGGGGTTA A
                                               40
```

This corresponds to the amino acid sequence <SEQ ID 766; ORF 217>:

```
m217.pep
    1    MADDGVRRQL SGKLRQFGFR LPFDPFVFKV LDXLLVIGFS LEQCFKQIPA

51    TRHPFADRCG LPPYPYNIRQ GFEEGGKTSE HGGLIHVGIP RADILPHRIA

101    AFGQHPAQYH AFYRLLPGEQ LIRAAAHFSV QTPVDVQIGN HVVQKRXIVL

151    SQSETAQHGR GFXKHKHFID FKSAFQQVEQ AXQSMKQRLA AADFHVXHGI

201    RQCLRTGLRL SEHGFDKRRI GFDIRG*
```

Computer analysis of this amino acid sequence gave the following results:
Homology with a Predicted ORF from *N. gonorrhoeae*
ORF 217 shows 80.5% identity over a 226 aa overlap with a predicted ORF (ORF 217.ng) from *N. gonorrhoeae*:

```
m217/g217
                     10         20         30         40         50         60
   m217.pep  MADDGVRRQLSGKLRQFGFRLPFDPFVFKVLDXLLVIGFSLEQCFKQIPATRHPFADRCG
             |||||:  ||||  |   ::  ||||||||||:|||  ||||  :|:||||||||||||||
   g217      MADDGLLRQLSEKPSQSALFLPFDPFVFEVLDCLLVIGPGLKQCFKQIPATRHPFADRRR
                     10         20         30         40         50         60
```

-continued

```
                   70        80        90       100       110       120
m217.pep   LPPYPYNIRQGFEEGGKTSEHGGLIHVGIPRADILPHRIAAFGQHPAQYHAFYRLLPGEQ
           ||||| ||||||||||||||||||||||||||||||||:|||||||||||:  |||||:|
g217       LPPYPGNIRQGFEEGGKTSEHGGLIHVGIPRADILPHRVAAFGQHPAQYHTVCRLLPGKQ
                   70        80        90       100       110       120

130       140       150       160       170       180
m217.pep   LIRAAAHFSVQTPVDVQIGNHVVQKRXIVLSQSETAQHGRGFXKHKHFIDFKSAFQQVEQ
           |||||||||||:|:|||||||:|||| || :||||||||||| |::|| |||:||||| :
g217       LIRAAAHFSVQSPMDVQIGNHIVQKRQIVPGQSETAQHGRGFQKREHFADFKTAFQQVGH
                  130       140       150       160       170       180

190       200       210       220
m217.pep   AXQSMKQRLAAADFHVXHGIRQCLRTGLRLSEHGFDKRRIGFDIRGX
           | | :|:|| |||||| :|||||||:||||||||| ||||||||||
g217       ALQRIKKRLPAADFHVRNGIRQCLRAGLRLSEHGFHKRRIGFDIRG
                  190       200       210       220
```

The following partial DNA sequence was identified in *N. meningitidis* <SEQ ID 767>:

```
a217.seq
     1  GTGGCGGATG ACGGTGTGCA GCGGCAACTG TCCGGAAAAT TGCGCCAATT

51  CGGTTTCCGC CTGCCATTTG ACCCATTCGT TTTCGAGGCT TTGGACTGCC

101  TTTTGGTCAT CGCCTTCGAC TTGGAACAAT GTTTCAAGCA AATCCCGGCA

151  ACGCGCCACC CATTCGTCAA CCGTCGCAGG TTGCCGCCAT ATCCGTACAA

201  TATCCGTCAG GGTTTCGAGG AAGGCGGCAA AACGTCCGAA CAGGGCGGTT

251  TGGTTCACGT CGGCATACCA CGCGCTGACC CCCTGCCACA TCGGATTGCC

301  GCCTTCGGGC AGCATCCAGC CCAATATCAT GCGTTCTACC GCCTGCTTCC

351  AGGTGAACAG CTGATCCGTG CCGCCGCGCA TTTCTCCGTC CAAACCCCAG

401  CGGACGTTCA AATCGGCAAC CATGTCGTGC AAAAGCGGCA AATCGTCCTC

451  AGTCAGTCCG AAATGGCGCA ACACGGGCGC GGTTTCTAAA AGCACAAGCA

501  CTTTATCGAC TTCAAATCGG CTTTCCAACA AGTCGAACAG GCATGACAAA

551  GCATGAAACA GCGGTTGTCG GCGGCTGATT TTCACATCCG AAACGGAATA

601  CGGCAATGCC TGCGCGCCGG GCTGCGCCTG TCCGAACACG GCTTCGATAA

651  AAGGCGTATA GGATTCGATA TTCGGGGTTA A
```

This corresponds to the amino acid sequence <SEQ ID 768; ORF 217.a>:

```
a217.pep
     1  VADDGVQRQL SGKLRQFGFR LPFDPFVFEA LDCLLVIAFD LEQCFKQIPA

51  TRHPFVNRRR LPPYPYNIRQ GFEEGGKTSE QGGLVHVGIP RADPLPHRIA

101  AFGQHPAQYH AFYRLLPGEQ LIRAAAHFSV QTPADVQIGN HVVQKRQIVL

151  SQSEMAQHGR GF*KHKHFID FKSAFQQVEQ A*QSMKQRLS AADFHIRNGI

201  RQCLRAGLRL SEHGFDKRRI GFDIRG*
``` m217/a217 90.3% identity in 226 aa overlap

```
                   10        20        30        40        50        60
m217.pep   MADDGVRRQLSGKLRQFGFRLPFDPFVFKVLDXLLVIGFSLEQCFKQIPATRHPFADRCG
           :|||||:|||||||||||||||||||||::|| ||||:|:|||||||||||||||::|
a217       VADDGVQRQLSGKLRQFGFRLPFDPFVFEALDCLLVIAFDLEQCFKQIPATRHPFVNRRR
                   10        20        30        40        50        60
```

-continued

```
                70         80         90        100        110        120
m217.pep   LPPYPYNIRQGFEEGGKTSEHGGLIHVGIPRADILPHRIAAFGQHPAQYHAFYRLLPGEQ
           ||||||||||||||||||||||||:|||:||||||||| |||||||||||||||||||||
a217       LPPYPYNIRQGFEEGGKTSEQGGLVHVGIPRADPLPHRIAAFGQHPAQYHAFYRLLPGEQ
                70         80         90        100        110        120

130        140        150        160        170        180
m217.pep   LIRAAAHFSVQTPVDVQIGNHVVQKRXIVLSQSETAQHGRGFXKHKHFIDFKSAFQQVEQ
           |||||||||||:||||||||||||||  ||||||  |||||||||||||||||||||||
a217       LIRAAAHFSVQTPADVQIGNHVVQKRQIVLSQSEMAQHGRGFXKHKHFIDFKSAFQQVEQ
               130        140        150        160        170        180

190        200        210        220
m217.pep   AXQSMKQRLAAADFHVXHGIRQCLRTGLRLSEHGFDKRRIGFDIRGX
           |||||||||:|||| : :|||||||:|||||||||||||||||||||
a217       AXQSMKQRLSAADFHIRNGIRQCLRAGLRLSEHGFDKRRIGFDIRGX
               190        200        210        220
```

15

The following partial DNA sequence was identified in *N. gonorrhoeae* <SEQ ID 769>:

```
g218.seq
    1   atggttgcgg tggatcctta tacggcaaaa gtggtcaaca ccatgccgcg 51   caatcagggt tggtatcaca ctatggatga aatccacggc gatatgatgc 101   tcggtgcggc aggcgattat cttttggaaa cggcagcttc actgaccatt 151   attatggttg tcagcggctt gtacctttgg tgggcgaaac agcgcggcat 201   taaagcgatg ctgctgccgc caaaaagcag ggcgcgttct tggtggcgga 251   atctgcacgg cgcgtttgga acttgggtgt cgttgatttt actgttgttc 301   tgcctgtcgg gtattgcttg ggcaggtatt tggggcggca aattcgtgca 351   ggcttggaat cagttcccgg ccggcaaatg gggtgtcgaa ccgaaccccg 401   tttcaatcgt gccgacccac ggcgaggtat tgaatgacgg caaggttaag 451   gaagtgccgt ggattttgga gcttatgcct atgcctgtct cagggacgac 501   tgtgggtgaa aacggcatta accccaccga gcccaataac attggaaacc 551   gtcgaccgtt tcgcgcggga aatcggtttc aaagggcgtt atcagttgaa 601   tttgcccaaa ggcgaggacg gggtatggac tttgtcgcag gattctatga 651   gttatga
```

This corresponds to the amino acid sequence <SEQ ID 770; ORF 218.ng>:

```
g218.pep
    1   MVAVDPYTAK VVNTMPRNQG WYHTMDEIHG DMMLGAAGDY LLETAASLTI

51   IMVVSGLYLW WAKQRGIKAM LLPPKSRARS WWRNLHGAFG TWVSLILLLF

101   CLSGIAWAGI WGGKFVQAWN QFPAGKWGVE PNPVSIVPTH GEVLNDGKVK

151   EVPWILELMP MPVSGTTVGE NGINPTEPNN IGNRRPFRAG NRFQRALSVE

201   FAQRRGRGMD FVAGFYEL*
```

The following partial DNA sequence was identified in *N. meningitidis* <SEQ ID 771>:

```
m218.seq
    1   ATGGTCGCGG TCGATCCTTA TACGGCAAAA GTGGTCAGTA CCATGCCGCG

51   CAATCAGGGT TGGTATTACA CGATGGATGA AATCCACAGC GATATGATGC

101   TCGGTGCGGC AGGCGATTAT CTTTTGGAAA CGGCAGCTTC ACTGACCATT

151   ATTATGGTTG TCAGCGGCTT GTACCTTTGG TGGGTGAAAC GGCGCGGCAT
```

-continued

```
201  CAAGGCGATG CTGCTGCCGT CAAAAGGCAr GGCGCGTTCT TGGTGGCGGA

251  ATCTGCACGG CACGTTTGGA ACTTGGGTGT CGTTGATTTT GCTGTTGTTC

301  TGCCTGTCGG GTATTGCTTG GGCGGGTATT TGGGGCGGCA AGTTCGTACA

351  GGCTTGGAGT CAGTTCCCTG CCGGTAAATG GGGTGTCGAA CCGAACCCCG

401  TTTCAGTCGT GCCGACCCAC GGCGAGGTAT TGAATGACGG CAAGGTTAAG

451  GAAGTGCCGT GGGTTTTGGA GCTTACGCCT ATGCCTGTTT CAGGGACGaC 501  yGtgGGCAAA GACGGCATTA ACCCTGACGA GCCGATGACA TTGGAAACCG

551  TCGACCGCTT TGCGCGGnGA AATCGGTTTC AAAGGGCGTT ATCAGTTGAA

601  TTTGCCCAAA GGCGAGGACG GCGTATGGAC TTTGTCGCAG GATTCTATGA

651  GTTA
```

This corresponds to the amino acid sequence <SEQ ID 772; ORF 218>:

```
m218.pep
  1  MVAVDPYTAK VVSTMPRNQG WYYTMDEIHS DMMLGAAGDY LLETAASLTI

51  IMVVSGLYLW WVKRRGIKAM LLPSKGXARS WWRNLHGTFG TWVSLILLLF

101  CLSGIAWAGI WGGKFVQAWS QFPAGKWGVE PNPVSVVPTH GEVLNDGKVK

151  EVPWVLELTP MPVSGTTVGK DGINPDEPMT LETVDRFARX NRFQRALSVE

201  FAQRRGRRMD FVAGFYEL
```

Computer analysis of this amino acid sequence gave the following results:
Homology with a Predicted ORF from *N. gonorrhoeae*
ORF 218 shows 87.2% identity over a 218 aa overlap with a predicted ORF (ORF 218.ng) from *N. gonorrhoeae*:

```
m218/g218
                    10         20         30         40         50         60
m218.pep  MVAVDPYTAKVVSTMPRNQGWYYTMDEIHSDMMLGAAGDYLLETAASLTIIMVVSGLYLW
          ||||||||||:||||||||||:||||||:||||||||||||||||||||||||||||||
g218      MVAVDPYTAKVVNTMPRNQGWYHTMDEIHGDMMLGAAGDYLLETAASLTIIMVVSGLYLW
                    10         20         30         40         50         60
           70         80         90        100        110        120
m218.pep  WVKRRGIKAMLLPSKGXARSWWRNLHGTFGTWVSLILLLFCLSGIAWAGIWGGKFVQAWS
          |:|:||||||||| |: |||||||||||:|||||||||||||||||||||||||||||:
g218      WAKQRGIKAMLLPPKSRARSWWRNLHGAFGTWVSLILLLFCLSGIAWAGIWGGKFVQAWN
                    70         80         90        100        110        120
                   130        140        150        160        170        180
m218.pep  QFPAGKWGVEPNPVSVVPTHGEVLNDGKVKEVPWVLELTPMPVSGTTVGKDGINPDEPMT
          ||||||||||||||:|||||||||||||||||||:|||:|||||||||||| || ||
g218      QFPAGKWGVEPNPVSIVPTHGEVLNDGKVKEVPWILELMPMPVSGTTVGENGINPTEPNN
                   130        140        150        160        170        180
                   190        200        210
m218.pep  LETVDRFARXNRFQRALSVEFAQRRGRRMDFVAGFYEL
          : :   |  ||||||||||||||||| |||||||||
g218      IGNRRPFRAGNRFQRALSVEFAQRRGRGMDFVAGFYEL
                   190        200        210
```

The following partial DNA sequence was identified in *N. meningitidis* <SEQ ID 773>:

```
a218.seq
  1  ATGGTCGCGG TCGATCCTTA TACGGCAAAA GTGGTCAGTA CCATGCCGCG

51  CAATCAGGGT TGGTATTACG CGATGGATGA AATCCACAGC GATATGATGC

101  TCGGTTCGAC AGGTGATTAT CTTTTGGAAA CGGCTGCATC GCTGACGATT
```

-continued

```
151   ATCATGATAA TCAGCGGTTT GTACCTTTGG TGGGTGAAAC GGCGCGGCAT

201   CAAGGCGATG CTGCTGCCGC CAAAAGGCAG GGCGCGTTCT TGGTGGCGGA

251   ATCTGCACGG CGCGTTTGGA ACTTGGGTGT CGTTGATTTT ACTGTTGTTC

301   TGCCTGTCGG GTATTGCTTG GGCAGGTATT TGGGGCGGCA AGTTCGTGCA

351   GGCTTGGAGT CAGTTCCCGG CAGGCAAATG GGGTGTCGAA CCGAACCCTG

401   TTTCAGTCGT GCCGACCCAC GGCGAGGTAT TGAATGACGG CAAGGTTAAG

451   GAAGTGCCGT GGGTTTTGGA GCTTACGCCT ATGCCTGTTT CAGGGACGAC

501   TGTGGGCAAA GACGGTATTA ACCCTGACGA GCCGATGACA TTGGAAACCG

551   TCGACCGTTT TGCGCGG.GA AATCGGTTTC AAAGGGCGTT ATCAGCTGAA

601   TTTGCCCAAA GGCGAGGACG GCGTATGGAC TTTGTCGCAG GATTCTATGA

651   GTTA
```

This corresponds to the amino acid sequence <SEQ ID 774; ORF 218.a>:

```
a218.pep
  1   MVAVDPYTAK VVSTMPRNQG WYYAMDEIHS DMMLGSTGDY LLETAASLTI

51   IMIISGLYLW WVKRRGIKAM LLPPKGRARS WWRNLHGAFG TWVSLILLLF

101   CLSGIAWAGI WGGKFVQAWS QFPAGKWGVE PNPVSVVPTH GEVLNDGKVK

151   EVPWVLELTP MPVSGTTVGK DGINPDEPMT LETVDRFARX NRFQRALSAE

201   FAQRRGRRMD FVAGFYEL
``` m218/a218 95.9% identity in 218 aa overlap

```
                 10         20         30         40         50         60
m218.pep  MVAVDPYTAKVVSTMPRNQGWYYTMDEIHSDMMLGAAGDYLLETAASLTIIMVVSGLYLW
          ||||||||||||||||||||||||:|||||||||::||||||||||||||::|||||
a218      MVAVDPYTAKVVSTMPRNQGWYYAMDEIHSDMMLGSTGDYLLETAASLTIIMIICGLYLW
                 10         20         30         40         50         60

70         80         90        100        110        120
m218.pep  WVKRRGIKAMLLPSKGXARSWWRNLHGTFGTWVSLILLLFCLSGIAWAGIWGGKFVQAWS
          |||||||||||  || ||||||||||:|||||||||||||||||||||||||||||||
a218      WVKRRGIKAMLLPPKGRARSWWRNLHGAFGTWVSLILLLFCLSGIAWAGIWGGKFVQAWS
                 70         80         90        100        110        120

130        140        150        160        170        180
m218.pep  QFPAGKWGVEPNPVSVVPTHGEVLNDGKVKEVPWVLELTPMPVSGTTVGKDGINPDEPMT
          ||||||||||||||||||||||||||||||||||||||||||||||||||||||||||||
a218      QFPAGKWGVEPNPVSVVPTHGEVLNDGKVKEVPWVLELTPMPVSGTTVGKDGINPDEPMT
                130        140        150        160        170        180

190        200        210
m218.pep  LETVDRFARXNRFQRALSVEFAQRRGRRMDFVAGFYEL
          ||||||||||||||||||:||||||||||||||||||
a218      LETVDRFARXNRFQRALSAEFAQRRGRRMDFVAGFYEL
                190        200        210
```

The following partial DNA sequence was identified in *N. gonorrhoeae* <SEQ ID 775>:

```
g219.seq
  1   atgacggcaa ggttaaggaa gtgccgtgga ttttggagct tatgcctatg 51   cctgtctcag ggacgactgt gggtgaaaac ggcattaacc ccaccgagcc 101   caataacatt ggaaaccgtc gaccgtttcg cgcgggaaat cggtttcaaa 151   gggcgttatc agttgaattt gcccaaaggc gaggacgggg tatggacttt 201   gtcgcaggat tctatgagtt atgacatgat cagcccgttt gccgaccgca
```

-continued

```
251  cggtacatat cgaccagtac agcggcgaga ttcttgccga catccgtttt 301  gacgattaca acccgttcgg caaatttatg gcggcaagca ttgcgctgca 351  tatggggact ttgggctggt ggagcgtgtt ggcgaacgtc gtgttctgcc 401  ttgccgtgat ttttatcggc atcagcggct gcgtgatgtg gtggaaacgc 451  cgtccgtccg gcgtggcggg cattgttcct ccggcgcaaa aaatcaaact 501  gcccgtctgg tgggcgatgg cattgccgct gctgttgatt gcactgcttt 551  tcccgaccgc gctgcttgcc attgccgtga tttggctgtt ggataccttg 601  ctgctgtcgc ggattcctgt gttgaggaaa tggtttaaat ga
```

This corresponds to the amino acid sequence <SEQ ID 776; ORF 219.ng>:

```
g219.pep
    1  MTARLRKCRG FWSLCLCLSQ GRLWVKTALT PPSPITLETV DRFAREIGFK

51  GRYQLNLPKG EDGVWTLSQD SMSYDMISPF ADRTVHIDQY SGEILADIRF

101  DDYNPFGKFM AASIALHMGT LGWWSVLANV VFCLAVIFIG ISGCVMWWKR

151  RPSGVAGIVP PAQKIKLPVW WAMALPLLLI ALLFPTALLA IAVIWLLDTL

201  LLSRIPVLRK WFK*
```

The following partial DNA sequence was identified in N. meningitidis <SEQ ID 777>:

```
m219.seq
    1  ATGACGGCAA GGTTAAGGAA GTGCCGTGGG TTTTGGAGCT TACGCCTATG

51  CCTGTTTCAG GGACGaCyGt gGGCAAAGAC GGCATTAACC CTGACGAGCC

101  GATGACATTG GAAACCGTCG ACCGCTTTGC GCGGnGAAAT CGGTTTCAAA

151  GGGCGTTATC AGTTGAATTT GCCCAAAGGC GAGGACGGCG TATGGACTTT

201  GTCGCAGGAT TCTATGAGTT ACGACATGAT CAGCCCGTTT GCCGACCGCA

251  CGGTACATAT CGACCAGTAC AGCGGCAAAA TCCTTGCCGA CATCCGTTTT

301  GACGATTACA ACCCGTTCGG CAAATTTATG GCGGCAAGCA TTGCGCTGCA

351  TATGGGGACT CTGGGCTGGT GGAGCGTGTT GGCGAACGTC TTGTTCTGCC

401  TTGCCGTCAT TTTTATCGGT ATCAGCGGCT GCGTGATGTG GTGGAAACGC

451  CGTCCGACCG GAGCGGTGGG CATCGTTCCG CCGGCGCAGA AAGTCAAGCT

501  GCCGGTTTGG TGGATGATGG CATTGCCGCT ATTGGCAATC GCACTGCTCT

551  TCCCGACCTC ACTGCTTGCC ATTGCCGTGA TTTGGCTGTT GGATACGCTG

601  CTGTTGTCGC GGATTCCTGT TTTGAGGAGA TGGTTTAAAT GA
```

This corresponds to the amino acid sequence <SEQ ID 778; ORF 219>:

```
m219.pep
    1  MTARLRKCRG FWSLRLCLFQ GRXWAKTALT LTSRXHWKPS TALRGEIGFK

51  GRYQLNLPKG EDGVWTLSQD SMSYDMISPF ADRTVHIDQY SGKILADIRF

101  DDYNPFGKFM AASIALHMGT LGWWSVLANV LFCLAVIFIG ISGCVMWWKR

151  RPTGAVGIVP PAQKVKLPVW WMMALPLLAI ALLFPTSLLA IAVIWLLDTL

201  LLSRIPVLRR WFK*
```

Computer analysis of this amino acid sequence gave the following results:
Homology with a Predicted ORF from *N. gonorrhoeae*
ORF 219 shows 86.9% identity over a 213 aa overlap with a predicted ORF (ORF 219.ng) from *N. gonorrhoeae*:

```
m219/g219
                  10         20         30         40         50         60
m219.pep  MTARLRKCRGFWSLRLCLFQGRXWAKTALTLTSRXHWKPSTALRGEIGFKGRYQLNIPKG
          ||||||||||||| ||| ||| :||||| |    :    : ||||||||||||||||||
g219      MTARLRKCRGFWGLCLCLSQGRLWVKTALTPPSPITLETVDRFAREIGFKGRYQLNIPKG
                  10         20         30         40         50         60

70         80         90        100        110        120
m219.pep  EDGVWTLSQDSMSYDMISPFADRTVHIDQYSGKILADIRFDDYNPFGKFMAASIALHMGT
          |||||||||||||||||||||||||||||||:||||||||||||||||||||||||||||
g219      EDGVWTLSQDSMSYDMISPFADRTVHIDQYSGEILADIRFDDYNPFGKFMAASIALHMGT
                  70         80         90        100        110        120

130        140        150        160        170        180
m219.pep  LGWWSVLANVLFCIAVIFIGISGCVMWWKRRPTGAVGIVPPAQKVKLPVWWMMALPLLAI
          ||||||||||:|||||||||||||||||||||:|::||||||||||:|||||| |||| |
g219      LGWWSVLANVVFCLAVIFIGISGCVMWWKRRPSGVAGIVPPAQKIKLPVWWAMALPLLLI
                  130        140        150        160        170        180

190        200        210
m219.pep  ALLFPTSLLAIAVIWLLDTLLLSRIPVLRRWFKX
          ||||||:|||||||||||||||||||||||:||
g219      ALLFPTALLAIAVIWLLDTLLLSRIPVLRKWFK
                  190        200        210
```

The following partial DNA sequence was identified in *N. meningitidis* <SEQ ID 779>:

```
a219.seq
    1   ATGACGGCAA GGTTAAGGAA GTGCCGTGGG TTTTGGAGCT TACGCCTATG

51   CCTGTTTCAG GGACGACTGT GGGCAAAGAC GGTATTAACC CTGACGAGCC

101   GATGACATTG GAAACCGTCG ACCGTTTTGC GCGG.GAAAT CGGTTTCAAA

151   GGGCGTTATC AGCTGAATTT GCCCAAAGGC GAGGACGGCG TATGGACTTT

201   GTCGCAGGAT TCTATGAGTT ACGACATGAT CAGCCCGTTT GCTGACCGCA

251   CGGTGCATAT CGACCAGTAC AGCGGCAAGA TTCTTGCCGA CATCCGTTTT

301   GACGATTACA ACCCGTTCGG CAAATTTATG GCGGCAAGCA TTGCGCTGCA

351   TATGGGGACT TTGGGCTGGT GGAGCGTGTT GGCGAACGTT TTGTTCTGCC

401   TTGCCGTGAT TTTTATCGGC ATCAGCGGCT GCGTGATGTG GTGGAAACGC

451   CGTCCGTCCG GCGCGGTGGG CATGGTTCCG CCGGCGCAAA AAATCAAGCT

501   GCCCGTCTGG TGGGCAATGG CGGTGCCGCT GCTGCTGATT GCATTGCTTT

551   TCCCGACCGC GTTGCTTGCC ATTGCCGTGA TTTGGCTGTT GGATACGCTG

601   CTGTTGTCGC GGATTCCTGT TTTGAGGAGA TGGTTTAAAT GA
```

This corresponds to the amino acid sequence <SEQ ID 780; ORF 219.a>:

```
a219.pep
    1   MTARLRKCRG FWSLRLCLFQ GRLWAKTVLT LTSR*HWKPS TVLRXEIGFK

51   GRYQLNLPKG EDGVWTLSQD SMSYDMISPF ADRTVHIDQY SGKILADIRF

101   DDYNPFGKFM AASIALHMGT LGWWSVLANV LFCLAVIFIG ISGCVMWWKR

151   RPSGAVGMVP PAQKIKLPVW WAMAVPLLLI ALLFPTALLA IAVIWLLDTL

201   LLSRIPVLRR WFK*
``` m219/a219 94.8% identity in 213 aa overlap

```
                 10         20         30         40         50         60
m219.pep  MTARLRKCRGFWSLRLCLFQGRXWAKTALTLTSRXHWKPSTALRGEIGFKGRYQLNLPKG
          ||||||||||||||||||||||||| ||||:||||||||||||:|| |||||||||||||
a219      MTARLRKCRGFWSLRLCLFQGRLWAKTVLTLTSRXHWKPSTVLRXEIGFKGRYQLNLPKG
                 10         20         30         40         50         60

70         80         90        100        110        120
m219.pep  EDGVWTLSQDSMSYDMISPFADRTVHIDQYSGKILADIRFDDYNPFGKFMAASIALHMGT
          ||||||||||||||||||||||||||||||||||||||||||||||||||||||||||||
a219      EDGVWTLSQDSMSYDMISPFADRTVHIDQYSGKILADIRFDDYNPFGKFMAASIALHMGT
                 70         80         90        100        110        120

130        140        150        160        170        180
m219.pep  LGWWSVLANVLFCLAVIFIGISGCVMWWKRRPTGAVGIVPPAQKVKLPVWWMMALPLLAI
          ||||||||||||||||||||||||||||||||||:||||:||||||:||||| |:||| |
a219      LGWWSVLANVLFCLAVIFIGISGCVMWWKRRPSGAVGMVPPAQKIKLPVWWAMAVPLLLI
                130        140        150        160        170        180

190        200        210
m219.pep  ALLFPTSLLAIAVIWLLDTLLLSRIPVLRRWFKX
          |||||:||||||||||||||||||||||||||||
a219      ALLFPTALLAIAVIWLLDTLLLSRIPVLRRWFKX
                190        200        210
```

The following partial DNA sequence was identified in *N. gonorrhoeae* <SEQ ID 781>:

```
g221.seq
    1   atgcacgacc acggcgccat ggatcgccgc ctccccgctt cggaagtct
   51   gatgcggcga gccgtaaatc adatcgacgc tgacggattt gaaccctgcc
  101   tcacgggcgg catcgatgac ttctttggtt cttcgtagc tttggatgcg
  151   gttgactgcc gcctgcactt tggggtcgaa atcctgaatg ccgacgctca
  201   tgcggttgaa gccgagtctg ccgagcatga ggacggtgtc gcggctgact
  251   ttgcgcgggt cgatttcgat ggaatattcg ccggacggta tcagttcgaa
  301   atgtttgcgg atcatgcgga agacacgttc gatctgttcg tcgctcaaaa
  351   aggtcggcgt gccgccgccg aagtgcagtt gggcaagctg gtgccgtccg
  401   ttcagatgtg gagcgagcag ttccatttct ttttcaagat attcgatgta
  451   ggtatcggcg cggctttttgt ctttggtgat gattttgttg cagccgcagt
  501   agtagcagat ggtgttgcaa acggaatgt gaatgtaaag ggaaagcggt
  551   ttgtttaa
```

45

This corresponds to the amino acid sequence <SEQ ID 782; ORF 221.ng>:

```
g221.pep
    1   MHDHGAMDRR LPAFGSLMRR AVNXIDADGF EPCLTGGIDD FFGFFVALDA
   51   VDCRLHFGVE ILNADAHAVE AESAEHEDGV AADFARVDFD GIFAGRYQFE
  101   MFADHAEDTF DLFVAQKGRR AAAEVQLGKL VPSVQMWSEQ FHFFFKIFDV
  151   GIGAAFVFGD DFVAAAVVAD GVAKRNVNVK GKRFV*
```

The following partial DNA sequence was identified in *N. meningitidis* <SEQ ID 783>:

```
m221.seq
    1   ATGGyGGTTT TGATGcwcmg AAGTCTGGTG CGGCAGGCCG TAAATCAAAT
   51   CGACGCTGAC GGATTTGAAC CCCGCTTCGC GCGCCGCATC GATGACTTCT
  101   TTGGTTTCTT CGTAACTTTG GATGCGGTTG ACCGCCGCCT GCACTTTGGG
```

```
-continued
151    GTCGAAATCC TGAATGCCGA TGCTCATGCG GTTGAAGCCG AGTCTGCCGA

201    GCATGAGGAC GGTGTCGCGG CTGACTTTGC GCGGGTCGAT TTCGATGGAG

251    TATTCGCCGG TGGGGATTAA CTCGAAATGT TTGCGTATCA TGCGGAAGAC

301    ACGTTCGATC TGTTCGTCGC TCAAAAAGGt GCGTGCcCCG CCGAAGTGCA

351    GTTGGGCAAG CTGGTGCCGT CCGTTCAGAT GTGGAGCGAG CAGTTCCATT

401    TCTTTTTCAA GATATTCGAT GTAGGCATCG GCGCGGCTTT TGTCTTTGGT

451    GATGATTTTG TTGCAGCCGC AGTAGTAGCA GATGGTGTTG CAGAACGGAA

501    TGTGAATGTA AAGGGAAAGC GGTTTGTTTA A
```

This corresponds to the amino acid sequence <SEQ ID 784; ORF 221>:

```
m221.pep
  1   MXVLMXRSLV RQAVNQIDAD GFEPRFARRI DDFFGFFVTL DAVDRRLHFG

51   VEILNADAHA VEAESAEHED GVAADFARVD FDGVFAGGDX LEMFAYHAED

101   TFDLFVAQKG ACPAEVQLGK LVPSVQMWSE QFHFFFKIFD VGIGAAFVFG

151   DDFVAAAVVA DGVAERNVNV KGKRFV*
```

Computer analysis of this amino acid sequence gave the following results:
Homology with a Predicted ORF from *N. gonorrhoeae*
ORF 221 shows 87.6% identity over a 170 aa overlap with a predicted ORF (ORF 221.ng) from *N. gonorrhoeae*:

```
m221/g221
                    10         20         30         40         50
    m221.pep        MXVLMXRSLVRQAVNQIDADGFEPRFARRIDDFFGFFVTLDAVDRRLHFGVE
                    ||:|:|||  ||||||||| :: ||||||||||:|||| ||||||
    g221    MHDHGAMDRRLPAFGSLMRRAVNXIDADGFEPCLTGGIDDFFGFFVALDAVDCRLHFGVE
                10         20         30         40         50         60

60         70         80         90        100        110
    m221.pep        ILNADAHAVEAESAEHEDGVAADFARVDFDGVFAGGDXLEMFAYHAEDTFDLFVAQKGA-
                    ||||||||||||||||||||||||||||||:|||   :||| ||||||||||||||
    g221            ILNADAHAVEAESAEHEDGVAADFARVDFDGIFAGRYQFEMFADHAEDTFDLFVAQKGRR
                        70         80         90        100        110        120

120        130        140        150        160        170
    m221.pep        CPAEVQLGKLVPSVQMWSEQFHFFFKIFDVGIGAAFVFGDDFVAAAVVADGVAERNVNVK
                     ||||||||||||||||||||||||||||||||||||||||||||||||:||||||
    g221            AAAEVQLGKLVPSVQMWSEQFHFFFKIFDVGIGAAFVFGDDFVAAAVVADGVAKRNVNVK
                        130        140        150        160        170        180 m221.pep        GKRFVX
                    ||||||
    g221            GKRFVX
                                                                  50
```

The following partial DNA sequence was identified in *N. meningitidis* <SEQ ID 785>:

```
a221.seq
  1    ATGGTGGTTT TGATGCTCCG AAGTCTGGTG CGGCAGGCCG TAAATCAAAT

51    CGACGCTGAC GGATTTGAAC CCCGCTTCGC GCGCCGCATC GATGACTTCT

101    TTGGTTTCTT CGTAACTTTG GATGCGGTTG ACCGCCGCCT GCACTTTGGG

151    GTCGAAATCC TGAATGCCGA TGCTCATGCG GTTGAAGCCG AGTCTGCCGA

201    GCATGAGGAC GGTGTCGCGG CTGACTTTGC GCGGGTCGAT TTCGATGGAG

251    TATTCGCCGG TGGGGATTAA CTCGAAATGT TTGCGTATCA TGCGGAAGAC

301    ACGTTCGATT TGGTCGTCGC TCAAAAAGGT CGGCGTGCCG CCGCCGAAGT
```

```
         -continued
351  GCAGTTGGGC AAGCTGGTGC CGTCCGTTCA GATGTGGAGC GAGCAGTTCC

401  ATTTCTTTTT CAAGAAATTC GATGTAGGCA TCGGCGCGGC TTTTGTCTTT

451  GGTGATGATT TTGTTGCAGC CGCAGTAGTA GCAGATGGTG TTGCAGAACG

501  GAATGTGAAT GTAAAGGGAA AGCGGTTTGT TTAA
```

This corresponds to the amino acid sequence <SEQ ID 786; ORF 221.a>:

```
a221.pep
   1   MVVLMLRSLV RQAVNQIDAD GFEPRFARRI DDFFGFFVTL DAVDRRLHFG

51   VEILNADAHA VEAESAEHED GVAADFARVD FDGVFAGGD* LEMFAYHAED

101   TFDLVVAQKG RRAAAEVQLG KLVPSVQMWS EQFHFFFKKF DVGIGAAFVF

151   GDDFVAAAVV ADGVAERNVN VKGKRFV*
``` m221/a221 95.5% identity in 177 aa overlap

```
                 10         20         30         40         50         60
 m221.pep  MXVLMXRSLVRQAVNQIDADGFEPRFARRIDDFFGFFVTLDAVDRRLHFGVEILNADAHA
           | |||  ||||||||||||||||||||||||||||||||||||||||||||||||||||
 a221      MVVLMLRSLVRQAVNQIDADGFEPRFARRIDDFFGFFVTLDAVDRRLHFGVEILNADAHA
                 10         20         30         40         50         60

70         80         90        100        110       119
 m221.pep  VEAESAEHEDGVAADFARVDFDGVFAGGDXLEMFAYHAEDTFDLFVAQKGA-CPAEVQLG
           |||||||||||||||||||||||||||||||||||||||||||||| ||||     ||||
 a221      VEAESAEHEDGVAADFARVDFDGVFAGGDXLEMFAYHAEDTFDLVVAQKGRRAAAEVQLG
                 70         80         90        100        110       120

120        130        140        150        160        170
 m221.pep  KLVPSVQMWSEQFHFFFKIFDVGIGAAFVFGDDFVAAAVVADGVAERNVNVKGKRFVX
           ||||||||||||||||||| ||||||||||||||||||||||||||||||||||||||
 a221      KLVPSVQMWSEQFHFFFKKFDVGIGAAFVFGDDFVAAAVVADGVAERNVNVKGKRFVX
                130        140        150        160        170
```

The following partial DNA sequence was identified in *N. gonorrhoeae* <SEQ ID 787>:

```
g223.seq
   1   atggaattca ggcaccaggt agtggtagtt ggtgtcgaac catttggtca 51   tttcgatggc gaattggtct tgttgccgc gcgccagttg gaagaattgt 101   tccaaaggca ggttttggct atcgaagccg aaacgggcgg gaatcgcgcc 151   cgtggatact tgcaggtcga ggatgtgatg gtagaaagtg aaatcacgta 201   cagcaacgta atcagcgtta ggagcagctt ggtgtttcca gttttctcg 251   cgcaggtctt tggcaacgtc gagcagctct tgttcactga tctctttgcg 301   ccagtatttt tcttgggcga atttcaattc acggaaggcg ccgacacgcg 351   ggaagcctga
```

This corresponds to the amino acid sequence <SEQ ID 788; ORF 223.ng>:

```
g223.pep..
   1       MEFRHQVVVV GVEPFGHFDG ELVFVAARQL EELFQRQVLA IEAETGGNRA

51       RGYLQVEDVM VESEITYSNV ISVRSSLVFP VFLAQVFGNV EQLLFTDLFA

101       PVFFLGEFQF TEGADTREA*
```

The following partial DNA sequence was identified in *N. meningitidis* <SEQ ID 789>:

```
m223.seq
    1   GTGGAATTCA GGCACCAAGT AGTGGTAGTT GGTGTCGAAC CATTTGGTCA

51   TTTCGATAGC GAATTGGTCT TTGTTACCGC GCGCCAGTTG GAAGAATTGT

101   TCCAAAGACA GGTTTTGGCT GTCGAAGCCG AAGCGGGCGG GAATCGCGCC

151   GGTGGCGACT TGCAGGTCGA GGATGTGGTC GTAGAAAGTG AAATCsCTAC

201   GGCAACGAAA TCGGCGTTGG CAGCGACCTG GTGTTTCCAG TTTTTCTCGC

251   GCAAGTCTTT AGCAACAGCC AGCAATTCTT GCTCGCTGAT TTCTTTGCGC

301   CAGTATTTTT CTTGTCGAA TTTCAATTCG CGGAAGGCGC CGACACGCGG

351   GAAGCCTGA
```

This corresponds to the amino acid sequence <SEQ ID 790; ORF 223>:

```
m223.pep
    1   VEFRHQVVVV GVEPFGHFDS ELVFVTARQL EELFQRQVLA VEAEAGGNRA

51   GGDLQVEDVV VESEIXYGNE IGVGSDLVFP VFLAQVFSNS QQFLLADFFA

101   PVFFLCEFQF AEGADTREA*
```

Computer analysis of this amino acid sequence gave the following results:
Homology with a Predicted ORF from *N. gonorrhoeae*
ORF 223 shows 80.7% identity over a 119 aa overlap with a predicted ORF (ORF 223.ng) from *N. gonorrhoeae*:

```
m223/g223
                  10         20         30         40         50         60
m223.pep  VEFRHQVVVVGVEPFGHFDSELVFVTARQLEELFQRQVLAVEAEAGGNRAGGDLQVEDVV
          :||||||||||||||||||:|||||:||||||||||||||:|||:||||| |||||||:
g223      MEFRHQVVVVGVEPFGHFDGELVFVAARQLEELFQRQVLAIEAETGGNRARGYLQVEDVM
                  10         20         30         40         50         60

70         80         90        100        110        120
m223.pep  VESEIXYGNEIGVGSDLVFPVFLAQVFSNSQQFLLADFFAPVFFLCEFQFAEGADTREAX
          |||||:|:| |:| |:||||||||||:|:|::|:|||||| ||||:|||||||||||
g223      VESEITYSNVISVRSSLVFPVFLAQVFGNVEQLLFTDLFAPVFFLGEFQFTEGADTREAX
                  70         80         90        100        110
```

The following partial DNA sequence was identified in *N. meningitidis* <SEQ ID 791>:

```
a223.seq
    1   GTGGAATTCA GGCACCAAGT AGTGGTAGTT GGTGTCGAAC CATTTGGTCA

51   TTTCGATAGC GAATTGGTCT TTGTTACCGC GCGCCAGTTG GAAGAATTGT

101   TCCAAAGATA GGTTTTGGCT GTCGAAGCCG AAGCGGGCGG GAATCGCGCC

151   GGTGGCGACT TGCAGGTCGA GGATGTGGTC GTAGAAAGTG AAATCGCCTA

201   CGGCAACGTA ATCGGCGTTG GCAGCGGCCT GGTGTTTCCA GTTTTTCTCG

251   CGCAAGTCTT TAGCAACAGC CAGCAATTCT TGCTCGCTGA TTTCTTTGCG

301   CCAGTATTTT TCTTGTCGA ATTTCAATTC GCGGAAGGCA CCGACACGCG

351   GGAAGCCTGA
```

This corresponds to the amino acid sequence <SEQ ID 792; ORF 223.a>:

```
a223.pep
    1    VEFRHQVVVV GVEPFGHFDS ELVFVTARQL EELFQR*VLA VEAEAGGNRA

51    GGDLQVEDVV VESEIAYGNV IGVGSGLVFP VFLAQVFSNS QQFLLADFFA

101    PVFFLCEFQF AEGTDTREA*
``` m223/a223 95.8% identity in 119 aa overlap

```
                  10         20         30         40         50         60
     m223.pep VEFRHQVVVVGVEPFGHFDSELVFVTARQLEELFQRQVLAVEAEAGGNRAGGDLQVEDVV
              ||||||||||||||||||||||||||||||||| ||||||||||||||||||||||||||
     a223     VEFRHQVVVVGVEPFGHFDSELVFVTARQLEELFQRXVLAVEAEAGGNRAGGDLQVEDVV
                  10         20         30         40         50         60

70         80         90        100        110        120
     m223.pep VESEIXYGNEIGVSDLVFPVFLAQVFSNSQQFLLADFFAPVFFLCEFQFAEGADTREAX
              ||||| ||| |||||  ||||||||||||||||||||||||||||||||||:||||||
     a223     VESEIAYGNVIGVGSGLVFPVFLAQVFSNSQQFLLADFFAPVFFLCEFQFAEGTDTREAX
                  70         80         90        100        110        120
```

The following partial DNA sequence was identified in *N. gonorrhoeae* <SEQ ID 793>:

```
g225.seq
    1    atggattctt ttttcaaacc ggcagtttgg gcggttttgt ggctgatgtt 51    tgccgtccgc cccgcccttg ccgacgagtt gaccaacctg ctcagcagcc 101    gcgagcagat tctcagacag tttgccgaag acgaacagcc cgttttaccc 151    gtcaaccgag ccccgcccg gcgggcgggc aatgccgacg aactcatcgg 201    cggcgcgatg gggcttaacg aacagcccgt tgtacgcgtc aaccgagccn 251    ccgcccggcg ggcgggcaat gccgacaaac tcatcggcag cgcgatgcgg 301    cttttgggta ttgcctaccg ctacggcggc acatcggtgt ctaccggttt 351    tgactgcagc ggattcatgc agcacatctt caaacgcgcc atgggcatca 401    acctgccgcg cacgtcggcg gaacaggcgc ggatgggcgc accgttgcc 451    cgaagcgaat tgcagcccgg ggatatggtg ttttccgca cgctcggcgg 501    cagccgcatt tcccatgtcg gactttatat cggcaacaac cgcttcatcc 551    acgcgccgcg cacggggaaa aatatcgaaa tcaccagcct gagccacaaa 601    tattggagcg gcaaatatgc gttcgcccgc cgggtcaaga aaacgaccc 651    gtcacgcttt ctgaactga
```

This corresponds to the amino acid sequence <SEQ ID 794; ORF 225.ng>:

```
g225.pep
    1    MDSFFKPAVW AVLWLMFAVR PALADELTNL LSSREQILRQ FAEDEQPVLP

51    VNRAPARRAG NADELIGGAM GLNEQPVVRV NRAXARRAGN ADKLIGSAMR

101    LLGIAYRYGG TSVSTGFDCS GFMQHIFKRA MGINLPRTSA EQARMGAPVA

151    RSELQPGDMV FFRTLGGSRI SHVGLYIGNN RFIHAPRTGK NIEITSLSHK

201    YWSGKYAFAR RVKKNDPSRF LN*
```

The following partial DNA sequence was identified in *N. meningitidis* <SEQ ID 795>:

m225.seq (partial)
```
   1   ..TTTTCAAACC CGGCAGTTTG GGCGGTTTTG TGGCTGAwGT TTGCCGTCCG
  51     CCCCGCCCTT GCCGACGAGT TGACCAACCT GCTCAGCAGC CGCGAGCAGA
 101     TTCTCAGACA GTTTGCCGAA GACGAACAGC CCGTTTTACC CATCAACCGA
 151     GCCCCCGCCC GGCGGGCGGG CAATGCCGAC GAACTCATCG GCAGCGCGAT
 201     GGGGCTTAAC GAACAGCCCG TTTTACCCGT CAACCGAGTC CCCGCCCGGC
 251     GGGCGGGCAA TGCCGACGAA CTCATCGGCA ACGCGATGGG GCTTAACGAA
 301     CAGCCCGTTT TACCCGTCAA CCGAGCCCCC GCCCGGCGGG CGGGCAATGC
 351     CGACGAACTC ATCGGCAACG CGATGGGACT TTTGGGTATT GCCTACCGCT
 401     ACGGCGGCAC ATCGGTTTCT ACCGGTTTTG ACTGCAGCGG CTTCATGCAG
 451     CACATCTTCA AACGCGCCAT GGGCATCAAC CTGCCGCGCA CGTCGGCAGA
 501     ACAGGCACGG ATGGGTACGC CGGTTGCCCG AAGCGAATTG CAGCCCGGAG
 551     ATATGGTGTT TTTCCGCACG CTCGGCGGCA GCCGCATTTC CCATGTCGGA
 601     CTTTATATCG GCAACAACCG CTTCATCCAC GCGCCGCGCA CGGGGAAAAA
 651     TATCGAAATC ACCAGCCTGA GCCACAAATA TTGGAGCGGC AAATACGCGT
 701     TCGCCCGCCG GGTCAAGAAA AACGACCCGT CCCGCTTTCT GAACTGA
```

This corresponds to the amino acid sequence <SEQ ID 796; ORF 225>:

m225.pep (partial)
```
   1   ..FSNPAVWAVL WLXFAVRPAL ADELTNLLSS REQILRQFAE DEQPVLPINR
  51     APARRAGNAD ELIGSAMGLN EQPVLPVNRV PARRAGNADE LIGNAMGLNE
 101     QPVLPVNRAP ARRAGNADEL IGNAMGLLGI AYRYGGTSVS TGFDCSGFMQ
 151     HIFKRAMGIN LPRTSAEQAR MGTPVARSEL QPGDMVFFRT LGGSRISHVG
 201     LYIGNNRFIH APRTGKNIEI TSLSHKYWSG KYAFARRVKK NDPSRFLN*
```

Computer analysis of this amino acid sequence gave the following results:
Homology with a Predicted ORF from *N. gonorrhoeae*
ORF 225 shows 83.5% identity over a 248 aa overlap with a predicted ORF (ORF 225.ng) from *N. gonorrhoeae*:

```
     m225/g225
                     10         20         30         40         50
        m225.pep    FSNPAVWAVLWLXFAVRPALADELTNLLSSREQILRQFAEDEQPVLPINRAPARRAG
                      :||||||||| |||||||||||||||||||||||||||||||||:|||||||||
            g225    MDSFFKPAVWAVLWLMFAVRPALADELTNLLSSREQILRQFAEDEQPVLPVNRAPARRAG
                         10         20         30         40         50         60

60         70         80         90        100        110
        m225.pep    NADELIGSAMGLNEQPVLPVNRVPARRAGNADELIGNAMGLNEQPVLPVNRAPARRAGNA
                    |||||||                           :||||||: |||| |||||||
            g225    NADELIG---------------------------GAMGLNEQPVVRVNRAXARRAGNA
                                                           70         80         90

120        130        140        150        160        170
        m225.pep    DELIGNAMGLLGIAYRYGGTSVSTGFDCSGFMQHIFKRAMGINLPRTSAEQARMGTPVAR
                    |:|||:|| |||||||||||||||||||||||||||||||||||||||||||| ||||
            g225    DKLIGSAMRLLGIAYRYGGTSVSTGFDCSGFMQHIFKRAMGINLPRTSAEQARMGAPVAR
                          100        110        120        130        140        150

180        190        200        210        220        230
        m225.pep    SELQPGDMVFFRTLGGSRISHVGLYIGNNRFIHAPRTGKNIEITSLSHKYWSGKYAFARR
                    ||||||||||||||||||||||||||||||||||||||||||||||||||||||||||
            g225    SELQPGDMVFFRTLGGSRISHVGLYIGNNRFIHAPRTGKNIEITSLSHKYWSGKYAFARR
                          160        170        180        190        200        210
```

```
                240       249
m225.pep    VKKNDPSRFLNX
            ||||||||||
g225        VKKNDPSRFLN
                220
```

The following partial DNA sequence was identified in *N. meningitidis* <SEQ ID 797>:

```
a225.seq
    1   ATGGATTCTT TTTTCAAACC GGCAGTTTGG GCGGTTTTGT GGCTGATGTT

51   TGCCGTCCGC C

```
              90        100       110       120       130       140
m225.pep   DELIGNAMGLNEQPVLPVNRAPARRAGNADELIGNAMGLLGIAYRYGGTSVSTGFDCSGF
           ||||||||||||||||||||||||||||||||||||||||||||||||:|||||||||
a225       DELIGNAMGLNEQPVLPVNRAPARRAGNADELIGNAMGLLGIAYRYGGTSISTGFDCSGF
              130       140       150       160       170       180
              150       160       170       180       190       200
m225.pep   MQHIFKRAMGINLPRTSAEQARMGTPVARSELQPGDMVFFRTLGGSRISHVGLYIGNNRF
           |||||||||||||||||||||||||||||||||||||| |||||||||||||||||||||
a225       MQHIFKRAMGINLPRTSAEQARMGTPVARSELQPGDMVXFRTLGGSRISHVGLYIGNNRF
              190       200       210       220       230       240
              210       220       230       240    249
m225.pep   IHAPRTGKNIEITSLSHKYWSGKYAFARRVKKNDPSRFLNX
           ||||||||||||||||||||||||||||||||||||||||
a225       IHAPRTGKNIEITSLSHKYWSGKYAFARRVKKNDPSRFLNX
              250       260       270       280
```

15

The following partial DNA sequence was identified in *N. gonorrhoeae* <SEQ ID 799>:

```
g225-1.seq
     1   atggattctt ttttcaaacc ggcagtttgg gcggttttgt ggctgatgtt
    51   tgccgtccgc cccgcccttg ccgacgagtt gaccaacctg ctcagcagcc
   101   gcgagcagat tctcagacag tttgccgaag acgaacagcc cgttttaccc
   151   gtcaaccgag cccccgcccg gcgggcgggc aatgccgacg aactcatcgg
   201   cggcgcgatg gggcttaacg aacagcccgt tgtacgcgtc aaccgagccn
   251   ccgcccggcg ggcgggcaat gccgacaaac tcatcggcag cgcgatgcgg
   301   cttttgggta ttgcctaccg ctacggcggc acatcggtgt ctaccggttt
   351   tgactgcagc ggattcatgc agcacatctt caaacgcgcc atgggcatca
   401   acctgccgcg cacgtcggcg gaacaggcgc ggatgggcgc accgttgcc
   451   cgaagcgaat tgcagcccgg ggatatggtg tttttccgca cgctcggcgg
   501   cagccgcatt tcccatgtcg gactttatat cggcaacaac cgcttcatcc
   551   acgcgccgcg cacggggaaa aatatcgaaa tcaccagcct gagccacaaa
   601   tattggagcg gcaaatatgc gttcgcccgc cgggtcaaga aaaacgaccc
   651   gtcacgcttt ctgaactga
```

This corresponds to the amino acid sequence <SEQ ID 800; ORF 225-1.ng>:

```
g225-1.pep
     1   MDSFFKPAVW AVLWLMFAVR PALADELTNL LSSREQILRQ FAEDEQPVLP
    51   VNRAPARRAG NADELIGGAM GLNEQPVVRV NRAXARRAGN ADKLIGSAMR
   101   LLGIAYRYGG TSVSTGFDCS GFMQHIFKRA MGINLPRTSA EQARMGAPVA
   151   RSELQPGDMV FFRTLGGSRI SHVGLYIGNN RFIHAPRTGK NIEITSLSHK
   201   YWSGKYAFAR RVKKNDPSRF LN*
```

The following partial DNA sequence was identified in *N. meningitidis* <SEQ ID 801>:

```
m225-1.seq
     1   ATGGATTCTT TTTTCAAACC GGCAGTTTGG GCGGTTTTGT GGCTGATGTT
    51   TGCCGTCCGC CCCGCCCTTG CCGACGAGTT GACCAACyTG CTCAGCAGCC
   101   GCGAGCAGAT TCTCAGACAG TTTGCCGAAG ACGAACAGCC CGTTTTACCC
   151   ATCAACCGAG CCCCCGCCCG GCGGGCGGGC AATGCCGACG AACTCATCGG
```

-continued

```
201    CAGCGCGATG GGGCTTAACG AACAGCCCGT TTTACCCGTC AACCGAGTCC

251    CCGCCCGGCG GGCGGGCAAT GCCGACGAAC TCATCGGCAA CGCGATGGGG

301    CTTAACGAAC AGCCCGTTTT ACCCGTCAAC CGAGCCCCCG CCCGGCGGGC

351    GGGCAATGCC GACGAACTCA TCGGCAACGC GATGGGACTT TTGGGTATTG

401    CCTACCGCTA CGGCGGCACA TCGGTTTCTA CCGGTTTTGA CTGCAGCGGC

451    TTCATGCAGC ACATCTTCAA ACGCGCCATG GGCATCAACC TGCCGCGCAC

501    GTCGGCAGAA CAGGCACGGA TGGGTACGCC GGTTGCCCGA AGCGAATTGC

551    AGCCCGGAGA TATGGTGTTT TTCCGCACGC TCGGCGGCAG CCGCATTTCC

601    CATGTCGGAC TTTATATCGG CAACAACCGC TTCATCCACG CGCCGCGCAC

651    GGGGAAAAAT ATCGAAATCA CCAGCCTGAG CCACAAATAT GGAGCGGCA

701    AATACGCGTT CGCCCGCCGG GTCAAGAAAA ACGACCCGTC CCGCTTTCTG

751    AACTGA
```

This corresponds to the amino acid sequence <SEQ ID 802; ORF 217>:

```
m225-1.pep
    1   MDSFFKPAVW AVLWLMFAVR PALADELTNL LSSREQILRQ FAEDEQPVLP

51   INRAPARRAG NADELIGSAM GLNEQPVLPV NRVPARRAGN ADELIGNAMG

101   LNEQPVLPVN RAPARRAGNA DELIGNAMGL LGIAYRYGGT SVSTGFDCSG

151   FMQHIFKRAM GINLPRTSAE QARMGTPVAR SELQPGDMVF FRTLGGSRIS

201   HVGLYIGNNR FIHAPRTGKN IEITSLSHKY WSGKYAFARR VKKNDPSRFL

251   N*
``` m225-1/g225-1 84.9% identity in 251 aa overlap

```
                    10         20         30         40         50         60
m225-1.pep  MDSFFKPAVWAVLWLMFAVRPALADELTNLLSSREQILRQFAEDEQPVLPINRAPARRAG
            ||||||||||||||||||||||||||||||||||||||||||||||||||:|||||||||
g225-1      MDSFFKPAVWAVLWLMFAVRPALADELTNLLSSREQILRQFAEDEQPVLPVNRAPARRAG
                    10         20         30         40         50         60

70         80         90        100        110        120
m225-1.pep  NADELIGSAMGLNEQPVLPVNRVPARRAGNADELIGNAMGLNEQPVLPVNRAPARRAGNA
            ||||                       |||:||||||||||: ||||  |||||||||||
g225-1      NADE-----------------------LIGGAMGLNEQPVVRVNRAXARRAGNA
                                                70         80         90

130        140        150        160        170        180
m225-1.pep  DELIGNAMGLLGIAYRYGGTSVSTGFDCSGFMQHIFKRAMGINLPRTSAEQARMGTPVAR
            :|||:||||||||||||||||||||||||||||||||||||||||||||||||||:||||
g225-1      DKLIGSAMRLLGIAYRYGGTSVSTGFDCSGFMQHIFKRAMGINLPRTSAEQARMGAPVAR
                   100        110        120        130        140        150

190        200        210        220        230        240
m225-1.pep  SELQPGDMVFFRTLGGSRISHVGLYIGNNRFIHAPRTGKNIEITSLSHKYWSGKYAFARR
            ||||||||||||||||||||||||||||||||||||||||||||||||||||||||||||
g225-1      SELQPGDMVFFRTLGGSRISHVGLYIGNNRFIHAPRTGKNIEITSLSHKYWSGKYAFARR
                   160        170        180        190        200        210

250
m225-1.pep  VKKNDPSRFLNX
            ||||||||||||
g225-1      VKKNDPSRFLNX
                   220
```

The following partial DNA sequence was identified in *N. meningitidis* <SEQ ID 803>:

```
a225-1.seq
     1   ATGGATTCTT TTTTCAAACC GGCAGTTTGG GCGGTTTTGT GGCTGATGTT
    51   TGCCGTCCGC CCCGCCCTTG CCGACGAGTT GACCAACCTG CTCAGCAGCC
   101   GCGAGCAGAT TCTCAGACAG TTTGCCGAAG ACGAACAGCC CGTTTTACCC
   151   ATCAACCGAN CCCCCGCCCG GCGGGCGGGC AATGCCGACG AACTCATCGG
   201   CAGCGCGATG GGGCTTAACG AACAGCCCGT TTTACCCGTC AACCGANTCC
   251   CCGCCCGGCG GGCGGGCAAT GCCGACNAAC TCATCGGCAA CGCGATGGGG
   301   CTTAACGAAC AGCCCGTTTT ACCCGTCAAC CGAGTCCCCG CCCGGCGGGC
   351   GGGCAATGCC GACGAACTCA TCGGCAACGC GATGGGGCTT AACGAACAGC
   401   CCGTTTTACC CGTCAACCGA GCCCCGCCC GGCGGGCGGG CAATGCCGAC
   451   GAACTCATCG GCAACGCGAT GGGACTTTTG GGTATTGCCT ACCGCTACGG
   501   CGGCACATCG ATTTCTACCG GTTTTGACTG CAGCGGCTTC ATGCAGCACA
   551   TCTTCAAACG CGCCATGGGC ATCAACCTGC CGCGCACGTC GGCAGAACAG
   601   GCGCGGATGG GTACGCCGGT TGCCCGAAGC GAATTGCAGC CCGGGGATAT
   651   GGTGTNTTTC CGCACGCTCG GCGGCAGCCG CATTTCCCAT GTCGGACTTT
   701   ATATCGGCAA CAACCGCTTC ATCCACGCGC CGCGCACGGG GAAAAATATC
   751   GAAATCACCA GCCTGAGCCA CAAATATTGG AGCGGCAAAT ACGCGTTCGC
   801   CCGCCGGGTC AAGAAAAACG ACCCGTCCCG CTTTCTGAAC TGA
                                                            30
```

This corresponds to the amino acid sequence <SEQ ID 804; ORF 225-1.a>:

```
a225-1.pep
     1   MDSFFKPAVW AVLWLMFAVR PALADELTNL LSSREQILRQ FAEDEQPVLP
    51   INRXPARRAG NADELIGSAM GLNEQPVLPV NRXPARRAGN ADXLIGNAMG
   101   LNEQPVLPVN RVPARRAGNA DELIGNAMGL NEQPVLPVNR APARRAGNAD
   151   ELIGNAMGLL GIAYRYGGTS ISTGFDCSGF MQHIFKRAMG INLPRTSAEQ
   201   ARMGTPVARS ELQPGDMVXF RTLGGSRISH VGLYIGNNRF IHAPRTGKNI
   251   EITSLSHKYW SGKYAFARRV KKNDPSRFLN *
``` a225-1/m225-1 88.6% identity in 280 aa overlap

```
                  10         20         30         40         50         60
a225-1.pep   MDSFFKPAVWAVLWLMFAVRPALADELTNLLSSREQILRQFAEDEQPVLPINRXPARRAG
             |||||||||||||||||||||||||||||||||||||||||||||||||||||  |||||
m225-1       MCSFFKPAVWAVLWLMFAVRPALADELTNLLSSREQILRQFAEDEQPVLPINRAPARRAG
                  10         20         30         40         50         60

70         80         90        100        110        120
a225-1.pep   NADELIGSAMGLNEQPVLPVNRXPARRAGNADXLIGNAMGLNEQPVLPVNRVPARRAGNA
             ||||||||||||||||                                ||||||||||||
m225-1       NADELIGSAMGLNEQP----------------------------VLPVNRVPARRAGNA
                  70         80                                  80         90

130        140        150        160        170        180
a225-1.pep   DELIGNAMGLNEQPVLPVNRAPARRAGNADELIGNAMGLLGIAYRYGGTSISTGFDCSGF
             ||||||||||||||||||||||||||||||||||||||||||||||||||:|||||||||
m225-1       DELIGNAMGLNEQPVLPVNRAPARRAGNADELIGNAMGLLGIAYRYGGTSVSTGFDCSGF
                 100        110        120        130        140        150

190        200        210        220        230        242
a225-1.pep   MQHIFKRAMGINLPRTSAEQARMGTPVARSELQPGDMVXFRTLGGSRISHVGLYIGNNRF
             |||||||||||||||||||||||||||||||||||||||||||||||||||||||||||
m225-1       MCHIFKRAMGINLPRTSAEQARMGTPVARSELQPGDMVFFRTLGGSRISHVGLYIGNNRF
                 160        170        180        190        200        210
```

```
              250        260        270        280
a225-1.pep  IHAPRTGKNIEITSLSHKYWSGKYAFARRVKKNDPSRFKNX
            ||||||||||||||||||||||||||||||||||||||||
m225-1      IHAPRTGKNIEITSLSHKYWSGKYAFARRVKKNDPSRFKNX
              220        230        240        250
```

The following partial DNA sequence was identified in *N. gonorrhoeae* <SEQ ID 805>:

```
g226.seq
    1   ATGAGCGAAA TCCTCAGGCA GCCCAGCGTT CTGCTTTTCC TCACGCTTGC

51   CGTGTACGCG CTTGCGATTA TCGTGCGCAC GCGCACGGGC AATATCTTCT

101   GCAACCCCGT ACTCGTCAGC ACTATCGTGC TGATTGCCTA CCTGAAAATC

151   CTCGGTATCG ATTATGCGGT GTACCACAAC GCCGCGCAAT TCATTGATTT

201   TCGGCTGAAA cccGccgtCG TCGTGCTTGC CGTGCCGCTC TACCAAAACC

251   GCCGTAAAAT CTTCAACCAG TGGCTGCCCG TCATCGTTTC GCAGCTTGCG

301   GGCAGCGTTA cggGCATTGT tacggggATG TATTTTgccg cttggctcgg 351   gccggatacc caattctcct tcccgcctcg tcttcaatat ctgttattta 401   caccctctgg aatcccaatt cacaccctgt atgcgcgggt tctcccgcca 451   tttctgttgc ctccgcctct cctgccgcgc ctcggcccgc atacattgcg 501   ccggttcaca atacttccaa aaaaactacg gccgtttaag cccctcctcc 551   cagttgtggt cctttctcct Ccgggcctcg ccctcccct cttataa
```

This corresponds to the amino acid sequence <SEQ ID 806; ORF 226.ng>:

```
g226.pep
    1   MSEILRQPSV LLFLTLAVYA LAIIVRTRTG NIFCNPVLVS TIVLIAYLKI

51   LGIDYAVYHN AAQFIDFRLK PAVVVLAVPL YQNRRKIFNQ WLPVIVSQLA

101   GSVTGIVTGM YFAAWLGPDT QFSFPPRLQY LLFTPSGIPI HTLYARVLPP

151   FLLPPPLLPR LGPHTLRRFT ILPKKLRPFK PLLPVVVLSP PGLAPPLL*
```

The following partial DNA sequence was identified in *N. meningitidis* <SEQ ID 807>:

```
m226.seq
    1   ATGAACGAAA TCCTCAGGCA GCCCAGCGTT CTGCTTTTCC TCACGCTTGC

51   CGTGTACGCG CTTGCGATTA TCGtGCGCAC GCGCACGGGC AATATCTTCT

101   GCAACCCCGT ACTCGTCAGC ACTATCGTGC TGATTGCCTA CCTGAAAATC

151   CTCGGTATCG ATTATGCGGT GTACCACAAC GCCGCGCAAT TCATTGATTT

201   TTGGCTGAAA CCCGCCGTCG TCGTGCTTGC CGTGCCGCTC TACCAAAACC

251   GCCGTAAAAT CTTCAACCAG TGGCTGCCCG TCATCGTTTC ACAGCTTGCG

301   GGCAGCGTTA CGGGCATTGT TACAGGGATG TATTTTGCCA AATGGCTGGG

351   CGCGGAACGC GAAGTCGTCC TCTCGCTCGC GTCCAAATCT GTTACCAACC

401   CCATCGCTAT TGAAATCACC CGCTCCATCG GCGGCATTCC CGCCATTACC

451   GCCGCCACCG TCATCATTGC CGGTCTGGTC GGACAGATTG CCGGTTACAA

501   AATGCTGAAG AACACGGTCG TCATGCCCTC GTCCGTGGGT ATGTCGCTCG

551   GCACGGCTTC GCACGCGATG GGGATTGCCG CCTCGCTCGA ACGCAGCCGC
```

-continued

```
601  CGTATGGCGG CATACGCGGG GCTGGGGCTG ACGTTCAACG GCGTACTGAC

651  CGCGCTGATT GCGCCGCTGC TCATCCCCGT TTTGGGATTT TGA
```

This corresponds to the amino acid sequence <SEQ ID 808; ORF 226>:

```
m226.pep
   1  MNEILRQPSV LLFLTLAVYA LAIIVRTRTG NIFCNPVLVS TIVLIAYLKI

51  LGIDYAVYHN AAQFIDFWLK PAVVVLAVPL YQNRRKIFNQ WLPVIVSQLA

101  GSVTGIVTGM YFAKWLGAER EVVLSLASKS VTNPIAIEIT RSIGGIPAIT

151  AATVIIAGLV GQIAGYKMLK NTVVMPSSVG MSLGTASHAM GIAASLERSR

201  RMAAYAGLGL TFNGVLTALI APLLIPVLGF *
```

Computer analysis of this amino acid sequence gave the following results:
Homology with a Predicted ORF from *N. gonorrhoeae*
ORF 226 shows 94.2% identity over a 121 aa overlap with a predicted ORF (ORF 226.ng) from *N. gonorrhoeae*:

```
m226/g226
                    10         20         30         40         50         60
m226.pep   MNEILRQPSVLLFLTLAVYALAIIVRTRTGNIFCNPVLVSTIVLIAYLKILGIDYAVYHN
           |:||||||||||||||||||||||||||||||||||||||||||||||||||||||||||
    g226   MSEILRQPSVLLFLTLAVYALAIIVRTRTGNIFCNPVLVSTIVLIAYLKILGIDYAVYHN
                    10         20         30         40         50         60

70         80         90        100        110        120
m226.pep   AAQFIDFWLKPAVVVLAVPLYQNRRKIFNQWLPVIVSQLAGSVTGIVTGMYFAKWLGAER
           ||||||||:|||||||||||||||||||||||||||||||||||||||||||||||:
    g226   AAQFIDFRLKPAVVVLAVPLYQNRRKIFNQWLPVIVSQLAGSVTGIVTGMYFAAWLGPDT
                    70         80         90        100        110        120

130        140        150        160        170        180
m226.pep   EVVLSLASKSVTNPIAIEITRSIGGIPAITAATVIIAGLVGQIAGYKMLKNTVVMPSSVG
           :
    g226   QFSFPPRLQYLLFTPSGIPIHTLYARVLPPFLLPPPLLPRLGPHTLRRFTILPKKLRPFK
                   130        140        150        160        170        180
```

The following partial DNA sequence was identified in *N. meningitidis* <SEQ ID 809>:

```
a226.seq
   1  ATGAACGAAA TCCTCAGGCA GCCGAGCATC CTGCTTTTCC TCACGCTTGC

51  CGTGTACGCG CTTGCGATTA TCGTGCGCAC GCGCACGGGT AATATCTTCT

101  GCAACCCCGT ACTCGTCAGC ACTATCGTGC TGATTGCCTA CCTGAAAATC

151  CTCGGTATCG ATTATGCGGT GTACCACAAC GCCGCGCAGT TTATCGATTT

201  CTGGCTCAAG CCCGCCGTCG TCGTGCTTGC CGTGCCGCTC TACCAAAACC

251  GCCGTAAAAT CTTCAACCAA TGGCTGCCCG TCATCGTTTC GCAGCTTGCG

301  GGCAGCGTTA CGGGCATTGT TACGGGGATG TATTTTGCCA AATGGCTGGG

351  CGCGGAACGC GAAGTCGTCC TCTCGCTCGC GTCCAAATCT GTTACCAATC

401  CTATCGCCAT CGAAATCACC CGCTCCATCG GCGGCATTCC CGCCATTACC

451  GCCGCCACCG TCATCATTGC CGGCCTGGTC GGACAGATTG CCGGTTACAA

501  AATGTTGAAA AACACGGTCG TTATGCCCTC ATCTGTCGGA ATGTCGCTCG

551  GCACGGCTTC GCACGCGATG GGCATTGCCG CCTCGCTCGA ACGCAGCCGC
```

-continued
```
601 CGCATGGCGG CATACGCGGG GCTGGGGCTG ACGTTCAACG GCGTACTGAC

651 CGCGCTGATT GCGCCGCTGC TTATCCCCGT TTTGGGATTT TGA
```

This corresponds to the amino acid sequence <SEQ ID 810; ORF 226.a>:

```
a226.pep
  1   MNEILRQPSI LLFLTLAVYA LAIIVRTRTG NIFCNPVLVS TIVLIAYLKI

51   LGIDYAVYHN AAQFIDFWLK PAVVVLAVPL YQNRRKIFNQ WLPVIVSQLA

101   GSVTGIVTGM YFAKWLGAER EVVLSLASKS VTNPIAIEIT RSIGGIPAIT

151   AATVIIAGLV GQIAGYKMLK NTVVMPSSVG MSLGTASHAM GIAASLERSR

201   RMAAYAGLGL TFNGVLTALI APLLIPVLGF *
``` m226/a226 99.6% identity in 230 aa overlap

```
                  10         20         30         40         50         60
m226.pep  MNEILRQPSVLLFLTLAVYALAIIVRTRTGNIFCNPVLVSTIVLIAYLKILGIDYAVYHN
          ||||||||:||||||||||||||||||||||||||||||||||||||||:|||||||||
a226      MNEILRQPSILLFLTLAVYALAIIVRTRTGNIFCNPVLVSTIVLIAYLKIIGIDYAVYHN
                  10         20         30         40         50         60

70         80         90        100        110        120
m226.pep  AAQFIDFWLKPAVVVLAVPLYQNRRKIFNQWLPVIVSQLAGSVTGIVTGMYFAKWLGAER
          ||||||||||||||||||||||||||||||||||||||||||||||||||||||||||||
a226      AAQFIDFWLKPAVVVLAVPLYQNRRKIFNQWLPVIVSQLAGSVTGIVTGMYFAKWLGAER
                  70         80         90        100        110        120

130        140        150        160        170        180
m226.pep  EVVLSLASKSVTNPIAIEITRSIGGIPAITAATVIIAGLVGQIAGYKMLKNTVVMPSSVG
          ||||||||||:|||||||||||||||||||||||||||||||||||||||||||||||||
a226      EVVLSLASKSVINPIAIEITRSIGGIPAITAATVIIAGLVGQIAGYKMLKNTVVMPSSVG
                 130        140        150        160        170        180

190        200        210        220        230
m226.pep  MSLGTASHAMGIAASLERSRRMAAYAGLGLTFNGVLTALIAPLLIPVLGFX
          ||||||||||||||||||||||||||||||||||||||||||||||||||
a226      MSLGTASHAMGIAASLERSRRMAAYAGLGLTFNGVLTALIAPLLIPVLGFX
                 190        200        210        220        230
```

The following partial DNA sequence was identified in *N. gonorrhoeae* <SEQ ID 811>:

```
g227.seq
  1   atgaacatca tccgcgcgct cctcatcatc ctcggctgcc tcgccgccgg 51   cgaaaccgcc gttttcctag caggcatcaa actgcccggc agcatcgtcg 101   gcatgggcgt gctgtttgcg cttttgcagg cgggttggct caaaacgtct 151   tggctgcaac agcttaccga cgcgctgatg gcaaacctga cgctgttcct 201   cgtgccgccc tgcgtggcgg tcatcagcta tttggatttg attgccgacg 251   attggttttc gatactggtt tccgcctccg ccagcacttt gtgcgtactg 301   ctggttacgg gcaaggttca ccgctggata cggagcatta tctga
```

This corresponds to the amino acid sequence <SEQ ID 812; ORF 227.ng>:

```
g227.pep
  1   MNIIRALLII LGCLAAGETA VFLAGIKLPG SIVGMGVLFA LLQAGWLKTS

51   WLQQLTDALM ANLTLFLVPP CVAVISYLDL IADDWFSILV SASASTLCVL

101   LVTGKVHRWI RSII*
```

The following partial DNA sequence was identified in *N. meningitidis* <SEQ ID 813>:

```
m227.seq (partial)
    1    ..ACGTCTTkGC TGCAACAGCT TACCGACGCG CTGATGTCGA ACCTGACGCT 51    GTtCCTCGTG CCgCC.TGCG TGGCGGTCAT CAGCTATTTG GATTTGATTG 101    CCGACGATTG GTTTTCGATA CTGGTTTCCG CCTCCGCCAG cACTTTGTGC

151    GTACTGCTGG TTACGGGCAA AGTCCACCGG TGGATACGGG GTATTATCCG

201    ATGA
```

This corresponds to the amino acid sequence <SEQ ID 814; ORF 227>:

```
m227.pep (partial)
    1    ..TSXLQQLTDA LMSNLTLFLV PPCVAVISYL DLIADDWFSI LVSASASTLC

51    VLLVTGKVHR WIRGIIR*
```

Computer analysis of this amino acid sequence gave the following results:
Homology with a Predicted ORF from *N. gonorrhoeae*
ORF 227 shows 95.5% identity over a 66 aa overlap with a predicted ORF (ORF 227.ng) from *N. gonorrhoeae*:

```
m227/g227
                                              10         20         30
   m227.pep                           TSXLQQLTDALMSNLTLFLVPPCVAVISYL
                                      || ||||||||:|||||||||||||||||
   g227     TAVFLAGIKLPGSIVGMGVLFALLQAGWLKTSWLQQLTDALMANLTLFLVPPCVAVISYL
            20        30        40        50        60        70
                  40        50        60
   m227.pep  DLIADDWFSILVSASASTLCVLLVTGKVHRWIRGIIRX
            ||||||||||||||||||||||||||||||||||:|||
   g227     DLIADDWFSILVSASASTLCVLLVTGKVHRWIRSIIX
            80        90       100       110
```

The following partial DNA sequence was identified in *N. meningitidis* <SEQ ID 815>:

```
a227.seq
    1    ATGAACATCA TCCGCGCGCT CCTCATCATC CTCGGCTGCC TCGCCACCGG

51    CGAAACCGCC GTTTTCCTAG CAGGCATCAA ACTGCCCGGC AGCATCGTCG

101    GCATGGGCGT ACTGTTTGCG CTTTTGCAGG CGGGTTGGGT CAAAACGTCT

151    TGGCTGCAAC AGCTTACCGA CGCGCTGATG GCGAATCTGA CGTTGTTTCT

201    CGTGCCGCCC TGCGTGGCGG TCATCAGCTA TTTGGATTTG ATTGCCGACG

251    ATTGGTTTTC GATACTGGTT TCCGCCTCCG CCAGCACTTT GTGCGTACTG

301    CTGGTTACAG GCAAGGTTCA CCGCTGGATA CGGAGCATTA TCTGA
```

This corresponds to the amino acid sequence <SEQ ID 816; ORF 227.a>:

```
a227.pep
    1    MNIIRALLII LGCLATGETA VFLAGIKLPG SIVGMGVLFA LLQAGWVKTS

51    WLQQLTDALM ANLTLFLVPP CVAVISYLDL IADDWFSILV SASASTLCVL

101    LVTGKVHRWI RSII*
``` m227/a227 95.5% identity in 66 aa overlap

```
                                     10        20        30
    m227.pep                   TSXLQQLTDALMSNLTLFLVPPCVAVISYL
                               || ||||||||:|||||||||||||||||
    a227     TAVFLAGIKLPGSIVGMGVLFALLQAGWVKTSWLQQLTDALMANLTLFLVPPCVAVISYL
              20        30        40        50        60        70
                    40        50        60
    m227.pep  DLIADDWFSILVSASASTLCVLLVTGKVHRWIRGIIRX
              ||||||||||||||||||||||||||||||||:|||
    a227      DLIADDWFSILVSASASTLCVLLVTGKVHRWIRSIIX
              80        90       100       110
```

The following partial DNA sequence was identified in *N. meningitidis* <SEQ ID 817>:

```
m228.seq
    1   ATGAAAAAAT TATTGATTGC CGCAATGATG GCGGCTGCCT TGGCAGCTTG
   51   TTCGCAAGAA GCCAAACAGG AGGTTAAGGA AGCGGTTCAA GCCGTTGAGT
  101   CCGATGTTAA AGACACTGCG GCTTCTGCCG CCGAGTCTGC CGCTTCTGCC
  151   GTCGAAGAAG CGAAAGACCA AGTCAAAGAT GCTGCGGCTG ATGCAAAGGC
  201   AAGTGCCGAG GAAGCTGTAA CTGAAGCCAA AGAAGCTGTA ACTGAAGCAG
  251   CTAAAGATAC TTTGAACAAA GCTGCCGACG CGACTCAGGA AGCGGCAGAC
  301   AAAATGAAAG ATGCCGCCAA ATAA
```

This corresponds to the amino acid sequence <SEQ ID 818; ORF 228>:

```
m228.pep
    1   MKKLLIAAMM AAALAACSQE AKQEVKEAVQ AVESDVKDTA ASAAESAASA
   51   VEEAKDQVKD AAADAKASAE EAVTEAKEAV TEAAKDTLNK AADATQEAAD
  101   KMKDAAK*
```

Computer analysis of this amino acid sequence gave the following results:

The following partial DNA sequence was identified in *N. meningitidis* <SEQ ID 819>:

```
a228.seq
    1   ATGAAAAAAT TATTGATTGC CGCAATGATG GCGGCTGCCT TGGCAGCTTG
   51   TTCGCAAGAA GCCAAACAGG AGGTTAAGGA AGCGGTTCAA GCCGTTGAGT
  101   CCGATGTTAA AGACACTGCG GCTTCTGCCG CCGAGTCTGC CGCTTCTGCC
  151   GTCGAAGAAG CGAAAGACCA AGTCAAAGAT GCTGCGGCTG ATGCAAAGGC
  201   AAGTGCCGAG GAAGCTGTAA CTGAAGCCAA AGAAGCTGTA ACTGAAGCAG
  251   CTAAAGATAC TTTGAACAAA GCTGCCGACG CGACTCAGGA AGCGGCAGAC
  301   AAAATGAAAG ATGCCGCCAA ATAA
```

This corresponds to the amino acid sequence <SEQ ID 820; ORF 228.a>:

```
a228.pep
    1   MKKLLIAAMM AAALAACSQE AKQEVKEAVQ AVESDVKDTA ASAAESAASA
   51   VEEAKDQVKD AAADAKASAE EAVTEAKEAV TEAAKDTLNK AADATQEAAD
  101   KMKDAAK*
``` m228/a228 100.0% identity in 107 aa overlap

```
              10        20        30        40        50        60
m228.pep  MKKLLIAAMMAAALAACSQEAKQEVKEAVQAVESDVKDTAASAAESAASAVEEAKDQVKD
          ||||||||||||||||||||||||||||||||||||||||||||||||||||||||||||
a228      MKKLLIAAMMAAALAACSQEAKQEVKEAVQAVESDVKDTAASAAESAASAVEEAKDQVKD
              10        20        30        40        50        60

70        80        90        100
m228.pep  AAADAKASAEEAVTEAKEAVTEAAKDTLNKAADATQEAADKMKDAAKX
          ||||||||||||||||||||||||||||||||||||||||||||||||
a228      AAADAKASAEEAVTEAKEAVTEAAKDTLNKAADATQEAADKMKDAAKX
              70        80        90        100
```

The following partial DNA sequence was identified in *N. gonorrhoeae* <SEQ ID 821>:

```
g229.seq
    1   atggctgccg tatcgggcgg cggtgcggtc ttcctgataa tgcttccaca
   51   tattgcccgc gttcagcgtc agccgccagc gttcgcccaa gcgtcgggag
  101   aaatcggcat tgaagccgcc ggcgaaattg tatcggctgc cgcccaagag
  151   gttttgcccg acaaacggca cggtgccgaa cgagcgcgtt accgaacggt
  201   tttgatggcc gaacgacagg cgcaggttct gttcgctgaa atctttgtta
  251   tcccaataat gcacgccgcg gctgatgccg ccgtagagga aatgatgccc
  301   gcccgcattg atttcgcgcg acacgcccaa gccgtagcgc aaaccgtgtg
  351   ccttttgcgg caggctgtcg gcggttttcg tccagcttct gcccgcaaat
  401   tcaatcgttt tttcggacga agcgttgttt atagcggatt aacaaaaatc
  451   aggacaaggc ggcgggccgc aggcagtacg gatggtacgg aaccggttcg
  501   cccggtgctt ggacgcctta gggaaccgtt cctttgagc cggggcgggg
  551   caacccgtac cggttttgt tcatccgcca tattgtgttg a
```

This corresponds to the amino acid sequence <SEQ ID 822; ORF 229.ng>:

```
g229.pep
    1   MAAVSGGGAV FLIMLPHIAR VQRQPPAFAQ ASGEIGIEAA GEIVSAAAQE
   51   VLPDKRHGAE RARYRTVLMA ERQAQVLFAE IFVIPIMHAA ADAAVEEMMP
  101   ARIDFARHAQ AVAQTVCLLR QAVGGFRPAS ARKFNRFFGR SVVYSGLTKI
  151   RTRRRAAGST DGTEPVRPVL GRLREPFPLS RGGATRTGFC SSAILC*
```

The following partial DNA sequence was identified in *N. meningitidis* <SEQ ID 823>:

```
m229.seq (partial)
    1   ..GCTCAAGCGT TGGGAGAAAT CGGCATTGAA GCCGCCGACG AAATTGTATC
   51      GGCTGCCGCC TAAGAGGTTT TGCTCGACAA ACGGCACGAT GCCGAACGAG
  101      CGCGTTACCG AACGGTTTTT ATAGCCGAAC GACAGGCGCA GGCTCTGTTC
  151      GCTGAAATCT TTGTTATCCC AATAATGCAC GCCGCCGCCG CTGATGCCGC
  201      CGTAGAGGAA ATGATGCCTG CCCGCATTGA TTTCGCGCGA CACGCCTAAG
  251      CCCTAGCGCA AACCGTGTGC CTTTTGCGGC AGGCTGTCGG CGGTTTTCGT
  301      CCAGCTTCTG CCCGCAAATT CAATCGTTTT TTCGGACGAA GCGTTGTTTA
  351      TAGCGGATTA ACAAAAATCA GGACAAGGCA ACGAAGCCGC AGACAGTACA
```

```
                            -continued
401     AATAGTACGG AACCGATTCA CTTGGTGCTT CAGCACcTTA GAGAATCGTT

451     CTCTTTTTTG TTCATCCGCT ATATTGTGTT GA
```

This corresponds to the amino acid sequence <SEQ ID 824; ORF 229>:

```
m229.pep (partial)
    1   ..AQALGEIGIE AADEIVSAAA XEVLLDKRHD AERARYRTVF IAERQAQALF

51     AEIFVIPIMH AAAADAAVEE MMPARIDFAR HAXALAQTVC LLRQAVGGFR

101     PASARKFNRF FGRSVVYSGL TKIRTRQRSA DSTNSTEPIH LVLQHLRESR

151     SLFCSSAILC *
```

Computer analysis or this amino acid sequence gave the following results:
Homology with a Predicted ORF from *N. gonorrhoeae*
ORF 229 shows 80.5% identity over a 169 aa overlap with a predicted ORF (ORF 229.ng) from *N. gonorrhoeae*:

```
    m229/g209

10         20         30
    m229.pep                        AQALGEIGIEAADEIVSAAAXEVLLDKRHDAE
                                    ||| ||||||||| |||||||  ||| ||||  ||
    g229     MAAVSGGGAVFLIMLPHIARVQRQPPAFAQASGEIGIEAAGSIVSAAAQEVLPDKRHGAE
                 10        20        30        40        50        60

40         50         60         70         80         90
    m229.pep  RARYRTVFIAERQAQALFAEIFVIPIMHAAAADAAVEEMMPARIDFARHAXALAQTVCLL
              |||||||::||||||:||||||||||||||||| |||||||||||||||||| :||||||
    g229      RARYRTVLMAERQAQVLFAEIFVIPIMHAAA-DAAVEEMMPARIDFARHAQAVAQTVCLL
                  70        80        90        100       110

100        110        120        130        140
    m229.pep  RQAVGGFRPASARKFNRFFGRSVVYSGLTKIRTRQRSADSTNSTEPIHLVLQHLRE----
              |||||||||||||||||||||||||||||||||||:|:| ||::|||:: || :|||
    g229      RQAVGGFRPASARKFNRFFGRSVVYSGLTKIRTRRRAAGSTDGTEPVRPVLGRLREPFPL
                 120        130        140        150        160        170

150        160
    m229.pep  -----SRSLFCSSAILCX
                   :|: ||||||||
    g229       SRGGATRTGFCSSAILC
                180       190
```

The following partial DNA sequence was identified in *N. meningitidis* <SEQ ID 825>:

```
a229.seq (partial)
    1   ATGGCTGTCG TATCGGGCGG CGGTGCGGTC TTCCTGATAA CGCTTCCACA

51   TATTGCCCAC GTTCAGCGTC AGCCGCCA.. GTTCGCTCAA GCGTCGGGAG

101   AAATCGGCAT TGAAGCCGCC GACGAAATTG TATCGGCTGC CGCCTAAGAG

151   GTTTTGCTCG ATAAACGGCA CGATGCCGAA TGAGCGCGTT ACTGAACGGT

201   TTTTATAGCC GAGCGACAGG CGCAGGCTCT GTTCGCTGAA ATCTTTGTTA

251   TCCTAATAGT GCACGCCGCC GCCGCTGATG TCTCCGTAGA GGAAATGATG

301   CCCGCCCGCA TTGATTTCGC GCGACACGCC CAAGCCGTAG CGCAAACCGT

351   GTGCCTTTTG CGGCAGGCTG TCGGCGGTTT TCGTCCAGCT TCTGCCTGCA

401   AATTCAATCG TTTTTTCGGA CGAAGCGTTG TTTATAGCGG ATTAACAAAA

451   ATCAGGACAA GGCGACGAAG CGCAGACAGT ACAGATAGTA CGGAACCGAT

501   TCACTTGGTG CTTCAGCACC TTAGAGAATC GTCTCTTTGA GCTAAGGCGA

551   GGCAACGCCG TACTGGTTTT TGTTCATCCA CTATA
```

This corresponds to the amino acid sequence <SEQ ID 826; ORF 229.a>:

```
a229.pep (partial)
    1  MAVVSGGGAV FLITLPHIAH VQRQPPXFAQ ASGEIGIEAA DEIVSAAA*E

51  VLLDKRHDAE *ARY*TVFIA ERQAQALFAE IFVILIVHAA AADVSVEEMM

101  PARIDFARHA QAVAQTVCLL RQAVGGFRPA SACKFNRFFG RSVVYSGLTK

151  IRTRRRSADS TDSTEPIHLV LQHLRESSL* AKARQRRTGF CSSTI
``` m229/n229 85.6% identity in 167 aa overlap

```
                                      10         20         30
   m229.pep                    AQALGEIGIEAADEIVSAAAXEVLLDKRHDAE
                               |||  |||||||||||||||||||||||||||
   a229     MAVVSGGGAVFLITLPHIAHVQRQPPXFAQASGEIGIEAADEIVSAAAXEVLLDKRHDAE
                    10        20        30        40        50        60
                 40        50        60        70        80        90
   m229.pep  RARYRTVFIAERQAQALFAEIFVIPIMHAAAADAAVEEMMPARIDFARHAXALAQTVCLL
             |||  ||||||||||||||||||||||| :|||||: :||||||||||||||| :||||||
   a229      XARYXTVFIAERQAQALFAEIFVILIVHAAAADVSVEEMMPARIDFARHAQAVAQTVCLL
                    70        80        90       100       110       120
                100       110       120       130       140      149
   m229.pep  RQAVGGFRPASARKFNRFFGRSVVYSGLTKIRTRQRSADSTNSTEPIHLVLQHLRES---
             ||||||||||| |||||||||||||||||||||||:||||||:|||||||||||||||
   a229      RQAVGGFRPASACKFNRFFGRSVVYSGLTKIRTRRRSADSTDSTEPIHLVLQHLRESSLX
                   130       140       150       160       170       180
                150        160
   m229.pep  ------RSLFCSSAILCX
                   |: ||||:|
   a229      AKARQRRTGFCSSTI
                   190
```

The following partial DNA sequence was identified in *N. gonorrhoeae* <SEQ ID 827>:

```
g230.seq
    1  atgttccatt ccatcgaaaa atacagaaca cccgcccaag tcttattagg 51  cctgattgca ttaacttttg tcggcttcgg cgtcagcacg gtttcccatc 101  cgggcgccga ctacatcgtc caagtgggcg acgaaaaaat cagcgagcac 151  tcaatcaaca acgccatgca gaacgagcag gcggacggcg gcagcccttg 201  gcgcgacgcg gtgttccaat ccctgctgca acgcgcctac ctgaaacagg 251  gcgcgaagct gatgggcatt tcggtttctt ccgaacaaat caagcagatg 301  attgtggacg atcccaattt ccacgacgca aacggcaaat tcagtcacgc 351  gcttttgagt caatacctgt cgcaacgcca tatgtctgaa gaccagtttg 401  tcgaagaaat ccgcgatcag tttgccttgc agaatttggt aagcctcgtc 451  caaaacggcg tattggtcgg cgacgcgcag gcggaacagc tgatcaggct 501  gacgcaggtc aaccgcacca tccgttcgca cactttcaac cccgacgagt 551  tcatcgccca agtcaaagcg tctgaagccg atttgcagaa attttataat 601  gcgaacaaaa aagactatct gctgccgcag gcggtcaaat tggaatatgt 651  cgccttgaat ctgaaggatt ttgcagacaa gcagaccgtc agtgaaacgg 701  aagtgaaaaa tgcgtttgaa gagcgcgtgg cgcgtttgcc ggcacatgaa 751  gccaaaccct ctttcgagca ggaaaaagcc gccgtcgaaa cgaattgaa 801  aatgaaaaag gcggttgccg acttcaacaa ggcaaagaa aagctgggcg 851  acgatgcgtt caatcatccc tcctcgcttg ccgaagccgc caaaaacagc
```

```
-continued
 901  ggtttgaaag tggaaaccca agaaacttgg ctgagcaggc aggacgcaca 951  aatgtccggc atgcccgaaa acctaatcaa tgccgtattc agcgacgacg 1001  tattgaagaa aaaacacaat tccgaagtgc tgaccatcaa cagcgaaacc 1051  gcgtgggtcg tccgcgccaa agaagtccgc gaagaaaaaa acctactgtt 1101  tgaagaagcc aaagatgcgg tgcgtcaggc ctatatccgt accgaagccg 1151  ccaaactttt gaaaacaatg taa
```

This corresponds to the amino acid sequence <SEQ ID 828; ORF 230.ng>:

```
g230.pep
    1  MFHSIEKYRT PAQVLLGLIA LTFVGFGVSTV SHPGADYIV QVGDEKISEH

51  SINNAMQNEQ ADGGSPWRDA VFQSLLQRAY LKQGAKLMGI SVSSEQIKQM

101  IVDDPNFHDA NGKFSHALLS QYLSQRHMSE DQFVEEIRDQ FALQNLVSLV

151  QNGVLVGDAQ AEQLIRLTQV NRTIRSHTFN PDEFIAQVKA SEADLQKFYN

201  ANKKDYLLPQ AVKLEYVALN LKDFADKQTV SETEVKNAFE ERVARLPAHE

251  AKPSFEQEKA AVENELKMKK AVADFNKAKE KLGDDAFNHP SSLAEAAKNS

301  GLKVETQETW LSRQDAQMSG MPENLINAVF SDDVLKKKHN SEVLTINSET

351  AWVVRAKEVR EEKNLLFEEA KDAVRQAYIR TEAAKLLKTM *
```

The following partial DNA sequence was identified in *N. meningitidis* <SEQ ID 829>:

```
m230.seq (partial)
    1  ATGTTCCATT CCATCGAAAA ATACAGAACG CCCGCCCAAG TCCTTTTGGG

51  CCTGATTGCA TTAACCTTCG TCGGCTTCGG GGTCAGCACG GTATCCCATC

101  CGGGTGCCGA CTACATCGTC CAAGTGGGCG ACGAAAAAaT CAGCGACCAC

151  TCCATCAACA ACGCCATACA GAACGAACAG GCGGACGGCG GCGGCCCTTC

201  GCc.GACGCG GTGTTCCAAT CCCTGCTGCA ACGCGCCTAC CTGAAACAGG

251  GCGCGAAGCT GATGGGCATT TCGGTTTCTT CCGAACAAAT CAAGCAAATT

301  ATCGTGGACG ATCCCAATTT CCACGACGCA AACGGCAAAT TCGACCACGC

351  GCTTTTAAAC CGCTACCTTT CCCAACGCCA TATGTCTGAA GACCAGTTTG

401  TCGAAGAAAT CCGCGATCAG TTTGCCTTGC AGAATTTGGT AAACCTCGTC

451  CAAAACGGCG TATTGGTCGG CGACGCGCAG GCGGAACAGC TGATCAGGCT

501  GACACAGGTC AACCGCACCA TCCGTTCGCA CACTTTCAAC CCCGACGAGT

551  TCATCGCCCA AGTCAAAGTG TCTGAAGCCG ATTTGCAGAA ATTTTATAAT

601  GCGAACAAAA AAGACTATCT GCTGCCGCAG gCGGTCAAAT TGGAATATGT

651  CGCCTTGAAT CTGAAGGATT TTGCAGACAA GCAGACCGTC AGTGAAACGg

701  AAGTGAAAAA TGCATTTGAA GAGCGCGTGG CGCGTTTGCC GGCAAATGAA

751  GCCAAACCTT CTTTCGAGCA GGAAAAAGCC GCCGTCGAAA ACGAATTGAA

801  AATGAAAAAG GCGGTTGCCG ACTTCAACAA GGCAAAAGAA AAATTGGGCG

851  ACGATGC.GT cAACCATCCT TCyTCGCTTG CCGAAGCCGC CAAAAACAGC

901  GGTTTGAAAG TCGAAACCCA AGAAACTTGG CTGAGTAGGC AGGACGCGCA

951  AATGTCCGGT ATGCCCGAAA ACCTGATCAA TGCCGTATTC AGCGACGACG
```

```
-continued
1001  TATTGAAGAA AAAACACAAT TCCGAAGTGC TGACCATCAA CAGCGAAACC

1051  GCGTGGGTCG TCCGCGCCAA AGAAGTCCGC GAAGAGAAAA CCCTGCCGTT

1101  TGCCGAAGCC AAAGACGCGG TACGTCAGGC TTATATCCGT ACCGAAGCCG

1151  CCAAACTT.. ...
```

This corresponds to the amino acid sequence <SEQ ID 830; ORF 230>:

```
m230.pep (partial)
    1  MFHSIEKYRT PAQVLLGLIA LTFVGFGVST VSHPGADYIV QVGDEKISDH

51  SINNAIQNEQ ADGGGPSPDA VFQSLLQRAY LKQGAKLMGI SVSSEQIKQI

101  IVDDPNFHDA NGKFDHALLN RYLSQRHMSE DQFVEEIRDQ FALQNLVNLV

151  QNGVLVGDAQ AEQLIRLTQV NRTIRSHTFN PDEFIAQVKV SEADLQKFYN

201  ANKKDYLLPQ AVKLEYVALN LKDFADKQTV SETEVKNAFE ERVARLPANE

251  AKPSFEQEKA AVENELKMKK AVADFNKAKE KLGDDAVNHP SSLAEAAKNS

301  GLKVETQETW LSRQDAQMSG MPENLINAVF SDDVLKKKHN SEVLTINSET

351  AWVVRAKEVR EEKTLPFAEA KDAVRQAYIR TEAAKL....
```

Computer analysis of this amino acid sequence gave the following results:
Homology with a Predicted ORF from *N. gonorrhoeae*
ORF 230 shows 95.9% identity over a 386 aa overlap with a predicted ORF (ORF 230.ng) from *N. gonorrhoeae*:

```
m230/g230
                     10         20         30         40         50         60
       m230.pep  MFHSIEKYRTPAQVLLGLIALTFVGFGVSTVSHPGADYIVQVGDEKISDHSINNAIQNEQ
                 ||||||||||||||||||||||||||||||||||||||||||||||:||||||:||||
       g230      MFHSIEKYRTPAQVLLGLIALTFVGFGVSTVSHPGADYIVQVGDEKISEHSINNAMQNEQ
                     10         20         30         40         50         60

70         80         90        100        110        120
       m230.pep  ADGGGPSPDAVFQSLLQRAYLKQGAKLMGISVSSEQIKQIIVDDPNFHDANGKFDHALLN
                 ||||:|||||||||||||||||||||||||||||||||||:|||||||||||||:||||:
       g230      ADGGSPWRDAVFQSLLQRAYLKQGAKLMGISVSSEQIKQMIVDDPNFHDANGKFSHALLS
                     70         80         90        100        110        120

130        140        150        160        170        180
       m230.pep  RYLSQRHMSEDQFVEEIRDQFALQNLVNLVQNGVLVGDAQAEQLIRLTQVNRTIRSHTFN
                 :|||||||||||||||||||||||||||:|||||||||||||||||||||||||||||
       g230      QYLSQRHMSEDQFVEEIRDQFALQNLVSLVQNGVLVGDAQAEQLIRLTQVNRTIRSHTFN
                    130        140        150        160        170        180

190        200        210        220        230        240
       m230.pep  PDEFIAQVKVSEADLQKFYNANKKDYLLPQAVKLEYVALNLKDFADKQTVSETEVKNAFE
                 ||||||||:|||||||||||||||||||||||||||||||||||||||||||||||||
       g230      PDEFIAQVKASEADLQKFYNANKKDYLLPQAVKLEYVALNLKDFADKQTVSETEVKNAFE
                    190        200        210        220        230        240

250        260        270        280        290        300
       m230.pep  ERVARLPANEAKPSFEQEKAAVENELKMKKAVADFNKAKEKLGDDAVNHPSSLAEAAKNS
                 ||||||||:|||||||||||||||||||||||||||||||||||||:|||||||||||
       g230      ERVARLPAHEAKPSFEQEKAAVENELKMKKAVADFNKAKEKLGDDAFNHPSSLAEAAKNS
                    250        260        270        280        290        300

310        320        330        340        350        360
       m230.pep  GLKVETQETWLSRQDAQMSGMPENLINAVFSDDVLKKKHNSEVLTINSETAWVVRAKEVR
                 ||||||||||||||||||||||||||||||||||||||||||||||||||||||||||||
       g230      GLKVETQETWLSRQDAQMSGMPENLINAVFSDDVLKKKHNSEVLTINSETAWVVRAKEVR
                    310        320        330        340        350        360

370        380
       m230.pep  EEKTLPFAEAKDAVRQAYIRTEAAKL
                 |||:|  |||||||||||||||||||
       g230      EEKNLLFEEAKDAVRQAYIRTEAAKLLKTM
                    370        380        390
```

The following partial DNA sequence was identified in *N. meningitidis* <SEQ ID 831>:

a230.seq (partial)
```
   1 ATGTTCCATT CCATCGAAAA ATACAGAACG CCCGCCCAAG TCCTTTTGGG
  51 CCTGATTGCA TTAACCTTCG TCGGCTTCGG GGTCAGCACG GTATCCCATC
 101 CGGGTGCCGA CTACATCGTC CAAGTGGGCG ACGAAAAAAT CAGCGACCAC
 151 TCCATCAACA ACGCCATACA GAACGAACAG GCGGACGGCG GCGGCCCTTC
 201 GCGCGACGCG GTGTTCCAAT CCCTGCTACA ACGCGCCTAC CTGAAACAGG
 251 GCGCGAAGCT GATGGGCATT TCGGTTTCTT CCGAACAAAT CAAGCAGATT
 301 ATCGTGGACG ATCCCAATTT CCACGACGCA AACGGCAAAT TCGACCACGC
 351 GCTTTTAAAC CGCTACCTTT CCCAACGTCA TATGTCTGAA GACCAGTTTG
 401 TCGAAGAAAT CCGCGATCAG TTTGCCTTGC AGAATTTGGT AAACCTCGTC
 451 CAAAACGGCG TATTGGTCGG CGACGCGCAG GCGGAACAGC TGATCAGGCT
 501 GACGCAGGTC AACCGCACCA TCCGTTCGCA CACTTTCAAC CCCGACGAAT
 551 TCATCGCCCA AGTCAAAGTG TCTGAAGCCG ATTTGCAGAA GTTTTATAAC
 601 GCAAACAAAA AAGACTACCT GCTTCCCAAA GCGGTCAAAT TGGAATATGT
 651 CGCCTTGAAT CTGAAAGACT TTGCAGACAA ACAGACCGTC AGCGAAACAG
 701 AAGTGAAAAA TGCGTTTGAA GAGCGCGTGG CGCGTTTGCC GGCAAATGAA
 751 GCCAAACCTT CTTTCGAGCA GGAAAAAGCC GCCGTCGAAA ACGAATTGAA
 801 AATGAAAAAG GCGGTTGCCG ACTTCAATAA GGCAAAAGAA AAGCTGGGCG
 851 ATGACGCGTT CAACCATCCT TCCTCGCTTG CCGAAGCCGC CAAAAACAGC
 901 GGTTTGAAAG TCGAAACCCA AGAAACTTGG CTGAGCAGGC AGGATGCGCA
 951 AATGTCCGGT ATGCCCGAAA ACCTGATCAA TGCCGTATTC AGCGACGACG
1001 TATTGAAGAA AAAACACAAT TCCGAAGTGC TGACCATCAA CAGCGAAACC
1051 GCGTGGGTCG TCCGCGCCAA AGAAGTCCGC GAAGAGAAAA CCCTGCCGTT
1101 TGCCGAAGCC AAAGACGCGG TACGTCAGGC TTATATCCGT ACCGAAGCCG
1151 CCAAACTT
```

This corresponds to the amino acid sequence <SEQ ID 832;
ORF 230.a>:

a230.pep (partial)
```
   1 MFHSIEKYRT PAQVLLGLIA LTFVGFGVST VSHPGADYIV QVGDEKISDH
  51 SINNAIQNEQ ADGGGPSRDA VFQSLLQRAY LKQGAKLMGI SVSSEQIKQI
 101 IVDDPNFHDA NGKFDHALLN RYLSQRHMSE DQFVEEIRDQ FALQNLVNLV
 151 QNGVLVGDAQ AEQLIRLTQV NRTIRSHTFN PDEFIAQVKV SEADLQKFYN
 201 ANKKDYLLPK AVKLEYVALN LKDFADKQTV SETEVKNAFE ERVARLPANE
 251 AKPSFEQEKA AVENELKMKK AVADFNKAKE KLGDDAFNHP SSLAEAAKNS
 301 GLKVETQETW LSRQDAQMSG MPENLINAVF SDDVLKKKHN SEVLTINSET
 351 AWVVRAKEVR EEKTLPFAEA KDAVRQAYIR TEAAKL
``` m230/a230 99.2% identity in 386 aa overlap

```
                10         20         30         40         50         60
  m230.pep  MFHSIEKYRTPAQVLLGLIALTFVGFGVSTVSHPGADYIVQVGDEKISDHSINNAIQNEQ
            ||||||||||||||||||||||||||||||||||||||||||||||||||||||||||||
      a230  MFHSIEKYRTPAQVLLGLIALTFVGFGVSTVSHPGADYIVQVGDEKISDHSINNAIQNEQ
                10         20         30         40         50         60
```

```
                70        80        90       100       110       120
m230.pep    ADGGGPSPDAVFQSLLQRAYLKQGAKLMGISVSSEQIKQIIVDDPNFHDANGKFDHALLN
            ||||||||||||||||||||||||||||||||||||||||||||||||||||||||||||
a230        ADGGGPSPDAVFQSLLQRAYLKQGAKLMGISVSSEQIKQIIVDDPNFHDANGKFDHALLN
                70        80        90       100       110       120

130       140       150       160       170       180
m230.pep    RYLSQRHMSEDQFVEEIRDQFALQNLVNLVQNGVLVGDAQAEQLIRLTQVNRTIRSHTFN
            ||||||||||||||||||||||||||||||||||||||||||||||||||||||||||||
a230        RYLSQRHMSEDQFVEEIRDQFALQNLVNLVQNGVLVGDAQAEQLIRLTQVNRTIRSHTFN
               130       140       150       160       170       180

190       200       210       220       230       240
m230.pep    PDEFIAQVKVSEADLQKFYNANKKDYLLPQAVKLEYVALNLKDFADKQTVSETEVKNAFE
            |||||||||||||||||||||||||||||||:||||||||||||||||||||||||||||
a230        PDEFIAQVKVSEADLQKFYNANKKDYLLPKAVKLEYVALNLKDFADKQTVSETEVKNAFE
               190       200       210       220       230       240

250       260       270       280       290       300
m230.pep    ERVARLPANEAKPSFEQEKAAVENELKMKKAVADFNKAKEKLGDDAVNHPSSLAEAAKNS
            ||||||||||||||||||||||||||||||||||||||||||||||| ||||||||||||
a230        ERVARLPANEAKPSFEQEKAAVENELKMKKAVADFNKAKEKLGDDAFNHPSSLAEAAKNS
               250       260       270       280       290       300

310       320       330       340       350       360
m230.pep    GLKVETQETWLSRQDAQMSGMPENLINAVFSDDVLKKKHNSEVLTINSETAWVVRAKEVR
            ||||||||||||||||||||||||||||||||||||||||||||||||||||||||||||
a230        GLKVETQETWLSRQDAQMSGMPENLINAVFSDDVLKKKHNSEVLTINSETAWVVRAKEVR
               310       320       330       340       350       360

370       380
m230.pep    EEKTLPFAEAKDAVRQAYIRTEAAKL
            ||||||||||||||||||||||||||
a230        EEKTLPFAEAKDAVRQAYIRTEAAKL
               370       380
```

The following partial DNA sequence was identified in *N. gonorrhoeae* <SEQ ID 833>:

```
g230-1.seq
      1    ATGTTCCATT CCATCGAAAA ATACAGAACA CCCGCCCAAG TCTTATTAGG

51    CCTGATTGCA TTAACTTTTG TCGGCTTCGG CGTCAGCACG GTTTCCCATC

101    CGGGCGCCGA CTACATCGTC CAAGTGGGCG ACGAAAAAAT CAGCGAGCAC

151    TCAATCAACA ACGCCATGCA GAACGAGCAG GCGGACGGCG GCAGCCCTTG

201    GCGCGACGCG GTGTTCCAAT CCCTGCTGCA ACGCGCCTAC CTGAAACAGG

251    GCGCGAAGCT GATGGGCATT TCGGTTTCTT CCGAACAAAT CAAGCAGATG

301    ATTGTGGACG ATCCCAATTT CCACGACGCA AACGGCAAAT TCAGTCACGC

351    GCTTTTGAGT CAATACCTGT CGCAACGCCA TATGTCTGAA GACCAGTTTG

401    TCGAAGAAAT CCGCGATCAG TTTGCCTTGC AGAATTTGGT AAGCCTCGTC

451    CAAAACGGCG TATTGGTCGG CGACGCGCAG GCGGAACAGC TGATCAGGCT

501    GACGCAGGTC AACCGCACCA TCCGTTCGCA CACTTTCAAC CCCGACGAGT

551    TCATCGCCCA AGTCAAAGCG TCTGAAGCCG ATTTGCAGAA ATTTTATAAT

601    GCGAACAAAA AAGACTATCT GCTGCCGCAG GCGGTCAAAT TGGAATATGT

651    CGCCTTGAAT CTGAAGGATT TTGCAGACAA GCAGACCGTC AGTGAAACGG

701    AAGTGAAAAA TGCGTTTGAA GAGCGCGTGG CGCGTTTGCC GGCACATGAA

751    GCCAAACCTT CTTTCGAGCA GGAAAAAGCC GCCGTCGAAA ACGAATTGAA

801    AATGAAAAAG GCGGTTGCCG ACTTCAACAA GGCAAAAGAA AAGCTGGGCG

851    ACGATGCGTT CAATCATCCC TCCTCGCTTG CCGAAGCCGC CAAAAACAGC

901    GGTTTGAAAG TGGAAACCCA AGAAACTTGG CTGAGCAGGC AGGACGCACA

951    AATGTCCGGC ATGCCCGAAA ACCTAATCAA TGCCGTATTC AGCGACGACG

1001    TATTGAAGAA AAAACACAAT TCCGAAGTGC TGACCATCAA CAGCGAAACC
```

```
                            -continued
1051    GCGTGGGTCG TCCGCGCCAA AGAAGTCCGC GAAGAAAAAA ACCTACTGTT

1101    TGAAGAAGCC AAAGATGCGG TGCGTCAGGC CTATATCCGT ACCGAAGCCG

1151    CCAAACTTGC CGAAAACAAG GCAAAAGAAG TGCTTACCCA ACTGAACGGC

1201    GGCAAGGCAG TTGACGTGAA ATGGTCGGAA GTGTCCGTTT TGGGCGCGCA

1251    GCAGGCAAGG CAGTCCATGC CGCCCGAGGC TTATGCGGAA CTGCTGAAAG

1301    CAAAACCGGC AAACGGCAAA CCCGCCTATG TCAGACTGAC CGGTCTGCCG

1351    GCACCCGTGA TTGTCGAGGC GCAGGCAGTC ACGCCTCCGG AGGATATTGC

1401    CGCACAGCTT CCTCCTGCGA AACAGGCTTT GGCGCAACAG CAGTCTGCCA

1451    ATACTTTCGA CCTGCTGATC CGCTATTTCA ACGGAAAAAT CAAACAGACT

1501    AAAGGAGCAC AATCGGTTGA CAACGGCGAT GGTCAGTAA
```

This corresponds to the amino acid sequence <SEQ ID 834; ORF 230-1.ng>:

```
g230-1.pep
    1   MFHSIEKYRT PAQVLLGLIA LTFVGFGVST VSHPGADYIV QVGDEKISEH

51   SINNAMQNEQ ADGGSPWRDA VFQSLLQRAY LKQGAKLMGI SVSSEQIKQM

101   IVDDPNFHDA NGKFSHALLS QYLSQRHMSE DQFVEEIRDQ FALQNLVSLV

151   QNGVLVGDAQ AEQLIRLTQV NRTIRSHTFN PDEFIAQVKA SEADLQKFYN

201   ANKKDYLLPQ AVKLEYVALN LKDFADKQTV SETEVKNAFE ERVARLPAHE

251   AKPSFEQEKA AVENELKMKK AVADFNKAKE KLGDDAFNHP SSLAEAAKNS

301   GLKVETQETW LSRQDAQMSG MPENLINAVF SDDVLKKKHN SEVLTINSET

351   AWVVRAKEVR EEKNLLFEEA KDAVRQAYIR TEAAKLAENK AKEVLTQLNG

401   GKAVDVKWSE VSVLGAQQAR QSMPPEAYAE LLKAKPANGK PAYVRLTGLP

451   APVIVEAQAV TPPEDIAAQL PPAKQALAQQ QSANTFDLLI RYFNGKIKQT

501   KGAQSVDNGD GQ*
```
                                                     40
The following partial DNA sequence was identified in *N. meningitidis* <SEQ ID 835>:

```
m230-1.seq
    1   ATGTTCCATT CCATCGAAAA ATACAGAACG CCCGCCCAAG TCCTTTTGGG

51   CCTGATTGCA TTAACCTTCG TCGGCTTCGG GGTCAGCACG GTATCCCATC

101   CGGGTGCCGA CTACATCGTC CAAGTGGGCG ACGAAAAAAT CAGCGACCAC

151   TCCATCAACA ACGCCATACA GAACGAACAG GCGGACGGCG GCGGCCCTTC

201   GCGCGACGCG GTGTTCCAAT CCCTGCTGCA ACGCGCCTAC CTGAAACAGG

251   GCGCGAAGCT GATGGGCATT TCGGTTTCTT CCGAACAAAT CAAGCAAATT

301   ATCGTGGACG ATCCCAATTT CCACGACGCA AACGGCAAAT TCGACCACGC

351   GCTTTTAAAC CGCTACCTTT CCCAACGCCA TATGTCTGAA GACCAGTTTG

401   TCGAAGAAAT CCGCGATCAG TTTGCCTTGC AGAATTTGGT AAACCTCGTC

451   CAAAACGGCG TATTGGTCGG CGACGCGCAG GCGGAACAGC TGATCAGGCT

501   GACACAGGTC AACCGCACCA TCCGTTCGCA CACTTTCAAC CCCGACGAGT

551   TCATCGCCCA AGTCAAAGTG TCTGAAGCCG ATTTGCAGAA ATTTTATAAT

601   GCGAACAAAA AAGACTATCT GCTGCCGCAG GCGGTCAAAT TGGAATATGT
```

```
 651    CGCCTTGAAT CTGAAGGATT TTGCAGACAA GCAGACCGTC AGTGAAACGG

701    AAGTGAAAAA TGCATTTGAA GAGCGCGTGG CGCGTTTGCC GGCAAATGAA

751    GCCAAACCTT CTTTCGAGCA GGAAAAAGCC GCCGTCGAAA ACGAATTGAA

801    AATGAAAAAG GCGGTTGCCG ACTTCAACAA GGCAAAAGAA AAATTGGGCG

851    ACGATGCGTT CAACCATCCT TCCTCGCTTG CCGAAGCCGC CAAAAACAGC

901    GGTTTGAAAG TCGAAACCCA AGAACTTGGC TGAGTAGGCA GGACGCGCA

951    AATGTCCGGT ATGCCCGAAA ACCTGATCAA TGCCGTATTC AGCGACGACG

1001    TATTGAAGAA AAAACACAAT TCCGAAGTGC TGACCATCAA CAGCGAAACC

1051    GCGTGGGTCG TCCGCGCCAA AGAAGTCCGC GAAGAGAAAA CCCTGCCGTT

1101    TGCCGAAGCC AAAGACGCGG TACGTCAGGC TTATATCCGT ACCGAAGCCG

1151    CCAAACTTGC CGAAAACAAG GCAAAAGACG TGCTTACCCA ACTGAACGGC

1201    GGCAAGGCTG TTGACGTGAA ATGGTCGGAA GTGTCCGTTT TGGGCGCACA

1251    GCAGGCAAGG CAGTCCATGC CGCCCGAGGC TTATGCGGAA CTGCTGAAAG

1301    CAAAACCGGC AAACGGCAAA CCCGCCTACG TCAGGCTGAT CGGTCTGCCG

1351    GCACCCGTGA TTGTCGAAGT ACAGGCTGTA ACCCCGCCGG ATGATATCGC

1401    CGCACAGCTT CCGCTTGCAA ACAGGCTTT GGCGCAACAG CAGTCTGCCA

1451    ATACTTTCGA CTTGTTGATA CGTTATTTCA ACGGCAAAAT CAAACAGACC

1501    AAAGGAGCGC AATCGGTCGA CAACGGCGAC GGTCAGTAA
```

This corresponds to the amino acid sequence <SEQ ID 836;
ORF 230-1>:

```
m230-1.pep
      1    MFHSIEKYRT PAQVLLGLIA LTFVGFGVST VSHPGADYIV QVGDEKISDH

51    SINNAIQNEQ ADGGGPSRDA VFQSLLQRAY LKQGAKLMGI SVSSEQIKQI

101    IVDDPNFHDA NGKFDHALLN RYLSQRHMSE DQFVEEIRDQ FALQNLVNLV

151    QNGVLVGDAQ AEQLIRLTQV NRTIRSHTFN PDEFIAQVKV SEADLQKFYN

201    ANKKDYLLPQ AVKLEYVALN LKDFADKQTV SETEVKNAFE ERVARLPANE

251    AKPSFEQEKA AVENELKMKK AVADFNKAKE KLGDDAFNHP SSLAEAAKNS

301    GLKVETQETW LSRQDAQMSG MPENLINAVF SDDVLKKKHN SEVLTINSET

351    AWVVRAKEVR EEKTLPFAEA KDAVRQAYIR TEAAKLAENK AKDVLTQLNG

401    GKAVDVKWSE VSVLGAQQAR QSMPPEAYAE LLKAKPANGK PAYVRLIGLP

451    APVIVEVQAV TPPDDIAAQL PLAKQALAQQ QSANTFDLLI RYFNGKIKQT

501    KGAQSVDNGD GQ*
``` m230-1/g230-1 96.3% identity in 512 aa overlap

```
                  10         20         30         40         50         60
m230-1.pep  MFHSIEKYRTPAQVLLGLIALTFVGFGVSTVSHPGADYIVQVGDEKISDHSINNAIQNEQ
            ||||||||||||||||||||||||||||||||||||||||||||||||||:||||:||||
g230-1      MFHSIEKYRTPAQVLLGLIALTFVGFGVSTVSHPGADYIVQVGDEKISEHSINNAMQNEQ
                  10         20         30         40         50         60

70         80         90        100        110        120
m230-1.pep  ADGGGPSRDAVFQSLLQRAYLKQGAKLMGISVSSEQIKQIIVDDPNFHDANGKFDHALLN
            ||||:|||||||||||||||||||||||||||||||||||:|||||||||||||:||||:
g230-1      ADGGGPSRDAVFQSLLQRAYLKQGAKLMGISVSSEQIKQMIVDDPNFHDANGKFSHALLS
                  70         80         90        100        110        120
```

```
                   130        140        150        160        170        180
m230-1.pep  RYLSQRHMSEDQFVEEIRDQFALQNLVNLVQNGVLVGDAQAEQLIRLTQVNRTIRSHTFN
            :|||||||||||||||||||||||||||||::|||||||||||||||||||||||||||
g230-1      QYLSQRHMSEDQFVEEIRDQFALQNLVSLVQNGVLVGDAQAEQLIRLTQVNRTIRSHTFN
                   130        140        150        160        170        180

190        200        210        220        230        240
m230-1.pep  PDEFIAQVKVSEADLQKFYNANKKDYLLPQAVKLEYVALNLKDFADKQTVSETEVKNAFE
            ||||||||||:|||||||||||||||||||||||||||||||||||||||||||||||||
g230-1      PDEFIAQVKASEADLQKFYNANKKDYLLPQAVKLEYVALNLKDFADKQTVSETEVKNAFE
                   190        200        210        220        230        240

250        260        270        280        290        300
m230-1.pep  ERVARLPANEAKPSFEQEKAAVENELKMKKAVADFNKAKEKLGDDAFNHPSSLAEAAKNS
            |||||||||:||||||||||||||||||||||||||||||||||||||||||||||||||
g230-1      ERVARLPAHEAKPSFEQEKAAVENELKMKKAVADFNKAKEKLGDDAFNHPSSLAEAAKNS
                   250        260        270        280        290        300

310        320        330        340        350        360
m230-1.pep  GLKVETQETWLSRQDAQMSGMPENLINAVFSDDVLKKKHNSEVLTINSETAWVVRAKEVR
            ||||||||||||||||||||||||||||||||||||||||||||||||||||||||||||
g230-1      GLKVETQETWLSRQDAQMSGMPENLINAVFSDDVLKKKHNSEVLTINSETAWVVRAKEVR
                   310        320        330        340        350        360

370        380        390        400        410        420
m230-1.pep  EEKTLPFAEAKDAVRQAYIRTEAAKLAENKAKDVLTQLNGGKAVDVKWSEVSVLGAQQAR
            |||: | |||||||||||||||||||||||||:|||||||||||||||||||||||||||
g230-1      EEKNLLFEEAKDAVRQAYIRTEAAKLAENKAKEVLTQLNGGKAVDVKWSEVSVLGAQQAR
                   370        380        390        400        410        420

430        440        450        460        470        480
m230-1.pep  QSMPPEAYAELLKAKPANGKPAYVRLIGLPAPVIVEVQAVTPPDDIAAQLPLAKQALAQQ
            |||||||||||||||||||||||||| |||||||||:||||||:|||||:|||||||||
g230-1      QSMPPEAYAELLKAKPANGKPAYVRLTGLPAPVIVEAQAVTPPEDIAAQLPPAKQALAQQ
                   430        440        450        460        470        480

490        500        510
m230-1.pep  QSANTFDLLIRYFNGKIKQTKGAQSVDNGDGQX
            ||||||||||||||||||||||||||||||||
g230-1      QSANTFDLLIRYFNGKIKQTKGAQSVDNGDGQX
                   490        500        510
```

The following partial DNA sequence was identified in *N. meningitidis* <SEQ ID 837>:

```
a230-1.seq
     1     ATGTTCCATT CCATCGAAAA ATACAGAACG CCCGCCCAAG TCCTTTTGGG

51     CCTGATTGCA TTAACCTTCG TCGGCTTCGG GGTCAGCACG GTATCCCATC

101     CGGGTGCCGA CTACATCGTC CAAGTGGGCG ACGAAAAAAT CAGCGACCAC

151     TCCATCAACA ACGCCATACA GAACGAACAG GCGGACGGCG GCGGCCCTTC

201     GCGCGACGCG GTGTTCCAAT CCCTGCTACA ACGCGCCTAC CTGAAACAGG

251     GCGCGAAGCT GATGGGCATT TCGGTTTCTT CCGAACAAAT CAAGCAGATT

301     ATCGTGGACG ATCCCAATTT CCACGACGCA AACGGCAAAT TCGACCACGC

351     GCTTTTAAAC CGCTACCTTT CCCAACGTCA TATGTCTGAA GACCAGTTTG

401     TCGAAGAAAT CCGCGATCAG TTTGCCTTGC AGAATTTGGT AAACCTCGTC

451     CAAAACGGCG TATTGGTCGG CGACGCGCAG GCGGAACAGC TGATCAGGCT

501     GACGCAGGTC AACCGCACCA TCCGTTCGCA CACTTTCAAC CCCGACGAAT

551     TCATCGCCCA AGTCAAAGTG TCTGAAGCCG ATTTGCAGAA GTTTTATAAC

601     GCAAACAAAA AAGACTACCT GCTTCCCAAA GCGGTCAAAT TGGAATATGT

651     CGCCTTGAAT CTGAAAGACT TTGCAGACAA ACAGACCGTC AGCGAAACAG

701     AAGTGAAAAA TGCGTTTGAA GAGCGCGTGG CGCGTTTGCC GGCAAATGAA

751     GCCAAACCTT CTTTCGAGCA GGAAAAAGCC GCCGTCGAAA ACGAATTGAA

801     AATGAAAAAG GCGGTTGCCG ACTTCAATAA GGCAAAAGAA AAGCTGGGCG

851     ATGACGCGTT CAACCATCCT TCCTCGCTTG CCGAAGCCGC CAAAAACAGC

901     GGTTTGAAAG TCGAAACCCA AGAAACTTGG CTGAGCAGGC AGGATGCGCA
```

-continued

```
 951   AATGTCCGGT ATGCCCGAAA ACCTGATCAA TGCCGTATTC AGCGACGACG
1001   TATTGAAGAA AAAACACAAT TCCGAAGTGC TGACCATCAA CAGCGAAACC
1051   GCGTGGGTCG TCCGCGCCAA AGAAGTCCGC GAAGAGAAAA CCCTGCCGTT
1101   TGCCGAAGCC AAAGACGCGG TACGTCAGGC TTATATCCGT ACCGAAGCCG
1151   CCAAACTTGC CGAAAACAAG GCAAAAGACG TGCTTACCCA ACTGAACGGC
1201   GGCAAGGCTG TTGACGTGAA ATGGTCGGAA GTGTCCGTTT TGGGCGCACA
1251   GCAGGCAAGG CAGTCCATGC CGCCCGAGGC TTATGCGGAA CTGCTGAAAG
1301   CAAAACCGGC AAACGGCAAA CCCGCCTACG TCAGGCTGAT CGGTCTGCCG
1351   GCACCCGTGA TTGTCGAAGT ACAGGCTGTA ACCCCGCCGG ATGATATCGC
1401   CGCACAGCTT CCGCTTGCAA AACAGGCTTT GGCGCAACAG CAGTCTGCCA
1451   ATACTTTCGA CTTGTTGATA CGTTATTTCA ACGGCAAAAT CAAACAGACC
1501   AAAGGAGCGC AATCGGTCGA CAACGGCGAC GGTCAGTAA
```

This corresponds to the amino acid sequence <SEQ ID 838; ORF 230-1.a>:

```
a230-1.pep
    1   MFHSIEKYRT PAQVLLGLIA LTFVGFGVST VSHPGADYIV QVGDEKISDH
   51   SINNAIQNEQ ADGGGPSRDA VFQSLLQRAY LKQGAKLMGI SVSSEQIKQI
  101   IVDDPNFHDA NGKFDHALLN RYLSQRHMSE DQFVEEIRDQ FALQNLVNLV
  151   QNGVLVGDAQ AEQLIRLTQV NRTIRSHTFN PDEFIAQVKV SEADLQKFYN
  201   ANKKDYLLPK AVKLEYVALN LKDFADKQTV SETEVKNAFE ERVARLPANE
  251   AKPSFEQEKA AVENELKMKK AVADFNKAKE KLGDDAFNHP SSLAEAAKNS
  301   GLKVETQETW LSRQDAQMSG MPENLINAVF SDDVLKKKHN SEVLTINSET
  351   AWVVRAKEVR EEKTLPFAEA KDAVRQAYIR TEAAKLAENK AKDVLTQLNG
  401   GKAVDVKWSE VSVLGAQQAR QSMPPEAYAE LLKAKPANGK PAYVRLIGLP
  451   APVIVEVQAV TPPDDIAAQL PLAKQALAQQ QSANTFDLLI RYFNGKIKQT
  501   KGAQSVDNGD GQ*
``` a230-1/m230-1 99.8% identity in 512 aa overlap

```
                  10         20         30         40         50         60
a230-1.pep  MFHSIEKYRTPAQVLLGLIALTFVGFGVSTVSHPGADYIVQVGDEKISDHSINNAIQNEQ
            ||||||||||||||||||||||||||||||||||||||||||||||||||||||||||||
m230-1      MFHSIEKYRTPAQVLLGLIALTFVGFGVSTVSHPGADYIVQVGDEKISDHSINNAIQNEQ
                  10         20         30         40         50         60

70         80         90        100        110        120
a230-1.pep  ADGGGPSRDAVFQSLLQRAYLKQGAKLMGISVSSEQIKQIIVDDPNFHDANGKFDHALLN
            ||||||||||||||||||||||||||||||||||||||||||||||||||||||||||||
m230-1      ADGGGPSRDAVFQSLLQRAYLKQGAKLMGISVSSEQIKQIIVDDPNFHDANGKFDHALLN
                  70         80         90        100        110        120

130        140        150        160        170        180
a230-1.pep  RYLSQRHMSEDQFVEEIRDQFALQNLVNLVQNGVLVGDAQAEQLIRLTQVNRTIRSHTFN
            ||||||||||||||||||||||||||||||||||||||||||||||||||||||||||||
m230-1      RYLSQRHMSEDQFVEEIRDQFALQNLVNLVQNGVLVGDAQAEQLIRLTQVNRTIRSHTFN
                 130        140        150        160        170        180

190        200        210        220        230        240
a230-1.pep  PDEFIAQVKVSEADLQKFYNANKKDYLLPKAVKLEYVALNLKDFADKQTVSETEVKNAFE
            ||||||||||||||||||||||||||||||:||||||||||||||||||||||||||||
m230-1      PDEFIAQVKVSEADLQKFYNANKKDYLLPQAVKLEYVALNLKDFADKQTVSETEVKNAFE
                 190        200        210        220        230        240
```

-continued

```
              250        260        270        280        290        300
a230-1.pep    ERVARLPANEAKPSFEQEKAAVENELKMKKAVADFNKAKEKLGDDAFNHPSSLAEAAKNS
              ||||||||||||||||||||||||||||||||||||||||||||||||||||||||||||
m230-1        ERVARLPANEAKPSFEQEKAAVENELKMKKAVADFNKAKEKLGDDAFNHPSSLAEAAKNS
              250        260        270        280        290        300

310        320        330        340        350        360
a230-1.pep    GLKVETQETWLSRQDAQMSGMPENLINAVFSDDVLKKKHNSEVLTINSETAWVVWRAKEVR
              ||||||||||||||||||||||||||||||||||||||||||||||||||||||||||||
m230-1        GLKVETQETWLSRQDAQMSGMPENLINAVFSDDVLKKKHNSEVLTINSETAWVVWRAKEVR
              310        320        330        340        350        360

370        380        390        400        410        420
a230-1.pep    EEKTLPFAEAKDAVRQAYIRTEAAKLAENKAKDVLTQLNGGKAVDVKWSEVSVLGAQQAR
              |||||||||||||||||||||||||||||||||||||||||||||||||||||||||||
m230-1        EEKTLPFAEAKDAVRQAYIRTEAAKLAENKAKDVLTQLNGGKAVDVKWSEVSVLGAQQAR
              370        380        390        400        410        420

430        440        450        460        470        480
a230-1.pep    QSMPPEAYAELLKAKPANGKPAYVRLIGLPAPVIVEVQAVTPPDDIAAQLPLAKQALAQQ
              |||||||||||||||||||||||||||||||||||||||||||||||||||||||||||
m230-1        QSMPPEAYAELLKAKPANGKPAYVRLIGLPAPVIVEVQAVTPPDDIAAQLPLAKQALAQQ
              430        440        450        460        470        480

490        500        510
a230-1.pep    QSANTFDLLIRYFNGKIKQTKGAQSVDNGDGQX
              ||||||||||||||||||||||||||||||||
m230-1        QSANTFDLLIRYFNGKIKQTKGAQSVDNGDGQX
              490        500        510
```

The following partial DNA sequence was identified in *N. gonorrhoeae* <SEQ ID 839>:

```
g231.seq
   1    atgtcaaaac gaaaatccat aaaccgtccg tatcaaaaac cggcggaact 51    gccgccgttg caaataatc cgccatttta ccgtaaaaac cgccgcctga 101    acttttttat cgcggcagac ggcggttgcg cgtctccgca aaaatgcagg 151    gcgcgcggtt ttcagacggc atttgccgtt caaggccgtg cggtgtcttt 201    accaaatgcc caaccattcg cccacggaat ccatccaatc cttattgccc 251    ccgccgctcc tgcctgcccg gcggtacgcc cacggcgctt gcggattttt 301    agctttccac aatcctttgc gttccctttc cgcctgaatt tgagcgtcgg 351    catagtcggc aaaatccgcc ttatcctgct gttctttagc ataacttttta 401    taatgccacg ccgccccgtc ctgcacctgc atcaggttca atcggtttt 451    gccggcggat acctgcgcca cttcgcgctg atagcggtcg gtttcaaaca 501    cacgtacact gactttccta ccctccgccg ccgcgcgcag gttgtcgcgc 551    gaacgtgtac cgtaagcctg tttcatctcc ggtgcgtcga tatacgccat 601    ccgaatttta tgtttcgcgc cgtcgccgtc gatgacgtga agggtatcgc 651    cgtcatagac tttggacacc gtgcctgtgt agctgtggcc ggatttcgcc 701    gatgcccgtc ggcgaacggg cgcgtcgaaa cccacgtccc ctgcagtgcc 751    gagtacgtcg agtacggcaa ccgccgtccg caccgcctca ctgtcatatc 801    ccgtataacc caacgcgccc aaaagcgaca gggcgacggg aagccatttc 851    atgatttttt taatctgcat attttcaaa tgccgatgcc gtctgaacat 901    ctctga
```

This corresponds to the amino acid sequence <SEQ ID 840; ORF 231.ng>:

```
g231.pep
   1    MSKRKSINRP YQKPAELPPL QNNPPFYRKN RRLNFFIAAD GGCASPQKCR

51    ARGFQTAFAV QGRAVSLPNA QPFAHGIHPI LIAPAAPACP AVRPRRLRIF
```

-continued

```
101  SFPQSFAFPF RLNLSVGIVG KIRLILLFFS ITFIMPRRPV LHLHQVQIGF

151  AGGYLRHFAL IAVGFKHTYT DFPTLRRRAQ VVARTCTVSL FHLRCVDIRH

201  PNFMFRAVAV DDVKGIAVID FGHRACVAVA GFRRCPSANG RVETHVPCSA

251  EYVEYGNRRP HRLTVISRIT QRAQKRQGDG KPFHDFFNLH IFQMPMPSEH

301  L*
```

The following partial DNA sequence was identified in *N. meningitidis* <SEQ ID 841>:

```
m231.seq (partial)
    1  ATGTCAAAAC GAAATCCAT AAACCGTCCG TATCAAAAAC CGGCGGAACT

51  GCCGCCGTTG CAAATAATC CGCCATTTTA CCGTAAAAAC CGCCGCCTGA

101  ACTTTTTTAT CGCGGCAGAC GGCGGTTGCG CGTCTCCGCA AAAATGCAGG

151  GCGCGCGGTT TTCAGACGGC ATTTGCCGTT CAAAGCCGTG CGGTGTCTTT

201  ACCAAATGCC CAACCATTCG GC....
```

This corresponds to the amino acid sequence <SEQ ID 842; ORF 231>:

```
m231.pep (partial)
    1  MSKRKSINRP YQKPAELPPL QNNPPFYRKN RRLNFFIAAD GGCASPQKCR

51  ARGFQTAFAV QSRAVSLPNA QPFG.....
```

Computer analysis of this amino acid sequence gave the following results:
Homology with a Predicted ORF from *N. gonorrhoeae*
ORF 231 shows 98.6% identity over a 73 aa overlap with a predicted ORF (ORF 231.ng) from *N. gonorrhoeae*:

```
    m231/g231
                    10        20        30        40        50        60
     m231.pep  MSKRKSINRPYQKPAELPPLQNNPPFYRKNRRLNFFIAADGGCASPQKCRARGFQTAFAV
               ||||||||||||||||||||||||||||||||||||||||||||||||||||||||||||
        g231  MSKRKSINRPYQKPAELPPLQNNPPFYRKNRRLNFFIAADGGCASPQKCRARGFQTAFAV
                    10        20        30        40        50        60
                    70
     m231.pep  QSRAVSLPNAQPFG
               |:||||||||||||:
        g231  QGRAVSLPNAQPFAHGIHPILIAPAAPACPAVRPRRLRIFSFPQSFAFPFRLNLSVGIVG
                    70        80        90       100       110       120
```

The following partial DNA sequence was identified in *N. meningitidis* <SEQ ID 843>:

```
a231.seq (partial)
    1  ATGTCAAAAC GAAATCCAT AAACCGTCCG TATCAAAAAC CGGCGGAACT

51  GCCGCCGTTG CAAATAATC CGCCATTTTA CCGTAAAAAC CGCCGCCTGA

101  ACTTTTTTAT CGNGGCAGAC GGCGGTTGCG CGTCTCCGCA AAAATGCAGG

151  GCGCGCGGTT TTCAGACGGC ATTTGCCGTT CAAAGCCGTG CGGTGTCTTT

201  ACCAAATGCC CAACCATTCG CCCACGGCAT CCATCCAATC CTTATTGCCC

251  CCGCCGCTCC TGCCTGCCCG GCGGTACGCC CACGGCGCTT GCGGATTTTT

301  AGCTTTCCAC AATCCTTTGC GTTCCCTTTC CGCCTGAATT TGAGCGTCGG

351  CATAATCGGC AAAATCCGCC TTATCCTGCT GTTCTTTAGC ATAACTTTTA
```

-continued

```
401  TAATGCCACG CCGCCCCGTC CTGCACCTGC ATCAGGTTCA AATCGGTTTT

451  GCCGACAGAA ACCTGCGCCA CTTCGCGCTG GTAGCGGTCG GTGTCGAACA

501  CGCGGACGCT GACTTTCCTG CCTTCCGCCG CCGCGCGCAG GTTGTCGCGC

551  GAACGCGTGC CGTAAGCCTG TTTCATCTCC GGCGCGTCGA TATACGCCAT

601  CCGGATTTTG TGTTTCGCGC CGTCGCCGTC GATAACGTGA AGGGTGTCGC

651  CGTCATAGAC TTTGGACACC GTGCCTGTGT AGCGGTGGCC GGATTTCGCC

701  GATGCTCGGC GGCGGGCGGG CGCGTCGGAA CCCGCGTCCC CTGCCGCGCC

751  GAGTACGTCG AGTACGGCAA CCGCCGTCCG CACCGCCTCG CTGCCGTACC

801  CCGTATAACC CAACGCACCC AAAAGCGACA AGGCGACGGG AAGCCATTTC

851  ATGATTTTTT TAATCTGCAT ATTTTTCAAA TGCCGATGCC GTCTGAACAT

901  ATC
```

This corresponds to the amino acid sequence <SEQ ID 844; ORF 217.a>:

```
a231.pep (partial)
    1  MSKRKSINRP YQKPAELPPL QNNPPFYRKN RRLNFFIXAD GGCASPQKCR

51  ARGFQTAFAV QSRAVSLPNA QPFAHGIHPI LIAPAAPACP AVRPRRLRIF

101  SFPQSFAPPF RLNLSVGIIG KIRLILLFFS ITFIMPRRPV LHLHQVQIGF

151  ADRNLRHFAL VAVGVEHADA DFPAFRRRAQ VVARTRAVSL FHLRRVDIRH

201  PDFVFRAVAV DNVKGVAVID FGHRACVAVA GFRRCSAAGG RVGTRVPCRA

251  EYVEYGNRRP HRLAAVPRIT QRTQKRQGDG KPFHDFFNLH IFQMPMPSEH

301  I
``` m231/a231 98.6% identity in 73 aa overlap

```
                  10         20         30         40         50         60
    m231.pep  MSKRKSINRPYQKPAELPPLQNNPPFYRKNRRLNFFIAADGGCASPQKCRARGFQTAFAV
              ||||||||||||||||||||||||||||||||||||| |||||||||||||||||||||
    a231      MSKRKSINRPYQKPAELPPLQNNPPFYRKNRRLNFFIXADGGCASPQKCRARGFQTAFAV
                  10         20         30         40         50         60

70
    m231.pep  QSRAVSLPNAQPFG
              |||||||||||||:
    a231      QSRAVSLPNAQPFAHGIHPILIAPAAPACPAVRPRRLRIFSFPQSFAPPFRLNLSVGIIG
                  70         80         90        100        110        120
```

The following partial DNA sequence was identified in *N. gonorrhoeae* <SEQ ID 845>:

```
g231-1.seq
    1   ATGTCAAAAC GAAAATCCAT AAACCGTCCG TATCAAAAAC CGGCGGAACT

51   GCCGCCGTTG CAAAATAATC CGCCATTTTA CCGTAAAAAC CGCCGcCTGA

101   ACTTTTTTAT CGCGGCAGAC GGCGGTTGCG CGTCTCCGCA AAAATGCAGG

151   GCGCGCGGTT TTCAGACGGC ATTTGCCGTT CAAGGCCGTG CGGTGTCTTT

201   ACCAAATGCC CAACCATTCG CCCACGGAAT CCATCCAATC CTTATTGCCC

251   CCGCCGCTCC TGCCTGCCCG GCGGTACGCC CACGGCGCTT GCGGATTTTT

301   AGCTTTCCAC AATCCTTTGC GTTCCCTTTC CGCCTGAATT TGAGCGTCGG

351   CATAGTCGGC AAAATCCGCC TTATCCTGCT GTTCTTTAGC ATAACTTTTA
```

-continued

```
       401  TAATGCCACG CCGCCCCGTC CTGCACCTGC ATCAGGTTCA AATCGGTTTT

451  GCCGGCGGAT ACCTGCGCCA CTTCGCGCTG ATAGCGGTCG GTTTCAAACa

501  CaCgTaCaat gagtttcgtA ccctccGCCG ccgcgcgCAG GTTGtcgcGC

551  GAACgTGTAC CGTAagcgtg TTtcatctcc GGTGCgtcGA TATACGCCAT 601  cCgAATTTta tGTttcgcgc cgtcgcCgtc gATGACGTGA AGGGtatcGC 651  CgtcATAGAC TTTGGACACC Gtgcctgcgt AGctGTGGCC GGATttcgc
```

This corresponds to the amino acid sequence <SEQ ID 846; ORF 231-1.ng>:

```
g231-1.pep
         1  MSKRKSINRP YQKPAELPPL QNNPPFYRKN RRLNFFIAAD GGCASPQKCR

51  ARGFQTAFAV QGRAVSLPNA QPFAHGIHPI LIAPAAPACP AVRPRRLRIF

101  SFPQSFAFPF RLNLSVGIVG KIRLILLFFS ITFIMPRRPV LHLHQVQIGF

151  AGGYLRHFAL IAVGFKHTYN EFRTLRRRAQ VVARTCTVSV FHLRCVDIRH

201  PNFMFRAVAV DDVKGIAVID FGHRACVAVA GFR
```

The following partial DNA sequence was identified in *N. meningitidis* <SEQ ID 847>:

```
m231-1.seq
         1  ATGTCAAAAC GAAAATCCAT AAACCGTCCG TATCAAAAAC CGGCGGAACT

51  GCCGCCGTTG CAAAATAATC CGCCATTTTA CCGTAAAAAC CGCCGCCTGA

101  ACTTTTTTAT CGCGGCAGAC GGCGGTTGCG CGTCTCCGCA AAAATGCAGG

151  GCGCGCGGTT TTCAGACGGC ATTTGCCGTT CAAAGCCGTG CGGTGTCTTT

201  ACCAAATGCC CAACCATTCG CCCACGGCAT CCATCCAATC CTTATTGCCC

251  CCGCCGCTCC TGCCTGCTCG GCGGTACGCC CACGGCGCTT GCGGATTTTT

301  AGCTTTCCAC AATCCTTTGC GTTCCCTTTC CGCCTGAATT TGAGCGTCGG

351  CATAATCGGC AAAATCCGCC TTATCCTGCT GTTCTTTAGC ATAACTTTTA

401  TAATGCCACG CCGCCCCGTC CTGCACCTGC ATCAGGTTCA AATCGGTTTT

451  GCCGACAGAA ACCTGCGCCA CTTCGCGCTG GTAGCGGTCG GTATCGAACA

501  CGCGCACGCT GACTTTCCTG CCTTCCGCCG CCGCGCGCAG GTTGTCGCGC

551  GAACGCGTGC CGTAAGCCTG TTTCATCTCC GGCGCGTCGA TATACGCCAT

601  CCGGATTTTG TGTTTCGCGC CGTCGCCGTC GATAACGTGA AGGGTGTCGC

651  CGTCATAGAC TTTGGACACC GTGCCTGTGT AGCGGTGGCC GGATTTCGCC

701  GATGCTCGGC GGCGGGCGGG CGCGTCGGAA CCCGCGTCCC CTGCCGCGCC

751  GAGTACGTCG AGTACGGCAA CCGCCGTCCG CACCGCCTCG CTGCCGTACC

801  CCGTATAACC CAACGCACCC AAAAGCGACA GGGCGACGGG AAGCCATTTC

851  ATGATTTTTT TAATCTGCAT ATTTTTCAAA TGCCGATGCC GTCTGAACAT

901  ATCGGAATCG GATTTCAGAC GGCATCTTAA
```

This corresponds to the amino acid sequence <SEQ ID 848; ORF 231-1>:

```
m231-1.pep
     1    MSKRKSINRP YQKPAELPPL QNNPPFYRKN RRLNFFIAAD GGCASPQKCR

51    ARGFQTAFAV QSRAVSLPNA QPFAHGIHPI LIAPAAPACS AVRPRRLRIF

101    SFPQSFAFPF RLNLSVGIIG KIRLILLFFS ITFIMPRRPV LHLHQVQIGF

151    ADRNLRHFAL VAVGIEHAHA DFPAFRRRAQ VVARTRAVSL FHLRRVDIRH

201    PDFVFRAVAV DNVKGVAVID FGHRACVAVA GFRRCSAAGG RVGTRVPCRA

251    EYVEYGNRRP HRLAAVPRIT QRTQKRQGDG KPFHDFFNLH IFQMPMPSEH

301    IGIGFQTAS*
``` g231-1/m231-1 87.0% identity in 262 aa overlap

```
                      10        20        30        40        50        60
g231-1.pep    MSKRKSINRPYQKPAELPPLQNNPPFYRKNRRLNFFIAADGGCASPQKCRARGFQTAFAV
              ||||||||||||||||||||||||||||||||||||||||||||||||||||||||||||
m231-1        MSKRKSINRPYQKPAELPPLQNNPPFYRKNRRLNFFIAADGGCASPQKCRARGFQTAFAV
                      10        20        30        40        50        60

70        80        90       100       110       120
g231-1.pep    QGRAVSLPNAQPFAHGIHPILIAPAAPACPAVRPRRLRIFSFPQSFAFPFRLNLSVGIVG
              |:||||||||||||||||||||||||||| ||||||||||||||||||||||||||||:|
m231-1        QSRAVSLPNAQPFAHGIHPILIAPAAPACSAVRPRRLRIFSFPQSFAFPFRLNLSVGIIG
                      70        80        90       100       110       120

130       140       150       160       170       180
g231-1.pep    KIRLILLFFSITFIMPRRPVLHLHQVQIGFAGGYLRHFALIAVGFKHTYNEFRTLRRRAQ
              |||||||||||||||||||||||||||||||   ||||||:|||::|:: :| ::|||||
m231-1        KIRLILLFFSITFIMPRRPVLHLHQVQIGFADRNLRHFALVAVGIEHAHADFPAFRRRAQ
                     130       140       150       160       170       180

190       200       210       220       230       240
g231-1.pep    VVARTCTVSVFHLRCVDIRHPNFMFRAVAVDDVKGIAVIDFGHRACVAVAGFRXCPSANG
              ||||| :||:|||| ||||||:|:|||||||:|||:||||||||||||||||| | :|:|
m231-1        VVARTRAVSLFHLRRVDIRHPDFVFRAVAVDNVKGVAVIDFGHRACVAVAGFRRCSAAGG
                     190       200       210       220       230       240

250       260
g231-1.pep    CVETHVPCSAEYVVXGNRRPHR
               | |:||| ||||  |||||||
m231-1        RVGTRVPCRAEYVEYGNRRPHRLAAVPRITQRTQKRQGDGKPFHDFFNLHIFQMPMPSEH
                     250       260       270       280       290       300
```

The following partial DNA sequence was identified in *N. meningitidis* <SEQ ID 849>:

```
a231-1.seq
     1    ATGTCAAAAC GAAAATCCAT AAACCGTCCG TATCAAAAAC CGGCGGAACT

51    GCCGCCGTTG CAAAATAATC CGCCATTTTA CCGTAAAAAC CGCCGCCTGA

101    ACTTTTTTAT CGCGGCAGAC GGCGGTTGCG CGTCTCCGCA AAAATGCAGG

151    GCGCGCGGTT TTCAGACGGC ATTTGCCGTT CAAAGCCGTG CGGTGTCTTT

201    ACCAAATGCC CAACCATTCG CCCACGGCAT CCATCCAATC CTTATTGCCC

251    CCGCCGCTCC TGCCTGCCCG GCGGTACGCC CACGGCGCTT GCGGATTTTT

301    AGCTTTCCAC AATCCTTTGC GTTCCCTTTC CGCCTGAATT TGAGCGTCGG

351    CATAATCGGC AAAATCCGCC TTATCCTGCT GTTCTTTAGC ATAACTTTTA

401    TAATGCCACG CCGCCCCGTC CTGCACCTGC ATCAGGTTCA AATCGGTTTT

451    GCCGACAGAA ACCTGCGCCA CTTCGCGCTG GTAGCGGTCG GTGTCGAACA

501    CGCGGACGCT GACTTTCCTG CCTTCCGCCG CCGCGCGCAG GTTGTCGCGC

551    GAACGCGTGC CGTAAGCCTG TTTCATCTCC GGCGCGTCGA TATACGCCAT

601    CCGGATTTTG TGTTTCGCGC CGTCGCCGTC GATAACGTGA AGGGTGTCGC

651    CGTCATAGAC TTTGGACACC GTGCCTGTGT AGCGGTGGCC GGATTTCGCC
```

```
-continued
701   GATGCTCGGC GGCGGGCGGG CGCGTCGGAA CCCGCGTCCC CTGCCGCGCC

751   GAGTACGTCG AGTACGGCAA CCGCCGTCCG CACCGCCTCG CTGCCGTACC

801   CCGTATAACC CAACGCACCC AAAAGCGACA AGGCGACGGG AAGCCATTTC

851   ATGATTTTTT TAATCTGCAT ATTTTTCAAA TGCCGATGCC GTCTGAACAT

901   ATCGGAATCG GATTTCAGAC GGCATCTTAA
```

This corresponds to the amino acid sequence <SEQ ID 850; ORF 231-1.a>:

```
a231-1.pep
      1    MSKRKSINRP YQKPAELPPL QNNPPFYRKN RRLNFFIAAD GGCASPQKCR

51    ARGFQTAFAV QSRAVSLPNA QPFAHGIHPI LIAPAAPACP AVRPRRLRIF

101    SFPQSFAPPF RLNLSVGIIG KIRLILLFFS ITFIMPRRPV LHLHQVQIGF

151    ADRNLRHFAL VAVGVEHADA DFPAFRRRAQ VVARTRAVSL FHLRRVDIRH

201    PDFVFRAVAV DNVKGVAVID FGHRACVAVA GFRRCSAAGG RVGTRVPCRA

251    EYVEYGNRRP HRLAAVPRIT QRTQKRQGDG KPFHDFFNLH IFQMPMPSEH

301    IGIGFQTAS*
``` a231-1/m231-1 99.0% identity in 309 aa overlap

```
                  10         20         30         40         50         60
a231-1.pep    MSKRKSINRPYQKPAELPPLQNNPPFYRKNRRLNFFIAADGGCASPQKCRARGFQTAFAV
              ||||||||||||||||||||||||||||||||||||||||||||||||||||||||||||
m231-1        MSKRKSINRPYQKPAELPPLQNNPPFYRKNRRLNFFIAADGGCASPQKCRARGFQTAFAV
                  10         20         30         40         50         60

70         80         90        100        110        120
a231-1.pep    QSRAVSLPNAQPFAHGIHPILIAPAAPACPAVRPRRLRIFSFPQSFAPPFRLNLSVGIIG
              |||||||||||||||||||||||||||||| |||||||||||||||||||||||||||||
m231-1        QSRAVSLPNAQPFAHGIHPILIAPAAPACSAVRPRRLRIFSFPQSFAPPFRLNLSVGIIG
                  70         80         90        100        110        120

130        140        150        160        170        180
a231-1.pep    KIRLILLFFSITFIMPRRPVLHLHQVQIGFADRNLRHFALVAVGVEHADADFPAFRRRAQ
              |||||||||||||||||||||||||||||||||||||||||||||||:||| ||||||||
m231-1        KIRLILLFFSITFIMPRRPVLHLHQVQIGFADRNLRHFALVAVGIEHAHADFPAFRRRAQ
                 130        140        150        160        170        180

190        200        210        220        230        240
a231-1.pep    VVARTRAVSLFHLRRVDIRHPDFVFRAVAVDNVKGVAVIDFGHRACVAVAGFRRCSAAGG
              ||||||||||||||||||||||||||||||||||||||||||||||||||||||||||||
m231-1        VVARTRAVSLFHLRRVDIRHPDFVFRAVAVDNVKGVAVIDFGHRACVAVAGFRRCSAAGG
                 190        200        210        220        230        240

250        260        270        280        290        300
a231-1.pep    RVGTRVPCRAEYVEYGNRRPHRLAAVPRITQRTQKRQGDGKPFHDFFNLHIFQMPMPSEH
              ||||||||||||||||||||||||||||||||||||||||||||||||||||||||||||
m231-1        RVGTRVPCRAEYVEYGNRRPHRLAAVPRITQRTQKRQGDGKPFHDFFNLHIFQMPMPSEH
                 250        260        270        280        290        300

310
a231-1.pep    IGIGFQTASX
              ||||||||||
m231-1        IGIGFQTASX
                 310
```

The following partial DNA sequence was identified in *N. gonorrhoeae* <SEQ ID 851>:

```
g232.seq
      1    atgatgggca acagcctgat tgaatccggt acgtttgtcg ccatcctgtt 51    tggtcagatt ttgggaacgg cggttgccgg cgcgccgcct tatattgtcg 101    ggatactggt tttgctggtc gccgtcggag gaacggccgg cagcctgttt 151    atgccgtccg tacccgccaa ggctgccgat acccaaatcg agtggaatat
```

-continued

```
 201   tgtccgtggt acaaaatccc tgctgcgtga acggtgcgg  cacaatcccg 251   tttttaccgc cattatcggc atctcgtggt tttggtttgt cggcgcggtt 301   tataccacgc aactgccgac ctttacccaa atccatttgg gcggcaacga 351   taatgttttt aacctgatgc ttgctttgtt ttccatcggt attgccgccg 401   gttcggtact gtgtgccaag ttcggcaggg aacggctgat gttggcttgg 451   gtaacggttg gtgcgttggg ttcgacggtt tgcggcctgg ttttggtgtg 501   gctgacgcac ggacaccgtt ttgaagggct gaacggcatt ttttggtttt 551   tatcgcaagg atgggcatac cccgtgatgg cggtgatgac gctgatcggc 601   tttttcggcg gattttttctc cgttccgctc tatacctggc tgcaaaccgc 651   cagcagcgag actttccgcg cccgcgccgt tgccgccaac aatatcgtta 701   acggcatctt tatggtttcc gccgccgttt tgagcgcggt attgctgttt 751   ttgtttgaca gcatttccct gctgtatctg attgtcgcct tgggcaatat 801   tccgttggcg gtatttttga ttaagcgcga aaggcggttt ttaggcgcgg 851   cggcaatcag gaaaaaacct tga
```

This corresponds to the amino acid sequence <SEQ ID 852; ORF 232.ng>:

```
g232.pep
   1  MMGNSLIESG TFVAILFGQI LGTAVAGAPP YIVGILVLLV AVGGTAGSLF

51  MPSVPAKAAD TQIEWNIVRG TKSLLRETVR HNPVFTAIIG ISWFWFVGAV

101  YTTQLPTFTQ IHLGGNDNVF NLMLALFSIG IAAGSVLCAK FGRERLMLAW

151  VTVGALGSTV CGLVLVWLTH GHRFEGLNGI FWFLSQGWAY PVMAVMTLIG

201  FFGGFFSVPL YTWLQTASSE TFRARAVAAN NIVNGIFMVS AAVLSAVLLF

251  LFDSISLLYL IVALGNIPLA VFLIKRERRF LGAAAIRKKP *
```

The following partial DNA sequence was identified in *N. meningitidis* <SEQ ID 853>:

```
m232.seq
   1  ATGATGGGCA ACAGCCTGAT TGAATCGGGT ACGTTTGTCG CCATCCTGTT

51  CGGTCAGATT TTGGGAACGG CGGTGGCAGG TGTACCGCCT TATATTGTCG

101  GGATACTGGT TTTGCTGGTC GCCGTCGGAG GCACGGTCGG CAGCCTGTTT

151  ATGCCGTCCG TACCCGCCAA GGCTGCCGAT ACACAAATTG AGTGGAATAT

201  TGTCCGTGGC ACAAAATCCC TGCTGCGTGA AACGGTGCGG CACAAGCCCG

251  TTTTTACCGC CATTATCGGT ATTTCGTGGT TTTGGTTTGT CGGCGCGGTT

301  TATACCACGC AACTGCCGAC CTTTACCCAA ATCCATCTGG GCGGCAACGA

351  CAATGTTTTC AACCTGATGC TTGCTCTGTT TTCCATCGGT ATTGCCGCCG

401  GTTCGGTACT GTGTGCCAAG TTCAGCAkGG AACGCCTGAT GTTGGCTTGG

451  GTAACGGTTG GTGCGTTGGG TTTGACGGTT TGCGGCTTGG TTTTGGTGTG

501  GCTGACGCAC GGACACCGTT TTGAAGGGCT GAACGGCATT TTTTrGTTTT

551  TATCGCAAGG ATGGGCATAT CCCGTGATGG CGGTGATGAC GCTGATCGGC

601  TTTTTCGGCG GATTTTTCTC CGTTCCGCTC TATACCt(g)TG CAAACCGCCa

651  TAGCGAGaTT TCCGCGCCCg GCCGTTGCCG CCAACAATAT CGTTAACGGT
```

-continued
```
701   ATTTTTATGG TTTCCGCTGC CGTTTTGAGC GCGGTGTTGC TGTTTTTGTT

751   TGACAGCATT TCCTTGTTGT ATCTGATTGT CGCTTTGGGC AATATTCCGT

801   TGTCGGTATT TTTGATTAAG CGCGAAAGGC GGTTTTTAGG CGCGGCGGCA

851   ATCAGGAAAA AACCTTGA
```

This corresponds to the amino acid sequence <SEQ ID 854; ORF 232>:

```
m232.pep
  1   MMGNSLIESG TFVAILFGQI LGTAVAGVPP YIVGILVLLV AVGGTVGSLF

51   MPSVPAKAAD TQIEWNIVRG TKSLLRETVR HKPVFTAIIG ISWFWFVGAV

101   YTTQLPTFTQ IHLGGNDNVF NLMLALFSIG IAAGSVLCAK FSXERLMLAW

151   VTVGALGLTV CGLVLVWLTH GHRFEGLNGI FXFLSQGWAY PVMAVMTLIG

201   FFGGFFSVPL YTVQTAIARF PRPAVAANNI VNGIFMVSAA VLSAVLLFLF

251   DSISLLYLIV ALGNIPLSVF LIKRERRFLG AAAIRKKP*
```

Computer analysis of this amino acid sequence gave the following results:
Homology with a Predicted ORF from *N. gonorrhoeae*
ORF 232 shows 94.1% identity over a 290 aa overlap with a predicted ORF (ORF 232.ng) from *N. gonorrhoeae*:

```
m232/g232
                 10         20         30         40         50         60
m232.pep  MMGNSLIESGTFVAILFGQILGTAVAGVPPYIVGILVLLVAVGGTVGSLFMPSVPAKAAD
          |||||||||||||||||||||||||||||:|||||||||||||||||:|||||||||||
g232      MMGNSLIESGTFVAILFGQILGTAVAGAPPYIVGILVLLVAVGGTAGSLFMPSVPAKAAD
                 10         20         30         40         50         60

70         80         90        100        110        120
m232.pep  TQIEWNIVRGTKSLLRETVRHKPVFTAIIGISWFWFVGAVYTTQLPTFTQIHLGGNDNVF
          |||||||||||||||||||||:||||||||||||||||||||||||||||||||||||||
g232      TQIEWNIVRGTKSLLRETVRHNPVFTAIIGISWFWFVGAVYTTQLPTFTQIHLGGNDNVF
                 70         80         90        100        110        120

130        140        150        160        170        180
m232.pep  NLMLALFSIGIAAGSVLCAKFSXERLMLAWVTVGALGLTVCGLVLVWLTHGHRFEGLNGI
          ||||||||||||||||||||||: ||||||||||||||:|||||||||||||||||||||
g232      NLMLALFSIGIAAGSVLCAKFGRERLMLAWVTVGALGSTVCGLVLVWLTHGHRFEGLNGI
                130        140        150        160        170        180

190        200        210        220        230
m232.pep  FXFLSQGWAYPVMAVMTLIGFFGGFFSVPLYT-VQTAIARFPRP-AVAANNIVNGIFMVS
          | ||||||||||||||||||||||||||||||:||| :: | ||||||||||||||||||
g232      FWFLSQGWAYPVMAVMTLIGFFGGFFSVPLYTWLQTASSETFRARAVAANNIVNGIFMVS
                190        200        210        220        230        240

240        250        260        270        280        289
m232.pep  AAVLSAVLLFLFDSISLLYLIVALGNIPLSVFLIKRERRFLGAAAIRKKPX
          |||||||||||||||||||||||||||||:||||||||||||||||||||
g232      AAVLSAVLLFLFDSISLLYLIVALGNIPLAVFLIKRERRFLGAAAIRKKP
                250        260        270        280        290
```

The following partial DNA sequence was identified in *N. meningitidis* <SEQ ID 855>:

```
a232.seq
  1   ATGTACGCTA AAAAAGGCGG TTTGGGACTG GTTAAAAGCC GCCGTTTCGC

51   ACCTCTTTTC GCTACGCAGT TTCTCGGCGC GTTCAACGAC AATGTGTTCA

101   AAACCGCGCT GTTTGTGATG ATTGGGTTTT ACGGTTTGGG GCAAAACGGC

151   TTCCTGCCTG CCGGACAGAT GTTGAACTTG GGCGCGTTGC TGTTTATTTT

201   GCCGTATTTC CTGTTTTCCT CGCTGTCGGG GCAGTTGGGT AACAAATTCG

251   ACAAGGCCGT TTTGGCGCGT TGGGCCAAGG TGCTGGAAAT GATCATTATG
```

-continued

```
 301    GCGGTGGCGG CATACGGGTT TTATATCCGG TCTGCCCCGC TGCTTTTGGC
 351    GTGTCTGTTT TGCATGGGCG CGCAATCGAC GCTGTTCGGG CCGCTGAAAT
 401    ACGCCATCCT GCCCGATTAT CTCGACGACA AGAGTTGAT GATGGGCAAC
 451    AGCCTGATTG AATCGGGTAC GTTTGTCGCC ATCCTGTTCG GTCAGATACT
 501    GGGGACTGCG GTGGCAGGTG TACCGCCTTA TATTGTCGGG ATACTGGTTT
 551    TGCTGGTCGC CGTAGGAGGC ACGGTCGGCA GCCTGTTTAT GCCGTCCGTA
 601    CCCGCCAAGG CTGCCGATAC ACAAATTGAG TGGAATATTG TCCGGGGTAC
 651    AAAATCCCTG CTGCGTGAAA CGGTGCGGCA CAAGCCCGTT TTTACCGCCA
 701    TTATCGGTAT TTCGTGGTTT TGGTTTGTCG GCGCGGTTTA TACCACGCAA
 751    CTGCCGACCT TTACCCAAAT CCATCTAGGC GGCAACGACA ATGTTTTCAA
 801    CCTGATGCTT GCCCTGTTTT CCATCGGTAT TGCCGCCGGT TCGGTACTGT
 851    GTGCCAAGTT CAGCAGGGAA CGGCTGAGGT TGGCTTGGGT AACGGTTGGT
 901    GCGTTGGGTT TGACGGTTTG CGGCTTGGTT TTGGTGTGGC TGACGCACGG
 951    ACACCGTTTT GAAGGGCTGA ACGGCATTTT TTGGTTTTTA TCGCAAGGAT
1001    GGGCATATCC CGTGATGGCG GTGATGACGC TGATCGGCTT TTTCGGCGGA
1051    TTTTTCTCCG TTCCGCTCTA TACCTGGCTG CAAACCGCCA GTAGCGAGAC
1101    TTTCCGCGCC CGCGCCGTTG CCGCCAACAA TATCGTTAAC GGTATTTTTA
1151    TGGTTTCCGC TGCCGTTTTG AGCGCGGTGT TGCTGTTTTT GTTTGACAGC
1201    ATTTCCTTGT TGTATCTGAT TGTCGCTTTG GGCAATATTC CGTTGTCGGT
1251    ATTTTTGATT AAGCGCGAAA GGCGGTTTTT AGGCGCGGCG GCAATCAGGA
1301    AAAAACCTTG A
```

This corresponds to the amino acid sequence <SEQ ID 856; ORF 232.a>:

```
a232.pep
  1    MYAKKGGLGL VKSRRFAPLF ATQFLGAFND NVFKTALFVM IGFYGLGQNG

51    FLPAGQMLNL GALLFILPYF LFSSLSGQLG NKFDKAVLAR WAKVLEMIIM

101    AVAAYGFYIR SAPLLLACLF CMGAQSTLFG PLKYAILPDY LDDKELMMGN

151    SLIESGTFVA ILFGQILGTA VAGVPPYIVG ILVLLVAVGG TVGSLFMPSV

201    PAKAADTQIE WNIVRGTKSL LRETVRHKPV FTAIIGISWF WFVGAVYTTQ

251    LPTFTQIHLG GNDNVFNLML ALFSIGIAAG SVLCAKFSRE RLRLAWVTVG

301    ALGLTVCGLV LVWLTHGHRF EGLNGIFWFL SQGWAYPVMA VMTLIGFFGG

351    FFSVPLYTWL QTASSETFRA RAVAANNIVN GIFMVSAAVL SAVLLFLFDS

401    ISLLYLIVAL GNIPLSVFLI KRERRFLGAA AIRKKP*
``` m232/a232 95.9% identity in 290 aa overlap

```
                          10         20         30
m232.pep        MMGNSLIESGTFVAILFGQILGTAVAGVPP
                ||||||||||||||||||||||||||||||
a232    ACLFCMGAQSTLFGPLKYAILPDYLDDKELMMGNSLIESGTFVAILFGQILGTAVAGVPP
              120        130        140        150        160        170
```

```
                        40         50         60         70         80         90
m232.pep    YIVGILVLLVAVGGTVGSLFMPSVPAKAADTQIEWNIVRGTKSLLRETVRHKPVFTAIIG
            ||||||||||||||||||||||||||||||||||||||||||||||||||||||||||||
a232        YIVGILVLLVAVGGTVGSLFMPSVPAKAADTQIEWNIVRGTKSLLRETVRHKPVFTAIIG
                       180        190        200        210        220        230

100        110        120        130        140        150
m232.pep    ISWFWFVGAVYTTQLPTFTQIHLGGNDNVFNLMLALFSIGIAAGSVLCAKFSXERLMLAW
            |||||||||||||||||||||||||||||||||||||||||||||||||||| ||| |||
a232        ISWFWFVGAVYTTQLPTFTQIHLGGNDNVFNLMLALFSIGIAAGSVLCAKFSRERLRLAW
                       240        250        260        270        280        290

160        170        180        190        200        210
m232.pep    VTVGALGLTVCGLVLVWLTHGHRFEGLNGIFXFLSQGWAYPVMAVMTLIGFFGGFFSVPL
            |||||||||||||||||||||||||||||||| |||||||||||||||||||||||||||
a232        VTVGALGLTVCGLVLVWLTHGHRFEGLNGIFWFLSQGWAYPVMAVMTLIGFFGGFFSVPL
                       300        310        320        330        340        350

220        230        240        250        260
m232.pep    YT-VQTAIARFPRP-AVAANNIVNGIFMVSAAVLSAVLLFLFDSISLLYLIVALGNIPLS
            || :|||  ::  | ||||||||||||||||||||||||||||||||||||||||||||
a232        YTWLQTASSETFRARAVAANNIVNGIFMVSAAVLSAVLLFLFDSISLLYLIVALGNIPLS
                       360        370        380        390        400        410

270        280     289
m232.pep    VFLIKRERRFLGAAAIRKKPX
            |||||||||||||||||||||
a232        VFLIKRERRFLGAAAIRKKPX
                       420        430
```

The following partial DNA sequence was identified in *N. gonorrhoeae* <SEQ ID 857>:

```
g233.seq
    1   atgaaacgca aaaatatcgc gctgattccc gccgccggca tcggggtgcg
   51   tttcggtgcg gacaaaccca agcaatatgt cgaaatcgga agcaaaaccg
  101   ttttagaaca tgtacttggg atttttgaac ggcatgaggc cgtcgatttg
  151   accgtcgttg tcgtctcgcc cgaagacacg tttgccgata aggttcagac
  201   ggcatttcca caggttcggg tgtggaaaaa cggtggacag acccgcgccg
  251   aaactgtccg caacggtgtg gcaaaactgt tggaaaccgg tttggcggcg
  301   gaaaccgaca atattctggt acacgatgcc gcccgctgct gcctgccgtc
  351   tgaagctctg gcgcggttga tagaacaggc gggcaacgcc gccgaaggcg
  401   ggattttggc agttcccgtt gccgatacgc tcaagcgcgc agaaagcgga
  451   caaatcagtg caactgtcga ccgttcgggg ctttggcagg cgcaaacgcc
  501   gcagcttttt caagcgggtt tgctgcaccg cgcattggct gcggaaaact
  551   tgggcggcat taccgatgaa gcgtccgccg tggaaaaact gggtgtgcgt
  601   ccgctactga tacagggcga cgcgcgcaat ttgaaactga cgcagccgca
  651   ggacgcatac atcgtcaggc tgctgctcaa tgccgtctga
```

This corresponds to the amino acid sequence <SEQ ID 858; ORF 233.ng>:

```
g233.pep
    1   MKRKNIALIP AAGIGVRFGA DKPKQYVEIG SKTVLEHVLG IFERHEAVDL
   51   TVVVVSPEDT FADKVQTAFP QVRVWKNGGQ TRAETVRNGV AKLLETGLAA
  101   ETDNILVHDA ARCCLPSEAL ARLIEQAGNA AEGGILAVPV ADTLKRAESG
  151   QISATVDRSG LWQAQTPQLF QAGLLHRALA AENLGGITDE ASAVEKLGVR
  201   PLLIQGDARN LKLTQPQDAY IVRLLLNAV*
```

The following partial DNA sequence was identified in *N. meningitidis* <SEQ ID 859>:

```
m233.seq (partial)
    1   ATGAAGCGCA AAAATATCGC GCTGATTCCC GCCGCCGGCA TCGGGGCGCG

51   TTTCGGTGCG GACAAACCCA AGCAATATGT CGAAATCGGA AGCAAAACCG

101   TTTTAGAACA TACGATTGGG ATTTTTGAAC GGCATGAGGC CGTCGATTTG

151   ACCGTCGTTG TCGTCTCGCC CGAAGACACG TTTGCCGATA AGGTTCAGAC

201   GGCATTTCCA CAGGTTCGGG TGTGGAAAAA CGGCGGACAG ACCCGCGCCG

251   AAACCGTCCG CAACGGTGTG GCAAAACTGT TGGAAACCGG TTTGGCGGCG

301   GAAACCGACA ATATTCTGGT ACACGATGCC GCGCGTTGCT GCCTGCCGTC

351   TGAAGCTTTG ACGCGGTTGA TAGAACAGGC GGGCAACGCC GCCGAAGGCG

401   GGATTTTGGC AATTCCCATT GCCGATACGC TCAAGTGCGC GGACGGTGGG

451   AACATT....
```

This corresponds to the amino acid sequence <SEQ ID 860; ORF 233>:

```
m233.pep (partial)
    1   MKRKNIALIP AAGIGARFGA DKPKQYVEIG SKTVLEHTIG IFERHEAVDL

51   TVVVVSPEDT FADKVQTAFP QVRVWKNGGQ TRAETVRNGV AKLLETGLAA

101   ETDNILVHDA ARCCLPSEAL TRLIEQAGNA AEGGILAIPI ADTLKCADGG

151   NI....
```

Computer analysis of this amino acid sequence gave the following results:
Homology with a Predicted ORF from *N. gonorrhoeae*
ORF 233 shows 93.4% identity over a 152 aa overlap with a predicted ORF (ORF 233.ng) from *N. gonorrhoeae*:

```
m233/g233
                   10         20         30         40         50         60
    m233.pep  MKRKNIALIPAAGIGARFGADKPKQYVEIGSKTVLEHTIGIFERHEAVDLTVVVVSPEDT
              ||||||||||||||:|||||||||||||||||||||::|||||||||||||||||||||
    g233      MKRKNIALIPAAGIGVRFGADKPKQYVEIGSKTVLEHVLGIFERHEAVDLTVVVVSPEDT
                   10         20         30         40         50         60

70         80         90        100        110        120
    m233.pep  FADKVQTAFPQVRVWKNGGQTRAETVRNGVAKLLETGLAAETDNILVHDAARCCLPSEAL
              ||||||||||||||||||||||||||||||||||||||||||||||||||||||||||||
    g233      FADKVQTAFPQVRVWKNGGQTRAETVRNGVAKLLETGLAAETDNILVHDAARCCLPSEAL
                   70         80         90        100        110        120

130        140        150
    m233.pep  TRLIEQAGNAAEGGILAIPIADTLKCADGGNI
              :|||||||||||||||:|:|||||  |::|:|
    g233      ARLIEQAGNAAEGGILAVPVADTLKRAESGQISATVDRSGLWQAQTPQLFQAGLLHRALA
                  130        140        150        160        170        180
```

The following partial DNA sequence was identified in *N. meningitidis* <SEQ ID 861>:

```
a233.seq
    1   ATGAAGCGCA AAAATATCGC GCTGATTCCC GCCGCCGGCA TCGGGGCGCG

51   TTTCGGTGCG GACAAACCCA AGCAATATGT CGAAATCGGA AGCAAAACCG

101   TTTTAGAACA TACGATTGGG ATTTTTGAAC GGCATGAGGC CGTCGATTTG

151   ACCGTCGTTG TCGTCTCGCC CGAAGACACG TTTGCCGATA AGGTTCAGAC

201   GGCATTTCCA CAGGTTCGGG TGTGGAAAAA CGGCGGACAG ACCCGCGCCG

251   AAACTGTCCG CAACGGTGTG GCAAAATTGT TGGAAACCGG TTTGGCGGCG
```

```
 301  GAAACCGACA ATATTCTGGT ACACGATGCC GCGCGTTGCT GCCTGCCGTC

351  TGAAGCTTTG ACGCGGTTGA TAGAACAGGC GGGCAACGCT GCCGAAGGTG

401  GGATTTTGGC AATTCCCGTT GCCGATACGC TCAAGTGCGC GGACGGTGGG

451  AACATTAGTG CAACCGTCGA GCGGACGAGC CTTTGGCAGG CGCAAACGCC

501  GCAGCTTTTC CGCGCCGGGC TGCTGCACCG CGCATTGGCT GCGGAAAACT

551  TGGACGGCAT TACCGATGAA GCGTCCGCCG TGGAAAAATT GGGCATCCGC

601  CCTTTGCTGG TGCAGGGCGA CGCGCGCAAT TTGAAACTGA CGCAGCCGCA

651  GGACGCATAC ATCGTCAGGC TGCTGCTCGA TGCCGTCTGA
```

This corresponds to the amino acid sequence <SEQ ID 862; ORF 233.a>:

```
a233.pep
   1  MKRKNIALIP AAGIGARFGA DKPKQYVEIG SKTVLEHTIG IFERHEAVDL

51  TVVVVSPEDT FADKVQTAFP QVRVWKNGGQ TRAETVRNGV AKLLETGLAA

101  ETDNILVHDA ARCCLPSEAL TRLIEQAGNA AEGGILAIPV ADTLKCADGG

151  NISATVERTS LWQAQTPQLF RAGLLHRALA AENLDGITDE ASAVEKLGIR

201  PLLVQGDARN LKLTQPQDAY IVRLLLDAV*
``` m233/a233 99.3% identity in 152 aa overlap

```
                  10         20         30         40         50         60
m233.pep  MKRKNIALIPAAGIGARFGADKPKQYVEIGSKTVLEHTIGIFERHEAVDLTVVVVSPEDT
          ||||||||||||||||||||||||||||||||||||||||||||||||||||||||||||
a233      MKRKNIALIPAAGIGARFGADKPKQYVEIGSKTVLEHTIGIFERHEAVDLTVVVVSPEDT
                  10         20         30         40         50         60

70         80         90        100        110        120
m233.pep  FADKVQTAFPQVRVWKNGGQTRAETVRNGVAKLLETGLAAETDNILVHDAARCCLPSEAL
          ||||||||||||||||||||||||||||||||||||||||||||||||||||||||||||
a233      FADKVQTAFPQVRVWKNGGQTRAETVRNGVAKLLETGLAAETDNILVHDAARCCLPSEAL
                  70         80         90        100        110        120

130        140        150
m233.pep  TRLIEQAGNAAEGGILAIPIADTLKCADGGNI
          |||||||||||||||||||:||||||||||||
a233      TRLIEQAGNAAEGGILAIPVADTLKCADGGNISATVERTSLWQAQTPQLFRAGLLHRALA
                 130        140        150        160        170        180 a233      AENLDGITDEASAVEKLGIRPLLVQGDARNLKLTQPQDAYIVRLLLDAVX
                 190        200        210        220        230
```

The following partial DNA sequence was identified in *N. gonorrhoeae* <SEQ ID 863>:

```
g234.seq
   1  atgaaaaccg tttccgccgc catcgctttt gccgccgctg ccgtttcact 51  gaccggctgt gcgaccgagt cctcacgcag cctcgaggtt gcaaaagtcg 101  cctcctgcaa tacgcaatat cacggtgttc gcaccccgat ttccgtcgga 151  acattcgaca accgctccag cttccaaaaa ggcattttct ccgacagtga 201  agaccgtctg ggcagccagg caaaaaccat cctggtaaca cacctgcaac 251  aaaccaaccg cttcaacgta ctgaaccgca ccaaccttag cgcattgaaa 301  caggaatccg gcatttccgg caaagcgcag aacctgaaag cgcagattta 351  tgtcgttacc ggcgatgtaa ccgaattcgg acgcagagat gtcggcgatc 401  atcagctctt cggcattttg ggtcgcggca atcgcaaat cgcctatgca
```

```
451  aaagtggctc tgaatatcgt caacgtcaat acttccgaaa tcgtctattc 501  cacacagggc gcgggcgaat acgcactttc caaccgcgaa atcatcggtt 551  tcggcggcac ttccggctac gatgcgactt gaacggcaa agttttagac 601  ttggcaatcc gcgaagccgt cgacaacttg gttcaggctg tcgacaacgg 651  cgcatggcaa tccaaccgtt aa
```

This corresponds to the amino acid sequence <SEQ ID 864; ORF 234.ng>:

```
g234.pep
  1  MKTVSAAIAF AAAAVSLTGC ATESSRSLEV AKVASCNTQY HGVRTPISVG

51  TFDNRSSFQK GIFSDSEDRL GSQAKTILVT HLQQTNRFNV LNRTNLSALK

101  QESGISGKAQ NLKGADYVVT GDVTEFGRRD VGDHQLFGIL GRGKSQIAYA

151  KVALNIVNVN TSEIVYSTQG AGEYALSNRE IIGFGGTSGY DATLNGKVLD

201  LAIREAVDNL VQAVDNGAWQ SNR*
```

The following partial DNA sequence was identified in *N. meningitidis* <SEQ ID 865>:

```
m234.seq (partial)
  1  ...GGCGCGGGCG AATACGCACT TTCCAACCGt GAAATCATCG GTTTCGGCGG

51     CACTTCCGGC TACGATGCGA CTTTGAACGG CAAAGTTTTA GACTTGGCAA

101     TCCGCGAAGC .gTCAACAGC CTGGTTCAGG CTGTTGACAA CGGCGCATGG

151     CAACCCAACC GTTAA
```

This corresponds to the amino acid sequence <SEQ ID 866; ORF 234>:

```
m234.pep (partial)
  1  ..GAGEYALSNR EIIGFGGTSG YDATLNGKVL DLAIREAVNS LVQAVDNGAW

51     QPNR*
```

Computer analysis of this amino acid sequence gave the following results:
Homology with a Predicted ORF from *N. gonorrhoeae*
ORF 234 shows 94.4% identity over a 54 aa overlap with a predicted ORF (ORF 234.ng) from *N. gonorrhoeae*:

```
m234/g234
                                    10         20         30
    m234.pep             GAGEYALSNREIIGFGGTSGYDATLNGKVL
                         |||||||||||||||||||||||||||||
    g234     LGRGKSQIAYAKVALNIVNVNTSEIVYSTQGAGEYALSNREIIGFGGTSGYDATLNGKVL
              140       150       160       170       180       190
                     40         50
    m234.pep DLAIREAVNSLVQAVDNGAWQPNRX
             ||||||||::||||||||||| |||
    g234     DLAIREAVDNLVQAVDNGAWQSNRX
              200       210       220
```

The following partial DNA sequence was identified in *N. meningitidis* <SEQ ID 867>:

a234.seq (partial)
```
  1  AACCGCACCT ATTTGAACGC ATTAAAACAG GAATCCGGCA TTTCCGGCAA
 51  AGCGCATAAC CTGAAAGGCG CAAATTATGT CGNNACCGGC GATGTAACCG
101  AATTCGGACG CANAGATGTC GGCGATCATC AGCTCTTCGG CATTTTGGGT
151  CGCGGCAAAT CGCAAATCGC CTATGCAAAA GTGGCTCTGA ATATCGTCAA
201  CGTCAATACT TCCGAAATCG TCTATTCCGC ACAGGGCGCG GGCGAATACG
251  CACTTTCCAA CCGTGAAATC ATCGGTTTCG GCGGCACTTC CGGCTACGAT
301  GCGACTTTGA ACGGCAAAGT TTTAGACTTG GCAATCCGCG AAGCCGTCAA
351  CAGCCTGGTT CAGGCTGTTG ACAACGGCGC ATGGCAACCC AACCGTTAA
```

This corresponds to the amino acid sequence <SEQ ID 868; ORF 234.a>:

a234.pep (partial)
```
  1  NRTYLNALKQ ESGISGKAHN LKGANYVXTG DVTEFGRXDV GDHQLFGILG
 51  RGKSQIAYAK VALNIVNVNT SEIVYSAQGA GEYALSNREI IGFGGTSGYD
101  ATLNGKVLDL AIREAVNSLV QAVDNGAWQP NR*
``` m234/a234 100.0% identity in 54 aa overlap

```
                          10         20         30
m234.pep             GAGEYALSNREIIGFGGTSGYDATLNGKVL
                     |||||||||||||||||||||||||||||
a234     LGRGKSQIAYAKVALNIVNVNTSEIVYSAQGAGEYALSNREIIGFGGTSGYDATLNGKVL
             50        60        70        80        90       100
                 40        50
m234.pep  DLAIREAVNSLVQAVDNGAWQPNRX
          |||||||||||||||||||||||||
a234      DLAIREAVNSLVQAVDNGAWQPNRX
             110       120       130
```

The following partial DNA sequence was identified in *N. gonorrhoeae* <SEQ ID 869>:

g235.seq
```
  1  atgaaacctt tgattttagg gcttgccgcc gtgttggctc tgtctgcctg
 51  ccaagttcga aaagctcccg acctcgacta cacgtcattc aaagaaagca
101  aaccggcttc aattttggtg gttccgccgc tgaacgagtc gcctgatgtc
151  aacggcactt gggggatgct ggcttcgacc gccgcgccga tttccgaagc
201  cggctattac gtctttcccg ccgcagtcgt ggaggaaacc ttcaaagaaa
251  acggcttgac caatgccgcc gatattcacg ccgtccggcc ggaaaaactg
301  catcaaattt tcggcaatga tgcggttttg tacattacgg ttaccgaata
351  cggcacttca tatcaaattt tagacagcgt gacgaccgta tccgccaaag
401  cacggctggt cgattcccgc aacgggaaag agttgtggtc gggttcggcc
451  agcatccgcg aaggcagcaa caacagcaac agcggcctgt tggggcttt
501  ggtcggcgca gtggtcaatc agattgccaa cagcctgacc gaccgcggtt
551  atcaggtttc caaaaccgcc gcatacaacc tactgtcgcc ctattcccgc
601  aacggtatct tgaaaggtcc gagattcgtc gaagagcagc ccaaataa
```

This corresponds to the amino acid sequence <SEQ ID 870; ORF 235.ng>:

```
g235.pep
     1   MKPLILGLAA VLALSACQVR KAPDLDYTSF KESKPASILV VPPLNESPDV

51   NGTWGMLAST AAPISEAGYY VFPAAVVEET FKENGLTNAA DIHAVRPEKL

101   HQIFGNDAVL YITVTEYGTS YQILDSVTTV SAKARLVDSR NGKELWSGSA

151   SIREGSNNSN SGLLGALVGA VVNQIANSLT DRGYQVSKTA AYNLLSPYSR

201   NGILKGPRFV EEQPK*
```

The following partial DNA sequence was identified in *N. meningitidis* <SEQ ID 871>:

```
m235.seq
     1   ATGAAACCTT TGATTTTAGG GCTTGCCGCC GTGTTGGCGC TGTCTGCCTG

51   CCAAGTTCAA AAAGCGCCCG ATTTCGACTA CACGTCATTC AAGGAAAGCA

101   AACCGGCTTC AATTTTGGTG GTTCCGCCGC TGAACGAATC GCCCGATGTC

151   AACGGAACAT GGGGTGTACT GGCTTCGACC GCCGCGCCGC TTTCCGAAGC

201   CGGCTATTAC GTCTTCCCCG CCGCAGTCGT GGAGGAAACC TTCAAACAAA

251   ACGGCTTGAC CAATGCCGCC GATATTCACG CCGTCCGGCC GGAAAAACTG

301   CATCAGATTT TCGGCAATGA TGCGGTTTTG TACATTACGG TTACCGAATA

351   CGGCACTTCA TATCAAATTT TAGACAGCGT GACGACCGTA TCCGCCAAAG

401   CACGGCTGGT CGATTCCCGC AACGGAAAAG AGTTGTGGTC GGGTTCGGCC

451   AGCATCCGCG AAGGCAGCAA CAACAGCAAC AGCGGCCTGT TGGGGGCTTT

501   GGTCAGCGCA GTGGTCAATC AGATTGCCAA CAGCCTGACC GACCGCGGTT

551   ATCAGGTTTC CAAAACCGCC GCATACAACC TGCTGTCGCC CTATTCTCAC

601   AACGGCATCT TGAAAGGTCC GAGATTCGTT GAAGAGCAGC CCAAATAA
```

This corresponds to the amino acid sequence <SEQ ID 872; ORF 235>:

```
m235.pep
     1   MKPLILGLAA VLALSACQVQ KAPDFDYTSF KESKPASILV VPPLNESPDV

51   NGTWGVLAST AAPLSEAGYY VFPAAVVEET FKQNGLTNAA DIHAVRPEKL

101   HQIFGNDAVL YITVTEYGTS YQILDSVTTV SAKARLVDSR NGKELWSGSA

151   SIREGSNNSN SGLLGALVSA VVNQIANSLT DRGYQVSKTA AYNLLSPYSH

201   NGILKGPRFV EEQPK*
```

Computer analysis of this amino acid sequence gave the following results:

Homology with a Predicted ORF from *N. gonorrhoeae*

ORF 235 shows 96.7% identity over a 215 aa overlap with a predicted ORF (ORF 235.ng) from *N. gonorrhoeae*:

```
m235/g235
                   10        20        30        40        50        60
m235.pep   MKPLILGLAAVLALSACQVQKAPDFDYTSFKESKPASILVVPPLNESPDVNGTWGVLAST
           |||||||||||||||||||:||||:||||||||||||||||||||||||||||||:||||
g235       MKPLILGLAAVLALSACQVRKAPDLDYTSFKESKPASILVVPPLNESPDVNGTWGMLAST
                   10        20        30        40        50        60

70        80        90       100       110       120
m235.pep   AAPLSEAGYYVFPAAVVEETFKQNGLTNAADIHAVRPEKLHQIFGNDAVLYITVTEYGTS
           |||:||||||||||||||||||:|||||||||||||||||||||||||||||||||||||||
g235       AAPISEAGYYVFPAAVVEETFKENGLTNAADIHAVRPEKLHQIFGNDAVLYITVTEYGTS
                   70        80        90       100       110       120
```

-continued

```
                 130       140       150       160       170       180
m235.pep  YQILDSVTTVSAKARLVDSRNGKELWSGSASIREGSNNSNSGLLGALVSAVVNQIANSIT
          ||||||||||||||||||||||||||||||||||||||||||||||||:|||||||||||
g235      YQILDSVTTVSAKARLVDSRNGKELWSGSASIREGSNNSNSGLLGALVGAVVNQIANSIT
                 130       140       150       160       170       180

190       200       210
m235.pep  DRGYQVSKTAAYNLLSPYSHNGILKGPRFVEEQPKX
          |||||||||||||||||||:||||||||||||||||
g235      DRGYQVSKTAAYNLLSPYSRNGILKGPRFVEEQPKX
                 190       200       210
```

The following partial DNA sequence was identified in *N. meningitidis* <SEQ ID 873>:

```
a235.seq
     1  ATGAAACCTT TGATTTTAGG GCTTGCCGCC GTGTTGGCGC TGTCTGCCTG

51  CCAAGTTCAA AAAGCGCCCG ATTTCGACTA CACGTCATTC AAGGAAAGCA

101  AACCGGCTTC AATTTTGGTG GTTCCGCCGC TGAACGAATC GCCCGATGTC

151  AACGGAACAT GGGGTGTACT GGCTTCGACC GCCGCGCCGC TTTCCGAAGC

201  CGGCTATTAC GTCTTCCCCG CCGCAGTCGT GGAGGAAACC TTCAAACAAA

251  ACGGCTTGAC CAATGCCGCC GATATTCACG CCGTCCGGCC GGAAAAACTG

301  CATCAGATTT TCGGCAATGA TGCGGTTTTG TACATTACGG TTACCGAATA

351  CGGCACTTCA TATCAAATTT TAGACAGCGT GACGACCGTA TCCGCCAAAG

401  CACGGCTGGT CGATTCCCGC AACGGAAAAG AGTTGTGGTC GGGTTCGGCC

451  AGCATCCGCG AAGGCAGCAA CAACAGCAAC AGCGGCCTGT TGGGGGCTTT

501  GGTCAGCGCA GTGGTCAATC AGATTGCCAA CAGCCTGACC GACCGCGGTT

551  ATCAGGTTTC TAAAACCGCC GCATACAACC TGCTGTCGCC CTATTCTCAC

601  AACGGCATCT TGAAAGGTCC GAGATTCGTC GAAGAGCAGC CCAAATAA
```

This corresponds to the amino acid sequence <SEQ ID 874; ORF 235.a>:

```
a235.pep
     1  MKPLILGLAA VLALSACQVQ KAPDFDYTSF KESKPASILV VPPLNESPDV

51  NGTWGVLAST AAPLSEAGYY VFPAAVVEET FKQNGLTNAA DIHAVRPEKL

101  HQIFGNDAVL YITVTEYGTS YQILDSVTTV SAKARLVDSR NGKELWSGSA

151  SIREGSNNSN SGLLGALVSA VVNQIANSLT DRGYQVSKTA AYNLLSPYSH

201  NGILKGPRFV EEQPK*
```

(underlined in a235.pep: MKPLILGLAA VLALSA)

m235/a235 100.0% identity in 215 aa overlap

```
                  10        20        30        40        50        60
m235.pep  MKPLILGLAAVLALSACQVQKAPDFDYTSFKESKPASILVVPPLNESPDVNGTWGVLAST
          ||||||||||||||||||||||||||||||||||||||||||||||||||||||||||||
a235      MKPLILGLAAVLALSACQVQKAPDFDYTSFKESKPASILVVPPLNESPDVNGTWGVLAST
                  10        20        30        40        50        60

70        80        90       100       110       120
m235.pep  AAPLSEAGYYVFPAAVVEETFKQNGLTNAADIHAVRPEKLHQIFGNDAVLYITVTEYGTS
          ||||||||||||||||||||||||||||||||||||||||||||||||||||||||||||
a235      AAPLSEAGYYVFPAAVVEETFKQNGLTNAADIHAVRPEKLHQIFGNDAVLYITVTEYGTS
                  70        80        90       100       110       120

130       140       150       160       170       180
m235.pep  YQILDSVTTVSAKARLVDSRNGKELWSGSASIREGSNNSNSGLLGALVSAVVNQIANSLT
          ||||||||||||||||||||||||||||||||||||||||||||||||||||||||||||
a235      YQILDSVTTVSAKARLVDSRNGKELWSGSASIREGSNNSNSGLLGALVSAVVNQIANSLT
                 130       140       150       160       170       180
```

```
                    190        200        210
m235.pep  DRGYQVSKTAAYNLLSPYSHNGILKGPRFVEEQPKX
          |||||||||||||||||||||||||||||||||||
a235      DRGYQVSKTAAYNLLSPYSHNGILKGPRFVEEQPKX
                    190        200        210
```

The following partial DNA sequence was identified in *N. gonorrhoeae* <SEQ ID 875>:

```
g236.seq
    1  ATGGCGCGTT TCGCCTTCTC CGCCGACATT CTCCGCACAG CGTTTGCAGA
   51  CGGTTTCATA ACCTGCAACC GCGCCCACAT CGCGGGTGTA ATGCCAGCAG
  101  CGTTCGCATT TTTCGCCGTC GCTGGCTTTG GCGGCAACGG CAAGTTCATC
  151  ACCGACTTTC ACTTCTGCTT TAGACACCAG CAGGGCAAAG CGCAATTCTT
  201  CGCCCAAAGC ATTCAGATAG CCGGCCATTT CTTCCGGCGC GGTAATTTCG
  251  GCTTCCGCCT GCAAggacga accgacagTT TTGTcggcGC GCAAAGGCTC
  301  GAtagcggcg gTTACTGCTT CGCGCGCTTC GCGGATTGCC GTCCATTTTT
  351  TCACCAGTTC GGCTTCGGCT TTTTCGTTGA TGGCCGGGAA CTCGTGCCAA
  401  GTATGGAAGA GGACGCTGTC TTCTTCGCCG CCGCCGATGA TGTCCCACGC
  451  TTCTTCGCCG GTGAAGCACA AAATCGGTGC AATCAAGAGA ACCAGGCTGC
  501  GCGTGATGTG GTACAGGGCG GTTTGCGCGC TGCGGCGGGC GCGGCTGTCG
  551  GCTTTGGTGG TGTAGAGGCG GTCTTTCAGG ATGTCGAGGT AGAACGCGCC
  601  CAAGTCTTCC GAGCAGAAAG AAACAATGTC TTTCACGGCG AAGTGGAAGG
  651  CATAGCGCGG ATAGTAACCG CCTGCCAAAC GCTCTTGCAG CCGCCGCGCC
  701  AATACCAAGG CGTAGCGGTC GATTTCCACC ATATCCGCCT GTTGCACGGC
  751  ATCTTCAATC GGATTAAAGT CGCTCAAATT GGCAAAcagG AAGCTCAAGG
  801  TATTGCGGAT GCGGCGGTAG CTTTCGGTAA CGCGTTTGAG GATTTCTTTG
  851  GAAatcgCCA ATtcgccgct gTAATCGGTG GATGCCGCCC ACAGGCGCAG
  901  GATGTCCGCG CCGAATTCGT TATAGACTTC CTGCGGCGCG ACGACGTTGC
  951  CGATGGATTT CGACATTTTG CGGCCGTTTT GGTCAACCAC GAAACCGTGG
 1001  GTCAGCAGCT GTTTATACGG TGCGCGTCCC ATGGATGA
```

This corresponds to the amino acid sequence <SEQ ID 876; ORF 236.ng>:

```
g236.pep
    1  MARFAFSADI LRTAFADGFI TCNRAHIAGV MPAAFAFFAV AGFGGNGKFI
   51  TDFHFCFRHQ QGKAQFFAQS IQIAGHFFRR GNFGFRLQGR TDSFVGAQRL
  101  DSGGYCFARF ADCRPFFHQF GFGFFVDGRE LVPSMEEDAV FFAAADDVPR
  151  FFAGEAQNRC NQENQAARDV VQGGLRAAAG AAVGFGGVEA VFQDVEVERA
  201  QVFRAERNNV FHGEVEGIAR IVTACQTLLQ PPRQYQGVAV DFHHIRLLHG
  251  IFNRIKVAQI GKQEAQGIAD AAVAFGNAFE DFFGNRQFAA VIGGCRPQAQ
  301  DVRAEFVIDF LRRDDVADGF RHFAAVLVNH ETVGQQLFIR CASHG*
```

The following partial DNA sequence was identified in *N. meningitidis* <SEQ ID 877>:

```
m236.seq (partial)
    1   ..TTGCACGGAC GAACCGACGG TTTTGTCGGC GCGCAAAGGC TCGATGGCGG
   51   CGGTTACCGC TTCGCGGGCT TCGCGGATTG CCGTCCATTT TTTCACCAGT
  101   TCGGCTTCGG TTTTTTCGTT GATGGTCGGG AACTCGTGCC AAGTATGGAA
  151   GAGGACGCTG TCkTCTTCGC CGCCGCCGwT GAyGTCCCAC GCTTCTTCGC
  201   CGGTGAAGCA CAAAATCGGT GCAATCAAGA GAACCAAACT GCGTGTGATG
  251   TGATACAGGG CAGTTTGTGC GCTGCGGCGT GCATGGCTGT CTGCTTTGGT
  301   GGTGTAGAGG CGGTCTTTCA GGATGTCGAG GTAGAACGCA CCCAAGTCTT
  351   CCGAGCAGAA AGAAACArTG TCTTTTACGG CAAAGTGGaA kGCATAACGC
  401   GGATAGTAAT CGCCTGCCAG ACACTCTTGC AGCTGACGTG CCAATACCAC
  451   GGCGTAGCGG TCGATTTCCA CCATATCCGC CTGTTGCACG GCATCTTCAA
  501   TCGGATTAAA GTCGCTCAAG TTGGCAAACA AAAAGCTCAA GGTATTGCGG
  551   ATACGGCGGT AgCTTTCGGT TACGCGTTTG AGGATTTCTT TGGAAATCGC
  601   CAATTCGCCG CTGTAATCGG TAGATGCCGC CCACAGGCGC AGGATGTCTG
  651   CGCCGAATTC GTTATAAACC TCTTGCGGTG CAACGACGTT GCCGATGGAT
  701   TTCGACATTT TTTTGCCTTC GCCGTCGACA ACGAAACCAT GGGTCAGCAG
  751   CTGTTTATAC GGCGCGCGAC CCATTGA
```

This corresponds to the amino acid sequence <SEQ ID 878; ORF 236>:

```
m236.pep (partial)
    1   ..LHGRTDGFVG AQRLDGGGYR FAGFADCRPF FHQFGFGFFV DGRELVPSME
   51   EDAVXFAAAX DVPRFFAGEA QNRCNQENQT ACDVIQGSLC AAACMAVCFG
  101   GVEAVFQDVE VERTQVFRAE RNXVFYGKVE XITRIVIACQ TLLQLTCQYH
  151   GVAVDFHHIR LLHGIFNRIK VAQVGKQKAQ GIADTAVAFG YAFEDFFGNR
  201   QFAAVIGRCR PQAQDVCAEF VINLLRCNDV ADGFRHFFAF AVDNETMGQQ
  251   LFIRRATH*
```

45

Computer analysis of this amino acid sequence gave the following results:
Homology with a Predicted ORF from *N. gonorrhoeae*
ORF 236 shows 82.9% identity over a 258 aa overlap with a predicted ORF (ORF 236.ng) from *N. gonorrhoeae*:

```
m236/g236
                                            10        20        30
    m236.pep                        LHGRTDGFVGAQRLDGGGYRFAGFADCRPF
                                    |:||||:|||||||:|||  ||  ||||||||
    g236   FRHQQGKAQFFAQSIQIAGHFFRRGNFGFRLQGRTDSFVGAQRLDSGGYCFARFADCRPF
              60        70        80        90       100       110

40        50        60        70        80        90
    m236.pep   FHQFGFGFFVDGRELVPSMEEDAVXFAAAXDVPRFFAGEAQNRCNQENQTACDVIQGSLC
               ||||||||||||||||||||||||||:||||||||||||||||||||:||:|
    g236       FHQFGFGFFVDGRELVPSMEEDAVFFAAADDVPRFFAGEAQNRCNQENQAARDVVQGGLR
              120       130       140       150       160       170

100       110       120       130       140       150
    m236.pep   AAACMAVCFGGVEAVFQDVEVERTQVFRAERNXVFYGKVEXITRIVIACQTLLQLTCQYH
               |||  ||  ||||||||||||||:|||||||| ||:|:|||  |:|||||||||    ||:
    g236       AAAGAAVGFGGVEAVFQDVEVERAQVFRAERNNVFHGEVEGIARIVTACQTLLQPPRQYQ
              180       190       200       210       220       230
```

-continued

```
                   160       170       180       190       200       210
m236.pep   GVAVDFHHIRLLHGIFNRIKVAQVGKQKAQGIADTAVAFGYAFEDFFGNRQFAAVIGRCR
           |||||||||||||||||||||||:|||:||||||:||||| |||||||||||||||| ||
g236       GVAVDFHHIRLLHGIFNRIKVAQIGKQEAQGIADAAVAFGNAFEDFFGNRQFAAVIGGCR
            240       250       260       270       280       290

220       230       240       250      259
m236.pep   PQAQDVCAEFVINLLRCNDVADGFRHFFAFAVDNETMGQQLFIRRATHX
           |||||| |||||::|| :||||||||| |  |::||:||||||| |:|
g236       PQAQDVRAEFVIDFLRRDDVADGFRHFAAVLVNHETVGQQLFIRCASHG
            300       310       320       330       340
```

The following partial DNA sequence was identified in *N. meningitidis* <SEQ ID 879>:

```
a236.seq
   1  ATGGCGCGTT TCGCCTTCTC CGCCGACATT CTCTGCACAG CGTTTGCAGA

51  CGGTTTCATG GCCTGCAACC GCGCCCACAT CGCGGGTGTA GTGCCAGCAG

101  CGTTCGCATT TTTCACCATC ACTGGCTTTA GCGGCAACGG CAAGTTCGCT

151  GCCTACTTTC ACTTCTGCTT TAGACACCAG CAAAGCAAAG CGCAATTCTT

201  CGCCCAAAGC ATTCAGATAG CCGGCCATTT CTTCCGGCGC GGTAATTTCG

251  GCTTCGGCTT GCAAGGACGA ACCGACGGTT TTGTCGGCGC GCAAAGGCTC

301  GATGGCGGCG GTTACCGCTT CGCGGGCTTC GCGGATTGCC GTCCATTTTT

351  TCACCAGTTC GGCTTCGGCT TTTTCGTTGA TGGTCGGGAA CTCGTGCCAA

401  GTATGGAAAA GCACGCTGTC TTCTGCGCCG CCGCCGATGA TGTCCCACGC

451  TTCTTCGCCG GTGAAGCACA AAATCGGTGC AATCAAGAGA ACCAGGCTGC

501  GCGTGATGTG GTACAGGGCG GTTTGCGCGC TGCGGCGGGC GCGGCTGTCG

551  GCTTTGGTGG TATAGAGGCG GTCTTTCAGG ATATCGAGGT AGAACGCGCC

601  CAAGTCTTCC GAGCAGAAAG AAACCATTTC TTTCACGGCA AAGTGGAAGG

651  CATAACGCGG ATAAAAATCA CCGGCAACGC GTTCTTGCAG CCGCCTTGCC

701  AACACCAAGG CATAGCGGTC GATTTCCACC ATATCCGCCT GTTGCACGGC

751  ATCTTCAATA GGATTGAAGT CGCTCAAGTT GGCAAACAAA AAGCTCAAGG

801  TATTGCGGAT ACGGCGGTAG CTTTCGGTTA CGCGCTTGAG GATTTCTTTG

851  GAAATCGCCA ATTCGCCGCT GTAATCGGTG GATGCCGCCC ACAGGCGCAG

901  GATGTCCGCG CCGAACTCGT TATACACTTC TTGCGGCGCG ACGACGTTGC

951  CGATGGATTT CGACATTTTG CGCCCGTTTT GATCCACCAC GAAACCATGG

1001  GTCAGCAGCT GTTTGTACGG CGCGCGACCC ATTGA
```

This corresponds to the amino acid sequence <SEQ ID 880; ORF 236.a>:

```
a236.pep
   1  MARFAFSADI LCTAFADGFM ACNRAHIAGV VPAAFAFFTI TGFSGNGKFA

51  AYFHFCFRHQ QSKAQFFAQS IQIAGHFFRR GNFGFGLQGR TDGFVGAQRL

101  DGGGYRFAGF ADCRPFFHQF GFGFFVDGRE LVPSMEKHAV FCAAADDVPR

151  FFAGEAQNRC NQENQAARDV VQGGLRAAAG AAVGFGGIEA VFQDIEVERA

201  QVFRAERNHF FHGKVEGITR IKITGNAFLQ PPCQHQGIAV DFHHIRLLHG

251  IFNRIEVAQV GKQKAQGIAD TAVAFGYALE DFFGNRQFAA VIGGCRPQAQ

301  DVRAELVIHF LRRDDVADGF RHFAPVLIHH ETMGQQLFVR RATH*
``` m236/a236 81.0% identity in 258 aa overlap

```
                           10        20        30
m236.pep                   LHGRTDGFVGAQRLDGGGYRFAGFADCRPF
                           |:|||||||||||||||||||||||||||
a236       FRHQQCKAQFFAQSIQIAGHFFRRGNFGFGLQGRTDGFVGAQRLDGGGYRFAGFADCRPF
               60        70        80        90       100       110
            40        50        60        70        80        90
m236.pep   FHQFGFGFFVDGRELVPSMEEDAVXFAAAXDVPRFFAGEAQNRCNQENQTACDVIQGSLC
           ||||||||||||||||||||||:  ||   ||| |||||||||||||||:| ||:||:|
a236       FHQFGFGFFVDGRELVPSMEKHAVFCAAADDVPRFFAGEAQNRCNQENQAARDVVQGGLR
              120       130       140       150       160       170
           100       110       120       130       140       150
m236.pep   AAACMAVCFGGVEAVFQDVEVERTQVFRAERNXVFYGKVEXITRIVIACQTLLQLTCQYH
           |||   ||  |||:||||:||||:||||||||  |:||||  |||| |:  :::|| ||::
a236       AAAGAAVGFGGIEAVFQDIEVERAQVFRAERNHFFHGKVEGITRIKITGNAFLQPPCQHQ
              180       190       200       210       220       230
           160       170       180       190       200       210
m236.pep   GVAVDFHHIRLLHGIFNRIKVAQVGKQKAQGIADTAVAFGYAFEDFFGNRQFAAVIGRCR
           |:||||||||||||||||||:|||||||||||||||||:|||||||||||||||||| ||
a236       GIAVDFHHIRLLHGIFNRIEVAQVGKQKAQGIADTAVALGYALEDFFGNRQFAAVIGGCR
              240       250       260       270       280       290
           220       230       240       250       259
m236.pep   PQAQDVCAEFVINLLRCNDVADGFRHFFAFAVDNETMGQQLFIRRATHX
           ||||||  ||:||::|| :||||||||     : :|||||||||:|||||
a236       PQAQDVRAELVIHFLRRDDVADGFRHFAPVLIHHETMGQQLFVRRATHX
              300       310       320       330       340
```

The following partial DNA sequence was identified in *N. gonorrhoeae* <SEQ ID 881>:

```
g237.seq
    1 atgcgggaca aggttggcgg taatatcgca ctccccgccc acgaatatt
   51 cgattctaac atcggcaagc tgcggaaaaa ctttaagcat atcttggcgg
  101 acaagctcgg tcatacgcgc aggattgtcg ataaattcgt tatccttacc
  151 gccgaaaagc agcctgccgt ccgcgctgag gcggtaataa tccaaaatat
  201 ggcggttgtc gcatactgcc atattgttgc ggataagccc ttttgtgcgc
  251 gcgcccaagg gttcggtggc aataataaag gtgctgacgg caatcgcctt
  301 gcgttccaaa ggccggaata tcgggttcaa accgacataa gtattgacgg
  351 catagaccac attttttacac tcgacgctgc cttcgggcgt gtaaaccagc
  401 caaccgtttt gatacggttc gatgcgcgtc atcggggatt gctcgaaaat
  451 ctgcgcgccg gcttcggcag cggcgctggc aacacccaac gtgtaattga
  501 gcggatgaag atgcccggac aagggatcga actgtgcgcc ttggtacata
  551 tcgctgtcaa gctgctgttt caactcggct ttatcccaaa gttgataatg
  601 actcgcaccg taatgccgtt gggcgtgttc atgccactgc tgcaactctt
  651 cccaatgctg cggacggacg gcaaccgtgg cataaccgcg ctgccaatcg
  701 caatcgatgg catgtttgcg gacgcgttcg tccaccagtt cgaccgcctg
  751 caaagactgt tgccaaaacc attgcgcctg ctccaagccg acctgttttt
  801 caatttcccc cataccgcag gcgtagtcgc tgataacctg cccgccactc
  851 ctgccggacg cgccgaagcc gatacgtgcg gcttccaaaa cgacggcttc
  901 atgtccgtgt ccgccagcg gcaatgcggt acacaaaccg ctcaaaccgc
  951 cgccgataat gcaggtttcg gctttcagac ggcattggag tttcggataa
 1001 acagtatgcg gattaaccga actaaaataa taagaaggca gatattcttg
 1051 aaaatcaggg cgaatcattg tgtttgcttt atcgggtata ttttcggacg
 1101 gaatgataca gactgtcggg ccatatcgtc caaacagaaa atcggttga
```

This corresponds to the amino acid sequence <SEQ ID 882; ORF 237.ng>:

```
g237.pep
    1  MRDKVGGNIA LPAPRIFDSN IGKLRKNFKH ILADKLGHTR RIVDKFVILT

51  AEKQPAVRAE AVIIQNMAVV AYCHIVADKP FCARAQGFGG NNKGADGNRL

101  AFQRPEYRVQ TDISIDGIDH IFTLDAAFGR VNQPTVLIRF DARHRGLLEN

151  LRAGFGSGAG NTQRVIERMK MPGQGIELCA LVHIAVKLLF QLGFIPKLIM

201  TRTVMPLGVF MPLLQLFPML RTDGNRGITA LPIAIDGMFA DAFVHQFDRL

251  QRLLPKPLRL LQADLFFNFP HTAGVVADNL PATPAGRAEA DTCGFQNDGF

301  MSVFRQRQCG TQTAQTAADN AGFGFQTALE FRINSMRINR TKIIRRQIFL

351  KIRANHCVCF IGYIFGRNDT DCRAISSKQK IG*
```

The following partial DNA sequence was identified in *N. meningitidis* <SEQ ID 883>:

```
m237.seq
    1  ATGCGGGACA AGGTTGGCGG TAATGTCGCA CTCCCCGCCC CACGAATATT

51  CGATTTTGAC ATCGGCAAGC TGCGGAAAAA CTTTAAGCAT ATCTTGGCGG

101  ACAAGCTCGG TCATaCGCTC AGGATTGTCG ATAAACTCGT TATCCTTACC

151  GCCGAAAAGC AGTCTGCCGT CCGCGCTGAG GCGGTAATAA TCCAAAATAT

201  GGCGGTTGTC GCATACTGCC ATATTGTTAC GGATAAGCCC TTTTGCGCGC

251  GCCCCCAAGG GTTCGGTCGC AATAATAAAG GTGCTGACAG CAATCGCCTT

301  GCGTTCCAAA GGCCGGAATA TCGGGTTCAA ACCTGCATAA GTATTGACAG

351  CATAGACCAC ATTTTTGCAC TCGACGCTGC CTTCGGGCGT GTAAACCAGC

401  CAACCGTTTT GATGCGGTTC GATGCACGTC ATCGGGGATT GCTCGAAAAT

451  CTGCGCACCG GCTTCGGCAG CGGCACGAGC GATGCCCAAA GTGTAAGTGA

501  GCGGATGCAG GTGTCCGGAT AAGGGGTCGA ATTGTGCCCC TTGGTACATA

551  TCGCTGTCAA GCTGCTGTTT CAACTCGGCT TTATCCCAAA GTTGATAATG

601  ACTCGCACCG TAATGCCGTT GGGCGTGTTC ATGCCACTGC TGCAACTCTT

651  CCCAATGCTG CGGACGGACG GCAACCGTGG CATAACCGCG CTGCCAATCA

701  CAATCGACGG CATGTTTGCG GACGCGTTCG TCCACCAGTT CGACCGCCTG

751  CAAAGACTGT TGCCAAAACC ATTGCGCCTG CTCCAAGCCG ACCTGTTTTT

801  CAATTTCCCC CATACCGCAG nCGTAATCGC TGATAACCTG CCCGCCACTC

851  CGTCCCGACG CGCCGAAACC GATACGCGCG GCTTCCAACA CAACCGTTTC

901  ATGTCCCTGC TCCGCCAAGG GCAATGCAGT GCACAAACCA CCCAATCCGC

951  CGCCGATGAT ACAGGTATCG GTTTTCAGAC GGCATTGAAG TTtCGGATAA

1001  ACAGTATGAG GATTAACCGA ACTGAAATAA TAAGAAGGCA GATATTCTTG

1051  AAAATCAGGG CGAATCATTG TGTTTGCTTT ATCAGGTGTA TTTTCGGACG

1101  GAATGATACA GGCTGTCGGG CCATATCGTC CAwACAGAAA ATCGGTTGA
```

This corresponds to the amino acid sequence <SEQ ID 884; ORF 237>:

```
m237.pep
    1   MRDKVGGNVA LPAPRIFDFD IGKLRKNFKH ILADKLGHTL RIVDKLVILT

51   AEKQSAVRAE AVIIQNMAVV AYCHIVTDKP FCARPQGFGR NNKGADSNRL

101   AFQRPEYRVQ TCISIDSIDH IFALDAAFGR VNQPTVLMRF DARHRGLLEN

151   LRTGFGSGTS DAQSVSERMQ VSGXGVELCP LVHIAVKLLF QLGFIPKLIM

201   TRTVMPLGVF MPLLQLFPML RTDGNRGITA LPITIDGMFA DAFVHQFDRL

251   QRLLPKPLRL LQADLFFNFP HTAXVIADNL PATPSRRAET DTRGFQHNRF

301   MSLLRQGQCS AQTTQSAADD TGIGFQTALK FRINSMRINR TEIIRRQIFL

351   KIRANHCVCF IRCIFGRNDT GCRAISSXQK IG*
                                                         15
```

Computer analysis of this amino acid sequence gave the following results:
Homology with a Predicted ORF from *N. gonorrhoeae*
ORF 237 shows 86.1% identity over a 382 aa overlap with a predicted ORF (ORF 237.ng) from *N. gonorrhoeae*:

```
    m237/g237
                        10         20         30         40         50         60
    m237.pep   MRDKVGGNVALPAPRIFDFDIGKLRKNFKHILADKLGHTLRIVDKLVILTAEKQSAVRAE
               ||||||||:|||||||||| :||||||||||||||||| ||||| |||||||:||||
    g237       MRDKVGGNIALPAPRIFDSNIGKLRKNFKHILADKLGHTRRIVDKFVILTAEKQPAVRAE
                        10         20         30         40         50         60

70         80         90        100        110        120
    m237.pep   AVIIQNMAVVAYCHIVTDKPFCARPQGFGRNNKGADSNRLAFQRPEYRVQTCISIDSIDH
               |||||||||||||||| :||||| |||| |||||| ||||||||||||||||    |:|||
    g237       AVIIQNMAVVAYCHIVADKPFCARAQGFGGNNKGADGNRLAFQRPEYRVQTDISIDGIDH
                        70         80         90        100        110        120

130        140        150        160        170        180
    m237.pep   IFALDAAFGRVNQPTVLMRFDARHRGLLENLRTGFGSGTSDAQSVSERMQVSGXGVELCP
               ||:||||||||||||||:|||||||||||||||:||||:||:::| |||:: | |:|||
    g237       IFTLDAAFGRVNQPTVLIRFDARHRGLLENLRAGFGSGAGNTQRVIERMKMPGQGIELCA
                       130        140        150        160        170        180

190        200        210        220        230        240
    m237.pep   LVHIAVKLLFQLGFIPKLIMTRTVMPLGVFMPLLQLFPMLRTDGNRGITALPITIDGMFA
               |||||||||||||||||||||||||||||||||||||||||||||||||||:||||||
    g237       LVHIAVKLLFQLGFIPKLIMTRTVMPLGVFMPLLQLFPMLRTDGNRGITALPIAIDGMFA
                       190        200        210        220        230        240

250        260        270        280        290        300
    m237.pep   DAFVHQFDRLQRLLPKPLRLLQADLFFNFPHTAXVIADNLPATPSRRAETDTRGFQHNRF
               |||||||||||||||||||||||||||||||| |:|||||||| |||: |||:|| |::|
    g237       DAFVHQFDRLQRLLPKPLRLLQADLFFNFPHTAGVVADNLPATPAGRAEADTCGFQNDGF
                       250        260        270        280        290        300

310        320        330        340        350        360
    m237.pep   MSLLRQGQCSAQTTQSAADDTGIGFQTALKFRINSMRINRTEIIRRQIFLKIRANHCVCF
               ||::||  ||::|| ::|:||||||||||| ||||||||||:|||||||||||||||
    g237       MSVFRQRQCGTQTAQTAADNAGFGFQTALEFRINSMRINRTKIIRRQIFLKIRANHCVCF
                       310        320        330        340        350        360

370        380
    m237.pep   IRCIFGRNDTGCRAISSXQKIGX
               |  ||||||| ||||| |||||
    g237       IGYIFGRNDTDCRAISSKQKIGX
                       370        380
```

The following partial DNA sequence was identified in *N. meningitidis* <SEQ ID 885>:

```
a237.seq
    1   ATGCGGGACA AGGTTGGCGG TAATGTCGCA CTCCCCGCCC CACGAATATT

51   CGATTTTGAC ATCGGCAAGC TGCGGAAAAA CTTTAAGCAT ATCTTGGCGG

101   ACAAGCTCGG TCATACGCGC GGGATTGTCG ATAAACTCGT TATCCTTACC

151   GCCGAAAAGC AGTCTGCCGT CCGCGCTGAG GCGGTAATAA TCCAAAATAT

201   GACGGTTGTC GCATACTGCC ATATTGTTGC GGATAAGCCC TTTTGCACGC
```

```
-continued
 251  GCGCCCAAGG GTTCTGTGGC AATAATAAAG GTGCTGACAG CAATCGCCTT

301  GCGCTCCAAA GGCTTGAATA TCGGATTCAA ACCGGCATAA GTATTGACGG

351  CGTACACCAG ATTTTTGCAT TCGACGCTGC CTTCGGGGGT GTAAACCAGC

401  CAACCGTTTT GATAAGGTTC AATGCGTATC ATGGGAGAAT GCTCAAAAAT

451  CTTCGTACCA GCTTCGGCAG CGGCGCGGGC GATGCCCAAC GTGTAATTGA

501  GCGGATGGAG ATGCCCGGAC AAGGGATCGA ACTGTGCGCC TTGGTACATA

551  TCGCTGTCAA GCTGCTGCTT CAGTTCAGTG TTATCCCAGA GTTGATAATG

601  AGTTGCACCG TAATATTTTT GGGCGTGCTC ATGCCATTGT TGCAATTCTT

651  CCCAATGCTG CGAACGGATG GCAACCGTGG CATAACCGCG CTGCCAATCG

701  CAATCAATGG CATGTTTGCG GACGCGTTCG TCCACCAGTT CGACCGCCTG

751  CAAAGACTGT TGCCAAAACC ATTGCGCTTG CTCCAAACCG ACCTGTTTTT

801  CAATTTCCTC CATACCGCAG GCGTAATCGC TGATAACCTG CCCGCCACTC

851  CGTCCCGACG CGCCGAAACC GATACGCGCG GCTTCCAACA CAACCGTTTC

901  ATGTCCCTGC TCCGCCAAGG GCAATGCAGT GCACAAACCA CTCAATCCGC

951  CGCCGATGAT ACAGGTATCG GTTTTCAGAC GGCATTGAAG TTTCGGATAA

1001  ACAGTATGAG GATTAACCGA ACTGAAATAA TAAGAAGGCA GATATTCTTG

1051  AAAATCAGGG CGAATCATTG TGTTTGCTTT ATCGGGTATA TTTTCGGACG

1101  GAATGATACA GGCTGTCGAG CCATATCGTC CAAACAGAAA ATCGGTTGA
```

This corresponds to the amino acid sequence <SEQ ID 886;
ORF 237.a>:

```
a237.pep
   1  MRDKVGGNVA LPAPRIFDFD IGKLRKNFKH ILADKLGHTR GIVDKLVILT

51  AEKQSAVRAE AVIIQNMTVV AYCHIVADKP FCTRAQGFCG NNKGADSNRL

101  ALQRLEYRIQ TGISIDGVHQ IFAFDAAFGG VNQPTVLIRF NAYHGRMLKN

151  LRTSFGSGAG DAQRVIERME MPGQGIELCA LVHIAVKLLL QFSVIPELIM

201  SCTVIFLGVL MPLLQFFPML RTDGNRGITA LPIAINGMFA DAFVHQFDRL

251  QRLLPKPLRL LQTDLFFNFL HTAGVIADNL PATPSRRAET DTRGFQHNRF

301  MSLLRQGQCS AQTTQSAADD TGIGFQTALK FRINSMRINR TEIIRRQIFL

351  KIRANHCVCF IGYIFGRNDT GCRAISSKQK IG*
``` m237/a237 85.6% identity in 382 aa overlap

```
                10         20         30         40         50         60
  m237.pep  MRDKVGGNVALPAPRIFDFDIGKLRKNFKHILADKLGHTLRIVDKLVILTAEKQSAVRAE
            ||||||||||||||||||||||||||||||||||||||| ||||||||||||||||||||
     a237   MRDKVGGNVALPAPRIFDFDIGKLRKNFKHILADKLGHTRGIVDKLVILTAEKQSAVRAE
                10         20         30         40         50         60

70         80         90        100        110        120
  m237.pep  AVIIQNMAVVAYCHIVTDKPFCARPQGFGRNNKGADSNRLAFQRPEYRVQTCISIDSIDH
            ||||||| :||||||||:||||| ||| :||||||||||| ||| :|| ||||:: :
     a237   AVIIQNMTVVAYCHIVADKPFCTRAQGFCGNNKGADSNRLALQRLEYRIQTGISIDGVHQ
                70         80         90        100        110        120

130        140        150        160        170        180
  m237.pep  IFALDAAFGRVNQPTVLMRFDARHRGLLENLRTGFGSGTSDAQSVSERMQVSGXGVELCP
            |||:|||||:|||||||:||:|:| :| ::||||||||| ||| ||| |||: | |||:
     a237   IFAFDAAFGGVNQPTVLIRFNAYHGRMLKNLRTSFGSGAGDAQRVIERMEMPGQGIELCA
               130        140        150        160        170        180
```

-continued

```
                  190       200       210       220       230       240
m237.pep   LVHIAVKLLFQLGFIPKLIMTRTVMPLGVFMPLLQLFPMLRTDGNRGITALPITIDGMFA
           ||||||||:|::  ||:|||:  ||:  |||:|||||:||||||||||||||:|||
a237       LVHIAVKLLLQFSVIPELIMSCTVIFLGVLMPLLQFFPMLRTDGNRGITALPIAINGMFA
                  190       200       210       220       230       240

250       260       270       280       290       300
m237.pep   DAFVHQFDRLQRLLPKPLRLLQADLFFNFPHTAXVIADNLPATPSRRAETDTRGFQHNRF
           ||||||||||||||||||||||:||||| ||| ||||||||||||||||||||||||||
a237       DAFVHQFDRLQRLLPKPLRLLQTDLFFNFLHTAGVIADNLPATPSRRAETDTRGFQHNRF
                  250       260       270       280       290       300

310       320       330       340       350       360
m237.pep   MSLLRQGQCSAQTTQSAADDTGIGFQTALKFRINSMRINRTEIIRRQIFLKIRANHCVCF
           ||||||||||||||||||||||||||||||||||||||||||||||||||||||||||||
a237       MSLLRQGQCSAQTTQSAADDTGIGFQTALKFRINSMRINRTEIIRRQIFLKIRANHCVCF
                  310       320       330       340       350       360

370       380
m237.pep   IRCIFGRNDTGCRAISSXQKIGX
           |  ||||||||||||| |||||
a237       IGYIFGRNDTGCRAISSKQKIGX
                  370       380
```

The following partial DNA sequence was identified in *N. gonorrhoeae* <SEQ ID 887>:

```
g238.seq
    1  atgaatttgc ctattcaaaa attcatgatg ctgttggcag cggcaatatc
   51  gatgctgcat atccccatta gtcatgcgaa cggtttggat gcccgtttgc
  101  gcgatgatat gcaggcaaaa cactacgaac cgggtggcaa ataccatctg
  151  tttggtaatg ctcgcggcag tgttaaaaat cgggtttgcg ccgtccaaac
  201  atttgatgca actgcggtcg gccccatact gcctattaca cacgaacgga
  251  caggatttga aggtgttatc ggctatgaaa cccatttttc aggacacgga
  301  cacgaagtac acagtccgtt cgataatcat gattcaaaaa gcacttctga
  351  tttcagcggc ggcgtagacg gcggttttac cgtttaccaa cttcatcgga
  401  cagggtcgga aatacatccc gcagacggat atgacgggcc tcaaggcggc
  451  ggttatccgg aaccacaagg ggcaagggat atatacagct accatatcaa
  501  aggaacttca accaaaacaa agataaacac tgttccgcaa gccccttttt
  551  cagaccgctg gctaaaagaa aatgccggtg ccgcttccgg ttttctcagc
  601  cgtgcggatg aagcaggaaa actgatatgg gaaaacgacc ccgataaaaa
  651  ttggcgggct aaccgtatgg atgatattcg cggcatcgtc caaggtgcgg
  701  ttaatccttt tttaacgggt tttcaagggg tagggattgg ggcaattaca
  751  gacagtgcgg taagcccggt cacagataca gccgctcagc agactctaca
  801  aggtattaat gatttaggaa atttaagtcc ggaagcacaa cttgccgccg
  851  cgagcctatt acaggacagt gcctttgcgg taaagacgg catcaattcc
  901  gccagacaat gggctgatgc ccatccgaat ataacagcaa cagcccaaac
  951  tgcccttgcc gtagcagagg ccgcaggtac ggtttggcgc ggtaaaaaag
 1001  tagaacttaa cccgaccaaa tgggattggg ttaaaaatac cggctataaa
 1051  aaacctgctg cccgccatat gcagactgta gatggggaga tggcagggg
 1101  gaatagaccg cctaaatcta taacgtcgga aggaaaagct aatgctgcaa
 1151  cctatcctaa gttggttaat cagctaaatg agcaaaactt aaataacatt
 1201  gcggctcaag atccaagatt gagtctagct attcatgagg gtaaaaaaaa
 1251  tttttccaata ggaactgcaa cttatgaaga ggcagataga ctaggtaaaa
```

```
-continued
1301  tttgggttgg tgagggtgca agacaaacta gtggaggcgg atggttaagt
1351  agagatggca ctcgacaata tcggccacca acagaaaaaa aatcacaatt
1401  tgcaactaca ggtattcaag caaattttga aacttatact attgattcaa
1451  atgaaaaaag aaataaaatt aaaaatggac atttaaatat taggtaa
```

This corresponds to the amino acid sequence <SEQ ID 888; ORF 238.ng>:

```
g238.pep
  1  MNLPIQKFMM LLAAAISMLH IPISHANGLD ARLRDDMQAK HYEPGGKYHL
 51  FGNARGSVKN RVCAVQTFDA TAVGPILPIT HERTGFEGVI GYETHFSGHG
101  HEVHSPFDNH DSKSTSDFSG GVDGGFTVYQ LHRTGSEIHP ADGYDGPQGG
151  GYPEPQGARD IYSYHIKGTS TKTKINTVPQ APFSDRWLKE NAGAASGFLS
201  RADEAGKLIW ENDPDKNWRA NRMDDIRGIV QGAVNPFLTG FQGVGIGAIT
251  DSAVSPVTDT AAQQTLQGIN DLGNLSPEAQ LAAASLLQDS AFAVKDGINS
301  ARQWADAHPN ITATAQTALA VAEAAGTVWR GKKVELNPTK WDWVKNTGYK
351  KPAARHMQTV DGEMAGGNRP PKSITSEGKA NAATYPKLVN QLNEQNLNNI
401  AAQDPRLSLA IHEGKKNFPI GTATYEEADR LGKIWVGEGA RQTSGGGWLS
451  RDGTRQYRPP TEKKSQFATT GIQANFETYT IDSNEKRNKI KNGHLNIR*
```

The following partial DNA sequence was identified in *N. meningitidis* <SEQ ID 889>:

```
m238.seq
  1  ATGAATTTGC CTATTCAAAA ATTCATGATG CTGTTTGCAG CAGCAATATC
 51  GTTGCTGCAA ATCCCCATTA GTCATGCGAA CGGTTTGGAT GCCCGTTTGC
101  GCGATGATAT GCAGGCAAAA CAcTACGAAC CGGGTGGTAA ATACCATCTG
151  TTTGGTAATG CTCGCGGCAG TGTTAAAAAG CGGGTTTACG CCGTCCAGAC
201  ATTTGATGCA ACTGCGGTCA GTCCTGTACT GCCTATTACA CACGAACGGA
251  CAGGGTTTGA AGGTGTTATC GGTTATGAAA CCCATTTTTC AGGGCACGGA
301  CATGAAGTAC ACAGTCCGTT CGATCATCAT GATTCAAAAA GCACTTCTGA
351  TTTCAGCGGC GGTGTAGACG GCGGTTTTAC TGTTTACCAA CTTCATCGAA
401  CAGGGTCGGA AATCCATCCG GAGGATGGAT ATGACGGGCC GCAAGGCAGC
451  GATTATCCGC CCCCCGGAGG AGCAAGGGAT ATATACAGCT ATTATGTCAA
501  AGGAACTTCA ACAAAAACAA AGACTAATAT TGTCCCTCAA GCCCCATTTT
551  CAGACCGTTG GCTAAAAGAA AATGCCGGTG CCGCCTCTGG TTTTTTCAGC
601  CGTGCGGATG AAGCAGGAAA ACTGATATGG GAAAGCGACC CCAATAAAAA
651  TTGGTGGGCT AACCGTATGG ATGATGTTCG CGGCATCGTC CAAGGTGCGG
701  TTAATCCTTT TTTAATGGGT TTTCAAGGAG TAGGGATTGG GGCAATTACA
751  GACAGTGCAG TAAGCCCGGT CACAGATACA GCCGCGCAGC AGACTCTACA
801  AGGTATTAAT GATTTAGGAA AATTAAGTCC GGAAGCACAA CTTGCTGCCG
851  CGAGCCTATT ACAGGACAGT GCTTTTGCGG TAAAAGACGG TATCAACTCT
901  GCCAAACAAT GGGCTGATGC CCATCCAAAT ATAACAGCTA CTGCCCAAAC
951  TGCCCTTTCC GCAGCAGAGG CCGCAGGTAC GGTTTGGAGA GGTAAAAAAG
```

```
-continued
1001  TAGAACTTAA CCCGACTAAA TGGGATTGGG TTAAAAATAC CGGTTATAAA

1051  AAACCTGCTG CCCGCCATAT GCAGACTTTA GATGGGGAGA TGGCAGGTGG

1101  GAATAAACCT ATTAAATCTT TACCAAACAG TGCCGCTGAA AAAGAAAAC

1151  AAAATTTTGA GAAGTTTAAT AGTAACTGGA GTTCAGCAAG TTTTGATTCA

1201  GTGCACAAAA CACTAACTCC CAATGCACCT GGTATTTTAA GTCCTGATAA

1251  AGTTAAAACT CGATACACTA GTTTAGATGG AAAAATTACA ATTATAAAAG

1301  ATAACGAAAA CAACTATTTT AGAATCCATG ATAATTCACG AAAACAGTAT

1351  CTTGATTCAA ATGGTAATGC TGTGAAAACC GGTAATTTAC AAGGTAAGCA

1401  AGCAAAAGAT TATTTACAAC AACAAACTCA TATCAGGAAC TTAGACAAAT

1451  GA
```

This corresponds to the amino acid sequence <SEQ ID 890; ORF 238>:

```
m238.pep
    1  MNLPIQKFMM LFAAAISLLQ IPISHANGLD ARLRDDMQAK HYEPGGKYHL

51  FGNARGSVKK RVYAVQTFDA TAVSPVLPIT HERTGFEGVI GYETHFSGHG

101  HEVHSPFDHH DSKSTSDFSG GVDGGFTVYQ LHRTGSEIHP EDGYDGPQGS

151  DYPPPGGARD IYSYYVKGTS TKTKTNIVPQ APFSDRWLKE NAGAASGFFS

201  RADEAGKLIW ESDPNKNWWA NRMDDVRGIV QGAVNPFLMG FQGVGIGAIT

251  DSAVSPVTDT AAQQTLQGIN DLGKLSPEAQ LAAASLLQDS AFAVKDGINS

301  AKQWADAHPN ITATAQTALS AAEAAGTVWR GKKVELNPTK WDWVKNTGYK

351  KPAARHMQTL DGEMAGGNKP IKSLPNSAAE KRKQNFEKFN SNWSSASFDS

401  VHKTLTPNAP GILSPDKVKT RYTSLDGKIT IIKDNENNYF RIHDNSRKQY

451  LDSNGNAVKT GNLQGKQAKD YLQQQTHIRN LDK*
```

Computer analysis of this amino acid sequence gave the following results:
Homology with a Predicted ORF from *N. gonorrhoeae*
ORF 238 shows 86.0% identity over a 401 aa overlap with a predicted ORF (ORF 238.ng) from *N. gonorrhoeae*:

```
       m238/g238
                       10         20         30         40         50         60
         m238.pep   MNLPIQKFMMLFAAAISLLQIPISHANGLDARLRDDMQAKHYEPGGKYHLFGNARGSVKK
                    ||||||||||:||||:|:||||||||||||||||||||||||||||||||||||||||:
             g238   MNLPIQKFMMLLAAAISMLHIPISHANGLDARLRDDMQAKHYEPGGKYHLFGNARGSVKN
                       10         20         30         40         50         60

70         80         90        100        110        120
         m238.pep   RVYAVQTFDATAVSPVLPITHERTGFEGVIGYETHFSGHGHEVHSPFDHHDSKSTSDFSG
                    ||:|||||||||:||:||||||||||||||||||||||||||||||||:|||||||||
             g238   RVCAVQTFDATAVGPILPITHERTGFEGVIGYETHFSGHGHEVHSPFDNHDSKSTSDFSG
                       70         80         90        100        110        120

130        140        150        160        170        180
         m238.pep   GVDGGFTVYQLHRTGSEIHPEDGYDGPQGSDYPPPGGARDIYSYYVKGTSTKTKTNIVPQ
                    |||||||||||||||||||| |||||||||:  || |||||||:::||||||||| |||
             g238   GVDGGFTVYQLHRTGSEIHPADGYDGPQGGGYPEPQGARDIYSYHIKGTSTKTKINTVPQ
                      130        140        150        160        170        180

190        200        210        220        230        240
         m238.pep   APFSDRWLKENAGAASGFFSRADEAGKLIWESDPNKNWWANRMDDVRGIVQGAVNPFLMG
                    ||||||||||||||||||:|||||||||||:||:|||W ||||||:||||||||||||| |
             g238   APFSDRWLKENAGAASGFLSRADEAGKLIWENDPDKNWRANRMDDIRGIVQGAVNPFLTG
                      190        200        210        220        230        240
```

```
            250        260        270        280        290        300
m238.pep  FQGVGIGAITDSAVSPVTDTAAQQTLQGINDLGKLSPEAQLAAASLLQDSAFAVKDGINS
          ||||||||||||||||||||||||||||||:|||||||||||||||||||||||||||||
g238      FQGVGIGAITDSAVSPVTDTAAQQTLQGINDLGNLSPEAQLAAASLLQDSAFAVKDGINS
            250        260        270        280        290        300

310        320        330        340        350        360
m238.pep  AKQWADAHPNITATAQTALSAAEEAAGTVWRGKKVELNPTKWDWVKNTGYKKPAARHMQTL
          |:||||||||||||||||||||::||||||||||||||||||||||||||||||||||:
g238      ARQWADAHPNITATAQTALAVAEAAGTVWRGKKVELNPTKWDWVKNTGYKKPAARHMQTV
            310        320        330        340        350        360

370        380        390        400        410        420
m238.pep  DGEMAGGNKPIKSLPNSAAEKRKQNFEKFNSNWSSASFDSVHKTLTPNAPGILSPDKVKT
          ||||||||:|  ||: :|  ::      ::  |: :: :    : ::::
g238      DGEMAGGNRPPKSI-TSEGKANAATYPKLVNQLNEQNLNNIAAQDPRLSLAIHEGKKNFP
            370        380        390        400        410

430        440        450        460        470        480
m238.pep  RYTSLDGKITIIKDNENNYFRIHDNSRKQYLDSNGNAVKTGNLQGKQAKDYLQQQTHIRN g238      IGTATYEEADRLGKIWVGEGARQTSGGGWLSRDGTRQYRPPTEKKSQFATTGIQANFETY
            420        430        440        450        460        470
```

The following partial DNA sequence was identified in *N. meningitidis* <SEQ ID 891>:

```
a238.seq (partial)
   1  ATGAATTTGC CTATTCAAAA ATTCATGATG CTGTTTGCAG CAGCAATATC

51  GTTGCTGCAA ATCCCCATTA GTCATGCGAA CGGTTTGGAT GCCCGTTTGC

101  GCGATGATAT GCAGGCAAAA CACTACGAAC CGGGTGGTAA ATACCATCTG

151  TTTGGTAATG CTCGCGGCAG TGTTAAAAAT CGGGTTTACG CCGTCCAAAC

201  ATTTGATGCA ACTGCGGTCG GCCCCATACT GCCTATTACA CACGAACGGA

251  CAGGATTTGA AGGCATTATC GGTTATGAAA CCCATTTTTC AGGACATGGA

301  CATGAAGTAC ACAGTCCGTT CGATAATCAT GATTCAAAAA GCACTTCTGA

351  TTTCAGCGGC GGCGTAGACG GTGGTTTTAC CGTTTACCAA CTTCATCGGA

401  CAGGGTCGGA AATCCATCCG GAGGATGGAT ATGACGGGCC GCAAGGCAGC

451  GATTATCCGC CCCCCGGAGG AGCAAGGGAT ATATACAGCT ACTATGTCAA

501  AGGAACTTCA ACAAAAACAA AGAGTAATAT TGTTCCCCGA GCCCCATTTT

551  CAGACCGCTG GCTAAAAGAA AATGCCGGTG CCGCCTCTGG TTTTTTCAGC

601  CGTGCTGATG AAGCAGGAAA ACTGATATGG GAAAGCGACC CCAATAAAAA

651  TTGGTGGGCT AACCGTATGG ATGATATTCG CGGCATCGTC CAAGGTGCGG

701  TTAATCCTTT TTTAATGGGT TTTCAAGGAG TAGGGATTGG GGCAATTACA

751  GACAGTGCAG TAAGCCCGGT CACAGATACA GCCGCGCAGC AGACTCTACA

801  AGGTATTAAT CATTTAGGAA ATTTAAGTCC CGAAGCACAA CTTGCGGCTG

851  CAACCGCATT ACAAGACAGT GCTTTTGCGG TAAAAGACGG TATCAATTCC

901  GCCAGACAAT GGGCTGATGC CCATCCGAAT ATAACTGCAA CAGCCCAAAC

951  TGCCCTTGCC GTAGCAGAGG CCGCAACTAC GGTTTGGGGC GGTAAAAAAG

1001  TAGAACTTAA CCCGACCAAA TGGGATTGGG TTAAAAATAC CGGCTATAAA

1051  ACACCTGCTG TTCGCACCAT GCATACTTTG GATGGGGAAA TGGCCGGTGG

1101  GAATAGACCG CCTAAATCTA TAACGTCCAA CAGCAAAGCA GATGCTTCCA

1151  CACAA
```

This corresponds to the amino acid sequence <SEQ ID 892; ORF 238.a>:

```
a238.pep (partial)
    1   MNLPIQKFMM LFAAAISLLQ IPISHANGLD ARLRDDMQAK HYEPGGKYHL

51   FGNARGSVKN RVYAVQTFDA TAVGPILPIT HERTGFEGII GYETHFSGHG

101   HEVHSPFDNH DSKSTSDFSG GVDGGFTVYQ LHRTGSEIHP EDGYDGPQGS

151   DYPPPGGARD IYSYYVKGTS TKTKSNIVPR APFSDRWLKE NAGAASGFFS

201   RADEAGKLIW ESDPNKNWWA NRMDDIRGIV QGAVNPFLMG FQGVGIGAIT

251   DSAVSPVTDT AAQQTLQGIN HLGNLSPEAQ LAAATLQDS AFAVKDGINS

301   ARQWADAHPN ITATAQTALA VAEAATTVWG GKKVELNPTK WDWVKNTGYK

351   TPAVRTMHTL DGEMAGGNRP PKSITSNSKA DASTQ
                                                           15
``` m238/a238 91.9% identity in 385 aa overlap

```
                 10         20         30         40         50         60
  m238.pep  MNLPIQKFMMLFAAAISLLQIPISHANGLDARLRDDMQAKHYEPGGKYHLFGNARGSVKK
            ||||||||||||||||||||||||||||||||||||||||||||||||||||||||||:
  a238      MNLPIQKFMMLFAAAISLLQIPISHANGLDARLRDDMQAKHYEPGGKYHLFGNARGSVKN
                 10         20         30         40         50         60

70         80         90        100        110        120
  m238.pep  RVYAVQTFDATAVSPVLPITHERTGFEGVIGYETHFSGHGHEVHSPFDHHDSKSTSDFSG
            ||||||||||||||:|:||||||||||||:||||||||||||||||||||:|||||||||
  a238      RVYAVQTFDATAVGPILPITHERTGFEGIIGYETHFSGHGHEVHSPFDNHDSKSTSDFSG
                 70         80         90        100        110        120

130        140        150        160        170        180
  m238.pep  GVDGGFTVYQLHRTGSEIHPEDGYDGPQGSDYPPPGGARDIYSYYVKGTSTKTKTNIVPQ
            ||||||||||||||||||||||||||||||||||||||||||||||||||||||:||||:
  a238      GVDGGFTVYQLHRTGSEIHPEDGYDGPQGSDYPPPGGARDIYSYYVKGTSTKTKSNIVPR
                130        140        150        160        170        180

190        200        210        220        230        240
  m238.pep  APFSDRWLKENAGAASGFFSRADEAGKLIWESDPNKNWWANRMDDVRGIVQGAVNPFLMG
            |||||||||||||||||||||||||||||||||||||||||||||:||||||||||||||
  a238      APFSDRWLKENAGAASGFFSRADEAGKLIWESDPNKNWWANRMDDIRGIVQGAVNPFLMG
                190        200        210        220        230        240

250        260        270        280        290        300
  m238.pep  FQGVGIGAITDSAVSPVTDTAAQQTLQGINDLGKLSPEAQLAAASLLQDSAFAVKDGINS
            ||||||||||||||||||||||||||||||||:||:||||||||||:||||||||||||
  a238      FQGVGIGAITDSAVSPVTDTAAQQTLQGINHLGNLSPEAQLAAATLLQDSAFAVKDGINS
                250        260        270        280        290        300

310        320        330        340        350        360
  m238.pep  AKQWADAHPNITATAQTALSAAEAAGTVWRGKKVELNPTKWDWVKNTGYKKPAARHMQTL
            |:|||||||||||||||||::|||:|||:|||||||||||||||||||||||:|:|:||
  a238      ARQWADAHPNITATAQTALAVAEAATTVWGGKKVELNPTKWDWVKNTGYKTPAVRTMHTL
                310        320        330        340        350        360

370        380        390        400        410        419
  m238.pep  DGEMAGGNKPIKSLP-NSAAEKRKQNFEKFNSNWSSASFDSVHKTLTPNAPGILSPDKVK
            ||||||||:| ||: || |:    |
  a238      DGEMAGGNRPPKSITSNSKADASTQ
```

The following partial DNA sequence was identified in *N. gonorrhoeae* <SEQ ID 893>:

```
g239.seq
    1   atgttccacc ataaaggtat tgcccgaaac cggcggatgg aggttttgtt 51   tttctgccgc cgccctgatc gcttcgtgat cgccaaacg cgcctgttgc 101   agcctcattt gcgcataatc ctgctccaag gcgatttcct gttttttcgc 151   cttgtccaaa gctgtgaagt tgagcctgta ctggttttgc tgcatcacaa 201   cggaaaaagc ggaaacgcac accgcaagca gcagaaagaa attcgatttg 251   ttcattgccg ttcagacgtt tttctctgtt attattccgg tatcggaccg 301   gcagtccgct ccgccacacg caaaactgcg ctcctcgccc tcgggttggc 351   ggcaatttcc gcttcacccg gctttaatgc cctgcccacg attttcaggg 401   gcggatcggg caaatccgct tctctgaccg ccgcccagct cggcagggc
```

-continued

```
451   tcgtgttgcg aatatttttt gacaaactgc ttcacaatgc ggtcttccaa 501   cgaatggaaa gcaatgaccg ccaaacgccc gccctctttc agacggcaca 551   tgacctgcgg caataccgcc ctacttctt caagctcgcg gttaataaag 601   atgcggattg cctggaaggt gcgcgtcgca ggatcctgcc cccgctcgcg 651   agtacggacg ttttgtgcca cgatctgcgc cagcttgcgg gttgtatcga 701   ttggactttc cgcccgttgc gcgacaatgg cgcgcacaat ctggcggcta 751   aaccgctctt caccataa
```

This corresponds to the amino acid sequence <SEQ ID 894; ORF 239.ng>:

```
g239.pep
  1   MFHHKGIARN RRMEVLFFCR RPDRFVIRQT RLLQPHLRII LLQGDFLFFR

51   LVQSCEVEPV LVLLHHNGKS GNAHRKQQKE IRFVHCRSDV FLCYYSGIGP

101   AVRSATRKTA LLALGLAAIS ASPGFNALPT IFRGGSGKSA SLTAAQLGRG

151   SCCEYFLTNC FTMRSSNEWK AMTAKRPPSF RRHMTCGNTA PTSSSSRLIK

201   MRIAWKVRVA GSCPRSRVRT FCATICASLR VVSIGLSARC ATMARTIWRL

251   NRSSP*
```

The following partial DNA sequence was identified in *N. meningitidis* <SEQ ID 895>:

```
m239.seq
  1   ATGCTCCACC ATAAAGGTmy kGCCCGAAAC CGGCkGATGG AGGTTTTGTT

51   TTTCTGCCGC CGCCCTGATC GCTTCGTGGT TCGCCAAACG CGCCTGTTGC

101   AGCCTCATTT GCGCATAATC CTGCTCCAAG GCGATTTCCT GTTTTTTCGC

151   CTTATCCAAA GCTGTGAAAT TGAGCCTGTA CTGGTTTTGC TGCATCACAA

201   CGGAAAAAGC GGAAACGCAC ACCGCAAGCA GCAGAAGGAA ATTCAATTTG

251   TTCATTGCCA TTCAGACGTT TTTCTCTGTG ATTGTTCCGG TATCGGACCG

301   GCAGTCCGCT CCGCCACACG CAAAACCGCA CTTCTCGCCC TCGGATTGGC

351   GGCAATTTCC GCCTCACCCG GCTTTAATGC CCTGCCCACG ATTTTCAGGG

401   GCAGCTCGGG CAAATCCGCT TCCCTGaCCG CCGCCCAGCG CGGCAGGGGC

451   GCGTGTTGCG AATATTTTTT GACAAACTGC TTCACAATGC GATCTTCCAA

501   CGAATGGAAA GCAATGACCG CCAAACGTCC GCCCTCTTTC AGACGACACA

551   TGACCTGCGG CAATACTGCC CTACTTCTT CAAGCTCGCG GTTAATAAAG

601   ATGCGGACCG CCTGGAAGGT GCGCGTCGCA GGATCCTGCC CCCGCTCGCG

651   AGTACGGACG TTTTGTGCCA CGATCTGCGC CAGCTTGCGG GTTGTATCGA

701   TTGGACTTTC CGCCCGTTGC GCAACAATGG CGCGCGCAAT cCGGCGGCTa

751   AACCGCTCTT cACCATAA
```

This corresponds to the amino acid sequence <SEQ ID 896; ORF 239>:

```
m239.pep
  1   MLHHKGXARN RXMEVLFFCR RPDRFVVRQT RLLQPHLRII LLQGDFLFFR

51   LIQSCEIEPV LVLLHHNGKS GNAHRKQQKE IQFVHCHSDV FLCDCSGIGP
```

-continued

```
101    AVRSATRKTA LLALGLAAIS ASPGFNALPT IFRGSSGKSA SLTAAQRGRG

151    ACCEYFLTNC FTMRSSNEWK AMTAKRPPSF RRHMTCGNTA PTSSSSRLIK

201    MRTAWKVRVA GSCPRSRVRT FCATICASLR VVSIGLSARC ATMARAIRRL

251    NRSSP*
```

Computer analysis of this amino acid sequence gave the following results:
Homology with a Predicted ORF from *N. gonorrhoeae*
ORF 239 shows 93.7% identity over a 255 aa overlap with a predicted ORF (ORF 239.ng) from *N. gonorrhoeae*:

```
m239/g239
                    10         20         30         40         50         60
    m239.pep  MLHHKGXARNRXMEVLFFCRRPDRFVVRQTRLLQPHLRIILLQGDFLFFRLIQSCEIEPV
              |:||||  ||||  |||||||||||||||:||||||||||||||||||||:||||:|||
      g239    MFHHKGIARNRRMEVLFFCRRPDRFVIRQTRLLQPHLRIILLQGDFLFFRLVQSCEVEPV
                    10         20         30         40         50         60

70         80         90        100        110        120
    m239.pep  LVLLHHNGKSGNAHRKQQKEIQFVHCHSDVFLCDCSGIGPAVRSATRKTALLALGLAAIS
              ||||||||||||||||||||||:||||:|||||| |||||||||||||||||||||||||
      g239    LVLLHHNGKSGNAHRKQQKEIRFVHCRSDVFLCYYSGIGPAVRSATRKTALLALGLAAIS
                    70         80         90        100        110        120

130        140        150        160        170        180
    m239.pep  ASPGFNALPTIFRGSSGKSASLTAAQRGRGACCEYFLTNCFTMRSSNEWKAMTAKRPPSF
              ||||||||||||||:|||||||||||:||||  |:|||||||||||||||||||||||||
      g239    ASPGFNALPTIFRGGSGKSASLTAAQLGRGSCCEYFLTNCFTMRSSNEWKAMTAKRPPSF
                   130        140        150        160        170        180

190        200        210        220        230        240
    m239.pep  RRHMTCGNTAPTSSSSRLIKMRTAWKVRVAGSCPRSRVRTFCATICASLRVVSIGLSARC
              ||||||||||||||||||||||| ||||||||||||||||||||||||||||||||||||
      g239    RRHMTCGNTAPTSSSSRLIKMRIAWKVRVAGSCPRSRVRTFCATICASLRVVSIGLSARC
                   190        200        210        220        230        240

250
    m239.pep  ATMARAIRRLNRSSPX
              |||||:| ||||||||
      g239    ATMARTIWRLNRSSPX
                   250
```

The following partial DNA sequence was identified in *N. meningitidis* <SEQ ID 897>:

```
a239.seq
    1    ATGCTCCACC ATAAAGGTAT TGCCCGAAAC CGGCGGATGG AGGTTTTGTT

51    TTTCTGCCGC CGCCCTGATC GCTTCGTGGT TCGCCAAACG CGCCTGTTGC

101    AGCCTCATTT GCGCATAATC CTGCTCCAAG GCGATTTCCT GTTTTTTCGC

151    CTTATCCAAA GCTGTGAAGT TGAGCCTGTA CTGGTTTTGC TGCATCACAA

201    CGGAAAAAGC GGAAACGCAC ACCGCAAGCA GCAGAAGGAA ATTCAATTTG

251    TTCATTGCCA TTCAGACGTT TTTCTCTGTG ATTGTTCCGG TATCGGACCG

301    GCAGTCCGCT CCGCCACACG CAAAACCGCA CTTCTCGCCC TCGGATTGGC

351    GGCAATTTCC GCCTCACCCG GCTTTAATGC CCTGCCCGCG ATTTTCAGGG

401    GCGGCTCGGG CAAATCCGCT TCCCTGACCG CCGCCCAGCG CGGCAGGGGC

451    GCGTGTTGCG AATATTTTTT GACAAACTGC TTCACAATGC GGTCTTCCAA

501    CGAATGGAAA GCAATGACCG CCAAACGTCC GCCCTCTTTC AGACGACACA

551    TGACCTGCGG CAATACTGCC CCTACTTCTT CAAGCTCGCG GTTAATAAAG

601    ATGCGGATTG CCTGGAAGGT GCGCGTCGCA GGATCCTGCC CCCGCTCGCG

651    AGTACGGACG TTTTGTGCCA CGATCTGCGC CAGCTTGCGG GTTGTATCGA
```

```
    701   TTGGACTTTC CGCCCGTTGC GCAACAATGG CGCGCGCAAT CTGGCGGCTA

751   AACCGCTCTT CACCATAA
```

This corresponds to the amino acid sequence <SEQ ID 898; ORF 239.a>:

```
a239.pep
      1   MLHHKGIARN RRMEVLFFCR RPDRFVVRQT RLLQPHLRII LLQGDFLFFR

51   LIQSCEVEPV LVLLHHNGKS GNAHRKQQKE IQFVHCHSDV FLCDCSGIGP

101   AVRSATRKTA LLALGLAAIS ASPGFNALPA IFRGGSGKSA SLTAAQRGRG

151   ACCEYFLTNC FTMRSSNEWK AMTAKRPPSF RRHMTCGNTA PTSSSSRLIK

201   MRIAWKVRVA GSCPRSRVRT FCATICASLR VVSIGLSARC ATMARAIWRL

251   NRSSP*
``` m239/a239 97.3% identity in 255 aa overlap

```
                   10         20         30         40         50         60
     m239.pep  MLHHKGXARNRXMEVLFFCRRPDRFVVRQTRLLQPHLRIILLQGDFLFFRLIQSCEIEPV
               ||||||  |||| ||||||||||||||||||||||||||||||||||||||||||:|||
     a239      MLHHKGIARNRRMEVLFFCRRPDRFVVRQTRLLQPHLRIILLQGDFLFFRLIQSCEVEPV
                   10         20         30         40         50         60

70         80         90        100        110        120
     m239.pep  LVLLHHNGKSGNAHRKQQKEIQFVHCHSDVFLCDCSGIGPAVRSATRKTALLALGLAAIS
               ||||||||||||||||||||||||||||||||||||||||||||||||||||||||||||
     a239      LVLLHHNGKSGNAHRKQQKEIQFVHCHSDVFLCDCSGIGPAVRSATRKTALLALGLAAIS
                   70         80         90        100        110        120

130        140        150        160        170        180
     m239.pep  ASPGFNALPTIFRGSSGKSASLTAAQRGRGACCEYFLTNCFTMRSSNEWKAMTAKRPPSF
               |||||||||:||||:|||||||||||||||||||||||||||||||||||||||||||||
     a239      ASPGFNALPAIFRGGSGKSASLTAAQRGRGACCEYFLTNCFTMRSSNEWKAMTAKRPPSF
                  130        140        150        160        170        180

190        200        210        220        230        240
     m239.pep  RRHMTCGNTAPTSSSSRLIKMRTAWKVRVAGSCPRSRVRTFCATICASLRVVSIGLSARC
               |||||||||||||||||||||| |||||||||||||||||||||||||||||||||||||
     a239      RRHMTCGNTAPTSSSSRLIKMRIAWKVRVAGSCPRSRVRTFCATICASLRVVSIGLSARC
                  190        200        210        220        230        240

250
     m239.pep  ATMARAIRRLNRSSPX
               ||||||| ||||||||
     a239      ATMARAIWRLNRSSPX
                  250
```

The following partial DNA sequence was identified in *N. gonorrhoeae* <SEQ ID 899>:

```
g240.seq
      1   atgatagaag tcatacattt cttcggcgcc gaaacgcgca gacagtttgc 51   ttgtgccgac gttggacgat ttctgcataa tgccgcgcac atccaaagag 101   gggtaaacat gggtatcatc gcgcacggga gacggtccga ttttataagg 151   ctgcgtattc agccgttcgt tcaaatcggt tttgcccgca tccaatgcct 201   tcgcaatcac gaacggtttg attgccgaac caggttcgat catatcggtt 251   acggcacggt tgcgccgctg ttcgctgtct gcccggccgg gtctgttggg 301   atcgtaggcg ggcgtattgg ccaaggcgag gatttccccc gtgcgggcat 351   ccaaaaccac caccgttccg gcttttgcct gatggtattc gaccgccttg 401   ttcaactctt cataggccaa ggtctgaatc ctctgatcga gggaaaggat 451   gatgtctttg ccgttttgcg gtgctttatt gcgcggggag tccaagctgt
```

```
-continued
501  ccacaatatt gccctgccgg tcccgcaaaa caacttccgc gccgtcttcg 551  ccatacaggc tgtcttcaag cgaaagttcc aaaccttcct gacctttgcc 601  gtcaatatcg gtaaatccga tgacgtgtgc aaacaggttg cccatcgggt 651  aatggcgttt taa
```

This corresponds to the amino acid sequence <SEQ ID 900; ORF 240.ng>:

```
g240.pep
  1    MIEVIHFFGA ETRRQFACAD VGRFLHNAAH IQRGVNMGII AHGRRSDFIR

51    LRIQPFVQIG FARIQCLRNH ERFDCRTRFD HIGYGTVAPL FAVCPAGSVG

101    IVGGRIGQGE DFPRAGIQNH HRSGFCLMVF DRLVQLFIGQ GLNPLIEGKD

151    DVFAVLRCFI ARGVQAVHNI ALPVPQNNFR AVFAIQAVFK RKFQTFLTFA

201    VNIGKSDDVC KQVAHRVMAF *
```

The following partial DNA sequence was identified in *N. meningitidis* <SEQ ID 901>:

```
m240.seq
  1    ATGATAGAAG TCATACATTT CTTCGGCACC GAAACGCGCA GACAGTTTGC

51    TTGTGCCGAC GTTGGACGAT TTCTGCATGA TGCCGCGCAC ATCCAAAGAG

101    GGGTAAACAT GGGTATCGCG CACGGGAGAC GGTCCGATTT TATAAGGCTG

151    CGTATTCAGC CGTTCGTTCA AATCGGTTTT GCCCGCATCC AATGCCTTCG

201    CAATCACAAA CGGTTTGATT GCCGAACCGG GTTCGATCAT ATCGGTTACG

251    GCACGGTTGC GCCGCTGTTC GCTGTCTGCC CGGCCGGGCC TGTTGGGATC

301    GTAGGCGGGC GTATTGGCCA AGGCGAGGAT TTCCCCCGTG CGGGCATCCA

351    ArACCACCAC CGTTCCGGCT TTTGCCTGAT GGTATTCGAC CGCCTTGTTC

401    AACTCTTCAT AGGCCAAGGT CTGAATCCTC TGATCGAGGG AAAGGATGAT

451    GTCTTTGCCG TTTTTCGGGG CTTTAkTGCG CGGGGAGTCC AAGCTGTCCA

501    CAATATTGCC CTGCCGGTCC CGCAAAACGA CTTCCGCGCC GTCTTCGCCA

551    TGCAAGCTGT CTTCAAGCGA AAGTTCCAAA CCTTCCTGAC CTTTGCCGTC

601    AATATCGGTA AATCCGATGA CGTGTGCAAA CAGGTTGCCC ATCGGGTAAT

651    GGCGTTTTAA
```

This corresponds to the amino acid sequence <SEQ ID 902; ORF 240>:

```
m240.pep
  1    MIEVIHFFGT ETRRQFACAD VGRFLHDAAH IQRGVNMGIA HGRRSDFIRL

51    RIQPFVQIGF ARIQCLRNHK RFDCRTGFDH IGYGTVAPLF AVCPAGPVGI

101    VGGRIGQGED FPRAGIQXHH RSGFCLMVFD RLVQLFIGQG LNPLIEGKDD

151    VFAVFRGFXA RGVQAVHNIA LPVPQNDFRA VFAMQAVFKR KFQTFLTFAV

201    NIGKSDDVCK QVAHRVMAF*
```

Computer analysis of this amino acid sequence gave the following results:
Homology with a Predicted ORF from *N. gonorrhoeae*
ORF 240 shows 94.5% identity over a 220 aa overlap with a predicted ORF (ORF 240.ng) from *N. gonorrhoeae*:

```
m240/g240
                   10        20        30         40        50       59
m240.pep   MIEVIHFFGTETRRQFACADVGRFLHDAAHIQRGVNMGI-AHGRRSDFIRLRIQPFVQIG
           |||||||||:||||||||||||||||:|||||||||||| ||||||||||||||||||||
g240       MIEVIHFFGAETRRQFACADVGRFLHNAAHIQRGVNMGIIAHGRRSDFIRLRIQPFVQIG
                   10        20        30        40        50        60

60        70        80        90       100       110      119
m240.pep   FARIQCLRNHKRFDCRTGFDHIGYGTVAPLFAVCPAGPVGIVGGRIGQGEDFPRAGIQXH
           ||||||||||:|||||| ||||||||||||||||||| |||||||||||||||||||| |
g240       FARIQCLRNHERFDCRTRFDHIGYGTVAPLFAVCPAGSVGIVGGRIGQGEDFPRAGIQNH
                   70        80        90       100       110       120

120       130       140       150       160       170      179
m240.pep   HRSGFCLMVFDRLVQLFIGQGLNPLIEGKDDVFAVFRGFXARGVQAVHNIALPVPQNDFR
           |||||||||||||||||||||||||||||||||||:| | |||||||||||||||||:||
g240       HRSGFCLMVFDRLVQLFIGQGLNPLIEGKDDVFAVLRCFIARGVQAVHNIALPVPQNNFR
                  130       140       150       160       170       180

180       190       200       210       220
m240.pep   AVFAMQAVFKRKFQTFLTFAVNIGKSDDVCKQVAHRVMAFX
           ||||:|||||||||||||||||||||||||||||||||||
g240       AVFAIQAVFKRKFQTFLTFAVNIGKSDDVCKQVAHRVMAF
                  190       200       210       220
```

The following partial DNA sequence was identified in *N. meningitidis* <SEQ ID 903>:

```
a240.seq
     1  ATGATAGAAG TCATACATTT CTTCGGCACC GAAACGCGCA GACAGTTTGC

51  TTGTGCCGAC GTTGGACGAT TTCTGCATGA TGCCGCGCAC ATCCAAAGAG

101  GGGTAAACAT GGGTATCGCG CACGGGAGAC GGTCCGATTT TATAAGGCTG

151  CGTATTCAGC CGTTCGTTCA AATCGGTTTT GCCCGCATCC AATGCCTTCG

201  CAATCACAAA CGGTTTGATT GCCGAACCGG GTTCGATCAT ATCGGTTACG

251  GCACGGTTGC GCCGCTGTTC GCTGTCTGCC CGGCCGGGCC TGTTGGGATC

301  GTAGGCGGGC GTATTGGCCA AGGCGAGGAT TTCCCCCGTG CGGGCATCCA

351  AAACCACCAC CGTTCCGGCT TTTGCCTGAT GGTATTCGAC CGCCTTGTTC

401  AACTCTTCAT AGGCCAAGGT CTGAATCCTC TGATCGAGGG AAAGGATGAT

451  GTCTTTGCCG TTTTTCGGGG CTTTATTGCG CGGGGAGTCC AAGCTGTCCA

501  CAATATTGCC CTGCCGGTCC CGCAAAACGA CTTCCGCGCC GTCTTCGCCA

551  TGCAGGCTGT CTTCAAGCGA AAGTTCCAAA CCTTCCTGAC CTTTGCCGTC

601  AATATCGGTA AATCCGATGA CGTGTGCAAA CAGGTTGCCC ATCGGGTAAT

651  GGCGTTTTAA
```

This corresponds to the amino acid sequence <SEQ ID 904; ORF 240.a>:

```
a240.pep
     1  MIEVIHFFGT ETRRQFACAD VGRFLHDAAH IQRGVNMGIA HGRRSDFIRL

51  RIQPFVQIGF ARIQCLRNHK RFDCRTGFDH IGYGTVAPLF AVCPAGPVGI

101  VGGRIGQGED FPRAGIQNHH RSGFCLMVFD RLVQLFIGQG LNPLIEGKDD

151  VFAVFRGFIA RGVQAVHNIA LPVPQNDFRA VFAMQAVFKR KFQTFLTFAV

201  NIGKSDDVCK QVAHRVMAF*
``` m240/a240 99.1% identity in 219 aa overlap

```
              10         20         30         40         50         60
m240.pep  MIEVIHFFGTETRRQFACADVGRFLHDAAHIQRGVNMGIAHGRRSDFIRLRIQPFVQIGF
          ||||||||||||||||||||||||||||||||||||||||||||||||||||||||||||
a240      MIEVIHFFGTETRRQFACADVGRFLHDAAHIQRGVNMGIAHGRRSDFIRLRIQPFVQIGF
              10         20         30         40         50         60

70         80         90        100        110        120
m240.pep  ARIQCLRNHKRFDCRTGFDHIGYGTVAPLFAVCPAGPVGIVGGRIGQGEDFPRAGIQXHH
          ||||||||||||||||||||||||||||||||||||||||||||||||||||||||| ||
a240      ARIQCLRNHKRFDCRTGFDHIGYGTVAPLFAVCPAGPVGIVGGRIGQGEDFPRAGIQNHH
              70         80         90        100        110        120

130        140        150        160        170        180
m240.pep  RSGFCLMVFDRLVQLFIGQGLNPLIEGKDDVFAVFRGFXARGVQAVHNIALPVPQNDFRA
          |||||||||||||||||||||||||||||||||||||| |||||||||||||||||||||
a240      RSGFCLMVFDRLVQLFIGQGLNPLIEGKDDVFAVFRGFIARGVQAVHNIALPVPQNDFRA
             130        140        150        160        170        180

190        200        210        220
m240.pep  VFAMQAVFKRKFQTFLTFAVNIGKSDDVCKQVAHRVMAFX
          ||||||||||||||||||||||||||||||||||||||||
a240      VFAMQAVFKRKFQTFLTFAVNIGKSDDVCKQVAHRVMAFX
             190        200        210        220
```

The following partial DNA sequence was identified in *N. gonorrhoeae* <SEQ ID 905>:

```
g241.seq
    1   ATGATAGAAG TCATACATTT CTTCGGCACC GAAACGCGCA GACAGTTTGC

51   TTGTGCCGAC GTTGGACGAT TTCTGCATGA TGCCGCGCAC ATCCAAAGAG

101   GGGTAAACAT GGGTATCGCG CACGGGAGAC GGTCCGATTT TATAAGGCTG

151   CGTATTCAGC CGTTCGTTCA AATCGGTTTT GCCCGCATCC AATGCCTTCG

201   CAATCACAAA CGGTTTGATT GCCGAACCGG GTTCGATCAT ATCGGTTACG

251   GCACGGTTGC GCCGCTGTTC GCTGTCTGCC CGGCCGGGCC TGTTGGGATC

301   GTAGGCGGGC GTATTGGCCA AGGCGAGGAT TTCCCCCGTG CGGGCATCCA

351   ArACCACCAC CGTTCCGGCT TTTGCCTGAT GGTATTCGAC CGCCTTGTTC

401   AACTCTTCAT AGGCCAAGGT CTGAATCCTC TGATCGAGGG AAAGGATGAT

451   GTCTTTGCCG TTTTTCGGGG CTTTAkTGCG CGGGGAGTCC AAGCTGTCCA

501   CAATATTGCC CTGCCGGTCC CGCAAAACGA CTTCCGCGCC GTCTTCGCCA

551   TGCAAGCTGT CTTCAAGCGA AAGTTCCAAA CCTTCCTGAC CTTTGCCGTC

601   AATATCGGTA AATCCGATGA CGTGTGCAAA CAGGTTGCCC ATCGGGTAAT

651   GGCGTTTTAA
                                                50
```

This corresponds to the amino acid sequence <SEQ ID 906; ORF 241.ng>:

```
g241.pep
    1   MPTRPTRAAN PPTPTTWLQT AYCPRPPYRP PSVQTHTPHE PASSTCAAKS

51   ANRRENSHNA QPTYLLHPSN KMPSETEQTL FRRHQIPPSC RQSVVVMTVR

101   TVDMTVCDFL IGCIAHAFNR SFKADFHACQ RMVAVHHRLA VGNIGYTIDD

151   NIAGFRIVRF KHHTDLDFNR ERARIFNTDQ LRIMLTERIV GRKRHFDRIA

201   GILTVQRLFH QRENAVVTAV QIRNRFFGFI QKLIVGIIHL IMQRNHGIFC

251   NSHICPFRNS RLITGAF*
                                                65
```

The following partial DNA sequence was identified in *N. meningitidis* <SEQ ID 907>:

```
m241.seq (partial)
    1  ..CGGCAATCAG TGGTGGTGAT GACCGTGCGG GCCGTGGACA TGACCGTGTG

51    CGATTTCCTC ATCGGATGCA TCGCGCACGC TTTCAACTGT AGCCTTAAAG

101    CGGATTTTCA TGCCTGCCAA AGGATGGTTG CCGTCCACCA CCGCCTTGCC

151    GTCGGCAACA TCGGTTACAC GATAGACGAC AACATCGCCG GTTTCAGGAT

201    CGTCGGCTTC AAACATCATG CCGACTTCGA CTTCAACAGG GAACACGCCC

251    GCATCTTCGA TACGGACCAA CTCCGGATCC TGCTCGCCGA ACGCATCGTC

301    GGGCGACAGC GCCACATCGA CCGTATCGCC GGCATCCTTA CCGTGCAACG

351    CCTCTTCCAC CAAAGGGAAA ATGCCGTCGT AACCGCCGTG CAGATACGCA

401    ATCGGTTCTT CGGTTTTGTC CAAAAGCTGA TTGTTGGCAT CATACATCTC

451    ATAATGCAGC GAAACCACGG AATTTTTCAC GATAGCCATA TTTGTCCTTT

501    CAGGAACAGC AGATTAATTA CAGGCGCATT CTAA
```

This corresponds to the amino acid sequence <SEQ ID 908; ORF 241>:

```
m241.pep (partial)
    1  ..RQSVVVMTVR AVDMTVCDFL IGCIAHAFNC SLKADFHACQ RMVAVHHRLA

51    VGNIGYTIDD NIAGFRIVGF KHHADFDFNR EHARIFDTDQ LRILLAERIV

101    GRQRHIDRIA GILTVQRLFH QRENAVVTAV QIRNRFFGFV QKLIVGIIHL

151    IMQRNHGIFH DSHICPFRNS RLITGAF*
```

Computer analysis of this amino acid sequence gave the following results:
Homology with a Predicted ORF from *N. gonorrhoeae*
ORF 241 shows 91.5% identity over a 177 aa overlap with a predicted ORF (ORF 241.ng) from *N. gonorrhoeae*:

```
m241/g241
                                                10        20        30
     m241.pep                            RQSVVVMTVRAVDMTVCDFLIGCIAHAFNC
                                         |||||||||||:||||||||||||||||||
     g241     QPTYLLHPSNKMPSETEQTLFRRHQIPPSCRQSVVVMTVRTVDMTVCDFLIGCIAHAFNR
                     70        80        90       100       110       120

40        50        60        70        80        90
     m241.pep SLKADFHACQRMVAVHHRLAVGNIGYTIDDNIAGFRIVGFKHHADFDFNREHARIFDTDQ
              |:||||||||||||||||||||||||||||||||||||| ||||:|:||||:||||:|||
     g241     SFKADFHACQRMVAVHHRLAVGNIGYTIDDNIAGFRIVRFKHHTDLDFNRERARIFNTDQ
                     130       140       150       160       170       180

100       110       120       130       140       150
     m241.pep LRILLAERIVGRQRHIDRIAGILTVQRLFHQRENAVVTAVQIRNRFFGFVQKLIVGIIHL
              |||:|:||||||:|:|||:|||||||||||||||||||||||||||||:||||||||||
     g241     LRIMLTERIVGRKRHFDRIAGILTVQRLFHQRENAVVTAVQIRNRFFGFIQKLIVGIIHL
                     190       200       210       220       230       240

160       170
     m241.pep IMQRNHGIFHDSHICPFRNSRLITGAFX
              |||||||||:||||||||||||||||||
     g241     IMQRNHGIFCNSHICPFRNSRLITGAFX
                     250       260
```

The following partial DNA sequence was identified in *N. meningitidis* <SEQ ID 909>:

```
a241.seq
    1    ATGCCAACAC GTCCAACTCG CGCCGCAAAG CATCCAACCC CGCCAACCTG

51    GCTTCAGACG GCATACTGCC CTCGTCCGCC ATATCGTCCG CCGTCCGTGC

101    AAACGCATAC ACCGCATGAA CCGGCTTCCT CAACCTGCGC GGCAAAATCA
```

-continued

```
151  GCGAACCGAC GGGAAAATTT TCATAATGCC CAACCGACAT ACCTTCTCCA

201  TCCATCAAAC AAAATGCCGT CTGAAATGGA ACAAACCCTT TTCAGACGGC

251  ATCAGATACC TCCAAGCTGC CGGCAATCAG TGGTGGTGAT GACCGTGCGG

301  ACCGTGGACA TGACCGTGTG CGATTTCCTC ATCGGATGCA TCGCGCACAC

351  TTTCAACCGT AGCCTTAAAG CGGATTTTCA TGCCTGCCAA AGGATGGTTG

401  CCGTCCACCA CCGCCTTACC GTCGGCAACA TCGGTTACAC GATAGACGAC

451  AACATCGCCG GTTTCAGGAT CGTCGGCTTC AAACATCATG CCGACTTCGA

501  CTTCAACAGG GAACACGCCC GCATCTTCAA TACGGACCAA CTCCGGATCC

551  TGCTCGCCGA ACGCATCGTC GGGCGAAAGC GCCACATCGA CCGTATCGCC

601  GGCATCCTTA CCGTGCAACG CCTCTTCCAC CAAAGGGAAA ATGCCGTCGT

651  AACCGCCGTG CAGATACGCA ATCGGTTCTT CGGTTTTGTC CAAAAGCTGA

701  TTGTTGGCAT CATACATCTC ATAATGCAGC GAAACCACGG AATTCTTCAC

751  GATAGCCATA TTTGTCCTTT CAGGAACAGC AGATTAATTA CAGGCGCATT

801  CTAA
```

This corresponds to the amino acid sequence <SEQ ID 910; ORF 241.a>:

```
a241.pep
  1  MPTRPTRAAK HPTPPTWLQT AYCPRPPYRP PSVQTHTPHE PASSTCAAKS

51  ANRRENFHNA QPTYLLHPSN KMPSEMEQTL FRRHQIPPSC RQSVVVMTVR

101  TVDMTVCDFL IGCIAHTFNR SLKADFHACQ RMVAVHHRLT VGNIGYTIDD

151  NIAGFRIVGF KHHADFDFNR EHARIFNTDQ LRILLAERIV GRKRHIDRIA

201  GILTVQRLFH QRENAVVTAV QIRNRFFGFV QKLIVGIIHL IMQRNHGILH

251  DSHICPFRNS RLITGAF*
``` m241/a241 96.0% identity in 177 aa overlap

```
                                        10         20         30
    m241.pep                    RQSVVVMTVRAVDMTVCDFLIGCIAHAFNC
                                ||||||||||:||||||||||||||||:||
    a241     QPTYLLHPSNKMPSEMEQTLFRRHQIPPSCRQSVVVMTVRTVDMTVCDFLIGCIAHTFNR
                70        80        90       100       110       120
              40        50        60        70        80        90
    m241.pep SLKADFHACQRMVAVHHRLAVGNIGYTIDDNIAGFRIVGFKHHADFDFNREHARIFDTDQ
             ||||||||||||||||||||:|||||||||||||||||||||||||||||||||||:|||
    a241     SLKADFHACQRMVAVHHRLTVGNIGYTIDDNIAGFRIVGFKHHADFDFNREHARIFNTDQ
             130       140       150       160       170       180
              100       110       120       130       140       150
    m241.pep LRILLAERIVGRQRHIDRIAGILTVQRLFHQRENAVVTAVQIRNRFFGFVQKLIVGIIHL
             |||||||||||:||||||||||||||||||||||||||||||||||||||||||||||||
    a241     LRILLAERIVGRKRHIDRIAGILTVQRLFHQRENAVVTAVQIRNRFFGFVQKLIVGIIHL
             190       200       210       220       230       240
              160       170
    m241.pep IMQRNHGIPHDSHICPFRNSRLITGAFX
             |||||||||:||||||||||||||||||
    a241     IMQRNHGILHDSHICPFRNSRLITGAFX
             250       260
```

The following partial DNA sequence was identified in *N. gonorrhoeae* <SEQ ID 911>:

```
g241-1.seq
      1     ATGATAGAAG TCATACATTT CTTCGGCACC GAAACGCGCA GACAGTTTGC
     51     TTGTGCCGAC GTTGGACGAT TTCTGCATGA TGCCGCGCAC ATCCAAAGAG
    101     GGGTAAACAT GGGTATCGCG CACGGGAGAC GGTCCGATTT TATAAGGCTG
    151     CGTATTCAGC CGTTCGTTCA AATCGGTTTT GCCCGCATCC AATGCCTTCG
    201     CAATCACAAA CGGTTTGATT GCCGAACCGG GTTCGATCAT ATCGGTTACG
    251     GCACGGTTGC GCCGCTGTTC GCTGTCTGCC CGGCCGGGCC TGTTGGGATC
    301     GTAGGCGGGC GTATTGGCCA AGGCGAGGAT TTCCCCCGTG CGGGCATCCA
    351     ArACCACCAC CGTTCCGGCT TTTGCCTGAT GGTATTCGAC CGCCTTGTTC
    401     AACTCTTCAT AGGCCAAGGT CTGAATCCTC TGATCGAGGG AAAGGATGAT
    451     GTCTTTGCCG TTTTTCGGGG CTTTAkTGCG CGGGGAGTCC AAGCTGTCCA
    501     CAATATTGCC CTGCCGGTCC CGCAAAACGA CTTCCGCGCC GTCTTCGCCA
    551     TGCAAGCTGT CTTCAAGCGA AAGTTCCAAA CCTTCCTGAC CTTTGCCGTC
    601     AATATCGGTA AATCCGATGA CGTGTGCAAA CAGGTTGCCC ATCGGGTAAT
    651     GGCGTTTTAA
```

This corresponds to the amino acid sequence <SEQ ID 912; ORF 241-1.ng>:

```
g241-1.pep
      1     MPTRPTRAAN PPTPTTWLQT AYCPRPPYRP PSVQTHTPHE PASSTCAAKS
     51     ANRRENSHNA QPTYLLHPSN KMPSETEQTL FRRHQIPPSC RQSVVVMTVR
    101     TVDMTVCDFL IGCIAHAFNR SFKADFHACQ RMVAVHHRLA VGNIGYTIDD
    151     NIAGFRIVRF KHHTDLDFNR ERARIFNTDQ LRIMLTERIV GRKRHFDRIA
    201     GILTVQRLFH QRENAVVTAV QIRNRFFGFI QKLIVGIIHL IMQRNHGIFC
    251     NSHICPFRNS RLITGAF*
```

The following partial DNA sequence was identified in *N. meningitidis* <SEQ ID 913>:

```
m241-1.seq
      1     ATGCCAACAC GTCCAACTCG CGCTGCAAAC CCTCCAACCC CGCCAACCTG
     51     GCTTCAGACG GCATACTGCC CTCGTCCGCC ATATCGTCCG CCGTCCGTGC
    101     AAACGCGTAC ACCGCGTGAA CCGGCTTCCT CAACCTGCGC GGCAAAATCA
    151     GCGAACCGAC GGGAAAATTC TCATAATGCC CAACCGACAT ACCTTCTCCA
    201     TCCATCAAAC AAAATGCCGT CTGAAACGGA ACAAACCCTT TTCAGACGGC
    251     ATCAGATACC TCCAAGCTGC CGGCAATCAG TGGTGGTGAT GACCGTGCGG
    301     GCCGTGGACA TGACCGTGTG CGATTTCCTC ATCGGATGCA TCGCGCACGC
    351     TTTCAACTGT AGCCTTAAAG CGGATTTTCA TGCCTGCCAA AGGATGGTTG
    401     CCGTCCACCA CCGCCTTGCC GTCGGCAACA TCGGTTACAC GATAGACGAC
    451     AACATCGCCG GTTTCAGGAT CGTCGGCTTC AAACATCATG CCGACTTCGA
    501     CTTCAACAGG GAACACGCCC GCATCTTCGA TACGGACCAA CTCCGGATCC
    551     TGCTCGCCGA ACGCATCGTC GGGCGACAGC GCCACATCGA CCGTATCGCC
    601     GGCATCCTTA CCGTGCAACG CCTCTTCCAC CAAAGGGAAA ATGCCGTCGT
    651     AACCGCCGTG CAGATACGCA ATCGGTTCTT CGGTTTTGTC CAAAAGCTGA
```

-continued

```
701    TTGTTGGCAT CATACATCTC ATAATGCAGC GAAACCACGG AATTTTTCAC

751    GATAGCCATA TTTGTCCTTT CAGGAACAGC AGATTAATTA CAGGCGCATT

801    CTAA
```

This corresponds to the amino acid sequence <SEQ ID 914; ORF 241-1>:

```
m241-1.pep
      1    MPTRPTRAAN PPTPPTWLQT AYCPRPPYRP PSVQTRTPRE PASSTCAAKS

51    ANRRENSHNA QPTYLLHPSN KMPSETEQTL FRRHQIPPSC RQSVVVMTVR

101    AVDMTVCDFL IGCIAHAFNC SLKADFHACQ RMVAVHHRLA VGNIGYTIDD

151    NIAGFRIVGF KHHADFDFNR EHARIFDTDQ LRILLAERIV GRQRHIDRIA

201    GILTVQRLFH QRENAVVTAV QIRNRFFGFV QKLIVGIIHL IMQRNHGIFH

251    DSHICPFRNS RLITGAF*
``` m241-1/g241-1 93.3% identity in 267 aa overlap

```
                    10         20         30         40         50         60
m241-1.pep  MPTRPTRAANPPTPPTWLQTAYCPRPPYRPPSVQTRTPREPASSTCAAKSANRRENSHNA
            ||||||||||||||| |||||||||||||||||||| ::||:||||||||||||||||||
g241        MPTRPTRAANPPTPTTWLQTAYCPRPPYRPPSVQTHTPHEPASSTCAAKSANRRENSHNA
                    10         20         30         40         50         60

70         80         90        100        110        120
m241-1.pep  QPTYLLHPSNKMPSETEQTLFRRHQIPPSCRQSVVVMTVRAVDMTVCDFLIGCIAHAFNC
            |||:||||||||||||||||||||||||||||||||||||:|||||||||||||||||| 
g241        QPTVLLHPSNKMPSETEQTLFRRHQIPPSCRQSVVVMTVRTVDMTVCDFLIGCIAHAFNR
                    70         80         90        100        110        120

130        140        150        160        170        180
m241-1.pep  SLKADFHACQRMVAVHHRLAVGNIGYTIDDNIAGFRIVGFKHHADFDFNREHARIFDTDQ
            :||||||||||||||||||||||||||||||||||||| ||||:|:||||:||||:|||
g241        SFKADFHACQRMVAVHHRLAVGNIGYTIDDNIAGFRIVRFKHHTDLDFNRERARIFNTDQ
                   130        140        150        160        170        180

190        200        210        220        230        240
m241-1.pep  LRILLAERIVGRQRHIDRIAGILTVQRLFHQRENAVVTAVQIRNRFFGFVQKLIVGIIKL
            |||:|:||||||:||:|||||||||||||||||||||||||||||||||:||||||||| 
g241        LRIMLTERIVGRKRHFDRIAGILTVQRLFHQRENAVVTAVQIRNRFFGFIQKLIVGIIHL
                   190        200        210        220        230        240

250        260
m241-1.pep  IMQRNHGIFHDSHICPFRNSRLITGAFX
            |||||||||:||||||||||||||||||
g241        IMQRNHGIFCNSHICPFRNSRLITGAFX
                   250        260
```

The following partial DNA sequence was identified in N. meningitidis <SEQ ID 915>:

```
a241-1.seq
      1    ATGCCAACAC GTCCAACTCG CGCCGCAAAG CATCCAACCC CGCCAACCTG

51    GCTTCAGACG GCATACTGCC CTCGTCCGCC ATATCGTCCG CCGTCCGTGC

101    AAACGCATAC ACCGCATGAA CCGGCTTCCT CAACCTGCGC GGCAAAATCA

151    GCGAACCGAC GGGAAAATTT TCATAATGCC CAACCGACAT ACCTTCTCCA

201    TCCATCAAAC AAAATGCCGT CTGAAATGGA CAAACCCTT TTCAGACGGC

251    ATCAGATACC TCCAAGCTGC CGGCAATCAG TGGTGGTGAT GACCGTGCGG

301    ACCGTGGACA TGACCGTGTG CGATTTCCTC ATCGGATGCA TCGCGCACAC

351    TTTCAACCGT AGCCTTAAAG CGGATTTTCA TGCCTGCCAA AGGATGGTTG

401    CCGTCCACCA CCGCCTTACC GTCGGCAACA TCGGTTACAC GATAGACGAC
```

```
451    AACATCGCCG GTTTCAGGAT CGTCGGCTTC AAACATCATG CCGACTTCGA

501    CTTCAACAGG AACACGCCC GCATCTTCAA TACGGACCAA CTCCGGATCC

551    TGCTCGCCGA ACGCATCGTC GGGCGAAAGC GCCACATCGA CCGTATCGCC

601    GGCATCCTTA CCGTGCAACG CCTCTTCCAC CAAAGGGAAA ATGCCGTCGT

651    AACCGCCGTG CAGATACGCA ATCGGTTCTT CGGTTTTGTC CAAAAGCTGA

701    TTGTTGGCAT CATACATCTC ATAATGCAGC GAAACCACGG AATTCTTCAC

751    GATAGCCATA TTTGTCCTTT CAGGAACAGC AGATTAATTA CAGGCGCATT

801    CTAA
```

This corresponds to the amino acid sequence <SEQ ID 916; ORF 241-1.a>:

```
a241-1.pep
    1   MPTRPTRAAK HPTPPTWLQT AYCPRPPYRP PSVQTHTPHE PASSTCAAKS

51   ANRRENFHNA QPTYLLHPSN KMPSEMEQTL FRRHQIPPSC RQSVVVMTVR

101   TVDMTVCDFL IGCIAHTFNR SLKADFHACQ RMVAVHHRLT VGNIGYTIDD

151   NIAGFRIVGF KHHADFDFNR EHARIFNTDQ LRILLAERIV GRKRHIDRIA

201   GILTVQRLFH QRENAVVTAV QIRNRFFGFV QKLIVGIIHL IMQRNHGILH

251   DSHICPFRNS RLITGAF*
``` m241-1/a241-1 95.1% identity in 267 aa overlap

```
                10         20         30         40         50         60
m241-1.pep  MPTRPTRAANPPTPPTWLQTAYCPRPPYRPPSVQTRTPREPASSTCAAKSANRRENSHNA
            ||||||||| :|||||||||||||||||||||||| :||:|||||||||||||||| |||
a241        MPTRPTRAAKHPTPPTWLQTAYCPRPPYRPPSVQTHTPHEPASSTCAAKSANRRENFHNA
                10         20         30         40         50         60

70         80         90        100        110        120
m241-1.pep  QPTYLLHPSNKMPSETEQTLFRRHQIPPSCRQSVVVMTVRAVDMTVCDFLIGCIAHAFNC
            ||||||||||||||: ||||||||||||||||||||||||:||||||||||||||||:||
a241        QPTYLLHPSNKMPCEMEQTLFRRHQIPPSCRQSVVVMTVRTVDMTVCDFLIGCIAHTFNR
                70         80         90        100        110        120

130        140        150        160        170        180
m241-1.pep  SLKADFHACQRMVAVHHRLAVGNIGYTIDDNIAGFRIVGFKHHADFDFNREHARIFDTDQ
            ||||||||||||||||||||:|||||||||||||||||||||||||||||||||||:|||
a241        SLKADFHACQRMVAVHHRLTVGNIGYTIDDNIAGFRIVGFKHHADFDFNREHARIFNTDQ
               130        140        150        160        170        180

190        200        210        220        230        240
m241-1.pep  LRILLAERIVGRQRHIDRIAGILTVQRLFHQRENAVVTAVQIRNRFFGFVQKLIVGIIHL
            |||||||||||:||||||||||||||||||||||||||||||||||||||||||||||||
a241        LRILLAERIVGRKRHIDRIAGILTVQRLFHQRENAVVTAVQIRNRFFGFVQKLIVGIIHL
               190        200        210        220        230        240

250        260
m241-1.pep  IMQRNHGIFHDSHICPFRNSRLITGAFX
            ||||||||:|||||||||||||||||||
a241        IMQRNHGILHDSHICPFRNSRLITGAFX
               250        260
```

The following partial DNA sequence was identified in *N. gonorrhoeae* <SEQ ID 917>:

```
g242.seq
    1   atgatcggcg aacttgttgt tttgttcgtg atcgagcact tcaagcaacg 51   cgctggcggg atcgccccga aagtcgctgc ccaatttgtc gatttcgtcg 101   agcaggaaca acgggtttct tacgcctgct tttgccatat tctgcaaaat 151   cttgccgggc ataggaccga tataggtacg gcggtgcccg cggatttcgc 201   tttcgtcgcg cacgccgccc aaggccatac ggacatattt ccgccccgtt
```

-continued

```
251  gctttggcga tggattcgcc caaagaggtt ttgcccacgc ccggagggcc 301  gaccaaacac agaatcggac ctttgagctt gtccatacgt ttttggacgg 351  cgaggtattc caaaatccgt tctttgactt tttccaggcc gtagtggtcg 401  gcatccagca ccagtccggc tttggcgatg tctttgctga cgcgggattt 451  tttcttccac ggcagtccga gcagggtgtc gatgtagttg cgtacgacgg 501  tggattcggc agacatcggc ggcatcattt tgagttttt cagttcggac 551  aggcatttt cttccgcttc tttggtcata cccgccttt tgatgcctgc 601  ctccaaggca tccagttcgc cgttttcgtc ttcttcgccc aattctttgt 651  gtatcgcttt aatctgttcg ttcagataat attcgcgttg ggattttcc 701  atttggcgtt tgacgcgtcc gcgtatgcgt ttttcggcct gcataatgtc 751  gagttcggat tccagctttg ccagcaggaa ttccatccgt ttgccgattt 801  cgggaatctc caaaatctgt tggcgttgcg ccagtttcaa ctgcaaatgc 851  gctgcgaccg tatcggttag
```

This corresponds to the amino acid sequence <SEQ ID 918; ORF 242.ng>:

```
g242.pep
  1  MIGELVVLFV IEHFKQRAGG IAPKVAAQFV DFVEQEQRVS YACFCHILQN

51  LAGHRADIGT AVPADFAFVA HAAQGHTDIF PPRCFGDGFA QRGFAHARRA

101  DQTQNRTFEL VHTFLDGEVF QNPFFDFFQA VVVGIQHQSG FGDVFADAGF

151  FLPRQSEQGV DVVAYDGGFG RHRRHHFEFF QFGQAFFFRF FGHTRLFDAC

201  LQGIQFAVFV FFAQFFVYRF NLFVQIIFAL GFFHLAFDAS AYAFFGLHNV

251  EFGFQLCQQE FHPFADFGNL QNLLALRQFQ LQMRCDRIG*
```

The following partial DNA sequence was identified in *N. meningitidis* <SEQ ID 919>:

```
m242.seq
  1  ATGATCGGCA AACTTGTTGT TTTGTTCGGG ATCGAGCACT TCGAGCAACG

51  CGCTGGCGGG ATCGCCTCGG AAGTCGTTAC CCAATTTGTC GATTTCGTCG

101  AGCAGGAACA AGGGGTTTTT CACGCCGGCT TTTGCCATAT TCTGCAAAAT

151  CTTACCGGGC ATAGAGCCGA TATAGGTGCG GCGGTGTCCC CTGATTTCGC

201  TTTCGTCGCG CACGCCGCCC AAAGCCATGC GGACATATTT CCGCCCCGTT

251  GCTTTGGCGA TGGATTCGCC CAAAGAGGTT TTGCCCACGC CCGGAGGGCC

301  GACCAGGCAC AGAATCGGGC CTTTGAGTTT GTCCATACGT TTTTGGACGG

351  CGAGGTATTC CAAAATCCGT TCTTTGACTT TTTCCAGGCC GTAGTGGTCG

401  GCATCCAGCA CCAGTCCGGC TTTGGCGATG TCTTTGCTGA CGCGGGATTT

451  TTTCTTCCAC GGCAGCTCGA GCAAAGTGTC GATGTAGTTG CGTACGACGG

501  TGGATTCCGC AGACATCGGT GGCATCATTT TGAGCTTTTT CAGTTCGGAC

551  AGGCATTTTT CTTCCGCTTC TTTGGTCATA CCCGCCTTTT TGATATCTGC

601  TTCCAAGGCA TCCAGTTCGC CGTTTTCGTC TTCTTCGCCC AGTTCTTTGT

651  GTATCGCTTT AATCTGTTCG TTCAGATAAT ATTCGCGCTG GGATTTTCC

701  ATTTGGCGTT TGACGCGTCC GCGTATGCGT TTTCGGCCT GCATAATGTC
```

-continued

```
   751  GAGTTCGGAT TCCAGCTGTG CCAGCAGGAA TTCCATCCGT TTGCCGATTT

801  CGGGAATTTC CAAAATCTGT TGGCGTTGCG CCAGTTTCAA CTGCAAATGC

851  GCTGCGACCG TATCGGTTAG
```

This corresponds to the amino acid sequence <SEQ ID 920; ORF 242>:

```
m242.pep
     1  MIGKLVVLFG IEHFEQRAGG IASEVVTQFV DFVEQEQGVF HAGFCHILQN

51  LTGHRADIGA AVSPDFAFVA HAAQSHADIF PPRCFGDGFA QRGFAHARRA

101  DQAQNRAFEF VHTFLDGEVF QNPFFDFFQA VVVGIQHQSG FGDVFADAGF

151  FLPRQLEQSV DVVAYDGGFR RHRWHHFELF QFGQAFFFRF FGHTRLFDIC

201  FQGIQFAVFV FFAQFFVYRF NLFVQIIFAL GFFHLAFDAS AYAFFGLHNV

251  EFGFQLCQQE FHPFADFGNF QNLLALRQFQ LQMRCDRIG*
```

Computer analysis of this amino acid sequence gave the following results:
Homology with a Predicted ORF from *N. gonorrhoeae*
ORF 242 shows 90.3% identity over a 289 as overlap with a predicted ORF (ORF 242.ng) from *N. gonorrhoeae*:
  m242/a24290. 3% identity in 289 aa overlap

```
                  10        20        30        40        50        60
m242.pep  MIGKLVVLFGIEHFEQRAGGIASEVVTQFVDFVEQEQGVFHAGFCHILQNLTGHRADIGA
          |||:||||| ||||:||||||  :|::|||||||||| |  :| ||||||||:||||||:
g242      MIGELVVLFVIEHFKQRAGGIAPKVAAQFVDFVEQEQRVSYACFCHILQNLAGHRADIGT
                  10        20        30        40        50        60

70        80        90       100       110       120
m242.pep  AVSPDFAFVAHAAQSHADIFPPRCFGDGFAQRGFAHARRADQAQNRAFEFVHTFLDGEVF
          ||   ||||||||:|:|||||||||||||||||||||||||:|||:||:||||||||||
g242      AVPADFAFVAHAAQGHTDIFPPRCFGDGFAQRGFAHARRADQTQNRTFELVHTFLDGEVF
                  70        80        90       100       110       120

130       140       150       160       170       180
m242.pep  QNPFFDFFQAVVVGIQHQSGFGDVFADAGFFLPRQLEQSVDVVAYDGGFRRHRWHHFELF
          |||||||||||||||||||||||||||||||||| ||:||||||||||| |||:|||:|
g242      QNPFFDFFQAVVVGIQHQSGFGDVFADAGFFLPRQSEQGVDVVAYDGGFGRHRRHHFEFF
                 130       140       150       160       170       180

190       200       210       220       230       240
m242.pep  QFGQAFFFRFFGHTRLFDICFQGIQFAVFVFFAQFFVYRFNLFVQIIFALGFFHLAFDAS
          ||||||||||||||||||| :|||||||||||||||||||||||||||||||||||||
g242      QFGQAFFFRFFGHTRLFDACLQGIQFAVFVFFAQFFVYRFNLFVQIIFALGFFHLAFDAS
                 190       200       210       220       230       240

250       260       270       280       290
m242.pep  AYAFFGLHNVEFGFQLCQQEFHPFADFGNFQNLLALRQFQLQMRCDRIGX
          |||||||||||||||||||||||||||||:||||||||||||||||||||
g242      AYAFFGLHNVEFGFQLCQQEFHPFADFGNLQNLLALRQFQLQMRCDRIGX
                 250       260       270       280
```

The following partial DNA sequence was identified in *N. meningitidis* <SEQ ID 921>:

```
a242.seq
     1  ATGATCGGCG AACTTGTTGT TTTGCTCGGG ATCAAGCACT TCGAGCAACG

51  CGCTGGCGGG ATCGCCCCGG AAGTCGCTAN CCAATTTGTC GATTTCGTCG

101  AGCAGGAACA ATGGGTTTTT TACGCCGGCT TTTGCCATAT TCTGCAAAAT

151  CTTACCGGGC ATGGAGCCGA TATAGGTGCG GCGGTGTCCC GGATTTCGC

201  TTTCGTCGCG CACGCCGCCC AAAGCCATGC GGACATATTT CCGCCCGTT

251  GCTTTGGCGA TGGATTCGCC CAAAGAGGTT TTGCCCACGC CTGGAGGGCC
```

```
301   GACCAGGCAC AGAATCGGGC CTTTGAGTTT GTCCATACGT TTTTGGACGG

351   CGAGGTATTC CAAAATCCGT TCTTTGACTT TTTCCAGGCC GTAGTGGTCG

401   GTATCCAGCA CCAATCCGGC TTTGGCGATG TCTTTGCTGA CGCGGGATTT

451   TTTCTTCCAC GGCAGTTCGA GCAGGGTGTC GATGTAGTTG CGTACGACGG

501   TGGATTCGGC AGACATCGGC GGCATCATTT TGAGCTTTTT CAGTTCGGAC

551   AGGCATTTTT CTTCCGCTTC TTTGGTCATA CCCGCCTTTT TGATATCTGC

601   TTCCAAGGCA TCCAGTTCGC CGTTTTCGTC TTCTTCGCCC AGTTCTTTGT

651   GTATCGCTTT AATCTGTTCG TTCAGATAAT ATTCGCGCTG GGATTTTTCC

701   ATTTGGCGTT TGACGCGTCC GCGTATGCGT TTTTCGGCCT GCATAATGTC

751   GAGTTCGGAT TCCAGCTGTG CCAGCAGGAA TTCCATCCGT TTGCCGATTT

801   CGGGAATTTC CAAAATCTGT TGGCGTTGCG CCAGTTTCAA CTGCAAATGC

851   GCTGCGACCG TATCGGTTAG
```

This corresponds to the amino acid sequence <SEQ ID 922; ORF 242.a>:

```
a242.pep
    1   MIGELVVLLG IKHFEQRAGG IAPEVAXQFV DFVEQEQWVF YAGFCHILQN

51   LTGHGADIGA AVSPDFAFVA HAAQSHADIF PPRCFGDGFA QRGFAHAWRA

101   DQAQNRAFEF VHTFLDGEVF QNPFFDFFQA VVVGIQHQSG FGDVFADAGF

151   FLPRQFEQGV DVVAYDGGFG RHRRHHFELF QFGQAFFFRF FGHTRLFDIC

201   FQGIQFAVFV FFAQFFVYRF NLFVQIIFAL GFFHLAFDAS AYAFFGLHNV

251   EFGFQLCQQE FHPFADFGNF QNLLALRQFQ LQMRCDRIG*
``` m242/a242 95.2% identity in 289 aa overlap

```
                  10         20         30         40         50         60
  m242.pep  MIGKLVVLFGIEHFEQRAGGIASEVVTQFVDFVEQEQGVFHAGFCHILQNLTGHRADIGA
            |||:||||:||:||||||||||| ::|||||||||||| |:||||||||||||:|||||
  a242      MIGELVVLLGIKHFEQRAGGIAPEVAXQFVDFVEQEQWVFYAGFCHILQNLTGHGADIGA
                  10         20         30         40         50         60

70         80         90        100        110        120
  m242.pep  AVSPDFAFVAHAAQSHADIFPPRCFGDGFAQRGFAHARRADQAQNRAFEFVHTFLDGEVF
            ||||||||||||||||||||||||||||||||||||| ||||||||||||||||||||||
  a242      AVSPDFAFVAHAAQSHADIFPPRCFGDGFAQRGFAHAWRADQAQNRAFEFVHTFLDGEVF
                  70         80         90        100        110        120

130        140        150        160        170        180
  m242.pep  QNPFFDFFQAVVVGIQHQSGFGDVFADAGFFLPRQLEQSVDVVAYDGGFRRHRWHHFELF
            |||||||||||||||||||||||||||||||||||:||:|||||||||| ||| ||||||
  a242      QNPFFDFFQAVVVGIQHQSGFGDVFADAGFFLPRQFEQGVDVVAYDGGFGRHRRHHFELF
                 130        140        150        160        170        180

190        200        210        220        230        240
  m242.pep  QFGQAFFFRFFGHTRLFDICFQGIQFAVFVFFAQFFVYRFNLFVQIIFALGFFHLAFDAS
            ||||||||||||||||||||||||||||||||||||||||||||||||||||||||||||
  a242      QFGQAFFFRFFGHTRLFDICFQGIQFAVFVFFAQFFVYRFNLFVQIIFALGFFHLAFDAS
                 190        200        210        220        230        240

250        260        270        280        290
  m242.pep  AYAFFGLHNVEFGFQLCQQEFHPFADFGNFQNLLALRQFQLQMRCDRIGX
            ||||||||||||||||||||||||||||||||||||||||||||||||||
  a242      AYAFFGLHNVEFGFQLCQQEFHPFADFGNFQNLLALRQFQLQMRCDRIGX
                 250        260        270        280        290
```

The following partial DNA sequence was identified in *N. gonorrhoeae* <SEQ ID 923>:

```
g243.seq
    1   ATGGTaatcg tctGGTTGCc cgAGTTaccg CCGATGCCGG CGACGATGGG

51   CATCAGCGCG GCGAGTGCGA CGATTTTTTC gatactgcCT TCAAACGCGC

101   CGATGACGCG GCTGGCGAGG AAGGCGGTGC AGAGGTTGAC GGCGAGCCAC

151   ATCCAGCGGT TTTTGACGGA ATCCAAGACG GGGGCGAACA GGTCTTCCTC

201   TTCCTGCAAA CCTGCCATGT TCAACATATC CGCTTCGGAT TCTTCGCGGA

251   TCACGTCCAC CATCTCGTCG ATGGTAATCc tgCCGATGAG CTTTTTGTTT

301   TCATCAACGA CGGGCGCGGT AACCAAGTCG TAG
```

This corresponds to the amino acid sequence <SEQ ID 924; ORF 243.ng>:

```
g243.pep
    1   MVIVWLPELP PMPATMGISA ASATIFSILP SNAPMTRLAR KAVQRLTASH

51   IQRFLTESKT GANRSSSSCK PAMFNISASD SSRITSTISS MVILPMSFLF

101   SSTTGAVTKS *
```

The following partial DNA sequence was identified in *N. meningitidis* <SEQ ID 925>:

```
m243.seq
    1   ATGGTAATCG TCTGGTTGCC CGAGTTACCG CCTATGCCGG CGACGATGGG

51   CATCAGCGCG GyGAGTGCGA CGATTTTTTC GATGCTGCCT TCAAACGCGC

101   CGATAACACG GyTGGCGAGG AAGGCGGTGC AGAGGTTGAC GGCGAGCCAC

151   ATCCAGyGGT TTTTCACCGA ATCCCACACG GGGGCGAAyA GGTCTTCCTC

201   TTCCTGCAAA CCCGCCATAT TCAGCATATC CGCTTCCGAT TCTTCGCGGA

251   TCACGTCCAC CATCTCGTCG ATGGTAATCC TGCCGATGAG CTTTTTGTTT

301   TCATCGACGA CGGGCGCGGT AACCAAGTCG TAG
```

This corresponds to the amino acid sequence <SEQ ID 926; ORF 243>:

```
m243.pep
    1   MVIVWLPELP PMPATMGISA XSATIFSMLP SNAPITRLAR KAVQRLTASH

51   IQXFFTESHT GANRSSSSCK PAIFSISASD SSRITSTISS MVILPMSFLF

101   SSTTGAVTKS *
```

Computer analysis of this amino acid sequence gave the following results:
Homology with a Predicted ORF from *N. gonorrhoeae*
ORF 243 shows 92.7% identity over a 110 aa overlap with a predicted ORF (ORF 243.ng) from *N. gonorrhoeae*:

```
    m243/g243
                  10         20         30         40         50         60
    m243.pep  MVIVWLPELPPMPATMGISAXSATIFSMLPSNAPITRLARKAVQRLTASHIQXFFTESHT
              |||||||||||||||||||| ||||||:||||||:||||||||||||||||| :|||:|
    g243      MVIVWLPELPPMPATMGISAASATIFSILPSNAPMTRLARKAVQRLTASHIQRFLTESKT
                  10         20         30         40         50         60

70         80         90        100        110
    m243.pep  GANRSSSSCKPAIFSISASDSSRITSTISSMVILPMSFLFSSTTGAVTKSX
              ||||||||||||:|:||||||||||||||||||||||||||||||||||||
    g243      GANRSSSSCKPAMFNISASDSSRITSTISSMVILPMSFLFSSTTGAVTKSX
                  70         80         90        100        110
```

The following partial DNA sequence was identified in *N. meningitidis* <SEQ ID 927>:

```
a243.seq
     1  ATGGTAATCG TCTGGTTGCC CGAGTTACCG CCTATGCCGG CGACGATGGG
    51  CATCAGCGCG GCGAGTGCGA CGATTTTTTC GATGCTGCCT TCAAACGCGC
   101  CGATAACACG GCTGGCGAGG AAGGCGGTGC AGAGGTTGAC GGCGAGCCAC
   151  ATCCAGCGGT TTTTGACGGA ATCCAAGACG GGGGCGAATA AGTCTTCCTC
   201  TTCTTGCAAA CCCGCCATAT TCAACATATC CGCTTCGGAT TCTTCGCGGA
   251  TCACGTCCAC CATTTCGTCA ACGGTCACCC TGCCGATGAG CTTTTTGTTT
   301  TCATCGACGA CGGGCGCGGT AACCAAGTCA TAG
```

This corresponds to the amino acid sequence <SEQ ID 928; ORF 243.a>:

```
a243.pep
     1  MVIVWLPELP PMPATMGISA ASATIFSMLP SNAPITRLAR KAVQRLTASH
    51  IQRFLTESKT GANKSSSSCK PAIFNISASD SSRITSTISS TVTLPMSFLF
   101  SSTTGAVTKS *
``` m243/a243 92.7% identity in 110 aa overlap

```
                   10         20         30         40         50         60
   m243.pep  MVIVWLPELPPMPATMGISAXSATIFSMLPSNAPITRLARKAVQRLTASHIQXFFTESHT
             ||||||||||||||||||| |||||||||||||||||||||||||||||||| :|||:|
   a243      MVIVWLPELPPMPATMGISAASATIFSMLPSNAPITRLARKAVQRLTASHIQRFLTESKT
                   10         20         30         40         50         60

70         80         90        100        110
   m243.pep  GANRSSSSCKPAIFSISASDSSRITSTISSMVILPMSFLFSSTTGAVTKSX
             |||:||||||||||:|||||||||||||||| ||||||||||||||||||
   a243      GANKSSSSCKPAIFNISASDSSRITSTISSTVTLPMSFLFSSTTGAVTKSX
                   70         80         90        100        110
```

The following partial DNA sequence was identified in *N. gonorrhoeae* <SEQ ID 929>:

```
g244.seq
     1  atgccgcctg aagcccggcc ggcgggttca gacggcattg ccgctttact
    51  tcgatcggtt tatacgcaaa acgcgcttca ggaaataaat cagattattc
   101  cccagacgcc ttcaggcttc cttccgtgcc accgtaacca tagccgggcg
   151  caacacacgg tcggacaggg tataaccctt cttcatcaca ccaaccacgg
   201  tattgggttc ctgctcactg gccaccgcct gcatcgcctg atggatattc
   251  ggatcgagct tatcgcccgc tttaggattg atttccttga tttgcgtggc
   301  atcaaacgcc ttctgcaact cattcaaagt catctgcaca cccattttca
   351  gcgcatcgaa attaccgctc tgatccaaaa gcgccatttc cagataatcc
   401  ttgaccggca acatttccac ggcaaacttc tgtccggcga acttgtgcgt
   451  atcggcaatt tcctgctggt ggcggcggcg caggttttgc tcgtttgcca
   501  aagcgcgcag ttgttcgtct ttcaactgcg cttccagctc ggcaatccgc
   551  gcctgcaaat cctcataagc cggctcggcg cagcctgtt cctgtacacc
   601  gtccgcattt cctactgtct cgacggtttc caccgcctcc acattttcaa
   651  ccgcttcttc actgttttgc tgctgtgtct gttcgctcat atcgtatccc
```

-continued
```
   701   tcaaaacaaa ttggaaatca aaatccggtt attacccgag caagataagg
   751   acattttcaa gaaacttcaa gcaaaggcag gaaatttcac atccgccgcc
   801   gaatacccta ccgcaaaaac catataaacg gtaa
```

This corresponds to the amino acid sequence <SEQ ID 930; ORF 244.ng>:

```
g244.pep
     1   MPPEARPAGS DGIAALLRSV YTQNALQEIN QIIPQTPSGF LPCHRNHSRA
    51   QHTVGQGITL LHHTNHGIGF LLTGHRLHRL MDIRIELIAR FRIDFLDLRG
   101   IKRLLQLIQS HLHTHFQRIE ITALIQKRHF QIILDRQHFH GKLLSGELVR
   151   IGNFLLVAAA QVLLVCQSAQ LFVFQLRFQL GNPRLQILIS RLGGSLFLYT
   201   VRISYCLDGF HRLHIFNRFF TVLLLCLFAH IVSLKTNWKS KSGYYPSKIR
   251   TFSRNFKQRQ EISHPPPNTL PQKPYKR*
```

The following partial DNA sequence was identified in *N. meningitidis* <SEQ ID 931>:

```
m244.seq
     1   ATGCCGTCTG AAGCCCGACA GGCGGGTTCA GACGGCATTG CCGCTTTACT
    51   TCGATCGGTT TATACGCAAA ACGCGCTTCA GGAAATAAAT CAGATTATTC
   101   CCCAGACGCC TTCAGGCTTC CTTCTGCGCC ACCGTAACCA TAGCCGGGCG
   151   CAACACGCGG TCGGACAGCG TATAACCCTT CTTCATCACA CCCACCACGG
   201   TATTCGGCTC CTGTTCGCTT GCCACCGCCT GCATCGCCTG ATGGATATTC
   251   GGATCGAGCT TATCGCCCGC TTTAGGGTTG ATTTCCTTGA TTTGCGTAGC
   301   ATCAAATGCT TTCTGCAACT CGTTCAAAGT CATCTGCACG CCCATTTTCA
   351   GCGCATCGAA ATTGCCGCTC TGATCCAAAA GCGCCATTTC CAGATAATCC
   401   TTGACCGGCA GCATTTCCAC GGCAAACTTC TGTCCGGCGA ACTTGTGCGT
   451   ATCCGCAATT TyCTGCTGGT GGCGGCGGCG CAGGTTTTGC TCGTTTGCCA
   501   AAGCGCGCTG CTCGTCTTTC AACTGCGTTT CCAGCTCGGC AATCCGCGCC
   551   TGCAAATCCT CATAAGCCGG CTCTGCGGCA GCCTGTTCCT GCACACCGTC
   601   CGCATTTCCT ACTGTTTCGA CGGTTTCCAC CGCCTCCACA TTTTCAACCG
   651   CTTCTTCACT GTTTTGCTGC TGTGTCTGTT CGCTCATATC GTATCCCTTA
   701   AAACAAATTG GAAATCAAAA TCCAGTTATT ACCCGCGCAA GATAAGGACA
   751   TTTTCAAGAA ACTTCAAkCA AAAkCAGAGA ATTTCAAATT CATTTTCAAA
   801   TCCCCTACCG AAAAAATAAT ATAGACGGTA A
```

This corresponds to the amino acid sequence <SEQ ID 932; ORF 244>:

```
m244.pep
     1   MPSEARQAGS DGIAALLRSV YTQNALQEIN QIIPQTPSGF LLRHRNHSRA
    51   QHAVGQRITL LHHTHHGIRL LFACHRLHRL MDIRIELIAR FRVDFLDLRS
   101   IKCFLQLVQS HLHAHFQRIE IAALIQKRHF QIILDRQHFH GKLLSGELVR
   151   IRNFLLVAAA QVLLVCQSAL LVFQLRFQLG NPRLQILISR LCGSLFLHTV
```

```
  201  RISYCFDGFH RLHIFNRFFT VLLLCLFAHI VSLKTNWKSK SSYYPRKIRT

251  FSRNFXQXQR ISNSFSNPLP KKXYRR*
```

Computer analysis of this amino acid sequence gave the following results:
Homology with a Predicted ORF from *N. gonorrhoeae*
ORF 244 shows 86.3% identity over a 277 aa overlap with a predicted ORF (ORF 244.ng) from *N. gonorrhoeae*:

```
         M244/G244
                          10         20         30         40         50         60
         m244.pep  MPSEARQAGSDGIAALLRSVYTQNALQEINQIIPQTPSGFLLRHRNHSRAQHAVGQRITL
                   || ||| |||||||||||||||||||||||||||||| |||||||||:||| |||
         g244      MPPEARPAGSDGIAALLRSVYTQNALQEINQIIPQTPSGFLPCHRNHSRAQHTVGQGITL
                          10         20         30         40         50         60

70         80         90        100        110        120
         m244.pep  LHHTHHGIRLLFACHRLHRLMDIRIELIARFRVDPLDLRSIKCFLQLVQSHLHAHFQRIE
                   ||||:||| :|:: |||||||||||||||||||:||||||: ||| :|||||: ||||||
         g244      LHHTNHGIGFLLTGHRLHRLMDIRIELIARFRIDFLDLRGIKRLLQLIQSHLHTHFQRIE
                          70         80         90        100        110        120

130        140        150        160        170        180
         m244.pep  IAALIQKRHFQIILDRQHFHGKLLSGELVRIRNFLLVAAAQVLLVCQSAALLVFQLRFQL
                   |:|||||||||||||||||||||||||||| |||||||||||||||||:| |:||||||
         g244      ITALIQKRHFQIILDRQHFHGKLLSGELVRIGNFLLVAAAQVLLVCQSAQLFVFQLRFQL
                         130        140        150        160        170        180

190        200        210        220        230        240
         m244.pep  GNPRLQILISRLCGSLFLHTVRISYCFDGFHRLHIFNRFFTVLLLCLFAHIVSLKTNWKS
                   |||||||||||| ||||| :||||||:|||||||||||||||||||||||||||||||||
         g244      GNPRLQILISRLGGSLFLYTVRISYCLDGFHRLHIFNRFFTVLLLCLFAHIVSLKTNWKS
                         190        200        210        220        230        240

250        260        270
         m244.pep  KSSYYPRKIRTFSRNFXQXQRISNSFSNPLPKKXYRRX
                   ||:||| ||||||||||| | ::|: ||:| |:||
         g244      KSGYYPSKIRTFSRNFKQRQEISHPPPNTLPQKPYKRX
                         250        260        270
```

The following partial DNA sequence was identified in *N. meningitidis* <SEQ ID 933>:

```
a244.seq
    1   ATGCCGTCTG AAGCCCGACA GGCGGGTTCA GACGGCATTG CCGCTTTACT

51   TCGATCGGTT TATACGCAAA ACGCGCTTCA GGAAATAAAT CAGATTATTC

101   CCCAGACGCC TTCAGGCTTC CTTCTGTGCC ACCGTAACCA TAGCCGGGCG

151   CAACACGCGG TCGGACAGCG TATAACCCTT CTTCATCACG CCCACCACGG

201   TATTGGGTTC CTGTTCGCTT GCCACCGCCT GCATCGCCTG ATGGATATTC

251   GGATCGAGCT TATCGCCCGC TTTAGGATTG ATTTCCTTGA TTTGCGTAGC

301   ATCAAATGCT TTCTGCAACT CGTTCAAAGT CATCTGCACG CCCATTTTCA

351   GCGCATCGAA ATTGCCGCTC TGATCCAAAA GCGCCATTTC CAGATAATCC

401   TTGACCGGCA GCATTTCCAC GGCAAACTTC TGTCCGGCGA ACTTGTGCGT

451   ATCCGCAATT TCCTGCTGGT GGCGGCGGCG CAGGTTTTGC TCGTTTGCCA

501   AAGCGCGCAG CTGCTCGTCT TTCAACTGCG CTTCCAGCTC GGCAATCCGC

551   GCCTGCAAAT CCTCATAAGC CGGCTCTGCG GCAGCCTGTT CCTGCACACC

601   GTCCGCATTT CCTACTGTCT CGACGGTTTC CACCGCCTCC ACATTTTCAA

651   CCGCTTCTTC ACTGTTTTGC TGCTGTGTCT GTTCGCTCAT ATCGTATCCC

701   TTAAAACAAA TTGGAAATCA AATCCAGTT ATTACCCGCG CAAGATAAGG

751   ACATTTTCAA GAAACTTCAA GCAAAGGCAG AGAATTTCAA ATTCATTTTC

801   AAATCCCCTA CCCAAAAAAT AATATAGACG GTAA
```

This corresponds to the amino acid sequence <SEQ ID 934; ORF 244.a>:

```
a244.pep
   1    MPSEARQAGS DGIAALLRSV YTQNALQEIN QIIPQTPSGF LLCHRNHSRA

51    QHAVGQRITL LHHAHHGIGF LFACHRLHRL MDIRIELIAR FRIDFLDLRS

101    IKCFLQLVQS HLHAHFQRIE IAALIQKRHF QIILDRQHFH GKLLSGELVR

151    IRNFLLVAAA QVLLVCQSAQ LLVFQLRFQL GNPRLQILIS RLCGSLFLHT

201    VRISYCLDGF HRLHIFNRFF TVLLLCLFAH IVSLKTNWKS KSSYYPRKIR

251    TFSRNFKQRQ RISNSFSNPL PKK*YRR*
``` m244/a244 96.8% identity in 277 aa overlap

```
                10         20         30         40         50         60
m244.pep  MPSEARQAGSDGIAALLRSVYTQNALQEINQIIPQTPSGFLLRHRNHSRAQHAVGQRITL
          ||||||||||||||||||||||||||||||||||||||||||  ||||||||||||||||
a244      MPSEARQAGSDGIAALLRSVYTQNALQEINQIIPQTPSGFLLCHRNHSRAQHAVGQRITL
                10         20         30         40         50         60

70         80         90        100        110        120
m244.pep  LHHTHHGIRLLFACHRLHRLMDIRIELIARFRVDFLDLRSIKCFLQLVQSHLHAHFQRIE
          |||:||||  :|||||||||||||||||||||:|||||||||||||||||||||||||||
a244      LHHAHHGIGFLFACHRLHRLMDIRIELIARFRIDFLDLRSIKCFLQLVQSHLHAHFQRIE
                70         80         90        100        110        120

130        140        150        160        170        179
m244.pep  IAALIQKRHFQIILDRQHFHGKLLSGELVRIRNFLLVAAAQVLLVCQSA-LLVFQLRFQL
          |||||||||||||||||||||||||||||||||||||||||||||||| ||||||||||
a244      IAALIQKRHFQIILDRQHFHGKLLSGELVRIRNFLLVAAAQVLLVCQSAQLLVFQLRFQL
               130        140        150        160        170        180

180        190        200        210        220        230   239
m244.pep  GNPRLQILISRLCGSLFLHTVRISYCFDGFHRLHIFNRFFTVLLLCLFAHIVSLKTNWKS
          |||||||||||||||||||||||||| :|||||||||||||||||||||||||||||||
a244      GNPRLQILISRLCGSLFLHTVRISYCLDGFHRLHIFNRFFTVLLLCLFAHIVSLKTNWKS
               190        200        210        220        230        240

240        250        260        270
m244.pep  KSSYYPRKIRTFSRNFXQXQRISNSFSNPLPKKXYRRX
          ||||||||||||||||| | |||||||||||||||||
a244      KSSYYPRKIRTFSRNFKQRQRISNSFSNPLPKKXYRRX
               250        260        270
```

The following partial DNA sequence was identified in *N. gonorrhoeae* <SEQ ID 935>:

```
g244-1.seq
   1    atgccgcctg aagcccggcc ggcggggttca gacggcattg ccgctttact 51    tcgatcggtt tatacgcaaa acgcgcttca ggaaataaat cagattattc 101    cccagacgcc ttcaggcttc cttccgtgcc accgtaacca tagccgggcg 151    caacacacgg tcggacaggg tataaccctt cttcatcaca ccaaccacgg 201    tattgggttc ctgctcactg gccaccgcct gcatcgcctg atggatattc 251    ggatcgagct tatcgcccgc tttaggattg atttccttga tttgcgtggc 301    atcaaacgcc ttctgcaact cattcaaagt catctgcaca cccatttca 351    gcgcatcgaa attaccgctc tgatccaaaa gcgccatttc cagataatcc 401    ttgaccggca acatttccac ggcaaacttc tgtccggcga acttgtgcgt 451    atcggcaatt tcctgctggt ggcggcggcg caggttttgc tcgtttgcca 501    aagcgcgcag ttgttcgtct ttcaactgcg cttccagctc ggcaatccgc 551    gcctgcaaat cctcataagc cggctcggcg cagcctgtt cctgtacacc 601    gtccgcattt cctactgtct cgacggtttc caccgcctcc acatttcaa 651    ccgcttcttc actgttttgc tgctgtgtct gttcgctcat atcgtatccc
```

-continued

```
701  tcaaaacaaa ttggaaatca aaatccggtt attacccgag caagataagg
751  acattttcaa gaaacttcaa gcaaaggcag gaaatttcac atccgccgcc
801  gaatacccta ccgcaaaaac catataaacg gtaa
```

This corresponds to the amino acid sequence <SEQ ID 936; ORF 244-1.ng>:

```
g244-1.pep
  1  MPPEARPAGS DGIAALLRSV YTQNALQEIN QIIPQTPSGF LPCHRNHSRA
 51  QHTVGQGITL LHHTNHGIGF LLTGHRLHRL MDIRIELIAR FRIDFLDLRG
101  IKRLLQLIQS HLHTHFQRIE ITALIQKRHF QIILDRQHFH GKLLSGELVR
151  IGNFLLVAAA QVLLVCQSAQ LFVFQLRFQL GNPRLQILIS RLGGSLFLYT
201  VRISYCLDGF HRLHIFNRFF TVLLLCLFAH IVSLKTNWKS KSGYYPSKIR
251  TFSRNFKQRQ EISHPPPNTL PQKPYKR*
```

The following partial DNA sequence was identified in *N. meningitidis* <SEQ ID 937>:

```
m244-1.seq
  1  ATGCCGTCTG AAGCCCGACA GGCGGGTTCA GACGGCATTG CCGCTTTACT
 51  TCGATCGGTT TATACGCAAA ACGCGCTTCA GGAAATAAAT CAGATTATTC
101  CCCAGACGCC TTCAGGCTTC CTTCTGCGCC ACCGTAACCA TAGCCGGGCG
151  CAACACGCGG TCGGACAGCG TATAACCCTT CTTCATCACA CCCACCACGG
201  TATTCGGCTC CTGTTCGCTT GCCACCGCCT GCATCGCCTG ATGGATATTC
251  GGATCGAGCT TATCGCCCGC TTTAGGGTTG ATTTCCTTGA TTTGCGTAGC
301  ATCAAATGCT TTCTGCAACT CGTTCAAAGT CATCTGCACG CCCATTTTCA
351  GCGCATCGAA ATTGCCGCTC TGATCCAAAA GCGCCATTTC CAGATAATCC
401  TTGACCGGCA GCATTTCCAC GGCAAACTTC TGTCCGGCGA ACTTGTGCGT
451  ATCCGCAATT TyCTGCTGGT GGCGGCGGCG CAGGTTTTGC TCGTTTGCCA
501  AAGCGCGCTG CTCGTCTTTC AACTGCGTTT CCAGCTCGGC AATCCGCGCC
551  TGCAAATCCT CATAAGCCGG CTCTGCGGCA GCCTGTTCCT GCACACCGTC
601  CGCATTTCCT ACTGTTTCGA CGGTTTCCAC CGCCTCCACA TTTTCAACCG
651  CTTCTTCACT GTTTTGCTGC TGTGTCTGTT CGCTCATATC GTATCCCTTA
701  AAACAAATTG GAAATCAAAA TCCAGTTATT ACCCGCGCAA GATAAGGACA
751  TTTTCAAGAA ACTTCAAkCA AAAkCAGAGA ATTTCAAATT CATTTTCAAA
801  TCCCCTACCG AAAAAATAA
```

This corresponds to the amino acid sequence <SEQ ID 938; ORF 244-1>:

```
m244-1.pep
  1  MPSEARQAGS DGIAALLRSV YTQNALQEIN QIIPQTPSGF LLRHRNHSRA
 51  QHAVGQRITL LHHTHHGIRL LFACHRLHRL MDIRIELIAR FRVDFLDLRS
101  IKCFLQLVQS HLHAHFQRIE IAALIQKRHF QIILDRQHFH GKLLSGELVR
151  IRNFLLVAAA QVLLVCQSAL LVFQLRFQLG NPRLQILISR LCGSLFLHTV
```

```
 201   RISYCFDGFH RLHIFNRFFT VLLLCLFAHI VSLKTNWKSK SSYYPRKIRT

251   FSRNFXQXQR ISNSFSNPLP KK*
``` m244-1/G244-1 86.3% identity in 277 aa overlap

```
                    10         20         30         40         50         60
m244-1.pep  MPSEARQAGSDGIAALLRSVYTQNALQEINQIIPQTPSGFLLRHRNHSRAQHAVGQRITL
            ||  |||  ||||||||||||||||||||||||||||||||| ||||||||||:||| |||
g244-1      MPPEARPAGSDGIAALLRSVYTQNALQEINQIIPQTPSGFLPCHRNHSRAQHTVGQGITL
                    10         20         30         40         50         60
                    70         80         90        100        110        120
m244-1.pep  LHHTHHGIRLLFACHRLHRLMDIRIELIARFRVDFLDLRSIKCFLQLVQSHLHAHFQRIE
            ||||:||| :|::: ||||||||||||||||||:|||||| :| :|||:|||||:||||||
g244-1      LHHTNHGIGFLLTGHRLHRLMDIRIELIARFRIDFLDLRGIKRLLQLIQSHLHTHFQRIE
                    70         80         90        100        110        120
                   130        140        150        160        170        180
m244-1.pep  IAALIQKRHFQIILDRQHFHGKLLSGELVRIRNFLLVAAAQVLLVCQSAALLVFQLRFQL
            |:||||||||||||||||||||||||||||| |||||||||||||||||| |:||||||||
g244-1      ITALIQKRHFQIILDRQHFHGKLLSGELVRIGNFLLVAAAQVLLVCQSAQLFVFQLRFQL
                   130        140        150        160        170        180
                   190        200        210        220        230        240
m244-1.pep  GNPRLQILISRLCGSLFLHTVRISYCFDGFHRLHIFNRFFTVLLLCLFAHIVSLKTNWKS
            |||||||||||| ||||| :||||||:|||||||||||||||||||||||||||||||||
g244-1      GNPRLQILISRLGGSLFLYTVRISYCLDGFHRLHIFNRFFTVLLLCLFAHIVSLKTNWKS
                   190        200        210        220        230        240
                   250        260        270
m244-1.pep  KSSYYPRKIRTFSRNFXQXQRISNSFSNPLPKKX
            ||:|||  ||||||||| |:::   |  |::|
g244-1      KSGYYPSKIRTFSRNFKQRQEISHPPPNTLPQKPYKRX
                   250        260        270
```

The following partial DNA sequence was identified in *N. meningitidis* <SEQ ID 939>:

```
a244-1.seq
   1   ATGCCGTCTG AAGCCCGACA GGCGGGTTCA GACGGCATTG CCGCTTTACT

51   TCGATCGGTT TATACGCAAA ACGCGCTTCA GGAAATAAAT CAGATTATTC

101   CCCAGACGCC TTCAGGCTTC CTTCTGTGCC ACCGTAACCA TAGCCGGGCG

151   CAACACGCGG TCGGACAGCG TATAACCCTT CTTCATCACG CCCACCACGG

201   TATTGGGTTC CTGTTCGCTT GCCACCGCCT GCATCGCCTG ATGGATATTC

251   GGATCGAGCT TATCGCCCGC TTTAGGATTG ATTTCCTTGA TTTGCGTAGC

301   ATCAAATGCT TTCTGCAACT CGTTCAAAGT CATCTGCACG CCCATTTTCA

351   GCGCATCGAA ATTGCCGCTC TGATCCAAAA GCGCCATTTC CAGATAATCC

401   TTGACCGGCA GCATTTCCAC GGCAAACTTC TGTCCGGCGA ACTTGTGCGT

451   ATCCGCAATT TCCTGCTGGT GGCGGCGGCG CAGGTTTTGC TCGTTTGCCA

501   AAGCGCGCAG CTGCTCGTCT TTCAACTGCG CTTCCAGCTC GGCAATCCGC

551   GCCTGCAAAT CCTCATAAGC CGGCTCTGCG GCAGCCTGTT CCTGCACACC

601   GTCCGCATTT CCTACTGTCT CGACGGTTTC CACCGCCTCC ACATTTTCAA

651   CCGCTTCTTC ACTGTTTTGC TGCTGTGTCT GTTCGCTCAT ATCGTATCCC

701   TTAAAACAAA TTGGAAATCA AATCCAGTT ATTACCCGCG CAAGATAAGG

751   ACATTTTCAA GAAACTTCAA GCAAAGGCAG AGAATTTCAA ATTCATTTTC

801   AAATCCCCTA CCGAAAAAAT AA
```

This corresponds to the amino acid sequence <SEQ ID 940; ORF 244-1.a>:

```
a244-1.pep
     1     MPSEARQAGS DGIAALLRSV YTQNALQEIN QIIPQTPSGF LLCHRNHSRA

51     QHAVGQRITL LHHAHHGIGF LFACHRLHRL MDIRIELIAR FRIDFLDLRS

101     IKCFLQLVQS HLHAHFQRIE IAALIQKRHF QIILDRQHFH GKLLSGELVR

151     IRNFLLVAAA QVLLVCQSAQ LLVFQLRFQL GNPRLQILIS RLCGSLFLHT

201     VRISYCLDGF HRLHIFNRFF TVLLLCLFAH IVSLKTNWKS KSSYYPRKIR

251     TFSRNFKQRQ RISNSFSNPL PKK*
```

A
m244-1/a244-1 96.8% identity in 274 aa overlap

```
                  10         20         30         40         50         60
m244-1.pep  MPSEARQAGSDGIAALLRSVYTQNALQEINQIIPQTPSGFLLRHNHSRAQHAVGQRITL
            ||||||||||||||||||||||||||||||||||||||||||  ||||||||||||||
a244-1      MPSEARQAGSDGIAALLRSVYTQNALQEINQIIPQTPSGFLLCHRNHSRAQHAVGQRITL
                  10         20         30         40         50         60

70         80         90        100        110        120
m244-1.pep  LHHTHHGIRLLFACHRLHRLMDIRIELIARFRVDFLDLRSIKCFLQLVQSHLHAHFQRIE
            |||:||||  :|||||||||||||||||||||:|||||||||||||||||||||||||||
a244-1      LHHAHHGIGLFACHRLHRLMDIRIELIARFRIDFLDLRSIKCFLQLVQSHLHAHFQRIE
                  70         80         90        100        110        120

130        140        150        160        170        179
m244-1.pep  IAALIQKRHFQIILDRQHFHGKLLSGELVRIRNFLLVAAAQVLLVCQSA-LLVFQLRFQL
            |||||||||||||||||||||||||||||||||||||||||||||||| ||||||||||
a244-1      IAALIQKRHFQIILDRQHFHGKLLSGELVRIRNFLLVAAAQVLLVCQSAQLLVFQLRFQL
                 130        140        150        160        170        179

180        190        200        210        220        230        239
m244-1.pep  GNPRLQILISRLCGSLFLHTVRISYCFDGFHRLHIFNRFFTVLLLCLFAHIVSLKTNWKS
            |||||||||||||||||||||||||:|||||||||||||||||||||||||||||||||
a244-1      GNPRLQILISRLCGSLFLHTVRISYCLDGFHRLHIFNRFFTVLLLCLFAHIVSLKTNWKS
                       190        200        210        220        230        239

240        250        260        270
m244-1.pep  KSSYYPRKIRTFSRNFXQXQRISNSFSNPLPKKX
            |||||||||||||||| | |||||||||||||||
a244-1      KSSYYPRKIRTFSRNFXQXQRISNSFSNPLPKKX
                       250        260        270
```

The following partial DNA sequence was identified in *N. gonorrhoeae* <SEQ ID 941>:

```
g246.seq
     1     atgtacgggc ggaacggtag tactcaagcg gccgttgcct tcgttttcga 51     ccagacacag cgtgcccgtt tcggcaacgg cgaagtttac gccgctcaag 101     ccgacatcgg cagtgctgta aatatcgcgc agggctttgc gggcgaatcc 151     ggtcagttgg tccacgtcgt ctgtaagcgg tgtgccgagg ttttggtgga 201     acagttcgct gacctgttct ttggttttat ggattgcggg catcacgata 251     tgggtcggtt tttcgcctgc catttggacg ataaactcgc ccaagtcgct 301     ttccaccgcc ttaatgcctt tgcttcaag ataatggttc agctcgattt 351     cttcgctgac catggatttg cctttgacca tcagcttgcc gttttttggct 401     gtgatgatgt cgtggataat ttggcaggct tcggcagggg tttccgccca 451     gtgtactttc acgcccaact tagtcaggtt ttcttccaac tgctccagca 501     gcgcgggtaa
```

This corresponds to the amino acid sequence <SEQ ID 942; ORF 246.ng>:

```
g246.pep
    1    MYGRNGSTQA AVAFVFDQTQ RARFGNGEVY AAQADIGSAV NIAQGFAGES

51    GQLVHVVCKR CAEVLVEQFA DLFFGFMDCG HHDMGRFFAC HLDDKLAQVA

101    FHRLNAFCFK IMVQLDFFAD HGFAFDHQLA VFGCDDVVDN LAGFGRGFRP

151    VYFHAQLSQV FFQLLQQRG*
```

The following partial DNA sequence was identified in *N. meningitidis* <SEQ ID 943>:

```
m246.seq (partial)
    1    ATGCACGGGC GGTACGGTGG TACTCAAGCG ACCGTTgCTT CGTTTTCCAC

51    CAGACACAGC GTACCTGTTT CAGCAACGGC AAAGTTTACG CCACTCAAAC

101    CGACATCGGC AGTGCTGTAA ATATCGCGCA GTGCTTTACG GGCGAAGCCG

151    GTCAGTTGGT CTACATCGTC TGTCAGCGGC GTACCGAGGT TTTGGTGGAA

201    CAGTTCGCTA ACCTGTTCTT TGGTTTTGTG GATAGCAGGC ATCACGATAT

251    GGGTCGGTTT TTCGCCTGCC ATTTGGACGA TGAACTCGCC CAAGTCGCTT

301    TCTACCGCTT TAATGCyTTT TGCTTCAAGA TAATGrTTCA GCTCGATTTC

351    CTCGCTGACC ATCGATTTGC CTTTGACCAT CAGCTTGCCG TTTTTGGCTG

401    TGATGATGTC GTGGATAATT TGGCAGGCTT CGGTCGGGGT TTCTGCCCG...
```

This corresponds to the amino acid sequence <SEQ ID 944; ORF 246>:

```
m246.pep (partial)
    1    MHGRYGGTQA TVAFVFHQTQ RTCFSNGKVY ATQTDIGSAV NIAQCFTGEA

51    GQLVYIVCQR RTEVLVEQFA NLFFGFVDSR HHDMGRFFAC HLDDELAQVA

101    FYRFNAFCFK IMXQLDFLAD HRFAFDHQLA VFGCDDVVDN LAGFGRGFCP...
```

Computer analysis of this amino acid sequence gave the following results:
Homology with a Predicted ORF from *N. gonorrhoeae*
ORF 246 shows 80.0% identity over a 150 aa overlap with a predicted ORF (ORF 246.ng) from *N. gonorrhoeae*:

```
m246/g246
                 10         20         30         40         50         60
m246.pep  MHGRYGGTQATVAFVFHQTQRTCFSNGKVYATQTDIGSAVNIAQCFTGEAGQLVYIVCQR
          |:||  |:|||:|||||  ||||:  |:||:|||:|:||||||||||  |:||:||||::||:|
g246      MYGRNGSTQAAVAFVFDQTQRARFGNGEVYAAQADIGSAVNIAQGFAGESGQLVHVVCKR
                 10         20         30         40         50         60

70         80         90        100        110        120
m246.pep  RTEVLVEQFANLFFGFVDSRHHDMGRFFACHLDDELAQVAFYRFNAFCFKIMXQLDFLAD
          :|||||||||:||||||:|   |||||||||||||||:||||||:|:|||||||||| ||||:||
g246      CAEVLVEQFADLFFGFMDCGHHDMGRFFACHLDDKLAQVAFHRLNAFCFKIMVQLDFFAD 130        140        150
m246.pep  HRFAFDHQLAVFGCDDVVDNLAGFGRGFCP
          | ||||||||||||||||||||||||||||| |
g246      HGFAFDHQLAVFGCDDVVDNLAGFGRGFRPVYFHAQLSQVFFQLLQQRGX
                130        140        150        160
```

The following partial DNA sequence was identified in *N. meningitidis* <SEQ ID 945>:

a246.seq (partial)
```
     1  ATGCACGGGC GGAACGGTGG TACTCAAGCG ACCGTTGCCT TCGTTTTCCA

51  CCAGACACAG CGTACCTGTT TCAGCAACGG CGAAGTTCAC GCCACTCAAA

101  CCGACATCGG CAGTGCTGTA AATATCGCGC AGTGCTTTAC GGGCGAAGCC

151  GGTCAGTTGG TCTACGTCGT CCGTTAACGG TGTGCCGAGG TTTTGGTGGA

201  ACAGTTCGCT AACCTGTTCT TTGGTTTTAT GGATTGCGGG CATCACGATA

251  TGGGTCGGTT TTTCACCTGC CATTTGGACG ATGAACTCGC CCAAGTCGCT

301  TTCCACCGCT TTAATGCCTT TTGCTTCAAG ATAATGGTTC AGCTCGATTT

351  CCTCGCTGAC CATCGATTTG CCTTTGACCA TCAGCTTGCC GTTTTTGGCT

401  GTGATGATGT CGTGGATGAT TTCGCAGGCT TCGGCCGGTG TTTCCGCCCA

451  GTGTACTTTT ACGCCCAACT TGGTCAGGTT TTCTTCCAGC TGCTCCAGCA

501  G
```

This corresponds to the amino acid sequence <SEQ ID 946; ORF 246.a>:

a246.pep (partial)
```
     1  MHGRNGGTQA TVAFVFHQTQ RTCFSNGEVH ATQTDIGSAV NIAQCFTGEA

51  GQLVYVVR*R CAEVLVEQFA NLFFGFMDCG HHDMGRFFTC HLDDELAQVA

101  FHRFNAFCFK IMVQLDFLAD HRFAFDHQLA VFGCDDVVDD FAGFGRCFRP

151  VYFYAQLGQV FFQLLQQ
``` m246/a246 88.0% identity in 150 aa overlap

```
                  10         20         30         40         50         60
m246.pep  MHGRYGGTQATVAFVFHQTQRTCFSNGKVYATQTDIGSAVNIAQCFTGEAGQLVYIVCQR
          ||||  |||||||||||||||||||||:|:||||||||||||||||||||||||: |  |
a246      MHGRNGGTQATVAFVFHQTQRTCFSNGEVHATQTDIGSAVNIAQCFTGEAGQLVYVVRXR
                  10         20         30         40         50         60

70         80         90        100        110        120
m246.pep  RTEVLVEQFANIFFGFVDSRHHDMGRFFACHLDDELAQVAFYRFNAFCFKIMXQLDFLAD
           :||||||||||||||:|   ||||||||:||||||||||||||||||||||| ||||||
a246      CAEVLVEQFANIFFGFMDCGHHDMGRFFTCHLDDELAQVAFHRFNAFCFKIMVQLDFLAD
                  70         80         90        100        110        120

130        140        150
m246.pep  HRFAFDHQLAVFGCDDVVDNLAGFGRGFCP
          ||||||||||||||||||||::||||| ||
a246      HRFAFDHQLAVFGCDDVVDDFAGFGRCFRPVYFYAQLGQVFFQLLQQ
                 130        140        150        160
```

The following partial DNA sequence was identified in *N. gonorrhoeae* <SEQ ID 947>:

g247.seq
```
     1  atgaaacgta aaatgctaaa cgtaccaaag ggcggttatg atggtatgaa 51  gggttttacc attgttgaat ttctggttgc gggcctgctc agtataattg 101  tcctgatagc ggtcgtatcg agttacttta catcccggaa attaaatgat 151  gtggcaaacg agcgtcttgc cattcaacag gatttgcgga atgcggcaac 201  attaattgtc cgcgatgcaa gaatggcggg gagcttcggt tgtttcaata 251  tgtccgagca tactaaagac gatattgttg attcaagtaa tcaaactcaa 301  tctaaccttg caaaacccgg tgccaaacaa gaaaatcccc ttttttcctt 351  aaaaaggagc ggcatggata aacaactgat tcccgttgct gaatccatag
```

-continued
```
401   atattaaata tccgggtttt atccagcgcc ttaacgcatt ggttttccaa 451   tacggtatcg atgatcttga tgcgagtgct gagactgttg tagtcagcag 501   ctgttccaaa atagcaaaac cgggtaagaa aatatctacc ttgcaagaag 551   caaagagtgc attacagatt actaatgatg ataaacaaaa tggaaatatc 601   acccgtcaga aacatgtggt caatgcctat gcggtcggca ggtttggcaa 651   taatgaggaa agtttgttcc gcttccaatt ggatgataag ggcaagtggg 701   gtaatcctca gttgctcgtg aaaaaggtta aacgtatgga tgtgcggtat 751   atttatgttt ccggttgtcc tgaagatgaa gatgccggca aagaggaaaa 801   attcagatat acgaataaat tcgacaaatc caaaaatgct gttacgcctg 851   ccggggtgga ggttttattg gatagcggcc ttaatgccaa gattgccgct 901   tcttcagaca atagtattta tgcttaccgt atcaatgcga caatacgcgg 951   gggaaatgta tgcgcaaaca gaacactttg a
```

This corresponds to the amino acid sequence <SEQ ID 948; ORF 247.ng>:

```
g247.pep
    1   MKRKMLNVPK GGYDGMKGFT IVEFLVAGLL SIIVLIAVVS SYFTSRKLND

51   VANERLAIQQ DLRNAATLIV RDARMAGSFG CFNMSEHTKD DIVDSSNQTQ

101   SNLAKPGAKQ ENPLFSLKRS GMDKQLIPVA ESIDIKYPGF IQRLNALVFQ

151   YGIDDLDASA ETVVVSSCSK IAKPGKKIST LQEAKSALQI TNDDKQNGNI

201   TRQKHVVNAY AVGRFGNNEE SLFRFQLDDK GKWGNPQLLV KKVKRMDVRY

251   IYVSGCPEDE DAGKEEKFRY TNKFDKSKNA VTPAGVEVLL DSGLNAKIAA

301   SSDNSIYAYR INATIRGGNV CANRTL*
```

The following partial DNA sequence was identified in *N. meningitidis* <SEQ ID 949>:

```
m247.seq (partial)
    1   ATsAGACGTA AAATGCTAAA CGTwsyArAA GGCAGTTATG ATGGTATGAA

51   AGGTTTTACC ATTATTGAAT TTTTGGTTGC GGGCCTGCTC AGTATGATTG

101   TCCTGATGGC GGTCGGATCG AGTTACTTCA CATCCCGGAA ATTAAATGAT

151   GCGGCAAACG AGCGTCTTGC CGCGCAACAG GATTTGCGGA ATGCGGCAAC

201   ATTGATTGTC CGCGATGCGA GAATGGCAGG CGGCTTCGGT TGTTTCAATA

251   TGTCCGAGCA TCCTGCAACT GATGTTATTC CCGATACGAC GCAACAAAAT

301   TCTCCTTTTT CCTTAAAAAG GAACGGTATA GATAAACTTA TTCCCATAGC

351   GGAATCTTCA AATATCAATT ATCAGAATTT TTTCCAGGTT GGTAGCGCAT

401   TGATTTTTCA ATACGGAATC GATGATGTTA ATGCAAGCAC CGCGACTACC

451   GTCGTCAGCA GCTGTGCCGC AATATCGAAA CCGGGCAAGC AAATCCCTAC

501   TTTAGAAGAT GCAAAAAAAG AATTGAAGAT TCCGGATCAG GATAAGGAGC

551   AAAATGGCAA TATAGCGCGT CAAAGGCATG TGGTCAATGC CTATGCGGTC

601   GGCAGGATTG CCGATGAGGA AGTTTGTTC CGCTTCCAAT TGGATGATAA

651   GGGCAAGTGG GGTAATCCTC AGTTGC...
```

This corresponds to the amino acid sequence <SEQ ID 950; ORF 247>:

```
m247.pep (partial)
    1   XRRKMLNVXX GSYDGMKGFT IIEFLVAGLL SMIVLMAVGS SYFTSRKLND

51   AANERLAAQQ DLRNAATLIV RDARMAGGFG CFNMSEHPAT DVIPDTTQQN

101   SPFSLKRNGI DKLIPIAESS NINYQNFFQV GSALIFQYGI DDVNASTATT

151   VVSSCAAISK PGKQIPTLED AKKELKIPDQ DKEQNGNIAR QRHVVNAYAV

201   GRIADEESLF RFQLDDKGKW GNPQL....
```

Computer analysis of this amino acid sequence gave the following results:
Homology with a Predicted ORF from *N. gonorrhoeae*
ORF 247 shows 69.3% identity over a 238 aa overlap with a predicted ORF (ORF 247.ng) from *N. gonorrhoeae*:

```
m247/g247
                       10         20         30         40         50         60
    m247.pep   XRRKMLNVXXGSYDGMKGFTIIEFLVAGLLSMIVLMAVGSSYFTSRKLNDAANERLAAQQ
               :||||||  |:|||||||||:|||||||||:|||:|| ||||||||||:||||| ||
        g247   MKRKMLNVPKGGYDGMKGFTIVEFLVAGLLSIIVLIAVVSSYFTSRKLNDVANERLAIQQ
                       10         20         30         40         50         60

70         80         90                    100
    m247.pep   DLRNAATLIVRDARMAGGFGCFNMSEHPATDVI-----------PDTTQQNSPFSLKRN
               ||||||||||||||||| :||||||||| |::       | :|:   |||||:
        g247   DLRNAATLIVRDARMAGSFGCFNMSEHTKDDIVDSSNQTQSNLAKPGAKQENPLFSLKRS
                       70         80         90        100        110        120

110       120        130        140        150        160
    m247.pep   GIDK-LIPIAESSNINYQNFFQVGSALIFQYGIDDVNASTATTVVSSCAAISKPGKQIPT
               |:||  ||| |||| :|:|   :|  :||:||||||||:::||: ||||:|| |:| |
        g247   GMDKQLIPVAESIDIKYPGFIQRLNALVFQYGIDDLDASAETVVVSSCSKIAKPGKKIST
                      130        140        150        160        170        180

170        180        190        200        210        220
    m247.pep   LEDAKKELKIPDQDKEQNGNIARQRHVVNAYAVGRIAD-EESLFRFQLDDKGKWGNPQL
               |::||: |:|  :|| |||||:||:||||||||||||:| |:|||||||||||||||||
        g247   LQEAKSALQITNDDK-QNGNITRQKHVVNAYAVGRFGNNEESLFRFQLDDKGKWGNPQLL
                      190        200        210        220        230 g247   VKKVKRMDVRYIYVSGCPEDEDAGKEEKFRYTNKFDKSKNAVTPAGVEVLLDSGLNAKIA
                      240        250        260        270        280        290
```

The following partial DNA sequence was identified in *N. meningitidis* <SEQ ID 951>:

```
a247.seq
    1   ATGAGACGTA AAATGCTAAA CGTACCAAAA GGCAATTATG ATGGTATGAA

51   GGGTTTTACC ATTATTGAAT TTTTGGTTGC GGGCATGCTC AGTATGATTG

101   TCCTGATGGC GGTCGGATCG AGTTACTTCA CATCCCGGAA ATTAAATGAT

151   GCGGCAAACG AGCGTCTTTC CGCGCAACAG GATTTGCGGA ATGCGGCAAC

201   ATTGATTGTC CGCGATGCAA GAATGGCAGG GGGCTTCGGT TGTTTCAATA

251   TGTCCGAGCA TACTAAAAAT GATATTATTG TTGATCCAAG TAAGCAAACT

301   CAACATGTCC CTGTAAAACC CGGTGCCAAA CAAGAAAATC CCCTTTTTTC

351   TTTAGAGTGG GCTAATACTA ATAATACTAA TAATAATACA GCTAAATTGA

401   TTCCTATTGC TGAATCCACA GATATTAAAT ATCCGGGTTT TGCCCAGGCT

451   CGTCCGGCAT TGATTTTCCA ATACGGCATC GATGATCTTG ATGCGAGTGC

501   TGAGACTGTT GTAGTCAGCA GCTGTTCCAA AATAGCAAAA CCGGGTAAGA

551   AAATATCTAC CTTGCAAGAA GCAAAGAGTG CATTACAGAT TACTAATGAT

601   GATAAACAAA ATGGAAATAT CACCCGTCAA AGGCATGTGG TCAATGCCTA

651   TGCGGTCGGC AGGATTGCCG GTGAGGAAGG TTTGTTCCGC TTCCAATTGG
```

```
-continued
701  ATGATAAGGG CAAGTGGGGT AATCCTCAGT TGCTCGTGAA AAAGATTAGA

751  CATATGAAAG TGCGGTATAT CTATGTTTCC GACTGTCCTG AAGATGACGA

801  TGCCGGCAAA GAGGAAAAAT TCAAATATAC GGGTACATTC GACAGCTCCA

851  CAAATGCTGT TACGCCCGCC GGGGTGGAGG TTTTATTGAG TANCGGTACT

901  GATACCAAGA TTGCCGCTTC TTCAGACAAT CATATTTATG CTTACCGTAT

951  CGATGCGACA ATACGCGGGG GAAATGTATG CGCAAACAGA ACACTTTGA
```

This corresponds to the amino acid sequence <SEQ ID 952; ORF 247.a>:

```
a247.pep
   1  MRRKMLNVPK GNYDGMKGFT IIEFLVAGML SMIVLMAVGS SYFTSRKLND

51  AANERLSAQQ DLRNAATLIV RDARMAGGFG CFNMSEHTKN DIIVDPSKQT

101  QHVPVKPGAK QENPLFSLEW ANTNNTNNNT AKLIPIAEST DIKYPGFAQA

151  RPALIFQYGI DDLDASAETV VVSSCSKIAK PGKKISTLQE AKSALQITND

201  DKQNGNITRQ RHVVNAYAVG RIAGEEGLFR FQLDDKGKWG NPQLLVKKIR

251  HMKVRYIYVS DCPEDDDAGK EEKFKYTGTF DSSTNAVTPA GVEVLLSXGT

301  DTKIAASSDN HIYAYRIDAT IRGGNVCANR TL*
``` m247/a247 70.9% identity in 244 aa overlap

```
                  10         20         30         40         50         60
m247.pep  XRRKMLNVXXGSYDGMKGFTIIEFLVAGLLSMIVLMAVGSSYFTSRKLNDAANERLAAQQ
          ||||||| |:||||||||||||||||:||||||||||||||||||||||||||||:|||
a247      MRRKMLNVPKGNYDGMKGFTIIEFLVAGMLSMIVLMAVGSSYFTSRKLNDAANERLSAQQ
                  10         20         30         40         50         60

70         80         90                         100
m247.pep  DLRNAATLIVRDARMAGGFGCFNMSEHPATDVI-------------PDTTQQNSPFSLK-
          |||||||||||||||||||||||||||| :|:|             | :| |||:
a247      DLRNAATLIVRDARMAGGFGCFNMSEHTKNDIIVDPSKQTQHVPVKPGAKQENPLFSLEW
                  70         80         90        100        110        120

110        120        130        140        150        160
m247.pep  ------RNGIDKLIPIAESSNINYQNFFQVGSALIFQYGIDDVNASTATTVVSSCAAISK
                |:| |||||||||::|:| :| |: |||||||||||::||: |:|||||:|||
a247      ANTNNTNNNTAKLIPIAESTDIKYPGFAQARPALIFQYGIDDLDASAETVVSSCSKIAK
                 130        140        150        160        170        180

170        180        190        200        210        220
m247.pep  PGKQIPTLEDAKKELKIPDQDKEQNGNIARQRHVVNAYAVGRIADEESLFRFQLDDKGKW
          |||:| ||::||: |:| |::  |||||:||||||||||||||| ||:|||||||||||
a247      PGKKISTLQEAKSALQITNDDK-QNGNITRQRHVVNAYAVGRIAGEEGLFRFQLDDKGKW
                 190        200        210        220        230 m247.pep  GNPQL
          |||||
a247      GNPQLLVKKIRHMKVRYIYVSDCPEDDDAGKEEKFKYTGTFDSSTNAVTPAGVEVLLSXG
                 240        250        260        270        280        290
```

The following partial DNA sequence was identified in *N. gonorrhoeae* <SEQ ID 953>:

```
g247-1.seq (partial) ..
   1      CCCGGTGCCA AACAAGAAAA TCCCCTTTTT TCCTTAAAAA GGAGCGGCAT

51      GGATAAACAA CTGATTCCCG TTGCTGAATC CATAGATATT AAATATCCGG

101      GTTTTATCCA GCGCCTTAAC GCATTGGTTT TCCAATACGG TATCGATGAT

151      CTTGATGCGA GTGCTGAGAC TGTTGTAGTC AGCAGCTGTT CCAAAATAGC

201      AAAACCGGGT AAGAAAATAT CTACCTTGCA AGAAGCAAAG AGTGCATTAC

251      AGATTACTAA TGATGATAAA CAAAATGGAA ATATCACCCG TCAGAAACAT
```

```
301    GTGGTCAATG CCTATGCGGT CGGCAGGTTT GGCAATAATG AGGAAAGTTT

351    GTTCCGCTTC CAATTGGATG ATAAGGGCAA GTGGGGTAAT CCTCAGTTGC

401    TCGTGAAAAA GGTTAAACGT ATGGATGTGC GGTATATTTA TGTTTCCGGT

451    TGTCCTGAAG ATGAAGATGC CGGCAAAGAG GAAAAATTCA GATATACGAA

501    TAAATTCGAC AAATCCAAAA ATGCTGTTAC GCCTGCCGGG GTGGAGGTTT

551    TATTGGATAG CGGCCTTAAT GCCAAGATTG CCGCTTCTTC AGACAATAGT

601    ATTTATGCTT ACCGTATCAA TGCGACAATA CGCGGGGGAA ATGTATGCGC

651    AAACAGAACA CTTTGA
```

This corresponds to the amino acid sequence <SEQ ID 954; ORF 247-1.ng>:

```
g247-1.pep (partial) ..
  1    PGAKQENPLF SLKRSGMDKQ LIPVAESIDI KYPGFIQRLN ALVFQYGIDD

51    LDASAETVVV SSCSKIAKPG KKISTLQEAK SALQITNDDK QNGNITRQKH

101    VVNAYAVGRF GNNEESLFRF QLDDKGKWGN PQLLVKKVKR MDVRYIYVSG

151    CPEDEDAGKE EKFRYTNKFD KSKNAVTPAG VEVLLDSGLN AKIAASSDNS

201    IYAYRINATI RGGNVCANRT L*
```

The following partial DNA sequence was identified in *N. meningitidis* <SEQ ID 955>:

```
m247-1.seq
  1    ATGAGACGTA AAATGCTAAA CGTACCAAAA GGCAGTTATG ATGGTATGAA

51    AGGTTTTACC ATTATTGAAT TTTTGGTTGC GGGCCTGCTC AGTATGATTG

101    TCCTGATGGC GGTCGGATCG AGTTACTTCA CATCCCGGAA ATTAAATGAT

151    GCGGCAAACG AGCGTCTTGC CGCGCAACAG GATTTGCGGA ATGCGGCAAC

201    ATTGATTGTC CGCGATGCGA GAATGGCAGG CGGCTTCGGT TGTTTCAATA

251    TGTCCGAGCA TCCTGCAACT GATGTTATTC CCGATACGAC GCAACAAAAT

301    TCTCCTTTTT CCTTAAAAAG GAACGGTATA GATAAACTTA TTCCCATAGC

351    GGAATCTTCA AATATCAATT ATCAGAATTT TTTCCAGGTT GGTAGCGCAT

401    TGATTTTTCA ATACGGAATC GATGATGTTA ATGCAAGCAC GCGACTACC

451    GTCGTCAGCA GCTGTGCCGC AATATCGAAA CCGGGCAAGC AAATCCCTAC

501    TTTAGAAGAT GCAAAAAAAG AATTGAAGAT TCCGGATCAG GATAAGGAGC

551    AAAATGGCAA TATAGCGCGT CAAGGCATG TGGTCAATGC CTATGCGGTC

601    GGCAGGATTG CCGATGAGGA AGGTTTGTTC CGCTTCCAAT GGATGATAA

651    GGGCAAGTGG GGTAATCCTC AGTTGCTCGT GAAAAAGGTT AGACATATGA

701    AAGTGCGGTA TATCTATGTT TCCGGCTGTC CTGAAGATGA CGATGCCGGC

751    AAAGAGGAAA CATTCAAATA TACGGATAAA TTCGACAGCG CCCAAAATGC

801    TGTTACGCCC GCCGGGGTGG AGGTTTTATT GAGTAGCGGT ACTGATACCA

851    AGATTGCCGC TTCTTCAGAC AATCATATTT ATGCTTACCG TATCGATGCG

901    ACAATACGCG GGGAAATGT ATGCGCAAAC AGAACACTTT GA
```

This corresponds to the amino acid sequence <SEQ ID 956; ORF 247-1>:

```
m247-1.pep
      1     MRRKMLNVPK GSYDGMKGFT IIEFLVAGLL SMIVLMAVGS SYFTSRKLND

51     AANERLAAQQ DLRNAATLIV RDARMAGGFG CFNMSEHPAT DVIPDTTQQN

101     SPFSLKRNGI DKLIPIAESS NINYQNFFQV GSALIFQYGI DDVNASTATT

151     VVSSCAAISK PGKQIPTLED AKKELKIPDQ DKEQNGNIAR QRHVVNAYAV

201     GRIADEEGLF RFQLDDKGKW GNPQLLVKKV RHMKVRYIYV SGCPEDDDAG

251     KEETFKYTDK FDSAQNAVTP AGVEVLLSSG TDTKIAASSD NHIYAYRIDA

301     TIRGGNVCAN RTL*
``` m247-1/g247-1 72.1% identity in 222 aa overlap

```
                   70        80        90       100       110       120
m247-1.pep    NAATLIVRDARMAGGFGCFNMSEHPATDVIPDTTQQNSPFSLKRNGIDK-LIPIAESSNI
                                            | :  |:|  |||||:|:|| |||:||| :|
g247-1                                      PGAKQENPLFSLKRSGMDKQLIPVAESIDI
                                                    10        20        30

130       140       150       160       170       180
m247-1.pep    NYQNFFQVGSALIFQYGIDDVNASTATTVVSSCAAISKPGKQIPTLEDAKKELKIPDQDK
              :| :|:|  :||:|||||||::||: |:|||||: |:||||:| ||::||: |:| ::||
g247-1        KYPGFIQRLNALVFQYGIDDLDASAETVVVSSCSKIAKPGKKISTLQEAKSALQITNDDK
                      40        50        60        70        80        90

190       200       210       220       230       240
m247-1.pep    EQNGNIARQRHVVNAYAVGRIAD-EEGLFRFQLDDKGKWGNPQLLVKKVRHMKVRYIYVS
               |||||:||:||||||||||::: ||:||||||||||||||||||||||::| |||||||
g247-1        -QNGNITRQKHVVNAYAVGRFGNNEESLFRFQLDDKGKWGNPQLLVKKVKRMDVRYIYVS
                      100       110       120       130       140

250       260       270       280       290       300
m247-1.pep    GCPEDDDAGKEETFKYTDKFDSAQNAVTPAGVEVLLSSGTDTKIAASSDNHIYAYRIDAT
              |||||:|||||| |:||:|||:::||||||||||||:|| ::|||||||| ||||||:||
g247-1        GCPEDEDAGKEEKFRYTNKFDKSKNAVTPAGVEVLLDSGLNAKIAASSDNSIYAYRINAT
            150       160       170       180       190       200

310
m247-1.pep    IRGGNVCANRTLX
              |||||||||||||
g247-1        IRGGNVCANRTLX
            210       220
```

The following partial DNA sequence was identified in *N. meningitidis* <SEQ ID 957>:

```
a247-1.seq (partial)
      1     AATAATACAG CTAAATTGAT TCCTATTGCT GAATCCACAG ATATTAAATA

51     TCCGGGTTTT GCCCAGGCTC GTCCGGCATT GATTTTCCAA TACGGCATCG

101     ATGATCTTGA TGCGAGTGCT GAGACTGTTG TAGTCAGCAG CTGTTCCAAA

151     ATAGCAAAAC CGGGTAAGAA AATATCTACC TTGCAAGAAG CAAAGAGTGC

201     ATTACAGATT ACTAATGATG ATAAACAAAA TGGAAATATC ACCCGTCAAA

251     GGCATGTGGT CAATGCCTAT GCGGTCGGCA GGATTGCCGG TGAGGAAGGT

301     TTGTTCCGCT TCCAATTGGA TGATAAGGGC AAGTGGGGTA ATCCTCAGTT

351     GCTCGTGAAA AAGATTAGAC ATATGAAAGT GCGGTATATC TATGTTTCCG

401     ACTGTCCTGA AGATGACGAT GCCGGCAAAG AGGAAAAATT CAAATATACG

451     GGTACATTCG ACAGCTCCAC AAATGCTGTT ACGCCCGCCG GGGTGGAGGT

501     TTTATTGAGT AGCGGTACTG ATACCAAGAT TGCCGCTTCT TCAGACAATC

551     ATATTTATGC TTACCGTATC GATGCGACAA TACGCGGGGG AAATGTATGC

601     GCAAACAGAA CACTTTGA
```

This corresponds to the amino acid sequence <SEQ ID 958; ORF 247-1.a>:

```
a247-1.pep (partial) ..
     1     NNTAKLIPIA ESTDIKYPGF AQARPALIFQ YGIDDLDASA ETVVVSSCSK

51     IAKPGKKIST LQEAKSALQI TNDDKQNGNI TRQRHVVNAY AVGRIAGEEG

101     LFRFQLDDKG KWGNPQLLVK KIRHMKVRYI YVSDCPEDDD AGKEEKFKYT

151     GTFDSSTNAV TPAGVEVLLS SGTDTKIAAS SDNHIYAYRI DATIRGGNVC

201     ANRTL*
``` m247-1/a247-1 80.6% identity in 206 aa overlap

```
                                       10         20         30
      a247-1.pep                NNTAKLIPIAESTDIKYPGFAQARPALIFQ
                                |: ||||||||::|:| :| |: |||||
      m247-1     GFGCFNMSEHPATDVIPDTTQQNSPFSLKRNGIDKLIPIAESSNINYQNFFQVGSALIFQ
                         80        90       100       110       120       130
                         40         50         60         70         80        89
      a247-1.pep YGIDDLDASAETVVVSSCSKIAKPGKKISTLQEAKSALQITNDDK-QNGNITRQRHVVNA
                 ||||::||: |:|||||: |:||||| ||::||: |:| ::|| |||||||||||||
      m247-1     YGIDDVNASTATTVVSSCAAISKPGKQIPTLEDAKKELKIPDQDKEQNGNIARQRHVVNA
                        140       150       160       170       180       190
                 90        100       110       120       130       140       149
      a247-1.pep YAVGRIAGEEGLFRFQLDDKGKWGNPQLLVKKIRHMKVRYIYVSDCPEDDDAGKEEKFKY
                 ||||||| |||||||||||||||||||||||||:||||||||||| |||||||||| |||
      m247-1     YAVGRIADEEGLFRFQLDDKGKWGNPQLLVKKVRHMKVRYIYVSGCPEDDDAGKEETFKY
                        200       210       220       230       240       250
                 150       160       170       180       190       200
      a247-1.pep TGTFDSSTNAVTPAGVEVLLSSGTDTKIAASSDNHIYAYRIDATIRGGNVCANRTLX
                 | |||: ||||||||||||||||||||||||||||||||||||||||||||||||||
      m247-1     TDKFDSAQNAVTPAGVEVLLSSGTDTKIAASSDNHIYAYRIDATIRGGNVCANRTLX
                        260       270       280       290       300       310
```

The following partial DNA sequence was identified in *N. gonorrhoeae* <SEQ ID 959>:

```
g248.seq
     1     atgcgcaaac agaacacttt gacaggaatc ccgacttctg acggacagag 51     ggggtccgca ctgtttatcg tgctgatggt gatgatagtc gtggcctttt 101     tggttgtaac tgccgcccag tcctacaata ccgaacagag gatcagtgcc 151     aacgaatcag acaggaaatt ggctttgtct ttagccgagg cggctttgcg 201     ggagggcgaa tttcaggttt tggatttgga atatgctgcg gacagtaagg 251     ttacgttttag cgaaaactgt gaaaaaggtc tgtgtaccgc agtgaatgtg 301     cggacaaata ataatggtag tgaagaggct tttggcaata tcgtggtgca 351     aggcaagccc gccgttgagg cggtgaaacg ttcttgccct gcaaagtctg 401     gcaaaaattc taccgacctg tgcattgaca ataaagggat ggaatataat 451     aaaggcgcgg caggcgtcag caaaatgccg cgctatatta tcgaatattt 501     aggcgtgaag aacggacaaa atgtttatcg ggttactgcc aaggcttggg 551     gtaagaatgc caataccgtg gtcgtccttc aatcttatgt aggcaataat 601     gatgagcaat aa
```

This corresponds to the amino acid sequence <SEQ ID 960; ORF 248.ng>:

```
g248.pep
     1     MRKQNTLTGI PTSDGQRGSA LFIVLMVMIV VAFLVVTAAQ SYNTEQRISA

51     NESDRKLALS LAEAALREGE FQVLDLEYAA DSKVTFSENC EKGLCTAVNV

101     RTNNNGSEEA FGNIVVQGKP AVEAVKRSCP AKSGKNSTDL CIDNKGMEYN
```

```
151  KGAAGVSKMP RYIIEYLGVK NGQNVYRVTA KAWGKNANTV VVLQSYVGNN

201  DEQ*
```

The following partial DNA sequence was identified in *N. meningitidis* <SEQ ID 961>:

```
m248.seq (partial)
  1    ..GGGTTTGCAC TGTTAATCGT GCTGATGGTG ATrATCGTCG TGGCT.TywT 51       gGwTGTAACT GCCGCGCAGT CTTACAATAC cGAGCAGCGk ATCAGTkCCA 101       ACGAATCAGA CAGGAAATTG GCTwTGTCTT TGGCCGAGkC GkCTwTGCGG

151       GAAGGCGAAC TTCAGGTTTT GGATTTGGAA TATGATACGG ACAGTAAGGT

201       TACATTTAGC GAAAACTGTG GAAAAGGTCT GTsTGCCGCA GTGAATGTGC

251       GGACAAATAA TGATAATGAA GAGGCTTTTG ACAATATCGT GGTGCAAGGC

301       AAGCCCACCG TTGAGGCGGT GAAGCGTTCT TGCCCTGCAA ATTCTACCGA

351       CCTGTGCATT GACAAGAAAG GGwTGGAATA TAAGAAAGGC ACGAGAAGCG

401       TCAc.AAAAT GCCACGTTAT ATTATCGAAT ATTTGGGCGT GwAGAACGGA

451       GAAAATGTTT ATCGGGTTAC TGCCAAGGCT TGGGGtAAGA ATGCCAATAC

501       CGTGGTCGTC CTTCAATCTT ATGTAAGCAA TAATGATGAG TAA
```

This corresponds to the amino acid sequence <SEQ ID 962; ORF 248>:

```
m248.pep (partial)
  1    ..GFALLIVLMV XIVVAFXXVT AAQSYNTEQR ISXNESDRKL AXSLAEXXXR

51       EGELQVLDLE YDTDSKVTFS ENCGKGLXAA VNVRTNNDNE EAFDNIVVQG

101       KPTVEAVKRS CPANSTDLCI DKKGXEYKKG TRSVTKMPRY IIEYLGVXNG

151       ENVYRVTAKA WGKNANTVVV LQSYVSNNDE *
```

Computer analysis of this amino acid sequence gave the following results:
Homology with a Predicted ORF from *N. gonorrhoeae*
ORF 248 shows 81.1% identity over a 185 aa overlap with a predicted ORF (ORF 248.ng) from *N. gonorrhoeae*:

```
m248/g248
                         10         20         30         40
m248.pep          GFALLIVLMVXIVVAFXXVTAAQSYNTEQRISXNESDRKLAXS
                  | ||:||||| |||||  |||||||||||||| |||||||| |
g248     MRKQNTLTGIPTSDGQRGSALFIVLMVMIVVAFLVVTAAQSYNTEQRISANESDRKLALS
                 10        20        30        40        50        60

50         60         70         80         90        100
m248.pep  LAEXXXREGELQVLDLEYDTDSKVTFSENCGKGLXAAVNVRTNND-NEEAFDNIVVQGKP
          |||    ||||:|||||| :|||||||||| ||| :|||||||:  :|||| ||||||||
g248      LAEAALREGEFQVLDLEYAADSKVTFSENCEKGLCTAVNVRTNNNGSEEAFGNIVVQGKP
                 70        80        90        100       110       120

110        120        130        140        150
m248.pep  TVEAVKRSCPA----NSTDLCIDKKGXEYKKGTRSVTKMPRYIIEYLGVXNGENVYRVTA
          :||||||||||    ||||||||:|| ||:||: :|:||||||||||||||:|||||||
g248      AVEAVKRSCPAKSGKNSTDLCIDNKGMEYNKGAAGVSKMPRYIIEYLGVKNGQNVYRVTA
                130       140        150       160       170       180

160        170        180
m248.pep  KAWGKNANTVVVLQSYVSNNDEX
          |||||||||||||||||:||||
g248      KAWGKNANTVVVLQSYVGNNDEQX
                190       200
```

The following partial DNA sequence was identified in *N. meningitidis* <SEQ ID 963>:

```
a248.seq
     1   ATGCGCAAAC AGAACACTTT GACGGGAATC CCGACTTCTG ACGGACAGAG

51   GGGGTTTGCA CTGTTTATCG TGCTGATGGT GATGATCGTC GTGGCTTTTT

101   TGGTTGTAAC TGCCGCGCAG TCTTACAATA CCGAGCAGCG GATCAGTGCC

151   AACGAATCAG ACAGGAAATT GGCTTTGTCT TTGGCCGAGG CGGCTTTGCG

201   GGAAGGCGAA CTTCAGGTTT TGGATTTGGA ATATGATACG GACAGTAAGG

251   TTACATTTAG CGAAAACTGT GGAAAAGGTC TGTGTACCGC AGTGAATGTG

301   CGGACAAATA ATGATAATGA AGAGGCTTTT GACAATATCG TGGTGCAAGG

351   CAAGCCCACC GTTGAGGCGG TGAAGCGTTC TTGCACTGCA AAATCTACAG

401   GCCTGTGCAT TGACAATAAA GGGATGGAAT ATAAGAAAGG CACGCAAAGC

451   GTCAGCAAAA TGCCACGTTA TATTATCGAA TATTTGGGCG TGAAGAACGG

501   AGAAAATGTT TATCGGGTTA CTGCCAAGGC TTGGGGTAAG AATGCCAATA

551   CCGTGGTCGT CCTTCAATCT TATGTAAGCA ATAATGATGA GTAA
```

This corresponds to the amino acid sequence <SEQ ID 964; ORF 248.a>:

```
a248.pep
     1   MRKQNTLTGI PTSDGQRGFA LFIVLMVMIV VAFLVVTAAQ SYNTEQRISA

51   NESDRKLALS LAEAALREGE LQVLDLEYDT DSKVTFSENC GKGLCTAVNV

101   RTNNDNEEAF DNIVVQGKPT VEAVKRSCTA KSTGLCIDNK GMEYKKGTQS

151   VSKMPRYIIE YLGVKNGENV YRVTAKAWGK NANTVVVLQS YVSNNDE*
``` m248/a248 89.4% identity in 180 aa overlap

```
                                         10        20        30        40
m248.pep                        GFALLIVLMVXIVVAFXXVTAAQSYNTEQRISXNESDRKLAXS
                                ||||:||||| |||||  |||||||||||||| |||||||| |
a248           MRKQNTLTGIPTSDGQRGFALFIVLMVMIVVAFLVVTAAQSYNTEQRISANESDRKLALS
                       10        20        30        40        50        60

50        60        70        80        90       100
m248.pep       LAEXXXREGELQVLDLEYDTDSKVTFSENCGKGLXAAVNVRTNNDNEEAFDNIVVQGKPT
               |||   |||||||||||||||||||||||||||| :||||||||||||||||||||||||
a248           LAEAALREGELQVLDLEYDTDSKVTFSENCGKGLCTAVNVRTNNDNEEAFDNIVVQGKPT
                       70        80        90       100       110       120

110       120       130       140       150       160
m248.pep       VEAVKRSCPANSTDLCIDKKGXEYKKGTRSVTKMPRYIIEYLGVXNGENVYRVTAKAWGK
               |||||||| |:|| ||||:|| ||||||:||:|||||||||||| |||||||||||||||
a248           VEAVKRSCTAKSTGLCIDNKGMEYKKGTQSVSKMPRYIIEYLGVKNGENVYRVTAKAWGK
                      130       140       150       160       170       180

170       180
m248.pep       NANTVVVLQSYVSNNDEX
               ||||||||||||||||||
a248           NANTVVVLQSYVSNNDEX
                      190
```

The following partial DNA sequence was identified in *N. meningitidis* <SEQ ID 965>:

```
m248-1.seq
       1     ATGCGCAAAC AGAACACTTT GACGGGAATC CCGACTTCTG ACGGACAGAG

51     GGGGTTTGCA CTGTTTATCG TGCTGATGGT GATGATCGTC GTGGCTTTTT

101     TGGTTGTAAC TGCCGCGCAG TCTTACAATA CCGAGCAGCG GATCAGTGCC
```

-continued

```
151  AACGAATCAG ACAGGAAATT GGCTTTGTCT TTGGCCGAGG CGGCTTTGCG

201  GGAAGGCGAA CTTCAGGTTT TGGATTTGGA ATATGATACG GACAGTAAGG

251  TTACATTTAG CGAAAACTGT GGAAAAGGTC TGTGTGCCGC AGTGAATGTG

301  CGGACAAATA ATGATAATGA AGAGGCTTTT GACAATATCG TGGTGCAAGG

351  CAAGCCCACC GTTGAGGCGG TGAAGCGTTC TTGCCCTGCA AATTCTACCG

401  ACCTGTGCAT TGACAAGAAA GGGATGGAAT ATAAGAAAGG CACGAGAAGC

451  GTCAGCAAAA TGCCACGTTA TATTATCGAA TATTTGGGCG TGAAGAACGG

501  AGAAAATGTT TATCGGGTTA CTGCCAAGGC TTGGGGTAAG AATGCCAATA

551  CCGTGGTCGT CCTTCAATCT TATGTAAGCA ATAATGATGA GTAA
```

This corresponds to the amino acid sequence <SEQ ID 966; ORF 248-1>:

```
m248-1.pep
    1  MRKQNTLTGI PTSDGQRGFA LFIVLMVMIV VAFLVVTAAQ SYNTEQRISA

51  NESDRKLALS LAEAALREGE LQVLDLEYDT DSKVTFSENC GKGLCAAVNV

101  RTNNDNEEAF DNIVVQGKPT VEAVKRSCPA NSTDLCIDKK GMEYKKGTRS

151  VSKMPRYIIE YLGVKNGENV YRVTAKAWGK NANTVVVLQS YVSNNDE*
``` m248-1/g248 89.1% identity in 202 aa overlap

```
                 10         20         30         40         50         60
m248-1.pep  MRKQNTLTGIPTSDGQRGFALFIVLMVMIVVAFLVVTAAQSYNTEQRISANESDRKLALS
            ||||||||||||||||||||  ||||||||||||||||||||||||||||||||||||||
g248        MRKQNTLTGIPTSDGQRGSALFIVLMVMIVVAFLVVTAAQSYNTEQRISANESDRKLALS
                 10         20         30         40         50         60

70         80         90        100        110       119
m248-1.pep  LAEAALREGELQVLDLEYDTDSKVTFSENCGKGLCAAVNVRTNND-NEEAFDNIVVQGKP
            ||||||||||:|||||||| :|||||||||:|||||:|||||||| :||||:|||||||
g248        LAEAALREGEFQVLDLEYAADSKVTFSENCEKGLCTAVNVRTNNNGSEEAFGNIVVQGKP
                 70         80         90        100        110        120

120        130        140        150        160        170
m248-1.pep  TVEAVKRSCPA----NSTDLCIDKKGMEYKKGTRSVSKMPRYIIEYLGVKNGENVYRVTA
            :||||||||||    |||||||||:|||| :  :|||||||||||||:||||:|||||||
g248        AVEAVKRSCPAKSGKNSTDLCIDNKGMEYNKGAAGVSKMPRYIIEYLGVKNGQNVYRVTA
                130        140        150        160        170        180

180        190
m248-1.pep  KAWGKNANTVVVLQSYVSNNDEX
            ||||||||||||||||||:||||
g248        KAWGKNANTVVVLQSYVGNNDEQX
                190        200
``` m248-1/a248 97.0% identity in 197 aa overlap

```
                 10         20         30         40         50         60
m248-1.pep  MRKQNTLTGIPTSDGQRGFALFIVLMVMIVVAFLVVTAAQSYNTEQRISANESDRKLALS
            ||||||||||||||||||||||||||||||||||||||||||||||||||||||||||||
a248        MRKQNTLTGIPTSDGQRGFALFIVLMVMIVVAFLVVTAAQSYNTEQRISANESDRKLALS
                 10         20         30         40         50         60

70         80         90        100        110        120
m248-1.pep  LAEAALREGELQVLDLEYDTDSKVTFSENCGKGLCAAVNVRTNNDNEEAFDNIVVQGKPT
            |||||||||||||||||||||||||||||||||||:||||||||||||||||||||||||
a248        LAEAALREGELQVLDLEYDTDSKVTFSENCGKGLCTAVNVRTNNDNEEAFDNIVVQGKPT
                 70         80         90        100        110        120

130        140        150        160        170        180
m248-1.pep  VEAVKRSCPANSTDLCIDKKGMEYKKGTRSVSKMPRYIIEYLGVKNGENVYRVTAKAWGK
            ||||||||:||:||||||:|||||||||:||||||||||||||||||||||||||||||
a248        VEAVKRSCTAKSTGLCIDNKGMEYKKGTQSVSKMPRYIIEYLGVKNGENVYRVTAKAWGK
                130        140        150        160        170        180
```

```
            190
m248-1.pep  NANTVVVLQSYVSNNDEX
            ||||||||||||||||||
a248        NANTVVVLQSYVSNNDEX
            190
```

The following partial DNA sequence was identified in *N. gonorrhoeae* <SEQ ID 967>:

```
g249.seq
    1   atgaagaata atgattgctt gcgcctgaaa aatccccagt ccggtatggc 51   gttgatagaa gtcttggtcg ctatgctcgt tctgaccatc ggtattttgg 101   cattgctgtc cgtacagttg cggacagtcg cttccgtcag ggaggcggaa 151   acgcaaacca tcgtcagcca aatcacgcaa aacctgatgg aaggaatgtt 201   gatgaatccg accattgatt tggacagcaa caagaaaaac tatagtcttt 251   acatgggaaa acagacacta tcagctgtgg atggtgagtt tatgcttgat 301   gccgagaaaa gtaaggcgca gttggcagag gaacaattga agagatttag 351   tcatgagctg aaaaatgcct tgccggatgc ggtagctatt cattacgccg 401   tctgcaagga ttcgtcgggt gacgcgccga cattgtccga cagcggtgct 451   ttttcttcaa attgcgacaa taaggcaaac ggggatactt tgattaaagt 501   attgtgggta aatgattcgg caggggattc ggatatttcc cgtacgaatc 551   ttgaagtgag cggcgacaat atcgtatata cctatcaggc aagggtcgga 601   ggtcgtgaat ga
```

This corresponds to the amino acid sequence <SEQ ID 968; ORF 249.ng>:

```
g249.pep
    1   MKNNDCLRLK NPQSGMALIE VLVAMLVLTI GILALLSVQL RTVASVREAE

51   TQTIVSQITQ NLMEGMLMNP TIDLDSNKKN YSLYMGKQTL SAVDGEFMLD

101   AEKSKAQLAE EQLKRFSHEL KNALPDAVAI HYAVCKDSSG DAPTLSDSGA

151   FSSNCDNKAN GDTLIKVLWV NDSAGDSDIS RTNLEVSGDN IVYTYQARVG

201   GRE*
```

The following partial DNA sequence was identified in *N. meningitidis* <SEQ ID 969>:

```
m249.seq
    1   ATGAAGAATA ATGATTGCTT CCGCCTGAAA GATTCCCAGT CCGGTATGGC

51   GCTGATAGAA GTCTTGGTTG CTATGCTCGT TCTGACCATC GGTATTTTGG

101   CACTATTGTC TGTACAGTTG CGGACAGTCN NNNNNNNNNN NNNNNNNNNN

151   NNNNNNNNNN NNNNNNNNNN NNNNNNNNNN NNNTTGATGG AGGGAATGTT

201   GATGAATCCG ACCATTGATT CGGACAGCAA CAAGAAAAAC TATAATCTTT

251   ACATGGGAAA CCATACACTA TCAGCTGTGG ATGGCGATTT TGCGATTGAT

301   GCCATGAAAA CTAAGGGGCA ATTGGCAGAG GCACAATTGA AGAGATTTAG

351   TTATGAGCTG AAAAATGCCT TGCCGGATGC GGCAGCCATC CATTACGCCG

401   TCTGCAAGGA TTCGTCGGGT AACGCGCCGA CATTGTCCGG CAATGCTTTT

451   TCTTCAAATT GCGACAATAA GGCAAACGGG GATACTTTAA TTAAAGTATT
```

-continued

```
501  GTGGGTAAAT GATTCGGCAG GGGATTCGGA TATTTCCCGT ACGAATCTTG

551  AGGTGAGCGG CGACAATATC GTATATACTT ATCAGGCAAG GGTCGGAGGT

601  CGGGAATGA
```

This corresponds to the amino acid sequence <SEQ ID 970; m249.pep ORF 249>:

```
m249.pep
    1   MKNNDCFRLK DSQSGMALIE VLVAMLVLTI GILALLSVQL RTVXXXXXXX

51   XXXXXXXXXX XLMEGMLMNP TIDSDSNKKN YNLYMGNHTL SAVDGDFAID

101   AMKTKGQLAE AQLKRFSYEL KNALPDAAAI HYAVCKDSSG NAPTLSGNAF

151   SSNCDNKANG DTLIKVLWVN DSAGDSDISR TNLEVSGDNI VYTYQARVGG

201   RE*
```

Computer analysis of this amino acid sequence gave the following results:
Homology with a Predicted ORF from *N. gonorrhoeae*
ORF 249 shows 81.3% identity over a 203 aa overlap with a predicted ORF (ORF 249.ng) from *N. gonorrhoeae*:
m249/g249

```
m249/g249
                     10         20         30         40         50         60
   n249.pep  MKNNDCFRLKDSQSGMALIEVLVAMLVLTIGILALLSVQLRTVXXXXXXXXXXXXXXXX
             ||||||:|||:||||||||||||||||||||||||||||||||   :    :       :
   g249      MKNNDCLRLKNPQSGMALIEVLVAMLVLTIGILALLSVQLRTVASVREAETQTIVSQITQ
                     10         20         30         40         50         60

70         80         90        100        110        120
   m249.pep  XIMEGMLMNPTIDSDSNKKNYNLYMGNHTLSAVDGDFAIDAMKTKGQLAEAQLKRFSYEL
              ||||||||||||| |||||||:||||::||||||||:|:||  |:|:||||||||||:||
   g249      NLMEGMLMNPTIDLDSNKKNYSLYMGKQTLSAVDGEFMLDAEKSKAQLAEEQLKRFSHEL
                     70         80         90        100        110        120

130        140        150        160        170        179
   m249.pep  KNALPDAAAIHYAVCKDSSGNAPTLSGN-AFSSNCDNKANGDTLIKVLWVNDSAGDSDIS
             ||||||:|||||||||||||:||||  :  ||||||||||||||||||||||||||||||
   g249      KNALPDAVAIHYAVCKDSSGDAPTLSDSGAFSSNCDNKANGDTLIKVLWVNDSAGDSDIS
                     130        140        150        160        170        180

180        190        200
   m249.pep  RTNLEVSGDNIVYTYQARVGGREX
             ||||||||||||||||||||||||
   g249      RTNLEVSGDNIVYTYQARVGGREX
                 190        200
```

The following partial DNA sequence was identified in *N. meningitidis* <SEQ ID 971>:

```
a249.seq
    1   ATGAAGAATA ATGATTGCTT CCGCCTGAAA AACCCCCAGT CCGGTATGGC

51   GCTGATAGAA GTCTTGGTCG CTATGCTCGT TCTGACCATC GGTATTTTGG

101   CACTATTGTC TGTTCAGTTG CGGACAGTCG CTTCCGTCAG GGAGGCAGAG

151   ACGCAAACCA TCGTCAGTCA AATCACGCAA AACCTGATGG AAGGAATGTT

201   GATGAATCCG ACCATTGATT CGGACAGCAA CAAGAAAAAC TATAATCTTT

251   ACATGGGAAA CCATCATGCA CTATCAGTTG TGGATGGCGA TTTTCAGGTT

301   GATGCCATAA AAACTAAGAC GCAGTTGGCA GAGGCACAAT TGAAGAGATT

351   TAGTTATGAG CTGAAAAATG CCTTGCCGGA TGCGGCAGCC ATCCATTACG

401   CCGTCTGCAA GGATTCGTCG GGTGTTGCGC CGACATTGTC CGCCGGCAGT
```

```
-continued
451  ACTTTTTCTT CAAATTGCGA TGGTAGTGCA AATGGGGATA CTTTGATTAA

501  AGTATTGTGG GTAAATGATT CGGCAGGGGA TTCGGATATC GCCCGTACGA

551  ATCTTGAGAC GAACGGCAAC AATATCGTAT ATACCTATCA GGCAAGGGTC

601  GGAGGTCGGG AATGA
```

This corresponds to the amino acid sequence <SEQ ID 972; ORF 249.a>:

```
a249.pep
  1  MKNNDCFRLK NPQSGMALIE VLVAMLVLTI GILALLSVQL RTVASVREAE

51  TQTIVSQITQ NLMEGMLMNP TIDSDSNKKN YNLYMGNHHA LSVVDGDFQV

101  DAIKTKTQLA EAQLKRFSYE LKNALPDAAA IHYAVCKDSS GVAPTLSAGS

151  TFSSNCDGSA NGDTLIKVLW VNDSAGDSDI ARTNLETNGN NIVYTYQARV

201  GGRE*
``` m249/a249 81.9% identity in 204 aa overlap

```
                10         20         30         40         50         60
m249.pep  MKNNDCFRLKDSQSGMALIEVLVAMLVLTIGILALLSVQLRTVXXXXXXXXXXXXXXXXX
          ||||||||||:||||||||||||||||||||||||||||||||
a249      MKNNDCFRLKNPQSGMALIEVLVAMLVLTIGILALLSVQLRTVASVREAETQTIVSQITQ
                10         20         30         40         50         60
                70         80         90        100        110       119
m249.pep  XLMEGMLMNPTIDSDSNKKNYNLYMGNH-TLSAVDGDFAIDAMKTKGQLAEAQLKRFSYE
           |||||||||||||||||||||||||||| :|| :|||||  :||:|| ||||||||||||
a249      NLMEGMLMNPTIDSDSNKKNYNLYMGNHHALSVVDGFFQVDAIKTKTQLAEAQLKRFSYE
                70         80         90        100        110        120
               120        130        140        150        160        170
m249.pep  LKNALPDAAAIHYAVCKDSSGNAPTLS-GNAFSSNCDNKANGDTLIKVLWVNDSAGDSDI
          ||||||||||||||||||||||||||| |::||||| :|::||| ||||||||||||||
a249      LKNALPDAAAIHYAVCKDSSGNAPTLSAGSTFSSNCDGSANGDTLIKVLWVNDSAGDSDI
               130        140        150        160        170        180
               180        190        200
m249.pep  SRTNLEVSGDNIVYTYQARVGGREX
          :||||::|:||||||||||||||||
a249      ARTNLETNGNNIVYTYQARVGGREX
               190        200
```

The following partial DNA sequence was identified in *N. meningitidis* <SEQ ID 973>:

```
m249-1.seq
  1    ATGAAGAATA ATGATTGCTT CCGCCTGAAA GATTCCCAGT CCGGTATGGC

51    GCTGATAGAA GTCTTGGTTG CTATGCTCGT TCTGACCATC GGTATTTTGG

101    CACTATTGTC TGTACAGTTG CGGACAGTCG CTTCCGTCAG GGAGGCGGAG

151    ACACAAACCA TCGTCAGCCA AATCACGCAA AACCTGATGG AGGGAATGTT

201    GATGAATCCG ACCATTGATT CGGACAGCAA CAAGAAAAAC TATAATCTTT

251    ACATGGGAAA CCATACACTA TCAGCTGTGG ATGGCGATTT TGCGATTGAT

301    GCCATGAAAA CTAAGGGGCA ATTGGCAGAG GCACAATTGA AGAGATTTAG

351    TTATGAGCTG AAAAATGCCT TGCCGGATGC GGCAGCCATC CATTACGCCG

401    TCTGCAAGGA TTCGTCGGGT AACGCGCCGA CATTGTCCGG CAATGCTTTT

451    TCTTCAAATT GCGACAATAA GGCAAACGGG GATACTTTAA TTAAAGTATT

501    GTGGGTAAAT GATTCGGCAG GGGATTCGGA TATTTCCCGT ACGAATCTTG
```

-continued

```
551  AGGTGAGCGG CGACAATATC GTATATACTT ATCAGGCAAG GGTCGGAGGT

601  CGGGAATGA
```

This corresponds to the amino acid sequence <SEQ ID 974; ORF 249-1>:

```
m249-1.pep
    1   MKNNDCFRLK DSQSGMALIE VLVAMLVLTI GILALLSVQL RTVASVREAE

51   TQTIVSQITQ NLMEGMLMNP TIDSDSNKKN YNLYMGNHTL SAVDGDFAID

101   AMKTKGQLAE AQLKRFSYEL KNALPDAAAI HYAVCKDSSG NAPTLSGNAF

151   SSNCDNKANG DTLIKVLWVN DSAGDSDISR TNLEVSGDNI VYTYQARVGG

201   RE*
``` m249-1/g249 90.1% identity in 203 aa overlap

```
                  10         20         30         40         50         60
m249-1.pep  MKNNDCFRLKDSQSGMALIEVLVAMLVLTIGILALLSVQLRTVASVREAETQTIVSQITQ
            ||||||:|||:|||||||||||||||||||||||||||||||||||||||||||||||||
g249        MKNNDCLRLKNPQSGMALIEVLVAMLVLTIGILALLSVQLRTVASVREAETQTIVSQITQ
                  10         20         30         40         50         60

70         80         90        100        110        120
m249-1.pep  NLMEGMLMNPTIDSDSNKKNYNLYMGNHTLSAVDGDFAIDAMKTKGQLAEAQLKRFSYEL
            ||||||||||||| ||||||||:||||::||||||:|:|:|:|:|||||| ||||||:||
g249        NLMEGMLMNPTIDLDSNKKNYSLYMGKQTLSAVDGEFMLDAEKSKAQLAEEQLKRFSHEL
                  70         80         90        100        110        120

130        140        150        160        170       179
m249-1.pep  KNALPDAAAIHYAVCKDSSGNAPTLSGN-AFSSNCDNKANGDTLIKVLWVNDSAGDSDIS
            ||||||:|||||||||||||:||||    : |||||||||||||||||||||||||||||
g249        KNALPDAVAIHYAVCKDSSGDAPTLSDSGAFSSNCDNKANGDTLIKVLWVNDSAGDSDIS
                 130        140        150        160        170        180

180        190        200
m249-1.pep  RTNLEVSGDNIVYTYQARVGGREX
            ||||||||||||||||||||||||
g249        RTNLEVSGDNIVYTYQARVGGREX
                 190        200
``` a249 (SEQ ID 972)/L36117 (SEQ ID 4166)

```
gi|643582 (L36117) prepilin leader sequence requires cleavage to be
active [Pseudomonas aeruginosa]
>gi|1161222 (L48934) involved in type 4 fimbrial biogenesis; contains
pre-pilin like leader sequence [Pseudomonas aeruginosa]
>gi|1246299 (L76605) reference L36117, L48934 [Pseudomonas aeruginosa]
Length = 185 Score = 50.4 bits (118), Expect = 9e-06
Identities = 45/183 (24%), Positives = 84/183 (45%), Gaps = 26/183 (14%)
Query:  13 QSGMALIEVLVAMLVLTIGILALLSVQLRTVASVREAETQTIVSQITQNLMEGMLMNPTI   72
           QSG ++IEVLVA+L+++IG+L ++++Q +T+    ++  + + + NL+E M  +P
Sbjct:  12 QSGFSMIEVLVALLLISIGVLGMIAMQGKTIQYTADSVERNKAAMLGSNLLESMRASPKA   71

Query:  73 DSDSNKKNYNLYMGNHHALSVVDGDFQVDAIKTKTQLAEA---QLKRFSYELKNALPDAA  129
                 D   +  M        G    A  +T  +A   +L  ++ ++KN LP  A
Sbjct:  72 LYDVKDQMATQSDFFKAKGSAFPTAPSSCTPLPDAIKDRLGCWAEQVKNELPGAG      126

Query: 130 AI---HYAVCKDSSGVAPTLSAGSTFSSNCDGSANGDTL-IKVLWVNDSAGDSDIARTNL  185
             +      Y +C+ S              +CDG  G  L I++  W       + A ++
Sbjct: 127 DLLKSDYYICRSSKPGDCDG--KGSMLEIRLAWRGKQGACVNAADSSA              172

Query: 186 ETN                                                          188
           +T+
Sbjct: 173 DTS  175
``` m249-1/a249 90.7% identity in 204 aa overlap

```
                  10        20        30        40        50        60
m249-1.pep  MKNNDCFRLKDSQSGMALIEVLVAMLVLTIGILALLSVQLRTVASVREAETQTIVSQITQ
            |||||||||||:||||||||||||||||||||||||||||||||||||||||||||||||
a249        MKNNDCFRLKNPQSGMALIEVLVAMLVLTIGILALLSVQLRTVASVREAETQTIVSQITQ
                  10        20        30        40        50        60

70        80        90       100       110       119
m249-1.pep  NLMEGMLMNPTIDSDSNKKNYNLYMGNH-TLSAVDGDFAIDAMKTKGQLAEAQLKRFSYE
            |||||||||||||||||||||||||||| :||:||||| :||:|||||||||||||||||
a249        NLMEGMLMNPTIDSDSNKKNYNLYMGNHHALSVVDGDFQVDAIKTKTQLAEAQLKRFSYE
                  70        80        90       100       110       120

120       130       140       150       160       170
m249-1.pep  LKNALPDAAAIHYAVCKDSSGNAPTLS-GNAFSSNCDNKANGDTLIKVLWVNDSAGDSDI
            ||||||||||||||||||||| ||||| |::||||| ::|||||||||||||||||||||
a249        LKNALPDAAAIHYAVCKDSSGVAPTLSAGSTFSSNCDGSANGDTLIKVLWVNDSAGDSDI
                 130       140       150       160       170       180

180       190       200
m249-1.pep  SRTNLEVSGDNIVYTYQARVGGREX
            :||||::|:||||||||||||||||
a249        ARTNLETNGNNIVYTYQARVGGREX
                 190       200
```

```
g250.seq
    1 atgacgcaca cagcctctcc acgtgatgaa ttcatacgcg gcataaaaga 51 aagttcgccc atgctgattg ggcttttgcc ttgggcattg atactcggta 101 tgcagggcgg gcaaaaaggt atgggccggc tggaaatgct gctgatgacg 151 gggatgaact ttgccggcgg ctccgaattt gccacggtca acctgtgggc 201 ggaacctctg ccgatactgc ttatcgccac cataaccttt atgattaatt 251 cgcggcatat cctgatgggg ggcggcgctt gccacgcaca tgaaagaaat 301 accgctgaaa aaagccgcgc ccgcgctgtt ttttatgtgt ga
```

This corresponds to the amino acid sequence <SEQ ID 976; ORF 250.ng>:

```
g250.pep
    1 MTHTASPRDE FIRGIKESSP MLIGLLPWAL ILGMQGGQKG MGRLEMLLMT

51 GMNFAGGSEF ATVNLWAEPL PILLIATITF MINSRHILMG GGACHAHERN

101 TAEKSRARAV FYV*
```

The following partial DNA sequence was identified in *N. meningitidis* <SEQ ID 977>:

```
m250.seq
    1 ATGCACACCT TCCCCGCATA ACGAATTTAT ACGCGGCATC AAAGAAAGTT

51 CGCCTATGCT GATTGGGCTG CTGCCTTGGG CATTAATACT CGGTATGCAG

101 GGCGGACAAA AAGGCATGAG CTGGCTGGAA ATGTTGTTGA TGACCAGTAT

151 GAACTTCGCC GGCGGCTCCG AGTTTGCCAC GGTCAACCTG TGGGCsGAAC

201 CTCTGCCGAT ACTGCTTATC GCCACCGTAA CCTTTATGAT TAATTCTCGG

251 CATATCCTGA T.GGGGGCGG CGCTTGCCCC GCACCTGAAA GGAaTACCGC

301 TGAAAAAGC CGTGCCCGCA CTGTTTTTTA TGTGTGA
```

This corresponds to the amino acid sequence <SEQ ID 978; ORF 250>:

```
m250.pep
    1   MHTPSPHNEF IRGIKESSPM LIGLLPWALI LGMQGGQKGM SWLEMLLMTS

51   MNFAGGSEFA TVNLWAEPLP ILLIATVTFM INSRHILMGG GACPAPERNT

101   AEKSRARTVF YV*
```

Computer analysis of this amino acid sequence gave the following results:
Homology with a Predicted ORF from *N. gonorrhoeae*
ORF 250 shows 91.0% identity over a 111 aa overlap with a predicted ORF (ORF 250.ng) from *N. gonorrhoeae*:

```
m250/g250
                     10        20        30        40        50        59
m250.pep   MHTPSPHNEFIRGIKESSPMLIGLLPWALILGMQGGQKGMSWLEMLLMTSMNFAGGSEF
           || ||::||||||||||||||||||||||||||||||||: |||||||:|||||||||
g250       MTHTASPRDEFIRGIKESSPMLIGLLPWALILGMQGGQKGMGRLEMLLMTGMNFAGGSEF
                     10        20        30        40        50        60

60        70        80        90       100       110
m250.pep   ATVNLWAEPLPILLIATVTFMINSRHILMGGGACPAPERNTAEKSRARTVFYVX
           ||||||||||||||||:||||||||||||||||| |||||||||||||:||||
g250       ATVNLWAEPLPILLIATITFMINSRHILMGGGACHAHERNTAEKSRARAVFYV
                70        80        90       100       110
```

The following partial DNA sequence was identified in *N. meningitidis* <SEQ ID 979>:

```
a250.seq
    1   ATGACACACA TAAGCTCGCC CCGTAACGAA TTTATACGCG GCATCAAAGA

51   AAGTTCGCCC ATGCTGATCG GGCTTTTGCC TTGGGCATTA ATACTCGGTA

101   TGCAGGGTGG ACAAAAAGGC ATGAGCTGGC TGGAAATGTT GTTGATGACC

151   GGTATGAACT TCGCCGGCGG CTCCGAGTTT GCCACGGTCA ACCTGTGGGC

201   GGAACCTCTG CCGATACTGC TTATCGCCAC CGTAACCTTT ATGATTAATT

251   CTCGGCATAT CCTGATGGGG G.CGGCACTT GCCCCGCACC TGAAAGAAAT

301   ACCGCTGAAA AAGCCGTGCC CCGCACTGTT TTTTATGTGT GA
```

This corresponds to the amino acid sequence <SEQ ID 980; ORF 250.a>:

```
a250.pep
    1   MTHISSPRNE FIRGIKESSP MLIGLLPWAL ILGMQGGQKG MSWLEMLLMT

51   GMNFAGGSEF ATVNLWAEPL PILLIATVTF MINSRHILMG XGTCPAPERN

101   TAEKSRARTV FYV*
``` m250/n250 94.6% identity in 111 aa overlap

```
                     10        20        30        40        50        59
m250.pep   MHTPSPHNEFIRGIKESSPMLIGLLPWALILGMQGGQKGMSWLEMLLMTSMNFAGGSEF
           |  ||:|||||||||||||||||||||||||||||||||||||||||||:|||||||||
a250       MTHISSPRNEFIRGIKESSPMLIGLLPWALILGMQGGQKGMSWLEMLLMTGMNFAGGSEF
                     10        20        30        40        50        60

60        70        80        90       100       110
m250.pep   ATVNLWAEPLPILLIATVTFMINSRHILMGGGACPAPERNTAEKSRARTVFYVX
           |||||||||||||||||||||||||||||||| |:|||||||||||||||||||
a250       ATVNLWAEPLPILLIATVTFMINSRHILMGXGTCPAPERNTAEKSRARTVFYVX
                70        80        90       100       110
```

The following partial DNA sequence was identified in *N. gonorrhoeae* <SEQ ID 981>:

```
g251.seq
    1   atgcctgacc caatagggat tctttcgct gccgtcgggg ttgatttttt 51   tgccgttgtt ttgaggggc gttttcaacg aataggcgcg gttggcatgt 101   tgataataat aatcctgatg gcggaggtcg gaaccaaaac ggtcgtaacc 151   gaggttgacg ctcaggttgt ggcggatttt ggcggtatcg aaggattttt 201   tgaatgccgc ctgcaagagc ctgtggcttt ccccgtaaat cacgcggtcg 251   gatttgtagt aggaagacgg cttgtcggca ctcgggcggc aatatttgtc 301   cgaaccgtcg gcggaacagt gcgtctgctg aaaatgattg ccaaaccga 351   tgccctgccg gtcgtaagag aggcgggcat aatccgccca agtgtctta 401   tcggcattgg tatagacata ttccaaaccg tagcggcttt tggtgtgcgt 451   ctcgtcgtaa aacacgcccg taccgtattc cgcgcccacc tccgcaccgt 501   tttcaccgtt ggtaatcagc ccgctgtatt tgcggccgcc cgcgtatttg 551   ccgtagcctc ttatcgatcc gtatttttta ttttcatcaa aaaccgcctt 601   ggtcaggaat gccggaaccg tcatatcgcg cgtgtcgaaa gttgctgcg 651   tgcgttcgag tatgccgccg atgtagtgcc gtttgttttc aaaacgaaaa 701   cccgggcgga acagccacga ccggctttcg tatga
```

This corresponds to the amino acid sequence <SEQ ID 982; ORF 251.ng>:

```
g251.pep
    1   MPDPIGILFA AVGVDFFAVV LRGRFQRIGA VGMLIIIILM AEVGTKTVVT

51   EVDAQVVADF GGIEGFFECR LQEPVAFPVN HAVGFVVGRR LVGTRAAIFV

101   RTVGGTVRLL KMIVQTDALP VVREAGIIRP SVFIGIGIDI FQTVAAFGVR

151   LVVKHARTVF RAHLRTVFTV GNQPAVFAAA RVFAVASYRS VFFIFIKNRL

201   GQECRNRHIA RVESLLRAFE YAADVVPFVF KTKTRAEQPR PAFV*
```

The following partial DNA sequence was identified in *N. meningitidis* <SEQ ID 983>:

```
m251.seq
    1   ATGCGTGCTG CGGTAGTCGT AGCGCAAGCC CGCGCCGACA TCCGCCCACC

51   TGCCCAAACG GACATTGTCC CGAACTGCCG CGTAATAGCT TTTACCGTTG

101   ATGCTGCGCG GCGTGCAGTC CGTATAAGTA TTGTTGCCCA AGCGGCAGAT

151   TTGCCCCGTA ACGACATTTC CCCTGCCTAT GGTGACCCAA TAGGGGCTGG

201   TTTCACTGCC GTTGGGGCTG ATTTTTTTGC CGTTGTTTTG AGGGGGCGTG

251   TTCGACGAAT AGGCGCGGTT GGCATGTTGA TAATAATAAT CCTGATGGCG

301   GAGATTAGAG CCAAAGCGGT CAAACCCGAG ATTCACGCTC AGGTTGTGGC

351   GGATTTTGGC GGTATCGAAG GATTTTTTGA ATGCCGCCTG CAAGAGCCTG

401   TGGCTTTCCC CGTAAATCAC GCGATCGGAT TTGTAATAGG AAAACGGCTT

451   GTCGGCACTC GGGCGGCAAT ATTTGTCCGA ACCGTCGGCA GAACAGTGCG

501   TCTGCTGAAA ATGATTATCC AAACCGATGC CCTGCCGGTC GTAAGAGAGG

551   CGGGCATAAT CCGCCCAAGT GTCTTTATCG GCATTGGTAT AGACATATTC

601   CAAACCGTAG CGGCTTTTGG TGTGCGTCTC GTCGTAAAAC ACGCCCGTAC

651   CGTATTCCGC GCCCACCAGC GCACCGTTTT CGCCGTTGGT AAACAGTCCG
```

-continued

```
701   CCGTATTTGT GGTTGCCCGC GTATTTGCCG TTACCGGGCA AAGAACCCGC
751   CTGTTTTTTA TTTGCATCAA AAACCGCCTT GGTCAGGAAT GCCGGAACCG
801   TCATATCGCG CGTGTCGAAA GTTTGTTGCG TGTGTTCGAG TATGCCGCCG
851   ATGTAGTGCC GCTTATTCTC AAAACGAAAA CCCGGGCGGA ACAGCCACGA
901   CCGGCTTTCG TATGA
```

This corresponds to the amino acid sequence <SEQ ID 984; ORF 251>:

```
m251.pep
    1   MRAAVVVAQA RADIRPPAQT DIVPNCRVIA FTVDAARRAV RISIVAQAAD

51   LPRNDISPAY GDPIGAGFTA VGADFFAVVL RGRVRRIGAV GMLIIIILMA

101   EIRAKAVKPE IHAQVVADFG GIEGFFECRL QEPVAFPVNH AIGFVIGKRL

151   VGTRAAIFVR TVGRTVRLLK MIIQTDALPV VREAGIIRPS VFIGIGIDIF

201   QTVAAFGVRL VVKHARTVFR AHQRTVFAVG KQSAVFVVAR VFAVTGQRTR

251   LFFICIKNRL GQECRNRHIA RVESLLRVFE YAADVVPLIL KTKTRAEQPR

301   PAFV*
```

Computer analysis of this amino acid sequence gave the following results:
Homology with a Predicted ORF from *N. gonorrhoeae*
ORF 251 shows 85.2% identity over a 243 aa overlap with a predicted ORF (ORF 251.ng) from *N. gonorrhoeae*:

```
m251/g251

40         50         60         70         80         90
  m251.pep   TVDAARRAVRISIVAQAADLPRNDISPAYGDPIGAGFTAVGADFFAVVLRGRVRRIGAVG
                                ||||  |:|||:|||||||||||  :||||||
  g251                         MPDPIGILFAAVGVDFFAVVLRGRFQRIGAVG
                               10         20         30

100        110        120        130        140        150
  m251.pep   MLIIIILMAEIRAKAVKPEIHAQVVADFGGIEGFFECRLQEPVAFPVNHAIGFVIGKRLV
             ||||||||||:  :|:|  |:  ||||||||||||||||||||||||||:|||:|:|||
  g251       MLIIIILMAEVGTXTVVTEVDAQVVADFGGIEGFFECRLQEPVAFPVNHAVGFVVGRRLV
                      40         50         60         70         80         90

160        170        180        190        200        210
  m251.pep   GTRAAIFVRTVGRTVRLLKMIIQTDALPVVREAGIIRPSVFIGIGIDIFQTVAAFGVRLV
             ||||||||||||| ||||||||:|||||||||||||||||||||||||||||||||||||
  g251       GTRAAIFVRTVGGTVRLLKMIVQTDALPVVREAGIIRPSVFIGIGIDIFQTVAAFGVRLV
                     100        110        120        130        140        150

220        230        240        250        260        270
  m251.pep   VKHARTVFRAHQRTVFAVGKQSAVFVVARVFAVTGQRTRLFFICIKNRLGQECRNRHIAR
             ||||||||||| ||||:||:|  |::|||||:|  |: :||| |||||||||||||||||
  g251       VKHARTVFRAHLRTVFTVGNQPAVFAAARVFAVASYRS-VFFIFIKNRLGQECRNRHIAR
                     160        170        180        190        200        210

280        290        300
  m251.pep   VESLLRVFEYAADVVPLILKTKTRAEQPRPAFVX
             ||||||:||||||||||:::|||||||||||||
  g251       VESLLRAFEYAADVVPFVFKTKTRAEQPRPAFVX
                     220        230        240
```

The following partial DNA sequence was identified in *N. meningitidis* <SEQ ID 985>:

```
a251.seq
    1   ATGCGTGCTG CGGTAGTCGT AGCGCAACCC CGCGCCGACA TCCGCCCACC

51   TGCCCAAACG GACATTGTCC CGAACTGCCG CGTAATAGCT TTTGCCGTTG

101   ATGCTGCGCG GCGTGCAGTC CGTATAAGTA TTGTTGCCCA AGCGGCAGAT
```

```
151  TTGCCCCGTA ACCACATTTC CCCTGCCTAT GCTGACCCAA TAGGGTTGGT

201  CCTTGCCGCC GTTGGGGTTG GCGGTTTTAG GGGGCGTTTT CGACGAATAG

251  GCGCGGTTGG CATGTTGATA ATAATAATCC TGATGGCGGA GATTAGAGTC

301  AAAGCGGTCA AAACCGAGAT TCACGCTCAG GTTGTGGCGG ATTTTGGCGG

351  TATCGAAGGA TTTTTTGAAT GCCGCCTGCA AGAGCCTGTG GCTTTCCCCG

401  TAAATCACGC GGTCGGATTT GTAGTAGGAA AACGGCTTGT CGGCACTCGG

451  GCGGCAATAT TTGTCCGAAC CGTCGGCAGA ACAGTGCGTC TGCTGAAAAT

501  GATTGTCCAA ACCGATGCCC TGCCGGTCGT AAGAGAGGCG GGCATAATCC

551  ACCCAAGTGT CTTTATCGGC ATTGGTATAG ACATATTCCA AACCGTAGCG

601  GCTTTTGGTG TGCGTCTCGT CGTAAAACAC GCCCGTACCG TATTCCGCGC

651  CCACCAGCGC ACCGTTTTCG CCGTTGGTAA ACAGACCGCC GTATTTGTGG

701  TCGCCCGCGT ATTTGCCGTT GCCTCTTATC GGTCCGTATT TTCTATTTTC

751  ATCAAAAACC GCCTTGGTCA GGAATGCCGG AACCGTCATA TCGCGCGTGT

801  CGAAAGTTTG TTGCGTGTGT TCGAGTATGC CGCCGATGTA GTGCCGTTTG

851  TTTTCAAAAC GAAAACCCGG GCGGAACAGC CACGATCGGC TTTCGTATGA
```

This corresponds to the amino acid sequence <SEQ ID 986; ORF 251.a>:

```
a251.pep
  1  MRAAVVVAQP RADIRPPAQT DIVPNCRVIA FAVDAARRAV RISIVAQAAD

51  LPRNHISPAY ADPIGLVLAA VGVGGFRGRF RRIGAVGMLI IIILMAEIRV

101  KAVKTEIHAQ VVADFGGIEG FFECRLQEPV AFPVNHAVGF VVGKRLVGTR

151  AAIFVRTVGR TVRLLKMIVQ TDALPVVREA GIIHPSVFIG IGIDIFQTVA

201  AFGVRLVVKH ARTVFRAHQR TVFAVGKQTA VFVVARVFAV ASYRSVFSIF

251  IKNRLGQECR NRHIARVESL LRVFEYAADV VPFVFKTKTR AEQPRSAFV*
``` m251/a251 88.5% identity in 304 aa overlap

```
                10         20         30         40         50         60
   m251.pep  MRAAVVVAQARADIRPPAQTDIVPNCRVIAFTVDAARRAVRISIVAQAADLPRNDISPAY
             ||||||||| ||||||||||||||||||||||:|||||||||||||||||||||| ||||
   a251      MRAAVVVAQPRADIRPPAQTDIVPNCRVIAFAVDAARRAVRISIVAQAADLPRNHISPAY
                10         20         30         40         50         60

70         80         90        100        110        120
   m251.pep  GDPIGAGFTAVGADFFAVVLRGRVRRIGAVGMLIIIILMAEIRAKAVKPEIHAQVVADFG
             :||||  ::|||:  |    ||| |||||||||||||||||||:|||| |||||||||||
   a251      ADPIGLVLAAVGVGGF----RGRFRRIGAVGMLIIIILMAEIRVKAVKTEIHAQVVADFG
                70         80         90        100        110

130        140        150        160        170        180
   m251.pep  GIEGFFECRLQEPVAFPVNHAIGFVIGKRLVGTRAAIFVRTVGRTVRLLKMIIQTDALPV
             |||||||||||||||||||||:|||:|||||||||||||||||||||||||||:|||||
   a251      GIEGFFECRLQEPVAFPVNHAVGFVVGKRLVGTRAAIFVRTVGRTVRLLKMIVQTDALPV
               120        130        140        150        160        170

190        200        210        220        230        240
   m251.pep  VREAGIIRPSVFIGIGIDIFQTVAAFGVRLVVKHARTVFRAHQRTVFAVGKQSAVFVVAR
             ||||||:|||||||||||||||||||||||||||||||||||||||||||||:||||||
   a251      VREAGIIHPSVFIGIGIDIFQTVAAFGVRLVVKHARTVFRAHQRTVFAVGKQTAVFVVAR
               180        190        200        210        220        230

250        260        270        280        290        300
   m251.pep  VFAVTGQRTRLFFICIKNRLGQECRNRHIARVESLLRVFEYAADVVPLILKTKTRAEQPR
             ||||:: |: :| | ||||||||||||||||||||||||||||||| :::|||||||||
   a251      VFAVASYRS-VFSIFIKNRLGQECRNRHIARVESLLRVFEYAADVVPFVFKTKTRAEQPR
               240        250        260        270        280        290
```

```
m251.pep  PAFVX
          ||||
a251      SAFVX
             300
```

The following partial DNA sequence was identified in *N. gonorrhoeae* <SEQ ID 987>:

```
g253.seq
    1 atgatcgaca gggaccgtat gttgcgggac acgttggaac gtgtgcgtgc
   51 ggggtcgttc tggttatggg tggtggtggc atcgatgatg tttaccgccg
  101 gattttcagg cacttatctt ctgatggaca atcaggggct gaatttcttt
  151 ttagttttgg cgggagtgtt gggcatgaat acgctgatgc tggcagtatg
  201 gttggcaacg ttgttcctgc gcgtgaaagt gggacggttt ttcagcagtc
  251 cggcgacgtg gtttcggggc aaaggccctg taaatcaggc ggtgttgcgg
  301 ctgtatgcgg accagtggcg gcaaccttcg gtacgatgga aaataggcgc
  351 aacggcgcac agcttgtggc tctgcacgct gctcggaatg ctggtgtcgg
  401 tattgctgct gcttttggtg cggcaatata cgttcaactg ggaaagcacg
  451 ctgttgagca atgccgcttc ggtacgcgcg gtggaaatgt tggcatggct
  501 gccgtcgaaa ctcggtttcc ctgtccccga tgcgcgggcg gtcatcgaag
  551 gtcgtctgaa cggcaatatt gccgatgcgc gggcttggtc ggggctgctg
  601 gtcggcagta tcgtctgcta cggcatcctg ccgcgcctct tggcttgggt
  651 agtgtgtaaa atcctttttga aaacaagcga aaacggattg gatttggaaa
  701 aaacctatta tcaggcggtc atccgccgct ggcagaacaa aatcaccgat
  751 gcggatacgc gtcgggaaac cgtgtccgcc gtttcgccga aaatcgtctt
  801 gaacgatgcg ccgaaatggg cgctcatgct ggagaccgag tggcaggacg
  851 gccaatggtt cgagggcagg ctggcgcagg aatggctgga taagggcgtt
  901 gccgccaatc gggaacaggt tgccgcgctg gagacagagc tgaagcagaa
  951 accggcgcaa ctgcttatcg gcgtacgcgc ccaaactgtg ccggaccggg
 1001 gcgtgctgcg gcagattgtg cggctttcgg aagcggcgca gggcggcgcg
 1051 gtggtgcagc ttttggcgga acaggggctt tcagacgacc tttcggaaaa
 1101 gctggaacat tggcgtaacg cgctgaccga atgcggcgcg cgtggcttg
 1151 agcctgacag ggtggcgcag gaaggccgtt tgaaagacca ataa
                                                         50
```

This corresponds to the amino acid sequence <SEQ ID 988; ORF 253.ng>:

```
g253.pep
    1 MIDRDRMLRD TLERVRAGSF WLWVVVASMM FTAGFSGTYL LMDNQGLNFF

51 LVLAGVLGMN TLMLAVWLAT LFLRVKVGRF FSSPATWFRG KGPVNQAVLR

101 LYADQWRQPS VRWKIGATAH SLWLCTLLGM LVSVLLLLLV RQYTFNWEST

151 LLSNAASVRA VEMLAWLPSK LGFPVPDARA VIEGRLNGNI ADARAWSGLL

201 VGSIVCYGIL PRLLAWVVCK ILLKTSENGL DLEKTYYQAV IRRWQNKITD

251 ADTRRETVSA VSPKIVLNDA PKWALMLETE WQDGQWFEGR LAQEWLDKGV
```

```
301  AANREQVAAL ETELKQKPAQ LLIGVRAQTV PDRGVLRQIV RLSEAAQGGA

351  VVQLLAEQGL SDDLSEKLEH WRNALTECGA AWLEPDRVAQ EGRLKDQ*
```

The following partial DNA sequence was identified in *N. meningitidis* <SEQ ID 989>:

```
m253.seq
    1  ATGATTGACA GGAACCGTAT GCTGCGGGAG ACGTTGGAAC GTGTGCGTGC

51  GGGGTCGTTC TGGTTGTGGG TGGTGGCGGC GACGTTTGCA TTTTTTACCG

101  GTTTTTCAGT CACTTATCTT CTAATGGACA ATCAGGGTCT GAATTTCTTT

151  TTGGTTTTGG CGGGCGTGTT GGGCATGAAT ACGCTGATGC TGGCAGTATG

201  GTTGGCAATG TTGTTCCTGC GTGTGAAAGT GGGGCGTTTT TTCAGCAGTC

251  CGGCGACGTG GTTTCGGGGC AAAGACCCTG TAAATCAGGC GGTGTTGCGG

301  CTGTATGCGG ACGAGTGGCG GCAACCTTCG GTACGTTGGA AAATAGGCGC

351  AACGTCGCAC AGCCTGTGGC TCTGCACGCT GCTCGGAATG CTGGTGTCGG

401  TATTGTTGCT GCTTTTGGTG CGGCAATATA CGTTCAACTG GGAAAGCACG

451  CTGTTGAGCA ATGCCGCTTC GGTACGCGCG GTGGAAATGT TGGCATGGCT

501  GCCGTCGAAA CTCGGTTTCC CTGTCCCCGA TGCGCGGGCG GTCATCGAAG

551  GCCGTCTGAA CGGCAATATT GCCGATGCGC GGGCTTGGTC GGGGCTGCTG

601  GTCGGCAGTA TCGCCTGCTA CGGCATCCTG CCGCGCCTGC TGGCTTGGGT

651  AGTGTGTAAA ATCCTTTTGA AAACAAGCGA AAACGGATTG GATTTGGAAA

701  AGCCCTATTA TCAGGCGGTC ATCCGCCGCT GGCAGAACAA AATCACCGAT

751  GCGGATACGC GTCGGGAAAC CGTGTCCGCC GTTTCACCGA AAATCATCTT

801  GAACGATGCG CCGAAATGGG CGGTCATGCT GGAGACCGAG TGGCAGGACG

851  GCGAATGGTT CGAGGGCAGG CTGGCGCAGG AATGGCTGGA TAAGGGCGTT

901  GCCACCAATC GGGAACAGGT TGCCGCGCTG GAGACAGAGC TGAAGCAGAA

951  ACCGGCGCAA CTGCTTATCG GCGTGCGCGC CCAAACTGTG CCGGACCGCG

1001  GCGTGTTGCG GCAGATTGTC CGACTCTCGG AAGCGGCGCA GGGCGGCGCG

1051  GTGGTGCAGC TTTTGGCGGA ACAGGGGCTT TCAGACGACC TTTCGGAAAA

1101  GCTGGAACAT TGGCGTAACG CGCTGGCCGA ATGCGGCGCG GCGTGGCTTG

1151  AGCCTGACAG GGCGGCGCAG GAAGGGCGTT TGAAAGACCA ATAA
```

This corresponds to the amino acid sequence <SEQ ID 990; ORF 253>:

```
m253.pep
    1  MIDRNRMLRE TLERVRAGSF WLWVVAATFA FFTGFSVTYL LMDNQGLNFF

51  LVLAGVLGMN TLMLAVWLAM LFLRVKVGRF FSSPATWFRG KDPVNQAVLR

101  LYADEWRQPS VRWKIGATSH SLWLCTLLGM LVSVLLLLLV RQYTFNWEST

151  LLSNAASVRA VEMLAWLPSK LGFPVPDARA VIEGRLNGNI ADARAWSGLL

201  VGSIACYGIL PRLLAWVVCK ILLKTSENGL DLEKPYYQAV IRRWQNKITD

251  ADTRRETVSA VSPKIILNDA PKWAVMLETE WQDGEWFEGR LAQEWLDKGV

301  ATNREQVAAL ETELKQKPAQ LLIGVRAQTV PDRGVLRQIV RLSEAAQGGA

351  VVQLLAEQGL SDDLSEKLEH WRNALAECGA AWLEPDRAAQ EGRLKDQ*
```

Computer analysis of this amino acid sequence gave the following results:
Homology with a Predicted ORF from *N. gonorrhoeae*
ORF 253 shows 94.7% identity over a 397 aa overlap with a predicted ORF (ORF 253.ng) from *N. gonorrhoeae*:

```
m253/g253
                   10         20         30         40         50         60
m253.pep  MIDRNRMLRETLERVRAGSFWLWVVAATFAFFTGFSVTYLLMDNQGLNFFLVLAGVLGMN
          ||||:||||:|||||||||||||||:|::| :||| ||||||||||||||||||||||||
g253      MIDRDRMLRDTLERVRAGSFWLWVVASMMFTAGFSGTYLLMDNQGLNFFLVLAGVLGMN
                   10         20         30         40         50         60

70         80         90        100        110        120
m253.pep  TLMLAVWLAMLFLRVKVGRFFSSPATWFRGKDPVNQAVLRLYADEWRQPSVRWKIGATSH
          |||||||||| ||||||||||||||||||||| |||||||||||:|||||||||||||:|
g253      TLMLAVWLATLFLRVKVGRFFSSPATWFRGKGPVNQAVLRLYADQWRQPSVRWKIGATAH
                   70         80         90        100        110        120

130        140        150        160        170        180
m253.pep  SLWLCTLLGMLVSVLLLLLVRQYTFNWESTLLSNAASVRAVEMLAWLPSKLGFPVPDARA
          ||||||||||||||||||||||||||||||||||||||||||||||||||||||||||||
g253      SLWLCTLLGMLVSVLLLLLVRQYTFNWESTLLSNAASVRAVEMLAWLPSKLGFPVPDARA
                  130        140        150        160        170        180

190        200        210        220        230        240
m253.pep  VIEGRLNGNIADARAWSGLLVGSIACYGILPRLLAWVVCKILLKTSENGLDLEKPYYQAV
          |||||||||||||||||||||||||:|||||||||||||||||||||||||||| |||||
g253      VIEGRLNGNIADARAWSGLLVGSIVCYGILPRLLAWVVCKILLKTSENGLDLEKTYYQAV
                  190        200        210        220        230        240

250        260        270        280        290        300
m253.pep  IRRWQNKITDADTRRETVSAVSPKIILNDAPKWAVMLETEWQDGEWFEGRLAQEWLDKGV
          |||||||||||||||||||||||||:|||||||||:|||||||||:||||||||||||||
g253      IRRWQNKITDADTRRETVSAVSPKIVLNDAPKWALMLETEWQDGQWFEGRLAQEWLDKGV
                  250        260        270        280        290        300

310        320        330        340        350        360
m253.pep  ATNREQVAALETELKQKPAQLLIGVRAQTVPDRGVLRQIVRLSEAAQGGAVVQLLAEQGL
          |:||||||||||||||||||||||||||||||||||||||||||||||||||||||||||
g253      AANREQVAALETELKQKPAQLLIGVRAQTVPDRGVLRQIVRLSEAAQGGAVVQLLAEQGL
                  310        320        330        340        350        360

370        380        390
m253.pep  SDDLSEKLEHWRNALAECGAAWLEPDRAAQEGRLKDQX
          |||||||||||||||:|||||||||||:|||||||||
g253      SDDLSEKLEHWRNALTECGAAWLEPDRVAQEGRLKQQX
                  370        380        390
```

The following partial DNA sequence was identified in *N. meningitidis* <SEQ ID 991>:

```
a253.seq
    1    ATGATCGACA GGAACCGTAT GCTGCGGGAG ACGTTGGAAC GTGTGCGTGC

51    GGGGTCGTTC TGGTTGTGGG TGGCGGCGGC GACGTTTGCG TTTTTTACCG

101    GTTTTTCAGT TACTTATCTT CTAATGGACA ATCAGGGTCT GAATTTCTTT

151    TTGGTTTTGG CGGGCGTGTT GGGCATGAAT ACGCTGATGC TGGCAGTATG

201    GTTGGCAATG TTGTTCCTGC GCGTGAAAGT GGGGCGTTTT TTCAGCAGTC

251    CGGCGACGTG GTTTCGGGGC AAAGACCCTG TCAATCAGGC GGTGTTGCGG

301    CTGTATGCGG ACGAGTGGCG GCAACCTTCG GTACGTTGGA AAATAGGCGC

351    AACGTCGCAC AGCCTGTGGC TCTGCACGCT GCTCGGAATG CTGGTGTCGG

401    TATTGTTGCT GCTTTTGGTG CGGCAATATA CGTTCAACTG GGAAAGCACG

451    CTGTTGGGCG ATTCGTCTTC GGTACGGCTG GTGGAAATGT TGGCATGGCT

501    GCCTGCGAAA CTGGGTTTTC CCGTGCCTGA TGCGCGGGCG GTCATCGAAG

551    GTCGTCTGAA CGGCAATATT GCCGATGCGC GGGCTTGGTC GGGGCTGCTG

601    GTCGGCAGTA TCGCCTGCTA CGGCATCCTG CCGCGCCTCT TGGCTTGGGC

651    GGTATGCAAA ATCCTTTTGA AAACAAGCGA AAACGGCTTG GATTTGGAAA

701    AGCCCTATTA TCAGGCGGTC ATCCGCCGCT GGCAGAACAA AATCACCGAT
```

-continued

```
 751  GCGGATACGC GTCGGGAAAC CGTGTCCGCC GTTTCGCCGA AAATCGTCTT

801  GAACGATGCG CCGAAATGGG CGGTCATGCT GGAGACCGAA TGGCAGGACG

851  GCGAATGGTT CGAGGGCAGG CTGGCGCAGG AATGGCTGGA TAAGGGCGTT

901  GCCGCCAATC GGGAACAGGT TGCCGCGCTG GAGACAGAGC TGAAGCAGAA

951  ACCGGCGCAA CTGCTTATCG GCGTGCGCGC CCAAACTGTG CCCGACCGCG

1001  GCGTGTTGCG GCAGATCGTC CGACTTTCGG AAGCGGCGCA GGGCGGCGCG

1051  GTGGTGCAGC TTTTGGCGGA ACAGGGGCTT TCAGACGACC TTTCGGAAAA

1101  GCTGGAACAT GGCGTAACGC CGCTGACCGA ATGCGGCGCG GCGTGGCTGG

1151  AACCCGACAG AGCGGCGCAG GAAGGCCGTC TGAAAACCAA CGACCGCACT

1201  TGA
```

This corresponds to the amino acid sequence <SEQ ID 992; ORF 253.a>:

```
a253.pep
   1  MIDRNRMLRE TLERVRAGSF WLWVAAATFA FFTGFSVTYL LMDNQGLNFF

51  LVLAGVLGMN TLMLAVWLAM LFLRVKVGRF FSSPATWFRG KDPVNQAVLR

101  LYADEWRQPS VRWKIGATSH SLWLCTLLGM LVSVLLLLLV RQYTFNWEST

151  LLGDSSSVRL VEMLAWLPAK LGFPVPDARA VIEGRLNGNI ADARAWSGLL

201  VGSIACYGIL PRLLAWAVCK ILLKTSENGL DLEKPYYQAV IRRWQNKITD

251  ADTRRETVSA VSPKIVLNDA PKWAVMLETE WQDGEWFEGR LAQEWLDKGV

301  AANREQVAAL ETELKQKPAQ LLIGVRAQTV PDRGVLRQIV RLSEAAQGGA

351  VVQLLAEQGL SDDLSEKLEH WRNALTECGA AWLEPDRAAQ EGRLKTNDRT

401  *
``` m253/a253 97.2% identity in 395 aa overlap

```
                10         20         30         40         50         60
m253.pep  MIDRNRMLRETLERVRAGSFWLWVAATFAFFTGFSVTYLLMDNQGLNFFLVLAGVLGMN
          ||||||||||||||||||||||||:|||||||||||||||||||||||||||||||||||
a253      MIDRNRMLRETLERVRAGSFWLWVAAATFAFFTGFSVTYLLMDNQGLNFFLVLAGVLGMN
                10         20         30         40         50         60

70         80         90        100        110        120
m253.pep  TLMLAVWLAMLFLRVKVGRFFSSPATWFRGKDPVNQAVLRLYADEWRQPSVRWKIGATSH
          ||||||||||||||||||||||||||||||||||||||||||||||||||||||||||||
a253      TLMLAVWLAMLFLRVKVGRFFSSPATWFRGKDPVNQAVLRLYADEWRQPSVRWKIGATSH
                70         80         90        100        110        120

130        140        150        160        170        180
m253.pep  SLWLCTLLGMLVSVLLLLLVRQYTFNWESTLLSNAASVRAVEMLAWLPSKLGFPVPDARA
          ||||||||||||||||||||||||||||||||::::|||  ||||||||:||||||||||
a253      SLWLCTLLGMLVSVLLLLLVRQYTFNWESTLLGDSSSVLVEMLAWLPAKLGFPVPDARA
               130        140        150        160        170        180

190        200        210        220        230        240
m253.pep  VIEGRLNGNIADARAWSGLLVGSIACYGILPRLLAWVVCKILLKTSENGLDLEKPYYQAV
          ||||||||||||||||||||||||||||||||||||:|||||||||||||||||||||||
a253      VIEGRLNGNIADARAWSGLLVGSIACYGILPRLLAWAVCKILLKTSENGLDLEKPYYQAV
               190        200        210        220        230        240

250        260        270        280        290        300
m253.pep  IRRWQNKITDADTRRETVSAVSPKIILNDAPKWAVMLETEWQDGEWFEGRLAQEWLDKGV
          |||||||||||||||||||||||||:||||||||||||||||||||||||||||||||||
a253      IRRWQNKITDADTRRETVSAVSPKIVLNDAPKWAVMLETEWQDGEWFEGRLAQEWLDKGV
               250        260        270        280        290        300

310        320        330        340        350        360
m253.pep  ATNREQVAALETELKQKPAQLLIGVRAQTVPDRGVLRQIVRLSEAAQGGAVVQLLAEQGL
          |:||||||||||||||||||||||||||||||||||||||||||||||||||||||||||
a253      AANREQVAALETELKQKPAQLLIGVRAQTVPDRGVLRQIVRLSEAAQGGAVVQLLAEQGL
               310        320        330        340        350        360
```

-continued

```
           370        380        390
m253.pep   SDDLSEKLEHWRNALAECGAAWLEPDRAAQEGRLKDQX
           ||||||||||||||:||||||||||||||||||||
a253       SDDLSEKLEHWRNALTECGAAWLEPDRAAQEGRLKTNDRTX
           370        380        390        400
```

The following partial DNA sequence was identified in *N. gonorrhoeae* <SEQ ID 993>:

```
g254.seq
    1    atgtatgcag gcgaacgctt caatacttac agccatttga gcggtttgat 51    tctggcggcg gcaggtttga tgctgatgct gctgaaaacc ataggacacg 101    gggacggata ccgtatcttc agcgtatcgg tttacggcat cagccttctt 151    ctgctctatt tgagttcctc gctgtaccac ggaattgcag ccggaaaact 201    gaaaagcatt ttgaaaaaaa ccgaccactg catgatttat gtgctgattg 251    ccggaagcta cacccgtttg cactggtttc ttttgagaaa cgggccgggc 301    tggacggtat tttcactgtc ctggctgctg gcggctgcag gaatcgcaca 351    agaactcacc atcggacgga aaagcgaaaa acgtctgctg tctattgcga 401    tttatatcgt aatgggctgg atggtcttgg cggtaatgaa atccctgaca 451    gcctcactcc cgccggcagg actggcttgg ctggcggcag gcggtatgct 501    gtacagcgtc ggcatttact ggtttgtaaa cgatgaaaaa atccgacacg 551    ggcacggaat ctggcatctg ttcgtattgg gcggcagcat aacccaattt 601    gtcagcgtgt acggttatgt aatctga
```

This corresponds to the amino acid sequence <SEQ ID 994; ORF 254.ng>:

```
g254.pep
    1    MYAGERFNTY SHLSGLILAA AGLMLMLLKT IGHGDGYRIF SVSVYGISLL

51    LLYLSSSLYH GIAAGKLKSI LKKTDHCMIY VLIAGSYTPF ALVSLRNGPG

101    WTVFSLSWLL AAAGIAQELT IGRKSEKRLL SIAIYIVMGW MVLAVMKSLT

151    ASLPPAGLAW LAAGGMLYSV GIYWFVNDEK IRHGHGIWHL FVLGGSITQF

201    VSVYGYVI*
```

The following partial DNA sequence was identified in *N. meningitidis* <SEQ ID 995>:

```
m254.seq (partial)
    1    ..GTATCGGTTT ACGGCATCAG CCTTCTTCTG CTCTATTTGA GTTCCTGGCT

51    GTACCACGGA ATTGCAGCCG GAAAACTGAA AAGCATTTTG AAAAAACCG

101    ACCACTGCAT GATTTATGTG CTGATTGCCG GAAGCTACAC ACCGTTTGCA

151    CTGGTTTCTT TGAGAAACGG GCCGGGCTGG ACGGTATTTT CACTGTCCTG

201    GCTGCTGGCG GCTGCAGGAA TCGCACAAGA ACTCACCATC GGACGGAAAA

251    GCGAAAAACG TCTGCTGTCT ATTGTGATTT ATGTCGTCAT GGGTTGGATG

301    GTCTTGGCGG TAATGAAATC CCTGACAGCC TCACTCCCGT CGGCAGGACT

351    GGCTTGGCTG GCGGCAGGCG GTATGCTGTA CAGTGTCGGC ATTTACTGGT

401    TTGTAAACGA TGAAAAAATC CGACACGGGC ACGGAATCTG GCATCTGTTC
```

-continued

```
451    GTATTGGGCG GCAGCATCAC CCAATTTGTC AGCGTGTACG GTTACGTAAT

501    CTGA
```

This corresponds to the amino acid sequence <SEQ ID 996; ORF 254>:

```
m254.pep (partial)
    1    ..VSVYGISLLL LYLSSWLYHG IAAGKLKSIL KKTDHCMIYV LIAGSYTPFA

51    LVSLRNGPGW TVFSLSWLLA AAGIAQELTI GRKSEKRLLS IVIYVVMGWM

101    VLAVMKSLTA SLPSAGLAWL AAGGMLYSVG IYWFVNDEKI RHGHGIWHLF

151    VLGGSITQFV SVYGYVI*
```

Computer analysis of this amino acid sequence gave the following results:
Homology with a Predicted ORF from *N. gonorrhoeae*   20
ORF 254 shows 97.6% identity over a 167 aa overlap with a predicted ORF (ORF 254.ng) from *N. gonorrhoeae*:

```
m254/g254
                                              10         20         30
     m254.pep                            VSVYGISLLLLYLSSWLYHGIAAGKLKSIL
                                         ||||||||||||| ||||||||||||||||
     g254     HLSGLILAAAGLMLMLLKTIGHGDGYRIFSVSVYGISLLLLYLSSSLYHGIAAGKLKSIL
                       20         30         40         50         60         70

40         50         60         70         80         90
     m254.pep KKTDHCMIYVLIAGSYTPFALVSLRNGPGWTVFSLSWLLAAAGIAQELTIGRKSEKRLLS
              ||||||||||||||||||||||||||||||||||||||||||||||||||||||||||||
     g254     KKTDHCMIYVLIAGSYTPFALVSLRNGPGWTVFSLSWLLAAAGIAQELTIGRKSEKRLLS
                       80         90        100        110        120        130

100        110        120        130        140        150
     m254.pep IVIYVVMGWMVLAVMKSLTASLPSAGLAWLAAGGMLYSVGIYWFVNDEKIRHGHGIWHLF
              |:||:|||||||||||||||||||| |||||||||||||||||||||||||||||||||
     g254     IAIYIVMGWMVLAVMKSLTASLPPAGLAWLAAGGMLYSVGIYWFVNDEKIRHGHGIWHLF
                      140        150        160        170        180        190

160
     m254.pep VLGGSITQFVSVYGYVIX
              ||||||||||||||||||
     g254     VLGGSITQFVSVYGYVIX
                      200
```

The following partial DNA sequence was identified in *N. meningitidis* <SEQ ID 997>:

```
a254.seq
    1    ATGTATACAG GCGAACGCTT CAATACTTAC AGCCATTTGA GCGGTTTGAT

51    TCTGGCGGCG GCAGGTTTGG CGCTGATGCT GCTGAAAACC ATAGGACACG

101    GGGACGGCTA CCGTATCTTC AGCGTATCGG TTTACGGCAT CAGCCTTCTT

151    CTGCTCTATT TGAGTTCCTC GCTGTACCAC GGAATTGCAG CCGGAAAACT

201    GAAAAGCATT TTGAAAAAAA CCGACCACTG CATGATTTAT GTGCTGATTG

251    CCGGAAGCTA CACACCGTTT GCACTGGTTT CTTTGAGAAA CGGGCCGGGC

301    TGGACGGTAT TTTCACTGTC CTGGCTGCTG GCGGCTGCAG GAATCGCACA

351    AGAACTCACC ATTGGACGGA AAAGCGAAAA ACGACTGCTG TCTATTGCGA

401    TTTATATCGT AATGGGCTGG ATGGTCTTGG CGGTAATGAA ATCCCTGACA

451    GCCTCACTCC CGCCGGCAGG ACTGGCTTGG CTGGCGGCAG GCGGTATGCT

501    GTACAGCGTC GGCATTTACT GGTTTGTAAA CGATGAAAAA ATCCGACACG
```

-continued

```
551  GGCACGGAAT CTGGCATCTG TTCGTATTGG GCGGCAGCAT CACCCAATTT

601  GTCAGCGTGT ACGGTTACGT AATCTGA
```

This corresponds to the amino acid sequence <SEQ ID 998; ORF 254.a>:

```
a254.pep
   1  MYTGERFNTY SHLSGLILAA AGLALMLLKT IGHGDGYRIF SVSVYGISLL

51  LLYLSSSLYH GIAAGKLKSI LKKTDHCMIY VLIAGSYTPF ALVSLRNGPG

101  WTVFSLSWLL AAAGIAQELT IGRKSEKRLL SIAIYIVMGW MVLAVMKSLT

151  ASLPPAGLAW LAAGGMLYSV GIYWFVNDEK IRHGHGIWHL FVLGGSITQF

201  VSVYGYVI*
``` m254/a254 97.6% identity in 167 aa overlap

```
                                  10         20         30
   m254.pep                VSVYGISLLLLYLSSWLYHGIAAGKLKSIL
                           ||||||||||||||| ||||||||||||||
   a254     HLSGLILAAAGLALMLLKTIGHGDGYRIFSVSVYGISLLLLYLSSSLYHGIAAGKLKSIL
                   20        30        40        50        60        70

40        50        60        70        80        90
   m254.pep  KKTDHCMIYVLIAGSYTPFALVSLRNGPGWTVFSLSWLLAAAGIAQELTIGRKSEKRLLS
             ||||||||||||||||||||||||||||||||||||||||||||||||||||||||||||
   a254      KKTDHCMIYVLIAGSYTPFALVSLRNGPGWTVFSLSWLLAAAGIAQELTIGRKSEKRLLS
                   80        90       100       110       120       130

100       110       120       130       140       150
   m254.pep  IVIYVVMGWMVLAVMKSLTASLPSAGLAWLAAGGMLYSVGIYWFVNDEKIRHGHGIWHLF
             |:||:|||||||||||||||||| ||||||||||||||||||||||||||||||||||||
   a254      IAIYIVMGWMVLAVMKSLTASLPPAGLAWLAAGGMLYSVGIYWFVNDEKIRHGHGIWHLF
                  140       150       160       170       180       190

160
   m254.pep  VLGGSITQFVSVYGYVIX
             ||||||||||||||||||
   a254      VLGGSITQFVSVYGYVIX
                  200
```

The following partial DNA sequence was identified in *N. gonorrhoeae* <SEQ ID 999>:

```
g255.seq
   1  atggttggac aggaagcctt gcggggtcag ttcgtcgccg tgttcgctgc 51  cgcgttgcgt tacgctgtca aaacctgcgc cgatttccac gcctttgacg 101  gcgttgatgc ccatcatcgc gtaggcgatt tcggcatcga ggcggtcgaa 151  aacggggttcg cccaaaccga cggggacgtt ggcggcttcg atatgcagtt 201  tcgcgccgac ggaatccaag gatttgcgca caccgtccat atagtgttcc 251  agttcggcga tttggctttg gttggcggca aaaaaggat tttgggaaat 301  gtgttcgctg ccttcaaacc ggatttttt ttcgccgact ggggtaacgt 351  aggcggtgat ttccgtgccg aatttttctt tcagccattt tttggcaacg 401  gctccggcgg caacgcgggc tgcggtttcg cgggcggaac tcctgccgcc 451  gccccggtag tcgcgcgtac cgtatttgtg ccaataggta tagtcggcgt 501  gtccggggcg gaaggcggtg gcgatgtcgc cgtagtcttc gctgcgctgg 551  tcggtgttgc ggattag
```

This corresponds to the amino acid sequence <SEQ ID 1000; ORF 255.ng>:

```
g255.pep
    1   MVGQEALRGQ FVAVFAAALR YAVKTCADFH AFDGVDAHHR VGDFGIEAVE

51   NGFAQTDGDV GGFDMQFRAD GIQGFAHTVH IVFQFGDLAL VGGKKRILGN

101   VFAAFKPDFF FADLGNVGGD FRAEFFFQPF FGNGSGGNAG CGFAGGTPAA

151   APVVARTVFV PIGIVGVSGA EGGGDVAVVF AALVGVAD*
```

The following partial DNA sequence was identified in N. meningitidis <SEQ ID 1001>:

```
m255.seq
    1   GTGGTTGGAC AGGAAGCCTT GCGGGGTCAG TTCGTCGCCG TGTTCGCTGC

51   CGCGTTGCGT TACGCTGTCA AAACCTGCGC CGATTTCCAC GCCTTTGACG

101   GCGTTGATGC CCATCATCGC GTAGGCGATT TCGGCATCGA GGCGGTCAAA

151   AACAGGTTCG CCCAAGCCGA CAGGGACATT GGCTGCTTCG ATATGCAGCT

201   TCGCGCCGAC GGAATCCAAG GATTTGCGCA CGCTGTCCAT ATAGTTTTCC

251   AGCTCGGCAA TTTGGCTATG GTTGGCGGCA AAAAAGGAT TTGGGAAAT

301   GTGTTCGCAG CCTTCAAACC GGATTTCTTT TTCGCCGACT TGGGTAACGT

351   AGGCGGTGAT TTCCGTGCCG AATTTTTCTT TCAACCATTT TTTGGCAACG

401   GCTCCGGCAG CAACGCGGGC GGCGGTTTCA CGGGCGGAGC TCCTGCCGCC

451   GCCGCGGTAG TCGCGCGTGC CGTATTTGTG CCAATAGGTA TAGTCGGCGT

501   GGCCGGGGCG GAAGCTGGTG GCGATGTTGC CGTAGTCTTT GCTGCGCTGG

551   TCGGTATTGC GGATTAA
```

This corresponds to the amino acid sequence <SEQ ID 1002; ORF 255>:

```
m255.pep
    1   VVGQEALRGQ FVAVFAAALR YAVKTCADFH AFDGVDAHHR VGDFGIEAVK

51   NRFAQADRDI GCFDMQLRAD GIQGFAHAVH IVFQLGNLAM VGGKKRILGN

101   VFAAFKPDFF FADLGNVGGD FRAEFFFQPF FGNGSGSNAG GGFTGGAPAA

151   AAVVARAVFV PIGIVGVAGA EAGGDVAVVF AALVGIAD*
```

Computer analysis of this amino acid sequence gave the following results:
Homology with a Predicted ORF from N. gonorrhoeae
ORF 255 shows 88.8% identity over a 188 aa overlap with a predicted ORF (ORF 255.ng) from N. gonorrhoeae:

```
     m255/g255
                       10         20         30         40         50         60
         m255.pep  VVGQEALRGQFVAVFAAALRYAVKTCADFHAFDGVDAHHRVGDFGIEAVKNRFAQADRDI
                   :||||||||||||||||||||||||||||||||||||||||||||||:|  |||:| |:
             g255  MVGQEALRGQFVAVFAAALRYAVKTCADFHAFDGVDAHHRVGDFGIEAVENGFAQTDGDI
                           10         20         30         40         50         60

70         80         90        100        110        120
         m255.pep  GCFDMQLRADGIQGFAHAVHIVFQLGNLAMVGGKKRILGNVFAAFKPDFFFADLGNVGGD
                   |  ||||:||||||||||:||||||:|:||:|||||||||||||||||||||||||||||
             g255  GGFDMQFRADGIQGFAHTVHIVFQFGDLALVGGKKRILGNVFAAFKPDFFFADLGNVGGD
                           70         80         90        100        110        120

130        140        150        160        170        180
         m255.pep  FRAEFFFQPFFGNGSGSNAGGGFTGGAPAAAAVVARAVFVPIGIVGVAGAEAGGDVAVVF
                   ||||||||||||||:|||  ||:||:||||  ||||:||||||||||:|||:||||||||
             g255  FRAEFFFQPFFGNGSGGNAGCGFAGGTPAAAPVVARTVFVPIGIVGVSGAEGGGDVAVVF
                          130        140        150        160        170        180
```

```
           189
m255.pep   AALVGIADX
           ||||| :|||
g255       AALVGVADX
```

The following partial DNA sequence was identified in *N. meningitidis* <SEQ ID 1003>:

```
a255.seq
  1   GTGGTTGGAC AGGAAGCCTT GCGGGGTGAG TTCGTCGCCG TGTTCGCTGC

51   CGCGTTGCGT TACGCTGTCA AAACCTGCGC CGATTTCCAC GCCTTTGACG

101   GCGTTGATGC CCATCATGGC GTAGGCGATT TCGGCATCGA GGCGGTCGAA

151   TACGGGTTCG CCCAAGCCGA CGGGGACGTT GGCGGCTTCA ATATGCAGCT

201   TCGCGCCGAC GGAATCCAAG GATTTGCGCA CGCTGTCCAT ATAGTTTTCC

251   AGCTCGGCAA TTTGGCTATG GTTGGCGGCA AAAAAGGAT TTTGGGAAAT

301   GTGTTCGCAG CCTTCAAACC GGATTTCTTT TTCGCCGACT TGGGTAACGT

351   AGGCGGTGAT TTCCGTGCCG AATTTTTCTT TCAACCATTT TTTGGCAACG

401   GCTCCGGCGG CAACGCGGGC GGCGGTTTCG CGGGCGGAAC TCCTGCCGCC

451   GCCCCGGTAG TCGCGCGTGC CGTATTTGTG CCAATAGGTA TAGTCGGCGT

501   GGCCGGGGCG GAAGCTGGTG GCGATGTTGC CGTAGTCTTT GCTGCGCTGG

551   TCGGTATTGC GGATTAA
```

This corresponds to the amino acid sequence <SEQ ID 1004; ORF 255.a>:

```
a255.pep
  1   VVGQEALRGE FVAVFAAALR YAVKTCADFH AFDGVDAHHG VGDFGIEAVE

51   YGFAQADGDV GGFNMQLRAD GIQGFAHAVH IVFQLGNLAM VGGKKRILGN

101   VFAAFKPDFF FADLGNVGGD FRAEFFFQPF FGNGSGGNAG GGFAGGTPAA

151   APVVARAVFV PIGIVGVAGA EAGGDVAVVF AALVGIAD*
``` m255/a255 93.1% identity in 188 aa overlap

```
                   10         20         30         40         50         60
m255.pep   VVGQEALRGQFVAVFAAALRYAVKTCADFHAFDGVDAHHRVGDFGIEAVKNRFAQADRDI
           ||||||||| :|||||||||||||||||||||||||||| |||||||||: ||||  |:
a255       VVGQEALRGEFVAVFAAALRYAVKTCADFHAFDGVDAHHGVGDFGIEAVEYGFAQADGDV
                   10         20         30         40         50         60

70         80         90        100        110        120
m255.pep   GCFDMQLRADGIQGFAHAVHIVFQLGNLAMVGGKKRILGNVFAAFKPDFFFADLGNVGGD
           | |:||||||||||||||||||||||||||||||||||||||||||||||||||||||||
a255       GGFNMQLRADGIQGFAHAVHIVFQLGNLAMVGGKKRILGNVFAAFKPDFFFADLGNVGGD
                   70         80         90        100        110        120

130        140        150        160        170        180
m255.pep   FRAEFFFQPFFGNGSGSNAGGGFTGGAPAAAAVVARAVFVPIGIVGVAGAEAGGDVAVVF
           ||||||||||||||| ||||| ||:||| ||||||||||||||||||||||||||||||
a255       FRAEFFFQPFFGNGSGGNAGGGFAGGTPAAAPVVARAVFVPIGIVGVAGAEAGGDVAVVF
                  130        140        150        160        170        180

189
m255.pep   AALVGIADX
           |||||||||
a255       AALVGIADX
```

The following partial DNA sequence was identified in *N. gonorrhoeae* <SEQ ID 1005>:

g256.seq
```
  1  atgctcgcgg tacgcaatcg gggttggcac ggcgcagtcg tccatttccg
 51  cagctgcggc ggcgtagcga acaccgcccc ggtgttctac cacttgggtg
101  ataccgccga aatcgccttt gctttggaca cgctcaccgc gcgttaccgt
151  gaaatatacg ccgtcggcgt atcgctgggc ggcaacgcgc cggcaaaata
201  tttgggcgaa cagggcaaaa aggcattgcc gcacgcctcg gccgccgtat
251  ccgcccccgt tgatgcagag gcggcaggca gccgcttcga cagcggcatc
301  acgcggctgc tctacacgcg ctacttcctc cgcacactga tacccaaagc
351  acgttcgctc caaggttttc agacggcatt tgccgcaggg tgcaaaacac
401  tgggcgagtt tgacgaccgt ttcaccgcac cgctgcacgg ctttgccgac
451  cggcacgact actaccgcca aacttcctgc aaaccgctgc tcaaacacgt
501  tgccaaaccg ctgctcctgc tcaatgccgc caacgacccc ttcctgccgc
551  ccgaagccct gccccgtgca gacgaagcgt ccgaagccgt taccctgttc
601  caacctgcac acggcgggca cgccggcttt gtcagcagca ccggcggcag
651  gctgcacctg caatggctgc cgcagaccgt cctgtcctat tttgacagct
701  tccgcacaaa caggcgttaa
```

This corresponds to the amino acid sequence <SEQ ID 1006; ORF 256.ng>:

g256.pep
```
  1  MLAVRNRGWH GAVVHFRSCG GVANTAPVFY HLGDTAEIAF ALDTLTARYR
 51  EIYAVGVSLG GNAPAKYLGE QGKKALPHAS AAVSAPVDAE AAGSRFDSGI
101  TRLLYTRYFL RTLIPKARSL QGFQTAFAAG CKTLGEFDDR FTAPLHGFAD
151  RHDYYRQTSC KPLLKHVAKP LLLLNAANDP FLPPEALPRA DEASEAVTLF
201  QPAHGGHAGF VSSTGGRLHL QWLPQTVLSY FDSFRTNRR*
```

The following partial DNA sequence was identified in *N. meningitidis* <SEQ ID 1007>:

m256.seq
```
  1  ATGCTTGCGG TACGCGATCG GGGTTGGCAC GGCGTAGTCG TCCATTTCCG
 51  CAGCTGCGGC GGCATTGCCA ACACCGCTCC GGTGTTCTAC CA.CTtGGCG
101  ATACCGCCGA AATCGCCTTT ACTTTGGACA CGTTCGCCGC GCGTTACCGT
151  GAAAtATACG CCGTCGGCGT ATCGCTGGGC GGCAACGCGC TGGCAAAATA
201  TTTGGGCGAA CAGGGCAAAA AGGCATTGCC GCAAGCCGCT GCCGTCATCT
251  CCGCCCCCGT CGATGCAGAG GCGGCAGGCA GACGCTTCGA CAGCGGCATC
301  ACGCGGCTGC TCTACACGCG CTACTTCCTC GCACCCTGA TACCCAAAGC
351  AAAATCGCTC CAAGGTTTTC AGACGGCATT TGCCGCAGGG TGCAAAACAC
401  TGGGCGAGTT TGACGACCGC TTCACCGCAC CGCTGCACGG CTTTGCCGAC
451  CGGCACGACT ACTACCGCCA AACTTCCTGC AAACCGCTGC TCAAACACGT
501  TGCCAAACCG CTGCTCCTGC TCAATGCCGT CAACGACCCC TTCCTGCCGC
551  CCGAAGCCGT GCCCCGCGCA GACGAAGTAT CCGAAGCCGT TACCCTGTTC
601  CAGCCGGCAT ATGGTGGTCA TGTCGGCTTT GTCAGCAGCA CCGGCGGCAG
```

-continued

```
651  GCTGCACCTG CAATGGCTGC CGCAGACCGT CCTGTCCTAT TTCGACAGCT

701  TCCGCACAAA CAGGCGTTAA
```

This corresponds to the amino acid sequence <SEQ ID 1008; ORF 256>:

```
m256.pep
  1  MLAVRDRGWH GVVVHFRSCG GIANTAPVFY XLGDTAEIAF TLDTFAARYR

51  EIYAVGVSLG GNALAKYLGE QGKKALPQAA AVISAPVDAE AAGRRFDSGI

101  TRLLYTRYFL RTLIPKAKSL QGFQTAFAAG CKTLGEFDDR FTAPLHGFAD

151  RHDYYRQTSC KPLLKHVAKP LLLLNAVNDP FLPPEALPRA DEVSEAVTLF

201  QPAYGGHVGF VSSTGGRLHL QWLPQTVLSY FDSFRTNRR*
```

Computer analysis of this amino acid sequence gave the following results:
Homology with a Predicted ORF from *N. gonorrhoeae*
ORF 256 shows 92.9% identity over a 239 aa overlap with a predicted ORF (ORF 256.ng) from *N. gonorrhoeae*:

```
m256/g256
                    10         20         30         40         50         60
m256.pep   MLAVRDRGWHGVVVHFRSCGGIANTAPVFYHLGDTAEIAFTLDTFAARYREIYAVGVSLG
           |||||:|||||:||||||||||:|||||||||||||||||||:|||::||||||||||||
g256       MLAVRNRGWHGAVVVHFRSCGGVANTAPVFYHLGDTAEIAFALDTLTARYREIYAVGVSLG
                    10         20         30         40         50         60

70         80         90        100        110        120
m256.pep   GNALAKYLGEQGKKALPQAAAVISAPVDAEAAGRRFDSGITRLLYTRYFLRTLIPKAKSL
           |||  ||||||||||||||:|:::||||||||||:||||||||||||||||||||:||
g256       GNAPAKYLGEQGKKALPHASAAVSAPVDAEAAGSRFDSGITRLLYTRYFLRTLIPKARSL
                    70         80         90        100        110        120

130        140        150        160        170        180
m256.pep   QGFQTAFAAGCKTLGEFDDRFTAPLHGFADRHDYYRQTSCKPLLKHVAKPLLLLNAVNDP
           |||||||||||||||||||||||||||||||||||||||||||||||||||||||:|||
g256       QGFQTAFAAGCKTLGEFDDRFTAPLHGFADRHDYYRQTSCKPLLKHVAKPLLLLNAANDP
                   130        140        150        160        170        180

190        200        210        220        230        240
m256.pep   FLPPEALPRADEVSEAVTLFQPAYGGHVGFVSSTGGRLHLQWLPQTVLSYFDSFRTNRRX
           ||||||||||||:|||||||||||:|||:||||||||||||||||||||||||||||||
g256       FLPPEALPRADEASEAVTLFQPAHGGHAGFVSSTGGRLHLQWLPQTVLSYFDSFRTNRRX
                   190        200        210        220        230        240
```

The following partial DNA sequence was identified in *N. meningitidis* <SEQ ID 1009>:

```
a256.seq
  1  ATGCTCGCGG TACGCGATCG GGGTTGGAAC GGCGTAGTCG TCCATTTCCG

51  CAGCTGCGGC GGCGTAGCGA ACACCGCCCC GGTGTTCTAC CACTTGGGCG

101  ATACCGCCGA AATTGCCTTT ACTTTGGACA CGCTCGCCGC GCGTTACCGT

151  GAAATATACG CCGTCGGCGT ATCGCTGGGC GGCAACGCGC TGGCAAAATA

201  TTTGGGCGAA CAGGGCGAAA ACGCGCTGCC GCAAGCCGCC GCCGTCATCT

251  CCGAAGCCGT CGATGCAGAG GCGGCAGGCA ACCGCTTCGA CAGCGGCATC

301  ACACGGCTGC TCTACACGCG CTACTTCCTC CGCACACTGA TACCCAAAGC

351  ACGGTCGCTC CAAGGTTTTC AGACGGCATT TGCCGCAGGG TGCAAAACAC

401  TGGGCGAGTT TGACGACCGT TTCACCGCAC CGCTGCACGG CTTTGCCGAT

451  CGGCACGACT ACTACCGCCA AACTTCCTGC AAACCGCTGC TCAAACACGT

501  TGCCAAACCG CTGCTCCTGC TCAATGCCGT CAACGACCCC TTCCTGCCGC
```

```
551  CCGAAGCGCT GCCCCGCGCA GACGAAGTGT CCGAAGCCGT TACCCTGTTC

601  CAGCCGACAC ACGGTGGTCA TGTCGGCTTT GTCGGCAGCA CCGGCGGCAG

651  GCTGCACCTG CAATGGTTGC CGCAGACCGT CCTGTCCTAT TTCGACAGCT

701  TCCGCACAAA CAGGCGTTAA
```

This corresponds to the amino acid sequence <SEQ ID 1010; ORF 256.a>:

```
a256.pep
  1  MLAVRDRGWN GVVVHFRSCG GVANTAPVFY HLGDTAEIAF TLDTLAARYR

51  EIYAVGVSLG GNALAKYLGE QGENALPQAA AVISAPVDAE AAGNRFDSGI

101  TRLLYTRYFL RTLIPKARSL QGFQTAFAAG CKTLGEFDDR FTAPLHGFAD

151  RHDYYRQTSC KPLLKHVAKP LLLLNAVNDP FLPPEALPRA DEVSEAVTLF

201  QPTHGGHVGF VGSTGGRLHL QWLPQTVLSY FDSFRTNRR*
``` m256/a256 95.4% identity in 239 aa overlap

```
               10         20         30         40         50         60
m256.pep  MLAVRDRGWHGVVVHFRSCGGIANTAPVFYXLGDTAEIAFTLDTFAARYREIYAVGVSLG
          ||||||||||:|||||||||||:||||||| |||||||||||||:|||||||||||||||
a256      MLAVRDRGWNGVVVHFRSCGGVANTAPVFYHLGDTAEIAFTLDTLAARYREIYAVGVSLG
               10         20         30         40         50         60

70         80         90        100        110        120
m256.pep  GNALAKYLGEQGKKALPQAAAVISAPVDAEAAGRRFDSGITRLLYTRYFLRTLIPKAKSL
          ||||||||||::|||||||||||||||||||||||:|||||||||||||||||||||:||
a256      GNALAKYLGEQGENALPQAAAVISAPVDAEAAGNRFDSGITRLLYTRYFLRTLIPKARSL
               70         80         90        100        110        120

130        140        150        160        170        180
m256.pep  QGFQTAFAAGCKTLGEFDDRFTAPLHGFADRHDYYRQTSCKPLLKHVAKPLLLLNAVNDP
          ||||||||||||||||||||||||||||||||||||||||||||||||||||||||||||
a256      QGFQTAFAAGCKTLGEFDDRFTAPLHGFADRHDYYRQTSCKPLLKHVAKPLLLLNAVNDP
              130        140        150        160        170        180

190        200        210        220        230        240
m256.pep  FLPPEALPRADEVSEAVTLFQPAYGGHVGFVSSTGGRLHLQWLPQTVLSYFDSFRTNRRX
          |||||||||||||||||||||::||||||:||||||||||||||||||||||||||||||
a256      FLPPEALPRADEVSEAVTLFQPTHGGHVGFVGSTGGRLHLQWLPQTVLSYFDSFRTNRRX
              190        200        210        220        230        240
```

The following partial DNA sequence was identified in *N. gonorrhoeae* <SEQ ID 1011>:

```
g256-1.seq
  1  ATGATTTTGA CACCGCCGGA CACGCCCTTT TTCCTCCGCA ACGGCAATGC

51  CGACACGATT GCCGCCAAAT TCCTGCAACA CCCCGCACCC GCATACCGCC

101  GCGAGATGCT TCCCGACAGC ACGGGTAAAA CCAAAACCGC CTACGACTTT

151  TCAGCAGGCG GCATTTCGCC CGATGCGCCG CTGGTCGTGC TGTTTCACGG

201  TTTGGAAGGA AGCAGCCGCA GCCATTACGC GGTCGAACTG ATGCTCGCGG

251  TACGCAATCG GGGTTGGCAC GGCGCAGTCG TCCATTTCCG CAGCTGCGGC

301  GGCGTAGCGA ACACCGCCCC GGTGTTCTAC CACTTGGGTG ATACCGCCGA

351  AATCGCCTTT GCTTTGGACA CGCTCACCGC GCGTTACCGT GAAATATACG

401  CCGTCGGCGT ATCGCTGGGC GGCAACGCGC CGGCAAAATA TTTGGGCGAA

451  CAGGGCAAAA AGGCATTGCC GCACGCCTCG CCGCCGTAT CCGCCCCCGT

501  TGATGCAGAG GCGGCAGGCA GCCGCTTCGA CAGCGGCATC ACGCGGCTGC

551  TCTACACGCG CTACTTCCTC CGCACACTGA TACCCAAAGC ACGTTCGCTC
```

-continued

```
601    CAAGGTTTTC AGACGGCATT TGCCGCAGGG TGCAAAACAC TGGGCGAGTT

651    TGACGACCGT TTCACCGCAC CGCTGCACGG CTTTGCCGAC CGGCACGACT

701    ACTACCGCCA AACTTCCTGC AAACCGCTGC TCAAACACGT TGCCAAACCG

751    CTGCTCCTGC TCAATGCCGC AACGACCCC TTCCTGCCGC CCGAAGCCCT

801    GCCCCGTGCA GACGAAGCGT CCGAAGCCGT TACCCTGTTC AACCTGCAC

851    ACGGCGGGCA CGCCGGCTTT GTCAGCAGCA CCGGCGGCAG GCTGCACCTG

901    CAATGGCTGC CGCAGACCGT CCTGTCCTAT TTTGACAGCT TCCGCACAAA

951    CAGGCGTTAA
```

This corresponds to the amino acid sequence <SEQ ID 1012; ORF 256-1.ng>:

```
g256-1.pep
  1    MILTPPDTPF FLRNGNADTI AAKFLQHPAP AYRREMLPDS TGKTKTAYDF

51    SAGGISPDAP LVVLFHGLEG SSRSHYAVEL MLAVRNRGWH GAVVHFRSCG

101    GVANTAPVFY HLGDTAEIAF ALDTLTARYR EIYAVGVSLG GNAPAKYLGE

151    QGKKALPHAS AAVSAPVDAE AAGSRFDSGI TRLLYTRYFL RTLIPKARSL

201    QGFQTAFAAG CKTLGEFDDR FTAPLHGFAD RHDYYRQTSC KPLLKHVAKP

251    LLLLNAANDP FLPPEALPRA DEASEAVTLF QPAHGGHAGF VSSTGGRLHL

301    QWLPQTVLSY FDSFRTNRR*
```

The following partial DNA sequence was identified in *N. meningitidis* <SEQ ID 1013>:

```
m256-1.seq
  1    ATGATTTTAA CACCGCCGGA CACGCCCTTT TTCCTCCGCA ACGGCAATGC

51    CGACACGATT GCCGCCAAAT TCCTGCAACG CCCCGCGCCC GCATACCGCC

101    GAGAGCTGCT TCCCGACAGC ACGGGTAAAA CCAAAGTCGC CTACGACTTT

151    TCAGACGGCA TTTCGCCCGA TGCCGCCCTG GTCGTGCTGT TCACGGTTT

201    GGAAGGAAGC AGCCGCAGCC ATTACGCGGT CGAACTGATG CTTGCGGTAC

251    GCGATCGGGG TTGGCACGGC GTAGTCGTCC ATTTCCGCAG CTGCGGCGGC

301    ATTGCCAACA CCGCTCCGGT GTTCTACCAC TTGGGCGATA CCGCCGAAAT

351    CGCCTTTACT TTGGACACGT TCGCCGCGCG TTACCGTGAA ATATACGCCG

401    TCGGCGTATC GCTGGGCGGC AACGCGCTGG CAAAATATTT GGGCGAACAG

451    GGCAAAAAGG CATTGCCGCA AGCCGCTGCC GTCATCTCCG CCCCCGTCGA

501    TGCAGAGGCG GCAGGCAGAC GCTTCGACAG CGGCATCACG CGGCTGCTCT

551    ACACGCGCTA CTTCCTCCGC ACCCTGATAC CAAAGCAAA ATCGCTCCAA

601    GGTTTTCAGA CGGCATTTGC CGCAGGGTGC AAAACACTGG GCGAGTTTGA

651    CGACCGCTTC ACCGCACCGC TGCACGGCTT TGCCGACCGG CACGACTACT

701    ACCGCCAAAC TTCCTGCAAA CCGCTGCTCA ACACGTTGC CAAACCGCTG

751    CTCCTGCTCA ATGCCGTCAA CGACCCCTTC CTGCCGCCCG AAGCCCTGCC

801    CCGCGCAGAC GAAGTATCCG AAGCCGTTAC CCTGTTCCAG CCGGCATATG

851    GTGGTCATGT CGGCTTTGTC AGCAGCACCG GCGGCAGGCT GCACCTGCAA
```

```
                              -continued
    901    TGGCTGCCGC AGACCGTCCT GTCCTATTTC GACAGCTTCC GCACAAACAG

951    GCGTTAA
```

This corresponds to the amino acid sequence <SEQ ID 1014; ORF 256-1>:

```
m256-1.pep
      1    MILTPPDTPF FLRNGNADTI AAKFLQRPAP AYRRELLPDS TGKTKVAYDF

51    SDGISPDAPL VVLFHGLEGS SRSHYAVELM LAVRDRGWHG VVVHFRSCGG

101    IANTAPVFYH LGDTAEIAFT LDTFAARYRE IYAVGVSLGG NALAKYLGEQ

151    GKKALPQAAA VISAPVDAEA AGRRFDSGIT RLLYTRYFLR TLIPKAKSLQ

201    GFQTAFAAGC KTLGEFDDRF TAPLHGFADR HDYYRQTSCK PLLKHVAKPL

251    LLLNAVNDPF LPPEALPRAD EVSEAVTLFQ PAYGGHVGFV SSTGGRLHLQ

301    WLPQTVLSYF DSFRTNRR*
``` m256-1/a256-1 93.1% identity in 319 aa overlap

```
                        10          20          30          40          50          59
m256-1.pep   MILTPPDTPFFLRNGNADTIAAKFLQRPAPAYRRELLPDSTGKTKVAYDFS-DGISPDAP
             ||||||||||||||||||||||||| ||||||||||:||||||||| ||||| ||||||||
g256-1       MILTPPDTPFFLRNGNADTIAAKFLQHPAPAYRREMLPDSTGKTKTAYDFSAGGISPDAP
                        10          20          30          40          50          60
                        60          70          80          90         100         110         119
m256-1.pep   LVVLFHGLEGSSRSHYAVELMLAVRDRGWHGVVVHFRSCGGIANTAPVFYHLGDTAEIAF
             |||||||||||||||||||||||||:||||||||:||||||||||||||||||||||||||||
g256-1       LVVLFHGLEGSSRSHYAVELMLAVRNRGWHGAVVHFRSCGGVANTAPVFYHLGDTAEIAF
                        70          80          90         100         110         120
                       120         130         140         150         160         170         179
m256-1.pep   TLDTFAARYREIYAVGVSLGGNALAKYLGEQGKKALPQAAAVISAPVDAEAAGRRFDSGI
             :|||::|||||||||||||||||| ||||||||||||||:|:|:::||||||||| ||||||
g256-1       ALDTLTARYREIYAVGVSLGGNAPAKYLGEQGKKALPHASAAVSAPVDAEAAGSRFDSGI
                       130         140         150         160         170         180
                       180         190         200         210         220         230         239
m256-1.pep   TRLLYTRYFLRTLIPKAKSLQGFQTAFAAGCKTLGEFDDRFTAPLHGFADRHDYYRQTSC
             |||||||||||||||||:||||||||||||||||||||||||||||||:||||||||||||
g256-1       TRLLYTRYFLRTLIPKARSLQGFQTAFAAGCKTLGEFDDRFTAPLHGFADRHDYYRQTSC
                       190         200         210         220         230         240
                       240         250         260         270         280         290         299
m256-1.pep   KPLLKHVAKPLLLLNAVNDPFLPPEALPRADEVSEAVTLFQPAYGGHVGFVSSTGGRLHL
             ||||||||||||||||:|||||||||||||||:|||||||||:|||:|||:||||||||||
g256-1       KPLLKHVAKPLLLLNAANDPFLPPEALPRADEASEAVTLFQPAHGGHAGFVSSTGGRLHL
                       250         260         270         280         290         300
                       300         310   319
m256-1.pep   QWLPQTVLSYFDSFRTNRRX
             ||||||||||||||||||||
g256-1       QWLPQTVLSYFDSFRTNRRX
                       310         320
```

The following partial DNA sequence was identified in *N. meningitidis* <SEQ ID 1015>:

```
a256-1.seq
      1    ATGATTTTGA CACCGCCGGA CACACCCTTT TTCCTCCGCA ACGGCAATGC

51    CGACACGATT GCCGCCAAAT TCCTGCAACG CTCCGCACCT GCATACCGCC

101    GCGAGCTGCT TCCCGACAGC ACGGGTAAAA CCAAAACCGC CTACGACTTT

151    TCAGACGGCA TTTCGCCCGA TGCGCCGCTG GTCGTGCTGT TTCACGGTTT

201    GGAGGGCGGC AGTGGCAGCC ATTACGCGGT CGAACTGATG CTCGCGGTAC

251    GCGATCGGGG TTGGAACGGC GTAGTCGTCC ATTTCCGCAG CTGCGGCGGC

301    GTAGCGAACA CCGCCCCGGT GTTCTACCAC TTGGGCGATA CCGCCGAAAT
```

```
 351    TGCCTTTACT TTGGACACGC TCGCCGCGCG TTACCGTGAA ATATACGCCG

401    TCGGCGTATC GCTGGGCGGC AACGCGCTGG CAAAATATTT GGGCGAACAG

451    GGCGAAAACG CGCTGCCGCA AGCCGCCGCC GTCATCTCCG CACCCGTCGA

501    TGCAGAGGCG GCAGGCAACC GCTTCGACAG CGGCATCACA CGGCTGCTCT

551    ACACGCGCTA CTTCCTCCGC ACACTGATAC CAAAGCACG GTCGCTCCAA

601    GGTTTTCAGA CGGCATTTGC CGCAGGGTGC AAAACACTGG GCGAGTTTGA

651    CGACCGTTTC ACCGCACCGC TGCACGGCTT TGCCGATCGG CACGACTACT

701    ACCGCCAAAC TTCCTGCAAA CCGCTGCTCA ACACGTTGC CAAACCGCTG

751    CTCCTGCTCA ATGCCGTCAA CGACCCCTTC CTGCCGCCCG AAGCGCTGCC

801    CCGCGCAGAC GAAGTGTCCG AAGCCGTTAC CCTGTTCCAG CCGACACACG

851    GTGGTCATGT CGGCTTTGTC GGCAGCACCG GCGGCAGGCT GCACCTGCAA

901    TGGTTGCCGC AGACCGTCCT GTCCTATTTC GACAGCTTCC GCACAAACAG

951    GCGTTAA
```

This corresponds to the amino acid sequence <SEQ ID 1016;
ORF 256-1.a>:

```
a256-1.pep
     1      MILTPPDTPF FLRNGNADTI AAKFLQRSAP AYRRELLPDS TGKTKTAYDF

51      SDGISPDAPL VVLFHGLEGG SGSHYAVELM LAVRDRGWNG VVVHFRSCGG

101      VANTAPVFYH LGDTAEIAFT LDTLAARYRE IYAVGVSLGG NALAKYLGEQ

151      GENALPQAAA VISAPVDAEA AGNRFDSGIT RLLYTRYFLR TLIPKARSLQ

201      GFQTAFAAGC KTLGEFDDRF TAPLHGFADR HDYYRQTSCK PLLKHVAKPL

251      LLLNAVNDPF LPPEALPRAD EVSEAVTLFQ PTHGGHVGFV GSTGGRLHLQ

301      WLPQTVLSYF DSFRTNRR*
``` a256-1/m256-1 95.6% identity in 318 aa overlap

```
                    10         20         30         40         50         60
a256-1.pep  MILTPPDTPFFLRNGNADTIAAKFLQRSAPAYRRELLPDSTGKTKTAYDFSDGISPDAPL
            |||||||||||||||||||||||||||||:||||||||||||||||:|||||||||||||
m256-1      MILTPPDTPFFLRNGNADTIAAKFLQRPAPAYRRELLPDSTGKTKVAYDFSDGISPDAPL
                    10         20         30         40         50         60

70         80         90        100        110        120
a256-1.pep  VVLFHGLEGGSGSHYAVELMLAVRDRGWNGVVVHFRSCGGVANTAPVFYHLGDTAEIAFT
            |||||||||:|||||||||||||||||:||||||||||||||:|||||||||||||||||
m256-1      VVLFHGLEGSSRSHYAVELMLAVRDRGWHGVVVHFRSCGGIANTAPVFYHLGDTAEIAFT
                    70         80         90        100        110        120

130        140        150        160        170        180
a256-1.pep  LDTLAARYREIYAVGVSLGGNALAKYLGEQGENALPQAAAVISAPVDAEAAGNRFDSGIT
            |||:|||||||||||||||||||||||||||::|||||||||||||||||||||||||||
m256-1      LDTFAARYREIYAVGVSLGGNALAKYLGEQGKKALPQAAAVISAPVDAEAAGRRFDSGIT
                   130        140        150        160        170        180

190        200        210        220        230        240
a256-1.pep  RLLYTRYFLRTLIPKARSLQGFQTAFAAGCKTLGEFDDRFTAPLHGFADRHDYYRQTSCK
            ||||||||||||||||:|||||||||||||||||||||||||||||||||||||||||||
m256-1      RLLYTRYFLRTLIPKAKSLQGFQTAFAAGCKTLGEFDDRFTAPLHGFADRHDYYRQTSCK
                   190        200        210        220        230        240

250        260        270        280        290        300
a256-1.pep  PLLKHVAKPLLLLNAVNDPFLPPEALPRADEVSEAVTLFQPTHGGHVGFVGSTGGRLHLQ
            ||||||||||||||||||||||||||||||||||||||||||::||||||:|||||||||
m256-1      PLLKHVAKPLLLLNAVNDPFLPPEALPRADEVSEAVTLFQPAYGGKVGFVSSTGGRLHLQ
                   250        260        270        280        290        300
```

```
            310       319
a256-1.pep  WLPQTVLSYFDSFRTNRRX
            |||||||||||||||||||
m256-1      WLPQTVLSYFDSFRTNRRX
            310
```

The following partial DNA sequence was identified in *N. gonorrhoeae* <SEQ ID 1017>:

```
g257.seq
    1   atgggcaggc atttcgggcg cagacgtttt ctgacggctg ccgccgttgc 51   tgtggccggt gcggcggttt ctttttttgcc gaatccttttt gccgccggcg 101   gcgaaaaacg caacatggat aaaaaacgcg atgaaaatgt gttttctgg 151   aaaggtgtcg cgctgggttc cggcgcggag ctgcgcctgt tcggcgtgga 201   cgacagacag gcggcggatt tggtcaataa ggttttggcg aagtggcgc 251   gtttggaaaa aatgttcagc ctttaccgtg aagacagcct gatcagccgt 301   ctgaaccgcg acggttatct gacttcgcct ccggcggatt ttttggaact 351   gttgagcctg gccgcgatat tcacgcgctg a
```

This corresponds to the amino acid sequence <SEQ ID 1018; ORF 257.ng>:

```
g257.pep
    1   MGRHFGRRRF LTAAAVAVAG AAVSFLPNPF AAGGEKRNMD KKRDENVFFW

51   KGVALGSGAE LRLFGVDDRQ AADLVNKVLA EVARLEKMFS LYREDSLISR

101   LNRDGYLTSP PADFLELLSL AAIFTR*
```

The following partial DNA sequence was identified in *N. meningitidis* <SEQ ID 1019>:

```
m257.seq
    1   ATGGGCAGGC ATTTCGGGCG .CAGCGTTTT CTGACGGTTG CCGCCGTTGC

51   GGCGGGGaC. GCGGcGGTTT CTTTCCTGCC GAATCCTTTT GCCGCCGATG

101   ATGAAAAACG CAAcGGGGAT GAAAAACGCA ATGAAAATGT GTTTTTCTGG

151   AAAGGTGTCG CACTGGGTTC CGGTGCGGa. CTCCGTCTGT TCGGTGTGGA

201   CGACAGGCGT GCGGCGGATT TGGTCAACAA GGTTTTGGCG GAAGTGGCGC

251   GTTTGGAAAA ATTGTTCAGC CTTTACCGTG AAGACAGCCT GATCAGCCGC

301   CTGAACAGGG ACGGTTATCT GACTTCGCCG TCGGCGGATT TTTTGGAACT

351   GkTGAGCCTG GCCGCGATAT TCACGCkCTG A
                                         55
```

This corresponds to the amino acid sequence <SEQ ID 1020; ORF 257>:

```
m257.pep
    1   MGRHFGXQRF LTVAAVAAGX AAVSFLPNPF AADDEKRNGD EKRNENVFFW

51   KGVALGSGAX LRLFGVDDRR AADLVNKVLA EVARLEKLFS LYREDSLISR

101   LNRDGYLTSP SADFLELXSL AAIFTX*
```

Computer analysis of this amino acid sequence gave the following results:
Homology with a Predicted ORF from *N. gonorrhoeae*
ORF 257 shows 88.0% identity over a 125 aa overlap with a predicted ORF (ORF 257.ng) from *N. gonorrhoeae*:

```
m257/g257
                    10        20        30        40        50        60
    m257.pep  MGRHFGRQRFLTVAAVAAGTAAVSFLPNPFAADDEKRNGDEKRNENVFFWKGVALGSGAD
              ||||||| :||||:||||:: |||||||||||| |||| |:||:||||||||||||||||:
    g257      MGRHFGRRRFLTAAAVAVAGAAVSFLPNPFAAGGEKRNMDKKRDENVFFWKGVALGSGAE
                    10        20        30        40        50        60

70        80        90       100       110       120
    m257.pep  LRLFGVDDRRAADLVNKVLAEVARLEKLFSLYREDSLISRLNRDGYLTSPSADFLELXSL
              |||||||| :||||||||||||||||||||:|||||||||||||||||||||| |||||| ||
    g257      LRLFGVDDRQAADLVNKVLAEVARLEKMFSLYREDSLISRLNRDGYLTSPPADFLELLSL
                    70        80        90       100       110       120 m257.pep  AAIFTXX
              ||||| |
    g257      AAIFTRX
```

The following partial DNA sequence was identified in *N. meningitidis* <SEQ ID 1021>:

```
a257.seq
     1   ATGGGCAGGC ATTTCGGGCG CAGGCGTTTT TTGACAGTTG CCGCCGTTGC

51   GGCGGCGGGC GCGGCGGTTT CTTTCCTGCC GAATCCTTTT GCCGCCGATG

101   ATGAAAAACG CAATAAAGAT GAAAAACGCA ATGAAAATGT GTTTTTCTGG

151   AAAGGTGTCG CACTGGGTTC CGGTGCGGAG CTCCGTCTGT TCGGTGTGGA

201   CGACAGGCGT GCGGCGGATT TGGTCAACAA GGTTTTGGCG GAAGTGGCGC

251   GTTTGGAAAA AATGTTCAGC CTTTACCGTG AAGACAGCCT GATCAGCCGT

301   CTGAACCGTG ACGGTTATTT GACTTCGCCG CCGGCGGATT TTTTGGAACT

351   GTTGAGCCTG GCCGTGATAT TCACGCGCTG A
```

This corresponds to the amino acid sequence <SEQ ID 1022; ORF 257.a>:

```
a257.pep
     1   MGRHFGRRRF LTVAAVAAAG AAVSFLPNPF AADDEKRNKD EKRNENVFFW

51   KGVALGSGAE LRLFGVDDRR AADLVNKVLA EVARLEKMFS LYREDSLISR

101   LNRDGYLTSP PADFLELLSL AVIFTR*
``` m257/a257 92.0% identity in 125 aa overlap

```
                    10        20        30        40        50        60
    m257.pep  MGRHFGXQRFLTVAAVAAGXAAVSFLPNPFAADDEKRNGDEKRNENVFFWKGVALGSGAX
              ||||| :|||||||||| |||||||||||||||| ||||||||||||||||||||||
    a257      MGRHFGRRRFLTVAAVAAAGAAVSFLPNPFAADDEKRNKDEKRNENVFFWKGVALGSGAE
                    10        20        30        40        50        60

70        80        90       100       110       120
    m257.pep  LRLFGVDDRRAADLVNKVLAEVARLEKLFSLYREDSLISRLNRDGYLTSPSADFLELXSL
              |||||||||||||||||||||||||||:||||||||||||||||||||| |||||| ||
    a257      LRLFGVDDRRAADLVNKVLAEVARLEKMFSLYREDSLISRLNRDGYLTSPPADFLELLSL
                    70        80        90       100       110       120 m257.pep  AAIFTXX
              |:|||
    a257      AVIFTRX
```

The following partial DNA sequence was identified in *N. gonorrhoeae* <SEQ ID 1023>:

g258.seq
```
   1  atgcgccgct tcctaccgat cgcagccata tgcgccgtcg tcctgctgta
  51  cggattgacg gcggcgaccg gcagcaccag ttcgctggcg gattatttct
 101  ggtggatagt ctcgttcagc gcaatgctgc tgctggtgtt gtccgccgtt
 151  ttggcacgtt atgtcatatt gctgttgaaa gacaggcgca acggcgtgtt
 201  cggttcgcag attgccaaac gcctttccgg gatgttcacg ctggtcgccg
 251  tactgcccgg cttgttcctg ttcggcattt ccgcgcagtt tatcaacggc
 301  acgattaatt cgtggttcgg caacgacacc cacgaagccc tcgaacgcag
 351  ccttaatttg agcaagtccg cactggattt ggcggcagac aatgccgtca
 401  gcaacgccgt tcccgtacag atagacctca tcggcaccgc ctccctgtcg
 451  ggcaatatgg gcagtgtgct ggaacactac gccggcagcg gttttgccca
 501  gcttgccctg tacaatgccg caagcgggaa aatcgaaaaa agcatcaatc
 551  cgcaccaatt cgaccagccg cttcccgaca agaacattg  ggaacagatt
 601  cagcagaccg gttcggttcg gagtttggaa agcataggcg gcgtattgta
 651  cgcgcaggga tggttgtcgg caggtacgca caacgggcgc gattacgcgc
 701  tgttcttccg ccagccgatt cccgaaaatg tggcacagga tgccgttctg
 751  attgaaaagg cgcgggcgaa atatgccgaa ttgagttaca gcaaaaaagg
 801  tttgcagacc ttttttctgg taaccctgct gattgcctcg ctgctgtcga
 851  tttttcttgc gctggtaatg gcactgtatt ttgcccgccg tttcgtcgaa
 901  cccattctgt cgcttgccga gggcgcaaag gcggtggcgc agggtgattt
 951  cagccagacg cgccccgtat tgcgcaacga cgagttcgga cgtttgacca
1001  agctgttcaa ccatatgacc gagcagcttt ccatcgccaa agaagcagac
1051  gaacgcaacc gccggcgcga ggaagccgcc cgtcactacc tcgagtgcgt
1101  gttggatggg ttgactaccg gtgtggtggt ctcntacccc ctctcttgtt
1151  gccgtaccgc ggtgtttcc  acttgtcatt cctcccctct ttcttatttc
1201  taa
```

This corresponds to the amino acid sequence <SEQ ID 1024; ORF 258.ng>:

g258.pep
```
  1  MRRFLPIAAI CAVVLLYGLT AATGSTSSLA DYFWWIVSFS AMLLLVLSAV
 51  LARYVILLLK DRRNGVFGSQ IAKRLSGMFT LVAVLPGLFL FGISAQFING
101  TINSWFGNDT HEALERSLNL SKSALDLAAD NAVSNAVPVQ IDLIGTASLS
151  GNMGSVLEHY AGSGFAQLAL YNAASGKIEK SINPHQFDQP LPDKEHWEQI
201  QQTGSVRSLE SIGGVLYAQG WLSAGTHNGR DYALFFRQPI PENVAQDAVL
251  IEKARAKYAE LSYSKKGLQT FFLVTLLIAS LLSIFLALVM ALYFARRFVE
301  PILSLAEGAK AVAQGDFSQT RPVLRNDEFG RLTKLFNHMT EQLSIAKEAD
351  ERNRRREEAA RHYLECVLDG LTTGVVVSYP LSCCRTAVFS TCHSSPLSYF*
```

The following partial DNA sequence was identified in *N. meningitidis* <SEQ ID 1025>:

```
m258.seq
   1 ATGCGCCGTT TTCTACCGAT CGCAGCCATA TGCGCCGTCG TCCTGTTGTA
  51 CGGACTGACG GCGGCAACCG GCAGCACCAG TTCGCTGGCG GATTATTTCT
 101 GGTGGATTGT TGCGTTCAGC GCAATGCTGC TGCTGGTGTT GTCCGCCGTT
 151 TTGGCACGTT ATGTCATATT GCTGTTGAAA GACAGGCGCG ACGGCGTATT
 201 CGGTTCGCAG ATTGCCAAAC GCCTTTCTGG GATGTTTACG CTGGTTGCCG
 251 TACTGCCCGG CGTGTTTCTG TTCGGCGTTT CCGCACAGTT CATCAACGGC
 301 ACGATTAATT CGTGGTTCGG CAACGATACC CACGAGGCGC TTGAACGCAG
 351 CCTCAATTTG AGCAAGTCCG CATTGAATTT GGCGGCAGAC AACGCCCTCG
 401 GCAACGCCGT CCCCGTGCAG ATAGACCTCA TCGGCGCGGC TTCCCTGCCC
 451 GGGGATATGG CAGGGTGCT GGAACATTAC GCCGGCAGCG GTTTTGCCCA
 501 GCTTGCCCTG TACAATGCCG CAAGCGGCAA AATCGAAAAA AGCATCAACC
 551 CGCACAAGCT CGATCAGCCG TTTCCAGGTA AGGCGCGTTG GGAAAAAATC
 601 CAACGGGCGG GTTCGGTCAG GGATTTGGAA AGCATAGGCG GCGTATTGTA
 651 CGCGCAGGGC TGGCTGTCGG CGGGTACGCA CAACGGGCGC GATTACGCCT
 701 TGTTTTTCCG TCAGCCGGTT CCCAAAGGCG TGGCAGAGGA TGCCGTCTTA
 751 ATCGAAAAGG CAAGGGCGAA ATATGCTGAG TTGAGTTACA GCAAAAAAGG
 801 TTTGCAGACC TTTTTCCTGG CAACCCTGCT GATTGCCTCG CTGCTGTCGA
 851 TTTTTCTTGC ACTGGTCATG GCACTGTATT TCGCCCGCCG TTTCGTCGAA
 901 CCCGTCCTAT CGCTTGCCGA GGGGGCGAAG GCGGTGGCGC AAGGCGATTT
 951 CAGCCAGACG CGCCCCGTGT TGCGCAACGA CGAGTTCGGA CGCTTGACCA
1001 AGTTGTTCAA CCACATGACC GAGCAGCTTT CCATCGCCAA AGAAGCAGAC
1051 GAGCGCAACC GCCGGCGCGA GGAAGCCGCC AGGCATTATC TTGAATGCGT
1101 GTTGGAGGGG CTGACCACGG GCGTGGTGGT GTTTGACGAA CAAGGCTGTC
1151 TGAAAACsTT CAACAAAGCG GCGGAACAGA TTyTGGGGAT GCCGCTTACC
1201 CCCcTGTGGG GCAGCAGCCG GCACGGTTGG CACGGCGTTT CGGCGCAGCA
1251 GTCCCTGCTT GCCGAAGTGT TTGCCGCCAT CGGCGCGGCG GCAGGTACGG
1301 ACAAACCGGT CCATGTGAAA TATGCCGCGC CGGACGATGC CAAAATCCTG
1351 CTGGGCAAGG CAACCGTCCT GCCCGAAGAC AACGGCAACg GCGTGGTAAT
1401 GGTGATTGAC GACATCACCG TTTTGATACA CGCGCAAAAA GAAGCCGCGT
1451 GGGGCGAAgT GGCGaAgCGG CTGGCACACG AAATCCGCAA TCCGCTCACG
1501 CCCATCCAGC TTTCCGCCGA ACgGsTGGCG TkGAAATTGG GCGGGAAGCT
1551 GGATGAGCAG GATGCGCAAA TCCTGACGCG TTCGACCGAC ACCATCGTCA
1601 AACAGGTGGC GGCATTGAAG GAAATGGTCG AAGCATTCCG CAATTATGCG
1651 CGTTCCCCTT CGCTCAAATT GGAAAAATCAG GATTTGAACG CCTTAATCGG
1701 CGATGTGTTG GCATTGTATG AAGCCGGTCC GTGCCGGTTT GCGGCGGACT
1751 TGCCGGCGAA CCGCTGA
```

This corresponds to the amino acid sequence <SEQ ID 1026; ORF 258>:

```
m258.pep
    1   MRRFLPIAAI CAVVLLYGLT AATGSTSSLA DYFWWIVAFS AMLLLVLSAV

51   LARYVILLLK DRRDGVFGSQ IAKRLSGMFT LVAVLPGVFL FGVSAQFING

101   TINSWFGNDT HEALERSLNL SKSALNLAAD NALGNAVPVQ IDLIGAASLP

151   GDMGRVLEHY AGSGFAQLAL YNAASGKIEK SINPHKLDQP FPGKARWEKI

201   QRAGSVRDLE SIGGVLYAQG WLSAGTHNGR DYALFFRQPV PKGVAEDAVL

251   IEKARAKYAE LSYSKKGLQT FFLATLLIAS LLSIFLALVM ALYFARRFVE

301   PVLSLAEGAK AVAQGDFSQT RPVLRNDEFG RLTKLFNHMT EQLSIAKEAD

351   ERNRRREEAA RHYLECVLEG LTTGVVVFDE QGCLKTFNKA AEQILGMPLT

401   PLWGSSRHGW HGVSAQQSLL AEVFAAIGAA AGTDKPVHVK YAAPDDAKIL

451   LGKATVLPED NGNGVVMVID DITVLIHAQK EAAWGEVAKR LAHEIRNPLT

501   PIQLSAERXA XKLGGKLDEQ DAQILTRSTD TIVKQVAALK EMVEAFRNYA

551   RSPSLKLENQ DLNALIGDVL ALYEAGPCRF AADLPANR*
```

Computer analysis of this amino acid sequence gave the following results:

Homology with a Predicted ORF from *N. gonorrhoeae*

ORF 258 shows 90.9% identity over a 386 aa overlap with a predicted ORF (ORF 258.ng) from *N. gonorrhoeae*:

```
    m258/g258
                 10         20         30         40         50         60
    m258.pep  MRRFLPIAAICAVVLLYGLTAATGSTSSLADYFWWIVAFSAMLLLVLSAVLARYVILLLK
              ||||||||||||||||||||||||||||||||||||||:|||||||||||||||||||||
    g258      MRRFLPIAAICAVVLLYGLTAATGSTSSLADYFWWIVSFSAMLLLVLSAVLARYVILLLK
                 10         20         30         40         50         60

70         80         90        100        110        120
    m258.pep  DRRDGVFGSQIAKRLSGMFTLVAVLPGVFLFGVSAQFINGTINSWFGNDTHEALERSLNL
              |||:||||||||||||||||||||||||:||||:||||||||||||||||||||||||||
    g258      DRRNGVFGSQIAKRLSGMFTLVAVLPGLFLFGISAQFINGTINSWFGNDTHEALERSLNL
                 70         80         90        100        110        120

130        140        150        160        170        180
    m258.pep  SKSALNLAADNALGNAVPVQIDLIGAASLPGDMGRVLEHYAGSGFAQLALYNAASGKIEK
              |||||:||||::|||||||||||||:|||:|||:||||||||||||||||||||||||||
    g258      SKSALDLAADNAVSNAVPVQIDLIGTASLSGNMGSVLEHYAGSGFAQLALYNAASGKIEK
                130        140        150        160        170        180

190        200        210        220        230        240
    m258.pep  SINPHKLDQPFPGKARWEKIQRAGSVRDLESIGGVLYAQGWLSAGTHNGRDYALFFRQPV
              |||||::|||:|  |:||::||||:|||||||||||||||||||||||||||||||||:
    g258      SINPHQFDQPLPDKEHWEQIQQTGSVRSLESIGGVLYAQGWLSAGTHNGRDYALFFRQPI
                190        200        210        220        230        240

250        260        270        280        290        300
    m258.pep  PKGVAEDAVLIEKARAKYAELSYSKKGLQTFFLATLLIASLLSIFLALVMALYFARRFVE
              |::||:|||||||||||||||||||||||||||:||||||||||||||||||||||||||
    g258      PENVAQDAVLIEKARAKYAELSYSKKGLQTFFLVTLLIASLLSIFLALVMALYFARRFVE
                250        260        270        280        290        300

310        320        330        340        350        360
    m258.pep  PVLSLAEGAKAVAQGDFSQTRPVLRNDEFGRLTKLFNHMTEQLSIAKEADERNRRREEAA
              |:||||||||||||||||||||||||||||||||||||||||||||||||||||||||||
    g258      PILSLAEGAKAVAQGDFSQTRPVLRNDEFGRLTKLFNHMTEQLSIAKEADERNRRREEAA
                310        320        330        340        350        360

370        380        390        400        410        420
    m258.pep  RHYLECVLEGLTTGVVVFDEQGCLKTFNKAAEQILGMPLTPLWGSSRHGWHGVSAQQSLL
              |||||||:|||||||||             :| :|
    g258      RHYLECVLDGLTTGVVVSYPLSCCRTAVFSTCHSSPLSYFX
                370        380        390        400
```

The following partial DNA sequence was identified in *N. meningitidis* <SEQ ID 1027>:

```
a258.seq
    1   ATGCGCCGTT TTCTACCGAT CGCAGCCATA TGCGCCGTCG TCCTGTTGTA

51   CGGACTGACG GCGGCAACCG GCAGCACCAG TTCGCTGGCG GATTATTTCT
```

-continued

```
 101  GGTGGATTGT TGCGTTCAGC GCAATGCTGC TGCTGGTGTT GTCCGCCGTT
 151  TTGGCACGTT ATGTCATATT GCTGTTGAAA GACAGGCGCG ACGGCGTATT
 201  CGGTTCGCAG ATTGCCAAAC GCCTTTCCGG GATGTTTACG CTGGTTGCCG
 251  TACTGCCCGG CGTGTTTCTG TTCGGCGTTT CCGCACAGTT TATCAACGGC
 301  ACGATTAATT CGTGGTTCGG CAACGATACC CACGAGGCGC TTGAACGCAG
 351  CCTCAATTTG AGCAAGTCCG CATTGAATCT GGCGGCAGAC AACGCCCTTG
 401  GCAACGCCAT CCCCGTGCAG ATAGACCTCA TCGGCGCGGC TTCCCTGCCC
 451  GGGGATATGG GCAGGGTGCT GGAACATTAC GCCGGCAGCG GTTTTGCCCA
 501  GCTTGCCCTG TACAATGCCG CAAGCGGCAA AATCGAAAAA AGCATCAACC
 551  CGCACAAGCT CGATCAGCCG TTTCCAGGTA AGGCGCGTTG GGAAAAAATC
 601  CAACAGGCGG GTTCGGTCAG GGATTTGGAA AGCATAGGCG GCGTATTGTA
 651  CGCGCAGGGC TGGCTGTCGG CAGGTACGCA CAACGGGCGC GATTACGCCT
 701  TGTTTTTCCG TCAGCCGGTT CCCAAAGGCG TGGCAGAGGA TGCCGTCTTA
 751  ATCGAAAAGG CAAGGGCGAA ATATGCTGAG TTGAGTTACA GCAAAAAAGG
 801  TTTGCAGACC TTTTTCCTGG CAACCCTGCT GATTGCCTCG CTGCTGTCGA
 851  TTTTTCTTGC ACTGGTCATG GCACTGTATT CGCCCGCCG TTTCGTCGAA
 901  CCCGTCCTAT CGCTTGCCGA GGGGGCGAAG GCGGTGGCGC AAGGCGATTT
 951  CAGCCAGACG CGCCCCGTGT TGCGCAACGA CGAGTTCGGA CGCTTGACCA
1001  AGTTGTTCAA CCACATGACC GAGCAGCTTT CCATCGCCAA AGAAGCAGAC
1051  GAGCGCAACC GCCGGCGCGA GGAAGCCGCC AGACATTATC TCGAATGCGT
1101  GTTGGAGGGG CTGACCACGG GCGTGGTGGT GTTTGACGAA CAAGGCTGTC
1151  TGAAAACCTT CAACAAAGCG GCGGAACAGA TTTTGGGGAT GCCGCTTACC
1201  CCCCTGTGGG GCAGCAGCCG GCACGGTTGG CACGGCGTTT CGGCGCAGCA
1251  GTCCCTGCTT GCCGAAGTGT TTGCCGCCAT CGGCGCGCG GCAGGTACGG
1301  ACAAACCGGT CCATGTGAAA TATGCCGCGC CGGACGATGC CAAAATCCTG
1351  CTGGGCAAGG CAACCGTCCT GCCCGAAGAC AACGGCAACG GCGTGGTAAT
1401  GGTGATTGAC GACATCACCG TTTTGATACA CGCGCAAAAA GAAGCCGCGT
1451  GGGGCGAAGT GGCAAAACGG CTGGCACACG AAATCCGCAA TCCGCTCACG
1501  CCCATCCAGC TTTCTGCCGA ACGGCTGGCG TGGAAATTGG GCGGGAAGCT
1551  GGACGAGCAG GACGCGCAAA TCCTGACACG TTCGACCGAC ACCATCATCA
1601  AACAAGTGGC GGCATTAAAA GAAATGGTCG AGGCATTCCG CAATTACGCG
1651  CGTTCCCCTT CGCTCAAATT GGAAAATCAG GATTTGAACG CCTTAATCGG
1701  CGATGTGTTG GCATTGTACG AAGCTGGTCC GTGCCGGTTT GCGGCGGAAC
1751  TTGCCGGCGA ACCGCTGATG ATGGCGGCGG ATACGACCGC CATGCGGCAG
1801  GTGCTGCACA ATATTTTCAA AAATGCCGCC GAAGCGGCGG AAGAAGCCGA
1851  TGTGCCCGAA GTCAGGGTAA ATCGGAAGC GGGGCAGGAC GGACGGATTG
1901  TCCTGACAGT TTGCGACAAC GGCAAGGGGT TCGGCAGGGA AATGCTGCAC
1951  AATGCCTTCG AGCCGTATGT AACGGACAAA CCGGCTGGAA CGGGATTGGG
2001  ACTGCCCGTG GTGAAAAAAA TCATTGAAGA ACACGGCGGC CGCATCAGCC
```

-continued

```
2051 TGAGCAATCA GGATGCGGGC GGCGCGTGTG TCAGAATCAT CTTGCCAAAA

2101 ACGGTAGAAA CTTATGCGTA G
```

This corresponds to the amino acid sequence <SEQ ID 1028; ORF 258.a>:

```
a258.pep
   1 MRRFLPIAAI CAVVLLYGLT AATGSTSSLA DYFWWIVAFS AMLLLVLSAV

51 LARYVILLLK DRRDGVFGSQ IAKRLSGMFT LVAVLPGVFL FGVSAQFING

101 TINSWFGNDT HEALERSLNL SKSALNLAAD NALGNAIPVQ IDLIGAASLP

151 GDMGRVLEHY AGSGFAQLAL YNAASGKIEK SINPHKLDQP FPGKARWEKI

201 QQAGSVRDLE SIGGVLYAQG WLSAGTHNGR DYALFFRQPV PKGVAEDAVL

251 IEKARAKYAE LSYSKKGLQT FFLATLLIAS LLSIFLALVM ALYFARRFVE

301 PVLSLAEGAK AVAQGDFSQT RPVLRNDEFG RLTKLFNHMT EQLSIAKEAD

351 ERNRRREEAA RHYLECVLEG LTTGVVVFDE QGCLKTFNKA AEQILGMPLT

401 PLWGSSRHGW HGVSAQQSLL AEVFAAIGAA AGTDKPVHVK YAAPDDAKIL

451 LGKATVLPED NGNGVVMVID DITVLIHAQK EAAWGEVAKR LAHEIRNPLT

501 PIQLSAERLA WKLGGKLDEQ DAQILTRSTD TIIKQVAALK EMVEAFRNYA

551 RSPSLKLENQ DLNALIGDVL ALYEAGPCRF AAELAGEPLM MAADTTAMRQ

601 VLHNIFKNAA EAAEEADVPE VRVKSEAGQD GRIVLTVCDN GKGFGREMLH

651 NAFEPYVTDK PAGTGLGLPV VKKIIEEHGG RISLSNQDAG GACVRIILPK

701 TVETYA*
``` m258/a258 99.0% identity in 584 aa overlap

```
                 10        20        30        40        50        60
    m258.pep MRRFLPIAAICAVVLLYGLTAATGSTSSLADYFWWIVAFSAMLLLVLSAVLARYVILLLK
            ||||||||||||||||||||||||||||||||||||||||||||||||||||||||||||
    a258    MRRFLPIAAICAVVLLYGLTAATGSTSSLADYFWWIVAFSAMLLLVLSAVLARYVILLLK
                 10        20        30        40        50        60

70        80        90       100       110       120
    m258.pep DRRDGVFGSQIAKRLSGMFTLVAVLPGVFLFGVSAQFINGTINSWFGNDTHEALERSLNL
            ||||||||||||||||||||||||||||||||||||||||||||||||||||||||||||
    a258    DRRDGVFGSQIAKRLSGMFTLVAVLPGVFLFGVSAQFINGTINSWFGNDTHEALERSLNL
                 70        80        90       100       110       120

130       140       150       160       170       180
    m258.pep SKSALNLAADNALGNAVPVQIDLIGAASLPGDMGRVLEHYAGSGFAQLALYNAASGKIEK
            ||||||||||||||||| :|||||||||||||||||||||||||||||||||||||||||
    a258    SKSALNLAADNALGNAIPVQIDLIGAASLPGDMGRVLEHYAGSGFAQLALYNAASGKIEK
                130       140       150       160       170       180

190       200       210       220       230       240
    m258.pep SINPHKLDQPFPGKARWEKIQRAGSVRDLESIGGVLYAQGWLSAGTHNGRDYALFFRQPV
            |||||||||||||||||||||:||||||||||||||||||||||||||||||||||||||
    a258    SINPHKLDQPFPGKARWEKIQQAGSVRDLESIGGVLYAQGWLSAGTHNGRDYALFFRQPV
                190       200       210       220       230       240

250       260       270       280       290       300
    m258.pep PKGVAEDAVLIEKARAKYAELSYSKKGLQTFFLATLLIASLLSIFLALVMALYFARRFVE
            ||||||||||||||||||||||||||||||||||||||||||||||||||||||||||||
    a258    PKGVAEDAVLIEKARAKYAELSYSKKGLQTFFLATLLIASLLSIFLALVMALYFARRFVE
                250       260       270       280       290       300

310       320       330       340       350       360
    m258.pep PVLSLAEGAKAVAQGDFSQTRPVLRNDEFGRLTKLFNHMTEQLSIAKEADERNRRREEAA
            ||||||||||||||||||||||||||||||||||||||||||||||||||||||||||||
    a258    PVLSLAEGAKAVAQGDFSQTRPVLRNDEFGRLTKLFNHMTEQLSIAKEADERNRRREEAA
                310       320       330       340       350       360

370       380       390       400       410       420
    m258.pep RHYLECVLEGLTTGVVVFDEQGCLKTFNKAAEQILGMPLTPLWGSSRHGWHGVSAQQSLL
            ||||||||||||||||||||||||||||||||||||||||||||||||||||||||||||
    a258    RHYLECVLEGLTTGVVVFDEQGCLKTFNKAAEQILGMPLTPLWGSSRHGWHGVSAQQSLL
                370       380       390       400       410       420
```

```
                430       440       450       460       470       480
m258.pep   AEVFAAIGAAAGTDKPVHVKYAAPDDAKILLGKATVLPEDNGNGVVMVIDDITVLIHAQK
           ||||||||||||||||||||||||||||||||||||||||||||||||||||||||||||
a258       AEVFAAIGAAAGTDKPVHVKYAAPDDAKILLGKATVLPEDNGNGVVMVIDDITVLIHAQK
                430       440       450       460       470       480

490       500       510       520       530       540
m258.pep   EAAWGEVAKRLAHEIRNPLTPIQLSAERXAXKLGGKLDEQDAQILTRSTDTIVKQVAALK
           |||||||||||||||||||||||||||||| | ||||||||||||||||||||:||||||
a258       EAAWGEVAKRLAHEIRNPLTPIQLSAERLAWKLGGKLDEQDAQILTRSTDTIIKQVAALK
                490       500       510       520       530       540

550       560       570       580       589
m258.pep   EMVEAFRNYARSPSLKLENQDLNALIGDVLALYEAGPCRFAADLPANRX
           |||||||||||||||||||||||||||||||||||||||:|
a258       EMVEAFRNYARSPSLKLENQDLNALIGDVLALYEAGPCRFAAELAGEPLMMAADTTAMRQ
                550       560       570       580       590       600 a258       VLHNIFKNAAEAAEEADVPEVRVKSEAGQDGRIVLTVCDNGKGFGREMLHNAFEPYVTDK
                610       620       630       640       650       660
```

The following partial DNA sequence was identified in *N. gonorrhoeae* <SEQ ID 1029>:

```
g259.seq
     1  atgatgatgc acgcttctgt ccaaagtcgt ttcgcaccga tactttatgt
    51  tttgattttc tttgccggtt ttttgaccgc gcaaatctgg ttcaatcaga
   101  aagcctatac tgaagagctg cctccgcttc tgtccgcatt gtccgccgtc
   151  gcgctggtgt ggctggcgtg ggcgttcgtg tcggtgcgtt caaaggctaa
   201  ggcagaaaag ttctaccgcg aaaaaatgat acagaacgaa agcatacacc
   251  ccgtcctgca cgcttctttg caacacttgg aacacaagcc gcaaatgctc
   301  gccctgctgg tcaaaaacca cggcaaaggc atggcggaac aggtcaggtt
   351  caaggcggaa gtgctgcccg acgacgaaga cgcgcgcacg attgccgccg
   401  agttggcaaa aatggatatg ttcgcattgg ggacggacgc ggtcgcctcg
   451  ggcgaaacct atgggcgcgt gttcgccgat attttcgagt tgtcggcggc
   501  tttggaaagg cgcgcgttca aagggatact gaaactgacg gcggaatata
   551  aaaaacatct tcggcgatgc ctgccgttcg gaaacggcgt tggatttggg
   601  cgcgctcaat caggcgttga gggaaatctc gaaaacgccg gaaaagccta
   651  a
```

45

This corresponds to the amino acid sequence <SEQ ID 1030; ORF 259.ng>:

```
g259.pep
     1  MMMHASVQSR FAPILYVLIF FAGFLTAQIW FNQKAYTEEL PPLLSALSAV
    51  ALVWLAWAFV SVRSKAKAEK FYREKMIQNE SIHPVLHASL QHLEHKPQML
   101  ALLVKNHGKG MAEQVRFKAE VLPDDEDART IAAELAKMDM FALGTDAVAS
   151  GETYGRVFAD IFELSAALER RAFKGILKLT AEYKKHLRRC LPFGNGVGFG
   201  RAQSGVEGNL ENAGKA*
```

The following partial DNA sequence was identified in *N. meningitidis* <SEQ ID 1031>:

```
m259.seq (partial)
     1  ATGATGATGC ACGCTTCTGT CCAAAGCCGT TTCGCACCGA TACTTTATGT
    51  TTTGATTTTC TTTGCCGGTT TTTTGACCGC GCAAATCTGG TTCAATCAGA
```

-continued

```
101    AAGCCTATAC TGAAGAGCTG CCTCCGCTTC TGTCCGCATT GTCCGCCGTC

151    GCGCTGGTGT GGCTGGCGTG GGCGTTCGTG TCGGCGCGTT CAAAGGCCAA

201    GGCGGAAAAG TTCTACCGCG AAAAAATGAT ACAGAACGAA AGCATACACC

251    CCGTCsTGCA CGCCTCTTTG CAACACTTGG AACACAAGCC GCAAATACTC

301    GCCCTGCTGG TCAAAAACCA CGGCAAAGGG ATGGCGGAAC AGGTCAGGTT

351    CAAGGCGGAA GTGCTGCCCG ACGACGAAGA CGCGCGCACG ATTGCCGCCG

401    AGTTGGCAAA AATGGATATG TTCGCATTGG GGACkGACGC GGTCGCCTCG

451    GGCGAAACCT ATGGACGCGT GTTCGCCGAT ATTTTCGAGT TGTCGGmGGC

501    TTTGGAAGGG CGCGCGTTCA AAGGAATGTT GAAACTGACG GCGGAATATA

551    AA.AACATCT TCGGmGATGC CTGCCGTTCG GAAACGGCGT TGGAGTTGGG

601    CGCACTCAAT CAGGCGTTGC AGGAGATTTC AAAAACATCC GG..
```

This corresponds to the amino acid sequence <SEQ ID 1032; ORF 259>:

```
m259.pep (partial)
  1    MMMHASVQSR FAPILYVLIF FAGFLTAQIW FNQKAYTEEL PPLLSALSAV

51    ALVWLAWAFV SARSKAKAEK FYREKMIQNE SIHPVXHASL QHLEHKPQIL

101    ALLVKNHGKG MAEQVRFKAE VLPDDEDART IAAELAKMDM FALGTDAVAS

151    GETYGRVFAD IFELSXALEG RAFKGMLKLT AEYKXHLRRC LPFGNGVGVG

201    RTQSGVAGDF KNIR..
```

Computer analysis of this amino acid sequence gave the following results:
Homology with a Predicted ORF from *N. gonorrhoeae*
ORF 259 shows 94.3% identity over a 212 aa overlap with a predicted ORF (ORF 259.ng) from *N. gonorrhoeae*:

```
m259/g259
                 10         20         30         40         50         60
m259.pep  MMMHASVQSRFAPILYVLIFFAGFLTAQIWFNQKAYTEELPPLLSALSAVALVWLAWAFV
          ||||||||||||||||||||||||||||||||||||||||||||||||||||||||||||
g259      MMMHASVQSRFAPILYVLIFFAGFLTAQIWFNQKAYTEELPPLLSALSAVALVWLAWAFV
                 10         20         30         40         50         60

70         80         90        100        110        120
m259.pep  SARSKAKAEKFYREKMIQNESIHPVXHASLQHLEHKPQILALLVKNHGKGMAEQVRFKAE
          |:||||||||||||||||||||||| |||||||||||:||||||||||||||||||||||
g259      SVRSKAKAEKFYREKMIQNESIHPVLHASLQHLEHKPQMLALLVKNHGKGMAEQVRFKAE
                 70         80         90        100        110        120

130        140        150        160        170        180
m259.pep  VLPDDEDARTIAAELAKMDMFALGTDAVASGETYGRVFADIFELSXALEGRAFKGMLKLT
          |||||||||||||||||||||||||||||||||||||||||||||||   ||| :||||
g259      VLPDDEDARTIAAELAKMDMFALGTDAVASGETYGRVFADIFELSAALERRAFKGILKLT
                130        140        150        160        170        180

190        200        210
m259.pep  AEYKKHLRRCLPFGNGVGVGRTQSGVAGDFKNIR
          ||||||||||||||||||| ||:||||  |:::|
g259      AEYKKHLRRCLPFGNGVGFGRAQSGVEGNLENAGKAX
                190        200        210
```

The following partial DNA sequence was identified in *N. meningitidis* <SEQ ID 1033>:

```
a259.seq (partial)
  1    ATGATGATGC ACGCTTCTGT CCAAAGCCGT TTCGCACCGA TACTTTATGT

51    TTTGATTTTC TTTGCCGGTT TTTTGACCGC GCAAATCTGG TTCAATCAGA
```

```
101   AAGCCTATAC TGAAGAGCTG CCTCCGCTTC TGTCCGCATT GTCCGCCGTC

151   GCGCTGGTGT GGCTGGCGTG GGCGTTCGTG TCGGCGCGTT CAAAGGCTAA

201   GGCGGAAAAG TTCTACCGCG AAAAAATGAT ACAGAACGAA AGCATACACC

251   CCGTCCTGCA CGCTTCTTTG CAACACTTGG AACACAAGCC GCAAATGCTC

301   GCCCTGCTGG TCAAAAACCA CGGCAAAGGG ATGGCGGAAC AGGTCAGGTT

351   CAAGGCGGAA GTGCTGCCCG ACGACGAAGA CGCGCGCACG ATTGCCGCCG

401   AGTTGGCAAA AATGGATATG TTTGCATTGG GGACGGACGC GGTCGCCTCG

451   GGCGAAACCT ATGGACGCGT GTTCGCCGAT ATTTTCGAGT TGTCGGCGGC

501   TTTGGAAGGG CGCGCGTTCA AAGGAATGTT GAAACTGACG GCGGAATATA

551   AAAA.CATCT TCGGCGATGC CTGCCGTTCG GAAACGGCGT TGGAGTTGGG

601   CGCGCTCAAT CAGGCGTTGC AGGAGATTTC AAAAACATCG GAAAAGTCCA

651   A
```

This corresponds to the amino acid sequence <SEQ ID 1034; ORF 259.a>:

```
a259.pep (partial)
    1   MMMHASVQSR FAPILYVLIF FAGFLTAQIW FNQKAYTEEL PPLLSALSAV

51   ALVWLAWAFV SARSKAKAEK FYREKMIQNE SIHPVLHASL QHLEHKPQML

101   ALLVKNHGKG MAEQVRFKAE VLPDDEDART IAAELAKMDM FALGTDAVAS

151   GETYGRVFAD IFELSAALEG RAFKGMLKLT AEYKXHLRRC LPFGNGVGVG

201   RAQSGVAGDF KNIGKVQ
``` m259/a259 98.1% identity in 213 aa overlap

```
                   10         20         30         40         50         60
    m259.pep  MMMHASVQSRFAPILYVLIFFAGFLTAQIWFNQKAYTEELPPLLSALSAVALVWLAWAFV
              ||||||||||||||||||||||||||||||||||||||||||||||||||||||||||||
    a259      MMMHASVQSRFAPILYVLIFFAGFLTAQIWFNQKAYTEELPPLLSALSAVALVWLAWAFV
                   10         20         30         40         50         60

70         80         90        100        110        120
    m259.pep  SARSKAKAEKFYREKMIQNESIHPVXHASLQHLEHKPQILALLVKNHGKGMAEQVRFKAE
              |||||||||||||||||||||||||| ||||||||||||:||||||||||||||||||||
    a259      SARSKAKAEKFYREKMIQNESIHPVLHASLQHLEHKPQMLALLVKNHGKGMAEQVRFKAE
                   70         80         90        100        110        120

130        140        150        160        170        180
    m259.pep  VLPDDEDARTIAAELAKMDMFALGTDAVASGETYGRVFADIFELSXALEGRAFKGMLKLT
              ||||||||||||||||||||||||||||||||||||||||||||||||||||||||||||
    a259      VLPDDEDARTIAAELAKMDMFALGTDAVASGETYGRVFADIFELSXALEGRAFKGMLKLT
                  130        140        150        160        170        180

190        200        210
    m259.pep  AEYKXHLRRCLPFGNGVGVGRTQSGVAGDFKNIR
              ||||||||||||||||||||||:|||||||||||
    a259      AEYKXHLRRCLPFGNGVGVGRAQSGVAGDFKNIGKVQ
                  190        200        210
```

55

The following partial DNA sequence was identified in *N. gonorrhoeae* <SEQ ID 1035>:

```
g259-1.seq
    1      ATGATGATGC ACGCTTCTGT CCAAAGTCGT TTCGCACCGA TACTTTATGT

51      TTTGATTTTC TTTGCCGGTT TTTTGACCGC GCAAATCTGG TTCAATCAGA

101      AAGCCTATAC TGAAGAGCTG CCTCCGCTTC TGTCCGCATT GTCCGCCGTC

151      GCGCTGGTGT GGCTGGCGTG GGCGTTCGTG TCGGTGCGTT CAAAGGCTAA
```

```
       201   GGCAGAAAAG TTCTACCGCG AAAAAATGAT ACAGAACGAA AGCATACACC

251   CCGTCCTGCA CGCTTCTTTG CAACACTTGG AACACAAGCC GCAAATGCTC

301   GCCCTGCTGG TCAAAAACCA CGGCAAAGGC ATGGCGGAAC AGGTCAGGTT

351   CAAGGCGGAA GTGCTGCCCG ACGACGAAGA CGCGCGCACG ATTGCCGCCG

401   AGTTGGCAAA AATGGATATG TTCGCATTGG GGACGGACGC GGTCGCCTCG

451   GGCGAAACCT ATGGGCGCGT GTTCGCCGAT ATTTTCGAGT TGTCGGCGGC

501   TTTGGAA
```

This corresponds to the amino acid sequence <SEQ ID 1036; ORF 259-1.ng>:

```
g259-1.pep
         1   MMMHASVQSR FAPILYVLIF FAGFLTAQIW FNQKAYTEEL PPLLSALSAV

51   ALVWLAWAFV SVRSKAKAEK FYREKMIQNE SIHPVLHASL QHLEHKPQML

101   ALLVKNHGKG MAEQVRFKAE VLPDDEDART IAAELAKMDM FALGTDAVAS

151   GETYGRVFAD IFELSAALE
```

The following partial DNA sequence was identified in *N. meningitidis* <SEQ ID 1037>:

```
m259-1.seq
         1   ATGATGATGC ACGCTTCTGT CCAAAGCCGT TTCGCACCGA TACTTTATGT

51   TTTGATTTTC TTTGCCGGTT TTTTGACCGC GCAAATCTGG TTCAATCAGA

101   AAGCCTATAC TGAAGAGCTG CCTCCGCTTC TGTCCGCATT GTCCGCCGTC

151   GCGCTGGTGT GGCTGGCGTG GGCGTTCGTG TCGGCGCGTT CAAAGGCCAA

201   GGCGGAAAAG TTCTACCGCG AAAAAATGAT ACAGAACGAA AGCATACACC

251   CCGTCCTGCA CGCCTCTTTG CAACACTTGG AACACAAGCC GCAAATACTC

301   GCCCTGCTGG TCAAAAACCA CGGCAAAGGG ATGGCGGAAC AGGTCAGGTT

351   CAAGGCGGAA GTGCTGCCCG ACGACGAAGA CGCGCGCACG ATTGCCGCCG

401   AGTTGGCAAA AATGGATATG TTCGCATTGG GGACGGACGC GGTCGCCTCG

451   GGCGAAACCT ATGGACGCGT GTTCGCCGAT ATTTTCGAGT TGTCGGCGGC

501   TTTGGAAGGG CGCGCGTTCA AAGGAATGTT GAAACTGACG GCGGAATATA

551   AAAACATCTT CGGCGATGCC TGCCGTTCGG AAACGGCGTT GGAGTTGGGC

601   GCACTCAATC AGGCGTTGCA GGAGATTTCA AAAACATCGG AAAAGTCCAA

651   ACGGATATTT TATTGA
```

This corresponds to the amino acid sequence <SEQ ID 1038; ORF 259-1>:

```
m259-1.pep
         1   MMMHASVQSR FAPILYVLIF FAGFLTAQIW FNQKAYTEEL PPLLSALSAV

51   ALVWLAWAFV SARSKAKAEK FYREKMIQNE SIHPVLHASL QHLEHKPQIL

101   ALLVKNHGKG MAEQVRFKAE VLPDDEDART IAAELAKMDM FALGTDAVAS

151   GETYGRVFAD IFELSAALEG RAFKGMLKLT AEYKNIFGDA CRSETALELG

201   ALNQALQEIS KTSEKSKRIF Y*
``` g259-1/m259-1 98.8% identity in 169 aa overlap

```
                      10        20        30        40        50        60
g259-1.pep    MMMHASVQSRFAPILYVLIFFAGFLTAQIWFNQKAYTEELPPLLSALSAVALVWLAWAFV
              ||||||||||||||||||||||||||||||||||||||||||||||||||||||||||||
m259-1        MMMHASVQSRFAPILYVLIFFAGFLTAQIWFNQKAYTEELPPLLSALSAVALVWLAWAFV
                      10        20        30        40        50        60

70        80        90       100       110       120
g259-1.pep    SVRSKAKAEKFYREKMIQNESIHPVLHASLQHLEHKPQMLALLVKNHGKGMAEQVRFKAE
              |:|||||||||||||||||||||||||||||||||||||:||||||||||||||||||||
m259-1        SARSKAKAEKFYREKMIQNESIHPVLHASLQHLEHKPQILALLVKNHGKGMAEQVRFKAE
                      70        80        90       100       110       120

130       140       150       160      169
g259-1.pep    VLPDDEDARTIAAELAKMDMFALGTDAVASGETYGRVFADIFELSAALE
              |||||||||||||||||||||||||||||||||||||||||||||||||
m259-1        VLPDDEDARTIAAELAKMDMFALGTDAVASGETYGRVFADIFELSAALEGRAFKGMLKLT
                     130       140       150       160       170       180
```

The following partial DNA sequence was identified in *N. meningitidis* <SEQ ID 1039>:

```
a259-1.seq
      1    ATGATGATGC ACGCTTCTGT CCAAAGCCGT TTCGCACCGA TACTTTATGT

51    TTTGATTTTC TTTGCCGGTT TTTTGACCGC GCAAATCTGG TTCAATCAGA

101    AAGCCTATAC TGAAGAGCTG CCTCCGCTTC TGTCCGCATT GTCCGCCGTC

151    GCGCTGGTGT GGCTGGCGTG GGCGTTCGTG TCGGCGCGTT CAAAGGCTAA

201    GGCGGAAAAG TTCTACCGCG AAAAAATGAT ACAGAACGAA AGCATACACC

251    CCGTCCTGCA CGCTTCTTTG CAACACTTGG AACACAAGCC GCAAATGCTC

301    GCCCTGCTGG TCAAAAACCA CGGCAAAGGG ATGGCGGAAC AGGTCAGGTT

351    CAAGGCGGAA GTGCTGCCCG ACGACGAAGA CGCGCGCACG ATTGCCGCCG

401    AGTTGGCAAA AATGGATATG TTTGCATTGG GGACGGACGC GGTCGCCTCG

451    GGCGAAACCT ATGGACGCGT GTTCGCCGAT ATTTTCGAGT TGTCGGCGGC

501    TTTGGAAGGG CGCGCGTTCA AAGGAATGTT GAAACTGACG GCGGAATATA

551    AAAACATCTT CGGCGATGCC TGCCGTTCGG AAACGGCGTT GGAGTTGGGC

601    GCGCTCAATC AGGCGTTGCA GGAGATTTCA AAAACATCGG AAAAGTCCAA

651    ACGGATATTT TATTGA
```

This corresponds to the amino acid sequence <SEQ ID 1040; ORF 259-1.a>:

```
a259-1.pep
      1    MMMHASVQSR FAPILYVLIF FAGFLTAQIW FNQKAYTEEL PPLLSALSAV

51    ALVWLAWAFV SARSKAKAEK FYREKMIQNE SIHPVLHASL QHLEHKPQML

101    ALLVKNHGKG MAEQVRFKAE VLPDDEDART IAAELAKMDM FALGTDAVAS

151    GETYGRVFAD IFELSAALEG RAFKGMLKLT AEYKNIFGDA CRSETALELG

201    ALNQALQEIS KTSEKSKRIF Y*
``` a259-1/m259-1 99.5% identity in 221 aa overlap

```
                      10        20        30        40        50        60
a259-1.pep    MMMHASVQSRFAPILYVLIFFAGFLTAQIWFNQKAYTEELPPLLSALSAVALVWLAWAFV
              ||||||||||||||||||||||||||||||||||||||||||||||||||||||||||||
m259-1        MMMHASVQSRFAPILYVLIFFAGFLTAQIWFNQKAYTEELPPLLSALSAVALVWLAWAFV
                      10        20        30        40        50        60
```

```
                 70         80         90        100        110        120
a259-1.pep  SARSKAKAEKFYREKMIQNESIHPVLHASLQHLEHKPQMLALLVKNHGKGMAEQVRFKAE
            |||||||||||||||||||||||||||||||||||| :|||||||||||||||||||||
m259-1      SARSKAKAEKFYREKMIQNESIHPVLHASLQHLEHKPQILALLVKNHGKGMAEQVRFKAE
                 70         80         90        100        110        120

130        140        150        160        170        180
a259-1.pep  VLPDDEDARTIAAELAKMDMFALGTDAVASGETYGRVFADIFELSAALEGRAFKGMLKLT
            ||||||||||||||||||||||||||||||||||||||||||||||||||||||||||| 
m259-1      VLPDDEDARTIAAELAKMDMFALGTDAVASGETYGRVFADIFELSAALEGRAFKGMLKLT
                130        140        150        160        170        180

190        200        210        220
a259-1.pep  AEYKNIFGDACRSETALELGALNQALQEISKTSEKSKRIFYX
            |||||||||||||||||||||||||||||||||||||||||
m259-1      AEYKNIFGDACRSETALELGALNQALQEISKTSEKSKRIFYX
                190        200        210        220
```

The following partial DNA sequence was identified in *N. gonorrhoeae* <SEQ ID 1041>:

```
g260.seq
     1    atgggtgcgg gtgtagtatt cgttgtcttt cagccgttct tcagcctgtt
    51    tcgagcgttg ttcgagggcg gagtcggtat agtcgaggga gcgcacgatg
   101    ccgctgaatg cgacttcttg tccgaggaat ttacccgtat ccggatcggt
   151    gatgttttta ttgattcggt aggtcagata acggcccggt tctttcaggc
   201    ctttggtgta aaccctggcg cctttggtgt acagcagcct gccttccggg
   251    cccgagagca ggcgcggcgc ggcagcggtt tctttgcggg aaacgatttg
   301    cgggtgctgc ataaagacgc ggtagaagtt gacatcgatg gcgggaatac
   351    cgtatccgga cacttcctta tccggactga ttttgacgac ggggatgccg
   401    tctgtctgtt ccaagccgag gcgcggttcg ccgccaacgt agcgcaacac
   451    caatacctgg cccgdataaa tcaggtcggg attgtggatt tgatcccggt
   501    tcgcgcccca caggggggga ccattgccac gggctgtaca ggtatttgcc
   551    cgaaataccc cacagggtgt cgccctgttt ga
```

This corresponds to the amino acid sequence <SEQ ID 1042; ORF 260.ng>:

```
g260.pep
     1    MGAGVVFVVF QPFFSLFRAL FEGGVGIVEG AHDAAECDFL SEEFTRIRIG
    51    DVFIDSVGQI TARFFQAFGV NPGAFGVQQP AFRAREQARR GSGFFAGNDL
   101    RVLHKDAVEV DIDGGNTVSG HFLIRTDFDD GDAVCLFQAE ARFAANVAQH
   151    QYLARINQVG IVDLIPVRAP QGGTIATGCT GICPKYPTGC RPV*
```

The following partial DNA sequence was identified in *N. meningitidis* <SEQ ID 1043>:

```
m260.seq
     1    ATGGGTGCGG GTATGGTATT CGTTGTCTTT CGGCCGTTCT CCAGCCTGTT
    51    TCGAGCGTTG TTCGAGGACA GAGTCGGTAT AGTCGAGGGA GCGCACGATG
   101    CCGCTGAATG CGACTTCCTG CCCGAGGAAT TTACCCGTAT CCGGATCGGT
   151    GATGTTTTTA TTGATTCGGT AGGTCAGGTA GCGGCCCGGC TCTTTCAGGC
   201    CTTTGGTGTA AACCCTGGTG CCTTTGGTGT ACAGCAGCCT GCCTTCCGGG
   251    CCCGAGwrCA sGCGCGGyGC GGCAGCGGTT TCTTTGCGGG AAACGATTTG
   301    CGGATGCCGC ATAAAGATGC GGTAGAAGTT GACATCGATG GCGGGAATAC
```

-continued

```
351    CGTATCCGGA CACTTCCTTA TCCGGACTCA TTTTGACGAC GGGGATGCCG

401    TCTGTCTGTT CCAAGCCGAG GCGCGGTTCG CCGTCAACGT GGCGCAACAC

451    CAATACCTGG TCCGGATAAA TCAGGTCGGG ATTGTGGATT TGATCCCGGT

501    TCGCGTyCCA CAG
```

This corresponds to the amino acid sequence <SEQ ID 1044; ORF 260>:

```
m260.pep
    1   MGAGMVFVVF RPFSSLFRAL FEDRVGIVEG AHDAAECDFL PEEFTRIRIG

51   DVFIDSVGQV AARLFQAFGV NPGAFGVQQP AFRARXXARX GSGFFAGNDL

101   RMPHKDAVEV DIDGGNTVSG HFLIRTHFDD GDAVCLFQAE ARFAVNVAQH

151   QYLVRINQVG IVDLIPVRVP Q
```

Computer analysis of this amino acid sequence gave the following results:
Homology with a Predicted ORF from *N. gonorrhoeae*
ORF 260 shows 89.5% identity over a 171 aa overlap with a predicted ORF (ORF 260.ng) from *N. gonorrhoeae*:

```
m260/g260
                    10         20         30         40         50         60
    m260.pep  MGAGMVFVVFRPFSSLFRALFEDRVGIVEGAHDAAECDFLPEEFTRIRIGDVFIDSVGQV
              ||||:||||||:|| ||||||||| ||||||||||||||| |||||||||||||||||||:
        g260  MGAGVVFVVFQPFFSLFRALFEGGVGIVEGAHDAAECDFLSEEFTRIRIGDVFIDSVGQI
                    10         20         30         40         50         60

70         80         90        100        110        120
    m260.pep  AARLFQAFGVNPGAFGVQQPAFRARXXARXGSGFFAGNDLRMPHKDAVEVDIDGGNTVSG
              :||:||||||||||||||||||||||   || |||||||||:||||||||||||||||||
        g260  TARFFQAFGVNPGAFGVQQPAFRAREQARRGSGFFAGNDLRVLHKDAVEVDIDGGNTVSG
                    70         80         90        100        110        120

130        140        150        160        170
    m260.pep  HFLIRTHFDDGDAVCLFQAEARFAVNVAQHQYLVRINQVGIVDLIPVRVPQ
              ||||||:|||||||||||||||||:||||||||:|||||||||||||||:||
        g260  HFLIRTDFDDGDAVCLFQAEARFAANVAQHQYLARINQVGIVDLIPVRAPQGGTIATGCT
                   130        140        150        160        170 g260  GICPKYPTGCRPV
                   190
```

The following partial DNA sequence was identified in *N. meningitidis* <SEQ ID 1039>:

```
a260.seq
    1   ATGGGTGCGG GTATGGTATT CGTTGTCTTT CGGCCGTTCT CCAGCCTGTT

51   TCGAGCGTTG TTCGAGGACA GAGTCGGTAT AGTCGAGGGA GCGCACGATG

101   CCGCTGAATG CGACTTCCTG CCCGAGGAAT TTACCCGTAT CCGGATCGGT

151   GATGTTTTTA TTGATTCGGT AGGTCAGGTA GCGGCCCGGC TCTTTCAGGC

201   CTTTGGTGTA AACCCTGGTG CCTTTGGTGT ACAGCAGCCT GCCTTCCGGG

251   CCCGAGAGCA GGCGCGGCGC GGCAGCGGTT CTTTGCGGG AAACGATTTG

301   CGGGTGCCGC ATAAAGATGC GGTAGAAGTT GACATCGATG GCGGGAATAC

351   CGTATCCGGA CACTTCCTTA TCCGGACTCA TTTTGACGAC GGGGATGCCG

401   TCTGTCTGTT CCAAGCCGAG GCGCGGTTCG CCGTCAACGT GGCGCAACAC

451   CAATACCTGG TCCAGATAAA TCAGGTCGGG ATTGTGGATT TGATCCCGGT
```

-continued
```
501  TCGCGTCCCA CAGGCGGCC. CCATTGCCAC GGGCTGTACA GGTATTTGCC

551  CGAAATGCCC CACAGGGTGT CGCCCTGTTT GA
```

This corresponds to the amino acid sequence <SEQ ID 1046; ORF 260.a>:

```
a260.pep
   1  MGAGMVFVVF RPFSSLFRAL FEDRVGIVEG AHDAAECDFL PEEFTRIRIG

51  DVFIDSVGQV AARLFQAFGV NPGAFGVQQP AFRAREQARR GSGFFAGNDL

101  RVPHKDAVEV DIDGGNTVSG HFLIRTHFDD GDAVCLFQAE ARFAVNVAQH

151  QYLVQINQVG IVDLIPVRVP QAAXIATGCT GICPKCPTGC RPV*
``` m260/a260 97.1% identity in 171 aa overlap

```
                 10         20         30         40         50         60
   m260.pep  MGAGMVFVVFRPFSSLFRALFEDRVGIVEGAHDAAECDFLPEEFTRIRIGDVFIDSVGQV
             ||||||||||||||||||||||||||||||||||||||||||||||||||||||||||||
   a260      MGAGMVFVVFRPFSSLFRALFEDRVGIVEGAHDAAECDFLPEEFTRIRIGDVFIDSVGQV
                 10         20         30         40         50         60

70         80         90        100        110        120
   m260.pep  AARLFQAFGVNPGAFGVQQPAFRARXXARXGSGFFAGNDLRMPHKDAVEVDIDGGNTVSG
             |||||||||||||||||||||||||  || ||||||||||||:|||||||||||||||||
   a260      AARLFQAFGVNPGAFGVQQPAFRAREQARRGSGFFAGNDLRVPHKDAVEVDIDGGNTVSG
                 70         80         90        100        110        120

130        140        150        160        170
   m260.pep  HFLIRTHFDDGDAVCLFQAEARFAVNVAQHQYLVRINQVGIVDLIPVRVPQ
             |||||||||||||||||||||||||||||||||||:|||||||||||||||
   a260      HFLIRTHFDDGDAVCLFQAEARFAVNVAQHQYLVQINQVGIVDLIPVRVPQAAXIATGCT
                130        140        150        160        170        180 a260      GICPKCPTGCRPVX
                190
```

The following partial DNA sequence was identified in *N. gonorrhoeae* <SEQ ID 1047>:

```
g261.seq
   1  atggagcttg ggcatatcgt attccttgtg ctttgcgcgc gttcagacgg 51  cctttttact ttccagacat tccgccagcc cgcgttcgcg caagatacag 101  ctcgggcatt cgcggcagcc gccgacgata cccttgtagc aggtgtgggt 151  ctgttcgcgg atgtagtcca acacgcccat ttcgtccgcc aacgcccacg 201  tttgcgcctt ggtcaggtac atcagcggcg tgtggatttg aaaatcgtag 251  tccatcgcca gattaagggt aacgttcatg gatttgacga acacgccgcg 301  gcagtcggga tagcccgaaa aatcggtttc gcacacgccc gcgatgatgt 351  gccggatacc ctgcccttttg gcaaaaatgg cggcgtaaag caggaaaagc 401  gcgttacgcc cgtccacaaa ggtattggga acgccgttgt cggcggtttc 451  gatggcggcg gtttcgatgg cggcggtttc gtccatcagg gcgttgtgcg 501  taatctgccg catcaggctc aaatcgagta cggtttgact gacacccaaa 551  tcctgcgcga tccactctgc gcgttccagc tcgacggcat ggcgttgccc 601  gtatcggaag gtgatggctt ggacgttttc gcgcccgtag gtttggattg 651  cctgaatcag gcaggtggtc gaatcctgac cgcccgagaa gatgaccaag 701  gcttttttggt ttga
```

This corresponds to the amino acid sequence <SEQ ID 1048; ORF 261.ng>:

```
g261.pep
     1  MELGHIVFLV LCARSDGLFT FQTFRQPAFA QDTARAFAAA ADDTLVAGVG

51  LFADVVQHAH FVRQRPRLRL GQVHQRRVDL KIVVHRQIKG NVHGFDEHAA

101  AVGIARKIGF AHARDDVPDT LPFGKNGGVK QEKRVTPVHK GIGNAVVGGF

151  DGGGFDGGGF VHQGVVRNLP HQAQIEYGLT DTQILRDPLC AFQLDGMALP

201  VSEGDGLDVF APVGLDCLNQ AGGRILTARE DDQGFLV*
```

The following partial DNA sequence was identified in *N. meningitidis* <SEQ ID 1049>:

```
m261.seq
     1  ATGGAGCTTG GGCATATCGT ATTCCTTATG GTTTGCGCGT GTTCAGACGG

51  CCTTTTTACT TTCCAGATAT TCCGCCAGCC cGcGTTCGCG CAAGATACAG

101  CTCGGGCATT CGCGgCAGCC GCCGACGATG CCGTTATAGC AGGTGTGGGT

151  TTGCTCGCGG ATATAGTCCA GCACGCCCAT TTCGTCCGCC AACGCCCACG

201  TTTGCGCCTT GGTCAGATAC ATCAGCGGCG TGTGGATTTG AAAATCATAG

251  TCCATCGCCA AATTAAGGGT AACGTTCATC GATTTGACAA ACACGTCGCG

301  GCAGTCGGGA TAGCCGGAGA AGTCGGTTTC GCACACGCCC GCGATGATGT

351  GCCGTATCCC CTGCCCTTTG GCGTAAATCG CGGCATAGAG CAGGAAAAGC 401  gCGTTGCGGC CGTCTACAAA GGTATTCGGA ACGCCGTTTT CGGCAGTTTC

451  GATGGCGGCG GTGTCGTCCA TCAGGGCATT GTGCGTAATC TGCCGCATCA

501  GgCTcAAGTC GAGTACGGTT TGTTTGACGC CCAAATCCTG CGCAATCCAG

551  CGGGCACGTT CCAGCTCGAC GGCATGGCGT TGCCCGTATT GGAAAGTAAT

601  GGCTTGGACG TTTTCGCGCC CGTAGGTTTG GATTGCCTGA ATCAGGCAGG

651  TGGTCGAATC CTGACCGCCC GAAAAGATGA CCAAGGCTTG TTGGTTTGA
```

This corresponds to the amino acid sequence <SEQ ID 1050; ORF 261>:

```
m261.pep
     1  MELGHIVFLM VCACSDGLFT FQIFRQPAFA QDTARAFAAA ADDAVIAGVG

51  LLADIVQHAH FVRQRPRLRL GQIHQRRVDL KIIVHRQIKG NVHRFDKHVA

101  AVGIAGEVGF AHARDDVPYP LPFGVNRGIE QEKRVAAVYK GIRNAVFGSF

151  DGGGVVHQGI VRNLPHQAQV EYGLFDAQIL RNPAGTFQLD GMALPVLESN

201  GLDVFAPVGL DCLNQAGGRI LTARKDDQGL LV*
```

Computer analysis of this amino acid sequence gave the following results:

Homology with a Predicted ORF from *N. gonorrhoeae*

ORF 261 shows 79.7% identity over a 237 aa overlap with a predicted ORF (ORF 261.ng) from *N. gonorrhoeae*:

```
m261/g261
                   10        20        30        40        50        60
m261.pep  MELGHIVFLMVCACSDGLFTFQIFRQPAFAQDTARAFAAAADDAVIAGVGLLADIVQHAH
          |||||||||::|| ||||||| ||||||||||||||||||||:::|||||:||:|||||
g261      MELGHIVFLVLCARSDGLFTFQTFRQPAFAQDTARAFAAAADDTLVAGVGLFADVVQHAH
                   10        20        30        40        50        60
```

-continued

```
                  70         80         90        100        110        120
m261.pep   FVRQRPRLRLGQIHQRRVDLKIIVHRQIKGNVHRFDKHVAAVGIAGEVGFAHARDDVPYP
           ||||||||||||:||||||||||:|||||||||||::|||||   ::|||||||||||
g261       FVRQRPRLRLGQVHQRRVDLKIVVHRQIKGNVHGFDEHAAAVGIARKIGFAHARDDVPDT
                  70         80         90        100        110        120

130        140        150        160        170
m261.pep   LPFGVNRGIEQEKRVAAVYKGIRNAVFGSFDGGGV-----VHQGIVRNLPHQAQVEYGLF
           ||||  |  |:|||||:  |:|||   |:|||||      ||||:||||||||:||||
g261       LPFGKNGGVKQEKRVTPVHKGIGNAVVGGFDGGGFDGGGFVHQGVVRNLPHQAQIEYGLT
                  130        140        150        160        170        180

180        190        200        210        220        230
m261.pep   DAQILRNPAGTFQLDGMALPVLESNGLDVFAPVGLDCLNQAGGRILTARKDDQGLLVX
           |:||||:  :||||||||||||: :|||||||||||||||||||||||:|||||:|||
g261       DTQILRDPLCAFQLDGMALPVSEGDGLDVFAPVGLDCLNQAGGRILTAREDDQGFLVX
                  190        200        210        220        230
```

15

The following partial DNA sequence was identified in *N. meningitidis* <SEQ ID 1051>:

```
a261.seq
     1   ATGGAGCTTG GGCATATCGT ATTCCTTATG GTTTGCGCGT GTTCAGACGG

51   CCTTTTTACT TTCCAGATAT TCCGCCAGCC CGCGTTCGCG CAAGATACAG

101   CTCGGGCATT CGCGGCAGCC GCCGACGATG CCGTTATAGC AGGTGTGGGT

151   TTGCTCGCGG ATATAGTCCA GCGCGCCCAT TTCGTCCGCC AACGCCCAAG

201   TTTGCGCCTT GGTCAGATAC ATCAGCGGCG TGTGGATTTG AAAATCATAG

251   TCCATCGCCA GATTAAGGGT AACGTTCATG GATTTGACAA ACACGTCACG

301   GCAGTCGGGA TAGCCGGAGA AGTCGGTTTC GCACACGCCC GCGATGATGT

351   GCCGTATCCC CTGCCCTTTG GCGTAAATCG CGGCATAGAG CAGGAAAAGC

401   GCGTTGCGGC CGTCTACAAA GGTATTCGGA ACGCCGTTTT CGGCAGTTTC

451   GATGGCGGCG GTGTCGTCCA TCAGGGCATT GTGCGTAATC TGCCGCATCA

501   GGCTCAAGTC GAGTACGGTT TGTTTGACGC CCAAATCCTG CGCAATCCAG

551   CGGGCACGTT CCAGCTCGAC GGCATGGCGT TGCCCGTATT GGAAAGTAAT

601   GGCTTGGACG TTTTCGCGCC CGTAGGTTTG GATTGCCTGA ATCAGGCAGG

651   TGGTCGAATC CTGACCGCCC GAAAAGATGA CCAAGGCTTT TTGGTTTGA
```

This corresponds to the amino acid sequence <SEQ ID 1052; ORF 261.a>:

```
a261.pep
     1   MELGHIVFLM VCACSDGLFT FQIFRQPAFA QDTARAFAAA ADDAVIAGVG

51   LLADIVQRAH FVRQRPSLRL GQIHQRRVDL KIIVHRQIKG NVHGFDKHVT

101   AVGIAGEVGF AHARDDVPYP LPFGVNRGIE QEKRVAAVYK GIRNAVFGSF

151   DGGGVVHQGI VRNLPHQAQV EYGLFDAQIL RNPAGTFQLD GMALPVLESN

201   GLDVFAPVGL DCLNQAGGRI LTARKDDQGF LV*
``` m261/a261 97.8% identity in 232 aa overlap

```
                  10         20         30         40         50         60
m261.pep   MELGHIVFLMVCACSDGLFTFQIFRQPAFAQDTARAFAAAADDAVIAGVGLLADIVQHAH
           ||||||||||||||||||||||||||||||||||||||||||||||||||||||||:||
a261       MELGHIVFLMVCACSDGLFTFQIFRQPAFAQDTARAFAAAADDAVIAGVGLLADIVQRAH
                  10         20         30         40         50         60
```

-continued

```
               70         80         90        100        110        120
m261.pep  FVRQRPRLRLGQIHQRRVDLKIIVHRQIKGNVHRFDKHVAAVGIAGEVGFAHARDDVPYP
          ||||||  |||||||||||||||||||||||||||| |||||:|||||||||||||||||||
a261      FVRQRPSLRLGQIHQRRVDLKIIVHRQIKGNVHGFDKHVTAVGIAGEVGFAHARDDVPYP
               70         80         90        100        110        120

130        140        150        160        170        180
m261.pep  LPFGVNRGIEQEKRVAAVYKGIRNAVFGSFDGGGVVHQGIVRNLPHQAQVEYGLFDAQIL
          ||||||||||||||||||||||||||||||||||||||||||||||||||||||||||||
a261      LPFGVNRGIEQEKRVAAVYKGIRNAVFGSFDGGGVVHQGIVRNLPHQAQVEYGLFDAQIL
              130        140        150        160        170        180

190        200        210        220        230
m261.pep  RNPAGTFQLDGMALPVLESNGLDVFAPVGLDCLNQAGGRILTARKDDQGLLVX
          |||||||||||||||||||||||||||||||||||||||||||||||:|||
a261      RNPAGTFQLDGMALPVLESNGLDVFAPVGLDCLNQAGGRILTARKDDQGFLVX
              190        200        210        220        230
```

The following partial DNA sequence was identified in *N. gonorrhoeae* <SEQ ID 1053>:

```
g263.seq
    1  atggcacgtt taaccgtaca caccctcgaa accgcccccg aagccgccaa 51  accgcgcgta gaggccgtac ccaaaaacaa cggctttatc cccaacctca 101  tcggcgtatt ggcaaacgcc cccgaagctt ggcgttttta ccaagaagtc 151  ggcaagctca acgccgccaa cagcctgacc gccggcgaag tcgaagtgat 201  ccggatcatc gccgtccgca ccaaccaatg cagcttctgc gtggcagggc 251  acaccaaact cgcaaccctg aaaaaactcc tgtccgagca atccctcaat 301  gccgcccgcg ctttggcggc aggtaaatct gacgatgcca aactcggcgc 351  gcttgccgcc ttcacccaag ccgtaatggc gaaaaaaggc gcagtatccg 401  acgacgaact caacgccttc ctcgaagcgg gctacaaccg gcagcaggca 451  gtcgaagtcg taatgggcgt agccttggca actttgtgca actacgccaa 501  caacctcgcc caaaccgaaa tcaaccccaa attgcaggca tacgcctaa
                                                          40
```

This corresponds to the amino acid sequence <SEQ ID 1054; ORF 263.ng>:

```
g263.pep
    1  MARLTVHTLE TAPEAAKPRV EAVPKNNGFI PNLIGVLANA PEALAFYQEV

51  GKLNAANSLT AGEVEVIRII AVRTNQCSFC VAGHTKLATL KKLLSEQSLN

101  AARALAAGKS DDAKLGALAA FTQAVMAKKG AVSDDELNAF LEAGYNRQQA

151  VEVVMGVALA TLCNYANNLA QTEINPKLQA YA*
```

The following partial DNA sequence was identified in *N. meningitidis* <SEQ ID 1055>:

```
m263.seq (partial)
    1  ..GCAGCAGGCG AATTTGACGA TGCCAAACTC GGCGCGCTCG CCGCCTTCAC

51     CCAAGCCGTA ATGGCGAAAA AAGGCGCGGT ATCCGACGAG GAACTCAAAG

101     CATTTTTCGA TGCGGGCTAC AACCAGCAGC AGGCAGTCGA AGTCGTGATG

151     GGCGT.AsyC TgGCAACCCT GTGCAACTAC GTCAACAACC TCGGACAAAC

201     CGAAATCAAC CCCGAATTGC AGGCTTACGC CTGA
```

This corresponds to the amino acid sequence <SEQ ID 1056; ORF 263>:

```
m263.pep (partial)
    1     ..GCAGCAGGCG AATTTGACGA TGCCAAACTC GGCGCGCTCG CCGCCTTCAC

51     CCAAGCCGTA ATGGCGAAAA AAGGCGCGGT ATCCGACGAG GAACTCAAAG

101     CATTTTTCGA TGCGGGCTAC AACCAGCAGC AGGCAGTCGA AGTCGTGATG

151     GGCGT.AsyC TgGCAACCCT GTGCAACTAC GTCAACAACC TCGGACAAAC

201     CGAAATCAAC CCCGAATTGC AGGCTTACGC CTGA
```

Computer analysis of this amino acid sequence gave the following results:
Homology with a Predicted ORF from *N. gonorrhoeae*
ORF 263 shows 85.7% identity over a 77 aa overlap with a predicted ORF (ORF 263.ng) from *N. gonorrhoeae*:

```
    m263/g263
                                                     10         20         30
         m263.pep                              AAGEFDDAKLGALAAFTQAVMAKKGAVSDE
                                               |||: ||||||||||||||||||||||||:
         g263       QCSFCVAGHTKLATLKKLLLSEQSLNAARALAAGKSDDAKLGALAAFTQAVMAKKGAVSDD
                    80         90        100        110        120        130
                        40         50         60         70
         m263.pep   ELKAFFDAGYNQQQAVEVVMGVXLATLCNYVNNLGQTEINPELQAYAX
                    ||:||::||||:|||||||||| |||||||:|||:||||||:||||||
         g263       ELNAFLEAGYNRQQAVEVVMGVALATLCNYANNLAQTEINPKLQAYAX
                    140        150        160        170        180
```

The following partial DNA sequence was identified in *N. meningitidis* <SEQ ID 1057>:

```
a263.seq
    1     ATGGCACGTT TAACCGTACA CACCCTCGAA ACCGCCCCCG AAGCCGCCAA

51     AGCGCGCGTC GAGGCGGTAC TTCAAAACAA CGGCTTTATC CCCAACCTTA

101     TCGGCGTATT ATCAAACGCC CCCGAAGCCT GGCGTTTTA CCAAGAAGTC

151     GGCAAGCTCA ACGCCGCCAA CAGCCTGACC GCCGGCGAAG TCGAAGTAAT

201     CCAGATTATT GCCGCCCGCA CCAACCAATG CGGCTTCTGC GTGGCAGGGC

251     ACACCAAACT CGCAACCCTG AAAAAACTCC TTTCCGAACA ATCCGTCAAA

301     GCCGCGCGCG CTTTGGCGGC AGGCGAATTT GACGATGCTA AACTCGGCGC

351     GCTCGCCGCC TTTACCCAAG CCGTAATGGC AAAAAAAGGC GCGGTATCCG

401     ACGAGGAACT CAAAGCATTT TTTGATGCGG GCTACAACCA GCAGCAGGCA

451     GTCGAAGTCG TGATGGGCGT AGCCTTGGCA ACTTTGTGCA ACTACGTCAA

501     CAACCTCGGA CAAACCGAAA TCAACCCCGA ATTGCAGGCT TACGCCTGA
                                                              55
```

This corresponds to the amino acid sequence <SEQ ID 1058; ORF 263.a>:

```
a263.pep
    1     MARLTVHTLE TAPEAAKARV EAVLQNNGFI PNLIGVLSNA PEALAFYQEV

51     GKLNAANSLT AGEVEVIQII AARTNQCGFC VAGHTKLATL KKLLSEQSVK

101     AARALAAGEF DDAKLGALAA FTQAVMAKKG AVSDEELKAF FDAGYNQQQA

151     VEVVMGVALA TLCNYVNNLG QTEINPELQA YA*
``` m263/a263 97.4% identity in 77 aa overlap

```
                                  10        20        30
m263.pep                  AAGEFDDAKLGALAAFTQAVMAKKGAVSDE
                          |||||||||||||||||||||||||||||
a263     QCGFCVAGHTKLATLKKLLSEQSVKAARALAAGEFDDAKLGALAAFTQAVMAKKGAVSDE
             80        90       100       110       120       130

40        50        60        70
m263.pep ELKAFFDAGYNQQQAVEVVMGXXLATLCNYVNNLGQTEINPELQAYAX
         |||||||||||||||||||||||  |||||||||||||||||||||||
a263     ELKAFFDAGYNQQQAVEVVMGVALATLCNYVNNLGQTEINPELQAYAX
             140       150       160       170       180
```

The following partial DNA sequence was identified in *N. gonorrhoeae* <SEQ ID 1059>:

```
g264.seq
    1  ttgactttaa cccgaaaaac ccttttcctc ctcaccgccg cgttcggcac
   51  acactccctt cagacggcat ccgccgacgc agtggtcaag ccggaaaaac
  101  tgcacgcctc cgccaaccgc agctacaaag tcgccgaatt cacgcaaacc
  151  ggcaacgcct cgtggtacgg cggcaggttt cacgggcgca aacttccgg
  201  cggagaccgc tacgatatga acgcctttac cgccgcccac aaaaccctgc
  251  ccatccccag ccatgtgcgc gtaaccaaca ccaaaaacgg caaaagcgtc
  301  atcgtccgcg tcaacgaccg cggcccttc cacggcaacc gcatcatcga
  351  cgtatccaaa gccgccgcgc aaaaattggg ctttgtcagc caagggacgg
  401  cacacgtcaa aatcgaacaa atcgtcccgg gccaatccgc accggttgcc
  451  gaaaacaaag acatctttat cgacttgaaa tctttcggta cggaacacga
  501  agcacaagcc tatctgaacc aagccgccca aaatttcgcc gcttcgtcat
  551  caagcccgaa cctctcggtt gaaaaacgcc gttacgaata cgttgtcaaa
  601  atgggcccgt ttgcctcgca ggaacgcgcc gccgaagccg aagcgcaggc
  651  acgcggtatg gttcgggcgg tactgacctc cggttga
                                                     40
```

This corresponds to the amino acid sequence <SEQ ID 1060; ORF 264.ng>:

```
g264.pep
    1  LTLTRKTLFL LTAAFGTHSL QTASADAVVK PEKLHASANR SYKVAEFTQT
   51  GNASWYGGRF HGRKTSGGDR YDMNAFTAAH KTLPIPSHVR VTNTKNGKSV
  101  IVRVNDRGPF HGNRIIDVSK AAAQKLGFVS QGTAHVKIEQ IVPGQSAPVA
  151  ENKDIFIDLK SFGTEHEAQA YLNQAAQNFA ASSSSPNLSV EKRRYEYVVK
  201  MGPFASQERA AEAEAQARGM VRAVLTSG*
```

The following partial DNA sequence was identified in *N. meningitidis* <SEQ ID 1061>:

```
m264.seq
    1  TTGACTTTAA CCCGAAAAAC CCTTTTCCTT CTCACCGCCG CATTCGGCAC
   51  ACACTCCCTT CAGACGGCAT CCGCCGACGC AGTGGTCAAG GCAGAAAAAC
  101  TGCACGCCTC CGCCAACCGC AGCTACAAAG TCGCCGGAAA CGCTACACG
  151  CCGAAAAACC AAGTCGCCGA ATTCACGCAA ACCGGCAACG CCTCGTGGTA
  201  CGGCGGCAGG TTTCACGGGC GCAAACTTC CGGCGGAGAA CGATACGATA
```

```
-continued
251  TGAACGCCTT TACCGCCGCC CACAAAACCC TGCCCATCCC CAGCTATGTG

301  CGCGTAACCA ATACCAAAAA CGGCAAAAGC GTCATCGTCC GCGTCAACGA

351  CCGCGGCCCC TTCCACGGCA ACCGCATCAT CGACGTATCC AAAGCCGCCG

401  CGCAAAAATT GGGCTTTGTC AACCAAGGGA CGGCACACGT CAAAATCGAA

451  CAAATCGTCC CGGGCCAATC CGCACCGGTT GCCGAAAACA AGACATCTT

501  TATCGACTTG AAATCTTTCG GTACGGAACA CGAAGCACAA GCCTATCTGA

551  ACCAAGCCGC CCAAAACTTC GCCGTTTCGT CATCGGGTAC GAACCTCTCG

601  GTTGAAAAAC GCCGTTACGA ATACGTCGTC AAAATGGGAC CGTTTACCTC

651  GCAGGAACGC GCCGCCGAAG CCGAAGCTCA GGCGCGCGGT ATGGTTCGGG

701  CGGTATTGAC CGCCGGCTGA
```

This corresponds to the amino acid sequence <SEQ ID 1062; ORF 264>:

```
m264.pep
   1  LTLTRKTLFL LTAAFGTHSL QTASADAVVK AEKLHASANR SYKVAGKRYT

51  PKNQVAEFTQ TGNASWYGGR FHGRKTSGGE RYDMNAFTAA HKTLPIPSYV

101  RVTNTKNGKS VIVRVNDRGP FHGNRIIDVS KAAAQKLGFV NQGTAHVKIE

151  QIVPGQSAPV AENKDIFIDL KSFGTEHEAQ AYLNQAAQNF AVSSSGTNLS

201  VEKRRYEYVV KMGPFTSQER AAEAEAQARG MVRAVLTAG*
```

Computer analysis of this amino acid sequence gave the following results:
Homology with a Predicted ORF from *N. gonorrhoeae*
ORF 264 shows 91.6% identity over a 239 aa overlap with a predicted ORF (ORF 264.ng) from *N. gonorrhoeae*:

```
  m264/g264
                   10         20         30         40         50         60
   m264.pep  LTLTRKTLFLLTAAFGTHSLQTASADAVVKAEKLHASANRSYKVAGKRYTPKNQVAEFTQ
             |||||||||||||||||||||||||||||| |||||||||||||||            ||||
   g264      LTLTRKTLFLLTAAFGTHSLQTASADAVVKPEKLHASANRSYKVA----------EFTQ
                   10         20         30         40
                   70         80         90        100        110        120
   m264.pep  TGNASWYGGRFHGRKTSGGERYDMNAFTAAHKTLPIPSYVRVTNTKNGKSVIVRVNDRGP
             |||||||||||||||||||||:|||||||||||||||||:||||||||||||||||||||
   g264      TGNASWYGGRFHGRKTSGGDRYDMNAFTAAHKTLPIPSHVRVTNTKNGKSVIVRVNDRGP
                   50         60         70         80         90        100
                  130        140        150        160        170        180
   m264.pep  FHGNRIIDVSKAAAQKLGFVNQGTAHVKIEQIVPGQSAPVAENKDIFIDLKSFGTEHEAQ
             |||||||||||||||||||||:||||||||||||||||||||||||||||||||||||||
   g264      FHGNRIIDVSKAAAQKLGFVSQGTAHVKIEQIVPGQSAPVAENKDIFIDLKSFGTEHEAQ
                  110        120        130        140        150        160
                  190        200        210        220        230        240
   m264.pep  AYLNQAAQNFAVSSSGTNLSVEKRRYEYVVKMGPFTSQERAAEAEAQARGMVRAVLTAGX
             ||||||||||:|||: |||||||||||||||||||||||||||||||||||||||||:||
   g264      AYLNQAAQNFAASSSSPNLSVEKRRYEYVVKMGPFASQERAAEAEAQARGMVRAVLTSGX
                  170        180        190        200        210        220
```

The following partial DNA sequence was identified in *N. meningitidis* <SEQ ID 1063>:

```
a264.seq
   1  TTGACTTTAA CCCGAAAAAC CCTTTTCCTC CTCACCGCCG CATTCGGCAT

51  ACATTCCTTT CAGACGGCAT CCGCCGACGC AGTGGTCAGG GCAGAAAAAC

101  TGCACGCCTC CGCCAACCGC AGCTACAAAG TCGCCGGAAA ACGCTACACG
```

```
-continued
151   CCGAAAAACC AAGTCGCCGA ATTCACGCAA ACCGGCAACG CCTCGTGGTA

201   CGGCGGCAGG TTTCACGGGC GCAAAACTTC CGGCGGAGAA CGATACGATA

251   TGAACGCCTT TACCGCCGCC CACAAAACCC TGCCCATCCC CAGCTATGTG

301   CGCGTAACCA ATACCAAAAA CGGCAAAAGC GTCATCGTCC GCGTCAACGA

351   CCGCGGCCCC TTCCACGGCA ACCGCATCAT CGACGTATCC AAAGCCGCCG

401   CGCAAAAATT GGGCTTTGTC AACCAAGGGA CGGCGCACGT CAAAATCGAA

451   CAAATCGTCC CGGGCCAATC CGCACCGGTT GCCGAAAACA AGACATCTT

501   CATCGACTTG AAATCTTTCG GTACGGAACA CGAAGCACAA GCCTATCTGA

551   ACCAAGCCGC CCAAAACCTG GCTTCATCGG CATCAAACCC GAACCTCTCG

601   GTTGAAAAAC GCCGTTACGA ATACGTCGTC AAAATGGGAC CGTTTGCCTC

651   GCAGGAACGC GCCGCCGAGG CCGAAGCTCA GGCGCGCGGT ATGGTTCGGG

701   CGGTATTAAC CGCCGGTTGA
```

This corresponds to the amino acid sequence <SEQ ID 1064; ORF 264.a>:

```
a264.pep
  1   LTLTRKTLFL LTAAFGIHSF QTASADAVVR AEKLHASANR SYKVAGKRYT

51   PKNQVAEFTQ TGNASWYGGR FHGRKTSGGE RYDMNAFTAA HKTLPIPSYV

101   RVTNTKNGKS VIVRVNDRGP FHGNRIIDVS KAAAQKLGFV NQGTAHVKIE

151   QIVPGQSAPV AENKDIFIDL KSFGTEHEAQ AYLNQAAQNL ASSASNPNLS

201   VEKRRYEYVV KMGPFASQER AAEAEAQARG MVRAVLTAG*
``` m264/a264 96.2% identity in 239 aa overlap

```
                 10         20         30         40         50         60
m264.pep  LTLTRKTLFLLTAAFGTHSLQTASADAVVKAEKLHASANRSYKVAGKRYTPKNQVAEFTQ
          ||||||||||||||||| ||:|||||||||:|||||||||||||||||||||||||||||
a264      LTLTRKTLFLLTAAFGIHSFQTASADAVVRAEKLHASANRSYKVAGKRYTPKNQVAEFTQ
                 10         20         30         40         50         60
                 70         80         90        100        110        120
m264.pep  TGNASWYGGRFHGRKTSGGERYDMNAFTAAHKTLPIPSYVRVTNTKNGKSVIVRVNDRGP
          ||||||||||||||||||||||||||||||||||||||||||||||||||||||||||||
a264      TGNASWYGGRFHGRKTSGGERYDMNAFTAAHKTLPIPSYVRVTNTKNGKSVIVRVNDRGP
                 70         80         90        100        110        120
                130        140        150        160        170        180
m264.pep  FHGNRIIDVSKAAAQKLGFVNQGTAHVKIEQIVPGQSAPVAENKDIFIDLKSFGTEHEAQ
          ||||||||||||||||||||||||||||||||||||||||||||||||||||||||||||
a264      FHGNRIIDVSKAAAQKLGFVNQGTAHVKIEQIVPGQSAPVAENKDIFIDLKSFGTEHEAQ
                130        140        150        160        170        180
                190        200        210        220        230        240
m264.pep  AYLNQAAQNFAVSSSGTNLSVEKRRYEYVVKMGPFTSQERAAEAEAQARGMVRAVLTAGX
          |||||||||:| |:|:  |||||||||||||||||:|||||||||||||||||||||||
a264      AYLNQAAQNLASSASNPNLSVEKRRYEYVVKMGPFASQERAAEAEAQARGMVRAVLTAGX
                190        200        210        220        230        240
```

The following partial DNA sequence was identified in *N. meningitidis* <SEQ ID 1065>:

```
m265.seq
  1   ATGTCGGTGA TTTTGCCGCC GACACGCGCC AACGCTGCTT TTTCGGCTTG

51   GGCGCGGCTG ATGATTTTGT CTTGTTTGTT GTGTTGGTGT GCGGCGTGTC

101   CGTGGTCGTC ATCGCCGTGT CCGTCGTGGT GGGCGAGCGC GGGGGCGGAA

151   ATGCTCAGCA GTGCGGTTGC GGCGGAGGTC AAGAGAAGGT GTTTGATGTT
```

```
                          -continued
201     CATAT.TTTT GCCTTTGTAA ATCGTGGGTT GGAAAATGTG GATATTAATA

251     AGGTATCAAA TAACCGTCAG CCGGCGGTCA ATACCGCCCG AACCATACCG

301     CGCGCCTGAG CTTCGGCTTC GGCGGCGCGT TCCTGCGAGG TAAACGGTCC

351     CATTTTGACG ACGTATTCGT AA
```

This corresponds to the amino acid sequence <SEQ ID 1066; ORF 265>:

```
m265.pep
    1   MSVILPPTRA NAAFSAWARL MILSCLLCWC AACPWSSSPC PSWWASAGAE

51   MLSSAVAAEV KRRCLMFIXF AFVNRGLENV DINKVSNNRQ PAVNTARTIP

101   RAXASASAAR SCEVNGPILT TYS*
```

Computer analysis of this amino acid sequence gave the following results:
Homology with a Predicted ORF from *N. gonorrhoeae*
ORF 265 shows 88.6% identity over a 123 aa overlap with a predicted ORF (ORF 265.ng) from *N. gonorrhoeae*:

```
m265/g265
                    10         20         30         40         50         60
m265.pep    MSVILPPTRANAAFSAWARLMILSCLLCWCAACPWSSSPCPSWWASAGAEMLSSAVAAEV
            ||||||||||:||||||||||||||||| ||||||||||||||||||||||:||||| |
g265        MSVILPPTRAQAAFSAWARLMILSCLPCWCAACPWSSSPCPSWWASAGAEMPNSAVAAV
                    10         20         30         40         50         60
                    70         80         90        100        100        120
m265.pep    KRRCLMFIXFAFVNRGLENVDINKVSNNRQPAVNTARTIPRAXASASAARSCEVNGPILT
            ||||||||  ||:||:||:| ||||||||||||:||||||| ||||||||||:||||||
g265        KRRCLMFI-FALVNQGLKNGDINKVSNNRQPEVSTARTIPRACASASAARSCEANGPILT
                    70         80         90        100        110
m265.pep    TYSX
            ||||
g265        TYSX
            120
```

The following partial DNA sequence was identified in *N. meningitidis* <SEQ ID 1067>:

```
a265.seq
    1   ATGTCGGTGA TTTTGCCGCC GACACGCGCC AACGCTGCTT TTTCGGCTTG

51   GGCGCGGCTG ATGATTTTGT CTTGTTTGCT GTGTTGGTGT GCGGCGTGTC

101   CGTGGTCGTC ATCGCCGTGT CCGTCGTGGT GGGCGAGTGC GGGGGCGGAA

151   ATGCCCATCA GTGCGGTTGC GGCGGCGGTC AAGAGAAGGC GTTTGAAGTT

201   CATTTTTGCT CCTGCGAAGT ATCTGGT... ......GGTGT TTGAAGGACG

251   TAAAGGCGGG ACATCAACCG GCGGTTAATA CCGCCCGAAC CATACCGCGC

301   GCCTGAGCTT CGGCCTCGGC GGCGCGTTCC TGCGAGGCAA ACGGTCCCAT

351   TTTGACGACG TATTCGTAA
```

This corresponds to the amino acid sequence <SEQ ID 1068; ORF 265.a>:

```
a265.pep
    1   MSVILPPTRA NAAFSAWARL MILSCLLCWC AACPWSSSPC PSWWASAGAE

51   MPISAVAAAV KRRRLKFIFA PAKYLX..XC LKDVKAGHQP AVNTARTIPR

101   A*ASASAARS CEANGPILTT YS*
``` m265/a265 79.7% identity in 123 aa overlap

```
                 10        20        30        40        50        60
m265.pep  MSVILPPTRANAAFSAWARLMILSCLLCWCAACPWSSSPCPSWWASAGAEMLSSAVAAEV
          ||||||||||||||||||||||||||||||||||||||||||||||||||  ||||| |
a265      MSVILPPTRANAAFSAWARLMILSCLLCWCAACPWSSSPCPSWWASAGAEMPISAVAAAV
                 10        20        30        40        50        60

70        80        90       100       110       120
m265.pep  KRRCLMFIXFAFVNRGLENVDINKVSNNRQPAVNTARTIPRAXASASAARSCEVNGPILT
          ||| |  ||    |:       :: |: ::||||||||||||||||||||||:|||||
a265      KRRRLKFI---FAPAKYLXXCLKDVKAGHQPAVNTARTIPRAXASASAARSCEANGPILT
                 70        80        90       100       110 m265.pep  TYSX
          ||||
a265      TYSX
          120
```

The following partial DNA sequence was identified in *N. gonorrhoeae* <SEQ ID 1069>:

```
g266.seq
    1   agttcagacg gcatcgccgc cgacaatgcc caaacagaaa gcccatcatg 51   accgcatcca tgtacatcct tttggtcttg gcactcatct ttgccaacgc 101   cccttcctc acgaccagac tgttcggcgt ggccgcgctc aagcgcaaac 151   atttcggaca ccacctgatc gagctggcgg caggtttcgc gctgaccgcc 201   tctcttgcct acatcctcga atcccgtgcg ggagcggtac acaatcaggg 251   ttgggagttt tacgccaccg tcgtctgcct gtacctcatt ttcgccttcc 301   cgtgtttcgt gcggcggtat ttttggcaca cgcgcaacag ggaataa
```

This corresponds to the amino acid sequence <SEQ ID 1070; ORF 266.ng>:

```
g266.pep
    1   MQFRRHRRRQ CPNRKPIMTA SMYILLVLAL IFANAPFLTT RLFGVAALKR

51   KHFGHHLIEL AAGFALTASL AYILESRAGA VHNQGWEFYA TVVCLYLIFA

101   FPCFVRRYFW HTRNRE*
```

The following partial DNA sequence was identified in *N. meningitidis* <SEQ ID 1071>:

```
m266.seq
    1   ATGCCGTTCC GCAACGCGtT cAGACGGCAT CGCCGCCGAC AACGCCTAAA

51   CAGAAAGCCC ACCATGACCG CATCCATGTA CATCCTTTTG GTCTTGGCAC

101   TCATCTTTGC CAACGCCCCC TTCCTCACGA CCAGACTGTT CGGCGTGGCC 151   rCACTCAAGC GCAAACATTT CGGACACCAC ATGATCGAGC TGGCGGCAGG

201   TTTCGCGCTG ACCGCCGTTC TTGCCTACAT CCTsGAATCC CGTGCAGGAT

251   CGGTACACGA TCAGGGTTGG GAGTTTTATG CCACAGTCGT CTGCCTGTAC

301   CTGATTTTTG CGTTTCCATG TTTTGTGTGG CGGTATTTTT GGCACACGCG

351   CAACAGGGAA TAG
```

This corresponds to the amino acid sequence <SEQ ID 1072; ORF 266>:

```
m266.pep
    1   MPFRNAFRRH RRRQRLNRKP TMTASMYILL VLALIFANAP FLTTRLFGVA

51   XLKRKHFGHH MIELAAGFAL TAVLAYILES RAGSVHDQGW EFYATVVCLY

101   LIFAFPCFVW RYFWHTRNRE *
```

Computer analysis of this amino acid sequence gave the following results:
Homology with a Predicted ORF from *N. gonorrhoeae*
ORF 266 shows 92.1% identity over a 114 aa overlap with a predicted ORF (ORF 266.ng) from *N. gonorrhoeae*:

```
   m266/g266
                     10         20         30         40         50         60
   m266.pep   MPFRNAFRRHRRRQRLNRKPTMTASMYILLVLALIFANAPFLTTRLFGVAXLKRKHFGHH
              ||||||||   ||||  ||||||||||||||||||||||||||||||  ||||||||
   g266       MQFRRHRRRQCPNRKPIMTASMYILLVLALIFANAPFLTTRLFGVAALKRKHFGHH
                        10         20         30         40         50

70         80         90        100        110        120
   m266.pep   MIELAAGFALTAVLAYILESRAGSVHDQGWEFYATVVCLYLIFAFPCFVWRYFWHTRNREX
              :||||||||||| ||||||||||||:||:|||||||||||||||||||| |||||||||||
   g266       LIELAAGFALTASLAYILESRAGAVHNQGWEFYATVVCLYLIFAFPCFVRRYFWHTRNREX
                  60         70         80         90        100        110
```

The following partial DNA sequence was identified in *N. meningitidis* <SEQ ID 1073>:

```
a266.seq
    1   ATGCCGTTCC GCAATGCGTT CAGACGGCAT CGCCGCCGAC AATGCCCAAA

51   CAGAAAGCCC GCCATGACCG CATCCATGTA CATCCTTTTG CTGCTTGCCT

101   TGATTTTTGC CAACGCCCCC TTCCTCACGA CCAAGCTGTT CGGCATCGTA

151   CCGCTCAAGC GCAAACATTT CGGACACCAC CTGATCGAGC TGGCGGCAGG

201   TTTCGCGCTG ACCGCCGTTC TTGCCTACAT CCTCGAATCC CGTGCGGGAG

251   CGGTACACGA TCAGGGTTGG GAGTTTTACG CCACCGTCGT CTGCCTGTAC

301   CTGATTTTTG CGTTTCCCTG TTTCGTGTGG CGGTATTTTT GGCACACGCG

351   CAACAGGGAA TAG
```

This corresponds to the amino acid sequence <SEQ ID 1074; ORF 266.a>:

```
a266.pep
    1   MPFRNAFRRH RRRQCPNRKP AMTASMYILL LLALIFANAP FLTTKLFGIV

51   PLKRKHFGHH LIELAAGFAL TAVLAYILES RAGAVHDQGW EFYATVVCLY

101   LIFAFPCFVW RYFWHTRNRE *
``` m266/a266 91.7% identity in 120 aa overlap

```
                     10         20         30         40         50         60
   m266.pep   MPFRNAFRRHRRRQRLNRKPTMTASMYILLVLALIFANAPFLTTRLFGVAXLKRKHFGHH
              |||||||||||||    ||||:|||||||||:||||||||||||||:|||::  ||||||||
   a266       MPFRNAFRRHRRRQCPNRKPAMTASMYILLLLALIFANAPFLTTKLFGIVPLKRKHFGHH
                     10         20         30         40         50         60

70         80         90        100        110        120
   m266.pep   MIELAAGFALTAVLAYILESRAGSVHDQGWEFYATVVCLYLIFAFPCFVWRYFWHTRNRE
              :|||||||||||||||||||||||:|||||||||||||||||||||||||||||||||||
   a266       LIELAAGFALTAVLAYILESRAGAVHDQGWEFYATVVCLYLIFAFPCFVWRYFWHTRNRE
                     70         80         90        100        110        120
```

```
m266.pep   X
           |
a266       X
```

The following partial DNA sequence was identified in *N. gonorrhoeae* <SEQ ID 1075>:

```
g267.seq
     1    atgcaagtcg ccttttttct cgccgtggta ttcaaaaata tgggtttcca 51    caatcgcatc ggtcgggcag gcctcttcgc agaaaccgca gaagatgcac 101    ttggtcaggt cgatgtcgta acgcttggtg cggcgggtgc cgtcttcgcg 151    ttcttccgat tcgatgttga tcgccattgc cggacacacc gcctcgcaca 201    atttacacgc gatgcagcgt tcctctccgt tcggaaaacg gcgttgcgcg 251    tgcagaccgc ggaaacgcac ggattgcggc gttttctctt cgggaaaata 301    aattgtgtct ttgcgggcaa aaaagttttt gagcgttacg cccatgcctt 351    tgaccagttc gccaagcaga aaggttttta ctaa
```

This corresponds to the amino acid sequence <SEQ ID 1076; ORF 267.ng>:

```
g267.pep
     1    MQVAFFLAVV FKNMGFHNRI GRAGLFAETA EDALGQVDVV TLGAAGAVFA

51    FFRFDVDRHC RTHRLAQFTR DAAFLSVRKT ALRVQTAETH GLRRFLFGKI

101    NCVFAGKKVF ERYAHAFDQF AKQKGFY*
```

The following partial DNA sequence was identified in *N. meningitidis* <SEQ ID 1077>:

```
m267.seq
     1    GTGCAAGTCG CCTTTTTTCT CGCCGTGGTA TTCAAAAATA TGGGTTTCCA

51    CAATCGCATC AGTCGGGCAT GCCTCTTCGC AGAAACCGCA GAAGATGCAC

101    TTGGTCAGGT CGATGTCGTA ACGCTTGGTG CGGCGCGTAC CGTCTTCACG

151    TTCTTCCGAT TCGATGTTAA TCGCCATTGC CGGACACACT GCCTCACACA

201    ACTTACACGC GATACACCGC TCTTCGCCGT TCGGATACCG CcGCTGCGCG

251    TGCAGACCGC GGAAACGCAC GGATTGCGGC GTTTTCTCTT CGGGGAAATA

301    AATTGTGTCT TTGCGGGCGA AAAAGTTTTT GAGCGTTACG CCCATACCTT

351    TTACCAATTC GCCAAGCAGA AAGGTTTTTA CTAA
```

This corresponds to the amino acid sequence <SEQ ID 1078; ORF 267>:

```
m267.pep
     1    VQVAFFLAVV FKNMGFHNRI SRACLFAETA EDALGQVDVV TLGAARTVFT

51    FFRFDVNRHC RTHCLTQLTR DTPLFAVRIP PLRVQTAETH GLRRFLFGEI

101    NCVFAGEKVF ERYAHTFYQF AKQKGFY*
```

Computer analysis of this amino acid sequence gave the following results:

Homology with a Predicted ORF from *N. gonorrhoeae*

ORF 267 shows 82.7% identity over a 127 aa overlap with a predicted ORF (ORF 267.ng) from *N. gonorrhoeae*:

```
m267/g267
                  10         20         30         40         50         60
m267.pep  VQVAFFLAVVFKNMGFHNRISRACLFAETAEDALGQVDVVTLGAARTVFTFFRFDVNRHC
          :|||||||||||||||||:|| ||||||||||||||||||||:||:||||||:|||
g267      MQVAFFLAVVFKNMGFHNRIGRAGLFAETAEDALGQVDVVTLGAAGAVFAFFRFDVDRHC
                  10         20         30         40         50         60

70         80         90        100        110        120
m267.pep  RTHCLTQLTRDTPLFAVRIPPLRVQTAETHGLRRFLFGEINCVFAGEKVFERYAHTFYQF
          |||  |:|:|||:  :::|| ||||||||||||||||:||||||:|||||||||:| ||
g267      RTHRLAQFTRDAAFLSVRKTALRVQTAETHGLRRFLFGKINCVFAGKKVFERYAHAFDQF
                  70         80         90        100        110        120 m267.pep  AKQKGFYX
          ||||||||
g267      AKQKGFYX
```

The following partial DNA sequence was identified in *N. meningitidis* <SEQ ID 1079>:

```
a267.seq
    1    GTGCAAGTCG CCTTTTTTCT CGCCGTGGTA TTCAAAAATA TGGGTTTCCA

51    CAATCGCATC GGTCGGGCAG GCTTCTTCGC AGAAACCGCA GAAGATGCAC

101    TTGGTCAGGT CGATGTCGTA ACGCTTGGTG CGGCGCGTGC CGTCTTCGCG

151    TTCTTCCGAT TCGATGTTGA TCGCCATTGC GGGGCAAACG GCTTCACACA

201    ATTTACACGC GATGCAGCGT TCCTCGCCGT TTGGATAACG GCGTTGCGCG

251    TGCAGACCGC GGAAACGCAC GGATTGCGGC GTTTTCTCTT CGGGAAAATA

301    AATCGTGTCT TTGCGGGCAA AAAAGTTTTT GAGCGTTACG CCCATACCTT

351    TTACCAATTC GCCAAGCAGA AAGGTTTTTA CTAA
```

This corresponds to the amino acid sequence <SEQ ID 1080; ORF 267.a>:

```
a267.pep
    1    VQVAFFLAVV FKNMGFHNRI GRAGFFAETA EDALGQVDVV TLGAARAVFA

51    FFRFDVDRHC GANGFTQFTR DAAFLAVWIT ALRVQTAETH GLRRFLFGKI

101    NRVFAGKKVF ERYAHTFYQF AKQKGFY*
``` m267/a267 82.7% identity in 127 aa overlap

```
                  10         20         30         40         50         60
m267.pep  VQVAFFLAVVFKNMGFHNRISRACLFAETAEDALGQVDVVTLGAARTVFTFFRFDVNRHC
          ||||||||||||||||||||||:|  :||||||||||||||||||||:||:||||||:|||
a267      VQVAFFLAVVFKNMGFHNRIGRAGFFAETAEDALGQVDVVTLGAARAVFAFFRFDVDRHC
                  10         20         30         40         50         60

70         80         90        100        110        120
m267.pep  RTHCLTQLTRDTPLFAVRIPPLRVQTAETHGLRRFLFGEINCVFAGEKVFERYAHTFYQF
          :: :||:|||:  ::|| | ||||||||||||||||||:|| ||||:|||||||||||||
a267      GANGFTQFTRDAAFLAVWITALRVQTAETHGLRRFLFGKINRVFAGKKVFERYAHTFYQF
                  70         80         90        100        110        120 m267.pep  AKQKGFYX
          ||||||||
a267      AKQKGFYX
```

The following partial DNA sequence was identified in *N. gonorrhoeae* <SEQ ID 1081>:

```
G268.seq
    1    atgaaaaaaa atttacccgc actggcattg gcaagtatgc tgattttgtc 51    gggctgcgac cgtttgggaa taggcaaccc gttttccgga aaggaaattt
```

```
-continued
 101  cctgcggaag cgaagagact aaagagattt tggtcaaact ggtccgcgac 151  aatgtcgaag gtgaaaccgt caaaactttt gacgacgacg cattcaaaga 201  ccaagcattt gccgatatcg gcatatcgca tatccgcaga atggtcgaac 251  gtttgggcat aaccgtcgat gaagtccgaa ctaccgagaa aaccgacacg 301  tccagcaaac tcaaatgtga agccgcgtta aaactggacg tgcccgacga 351  tgttgtcgat tatgccgtcg ccgccaacca atctataggc aacagccata 401  agaaaacgcc cgactttttt gaaccctact accgcaaaga aggcgcgtat 451  tatgtcaaaa ctatttctta cagcgtccag ccgacagacg acaaaagcaa 501  aatctttgcc gaactcagtc aggcacacga tatcatccat ccgctcagcg 551  agctggtgtc tatggcactg attaaagagc cgttggacaa agcgaaacaa 601  aggaacgaaa aacttgaagc ggcagaagcc accgcgcagg aagcgaggga 651  ggcagaagaa gcggcggcgc aggaggcatt gggtcgggag caggaagccg 701  cccgcgtatc cgaatgggaa gaacgctaca agctgtcgcg cagcgagttc 751  gagcagtttt ggaaaggatt gcctcaaact gtacagaata agctgcaagc 801  ctcgcagaaa acatggaaaa gcggtatgga caagatctgt gccaacaatg 851  cgaaagccga aggtgaaacg ccaaacggca taaaagtcag tgagttggcg 901  tgtaaaacgg cagaaaccga agcacgcttg gaagagctgc acaaccgtaa 951  aaaagcccctt atcgacgaaa tggtcaggga agaggacaag aaagaactgc 1001  caaagcggct ctga
```

This corresponds to the amino acid sequence <SEQ ID 1082; ORF 268.ng>:

```
m268.pep
   1  MKKNLPALAL ASMLILSGCD RLGIGNPFSG KEISCGSEET KEILVKLVRD

51  NVEGETVKTF DDDAFKDQAF ADIGISHIRR MVERLGITVD EVRTTEKTDT

101  SSKLKCEAAL KLDVPDDVVD YAVAANQSIG NSHKKTPDFF EPYYRKEGAY

151  YVKTISYSVQ PTDDKSKIFA ELSQAHDIIH PLSELVSMAL IKEPLDKAKQ

201  RNEKLEAAEA TAQEAREAEE AAAQEALGRE QEAARVSEWE ERYKLSRSEF

251  EQFWKGLPQT VQNKLQASQK TWKSGMDKIC ANNAKAEGET PNGIKVSELA

301  CKTAETEARL EELHNRKKAL IDEMVREEDK KELPKRL*
```

The following partial DNA sequence was identified in *N. meningitidis* <SEQ ID 1083>:

```
m268.seq (partial)
    1    ..ATGGCACTGA TTAAAGAGCC GTTGGACAAA GTGAAACAAA GGAACGAAGA

51    ACTTGAAGCG GCAGAAGAAG CGGCGGCGCA GGAGGCATTG GGTCGGGAGC

101    AGGAAGCCGC CCGCGTATCC GAATGGGAAG AACGCTACAA GCTGTCGCGC

151    AG.CAGTTCG AGCAGTTCTG GAAAGGATTG CCTCAAACCG TACAGAATAA

201    GCTGCAACCn TCACAGAAAA CATGGAAAAG CGGGATGGAT AAAATCTGTG

251    CCAACAATGC GAAAGCTGAA GGTAAAACGC CAAACGGCAT AAAATTCAGC

301    GAACTGGCAT GCAAAACGGC GAAAACCGAA GCACGCTTGG AAGAGCTGCA
```

-continued

```
351    CAACCGTAAA AAAGCCCTTA TCGACGAAAT GGyCAGGGAA GCGGACAmGA

401    AAGAACTGTC AAAGCGGCTs TGA
```

This corresponds to the amino acid sequence <SEQ ID 1084; ORF 268>:

```
m268.pep (partial)
     1    ..MALIKEPLDK VKQRNEELEA AEEAAAQEAL GREQEAARVS EWEERYKLSR

51    XQFEQFWKGL PQTVQNKLQP SQKTWKSGMD KICANNAKAE GKTPNGIKFS

101    ELACKTAKTE ARLEELHNRK KALIDEMXRE ADXKELSKRL *
```

Computer analysis of this amino acid sequence gave the following results:
Homology with a Predicted ORF from *N. gonorrhoeae*
ORF 268 shows 86.0% identity over a 150 aa overlap with a predicted ORF (ORF 268.ng) from *N. gonorrhoeae*:

```
    m268/g268
                                                        10         20
       m268.pep                            MALIKEPLDKVKQRNEELEAAE--------
                                           ||||||||||:|||||:||||
           g268    SVQPTDDKSKIFAELSQAHDIIHPLSELVSMALIKEPLDKAKQRNELLEAAEATAQEARE
                   160       170       180       190       200       210

30        40        50        60        70        80
       m268.pep    --EAAAQEALGREQEAARVSEWEERYKLSRSQFEQFWKGLPQTVQNKLQPSQKTWKSGMD
                     ||||||||||||||||||||||||||||||:||||||||||||||||||:||||||||||
           g268    AEEAAAQEALGREQEAARVSEWEERYKLSRSEFEQFWKGLPQTVQNKLQASQKTWKSGMD
                   220       230       240       250       260       270

90       100       110       120       130       140
       m268.pep    KICANNAKAEGKTPNGIKFSELACKTAKTEARLEELHNRKKALIDEMXREADXKELSKRLX
                   ||||||||||:|||||| |||||||||:||||||||||||||||||||| ||  ||| |||
           g268    KICANNAKAEGETPNGIKVSELACKTAETEARLEELHNRKKALIDEMVREEDKKELPKRLX
                   280       290       300       310       320       330
```

The following partial DNA sequence was identified in *N. meningitidis* <SEQ ID 1085>:

```
a268.seq
     1    ATGGCACTGA TTAAAGAGCC GTTGGACAAA GCGAAACAAA GGAACGAAGA

51    ACTTGAAGCG GCAGAAGAAG CGGCGGCGCA GGAGGCATTG GGTCGGGAGC

101    AGGAAGTCGA CCGCGTATCC GAATGGGAAG AACGCTACAA GCTGTCGCGC

151    AGCGAGTTCG AGCAGTTCTG GAAAGGATTG CCTCAAACCG TACAGAATAA

201    GCTGCAAGCC TCACAGAAAA CATGGAAAAG CGGGATGGAT AAAATCTGTG

251    CCAACAATGC GAAAGCTGAA GGTGAAACGC CAAACGGCAT AAAATTCAGC

301    GAACTGGCAT GCAAAACGGC GGAAACCGAA GCACGCTTGG AAGAGCTGCA

351    CAACCGTAAA AAAGCCCTTC TCGACGAAAT GGCCAGGGAA GCGGACAAGA

401    AAGAACTGCC AAAGCGGCTC TGA
```

This corresponds to the amino acid sequence <SEQ ID 1086; ORF 268.a>:

```
a268.pep
     1    MALIKEPLDK AKQRNEELEA AEEAAAQEAL GREQEVDRVS EWEERYKLSR

51    SEFEQFWKGL PQTVQNKLQA SQKTWKSGMD KICANNAKAE GETPNGIKFS

101    ELACKTAETE ARLEELHNRK KALLDEMARE ADKKELPKRL *
``` m268/a268 91.4% identity in 140 aa overlap

```
                   10        20        30        40        50        60
   m268.pep   MALIKEPLDKVKQRNEELEAAEEAAAQEALGREQEAARVSEWEERYKLSRXQFEQFWKGL
              ||||||||||:|||||||||||||||||||||||||:||||||||||||:||||||||
   a268       MALIKEPLDKAKQRNEELEAAEEAAAQEALGREQEVDRVSEWEERYKLSRSEFEQFWKGL
                   10        20        30        40        50        60

70        80        90       100       110       120
   m268.pep   PQTVQNKLQPSQKTWKSGMDKICANNAKAEGKTPNGIKFSELACKTAKTEARLEELHNRK
              ||||||||||:|||||||||||||||||||||||:|||||||||||:|||||||||||||
   a268       PQTVQNKLQASQKTWKSGMDKICANNAKAEGETPNGIKFSELACKTAETEARLEELHNRK
                   70        80        90       100       110       120

130       140
   m268.pep   KALIDEMXREADXKELSKRLX
              |||:||| |||| |||||||
   a268       KALLDEMAREADKKELPKRLX
                  130       140
```

The following partial DNA sequence was identified in *N. meningitidis* <SEQ ID 1087>:

```
m268-1.seq
     1    GTGCAATCCC GATATGATGG TTTGCATAAA TTTAAACATA TATGTTCCGC

51    AGCTATGGCA CTGATTAAAG AGCCGTTGGA CAAAGTGAAA CAAAGGAACG

101    AAGAACTTGA AGCGGCAGAA GAAGCGGCGG CGCAGGAGGC ATTGGGTCGG

151    GAGCAGGAAG CCGCCCGCGT ATCCGAATGG GAAGAACGCT ACAAGCTGTC

201    GCGCAGCGAG TTCGAGCAGT TCTGGAAAGG ATTGCCTCAA ACCGTACAGA

251    ATAAGCTGCA AGCCTCACAG AAAACATGGA AAGCGGGAT GGATAAAATC

301    TGTGCCAACA ATGCGAAAGC TGAAGGTAAA ACGCCAAACG GCATAAAATT

351    CAGCGAACTG GCATGCAAAA CGGCGAAAAC CGAAGCACGC TTGGAAGAGC

401    TGCACAACCG TAAAAAAGCC CTTATCGACG AAATGGCCAG GGAAGCGGAC

451    AAGAAAGAAC TGTCAAAGCG GCTCTGA
```

This corresponds to the amino acid sequence <SEQ ID 1088; ORF 268-1>:

```
m268-1.pep
     1    VQSRYDGLHK FKHICSAAMA LIKEPLDKVK QRNEELEAAE EAAAQEALGR

51    EQEAARVSEW EERYKLSRSE FEQFWKGLPQ TVQNKLQASQ KTWKSGMDKI

101    CANNAKAEGK TPNGIKFSEL ACKTAKTEAR LEELHNRKKA LIDEMAREAD

151    KKELSKRL*
``` m268-1/g268 82.3% identity in 164 aa overlap

```
                                            10        20        30
   m268-1.pep                          VQSRYDGLHKFKHICSAAMALIKEPLDKVKQRNE
                                       :| :| :::: |  ||||||||||||:||||
   g268       KEGAYYVKTISYSVQPTDDKSKIFAELSQAHDIIHPLSELVS--MALIKEPLDKAKQRNE
                       150       160       170       180       190       200

40              50        60        70        80
   m268-1.pep   ELEAAE---------EAAAQEALGREQEAARVSEWEERYKLSRSEFEQFWKGLPQTVQN
                :|||||         ||||||||||||||||||||||||||||||||||||||||||||
   g268       KLEAAEATAQEAREAEEAAAQEALGREQEAARVSEWEERYKLSRSEFEQFWKGLPQTVQN
                       210       220       230       240       250       260

90       100       110       120       130       140
   m268-1.pep   KLQASQKTWKSGMDKICANNAKAEGKTPNGIKFSELACKTAKTEARLEELHNRKKALIDE
                ||||||||||||||||||||||||||:||||||| |||||:|||||||||||||||||||
   g268       KLQASQKTWKSGMDKICANNAKAEGETPNGIKVSELACKTAETEARLEELHNRKKALIDE
                       270       280       290       300       310       320
```

```
              150       159
m268-1.pep  MAREADKKELSKRLX
            |:||  |||||  ||||
g268        MVREEDKKELPKRLX
              330
```

The following partial DNA sequence was identified in *N. meningitidis* <SEQ ID 1089>:

```
a268-1.seq
     1    GTGCAATCCC GATATGATGG TTTGCATAAA TTTAAACATA TATGTTCCGC

51    AGCTATGGCA CTGATTAAAG AGCCGTTGGA CAAAGCGAAA CAAAGGAACG

101    AAGAACTTGA AGCGGCAGAA GAAGCGGCGG CGCAGGAGGC ATTGGGTCGG

151    GAGCAGGAAG TCGACCGCGT ATCCGAATGG GAAGAACGCT ACAAGCTGTC

201    GCGCAGCGAG TTCGAGCAGT TCTGGAAAGG ATTGCCTCAA ACCGTACAGA

251    ATAAGCTGCA AGCCTCACAG AAAACATGGA AAGCGGGAT GGATAAAATC

301    TGTGCCAACA ATGCGAAAGC TGAAGGTGAA ACGCCAAACG GCATAAAATT

351    CAGCGAACTG GCATGCAAAA CGGCGGAAAC CGAAGCACGC TTGGAAGAGC

401    TGCACAACCG TAAAAAAGCC CTTCTCGACG AAATGGCCAG GGAAGCGGAC

451    AAGAAAGAAC TGCCAAAGCG GCTCTGA
```

This corresponds to the amino acid sequence <SEQ ID 1090; ORF 268-1.a>:

```
a268-1.pep
     1    VQSRYDGLHK FKHICSAAMA LIKEPLDKAK QRNEELEAAE EAAAQEALGR

51    EQEVDRVSEW EERYKLSRSE FEQFWKGLPQ TVQNKLQASQ KTWKSGMDKI

101    CANNAKAEGE TPNGIKFSEL ACKTAETEAR LEELHNRKKA LLDEMAREAD

151    KKELPKRL*
                                             40
``` a268-1/m268-1 95.6% identity in 158 aa overlap

```
                    10        20        30        40        50        60
a268-1.pep  VWSRYDGLHKFKHICSAAMALIKEPLDKAKQRNEELEAAEEAAAQEALGREQEVDRVSEW
            ||||||||||||||||||||||||||:||||||||||||||||||||||||:  |||||
m268-1      VWSRYDGLHKFKHICSAAMALIKEPLDKVKQRNEELEAAEEAAAQEALGREQEAARVSEW
                    10        20        30        40        50        60

70        80        90       100       110       120
a268-1.pep  EERYKLSRSEFEQFWKGLPQTVQNKLQASQKTWKSGMDKICANNAKAEGETPNGIKFSEL
            ||||||||||||||||||||||||||||||||||||||||||||||||:|||||||||||
m268-1      EERYKLSRSEFEQFWKGLPQTVQNKLQASQKTWKSGMDKICANNAKAEGKTPNGIKFSEL
                    70        80        90       100       110       120

130       140       150       159
a268-1.pep  ACKTAETEARLEELHNRKKALLDEMAREADKKELPKRLX
            |||||:|||||||||||||||:||||||||||||  ||||
m268-1      ACKTAKTEARLEELHNRKKALIDEMAREADKKELSKRLX
                   130       140       150
```

The following partial DNA sequence was identified in *N. gonorrhoeae* <SEQ ID 1091>:

```
g269.seq
     1    atggtttggc gtgtgaattg cgcggcaacg gcggcgctga ttttttcgtc 51    cagcccttgg atttgggcgg tggtgtgggt gtggtcgcgg tcggcttttt 101    cctgcaaacc ttgcgccagc cttgacgcgt ccagtgcgcc ggcgttggcg
```

-continued

```
   151  gtttcgccgt gggactttat ccggaacacg gcttcgccca aggtgtcggc 201  ggctttgatg cacagtttta aaaccagggc tttggggcgg ttttctgcgc 251  cgcccgttgc cattttgctg tccaatcgcg gggttaaaaa accgttgtcg 301  tttaagtcgc cgtccgtcca agtcgatacg agcgcgcttc tttgcctttc 351  attgcggtct tcgtaa
```

This corresponds to the amino acid sequence <SEQ ID 1092; ORF 269.ng>:

```
g269.pep
     1  MVWRVNCAAT AALIFSSSPW IWAVVWVWSR SAFSCKPCAS LDASSAPALA

51  VSPWDFIRNT ASPKVSAALM HSFKTRALGR FSAPPVAILL SNRGVKKPLS

101  FKSPSVQVDT SALLCLSLRS S*
```

The following partial DNA sequence was identified in *N. meningitidis* <SEQ ID 1093>:

```
m269.seq
     1  ATGGTTTGGC GTGTGAATTG CGCGGCAACG GCGGTGCTGA TTTTTTCGTC

51  CAGCCCTTGG ATTTGGGCGG CGGTGTGGGT GTGGTCTCGG TCGGCTTTGT

101  CTTGCAAACC TTGCGCCaCG TGCCCGCGTC CAGCGCCTGC GTTGATGGTT

151  TCGCCGTGGG ACTTTATCCA AAACACGGCT TCGCCCAAGG TGTCGGCGGC

201  TTTGATGCAC AGTTTTAAAA CCAGGGCTTT GGGGCGGTTT TCGTCGCCGC

251  CTGTCGCCAT TTTGCTGTCC GAGCGCGGGG TTAAAAAGCC GTTGTCGTTT

301  AAATTTTCGT CCGTCCAAGT CGATACGAGC GCGCTTCTCT GCCTTTCGTT

351  GCGGTCTTCG TAA
```

This corresponds to the amino acid sequence <SEQ ID 1094; ORF 269>:

```
m269.pep
     1  MVWRVNCAAT AVLIFSSSPW IWAAVWVWSR SALSCKPCAT CPRPAPALMV

51  SPWDFIQNTA SPKVSAALMH SFKTRALGRF SSPPVAILLS ERGVKKPLSF

101  KFSSVQVDTS ALLCLSLRSS *
```

Computer analysis of this amino acid sequence gave the following results:
Homology with a Predicted ORF from *N. gonorrhoeae*
ORF 269 shows 87.6% identity over a 121 aa overlap with a predicted ORF (ORF 269.ng) from *N. gonorrhoeae*:

```
m269.pep  MVWRVNCAATAVLIFSSSPWIWAAVWVWSRSALSCKPCATCP-RPAPALMVSPWDFIQNT   59
          ||||||||||:||||||||||:||||||||:||||| :     |||| |||||||:||
g269      MVWRVNCAATAALIFSSSPWIWAVVWVWSRSAFSCKPCASLDASSAPALAVSPWDFIRNT   60
m269.pep  ASPKVSAALMHSFKTRALGRFSSPPVAILLSERGVKKPLSFKFSSVQVDTSALLCLSLRS  119
          |||||||||||||||||||||:||||||||:|||||||||  |||||||||||||||||
g269      ASPKVSAALMHSFKTRALGRFSAPPVAILLSNRGVKKPLSFKSPSVQVDTSALLCLSLRS  120
m269.pep  SX  121
          ||
g269      SX  122
```

The following partial DNA sequence was identified in *N. meningitidis* <SEQ ID 1095>:

```
a269.seq
    1   ATGGTTTGGC GTGTGAATTG CGCGGCAACG GCGGTGCTGA TTTTTTCGTC

51   CAGCCCTTGG ATTTGGGCGG CGGTGTGGGT GTGGGCGCGG TCTGCTTTGT

101   CTTGGAGGTT TTGCGCCAGC GTGCCCGCGT CCAGCGCGCC GGCGTTGACG

151   GTTTCGCCGT GGGACTTTAT CCAGAACACG GCTTCGCCCA AGGTGTCGGC

201   GGCTTTGATG CACAGTTTTA AAACCAGGGC TTTGGGGCGG TTTTCGTCGC

251   CGCCTGTCGC CATTTTGCTG TCCGGGCGCG GGGTTAAAAA GCCGTTGTCG

301   TTTAAATTTT CGTCCGTCCA AGTCGATACG AGCGCGCTTC TCTGCCTTTC

351   GTTGTGGTCT TCGTAA
```

This corresponds to the amino acid sequence <SEQ ID 1096; ORF 269.a>:

```
a269.pep
    1   MVWRVNCAAT AVLIFSSSPW IWAAVWVWA SALSWRFCAS VPASSAPALT

51   VSPWDFIQNT ASPKVSAALM HSFKTRALGR FSSPPVAILL SGRGVKKPLS

101   FKFSSVQVDT SALLCLSLWS S*
``` m269/a269 90.1% identity in 121 aa overlap

```
                  10         20         30         40         50         59
m269.pep  MVWRVNCAATAVLIFSSSPWIWAAVWVWSRSALSCKPCATCP-RPAPALMVSPWDFIQNT
          |||||||||||||||||||||||||||| :||||| : ||:  ||||  ||||||||||
a269      MVWRVNCAATAVLIFSSSPWIWAAVWVWARSALSWRFCASVPASSAPALTVSPWDFIQNT
                  10         20         30         40         50         60

60         70         80         90        100        110        119
m269.pep  ASPKVSAALMHSFKTRALGRFSSPPVAILLSERGVKKPLSFKFSSVQVDTSALLCLSLRS
          ||||||||||||||||||||||||||||||:|||||||||||||||||||||||||| |
a269      ASPKVSAALMHSFKTRALGRFSSPPVAILLSGRGVKKPLSFKFSSVQVDTSALLCLSLWS
                  70         80         90        100        110        120

120
m269.pep  SX
          ||
a269      SX
```

The following partial DNA sequence was identified in *N. gonorrhoeae* <SEQ ID 1097>:

```
g270.seq
    1   atgaataaaa accgcaaatt actgcttgcc gcactgctgc tgactgcctt 51   tgccgccttc aagctcgttt tgttgcaatg gtggcaggcg cagcagccgc 101   aagccgtggc ggcgcaatgc gatttgaccg agggttgcac gctgccggac 151   ggaagccgtg tccgcgccgc cgccgtttca accaaaaaac cgtttgatat 201   ttatatcgaa cacgcgcccg ccggcacgga acaggtcagc atcagcttca 251   gtatgaaaaa tatggatatg ggtttcaacc gctatatgtt cgagcggcaa 301   ccgtcgggga cttggcaggc agcacgcatc cgcctgcccg tctgtgtcga 351   aggcaggcgc gattttacgg cggacattac aatcggcagc ggacatttc 401   agacggcatt taccgccgaa taa
```

This corresponds to the amino acid sequence <SEQ ID 1098; ORF 270.ng>:

```
g270.pep
    1   MNKNRKLLLA ALLLTAFAAF KLVLLQWWQA QQPQAVAAQC DLTEGCTLPD

51   GSRVRAAAVS TKKPFDIYIE HAPAGTEQVS ISFSMKNMDM GFNRYMFERQ

101   PSGTWQAARI RLPVCVEGRR DFTADITIGS RTFQTAFTAE *
```

The following partial DNA sequence was identified in *N. meningitidis* <SEQ ID 1099>:

```
m270.seq
    1   ATGAATAAAA ACCGTAAATT ACTGCTTGCC GCACTGCTGC TGATTGCCTT

51   TGCCGCCGTC AAGCTCGTTT TGTTGCAATG GTGGCAGGCG Ca.CAGCCGC

101   AAGCTGTGGC GGCGCAATGC GATTTGACCG AGGGTTGCAC GCTGCCGGAC

151   GGAAGCCGCG TCCGCGCCGC CGCcGTTTCA ACCAAAAAAC CGTTTGATAT

201   TTATATCGAA CACGCGCCCG CCGGCACGGA ACAGGTCAGC ATCAGCTTCA

251   GTATGAAAAA TATGGATATG GGTTTCaACC GCTATATGTT CGAGCGGCAA 301   cCGTCGGGGA CTTGGCAGGC AGTACGCATC CGCCTGCCCA TCTGTGTCGA

351   AGGCAGGCGC GATTTTACGG CGGACATTAC AATCGGCAGT CGGACATTTC

401   AGACGGCATT TACCGCCGAA TAA
```

This corresponds to the amino acid sequence <SEQ ID 1100; ORF 270>:

```
m270.pep
    1   MNKNRKLLLA ALLLIAFAAV KLVLLQWWQA XQPQAVAAQC DLTEGCTLPD

51   GSRVRAAAVS TKKPFDIYIE HAPAGTEQVS ISFSMKNMDM GFNRYMFERQ

101   PSGTWQAVRI RLPICVEGRR DFTADITIGS RTFQTAFTAE *
```

Computer analysis of this amino acid sequence gave the following results:
Homology with a Predicted ORF from *N. gonorrhoeae*
ORF 270 shows 96.4% identity over a 140 aa overlap with a predicted ORF (ORF 270.ng) from *N. gonorrhoeae*:

```
m270/g270
                   10         20         30         40         50         60
   m270.pep  MNKNRKLLLAALLLIAFAAVKLVLLQWWQAXQPQAVAAQCDLTEGCTLPDGSRVRAAAVS
             ||||||||||||| |||| |||||||||||| ||||||||||||||||||||||||||||
       g270  MNKNRKLLLAALLLTAFAAFKLVLLQWWQAQQPQAVAAQCDLTEGCTLPDGSRVRAAAVS
                   10         20         30         40         50         60

70         80         90        100        110        120
   m270.pep  TKKPFDIYIEHAPAGTEQVSISFSMKNMDMGFNRYMFERQPSGTWQAVRIRLPICVEGRR
             |||||||||||||||||||||||||||||||||||||||||||||||:||||:||||||
       g270  TKKPFDIYIEHAPAGTEQVSISFSMKNMDMGFNRYMFERQPSGTWQAARIRLPVCVEGRR
                   70         80         90        100        110        120

130        140
   m270.pep  DFTADITIGSRTFQTAFTAEX
             |||||||||||||||||||||
       g270  DFTADITIGSRTFQTAFTAEX
                  130        140
```

The following partial DNA sequence was identified in *N. meningitidis* <SEQ ID 1101>:

```
a270.seq
    1   ATGAATAAAA ACCGTAAATT ACTGCTTGCC GCACTGCTGC TGATTGCCTT

51   TGCCGCCGTC AAGCTCGTTT TGTTGCAATG GTGGCAGGCG CAGCAGCCGC
```

```
-continued
101   AAGCTGTGGC GGCGCAATGC GATTTGACCG AGGGTTGCAC GCTGCCGGAC

151   GGAAGCCGCG TCCGCGCCGC CGCCGTTTCA ACCAAAAAAC CGTTTGATAT

201   TTATATCGAA CACGCGCCCG CCGGCACGGA ACAGGTCAGC ATCAGCTTCA

251   GTATGAAAAA TATGGATATG GGTTTCAACC GCTATATGTT CGAGCGGCAA

301   CCGTCGGGGA CTTGGCAGGC AGTACGCATC CGCCTGCCCA TCTGTGTCGA

351   AGGCAGGCGC GATTTTACGG CGGACATTAC AATCGGCAGC CGGACATTTC

401   AGACGGCATT TACCGCCGAA TAA
```

This corresponds to the amino acid sequence <SEQ ID 1102; ORF 270.a>:

```
a270.pep
    1   MNKNRKLLLA ALLLIAFAAV KLVLLQWWQA QQPQAVAAQC DLTEGCTLPD

51   GSRVRAAAVS TKKPFDIYIE HAPAGTEQVS ISFSMKNMDM GFNRYMFERQ

101   PSGTWQAVRI RLPICVEGRR DFTADITIGS RTFQTAFTAE *
``` m270/a270 99.3% identity in 140 aa overlap

```
                 10         20         30         40         50         60
m270.pep  MNKNRKLLLAALLLIAFAAVKLVLLQWWQAXQPQAVAAQCDLTEGCTLPDGSRVRAAAVS
          |||||||||||||||||||||||||||||| |||||||||||||||||||||||||||||
a270      MNKNRKLLLAALLLIAFAAVKLVLLQWWQAQQPQAVAAQCDLTEGCTLPDGSRVRAAAVS
                 10         20         30         40         50         60

70         80         90        100        110        120
m270.pep  TKKPFDIYIEHAPAGTEQVSISFSMKNMDMGFNRYMFERQPSGTWQAVRIRLPICVEGRR
          ||||||||||||||||||||||||||||||||||||||||||||||||||||||||||||
a270      TKKPFDIYIEHAPAGTEQVSISFSMKNMDMGFNRYMFERQPSGTWQAVRIRLPICVEGRR
                 70         80         90        100        110        120

130        140
m270.pep  DFTADITIGSRTFQTAFTAEX
          |||||||||||||||||||||
a270      DFTADITIGSRTFQTAFTAEX
                130        140
```

The following partial DNA sequence was identified in *N. gonorrhoeae* <SEQ ID 1103>:

```
g271.seq
    1   atgttcagtt cgcggatggc gaggatttgg gcgacggggg taacgttgtg 51   tatggtcagt ccgtgtccgg cgttgacgac caagcccaaa tcgccggcga 101   aatgcgcgcc gttttggatg cgctcgaact gcctgatttg ttcggcgtgg 151   ctttgtgcgt cggcatatgc gccggtgtgc agctcgacaa cgggcgcgcc 201   gacatcacgg gcggcttgga tttgcctgtc gtcggcatcg ataaacaagg 251   acacgcgtat gcccgcgtcg gtcaggattt tggcgaattc ggcgattttt 301   tcctgttgcg ccaatacgtc caaaccgcct tcggtcgtga tttcctgccg 351   tttttcaggc acgatgcaca cgtcttccgg catcacttta agcgcgtttt 401   cgagcatttc ttccgtcaac gccatttcaa ggttcaggcg cgtgcggatg 451   gcgttttgga cggcaaatac atccgcgtct ttgatgtggc ggcggtcttc 501   gcgcaggtgc atggtaatca ggtctgcacc gtgcgtttcg caaccagtg 551   ccgcctccac ggggctggga taa
```

This corresponds to the amino acid sequence <SEQ ID 1104; ORF 271.ng>:

```
g271.pep
     1   MFSSRMARIW ATGVTLCMVS PCPALTTKPK SPAKCAPFWM RSNCLICSAW

51   LCASAYAPVC SSTTGAPTSR AAWICLSSAS INKDTRMPAS VRILANSAIF

101   SCCANTSKPP SVVISCRFSG TMHTSSGITL SAFSSISSVN AISRFRRVRM

151   AFLTANTSAS LMWRRSSRRC MVIRSAPCVS ATSAASTGLG *
```

The following partial DNA sequence was identified in *N. meningitidis* <SEQ ID 1105>:

```
m271.seq
     1   AwGTTCAGTT CGCGGATGGC GAGGATTTGG GCGATGGGGG TAACGTTGTG

51   TATGGTCAGT CCGTGTCCGG CGTTGACGAC CAAGCCCAAA TCGCCGGCGA

101   AATGCGCGCC GTTTTGGATG CGCTCGAACT GCCTGATTTG TTCGGCGTGG

151   CTGCGCGCGT CGGCATACGC GCCTGTGTGC AGCTCGACAA CGGGCGCGCC

201   GACATCACGG GCGGCTTGGA TTTGCCTGTC GTCGGCATCG ATAAACAAAG

251   ACACGCGTAT GCCTGCGTCG GTCAGGATTT TGGTGAACCC GGCGATTTTT

301   TCCTGTTGCG CCAATACGTC CAAACCGCCT TCGGTCGTGA TTTCCTGACG

351   TTTTTCAGGC ACGATGCACA CGTCTTCCGG CATCACTTTC AAAGCGTTTT

401   CCAACATTTC TTCCGTCAAC GCCATTTCAA GGTTCAGGCG CGTGCGGATG

451   GCGTTTTTGA CGGCAAACAC GTCCGCGTCT TTGATGTGGC GGCGGTCTTC

501   GCGCAGGTGC ATGGTAATCA AATCCGCACC GTGCGTTTCG GCAACCAGTG

551   CCGCCTCCAC GGGGCTGGGA TAA
```

This corresponds to the amino acid sequence <SEQ ID 1106; ORF 271>:

```
m271.pep
     1   XFSSRMARIW AMGVTLCMVS PCPALTTKPK SPAKCAPFWM RSNCLICSAW

51   LRASAYAPVC SSTTGAPTSR AAWICLSSAS INKDTRMPAS VRILVNPAIF

101   SCCANTSKPP SVVISXRFSG TMHTSSGITF KAFSNISSVN AISRFRRVRM

151   AFLTANTSAS LMWRRSSRRC MVIKSAPCVS ATSAASTGLG *
```

Computer analysis of this amino acid sequence gave the following results:

Homology with a Predicted ORF from *N. gonorrhoeae*

ORF 271 shows 95.2% identity over a 189 aa overlap with a predicted ORF (ORF 271.ng) from *N. gonorrhoeae*:

```
m271/g271
                    10        20        30        40        50        60
m271.pep    XFSSRMARIWAMGVTLCMVSPCPALTTKPKSPAKCAPFWMRSNCLICSAWLRASAYAPVC
             |||||||||| ||||||||||||||||||||||||||||||||||||||| ||||||||
g271        MFSSRMARIWATGVTLCMVSPCPALTTKPKSPAKCAPFWMRSNCLICSAWLCASAYAPVC
                    10        20        30        40        50        60

70        80        90       100       110       120
m271.pep    SSTTGAPTSRAAWICLSSASINKDTRMPASVRILVNPAIFSCCANTSKPPSVVISXRFSG
            ||||||||||||||||||||||||||||||||||:| |||||||||||||||||| ||||
g271        SSTTGAPTSRAAWICLSSASINKDTRMPASVRILANSAIFSCCANTSKPPSVVISCRFSG
                    70        80        90       100       110       120

130       140       150       160       170       180
m271.pep    TMHTSSGITFKAFSNISSVNAISRFRRVRMAFLTANTSASLMWRRSSRRCMVIKSAPCVS
            |||||||||::|||:||||||||||||||||||||||||||||||||||||||:||||||
g271        TMHTSSGITLSAFSSISSVNAISRFRRVRMAFLTANTSASLMWRRSSRRCMVIRSAPCVS
                   130       140       150       160       170       180
```

-continued
```
                     190
m271.pep  ATSAASTGLGX
          |||||||||||
g271      ATSAASTGLGX
                 190
```

The following partial DNA sequence was identified in *N. meningitidis* <SEQ ID 1107>:

```
a271.seq
    1    ATGTTCAGTT CGCGGATGGC GAGGATTTGG GCGATGGGGG TAACGTTGTG

51    TATGGTCAGT CCGTGTCCGG CGTTGACGAC CAAGCCCAAA TCGCTGGCAA

101    AATGCGCGCC GTTTTGGATG CGCTCGAACT GCCTGATTTG TTCGGCGTGG

151    CTGCGCGCGT CGGCATACGC GCCTGTGTGC AGCTCGACAA CGGGCGCGCC

201    GACATCACGG GCGGCTTGGA TTTGCCTGTC GTCGGCATCG ATAAACAAGG

251    ACACGCGTAT GCCCGCGTCG GTCAGGATTT TGGTGAATTC GGCAATTTTG

301    TCTTGTTGCG CCAATACGTC CAAGCCGCCT TCGGTCGTGA TTTCCTGACG

351    TTTTTCCGGC ACGATGCACA CGTCTTCCGG CATCACTTTA AGCGCGTTTT

401    CGAGCATTTC TTCCGTCAAC GCCATTTCAA GGTTCAGGCG CGTGCGGATG

451    GCGTTTTTGA CAGCAAACAC GTCCGCGTCT TTGATGTGGC GGCGGTCTTC

501    GCGCAGGTGC ATGGTAATCA GGTCGGCACC GTGCGTTTCG CAACCAGTG

551    CCGCCTCCAC GGGGCTGGGA TAA
```

This corresponds to the amino acid sequence <SEQ ID 1108; ORF 271.a>:

```
a271.pep
    1    MFSSRMARIW AMGVTLCMVS PCPALTTKPK SLAKCAPFWM RSNCLICSAW

51    LRASAYAPVC SSTTGAPTSR AAWICLSSAS INKDTRMPAS VRILVNSAIL

101    SCCANTSKPP SVVIS*RFSG TMHTSSGITL SAFSSISSVN AISRFRRVRM

151    AFLTANTSAS LMWRRSSRRC MVIRSAPCVS ATSAASTGLG *
``` m271/a271 96.3% identity in 189 aa overlap

```
                  10         20         30         40         50         60
m271.pep  XFSSRMARIWAMGVTLCMVSPCPALTTKPKSPAKCAPFWMRSNCLICSAWLRASAYAPVC
          ||||||||||||||||||||||||||||| ||||||||||||||||||||||||||||||
a271      MFSSRMARIWAMGVTLCMVSPCPALTTKPKSLAKCAPFWMRSNCLICSAWLRASAYAPVC
                  10         20         30         40         50         60

70         80         90        100        110        120
m271.pep  SSTTGAPTSRAAWICLSSASINKDTRMPASVRILVNPAIFSCCANTSKPPSVVISXRFSG
          ||||||||||||||||||||||||||||||||||||||| ||:|||||||||||||||||
a271      SSTTGAPTSRAAWICLSSASINKDTRMPASVRILVNSAILSCCANTSKPPSVVISXRFSG
                  70         80         90        100        110        120

130        140        150        160        170        180
m271.pep  TMHTSSGITFKAFSNISSVNAISRFRRVRMAFLTANTSASLMWRRSSRRCMVIKSAPCVS
          ||||||||::|||:|||||||||||||||||||||||||||||||||||||||:||||||
a271      TMHTSSGITLSAFSSISSVNAISRFRRVRMAFLTANTSASLMWRRSSRRCMVIRSAPCVS
                 130        140        150        160        170        180

190
m271.pep  ATSAASTGLGX
          |||||||||||
a271      ATSAASTGLGX
                 190
```

The following partial DNA sequence was identified in *N. gonorrhoeae* <SEQ ID 1109>:

```
g272.seq
   1  atgactgcaa aggaagaact gttcgcatgg ctgcgccata tgaacaaaaa
  51  caaaggttcc gacctgtttg tgacgaccca tttcccgccc gctatgaagc
 101  tggacggcaa aatcacccgc atcacggacg aaccgctgac ggcggaaaaa
 151  tgtatggaaa tcgccttttc gattatgagt gcgaagcagg cggaagaatt
 201  ttcatcgacc aacgagtgca atttcgccat cagcctgccg gacaccagcc
 251  gcttccgcgt caatgcgatg atacagcgcg gtgcgacggc gttggtattc
 301  cgcgcgatta ccagcaagat tcccaagttt gaaagcctga acctgccgcc
 351  ggccttgaag gatgttgcgc tgaaaaaacg cgggctggtt attttttgtcg
 401  gcggcaccgg ctcgggcaaa tcgacttcgc tcgcctcgct tatcgactac
 451  cgcaatgaaa attcgttcgg acacatcatc accatcgaag atccgatcga
 501  gtttgtccac gaacacaaaa actgcatcat tacccagcgc gaggtcggcg
 551  tggacacgga aaactggatg gcggcgttga aaaatacgct gcgtcaggcg
 601  ccggatgtga tccttatcgg cgaaatccgc gaccgtgaaa caatggacta
 651  cgccatcgcc tttgccgaaa cggggcattt gtgtatggcg acgctgcacg
 701  ccaacagcac caatcaggcg ctcgaccgca tcatcaactt cttccccgag
 751  gagcggcgcg aacaattgct gacggatttg tcgctcaacc ttcaggcgtt
 801  tatttcgcaa cgcctcgttc cgcgagacgg cggcaagggc agggtggcgg
 851  cagtcgaggt gctgctcaat tcgccctga tttcggagtt gattcacaac
 901  ggcaacatcc atgaaatcaa agaagtgatg aaaaaatcca ctaccctggg
 951  tatgcagacc ttcgaccaac acctttacca attgtatgaa aaaggcgaga
1001  tttccttgca ggatgccttg aaaaatgccg attccgcaca tgatttgcgt
1051  ttggcggtac agttgcgcag ccgcagggca caaagttccg accccgattt
1101  ggaactgctc tga
```

This corresponds to the amino acid sequence <SEQ ID 1110; ORF 272.ng>:

```
g272.pep
   1  MTAKEELFAW LRHMNKNKGS DLFVTTHFPP AMKLDGKITR ITDEPLTAEK
  51  CMEIAFSIMS AKQAEEFSST NECNFAISLP DTSRFRVNAM IQRGATALVF
 101  RAITSKIPKF ESLNLPPALK DVALKKRGLV IFVGGTGSGK STSLASLIDY
 151  RNENSFGHII TIEDPIEFVH EHKNCIITQR EVGVDTENWM AALKNTLRQA
 201  PDVILIGEIR DRETMDYAIA FAETGHLCMA TLHANSTNQA LDRIINFFPE
 251  ERREQLLTDL SLNLQAFISQ RLVPRDGGKG RVAAVEVLLN SPLISELIHN
 301  GNIHEIKEVM KKSTTLGMQT FDQHLYQLYE KGEISLQDAL KNADSAHDLR
 351  LAVQLRSRRA QSSDPDLELL *
```

The following partial DNA sequence was identified in *N. meningitidis* <SEQ ID 1111>:

```
m272.seq
   1  ATGACCGCAA AGGAAGAACT GTTCGCATGG CTGCGCCATA TGAwCCAAAA
  51  CAAAGGTTCC GACCTGTTCG TGACAACCCA TTTCCCGCCC GCAATGAAGC
 101  TGGACGGCAA AATCACCCGC ATCACGGACG AACCGCTGAC GGCGGAAAAA
```

-continued

```
 151   TGTATGGAAA TCGCCTTTTC GATTATGAGT GCGAAGCAGG CGGAAGAATT

201   TTCATCGACC AACGAGTGCA ACTTCGCCAT CAGCCTGCCG GACACCAGCC

251   GCTTCCGCGT CAATGCGATG ATACAGCgCG GCGCGACGGC GTTGGTATTC

301   CGTACGATTA CCAGCAAGAT TCCCAAGTTT GAAAGCCTGA ACCTGCCGCC

351   AGTCTTGAAG GATGTCGCGC TGAAAAAACG CGGGCTGGTT ATTTTTGTCG

401   GCGGCACCGG CTCGGGTAAA TCGACTTCGC TTGCCTCGCT TATCGACTAC

451   CGCAATGAAA ATTCGTTCGG ACACATCATC ACCATCGAAG ACCCGATCGA

501   GTTTGTCCAC GAACACAAAA ACTGCATCAT CACCCAGCGC GAGGTCGGCG

551   TGGATACGGA AAACTGGATG GcGGCGTTGA AAAACACGCT GCGTCAGGCG

601   CCTGATGTCA TCCTTATCGG CGAAATCCGT GACCGCGAAA CAATGGACTA

651   CGCCATTGCC TTTGCCGAAA CGGGGCATTT GTGTATGGCG ACGCTGCACG

701   CCAACAGCAC CAATCAGGCA CTCGACCGCA TCATCAACTT TTTCCCCGAG

751   GAGCGGCGCG AACAATTGCT GACGGATTTG TCGCTCAACC TTCAGGCGTT

801   TATTTCGCAA CGCCTCGTTC CGCGAGACGG CGGCAAGGGC AGGGTGGCGG

851   CAGTCGAGGT GCTGCTCAAT TCGCCCCtGA TTTCGGAGTT GATTCACAAC

901   GGCAACATCC ATGAAATCAA AGAAGTGATG AAAAAATCCA CTACCCTGGG

951   TATGCAGACC TTCGATCAAC ACCTTTACCA ATTGTATGAA AAAGGCGATA

1001   TTTCCCTGCA AGAAGCATTG AAAAATGCCG ATTCCGCACA CGATTTGCGT

1051   TTGGCGGTAC AGTTGCGCAG CCGCCGCGCG CAaAGTTyCA GCCCCGATTT

1101   GGnACTGCTC TGA
```

This corresponds to the amino acid sequence <SEQ ID 1112; ORF 272>:

```
m272.pep
   1   MTAKEELFAW LRHMXQNKGS DLFVTTHFPP AMKLDGKITR ITDEPLTAEK

51   CMEIAFSIMS AKQAEEFSST NECNFAISLP DTSRFRVNAM IQRGATALVF

101   RTITSKIPKF ESLNLPPVLK DVALKKRGLV IFVGGTGSGK STSLASLIDY

151   RNENSFGHII TIEDPIEFVH EHKNCIITQR EVGVDTENWM AALKNTLRQA

201   PDVILIGEIR DRETMDYAIA FAETGHLCMA TLHANSTNQA LDRIINFFPE

251   ERREQLLTDL SLNLQAFISQ RLVPRDGGKG RVAAVEVLLN SPLISELIHN

301   GNIHEIKEVM KKSTTLGMQT FDQHLYQLYE KGDISLQEAL KNADSAHDLR

351   LAVQLRSRRA QSXSPDLXLL *
```

Computer analysis of this amino acid sequence gave the following results:
Homology with a Predicted ORF from *N. gonorrhoeae*
ORF 272 shows 97.6% identity over a 370 aa overlap with a predicted ORF (ORF 272.ng) from *N. gonorrhoeae*:

```
m272/g272
                 10         20         30         40         50         60
   m272.pep   MTAKEELFAWLRHMXQNKGSDLFVTTHFPPAMKLDGKITRITDEPLTAEKCMEIAFSIMS
              ||||||||||||||:|||||||||||||||||||||||||||||||||||||||||||||
   g272       MTAKEELFAWLRHMNKNKGSDLFVTTHFPPAMKLDGKITRITDEPLTAEKCMEIAFSIMS
                 10         20         30         40         50         60
```

-continued

```
                 70        80        90       100       110       120
m272.pep  AKQAEEFSSTNECNFAISLPDTSRFRVNAMIQRGATALVFRTITSKIPKFESLNLPPVLK
          |||||||||||||||||||||||||||||||||||||||||:|||||||||||||||:||
g272      AKQAEEFSSTNECNFAISLPDTSRFRVNAMIQRGATALVFRAITSKIPKFESLNLPPALK
                 70        80        90       100       110       120

130       140       150       160       170       180
m272.pep  DVALKKRGLVIFVGGYGSGKSTSLASLIDYRNENSFGHIITIEDPIEFVHEHKNCIITQR
          ||||||||||||||||||||||||||||||||||||||||||||||||||||||||||||
g272      DVALKKRGLVIFVGGYGSGKSTSLASLIDYRNENSFGHIITIEDPIEFVHEHKNCIITQR
                130       140       150       160       170       180

190       200       210       220       230       240
m272.pep  EVGVDTENWMAALKNTLRQAPDVILIGEIRDRETMDYAIAFAETGHLCMATLHANSTNQA
          ||||||||||||||||||||||||||||||||||||||||||||||||||||||||||||
g272      EVGVDTENWMAALKNTLRQAPDVILIGEIRDRETMDYAIAFAETGHLCMATLHANSTNQA
                190       200       210       220       230       240

250       260       270       280       290       300
m272.pep  LDRIINFFPEERREQLLTDLSLNLQAFISQRLVPRDGGKGRVAAVEVLLNSPLISELIHN
          ||||||||||||||||||||||||||||||||||||||||||||||||||||||||||||
g272      LDRIINFFPEERREQLLTDLSLNLQAFISQRLVPRDGGKGRVAAVEVLLNSPLISELIHN
                250       260       270       280       290       300

310       320       330       340       350       360
m272.pep  GNIHEIKEVMKKSTTLGMQTFDQHLYQLYEKGDISLQEALKNADSAHDLRLAVQLRSRRA
          ||||||||||||||||||||||||||||||||:||||:||||||||||||||||||||||
g272      GNIHEIKEVMKKSTTLGMQTFDQHLYQLYEKGEISLQDALKNADSAHDLRLAVQLRSRRA
                310       320       330       340       350       360

370
m272.pep  QSXSPDLXLLX
          || :||| |||
g272      QSSDPDLELLX
                370
```

The following partial DNA sequence was identified in *N. meningitidis* <SEQ ID 1113>:

```
a272.seq
     1  ATGACCGCAA AGGAAGAACT GTTCGCATGG CTGCGCCATA TGAACAAAAA
    51  CAAAGGTTCC GACCTGTTCG TGACGACCCA TTTCCCGCCC GCAATGAAGC
   101  TGGACGGCAA AATCACCCGC ATCACGGACG AACCGCTGAC GGCGGAAAAA
   151  TGTATGGAAA TCGCCTTTTC GATTATGAGT GCGAAGCAGG CGGAAGAATT
   201  TTCATCGACC AACGAGTGCA ACTTCGCCAT CAGTCTGCCG GACACCAGCC
   251  GCTTCCGCGT CAATGCGATG ATACAGCGCG GTGCGACGGC GTTGGTATTC
   301  CGTGCGATTA CCAGCAAGAT TCCCAAGTTT GAAAGCCTGA ACCTGCCGCC
   351  GGTCTTGAAG GATGTCGCGC TGAAAAAACG CGGGCTGGTT ATTTTTGTCG
   401  GCGGCACCGG CTCGGGCAAA TCGACTTCGC TTGCCTCGCT TATCGACTAC
   451  CGCAATGAAA ATTCGTTCGG ACACATCATC ACCATCGAAG ACCCGATCGA
   501  GTTTGTCCAC GAACACAAAA ACTGCATCAT CACCCAGCGC GAGGTCGGCG
   551  TGGATACGGA AAACTGGATG GCGGCGTTGA AAAACACGCT GCGTCAGGCA
   601  CCGGATGTGA TTCTGATCGG CGAAATCCGC GACCGCGAAA CAATGGACTA
   651  CGCCATTGCT TTTGCCGAAA CGGGGCATTT GTGTATGGCG ACGCTGCACG
   701  CCAACAGCAC CAATCAGGCA CTCGACCGCA TCATCAACTT TTTCCCCGAG
   751  GAGCGGCGCG AACAATTGCT GACGGATTTG TCGCTCAACC TTCAGGCATT
   801  TATTTCGCAA CGCCTCGTTC CGCGAGACGG CGGCAAGGGC AGGGTGGCGG
   851  CAGTCGAGGT GCTGCTCAAT TCGCCCCTGA TTTCGGAGTT GATTCACAAC
   901  GGCAATATCC ATGAAATCAA AGAAGTGATG AAAAAATCCA CTACCCTGGG
   951  TATGCAGACT TTCGACCAAC ACCTTTACCA ATTGTATGAA AAAGGCGAGA
  1001  TTTCCTTGCA GGATGCCTTG AAAAATGCCG ATTCCGCACA CGATTTGCGT
```

```
1051  TTGGCGGTAC AGTTGCGCAG CCGCCAGGCG CAAAGTTCCG GTCCCGATTT

1101  GGAACTGCTC TGA
```

This corresponds to the amino acid sequence <SEQ ID 1114; ORF 272.a>:

```
a272.pep
    1  MTAKEELFAW LRHMNKNKGS DLFVTTHFPP AMKLDGKITR ITDEPLTAEK

51  CMEIAFSIMS AKQAEEFSST NECNFAISLP DTSRFRVNAM IQRGATALVF

101  RAITSKIPKF ESLNLPPVLK DVALKKRGLV IFVGGTGSGK STSLASLIDY

151  RNENSFGHII TIEDPIEFVH EHKNCIITQR EVGVDTENWM AALKNTLRQA

201  PDVILIGEIR DRETMDYAIA FAETGHLCMA TLHANSTNQA LDRIINFFPE

251  ERREQLLTDL SLNLQAFISQ RLVPRDGGKG RVAAVEVLLN SPLISELIHN

301  GNIHEIKEVM KKSTTLGMQT FDQHLYQLYE KGEISLQDAL KNADSAHDLR

351  LAVQLRSRQA QSSGPDLELL *
``` m272/a272 97.6% identity in 370 aa overlap

```
                   10         20         30         40         50         60
  m272.pep  MTAKEELFAWLRHMXQNKGSDLFVTTHFPPAMKLDGKITRITDEPLTAEKCMEIAFSIMS
            ||||||||||||||:||||||||||||||||||||||||||||||||||||||||||||
  a272      MTAKEELFAWLRKMNKGSDLFVTTHFPPAMKLDGKITRITDEPLTAEKCMEIAFSIMS
                   10         20         30         40         50         60

70         80         90        100        110        120
  m272.pep  AKQAEEFSSTNECNFAISLPDTSRFRVNAMIQRGATALVFRTITSKIPKFESLNLPPVLK
            |||||||||||||||||||||||||||||||||||||||||:||||||||||||||||||
  a272      AKQAEEFSSTNECNFAISLPDTSRFRVNAHIQRGATALVFRAITSKIPKFESLNLPPVLK
                   70         80         90        100        110        120

130        140        150        160        170        180
  m272.pep  DVALKKRGLVIFVGGTGSGKSTSLASLIDYRNENSFGHIITIEDPIEFVHEHKNCIITQR
            ||||||||||||||||||||||||||||||||||||||||||||||||||||||||||||
  a272      DVALKKRGLVIFVGGTGSGKSTSLASLIDYRNENSFGHIITIEDPIEFVHEHKNCIITQR
                  130        140        150        160        170        180

190        200        210        220        230        240
  m272.pep  EVGVDTENWMAALKNTLRQAPDVILIGEIRDRETMDYAIAFAETGHLCMATLHANSTNQA
            ||||||||||||||||||||||||||||||||||||||||||||||||||||||||||||
  a272      EVGVDTENWMAALKNTLRQAPDVILIGEIRDRETMDYAIAFAETGHLCMATLHANSTNQA
                  190        200        210        220        230        240

250        260        270        280        290        300
  m272.pep  LDRIINFFPEERREQLLTDLSLNLQAFISQRLVPRDGGKGRVAAVEVLLNSPLISELIHN
            |||||||||||||||||||||||||||||||||||||||||||||||||||||:||||||
  a272      LDRIINFFPEERREQLLTDLSLNLQAFISQRLVPRDGGKGRVAAVEVLLNSPLICELIHN
                  250        260        270        280        290        300

310        320        330        340        350        360
  m272.pep  GNIHEIKEVMKKSTTLGMQTFDQHLYQLYEKGDISLQEALKNADSAHDLRLAVQLRSRRA
            ||||||||||||||||||||||||||||||||||:||||:|||||||||||||||||||:|
  a272      GNIHEIKEVMKKSTTLGMQTFDQHLYQLYEKGEISLQDALKNADSAHDLRLAVQLRSRQA
                  310        320        330        340        350        360

370
  m272.pep  QSXSPDLXLLX
            ||:|||  |||
  a272      QSSGPDLELLX
                  370
```

The following partial DNA sequence was identified in *N. gonorrhoeae* <SEQ ID 1115>:

```
g273.seq
    1  atgagtcttc aggcggtatt tatatacccc ccaagccgta ccgcacaata 51  caacgaaaat caggaaaacg gcggtaaagc tcataaacag ggacaaagcg 101  gcaaacacac cgaccgccgt caggatatag gcgtattcga ggccggaact 151  ccattcaccg tttcctgcc gtttcttgtc gcttttgaaa taaaggatga
```

```
201   tgccggcaag  cagcgcggca  gccgcgcccg  acattggcat  tgtgttcatt 251   gttgttcctt  aacggttaaa  aacccgcccg  gccgtgcaac  cgttttaagg 301   cgggaaattg  caaaatttgt  ttgcgggcgc  gtgccgctga  aatcaaggcg 351   gtttgagaag  tgtttccnac  gcgcccgccc  tatgtgccga  aatattattt 401   gtcgctcacc  tgcaaaatcg  ccaagaacgc  gctttgcgga  atttccacgt 451   tgcccacttg  tttcatacgg  cgtttgcctg  cttttttgttt  ttcaagcagt 501   tttttcttac  gcgtaa
```

This corresponds to the amino acid sequence <SEQ ID 1116; ORF 273.ng>:

```
g273.pep
  1   MSLQAVFIYP  PSRTAQYNEN  QENGGKAHKQ  GQSGKHTDRR  QDIGVFEAGT

51   PFTVFLPFLV  AFEIKDDAGK  QRGSRARHWH  CVHCCSLTVK  NPPGRATVLR

101   REIAKFVCGR  VPLKSRRFEK  CFXRARPMCR  NIICRSPAKS  PRTRFAEFPR

151   CPLVSYGVCL  LFVFQAVFSY  A*
```

The following partial DNA sequence was identified in *N. meningitidis* <SEQ ID 1117>:

```
m273.seq
  1   ATGAGTCTTC  AGGCGGTATT  TATATACCCm  CCAAGCCGTA  CCGCACAATA

51   CAACGAAAAT  CAGGAAAACG  GCGGTAAAGC  TCAyAAACAG  GGACAAAGCG

101   GCAAACACGC  CGACCGCTGT  CAGGATATAG  GCGTATTCAA  GGCCGGAACT

151   CCATTCCCCG  TTTTCCTGCC  GCTTCTTGTC  GCTTTTGAAA  TAAAGGATGA

201   TGCCGGCAAG  CAGCGCGGCA  GCCGCGCCCG  ACATTAGCAT  TGTGTTCATT

251   GTTGTTCCTT  AATGCTTAAA  AACCCGCCTG  TCCGTGCAAC  CGTTTTAAGG

301   CGGCAAATTG  CAAAATTTGT  TTGCGGGCGC  GTGCCCCTGA  AATCAGGGCG

351   GTTTGAGGGG  TGTTCCCGAC  GCGCCGCCCT  GTGTGCCGGA  GTTATTTGTC

401   GCTCACCTGC  AAAATCGCCA  AGAACGCGCT  TTGCGGAATT  CCACATTGC

451   CCACTTGTTT  CATACGGCGT  TTACCTGCCT  TTTGTkTwTC  AAGCAGTTTT

501   TTCTTACGCG  TAA
```

This corresponds to the amino acid sequence <SEQ ID 1118; ORF 273>:

```
m273.pep
  1   MSLQAVFIYP  PSRTAQYNEN  QENGGKAHKQ  GQSGKHADRC  QDIGVFKAGT

51   PFPVFLPLLV  AFEIKDDAGK  QRGSRARH*H  CVHCCSLMLK  NPPVRATVLR

101   RQIAKFVCGR  VPLKSGRFEG  CSRRAALCAG  VICRSPAKSP  RTRFAEFPHC

151   PLVSYGVYLP  FVXQAVFSYA  *
```

Computer analysis of this amino acid sequence gave the following results:
Homology with a Predicted ORF from *N. gonorrhoeae*
ORF 273 shows 86.0% identity over a 171 aa overlap with a predicted ORF (ORF 273.ng) from *N. gonorrhoeae*:

```
m273/g273
                 10         20         30         40         50         60
m273.pep  MSLQAVFIYPPSRTAQYNENQENGGKAHKQGQSGKHADRCQDIGVFKAGTPFPVFLPLLV
          |||||||||||||||||||||||||||||||||||:||  ||||||:|||||  ||||:||
g273      MSLQAVFIYPPSRTAQYNENQENGGKAHKQGQSGKHTDRRQDIGVFEAGTPFTVFLPFLV
                 10         20         30         40         50         60

70         80         90        100        110        120
m273.pep  AFEIKDDAGKQRGSRARHXHCVHCCSLMLKNPPVRATVLRRQIAKFVCGRVPLKSGRFEG
          ||||||||||||||||||||  ||||||| :|||| ||||||:|||||||||||||| |||
g273      AFEIKDDAGKQRGSRARHWHCVHCCSLTVKNPPGRATVLRREIAKFVCGRVPLKSRRFEK
                 70         80         90        100        110        120

130        140        150        160        170
m273.pep  CSRRA-ALCAGVICRSPAKSPRTRFAEFPHCPLVSYGVYLPFVXQAVFSYAX
          |  ||  :|  ::||||||||||||||||:|||||||||| || ||||||||
g273      CFXRARPMCRNIICRSPAKSPRTRFAEFPRCPLVSYGVCLLFVFQAVFSYAX
                130        140        150        160        170
```

The following partial DNA sequence was identified in *N. meningitidis* <SEQ ID 1119>:

```
a273.seq
    1   ATGAGTCTTC AGGCGGTATT TGTATACCCC CCAAGCCGTA CCGCACAATA

51   CAACGAAAAT CAGGAAAACG GCGGTAAAGC TCATAAACAG GGACAAAGCG

101   GCAAACACGC CGACCGCCGT CAGGATATAG GCGTATTCCA GACCGGAACT

151   CCATTCACCG TTTTCCTGCC GCTTTTTGTC GCTTTTGAAA TAAAGGATGA

201   TGCCGGCAAG CAGCGCGGCA GCCGCGCCCG ACATTAGCAT AATGTTCATT

251   GTTGTTCCTT AACGGTTAAA AACCCGCCCG TCCGTGCAAC CGTTTTTAAG

301   AGGCGGTAAA TCACAAAGTT TGTTGGCGGA CGTGCTCTCT TACAATCAGG

351   GCGGTTTAAG GGGCATGATG CACTGCCCCG TGTGCCGGAT ATTATTTGTC

401   GCTCACCTGC AAAATTGCCA AGAACGCGCT TTGCGGGATT TCCACATTGC

451   CCACTTGTTT CATACGGCGT TTGCCTGCTT TTTGTTTTTC AAGCAGTTTT

501   TTCTTACGCG TAA
```

This corresponds to the amino acid sequence <SEQ ID 1120; ORF 273.a>:

```
a273.pep
    1   MSLQAVFVYP PSRTAQYNEN QENGGKAHKQ GQSGKHADRR QDIGVFQTGT

51   PFTVFLPLFV AFEIKDDAGK QRGSRARH*H NVHCCSLTVK NPPVRATVFK

101   RR*ITKFVGG RALLQSGRFK GHDALPRVPD IICRSPAKLP RTRFAGFPHC

151   PLVSYGVCLL FVFQAVFSYA *
``` m273/a273 80.1% identity in 171 aa overlap

```
                 10         20         30         40         50         60
m273.pep  MSLQAVFIYPPSRTAQYNENQENGGKAHKQGQSGKHADRCQDIGVFKAGTPFPVFLPLLV
          ||||||:||||||||||||||||||||||||||||||  ::||||  |||| ||||| :|
a273      MSLQAVFVYPPSRTAQYNENQENGGKAHKQGQSGKHADRRQDIGVFQTGTPFTVFLPLFV
                 10         20         30         40         50         60

70         80         90        100        110        119
m273.pep  AFEIKDDAGKQRGSRARHXHCVHCCSLMLKNPPVRATVL-RRQIAKFVCGRVPLKSGRFE
          |||||||||||||||||||  |||||| :||||||||| | ||  :||| ||  :||||:
a273      AFEIKDDAGKQRGSRARHXHNVHCCSLTVKNPPVRATVFKRRXITKFVGGRALLQSGRFK
                 70         80         90        100        110        120

120        130        140        150        160        170
m273.pep  GCSRRAALCAGVICRSPAKSPRTRFAEFPHCPLVSYGVYLPFVXQAVFSYAX
          |  :    :  :||||||| ||||||||||||||||||  ||  ||||||||
a273      GHDALPRV-PDIICRSPAKLPRTRFAGFPHCPLVSYGVCLLFVFQAVFSYAX
               130        140        150        160        170
```

The following partial DNA sequence was identified in *N. gonorrhoeae* <SEQ ID 1121>:

```
g274.seq
     1  ATGGCGGGGC CGATTTTTGT CGTCatCGCC AgcgTCGCTA TGTTTTTTGT
    51  CGCGCAGCAG CACGCGACAG ATTTGGTTAC GGACGATTAT TATAAGGATG
   101  GCAAGCATAT CGACATCCAG CTTCATCGGG ATGAAGAAGC CGTCAGACGG
   151  CATATCGGGG TGCAGGTCCT CATTTCTCCC GATATGAATG CGGCAAAAGT
   201  GTTTGTCGGc ggCgagtTTG ACGGCAAACA GCCTTTGAAC CTGCTGCTGA
   251  TGCACCCGAC CCGCAAGGCG GACGATCAAA CCGTCGCCCT CAAGCCCGTC
   301  GGCAGCGCGC AGAACGGCAG GGCGGAATAT GAGGCGGTgt tcaaAACCCT
   351  TCCGCCGGCC AACCACTGGT ATGTGCGCGT GGAggacgCG GCAGGCGTGT
   401  GGCGCGTCGA GAACAAATGG ATTACCAGCC AGGGCAATGC GGTCGATTTG
   451  ACCCCGATGG ACAAACTTTT CAATAATGCA GGAAGCAAAT AA
```

This corresponds to the amino acid sequence <SEQ ID 1122; ORF 274.ng>:

```
g274.pep
     1  MAGPIFVVIA SVAMFFVAQQ HATDLVTDDY YKDGKHIDIQ LHRDEEAVRR
    51  HIGVQVLISP DMNAAKVFVG GEFDGKQPLN LLLMHPTRKA DDQTVALKPV
   101  GSAQNGRAEY EAVFKTLPPA NHWYVRVEDA AGVWRVENKW ITSQGNAVDL
   151  TPMDKLFNNA GSK*
```

The following partial DNA sequence was identified in *N. meningitidis* <SEQ ID 1123>:

```
m274.seq
     1  ATGGCGGGGC CGATTTTTGT CGTCATCGCC AGCGTCGCTA TGTTTTTTGT
    51  CGCGCAGCAG CACGCGACAG ATTTGGTTAC GGACGATTAT TATAAAGACG
   101  GCAAACATAT CGACATCCAG CTTCATCGGG ATGAAGAAGC CGTCAGACGG
   151  CATATCGGGG TGCAGGTTCT CATTTCCCCC GATATGAATG CGGCAAAAGT
   201  GTTTGTCGGC GGCGAGTTTG ACGGCAAACA GCCTTTGAAC CTGCTGCTGA
   251  TGCACCCGAC CCGCAAGGCG GACGATCAAA CCGTCGCCCT CAAGCCCGTC
   301  GGCAGCGCGC AGAACGGCAG GGCGGAATAT GAGGCGGTGT TCAAAACCCT
   351  TTCGCCGACC AACCACTGGT ATGTGCGCGT GGAGGACGCG GCAGGCGTGT
   401  GGCGCGTCGA GAACAAATGG ATTACCAGCC AAGGCAATGC GGTCGATTTG
   451  ACCCCGATGG ACAAGCTTTT CAATAATACT GAAAGCAAAT AA
```

This corresponds to the amino acid sequence <SEQ ID 1124; ORF 274>:

```
m274.pep
     1  MAGPIFVVIA SVAMFFVAQQ HATDLVTDDY YKDGKHIDIQ LHRDEEAVRR
    51  HIGVQVLISP DMNAAKVFVG GEFDGKQPLN LLLMHPTRKA DDQTVALKPV
   101  GSAQNGRAEY EAVFKTLSPT NHWYVRVEDA AGVWRVENKW ITSQGNAVDL
   151  TPMDKLFNNT ESK*
```

Computer analysis of this amino acid sequence gave the following results:
Homology with a Predicted ORF from *N. gonorrhoeae*
ORF 274 shows 97.5% identity over a 163 aa overlap with a predicted ORF (ORF 274.ng) from *N. gonorrhoeae*:

```
g274/m274
                 10         20         30         40         50         60
g274.pep  MAGPIFVVIASVAMFFVAQQHATDLVTDDYYKDGKHIDIQLHRDEEAVRRHIGVQVLISP
          ||||||||||||||||||||||||||||||||||||||||||||||||||||||||||||
m274      MAGPIFVVIASVAMFFVAQQHATDLVTDDYYKDGKHIDIQLHRDEEAVRRHIGVQVLISP
                 10         20         30         40         50         60

70         80         90        100        110        120
g274.pep  DMNAAKVFVGGEFDGKQPLNLLLMHPTRKADDQTVALKPVGSAQNGRAEYEAVFKTLPPA
          |||||||||||||||||||||||||||||||||||||||||||||||||||||||| |:
m274      DMNAAKVFVGGEFDGKQPLNLLLMHPTRKADDQTVALKPVGSAQNGRAEYEAVFKTLSPT
                 70         80         90        100        110        120

130        140        150        160
g274.pep  NHWYVRVEDAAGVWRVENKWITSQGNAVDLTPMDKLFNNAGSKX
          ||||||||||||||||||||||||||||||||||||||:|||
m274      NHWYVRVEDAAGVWRVENKWITSQGNAVDLTPMDKLFNNTESKX
                130        140        150        160
```

The following partial DNA sequence was identified in *N. meningitidis* <SEQ ID 1125>:

```
a274.seq
    1  ATGGCGGGGC CGATTTTTGT CGTCATCGCC AGCGTCGCTA TGTTTTTTGT

51  CGCGCAGCAG CACGCGACAG ATTTGGTTAC GGACGATTAT TATAAAGACG

101  GCAAGCATAT CGACATCCAG CTTCATCGGG ATGAAGAAGC CGTCAGACGG

151  CATATCGGGG TGCAGGTTCT CATTTCCCCC GATATGAATG CGGCAAAAGT

201  GTTTGTCGGC GGCGAGTTTG ACGGCAAACA GCCTTTGAAC CTGCTGCTGA

251  TGCACCCGAC CCGCAAGGCG GACGATCAAA CCGTCGCCCT CAAGCCCGTC

301  GGCAGCGCGC AGAACGGCAG GGCGGAATAT GAGGCGGTGT TCAAAACCCT

351  TTCGCCGACC AACCACTGGT ATGTGCGCGT GGAGGACGCG GCAGGCGTGT

401  GGCGCGTCGA GAACAAATGG ATTACCAGCC AAGGCAATGC GGTCGATTTG

451  ACCCCGATGG ACAAACTTTT CAATAATACT GAAAGCAAAT AA
```

This corresponds to the amino acid sequence <SEQ ID 1126; ORF 274.a>:

```
a274.pep
    1  MAGPIFVVIA SVAMFFVAQQ HATDLVTDDY YKDGKHIDIQ LHRDEEAVRR

51  HIGVQVLISP DMNAAKVFVG GEFDGKQPLN LLLMHPTRKA DDQTVALKPV

101  GSAQNGRAEY EAVFKTLSPT NHWYVRVEDA AGVWRVENKW ITSQGNAVDL

151  TPMDKLFNNT ESK*
``` m274/a274 100.0% identity in 163 aa overlap

```
                 10         20         30         40         50         60
m274.pep  MAGPIFVVIASVAMFFVAQQHATDLVTDDYYKDGKHIDIQLHRDEEAVRRHIGVQVLISP
          ||||||||||||||||||||||||||||||||||||||||||||||||||||||||||||
a274      MAGPIFVVIASVAMFFVAQQHATDLVTDDYYKDGKHIDIQLHRDEEAVRRHIGVQVLISP
                 10         20         30         40         50         60

70         80         90        100        110        120
m274.pep  DMNAAKVFVGGEFDGKQPLNLLLMHPTRKADDQTVALKPVGSAQNGRAEYEAVFKTLSPT
          ||||||||||||||||||||||||||||||||||||||||||||||||||||||||||||
a274      DMNAAKVFVGGEFDGKQPLNLLLMHPTRKADDQTVALKPVGSAQNGRAEYEAVFKTLSPT
                 70         80         90        100        110        120
```

```
                          130         140         150         160
m274.pep    NHWYVRVEDAAGVWRVENKWITSQGNAVDLTPMDKLFNNTESKX
            ||||||||||||||||||||||||||||||||||||||||||||
a274        NHWYVRVEDAAGVWRVENKWITSQGNAVDLTPMDKLFNNTESKX
                          130         140         150         160
```

The following partial DNA sequence was identified in *N. gonorrhoeae* <SEQ ID 1127>:

```
g276.seq
     1   atgattttgc cgccatccat gacgatgatg cggtcggcgg attcgacggt
    51   ggtcaggcgg tgggcgacga tgatgccggt gcggttttcc atcaggcgtt
   101   cgagcgcttg ttggacgagg cgttcggatt cgttgtccaa tgcgctggtg
   151   gcttcgtcca ataataatat cggcgcgtct ttcaaaatgg cgcgggcgat
   201   ggcgacgcgt tgccgctgtc cgccggataa gttgctgccg ttcgatccga
   251   tgggctggtg cagtccgagc ggggatgcgt cgatcaggct ttgcaggttg
   301   gcggcttgga gggcggacag gacttcggct tcgcccgcgt cgggacggct
   351   gtatcggacg ttttcaaaca gggtgtcgtc aaacaggaat acgtcttggg
   401   agacgagggc gaattgggcg cgcaggcagt cgagtttgat gtcggcgatg
   451   tcgataccgt ctatgcagat gttgccggca gacggttcga caaagcgggg
   501   cagaaggttg acgacggtgg atttgccgct gccggaacgt ccgaccaggg
   551   cgacgcgttc gccttgtctg atgtcgaggt tgaagttgtc gagggctttg
   601   atgccgtctg aacggtattc gacatcgacg ttgcggaagc tgatgcgccc
   651   ttcgacacgc tgcggcgcga gcgtgccttt gtcctgttcg ggcggggtgt
   701   cgagaaatgc acatacgccg tcggcggcga ggaacatcgt ctgcataggg
   751   atgctgatgt tggcaaggct tttgatgggg gcgtacattt gcagcatcgc
   801   gacgatgaat gccataaatt cgccgatggt ggtgtag
```

This corresponds to the amino acid sequence <SEQ ID 1128; ORF 276.ng>:

```
g276.pep
     1   MILPPSMTMM RSADSTVVRR WATMMPVRFS IRRSSACWTR RSDSLSNALV
    51   ASSNNNIGAS FKMARAMATR CRCPPDKLLP FDPMGWCSPS GDASIRLCRL
   101   AAWRADRTSA SPASGRLYRT FSNRVSSNRN TSWETRANWA RRQSSLMSAM
   151   SIPSMQMLPA DGSTKRGRRL TTVDLPLPER PTRATRSPCL MSRLKLSRAL
   201   MPSERYSTST LRKLMRPSTR CGASVPLSCS GGVSRNAHTP SAARNIVCIG
   251   MLMLARLLMG AYICSIATMN AINSPMVV*
```

The following partial DNA sequence was identified in *N. meningitidis* <SEQ ID 1129>:

```
m276.seq
     1   ATGATTTTGC CGTCGTCCAT CACGATGATG CGGTCGGCCC CTTCGATGGT
    51   GGTCAGGCGG TGGGCGACGA TGATGCCGGT GCGGTTTTCC ATCAGGCGTT
   101   CGAGCGCCTG TTGGACGAGG CGTTCGGATT CGTTGTCTAA TGCGCTGGTG
   151   GCTTCGTCCA ATAATAATAT CGGCGCGTCT TTCAAAATGG CGCGGGCAAT
   201   GGCGACGCGT TGCCGCTGTC CGCCGGATAA GTTGCTGCCG TTCGATCCGA
```

-continued

```
251  TGGGCTGGTG CAGTCCGAGC GGGGAGCTGT CAATCAGGCT TTGCAGGTTG

301  GCGGTTTGGA GGGCGAACAG GACTTCGGCT TCGCCCGCGT CGGGACGGCT

351  GTATCGGACG TTTTCAAACA GGGTGTCGTC AAACAGGAAT ACGTCTTGGG

401  AGACGAGGGC GAATTGGGCG CGCAGGCAGT CGAGTTTGAT GTCGGCGATG

451  TCGATACCGT CTATGCAGAT GTTGCCGGCA GACGGTTCGA CAAAGCGGGG

501  CAGCAGGTTG ACGACGGTGG ATTTGCCGCT GCCGGAACGT CCGACCAGGG

551  CGACGCGTTC GCCTTGTCTG ATGTCGAGGT TGAAGTTGTC GAGGGCTTTG

601  ATGCCGTCTG AACGGTATTC GACATCGACG TTGCGGAAGC TGATGCGCCC

651  TTCGACACGC TGCGGTGCGA GCGTGCCCTT GTCCTGTTCG GGCGGGGTGT

701  CGAGAAATGC ACATACACCG TCGGCGGCGA GGAACATCGT CTGCATAGGG

751  ATGCTGATGT TGGCAAGGCT TTTGATGGGG GCGTACATTT GCAGCATCGC

801  GACGATGAAT GCCATAAATT CGCCGATGGT GGTGTAG
```

This corresponds to the amino acid sequence <SEQ ID 1130; ORF 276>:

```
m276.pep
    1  MILPSSITMM RSAPSMVVRR WATMMPVRFS IRRSSACWTR RSDSLSNALV

51  ASSNNNIGAS FKMARAMATR CRCPPDKLLP FDPMGWCSPS GELSIRLCRL

101  AVWRANRTSA SPASGRLYRT FSNRVSSNRN TSWETRANWA RRQSSLMSAM

151  SIPSMQMLPA DGSTKRGSRL TTVDLPLPER PTRATRSPCL MSRLKLSRAL

201  MPSERYSTST LRKLMRPSTR CGASVPLSCS GGVSRNAHTP SAARNIVCIG

251  MLMLARLLMG AYICSIATMN AINSPMVV*
```

Computer analysis of this amino acid sequence gave the following results:
Homology with a Predicted ORF from *N. gonorrhoeae*
ORF 276 shows 96.8% identity over a 278 aa overlap with a predicted ORF (ORF 276.ng) from *N. gonorrhoeae*:

```
m276/g276
                       10         20         30         40         50         60
    m276.pep  MILPSSITMMRSAPSMVVRRWATMMPVRFSIRRSSACWTRRSDSLSNALVASSNNNIGAS
              ||||  :||||||  ||||||||||||||||||||||||||||||||||||||||||||||
    g276      MILPPSMTMMRSADSTVVRRWATMMPVRFSIRRSSACWTRRSDSLSNALVASSNNNIGAS
                       10         20         30         40         50         60

70         80         90        100        110        120
    m276.pep  FKMARAMATRCRCPPDKLLPFDPMGWCSPSGELSIRLCRLAVWRANRTSASPASGRLYRT
              ||||||||||||||||||||||||||||||: ||||||||:|||:|||||||||||||||
    g276      FKMARAMATRCRCPPDKLLPFDPMGWCSPSGDASIRLCRLAAWRADRTSASPASGRLYRT
                       70         80         90        100        110        120

130        140        150        160        170        180
    m276.pep  FSNRVSSNRNTSWETRANWARRQSSLMSAMSIPSMQMLPADGSTKRGSRLTTVDLPLPER
              |||||||||||||||||||||||||||||||||||||||||||||| |||||||||||||
    g276      FSNRVSSNRNTSWETRANWARRQSSLMSAMSIPSMQMLPADGSTKRGRRLTTVDLPLPER
                      130        140        150        160        170        180

190        200        210        220        230        240
    m276.pep  PTRATRSPCLMSRLKLSRALMPSERYSTSTLRKLMRPSTRCGASVPLSCSGGVSRNAHTP
              ||||||||||||||||||||||||||||||||||||||||||||||||||||||||||||
    g276      PTRATRSPCLMSRLKLSRALMPSERYSTSTLRKLMRPSTRCGASVPLSCSGGVSRNAHTP
                      190        200        210        220        230        240

250        260        270    279
    m276.pep  SAARNIVCIGMLMLARLLMGAYICSIATMNAINSPMVVX
              |||||||||||||||||||||||||||||||||||||||
    g276      SAARNIVCIGMLMLARLLMGAYICSIATMNAINSPMVVX
                      250        260        270
```

The following partial DNA sequence was identified in *N. meningitidis* <SEQ ID 1131>:

```
a276.seq
      1   ATGATTTTGC CGTCGTCCAT TACGATGATG CGGTCGGCCC CTTCGATGGT

51   GGTCAGGCGG TGGGCGACGA TGATGCCGGT GCGGTTTTCC ATCAGGCGTT

101   CGAGCGCCTG TTGGACGAGG CGTTCGGATT CGTTGTCCAA TGCGCTGGTG

151   GCTTCGTCCA ATAATAATAT CGGCGCGTCT TTCAAAATGG CGCGGGCAAT

201   GGCAACGCGT TGCCGCTGTC CGCCGGATAA GTTGCTGCCG TTCGATCCGA

251   TGGGCTGGTG CAGTCCGAGC GGTGATGCGT CGATCAGGCT TTGCAGGTTA

301   GCGGCTTGGA GGGCGGATAG GACTTCGGCT TCGCCCGCGT CGGGACGGCT

351   ATATCGGACG TTTTCAAACA GGGTGTCGTC AAACAGGAAT ACGTCTTGGG

401   AGACGAGGGC AAATTGGGCG CGCAGGCAGT CGAGTTTGAT GTCGGCGATG

451   TCGATACCGT CTATGCAGAT GTTGCCGGCA GACGGTTCGA CAAAGCGGGG

501   CAGCAGGTTG ACGACGGTGG ATTTGCCGCT GCCGGAACGT CCGACCAGGG

551   CGACGCGTTC GCCTTGTCTG ATGTCGAGGT TGAAGCCGTC GAGGGCTTTG

601   ATGCCGTCCG AACGGTATTC GACATCGACG TTGCGGAAGC TGATGCGCCC

651   TTCGACACGC TGCGGTGCGA GCGTGCCTTT GTCCTGTTCG GGCGGGGTGT

701   CGAGAAATGC ACATACGCCG TCGGCGGCGA GGAACATCGT CTGCATAGGG

751   ATGCTAATGT TGGCAAGGCT TTTGATGGGG GCGTACATTT GCAGCATCGC

801   GACGATGAAT GCCATAAATT CGCCGATGGT GGTGTAG
```

This corresponds to the amino acid sequence <SEQ ID 1132; ORF 276.a>:

```
a276.pep
      1   MILPSSITMM RSAPSMVVRR WATMMPVRFS IRRSSACWTR RSDSLSNALV

51   ASSNNNIGAS FKMARAMATR CRCPPDKLLP FDPMGWCSPS GDASIRLCRL

101   AAWRADRTSA SPASGRLYRT FSNRVSSNRN TSWETRANWA RRQSSLMSAM

151   SIPSMQMLPA DGSTKRGSRL TTVDLPLPER PTRATRSPCL MSRLKPSRAL

201   MPSERYSTST LRKLMRPSTR CGASVPLSCS GGVSRNAHTP SAARNIVCIG

251   MLMLARLLMG AYICSIATMN AINSPMVV*
``` m276/a776 98.2% identity in 278 aa overlap

```
                     10        20        30        40        50        60
m276.pep    MILPSSITMMRSAPSMVVRRWATMMPVRFSIRRSSACWTRRSDSLSNALVASSNNNIGAS
            ||||||||||||||||||||||||||||||||||||||||||||||||||||||||||||
a276        MILPSSITMMRSAPSMVVRRWATMMPVRFSIRRSSACWTRRSDSLSNALVASSNNNIGAS
                     10        20        30        40        50        60

70        80        90       100       110       120
m276.pep    FKMARAMATRCRCPPDKLLPFDPMGWCSPSGELSIRLCRLAVWRANRTSASPASGRLYRT
            ||||||||||||||||||||||||||||||||: |||||||:|||:||||||||||||||
a276        FKMARAMATRCRCPPDKLLPFDPMGWCSPSGDASIRLCRLAAWRADRTSASPASGRLYRT
                     70        80        90       100       110       120

130       140       150       160       170       180
m276.pep    FSNRVSSNRNTSWETRANWARRQSSLMSAMSIPSMQMLPADGSTKRGSRLTTVDLPLPER
            ||||||||||||||||||||||||||||||||||||||||||||||||||||||||||||
a276        FSNRVSSNRNTSWETRANWARRQSSLMSAMSIPSMQMLPADGSTKRGSRLTTVDLPLPER
                    130       140       150       160       170       180

190       200       210       220       230       240
m276.pep    PTRATRSPCLMSRLKLSRALMPSERYSTSTLRKLMRPSTRCGASVPLSCSGGVSRNAHTP
            ||||||||||||||| ||||||||||||||||||||||||||||||||||||||||||||
a276        PTRATRSPCLMSRLKPSRALMPSERYSTSTLRKLMRPSTRCGASVPLSCSGGVSRNAHTP
                    190       200       210       220       230       240
```

-continued

```
              250        260        270      279
m276.pep  SAARNIVCIGMLMLARLLMGAYICSIATMNAINSPMVVX
          |||||||||||||||||||||||||||||||||||||||
a276      SAARNIVCIGMLMLARLLMGAYICSIATMNAINSPMVVX
              250        260        270
```

The following partial DNA sequence was identified in *N. gonorrhoeae* <SEQ ID 1133>:

```
g277.seq (partial)
    1    ..atggtacacg tcgccgtagc ttacggtatt gccgtccggc gtttttgccc
   51      aaacgaggtc atagacgttt tccacgcctt gcaggtacat cgccaagcgt
  101      tcgatgccgt aggtaatttc gccgagtacg ggcgtgcaat cgataccgcc
  151      gacttgttgg aaataggtaa actgggttac ttccatgccg ttgagccaga
  201      cttcccagcc caaacccac gcaccgaggg tggggttttc ccagtcgtct
  251      tcgacaaagc ggatgtcgtg gactttggga tcgatgccca attcgcgcag
  301      ggagtcgaga tagaggtctt ggatattggc ggggcgggt ttgagggcga
  351      cttggaattg gtaatagtgt tgcaggcggt tggggttgtc gccgtagcgg
  401      ccgtctttgg ggcggcggct gggttggacg taggcggcaa accaaggctc
  451      ggggccgagc gcgcgcaggc aggtggcggg atgggatgtg ccggcaccga
  501      cttccatgtc gaagggttgg atgacggtgc agcctttgtc tgcccagaag
  551      gtttgcagtt tgaagatgat ttgttggaag gtaagcatgg cttattgttc
  601      gataaaataa aggttttatt ttactgtttc catagccgct tgaatagatt
  651      tatctcgaag acagcctga
```

This corresponds to the amino acid sequence <SEQ ID 1134; ORF 277.ng>:

```
g277.pep (partial)
    1    ..MVHVAVAYGI AVRRFCPNEV IDVFHALQVH RQAFDAVGNF AEYGRAIDTA
   51      DLLEIGKLGY FHAVEPDFPA QTPRTEGGVF PVVFDKADVV DFGIDAQFAQ
  101      GVEIEVLDIG GGGFEGDLEL VIVLQAVGVV AVAAVFGAAA GLDVGGKPRL
  151      GAERAQAGGG MGCAGTDFHV EGLDDGAAFV CPEGLQFEDD LLEGKHGLLF
  201      DKIKVLFYCF HSRLNRFISK TA*
```

The following partial DNA sequence was identified in *N. meningitidis* <SEQ ID 1135>:

```
m277.seq
    1    ATGCCCCGCT TGAGGACAA GCTCGTAGGC AGGCAGGGCG AGGGCGGCGT
   51      TTTCTTCGGC AAGCAGGCGT TTGGCTTGCG CTTCGTAGTC GTTGAACTGG
  101      CGCAGCAGCC AGTCGGCATC GCTGTATTCG AAGTTGTAGG TGGATTGCTC
  151      GACTTCGTTT TGGTGGTACA CGTCGCCGTA GGTGACGGTG TTGCCGTCGA
  201      GCGTTTTTGC CCAAACGAGG TCGTAGACGT TTTCTACACC TTGCAAGTAC
  251      ATCGCCAAGC GTTCGATGCC GTAGGTGATT CGCCGAGTA CGGGCGTGCA
  301      GTCGATGCCG CCGACTTGTT GGAAATAGGT AAACTGGGTT ACTTCCATGC
  351      CGTTGAGCCA GACTTCCCAG CCCAAACCCC ACGCGCCGAG GGTGGGGTTT
  401      TCCCAGTCGT CTTCGACAAA GCGGATGTCG TGGACTTTGG GATCGATGCC
```

-continued

```
   451  CAATTCGCGC AGAGAGTCGA GATAGAGGTC TTGGATATTG GCGGGAGCGG

501  GCTTGAGGGC GACTTGGAAT TGGTAATAGT GTTGCAGGCG GTTGGGGTTG

551  TCGCCGTAGC GGCCGTCTTT GGGGCGGCGG CTGGGTTGGA CGTAGGCGGC

601  AAACCAAGGC TCGGGGCCGA GTGCGCGCAG GCAGGTGGCG GGATGGGATG

651  TGCCGGCACC GACTTCCATG TCGAAGGGTT GGATGACGGT GCAGCCTTTG

701  TCTGCCCAGA ATGTTTGCAG TTTGAAGATG ATTTGTTGGA AGGTAAGCAT

751  GGCTTATGA
```

This corresponds to the amino acid sequence <SEQ ID 1136; ORF 277>:

```
m277.pep
     1  MPRFEDKLVG RQGEGGVFFG KQAFGLRFVV VELAQQPVGI AVFEVVGGLL

51  DFVLVVHVAV GDGVAVERFC PNEVVDVFYT LQVHRQAFDA VGDFAEYGRA

101  VDAADLLEIG KLGYFHAVEP DFPAQTPRAE GGVFPVVFDK ADVVDFGIDA

151  QFAQRVEIEV LDIGGSGLEG DLELVIVLQA VGVVAVAAVF GAAAGLDVGG

201  KPRLGAECAQ AGGGMGCAGT DFHVEGLDDG AAFVCPECLQ FEDDLLEGKH

251  GL*
```

Computer analysis of this amino acid sequence gave the following results:
Homology with a Predicted ORF from *N. gonorrhoeae*
ORF 277 shows 90.0% identity over a 221 aa overlap with a predicted ORF (ORF 277.ng) from *N. gonorrhoeae*:

```
   g277/m277
                                                  10         20         30
        g277.pep                              MVHVAVAYGIAVRRFCPNEVIDVFHALQVH
                                              :|||||: |:||:||||||||:|||::||||
        m277     GLRFVVVELAQQPVGIAVFEVVGGLLDFVLVVHVAVGDGVAVERFCPNEVVDVFYTLQVH
                 30        40        50        60        70        80

40         50         60         70         80         90
        g277.pep RQAFDAVGNFAEYGRAIDTADLLEIGKLGYFHAVEPDFPAQTPRTEGGVFPVVFDKADVV
                 ||||||||:||||||||:|:|||||||||||||||||||||||||:||||||||||||||
        m277     RQAFDAVGDFAEYGRAVDAADLLEIGKLGYFHAVEPDFPAQTPRAEGGVFPVVFDKADVV
                 90        100       110       120       130       140

100        110        120        130        140        150
        g277.pep DFGIDAQFAQGVEIEVLDIGGGGFEGDLELVIVLQAVGVVAVAAVFGAAAGLDVGGKPRL
                 ||||||||||| ||||||||||:|:|||||||||||||||||||||||||||||||||||
        m277     DFGIDAQFAQRVEIEVLDIGGSGLEGDLELVIVLQAVGVVAVAAVFGAAAGLDVGGKPRL
                 150       160       170       180       190       200

160        170        180        190        200
        g277.pep GAERAQAGGGMGCAGTDFHVEGLDDGAAFVCPEGLQFEDDLLEGKHGLL
                 ||| |||||||||||||||||||||||||||||| |||||||||||||||
        m277     GAECAQAGGGMGCAGTDFHVEGLDDGAAFVCPECLQFEDDLLEGKHGLX
                 210       220       230       240       250
```

The following partial DNA sequence was identified in *N. meningitidis* <SEQ ID 1137>:

```
a277.seq
     1  ATGCCCCGCT TTGAGGACAA GCTCGTAGGC AGGCAGGGCG AGGGCGGCGT

51  TTTCTTCGGC AAGCAGGCGT TTGGCTTGCG CTTCGTAGTC GTTGAACTGG

101  CGCAGCAGCC AATCGGCATC GCTGTATTCG AAGTTGTAGG TGGATTGTTC

151  GACTTCGTTT TGGTGGTACA CGTCGCCGTA AGTTACTGTA TTACCGTCCA

201  GCGTTTTTGC CCAAACGAGG TCATAGACGT TTTCCACGCC TTGCAGGTAC
```

-continued

```
251  ATCGCCAAGC GTTCGATGCC GTAGGTGATT TCGCCGAGTA CGGGGGTGCA

301  GTCGATGCCG CCGACTTGTT GGAAATAGGT GAACTGGGTT ACTTCCATAC

351  CGTTGAGCCA GACTTCCCAG CCCAAACCCC ACGCGCCGAG GGTGGGGTTT

401  TCCCAGTCGT CTTCGACAAA GCGGATGTCG TGCACTTTGG GGTCGATGCC

451  CAATTCGCGC AGGGAGTCGA GATAGAGGTC TTGGATATTG GCGGGAGCGG

501  GCTTGAGGGC GACTTGGAAT TGGTAATAGT GTTGCAGGCG GTTGGGGTTG

551  TCGCCGTAGC GACCGTCTTT GGGGCGGCGG CTGGGTTGGA CGTAGGCGGC

601  AAACCAAGGC TCGGGGCCGA GTGCGCGCAG ACAGGTGGCG GGATGGGATG

651  TGCCGGCACC GACTTCCATG TCGAAGGGTT GGATGACGGT GCAGCCTTTG

701  TCTGCCCAGA ATGTTTGCAG TTTGAAGATG ATTTGTTGGA AGGTAAGCAT

751  GGCTTATGA
```

This corresponds to the amino acid sequence <SEQ ID 1138; ORF 277.a>:

```
a277.pep
    1  MPRFEDKLVG RQGEGGVFFG KQAFGLRFVV VELAQQPIGI AVFEVVGGLF

51  DFVLVVHVAV SYCITVQRFC PNEVIDVFHA LQVHRQAFDA VGDFAEYGGA

101  VDAADLLEIG ELGYFHTVEP DFPAQTPRAE GGVFPVVFDK ADVVHFGVDA

151  QFAQGVEIEV LDIGGSGLEG DLELVIVLQA VGVVAVATVF GAAAGLDVGG

201  KPRLGAECAQ TGGGMGCAGT DFHVEGLDDG AAFVCPECLQ FEDDLLEGKH

251  GL*
``` m277/a277 92.5% identity in 252 aa overlap

```
                 10         20         30         40         50         60
   m277.pep  MPRFEDKLVGRQGEGGVFFGKQAFGLRFVVVELAQQPVGIAVFEVVGGLLDFVLVVHVAV
             |||||||||||||||||||||||||||||||||||||:||||||||||||:|||||||||
       a277  MPRFEDKLVGRQGEGGVFFGKQAFGLRFVVVELAQQPIGIAVFEVVGGLFDFVLVVHVAV
                 10         20         30         40         50         60

70         80         90        100        110        120
   m277.pep  GDGVAVERFCPNEVVDVFYTLQVHRQAFDAVGDFAEYGRAVDAADLLEIGKLGYFHAVEP
             :  ::|:|||||||||:|||::||||||||||||||||||  |||||||||||:||||:|||
       a277  SYCITVQRFCPNEVIDVFHALQVHRQAFDAVGDFAEYGGAVDAADLLEIGELGYFHTVEP
                 70         80         90        100        110        120

130        140        150        160        170        180
   m277.pep  DFPAQTPRAEGGVFPVVFDKADVVDFGIDAQFAQRVEIEVLDIGGSGLEGDLELVIVLQA
             ||||||||||||||||||||||||:||||| ||||||||||||||||||||||||||||
       a277  DFPAQTPRAEGGVFPVVFDKADVVHFGVDAQFAQGVEIEVLDIGGSGLEGDLELVIVLQA
                130        140        150        160        170        180

190        200        210        220        230        240
   m277.pep  VGVVAVAAVFGAAAGLDVGGKPRLGAECAQAGGGMGCAGTDFHVEGLDDGAAFVCPECLQ
             |||||||:|||||||||||||||||||||:||||||||||||||||||||||||||||||
       a277  VGVVAVATVFGAAAGLDVGGKPRLGAECAQTGGGMGCAGTDFHVEGLDDGAAFVCPECLQ
                190        200        210        220        230        240

250
   m277.pep  FEDDLLEGKHGLX
             |||||||||||||
       a277  FEDDLLEGKHGLX
                250
```

The following partial DNA sequence was identified in *N. gonorrhoeae* <SEQ ID 1139>:

g278.seq (partial)
```
  1  ttgcgtgcaa tcacgcccgg tgcgattttt tcgacagggg cggtcaaagt
 51  tgtattaatc ggacctttgc cgtcgatagg ccgacccaat gcatcgacga
101  cgcgtccgac caattcgcgt ccgaccggca cttctaaaat acggccggta
151  caggtaaccg tgtcgccttc tttaatatgt tcgtactcgc ccaacactac
201  ggcaccgacg gagtcgcgct ccaggttcat cgccaagcct aaagtgttac
251  ccgggaattc gagcatctca ccttgcattg catctgacaa accatggatg
301  cgaacgatac cgtcagttac cgaaatcacc gtaccacggg tactcacttc
351  ggcatttaca gacagatttt cgatcttggc tttaatcaga tcgctaattt
401  cagcaggatt aagctgcatg aaaactctcc taattcgtca tagtcgtgta
451  caaagcactc agtttgcctt gtacagacaa atccaaaacc tgatcaccca
501  cttcaacttt ta...
```

This corresponds to the amino acid sequence <SEQ ID 1140; ORF 278.ng>:

g278.pep (partial)
```
  1  LRAITPGAIF STGAVKVVLI GPLPSIGRPN ASTTRPTNSR PTGTSKIRPV
 51  QVTVSPSLIC SYSPNTTAPT ESRSRFIAKP KVLPGNSSIS PCIASDKPWM
101  RTIPSVTEIT VPRVLTSAFT DRFSILALIR SLISAGLSCM KTLLIRHSRV
151  QSTQFALYRQ IQNLITHFNF....
```

The following partial DNA sequence was identified in *N. meningitidis* <SEQ ID 1141>:

m278.seq..
```
  1  TTGCGCGCAA TCACGCCCGG TGCGATTTTT TCGATAGGGG CGGTCAAAGT
 51  TGTATTAATC GGGCCTTTGC CGTCGATAGG CCGACCCAAT GCATCAACGA
101  CGCGTCCGAC CAGTTCGCGT CCGACCGGCA CTTCCAAGAT ACGACCGGTA
151  CAGGTAACCG TGTCGCCTTC TTTAATGTGT TCGTACTCGC CCAACACTAC
201  GGCGCCGACG GAGTCGCGCT CCAGGTTCAT CGCCAAGCCG AAAGTGTTAC
251  CCGGGAATTC GAGCATCTCA CCTTGCATTG CATCTGACAA ACCATGGATG
301  CGAACGATAC CGTCAGTTAC CGAAATTACC GTACCACAGG TACGCACTTC
351  GGCATTTACA GACAGATTTT CGATCTTGGC TTTAATCAAA TCGCTAATTT
401  CAGCAGGATT AAGCTGCATG AAAACTCTCC TAATTCGTCA TAGTCGTGTA
451  CAAGGCACTC AATTTGCCTT GTACAGACAA ATCCAAAACC TGATCACCCA
501  CTTCAACTTT TATGCCGCCA ATCAGCTCCG GTTCGATTTC GACAGAGATT
551  TTCAGCTCGC TGTCGAAACG CTTATTCAGC ATTTGCACCA ACTCGCCGAC
601  CTGTTTGTCG GTCAACGGAT AGGCACTGTA AATGACGGCA GATTTGATAT
651  GGTTGAATGA
```

This corresponds to the amino acid sequence <SEQ ID 1142; ORF 278>:

m278.pep
```
  1  LRAITPGAIF SIGAVKVVLI GPLPSIGRPN ASTTRPTSSR PTGTSKIRPV
 51  QVTVSPSLMC SYSPNTTAPT ESRSRFIAKP KVLPGNSSIS PCIASDKPWM
```

-continued

```
101  RTIPSVTEIT VPQVRTSAFT DRFSILALIK SLISAGLSCM KTLLIRHSRV

151  QGTQFALYRQ IQNLITHFNF YAANQLRFDF DRDFQLAVET LIQHLHQLAD

201  LFVGQRIGTV NDGRFDMVE*
```

Computer analysis of this amino acid sequence gave the following results:
Homology with a Predicted ORF from *N. gonorrhoeae*  10
ORF 278 shows 95.9% identity over a 170 aa overlap with a predicted ORF (ORF 278.ng) from *N. gonorrhoeae*:

```
g278/m278
                   10        20        30        40        50        60
    g278.pep  LRAITPGAIFSTGAVKVVLIGPLPSIGRPNASTTRPTNSRPTGTSKIRPVQVTVSPSLIC
              ||||||||||| |||||||||||||||||||||||||||:||||||||||||||||||:|
    m278      LRAITPGAIFSIGAVKVVLIGPLPSIGRPNASTTRPTSSRPTGTSKIRPVQVTVSPSLMC
                   10        20        30        40        50        60

70        80        90       100       110       120
    g278.pep  SYSPNTTAPTESRSRFIAKPKVLPGNSSISPCIASDKPWMRTIPSVTEITVPRVLTSAFT
              ||||||||||||||||||||||||||||||||||||||||||||||||||||:|  |||||
    m278      SYSPNTTAPTESRSRFIAKPKVLPGNSSISPCIASDKPWMRTIPSVTEITVPQVRTSAFT
                   70        80        90       100       110       120

130       140       150       160       170
    g278.pep  DRFSILALIRSLISAGLSCMKTLLIRHSRVQSTQFALYRQIQNLITHFNF
              ||||||||:||||||||||||||||||||||:|||||||||||||||||
    m278      DRFSILALIKSLISAGLSCMKTLLIRHSRVQGTQFALYRQIQNLITHFNFYAANQLRFDF
                  130       140       150       160       170       180 m278      DRDFQLAVETLIQHLHQLADLFVGQRIGTVNDGRFDMVE*
                  190       200       210
```

The following partial DNA sequence was identified in *N. meningitidis* <SEQ ID 1143>:

```
a278.seq
    1  TTGCGCGCAA TCACGCCCGG TGCGATTTTT TCGATAGGGG CGGTCAAAGT

51  TGTATTAATC GGGCCTTTGC CGTCGATAGG CCGACCCAAT GCATCAACGA

101  CGCGTCCGAC CAGTTCGCGT CCGACCGGCA CTTCCAAGAT ACGACCGGTA

151  CAGGTAACCG TGTCGCCTTC TTTAATATGT TCGTGCTCGC CCAACACTAC

201  GGCGCCGACG GAGTCGCGCT CCAGGTTCAT CGCCAAGCCG AAAGTGTTAC

251  CCGGGAATTC GAGCATCTCA CCTTGCATTG CATCTGACAA ACCATGGATG

301  CGAACGATAC CGTCAGTTAC CGAAATCACC GTACCACGGG TACGCACTTC

351  GGCATTTACA GACAGATTTT CGATCTTGGC TTTAATCAAA TCGCTAATTT

401  CAGCAGGATT AAGCTGCATG AAAACTCTCC TAATTCGTCA TAGTCGTGTA

451  CAAGGCACTC AATTTGCCTT GTACAGACAA ATCCAAAACC TGATCACCCA

501  CTTCAACTTT TATGCCGCCA ATCAGCTCCG GTTCGATTTC GACAGAGATT

551  TTCAGCTCGC TGTCGAAACG CTTATTCAGC ATTTGCGCCA ACTCGCCGAC

601  CTGTTTGTCG GTCAACGGAT AGGCACTGTA AATGACGGCA GATTTGATAT

651  GGTTGAATGA
```

This corresponds to the amino acid sequence <SEQ ID 1144; ORF 278.a>:

```
a278.pep
    1  LRAITPGAIF SIGAVKVVLI GPLPSIGRPN ASTTRPTSSR PTGTSKIRPV

51  QVTVSPSLIC SCSPNTTAPT ESRSRFIAKP KVLPGNSSIS PCIASDKPWM
```

```
        -continued
101  RTIPSVTEIT VPRVRTSAFT DRFSILALIK SLISAGLSCM KTLLIRHSRV

151  QGTQFALYRQ IQNLITHFNF YAANQLRFDF DRDFQLAVET LIQHLRQLAD

201  LFVGQRIGTV NDGRFDMVE*
``` m278/a278 98.2% identity in 219 aa overlap

```
                    10         20         30         40         50         60
m278.pep    LRAITPGAIFSIGAVKVVLIGPLPSIGRPNASTTRPTSSRPTGTSKIRPVQVTVSPSLMC
            ||||||||||||||||||||||||||||||||||||||||||||||||||||||||||:|
a278        LRAITPGAIFSIGAVKVVLIGPLPSIGRPNASTTRPTSSRPTGTSKIRPVQVTVSPSLIC
                    10         20         30         40         50         60

70         80         90        100        110        120
m278.pep    SYSPNTTAPTESRSRFIAKPKVLPGNSSISPCIASDKPWMRTIPSVTEITVPQVRTSAFT
            | ||||||||||||||||||||||||||||||||||||||||||||||||:|||||||
a278        SCSPNTTAPTESRSRFIAKPKVLPGNSSISPCIASDKPWMRTIPSVTEITVPRVRTSAFT
                    70         80         90        100        110        120

130        140        150        160        170        180
m278.pep    DRFSILALIKSLISAGLSCMKTLLIRHSRVQGTQFALYRQIQNLITHFNFYAANQLRFDF
            ||||||||||||||||||||||||||||||||||||||||||||||||||||||||||||
a278        DRFSILALIKSLISAGLSCMKTLLIRHSRVQGTQFALYRQIQNLITHFNFYAANQLRFDF
                   130        140        150        160        170        180

190        200        210        220
m278.pep    DRDFQLAVETLIQHLHQLADLFVGQRIGTVNDGRFDMVEX
            |||||||||||||||:||||||||||||||||||||||||
a278        DRDFQLAVETLIQHLRQLADLFVGQRIGTVNDGRFDMVEX
                   190        200        210        220
```

The following partial DNA sequence was identified in *N. gonorrhoeae* <SEQ ID 1145>:

```
g279.seq
    1   atgacgcgga tttgcggctg cttgatttca acggttttga gtgtttcggc 51   aagtttgtcg gcggcgggtt tcatcaggct gcaatgggaa ggaacggata 101   ccggcagcgg cagggcgcgt ttggctccgg cttctttggc ggcagccatg 151   gtgcgtccga cggcggcggc gttgcctgca atcacgactt gtccgggcga 201   gttgaagttg acggcttcga ccacttcgcc ctgtgcggat cggcacaaa 251   tctgcctgac ctgttcatct ccaaaccca aaatggccgc cattgcgcct 301   acgccttgcg gtacggcgga ctgcatcagt tcggcgcgca ggcggacgag 351   tttgacggca tcggcaaaat ccaatgcttc ggcggcgaca agcgcggtgt 401   attcgccgag gctgtgtccg gcaacggcgg caggcgtttt gccgcccact 451   tccaaatag
```

This corresponds to the amino acid sequence <SEQ ID 1146; ORF 279.ng>:

```
g279.pep
    1   MTRICGCLIS TVLSVSASLS AAGFIRLQWE GTDTGSGRAR LAPASLAAAM

51   VRPTAAALPA ITTCPGELKL TASTTSPCAD SAQICLTCSS SKPKMAAIAP

101   TPCGTADCIS SARRRTSLTA SAKSNASAAT SAVYSPRLCP ATAAGVLPPT

151   SK*
```

The following partial DNA sequence was identified in *N. meningitidis* <SEQ ID 1147>:

```
m279.seq
    1  ATAACGCGGA TTTGCGGCTG CTTGATTTCA ACGGTTTTCA GGGCTTCGGC

51  AAGTTTGTCG GCGGCGGGTT TCATCAGGCT GCAATGGGAA GGTACGGACA

101  CGGGCAGCGG CAGGGCGCGT TTGGCACCGG CTTCTTTGGC GGCAGCCATG

151  GCGCGTCCGA CGGCGGCGGC GTTGCCTGCA ATCACGATTT GTCCGGGTGA

201  GTTGAAGTTG ACGGCTTCGA CCACTTCGCT TTGGGCGGCT TCGGCACAAA

251  TGGCTTTAAC CTGCTCATCT TCCAAGCCGA GAATCGCCGC CATTGCGCCC

301  ACGCCTTGCG GTACGGCGGA CTGCATCAGT TCGGCGCGCA GGCGCACGAG

351  TTTGACCGCG TCGGCAAAAT TCAATGCGCC GGCGGCAACG AGTGCGGTGT

401  ATTCGCCGAG GCTGTGTCCG GCAACGGCGG CAGGCGTTTT GCCGCCCGCT

451  TCTAAATAG
```

This corresponds to the amino acid sequence <SEQ ID 1148; ORF 279>:

```
m279.pep
    1  ITRICGCLIS TVFRASASLS AAGFIRLQWE GTDTGSGRAR LAPASLAAAM

51  ARPTAAALPA ITICPGELKL TASTTSLWAA SAQMALTCSS SKPRIAAIAP

101  TPCGTADCIS SARRRTSLTA SAKFNAPAAT SAVYSPRLCP ATAAGVLPPA

151  SK*
```

Computer analysis of this amino acid sequence gave the following results:
Homology with a Predicted ORF from *N. gonorrhoeae*
ORF 279 shows 89.5% identity over a 152 aa overlap with a predicted ORF (ORF 279.ng) from *N. gonorrhoeae*:

```
                    10         20         30         40         50         60
    m279.pep  ITRICGCLISTVFRASASLSAAGFIRLQWEGTDTGSGRARLAPASLAAAMARPTAAALPA
              :||||||||||: :||||||||||||||||||||||||||||||||||||:||||||||
    g279      MTRICGCLISTVLSVSASLSAAGFIRLQWEGTDTGSGRARLAPASLAAAMVRPTAAALPA
                    10         20         30         40         50         60

70         80         90        100        110        120
    m279.pep  ITICPGELKLTASTTSLWAASAQMALTCSSSKPRIAAIAPTPCGTADCISSARRRTSLTA
              || ||||||||||||| |||: ||||||||::|||:|||||||||||||||||||||||
    g279      ITTCPGELKLTASTTSPCADSAQICLTCSSSKPKMAAIAPTPCGTADCISSARRRTSLTA
                    70         80         90        100        110        120

130        140        150
    m279.pep  SAKFNAPAATSAVYSPRLCPATAAGVLPPASKX
              ||| || |||||||||||||||||||||:|||
    g279      SAKSNASAATSAVYSPRLCPATAAGVLPPTSKX
                   130        140        150
```

The following partial DNA sequence was identified in *N. meningitidis* <SEQ ID 1149>:

```
a279.seq
    1  ATGACNCNGA TTTGCGGCTG CTTGATTTCA ACGGTTTNNA GGGCTTCGGC

51  GAGTTTGTCG GCGGCGGGTT TCATGAGGCT GCAATGGGAA GGTACNGACA

101  CNGGCAGCGG CAGGGCGCGT TTGGCGCCGG CTTCTTTGGC GGCAAGCATA

151  GCGCGCTCGA CGGCGGCGGC ATTGCCTGCA ATCACGACTT GTCCGGGCGA

201  GTTGAAGTTG ACGGCTTCAA CCACTTCATC CTGTGCGGAT TCGGCGCAAA

251  TTTGTTTTAC CTGTTCATCT TCCAAGCCGA GAATCGCCGC CATTGCGCCC

301  ACGCCTTGCG GTACGGCGGA CTGCATCAGT TCGGCGCGCA NGCGCACGAG
```

```
351   TTTGACCGCG TCGGCAAAAT CCAATGCGCC GGCGGCAACN AGTGCGGTGT

401   ATTCGCCGAN GCTGTGTCCG GCAACGGCGG CAGGCGTTTT GCCGCCCGCT

451   TCCGAATAG
```

This corresponds to the amino acid sequence <SEQ ID 1150;
ORF 279.a>:

```
a279.pep
    1   MTXICGCLIS TVXRASASLS AAGFMRLQWE GTDTGSGRAR LAPASLAASI

51   ARSTAAALPA ITTCPGELKL TASTTSSCAD SAQICFTCSS SKPRIAAIAP

101   TPCGTADCIS SARXRTSLTA SAKSNAPAAT SAVYSPXLCP ATAAGVLPPA

151   SE*
``` m279/a279 88.2% identity in 152 aa overlap

```
                 10         20         30         40         50         60
   m279.pep  ITRICGCLISTVFRASASLSAAGFIRLQWEGTDTGSGRARLAPASLAAAMARPTAAALPA
             :| ||||||||| |||||||||| ||||||||||||||||||||||||::|  ||||||
   a279      MTXICGCLISTVXRASASLSAAGFMRLQWEGTDTGSGRARLAPASLAASIARSTAAALPA
                 10         20         30         40         50         60

70         80         90        100        110        120
   m279.pep  ITICPGELKLTASTTSLWAASAQMALTCSSSKPRIAAIAPTPCGTADCISSARRRTSLTA
             || ||||||||||||| | |||: :|||||||||||||||||||||||||||| ||||||
   a279      ITTCPGELKLTASTTSSCADSAQICFTCSSSKPRIAAIAPTPCGTADCISSARXRTSLTA
                 70         80         90        100        110        120

130        140        150
   m279.pep  SAKFNAPAATSAVYSPRLCPATAAGVLPPASKX
             ||| |||||||||||||| ||||||||||||:|
   a279      SAKSNAPAATSAVYSPXLCPATAAGVLPPASEX
                130        140        150
```

Expression of ORF 279

The primer described in Table 1 for ORF 279 was used to locate and clone ORF 279. ORF 279 was cloned in pET and pGex vectors and expressed in E. coli as above-described. The products of protein expression and purification were analyzed by SDS-PAGE. FIG. 2A shows the results of affinity purification and FIG. 2B shows the expression in E. coli. Purified GST-fusion protein was used to immunize mice whose sera were used for ELISA (positive result), FACS analysis (FIG. 2C), western blot (FIG. 2D). These experiments confirm that 279 is a surface-exposed protein and that it is a useful immunogen. The hydrophilicity plots, antigenic index, and amphipatic regions of ORF 279 are provided in FIG. 6. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided herein.

The following partial DNA sequence was identified in *N. gonorrhoeae* <SEQ ID 1151>:

```
g280.seq
    1   atgaaacacc tcaaacttac ccttattgcc gcattgctgg ccaccgccgc 51   aactgccgca cccctccgg ttgtaaccag tttcagcatt ttaggcgacg 101   tagccaaaca aatcggcggt gagcgcgtag ccgtacaaag cctcgtcgga 151   gccaaccaag atactcatgc ctatcacatg accagtggcg acattaaaaa 201   aatccgcagt gcaaaactcg tcctgctcaa cggcttggga cttgaagccg 251   ccgacatcca acgcgccgtc aaacagagca agtatcctta tgccgaagcg 301   accaaaggca tccaacccct caaagccgaa gaagaaggcg acaccatca 351   cgaccaccat cacgaccacg atcatgacca cgaaggacac caccacgacc 401   acggcgaata tgaccccac gtctggaacg accctgttct tatgtccgac 451   tatgcccaaa acgtcgctga aaccctgata aaggccgatc ccgaaggcaa
```

-continued
```
501  agtttattat caacaacgct tgggcaacta ccaaatgcag cttaaaaaac 551  tgcacagcga cgcacaagcc gcatttaatg ccgtccctgc cgccaaacgc 601  aaagtcctga ccgggcacga cgcattttcc tacatgggca accgctacaa 651  catcagcttc atcgcccgc aaggcgtgag cagcgaagcc gagccgtccg 701  ccaaacaagt cgccgccatc atccggcaaa tcaaacgcga aggcatcaaa 751  gccgtattta ccgaaaatat caaagacacc cgcatggttg accgcatcgc 801  caaagaaacc ggcgtcaacg tcagcggcaa actgtattcc gacgcactcg 851  gcaacgcgcc cgcagacacc tacatcggca tgtaccgcca caacgtcgaa 901  gccttgacca acgcgatgaa gcaataa
```

This corresponds to the amino acid sequence <SEQ ID 1152; ORF 280.ng>:

```
g280.pep
  1  MKHLKLTLIA ALLATAATAA PLPVVTSFSI LGDVAKQIGG ERVAVQSLVG

51  ANQDTHAYHM TSGDIKKIRS AKLVLLNGLG LEAADIQRAV KQSKVSYAEA

101  TKGIQPLKAE EEGGHHHDHH HDHDHDHEGH HHDHGEYDPH VWNDPVLMSD

151  YAQNVAETLI KADPEGKVYY QQRLGNYQMQ LKKLHSDAQA AFNAVPAAKR

201  KVLTGHDAFS YMGNRYNISF IAPQGVSSEA EPSAKQVAAI IRQIKREGIK

251  AVFTENIKDT RMVDRIAKET GVNVSGKLYS DALGNAPADT YIGMYRHNVE

301  ALTNAMKQ*
```

The following partial DNA sequence was identified in *N. meningitidis* <SEQ ID 1153>:

```
m280.seq
  1  ATGAAACACC TCAAACTCAC CCTTATTGCC GCATTGCTGA CCGCCTCCGC

51  AACTGCCGCC CCCCTGCCGG TTGTAACCAG CTTCAGCATT TTAGGCGACG

101  TAGCCAAACA AATCGGCGGA GAGCGCGTAT CCATACAAAG TTTGGTCGGA

151  GCCAACCAAG ATACGCACGC CTATCATATG ACCAGTGGCG ACATTAAAAA

201  AATCCGCAGT GCAAAACTCG TCCTGCTCAA CGGCTTAGGA CTTGAAGCTG

251  CCGATGTGCA ACGCGCCGTC AAACAAAGCA AAGTATCCTA TGCCGAAGCG

301  ACCAAAGGCA TCCAACCCCT CAAAGCCGAA GAAGAAGGCG GACACCATCA

351  CGACCACGAT CATGACCACG AAGGACACCA CCATGACCAC GGCGAATATG

401  ACCCGCACGT CTGGAACGAC CCCGTCCTTA TGTCCGCCTA TGCCCAAAAC

451  GTTGCCAAAG CCCTGATAAA GGCCGATCCC GAAGGCAAAG TTTATTATCA

501  ACAACGCTTG GGCAACTACC AAATGCAGCT CAAAAAACTG CACAGCGACG

551  CACAAGCCGC ATTTAATGCC GTCCCTGCTG CCAAACGCAA AGTCCTGACC

601  GGGCACGATG CCTTTTCCTA TATGGGCAAA CGTTACCATA TCGAATTCAT

651  CGCCCCGCAA GGCGTGAGCA GCGAAGCCGA GCCTTCGGCC AAACAAGTCG

701  CCGCCATCAT CCGACAAATC AAACGCGAAG GCATCAAAGC CGTCTTTACC

751  GAAAACATCA AGGACACCCG TATGGTTGAC CGTATCGCCA AGAAACCGG

801  TGTCAACGTC AGCGGCAAAC TGTATTCCGA CGCACTCGGC AACGCGCCCG
```

-continued

```
851  CAGACACCTA CATCGGAATG TACCGCCACA ACATCAAAGC CTTGACCAAC

901  GCGATGAAGC AATAA
```

This corresponds to the amino acid sequence <SEQ ID 1154; ORF 280>:

```
m280.pep
  1  MKHLKLTLIA ALLTASATAA PLPVVTSFSI LGDVAKQIGG ERVSIQSLVG

51  ANQDTHAYHM TSGDIKKIRS AKLVLLNGLG LEAADVQRAV KQSKVSYTEA

101  TKGIQPLKAE EEGGHHHDHD HDHEGHHHDH GEYDPHVWND PVLMSAYAQN

151  VAKALIKADP EGKVYYQQRL GNYQMQLKKL HSDAQAAFNA VPAAKRKVLT

201  GHDAFSYMGK RYHIEFIAPQ GVSSEAEPSA KQVAAIIRQI KREGIKAVFT

251  ENIKDTRMVD RIAKETGVNV SGKLYSDALG NAPADTYIGM YRHNIKALTN

301  AMKQ*
```

Computer analysis of this amino acid sequence gave the following results:
Homology with a Predicted ORF from *N. gonorrhoeae*
ORF 280 shows 93.8% identity over a 308 aa overlap with a predicted ORF (ORF 280.ng) from *N. gonorrhoeae*:

```
m280/g280
                    10         20         30         40         50         60
m280.pep  MKHLKLTLIAALLTASATAAPLPVVTSFSILGDVAKQIGGERVSIQSLVGANQDTHAYHM
          |||||||||||:::|||||||||||||||||||||||||||||::|||||||||||||
g280      MKHLKLTLIAALLATAATAAPLPVVTSFSILGDVAKQIGGERVAVQSLVGANQDTHAYHM
                    10         20         30         40         50         60
                    70         80         90        100        110        119
m280.pep  TSGDIKKIRSAKLVLLNGLGLEAADVQRAVKQSKVSYTEATKGIQPLKAEEEGGHHHDH-
          ||||||||||||||||||||||||:|||||||||||||:||||||||||||||||||||
g280      TSGDIKKIRSAKLVLLNGLGLEAADIQRAVKQSKVSYAEATKGIQPLKAEEEGGHHHDHH
                    70         80         90        100        110        120
                   120        130        140        150        160        170
m280.pep  ---DHDHEGHHHDHGEYDPHVWNDPVLMSAYAQNVAKALIKADPEGKVYYQQRLGNYQMQ
             ||||||||||||||||||||||||||:::|||||||||||||||||||||||||||
g280      HDHDHDHEGHHHDHGEYDPHVWNDPVLMSDYAQNVAETLIKADPEGKVYYQQRLGNYQMQ
                   130        140        150        160        170        180
                   180        190        200        210        220        230
m280.pep  LKKLHSDAQAAFNAVPAAKRKVLTGHDAFSYMGKRYHIEFIAPQGVSSEAEPSAKQVAAI
          |||||||||||||||||||||||||||||||||:||:|||||||||||||||||||||
g280      LKKLHSDAQAAFNAVPAAKRKVLTGHDAFSYMGNRYNISFIAPQGVSSEAEPSAKQVAAI
                   190        200        210        220        230        240
                   240        250        260        270        280        290
m280.pep  IRQIKREGIKAVFTENIKDTRMVDRIAKETGVNVSGKLYSDALGNAPADTYIGMYRHNIK
          |||||||||||||||||||||||||||||||||||||||||||||||||||||||||::
g280      IRQIKREGIKAVFTENIKDTRMVDRIAKETGVNVSGKLYSDALGNAPADTYIGMYRHNVE
                   250        260        270        280        290        300
                  300
m280.pep  ALTNAMKQX
          |||||||||
g280      ALTNAMKQX
```

The following partial DNA sequence was identified in *N. meningitidis* <SEQ ID 1155>:

```
a280.seq
  1  ATGAAACACC CCAAACTCAC CCTTATCGCC GCATTGCTGA CCACTGCCGC

51  AACTGCCGCC CCCCTGCCGG TTGTAACCAG CTTCAGCATT TTAGGCGACG

101  TAGCCAAACA AATCGGCGGA GAGCGCGTAT CCATACAAAG TTTGGTCGGA

151  GCCAACCAAG ATACGCACGC CTATCATATG ACCAGCGGCG ACATTAAAAA
```

```
 201   AATCCGCAGT GCAAAACTCG TCCTGATTAA CGGCTTAGGA CTTGAAGCTG

251   CCGACATCCA ACGTGCCGTC AAACAGAGCA AAGTATCCTA TGCCGAAGCG

301   ACCAAAGGCA TCCAACCCCT CAAAGCCGAA GAAGAAGGCG GACACCATCA

351   CGACCACGAT CATGACCACG ACCATGACCA CGAAGGACAC CACCACGACC

401   ACGGCGAATA TGACCCCCAC GTCTGGAACG ACCCCGTCCT TATGTCCGCC

451   TATGCCCAAA ACGTCGCCGA AGCCCTGATA AAGGCCGACC CCGAAGGCAA

501   AGTTTATTAT CAACAACGCT TGGGCAACTA CCAAATGCAG CTCAAAAAAC

551   TGCACAGTGA CGCACAAGCC GCATTTAATG CCGTCCCTGC CGCCAAACGC

601   AAAGTCCTGA CCGGGCACGA TGCCTTTTCC TATATGGGCA AACGTTACCA

651   TATCGAATTC ATCGCCCCAC AAGGTGTGAG CAGCGAAGCC GAGCCTTCAG

701   CCAAACAAGT CGCCGCCATC ATCCGACAAA TCAAACGCGA AGGCATCAAA

751   GCCGTATTTA CCGAAAATAT CAAAGACACC CGCATGGTTG ACCGCATCGC

801   CAAAGAAACC GGTGTCAACG TCAGCGGCAA ACTGTATTCC GACGCACTCG

851   GCAACGCACC CGCAGACACC TACATCGGCA TGTACCGCCA CAACATCAAA

901   GCCTTAACCA ACGCGATGAA GCAATAA
```

This corresponds to the amino acid sequence <SEQ ID 1156; ORF 280.a>:

```
a280.pep
   1    MKHPKLTLIA ALLTTAATAA PLPVVTSFSI LGDVAKQIGG ERVSIQSLVG

51    ANQDTHAYHM TSGDIKKIRS AKLVLINGLG LEAADIQRAV KQSKVSYAEA

101    TKGIQPLKAE EEGGHHHDHD HDHDHDHEGH HHDHGEYDPH VWNDPVLMSA

151    YAQNVAEALI KADPEGKVYY QQRLGNYQMQ LKKLHSDAQA AFNAVPAAKR

201    KVLTGHDAFS YMGKRYHIEF IAPQGVSSEA EPSAKQVAAI IRQIKREGIK

251    AVFTENIKDT RMVDRIAKET GVNVSGKLYS DALGNAPADT YIGMYRHNIK

301    ALTNAMKQ*
``` m280/a280 96.4% identity in 308 aa overlap

```
                  10         20         30         40         50         60
m280.pep  MKHLKLTLIAALLTASATAAPLPVVTSFSILGDVAKQIGGERVSIQSLVGANQDTHAYHM
          ||| ||||||||||| ::|||||||||||||||||||||||||||||||||||||||||
a280      MKHPKLTLIAALLTTAATAAPLPVVTSFSILGDVAKQIGGERVSIQSLVGANQDTHAYHM
                  10         20         30         40         50         60

70         80         90        100        110        120
m280.pep  TSGDIKKIRSAKLVLLNGLGLEAADVQRAVKQSKVSYTEATKGIQPLKAEEEGGHHHDHD
          |||||||||||||||:|||||||||:|||||||||||||:||||||||||||||||||
a280      TSGDIKKIRSAKLVLINGLGLEAADIQRAVKQSKVSYAEATKGIQPLKAEEEGGHHHDHD
                  70         80         90        100        110        120

130        140        150        160        170
m280.pep  HDH----EGHHHDHGEYDPHVWNDPVLMSAYAQNVAKALIKADPEGKVYYQQRLGNYQMQ
          |||    ||||||||||||||||||||||||||||:||||||||||||||||||||||||
a280      HDHDHDHEGHHHDHGEYDPHVWNDPVLMSAYAQNVAEALIKADPEGKVYYQQRLGNYQMQ
                         130        140        150        160        170        180

180        190        200        210        220        230
m280.pep  LKKLHSDAQAAFNAVPAAKRKVLTGHDAFSYMGKRYHIEFIAPQGVSSEAEPSAKQVAAI
          ||||||||||||||||||||||||||||||||||  | |||||||||||||||||||||
a280      LKKLHSDAQAAFNAVPAAKRKVLTGHDAFSYMGNRYNIEFIAPQGVSSEAEPSAKQVAAI
                 190        200        210        220        230        240

240        250        260        270        280        290
m280.pep  IRQIKREGIKAVFTENIKDTRMVDRIAKETGVNVSGKLYSDALGNAPADTYIGMYRHNIK
          ||||||||||||||||||||||||||||||||||||||||||||||||||||||||||||
a280      IRQIKREGIKAVFTENIKDTRMVDRIAKETGVNVSGKLYSDALGNAPADTYIGMYRHNIK
                 250        260        270        280        290        300
```

```
            300
m280.pep  ALTNAMKQX
          |||||||||
a280      ALTNAMKQX
```

The following partial DNA sequence was identified in *N. gonorrhoeae* <SEQ ID 1157>:

```
g281.seq
    1   atgcactacg ccctcgcatc cgtcttctgc ctgtccctca gcgccgcacc
   51   cgtcggcgta ttcctcgtca tgcgccgtat gagcctgata ggcgacgcat
  101   tgagccacgc cgtcctgccc ggtgccgccg tcggctacat gtttgccggc
  151   ttgagcctgc ccgctatggg tgtgggcggg tttgccgccg gtatgctgat
  201   ggcgctgctt gccggactcg tcagccgctt taccaccctg aaagaagatg
  251   ccaactttgc cgccttttac ctgagcagcc tcgccatcgg cgtaatcctc
  301   atcagcaaaa acggcagcag cgtcgattta ctccacctcc ttttcggatc
  351   tgtgcttgcc gtcgatattc ccgcactgca actcatcgcc gccgtctccg
  401   gcctcacgct cattacccit gccgtcatct accgccccct ggtgctagaa
  451   agcatagacc ccttttcct caagtccgtc aacggcaaag gcgggctttg
  501   gcacgtcatt ttcctcatcc tcgtcgttat gaacctcgta tccggcttcc
  551   aagctctcgg catcctgatg tcggtcggaa ttatgatgct gcccgccatt
  601   accgcccgtt tatgggcaag aaatatgggg acgctcattc tgttgtccgt
  651   cctcatcgcc cttttttgcg gtttgatcgg gctgctcatt tcctaccaca
  701   tcgaaatccc ttccggcccc gccatcatcc tctgttgcag cgtcctttat
  751   cttttttccg tcatactcgg caaagaaggc ggcatcttgc ccaaatggtt
  801   caaaaaccac cgccaccaca ccacctga
```

This corresponds to the amino acid sequence <SEQ ID 1158; ORF 281.ng>:

```
g281.pep
    1   MHYALASVFC LSLSAAPVGV FLVMRRMSLI GDALSHAVLP GAAVGYMFAG
   51   LSLPAMGVGG FAAGMLMALL AGLVSRFTTL KEDANFAAFY LSSLAIGVIL
  101   ISKNGSSVDL LHLLFGSVLA VDIPALQLIA AVSGLTLITL AVIYRPLVLE
  151   SIDPLFLKSV NGKGGLWHVI FLILVVMNLV SGFQALGILM SVGIMMLPAI
  201   TARLWARNMG TLILLSVLIA LFCGLIGLLI SYHIEIPSGP AIILCCSVLY
  251   LFSVILGKEG GILPKWFKNH RHHTT*
```

The following partial DNA sequence was identified in *N. meningitidis* <SEQ ID 1159>:

```
m281.seq (partial)
    1   ATGCGCTACG CCCTCGCATC CGTCTTCTGC CTGTCCCTCA GTGCCGCACC
   51   CGTCGGCGTA TTCCTCGTCA TGCGCCGTAT GAGCCTGATA GGCGACGCAT
  101   TGAGCCACGC CGTCCTGCCC GGTGCCGCCG TCGGCTACAT GTTTGCCGGC
  151   TTGAGCCTGC CCGCCATGGG TTTGGGCGGC GTAGCCGCAG GCATGCTGAT
  201   GGCACTGCTT GCCGGACTCG TCAGCCGCTT CACCACCCTG AAAGAAGATG
```

```
251  CCAACTTTGC CGCCTTTTAT CTCAGCAGCC TCGCCATCGG CGTAGTCCTC

301  GTCAGCAAAA ACGGGAGCAG CGTCGATTTG CTCCACCTCC TTTTCGGCTC

351  TGTACTTGCC GTCGATATTC CTGCCCTGCA GCTCATCGCC GCCGTCTCCA

401  GCCTCACGCT CATTACCCTT GCCGTCATCT ACCGCCCGCT CGTACTCGAA

451  AGCATCGACC CCCTGTTTCT CAAATCCGTC GGCGGCAAAG GCGGGCTTTG

501  GCACGTCCTC TTTCTCGTCC TGGTCGTCAT GAACCTCGTA TCCGGCTTTC

551  AAGCCCTCGG CACACTCATG TCCGTCGGAC TCATGATGCT GCCAGCCATT

601  ACCGCCCGCC TGTGGGCGAA GCATATGGGC GCACTCATCC TCCTATCCGT

651  TCTGACAGCC CTGCTGTGCG GCTTGAGCGG ACTGCTCATT TCCTACCACA

701  TCGAAATTCC TTCCGGTCCC GCCATCATCC TCTGTTGCAG CGTCCTTTAT

751  CTCTTTTCCG TCATACTCGG CAAAGAAGGC GGCATTCTGA CC..
```

This corresponds to the amino acid sequence <SEQ ID 1160; ORF 281>:

```
m281.pep (partial)
   1  MRYALASVFC LSLSAAPVGV FLVMRRMSLI GDALSHAVLP GAAVGYMFAG

51  LSLPAMGLGG VAAGMLMALL AGLVSRFTTL KEDANFAAFY LSSLAIGVVL

101  VSKNGSSVDL LHLLFGSVLA VDIPALQLIA AVSSLTLITL AVIYRPLVLE

151  SIDPLFLKSV GGKGGLWHVL FLVLVVMNLV SGFQALGTLM SVGLMMLPAI

201  TARLWAKHMG ALILLSVLTA LLCGLSGLLI SYHIEIPSGP AIILCCSVLY

251  LFSVILGKEG GILT..
```

Computer analysis of this amino acid sequence gave the following results:
Homology with a Predicted ORF from *N. gonorrhoeae*
ORF 281 shows 93.5% identity over a 263 aa overlap with a predicted ORF (ORF 281.ng) from *N. gonorrhoeae*:

```
m281/g281
                  10         20         30         40         50         60
   m281.pep  MRYALASVFCLSLSAAPVGVFLVMRRMSLIGDALSHAVLPGAAVGYMFAGLSLPAMGLGG
             |:||||||||||||||||||||||||||||||||||||||||||||||||||||||:||
   g281      MHYALASVFCLSLSAAPVGVFLVMRRMSLIGDALSHAVLPGAAVGYMFAGLSLPAMGVGG
                  10         20         30         40         50         60

70         80         90        100        110        120
   m281.pep  VAAGMLMALLAGLVSRFTTLKEDANFAAFYLSSLAIGVVLVSKNGSSVDLLHLLFGSVLA
             |||||||||||||||||||||||||||||||||||||:|:||||||||||||||||||
   g281      FAAGMLMALLAGLVSRFTTLKEDANFAAFYLSSLAIGVILISKNGSSVDLLHLLFGSVLA
                  70         80         90        100        110        120

130        140        150        160        170        180
   m281.pep  VDIPALQLIAAVSSLTLITLAVIYRPLVLESIDPLFLKSVGGKGGLWHVLFLVLVVMNLV
             ||||||||||||:||||||||||||||||||||||||||:||||||:||:||||||||
   g281      VDIPALQLIAAVSGLTLITLAVIYRPLVLESIDPLFLKSVNGKGGLWHVIFLILVVMNLV
                 130        140        150        160        170        180

190        200        210        220        230        240
   m281.pep  SGFQALGTLMSVGLMMLPAITARLWAKHMGALILLSVLTALLCGLSGLLISYHIEIPSGP
             |||||| |||| :|||||||||||||::||:||||| ||:||| ||||||||||||||
   g281      SGFQALGILMSVGIMMLPAITARLWARNMGTLILLSVLIALFCGLIGLLISYHIEIPSGP
                 190        200        210        220        230        240

250        260
   m281.pep  AIILCCSVLYLFSVILGKEGGILT
             ||||||||||||||||||||||||
   g281      AIILCCSVLYLFSVILGKEGGILTKWLKNHRHHTTX
                 250        260        270
```

The following partial DNA sequence was identified in *N. meningitidis* <SEQ ID 1161>:

```
a281.seq
    1   ATGCGCTACG CCCTCGCATC CGTCTTCTGC CTGTCCCTCA GTGCCGCACC

51   CGTCGGCGTA TTCCTCGTCA TGCGCCGTAT GAGCCTGATA GGCGACGCAT

101   TGAGCCACGC CGTCCTGCCC GGTGCCGCCG TCGGCTACAT GTTTGCCGGC

151   TTAAGCCTGC CGCCATGGG TTTGGGCGGC GTAGCCGCAG GTATGCTGAT

201   GGCACTGCTT GCCGGACTCG TCAGCCGCTT CACCACCCTG AAAGAAGATG

251   CCAACTTTGC CGCCTTTTAT CTCAGCAGCC TCGCCATCGG TGTAGTCCTC

301   GTCAGCAAAA ACGGCAGCAG CGTCGATTTG CTCCACCTCC TTTTCGGCTC

351   CGTACTTGCC GTCGATATTC CTGCCCTGCA ACTCATCGCC GCCGTATCCA

401   CCCTCACACT GCTTACCCTT GCCGTCATCT ACCGCCCGCT CGTACTCGAA

451   AGCATCGACC CCCTGTTTCT CAAATCTGTC GGCGGCAAAG GCGGGCTTTG

501   GCACGTCCTC TTTCTCGTCC TGGTCGTCAT GAACCTCGTA TCCGGCTTTC

551   AAGCCCTCGG CACACTCATG TCCGTCGGAC TTATGATGCT GCCAGCCATT

601   ACCGCCCGCC TATGGGCGAA GCACATGGGC GCACTCATCC TCCTATCCGT

651   TCTGACAGCC CTGCTGTGCG GCTTGAGCGG ACTGCTCATT TCCTACCACA

701   TCGAAATTCC TTCCGGTCCC GCCATCATCC TCTGTTGCAG CGTCCTTTAT

751   CTCTTTTCCG TCATACTCGG CAAAGAAGGC GGCATTCTGA CCAAATGGCT

801   CAAAAACCAC CGCCACCACA CCACCTGA
```

This corresponds to the amino acid sequence <SEQ ID 1162; ORF 281.a>:

```
a281.pep
    1   MRYALASVFC LSLSAAPVGV FLVMRRMSLI GDALSHAVLP GAAVGYMFAG

51   LSLPAMGLGG VAAGMLMALL AGLVSRFTTL KEDANFAAFY LSSLAIGVVL

101   VSKNGSSVDL LHLLFGSVLA VDIPALQLIA AVSTLTLLTL AVIYRPLVLE

151   SIDPLFLKSV GGKGGLWHVL FLVLVVMNLV SGFQALGTLM SVGLMMLPAI

201   TARLWAKHMG ALILLSVLTA LLCGLSGLLI SYHIEIPSGP AIILCCSVLY

251   LFSVILGKEG GILTKWLKNH RHHTT*
``` m281/a281 99.2% identity in 264 aa overlap

```
                 10         20         30         40         50         60
   m281.pep  MRYALASVFCLSLSAAPVGVFLVMRRMSLIGDALSHAVLPGAAVGYMFAGLSLPAMGLGG
             ||||||||||||||||||||||||||||||||||||||||||||||||||||||||||||
   a281      MRYALASVFCLSLSAAPVGVFLVMRRMSLIGDALSHAVLPGAAVGYMFAGLSLPAMGLGG
                 10         20         30         40         50         60

70         80         90        100        110        120
   m281.pep  VAAGMLMALLAGLVSRFTTLKEDANFAAFYLSSLAIGVVLVSKNGSSVDLLHLLFGSVLA
             ||||||||||||||||||||||||||||||||||||||||||||||||||||||||||||
   a281      VAAGMLMALLAGLVSRFTTLKEDANFAAFYLSSLAIGVVLVSKNGSSVDLLHLLFGSVLA
                 70         80         90        100        110        120

130        140        150        160        170        180
   m281.pep  VDIPALQLIAAVSSLTLITLAVIYRPLVLESIDPLFLKSVGGKGGLWHVLFLVLVVMNLV
             ||||||||||||:|||:|||||||||||||||||||||||||||||||||||||||||||
   a281      VDIPALQLIAAVSTLTLLTLAVIYRPLVLESIDPLFLKSVGGKGGLWHVLFLVLVVMNLV
                130        140        150        160        170        180

190        200        210        220        230        240
   m281.pep  SGFQALGTLMSVGLMMLPAITARLWAKHMGALILLSVLTALLCGLSGLLISYHIEIPSGP
             ||||||||||||||||||||||||||||||||||||||||||||||||||||||||||||
   a281      SGFQALGTLMSVGLMMLPAITARLWAKHMGALILLSVLTALLCGLSGLLISYHIEIPSGP
                190        200        210        220        230        240
```

```
                  250        260
m281.pep  AIILCCSVLYLFSVILGKEGGILT
          |||||||||||||||||||||||
a281      AIILCCSVLYLFSVILGKEGGILTKWLKNHRHHTTX
                  250        260        270
```

The following partial DNA sequence was identified in *N. gonorrhoeae* <SEQ ID 1163>:

```
g282.seq
    1  atgggattgg gtatggaaat cggcaagctg attgtggctc ttttggtgct
   51  gatcaatccg tttagcgcgt tgtcgcttta ccttgacctg accaacggac
  101  acagcacgaa ggagcgcagg aaggtcgcgc ggacggccgc cgtcgccgtg
  151  tttgccgtga ttgcggtatt tgcgctgatc ggcggtgcgc tattgaaggt
  201  tttgggcatc agcgtcggtt cgtttcaggt cggcggcggg attttggtgc
  251  tgctgatcgc catttcgatg atgaacggca acgacaatcc cgccaagcag
  301  aatctcggcg cgcagccgga aacggggcaa gcgcgccccg cccgcaatgc
  351  aggggcgatt gccgtcgtgc ccatcgccat accgatcacc atcggtccgg
  401  gcggtatttc gactgtgatt atttatgctt cggcagccaa aacgtacagc
  451  gatatcgcgc tgattatcgc ggccggtttg gtggtcagtg cgatttgtta
  501  tgccatttta atcgttgccg ggaaggtcag ccgcctgctg ggcgcgacgg
  551  ggctgacgat tttaaaccgc attatgggta tgatgctggc ggcggtatcg
  601  gtggagatta ttgtgtcggg actgaaaacg atattcccgc aactggcagg
  651  ttga
```

This corresponds to the amino acid sequence <SEQ ID 1164; ORF 282.ng>:

```
g282.pep
    1  MGLGMEIGKL IVALLVLINP FSALSLYLDL TNGHSTKERR KVARTAAVAV
   51  FAVIAVFALI GGALLKVLGI SVGSFQVGGG ILVLLIAISM MNGNDNPAKQ
  101  NLGAQPETGQ ARPARNAGAI AVVPIAIPIT IGPGGISTVI IYASAAKTYS
  151  DIALIIAAGL VVSAICYAIL IVAGKVSRLL GATGLTILNR IMGMMLAAVS
  201  VEIIVSGLKT IFPQLAG*
```

The following partial DNA sequence was identified in *N. meningitidis* <SEQ ID 1165>:

```
m282.seq
    1  ATGGGATTGG GCATGGAAAT CGGCAAGCTG ATTGTGGCTT TTTTGGTGCT
   51  GATTAATCCG TTTAGCGCGT TGTCGCTTTA CCTTGACCTG ACCAACGGGC
  101  ACAGCACGAA GGAGCGCAGG AAGGTCGCGC GGACGGCCGC CGTTGCCGTG
  151  TTTGCCGTGA TTGCGGTATT TGCGCTGATC GGCGGTACGC TGCTGAAGGT
  201  TTTGGGCATC AGCGTCGGTT CGTTTCAGGT CGGCGGCGGG ATTTTGGTGC
  251  TGCTGATCGC CATTTCGATG ATGAACGGCA ACGACAATCC CGCCAAGCAG
  301  AATCTCGGCG CGCAGCCGGA AACGGGGCAG GCGCGCCCCG CCCGCAATGC
  351  CGGAGCGATT GCCGTCGTGC CCATCGCCAT ACCGATCACC ATCGGCCCGG
  401  GCGGTATTTC GACCGTGATT ATTTACGCTT CGGCGGCTAA AACATACGGC
```

-continued

```
451  GACATCGCGT TGATTATCGC GGCCGGTTTG GTGGTCAGTG CGATTTGTTA

501  TGCCATTTTA ATCGTTGCCG GGAAGGTCAG CCGCCTGCTG GGCGCGACGG

551  GGCTGACGAT TTTAAACCGC ATTATGGGTA TGATGCTGGC GGCGGTATCG

601  GTGGAGATTA TTGTGTCGGG ACTGAAAACG ATATTCCCGC AACTGGCAGG

651  TTGA
```

This corresponds to the amino acid sequence <SEQ ID 1166; ORF 282.ng>:

```
m282.pep
    1  MGLGMEIGKL IVAFLVLINP FSALSLYLDL TNGHSTKERR KVARTAAVAV

51  FAVIAVFALI GGTLLKVLGI SVGSFQVGGG ILVLLIAISM MNGNDNPAKQ

101  NLGAQPETGQ ARPARNAGAI AVVPIAIPIT IGPGGISTVI IYASAAKTYG

151  DIALIIAAGL VVSAICYAIL IVAGKVSRLL GATGLTILNR IMGMMLAAVS

201  VEIIVSGLKT IFPQLAG*
```

Computer analysis of this amino acid sequence gave the following results:
Homology with a Predicted ORF from *N. gonorrhoeae*
ORF 282 shows 98.6% identity over a 217 aa overlap with a predicted ORF (ORF 282.ng) from *N. gonorrhoeae*:

```
m282/g282
                 10         20         30         40         50         60
    m282.pep  MGLGMEIGKLIVAFLVLINPFSALSLYLDLTNGHSTKERRKVARTAAVAVFAVIAVFALI
              ||||||||||||:|||||||||||||||||||||||||||||||||||||||||||||||
        g282  MGLGMEIGKLIVALLVLINPFSALSLYLDLTNGHSTKERRKVARTAAVAVFAVIAVFALI
                 10         20         30         40         50         60

70         80         90        100        110        120
    m282.pep  GGTLLKVLGISVGSFQVGGGILVLLIAISMMNGNDNPAKQNLGAQPETGQARPARNAGAI
              ||:|||||||||||||||||||||||||||||||||||||||||||||||||||||||||
        g282  GGALLKVLGISVGSFQVGGGILVLLIAISMMNGNDNPAKQNLGAQPETGQARPARNAGAI
                 70         80         90        100        110        120

130        140        150        160        170        180
    m282.pep  AVVPIAIPITIGPGGISTVIIYASAAKTYGDIALIIAAGLVVSAICYAILIVAGKVSRLL
              ||||||||||||||||||||||||||||||:|||||||||||||||||||||||||||||
        g282  AVVPIAIPITIGPGGISTVIIYASAAKTYSDIALIIAAGLVVSAICYAILIVAGKVSRLL
                130        140        150        160        170        180

190        200        210
    m282.pep  GATGLTILNRIMGMMLAAVSVEIIVSGLKTIFPQLAGX
              |||||||||||||||||||||||||||||||||||||
        g282  GATGLTILNRIMGMMLAAVSVEIIVSGLKTIFPQLAGX
                190        200        210
```

The following partial DNA sequence was identified in *N. meningitidis* <SEQ ID 1167>:

```
a282.seq
    1  ATGGGATTGG GCATGGAAAT CGGCAAGCTG ATTGTGGCTT TTTTGGTGCT

51  GATTAATCCG TTTAGCGCGT TGTCGCTTTA CCTTGACCTG ACCAACGGGC

101  ACAGCACGAA GGAGCGCAGG AAGGTCGCGC GGACGGCCGC CGTTGCCGTG

151  TTTGCCGTGA TTGCGGTATT TGCGCTGATC GGCGGTACGC TGCTGAAGGT

201  TTTGGGCATC AGCGTCGGTT CGTTTCAGGT CGGCGGCGGA ATTTTGGTGT

251  TGCTGATTGC CATTTCGATG ATGAACGGCA ACGACAATCC CGCCAAGCAG

301  AATCTCGGCG CGCAGCCGGA AACGGGGCAG GTGCGCCCCG CCCGCAATGC

351  CGGAGCGATT GCCGTCGTGC CCATCGCCAT ACCGATCACC ATCGGCCCGG
```

-continued

```
401  GCGGTATTTC GACCGTGATT ATTTACGCTT CGGCGGCTAA AACATACGGC

451  GACATCGCGT TGATTATCGC GGCCGGTTTG GTGGTCAGTG CGATTTGTTA

501  TGCCATTTTA ATCGTTGCCG GGAAGGTCAG CCGCCTGCTG GGTGCGACGG

551  GGCTGACGAT TTTAAACCGT ATCATGGGTA TGATGCTGGC GGCGGTATCG

601  GTGGAGATTA TTGTGTCGGG ACTGAAAATG ATATTCCCGC AACTGGCAGG

651  TTGA
```

This corresponds to the amino acid sequence <SEQ ID 1168; ORF 282.a>:

```
a282.pep
  1  MGLGMEIGKL IVAFLVLINP FSALSLYLDL TNGHSTKERR KVARTAAVAV

51  FAVIAVFALI GGTLLKVLGI SVGSFQVGGG ILVLLIAISM MNGNDNPAKQ

101  NLGAQPETGQ VRPARNAGAI AVVPIAIPIT IGPGGISTVI IYASAAKTYG

151  DIALIIAAGL VVSAICYAIL IVAGKVSRLL GATGLTILNR IMGMMLAAVS

201  VEIIVSGLKM IFPQLAG*
``` m282/a282 99.1% identity in 217 aa overlap

```
                 10         20         30         40         50         60
m282.pep  MGLGMEIGKLIVAFLVLINPFSALSLYLDLTNGHSTKERRKVARTAAVAVFAVIAVFALI
          ||||||||||||||||||||||||||||||||||||||||||||||||||||||||||||
a282      MGLGMEIGKLIVAFLVLINPFSALSLYLDLTNGHSTKERRKVARTAAVAVFAVIAVFALI
                 10         20         30         40         50         60

70         80         90        100        110        120
m282.pep  GGTLLKVLGISVGSFQVGGGILVLLIAISMMNGNDNPAKQNLGAQPETGQARPARNAGAI
          |||||||||||||||||||||||||||||||||||||||||||||||||||:||||||||
a282      GGTLLKVLGISVGSFQVGGGILVLLIAISMMNGNDNPAKQNLGAQPETGQVRPARNAGAI
                 70         80         90        100        110        120

130        140        150        160        170        180
m282.pep  AVVPIAIPITIGPGGISTVIIYASAAKTYGDIALIIAAGLVVSAICYAILIVAGKVSRLL
          ||||||||||||||||||||||||||||||||||||||||||||||||||||||||||||
a282      AVVPIAIPITIGPGGISTVIIYASAAKTYGDIALIIAAGLVVSAICYAILIVAGKVSRLL
                130        140        150        160        170        180

190        200        210
m282.pep  GATGLTILNRIMGMMLAAVSVEIIVSGLKTIFPQLAGX
          ||||||||||||||||||||||||||||| ||||||||
a282      GATGLTILNRIMGMMLAAVSVEIIVSGLKMIFPQLAGX
                190        200        210
```

The following partial DNA sequence was identified in *N. gonorrhoeae* <SEQ ID 1169>:

```
g283.seq
  1  atgaactttg ctttatccgt catcacattt accctcgcct ctttcctgcc 51  cgtcccgcct gccggaaccg ccgtctttac ttggaaagac ggcggcggca 101  acagctattc ggatgtgccg aaacagcttc atcccgacca gagccaaatc 151  ctcaacctgc ggacgctcca aaccaaaccg gcggtcaagc ccaaacctgc 201  cgtcgatacg aatgcggaca gtgcgaagga aaacgaaaag gatatcgccg 251  agaaaacgg gcagcttgag gaagaaaaga aaaaattgc cgaaaccgaa 301  cggcagaaca aagaagaaaa ctgccggatt tcaaaaatga acctgaaggc 351  ggtgggaaac tcaaatgcga aaaacaagga tgatttgatc cgtaaataca 401  ataacgccgt aaacaaatac tgccgttaa
```

This corresponds to the amino acid sequence <SEQ ID 1170; ORF 283.ng>:

```
g283.pep
    1  MNFALSVITF TLASFLPVPP AGTAVFTWKD GGGNSYSDVP KQLHPDQSQI

51  LNLRTLQTKP AVKPKPAVDT NADSAKENEK DIAEKNGQLE EEKKKIAETE

101  RQNKEENCRI SKMNLKAVGN SNAKNKDDLI RKYNNAVNKY CR*
```

The following partial DNA sequence was identified in N. meningitidis <SEQ ID 1171>:

```
m283.seq
    1  ATGAACTTTG CTTTATCCGT CATTATGTTG ACCCTCGCCT CTTTCCTGCC

51  CGTCCCGCCT GCCGGAGCCG CCGTCTTTAC TTGGAAGGAC GGCGGCGGCA

101  ACAGCTATTC GGATGTACCG AAACAGCTTC ATCCCGACCA AAGCCAAATC

151  TTAAACCTGC GGACGCGCCA AACCAAACCG GCGGTCAAAC CCGCCCAAGC

201  CGACGCAGGG AAGCGCACAG ACGGCGCGGC ACAGGAAAAC AATCCCGACA

251  CTGCCGAGAA AAACCGGCAG CTTGAGGAAG AAAAGAAAAG AATTGCCGAA

301  ACCGAACGGC AGAACAAAGA AGAAAACTGC CGGATTTCAA AAATGAACCT

351  GAAGGCGGTG GGAAATTCAA ATGCAAAAAA CAAGGATGAT TTGATTCGGA

401  AATACAATAA CGCCGTAAAC AAATACTGCC GTTAA
```

This corresponds to the amino acid sequence <SEQ ID 1172; ORF 283>:

```
m283.pep
    1  MNFALSVIML TLASFLPVPP AGAAVFTWKD GGGNSYSDVP KQLHPDQSQI

51  LNLRTRQTKP AVKPAQADAG KRTDGAAQEN NPDTAEKNRQ LEEEKKRIAE

101  TERQNKEENC RISKMNLKAV GNSNAKNKDD LIRKYNNAVN KYCR*
```

Computer analysis of this amino acid sequence gave the following results:
Homology with a Predicted ORF from N. gonorrhoeae
    m283/g283 86.1% identity in 144 aa overlap

```
                    10         20         30         40         50         60
   m283.pep  MNFALSVIMLTLASFLPVPPAGAAVFTWKDGGGNSYSDVPKQLHPDQSQILNLRTRQTKP
             ||||||||:|||||||||||:||||||||||||||||||||||||||||||||| ||||
       g283  MNFALSVITFTLASFLPVPPAGTAVFTWKDGGGNSYSDVPKQLHPDQSQILNLRTLQTKP
                    10         20         30         40         50         60

70         80         90        100        110        120
   m283.pep  AVKPAQADAGKRTDGAAQENNPDTAEKNRQLEEEKKRIAETERQNKEENCRISKMNLKAV
             ||||  :  : :|:|: | |||| ||||||:|||||||||||||||||||||||||||||
       g283  AVKPKPA-VDTNAD-SAKENEKDIAEKNGQLEEEKKKIAETERQNKEENCRISKMNLKAV
                       70         80         90        100        110

130        140
   m283.pep  GNSNAKNKDDLIRKYNNAVNKYCRX
             |||||||||||||||||||||||||
       g283  GNSNAKNKDDLIRKYNNAVNKYCRX
                   120        130        140
```

The following partial DNA sequence was identified in N. meningitidis <SEQ ID 1173>:

```
a283.seq
    1  ATGAACTTTG CTTTATCCGT CATTATGTTG ACCCTCGCCT CTTTCCTGCC

51  CGTCCCGCCT GCCGGAGCCG CCGTCTTTAC TTGGAAGGAC GGCGGCGGCA
```

-continued

```
101  ACAGCTATTC GGATGTACCG AAACAGCTTC ATCCCGACCA AAGCCAAATC
151  TTAAACCTGC GGACGCGCCA AACCAAACCG GCGGTCAAAC CCGCCCAAGC
201  CGACGCAGGG AAGCGCACAG ACGGCGCGGC ACAGGAAAAC AATCCCGACA
251  CTGCCGAGAA AAACCGGCAG CTTGAGGAAG AAAAGAAAAG AATTGCCGAA
301  ACCGAACGGC AGAACAAAGA AGAAACTGC CGGATTTCAA AAATGAACCT
351  GAAAGCGGTG GGAAATTCAA ATGCAAAAAA CAAGGATGAT TTGATTCGGA
401  AATACAATAA CGCCGTAAAC AAATACTGCC GTTAA
```

This corresponds to the amino acid sequence <SEQ ID 1174;
ORF 283.a>:

```
a283.pep
    1  MNFALSVIML TLASFLPVPP AGAAVFTWKD GGGNSYSDVP KQLHPDQSQI

51  LNLRTRQTKP AVKPAQADAG KRTDGAAQEN NPDTAEKNRQ LEEEKKRIAE

101  TERQNKEENC RISKMNLKAV GNSNAKNKDD LIRKYNNAVN KYCR*
``` m283/a283 100.0% identity in 144 aa overlap

```
                 10         20         30         40         50         60
m283.pep  MNFALSVIMLTLASFLPVPPAGAAVFTWKDGGGNSYSDVPKQLHPDQSQILNLRTRQTKP
          ||||||||||||||||||||||||||||||||||||||||||||||||||||||||||||
a283      MNFALSVIMLTLASFLPVPPAGAAVFTWKDGGGNSYSDVPKQLHPDQSQILNLRTRQTKP
                 10         20         30         40         50         60

70         80         90        100        110        120
m283.pep  AVKPAQADAGKRTDGAAQENNPDTAEKNRQLEEEKKRIAETERQNKEENCRISKMNLKAV
          ||||||||||||||||||||||||||||||||||||||||||||||||||||||||||||
a283      AVKPAQADAGKRTDGAAQENNPDTAEKNRQLEEEKKRIAETERQNKEENCRISKMNLKAV
                 70         80         90        100        110        120

130        140
m283.pep  GNSNAKNKDDLIRKYNNAVNKYCRX
          |||||||||||||||||||||||||
a283      GNSNAKNKDDLIRKYNNAVNKYCRX
                130        140
```

The following partial DNA sequence was identified in *N. gonorrhoeae* <SEQ ID 1175>:

```
g284.seq.
    1  atgccgtctg aaactcgaaa tcggtttcag acggcattgg tttacgcggc 51  aggttggggc ttagcggtct ttgtaacggc attcgctttt gcctgcaaaa 101  gagtcgccgg ctttgcgttt gcctttgaag ccttcgccgg tttttttgaa 151  actgtctttc ttaaagcctt cttcttgaa accttcgccg cgcgttttgc 201  cgccgaagcc ttctttgccc ggtttatgat cgccgcgccg gccgccggat 251  ttcctatcgc cccagccgcc tttgcctttc ggcttgccgc ctgcggattt 301  gcgtttgcgg gccggctcca tgccttcgat ggtcagttcg ggcagtttgc 351  ggttaatgta tttttcgatt ttgtggactt tgacgtattc gttcacttcg 401  gcaaacgtaa tcgcaatacc cgtgcggcct gcgcggccgg tgcgcccgat 451  gcggtggacg tagtcttccg cctgtttcgg caggtcgtag tttatgacgt 501  gggtaatggt cggtacgtca ataccgcgtg cggcaacgtc ggtggcaacc 551  aaaatttgc agcggccttt acgcaaatcc gtcagcgtgc ggttgcgcca 601  gccctgcggc atatcgccgt gcaggcagtt ggcggcgaaa ccttttttcgt
```

```
-continued
 651    acaattcatc cgcgatgact tcggtcatcg ctttggtgga cgtgaaaatc 701    acacattggt cgatgttggc atcgcgcagg atgtggtcga gcaggcggtt 751    tttgtggcgc atatcgtcgc agtacaacaa ctgctcttcg attttgcctt 801    ggccgtccac gcgttcgact tcgataattt cagagtcttt ggtcagtttg 851    cgcgccagtt tgccgactgc gccgtcccaa gtggcggaga acaataa
```

This corresponds to the amino acid sequence <SEQ ID 1176; ORF 284.ng>:

```
g284.pep
   1    MPSETRNRFQ TALVYAAGWG LAVFVTAFAF ACKRVAGFAF AFEAFAGFFE

51    TVFLKAFFLE TFAARFAAEA FFARFMIAAP AAGFPIAPAA FAFRLAACGF

101    AFAGRLHAFD GQFGQFAVNV FFDFVDFDVF VHFGKRNRNT RAACAAGAPD

151    AVDVVFRLFR QVVVYDVGNG RYVNTACGNV GGNQNFAAAF TQIRQRAVAP

201    ALRHIAVQAV GGETFFVQFI RDDFGHRFGG RENHTLVDVG IAQDVVEQAV

251    FVAHIVAVQQ LLFDFALAVH AFDFDNFRVF GQFARQFADC AVPSGGEQ*
```

The following partial DNA sequence was identified in *N. meningitidis* <SEQ ID 1177>:

```
m284.seq..
    1    ATGCCGTCTG AAACTCGAAA TCGGTTTCAG ACGGCATTGG TTTATGCGGC

51    AGGTTGGGGC TTAGCGGTCT TTGTAACGGC GTTCGCCTTT GCCTGCAAAA

101    GAATCGCCGG CTTTGCGTTT GCCTTTGAAG CCTTCGCCGG TTTTTTTGAA

151    ACCGTCTCTC TTAAAGCCTT CTTTCTTGAA ACCTTCGCCG CGCGTTTTGC

201    CGCCGAAGCC TTCTTTGCTC GGTTTATGAT CGCCGCGCCA ACCGCCGGAT

251    TTACGATCGC CCCAGCCGCC TTTGCCTTTC GGCTTGCCGC CTGCGGATTT

301    GCGTTTGCGG GTCGGTTCCA TGCCTTCGAT GGTCAGTTCG GGCAGTTTTC

351    GGTTAATGTA TTTTTCGATT TTGTGGACTT TGACGTATTC GTTCACTTCG

401    GCAAACGTAA TCGCAATACC CGTGCGGCCT GCGCGGCCGG TGCGCCCGAT

451    GCGGTGGACG TAGTCTTCCG CCTGTTTCGG CAGGTCGTAG TTGATAACGT

501    GGGTAATGGT CGGTACGTCG ATACCGCGTG CGGCAACATC GGTGGCAACC

551    AAAATTTTGC AGCGGCCTTT ACGCAAATCC ATCAGCGTGC GGTTGCGCCA

601    GCCTTGCGGC ATATCGCCGT GCAGGCAGTT TGCGGCGAAA CCTTTTTCGT

651    ACAGTTCATC CGCAATGACT TCGGTCATGG CTTTGGTGGA CGTGAAAATC

701    ACGCATTGAT CGATATTGGC ATCGCGCAAG ATATGATCGA GCAGGCGGTT

751    TTTGTGGCGC ATATCGTCGC AGTACAGCAG TTGTTCTTCG ATTTTGCCTT

801    GATCGTCCAC GCGTTCGACT TCGATGATTT CAGGGTCTTT GGTCAGTTTG

851    CGCGCCAGTT TGCCGACCGC GCCGTCCCAA GTGGCGGAGA ACAACAAAGT

901    CTGACGGTCG CTCGGCGTTG CTTCCACGAT GGTTTCGATG TCGTCGATAA

951    AGCCCATATC CAACATACGT TCGGCTTCGT CCAAAATCAG CACTTCCAAA

1001    CGTTCAAAAT CAACTTTGCC GCTTTGCATC AGGTCCATCA GACGGCCCGG

1051    CGTGGCGACA ATCAGATCGA CCGGTTTGCT CAGGGCACGG GTTTGGTAGC

1101    CGAAAGACGC GCCGCCGACG ATGCTGACGG TGCGGAACCA ACGCATATTT
```

```
                              -continued
1151    TTGGCATACG CCAGCGCGTT TTTCTCGACT TGAGCCGCCA GTTCGCGGGT

1201    CGGGGTCAAC ACCAAAGCAC GCGGGCCTTT GCCCGGTTTT TCGCTGCGTT

1251    TGGTCAGTTT TTGCAAAGTC GGTAA
```

This corresponds to the amino acid sequence <SEQ ID 1178; ORF 284>:

```
m284.pep
    1   MPSETRNRFQ TALVYAAGWG LAVFVTAFAF ACKRIAGFAF AFEAFAGFFE

51   TVSLKAFFLE TFAARFAAEA FFARFMIAAP TAGFTIAPAA FAFRLAACGF

101   AFAGRFHAFD GQFGQFSVNV FFDFVDFDVF VHFGKRNRNT RAACAAGAPD

151   AVDVVFRLFR QVVVDNVGNG RYVDTACGNI GGNQNFAAAF TQIHQRAVAP

201   ALRHIAVQAV CGETFFVQFI RNDFGHGFGG RENHALIDIG IAQDMIEQAV

251   FVAHIVAVQQ LFFDFALIVH AFDFDDFRVF GQFARQFADR AVPSGGEQQS

301   LTVARRCFHD GFDVVDKAHI QHTVGFVQNQ HFQTFKINFA ALHQVHQTAR

351   RGDNQIDRFA QGTGLVAERR AADDADGAEP THIFGIRQRV FLDLSRQFAG

401   RGQHQSTRAF ARFFAAFGQF LQSR*
```

Computer analysis of this amino acid sequence gave the following results:
Homology with a Predicted ORF from *N. gonorrhoeae*
  m284/g284 92.3% identity in 298 aa overlap

```
                   10         20         30         40         50         60
    m284.pep  MPSETRNRFQTALVYAAGWGLAVFVTAFAFACKRIAGFAFAFEAFAGFFETVSLKAFFLE
              ||||||||||||||||||||||||||||||||||:||||||||||||||||| |||||||
    g284      MPSETRNRFQTALVYAAGWGLAVFVTAFAFACKRVAGFAFAFEAFAGFFETVFLKAFFLE
                   10         20         30         40         50         60

70         80         90        100        110        120
    m284.pep  TFAARFAAEAFFARFMIAAPTAGFTIAPAAFAFRLAACGFAFAGRFHAFDGQFGQFSVNV
              |||||||||||||||||||||:|||  |||||||||||||||||||:||||||||||:|||
    g284      TFAARFAAEAFFARFMIAAPAAGFPIAPAAFAFRLAACGFAFAGRLHAFDGQFGQFAVNV
                   70         80         90        100        110        120

130        140        150        160        170        180
    m284.pep  FFDFVDFDVFVHFGKRNRNTRAACAAGAPDAVDVVFRLFRQVVVDNVGNGRYVDTACGNI
              ||||||||||||||||||||||||||||||||||||||||||| :|||||| :||||| :
    g284      FFDFVDFDVFVHFGKRNRNTRAACAAGAPDAVDVVFRLFRQVVVYDVGNGRYVNTACGNV
                  130        140        150        160        170        180

190        200        210        220        230        240
    m284.pep  GGNQNFAAAFTQIHQRAVAPALRHIAVQAVCGETFFVQFIRNDFGHGFGGRENHALIDIG
              ||||||||||:||||||||||||||||||| ||||||||||||:||||:|||||:|:|:|
    g284      GGNQNFAAAFTQIRQRAVAPALRHIAVQAVGGETFFVQFIRDDFGHRFGGRENHTLVDVG
                  190        200        210        220        230        240

250        260        270        280        290        300
    m284.pep  IAQDMIEQAVFVAHIVAVQQLFFDFALIVHAFDFDDFRVFGQFARQFADRAVPSGGEQQS
              ||||::|||||||||||||||:|||| ||||||||:||||||||||||:||||||||||X
    g284      IAQDVVEQAVFVAHIVAVQQLLFDFALAVHAFDFDNFRVFGQFARQFADCAVPSGGEQX
                  250        260        270        280        290

310        320        330        340        350        360
    m284.pep  LTVARRCFHDGFDVVDKAHIQHTVGFVQNQHFQTFKINFAALHQVHQTARRGDNQIDRFA
```

The following partial DNA sequence was identified in *N. meningitidis* <SEQ ID 1179>:

```
a284.seq
    1   ATGCCGTCTG AAACTCGAAA TCGGTTTCAG ACGGCATTGG TTTATGCGGC

51   AGGTTGGGGC TTAGCGGTCT TTGTAACGGC GTTCGCCTTT GCCTGCAAAA

101   GAATCGCCGG CTTTGCGTTT GCCTTTGAAG CCTTCGCCGG TTTTTTTGAA

151   ACCGTCTCTC TTAAAGCCTT CTTTCTTGAA ACCTTCGCCG CGCGTTTTGC
```

-continued

```
 201 CGCCGAAGCC TTCTTTGCTC GGTTTATGAT CGCCGCGCCA ACCGCCGGAT
 251 TTACGATCGC CCCAGCCGCC TTTGCCTTTC GGCTTGCCGC CTGCGGATTT
 301 GCGTTTGCGG GTCGGTTCCA TGCCTTCGAT GGTCAGTTCG GCAGTTTTC
 351 GGTTAATGTA TTTTTCGATT TTGTGGACTT TGACGTATTC GTTCACTTCG
 401 GCAAACGTAA TCGCAATACC CGTGCGGCCT GCGCGGCCGG TGCGCCCGAT
 451 GCGGTGGACG TAGTCTTCCG CCTGTTTCGG CAGGTCGTAG TTGATAACGT
 501 GGGTAATGGT CGGTACGTCG ATACCGCGTG CGGCAACGTC GGTGGCAACC
 551 AAAATTTTGC AGCGGCCTTT GCGCAAATCC ATCAGCGTGC GGTTGCGCCA
 601 GCCTTGCGGC ATATCGCCGT GCAGGCAGTT GGCGGCGAAA CCTTTTTCGT
 651 ACAATTCATC CGCGATGACT TCGGTCATGG CTTTGGTGGA CGTGAAAATC
 701 ACGCATTGAT CGATGTCGGC ATCGCGCAAG ATATGATCGA GCAGGCGGTT
 751 TTTGTGGCGC ATATCGTCGC AGTACAGCAG TTGTTCTTCG ATTTTGCCTT
 801 GGTCGTCCAC GCGTTCGACT TCGATGATTT CAGGGTCTTT GGTCAGTTTG
 851 CGCGCCAGTT TGCCGACCGC GCCGTCCCAA GTGGCGGAGA ACAACAAAGT
 901 CTGACGGTCT TCCGGCGTGG CTTCGACGAT GGTTTCGATG TCGTCGATAA
 951 AGCCCATATC CAACATACGG TCGGCTTCGT CCAAAATCAG CACTTCCAAG
1001 CGGGCGAAAT CGACTTTGCC GCTTTGCATC AAGTCCATCA GACGGCCCGG
1051 CGTGGCGACA ATCAGATCGA CCGGTTTGCT CAGGGCGCGG GTTTGGTAGC
1101 CGAACGATGC ACCACCGACG ATGCTGACGG TACGGAACCA ACGCATATTT
1151 TTGGCATACG CCAGCGCGTT TTTCTCGACT TGAGCCGCCA ATTCGCGGGT
1201 CGGCGTCAAC ACCAACGCGC GCGGGCCTTT GCCCGGTTTT TCGCTGCGTT
1251 TGGTCAGTCG CTGCAAAGTC GGTAA
```

This corresponds to the amino acid sequence <SEQ ID 1180;
ORF 284.a>:

```
a284.pep
    1 MPSETRNRFQ TALVYAAGWG LAVFVTAFAF ACKRIAGFAF AFEAFAGFFE

51 TVSLKAFFLE TFAARFAAEA FFARFMIAAP TAGFTIAPAA FAFRLAACGF

101 AFAGRFHAFD GQFGQFSVNV FFDFVDFDVF VHFGKRNRNT RAACAAGAPD

151 AVDVVFRLFR QVVVDNVGNG RYVDTACGNV GGNQNFAAAF AQIHQRAVAP

201 ALRHIAVQAV GGETFFVQFI RDDFGHGFGG RENHALIDVG IAQDMIEQAV

251 FVAHIVAVQQ LFFDFALVVH AFDFDDFRVF GQFARQFADR AVPSGGEQQS

301 LTVFRRGFDD GFDVVDKAHI QHTVGFVQNQ HFQAGEIDFA ALHQVHQTAR

351 RGDNQIDRFA QGAGLVAERC TTDDADGTEP THIFGIRQRV FLDLSRQFAG

401 RRQHQRARAF ARFFAAFGQS LQSR*
``` m284/a284 94.8% identity in 424 aa overlap

```
                  10         20         30         40         50         60
m284.pep  MPSETRNRFQTALVYAAGWGLAVFVTAFAFACKRIAGFAFAFEAFAGFFEETVSLKAFFLE
          ||||||||||||||||||||||||||||||||||||||||||||||||||||||||||||
a284      MPSETRNRFQTALVYAAGWGLAVFVTAFAFACKRIAGFAFAFEAFAGFFEETVSLKAFFLE
                  10         20         30         40         50         60
```

```
              70         80         90        100        110        120
m284.pep  TFAARFAAEAFFARFMIAAPTAGFTIAPAAFAFRLAACGFAFAGRFHAFDGQFGQFSVNV
          ||||||||||||||||||||||||||||||||||||||||||||||||||||||||||||
a284      TFAARFAAEAFFARFMIAAPTAGFTIAPAAFAFRLAACGFAFAGRFHAFDGQFGQFSVNV
              70         80         90        100        110        120

130        140        150        160        170        180
m284.pep  FFDFVDFDVFVHFGKRNRNTRAACAAGAPDAVDVVFRLFRQVVVDNVGNGRYVDTACGNI
          |||||||||||||||||||||||||||||||||||||||||||||||||||||||||||:
a284      FFDFVDFDVFVHFGKRNRNTRAACAAGAPDAVDVVFRLFRQVVVDNVGNGRYVDTACGNV
             130        140        150        160        170        180

190        200        210        220        230        240
m284.pep  GGNQNFAAAFTQIHQRAVAPALRHIAVQAVCGETFFVQFIRNDFGHGFGGRENHALIDIG
          ||||||||||:||||||||||||||||||| ||||||||||:||||||||||||||||:|
a284      GGNQNFAAAFAQIHQRAVAPALRHIAVQAVGGETFFVQFIRDDFGHGFGGRENHALIDVG
             190        200        210        220        230        240

250        260        270        280        290        300
m284.pep  IAQDMIEQAVFVAHIVAVQQLFFDFALIVHAFDFDDFRVFGQFARQFADRAVPSGGEQQS
          |||||||||||||||||||||||||||:|||||||||||||||||||||||||||||||
a284      IAQDMIEQAVFVAHIVAVQQLFFDFALVVHAFDFDDFRVFGQFARQFADRAVPSGGEQQS
             250        260        270        280        290        300

310        320        330        340        350        360
m284.pep  LTVARRCFHDGFDVVDKAHIQHTVGFVQNQHFQTFKINFAALHQVHQTARRGDNQIDRFA
          ||| || |  ||||||||||||||||||||||| : :|:||||||||||||||||||||
a284      LTVFRRGFDDGFDVVDKAHIQHTVGFVQNQHFQAGEIDFAALHQVHQTARRGDNQIDRFA
             310        320        330        340        350        360

370        380        390        400        410        420
m284.pep  QGTGLVAERRAADDADGAEPTHIFGIRQRVFLDLSRQFAGRGQHQSTRAFARFFAAFGQF
          ||:|||||| ::||||||||:|||||||||||||||||||::|||:|||||||||||| 
a284      QGAGLVAERCTTDDADGTEPTHIFGIRQRVFLDLSRQFAGRRQHQRARAFARFFAAFGQS
             370        380        390        400        410        420 m284.pep  LQSRX
          |||||
a284      LQSRX
```

30

The following partial DNA sequence was identified in *N. gonorrhoeae* <SEQ ID 1181>:

```
g285.seq
    1  atgaccgata ccacaccgac agataccgat ccgaccgaaa acggcacgcg
   51  caaaatgccg tctgaacacc gccccgcccc gccggcaaaa aaacgccgcc
  101  cgctgctgaa gctgtcggcg gcactgctgt ctgtcctgat tttggcagta
  151  tgtttcctcg gctggatcgc cggtacggaa gcaggtttgc gcttcgggct
  201  gtaccaaatc ccgtcctggt tcggcgtaaa catttcctcc caaaacctca
  251  aaggcacact gctcgacggc ttcgacggcg acaactggtc gatagaaacc
  301  gaggggggcag accttaaaat cagccgcttc cgcttcgcgt ggaaaccgtc
  351  cgaactgatg cgccgcagcc tgcacatcac cgacatctcc gccggcgaca
  401  tcgccatcgt aaccaaaccg actccgccta agaagaacg  cccgcctcaa
  451  ggcctgcccg acagcataga cctgcccgcc gctgtctatc tcgaccgctt
  501  cgagacgggc aaaatcagca tgggcaaaac ctttgacaaa caaccgtct
  551  atctcgaacg cctcaacgcg gcataccgtt acgaccgtaa agggcaccgc
  601  ctcgacctga aggccgccga cacgccgtgg agcagttcgt cggggtcagc
  651  ctcggtcggc ttgaaaaaac cgtttgccct cgataccgcc atttacacca
  701  aaggcggatt cgaaggcgaa accatacaca gtacggcgcg gctgagcggc
  751  agcctgaagg atgtgcgcgc cgaactgacg atcgacggcg caatatccg
  801  cctctcggga aaatccgtca tccacccgtt tgccgaatca ttggataaaa
  851  cattggaaga agtactggtc aaaggattca acatcaatcc gtccgccttc
  901  gtgccttccc tgcccgatgc cgggctgaat ttcgacctga ccgccatccc
```

-continued

```
 951 gtcgttttca gacggcatcg cgctggaagg ctcgctcgat ttggaaaaca
1001 ccaaagccgg ctttgccgac cgcaacggca tccccgtccg tcaggttttg
1051 ggcggctttg tcatccggca ggacggcacg gtgcatatcg gcaatacgtc
1101 cgccgccctg ctcggacggg gcggcatcag gctgtcgggc aaaatcgaca
1151 ccgaaaaaga catccttgat ttaaatatag gcatcaactc cgtcggcgcg
1201 gaagacgtgc tgcaaaccgc gttcaaaggc aggttggacg gcagcatcgg
1251 catcggcggc acgaccgcct cgcccaaaat ctcttggcaa ctcggcaccg
1301 gcacggcacg cacggacggc agcctcccca tcgcaagcga ccccgcaaac
1351 gaacagcgga aactggtgtt cgacaccgtc aacatctccg ccggggaagg
1401 cagcctgacc gcgcaaggct atctcgagct gttttaaagac cgcctgctca
1451 agctggacat ccgttcccgc gcattcgacc cttcgcgcat cgatccgcaa
1501 tttccggcag gcaatatcaa cggttcgatt catcttgccg gtgaactggc
1551 aaaagagaaa tttacgggca aaatgcgttt tttgcccggt acgttcaacg
1601 gcgtgccgat tgccggcagc gccgacattg tttacgagtc ccgccacctt
1651 ccgcgcgccg ccgtcgattt gcggttgggg cggaacatcg tcaaaacaga
1701 cggcggcttc ggcaaaaaag gcgaccggct taacctcaat atcaccgcac
1751 ccgatttatc ccgtttcggt ttcggactcg cggggtcttt aaatgtacgc
1801 ggacaccttt ccggcgattt ggacggcggc atccgaacct ttgaaaccga
1851 cctttccggc acggcgcgca acttacacat cggcaaagcg gcagacatcc
1901 gttcgctcga ttttacccte aaaggctcac ccggcacaag ccgcccgatg
1951 cgcgccgata tcaagggcgg ccgccttttcc ctgtcgggcg gcgcggcggt
2001 tgtcgatacc gccggcctga cgctggaagg tacgggcgcg cagcaccgca
2051 tccgcacaca cgccgccatg acgctggacg gcaaaccgtt caaactcgat
2101 ttggacgctt caggcggcat caacagggaa cttacccgat ggaaaggcag
2151 catcggcatc ctcgacatcg gcggcgcatt caacctcaag ctgcaaaacc
2201 gtatgacgct cgaagccggt gcggaacacg tggcggcaag tgcggcaaat
2251 tggcaggcaa tgggcggcag cctcaacctg caacactttt cttgggacag
2301 gaaaaccggc atatcggcaa aaggcggcgc acgcggcctg cacatcgccg
2351 agttgcacaa tttcttcaaa ccgcccttcg aacacaatct ggttttaaac
2401 ggcgactggg atgtcgccta cgggcacaac gcgcgcggct acctcaatat
2451 cagccggcaa agcggcgatg ccgtattgcc cggcgggcag gctttgggtt
2501 tgaacgcatt ttccctgaaa acgcgctttc aaaacgaccg catcggaatc
2551 ctgcttgacg gcggcgcgcg tttcggacgg attaacgccg atttgggcat
2601 cggcaacgcc ttcggcggca atatggcaaa tacaccgctc ggcggcagga
2651 ttacagcctc ccttcccgac ttgggcgcat tgaagccctt tctgcccgcc
2701 gccgcgcaaa acattaccgg cagcctgaat gcctccgcgc aaatcggcgg
2751 acgggtaggc tctccgtccg tcaatgccgc cgtcaacggt agcagcaact
2801 acgggaaaat caacggcaat atcaccgtcg gcaaagccg ctccttcgat
2851 accgcacctt tgggcggcag gctcaacctg accgttgccg atgccgaagc
2901 attccgcaac ttcctaccgg tcggacaaac cgtcaaaggc agcctgaatg
2951 ccgccgtaac cctcggcggc agcatcgccg acccgcactt gggcggcagt
```

-continued

```
3001 atcaacggcg acaagctcta ttaccgcaac caaacccaag gcatcatctt
3051 ggacaacggc tcgctgcgtt cgcatattgc aggcaggaaa tgggtaatcg
3101 acagcctgaa attccggcac gaagggacgg cggaactctc cggcacggtc
3151 agcatggaaa acagcgtgcc cgatgtcgat atcggcgcgg tgttcgacaa
3201 ataccgcatc ctgtcccgcc ccaaccgccg cctgacggtt tccggcaaca
3251 cccgcctgcg ctattcgccg caaaaaggca tatccgttac cggtatgatt
3301 aaaactgatc aggggctgtt cggttcgcaa aaatcctcga tgccgtccgt
3351 cggcgacgat gtcgtcgtat tgggcgaagt caagaaagag gcggcggcat
3401 cgctccccgt caatatgaac ctgactttag acctcaatga cggcatccgc
3451 ttctccggct acggcgcgga cgttaccata ggcggcaaac tgaccctgac
3501 cgcgcaaccg ggcggaaatg tgcgtggggt gggcacggtc cgcgtcatca
3551 aagggcgtta caaagcatac gggcaggatt tagacattac caaaggcaca
3601 gtctcctttg tcggcccgct caacgacccc aacctgaaca tccgcgccga
3651 acgccgcctt tccccgtcg gtgcgggcgt ggaaatattg ggcagcctca
3701 acagcccgcg cattacgctg acggcaaacg aaccgatgag tgaaaaagac
3751 aagctctcct ggctcatcct caaccgtgcc ggcagcggca gcagcggcga
3801 caatgccgcc ctgtccgcag ccgcaggcgc gctgcttgcc gggcaaatca
3851 acgaccgcat cgggctggtg gatgatttgg gctttaccag caagcgcagc
3901 cgcaacgcgc aaaccggcga actcaacccc gccgaacagg tgctgaccgt
3951 cggcaaacaa ctgaccggca aactctacat cggctacgaa tacggcatct
4001 ccagcgcgga acagtccgtc aaactgattt accggctgac ccgcgccata
4051 caggcggttg cccgtatcgg cagccgttcg tcgggcggcg agctgacata
4101 caccatacgt ttcgaccgcc tcttcggttc ggacaaaaaa gactccgcag
4151 gaaacggcaa agggaaataa
```

This corresponds to the amino acid sequence <SEQ ID 1182; ORF 285.ng>:

```
g285.pep
    1 MTDTTPTDTD PTENGTRKMP SEHRPAPPAK KRRPLLKLSA ALLSVLILAV
   51 CFLGWIAGTE AGLRFGLYQI PSWFGVNISS QNLKGTLLDG FDGDNWSIET
  101 EGADLKISRF RFAWKPSELM RRSLHITDIS AGDIAIVTKP TPPKEERPPQ
  151 GLPDSIDLPA AVYLDRFETG KISMGKTFDK QTVYLERLNA AYRYDRKGHR
  201 LDLKAADTPW SSSSGSASVG LKKPFALDTA IYTKGGFEGE TIHSTARLSG
  251 SLKDVRAELT IDGGNIRLSG KSVIHPFAES LDKTLEEVLV KGFNINPSAF
  301 VPSLPDAGLN FDLTAIPSFS DGIALEGSLD LENTKAGFAD RNGIPVRQVL
  351 GGFVIRQDGT VHIGNTSAAL LGRGGIRLSG KIDTEKDILD LNIGINSVGA
  401 EDVLQTAFKG RLDGSIGIGG TTASPKISWQ LGTGTARTDG SLPIASDPAN
  451 EQRKLVFDTV NISAGEGSLT AQGYLELFKD RLLKLDIRSR AFDPSRIDPQ
  501 FPAGNINGSI HLAGELAKEK FTGKMRFLPG TFNGVPIAGS ADIVYESRHL
  551 PRAAVDLRLG RNIVKTDGGF GKKGDRLNLN ITAPDLSRFG FGLAGSLNVR
  601 GHLSGDLDGG IRTFETDLSG TARNLHIGKA ADIRSLDFTL KGSPGTSRPM
```

-continued

```
 651   RADIKGGRLS LSGGAAVVDT AGLTLEGTGA QHRIRTHAAM TLDGKPFKLD
 701   LDASGGINRE LTRWKGSIGI LDIGGAFNLK LQNRMTLEAG AEHVAASAAN
 751   WQAMGGSLNL QHFSWDRKTG ISAKGGARGL HIAELHNFFK PPFEHNLVLN
 801   GDWDVAYGHN ARGYLNISRQ SGDAVLPGGQ ALGLNAFSLK TRFQNDRIGI
 851   LLDGGARFGR INADLGIGNA FGGNMANTPL GGRITASLPD LGALKPFLPA
 901   AAQNITGSLN ASAQIGGRVG SPSVNAAVNG SSNYGKINGN ITVGQSRSFD
 951   TAPLGGRLNL TVADAEAFRN FLPVGQTVKG SLNAAVTLGG SIADPHLGGS
1001   INGDKLYYRN QTQGIILDNG SLRSHIAGRK WVIDSLKFRH EGTAELSGTV
1051   SMENSVPDVD IGAVFDKYRI LSRPNRRLTV SGNTRLRYSP QKGISVTGMI
1101   KTDQGLFGSQ KSSMPSVGDD VVVLGEVKKE AAASLPVNMN LTLDLNDGIR
1151   FSGYGADVTI GGKLTLTAQP GGNVRGVGTV RVIKGRYKAY GQDLDITKGT
1201   VSFVGPLNDP NLNIRAERRL SPVGAGVEIL GSLNSPRITL TANEPMSEKD
1251   KLSWLILNRA GSGSSGDNAA LSAAAGALLA GQINDRIGLV DDLGFTSKRS
1301   RNAQTGELNP AEQVLTVGKQ LTGKLYIGYE YGISSAEQSV KLIYRLTRAI
1351   QAVARIGSRS SGGELTYTIR FDRLFGSDKK DSAGNGKGK*
```

The following partial DNA sequence was identified in N. meningitidis <SEQ ID 1183>:

```
m285.seq
    1  ATGACCGATA CCGCACCGAC AGATACCGAT CCGACCGAAA ACGGCACGCG
   51  CAAAATGCCG TCTGAACACC GCCCTACCCC GCCGGCAAAA AAACGCCGCC
  101  CGTTGCTGAA GCTGTCGGCG GCACTGCTGT CTGTCCTGAT TTTGGCAGTA
  151  TGTTTCCTCG GCTGGCTCGC CGGTACGGAA GCAGGTTTGC GCTTCGGGCT
  201  GTACCAAATC CCGTCTTGGT TCGGCGTAAA CATTTCCTCC CAAAACCTCA
  251  AAGGCACGCT GCTCGACGGC TTCGACGGCG ACAACTGGTC GATAGAAACC
  301  GAGGGGGCAG ACCTTAAAAT CAGCCGCTTC CGCTTCGCGT GGAAACCGTC
  351  CGAACTGATG CGCCGCAGCC TGCACATTAC CGAAATTTCC GCCGGCGACA
  401  TCGCCATCGT TACCAAACCG ACTCCGCCTA AGAAGAACG CCCGCCGCTC
  451  AGCCTTCCCG ACAGCATAGA CCTGCCTGCC GCCGTCTATC TCGACCGCTT
  501  CGAGACGGGC AAAATCAGCA TGGGCAAAGC CTTTGACAAA CAAACCGTCT
  551  ATCTCGAACG GCTGGATGCT TCATACCGTT ACGACCGCAA AGGACACCGC
  601  CTTGACCTGA AGGCCGCCGA CACGCCGTGG AGCAGTTCGT CGGGGGCGGC
  651  CTCGGTCGGC TTGAAAAAAC CGTTTGCCCT CGATACCGCC ATTTACACCA
  701  AAGGCGGACT CGAAGGCAAA ACCATACACA GTACGGCTCG GCTGAGCGGC
  751  AGCCTGAAGG ATGTGCGCGC CGAACTGGCG ATCGACGGCG GCAATATCCG
  801  CCTCTCGGGA AAATCCGTCA TCCACCCGTT TGCCGAATCA TTGGATAAAA
  851  CATTGGAAGA AGTACTGGTC AAAGGGTTCA ACATCAATCC GGCCGCCTTC
  901  GTGCCTTCCC TGCCCGATGC CGGACTGAAT TTCGACCTGA CCGCCATCCC
  951  GTCGTTTTCA GACGGCATCG CGCTGGAAGG TTCGCTCGAT TTGGAAAACA
 1001  CCAAAGCCGG CTTTGCCGAC CGCAACGGCA TCCCCGTCCG TCAGGTTTTA
 1051  GGCGGCTTTG TCATCCGGCA GGACGGCACG GTGCATATCG GCAATACGTC
```

-continued

```
1101  CGCCGCCCTG CTCGGACGGG GCGGCATCAG GCTGTCGGGC AAAATCGACA
1151  CCGAAAAAGA CATCCTCGAT TTAAATATAG GCATCAACTC CGTCGGCGCG
1201  GAAGACGTAC TGCAAACCGC GTTCAAAGGC AGGTTGGACG GCAGCATCGG
1251  CATCGGTGGC ACGACCGCCT CGCCCAAAAT CTCTTGGCAA CTCGGCATCG
1301  GCACGGCGCG CACGGACGGC AGCCTCGCCA TTGCAAGCGA CCCAGCAAAC
1351  GGACAGCGGA AACTGGTGCT CGACACCGTC AACATCGCCG CCGGGCAAGG
1401  CAGCCTGACC GCGCAAGGCT ATCTCGAGCT GTTTAAAGAC CGCCTGCTCA
1451  AGCTGGACAT CCGTTCCCGC GCATTCGACC CTTCGCGCAT CGATCCGCAA
1501  CTTCCGGCAG GCAATATCAA CGGCTCAATA AACCTTGCCG GCGAACTGGC
1551  AAAAGAGAAA TTCACAGGCA AAATGCGGTT TTTACCCGGC ACGTTCAACG
1601  GCGTACCGAT TGCCGGCAGT GCCGACATTG TTTACGAGTC CCGCCACCTT
1651  CCGCGTGCCG CCGTCGATTT GCGGCTGGGG CGGAACATTA TTAAAACAGA
1701  CGGCGGCTTC GGCAAAAAAG GCGACCGGCT TAACCTCAAT ATCACCGCAC
1751  CCGATTTATC CCGTTTCGGT TTCGGACTCG CGGGGTCTTT AAATGTACGC
1801  GGACACCTTT CCGGTGATTT GGACGGCGGC ATCCGAACCT TTGAAACCGA
1851  CCTTTCCGGC GCGGCGCGCA ACCTGCACAT CGGCAAGGCG GCAGACATCC
1901  GTTCGCTCGA TTTCACGCTC AAAGGTTCGC CCGACACAAG CCGCCCGATA
1951  CGCGCCGACA TCAAAGGCAG CCGCCTTTCG CTGTCGGGCG GAGCGGCGGT
2001  TGTCGATACC GCCGACCTGA TGCTGGACGG CACGGGCGTG CAGCACCGCA
2051  TCCGCACACA CGCCGCCATG ACGCTGGATG GCAAACCGTT CAAATTCGAT
2101  TTGGACGCTT CAGGCGGCAT CAACAGGGAA CTTACCCGAT GGAAAGGCAG
2151  CATCGGCATC CTCGACATCG GCGGCGCATT CAACCTCAAG CTGCAAAACC
2201  GTATGACGCT CGAAGCCGGT GCGGAACGCG TGGCGGCAAG TGCGGCAAAT
2251  TGGCAGGCAA TGGGCGGCAG CCTCAACCTG CAACACTTTT CTTGGGATAA
2301  AAAAACCGGC ATATCGGCAA AAGGCGGCGC ACACGGTCTG CATATCGCCG
2351  AGTTGCACAA TTTCTTCAAA CCGCCCTTCG AACACAATCT GGTTTTAAAC
2401  GGCGACTGGG ATGTCGCCTA CGGGCGCAAC GCGCGCGGCT ACCTCAATAT
2451  CAGCCGGCAA AGCGGCGATG CCGTATTGCC CGGCGGGCAG GCTTTGGGTT
2501  TGAACGCATT TTCCCTGAAA ACGCGCTTTC AAAACGACCG CATCGGAATC
2551  CTGCTTGACG GCGGCGCGCG TTTCGGGCGG ATTAACGCCG ATTTGGGCAT
2601  CGCCAACGCC TTCGGCGGCA ATATGGCAAA TGCACCGCTC GGCGGCAGGA
2651  TTACCGCCTC CCTTCCCGAC TTGGGCGCAT TGAAGCCCTT TCTGCCCGCC
2701  GCCGCGCAAA ACATTACCGG CAGCCTGAAT GCCGCCGCGC AAATCGGCGG
2751  ACGGGTAGGC TCTCCGTCCG TCAATGCCGC CGTCAACGGC AGCAGCAACT
2801  ACGGGAAAAT CAACGGCAAC ATCACCGTCG GCAAAGCCG CTCTTTCGAT
2851  ACCGCGCCTT TGGGCGGCAG GCTCAACCTG ACCGTTGCCG ATGCCGAAGT
2901  ATTCCGCAAC TTCCTACCGG TCGGACAAAC CGTCAAAGGC AGCCTGAATG
2951  CCGCCGTAAC CCTCGGCGGC AGCATCGCCG ATCCGCACTT GGGCGGCAGC
3001  ATCAACGGCG ACAAACTCTA TTACCGCAAC CAAACCCAAG GCATCATCTT
3051  GGACAACGGC TCGCTGCGTT CGCATATCGC GGGCAGGAAA TGGGTAATCG
```

```
3101 ACAGCCTGAA ATTCCGGCAC GAAGGGACGG CGGAACTCTC CGGTACGGTC

3151 GGTATGGAAA ACAGCGGACC CGATGTCGAT ATCGGCGCGG TGTTCGACAA

3201 ATACCGCATC CTGTCCCGCC CCAACCGCCG CCTGACGGTT TCCGGCAACA

3251 CCCGCCTGCG CTATTCGCCG CAAAAAGGCA TATCCGTTAC CGGGATGATT

3301 AAAACGGATC AGGGGCTGTT CGGTTCGCAA AAATCCTCGA TGCCGTCCGT

3351 CGGCGACGAT GTCGTCGTAT TAGGCGAAGT CAAAAAAGAG GCGGCGGCAC

3401 CGCTCCCCGT CAATATGAAC CTGACTTTAG ACCTCAATGA CGGCATCCGC

3451 TTCGCCGGCT ACGGCGCGGA CGTTACCATA GCGGCAAAC TGACCCTGAC

3501 CGCCCAATCG GGCGGAAGCG TACGGGCGT GGGCACGGTC CGCGTCATCA

3551 AAGGGCGTTA TAAGGCATAC GGGCAGGATT TGGACATTAC CAAAGGCACG

3601 GTCTCCTTTG TCGGCCCGCT CAACGATCCC AACCTCAACA TCCGCGCCGA

3651 ACGCCGCCTT TCCCCCGTCG GTGCGGGCGT GGAAATATTG GGCAGCCTCA

3701 ACAGCCCGCG CATTACGCTG ACGGCAAACG AACCGATGAG TGAAAAAGAC

3751 AAGCTCTCTT GGCTCATCCT CAACCGCGCC GGCAGCGGCA GCAGCGGCGA

3801 CAATGCCGCC CTGTCTGCAG CCGCAGGTGC GCTGCTTGCC GGGCAAATCA

3851 ACGACCGCAT CGGGCTGGTG GATGATTTGG GCTTTACCAG CAAGCGCAGC

3901 CGCAACGCGC AAACCGGCGA ACTCAACCCC GCCGAACAGG TGCTGACCGT

3951 CGGCAAACAA CTGACCGGCA AACTCTACAT CGGCTACGAA TACAGCATCT

4001 CCAGCGCGGA ACAGTCCGTC AAACTGATTT ACCGGCTGAC CCGCGCCATA

4051 CAGGCGGTTG CCCGTATCGG CAGCCGTTCG TCGGGCGGCG AGCTGACATA

4101 CACCATACGT TTCGACCGCT TCTCCGGTTC GGACAAAAAA GACTCCGCCG

4151 GAAACGGCAA AGGAAAATAA
```

This corresponds to the amino acid sequence <SEQ ID 1184; ORF 285>:

```
m285.pep
    1 MTDTAPTDTD PTENGTRKMP SEHRPTPPAK KRRPLLKLSA ALLSVLILAV

51 CFLGWLAGTE AGLRFGLYQI PSWFGVNISS QNLKGTLLDG FDGDNWSIET

101 EGADLKISRF RFAWKPSELM RRSLHITEIS AGDIAIVTKP TPPKEERPPL

151 SLPDSIDLPA AVYLDRFETG KISMGKAFDK QTVYLERLDA SYRYDRKGHR

201 LDLKAADTPW SSSSGAASVG LKKPFALDTA IYTKGGLEGK TIHSTARLSG

251 SLKDVRAELA IDGGNIRLSG KSVIHPFAES LDKTLEEVLV KGFNINPAAF

301 VPSLPDAGLN FDLTAIPSFS DGIALEGSLD LENTKAGFAD RNGIPVRQVL

351 GGFVIRQDGT VHIGNTSAAL LGRGGIRLSG KIDTEKDILD LNIGINSVGA

401 EDVLQTAFKG RLDGSIGIGG TTASPKISWQ LGIGTARTDG SLAIASDPAN

451 GQRKLVLDTV NIAAGQGSLT AQGYLELFKD RLLKLDIRSR AFDPSRIDPQ

501 LPAGNINGSI NLAGELAKEK FTGKMRFLPG TFNGVPIAGS ADIVYESRHL

551 PRAAVDLRLG RNIIKTDGGF GKKGDRLNLN ITAPDLSRFG FGLAGSLNVR

601 GHLSGDLDGG IRTFETDLSG AARNLHIGKA ADIRSLDFTL KGSPDTSRPI

651 RADIKGSRLS LSGGAAVVDT ADLMLDGTGV QHRIRTHAAM TLDGKPFKFD

701 LDASGGINRE LTRWKGSIGI LDIGGAFNLK LQNRMTLEAG AERVAASAAN
```

-continued

```
 751  WQAMGGSLNL QHFSWDKKTG ISAKGGAHGL HIAELHNFFK PPFEHNLVLN

801  GDWDVAYGRN ARGYLNISRQ SGDAVLPGGQ ALGLNAFSLK TRFQNDRIGI

851  LLDGGARFGR INADLGIANA FGGNMANAPL GGRITASLPD LGALKPFLPA

901  AAQNITGSLN AAAQIGGRVG SPSVNAAVNG SSNYGKINGN ITVGQSRSFD

951  TAPLGGRLNL TVADAEVFRN FLPVGQTVKG SLNAAVTLGG SIADPHLGGS

1001  INGDKLYYRN QTQGIILDNG SLRSHIAGRK WVIDSLKFRH EGTAELSGTV

1051  GMENSGPDVD IGAVFDKYRI LSRPNRRLTV SGNTRLRYSP QKGISVTGMI

1101  KTDQGLFGSQ KSSMPSVGDD VVVLGEVKKE AAAPLPVNMN LTLDLNDGIR

1151  FAGYGADVTI GGKLTLTAQS GGSVRGVGTV RVIKGRYKAY GQDLDITKGT

1201  VSFVGPLNDP NLNIRAERRL SPVGAGVEIL GSLNSPRITL TANEPMSEKD

1251  KLSWLILNRA GSGSSGDNAA LSAAAGALLA GQINDRIGLV DDLGFTSKRS

1301  RNAQTGELNP AEQVLTVGKQ LTGKLYIGYE YSISSAEQSV KLIYRLTRAI

1351  QAVARIGSRS SGGELTYTIR FDRFSGSDKK DSAGNGKGK*
```

Computer analysis of this amino acid sequence gave the following results:
Homology with a Predicted ORF from *N. gonorrhoeae* m285/g285 96.5% identity in 1389 aa overlap

```
                   10         20         30         40         50         60
m285.pep  MTDTAPTDTDPTENGTRKMPSHERPTPPAKKRRPLLKLSAALLSVLILAVCFLGWLAGTE
          ||||:||||||||||||||||||||:||||||||||||||||||||||||||||:||||
g285      MTDTTPTDTDPTENGTRKMPSHERPAPPAKKRRPLLKLSAALLSVLILAVCFLGWIAGTE
                   10         20         30         40         50         60

70         80         90        100        110        120
m285.pep  AGLRFGLYQIPSWFGVNISSQNLKGTLLDGFDGDNWSIETEGADLKISRFRFAWKPSELM
          ||||||||||||||||||||||||||||||||||||||||||||||||||||||||||||
g285      AGLRFGLYQIPSWFGVNISSQNLKGTLLDGFDGDNWSIETEGADLKISRFRFAWKPSELM
                   70         80         90        100        110        120

130        140        150        160        170        180
m285.pep  RRSLHITEISAGDIAIVTKPTPPKEERPPLSLPDSIDLPAAVYLDRFETGKISMGKAFDK
          |||||||:|||||||||||||||||||||:||||||||||||||||||||||||||:|||
g285      RRSLHITDISAGDIAIVTKPTPPKEERPPQGLPDSIDLPAAVYLDRFETGKISMGKTFDK
                  130        140        150        160        170        180

190        200        210        220        230        240
m285.pep  QTVYLERLDASYRYDRKGHRLDLKAADTPWSSSSGAASVGLKKPFALDTAIYTKGGLEGK
          |||||||||:|:||||||||||||||||||||||||:|||||||||||||||||||||:|:
g285      QTVYLERLNAAYRYDRKGHRLDLKAADTPWSSSSGASVGLKKPFALDTAIYTKGGFEGE
                  190        200        210        220        230        240

250        260        270        280        290        300
m285.pep  TIHSTARLSGSLKDVRAELAIDGGNIRLSGKSVIHPFAESLDKTLEEVLVKGFNINPAAF
          |||||||||||||||||||||:|||||||||||||||||||||||||||||||||:||
g285      TIHSTARLSGSLKDVRAELTIDGGNIRLSGKSVIHPFAESLDKTLEEVLVKGFNINPSAF
                  250        260        270        280        290        300

310        320        330        340        350        360
m285.pep  VPSLPDAGLNFDLTAIPSFSDGIALEGSLDLENTKAGFADRNGIPVRQVLGGFVIRQDGT
          ||||||||||||||||||||||||||||||||||||||||||||||||||||||||||||
g285      VPSLPDAGLNFDLTAIPSFSDGIALEGSLDLENTKAGFADRNGIPVRQVLGGFVIRQDGT
                  310        320        330        340        350        360

370        380        390        400        410        420
m285.pep  VHIGNTSAALLGRGGIRLSGKIDTEKDILDLNIGINSVGAEDVLQTAFKGRLDGSIGIGG
          ||||||||||||||||||||||||||||||||||||||||||||||||||||||||||||
g285      VHIGNTSAALLGRGGIRLSGKIDTEKDILDLNIGINSVGAEDVLQTAFKGRLDGSIGIGG
                  370        380        390        400        410        420

430        440        450        460        470        480
m285.pep  TTASPKISWQLGIGTARTDGSLAIASDPANGQRKLVLDTVNIAAGQGSLTAQGYLELFKD
          |||||||||||| ||||||||||| |||||:||||:|||||:||:||||||||||||||
g285      TTASPKISWQLGTGTARTDGSLPIASDPANEQRKLVFDTVNISAGEGSLTAQGYLELFKD
                  430        440        450        460        470        480

490        500        510        520        530        540
m285.pep  RLLKLDORSRAFDPSRIDPQLPAGNINGSINLAGELAKEKFTGKMRFLPGTFNGVPIAGS
          |||||||||:|||||||||:|||||||||||:||||||||||||||||||||||||||||
g285      RLLKLDORSRAFDPSRIDPQFPAGNINGSIHLAGELAKEKFTGKMRFLPGTFNGVPIAGS
                  490        500        510        520        530        540
```

-continued

```
              550        560        570        580        590        600
m285.pep   ADIVYESRHLPRAAVDLRLGRNIIKTDGGFGKKGDRLNLNITAPDLSRFGFGLAGSLNVR
           ||||||||||||||||||||||||:|||||||||||||||||||||||||||||||||||
g285       ADIVYESRHLPRAAVDLRLGRNIVKTDGGFGKKGDRLNLNITAPDLSRFGFGLAGSLNVR
              550        560        570        580        590        600

610        620        630        640        650        660
m285.pep   GHLSGDLDGGIRTFETDLSGAARNLHIGKAADIRSLDFTLKGSPDTSRPIRADIKGSRLS
           |||||||||||||||||||||:||||||||||||||||||||||||| ||||:||||:|||
g285       GHLSGDLDGGIRTFETDLSGTARNLHIGKAADIRSLDFTLKGSPGTSRPMRADIKGGRLS
              610        620        630        640        650        660

670        680        690        700        710        720
m285.pep   LSGGAAVVDTADLMLDGTGVQHRIRTHAAMTLDGKPFKFDLDASGGINRELTRWKGSIGI
           ||||||||||| |:|||:||||||||||||||||||:|||||||||||||||||||||||
g285       LSGGAAVVDTAGLTLEGTGAQHRIRTHAAMTLDGKPFKLDLDASGGINRELTRWKGSIGI
              670        680        690        700        710        720

730        740        750        760        770        780
m285.pep   LDIGGAFNLKLQNRMTLEAGAERVAASAANWQAMGGSLNLQHFSWDKKTGISAKGGAHGL
           |||||||||||||||||||||:||||||||||||||||||||||||:|||||||||:||
g285       LDIGGAFNLKLQNRMTLEAGAEHVAASAANWQAMGGSLNLQHFSWDRKTGISAKGGARGL
              730        740        750        760        770        780

790        800        810        820        830        840
m285.pep   HIAELHNFFKPPFEHNLVLNGDWDVAYGRNARGYLNISRQSGDAVLPGGQALGLNAFSLK
           |||||||||||||||||||||||||||||:||||||||||||||||||||||||||||||
g285       HIAELHNFFKPPFEHNLVLNGDWDVAYGHNARGYLNISRQSGDAVLPGGQALGLNAFSLK
              790        800        810        820        830        840

850        860        870        880        890        900
m285.pep   TRFQNDRIGILLDGGARFGRINADLGIANAFGGNMANAPLGGRITASLPDLGALKPFLPA
           |||||||||||||||||||||||||||:|||||||||:||||||||||||||||||||||
g285       TRFQNDRIGILLDGGARFGRINADLGIGNAFGGNMANTPLGGRITASLPDLGALKPFLPA
              850        860        870        880        890        900

910        920        930        940        950        960
m285.pep   AAQNITGSLNAAAQIGGRVGSPSVNAAVNGSSNYGKINGNITVGQSRSFDTAPLGGRLNL
           ||||||||||:|||||||||||||||||||||||||||||||||||||||||||||||||
g285       AAQNITGSLNASAQIGGRVGSPSVNAAVNGSSNYGKINGNITVGQSRSFDTAPLGGRLNL
              910        920        930        940        950        960

970        980        990        1000       1010       1020
m285.pep   TVADAEVFRNFLPVGQTVKGSLNAAVTLGGSIADPHLGGSINGDKLYYRNQTQGIILDNG
           ||||||:|||||||||||||||||||||||||||||||||||||||||||||||||||||
g285       TVADAEAFRNFLPVGQTVKGSLNAAVTLGGSIADPHLGGSINGDKLYYRNQTQGIILDNG
              970        980        990        1000       1010       1020

1030       1040       1050       1060       1070       1080
m285.pep   SLRSHIAGRKWVIDSLKFRHEGTAELSGTVGMENSGPDVDIGAVFDKYRILSRPNRRLTV
           ||||||||||||||||||||||||||||||:||||:||||||||||||||||||||||||
g285       SLRSHIAGRKWVIDSLKFRHEGTAELSGTVSMENSVPDVDIGAVFDKYRILSRPNRRLTV
              1030       1040       1050       1060       1070       1080

1090       1100       1110       1120       1130       1140
m285.pep   SGNTRLRYSPQKGISVTGMIKTDQGLFGSQKSSMPSVGDDVVVLGEVKKEAAAPLPVNMN
           |||||||||||||||||||||||||||||||||||||||||||||||||||||| ||||||
g285       SGNTRLRYSPQKGISVTGMIKTDQGLFGSQKSSMPSVGDDVVVLGEVKKEAAASLPVNMN
              1090       1100       1110       1120       1130       1140

1150       1160       1170       1180       1190       1200
m285.pep   LTDDLNDGIRFAGYGADVTIGGKLTLTAQSGGSVRGVGTVRVIKGRYKAYGQDLDITKGT
           ||||||||||||:|||||||||||||||||:||:||||||||||||||||||||||||||
g285       LTDDLNDGIRFSGYGADVTIGGKLTLTAQPGGNVRGVGTVRVIKGRYKAYGQDLDITKGT
              1150       1160       1170       1180       1190       1200

1210       1220       1230       1240       1250       1260
m285.pep   VSFVGPLNDPNLNIRAERRLSPVGAGVEILGSLNSPRITLTANEPMSEKDKLSWLILNRA
           ||||||||||||||||||||||||||||||||||||||||||||||||||||||||||||
g285       VSFVGPLNDPNLNIRAERRLSPVGAGVEILGSLNSPRITLTANEPMSEKDKLSWLILNRA
              1210       1220       1230       1240       1250       1260

1270       1280       1290       1300       1310       1320
m285.pep   GSGSSGDNAALSAAAGALLAGQINDRIGLVDDLGFTSKRSRNAQTGELNPAEQVLTVGKQ
           ||||||||||||||||||||||||||||||||||||||||||||||||||||||||||||
g285       GSGSSGDNAALSAAAGALLAGQINDRIGLVDDLGFTSKRSRNAQTGELNPAEQVLTVGKQ
              1270       1280       1290       1300       1310       1320

1330       1340       1350       1360       1370       1380
m285.pep   LTGKLYIGYEYSISSAEQSVKLIYRLTRAIQAVARIGSRSSGGELTYTIRFDRFSGSDKK
           ||||||||||:|||||||||||||||||||||||||||||||||||||||||||:|||||
g285       LTGKLYIGYEYGISSAEQSVKLIYRLTRAIQAVARIGSRSSGGELTYTIRFDRLFGSDKK
              1330       1340       1350       1360       1370       1380

1390
m285.pep   DSAGNGKGKX
           ||||||||||
g285       DSAGNGKGKX
```

The following partial DNA sequence was identified in *N. meningitidis* <SEQ ID 1185>:

a285.seq
```
   1 ATGACCGATA CCGCACCGAC AGATACCGAT CCGACCGAAA ACGGCACGCG
  51 CAAAATGCCG TCTGAACACC GCCCTACCCC GCCGGCAAAA AAACGCCGCC
 101 CGCTGCTGAA GCTGTCGGCG GCACTGCTGT CTGTTCTGAT TTTGGCAGTA
 151 TGTTTCCTCG GCTGGCTCGC CGGCACGGAA GCGGGTTTGC GCTTCGGGCT
 201 GTACCAAATC CCGTCTTGGT TCGGCGTAAA CATTTCCTCC CAAAACCTCA
 251 AAGGCACGCT GCTCGACGGC TTCGACGGCG ACAACTGGTC GATAGAAACC
 301 GAGGGGGCAG ACCTTAAAAT CAGCCGCTTC CGCTTCGCGT GGAAACCGTC
 351 CGAACTGATG CGCCGCAGCC TGCACATTAC CGAAATTTCC GCCGGCGACA
 401 TCGCCATCGT TACCAAACCG ACTCCGCCTA AGAAGAACG CCCGCCGCTC
 451 AGCCTTCCCG ACAGCATAGA CCTGCCTGCC GCCGTCTATC TCGACCGCTT
 501 CGAGACGGGC AAAATCAGCA TGGGCAAAGC CTTTGACAAA CAAACCGTCT
 551 ATCTCGAACG GCTGGATGCT TCATACCGTT ACGACCGCAA AGGACACCGC
 601 CTCGACCTGA AGGCTGCCGA CACGCCGTGG AGCAGTTCGT CGGGGTCAGC
 651 CTCGGTCGGC TTGAAAAAAC CGTTTGCCCT CGATACCGCC ATTTACACCA
 701 AAGGCGGACT CGAAGGCAAA ACCATACACA GTACGGCTCG GCTGAGCGGC
 751 AGCCTGAAGG ATGTGCGCGC CGAACTGGCG ATCGACGGCG GCAATATCCG
 801 CCTCTCGGGA AAATCCGTCA TCCACCCGTT TGCCGAATCA TTGGATAAAA
 851 CATTGGAAGA AGTACTGGTC AAAGGGTTCA ACATCAATCC GTCCGCCTTC
 901 GTGCCTTCCC TGCCCGATGC CGGGCTGAAT TTCGACCTGA CCGCCATCCC
 951 GTCGTTTTCA GACGGCATCG CGCTGGAAGG CTCGCTCGAT TTGGAAAACA
1001 CCAAAGCCGG CTTTGCCGAC CGCAACGGCA TCCCCGTCCG TCAGGTTTTA
1051 GGCAGCTTTG TCATCCGGCA GGACGGCACG GTGCATATCG GCAATACGTC
1101 CGTCGCCCTG CTCGGACGGG GCGGCATCAG GCTGTCGGGC AAAATCGACA
1151 CCGAAAAAGA CATCCTCGAT TTAAATATAG GCATCAACTC CGTCGGCGCG
1201 GAAGACGTAC TGCAAACCGC GTTCAAAGGC AGGTTGGACG GCAGCATCGG
1251 CATCGGTGGC ACGACCGCCT CGCCCAAAAT CTCTTGGCAA CTCGGCATCG
1301 GCACGGCGCG CACGGACGGC AGCCTCGCCA TTGCAAGCGA CCCCGCAAAC
1351 GGACAGCGGA AACTGGTGCT CGACACCGTC AACATCGCCG CCGGGCAAGG
1401 CAGCCTGACC GCGCAAGGCT ATCTCGAGCT GTTTAAAGAC CGCCTGCTCA
1451 AGCTGGACAT CCGTTCCCGC GCATTCGACC CTTCGCGCAT CGATCCGCAA
1501 CTTCCGGCAG GCAATATCAA CGGCTCAATA AACCTTGCCG GCGAACTGGC
1551 AAAAGAGAAA TTCACAGGCA AAATGCGGTT TTTACCCGGC ACGTTCAACG
1601 GCGTACCGAT TGCCGGCAGT GCCGACATTG TTTACGAGTC CGCCACCTT
1651 CCGCGTGCCG CCGTCGATTT GCGGCTGGGG CGGAACATTA TTAAAACAGA
1701 CGGCGGCTTC GGCAAAAAAG GCGACCGGCT TAACCTCAAT ATCACCGCAC
1751 CCGATTTATC CCGTTTCGGT TTCGGACTCG CGGGGTCTTT AAATGTACGC
1801 GGACACCTTT CCGGCGATTT GGACGGTGGC ATCCGAACCT TTGAAACCGA
1851 CCTTTCCGGC GCGGCGCGCA ACCTGCACAT CGGCAAGGCG GCAGACATCC
1901 GTTCGCTCGA TTTCACGCTC AAAGGTTCGC CGACACAAG CCGCCCGATA
1951 CGCGCCGACA TCAAAGGCAG CCGCCTTTCG CTGTCGGGCG GAGCGGAGGT
```

-continued

```
2001 TGTCGATACC GCCGACCTGA TGCTGGACGG CACGGGCGTG CAGCACCGCA

2051 TCCGCACACA CGCCGCCATG ACGCTGGATG GCAAACCGTT CAAATTCGAT

2101 TTGGACGCTT CAGGCGGCAT CAACAGGGAA CTTACCCGAT GGAAAGGCAG

2151 CATCGGCATC CTCGACATCG GCGGCGCATT CAACCTCAAG CTGCAAAACC

2201 GTATGACGCT CGAAGCCGGT GCGGAACGCG TGGCGGCAAG TGCGGCAAAT

2251 TGGCAGGCAA TGGGCGGCAG CCTCAACCTG CAACACTTTT CTTGGGATAA

2301 AAAAACCGGC ATATCGGCAA AAGGCGGCGC ACACGGTCTG CATATCGCCG

2351 AGTTGCACAA TTTCTTCAAA CCGCCCTTCG AACACAATCT GGTTTTAAAC

2401 GGCGACTGGG ATGTCGCCTA CGGGCGAAAC GCGCGCGGCT ACCTCAATAT

2451 CAGCCGGCAA AGCGGCGATG CCGTATTGCC CGGCGGGCAG GCTTTGGGTT

2501 TGAACGCATT TTCCCTGAAA ACGCGCTTTC AAAACGACCG TATCGGAATC

2551 CTGCTTGACG GCGGCGCGCG TTTCGGGCGG ATTAACGCCG ATTTGGACAT

2601 CGGCAACGCC TTCGGCGGCA ATATGGCAAA TGCACCGCTC GGCGGCAGGA

2651 TTACCGCCTC CCTTCCCGAC TTGGGCACAT TGAAGCCCTT TCTGCCCGCC

2701 GCCGCGCAAA ACATTACCGG CAGCCTGAAT GCCGCCGCGC AAATCGGCGG

2751 ACGGGTCGGC TCTCCGTCCG TCAATGCCGC CGTCAACGGC AGCAGCAACT

2801 ACGGGAAAAT CAACGGCAAC ATCACCGTCG GCAAAGCCG CTCTTTCGAT

2851 ACCGCGCCTT TGGGCGGCAG GCTCAACCTG ACCGTTGCCG ATGCCGAAGT

2901 ATTCCGCAAC TTCCTACCGG TCGGACAAAC CGTCAAAGGC AGCCTGAATG

2951 CCGCCGTAAC CCTCGGCGGC AGCATCGCCG ATCCGCACTT GGGCGGCAGC

3001 ATCAACGGCG ACAAACTCTA TTACCGCAAC CAAACCCAAG GCATCATCTT

3051 GGACAACGGC TCGCTGCGTT CGCATATCGC GGGCAGGAAA TGGGTAATCG

3101 ACAGCCTGAA ATTCCGGCAC GAAGGGACGG CGGAACTCTC CGGTACGGTC

3151 GGTATGGAAA ACAGCGGACC CGATGTCGAT ATCGGCGCGG TGTTCGACAA

3201 ATACCGCATC CTGTCCCGCC CCAACCGCCG CCTGACGGTT TCCGGCAACA

3251 CCCGCCTGCG CTATTCGCCG CAAAAAGGCA TATCCGTTAC CGGGATGATT

3301 AAAACGGATC AGGGGCTGTT CGGTTCGCAA AAATCCTCGA TGCCGTCCGT

3351 CGGCGACGAT GTCGTCGTAT TAGGCGAAGT CAAAAAAGAG GCGGCGGCAC

3401 CGCTCCCCGT CAATATGAAC CTGACTTTAG ACCTCAATGA CGGCATCCGC

3451 TTCGCCGGCT ACGGCGCGGA CGTTACCATA GGCGGCAAAC TGACCCTGAC

3501 CGCCCAATCG GGCGGAAGCG TGCGGGGCGT GGGCACGGTC CGCGTCATCA

3551 AAGGGCGTTA TAAGGCATAC GGGCAGGATT TGGACATTAC CAAAGGCACG

3601 GTCTCCTTTG TCGGCCCGCT CAACGACCCC AACCTCAACA TCCGCGCCGA

3651 ACGCCGCCTT TCCCCCGTCG GTGCGGGCGT GGAAATATTG GGCAGCCTCA

3701 ACAGTCCGCG CATTACGCTG ACGGCAAACG AACCGATGAG TGAAAAAGAC

3751 AAGCTCTCCT GGCTCATCCT CAACCGCGCC GGCAGTGGCA GCAGCGGCGA

3801 CAATGCCGCC CTGTCCGCAG CCGCCGGCGC GCTGCTTGCC GGGCAAATCA

3851 ACGACCGCAT CGGGCTGGTG GATGATTTGG GCTTTACCAG CAAGCGCAGC

3901 CGCAACGCGC AAACCGGCGA ACTCAACCCC GCCGAACAGG TGCTGACCGT

3951 CGGCAAACAA CTGACCGGCA AACTCTACAT CGGCTACGAA TACAGCATCT

4001 CCAGCGCGGA ACAGTCCGTC AAACTGATTT ACCGGCTGAC CCGCGCCATA
```

```
-continued
4051  CAGGCGGTTG CCCGTATCGG CAGCCGTTCG TCGGGCGGCG AGCTGACATA
4101  CACCATACGT TTCGACCGCT TCTCCGGTTC GGACAAAAAA GACTCCGCCG
4151  GAAACAGCAA AGGAAAATAA
```

This corresponds to the amino acid sequence <SEQ ID 1186; ORF 285.a>:

```
a285.pep
    1  MTDTAPTDTD PTENGTRKMP SEHRPTPPAK KRRPLLKLSA ALLSVLILAV
   51  CFLGWLAGTE AGLRFGLYQI PSWFGVNISS QNLKGTLLDG FDGDNWSIET
  101  EGADLKISRF RFAWKPSELM RRSLHITEIS AGDIAIVTKP TPPKEERPPL
  151  SLPDSIDLPA AVYLDRFETG KISMGKAFDK QTVYLERLDA SYRYDRKGHR
  201  LDLKAADTPW SSSSGSASVG LKKPFALDTA IYTKGGLEGK TIHSTARLSG
  251  SLKDVRAELA IDGGNIRLSG KSVIHPFAES LDKTLEEVLV KGFNINPSAF
  301  VPSLPDAGLN FDLTAIPSFS DGIALEGSLD LENTKAGFAD RNGIPVRQVL
  351  GSFVIRQDGT VHIGNTSVAL LGRGGIRLSG KIDTEKDILD LNIGINSVGA
  401  EDVLQTAFKG RLDGSIGIGG TTASPKISWQ LGIGTARTDG SLAIASDPAN
  451  GQRKLVLDTV NIAAGQGSLT AQGYLELFKD RLLKLDIRSR AFDPSRIDPQ
  501  LPAGNINGSI NLAGELAKEK FTGKMRFLPG TFNGVPIAGS ADIVYESRHL
  551  PRAAVDLRLG RNIIKTDGGF GKKGDRLNLN ITAPDLSRFG FGLAGSLNVR
  601  GHLSGDLDGG IRTFETDLSG AARNLHIGKA ADIRSLDFTL KGSPDTSRPI
  651  RADIKGSRLS LSGGAEVVDT ADLMLDGTGV QHRIRTHAAM TLDGKPFKFD
  701  LDASGGINRE LTRWKGSIGI LDIGGAFNLK LQNRMTLEAG AERVAASAAN
  751  WQAMGGSLNL QHFSWDKKTG ISAKGGAHGL HIAELHNFFK PPFEHNLVLN
  801  GDWDVAYGRN ARGYLNISRQ SGDAVLPGGQ ALGLNAFSLK TRFQNDRIGI
  851  LLDGGARFGR INADLDIGNA FGGNMANAPL GGRITASLPD LGTLKPFLPA
  901  AAQNITGSLN AAAQIGGRVG SPSVNAAVNG SSNYGKINGN ITVGQSRSFD
  951  TAPLGGRLNL TVADAEVFRN FLPVGQTVKG SLNAAVTLGG SIADPHLGGS
 1001  INGDKLYYRN QTQGIILDNG SLRSHIAGRK WVIDSLKFRH EGTAELSGTV
 1051  GMENSGPDVD IGAVFDKYRI LSRPNRRLTV SGNTRLRYSP QKGISVTGMI
 1101  KTDQGLFGSQ KSSMPSVGDD VVVLGEVKKE AAAPLPVNMN LTLDLNDGIR
 1151  FAGYGADVTI GGKLTLTAQS GGSVRGVGTV RVIKGRYKAY GQDLDITKGT
 1201  VSFVGPLNDP NLNIRAERRL SPVGAGVEIL GSLNSPRITL TANEPMSEKD
 1251  KLSWLILNRA GSGSSGDNAA LSAAAGALLA GQINDRIGLV DDLGFTSKRS
 1301  RNAQTGELNP AEQVLTVGKQ LTGKLYIGYE YSISSAEQSV KLIYRLTRAI
 1351  QAVARIGSRS SGGELTYTIR FDRFSGSDKK DSAGNSKGK*
``` m285/a285 99.4% identity in 1389 aa overlap

```
                    10         20         30         40         50         60
m285.pep   MTDTAPTDTDPTENGTRKMPSHERPTPPAKKRRPLLKLSAALLSVLILAVCFLGWLAGTE
           ||||||||||||||||||||||||||| |||||||||||||||||||||||||||||||||
a285       MTDTAPTDTDPTENGTRKMPSHERPAPPAKKRRPLLKLSAALLSVLILAVCFLGWIAGTE
                    10         20         30         40         50         60
```

-continued

```
                  70        80        90        100       110       120
m285.pep  AGLRFGLYQIPSWFGVNISSQNLKGTLLDGFDGDNWSIETEGADLKISRFRFAWKPSELM
          ||||||||||||||||||||||||||||||||||||||||||||||||||||||||||||
a285      AGLRFGLYQIPSWFGVNISSQNLKGTLLDGFDGDNWSIETEGADLKISRFRFAWKPSELM
                  70        80        90        100       110       120

130       140       150       160       170       180
m285.pep  RRSLHITEISAGDIAIVTKPTPPKEERPPLSLPDSIDLPAAVYLDRFETGKISMGKAFDK
          ||||||||||||||||||||||||||||||||||||||||||||||||||||||||||||
a285      RRSLHITEISAGDIAIVTKPTPPKEERPPLSLPDSIDLPAAVYLDRFETGKISMGKAFDK
                  130       140       150       160       170       180

190       200       210       220       230       240
m285.pep  QTVYLERLDASYRYDRKGHRLDLKAADTPWSSSSGAASVGLKKPFALDTAIYTKGGLEGK
          |||||||||||||||||||||||||||||||||||:||||||||||||||||||||||||
a285      QTVYLERLDASYRYDRKGHRLDLKAADTPWSSSSGSASVGLKKPFALDTAIYTKGGLEGK
                  190       200       210       220       230       240

250       260       270       280       290       300
m285.pep  TIHSTARLSGSLKDVRAELAIDGGNIRLSGKSVIHPFAESLDKTLEEVLVKGFNINPAAF
          ||||||||||||||||||||||||||||||||||||||||||||||||||||||||:||
a285      TIHSTARLSGSLKDVRAELAIDGGNIRLSGKSVIHPFAESLDKTLEEVLVKGFNINPSAF
                  250       260       270       280       290       300

310       320       330       340       350       360
m285.pep  VPSLPDAGLNFDLTAIPSFSDGIALEGSLDLENTKAGFADRNGIPVRQVLGGFVIRQDGT
          |||||||||||||||||||||||||||||||||||||||||||||||||:||||||||
a285      VPSLPDAGLNFDLTAIPSFSDGIALEGSLDLENTKAGFADRNGIPVRQVLGSFVIRQDGT
                  310       320       330       340       350       360

370       380       390       400       410       420
m285.pep  VHIGNTSAALLGRGGIRLSGKIDTEKDILDLNIGINSVGAEDVLQTAFKGRLDGSIGIGG
          |||||||:||||||||||||||||||||||||||||||||||||||||||||||||||
a285      VHIGNTSVALLGRGGIRLSGKIDTEKDILDLNIGINSVGAEDVLQTAFKGRLDGSIGIGG
                  370       380       390       400       410       420

430       440       450       460       470       480
m285.pep  TTASPKISWQLGIGTARTDGSLAIASDPANGQRKLVLDTVNIAAGQGSLTAQGYLELFKD
          ||||||||||||||||||||||||||||||||||||||||||||||||||||||||||||
a285      TTASPKISWQLGIGTARTDGSLAIASDPANGQRKLVLDTVNIAAGQGSLTAQGYLELFKD
                  430       440       450       460       470       480

490       500       510       520       530       540
m285.pep  RLLKLDQRSRAFDPSRIDPQLPAGNINGSINLAGELAKEKFTGKMRFLPGTFNGVPIAGS
          ||||||||||||||||||||||||||||||||||||||||||||||||||||||||||||
a285      RLLKLDQRSRAFDPSRIDPQLPAGNINGSINLAGELAKEKFTGKMRFLPGTFNGVPIAGS
                  490       500       510       520       530       540

550       560       570       580       590       600
m285.pep  ADIVYESRHLPRAAVDLRLGRNIIKTDGGFGKKGDRLNLNITAPDLSRFGFGLAGSLNVR
          ||||||||||||||||||||||||||||||||||||||||||||||||||||||||||||
a285      ADIVYESRHLPRAAVDLRLGRNIIKTDGGFGKKGDRLNLNITAPDLSRFGFGLAGSLNVR
                  550       560       570       580       590       600

610       620       630       640       650       660
m285.pep  GHLSGDLDGGIRTFETDLSGAARNLHIGKAADIRSLDFTLKGSPDTSRPIRADIKGSRLS
          ||||||||||||||||||||||||||||||||||||||||||||||||||||||||||||
a285      GHLSGDLDGGIRTFETDLSGAARNLHIGKAADIRSLDFTLKGSPDTSRPIRADIKGSRLS
                  610       620       630       640       650       660

670       680       690       700       710       720
m285.pep  LSGGAAVVDTADLMLDGTGVQHRIRTHAAMTLDGKPFKFDLDASGGINRELTRWKGSIGI
          |||||  ||||||||||||||||||||||||||||||||||||||||||||||||||||
a285      LSGGAEVVDTADLMLDGTGVQHRIRTHAAMTLDGKPFKFDLDASGGINRELTRWKGSIGI
                  670       680       690       700       710       720

730       740       750       760       770       780
m285.pep  LDIGGAFNLKLQNRMTLEAGAERVAASAANWQAMGGSLNLQHFSWDKKTGISAKGGAHGL
          ||||||||||||||||||||||||||||||||||||||||||||||||||||||||||||
a285      LDIGGAFNLKLQNRMTLEAGAERVAASAANWQAMGGSLNLQHFSWDKKTGISAKGGAHGL
                  730       740       750       760       770       780

790       800       810       820       830       840
m285.pep  HIAELHNFFKPPFEHNLVLNGDWDVAYGRNARGYLNISRQSGDAVLPGGQALGLNAFSLK
          ||||||||||||||||||||||||||||||||||||||||||||||||||||||||||||
a285      HIAELHNFFKPPFEHNLVLNGDWDVAYGRNARGYLNISRQSGDAVLPGGQALGLNAFSLK
                  790       800       810       820       830       840

850       860       870       880       890       900
m285.pep  TRFQNDRIGILLDGGARFGRINADLGIANAFGGNMANAPLGGRITASLPDLGALKPFLPA
          |||||||||||||||||||||||| :||||||||||||||||||||||||||:|||||||
a285      TRFQNDRIGILLDGGARFGRINADLGIGNAFGGNMANAPLGGRITASLPDLGTLKPFLPA
                  850       860       870       880       890       900

910       920       930       940       950       960
m285.pep  AAQNITGSLNAAAQIGGRVGSPSVNAAVNGSSNYGKINGNITVGQSRSFDTAPLGGRLNL
          ||||||||||||||||||||||||||||||||||||||||||||||||||||||||||||
a285      AAQNITGSLNAAAQIGGRVGSPSVNAAVNGSSNYGKINGNITVGQSRSFDTAPLGGRLNL
                  910       920       930       940       950       960
```

```
            970        980        990       1000       1010       1020
m285.pep  TVADAEVFRNFLPVGQTVKGSLNAAVTLGGSIADPHLGGSINGDKLYYRNQTQGIILDNG
          ||||||||||||||||||||||||||||||||||||||||||||||||||||||||||||
a285      TVADAEVFRNFLPVGQTVKGSLNAAVTLGGSIADPHLGGSINGDKLYYRNQTQGIILDNG
            970        980        990       1000       1010       1020

1030       1040       1050       1060       1070       1080
m285.pep  SLRSHIAGRKWVIDSLKFRHEGTAELSGTVGMENSGPDVDIGAVFDKYRILSRPNRRLTV
          ||||||||||||||||||||||||||||||||||||||||||||||||||||||||||||
a285      SLRSHIAGRKWVIDSLKFRHEGTAELSGTVGMENSGPDVDIGAVFDKYRILSRPNRRLTV
           1030       1040       1050       1060       1070       1080

1090       1100       1110       1120       1130       1140
m285.pep  SGNTRLRYSPQKGISVTGMIKTDQGLFGSQKSSMPSVGDDVVVLGEVKKEAAAPLPVNMN
          ||||||||||||||||||||||||||||||||||||||||||||||||||||||||||||
a285      SGNTRLRYSPQKGISVTGMIKTDQGLFGSQKSSMPSVGDDVVVLGEVKKEAAAPLPVNMN
           1090       1100       1110       1120       1130       1140

1150       1160       1170       1180       1190       1200
m285.pep  LTLDLNDGIRFAGYGADVTIGGKLTLTAQSGGSVRGVGTVRVIKGRYKAYGQDLDITKGT
          ||||||||||||||||||||||||||||||||||||||||||||||||||||||||||||
a285      LTLDLNDGIRFAGYGADVTIGGKLTLTAQSGGSVRGVGTVRVIKGRYKAYGQDLDITKGT
           1150       1160       1170       1180       1190       1200

1210       1220       1230       1240       1250       1260
m285.pep  VSFVGPLNDPNLNIRAERRLSPVGAGVEILGSLNSPRITLTANEPMSEKDKLSWLILNRA
          ||||||||||||||||||||||||||||||||||||||||||||||||||||||||||||
a285      VSFVGPLNDPNLNIRAERRLSPVGAGVEILGSLNSPRITLTANEPMSEKDKLSWLILNRA
           1210       1220       1230       1240       1250       1260

1270       1280       1290       1300       1310       1320
m285.pep  GSGSSGDNAALSAAAGALLAGQINDRIGLVDDLGFTSKRSRNAQTGELNPAEQVLTVGKQ
          ||||||||||||||||||||||||||||||||||||||||||||||||||||||||||||
a285      GSGSSGDNAALSAAAGALLAGQINDRIGLVDDLGFTSKRSRNAQTGELNPAEQVLTVGKQ
           1270       1280       1290       1300       1310       1320

1330       1340       1350       1360       1370       1380
m285.pep  LTGKLYIGYEYSISSAEQSVKLIYRLTRAIQAVARIGSRSSGGELTYTIRFDRFSGSDKK
          ||||||||||||||||||||||||||||||||||||||||||||||||||||||||||||
a285      LTGKLYIGYEYSISSAEQSVKLIYRLTRAIQAVARIGSRSSGGELTYTIRFDRFSGSDKK
           1330       1340       1350       1360       1370       1380

1390
m285.pep  DSAGNGKGKX
          |||||:||||
a285      DSAGNSKGKX
           1390
```

The following partial DNA sequence was identified in *N. gonorrhoeae* <SEQ ID 1187>:

```
g285-1.seq
     1    CTGAAGCTGT CGGCGGCACT GCTGTCTGTC CTGATTTTGG CAGTATGTTT

51    CCTCGGCTGG ATCGCCGGTA CGGAAGCAGG TTTGCGCTTC GGGCTGTACC

101    AAATCCCGTC CTGGTTCGGC GTAAACATTT CCTCCCAAAA CCTCAAGGC

151    ACACTGCTCG ACGGCTTCGA CGGCGACAAC TGGTCGATAG AAACCGAGGG

201    GGCAGACCTT AAAATCAGCC GCTTCCGCTT CGCGTGGAAA CCGTCCGAAC

251    TGATGCGCCG CAGCCTGCAC ATCACCGACA TCTCCGCCGG CGACATCGCC

301    ATCGTAACCA AACCGACTCC GCCTAAAGAA GAACGCCCGC CTCAAGGCCT

351    GCCCGACAGC ATAGACCTGC CCGCCGCCGT CTATCTCGAC CGCTTCGAGA

401    CGGGCAAAAT CAGCATGGGC AAAACCTTTG ACAAACAAAC CGTCTATCTC

451    GAACGCCTCA ACGCGGCATA CCGTTACGAC CGTAAAGGGC ACCGCCTCGA

501    CCTGAAGGCC GCCGACACGC CGTGGAGCAG TTCGTCGGGG TCAGCCTCGG

551    TCGGCTTGAA AAACCGTTT GCCCTCGATA CCGCCATTTA CACCAAAGGC

601    GGATTCGAAG GCGAAACCAT ACACAGTACG GCGCGGCTGA GCGGCAGCCT

651    GAAGGATGTG CGCGCCGAAC TGACGATCGA CGGCGGCAAT ATCCGCCTCT

701    CGGGAAAATC CGTCATCCAC CCGTTTGCCG AATCATTGGA TAAAACATTG

751    GAAGAAGTAC TGGTCAAAGG ATTCAACATC AATCCGTCCG CCTTCGTGCC
```

```
 801   TTCCCTGCCC GATGCCGGGC TGAATTTCGA CCTGACCGCC ATCCCGTCGT

851   TTTCAGACGG CATCGCGCTG GAAGGCTCGC TCGATTTGGA AACACCAAA

901   GCCGGCTTTG CCGACCGCAA CGGCATCCCC GTCCGTCAGG TTTTGGGCGG

951   CTTTGTCATC CGGCAGGACG GCACGGTGCA TATCGGCAAT ACGTCCGCCG

1001   CCCTGCTCGG ACGGGGCGGC ATCAGGCTGT CGGGCAAAAT CGACACCGAA

1051   AAAGACATCC TTGATTTAAA TATAGGCATC AACTCCGTCG GCGCGGAAGA

1101   CGTGCTGCAA ACCGCGTTCA AAGGCAGGTT GGACGGCAGC ATCGGCATCG

1151   GCGGCACGAC CGCCTCGCCC AAAATCTCTT GGCAACTCGG CACCGGCACG

1201   GCACGCACGG ACGGCAGCCt cgcCATCGCA AGCGAcCCCG CAAACGAACA

1251   GCGGAAACTG GTGTTCGACA CCGTCAACAT CTCCGCCGGG AAGGCAGCC

1301   TGACCGCGCA AGGCTATCTC GAGCTGTTTA AGACCGCCT GCTCAAGCTG

1351   GACATCCGTT CCCGCGCATT CGACCCTTCG CGCATCGATC CGCAATTTCC

1401   GGCAGGCgat atCAACGGTT CGATTCATCT TGCCGGTGAA CTGGCAAAAG

1451   AGAAATTTAC GGGCAAAATG CGTTTTTTGC CCGGTACGTT CAACGGCGTG

1501   CCGATTGCCG GCAGCGCCGA CATTGTTTAC GAGTCCCGCC ACCTTCCGCG

1551   CGCCGCCGTC GATTTGCGGT TGGGGCGGAA CATCGTCAAA ACAGACGGCG

1601   GCTTCGGCAA AAAAGGCGAC CGGCTTAACC TCAATATCAC CGCACCCGAT

1651   TTATCCCGTT TCGGTTTCGG ACTCGCGGGG TCTTTAAATG TACGCGGACA

1701   CCTTTCCGGC GATTTGGACG GCGGCATCCG AACCTTTGAA CCGACCTTT

1751   CCGGCACGGC GCGCAACTTA CACATCGGCA AGCGGCAGA CATCCGTTCG

1801   CTCGATTTTA CCCTCAAAGG CTCACCCGGC ACAAGCCGCC CGATGCGCGC

1851   CGATATCAAG GGCGGCCGCC TTTCCCTGTC GGGCGGCGCG GCGGTTGTCG

1901   ATACCGCCGG CCTGACGCTG GAAGGTACGG GCGCGCAGCA CCGCATCCGC

1951   ACACACGCCG CCATGACGCT GGACGGCAAA CCGTTCAAAC TCGATTTGGA

2001   CGCTTCAGGC GGCATCAACA GGGAACTTAC CCGATGGAAA GGCAGCATCG

2051   GCATCCTCGA CATCGGCGGC GCATTCAACC TCAAGCTGCA AAACCGTATG

2101   ACGCTCGAAG CCGGTGCGGA ACACGTGGCG GCAAGTGCGG CAAATTGGCA

2151   GGCAATGGGC GGCAGCCTCA ACCTGCAACA CTTTTCTTGG ACAGGAAAA

2201   CCGGCATATC GGCAAAAGGC GGCGCACGCG GCCTGCACAT CGCCGAGTTG

2251   CACAATTTCT TCAAACCGCC CTTCGAACAC AATCTGGTTT TAAACGGCGA

2301   CTGGGATGTC GCCTACGGGC ACAACGCGCG CGGCTACCTC AATATCAGCC

2351   GGCAAAGCGG CGATGCCGTA TTGCCCGGCG GCAGGCTTT GGGTTTGAAC

2401   GCATTTTCCC TGAAAACGCG CTTTCAAAAC GACCGCATCG GAATCCTGCT

2451   TGACGGCGGC GCGCGTTTCG GACGGATTAA CGCCGATTTG GCATCGGCA

2501   ACGCCTTCGG CGGCAATATG GCAAATACAC CGCTCGGCGG CAGGATTACA

2551   GCCTCCCTTC CCGACTTGGG CGCATTGAAG CCCTTTCTGC CCGCCGCCGC

2601   GCAAAACATT ACCGGCAGCC TGAATGCCTC CGCGCAAATC GGCGGACGGG

2651   TAGGCTCTCC GTCCGTCAAT GCCGCCGTCA ACGGTAGCAG CAACTACGGG

2701   AAAATCAACG GCAATATCAC CGTCGGGCAA AGCCGCTCCT TCGATACCGC

2751   ACCTTTGGGC GGCAGGCTCA ACCTGACCGT TGCCGATGCC GAAGCATTCC

2801   GCAACTTCCT ACCGGTCGGA CAAACCGTCA AAGGCAGCCT GAATGCCGCC
```

```
2851  GTAACCCTCG GCGGCAGCAT CGCCGACCCG CACTTGGGCG GCAGTATCAA

2901  CGGCGACAAG CTCTATTACC GCAACCAAAC CCAAGGCATC ATCTTGGACA

2951  ACGGCTCGCT GCGTTCGCAT ATTGCAGGCA GGAAATGGGT AATCGACAGC

3001  CTGAAATTCC GGCACGAAGG GACGGCGGAA CTCTCCGGCA CGGTCAGCAT

3051  GGAAAACAGC GTGCCCGATG TCGATATCGG CGCGGTGTTC GACAAATACC

3101  GCATCCTGTC CCGCCCCAAC CGCCGCCTGA CGGTTTCCGG CAACACCCGC

3151  CTGCGCTATT CGCCGCAAAA AGGCATATCC GTTACCGGTA TGATTAAAAC

3201  TGATCAGGGG CTGTTCGGTT CGCAAAAATC CTCGATGCCG TCCGTCGGCG

3251  ACGATGTCGT CGTATTGGGC GAAGTCAAGA AGAGGCGGC GGCATCGCTC

3301  CCCGTCAATA TGAACCTGAC TTTAGACCTC AATGACGGCA TCCGCTTCTC

3351  CGGCTACGGC GCGGACGTTA CCATAGGCGG CAAACTGACC CTGACCGCGC

3401  AACCGGCGG AAATGTGCGT GGGGTGGGCA CGGTCCGCGT CATCAAAGGG

3451  CGTTACAAAG CATACGGGCA GGATTTAGAC ATTACCAAAG CACAGTCTC

3501  CTTTGTCGGC CCGCTCAACG ACCCCAACCT GAACATCCGC GCCGAACGCC

3551  GCCTTTCCCC CGTCGGTGCG GGCGTGGAAA TATTGGGCAG CCTCAACAGC

3601  CCGCGCATTA CGCTGACGGC AAACGAACCG ATGAGTGAAA AAGACAAGCT

3651  CTCCTGGCTC ATCCTCAACC GTGCCGGCAG CGGCAGCAGC GGCGACAATG

3701  CCGCCCTGTC CGCAGCCGCA GGCGCGCTGC TTGCCGGGCA AATCAACGAC

3751  CGCATCGGGC TGGTGGATGA TTTGGGCTTT ACCAGCAAGC GCAGCCGCAA

3801  CGCGCAAACC GGCGAACTCA ACCCCGCCGA ACAGGTGCTG ACCGTCGGCA

3851  AACAACTGAC CGGCAAACTC TACATCGGCT ACGAATACGG CATCTCCAGC

3901  GCGGAACAGT CCGTCAAACT GATTTACCGG CTGACCCGCG CCATACAGGC

3951  GGTTGCCCGT ATCGGCAGCC GTTCGTCGGG CGGCGAGCTG ACATACACCA

4001  TACGTTTCGA CCGCCTCTTC GGTTCGGACA AAAAAGACTC CGCAGGAAAC

4051  GGCAAAGGGA AATAA
```

This corresponds to the amino acid sequence <SEQ ID 1188;
ORF 285-1.ng>:

```
g285-1.pep
    1  LKLSAALLSV LILAVCFLGW IAGTEAGLRF GLYQIPSWFG VNISSQNLKG

51  TLLDGFDGDN WSIETEGADL KISRFRFAWK PSELMRRSLH ITDISAGDIA

101  IVTKPTPPKE ERPPQGLPDS IDLPAAVYLD RFETGKISMG KTFDKQTVYL

151  ERLNAAYRYD RKGHRLDLKA ADTPWSSSSG SASVGLKKPF ALDTAIYTKG

201  GFEGETIHST ARLSGSLKDV RAELTIDGGN IRLSGKSVIH PFAESLDKTL

251  EEVLVKGFNI NPSAFVPSLP DAGLNFDLTA IPSFSDGIAL EGSLDLENTK

301  AGFADRNGIP VRQVLGGFVI RQDGTVHIGN TSAALLGRGG IRLSGKIDTE

351  KDILDLNIGI NSVGAEDVLQ TAFKGRLDGS IGIGGTTASP KISWQLGTGT

401  ARTDGSLAIA SDPANEQRKL VFDTVNISAG EGSLTAQGYL ELFKDRLLKL

451  DIRSRAFDPS RIDPQFPAGD INGSIHLAGE LAKEKFTGKM RFLPGTFNGV

501  PIAGSADIVY ESRHLPRAAV DLRLGRNIVK TDGGFGKKGD RLNLNITAPD

551  LSRFGFGLAG SLNVRGHLSG DLDGGIRTFE TDLSGTARNL HIGKAADIRS
```

-continued

```
 601   LDFTLKGSPG TSRPMRADIK GGRLSLSGGA AVVDTAGLTL EGTGAQHRIR
 651   THAAMTLDGK PFKLDLDASG GINRELTRWK GSIGILDIGG AFNLKLQNRM
 701   TLEAGAEHVA ASAANWQAMG GSLNLQHFSW DRKTGISAKG GARGLHIAEL
 751   HNFFKPPFEH NLVLNGDWDV AYGHNARGYL NISRQSGDAV LPGGQALGLN
 801   AFSLKTRFQN DRIGILLDGG ARFGRINADL GIGNAFGGNM ANTPLGGRIT
 851   ASLPDLGALK PFLPAAAQNI TGSLNASAQI GGRVGSPSVN AAVNGSSNYG
 901   KINGNITVGQ SRSFDTAPLG GRLNLTVADA EAFRNFLPVG QTVKGSLNAA
 951   VTLGGSIADP HLGGSINGDK LYYRNQTQGI ILDNGSLRSH IAGRKWVIDS
1001   LKFRHEGTAE LSGTVSMENS VPDVDIGAVF DKYRILSRPN RRLTVSGNTR
1051   LRYSPQKGIS VTGMIKTDQG LFGSQKSSMP SVGDDVVVLG EVKKEAAASL
1101   PVNMNLTLDL NDGIRFSGYG ADVTIGGKLT LTAQPGGNVR GVGTVRVIKG
1151   RYKAYGQDLD ITKGTVSFVG PLNDPNLNIR AERRLSPVGA GVEILGSLNS
1201   PRITLTANEP MSEKDKLSWL ILNRAGSGSS GDNAALSAAA GALLAGQIND
1251   RIGLVDDLGF TSKRSRNAQT GELNPAEQVL TVGKQLTGKL YIGYEYGISS
1301   AEQSVKLIYR LTRAIQAVAR IGSRSSGGEL TYTIRFDRLF GSDKKDSAGN
1351   GKGK*
```

The following partial DNA sequence was identified in *N. meningitidis* <SEQ ID 1189>:

```
m285-1.seq
   1   CTGAAGCTGT CGGCGGCACT GCTGTCTGTC CTGATTTTGG CAGTATGTTT
  51   CCTCGGCTGG CTCGCCGGTA CGGAAGCAGG TTTGCGCTTC GGGCTGTACC
 101   AAATCCCGTC TTGGTTCGGC GTAAACATTT CCTCCCAAAA CCTCAAAGGC
 151   ACGCTGCTCG ACGGCTTCGA CGGCGACAAC TGGTCGATAG AAACCGAGGG
 201   GGCAGACCTT AAAATCAGCC GCTTCCGCTT CGCGTGGAAA CCGTCCGAAC
 251   TGATGCGCCG CAGCCTGCAC ATTACCGAAA TTTCCGCCGG CGACATCGCC
 301   ATCGTTACCA AACCGACTCC GCCTAAAGAA GAACGCCCGC CGCTCAGCCT
 351   TCCCGACAGC ATAGACCTGC CTGCCGCCGT CTATCTCGAC CGCTTCGAGA
 401   CGGGCAAAAT CAGCATGGGC AAAGCCTTTG ACAAACAAAC CGTCTATCTC
 451   GAACGGCTGG ATGCTTCATA CCGTTACGAC CGCAAAGGAC ACCGCCTTGA
 501   CCTGAAGGCC GCCGACACGC CGTGGAGCAG TTCGTCGGGG GCGGCCTCGG
 551   TCGGCTTGAA AAAACCGTTT GCCCTCGATA CCGCCATTTA CACCAAAGGC
 601   GGACTCGAAG GCAAAAACCAT ACACAGTACG GCTCGGCTGA GCGGCAGCCT
 651   GAAGGATGTG CGCGCCGAAC TGGCGATCGA CGGCGGCAAT ATCCGCCTCT
 701   CGGGAAAATC CGTCATCCAC CCGTTTGCCG AATCATTGGA TAAAACATTG
 751   GAAGAAGTAC TGGTCAAAGG GTTCAACATC AATCCGGCCG CCTTCGTGCC
 801   TTCCCTGCCC GATGCCGGAC TGAATTTCGA CCTGACCGCC ATCCCGTCGT
 851   TTTCAGACGG CATCGCGCTG GAAGGTTCGC TCGATTTGGA AAACACCAAA
 901   GCCGGCTTTG CCGACCGCAA CGGCATCCCC GTCCGTCAGG TTTTAGGCGG
 951   CTTTGTCATC CGGCAGGACG GCACGGTGCA TATCGGCAAT ACGTCCGCCG
1001   CCCTGCTCGG ACGGGGCGGC ATCAGGCTGT CGGGCAAAAT CGACACCGAA
```

-continued

```
1051  AAAGACATCC TCGATTTAAA TATAGGCATC AACTCCGTCG GCGCGGAAGA

1101  CGTACTGCAA ACCGCGTTCA AAGGCAGGTT GGACGGCAGC ATCGGCATCG

1151  GTGGCACGAC CGCCTCGCCC AAAATCTCTT GGCAACTCGG CATCGGCACG

1201  GCGCGCACGG ACGGCAGCCT CGCCATTGCA AGCGACCCAG CAAACGGACA

1251  GCGGAAACTG GTGCTCGACA CCGTCAACAT CGCCGCCGGG CAAGGCAGCC

1301  TGACCGCGCA AGGCTATCTC GAGCTGTTTA AAGACCGCCT GCTCAAGCTG

1351  GACATCCGTT CCCGCGCATT CGACCCTTCG CGCATCGATC CGCAACTTCC

1401  GGCAGGCAAT ATCAACGGCT CAATAAACCT TGCCGGCGAA CTGGCAAAAG

1451  AGAAATTCAC AGGCAAAATG CGGTTTTTAC CCGGCACGTT CAACGGCGTA

1501  CCGATTGCCG GCAGTGCCGA CATTGTTTAC GAGTCCCGCC ACCTTCCGCG

1551  TGCCGCCGTC GATTTGCGGC TGGGGCGGAA CATTATTAAA ACAGACGGCG

1601  GCTTCGGCAA AAAAGGCGAC CGGCTTAACC TCAATATCAC CGCACCCGAT

1651  TTATCCCGTT TCGGTTTCGG ACTCGCGGGG TCTTTAAATG TACGCGGACA

1701  CCTTTCCGGT GATTTGGACG GCGGCATCCG AACCTTTGAA ACCGACCTTT

1751  CCGGCGCGGC GCGCAACCTG CACATCGGCA AGGCGGCAGA CATCCGTTCG

1801  CTCGATTTCA CGCTCAAAGG TTCGCCCGAC ACAAGCCGCC CGATACGCGC

1851  CGACATCAAA GGCAGCCGCC TTTCGCTGTC GGGCGGAGCG GCGGTTGTCG

1901  ATACCGCCGA CCTGATGCTG GACGGCACGG GCGTGCAGCA CCGCATCCGC

1951  ACACACGCCG CCATGACGCT GGATGGCAAA CCGTTCAAAT TCGATTTGGA

2001  CGCTTCAGGC GGCATCAACA GGGAACTTAC CCGATGGAAA GGCAGCATCG

2051  GCATCCTCGA CATCGGCGGC GCATTCAACC TCAAGCTGCA AAACCGTATG

2101  ACGCTCGAAG CCGGTGCGGA ACGCGTGGCG GCAAGTGCGG CAAATTGGCA

2151  GGCAATGGGC GGCAGCCTCA ACCTGCAACA CTTTTCTTGG GATAAAAAAA

2201  CCGGCATATC GGCAAAAGGC GGCGCACACG GTCTGCATAT CGCCGAGTTG

2251  CACAATTTCT TCAAACCGCC CTTCGAACAC AATCTGGTTT TAAACGGCGA

2301  CTGGGATGTC GCCTACGGGC GCAACGCGCG CGGCTACCTC AATATCAGCC

2351  GGCAAAGCGG CGATGCCGTA TTGCCCGGCG GCAGGCTTT GGGTTTGAAC

2401  GCATTTTCCC TGAAAACGCG CTTTCAAAAC GACCGCATCG GAATCCTGCT

2451  TGACGGCGGC GCGCGTTTCG GCGGATTAA CGCCGATTTG GCATCGCCA

2501  ACGCCTTCGG CGGCAATATG GCAAATGCAC CGCTCGGCGG CAGGATTACC

2551  GCCTCCCTTC CCGACTTGGG CGCATTGAAG CCCTTTCTGC CCGCCGCCGC

2601  GCAAAACATT ACCGGCAGCC TGAATGCCGC CGCGCAAATC GGCGGACGGG

2651  TAGGCTCTCC GTCCGTCAAT GCCGCCGTCA ACGGCAGCAG CAACTACGGG

2701  AAAATCAACG GCAACATCAC CGTCGGGCAA AGCCGCTCTT TCGATACCGC

2751  GCCTTTGGGC GGCAGGCTCA ACCTGACCGT TGCCGATGCC GAAGTATTCC

2801  GCAACTTCCT ACCGGTCGGA CAAACCGTCA AAGGCAGCCT GAATGCCGCC

2851  GTAACCCTCG GCGGCAGCAT CGCCGATCCG CACTTGGGCG GCAGCATCAA

2901  CGGCGACAAA CTCTATTACC GCAACCAAAC CCAAGGCATC ATCTTGGACA

2951  ACGGCTCGCT GCGTTCGCAT ATCGCGGGCA GGAAATGGGT AATCGACAGC

3001  CTGAAATTCC GGCACGAAGG GACGGCGGAA CTCTCCGGTA CGGTCGGTAT
```

```
3051    GGAAAACAGC GGACCCGATG TCGATATCGG CGCGGTGTTC GACAAATACC

3101    GCATCCTGTC CCGCCCCAAC CGCCGCCTGA CGGTTTCCGG CAACACCCGC

3151    CTGCGCTATT CGCCGCAAAA AGGCATATCC GTTACCGGGA TGATTAAAAC

3201    GGATCAGGGG CTGTTCGGTT CGCAAAAATC CTCGATGCCG TCCGTCGGCG

3251    ACGATGTCGT CGTATTAGGC GAAGTCAAAA AGAGGCGGC GGCACCGCTC

3301    CCCGTCAATA TGAACCTGAC TTTAGACCTC AATGACGGCA TCCGCTTCGC

3351    CGGCTACGGC GCGGACGTTA CCATAGGCGG CAAACTGACC CTGACCGCCC

3401    AATCGGGCGG AAGCGTACGG GGCGTGGGCA CGGTCCGCGT CATCAAAGGG

3451    CGTTATAAGG CATACGGGCA GGATTTGGAC ATTACCAAAG CACGGTCTC

3501    CTTTGTCGGC CCGCTCAACG ATCCCAACCT CAACATCCGC GCCGAACGCC

3551    GCCTTTCCCC CGTCGGTGCG GGCGTGGAAA TATTGGGCAG CCTCAACAGC

3601    CCGCGCATTA CGCTGACGGC AAACGAACCG ATGAGTGAAA AAGACAAGCT

3651    CTCTTGGCTC ATCCTCAACC GCGCCGGCAG CGGCAGCAGC GGCGACAATG

3701    CCGCCCTGTC TGCAGCCGCA GGTGCGCTGC TTGCCGGGCA AATCAACGAC

3751    CGCATCGGGC TGGTGGATGA TTTGGGCTTT ACCAGCAAGC GCAGCCGCAA

3801    CGCGCAAACC GGCGAACTCA ACCCCGCCGA ACAGGTGCTG ACCGTCGGCA

3851    AACAACTGAC CGGCAAACTC TACATCGGCT ACGAATACAG CATCTCCAGC

3901    GCGGAACAGT CCGTCAAACT GATTTACCGG CTGACCCGCG CCATACAGGC

3951    GGTTGCCCGT ATCGGCAGCC GTTCGTCGGG CGGCGAGCTG ACATACACCA

4001    TACGTTTCGA CCGCTTCTCC GGTTCGGACA AAAAGACTC CGCCGGAAAC

4051    GGCAAGGAA AATAA
```

This corresponds to the amino acid sequence <SEQ ID 1190; ORF 285-1>:

```
m285-1.pep
     1      LKLSAALLSV LILAVCFLGW LAGTEAGLRF GLYQIPSWFG VNISSQNLKG

51      TLLDGFDGDN WSIETEGADL KISRFRFAWK PSELMRRSLH ITEISAGDIA

101      IVTKPTPPKE ERPPLSLPDS IDLPAAVYLD RFETGKISMG KAFDKQTVYL

151      ERLDASYRYD RKGHRLDLKA ADTPWSSSSG AASVGLKKPF ALDTAIYTKG

201      GLEGKTIHST ARLSGSLKDV RAELAIDGGN IRLSGKSVIH PFAESLDKTL

251      EEVLVKGFNI NPAAFVPSLP DAGLNFDLTA IPSFSDGIAL EGSLDLENTK

301      AGFADRNGIP VRQVLGGFVI RQDGTVHIGN TSAALLGRGG IRLSGKIDTE

351      KDILDLNIGI NSVGAEDVLQ TAFKGRLDGS IGIGGTTASP KISWQLGIGT

401      ARTDGSLAIA SDPANGQRKL VLDTVNIAAG QGSLTAQGYL ELFKDRLLKL

451      DIRSRAFDPS RIDPQLPAGN INGSINLAGE LAKEKFTGKM RFLPGTFNGV

501      PIAGSADIVY ESRHLPRAAV DLRLGRNIIK TDGGFGKKGD RLNLNITAPD

551      LSRFGFGLAG SLNVRGHLSG DLDGGIRTFE TDLSGAARNL HIGKAADIRS

601      LDFTLKGSPD TSRPIRADIK GSRLSLSGGA AVVDTADLML DGTGVQHRIR

651      THAAMTLDGK PFKFDLDASG GINRELTRWK GSIGILDIGG AFNLKLQNRM

701      TLEAGAERVA ASAANWQAMG GSLNLQHFSW DKKTGISAKG GAHGLHIAEL

751      HNFFKPPFEH NLVLNGDWDV AYGRNARGYL NISRQSGDAV LPGGQALGLN
```

```
-continued
 801    AFSLKTRFQN DRIGILLDGG ARFGRINADL GIANAFGGNM ANAPLGGRIT

851    ASLPDLGALK PFLPAAAQNI TGSLNAAAQI GGRVGSPSVN AAVNGSSNYG

901    KINGNITVGQ SRSFDTAPLG GRLNLTVADA EVFRNFLPVG QTVKGSLNAA

951    VTLGGSIADP HLGGSINGDK LYYRNQTQGI ILDNGSLRSH IAGRKWVIDS

1001    LKFRHEGTAE LSGTVGMENS GPDVDIGAVF DKYRILSRPN RRLTVSGNTR

1051    LRYSPQKGIS VTGMIKTDQG LFGSQKSSMP SVGDDVVVLG EVKKEAAAPL

1101    PVNMNLTLDL NDGIRFAGYG ADVTIGGKLT LTAQSGGSVR GVGTVRVIKG

1151    RYKAYGQDLD ITKGTVSFVG PLNDPNLNIR AERRLSPVGA GVEILGSLNS

1201    PRITLTANEP MSEKDKLSWL ILNRAGSGSS GDNAALSAAA GALLAGQIND

1251    RIGLVDDLGF TSKRSRNAQT GELNPAEQVL TVGKQLTGKL YIGYEYSISS

1301    AEQSVKLIYR LTRAIQAVAR IGSRSSGGEL TYTIRFDRFS GSDKKDSAGN

1351    GKGK*
``` g285-1/m285-1 96.5% identity in 1354 aa overlap

```
                    10         20         30         40         50         60
g285-1.pep  LKLSAALLSVLILAVCFLGWIAGTEAGLRFGLYQIPSWFGVNISSQNLKGTLLDGFDGDN
            |||||||||||||||||||||||||||||||||||:||||||||||||||||||||||||
m285-1      LKLSAALLSVLILAVCFLGWLAGTEAGLRFGLYQIPSWFGVNISSQNLKGTLLDGFDGDN
                    10         20         30         40         50         60

70         80         90        100        110        120
g285-1.pep  WSIETEGADLKISRFRFAWKPSELMRRSLHITDISAGDIAIVTKPTPPKEERPPQGLPDS
            ||||||||||||||||||||||||||||||||:|||||||||||||||||||||::||||
m285-1      WSIETEGADLKISRFRFAWKPSELMRRSLHITEISAGDIAIVTKPTPPKEERPPLSLPDS
                    70         80         90        100        110        120

130        140        150        160        170        180
g285-1.pep  IDLPAAVYLDRFETGKISMGKTFDKQTVYLERLNAAYRYDRKGHRLDLKAADTPWSSSSG
            |||||||||||||||||||||:||||||||||||:|:|||||||||||||||||||||||
m285-1      IDLPAAVYLDRFETGKISMGKAFDKQTVYLERLDASYRYDRKGHRLDLKAADTPWSSSSG
                   130        140        150        160        170        180

190        200        210        220        230        240
g285-1.pep  SASVGLKKPFALDTAIYTKGGFEGETIHSTARLSGSLKDVRAELTIDGGNIRLSGKSVIH
            :|||||||||||||||||||||:||:|||||||||||||||||| :||||||||||||||
m285-1      AASVGLKKPFALDTAIYTKGGLEGKTIHSTARLSGSLKDVRAELAIDGGNIRLSGKSVIH
                   190        200        210        220        230        240

250        260        270        280        290        300
g285-1.pep  PFAESLDKTLEEVLVKGFNINPSAFVPSLPDAGLNFDLTAIPSFSDGIALEGSLDLENTK
            |||||||||||||||||||||:||||||||||||||||||||||||||||||||||||||
m285-1      PFAESLDKTLEEVLVKGFNINPAAFVPSLPDAGLNFDLTAIPSFSDGIALEGSLDLENTK
                   250        260        270        280        290        300

310        320        330        340        350        360
g285-1.pep  AGFADRNGIPVRQVLGGFVIRQDGTVHIGNTSAALLGRGGIRLSGKIDTEKDILDLNIGI
            ||||||||||||||||||||||||||||||||||||||||||||||||||||||||||||
m285-1      AGFADRNGIPVRQVLGGFVIRQDGTVHIGNTSAALLGRGGIRLSGKIDTEKDILDLNIGI
                   310        320        330        340        350        360

370        380        390        400        410        420
g285-1.pep  NSVGAEDVLQTAFKGRLDGSIGIGGTTASPKISWQLGTGTARTDGSLAIASDPANEQRKL
            ||||||||||||||||||||||||||||||||||||||| ||||||||||||||| ||||
m285-1      NSVGAEDVLQTAFKGRLDGSIGIGGTTASPKISWQLGIGTARTDGSLAIASDPANGQRKL
                   370        380        390        400        410        420

430        440        450        460        470        480
g285-1.pep  VFDTVNISAGEGSLTAQGYLELFKDRLLKLDIRSRAFDPSRIDPQFPAGDINGSIHLAGE
            |:||||:||:||||||||||||||||||||||||||||||||||||:|||:||||:||||
m285-1      VLDTVNIAAGQGSLTAQGYLELFKDRLLKLDIRSRAFDPSRIDPQLPAGNINGSINLAGE
                   430        440        450        460        470        480

490        500        510        520        530        540
g285-1.pep  LAKEKFTGKMRFLPGTFNGVPIAGSADIVYESRHLPRAAVDLRLGRNIVKTDGGFGKKGD
            ||||||||||||||||||||||||||||||||||||||||||||||:|||||||||||||
m285-1      LAKEKFTGKMRFLPGTFNGVPIAGSADIVYESRHLPRAAVDLRLGRNIIKTDGGFGKKGD
                   490        500        510        520        530        540

550        560        570        580        590        600
g285-1.pep  RLNLNITAPDLSRFGFGLAGSLNVRGHLSGDLDGGIRTFETDLSGTARNLHIGKAADIRS
            |||||||||||||||||||||||||||||||||||||||||||:||||||||||||||||
m285-1      RLNLNITAPDLSRFGFGLAGSLNVRGHLSGDLDGGIRTFETDLSGAARNLHIGKAADIRS
                   550        560        570        580        590        600
```

-continued

```
                     610       620       630       640       650       660
g285-1.pep    LDFTLKGSPGTSRPMRADIKGGRLSLSGGAAVVDTAGLTLEGTGAQHRIRTHAAMTLDGK
              ||||||||| ||||:||||||:|||||||||||||| | |:|||:|||||||||||||||
m285-1        LDFTLKGSPDTSRPIRADIKGSRLSLSGGAAVVDTADLMLDGTGVQHRIRTHAAMTLDGK
                     610       620       630       640       650       660

670       680       690       700       710       720
g285-1.pep    PFKLDLDASGGINRELTRWKGSIGILDIGGAFNLKLQNRMTLEAGAEHVAASAANWQAMG
              |||:|||||||||||||||||||||||||||||||||||||||||||:||||||||||||
m285-1        PFKFDLDASGGINRELTRWKGSIGILDIGGAFNLKLQNRMTLEAGAERVAASAANWQAMG
                     670       680       690       700       710       720

730       740       750       760       770       780
g285-1.pep    GSLNLQHFSWDRKTGISAKGGARGLHIAELHNFFKPPFEHNLVLNGDWDVAYGHNARGYL
              |||||||||||:||||||||||:||||||||||||||||||||||||||||||:||||||
m285-1        GSLNLQHFSWDKKTGISAKGGAHGLHIAELHNFFKPPFEHNLVLNGDWDVAYGRNARGYL
                     730       740       750       760       770       780

790       800       810       820       830       840
g285-1.pep    NISRQSGDAVLPGGQALGLNAFSLKTRFQNDRIGILLDGGARFGRINADLGIGNAFGGNM
              ||||||||||||||||||||||||||||||||||||||||||||||||||||:|||||||
m285-1        NISRQSGDAVLPGGQALGLNAFSLKTRFQNDRIGILLDGGARFGRINADLGIANAFGGNM
                     790       800       810       820       830       840

850       860       870       880       890       900
g285-1.pep    ANTPLGGRITASLPDLGALKPFLPAAAQNITGSLNASAQIGGRVGSPSVNAAVNGSSNYG
              ||:|||||||||||||||||||||||||||||||||:|||||||||||||||||||||||
m285-1        ANAPLGGRITASLPDLGALKPFLPAAAQNITGSLNAAAQIGGRVGSPSVNAAVNGSSNYG
                     850       860       870       880       890       900

910       920       930       940       950       960
g285-1.pep    KINGNITVGQSRSFDTAPLGGRLNLTVADAEAFRNFLPVGQTVKGSLNAAVTLGGSIADP
              |||||||||||||||||||||||||||||||:||||||||||||||||||||||||||||
m285-1        KINGNITVGQSRSFDTAPLGGRLNLTVADAEVFRNFLPVGQTVKGSLNAAVTLGGSIADP
                     910       920       930       940       950       960

970       980       990      1000      1010      1020
g285-1.pep    HLGGSINGDKLYYRNQTQGIILDNGSLRSHIAGRKWVIDSLKFRHEGTAELSGTVSMENS
              |||||||||||||||||||||||||||||||||||||||||||||||||||||||:||||
m285-1        HLGGSINGDKLYYRNQTQGIILDNGSLRSHIAGRKWVIDSLKFRHEGTAELSGTVGMENS
                     970       980       990      1000      1010      1020

1030      1040      1050      1060      1070      1080
g285-1.pep    VPDVDIGAVFDKYRILSRPNRRLTVSGNTRLRYSPQKGISVTGMIKTDQGLFGSQKSSMP
               |||||||||||||||||||||||||||||||||||||||||||||||||||||||||||
m285-1        GPDVDIGAVFDKYRILSRPNRRLTVSGNTRLRYSPQKGISVTGMIKTDQGLFGSQKSSMP
                    1030      1040      1050      1060      1070      1080

1090      1100      1110      1120      1130      1140
g285-1.pep    SVGDDVVVLGEVKKEAAASLPVNMNLTLDLNDGIRFSGYGADVTIGGKLTLTAQPGGNVR
              |||||||||||||||||| |||||||||||||||||:||||||||||||||||| ||:||
m285-1        SVGDDVVVLGEVKKEAAAPLPVNMNLTLDLNDGIRFAGYGADVTIGGKLTLTAQSGGSVR
                    1090      1100      1110      1120      1130      1140

1150      1160      1170      1180      1190      1200
g285-1.pep    GVGTVRVIKGRYKAYGQDLDITKGTVSFVGPLNDPNLNIRAERRLSPVGAGVEILGSLNS
              ||||||||||||||||||||||||||||||||||||||||||||||||||||||||||||
m285-1        GVGTVRVIKGRYKAYGQDLDITKGTVSFVGPLNDPNLNIRAERRLSPVGAGVEILGSLNS
                    1150      1160      1170      1180      1190      1200

1210      1220      1230      1240      1250      1260
g285-1.pep    PRITLTANEPMSEKDKLSWLILNRAGSGSSGDNAALSAAAGALLAGQINDRIGLVDDLGF
              ||||||||||||||||||||||||||||||||||||||||||||||||||||||||||||
m285-1        PRITLTANEPMSEKDKLSWLILNRAGSGSSGDNAALSAAAGALLAGQINDRIGLVDDLGF
                    1210      1220      1230      1240      1250      1260

1270      1280      1290      1300      1310      1320
g285-1.pep    TSKRSRNAQTGELNPAEQVLTVGKQLTGKLYIGYEYGISSAEQSVKLIYRLTRAIQAVAR
              ||||||||||||||||||||||||||||||||||||:|||||||||||||||||||||||
m285-1        TSKRSRNAQTGELNPAEQVLTVGKQLTGKLYIGYEYSISSAEQSVKLIYRLTRAIQAVAR
                    1270      1280      1290      1300      1310      1320

1330      1340      1350
g285-1.pep    IGSRSSGGELTYTIRFDRLFGSDKKDSAGNGKGK
              ||||||||||||||||||: ||||||||||||||
m285-1        IGSRSSGGELTYTIRFDRFSGSDKKDSAGNGKGKX
                    1330      1340      1350
```

The following partial DNA sequence was identified in *N. meningitidis* <SEQ ID 1191>:

```
a285-1.seq
      1   CTGAAGCTGT CGGCGGCACT GCTGTCTGTT CTGATTTTGG CAGTATGTTT

51   CCTCGGCTGG CTCGCCGGCA CGGAAGCGGG TTTGCGCTTC GGGCTGTACC

101   AAATCCCGTC TTGGTTCGGC GTAAACATTT CCTCCCAAAA CCTCAAAGGC

151   ACGCTGCTCG ACGGCTTCGA CGGCGACAAC TGGTCGATAG AAACCGAGGG
```

-continued

```
 201   GGCAGACCTT AAAATCAGCC GCTTCCGCTT CGCGTGGAAA CCGTCCGAAC
 251   TGATGCGCCG CAGCCTGCAC ATTACCGAAA TTTCCGCCGG CGACATCGCC
 301   ATCGTTACCA AACCGACTCC GCCTAAAGAA GAACGCCCGC CGCTCAGCCT
 351   TCCCGACAGC ATAGACCTGC CTGCCGCCGT CTATCTCGAC CGCTTCGAGA
 401   CGGGCAAAAT CAGCATGGGC AAAGCCTTTG ACAAACAAAC CGTCTATCTC
 451   GAACGGCTGG ATGCTTCATA CCGTTACGAC CGCAAAGGAC ACCGCCTCGA
 501   CCTGAAGGCT GCCGACACGC CGTGGAGCAG TTCGTCGGGG TCAGCCTCGG
 551   TCGGCTTGAA AAACCGTTT GCCCTCGATA CCGCCATTTA CACCAAAGGC
 601   GGACTCGAAG GCAAAACCAT ACACAGTACG GCTCGGCTGA GCGGCAGCCT
 651   GAAGGATGTG CGCGCCGAAC TGGCGATCGA CGGCGGCAAT ATCCGCCTCT
 701   CGGGAAAATC CGTCATCCAC CCGTTTGCCG AATCATTGGA TAAACATTG
 751   GAAGAAGTAC TGGTCAAAGG GTTCAACATC AATCCGTCCG CCTTCGTGCC
 801   TTCCCTGCCC GATGCCGGGC TGAATTTCGA CCTGACCGCC ATCCCGTCGT
 851   TTTCAGACGG CATCGCGCTG GAAGGCTCGC TCGATTTGGA AACACCAAA
 901   GCCGGCTTTG CCGACCGCAA CGGCATCCCC GTCCGTCAGG TTTTAGGCAG
 951   CTTTGTCATC CGGCAGGACG GCACGGTGCA TATCGGCAAT ACGTCCGTCG
1001   CCCTGCTCGG ACGGGCGGC ATCAGGCTGT CGGGCAAAAT CGACACCGAA
1051   AAAGACATCC TCGATTTAAA TATAGGCATC AACTCCGTCG GCGCGGAAGA
1101   CGTACTGCAA ACCGCGTTCA AAGGCAGGTT GGACGGCAGC ATCGGCATCG
1151   GTGGCACGAC CGCCTCGCCC AAAATCTCTT GGCAACTCGG CATCGGCACG
1201   GCGCGCACGG ACGGCAGCCT CGCCATTGCA AGCGACCCCG CAAACGGACA
1251   GCGGAAACTG GTGCTCGACA CCGTCAACAT CGCCGCCGGG CAAGGCAGCC
1301   TGACCGCGCA AGGCTATCTC GAGCTGTTTA AGACCGCCT GCTCAAGCTG
1351   GACATCCGTT CCCGCGCATT CGACCCTTCG CGCATCGATC CGCAACTTCC
1401   GGCAGGCAAT ATCAACGGCT CAATAAACCT TGCCGGCGAA CTGGCAAAAG
1451   AGAAATTCAC AGGCAAAATG CGGTTTTTAC CCGGCACGTT CAACGGCGTA
1501   CCGATTGCCG GCAGTGCCGA CATTGTTTAC GAGTCCCGCC ACCTTCCGCG
1551   TGCCGCCGTC GATTTGCGGC TGGGGCGGAA CATTATTAAA ACAGACGGCG
1601   GCTTCGGCAA AAAAGGCGAC CGGCTTAACC TCAATATCAC CGCACCCGAT
1651   TTATCCCGTT TCGGTTTCGG ACTCGCGGGG TCTTTAAATG TACGCGGACA
1701   CCTTTCCGGC GATTTGGACG GTGGCATCCG AACCTTTGAA ACCGACTTT
1751   CCGGCGCGGC GCGCAACCTG CACATCGGCA AGGCGGCAGA CATCCGTTCG
1801   CTCGATTTCA CGCTCAAAGG TTCGCCCGAC ACAAGCCGCC CGATACGCGC
1851   CGACATCAAA GGCAGCCGCC TTTCGCTGTC GGGCGGAGCG GAGGTTGTCG
1901   ATACCGCCGA CCTGATGCTG GACGGCACGG GCGTGCAGCA CCGCATCCGC
1951   ACACACGCCG CCATGACGCT GGATGGCAAA CCGTTCAAAT TCGATTTGGA
2001   CGCTTCAGGC GGCATCAACA GGGAACTTAC CGATGGAAA GGCAGCATCG
2051   GCATCCTCGA CATCGGCGGC GCATTCAACC TCAAGCTGCA AAACCGTATG
2101   ACGCTCGAAG CCGGTGCGGA ACGCGTGGCG GCAAGTGCGG CAAATTGGCA
2151   GGCAATGGGC GGCAGCCTCA ACCTGCAACA CTTTTCTTGG GATAAAAAAA
```

```
                       -continued
2201    CCGGCATATC GGCAAAAGGC GGCGCACACG GTCTGCATAT CGCCGAGTTG

2251    CACAATTTCT TCAAACCGCC CTTCGAACAC AATCTGGTTT TAAACGGCGA

2301    CTGGGATGTC GCCTACGGGC GAAACGCGCG CGGCTACCTC AATATCAGCC

2351    GGCAAAGCGG CGATGCCGTA TTGCCCGGCG GGCAGGCTTT GGGTTTGAAC

2401    GCATTTTCCC TGAAAACGCG CTTTCAAAAC GACCGTATCG GAATCCTGCT

2451    TGACGGCGGC GCGCGTTTCG GGCGGATTAA CGCCGATTTG GACATCGGCA

2501    ACGCCTTCGG CGGCAATATG GCAAATGCAC CGCTCGGCGG CAGGATTACC

2551    GCCTCCCTTC CCGACTTGGG CACATTGAAG CCCTTTCTGC CCGCCGCCGC

2601    GCAAAACATT ACCGGCAGCC TGAATGCCGC CGCGCAAATC GGCGGACGGG

2651    TCGGCTCTCC GTCCGTCAAT GCCGCCGTCA ACGGCAGCAG CAACTACGGG

2701    AAAATCAACG GCAACATCAC CGTCGGGCAA AGCCGCTCTT TCGATACCGC

2751    GCCTTTGGGC GGCAGGCTCA ACCTGACCGT TGCCGATGCC GAAGTATTCC

2801    GCAACTTCCT ACCGGTCGGA CAAACCGTCA AAGGCAGCCT GAATGCCGCC

2851    GTAACCCTCG GCGGCAGCAT CGCCGATCCG CACTTGGGCG GCAGCATCAA

2901    CGGCGACAAA CTCTATTACC GCAACCAAAC CCAAGGCATC ATCTTGGACA

2951    ACGGCTCGCT GCGTTCGCAT ATCGCGGGCA GGAAATGGGT AATCGACAGC

3001    CTGAAATTCC GGCACGAAGG GACGGCGGAA CTCTCCGGTA CGGTCGGTAT

3051    GGAAAACAGC GGACCCGATG TCGATATCGG CGCGGTGTTC GACAAATACC

3101    GCATCCTGTC CCGCCCCAAC CGCCGCCTGA CGGTTTCCGG CAACACCCGC

3151    CTGCGCTATT CGCCGCAAAA AGGCATATCC GTTACCGGGA TGATTAAAAC

3201    GGATCAGGGG CTGTTCGGTT CGCAAAAATC CTCGATGCCG TCCGTCGGCG

3251    ACGATGTCGT CGTATTAGGC GAAGTCAAAA AGAGGCGGC GGCACCGCTC

3301    CCCGTCAATA TGAACCTGAC TTTAGACCTC AATGACGGCA TCCGCTTCGC

3351    CGGCTACGGC GCGGACGTTA CCATAGGCGG CAAACTGACC CTGACCGCCC

3401    AATCGGGCGG AAGCGTGCGG GGCGTGGGCA CGGTCCGCGT CATCAAAGGG

3451    CGTTATAAGG CATACGGGCA GGATTTGGAC ATTACCAAAG CACGGTCTC

3501    CTTTGTCGGC CCGCTCAACG ACCCCAACCT CAACATCCGC GCCGAACGCC

3551    GCCTTTCCCC CGTCGGTGCG GGCGTGGAAA TATTGGGCAG CCTCAACAGT

3601    CCGCGCATTA CGCTGACGGC AAACGAACCG ATGAGTGAAA AAGACAAGCT

3651    CTCCTGGCTC ATCCTCAACC GCGCCGGCAG TGGCAGCAGC GGCGACAATG

3701    CCGCCCTGTC CGCAGCCGCC GGCGCGCTGC TTGCCGGGCA AATCAACGAC

3751    CGCATCGGGC TGGTGGATGA TTTGGGCTTT ACCAGCAAGC GCAGCCGCAA

3801    CGCGCAAACC GGCGAACTCA ACCCCGCCGA ACAGGTGCTG ACCGTCGGCA

3851    AACAACTGAC CGGCAAACTC TACATCGGCT ACGAATACAG CATCTCCAGC

3901    GCGGAACAGT CCGTCAAACT GATTTACCGG CTGACCCGCG CCATACAGGC

3951    GGTTGCCCGT ATCGGCAGCC GTTCGTCGGG CGGCGAGCTG ACATACACCA

4001    TACGTTTCGA CCGCTTCTCC GGTTCGGACA AAAAGACTC CGCCGGAAAC

4051    AGCAAAGGAA AATAA
```

This corresponds to the amino acid sequence <SEQ ID 1192; ORF 285-1.a>:

```
a285-1.pep
     1    LKLSAALLSV LILAVCFLGW LAGTEAGLRF GLYQIPSWFG VNISSQNLKG

51    TLLDGFDGDN WSIETEGADL KISRFRFAWK PSELMRRSLH ITEISAGDIA

101    IVTKPTPPKE ERPPLSLPDS IDLPAAVYLD RFETGKISMG KAFDKQTVYL

151    ERLDASYRYD RKGHRLDLKA ADTPWSSSSG SASVGLKKPF ALDTAIYTKG

201    GLEGKTIHST ARLSGSLKDV RAELAIDGGN IRLSGKSVIH PFAESLDKTL

251    EEVLVKGFNI NPSAFVPSLP DAGLNFDLTA IPSFSDGIAL EGSLDLENTK

301    AGFADRNGIP VRQVLGSFVI RQDGTVHIGN TSVALLGRGG IRLSGKIDTE

351    KDILDLNIGI NSVGAEDVLQ TAFKGRLDGS IGIGGTTASP KISWQLGIGT

401    ARTDGSLAIA SDPANGQRKL VLDTVNIAAG QGSLTAQGYL ELFKDRLLKL

451    DIRSRAFDPS RIDPQLPAGN INGSINLAGE LAKEKFTGKM RFLPGTFNGV

501    PIAGSADIVY ESRHLPRAAV DLRLGRNIIK TDGGFGKKGD RLNLNITAPD

551    LSRFGFGLAG SLNVRGHLSG DLDGGIRTFE TDLSGAARNL HIGKAADIRS

601    LDFTLKGSPD TSRPIRADIK GSRLSLSGGA EVVDTADLML DGTGVQHRIR

651    THAAMTLDGK PFKFDLDASG GINRELTRWK GSIGILDIGG AFNLKLQNRM

701    TLEAGAERVA ASAANWQAMG GSLNLQHFSW DKKTGISAKG GAHGLHIAEL

751    HNFFKPPFEH NLVLNGDWDV AYGRNARGYL NISRQSGDAV LPGGQALGLN

801    AFSLKTRFQN DRIGILLDGG ARFGRINADL DIGNAFGGNM ANAPLGGRIT

851    ASLPDLGTLK PFLPAAAQNI TGSLNAAAQI GGRVGSPSVN AAVNGSSNYG

901    KINGNITVGQ SRSFDTAPLG GRLNLTVADA EVFRNFLPVG QTVKGSLNAA

951    VTLGGSIADP HLGGSINGDK LYYRNQTQGI ILDNGSLRSH IAGRKWVIDS

1001    LKFRHEGTAE LSGTVGMENS GPDVDIGAVF DKYRILSRPN RRLTVSGNTR

1051    LRYSPQKGIS VTGMIKTDQG LFGSQKSSMP SVGDDVVVLG EVKKEAAAPL

1101    PVNMNLTLDL NDGIRFAGYG ADVTIGGKLT LTAQSGGSVR GVGTVRVIKG

1151    RYKAYGQDLD ITKGTVSFVG PLNDPNLNIR AERRLSPVGA GVEILGSLNS

1201    PRITLTANEP MSEKDKLSWL ILNRAGSGSS GDNAALSAAA GALLAGQIND

1251    RIGLVDDLGF TSKRSRNAQT GELNPAEQVL TVGKQLTGKL YIGYEYSISS

1301    AEQSVKLIYR LTRAIQAVAR IGSRSSGGEL TYTIRFDRFS GSDKKDSAGN

1351    SKGK*
``` a285-1/m285-1 99.3% identity in 1354 aa overlap

```
                    10         20         30         40         50         60
a285-1.pep  LKLSAALLSVLILAVCFLGWLAGTEAGLRFGLYQIPSWFGVNISSQNLKGTLLDGFDGDN
            ||||||||||||||||||||||||||||||||||||||||||||||||||||||||||||
m285-1      LKLSAALLSVLILAVCFLGWLAGTEAGLRFGLYQIPSWFGVNISSQNLKGTLLDGFDGDN
                    10         20         30         40         50         60

70         80         90        100        110        120
a285-1.pep  WSIETEGADLKISRFRFAWKPSELMRRSLHITEISAGDIAIVTKPTPPKEERPPLSLPDS
            ||||||||||||||||||||||||||||||||||||||||||||||||||||||||||||
m285-1      WSIETEGADLKISRFRFAWKPSELMRRSLHITEISAGDIAIVTKPTPPKEERPPLSLPDS
                    70         80         90        100        110        120

130        140        150        160        170        180
a285-1.pep  IDLPAAVYLDRFETGKISMGKAFDKQTVYLERLDASYRYDRKGHRLDLKAADTPWSSSSG
            ||||||||||||||||||||||||||||||||||||||||||||||||||||||||||||
m285-1      IDLPAAVYLDRFETGKISMGKAFDKQTVYLERLDASYRYDRKGHRLDLKAADTPWSSSSG
                   130        140        150        160        170        180
```

```
                    190       200       210       220       230       240
a285-1.pep  SASVGLKKPFALDTAIYTKGGLEGKTIHSTARLSGSLKDVRAELAIDGGNIRLSGKSVIH
            :|||||||||||||||||||||||||||||||||||||||||||||||||||||||||||
m285-1      AASVGLKKPFALDTAIYTKGGLEGKTIHSTARLSGSLKDVRAELAIDGGNIRLSGKSVIH
                    190       200       210       220       230       240

250       260       270       280       290       300
a285-1.pep  PFAESLDKTLEEVLVKGFNINPSAFVPSLPDAGLNFDLTAIPSFSDGIALEGSLDLENTK
            |||||||||||||||||||||||||||:||||||||||||||||||||||||||||||||
m285-1      PFAESLDKTLEEVLVKGFNINPAAFVPSLPDAGLNFDLTAIPSFSDGIALEGSLDLENTK
                    250       260       270       280       290       300

310       320       330       340       350       360
a285-1.pep  AGFADRNGIPVRQVLGSFVIRQDGTVHIGNTSVALLGRGGIRLSGKIDTEKDILDLNIGI
            |||||||||||||||||:||||||||||||||||:|||||||||||||||||||||||||
m285-1      AGFADRNGIPVRQVLGGFVIRQDGTVHIGNTSAALLGRGGIRLSGKIDTEKDILDLNIGI
                    310       320       330       340       350       360

370       380       390       400       410       420
a285-1.pep  NSVGAEDVLQTAFKGRLDGSIGIGGTTASPKISWQLGIGTARTDGSLAIASDPANGQRKL
            ||||||||||||||||||||||||||||||||||||||||||||||||||||||||||||
m285-1      NSVGAEDVLQTAFKGRLDGSIGIGGTTASPKISWQLGIGTARTDGSLAIASDPANGQRKL
                    370       380       390       400       410       420

430       440       450       460       470       480
a285-1.pep  VLDTVNIAAGQGSLTAQGYLELFKDRLLKLDIRSRAFDPSRIDPQLPAGNINGSINLAGE
            ||||||||||||||||||||||||||||||||||||||||||||||||||||||||||||
m285-1      VLDTVNIAAGQGSLTAQGYLELFKDRLLKLDIRSRAFDPSRIDPQLPAGNINGSINLAGE
                    430       440       450       460       470       480

490       500       510       520       530       540
a285-1.pep  LAKEKFTGKMRFLPGTFNGVPIAGSADIVYESRHLPRAAVDLRLGRNIIKTDGGFGKKGD
            ||||||||||||||||||||||||||||||||||||||||||||||||||||||||||||
m285-1      LAKEKFTGKMRFLPGTFNGVPIAGSADIVYESRHLPRAAVDLRLGRNIIKTDGGFGKKGD
                    490       500       510       520       530       540

550       560       570       580       590       600
a285-1.pep  RLNLNITAPDLSRFGFGLAGSLNVRGHLSGDLDGGIRTFETDLSGAARNLHIGKAADIRS
            ||||||||||||||||||||||||||||||||||||||||||||||||||||||||||||
m285-1      RLNLNITAPDLSRFGFGLAGSLNVRGHLSGDLDGGIRTFETDLSGAARNLHIGKAADIRS
                    550       560       570       580       590       600

610       620       630       640       650       660
a285-1.pep  LDFTLKGSPDTSRPIRADIKGSRLSLSGGAEVVDTADLMLDGTGVQHRIRTHAAMTLDGK
            |||||||||||||||||||||||||||||||  |||||||||||||||||||||||||||
m285-1      LDFTLKGSPDTSRPIRADIKGSRLSLSGGAAVVDTADLMLDGTGVQHRIRTHAAMTLDGK
                    610       620       630       640       650       660

670       680       690       700       710       720
a285-1.pep  PFKFDLDASGGINRELTRWKGSIGILDIGGAFNLKLQNRMTLEAGAERVAASAANWQAMG
            ||||||||||||||||||||||||||||||||||||||||||||||||||||||||||||
m285-1      PFKFDLDASGGINRELTRWKGSIGILDIGGAFNLKLQNRMTLEAGAERVAASAANWQAMG
                    670       680       690       700       710       720

730       740       750       760       770       780
a285-1.pep  GSLNLQHFSWDKKTGISAKGGAHGLHIAELHNFFKPPFEHNLVLNGDWDVAYGRNARGYL
            ||||||||||||||||||||||||||||||||||||||||||||||||||||||||||||
m285-1      GSLNLQHFSWDKKTGISAKGGAHGLHIAELHNFFKPPFEHNLVLNGDWDVAYGRNARGYL
                    730       740       750       760       770       780

790       800       810       820       830       840
a285-1.pep  NISRQSGDAVLPGGQALGLNAFSLKTRFQNDRIGILLDGGARFGRINADLDIGNAFGGNM
            |||||||||||||||||||||||||||||||||||||||||||||||||:||||||||||
m285-1      NISRQSGDAVLPGGQALGLNAFSLKTRFQNDRIGILLDGGARFGRINADLGIANAFGGNM
                    790       800       810       820       830       840

850       860       870       880       890       900
a285-1.pep  ANAPLGGRITASLPDLGTLKPFLPAAAQNITGSLNAAAQIGGRVGSPSVNAAVNGSSNYG
            ||||||||||||||||||:|||||||||||||||||||||||||||||||||||||||||
m285-1      ANAPLGGRITASLPDLGALKPFLPAAAQNITGSLNAAAQIGGRVGSPSVNAAVNGSSNYG
                    850       860       870       880       890       900

910       920       930       940       950       960
a285-1.pep  KINGNITVGQSRSFDTAPLGGRLNLTVADAEVFRNFLPVGQTVKGSLNAAVTLGGSIADP
            ||||||||||||||||||||||||||||||||||||||||||||||||||||||||||||
m285-1      KINGNITVGQSRSFDTAPLGGRLNLTVADAEVFRNFLPVGQTVKGSLNAAVTLGGSIADP
                    910       920       930       940       950       960

970       980       990      1000      1010      1020
a285-1.pep  HLGGSINGDKLYYRNQTQGIILDNGSLRSHIAGRKWVIDSLKFRHEGTAELSGTVGMENS
            ||||||||||||||||||||||||||||||||||||||||||||||||||||||||||||
m285-1      HLGGSINGDKLYYRNQTQGIILDNGSLRSHIAGRKWVIDSLKFRHEGTAELSGTVGMENS
                    970       980       990      1000      1010      1020

1030      1040      1050      1060      1070      1080
a285-1.pep  GPDVDIGAVFDKYRILSRPNRRLTVSGNTRLRYSPQKGISVTGMIKTDQGLFGSQKSSMP
            ||||||||||||||||||||||||||||||||||||||||||||||||||||||||||||
m285-1      GPDVDIGAVFDKYRILSRPNRRLTVSGNTRLRYSPQKGISVTGMIKTDQGLFGSQKSSMP
                   1030      1040      1050      1060      1070      1080

1090      1100      1110      1120      1130      1140
a285-1.pep  SVGDDVVVLGEVKKEAAAPLPVNMNLTLDLNDGIRFAGYGADVTIGGKLTLTAQSGGSVR
            ||||||||||||||||||||||||||||||||||||||||||||||||||||||||||||
m285-1      SVGDDVVVLGEVKKEAAAPLPVNMNLTLDLNDGIRFAGYGADVTIGGKLTLTAQSGGSVR
                   1090      1100      1110      1120      1130      1140
```

```
                   1150       1160       1170       1180       1190       1200
a285-1.pep  GVGTVRVIKGRYKAYGQDLDITKGTVSFVGPLNDPNLNIRAERRLSPVGAGVEILGSLNS
            ||||||||||||||||||||||||||||||||||||||||||||||||||||||||||||
m285-1      GVGTVRVIKGRYKAYGQDLDITKGTVSFVGPLNDPNLNIRAERRLSPVGAGVEILGSLNS
                   1150       1160       1170       1180       1190       1200

1210       1220       1230       1240       1250       1260
a285-1.pep  PRITLTANEPMSEKDKLSWLILNRAGSGSSGDNAALSAAAGALLAGQINDRIGLVDDLGF
            ||||||||||||||||||||||||||||||||||||||||||||||||||||||||||||
m285-1      PRITLTANEPMSEKDKLSWLILNRAGSGSSGDNAALSAAAGALLAGQINDRIGLVDDLGF
                   1210       1220       1230       1240       1250       1260

1270       1280       1290       1300       1310       1320
a285-1.pep  TSKRSRNAQTGELNPAEQVLTVGKQLTGKLYIGYEYSISSAEQSVKLIYRLTRAIQAVAR
            ||||||||||||||||||||||||||||||||||||||||||||||||||||||||||||
m285-1      TSKRSRNAQTGELNPAEQVLTVGKQLTGKLYIGYEYSISSAEQSVKLIYRLTRAIQAVAR
                   1270       1280       1290       1300       1310       1320

1330       1340       1350
a285-1.pep  IGSRSSGGELTYTIRFDRFSGSDKKDSAGNSKGKX
            |||||||||||||||||||||||||||||:||||
m285-1      IGSRSSGGELTYTIRFDRFSGSDKKDSAGNGKGKX
                   1330       1340       1350
```

The following partial DNA sequence was identified in *N. gonorrhoeae* <SEQ ID 1193>:

```
g286.seq
   1  atgcagaaca ccggtaccat gatgatcaaa ccgaccgccc tgctcctgcc 51  ggctttattt ttctttccgc acgcatacgc gcctgccgcc gacctttccg 101  aaaacaaggc ggcgggtttc gcattgttca aaagcaaaag ccccgacacc 151  gaatcagtca aattaaaacc caaattcccc gtccgcatcg acacgcagga 201  cagtgaaatc aaagatatgg tcgaagaaca cctgccgctc atcacgcagc 251  agcaggaaga ggttttggat aaggaacaga cgggattcct tgccgaagaa 301  gcaccggaca acgttaaaac aatgctccgc agcaaaggct atttcagcag 351  caaggtcagc ctgacggaaa agacggagc ttatacggtg cacatcacac 401  cgggcccgcg caccaaaatc gccaacgtcg gcgtcgccat cctcggcgac 451  atcctttcag acggcaacct cgccgaatac taccgcaacg cgctggaaaa 501  ctggcagcag ccggtaggca gcgatttcga tcaggacagt tgggaaaaca 551  gcaaaacttc cgtcctcggc gcggtaacgc gcaaaggcta cccgcttgcc 601  aagctcggca cacccgggc ggccgtcaac cccgataccg ccaccgccga 651  tttgaacgtc gtcgtggaca gcggccgccc cattgccttc ggcgactttg 701  aaatcaccgg cacacagcgt taccccgaac aaaccgtctc cggcctggcg 751  cgcttccaac cgggcacgcc ctacgacctc gacctgctgc tcgacttcca 801  acaggcgctc gaacaaaacg ggcattattc cggcgcgtcc gtacaagccg 851  acttcgaccg cctcccaagg ggaccgcgtc cccgtcaaag tcagcgtaac 901  cgaggtcaaa cgccacaaac tcgaaccgg catccgcctc gattcggaat 951  acggtttggg cggcaaaatc gcctacgact attacaacct cttcaacaaa 1001  ggctatatcg gctcggtcgt ctgggatatg gacaaatacg aaaccacgct 1051  tgccgccggc atcagccagc cgcgcaacta tcggggcaac tactggacaa 1101  gcaacgtttc ctacaaccgt tcgaccaccc aaaacctcga aaacgcgcc 1151  ttctccggcg gcatctggta tgtgcgcgac cgcgcgggca tcgatgccag 1201  gctgggggcg gaatttctcg cagaaggccg gaaaatcccc ggctcggatg 1251  tcgatttggg caacagccac gccacgatgc tgaccgcctc ttggaaacgc
```

-continued

```
1301  cagctgctca acaacgtgct gcaccccgaa aacggccatt acctcgacgg 1351  caaaatcggg acgactttgg gcacattcct gtcctccacc gcgctaatcc 1401  gcacctctgc ccgcgcaggt tatttcttca cgcccgaaaa caaaaaactc 1451  ggcacgttca tcatacgcgg acaagcgggt tacaccgttg cacgcgacaa 1501  tgccgatgtc ccctcggggc tgatgttccg cagcggcggc gcgtcttccg 1551  tgcgcggtta cgaacttga
```

This corresponds to the amino acid sequence <SEQ ID 1194; ORF 286.ng>:

```
g286.pep
    1  MQNTGTMMIK PTALLLPALF FFPHAYAPAA DLSENKAAGF ALFKSKSPDT

51  ESVKLKPKFP VRIDTQDSEI KDMVEEHLPL ITQQQEEVLD KEQTGFLAEE

101  APDNVKTMLR SKGYFSSKVS LTEKDGAYTV HITPGPRTKI ANVGVAILGD

151  ILSDGNLAEY YRNALENWQQ PVGSDFDQDS WENSKTSVLG AVTRKGYPLA

201  KLGNTRAAVN PDTATADLNV VVDSGRPIAF GDFEITGTQR YPEQTVSGLA

251  RFQPGTPYDL DLLLDFQQAL EQNGHYSGAS VQADFDRLPR GPRPRQSQRN

301  RGQTPQTRNR HPPRFGIRFG RQNRLRLLQP LQQRLYRLGR LGYGQIRNHA

351  CRRHQPAAQL SGQLLDKQRF LQPFDHPKPR KTRLLRRHLV CARPRGHRCQ

401  AGGGISRRRP ENPRLGCRFG QQPRHDADRL LETPAAQQRA APRKRPLPRR

451  QNRDDFGHIP VLHRANPHLC PRRLFLHARK QKTRHVHHTR TSGLHRCTRQ

501  CRCPLGADVP QRRRVFRARL RT*
```

The following partial DNA sequence was identified in *N. meningitidis* <SEQ ID 1195>:

```
m286.seq
    1  ATGCACGACA CCCGTACCAT GATGATCAAA CCGACCGCCC TGCTCCTGCC

51  GGCTTTATTT TTCTTTCCGC ACGCATACGC GCCTGCCGCC GACCTTTCCG

101  AAAACAAGGC GGCGGGTTTC GCATTGTTCA AAAACAAAAG CCCCGACACC

151  GAATCAGTCA AATTAAAACC CAAATTCCCC GTCCTCATCG ACACGCAGGA

201  CAGTGAAATC AAAGATATGG TCGAAGAACA CCTGCCGCTC ATCACGCAGC

251  AGCAGGAAGA AGTATTGGAC AAGGAACAGA CGGGCTTCCT CGCCGAAGAA

301  GCGCCGGACA ACGTTAAAAC GATGCTCCGC AGCAAAGGCT ATTTCAGCAG

351  CAAAGTCAGC CTGACGGAAA AGACGGAGC TTATACGGTA CACATCACAC

401  CGGGCCCGCG CACCAAAATC GCCAACGTCG GCGTCGCCAT CCTCGGCGAC

451  ATCCTTTCAG ACGGCAACCT CGCCGAATAC TACCGCAACG CGCTGGAAAA

501  CTGGCAGCAG CCGGTAGGCA GCGATTTCGA TCAGGACAGT TGGGAAAACA

551  GCAAAACTTC CGTCCTCGGC GCGGTAACGC GCAAAGCCTA CCCGCTTGCC

601  AAGCTCGGCA ATACGCAGGC GGCCGTCAAC CCCGATACCG CCACCGCCGA

651  TTTGAACGTC GTCGTGGACA GCGGCCGCCC CATCGCCTTC GGCGACTTTG

701  AAATCACCGG CACACAGCGT TACCCCGAAC AAATCGTCTC CGGCCTTGCG
```

-continued

```
 751 CGTTTCCAGC CCGGTATGCC GTACGACCTC GACCTGCTGC TCGACTTCCA
 801 ACAGGCGCTC GAACAAAACG GGCATTATTC CGGCGCGTCC GTACAAGCCG
 851 ACTTCGACCG CCTCCAAGGC GACCGCGTCC CCGTCAAAGT CAGCGTAACC
 901 GAGGTCAAAC GCCACAAACT CGAAACCGGC ATCCGCCTCG ATTCGGAATA
 951 CGGTTTGGGC GGCAAAATCG CCTACGACTA TTACAACCTC TTCAACAAAG
1001 GCTATATCGG TTCGGTCGTC TGGGATATGG ACAAATACGA AACCACGCTT
1051 GCCGCCGGCA TCAGCCAGCC GCGCAACTAT CGGGGCAACT ACTGGACAAG
1101 CAACGTTTCC TACAACCGTT CGACCACCCA AAACCTCGAA AAACGCGCCT
1151 TCTCCGGCGG CGTCTGGTAT GTGCGCGACC GCGCGGGCAT CGATGCCAGG
1201 CTGGGGGCGG AATTTCTCGC AGAAGGCCGG AAAATCCCCG GCTCGGCTGT
1251 CGATTTGGGC AACAGCCACG CCACGATGCT GACCGCCTCT TGGAAACGCC
1301 AGCTGCTCAA CAACGTGCTG CATCCCGAAA ACGGCCATTA CCTCGACGGC
1351 AAAATCGGTA CGACTTTGGG CACATTCCTG TCCTCCACCG CGCTGATCCG
1401 CACCTCTGCC CGTGCAGGTT ATTTCTTCAC GCCCGAAAAC AAAAAACTCG
1451 GCACGTTCAT CATACGCGGA CAAGCGGGTT ACACCGTTGC CCGCGACAAT
1501 GCCGACGTTC CTTCAGGGCT GATGTTCCGC AGCGGCGGCG CGTCTTCCGT
1551 GCGCGGTTAC GAACTCGACA GCATCGGACT TGCCGGCCCG AACGGATCGG
1601 TCCTGCCCGA ACGCGCCCTC CTGGTGGGCA GCCTGGAATA CCAACTGCCG
1651 TTTACGCGCA CCCTTTCCGG CGCGGTGTTC CACGATATGG GCGATGCCGC
1701 CGCCAATTTC AAACGTATGA AGCTGAAACA CGGTTCGGGA CTGGGCGTGC
1751 GCTGGTTCAG CCCGCTTGCG CCGTTTTCCT TCGACATCGC CTACGGGCAC
1801 AGCGATAAGA AAATCCGCTG GCACATCAGC TTGGGAACGC GCTTCTAA
```

This corresponds to the amino acid sequence <SEQ ID 1196; ORF 286>:

```
m286.pep
   1 MHDTRTMMIK PTALLLPALF FFPHAYAPAA DLSENKAAGF ALFKNKSPDT

51 ESVKLKPKFP VLIDTQDSEI KDMVEEHLPL ITQQQEEVLD KEQTGFLAEE

101 APDNVKTMLR SKGYFSSKVS LTEKDGAYTV HITPGPRTKI ANVGVAILGD

151 ILSDGNLAEY RNALENWQQ PVGSDFDQDS WENSKTSVLG AVTRKAYPLA

201 KLGNTQAAVN PDTATADLNV VVDSGRPIAF GDFEITGTQR YPEQIVSGLA

251 RFQPGMPYDL DLLLDFQQAL EQNGHYSGAS VQADFDRLQG DRVPVKVSVT

301 EVKRHKLETG IRLDSEYGLG GKIAYDYYNL FNKGYIGSVV WDMDKYETTL

351 AAGISQPRNY RGNYWTSNVS YNRSTTQNLE KRAFSGGVWY VRDRAGIDAR

401 LGAEFLAEGR KIPGSAVDLG NSHATMLTAS WKRQLLNNVL HPENGHYLDG

451 KIGTTLGTFL SSTALIRTSA RAGYFFTPEN KKLGTFIIRG QAGYTVARDN

501 ADVPSGLMFR SGGASSVRGY ELDSIGLAGP NGSVLPERAL LVGSLEYQLP

551 FTRTLSGAVF HDMGDAAANF KRMKLKHGSG LGVRWFSPLA PFSFDIAYGH

601 SDKKIRWHIS LGTRF*
```

Computer analysis of this amino acid sequence gave the following results:
Homology with a Predicted ORF from N. gonorrhoeae
m286/g286 95.9% identity in 293 aa overlap

```
               10        20        30        40        50        60
m286.pep  MHDTRTMMIKPTALLLPALFFFPHAYAPAADLSENKAAGFALFKNKSPDTESVKLKPKFP
          | : :  ||||||||||||||||||||||||||||||||||| : ||||||||||||||
g286      MQNTGTMMIKPTALLLPALFFFPHAYAPAADLSENKAAGFALFKSKSPDTESVKLKPKFP
               10        20        30        40        50        60

70        80        90       100       110       120
m286.pep  VLIDTQDSEIKDMVEEHLPLITQQQEEVLDKEQTGFLAEEAPDNVKTMLRSKGYFSSKVS
          | |||||||||||||||||||||||||||||||||||||||||||||||||||||||||
g286      VRIDTQDSEIKDMVEEHLPLITQQQEEVLDKEQTGFLAEEAPDNVKTMLRSKGYFSSKVS
               70        80        90       100       110       120

130       140       150       160       170       180
m286.pep  LTEKDGAYTVHITPGPRTKIANVGVAILGDILSDGNLAEYYRNALENWQQPVGSDFDQDS
          ||||||||||||||||||||||||||||||||||||||||||||||||||||||||||||
g286      LTEKDGAYTVHITPGPRTKIANVGVAILGDILSDGNLAEYYRNALENWQQPVGSDFDQDS
              130       140       150       160       170       180

190       200       210       220       230       240
m286.pep  WENSKTSVLGAVTRKAYPLAKLGNTQAAVNPDTATADLNVVVDSGRPIAFGDFEITGTQR
          |||||||||||||| :|||||||||: ||||||||||||||||||||||||||||||||
g286      WENSKTSVLGAVTRKGYPLAKLGNTRAAVNPDTATADLNVVVDSGRPIAFGDFEITGTQR
              190       200       210       220       230       240

250       260       270       280       290       299
m286.pep  YPEQIVSGLARFQPGMPYDLDLLLDFQQALEQNGHYSGASVQADFDRL-QGDRVPVKVSV
          |||| |||||||||||  ||||||||||||||||||||||||||||| :| |
g286      YPEQTVSGLARFQPGTPYDLDLLLDFQQALEQNGHYSGASVQADFDRLPRGPRPRQSQRN
              250       260       270       280       290       300

300       310       320       330       340       350       359
m286.pep  TEVKRHKLETGIRLDSEYGLGGKIAYDYYNLFNKGYIGSVVWDMKYETTLAAGISQPRN g286      RGQTPQTRNRHPPRFGIRFGRQNRLRLLQPLQQRLYRLGRLGYGQIRNHACRRHQPAAQL
                 310       320       330       340       350       360
```

The following partial DNA sequence was identified in N. meningitidis <SEQ ID 1197>:

```
a286.seq
     1   ATGCACGACA CCCGTACCAT GATGATTAAA CCGACCGCCC TGCTCCTGCC

51   GGCTTTATTT TTCTTTCCGC ACGCATACGC GCCTGCCGCC GACCTTTCCG

101   AAAACAAGGC GGCGGGTTTC GCATTGTTCA AAAACAAAAG CCCCGACACC

151   GAATCAGTTA AATTAAAACC CAAATTCCCC GTCCGCATCG ACACGCAGGA

201   TAGTGAAATC AAAGATATGG TCGAAGAACA CCTGCCGCTC ATCACGCAGC

251   AGCAGGAAGA AGTATTGGAC AAGGAACAGA CGGGCTTCCT CGCCGAAGAA

301   GCACCGGACA ACGTTAAAAC AATGCTCCGC AGCAAAGGCT ATTTCAGCAG

351   CAAAGTCAGC CTGACGGAAA AGACGGAGC TTATACGGTA CACATCACAC

401   CGGGCCCGCG CACCAAAATC GCCAACGTCG GCGTCGCCAT CCTCGGCGAC

451   ATCCTTTCAG ACGGCAACCT CGCCGAATAC TACCGCAACG CGCTGGAAAA

501   CTGGCAGCAG CCGGTAGGCA GTGATTTCGA TCAGGACAGT TGGGAAAACA

551   GCAAAACTTC CGTCCTCGGC GCGGTAACGC GCAAAGCCTA CCCGCTTGCC

601   AAGCTCGGCA ACACCCGGGC GGCCGTCAAC CCCGATACCG CCACCGCCGA

651   TTTGAACGTC GTCGTGGACA GCGGCCGCCC CATCGCCTTC GGCGACTTTG

701   AAATTACCGG CACGCAGCGT TACCCCGAAC AAATCGTCTC CGGCTTGGCG

751   CGCTTCCAAC CGGGCACGCC CTACGACCTC GACCTGCTGC TCGACTTCCA

801   ACAGGCGCTC GAACAAAACG GCATTATTC CGGCGCGTCC GTACAAGCCG

851   ACTTCGACCG CCTCCAAGGC GACCGCGTCC CCGTCAAAGT CAGCGTAACC

901   GAGGTCAAAC GCCACAAGCT CGAAACCGGC ATCCGCCTCG ATTCGGAATA
```

```
 951  CGGTTTGGGC GGCAAAATCG CCTACGACTA TTACAACCTC TTCAACAAAG
1001  GCTATATCGG TTCGGTCGTC TGGGATATGG ACAAATACGA AACCACGCTT
1051  GCCGCCGGCA TCAGCCAGCC GCGCAACTAT CGGGGCAACT ACTGGACAAG
1101  CAACGTTTCC TACAACCGTT CGACCACCCA AAACCTCGAA AAACGCGCCT
1151  TCTCCGGCGG CATCTGGTAT GTGCGCGACC GCGCGGGCAT CGATGCCAGG
1201  CTGGGGGCGG AGTTTCTCGC AGAAGGCCGG AAAATCCCCG GCTCGGATAT
1251  CGATTTGGGC AACAGCCACG CCACGATGCT GACCGCCTCT GGAAACGCC
1301  AGCTGCTCAA CAACGTGCTG CATCCCGAAA ACGGCCATTA CCTCGACGGC
1351  AAAATCGGTA CGACTTTGGG CGCATTCCTG TCCTCCACCG CGCTGATCCG
1401  CACCTCTGCC CGCGCAGGTT ATTTCTTCAC GCCCGAAAAC AAAAAACTCG
1451  GCACGTTCAT CATACGCGGA CAAGCGGGTT ACACCGTTGC CGCGACAAT
1501  GCCAACGTTC CTTCAGGGCT GATGTTCCGC AGCGGCGGCG CGTCTTCCGT
1551  GCGCGGTTAC GAACTCGACA GCATCGGGCT TGCCGGCCCG AACGGATCGG
1601  TCCTGCCCGA ACGCGCCCTC TTGGTGGGCA GCCTGGAATA CCAACTGCCG
1651  TTTACGCGCA CCCTTTCCGG CGCGGTGTTC CACGATATGG GCGACGCCGC
1701  CGCCAATTTC AAACGTATGA AGCTGAAACA CGGTTCGGGA CTGGGCGTGC
1751  GCTGGTTCAG CCCGCTCGCG CCGTTTTCCT TCGACATCGC CTACGGGCAC
1801  AGCGACAAGA AAATCCGCTG GCACATCAGC TTGGGAACGC GCTTCTAA
```

This corresponds to the amino acid sequence <SEQ ID 1198; ORF 286.a>:

```
a286.pep
    1  MHDTRTMMIK PTALLLPALF FFPHAYAPAA DLSENKAAGF ALFKNKSPDT
   51  ESVKLKPKFP VRIDTQDSEI KDMVEEHLPL ITQQQEEVLD KEQTGFLAEE
  101  APDNVKTMLR SKGYFSSKVS LTEKDGAYTV HITPGPRTKI ANVGVAILGD
  151  ILSDGNLAEY YRNALENWQQ PVGSDFDQDS WENSKTSVLG AVTRKAYPLA
  201  KLGNTRAAVN PDTATADLNV VVDSGRPIAF GDFEITGTQR YPEQIVSGLA
  251  RFQPGTPYDL DLLLDFQQAL EQNGHYSGAS VQADFDRLQG DRVPVKVSVT
  301  EVKRHKLETG IRLDSEYGLG GKIAYDYYNL FNKGYIGSVV WDMDKYETTL
  351  AAGISQPRNY RGNYWTSNVS YNRSTTQNLE KRAFSGGIWY VRDRAGIDAR
  401  LGAEFLAEGR KIPGSDIDLG NSHATMLTAS WKRQLLNNVL HPENGHYLDG
  451  KIGTTLGAFL SSTALIRTSA RAGYFFTPEN KKLGTFIIRG QAGYTVARDN
  501  ANVPSGLMFR SGGASSVRGY ELDSIGLAGP NGSVLPERAL LVGSLEYQLP
  551  FTRTLSGAVF HDMGDAAANF KRMKLKHGSG LGVRWFSPLA PFSFDIAYGH
  601  SDKKIRWHIS LGTRF*
``` m286/a286 98.7% identity in 615 aa overlap

```
                    10         20         30         40         50         60
m286.pep    MHDTRTMMIKPTALLLPALFFFPHAYAPAADLSENKAAGFALFKNKSPDTESVKLKPKFP
            ||||||||||||||||||||||||||||||||||||||||||||||||||||||||||||
a286        MHDTRTMMIKPTALLLPALFFFPHAYAPAADLSENKAAGFALFKNKSPDTESVKLKPKFP
                    10         20         30         40         50         60
```

-continued

```
                70        80        90       100       110       120
m286.pep  VLIDTQDSEIKDMVEEHLPLITQQQEEVLDKEQTGFLAEEAPDNVKTMLRSKGYFSSKVS
          | ||||||||||||||||||||||||||||||||||||||||||||||||||||||||||
a286      VRIDTQDSEIKDMVEEHLPLITQQQEEVLDKEQTGFLAEEAPDNVKTMLRSKGYFSSKVS
                70        80        90       100       110       120

130       140       150       160       170       180
m286.pep  LTEKDGAYTVHITPGPRTKIANVGVAILGDILSDGNLAEYYRNALENWQQPVGSDFDQDS
          ||||||||||||||||||||||||||||||||||||||||||||||||||||||||||||
a286      LTEKDGAYTVHITPGPRTKIANVGVAILGDILSDGNLAEYYRNALENWQQPVGSDFDQDS
               130       140       150       160       170       180

190       200       210       220       230       240
m286.pep  WENSKTSVLGAVTRKAYPLAKLGNTQAAVNPDTATADLNVVVDSGRPIAFGDFEITGTQR
          ||||||||||||||||||||||||:|||||||||||||||||||||||||||||||||||
a286      WENSKTSVLGAVTRKAYPLAKLGNTRAAVNPDTATADLNVVVDSGRPIAFGDFEITGTQR
               190       200       210       220       230       240

250       260       270       280       290       300
m286.pep  YPEQIVSGLARFQPGMPYDLDLLLDFQQALEQNGHYSGASVQADFDRLQGDRVPVKVSVT
          |||||||||||||| |||||||||||||||||||||||||||||||||||||||||||||
a286      YPEQIVSGLARFQPGTPYDLDLLLDFQQALEQNGHYSGASVQADFDRLQGDRVPVKVSVT
               250       260       270       280       290       300

310       320       330       340       350       360
m286.pep  EVKRHKLETGIRLDSEYGLGGKIAYDYYNLFNKGYIGSVVWDMDKYETTLAAGISQPRNY
          ||||||||||||||||||||||||||||||||||||||||||||||||||||||||||||
a286      EVKRHKLETGIRLDSEYGLGGKIAYDYYNLFNKGYIGSVVWDMDKYETTLAAGISQPRNY
               310       320       330       340       350       360

370       380       390       400       410       420
m286.pep  RGNYWTSNVSYNRSTTQNLEKRAFSGGVWYVRDRAGIDARLGAEFLAEGRKIPGSAVDLG
          ||||||||||||||||||||||||||||:|||||||||||||||||||||||||| :|||
a286      RGNYWTSNVSYNRSTTQNLEKRAFSGGIWYVRDRAGIDARLGAEFLAEGRKIPGSDIDLG
               370       380       390       400       410       420

430       440       450       460       470       480
m286.pep  NSHATMLTASWKRQLLNNVLHPENGHYLDGKIGTTLGTFLSSTALIRTSARAGYFFTPEN
          |||||||||||||||||||||||||||||||||||||:||||||||||||||||||||||
a286      NSHATMLTASWKRQLLNNVLHPENGHYLDGKIGTTLGAFLSSTALIRTSARAGYFFTPEN
               430       440       450       460       470       480

490       500       510       520       530       540
m286.pep  KKLGTFIIRGQAGYTVARDNADVPSGLMFRSGGASSVRGYELDSIGLAGPNGSVLPERAL
          ||||||||||||||||||||:|||||||||||||||||||||||||||||||||||||||
a286      KKLGTFIIRGQAGYTVARDNANVPSGLMFRSGGASSVRGYELDSIGLAGPNGSVLPERAL
               490       500       510       520       530       540

550       560       570       580       590       600
m286.pep  LVGSLEYQLPFTRTLSGAVFHDMGDAAANFKRMKLKHGSGLGVRWFSPLAPFSFDIAYGH
          ||||||||||||||||||||||||||||||||||||||||||||||||||||||||||||
a286      LVGSLEYQLPFTRTLSGAVFHDMGDAAANFKRMKLKHGSGLGVRWFSPLAPFSFDIAYGH
               550       560       570       580       590       600

610
m286.pep  SDKKIRWHISLGTRFX
          ||||||||||||||||
a286      SDKKIRWHISLGTRFX
               610
```

The following partial DNA sequence was identified in *N. gonorrhoeae* <SEQ ID 1199>:

```
g287.seq
     1  atgtttaaac gcagtgtgat tgcaatggct tgtatttttc ccctttcagc
    51  ctgtgggggc ggcggtggcg gatcgcccga tgtcaagtcg gcggacacgc
   101  cgtcaaaacc ggccgccccc gttgttgctg aaaatgccgg ggaaggggtg
   151  ctgccgaaag aaaagaaaga tgaggaggca gcgggcggtg cgccgcaagc
   201  cgatacgcag gacgcaaccg ccggagaagg cagccaagat atggcggcag
   251  tttcggcaga aaatacaggc aatggcggtg cggcaacaac ggacaacccc
   301  aaaaatgaag acgcgggggc gcaaaatgat atgccgcaaa atgccgccga
   351  atccgcaaat caaacaggga acaaccaacc cgccggttct tcagattccg
   401  cccccgcgtc aaaccctgcc cctgcgaatg gcggtagcga ttttggaagg
   451  acgaacgtgg gcaattctgt tgtgattgac ggaccgtcgc aaaatataac
   501  gttgacccac tgtaaaggcg attcttgtaa tggtgataat ttattggatg
```

```
 551  aagaagcacc gtcaaaatca gaatttgaaa aattaagtga tgaagaaaaa 601  attaagcgat ataaaaaaga cgagcaacgg gagaattttg tcggtttggt 651  tgctgacagg gtaaaaaagg atggaactaa caaatatatc atcttctata 701  cggacaaacc acctactcgt tctgcacggt cgaggaggtc gcttccggcc 751  gagattccgc tgattcccgt caatcaggcc gatacgctga ttgtggatgg 801  ggaagcggtc agcctgacgg ggcattccgg caatatcttc gcgcccgaag 851  ggaattaccg gtatctgact tacggggcgg aaaaattgcc cggcggatcg 901  tatgccctcc gtgtgcaagg cgaaccggca aaaggcgaaa tgcttgttgg 951  cacggccgtg tacaacggcg aagtgctgca tttccatatg gaaacggcc 1001  gtccgtaccc gtccggaggc aggtttgccg caaaagtcga tttcggcagc 1051  aaatctgtgg acggcattat cgacagcggc gatgatttgc atatgggtac 1101  gcaaaaattc aaagccgcca tcgatggaaa cggctttaag gggacttgga 1151  cggaaaatgg cggcggggat gtttccggaa ggttttacgg cccggccggc 1201  gaggaagtgg cgggaaaata cagctatcgc ccgacagatg ctgaaaggg 1251  cggattcggc gtgtttgccg gcaaaaaaga tcgggattga
```

This corresponds to the amino acid sequence <SEQ ID 1200; ORF 287.ng>:

```
g287.pep
  1  MFKRSVIAMA CIFPLSACGG GGGGSPDVKS ADTPSKPAAP VVAENAGEGV

51  LPKEKKDEEA AGGAPQADTQ DATAGEGSQD MAAVSAENTG NGGAATTDNP

101  KNEDAGAQND MPQNAAESAN QTGNNQPAGS SDSAPASNPA PANGGSDFGR

151  TNVGNSVVID GPSQNITLTH CKGDSCNGDN LLDEEAPSKS EFEKLSDEEK

201  IKRYKKDEQR ENFVGLVADR VKKDGTNKYI IFYTDKPPTR SARSRRSLPA

251  EIPLIPVNQA DTLIVDGEAV SLTGHSGNIF APEGNYRYLT YGAEKLPGGS

301  YALRVQGEPA KGEMLVGTAV YNGEVLHFHM ENGRPYPSGG RFAAKVDFGS

351  KSVDGIIDSG DDLHMGTQKF KAAIDGNGFK GTWTENGGGD VSGRFYGPAG

401  EEVAGKYSYR PTDAEKGGFG VFAGKKDRD*
```

45

The following partial DNA sequence was identified in *N. meningitidis* <SEQ ID 1201>:

```
m287.seq
  1  ATGTTTAAAC GCAGCGTAAT CGCAATGGCT TGTATTTTTG CCCTTTCAGC

51  CTGCGGGGGC GGCGGTGGCG GATCGCCCGA TGTCAAGTCG GCGGACACGC

101  TGTCAAAACC TGCCGCCCCT GTTGTTTCTG AAAAAGAGAC AGAGGCAAAG

151  GAAGATGCGC CACAGGCAGG TTCTCAAGGA CAGGGCGCGC CATCCGCACA

201  AGGCAGTCAA GATATGGCGG CGGTTTCGGA AGAAAATACA GGCAATGGCG

251  GTGCGGTAAC AGCGGATAAT CCCAAAAATG AAGACGAGGT GGCACAAAAT

301  GATATGCCGC AAAATGCCGC CGGTACAGAT AGTTCGACAC CGAATCACAC

351  CCCGGATCCG AATATGCTTG CCGGAAATAT GGAAAATCAA GCAACGGATG

401  CCGGGGAATC GTCTCAGCCG GCAAACCAAC CGGATATGGC AAATGCGGCG

451  GACGGAATGC AGGGGGACGA TCCGTCGGCA GGCGGGCAAA ATGCCGGCAA
```

-continued
```
 501  TACGGCTGCC CAAGGTGCAA ATCAAGCCGG AAACAATCAA GCCGCCGGTT

551  CTTCAGATCC CATCCCCGCG TCAAACCCTG CACCTGCGAA TGGCGGTAGC

601  AATTTTGGAA GGGTTGATTT GGCTAATGGC GTTTTGATTG ACGGGCCGTC

651  GCAAAATATA ACGTTGACCC ACTGTAAAGG CGATTCTTGT AGTGGCAATA

701  ATTTCTTGGA TGAAGAAGTA CAGCTAAAAT CAGAATTTGA AAAATTAAGT

751  GATGCAGACA AAATAAGTAA TTACAAGAAA GATGGGAAGA ATGATAAATT

801  TGTCGGTTTG GTTGCCGATA GTGTGCAGAT GAAGGGAATC AATCAATATA

851  TTATCTTTTA TAAACCTAAA CCCACTTCAT TTGCGCGATT TAGGCGTTCT

901  GCACGGTCGA GGCGGTCGCT TCCGGCCGAG ATGCCGCTGA TTCCCGTCAA

951  TCAGGCGGAT ACGCTGATTG TCGATGGGGA AGCGGTCAGC CTGACGGGGC

1001  ATTCCGGCAA TATCTTCGCG CCCGAAGGGA ATTACCGGTA TCTGACTTAC

1051  GGGGCGGAAA AATTGCCCGG CGGATCGTAT GCCCTTCGTG TTCAAGGCGA

1101  ACCGGCAAAA GGCGAAATGC TTGCGGGCGC GGCCGTGTAC AACGGCGAAG

1151  TACTGCATTT CCATACGGAA AACGGCCGTC CGTACCCGAC CAGGGGCAGG

1201  TTTGCCGCAA AAGTCGATTT CGGCAGCAAA TCTGTGGACG GCATTATCGA

1251  CAGCGGCGAT GATTTGCATA TGGGTACGCA AAAATTCAAA GCCGCCATCG

1301  ATGGAAACGG CTTTAAGGGG ACTTGGACGG AAAATGGCAG CGGGGATGTT

1351  TCCGGAAAGT TTTACGGCCC GGCCGGCGAG GAAGTGGCGG GAAAATACAG

1401  CTATCGCCCG ACAGATGCGG AAAAGGGCGG ATTCGGCGTG TTTGCCGGCA

1451  AAAAGAGCA GGATTGA
```

This corresponds to the amino acid sequence <SEQ ID 1202; ORF 287>:

```
m287.pep
     1  MFKRSVIAMA CIFALSACGG GGGGSPDVKS ADTLSKPAAP VVSEKETEAK

51  EDAPQAGSQG QGAPSAQGSQ DMAAVSEENT GNGGAVTADN PKNEDEVAQN

101  DMPQNAAGTD SSTPNHTPDP NMLAGNMENQ ATDAGESSQP ANQPDMANAA

151  DGMQGDDPSA GGQNAGNTAA QGANQAGNNQ AAGSSDPIPA SNPAPANGGS

201  NFGRVDLANG VLIDGPSQNI TLTHCKGDSC SGNNFLDEEV QLKSEFEKLS

251  DADKISNYKK DGKNDKFVGL VADSVQMKGI NQYIIFYKPK PTSFARFRRS

301  ARSRRSLPAE MPLIPVNQAD TLIVDGEAVS LTGHSGNIFA PEGNYRYLTY

351  GAEKLPGGSY ALRVQGEPAK GEMLAGAAVY NGEVLHFHTE NGRPYPTRGR

401  FAAKVDFGSK SVDGIIDSGD DLHMGTQKFK AAIDGNGFKG TWTENGSGDV

451  SGKFYGPAGE EVAGKYSYRP TDAEKGGFGV FAGKKEQD*
```

Computer analysis of this amino acid sequence gave the following results:
Homology with a Predicted ORF from *N. gonorrhoeae*
m287/g287 70.1% identity in 499 aa overlap

```
                  10        20        30        40            49
m287.pep  MFKRSVIAMACIFALSACGGGGGGSPDVKSADTLSKPAAPVVSE----------KETEA
          |||||||||||| ||||||||||||||||||||| |||||||:|          |: ||
 g287     MFKRSVIAMACIFPLSACGGGGGGSPDVKSADTPSKPAAPVVAENAGEGVLPKEKKDEEA
                  10        20        30        40        50        60
```

-continued

```
            50        60        70        80        90       100      109
m287.pep     KEDAPQAGSQGQGAPSAQGSQDMAAVSEENTGNGGAVTADNPKNEDEVAQNDMPQNAAGT
                |||| :|   | :::||||||||| ||||||||:|:|||||||  ||||||||||
g287         AGGAPQADTQD--ATAGEGSQDMAAVSAENTGNGGAATTDNPKNEDAGAQNDMPQNAA--
                     70          80        90       100       110

110       120       130       140       150       160      169
m287.pep     DSSTPNHTPDPNMLAGNMENQATDAGESSQPANQPDMANAADGMQGDDPSAGGQNAGNTA g287         ------------------------------------------------------------

170       180       190       200       210       220      229
m287.pep     AQGANQAGNNQAAGSSDPIPASNPAPANGGSNFGRVDLANGVLIDGPSQNITLTHCKGDS
              ::|||:|||| |||||  ||||||||||||:|||::::|:|:|||||||||||||||||
g287         -ESANQTGNNQPAGSSDSAPASNPAPANGGSDFGRTNVGNSVVIDGPSQNITLTHCKGDS
               120       130       140       150       160       170

230       240       250       260       270       280      289
m287.pep     CSGNNFLDEEVQLKSEFEKLSDADKISNYKKDGKNDKFVGLVADSVQMKGINQYIIFYKP
             |:|:|:||||:  ||||||||| :||: |||| : ::||||||| |:  | |:|||||
g287         CNGDNLLDEEAPSKSEFEKLSDEEKIKRYKKDEQRENFVGLVADRVKKDGTNKYIIFYTD
               180       190       200       210       220       230

290       300       310       320       330       340      349
m287.pep     KPTSFARFRRSARSRRSLPAEMPLIPVNQADTLIVDGEAVSLTGHSGNIFAPEGNYRYLT
             || :     ||||||||||||:||||||||||||||||||||||||||||||||||||||
g287         KPPT-----RSARSRRSLPAEIPLIPVNQADTLIVDGEAVSLTGHSGNIFAPEGNYRYLT
               240       250       260       270       280       290

350       360       370       380       390       400      409
m287.pep     YGAEKLPGGSYALRVQGEPAKGEMLAGAAVYNGEVLHFHTENGRPYPTRGRFAAKVDFGS
             |||||||||||||||||||||||||:|:||||||||||| |||||||: |||||||||||
g287         YGAEKLPGGSYALRVQGEPAKGEMLVGTAVYNGEVLHFHMENGRPYPSGGRFAAKVDFGS
               300       310       320       330       340       350

410       420       430       440       450       460      469
m287.pep     KSVDGIIDSGDDLHMGTQKFKAAIDGNGFKGTWTENGSGDVSGKFYGPAGEEVAGKYSYR
             |||||||||||||||||||||||||||||||||||||:|||||:||||||||||||||||
g287         KSVDGIIDSGDDLHMGTQKFKAAIDGNGFKGTWTENGGGDVSGRFYGPAGEEVAGKYSYR
               300       310       320       330       340       350

470       480      489
m287.pep     PTDAEKGGFGVFAGKKEQDX
             ||||||||||||||||::||
g287         PTDAEKGGFGVFAGKKDRDX
               420       430
```

The following partial DNA sequence was identified in *N. meningitidis* <SEQ ID 1203>:

```
a287.seq
      1   ATGTTTAAAC GCAGTGTGAT TGCAATGGCT TGTATTGTTG CCCTTTCAGC

51   CTGTGGGGGC GGCGGTGGCG GATCGCCCGA TGTTAAGTCG GCGGACACGC

101   TGTCAAAACC TGCCGCCCCT GTTGTTACTG AAGATGTCGG GGAAGAGGTG

151   CTGCCGAAAG AAAAGAAAGA TGAGGAGGCG GTGAGTGGTG CGCCGCAAGC

201   CGATACGCAG GACGCAACCG CCGGAAAAGG CGGTCAAGAT ATGGCGGCAG

251   TTTCGGCAGA AAATACAGGC AATGGCGGTG CGGCAACAAC GGATAATCCC

301   GAAAATAAAG ACGAGGGACC GCAAAATGAT ATGCCGCAAA ATGCCGCCGA

351   TACAGATAGT TCGACACCGA ATCACACCCC TGCACCGAAT ATGCCAACCA

401   GAGATATGGG AAACCAAGCA CCGGATGCCG GGGAATCGGC ACAACCGGCA

451   AACCAACCGG ATATGGCAAA TGCGGCGGAC GGAATGCAGG GGGACGATCC

501   GTCGGCAGGG GAAAATGCCG GCAATACGGC AGATCAAGCT GCAAATCAAG

551   CTGAAAACAA TCAAGTCGGC GGCTCTCAAA ATCCTGCCTC TTCAACCAAT

601   CCTAACGCCA CGAATGGCGG CAGCGATTTT GGAAGGATAA ATGTAGCTAA

651   TGGCATCAAG CTTGACAGCG GTTCGGAAAA TGTAACGTTG ACACATTGTA

701   AAGACAAAGT ATGCGATAGA GATTTCTTAG ATGAAGAAGC ACCACCAAAA

751   TCAGAATTTG AAAAATTAAG TGATGAAGAA AAAATTAATA AATATAAAAA

801   AGACGAGCAA CGAGAGAATT TTGTCGGTTT GGTTGCTGAC AGGGTAGAAA
```

-continued

```
 851  AGAATGGAAC TAACAAATAT GTCATCATTT ATAAAGACAA GTCCGCTTCA
 901  TCTTCATCTG CGCGATTCAG GCGTTCTGCA CGGTCGAGGC GGTCGCTTCC
 951  GGCCGAGATG CCGCTGATTC CCGTCAATCA GGCGGATACG CTGATTGTCG
1001  ATGGGGAAGC GGTCAGCCTG ACGGGGCATT CCGGCAATAT CTTCGCGCCC
1051  GAAGGGAATT ACCGGTATCT GACTTACGGG GCGGAAAAAT TGTCCGGCGG
1101  ATCGTATGCC CTCAGTGTGC AAGGCGAACC GGCAAAAGGC GAAATGCTTG
1151  CGGGCACGGC CGTGTACAAC GGCGAAGTGC TGCATTTCCA TATGGAAAAC
1201  GGCCGTCCGT CCCCGTCCGG AGGCAGGTTT GCCGCAAAAG TCGATTTCGG
1251  CAGCAAATCT GTGGACGGCA TTATCGACAG CGGCGATGAT TTGCATATGG
1301  GTACGCAAAA ATTCAAAGCC GTTATCGATG GAAACGGCTT TAAGGGGACT
1351  TGGACGGAAA ATGGCGGCGG GGATGTTTCC GGAAGGTTTT ACGGCCCGGC
1401  CGGCGAAGAA GTGGCGGGAA AATACAGCTA TCGCCCGACA GATGCGGAAA
1451  AGGGCGGATT CGGCGTGTTT GCCGGCAAAA AAGAGCAGGA TTGA
```

This corresponds to the amino acid sequence <SEQ ID 1204; ORF 287.a>:

```
a287.pep
   1  MFKRSVIAMA CIVALSACGG GGGGSPDVKS ADTLSKPAAP VVTEDVGEEV

51  LPKEKKDEEA VSGAPQADTQ DATAGKGGQD MAAVSAENTG NGGAATTDNP

101  ENKDEGPQND MPQNAADTDS STPNHTPAPN MPTRDMGNQA PDAGESAQPA

151  NQPDMANAAD GMQGDDPSAG ENAGNTADQA ANQAENNQVG GSQNPASSTN

201  PNATNGGSDF GRINVANGIK LDSGSENVTL THCKDKVCDR DFLDEEAPPK

251  SEFEKLSDEE KINKYKKDEQ RENFVGLVAD RVEKNGTNKY VIIYKDKSAS

301  SSSARFRRSA RSRRSLPAEM PLIPVNQADT LIVDGEAVSL TGHSGNIFAP

351  EGNYRYLTYG AEKLSGGSYA LSVQGEPAKG EMLAGTAVYN GEVLHFHMEN

401  GRPSPSGGRF AAKVDFGSKS VDGIIDSGDD LHMGTQKFKA VIDGNGFKGT

451  WTENGGGDVS GRFYGPAGEE VAGKYSYRPT DAEKGGFGVF AGKKEQD*
                                                        45
``` m287/a287 77.2% identity in 501 aa overlap

```
                10         20         30         40          49
m287.pep  MFKRSVIAMACIFALSACGGGGGGSPDVKSADTLSKPAAPVVSE----------KETEA
          ||||||||||| ||||||||||||||||||||||||||||||:|         |: ||
a287      MFKRSVIAMACIVALSACGGGGGGSPDVKSADTLSKPAAPVVTEDVGEEVLPKEKKDEEA
                10         20         30         40         50         60

50         60         70         80         90        100       109
m287.pep  KEDAPQAGSQGQGAPSAQGSQDMAAVSEENTGNGGAVTADNPKNEDEVAQNDMPQNAAGT
           |||  :|    |    ::::|:|||||||| ||||||||:|:|||:|||  ||||||||| |
a287      VSGAPQADTQ--DATAGKGGQDMAAVSAENTGNGGAATTDNPENKDEGPQNDMPQNAADT
                70         80         90        100        110

110        120        130        140        150        160       169
m287.pep  DSSTPNHTPDPNMLAGNMENQATDAGESSQPANQPDMANAADGMQGDDPSAGGQNAGNTA
          |||||||||  ||| : :| ||| |||||:||||||||||||||||||||||: |||||
a287      DSSTPNHTPAPNMPTRDMGNQAPDAGESAQPANQPDMANAADGMQGDDPSAG-ENAGNTA
                120        130        140        150        160        170

170        180        190        200        210        220       229
m287.pep  AQGANQAGNNQAAGSSDPIPASNPAPANGGSNFGRVDLANGVLIDGPSQNITLTHCKGDS
          :||| ||| ||| ::||| ::||     :|||||||:||:||:|:|:: :|:|||||:
a287      DQAANQAENNQVGGSQNPASSTNPNATNGGSDFGRINVANGIKLDSGSENVTLTHCKDKV
                180        190        200        210        220        230
```

```
                 230       240       250       260       270       280    289
   m287.pep  CSGNNFLDEEVQLKSEFEKLSDADKISNYKKDGKNDKFVGLVADSVQMKGINQYIIFYKP
             |: :||||: |||||||||| :||:||||: : ::||||||| |: :| |:|:|:||
   a287      CD-RDFLDEEAPPKSEFEKLSDEEKINKYKKDEQRENFVGLVADRVEKNGTNKYVIIYKD
                 240       250       260       270       280       290

290       300       310       320       330       340
   m287.pep  KP--TSFARFRRSARSRRSLPAEMPLIPVNQADTLIVDGEAVSLTGHSGNIFAPEGNYRY
             |   :| ||||||||||||||||||||||||||||||||||||||||||||||||||||
   a287      KSASSSSARFRRSARSRRSLPAEMPLIPVNQADTLIVDGEAVSLTGHSGNIFAPEGNYRY
                 300       310       320       330       340       350

350       360       370       380       390       400
   m287.pep  LTYGAEKLPGGSYALRVQGEPAKGEMLAGAAVYNGEVLHFHTENGRPYPTRGRFAAKVDF
             ||||||||| |||| |||||||||||||||:|||||||||||| ||: | ||||||||
   a287      LTYGAEKLSGGSYALSVQGEPAKGEMLAGTAVYNGEVLHFHMENGRPSPSGGRFAAKVDF
                 360       370       380       390       400       410

410       420       430       440       450       460
   m287.pep  GSKSVDGIIDSGDDLHMGTQKFKAAIDGNGFKGTWTENGSGDVSGKFYGPAGEEVAGKYS
             ||||||||||||||||||||||||:|||||||||||||||:|||||:|||||||||||||
   a287      GSKSVDGIIDSGDDLHMGTQKFKAVIDGNGFKGTWTENGGGDVSGRFYGPAGEEVAGKYS
                 420       430       440       450       460       470

470       480    489
   m287.pep  YRPTDAEKGGFGVFAGKKEQDX
             ||||||||||||||||||||||
   a287      YRPTDAEKGGFGVFAGKKEQDX
                 480       490
```

The following partial DNA sequence was identified in *N. gonorrhoeae* <SEQ ID 1205>:

```
g288.seq
    1   atgcacaccg gacaggcggt aagccgggtt ctgtctcgga cagtcattcc 51   tctaggcata ccgttgccgg tatgctcaag caacctaccc gaacgctcgg 101   cgggcagcgt cattgcgttc tgtttggtct tgctccgaat ggggtttggc 151   ctgccgcata ttgttaccaa atgcgcggtg cgcccttacc gcaccttttc 201   acccttgcct gtgctgccaa agcagccatc ggcggttttg ctttctgttc 251   cactttccgt cgcgttaccg cgcccggccg ttaaccggca ttctaccctg 301   cggagcccgg actttcctcc ccgtatgcct tacgcgatac gcggcgactg 351   tctgcccgtc ccgtgtgcgg cgcggattat aacacgaaac gcaaaaatgc 401   cgtctgaaac ggtacaggtt tcagacggca tacagcctaa actacacacc 451   ctgtttcagg ctggcttcga tgaagccgtc caagtcgccg tccaatacgg 501   ctttgtggtt gccgacttcg tagcctgtac gcaagtcttt gatgcgtga
```

This corresponds to the amino acid sequence <SEQ ID 1206; ORF 288.ng>:

```
g288.pep
    1   MHTGQAVSRV LSRTVIPLGI PLPVCSSNLP ERSAGSVIAF CLVLLRMGFG

51   LPHIVTKCAV RPYRTFSPLP VLPKQPSAVL LSVPLSVALP RPAVNRHSTL

101   RSPDFPPRMP YAIRGDCLPV PCAARIITRN AKMPSETVQV SDGIQPKLHT

151   LFQAGFDEAV QVAVQYGFVV ADFVACTQVF DA*
```

The following partial DNA sequence was identified in *N. meningitidis* <SEQ ID 1207>:

```
m288.seq
    1   ATGCACACCG GACAGGCGGT AAGCCGGGTT CTGTCTCGGA CAGTCATTCC

51   TCTAGGCATA CCGTTACCGG TATGCTCAAG CAACCTACCC GAACGCTCGG
```

-continued
```
101    CGGGCAGCGT CATTGCGTTC TGTTTGGTCT TGCTCCGAAT GGGGTTTGGC

151    CTGCCGCATA TTGTTACCAA ATGCGCGGTG CGCCCTTACC GCACCTTTTC

201    ACCCTTACCT GTGCTGCCAA AGCAGCCATC GGCGGTTTTG CTTTCTGTTC

251    CACTTTCCGT CGCGTTACCG CGCCCGGCCG TTAACCGGCA TTCTACCCTG

301    CGGAGCCCGG ACTTTCCTCC CCGTATGCCT TACGCGATAC GCGGCGACTG

351    TCTGCCCGTC CCGTGTGCGG CGCGGATTAT AACACGAAAC ACAAAAATGC

401    CGTCTGAAAC GGTACAGGTT TCAGACGGCA TACAGCCTAA ACTACACGCC

451    CTGTTTCAGG CTGGCTTCGA TGAAGCCGTC CAAGTCGCCA TCCAATACGG

501    CTTTGGTGTT GCCGACTTCG TAGCCTGTAC GCAAGTCTTT GATACGTGA
```

This corresponds to the amino acid sequence <SEQ ID 1208; ORF 288>:

```
m288.pep
    1    MHTGQAVSRV LSRTVIPLGI PLPVCSSNLP ERSAGSVIAF CLVLLRMGFG

51    LPHIVTKCAV RPYRTFSPLP VLPKQPSAVL LSVPLSVALP RPAVNRHSTL

101    RSPDFPPRMP YAIRGDCLPV PCAARIITRN TKMPSETVQV SDGIQPKLHA

151    LFQAGFDEAV QVAIQYGFGV ADFVACTQVF DT*
```

Computer analysis of this amino acid sequence gave the following results:
Homology with a Predicted ORF from *N. gonorrhoeae*
  m288/g288 97.8% identity in 181 aa overlap

```
                  10         20         30         40         50         60
    m288.pep  MHTGQAVSRVLSRTVIPLGIPLPVCSSNLPERSAGSVIAFCLVLLRMGFGLPHIVTKCAV
              ||||||||||||||||||||||||||||||||||||||||||||||||||||||||||||
    g288      MHTGQAVSRVLSRTVIPLGIPLPVCSSNLPERSAGSVIAFCLVLLRMGFGLPHIVTKCAV
                  10         20         30         40         50         60

70         80         90        100        110        120
    m288.pep  RPYRTFSPLPVLPKQPSAVLLSVPLSVALPRPAVNRHSTLRSPDFPPRMPYAIRGDCLPV
              ||||||||||||||||||||||||||||||||||||||||||||||||||||||||||||
    g288      RPYRTFSPLPVLPKQPSAVLLSVPLSVALPRPAVNRHSTLRSPDFPPRMPYAIRGDCLPV
                  70         80         90        100        110        120

130        140        150        160        170        180
    m288.pep  PCAARIITRNTKMPSETVQVSDGIQPKLHALFQAGFDEAVQVAIQYGFGVADFVACTQVF
              |||||||||| :||||||||||||||||||: |||||||||||:|||| |||||||||||
    g288      PCAARIITRNAKMPSETVQVSDGIQPKLHTLFQAGFDEAVQVAVQYGFVVADFVACTQVF
                 130        140        150        160        170        180 m288.pep  DTX
              |:|
    g288      DAX
                50
```

The following partial DNA sequence was identified in *N. meningitidis* <SEQ ID 1209>:

```
a288.seq
    1    ATGCACACCG GACAGGCGGT AAGCCGGGTT CTGTCTCGGA CAGTCATTCC

51    TCTAGGCATA CCGTTGCCGG TATGCTCAAG CAACCTACCC GAACGCTCGG

101    CGGGCAGCGT CATTGCGTTC TGTTTGGTCT TGCTCCGAAT GGGGTTTGGC

151    CTGCCGCATA TTGTTACCAA ATGCGCGGTG CGCCCTTACC GCACCTTTTC

201    ACCCTTGCCT GTGCTGCCAA AGCAGCCATC GGCGGTTTTG CTTTCTGTTC

251    CACTTTCCGT CGCGTTACCG CGCCCGGCCG TTAACCGGCA TTCTACCCTG

301    CGGAGCCCGG ACTTTCCTCC CCGTATGCCT TACGCGATAC GCGGCGACTG
```

-continued
```
351  TCTGCCCGTC CCGTGTGCGG CGCGGATTAT AACACGAAAC GCAAAAATGC

401  CGTCTGAAAC GGTACAGGTT TCAGACGGCA TACAGCCTAA ACTACACGCC

451  CTGTTTCAGG CTGGCTTCGA TAAAGCCGTC CAAGTCGCCG TCCAATACGG

501  CTTTGGTGTT GCCGACTTCG TAGCCTGTGC GCAAGTCTTT AATGCGTGA
```

This corresponds to the amino acid sequence <SEQ ID 1210; ORF 288.a>:

```
a288.pep
    1   MHTGQAVSRV LSRTVIPLGI PLPVCSSNLP ERSAGSVIAF CLVLLRMGFG

51   LPHIVTKCAV RPYRTFSPLP VLPKQPSAVL LSVPLSVALP RPAVNRHSTL

101   RSPDFPPRMP YAIRGDCLPV PCAARIITRN AKMPSETVQV SDGIQPKLHA

151   LFQAGFDKAV QVAVQYGFGV ADFVACAQVF NA*
``` m288/a288 97.2% identity in 181 aa overlap

```
                   10         20         30         40         50         60
   m288.pep  MHTGQAVSRVLSRTVIPLGIPLPVCSSNLPERSAGSVIAFCLVLLRMGFGLPHIVTKCAV
             ||||||||||||||||||||||||||||||||||||||||||||||||||||||||||||
   a288      MHTGQAVSRVLSRTVIPLGIPLPVCSSNLPERSAGSVIAFCLVLLRMGFGLPHIVTKCAV
                   10         20         30         40         50         60

70         80         90        100        110        120
   m288.pep  RPYRTFSPLPVLPKQPSAVLLSVPLSVALPRPAVNRHSTLRSPDFPPRMPYAIRGDCLPV
             ||||||||||||||||||||||||||||||||||||||||||||||||||||||||||||
   a288      RPYRTFSPLPVLPKQPSAVLLSVPLSVALPRPAVNRHSTLRSPDFPPRMPYAIRGDCLPV
                   70         80         90        100        110        120

130        140        150        160        170        180
   m288.pep  PCAARIITRNTKMPSETVQVSDGIQPKLHALFQAGFDEAVQVAIQYGFGVADFVACTQVF
             |||||||||| :||||||||||||||||||||||||||:|||| :||||||||||| :|||
   a288      PCAARIITRNAKMPSETVQVSDGIQPKLHALFQAGFDKAVQVAVQYGFGVADFVACAQVF
                  130        140        150        160        170        180 m288.pep  DTX
             ::
   a288      NAX
```

The following partial DNA sequence was identified in *N. gonorrhoeae* <SEQ ID 1211>:

```
g290.seq
    1   atggcaaaaa tgatgaaatg ggcggctgtt gcggcggtcg cggcggcagc 51   ggtttggggc ggatggtctt atctgaagcc cgaaccgcag gctgcttata 101   ttacggaagc ggtcaggcgc ggcgatatca gccggacggt ttccgcgacg 151   ggcgagattt cgccgtccaa cctggtatcg gtcggcgcgc aggcttcggg 201   gcagattaaa aagctttatg tcaaactcgg gcaacaggtc aaaaagggcg 251   atttgattgc ggaaatcaat tcgaccacgc agaccaacac gatcgatatg 301   gaaaaatcca aattggaaac gtatcaggcg aagctggtgt ccgcacagat 351   tgcattgggc agcgcggaaa aaaatataa gcgtcaggcg gcgttgtgga 401   aggatgatgc gacctctaaa gaagatttgg aaagcgcgca ggatgcgctt 451   gccgccgcca agccaatgt tgccgagttg aaggctttaa tcagacagag 501   caaaatttcc atcaataccg ccgagtcgga tttgggctac acgcgcatta 551   ccgcgacgat ggacggcacg gtggtggcga ttcccgtgga agaggggcag 601   actgtgaacg cggcgcagtc tacgccgacg attgtccaat tggcgaatct 651   ggatatgatg ttgaacaaaa tgcagattgc cgagggcgat attaccaagg
```

-continued
```
 701  tgaaggcggg gcaggatatt tcgtttacga ttttgtccga accggatacg 751  ccgattaagg cgaagctcga cagcgtcgac cccgggctga ccacgatgtc 801  gtcgggcggc tacaacagca gtacggatac ggcttccaat gcggtctatt 851  attatgcccg ttcgtttgtg ccgaatccgg acggcaaact cgccacgggg 901  atgacgacgc agaataccggt tgaaatcgac ggtgtgaaaa atgtgttgct 951  tattccgtcg ctgaccgtga aaaatcgcgg cggcaaggcg ttcgtacgcg 1001  tgttgggtgc ggacggcaag gcagtggaac gcgaaatccg gaccggtatg 1051  aaagacagta tgaataccga agtgaaaagc gggttgaaag aggggggacaa 1101  agtggtcatc tccgaaataa ccgccgccga gcagcaggaa agcggcgaac 1151  gcgccctagg cggcccgccg cgccgataa
```

This corresponds to the amino acid sequence <SEQ ID 1212; ORF 290.ng>:

```
g290.pep
   1  MAKMMKWAAV AAVAAAAVWG GWSYLKPEPQ AAYITEAVRR GDISRTVSAT

51  GEISPSNLVS VGAQASGQIK KLYVKLGQQV KKGDLIAEIN STTQTNTIDM

101  EKSKLETYQA KLVSAQIALG SAEKKYKRQA ALWKDDATSK EDLESAQDAL

151  AAAKANVAEL KALIRQSKIS INTAESDLGY TRITATMDGT VVAIPVEEGQ

201  TVNAAQSTPT IVQLANLDMM LNKMQIAEGD ITKVKAGQDI SFTILSEPDT

251  PIKAKLDSVD PGLTTMSSGG YNSSTDTASN AVYYYARSFV PNPDGKLATG

301  MTTQNTVEID GVKNVLLIPS LTVKNRGGKA FVRVLGADGK AVEREIRTGM

351  KDSMNTEVKS GLKEGDKVVI SEITAAEQQE SGERALGGPP RR*
```

The following partial DNA sequence was identified in *N. meningitidis* <SEQ ID 1213>:

```
m290.seq (partial)
   1  ..GTATCGGTCG GCGCGCAGGC ATCGGGGCAG ATTAAGATAC TTTATGTCAA

51     ACTCGGGCAA CAGGTTAAAA AGGGCGATTT GATTGCGGAA ATCAATTCGA

101     CCTCGCAGAC CAATACGCTC AATACGGAAA AATCCAAGTT GGAAACGTAT

151     CAGGCGAAGC TGGTGTCGGC ACAGATTGCA TTGGGCAGCG CGGAGAAGAA

201     ATATAAGCGT CAGGCGGCGT TATGGAAGGA AAACGCGACT TCCAAAGAGG

251     ATTTGGAAAG CGCGCAGGAT GCGTTTGCCG CCGCCAAAGC CAATGTTGCC

301     GAGCTGAAGG CTTTAATCAG ACAGAGCAAA ATTTCCATCA ATACCGCCGA

351     GTCGGAATTG GGCTACACGC GCATTACCGC AACGATGGAC GGCACGGTGG

401     TGGCGATTCT CGTGGAAGAG GGGCAGACTG TGAACGCGGC GCAGTCTACG

451     CCGACGATTG TCCAATTGGC GAATCTGGAT ATGATGTTGA ACAAAATGCA

501     GATTGCCGAG GGCGATATTA CCAAGGTGAA GGCGGGGCAG GATATTTCGT

551     TTACGATTTT GTCCGAACCG GATACGCCGA TTAAGGCGAA GCTCGACAGC

601     GTCGACCCCG GCTGACCAC GATGTCGTCG GGCGGTTACA ACAGCAGTAC

651     GGATACGGCT TCCAATGCGG TCTACTATTA TGCCCGTTCG TTTGTGCCGA

701     ATCCGGACGG CAAACTCGCC ACGGGGATGA CGACGCAGAA TACGGTTGAA

751     ATCGACGGCG TGAAAAATGT GCTGATTATT CCGTCGCTGA CCGTGAAAAA
```

```
 801    TCGCGGCGGC AAGGCGTTTG TGCGCGTGTT GGGTGCGGAC GGCAAGGCGG

851    CGGAACGCGA AATCCGGACC GGTATGAGAG ACAGTATGAA TACCGAAGTA

901    AAAAGCGGGT TGAAAGAGGG GGACAAAGTG GTCATCTCCG AAATAACCGC

951    CGCCGAGCAA CAGGAAAGCG GCGAACGCGC CCTAGGCGGC CCGCCGCGCC

1001    GATAA
```

This corresponds to the amino acid sequence <SEQ ID 1214; ORF 290>:

```
m290.pep (partial)
    1    ..VSVGAQASGQ IKILYVKLGQ QVKKGDLIAE INSTSQTNTL NTEKSKLETY

51    QAKLVSAQIA LGSAEKKYKR QAALWKENAT SKEDLESAQD AFAAAKANVA

101    ELKALIRQSK ISINTAESEL GYTRITATMD GTVVAILVEE GQTVNAAQST

151    PTIVQLANLD MMLNKMQIAE GDITKVKAGQ DISFTILSEP DTPIKAKLDS

201    VDPGLTTMSS GGYNSSTDTA SNAVYYYARS FVPNPDGKLA TGMTTQNTVE

251    IDGVKNVLII PSLTVKNRGG KAFVRVLGAD GKAAEREIRT GMRDSMNTEV

301    KSGLKEGDKV VISEITAAEQ QESGERALGG PPRR*
```

Computer analysis of this amino acid sequence gave the following results:
Homology with a Predicted ORF from *N. gonorrhoeae*
  m290/g290 96.1% identity in 334 aa overlap

```
                                       10        20        30
    m290.pep                     VSVGAQASGQIKILYVKLGQQVKKGDLIAE
                                 |||||||||| ||||||||||||||||||
    g290     PQAAYITEAVRRGDISRTVSATGEISPSNLVSVGAQASGQIKKLYVKLGQQVKKGDLIAE
                 30        40        50        60        70        80

40        50        60        70        80        90
    m290.pep  INSTSQTNTLNTEKSKLETYQAKLVSAQIALGSAEKKYKRQAALWKENATSKEDLESAQD
              ||||:||||:: ||||||||||||||||||||||||||||||||||::||||||||||||
    g290      INSTTQTNTIDMEKSKLETYQAKLVSAQIALGSAEKKYKRQAALWKDDATSKEDLESAQD
                  90       100       110       120       130       140

100       110       120       130       140       150
    m290.pep  AFAAAKANVAELKALIRQSKISINTAESELGYTRITATMDGTVVAILVEEGQTVNAAQST
              |:||||||||||||||||||||||||||:||||||||||||||| |||||||||||||||
    g290      ALAAAKANVAELKALIRQSKISINTAESDLGYTRITATMDGTVVAIPVEEGQTVNAAQST
                 150       160       170       180       190       200

160       170       180       190       200       210
    m290.pep  PTIVQLANLDMMLNKMQIAEGDITKVKAGQDISFTILSEPDTPIKAKLDSVDPGLTTMSS
              ||||||||||||||||||||||||||||||||||||||||||||||||||||||||||||
    g290      PTIVQLANLDMMLNKMQIAEGDITKVKAGQDISFTILSEPDTPIKAKLDSVDPGLTTMSS
                 210       220       230       240       250       260

220       230       240       250       260       270
    m290.pep  GGYNSSTDTASNAVYYYARSFVPNPDGKLATGMTTQNTVEIDGVKNVLIIPSLTVKNRGG
              ||||||||||||||||||||||||||||||||||||||||||||||||:|||||||||||
    g290      GGYNSSTDTASNAVYYYARSFVPNPDGKLATGMTTQNTVEIDGVKNVLLIPSLTVKNRGG
                 270       280       290       300       310       320

280       290       300       310       320       330
    m290.pep  KAFVRVLGADGKAAEREIRTGMRDSMNTEVKSGLKEGDKVVISEITAAEQQESGERALGG
              ||||||||||:|||||:|||||||||||||||||||||||||||||||||||||||||||
    g290      KAFVRVLGADGKAVEREIRTGMKDSMNTEVKSGLKEGDKVVISEITAAEQQESGERALGG
                 330       340       350       360       370       380 m290.pep  PPRRX
              |||||
    g290      PPRRX
              390
```

The following partial DNA sequence was identified in *N. meningitidis* <SEQ ID 1215>:

```
a290.seq
    1 ATGGCAAAAA TGATGAAATG GGCGGCTGTT GCGGCGGTCG CGGCGGCAGC
   51 GGTTTGGGGC GGATGGTCTT ATCTGAAGCC CGAGCCGCAG GCTGCTTATA
  101 TTACGGAAAC GGTCAGGCGC GGCGACATCA GCCGGACGGT TTCTGCAACA
  151 GGGGAGATTT CGCCGTCCAA CCTGGTATCG GTCGGCGCGC AGGCATCGGG
  201 GCAGATTAAG AAACTTTATG TCAAACTCGG GCAACAGGTT AAAAAGGGCG
  251 ATTTGATTGC GGAAATCAAT TCGACCTCGC AGACCAATAC GCTCAATACG
  301 GAAAAATCCA AATTGGAAAC GTATCAGGCG AAGCTGGTGT CGGCACAGAT
  351 TGCATTGGGC AGCGCGGAGA AGAAATATAA GCGTCAGGCG GCGTTGTGGA
  401 AGGATGATGC GACCGCTAAA GAAGATTTGG AAAGCGCACA GGATGCGCTT
  451 GCCGCCGCCA AAGCCAATGT TGCCGAGCTG AAGGCTCTAA TCAGACAGAG
  501 CAAAATTTCC ATCAATACCG CCGAGTCGGA ATTGGGCTAC ACGCGCATTA
  551 CCGCAACGAT GGACGGCACG GTGGTGGCGA TTCTCGTGGA AGAGGGGCAG
  601 ACTGTGAACG CGGCGCAGTC TACGCCGACG ATTGTCCAAT TGGCGAATCT
  651 GGATATGATG TTGAACAAAA TGCAGATTGC CGAGGGCGAT ATTACCAAGG
  701 TGAAGGCGGG GCAGGATATT TCGTTTACGA TTTTGTCCGA ACCGGATACG
  751 CCGATTAAGG CGAAGCTCGA CAGCGTCGAC CCCGGGCTGA CCACGATGTC
  801 GTCGGGCGGC TACAACAGCA GTACGGATAC GGCTTCCAAT GCGGTCTACT
  851 ATTATGCCCG TTCGTTTGTG CCGAATCCGG ACGGCAAACT CGCCACGGGG
  901 ATGACGACGC AGAATACGGT TGAAATCGAC GGTGTGAAAA ATGTGCTGAT
  951 TATTCCGTCG CTGACCGTGA AAAATCGCGG CGGCAGGGCG TTTGTGCGCG
 1001 TGTTGGGTGC AGACGGCAAG GCGGCGGAAC GCGAAATCCG GACCGGTATG
 1051 AGAGACAGTA TGAATACCGA AGTAAAAAGC GGGTTGAAAG AGGGGGACAA
 1101 AGTGGTCATC TCCGAAATAA CCGCCGCCGA GCAGCAGGAA AGCGGCGAAC
 1151 GCGCCCTAGG CGGCCCGCCG CGCCGATAA
```

This corresponds to the amino acid sequence <SEQ ID 1216; ORF 290.a>:

```
a290.pep
    1 MAKMMKWAAV AAVAAAAVWG GWSYLKPEPQ AAYITETVRR GDISRTVSAT
   51 GEISPSNLVS VGAQASGQIK KLYVKLGQQV KKGDLIAEIN STSQTNTLNT
  101 EKSKLETYQA KLVSAQIALG SAEKKYKRQA ALWKDDATAK EDLESAQDAL
  151 AAAKANVAEL KALIRQSKIS INTAESELGY TRITATMDGT VVAILVEEGQ
  201 TVNAAQSTPT IVQLANLDMM LNKMQIAEGD ITKVKAGQDI SFTILSEPDT
  251 PIKAKLDSVD PGLTTMSSGG YNSSTDTASN AVYYYARSFV PNPDGKLATG
  301 MTTQNTVEID GVKNVLIIPS LTVKNRGGRA FVRVLGADGK AAEREIRTGM
  351 RDSMNTEVKS GLKEGDKVVI SEITAAEQQE SGERALGGPP RR*
``` m290/a290 98.2% identity in 334 aa overlap

```
                                 10        20        30
m290.pep                 VSVGAQASGQIKILYVKLGQQVKKGDLIAE
                         ||||||||||| |||||||||||||||||
a290     PQAAYITETVRRGDISRTVSATGEISPSNLVSVGAQASGQIKKLYVKLGQQVKKGDLIAE
              30        40        50        60        70        80
```

```
                     40         50         60         70         80         90
m290.pep   INSTSQTNTLNTEKSKLETYQAKLVSAQIALGSAEKKYKRQAALWKENATSKEDLESAQD
           ||||||||||||||||||||||||||||||||||||||||||||::||:||||||||||
a290       INSTSQTNTLNTEKSKLETYQAKLVSAQIALGSAEKKYKRQAALWKDDATAKEDLESAQD
                     90        100        110        120        130        140

100        110        120        130        140        150
m290.pep   AFAAAKANVAELKALIRQSKISINTAESELGYTRITATMDGTVVAILVEEGQTVNAAQST
           |:||||||||||||||||||||||||||||||||||||||||||||||||||||||||||
a290       ALAAAKANVAELKALIRQSKISINTAESELGYTRITATMDGTVVAILVEEGQTVNAAQST
                    150        160        170        180        190        200

160        170        180        190        200        210
m290.pep   PTIVQLANLDMMLNKMQIAEGDITKVKAGQDISFTILSEPDTPIKAKLDSVDPGLTTMSS
           ||||||||||||||||||||||||||||||||||||||||||||||||||||||||||||
a290       PTIVQLANLDMMLNKMQIAEGDITKVKAGQDISFTILSEPDTPIKAKLDSVDPGLTTMSS
                    210        220        230        240        250        260

220        230        240        250        260        270
m290.pep   GGYNSSTDTASNAVYYYARSFVPNPDGKLATGMTTQNTVEIDGVKNVLIIPSLTVKNRGG
           ||||||||||||||||||||||||||||||||||||||||||||||||||||||||||||
a290       GGYNSSTDTASNAVYYYARSFVPNPDGKLATGMTTQNTVEIDGVKNVLIIPSLTVKNRGG
                    270        280        290        300        310        320

280        290        300        310        320        330
m290.pep   KAFVRVLGADGKAAEREIRTGMRDSMNTEVKSGLKEGDKVVISEITAAEQQESGERALGG
           :|||||||||||||||||||||||||||||||||||||||||||||||||||||||||||
a290       RAFVRVLGADGKAAEREIRTGMRDSMNTEVKSGLKEGDKVVISEITAAEQQESGERALGG
                    330        340        350        360        370        380 m290.pep   PPRRX
           |||||
a290       PPRRX
           390
```

The following partial DNA sequence was identified in *N. gonorrhoeae* <SEQ ID 1217>:

```
g292.seq
   1   atgaaaacca agttaatcaa aatcttgacc cccttaccg tcctgccgct
  51   gctggcttgc gggcaaacgc ccgtttccaa tgccaacgcc gaatccgccg
 101   tcaaagccga atccgccggc aaatccgttg ccgcttcttt gaaagcgcgt
 151   ttggaaaaaa cctattccgc ccaagatttg aaagtgttga gcgtcagcga
 201   aacaccggtc aaaggcattt acgaagtcgt cgtcagcggc aggcagatta
 251   tctacaccga tgccgaaggc ggctatatgt tcgtcggcga actcatcaac
 301   atcgacacgc gcaaaaacct gaccgaagaa cgcgccgccg atttgaacaa
 351   aatcgacttc gcctccctgc ctttggacaa agccatcaaa gaagtacgcg
 401   gcaacggcaa gctgaaagtc gccgtcttct ccgaccccga ttgtccgttc
 451   tgcaaacgct tggaacatga gtttgaaaaa atgaccgacg tgacggttta
 501   cagctttatg atgcccattg ccggcctgca cccagatgcc gcgcgcaagg
 551   cgcaaatctt atggtgtcag cccgaccgtg ccaaagcgtg gacggattgg
 601   atgcgtaaag gcaaattccc ggtcggcggc agcatctgcg acaatcccgt
 651   cgcggaaacc acttccttgg gcgaacagtt cggcttcaac ggcacgccga
 701   cccttcgtct tccccaacgg gcgcacccaa agcggttaca gcccgatgcc
 751   ccaactggag gaaatcatcc gcaaaaacca gcagtaaacc cgcaatga
```

This corresponds to the amino acid sequence <SEQ ID 1218; ORF 292.ng>:

```
g292.pep
   1   MKTKLIKILT PFTVLPLLAC GQTPVSNANA ESAVKAESAG KSVAASLKAR

51   LEKTYSAQDL KVLSVSETPV KGIYEVVVSG RQIIYTDAEG GYMFVGELIN
```

```
-continued
101  IDTRKNLTEE RAADLNKIDF ASLPLDKAIK EVRGNGKLKV AVFSDPDCPF

151  CKRLEHEFEK MTDVTVYSFM MPIAGLHPDA ARKAQILWCQ PDRAKAWTDW

201  MRKGKFPVGG SICDNPVAET TSLGEQFGFN GTPTLRLPQR AHPKRLQPDA

251  PTGGNHPQKP AVNPQ*
```

The following partial DNA sequence was identified in *N. meningitidis* <SEQ ID 1219>:

```
m292.seq
    1  ATGAAAACCA AGTTAATCAA AATCTTGACC CCCTTTACCG TCCTCCCGCT

51  GCTGGCTTGC GGGCAAACGC CCGTTTCCAA TGCCAACGCC GAACCCGCCG

101  TCAAAGCCGA GTCCGCCGGC AAATCCGTTG CCGCCTCTTT GAAAGCGCGT

151  TTGGAAAAAA CCTATTCCGC CCAAGATTTG AAAGTGTTGA GCGTCAGCGA

201  AACACCGGTC AAAGGCATTT ACGAAGTCGT CGTCAGCGGC AGGCAGATTA

251  TCTACACCGA TGCCGAAGGC GGCTATATGT TCGTCGGCGA ACTCATCAAC

301  ATCGACACGC GCAAAAACCT GACCGAAGAA CGCGCCGCCG ATTTGAACAA

351  AATCGACTTC GCCTCCCTGC CTTTGGACAA AGCCATCAAA GAAGTGCGCG

401  GCAACGGCAA GCTGAAAGTC GCCGTCTTCT CCGACCCCGA TTGTCCGTTC

451  TGCAAACGCT TGGAACACGA GTTTGAAAAA ATGACCGACG TGACGGTTTA

501  CAGCTTTATG ATGCCCATTG CCGGCCTGCA CCCCGATGCC GCGCGCAAGG

551  CGCAAATCTT ATGGTGTCAG CCCGACCGCG CCAAAGCGTG GACGGATTGG

601  ATGCGTAAAG GCAAATTCCC GGTCGGCGGC AGCATCTGCG ACAATCCCGT

651  CGCGGAAACC ACTTCCTTGG GCGAACAATT CGGCTTCAAC GGCACGCCGA

701  CCCTCGTCTT CCCCAACGGG CGCAGCCAAA GCGGCTACAG CCCGATGCCC

751  CAACTGGAGG AAATCATCCG CAAAAATCAA TAA
```

This corresponds to the amino acid sequence <SEQ ID 1220; ORF 292>:

```
m292.pep
    1  MKTKLIKILT PFTVLPLLAC GQTPVSNANA EPAVKAESAG KSVAASLKAR

51  LEKTYSAQDL KVLSVSETPV KGIYEVVVSG RQIIYTDAEG GYMFVGELIN

101  IDTRKNLTEE RAADLNKIDF ASLPLDKAIK EVRGNGKLKV AVFSDPDCPF

151  CKRLEHEFEK MTDVTVYSFM MPIAGLHPDA ARKAQILWCQ PDRAKAWTDW

201  MRKGKFPVGG SICDNPVAET TSLGEQFGFN GTPTLVFPNG RSQSGYSPMP

251  QLEEIIRKNQ *
```

Computer analysis of this amino acid sequence gave the following results:
Homology with a Predicted ORF from *N. gonorrhoeae*
m292/g292 98.7% identity in 238 aa overlap

```
                  10         20         30         40         50         60
m292.pep  MKTKLIKILTPFTVLPLLACGQTPVSNANAEPAVKAESAGKSVAASLKARLEKTYSAQDL
          ||||||||||||||||||||||||||||||| ||||||||||||||||||||||||||||
    g292  MKTKLIKILTPFTVLPLLACGQTPVSNANAESAVKAESAGKSVAASLKARLEKTYSAQDL
                  10         20         30         40         50         60
```

-continued

```
                 70         80         90        100        110        120
m292.pep  KVLSVSETPVKGIYEVVVSGRQIIYTDAEGGYMFVGELINIDTRKNLTEERAADLNKIDF
          ||||||||||||||||||||||||||||||||||||||||||||||||||||||||||||
g292      KVLSVSETPVKGIYEVVVSGRQIIYTDAEGGYMFVGELINIDTRKNLTEERAADLNKIDF
                 70         80         90        100        110        120

130        140        150        160        170        180
m292.pep  ASLPLDKAIKEVRGNGKLKVAVFSDPDCPFCKRLEHEFEKMTDVTVYSFMMPIAGLHPDA
          ||||||||||||||||||||||||||||||||||||||||||||||||||||||||||||
g292      ASLPLDKAIKEVRGNGKLKVAVFSDPDCPFCKRLEHEFEKMTDVTVYSFMMPIAGLHPDA
                130        140        150        160        170        180

190        200        210        220        230        240
m292.pep  ARKAQILWCQPDRAKAWTDWMRKGKFPVGGSICDNPVAETTSLGEQFGFNGTPTLVFPNG
          ||||||||||||||||||||||||||||||||||||||||||||||||||||||| :|:
g292      ARKAQILWCQPDRAKAWTDWMRKGKFPVGGSICDNPVAETTSLGEQFGFNGTPTLRLPQR
                190        200        210        220        230        240

250        260
m292.pep  RSQSGYSPMPQLEEIIRKNQX g292      AHPKRLQPDAPTGGNHPQKPAVNPQX
                250        260
```

The following partial DNA sequence was identified in *N. meningitidis* <SEQ ID 1221>:

```
a292.seq
    1   ATGAAAACCA AGTTAATCAA AATCTTGACC CCCTTTACCG TCCTCCCGCT

51   GCTGGCTTGC GGGCAAACGC CCGTTTCCAA TGCCAACGCC GAACCCGCCG

101   TCAAAGCCGA GTCCGCCGGC AAATCCGTTG CCGCCTCTTT GAAAGCGCGT

151   TTGGAAAAAA CCTATTCCGC CCAAGATTTG AAAGTGTTGA GCGTCAGCGA

201   AACACCGGTC AAAGGCATTT ACGAAGTCGT CGTCAGCGGC AGGCAGATTA

251   TCTACACCGA TGCCGAAGGC GGCTATATGT TCGTCGGCGA ACTCATCAAC

301   ATCGACACGC GCAAAAACCT GACCGAAGAA CGCGCCGCCG ATTTGAACAA

351   AATCGACTTC GCCTCCCTGC CTTTGGACAA AGCCATCAAA GAAGTGCGCG

401   GCAACGGCAA GCTGAAAGTC GCCGTCTTCT CCGACCCCGA TTGTCCGTTC

451   TGCAAACGCT TGGAACACGA GTTTGAAAAA ATGACCGACG TGACGGTTTA

501   CAGCTTTATG ATGCCCATTG CCGGCCTGCA CCCCGATGCC GCGCGCAAGG

551   CGCAAATCTT ATGGTGTCAG CCCGACCGCG CCAAAGCGTG GACGGATTGG

601   ATGCGTAAAG GCAAATTCCC GGTCGGCGGC AGCATCTGCG ACAATCCCGT

651   CGCGGAAACC ACTTCCTTGG GCGAACAATT CGGCTTCAAC GGCACGCCGA

701   CCCTCGTCTT CCCCAACGGG CGCAGCCAAA GCGGCTACAG CCCGATGCCC

751   CAACTGGAGG AAATCATCCG CAAAAATCAA TAA
```

This corresponds to the amino acid sequence <SEQ ID 1222; ORF 292.a>:

```
a292.pep
    1   MKTKLIKILT PFTVLPLLAC GQTPVSNANA EPAVKAESAG KSVAASLKAR

51   LEKTYSAQDL KVLSVSETPV KGIYEVVVSG RQIIYTDAEG GYMFVGELIN

101   IDTRKNLTEE RAADLNKIDF ASLPLDKAIK EVRGNGKLKV AVFSDPDCPF

151   CKRLEHEFEK MTDVTVYSFM MPIAGLHPDA ARKAQILWCQ PDRAKAWTDW

201   MRKGKFPVGG SICDNPVAET TSLGEQFGFN GTPTLVFPNG RSQSGYSPMP

251   QLEEIIRKNQ *
``` m292/a292 100.0% identity in 260 aa overlap

```
                   10         20         30         40         50         60
   m292.pep  MKTKLIKILTPFTVLPLLACGQTPVSNANAEPAVKAESAGKSVAASLKARLEKTYSAQDL
             ||||||||||||||||||||||||||||||||||||||||||||||||||||||||||||
   a292      MKTKLIKILTPFTVLPLLACGQTPVSNANAEPAVKAESAGKSVAASLKARLEKTYSAQDL
                   10         20         30         40         50         60

70         80         90        100        110        120
   m292.pep  KVLSVSETPVKGIYEVVVSGRQIIYTDAEGGYMFVGELINIDTRKNLTEERAADLNKIDF
             ||||||||||||||||||||||||||||||||||||||||||||||||||||||||||||
   a292      KVLSVSETPVKGIYEVVVSGRQIIYTDAEGGYMFVGELINIDTRKNLTEERAADLNKIDF
                   70         80         90        100        110        120

130        140        150        160        170        180
   m292.pep  ASLPLDKAIKEVRGNGKLKVAVFSDPDCPFCKRLEHEFEKMTDVTVYSFMMPIAGLHPDA
             ||||||||||||||||||||||||||||||||||||||||||||||||||||||||||||
   a292      ASLPLDKAIKEVRGNGKLKVAVFSDPDCPFCKRLEHEFEKMTDVTVYSFMMPIAGLHPDA
                  130        140        150        160        170        180

190        200        210        220        230        240
   m292.pep  ARKAQILWCQPDRAKAWTDWMRKGKFPVGGSICDNPVAETTSLGEQFGFNGTPTLVFPNG
             ||||||||||||||||||||||||||||||||||||||||||||||||||||||||||||
   a292      ARKAQILWCQPDRAKAWTDWMRKGKFPVGGSICDNPVAETTSLGEQFGFNGTPTLVFPNG
                  190        200        210        220        230        240

250        260
   m292.pep  RSQSGYSPMPQLEEIIRKNQX
             |||||||||||||||||||||
   a292      RSQSGYSPMPQLEEIIRKNQX
                  250        260
```

The following partial DNA sequence was identified in *N. gonorrhoeae* <SEQ ID 1223>:

```
g294.seq (partial)
    1  atgcgtatta cctgtgcgcc gatgtcgctt ttgtcggcgg cagtctggtc
   51  ggttcgggct gtcagaacat catcgaaccg ctttcctgcg gcgttacgac
  101  gatattcggc ttttcgacct acaattttc cgaagcctgc cggcacgcct
  151  tggcatcggg tgcggcggtt caagtcgaat cggcggacgc gtggcgtgaa
  201  gccgttgaaa aaaccttatc tggcgagggg ggcggaatgc agatgcaggc
  251  gcgcgtggac ggctttatcg cacaacatcg cggagcgggc gcgagaatcg
  301  ccgaggcggt gcgggaagcg gtatgcggac atcgggggcg atagtgatac
  351  aatccgtatc cgagttttcc ggttggagca tcgtatgagt atttatgccg
  401  tcgcgcacat catccacctg tattgcgcca ccgcctttgt cggcggcgtg
  451  tttttttgaag tgctggtttt gtccgtcctg catacgggac gggtgtcgcg
  501  cgaggcgcgg cgcgaagtgg aaaaggcaat gtcttaccgc gccgtcaggg
  551  tgatgccgtt tgcggtcgga ctgctgttcg ccaggggaac tctagagtcg
  601  actgcagcag catgccctc...
```

This corresponds to the amino acid sequence <SEQ ID 1224; ORF 294.ng>:

```
g294.pep (partial)
    1  MRITCAPMSL LSAAVWSVRA VRTSSNRFPA ALRRYSAFRP TIFPKPAGTP
   51  WHRVRRFKSN RRTRGVKPLK KPYLARGAEC RCRRAWTALS HNIAERARES
  101  PRRCGKRYAD IGGDSDTIRI RVFRLEHRMS IYAVAHIIHL YCATAFVGGV
  151  FFEVLVLSVL HTGRVSREAR REVEKAMSYR AVRVMPFAVG LLFARGTLES
  201  TAAACP....
```

The following partial DNA sequence was identified in *N. meningitidis* <SEQ ID 1225>:

m294.seq
```
  1  ATGCGTATTA CCTGTGCGCC GATGTCGCTT TTGTCGGCGG CAGTCTGGTC
 51  GATTCGGGTT GTCAGAACAT CATCGAACCG CTTTCCTGCG GCGTTCCGAC
101  GATATTCGGC TTTTCAACCT ACAATTTTTC CGAAGCCTGC CGACACGCCT
151  TGGCATCGGG TGCGGCGGTT CAAGTCGAAT CGGCGGATGC GTGGCGGGAA
201  GCCGTTGAAA AAACCTTATC GTCCGAGGGG GGGGGGATGC AGATGCAGGC
251  GCGCGTGGAC GGCTTTATCG CACAACATCG CGGAGCGGGC GCGAGAATCG
301  CCGAGGCGGT GCGGGAAGCG GTATGCGGAT ATCGGGGGCG ATAGTGATAC
351  AATCCGTATC CGAGTTTTCC GTTTGGAGCA TCGTATGAGT ATTTATGCCG
401  TCGCGCACAT CGTTCATCTG TATTGCGCTA TTGCCTTTGT CGGCGGCGTG
451  TTTTTTGAAG TGCTGGTTTT GTCCGTCCTG CATACGGGAC GGGTGTCGCG
501  CGAGGCGCGG CGCGAAGTGG AAAAGGCAAT GTCTTACCGC GCCGTCAGGG
551  TGATGCCGTT TGTGGTCGGA CTGCTGTTCG CCAGCGGCAT CGTGATGGCG
601  GCAAACCGCT ATCTTTCTAT ATTGGGCGAA CCGTTTGCCA CTTCCTTCGG
651  TACGATGCTG ACGCTGAAAA TCCTGTTGGC GTTCAGCGTA TTGGCGCACT
701  TCGCCATCGC CGTCGTCAAA ATGGCGCGTT CCACACTGAC GGTCGGTTGG
751  TCGAAATACA TACACGCCGT CGTCTTTACC CATATGcTGC TGATTGTCTT
801  TTTGGCAAAA GCGATGTTTT ATATCAGCTG GTAA
```

This corresponds to the amino acid sequence <SEQ ID 1226; ORF 294>:

m294.pep
```
  1  MRITCAPMSL LSAAVWSIRV VRTSSNRFPA AFRRYSAFQP TIFPKPADTP
 51  WHRVRRFKSN RRMRGGKPLK KPYRPRGGGC RCRRAWTALS HNIAERARES
101  PRRCGKRYAD IGGDSDTIRI RVFRLEHRMS IYAVAHIVHL YCAIAFVGGV
151  FFEVLVLSVL HTGRVSREAR REVEKAMSYR AVRVMPFVVG LLFASGIVMA
201  ANRYLSILGE PFATSFGTML TLKILLAFSV LAHFAIAVVK MARSTLTVGW
251  SKYIHAVVFT HMLLIVFLAK AMFYISW*
``` g294/m294 92.3% identity in 196 aa overlap

```
                 10         20         30         40         50         60
g294.pep  MRITCAPMSLLSAAVWSVRAVRTSSNRFPAALRRYSAFRPTIFPKPAGTPWHRVRRFKSN
          ||||||||||||||||| :|:||||||||||:|||||:||||||| ||||||||||||||
m294      MRITCAPMSLLSAAVWSIRVVRTSSNRFPAAFRRYSAFQPTIFPKPADTPWHRVRRFKSN
                 10         20         30         40         50         60

70         80         90        100        110        120
g294.pep  RRTRGVKPLKKPYLARGAECRCRRAWTALSHNIAERARESPRRCGKRYADIGGDSDTIRI
          ||  || |||||||| ||: |||||||||||||||||||||||||||||||||||||||
m294      RRMRGGKPLKKPYRPRGGGCRCRRAWTALSHNIAERARESPRRCGKRYADIGGDSDTIRI
                 70         80         90        100        110        120

130        140        150        160        170        180
g294.pep  RVFRLEHRMSIYAVAHIIHLYCATAFVGGVFFEVLVLSVLHTGRVSREARREVEKAMSYR
          |||||||||||||||||:|||||:|||||||||||||||||||||||||||||||||||
m294      RVFRLEHRMSIYAVAHIVHLYCAIAFVGGVFFEVLVLSVLHTGRVSREARREVEKAMSYR
                130        140        150        160        170        180

190        200
g294.pep  AVRVMPFAVGLLFARGTLESTAAACP
          |||||||:||||||: ||||||| |
m294      AVRVMPFVVGLLFASGIVMAANRYLSILGEPFATSFGTMLTLKILLAFSVLAHFAIAVVK
                190        200        210        220        230        240
```

The following partial DNA sequence was identified in *N. meningitidis* <SEQ ID 1227>:

```
a294.seq
     1   ATGCGTATTA CCTGTGCGCC GATGTCGCTT TTGTCGGCGG CAGTCTGGTC

51   GATTCGGGCT GTCAGAACAT CATCGAACCG CTTTCCTGCG GCGTTCCGAC

101   GATATTCGGC TTTTCGACCT ACAATTTTTC CGAAGCCTGC CGGCACGCCT

151   TGGCATCGGG TGCGGCGGTT CAAGTCGAAT CGGCGGACGC GTGGCGGGAA

201   GCCGTTGAAA AAAACTTATC GTCCGAGGAG GGCGGAATGC AGATGCAGGC

251   GCGCGCGGAC GGCTTTATCG CACAACATCG CGGAGCGGGC GCGAGAATCG

301   CCGAGGCGGT ACGGGAAGCG GTATGCGGAC ATCGGGGACG ATAGTGATAC

351   AATCCGTATC CGAGTTTTCC GGTTGGAGTA CCGTATGAGT ATTTATGCCG

401   TCGCGCACAT CGTCCACCTG TATTGCGCCA TCGCCTTTGT CGGCGGCGTG

451   TTTTTTGAAG TGCTGGTTTT GTCCGTCCTG CATACGGGAC GGGTGTCGTG

501   CGAGGCGCGG CGCGAAGTGG AAAAGGCAAT GTCTTACCGC GCCGTCAGGG

551   TGATGCCGTT TGTGGTCGGA CTGCTGTTCG CCAGCGGCAT CGTGATGGCG

601   GCAAACCGCT ATCTTTCTAT ATTGGGCGAA CCGTTTGCCA CTTCCTTCGG

651   TACGATGCTG ACGCTGAAAA TCCTGTTGGC GTTCAGCGTG TTGGCGCACT

701   TCGCCATCGC CGTCGTCAAA ATGGCGCGTT CCACACTGAC CGTCGGCTGG

751   TCGAAATACA TACACACCGT CGTCTTTACC CATATGCTGC TGATTGTCTT

801   TTTGGCAAAA GCGATGTTTT ATATCAGCTG GTAA
```

This corresponds to the amino acid sequence <SEQ ID 1228; ORF 294.a>:

```
a294.pep
     1   MRITCAPMSL LSAAVWSIRA VRTSSNRFPA AFRRYSAFRP TIFPKPAGTP

51   WHRVRRFKSN RRTRGGKPLK KTYRPRRAEC RCRRARTALS HNIAERARES

101   PRRYGKRYAD IGDDSDTIRI RVFRLEYRMS IYAVAHIVHL YCAIAFVGGV

151   FFEVLVLSVL HTGRVSCEAR REVEKAMSYR AVRVMPFVVG LLFASGIVMA

201   ANRYLSILGE PFATSFGTML TLKILLAFSV LAHFAIAVVK MARSTLTVGW

251   SKYIHTVVFT HMLLIVFLAK AMFYISW*
``` m294/a294 94.9% identity in 277 aa overlap

```
                    10        20        30        40        50        60
m294.pep    MRITCAPMSLLSAAVWSIRVVRTSSNRFPAAFRRYSAFQPTIFPKPADTPWHRVRRFKSN
            |||||||||||||||||||:||||||||||||||||||| :|||||| |||||||||||||
a294        MRITCAPMSLLSAAVWSIRAVRTSSNRFPAAFRRYSAFRPTIFPKPAGTPWHRVRRFKSN
                    10        20        30        40        50        60

70        80        90       100       110       120
m294.pep    RRMRGGKPLKKPYRPRGGGCRCRRAWTALSHNIAERARESPRRCGKRYADIGGDSDTIRI
            || |||||||| |||| : |||||| ||||||||||||||||| |||||||| |||||||
a294        RRTRGGKPLKKTYRPRRAECRCRRARTALSHNIAERARESPRRYGKRYADIGDDSDTIRI
                    70        80        90       100       110       120

130       140       150       160       170       180
m294.pep    RVFRLEHRMSIYAVAHIVHLYCAIAFVGGVFFEVLVLSVLHTGRVSREARREVEKAMSYR
            ||||||:|||||||||||||||||||||||||||||||||||| ||||||||||||||||
a294        RVFRLEYRMSIYAVAHIVHLYCAIAFVGGVFFEVLVLSVLHTGRVSCEARREVEKAMSYR
                   130       140       150       160       170       180

190       200       210       220       230       240
m294.pep    AVRVMPFVVGLLFASGIVMAANRYLSILGEPFATSFGTMLTLKILLAFSVLAHFAIAVVK
            ||||||||||||||||||||||||||||||||||||||||||||||||||||||||||||
a294        AVRVMPFVVGLLFASGIVMAANRYLSILGEPFATSFGTMLTLKILLAFSVLAHFAIAVVK
                   190       200       210       220       230       240
```

-continued

```
               250         260        270
m294.pep  MARSTLTVGWSKYIHAVVFTHMLLIVFLAKAMFYISWX
          ||||||||||||||:|||||||||||||||||||||||
a294      MARSTLTVGWSKYIHTVVFTHMLLIVFLAKAMFYISWX
               250         260        270
```

The following partial DNA sequence was identified in *N. gonorrhoeae* <SEQ ID 1229>:

```
g295.seq
    1   atgctcggga tggcgcggca cgacggccag cagggcatcg ccgcgatatt
   51   gttgccacgc cgccagcagt ttttccgcct cgtcttcgcc ccgataaacg
  101   cgcgtgctgc cgcacacggc aaccggccgg cctccgatgc gttttttcaaa
  151   ctgccccgcc agcgttttca tgtcttcaga cggcatcagg tcgtatttgg
  201   tattgccgca cacctgcacg gatgccgcgc ccaatttcgc caaccgcgcc
  251   gcatccgcct ccgtctgcgc cagacagccc gtcagcgaag cggctgcggg
  301   acggatcagg cggcggactt tcagataacc gttcagcgat ttttccgaca
  351   gccgcgcatt cgccaaaaac agcggcacac ccgctcgccg gcattccttc
  401   atcagattgg gccagatttc ggtttccatc aaaatgccga acatcgggcg
  451   gtgttcgcgc aaaaactgcc gtacccacgt ttttttgtca tacggaagat
  501   agcggcattg cgcatcggga aacagaactt gcgcggtttc ccgtcccgtc
  551   ggggtcatct gcgtcatcag cagcggcgca tcgggaaaac gccgccgcaa
  601   ctcgcgtatc aagggctggg cggcacgcgt ttctccgacc gaaacggcgt
  651   gtatccaaac cgcgccggta acgggattcg gatgcggctt gccgaaacgc
  701   tcgtccctat gcgcccggta tgccggggca cttccggagc gtttgtccaa
  751   ataacgccgt atccatatcg gcgcaagcag ccacaataca tcataaagcc
  801   attggaacat ctttctattt cctgcaaaac aaatgccgtc gaacggttc
  851   ggacggcatt tcggcaacgg aatcaaatat cgtag
```

This corresponds to the amino acid sequence <SEQ ID 1230; ORF 295.ng>:

```
g295.pep
    1   MLGMARHDGQ QGIAAILLPR RQQFFRLVFA PINARAAAHG NRPASDAFFK
   51   LPRQRFHVFR RHQVVFGIAA HLHGCRAQFR QPRRIRLRLR QTARQRSGCG
  101   TDQAADFQIT VQRFFRQPRI RQKQRHTRSP AFLHQIGPDF GFHQNAEHRA
  151   VFAQKLPYPR FFVIRKIAAL RIGKQNLRGF PSRRGHLRHQ QRRIGKTPPQ
  201   LAYQGLGGTR FSDRNGVYPN RAGNGIRMRL AETLVPMRPV CRGTSGAFVQ
  251   ITPYPYRRKQ PQYIIKPLEH LSISCKTNAV RTVRTAFRQR NQIS*
```

The following partial DNA sequence was identified in *N. meningitidis* <SEQ ID 1231>:

```
m295.seq
    1   ATGCTCGGGA TGGCGCGGCA CGACGACCAG CAGCGCATCG CCGCGATATT
   51   GTTGCCACGC CGCCAGCAGT TTTTCCGCCT CGTCTTCACC CCGATAAACG
  101   CGCGTGCTGC CGCACACGGC AACCGGCCGG CCTCCGATGC GTTTTTCAAA
  151   CTGCCCCGCC AGCGTTTTCA TCTGTTCCGA CGGTATGATG TCGTATTTGG
```

-continued

```
 201  TATTGCCGCA CACCTGCACG GATGCCGCGC CCAATTTCGC CAACCGCGCC

251  GCATCCGCCT CTGTCTGCGC CAGACACCCC GTCAGCGAAG CGGCGGCAGG

301  ACGGATCAGG CGGCGGACTT TCAGATAACC GTTCAACGAT TTTTCCGACA

351  GCCGCGCATT CGCCAAAAAC AGCGGCACAC CCGCGCGCCG GCATTCCCTC

401  ATCAGGTTGG GCCAGATTTC GGTTTCCATC AAAATGCCGA ACATCGGGCG

451  GTGTTCGCGC AAAAACTGCC GTACCCACGT TTTTTTGTCA TACGGAAGAT

501  AGCGGCATTG CGCATCGGGA ACAGAACTT GCGCGGTTTC CCGCCCCGTC

551  GGGGTCATCT GCGTCATCAG CAGCGGCGCA TCGGGAAAAC GCCGCCGCAA

601  CTCGCGTATC AAGGACTGGG CGGCACGCGT TTCTCCGACC GAAACGGCGT

651  GTATCCAAAC CGCGCCGGTA ACGGGATTCG GATACGGCTT GCCGAAACGC

701  TCGTCCCGAT GCGCCCGATA TGCCGGGGCA CTTCCGGAGC GTTTGTCCAA

751  ATAACGCCGT ATCCATATCG GCGCAAGCAG CCACAATACA TCATAAAGCC

801  ATTGGAACAT CTTTCTATTT CCTGCAAAAC AAATGCCGTC TGAACGGTTC

851  AGACGGCATT TCGGCAACGG AATCAAATAT CGTAG
```

This corresponds to the amino acid sequence <SEQ ID 1232; ORF 295>:

```
m295.pep
     1   MLGMARHDDQ QRIAAILLPR RQQFFRLVFT PINARAAAHG NRPASDAFFK

51   LPRQRFHLFR RYDVVFGIAA HLHGCRAQFR QPRRIRLCLR QTPRQRSGGR

101   TDQAADFQIT VQRFFRQPRI RQKQRHTRAP AFPHQVGPDF GFHQNAEHRA

151   VFAQKLPYPR FFVIRKIAAL RIGKQNLRGF PPRRGHLRHQ QRRIGKTPPQ

201   LAYQGLGGTR FSDRNGVYPN RAGNGIRIRL AETLVPMRPI CRGTSGAFVQ

251   ITPYPYRRKQ PQYIIKPLEH LSISCKTNAV XTVQTAFRQR NQIS*
``` m295/g295 93.9% identity in 294 aa overlap

```
                  10         20         30         40         50         60
m295.pep  MLGMARHDDQQRIAAILLPRRQQFFRLVFTPINARAAAHGNRPASDAFFKLPRQRFHLFR
          |||||||| ||  |||||||||||||||||||:||||||||||||||||||||||||:||
g295      MLGMARHDGQQGIAAILLPRRQQFFRLVFAPINARAAAHGNRPASDAFFKLPRQRFHVFR
                  10         20         30         40         50         60

70         80         90        100        110        120
m295.pep  RYDVVFGIAAHLHGCRAQFRQPRRIRLCLRQTPRQRSGGRTDQAADFQITVQRFFRQPRI
          |::|||||||||||||||||||||||||||| ||||   || |||||||||||||||||
g295      RHQVVFGIAAHLHGCRAQFRQPRRIRLRLRQTARQRSGCGTDQAADFQITVQRFFRQPRI
                  70         80         90        100        110        120

130        140        150        160        170        180
m295.pep  RQKQRHTRAPAFPHQVGPDFGFHQNAEHRAVFAQKLPYPRFFVIRKIAALRIGKQNLRGF
          ||||||||| ||| ||:||||||||||||||||||||||||||||||||||||||||||
g295      RQKQRHTRSPAFLHQIGPDFGFHQNAEHRAVFAQKLPYPRFFVIRKIAALRIGKQNLRGF
                 130        140        150        160        170        180

190        200        210        220        230        240
m295.pep  PPRRGHLRHQQRRIGKTPPQLAYQGLGGTRFSDRNGVYPNRAGNGIRIRLAETLVPMRPI
          | |||||||||||||||||||||||||||||||||||||||||||||:|||||||||||:
g295      PSRRGHLRHQQRRIGKTPPQLAYQGLGGTRFSDRNGVYPNRAGNGIRMRLAETLVPMRPV
                 190        200        210        220        230        240

250        260        270        280        290
m295.pep  CRGTSGAFVQITPYPYRRKQPQYIIKPLEHLSISCKTNAVXTVQTAFRQRNQISX
          |||||||||||||||||||||||||||||||||||||||:|||:||||||||||
g295      CRGTSGAFVQITPYPYRRKQPQYIIKPLEHLSISCKTNAVRTVRTAFRQRNQIS
                 250        260        270        280        290
```

The following partial DNA sequence was identified in N. meningitidis <SEQ ID 1233>:

```
a295.seq
    1  ATGCTCGGGA TGGCGCGGCA CGACGACCAG CAGGGCATCG CCGCGATATT
   51  GTTGCCACGC CGCCAGCAGT TTTTCCGCCT CGTCTTCACC CCGATAAACG
  101  CGCGTGCTGC CGCACACGGC AACCTGCCGG TCTCCGATGC GTTTTTCAAA
  151  CTGCCCCGCC AGCGTTTTCA TCTGTTCCGA CGGCATCAGG TCGTATTTGG
  201  TATTGCCGCA CACCTGCACG GATGCCGCGC CCAATTTCGC CAACCGCGCC
  251  GCATCCGCCT CCGTCTGTGC CAGACAGCCC GTCAGCGAAG CGGCGGCAGG
  301  ACGGATCAGG CTGCGGACTT TCAGATAACC GTTTAGCGAT TTTTCCGACA
  351  GCCGCGCATT CGCCAAAAAC AGCGGCACAC CCGTGCGCCG GCATTCCTTC
  401  ATCAGATTGG GCCAGATTTC GGTTTCCATC AAAATGCCGA ACATCGGGCG
  451  GTGTTCGCGC AAAAACTGCC GTACCCACGT TTTTTTGTCA TACGGAAGAT
  501  AGCGGCATTG TGCATCAGGA ACAGAACTT GCGCGGTTTC CCGTCCCGTC
  551  GGGGTCATCT GCGTCATCAG CAGCGGCGCA TCGGGAAAAC GCTGCCGCAA
  601  CTCGCGTATC AAAGGTTGGG CGGCACGCGT TTCCCCGACC GAAACGGCGT
  651  GTATCCAAAC CGCGCCGGTA ACGGGATTCG GATACGGCTT GCCGAAACGC
  701  TCGCCCCGAT GCGCCCGATA TGCAGGGGCA CTTCCGGAGC GTTTGTCCAA
  751  ATAACGCCGT ATCCATATCG GCGCAAGCAG CCACAATACA TCATAAAGCC
  801  ATTGGAACAT CTTTCTATTT CCTGCAAAAC AAATGCCGTC CGAACGGTTC
  851  GGACGGCATT TCGGCAACGG AATCAAATAT CGTAG
```

This corresponds to the amino acid sequence <SEQ ID 1234; ORF 295.a>:

```
a295.pep
    1  MLGMARHDDQ QGIAAILLPR RQQFFRLVFT PINARAAAHG NLPVSDAFFK
   51  LPRQRFHLFR RHQVVFGIAA HLHGCRAQFR QPRRIRLRLC QTARQRSGGR
  101  TDQAADFQIT V*RFFRQPRI RQKQRHTRAP AFLHQIGPDF GFHQNAEHRA
  151  VFAQKLPYPR FFVIRKIAAL CIRKQNLRGF PSRRGHLRHQ QRRIGKTLPQ
  201  LAYQRLGGTR FPDRNGVYPN RAGNGIRIRL AETLAPMRPI CRGTSGAFVQ
  251  ITPYPYRRKQ PQYIIKPLEH LSISCKTNAV RTVRTAFRQR NQIS*
``` m295/a295 93.2% identity in 294 aa overlap

```
                10         20         30         40         50         60
   m295.pep  MLGMARHDDQQRIAAILLPRRQQFFRLVFTPINARAAAHGNRPASDAFFKLPRQRFHLFR
             ||||||||||:|||||||||||||||||||||||||||||:||||||||||||||||||
       a295  MLGMARHDDQQGIAAILLPRRQQFFRLVFTPINARAAAHGNLPVSDAFFKLPRQRFHLFR
                10         20         30         40         50         60

70         80         90        100        110        120
   m295.pep  RYDVVFGIAAHLHGCRAQFRQPRRIRLCLRQTPRQRSGGRTDQAADFQITVQRFFRQPRI
             |::|||||||||||||||||||||||||| || |||||||||||||||||:|||||||
       a295  RHQVVFGIAAHLHGCRAQFRQPRRIRLRLCQTARQRSGGRTDQAADFQITVXRFFRQPRI
                70         80         90        100        110        120

130        140        150        160        170        180
   m295.pep  RQKQRHTRAPAFPHQVGPDFGFHQNAEHRAVFAQKLPYPRFFVIRKIAALRIGKQNLRGF
             |||||||||||| ::|||||||||||||||||||||||||||||||||| |||||||||
       a295  RQKQRHTRAPAFLHQIGPDFGFHQNAEHRAVFAQKLPYPRFFVIRKIAALCIRKQNLRGF
               130        140        150        160        170        180

190        200        210        220        230        240
   m295.pep  PPRRGHLRHQQRRIGKTPPQLAYQGLGGTRFSDRNGVYPNRAGNGIRIRLAETLVPMRPI
             | |||||||||||||||| ||||| ||||||| :||||||||||||||||||||||:|||||
       a295  PSRRGHLRHQQRRIGKTLPQLAYQRLGGTRFPDRNGVYPNRAGNGIRIRLAETLAPMRPI
               190        200        210        220        230        240
```

```
                      250        260        270        280        290
m295.pep    CRGTSGAFVQITPYPYRRKQPQYIIKPLEHLSISCKTNAVXTVQTAFRQRNQISX
            |||||||||||||||||||||||||||||||||||||| :||||||||||||||
a295        CRGTSGAFVQITPYPYRRKQPQYIIKPLEHLSISCKTNAVRTVRTAFRQRNQISX
                      250        260        270        280        290
```

The following partial DNA sequence was identified in *N. gonorrhoeae* <SEQ ID 1235>:

```
g297.seq
   1    ATGGCTGTCT TCCCACTTTC GGCAAAACAT CGGAAATACG CGCTGCGCGC
  51    GCTTGCCGTT TCGATTATTC TGGTGtcgGC GGCATACATT GCttcgacag
 101    aggggaccga gcgcgtcaga ccgcAGCGCG TggaacaaAA ACTGCCGCCG
 151    CTGTCtTGGg gcggcaacgg CGTtcagacg gcaTATTGGG TGCAGGAGGC
 201    GGTGCagccg ggggactcgC TGGCGGACGT GCTGGCGCGT TCGGGTATGG
 251    CGCGGGacga gattgCCcga ATcacGGAAA aataTggcgG CGAAGCCGAT
 301    TTGCGgcatt tGCGTGCCGA CCAGTCGGTT CATGTTTTGG TCGGCGGCGA
 351    CGGCAGTGCG CGCGAAGTGC AGTTTTttaC CGACGAAGAC GGCGAGCGCA
 401    aTctGGTCGC TTTGGAAAAA AAGGCGGCA TATGGCGGCG GTCGGCTTCT
 451    GATGCGGATA TGAAGGTTTT GCCGACACTG CGTTCGGTCG TGGTCAAAAC
 501    GTCGGCGCGC GGTTCGCTGG CGCGGGCGGA AGTGCCCGTC GAAATCCGCG
 551    AATCCTTAAG CGGGATTTTT GCCGGCCGCT TCAGCCTTGA CGGTTTGAAG
 601    GAAGGCGATG CCGTGCGCCT GCTTTACGAC AGCCTGTATT CCACGGGCA
 651    GCAGGTGGCG GCGGGCGATA TTTTGGCGGC GGAAGTTGTC AAGGGCGGCA
 701    CAACCCATCA GGCGTTCTAT TACCGTTCGG ACAAGGAAGG CGGAGGGGGC
 751    GGCAATTATT ACGATGAAGA CGGCAGGGTG TTGCAGGAAA AAGGCGGCTT
 801    CAACATCgaG CCGCTGGTCT ATACGCGCAT TTCTTCGCCG TTCGGCTACC
 851    GTATGCACCC CATCCTGCAC ACATGGCGGC TGCACACGGG CATCGATTAT
 901    GCCGCACCGC AGGGAACGCC GGTCAGGGCT TCCGCCGACG GCGTGATTAC
 951    CTTTAAAGGC CGGAAGGGCG GATACGGCAA CGCGGTGATG ATACGCCACG
1001    CCAACGGTGT GGAAACGCTG TACGCGCACT TGAGCGCGTT TTCGCAGGCA
1051    CAAGGCAATG TGCGCGGCGG CGAGGTCATC GGTTTTGTCG GTTCGACAGG
1101    GCGTTCGACC GGGCCGCACC TGCATTACGA GGCGCGCATC AACGGGCAGC
1151    CCGTCAATCC TGTTTCGGTC GCATTGCCGA CACCCGAATT GACGCAGGCG
1201    GACAAGGCGG CGTTTGCCGC GCAGAAACAG AAGGCGGACG CGCTGCTTGC
1251    GCGCTTGCGC GGCATACCGG TTACCGTGTC GCAATCGGAT TGA
```

This corresponds to the amino acid sequence <SEQ ID 1236; ORF 297.ng>:

```
g297.pep
   1    MAVFPLSAKH RKYALRALAV SIILVSAAYI ASTEGTERVR PQRVEQKLPP
  51    LSWGGNGVQT AYWVQEAVQP GDSLADVLAR SGMARDEIAR ITEKYGGEAD
 101    LRHLRADQSV HVLVGGDGSA REVQFFTDED GERNLVALEK KGGIWRRSAS
 151    DADMKVLPTL RSVVVKTSAR GSLARAEVPV EIRESLSGIF AGRFSLDGLK
 201    EGDAVRLLYD SLYFHGQQVA AGDILAAEVV KGGTTHQAFY YRSDKEGGGG
```

-continued

```
 251  GNYYDEDGRV LQEKGGFNIE PLVYTRISSP FGYRMHPILH TWRLHTGIDY

301  AAPQGTPVRA SADGVITFKG RKGGYGNAVM IRHANGVETL YAHLSAFSQA

351  QGNVRGGEVI GFVGSTGRST GPHLHYEARI NGQPVNPVSV ALPTPELTQA

401  DKAAFAAQKQ KADALLARLR GIPVTVSQSD *
```

The following partial DNA sequence was identified in *N. meningitidis* <SEQ ID 1237>:

```
m297.seq
    1  ATGGCTGTCT TCCCACTTTC GGCAAAACAT CGGAAATACG CGCTGCGTGC

51  GCTTGCCGTT TCGATTATTT TGGTGTCGGC GGCATACATT GCTTCGACAG

101  AGAGGACGGA GCGCGTCAGA CCGCAGCGCG TGGAACAAAA TCTGCCGCCG

151  CTGTCTTGGG GCGGCAGCGG CGTTCAGACG GCATATTGGG TGCAGGAGGC

201  GGTGCAGCCG GGCGACTCGC TGGCGGACGT GCTGGCGCGT TCGGGTATGG

251  CGCGGGACGA GATTGCCCGA ATCACGGAAA AATATGGCGG CGAAGCCGAT

301  TTGCGGCATT TGCGTGCCGA CCAGTCGGTT CATGTTTTGG TCGGCGGCGA

351  CGGCGGCGCG CGCGAAGTGC AGTTTTTTAC CGACGAAGAC GGCGAGCGCA

401  ATCTGGTCGC TTTGGAAAAG AAAGGCGGCA TATGGCGGCG GTCGGCTTCT

451  GAGGCGGATA TGAAGGTTTT GCCGACGCTG CGTTCGGTCG TGGTCAAAAC

501  GTCGGCGCGC GGTTCGCTGG CGCGGGCGGA AGTGCCCGTC GAAATCCGCG

551  AATCCTTAAG CGGGATTTTC GCCGGCCGCT TCAGCCTTGA CGGTTTGAAG

601  GAAGGCGATG CCGTGCGCCT GATGTACGAC AGCCTGTATT CCACGGGCA

651  GCAGGTGGCG GCGGGCGATA TTTTGGCGGC TGAAGTCGTT AAGGGCGGCA

701  CAAGGCATCA GGCGTTCTAT TACCGTTCGG ACAAGGAAGG CGGAGGGGGC

751  GGCAATTATT ATGATGAAGA CGGCAAGGTG TTGCAGGAAA AAGGCGGCTT

801  CAACATCGAG CCGCTGGTCT ATACGCGCAT TCCTTCGCCG TTCGGCTACC

851  GTATGCACCC CATCCTGCAC ACATGGCGGC TGCACACGGG CATCGATTAT

901  GCCGCACCGC AGGGAACGCC GGTCAGGGCT TCCGCCGACG GCGTGATTAC

951  CTTTAAAGGC CGGAAGGGCG GATACGGCAA CGCGGTGATG ATACGCCACG

1001  CCAACGGTGT GGAAACGCTG TACGCGCACT TGAGCGCGTT TTCGCAGGCG

1051  GAAGGCAATG TGCGCGGCGG CGAGGTCATC GGTTTTGTCG GTTCGACCGG

1101  GCGTTCGACC GGGCCGCACC TGCATTACGA GGCGCGCATC AACGGGCAGC

1151  CCGTCAATCC TGTTTCGGTC GCATTGCCGA CACCGGAATT GACGCAGGCG

1201  GACAAGGCGG CGTTTGCCGC GCAGAAACAG AAGGCGGACG CGCTGCTTGC

1251  GCGCTTGCGC GGCATACCGG TTACCGTGTC GCAATCGGAT TGA
```

This corresponds to the amino acid sequence <SEQ ID 1238; ORF 297>:

```
m297.pep
    1  MAVFPLSAKH RKYALRALAV SIILVSAAYI ASTERTERVR PQRVEQNLPP

51  LSWGGSGVQT AYWVQEAVQP GDSLADVLAR SGMARDEIAR ITEKYGGEAD

101  LRHLRADQSV HVLVGGDGGA REVQFFTDED GERNLVALEK KGGIWRRSAS

151  EADMKVLPTL RSVVVKTSAR GSLARAEVPV EIRESLSGIF AGRFSLDGLK
```

```
-continued

201   EGDAVRLMYD  SLYFHGQQVA  AGDILAAEVV  KGGTRHQAFY  YRSDKEGGGG

251   GNYYDEDGKV  LQEKGGFNIE  PLVYTRISSP  FGYRMHPILH  TWRLHTGIDY

301   AAPQGTPVRA  SADGVITFKG  RKGGYGNAVM  IRHANGVETL  YAHLSAFSQA

351   EGNVRGGEVI  GFVGSTGRST  GPHLHYEARI  NGQPVNPVSV  ALPTPELTQA

401   DKAAFAAQKQ  KADALLARLR  GIPVTVSQSD  *
``` m297/g297 97.9% identity in 430 aa overlap

```
                 10         20         30         40         50         60
m297.pep  MAVFPLSAKHRKYALRALAVSIILVSAAYIASTERTERVRPQRVEQNLPPLSWGGSGVQT
          ||||||||||||||||||||||||||||||||||||| ||||||||||:||||||:||||
g297      MAVFPLSAKHRKYALRALAVSIILVSAAYIASTEGTERVRPQRVEQKLPPLSWGGNGVQT
                 10         20         30         40         50         60

70         80         90        100        110        120
m297.pep  AYWVQEAVQPGDSLADVLARSGMARDEIARITEKYGGEADLRHLRADQSVHVLVGGDGGA
          |||||||||||||||||||||||||||||||||||||||||||||||||||||||||:|
g297      AYWVQEAVQPGDSLADVLARSGMARDEIARITEKYGGEADLRHLRADQSVHVLVGGDGSA
                 70         80         90        100        110        120

130        140        150        160        170        180
m297.pep  REVQFFTDEDGERNLVALEKKGGIWRRSASEADMKVLPTLRSVVVKTSARGSLARAEVPV
          |||||||||||||||||||||||||||||||:||||||||||||||||||||||||||||
g297      REVQFFTDEDGERNLVALEKKGGIWRRSASDADMKVLPTLRSVVVKTSARGSLARAEVPV
                130        140        150        160        170        180

190        200        210        220        230        240
m297.pep  EIRESLSGIFAGRFSLDGLKEGDAVRLMYDSLYFHGQQVAAGDILAAEVVKGGTRHQAFY
          ||||||||||||||||||||||||||||:|||||||||||||||||||||||||| ||||
g297      EIRESLSGIFAGRFSLDGLKEGDAVRLLYDSLYFHGQQVAAGDILAAEVVKGGTTHQAFY
                190        200        210        220        230        240

250        260        270        280        290        300
m297.pep  YRSDKEGGGGGNYYDEDGKVLQEKGGFNIEPLVYTRISSPFGYRMHPILHTWRLHTGIDY
          |||||||||||||||||||:||||||||||||||||||||||||||||||||||||||||
g297      YRSDKEGGGGGNYYDEDGRVLQEKGGFNIEPLVYTRISSPFGYRMHPILHTWRLHTGIDY
                250        260        270        280        290        300

310        320        330        340        350        360
m297.pep  AAPQGTPVRASADGVITFKGRKGGYGNAVMIRHANGVETLYAHLSAFSQAEGNVRGGEVI
          ||||||||||||||||||||||||||||||||||||||||||||||||||:|||||||||
g297      AAPQGTPVRASADGVITFKGRKGGYGNAVMIRHANGVETLYAHLSAFSQAQGNVRGGEVI
                310        320        330        340        350        360

370        380        390        400        410        420
m297.pep  GFVGSTGRSTGPHLHYEARINGQPVNPVSVALPTPELTQADKAAFAAQKQKADALLARLR
          ||||||||||||||||||||||||||||||||||||||||||||||||||||||||||||
g297      GFVGSTGRSTGPHLHYEARINGQPVNPVSVALPTPELTQADKAAFAAQKQKADALLARLR
                370        380        390        400        410        420

430
m297.pep  GIPVTVSQSDX
          |||||||||||
g297      GIPVTVSQSDX
                430
```

The following partial DNA sequence was identified in *N. meningitidis* <SEQ ID 1239>:

```
a297.seq
    1   ATGGCTGTCT  TCCCACTTTC  GGCAAAACAT  CGGAAATACG  CGCTGCGCGC

51   GCTTGCCGTT  TCGATTATTT  TGGTGTCGGC  GGCATACATT  GCTTCGACAG

101   AGAGGACGGA  GCGCGTCAGA  CCGCAGCGCG  TGGAACAAAA  ACTGCCGCCG

151   CTGTCTTGGG  GCGGCAGCGG  TGTTCAGACG  GCATATTGGG  TGCAGGAGGC

201   GGTGCAGCCA  GGCGACTCGC  TGGCGGACGT  GCTGGCGCGT  TCGGGTATGG

251   CGCGGGACGA  AATTGCCCGA  ATAACGGAAA  AATATGGCGG  CGAAGCCGAT

301   TTGCGGCATT  TGCGTGCCGA  CCAGTCGGTT  CATGTTTTGG  TCGGCGGCGA

351   CGGCGGCGCG  CGCGAAGTGC  AGTTTTTTAC  CGACGAAGAC  GGCGAGCGCA

401   ATCTGGTCGC  TTTGGAAAAA  AAAGGCGGCA  TATGGCGGCG  GTCGGCTTCT
```

-continued

```
 451  GAGGCGGATA TGAAGGTTTT GCCGACGCTG CGTTCGGTCG TGGTCAAAAC
 501  GTCGGCGCGC GGTTCGCTGG CGCGGGCGGA AGTGCCCGTC GAAATTCGCG
 551  AATCCTTAAG CGGGATTTTC GCCGGCCGCT TCAGCCTTGA TGGTTTGAAG
 601  GAAGGCGATG CCGTGCGCCT GATTTACGAC AGCCTGTATT TCCACGGGCA
 651  GCAGGTGGCG GCGGGCGATA TTCTGGCGGC GGAAGTCGTT AAGGGCGGCA
 701  CAAGGCATCA GGCGTTCTAT TACCGTTCGG ACAAGGAAGG AGGAGGGGGC
 751  GGCAATTATT ACGATGAAGA CGGCAGGGTG TTGCAGGAAA AAGGCGGCTT
 801  CAACATCGAG CCACTGGTCT ATACGCGCAT TTCTTCGCCG TTCGGCTACC
 851  GTATGCACCC CATCCTGCAC ACTTGGCGGC TGCACACGGG CATCGATTAT
 901  GCCGCACCGC AGGGAACGCC GGTCAGGGCT TCCGCCGACG GCGTGATTAC
 951  CTTTAAAGGC CGGAAGGGTG GCTACGGCAA CGCGGTGATG ATACGCCACG
1001  CCAACGGTGT GGAAACGCTG TATGCGCACT TGAGCGCGTT TTCTCAGGCA
1051  GAAGGCAATG TGCGCGGCGG CGAGGTCATC GGTTTTGTCG GTTCGACCGG
1101  GCGTTCGACG GGGCCGCACC TGCATTACGA GGCGCGCATC AATGGGCAGC
1151  CCGTCAATCC TGTTTCGGTC GCATTGCCGA CACCCGAATT GACGCAGGCG
1201  GACAAGGCGG CGTTTGCCGC GCAGAAACAG AAGGCGGACG CGCTGCTTGC
1251  GCGCTTGCGC GGCATACCGG TTACCGTGTC GCAATCGGAT TGA
```

This corresponds to the amino acid sequence <SEQ ID 1240; ORF 297.a>:

```
a297.pep
   1  MAVFPLSAKH RKYALRALAV SIILVSAAYI ASTERTERVR PQRVEQKLPP
  51  LSWGGSGVQT AYWVQEAVQP GDSLADVLAR SGMARDEIAR ITEKYGGEAD
 101  LRHLRADQSV HVLVGGDGGA REVQFFTDED GERNLVALEK KGGIWRRSAS
 151  EADMKVLPTL RSVVVKTSAR GSLARAEVPV EIRESLSGIF AGRFSLDGLK
 201  EGDAVRLIYD SLYFHGQQVA AGDILAAEVV KGGTRHQAFY YRSDKEGGGG
 251  GNYYDEDGRV LQEKGGFNIE PLVYTRISSP FGYRMHPILH TWRLHTGIDY
 301  AAPQGTPVRA SADGVITFKG RKGGYGNAVM IRHANGVETL YAHLSAFSQA
 351  EGNVRGGEVI GFVGSTGRST GPHLHYEARI NGQPVNPVSV ALPTPELTQA
 401  DKAAFAAQKQ KADALLARLR GIPVTVSQSD *
``` m297/a297 99.3% identity in 430 aa overlap

```
                10         20         30         40         50         60
m297.pep  MAVFPLSAKHRKYALRALAVSIILVSAAYIASTERTERVRPQRVEQNLPPLSWGGSGVQT
          ||||||||||||||||||||||||||||||||||||||||||||||:|||||||||||||
a297      MAVFPLSAKHRKYALRALAVSIILVSAAYIASTERTERVRPQRVEQKLPPLSWGGSGVQT
                10         20         30         40         50         60

70         80         90        100        110        120
m297.pep  AYWVQEAVQPGDSLADVLARSGMARDEIARITEKYGGEADLRHLRADQSVHVLVGGDGGA
          ||||||||||||||||||||||||||||||||||||||||||||||||||||||||||||
a297      AYWVQEAVQPGDSLADVLARSGMARDEIARITEKYGGEADLRHLRADQSVHVLVGGDGGA
                70         80         90        100        110        120

130        140        150        160        170        180
m297.pep  REVQFFTDEDGERNLVALEKKGGIWRRSASEADMKVLPTLRSVVVKTSARGSLARAEVPV
          ||||||||||||||||||||||||||||||||||||||||||||||||||||||||||||
a297      REVQFFTDEDGERNLVALEKKGGIWRRSASEADMKVLPTLRSVVVKTSARGSLARAEVPV
               130        140        150        160        170        180
```

```
              190        200        210        220        230        240
m297.pep  EIRESLSGIFAGRFSLDGLKEGDAVRLMYDSLYFHGQQVAAGDILAAEVVKGGTRHQAFY
          ||||||||||||||||||||||||||||:|||||||||||||||||||||||||||||||
a297      EIRESLSGIFAGRFSLDGLKEGDAVRLIYDSLYFHGQQVAAGDILAAEVVKGGTRHQAFY
              190        200        210        220        230        240

250        260        270        280        290        300
m297.pep  YRSDKEGGGGGNYYDEDGKVLQEKGGFNIEPLVYTRISSPFGYRMHPILHTWRLHTGIDY
          ||||||||||||||||||:|||||||||||||||||||||||||||||||||||||||||
a297      YRSDKEGGGGGNYYDEDGRVLQEKGGFNIEPLVYTRISSPFGYRMHPILHTWRLHTGIDY
              250        260        270        280        290        300

310        320        330        340        350        360
m297.pep  AAPQGTPVRASADGVITFKGRKGGYGNAVMIRHANGVETLYAHLSAFSQAEGNVRGGEVI
          ||||||||||||||||||||||||||||||||||||||||||||||||||||||||||||
a297      AAPQGTPVRASADGVITFKGRKGGYGNAVMIRHANGVETLYAHLSAFSQAEGNVRGGEVI
              310        320        330        340        350        360

370        380        390        400        410        420
m297.pep  GFVGSTGRSTGPHLHYEARINGQPVNPVSVALPTPELTQADKAAFAAQKQKADALLARLR
          ||||||||||||||||||||||||||||||||||||||||||||||||||||||||||||
a297      GFVGSTGRSTGPHLHYEARINGQPVNPVSVALPTPELTQADKAAFAAQKQKADALLARLR
              370        380        390        400        410        420

430
m297.pep  GIPVTVSQSDX
          |||||||||||
a297      GIPVTVSQSDX
              430
```

The following partial DNA sequence was identified in *N. gonorrhoeae* <SEQ ID 1241>:

```
g298.seq
   1    ATGAAAAACT TTCTTTCCCT TTTCGCCTCC ATACTGATGT CTGCCCTGAT

51    TGCCGTGTGG TTCAGCCAAA ACCCCATCAA CGCCTACTGG CAGCAGACCT

101    ACCACCGCAA CAGCCCGCTC GAACCGCTTG CCGCCTACGG ATGGTGGCGG

151    AGCGGAGCGG CGTTGCAAGA AAACGCCTAC GCCCTTTCAG ACGGCATCAA

201    AACCTTCCTG TCCGGCGAAA cgccccccac ggCTCAAGAC GGCGGTTCGG

251    CAGATATGCC GCCTGAAGCC GCCGCATCCG AAGCCGCCCC GCCGGCCGGC

301    GGAACAGAAT GGAAACAAGG CACCGAAGCC GCCGCCGTCC GCAGCGGCGA

351    CAAAGTCTTT TTCGCCGGAG ATTCGCTGAT GCAGGGCGTT GCGCCTTTCG

401    TGCAAAAAAG CCTGAAACAG CAATACGGCA TCGAATCCGC CAACCTCAGC

451    AAACAAAGCA CGGGGCTTTC CTATCCCTCA TTCTTCGACT GGCCGAAAAC

501    GATTGAAGAA ACCTTGAAAA ACATCCCGA ATCAGCGTA CTCGCCGTCT

551    TCCTCGGCCC GAACGACCCG TGGGATTTCC CCGTCGGCAA ACGCTACCTC

601    AAATTCGCTT CCGACGAATG GGCGCAAGAA TACCTGAAAC GCGTCGACCG

651    CATCCTTGAA GCCGCACACA CGCACCGCGT CCAAGTCGTC TGGCTCGGCA

701    TCCCCTACAT GAAAAAAGTC AAGCTCGACG GTCAGATGCG CTACCTCGAC

751    AAACTGCTTT CGGAACACTT GAAAGGCAAA ATCATCCTGA TTCCCACCGC

801    GCAAACACTG AGCGGCGGGA AAGccGCTA CACCGATTCC GTCAACGTCA

851    ACGGCAAACC CGTCCGCTAC CGCAGTAAGG ACGGCATACA CTTTACCGCC

901    GAAGGACAAA AACTGCTGGC GGAAAAAATA ATGGAAAAAA TCGTTTTTGA

951    ACCGAGTACG CAACCATCAA GTACACAGCC ATGA
```

This corresponds to the amino acid sequence <SEQ ID 1242; ORF 298.ng>:

```
g298.pep
    1   KNFLSLFAS ILMSALIAVW FSQNPINAYW QQTYHRNSPL EPLAAYGWWR

51   SGAALQENAY ALSDGIKTFL SGETPPTAQD GGSADMPPEA AASEAAPPAG

101   GTEWKQGTEA AAVRSGDKVF FAGDSLMQGV APFVQKSLKQ QYGIESANLS

151   KQSTGLSYPS FFDWPKTIEE TLKKHPEISV LAVFLGPNDP WDFPVGKRYL

201   KFASDEWAQE YLKRVDRILE AAHTHRVQVV WLGIPYMKKV KLDGQMRYLD

251   KLLSEHLKGK IILIPTAQTL SGGKGRYTDS VNVNGKPVRY RSKDGIHFTA

301   EGQKLLAEKI MEKIVFEPST QPSSTQP*
```

The following partial DNA sequence was identified in *N. meningitidis* <SEQ ID 1243>:

```
m298.seq
    1   ATGAAAAACT TCTTTCCCT TTTCTCCTCC ATACTGATGT CTGCCCTGAT

51   TGCCGTGTGG TTCAGCCAAA ACCCCATCAA CGCCTACTGG CAGCAGACCT

101   ACCACCGCAA CAGCCCGCTC GAACCGCTTG CCGCCTACGG ATGGTGGCGG

151   AGCGGTGCGG CGTTGCAAGA AAACGCCTAC GCCCTTTCAG ACGGCATCAA

201   AGCCTTCCTG TCCGGCGAAA CGCCGCCGAC GGCTCAAGAC GGCGGTTCGG

251   CAGATATGCC GTCTGAAGCC GCCGCATCCG AAGCCGTCCC TCAAACCGGT

301   GAAACAGAAT GGAAACAAGA CACCGAAGCC GCCGCCGTCC GCAGCGGCGA

351   CAAAGTCTTT TTTGTCGGCG ACTCGCTGAT GCAGGGCGTT GCCCCCTTCG

401   TGCAAAAAAG CCTGAAACAG CAATACGGCA TCGAATCCGT CAACCTCAGC

451   AAACAAAGCA CGGGGCTGTC CTACCCCTCA TTCTTCGACT GGCCGAAAAC

501   GATTGAAGAA ACCCTGCAAA AACATCCCGA AATCAGCGTA CTCGCCGTCT

551   TCCTCGGACC GAACGACCCG TGGGATTTCC CCGTCGGCAA ACTCTATCTC

601   AAATTCGCTT CCGACGAATG GGCGCAAGAA TACCTGAAAC GTGTCGACCG

651   CATCCTTGAA GCCGCACACA CGCACCGCGT CCAAGTCGTC TGGCTCGGCA

701   TCCCCTACAT GAAAAAAGCC AAGCTCGACG GACAGATGCG CTACCTAGAC

751   AAACTGCTTT CGGAACATTT GAAAGGCAAA ATCATCCTGA TTCCCACCAC

801   GCACACCCTG AGCGGCGGGA AAGACCGCTA CACCGACTCC GTCAACGTCA

851   ACGGCAAACC CGTCCGCTAC CGCAGCAAGG ACGGCATACA CTTTACCGCC

901   GAAGGACAAA AACTGCTGGC GGCAAAAATA ATGGAAAAAA TCGTTTTTGA

951   ACCAAGTACG CAACCATCAA GTACACAGCC ATGA
```

This corresponds to the amino acid sequence <SEQ ID 1244; ORF 298>:

```
m298.pep
    1   MKNFLSLFSS ILMSALIAVW FSQNPINAYW QQTYHRNSPL EPLAAYGWWR

51   SGAALQENAY ALSDGIKAFL SGETPPTAQD GGSADMPSEA AASEAVPQTG

101   ETEWKQDTEA AAVRSGDKVF FVGDSLMQGV APFVQKSLKQ QYGIESVNLS

151   KQSTGLSYPS FFDWPKTIEE TLQKHPEISV LAVFLGPNDP WDFPVGKLYL

201   KFASDEWAQE YLKRVDRILE AAHTHRVQVV WLGIPYMKKA KLDGQMRYLD

251   KLLSEHLKGK IILIPTTHTL SGGKDRYTDS VNVNGKPVRY RSKDGIHFTA

301   EGQKLLAAKI MEKIVFEPST QPSSTQP*
``` m298/g298 94.8% identity in 327 aa overlap

```
                    10        20        30        40        50        60
m298.pep    MKNFLSLFSSILMSALIAVWFSQNPINAYWQQTYHRNSPLEPLAAYGWWRSGAALQENAY
            ||||||||:|||||||||||||||||||||||||||||||||||||||||||||||||||
g298        MKNFLSLFASILMSALIAVWFSQNPINAYWQQTYHRNSPLEPLAAYGWWRSGAALQENAY
                    10        20        30        40        50        60

70        80        90       100       110       120
m298.pep    ALSDGIKAFLSGETPPTAQDGGSADMPSEAAASEAVPQTGETEWKQDTEAAAVRSGDKVF
            |||||||:||||||||||||||||||| |||||||:| :| ||||| |||||||||||||
g298        ALSDGIKTFLSGETPPTAQDGGSADMPPEAAASEAAPPAGGTEWKQGTEAAAVRSGDKVF
                    70        80        90       100       110       120

130       140       150       160       170       180
m298.pep    FVGDSLMQGVAPFVQKSLKQQYGIESVNLSKQSTGLSYPSFFDWPKTIEETLQKHPEISV
            |:||||||||||||||||||||||||:|||||||||||||||||||||||||:|||||||
g298        FAGDSLMQGVAPFVQKSLKQQYGIESANLSKQSTGLSYPSFFDWPKTIEETLKKHPEISV
                   130       140       150       160       170       180

190       200       210       220       230       240
m298.pep    LAVFLGPNDPWDFPVGKLYLKFASDEWAQEYLKRVDRILEAAHTHRVQVVWLGIPYMKKA
            ||||||||||||||||| |||||||||||||||||||||||||||||||||||||||||:
g298        LAVFLGPNDPWDFPVGKRYLKFASDEWAQEYLKRVDRILEAAHTHRVQVVWLGIPYMKKV
                   190       200       210       220       230       240

250       260       270       280       290       300
m298.pep    KLDGQMRYLDKLLSEHLKGKIILIPTTHTLSGGKDRYTDSVNVNGKPVRYRSKDGIHFTA
            ||||||||||||||||||||||||||::|||||| |||||||||||||||||||||||||
g298        KLDGQMRYLDKLLSEHLKGKIILIPTAQTLSGGKGRYTDSVNVNGKPVRYRSKDGIHFTA
                   250       260       270       280       290       300

310       320
m298.pep    EGQKLLAAKIMEKIVFEPSTQPSSTQPX
            ||||||| ||||||||||||||||||||
g298        EGQKLLAEKIMEKIVFEPSTQPSSTQPX
                   310       320
```

The following partial DNA sequence was identified in *N. meningitidis* <SEQ ID 1245>:

```
a298.seq
     1  ATGAAAAACT TTCTTTCCCT TTTCGCCTCC ATACTGATGT CTGCCCTGAT

51  TGCCGTGTGG TTCAGCCAAA ACCCCATCAA CGCCTACTGG CAGCAGACCT

101  ACCACCGCAA CAGCCCGCTC GAACCGCTTG CCGCCTACGG ATGGTGGCGG

151  AGCGGTGCGG CATTGCAAGA AAACGCCTAC GCCCTTTCAG ACGGCATCAA

201  AGCCTTCCTG TCCGGCGAAA CGCCGCCGAC GGCTCAAGAC GGCGGTTCGG

251  CAGATATGCC GTCTGAAGCC GCCGCACCCG AAACCGCCCC TCAAACTGGC

301  GAAACAGAAT GGAAACAAAA CACCGAAGCC GCCGCCGTCC GAACAGGGGA

351  CAAAGTCTTT TTCGCCGGCG ACTCGCTGAT GCAGGGCGTT GCACCCTTCG

401  TGCAAAAAAG CCTGAAACAG CAATACGGCA TCGAATCCGT CAACCTCAGC

451  AAACAAAGCA CGGGGCTGTC CTACCCCTCA TTCTTCGACT GGCCGAAAAC

501  GATTGAAGAA ACCCTGAAAA AACATCCCGA AATCAGCGTG CTCGCCGTCT

551  TCCTCGGTCC GAACGACCCG TGGGATTTCC CCGTTGGCAA ACGCTACCTC

601  AAATTCGCTT CCGACGAATG GGCGCAAGAA TACCTGAAAC GCGTCGACCG

651  CATCCTTGAA GCCGCACACA CGCACTACGT CCAAGTCGTC TGGCTCGGCA

701  TCCCCTACAT GAAAAAAGCC AAGCTCGACG GACAGATGCG CTACCTAGAC

751  AAACTGCTTT CGGAATATTT GAAAGGCAAA ATCATCCTGA TTCCCACCGC

801  GCACACCCTG AGCGGCGGGA AAGACCGCTA CACCGACTCC GTCAACGTCA

851  ACGGCAAACC CGTCCGCTAC CGCAGCAAGG ACGGCATACA CTTTACCGCC

901  GAAGGACAAA AACTGCTGGC GGCAAAAATA ATGGAAAAAA TCGTTTTTGA

951  ACCAAGTACG CAACCATCAA GTACACAGCC ATGA
```

This corresponds to the amino acid sequence <SEQ ID 1246; ORF 298.a>:

```
a298.pep
    1   MKNFLSLFAS ILMSALIAVW FSQNPINAYW QQTYHRNSPL EPLAAYGWWR

51   SGAALQENAY ALSDGIKAFL SGETPPTAQD GGSADMPSEA AAPETAPQTG

101   ETEWKQNTEA AAVRTGDKVF FAGDSLMQGV APFVQKSLKQ QYGIESVNLS

151   KQSTGLSYPS FFDWPKTIEE TLKKHPEISV LAVFLGPNDP WDFPVGKRYL

201   KFASDEWAQE YLKRVDRILE AAHTHYVQVV WLGIPYMKKA KLDGQMRYLD

251   KLLSEYLKGK IILIPTAHTL SGGKDRYTDS VNVNGKPVRY RSKDGIHFTA

301   EGQKLLAAKI MEKIVFEPST QPSSTQP*
``` m298/a298 96.3% identity in 327 aa overlap

```
                    10         20         30         40         50         60
    m298.pep   MKNFLSLFSSILMSALIAVWFSQNPINAYWQQTYHRNSPLEPLAAYGWWRSGAALQENAY
               ||||||||:||||||||||||||||||||||||||||||||||||||||||||||||||
    a298       MKNFLSLFASILMSALIAVWFSQNPINAYWQQTYHRNSPLEPLAAYGWWRSGAALQENAY
                    10         20         30         40         50         60

70         80         90        100        110        120
    m298.pep   ALSDGIKAFLSGETPPTAQDGGSADMPSEAAASEAVPQTGETEWKQDTEAAAVRSGDKVF
               ||||||||||||||||||||||||||||||||  |::||||||||:|||||||:|||||
    a298       ALSDGIKAFLSGETPPTAQDGGSADMPSEAAAPETAPQTGETEWKQNTEAAAVRTGDKVF
                    70         80         90        100        110        120

130        140        150        160        170        180
    m298.pep   FVGDSLMQGVAPFVQKSLKQQYGIESVNLSKQSTGLSYPSFFDWPKTIEETLQKHPEISV
               |:||||||||||||||||||||||||||||||||||||||||||||||||||:||||||
    a298       FAGDSLMQGVAPFVQKSLKQQYGIESVNLSKQSTGLSYPSFFDWPKTIEETLKKHPEISV
                   130        140        150        160        170        180

190        200        210        220        230        240
    m298.pep   LAVFLGPNDPWDFPVGKLYLKFASDEWAQEYLKRVDRILEAAHTHRVQVVWLGIPYMKKA
               |||||||||||||||||  |||||||||||||||||||||||||| |||||||||||||
    a298       LAVFLGPNDPWDFPVGKRYLKFASDEWAQEYLKRVDRILEAAHTHYVQVVWLGIPYMKKA
                   190        200        210        220        230        240

250        260        270        280        290        300
    m298.pep   KLDGQMRYLDKLLSEHLKGKIILIPTTHTLSGGKDRYTDSVNVNGKPVRYRSKDGIHFTA
               |||||||||||||||:|||||||||||:||||||||||||||||||||||||||||||||
    a298       KLDGQMRYLDKLLSEYLKGKIILIPTAHTLSGGKDRYTDSVNVNGKPVRYRSKDGIHFTA
                   250        260        270        280        290        300

310        320
    m298.pep   EGQKLLAAKIMEKIVFEPSTQPSSTQPX
               ||||||||||||||||||||||||||||
    a298       EGQKLLAAKIMEKIVFEPSTQPSSTQPX
                   310        320
```

45

The following partial DNA sequence was identified in *N. gonorrhoeae* <SEQ ID 1247>:

```
g299.seq
    1   ATGAACCCCA AACACTTCAT CGCATTTTCC GCCCTGTTCG CCGCCACGCA

51   GGCAGAAGCC CTGCCCGTCG CCTCCGTCAG CCCCGACACC GTTACCGTTT

101   CCCCGTCCGC CCCCTACACC GATACAAACG GCTGCTGAC CGACTACGGC

151   AACGCCGCCG CCTCGCCTTG GATGAAAAAA CTCCGATCCG TCGCACAAGG

201   CAGCGGCGAG GCCTTCCGCA TCCTGCAAAT CGGCGACTCG CATACCGCCG

251   GCGACTTCTT TACCGACGCC CTGCGCAAAC GCCTGCAAAA ACATGGGGC

301   GACGGCGGCA TAGGCTGGGT TTACCCCGCC AACGTCAAAG GGCAGCGCAT

351   GGCGGCCGTC CGTCACAGCG GCAACTGGCA AAGCTTCACC AGCAGGAACA

401   ATACCGGAGA TTTCCCGCTC GGCGGCATCC TCGCCCAAAC CGGCAGCGGC

451   GGCGGCATGA CCCTGACCGC GTCTGACGGC AAAACCGGCA AACAGCGCGT
```

-continued

```
 501  TTCCCTGTTT GCCAAACCGC TGCTCGCCGA ACAAACCCTG ACCGTCAACG
 551  GCAACACCGT CTCCGCCAAC GGCGGCGGCT GGCAGGTACT GGATACGGGC
 601  GCGGCACTGC CCCTGGCCAT ACAGACCGAA ATGCCGTGGG ACATCGGCTT
 651  CATCAACATC GAAAATCCCG CCGGCGGCAT TACCGTTTCC GCGATGGGCA
 701  TCAACGGCGC ACAATTGACC CAGTGGTCGA AATGGCGTGC CGACCGTATG
 751  AACGACCTTG CCCAAACCGG CGCCGATTTG GTTATCCTTT CCTACGGCAC
 801  CAACGAAGCC TTCAACAACA ACATCGACAT TGCCGATACC GAACAAAAAT
 851  GGCTGGATAC CGTCCGCCAA ATCCGCGACA GCCTGCCCGC CGCCGGCATC
 901  CTCATCATCG GCGCGCCCGA ATCCCTGAAA ACACGCTCG GCGTATGCGG
 951  CACGCGCCCC GTCCTCCTGA CCGAAGTCCA ACAGATGCAG CGGCGCGTCG
1001  CCCGTCAGGG GCAGACGATG TTTTGGTCTT GGCAAAACGC AATGGGCGGC
1051  ATATGCAGCA TGAAAAACTG GCTCAACCAA GGATGGGCCG CCAAAGACGG
1101  CGTACACTTC TCCGCCCAAG GCTACCGGCG CGCGGCGGAA ATGCTTGCCG
1151  ACAGCCTCGA GAACTCGTC CGCGCCGCCG CAATCAGGCA ATAA
```

This corresponds to the amino acid sequence <SEQ ID 1248; ORF 299.ng>:

```
g299.pep
   1  MNPKHFIAFS ALFAATQAEA LPVASVSPDT VTVSPSAPYT DTNGLLTDYG
  51  NAAASPWMKK LRSVAQGSGE AFRILQIGDS HTAGDFFTDA LRKRLQKTWG
 101  DGGIGWVYPA NVKGQRMAAV RHSGNWQSFT SRNNTGDFPL GGILAQTGSG
 151  GGMTLTASDG KTGKQRVSLF AKPLLAEQTL TVNGNTVSAN GGGWQVLDTG
 201  AALPLAIQTE MPWDIGFINI ENPAGGITVS AMGINGAQLT QWSKWRADRM
 251  NDLAQTGADL VILSYGTNEA FNNNIDIADT EQKWLDTVRQ IRDSLPAAGI
 301  LIIGAPESLK NTLGVCGTRP VLLTEVQQMQ RRVARQGQTM FWSWQNAMGG
 351  ICSMKNWLNQ GWAAKDGVHF SAQGYRRAAE MLADSLEELV RAAAIRQ*
```

The following partial DNA sequence was identified in N. meningitidis <SEQ ID 1249>:

```
m299.seq
   1  ATGAACCCCA ACACCTCAT CGCATTTTCC GCCCTATTCG CCGCCACGCA
  51  GGCAGAAGCC CTACCTGTCG CCTCCGTCAG CCTCGACACC GTTACCGTTT
 101  CCCCGTCCGC CCCCTACACC GATACAAACG GGCTGCTGAC CGACTACGGC
 151  AACGCCTCCG CCTCGCCTTG GATGAAAAAA CTCCAATCCG TCGCACAAGG
 201  CAGCGGCGAG ACCTTCCGTA TCCTGCAAAT CGGCGACTCG CATACCGCCG
 251  GCGACTTCTT TACCGACAGC CTGCGCAAAC GCCTGCAAAA AACTTGGGGC
 301  GACGGCGGCA TAGGCTGGGT TTACCCCGCC AACGTCAAAG GGCAGCGCAT
 351  GGCGGCCGTC CGGCACAACG GTAACTGGCA AAGCCTCACC AGCAGGAACA
 401  ACACCGGAGA CTTCCCGCTC GGCGGCATCC TCGCCCACAC CGGCAGCGGC
 451  GGCAGCATGA CCCTGACCGC ATCGGACGGC ATAGCAAGCA AGCAGCGCGT
 501  TTCCCTGTTT GCCAAACCCC TGCTTGCCGA ACAAACCCTG ACCGTCAACG
 551  GCAACACCGT CTCCGCCAAC GGCGGCGGCT GGCAGGTACT GGATACGGGC
```

```
-continued
 601  GCGGCACTGC CCCTGACCAT ACACACCGAA ATGCCGTGGG ACATCGGCTT
 651  CATCAACATC GAAAATCCCG CCGGCGGCAT TACCGTTTCC GCGATGGGCA
 701  TCAACGGCGC ACAATTAACC CAGTGGTCGA ATGGCGTGC CGACCGTATG
 751  AACGACCTCG CCCAAACCGG CGCCGATTTG GTTATCCTTT CCTACGGCAC
 801  CAACGAAGCT TCAACAACA ACATCGACAT TGCCGACACC GAACAAAAAT
 851  GGCTGGATAC CGTCCGCCAA ATCCGCGACA GCCTGCCTGC CGCCGGCATC
 901  CTCATCATCG GCGCACCCGA ATCCCTGAAA ACACGCTCG GCGTATGCGG
 951  CACACGCCCC GTCCGCCTGA CCGAAGTCCA ACAGATGCAG CGGCGCGTCG
1001  CCCGTCAGGG GCAGACGATG TTCTGGTCTT GGCAAAACGC CATGGGCGGC
1051  ATATGCAGCA TGAAAAACTG GCTCAACCAA GGATGGGCCG CCAAAGACGG
1101  CGTACACTTC TCCGCCAAAG GCTACCGGCG CGCGGCGGAA ATGCTCGCCG
1151  ACAGCCTCGA AGAACTCGTC CGCTCCGCTG CAATCAGGCA ATAA
```

This corresponds to the amino acid sequence <SEQ ID 1250; ORF 299>:

```
m299.pep
   1  MNPKHLIAFS ALFAATQAEA LPVASVSLDT VTVSPSAPYT DTNGLLTDYG

51  NASASPWMKK LQSVAQGSGE TFRILQIGDS HTAGDFFTDS LRKRLQKTWG

101  DGGIGWVYPA NVKGQRMAAV RHNGNWQSLT SRNNTGDFPL GGILAHTGSG

151  GSMTLTASDG IASKQRVSLF AKPLLAEQTL TVNGNTVSAN GGGWQVLDTG

201  AALPLTIHTE MPWDIGFINI ENPAGGITVS AMGINGAQLT QWSKWRADRM

251  NDLAQTGADL VILSYGTNEA FNNNIDIADT EQKWLDTVRQ IRDSLPAAGI

301  LIIGAPESLK NTLGVCGTRP VRLTEVQQMQ RRVARQGQTM FWSWQNAMGG

351  ICSMKNWLNQ GWAAKDGVHF SAKGYRRAAE MLADSLEELV RSAAIRQ*
``` m299/g299 95.5% identity in 397 aa overlap

```
                10         20         30         40         50         60
m299.pep  MNPKHLIAFSALFAATQAEALPVASVSLDTVTVSPSAPYTDTNGLLTDYGNASASPWMKK
          |||||:||||||||||||||||||||| ||||||||||||||||||||||||:||||||
g299      MNPKHFIAFSALFAATQAEALPVASVSPDTVTVSPSAPYTDTNGLLTDYGNAAASPWMKK
                10         20         30         40         50         60

70         80         90        100        110        120
m299.pep  LQSVAQGSGETFRILQIGDSHTAGDFFTDSLRKRLQKTWGDGGIGWVYPANVKGQRMAAV
          |:||||||||:|||||||||||||||||:|||||||||||||||||||||||||||||
g299      LRSVAQGSGEAFRILQIGDSHTAGDFFTDALRKRLQKTWGDGGIGWVYPANVKGQRMAAV
                70         80         90        100        110        120

130        140        150        160        170        180
m299.pep  RHNGNWQSLTSRNNTGDFPLGGILAHTGSGGSMTLTASDGIASKQRVSLFAKPLLAEQTL
          ||:|||||:|||||||||||||||| |||| |||||||||: |||||||||||||||||
g299      RHSGNWQSFTSRNNTGDFPLGGILAQTGSGGGMTLTASDGKTGKQRVSLFAKPLLAEQTL
               130        140        150        160        170        180

190        200        210        220        230        240
m299.pep  TVNGNTVSANGGGWQVLDTGAALPLTIHTEMPWDIGFINIENPAGGITVSAMGINGAQLT
          |||||||||||||||||||||||| :|:|||||||||||||||||||||||||||||||
g299      TVNGNTVSANGGGWQVLDTGAALPLAIQTEMPWDIGFINIENPAGGITVSAMGINGAQLT
               190        200        210        220        230        240

250        260        270        280        290        300
m299.pep  QWSKWRADRMNDLAQTGADLVILSYGTNEAFNNNIDIADTEQKWLDTVRQIRDSLPAAGI
          ||||||||||||||||||||||||||||||||||||||||||||||||||||||||||||
g299      QWSKWRADRMNDLAQTGADLVILSYGTNEAFNNNIDIADTEQKWLDTVRQIRDSLPAAGI
               250        260        270        280        290        300
```

-continued

```
                    310       320       330       340       350       360
m299.pep      LIIGAPESLKNTLGVCGTRPVRLTEVQQMQRRVARQGQTMFWSWQNAMGGICSMKNWLNQ
              ||||||||||||||||||||| ||||||||||||||||||||||||||||||||||||||
g299          LIIGAPESLKNTLGVCGTRPVLLTEVQQMQRRVARQGQTMFWSWQNAMGGICSMKNWLNQ
                    310       320       330       340       350       360

370       380       390
m299.pep      GWAAKDGVHFSAKGYRRAAEMLADSLEELVRSAAIRQX
              ||||||||||||:||||||||||||||||||:||||||
g299          GWAAKDGVHFSAQGYRRAAEMLADSLEELVRAAAIRQX
                    370       380       390
```

The following partial DNA sequence was identified in *N. meningitidis* <SEQ ID 1251>:

```
a299.seq
   1   ATGAACCCCA AACACCTCAT CGCATTTTCC GCCCTATTCG CCGCCACGCA

51   GGCAGAAGCC CTACCTGTCG CCTCAGTCAG CCTCGACACC GTTACCGTTT

101   CCCCGTCCGC CCCCTACACC GATACAAACG GGCTGCTGAC CGACTACGGC

151   AACGCCTCCG CCTCGCCTTG GATGAAAAAA CTCCAATCCG TCGCACAAGG

201   CAGCGGCGAG ACCTTCCGTA TCCTGCAAAT CGGCGACTCG CATACCGCCG

251   GCGACTTCTT TACCGACAGC CTGCGCAAAC GCCTACAAAA AACTTGGGGC

301   GACGGCGGCA TAGGCTGGGT TTACCCCGCC AACGTCAAAG GGCAGCGCAT

351   GGCGGCCGTC CGGCACAACG GTAACTGGCA AAGCCTCACC AGCAGGAACA

401   ACACCGGAGA CTTCCCGCTC GGCGGCATCC TCGCCCACAC CGGCAGCGGC

451   GGCAGCATGA CCCTGACCGC ATCGGACGGC ATAGCAAGCA AGCAGCGCGT

501   TTCCCTGTTT GCCAAACCCC TGCTTGCCGA ACAAACCCTG ACCGTCAACG

551   GCAACACCGT CTCCGCCAAC GGCGGCGGCT GGCAGGTACT GGATACGGGC

601   GCGGCACTGC CCCTGACCAT ACACACCGAA ATGCCGTGGG ACATCGGCTT

651   CATCAACATC GAAAATCCCG CCGGCGGCAT TACCGTTTCC GCGATGGGCA

701   TCAACGGCGC ACAATTAACC CAGTGGTCGA AATGGCGTGC CGACCGTATG

751   AACGACCTTG CCCAAACCGG CGCCGATCTA GTCATCCTTG CCTACGGTAC

801   CAACGAAGCC TTCGGCGACA ACATCGACAT TGCCGATACC GAACAGAAAT

851   GGCTGGATAC CGTCCGCCAA ATCCGCGACA GCCTACCTGC CGCCGGCATC

901   CTCATCATCG GCGCGCCCGA ATCCCTGAAA AACACGCTCG GCGTATGCGG

951   CACACGCCCC GTCCGCCTGA CCGAAGTCCA ACAGATGCAG CGGCGCATCG

1001   CCCGTCAGGG GCAGACGATG TTCTGGTCTT GGCAAAACGC GATGGGCGGC

1051   GTTTGCAGCA TGAAAAACTG GCTCAACCAC GGATGGGCCG CCAAAGACGG

1101   CGTACACTTT TCCGCCAAAG GCTACCAACG GTCGGCGGAA ATGCTCGCCG

1151   ACAGCCTCGA AGAACTCGTC CGCTCCGCTG CAATCAGGCA ATAA
```

This corresponds to the amino acid sequence <SEQ ID 1252; ORF 299.a>:

a299.pep

1 <u>MNPKHLIAFS ALFAATQAEA</u> LPVASVSLDT VTVSPSAPYT DTNGLLTDYG

51 NASASPWMKK LQSVAQGSGE TFRILQIGDS HTAGDFFTDS LRKRLQKTWG

101 DGGIGWVYPA NVKGQRMAAV RHNGNWQSLT SRNNTGDFPL GGILAHTGSG

151 GSMTLTASDG IASKQRVSLF AKPLLAEQTL TVNGNTVSAN GGGWQVLDTG

-continued

```
201  AALPLTIHTE MPWDIGFINI ENPAGGITVS AMGINGAQLT QWSKWRADRM

251  NDLAQTGADL VILAYGTNEA FGDNIDIADT EQKWLDTVRQ IRDSLPAAGI

301  LIIGAPESLK NTLGVCGTRP VRLTEVQQMQ RRIARQGQTM FWSWQNAMGG

351  VCSMKNWLNH GWAAKDGVHF SAKGYQRSAE MLADSLEELV RSAAIRQ*
``` m299/a299 98.0% identity in 397 aa overlap

```
                 10         20         30         40         50         60
m299.pep  MNPKHLIAFSALFAATQAEALPVASVSLDTVTVSPSAPYTDTNGLLTDYGNASASPWMKK
          ||||||||||||||||||||||||||||||||||||||||||||||||||||||||||||
a299      MNPKHLIAFSALFAATQAEALPVASVSLDTVTVSPSAPYTDTNGLLTDYGNASASPWMKK
                 10         20         30         40         50         60

70         80         90        100        110        120
m299.pep  LQSVAQGSGETFRILQIGDSHTAGDFFTDSLRKRLQKTWGDGGIGWVYPANVKGQRMAAV
          ||||||||||||||||||||||||||||||||||||||||||||||||||||||||||||
a299      LQSVAQGSGETFRILQIGDSHTAGDFFTDSLRKRLQKTWGDGGIGWVYPANVKGQRMAAV
                 70         80         90        100        110        120

130        140        150        160        170        180
m299.pep  RHNGNWQSLTSRNNTGDFPLGGILAHTGSGGSMTLTASDGIASKQRVSLFAKPLLAEQTL
          ||||||||||||||||||||||||||||||||||||||||||||||||||||||||||||
a299      RHNGNWQSLTSRNNTGDFPLGGILAHTGSGGSMTLTASDGIASKQRVSLFAKPLLAEQTL
                130        140        150        160        170        180

190        200        210        220        230        240
m299.pep  TVNGNTVSANGGGWQVLDTGAALPLTIHTEMPWDIGFINIENPAGGITVSAMGINGAQLT
          ||||||||||||||||||||||||||||||||||||||||||||||||||||||||||||
a299      TVNGNTVSANGGGWQVLDTGAALPLTIHTEMPWDIGFINIENPAGGITVSAMGINGAQLT
                190        200        210        220        230        240

250        260        270        280        290        300
m299.pep  QWSKWRADRMNDLAQTGADLVILSYGTNEAFNNNIDIADTEQKWLDTVRQIRDSLPAAGI
          |||||||||||||||||||||||||||| ||||||::||||||||||||||||||||||
a299      QWSKWRADRMNDLAQTGADLVILAYGTNEAFGDNIDIADTEQKWLDTVRQIRDSLPAAGI
                250        260        270        280        290        300

310        320        330        340        350        360
m299.pep  LIIGAPESLKNTLGVCGTRPVRLTEVQQMQRRVARQGQTMFWSWQNAMGGICSMKNWLNQ
          ||||||||||||||||||||||||||||||||:|||||||||||||||||:||||||||:
a299      LIIGAPESLKNTLGVCGTRPVRLTEVQQMQRRIARQGQTMFWSWQNAMGGVCSMKNWLNH
                310        320        330        340        350        360

370        380        390
m299.pep  GWAAKDGVHFSAKGYRRAAEMLADSLEELVRSAAIRQX
          |||||||||||||||:|:|||||||||||||||||||
a299      GWAAKDGVHFSAKGYQRSAEMLADSLEELVRSAAIRQX
                370        380        390
```

The following partial DNA sequence was identified in *N. gonorrhoeae* <SEQ ID 1253>:

```
g302.seq
    1  ATGCACTCAA TATATTTTTT TAAGGAGAAG CAGATGAGTC AAACCGACGC

51  GCGTCGTAGC GGACGATTTT TACGCACAGT CGAATGGCTG GCAATATGT

101  TGCCGCACCC GGTTACGCTT TTTATTATTT TCATTGTGTT ATTGCTGATT

151  GCCTCTGCCG TCGGTGCGTA TTTCGGACTA TCCGTCCCCG ATCCGCGTCC

201  TGTTGGGGCG AAAGGACGTG CCGATGACGG TTTGATTCAC GTTGTCAGCC

251  TGCTCGATGC CGACGGTTTG ATCAAAATCC TGACGCATAC CGTTAAAAAT

301  TTCACCGGTT TCGCGCCGTT GGGAACGGTG TTGGTTTCTT TATTGGGCGT

351  GGGGATTGCG GAAAAATCGG GCTTGATTTC CGCATTAATG CGCTTATTGC

401  TCACAAAATC CCCACGCAAA CTCACTACTT TTATGGTTGT TTTTACAGGG

451  ATTTTATCCA ATACGGCTTC TGAATTGGGC TATGTCGTCC TAATCCCTTT

501  GTCCGCCGTC ATCTTTCATT CGCTCGGCCG CCATCCGCTT GCCGGTTTGG

551  CTGCGGCTTT CGCCGGCGTT TCGGGCGGTT ATTCGGCCAA TCTGTTCTTA

601  GGCACAATCG ATCCGCTCTT GGCAGGCATC ACCCAACAGG CGGCGCAAAT
```

-continued

```
 651  CATCCATCCC GACTACGTCG TAGGCCCTGA AGCCAACTGG TTTTTTATGG
 701  CAGCCAGTAC GTTTGTGATT GCTTTGATTG GTTATTTTGT TACTGAAAAA
 751  ATCGTCGAAC CGCAATTGGG CCCTTATCAA TCAGATTTGT CACAAGAAGA
 801  AAAAGACATT CGGCATTCCA ATGAAATCAC GCCTTTGGAA TATAAAGGAT
 851  TAATTTGGGC AGGCGTGGTG TTTGTTGCCT TATCCGCCCT ATTGGCTTGG
 901  AGCATCGTCC CTGCCGACGG TATTTTGCGT CATCCTGAAA CAGGATTGGT
 951  TGCCGGTTCG CCGTTTTTAA AATCGATTGT TGTTTTTATT TTCTTGTTGT
1001  TTGCGCTGCC GGGCATTGTT TATGGCCGGA TAACCCGAAG TTTGCGCGGC
1051  GAACGGGAAG TCGTTAATGC GATGGCCGAA TCGATGAGTA CTTTGGGACT
1101  TTATTTGGTC ATCATCTTTT TTGCCGCACA GTTTGTCGCA TTTTTTAATT
1151  GGACGAATAT TGGGCAATAT ATTGCCGTTA AAGGGGCGGT GTTCTTAAAA
1201  GAAGTCGGCT TGGGCGGCAG TGTGTTGTTT ATCGGTTTTA TTTTAATTTG
1251  TGCTTTTATC AATCTGATGA TAGGCTCCGC CTCCGCGCAA TGGGCGGTAA
1301  CTGCGCCGAT TTTCGTCCCT ATGCTGATGT TGGCCGGCTA CGCGCCCCAA
1351  GTCATTCAAG CCGCTTACCG CATCGGTGAT TCCGTTACCA ATATTATTAC
1401  GCCGATGATG AGTTATTTCG GGCTGATTAT GGCGACGGTA ATCAAATACA
1451  AAAAGATGC GGGCGTAGGC ACGCTGATTT CTATGATGTT GCCGTATTCC
1501  GCTTTCTTCT TAATTGCATG GATCGCCTTA TTCTGCATTT GGGTATTTGT
1551  TTTGGGTCTG CCCGTCGGTC CCGGCACACC CACATTCTAT CCGGTGCCTT
1601  AA
```

This corresponds to the amino acid sequence <SEQ ID 1254; ORF 302.ng>:

```
g302.pep
  1  MHSIYFFKEK QMSQTDARRS GRFLRTVEWL GNMLPHPVTL FIIFIVLLLI
 51  ASAVGAYFGL SVPDPRPVGA KGRADDGLIH VVSLLDADGL IKILTHTVKN
101  FTGFAPLGTV LVSLLGVGIA EKSGLISALM RLLLTKSPRK LTTFMVVFTG
151  ILSNTASELG YVVLIPLSAV IFHSLGRHPL AGLAAAFAGV SGGYSANLFL
201  GTIDPLLAGI TQQAAQIIHP DYVVGPEANW FFMAASTFVI ALIGYFVTEK
251  IVEPQLGPYQ SDLSQEEKDI RHSNEITPLE YKGLIWAGVV FVALSALLAW
301  SIVPADGILR HPETGLVAGS PFLKSIVVFI FLLFALPGIV YGRITRSLRG
351  EREVVNAMAE SMSTLGLYLV IIFFAAQFVA FFNWTNIGQY IAVKGAVFLK
401  EVGLGGSVLF IGFILICAFI NLMIGSASAQ WAVTAPIFVP MLMLAGYAPQ
451  VIQAAYRIGD SVTNIITPMM SYFGLIMATV IKYKKDAGVG TLISMMLPYS
501  AFFLIAWIAL FCIWVFVLGL PVGPGTPTFY PVP*
```

The following partial DNA sequence was identified in *N. meningitidis* <SEQ ID 1255>:

```
m302.seq
  1  ATGCACTCAA TATATTTTTT TAAGGAGAAG CAGATGAGTC AAACCGATAC
 51  GCAACGGGAC GGACGATTTT TACGCACAGT CGAATGGCTG GGCAATATGT
101  TGCCGCATCC GGTTACGCTT TTTATTATTT TCATTGTGTT ATTGCTGATT
```

-continued

```
 151   GCCTCTGCCG TCGGTGCGTA TTTCGGACTA TCCGTCCCCG ATCCGCGCCC

201   TGTTGGTGCG AAAGGACGTG CCGATGACGG TTTGATTTAC ATTGTCAGCC

251   TGCTCAATGC CGACGGTTTT ATCAAAATCC TGACGCATAC CGTTAAAAAT

301   TTCACCGGTT TCGCGCCGTT GGGAACGGTG TTGGTTTCTT TATTGGGCGT

351   GGGGATTGCG GAAAAATCGG GCTTGATTTC CGCATTAATG CGCTTATTGC

401   TCACAAAATC GCCACGCAAA CTCACTACTT TTATGGTTGT TTTTACAGGG

451   ATTTTATCTA ATACCGCTTC TGAATTGGGC TATGTCGTCC TAATCCCTTT

501   GTCCGCCATC ATCTTTCATT CCCTCGGCCG CCATCCGCTT GCCGGTCTGG

551   CTGCGGCTTT CGCCGGCGTT TCGGGCGGTT ATTCGGCCAA TCTGTTCTTA

601   AGCACAATCG ATCCGCTCTT GGCATGCATC ACCCATCAGG CGGCGGTCGT

651   AGGCCCTGAA GCCAACTGGT TTTTTATGGT AGCCAGTACG TTTGTGATTG

701   CTTTGATTGG TTATTTTGTT ACTGAAAAAA TCGTCGAACC GCAATTGGGC

751   CCTTATCAAT CAGATTTGTC ACAAGAAGAA AAAGACATTC GGCATTCCAA

801   TGAAATCACG CCTTTGGAAT ATAAAGGATT AATTTGGGCT GGCGTGGTGT

851   TTGTTGCCTT ATCCGCCCTA TTGGCTTGGA GCATCGTCCC TGCCGACGGT

901   ATTTTGCGTC ATCCTGAAAC AGGATTGGTT TCCGGTTCGC CGTTTTTAAA

951   ATCGATTGTT GTTTTTATTT TCTTGTTGTT TGCACTGyCG GGCmTTGTTT

1001   ATGGmCGGGT AACAGGAAGT TTGCGCGGCG AACAGGAAGT CGTTAATGCG

1051   ATGGCCGAAT CGATGAGTAC TCTGGsGCTT TmTTTGswCA kcATCTTTTT

1101   TGCCGCACAG TTTGTCGCAT TTTTTAATTG GACGAATATT GGGCAATATA

1151   TTGCCGTTAA AGGGGCGACG TTCTTAAAAG AAGTCGGCTT GGGCGGCAGC

1201   GTGTTGTTTA TCGGTTTTAT TTTAATTTGT GCTTTTATCA ATCTGATGAT

1251   AGGCTCCGCC TCCGCGCAAT GGGCGGTAAC TGCGCCGATT TTCGTCCCTA

1301   TGCTGATGTT GGCCGGCTAC GCGCCCGAAG TCATTCAAGC CGCTTACCGC

1351   ATCGGTGATT CCGTTACCAA TATTATTACG CCGATGATGA GTTATTTCGG

1401   GCTGATTATG GCGACGGTGA TCAAATACAA AAAAGATGCG GGCGTGGGTA

1451   CGCTGATTTC TATGATGTTG CCGTATTCCG CTTTCTTCTT GATTGCGTGG

1501   ATTGCCTTAT TCTGCATTTG GGTATTTGTT TTGGGCCTGC CGTCGGTCC

1551   CGGCGCGCCC ACATTCTATC CCGCACCTTA A
```

This corresponds to the amino acid sequence <SEQ ID 1256; ORF 302>:

```
m302.pep
   1   MHSIYFFKEK QMSQTDTQRD GRFLRTVEWL GNMLPHPVTL FIIFIVLLLI

51   ASAVGAYFGL SVPDPRPVGA KGRADDGLIY IVSLLNADGF IKILTHTVKN

101   FTGFAPLGTV LVSLLGVGIA EKSGLISALM RLLLTKSPRK LTTFMVVFTG

151   ILSNTASELG YVVLIPLSAI IFHSLGRHPL AGLAAAFAGV SGGYSANLFL

201   STIDPLLACI THQAAVVGPE ANWFFMVAST FVIALIGYFV TEKIVEPQLG

251   PYQSDLSQEE KDIRHSNEIT PLEYKGLIWA GVVFVALSAL LAWSIVPADG

301   ILRHPETGLV SGSPFLKSIV VFIFLLFALX GXVYGRVTRS LRGEQEVVNA

351   MAESMSTLXL XLXXIFFAAQ FVAFFNWTNI GQYIAVKGAT FLKEVGLGGS
```

```
401  VLFIGFILIC AFINLMIGSA SAQWAVTAPI FVPMLMLAGY APEVIQAAYR

451  IGDSVTNIIT PMMSYFGLIM ATVIKYKKDA GVGTLISMML PYSAFFLIAW

501  IALFCIWVFV LGLPVGPGAP TFYPAP*
```

Computer analysis of this amino acid sequence gave the following results:
Homology with a Predicted ORF from *N. gonorrhoeae*
ORF 302 shows 94.0% identity over a 533 aa overlap with a predicted ORF (ORF 302.ng) from *N. gonorrhoeae*:

```
m302/g302
                   10         20         30         40         50         60
m302.pep  MHSIYFFKEKQMSQTDTQRDGRFLRTVEWLGNMLPHPVTLKIIFIVLLLIASAVGAYFGL
          |||||||||||||||::|:|||||||||||||||||||||||||||||||||||||||||
g302      MHSIYFFKEKQMSQTDARRSGRFLRTVEWLGNMLPHPVTLKIIFIVLLLIASAVGAYFGL
                   10         20         30         40         50         60

70         80         90        100        110        120
m302.pep  SVPDPRPVGAKGRADDGLIYIVSLLNADGFIKILTHTVKNFTGFAPLGTVLVSLLGVGIA
          ||||||||||||||||||::||||:|||:|||||||||||||||||||||||||||||||
g302      SVPDPRPVGAKGRADDGLIHVVSLLDADGLIKILTHTVKNFTGFAPLGTVLVSLLGVGIA
                   70         80         90        100        110        120

130        140        150        160        170        180
m302.pep  EKSGLISALMRLLLTKSPRKLTTFMVVFTGILSNTASELGYVVLIPLSAIIFHSLGRHPL
          |||||||||||||||||||||||||||||||||||||||||||||||:||||||||||||
g302      EKSGLISALMRLLLTKSPRKLTTFMVVFTGILSNTASELGYVVLIPLSAVIFHSLGRHPL
                  130        140        150        160        170        180

190        200        210                 220        230
m302.pep  AGLAAAFAGVSGGYSANLFLSTIDPLLACITHQAA-------VVGPEANWFFMVASTFVI
          |||||||||||||||||||||:|||||||||||||::|||        ||||||||:||||
g302      AGLAAAFAGVSGGYSANLFLGTIDPLLAGITQQAAQIIHPDYVVGPEANWFFMAASTFVI
                  190        200        210        220        230        240

240        250        260        270        280        290
m302.pep  ALIGYFVTEKIVEPQLGPYQSDLSQEEKDIRHSNEITPLEYKGLIWAGVVFVALSALLAW
          ||||||||||||||||||||||||||||||||||||||||||||||||||||||||||||
g302      ALIGYFVTEKIVEPQLGPYQSDLSQEEKDIRHSNEITPLEYKGLIWAGVVFVALSALLAW
                  250        260        270        280        290        300

300        310        320        330        340        350
m302.pep  SIVPADGILRHPETGLVSGSPFLKSIVVFIFLLFALXGXVYGRVTRSLRGEQEVVNAMAE
          ||||||||||||||||||:|||||||||||||||||||  |  ||||||:||||||||
g302      SIVPADGILRHPETGLVAGSPFLKSIVVFIFLLFALPGIVYGRITRSLRGEREVVNAMAE
                  310        310        320        330        340        350

360        310        320        330        340        350
m302.pep  SMSTLXLXLXXIFFAAQFVAFFNWTNIGQYIAVKGATFLKEVGLGGSVLFIGFILICAFI
          |||||   |  ||||||||||||||||||||||||:||||||||||||||||||||||||
g302      SMSTLGLYLVIIFFAAQFVAFFNWTNIGQYIAVKGAVFLKEVGLGGSVLFIGFILICAFI
                  370        380        390        400        410        420

420        430        440        450        460        470
m302.pep  NLMIGSASAQWAVTAPIFVPMLMLAGYAPEVIQAAYRIGDSVTNIITPMMSYFGLIMATV
          |||||||||||||||||||||||||||||:||||||||||||||||||||||||||||||
g302      NLMIGSASAQWAVTAPIFVPMLMLAGYAPQVIQAAYRIGDSVTNIITPMMSYFGLIMATV
                  430        440        450        460        470        480

480        490        500        510        520
m302.pep  IKYKKDAGVGTLISMMLPYSAFFLIAWIALFCIWVFVLGLPVGPGAPTFYPAPX
          |||||||||||||||||||||||||||||||||||||||||||:|||||:||
g302      IKYKKDAGVGTLISMMLPYSAFFLIAWIALFCIWVFVLGLPVGPGTPTFYPVPX
                  490        500        510        520        530
```

The following partial DNA sequence was identified in *N. meningitidis* <SEQ ID 1257>:

```
a302.seq
    1  ATGCACTCAA TATATTTTTT TAAGGAGAAG CAGATGAGTC AAACCGATAC

51  GCAACGGGAC GGACGATTTT TACGCACAGT CGAATGGCTG GGCAATATGT

101  TGCCGCACCC GGTTACGCTT TTTATTATTT TCATTGTGTT ATTGCTGATT

151  GCCTCTGCCG CCGGTGCGTA TTTCGGACTA TCCGTCCCCG ATCCGCGCCC

201  TGTTGGTGCG AAAGGACGTG CCGATGACGG TTTGATTCAC GTTGTCAGCC
```

```
-continued
 251   TGCTCGATGC TGACGGTTTG ATCAAAATCC TGACGCATAC CGTTAAAAAT

301   TTCACCGGTT TCGCGCCGTT GGGAACGGTG TTGGTTTCTT TATTGGGCGT

351   GGGGATTGCG GAAAAATCGG GCTTGATTTC CGCATTAATG CGCTTATTGC

401   TCACAAAATC TCCACGCAAA CTCACTACTT TTATGGTTGT TTTTACAGGG

451   ATTTTATCTA ATACCGCTTC TGAATTGGGC TATGTCGTCC TAATCCCTTT

501   GTCCGCCATC ATCTTTCATT CCCTCGGCCG CCATCCGCTT GCCGGTCTGG

551   CTGCGGCTTT CGCCGGCGTT TCGGCGGTT ATTCGGCCAA TCTGTTCTTA

601   GGCACAATCG ATCCGCTCTT GGCAGGCATC ACCCAACAGG CGGCGCAAAT

651   CATCCATCCC GACTACGTCG TAGGCCCTGA AGCCAACTGG TTTTTTATGG

701   TAGCCAGTAC GTTTGTGATT GCTTTGATTG GTTATTTTGT TACTGAAAAA

751   ATCGTCGAAC CGCAATTGGG CCCTTATCAA TCAGATTTGT CACAAGAAGA

801   AAAAGACATT CGACATTCCA ATGAAATCAC GCCTTTGGAA TATAAAGGAT

851   TAATTTGGGC TGGCGTGGTG TTTGTTGCCT TATCCGCCCT ATTGGCTTGG

901   AGCATCGTCC CTGCCGACGG TATTTTGCGT CATCCTGAAA CAGGATTGGT

951   TTCCGGTTCG CCGTTTTTAA AATCAATTGT TGTTTTTATT TTCTTGTTGT

1001   TTGCACTGCC GGGCATTGTT TATGGCCGGG TAACCCGAAG TTTGCGCGGC

1051   GAACAGGAAG TCGTTAATGC GATGGCCGAA TCGATGAGTA CTCTGGGGCT

1101   TTATTTGGTC ATCATCTTTT TTGCCGCACA GTTTGTCGCA TTTTTTAATT

1151   GGACGAATAT TGGGCAATAT ATTGCCGTTA AAGGGGCGAC GTTCTTAAAA

1201   GAAGTCGGCT TGGGCGGCAG CGTGTTGTTT ATCGGTTTTA TTTTAATTTG

1251   TGCTTTTATC AATCTGATGA TAGGCTCCGC CTCCGCGCAA TGGGCGGTAA

1301   CTGCGCCGAT TTTCGTCCCT ATGCTGATGT TGGCCGGCTA CGCGCCCGAA

1351   GTCATTCAAG CCGCTTACCG CATCGGTGAT TCCGTTACCA ATATTATTAC

1401   GCCGATGATG AGTTATTTCG GGCTGATTAT GGCGACGGTG ATCAAATACA

1451   AAAAAGATGC GGGCGTGGGT ACGCTGATTT CTATGATGTT GCCGTATTCC

1501   GCTTTCTTCT TGATTGCGTG GATTGCCTTA TTCTGCATTT GGGTATTTGT

1551   TTTGGGCCTG CCCGTCGGTC CGGCGCGCC CACATTCTAT CCCGCACCTT

1601   AA
```

This corresponds to the amino acid sequence <SEQ ID 1258; ORF 302.a>:

```
a302.pep
   1   MHSIYFFKEK QMSQTDTQRD GRFLRTVEWL GNMLPHPVTL FIIFIVLLLI

51   ASAAGAYFGL SVPDPRPVGA KGRADDGLIH VVSLLDADGL IKILTHTVKN

101   FTGFAPLGTV LVSLLGVGIA EKSGLISALM RLLLTKSPRK LTTFMVVFTG

151   ILSNTASELG YVVLIPLSAI IFHSLGRHPL AGLAAAFAGV SGGYSANLFL

201   GTIDPLLAGI TQQAAQIIHP DYVVGPEANW FFMVASTFVI ALIGYFVTEK

251   IVEPQLGPYQ SDLSQEEKDI RHSNEITPLE YKGLIWAGVV FVALSALLAW

301   SIVPADGILR HPETGLVSGS PFLKSIVVFI FLLFALPGIV YGRVTRSLRG

351   EQEVVNAMAE SMSTLGLYLV IIFFAAQFVA FFNWTNIGQY IAVKGATFLK

401   EVGLGGSVLF IGFILICAFI NLMIGSASAQ WAVTAPIFVP MLMLAGYAPE
```

```
                                                 -continued
    451   VIQAAYRIGD SVTNIITPMM SYFGLIMATV IKYKKDAGVG TLISMMLPYS

501   AFFLIAWIAL FCIWVFVLGL PVGPGAPTFY PAP*
```

5 m302/a302 96.1% identity in 533 aa overlap

```
                   10         20         30         40         50         60
m302.pep   MHSIYFFKEKQMSQTDTQRDGRFLRTVEWLGNMLPHPVTLFIIFIVLLLIASAVGAYFGL
           |||||||||||||||||||||||||||||||||||||||||||||||||:||||||
a302       MHSIYFFKEKQMSQTDTQRDGRFLRTVEWLGNMLPHPVTLFIIFIVLLLIASAAGAYFGL
                   10         20         30         40         50         60

70         80         90        100        110        120
m302.pep   SVPDPRPVGAKGRADDGLIYIVSLLNADGFIKILTHTVKNFTGFAPLGTVLVSLLGVGIA
           ||||||||||||||||||::||||:|||:||||||||||||||||||||||||||||||
a302       SVPDPRPVGAKGRADDGLIHVVSLLDADGLIKILTHTVKNFTGFAPLGTVLVSLLGVGIA
                   70         80         90        100        110        120

130        140        150        160        170        180
m302.pep   EKSGLISALMRLLLTKSPRKLTTFMVVFTGILSNTASELGYVVLIPLSAIIFHSLGRHPL
           ||||||||||||||||||||||||||||||||||||||||||||||||||||||||||||
a302       EKSGLISALMRLLLTKSPRKLTTFMVVFTGILSNTASELGYVVLIPLSAIIFHSLGRHPL
                  130        140        150        160        170        180

190        200        210        220        230
m302.pep   AGLAAAFAGVSGGYSANLFLSTIDPLLACITHQAA-------VVGPEANWFFMVASTFVI
           ||||||||||||||||||||:|||||||  ||:|||       |||||||||||||||||
a302       AGLAAAFAGVSGGYSANLFLGTIDPLLAGITQQAAQIIHPDYVVGPEANWFFMVASTFVI
                  190        200        210        220        230        240

240        250        260        270        280        290
m302.pep   ALIGYFVTEKIVEPQLGPYQSDLSQEEKDIRHSNEITPLEYKGLIWAGVVFVALSALLAW
           ||||||||||||||||||||||||||||||||||||||||||||||||||||||||||||
a302       ALIGYFVTEKIVEPQLGPYQSDLSQEEKDIRHSNEITPLEYKGLIWAGVVFVALSALLAW
                  250        260        270        280        290        300

300        310        320        330        340        350
m302.pep   SIVPADGILRHPETGLVSGSPFLKSIVVFIFLLFALXGXVYGRVTRSLRGEQEVVNAMAE
           |||||||||||||||||||||||||||||||||||||| | ||||||||||||||||||
a302       SIVPADGILRHPETGLVSGSPFLKSIVVFIFLLFALPGPVYGRVTRSLRGEQEVVNAMAE
                  310        320        330        340        350        360

360        310        320        330        340        350
m302.pep   SMSTLXLXLXXIFFAAQFVAFFNWTNIGQYIAVKGATFLKEVGLGGSVLFIGFILICAFI
           ||||| | |  |||||||||||||||||||||||||||||||||||||||||||||||||
a302       SMSTLGLYLVIIFFAAQFVAFFNWTNIGQYIAVKGATFLKEVGLGGSVLFIGFILICAFI
                  370        380        390        400        410        420

420        430        440        450        460        470
m302.pep   NLMIGSASAQWAVTAPIFVPMLMLAGYAPEVIQAAYRIGDSVTNIITPMMSYFGLIMATV
           ||||||||||||||||||||||||||||||||||||||||||||||||||||||||||||
a302       NLMIGSASAQWAVTAPIFVPMLMLAGYAPEVIQAAYRIGDSVTNIITPMMSYFGLIMATV
                  430        440        450        460        470        480

480        490        500        510        520
m302.pep   IKYKKDAGVGTLISMMLPYSAFFLIAWIALFCIWVFVLGLPVGPGAPTFYPAPX
           |||||||||||||||||||||||||||||||||||||||||||||||||||||
a302       IKYKKDAGVGTLISMMLPYSAFFLIAWIALFCIWVFVLGLPVGPGAPTFYPAPX
                  490        500        510        520        530
```

The following partial DNA sequence was identified in *N. gonorrhoeae* <SEQ ID 1259>:

```
g305.seq
    1   ATGGATTTTT TGATTGTCCT GAAAGCCCTG ATGATGGGCT TGGTAGAAGG

51   TTTTACCGAA TTTTTACCGA TTTCCAGCAC CGGACATTTG ATTGTGTTCG

101   GCAATCTGAT TGGTTTTCAC AGCAATCACA AGGTTTTTGA AATTGCCATC

151   CAGCTCGGTG CGGTTTTGGC GGTAGTGTTT GAATACCGGC AGCGTTTCAG

201   CAATGTGTTG CATGGCGTGG GAAAAGACCG GAAAGCCAAC CGTTTCGTCC

251   TCAATCTTGC CATTGCTTTT ATACCTGCCG CCGTGATGGG GCTGTTGTTC

301   GACAAACAAA TCAAAGAGTA TCTGTTTAAC CCCTTGAGTG TTGCAGTCAT

351   GCTGGTTTTG GGCGGTTTTT TTATTTTGTG GGTGGAGAAA CGCCAAAGCC

401   GAGCAGAGCC TAAAATTGCC GATGTTGATG CATTGCGTCC GATTGATGCG

451   TTGATGATCG GTGTTGCCCA AGTGTTTGCA CTGGTTCCGG GTACGTCCCG
```

-continued

```
501  TTCGGGCAGT ACGGTTATGG GCGGGATGCT TTGGGGAATC GAGCGGAAAA
551  CGGCAACGGA GTTTTCATTT TTCTTGGCCG TTCCGATGAT GGTTGCAGCA
601  ACGGCTTATG ATGTCCTGAA ACATTACCGA TTTTTCACCC TGCATGATGT
651  CGGTTTGATT TTGATAGGCT TTATTGCCGC TTTTGTTTCC GGTTTGGTAG
701  CGGTTAAAGC ACTGCTGAAG TTTGTTTCCA AGAAAAACTA TATCCCGTTT
751  GCCTATTACC GCATTGTTTT CGGCATTGTC ATCATAATAT TGTGGTTGTC
801  GGGCTGGATA AGTTGGGAAT GA
```

This corresponds to the amino acid sequence <SEQ ID 1260; ORF 305.ng>:

```
g305.pep
  1  MDFLIVLKAL MMGLVEGFTE FLPISSTGHL IVFGNLIGFH SNHKVFEIAI
 51  QLGAVLAVVF EYRQRFSNVL HGVGKDRKAN RFVLNLAIAF IPAAVMGLLF
101  DKQIKEYLFN PLSVAVMLVL GGFFILWVEK RQSRAEPKIA DVDALRPIDA
151  LMIGVAQVFA LVPGTSRSGS TVMGGMLWGI ERKTATEFSF FLAVPMMVAA
201  TAYDVLKHYR FFTLHDVGLI LIGFIAAFVS GLVAVKALLK FVSKKNYIPF
251  AYYRIVFGIV IIILWLSGWI SWE*
```

The following partial DNA sequence was identified in *N. meningitidis* <SEQ ID 1261>:

```
m305.seq (partial)
  1  AtGGATTTTC TGATTGTCCT GAAAGCCCTG ATGATGGGCT TGGTAGAAGG
 51  TTTTACCGAA TTTTTACCGA TTTCCAGCAC CGGACATTTG ATTGTGTTCG
101  GCAATCTGAT TGGTTTTCAC AGCAATCACA AGGTTTTTGA AATTGCCATC
151  CAGCTCGGTG CAGTTTTGGC GGTAGTGTTT GAATACCGGC AACGTTTCAG
201  CAATGTGTTG CACGGCTTGG GAAAAGACCG GAAAGCCAAC CGCTTCGTCC
251  TTAATCTTGC CATTGCTTTT ATACCTGCCG CCGTGATGGG GCTGTTGTTC
301  GGCAwACAAA TCAAAGAGyA TCTGTTTAAC CCCTTGAGTG TTGCAGTCAT
351  GCTGGTTyTG GrCGGTTTTT yTATTTTGTG GGTGGAGAAA CGCCAAAGCC
401  GAGCAGAGCC TAAAATTGCC GATGTTGATG CATTGCGTCC GATTGATGCC
451  TTGATGATCG GCGTTGCCCA AGTGTTTGCA CTGGTTCCGG GTACGTCCCG
501  TTCGGGCAGT ACGATTATGG GCGGGATGCT TTGGGGCATC GAACGGAAAA
551  CTGCGACAGA ATTCTCGTTT TTCTTGGCTG TGCCGATGAT GGTTGCCGCA
601  ACGGCTTATG ATGTCCTGAA ACATTACCGA TTTTTCACCC TGCATGATGT
651  CGGTTTGATT CTGATAGGCT TTATTGCTGC CTTTGTTTCA GGCTTGGTAG
701  CGGTAAAAGC GTTGCTGAGG TTTGTTTCGG GTAC...
```

This corresponds to the amino acid sequence <SEQ ID 1262; ORF 305>:

```
m305.pep (partial)
  1  MDFLIVLKAL MMGLVEGFTE FLPISSTGHL IVFGNLIGFH SNHKVFEIAI
 51  QLGAVLAVVF EYRQRFSNVL HGLGKDRKAN RFVLNLAIAF IPAAVMGLLF
101  GXQIKEXLFN PLSVAVMLVL XGFXILWVEK RQSRAEPKIA DVDALRPIDA
```

-continued

```
151  LMIGVAQVFA LVPGTSRSGS TIMGGMLWGI ERKTATEFSFFLAVPMMVAA

201  TAYDVLKHYR FFTLHDVGLI LIGFIAAFVS GLVAVKALLR FVSG...
```

Computer analysis of this amino acid sequence gave the following results:
Homology with a Predicted ORF from *N. gonorrhoeae*
ORF 305 shows 96.7% identity over a 243 aa overlap with a predicted ORF (ORF 305.ng) from *N. gonorrhoeae*:

```
g305/m305
                  10         20         30         40         50         60
   g305.pep  MDFLIVLKALMMGLVEGFTEFLPISSTGHLIVFGNLIGPHSNHKVFEIAIQLGAVLAVVF
             ||||||||||||||||||||||||||||||||||||||||||||||||||||||||||||
   m305      MDFLIVLKALMMGLVEGFTEFLPISSTGHLIVFGNLIGPHSNHKVFEIAIQLGAVLAVVF
                  10         20         30         40         50         60

70         80         90        100        110        120
   g305.pep  EYRQRFSNVLHGVGKDRKANRFVLNLAIAFIPAAVMGLLFDKQIKEYLFNPLSVAVMLVL
             ||||||||||||:|||||||||||||||||||||||||||    |||||||||||||||
   m305      EYRQRFSNVLHGLGKDRKANRFVLNLAIAFIPAAVMGLLFGXQIKEXLFNPLSVAVMLVL
                  70         80         90        100        110        120

130        140        150        160        170        180
   g305.pep  GGFFILWVEKRQSRAEPKIADVDALRPIDALMIGVAQVFALVPGTSRSGSTVMGGMLWGI
             ||  ||||||||||||||||||||||||||||||||||||||||||||||||:|||||||
   m305      XGFXILWVEKRQSRAEPKIADVDALRPIDALMIGVAQVFALVPGTSRSGSTIMGGMLWGI
                 130        140        150        160        170        180

190        200        210        220        230        240
   g305.pep  ERKTATEFSFFLAVPMMVAATAYDVLKHYRFFTLHDVGLILIGFIAAFVSGLVAVKALLK
             |||||||||||||||||||||||||||||||||||||||||||||||||||||||||||:
   m305      ERKTATEFSFFLAVPMMVAATAYDVLKHYRFFTLHDVGLILIGFIAAFVSGLVAVKALLR
                 190        200        210        220        230        240

250        260        270
   g305.pep  FVSKKNYIPFAYYRIVFGIVIIILWLSGWISWEX
             |||
   m305      FVSG
```

The following partial DNA sequence was identified in *N. meningitidis* <SEQ ID 1263>:

```
a305.seq
     1   ATGGATTTTC TGATTGTCCT GAAAGCCCTG ATGATGGGCT TGGTAGAAGG

51   TTTTACCGAA TTTTTACCGA TTTCCAGCAC CGGACATTTG ATTGTGTTCG

101   GCAATCTGAT TGATTTTCAC AGCAATCACA AGGTTTTTGA AATTACCATC

151   CAGCTCGGTG CGGTTTTGGC GGTAGTGTTT GAATACCGGC AGCGTTTCAG

201   CAATGTGTTG CATGGCGTGG GAAAAGACCG GAAAGCCAAC CGTTTCGTCC

251   TTAATCTTGC CATTGCTTTT ATACCTGCCG CCGTGATGGG GCTGTTGTTC

301   GGCAAACAAA TCAAAGAGTA TCTGTTTAAC CCCTTGAGTG TTGCAGTCAT

351   GCTGGTTTTG GGCGGTTTTT TTATTTTGTG GGTGGAGAAA CGCCAAAGCC

401   GAGCAGAGCC TAAAATTGTC GATGTTGATG CATTGCGTCC GATTGATGCG

451   TTGATGATCG GCGTTGCCCA AGTGTTTGCA CTGGTTCCAG GTACGTCCCG

501   TTCGGGCAGT ACGATTATGG GCGGGATGCT TTGGGGAATC GAGCGGAAAA

551   CGGCAACGGA GTTTTCATTT TTCTTGGCCG TTCCGATGAT GGTTGCAGCA

601   ACGGCTTATG ATGTCCTGAA GCATTACCGG TTTTTCACCC TGCATGATGT

651   CGGTTTGATT TTGATTGGCT TTGTTGCTGC CTTTGTTTCA GGCTTGGTGG

701   CGGTCAAAGC GTTGCTGAGG TTTGTTTCCA AGAAAAATTA TATTCCTTTT

751   GCCTATTACC GCATTGTTTT TGGTATTGCC ATCATTATAT TGTGGCTGTC

801   AGGCTGGATA AGTTGGGAAT GA
```

This corresponds to the amino acid sequence <SEQ ID 1264; ORF 305.a>:

```
a305.pep
    1  MDFLIVLKAL MMGLVEGFTE FLPISSTGHL IVFGNLIDFH SNHKVFEITI

51  QLGAVLAVVF EYRQRFSNVL HGVGKDRKAN RFVLNLAIAF IPAAVMGLLF

101  GKQIKEYLFN PLSVAVMLVL GGFFILWVEK RQSRAEPKIV DVDALRPIDA

151  LMIGVAQVFA LVPGTSRSGS TIMGGMLWGI ERKTATEFSF FLAVPMMVAA

201  TAYDVLKHYR FFTLHDVGLI LIGFVAAFVS GLVAVKALLR FVSKKNYIPF

251  AYYRIVFGIA IIILWLSGWI SWE*
``` m305/a305 96.3% identity in 243 aa overlap

```
                 10         20         30         40         50         60
m305.pep  MDFLIVLKALMMGLVEGFTEFLPISSTGHLIVFGNLIGFHSNHKVFEIAIQLGAVLAVVF
          ||||||||||||||||||||||||||||||||||||:|||||||||:|||||||||||||
a305      MDFLIVLKALMMGLVEGFTEFLPISSTGHLIVFGNLIDFHSNHKVFEITIQLGAVLAVVF
                 10         20         30         40         50         60

70         80         90        100        110        120
m305.pep  EYRQRFSNVLHGLGKDRKANRFVLNLAIAFIPAAVMGLLFGXQIKEXLFNPLSVAVMLVL
          |||||||||||:||||||||||||||||||||||||||||| ||| ||||||||||||||
a305      EYRQRFSNVLHGVGKDRKANRFVLNLAIAFIPAAVMGLLFGKQIKEYLFNPLSVAVMLVL
                 70         80         90        100        110        120

130        140        150        160        170        180
m305.pep  XGFXILWVEKRQSRAEPKIADVDALRPIDALMIGVAQVFALVPGTSRSGSTIMGGMLWGI
           || |||||||||||||||||:|||||||||||||||||||||||||||||||||||||||
a305      GGFFILWVEKRQSRAEPKIVDVDALRPIDALMIGVAQVFALVPGTSRSGSTIMGGMLWGI
                130        140        150        160        170        180

190        200        210        220        230        240
m305.pep  ERKTATEFSFFLAVPMMVAATAYDVLKHYRFFTLHDVGLILIGFIAAFVSGLVAVKALLR
          |||||||||||||||||||||||||||||||||||||||||||:||||||||||||||||
a305      ERKTATEFSFFLAVPMMVAATAYDVLKHYRFFTLHDVGLILIGFVAAFVSGLVAVKALLR
                190        200        210        220        230        240 m305.pep  FVSG
          |||
a305      FVSKKNYIPFAYYRIVFGIAIIILWLSGWISWEX
                250        260        270
```

The following partial DNA sequence was identified in *N. gonorrhoeae* <SEQ ID 1265>:

```
g306.seq
    1  ATGTTTATGA ACAAATTTTC CCAATCCGGA AAAGGTCTGT CCGGTTTCTT

51  CTTCGGTTTG ATACTGGCAA CGGTCATTAT TGCCGGTATT TTGCTTTATC

101  TGAACCAGGG CGGTCAAAAT GCGTTCAAAA TCCCGGCTCC GTCGAAGCAG

151  CCTGCAGAAA CGGAAATCCT GAAACTGAAA AACCAGCCTA AGGAAGACAT

201  CCAACCTGAA CCGGCCGATC AAAACGCCTT GTCCGAACCG GATGTTGCGA

251  AAGAGGCAGA GCAGTCGGAT GCGGAAAAAG CTGCCGACAA GCAGCCCGTT

301  GCCGACAAAG CCGACGAGGT TGAAGAAAAG GCGGGCGAGC CGGAACGGGA

351  AGAGCCGGAC GGACAGGCAG TGCGCAAGAA AGCACTGACT GAAGAGCGTG

401  AACAAACCGT CAGGGAAAAA GCGCAGAAGA AGATGCCGA AACGGTTAAA

451  AAAAAGCGG TAAACCGTC TAAAGAAACA GAGAAAAAG CTTCAAAAGA

501  AGAGAAAAAG GCGGCGAAAG AAAAGTTGC ACCCAAACCG ACCCCGGAAC

551  AAATCCTCAA CAGCCGCAGT ATCGAAAAAG CGCGTAGTGC CGCTGCCAAA

601  GAAGTGCAGA AAATGAAAAA CTTTGGGCAA GGCGGAAGCC AACGCATTAT

651  CTGCAAATGG GCGCGTATGC CGAACCCCGG AGCGCGGAAG GGCAGCGTGC
```

```
-continued
701  CAAACTGGCA ATCTTGGGCA TATCTTCCGA AGTGGTCGGC TATCAGGCGG

751  GACATAAAAC GCTTTACCGC GTGCAAAGCG GCAATATGTC CGCCGATGCG

801  GTGA
```

This corresponds to the amino acid sequence <SEQ ID 1266; ORF 306.ng>:

```
g306.pep
  1   MFMNKFSQSG KGLSGFFFGL ILATVIIAGI LLYLNQGGQN AFKIPAPSKQ

51   PAETEILKLK NQPKEDIQPE PADQNALSEP DVAKEAEQSD AEKAADKQPV

101   ADKADEVEEK AGEPEREEPD GQAVRKKALT EEREQTVREK AQKKDAETVK

151   KKAVKPSKET EKKASKEEKK AAKEKVAPKP TPEQILNSRS IEKARSAAAK

201   EVQKMKNFGQ GGSQRIICKW ARMPNPGARK GSVPNWQSWA YLPKWSAIRR

251   DIKRFTACKA AICPPMR*
```

The following partial DNA sequence was identified in *N. meningitidis* <SEQ ID 1267>:

```
m306.seq (partial)
  1   ..GGTTTGTTCT TCGGTTTGAT ACTGGCGACG GTCATTATTG CCGGTATTTT

51   GTTTTATCTG AACCAGAGCG GTCAAAATGC GTTCAAAATC CCGGCTTCGT

101   CGAAGCAGCC TGCAGAAACG GAAATCCTGA AACCGmAwAA CCAGCyTAAG

151   GAAGACATCC AACCTGAwCC GGCCGATCAA AACGCCTTGT CCGAACCGGA

201   TGCTGCGACA GAGGCAGAGC AGTCGGATGC GGAAAAwGCT GCCGACAAGC

251   AGCCCGTTGC CGATAAAGCC GACGAGGTTG AAGAAAAGGC GGGCGAGCCG

301   GAACGGGAAG AGCCGGACGG ACAGGCAGTG CGTAAGAAAG CGCTGACGGA

351   AGAGCGTGAA CAAACCGTCA GGGAAAAAGC GCAGAAGAAA GATGCCGAAA

401   CGGTTAAAAw ACAAGCGGTA AAACCGTCTA AGAAACAGA GAAAAAAGCT

451   TCAAAAGAAG AGAAAAAGGC GGCGAAGGAA AAAGTTGCAC CCAAACCAAC

501   CCCGGAACAA ATCCTCAACA GCGGCAGCAT CGAAAAAGCG CGCAGTGCCG

551   CCGCCAAAGA AGTGCAGAAA ATGAAAACGC CGACAAGGCG GAAGCAACGC

601   ATTATCTGCA AATGGGCGCG TATGCCGACC GTCAGAGCGC GGAAGGGCAG

651   CGTGCCAAAC TGGCAATCTT GGGCATATCT TCCAAGGTGG TCGGTTATCA

701   GGCGGGACAT AAAACGCTTT ACCGGGTGCA AAGCGGCAAT ATGTCTGCCG

751   ATGCGGTGA
```

This corresponds to the amino acid sequence <SEQ ID 1268; ORF 306>:

```
m306.pep (partial)
  1   ..GLFFGLILAT VIIAGILFYL NQSGQNAFKI PASSKQPAET EILKPXNQXK

51   EDIQPXPADQ NALSEPDAAT EAEQSDAEXA ADKQPVADKA DEVEEKAGEP

101   EREEPDGQAV RKKALTEERE QTVREKAQKK DAETVKXQAV KPSKETEKKA

151   SKEEKKAAKE KVAPKPTPEQ ILNSGSIEKA RSAAAKEVQK MKTPTRRKQR

201   IICKWARMPT VRARKGSVPN WQSWAYLPRW SVIRRDIKRF TGCKAAICLP

251   MR*
```

Computer analysis of this amino acid sequence gave the following results:
Homology with a Predicted ORF from *N. gonorrhoeae*
ORF 306 shows 88.9% identity over a 253 aa overlap with a predicted ORF (ORF 306.ng) from *N. gonorrhoeae*:

```
   m306/g306
                          10        20        30        40
      m306.pep            GLFFGLILATVIIAGILFYLNQSGQNAFKIPASSKQPAETEILKPX
                          |:||||||||||||||:||||:|||||||||| ||||||||||
      g306       MFMNKFSQSGKGLSGFFFGLILATVIIAGILLYLNQGGQNAFKIPAPSKQPAETEILKLK
                          10        20        30        40        50        60

50        60        70        80        90       100
      m306.pep   NQXKEDIQPXPADQNALSEPDAATEAEQSDAEXAADKQPVADKADEVEEKAGEPEREEPD
                 || |||||| |||||||||||:|  ||||||||||||||||||||||||||||||||||
      g306       NQPKEDIQPEPADQNALSEPDVAKEAEQSDAEKAADKQPVADKADEVEEKAGEPEREEPD
                          70        80        90       100       110       120

110       120       130       140       150       160
      m306.pep   GQAVRKKALTEEREQTVREKAQKKDAETVKXQAVKPSKETEKKASKEEKKAAKEKVAPKP
                 ||||||||||||||||||||||||||||||  :|||||||||||||||||||||||||
      g306       GQAVRKKALTEEREQTVREKAQKKDAETVKKKAVKPSKETEKKASKEEKKAAKEKVAPKP
                         130       140       150       160       170       180

170       180       190       200       210       220
      m306.pep   TPEQILNSGSIEKARSAAAKEVQKMKTPTRR-KQRIICKWARMPTVRARKGSVPNWQSWA
                 ||||||||  |||||||||||||||||:    : :||||||||:   ||||||||||||
      g306       TPEQILNSRSIEKARSAAAKEVQKMKNFGQGGSQRIICKWARMPNPGARKGSVPNWQSWA
                         190       200       210       220       230       240

230       240       250
      m306.pep   YLPRWSVIRRDIKRFTGCKAAICLPMRX
                 |||:||:||||||||||:||||||||||
      g306       YLPKWSAIRRDIKRFTACKAAICPPMRX
                         250       260
```

The following partial DNA sequence was identified in *N. meningitidis* <SEQ ID 1269>:

```
a306.seq
     1   ATGTTTATGA ACAAATTTTC CCAATCCGGA AAAGGTCTGT CCGGTTTTTT

51   CTTCGGTTTG ATACTGGCGA CGGTCATTAT TGCCGGTATT TTGTTTTATC

101   TGAACCAGAG CGGTCAAAAT GCGTTCAAAA TCCCGGTTCC GTCGAAGCAG

151   CCTGCAGAAA CGGAAATCCT GAAACCGAAA AACCAGCCTA AGGAAGACAT

201   CCAACCTGAA CCGGCCGATC AAAACGCCTT GTCCGAACCG GATGCTGCGA

251   AAGAGGCAGA GCAGTCGGAT GCGGAAAAAG CTGCCGACAA GCAGCCCGTT

301   GCCGACAAAG CCGACGAGGT TGAGGAAAAG GCGGACGAGC CGGAGCGGGA

351   AAAGTCGGAC GGACAGGCAG TGCGCAAGAA AGCACTGACG GAAGAGCGTG

401   AACAAACCGT CGGGGAAAAA GCGCAGAAGA AAGATGCCGA AACGGTTAAA

451   AAACAAGCGG TAAAACCATC TAAAGAAACA GAGAAAAAAG CTTCAAAAGA

501   AGAGAAAAAG GCGGAGAAGG AAAAAGTTGC ACCCAAACCG ACCCCGGAAC

551   AAATCCTCAA CAGCGGCAGC ATCGAAAAAG CGCGCAGTGC CGCTGCCAAA

601   GAAGTGCAGA AAATGAAAAC GCCGACAAGG CGGAAGCAAC GCATTATCTG

651   CAAATGGGCG CGTATGCCGA CCGCCGGAGC GCGGAAGGGC AGCGTGCCAA

701   ACTGGCAATC TTGGGCATAT CTTCCAAGGT GGTCGGTTAT CAGGCGGGAC

751   ATAAAACGCT TTACCGGGTG CAAAGCGGCA ATATGTCTGC CGATGCGGTG

801   A
```

This corresponds to the amino acid sequence <SEQ ID 1270; ORF 306.a>:

```
a306.pep
    1  MFMNKFSQSG KGLSGFFFGL ILATVIIAGI LFYLNQSGQN AFKIPVPSKQ

51  PAETEILKPK NQPKEDIQPE PADQNALSEP DAAKEAEQSD AEKAADKQPV

101  ADKADEVEEK ADEPEREKSD GQAVRKKALT EEREQTVGEK AQKKDAETVK

151  KQAVKPSKET EKKASKEEKK AEKEKVAPKP TPEQILNSGS IEKARSAAAK

201  EVQKMKTPTR RKQRIICKWA RMPTAGARKG SVPNWQSWAY LPRWSVIRRD

251  IKRFTGCKAA ICLPMR*
``` m306/a306 93.7% identity in 252 aa overlap

```
                    10         20         30         40
   m306.pep            GLFFGLILATVIIAGILFYLNQSGQNAFKIPASSKQPAETEILKPX
                       |:||||||||||||||||||||||||||||: |||||||||||||
   a306     MFMNKFSQSGKGLSGFFFGLILATVIIAGILFYLNQSGQNAFKIPVPSKQPAETEILKPX
                   10        20        30        40        50        60
                  50        60        70        80        90        100
   m306.pep  NQXKEDIQPXPADQNALSEPDAATEAEQSDAEXAADKQPVADKADEVEEKAGEPEREEPD
             ||  ||||||  |||||||||||||| ||||||||| |||||||||||||||||| : |
   a306      NQPKEDIQPEPADQNALSEPDAAKEAEQSDAEKAADKQPVADKADEVEEKADEPEREKSD
                    70        80        90       100       110       120
                  110       120       130       140       150       160
   m306.pep   GQAVRKKALTEEREQTVREKAQKKDAETVKXQAVKPSKETEKKASKEEKKAAKEKVAPKP
              |||||||||||||||||| |||||||||| |||||||||||||||||||||||||||||
   a306       GQAVRKKALTEEREQTVGEKAQKKDAETVKGQAVKPSKETEKKASKEEKKAAKEKVAPKP
                    130       140       150       160       170       180
                  170       180       190       200       210       220
   m306.pep   TPEQILNSGSIEKARSAAAKEVQKMKTPTRRKQRIICKWARMPTVRARKGSVPNWQSWAY
              ||||||||||||||||||||||||||||||||||||||||||||: ||||||||||||||
   a306       TPEQILNSGSIEKARSAAAKEVQKMKTPTRRKQRIICKWARMPTAGARKGSVPNWQSWAY
                    190       200       210       220       230       240
                  230       240       250
   m306.pep   LPRWSVIRRDIKRFTGCKAAICLPMRX
              ||||||||||||||||||||||||||
   a306       LPRWSVIRRDIKRFTGCKAAICLPMRX
                    250       260
```

The following partial DNA sequence was identified in *N. gonorrhoeae* <SEQ ID 1271>:

```
g307.seq
    1  atgaaaacct tcttcaaaac cctttcgacc gcgtcactcg cgctcatcct 51  cgcagcctgc ggcggtcaaa aagacagcgc gcccgcagcc tctgccgccg 101  cccttctgc cgataacggc gcggcgaaaa aagaaatcgt cttcggcacg 151  accgtgggcg acttcggcga tatggtcaaa gaacaaatcc aagccgagct 201  ggagaaaaaa ggctacaccg tcaaattggt cgaatttacc gactatgtgc 251  gcccgaatct ggcattggcg gagggcgagt ggacatcaa cgtcttccaa 301  cacaaaccct atcttgacga tttcaaaaaa gaacacaacc tggacatcac 351  cgaagccttc caagtgccga ccgcgccttt gggactgtat ccgggcaaac 401  tgaaatcgct ggaagaagtc aaagacggca gcaccgtatc cgcgcccaac 451  gacccgtcca acttcgcacg cgccttggtg atgctgaacg aactgggttg 501  gatcaaactc aaagacggca tcaatccgct gaccgcatcc aaagccgaca 551  tcgcggaaaa cctgaaaaac atcaaaatcg tcgagcttga agccgcacaa 601  ctgccgcgca gccgcgccga cgtggatttt gccgtcgtca cggcaacta 651  cgccataagc agcggcatga agctgaccga agccctgttc caagagccga 701  gctttgccta tgtcaactgg tctgccgtca aaccgccga caaagacagc
```

```
-continued
751  caatggctta aagacgtaac cgaggcctat aactccgacg cgttcaaagc 801  ctacgcgcac aaacgcttcg agggctacaa atacccctgcc gcatggaatg 851  aaggcgcagc caaataa
```

This corresponds to the amino acid sequence <SEQ ID 1272; ORF 307.ng>:

```
g307.pep
    1  MKTFFKTLST ASLALILAAC GGQKDSAPAA SAAAPSADNG AAKKEIVFGT

51  TVGDFGDMVK EQIQAELEKK GYTVKLVEFT DYVRPNLALA EGELDINVFQ

101  HKPYLDDFKK EHNLDITEAF QVPTAPLGLY PGKLKSLEEV KDGSTVSAPN

151  DPSNFARALV MLNELGWIKL KDGINPLTAS KADIAENLKN IKIVELEAAQ

201  LPRSRADVDF AVVNGNYAIS SGMKLTEALF QEPSFAYVNW SAVKTADKDS

251  QWLKDVTEAY NSDAFKAYAH KRFEGYKYPA AWNEGAAK*
```

The following partial DNA sequence was identified in *N. meningitidis* <SEQ ID 1273>:

```
m307.seq (partial)
    1  ..CAATGGCTTA AAGACGTAAC CGAGGCCTAT AACTCCGACG CGTTCAAAGC

51   CTACGCGCAC AAACGCTTCG AGGGCTACAA ATCCCCTGCC GCATGGAATG

101   AAGGCGCAGC CAAATAA
```

This corresponds to the amino acid sequence <SEQ ID 1274; ORF 307>:

```
m307.pep (partial)
    1  ..QWLKDVTEAY NSDAFKAYAH KRFEGYKSPA AWNEGAAK*
```

Computer analysis of this amino acid sequence gave the following results:

Homology with a Predicted ORF from *N. gonorrhoeae*

ORF 307 shows 97.4% identity over a 38 aa overlap with a predicted ORF (ORF 307.ng) from *N. gonorrhoeae*:

```
m307/g307
                                            10         20         30
     m307.pep                         QWLKDVTEAYNSDAFKAYAHKRFEGYKSPA
                                      |||||||||||||||||||||||||||| ||
     g307         SGMKLTEALFQEPSFAYVNWSAVKTADKDSQWLKDVTEAYNSDAFKAYAHKRFEGYKPA
                          230       240       250       260       270       280
                       39
     m307.pep    AWNEGAAKX
                 |||||||||
     g307        AWNEGAAKX
```

The following partial DNA sequence was identified in *N. meningitidis* <SEQ ID 1275>:

```
a307.seq
    1  ATGAAAACCT TCTTCAAAAC CCTTTCCGCC GCCGCACTCG CGCTCATCCT

51  CGCCGCCTGC GGCGGTCAAA AAGATAGCGC GCCCGCCGCA TCCGCTTCTG

101  CCGCCGCCGA CAACGGCGCG GCGAAAAAAG NAATCGTCTT CGGCACGACC

151  GTCGGCGACT TCGGCGATAT GGTCAAAGAA CAAATCCAAC CCGAGCTGGA
```

```
201  GAAAAAAGGC TACACCGTCA AACTGGTCGA GTTTACCGAC TATGTGCGCC

251  CGAATCTGGC ATTGGCTGAG GGCGAGTNGG ACATCAACGT CTTCCAACAC

301  AAACCCTATC TTGACGACTT CAAAAAAGAA CACAATCTGG ACATCACCGA

351  AGTCTTCCAA GTGCCGACCG CGCCTTTGGG ACTGTACCCG GGCAAGCTGA

401  AATCGCTGGA AGAAGTCAAA GACGGCAGCA CCGTATCCGC GCCCAACGAC

451  CCGTCCAACT TCGCCCGCGT CTTGGTGATG CTCGACGAAC TGGGTTGGAT

501  CAAACTCAAA GANGGCATCA ATCCGCTGAC CGCATCCAAA GCGGACATTG

551  CCGAAAACCT GAAAAACATC AAAATCGTCG AGCTTGAAGC CGCGCAACTG

601  CCGCGTAGCC GCGCCGACGT GGATTTTGNC GTCGTCAACG GCAANTACGC

651  CATAAGCAGC GGCATGAAGC TGACCGAAGC CCTGTTCCAA GAACCGAGCT

701  TTGCCTATGT CAACTGGTCT GCCGTCAAAA CCGCCGACAA AGACAGCCAA

751  TGGCTTAAAG ACGTAACCGA GGCCTATAAC TCCGACGCGT TCAAAGCCTA

801  CGCGCACAAA CGCTTCGAGG GCTACAAATC CCCTGCCGCA TGGAATGAAG

851  GCGCAGCCAA ATAA
```

This corresponds to the amino acid sequence <SEQ ID 1276; ORF 307.a>:

```
a307.pep
    1   MKTFFKTLSA AALALILAAC GGQKDSAPAA SASAAADNGA AKKXIVFGTT

51   VGDFGDMVKE QIQPELEKKG YTVKLVEFTD YVRPNLALAE GEXDINVFQH

101   KPYLDDFKKE HNLDITEVFQ VPTAPLGLYP GKLKSLEEVK DGSTVSAPND

151   PSNFARVLVM LDELGWIKLK XGINPLTASK ADIAENLKNI KIVELEAAQL

201   PRSRADVDFX VVNGXYAISS GMKLTEALFQ EPSFAYVNWS AVKTADKDSQ

251   WLKDVTEAYN SDAFKAYAHK RFEGYKSPAA WNEGAAK*
``` m307/a307 100.0% identity in 38 aa overlap

```
                                   10        20        30
   m307.pep                QWLKDVTEAYNSDAFKAYAHKRFEGYKSPA
                           ||||||||||||||||||||||||||||||
   a307      SGMKLTEALFQEPSFAYVNWSAVKTADKDSQWLKDVTEAYNSDAFKAYAHKRFEGYKSPA
                220       230       240       250       260       270
                      39
   m307.pep    AWNEGAAKX
              |||||||||
   a307        AWNEGAAKX
                280
```

The following partial DNA sequence was identified in *N. gonorrhoeae* <SEQ ID 1277>:

```
g308.seq
    1   ATGTTAAATC GGGTATTTTA TCGGATATTG GGTGTTGCCG ACAATTTGTA

51   TCCGTGTTTA TCGGATTTCT GTTTTTTCAC TATAATAGCC GGTTTGCCGT

101   TGCAGGCGGT TTTATGGGAA AGGCGGATGA TGGTACGGCG TTTGATAATC

151   GGCATCAGCG GGGCGAGCGG TTTCCAATAC GGCGTGAAGG CTTTGGAACT

201   TTTGCGCGCG CAAGATGTCG AAACGCACCT TGTGGTATCG AAAGGCGCGG

251   AGATGGCGCG CGCTTCGGAA ACGGATTATA CGAAAGACGA AGTATATGCC
```

-continued

```
301   TTGGCTGATT TCGTCCATCC GATCGGCAAT ATCGGGGCGT GCATTGCCAG
351   CGGTACGTTT AAAACGGACG GGATGCTGGT CGCACCCTGT TCGATGCGGA
401   CGCTTGCCTC TGTCGCGCAC GGCTTCGGCG ACAACCTCTT GACGCGTGCG
451   GCGGATGTGG TTTTGAAGGA AAGGCGGCGG CTGGTGCTGA TGGTGCGCGA
501   AACGCCGCTG AACCTTGCCC ATTTGGACAA TATGAAGCGG GTAACGGAAA
551   TGGGCGGCGT GGTGTTTCCC CCTGTTCCTG CGATGTACCG CAAGCCGCAG
601   ACGGCGGACG ACATAGTGGC GCACAGTATC GCACACACGC TGTCGCTGTT
651   CGGAATCGAT ACGCCGGATT TGGCGGAATG GCAGGGAATG GCGGATTAA
                                                                15
```

This corresponds to the amino acid sequence <SEQ ID 1278; ORF 308.ng>:

```
g308.pep
    1   MLNRVFYRIL GVADNLYPCL SDFCFFTIIA GLPLQAVLWE RRMMVRRLII
   51   GISGASGFQY GVKALELLRA QDVETHLVVS KGAEMARASE TDYTKDEVYA
  101   LADFVHPIGN IGACIASGTF KTDGMLVAPC SMRTLASVAH GFGDNLLTRA
  151   ADVVLKERRR LVLMVRETPL NLAHLDNMKR VTEMGGVVFP PVPAMYRKPQ
  201   TADDIVAHSI AHTLSLFGID TPDLAEWQGM AD*
```

The following partial DNA sequence was identified in *N. meningitidis* <SEQ ID 1279>:

```
m308.seq (partial)
    1   ATGTTAAATC GGGTATTTTA TCGGATATTG GGTGTTGCCG ACAATTTGTA
   51   TCCGCGTTTA TCGGATTTCT GTTTTTTCAC TATAATAGCC GGTTTGCCGT
  101   TGCAGGCGGT TTTATGGGAA AGGCGGATGA TGGTACGGCG TTTGATAATC
  151   GGCATCAGCG GGGCGAGCGG TTTCCAATAC GGCGTGAAGG CTTTGGAACT
  201   TTTGCGCGCG CAAGATGTCG AAACGCACCT TGTGGTATCG AAAGGTGCGG
  251   AGATGGCGCG CGCTTCGGAA ACGGCTTATG CGAGAGACGA GGTATATGCC
  301   TTGGCGGACT TCGTGCATCC GATCGGCAAT ATCGGGGCGT GCATTGCCAG
  351   CGGTACGTTT AAAACGGATG GGATGCTGGT CGCCCCCTGT TCGATGCGGA
  401   CGCTTGCCTC TGTCGCGCAC GGCTTCGGCG ACAATCTGcT GACGCGtGCG
  451   GCGGATGTGG TTTTGAAGGA AAGGCGGCGG CTGGTGCTGA TGGTGCGCGA
  501   AACGCCGCTG AACCTTGCCC ATTTGGACAA TATGAAGCGG GwAACGGAAA
  551   TGGGCGGCGT GGTGTTTCCC CCTGTTCCTG CGATGTACCG CAAACCGCAG
  601   ACGGCGGACG ACATAGTGGC GCACAGTGTT GCACACGCtT TGTCGCTGTT
  651   CGGAATCGAT ACGCCGGATT CGGCGGAATG GCArGGAATG gcG...
```

This corresponds to the amino acid sequence <SEQ ID 1280; ORF 308>:

```
m308.pep (partial)
    1   MLNRVFYRIL GVADNLYPRL SDFCFFTIIA GLPLQAVLWE RRMMVRRLII
   51   GISGASGFQY GVKALELLRA QDVETHLVVS KGAEMARASE TAYARDEVYA
  101   LADFVHPIGN IGACIASGTF KTDGMLVAPC SMRTLASVAH GFGDNLLTRA
```

```
151  ADVVLKERRR LVLMVRETPL NLAHLDNMKR XTEMGGVVFP PVPAMYRKPQ

201  TADDIVAHSV AHALSLFGID TPDSAEWQGM A..
```

Computer analysis of this amino acid sequence gave the following results:
Homology with a Predicted ORF from *N. gonorrhoeae*
ORF 308 shows 96.5% identity over a 231 aa overlap with a predicted ORF (ORF 308.ng) from *N. gonorrhoeae*:

```
                    10         20         30         40         50         60
   m308.pep  MLNRVFYRILGVADNLYPRLSDFCFFTIIAGLPLQAVLWERRMMVRRLIIGISGASGFQY
             ||||||||||||||||||| ||||||||||||||||||||||||||||||||||||||||
       g308  MLNRVFYRILGVADNLYPCLSDFCFFTIIAGLPLQAVLWERRMMVRRLIIGISGASGFQY
                    10         20         30         40         50         60

70         80         90        100        110        120
   m308.pep  GVKALELLRAQDVETHLVVSKGAEMARASETAYARDEVYALADFVHPIGNIGACIASGTF
             ||||||||||||||||||||||||||||||||| ::||||||||||||||||||||||||
       g308  GVKALELLRAQDVETHLVVSKGAEMARASETDYTKDEVYALADFVHPIGNIGACIASGTF
                    70         80         90        100        110        120

130        140        150        160        170        180
   m308.pep  KTDGMLVAPCSMRTLASVAHGFGDNLLTRAADVVLKERRRLVLMVRETPLNLAHLDNMKR
             ||||||||||||||||||||||||||||||||||||||||||||||||||||||||||||
       g308  KTDGMLVAPCSMRTLASVAHGFGDNLLTRAADVVLKERRRLVLMVRETPLNLAHLDNMKR
                   130        140        150        160        170        180

190        200        210        220        230
   m308.pep  XTEMGGVVFPPVPAMYRKPQTADDIVAHSVAHALSLFGIDTPDSAEWQGMA
              |||||||||||||||||||||||||||||:||:||||||||| ||||||||
       g308  VTEMGGVVFPPVPAMYRKPQTADDIVAHSIAHTLSLFGIDTPDLAEWQGMADX
                   190        200        210        220        230
```

The following partial DNA sequence was identified in *N. meningitidis* <SEQ ID 1281>:

```
a308.seq
    1  ATGTTAAATC GGATATTTTA TCGGATATTG GGTGTTGCCG ACAATTTGTA

51  TCCGTATTTA TCGGATTTCT GTTTTTTCAC TATAATAGCC GGTTTGCCGT

101  TGCAGGCGGT TTTATGGGAA AGGCGGATGA TGGTACGGCG TTTGATAATC

151  GGCATCAGTG GGGCGAGCGG TTTCCAATAC GGCGTGAAGG CTTTGGANCT

201  TTTACGCGCG CAAGATATCG AAACGCACCT TGTGGTATCG AAAGGTGCGG

251  AGATGGCGCG CGCTTCGGAA ACGGNTTATG CGAGAGACGA NGTATATGCC

301  TTGGCGGACT TNGTGCATCC GATCGGCAAT ATCGGGGCGT GCATTGCCAG

351  CGGTACGTTT AAAACGGACG GGATGCTGGT CGCCCCCTGT TCGATGCGGA

401  CGCTTGCCTC GGTCGTGCAC GGCTTCGGCG ACAACCTCTT GACGCGTGCG

451  GCGGATGTGG TTTTGAAGGA AAGGCGGCGG CTGGTGCTGA TGGTGCGCGA

501  AACGCCGCTG AACCTTGCCC ATTTGGACAA TATGAANCGG GTAACGGAAA

551  TGGGCGGCGT GGTGTTTCCC CCTGTTCCTG CGATGTACCG CAAACCGCAG

601  ACGGCGGACG ACATAGTGGC GCACAGTGTT GCACACGCTT TGTCGCTGTT

651  CGGAATCGAT ACGCCGGATT CGGCGAATG  GCAGGGAATG GCGGATTAA
```

This corresponds to the amino acid sequence <SEQ ID 1282; ORF 308.a>:

```
a308.pep
    1  MLNRIFYRIL GVADNLYPYL SDFCFFTIIA GLPLQAVLWE RRMMVRRLII

51  GISGASGFQY GVKALXLLRA QDIETHLVVS KGAEMARASE TXYARDXVYA
```

```
-continued
101   LADXVHPIGN IGACIASGTF KTDGMLVAPC SMRTLASVVH GFGDNLLTRA

151   ADVVLKERRR LVLMVRETPL NLAHLDNMXR VTEMGGVVFP PVPAMYRKPQ

201   TADDIVAHSV AHALSLFGID TPDSAEWQGM AD*
``` m308/a308 95.7% identity in 231 aa overlap

```
                  10         20         30         40         50         60
m308.pep  MLNRVFYRILGVADNLYPRLSDFCFFTIIAGLPLQAVLWERRMMVRRLIIGISGASGFQY
          |||| :|||||||||||| |||||||||||||||||||||||||||||||||||||||||
a308      MLNRIFYRILGVADNLYPYLSDFCFFTIIAGLPLQAVLWERRMMVRRLIIGISGASGFQY
                  10         20         30         40         50         60

70         80         90        100        110        120
m308.pep  GVKALELLRAQDVETHLVVSKGAEMARASETAYARDEVYALADFVHPIGNIGACIASGTF
          ||||| |||||| :|||||||||||||||||| |||| |||| ||||||||||||||||
a308      GVKALXLLRAQDIETHLVVSKGAEMARASETXYARDXVYALADXVHPIGNIGACIASGTF
                  70         80         90        100        110        120

130        140        150        160        170        180
m308.pep  KTDGMLVAPCSMRTLASVAHGFGDNLLTRAADVVLKERRRLVLMVRETPLNLAHLDNMKR
          ||||||||||||||||||: |||||||||||||||||||||||||||||||||||||| |
a308      KTDGMLVAPCSMRTLASVVHGFGDNLLTRAADVVLKERRRLVLMVRETPLNLAHLDNMXR
                  130        140        150        160        170        180

190        200        210        220        230
m308.pep  XTEMGGVVFPPVPAMYRKPQTADDIVAHSVAHALSLFGIDTPDSAEWQGMA
          |||||||||||||||||||||||||||||||||||||||||||||||||||
a308      VTEMGGVVFPPVPAMYRKPQTADDIVAHSVAHALSLFGIDTPDSAEWQGMADX
                  190        200        210        220        230
```

The following partial DNA sequence was identified in *N. gonorrhoeae* <SEQ ID 1283>:

```
g308-1.seq
     1   ATGTTAAATC GGGTATTTTA TCGGATATTG GGTGTTGCCG ACAATTTGTA

51   TCCGTGTTTA TCGGATTTCT GTTTTTTCAC TATAATAGCC GGTTTGCCGT

101   TGCAGGCGGT TTTATGGGAA AGGCGGATGA TGGTACGGCG TTTGATAATC

151   GGCATCAGCG GGGCGAGCGG TTTCCAATAC GGCGTGAAGG CTTTGGAACT

201   TTTGCGCGCG CAAGATGTCG AAACGCACCT TGTGGTATCG AAAGGCGCGG

251   AGATGGCGCG CGCTTCGGAA ACGGATTATA CGAAAGACGA AGTATATGCC

301   TTGGCTGATT TCGTCCATCC GATCGGCAAT ATCGGGGCGT GCATTGCCAG

351   CGGTACGTTT AAAACGGACG GGATGCTGGT CGCACCCTGT TCGATGCGGA

401   CGCTTGCCTC TGTCGCGCAC GGCTTCGGCG ACAACCTCTT GACGCGTGCG

451   GCGGATGTGG TTTTGAAGGA AAGGCGGCGG CTGGTGCTGA TGGTGCGCGA

501   AACGCCGCTG AACCTTGCCC ATTTGGACAA TATGAAGCGG GTAACGGAAA

551   TGGGCGGCGT GGTGTTTCCC CCTGTTCCTG CGATGTACCG CAAGCCGCAG

601   ACGGCGGACG ACATAGTGGC GCACAGTATC GCACACACGC TGTCGCTGTT

651   CGGAATCGAT ACGCCGGATT GGCGGAATG GCAGGGAATG GCGGATTAA
```

This corresponds to the amino acid sequence <SEQ ID 1284; ORF 308-1.ng>:

```
g308-1.pep
     1      MLNRVFYRIL GVADNLYPCL SDFCFFTIIA GLPLQAVLWE RRMMVRRLII

51      GISGASGFQY GVKALELLRA QDVETHLVVS KGAEMARASE TDYTKDEVYA

101      LADFVHPIGN IGACIASGTF KTDGMLVAPC SMRTLASVAH GFGDNLLTRA
```

```
151     ADVVLKERRR LVLMVRETPL NLAHLDNMKR VTEMGGVVFP PVPAMYRKPQ

201     TADDIVAHSI AHTLSLFGID TPDLAEWQGM AD*
```

The following partial DNA sequence was identified in *N. meningitidis* <SEQ ID 1285>:

```
m308-1.seq
    1     ATGTTAAATC GGGTATTTTA TCGGATATTG GGTGTTGCCG ACAATTTGTA

51     TCCGCGTTTA TCGGATTTCT GTTTTTTCAC TATAATAGCC GGTTTGCCGT

101     TGCAGGCGGT TTTATGGGAA AGGCGGATGA TGGTACGGCG TTTGATAATC

151     GGCATCAGCG GGGCGAGCGG TTTCCAATAC GGCGTGAAGG CTTTGGAACT

201     TTTGCGCGCG CAAGATGTCG AAACGCACCT TGTGGTATCG AAAGGTGCGG

251     AGATGGCGCG CGCTTCGGAA ACGGCTTATG CGAGAGACGA GGTATATGCC

301     TTGGCGGACT TCGTGCATCC GATCGGCAAT ATCGGGCGT GCATTGCCAG

351     CGGTACGTTT AAAACGGATG GGATGCTGGT CGCCCCCTGT TCGATGCGGA

401     CGCTTGCCTC TGTCGCGCAC GGCTTCGGCG ACAATCTGCT GACGCGTGCG

451     GCGGATGTGG TTTTGAAGGA AAGGCGGCGG CTGGTGCTGA TGGTGCGCGA

501     AACGCCGCTG AACCTTGCCC ATTTGGACAA TATGAAGCGG GTAACGGAAA

551     TGGGCGGCGT GGTGTTTCCC CCTGTTCCTG CGATGTACCG CAAACCGCAG

601     ACGGCGGACG ACATAGTGGC GCACAGTGTT GCACACGCTT TGTCGCTGTT

651     CGGAATCGAT ACGCCGGATT CGGCGGAATG GCAGGGAATG GCGGATTAA
```

This corresponds to the amino acid sequence <SEQ ID 1286; ORF 308-1>:

```
m308-1.pep
    1     MLNRVFYRIL GVADNLYPRL SDFCFFTIIA GLPLQAVLWE RRMMVRRLII

51     GISGASGFQY GVKALELLRA QDVETHLVVS KGAEMARASE TAYARDEVYA

101     LADFVHPIGN IGACIASGTF KTDGMLVAPC SMRTLASVAH GFGDNLLTRA

151     ADVVLKERRR LVLMVRETPL NLAHLDNMKR VTEMGGVVFP PVPAMYRKPQ

201     TADDIVAHSV AHALSLFGID TPDSAEWQGM AD*
``` m308-1/g308-1 97.0% identity in 232 aa overlap

```
                   10         20         30         40         50         60
m308-1.pep  MLNRVFYRILGVADNLYPRLSDFCFFTIIAGLPLQAVLWERRMMVRRLIIGISGASGFQY
            ||||||||||||||||||| ||||||||||||||||||||||||||||||||||||||||
g308-1      MLNRVFYRILGVADNLYPCLSDFCFFTIIAGLPLQAVLWERRMMVRRLIIGISGASGFQY
                   10         20         30         40         50         60

70         80         90        100        110        120
m308-1.pep  GVKALELLRAQDVETHLVVSKGAEMARASETAYARDEVYALADFVHPIGNIGACIASGTF
            |||||||||||||||||||||||||||||||| ::||||||||||||||||||||||||
g308-1      GVKALELLRAQDVETHLVVSKGAEMARASETDYTKDEVYALADFVHPIGNIGACIASGTF
                   70         80         90        100        110        120

130        140        150        160        170        180
m308-1.pep  KTDGMLVAPCSMRTLASVAHGFGDNLLTRAADVVLKERRRLVLMVRETPLNLAHLDNMKR
            ||||||||||||||||||||||||||||||||||||||||||||||||||||||||||||
g308-1      KTDGMLVAPCSMRTLASVAHGFGDNLLTRAADVVLKERRRLVLMVRETPLNLAHLDNMKR
                  130        140        150        160        170        180

190        200        210        220        230
m308-1.pep  VTEMGGVVFPPVPAMYRKPQTADDIVAHSVAHALSLFGIDTPDSAEWQGMADX
            ||||||||||||||||||||||||||||| :|||||||||| |||||||||
g308-1      VTEMGGVVFPPVPAMYRKPQTADDIVAHSIAHTLSLFGIDTPDLAEWQGMADX
                  190        200        210        220        230
```

The following partial DNA sequence was identified in *N. meningitidis* <SEQ ID 1287>:

```
a308-1.seq
     1   ATGTTAAATC GGATATTTTA TCGGATATTG GGTGTTGCCG ACAATTTGTA

51   TCCGTATTTA TCGGATTTCT GTTTTTTCAC TATAATAGCC GGTTTGCCGT

101   TGCAGGCGGT TTTATGGGAA AGGCGGATGA TGGTACGGCG TTTGATAATC

151   GGCATCAGTG GGGCGAGCGG TTTCCAATAC GGCGTGAAGG CTTTGGANCT

201   TTTACGCGCG CAAGATATCG AAACGCACCT TGTGGTATCG AAAGGTGCGG

251   AGATGGCGCG CGCTTCGGAA ACGGNTTATG CGAGAGACGA NGTATATGCC

301   TTGGCGGACT TNGTGCATCC GATCGGCAAT ATCGGGGCGT GCATTGCCAG

351   CGGTACGTTT AAAACGGACG GGATGCTGGT CGCCCCCTGT TCGATGCGGA

401   CGCTTGCCTC GGTCGTGCAC GGCTTCGGCG ACAACCTCTT GACGCGTGCG

451   GCGGATGTGG TTTTGAAGGA AAGGCGGCGG CTGGTGCTGA TGGTGCGCGA

501   AACGCCGCTG AACCTTGCCC ATTTGGACAA TATGAANCGG GTAACGGAAA

551   TGGGCGGCGT GGTGTTTCCC CCTGTTCCTG CGATGTACCG CAAACCGCAG

601   ACGGCGGACG ACATAGTGGC GCACAGTGTT GCACACGCTT TGTCGCTGTT

651   CGGAATCGAT ACGCCGGATT CGGCGGAATG GCAGGGAATG GCGGATTAA
```

This corresponds to the amino acid sequence <SEQ ID 1288; ORF 308-1.a>:

```
a308-1.pep
     1   MLNRIFYRIL GVADNLYPYL SDFCFFTIIA GLPLQAVLWE RRMMVRRLII

51   GISGASGFQY GVKALXLLRA QDIETHLVVS KGAEMARASE TXYARDXVYA

101   LADXVHPIGN IGACIASGTF KTDGMLVAPC SMRTLASVVH GFGDNLLTRA

151   ADVVLKERRR LVLMVRETPL NLAHLDNMXR VTEMGGVVFP PVPAMYRKPQ

201   TADDIVAHSV AHALSLFGID TPDSAEWQGM AD*
``` a308-1/m308-1 96.1% identity in 232 aa overlap

```
                  10        20        30        40        50        60
a308-1    MLNRIFYRILGVADNLYPYLSDFCFFTIIAGLPLQAVLWERRMMVRRLIIGISGASGFQY
          ||||:||||||||||||| |||||||||||||||||||||||||||||||||||||||||
m308-1    MLNRVFYRILGVADNLYPRLSDFCFFTIIAGLPLQAVLWERRMMVRRLIIGISGASGFQY
                  10        20        30        40        50        60

70        80        90       100       110       120
a308-1    GVKALXLLRAQDIETHLVVSKGAEMARASETXYARDXVYALADXVHPIGNIGACIASGTF
          ||||| ||||||:|||||||||||||||||| |||| |||||| ||||||||||||||||
m308-1    GVKALELLRAQDVETHLVVSKGAEMARASETAYARDEVYALADFVHPIGNIGACIASGTF
                  70        80        90       100       110       120

130       140       150       160       170       180
a308-1    KTDGMLVAPCSMRTLASVVHGFGDNLLTRAADVVLKERRRLVLMVRETPLNLAHLDNMXR
          |||||||||||||||||:|||||||||||||||||||||||||||||||||||||||| |
m308-1    KTDGMLVAPCSMRTLASVAHGFGDNLLTRAADVVLKERRRLVLMVRETPLNLAHLDNMKR
                 130       140       150       160       170       180

190       200       210       220       230
a308-1    VTEMGGVVFPPVPAMYRKPQTADDIVAHSVAHALSLFGIDTPDSAEWQGMADX
          ||||||||||||||||||||||||||||||||||||||||||||||||||||
m308-1    VTEMGGVVFPPVPAMYRKPQTADDIVAHSVAHALSLFGIDTPDSAEWQGMADX
                 190       200       210       220       230
```

The following partial DNA sequence was identified in *N. gonorrhoeae* <SEQ ID 1289>:

g311.seq
```
   1  atgttcagtt tcggctgggc gtttgaccgc ccgcagtatg agttgggttc
  51  gctgtcgcct gttgcggcac ttgcgtgccg gcgcgctttg ggtgtttgg
 101  gtttggaaac gcaaatcaag tggccaaacg atttggtcgt cggacgcgac
 151  aaattgggcg gcattctgat tgaaacagtc agggcgggcg gtaaaacggt
 201  tgccgtggtc ggtatcggca tcaatttcgt gctgcccaag gaagtggaaa
 251  acgccgcttc cgtgcagtcg ctgtttcaga cggcatcgcg gcggggcaat
 301  gccgatgccg ccgtattgct ggaaacattg cttgcggaac tgggcgcggt
 351  gttggaacaa tatgcggaag aagggttcgc gccattttta aatgagtatg
 401  aaacggccaa ccgcgaccac ggcaaggcgg tattgctgtt gcgcgacggc
 451  gaaaccgtgt gcgaaggcac ggttaaaggc gtggacggac gaggcgttct
 501  gcacttggaa acggcagaag gcaacagac ggtcgtcagc ggcgaaatca
 551  gcctgcggcc cgacaacagg tcggtttccg tgccgaagcg gccggattcg
 601  gaacgttttt tgctgttgga aggcgggaac agccggctca gtgggcgtg
 651  ggtggaaaac ggcacgttcg caaccgtggg cagcgcgccg taccgcgatt
 701  tgtcgccttt gggcgcggag tgggcggaaa aggcggatgg aaatgtccgc
 751  atcgtcggtt gcgccgtgtg cggagaatcc aaaaaggcac aagtgaagga
 801  acagctcgcc cgaaaaatcg agtggctgcc gtcttccgca caggctttgg
 851  gcatacgcaa ccactaccgc cacccccgaag aacacggttc cgaccgttgg
 901  ttcaacgcct tgggcagccg ccgcttcagc cgcaacgcct gcgtcgtcgt
 951  cagttgcggc acggcggtaa cggttgacgc gctcaccgat gacggacatt
1001  atctcggcgg aaccatcatg cccggcttcc acctgatgaa agaatcgctc
1051  gccgtccgaa ccgccaacct caaccgcccc gccggcaaac gttaccctt
1101  cccgaccaca acgggcaacg ccgtcgcaag cggcatgatg gacgcggttt
1151  gcggctcgat aatgatgatg cacggccgtt tgaaagaaaa aaacggcgcg
1201  ggcaagcctg tcgatgtcat cattaccggg gcggcgcgg cgaaagtcgc
1251  cgaagccctg ccgcctgcat ttttggcgga aaataccgtg cgcgtggcgg
1301  acaacctcgt catccacggg ctgctgaacc tgattgccgc cgaaggcggg
1351  gaatcggaac acgcttaa
```

This corresponds to the amino acid sequence <SEQ ID 1290; ORF 311.ng>:

g311.pep
```
   1  MFSFGWAFDR PQYELGSLSP VAALACRRAL GCLGLETQIK WPNDLVVGRD
  51  KLGGILIETV RAGGKTVAVV GIGINFVLPK EVENAASVQS LFQTASRRGN
 101  ADAAVLLETL LAELGAVLEQ YAEEGFAPFL NEYETANRDH GKAVLLLRDG
 151  ETVCEGTVKG VDGRGVLHLE TAEGEQTVVS GEISLRPDNR SVSVPKRPDS
 201  ERFLLLEGGN SRLKWAWVEN GTFATVGSAP YRDLSPLGAE WAEKADGNVR
 251  IVGCAVCGES KKAQVKEQLA RKIEWLPSSA QALGIRNHYR HPEEHGSDRW
 301  FNALGSRRFS RNACVVVSCG TAVTVDALTD DGHYLGGTIM PGFHLMKESL
 351  AVRTANLNRP AGKRYPFPTT TGNAVASGMM DAVCGSIMMM HGRLKEKNGA
```

-continued

```
401   GKPVDVIITG GGAAKVAEAL PPAFLAENTV RVADNLVIHG LLNLIAAEGG

451   ESEHA*
```

The following partial DNA sequence was identified in *N. meningitidis* <SEQ ID 1291>:

```
m311.seq (partial)
   1  ATGTTCAGTT TTGGCTGGGT GTTTGACCGG CCGCAGTATG AGTTGGGTTC

51  GCTGTCGCCT GTTGCGGCAG TGGCGTGTCG GCGCGCCTTG TCGCGTTTAG

101  GTTTGGATGT GCArATTAAG TGGCCCAATG ATTTGGTTGT CGGACGCGAC

151  AAATTGGGCG GCATTCTGAT TGAAACGGTC AGGACGGGCG GCAAAACGGT

201  TGCCGTGGTC GGTATCGGCA TCAATTTTGT CCTGCCCAAn GAAGTAGAAA

251  ATGCCGCTTC CGTGCAATCG CTGTTTCAGA CGGCATCGCG GCGGGGCAAT

301  GCCGATGCCG CCGTGCTGCT nnnnnnnnnn nnnnnnnnnn nnnnGGAAAT

351  CAGCCTGCGG TCCGACnACA GGCCGGTTTC CGTGnCGAAG CGGCGGGATT

401  CGGAACGTTT TCTGCTGTTG GACGGCGGCA ACAGCCGGCT CAAGTGGgCG

451  TGGGTGGAAA ACGGCACGTT CGCAACCGTC GGTAGCGCGC CGTACCgCGA

501  TTTGTCGCCT TTGGGCGCGG AGTGGGCGGA AAAGGCGGAT GGAAATGTCC

551  GCATCGTCGG TTGCGCTGTG TGCGGAGAAT TCAAAAAGGC ACAAGTGCAG

601  GAACAGCTCG CCCGAAAAAT CGAGTGGCTG CCGTCTTCCG CACAGGCTTT

651  GTTTGGCATA CGCAACCACT ACCGCCACCC CGAAGAACAC GGTTCCGACC

701  GCTGGTTCAA CGCCTTGGGC AGCCGCCGCT TCAGCCGCAA CGCyTGCGTC

751  GTCGTCAGTT GCGGCACGGC GGTAACGGTT GACGCGCTCA CCGATGACGG

801  ACATTATCTC GGrgGAACCA TCATGCCCGG TTTCCACCTG ATGAAAGAAT

851  CGCTCGCCGT CCGAACCGCC AACCTCAACC GGCACGCCGG TAAGCGTTAT

901  CCTTTCCCGA CCACAACGGG CAATGCCGTC GCCAGCGGCA TGATGGATGC

951  GGTTTGCGGC TCGGTTATGA TGATGCACGG GCGTTTGAAA GAAAAAACCG

1001  GGGCGGGCAA GCCTGTCGAT GTCATCATTA CCGGCGGCGG CGCGGCAAAA

1051  GTTGCCGAAG CCCTGCCGCC TGCATTTTTG GCGGAAAATA CCGTGCGCGT

1101  GGCGGACAAC CTCGTCATTT ACGGGTTGTT GAACATGATT GCCGCCGAAG

1151  GCAGGGAATA TGAACAT....
```

This corresponds to the amino acid sequence <SEQ ID 1292; ORF 311>:

```
m311.pep (partial)
   1  MFSFGWVFDR PQYELGSLSP VAAVACRRAL SRLGLDVQIK WPNDLVVGRD

51  KLGGILIETV RTGGKTVAVV GIGINFVLPX EVENAASVQS LFQTASRRGN

101  ADAAVLLXXX XXXXXEISLR SDXRPVSVXK RRDSERFLLL DGGNSRLKWA

151  WVENGTFATV GSAPYRDLSP LGAEWAEKAD GNVRIVGCAV CGEFKKAQVQ

201  EQLARKIEWL PSSAQALFGI RNHYRHPEEH GSDRWFNALG SRRFSRNACV

251  VVSCGTAVTV DALTDDGHYL GGTIMPGFHL MKESLAVRTA NLNRHAGKRY

301  PFPTTTGNAV ASGMMDAVCG SVMMMHGRLK EKTGAGKPVD VIITGGGAAK

351  VAEALPPAFL AENTVRVADN LVIYGLLNMI AAEGREYEH....
```

Computer analysis of this amino acid sequence gave the following results:
Homology with a Predicted ORF from N. gonorrhoeae
ORF 311 shows 78.5% identity over a 455 aa overlap with a predicted ORF (ORF 311.ng) from N. gonorrhoeae:

```
m311/g311
                  10         20         30         40         50         60
m311.pep  MFSFGWVFDRPQYELGSLSPVAAVACRRALSRLGLDVQIKWPNDLVVGRDKLGGILIETV
          ||||||:||||||||||||||:||||||:|||::|||||||||||||||||||||||||
g311      MFSFGWAFDRPQYELGSLSPVAALACRRALGCLGLETQIKWPNDLVVGRDKLGGILIETV
                  10         20         30         40         50         60

70         80         90        100        110
m311.pep  RTGGKTVAVVGIGINFVLPXEVENAASVQSLFQTASRRGNADAAVLLXXX----------
          |:|||||||||||||||||| ||||||||||||||||||||||||||||:
g311      RAGGKTVAVVGIGINFVLPKEVENAASVQSLFQTASRRGNADAAVLLETLLAELGAVLEQ
                  70         80         90        100        110        120 m311.pep  --------------------------------------------------------XXXX
                                                                          :
g311      YAEEGFAPFLNEYETANRDHGKAVLLLRDGETVCEGTVKGVDGRGVLHLETAEGEQTVVS
                  130        140        150        160        170        180

120        130        140        150        160        170
m311.pep  XEISLRSDXRPVSVXKRRDSERFLLLDGGNSRLKWAWVENGTFATVGSAPYRDLSPLGAE
          ||||| | |||  ||  |||||||||:|||||||||||||||||||||||||||||||
g311      GEISLRPDNRSVSVPKRPDSERFLLLEGGNSRLKWAWVENGTFATVGSAPYRDLSPLGAE
                  190        200        210        220        230        240

180        190        200        210        220        230
m311.pep  WAEKADGNVRIVGCAVCGEFKKAQVQEQLARKIEWLPSSAQALFGIRNHYRHPEEHGSDR
          ||||||||||||||||||| |||||:|||||||||||||||| |||||||||||||||||
g311      WAEKADGNVRIVGCAVCGESKKAQVKEQLARKIEWLPSSAQAL-GIRNHYRHPEEHGSDR
                  250        260        270        280        290

240        250        260        270        280        290
m311.pep  WFNALGSRRFSRNACVVVSCGTAVTVDALTDDGHYLGGTIMPGFHLMKESLAVRTANLNR
          ||||||||||||||||||||||||||||||||||||||||||||||||||||||||||||
g311      WFNALGSRRFSRNACVVVSCGTAVTVDALTDDGHYLGGTIMPGFHLMKESLAVRTANLNR
                300        310        320        330        340        350

300        310        320        330        340        350
m311.pep  HAGKRYPFPTTTGNAVASGMMDAVCGSVMMMHGRLKEKTGAGKPVDVIITGGGAAKVAEA
          |||||||||||||||||||||||||||:||||||||||:|||||||||||||||||||||
g311      PAGKRYPFPTTTGNAVASGMMDAVCGSIMMMHGRLKEKNGAGKPVDVIITGGGAAKVAEA
                360        370        380        390        400        410

360        370        380    389
m311.pep  LPPAFLAENTVRVADNLVIYGLLNMIAAEGREYEH
          |||||||||||||||||||:||||:|||||  | ||
g311      LPPAFLAENTVRVADNLVIHGLLNLIAAEGGESEHAX
                420        430        440        450
```

The following partial DNA sequence was identified in N. meningitidis <SEQ ID 1293>:

```
a311.seq
    1   ATGTTCAGTT TTGGCTGGGT GTTTGACCGG CCGCAGTATG AGTTGGGTTC

51   GCTGTCGCCT GTTGCGGCAG TGGCGTGCCG GCGCGCCTTG TCGCGTTTGG

101   GTTTGAAAAC GCAAATCAAG TGGCCAAACG ATTTGGTCGT CGGACGCGAC

151   AAATTGGGCG GCATTCTGAT TGAAACGGTC AGGACGGGCG GCAAAACGGT

201   TGCCGTGGTC GGTATCGGCA TCAATTTCGT GCTGCCCAAG GAAGTGGAAA

251   ACGCCGCTTC CGTGCAATCG CTGTTTCAGA CGGCATCGCG GCGGGGAAAT

301   GCCGATGCCG CCGTGTTGCT GGAAACGCTG TTGGCGGAAC TTGATGCGGT

351   GTTGTTGCAA TATGCGCGGG ACGGATTTGC GCCTTTTGTG GCGGAATATC

401   AGGCTGCCAA CCGCGACCAC GGCAAGGCGG TATTGCTGTT GCGCGACGGC

451   GAAACCGTGT TCGAAGGCAC GGTTAAAGGC GTGGACGGAC AAGGCGTTCT

501   GCACTTGGAA ACGGCAGAGG GCAAACAGAC GGTCGTCAGC GGCGAAATCA

551   GCCTGCGGTC CGACGACAGG CCGGTTTCCG TGCCGAAGCG GCGGGATTCG

601   GAACGTTTTC TGCTGTTGGA CGGCGGCAAC AGCCGGCTCA AGTGGGCGTG
```

-continued

```
 651    GGTGGAAAAC GGCACGTTCG CAACCGTCGG TAGCGCGCCG TACCGCGATT
 701    TGTCGCCTTT GGGCGCGGAG TGGGCGGAAA AGGTGGATGG AAATGTCCGC
 751    ATCGTCGGTT GCGCCGTGTG CGGAGAATTC AAAAAGGCAC AAGTGCAGGA
 801    ACAGCTCGCC CGAAAAATCG AGTGGCTGCC GTCTTCCGCA CAGGCTTTGG
 851    GCATACGCAA CCACTACCGC CACCCCGAAG AACACGGTTC CGACCGCTGG
 901    TTCAACGCCT TGGGCAGCCG CCGCTTCAGC CGCAACGCCT GCGTCGTCGT
 951    CAGTTGCGGC ACGGCGGTAA CGGTTGACGC GCTCACCGAT GACGGACATT
1001    ATCTCGGGGG AACCATCATG CCCGGTTTCC ACCTGATGAA AGAATCGCTC
1051    GCCGTCCGAA CCGCCAACCT CAACCGGCAC GCCGGTAAGC GTTATCCTTT
1101    CCCGACCACA ACGGGCAATG CCGTCGCCAG CGGCATGATG GATGCGGTTT
1151    GCGGCTCGGT TATGATGATG CACGGGCGTT GAAAGAAAA  AACCGGGGCG
1201    GGCAAGCCTG TCGATGTCAT CATTACCGGC GGCGGCGCGG CAAAAGTTGC
1251    CGAAGCCCTG CCGCCTGCAT TTTTGGCGGA AAATACCGTG CGCGTGGCGG
1301    ACAACCTCGT CATTCACGGG CTGCTGAACC TGATTGCCGC CGAAGGCGGG
1351    GAATCGGAAC ATACTTAA
```

This corresponds to the amino acid sequence <SEQ ID 1294; ORF 311.a>:

```
a311.pep
   1    MFSFGWVFDR PQYELGSLSP VAAVACRRAL SRLGLKTQIK WPNDLVVGRD

51    KLGGILIETV RTGGKTVAVV GIGINFVLPK EVENAASVQS LFQTASRRGN

101    ADAAVLLETL LAELDAVLLQ YARDGFAPFV AEYQAANRDH GKAVLLLRDG

151    ETVFEGTVKG VDGQGVLHLE TAEGKQTVVS GEISLRSDDR PVSVPKRRDS

201    ERFLLLDGGN SRLKWAWVEN GTFATVGSAP YRDLSPLGAE WAEKVDGNVR

251    IVGCAVCGEF KKAQVQEQLA RKIEWLPSSA QALGIRNHYR HPEEHGSDRW

301    FNALGSRRFS RNACVVVSCG TAVTVDALTD DGHYLGGTIM PGFHLMKESL

351    AVRTANLNRH AGKRYPFPTT TGNAVASGMM DAVCGSVMMM HGRLKEKTGA

401    GKPVDVIITG GGAAKVAEAL PPAFLAENTV RVADNLVIHG LLNLIAAEGG

451    ESEHT*
``` m311/a311 81.3% identity in 455 aa overlap

```
                 10         20         30         40         50         60
m311.pep  MFSFGWVFDRPQYELGSLSPVAAVACRRALSRLGLDVQIKWPNDLVVGRDKLGGILIETV
          ||||||||||||||||||||||||||||||||||| :|||||||||||||||||||||||
a311      MFSFGWVFDRPQYELGSLSPVAAVACRRALSRLGLKTQIKWPNDLVVGRDKLGGILIETV
                 10         20         30         40         50         60

70         80         90        100        110
m311.pep  RTGGKTVAVVGIGINFVLPXEVENAASVQSLFQTASRRGNADAAVLLXXXXXXXX-----
          |||||||||||||||||||| |||||||||||||||||||||||||| :
a311      RTGGKTVAVVGIGINFVLPKEVENAASVQSLFQTASRRGNADAAVLLETLLAELDAVLLQ
                 70         80         90        100        110        120 m311.pep  ------------------------------------------------------------ a311      YARDGFAPFVAEYQAANRDHGKAVLLLRDGETVFEGTVKGVDGQGVLHLETAEGKQTVVS
                130        140        150        160        170        180

120        130        140        150        160        170
m311.pep  -EISLRSDXRPVSVXKRRDSERFLLLDGGNSRLKWAWVENGTFATVGSAPYRDLSPLGAE
           |||||||  |||||  ||||||||||||||||||||||||||||||||||||||||||||
a311      GEISLRSDDRPVSVPKRRDSERFLLLDGGNSRLKWAWVENGTFATVGSAPYRDLSPLGAE
                190        200        210        220        230        240
```

```
              180        190        200        210        220        230
m311.pep    WAEKADGNVRIVGCAVCGEFKKAQVQEQLARKIEWLPSSAQALFGIRNHYRHPEEHGSDR
            ||||:||||||||||||||||||||||||||||||||||| ||||||||||||||||||
a311        WAEKVDGNVRIVGCAVCGEFKKAQVQEQLARKIEWLPSSAQAL-GIRNHYRHPEEHGSDR
              250        250        260        270        280        290
              240        250        260        270        280        290
m311.pep    WFNALGSRRFSRNACVVVSCGTAVTVDALTDDGHYLGGTIMPGFHLMKESLAVRTANLNR
            ||||||||||||||||||||||||||||||||||||||||||||||||||||||||||||
a311        WFNALGSRRFSRNACVVVSCGTAVTVDALTDDGHYLGGTIMPGFHLMKESLAVRTANLNR
              300        310        320        330        340        350
              300        310        320        330        340        350
m311.pep    HAGKRYPFPTTTGNAVASGMMDAVCGSVMMMHGRLKEKTGAGKPVDVIITGGGAAKVAEA
            ||||||||||||||||||||||||||||||||||||||||||||||||||||||||||||
a311        HAGKRYPFPTTTGNAVASGMMDAVCGSVMMMHGRLKEKTGAGKPVDVIITGGGAAKVAEA
              360        370        380        390        400        410
              360        370        380        389
m311.pep    LPPAFLAENTVRVADNLVIYGLLNMIAAEGREYEH
            ||||||||||||||||||||:||||:||||| | ||
a311        LPPAFLAENTVRVADNLVIHGLLNLIAAEGGESEHTX
              420        430        440        450
```

The following partial DNA sequence was identified in *N. gonorrhoeae* <SEQ ID 1295>:

```
g311-1.seq
    1    ATGACGGTTT TGAAGCCTTC GCATTGGCGG GTGTTGGCGG AGCTTGCCGA
   51    CGGTTTGCCG CAACACGTAT CGCAATTGGC GCGTGAGGCG GACATGAAGC
  101    CGCAGCAGCT CAACGGTTTT TGGCAGCAGA TGCCGGCGCA TATACGCGGG
  151    CTGTTGCGCC AACACGACGG CTATTGGCGG CTGGTGCGCC CCTTGGCGGT
  201    TTTCGATGCC GAAGGTTTGC GCGATCTGGG GGAAAGGTCG GGTTTTCAGA
  251    CGGCATTGAA GCACGAGTGC GCGTCCAGCA ACGACGAGAT ACTGGAATTG
  301    GCGCGGATTG CGCCGGACAA GGCGCACAAA ACCATATGCG TGACCCACCT
  351    GCAAAGTAAG GGCAGGGGGC GGCAGGGGCG GAAGTGGTCG CACCGTTTGG
  401    GCGAGTGCCT GATGTTCAGT TTCGGCTGGG CGTTTGACCG GCCGCAGTAT
  451    GAGTTGGGTT CGCTGTCGCC TGTTGCGGCA CTTGCGTGCC GGCGCGCTTT
  501    GGGGTGTTTG GGTTTGGAAA CGCAAATCAA GTGGCCAAAC GATTTGGTCG
  551    TCGGACGCGA CAAATTGGGC GGCATTCTGA TTGAAACAGT CAGGGCGGGC
  601    GGTAAAACGG TTGCCGTGGT CGGTATCGGC ATCAATTTCG TGCTGCCCAA
  651    GGAAGTGGAA ACGCCGCTT CCGTGCAGTC GCTGTTTCAG ACGGCATCGC
  701    GGCGGGGCAA TGCCGATGCC GCCGTATTGC TGGAAACATT GCTTGCGGAA
  751    CTGGGCGCGG TGTTGGAACA ATATGCGGAA GAAGGGTTCG CGCCATTTTT
  801    AAATGAGTAT GAAACGGCCA ACCGCGACCA CGGCAAGGCG GTATTGCTGT
  851    TGCGCGACGG CGAAACCGTG TGCGAAGGCA CGGTTAAAGG CGTGGACGGA
  901    CGAGGCGTTC TGCACTTGGA AACGGCAGaa ggCGAACAGa cggtcGtcag
  951    cggcGaaaTC AGccTGCGGc CCGacaacag gtcggtttcc GTgccgaagc
 1001    gGccggatTC GgaacgttTT tTGCTgttgg aaggcgggaa cagccggctc
 1051    aAGTGGgcgt gGGTggAAAA Cggcacgttc gcaaccgtgg gcAGCGCgCC
 1101    gtaCCGCGAT TTGTCGCCTT TGGGCGCGGA GTGGGCGGAA AAGGCGGATG
 1151    GAAATGTCCG CATCGTCGGT TGCGCCGTGT GCGGAGAATC CAAAAAGGCA
 1201    CAAGTGAAGG AACAGCTCGC CCGAAAAATC GAGTGGCTGC CGTCTTCCGC
 1251    ACAGGCTTTG GCATACGCA ACCACTACCG CCACCCCGAA GAACACGGTT
```

```
-continued
1301    CCGACCGTTG GTTCAACGCC TTGGGCAGCC GCCGCTTCAG CCGCAACGCC

1351    TGCGTCGTCG TCAGTTGCGG CACGGCGGTA ACGGTTGACG CGCTCACCGA

1401    TGACGGACAT TATCTCGGCG GAACCATCAT GCCCGGCTTC CACCTGATGA

1451    AAGAATCGCT CGCCGTCCGA ACCGCCAACC TCAACCGCCC CGCCGGCAAA

1501    CGTTACCCTT TCCCGACCAC AACGGGCAAC GCCGTCGCAA GCGGCATGAT

1551    GGACGCGGTT TGCGGCTCGA TAATGATGAT GCACGGCCGT TTGAAAGAAA

1601    AAAACGGCGC GGGCAAGCCT GTCGATGTCA TCATTACCGG CGGCGGCGCG

1651    GCGAAAGTCG CCGAAGCCCT GCCGCCTGCA TTTTTGGCGG AAAATACCGT

1701    GCGCGTGGCG GACAACCTCG TCATCCACGG GCTGCTGAAC CTGATTGCCG

1751    CCGAAGGCGG GGAATCGGAA CACGCTTAA
```

This corresponds to the amino acid sequence <SEQ ID 1296; ORF 311-1.ng>:

```
g311-1.pep
  1     MTVLKPSHWR VLAELADGLP QHVSQLAREA DMKPQQLNGF WQQMPAHIRG

51     LLRQHDGYWR LVRPLAVFDA EGLRDLGERS GFQTALKHEC ASSNDEILEL

101     ARIAPDKAHK TICVTHLQSK GRGRQGRKWS HRLGECLMFS FGWAFDRPQY

151     ELGSLSPVAA LACRRALGCL GLETQIKWPN DLVVGRDKLG GILIETVRAG

201     GKTVAVVGIG INFVLPKEVE NAASVQSLFQ TASRRGNADA AVLLETLLAE

251     LGAVLEQYAE EGFAPFLNEY ETANRDHGKA VLLLRDGETV CEGTVKGVDG

301     RGVLHLETAE GEQTVVSGEI SLRPDNRSVS VPKRPDSERF LLLEGGNSRL

351     KWAWVENGTF ATVGSAPYRD LSPLGAEWAE KADGNVRIVG CAVCGESKKA

401     QVKEQLARKI EWLPSSAQAL GIRNHYRHPE EHGSDRWFNA LGSRRFSRNA

451     CVVVSCGTAV TVDALTDDGH YLGGTIMPGF HLMKESLAVR TANLNRPAGK

501     RYPFPTTTGN AVASGMMDAV CGSIMMMHGR LKEKNGAGKP VDVIITGGGA

551     AKVAEALPPA FLAENTVRVA DNLVIHGLLN LIAAEGGESE HA*
```

The following partial DNA sequence was identified in *N. meningitidis* <SEQ ID 1297>:

```
m311-1.seq
  1     ATGACGGTTT TGAAGCTTTC GCACTGGCGG GTGTTGGCGG AGCTTGCCGA

51     CGGTTTGCCG CAACACGTCT CGCAACTGGC GCGTATGGCG GATATGAAGC

101     CGCAGCAGCT CAACGGTTTT TGGCAGCAGA TGCCGGCGCA CATACGCGGG

151     CTGTTGCGCC AACACGACGG CTATTGGCGG CTGGTGCGCC CATTGGCGGT

201     TTTCGATGCC GAAGGTTTGC GCGAGCTGGG GGAAAGGTCG GGTTTTCAGA

251     CGGCATTGAA GCACGAGTGC GCGTCCAGCA ACGACGAGAT ACTGGAATTG

301     GCGCGGATTG CGCCGGACAA GGCGCACAAA ACCATATGCG TGACCCACCT

351     GCAAAGTAAG GGCAGGGGGC GGCAGGGGCG GAAGTGGTCG CACCGTTTGG

401     GCGAGTGTCT GATGTTCAGT TTTGGCTGGG TGTTTGACCG GCCGCAGTAT

451     GAGTTGGGTT CGCTGTCGCC TGTTGCGGCA GTGGCGTGTC GGCGCGCCTT

501     GTCGCGTTTA GGTTTGGATG TGCAGATTAA GTGGCCCAAT GATTTGGTTG

551     TCGGACGCGA CAAATTGGGC GGCATTCTGA TTGAAACGGT CAGGACGGGC
```

```
 601      GGCAAAACGG TTGCCGTGGT CGGTATCGGC ATCAATTTTG TCCTGCCCAA

651      GGAAGTAGAA AATGCCGCTT CCGTGCAATC GCTGTTTCAG ACGGCATCGC

701      GGCGGGGCAA TGCCGATGCC GCCGTGCTGC TGGAAACGCT GTTGGTGGAA

751      CTGGACGCGG TGTTGTTGCA ATATGCGCGG GACGGATTTG CGCCTTTTGT

801      GGCGGAATAT CAGGCTGCCA ACCGCGACCA CGGCAAGGCG GTATTGCTGT

851      TGCGCGACGG CGAAACCGTG TTCGAAGGCA CGGTTAAAGG CGTGGACGGA

901      CAAGGCGTTT TGCACTTGGA AACGGCAGAG GGCAAACAGA CGGTCGTCAG

951      CGGCGAAATC AGCCTGCGGT CCGACGACAG GCCGGTTTCC GTGCCGAAGC

1001      GGCGGGATTC GGAACGTTTT CTGCTGTTGG ACGGCGGCAA CAGCCGGCTC

1051      AAGTGGGCGT GGGTGGAAAA CGGCACGTTC GCAACCGTCG GTAGCGCGCC

1101      GTACCGCGAT TTGTCGCCTT TGGGCGCGGA GTGGGCGGAA AAGGCGGATG

1151      GAAATGTCCG CATCGTCGGT TGCGCTGTGT GCGGAGAATT CAAAAAGGCA

1201      CAAGTGCAGG AACAGCTCGC CCGAAAAATC GAGTGGCTGC CGTCTTCCGC

1251      ACAGGCTTTG GGCATACGCA ACCACTACCG CCACCCCGAA GAACACGGTT

1301      CCGACCGCTG GTTCAACGCC TTGGGCAGCC GCCGCTTCAG CCGCAACGCC

1351      TGCGTCGTCG TCAGTTGCGG CACGGCGGTA ACGGTTGACG CGCTCACCGA

1401      TGACGGACAT TATCTCGGGG AACCATCAT GCCCGGTTTC CACCTGATGA

1451      AAGAATCGCT CGCCGTCCGA ACCGCCAACC TCAACCGGCA CGCCGGTAAG

1501      CGTTATCCTT TCCCGACCAC AACGGGCAAT GCCGTCGCCA GCGGCATGAT

1551      GGATGCGGTT TGCGGCTCGG TTATGATGAT GCACGGGCGT TTGAAAGAAA

1601      AAACCGGGGC GGGCAAGCCT GTCGATGTCA TCATTACCGG CGGCGGCGCG

1651      GCAAAAGTTG CCGAAGCCCT GCCGCCTGCA TTTTTGGCGG AAAATACCGT

1701      GCGCGTGGCG GACAACCTCG TCATTTACGG GTTGTTGAAC ATGATTGCCG

1751      CCGAAGGCAG GGAATATGAA CATATTTAA
```

This corresponds to the amino acid sequence <SEQ ID 1298;
ORF 311-1>:

```
m311-1.pep
    1     MTVLKLSHWR VLAELADGLP QHVSQLARMA DMKPQQLNGF WQQMPAHIRG

51     LLRQHDGYWR LVRPLAVFDA EGLRELGERS GFQTALKHEC ASSNDEILEL

101     ARIAPDKAHK TICVTHLQSK GRGRQGRKWS HRLGECLMFS FGWVFDRPQY

151     ELGSLSPVAA VACRRALSRL GLDVQIKWPN DLVVGRDKLG GILIETVRTG

201     GKTVAVVGIG INFVLPKEVE NAASVQSLFQ TASRRGNADA AVLLETLLVE

251     LDAVLLQYAR DGFAPFVAEY QAANRDHGKA VLLLRDGETV FEGTVKGVDG

301     QGVLHLETAE GKQTVVSGEI SLRSDDRPVS VPKRRDSERF LLLDGGNSRL

351     KWAWVENGTF ATVGSAPYRD LSPLGAEWAE KADGNVRIVG CAVCGEFKKA

401     QVQEQLARKI EWLPSSAQAL GIRNHYRHPE EHGSDRWFNA LGSRRFSRNA

451     CVVVSCGTAV TVDALTDDGH YLGGTIMPGF HLMKESLAVR TANLNRHAGK

501     RYPFPTTTGN AVASGMMDAV CGSVMMMHGR LKEKTGAGKP VDVIITGGGA

551     AKVAEALPPA FLAENTVRVA DNLVIYGLLN MIAAEGREYE HI*
``` m311-1/g311-1 93.9% identity in 591 aa overlap

```
                    10        20        30        40        50        60
   m311-1.pep  MTVLKLSHWRVLAELADGLPQHVSQLARMADMKPQQLNGFWQQMPAHIRGLLRQHDGYWR
                |||||  |||||||||||||||||||| |||||||||||||||||||||||||||||||
       g311-1  MTVLKPSHWRVLAELADGLPQHVSQLAREADMKPQQLNGFWQQMPAHIRGLLRQHDGYWR
                    10        20        30        40        50        60

70        80        90       100       110       120
   m311-1.pep  LVRPLAVFDAEGLRELGERSGFQTALKHECASSNDEILELARIAPDKAHKTICVTHLQSK
                ||||||||||||| |||||||||||||||||||||||||||||||||||||||||||||
       g311-1  LVRPLAVFDAEGLRDLGERSGFQTALKHECASSNDEILELARIAPDKAHKTICVTHLQSK
                    70        80        90       100       110       120

130       140       150       160       170       180
   m311-1.pep  GRGRQGRKWSHRLGECLMFSFGWVFDRPQYELGSLSPVAAVACRRALSRLGLDVQIKWPN
                |||||||||||||||||||||||||:|||||||||||||||:||||||| ||| ::|||||
       g311-1  GRGRQGRKWSHRLGECLMFSFGWAFDRPQYELGSLSPVAALACRRALGCLGLETQIKWPN
                   130       140       150       160       170       180

190       200       210       220       230       240
   m311-1.pep  DLVVGRDKLGGILIETVRTGGKTVAVVGIGINFVLPKEVENAASVQSLFQTASRRGNADA
                ||||||||||||||||||:|||||||||||||||||||||||||||||||||||||||||
       g311-1  DLVVGRDKLGGILIETVRAGGKTVAVVGIGINFVLPKEVENAASVQSLFQTASRRGNADA
                   190       200       210       220       230       240

250       260       270       280       290       300
   m311-1.pep  AVLLETLLVELDAVLLQYARDGFAPFVAEYQAANRDHGKAVLLLRDGETVFEGTVKGVDG
                ||||||||:||   |||  |||::|||||:  ||::|||||||||||||||| |||||||
       g311-1  AVLLETLLAELGAVLEQYAEEGFAPFLNEYETANRDHGKAVLLLRDGETVCEGTVKGVDG
                   250       260       270       280       290       300

310       320       330       340       350       360
   m311-1.pep  QGVLHLETAEGKQTVVSGEISLRSDDRPVSVPKRRDSERFLLLDGGNSRLKWAWVENGTF
                :||||||||||:||||||||||| |:| ||||||||| ||||||||:|||||||||||||
       g311-1  RGVLHLETAEGEQTVVSGEISLRPDNRSVSVPKRPDSERFLLLEGGNSRLKWAWVENGTF
                   310       320       330       340       350       360

370       380       390       400       410       420
   m311-1.pep  ATVGSAPYRDLSPLGAEWAEKADGNVRIVGCAVCGEFKKAQVQEQLARKIEWLPSSAQAL
                |||||||||||||||||||||||||||||||||||| |||||:|||||||||||||||||
       g311-1  ATVGSAPYRDLSPLGAEWAEKADGNVRIVGCAVCGESKKAQVKEQLARKIEWLPSSAQAL
                   370       380       390       400       410       420

430       440       450       460       470       480
   m311-1.pep  GIRNHYRHPEEHGSDRWFNALGSRRFSRNACVVVSCGTAVTVDALTDDGHYLGGTIMPGF
                ||||||||||||||||||||||||||||||||||||||||||||||||||||||||||||
       g311-1  GIRNHYRHPEEHGSDRWFNALGSRRFSRNACVVVSCGTAVTVDALTDDGHYLGGTIMPGF
                   430       440       450       460       470       480

490       500       510       520       530       540
   m311-1.pep  HLMKESLAVRTANLNRHAGKRYPFPTTTGNAVASGMMDAVCGSVMMMHGRLKEKTGAGKP
                ||||||||||||||||| ||||||||||||||||||||||||:|||||||||||| ||||
       g311-1  HLMKESLAVRTANLNRPAGKRYPFPTTTGNAVASGMMDAVCGSIMMMHGRLKEKNGAGKP
                   490       500       510       520       530       540

550       560       570       580       590
   m311-1.pep  VDVIITGGGAAKVAEALPPAFLAENTVRVADNLVIYGLLNMIAAEGREYEHIX
                ||||||||||||||||||||||||||||||||||:||||:|||| ||| ||||
       g311-1  VDVIITGGGAAKVAEALPPAFLAENTVRVADNLVIHGLLNLIAAEGGESEHAX
                   550       560       570       580       590
```

The following partial DNA sequence was identified in *N. meningitidis* <SEQ ID 1299>:

```
a311-1.seq
    1       ATGACGGTTT TGAAGCCTTC GCACTGGCGG GTGTTGGCGG AGCTTGCCGA

51       CGGTTTGCCG CAACACGTCT CGCAACTGGC GCGTATGGCG GATATGAAGC

101       CGCAGCAGCT CAACGGTTTT TGGCAGCAGA TGCCGGCGCA CATACGCGGG

151       CTGTTGCGCC AACACGACGG CTATTGGCGG CTGGTGCGCC CATTGGCGGT

201       TTTCGATGCC GAAGGTTTGC GCGAGCTGGG GGAAAGGTCG GGTTTTCAGA

251       CGGCATTGAA GCACGAGTGC GCGTCCAGCA ACGACGAGAT ACTGGAATTG

301       GCGCGGATTG CGCCGGACAA GGCGCACAAA ACCATATGTG TGACCCACCT

351       GCAAAGTAAG GGCAGGGGGC GGCAGGGGCG GAAGTGGTCG CACCGTTTGG

401       GCGAGTGTCT GATGTTCAGT TTTGGCTGGG TGTTTGACCG GCCGCAGTAT

451       GAGTTGGGTT CGCTGTCGCC TGTTGCGGCA GTGGCGTGCC GGCGCGCCTT
```

```
-continued
 501    GTCGCGTTTG GGTTTGAAAA CGCAAATCAA GTGGCCAAAC GATTTGGTCG
 551    TCGGACGCGA CAAATTGGGC GGCATTCTGA TTGAAACGGT CAGGACGGGC
 601    GGCAAAACGG TTGCCGTGGT CGGTATCGGC ATCAATTTCG TGCTGCCCAA
 651    GGAAGTGGAA AACGCCGCTT CCGTGCAATC GCTGTTTCAG ACGGCATCGC
 701    GGCGGGGAAA TGCCGATGCC GCCGTGTTGC TGGAAACGCT GTTGGCGGAA
 751    CTTGATGCGG TGTTGTTGCA ATATGCGCGG GACGGATTTG CGCCTTTTGT
 801    GGCGGAATAT CAGGCTGCCA ACCGCGACCA CGGCAAGGCG GTATTGCTGT
 851    TGCGCGACGG CGAAACCGTG TTCGAAGGCA CGGTTAAAGG CGTGGACGGA
 901    CAAGGCGTTC TGCACTTGGA AACGGCAGAG GGCAAACAGA CGGTCGTCAG
 951    CGGCGAAATC AGCCTGCGGT CCGACGACAG GCCGGTTTCC GTGCCGAAGC
1001    GGCGGGATTC GGAACGTTTT CTGCTGTTGG ACGGCGGCAA CAGCCGGCTC
1051    AAGTGGGCGT GGGTGGAAAA CGGCACGTTC GCAACCGTCG GTAGCGCGCC
1101    GTACCGCGAT TTGTCGCCTT GGGCGCGGA GTGGGCGGAA AAGGTGGATG
1151    GAAATGTCCG CATCGTCGGT TGCGCCGTGT GCGGAGAATT CAAAAAGGCA
1201    CAAGTGCAGG AACAGCTCGC CCGAAAAATC GAGTGGCTGC CGTCTTCCGC
1251    ACAGGCTTTG GCATACGCA ACCACTACCG CCACCCCGAA GAACACGGTT
1301    CCGACCGCTG GTTCAACGCC TTGGGCAGCC GCCGCTTCAG CCGCAACGCC
1351    TGCGTCGTCG TCAGTTGCGG CACGGCGGTA ACGGTTGACG CGCTCACCGA
1401    TGACGGACAT TATCTCGGGG AACCATCAT GCCCGGTTTC CACCTGATGA
1451    AAGAATCGCT CGCCGTCCGA ACCGCCAACC TCAACCGGCA CGCCGGTAAG
1501    CGTTATCCTT TCCCGACCAC AACGGGCAAT GCCGTCGCCA GCGGCATGAT
1551    GGATGCGGTT TGCGGCTCGG TTATGATGAT GCACGGGCGT TTGAAAGAAA
1601    AAACCGGGGC GGGCAAGCCT GTCGATGTCA TCATTACCGG CGGCGGCGCG
1651    GCAAAAGTTG CCGAAGCCCT GCCGCCTGCA TTTTTGGCGG AAAATACCGT
1701    GCGCGTGGCG GACAACCTCG TCATTCACGG GCTGCTGAAC CTGATTGCCG
1751    CCGAAGGCGG GGAATCGGAA CATACTTAA
```

This corresponds to the amino acid sequence <SEQ ID 1300; ORF 311-1.a>:

```
a311-1.pep
    1   MTVLKPSHWR VLAELADGLP QHVSQLARMA DMKPQQLNGF WQQMPAHIRG
   51   LLRQHDGYWR LVRPLAVFDA EGLRELGERS GFQTALKHEC ASSNDEILEL
  101   ARIAPDKAHK TICVTHLQSK GRGRQGRKWS HRLGECLMFS FGWVFDRPQY
  151   ELGSLSPVAA VACRRALSRL GLKTQIKWPN DLVVGRDKLG GILIETVRTG
  201   GKTVAVVGIG INFVLPKEVE NAASVQSLFQ TASRRGNADA AVLLETLLAE
  251   LDAVLLQYAR DGFAPFVAEY QAANRDHGKA VLLLRDGETV FEGTVKGVDG
  301   QGVLHLETAE GKQTVVSGEI SLRSDDRPVS VPKRRDSERF LLLDGGNSRL
  351   KWAWVENGTF ATVGSAPYRD LSPLGAEWAE KVDGNVRIVG CAVCGEFKKA
  401   QVQEQLARKI EWLPSSAQAL GIRNHYRHPE EHGSDRWFNA LGSRRFSRNA
  451   CVVVSCGTAV TVDALTDDGH YLGGTIMPGF HLMKESLAVR TANLNRHAGK
```

```
-continued
501   RYPFPTTTGN AVASGMMDAV CGSVMMMHGR LKEKTGAGKP VDVIITGGGA

551   AKVAEALPPA FLAENTVRVA DNLVIHGLLN LIAAEGGESE HT*
``` a311-1/m311-1 98.5% identity in 591 aa overlap

```
                    10         20         30         40         50         60
a311-1.pep  MTVLKPSHWRVLAELADGLPQHVSQLARMADMKPQQLNGFWQQMPAHIRGLLRQHDGYWR
            |||||  |||||||||||||||||||||||||||||||||||||||||||||||||||||
m311-1      MTVLKLSHWRVLAELADGLPQHVSQLARMADMKPQQLNGFWQQMPAHIRGLLRQHDGYWR
                    10         20         30         40         50         60

70         80         90        100        110        120
a311-1.pep  LVRPLAVFDAEGLRELGERSGFQTALKHECASSNDEILELARIAPDKAHKTICVTHLQSK
            ||||||||||||||||||||||||||||||||||||||||||||||||||||||||||||
m311-1      LVRPLAVFDAEGLRELGERSGFQTALKHECASSNDEILELARIAPDKAHKTICVTHLQSK
                    70         80         90        100        110        120

130        140        150        160        170        180
a311-1.pep  GRGRQGRKWSHRLGECLMFSFGWVFDRPQYELGSLSPVAAVACRRALSRLGLKTQIKWPN
            |||||||||||||||||||||||||||||||||||||||||||||||||||| :||||||
m311-1      GRGRQGRKWSHRLGECLMFSFGWVFDRPQYELGSLSPVAAVACRRALSRLGLDVQIKWPN
                   130        140        150        160        170        180

190        200        210        220        230        240
a311-1.pep  DLVVGRDKLGGILIETVRTGGKTVAVVGIGINFVLPKEVENAASVQSLFQTASRRGNADA
            ||||||||||||||||||||||||||||||||||||||||||||||||||||||||||||
m311-1      DLVVGRDKLGGILIETVRTGGKTVAVVGIGINFVLPKEVENAASVQSLFQTASRRGNADA
                   190        200        210        220        230        240

250        260        270        280        290        300
a311-1.pep  AVLLETLLAELDAVLLQYARDGFAPFVAEYQAANRDHGKAVLLLRDGETVFEGTVKGVDG
            ||||||||:|||||||||||||||||||||||||||||||||||||||||||||||||||
m311-1      AVLLETLLVELDAVLLQYARDGFAPFVAEYQAANRDHGKAVLLLRDGETVFEGTVKGVDG
                   250        260        270        280        290        300

310        320        330        340        350        360
a311-1.pep  QGVLHLETAEGKQTVVSGEISLRSDDRPVSVPKRRDSERFLLLDGGNSRLKWAWVENGTF
            ||||||||||||||||||||||||||||||||||||||||||||||||||||||||||||
m311-1      QGVLHLETAEGKQTVVSGEISLRSDDRPVSVPKRRDSERFLLLDGGNSRLKWAWVENGTF
                   310        320        330        340        350        360

370        380        390        400        410        420
a311-1.pep  ATVGSAPYRDLSPLGAEWAEKVDGNVRIVGCAVCGEFKKAQVQEQLARKIEWLPSSAQAL
            ||||||||||||||||||||||||:|||||||||||||||||||||||||||||||||||
m311-1      ATVGSAPYRDLSPLGAEWAEKADGNVRIVGCAVCGEFKKAQVQEQLARKIEWLPSSAQAL
                   370        380        390        400        410        420

430        440        450        460        470        480
a311-1.pep  GIRNHYRHPEEHGSDRWFNALGSRRFSRNACVVVSCGTAVTVDALTDDGHYLGGTIMPGF
            ||||||||||||||||||||||||||||||||||||||||||||||||||||||||||||
m311-1      GIRNHYRHPEEHGSDRWFNALGSRRFSRNACVVVSCGTAVTVDALTDDGHYLGGTIMPGF
                   430        440        450        460        470        480

490        500        510        520        530        540
a311-1.pep  HLMKESLAVRTANLNRHAGKRYPFPTTTGNAVASGMMDAVCGSVMMMHGRLKEKTGAGKP
            ||||||||||||||||||||||||||||||||||||||||||||||||||||||||||||
m311-1      HLMKESLAVRTANLNRHAGKRYPFPTTTGNAVASGMMDAVCGSVMMMHGRLKEKTGAGKP
                   490        500        510        520        530        540

550        560        570        580        590
a311-1.pep  VDVIITGGGAAKVAEALPPAFLAENTVRVADNLVIHGLLNLIAAEGGESEHTX
            ||||||||||||||||||||||||||||||||||||||:||||:|||||  ||
m311-1      VDVIITGGGAAKVAEALPPAFLAENTVRVADNLVIYGLLNMIAAEGREYEHIX
                   550        560        570        580        590
```

The following partial DNA sequence was identified in *N. gonorrhoeae* <SEQ ID 1301>:

```
g312.seq
   1   atgaGtatCc aatCcGgcga AATTTtagaa accgtCAAAA TGGTTGCCGA 51   ccggaATttt gAtgtccgCA CCATTAccat cggcaTTgaT ttgcacgact 101   gcatcagcac cgacatcgac gtgttaAACC AAAACATtta caaCAaaaTc 151   accacggtcg gcaaagactT GGTGGCAacg Gcgaaacacc tTTccgcCAA 201   ATACGGCGTG CCGATTGTGA ATCAGCGCAT TTCCGTTACG CCGAttgccc 251   AaatcGCGGC GGcgaccaAa gccgaCAGTT AtgtcAGCgt ggcgcAGact 301   tTGGACAAGG CAGCCAAAGC CATCGGCGTG TCCTTTATCG GcggCTTTTC
```

-continued

```
 351    CGCGCTGGTG CAAAAAGGTA TGTCGCCTTC GGATGAGGTG TTGATCCGTT

401    CCGTTCCCGA AGCGATGAAA ACTACCGATA TCGTGTGCAG CTCCATCAAT

451    ATCGGCAGCA CGCGTGCCGG TATCAATATG GATGCGGTCA AGCTGGCAGG

501    CGAAACCATC AAACGCACGG CTGAAATCAC ACCCGAAGGT TTCGGCTGCG

551    CCAAAATCGT CGTGTTCTGC AACGCGGTGG AAGACAATCC GTTTATGGCG

601    GGTGCGTTCC ACGGCTCGGG CGAAGCGGAT GCTGTGATTA ATGTCGGCGT

651    ATCCGGTCCA GGCGTGGTCA AGCCGCGCT GGAAAATTCG GACGCGGTCA

701    GCCTGACCGA GGTCGCCGAA GTCGTGAAGA AAACCGCTTT CAAAATCACC

751    CGCGTGGGCG AACTCATCGG TCGCGAAGCC TCAAAAATGC TGAATATCCC

801    GTTCGGCATT CTCGATTTGT CGCTGGCACC GACCGCCGTC GTCGGCGACT

851    CGGTGGCGCG CATTCTTGAA GAAATGGGCT TGAGCGTCTG CGGTACGCAC

901    GGCACAACAG CAGCTTTGGC ATTGCTGAAC GATGCCGTGA AAAAGGGCGG

951    CATGATGGCT TCCAGCGCGG TCGGCGGTTT GAGCGGCGCG TTTATCCCCG

1001    TTTCCGAAGA CGAAGGTATG ATTGCCGCCG CCGAGGCAGG CGTGTTGACG

1051    CTGGACAAAC TCGAAGCCAT GACCGCCGTC TGCTCCGTTG GTTTGGACAT

1101    GATTGCCGTT CCCGGCGACA CGCCCGCGCA CACCATTTCC GGCATCATCG

1151    CCGACGAAGC CGCCATCGGC ATGATCAACA GCAAAACCAC CGCCGTGCGC

1201    ATTATTCCGG TAACGGGCAA ACCGTCGGC GACAGCGTCG AGTTCGGCGG

1251    TCTGTTGGGC TACGCGCCTG TAATGCCGGC AAAAGAAGGT TCGTGCGAAG

1301    TGTTCGTCAA CCGGGGCGGC AGGATTCCCG CACCGGTTCA ATCGATGAAA

1351    AACTGA
```

This corresponds to the amino acid sequence <SEQ ID 1302; ORF 312.ng>:

```
g312.pep
   1    MSIQSGEILE TVKMVADRNF DVRTITIGID LHDCISTDID VLNQNIYNKI

51    TTVGKDLVAT AKHLSAKYGV PIVNQRISVT PIAQIAAATK ADSYVSVAQT

101    LDKAAKAIGV SFIGGFSALV QKGMSPSDEV LIRSVPEAMK TTDIVCSSIN

151    IGSTRAGINM DAVKLAGETI KRTAEITPEG FGCAKIVVFC NAVEDNPFMA

201    GAFHGSGEAD AVINVGVSGP GVVKAALENS DAVSLTEVAE VVKKTAFKIT

251    RVGELIGREA SKMLNIPFGI LDLSLAPTPA VGDSVARILE EMGLSVCGTH

301    GTTAALALLN DAVKKGGMMA SSAVGGLSGA FIPVSEDEGM IAAAEAGVLT

351    LDKLEAMTAV CSVGLDMIAV PGDTPAHTIS GIIADEAAIG MINSKTTAVR

401    IIPVTGKTVG DSVEFGGLLG YAPVMPAKEG SCEVFVNRGG RIPAPVQSMK

451    N*
```

The following partial DNA sequence was identified in *N. meningitidis* <SEQ ID 1303>:

```
m312.seq
   1    ATGAGTATCC AATCCGGCGA AATTTTAGAA ACCGTCAAAA TGGTTGCCGA

51    CCAGAATTTT GATGTCCGCA CCATTACCAT CGGCATTGAT TTGCACGACT

101    GCATCAGCAG CGATATCAAT GTGTTGAACC AAAATATTTA CAATAAAATT
```

```
 151   ACCACAGTCG GCAAAGACTT GGTCACTACG GCAAAATATC TGTCTGCCAA

201   ATACGGCGTA CCGATTGTGA ATCAGCGCAT TTCCGTTACG CCGATTGCCC

251   AAATCGCGGC GGCCACCCAT GCTGATTCTT ACGTCAGCGT GGCGCAAACT

301   TTGGATAAAG CTGCCAAAGC CATCGGTGTG TCTTTTATCG GCGGTTTTTC

351   CGCGTTGGTG CAAAAAGGGA TGTCGCcTTC GGATGAGGTG TTAATCCGCT

401   CCATTCCCGA AGCGATGAAG ACTACCGATA TTGTGTGCwG CTCCATCAAT

451   ATCGGCAGTA CGCGTGCCGG TATCAATATG GATGCGGTCA AGCTGGCGGG

501   CGAAACcGTc AAACGCACGG CGGAAATCAC GCCCGAAGGT TTCGGCTGCG

551   CTAAAATTGT CGTGTTCTGC AACGCGGTGG AAGACAACCC GTTTwTGGCG

601   GGCGCGTTTC ATGGTTCGGG CGATGCCGTT ATCAATGTCG GCGTATCCGG

651   CCCAGGTGTC GTAAAAGCCG CGTTGGAAAA TTCAGATGCA ACGACATTGA

701   CCGAAGTTGC GGAAGTAGTG AAGAAAACTG CTTTCAAAAT TACCCGCGTG

751   GGCGAACTCA TCGGCCGCGA AGCcTCAAAA ATGCTGAATA TCCCGTTTGG

801   TATTCTCGAC TTGTCGCCGA CCCCGCCCGT CGGCGACTCA GTGGCACGCA

851   TTCTTGAAGA AATGGGCTTG AGCGTCTGCG GTACGCACGG CACAACAGCA

901   GCTTTGGCAT TGCTGAACGA TGCCGTGAAA AAAGGCGGCA TGATGGCTTC

951   CAGCGCGGTC GGGGGTTTGA GTGGCGCGTT TATCCCCGTT TCCGAAGACG

1001   AAGGTATGAT yGmCgCcGCC GAAGCAGGCG TGCTGACGCT GGACAAACTC

1051   GAAGCCATGA CCGCCGTTTG TTCGGTCGGC TTGGATATGA TTGCCGTTCC

1101   CGGCGACACG CCCGCGCACA CCATTTCCGG CATCATTGCC GACGAAGCCG

1151   CCATCGGCAt GATCAACAGC AAAACCACTG CCGTGCGCAT TATTCCGGTA

1201   ACCGGTAAAA CCGTCGGCGA CAcGGTCGAG TTCGGCGGCT TGTTGGGcTA

1251   CGCGCCTGTG ATGCCGGTCA AGAAGGTTC GTGCGAAGTA TTCGTCAACC

1301   GAGGCGGCAG AATTCCGGCT CCGGTTCAAT CGATGAAAAA CTGA
```

This corresponds to the amino acid sequence <SEQ ID 1304; ORF 312>:

```
m312.pep
    1   MSIQSGEILE TVKMVADQNF DVRTITIGID LHDCISSDIN VLNQNIYNKI

51   TTVGKDLVTT AKYLSAKYGV PIVNQRISVT PIAQIAAATH ADSYVSVAQT

101   LDKAAKAIGV SFIGGFSALV QKGMSPSDEV LIRSIPEAMK TTDIVCXSIN

151   IGSTRAGINM DAVKLAGETV KRTAEITPEG FGCAKIVVFC NAVEDNPFXA

201   GAFHGSGDAV INVGVSGPGV VKAALENSDA TTLTEVAEVV KKTAFKITRV

251   GELIGREASK MLNIPFGILD LSPTPPVGDS VARILEEMGL SVCGTHGTTA

301   ALALLNDAVK KGGMMASSAV GGLSGAFIPV SEDEGMIXAA EAGVLTLDKL

351   EAMTAVCSVG LDMIAVPGDT PAHTISGIIA DEAAIGMINS KTTAVRIIPV

401   TGKTVGDTVE FGGLLGYAPV MPVKEGSCEV FVNRGGRIPA PVQSMKN*
```

Computer analysis of this amino acid sequence gave the following results:

Homology with a Predicted ORF from *N. gonorrhoeae*

ORF 312 shows 95.6% identity over a 451 aa overlap with a predicted ORF (ORF 312.ng) from *N. gonorrhoeae*:

```
m312/g312
                   10         20         30         40         50         60
m312.pep   MSIQSGEILETVKMVADQNFDVRTITIGIDLHDCISSDINVLNQNIYNKITTVGKDLVTT
           ||||||||||||||||:||||||||||||||||||:||:||||||||||||||||||:|
g312       MSIQSGEILETVKMVADRNFDVRTITIGIDLHDCISTDIDVLNQNIYNKITTVGKDLVAT
                   10         20         30         40         50         60

70         80         90        100        110        120
m312.pep   AKYLSAKYGVPIVNQRISVTPIAQIAAATHADSYVSVAQTLDKAAKAIGVSFIGGFSALV
           ||:|||||||||||||||||||||||||||:|||||||||||||||||||||||||||||
g312       AKHLSAKYGVPIVNQRISVTPIAQIAAATKADSYVSVAQTLDKAAKAIGVSFIGGFSALV
                   70         80         90        100        110        120

130        140        150        160        170        180
m312.pep   QKGMSPSDEVLIRSIPEAMKTTDIVCXSINIGSTRAGINMDAVKLAGETVKRTAEITPEG
           ||||||||||||||:|||||||||||| ||||||||||||||||||||||:||||||||||
g312       QKGMSPSDEVLIRSVPEAMKTTDIVCSSINIGSTRAGINMDAVKLAGETIKRTAEITPEG
                  130        140        150        160        170        180

190        200          210        220        230
m312.pep   FGCAKIVVFCNAVEDNPFXAGAFHGSG--DAVINVGVSGPGVVKAALENSDATTLTEVAE
           |||||||||||||||||| ||||||||  ||||||||||||||||||||||::||||||
g312       FGCAKIVVFCNAVEDNPFMAGAFHGSGEADAVINVGVSGPGVVKAALENSDAVSLTEVAE
                  190        200        210        220        230        240

240        250        260        270          280        290
m312.pep   VVKKTAFKITRVGELIGREASKMLNIPFGILDLS--PTPPVGDSVARILEEMGLSVCGTH
           ||||||||||||||||||||||||||||||||||   ||| ||||||||||||||||||
g312       VVKKTAFKITRVGELIGREASKMLNIPFGILDLSLAPTPAVGDSVARILEEMGLSVCGTH
                  250        260        270        280        290        300

300        310        320        330        340        350
m312.pep   GTTAALALLNDAVKKGGMMASSAVGGLSGAFIPVSEDEGMIXAAEAGVLTLDKLEAMTAV
           ||||||||||||||||||||||||||||||||||||||||| ||||||||||||||||||
g312       GTTAALALLNDAVKKGGMMASSAVGGLSGAFIPVSEDEGMIAAAEAGVLTLDKLEAMTAV
                  310        320        330        340        350        360

360        370        380        390        400        410
m312.pep   CSVGLDMIAVPGDTPAHTISGIIADEAAIGMINSKTTAVRIIPVTGKTVGDTVEFGGLLG
           ||||||||||||||||||||||||||||||||||||||||||||||||||:||||||||
g312       CSVGLDMIAVPGDTPAHTISGIIADEAAIGMINSKTTAVRIIPVTGKTVGDSVEFGGLLG
                  370        380        390        400        410        420

420        430        440
m312.pep   YAPVMPVKEGSCEVFVNRGGRIPAPVQSMKNX
           ||||||:||||||||||||||||||||||||
g312       YAPVMPAKEGSCEVFVNRGGRIPAPVQSMKNX
                  430        440        450
```

The following partial DNA sequence was identified in *N. meningitidis* <SEQ ID 1305>:

```
a312.seq
     1  ATGAGTATCC AATCCGGCGA AATTTTAGAA ACCGTCAAAA TGGTTGCCGA
    51  CCAGAATTTC GATGTCCGCA CCATTACCAT CGGCATTGAT TTGCACGACT
   101  GCATCAGCAC CGACATCGAC GTGTTGAACC AAAATATTTA CAACAAAATT
   151  ACCACGGTCG GCAAAGACTT GGTGGCGACA GCAAAATATC TGTCTGCCAA
   201  ATACGGCGTG CCGATTGTGA ATCAGCGCAT TTCTGTCACG CCGATTGCCC
   251  AAATCGCGGC GGCCACCCAT GCTGATTCTT ACGTCAGCGT GGCGCAAACT
   301  TTGGATAAGG CTGCCAAAGC CATCGGCGTG TCTTTTATTG GCGGCTTTTC
   351  CGCGCTGGTG CAAAAAGGTA TGTCGCCTTC TGACGAGGTG TTAATCCGTT
   401  CCATTCCCGA AGCGATGAAG ACTACTGATA TCGTGTGCAG CTCCATCAAT
   451  ATCGGCAGTA CGCGCGCCGG TATCAATATG GACGCGGTCA GACTGGCGGG
   501  CGAAACCATC AAACGCACGG CTGAAATCAC ACTAGAAGGT TTCGGCTGCG
   551  CCAAAATCGT CGTGTTCTGC AACGCGGTGG AAGACAACCC GTTTATGGCG
   601  GGCGCGTTTC ACGGCTCAGG CGAAGCGGAT GCTGTGATTA ATGTCGGCGT
   651  ATCCGGCCCG GGTGTCGTAA AAGCCGCGTT GGAAAATTCG GATGCAACGA
   701  CATTGACCGA AGTTGCCGAA GTTGTGAAGA AAACCGCCTT CAAAATTACC
   751  CGCGTGGGCG AACTCATCGG CCGCGAAGCC TCAAAAATGC TGAATATCCC
```

-continued

```
 801  GTTTGGTATT CTCGACTTGT CGCTGGCACC GACCCCTGCC GTCGGCGACT

851  CGGTGGCGCG CATTCTTGAA GAAATGGGTT TGAGCGTCTG CGGTACGCAC

901  GGCACAACAG CAGCTTTGGC ATTGCTGAAC GATGCCGTGA AAAAGGGCGG

951  CATGATGGCT TCGAGCGCGG TTGGCGGTTT GAGTGGCGCG TTTATCCCCG

1001  TTTCCGAAGA CGAAGGTATG ATTGCCGCCG CCGAAGCAGG CGTGCTGACG

1051  TTGGATAAAC TCGAAGCGAT GACCGCCGTT TGTTCGGTCG GCTTGGATAT

1101  GATTGCCGTT CCCGGCGACA CACCCGCGCA CACCATTTCC GGCATCATTG

1151  CCGACGAAGC CGCCATCGGC ATGATCAACA GCAAAACCAC TGCCGTGCGC

1201  ATTATTCCGG TAACCGGTAA AACCGTCGGC GACAGCGTCG AGTTCGGCGG

1251  CCTGTTGGGC TACGCGCCTG TAATGCCGGT AAAAGAAGGC TCATGCGAAG

1301  TGTTCGTCAA CCGGGGCGGC AGGATTCCCG CACCGGTTCA ATCGATGAAA

1351  AACTGA
```

This corresponds to the amino acid sequence <SEQ ID 1306; ORF 312.a>:

```
a312.pep
    1  MSIQSGEILE TVKMVADQNF DVRTITIGID LHDCISTDID VLNQNIYNKI

51  TTVGKDLVAT AKYLSAKYGV PIVNQRISVT PIAQIAAATH ADSYVSVAQT

101  LDKAAKAIGV SFIGGFSALV QKGMSPSDEV LIRSIPEAMK TTDIVCSSIN

151  IGSTRAGINM DAVRLAGETI KRTAEITLEG FGCAKIVVFC NAVEDNPFMA

201  GAFHGSGEAD AVINVGVSGP GVVKAALENS DATTLTEVAE VVKKTAFKIT

251  RVGELIGREA SKMLNIPFGI LDLSLAPTPA VGDSVARILE EMGLSVCGTH

301  GTTAALALLN DAVKKGGMMA SSAVGGLSGA FIPVSEDEGM IAAAEAGVLT

351  LDKLEAMTAV CSVGLDMIAV PGDTPAHTIS GIIADEAAIG MINSKTTAVR

401  IIPVTGKTVG DSVEFGGLLG YAPVMPVKEG SCEVFVNRGG RIPAPVQSMK

451  N*
``` m312/a312 96.7% identity in 451 aa overlap

```
                  10         20         30         40         50         60
   m312.pep  MSIQSGEILETVKMVADQNFDVRTITIGIDLHDCISSDINVLNQNIYNKITTVGKDLVTT
             ||||||||||||||||||||||||||||||||||||:||:||||||||||||||||||:|
       a312  MSIQSGEILETVKMVADQNFDVRTITIGIDLHDCISTDIDVLNQNIYNKITTVGKDLVAT
                  10         20         30         40         50         60

70         80         90        100        110        120
   m312.pep  AKYLSAKYGVPIVNQRISVTPIAQIAAATHADSYVSVAQTLDKAAKAIGVSFIGGFSALV
             ||||||||||||||||||||||||||||||||||||||||||||||||||||||||||||
       a312  AKYLSAKYGVPIVNQRISVTPIAQIAAATHADSYVSVAQTLDKAAKAIGVSFIGGFSALV
                  70         80         90        100        110        120

130        140        150        160        170        180
   m312.pep  QKGMSPSDEVLIRSIPEAMKTTDIVCXSINIGSTRAGINMDAVKLAGETVKRTAEITPEG
             |||||||||||||||||||||||||||:||||||||||||||||:||||:||||||||:||
       a312  QKGMSPSDEVLIRSIPEAMKTTDIVCSSINIGSTRAGINMDAVRLAGETIKRTAEITLEG
                 130        140        150        160        170        180

190        200        210        220        230
   m312.pep  FGCAKIVVFCNAVEDNPFXAGAFHGSG--DAVINVGVSGPGVVKAALENSDATTLTEVAE
             |||||||||||||||||||| |||||||  |||||||||||||||||||||||||||||
       a312  FGCAKIVVFCNAVEDNPFMAGAFHGSGEADAVINVGVSGPGVVKAALENSDATTLTEVAE
                 190        200        210        220        230        240

240        250        260        270        280        290
   m312.pep  VVKKTAFKITRVGELIGREASKMLNIPFGILDLS--PTPPVGDSVARILEEMGLSVCGTH
             ||||||||||||||||||||||||||||||||||   |||||||||||||||||||||||
       a312  VVKKTAFKITRVGELIGREASKMLNIPFGILDLSLAPTPAVGDSVARILEEMGLSVCGTH
                 250        260        270        280        290        300
```

-continued

```
              300        310        320        330        340        350
m312.pep  GTTAALALLNDAVKKGGMMASSAVGGLSGAFIPVSEDEGMIXAAEAGVLTLDKLEAMTAV
          ||||||||||||||||||||||||||||||||||||||| ||||||||||||||||||||
a312      GTTAALALLNDAVKKGGMMASSAVGGLSGAFIPVSEDEGMIAAAEAGVLTLDKLEAMTAV
               310        320        330        340        350        360

360        370        380        390        400        410
m312.pep  CSVGLDMIAVPGDTPAHTISGIIADEAAIGMINSKTTAVRIIPVTGKTVGDTVEFGGLLG
          ||||||||||||||||||||||||||||||||||||||||||||||||||||:|||||||
a312      CSVGLDMIAVPGDTPAHTISGIIADEAAIGMINSKTTAVRIIPVTGKTVGDSVEFGGLLG
               370        380        390        400        410        420

420        430        440
m312.pep  YAPVMPVKEGSCEVFVNRGGRIPAPVQSMKNX
          ||||||| |||||||||||||||||||||||
a312      YAPVMPvKEGSCEVFVNRGGRIPAPVQSMKNX
               430        440        450
```

The following partial DNA sequence was identified in *N. gonorrhoeae* <SEQ ID 1307>:

```
g313.seq
    1  atggacgacc cgcgcaccta cggatcgggc aatcccggcg cgaccaatgt
   51  tttacgcagc ggcaaaaaaa aggcggccgc gctgacgctc ttgggcgatg
  101  ccgccaaagg tttggttgcc gttttgcttg cacgcgtgct tcaagaaccg
  151  ctcggtttat ccgacagcgc aatcgccgcc gtcgcactcg ccgcgctggt
  201  cgggcatatg tggccggtgt ttttcggatt taagggcggc aaaggcgtgg
  251  caacggcatt gggcgtgctt ctggcactct ctcctgcaac tgccttggtc
  301  tgcgcgttga tttggcttgt gatggcattc ggcttcaaag tatcctccct
  351  tgccgcgctg gtcgccacaa ccgccgcccc ccttgccgca ctgttttttta
  401  tgccgcatac ttcttggatt ttcgcaaccc tcgcaatcgc catattggtg
  451  ttgctccgcc ataagagcaa catcctcaac ctgattaaag gcaaagaaag
  501  caaaatcggc gaaaaacgct ga
```

This corresponds to the amino acid sequence <SEQ ID 1308; ORF 313.ng>:

```
g313.pep
    1  MDDPRTYGSG NPGATNVLRS GKKKAAALTL LGDAAKGLVA VLLARVLQEP
   51  LGLSDSAIAA VALAALVGHM WPVFFGFKGG KGVATALGVL LALSPATALV
  101  CALIWLVMAF GFKVSSLAAL VATTAAPLAA LFFMPHTSWI FATLAIAILV
  151  LLRHKSNILN LIKGKESKIG EKR*
```

The following partial DNA sequence was identified in *N. meningitidis* <SEQ ID 1309>:

```
m313.seq
    1  ATGGACGACC CGCGCACCTA CGGATCGGGC AATCCGGGGG CAACCAATGT
   51  TTTACGCAGC GGCAAAAAAA AGGCGGCCGC GCTGACGCTC TTGGGCGATG
  101  CCGCCAAAGG TTTAGTTGCC GTTTTGCTTG CACGCGTGCT TCAAGAACCG
  151  CTCGGTTTAT CCGACAGCGC AATCGCGGCC GTCGCACTCG CCGCGCTGGT
  201  CGGGCATATG TGGCCGGTGT TTTTCGGATT TAAAGGCGGC AAAGGCGTGG
  251  CAACGGCATT GGGCGTGCTT CTGGCACTCT CTCCCGCAAC TGCCTTGGTC
  301  TGCGCGTTGA TTTGGCTTGT TATGGCATTC GGCTTCAAGG TGTCCTCCCT
  351  TGCCGCATTA ACCGCCACAA TCGCCGCACC GGTCGCCGCA TCCTTCTTTA
```

-continued

```
401 TGCCGCACGT CTCGTGGGTT TGGGCGACCG TCGCCATTGC TTTGCTGGTG

451 TTGTTCCGCC ACAAAAGTAA TATCGTCAAG CTGCTCGAAG GCAGAGAAAG

501 CAAAATCGGC GGCAGCCGCT GA
```

This corresponds to the amino acid sequence <SEQ ID 1310; ORF 313>:

```
m313.pep
   1 MDDPRTYGSG NPGATNVLRS GKKKAAALTL LGDAAKGLVA VLLARVLQEP

51 LGLSDSAIAA VALAALVGHM WPVFFGFKGG KGVATALGVL LALSPATALV

101 CALIWLVMAF GFKVSSLAAL TATIAAPVAA SFFMPHVSWV WATVAIALLV

151 LFRHKSNIVK LLEGRESKIG GSR*
```

Computer analysis of this amino acid sequence gave the following results:
Homology with a Predicted ORF from *N. gonorrhoeae*
ORF 313 shows 90.2% identity over a 173 aa overlap with a predicted ORF (ORF 313.ng) from *N. gonorrhoeae*:

```
m313/g313
                  10         20         30         40         50         60
   m313.pep  MDDPRTYGSGNPGATNVLRSGKKKAAALTLLGDAAKGLVAVLLARVLQEPLGLSDSAIAA
             ||||||||||||||||||||||||||||||||||||||||||||||||||||||||||||
       g313  MDDPRTYGSGNPGATNVLRSGKKKAAALTLLGDAAKGLVAVLLARVLQEPLGLSDSAIAA
                  10         20         30         40         50         60

70         80         90        100        110        120
   m313.pep  VALAALVGHMWPVFFGFKGGKGVATALGVLLALSPATALVCALIWLVMAFGFKVSSLAAL
             ||||||||||||||||||||||||||||||||||||||||||||||||||||||||||||
       g313  VALAALVGHMWPVFFGFKGGKGVATALGVLLALSPATALVCALIWLVMAFGFKVSSLAAL
                  70         80         90        100        110        120

130        140        150        160        170
   m313.pep  TATIAAPVAASFFMPHVSWVWATVAIALLVLFRHKSNIVKLLEGRESKIGGSRX
             :||  |||:||  |||||:||::||:|||:|||:||||||||::|::|||||  :||
       g313  VATTAAPLAALFFMPHTSWIFATLAIAILVLLRHKSNILNLIKGKESKIGEKRX
                 130        140        150        160        170
```

The following partial DNA sequence was identified in *N. meningitidis* <SEQ ID 1311>:

```
a313.seq
   1 ATGGACGACC CGCGCACCTA CGGATCGGGC AATCCGGGGG CAACCAATGT

51 TTTACGCAGC GGCAAAAAAA AGGCGGCCGC GCTGACGCTC TTGGGCGATG

101 CCGCCAAAGG TTTGGTTGCC GTTTTGCTTG CACGCGTGCT TCAAGAACCG

151 CTCGGTTTAT CCGACAGCGC AATCGCGGCC GTCGCACTCG CCGCGCTGGT

201 CGGGCATATG TGGCCGGTGT TTTTCGGATT TAAAGGCGGC AAAGGCGTGG

251 CAACGGCATT GGGCGTGCTT CTGGCACTCT CTCCCACAAC TGCCTTGGTC

301 TGCGCGTTGA TTTGGCTTGT GATGGCATTC GGCTTCAAGG TGTCCTCCCT

351 TGCCGCATTA ACCGCCACAA TCGCCGCCCC CCTTGCCGCA CTGTTTTTTA

401 TGCCGCATAC TTCTTGGATT TTCGCAACCC TCGCAATCGC CATATTGGTG

451 TTGCTCCGCC ATAAGAGCAA CATCCTCAAC CTGATTAAAG GCAAAGAAAG

501 CAAAATCGGC GAAAAACGCT GA
```

This corresponds to the amino acid sequence <SEQ ID 1312; ORF 313.a>:

```
a313.pep
    1   MDDPRTYGSG NPGATNVLRS GKKKAAALTL LGDAAKGLVA VLLARVLQEP

51   LGLSDSAIAA VALAALVGHM WPVFFGFKGG KGVATALGVL LALSPTTALV

101   CALIWLVMAF GFKVSSLAAL TATIAAPLAA LFFMPHTSWI FATLAIAILV

151   LLRHKSNILN LIKGKESKIG EKR*
``` m313/a313 90.8% identity in 173 aa overlap

```
                  10         20         30         40         50         60
     m313.pep  MDDPRTYGSGNPGATNVLRSGKKKAAALTLLGDAAKGLVAVLLARVLQEPLGLSDSAIAA
               ||||||||||||||||||||||||||||||||||||||||||||||||||||||||||||
         a313  MDDPRTYGSGNPGATNVLRSGKKKAAALTLLGDAAKGLVAVLLARVLQEPLGLSDSAIAA
                  10         20         30         40         50         60

70         80         90        100        110        120
     m313.pep  VALAALVGHMWPVFFGFKGGKGVATALGVLLALSPATALVCALIWLVMAFGFKVSSLAAL
               ||||||||||||||||||||||||||||||||||||:|||||||||||||||||||||||
         a313  VALAALVGHMWPVFFGFKGGKGVATALGVLLALSPTTALVCALIWLVMAFGFKVSSLAAL
                  70         80         90        100        110        120

130        140        150        160        170
     m313.pep  TATIAAPVAASFFMPHVSWVWATVAIALLVLFRHKSNIVKLLEGRESKIGGSRX
               |||||||:||  |||||:||::||:|||:||||||||::|::|:||||| :||
         a313  TATIAAPLAALFFMPHTSWIFATLAIAILVLLRHKSNILNLIKGKESKIGEKRX
                 130        140        150        160        170
```

The following partial DNA sequence was identified in *N. gonorrhoeae* <SEQ ID 1313>:

```
g401.seq
    1   atgaaattac aacaattggc tgaagaaaaa atcggcgttc tgattgtgtt 51   cacgctgctt gtagtcagtg tcggtctgtt gattgaagtt gtgcccttgg 101   cctttaccaa ggcggcaaca cagccggcgc cgggcgtgaa gccttacaat 151   gccctgcagg ttgccggacg cgatatttac atccgtgagg gctgttacaa 201   ctgccactct caaatgattc gtccgttccg tgcggaaacc gagcgttacg 251   gtcattactc tgttgccgga gagtcggttt acgaccatcc gttccaatgg 301   ggttccaaac gtaccggtcc tgatttggca cgtgtgggcg gccgctattc 351   cgacgaatgg caccgcatcc acctgctgaa tccccgtgat gtcgtgcctg 401   agtccaatat gccggcattc ccgtggcttg cacgcaataa agtcgatgtc 451   gatgcaaccg ttgccaacat gaaggctttg cgtaaagtag gtactcctta 501   cagtgatgag gaaattgcga agcgcctga ggctttggca aacaaatccg 551   agctggatgc tgtagtcgcc tatctgcaag gattgggtct ggctttgaaa 601   aacgtaaggt aa
```

This corresponds to the amino acid sequence <SEQ ID 1314; ORF 401.ng>:

```
g401.pep
    1   MKLQQLAEEK IGVLIVFTLL VVSVGLLIEV VPLAFTKAAT QPAPGVKPYN

51   ALQVAGRDIY IREGCYNCHS QMIRPFRAET ERYGHYSVAG ESVYDHPFQW

101   GSKRTGPDLA RVGGRYSDEW HRIHLLNPRD VVPESNMPAF PWLARNKVDV

151   DATVANMKAL RKVGTPYSDE EIAKAPEALA NKSELDAVVA YLQGLGLALK

201   NVR*
```

The following partial DNA sequence was identified in *N. meningitidis* <SEQ ID 1315>:

```
m401.seq
    1 ATGAAATTAC AaCAATTGGC TGAAGAAAAA ATCGGCGTTC TGATTGTGTT

51 CACGCTGCTT GTAGTCAGTG TCGGTCTGTT GATTGAAGTT GTGCCCTTGG

101 CCTTTACCAA GGCGGCAACA CAGCCGGCGC CGGGCGTGAA GCCTTACAAT

151 GCCCTGCAGG TTGCCGGACG CGATATTTAC ATCCGTGAGG GCTGTTACAA

201 CTGCCACTCG CAAATGATTC GTCCGTTCCG TGCGGAAACC GAGCGTTACG

251 GTCATTACTC TGTTGCCGGA GAGTCGGTTT ACGACCATCC GTTCCAATGG

301 GGTTCCAAAC GTACCGGTCC TGATTTGGCA CGTGTGGGCG GTCGCTATTC

351 CGACGAATGG CACCGTATCC ACCTGCTGAA TCCCCGTGAT GTCGTGCCTG

401 AGTCCAATAT GCCGGCATTC CCGTGGCTTG CACGCAATAA AGTCGATGTC

451 GATGCAACCG TTGCCAACAT GAAGGCTTTG CGTAAAGTAG GTACTCCTTA

501 CAGTGATGAG GAAATTGCGA AAGCACCTGA GGCTTTGGCA AACAAATCCG

551 AGCTGGATGC TGTAGTCGCC TATCTGCAAG GATTGGGTCT GGCTTTGAAA

601 AACGTAAGGT AA
```

This corresponds to the amino acid sequence <SEQ ID 1316; ORF 401>:

```
m401.pep
    1 MKLQQLAEEK IGVLIVFTLL VVSVGLLIEV VPLAFTKAAT QPAPGVKPYN

51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
```

Computer analysis of this amino acid sequence gave the following results:
Homology with a Predicted ORF from *N. gonorrhoeae*
ORF 401 shows 100.0% identity over a 203 aa overlap with a predicted ORF (ORF 401.ng) from *N. gonorrhoeae*:

```
m401/g401
                  10         20         30         40         50         60
    m401.pep  MKLQQLAEEKIGVLIVFTLLVVSVGLLIEVVPLAFTKAATQPAPGVKPYNALQVAGRDIY
              ||||||||||||||||||||||||||||||||||||||||||||||||||||||||||||
        g401  MKLQQLAEEKIGVLIVFTLLVVSVGLLIEVVPLAFTKAATQPAPGVKPYNALQVAGRDIY
                  10         20         30         40         50         60

70         80         90        100        110        120
    m401.pep  IREGCYNCHSQMIRPFRAETERYGHYSVAGESVYDHPFQWGSKRTGPDLARVGGTYSDEW
              ||||||||||||||||||||||||||||||||||||||||||||||||||||||||||||
        g401  IREGCYNCHSQMIRPFRAETERYGHYSVAGESVYDHPFQWGSKRTGPDLARVGGTYSDEW
                  70         80         90        100        110        120

130        140        150        160        170        180
    m401.pep  HRIHLLNPRDVVPESNMPAFPWLARNKVDVDATVANMKALRKVGTPYSDEEIAKAPEALA
              ||||||||||||||||||||||||||||||||||||||||||||||||||||||||||||
        g401  HRIHLLNPRDVVPESNMPAFPWLARNKVDVDATVANMKALRKVGTPYSDEEIAKAPEALA
                 130        140        150        160        170        180

190        200
    m401.pep  NKSELDAVVAYLQGLGLALKNVRX
              ||||||||||||||||||||||||
        g401  NKSELDAVVAYLQGLGLALKNVRX
                 190        200
```

The following partial DNA sequence was identified in *N. meningitidis* <SEQ ID 1317>:

a401.seq
    1    ATGAAATTAC AACAATTGGC TGAAGAAAAA ATCGGCGTTC TGATTGTGTT

51    CACGCTGCTT GTAGTCAGTG TCGGTCTGTT GATTGAAGTT GTGCCCTTGG

101    CCTTTACCAA GGCGGCAACA CAGCCGGCGT CGGGCGTGAA GCCTTACAAT

151    GCCCTGCAGG TTGCCGGACG CGATATTTAC ATCCGTGAGG GCTGTTACAA

201    CTGCCACTCG CAAATGATTC GTCCGTTCCG TGCGGAAACC GAGCGTTACG

251    GTCATTACTC TGTTGCCGGA GAGTCGGTTT ACGACCATCC GTTCCAATGG

301    GGTTCCAAAC GTACCGGTCC TGATTTGGCA CGTGTGGGCG GTCGCTATTC

351    CGACGAATGG CACCGTATCC ACCTGCTGAA TCCCCGTGAT GTCGTGCCTG

401    AGTCCAATAT GCCGGCATTC CCGTGGCTTG CACGCAATAA AGTCGATGTC

451    GATGCAACCG TTGCCAACAT GAAGGCTTTG CGTAAAGTAG GTACTCCTTA

501    CAGTGATGAG GAAATTGCGA AAGCGCCTGA GGCTTTGGCA AACAAATCCG

551    AGCTGGATGC TGTAGTCGCC TATCTGCAAG GATTGGGTCT GGCTTTGAAA

601    AACGTAAGGT AA

This corresponds to the amino acid sequence <SEQ ID 1318; ORF 401.a>:

a401.pep
    1    MKLQQLAEEK IGVLIVFTLL VVSVGLLIEV VPLAFTKAAT QPASGVKPYN

51    ALQVAGRDIY IREGCYNCHS QMIRPFRAET ERYGHYSVAG ESVYDHPFQW

101    GSKRTGPDLA RVGGRYSDEW HRIHLLNPRD VVPESNMPAF PWLARNKVDV

151    DATVANMKAL RKVGTPYSDE EIAKAPEALA NKSELDAVVA YLQGLGLALK

201    NVR* m401/a401 99.5% identity in 203 aa overlap 10         20         30         40         50         60
    m401.pep  MKLQQLAEEKIGVLIVFTLLVVSVGLLIEVVPLAFTKAATQPAPGVKPYNALQVAGRDIY
              ||||||||||||||||||||||||||||||||||||||||| |||||||||||||||||
    a401      MKLQQLAEEKIGVLIVFTLLVVSVGLLIEVVPLAFTKAATQPASGVKPYNALQVAGRDIY
                  10         20         30         40         50         60

70         80         90        100        110        120
    m401.pep  IREGCYNCHSQMIRPFRAETERYGHYSVAGESVYDHPFQWGSKRTGPDLARVGGTYSDEW
              ||||||||||||||||||||||||||||||||||||||||||||||||||||||||||||
    a401      IREGCYNCHSQMIRPFRAETERYGHYSVAGESVYDHPFQWGSKRTGPDLARVGGTYSDEW
                  70         80         90        100        110        120

130        140        150        160        170        180
    m401.pep  HRIHLLNPRDVVPESNMPAFPWLARNKVDVDATVANMKALRKVGTPYSDEEIAKAPEALA
              ||||||||||||||||||||||||||||||||||||||||||||||||||||||||||||
    a401      HRIHLLNPRDVVPESNMPAFPWLARNKVDVDATVANMKALRKVGTPYSDEEIAKAPEALA
                 130        140        150        160        170        180

190        200
    m401.pep  NKSELDAVVAYLQGLGLALKNVRX
              ||||||||||||||||||||||||
    a401      NKSELDAVVAYLQGLGLALKNVRX
                 190        200

The following partial DNA sequence was identified in *N. gonorrhoeae* <SEQ ID 1319>:

g402.seq
    1    ATGGATATGG TGAACACTAA Accgaatact agtgtgatta atatgctttc 51    tttccttacc ggatTATTGA GCTTGGGTat agaagtCtTg tGGGTAAGGA 101    TGttttcgTT CGCagcAcag tccgtgcctc aggCATTTTC atttattctt -continued

```
 151   gcctGttttc tgACCGgtat cgccgtcggc gCgTATTTTG GCAAACGGAT
 201   TTGCCGCAGC CGCTTTGTTG ATATTCCctT TATCGGGCAG TgcttcttgT
 251   GGGCGGGTAT TgccgaTttt ttgatTTTGG GTGCTGCGTG GTTGTTGACG
 301   GGTTTTTccg gtttcGTCCA CCACGCCGGT AtttTCATTA CCCTgtctgc
 351   CGtcGTCAGG GGGTTGATTT TCCCACTTGT ACACCATgtg GGTACGGATG
 401   GCAACAAATC CGGACGACAG GTTTCCAATG TTTATTTCGC CAACGTTGCC
 451   GGCAGTGCAT TGGGTCCGGT CCTTATCGGC TTTGTGATAC TTGATttgtt
 501   gTCCACCCAA CAGATTtacc tgctcatCTG TTTGATTTCT GCTGCtgtcc
 551   cTTTGTTTTg tacaCTGtTC CAAAAAGTC TCCGACTGAA TGCAGTGTCG
 601   GTAGCAGTTT CCCTAATGTT CGGCATCCTC ATGTTCCTAC TGCCGGATTC
 651   TGTCTTTCAA AATATTGCTG GCCGTCCGGA TAGGTTGATT GAAAACAAAC
 701   ACGGCATTGT TGCGGTTTAC CATAGAGATG GTGATAAGGT TGTTTATGGG
 751   GCGAATGTAT ACGACGGCGC ATACAATACC GATATATTCA ATAGTGTCAA
 801   CGGCATCGAA CGTGCCTATC TGCTACCCTC CCTGAAGTCC GGCATACGCC
 851   GCATTTTCGT CGTTGGATTG AGTACAGGTT CGTGGGCGCG CGTCTTGTCT
 901   GCCATTCCGG AAATGCAGTC GATGATCGTT GCGGAAATCA ATCCGGCATA
 951   CCGTAGCCTT ATCGCGGAcg agccgcAAAT CGCACCGCTT TTGCAGGACA
1001   AACGTGTTGA AATTGTATTG GATGACGGTA GGAAATGGCT GCGTCGCCAT
1051   CCTGATGAAA AATTCGACCT GATTTTGATG AATTCGACTT GGTACTGGCG
1101   TGCCTATTCC ACTAACCTGT TGAGTGCGGA ATTTTTAAAA CAGGTGCAAA
1151   GCCACCTTAC CCCGGATGGT ATTGTAATGT TTAATACCAC GCACAGCCCG
1201   CATgctTTTG CTACCGCCGT ACACAGTATT CCCTATGCAT ACCGCTACGG
1251   GCATATGGTA GTCGGCTCGG CAACCCCGGT AGTTTTCcct AATAAAGAAC
1301   TGCTCaagca aCGCCTTTcc cgGTTGATTT GGCCGGAAAG CGGCAGgcac
1351   gtATTTGACA GCAGCACCGT GGATGCTGCA GCACAAAAGG TTGtctctCG
1401   TATGCTGATT CGGATGACGG AAcctTCGGC TGGGGCGGAA GTCATTACTG
1451   ACGATAATAT GATTGTAGAA TACAAATACG GCAGAGGGAT TTAA
```

This corresponds to the amino acid sequence <SEQ ID 1320; ORF 402.ng>:

```
g402.pep
   1   MDMVNTKPNT SVINMLSFLT GLLSLGIEVL WVRMFSFAAQ SVPQAFSFIL

51   ACFLTGIAVG AYFGKRICRS RFVDIPFIGQ CFLWAGIADF LILGAAWLLT

101   GFSGFVHHAG IFITLSAVVR GLIFPLVHHV GTDGNKSGRQ VSNVYFANVA

151   GSALGPVLIG FVILDLLSTQ QIYLLICLIS AAVPLFCTLF QKSLRLNAVS

201   VAVSLMFGIL MFLLPDSVFQ NIAGRPDRLI ENKHGIVAVY HRDGDKVVYG

251   ANVYDGAYNT DIFNSVNGIE RAYLLPSLKS GIRRIFVVGL STGSWARVLS

301   AIPEMQSMIV AEINPAYRSL IADEPQIAPL LQDKRVEIVL DDGRKWLRRH

351   PDEKFDLILM NSTWYWRAYS TNLLSAEFLK QVQSHLTPDG IVMFNTTHSP

401   HAFATAVHSI PYAYRYGHMV VGSATPVVFP NKELLKQRLS RLIWPESGRH

451   VFDSSTVDAA AQKVVSRMLI RMTEPSAGAE VITDDNMIVE YKYGRGI*
```

The following partial DNA sequence was identified in *N. meningitidis* <SEQ ID 1321>:

```
m402.seq
     1  ATGGATATAG TGAACACTAA ACCGAATACT AGTTTGATTT ATATGCnTTC
    51  TTTCCTTAGC GGCTTATTGA GCTTGGGTAT AGAAGTCTTG TGGGTGAGGA
   101  TGTTTTCGTT CGCAGCACAG TCCGTGCCTC AGGCATTTTC ATTTACCCTT
   151  GCCTGTTTTC TGACCGGTAT CGCCGTCGGC GCGTATTTTG GCAAACGGAT
   201  TTGCCGCAGC CGCTTTGTTG ATATTCCCTT TATCGGGCAG TGCTTCTTGT
   251  GGGCGGGTAT TGCCGACTTT TTGATTTTGG GTGCTGCGTG GTTGTTGACG
   301  GGTTTTTCCG GCTTCGTCCA CCACGCCGGT ATCTTCATTA CCCTGTCTGC
   351  CGTCGTCAsA sGGTTGATTT TCCCGCTCGT ACACCATGTG GGTACGGATG
   401  GCAACAAATC CGGACGACAG GTTTCCAATG TTTATTTCGC CAmCGTTGCC
   451  GGCAGTGCAT TGGGTCCGGT CCTTATCGGC TTTGTGATAC TTGATTTCTT
   501  GTCCACCCAA CAGATTTACC TGCTCATCTG TwTGATTTCT GCTGCTGTCC
   551  CTTTGTTTTG TACACTGTTC CAAAAAAGTC TCCGACTGAA TGCAGTGTCG
   601  GTAGCAGTTT CCCTAATGTT CGGCATCCTC ATGTTCyTAC TGCCGGATTC
   651  TGTCTTTCAA AATATTGCTG ACCGTCCGGA TAgGCTGATT GAAAACAAAC
   701  ACGGCATTGT TGCGGTTTAC CATAGAGATG GTGATAAGGT TGTTTATGGG
   751  GCGAATGTAT ACGACGGCGC ATACAATACC GATGTATTCA ATAGTGTCAA
   801  CGGCATCGAA CGTGCCTATC TGCTACCCTC CCTGAAGTCT GGCATACGCC
   851  GCATTTTCGT CGTTGGACTG AGTACAGGTT CGTGGGCGCG CGTCTTGTCT
   901  GCCATTCCGG AAATGCAGTC GATGATCGTT GCGGAAATCA ATCCGGCATA
   951  CCGTAGCCTT ATCGCGGACG AGCCGCAAAT CGCCCCGCTT TTGCAGGACA
  1001  AACGTGTTGA AATTGTATTG GATGACGGTA GGAAATGGCT GCGTCGCCAT
  1051  CCTGATGAAA AATTCGACCT GATTTTGATG AATACGACTT GGTACTGGCG
  1101  TGCCTATTCC ACCAACCTGT TGAGTGCGGA ATTTTTAAAA CAGGTGCAAA
  1151  GCCACCTTAC CCCGGATGGT ATTGTAATGT TTAATACCAC GCACAGCCCG
  1201  CATGCTTTTG CTACCGCCGT ACACAGTATT CCCTATGCAT ACCGCTATGG
  1251  GCATATGGTA GTCGGCTCGG CAACCCCGGT AGTTTTCCCT AATAAAGAAC
  1301  TGCTCAAGCA ACGTCTCTCC CGGTTGATTT GGCCGGAAAG CGGCAGGCAC
  1351  GTATTTGACA GCAGCACCGT GGATGCTGCA GCACAAAAGG TTGTCTCTCG
  1401  TATGCTGATT CAGATGACGG aAcCTTCGGC TGGGGCGGAA GTTATTACCG
  1451  ACGATAATAT GATTGTAGAA TACAAATACG GCAGAGGGAT TTAA
```

This corresponds to the amino acid sequence <SEQ ID 1322; ORF 402>:

```
m402.pep
     1  MDIVNTKPNT SLIYMXSFLS GLLSLGIEVL WVRMFSFAAQ SVPQAFSFTL
    51  ACFLTGIAVG AYFGKRICRS RFVDIPFIGQ CFLWAGIADF LILGAAWLLT
   101  GFSGFVHHAG IFITLSAVVX XLIFPLVHHV GTDGNKSGRQ VSNVYFAXVA
   151  GSALGPVLIG FVILDFLSTQ QIYLLICXIS AAVPLFCTLF QKSLRLNAVS
   201  VAVSLMFGIL MFLLPDSVFQ NIADRPDRLI ENKHGIVAVY HRDGDKVVYG
```

```
251  ANVYDGAYNT DVFNSVNGIE RAYLLPSLKS GIRRIFVVGL STGSWARVLS

301  AIPEMQSMIV AEINPAYRSL IADEPQIAPL LQDKRVEIVL DDGRKWLRRH

351  PDEKFDLILM NTTWYWRAYS TNLLSAEFLK QVQSHLTPDG IVMFNTTHSP

401  HAFATAVHSI PYAYRYGHMV VGSATPVVFP NKELLKQRLS RLIWPESGRH

451  VFDSSTVDAA AQKVVSRMLI QMTEPSAGAE VITDDNMIVE YKYGRGI*
```

Computer analysis of this amino acid sequence gave the following results:
Homology with a Predicted ORF from N. gonorrhoeae
ORF 402 shows 97.0% identity over a 497 aa overlap with a predicted ORF (ORF 402.ng) from N. gonorrhoeae:

```
m402/g402
                  10         20         30         40         50         60
m402.pep  MDIVNTKPNTSLIYMXSFLSGLLSLGIEVLWVRMFSFAAQSVPQAFSFTLACFLTGIAVG
          ||:|||||||:|  |  |||:||||||||||||||||||||||||| ||||||||||||
g402      MDMVNTKPNTSVINMLSFLTGLLSLGIEVLWVRMFSFAAQSVPQAFSFILACFLTGIAVG
                  10         20         30         40         50         60

70         80         90        100        110        120
m402.pep  AYFGKRICRSRFVDIPFIGQCFLWAGIADFLILGAAWLLTGFSGFVHHAGIFITLSAVVX
          |||||||||||||||||||||||||||||||||||||||||||||||||||||||||||
g402      AYFGKRICRSRFVDIPFIGQCFLWAGIADFLILGAAWLLTGFSGFVHHAGIFITLSAVVR
                  70         80         90        100        110        120

130        140        150        160        170        180
m402.pep  XLIFPLVHHVGTDGNKSGRQVSNVYFAXVAGSALGPVLIGFVILDFLSTQQIYLLICXIS
           ||||||||||||||||||||||||||| |||||||||||||||:|||||||||||| ||
g402      GLIFPLVHHVGTDGNKSGRQVSNVYFANVAGSALGPVLIGFVILDLLSTQQIYLLICLIS
                 130        140        150        160        170        180

190        200        210        220        230        240
m402.pep  AAVPLFCTLFQKSLRLNAVSVAVSLMFGILMFLLPDSVFQNIADRPDRLIENKHGIVAVY
          |||||||||||||||||||||||||||||||||||||||||| ||||||||||||||||
g402      AAVPLFCTLFQKSLRLNAVSVAVSLMFGILMFLLPDSVFQNIAGRPDRLIENKHGIVAVY
                 190        200        210        220        230        240

250        260        270        280        290        300
m402.pep  HRDGDKVVYGANVYDGAYNTDVFNSVNGIERAYLLPSLKSGIRRIFVVGLSTGSWARVLS
          |||||||||||||||||||||:||||||||||||||||||||||||||||||||||||| 
g402      HRDGDKVVYGANVYDGAYNTDIFNSVNGIERAYLLPSLKSGIRRIFVVGLSTGSWARVLS
                 250        260        270        280        290        300

310        320        330        340        350        360
m402.pep  AIPEMQSMIVAEINPAYRSLIADEPQIAPLLQDKRVEIVLDDGRKWLRRHPDEKFDLILM
          |||||||||||||||||||||||||||||||||||||||||||||||||||||||||||
g402      AIPEMQSMIVAEINPAYRSLIADEPQIAPLLQDKRVEIVLDDGRKWLRRHPDEKFDLILM
                 310        320        330        340        350        360

370        380        390        400        410        420
m402.pep  NTTWYWRAYSTNLLSAEFLKQVQSHLTPDGIVMFNTTHSPHAFATAVHSIPYAYRYGHMV
          |:|||||||||||||||||||||||||||||||||||||||||||||||||||||||||
g402      NSTWYWRAYSTNLLSAEFLKQVQSHLTPDGIVMFNTTHSPHAFATAVHSIPYAYRYGHMV
                 370        380        390        400        410        420

430        440        450        460        470        480
m402.pep  VGSATPVVFPNKELLKQRLSRLIWPESGRHVFDSSTVDAAAQKVVSRMLIQMTEPSAGAE
          ||||||||||||||||||||||||||||||||||||||||||||||||||||:||||||
g402      VGSATPVVFPNKELLKQRLSRLIWPESGRHVFDSSTVDAAAQKVVSRMLIRMTEPSAGAE
                 430        440        450        460        470        480

490
m402.pep  VITDDNMIVEYKYGRGIX
          |||||||||||||||||
g402      VITDDNMIVEYKYGRGI
                 490
```

The following partial DNA sequence was identified in N. meningitidis <SEQ ID 1323>:

```
a402.seq
    1  ATGGATATAG TGAACACTAA ACCGAATACT AGTTTGATTT ATATGCTTTC

51  TTTCCTTAGC GGCTTATTGA GCTTGGGTAT AGAAGTCTTG TGGGTAAGGA

101  TGTTTTCGTT CGCAGCACAG TCCGTGCCTC AGGCATTTTC ATTTACTCTT

151  GCCTGTTTTC TGACCGGTAT CGCCGTCGGC GCGTATTTTG GCAAACGGAT
```

-continued

```
 201 TTGCCGCAGC CGCTTTGTTG ATATTCCCTT TATCGGGCAG TGCTTCTTGT
 251 GGGCGGGTAT TGCCGACTTT TTGATTTTGG GTGCTGCGTG GTTGTTGACG
 301 GGTTTTTCCG GCTTCGTCCA CCACGCCGGT ATCTTCATTA CCCTGTCTGC
 351 CGTCGTCAGA GGGTTGATTT TCCCGCTCGT ACACCATGTG GGTACGGATG
 401 GCAACAAATC CGGACGACAG GTTTCCAATG TTTATTTCGC CAACGTTGCC
 451 GGCAGTGCAT TGGGTCCGGT CCTTATCGGC TTTGTGATAC TTGATTTCTT
 501 GTCCACCCAA CAGATTTACC TGCTCATCTG TTTGATTTCT GCTGCTGTCC
 551 CTTTGTTTTG TACACTGTTC CAAAAAGTC TCCGACTGAA TGCAGTGTCG
 601 GTAGCAGTTT CCCTAATGTT CGGCATCCTC ATGTTCCTAC TGCCGGATTC
 651 TGTCTTTCAA AATATTGCTG ACCGTCCGGA TAGGCTGATT GAAAACAAAC
 701 ACGGCATTGT TGCGGTTTAC CATAGAGATG GTGATAAGGT TGTTTATGGG
 751 GCGAATGTAT ACGACGGCGC ATACAATACC GATGTATTCA ATAGTGTCAA
 801 CGGCATCGAA CGTGCCTATC TGCTACCCTC CCTGAAGTCT GGCATACGCC
 851 GCATTTTCGT CGTTGGATTG AGTACAGGTT CGTGGGCGCG CGTCTTGTCT
 901 GCCATTCCGG AAATGCAGTC GATGATCGTT GCGGAAATCA ATCCGGCATA
 951 CCGTAGCCTT ATCGCGGACG AGCCGCAAAT CGCCCCGCTT TTGCAGGACA
1001 AACGTGTTGA AATTGTATTG GATGACGGTA GGAAATGGCT GCGTCGCCAT
1051 CCTGATGAAA AATTCGACCT GATTTTGATG AATACGACTT GGTACTGGCG
1101 TGCCTATTCC ACCAACCTGT TGAGTGCGGA ATTTTTAAAA CAGGTGCAAA
1151 GCCACCTTAC CCCGGATGGT ATTGTAATGT TTAATACCAC GCACAGCCCG
1201 CATGCTTTTG CTACCGCCGT ACACAGTATT CCCTATGCAT ACCGCTATGG
1251 GCATATGGTA GTCGGCTCGG CAACCCCGGT AGTTTTCCCT AATAAAGAAC
1301 TGCTCAAGCA ACGTCTCTCC CGGTTGATTT GGCCGGAAAG CGGCAGGCAC
1351 GTATTTGACA GCAGCACCGT GGATGCTGCA GCACAAAAGG TTGTCTCTCG
1401 TATGCTGATT CAGATGACGG AACCTTCGGC TGGTGCGGAA GTCATTACCG
1451 ACGATAATAT GATTGTAGAA TACAAATACG GCAGAGGGAT TTAA
```

This corresponds to the amino acid sequence <SEQ ID 1324; ORF 402.a>:

```
a402.pep
   1 MDIVNTKPNT SLIYMLSFLS GLLSLGIEVL WVRMFSFAAQ SVPQAFSFTL
  51 ACFLTGIAVG AYFGKRICRS RFVDIPFIGQ CFLWAGIADF LILGAAWLLT
 101 GFSGFVHHAG IFITLSAVVR GLIFPLVHHV GTDGNKSGRQ VSNVYFANVA
 151 GSALGPVLIG FVILDFLSTQ QIYLLICLIS AAVPLFCTLF QKSLRLNAVS
 201 VAVSLMFGIL MFLLPDSVFQ NIADRPDRLI ENKHGIVAVY HRDGDKVVYG
 251 ANVYDGAYNT DVFNSVNGIE RAYLLPSLKS GIRRIFVVGL STGSWARVLS
 301 AIPEMQSMIV AEINPAYRSL IADEPQIAPL LQDKRVEIVL DDGRKWLRRH
 351 PDEKFDLILM NTTWYWRAYS TNLLSAEFLK QVQSHLTPDG IVMFNTTHSP
 401 HAFATAVHSI PYAYRYGHMV VGSATPVVFP NKELLKQRLS RLIWPESGRH
 451 VFDSSTVDAA AQKVVSRMLI QMTEPSAGAE VITDDNMIVE YKYGRGI*
``` m402/a402 99.0% identity in 497 aa overlap

```
                    10        20        30        40        50        60
m402.pep   MDIVNTKPNTSLIYMXSFLSGLLSLGIEVLWVRMFSFAAQSVPQAFSFTLACFLTGIAVG
           |||||||||||||||| |||||||||||||||||||||||||||||||||||||||||||
a402       MDIVNTKPNTSLIYMLSFLSGLLSLGIEVLWVRMFSFAAQSVPQAFSFTLACFLTGIAVG
                    10        20        30        40        50        60

70        80        90       100       110       120
m402.pep   AYFGKRICRSRFVDIPFIGQCFLWAGIADPLILGAAWLLTGFSGFVHHAGIFITLSAVVX
           |||||||||||||||||||||||||||||||||||||||||||||||||||||||||||
a402       AYFGKRICRSRFVDIPFIGQCFLWAGIADPLILGAAWLLTGFSGFVHHAGIFITLSAVVR
                    70        80        90       100       110       120

130       140       150       160       170       180
m402.pep   XLIFPLVHHVGTDGNKSGRQVSNVYFAXVAGSALGPVLIGFVILDFLSTQQIYLLICXIS
            |||||||||||||||||||||||||| |||||||||||||||||||||||||||| ||
a402       GLIFPLVHHVGTDGNKSGRQVSNVYFANVAGSALGPVLIGFVILDFLSTQQIYLLICLIS
                   130       140       150       160       170       180

190       200       210       220       230       240
m402.pep   AAVPLFCTLFQKSLRLNAVSVAVSLMFGILMFLLPDSVFQNIADRPDRLIENKHGIVAVY
           |||||||||||||||||||||||||||||||||||||||||||||||||||||||||||
a402       AAVPLFCTLFQKSLRLNAVSVAVSLMFGILMFLLPDSVFQNIADRPDRLIENKHGIVAVY
                   190       200       210       220       230       240

250       260       270       280       290       300
m402.pep   HRDGDKVVYGANVYDGAYNTDVFNSVNGIERAYLLPSLKSGIRRIFVVGLSTGSWARVLS
           |||||||||||||||||||||||||||||||||||||||||||||||||||||||||||
a402       HRDGDKVVYGANVYDGAYNTDVFNSVNGIERAYLLPSLKSGIRRIFVVGLSTGSWARVLS
                   250       260       270       280       290       300

310       320       330       340       350       360
m402.pep   AIPEMQSMIVAEINPAYRSLIADEPQIAPLLQDKRVEIVLDDGRKWLRRHPDEKFDLILM
           |||||||||||||||||||||||||||||||||||||||||||||||||||||||||||
a402       AIPEMQSMIVAEINPAYRSLIADEPQIAPLLQDKRVEIVLDDGRKWLRRHPDEKFDLILM
                   310       320       330       340       350       360

370       380       390       400       410       420
m402.pep   NTTWYWRAYSTNLLSAEFLKQVQSHLTPDGIVMFNTTHSPHAFATAVHSIPYAYRYGHMV
           |||||||||||||||||||||||||||||||||||||||||||||||||||||||||||
a402       NTTWYWRAYSTNLLSAEFLKQVQSHLTPDGIVMFNTTHSPHAFATAVHSIPYAYRYGHMV
                   370       380       390       400       410       420

430       440       450       460       470       480
m402.pep   VGSATPVVFPNKELLKQRLSRLIWPESGRHVFDSSTVDAAAQKVVSRMLIQMTEPSAGAE
           |||||||||||||||||||||||||||||||||||||||||||||||||||||||||||
a402       VGSATPVVFPNKELLKQRLSRLIWPESGRHVFDSSTVDAAAQKVVSRMLIQMTEPSAGAE
                   430       440       450       460       470       480

490
m402.pep   VITDDNMIVEYKYGRGIX
           ||||||||||||||||||
a402       VITDDNMIVEYKYGRGIX
                   490
```

The following partial DNA sequence was identified in *N. gonorrhoeae* <SEQ ID 1325>:

```
g406.seq
     1    ATGCGGGCAC GGCTGCTGAT ACCTATTCTT TTTTCAGTTT TTATTTTATC

51    CGCCTGCGGG ACACTGACAG GTATTCCATC GCATGGCGGA GGCAAACGCT

101    TCGCGGTCGA ACAAGAACTT GTGGCCGCTT CTGCCAGAGC TGCCGTTAAA

151    GACATGGATT TACAGGCATT ACACGGACGA AAAGTTGCAT TGTACATTGC

201    AACTATGGGC GACCAAGGTT CAGGCAGTTT GACAGGGGGT CGCTACTCCA

251    TTGATGCACT GATTCGCGGC GAATACATAA ACAGCCCTGC CGTCCGCACC

301    GATTACACCT ATCCGCGTTA CGAAACCACC GCTGAAACAA CATCAGGCGG

351    TTTGACGGGT TAACCACTT CTTTATCTAC ACTTAATGCC CCTGCACTCT

401    CGCGCACCCA ATCAGACGGT AGCGGAAGTA GGAGCAGTCT GGGCTTAAAT

451    ATTGGCGGGA TGGGGGATTA TCGAAATGAA ACCTTGACGA CCAACCCGCG

501    CGACACTGCC TTTCTTTCCC ACTTGGTGCA GACCGTATTT TTCCTGCGCG

551    GCATAGACGT TGTTTCTCCT GCCAATGCCG ATACAGATGT GTTTATTAAC

601    ATCGACGTAT TCGGAACGAT ACGCAACAGA ACCGAAATGC ACCTATACAA
```

-continued

```
651  TGCCGAAACA CTGAAAGCCC AAACAAAACT GGAATATTTC GCAGTAGACA

701  GAACCAATAA AAAATTGCTC ATCAAACCCA AAACCAATGC GTTTGAAGCT

751  GCCTATAAAG AAAATTACGC ATTGTGGATG GGGCCGTATA AAGTAAGCAA

801  AGGAATCAAA CCGACGGAAG GATTGATGGT CGATTTCTCC GATATCCAAC

851  CATACGGCAA TCATACGGGT AACTCCGCCC CATCCGTAGA GGCTGATAAC

901  AGTCATGAGG GGTATGGATA CAGCGATGAA GCAGTGCGAC AACATAGACA

951  AGGGCAACCT TGA
```

This corresponds to the amino acid sequence <SEQ ID 1326; ORF 406>:

```
g406.pep
  1  MRARLLIPIL FSVFILSACG TLTGIPSHGG GKRFAVEQEL VAASARAAVK

51  DMDLQALHGR KVALYIATMG DQGSGSLTGG RYSIDALIRG EYINSPAVRT

101  DYTYPRYETT AETTSGGLTG LTTSLSTLNA PALSRTQSDG SGSRSSLGLN

151  IGGMGDYRNE TLTTNPRDTA FLSHLVQTVF FLRGIDVVSP ANADTDVFIN

201  IDVFGTIRNR TEMHLYNAET LKAQTKLEYF AVDRTNKKLL IKPKTNAFEA

251  AYKENYALWM GPYKVSKGIK PTEGLMVDFS DIQPYGNHTG NSAPSVEADN

301  SHEGYGYSDE AVRQHRQGQP *
```

The following partial DNA sequence was identified in *N. meningitidis* <SEQ ID 1327>:

```
m406.seq
  1  ATGCAAGCAC GGCTGCTGAT ACCTATTCTT TTTTCAGTTT TTATTTTATC

51  CGCCTGCGGG ACACTGACAG GTATTCCATC GCATGGCGGA GGTAAACGCT

101  TTGCGGTCGA ACAAGAACTT GTGGCCGCTT CTGCCAGAGC TGCCGTTAAA

151  GACATGGATT TACAGGCATT ACACGGACGA AAAGTTGCAT TGTACATTGC

201  CACTATGGGC GACCAAGGTT CAGGCAGTTT GACAGGGGGT CGCTACTCCA

251  TTGATGCACT GATTCGTGGC GAATACATAA ACAGCCCTGC CGTCCGTACC

301  GATTACACCT ATCCACGTTA CGAAACCACC GCTGAAACAA CATCAGGCGG

351  TTTGACAGGT TTAACCACTT CTTTATCTAC ACTTAATGCC CCTGCACTCT

401  CTCGCACCCA ATCAGACGGT AGCGGAAGTA AAAGCAGTCT GGGCTTAAAT

451  ATTGGCGGGA TGGGGGATTA TCGAAATGAA ACCTTGACGA CTAACCCGCG

501  CGACACTGCC TTTCTTTCCC ACTTGGTACA GACCGTATTT TTCCTGCGCG

551  GCATAGACGT TGTTTCTCCT GCCAATGCCG ATACAGATGT GTTTATTAAC

601  ATCGACGTAT TCGGAACGAT ACGCAACAGA ACCGAAATGC ACCTATACAA

651  TGCCGAAACA CTGAAAGCCC AAACAAAACT GGAATATTTC GCAGTAGACA

701  GAACCAATAA AAAATTGCTC ATCAAACCAA AAACCAATGC GTTTGAAGCT

751  GCCTATAAAG AAAATTACGC ATTGTGGATG GGGCCGTATA AAGTAAGCAA

801  AGGAATTAAA CCGACGGAAG GATTAATGGT CGATTTCTCC GATATCCGAC

851  CATACGGCAA TCATACGGGT AACTCCGCCC CATCCGTAGA GGCTGATAAC

901  AGTCATGAGG GGTATGGATA CAGCGATGAA GTAGTGCGAC AACATAGACA

951  AGGACAACCT TGA
```

This corresponds to the amino acid sequence <SEQ ID 1328; ORF 406>:

```
m406.pep
    1   MQARLLIPIL FSVFILSACG TLTGIPSHGG GKRFAVEQEL VAASARAAVK

51   DMDLQALHGR KVALYIATMG DQGSGSLTGG RYSIDALIRG EYINSPAVRT

101   DYTYPRYETT AETTSGGLTG LTTSLSTLNA PALSRTQSDG SGSKSSLGLN

151   IGGMGDYRNE TLTTNPRDTA FLSHLVQTVF FLRGIDVVSP ANADTDVFIN

201   IDVFGTIRNR TEMHLYNAET LKAQTKLEYF AVDRTNKKLL IKPKTNAFEA

251   AYKENYALWM GPYKVSKGIK PTEGLMVDFS DIRPYGNHTG NSAPSVEADN

301   SHEGYGYSDE VVRQHRQGQP *
```

Computer analysis of the amino acid sequences gave the following results:
Homology with a Predicted ORF from *N. meningitidis* menA with menB     20
ORF 406 shows 98.8% identity over a 320 aa overlap with a predicted ORF (ORF406.a) from *N. gonorrhoeae*:

```
    g406/m406
                    10         20         30         40         50         60
         g406.pep   MRARLLIPILFSVFILSACGTLTGIPSHGGGKRFAVEQELVAASARAAVKDMDLQALHGR
                    |:||||||||||||||||||||||||||||||||||||||||||||||||||||||||||
         m406       MQARLLIPILFSVFILSACGTLTGIPSHGGGKRFAVEQELVAASARAAVKDMDLQALHGR
                    10         20         30         40         50         60

70         80         90        100        110        120
         g406.pep   KVALYIATMGDQGSGSLTGGRYSIDALIRGEYINSPAVRTDYTYPRYETTAETTSGGLTG
                    ||||||||||||||||||||||||||||||||||||||||||||||||||||||||||||
         m406       KVALYIATMGDQGSGSLTGGRYSIDALIRGEYINSPAVRTDYTYPRYETTAETTSGGLTG
                    70         80         90        100        110        120

130        140        150        160        170        180
         g406.pep   LTTSLSTLNAPALSRTQSDGSGSRSSLGLNIGGMGDYRNETLTTNPRDTAFLSHLVQTVF
                    ||||||||||||||||||||||||||||:|||||||||||||||||||||||||||||||
         m406       LTTSLSTLNAPALSRTQSDGSGSKSSLGLNIGGMGDYRNETLTTNPRDTAFLSHLVQTVF
                    130        140        150        160        170        180

190        200        210        220        230        240
         g406.pep   FLRGIDVVSPANADTDVFINIDVFGTIRNRTEMHLYNAETLKAQTKLEYFAVDRTNKKLL
                    ||||||||||||||||||||||||||||||||||||||||||||||||||||||||||||
         m406       FLRGIDVVSPANADTDVFINIDVFGTIRNRTEMHLYNAETLKAQTKLEYFAVDRTNKKLL
                    190        200        210        220        230        240

250        260        270        280        290        300
         g406.pep   IKPKTNAFEAAYKENYALWMGPYKVSKGIKPTEGLMVDFSDIQPYGNHTGNSAPSVEADN
                    ||||||||||||||||||||||||||||||||||||||||||||:|||||||||||||||
         m406       IKPKTNAFEAAYKENYALWMGPYKVSKGIKPTEGLMVDFSDIRPYGNHTGNSAPSVEADN
                    250        260        270        280        290        300

310        320
         g406.pep   SHEGYGYSDEAVRQHRQGQPX
                    ||||||||||:||||||||||
         m406       SHEGYGYSDEVVRQHRQGQPX
                    310        320
```

The following partial DNA sequence was identified in *N. meningitidis* <SEQ ID 1329>:

```
a406.seq
    1   ATGCAAGCAC GGCTGCTGAT ACCTATTCTT TTTTCAGTTT TTATTTTATC

51   CGCCTGCGGG ACACTGACAG GTATTCCATC GCATGGCGGA GGTAAACGCT

101   TCGCGGTCGA ACAAGAACTT GTGGCCGCTT CTGCCAGAGC TGCCGTTAAA

151   GACATGGATT TACAGGCATT ACACGGACGA AAAGTTGCAT TGTACATTGC

201   AACTATGGGC GACCAAGGTT CAGGCAGTTT GACAGGGGGT CGCTACTCCA

251   TTGATGCACT GATTCGTGGC GAATACATAA ACAGCCCTGC CGTCCGTACC

301   GATTACACCT ATCCACGTTA CGAAACCACC GCTGAAACAA CATCAGGCGG
```

```
351  TTTGACAGGT TTAACCACTT CTTTATCTAC ACTTAATGCC CCTGCACTCT

401  CGCGCACCCA ATCAGACGGT AGCGGAAGTA AAAGCAGTCT GGGCTTAAAT

451  ATTGGCGGGA TGGGGGATTA TCGAAATGAA ACCTTGACGA CTAACCCGCG

501  CGACACTGCC TTTCTTTCCC ACTTGGTACA GACCGTATTT TTCCTGCGCG

551  GCATAGACGT TGTTTCTCCT GCCAATGCCG ATACGGATGT GTTTATTAAC

601  ATCGACGTAT TCGGAACGAT ACGCAACAGA ACCGAAATGC ACCTATACAA

651  TGCCGAAACA CTGAAAGCCC AAACAAAACT GGAATATTTC GCAGTAGACA

701  GAACCAATAA AAAATTGCTC ATCAAACCAA AAACCAATGC GTTTGAAGCT

751  GCCTATAAAG AAAATTACGC ATTGTGGATG GGACCGTATA AAGTAAGCAA

801  AGGAATTAAA CCGACAGAAG GATTAATGGT CGATTTCTCC GATATCCAAC

851  CATACGGCAA TCATATGGGT AACTCTGCCC CATCCGTAGA GGCTGATAAC

901  AGTCATGAGG GGTATGGATA CAGCGATGAA GCAGTGCGAC GACATAGACA

951  AGGGCAACCT TGA
```

This corresponds to the amino acid sequence <SEQ ID 1330; ORF 406.a>:

```
a406.pep
    1  MQARLLIPIL FSVFILSACG TLTGIPSHGG GKRFAVEQEL VAASARAAVK

51  DMDLQALHGR KVALYIATMG DQGSGSLTGG RYSIDALIRG EYINSPAVRT

101  DYTYPRYETT AETTSGGLTG LTTSLSTLNA PALSRTQSDG SGSKSSLGLN

151  IGGMGDYRNE TLTTNPRDTA FLSHLVQTVF FLRGIDVVSP ANADTDVFIN

201  IDVFGTIRNR TEMHLYNAET LKAQTKLEYF AVDRTNKKLL IKPKTNAFEA

251  AYKENYALWM GPYKVSKGIK PTEGLMVDFS DIQPYGNHMG NSAPSVEADN

301  SHEGYGYSDE AVRRHRQGQP *
``` m406/a406 98.8% identity in 320 aa overlap

```
                  10         20         30         40         50         60
m406.pep  MQARLLIPILFSVFILSACGTLTGIPSHGGGKRFAVEQELVAASARAAVKDMDLQALHGR
          ||||||||||||||||||||||||||||||||||||||||||||||||||||||||||||
a406      MQARLLIPILFSVFILSACGTLTGIPSHGGGKRFAVEQELVAASARAAVKDMDLQALHGR
                  10         20         30         40         50         60

70         80         90        100        110        120
m406.pep  KVALYIATMGDQGSGSLTGGRYSIDALIRGEYINSPAVRTDYTYPRYETTAETTSGGLTG
          ||||||||||||||||||||||||||||||||||||||||||||||||||||||||||||
a406      KVALYIATMGDQGSGSLTGGRYSIDALIRGEYINSPAVRTDYTYPRYETTAETTSGGLTG
                  70         80         90        100        110        120

130        140        150        160        170        180
m406.pep  LTTSLSTLNAPALSRTQSDGSGSKSSLGLNIGGMGDYRNETLTTNPRDTAFLSHLVQTVF
          ||||||||||||||||||||||||||||||||||||||||||||||||||||||||||||
a406      LTTSLSTLNAPALSRTQSDGSGSKSSLGLNIGGMGDYRNETLTTNPRDTAFLSHLVQTVF
                 130        140        150        160        170        180

190        200        210        220        230        240
m406.pep  FLRGIDVVSPANADTDVFINIDVFGTIRNRTEMHLYNAETLKAQTKLEYFAVDRTNKKLL
          ||||||||||||||||||||||||||||||||||||||||||||||||||||||||||||
a406      FLRGIDVVSPANADTDVFINIDVFGTIRNRTEMHLYNAETLKAQTKLEYFAVDRTNKKLL
                 190        200        210        220        230        240

250        260        270        280        290        300
m406.pep  IKPKTNAFEAAYKENYALWMGPYKVSKGIKPTEGLMVDFSDIRPYGNHTGNSAPSVEADN
          |||||||||||||||||||||||||||||||||||||||||:||||| ||||||||||||
a406      IKPKTNAFEAAYKENYALWMGPYKVSKGIKPTEGLMVDFSDIQPYGNHMGNSAPSVEADN
                 250        260        270        280        290        300
```

```
                310        320
m406.pep   SHEGYGYSDEVVRQHRQGQPX
           ||||||||||:||:|||||||
a406       SHEGYGYSDEAVRRHRQGQPX
                310        320
```

The following partial DNA sequence was identified in *N. gonorrhoeae* <SEQ ID 1331>:

```
g501.seq
   1  atggtcggac ggaccttgac cgcagatacc gacatatttg ttctgcttgc
  51  ggcaggcgga gatggcaaga tgcagcatca ctttgacggc agggttgcgt
 101  tcgtcaaacg attcggacac caagccgctg tctcggtcga ggccgagggt
 151  cagctgggtc atgtcgttcg agccgatgga gaagccgtcg aagtattgca
 201  ggaattgttc cgccaatacc gcgttgctcg gcagctcgca catcataatc
 251  aggcgcaggc cgttttttgcc gcgttccaag ccgttttctt tcaatgcctt
 301  aaccactgct tcggcttcgc ccaaagtgcg gacgaacgga atcatgattt
 351  cgacgttggt cagacccatt tcgtcacgaa cgcgtttcaa ggctttgcat
 401  tccaaggcga aacagtcttt gaagctctcg gcaacataac gcgccgcacc
 451  acggaagccc aacatcgggt tttcttcatg cggttcgtat acgctgccgc
 501  cgaccaggtt ggcgtattcg ttggatttga agtcggacat acggacgatg
 551  gttttacgcg gataaaccga tgcggcaagc gttgccacgc cttcggcgat
 601  tttatcgacg tagaagtcga caggggatgc gtaaccggcg atgcggcgga
 651  taatttccgc tttcagttcg tcgtcttgtt tgtcaaattc caacaaggct
 701  ttcgggtgga tgccgatttg gcggttgatg ataaattcca tacgcgccaa
 751  gccgatgcct tcgctgggca gattggcgaa gctgaatgcg agttcgggat
 801  tgccgacgtt catcatgact ttgacgggtg cttttggcat attgtccaag
 851  gcgacatcgg taatttgtac gtccagcagg ccggcataga taaagccggt
 901  atcgccttcg gcacaggata cggtaacttc ctgaccgttt tccaagagtt
 951  cggtcgcatt gccgcagccg acgacggcag gaatacccag ttcgcgcgcg
1001  atgatggcgg cgtggcaggt gcgtccgccg cggttggtca cgatggcgga
1051  agcacgtttc atcacgggtt cccaatccgg atcggtcatg tcggtaacca
1101  gtacgtcgcc ggcttcgacg gaatccatct cggaagcatc tttaatcagg
1151  cgcaccttgc cctgaccgac tttttgaccg atggcacgac cttcgcacaa
1201  gacggttttt cgccgttga tggcgtagcg gcgcaggttg cggctgcctt
1251  cttcttggga tttgacggtt tcggggcggg cttgcaggat gtagagtttg
1301  ccgtccaggc cgtcgcgtcc ccattcgata tccatcgggc ggccgtagtg
1351  ttttttcgatg gtcagcgcgt agtgtgccaa ctcggtgatt tcttcgtcgg
1401  taatggagaa gcggttgcgg tcttcttcgg ggacttcgac gttggttacc
1451  gatttgccgg cttcggcttt gtcggtgaaa atcattttga tgtgtttcga
1501  acccatggtc ttgcgcagga tggcgggttt gcctgctttg agcgtgggtt
1551  tgaacacata aaattcgtcc gggttgaccg cgccttgtac gacgttttcg
1601  cccagaccgt aagaggaggt aacaaagacg acttggttgt agccggattc
1651  ggtgtcgagg gtgaacatca cacctga
```

This corresponds to the amino acid sequence <SEQ ID 1332; ORF 501.ng>:

g501.pep
1 MVGRTLTADT DIFVLLAAGG DGKMQHHFDG RVAFVKRFGH QAAVSVEAEG
51 QLGHVVRADG EAVEVLQELF RQYRVARQLA HHNQAQAVFA AFQAVFFQCL
101 NHCFGFAQSA DERNHDFDVG QTHFVTNAFQ GFAFQGETVF EALGNITRRT
151 TEAQHRVFFM RFVYAAADQV GVFVGFEVGH TDDGFTRINR CGKRCHAFGD
201 FIDVEVDRGC VTGDAADNFR FQFVVLFVKF QQGFRVDADL AVDDKFHTRQ
251 ADAFAGQIGE AECEFGIADV HHDFDGCFWH IVQGDIGNLY VQQAGIDKAG
301 IAFGTGYGNF LTVFQEFGRI AAADDGRNTQ FARDDGGVAG ASAAVGHDGG
351 STFHHGFPIR IGHVGNQYVA GFDGIHLGSI FNQAHLALTD FLTDGTTFAQ
401 DGFFAVDGVA AQVAAAFFLG FDGFGAGLQD VEFAVQAVAS PFDIHRAAVV
451 FFDGQRVVCQ LGDFFVGNGE AVAVFFGDFD VGYRFAGFGF VGENHFDVFR
501 THGLAQDGGF ACFERGFEHI KFVRVDRALY DVFAQTVRGG NKDDLVVAGF
551 GVEGEHHT*

The following partial DNA sequence was identified in *N. meningitidis* <SEQ ID 1333>:

m501.seq
1 atggtcggac sggccttgac cgcagatgcc gacatatttg ttctgcttgc
51 ggcaggcgga gatggcaagg tgcagcatca ctttgacggc agggttgcgt
101 tcgtcaaacg attcggatac caagccgctg tcgcggtcga gaccgagggt
151 cagttgggtc atgtcgttcg agccgatgga gaagccgtcg aagtattgca
201 ggaattgttc cgccaatacc gcgttgctcg gcagctcgca catcataatc
251 aggcgcaggc cgtttttgcc gcgttccaag ccgttttctt tcagggcttt
301 gacaacggmt tcggcttcgc ccaaagtgcg gacgaacgga atcatgattt
351 caacgttggy caaccccatt tcatcgcgga cgcgtttcaa ggctttgcat
401 tccaaggcga aacagtcttt gaagttgtcg gcgacataac gcgccgcacc
451 acggaagccc aacatcgggt tttcttcatg cggttcgtat acgttgccgc
501 cgaccaggtt ggcgtattcg ttggatttga agtcggacat acggacgatg
551 gttttacgcg gataaaccga tgcggccaat gtcgccacgc cttcggcgat
601 tttatcgacg tagaagtcga caggggacgc gtaaccggcg atacggcggg
651 taatttccgc ttttaattcg tcgtcttgtt tgtcaaattc caacaargct
701 ttggggtgga taccgatttg gcggttgatg ataaattcca tacgcgccaa
751 gccgatgcct tcgctgggca ggttggcgaa gctgaatgcg agttcgggat
801 tgccgacgtt catcatgact tttacaggtg ctttaggcat attgtctaag
851 gcgacatcgg taatctgtac gtccaacaga ccggcataga taaagccggt
901 atcgccttcg gcacaggata cggtaacttc ttgaccgttt ttcagcaatt
951 cggttgcatt gccgcagccg acaacggcag gaatgcccaa ttcacgcgcg
1001 atgatggcgg cgtggcaggt acggccgccg cggttggtaa cgatggcaga
1051 agcacgtttc atcacgggtt cccaatccgg atcggtcatg tcggtaacga
1101 gtacgtcgcc ggcttcgacg gaatccatct cggaagcatc tttaatcagg

```
-continued
1151  cgcaccttgc cctgaccgac tttctgaccg atggcgcggc cttcgcataa 1201  tacggttttg tcgccgttga tggcgaagcg gcgcaggttg cggttgccct 1251  cttcttggga ttttacggtt tcgggacggg cttgcaggat gtagagtttg 1301  ccgtccaagc cgtcgcgtcc ccattcgata tccatcgggc ggccgtagtg 1351  tttttcgatg gtcagtgcgt aatgcgccaa ctcagtaatt tcttcgtcgg 1401  taatggagaa gcggttgcgg tcttcctcgg ggacatcgac gttggttacg 1451  gatttaccgg cttctgcttt gtcggtaaaa atcattttga tgtgttttga 1501  acccatggtt ttacgcagga tggcgggctt gcccgytttg agcgtgggtt 1551  tgaacacatr aaattcgtcc gggttgaccg caccttgtac gacgttttcg 1601  cccagaccgt aagaggaggt aacaaagacg acytgatcgt akccggattc 1651  ggtgtcgagg gtgaacatca cacctga
```

This corresponds to the amino acid sequence <SEQ ID 1334; ORF 501>:

```
m501.pep
  1  MVGXALTADA DIFVLLAAGG DGKVQHHFDG RVAFVKRFGY QAAVAVETEG

51  QLGHVVRADG EAVEVLQELF RQYRVARQLA HHNQAQAVFA AFQAVFFQGF

101  DNGFGFAQSA DERNHDFNVG QPHFIADAFQ GFAFQGETVF EVVGDITRRT

151  TEAQHRVFFM RFVYVAADQV GVFVGFEVGH TDDGFTRINR CGQCRHAFGD

201  FIDVEVDRGR VTGDTAGNFR FXFVVLFVKF QQXFGVDTDL AVDDKFHTRQ

251  ADAFAGQVGE AECEFGIADV HHDFYRCFRH IVXGDIGNLY VQQTGIDKAG

301  IAFGTGYGNF LTVFQQFGCI AAADNGRNAQ FTRDDGGVAG TAAAVGNDGR

351  STFHHGFPIR IGHVGNEYVA GFDGIHLGSI FNQAHLALTD FLTDGAAFAX

401  YGFVAVDGEA AQVAVALFLG FYGFGTGLQD VEFAVQAVAS PFDIHRAAVV

451  FFDGQCVMRQ LSNFFVGNGE AVAVFLGDID VGYGFTGFCF VGKNHFDVFX

501  THGFTQDGGL ARFERGFEHX KFVRVDRTLY DVFAQTVRGG NKDDLIVXGF

551  GVEGEHHT*
```

Computer analysis of this amino acid sequence gave the following results:
Homology with a Predicted ORF from *N. gonorrhoeae*
ORF 501 shows 86.2% identity over a 558 aa overlap with a predicted ORF (ORF 501.ng) from *N. gonorrhoeae*:

```
m501/g501
                10         20         30         40         50         60
m501.pep MVGXALTADADIFVLLAAGGDGKVQHHFDGRVAFVKRFGYQAAVAVETEGQLGHVVRADG
         |||:||||:||||||||||||||:||||||||||||||:||||::||||||||||||
g501     MVGRTLTADTDIFVLLAAGGDGKMQHHFDGRVAFVKRFGHQAAVSVEAEGQLGHVVRADG
                10         20         30         40         50         60

70         80         90        100        110        120
m501.pep EAVEVLQELFRQYRVARQLAHHNQAQAVFAAFQAVFFQGFDNGFGFAQSADERNHDFNVG
         ||||||||||||||||||||||||||||||||||||||:::||||||||||||||:||
g501     EAVEVLQELFRQYRVARQLAHHNQAQAVFAAFQAVFFQCLNHCFGFAQSADERNHDFDVG
                70         80         90        100        110        120

130        140        150        160        170        180
m501.pep QPHFIADAFQGFAFQGETVFEVVGDITRRTTEAQHRVFFMRFVYVAADQVGVFVGFEVGH
         | ||::||||||||||||||:::|:||||||||||||||||||:||||||||||||||
g501     QTHFVTNAFQGFAFQGETVFEALGNITRRTTEAQHRVFFMRFVYAAADQVGVFVGFEVGH
               130        140        150        160        170        180
```

-continued

```
                190        200        210        220        230        240
m501.pep   TDDGFTRINRCGQCRHAFGDFIDVEVDRGRVTGDTAGNFRFXFVVLFVKFQQXFGVDTDL
           ||||||||||||:  |||||||||||||| ||||:| |||| |||||||||| | ||:||
g501       TDDGFTRINRCGKRCHAFGDFIDVEVDRGCVTGDAADNFRFQFVVLFVKFQQGFRVDADL
                190        200        210        220        230        240

250        260        270        280        290        300
m501.pep   AVDDKFHTRQADAFAGQVGEAECEFGIADVHHDFYRCFRHIVXGDIGNLYVQQTGIDKAG
           |||||||||||||||||:||||||||||||||||  || ||| ||||||||||:||||||
g501       AVDDKFHTRQADAFAGQIGEAECEFGIADVHHDFDGCFWHIVQGDIGNLYVQQAGIDKAG
                250        260        270        280        290        300

310        320        330        340        350        360
m501.pep   IAFGTGYGNFLTVFQQFGCIAAADNGRNAQFTRDDGGVAGTAAAVGNDGRSTFHHGFPIR
           |||||||||||||||:|| |||||:|||:||:||||||||::||||:|| ||||||||||
g501       IAFGTGYGNFLTVFQEFGRIAAADDGRNTQFARDDGGVAGASAAVGHDGGSTFHHGFPIR
                310        320        330        340        350        360

370        380        390        400        410        420
m501.pep   IGHVGNEYVAGFDGIHLGSIFNQAHLALTDFLTDGAAFAXYGFVAVDGEAAQVAVALFLG
           ||||||:||||||||||||||||||||||||||||::||  || |||| |||||:|:|||
g501       IGHVGNQYVAGFDGIHLGSIFNQAHLALTDFLTDGTTFAQDGFFAVDGVAAQVAAAFFLG
                370        380        390        400        410        420

430        440        450        460        470        480
m501.pep   FYGFGTGLQDVEFAVQAVASPFDIHRAAVVFFDGQCVMRQLSNFFVGNGEAVAVFLGDID
           | |||:||||||||||||||||||||||||||||| |: ||::||||||||||||:||:|
g501       FDGFGAGLQDVEFAVQAVASPFDIHRAAVVFFDGQRVVCQLGDFFVGNGEAVAVFFGDFD
                430        440        450        460        470        480

490        500        510        520        530        540
m501.pep   VGYGFTGFCFVGKNHFDVFXTHGFTQDGGLARFERGFEHXKFVRVDRTLYDVFAQTVRGG
           ||| |:|| |||:|||||| |||::||||:| ||||||| |||||||:||||||||||||
g501       VGYRFAGFGFVGENHFDVFRTHGLAQDGGFACFERGFEHIKFVRVDRALYDVFAQTVRGG
                490        500        510        520        530        540

550
m501.pep   NKDDLIVXGFGVEGEHHT
           |||||:| ||||||||||
g501       DKDDLVVAGFGIEGEHHT
                550
```

The following partial DNA sequence was identified in *N. meningitidis* <SEQ ID 1335>:

```
a501.seq (partial)
     1  ATGGTCGGAC GGGCCTTGAC CGCAGATGCC GACATATTTG TTCTGCTTGC

51  GGCAGGCGGA GATGGCAAGG TGCAGCATCA CTTTGACGGC AGGGTTGCGT

101  TCGTCAAACG ATTCGGATAC CAAGCCGCTG TCGCGGTCGA GACCGAGGGT

151  CAGTTGGGTC ATGTCGTTCG AGCCGATGGA GAAGCCGTCG AAGTATTGCA

201  GGAATTGTTC CGCCAATACC GCGTTGCTCG GCAGCTCGCA CATCATAATC

251  AGGCGCAGGC CGTTTTTGCC GCGTTCCAAG CCGTTTTCTT TCAGGGCTTT

301  GACAACGGCT TCGGCTTCGC CCAAAGTGCG GACGAACGGA ATCATGATTT

351  CAACGTTGGT CAACCCCATT TCATCGCGGA CGCGTTTCAA GGCTTTGCAT

401  TCCAAGGCGA AACAGTCTTT GAAGTTGTCG GCGACATAAC GCGCCGCACC

451  ACGGAAGCCC AACATCGGGT TTTCTTCATG CGGTTCGTAT ACGTTGCCGC

501  CGACCAGGTT GGCGTATTCG TTGGATTTGA AGTCGGACAT ACGGACGATG

551  GTTTTACGCG GATAAACCGA TGCGGCCAAT GTCGCCACGC CTTCGGCGAT

601  TTTATCGACG TAGAAGTCGA CAGGGGACGC GTAACCGGCG ATACGGCGGG

651  TAATTTCCGC TTTTAATTCG TCGTCTTGTT TGTCAAATTC CAACAAGGCT

701  TTGGGGTGGA TACCGATTTG GCGGTTGATG ATAAATTCCA TACGCGCCAA

751  GCCGATGCCT TCGCTGGGCA GGTTGGCGAA GCTGAATGCG AGTTCGGGAT

801  TGCCGACGTT CATCATGACT TTTACAGGTG CTTTAGGCAT GTTGTCCAAA

851  GCAACATCGG TAATTTGTAC GTCCAGCAGG CCGGAGTAGA TGAAGCCGGT

901  ATCGCCTTCG GCACAGGATA CGGTAACTTC TTGACCGTTT TTCAGCAATT
```

```
-continued
 951 CGGTTGCATT GCCGCAGCCG ACAACGGCAG GAATACCCAG TTCGCGCGCG

1001 ATGATGGCGG CGTGGCAGGT ACGTCCGCCC CTGTTGGTCA CGATGGCGGA

1051 AGCGCGTTTC ATCACCGGTT CCCAATCTGG GTCGGTCATG TCGGTAACCA

1101 GTACGTCGCC GGCTTCGACG GAATCCATCT CGGAAGCATC TTTAATCAGG

1151 CGTACCTTGC CCTGACCGAC TTTCTGACCG ATGGCGCGGC CTTCGCACAA

1201 GACGGTTTTT TCGCCGTTGA TAGAAAAGCG GCGCAGGTTG CGGCTGCCTT

1251 CTTCCTGGGA TTTGACGGTT TCGGGACGGG CTTGCAGGAT GTAGAGTTTG

1301 CCGTCCAAGC CGTCGCGTCC CCATTCGATG TCCATCGGGC GGCCGTAGTG

1351 TTTTTCGATG GTCAGTGCGT AATGCGCCAA CTCGGTGATT TCTTCGTCGG

1401 TAATGGAGAA GCGGTTGCGG TCTTCTTCGG GGACATCGAC GTTGGTTACC

1451 GATTTGCCGG CTTCTGCTTT GTCGGTAAAA ATCATTTTGA TGTGTTTTGA

1501 GCCCATGGTT TTGCGCAGGA TGGCAGGTTT GCCTGCTTTC AGCGTGGGTT

1551 TGAACACATA GAATTCGTCG GGATTGACTG CGCCTTGTAC GACGTTTTCG

1601 CCCAGACCGT AGGATGAAGT GACAAAGACG ACTTGGTCGT AACCGGATTC

1651 GGTATCGAGG GTGAACATCA C
```

This corresponds to the amino acid sequence <SEQ ID 1336;
ORF 501.a>:

```
a501.pep
    1 MVGRALTADA DIFVLLAAGG DGKVQHHFDG RVAFVKRFGY QAAVAVETEG

51 QLGHVVRADG EAVEVLQELF RQYRVARQLA HHNQAQAVFA AFQAVFFQGF

101 DNGFGFAQSA DERNHDFNVG QPHFIADAFQ GFAFQGETVF EVVGDITRRT

151 TEAQHRVFFM RFVYVAADQV GVFVGFEVGH TDDGFTRINR CGQCRHAFGD

201 FIDVEVDRGR VTGDTAGNFR F*FVVLFVKF QQGFGVDTDL AVDDKFHTRQ

251 ADAFAGQVGE AECEFGIADV HHDFYRCFRH VVQSNIGNLY VQQAGVDEAG

301 IAFGTGYGNF LTVFQQFGCI AAADNGRNTQ FARDDGGVAG TSAPVGHDGG

351 SAFHHRFPIW VGHVGNQYVA GFDGIHLGSI FNQAYLALTD FLTDGAAFAQ

401 DGFFAVDRKA AQVAAAFFLG FDGFGTGLQD VEFAVQAVAS PFDVHRAAVV

451 FFDGQCVMRQ LGDFFVGNGE AVAVFFGDID VGYRFAGFCF VGKNHFDVF*

501 AHGFAQDGRF ACFQRGFEHI EFVGIDCALY DVFAQTVG*S DKDDLVVTGF

551 GIEGEHH
``` m501/a501 90.3% identity in 557 aa overlap

```
                10         20         30         40         50         60
m501.pep   MVGXALTADADIFVLLAAGGDGKVQHHFDGRVAFVKRFGYQAAVAVETEGQLGHVVRADG
           |||  |||||||||||||||||||||||||||||||||||||||||||||||||||||||
a501       MVGRALTADADIFVLLAAGGDGKVQHHFDGRVAFVKRFGYQAAVAVETEGQLGHVVRADG
                10         20         30         40         50         60

70         80         90        100        110        120
m501.pep   EAVEVLQELFRQYRVARQLAHHNQAQAVFAAFQAVFFQGFDNGFGFAQSADERNHDFNVG
           ||||||||||||||||||||||||||||||||||||||||||||||||||||||||||||
a501       EAVEVLQELFRQYRVARQLAHHNQAQAVFAAFQAVFFQGFDNGFGFAQSADERNHDFNVG
                70         80         90        100        110        120

130        140        150        160        170        180
m501.pep   QPHFIADAFQGFAFQGETVFEVVGDITRRTTEAQHRVFFMRFVYVAADQVGVFVGFEVGH
           ||||||||||||||||||||||||||||||||||||||||||||||||||||||||||||
a501       QPHFIADAFQGFAFQGETVFEVVGDITRRTTEAQHRVFFMRFVYVAADQVGVFVGFEVGH
               130        140        150        160        170        180
```

-continued

```
                    190       200       210       220       230       240
m501.pep     TDDGFTRINRCGQCRHAFGDFIDVEVDRGRVTGDTAGNFRFXFVVLFVKFQQXFGVDTDL
             |||||||||||||||||||||||||||||||||||||||||||||||||||| |||||||
a501         TDDGFTRINRCGQCRHAFGDFIDVEVDRGRVTGDTAGNFRFXFVVLFVKFQQGFGVDTDL
                    190       200       210       220       230       240

250       260       270       280       290       300
m501.pep     AVDDKFHTRQADAFAGQVGEAECEFGIADVHHDFYRCFRHIVXGDIGNLYVQQTGIDKAG
             ||||||||||||||||||||||||||||||||||||||||:| ::||||||||:|:|:||
a501         AVDDKFHTRQADAFAGQVGEAECEFGIADVHHDFYRCFRHVVQSNIGNLYVQQAGVDEAG
                    250       260       270       280       290       300

310       320       330       340       350       360
m501.pep     IAFGTGYGNFLTVFQQFGCIAAADNGRNAQFTRDDGGVAGTAAAVGNDGRSTFHHGFPIR
             ||||||||||||||||||||||||||||:||:|||||||||:| ||:|| |:||| ||| 
a501         IAFGTGYGNFLTVFQQFGCIAAADNGRNTQFARDDGGVAGTSAPVGHDGGSAFHHRFPIW
                    310       320       330       340       350       360

370       380       390       400       410       420
m501.pep     IGHVGNEYVAGFDGIHLGSIFNQAHLALTDFLTDGAAFAXYGFVAVDGEAAQVAVALFLG
             :|||||:|||||||||||||||||:||||||||||||||  || ||| :|||||:|:|||
a501         VGHVGNQYVAGFDGIHLGSIFNQAYLALTDFLTDGAAFAQDGFFAVDRKAAQVAAAFFLG
                    370       380       390       400       410       420

430       440       450       460       470       480
m501.pep     FYGFGTGLQDVEFAVQAVASPFDIHRAAVVFFDGQCVMRQLSNFFVGNGEAVAVFLGDID
             | |||||||||||||||||||||:|||||||||||||||||::||||||||||||:||||
a501         FDGFGTGLQDVEFAVQAVASPFDVHRAAVVFFDGQCVMRQLGDFFVGNGEAVAVFFGDID
                    430       440       450       460       470       480

490       500       510       520       530       540
m501.pep     VGYGFTGFCFVGKNHFDVFXTHGFTQDGGLARFERGFEHXKFVRVDRTLYDVFAQTVRGG
             ||| |:||||||||||||||:|||:||| :| |:||||| :|| :| :|||||||||  :
a501         VGYRFAGFCFVGKNHFDVFXAHGFAQDGRFACFQRGFEHIEFVGIDCALYDVFAQTVGXS
                    490       500       510       520       530       540

550      559
m501.pep     NKDDLIVXGFGVEGEHHTX
             :||||:|:|||:|||||
a501         DKDDLVVTGFGIEGEHH
                    550
```

The following partial DNA sequence was identified in *N. gonorrhoeae* <SEQ ID 1337>:

```
g502.seq
     1  atgatgaaac cgcacaacct gttccaattc ctcgccgttt gctccctgac 51  cgtcgccgtc gcttccgcac aggcgggcgc ggtggacgcg ctcaagcaat 101  tcaacaacga tgccgacggt atcagcggca gcttcaccca aaccgtccaa 151  agcaaaaaga aaacccaaac cgcgcacggc acgttcaaaa tcctgcgccc 201  gggcctcttc aaatgggaat acactttgcc ctacagacag actattgtcg 251  gcgacggtca aaccgtttgg ctctacgatg ttgatttggc acaagtgacc 301  aagtcgtccc aagaccaggc catcggcggc agccccgccg ccatcctgtc 351  gaacaaaacc gccctcgaaa gcagttacac gctgaaagag gacggttcgt 401  ccaacggcat cgattatgtg cggggcaacg cccaaacgca acaacgccgg 451  ctaccaatac atccgcatcg gcttcaaagg cggcaacctc gccgccatgc 501  agcttaa
```

This corresponds to the amino acid sequence <SEQ ID 1338; ORF 502.ng>:

```
g502.pep
     1  MMKPHNLFQF LAVCSLTVAV ASAQAGAVDA LKQFNNDADG ISGSFTQTVQ

51  SKKKTQTAHG TFKILRPGLF KWEYTLPYRQ TIVGDGQTVW LYDVDLAQVT

101  KSSQDQAIGG SPAAILSNKT ALESSYTLKE DGSSNGIDYV RGNAQTQQRR

151  LPIHPHRLQR RQPRRHAA*
```

The following partial DNA sequence was identified in *N. meningitidis* <SEQ ID 1339>:

```
m502.seq
    1   atgatgaaac cgcacaacct gttccaattc ctcgccgttt gctccctgac
   51   cgtcgccgtc gcttccgcac aggcgggcgc ggtagacgcg cttaagcaat
  101   tcaacaacga tgccgacggt atcagcggca gcttcaccca amccgtccaa
  151   wgcaaaaaga aacccaaac cgcgcacggc acgttcaaaa tcctgcgacc
  201   gggccttttc aaatgggaat acaccaaact t.acaggcaa accatcgtcg
  251   gcgacggtca aacygtttgg ctmtacgatg tygatctggc acaagtgacc
  301   aagtcgtccc aagaccaggc cataggcgsc agccccgccg ccatcctgtc
  351   gaacaaarcc gccctcgaaa gcagctacac gctgaaagag gacggttcgt
  401   ccaacggcat cgattatgtg ggcaacgccc aaacgcaaca acgccggcta
  451   ccaatacatc cgcatcggct tcaaaggcgg caacctcgcc gccatgcagc
  501   tyaa
```

This corresponds to the amino acid sequence <SEQ ID 1340; ORF 502.ng>:

```
m502.pep
    1   MMKPHNLFQF LAVCSLTVAV ASAQAGAVDA LKQFNNDADG ISGSFTQXVQ
   51   XKKKTQTAHG TFKILRPGLF KWEYTKLYRQ TIVGDGQTVW LYDVDLAQVT
  101   KSSQDQAIGX SPAAILSNKX ALESSYTLKE DGSSNGIDYV GNAQTQQRRL
  151   PIHPHRLQRR QPRRHAAX
```

Computer analysis of this amino acid sequence gave the following results:
Homology with a Predicted ORF from *N. gonorrhoeae*
ORF 502 shows 95.8% identity over a 168 aa overlap with a predicted ORF (ORF 502.ng) from *N. gonorrhoeae*:

```
m502/g502
                    10         20         30         40         50         60
   m502.pep  MMKPHNLFQFLAVCSLTVAVASAQAGAVDALKQFNNDADGISGSFTQXVQXKKKTQTAHG
             |||||||||||||||||||||||||||||||||||||||||||||||:|| |||||||||
   g502      MMKPHNLFQFLAVCSLTVAVASAQAGAVDALKQFNNDADGISGSFTQTVQSKKKTQTAHG
                    10         20         30         40         50         60

70         80         90        100        110        120
   m502.pep  TFKILRPGLFKWEYTKLYRQTIVGDGQTVWLYDVDLAQVTKSSQDQAIGXSPAAILSNKX
             ||||||||||||||||| |||||||||||||||||||||||||||||||| |||||||||:
   g502      TFKILRPGLFKWEYTLPYRQTIVGDGQTVWLYDVDLAQVTKSSQDQAIGGSPAAILSNKT
                    70         80         90        100        110        120

130        140        150        160
   m502.pep  ALESSYTLKEDGSSNGIDYV-GNAQTQQRRLPIHPHRLQRRQPRRHAA
             |||||||||||||||||||| |||||||||||||||||||||||||||
   g502      ALESSYTLKEDGSSNGIDYVRGNAQTQQRRLPIHPHRLQRRQPRRHAA
                   130        140        150        160
```

The following partial DNA sequence was identified in *N. meningitidis* <SEQ ID 1341>:

```
a502.seq
    1   ATGATGAAAC CGCACAACCT GTTCCAATTC CTCGCCGTTT GCTCCCTGAC
   51   CGTCTCCGTC GCTTCCGCAC AGGCGGGCGC GGTGGACGCG CTCAAGCAAT
  101   TCAACAACGA TGCCGACGGT ATCAGCGGCA GCTTCACCCA AACCGTCCAA
  151   AGCAAAAAGA AACCCAAAC CGCGCACGGC ACGTTCAAAA TCCTGCGCCC
```

-continued

```
201   GGGCCTCTTT AAATGGGAAT ACACTTCGCC TTACAAACAG ACTATTGTCG

251   GCGACGGTCA AACCGTTTGG CTCTACGATG TCGATTTGGC ACAAGTGACC

301   AAGTCGTCCC AAGACCAGGC CATAGGCGGC AGCCCCGCCG CCATCCTGTC

351   GAACAAAACC GCCCTCGAAA GCAGCTACAC GCTGAAAGAG GACGGTTCGT

401   CCAACGGCAT CGATTATGTG GGCAACGCCC AAACGCAACA ACGCCGGCTA

451   CCAATACATC CGCATCGGCT TCAAAGGCGG CAACCTCGCC GCCATGCAGC

501   TTAA
```

This corresponds to the amino acid sequence <SEQ ID 1342; 502 217.a>:

```
a502.pep
    1   MMKPHNLFQF LAVCSLTVSV ASAQAGAVDA LKQFNNDADG ISGSFTQTVQ

51   SKKKTQTAHG TFKILRPGLF KWEYTSPYKQ TIVGDGQTVW LYDVDLAQVT

101   KSSQDQAIGG SPAAILSNKT ALESSYTLKE DGSSNGIDYV GNAQTQQRRL

151   PIHPHRLQRR QPRRHAA*
``` m502/a502 95.2% identity in 167 aa overlap

```
                 10         20         30         40         50         60
m502.pep   MMKPHNLFQFLAVCSLTVAVASAQAGAVDALKQFNNDADGISGSFTQXVQXKKKTQTAHG
           ||||||||||||||||||:|||||||||||||||||||||||||||| :|| ||||||||
a502       MMKPHNLFQFLAVCSLTVSVASAQAGAVDALKQFNNDADGISGSFTQTVQSKKKTQTAHG
                 10         20         30         40         50         60

70         80         90        100        110        120
m502.pep   TFKILRPGLFKWEYTKLYRQTIVGDGQTVWLYDVDLAQVTKSSQDQAIGXSPAAILSNKX
           |||||||||||||||| : ||||||||||||||||||||||||||||||| |||||||||:
a502       TFKILRPGLFKWEYTSPYKQTIVGDGQTVWLYDVDLAQVTKSSQDQAIGGSPAAILSNKT
                 70         80         90        100        110        120

130        140        150        160
m502.pep   ALESSYTLKEDGSSNGIDYVGNAQTQQRRLPIHPHRLQRRQPRRHAAX
           |||||||||||||||||||||||||||||||||||||||||||||||
a502       ALESSYTLKEDGSSNGIDYVGNAQTQQRRLPIHPHRLQRRQPRRHAAX
                130        140        150        160
```

The following partial DNA sequence was identified in N. gonorrhoeae <SEQ ID 1343>:

```
g502-1.seq
    1     ATGatGAAAc cgcaCaacct gttccaaTTc CTCGCCGTTT GCTCCCTGAC

51     CGTCGCCGTC GCTTCCGCAC AGGCGGGCGC GGTGGACGCG CTCAAGCAAT

101     TCAACAACGA TGCCGACGGT ATCAGCGGCA GCTTCACCCA AACCGTCCAA

151     AGCAAAAAGA AAACCCAAAC CGCGCACGGC ACGTTCAAAA TCCTGCGCCC

201     GGGCCTCTTC AAATGGGAAT ACACTTTGCC CTACAGACAG ACTATTGTCG

251     GCGACGGTCA AACCGTTTGG CTCTACGATG TTGATTTGGC ACAAGTGACC

301     AAGTCGTCCC AAGACCAGGC CATCGGCGGC AGCCCCGCCG CCATCCTGTC

351     GAACAAAACC GCCCTCGAAA GCAGTTACAC GCTGAAAGAG GACGGTTCGT

401     CCAACGGCAT CGATTATGTG CGGGCAACGC CCAAACGCAA CAACGCCGGC

451     TACCAATACA TCCGCATCGG CTTCAAAGGC GGCAACCTCG CCGCCATGCA

501     GCTTAAAGAC AGCTTCGGCA ACCAAACCTC CATCAGTTTC GGCGGTTTGA
```

```
-continued
    551  ATACCAATCC CCAACTCTCG CGCGGCGCGT TCAAGTTTAC CCCGCCCAAA

601  GGCGTGGACG TGTTGAGCAA CTGA
```

This corresponds to the amino acid sequence <SEQ ID 1344; ORF 502-1.ng>:

```
g502-1.pep
      1  MMKPHNLFQF LAVCSLTVAV ASAQAGAVDA LKQFNNDADG ISGSFTQTVQ

51  SKKKTQTAHG TFKILRPGLF KWEYTLPYRQ TIVGDGQTVW LYDVDLAQVT

101  KSSQDQAIGG SPAAILSNKT ALESSYTLKE DGSSNGIDYV RATPKRNNAG

151  YQYIRIGFKG GNLAAMQLKD SFGNQTSISF GGLNTNPQLS RGAFKFTPPK

201  GVDVLSN*
```

The following partial DNA sequence was identified in *N. meningitidis* <SEQ ID 1345>:

```
m502-1.seq
      1  ATGATGAAAC CGCACAACCT GTTCCAATTC CTCGCCGTTT GCTCCCTGAC

51  CGTCGCCGTC GCTTCCGCAC AGGCGGGCGC GGTAGACGCG CTTAAGCAAT

101  TCAACAACGA TGCCGACGGT ATCAGCGGCA GCTTCACCCA AACCGTCCAA

151  AGCAAAAAGA AAACCCAAAC CGCGCACGGC ACGTTCAAAA TCCTGCGACC

201  GGGCCTTTTC AAATGGGAAT ACACCAAACC TTACAGGCAA ACCATCGTCG

251  GCGACGGTCA AACCGTTTGG CTCTACGATG TTGATCTGGC ACAAGTGACC

301  AAGTCGTCCC AAGACCAGGC CATAGGCGGC AGCCCCGCCG CCATCCTGTC

351  GAACAAAACC GCCCTCGAAA GCAGCTACAC GCTGAAAGAG GACGGTTCGT

401  CCAACGGCAT CGATTATGTG CTGGCAACGC CAAACGCAA CAACGCCGGC

451  TACCAATACA TCCGCATCGG CTTCAAAGGC GGCAACCTCG CCGCCATGCA

501  GCTTAAAGAC AGCTTCGGCA ACCAAACCTC CATCAGTTTC GGCGGTTTGA

551  ATACCAATCC CCAACTCTCG CGCGGCGCGT TCAAGTTTAC CCCGCCCAAA

601  GGCGTGGACG TGTTGAGCAA CTGA
```

This corresponds to the amino acid sequence <SEQ ID 1346; ORF 502-1>:

```
m502-1.pep
      1  MMKPHNLFQF LAVCSLTVAV ASAQAGAVDA LKQFNNDADG ISGSFTQTVQ

51  SKKKTQTAHG TFKILRPGLF KWEYTKPYRQ TIVGDGQTVW LYDVDLAQVT

101  KSSQDQAIGG SPAAILSNKT ALESSYTLKE DGSSNGIDYV LATPKRNNAG

151  YQYIRIGFKG GNLAAMQLKD SFGNQTSISF GGLNTNPQLS RGAFKFTPPK

201  GVDVLSN*
``` m502-1/g502-1 99.0% identity in 207 aa overlap

```
                    10         20         30         40         50         60
m502-1.pep  MMKPHMLFQFLAVCSLTVAVASAQAGAVDALKQFNNDADGISGSFTQTVQSKKKTQTAHG
            ||||||||||||||||||||||||||||||||||||||||||||||||||||||||||||
g502-1      MMKPHMLFQFLAVCSLTVAVASAQAGAVDALKQFNNDADGISGSFTQTVQSKKKTQTAHG
                    10         20         30         40         50         60
```

-continued

```
                      70         80         90        100        110        120
m502-1.pep   TFKILRPGLFKWEYTKPYRQTIVGDGQTVWLYDVDLAQVTKSSQDQAIGGSPAAILSNKT
             ||||||||||||||||| ||||||||||||||||||||||||||||||||||||||||||
g502-1       TFKILRPGLFKWEYTLPYRQTIVGDGQTVWLYDVDLAQVTKSSQDQAIGGSPAAILSNKT
                      70         80         90        100        110        120

130        140        150        160        170        180
m502-1.pep   ALESSYTLKEDGSSNGIDYVLATPKRNNAGYQYIRIGFKGGNLAAMQLKDSFGNQTSISF
             ||||||||||||||||||||||| ||||||||||||||||||||||||||||||||||||
g502-1       ALESSYTLKEDGSSNGIDYVRATPKRNNAGYQYIRIGFKGGNLAAMQLKDSFGNQTSISF
                     130        140        150        160        170        180

190        200
m502-1.pep   GGLNTNPQLSRGAFKFTPPKGVDVLSNX
             ||||||||||||||||||||||||||||
g502-1       GGLNTNPQLSRGAFKFTPPKGVDVLSNX
                     190        200
```

15

The following partial DNA sequence was identified in *N. meningitidis* <SEQ ID 1347>:

```
a502-1.seq
       1    ATGATGAAAC CGCACAACCT GTTCCAATTC CTCGCCGTTT GCTCCCTGAC

51    CGTCTCCGTC GCTTCCGCAC AGGCGGGCGC GGTGGACGCG CTCAAGCAAT

101    TCAACAACGA TGCCGACGGT ATCAGCGGCA GCTTCACCCA AACCGTCCAA

151    AGCAAAAAGA AAACCCAAAC CGCGCACGGC ACGTTCAAAA TCCTGCGCCC

201    GGGCCTCTTT AAATGGGAAT ACACTTCGCC TTACAAACAG ACTATTGTCG

251    GCGACGGTCA AACCGTTTGG CTCTACGATG TCGATTTGGC ACAAGTGACC

301    AAGTCGTCCC AAGACCAGGC CATAGGCGGC AGCCCCGCCG CCATCCTGTC

351    GAACAAAACC GCCCTCGAAA GCAGCTACAC GCTGAAAGAG GACGGTTCGT

401    CCAACGGCAT CGATTATGTG CTGGCAACGC CCAAACGCAA CAACGCCGGC

451    TACCAATACA TCCGCATCGG CTTCAAAGGC GGCAACCTCG CCGCCATGCA

501    GCTTAAAGAC AGCTTCGGCA ATCAAACCTC CATCAGTTTC GGCGGTTTGA

551    ATACCAATCC CCAACTCTCG CGCGGCGCGT TCAAGTTTAC CCCGCCCAAA

601    GGCGTGGACG TGTTGAGCAA CTGA
```

This corresponds to the amino acid sequence <SEQ ID 1348; ORF 502-1.a>:

```
a502-1.pep
       1    MMKPHNLFQF LAVCSLTVSV ASAQAGAVDA LKQFNNDADG ISGSFTQTVQ

51    SKKKTQTAHG TFKILRPGLF KWEYTSPYKQ TIVGDGQTVW LYDVDLAQVT

101    KSSQDQAIGG SPAAILSNKT ALESSYTLKE DGSSNGIDYV LATPKRNNAG

151    YQYIRIGFKG GNLAAMQLKD SFGNQTSISF GGLNTNPQLS RGAFKFTPPK

201    GVDVLSN*
``` a502-1/m502-1 98.6% identity in 207 aa overlap

```
                      10         20         30         40         50         60
a502-1.pep   MMKPHNLFQFLAVCSLTVSVASAQAGAVDALKQFNNDADGISGSFTQTVQSKKKTQTAHG
             |||||||||||||||||:||||||||||||||||||||||||||||||||||||||||||
m502-1       MMKPHNLFQFLAVCSLTVAVASAQAGAVDALKQFNNDADGISGSFTQTVQSKKKTQTAHG
                      10         20         30         40         50         60

70         80         90        100        110        120
a502-1.pep   TFKILRPGLFKWEYTSPYKQTIVGDGQTVWLYDVDLAQVTKSSQDQAIGGSPAAILSNKT
             |||||||||||||||:||:|||||||||||||||||||||||||||||||||||||||||
m502-1       TFKILRPGLFKWEYTKPYRQTIVGDGQTVWLYDVDLAQVTKSSQDQAIGGSPAAILSNKT
                      70         80         90        100        110        120
```

-continued

```
                      130        140        150        160        170        180
    a502-1.pep   ALESSYTLKEDGSSNGIDYVLATPKRNNAGYQYIRIGFKGGNLAAMQLKDSFGNQTSISF
                 ||||||||||||||||||||||||||||||||||||||||||||||||||||||||||||
    m502-1       ALESSYTLKEDGSSNGIDYVLATPKRNNAGYQYIRIGFKGGNLAAMQLKDSFGNQTSISF
                      130        140        150        160        170        180

190        200
    a502-1.pep   GGLNTNPQLSRGAFKFTPPKGVDVLSNX
                 ||||||||||||||||||||||||||||
    m502-1       GGLNTNPQLSRGAFKFTPPKGVDVLSNX
                      190        200
```

The following partial DNA sequence was identified in *N. gonorrhoeae* <SEQ ID 1349>:

```
g503.seq
     1    atgtccgcgc cgtcggcatc ggtaatcatt ttgttccatg ccgcttcgat 51    ttcggcatcg agctgttcgg ggaagggcgt gtccaaaatc cattggcgga 101    tttctttgcc gacgcgtgcc agttcggaaa cgtcttcgac atccaatttt 151    gccagagcgg cggaaatgcg ttcgttcaga ccgttgtgtg cgagaaatgc 201    gcggtag
```

This corresponds to the amino acid sequence <SEQ ID 1350; ORF 503.ng>:

```
g503.pep
     1    MSAPSASVII LFHAASISAS SCSGKGVSKI HWRISLPTRA SSETSSTSNF

51    ARAAEMRSFR PLCARNAR*
```

The following partial DNA sequence was identified in *N. meningitidis* <SEQ ID 1351>:

```
m503.seq
     1    atgtccgcac cgccggcatc ggcaaccatt ttgttccatg ccgcttcgat 51    ttcggcatcg agctgttcgg ggaaaggcgt atccaaaatc cattggcgga 101    tttctttgcc gacgcgtgcc agttcggcaa cgtcttcgac atccaatttt 151    gccagtgcgg cggaaatgcg ttcgctcaga ccgttgtgtg cgaggaatgc 201    gcggtag
```

This corresponds to the amino acid sequence <SEQ ID 1352; ORF 503>:

```
m503.pep
     1    MSAPPASATI LFHAASISAS SCSGKGVSKI HWRISLPTRA SSATSSTSNF

51    ASAAEMRSLR PLCARNAR*
```

Computer analysis of this amino acid sequence gave the following results:

Homology with a Predicted ORF from *N. gonorrhoeae*

ORF 503 shows 91.2% identity over a 68 aa overlap with a predicted ORF (ORF 503.ng) from *N. gonorrhoeae*:

```
m503/g503
                       10         20         30         40         50         60
    m503.pep     MSAPPASATILFHAASISASSCSGKGVSKIHWRISLPTRASSATSSTSNFASAAEMRSLR
                 |||| ||:|||||||||||||||||||||||||||||||||| |||||||| ||||||:|
    g503         MSAPSASVIILFHAASISASSCSGKGVSKIHWRISLPTRASSETSSTSNFARAAEMRSFR
                       10         20         30         40         50         60
```

```
         69
m503.pep  PLCARNAR
          ||||||||
g503      PLCARNAR
```

The following partial DNA sequence was identified in *N. meningitidis* <SEQ ID 1353>:

```
a503.seq
    1   ATGTCCGCGC CGCCGGCATC GGCAACCATT TTGTTCCATG CCGCTTCGAT

51   TTCGGCATCG AGCTGTTCGG GGAAGGGCGT GTCCAAAATC CATTGGCGGA

101   TTTCTTTGCC GACGCGTGCC AGTTCGGCAA CGTCTTCGAC ATCTAATTTT

151   GCCAGTGCGG CGGAAATGCG TTCGCTCAGA CCGTTGTGTG CGAGGAATGC

201   GCGGTAG
```

This corresponds to the amino acid sequence <SEQ ID 1354; ORF 503.a>:

```
a503.pep
    1   MSAPPASATI LFHAASISAS SCSGKGVSKI HWRISLPTRA SSATSSTSNF

51   ASAAEMRSLR PLCARNAR*
``` m503/a503 100.0% identity in 68 aa overlap

```
                  10         20         30         40         50         60
m503.pep  MSAPPASATILFHAASISASSCSGKGVSKIHWRISLPTRASSATSSTSNFASAAEMRSLR
          ||||||||||||||||||||||||||||||||||||||||||||||||||||||||||||
a503      MSAPPASATILFHAASISASSCSGKGVSKIHWRISLPTRASSATSSTSNFASAAEMRSLR
                  10         20         30         40         50         60

69
m503.pep  PLCARNARX
          |||||||||
a503      PLCARNARX
```

The following partial DNA sequence was identified in *N. gonorrhoeae* <SEQ ID 1355>:

```
g503-1.seq
    1     ATGGCGCGGT CGTTGTACAG GGAGGCGAAA ACGTGGCGCA TCGCTTTTTT

51     AACGTTATCC AAGCCATTGA TATTCAGGAA GGTTTCCTGT TGGCCGGCAA

101     ATGATGCGTC GGGCAGGTCT TCGGCGGTTG CGGAAGAGCG TACGGCAACG

151     GAAATGTCCG CGCCGTCGGC ATCGGTAATC ATTTTGTTCC ATGCCGCTTC

201     GATTTCGGCA TCGAGCTGTT CGGGGAAGGG CGTGTCCAAA ATCCATTGGC

251     GGATTTCTTT GCCGACGCGT GCCAGTTCGG AAACGTCTTC GACATCCAAT

301     TTTGCCAGAG CGGCGGAAAT GCGTTCGTTC AGACCGTTGT GTGCGAGAAA

351     TGCGCGGTAG
```

This corresponds to the amino acid sequence <SEQ ID 1356; ORF 214.ng>:

```
g503-1.pep
    1     MARSLYREAK TWRIAFLTLS KPLIFRKVSC WPANDASGRS SAVAEERTAT

51     EMSAPSASVI ILFHAASISA SSCSGKGVSK IHWRISLPTR ASSETSSTSN

101     FARAAEMRSF RPLCARNAR*
```

The following partial DNA sequence was identified in *N. meningitidis* <SEQ ID 1357>:

```
m503-1.seq
    1     ATGGCACGGT CGTTATACAG GGAAGCGAAT ACATGGTGCA TCGCTTCTTT

51     AACGTTATCC AAGCCGTTGA TGTTCAAGAA GGTTTCCTGT TGTCCAGCGA

101     ATGATGCGTC CGGCAGGTCT TCGGCAGTTG CGGAAGAACG TACGGCAACG

151     GAAATGTCCG CACCGCCGGC ATCGGCAACC ATTTTGTTCC ATGCCGCTTC

201     GATTTCGGCA TCGAGCTGTT CGGGGAAAGG CGTATCCAAA ATCCATTGGC

251     GGATTTCTTT GCCGACGCGT GCCAGTTCGG CAACGTCTTC GACATCCAAT

301     TTTGCCAGTG CGGCGGAAAT GCGTTCGCTC AGACCGTTGT GTGCGAGGAA

351     TGCGCGGTAG
```

This corresponds to the amino acid sequence <SEQ ID 1358; ORF 503-1>:

```
m503-1.pep
    1     MARSLYREAN TWCIASLTLS KPLMFKKVSC CPANDASGRS SAVAEERTAT

51     EMSAPPASAT ILFHAASISA SSCSGKGVSK IHWRISLPTR ASSATSSTSN

101     FASAAEMRSL RPLCARNAR*
``` g503-1/m503-1 89.9% identity in 119 aa overlap

```
                   10         20         30         40         50         60
g503-1.pep  MARSLYREAKTWRIAFLTLSKPLIFRKVSCWPANDASGRSSAVAEERTATEMSAPSASVI
            ||||||||| :|| || ||||||||:|:|||| |||||||||||||||||||||||| |:
m503-1      MARSLYREANTWCIASLTLSKPLMFKKVSCCPANDASGRSSAVAEERTATEMSAPPASAT
                   10         20         30         40         50         60

70         80         90        100        110        120
g503-1.pep  ILFHAASISASSCSGKGVSKIHWRISLPTRASSETSSTSNFARAAEMRSFRPLCARNARX
            ||||||||||||||||||||||||||||||||| ||||||||| |||||:|||||||||
m503-1      ILFHAASISASSCSGKGVSKIHWRISLPTRASSATSSTSNFASAAEMRSLRPLCARNARX
                   70         80         90        100        110        120
```

The following partial DNA sequence was identified in *N. meningitidis* <SEQ ID 1359>:

```
a503-1.seq
    1     ATGGCGCGGT CGTTGTACAG GGAGGCGAAT ACATGGCGCA TCGCTTCTTT

51     AACGTTTTCC AAGCCGTTGA TATTCAGGAA GGTTTCCTGT TGGCCGGCAA

101     ATGATGCGTC GGGCAGGTCT TCGGCGGTTG CGGAAGAGCG TACGGCAACG

151     GAAATGTCCG CGCCGCCGGC ATCGGCAACC ATTTTGTTCC ATGCCGCTTC

201     GATTTCGGCA TCGAGCTGTT CGGGGAAGGG CGTGTCCAAA ATCCATTGGC

251     GGATTTCTTT GCCGACGCGT GCCAGTTCGG CAACGTCTTC GACATCTAAT

301     TTTGCCAGTG CGGCGGAAAT GCGTTCGCTC AGACCGTTGT GTGCGAGGAA

351     TGCGCGGTAG
```

This corresponds to the amino acid sequence <SEQ ID 1360; ORF 503-1.a>:

```
a503-1.pep
     1    MARSLYREAN TWRIASLTFS KPLIFRKVSC WPANDASGRS SAVAEERTAT

51    EMSAPPASAT ILFHAASISA SSCSGKGVSK IHWRISLPTR ASSATSSTSN

101    FASAAEMRSL RPLCARNAR*
``` a503-1/m503-1 95.8% identity in 119 aa overlap

```
                    10         20         30         40         50         60
    a503-1.pep  MARSLYREANTWRIASLTFSKPLIFRKVSCWPANDASGRSSAVAEERTATEMSAPPASAT
                ||||||||||| ||||:||||:|:|||| |||||||||||||||||||||||||||||||
    m503-1      MARSLYREANTWCIASLTLSKPLMFKKVSCCPANDASGRSSAVAEERTATEMSAPPASAT
                    10         20         30         40         50         60

70         80         90        100        110        120
    a503-1.pep  ILFHAASISASSCSGKGVSKIHWRISLPTRASSATSSTSNFASAAEMRSLRPLCARNARX
                ||||||||||||||||||||||||||||||||||||||||||||||||||||||||||||
    m503-1      ILFHAASISASSCSGKGVSKIHWRISLPTRASSATSSTSNFASAAEMRSLRPLCARNARX
                    70         80         90        100        110        120
```

The following partial DNA sequence was identified in *N. gonorrhoeae* <SEQ ID 1361>:

```
g504.seq
     1    atgttggttc aggacttgcc ttttgaagtc aaactgaaaa aattccatat 51    cgatttttac aatacgggta tgccgcgcga ttttgccagc gatattgaag 101    taacggacaa ggcaaccggt gagaaactcg agcgcaccat ccgcgtgaac 151    catcctttga ccttgcacgg catcacgatt tatcaggcga gttttgccga 201    cggcggttcg gatttgacat tcaaggcgtg gaatttgagg gatgcttcgc 251    gcgaacctgt cgtgttgaag gcaacctcca tacaccagtt tccgttggaa 301    atcggcaaac acaaatatcg tcttgagttc gatcagttca cttctatgaa 351    tgtggaggac atgagcgagg gtgcggaacg ggaaaaaagc ctgaaatcca 401    ctctgaacga tgtccgcgcc gttactcagg aaggtaaaaa atacaccaat 451    atcggccctt ccatcgtgta ccgcatccgt gatgcggcag ggcaggcggt 501    cgaatataaa aactatatgc tgccgatttt gcaggacaaa gattattttt 551    ggctgaccgg cacgcgcagc ggcttgcagc agcaataccg ctggctgcgt 601    atcccttgg acaagcagtt gaaagcggac acctttatgg cattgcgtga 651    gttttgaaa gatggggaag ggcgcaaacg tctggttgcc gacgcaacca 701    aagacgcacc tgccgaaatc cgcgaacaat tcatgctggc tgcggaaaac 751    acgctgaata tctttgcgca aaaaggctat ttgggattgg acgaatttat 801    tacgtccaat atcccgaaag ggcagcagga taagatgcag ggctatttct 851    acgaaatgct ttacggcgtg atgaacgctg ctttggatga accatacgc 901    cggtacggct tgcccgaatg gcagcaggat gaagcgcgga accgtttcct 951    gctgcacagt atggatgcct atacggggct gacggaatat cccgcgccta 1001    tgctgctcca gcttgacggg ttttccgagg tgcgttcctc aggtttgcag 1051    atgacccgtt cgccgggtgc gcttttggtc tatctcggct cggtattgtt 1101    ggttttgggt acagtattta tgttttatgt gcccaaaaaa cgggcgtggg 1151    tattgttttc aaacdgcaaa atccgttttg ctatgtcttc ggcccgcagc
```

-continued
```
1201  gaacgggatt tgcagaagga atttccaaaa cacgtcgaga gcctgcaacg 1251  gctcggcaag gacttgaatc atgactga
```

This corresponds to the amino acid sequence <SEQ ID 1362; ORF 504.ng>:

```
g504.pep
    1   MLVQDLPFEV KLKKFHIDFY NTGMPRDFAS DIEVTDKATG EKLERTIRVN

51   HPLTLHGITI YQASFADGGS DLTFKAWNLR DASREPVVLK ATSIHQFPLE

101   IGKHKYRLEF DQFTSMNVED MSEGAEREKS LKSTLNDVRA VTQEGKKYTN

151   IGPSIVYRIR DAAGQAVEYK NYMLPILQDK DYFWLTGTRS GLQQQYRWLR

201   IPLDKQLKAD TFMALREFLK DGEGRKRLVA DATKDAPAEI REQFMLAAEN

251   TLNIFAQKGY LGLDEFITSN IPKGQQDKMQ GYFYEMLYGV MNAALDETIR

301   RYGLPEWQQD EARNRFLLHS MDAYTGLTEY PAPMLLQLDG FSEVRSSGLQ

351   MTRSPGALLV YLGSVLLVLG TVFMFYVPKK RAWVLFSNKI RFAMSSARSE

401   RDLQKEFPKH VESLQRLGKD LNHD*
```

The following partial DNA sequence was identified in *N. meningitidis* <SEQ ID 1363>:

```
m504.seq..
    1       atattggttc aggacttgcc ttttgaagtc aaactgaaaa aattccatat 51       cgatttttac aatacgggta tgccgcgtga tttcgccagc gatattgaag 101       tgacggacaa ggcaaccggt gagaaactcg agcgcaccat ccgcgtgaac 151       catcctttga ccttgcacgg catcacgatt tatcaggcga gttttgccga 201       cggcggttcg gatttgacat tcaaggcgtg gaatttgggt gatgcttcgc 251       gcgagcctgt cgtgttgaag gcaacatcca tacaccagtt tccgttggaa 301       attggcaaac acaaatatcg tcttgagttc gatcagttca cttctatgaa 351       tgtggaggac atgagcgagg gcgcggaacg ggaaaaaagc ctgaaatcca 401       cgctgmmcga tgtccgcgcc gttactcagg aaggtaaaaa atacaccaat 451       atcggccctt ccattgttta ccgtatccgt gatgcggcag ggcaggcggt 501       cgaatataaa aactatatgc tgccggtttt gcaggaacag gattattttt 551       ggattaccgg cacgcgcagc ggcttgcagc agcaataccg ctggctgcgt 601       atcccttgg acaagcagtt gaaagcggac accttatgg cattgcgtga 651       gttttgaaa gatggggaag ggcgcaaacg tctggttgcc gacgcaacca 701       aaggcgcacc tgccgaaatc cgcgaacaat tcatgctggc tgcggaaaac 751       acgctgaaca tctttgcaca aaaaggctat ttgggattgg acgaatttat 801       tacgtccaat atcccgaaag agcagcagga taagatgcag ggctatttct 851       acgaaatgct ttacggcgtg atgaacgctg ctttggatga accatacgc 901       cggtacggct tgcccgaatg gcagcaggat gaagcgcgga atcgtttcct 951       gctgcacagt atggatgcgt acacgggttt gaccgaatat cccgcgccta 1001       tgctgctgca acttgatggg ttttccgagg tgcgttcgtc gggtttgcag 1051       atgacccgtt ccccgggtgc gcttttggtc tatctcggct cggtgctgtt 1101       ggtattgggt acggtattga tgttttatgt gcgcgaaaaa cgggcgtggg
```

```
1151   tattgttttc agacggcaaa atccgttttg ccatgtcttc ggcccgcagc 1201   gaacgggatt tgcagaagga atttccaaaa cacgtcgaga gtctgcaacg 1251   gctcggcaag gacttgaatc atga
```

This corresponds to the amino acid sequence <SEQ ID 1364; ORF 504>:

```
m504.pep..
     1    ILVQDLPFEV KLKKFHIDFY NTGMPRDFAS DIEVTDKATG EKLERTIRVN

51    HPLTLHGITI YQASFADGGS DLTFKAWNLG DASREPVVLK ATSIHQFPLE

101    IGKHKYRLEF DQFTSMNVED MSEGAEREKS LKSTLXDVRA VTQEGKKYTN

151    IGPSIVYRIR DAAGQAVEYK NYMLPVLQEQ DYFWITGTRS GLQQQYRWLR

201    IPLDKQLKAD TFMALREFLK DGEGRKRLVA DATKGAPAEI REQFMLAAEN

251    TLNIFAQKGY LGLDEFITSN IPKEQQDKMQ GYFYEMLYGV MNAALDETIR

301    RYGLPEWQQD EARNRFLLHS MDAYTGLTEY PAPMLLQLDG FSEVRSSGLQ

351    MTRSPGALLV YLGSVLLVLG TVLMFYVREK RAWVLFSDGK IRFAMSSARS

401    ERDLQKEFPK HVESLQRLGK DLNHD*
```

Computer analysis of this amino acid sequence gave the following results:
Homology with a Predicted ORF from *N. gonorrhoeae*
ORF 504 shows 96.7% identity over a 425 aa overlap with a predicted ORF (ORF 504.ng) from *N. gonorrhoeae*:

```
m504/g504
                  10         20         30         40         50         60
   m504.pep  ILVQDLPFEVKLKKFHIDFYNTGMPRDFASDIEVTDKATGEKLERTIRVNHPLTLHGITI
             :||||||||||||||||||||||||||||||||||||||||||||||||||||||||||
   g504      MLVQDLPFEVKLKKFHIDFYNTGMPRDFASDIEVTDKATGEKLERTIRVNHPLTLHGITI
                  10         20         30         40         50         60

70         80         90        100        110        120
   m504.pep  YQASFADGGSDLTFKAWNLGDASREPVVLKATSIHQFPLEIGKHKYRLEFDQFTSMNVED
             ||||||||||||||||||||| ||||||||||||||||||||||||||||||||||||||
   g504      YQASFADGGSDLTFKAWNLRDASREPVVLKATSIHQFPLEIGKHKYRLEFDQFTSMNVED
                  70         80         90        100        110        120

130        140        150        160        170        180
   m504.pep  MSEGAEREKSLKSTLXDVRAVTQEGKKYTNIGPSIVYRIRDAAGQAVEYKNYMLPVLQEQ
             ||||||||||||||| |||||||||||||||||||||||||||||||||||||:||::
   g504      MSEGAEREKSLKSTLNDVRAVTQEGKKYTNIGPSIVYRIRDAAGQAVEYKNYMLPILQDK
                 130        140        150        160        170        180

190        200        210        220        230        240
   m504.pep  DYFWITGTRSGLQQQYRWLRIPLDKQLKADTFMALREFLKDGEGRKRLVADATKGAPAEI
             ||||:|||||||||||||||||||||||||||||||||||||||||||||||| ||||
   g504      DYFWLTGTRSGLQQQYRWLRIPLDKQLKADTFMALREFLKDGEGRKRLVADATKDAPAEI
                 190        200        210        220        230        240

250        260        270        280        290        300
   m504.pep  REQFMLAAENTLNIFAQKGYLGLDEFITSNIPKEQQDKMQGYFYEMLYGVMNAALDETIR
             |||||||||||||||||||||||||||||||| |||||||||||||||||||||||||||
   g504      REQFMLAAENTLNIFAQKGYLGLDEFITSNIPKGQQDKMQGYFYEMLYGVMNAALDETIR
                 250        260        270        280        290        300

310        320        330        340        350        360
   m504.pep  RYGLPEWQQDEARNRFLLHSMDAYTGLTEYPAPMLLQLDGFSEVRSSGLQMTRSPGALLV
             ||||||||||||||||||||||||||||||||||||||||||||||||||||||||||||
   g504      RYGLPEWQQDEARNRFLLHSMDAYTGLTEYPAPMLLQLDGFSEVRSSGLQMTRSPGALLV
                 310        320        330        340        350        360

370        380        390        400        410        420
   m504.pep  YLGSVLLVLGTVLMFYVREKRAWVLFSDGKIRFAMSSARSERDLQKEFPKHVESLQRLGK
             |||||||||||:||||:||||||||||||: |||||||||||||||||||||||||||||
   g504      YLGSVLLVLGTVFMFYVPKKRAWVLFSN-KIRFAMSSARSERDLQKEFPKHVESLQRLGK
                 370        380        390        400        410 m504.pep  DLNHD
             |||||
   g504      DLNHD
             420
```

The following partial DNA sequence was identified in *N. meningitidis* <SEQ ID 1365>:

a504.seq

1 ATATTGGTTC AGGACTTGCC TTTTGAAGTC AAACTGAAAA AATTCCATAT

51 CGATTTTTAC AATACGGGTA TGCCGCGCGA TTTTGCCAGT GATATTGAAG

101 TAACGGATAA GGCAACCGGT GAGAAACTCG AGCGCACCAT CCGCGTGAAC

151 CATCCTTTGA CCTTGCACGG CATCACGATT TATCAGGCGA GTTTTGCCGA

201 CGGCGGTTCG GATTTGACAT TCAAGGCGTG GAATTTGGGT GATGCTTCGC

251 GCGAGCCTGT CGTGTTGAAG GCAACATCCA TACACCAGTT TCCGTTGGAA

301 ATTGGCAAAC ACAAATATCG TCTTGAGTTC GATCAGTTTA CTTCTATGAA

351 TGTGGAGGAC ATGAGCGAGG GCGCGGAACG GGAAAAAAGC CTGAAATCCA

401 CGCTGAACGA TGTCCGCGCC GTTACTCAGG AAGGTAAAAA ATACACCAAT

451 ATCGGCCCTT CCATTGTTTA CCGTATCCGT GATGCGGCAG GGCAGGCGGT

501 CGAATATAAA AACTATATGC TGCCGGTTTT GCAGGAACAG GATTATTTTT

551 GGATTACCGG CACGCGCAGC GGCTTGCAGC AGCAATACCG CTGGCTGCGT

601 ATCCCCTTGG ACAAGCAGTT GAAAGCGGAC ACCTTTATGG CATTGCGTGA

651 GTTTTTGAAA GATGGGGAAG GGCGCAAACG TCTGGTTGCC GACGCAACCA

701 AAGGCGCACC TGCCGAAATC CGCGAACAAT TCATGCTGGC TGCGGAAAAC

751 ACGCTGAACA TCTTTGCACA AAAAGGCTAT TTGGGATTGG ACGAATTTAT

801 TACGTCCAAT ATCCCGAAAG AGCAGCAGGA TAAGATGCAG GGCTATTTCT

851 ACGAAATGCT TTACGGCGTG ATGAACGCTG CTTTGGATGA AACCATACGC

901 CGGTACGGCT TGCCCGAATG GCAGCAGGAT GAAGCGCGGA ATCGTTTCCT

951 GCTGCACAGT ATGGATGCGT ACACGGGTTT GACCGAATAT CCCGCGCCTA

1001 TGCTGCTGCA ACTTGATGGG TTTTCCGAGG TGCGTTCGTC GGGTTTGCAG

1051 ATGACCCGTT CCCCGGGTGC GCTTTTGGTC TATCTCGGCT CGGTGCTGTT

1101 GGTATTGGGT ACGGTATTGA TGTTTTATGT GCGCGAAAAA CGGGCGTGGG

1151 TATTGTTTTC AGACGGCAAA ATCCGTTTTG CCATGTCTTC GGCTTGCAGC

1201 GAACGGGATT TGCAGAAGGA ATTTCCAAAA CACGTCGAGA GTCTGCAACG

1251 GCTCGGCAAG GACTTGAATC ATGACTGA

This corresponds to the amino acid sequence <SEQ ID 1366; ORF 504.a>:

a504.pep

1 ILVQDLPFEV KLKKFHIDFY NTGMPRDFAS DIEVTDKATG EKLERTIRVN

51 HPLTLHGITI YQASFADGGS DLTFKAWNLG DASREPVVLK ATSIHQFPLE

101 IGKHKYRLEF DQFTSMNVED MSEGAEREKS LKSTLNDVRA VTQEGKKYTN

151 IGPSIVYRIR DAAGQAVEYK NYMLPVLQEQ DYFWITGTRS GLQQQYRWLR

201 IPLDKQLKAD TFMALREFLK DGEGRKRLVA DATKGAPAEI REQFMLAAEN

251 TLNIFAQKGY LGLDEFITSN IPKEQQDKMQ GYFYEMLYGV MNAALDETIR

301 RYGLPEWQQD EARNRFLLHS MDAYTGLTEY PAPMLLQLDG FSEVRSSGLQ

351 MTRSPGALLV YLGSVLLVLG TVLMFYVREK RAWVLFSDGK IRFAMSSARS

401 ERDLQKEFPK HVESLQRLGK DLNHD* m504/a504 99.8% identity in 425 aa overlap

```
                 10        20        30        40        50        60
    m504.pep  ILVQDLPFEVKLKKFHIDFYNTGMPRDFASDIEVTDKATGEKLERTIRVNHPLTLHGITI
              ||||||||||||||||||||||||||||||||||||||||||||||||||||||||||||
    a504      ILVQDLPFEVKLKKFHIDFYNTGMPRDFASDIEVTDKATGEKLERTIRVNHPLTLHGITI
                 10        20        30        40        50        60

70        80        90       100       110       120
    m504.pep  YQASFADGGSDLTFKAWNLGDASREPVVLKATSIHQFPLEIGKHKYRLEFDQFTSMNVED
              ||||||||||||||||||||||||||||||||||||||||||||||||||||||||||||
    a504      YQASFADGGSDLTFKAWNLGDASREPVVLKATSIHQFPLEIGKHKYRLEFDQFTSMNVED
                 70        80        90       100       110       120

130       140       150       160       170       180
    m504.pep  MSEGAEREKSLKSTLXDVRAVTQEGKKYTNIGPSIVYRIRDAAGQAVEYKNYMLPVLQEQ
              |||||||||||||||   ||||||||
    a504      GLIFPLVHHVGTDGNNSGRQVSNVYFANVAGSALGPVLIGFVILDFLSTQQIYLLICLIS
                130       140       150       160       170       180

190       200       210       220       230       240
    m504.pep  DYFWITGTRSGLQQQYRWLRIPLDKQLKADTFMALREFLKDGEGRKRLVADATKGAPAEI
              ||||||||||||||||||||||||||||||||||||||||||||||||||||||||||||
    a504      DYFWITGTRSGLQQQYRWLRIPLDKQLKADTFMALREFLKDGEGRKRLVADATKGAPAEI
                190       200       210       220       230       240

250       260       270       280       290       300
    m504.pep  REQFMLAAENTLNIFAQKGYLGLDEFITSNIPKEQQDKMQGYFYEMLYGVMNAALDETIR
              ||||||||||||||||||||||||||||||||||||||||||||||||||||||||||||
    a504      REQFMLAAENTLNIFAQKGYLGLDEFITSNIPKEQQDKMQGYFYEMLYGVMNAALDETIR
                250       260       270       280       290       300

310       320       330       340       350       360
    m504.pep  RYGLPEWQQDEARNRFLLHSMDAYTGLTEYPAPMLLQLDGFSEVRSSGLQMTRSPGALLV
              ||||||||||||||||||||||||||||||||||||||||||||||||||||||||||||
    a504      RYGLPEWQQDEARNRFLLHSMDAYTGLTEYPAPMLLQLDGFSEVRSSGLQMTRSPGALLV
                310       320       330       340       350       360

370       380       390       400       410       420
    m504.pep  YLGSVLLVLGTVLMFYVREKRAWVLFSDGKIRFAMSSARSERDLQKEFPKHVESLQRLGK
              ||||||||||||||||||||||||||||||||||||||||||||||||||||||||||||
    a504      YLGSVLLVLGTVLMFYVREKRAWVLFSDGKIRFAMSSARSERDLQKEFPKHVESLQRLGK
                370       380       390       400       410       420 m504.pep  DLNHDX
              ||||||
    a504      DLNHDX
```

The following partial DNA sequence was identified in *N. gonorrhoeae* <SEQ ID 1367>:

```
g505.seq
    1  atgtttcgtt tacaattcag gctgtttccc cctttgcgaa ccgccatgca
   51  catcctgttg accgccctgc tcaaatgcct ctccctgctg tcgctttcct
  101  gtctgcacac gctgggaaac cggctcggac atctggcgtt ttacctttta
  151  aaggaagacc gcgcgcgcat cgtcgccaat atgcggcagg cgggtttgaa
  201  ccccgacacg cagacggtca aagccgtttt tgcggaaacg gcaaaatgcg
  251  gtttggaact tgcccccgcg ttttcaaaa accggaaga catcgaaaca
  301  atgttcaaag cggtacacgg ctgggaacac gtgcagcagg ctttggacaa
  351  gggcgaaggg ctgctgttca tcacgccgca catcggcagc tacgatttgg
  401  gcggacgcta catcagccag cagcttccgt tccacctgac cgccatgtac
  451  aagccgccga aaatcaaagc gatagacaaa atcatgcagg cgggcagggt
  501  gcgcggcaaa ggcaaaaccg cgcccaccgg catacaaggg gtcaaacaaa
  551  tcatcaaggc cctgcgcgcg ggcgaggcaa ccatcatcct gcccgaccac
  601  gtcccttctc cgcaggaagg cggcggcgtg tgggcggatt ttttcggcaa
  651  acctgcatac accatgacac tggcggcaaa attggcacac gtcaaaggcg
  701  tgaaaaccct gttttttctgc tgcgaacgcc tgcccgacgg acaaggcttc
  751  gtgttgcaca tccgccccgt ccaagggggaa ttgaacggca acaaagccca
```

```
-continued
801  cgatgccgcc gtgttcaacc gcaataccga atattggata cgccgttttc 851  cgacgcagta tctgtttatg tacaaccgct ataaaacgcc gtaa
```

This corresponds to the amino acid sequence <SEQ ID 1368; ORF 505.ng>:

```
g505.pep
  1  MFRLQFRLFP PLRTAMHILL TALLKCLSLL SLSCLHTLGN RLGHLAFYLL

51  KEDRARIVAN MRQAGLNPDT QTVKAVFAET AKCGLELAPA FFKKPEDIET

101  MFKAVHGWEH VQQALDKGEG LLFITPHIGS YDLGGRYISQ QLPFHLTAMY

151  KPPKIKAIDK IMQAGRVRGK GKTAPTGIQG VKQIIKALRA GEATIILPDH

201  VPSPQEGGGV WADFFGKPAY TMTLAAKLAH VKGVKTLFFC CERLPDGQGF

251  VLHIRPVQGE LNGNKAHDAA VFNRNTEYWI RRFPTQYLFM YNRYKTP*
```

The following partial DNA sequence was identified in *N. meningitidis* <SEQ ID 1369>:

```
m505.seq (partial)
  1  GGCATGTTTC GTTTACAATT CAGGCTGTTT CCCCCTTTGC GAACCGCCAT

51  GCACATCCTG TTGACCGCCC TGCTCAAATG CCTCTCCCTG CTGCCGCTTT

101  CCTGTCTGCA CACGCTGGGA AACCGGCTCG GACATCTGGC GTTTTACCTT

151  TTAAAGGAAG ACCGCGCGCG CATCGTCGCC AATATGCGGC AGGCGGGTTT

201  GAACCCCGAC CCCAAAACGG TCAAAGCCGT TTTTGCGGAA ACGGCAAAAG

251  GCGGTTTGGA ACTTGCCCCC GCGTTTTTCA GAAAACCGGA AGACATAGAA

301  ACAATGTTCA AAGCGGTACA CGGCTGGGAA CATGTGCAGC AGGCTTTGGA

351  CAAACACGAA GGGCTGCTAT TCATCACGCC GCACATCGGC AGCTACGATT

401  TGGGCGGACG CTACATCAGC CAGCAGCTTC CGTTCCCGCT GACCGCCATG

451  TACAAACCGC CGAAAATCAA AGCGATAGAC AAAATCATGC AGGCGGGCAG

501  GGTTCGCGGC AAAGGAAAAA CCGCGCCTAC CAGCATACAA GGGGTCAAAC

551  AAATCATCAA AGCCCTGCGT TCGGGCGAgC AACCATCGTC CTGCCCGACC

601  ACGTCCCCTC CCCTCAAGAA GGCGGGGAAG GCGTATGGGT GGATTTCTTC

651  GGCAAACCTG CCTATACCAT GACGCTGGCG GCAArATTGG CACACGTCAA

701  AGGCGTGAAA ACCCTGTTTT TCTGCTGCGA ACGCCTGCCT GGCGGACAAG

751  GTTTCGATTT GCACATCCGC CCCGTCCAAG GGGAATTGAA CGGCGACAAA

801  GCCCATGATG CCGCCGTGTT CAACCGCAAT GCCGAATATT GGATACGCCG

851  TTTTCCGACG CAtATC....
```

This corresponds to the amino acid sequence <SEQ ID 1370; ORF 505>:

```
m505.pep (partial)
  1  MFRLQFRLFP PLRTAMHILL TALLKCLSLL PLSCLHTLGN RLGHLAFYLL

51  KEDRARIVAN MRQAGLNPDP KTVKAVFAET AKGGLELAPA FFRKPEDIET

101  MFKAVHGWEH VQQALDKHEG LLFITPHIGS YDLGGRYISQ QLPFPLTAMY

151  KPPKIKAIDK IMQAGRVRGK GKTAPTSIQG VKQIIKALRS GEATIVLPDH
```

```
    201  VPSPQEGGEG VWVDFFGKPA YTMTLAAXLA HVKGVKTLFF CCERLPGGQG

251  FDLHIRPVQG ELNGDKAHDA AVFNRNAEYW IRRFPTHI...
```

Computer analysis of this amino acid sequence gave the following results:
Homology with a Predicted ORF from *N. gonorrhoeae*
ORF 505 shows 93.7% identity over a 287 aa overlap with a predicted ORF (ORF 505.ng) from *N. gonorrhoeae*:

```
m505/g505
                     10         20         30         40         50         60
   m505.pep  MFRLQFRLFPPLRTAMHILLTALLKCLSLLPLSCLHTLGNRLGHLAFYLLKEDRARIVAN
             ||||||||||||||||||||||||||||||||||||||||||||||||||||||||||||
       g505  MFRLQFRLFPPLRTAMHILLTALLKCLSLLPLSCLHTLGNRLGHLAFYLLKEDRARIVAN
                     10         20         30         40         50         60

70         80         90        100        110        120
   m505.pep  MRQAGLNPDPKTVKAVFAETAKGGLELAPAFFRKPEDIETMFKAVHGWEHVQQALDKHEG
             ||||||||||:|||||||||||||| |||||||||:||||||||||||||||||||| ||
       g505  MRQAGLNPDTQTVKAVFAETAKCGLELAPAFFKKPEDIETMFKAVHGWEHVQQALDKGEG
                     70         80         90        100        110        120

130        140        150        160        170        180
   m505.pep  LLFITPHIGSYDLGGRYISQQLPFPLTAMYKPPKIKAIDKIMQAGRVRGKGKTAPTSIQG
             |||||||||||||||||||||||||| ||||||||||||||||||||||||||||||:|||
       g505  LLFITPHIGSYDLGGRYISQQLPFHLTAMYKPPKIKAIDKIMQAGRVRGKGKTAPTGIQG
                    130        140        150        160        170        180

190        200        210        220        230        240
   m505.pep  VKQIIKALRSGEATIVLPDHVPSPQEGGEGVWVDFFGKPAYTMTLAAXLAHVKGVKTLFF
             ||||||||:|||||:|||||||||||||| |||:||||||||||||| ||||||||||||
       g505  VKQIIKALRAGEATIILPDHVPSPQEGG-GVWADFFGKPAYTMTLAAKLAHVKGVKTLFF
                    190        200        210        220        230        240

250        260        270        280        289
   m505.pep  CCERLPGGQGFDLHIRPVQGELNGDKAHDAAVFNRNAEYWIRRFPTHI
             |||||| |||| |||||||||||||:|||||||||:||||||||:
       g505  CCERLPDGQGFVLHIRPVQGELNGNKAHDAAVFNRNTEYWIRRFPTQYLFMYNRYKTP
                240        250        260        270        280        290
```

The following partial DNA sequence was identified in *N. meningitidis* <SEQ ID 1371>:

```
a505.seq
     1   ATGTTTCGTT TACAATTCAG GCTGTTTCCC CCTTTGCGAA CCGCCATGCA

51   CATCCTGTTG ACCGCCCTGC TCAAATGCCT CTCCCTGCTG CCGCTTTCCT

101   GTCTGCACAC GCTGGGAAAC CGGCTCGGAC ATCTGGCGTT TTACCTTTTA

151   AAGGAAGACC GCGCGCGCAT CGTCGCCAAT ATGCGTCAGG CAGGCATGAA

201   TCCCGACCCC AAAACGGTCA AGCCGTTTT TGCGGAAACG GCAAAAGGCG

251   GTTTGGAACT TGCCCCCGCG TTTTTCAGAA AACCGGAAGA CATAGAAACA

301   ATGTTCAAAG CGGTACACGG CTGGGAACAT GTGCAGCAGG CTTTGGACAA

351   ACACGAAGGG CTGCTATTCA TCACGCCGCA CATCGGCAGC TACGATTTGG

401   GCGGACGCTA CATCAGCCAG CAGCTTCCGT TCCCGCTGAC CGCCATGTAC

451   AAACCGCCGA AAATCAAAGC GATAGACAAA ATCATGCAGG CGGGCAGGGT

501   TCGCGGCAAA GGAAAAACCG CGCCTACCAG CATACAAGGG GTCAAACAAA

551   TCATCAAAGC CCTGCGTTCG GGCGAAGCAA CCATCGTCCT GCCCGACCAC

601   GTCCCCTCCC CTCAAGAAGG CGGGGAAGGC GTATGGGTGG ATTTCTTCGG

651   CAAACCTGCC TATACCATGA CGCTGGCGGC AAAATTGGCA CACGTCAAAG

701   GCGTGAAAAC CCTGTTTTTC TGCTGCGAAC GCCTGCCTGG CGGACAAGGT

751   TTCGATTTGC ACATCCGCCC CGTCCAAGGG GAATTGAACG GCGACAAAGC
```

-continued

```
801  CCATGATGCC GCCGTGTTCA ACCGCAATGC CGAATATTGG ATACGCCGTT

851  TTCCGACGCA GTATCTGTTT ATGTACAACC GCTACAAAAT GCCGTAA
```

This corresponds to the amino acid sequence <SEQ ID 1372; ORF 505.a>:

```
a505.pep
   1  MFRLQFRLFP PLRTAMHILL TALLKCLSLL PLSCLHTLGN RLGHLAFYLL

51  KEDRARIVAN MRQAGMNPDP KTVKAVFAET AKGGLELAPA FFRKPEDIET

101  MFKAVHGWEH VQQALDKHEG LLFITPHIGS YDLGGRYISQ QLPFPLTAMY

151  KPPKIKAIDK IMQAGRVRGK GKTAPTSIQG VKQIIKALRS GEATIVLPDH

201  VPSPQEGGEG VWVDFFGKPA YTMTLAAKLA HVKGVKTLFF CCERLPGGQG

251  FDLHIRPVQG ELNGDKAHDA AVFNRNAEYW IRRFPTQYLF MYNRYKMP*
``` m505/a505 99.0% identity in 287 aa overlap

```
                  10         20         30         40         50         60
m505.pep  MFRLQFRLFPPLRTAMHILLTALLKCLSLLPLSCLHTLGNRLGHLAFYLLKEDRARIVAN
          ||||||||||||||||||||||||||||||||||||||||||||||||||||||||||||
a505      MFRLQFRLFPPLRTAMHILLTALLKCLSLLPLSCLHTLGNRLGHLAFYLLKEDRARIVAN
                  10         20         30         40         50         60

70         80         90        100        110        120
m505.pep  MRQAGLNPDPKTVKAVFAETAKGGLELAPAFFRKPEDIETMFKAVHGWEHVQQALDKHEG
          |||||:||||||||||||||||||||||||||||||||||||||||||||||||||||||
a505      MRQAGMNPDPKTVKAVFAETAKGGLELAPAFFRKPEDIETMFKAVHGWEHVQQALDKHEG
                  70         80         90        100        110        120

130        140        150        160        170        180
m505.pep  LLFITPHIGSYDLGGRYISQQLPFPLTAMYKPPKIKAIDKIMQAGRVRGKGKTAPTSIQG
          ||||||||||||||||||||||||||||||||||||||||||||||||||||||||||||
a505      LLFITPHIGSYDLGGRYISQQLPFPLTAMYKPPKIKAIDKIMQAGRVRGKGKTAPTSIQG
                 130        140        150        160        170        180

190        200        210        220        230        240
m505.pep  VKQIIKALRSGEATIVLPDHVPSPQEGGEGVWVDFFGKPAYTMTLAAXLAHVKGVKTLFF
          |||||||||||||||||||||||||||||||||||||||||||||| |||||||||||||
a505      VKQIIKALRSGEATIVLPDHVPSPQEGGEGVWVDFFGKPAYTMTLAAKLAHVKGVKTLFF
                 190        200        210        220        230        240

250        260        270        280
m505.pep  CCERLPGGQGFDLHIRPVQGELNGDKAHDAAVFNRNAEYWIRRFPTHI
          ||||||||||||||||||||||||||||||||||||||||||||||:
a505      CCERLPGGQGFDLHIRPVQGELNGDKAHDAAVFNRNAEYWIRRFPTQYLFMYNRYKMPX
                 250        260        270        280        290
```

The following partial DNA sequence was identified in *N. meningitidis* <SEQ ID 1373>:

```
m505-1.seq
   1     ATGTTTCGTT TACAATTCAG GCTGTTTCCC CCTTTGCGAA CCGCCATGCA

51     CATCCTGTTG ACCGCCCTGC TCAAATGCCT CTCCCTGCTG CCGCTTTCCT

101     GTCTGCACAC GCTGGGAAAC CGGCTCGGAC ATCTGGCGTT TTACCTTTTA

151     AAGGAAGACC GCGCGCGCAT CGTCGCCAAT ATGCGGCAGG CGGGTTTGAA

201     CCCCGACCCC AAAACGGTCA AGCCGTTTTT TGCGGAAACG GCAAAAGGCG

251     GTTTGGAACT TGCCCCCGCG TTTTTCAGAA AACCGGAAGA CATAGAAACA

301     ATGTTCAAAG CGGTACACGG CTGGGAACAT GTGCAGCAGG CTTTGGACAA

351     ACACGAAGGG CTGCTATTCA TCACGCCGCA CATCGGCAGC TACGATTTGG

401     GCGGACGCTA CATCAGCCAG CAGCTTCCGT TCCCGCTGAC CGCCATGTAC

451     AAACCGCCGA AAATCAAAGC GATAGACAAA ATCATGCAGG CGGGCAGGGT
```

-continued

```
501  TCGCGGCAAA GGAAAAACCG CGCCTACCAG CATACAAGGG GTCAAACAAA
551  TCATCAAAGC CCTGCGTTCG GGCGAAGCAA CCATCGTCCT GCCCGACCAC
601  GTCCCCTCCC CTCAAGAAGG CGGGGAAGGC GTATGGGTGG ATTTCTTCGG
651  CAAACCTGCC TATACCATGA CGCTGGCGGC AAAATTGGCA CACGTCAAAG
701  GCGTGAAAAC CCTGTTTTTC TGCTGCGAAC GCCTGCCTGG CGGACAAGGT
751  TTCGATTTGC ACATCCGCCC CGTCCAAGGG GAATTGAACG GCGACAAAGC
801  CCATGATGCC GCCGTGTTCA ACCGCAATGC CGAATATTGG ATACGCCGTT
851  TTCCGACGCA GTATCTGTTT ATGTACAACC GCTACAAAAT GCCGTAA
```

This corresponds to the amino acid sequence <SEQ ID 1374; ORF 505-1>:

```
m505-1.pep
  1  MFRLQFRLFP PLRTAMHILL TALLKCLSLL PLSCLHTLGN RLGHLAFYLL
 51  KEDRARIVAN MRQAGLNPDP KTVKAVFAET AKGGLELAPA FFRKPEDIET
101  MFKAVHGWEH VQQALDKHEG LLFITPHIGS YDLGGRYISQ QLPFPLTAMY
151  KPPKIKAIDK IMQAGRVRGK GKTAPTSIQG VKQIIKALRS GEATIVLPDH
201  VPSPQEGGEG VWVDFFGKPA YTMTLAAKLA HVKGVKTLFF CCERLPGGQG
251  FDLHIRPVQG ELNGDKAHDA AVFNRNAEYW IRRFPTQYLF MYNRYKMP*
``` m505-1/g505 94.3% identity in 298 aa overlap

```
                 10         20         30         40         50         60
m505-1.pep  MFRLQFRLFPPLRTAMHILLTALLKCLSLLPLSCLHTLGNRLGHLAFYLLKEDRARIVAN
            ||||||||||||||||||||||||||||  ||||||||||||||||||||||||||||||
g505        MFRLQFRLFPPLRTAMHILLTALLKCLSLLSLSCLHTLGNRLGHLAFYLLKEDRARIVAN
                 10         20         30         40         50         60

70         80         90        100        110        120
m505-1.pep  MRQAGLNPDPKTVKAVFAETAKGGLELAPAFFRKPEDIETMFKAVHGWEHVQQALDKHEG
            ||||||||||:|||||||||||| |||||||||||:||||||||||||||||||||| ||
g505        MRQAGLNPDTQTVKAVFAETAKCGLELAPAFFKKPEDIETMFKAVHGWEHVQQALDKGEG
                 70         80         90        100        110        120

130        140        150        160        170        180
m505-1.pep  LLFITPHIGSYDLGGRYISQQLPFPLTAMYKPPKIKAIDKIMQAGRVRGKGKTAPTSIQG
            ||||||||||||||||||||||||| |||||||||||||||||||||||||||||:|||
g505        LLFITPHIGSYDLGGRYISQQLPFHLTAMYKPPKIKAIDKIMQAGRVRGKGKTAPTGIQG
                130        140        150        160        170        180

190        200        210        220        230        240
m505-1.pep  VKQIIKALRSGEATIVLPDHVPSPQEGGEGVWVDFFGKPAYTMTLAAKLAHVKGVKTLFF
            ||||||||||:|||||:|||||||||||| ||:|||||||||||||||||||||||||||
g505        VKQIIKALRAGEATIILPDHVPSPQEGG-GVWADFFGKPAYTMTLAAKLAHVKGVKTLFF
                190        200        210        220        230        240

250        260        270        280        290   299
m505-1.pep  CCERLPGGQGFDLHIRPVQGELNGDKAHDAAVFNRNAEYWIRRFPTQYLFMYNRYKMPX
            |||||| |||| ||||||||||||:|||||||||||:|||||||||||||||||| ||
g505        CCERLPDGQGFVLHIRPVQGELNGNKAHDAAVFNRNTEYWIRRFPTQYLFMYNRYKTPX
                250        260        270        280        290
``` m505-1/a505 99.7% identity in 298 aa overlap

```
                 10         20         30         40         50         60
m505-1.pep  MFRLQFRLFPPLRTAMHILLTALLKCLSLLPLSCLHTLGNRLGHLAFYLLKEDRARIVAN
            ||||||||||||||||||||||||||||||||||||||||||||||||||||||||||||
a505        MFRLQFRLFPPLRTAMHILLTALLKCLSLLPLSCLHTLGNRLGHLAFYLLKEDRARIVAN
                 10         20         30         40         50         60

70         80         90        100        110        120
m505-1.pep  MRQAGLNPDPKTVKAVFAETAKGGLELAPAFFRKPEDIETMFKAVHGWEHVQQALDKHEG
            ||||:|||||||||||||||||||||||||||||||||||||||||||||||||||||||
a505        MRQAGMNPDPKTVKAVFAETAKGGLELAPAFFRKPEDIETMFKAVHGWEHVQQALDKHEG
                 70         80         90        100        110        120
```

```
                   130       140       150       160       170       180
m505-1.pep   LLFITPHIGSYDLGGRYISQQLPFPLTAMYKPPKIKAIDKIMQAGRVRGKGKTAPTSIQG
             ||||||||||||||||||||||||||||||||||||||||||||||||||||||||||||
a505         LLFITPHIGSYDLGGRYISQQLPFPLTAMYKPPKIKAIDKIMQAGRVRGKGKTAPTSIQG
                   130       140       150       160       170       180

190       200       210       220       230       240
m505-1.pep   LLFITPHIGSYDLGGRYISQQLPFPLTAMYKPPKIKAIDKIMQAGRVRGKGKTAPTSIQG
             ||||||||||||||||||||||||||||||||||||||||||||||||||||||||||||
a505         LLFITPHIGSYDLGGRYISQQLPFPLTAMYKPPKIKAIDKIMQAGRVRGKGKTAPTSIQG
                   190       200       210       220       230       240

250       260       270       280       290       299
m505-1.pep   CCERLPGGQGFDLHIRPVQGELNGDKAHDAAVFNRNAEYWIRRFPTQYLFMYNRYKMPX
             |||||||||||||||||||||||||||||||||||||||||||||||||||||||||||
a505         CCERLPGGQGFDLHIRPVQGELNGDKAHDAAVFNRNAEYWIRRFPTQYLFMYNRYKMPX
                   250       260       270       280       290
```

15

The following partial DNA sequence was identified in *N. gonorrhoeae* <SEQ ID 1375>:

```
g506.seq
    1   ATGGCGGTAT TTGATGAAGT CGGGCGCATC GCCCATGGCT GCGGCGGTGT
   51   TGTCAAACAA AGCCTGTTTC TGCGCGTCGT TCATCAGGTT GAACAAGGCG
  101   CGCGGTTGGC TGAAGTAGTC GTCATCGTCT GGCGGTAGT CCCAGTGTGC
  151   CGCGTCGCCG TTGATTTTCA AAGGCGGTTC GGCGAAGTCG GGTTGTTGCT
  201   GCCATTGGCC GAAGCTGTTG GGTTCGTAGT GCGGCAGGCT GCCGTAGTTG
  251   CCGTCGGCGC GGCCTTGTCC GTCGCGCTGG TTGCTGTGAA CAGGGCAACG
  301   CGGACGATTG ACGGGGATTT GGCGGAAGTT CACACCCAAG CGGTAACGTT
  351   GCGCGTCGGC GTAATTGAAC AAACGGGCTT GCAACATTTT ATCCGGGCTC
  401   GCGCCGATAC CGGGAACGAG GTTGCTCGGT GCGAAGGCGG ATTGTTCCAC
  451   ATCGGCGAAG AAGTTTTCGG GATTGCGGTT CAACTCGAAT TTGCCGACTT
  501   CAATCAGCGG ATAGTCTTTT TTCGGCCAAA CTTTGGTCAA GTCAAACGGA
  551   TGATAAGGCA CTTTTTCGGC ATCGGCTTCA GGCATGACTT GGATGTACAT
  601   CGTCCATTTC GGGAACTCGC CGCGCTCGAT GGCTTCGTAC AGGTCGCGCT
  651   GATGGCTTTC GCGGTCGTCG GCGATGATTT TGCAGCTTC TTCGTTGGTC
  701   AGGTTTTTAA TCCCTTGCTG GCTGCGGAAA TGGAATTTCA CCCAAAAACG
  751   TTCGCCCGCT TCGTTCCAGA AGCTGTAGGT ATGCGAACCG AAGCCGTGCA
  801   TATGGCGGTA GCTGGCGGGA ATACCGCGGT CGCTCATCAC GATGGTAACT
  851   TGGTGCAGGG CTTCGGGCAG CAGCGTCCAG AAGTCCCAGT TGTTTGTGGC
  901   GGAACGCATA TTGGTGCGCG GATCGCGTTT GACGGCTTTG TTCAGGTCGG
  951   GGAATTTGCG CGGGTCGCGC AGGAAGAACA CGGGCGTGTT GTTGCCGACC
 1001   ACATCCCAGT TGCCTTCTTC GGTATAGAAT TCAACGCAA AACCGCGGAT
 1051   GTCGCGTTCC GCATCGGCTG CGCCGCGCTC GCCTGCCACG GTGGTGAAAC
 1101   GGGCGAACAT CTCGGTTTTT TGCCGACTT CGCTGAAAAT TTTGGCGCGG
 1151   GTGTATTTGG TGATGTCGTG TGTTACGGTA AACGTACCGA ACGCGCCCGA
 1201   ACCTTTGGCG TGCATACGGC GTTCGGGGAT GACTTCGCGC ACGAAGTCGG
 1251   CGAGTTTTTC ATTCAGCCAC AAATCTTGCG TCAGCAGGGG GCCGCGCGGG
 1301   CCGGCGGTCA GGCTGTTTTG ATTGTCGGCA ACGGGCGCGC CGTTGTTCAT
 1351   GGTCAGATGG GTTACGGGGC ATTTGGAGGT AGTCATCGCT CTTGTTCCTT
 1401   TTCTCAGGTT GGTCAAATGG GGGGCAAACG GCTTACAGTA CGATTTGGCG
```

-continued

```
1451  GAAAGCGTAT TCGTAACCGG TTTCTTGATT GTAATAAATT TCTTGAATCG

1501  ACATTTTATT TTCCTTTTGC AAAAACTATG GATGCGATTA TACGCCAAGA

1551  TTTTCGTTAT TAA
```

This corresponds to the amino acid sequence <SEQ ID 1376;
ORF 506.ng>:

```
g506.pep
    1   MAVFDEVGRI AHGCGGVVKQ SLFLRVVHQV EQGARLAEVV VIVLAVVPVC

51   RVAVDFQRRF GEVGLLLPLA EAVGFVVRQA AVVAVGAALS VALVAVNRAT

101   RTIDGDLAEV HTQAVTLRVG VIEQTGLQHF IRARADTGNE VARCEGGLFH

151   IGEEVFGIAV QLEFAHFNQR IVFFRPNFGQ VKRMIRHFFG IGFRHDLDVH

201   RPFRELAALD GFVQVALMAF AVVGDDFCSF FVGQVFNPLL AAEMEFHPKT

251   FARFVPEAVG MRTEAVHMAV AGGNTAVAHH DGNLVQGFGQ QRPEVPVVCG

301   GTHIGARIAF DGFVQVGEFA RVAQEEHGRV VADHIPVAFF GIEFQRKTAD

351   VAFRIGCAAL ACHGGETGEH LGFFADFAEN FGAGVFGDVV CYGKRTERAR

401   TFGVHTAFGD DFAHEVGEFF IQPQILRQQG AARAGGQAVL IVGNGRAVVH

451   GQMGYGAFGG SHRSCSFSQV GQMGGKRLTV RFGGKRIRNR FLDCNKFLES

501   TFYFPFAKTM DAIIRQDFRY *
```

30
The following partial DNA sequence was identified in *N. meningitidis* <SEQ ID 1377>:

```
m506.seq
    1   ATGGCGGTAT TTGATGAAGT CGGGCGCGTC GCCCATTGCG GCGGCGGTGT

51   TGCCGAACAA TGCCTGTTTC TGCGCGTCGT TCATCAGGTT GAACAGGGCG

101   CGCGGTTGGC TGAAATAGTC GTCATCGTCT TGGCGGTAGT CCCAGTGTGC

151   CGCGTCGCCG TTGATTTTCA AAGGCGGTTC GGCGAAtCGg GGTTGTTGCT

201   GCCATTGGCC GAAGcTGTyG GGTTCGTAGT GCGGCAGGCT GCCGyAGTTG

251   CCGTCGGCGC GGCCTTGCCC GTyGCGsTgr TTgCTGTgAA CAsGGCAACG

301   CGGACGATTG ACGGGAATTT GGCGGAAGTT TACGCCCAAA CGGTAGCGTT

351   GTGCGTCGGC GTAATTGAAC AAACGCGCTT GCAGCATTTT ATCTsGGCTG

401   GCGCCGACAC CGGGAACGAG GTTGCTCGGT GCGAAGGCGG ATTGTTCCAC

451   ATCGGCGAAG AAGTTTTCGG GATTGCGGTT CTCAAACGGA TGATAAGGTA

501   CTTTTTCCGC GTCTGCTTCA GGCATGACTT GGATGTACAT CGTCCATTTC

551   GGAAACTCGC CGCGTTCGAT GGCTTCsTAT AAGTCGCGCT GATGGCTTTC

601   GCGGTCGTCG GCGATGATTT TGGCGGCTTC TTCGTTGGTC AGGTTTTTAA

651   TGCCTTGTTG GGTGCGGAAA TGGAATTTCA CCCAAAAACG CTCGCCTGCT

701   TCGTTCCAGA AGCTGTAGGT ATGCGAACCG AAGCCGTGCA TATGGCGGTA

751   GCCGGCGGGG ATGCCGCGGT CGCTCATCAC GATGGTAACT TGGTGCAGTG

801   CTTCGGGCAG CAGCGTCCAG AAGTCCCAGT TGTTTGTGGC AGAGCGCATA

851   TTGGTGCGCG GGTCGCGTTT GACGGCTTTG TTCAGGTCGG GGAACTTACG

901   CGGGTCGCGC AGGAAGAACA CGGGCGTGTT GTTGCCGACC ACATCCCAGT

951   TGCCTTCTTC GGTATAAAAT TTCAAGGCAA AACCGCGGAT GTCGCGTTCT
```

-continued

```
1001  GCATCGGCTG CGCCGCGTTC GCCTGCCACG GTGGTGAAAC GGGCGAACAT

1051  CTCGGTTTTT TTGCCGACTT CGCTGAAGAT TCCTTTGGCG TGCATACGGC

1101  GTTCGGGGAT GACTTCGCGC ACGAAGTCGG CGAGTTTTTC AGTCATCGCT

1151  CTTGTTCCTT TTCTCAGGTT GGTCAAATGG GGGTAAACGG CTTACAGTAC

1201  GATTTGGCGG AAAGCGTATT CGTAACCGGT TTCTTGATTG CAATAAATTT

1251  CTTGAATCGA CATTTTATTT CCCTTTTGTA AAAACTATGG ATGCGACTAT

1301  ACGCCAAGAT TTTCGCTATT AA
```

This corresponds to the amino acid sequence <SEQ ID 1378; ORF 506>:

```
m506.pep
    1  MAVFDEVGRV AHCGGGVAEQ CLFLRVVHQV EQGARLAEIV VIVLAVVPVC

51  RVAVDFQRRF GESGLLLPLA EAVGFVVRQA AXVAVGAALP VAXXAVNXAT

101  RTIDGNLAEV YAQTVALCVG VIEQTRLQHF IXAGADTGNE VARCEGGLFH

151  IGEEVFGIAV QLEFAHFNQR IVFFRPNFGQ VKRMIRYFFR VCFRHDLDVH

201  RPFRKLAAFD GFXXVALMAF AVVGDDFGGF FVGQVFNALL GAEMEFHPKT

251  LACFVPEAVG MRTEAVHMAV AGGDAAVAHH DGNLVQCFGQ QRPEVPVVCG

301  RAHIGARVAF DGFVQVGELT RVAQEEHGRV VADHIPVAFF GIKFQGKTAD

351  VAFCIGCAAF ACHGGETGEH LGFFADFAED FGAGVFGDVV RYGKRTERAR

401  TFGVHTAFGD DFAHEVGEFF IQPQILRQQR AARTGGQAVL IVGNRRAVVH

451  GQMGYRAFGG SHRSCSFSQV GQMGGKRLTV RFGGKRIRNR FLDCNKFLES

501  TFYFPFVKTM DATIRQDFRY *
```

Computer analysis of this amino acid sequence gave the following results:
Homology with a Predicted ORF from *N. gonorrhoeae*
ORF 506 shows 89.2% identity over a 520 aa overlap with a predicted ORF (ORF 506.ng) from *N. gonorrhoeae*:

```
m506/g506
                 10         20         30         40         50         60
m506.pep  MAVFDEVGRVAHCGGGVAEQCLFLRVVHQVEQGARLAEIVVIVLAVVPVCRVAVDFQRRF
          ||||||||||:||   |||::| |||||||||||||||:|||||||||||||||||||||
g506      MAVFDEVGRIAHCGGVVKQSLFLRVVHQVEQGARLAEVVVIVLAVVPVCRVAVDFQRRF
                 10         20         30         40         50         60

70         80         90        100        110        120
m506.pep  GESGLLLPLAEAVGFVVRQAAXVAVGAALPVAXXAVNXATRTIDGNLAEVYAQTVALCVG
          || |||||||||||||||||| |||||| ||  ||| |||||||||:||||::|:|:| ||
g506      GEVGLLLPLAEAVGFVVRQAAVVAVGAALSVALVAVNRATRTIDGDLAEVHTQAVTLRVG
                 70         80         90        100        110        120

130        140        150        160        170        180
m506.pep  VIEQTRLQHFIXAGADTGNEVARCEGGLFHIGEEVFGIAVQLEFAHFNQRIVFFRPNFGQ
          ||||| |||||| ||||||||||||||||||||||||||||||||||||||||||||||
g506      VIEQTGLQHFIRARADTGNEVARCEGGLFHIGEEVFGIAVQLEFAHFNQRIVFFRPNFGQ
                130        140        150        160        170        180

190        200        210        220        230        240
m506.pep  VKRMIRYFFRVCFRHDLDVHRPFRKLAAFDGFXXVALMAFAVVGDDFGGFFVGQVFNALL
          |||||| : |: ||||||||||||:|||| ||||||||||||||||||| ||||||| ||
g506      VKRMIRHFFGIGFRHDLDVHRPFRELAALDGFVQVALMAFAVVGDDFCSFFVGQVFNPLL
                190        200        210        220        230        240

250        260        270        280        290        300
m506.pep  GAEMEFHPKTLACFVPEAVGMRTEAVHMAVAGGDAAVAHHDGNLVQCFGQQRPEVPVVCG
          :||||||||:|   ||||||||||||||||||::||||||||||||:||||||||||||
g506      AAEMEFHPKTFARFVPEAVGMRTEAVHMAVAGGNTAVAHHDGNLVQGFGQQRPEVPVVCG
                250        260        270        280        290        300
```

-continued

```
                    310       320       330       340       350       360
m506.pep     RAHIGARVAFDGFVQVGELTRVAQEEHGRVVADHIPVAFFGIKFQGKTADVAFCIGCAAF
              :|||||:||||||||||::||||||||||||||||||||||:|| ||||||| |||||:
g506         GTHIGARIAFDGFVQVGEFARVAQEEHGRVVADHIPVAFFGIEFQRKTADVAFRIGCAAL
                    310       320       330       340       350       360

370       380       390       400       410       420
m506.pep     ACHGGETGEHLGFFADFAEDFGAGVFGDVVRYGKRTERARTFGVHTAFGDDFAHEVGEFF
             ||||||||||||||||||:||||||||||| |||||||||||||||||||||||||||||
g506         ACHGGETGEHLGFFADFANDFGAGVFGDVVCYGKRTERARTFGVHTAFGDDFAHEVGEFF
                    370       380       390       400       410       420

430       440       450       460       470       480
m506.pep     IQPQILRQQRAARTGGQAVLIVGNRRAVVHGQMGYRAFGGSHRSCSFSQVGQMGGKRLTV
             ||||||||| |||:|||||||||| ||||||||||| |||||||||||||||||||||||
g506         IQPQILRQQGAARAGGQAVLIVGNGRAVVHGQMGYGAFGGSHRSCSFSQVGQMGGKRLTV
                    430       440       450       460       470       480

490       500       510       520
m506.pep     RFGGKRIRNRFLDCNKFLESTFYFPFVKTMDATIRQDFRY
             ||||||||||||||||||||||||||:||||| |||||||
g506         RFGGKRIRNRFLDCNKFLESTFYFPFAKTMDAIIRQDFRY
                    490       500       510       520
```

The following partial DNA sequence was identified in *N. meningitidis* <SEQ ID 1379>:

```
a506.seq
      1  ATGGCGGTAT TTGATGAAGT CGGGCGCGTC GCCCATTGCG GCGGCGGTGT

51  TGCCGAACAA TGCCTGTTTC TGCGCGTCGT TCATCAGGTT GAACAGGGCG

101  CGCGGTTGGC TGAAATAGTC GTCATCGTCT TGGCGGTAGT CCCAGTGCGC

151  CGCGTCGCCG TTGATTTTCA AAGGCGGTTC GGCGAAGTCG GGCTGCTGCT

201  GCCATTGGCC GAAGCTGTTG GGTTCGTAGT GCGGCAGGCT GCCGTAGTTG

251  CCGTCGGCGC GTCCTTGTCC GTCGCGCTGG TTGCTGTGAA CAGGGCAACG

301  CGGACGGTTG ACAGGGATTT GGCGGAAGTT CACGCCCAAG CGGTAGCGTT

351  GCGCGTCGGC GTAATTGAAC AAACGCGCCT GCAACATTTT ATCTGGGCTG

401  GCGCCGACAC CGGGAACGAG GTTGCTCGGT GCGAAGGCGG ATTGTTCCAC

451  ATCGGCGAAG AAGTTTTCGG GATTGCGGTT CAACTCGAAT TCGCCCACTT

501  CAATCAGCGG ATAGTCTTTT TTCGGCCAAA CTTTGGTCAA GTCAAACGGA

551  TGATACGGCA CTTTTTCCGC ATCGGCTTCA GGCATGACTT GGATGTACAT

601  CGTCCATTTC GGAAACTCGC CGCGCTCGAT GGCTTCGTAC AGGTCGCGCT

651  GATGGCTTTC ACGGTCGTCG GCGATGATTT TGGCGGCTTC TTCGTTGGTC

701  AGGTTTTTAA TGCCTTGTTG GGTGCGGAAA TGGAATTTCA CCCAAAAACG

751  CTCGCCTGCT TCGTTCCAGA AGCTGTAGGT ATGCGAACCG AAGCCGTGCA

801  TATGGCGGTA GCCGGCGGGG ATGCCGCGGT CGCTCATCAC GATGGTAACT

851  TGGTGCAGTG CTTCGGGCAG CAGCGTCCAG AAGTCCCAGT TGTTTGTGGC

901  AGAGCGCATA TTGGTGCGCG GGTCGCGTTT GACGGCTTTG TTCAGGTCGG

951  GGAACTTACG CGGGTCGCGC AGGAAGAACA CGGGCGTGTT GTTGCCGACC

1001  ACATCCCAGT TGCCTTCTTC GGTATAGAAC TTCAACGCAA AACCGCGGAT

1051  GTCGCGTTCT GCATCGGCTG CGCCGCGTTC GCCTGCCACG GTGGTGAAAC

1101  GGGCGAACAT CTCGGTTTTT TTGCCGACTT CGCTGAAGAT TTTGGCGCGG

1151  GTGTATTTGG TGATGTCGTG CGTTACGGTA AACGTACCGA ACGCGCCCGA

1201  ACCTTTGGCG TGCATACGGC GTTCGGGGAT GACTTCGCGC ACGAAGTCGG

1251  CGAGTTTTTC ATTCAGCCAC AAATCCTGCG CCAGCAGAGG GCCGCGAGGA
```

```
-continued
1301  CCGGCGGTCA GGCTGTTTTG ATTGTCGGCA ACAGGCGCGC CGTTGTTCAT

1351  GGTCAGATGG GTTACAGGGC ATTTGGAGGT ANTCATCGCT CTTGTTCCTT

1401  TTCTCAGGTT GGTCAAAT.G GGGGTAAACG GCTTACAGTA CGATTTGGCG

1451  GAAAGCGTAT TCGTAACCGG TTTCTTGATT GCAATAAATT TCTTGAATCG

1501  ACATTTTATT TCCCTTTTGT AAAAACTATG GATGCGACTA TACGCCAAGA

1551  TTTTCGCTAT TAA
```

This corresponds to the amino acid sequence <SEQ ID 1380;
ORF 506.a>:

```
a506.pep
  1   MAVFDEVGRV AHCGGGVAEQ CLFLRVVHQV EQGARLAEIV VIVLAVVPVR

51   RVAVDFQRRF GEVGLLLPLA EAVGFVVRQA AVVAVGASLS VALVAVNRAT

101   RTVDRDLAEV HAQAVALRVG VIEQTRLQHF IWAGADTGNE VARCEGGLFH

151   IGEEVFGIAV QLEFAHFNQR IVFFRPNFGQ VKRMIRHFFR IGFRHDLDVH

201   RPFRKLAALD GFVQVALMAF TVVGDDFGGF FVGQVFNALL GAEMEFHPKT

251   LACFVPEAVG MRTEAVHMAV AGGDAAVAHH DGNLVQCFGQ QRPEVPVVCG

301   RAHIGARVAF DGFVQVGELT RVAQEEHGRV VADHIPVAFF GIELQRKTAD

351   VAFCIGCAAF ACHGGETGEH LGFFADFAED FGAGVFGDVV RYGKRTERAR

401   TFGVHTAFGD DFAHEVGEFF IQPQILRQQR AARTGGQAVL IVGNRRAVVH

451   GQMGYRAFGG XHRSCSFSQV GQXGGKRLTV RFGGKRIRNR FLDCNKFLES

501   TFYFPFVKTM DATIRQDFRY *
``` m506/a506 94.8% identity in 520 aa overlap

```
                    10         20         30         40         50         60
   m506.pep  MAVFDEVGRVAHCGGGVAEQCLFLRVVHQVEQGARLAEIVVIVLAVVPVCRVAVDFQRRF
             ||||||||||||||||||||||||||||||||||||||||||||||||| |||||||||
   a506      MAVFDEVGRVAHCGGGVAEQCLFLRVVHQVEQGARLAEIVVIVLAVVPVRRVAVDFQRRF
                    10         20         30         40         50         60

70         80         90        100        110        120
   m506.pep  GESGLLLPLAEAVGFVVRQAAXVAVGAALPVAXXAVNXATRTIDGNLAEVYAQTVALCVG
             || |||||||||||||||||||| |||||   |||  | :||||:  :||||::||| ||
   a506      GEVGLLLPLAEAVGFVVRQAAVVAVGASLSVALVAVNRATRTVDRDLAEVHAQAVALRVG
                    70         80         90        100        110        120

130        140        150        160        170        180
   m506.pep  VIEQTRLQHFIXAGADTGNEVARCEGGLFHIGEEVFGIAVQLEFAHFNQRIVFFRPNFGQ
             ||||||||||| ||||||||||||||||||||||||||||||||||||||||||||||||
   a506      VIEQTRLQHFIWAGADTGNEVARCEGGLFHIGEEVFGIAVQLEFAHFNQRIVFFRPNFGQ
                   130        140        150        160        170        180

190        200        210        220        230        240
   m506.pep  VKRMIRYFFRVCFRHDLDVHRPFRKLAAFDGFXXVALMAFAVVGDDFGGFFVGQVFNALL
             ||||||:|||: ||||||||||||||||||:||| ||||||:||||||||||||||||||
   a506      VKRMIRHFFRIGFRHDLDVHRPFRKLAALDGFVQVALMAFTVVGDDFGGFFVGQVFNALL
                   190        200        210        220        230        240

250        260        270        280        290        300
   m506.pep  GAEMEFHPKTLACFVPEAVGMRTEAVHMAVAGGDAAVAHHDGNLVQCFGQQRPEVPVVCG
             ||||||||||||||||||||||||||||||||||||||||||||||||||||||||||||
   a506      GAEMEFHPKTLACFVPEAVGMRTEAVHMAVAGGDAAVAHHDGNLVQCFGQQRPEVPVVCG
                   250        260        270        280        290        300

310        320        330        340        350        360
   m506.pep  RAHIGARVAFDGFVQVGELTRVAQEEHGRVVADHIPVAFFGIKFQGKTADVAFCIGCAAF
             ||||||||||||||||||||||||||||||||||||||||||::| ||||||||||||||
   a506      RAHIGARVAFDGFVQVGELTRVAQEEHGRVVADHIPVAFFGIELQRKTADVAFCIGCAAF
                   310        320        330        340        350        360

370        380        390        400        410        420
   m506.pep  ACHGGETGEHLGFFADFAEDFGAGVFGDVVRYGKRTERARTFGVHTAFGDDFAHEVGEFF
             ||||||||||||||||||||||||||||||||||||||||||||||||||||||||||||
   a506      ACHGGETGEHLGFFADFAEDFGAGVFGDVVRYGKRTERARTFGVHTAFGDDFAHEVGEFF
                   370        380        390        400        410        420
```

-continued

```
                430        440        450        460        470        480
m506.pep   IQPQILRQQRAARTGGQAVLIVGNRRAVVHGQMGYRAFGGSHRSCSFSQVGQMGGKRLTV
           ||||||||||||||||||||||||||||||||||||| ||||||||||| |||||||||
a506       IQPQILRQQRAARTGGQAVLIVGNRRAVVHGQMGYRAFGGXHRSCSFSQVGQXGGKRLTV
                430        440        450        460        470        480

490        500        510        520
m506.pep   RFGGKRIRNRFLDCNKFLESTFYFPFVKTMDATIRQDFRYX
           ||||||||||||||||||||||||||||||||||||||||
a506       RFGGKRIRNRFLDCNKFLESTFYFPFVKTMDATIRQDFRYX
                490        500        510        520
```

The following partial DNA sequence was identified in *N. gonorrhoeae* <SEQ ID 1381>:

```
g507.seq
    1   ATGCTCTTGC CGGCTTTGCA ACAAGGCGGC GGCTTCCTGA GCGGCGGCGG

51   TTTCGGCCTC GTCGGGCAGG TTCAGGGCTT GGTTTTCCTG CTTCAGACGG

101   CCTTTGCGCT CTTCGTGCTT GGCAACGGTT TGTTCGGCAT GGGCAAGCTG

151   CTGCTGCTTC AACGCCAGTT CGCGGCGGAT GCGGTTTGCC TCGTCCTGCT

201   GGGTTTGGAA GGCAGCGTTG AGCGTGGCTT GGACTTCTTC CAATTCGGGC

251   AGACGCTCTT CGTGTTCGGC AACCTGCATC GCCCATTCCG CCAATTCGGT

301   TTGCTTTTCT TCGACCTGCA ACTCGTTTTC CTCAAGCTGC ACGCGGATTT

351   GCTGCTGCTC CTGCCGGATG CGTTGCAACT GCGCCTGCGC TGCCTGCTTG

401   TCGCGTTCGA TGCGTTGGTG CAGGTTTTGC CGGTGGCGGA TTTGTTCTTC

451   CAAACGGGCA ATCTGCTCGC GCAACACGCC GCGTTTGTTG CTCAATTCGT

501   GTACTGCCTG CTGCTGCGAC TGTTCGGCAG TCTGCAAGGC GTGTACTTCG

551   TTATTTAA
```

This corresponds to the amino acid sequence <SEQ ID 1382; ORF 507.ng>:

```
g507.pep
    1   MLLPALQQGG GFLSGGGFGL VGQVQGLVFL LQTAFALFVL GNGLFGMGKL

51   LLLQRQFAAD AVCLVLLGLE GSVERGLDFF QFGQTLFVFG NLHRPFRQFG

101   LLFFDLQLVF LKLHADLLLL LPDALQLRLR CLLVAFDALV QVLPVADLFF

151   QTGNLLAQHA AFVACFVYCL LLRLFGSLQG VYFVI*
```

The following partial DNA sequence was identified in *N. meningitidis* <SEQ ID 1383>:

```
m507.seq
    1   ATGCTCTTGC TGACTTTGCA ACAAGGCGGC TGCTTCCTGC GCGGCGGCGG

51   TTTCGGCTTC GTCGGGCAGG TTTAAGGCTT GGTTTTCCTG TTTCAGACGA

101   CCTTTGCGCT CTTCGTGCTT GGCAATCGTT TGTTCGGCAT GGGCAAGCTG

151   CTGCTGCTTC AACGCCAGTT CGCGGCGGAT GCGGTTTGCC TCGTCCTGCT

201   GGGTTTGGAA GGCGGCGTTG AGCGTGGCTT GGGCTTCTTC CAATTCGGGC

251   AGACGCTCCT CGTGTTCGGC AACCTGCATC GCCCATTCCG CCAGCTCGGT

301   TTGTTTTTCT TCGACCTGCA ACTCGTTTTC TTCAAGCTGC ACGCGGATTT

351   GCTGCTGCTC TTGATGAATG CGTTGTAACT GCGCCTGCGC TGCCTGCTTG

401   TCGCGTTCGA TGCGTTGGTG CAGGTTTTGC TGATGGCGGA TTTGTTCTTC
```

```
    451   CAAACGGGCA ATCTGCTCGC GCAACACGCC GCGCTTGTTG CTCAATTCAT

501   GCACTGCCTG CTGCTGCGAC TGTTCGGCAG TCTGCAAGGC GTGTACTTCG

551   TCGTTTAA
```

This corresponds to the amino acid sequence <SEQ ID 1384; ORF 507>:

```
m507.pep
      1   MLLLTLQQGG CFLRGGGFGF VGQVXGLVFL FQTTFALFVL GNRLFGMGKL

51   LLLQRQFAAD AVCLVLLGLE GGVERGLGFF QFGQTLLVFG NLHRPFRQLG

101   LFFFDLQLVF FKLHADLLLL LMNALXLRLR CLLVAFDALV QVLLMADLFF

151   QTGNLLAQHA ALVAQFMHCL LLRLFGSLQG VYFVV*
```

Computer analysis of this amino acid sequence gave the following results:
Homology with a Predicted ORF from *N. gonorrhoeae*
ORF 507 shows 87.0% identity over a 185 aa overlap with a predicted ORF (ORF 507.ng) from *N. gonorrhoeae*:

```
    m507/g507
                        10         20         30         40         50         60
    m507.pep   MLLLTLQQGGCFLRGGGFGFVGQVXGLVFLFQTTFALFVLGNRLFGMGKLLLLQRQFAAD
               ||| :||||| || |||||:|||| |||||:||:|||||||| ||||||||||||||||||
    g507       MLLPALQQGGGFLSGGGFGLVGQVQGLVFLLQTAFALFVLGNGLFGMGKLLLLQRQFAAD
                        10         20         30         40         50         60

70         80         90        100        110        120
    m507.pep   AVCLVLLGLEGGVERGLGFFQFGQTLLVFGNLHRPFRQLGLFFFDLQLVFFKLHADLLLL
               |||||||||| :|||| |||||||||| :||||||||||||:||:|||||||| :|||||||
    g507       AVCLVLLGLEGSVERGLDFFQFGQTLFVFGNLHRPFRQFGLLFFDLQLVFLKLHADLLLL
                        70         80         90        100        110        120

130        140        150        160        170        180
    m507.pep   LMNALXLRLRCLLVAFDALVQVLLMADLFFQTGNLLAQHAALVAQFMHCLLLRLFGSLQG
               | :|| ||||||||||||||||:|||||||||||||||||:||::||||||||||||||
    g507       LPDALQLRLRCLLVAFDALVQVLPVADLFFQTGNLLAQHAAFVAQFVYCLLLRLFGSLQG
                       130        140        150        160        170        180 m507.pep   VYFVV
               ||||:
    g507       VYFVI
```

The following partial DNA sequence was identified in *N. meningitidis* <SEQ ID 1385>:

```
a507.seq
      1   ATGCTCTTGC TGGCTTTGCA ACAAGGCGGC AGCTTCCTGC GCGGCGGCGG

51   TTTCGGCTTC GTCAGGCAGA TTCAGGGCTT GGTTTTCCTG TTTCAGACGA

101   CCTTTGCGCT CTTCGTGCTT GGCAACGGTT TGTTCGGCAT GGGCAAGCTG

151   CTGCTGCTTC AACGCCAGTT CGCGGCGGAT GCGGTTTGCC TCGTCCTGCT

201   GGGTTTGGAA GGCGGCATTG AGTGTGGCTT GGGTTTCTTC CAATTCGGGC

251   AGACGCTCTT CGTGTTCGGC AACCTGCATC GCCCATTCCG CCAATTCGGT

301   TTGCTTTTCT TCCGCCTGCA ACTCGTTTTC TTCAAGCTGC ACGCGGATTT

351   GCTGCTGCTC CTGATGGATG CGCTGCATCT GCGCCTGCGC CGCCTGCTTG

401   TCGCGTTCGA TGCGTTGGTG CAGGTTTTGC TGATGGCGGA TTTGTTCTTC

451   CAAACGGGCA ATCTGTTCGC GCAACACGCC GCGTTTGTTG CCCAATTCGT

501   GCACCGCCTG CTGCTGCGAC TGTTCGGCAG TCTGCAAGGC GTGTACTTCG

551   TCGTTTAA
```

This corresponds to the amino acid sequence <SEQ ID 1386;
ORF 507.a>:

```
a507.pep
    1   MLLLALQQGG SFLRGGGFGF VRQIQGLVFL FQTTFALFVL GNGLFGMGKL

51   LLLQRQFAAD AVCLVLLGLE GGIECGLGFF QFGQTLFVFG NLHRPFRQFG

101   LLFFRLQLVF FKLHADLLLL LMDALHLRLR RLLVAFDALV QVLLMADLFF

151   QTGNLFAQHA AFVAQFVHRL LLRLFGSLQG VYFVV*
``` m507/a507 89.7% identity in 185 aa overlap

```
                   10         20         30         40         50         60
      m507.pep  MLLLTLQQGGCFLRGGGFGFVGQVXGLVFLFQTTFALFVLGNRLFGMGKLLLLLQRQFAAD
                ||||:|||| |||||||||| |:|||||||||||||||| ||||||||||||||||||||
         a507  MLLLALQQGGSFLRGGGFGFVRQIQGLVFLFQTTFALFVLGNGLFGMGKLLLLLQRQFAAD
                   10         20         30         40         50         60

70         80         90        100        110        120
      m507.pep  AVCLVLLGLEGGVERGLGFFQFGQTLLVFGNLHRPFRQLGLFFFDLQVFFKLHADLLLL
                |||||||||||||:| |||||||||:||||||||||||:||:|| ||||||||||||||
         a507  AVCLVLLGLEGGIECGLGFFQFGQTLFVFGNLHRPFRQFGLLFFRLQLVFFKLHADLLLL
                   70         80         90        100        110        120

130        140        150        160        170        180
      m507.pep  LMNALXLRLRCLLVAFDALVQVLLMADLFFQTGNLLAQHAALVAQFMHCLLLRLFGSLQG
                ||:|| |||| ||||||||||||||||||||||||:||||:|||:| |: ||||||||||
         a507  LMDALHLRLRRLLVAFDALVQVLLMADLFFQTGNLFAQHAAFVAQFVHRLLLRLFGSLQG
                  130        140        150        160        170        180 m507.pep  VYFVVX
                ||||||
         a507  VYFVVX
```

The following partial DNA sequence was identified in *N. gonorrhoeae* <SEQ ID 1387>:

```
g508.seq
    1   ATGGTAGCGT TTGGCGTTGA TCAGGGCCTC CTGCTGCTGC AACAGGGCGG

51   TTTGGGTGGC GGCCTGAAGC TGCGGCAGCT TGGTTTGCAG GGTTTGTACG

101   CGGGCGTATT GCTCCCTGCC CTGTTCCTGA ATCTGCGCGA GTTTTTCCTG

151   CACGGCGATG TATTCTTCGT CCAGCGTGTG TACGGTTTCG GTCAACTCGT

201   CGAGCTTGAT GTGCTGCTCG TCGTTTTGGA ACTCGGTTTC ATAGGCGAGG

251   GCAAGCTCTT GCCGGCGTTC CTGCCAGTCC AGGGTTTGCT GTTCGAGCCG

301   GGCGATTTGC TGCCGGTAGT TTTGTTTTTG CGGGTTGAGT TTGTGGACGG

351   CGACTTCGGC AAGCCCGTAT GGCGGTTGG  CTTCCAACAG GGCAAGCTGC

401   GCCTGTTTCA GACGGCCTTG CTGCTCTTGG CGGCTGTGCG CGGTGGTTTG

451   CTGCTGGTGT TCGAGTTCGG CGGCGGCTTC CTGCAAAGTA GCGATGTCGT

501   CTGA
```

This corresponds to the amino acid sequence <SEQ ID 1388;
ORF 508.ng>:

```
g508.pep
    1   MVAFGVDQGL LLLQQGGLGG GLKLRQLGLQ GLYAGVLLPA LFLNLREFFL

51   HGDVFFVQRV YGFGQLVELD VLLVVLELGF IGEGKLLPAF LPVQGLLFEP

101   GDLLPVVLFL RVEFVDGDFG KPVLAVGFQQ GKLRLFQTAL LLLAAVRGGL

151   LLVFEFGGGF LQSSDVV
```

The following partial DNA sequence was identified in *N. meningitidis* <SEQ ID 1389>:

```
m508.seq
     1  ATGGTAGCGT TTGGCGTTGA TCAGGGCTTC CTGCTGCTGC AACAAGGCGG

51  TTTGGGTGGC GGCCTGAAGC TGCGGCAGCT TGGTTTGCAG GGTTTGCACT

101  TTAGCGTATT GCTCCCTGCC CTGTTCCTGA ATCTGCGCGA GTTTCTCTTG

151  CACAACAATA TATTCTTCGT CCAAGGTCTG TACGGCTTCG CTTAATTCTT

201  CAAGCTTGAT GTGCTGCTCG TCGTTTTGGA ACTCGGTTTC ATAGGCGAGG

251  GCAAGCTCTT GCTGGCGTTC CTGCCAGTCG AGGGTTTGCT GTTCAAGCTG

301  GGCGATTTGC TGCCGGTAGT TTTGTTTTTG CTGGTTGAGT TTGTGGACGG

351  CGACTTCGGC AAGCCCGTAT TGGCGGTTGG CTTCCAACAG GGCAAGCTGC

401  GCCTGTTTCA GACGGCCTTG CTGCTCTTGG CGGCTGTGCG CGGTGGTTTG

451  CTGCTGGTGT TCGAGTTCGG CGGCGGCTTC CTGCAAGGTA ACGATGTCGT

501  CTGA
```

This corresponds to the amino acid sequence <SEQ ID 1390; ORF 508.ng>:

```
m508.pep
     1  MVAFGVDQGF LLLQQGGLGG GLKLRQLGLQ GLHFSVLLPA LFLNLREFLL

51  HNNIFFVQGL YGFAXFFKLD VLLVVLELGF IGEGKLLLAF LPVEGLLFKL

101  GDLLPVVLFL LVEFVDGDFG KPVLAVGFQQ GKLRLFQTAL LLLAAVRGGL

151  LLVFEFGGGF LQGNDVV*
```

Computer analysis of this amino acid sequence gave the following results:
Homology with a Predicted ORF from *N. gonorrhoeae*
ORF 508 shows 86.8% identity over a 167 aa overlap with a predicted ORF (ORF 508.ng) from *N. gonorrhoeae*:

```
m508/g508
                    10         20         30         40         50         60
      m508.pep   MVAFGVDQGFLLLQQGGLGGGLKLRQLGLQGLHFSVLLPALFLNLREFLLHNNIFFVQGL
                 |||||||||:||||||||||| ||||||||||: :||||||||||||||:||:::||||  :
      g508       MVAFGVDQGLLLLQQGGLGGGLKLRQLGLQGLYAGVLLPALFLNLREFFLHGDVFFVQRV
                    10         20         30         40         50         60

70         80         90        100        110        120
      m508.pep   YGFAXFFKLDVLLVVLELGFIGEGKLLLAFLPVEGLLFKLGDLLPVVLFLLVEFVDGDFG
                 |||: : :|||||||||||||||||||:||||:|||: ||||||||| ||||||||||
      g508       YGFGQLVELDVLLVVLELGFIGEGKLLPAFLPVQGLLFEPGDLLPVVLFLRVEFVDGDFG
                    70         80         90        100        110        120

130        140        150        160
      m508.pep   KPVLAVGFQQGKLRLFQTALLLLAAVRGGLLLVFEFGGGFLQGNDVV
                 |||||||||||||||||||||||||||||||||||||||||||::|||
      g508       KPVLAVGFQQGKLRLFQTALLLLAAVRGGLLLVFEFGGGFLQSSDVV
                   130        140        150        160
```

The following partial DNA sequence was identified in *N. meningitidis* <SEQ ID 1391>:

```
a508.seq
     1  ATGGTAGCGT TTGGCGTTGA TCAGGGCTTC CTGCTGCTGC AACAGGGCGG

51  TTTGGGTGGC GGCCTGAAGC TGCGGCAGCT TGGTTTGCAG GGTTTGTACG

101  CGGGCGTATT GTTCCCTACC CTGCTCCTGA ATCTGCGCGA GTTTCTCCTG

151  TACGACAATA TATTCTTCGT CCAAACTCTG TACGGCTTCG CTCAACTCTT
```

-continued

```
201  CGAGCTTGAT GTGCTGCTCG TCGTTTTGGA ACTCGGTTTC ATAGGCGAGG

251  GCAAGCTCTT GCTGGCGTTC CTGCCAATCG AAGGTTTGTT GTTCAAGCTG

301  GGCAATTTGC TGTTGGTAGT TTTGTTTTTG CTGGTTGAGC TTGTGGACGG

351  CGACTTCGGC AAGCCCGTAT TGGCGGTTGG CTTCCAACAG GGCAAGCTGC

401  GCCTGTTTCA GACGACCTTG CTGCTCTTGG CGGCTGTGCG CGGCGGTTTG

451  CTGCTGGTGT TCGAGTTCGG CGGCGGCTTC TGCAAAATG GCGATGTCGT

501  CTGA
```

This corresponds to the amino acid sequence <SEQ ID 1392; ORF 508.a>:

```
a508.pep
   1  MVAFGVDQGF LLLQQGGLGG GLKLRQLGLQ GLYAGVLFPT LLLNLREFLL

51  YDNIFFVQTL YGFAQLFELD VLLVVLELGF IGEGKLLLAF LPIEGLLFKL

101  GNLLLVVLFL LVELVDGDFG KPVLAVGFQQ GKLRLFQTTL LLLAAVRGGL

151  LLVFEFGGGF LQNGDVV*
``` m508/a508 88.6% identity in 167 aa overlap

```
                10         20         30         40         50         60
m508.pep  MVAFGVDQGFLLLQQGGLGGGLKLRQLGLQGLHFSVLLPALFLNLREFLLHNNIFFVQGL
          ||||||||||||||||||||||||||||||||: :||:|:||||||||||::||||| |
a508      MVAFGVDQGFLLLQQGGLGGGLKLRQLGLQGLYAGVLFPTLLLNLREFLLYDNIFFVQTL
                10         20         30         40         50         60

70         80         90        100        110        120
m508.pep  YGFAXFFKLDVLLVVLELGFIGEGKLLLAFLPVEGLLFKLGDLLPVVLFLLVEFVDGDFG
          ||||  :|:|||||||||||||||||||||||:||||||||:||||||||:||||||
a508      YGFAQLFELDVLLVVLELGFIGEGKLLLAFLPIEGLLFKLGNLLLVVLFLLVELVDGDFG
                70         80         90        100        110        120

130        140        150        160
m508.pep  KPVLAVGFQQGKLRLFQTALLLLAAVRGGLLLVFEFGGGFLQGNDVVX
          ||||||||||||||||||:|||||||||||||||||||||||::||||
a508      KPVLAVGFQQGKLRLFQTTLLLLAAVRGGLLLVFEFGGGFLQNGDVVX
               130        140        150        160
```

The following partial DNA sequence was identified in N. gonorrhoeae <SEQ ID 1393>:

```
g509.seq
   1  atggtcgctg tatgtgatga acgggctgta cagcggacgt tggtggccca 51  attcgcgcaa caaggcggct tgttttgct cttcgttcag gctgttgtag 101  tcttccaagc ctgcgtgttg gaaaagctcg gcaaccacat cggcgtgttt 151  gcctgcgtgt tggcgcaggt cgagcggcat catgtggaag ccgaacacgg 201  acacggaacg gatgaggtct gccaaacggc cttcggcaag caggcggctg 251  ccgttgtcga taagggaacg ttgcaatttt tcaaatcat cgagaaattt 301  ttgggccgaa gcataaggct cgagaaagcc gaatttgcag cccatgccca 351  aaccgagcga gcgcgctttg cccatagcgc gcgccataat gtaggcaatg 401  gcgcggcggt aaggttcttc ggtgcgggcg atttcttcgt caggcgagag 451  ggctgccagt gccattacgt cgtcgttgac tttgacgcgg cggatggaaa 501  gcggcagttc gcggtaaagt ttgtcgagtt cgctgcggta aaaacggaac 551  acggcatcgg cgtggcggcg gaaggcaaag cgcagggttt cgccagaaac
```

```
-continued
 601  aaacggattg ccgtcgcggt cgccgccgat ccagccgccg attttaagga
 651  tattcggaac gcggacatcg ggataggccg tctgaaagtc gtgttccatc
 701  ttgcggtaga gtttgggcag ggcttcaaaa aagctcatcg ggaagatgga
 751  cacgccgttg ttgatttcgt cgttgacgct gagtttgtgg cggcgcgttt
 801  cgctggtctg ccacaagccc agaagcacgg tgtcgatttc gcggcgcagc
 851  cgtgccagcg cgtcggcatt ggtgcagcgt tcgcgttgcg gcagcagcgc
 901  gcggatgcgg cggttgaaat tcaaaacggt ttggcgttgc acttcggtcg
 951  ggtgcgcggt caaaacggcg gtaacggacg tattgtccaa ctgccgctgc
1001  accgatttgc cgtcggcttt ccccgctttg agcctgcgga cggtttccgt
1051  caggctgcct tctgctgcgt tgtggccggc atcttcgtgg atttggcggc
1101  ggcgttcgtg gtgcacgtct tcggcgatat tcagaatctg ggcgaacagc
1151  ccgcaggcaa gcgtcagatc gtaggtctgc cgttcgtcca attgcggcaa
1201  tactttttca atcaatgccg cgctgtcgtc ggaagtggac aagagtttga
1251  ccgtttcgac aaccaacggc gaggcttctt cgtgcaggag gttgaacagg
1301  gactgtttca aaaattccgc gtccgccgcc aaagccgcgt ccttcggatt
1351  gttcaggata tgcagttgca tgattttcct ctcattgccg taaatactgt
1401  aaatgtacct caaatgccgc atccgtgcca aaccgttcac actttaacca
1451  ctcatgtccc gaaatgccgt ctgaagttga acgccgcccg acggcggcgt
1501  tacaatcgcc cgcaactgtt tttttccgaa catcatcatg accgcgaccg
1551  aacacgacaa cgacgacgca ctcctgctgc ggtacagccg ccacatcctc
1601  ttggacgaaa tcggcatcga agggcagcag aagctttccg ccgcgcatat
1651  tttggtcgtc ggctgcggcg gattgggcgc cgccgcccct gccctatctc
1701  gccgcctcgg gggtcggcac gctga
```

This corresponds to the amino acid sequence <SEQ ID 1394; ORF 509.ng>:

```
g509.pep
   1  MVAVCDERAV QRTLVAQFAQ QGGLFLLFVQ AVVVFQACVL EKLGNHIGVF

51  ACVLAQVERH HVEAEHGHGT DEVCQTAFGK QAAAVVDKGT LQFFQIIEKF

101  LGRSIRLEKA EFAAHAQTER ARFAHSARHN VGNGAAVRFF GAGDFFVRRE

151  GCQCHYVVVD FDAADGKRQF AVKFVEFAAV KTEHGIGVAA EGKAQGFARN

201  KRIAVAVAAD PAADFKDIRN ADIGIGRLKV VFHLAVEFGQ GFKKAHREDG

251  HAVVDFVVDA EFVAARFAGL PQAQKHGVDF AAQPCQRVGI GAAFALRQQR

301  ADAAVEIQNG LALHFGRVRG QNGGNGRIVQ LPLHRFAVGF PRFEPADGFR

351  QAAFCCVVAG IFVDLAAAFV VHVFGDIQNL GEQPAGKRQI VGLPFVQLRQ

401  YFFNQCRAVV GSGQEFDRFD NQRRGFFVQE VEQGLFQKFR VRRQSRVLRI

451  VQDMQLHDFP LIAVNTVNVP QMPHPCQTVH TLTTHVPKCR LKLNAARRRR

501  YNRPQLFFSE HHHDRDRTRQ RRRTPAAVQP PHPLGRNRHR RAAEAFRRAY

551  FGRRLRRIGR RRPCPISPPR GSAR*
```

The following partial DNA sequence was identified in *N. meningitidis* <SEQ ID 1395>:

m509.seq
```
   1 ATGGTCGCTG TATGTGATAA ACGGGCTGTA CAGAGGACGT TGATGGCTCA
  51 ATTCGCGCAA CAGGGCGGTT TGTTTTTGCT CTTCGTTCAG GCGGTTGTAG
 101 TCTTCCAAGC CTGCGTGTTG GAAAAGCTCG GCAACCACAT CGGCGTGTTT
 151 GCCTGCGTGT TGGCGCAAGT CGAGCGGCAT CATGTGAAAG CCGAACACGG
 201 ATACGGAACG GATGAGGTCT GCCAAACGGC CTTCGGCAAG CAGACGGCTG
 251 CCGTTGTCGA TAAGGGAACG TTGCAATTTT TTCAAATCAT CCAGAAACTC
 301 TTGTGCCGAA GCATAAGGCT CGAGAAAGCC GAATTTGCAG CCCATACCCA
 351 AACCGAGCGC GCGCGCTTTG CCCATAGCGC GCGCCATAAT GTAGGCGATG
 401 GCGCGGCGGT AGGGTTCTTC GGCGCGGGCG ATTTCTTCGT CGGGCGATTT
 451 GTCGGACAAC GCCGTTACAT CGCCGTTGAC TTTGACGCGG CGGATGGAGA
 501 GCGGCAGTTC GCGGTAGAGT TTGTCGAGTT CGCCGCGATA GAAGCGGAAC
 551 ACGGCATCGG CGTGGCGGCG GAAGGCAAAG CGCAGGGTTT CGGCAGAAAC
 601 AAACGGATTG CCGTCGCGGT CGCCGCCGAT CCAGCCGCCG ATTTTGAGGA
 651 TGTCCGGAAC GCGGACGCCG GGATAGGCCG TCTGAAAGTC GTGTTCCATC
 701 TTGCGGTAGA GCTTGGGCAG GGCTTCGAAA AAGCTCATCG GGAAGATGGA
 751 CACGCCGTTG TTGATTTCGT CGTTGACGCT GAGTTTGTGG CGGCGCGTTT
 801 CGCTGGTCTG CCACAAGCCC AGCAGGATAG TGTCGATTtC GCgGCGCAGC
 851 CGTGCCAGCG CGTCGGCATT GGTGCAGCGT TCgCGTTGCG GCAACAGTGC
 901 GCGGATGCGG CGGTTGAAGC TTAAGACGGT TTGGCGTTGC ACTTCGGTCG
 951 GGTGCGCGGT CAAAACGGCG GTAACGGACG TATTGTCCAA CTGCCGCTGC
1001 ACCGATTTGC CGTCGGCTTT CCCCGCTTTG AGCCTGCGGA CGGTTTCCGT
1051 CAGGCTGCCT TCCGCGCCGC CGCGTCCGGC TTCTTCGTGG ATTTGGCGGC
1101 GGCGTTCGTG GTGCACGTCT TCGGCGATGT TCAAAATCTG GCGGAACAGG
1151 CCGCAGGCCA AGGTTAAATC GTGGGTTTGT TGTTCGTCCA ATTGCGGCAA
1201 TACTTTTTCA ATCAATGCCG CGCTGTCGTC GGAAGTGGAC AAGAGTTTGA
1251 CTGTTTCGAC AACCAACGGC GAGGCTTCTT CGTGCAGGAG GTTGAACAGG
1301 GATTGTTTCA GAAATTCCGC GTCCGCCGCC AAAGCCGCGT CCTTTGGATT
1351 GTTCAGAATA TGCAGTTGCA TGATTTTTCT CTCTCGTCTG CCGTAAATAT
1401 TGTAAATGTA CCCCAAATGC CGCATCCGTG CCAAACCGTT CACACTTTAA
1451 CCGCCCGTGT CCCGAAATGC CGTCTGAAGT TGAACGCCGC CGACGGCAG
1501 CGTTACAATC GCCCGCAACT GTTTTtTTCC GAACATCATC ATGACCACGA
1551 CCGAACACGA CAACGACGAT GCATTCCTGC TGCGGTACAG CCGCCACATC
1601 CTCTTGGACG AAATCGGCAT CGAAGGGCAG CAGAAACTTT CCGCCGCGCA
1651 TATTTTGGTC GTCGGCTGCG GCGGTTTGGG TGCCGCCGCA CT.GCCCTAC
1701 CTTGCCGCTT CGGGTGTCGG CACGCTGA
```

This corresponds to the amino acid sequence <SEQ ID 1396; ORF 509>:

m509.pep
```
   1 MVAVCDKRAV QRTLMAQFAQ QGGLFLLFVQ AVVVFQACVL EKLGNHIGVF
  51 ACVLAQVERH HVKAEHGYGT DEVCQTAFGK QTAAVVDKGT LQFFQIIQKL
```

-continued

```
101  LCRSIRLEKA EFAAHTQTER ARFAHSARHN VGDGAAVGFF GAGDFFVGRF

151  VGQRRYIAVD FDAADGERQF AVEFVEFAAI EAEHGIGVAA EGKAQGFGRN

201  KRIAVAVAAD PAADFEDVRN ADAGIGRLKV VFHLAVELGQ GFEKAHREDG

251  HAVVDFVVDA EFVAARFAGL PQAQQDSVDF AAQPCQRVGI GAAFALRQQC

301  ADAAVEAXDG LALHFGRVRG QNGGNGRIVQ LPLHRFAVGF PRFEPADGFR

351  QAAFRAAASG FFVDLAAAFV VHVFGDVQNL GEQAAGQGXI VGLLFVQLRQ

401  YFFNQCRAVV GSGQEFDCFD NQRRGFFVQE VEQGLFQKFR VRRQSRVLWI

451  VQNMQLHDFS LSSAVNIVNV PQMPHPCQTV HTLTARVPKC RLKLNAARRQ

501  RYNRPQLFFS EHHHDHDRTR QRRCIPAAVQ PPHPLGRNRH RRAAETFRRA

551  YFGRRLRRFG CRRTXPTLPL RVSAR*
```

Computer analysis of this amino acid sequence gave the following results:
Homology with a Predicted ORF from *N. gonorrhoeae*
ORF 509 shows 87.8% identity over a 575 aa overlap with a predicted ORF (ORF 509.ng) from *N. gonorrhoeae*:

```
m509/g509
                   10         20         30         40         50         60
m509.pep  MVAVCDKRAVQRTLMAQFAQQGGLFLLFVQAVVVFQACVLEKLGNHIGVFACVLAQVERH
          |||||:||||||||:|||||||||||||||||||||||||||||||||||||||||||||
g509      MVAVCDERAVQRTLVAQFAQQGGLFLLFVQAVVVFQACVLEKLGNHIGVFACVLAQVERH
                   10         20         30         40         50         60

70         80         90        100        110        120
m509.pep  HVKAEHGYGTDEVCQTAFGKQTAAVVDKGTLQFFQIIQKLLCRSIRLEKAEFAAHTQTER
          ||:||||:|||||||||||||:|||||||||||||||:|:||||||||||||||||:||||
g509      HVEAEHGHGTDEVCQTAFGKQAAAVVDKGTLQFFQIIWKFLGRSIRLEKAEFAAHAQTER
                   70         80         90        100        110        120

130        140        150        160        170        180
m509.pep  ARFAHSARHNVGDGAAVGFFGAGDFFVGRFVGQRRYIAVDFDAADGERQFAVEFVEFAAI
          ||||||||||||:||||  ||||||||||||    |::::|||||||:|||||:|||||:
g509      ARFAHSARHNVGNGAAVRFFGAGDFFVRREGCQCHYVVVDFDAADGKRQFAVKFVEFAAV
                  130        140        150        160        170        180

190        200        210        220        230        240
m509.pep  EAEHGIGVAAEGKAQGFGRNKRIAVAVAADPAADFEDVRNADAGIGRLKVVFHLAVELGQ
          ::||||||||||||||||:|||||||||||||||:|:|:|||:||||||||||||||:||
g509      KTEHGIGVAAEGKAQGFARNKRIAVAVAADPAADFKDIRNADIGIGRLKVVFHLAVEFGQ
                  190        200        210        220        230        240

250        260        270        280        290        300
m509.pep  GFEKAHREDGHAVVDFVVDAEFVAARFAGLPQAQQDSVDFAAQPCQRVGIGAAFALRQQC
          ||:|||||||||||||||||||||||||||||:: :|||||||||||||||||||||||
g509      GFKKAHREDGHAVVDFVVDAEFVAARFAGLPQAQKHGVDFAAQPCQRVGIGAAFALRQQR
                  250        260        270        280        290        300

310        320        330        340        350        360
m509.pep  ADAAVEAXDGLALHFGRVRGQNGGNGRIVQLPLHRFAVGFPRFEPADGFRQAAFRAAASG
          ||||||  :||||||||||||||||||||||||||||||||||||||||||||:::|
g509      ADAAVEIQNGLALHFGRVRGQNGGNGRIVQLPLHRFAVGFPRFEPADGFRQAAFCCVVAG
                  310        320        330        340        350        360

370        380        390        400        410        420
m509.pep  FFVDLAAAFVVHVFGDVQNLGEQAAGQGXIVGLLFVQLRQYFFNQCRAVVGSGQEFDCFD
          :|||||||||||||||:|||||||  ||: ||||  ||||||||||||||||||||||:||
g509      IFVDLAAAFVVHVFGDIQNLGEQPAGKRQIVGLPFVQLRQYFFNQCRAVVGSGQEFDRFD
                  370        380        390        400        410        420

430        440        450        460        470        480
m509.pep  NQRRGFFVQEVEQGLFQKFRVRRQSRVLWIVQNMQLHDFSLSSAVNIVNVPQMPHPCQTV
          ||||||||||||||||||||||||||||| ||||||||:| |||||:|||||||||||||
g509      NQRRGFFVQEVEQGLFQKFRVRRQSRVLRIVQDMQLHDFPLI-AVNTVNVPQMPHPCQTV
                  430        440        450        460        470        480

490        500        510        520        530        540
m509.pep  HTLTARVPKCRLKLNAARRQRYNRPQLFFSEHHHDHDRTRQRRCIPAAVQPPHPLGRNRH
          ||||::||||||||||||||  |||||||||||:|||||||||  ||||||||||||||
g509      HTLTTHVPKCRLKLNAARRRRYNRPQLFFSEHHHDRDRTRQRRRTPAAVQPPHPLGRNRH
             480        490        500        510        520        530
```

-continued

```
                550        560        570
m509.pep   RRAAETFRRAYFGRRLRRFGCRRTCPTLPLRVSAR
           |||||:||||||||||||:| || ||  | | |||
g509       RRAAEAFRRAYFGRRLRRIGRRRPCPISPPRGSAR
        540        550        560        570
```

The following partial DNA sequence was identified in *N. meningitidis* <SEQ ID 1397>:

```
a509.seq
   1  ATGGTCGCTG TATGTGATGA ACGGACTGTA CAGTGGACGT TGATGGCTCA
  51  ATTCGCGCAA CAGGGCGGCT TGTTTTTGCT CTTCGTTGAG GCTGTTGTAG
 101  TCTTCCAAGC CTGCGTGTTG GAAAAGCTCG GCAACCACAT CGGCGTGTTT
 151  GCCTGCGTGT TGGCGCAGGT CGAGCGGCAT CATGTGGAAG CCGAACACGG
 201  ATACGGAACG GATGAGGTCT GCCAAACGGC CTTCGGCAAG CAGGCGGCTG
 251  CCGTTGTCGA TAAGGGAATG TTGCAATTTT TTCAAATCAT CGAGAAATTC
 301  TTGTGCCGAA GCATAAGGCT CGAGAAAGCC GAATTTGCAG CCCATACCCA
 351  AACCGAGCGC GCGCGCTTTG CCCATAGCGC GCGCCATAAT GTAGGCAATG
 401  GCGCGACGGT AGGGTTCTTC GGCGCGGGCG GTTTCTTCGT CGGGCGATTT
 451  GTCGGACAAC GCCATCACAT CGCCGTTGAC TTTGACGCGG CGGATGGAGA
 501  GCGGCAGTTC GCGGTAGAGT TTGTCGAGTT CGCCACGGTA AAAACGGAAC
 551  ACGGCATCGG CGTGGCGGCG GAAGGCAAAA CGCAAGGTTT CGGCAGAAAC
 601  GAACGGATTG CCGTCGCGGT CGCCGCCGAT CCAGCCGCCG ATTTTGAGGA
 651  TGTCCGGAAC GCGGACATCG GGATAGGCCG TCTGAAAGTC GTGTTCCATC
 701  TTGCGGTAGA GCTTGGGCAG GGCTTCAAAA AAGCTCATCG GAAAGATGGA
 751  CACGCCGTTG TTGATTTCGT CGTTGACGCT GAGTTTGTGG CGGCGCGTTT
 801  CGCTGGTCTG CCACAAGCCC AGCAGGATAG TGTCGATTTC GCGGCGCAGC
 851  CGTGCCAGCG CGTCGGCATT GGTACAGCGT TCGCGTTGCG GCAGCAGCGC
 901  GCGGATGCGG CGGTTGAAAT TCAAGACGGT CTGGCGTTGC ACTTCGGTCG
 951  GGTGCGCGGT CAAAACGGCG GTAACGGACG TATTGTCCAA CTGCCGCTGC
1001  ACCGATTTGC CGTCGGCTTT CCCCGCTTTG AGCCTGCGGA CGGTTTCCGT
1051  CAGGCTGCCT TCCGCGCCGC CGCGTCCGGC TTCTTCGTGG ATTTGGCGGC
1101  GGCGTTCGTG GTGCACGTCT TCGGCGATGT TCAAAATCTG GGCGAACAGG
1151  CCGCAGGCCA AGGTTAAATC GTGGGTTTGT TGTTCGTCCA ATTGCGGCAA
1201  TACTTTTTCA ATCAATGCCG CGCTGTCGTC GGAAGTGGAC AAGAGTTTGA
1251  CCGTTTCGAC AACCAACGGC GAGGCTTCTT CGTGCAGGAG GTTGAACAGG
1301  GATTGTTTCA GAAATTCCGC GTCCGCCGCC AAAGCCGCGT CCTTTGGATT
1351  GTTCAGAATA TGCAGTTGCA TGATTTTTCT CTCATTGCCG TAAATACTGT
1401  AAATGTACCT CAAATGCCGC ATCCGTGCCA AACCGTTCAC ACTTTAACCG
1451  CCCGTGTCCC GAAATGCCGT CTGAAGTTGA ACGCCGCCCG ACGGCAGCGT
1501  TACAATCGCC CACAACTGTT TTT.TCCGAA CATCATCATG ACCACGACCG
1551  AACACGACAA CGACGATGCA TTCCTGCTGC GGTACAGCCG CCACATCCTC
1601  TTGGACGAAA TTGGCATCGA AGGGCAGCAG AAACTTTCCG CCGCGCATAT
```

-continued

```
1651  TTTGGTCGTC GGCTGCGGCG GTTTGGGTGC CGCCGCCGAT GCCCTATCTC

1701  GCCGCTTCCG GCATCGGCAC GCTGA
```

This corresponds to the amino acid sequence <SEQ ID 1398; ORF 509.a>:

```
a509.pep
   1  MVAVCDERTV QWTLMAQFAQ QGGLFLLFVE AVVVFQACVL EKLGNHIGVF

51  ACVLAQVERH HVEAEHGYGT DEVCQTAFGK QAAAVVDKGM LQFFQIIEKF

101  LCRSIRLEKA EFAAHTQTER ARFAHSARHN VGNGATVGFF GAGGFFVGRF

151  VGQRHHIAVD FDAADGERQF AVEFVEFATV KTEHGIGVAA EGKTQGFGRN

201  ERIAVAVAAD PAADFEDVRN ADIGIGRLKV VFHLAVELGQ GFKKAHRKDG

251  HAVVDFVVDA EFVAARFAGL PQAQQDSVDF AAQPCQRVGI GTAFALRQQR

301  ADAAVEIQDG LALHFGRVRG QNGGNGRIVQ LPLHRFAVGF PRFEPADGFR

351  QAAFRAAASG FFVDLAAAFV VHVFGDVQNL GEQAAGQG*I VGLLFVQLRQ

401  YFFNQCRAVV GSGQEFDRFD NQRRGFFVQE VEQGLFQKFR VRRQSRVLWI

451  VQNMQLHDFS LIAVNTVNVP QMPHPCQTVH TLTARVPKCR LKLNAARRQR

501  YNRPQLFXSE HHHDHDRTRQ RRCIPAAVQP PHPLGRNWHR RAAETFRRAY

551  FGRRLRRFGC RXPCPISPLP ASAR*
``` m509/a509 93.0% identity in 575 aa overlap

```
                   10         20         30         40         50         60
    m509.pep  MVAVCDKRAVQRTLMAQFAQQGGLFLLFVQAVVVFQACVLEKLGNHIGVFACVLAQVERH
              ||||||:|:|| |||||||||||||||||:||||||||||||||||||||||||||||||
        a509  MVAVCDERTVQWTLMAQFAQQGGLFLLFVEAVVVFQACVLEKLGNHIGVFACVLAQVERH
                       10         20         30         40         50         60

70         80         90        100        110        120
    m509.pep  HVKAEHGYGTDEVCQTAFGKQTAAVVDKGTLQFFQIIQKLLCRSIRLEKAEFAAHTQTER
              || :|||||||||||||||||:||||||| ||||||||:|:|||||||||||||||||||
        a509  HVEAEHGYGTDEVCQTAFGKQAAAVVDKGMLQFFQIIEKFLCRSIRLEKAEFAAHTQTER
                       70         80         90        100        110        120

130        140        150        160        170        180
    m509.pep  ARFAHSARHNVGDGAAVGFFGAGDFFVGRFVGQRRYIAVDFDAADGERQFAVEFVEFAAI
              ||||||||||||:|::|||||||:|||||||||||::||||||||||||||||||||::
        a509  ARFAHSARHNVGNGATVGFFGAGGFFVGRFVGQRHHIAVDFDAADGERQFAVEFVEFATV
                      130        140        150        160        170        180

190        200        210        220        230        240
    m509.pep  EAEHGIVAAEGKAQGFGRNKRIAVAVAADPAADFEDVRNADAGIGRLKVVFHLAVELGQ
              ::|||||||||:|||||||:||||||||||||||||||||| ||||||||||||||||
        a509  KTEHGIGVAAEGKTQGFGRNERIAVAVAADPAADFEDVRNADIGIGRLKVVFHLAVELGQ
                      190        200        210        220        230        240

250        260        270        280        290        300
    m509.pep  GFEKAHREDGHAVVDFVVDAEFVAARFAGLPQAQQDSVDFAAQPCQRVGIGAAFALRQQC
              ||:||||:|||||||||||||||||||||||||||||||||||||||||:||||||||
        a509  GFKKAHRKDGHAVVDFVVDAEFVAARFAGLPQAQQDSVDFAAQPCQRVGIGTAFALRQQR
                      250        260        270        280        290        300

310        320        330        340        350        360
    m509.pep  ADAAVEAXDGLALHFGRVRGQNGGNGRIVQLPLHRFAVGFPRFEPADGFRQAAFRAAASG
              |||||| ||||||||||||||||||||||||||||||||||||||||||||||||||||
        a509  ADAAVEIQDGLALHFGRVRGQNGGNGRIVQLPLHRFAVGFPRFEPADGFRQAAFRAAASG
                      310        320        330        340        350        360

370        380        390        400        410        420
    m509.pep  FFVDLAAAFVVHVFGDVQNLGEQAAGQGXIVGLLFVQLRQYFFNQCRAVVGSGQEFDCFD
              ||||||||||||||||||||||||||||||||||||||||||||||||||||||||| |
        a509  FFVDLAAAFVVHVFGDVQNLGEQAAGQGXIVGLLFVQLRQYFFNQCRAVVGSGQEFDRFD
                      370        380        390        400        410        420

430        440        450        460        470        480
    m509.pep  NQRRGFFVQEVEQGLFQKFRVRRQSRVLWIVQNMQLHDFSLSSAVNIVNVPQMPHPCQTV
              |||||||||||||||||||||||||||||||||||||||||| ||||||||||||||||
        a509  NQRRGFFVQEVEQGLFQKFRVRRQSRVLWIVQNMQLHDFSLI-AVNTVNVPQMPHPCQTV
                      430        440        450        460        470
```

```
                 490        500        510        520        530        540
m509.pep  HTLTARVPKCRLKLNAARRQRYNRPQLFFSEHHHDHDRTRQRRCIPAAVQPPHPLGRNRH
          ||||||||||||||||||||||||||||| ||||||||||||||||||||||||||||| |
a509      HTLTARVPKCRLKLNAARRQRYNRPQLFXSEHHHDHDRTRQRRCIPAAVQPPHPLGRNWH
               480       490        500       510        520       530

550       560        570
m509.pep  RRAAETFRRAYFGRRLRRFGCRRTXPTLPLRVSARX
          ||||||||||||||||||||||||  |   ||  : ||||
a509      RRAAETFRRAYFGRRLRRFGCRXPCPISPLPASARX
              540       550        560       570
```

The following partial DNA sequence was identified in *N. gonorrhoeae* <SEQ ID 1399>:

```
g510.seq
    1   atgccttcgc ggacaccgca gggaaaaagg ggttattcct gccccaagcg
   51   ggatagtgcc ttttggcagg cgttgtccat atcggttatt ttacgcgcaa
  101   aatcgccgat tgccaaatcg ccgccgttca gggaggtttt caataggtcg
  151   tggacgacgt tgagcgcggc cataatgacg attttttcgc tgtccgcgac
  201   gcggccgcct tcgcggatgg cttcggcttt gccgttgagc attccgactg
  251   cctgcaacag tgtgtctttt tcttctgccg gcgtgttgac agtcagccgg
  301   ggcgtgcatg acttcgatgt agacttgttc gatgttcatc ctttaatcct
  351   tattgctgcg tttcctgccg ttggggagg cgcgctgcca gtgcgctga
```

This corresponds to the amino acid sequence <SEQ ID 1400; ORF 510.ng>:

```
g510.pep
    1   MPSRTPQGKR GYSCPKRDSA FWQALSISVI LRAKSPIAKS PPFREVFNRS
   51   WTTLSAAIMT IFSLSATRPP SRMASALPLS IPTACNSVSF SSAGVLTVSR
  101   GVHDFDVDLF DVHPLILIAA FPAVGGGALP VR*
```

The following partial DNA sequence was identified in *N. meningitidis* <SEQ ID 1401>:

```
m510.seq
    1   ATGCCTTCGC GGACACCGCA GGGnAAAAGG GGTTATTCCT GCGCCAAGCG
   51   GGATAGTGCT TTTTGGCAGG CGTTGTCCAT ATCGGCTATT TTACGCGCAA
  101   AATCGCCGAT TGCCAAATCG CCGCCGTTCA GGGAGGTTTT CAACAGGTCG
  151   TGGACGACGT TGAGCGCGGC CATAATGACG ATTTTTTCGC TGTCCGCGAC
  201   GCGTCCGCCT TCGCGGATGG CTTCGGCTTT GCCGTTGAGC ATTCCGACTG
  251   CCTGCAACAG TGTGTCTTTT TCTTCTGCCG GCGTGTTGAC GGTCAGCCGG
  301   GGCGTGCAwG ACTTCsAtGT GGACTTGTTC GATGTTCATC CTTTAATCCT
  351   TATTGCTGCG TTTCCTGCCA TTGGGGAGG CGCGCTGCCA GTGCGCTGA
```

This corresponds to the amino acid sequence <SEQ ID 1402; ORF 510>:

```
m510.pep
    1   MPSRTPQGKR GYSCAKRDSA FWQALSISAI LRAKSPIAKS PPFREVFNRS
   51   WTTLSAAIMT IFSLSATRPP SRMASALPLS IPTACNSVSF SSAGVLTVSR
  101   GVXDFXVDLF DVHPLILIAA FPAIGGGALP VR*
```

Computer analysis of this amino acid sequence gave the following results:
Homology with a Predicted ORF from *N. gonorrhoeae*
ORF 510 shows 96.2% identity over a 132 aa overlap with a predicted ORF (ORF 510.ng) from *N. gonorrhoeae*:

```
m510/g510
                    10        20        30        40        50        60
    m510.pep  MPSRTPQGKRGYSCAKRDSAFWQALSISAILRAKSPIAKSPPFREVFNRSWTTLSAAIMT
              ||||||||||||| ||||||||||||:|||||||||||||||||||||||||||||||||
       g510   MPSRTPQGKRGYSCPKRDSAFWQALSISVILRAKSPIAKSPPFREVFNRSWTTLSAAIMT
                    10        20        30        40        50        60

70        80        90       100       110       120
    m510.pep  IFSLSATRPPSRMASALPLSIPTACNSVSFSSAGVLTVSRGVXDFXVDLFDVHPLILIAA
              |||||||||||||||||||||||||||||||||||||||||| || ||||||||||||||
       g510   IFSLSATRPPSRMASALPLSIPTACNSVSFSSAGVLTVSRGVHDFDVDLFDVHPLILIAA
                    70        80        90       100       110       120

130
    m510.pep  FPAIGGGALPVRX
              |||:|||||||||
       g510   FPAVGGGALPVRX
                   130
```

The following partial DNA sequence was identified in *N. meningitidis* <SEQ ID 1403>:

```
a510.seq
      1  ATGCCTTCGC GGACACCGCA GGGAAAAAGG GGTTATTCCT GCGCCAAGCG

51  GGATAGTGCT TTTTGGCAGG CGTTGTCCAT ATCGGCTATT TTACGCGCAA

101  AATCGCCGAT TGCCAAATCG CCGCCGTTCA GGGAGGTTTT CAACAGGTCG

151  TGGACGACGT TGAGCGCGGC CATAATGACG ATTTTTTCGC TGTCCGCGAC

201  GCGTCCGCCT TCGCGGATGG CTTCGGCTTT GCCGTTGAGC ATTCCGACTG

251  CCTGCAACAG TGTGTCTTTT TCTTCTGCCG GCGTGTTGAC GGTCAGCCGG

301  G.CGTGCATG ACTTCGATGT GGACTTGTTC GATGTTCATC CTTTAATCCT

351  TATTGCTGCG TTTCCTGCCG TTGGGGGAGG CGCGCTGCCA GTGCGCTGA
                                                            40
```

This corresponds to the amino acid sequence <SEQ ID 1404; ORF 510.a>:

```
a510.pep
      1  MPSRTPQGKR GYSCAKRDSA FWQALSISAI LRAKSPIAKS PPFREVFNRS

51  WTTLSAAIMT IFSLSATRPP SRMASALPLS IPTACNSVSF SSAGVLTVSR

101  XVHDFDVDLF DVHPLILIAA FPAVGGGALP VR*
``` m510/a510 97.0% identity in 132 aa overlap

```
                    10        20        30        40        50        60
    m510.pep  MPSRTPQGKRGYSCAKRDSAFWQALSISAILRAKSPIAKSPPFREVFNRSWTTLSAAIMT
              ||||||||||||||||||||||||||||||||||||||||||||||||||||||||||||
       a510   MPSRTPQGKRGYSCAKRDSAFWQALSISAILRAKSPIAKSPPFREVFNRSWTTLSAAIMT
                    10        20        30        40        50        60

70        80        90       100       110       120
    m510.pep  IFSLSATRPPSRMASALPLSIPTACNSVSFSSAGVLTVSRGVXDFXVDLFDVHPLILIAA
              |||||||||||||||||||||||||||||||||||||||| | ||||||||||||||||
       a510   IFSLSATRPPSRMASALPLSIPTACNSVSFSSAGVLTVSRXVHDFDVDLFDVHPLILIAA
                    70        80        90       100       110       120

130
    m510.pep  FPAIGGGALPVRX
              |||:|||||||||
       a510   FPAVGGGALPVRX
                   130
```

The following partial DNA sequence was identified in *N. gonorrhoeae* <SEQ ID 1405>:

```
g512.seq
    1   atgaaagtgc ttgttttagg tgcgggtgtt gccggcgtat cctccgtgtg
   51   gtatctggca gaggccggac atgaagtaac ggtcatcgac cgcaccgagg
  101   gtgtggcgat ggaaaccagt tttgccaatg caggccagct ttcttacggc
  151   tataccacgc cttgggctgc acccggtatt ccgaccaaag cactgaaacg
  201   gctgtttaaa agccatccgc ctttactgtt ccgccctgac ggcggcctgt
  251   atcaaatcga atggctgtgg cggatgctgc aaaactgcac ggcaacgcgc
  301   tatcaaatca ataaagagcg catggtcagg atttccgaat acagccgtga
  351   aatgttccgc cgttttgaag cgcaaaccga catgaatttt gagggacgca
  401   aaaaagggac gttgcagatt ttccgccaaa ccgaagaagt cgaagcggca
  451   aaacaagaca ttgccgtttt ggaacgctac ggcgtgccgt accgccgtct
  501   gaagcccgaa gaatgcgcag aattcgagcc tgcgctggca cgcgttaccg
  551   ccaaaattgt cggcggtctg cacctgcctg cggatgcgac cggcgactgc
  601   cgcctcttca ccgaaaacct gtacaaattg tgtcaagaga aggggtacg
  651   gttctacttc aaccaaacca tcagccgcat cgaccacaac gggctgcgca
  701   tcaaagccgt tgaaacgaaa cagggcggtt tgaaacagat gccgttgtct
  751   gcgcgctcgg ctgcttcagc aggactgtgt tggcgcagtt ggatctcaat
  801   ctgcccattt atcccgtcaa aggctattcc ttga
```

This corresponds to the amino acid sequence <SEQ ID 1406; ORF 512.ng>:

```
g512.pep
    1   MKVLVLGAGV AGVSSVWYLA EAGHEVTVID RTEGVAMETS FANAGQLSYG
   51   YTTPWAAPGI PTKALKRLFK SHPPLLFRPD GGLYQIEWLW RMLQNCTATR
  101   YQINKERMVR ISEYSREMFR RFEAQTDMNF EGRKKGTLQI FRQTEEVEAA
  151   KQDIAVLERY GVPYRRLKPE ECAEFEPALA RVTAKIVGGL HLPADATGDC
  201   RLFTENLYKL CQEKGVRFYF NQTISRIDHN GLRIKAVETK QGGLKQMPLS
  251   ARSAASAGLC WRSWISICPF IPSKAIP*
```

The following partial DNA sequence was identified in *N. meningitidis* <SEQ ID 1407>:

```
m512.seq (partial)
    1   ..GTTTTGGAAC GCTACGGCGT GCCGTACCGC CGTCTGAAAC CCGAAGAATG
   51     TGCAGAATTT GAGCCTGCGC TGGCACGCGT TACCGCCAAA ATTGCCGGCG
  101     GCCTGCACCT GCCTGCAGAT GCGACCGGCG ACTggCGCCT CTTCACTGAA
  151     AACCTATACA AATTGTGTCA GGAAAAGGGC GTACGGTTTC ATTTCAACCA
  201     AAACATCAGC CGCATCGACC ACAACGGGCT GCGCATCAAA ACCGTTGAAA
  251     CCAAACAGGG CGGTTTGAAG CAGATGCCGT TGTCTGCGCG CTCGGTTGCT
  301     TCAGCAGGAC GGTTTTGGCG CAGTTGGATC TCAATCTGCC CATTTATCCC
  351     GTCAAAGGCT ATTCCTTGA
```

This corresponds to the amino acid sequence <SEQ ID 1408; ORF 512>:

```
m512.pep (partial)
    1    ..VLERYGVPYR RLKPEECAEF EPALARVTAK IAGGLHLPAD ATGDWRLFTE

51    NLYKLCQEKG VRFHFNQNIS RIDHNGLRIK TVETKQGGLK QMPLSARSVA

101    SAGRFWRSWI SICPFIPSKA IP*
```

Computer analysis of this amino acid sequence gave the following results:
Homology with a Predicted ORF from *N. gonorrhoeae*
ORF 512 shows 93.4% identity over a 122 aa overlap with a predicted ORF (ORF 512.ng) from *N. gonorrhoeae*:

```
    m512/g512
                                                         10         20         30
    m512.pep                                     VLERYGVPYRRLKPEECAEFEPALARVTAK
                                                 ||||||||||||||||||||||||||||||
    g512         TDMNFEGRKKGTLQIFRQTEEVEAAKQDIAVLERYGVPYRRLKPEECAEFEPALARVTAK
                    130       140       150       160       170       180
                      40         50         60         70         80         90
    m512.pep    IAGGLHLPADATGDWRLFTENLYKLCQEKGVRFHFNQNISRIDHNGLRIKTVETKQGGLK
                |:||||||||||| ||||||||||||||||||||:|||:|||||||||||:||||||||
    g512        IVGGLHLPADATGDCRLFTENLYKLCQEKGVRFYFNQTISRIDHNGLRIKAVETKQGGLK
                    190       200       210       220       230       240
                       100       110       120
    m512.pep    QMPLSARSVASAGRFWRSWISICPFIPSKAIP
                ||||||||:||| |||||||||||||||||||
    g512        QMPLSARSAASAGLCWRSWISICPFIPSKAIP
                    250       260       270
```

The following partial DNA sequence was identified in *N. meningitidis* <SEQ ID 1409>:

```
a512.seq
    1    ATGAAAGTGC TTGTTTTAGG TGCTGGTGTT GCCGGCGTAT CTTCCGCGTG

51    GTATCTGGCA GAGGCAGGAC ATGAAGTAAC GGTCATCGAC CGCGCCGAGG

101    GCGTGGCGAT GGAAACCAGT TTTGCCAACG CAGGCCAGCT TTCTTACGGC

151    TATACCACGC CTTGGGCTGC ACCCGGTATT CCGACCAAAG CACTGAAATG

201    GCTGTTTAAA AGCCATCCGC CTTTGCTGTT TCGCCCCGAC GGCAGCCTGT

251    ATCAAATCGA ATGGCTGTGG CAGATGCTGC AACACTGCAC GGCAGCGCGC

301    TATCAAATCA ATAAAGAGCG CATGGTCAGG ATGTCCGAAT ACAGCCGTGA

351    AATGTTCCGC CGTTTTGAAG CGCAAACCGG CATGAATTTT GAGGGACGCA

401    AAAAAGGGAC GTTGCAGATT TTCCGCCAAA CCAAAGAAGT CGAAGCGGCA

451    AAACAAGACA TTGCCGTTTT GGAACGCTAC GGCGTGCCGT ACCGCCGTCT

501    GAAGCCCGAA GAATGCGCAG AATTCGAGCC TGCGCTGGCA CGCGTTACCG

551    CCAAAATTGC CGGCGGCCTG CACCTGCCCG CAGACGCGAC CGGCGACTGC

601    CGCCTCTTCA CTGAAAACCT GTACAAATTG TGTCAGGAAA AGGGCGTACG

651    GTTTCATTTC AACCAAACCA TCAGCCGCAT CGACCACAAC GGGCTGCGCA

701    TCAAAACCGT TGAAACGAAA CAGGGCGGTT TGAAGCAGAT GCCGTTGTCT

751    GCGCGCTCGG CTGCTTCAGC AGGACGGTTT TGGCGCAAGT GGATCTCAAT

801    CTGCCGATTT ATCCCGTCAA AGGCTATTCC TTGA
```

This corresponds to the amino acid sequence <SEQ ID 1410; ORF 512.a>:

```
a512.pep
    1   MKVLVLGAGV AGVSSAWYLA EAGHEVTVID RAEGVAMETS FANAGQLSYG

51   YTTPWAAPGI PTKALKWLFK SHPPLLFRPD GSLYQIEWLW QMLQHCTAAR

101   YQINKERMVR MSEYSREMFR RFEAQTGMNF EGRKKGTLQI FRQTKEVEAA

151   KQDIAVLERY GVPYRRLKPE ECAEFEPALA RVTAKIAGGL HLPADATGDC

201   RLFTENLYKL CQEKGVRFHF NQTISRIDHN GLRIKTVETK QGGLKQMPLS

251   ARSAASAGRF WRKWISICRF IPSKAIP*
``` m512/a512 95.9% identity in 122 aa overlap

```
                                   10         20         30
     m512.pep                      VLERYGVPYRRLKPEECAEFEPALARVTAK
                                   |||||||||||||||||||||||||||||
     a512     TGMNFEGRKKGTLQIFRQTKEVEAAKQDIAVLERYGVPYRRLKPEECAEFEPALARVTAK
                 130       140       150       160       170       180

40         50         60         70         80         90
     m512.pep IAGGLHLPADATGDWRLFTENLYKLCQEKGVRFHFNQNISRIDHNGLRIKTVETKQGGLK
              |||||||||||||| ||||||||||||||||||||||:||||||||||||||||||||||
     a512     IAGGLHLPADATGDCRLFTENLYKLCQEKGVRFHFNQTISRIDHNGLRIKTVETKQGGLK
                 190       200       210       220       230       240

100       110       120
     m512.pep QMPLSARSVASAGRFWRSWISICPFIPSKAIPX
              ||||||||:|||||||||:||||| |||||||||
     a512     QMPLSARSAASAGRFWRKWISICRFIPSKAIPX
                 250       260       270
```

The following partial DNA sequence was identified in *N. gonorrhoeae* <SEQ ID 1411>:

```
g513.seq
    1   ATGGGTTCCG CGCCGAACGC CGCCGCCGCC GCCGAAGTGA AACACCCTGT

51   TTCGCAAGGT ATGATTCAAA TGCTGGGCGT GTTTGTCGAT ACCATCATCG

101   TTTGTTCTTG CACCGCCTTC ATCATCTTGA TTTACCAACA GCCTTATGGC

151   GATTTGAGCG GTGCGGCGCT GAcgcAGGCG GCGATTGTCA GCCAAGTGGG

201   GCAATGGGGC GCGGGTTTCC TCGCCGTCAT CCTGTTTATG TTTGCCTTTT

251   CCACCGTTAT CGGCAACTAT GCCTATGCCG AGTCCAACGT CCAATTCATC

301   AAAAGCCATT GGCTGATTAC CGCCGTTTTC CGTATGCTGG TTTTGGCGTG

351   GGTCTATTTC GGCGCGGTTG CCAATGTGCC TTTGGTCTGG GATATGGCGG

401   ATATGGCGAT GGGCATCATG GCGTGGATCA ACCTCGTCGC CATCCTGCTG

451   CTCTCGCCat TGGCGTTTAT GCTGCTGCGC GATTACACCG CCAAGCTGAA

501   AATGGGCAAA GACCCCGAGT TCAAACTTTc cgAACATCCG GGCCTGAAAC

551   GCCGCATCAA ATCCGATGTT TGGTAA
```

This corresponds to the amino acid sequence <SEQ ID 1412; ORF 513.ng>:

```
g513.pep
    1   MGSAPNAAAA AEVKHPVSQG MIQMLGVFVD TIIVCSCTAF IILIYQQPYG

51   DLSGAALTQA AIVSQVGQWG AGFLAVILFM FAFSTVIGNY AYAESNVQFI

101   KSHWLITAVF RMLVLAWVYF GAVANVPLVW DMADMAMGIM AWINLVAILL

151   LSPLAFMLLR DYTAKLKMGK DPEFKLSEHP GLKRRIKSDV W*
```

The following partial DNA sequence was identified in *N. meningitidis* <SEQ ID 1413>:

```
m513.seq
    1   ATGGGTTCCG CGCCGAACGC CGCCGCCGCC GCCGAAGTGA AACACCCTGT

51   TTCGCAAGGT ATGATTCAAA TGCTGGGCGT GTTTGTCGAT ACCATCATCG

101   TTTGTTCTTG CACCGCCTTC ATCATCTTGA TTTACCAACA GCCTTATGGC

151   GATTTGAGCG GTGCGGCGCT GAcgcAGGCG GCGATTGTCA GCCAAGTGGG

201   GCAATGGGGC GCGGGTTTCC TCGCCGTCAT CCTGTTTATG TTTGCCTTTT

251   CCACCGTTAT CGGCAACTAT GCCTATGCCG AGTCCAACGT CCAATTCATC

301   AAAAGCCATT GGCTGATTAC CGCCGTTTTC CGTATGCTGG TTTTGGCGTG

351   GGTCTATTTC GGCGCGGTTG CCAATGTGCC TTTGGTCTGG GATATGGCGG

401   ATATGGCGAT GGGCATCATG GCGTGGATCA ACCTCGTCGC CATCCTGCTG

451   CTCTCGCCat TGGCGTTTAT GCTGCTGCGC GATTACACCG CCAAGCTGAA

501   AATGGGCAAA GACCCCGAGT TCAAACTTTc cgAACATCCG GGCCTGAAAC

551   GCCGCATCAA ATCCGATGTT TGGTAA
```

This corresponds to the amino acid sequence <SEQ ID 1414; ORF 513>:

```
m513.pep
    1   MGSAPNAAAA AEVKHPVSQG MIQMLGVFVD TIIVCSCTAF IILIYQQPYG

51   DLSGAALTQA AIVSQVGQWG AGFLAVILFM FAFSTVIGNY AYAESNVQFI

101   KSHWLITAVF RMLVLAWVYF GAVANVPLVW DMADMAMGIM AWINLVAILL

151   LSPLAFMLLR DYTAKLKMGK DPEFKLSEHP GLKRRIKSDV W*
```

Computer analysis of this amino acid sequence gave the following results:
Homology with a Predicted ORF from *N. gonorrhoeae*
ORF 513 shows 99.5% identity over a 191 aa overlap with a predicted ORF (ORF 513.ng) from *N. gonorrhoeae*:

```
    m513/g513
                     10         20         30         40         50         60
       m513.pep   MGSAPNAAAAAEVKHPVSQGMIQMLGVFVDTIIVCSCTAFIILIYQQPYGDLSGAALTQA
                  ||||||||||||||||||||||||||||||||||||||||||||||||||||||||||||
           g513   MGSAPNAAAAAEVKHPVSQGMIQMLGVFVDTIIVCSCTAFIILIYQQPYGDLSGAALTQA
                     10         20         30         40         50         60
                     70         80         90        100        110        120
       m513.pep   AIVSQVGQWGAGFLAVILFMFAFSTVIGNYAYAESNVQFIKSHWLITAVFRMLVLAWVYF
                  ||||||||||||||||||||||||||||||||||||||||||||||||||||||||||||
           g513   AIVSQVGQWGAGFLAVILFMFAFSTVIGNYAYAESNVQFIKSHWLITAVFRMLVLAWVYF
                     70         80         90        100        110        120
                    130        140        150        160        170        180
       m513.pep   GAVANVPLVWDMADMAMGIMAWINLVAILLLSPLAFMXLRDYTAKLKMGKDPEFKLSEHP
                  ||||||||||||||||||||||||||||||||||||| ||||||||||||||||||||||
           g513   GAVANVPLVWDMADMAMGIMAWINLVAILLLSPLAFMLLRDYTAKLKMGKDPEFKLSEHP
                    130        140        150        160        170        180
                    190
       m513.pep   GLKRRIKSDVW
                  |||||||||||
           g513   GLKRRIKSDVW
                    190
```

The following partial DNA sequence was identified in *N. meningitidis* <SEQ ID 1415>:

```
a513.seq
    1   ATGAACGAGA ACTTTACCGA ATGGCTGCAC GGCTGGGTCG GCGCCATCAA

51   CGATCCGATG TGGTCATACT TGGTTTATNT GCTTTTGGGT ACGGGGCTTT
```

-continued

```
 101   TCTTCACCGT AACCACGGGC TTTGTCCAAT TCCGCCTGTT CGGGCGCAGC
 151   ATCAAAGAAA TGCTCGGCGG CCGCAAACAG GGGACGACC  CTCACGGCAT
 201   CACGCCGTTT CAGGCATTTG TAACCGGCCT TGCCAGCCGC GTGGGCGTGG
 251   GCAATATCGC GGGCGTGGCC ATCGCCATCA AAGTCGGCGG ACCGGGCGCG
 301   GTGTTTTGGA TGTGGGTAAC CGCCTTAATC GGTATGAGTT CGGCGTTTGT
 351   CGAATCTTCG CTGGCGCAGC TCTTTAAAGT CCGCGACTAC GACAACCACC
 401   ATTTCCGGGG CGGCCCTGCC TACTACATCA CTCAAGGGCT GGGGCAGAAA
 451   TGGCTGGGCG TGTTGTTCGC CCTGAGCCTG ATTTTCTGTT TCGGCTTTGT
 501   GTTTGAAGCG GTTCAGACCA ATACCATTGC CGATACCGTC AAAGCGGCGT
 551   GGGGTTGGGA GCCTCATTAT GTCGGCGTCG CCCTGGTGAT TTTAACCGCG
 601   CCGATTATCT TCGGCGGCAT CAGGCGCATA TCTAAAGCGG CGGAAATCGT
 651   CGTCCCCCTG ATGGCGGTTT TGTACCTCTT TATCGCGCTT TTCATCATTT
 701   TGACCAATAT TCCGATGATT CCGGACGTGT TCGGTCAGAT TTTTTCGGGC
 751   GCGTTCAAAT TCGACGCGGC AGCAGGCGGC TTACTCGGCG GTCTGATTTC
 801   GCAAACGATG ATGATGGGCA TCAAACGCGG CCTGTATTCC AACGAGGCGG
 851   GTATGGGTTC CGCGCCGAAC GCCGCCGCCG CCGCCGAAGT GAAACACCCT
 901   GTTTCGCAAG GTATGATTCA AATGCTGGGC GTGTTTGTCG ATACCATCAT
 951   CGTTTGTTCT TGCACCGCCT TCATCATCTT GATTTACCAA CAGCCTTACG
1001   GCGATTTGAG CGGTGCGGCG CTGACGCAGG CGGCGATTGT CAGCCAAGTG
1051   GGGCAATGGG GCGCGGGCTT CCTCGCCGTC ATCCTGTTTA TGTTTGCCTT
1101   TTCCACCGTT ATCGGCAACT ATGCCTATGC CGAGTCCAAC GTCCAATTCA
1151   TCAAAAGCCA TTGGCTGATT ACCGCCGTTT TCCGTATGCT GGTTTTGGCG
1201   TGGGTCTATT TCGGCGCGGT TGCCAATGTG CCTTTGGTCT GGGATATGGC
1251   GGATATGGCG ATGGGCATTA TGGCGTGGAT CAACCTTGTC GCCATCCTGC
1301   TGCTCTCGCC CTTGGCGTTT ATGCTGCTGC GCGATTACAC CGCCAAGCTG
1351   AAAATGGGCA AAGACCCCGA GTTCAAACTT TCCGAACATC CGGGCCTGAA
1401   ACGCCGTATC AAATCCGACG TTTGGTAA
```

This corresponds to the amino acid sequence <SEQ ID 1416; ORF 513.a>:

```
a513.pep
   1   MNENFTEWLH GWVGAINDPM WSYLVYXLLG TGLFFTVTTG FVQFRLFGRS
  51   IKEMLGGRKQ GDDPHGITPF QAFVTGLASR VGVGNIAGVA IAIKVGGPGA
 101   VFWMWVTALI GMSSAFVESS LAQLFKVRDY DNHHFRGGPA YYITQGLGQK
 151   WLGVLFALSL IFCFGFVFEA VQTNTIADTV KAAWGWEPHY VGVALVILTA
 201   PIIFGGIRRI SKAAEIVVPL MAVLYLFIAL FIILTNIPMI PDVFGQIFSG
 251   AFKFDAAGG  LLGGLISQTM MMGIKRGLYS NEAGMGSAPN AAAAAEVKHP
 301   VSQGMIQMLG VFVDTIIVCS CTAFIILIYQ QPYGDLSGAA LTQAAIVSQV
 351   GQWGAGFLAV ILFMFAFSTV IGNYAYAESN VQFIKSHWLI TAVFRMLVLA
 401   WVYFGAVANV PLVWDMADMA MGIMAWINLV AILLLSPLAF MLLRDYTAKL
 451   KMGKDPEFKL SEHPGLKRRI KSDVW*
``` m513/a513 100.0% identity in 191 aa overlap

```
                             10        20        30
m513.pep            MGSAPNAAAAAEVKHPVSQGMIQMLGVFVD
                    |||||||||||||||||||||||||||||
a513    DAAAGGLLGGLISQTMMMGIKRGLYSNEAGMGSAPNAAAAAEVKHPVSQGMIQMLGVFVD
            260       270       280       290       300       310

40        50        60        70        80        90
m513.pep    TIIVCSCTAFIILIYQQPYGDLSGAALTQAAIVSQVGQWGAGFLAVILFMFAFSTVIGNY
            ||||||||||||||||||||||||||||||||||||||||||||||||||||||||||||
a513        TIIVCSCTAFIILIYQQPYGDLSGAALTQAAIVSQVGQWGAGFLAVILFMFAFSTVIGNY
            320       330       340       350       360       370

100       110       120       130       140       150
m513.pep    AYAESNVQFIKSHWLITAVFRMLVLAWVYFGAVANVPLVWDMADMAMGIMAWINLVAILL
            ||||||||||||||||||||||||||||||||||||||||||||||||||||||||||||
a513        AYAESNVQFIKSHWLITAVFRMLVLAWVYFGAVANVPLVWDMADMAMGIMAWINLVAILL
            380       390       400       410       420       430

160       170       180       190
m513.pep    LSPLAFMLLRDYTAKLKMGKDPEFKLSEHPGLKRRIKSDVWX
            |||||||||||||||||||||||||||||||||||||||||
a513        LSPLAFMLLRDYTAKLKMGKDPEFKLSEHPGLKRRIKSDVWX
            440       450       460       470
```

The following partial DNA sequence was identified in *N. gonorrhoeae* <SEQ ID 1417>:

```
g515.seq
    1 atggttcaaa tacaggttgt gcgcgccgcc ggcgttgccc gtggtctgca 51 ttccgagttt gcgcgcgctg taactgccga ggaaatagcc ttcgacaatg 101 ccgttttgaa tcacgaagcg cggcgcggtg caacaccttc cgcatcaaa 151 atagctgctg cggaaagagc gggggatgtg cggttcttcg cgcaggttga 201 ggaaatcggg caggactttt ttgccgatgc tgtcgatcag gaaactgctt 251 tggcggtaga gcgcgccgcc ggagagtgtg ccgacgaggt gtccgatcag 301 cccgcccgaa acggtggtat cgaagaggac ggggtagctg cctgtcggga 351 tgctgcggct gccgagtcgg cgcaaagtgc ggcgggcggc ggtttgaccg 401 atggtttcgg ggctgtccat atccggatgc cggcaggcgg aatcgtacca 451 gtagtcgcgc tgcattccgt tttcgtcggc ggcgacgacg ctgcaggaaa 501 tgctgtggtg cgtgctttgc cggtgtgcgg caaaaccgtg ggtgttgccg 551 taaacgtatt ggtactgtcc ggtttgcacc gccgcgcctt cggagttttc 601 gatgcggctg tccgtgtcca acgctgcctg ttcgcattgt tttgccaagc 651 cgacggcggc ttccgtatcc aaatcccatt cgtggtaaag gtcggggtcg 701 ccgatgtgtt gcgccatcaa ctcggggtcg gcaagtccgg cgcaaccgtc 751 ttcggcggtg tggcgggcga tgtcggcggc ggcgcggacg gtgtcgcgca 801 gggcttgttc ggagaagtcg gcggtgccgg cgcggccttt gcgtttgccg 851 acgtaaacgg taatgtccag cgatttgtcc tgctggaact cgatttgttc 901 gatttcgccc aagcgcacgc tgacgctttg tccgagcgat tgctgaagt 951 cggcttcggc ggcggtcgcg cccgctgctt ttgccaagtc gagcgtgcgg 1001 cggcagaggt cgaggagttc ggaagcggtg tggttgaaca gcataacaat 1051 ctttcttggt ggagcgttgt ggcatttttaa
```

This corresponds to the amino acid sequence <SEQ ID 1418; ORF 515.ng>:

g515.pep
1 MVQIQVVRAA GVARGLHSEF ARAVTAEEIA FDNAVLNHEA RRGGNTFRIK

51 IAAAERAGDV RFFAQVEEIG QDFFADAVDQ ETALAVERAA GECADEVSDQ

101 PARNGGIEED GVAACRDAAA AESAQSAAGG GLTDGFGAVH IRMAAGGIVP

151 VVALHSVFVG GDDAAGNAVV RALPVCGKTV GVAVNVLVLS GLHRRAFGVF

201 DAAVRVQRCL FALFCQADGG FRIQIPFVVK VGVADVLRHQ LGVGKSGATV

251 FGGVAGDVGG GADGVAQGLF GEVGGAGAAF AFADVNGNVQ RFVLLELDLF

301 DFAQAHADAL SERFAEVGFG GGRARCFCQV ERAAAEVEEF GSGVVEQHNN

351 LSWWSVVAF*

The following partial DNA sequence was identified in *N. meningitidis* <SEQ ID 1419>:

m515.seq (partial)
1 ..GGAAAGAGCG GGGGATGTGC GTTCTTCGCG CAGGTTGAGG AAATCGGGCA

51 GGACTTTTCT GCCGATGCTG TCGATCAGGA AACTGCTTTG GCGGTAGAGC

101 GCGCCGCCGG AGAGTGCGCC GACGAGGTGT CCGATAAGAC CGCCCGAAAC

151 GGTGGTATCG AAGAGGACGG GGTAGCTGCC TGTCGGGATG CTGCGGCTGC

201 CGAGTCGGCG CAAAGTGCGG CGGGCGGCGG TTTGACCGAT GGTTTCGGGG

251 CTGTCCATAT CCGGATGGCG GCAGGCGGAA TCGTACCAGT AGTCGCGCTG

301 CATGCCGTTT TCGTCGGCGG CAACGACGCT GCAGGAAATG CTGTGGTGCG

351 TGCCTTGCCG GTGTGCGGCA AAACCGTGGG TGTTGCCGTA AACGTATTGG

401 TAATGGCCGG TTTGCACCGC CGCGCCTTCG GAGTTTTCGA TGCGCTCATC

451 CTCGTTCAGG GCGGCTTGTT CGCATTGTTT TGCCAAGCCG ACGGCGGCTk

501 CCGTATCCAA ATCCCATTCG TGGTAAAGGT CGGGGTCGCC GATGTGTTTT

551 GCCATCAGAC AGGCATCGGC AAGTCCGGCG CAACCGTCTT CGGCGGTGTG

601 GCGGGCGATG TCGATGGCGG CTTTGACGGT GTCTTGCAGG GCTTTTTCGG

651 AGAAGTCGGC AGTACTGGCG CGGCCTTTGC GTTTGCCGAC GTAAACGGTA

701 ATGTCCAGCG ACTTGTCCTG CTGGAACTCG ATTTGTTsGA TTTsGCCCAG

751 CCGCACGCTG ACGCTTTGTC CCAATGATTC GCTGAAATCG GCTTCGGCGG

801 CGGTTGCGCC CGTCGCTTTT GCCAAGTCGA GCGTGCGGCG GCAGAGGTCG

851 AGGAGTTCGG AAGCGGTGTG GTTgAACAGC ATAGAAATCT TTCTTGATGA

901 TGCTTTGCGG CATTTTAA

This corresponds to the amino acid sequence <SEQ ID 1420; ORF 515>:

m515.pep (partial)
1 ..GKSGGCAFFA QVEEIGQDFS ADAVDQETAL AVERAAGECA DEVSDKTARN

51 GGIEEDGVAA CRDAAAAESA QSAAGGGLTD GFGAVHIRMA AGGIVPVVAL

101 HAVFVGGNDA AGNAVVRALP VCGKTVGVAV NVLVMAGLHR RAFGVFDALI

151 LVQGGLFALF CQADGGXRIQ IPFVVKVGVA DVFCHQTGIG KSGATVFGGV

201 AGDVDGGFDG VLQGFFGEVG STGAAFAFAD VNGNVQRLVL LELDLXDXAQ

251 PHADALSQXF AEIGFGGGCA RRFCQVERAA AEVEEFGSGV VEQHRNLSXX

301 CFAAF*

Computer analysis of this amino acid sequence gave the following results:
Homology with a Predicted ORF from N. gonorrhoeae
ORF 515 shows 85.9% identity over a 304 aa overlap with a predicted ORF (ORF 515.ng) from N. gonorrhoeae:

```
m515/g515
                                                      10        20        30
    m515.pep                                  GKSGGCAFFAQVEEIGQDFSADAVDQETALA
                                              ::|  |||||||||||| |||||||||||
    g515     AEEIAFDNAVLNHEARCGGNAFRIKIAAAERAGDVRFFAQVEEIGQDFFADAVDQETALA
                 30        40        50        60        70        80
                     40        50        60        70        80        90
    m515.pep  VERAAGECADEVSDKTARNGGIEEDGVAACRDAAAAESAQSAAGGGLTDGFGAVHIRMAA
              |||||||||||||:||||||||||||||||||||||||||||||||||||||||||||
    g515      VERAAGECADEVSDQPARNGGIEEDGVAACRDAAAAESAQSAAGGGLTDGFGAVHIRMAA
                     90       100       110       120       130       140
                    100       110       120       130       140       150
    m515.pep  GGIVPVVALHAVFVGGNDAAGNAVVRALPVCGKTVGVAVNVLVMAGLHRRAFGVFDALIL
              |||||||||:|||| :|||||||||||||||||||||||||| ::||||||||||  :
    g515      GGIVPVVALHSVFVGGDDAAGNAVVRALPVCGKTVGVAVNVLVLSGLHRRAFGVFDAAVR
                    150       160       170       180       190       200
                    160       170       180       190       200       210
    m515.pep  VQGGLFALFCQADGGXRIQIPFVVKVGVADVFCHQTGIGKSGATVFGGVAGDVDGGFDGV
              ||  ||||||||||| ||||||||||||||: ||  |:||||||||||||||||  |||
    g515      VQRCLFALFCQADGGFRIQIPFVVKVGVADVLRHQLGVGKSGATVFGGVAGDVGGGADGV
                    210       220       230       240       250       260
                    220       230       240       250       260       270
    m515.pep  LQGFFGEVGSTGAAFAFADVNGNVQRLVLLELDLXDXAQPHADALSQXFAEIGFGGCAR
              || :||||::||||||||||||||||:|||||| | || |||||: |||:|||||  ||
    g515      AQGLFGEVGGAGAAFAFADVNGNVQRFVLLELDLFDFAQAHADALSERFAEVGFGGGRAR
                    270       280       290       300       310       320
                    280       290       300
    m515.pep  RFCQVERAAAEVEEFGSGVVEQHRNLSXXCFAAF
               ||||||||||||||||||||||| |||   :||
    g515      CFCQVERAAAEVEEFGSGVVEQHNNLSWWSVVAF
                    330       340       350
```

The following partial DNA sequence was identified in N. meningitidis <SEQ ID 1421>:

```
a515.seq
     1    ATGGTTCAAA TAAAGGTTGT GCGCGCCGCC GGCGTTGCCC GTGGTCTGCA

51    TTCCGAGTTT GCGCGCGCTG TAACTGCTGA GGAAATAGCC TTCGACAATG

101    CCGTTTTGAA TCACGAAGCG CGGTGCGGTG GCAACGCCTT CCGCATCAAA

151    ATAGCTGCTG CGGAAAGAGC GGGGGATGTG CGGTTCTTCG CGCAGGTTGA

201    GGAAATCGGG CAGGACTTTT TTGCCGATGC TGTCGATCAG GAAACTGCTT

251    TGGCGGTAGA GCGCTCCGCC GGAGAGTGCG CCGACGAGGT GTCCGATAAG

301    ACCGCCCGAA ACGGTGGTAT CGAAGAGGAC GGGGTAGTTG CCTGTCGGGA

351    TGCTGCGGCT GCCGAGTCGG CGCAAAGTGC GGCGGGCGGC GGTTTGACCG

401    ATGGTTTCGG GGCTGTCCAT ATCCGGATGG CGGCAGGCGG AATCGTACCA

451    GTAGTCGCGC TGCATGCCGT TTTCGTCGGC GGCAACGACG CTGCAGGAAA

501    TGCTGTGGTG CGTGCTTTGC CGGTGTGCGG CAAAACCGTA GGTGTTGCCG

551    TAAACGTATT GGTAATGGCC GGTTTGCACC GCCGCGCCTT CGGAGTTTTC

601    GATGCGCTCA TCCTCGTTCA GGGCGGCTTG TTCGCATTGT TTTGCCAAGC

651    CGACGGCGGC TTCCGTATCC AAATCCCATT CGTGGTAAAG GTCGGGGTCG

701    CCGATGTGTT GCGCCATCAA CTCGGGGTCG GCAAGTCCGG CGCAACCGTC

751    TTCGGCGGTG TGGCGGGCGA TGTCNNNNGC GGCGCGGACG GTGTCGCGCA

801    GGGCTTGTTC GGAGAAATCG GCGGTGCCGG CGCGGCCTTT GCGTTTGCCG
```

-continued
```
 851   ACGTAAACGG TAATGTCCAG CGACTTGTCC TGCTGAAACT CGATTTGTTC

901   GATTTCGCCC AGCCGCACGC TGACGCTTTG TCCCAATGAT TCGCTGAAAT

951   CGGCTTCGGC GGCGGTTGCG CCCGTCGCTT TTGCCAAGTC GAGCGTGCGG

1001   CGGCAGAGGT CGAGGAGTTC GGAAGCGGTG TGGTTGAACA GCATAGAAAT

1051   CTTTCTTGAT GATGCTTTGC GGCATTTTAA
```

This corresponds to the amino acid sequence <SEQ ID 1422; ORF 515.a>:

```
a515.pep
   1   MVQIKVVRAA GVARGLHSEF ARAVTAEEIA FDNAVLNHEA RCGGNAFRIK

51   IAAAERAGDV RFFAQVEEIG QDFFADAVDQ ETALAVERSA GECADEVSDK

101   TARNGGIEED GVVACRDAAA AESAQSAAGG GLTDGFGAVH IRMAAGGIVP

151   VVALHAVFVG GNDAAGNAVV RALPVCGKTV GVAVNVLVMA GLHRRAFGVF

201   DALILVQGGL FALFCQADGG FRIQIPFVVK VGVADVLRHQ LGVGKSGATV

251   FGGVAGDVXX GADGVAQGLF GEIGGAGAAF AFADVNGNVQ RLVLLKLDLF

301   DFAQPHADAL SQ*FAEIGFG GGCARRFCQV ERAAAEVEEF GSGVVEQHRN

351   LS**CFAAF*
``` m515/a515 92.1% identity in 304 aa overlap

```
                             10        20        30
 m515.pep             GKSGGCAFFAQVEEIGQDFSADAVDQETALA
                    ::|  ||||||||||| |||||||||||
 a515     AEEIAFDNAVLNHEARCGGNAFRIKIAAAERAGDVRFFAQVEEIGQDFFADAVDQETALA
             30        40        50        60        70        80
                 40        50        60        70        80        90
 m515.pep   VERAAGECADEVSDKTARNGGIEEDGVAACRDAAAAESAQSAAGGGLTDGFGAVHIRMAA
            |||:||||||||||||||||||||||||:||||||||||||||||||||||||||||||
 a515       VERSAGECADEVSDKTARNGGIEEDGVVACRDAAAAESAQSAAGGGLTDGFGAVHIRMAA
             90       100       110       120       130       140
                    100       110       120       130       140       150
 m515.pep   GGIVPVVALHAVFVGGNDAAGNAVVRALPVCGKTVGVAVNVLVMAGLHRRAFGVFDALIL
            ||||||||||||||||||||||||||||||||||||||||||||||||||||||||||||
 a515       GGIVPVVALHAVFVGGNDAAGNAVVRALPVCGKTVGVAVNVLVMAGLHRRAFGVFDALIL
                   150       160       170       180       190       200
                    160       170       180       190       200       210
 m515.pep   VQGGLFALFCQADGGXRIQIPFVVKVGVADVFCHQTGIGKSGATVFGGVAGDVDGGFDGV
            ||||||||||||||||:||||||||||||||||:  || :|||||||||||||||  |||
 a515       VQGGLFALFCQADGGFRIQIPFVVKVGVADVLRHQLGVGKSGATVFGGVAGDVXXGADGV
                   210       220       230       240       250       260
                    220       230       240       250       260       270
 m515.pep   LQGFFGEVGSTGAAFAFADVNGNVQRLVLLELDLXDXAQPHADALSQXFAEIGFGGGCAR
            | :|||:|::||||||||||||||||||:|||  |  ||||||||||||||||||||||
 a515       AQGLFGEIGGAGAAFAFADVNGNVQRLVLLKLDLFDFAQPHADALSQXFAEIGFGGGCAR
                   270       280       290       300       310       320
                    280       290       300
 m515.pep   RFCQVERAAAEVEEFGSGVVEQHRNLSXXCFAAFX
            ||||||||||||||||||||||||||||||||||
 a515       RFCQVERAAAEVEEFGSGVVEQHRNLSXXCFAAFX
                   330       340       350       360
```

The following partial DNA sequence was identified in *N. gonorrhoeae* <SEQ ID 1423>:

```
g515-1.seq
    1   ATGGTTCAAA TACAGGTTGT GCGCGCCGCC GGCGTTGCCC GTGGTCTGCA

51   TTCCGAGTTT GCGCGCGCTG TAACTGCCGA GGAAATAGCC TTCGACAATG

101   CCGTTTTGAA TCACGAAGCG CGGCGCGGTG GCAACACCTT CCGCATCAAA
```

-continued

```
 151    ATAGCTGCTG CGGAAAGAGC GGGGGATGTG CGGTTCTTCG CGCAGGTTGA

201    GGAAATCGGG CAGGACTTTT TTGCCGATGC TGTCGATCAG GAAACTGCTT

251    TGGCGGTAGA GCGCGCCGCC GGAGAGTGTG CCGACGAGGT GTCCGATCAG

301    CCCGCCCGAA ACGGTGGTAT CGAAGAGGAC GGGGTAGCTG CCTGTCGGGA

351    TGCTGCGGCT GCCGAGTCGG CGCAAAGTGC GGCGGGCGGC GGTTTGACCG

401    ATGGTTTCGG GGCTGTCCAT ATCCGGATGG CGGCAGGCGG AATCGTACCA

451    GTAGTCGCGC TGCATTCCGT TTTCGTCGGC GGCAACGACG CTGCAGGAAA

501    TGCTGTGGTG CGTGCTTTGC CGGTGTGCGG CAAAACCGTG GGTGTTGCCG

551    TAAACGTATT GGTAGTGTCC GGTTTGCACC GCCGCGCCTT CGGAGTTTTC

601    GATGCGGCTG TCCGTGTCCA ACGCTGCCTG TTCGCATTGT TTTGCCAAGC

651    CGACGGCGGC TTCCGTATCC AAATCCCATT CGTGGTAAAG GTCGGGGTCG

701    CCGATGTGTT GCGCCATCAA CTCGGGGTCG GCAAGTCCGG CGCAACCGTC

751    TTCGGCGGTG TGGCGGGCGA TGTCGGCGGC GGCGCGGACG GTGTCGCGCA

801    GGGCTTGTTC GGAGAAGTCG GCGGTGCCGG CGCGGCCTTT GCGTTTGCCG

851    ACGTAAACGG TAATGTCCAG CGATTTGTCC TGCTGGAACT CGATTTGTTC

901    GATTTCGCCC AAGCGCACGC TGACGCTTTG TCCGAGCGAT TCGCTGAAGT

951    CGGCTTCGGC GGCGGTCGCG CCCGCTGCTT TTGCCAAGTC GAGCGTGCGG

1001    CGGCAGAGGT CGAGGAGTTC GGAAGCGGTG TGGTTGAACA GCATAACAAT

1051    CTTTCTTGGT GGAGCGTTGT GGCATTTTAA
```

This corresponds to the amino acid sequence <SEQ ID 1424; ORF 515-1.ng>:

```
g515-1.pep
   1    MVQIQVVRAA GVARGLHSEF ARAVTAEEIA FDNAVLNHEA RRGGNTFRIK

51    IAAAERAGDV RFFAQVEEIG QDFFADAVDQ ETALAVERAA GECADEVSDQ

101    PARNGGIEED GVAACRDAAA AESAQSAAGG GLTDGFGAVH IRMAAGGIVP

151    VVALHSVFVG GNDAAGNAVV RALPVCGKTV GVAVNVLVVS GLHRRAFGVF

201    DAAVRVQRCL FALFCQADGG FRIQIPFVVK VGVADVLRHQ LGVGKSGATV

251    FGGVAGDVGG GADGVAQGLF GEVGGAGAAF AFADVNGNVQ RFVLLELDLF

301    DFAQAHADAL SERFAEVGFG GGRARCFCQV ERAAAEVEEF GSGVVEQHNN

351    LSWWSVVAF*
```

50
The following partial DNA sequence was identified in *N. meningitidis* <SEQ ID 1425>:

```
m515-1.seq
   1    ATGGTTCAAA TACAGGTTGT GCGCGCCGCC GGCGTTGCCC GTGGTCTGCA

51    TACCGAGTTT GCGCGCGCTG TAACTGCTGA GGAAATAGCC TTCGACAATG

101    CCGTTTTGAA TCACGAAGCG CGGTGCGGTG GCAACGCCTT CCGCATCAAA

151    ATAGCTGCTG CGGAAAGAGC GGGGGATGTG CGGTTCTTCG CGCAGGTTGA

201    GGAAATCGGG CAGGACTTTT TTGCCGATGC TGTCGATCAG GAAACTGCTT

251    TGGCGGTAGA GCGCGCCGCC GGAGAGTGCG CCGACGAGGT GTCCGATAAG

301    ACCGCCCGAA ACGGTGGTAT CGAAGAGGAC GGGGTAGCTG CCTGTCGGGA
```

```
-continued
351   TGCTGCGGCT GCCGAGTCGG CGCAAAGTGC GGCGGGCGGC GGTTTGACCG

401   ATGGTTTCGG GGCTGTCCAT ATCCGGATGG CGGCAGGCGG AATCGTACCA

451   GTAGTCGCGC TGCATGCCGT TTTCGTCGGC GGCAACGACG CTGCAGGAAA

501   TGCTGTGGTG CGTGCCTTGC CGGTGTGCGG CAAAACCGTG GGTGTTGCCG

551   TAAACGTATT GGTAATGGCC GGTTTGCACC GCCGCGCCTT CGGAGTTTTC

601   GATGCGCTCA TCCTCGTTCA GGGCGGCTTG TTCGCATTGT TTTGCCAAGC

651   CGACGGCGGC TTCCGTATCC AAATCCCATT CGTGGTAAAG GTCGGGGTCG

701   CCGATGTGTT TTGCCATCAG ACAGGCATCG GCAAGTCCGG CGCAACCGTC

751   TTCGGCGGTG TGGCGGGCGA TGTCGATGGC GGCTTTGACG GTGTCTTGCA

801   GGGCTTTTTC GGAGAAGTCG GCAGTACTGG CGCGGCCTTT GCGTTTGCCG

851   ACGTAAACGG TAATGTCCAG CGACTTGTCC TGCTGGAACT CGATTTGTTC

901   GATTTCGCCC AGCCGCACGC TGACGCTTTG TCCCAATGA
```

This corresponds to the amino acid sequence <SEQ ID 1426; ORF 515-1>:

```
m515-1.pep
    1   MVQIQVVRAA GVARGLHTEF ARAVTAEEIA FDNAVLNHEA RCGGNAFRIK

51   IAAAERAGDV RFFAQVEEIG QDFFADAVDQ ETALAVERAA GECADEVSDK

101   TARNGGIEED GVAACRDAAA AESAQSAAGG GLTDGFGAVH IRMAAGGIVP

151   VVALHAVFVG GNDAAGNAVV RALPVCGKTV GVAVNVLVMA GLHRRAFGVF

201   DALILVQGGL FALFCQADGG FRIQIPFVVK VGVADVFCHQ TGIGKSGATV

251   FGGVAGDVDG GFDGVLQGFF GEVGSTGAAF AFADVNGNVQ RLVLLELDLF

301   DFAQPHADAL SQ*
``` m515-1/g515-1 91.7% identity in 312 aa overlap

```
                  10        20        30        40        50        60
g515-1.pep  MVQIQVVRAAGVARGLHSEFARAVTAEEIAFDNAVLNHEARRGGNTFRIKIAAAERAGDV
            ||||||||||||||||||:|||||||||||||||||||||||| |||:||||||||||||
m515-1      MVQIQVVRAAGVARGLHTEFARAVTAEEIAFDNAVLNHEARCGGNAFRIKIAAAERAGDV
                  10        20        30        40        50        60

70        80        90       100       110       120
g515-1.pep  RFFAQVEEIGQDFFADAVDQETALAVERAAGECADEVSDQPARNGGIEEDGVAACRDAAA
            ||||||||||||||||||||||||||||||||||||||||: |||||||||||||||||
m515-1      RFFAQVEEIGQDFFADAVDQETALAVERAAGECADEVSDKTARNGGIEEDGVAACRDAAA
                  70        80        90       100       110       120

130       140       150       160       170       180
g515-1.pep  AESAQSAAGGGLTDGFGAVHIRMAAGGIVPVVALHSVFVGGNDAAGNAVVRALPVCGKTV
            ||||||||||||||||||||||||||||||||||||:|||||||||||||||||||||||
m515-1      AESAQSAAGGGLTDGFGAVHIRMAAGGIVPVVALHAVFVGGNDAAGNAVVRALPVCGKTV
                 130       140       150       160       170       180

190       200       210       220       230       240
g515-1.pep  GVAVNVLVSGLHRRAFGVFDAAVRVQRCLFALFCQADGGFRIQIPFVVKVGVADVLRHQ
            ||||||||::|||||||||||| :  ||  |||||||||||||||||||||||||: ||
m515-1      GVAVNVLVMAGLHRRAFGVFDALILVQGGLFALFCQADGGFRIQIPFVVKVGVADVFCHQ
                 190       200       210       220       230       240

250       260       270       280       290       300
g515-1.pep  LGVGKSGATVFGGVAGDVGGGADGVAQGLFGEVGGAGAAFAFADVNGNVQRFVLLILDLF
            |:|||||||||||||||| ||   ||:|||| ::|||||||||||||||||:||||||||
m515-1      TGIGKSGATVFGGVAGDVDGGFDGVLQGFFGEVGSTGAAFAFADVNGNVQRLVLLILDLF
                 250       260       270       280       290       300

310       320       330       340       350       360
g515-1.pep  DFAQAHADALSERFAEVGFGGGRARCFCQVERAAAEVEEFGSGVVEQHNNLSWWSVVAFX
            ||||  ||||| :
m515-1      DFAQPHADALSQX
                 310
```

The following partial DNA sequence was identified in *N. meningitidis* <SEQ ID 1427>:

```
a515-1.seq
     1    ATGGTTCAAA TAAAGGTTGT GCGCGCCGCC GGCGTTGCCC GTGGTCTGCA

51    TTCCGAGTTT GCGCGCGCTG TAACTGCTGA GGAAATAGCC TTCGACAATG

101    CCGTTTTGAA TCACGAAGCG CGGTGCGGTG GCAACGCCTT CCGCATCAAA

151    ATAGCTGCTG CGGAAAGAGC GGGGGATGTG CGGTTCTTCG CGCAGGTTGA

201    GGAAATCGGG CAGGACTTTT TTGCCGATGC TGTCGATCAG GAAACTGCTT

251    TGGCGGTAGA GCGCTCCGCC GGAGAGTGCG CCGACGAGGT GTCCGATAAG

301    ACCGCCCGAA ACGGTGGTAT CGAAGAGGAC GGGGTAGTTG CCTGTCGGGA

351    TGCTGCGGCT GCCGAGTCGG CGCAAAGTGC GGCGGGCGGC GGTTTGACCG

401    ATGGTTTCGG GGCTGTCCAT ATCCGGATGG CGGCAGGCGG AATCGTACCA

451    GTAGTCGCGC TGCATGCCGT TTTCGTCGGC GGCAACGACG CTGCAGGAAA

501    TGCTGTGGTG CGTGCTTTGC CGGTGTGCGG CAAAACCGTA GGTGTTGCCG

551    TAAACGTATT GGTAATGGCC GGTTTGCACC GCCGCGCCTT CGGAGTTTTC

601    GATGCGCTCA TCCTCGTTCA GGGCGGCTTG TTCGCATTGT TTTGCCAAGC

651    CGACGGCGGC TTCCGTATCC AAATCCCATT CGTGGTAAAG GTCGGGGTCG

701    CCGATGTGTT GCGCCATCAA CTCGGGGTCG GCAAGTCCGG CGCAACCGTC

751    TTCGGCGGTG TGGCGGGCGA TGTCGGCGGC GGCGCGGACG GTGTCGCGCA

801    GGGCTTGTTC GGAGAAATCG GCGGTGCCGG CGCGGCCTTT GCGTTTGCCG

851    ACGTAAACGG TAATGTCCAG CGACTTGTCC TGCTGAAACT CGATTTGTTC

901    GATTTCGCCC AGCCGCACGC TGACGCTTTG TCCCAATGA
```

This corresponds to the amino acid sequence <SEQ ID 1428; ORF 515-1.a>:

```
a515-1.pep
     1    MVQIKVVRAA GVARGLHSEF ARAVTAEEIA FDNAVLNHEA RCGGNAFRIK

51    IAAAERAGDV RFFAQVEEIG QDFFADAVDQ ETALAVERSA GECADEVSDK

101    TARNGGIEED GVVACRDAAA AESAQSAAGG GLTDGFGAVH IRMAAGGIVP

151    VVALHAVFVG GNDAAGNAVV RALPVCGKTV GVAVNVLVMA GLHRRAFGVF

201    DALILVQGGL FALFCQADGG FRIQIPFVVK VGVADVLRHQ LGVGKSGATV

251    FGGVAGDVGG GADGVAQGLF GEIGGAGAAF AFADVNGNVQ RLVLLKLDLF

301    DFAQPHADAL SQ*
``` m515-1/a515-1 94.9% identity in 312 aa overlap

```
                    10        20        30        40        50        60
a515-1.pep  MVQIKVVRAAGVARGLHSEFARAVTAEEIAFDNAVLNHEARRGGNTFRIKIAAAERAGDV
            ||||:||||||||||||:||||||||||||||||||||||||||||||||||||||||||
m515-1      MVQIQVVRAAGVARGLHTEFARAVTAEEIAFDNAVLNHEARRGGNTFRIKIAAAERAGDV
                    10        20        30        40        50        60

70        80        90       100       110       120
a515-1.pep  RFFAQVEEIGQDFFADAVDQETALAVERSAGECADEVSDKTARNGGIEEDGVVACRDAAA
            ||||||||||||||||||||||||||||:|||||||||||||||||||||||:|||||||
m515-1      RFFAQVEEIGQDFFADAVDQETALAVERAAGECADEVSDKTARNGGIEEDGVAACRDAAA
                    70        80        90       100       110       120
```

```
                130       140       150       160       170       180
a515-1.pep  AESAQSAAGGGLTDGFGAVHIRMAAGGIVPVVALHAVFVGGNDAAGNAVVRALPVCGKTV
            ||||||||||||||||||||||||||||||||||||||||||||||||||||||||||||
m515-1      AESAQSAAGGGLTDGFGAVHIRMAAGGIVPVVALHAVFVGGNDAAGNAVVRALPVCGKTV
                130       140       150       160       170       180

190       200       210       220       230       240
a515-1.pep  GVAVNVLVMAGLHRRAFGVFDALILVQGGLFALFCQADGGFRIQIPFVVKVGVADVLRHQ
            |||||||||||||||||||||||||||||||||||||||||||||||||||||||:  ||
m515-1      GVAVNVLVMAGLHRRAFGVFDALILVQGGLFALFCQADGGFRIQIPFVVKVGVADVFCHQ
                190       200       210       220       230       240

250       260       270       280       290       300
a515-1.pep  LGVGKSGATVFGGVAGDVGGGADGVAQGLFGEIGGAGAAFAFADVNGNVQRLVLLKLDLF
            |:||||||||||||||| |||  ||:|||:|::||||||||||||||||||||||:||||
m515-1      TGIGKSGATVFGGVAGDVDGGFDGVLQGFFGEVGSTGAAFAFADVNGNVQRLVLLELDLF
                250       260       270       280       290       300

310
a515-1.pep  DFAQPHADALSQX
            |||||||||||||
m515-1      DFAQPHADALSQX
                310
```

The following partial DNA sequence was identified in *N. gonorrhoeae* <SEQ ID 1429>:

```
g516.seq
    1  atgttgttcc gtaaaacgac cgccgccgtt ttggcggcaa ccttgatact 51  gaacggctgt acgatgatgt tgcgggggat gaacaacccg gtcagccaaa 101  caatcacccg caaacacgtt gacaaagacc aaatccgcgc cttcggtgtg 151  gttgccgaag acaatgccca attggaaaag ggcagcctgg tgatgatggg 201  cgggaaatac tggttcgccg tcaatcccga agattcggcg aagctgacgg 251  gccttttgaa ggccggggttg gacaagcccct tccaaatagt tgaggatacc 301  ccgagctatg cccgccacca agccctgccg gtcaaattcg aagcgcccgg 351  cagccagaat ttcagtaccg gaggtctttg cctgcgctat gataccggca 401  gacctgacga catcgccaag ctgaaacagc ttgagtttaa agcggtcaaa 451  ctcgacaatc ggaccattta cacgcgctgc gtatccgcca aaggcaaata 501  ctacgccacg ccgcaaaaac tgaacgccga ttatcatttt gagcaaagtg 551  tgcccgccga tatttattat acggttactg aaaaacatac cgacaaatcc 601  aagctgtttg gaaatatctt atatacgccc cccttgttga tattggatgc 651  ggcggccgcg gtgctggtct tgcctatggc tctgattgca gccgcgaatt 701  cctcagacaa atga
```

This corresponds to the amino acid sequence <SEQ ID 1430; ORF 516.ng>:

```
g516.pep
    1  MLFRKTTAAV LAATLILNGC TMMLRGMNNP VSQTITRKHV DKDQIRAFGV

51  VAEDNAQLEK GSLVMMGGKY WFAVNPEDSA KLTGLLKAGL DKPFQIVEDT

101  PSYARHQALP VKFEAPGSQN FSTGGLCLRY DTGRPDDIAK LKQLEFKAVK

151  LDNRTIYTRC VSAKGKYYAT PQKLNADYHF EQSVPADIYY TVTEKHTDKS

201  KLFGNILYTP PLLILDAAAA VLVLPMALIA AANSSDK*
```

The following partial DNA sequence was identified in *N. meningitidis* <SEQ ID 1431>:

```
m516.seq
    1   ATGTTGTTCC GTAAAACGAC CGCCGCCGTT TTGGCGGCAA CCTTGATGCT

51   GAACGGCTGT ACGTTGATGT TGTGGGGAAT GAACAACCCG GTCAGCGAAA

101   CAATCACCCG CAAACACGTT GACAAAGACC AAATCCGCGC CTTCGGTGTG

151   GTTGCCGAAG ACAATGCCCA ATTGGAAAAG GGCAGCCTGG TGATGATGGG

201   CGGAAAATAC TGGTTCGTCG TCAATCCCGA AGATTCGGCG AAGCTGACGG

251   GCATTTTGAA GGCAGGGCTG GACAAACCCT TCCAAATAGT TGAGGATACC

301   CCGAGCTATG CTCGCCACCA AGCCCTGCCG GTCAAACTCG AATCGCCTGG

351   CAGCCAGAAT TTCAGTACCG AAGGCCTTTG CCTGCGCTAC GATACCGACA

401   AGCCTGCCGA CATCGCCAAG CTGAAACAGC TCGGGTTTGA AGCGGTCAAA

451   CTCGACAATC GGACCATTTA CACGCGCTGC GTATCCGCCA AAGGCAAATA

501   CTACGCCACA CCGCAAAAAC TGAACGCCGA TTACCATTTT GAGCAAAGTG

551   TGCCTGCCGA TATTTATTAC ACGGTTACTG AAGAACATAC CGACAAATCC

601   AAGCTGTTTG CAAATATCTT ATATACGCCC CCCTTTTTGA TACTGGATGC

651   GGCGGGCGCG GTACTGGCCT TGCCTGCGGC GGCTCTGGGT GCGGTCGTGG

701   ATGCCGCCCG CAAATGA
```

This corresponds to the amino acid sequence <SEQ ID 1432; ORF 516>:

```
m516.pep
    1   MLFRKTTAAV LAATLMLNGC TLMLWGMNNP VSETITRKHV DKDQIRAFGV

51   VAEDNAQLEK GSLVMMGGKY WFVVNPEDSA KLTGILKAGL DKPFQIVEDT

101   PSYARHQALP VKLESPGSQN FSTEGLCLRY DTDKPADIAK LKQLGFEAVK

151   LDNRTIYTRC VSAKGKYYAT PQKLNADYHF EQSVPADIYY TVTEEHTDKS

201   KLFANILYTP PFLILDAAGA VLALPAAALG AVVDAARK*
```

Computer analysis of this amino acid sequence gave the following results:
Homology with a Predicted ORF from *N. gonorrhoeae*
ORF 516 shows 90.0% identity over a 231 aa overlap with a predicted ORF (ORF 516.ng) from *N. gonorrhoeae*:

```
    m516/g516
                        10         20         30         40         50         60
       m516.pep MLFRKTTAAVLAATLMLNGCTLMLWGMNNPVSETITRKHVDKDQIRAFGVVAEDNAQLEK
                ||||||||||||||||:|||||:||  |||||||:|||||||||||||||||||||||||
          g516 MLFRKTTAAVLAATLILNGCTMMLRGMNNPVSQTITRKHVDKDQIRAFGVVAEDNAQLEK
                        10         20         30         40         50         60

70         80         90        100        110        120
       m516.pep GSLVMMGGKYWFVVNPEDSAKLTGILKAGLDKPFQIVEDTPSYARHQALPVKLESPGSQN
                ||||||||||||:|||||||||||:|||||||||||||||||||||||||||::||||||
          g516 GSLVMMGGKYWFAVNPEDSAKLTGLLKAGLDKPFQIVEDTPSYARHQALPVKFEAPGSQN
                        70         80         90        100        110        120

130        140        150        160        170        180
       m516.pep FSTEGLCLRYDTDKPADIAKLKQLGFEAVKLDNRTIYTRCVSAKGKYYATPQKLNADYHF
                |||  |||||||| :| |||||||:|:||||||||||||||||||||||||||||||||
          g516 FSTGGLCLRYDTGRPDDIAKLKQLEFKAVKLDNRTIYTRCVSAKGKYYATPQKLNADYHF
                       130        140        150        160        170        180

190        200        210        220        230    239
       m516.pep EQSVPADIYYTVTEEHTDKSKLFANILYTPPFLILDAAGAVLALPAAALGAVVDAARK
                |||||||||||||:|||||||||:|||||||:|||||||:|| |  ::|:
          g516 EQSVPADIYYTVTEKHTDKSKLFGNILYTPPLLILDAAAAVLVLPMALIAAANSSDK
                       190        200        210        220        230
```

The following partial DNA sequence was identified in *N. meningitidis* <SEQ ID 1433>:

```
a516.seq
    1  ATGTTGTTCC GTAAAACGAC CGCCGCCGTT TTGGCGGCAA CCTTGATGTT

51  GAACGGCTGT ACGGTAATGA TGTGGGGTAT GAACAGCCCG TTCAGCGAAA

101  CGACCGCCCG CAAACACGTT GACAAGGACC AAATCCGCGC CTTCGGTGTG

151  GTTGCCGAAG ACAATGCCCA ATTGGAAAAG GGCAGCCTGG TGATGATGGG

201  CGGGAAATAC TGGTTCGTCG TCAATCCTGA AGATTCGGCG AAGCTGACGG

251  GCATTTTGAA GGCCGGGTTG GACAAGCAGT TTCAAATGGT TGAGCCCAAC

301  CCGCGCTTTG CCTACCAAGC CCTGCCGGTC AAACTCGAAT CGCCCGCCAG

351  CCAGAATTTC AGTACCGAAG GCCTTTGCCT GCGCTACGAT ACCGACAGAC

401  CTGCCGACAT CGCCAAGCTG AAACAGCTTG AGTTTGAAGC GGTCGAACTC

451  GACAATCGGA CCATTTACAC GCGCTGCGTC TCCGCCAAAG GCAAATACTA

501  CGCCACACCG CAAAAACTGA ACGCCGATTA TCATTTTGAG CAAAGTGTGC

551  CTGCCGATAT TTATTACACG GTTACGAAAA AACATACCGA CAAATCCAAG

601  TTGTTTGAAA ATATTGCATA TACGCCCACC ACGTTGATAC TGGATGCGGT

651  GGGCGCGGTG CTGGCCTTGC CTGTCGCGGC GTTGATTGCA GCCACGAATT

701  CCTCAGACAA ATGA
```

This corresponds to the amino acid sequence <SEQ ID 1434; ORF 516.a>:

```
a516.pep
    1  MLFRKTTAAV LAATLMLNGC TVMMWGMNSP FSETTARKHV DKDQIRAFGV

51  VAEDNAQLEK GSLVMMGGKY WFVVNPEDSA KLTGILKAGL DKQFQMVEPN

101  PRFAYQALPV KLESPASQNF STEGLCLRYD TDRPADIAKL KQLEFEAVEL

151  DNRTIYTRCV SAKGKYYATP QKLNADYHFE QSVPADIYYT VTKKHTDKSK

201  LFENIAYTPT TLILDAVGAV LALPVAALIA ATNSSDK*
``` m516/a516 86.1% identity in 238 aa overlap

```
                 10         20         30         40         50         60
    m516.pep  MLFRKTTAAVLAATLMLNGCTLMLWGMNNPVSETITRKHVDKDQIRAFGVVAEDNAQLEK
              ||||||||||||||||||||| :|||| :| ||| :||||||||||||||||||||||||
    a516      MLFRKTTAAVLAATLMLNGCTVMMWGMNSPFSETTARKHVDKDQIRAFGVVAEDNAQLEK
                 10         20         30         40         50         60

70         80         90        100        110        120
    m516.pep  GSLVMMGGKYWFVVNPEDSAKLTGILKAGLDKPFQIVEDTPSYARHQALPVKLESPGSQN
              |||||||||||||||||||||||||||||||| |:|| :| :| :||||||||||:|||
    a516      GSLVMMGGKYWFVVNPEDSAKLTGILKAGLDKQFQMVEPNPRFA-YQALPVKLESPASQN
                 70         80         90        100        110        120

130        140        150        160        170        180
    m516.pep  FSTEGLCLRYDTDKPADIAKLKQLGFEAVKLDNRTIYTRCVSAKGKYYATPQKLNADYHF
              |||||||||||||:|||||||||| |||:|||||||||||||||||||||||||||||||
    a516      FSTEGLCLRYDTDRPADIAKLKQLEFEAVELDNRTIYTRCVSAKGKYYATPQKLNADYHF
                120        130        140        150        160        170

190        200        210        220        230      239
    m516.pep  EQSVPADIYYTVTEEHTDKSKLFANILYTPPFLILDAAGAVLALPAAALGAVVDAARKX
              ||||||||||||::||||||||| ||| |||| |||| |||||||:||| |::::: ||
    a516      EQSVPADIYYTVTKKHTDKSKLFENIAYTPTTLILDAVGAVLALPVAALIAATNSSDKX
                180        190        200        210        220        230
```

The following partial DNA sequence was identified in *N. gonorrhoeae* <SEQ ID 1435>:

```
g517.seq
      1   atgcatcggg tttcagacgg cattggagtg tcagtcgtgt tctgccgatt 51   cgtaggcttc gacgattttt tgcaccagag gatgccggac aacgtcttcg 101   ccggtgaagg tatggaaata cagtcctgcc acgccgtgca gtttctcacg 151   tgcgtctttc aatcccgatt tgatgttttt gggcaggtcg atttggctgg 201   tgtcgccggt aatgacggct tcgcgccga agccgatgcg ggtcaggaac 251   attttcattt gttcgggcgt ggtgttttgc gcttcgtcga ggatgatgta 301   tgcgccgttg agcgtcctgc cgcgcatata ggcgagcggg gcgatttcaa 351   tcaggccttt ttcaatcagc ttggttacac ggtcaaagcc catcaggtca 401   tagagggcat cataaagcgg acggaggtag gggtcgactt tttgggtcag 451   gtctccgggc aggaagccca gtttctcacc ggcttcgacg gcaggccgaa 501   ctaa
```

This corresponds to the amino acid sequence <SEQ ID 1436; ORF 517.ng>:

```
g517.pep
      1   MHRVSDGIGV SVVFCRFVGF DDFLHQRMPD NVFAGEGMEI QSCHAVQFLT

51   CVFQSRFDVF GQVDLAGVAG NDGFRAEADA GQEHFHLFGR GVLRFVEDDV

101   CAVERPAAHI GERGDFNQAF FNQLGYTVKA HQVIEGIIKR TEVGVDFLGQ

151   VSGQEAQFLT GFDGRPN*
```

The following partial DNA sequence was identified in *N. meningitidis* <SEQ ID 1437>:

```
m517.seq
      1   ATGCATCGGG TTTCAGACGG CATTGGAATG TCAGTCGTGT TCTGCCGATT

51   CGTAGGCTTC GACGATTTTT TGCACCAAAG GATGCCGGAC AACGTCTTCG

101   CCGGTAAAGG TGTGGAAATA CAGCCCTTCC ACGTTGTGCA GTTTCTCACG

151   CGCATCTTTT AATCCCGATT TGATGTTTTT GGGCAGGTCG ATTTGGCTGG

201   TGTCGCCGGT AATGACGGCT TCGCGCCGA AGCCGATGCG GGTCAGGAAC

251   ATTTTCATTT GTTCGGGCGT GGTGTTTTGC GCTTCGTCGA GGATGATGTA

301   TGCGCCGTTG AGCGTCCTGC CGCGCATATA GGCGAGCGGG GCGATTTCAA

351   TCAGGCCTTT TTCAATCAGC TTGGTTACAC GGTCAAAGCC CATCAGGTCA

401   TAGAGGGCAT CATAAAGCGG ACGAAGGTAG GGATCGACTT TCTGGGTCAG

451   GTCTCCGGGC AGGAAGCCCA GTTTCTCGCC GGCTTCGACG GCTGgGCGCA

501   CTAA
```

This corresponds to the amino acid sequence <SEQ ID 1438; ORF 517>:

```
m517.pep
      1   MHRVSDGIGM SVVFCRFVGF DDFLHQRMPD NVFAGKGVEI QPFHVVQFLT

51   RIFXSRFDVF GQVDLAGVAG NDGFRAEADA GQEHFHLFGR GVLRFVEDDV

101   CAVERPAAHI GERGDFNQAF FNQLGYTVKA HQVIEGIIKR TKVGIDFLGQ

151   VSGQEAQFLA GFDGWAH*
```

Computer analysis of this amino acid sequence gave the following results:
Homology with a Predicted ORF from *N. gonorrhoeae*
ORF 517 shows 92.7% identity over a 164 aa overlap with a predicted ORF (ORF 517.ng) from *N. gonorrhoeae*:

```
    m517/g517
                    10        20        30        40        50        60
    m517.pep  MHRVSDGIGMSVVFCRFVGFDDFLHQRMPDNVFAGKGVEIQPFHVVQFLTRIFXSRFDVF
              ||||||||:||||||||||||||||||||||||||:|:|||  |:|||||  :|  ||||||
    g517      MHRVSDGIGVSVVFCRFVGFDDFLHQRMPDNVFAGEGMEIQSCHAVQFLTCVFQSRFDVF
                    10        20        30        40        50        60

70        80        90       100       110       120
    m517.pep  GQVDLAGVAGNDGFRAEADAGQEHFHLFGRGVLRFVEDDVCAVERPAAHIGERGDFNQAF
              ||||||||||||||||||||||||||||||||||||||||||||||||||||||||||||
    g517      GQVDLAGVAGNDGFRAEADAGQEHFHLFGRGVLRFVEDDVCAVERPAAHIGERGDFNQAF
                    70        80        90       100       110       120

130       140       150       160
    m517.pep  FNQLGYTVKAHQVIEGIIKRTKVGIDFLGQVSGQEAQFLAGFDGWAH
              ||||||||||||||||||||||:||:|||||||||||||:||  ||||
    g517      FNQLGYTVKAHQVIEGIIKRTEVGVDFLGQVSGQEAQFLTGFDGRPN
                   130       140       150       160
```

The following partial DNA sequence was identified in *N. meningitidis* <SEQ ID 1439>:

```
a517.seq
    1    ATGCATCGGG TTTCAGACGG CATTGGAATG TCAGTCGTGT TCTGCCGATT

51    CGTAGGCTTC GACGATTTTT TGCACCAAAG GATGCCGGAC AACGTCTTCG

101    CCGGTAAAGG TGTGGAAATA CAGCCCTTCC ACGCCGTGCA GTTTCTCACG

151    CGCATCTTTT AATCCCGATT TGATGTTTTT GGGCAGGTCG ATTTGGCTGG

201    TGTCGCCGGT AATGACGGCT TCGCGCCGA AGCCGATGCG GGTCAGGAAC

251    ATTTTCATTT GTTCGGGCGT GGTGTTTTGC GCTTCGTCGA GGATGATGTA

301    TGCGCCGTTG AGCGTCCTGC CGCGCATATA GGCGAGCGGG GCAATCTCAA

351    TCAGACCTTT TTCAATCAGC TTGGTGACAC GGTCGAAGCC CATCAGGTCA

401    TAGAGGGCAT CATAAAGCGG ACGAAGGTAG GGATCGACTT TCTGGGTCAG

451    GTCACCGGGC AGAAAACCCA GTTTCTCGCC GGCTTCGACG GCAGGCCGCA

501    CTAA
```

This corresponds to the amino acid sequence <SEQ ID 1440; ORF 517.a>:

```
a517.pep
    1    MHRVSDGIGM SVVFCRFVGF DDFLHQRMPD NVFAGKGVEI QPFHAVQFLT

51    RIF*SRFDVF GQVDLAGVAG NDGFRAEADA GQEHFHLFGR GVLRFVEDDV

101    CAVERPAAHI GERGNLNQTF FNQLGDTVEA HQVIEGIIKR TKVGIDFLGQ

151    VTGQKTQFLA GFDGRPH*
``` m517/a517 93.4% identity in 167 aa overlap

```
                    10        20        30        40        50        60
    m517.pep  MHRVSDGIGMSVVFCRFVGFDDFLHQRMPDNVFAGKGVEIQPFHVVQFLTRIFXSRFDVF
              ||||||||||||||||||||||||||||||||||||||||||||:|||||||||||||||
    a517      MHRVSDGIGMSVVFCRFVGFDDFLHQRMPDNVFAGKGVEIQPFHAVQFLTRIFXSRFDVF
                    10        20        30        40        50        60
```

```
                   70         80         90        100        110        120
m517.pep  GQVDLAGVAGNDGFRAEADAGQEHFHLFGRGVLRFVEDDVCAVERPAAHIGERGDFNQAF
          |||||||||||||||||||||||||||||||||||||||||||||||||||||::||:|
a517      GQVDLAGVAGNDGFRAEADAGQEHFHLFGRGVLRFVEDDVCAVERPAAHIGERGNLNQTF
                   70         80         90        100        110        120

130        140        150        160
m517.pep  FNQLGYTVKAHQVIEGIIKRTKVGIDFLGQVSGQEAQFLAGFDGWAHX
          |||||  ||:||||||||||||||||||||:||::|||||||  ||
a517      FNQLGDTVEAHQVIEGIIKRTKVGIDFLGQVTGQKTQFLTGFDGRPHX
                  130        140        150        160
```

The following partial DNA sequence was identified in *N. gonorrhoeae* <SEQ ID 1441>:

```
g518.seq
    1  atgacgtttt cggcggcaaa gctcaacatt tcggcactga tgttgtgtct 51  ttcggcagga atgaccgttt tactttccgc ttttttactg ctccgaccgg 101  aaggcagcat cttattcaac catttttca gcataaatat tctgacccga 151  agagcggcat ctccacgggc aaccgtgttc agactgcatc aggcggtacg 201  attccacaag atgccgaaaa ccataagcaa aatgcgtaga aactacgccg 251  tccgaatcac gccgcctcct cgggcggcaa cgcttcatta taacagattg 301  cccttaaaa aatcagaccc tgcttttgtg gcggagtctg aaatttga
```

This corresponds to the amino acid sequence <SEQ ID 1442; ORF 518.ng>:

```
g518.pep
    1  MTFSAAKLNI SALMLCLSAG MTVLLSAFLL LRPEGSILFN HFFSINILTR

51  RAASPRATVF RLHQAVRFHK MPKTISKMRR NYAVRITPPP RAATLHYNRL

101  PLKKSDPAFV AESEI*
```

The following partial DNA sequence was identified in *N. meningitidis* <SEQ ID 1443>:

```
m518.seq
    1  ATGACGTTTT CGGCGGCAAA GCTCAACATT TCGGCACGGA TGTTGTGTCT

51  TTCGGCAGGA ATGACCGTTT TACTTTCCGC TTTTTTACTG CTCCGACCGG

101  AAGGCAGCAT CTTATTCAAC CATTTTTCA GCATAAATAT TCTGACCCGA

151  AGAGCGGCAT CTCCACAGGC AACCGTGTTC AGACGGCATC AGGCGCGGTT

201  TGCAAGATGC CGTACCATAA ACAAAAGGCG TAGAAACTAC GCCGTCCGAA

251  TCACGCCGCC CTCGCG.GCG GCAACGCGTC ATTATAACAG ATTGCCCTCC

301  GCGGCAGGCT TAGTGCGGCG GGAGCGCCGC CGTTGCGCAG TAATATTGTC

351  TAACGGGAGG AAAAAATCAG ACCCTGCTTT TGTGGCAGAG TCTGAAATTT

401  GA
```

This corresponds to the amino acid sequence <SEQ ID 1444; ORF 518>:

```
m518.pep
    1  MTFSAAKLNI SARMLCLSAG MTVLLSAFLL LRPEGSILFN HFFSINILTR

51  RAASPQATVF RRHQARFARC RTINKRRRNY AVRITPPSXA ATRHYNRLPS

101  AAGLVRRERR RCAVILSNGR KKSDPAFVAE SEI*
```

Computer analysis of this amino acid sequence gave the following results:
Homology with a Predicted ORF from *N. gonorrhoeae*
ORF 518 shows 74.1% identity over a 135 aa overlap with a predicted ORF (ORF 518.ng) from *N. gonorrhoeae*:

```
m518/g518 m518.pep   MTFSAAKLNISARMLCLSAGMTVLLSAFLLLRPEGSILFNHFFSINILTRRAASPQATVF
           |||||||||||| |||||||||||||||||||||||||||||||||||||||||||:||||
g518       MTFSAAKLNISALMLCLSAGMTVLLSAFLLLRPEGSILFNHFFSINILTRRAASPRATVF
                    10        20        30        40        50        60

70        80        90       100       110
m518.pep   RRHQA-RFARC-RTINKRRRNYAVRITPPSXAATRHYNRLPSAAGLVRRERRRCAVILSN
           | ||| || :   :||:|  ||| ||||||| |||  ||||||
g518       RLHQAVRFHKMPKTISKMRRNYAVRITPPPRAATLHYNRLPL------------------
                    70        80        90       100

120       130
m518.pep   GRKKSDPAFVAESEI
             |||||||||||||||
g518       --KKSDPAFVAESEI
                    110
```

The following partial DNA sequence was identified in *N. meningitidis* <SEQ ID 1445>:

```
a518.seq
    1   ATGACGTTTT CGGCGGCAAA GCTCAACATT TCGGCACGGA TGTTGTGTCT

51   TTCGGCAGGA ATGACCGTTT TACTTTCCGC TTTTTTACTG CTCCGACCGG

101   AAGGCAGCAT CTTATTCAAC CATTTTTTCA GCATAAATAT TCTAACCCGA

151   AGAGCGGCAT CTCCACGGGC AACCGTGTTC AGACGGCATC AGGCGGTACG

201   ATTCCGCAAG ATGCCGACCA TAAACAAAAG GCGTAGAAAC TACGCCGTCC

251   GAATCACGCC GTCCTCG.CG GCGGCAACGC GTCATTATAA CAGATTGCCC

301   TCC....... .......... .......... .......... ..........

351   .......... ...AAAAAAT CAGACCCTGC TTTTGTGGCA GAGTCTGAAA

401   TTTGA
```

This corresponds to the amino acid sequence <SEQ ID 1446; ORF 518.a>:

```
a518.pep
    1   MTFSAAKLNI SARMLCLSAG MTVLLSAFLL LRPEGSILFN HFFSINILTR

51   RAASPRATVF RRHQAVRFRK MPTINKRRRN YAVRITPSSX AATRHYNRLP

101   S......... .......... .KKSDPAFVA ESEI*
``` m518/a518 79.9% identity in 134 aa overlap

```
                10        20        30        40        50        60
m518.pep   MTFSAAKLNISARMLCLSAGMTVLLSAFLLLRPEGSILFNHFFSINILTRRAASPQATVF
           ||||||||||||||||||||||||||||||||||||||||||||||||||||||:||||
a518       MTFSAAKLNISARMLCLSAGMTVLLSAFLLLRPEGSILFNHFFSINILTRRAASPRATVF
                    10        20        30        40        50        60

70        80        90       100       110    119
m518.pep   RRHQA-RFARCRTINKRRRNYAVRITPPSXAATRHYNRLPSAAGLVRRERRRCAVILSNG
           ||||| || :  ||||||||||||||||| |||||||||||
a518       RRHQAVRFRKMPTINKRRRNYAVRITPSSXAATRHYNRLPS-------------------
                    70        80        90       100
```

```
                 120       130
m518.pep    RKKSDPAFVAESEIX
            |||||||||||||||
a518       -KKSDPAFVAESEIX
                 110
```

The following partial DNA sequence was identified in *N. gonorrhoeae* <SEQ ID 1447>:

```
g519.seq
   1  atggaattt  tcattatctt  gttggcagcc  gtcgccgttt  tcggcttcaa
  51  atcctttgtc  gtcatcccc   agcaggaagt  ccacgttgtc  gaaaggctcg
 101  ggcgtttcca  tcgcgccctg  acggccggtt  tgaatatttt  gattcccttt
 151  atcgaccgcg  tcgcctaccg  ccattcgctg  aaagaaatcc  ctttagacgt
 201  acccagccag  gtctgcatca  cgcgcgataa  tacgcaattg  actgttgacg
 251  gcatcatcta  tttccaagta  accgatccca  aactcgcctc  atacggttcg
 301  agcaactaca  ttatggcaat  tacccagctt  gcccaaacga  cgctgcgttc
 351  cgttatcggg  cgtatggagt  tggacaaaac  gtttgaagaa  cgcgacgaaa
 401  tcaacagtac  cgtcgtctcc  gccctcgatg  aagccgccgg  ggcttggggt
 451  gtgaaagtcc  tccgttacga  aatcaaggat  ttggttccgc  cgcaagaaat
 501  ccttcgcgca  atgcaggcac  aaattaccgc  cgaacgcgaa  aaacgcgccc
 551  gtattgccga  atccgaaggc  cgtaaaatcg  aacaaatcaa  ccttgccagt
 601  ggtcagcgtg  aagccgaaat  ccaacaatcc  gaaggcgagg  ctcaggctgc
 651  ggtcaatgcg  tccaatgccg  agaaaatcgc  ccgcatcaac  cgcgccaaag
 701  gcgaagcgga  atccctgcgc  cttgttgccg  aagccaatgc  cgaagccaac
 751  cgtcaaattg  ccgccgccct  tcaaacccaa  agcggggcgg  atgcggtcaa
 801  tctgaagatt  gcgggacaat  acgttaccgc  gttcaaaaat  cttgccaaag
 851  aagacaatac  gcggattaag  cccgccaagg  ttgccgaaat  cgggaaccct
 901  aattttcggc  ggcatgaaaa  attttcgcca  gaagcaaaaa  cggccaaata
 951  a
```

This corresponds to the amino acid sequence <SEQ ID 1448; ORF 519.ng>:

```
g519.pep
   1  MEFFIILLAA VAVFGFKSFV VIPQQEVHVV ERLGRFHRAL TAGLNILIPF
  51  IDRVAYRHSL KEIPLDVPSQ VCITRDNTQL TVDGIIYFQV TDPKLASYGS
 101  SNYIMAITQL AQTTLRSVIG RMELDKTFEE RDEINSTVVS ALDEAAGAWG
 151  VKVLRYEIKD LVPPQEILRA MQAQITAERE KRARIAESEG RKIEQINLAS
 201  GQREAEIQQS EGEAQAAVNA SNAEKIARIN RAKGEAESLR LVAEANAEAN
 251  RQIAAALQTQ SGADAVNLKI AGQYVTAFKN LAKEDNTRIK PAKVAEIGNP
 301  NFRRHEKFSP EAKTAK*
```

The following partial DNA sequence was identified in *N. meningitidis* <SEQ ID 1449>:

```
m519.seq (partial)
    1   ..TCCGTTATCG GGCGTATGGA GTTGGACAAA ACGTTTGAAG AACGCGACGA 51     AATCAACAGT ACTGTTGTTG CGGCTTTGGA CGAGGCGGCC GGGgCTTgGG

101     GTGTGAAGGT TTTGCGTTAT GAGATTAAAG ACTTGGTTCC GCCGCAAGAA

151     ATCCTTCGCT CAATGCAGGC GCAAATTACT GCCGAACGCG AAAAACGCGC

201     CCGTATCGCC GAATCCGAAG GTCGTAAAAT CGAACAAATC AACCTTGCCA

251     GTGGTCAGCG CGAAGCCGAA ATCCAACAAT CCGAAGGCGA GGCTCAGGCT

301     GCGGTCAATG CGTCAAATGC CGAGAAAATC GCCCGCATCA ACCGCGCCAA

351     AGGTGAAGCG GAATCCTTGC GCCTTGTTGC CGAAGCCAAT GCCGAAGCCA

401     TCCGTCAAAT TGCCGCCGCC CTTCAAACCC AAGGCGGTGC GGATGCGGTC

451     AATCTGAAGA TTGCGGAACA ATACGTCGCT GCGTTCAACA ATCTTGCCAA

501     AGAAAGCAAT ACGCTGATTA TGCCCGCCAA TGTTGCCGAC ATCGGCAGCC

551     TGATTTCTGC CGGTATGAAA ATTATCGACA GCAGCAAAAC CGCCAAaTAA
```

This corresponds to the amino acid sequence <SEQ ID 1450; ORF 519>:

```
m519.pep (partial)
    1   ..SVIGRMELDK TFEERDEINS TVVAALDEAA GAWGVKVLRY EIKDLVPPQE

51     ILRSMQAQIT AEREKRARIA ESEGRKIEQI NLASGQREAE IQQSEGEAQA

101     AVNASNAEKI ARINRAKGEA ESLRLVAEAN AEAIRQIAAA LQTQGGADAV

151     NLKIAEQYVA AFNNLAKESN TLIMPANVAD IGSLISAGMK IIDSSKTAK*
```

Computer analysis of this amino acid sequence gave the following results:
Homology with a Predicted ORF from *N. gonorrhoeae*
ORF 519 shows 87.5% identity over a 200 aa overlap with a predicted ORF (ORF 519.ng) from *N. gonorrhoeae*:

```
    m519/g519
                                              10         20         30
    m519.pep                            SVIGRMELDKTFEERDEINSTVVAALDEAA
                                        ||||||||||||||||||||||||:|||||
    g519    YFQVTDPKLASYGSSNYIMAITQLAQTTLRSVIGRMELDKTFEERDEINSTVVSALDEAA
                  90        100       110       120       130       140

40         50         60         70         80         90
    m519.pep  GAWGVKVLRYEIKDLVPPQEILRSMQAQITAEREKRARIAESEGRKIEQINLASGQREAE
              ||||||||||||||||||||||||:|||||||||||||||||||||||||||||||||||
    g519      GAWGVKVLRYEIKDLVPPQEILRAMQAQITAEREKRARIAESEGRKIEQINLASGQREAE
                  150       160       170       180       190       200

100       110       120       130       140       150
    m519.pep  IQQSEGEAQAAVNASNAEKIARINRAKGEAESLRLVAEANAEAIRQIAAALQTQGGADAV
              ||||||||||||||||||||||||||||||||||||||||| ||||||||||:|||||
    g519      IQQSEGEAQAAVNASNAEKIARINRAKGEAESLRLVAEANAEANRQIAAALQTQSGADAV
                  210       220       230       240       250       260

160       170       180       190       200
    m519.pep  NLKIAEQYVAAFNNLAKESNTLIMPANVADIGSL-ISAGMKIIDSSKTAK
              ||||| |||:||:|||||:|| | ||:||:||:   |:   :||||
    g519      NLKIAGQYVTAFKNLAKEDNTRIKPAKVAEIGNPNFRRHEKFSPEAKTAK
                  270       280       290       300       310
```

The following partial DNA sequence was identified in *N. meningitidis* <SEQ ID 1451>:

```
a519.seq
    1     ATGGAATTTT TCATTATCTT GCTGGCAGCC GTCGTTGTTT TCGGCTTCAA

51     ATCCTTTGTT GTCATCCCAC AGCAGGAAGT CCACGTTGTC GAAAGGCTCG
```

-continued

```
101  GGCGTTTCCA TCGCGCCCTG ACGGCCGGTT TGAATATTTT GATTCCCTTT

151  ATCGACCGCG TCGCCTACCG CCATTCGCTG AAAGAAATCC CTTTAGACGT

201  ACCCAGCCAG GTCTGCATCA CGCGCGACAA TACGCAGCTG ACTGTTGACG

251  GTATCATCTA TTTCCAAGTA ACCGACCCCA AACTCGCCTC ATACGGTTCG

301  AGCAACTACA TTATGGCGAT TACCCAGCTT GCCCAAACGA CGCTGCGTTC

351  CGTTATCGGG CGTATGGAAT TGGACAAAAC GTTTGAAGAA CGCGACGAAA

401  TCAACAGCAC CGTCGTCTCC GCCCTCGATG AAGCCGCCGG AGCTTGGGGT

451  GTGAAGGTTT TGCGTTATGA GATTAAAGAC TTGGTTCCGC CGCAAGAAAT

501  CCTTCGCTCA ATGCAGGCGC AAATTACTGC TGAACGCGAA AAACGCGCCC

551  GTATCGCCGA ATCCGAAGGT CGTAAAATCG AACAAATCAA CCTTGCCAGT

601  GGTCAGCGCG AAGCCGAAAT CCAACAATCC GAAGGCGAGG CTCAGGCTGC

651  GGTCAATGCG TCAAATGCCG AGAAAATCGC CCGCATCAAC CGCGCCAAAG

701  GTGAAGCGGA ATCCTTGCGC CTTGTTGCCG AAGCCAATGC CGAAGCCATC

751  CGTCAAATTG CCGCCGCCCT TCAAACCCAA GGCGGTGCGG ATGCGGTCAA

801  TCTGAAGATT GCGGAACAAT ACGTCGCCGC GTTCAACAAT CTTGCCAAAG

851  AAAGCAATAC GCTGATTATG CCCGCCAATG TTGCCGACAT CGGCAGCCTG

901  ATTTCTGCCG GTATGAAAAT TATCGACAGC AGCAAAACCG CCAAATAA
```

This corresponds to the amino acid sequence <SEQ ID 1452; ORF 519.a>:

```
a519.pep
  1  MEFFIILLAA VVVFGFKSFV VIPQQEVHVV ERLGRFHRAL TAGLNILIPF

51  IDRVAYRHSL KEIPLDVPSQ VCITRDNTQL TVDGIIYFQV TDPKLASYGS

101  SNYIMAITQL AQTTLRSVIG RMELDKTFEE RDEINSTVVS ALDEAAGAWG

151  VKVLRYEIKD LVPPQEILRS MQAQITAERE KRARIAESEG RKIEQINLAS

201  GQREAEIQQS EGEAQAAVNA SNAEKIARIN RAKGEAESLR LVAEANAEAI

251  RQIAAALQTQ GGADAVNLKI AEQYVAAFNN LAKESNTLIM PANVADIGSL

301  ISAGMKIIDS SKTAK*
``` m519/a519 99.5% identity in 199 aa overlap

```
                            10         20         30
  m519.pep              SVIGRMELDKTFEERDEINSTVVAALDEAA
                        ||||||||||||||||||||||||:|||||
  a519     YFQVTDPKLASYGSSNYIMAITQLAQTTLRSVIGRMELDKTFEERDEINSTVVSALDEAA
                 90        100       110       120       130       140

40         50         60         70         80         90
  m519.pep  GAWGVKVLRYEIKDLVPPQEILRSMQAQITAEREKRARIAESEGRKIEQUNLASGQREAE
            ||||||||||||||||||||||||||||||||||||||||||||||||||||||||||||
  a519      GAWGVKVLRYEIKDLVPPQEILRSMQAQITAEREKRARIAESEGRKIEQUNLASGQREAE
                 150       160       170       180       190       200

100       110       120       130       140       150
  m519.pep  IQQSEGEAQAAVNASNAEKIARINRAKGEAESLRLVAEANAEAIRQIAAALQTQGGADAV
            ||||||||||||||||||||||||||||||||||||||||||||||||||||||||||||
  a519      IQQSEGEAQAAVNASNAEKIARINRAKGEAESLRLVAEANAEAIRQIAAALQTQGGADAV
                 210       220       230       240       250       260

160       170       180       190       200
  m519.pep  NLKIAEQYVAAFNNLAKESNTLIMPANVADIGSLISAGMKIIDSSKTAKX
            |||||||||||||||||||||||||||||||||||||||||||||||||
  a519      NLKIAEQYVAAFNNLAKESNTLIMPANVADIGSLISAGMKIIDSSKTAKX
                 270       280       290       300       310
```

The following partial DNA sequence was identified in *N. gonorrhoeae* <SEQ ID 1453>:

```
g519-1.seq
     1    ATGGAATTTT TCATTATCTT GTTGGCAGCC GTCGCCGTTT TCGGCTTCAA
    51    ATCCTTTGTC GTCATCCCCC AGCAGGAAGT CCACGTTGTC GAAAGGCTCG
   101    GGCGTTTCCA TCGCGCCCTG ACGGCCGGTT TGAATATTTT GATTCCCTTT
   151    ATCGACCGCG TCGCCTACCG CCATTCGCTG AAAGAAATCC CTTTAGACGT
   201    ACCCAGCCAG GTCTGCATCA CGCGCGATAA TACGCAATTG ACTGTTGACG
   251    GCATCATCTA TTTCCAAGTA ACCGATCCCA AACTCGCCTC ATACGGTTCG
   301    AGCAACTACA TTATGGCAAT TACCCAGCTT GCCCAAACGA CGCTGCGTTC
   351    CGTTATCGGG CGTATGGAGT TGGACAAAAC GTTTGAAGAA CGCGACGAAA
   401    TCAACAGTAC CGTCGTCTCC GCCCTCGATG AAGCCGCCGG GGCTTGGGGT
   451    GTGAAAGTCC TCCGTTACGA AATCAAGGAT TTGGTTCCGC CGCAAGAAAT
   501    CCTTCGCGCA ATGCAGGCAC AAATTACCGC CGAACGCGAA AAACGCGCCC
   551    GTATTGCCGA ATCCGAAGGC CGTAAAATCG AACAAATCAA CCTTGCCAGT
   601    GGTCAGCGTG AAGCCGAAAT CCAACAATCC GAAGGCGAGG CTCAGGCTGC
   651    GGTCAATGCG TCCAATGCCG AGAAAATCGC CCGCATCAAC CGCGCCAAAG
   701    GCGAAGCGGA ATCCCTGCGC CTTGTTGCCG AAGCCAATGC CGAAGCCATC
   751    CGTCAAATTG CCGCCGCCCT TCAAACCCAA GGCGGGGCGG ATGCGGTCAA
   801    TCTGAAGATT GCGGAACAAT ACGTAGCCGC GTTCAACAAT CTTGCCAAAG
   851    AAAGCAATAC GCTGATTATG CCCGCCAATG TTGCCGACAT CGGCAGCCTG
   901    ATTTCTGCCG GCATGAAAAT TATCGACAGC AGCAAAACCG CCAAATAA
                                                        35
```

This corresponds to the amino acid sequence <SEQ ID 1454; ORF 519-1.ng>:

```
g519-1.pep
     1    MEFFIILLAA VAVFGFKSFV VIPQQEVHVV ERLGRFHRAL TAGLNILIPF
    51    IDRVAYRHSL KEIPLDVPSQ VCITRDNTQL TVDGIIYFQV TDPKLASYGS
   101    SNYIMAITQL AQTTLRSVIG RMELDKTFEE RDEINSTVVS ALDEAAGAWG
   151    VKVLRYEIKD LVPPQEILRA MQAQITAERE KRARIAESEG RKIEQINLAS
   201    GQREAEIQQS EGEAQAAVNA SNAEKIARIN RAKGEAESLR LVAEANAEAI
   251    RQIAAALQTQ GGADAVNLKI AEQYVAAFNN LAKESNTLIM PANVADIGSL
   301    ISAGMKIIDS SKTAK*
```

The following partial DNA sequence was identified in *N. meningitidis* <SEQ ID 1455>:

```
m519-1.seq
     1    ATGGAATTTT TCATTATCTT GTTGGTAGCC GTCGCCGTTT TCGGTTTCAA
    51    ATCCTTTGTT GTCATCCCAC AACAGGAAGT CCACGTTGTC GAAAGGCTGG
   101    GGCGTTTCCA TCGCGCCCTG ACGGcCGGTT TGAATATTTT GATTCCCTTT
   151    ATCGACCGCG TCGCCTACCG CCATTCGCTG AAAGAAATCC CTTTAGACGT
   201    ACCCAGCCAG GTCTGCATCA CGCGCGACAA TACGCAGCTG ACTGTTGACG
   251    GCATCATCTA TTTCCAAGTA ACCGACCCCA AACTCGCCTC ATACGGTTCG
```

```
                       -continued
301     AGCAACTACA TTATGGCGAT TACCCAGCTT GCCCAAACGA CGCTGCGTTC

351     CGTTATCGGG CGTATGGAGT TGGACAAAAC GTTTGAAGAA CGCGACGAAA

401     TCAACAGTAC TGTTGTTGCG GCTTTGGACG AGGCGGCCGG GGCTTGGGGT

451     GTGAAGGTTT TGCGTTATGA GATTAAAGAC TTGGTTCCGC CGCAAGAAAT

501     CCTTCGCTCA ATGCAGGCGC AAATTACTGC CGAACGCGAA AAACGCGCCC

551     GTATCGCCGA ATCCGAAGGT CGTAAAATCG AACAAATCAA CCTTGCCAGT

601     GGTCAGCGCG AAGCCGAAAT CCAACAATCC GAAGGCGAGG CTCAGGCTGC

651     GGTCAATGCG TCAAATGCCG AGAAAATCGC CCGCATCAAC CGCGCCAAAG

701     GTGAAGCGGA ATCCTTGCGC CTTGTTGCCG AAGCCAATGC CGAAGCCATC

751     CGTCAAATTG CCGCCGCCCT TCAAACCCAA GGCGGTGCGG ATGCGGTCAA

801     TCTGAAGATT GCGGAACAAT ACGTCGCTGC GTTCAACAAT CTTGCCAAAG

851     AAAGCAATAC GCTGATTATG CCCGCCAATG TTGCCGACAT CGGCAGCCTG

901     ATTTCTGCCG GTATGAAAAT TATCGACAGC AGCAAAACCG CCAAATAA
```

This corresponds to the amino acid sequence <SEQ ID 1456; ORF 519-1>:

```
m519-1.
  1    MEFFIILLVA VAVFGFKSFV VIPQQEVHVV ERLGRFHRAL TAGLNILIPF

51    IDRVAYRHSL KEIPLDVPSQ VCITRDNTQL TVDGIIYFQV TDPKLASYGS

101    SNYIMAITQL AQTTLRSVIG RMELDKTFEE RDEINSTVVA ALDEAAGAWG

151    VKVLRYEIKD LVPPQEILRS MQAQITAERE KRARIAESEG RKIEQINLAS

201    GQREAEIQQS EGEAQAAVNA SNAEKIARIN RAKGEAESLR LVAEANAEAI

251    RQIAAALQTQ GGADAVNLKI AEQYVAAFNN LAKESNTLIM PANVADIGSL

301    ISAGMKIIDS SKTAK*
``` m519-1/g519-1 99.0% identity in 315 aa overlap

```
                   10         20         30         40         50         60
g519-1.pep    MEFFIILLAAVAVFGFKSFVVIPQQEVHVVERLGRFHRALRAGLNILIPFIDRVAYRHSL
              ||||||||:||||||||||||||||||||||||||||||| ||||||||||||||||||
m519-1        MEFFIILLVAVAVFGFKSFVVIPQQEVHVVERLGRFHRALRAGLNILIPFIDRVAYRHSL
                   10         20         30         40         50         60

70         80         90        100        110        120
g519-1.pep    KEIPLDVPSQVCITRDNTQLTVDGIIYFQVTDPKLASYGSSNYIMAITQLAQTTLRSVIG
              ||||||||||||||||||||||||||||||||||||||||||||||||||||||||||||
m519-1        KEIPLDVPSQVCITRDNTQLTVDGIIYFQVTDPKLASYGSSNYIMAITQLAQTTLRSVIG
                   70         80         90        100        110        120

130        140        150        160        170        180
g519-1.pep    RMELDTKFEERDEINSTVVSALDEAAGAWGVKVLRYEIKDLVPPQEILRAMQAQITAERE
              |||||||||||||||||||:||||||||||||||||||||||||||||||:||||||||
m519-1        RMELDTKFEERDEINSTVVAALDEAAGAWGVKVLRYEIKDLVPPQEILSAMQAQITAERE
                  130        140        150        160        170        180

190        200        210        220        230        240
g519-1.pep    KRARIAESEGRKIEQINLASGQREAEIQQSEGEAQAAVNASNAEKIARINRAKGEAESLR
              ||||||||||||||||||||||||||||||||||||||||||||||||||||||||||||
m519-1        KRARIAESEGRKIEQINLASGQREAEIQQSEGEAQAAVNASNAEKIARINRAKGEAESLR
                  190        200        210        220        230        240

250        260        270        280        290        300
g519-1.pep    LVAEANAEAIRQIAAALQTQGGADAVNLKIAEQYVAAFNNLAKESNTLIMPANVADIGSL
              ||||||||||||||||||||||||||||||||||||||||||||||||||||||||||||
m519-1        LVAEANAEAIRQIAAALQTQGGADAVNLKIAEQYVAAFNNLAKESNTLIMPANVADIGSL
                  250        260        270        280        290        300
```

-continued

```
                    310
g519-1.pep    ISAGMKIIDSSKTAKX
              ||||||||||||||||
m519-1        ISAGMKIIDSSKTAKX
                    310
```

The following partial DNA sequence was identified in *N. meningitidis* <SEQ ID 1457>:

```
a519-1.seq
     1    ATGGAATTTT TCATTATCTT GCTGGCAGCC GTCGTTGTTT TCGGCTTCAA

51    ATCCTTTGTT GTCATCCCAC AGCAGGAAGT CCACGTTGTC GAAAGGCTCG

101    GGCGTTTCCA TCGCGCCCTG ACGGCCGGTT TGAATATTTT GATTCCCTTT

151    ATCGACCGCG TCGCCTACCG CCATTCGCTG AAAGAAATCC CTTTAGACGT

201    ACCCAGCCAG GTCTGCATCA CGCGCGACAA TACGCAGCTG ACTGTTGACG

251    GTATCATCTA TTTCCAAGTA ACCGACCCCA AACTCGCCTC ATACGGTTCG

301    AGCAACTACA TTATGGCGAT TACCCAGCTT GCCCAAACGA CGCTGCGTTC

351    CGTTATCGGG CGTATGGAAT TGGACAAAAC GTTTGAAGAA CGCGACGAAA

401    TCAACAGCAC CGTCGTCTCC GCCCTCGATG AAGCCGCCGG AGCTTGGGGT

451    GTGAAGGTTT TGCGTTATGA GATTAAAGAC TTGGTTCCGC CGCAAGAAAT

501    CCTTCGCTCA ATGCAGGCGC AAATTACTGC TGAACGCGAA AAACGCGCCC

551    GTATCGCCGA ATCCGAAGGT CGTAAAATCG AACAAATCAA CCTTGCCAGT

601    GGTCAGCGCG AAGCCGAAAT CCAACAATCC GAAGGCGAGG CTCAGGCTGC

651    GGTCAATGCG TCAAATGCCG AGAAAATCGC CCGCATCAAC CGCGCCAAAG

701    GTGAAGCGGA ATCCTTGCGC CTTGTTGCCG AAGCCAATGC CGAAGCCATC

751    CGTCAAATTG CCGCCGCCCT TCAAACCCAA GGCGGTGCGG ATGCGGTCAA

801    TCTGAAGATT GCGGAACAAT ACGTCGCCGC GTTCAACAAT CTTGCCAAAG

851    AAAGCAATAC GCTGATTATG CCCGCCAATG TTGCCGACAT CGGCAGCCTG

901    ATTTCTGCCG GTATGAAAAT TATCGACAGC AGCAAAACCG CCAAATAA
```

This corresponds to the amino acid sequence <SEQ ID 1458; ORF 519-1.a>:

```
a519-1.pep.
     1    MEFFIILLAA VVVFGFKSFV VIPQQEVHVV ERLGRFHRAL TAGLNILIPF

51    IDRVAYRHSL KEIPLDVPSQ VCITRDNTQL TVDGIIYFQV TDPKLASYGS

101    SNYIMAITQL AQTTLRSVIG RMELDKTFEE RDEINSTVVS ALDEAAGAWG

151    VKVLRYEIKD LVPPQEILRS MQAQITAERE KRARIAESEG RKIEQINLAS

201    GQREAEIQQS EGEAQAAVNA SNAEKIARIN RAKGEAESLR LVAEANAEAI

251    RQIAAALQTQ GGADAVNLKI AEQYVAAFNN LAKESNTLIM PANVADIGSL

301    ISAGMKIIDS SKTAK*
``` m519-1/a519-1 99.0% identity in 315 aa overlap

```
                      10        20        30        40        50        60
a519-1.pep    MEFFIILLAAVVVFGFKSFVVIPQQEVHVVERLGRFHRALRAGLNILIPFIDRVAYRHSL
              ||||||||:||:||||||||||||||||||||||||||||||||||||||||||||||||
m519-1        MEFFIILLVAVAVFGFKSFVVIPQQEVHVVERLGRFHRALRAGLNILIPFIDRVAYRHSL
                      10        20        30        40        50        60
```

```
               70         80         90        100        110        120
a519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
               70         80         90        100        110        120

130        140        150        160        170        180
a519-1.pep  RMELDTKFEERDEINSTVVSALDEAAGAWGVKVLRYEIKDLVPPQEILRSMQAQITAERE
            ||||||||||||||||||:|||||||||||||||||||||||||||||||||||||||||
m519-1      RMELDTKFEERDEINSTVVAALDEAAGAWGVKVLRYEIKDLVPPQEILRSMQAQITAERE
              130        140        150        160        170        180

190        200        210        220        230        240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
              190        200        210        220        230        240

250        260        270        280        290        300
a519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
              250        260        270        280        290        300

310
a519-1.pep  ISAGMKIIDSSKTAKX
            ||||||||||||||||
m519-1      ISAGMKIIDSSKTAKX
              310
```

Expression of ORF 519

Figure 1E:
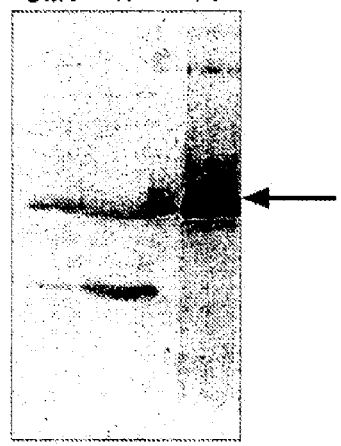
Figure 1C:
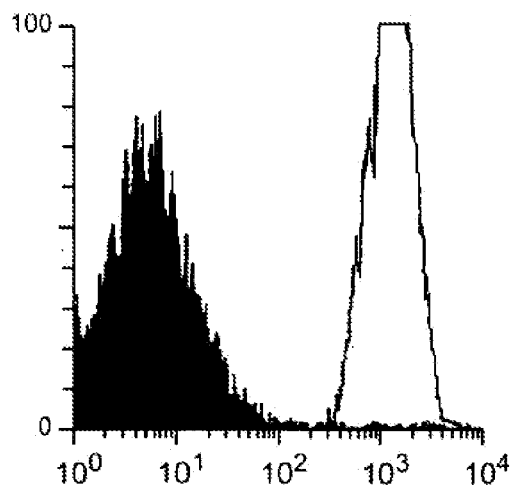
Figure 1D:
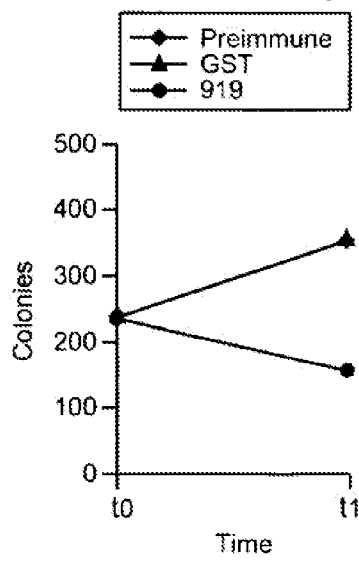
Figure 4A:
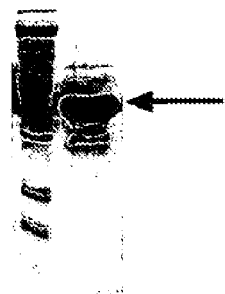
FIG. 4A through FIG. 4D illustrate the products of (FIG. 4A) protein expression and purification, (FIG. 4B) western blot, (FIG. 4C) FACs analysis, and (FIG. 4D) bactericidal assay. The result of the ELISA assay of the predicted ORF 519-1 as cloned and expressed in *E. coli* was positive.
Figure 4B:
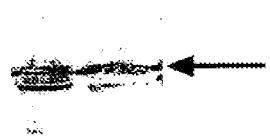
Figure 4C:
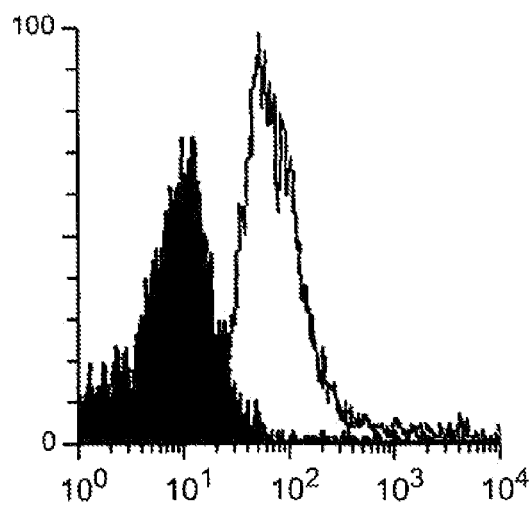
Figure 4D:
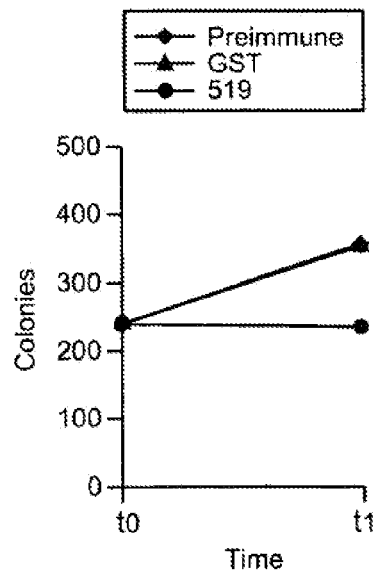
Figure 5A:
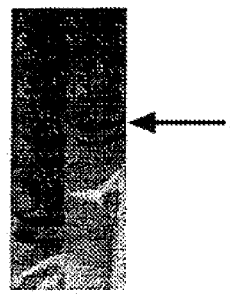
FIG. 5A through FIG. 5D illustrate the products of (FIG. 5A) protein expression and purification, (FIG. 5B) western blot, (FIG. 5C) FACs analysis, and (FIG. 5D) bactericidal assay. The result of the ELISA assay of the predicted ORF 121-1 as cloned and expressed in *E. coli* was positive.
Figure 5B:
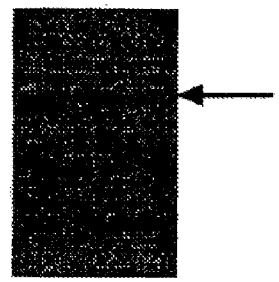
Figure 5C:
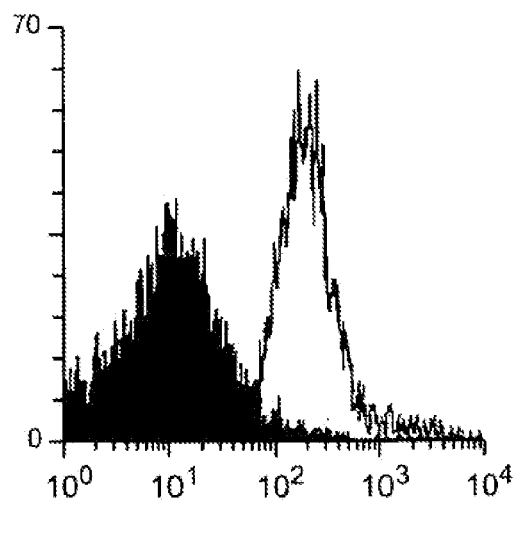
Figure 5D:
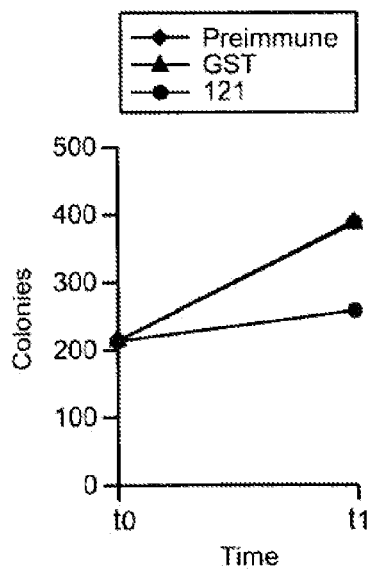
Figure 6A:
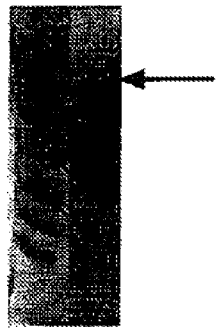
FIG. 6A through FIG. 6D illustrate the products of (FIG. 6A) protein expression and purification, (FIG. 6B) western blot, (FIG. 6C) FACs analysis, and (FIG. 6D) bactericidal assay. The result of the ELISA assay of the predicted ORF 128-1 as cloned and expressed in *E. coli* was positive.
Figure 6B:
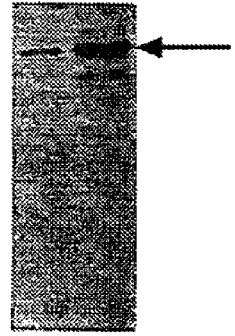
Figure 6C:
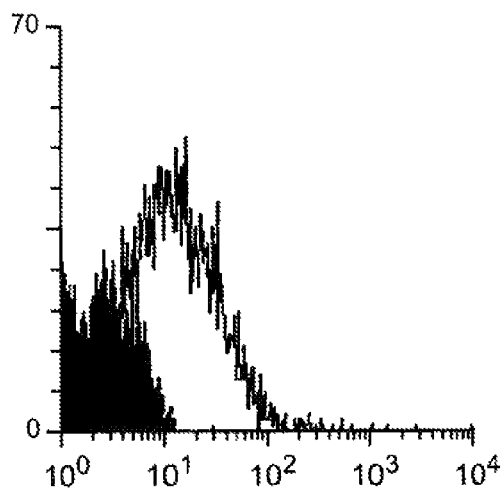
Figure 6D:
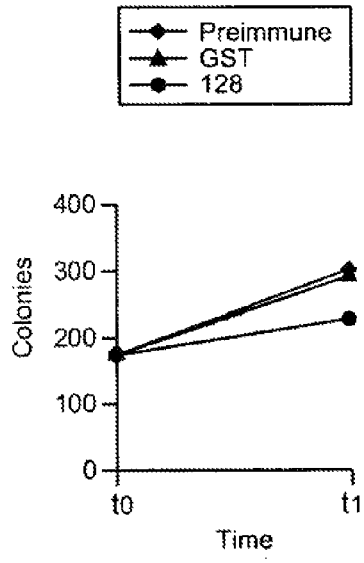
Figure 7A:
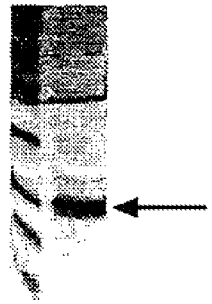
FIG. 7A through FIG. 7D illustrate the products of (FIG. 7A) protein expression and purification, (FIG. 7B) western blot, (FIG. 7C) FACs analysis, and (FIG. 7D) bactericidal assay. The result of the ELISA assay of the predicted ORF 206 as cloned and expressed in *E. coli* was positive.
Figure 7B:
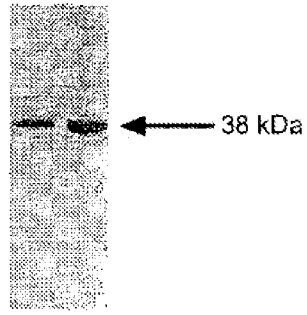
Figure 7C:
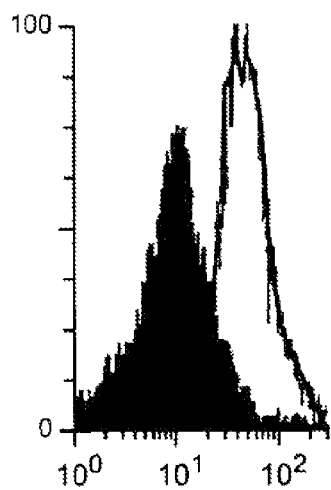
Figure 7D:
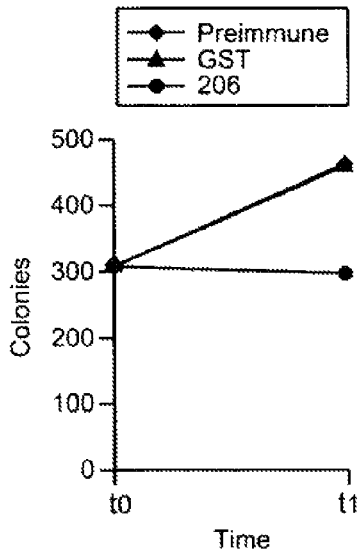
Figure 8A:
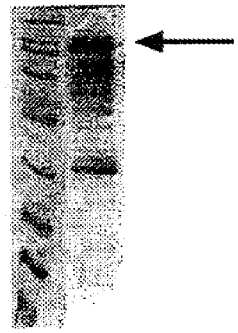
FIG. 8A through FIG. 8C illustrate the products of (FIG. 8A) protein expression and purification, (FIG. 8B) FACs analysis, and (FIG. 8C) bactericidal assay. The result of the ELISA assay of the predicted ORF 287 as cloned and expression in *E. coli* was positive.
Figure 8B:
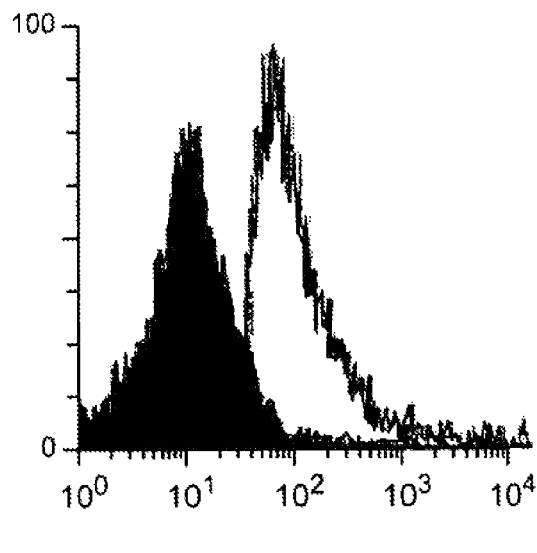
Figure 8C:
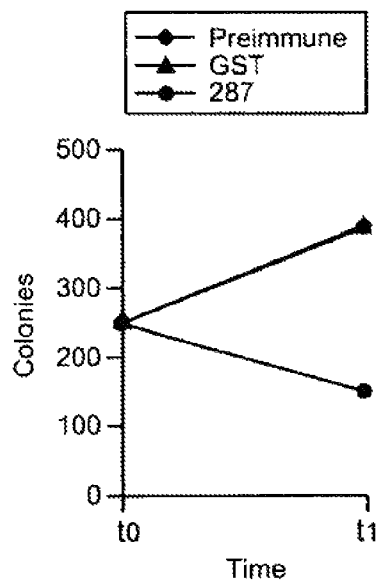
Figure 9A:
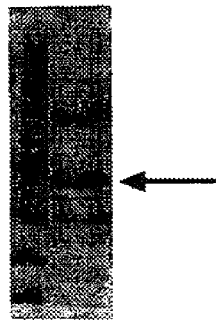
FIG. 9A through FIG. 9D illustrate the products of (FIG. 9A) protein expression and purification, (FIG. 9B) western blot, (FIG. 9C) FACs analysis, and (FIG. 9D) bactericidal assay. The result of the ELISA assay of the predicted ORF 406 as cloned and expressed in *E. coli* was positive.
Figure 9B:
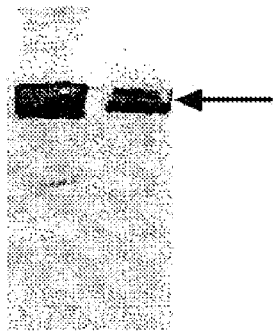
Figure 9C:
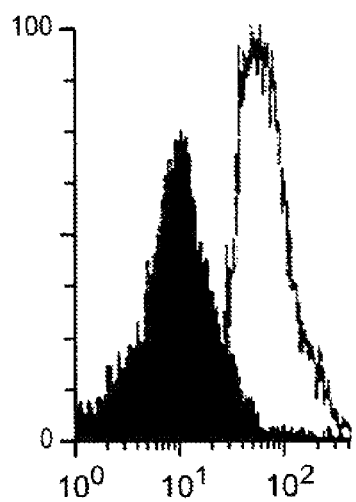
Figure 9D:
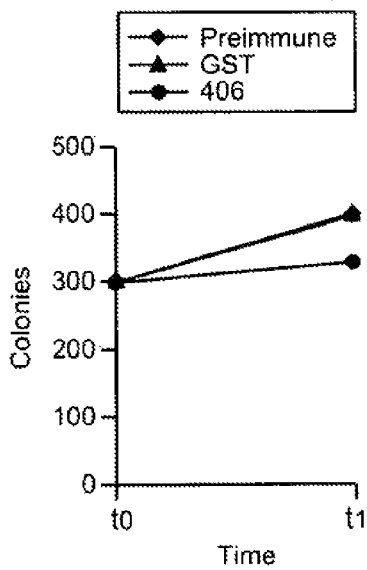

The primer described in Table 1 for ORF 519 was used to locate and clone ORF 519. ORF 519 was cloned in pET and pGex vectors and expressed in *E. coli* as above described. The products of protein expression and purification were analyzed by SDS-PAGE. FIG. 4A shows the results of affinity purification, and FIG. 4B shows the expression in *E. coli*. Purified Nis-fusion protein was used to immunize mice whose sera were used for ELISA (positive result), FACS analysis (FIG. 4C), western blot (FIG. 1E), and a bactericidal assay (FIG. 4D). These experiments confirm that 519 is a surface-exposed protein and that it is a useful immunogen. The hydrophilicity plots, antigenic index, and amphipatic regions of ORF 519 are provided in FIG. 8. The AMPHI program is used to predict putative T-cell epitopes (Gao et al 1989, *J. Immunol* 143: 3007; Roberts et al. 1996, *AIDS Res Human Retroviruses* 12:593; Quakyi et al. 1992, *Scand J Immunol Suppl* 11:9). The nucleic acid sequence of ORF 519 and the amino acid sequence encoded thereby as provided herein.

The following partial DNA sequence was identified in *N. gonorrhoeae* <SEQ ID 1459>:

```
g520.seq
     1  atgcctgcgc ttctttcaat acgtcgggca aacgcgctgc cttttcgcg
    51  catttcggaa aggatgaagt tgctggtgcc gttaataatg ccggcgatgg
   101  atttaatcct gtttgccgcc aaaccttcgc gcacggcttt gatgattggg
   151  ataccgcccg ctactgccgc ttcaaattgg acgatgacgt tttgttttc
   201  cgccagcggg aagatttcgt tgccgtattc ggcgagcagt ttttgttgg
   251  cggtaacgat gtgtttgccg ttttcaatgg ctttcaacac cgcttctttg
   301  gcaatgcccg tgccgccgaa caattcgacc aagacatcga cgtctttacg
   351  cgcgaacagt tcgaacggat cttttgacaa gggcgggcga cgggccgatt
   401  ttggcgggct ttttcttcgc ttaagtcgca catggcagaa atacggattt
   451  cgcgccccaa gcggcgggaa atttcctctg cgttgtcccg caacacggca
   501  gccgcaccgc cgccgaccgt acctaagcct aaaagaccga tgtttactgg
   551  cttcattgtg tctccttgta agccgactga aatgtaaata ttga
```

This corresponds to the amino acid sequence <SEQ ID 1460; ORF 520.ng>:

```
g520.pep
     1  MPALLSIRRA NALPFSRISE RMKLLVPLIM PAMDLILFAA KPSRTALMIG

51  IPPATAASNW TMTFCFSASG KISLPYSASS FLLAVTMCLP FSMAFNTASL
```

```
101    AMPVPPNNST KTSTSLRANS SNGSFDKGGR RADFGGLFLR LSRTWQKYGF

151    RAPSGGKFPL RCPATRQPHR RRPYLSLKDR CLLASLCLLV SRLKCKY*
```

The following partial DNA sequence was identified in *N. meningitidis* <SEQ ID 1461>:

```
m520.seq
  1    ATGCCTGCGC TTCTTTCAGT ACATCG.GCA AACGCGCTGC CTTTTTCGCG

51    CATTTCGGrk AGGATGAAGT TGCTGGTGCC GTTAATAATG CCGGCGATGG

101    ATTTAATCCT GTTTGCCGCC AAACCTTCGC GCAGGGCTTT GATGATTGGG

151    ATACCGCCCG CTACTGCCGC TTCAAATTGG ACGATGACGT TTTGTTTTTC

201    CGCCAGCGGG AAGATTTCGT TGCCGTATTC GGCGAGCAGT TTTTTGTTGG

251    CGGTAACGAT GTGTTTGCCG TTTTCAATGG CTTTCAACAC CGCATCTTTG

301    GCAATGCCGG TACCGCCGaA CAATTCGACG ACGACATCGA CGTCTTCACG

351    TGCGACCAGT TCGAACGGAT CTTTGACAAA GGCTGc.CGG ACGGGCAGGT

401    TTGTCGGGCT TTTTCTTCAC TCAAATCGCA CACGGCAGAA ATACGGATTT

451    CGCGCCCCAA GCGACGGGAA ATTTCCTCCG CGTTGTCsCG CAACACGGCA

501    GCCGTACCGC CGCCGACCGT ACCCAAACCT AAAAGACCGA TGTTTACTGG

551    CTTCATTGTG TCTCCTTGTA AGCCGACTGA AATGTAAATA TTGA
```

This corresponds to the amino acid sequence <SEQ ID 1462; ORF 520>:

```
m520.pep
  1    MPALLSVHXA NALPFSRISX RMKLLVPLIM PAMDLILFAA KPSRRALMIG

51    IPPATAASNW TMTFCFSASG KISLPYSASS FLLAVTMCLP FSMAFNTASL

101    AMPVPPNNST TTSTSSRATS SNGSLTKAXR TGRFVGLFLH SNRTRQKYGF

151    RAPSDGKFPP RCXATRQPYR RRPYPNLKDR CLLASLCLLV SRLKCKY*
```

Computer analysis of this amino acid sequence gave the following results:
Homology with a Predicted ORF from *N. gonorrhoeae*
ORF 520 shows 87.3% identity over a 197 aa overlap with a predicted ORF (ORF 520.ng) from *N. gonorrhoeae*:

```
  m520/g520
                 10         20         30         40         50         60
    m520.pep    MPALLSVHRANALPFSRISXRMKLLVPLIMPAMDLILFAAKPSRRALMIGIPPATAASNW
                ||||||::|||||||||||  |||||||||||||||||||||||:|||||||||||||||
    g520        MPALLSIRRANALPFSRISERMKLLVPLIMPAMDLILFAAKPSRTALMIGIPPATAASNW
                 10         20         30         40         50         60

70         80         90        100        110        120
    m520.pep    TMTFCFSASGKISLPYSASSFLLAVTMCLPFSMAFNTASLAMPVPPNNSTTTSTSSRATS
                ||||||||||||||||||||||||||||||||||||||||||||||||||  ||||  ::|
    g520        TMTFCFSASGKISLPYSASSFLLAVTMCLPFSMAFNTASLAMPVPPNNSTKTSTSLRANS
                 70         80         90        100        110        120

130        140        150        160        170        180
    m520.pep    SNGSLTKAARTGRFVGLFLHSNRTRQKYGFRAPSDGKFPPRCXATRQPYRRRPYPNLKDR
                ||||:  |:::|  :  ||||:  :||  ||||||||||||  ||  |||||:|||||  :||||
    g520        SNGSFDKGGRRADFGGLFLRLSRTWQKYGFRAPSGGKFPLRCPATRQPHRRRPYSLKDR
                130        140        150        160        170        180

190
    m520.pep    CLLASLCLLVSRLKCKY
                |||||||||||||||||
    g520        CLLASLCLLVSRLKCKY
                190
```

The following partial DNA sequence was identified in *N. meningitidis* <SEQ ID 1463>:

```
a520.seq
    1   ATGCCTGCGC TTCTTTCAGT ACATCGG.CA AACGCGCTGC CTTTTTCGCG

51   CATTTCGGAG AGGATGAAGT TGCTGGTGCC GTTAATAATG CCGGCGATGG

101   ATTTAATCCT GTTTGCCGCC AAACCTTCGC GCAGGGCTTT GATGATTGGG

151   ATACCGCCCG CTACTGCCGC TTCAAATTGG ACGATGACGT TTTGTTTTTC

201   CGCCAGCGGG AAGATTTCGT TGCCGTATTC GGCGAGCAGT TTTTTGTTGG

251   CGGTAACGAT GTGTTTGCCG TTTTCAATGG CTTTCAACAC CGCATCTTTG

301   GCAATGCCGG TACCGCCGAA CAATTCGACG ACGACATCGA CGTCTTCACG

351   TGCGACCAGT TCGAACGGAT CTTTGACAAA GGCTG..CGG ACGGGCAGGT

401   TTGTCGGGCT TTTTCTTCAC TCAAATCGCA CACGGCAGAA ATACGGATTT

451   CGCGCCCCAA GCGACGGGAA ATTTCCTCCG CGTTGTCCCG CAACACGGCA

501   GCCGTACCGC CGCCGACCGT ACCCAAACCT AAAAGACCGA TGTTTACTGG

551   CTTCATTGTG TCTCCTTGTA AGCCGACTGA AATGTAAATA TTGA
```

This corresponds to the amino acid sequence <SEQ ID 1464; ORF 520.a>:

```
a520.pep
    1   MPALLSVHRX NALPFSRISE RMKLLVPLIM PAMDLILFAA KPSRRALMIG

51   IPPATAASNW TMTFCFSASG KISLPYSASS FLLAVTMCLP FSMAFNTASL

101   AMPVPPNNST TTSTSSRATS SNGSLTKAXR TGRFVGLFLH SNRTRQKYGF

151   RAPSDGKFPP RCPATRQPYR RRPYPNLKDR CLLASLCLLV SRLKCKY*
``` m520/a520 98.0% identity in 197 aa overlap

```
                    10        20        30        40        50        60
m520.pep    MPALLSVHXANALPFSRISXRMKLLVPLIMPAMDLILFAAKPSRRALMIGIPPATAASNW
            ||||||||  ||||||||| ||||||||||||||||||||||||||||||||||||||||
a520        MPALLSVHRXNALPFSRISERMKLLVPLIMPAMDLILFAAKPSRRALMIGIPPATAASNW
                    10        20        30        40        50        60

70        80        90       100       110       120
m520.pep    TMTFCFSASGKISLPYSASSFLLAVTMCLPFSMAFNTASLAMPVPPNNSTTTSTSSRATS
            ||||||||||||||||||||||||||||||||||||||||||||||||||||||||||||
a520        TMTFCFSASGKISLPYSASSFLLAVTMCLPFSMAFNTASLAMPVPPNNSTTTSTSSRATS
                    70        80        90       100       110       120

130       140       150       160       170       180
m520.pep    SNGSLTKAXRTGRFVGLFLHSNRTRQKYGFRAPSDGKFPPRCXATRQPYRRRPYPNLKDR
            |||||||||||||||||||||||||||||||||||||||||| |||||||||||||||||
a505        SNGSLTKAXRTGRFVGLFLHSNRTRQKYGFRAPSDGKFPPRCPATRQPYRRRPYPNLKDR
                   130       140       150       160       170       180

190
m520.pep    CLLASLCLLVSRLKCKYX
            |||||||||||||||||
a520        CLLASLCLLVSRLKCKYX
                   190
```

The following partial DNA sequence was identified in *N. gonorrhoeae* <SEQ ID 1465>:

```
g520-1.seq
     1    ATGAAGTTGC TGGTGCCGTT AATAATGCCG GCGATGGATT TAATCCTGTT

51    TGCCGCCAAA CCTTCGCGCA GGGCTTTGAT GATTGGGATA CCGCCCGCTA

101    CTGCCGCTTC AAATTGGACG ATGACGTTTT GTTTTTCCGC CAGCGGGAAG
```

-continued

```
       151   ATTTCGTTGC CGTATTCGGC GAGCAGTTTT TTGTTGGCGG TAACGATGTG

201   TTTGCCGTTT TCAATGGCTT TCAACACCGC TTCTTTGGCA ATGCCCGTGC

251   CGccgAACAA TTCGACGACG ACATCGACGT CTTTACGCGC GACCAGTtCG

301   AACGGATCTT TGACAAAGGC GGCGGACGGG CAGATTTGGC GGGCTTTTTC

351   TTCGCTTAAG TCGCACATGG CAGAAATACG GATTTCGCGC CCCAAGCGGC

401   GGGAAATTTC CTCTGCGTTG TCCCGCAACA CGGCAGCCGC ACCGCCGCCG

451   ACCgTACCTA AGCCTAAAAG ACCGATGTTT ACTGGCTTCA TTGTGTCTCC

501   TTGTAAGCCG ACTGAAATGT AA
                                                15
```

This corresponds to the amino acid sequence <SEQ ID 1466; ORF 520-1.ng>:

```
g520-1.pep
     1    MKLLVPLIMP AMDLILFAAK PSRRALMIGI PPATAASNWT MTFCFSASGK

51    ISLPYSASSF LLAVTMCLPF SMAFNTASLA MPVPPNNSTT TSTSLRATSS

101    NGSLTKAADG QIWRAFSSLK SHMAEIRISR PKRREISSAL SRNTAAAPPP

151    TVPKPKRPMF TGFIVSPCKP TEM*
```

The following partial DNA sequence was identified in *N. meningitidis* <SEQ ID 1467>:

```
m520-1.seq
     1    ATGAAGTTGC TGGTGCCGTT AATAATGCCG GCGATGGATT TAATCCTGTT

51    TGCCGCCAAA CCTTCGCGCA GGGCTTTGAT GATTGGGATA CCGCCCGCTA

101    CTGCCGCTTC AAATTGGACG ATGACGTTTT GTTTTTCCGC CAGCGGGAAG

151    ATTTCGTTGC CGTATTCGGC GAGCAGTTTT TTGTTGGCGG TAACGATGTG

201    TTTGCCGTTT TCAATGGCTT TCAACACCGC ATCTTTGGCA ATGCCGGTAC

251    CGCCGAACAA TTCGACGACG ACATCGACGT CTTCACGTGC GACCAGTTCG

301    AACGGATCTT TGACAAAGGC TGCGGACGGG CAGGTTTGTC GGGCTTTTTC

351    TTCACTCAAA TCGCACACGG CAGAAATACG GATTTCGCGC CCCAAGCGAC

401    GGGAAATTTC CTCCGCGTTG TCCCGCAACA CGGCAGCCGT ACCGCCGCCG

451    ACCGTACCCA AACCTAAAAG ACCGATGTTT ACTGGCTTCA TTGTGTCTCC

501    TTGTAAGCCG ACTGAAATGT AA
                                                55
```

This corresponds to the amino acid sequence <SEQ ID 1468; ORF 520-1>:

```
m520-1.pep
     1    MKLLVPLIMP AMDLILFAAK PSRRALMIGI PPATAASNWT MTFCFSASGK

51    ISLPYSASSF LLAVTMCLPF SMAFNTASLA MPVPPNNSTT TSTSSRATSS

101    NGSLTKAADG QVCRAFSSLK SHTAEIRISR PKRREISSAL SRNTAAVPPP

151    TVPKPKRPMF TGFIVSPCKP TEM*
``` g520-1/m520-1 97.1% identity in 173 aa overlap

```
                    10         20         30         40         50         60
g520-1.pep   MKLLVPLIMPAMDLILFAAKPSRRALMIGIPPATAASNWTMTFCFSASGKISLPYSASSF
             ||||||||||||||||||||||||||||||||||||||||||||||||||||||||||||
m520-1       MKLLVPLIMPAMDLILFAAKPSRRALMIGIPPATAASNWTMTFCFSASGKISLPYSASSF
                    10         20         30         40         50         60

70         80         90        100        110        120
g520-1.pep   LLAVTMCLPFSMAFNTASLAMPVPPNNSTTTSTSLRATSSNGSLTKAADGQIWRAFSSLK
             |||||||||||||||||||||||||||||||||||:||||||||||||||||||:|||||
m520-1       LLAVTMCLPFSMAFNTASLAMPVPPNNSTTTSTSSRATSSNGSLTKAADGQVCRAFSSLK
                    70         80         90        100        110        120

130        140        150        160        170
g520-1.pep   SHMAEIRISRPKRREISSALSRNTAAAPPPTVPKPKRPMFTGFIVSPCKPTEMX
             ||:|||||||||||||||||||||||||:||||||||||||||||||||||||
m520-1       SHTAEIRISRPKRREISSALSRNTAAVPPPTVPKPKRPMFTGFIVSPCKPTEMX
                   130        140        150        160        170
```

The following partial DNA sequence was identified in *N. meningitidis* <SEQ ID 1469>:

```
a520-1.seq
    1    ATGAAGTTGC TGGTGCCGTT AATAATGCCG GCGATGGATT TAATCCTGTT

51    TGCCGCCAAA CCTTCGCGCA GGGCTTTGAT GATTGGGATA CCGCCCGCTA

101    CTGCCGCTTC AAATTGGACG ATGACGTTTT GTTTTTCCGC CAGCGGGAAG

151    ATTTCGTTGC CGTATTCGGC GAGCAGTTTT TTGTTGGCGG TAACGATGTG

201    TTTGCCGTTT TCAATGGCTT TCAACACCGC ATCTTTGGCA ATGCCGGTAC

251    CGCCGAACAA TTCGACGACG ACATCGACGT CTTCACGTGC GACCAGTTCG

301    AACGGATCTT TGACAAAGGC TGCGGACGGG CAGGTTTGTC GGGCTTTTTC

351    TTCACTCAAA TCGCACACGG CAGAAATACG GATTTCGCGC CCCAAGCGAC

401    GGGAAATTTC CTCCGCGTTG TCCCGCAACA CGGCAGCCGT ACCGCCGCCG

451    ACCGTACCCA AACCTAAAAG ACCGATGTTT ACTGGCTTCA TTGTGTCTCC

501    TTGTAAGCCG ACTGAAATGT AA
```

This corresponds to the amino acid sequence <SEQ ID 1470; ORF 520-1.a>:

```
a520-1.pep
    1    MKLLVPLIMP AMDLILFAAK PSRRALMIGI PPATAASNWT MTFCFSASGK

51    ISLPYSASSF LLAVTMCLPF SMAFNTASLA MPVPPNNSTT TSTSSRATSS

101    NGSLTKAADG QVCRAFSSLK SHTAEIRISR PKRREISSAL SRNTAAVPPP

151    TVPKPKRPMF TGFIVSPCKP TEM*
``` m520-1/a520-1 100.0% identity in 173 aa overlap

```
                    10         20         30         40         50         60
a520-1.pep   MKLLVPLIMPAMDLILFAAKPSRRALMIGIPPATAASNWTMTFCFSASGKISLPYSASSF
             ||||||||||||||||||||||||||||||||||||||||||||||||||||||||||||
m520-1       MKLLVPLIMPAMDLILFAAKPSRRALMIGIPPATAASNWTMTFCFSASGKISLPYSASSF
                    10         20         30         40         50         60

70         80         90        100        110        120
a520-1.pep   LLAVTMCLPFSMAFNTASLAMPVPPNNSTTTSTSSRATSSNGSLTKAADGQVCRAFSSLK
             ||||||||||||||||||||||||||||||||||||||||||||||||||||||||||||
m520-1       LLAVTMCLPFSMAFNTASLAMPVPPNNSTTTSTSSRATSSNGSLTKAADGQVCRAFSSLK
                    70         80         90        100        110        120
```

```
                  130        140        150        160        170
a520-1.pep  SHTAEIRISRPKRREISSALSRNTAAVPPPTVPKPKRPMFTGFIVSPCKPTEMX
            ||||||||||||||||||||||||||||||||||||||||||||||||||||||
m520-1      SHTAEIRISRPKRREISSALSRNTAAVPPPTVPKPKRPMFTGFIVSPCKPTEMX
                  130        140        150        160        170
```

The following partial DNA sequence was identified in *N. gonorrhoeae* <SEQ ID 1471>:

```
g521.seq
    1   ATGAAATCAA AACTCCCCTT AATCCTAATC AACCTTTCCC TGATTTCAAG

51   CCCATTGGGT GCGAATGCGG CCAAAATCTA TACCTGCACA ATCAACGGAG

101   AAACCGTTTA CACCACCAAG CCGTCTAAAA GCTGCCACTC AACCGATTTG

151   CCCCCAATCG GCAACTACAG CAGCGAACGC TATATCCTGC CCCAAACTCC

201   CGAACCGGCA CCATCACCGT CAAACGGCGG ACAGGCTGTC AAATATAAAG

251   CCCCGGTCAA AACAGTATCC AAGCCGGCAA AATCCAATAC GCCGCCTCAA

301   CAAGCACCTG TAAATAACAG CAGACGCTCC ATTCTcgaag caGaattaag 351   cAatgaacgc aaagccctGa ctGaAGCCCA AAAAATGTTA TCACAagcac 401   gtCtGGCAAA AGGCGgcaAC AtcaaCCatc aaaAaatcaa cgcattgtaa 451   AGCAATGTTt tggacAGACA GCAAAATaTC Caagcactgc aaaGAgAATt

501   GGGACGTATG TAA
```

This corresponds to the amino acid sequence <SEQ ID 1472; ORF 521.ng>:

```
g521n.pep
    1   MKSKLPLILI NLSLISSPLG ANAAKIYTCT INGETVYTTK PSKSCHSTDL

51   PPIGNYSSER YILPQTPEPA PSPSNGGQAV KYKAPVKTVS KPAKSNTPPQ

101   QAPVNNSRRS ILEAELSNER KALTEAQKML SQARLAKGGN INHQKINAL*

151   SNVLDRQQNI QALQRELGRM *
```

The following partial DNA sequence was identified in *N. meningitidis* <SEQ ID 1473>:

```
m521.seq
    1   ATGAAATCAA AACTCCTCTT AATCCTAATC AACTTTTCCC TGATTTCAAG

51   CCCATTGGGT GCGAATGCGG CCAAAATCTA sACCTGCACA ATCAACGGAG

101   AAACCGTTTA CACCAsCAAG CCGTCCAAAA GCTGCCACTC AACCGATTTG

151   CCCCCAATCG GCAACTACAG CAGCGAACGC TATATCCCGC CCCAAACGCC

201   CGAACCGGTA TCATCACCGT CAAACGGCGG ACwGGTTGTC AAATATAAAG

251   CCCCGGTCAA AACAGTATCC AAGCCGGCAA AATCCArTAC GCCGCCGCCG

301   CAACAAGCAC CCTCAAACAA CAGCAGACGC TCCATTCTCG AAACAGAATT

351   GAGCAACGAA CGCAAAGCAT TGGTTGAAGC CCAAAAAATG TTATCACAAG

401   CACGTCTGGC AAAGGGCGGC AACATCAACC ATCAAGAAAT AAATGCATTA

451   CAAAGCAATG TATTGGACAG GCAGCAAAAT ATTCAAGCCC TGCAAAGGGA

501   ACTGGGGCGT ATGTAA
```

This corresponds to the amino acid sequence <SEQ ID 1474; ORF 521>:

```
m521.pep
    1   MKSKLLLILI NFSLISSPLG ANAAKIXTCT INGETVYTXK PSKSCHSTDL

51   PPIGNYSSER YIPPQTPEPV SSPSNGGXVV KYKAPVKTVS KPAKSXTPPP

101   QQAPSNNSRR SILETELSNE RKALVEAQKM LSQARLAKGG NINHQEINAL

151   QSNVLDRQQN IQALQRELGR M*
```

Computer analysis of this amino acid sequence gave the following results:
Homology with a Predicted ORF from *N. gonorrhoeae*
ORF 521 shows 90.6% identity over a 171 aa overlap with a predicted ORF (ORF 521.ng) from *N. gonorrhoeae*:

```
      m521/g521
                      10         20         30         40         50         60
         m521.pep   MKSKLLLILINFSLISSPLGANAAKIXTCTINGETVYTXKPSKSCHSTDLPPIGNYSSER
                    |||||  ||||| :||||||||||||||| ||||||||| :||||||||||||||||||||
             g521   MKSKLPLILINLSLISSPLGANAAKIYTCTINGETVYTTKPSKSCHSTDLPPIGNYSSER
                      10         20         30         40         50         60
                      70         80         90        100        110        120
         m521.pep   YIPPQTPEPVSSPSNGGXVVKYKAPVKTVSKPAKSXTPPPQQAPSNNSRRSILETELSNE
                    || ||||||: |||||| :||||||||||||||| |||  ||||  :||||||:|||||
             g521   YILPQTPEPAPSPSNGGQAVKYKAPVKTVSKPAKSNTPP-QQAPVNNSRRSILEAELSNE
                      70         80         90        100        110
                     130        140        150        160        170
         m521.pep   RKALVEAQKMLSQARLAKGGNINHQEINALQSNVLDRQQNIQALQRELGRMX
                    ||||:|||||||||||||||:||||||||||: ||| ||||||||||||||||
             g521   RKALTEAQKMLSQARLAKGGNINHQKINALXSNVLDRQQNIQALQRELGRMX
                     120        130        140        150        160        170
```

The following partial DNA sequence was identified in *N. meningitidis* <SEQ ID 1475>:

```
a521.seq
    1   ATGAAATCAA AACTCCCCTT AATCCTAATC AACTTTTCCC TGATTTCAAG

51   CCCCATTGGGT GCGAATGCGG CCAAAATCTA CACCTGCACA ATCAACGGAG

101   AAACCGTTTA CACCACCAAG CCGTCCAAAA GCTGCCTCTC AACCGATTTG

151   CCCCCAATCG GCAACTACAG CAGCGAACGC TATATCCCGC CCAAACATC

201   CGAACCGACA CCATCACCGT CAAACGGCGG ACAGGCTGTC AAATATAAAG

251   CCCCGGTCAA AACAGTATCC AAGCCGGCAA AATCCAATAC GCCGCCGCCG

301   CAACAAGCAC CCTCAAACAA CAGCAGACGC TCCATTCTCG AAACAGAATT

351   GAGCAACGAA CGCAAAGCAT TGGTTGAAGC CCAAAAAATG TTATCACAAG

401   CACGTCTGGC AAAAGGCGGC AACATCAACC ATCAAGAAAT CAACGCATTG

451   CAAAGCAATG TATTGGACAG GCAGCAAAAT ATCCAAGCAC TGCAAAGAGA

501   ATTGGGACGT ATGTAA
```

This corresponds to the amino acid sequence <SEQ ID 1476; ORF 521.a>:

```
a521.pep
    1   MKSKLPLILI NFSLISSPLG ANAAKIYTCT INGETVYTTK PSKSCLSTDL

51   PPIGNYSSER YIPPQTSEPT PSPSNGGQAV KYKAPVKTVS KPAKSNTPPP

101   QQAPSNNSRR SILETELSNE RKALVEAQKM LSQARLAKGG NINHQEINAL

151   QSVLDRQQN IQALQRELGR M*
``` m521/a521 94.2% identity in 171 aa overlap

```
              10        20         30         40         50         60
m521.pep  MKSKLLLILINFSLISSPLGANAAKIXTCTINGETVYTXKPSKSCHSTDLPPIGNYSSER
          |||||  |||||||||||||||||||| |||||||||||||:|||||  |||||||||||
a521      MKSKLPLILINFSLISSPLGANAAKIYTCTINGETVYTTKPSKSCLSTDLPPIGNYSSER
              10        20         30         40         50         60

70        80         90        100        110        120
m521.pep  YIPPQTPEPVSSPSNGGXVVKYKAPVKTVSKPAKSXTPPPQQAPSNNSRRSILETELSNE
          ||||||  ||||||  ||::||||||||||||||| ||||||||||||||||||||||||
a521      YIPPQTSEPTPSPSNGGQAVKYKAPVKTVSKPAKSNTPPPQQAPSNNSRRSILETELSNE
              70        80         90        100        110        120

130       140        150        160        170
m521.pep  RKALVEAQLMLSQARLAKGGNINHQEINALQSNVLDRQQNIQALQRELGRMX
          ||||||||||||||||||||||||||||||||||||||||||||||||||||
a521      RKALVEAQLMLSQARLAKGGNINHQEINALQSNVLDRQQNIQALQRELGRMX
             130       140        150        160        170
```

The following partial DNA sequence was identified in *N. gonorrhoeae* <SEQ ID 1477>:

```
g522.seq
    1   atgactgagc cgaaacacga aacgccgacg gaagagcagg ttgccgcgcg
   51   caaaaaagca aaagccaaaa tccgcaccat ccgcatttgg gcgtgggtca
  101   ttttggcgtt gctcgcttca accgccctgc tctcccaatg cgcgatgtcc
  151   aaaccgcagg caaaacagaa aattgtcgag tcttgcatga aaatattcc
  201   gtttgctgaa aaatggcaga acgatttgaa agcgcgcggc ttggatgcgg
  251   acaatacccg tctcgccgtc gactactgca aatgtatgtg ggagcagcct
  301   ttggacggat tgagcgagaa acagatcagc tccttcggca aactcggtgc
  351   acaagaacag cttgacctgc tcggcggcgc aaacgcgttt gaaactcgag
  401   acaaacaatg tgtcgcggat ttgaaagccg attga
```

This corresponds to the amino acid sequence <SEQ ID 1478; ORF 522.ng>:

```
g522.pep
    1   MTEPKHETPT EEQVAARKKA KAKIRTIRIW AWVILALLAS TALLSQCAMS
   51   KPQAKQKIVE SCMKNIPFAE KWQNDLKARG LDADNTRLAV DYCKCMWEQP
  101   LDGLSEKQIS SFGKLGAQEQ LDLLGGANAF ETRDKQCVAD LKAD*
```

The following partial DNA sequence was identified in *N. meningitidis* <SEQ ID 1479>:

```
m522.seq
    1   ATGACTGAGC CGAAACACGA AATGCTGACG AAAGAGCAGG TTGCCGCGCG
   51   CAAAAAAGCA AAAGCCAAAA TCCGCACCAT CCGCATTTGG GCGTGGGTCA
  101   TTTTGGCGTT GCTCGCTTTA ACCGCCCTGC TCTCCCAATG CGCGATGTCC
  151   AAACCGCAGG CAAAACAGAA AATTGTCGAG TCTTGCGTGA AGAATATTCC
  201   GTTTGCCGAA AAATGGCAAA ACGATTTGCG GGCCCGCGGT TTAGATTCAA
  251   ACAATACCCG CCTCGCCGTC GACTACTGCA AATGTATGTG GGAGCAGCCT
  301   TTGGACAGAT TGAGCGAGAA ACAGATTAGA TCCTTCGGCA AACTCGGCGC
  351   ACAAGAACAG CTTGACCTGC TCGGCGGCGC AAATGCCTTT GAAGCACGTG
  401   ACAAGCAGTG TGTTGCCGAT TTGAAATCAG AATAA
```

This corresponds to the amino acid sequence <SEQ ID 1480; ORF 522>:

```
m522.pep
     1  MTEPKHEMLT KEQVAARKKA KAKIRTIRIW AWVILALLAL TALLSQCAMS

51  KPQAKQKIVE SCVKNIPFAE KWQNDLRARG LDSNNTRLAV DYCKCMWEQP

101  LDRLSEKQIR SFGKLGAQEQ LDLLGGANAF EARDKQCVAD LKSE*
```

Computer analysis of this amino acid sequence gave the following results:
Homology with a Predicted ORF from *N. gonorrhoeae*
ORF 522 shows 91.0% identity over a 144 aa overlap with a predicted ORF (ORF 522.ng) from *N. gonorrhoeae*:

```
m522/g522
                    10         20         30         40         50         60
   m522.pep  MTEPKHEMLTKEQVAARKKAKAKIRTIRIWAWVILALLALTALLSQCAMSKPQAKQKIVE
             ||||||| :||||||||||||||||||||||||||||| ||||||||||||||||||||
       g522  MTEPKHETPTEEQVAARKKAKAKIRTIRIWAWVILALLASTALLSQCAMSKPQAKQKIVE
                    10         20         30         40         50         60

70         80         90        100        110        120
   m522.pep  SCVKNIPFAEKWQNDLRARGLDSNNTRLAVDYCKCMWEQPLDRLSEKQIRSFGKLGAQEQ
             ||:|||||||||||||:|||||::||||||||||||||||||| ||||||:|||||||||
       g522  SCMKNIPFAEKWQNDLKARGLDADNTRLAVDYCKCMWEQPLDGLSEKQISSFGKLGAQEQ
                    70         80         90        100        110        120

130        140
   m522.pep  LDLLGGANAFEARDKQCVADLKSEX
             ||||||||||||:|||||||||||::
       g522  LDLLGGANAFETRDKQCVADLKAD
                   130        140
```

The following partial DNA sequence was identified in *N. meningitidis* <SEQ ID 1481>:

```
a522.seq
     1  ATGACTGAGC CGAAACACGA AATGCCGACG GAAGAGCAGG TTGCCGCGCG

51  CAAAAAAGCA AAAGCCAAAA TCCGCACCAT CCGCATTTGG GCATGGGTCA

101  TTTTGGCGTT GCTCGCTTCA ACCGCCCTGC TCTCCCAATG CGCGATGTCC

151  AAACCGCAGG CAAAACAGAA AATTGTCGAG TCTTGCGTGA AGAATATTCC

201  GTTTGCCGAA AAATGGCAAA ACGATTTGCG GGCCCGCGGT TTAGATTCAA

251  ACAATACCCG CCTTACCGTC GACTACTGCA AATGTATGTG GGAGCAGCCT

301  TTGGACAGAT TGAGCGAGAA ACAGATTAGT TCCTTCGGCA AACTCGGCGC

351  ACAAGAACAG CTTGACCTGC TCGGCGGCGC AAATGCCTTT GAAACGCGAG

401  ACAAGCAGTG TGTTGCCGAT TTGAAATCAG AATAA
```

This corresponds to the amino acid sequence <SEQ ID 1482; ORF 522.a>:

```
a522.pep
     1  MTEPKHEMPT EEQVAARKKA KAKIRTIRIW AWVILALLAS TALLSQCAMS

51  KPQAKQKIVE SCVKNIPFAE KWQNDLRARG LDSNNTRLTV DYCKCMWEQP

101  LDRLSEKQIS SFGKLGAQEQ LDLLGGANAF ETRDKQCVAD LKSE*
``` m522/a522 95.8% identity in 144 aa overlap

```
              10         20         30         40         50         60
m522.pep   MTEPKHEMLTKEQVAARKKAKAKIRTIRIWAWVILALLALTALLSQCAMSKPQAKQKIVE
           ||||||||  : |||||||||||||||||||||||||||  |||||||||||||||||||
a522       MTEPKHEMPTEEQVAARKKAKAKIRTIRIWAWVILALLASTALLSQCAMSKPQAKQKIVE
              10         20         30         40         50         60

70         80         90        100        110        120
m522.pep   SCVKNIPFAEKWQNDLRARGLDSNNTRLAVDYCKCMWEQPLDRLSEKQIRSFGKLGAQEQ
           ||||||||||||||||||||||||||||||| :|||||||||||||||| ||||||||||
a522       SCVKNIPFAEKWQNDLRARGLDSNNTRLTVDYCKCMWEQPLDRLSEKQISSFGKLGAQEQ
              70         80         90        100        110        120

130        140
m522.pep   LDLLGGANAFEARDKQCVADLKSEX
           ||||||||||| :||||||||||||
a522       LDLLGGANAFETRDKQCVADLKSEX
             130        140
```

The following partial DNA sequence was identified in *N. gonorrhoeae* <SEQ ID 1483>:

```
g523.seq
    1   atgactgtat ggtttgttgc cgctgttgcc gtcttaatca tcgaattatt 51   gacgggaacg gtttatcttt tggttgtcag cgcggctttg cggggttcgg 101   gcattgccta cgggctgact ggcagcacgc ctgccgccgt cttgaccgcc 151   gcactgcttt ccgcgctggg catttggttc gtacatgcca aaaccgccgt 201   gggaaaagtt gaaacggatt catatcagga tttggatacc ggaaaatatg 251   ccgaaatcct ccgatacaca ggcggcaacc gttacgaagt tttttatcgc 301   ggtacgcact ggcaggcgca aaatacgggg caggaagtgt tgaaccggg 351   aacgcgcgcc ctcatcgtcc gcaaagaagg taaccttctt atcatcgcaa 401   acccttaa
```

This corresponds to the amino acid sequence <SEQ ID 1484; ORF 523.ng>:

```
g523.pep
    1   MTVWFVAAVA VLIIELLTGT VYLLVVSAAL AGSGIAYGLT GSTPAAVLTA

51   ALLSALGIWF VHAKTAVGKV ETDSYQDLDT GKYAEILRYT GGNRYEVFYR

101   GTHWQAQNTG QEVFEPGTRA LIVRKEGNLL IIANP*
```

The following partial DNA sequence was identified in *N. meningitidis* <SEQ ID 1485>:

```
m523.seq (partial)
    1   ..GCCGTCTTAA TCATCGAATT ATTGACGGGA ACGGTTTATC TTTTGGTTGT 51   nAGCGCGGCT TTGGCGGGTT CGGGCATTGC TTACGGGCTG ACCGGCAGTA 101   CGCCTGCCGC CGTCTTGACC GnCGCTCTGC TTTCCGCGCT GGGTATTTnG

151   TTCGTACACG CCAAAACCGC CGTTAGAAAA GTTGAAACGG ATTCATATCA

201   GGATTTGGAT GCCGGACAAT ATGTCGAAAT CCTCCGACAC ACAGGCGGCA

251   ACCGTTACGA AGTTTTtTAT CGCGGTACGc ACTGGCAGGC TCAAAATACG

301   GGGCAAGAAG AGCTTGAACC AGGAACTCGC GCCCTCATTG TCCGCAAGGA

351   AGGCAACCTT CTTATTATCA CACACCCTTA A
```

This corresponds to the amino acid sequence <SEQ ID 1486; ORF 523>:

```
m523.pep (partial)
    1  ..AVLIIELLTG TVYLLVVSAA LAGSGIAYGL TGSTPAAVLT XALLSALGIX

51    FVHAKTAVRK VETDSYQDLD AGQYVEILRH TGGNRYEVFY RGTHWQAQNT

101    GQEELEPGTR ALIVRKEGNL LIITHP*
```

Computer analysis of this amino acid sequence gave the following results:
Homology with a Predicted ORF from *N. gonorrhoeae*
ORF523 shows 91.3% identity over a 126 aa overlap with a predicted ORF (ORF 523.ng) from *N. gonorrhoeae*:

```
m523/g523
                      10         20         30         40         50
   m523.pep       AVLIIELLTGTVYLLVVSAALAGSGIAYGLTGSTPAAVLTXALLSALGIXF
                  |||||||||||||||||||||||||||||||||||||||| |||||||||
   g523        MTVWFVAAVAVLIIELLTGTVYLLVVSAALAGSGIAYGLTGSTPAAVLTAALLSALGIXF
                     10         20         30         40         50         60

60         70         80         90        100        110
   m523.pep       VHAKTAVRKVETDSYQDLDAGQYVEILRHTGGNRYEVFYRGTHWQAQNTGQEELEPGTRA
                  ||||||||  ||||||||||||:|:|:||||:||||||||||||||||||||  ||||||
   g523          VHAKTAVGKVETDSYQDLDTGKYAEILRYTGGNRYEVFYRGTHWQAQNTGQEVFEPGTRA
                      70         80         90        100        110        120

120
   m523.pep       LIVRKEGNLLIITHP
                  |||||||||||||::|
   g523          LIVRKEGNLLIIANPX
                     130
```

The following partial DNA sequence was identified in *N. meningitidis* <SEQ ID 1487>:

```
a523.seq
    1    ATGACTGTAT GGTTTGTTGC CGCTGTTGCC GTCTTAATCA TCGAATTATT

51    GACGGGAACG GTTTATCTTT TGGTTGTCAG CGCGGCTTTG GCGGGTTCGG

101    GCATTGCTTA CGGGCTGACC GGCAGCACGC CTGCCGCCGT CTTGACCGCC

151    GCTCTGCTTT CCGCGCTGGG TATTTGGTTC GTACACGCCA AAACCGCCGT

201    GGGAAAAGTT GAAACGGATT CATATCAGGA TTTGGATGCC GGGCAATATG

251    CCGAAATCCT CCGGCACGCA GGCGGCAACC GTTACGAAGT TTTTTATCGC

301    GGTACGCACT GGCAGGCTCA AAATACGGGG CAAGAAGAGC TTGAACCAGG

351    AACGCGCGCC CTAATCGTCC GCAAGGAAGG CAACCTTCTT ATCATCGCAA

401    AACCTTAA
```

This corresponds to the amino acid sequence <SEQ ID 1488;
ORF 523.a>:

```
a523.pep
    1    MTVWFVAAVA VLIIELLTGT VYLLVVSAAL AGSGIAYGLT GSTPAAVLTA

51    ALLSALGIWF VHAKTAVGKV ETDSYQDLDA GQYAEILRHA GGNRYEVFYR

101    GTHWQAQNTG QEELEPGTRA LIVRKEGNLL IIAKP*
``` m523/a523 94.4% identity in 126 aa overlap

```
                      10         20         30         40         50
   m523.pep       AVLIIELLTGTVYLLVVSAALAGSGIAYGLTGSTPAAVLTXALLSALGIXF
                  |||||||||||||||||||||||||||||||||||||||| |||||||| |
   a523        MTVWFVAAVAVLIIELLTGTVYLLVVSAALAGSGIAYGLTGSTPAAVLTAALLSALGIWF
                     10         20         30         40         50         60
```

```
                    60         70         80         90        100        110
m523.pep    VHAKTAVRKVETDSYQDLDAGQYVEILRHTGGNRYEVFYRGTHWQAQNTGQEELEPGTRA
            ||||||  |||||||||||||||:|||||:||||||||||||||||||||||||||||||
a523        VHAKTAVGKVETDSYQDLDAGQYAEILRHAGGNRYEVFYRGTHWQAQNTGQEELEPGTRA
                    70         80         90        100        110        120

120
m523.pep    LIVRKEGNLLIITHPX
            |||||||||||||::||
a523        LIVRKEGNLLIIAKPX
                   130
```

The following partial DNA sequence was identified in *N. gonorrhoeae* <SEQ ID 1489>:

```
g525.seq
    1   atgaagtacg tccggttatt tttcctcggc acggcactcg ccggcactca
   51   agcggcggct gccgaaatgg ttcaaatcga aggcggcagc taccgcccgc
  101   tttatctgaa aaaagatacc ggcctgatta aagtcaaacc gttcaaactg
  151   gataaatatc ccgttaccaa tgccgagttt gccgaatttg tcaacagcca
  201   cccccaatgg caaaaggca ggatcggttc caaacaggca gaacccgctt
  251   acctgaagca ttggatgaaa acggcagcc gcagctatgc gccgaaggcg
  301   ggcgaattga acagccggt taccaatatt tcctggtttg ccgccaacgc
  351   ctattgcgcc gcacaaggca aacgcctgcc gaccatcgac gaatgggaat
  401   ttgccggact tgcttccgcc acgcagaaaa aacggctcaa acgaacccgg
  451   ctacaaccgc actattctcg attggtatgc cgacggcgga cggaaaggcc
  501   tgcacgatgt cggcaaagca ccgcccgaac tactggggtg tttatgatat
  551   gcacgggctg a
```

This corresponds to the amino acid sequence <SEQ ID 1490; ORF 525.ng>:

```
g525.pep
    1   MKYVRLFFLG TALAGTQAAA AEMVQIEGGS YRPLYLKKDT GLIKVKPFKL
   51   DKYPVTNAEF AEFVNSHPQW QKGRIGSKQA EPAYLKHWMK NGSRSYAPKA
  101   GELKQPVTNI SWFAANAYCA AQGKRLPTID EWEFAGLASA TQKKRLKRTR
  151   LQPHYSRLVC RRRTERPARC RQSTARTTGV FMICTG *
```

The following partial DNA sequence was identified in *N. meningitidis* <SEQ ID 1491>:

```
m525.seq
    1   ATGAAGTATG TCCGGTTATT TTwCCTCGGC GCGGCACTCG cCrrCACTCA
   51   ArCGGCGGCT GcCGAAATGG TTCAAATCGA AGGCGGCAgC TACCGCCCrC
  101   TTTATCTGAA AAAAGATACC GGCCTGATTA AAGTCAAACC GTTCAAACTG
  151   GATAAATATC CCGTTACCAA TGCCGAGTTT GCCGAATTTG TCAACAGCCA
  201   CCCCCAATGG CAAAAAGGCA GGATCGGTTC CAAACAGGCA GAACCCGCTT
  251   ACCTGAAGCA TTGGATGAAA AACGGCAGCC GCAGCTATGc GCCGAAGgCG
  301   GgCGAATTAA ACAACCGGT AACCAATGTT TCCTGGwTTG CCGCCAAcGC
  351   CTAtTGCGCC GCACAAGGCA AACGCCTGCC GACCATTGAC GAATGGGAAT
  401   TTGCCGGACT TGCTTCCGCC ACGCAGAAAA A.CGGCTCAA ACGAACCCGG
```

-continued

```
    451   CTACAACCGC ACTATTCTCG ATTGGTATGC CGACGGCGGA CGGAAAGGCC

501   TGCACGATGT CGGCA.AAGG CCGCCCGAAC TACTGGGGCG TTTATGATAT

551   GCACGGGCTG A
```

This corresponds to the amino acid sequence <SEQ ID 1492;
ORF 525>:

```
m525.pep
      1   MKYVRLFXLG AALAXTQXAA AEMVQIEGGS YRPLYLKKDT GLIKVKPFKL

51   DKYPVTNAEF AEFVNSHPQW QKGRIGSKQA EPAYLKHWMK NGSRSYAPKA

101   GELKQPVTNV SWXAANAYCA AQGKRLPTID EWEFAGLASA TQKXRLKRTR

151   LQPHYSRLVC RRRTERPARC RXKAARTTGA FMICTG*
```

Computer analysis of this amino acid sequence gave the following results:
Homology with a Predicted ORF from N. gonorrhoeae
ORF 525 shows 94.1% identity over a 186 aa overlap with a predicted ORF (ORF 525.ng) from N. gonorrhoeae:

```
    m525/g525
                       10         20         30         40         50         60
    m525.pep  MKYVRLFXLGAALAXTQXAAAEMVQIEGGSYRPLYLKKDTGLIKVKPFKLDKYPVTNAEF
              |||||||  ||:|||  |||||||||||||||||||||||||||||||||||||||||||
    g525      MKYVRLFFLGTALAATQXAAAEMVQIEGGSYRPLYLKKDTGLIKVKPFKLDKYPVTNAEF
                       10         20         30         40         50         60

70         80         90        100        110        120
    m525.pep  AEFVNSHPQWQKGRIGSKQAEPAYLKHWMKNGSRSYAPKAGELKQPVTNVSWXAANAYCA
              |||||||||||||||||||||||||||||||||||||||||||||||||||:||  ||||||
    g525      AEFVNSHPQWQKGRIGSKQAEPAYLKHWMKNGSRSYAPKAGELKQPVTNISWFAANAYCA
                       70         80         90        100        110        120

130        140        150        160        170        180
    m525.pep  AQGKRLPTIDEWEFAGLASATQKXRLKRTRLQPHYSRLVCRRRTERPARCRXKAARTTGA
              |||||||||||||||||||||||||||||||||||||||||||||||||||| ::||||:
    g525      AQGKRLPTIDEWEFAGLASATQKXRLKRTRLQPHYSRLVCRRRTERPARCRQSTARTTGV
                      130        140        150        160        170        180 m525.pep  FMICTGX
              |||||||
    g525      FMICTGX
```

The following partial DNA sequence was identified in N. meningitidis <SEQ ID 1493>:

```
a525.seq
      1   ATGAAGTTTA CCCGGTTACT CTTTCTCTGT GCGGCACTCG CCGGCACTCA

51   AGCGGCAGCT GCCGAAATGG TTCAAATCGA AGGCGGCAGC TACCGCCCGC

101   TTTATCTGAA AAAGATACC GGCCTGATTA AAGTCAAACC GTTCAAACTG

151   GATAAATATC CCGTTACCAA TGCCGAGTTT GCCGAATTTG TCAACAGCCA

201   CCCCCAATGG CAAAAGGCA GGATCGGTTC CAAACAGGCA GAACCCGCTT

251   ACCTGAAGCA TTGGATGAAA AACGGCAGCC GCAGCTATGC GCCGAAGGCG

301   GGCGATTTAA ACAACCGGT AACCAATGTT TCCTGGTTCG CCGCCAACGC

351   CTATTGCGCC GCACAAGGCA AACGCCTGCC GACCATTGAC GAATGGGAAT

401   TTGCCGGACT TGCCTCCGCC ACGCAG.AAA AACGGCTCAA ACGAACCCGG

451   CTACAACCGC ACTATTCTCG ACTGGTATGC GGATGGCGAC CGGAAAGACC

501   TGCACGATGT CGGCAAAG.G TCGCCCGAAC TACTGGGGCG TTTATGATAT

551   GCACGGTCTG A
```

This corresponds to the amino acid sequence <SEQ ID 1494; ORF 525.a>:

```
a525.pep
    1   MKFTRLLFLC AALAGTQAAA AEMVQIEGGS YRPLYLKKDT GLIKVKPFKL

51   DKYPVTNAEF AEFVNSHPQW QKGRIGSKQA EPAYLKHWMK NGSRSYAPKA

101   GDLKQPVTNV SWFAANAYCA AQGKRLPTID EWEFAGLASA TQXKRLKRTR

151   LQPHYSRLVC GWRPERPARC RQXVARTTGA FMICTV*
``` m525/a525 90.8% identity in 185 aa overlap

```
                    10         20         30         40         50         60
   m525.pep   MKYVRLFXLGAALAXTQXAAAEMVQIEGGSYRPLYLKKDTGLIKVKPFKLDKYPVTNAEF
              || ::||:  ||||  || ||||||||||||||||||||||||||||||||||||||||
   a525       MKFTRLLFLCAALAGTQAAAAEMVQIEGGSYRPLYLKKDTGLIKVKPFKLDKYPVTNAEF
                    10         20         30         40         50         60

70         80         90        100        110        120
   m525.pep   AEFVNSHPQWQKGRIGSKQAEPAYLKHWMKNGSRSYAPKAGELKQPVTNVSWXAANAYCA
              |||||||||||||||||||||||||||||||||||||||||:|||||||||| |||||||
   a525       AEFVNSHPQWQKGRIGSKQAEPAYLKHWMKNGSRSYAPKAGDLKQPVTNVSWFAANAYCA
                    70         80         90        100        110        120

130        140        150        160        170        180
   m525.pep   AQGKRLPTIDEWEFAGLASATQKXRLKRTRLQPHYSRLVCRRRTERPARCRXKAARTTGA
              ||||||||||||||||||||||| ||||||||||||||||| | |||||| :||||||||
   a525       AQGKRLPTIDEWEFAGLASATQXKRLKRTRLQPHYSRLVCGWRPERPARCRQXVARTTGA
                   130        140        150        160        170        180 m525.pep   FMICTGX
              |||||
   a525       FMICTVX
```

The following partial DNA sequence was identified in *N. gonorrhoeae* <SEQ ID 1495>:

```
g525-1.seq
    1   ATGAAGTACG TCCGGTTATT TTTCCTCGGC ACGGCACTCG CCGGCACTCA

51   AGCGGCGGCT GCCGAAATGG TTCAAATCGA AGGCGGCAGC TACCGCCCGC

101   TTTATCTGAA AAAAGATACC GGCCTGATTA AGTCAAACC GTTCAAACTG

151   GATAAATATC CCGTTACCAA TGCCGAGTTT GCCGAATTTG TCAACAGCCA

201   CCCCCAATGG CAAAAAGGCA GGATCGGTTC CAAACAGGCA GAACCCGCTT

251   ACCTGAAGCA TTGGATGAAA ACGGCAGCC GCAGCTATGC GCCGAAGGCG

301   GGCGAATTGA ACAGCCGGT TACCAATATT TCCTGGTTTG CCGCCAACGC

351   CTATTGCGCC GCACAAGGCA AACGCCTGCC GACCATCGAC GAATGGGAAT

401   TTGCCGGACT TGCTTCCGCC ACGCAGAAAA ACGGCTCAAA CGAACCCGGC

451   TACAACCGCA CTATTCTCGA TTGGTATGCC GACGGCGGAC GGAAAGGCCT

501   GCACGATGTC GGCAAAGACC GCCCGAACTA CTGGGGTGTT TATGATATGC

551   ACGGGCTGAT TGGGAATGG ACGGAAGATT TCAACAGCAG CCTGCTTTCT

601   TCCGGCAATG CCAACGCGCA AATGTTTTGC AGCGGCGCAT CTGTCGGGGC

651   GAGCGACTCG TCCAACTATG CCGCCTTCCT CCGCTACGGC ATCCGCACCA

701   GCCTGCAATC CAAATACGTC CTGCACAACT TGGGCTTCCG CTGCGCAAGC

751   CGATAA
```

This corresponds to the amino acid sequence <SEQ ID 1496; ORF 525-1.ng>:

```
g525-1.pep
     1    MKYVRLFFLG TALAGTQAAA AEMVQIEGGS YRPLYLKKDT GLIKVKPFKL

51    DKYPVTNAEF AEFVNSHPQW QKGRIGSKQA EPAYLKHWMK NGSRSYAPKA

101    GELKQPVTNI SWFAANAYCA AQGKRLPTID EWEFAGLASA TQKNGSNEPG

151    YNRTILDWYA DGGRKGLHDV GKDRPNYWGV YDMHGLIWEW TEDFNSSLLS

201    SGNANAQMFC SGASVGASDS SNYAAFLRYG IRTSLQSKYV LHNLGFRCAS

251    R*
```

The following partial DNA sequence was identified in *N. meningitidis* <SEQ ID 1497>:

```
m525-1.seq
     1    ATGAAGTATG TCCGGTTATT TTTCCTCGGC GCGGCACTCG CCGGCACTCA

51    AGCGGCGGCT GCCGAAATGG TTCAAATCGA AGGCGGCAGC TACCGCCCGC

101    TTTATCTGAA AAAAGATACC GGCCTGATTA AAGTCAAACC GTTCAAACTG

151    GATAAATATC CCGTTACCAA TGCCGAGTTT GCCGAATTTG TCAACAGCCA

201    CCCCCAATGG CAAAAAGGCA GGATCGGTTC CAAACAGGCA GAACCCGCTT

251    ACCTGAAGCA TTGGATGAAA AACGGCAGCC GCAGCTATGC GCCGAAGGCG

301    GGCGAATTAA AACAACCGGT AACCAATGTT TCCTGGTTTG CCGCCAACGC

351    CTATTGCGCC GCACAAGGCA AACGCCTGCC GACCATTGAC GAATGGGAAT

401    TTGCCGGACT TGCTTCCGCC ACGCAGAAAA ACGGCTCAAA CGAACCCGGC

451    TACAACCGCA CTATTCTCGA TTGGTATGCC GACGGCGGAC GGAAAGGCCT

501    GCACGATGTC GGCAAAGGCC GCCCGAACTA CTGGGGCGTT TATGATATGC

551    ACGGGCTGAT TTGGGAATGG ACGGAAGATT TCAACAGCAG CCTGCTTTCT

601    TCCGGCAATG CCAACGCGCA AATGTTTTGC AGCGGCGCGT CTATCGGGTC

651    GAGCGACTCG TCCAACTATG CCGCCTTCCT CCGCTACGGC ATCCGTACCA

701    GCCTGCAATC CAAATATGTC TTGCACAACT TGGGCTTCCG TTGCACAAGC

751    CGATAA
```

This corresponds to the amino acid sequence <SEQ ID 1498; ORF 525-1>:

```
m525-1.pep
     1    MKYVRLFFLG AALAGTQAAA AEMVQIEGGS YRPLYLKKDT GLIKVKPFKL

51    DKYPVTNAEF AEFVNSHPQW QKGRIGSKQA EPAYLKHWMK NGSRSYAPKA

101    GELKQPVTNV SWFAANAYCA AQGKRLPTID EWEFAGLASA TQKNGSNEPG

151    YNRTILDWYA DGGRKGLHDV GKGRPNYWGV YDMHGLIWEW TEDFNSSLLS

201    SGNANAQMFC SGASIGSSDS SNYAAFLRYG IRTSLQSKYV LHNLGFRCTS

251    R*
``` m525-1/a525-1 97.6% identity in 251 aa overlap

```
                         10        20        30        40        50        60
m525-1.pep    MKYVRLFFLGAALAGTQAAAAEMVQIEGGSYRPLYLKKDTGLIKVKPFKLDKYPVTNAEF
              ||||||||||:|||||||||||||||||||||||||||||||||||||||||||||||||
g525-1        MKYVRLFFLGTALAGTQAAAAEMVQIEGGSYRPLYLKKDTGLIKVKPFKLDKYPVTNAEF
                         10        20        30        40        50        60
```

```
                70        80        90       100       110       120
m525-1.pep  AEFVNSHPQWQKGRIGSKQAEPAYLKHWMKNGSRSYAPKAGELKQPVTNVSWFAANAYCA
            ||||||||||||||||||||||||||||||||||||||||||||||||:||||||||||
g525-1      AEFVNSHPQWQKGRIGSKQAEPAYLKHWMKNGSRSYAPKAGELKQPVTNISWFAANAYCA
                70        80        90       100       110       120

130       140       150       160       170       180
m525-1.pep  AQGKRLPTIDEWEFAGLASATQKNGSNEPGYNRTILDWYADGGRKGLHDVGKGRPNYWGV
            |||||||||||||||||||||||||||||||||||||||||||||||||||| ||||||
g525-1      AQGKRLPTIDEWEFAGLASATQKNGSNEPGYNRTILDWYADGGRKGLHDVGKDRPNYWGV
               130       140       150       160       170       180

190       200       210       220       230       240
m525-1.pep  YDMHGLIWEWTEDFNSSLLSSGNANAQMFCSGASIGSSDSSNYAAFLRYGIRTSLQSKYV
            |||||||||||||||||||||||||||||||||||:|:||||||||||||||||||||||
g525-1      YDMHGLIWEWTEDFNSSLLSSGNANAQMFCSGASVGASDSSNYAAFLRYGIRTSLQSKYV
               190       200       210       220       230       240

250
m525-1.pep  LHNLGFRCTSRX
            |||||||:|||
g525-1      LHNLGFRCASRX
               250
```

The following partial DNA sequence was identified in *N. meningitidis* <SEQ ID 1499>:

```
a525-1.seq
     1    ATGAAGTTTA CCCGGTTACT CTTTCTCTGT GCGGCACTCG CCGGCACTCA

51    AGCGGCAGCT GCCGAAATGG TTCAAATCGA AGGCGGCAGC TACCGCCCGC

101    TTTATCTGAA AAAGATACC GGCCTGATTA AAGTCAAACC GTTCAAACTG

151    GATAAATATC CCGTTACCAA TGCCGAGTTT GCCGAATTTG TCAACAGCCA

201    CCCCCAATGG CAAAAAGGCA GGATCGGTTC CAAACAGGCA GAACCCGCTT

251    ACCTGAAGCA TTGGATGAAA AACGGCAGCC GCAGCTATGC GCCGAAGGCG

301    GGCGATTTAA ACAACCGGT AACCAATGTT TCCTGGTTCG CCGCCAACGC

351    CTATTGCGCC GCACAAGGCA AACGCCTGCC GACCATTGAC GAATGGGAAT

401    TTGCCGGACT TGCCTCCGCC ACGCAGAAAA ACGGCTCAAA CGAACCCGGC

451    TACAACCGCA CTATTCTCGA CTGGTATGCG GATGGCGACC GGAAAGACCT

501    GCACGATGTC GGCAAAGGTC GCCCGAACTA CTGGGGCGTT TATGATATGC

551    ACGGTCTGAT TTGGGAATGG ACGGAAGATT TCAACAGCAG CCTGCTTTCT

601    TCCGGCAATG CCAACGCGCA AATGTTTTGC AGCGGCGCGT CTATCGGGTC

651    GAGCGACTCG TCCAACTATG CCGCCTTCCT CCGCTACGGC ATCCGCACCA

701    GCCTGCAATC CAAATATGTC TTGCACAACT TGGGCTTCCG TTGCACAAGC

751    CGATAA
```

This corresponds to the amino acid sequence <SEQ ID 1500; ORF 525-1.a>:

```
a525-1.pep
     1    MKFTRLLFLC AALAGTQAAA AEMVQIEGGS YRPLYLKKDT GLIKVKPFKL

51    DKYPVTNAEF AEFVNSHPQW QKGRIGSKQA EPAYLKHWMK NGSRSYAPKA

101    GDLKQPVTNV SWFAANAYCA AQGKRLPTID EWEFAGLASA TQKNGSNEPG

151    YNRTILDWYA DGDRKDLHDV GKGRPNYWGV YDMHGLIWEW TEDFNSSLLS

201    SGNANAQMFC SGASIGSSDS SNYAAFLRYG IRTSLQSKYV LHNLGFRCTS

251    R*
``` m525-1/a525-1 97.2% identity in 251 aa overlap

```
                  10        20        30        40        50        60
m525-1.pep  MKYVRLFFLGAALAGTQAAAAEMVQIEGGSYRPLYLKKDTGLIKVKPFKLDKYPVTNAEF
            ||::||:|| |||||||||||||||||||||||||||||||||||||||||||||||||
a525-1      MKFTRLLFLCAALAGTQAAAAEMVQIEGGSYRPLYLKKDTGLIKVKPFKLDKYPVTNAEF
                  10        20        30        40        50        60

70        80        90       100       110       120
m525-1.pep  AEFVNSHPQWQKGRIGSKQAEPAYLKHWMKNGSRSYAPKAGELKQPVTNVSWFAANAYCA
            |||||||||||||||||||||||||||||||||||||||:||||||||||||||||||||
a525-1      AEFVNSHPQWQKGRIGSKQAEPAYLKHWMKNGSRSYAPKAGDLKQPVTNVSWFAANAYCA
                  70        80        90       100       110       120

130       140       150       160       170       180
m525-1.pep  AQGKRLPTIDEWEFAGLASATQKNGSNEPGYNRTILDWYADGGRKGLHDVGKGRPNYWGV
            ||||||||||||||||||||||||||||||||||||||||||  || |||||||||||||
a525-1      AQGKRLPTIDEWEFAGLASATQKNGSNEPGYNRTILDWYADGDRKDLHDVGKGRPNYWGV
                 130       140       150       160       170       180

190       200       210       220       230       240
m525-1.pep  YDMHGLIWEWTEDFNSSLLSSGNANAQMFCSGASIGSSDSSNYAAFLRYGIRTSLQSKYV
            ||||||||||||||||||||||||||||||||||||||||||||||||||||||||||||
a525-1      YDMHGLIWEWTEDFNSSLLSSGNANAQMFCSGASIGSSDSSNYAAFLRYGIRTSLQSKYV
                 190       200       210       220       230       240

250
m525-1.pep  LHNLGFRCTSRX
            ||||||||||||
a525-1      LHNLGFRCTSRX
                 250
```

The following partial DNA sequence was identified in *N. gonorrhoeae* <SEQ ID 1501>:

```
g527.seq
     1  atggttttac cagtctcctt ttttcagcct gtccagttgg cggcggtcgc
    51  gcttggtcgg tctgccgtcg ggatgggcgg aagtgatgcg gctgaattgg
   101  tcgagctgtt tgcactcttc cctcaatgct gccgttttcg cgtcttcttc
   151  atacagaagc cgcgcctcgg gtgccgggcg gcgttggtgg ttcaaacctt
   201  taaccttgat tttatgggga agggaattga gcgtcaggtc gataatatcg
   251  ccgatgtcta tggttttact gtttttgact ttcgagccgt ttacttgaac
   301  cctacccagt tcgatatgct tttgcgcaag ggaacgggtc ttgaaaaaac
   351  gtgccgccca aagccatttg tccagccgca tggcggaaga atcgtgcttg
   401  tctttcatac gattttgttt gaaataattg aatttgtttc gagtttagca
   451  taa
```

This corresponds to the amino acid sequence <SEQ ID 1502; ORF 527.ng>:

```
g527.pep
     1  MVLPVSFFQP VQLAAVALGR SAVGMGGSDA AELVELFALF PQCCRFRVFF
    51  IQKPRLGCRA ALVVQTFNLD FMGKGIERQV DNIADVYGFT VFDFRAVYLN
   101  PTQFDMLLRK GTGLEKTCRP KPFVQPHGGR IVLVFHTILF EIIEFVSSLA
   151  *
```

The following partial DNA sequence was identified in *N. meningitidis* <SEQ ID 1503>:

```
m527.seq
     1  ATGGTTTTAC CAGTCTCCTT TTTTCAGCCT GTCCAGTTGG CGGCGGTCGC
    51  GCTTGGTCGG TCTGCCGTCG GGATAGGCGG AAGTGATGCG GCTGAATTGG
   101  TCGAGCTGTT TGCGCTCTTC CCTCAATGTT GCCGTTwTCG CGTCCTCTTC
```

-continued

```
  151    ATACAGAAGC CGCGCyTCGG ATGCCGGGCG GCGTTGGTGG TTCAAACCTT

201    TAACCkTGAT TTTATAGGGA AGGG.AATTk AgCkTCaGTy GrTwATaTCG

251    CsGATGTmTA TGGTTTTACT GTTTTTGACC TTCGAGCCGT TTACTTGAAC

301    CCTACCCAGT TCGATGTGCT TTTGCGCAAG GGAACGGGTC TTGAAAAAAC

351    GTGCCGCCCA AAGCCATTTG TCCAGCCGCA TGGCGGAAGA ATCGTGCTTG

401    TCTTTCATAC GATTTTGTTT GAAATAATTG AATTTGTTTC GAGTTTAGCA

451    TAA
```

This corresponds to the amino acid sequence <SEQ ID 1504; ORF 527>:

```
m527pep
    1    MVLPVSFFQP VQLAAVALGR SAVGIGGSDA AELVELFALF PQCCRXRVLF

51    IQKPRXGCRA ALVVQTFNXD FIGKXNXASV XXIADVYGFT VFDLRAVYLN

101    PTQFDVLLRK GTGLEKTCRP KPFVQPHGGR IVLVFHTILF EIIEFVSSLA

151    *
```

Computer analysis of this amino acid sequence gave the following results:
Homology with a Predicted ORF from *N. gonorrhoeae*
ORF 527 shows 90.0% identity over a 150 aa overlap with a predicted ORF (ORF 527.ng) from *N. gonorrhoeae*:

```
   m527/g527
                    10         20         30         40         50         60
    m527.pep   MVLPVSFFQPVQLAAVALGRSAVGIGGSDAAELVELFALFPQCCRXRVLFIQKPRXGCRA
               ||||||||||||||||||||||||||:|||||||||||||||||||||| ||:|||||| ||||
    g527       MVLPVSFFQPVQLAAVALGRSAVGMGGSDAAELVELFALFPQCCRFRVFFIQKPRLGCRA
                    10         20         30         40         50         60

70         80         90        100        110        120
    m527.pep   ALVVQTFNXDFIGKXNXASVXXIADVYGFTVFDLRAVYLNPTQFDVLLRKGTGLEKTCRP
               |||||||| ||:||    :|   ||||||||||||:|||||||||||:||||||||||||
    g527       ALVVQTFNLDFMGKGIERQVDNIADVYGFTVFDFRAVYLNPTQFDMLLRKGTGLEKTCRP
                    70         80         90        100        110        120

130        140        150
    m527.pep   KPFVQPHGGRIVLVFHTILFEIIEFVSSLA
               |||||||||||||||||||||||||||||
    g527       KPFVQPHGGRIVLVFHTILFEIIEFVSSLA
                   130        140        150
```

The following partial DNA sequence was identified in *N. meningitidis* <SEQ ID 1505>:

```
a527.seq
    1    ATGGTTTTAC CAGTCTCCTT TTTTCAGCCT GTCCAGTTGG CGGCGGTCGC

51    GCTTGGTCGG TCTGCCGTCG GGATAGGCGG AAGTGATGCG GCTGAATTGG

101    TCGAGCTGTT TGCGCTCTTC CCTCAATGTT GCCGTTTTCG CGTCCTCTTC

151    ATACAGAAGC CGCGCCTCGG ATGCCGGGCG GCGTTGGTGG TTCAAACCTT

201    TAACCTTGAT TTTATAGGGA AGGGAATTGA GCGTCAGGTC GATAATATCG

251    CCGATGTCTA TGGTTTTACT GTTTTTGACC TTCGAGCCGT TTACTTGAAC

301    CCTACCCAGT TCGATGTGCT TTTGCGCAAG GGAACGGGTC TTGAAAAAAC

351    GTGCCGCCCA AAGCCATTTG TCCAGCCGCA TGGCGGAAGA ATCGTGCTTG
```

-continued

```
401 TCTTTCATAC GATTTTGTTT GAAATAATTG AATTTGTTTC GAGTTTAGCA

451 TAA
```

This corresponds to the amino acid sequence <SEQ ID 1506; ORF 527.a>:

```
a527.pep
    1   MVLPVSFFQP VQLAAVALGR SAVGIGGSDA AELVELFALF PQCCRFRVLF

51   IQKPRLGCRA ALVVQTFNLD FIGKGIERQV DNIADVYGFT VFDLRAVYLN

101   PTQFDVLLRK GTGLEKTCRP KPFVQPHGGR IVLVFHTILF EIIEFVSSLA

151   *
``` m527/a527 93.3% identity in 150 aa overlap

```
                  10        20        30        40        50        60
    m527.pep  MVLPVSFFQPVQLAAVALGRSAVGIGGSDAAELVELFALFPQCCRXRVLFIQKPRXGCRA
              ||||||||||||||||||||||||||||||||||||||||||||| |||||||||| |||
    a527      MVLPVSFFQPVQLAAVALGRSAVGIGGSDAAELVELFALFPQCCRFRVLFIQKPRLGCRA
                  10        20        30        40        50        60

70        80        90       100       110       120
    m527.pep  ALVVQTFNXDFIGKXNXASVXXIADVYGFTVFDLRAVYLNPTQFDVLLRKGTGLEKTCRP
              ||||||||| |||||    :| |||||||||||||||||||||||||||||||||||||
    a527      ALVVQTFNLDFIGKGIERQVDNIADVYGFTVFDLRAVYLNPTQFDVLLRKGTGLEKTCRP
                  70        80        90       100       110       120

130       140       150
    m527.pep  KPFVQPHGGRIVLVFHTILFEIIEFVSSLAX
              ||||||||||||||||||||||||||||||
    a527      KPFVQPHGGRIVLVFHTILFEIIEFVSSLAX
                 130       140       150
```

The following partial DNA sequence was identified in *N. gonorrhoeae* <SEQ ID 1507>:

```
g528.seq
    1   atggaaattc gggtaataaa atatacggca acggctgcgt tgtttgcatt 51   tacggttgca ggctgccggc tggcggggtg gtatgagtgt ttgtccttgt 101   ccggctggtg taagccgaga aaacctgccg ccatcgattt ttgggatatt 151   ggcggcgaga gtccgctgtc tttagaggac tacgagatac cgctttcaga 201   cggcaatcgt tccgtcaggg caaacgaata tgaatccgcg caaaaatctt 251   actttttatag gaaaataggg aagtttgaag cctgcgggtt ggattggcgt 301   acgcgtgacg gcaaaccttt ggttgagagg ttcaaacagg aaggtttcga 351   ctgtttggaa aagcaggggt tgcggcgcaa cggcctgtcc gagcgcgtcc 401   gatggtaa
```

This corresponds to the amino acid sequence <SEQ ID 1508; ORF 528.ng>:

```
g528.pep
    1   MEIRVIKYTA TAALFAFTVA GCRLAGWYEC LSLSGWCKPR KPAAIDFWDI

51   GGESPLSLED YEIPLSDGNR SVRANEYESA QKSYFYRKIG KFEACGLDWR

101   TRDGKPLVER FKQEGFDCLE KQGLRRNGLS ERVRW*
```

The following partial DNA sequence was identified in *N. meningitidis* <SEQ ID 1509>:

```
m528.seq (partial)
    1   ATGGAAATTC GGGCAATAAA ATATACGGCA ATGGCTGCGT TGCTTGCATT

51   TACGGTTGCA GGCTGCCGGC TGGCGGGGTG GTATGAGTGT TCGTCCCTCA

101   CCGGCTGGTG TAAGCCGAGA AAACCGGCTG CCATCGATTT TTGGGATATT

151   GGCGGCGAGA GTCCGCCGTC TTTAGGGGAC TACGAGATAC CGCTTTCAGA

201   CGGCAATAGT TCCGTCAGGG CAAACGAATA TGAATCCGCA CAACAATCTT

251   ACTTTTACAG GAAAATAGGG AAGTTTGAAG C.TGCGGGCT GGATTGGCGT

301   ACGCGTGACG GCAAACCTTT GATTGAGACG TTCAAACAGG GAGGATTTGA

351   CTGCTTGGAA AAG....
```

This corresponds to the amino acid sequence <SEQ ID 1510; ORF 528>:

```
m528.pep (partial)
    1   MEIRAIKYTA MAALLAFTVA GCRLAGWYEC SSLTGWCKPR KPAAIDFWDI

51   GGESPPSLGD YEIPLSDGNS SVRANEYESA QQSYFYRKIG KFEXCGLDWR

101   TRDGKPLIET FKQGGFDCLE K....
```

Computer analysis of this amino acid sequence gave the following results:
Homology with a Predicted ORF from *N. gonorrhoeae*
ORF 528 shows 89.3% identity over a 121 aa overlap with a predicted ORF (ORF 528.ng) from *N. gonorrhoeae*:

```
m528/g528
                  10         20         30         40         50         60
m528.pep  MEIRAIKYTAMAALLAFTVAGCRLAGWYECSSLTGWCKPRKPAAIDFWDIGGESPPSLGD
          ||||:||||| |||:||||||||||||||| ||:||||||||||||||||||||| || |
g528      MEIRVIKYTATAALFAFTVAGCRLAGWYECLSLSGWCKPRKPAAIDFWDIGGESPLSLED
                  10         20         30         40         50         60

70         80         90        100        110        120
m528.pep  YEIPLSDGNSSVRANEYESAQQSYFYRKIGKFEXCGLDWRTRDGKPLIETFKQGGFDCLE
          ||||||||| |||||||||||:|||||||||||| ||||||||||||:| ||| ||||||
g528      YEIPLSDGNRSVRANEYESAQKSYFYRKIGKFEACGLDWRTRDGKPLVERFKQEGFDCLE
                  70         80         90        100        110        120 m528.pep  K
          |
g528      KQGLRRNGLSERVRW
```

The following partial DNA sequence was identified in *N. meningitidis* <SEQ ID 1511>:

```
a528.seq
    1   ATGGAAATTC GGGCAATAAA ATATACGGCA ATGGCTGCGT TGCTTGCATT

51   TACGGTTGCA GGCTGCCGGT TGGCAGGTTG GTATGAGTGT TCGTCCCTGT

101   CCGGCTGGTG TAAGCCGAGA AAACCTGCCG CCATCGATTT TTGGGATATT

151   GGCGGCGAGA GTCCTCCGTC TTTAGAGGAC TACGAGATAC CGCTTTCAGA

201   CGGCAATCGT TCCGTCAGGG CAAACGAATA TGAATCCGCA CAACAATCTT

251   ACTTTTACAG GAAAATAGGG AAGTTTGAAG CCTGCGGGTT GGATTGGCGT

301   ACGCGTGACG GCAAACCTTT GATTGAGACG TTCAAACAGG AAGGTTTTGA

351   TTGTTTGAAA AAGCAGGGGT TGCGGCGCAA CGGTCTGTCC GAGCGCGTCC

401   GATGGTAA
```

This corresponds to the amino acid sequence <SEQ ID 1512; ORF 528.a>:

```
a528.pep
    1    MEIRAIKYTA MAALLAFTVA GCRLAGWYEC SSLSGWCKPR KPAAIDFWDI

51    GGESPPSLED YEIPLSDGNR SVRANEYESA QQSYFYRKIG KFEACGLDWR

101    TRDGKPLIET FKQEGFDCLK KQGLRRNGLS ERVRW*
``` m528/a528 95.0% identity in 121 aa overlap

```
                 10        20        30        40        50        60
   m528.pep  MEIRAIKYTAMAALLAFTVAGCRLAGWYECSSLTGWCKPRKPAAIDFWDIGGESPPSLGD
             ||||||||||||||||||||||||||||||||:|||||||||||||||||||||||||| |
   a528      MEIRAIKYTAMAALLAFTVAGCRLAGWYECSSLSGWCKPRKPAAIDFWDIGGESPPSLED
                 10        20        30        40        50        60

70        80        90       100       110       120
   m528.pep  YEIPLSDGNSSVRANEYESAQQSYFYRKIGKFEXCGLDWRTRDGKPLIETFKQGGFDCLE
             ||||||||||  |||||||||||  |||||||||||||| |||||||||||||||| |||:
   a528      YEIPLSDGNRSVRANEYESAQqSYFYRKIGKFEACGLDWRTRDGKPLIETFKQEGFDCLK
                 70        80        90       100       110       120 m528.pep  K
             |
   a528      KQGLRRNGLSERVRWX
                     130
```

The following partial DNA sequence was identified in *N. gonorrhoeae* <SEQ ID 1513>:

```
g528-1.seq
    1    ATGGAAATTC GGGTAATAAA ATATACGGCA ACGGCTGCGT TGTTTGCATT

51    TACGGTTGCA GGCTGCCGGC TGGCGGGGTG GTATGAGTGT TCGTCCTTGT

101    CCGGCTGGTG TAAGCCGAGA AAACCTGCCG CCATCGATTT TTGGGATATT

151    GGCGGCGAGA GTCCGCTGTC TTTAGAGGAC TACGAGATAC CGCTTTCAGA

201    CGGCAATCGT TCCGTCAGGG CAAACGAATA TGAATCCGCG CAAAAATCTT

251    ACTTTTATAG GAAAATAGGG AAGTTTGAAG CCTGCGGGTT GGATTGGCGT

301    ACGCGTGACG GCAAACCTTT GGTTGAGAGG TTCAAACAGG AAGGTTTCGA

351    CTGTTTGGAA AAGCAGGGGT TGCGGCGCAA CGGCCTGTCC GAGCGCGTCC

401    GATGGTAA
```

This corresponds to the amino acid sequence <SEQ ID 1514; ORF 528-1.ng>:

```
g528-1.pep
    1    MEIRVIKYTA TAALFAFTVA GCRLAGWYEC SSLSGWCKPR KPAAIDFWDI

51    GGESPLSLED YEIPLSDGNR SVRANEYESA QKSYFYRKIG KFEACGLDWR

101    TRDGKPLVER FKQEGFDCLE KQGLRRNGLS ERVRW*
```

The following partial DNA sequence was identified in *N. meningitidis* <SEQ ID 1515>:

```
m528-1.seq
    1    ATGGAAATTC GGGCAATAAA ATATACGGCA ATGGCTGCGT TGCTTGCATT

51    TACGGTTGCA GGCTGCCGGC TGGCGGGGTG GTATGAGTGT TCGTCCCTCA

101    CCGGCTGGTG TAAGCCGAGA AAACCGGCTG CCATCGATTT TTGGGATATT

151    GGCGGCGAGA GTCCGCCGTC TTTAGGGGAC TACGAGATAC CGCTTTCAGA

201    CGGCAATCGT TCCGTCAGGG CAAACGAATA TGAATCCGCA CAACAATCTT
```

```
                                -continued
      251   ACTTTTACAG GAAAATAGGG AAGTTTGAAG CCTGCGGGCT GGATTGGCGT

301   ACGCGTGACG GCAAACCTTT GATTGAGACG TTCAAACAGG GAGGATTTGA

351   CTGCTTGGAA AAGCAGGGGT TGCGGCGCAA CGGTCTGTCC GAGCGCGTCC

401   GATGGTAA
```

This corresponds to the amino acid sequence <SEQ ID 1516; ORF 528-1>:

```
m528-1.pep..
       1        MEIRAIKYTA MAALLAFTVA GCRLAGWYEC SSLTGWCKPR KPAAIDFWDI

51        GGESPPSLGD YEIPLSDGNR SVRANEYESA QQSYFYRKIG KFEACGLDWR

101        TRDGKPLIET FKQGGFDCLE KQGLRRNGLS ERVRW*
``` g528-1/m528-1 92.6% identity in 135 aa overlap

```
                         10         20         30         40         50         60
    g528-1.pep   MEIRVIKYTATAALFAFTVAGCRLAGWYECSSLSGWCKPRKPAAIDFWDIGGESPLSLED
                 ||||:||||| |||:||||||||||||||||||:|||||||||||||||||||||| ||  |
    m528-1       MEIRAIKYTAMAALLAFTVAGCRLAGWYECSSLTGWCKPRKPAAIDFWDIGGESPPSLGD
                         10         20         30         40         50         60
                         70         80         90        100        110        120
    g528-1.pep   YEIPLSDGNRSVRANEYESAQKSYFYRKIGKFEACGLDWRTRDGKPLVERFKQEGFDCLE
                 ||||||||||||||||||||:|||||||||||||||||||||||||:| ||| ||||||
    m528-1       YEIPLSDGNRSVRANEYESAQQSYFYRKIGKFEACGLDWRTRDGKPLIETFKQGGFDCLE
                         70         80         90        100        110        120
                        130
    g528-1.pep   KQGLRRNGLSERVRWX
                 ||||||||||||||||
    m528-1       KQGLRRNGLSERVRWX
                        130
```

The following partial DNA sequence was identified in *N. meningitidis* <SEQ ID 1517>:

```
a528-1.seq
       1        ATGGAAATTC GGGCAATAAA ATATACGGCA ATGGCTGCGT TGCTTGCATT

51        TACGGTTGCA GGCTGCCGGT TGGCAGGTTG GTATGAGTGT TCGTCCCTGT

101        CCGGCTGGTG TAAGCCGAGA AAACCTGCCG CCATCGATTT TTGGGATATT

151        GGCGGCGAGA GTCCTCCGTC TTTAGAGGAC TACGAGATAC CGCTTTCAGA

201        CGGCAATCGT TCCGTCAGGG CAAACGAATA TGAATCCGCA CAACAATCTT

251        ACTTTTACAG GAAAATAGGG AAGTTTGAAG CCTGCGGGTT GGATTGGCGT

301        ACGCGTGACG GCAAACCTTT GATTGAGACG TTCAAACAGG AAGGTTTTGA

351        TTGTTTGAAA AAGCAGGGGT TGCGGCGCAA CGGTCTGTCC GAGCGCGTCC

401        GATGGTAA
```

This corresponds to the amino acid sequence <SEQ ID 1518; ORF 528-1.a>:

```
a528-1.pep
       1        MEIRAIKYTA MAALLAFTVA GCRLAGWYEC SSLSGWCKPR KPAAIDFWDI

51        GGESPPSLED YEIPLSDGNR SVRANEYESA QQSYFYRKIG KFEACGLDWR

101        TRDGKPLIET FKQEGFDCLK KQGLRRNGLS ERVRW*
``` a528-1/m528-1 97.0% identity in 135 aa overlap

```
                 10        20        30        40        50        60
   a528-1.pep   MEIRAIKYTAMAALLAFTVAGCRLAGWYECSSLSGWCKPRKPAAIDFWDIGGESPPSLED
                ||||||||||||||||||||||||||||||||:|||||||||||||||||||||||||| |
   m528-1       MEIRAIKYTAMAALLAFTVAGCRLAGWYECSSLTGWCKPRKPAAIDFWDIGGESPPSLGD
                 10        20        30        40        50        60

70        80        90       100       110       120
   a528-1.pep   YEIPLSDGNRSVRANEYESAQQSYFYRKIGKFEACGLDWRTRDGKPLIETFKQEGFDCLK
                |||||||||||||||||||||||||||||||||||||||||||||||||||||| |||| :
   m528-1       YEIPLSDGNRSVRANEYESAQQSYFYRKIGKFEACGLDWRTRDGKPLIETFKQGGFDCLE
                 70        80        90       100       110       120

130
   a528-1.pep   KQGLRRNGLSERVRWX
                ||||||||||||||||
   a528-1       KQGLRRNGLSERVRWX
                130
```

The following partial DNA sequence was identified in *N. gonorrhoeae* <SEQ ID 1519>:

```
g529.seq (partial)
     1   atgacccata tcaaacccgt cattgccgcg ctcgcactca tcgggcttgc 51   cgcctgctcc ggcagcaaaa ccgaacagcc caagctcgac taccaaagcc 101   ggtcgcaccg cctgatcaaa ctcgaagtcc cgcctgattt gaacaacccc 151   gaccaaggca acctctaccg cctgcctgcc ggttcgggag ccgtccgcgc 201   cggggatttg gaaaaacgcc gcacacccgc cgtccaacag ccagcggatg 251   ccggaagtat tgaaaagcgt caaggcgtc cgcttcgagc ggcgacggca 301   gccaacgcct ggcttgtcgt tgacggcaaa tcccccgccg aaatctccgc 351   cgctttctg.
```

This corresponds to the amino acid sequence <SEQ ID 1520; ORF 529.ng>:

```
g529.pep (partial)
     1   MTHIKPVIAA LALIGLAACS GSKTEQPKLD YQSRSHRLIK LEVPPDLNNP

51   DQGNLYRLPA GSGAVRAGDL EKRRTPAVQQ PADAGSIEKR QRRPLRAATA

101   ANAWLVVDGK SPAEISAAF..
```

The following partial DNA sequence was identified in *N. meningitidis* <SEQ ID 1521>:

```
m529.seq
     1   ATGACCCATA TCAAACCCGT CATTGCCGCG CTCGCACTCA TCGGGCTTGC

51   CGCCTGCTCC GGCAGCAAAA CCGAACAGCC CAAGCTCGAC TACCAAAGCC

101   GGTCGCACCG CCTGATCAAA CTTGAAGTCC CACCTGATTT GAAAAACGCC

151   GACCAAGGCA ACCTCTACCG CCTGCCTGCC GGTTCGGGCG CCGTCCGCGC

201   CAGCGATTTG GAAAAACGCC GCACACCCGC CGTCCAACAG CCTGCCGATG

251   CCGAAGTATT GAAAAGCGTC AAAGGTGTCC GCCTCGAGCG CGACGGCAGC

301   CAACGCTGGC TCGTTGTCGA CGGCAAGTCT CCTGCCGAAA TCTGGCCGCT

351   CCTGAAAGCC TTTTGGCAGG AAAACGGCTT CGACATCAAA TCCGAAGAAC

401   CCGCCATCGG ACAAATGGAA ACCGAGTGGG CGGAAAACCG CGCCAAAATC

451   CCCCAAGACA GCTTGCGCCG CCTCTTCGAC AAAGTCGGCT TGGGCGGCAT

501   CTACTCCACC GGCGAGCGCG ACAAATTCAT CGTCCGTATC GAACAGGGCA
```

-continued

```
 551  AAAACGGCGT TTCCGACATC TTCTTCGCCC ACAAAGCCAT GAAAGAAGTG

601  TACGGCGGCA AAGACAAAGA CACGACCGTA TGGCAGCCCT CCCCGTCCGA

651  TCCCAACCTC GAAGCCGCTT TCCTGACGCG CTTTATGCAA TATTTGGGCG

701  TTGACGGACA GCAGGCGGAA AACGCATCGG CAAAAAAACC TACCCTTCCC

751  GCCGCCAACG AAATGGCGCG TATCGAAGGC AAAAGCCTGA TTGTCTTTGG

801  CGACTACGGC AGAAACTGGC GGCGCACCGT GCTCGCCCTC GACCGCATCG

851  GGCTGACCGT CGTCGGTCAA AACACCGAAC GCCACGCCTT CCTGGTTCAA

901  AAAGCCCCGA ACGAAAGCAA TGCAGTTACC GAACAAAAAC CCGGCCTGTT

951  CAAACGCCTG CTGGGCAAAG GCAAAGCGGA GAAACCTGCC GAACAGCCGG

1001  AACTGATTGT CTATGCAGAA CCTGTCGCCA ACGGCTCGCG CATCGTCCTG

1051  CTCAACAAAG ACGGCAGCGC ATATGCCGGC AAAGACGCAT CCGCATTATT

1101  GGGCAAACTC CATTCCGAAC TGCGTTAA
```

This corresponds to the amino acid sequence <SEQ ID 1522; ORF 529>:

```
m529.pep
   1    MTHIKPVIAA LALIGLAACS GSKTEQPKLD YQSRSHRLIK LEVPPDLNNP

51    DQGNLYRLPA GSGAVRASDL EKRRTPAVQQ PADAEVLKSV KGVRLERDGS

101    QRWLVVDGKS PAEIWPLLKA FWQENGFDIK SEEPAIGQME TEWAENRAKI

151    PQDSLRRLFD KVGLGGIYST GERDKFIVRI EQGKNGVSDI FFAHKAMKEV

201    YGGKDKDTTV WQPSPSDPNL EAAFLTRFMQ YLGVDGQQAE NASAKKPTLP

251    AANEMARIEG KSLIVFGDYG RNWRRTVLAL DRIGLTVVGQ NTERHAFLVQ

301    KAPNESNAVT EQKPGLFKRL LGKGKAEKPA EQPELIVYAE PVANGSRIVL

351    LNKDGSAYAG KDASALLGKL HSELR*
```

Computer analysis of this amino acid sequence gave the following results:
Homology with a Predicted ORF from *N. gonorrhoeae*
ORF 529 shows 83.5% identity over a 115 aa overlap with a predicted ORF (ORF 529.ng) from *N. gonorrhoeae*:

```
    g529/m529
                     10         20         30         40         50         60
       g529.pep  MTHIKPVIAALALIGLAACSGSKTEQPKLDYQSRSHRLIKLEVPPDLNNPDQGNLYRLPA
                 ||||||||||||||||||||||||||||||||||||||||||||||||||||||||||||
       m529      MTHIKPVIAALALIGLAACSGSKTEQPKLDYQSRSHRLIKLEVPPDLNNPDQGNLYRLPA
                     10         20         30         40         50         60

70         80         90        100        110        120
       g529.pep  GSGAVRAGDLEKRRTPAVQQPADAGSIEKRQRRPLRAATAANAWLVVDGKSPAEISAAFX
                 |||||:||||||||||||||||||| ::: :    |:   ::: ||||||||||||
       m529      GSGAVRASDLEKRRTPAVQQPADAEVLKSVKGVRLER-DGSQRWLVVDGKSPAEIWPLLK
                     70         80         90        100        110 m529      AFWQENGFDIKSEEPAIGQMETEWAENRAKIPQDSLRRLFDKVGLGGIYSTGERDKFIVR
                        120        130        140        150        160        170
```

The following partial DNA sequence was identified in *N. meningitidis* <SEQ ID 1523>:

```
a529.seq
   1    ATGACCCATA TCAAACCCGT CATTGCCGCG CTCGCACTCA TCGGGCTTGC

51    CGCCTGCTCC GGCAGCAAAA CCGAACAGCC CAAGCTCGAC TACCAAAGCC
```

```
 101  GGTCGCACCG CCTGATCAAA CTCGAAGTCC CACCTGATTT GAAAAACGCC
 151  GACCAAGGCA ACCTCTACCG CCTGCCTGCC GGTTCGGGCG CCGTCCGCGC
 201  CAGCGATTTG GAAAACGCC GCACACCCGC CGTCCAACAG CCTGCCGATG
 251  CCGAAGTATT GAAAAGCGTC AAAGGTGTCC GCCTCGAGCG CGACGGCAGC
 301  CAACGCTGGC TCGTTGTCGA CGGCAAGTCT CATGCCGAAA TCTGGCCGCT
 351  CCTGAAAGCC TTTTGGCAGG AAAACGGCTT CGACATCAAA TCCGAAGAAC
 401  CCGCCATCGG ACAAATGGAA ACCGAGTGGG CGGAAAACCG TGCCAAAATC
 451  CCCCAAGACA GCTTGCGCCG CCTATTCGAC ACAGTCGGTT TGGGCGGCAT
 501  CTACTCCACC GGCGAGCGCG ACAAATTCAT CGTCCGTATC GAACAGGGCA
 551  AAAACGGCGT TTCCGACATC TTCTTCGCCC ACAAAGCCAT GAAAGAAGTG
 601  TACGGCGGCA AGACAAAGA CACGACCGTA TGGCAGCCCT CCCCGTCCGA
 651  TCCCAACCTC GAAGCCGCTT TCCTGACGCG CTTTATGCAA TATTTGGGCG
 701  TTGACGGACA GCAGGCGGAA AACGCATCGG CAAAAAAACC TACCCTTCCC
 751  GCCGCCAACG AAATGGCGCG TATCGAAGGC AAAAGCCTGA TTGTCTTTGG
 801  CGACTACGGC AGAAACTGGC GGCGCACCGC GCTCGCCCTC GACCGCATCG
 851  GGCTGACCGT CGTCGGTCAA ACACCGAAC GCCACGCTTT CCTGGTTCAA
 901  AAAGCCCCGA ACGAAAGCAA TGCAGTTACC GAACAAAAAC CCGGCCTGTT
 951  CAAACGCCTG CTGGGCAAAG GCAAAGCGGA GAAACCTGCC GAACAGCCGG
1001  AACTGATTGT CTATGCCGAG CCTGTCGCCA ACGGCTCGCG CATCGTCCTG
1051  CTCAACAAAG ACGGCAGCGC ATATGCCGGC AAAGACGCAT CCGCATTATT
1101  GGGCAAACTC CATTCCGAAC TGCGTTAA
```

This corresponds to the amino acid sequence <SEQ ID 1524; ORF 529.a>:

```
a529.pep
  1  MTHIKPVIAA LALIGLAACS GSKTEQPKLD YQSRSHRLIK LEVPPDLNNP
 51  DQGNLYRLPA GSGAVRASDL EKRRTPAVQQ PADAEVLKSV KGVRLERDGS
101  QRWLVVDGKS HAEIWPLLKA FWQENGFDIK SEEPAIGQME TEWAENRAKI
151  PQDSLRRLFD TVGLGGIYST GERDKFIVRI EQGKNGVSDI FFAHKAMKEV
201  YGGKDKDTTV WQPSPSDPNL EAAFLTRFMQ YLGVDGQQAE NASAKKPTLP
251  AANEMARIEG KSLIVFGDYG RNWRRTALAL DRIGLTVVGQ NTERHAFLVQ
301  KAPNESNAVT EQKPGLFKRL LGKGKAEKPA EQPELIVYAE PVANGSRIVL
351  LNKDGSAYAG KDASALLGKL HSELR*
``` m529/a529 99.2% identity in 375 aa overlap

```
                10         20         30         40         50         60
m529.pep  MTHIKPVIAALALIGLAACSGSKTEQPKLDYQSRSHRLIKLEVPPDLNNPDQGNLYRLPA
          ||||||||||||||||||||||||||||||||||||||||||||||||||||||||||||
a529      MTHIKPVIAALALIGLAACSGSKTEQPKLDYQSRSHRLIKLEVPPDLNNPDQGNLYRLPA
                10         20         30         40         50         60

70         80         90        100        110        120
m529.pep  GSGAVRASDLEKRRTPAVQQPADAEVLKSVKGVRLERDGSQRWLVVDGKSPAEIWPLLKA
          |||||||||||||||||||||||||||||||||||||||||||||||||| |||||||||
a529      GSGAVRASDLEKRRTPAVQQPADAEVLKSVKGVRLERDGSQRWLVVDGKSHAEIWPLLKA
                70         80         90        100        110        120
```

```
              130       140       150       160       170       180
m529.pep  FWQENGFDIKSEEPAIGQMETEWAENRAKIPQDSLRRLFDKVGLGGIYSTGERDKFIVRI
          ||||||||||||||||||||||||||||||||||||||| ||||||||||||||||||||
a529      FWQENGFDIKSEEPAIGQMETEWAENRAKIPQDSLRRLFDTVGLGGIYSTGERDKFIVRI
              130       140       150       160       170       180

190       200       210       220       230       240
m529.pep  EQGKNGVSDIFFAHKAMKEVYGGKDKDTTVWQPSPSDPNLEAAFLTRFMQYLGVDGQQAE
          ||||||||||||||||||||||||||||||||||||||||||||||||||||||||||||
a529      EQGKNGVSDIFFAHKAMKEVYGGKDKDTTVWQPSPSDPNLEAAFLTRFMQYLGVDGQQAE
              190       200       210       220       230       240

250       260       270       280       290       300
m529.pep  NASAKKPTLPAANEMARIEGKSLIVFGDYGRNWRRTVLALDRIGLTVVGQNTERHAFLVQ
          |||||||||||||||||||||||||||||||||||||:||||||||||||||||||||||
a529      NASAKKPTLPAANEMARIEGKSLIVFGDYGRNWRRTALALDRIGLTVVGQNTERHAFLVQ
              250       260       270       280       290       300

310       320       330       340       350       360
m529.pep  KAPNESNAVTEQKPGLFKRLLGKGKAEKPAEQPELIVYAEPVANGSRIVLLNKDGSAYAG
          ||||||||||||||||||||||||||||||||||||||||||||||||||||||||||||
a529      KAPNESNAVTEQKPGLFKRLLGKGKAEKPAEQPELIVYAEPVANGSRIVLLNKDGSAYAG
              310       320       330       340       350       360

370
m529.pep  KDASALLGKLHSELRX
          ||||||||||||||||
a529      KDASALLGKLHSELRX
              370
```

The following partial DNA sequence was identified in *N. gonorrhoeae* <SEQ ID 1525>:

```
g530.seq
    1   atgagtgcga gcgcggcaat gacgggtttg atatgggtca tcgtgtcatc 51   ctgtgtgatg gatattaaag tgtttgtcat gttatgccgt ccgaacggtt 101   cagacggcat ggctatattt aaagttgtcc tgaggctttc agggcggcgc 151   ggacttttgc ctgtccgcct tccgtcagcg gaacgagcgg caggcgcacg 201   tgcggtccgc atccgcccaa ggcggatacc gcccatttcg gtgcggcggg 251   actgggttcg cagaacatgg tgtcgtaaat cggaatcagc cggtcgttga
```

This corresponds to the amino acid sequence <SEQ ID 1526; ORF 530.ng>:

```
g530.pep
    1   MSASAAMTGL IWVIVSSCVM DIKVFVMLCR PNGSDGMAIF KVVLRLSGRR

51   GLLPVRLPSA ERAAGARAVR IRPRRIPPIS VRRDWVRRTW CRKSESAGR*
                                                            50
```

The following partial DNA sequence was identified in *N. meningitidis* <SEQ ID 1527>:

```
m530.seq
    1   wTGAGTGCGA GCGCGGCAAT GACGGGTyTG ATATGGGTCA TCGTGTCATC 51   sTGTGTGATG GATATTAAAG TGTyTGTTGC GwTATGCCGT CCGAACGGTT 101   CGGACGGCAT GGmTATATTT AAAGTTGTCC TGAGGCTTTC AGGGCGGCGC 151   GGACTkTTGC wTGTCCGTTT yCCGTCAGCG GAACGAGCGG CAGGCGGACG 201   TGCGGTTCGC ATCTGCCCAg GGCGGATACC GCCCATTTCG GTGCGGCGGG 251   GCTGGGTTCG CAGAACATGG TGTCGTAAAT CGGAATCAGT CGGTCGTTGA
                                                           65
```

This corresponds to the amino acid sequence <SEQ ID 1528; ORF 530>:

```
m530.pep
    1   XSASAAMTGL IWVIVSSCVM DIKVXVAXCR PNGSDGMXIF KVVLRLSGRR

51   GLLXVRFPSA ERAAGGRAVR ICPGRIPPIS VRRGWVRRTW CRKSESVGR*
```

Computer analysis of this amino acid sequence gave the following results:
Homology with a Predicted ORF from *N. gonorrhoeae*
ORF 530 shows 88.8% identity over a 98 aa overlap with a predicted ORF (ORF 530.ng) from *N. gonorrhoeae*:

```
m530/g530 m530.pep   XSASAAMTGLIWVIVSSCVMDIKVXVAXCRPNGSDGMXIFKVVLRLSGRRGLLXVRFPSA   60
            |||||||||||||||||||||||| |  |||||||||| ||||||||||||||  :|||
 g530       MSASAAMTGLIWVIVSSCVMDIKVFVMLCRPNGSDGMAIFKVVLRLSGRRGLLPVRLPSA   60
                    10        20        30        40        50        60
 m530.pep   ERAAGGRAVRICPGRIPPISVRRGWVRRTWCRKSESVGR   99
            |||||:||||| |||||||||||||||||||||||||:||
 g530       ERAAGARAVRIRPRRIPPISVRRDWVRRTWCRKSESAGR   99
```

The following partial DNA sequence was identified in *N. meningitidis* <SEQ ID 1529>:

```
a530.seq
    1   ATGAGTGCGA GCGCGGCAAT GACGGGTTTG ATATGGGTCA TCGTGTCATC

51   CTGTGTGATG GATATTAAAG TGTTTGTTGC GTTATGCCGT CCGAACGGTT

101   CGGACGGCAT GGCTATATTT AAAGTTGTCC TGAGGCTTTC AGGGCGGCGC

151   GGACTTTTGC CTGTCCGCCT TCCGTCAGCG GAACGAGCGG CAGGCGGACG

201   TGCGGTTCGC ATCTGCCCAG GGCGGATACC GCCCATTTCG GTGCGGCGGG

251   GCTGGGTTCG CAGAACATGG TGTCGTAAAT CGGAATCAGC CGGTCGTTGA
```

This corresponds to the amino acid sequence <SEQ ID 1530; ORF 530.a>:

```
a530.pep
    1   MSASAAMTGL IWVIVSSCVM DIKVFVALCR PNGSDGMAIF KVVLRLSGRR

51   GLLPVRLPSA ERAAGGRAVR ICPGRIPPIS VRRGWVRRTW CRKSESAGR*
``` m530/a530 93.9% identity in 98 aa overlap

```
                    10        20        30        40        50        60
 m530.pep   XSASAAMTGLIWVIVSSCVMDIKVXVAXCRPNGSDGMXIFKVVLRLSGRRGLLXVRFPSA
            |||||||||||||||||||||||| || |||||||||| ||||||||||||||  :|||
 a530       MSASAAMTGLIWVIVSSCVMDIKVFVALCRPNGSDGMAIFKVVLRLSGRRGLLPVRLPSA
                    10        20        30        40        50        60
                    70        80        90       100
 m530.pep   ERAAGGRAVRICPGRIPPISVRRGWVRRTWCRKSESVGRX
            |||||||||||||||||||||||||||||||||||||:||
 a530       ERAAGGRAVRICPGRIPPISVRRGWVRRTWCRKSESAGRX
                    70        80        90       100
```

The following partial DNA sequence was identified in *N. gonorrhoeae* <SEQ ID 1531>:

```
g531.seq
    1   ATGACCGCCC TACTCGTCAT CCTCGCCCTC GCCCTGATAG CCGTCGGCAC

51   GGCAGGCATC GTCTATCCCG CCCTGCCCGG CTTGGCATTG ATGTTTGCCG
```

```
101    GAACATGGCT GCTTGCCTAT GCCGGCGGCT ATCAAATCTA CGGCGCAGGC

151    ATCTTGTGGA CGGTCGGACT CATCAGCCTT GGCGGCATAC TGGCGGACTA

201    TATGGCAGGC ATGTTGGGGG TAAAATACAC TGGGGCAGGC AAACTCGCCG

251    TCCGAGGTGC ATTGGCCGGC AGCATCATCG GCATATTTTT CTCCCTTCCC

301    GGACTAATAC TCGGCCCCTT TATCGGCGCG GCGGCAGGCG AACTGATCGA

351    TCGGCGCAAT ATGCTTCAGG CAGGTAAAGC GGGCTTGGGT ACGCTGTTGG

401    GGCTTGTCGT CGGCACGGCG TTCAAAATCG GCTGCGCCGT ATCCATCTTG

451    TTTATCCTGT TGGTGAAATA CATCGCATAC CTGTTTTAA
```

This corresponds to the amino acid sequence <SEQ ID 1532; ORF 531.ng>:

```
g531.pep
  1    MTALLVILAL ALIAVGTAGI VYPALPGLAL MFAGTWLLAY AGGYQIYGAG

51    ILWTVGLISL GGILADYMAG MLGVKYTGAG KLAVRGALAG SIIGIFFSLP

101    GLILGPFIGA AAGELIDRRN MLQAGKAGLG TLLGLVVGTA FKIGCAVSIL

151    FILLVKYIAY LF
```

The following partial DNA sequence was identified in *N. meningitidis* <SEQ ID 1533>:

```
m531.seq
  1    ATGACCGTAC TGACCGTCAT CCTCGCCCTC GCCCTGATAG CCGTCGGCAC

51    GGCGGGCATC GTTTaCCCCG CCCTGCCCGG ATTGGCATTG ATGTTTGCCG

101    GAACATGGCT GCTTGCCTAT GCCGGCGGCT ACCAAATCTA CGGCGCGGGC

151    GTTTTGTGGA CGGTCGGACT CATCAGCCTT GCCGGCATAC TGGCGGACTA

201    TGTGGCAGGC ATATGGGGA CAAAATATAC CGGAGCGGGC AAGCTCGCCG

251    TTCGCGGCGC ATTGGCCGGC AGCATCATCG GCATATTTTT CTCCCTTCCC

301    GGACTAATAC TCGGTCCCTT TATCGGCGCG GCGGCAGGCG AACTGATCGA

351    ACGGCGCAAT ATGCTTCAGG CAGGTAAAGC GGGCTTGGGT ACGCTGTTGG

401    GGCTTGTCGT CGGCACGGCG TTCAAAATCG GCTGCGCnGT ATCCATCTTG

451    TTTATCCTGT TGGTGAaATA CATCGCCTAC CTGTTTTAA
```

This corresponds to the amino acid sequence <SEQ ID 1534; ORF 531>:

```
m531.pep
  1    MTVLTVILAL ALIAVGTAGI VYPALPGLAL MFAGTWLLAY AGGYQIYGAG

51    VLWTVGLISL AGILADYVAG IWGTKYTGAG KLAVRGALAG SIIGIFFSLP

101    GLILGPFIGA AAGELIERRN MLQAGKAGLG TLLGLVVGTA FKIGCAVSIL

151    FILLVKYIAY LF*
```

Computer analysis of this amino acid sequence gave the following results:
Homology with a Predicted ORF from *N. gonorrhoeae*
ORF 531 shows 94.4% identity over a 162 aa overlap with a predicted ORF (ORF 531.ng) from *N. gonorrhoeae*:

```
m531/g531
                   10        20        30        40        50        60
m531.pep   MTVLTVILALALIAVGTAGIVYPALPGLALMFAGTWLLAYAGGYQIYGAGVLWTVGLISL
           ||:|||||||||||||||||||||||||||||||||||||||||||||:|||||||||
g531       MTALLVILALALIAVGTAGIVYPALPGLALMFAGTWLLAYAGGYQIYGAGILWTVGLISL
                   10        20        30        40        50        60

70        80        90       100       110       120
m531.pep   AGILADYVAGIWGTKYTGAGKLAVRGALAGSIIGIFFSLPGLILGPFIGAAAGELIERRN
           :||||||:||:|:|||||||||||||||||||||||||||||||||||||||||:|||
g531       GGILADYMAGMLGVKYTGAGKLAVRGALAGSIIGIFFSLPGLILGPFIGAAAGELIDRRN
                   70        80        90       100       110       120

130       140       150       160
m531.pep   MLQAGKAGLGTLLGLVVGTAFKIGCAVSILFILLVKYIAYLF
           |||||||||||||||||||||||||||||||||||||||||
g531       MLQAGKAGLGTLLGLVVGTAFKIGCAVSILFILLVKYIAYLF
                  130       140       150       160
```

The following partial DNA sequence was identified in *N. meningitidis* <SEQ ID 1535>:

```
a531.seq
    1   ATGACCGCCT TGCTCGTCAT CCTCGCCCTC GCCCTGATAG CCGCCGGTAC

51   GGCGGGCATC GTTTACCCCG CCCTGCCCGG ATTGGCATTG ATGTTTGCCG

101   GAACCTGGCT GCTCGCCTAC TCCGGCGGCT ACCAAATCTA CGGCGCGGGC

151   GTTTTGTGGA CGGTCGGACT CATCAGCCTT GCCGGCATAC TGGCGGACTA

201   TGTGGCAGGC ATATGGGGGA CAAAATATAC CGGAGCGGGC AAGCTCGCCG

251   TTCGCGGCGC ATTGGCCGGC AGCATCATCG GCATATTTTT CTCCCTTCCC

301   GGACTAATAC TCGGTCCCTT TATCGGCGCG GCGGCAGGCG AACTGATCGA

351   ACGGCGCAAT ATGCTTCAGG CAGGTAAAGC GGGCTTGGGT ACGCTGTTGG

401   GGCTTATCGT CGGTACGGCC TTCAAAATCG GCTGCGCCGT ATCCATCTTG

451   TTTATCCTGT TGGTGAAATA CATCGCCTAC CTGTTTTAA
```

This corresponds to the amino acid sequence <SEQ ID 1536; ORF 531.a>:

```
a531.pep
    1   MTALLVILAL ALIAAGTAGI VYPALPGLAL MFAGTWLLAY SGGYQIYGAG

51   VLWTVGLISL AGILADYVAG IWGTKYTGAG KLAVRGALAG SIIGIFFSLP

101   GLILGPFIGA AAGELIERRN MLQAGKAGLG TLLGLIVGTA FKIGCAVSIL

151   FILLVKYIAY LF*
``` m531/a531 96.9% identity in 162 aa overlap

```
                   10        20        30        40        50        60
m531.pep   MTVLTVILALALIAVGTAGIVYPALPGLALMFAGTWLLAYAGGYQIYGAGVLWTVGLISL
           ||:||||||||:||||||||||||||||||||||||||||:|||||||||||||||||
a531       MTALLVILALALIAAGTAGIVYPALPGLALMFAGTWLLAYSGGYQIYGAGVLWTVGLISL
                   10        20        30        40        50        60

70        80        90       100       110       120
m531.pep   AGILADYVAGIWGTKYTGAGKLAVRGALAGSIIGIFFSLPGLILGPFIGAAAGELIERRN
           ||||||||||||||||||||||||||||||||||||||||||||||||||||||||||
a531       AGILADYVAGIWGTKYTGAGKLAVRGALAGSIIGIFFSLPGLILGPFIGAAAGELIERRN
                   70        80        90       100       110       120

130       140       150       160
m531.pep   MLQAGKAGLGTLLGLVVGTAFKIGCAVSILFILLVKYIAYLFX
           ||||||||||||||:|||||||||||||||||||||||||||
a531       MLQAGKAGLGTLLGLIVGTAFKIGCAVSILFILLVKYIAYLFX
                  130       140       150       160
```

The following partial DNA sequence was identified in *N. gonorrhoeae* <SEQ ID 1537>:

```
g532.seq (partial)
    1  atggctgaaa caatgaaaaa acaggcggat tcgcctgatt tggtgtacgg 51  tttggaagac aggccgccgt tcggtaatgc gctcttgagc gcggttaccc 101  atcttttggc gattttcgtg ccgatgatta cgcccgcgct gattgtgggc 151  ggcgcgctgg aattgccggt ggagatgacg gcgtatctgg tgtcgatggc 201  gatggttgcg tcgggtgtcg gcacttattt gcaggtcaac cgcttcgggt 251  cggtcggctc ggggatgctg tccatccagc gttaccgtca tgattgcgct 301  cggcgcgggg atgaaagagg gcggtttgag ...
```

This corresponds to the amino acid sequence <SEQ ID 1538; ORF 532.ng>:

```
g532.pep (partial)
    1  MAETMKKQAD SPDLVYGLED RPPFGNALLS AVTHLLAIFV PMITPALIVG

51  GALELPVEMT AYLVSMAMVA SGVGTYLQVN RFGSVGSGML SIQRYRHDCA

101  RRGDERGRFE ...
```

The following partial DNA sequence was identified in *N. meningitidis* <SEQ ID 1539>:

```
m532.seq
    1  ATGAGCGGTC AGTTGGGCAA AGGTGCGGAT GCGCCTGATT TGGTGTACGG

51  TTTGGAAGAC AGGCCGCCGT TCGGTAATGC GCTCTTGAGC GCGGTTACCC

101  ATCTTTTGGC GATTTTGTG CCGATGATTA CGCCCGCGCT GATTGTGGGC

151  GGCGCGCTGG AATTGCCGGT GGAGATGACG GCGTATCTCG TGTCGATGGC

201  GATGGTTGCG TCGGGTGTCG GCACTTATTT GCAGGTCAAC CGCTTCGGGC

251  CGGTCGGTTC GGGGATGCTG TCCATCCAGT CGGTGAATTT TTCGTTCGTT

301  ACCGTGATGA TTGCGCTGGG CGCGGGGATG AAAGAGGGCG GTTTGACTAA

351  GGATGCGATG ATTTCGACGC TCTTGGGCGT ATCGTTTGTC GGCGCGTTTT

401  TGGTGTGTTT CTCGGCGTGG CTTCTGCCGT ATTTGAAAAA AGTGATTACG

451  CCGACGGTCA GCGGCGTGGT CGTGATGCTC ATTGGTTTGA GTTTGGTACA

501  CGTCGGCATT ACCGATTTCG GCGGCGGCTT CGGCGCGAAG GCGGACGGCA

551  CGTTCGGCTC GATGGAAAAC TTGGGGCTGG CATCGCTGGT GTTGCTGATT

601  GTGTTGGTGT TCAACTGCAT GAAAAACCCG CTGTTGCGCA TGAGCGGCAT

651  TGCGGTCGGG CTGATTGCCG GCTATATCGT CGCGCTGTTT TTGGGCAAGG

701  TGGATTTTTC CGCGCTGCAA AACCTGCCGC TGGTTACGCT GCCCGTACCG

751  TTTAAATACG GTTTTGCTTT CGACTGGCAC GCGTTTATTG TGGCGGGCGC

801  GATTTCTTG TTGAGCGTGT TTGAGGCGGT CGGCGATTTA ACCGCGACGG

851  CAATGGTGTC CGACCAGCCG ATTGAAGGCG AGGAATACAC CAAACGCCTG

901  CGCGGCGGCG TGTTGGCTGA CGGCTTGGTG TCGGTGATTG CGACGGCTTT

951  GGGTTCGCTG CCGCTGACGA CGTTTGCGCA AACAACGGC GTGATTCAGA

1001  TGACCGGCGT GGCTTCGCGC CATGTGGGCA AATATATTGC CGTGATTTTG

1051  GTGCTGTTGG GTCTGTTCCC CGTTGTCGGT CGCGCGTTTA CGACGATTCC
```

```
-continued
1101 GAGTCCGGTG TTGGGCGGCG CGATGGTTTT GATGTTCGGC TTAATTGCGA

1151 TTGCGGGCGT GCGGATTTTG GTCAGTCACG GCATCCGCAG GCGCGAAGCG

1201 GTGATTGCGG CAACGTCGGT CGGTTTGGGC TTGGGTGTCG CGTTTGAGCC

1251 GGAAGTGTTT AAAAACCTGC CCGTCTTGTT CCAAAACTCT ATTTCCGCCG

1301 GCGGCATTAC GGCAGTCTTG CTGAATTTGG TCTTGCCCGA AGATAAAACC

1351 GAGGCGGCGG TCAAGTTTGA TACCGACCAC TTGGAACACT GA
```

This corresponds to the amino acid sequence <SEQ ID 1540; ORF 532>:

```
m532.pep
    1 MSGQLGKGAD APDLVYGLED RPPFGNALLS AVTHLLAIFV PMITPALIVG

51 GALELPVEMT AYLVSMAMVA SGVGTYLQVN RFGPVGSGML SIQSVNFSFV

101 TVMIALGAGM KEGGLTKDAM ISTLLGVSFV GAFLVCFSAW LLPYLKKVIT

151 PTVSGVVVML IGLSLVHVGI TDFGGGFGAK ADGTFGSMEN LGLASLVLLI

201 VLVFNCMKNP LLRMSGIAVG LIAGYIVALF LGKVDFSALQ NLPLVTLPVP

251 FKYGFAFDWH AFIVAGAIFL LSVFEAVGDL TATAMVSDQP IEGEEYTKRL

301 RGGVLADGLV SVIATALGSL PLTTFAQNNG VIQMTGVASR HVGKYIAVIL

351 VLLGLFPVVG RAFTTIPSPV LGGAMVLMFG LIAIAGVRIL VSHGIRRREA

401 VIAATSVGLG LGVAFEPEVF KNLPVLFQNS ISAGGITAVL LNLVLPEDKT

451 EAAVKFDTDH LEH*
```

Computer analysis of this amino acid sequence gave the following results:
Homology with a Predicted ORF from *N. gonorrhoeae* 35
ORF532 shows 91.4% identity over a 93 aa overlap with a predicted ORF (ORF 532.ng) from *N. gonorrhoeae*:

```
g532/m532
                  10         20         30         40         50         60
    g532.pep MAETMKKQADSPDLVYGLEDRPPFGNALLSAVTHLLAIFVPMITPALIVGGALELPVEMT
             |: :  |  ||:||||||||||||||||||||||||||||||||||||||||||||||||
    m532     MSGQLGKGADAPDLVYGLEDRPPFGNALLSAVTHLLAIFVPMITPALIVGGALELPVEMT
                  10         20         30         40         50         60
                  70         80         90        100        110
    g532.pep AYLVSMAMVASGVGTYLQVNRFGSVGSGMLSIQRYRHDCARRGDERGRFEX
             ||||||||||||||||||||||| |||||||||| |||||||
    m532     AYLVSMAMVASGVGTYLQVNRFGPVGSGMLSIQSVNFSFVTVMIALGAGMKEGGLTKDAM
                  70         80         90        100        110        120
```

The following partial DNA sequence was identified in *N. meningitidis* <SEQ ID 1541>:  50

```
a532.seq
    1 ATGAGCGGTC AGTTGGGCAA AGGTGCGGAT GCGCCTGATT TGGTGTACGG

51 TTTGGAGGAT AGGCCGCCGT TCGGTAATGC GCTCTTGAGC GCGGTTACCC

101 ATCTTTTGGC GATTTTTGTG CCGATGATTA CGCCCGCGCT GATTGTGGGC

151 GGCGCGCTGG AATTGCCGGT GGAGATGACG GCGTATCTCG TGTCGATGGC

201 GATGGTTGCG TCGGGTGTCG GCACTTATTT GCAGGTCAAC CGCTTCGGGC

251 CGGTCCGGTTC GGGGATGCTG TCCATCCAGT CGGTGAATTT CTCGTTCGTT

301 ACCGTCATGA TTGCGCTCGG CGCGGGGATG AAAGAGGGCG GTTTGACTAA
```

```
-continued
 351   GGATGCGATG ATTTCGACGC TCTTGGGCGT ATCGTTTGTC GGCGCGTTTT

401   TGGTGTGTTT TTCGGCGTGG CTTCTGCCGT ATTTGAAAAA AGTGATTACG

451   CCGACGGTCA GCGGTGTGGT GGTGATGCTG ATCGGCTTGA GTTTGGTACA

501   CGTCGGTATT ACCGATTTCG GCGGCGGCTT CGGCGCAAAG GCGGACGGCA

551   CGTTCGGCTC GATGGAAAAC TTGGGGCTGG CATCGCTGGT GCTGCTGATT

601   GTGCTGGTGT TCAATTGCAT GAAAAACCCG CTGCTGCGGA TGAGCGGCAT

651   TGCGGTCGGT CTGATTGCCG GCTATATCGT CGCGCTGTTT TTGGGCAAGG

701   TGGATTTTTC GGCACTGCAA AACCTGCCGC TGGTTACGCT GCCCGTACCG

751   TTTAAATATG GTTTTGCTTT TGACTGGCAC GCATTTATTG TGGCGGGTGC

801   GATTTCTTG TTGAGCGTGT TTGAGGCGGT CGGCGATTTG ACGGCGACGG

851   CAATGGTGTC CGACCAGCCG ATTGAAGGCG AGGAATACAC CAAACGCTTG

901   CGCGGCGGCG TGTTGGCGGA CGGCTTGGTG TCGGTGATTG CGACGGCTTT

951   GGGTTCGCTG CCGCTGACGA CGTTTGCACA AAACAACGGC GTGATTCAGA

1001   TGACCGGCGT GGCTTCGCGC CATGTGGGCA AATATATTGC CGTGATTTTG

1051   GTGCTGTTGG GTCTGTTCCC CGTTGTCGGA CGCGCGTTTA CGACGATTCC

1101   GAGTCCGGTG TTGGGCGGCG CGATGGTTTT GATGTTCGGC TTGATTGCGA

1151   TTGCGGGCGT GCGGATTTTG GTCAGCCACG GCATCCGCAG GCGCGAAGCG

1201   GTAATTGCGG CAACGTCGGT CGGTTTGGGC TTGGGTGTCG CGTTTGAGCC

1251   GGAAGTGTTT AAAAACCTGC CCGTCTTGTT CCAAAACTCT ATTTCCGCCG

1301   GCGGCATTAC GGCAGTCTTG CTGAATTTGG TCTTGCCCGA AGATAAAACC

1351   GAGGCGGCGG TCAAGTTTGA TACCGACCAC TTGGAACACT GA
                                                        35
```

This corresponds to the amino acid sequence <SEQ ID 1542; ORF 532.a>:

```
a532.pep
   1   MSGQLGKGAD APDLVYGLED RPPFGNALLS AVTHLLAIFV PMITPALIVG

51   GALELPVEMT AYLVSMAMVA SGVGTYLQVN RFGPVGSGML SIQSVNFSFV

101   TVMIALGAGM KEGGLTKDAM ISTLLGVSFV GAFLVCFSAW LLPYLKKVIT

151   PTVSGVVVML IGLSLVHVGI TDFGGGFGAK ADGTFGSMEN LGLASLVLLI

201   VLVFNCMKNP LLRMSGIAVG LIAGYIVALF LGKVDFSALQ NLPLVTLPVP

251   FKYGFAFDWH AFIVAGAIFL LSVFEAVGDL TATAMVSDQP IEGEEYTKRL

301   RGGVLADGLV SVIATALGSL PLTTFAQNNG VIQMTGVASR HVGKYIAVIL

351   VLLGLFPVVG RAFTTIPSPV LGGAMVLMFG LIAIAGVRIL VSHGIRRREA

401   VIAATSVGLG LGVAFEPEVF KNLPVLFQNS ISAGGITAVL LNLVLPEDKT

451   EAAVKFDTDH LEH*
``` m532/a532 100.0% identity in 463 aa overlap

```
                 10        20        30        40        50        60
m532.pep  MSGQLGKGADAPDLVYGLEDRPPFGNALLSAVTHLLAIFVPMITPALIVGGALELPVEMT
          ||||||||||||||||||||||||||||||||||||||||||||||||||||||||||||
a532      MSGQLGKGADAPDLVYGLEDRPPFGNALLSAVTHLLAIFVPMITPALIVGGALELPVEMT
                 10        20        30        40        50        60
```

```
              70         80         90        100        110        120
m532.pep  AYLVSMAMVASGVGTYLQVNRFGPVGSGMLSIQSVNFSFVTVMIALGAGMKEGGLTKDAM
          ||||||||||||||||||||||||||||||||||||||||||||||||||||||||||||
a532      AYLVSMAMVASGVGTYLQVNRFGPVGSGMLSIQSVNFSFVTVMIALGAGMKEGGLTKDAM
              70         80         90        100        110        120

130        140        150        160        170        180
m532.pep  ISTLLGVSFVGAFLVCFSAWLPPYLKKVITPTVSGVVVMLIGLSLVHVGITDFGGGFGAK
          ||||||||||||||||||||||||||||||||||||||||||||||||||||||||||||
a532      ISTLLGVSFVGAFLVCFSAWLPPYLKKVITPTVSGVVVMLIGLSLVHVGITDFGGGFGAK
             130        140        150        160        170        180

190        200        210        220        230        240
m532.pep  ADGTFGSMENLGLASLVLLIVLVFNCMKNPLLRMSGIAVGLIAGYIVALFLGKVDFSALQ
          ||||||||||||||||||||||||||||||||||||||||||||||||||||||||||||
a532      ADGTFGSMENLGLASLVLLIVLVFNCMKNPLLRMSGIAVGLIAGYIVALFLGKVDFSALQ
             190        200        210        220        230        240

250        260        270        280        290        300
m532.pep  NLPLVTLPVPFKYGFAFDWHAFIVAGAIFLLSVFEAVGDLTATAMVSDQPIEGEEYTKRL
          ||||||||||||||||||||||||||||||||||||||||||||||||||||||||||||
a532      NLPLVTLPVPFKYGFAFDWHAFIVAGAIFLLSVFEAVGDLTATAMVSDQPIEGEEYTKRL
             250        260        270        280        290        300

310        320        330        340        350        360
m532.pep  RGGVLADGLVSVIATALGSLPLTTFAQNNGVIQMTGVASRHVGKYIAVILVLLGLFPVVG
          ||||||||||||||||||||||||||||||||||||||||||||||||||||||||||||
a532      RGGVLADGLVSVIATALGSLPLTTFAQNNGVIQMTGVASRHVGKYIAVILVLLGLFPVVG
             310        320        330        340        350        360

370        380        390        400        410        420
m532.pep  RAFTTIPSPVLGGAMVLMFGLIAIAGVRILVSHGIRRREAVIAATSVGLGLGVAFEPEVF
          ||||||||||||||||||||||||||||||||||||||||||||||||||||||||||||
a532      RAFTTIPSPVLGGAMVLMFGLIAIAGVRILVSHGIRRREAVIAATSVGLGLGVAFEPEVF
             370        380        390        400        410        420

430        440        450        460
m532.pep  KNLPVLFQNSISAGGITAVLLNLVLPEDKTEAAVKFDTDHLEHX
          |||||||||||||||||||||||||||||||||||||||||||
a532      KNLPVLFQNSISAGGITAVLLNLVLPEDKTEAAVKFDTDHLEHX
             430        440        450        460
```

The following partial DNA sequence was identified in *N. gonorrhoeae* <SEQ ID 1543>:

```
g535.seq
   1  atgccctttc ccgttttcag acaantattt gcttngtcct tgctacggtt 51  ttttgccgta ggtcggattc tcgaatccga catttccaac agcggttttt 101  cggaaacgat aaacgcgtca aatgtttttt ttgtcggata cgaatatccg 151  gcctgcattt caaatttaca tcgcttccaa tttcgcaaac ttggtatcca 201  gttctttcac gccctgtttg ccgaagttga tggtcagtcg gcggattcg 251  cctttgtctg cggcatcgat aatcacgccg gtgccgaatt tggcgtgacg 301  gacgttttgt ccgatgcgga agcctgcgta ggtttgcggc tgtttgaagt 351  catcgatgat tttgtcccgt tgtacggtgg tttggcgcgt gttgccgtag 401  ctgtcgaagg cgggtttttt gacggacagg tagtgcaata cttctggcgg 451  gatttcttcg acgaagcggg atgcgatgcc gaattgggtt tgtccgtgca 501  gcatgcgttg ctgtgccatg gtgatgtaga ggcgtttgcg ggcgcgggtg 551  atggcgacgt acatgaggcg gcgttcttct tcgaggccgc cgcgctcggc 601  aaggctcatt tcgctgggga aacgcccctc ttccataccg gtgaggaaga 651  cggcgttgaa ttccaagcct ttggcggcgt ggacggtcat cagttggacg 701  gctttttcgc ctgccctgc ttggttttcg ccggattcga gggcggcgtt 751  gctcaagaag gcgaggatgg ggaaggcggg atcgtctga
```

This corresponds to the amino acid sequence <SEQ ID 1544; ORF 535.ng>:

```
g535.pep
    1   MPFPVFRQXF AXSLLRFFAV GRILESDISN SGFSETINAS NVFFVGYEYP

51   ACISNLHRFQ FRKLGIQFFH ALFAEVDGQS GGFAFVCGID NHAGAEFGVT

101   DVLSDAEACV GLRLFEVIDD FVPLYGGLAR VAVAVEGGFF DGQVVQYFWR

151   DFFDEAGCDA ELGLSVQHAL LCHGDVEAFA GAGDGDVHEA AFFFEAAALG

201   KAHFAGETPL FHTGEEDGVE FQAFGGVDGH QLDGFFACPC LVFAGFEGGV

251   AQEGEDGEGG IV*
```

The following partial DNA sequence was identified in *N. meningitidis* <SEQ ID 1545>:

```
m535.seq
    1   aTGCCCTTtC CCGTTTTCAG ACGGCCTTTT GCTTTGTCCT TACTtACGTT

51   TTTTGCCGTA AGTCAGATTC TTGTATCCGA CATTTCCAAC AGCGGTGTTT

101   CGGAAACAAT AGACGCGTCA AATGTTTTTG TCGGATACGA ATATCCGACC

151   TACATTTCAA ATTTACATCT CTTCCAATTT CGCAAACTTG GTGTCCAACT

201   CTTTCACGCC CTGTTTGCCG AAATTGATGG TCAGTCGGGC GGATTCGCCT

251   TTATCTGCGG CATCGATAAT CACGCCGGTG CCGAATTTGG CGTGGCGGAC

301   GTTTTGTCCG ATACGGAAAC CTGCGTAGGT TTGGGGCTGT TTGTAGTCGT

351   CGATGATTTT ATCTTTGGAT GCGGCGGTTT GGCGCGTGTT GCCGTAACTG

401   TCGTAGGCAG GCTTTTTGAC GGACAGGTAG TGCAATACTT CGGGTGGGAT

451   CTCTTCGACG AAGCGGGAGA CGATGCCGAA TTGGGTTTGT CCGTGCAGCA

501   TGCGTTGTTG CGCCATGGTG ATGTAGAGGC GTTTGCGGGC GCGGGTGATG

551   GCGACGTACA TGAGGCGGCG TTCTTCTTCG AGGCCGCCGC GTTCGGCAAG

601   GCTCATTTCG CTGGGGAAGC GGCCTTCTTC CATGCCGGTG AGGAAGACGG

651   CGTTAAATTC CAAGCCTTTG GCGGCGTGGA CGGTCATGAG TTGGACGGCC

701   TTTTCGCCTG CGCCTGCCTG GTTTTCACCG GATTCGAGGG CGGCATTGCT

751   TAGGAAGGCG AGAATGGGGA AGGCGGGGTC GTCTGA
```

This corresponds to the amino acid sequence <SEQ ID 1546; ORF 535>:

```
m535.pep
    1   MPFPVFRRPF ALSLLTFFAV SQILVSDISN SGVSETIDAS NVFVGYEYPT

51   YISNLHLFQF RKLGVQLFHA LFAEIDGQSG GFAFICGIDN HAGAEFGVAD

101   VLSDTETCVG LGLFVVVDDF IFGCGGLARV AVTVVGRLFD GQVVQYFGWD

151   LFDEAGDDAE LGLSVQHALL RHGDVEAFAG AGDGDVHEA FFFEAAAFGK

201   AHFAGEAAFF HAGEEDGVKF QAFGGVDGHE LDGLFACACL VFTGFEGGIA

251   XEGENGEGGV V*
```

Computer analysis of this amino acid sequence gave the following results:

Homology with a Predicted ORF from *N. gonorrhoeae*

ORF 535 shows 80.9% identity over a 262 aa overlap with a predicted ORF (ORF 535.ng) from *N. gonorrhoeae*:

```
m535/g535
                      10        20        30        40         50       59
m535.pep       MPFPVFRRPFALSLLTFFAVSQILVSDISNSGVSETIDASNVF-VGYEYPTYISNLHLFQ
               |||||||: || ||| ||||::|| ||||||| ||||:||||| ||||||: ||||| ||
g535           MPFPVFRQXFAXSLLRFFAVGRILESDISNSGFSETINASNVFFVGYEYPACISNLHRFQ
                      10        20        30        40        50        60

60        70        80        90       100       110      119
m535.pep       FRKLGVQLFHALFAEIDGQSGGFAFICGIDNHAGAEFGVADVLSDTETCVGLGLFVVVDD
               |||||:|:|||||||:|||||||||:|||||||||||||:|||||:|:|||| || |:||
g535           FRKLGIQFFHALFAEVDGQSGGFAFVCGIDNHAGAEFGVTDVLSDAEACVGLRLFEVIDD
                      70        80        90       100       110       120

120       130       140       150       160       170      179
m535.pep       FIFGCGGLARVAVTVVGRLFDGQVVQYFGWDLFDEAGDDAELGLSVQHALLRHGDVEAFA
               |:   ||||||||:| | :|||||||||  |:||||| ||||||||||||| ||||||||
g535           FVPLYGGLARVAVAVEGGFFDGQVVQYFWRDFFDEAGCDAELGLSVQHALLCHGDVEAFA
                     130       140       150       160       170       180

180       190       200       210       220       230      239
m535.pep       GAGDGDVHEAAFFFEAAAFGKAHFAGEAAFFHAGEEDGVKFQAFGGVDGHELDGLFACAC
               ||||||||||||||||||:||||||||: :||:||||||:||||||||||:|||:||| |
g535           GAGDGDVHEAAFFFEAAALGKAHFAGETPLFHTGEEDGVEFQAFGGVDGHQLDGFFACPC
                     190       200       210       220       230       240

240       250       260
m535.pep       LVFTGFEGGIAXEGENGEGGVV
               |||:|||||:| |||:||||:|
g535           LVFAGFEGGVAQEGEDGEGGIV
                     200       260
```

The following partial DNA sequence was identified in *N. meningitidis* <SEQ ID 1547>:

```
a535.seq (partial)
     1   TTCAGACGGC CTTTTGCCTT GTCCTTGCTA CAGTTTTTTG CCATAGGTCG

51   GATTCTCGAA TCCGACATTT CCAACAGCGG TTTTTCGGAA ACGATAGACG

101   CGTCAAATAT TTTTGTCGGA TACGAGTATC CAGCCTGCAT TTCAAATTTA

151   CATCGCTTCC AATTTCGCAA ACTTGGTGTC CAACTCTTTC ACGCCCTGTT

201   TGCCGAAATT GATGGTCAGT CGGGCGGATT CGCCTTTATC TGCGGCATCG

251   ATAATCACGC CGGTGCCGAA TTTGGCGTGG CGGACGTTTT GTCCGATACG

301   GAAACCTGCG TAGGTTTGGG GCTGTTTGTA GTCGTCGATG ATTTTGTCTT

351   TGGGCGCGGC GGTTTGGCGC GTGTTGCCAT AGCGGTCGTA GGCGGGTTTT

401   TTGACGGACA GGTAGTGCAA TACTTCGGGC GGGATTTCTT CGACGAAGCG

451   GGAGACGATG CCGAATTGGG TTTGTCCGTG CAGCATGCGT TGTTGCGCCA

501   TGGTGATGTA GAGGCGTTTG CGGGCGCGGG TGATGGCGAC GTACATCAGG

551   CGGCGTTCTT CTTCGAGGCC GCCGCGTTCG GCAAGGCTCA TTTCGCTGGG

601   GAAGCGGCCT TCTTCCATGC CGGTGAGGAA TACGGCGTTA AATTCCAAGC

651   CTTTGGCGGC GTGCACGGTC ATGAGTTGTA CGGCTTTTTC GCCCGCGCCT

701   GCTTGGTTTT CGCCGGATTC GAGAGCAGCA TTGCTTAGGA AAGCGAGGAT

751   GGGGAAGGCG GGGTCGTCTG A
```

This corresponds to the amino acid sequence <SEQ ID 1548; ORF 535.a>:

```
a535.pep (partial)
     1   FRRPFALSLL QFFAIGRILE SDISNSGFSE TIDASNIFVG YEYPACISNL

51   HRFQFRKLGV QLFHALFAEI DGQSGGFAFI CGIDNHAGAE FGVADVLSDT

101   ETCVGLGLFV VVDDFVFGRG GLARVAIAVV GGFFDGQVVQ YFGRDFFDEA

151   GDDAELGLSV QHALLRHGDV EAFAGAGDGD VHQAAFFFEA AAFGKAHFAG
```

```
                                               -continued
    201    EAAFFHAGEE YGVKFQAFGG VHGHELYGFF ARACLVFAGF ESSIA*ESED

251    GEGGVV*
``` m535/n535 88.7% identity in 256 aa overlap

```
                    10         20         30         40         50         60
m535.pep    MPFPVFRRPPFALSLLTFFAVSQILVSDISNSGVSETIDASNVFVGYEYPTYISNLHLFQF
            ||||||||||| |||::||| |||||||| |||||||||:||||||:| ||||| |||
a535             FRRPPFALSLLQFFAIGRILESDISNSGFSETIDASNIFVGYEYPACISNLHRFQF
                      10        20        30        40        50

70        80        90        100       110       120
m535.pep    RKLGVQLFHALFAEIDGQSGGFAFICGIDNHAGAEFGVADVLSDTETCVGLGLFVVVDDF
            ||||||||||||||||||||||||||||||||||||||||||||||||||||||||||||
a535        RKLGVQLFHALFAEIDGQSGGFAFICGIDNHAGAEFGVADVLSDTETCVGLGLFVVVDDF
                  60        70        80        90        100       110

130       140       150       160       170       180
m535.pep    IFGCGGLARVAVTVVGRLFDGQVVQYFGWDLFDEAGDDAELGLSVQHALLRHGDVEAFAG
            :|| |||||||:::||| :||||||||| |:|||||||||||||||||||||||||||||
a535        VFGRGGLARVAIAVVGGFFDGQVVQYFGRDFFDEAGDDAELGLSVQHALLRHGDVEAFAG
                  120       130       140       150       160       170

190       200       210       220       230       240
m535.pep    AGDGDVHEAAFFFEAAAFGKAHFAGEAAFFHAGEEDGVKFQAFGGVDGHELDGLFACACL
            |||||||:||||||||||||||||||||||||||||| |||||||||| |||| :|| |||
a535        AGDGDVHQAFFFEAAAFGKAHFAGEAAFFHAGEEYGVKFQAFGGVHGHELYGFFARACL
                   180       190       200       210       220       230

250       260
m535.pep    VFTGFEGGIAXEGENGEGGVVX
            ||:|||::||||:|:|||||||
a535        VFAGFESSIAXESEDGEGGVVX
                 240       250
```

The following partial DNA sequence was identified in *N. gonorrhoeae* <SEQ ID 1549>:

```
g537.seq
    1    atgaaatccc tttttatttg gctgcttcta ttgggctcgg cggcaggcgt 51    tttctaccat acccaaaacc aatccctgcc cgcgggcgaa cttgtctatc 101    cgtccgcacc gcaaatcagg gacggcggcg atgcgctgca ctacctcaac 151    cgcatccgca cacaaatcgg tttgcacgcg ctggcacacg cgccggtttt 201    ggaaaattcc gcccgcaggc acgcacgcta tctcacgctc aatcccgaag 251    acggacacgg cgaacaccat cccgacaatc cgcactacac cgcacaaaag 301    ctgaccgaac gcacacgcct tgccgggtat ctctacaacg gcgtgcatga 351    aaacatcagc acggaagagg aagccgccga atcgtccgac agcgacatcc 401    gcacgcagca acgccaagtg gacgctttga tgagcgcaat ctaccaccgc 451    ctttcgctgc ttgaccgcca taccgacgaa gcaggtgcgg catttgtgcg 501    cgaaaacggc aaaaccgtcc tcgtattcaa tcagggcaac ggcagcttcg 551    agcgcgcctg tgcaaaagga aggcggcagc cggaagcagg acggaaatat 601    taccgcaacg cttgccacaa cggtgcggcc gtttatgctg acgaagccat 651    gcccgtaacg gaattgcttt ataccgccta tccggttggc ggcggcgcgc 701    tgccttattt ttacggggaa cgtcccgacc ccgtgccgga atatgaaatc 751    acaggcaatc ctgccagcat tgattttttc gaggcggcag gcaaaattgc 801    gatgaaaagt ttcaagctgt atcagggtaa aaacgaaatc cgccccgtca 851    gggttttaac cgccggcaac gaccctaacg gcaggctgac cgcgcaccaa 901    ttcgcccttt tcccgctcaa acctttggaa tacggcacgc tttatacggc 951    ggtattcgac tatgtccgca acggacggca cgcgcaggcg aaatggcagt
```

-continued

```
1001  ttagaacccg aaaacccgat taccettatt ttgaggtaaa cggcggcgag
1051  acacttgcgg ttagaaaagg cgaaaaatat ttcatccact ggcgcggacg
1101  ctggtgtctg gaagcgtgta cccgttatac ctaccggcgg cagttcggca
1151  acagcctgtc catactccgg cacgaagcgg gcggcattgt cttcagcgtc
1201  agcggaatgg cgggaagccg catcaggctt actccggaag acagcccgga
1251  acgcggtgta acctttatt tgcaggattg a
```

This corresponds to the amino acid sequence <SEQ ID 1550; ORF 537.ng>:

```
g537.pep
    1   MKSLFIWLLL LGSAAGVFYH TQNQSLPAGE LVYPSAPQIR DGGDALHYLN
   51   RIRTQIGLHA LAHAPVLENS ARRHARYLTL NPEDGHGEHH PDNPHYTAQK
  101   LTERTRLAGY LYNGVHENIS TEEEAAESSD SDIRTQQRQV DALMSAIYHR
  151   LSLLDRHTDE AGAAFVRENG KTVLVFNQGN GSFERACAKG RRQPEAGRKY
  201   YRNACHNGAA VYADEAMPVT ELLYTAYPVG GGALPYFYGE RPDPVPEYEI
  251   TGNPASIDFS EAAGKIAMKS FKLYQGKNEI RPVRVLTAGN DPNGRLTAHQ
  301   FALFPLKPLE YGTLYTAVFD YVRNGRHAQA KWQFRTRKPD YPYFEVNGGE
  351   TLAVRKGEKY FIHWRGRWCL EACTRYTYRR QFGNSLSILR HEAGGIVFSV
  401   SGMAGSRIRL TPEDSPERGV TLYLQD *
```

The following partial DNA sequence was identified in *N. meningitidis* <SEQ ID 1551>:

```
m537.seq (partial)
    1   ATGAAATCCC TTTTTATTCG GCTGCTCCTG TTGGGTTCGG CGGCAGGCGT
   51   TTTCTACCAT ACCCAAAmCC AATCCCTGCC CGCGGGCGAA CTTGTCTATC
  101   CGTCCGCACC GCAAATCAGG GACGGCGGCG ATGCGCTGCA CTACCTCAAC
  151   CGCATCCGAG CCCAAATCGG TTTGCACAAG CTGGCACACG CGCCGGTTTT
  201   GGAAAACTCC GCCCGCAgGC ACGCAAGCTA CCTCACGCTC AATCCCGAAG
  251   ACGGACACGG CGAACACCAT CCCGACAATC CGCACTACAC CGCACAAAAG
  301   CTGACCGAAC GCACACGCCT TGCCGGGTAT CTCTACAACG GCGTGCATGA
  351   AAACATCAGC ACGGAAGAAG AAGCCGCCGA ATCGTCCGAC AGCGACATCC
  401   GCACGCAGCA ACGCCAAGTG GACGGATTAA TGAGCGCAAT CTACCACCGC
  451   CTTTCCCTAC TTGACCGCCA TACGGATGAG TCAGGAGCGG CATT...
```

This corresponds to the amino acid sequence <SEQ ID 1552; ORF 537>:

```
m537.pep (partial)
    1   MKSLFIRLLL LGSAAGVFYH TQXQSLPAGE LVYPSAPQIR DGGDALHYLN

51   RIRAQIGLHK LAHAPVLENS ARRHASYLTL NPEDGHGEHH PDNPHYTAQK

101   LTERTRLAGY LYNGVHENIS TEEEAAESSD SDIRTQQRQV DGLMSAIYHR

151   LSLLDRHTDE SGAA...
```

Computer analysis of this amino acid sequence gave the following results:
Homology with a Predicted ORF from *N. gonorrhoeae*
ORF 537 shows 95.7% identity over a 164 aa overlap with a predicted ORF (ORF 537.ng) from *N. gonorrhoeae*:

```
    m537/g537
                      10        20        30        40        50        60
      m537.pep  MKSLFIRLLLLGSAAGVFYHTQXQSLPAGELVYPSAPQIRDGGDALHYLNRIRAQIGLHK
                ||||| |||||||||||||| ||||||||||||||||||||||||||||||| :|||||
         g537  MKSLFIWLLLLGSAAGVFYHTQNQSLPAGELVYPSAPQIRDGGDALHYLNRIRTQIGLHA
                      10        20        30        40        50        60

70        80        90       100       110       120
      m537.pep  LAHAPVLENSARRHASYLTLNPEDGHGEHHPDNPHYTAQKLTERTRLAGYLYNGVHENIS
                ||||||||||||||| ||||||||||||||||||||||||||||||||||||||||||||
         g537  LAHAPVLENSARRHARYLTLNPEDGHGEHHPDNPHYTAQKLTERTRLAGYLYNGVHENIS
                      70        80        90       100       110       120

130       140       150       160
      m537.pep  TEEEAAESSDSDIRTQQRQVDGLMSAIYHRLSLLDRHTDESGAA
                ||||||||||||||||||||||:|||||||||||||||:|||
         g537  TEEEAAESSDSDIRTQQRQVDALMSAIYHRLSLLDRHTDEAGAAFVRENGKTVLVFNQGN
                     130       140       150       160       170       180 g537  GSFERACAKGRRQPEAGRKYYRNACHNGAAVYADEAMPVTELLYTAYPVGGGALPYFYGE
                     190       200       210       220       230       240
```

The following partial DNA sequence was identified in *N. meningitidis* <SEQ ID 1553>:

```
    a537.seq
       1   ATGAAATCCC TTTTTATTCG GCTGCTCCTG TTGGGTTCGG CGGCCGGCGT
      51   TTTCTATCAT ACCCAAAACC AATCCCTGCC CGCGGGCGAA CTTGTCTATC
     101   CGTCCGCACC GCAAATCAGG GACGGCGGCG ATGCGCTGCA CTACCTCAAC
     151   CGCATCCGCG CCCAAATCGG TTTGCACAAG CTGGCACACG CGCCGGTTTT
     201   GGAAAATTCC GCCCGCAGGC ACGCACGCTA TCTCACGCTC AATCCCGAAG
     251   ACGGACACGG CGAACACCAT CCCGACAATC CGCACTACAC CGCACAAAAG
     301   CTGACCGAAC GCACACGCCT TGCCGGGTAT CTCTACAACG GCGTGCATGA
     351   AAACATCAGC ACGGAAGAGG AAGCCGCCGA ATCGTCCGAC AGCGACATCC
     401   GCACGCAGCA ACGCCAAGTG GACGGATTAA TGAGCGCAAT CTACCACCGC
     451   CTTTCCCTAC TTGACCGCCA TACGGATGAG GCAGGAGCGG CATTTGTGCG
     501   CGAAAACGGT AAAACCGTTC TCGTATTCAA TCAGGGCAAC GGCAGGTTTG
     551   AGCGGCATTG CGCCCAAGGC AGAAATCAGC CGGAAGCAGG ACGGAAATAT
     601   TACCGCAACG CCTGCCATAA CGGTGCGGTC GTGTACACCG ACGAAGCCAT
     651   GCCCGCACAG GAGCTGCTCT ATACAGCCTA TCCCGTCGGC AACGGCGCAC
     701   TGCCTTATTT CCACGGCGAG CGTCCAGACC CCGTGCCGGA ATATGAAATC
     751   ACGGGCAATC CTGCCAGCAT TGATTTTTCC GAGGCGGCAG GCAAAATTAC
     801   GATGAAAAGT TTCAAGCTGT ATCAGGGTAA AAACGAAATC CGCCCCGTCA
     851   GGGTTTTAAC CGCCGGCAAC GACCCCAACG GCAGGCTGAC CGCGTACCAA
     901   TTCGCGCTTT TCCCGCTCAA GCCTTTGGAA TACGGTACGC TTTATACGGC
     951   GGTATTCGAC TATGTCCGCA ACGGACGGCG CGCGCAGGCG AAATGGCAGT
    1001   TTAGAACCCG AAAACCCGAT TACCCTTATT TTGAGGTAAA CGGCGGCGAG
    1051   ACACTTGCGG TTAGAAAAGG CGAAAAATAT TTCATCCACT GGCGCGGACG
    1101   CTGGTGTTTG GAAGCGTGTA CCCGTTATAC CTACCGGCAG CGACCCGGCA
    1151   GCCGCCTGTC CATAGGAAGG CACAAGGCGG GCGGCATCGT CTTCAGCGTT
```

-continued

```
1201  GACGGAATGG CGGGCAGCCG CATCACGCTT GCACCGGAAG GAGAAACGGA

1251  ACGAGGCGTA ACCCTTTATT TACAGGATTG A
```

This corresponds to the amino acid sequence <SEQ ID 1554; ORF 537.a>:

```
a537.pep
    1  MKSLFIRLLL LGSAAGVFYH TQNQSLPAGE LVYPSAPQIR DGGDALHYLN

51  RIRAQIGLHK LAHAPVLENS ARRHARYLTL NPEDGHGEHH PDNPHYTAQK

101  LTERTRLAGY LYNGVHENIS TEEEAAESSD SDIRTQQRQV DGLMSAIYHR

151  LSLLDRHTDE AGAAFVRENG KTVLVFNQGN GRFERHCAQG RNQPEAGRKY

201  YRNACHNGAV VYTDEAMPAQ ELLYTAYPVG NGALPYFHGE RPDPVPEYEI

251  TGNPASIDFS EAAGKITMKS FKLYQGKNEI RPVRVLTAGN DPNGRLTAYQ

301  FALFPLKPLE YGTLYTAVFD YVRNGRRAQA KWQFRTRKPD YPYFEVNGGE

351  TLAVRKGEKY FIHWRGRWCL EACTRYTYRQ RPGSRLSIGR HKAGGIVFSV

401  DGMAGSRITL APEGETERGV TLYLQD*
``` m537/a537 98.2% identity in 164 aa overlap

```
                 10        20        30        40        50        60
   m537.pep  MKSLFIRLLLLGSAAGVFYHTQXQSLPAGELVYPSAPQIRDGGDALHYLNRIRAQIGLHK
              ||||||  |||||||||||||||| |||||||||||||||||||||||||||||:|||||
   a537      MKSLFIWLLLLGSAAGVFYHTQNQSLPAGELVYPSAPQIRDGGDALHYLNRIRTQIGLHA
                 10        20        30        40        50        60

70        80        90       100       110       120
   m537.pep  LAHAPVLENSARRHASYLTLNPEDGHGEHHPDNPHYTAQKLTERTRLAGYLYNGVHENIS
              ||||||||||||||| |||||||||||||||||||||||||||||||||||||||||||||
   a537      LAHAPVLENSARRHARYLTLNPEDGHGEHHPDNPHYTAQKLTERTRLAGYLYNGVHENIS
                 70        80        90       100       110       120

130       140       150       160
   m537.pep  TEEEAAESSDSDIRTQQRQVDGLMSAIYHRLSLLDRHTDESGAA
              |||||||||||||||||||||||||||||||||||||||:|||
   a537      TEEEAAESSDSDIRTQQRQVDGLMSAIYHRLSLLDRHTDEAGAAFVRENGKTVLVFNQGN
                130       140       150       160       170       180 a537      GSFERACAKGRRQPEAGRKYYRNACHNGAAVYADEAMPVTELLYTAYPVGGGALPYFYGE
                190       200       210       220       230       240
```

The following partial DNA sequence was identified in *N. gonorrhoeae* <SEQ ID 1555>:

```
g538.seq
    1  atgtcaggta gaacaggacg gaacagtgcc actcaggcgc aaccggaacg 51  cgtcatgctg gtgggcgtaa tgttggataa agatgatacg ggcagcaatg 101  ccgcccgtct gaacggtttt cagacggcat tggcggaagc cgtcgagctg 151  gtcaaagcgg cgggcggcga ttccgtacgc gtggagactg ccaaacgcga 201  ccgcccgcac actgcgctgt tgtcggcac gggcaaggcg gcggagctgt 251  cggaagcagt tgccgcagac ggcattgatt tggtcgtatt caaccacgaa 301  cttactccca cgcaggaacg caatttggaa aaaatcctcc aatgccgcgt 351  attggacaga gtgggctga ttctggcgat tttcgcccgc cgcgcccgca 401  cgcaggaagg caggctgcaa gtcgagttgg cgcaattgag ccatttggcg 451  ggacgcttga tacgcggtta cggacatttg caaagccagc gcggcggtat 501  cggcatgaaa gggccgggcg aaaccaaact ggaaaccgac cgccgattaa
```

-continued

```
 551  ccgcccatcg gatcaacgcc ttgaaaaaac agcttgccaa cctcaaaaaa
 601  cagcgcgccc tgcgccgcaa gtcccgcgag tcgggcagaa tcaaaacgtt
 651  tgcgctggtc ggctatacca atgtcggcaa atccagcctg ttcaaccggc
 701  tgaccaagtc gggcatatat gcgaaagacc agcttttcgc cactctcgac
 751  acgacggcgc ggcggctgta catcagtccc gcatgcagca ttatcctgac
 801  cgataccgtc ggattcgtca gcgatctgcc gcacaaactg atttccgcct
 851  tttccgccac cttggaagaa accgtgcaag ccgatgtgct gctgcacgtc
 901  gtcgatgctg ccgcccggaa cagcgggcag cagattgaag acgtggaaaa
 951  cgtactgcaa gaaatccatg cccacgatat tccgtgcatc aaggtgtaca
1001  acaaaaccga cctgctgccg tctgaagaac aaaacacggg catatggcgc
1051  gacgctgcgg gaaaaattgc cgccgtccgc atttccgttg ctgaaaatac
```

20

This corresponds to the amino acid sequence <SEQ ID 1556;
ORF 538.ng>:

```
g538.pep
   1  MSGRTGRNSA TQAQPERVML VGVMLDKDDT GSNAARLNGF QTALAEAVEL
  51  VKAAGGDSVR VETAKRDRPH TALFVGTGKA AELSEAVAAD GIDLVVFNHE
 101  LTPTQERNLE KILQCRVLDR VGLILAIFAR RARTQEGRLQ VELAQLSHLA
 151  GRLIRGYGHL QSQRGGIGMK GPGETKLETD RRLTAHRINA LKKQLANLKK
 201  QRALRRKSRE SGRIKTFALV GYTNVGKSSL FNRLTKSGIY AKDQLFATLD
 251  TTARRLYISP ACSIILTDTV GFVSDLPHKL ISAFSATLEE TVQADVLLHV
 301  VDAAARNSGQ QIEDVENVLQ EIHAHDIPCI KVYNKTDLLP SEEQNTGIWR
 351  DAAGKIAAVR ISVAENTGID ALREAIAEYC AAAPNTDETE MP*
```

The following partial DNA sequence was identified in *N. meningitidis* <SEQ ID 1557>:

```
m538.seq
   1  ATGACAGGCA GAACAGGCGG CAACGGCAGT ACCCAAGCGC AACCCGAACG
  51  CGTCATGCTG GTGGGCGTAA TGTTGGACAA AGATGGTACG GGCAGTAGTG
 101  CCGCCCGTCT GAACGGTTTT CAGACGGCAT TGGCGGAAGC TGTCGAGCTG
 151  GTCAAAGCGG CGGGCGGCGA TTCCGTGCGC GTGGAGACTG CCAAACGCGA
 201  CCGTCCGCAC ACCGCGCTGT TTGTCGGCAC GGGCAAGGCG GCGGAGCTGT
 251  CAGAAGCAGT TGCCGCAGAC GGCATCGATT TGGTCGTATT CAACCACGAA
 301  CTCACGCCCA CGCAGGAACG CAACCTTGAA AAAGAACTsA AATGCCGCGT
 351  ATTGGACAGG GTAGGGCTGA TTCTGGCGAT TTTCGCTCGC CGCGCCCGCA
 401  CGCAGGAAGG CAGGCTGCAA GTCGAGTTGG CGCAATTGAG CCATTTGGCG
 451  GGACGCTTGA TACGCGGTTA CGGCCATCTG CAGAGCCAGC GCGGCGGTAT
 501  CGGCATGAAA GGCCCCGGCG AAACCAAACT GGAAACCGAC CGCCGATTGA
 551  TCGCCCATCG GATCAATGCC TTGATAAAAC AGCTTGCCAA CCTCAAAAAA
 601  CAGCGCGCCC TGCGCCGCAA GTCnCGCGAA TCGGGCACAA TCAAAACGTT
 651  TGCGCTGGTC GGCTATACAA ATGTCGGAAA ATCCAGCCTG TTCAACCGGC
 701  TGACAAAGTC GGGCATATAT GCAAGGACA AGCTTAGTCC CGAATGCAGC
```

-continued

```
 751   ATTATCCTGA CCGATACCGT CGGATTCGTn AGCGATCTGC CGCAcAAACT
 801   GATTTCCGCC TTTTCgCC.A CGCTGGAAGA AACCGCGCAA GCCGATGTGC
 851   TGCTGCACGT CGTCGATGCC GCCGCTCCGA ACAGCGGACA GCAGATTGAA
 901   GACGTGGAAA ACGTACTGCA AGAAATCCAT GCCGGCGATA TTCCGTGCAT
 951   cAAGGTGTAC AACAAAACCG ACCTGCTGCC GTCTGAAGAA CAAAACACGG
1001   GCATATGGCG CGACGCTGCG GGAAAAATTG CCGCCGTCCG CATTTCCGTT
1051   GCTGAAAATA CCGGTATAGA CGCACTGCGC GAAGCcATTG CCGAGTCTTG
1101   TGCCGCCGCA CCAAACACAG ACGAAACCGA AATGCCATGA
```

This corresponds to the amino acid sequence <SEQ ID 1558; ORF 538>:

```
m538.pep
    1   MTGRTGGNGS TQAQPERVML VGVMLDKDGT GSSAARLNGF QTALAEAVEL
   51   VKAAGGDSVR VETAKRDRPH TALFVGTGKA AELSEAVAAD GIDLVVFNHE
  101   LTPTQERNLE KELKCRVLDR VGLILAIFAR RARTQEGRLQ VELAQLSHLA
  151   GRLIRGYGHL QSQRGGIGMK GPGETKLETD RRLIAHRINA LIKQLANLKK
  201   QRALRRKSRE SGTIKTFALV GYTNVGKSSL FNRLTKSGIY AKDKLSPECS
  251   IILTDTVGFV SDLPHKLISA FSXTLEETAQ ADVLLHVVDA AAPNSGQQIE
  301   DVENVLQEIH AGDIPCIKVY NKTDLLPSEE QNTGIWRDAA GKIAAVRISV
  351   AENTGIDALR EAIAESCAAA PNTDETEMP*
```

Computer analysis of this amino acid sequence gave the following results:
Homology with a Predicted ORF from *N. gonorrhoeae*
ORF 538 shows 92.1% identity over a 392 aa overlap with a predicted ORF (ORF 538.ng) from *N. gonorrhoeae*:

```
   m538/g538
                  10         20         30         40         50         60
   m538.pep  MTGRTGGNGSTQAQPERVMLVGVMLDKDGTGSSAARLNGFQTALAEAVELVKAAGGDSVR
             |:||||  |::|||||||||||||||||||  |::|||||||||||||||||||||||||
   g538      MSGRTGRNSATQAQPERVMLVGVMLDKDDTGSNAARLNGFQTALAEAVELVKAAGGDSVR
                  10         20         30         40         50         60

70         80         90        100        110        120
   m538.pep  VETAKRDRPHTALFVGTGKAAELSEAVAADGIDLVVFNHELTPTQERNLEKELKCRVLDR
             |||||||||||||||||||||||||||||||||||||||||||||||||||:|||||||
   g538      VETAKRDRPHTALFVGTGKAAELSEAVAADGIDLVVFNHELTPTQERNLEKILQCRVLDR
                  70         80         90        100        110        120

130        140        150        160        170        180
   m538.pep  VGLILAIFARRARTQEGRLQVELAQLSHLAGRLIRGYGHLQSQRGGIGMKGPGETKLETD
             ||||||||||||||||||||||||||||||||||||||||||||||||||||||||||||
   g538      VGLILAIFARRARTQEGRLQVELAQLSHLAGRLIRGYGHLQSQRGGIGMKGPGETKLETD
                 130        140        150        160        170        180

190        200        210        220        230        240
   m538.pep  RRLIAHRINALIKQLANLKKQRALRRKSRESGTIKTFALVGYTNVGKSSLFNRLTKSGIY
             ||| |||||||| ||||||||||||||||||| |||||||||||||||||||||||||||
   g538      RRLIAHRINALKKQLANLKKQRALRRKSRESGRIKTFALVGYTNVGKSSLFNRLTKSGIY
                 190        200        210        220        230        240

250        260        270        280
   m538.pep  AKDKL-------------SPECSIILTDTVGFVSDLPHKLISAFSXTLEETAQADVLLHV
             |||:|             || |||||||||||||||||||||||  |||||:|||||||
   g538      AKDQLFATLDTTARRLYISPACSIILTDTVGFVSDLPHKLISAFSATLEETVQADVLLHV
                 250        260        270        280        290        300

290        300        310        320        330        340
   m538.pep  VDAAAPNSGQQIEDVENVLQEIHAGDIPCIKVYNKTDLLPSEEQNTGIWRDAAGKIAAVR
             ||||| ||||||||||||||||||| ||||||||||||||||||||||||||||||||||
   g538      VDAAARNSGQQIEDVENVLQEIHAHDIPCIKVYNKTDLLPSEEQNTGIWRDAAGKIAAVR
                 310        320        330        340        350        360
```

```
                350        360        370        380
m538.pep  ISVAENTGIDALREAIAESCAAAPNTDETEMPX
          |||||||||||||||||| |||||||||||||||
g538      ISVAENTGIDALREAIAEYCAAAPNTDETEMPX
```

The following partial DNA sequence was identified in *N. meningitidis* <SEQ ID 1559>:

```
a538.seq
    1  ATGACAGGCA GAACAGGCCG CAACGGCAGT ACCCAAGCGC AACCCGAACG
   51  CGTCATGCTG GTGGGCGTAA TGTTGGACAA AGATGGTACG GGCAGCAGTG
  101  CCACCCGTCT GAACGGTTTT CAGACGGCAT TGGCGGAAGC TGTCGAGCTG
  151  GTCAAAGCGG CGGGCGGCGA TTCCGTGCGC GTGGAGACTG CCAAACGCGA
  201  CCGTCCGCAC ACCGCGCTGT TTGTCGGCAC GGGCAAGGCG GCGGAGCTGT
  251  CGGAAGCAGT TGCCGCAGAC GGCATCGATT TGGTCGTATT CAACCACGAA
  301  CTTACGCCCA CGCAGGAACG CAATTTGGAA AAAATCCTCC AATGCCGCGT
  351  ATTGGACAGA GTGGGGCTGA TTCTGGCGAT TTTCGCCCGC CGCGCCCGCA
  401  CGCAGGAAGG CAGGCTGCAA GTCGAGTTGG CACAATTGAG CCATTTGGCG
  451  GGACGCTTGA TACGCGGTTA CGGCCATCTG CAGAGCCAGC GCGGCGGTAT
  501  CGGCATGAAA GGCCCCGGCG AAACCAAACT GGAAACCGAC CGCCGATTGA
  551  TCGCCCATCG GATCAATGCC TTGAAAAAAC AGCTTGCCAA CCTCAAAAAA
  601  CAGCGCGCCC TGCGCCGCAA GTCCCGCGAA TCGGGCACAA TCAAAACGTT
  651  TGCGCTGGTC GGCTATACCA ATGTCGGCAA ATCCAGTCTG TTCAACCGGC
  701  TGACCAAGTC GGGCATATAT GCGAAAGACC AGCTTTTCGC CACACTCGAC
  751  ACGACGGCGC GGCGGCTGTA CATCAGTCCC GAATGCAGCA TTATCCTGAC
  801  CGATACCGTC GGATTCGTCA GCGATCTGCC GCACAAACTG ATTTCCGCCT
  851  TTTCCGCCAC GCTGGAAGAA ACCGCGCAAG CCGATGTGCT GCTGCACGTC
  901  GTCGATGCCG CCGCTCCGAA CAGCGGACAG CAGATTGAAG ACGTGGAAAA
  951  CGTACTGCAA GAAATCCATG CCGGCGATAT TCCGTGCATC AAGGTGTACA
 1001  ACAAAACCGA CCTGCTGCCG TCTGAAGAAC AAAACACGGG CATATGGCGC
 1051  GACGCTGCGG GAAAAATTGC CGCCGTCCGC ATTTCCGTTG CTGAAAATAC
 1101  CGGTATAGAC GCACTGCGCG AAGCCATTGC CGAGTATTGT GCCGCCGCAC
 1151  CAAACACAGA CGAAACCGAA ATGCCATGA
```

This corresponds to the amino acid sequence <SEQ ID 1560; ORF 538.a>:

```
a538.pep
    1  MTGRTGRNGS TQAQPERVML VGVMLDKDGT GSSATRLNGF QTALAEAVEL

51  VKAAGGDSVR VETAKRDRPH TALFVGTGKA AELSEAVAAD GIDLVVFNHE

101  LTPTQERNLE KILQCRVLDR VGLILAIFAR RARTQEGRLQ VELAQLSHLA

151  GRLIRGYGHL QSQRGGIGMK GPGETKLETD RRLIAHRINA LKKQLANLKK

201  QRALRRKSRE SGTIKTFALV GYTNVGKSSL FNRLTKSGIY AKDQLFATLD

251  TTARRLYISP ECSIILTDTV GFVSDLPHKL ISAFSATLEE TAQADVLLHV
```

-continued

```
301 VDAAAPNSGQ QIEDVENVLQ EIHAGDIPCI KVYNKTDLLP SEEQNTGIWR

351 DAAGKIAAVR ISVAENTGID ALREAIAEYC AAAPNTDETE MP*
``` m538/a538 94.6% identity in 392 aa overlap

```
                 10         20         30         40         50         60
m538.pep MTGRTGGNGSTQAQPERVMLVGVMLDKDGTGSSAARLNGFQTALAEAVELVKAAGGDSVR
         ||||||  |||||||||||||||||||||||||: ||||||||||||||||||||||||
a538     MTGRTGRNGSTQAQPERVMLVGVMLDKDGTGSSATRLNGFQTALAEAVELVKAAGGDSVR
                 10         20         30         40         50         60
                 70         80         90        100        110        120
m538.pep VETAKRDRPHTALFVGTGKAAELSEAVAADGIDLVVFNHELTPTQERNLEKELKCRVLDR
         |||||||||||||||||||||||||||||||||||||||||||||||||| :||||||
a538     VETAKRDRPHTALFVGTGKAAELSEAVAADGIDLVVFNHELTPTQERNLEKILQCRVLDR
                 70         80         90        100        110        120
                130        140        150        160        170        180
m538.pep VGLILAIFARRARTQEGRLQVELAQLSHLAGRLIRGYGHLQSQRGGIGMKGPGETKLETD
         |||||||||||||||||||||||||||||||||||||||||||||||||||||||||||
a538     VGLILAIFARRARTQEGRLQVELAQLSHLAGRLIRGYGHLQSQRGGIGMKGPGETKLETD
                130        140        150        160        170        180
                190        200        210        220        230        240
m538.pep RRLIAHRINALIKQLANLKKQRALRRKSRESGTIKTFALVGYTNVGKSSLFNRLTKSGIY
         |||||||||||| ||||||||||||||||||||||||||||||||||||||||||||||
a538     RRLIAHRINALKKQLANLKKQRALRRKSRESGTIKTFALVGYTNVGKSSLFNRLTKSGIY
                190        200        210        220        230        240
                           250        260        270        280
m538.pep AKDKL-------------SPECSIILTDTVGFVSDLPHKLISAFSXTLEETAQADVLLHV
         ||| :             ||||||||||||||||||||||||||| |||||||||||||
a538     AKDQLFATLDTTARRLYISPECSIILTDTVGFVSDLPHKLISAFSATLEETAQADVLLHV
                250        260        270        280        290        300
                290        300        310        320        330        340
m538.pep VDAAAPNSGQQIEDVENVLQEIHAGDIPCIKVYNKTDLLPSEEQNTGIWRDAAGKIAAVR
         |||||||||||||||||||||||||||||||||||||||||||||||||||||||||||
a538     VDAAAPNSGQQIEDVENVLQEIHAGDIPCIKVYNKTDLLPSEEQNTGIWRDAAGKIAAVR
                310        320        330        340        350        360
                350        360        370        380
m538.pep ISVAENTGIDALREAIAESCAAAPNTDETEMPX
         |||||||||||||||||| |||||||||||||
a538     ISVAENTGIDALREAIAEYCAAAPNTDETEMPX
                370        380        390
```

The following partial DNA sequence was identified in *N. gonorrhoeae* <SEQ ID 1561>:

```
g539.seq
    1 atggaggatc tgcaggaaat cgggttcgat gtcgccgccg taaaggtagg 51 tcggcagcgc gaacatcatc gtctgcatca tacccagtcc ggcaacggca 101 aggcggacga tgtattgttt gcgttctttt tggttggcgg cttcgatttt 151 ttgcgcgtca tagggtgcgg cggtgtagcc tgtctgccgg attttcaaca 201 gaatgtcgga gaggcggatt ttgccgtcgt cccagacgac gcggcagcgg 251 tgcgtgctgt aattgaggtc gatgcggacg atgccgtctg tgcgcaaaag 301 ctgctgttcg atcagccaga cgcaggcggc gcaggtaatg ccgctgagca 351 tcagcactgc ttcgtgcgtg ccattatggg tttccacaaa gtcggattgg 401 acttcgggca ggtcgtacag gcggatttgg tcgaggattt cttggggcgg 451 cagttcggtt tttttcgcgt cggcggtgcg tcgtttgtaa taactgccca 501 agccggaatc gatgatgctt tgtgcgactg cctgacagcc gacgcagcag 551 gtttcgcggt cttcgccttc gtagcggacg tcagatgca ggttttcggg 601 aacgtccagc ccgcagtgga aacaggtttt tttcatggca tttcggtttc 651 gtctgtgttt ggtgcggcgg cacaatactc ggcaatggct tcgcgcagtg
```

```
-continued
 701   cgtctatacc ggtattttca gcaacggaaa tgcggacggc ggcaattttt 751   cccgcagcgt cgcgccatat gcccgtgttt tgttcttcag acggcagcag 801   gtcggttttg ttgtacacct tgatgcacgg aatatcgtgg gcatggattt 851   cttgcagtac gttttccacg tcttcaatct gctgcccgct gttccgggcg 901   gcagcatcga cgacgtgcag cagcacatcg gcttgcacgg tttcttccaa 951   ggtggcggaa aaggcggaaa tcagtttgtg cggcagatcg ctgacgaatc 1001   cgacggtatc ggtcaggata atgctgcatg cgggactgat gtacagccgc 1051   cgcgccgtcg tgtcgagagt ggcgaaaagc tggtctttcg catatatgcc 1101   cgacttggtc agccggttga acaggctgga tttgccgaca ttggtatag
```

This corresponds to the amino acid sequence <SEQ ID 1562; ORF 539.ng>:

```
g539.pep
  1    MEDLQEIGFD VAAVKVGRQR EHHRLHHTQS GNGKADDVLF AFFLVGGFDF

51    LRVIGCGGVA CLPDFQQNVG EADFAVVPDD AAAVRAVIEV DADDAVCAQK

101    LLFDQPDAGG AGNAAEHQHC FVRAIMGFHK VGLDFGQVVQ ADLVEDFLGR

151    QFGFFRVGGA SFVITAQAGI DDALCDCLTA DAAGFAVFAF VADGQMQVFG

201    NVQPAVETGF FHGISVSSVF GAAAQYSAMA SRSASIPVFS ATEMRTAAIF

251    PAASRHMPVF CSSDGSRSVL LYTLMHGISW AWISCSTFST SSICCPLFRA

301    AASTTCSSTS ACTVSSKVAE KAEISLCGRS LTNPTVSVRI MLHAGLMYSR

351    RAVVSRVAKS WSFAYMPDLV SRLNRLDLPT LV*
```

The following partial DNA sequence was identified in *N. meningitidis* <SEQ ID 1563>:

```
m539.seq (partial)
  1    ATGGAGGATT TGCAGGAAAT CGGGTTCGAT GTCGCCGCCG TAAAGGTAGG

51    TCGGCAGCGC GAACATCATC GTCTGCATCA TCCCCAGCCC GGCAACGGCG

101    AGGCGGACGA TGTATTGTTT GCGTTCTTTT TGGTTGGCGG CTTCGATTTT

151    TTGCGCGTCA TAGGGTGCGG CGGTGTAGCC TATCTGCCTG ATTTTCAACA

201    GAATGTCGGA AAGGCGGATT TTGCCGTCGT CCCAGACGAc GCGGcAGCgG

251    TGCGTGCTGT AATTGAGGTC GATGCGGACG ATGCCGTCTG TACGCAAAAG

301    CTGCTGTTCG ATCAGCCAGA CGCAGGCGGC GCAGGTGATG CCGCCGAGCA

351    TTAAAACCGC CTCGCGCGTG CCGCCGTGGG TTTCCACAAA GTCGGACTGG

401    ACTTCGGGCA GGTCGTACAG GCGGATTTGG TCGAGGATTT CTTGGGGCGG

451    CAgCTCGGTT TTTTGCGCGT CGGCGGTGCG TTGTTTGTAA TAACTGCCCA

501    AGCCCGCGTC AATAATGCTT TGTGCGACCG CCTGACAGCC GGCGCaCAgG

551    GTTTCGCGGT CTTCGTTTTC GTAACGGACA GTCAGGTGGA GGTGTTCGGG

601    AACATCCAGA CCGCAGTGGA AACAGGTTTT TTTCATGGCA TTTCGGTTTC

651    GTCTGTGTTT GGTGCGGCGG CACAAGACTC GGCAATgGCT TCGCGCAGTG

701    CGTCTATACC GGTATTTTCA GCAACGGAAA TGCGGACGGC GGCAATTTTT

751    CCCGCAGCGT CGCGCCATAT GTCTGTGTTT TGTTCTTCAG ACGGCAGCAG
```

-continued

```
 801  GTCGGTTTTG TTGTACACCT TgATGCACGG AATATCGCCG GCATGGATTT
 851  CTTGCAGTAC GTTTTCCACG TCTTCAATCT GCTGTCCGCT GTTCGGAGCG
 901  GCGGCATCGA CGACGTGCAG CAGCACATCG GCTTGCGCGG TTTCTTCCAG
 951  CGTGGcG.AA AAGGCGGAAA TCAGTTTgTG CGGCAGATCG CTnACGAATC
1001  CGACGGTATC GGTCAGGATA ATGCTGCATT CGGGAC...
```

This corresponds to the amino acid sequence <SEQ ID 1564; ORF 539>:

```
m539.pep (partial)
    1  MEDLQEIGFD VAAVKVGRQR EHHRLHHPQP GNGEADDVLF AFFLVGGFDF

51  LRVIGCGGVA YLPDFQQNVG KADFAVVPDD AAAVRAVIEV DADDAVCTQK

101  LLFDQPDAGG AGDAAEH*NR LARAAVGFHK VGLDFGQVVQ ADLVEDFLGR

151  QLGFLRVGGA LFVITAQARV NNALCDRLTA GAQGFAVFVF VTDSQVEVFG

201  NIQTAVETGF FHGISVSSVF GAAAQDSAMA SRSASIPVFS ATEMRTAAIF

251  PAASRHMPVF CSSDGSRSVL LYTLMHGISP AWISCSTFST SSICCPLFGA

301  AASTTCSSTS ACAVSSSVAX KAEISLCGRS LTNPTVSVRI MLHSG....
```

Computer analysis of this amino acid sequence gave the following results:
Homology with a Predicted ORF from *N. gonorrhoeae*
ORF 539 shows 89% identity over a 345 aa overlap with a predicted ORF (ORF 539.ng) from *N. gonorrhoeae*:

```
    m539/g539
                   10         20         30         40         50         60
    m539.pep  MEDLQEIGFDVAAVKVGRQREHHRLHHPQPGNGEADDVLFAFFLVGGFDFLRVIGCGGVA
              |||||||||||||||||||||||||||| | |||:|||||||||||||||||||||||||
    g539      MEDLQEIGFDVAAVKVGRQREHHRLHHTQSGNGKADDVLFAFFLVGGFDFLRVIGCGGVA
                   10         20         30         40         50         60

70         80         90        100        110        120
    m539.pep  YLPDFQQNVGKADFAVVPDDAAAVRAVIEVDADDAVCTQKLLFDQPDAGGAGDAAEHXNR
              ||||||||:|||||||||||||||||||||||||||:|||||||||||||||:||||  :
    g539      CLPDFQQNVGEADFAVVPDDAAAVRAVIEVDADDAVCAQKLLFDQPDAGGAGNAAEHQHC
                   70         80         90        100        110        120

130        140        150        160        170        180
    m539.pep  LARAAVGFHKVGLDFGQVVQADLVEDFLGRQLGFLRVGGALFVITAQARVNNALCDRLTA
              ::||  :|||||||||||||||||||||||:||:|||| |||||||| :::||||| ||
    g539      FVRAIMGFHKVGLDFGQVVQADLVEDFLGRQFGFFRVGGASFVITAQAGIDDALCDCLTA
                  130        140        150        160        170        180

190        200        210        220        230        240
    m539.pep  GAQGFAVFVFVTDSQVEVFGNIQTAVETGFFHGISVSSVFGAAAQDSAMASRSASIPVFS
              |  |||||:||:||:|:::|||:| ||||||||||||||||||||:|||||||||||||
    g539      DAAGFAVFAFVADGQMQVFGNVQPAVETGFFHGISVSSVFGAAAQYSAMASRSASIPVFS
                  190        200        210        220        230        240

250        260        270        280        290        300
    m539.pep  ATEMRTAAIFPAASRHMPVFCSSDGSRSVLLYTLMHGISPAWISCSTFSTSSICCPLFGA
              |||||||||||||||||||||||||||||||||||||||| |||||||||||||||||||
    g539      ATEMRTAAIFPAASRHMPVFCSSDGSRSVLLYTLMHGISWAWISCSTFSTSSICCPLFRA
                  250        260        270        280        290        300

310        320        330        340
    m539.pep  AASTTCSSTSACAVSSSVAXKAEISLCGRSLTNPTVSVRIMLHSG
              ||||||||||:|||:||||||||||||||||||||||||||||:|
    g539      AASTTCSSTSACTVSSKVAEKAEISLCGRSLTNPTVSVRIMLHAGLMYSRRAVVSRVAKS
                  310        320        330        340        350        360 g539      WSFAYMPDLVSRLNRLDLPTLV
                  370        380
```

The following partial DNA sequence was identified in *N. meningitidis* <SEQ ID 1565>:

```
a539.seq
    1 ATGGAGGATT TGCAGGAAAT CGGGTTCGAT GTCGCCGCCG TAAAGGTAGG
   51 TCGGCAGCGC GAACATCATC GTCTGCATCA TCCCCAGCCC GGCAACGGCG
  101 AGGCGGACGA TGTATTGTTT GCGTTCTTTT TGGTTGGCGG CTTCGATTTT
  151 TTGCGCGTCA TAGGGTGCGG CGGTGTAGCC TATCTGCCTG ATTTTCAACA
  201 GAATGTCGGA AAGGCGGATT TTGCCGTCGT CCCAGACGAC GCGGCAGCGG
  251 TGCGTGCTGT AATTGAGGTC GATGCGGACG ATGCCGTCTG TACGCAAAAG
  301 CTGCTGTTCG ATCAGCCAGA CGCAGGCGGC GCAGGTGATG CCGCCGAGCA
  351 TTAAAACCGC CTCGCGCGTG CCGCCGTGGG TTTCCACAAA GTCGGACTGG
  401 ACTTCGGGCA GGTCGTACAG GCGGATTTGG TCGAGGATTT CTTGGGGCGG
  451 CAGCTCGGTT TTTTGCGCGT CGGCGGTGCG TTGTTTGTAA TAACTGCCCA
  501 AGCCCGCGTC AATAATGCTT TGTGCGACTG CCTGACAACC GGCGCAGCAG
  551 GTTTCGCGGT CTTCGTTTTC GTAACGGACG GTCAGATGCA GGTTTTCGGG
  601 AACGTCCAGC CCGCAGTGGA ACAGGTTTT TTTCATGGCA TTTCGGTTTC
  651 GTCTGTGTTT GGTGCGGCGG CACAATACTC GGCAATGGCT TCGCGCAGTG
  701 CGTCTATACC GGTATTTTCA GCAACGGAAA TGCGGACGGC GGCAATTTTT
  751 CCCGCAGCGT CGCGCCATAT GCCCGTGTTT TGTTCTTCAG ACGGCAGCAG
  801 GTCGGTTTTG TTGTACACCT TGATGCACGG AATATCGCCG GCATGGATTT
  851 CTTGCAGTAC GTTTTCCACG TCTTCAATCT GCTGTCCGCT GTTCGGAGCG
  901 GCGGCATCGA CGACGTGCAG CAGCACATCG GCTTGCGCGG TTTCTTCCAG
  951 CGTGGCGGAA AAGGCGGAAA TCAGTTTGTG CGGCAGATCG CTGACGAATC
 1001 CGACGGTATC GGTCAGGATA ATGCTGCATT CGGGACTGAT GTACAGCCGC
 1051 CGCGCCGTCG TGTCGAGTGT GGCGAAAAGC TGGTCTTTCG CATATATGCC
 1101 CGACTTGGTC AGCCGGTTGA ACAGACTGGA TTTGCCGACA TTGGTATAG
```

This corresponds to the amino acid sequence <SEQ ID 1566; ORF 539.a>:

```
a539.pep
    1 MEDLQEIGFD VAAVKVGRQR EHHRLHHPQP GNGEADDVLF AFFLVGGFDF
   51 LRVIGCGGVA YLPDFQQNVG KADFAVVPDD AAAVRAVIEV DADDAVCTQK
  101 LLFDQPDAGG AGDAAEH*NR LARAAVGFHK VGLDFGQVVQ ADLVEDFLGR
  151 QLGFLRVGGA LFVITAQARV NNALCDCLTT GAAGFAVFVF VTDGQMQVFG
  201 NVQPAVETGF FHGISVSSVF GAAAQYSAMA SRSASIPVFS ATEMRTAAIF
  251 PAASRHMPVF CSSDGSRSVL LYTLMHGISP AWISCSTFST SSICCPLFGA
  301 AASTTCSSTS ACAVSSSVAE KAEISLCGRS LTNPTVSVRI MLHSGLMYSR
  351 RAVVSSVAKS WSFAYMPDLV SRLNRLDLPT LV*
``` m539/a539 97.1% identity in 345 aa overlap

```
                   10         20         30         40         50         60
    m539.pep  MEDLQEIGFDVAAVKVGRQREHHRLHHPQPGNGEADDVLFAFFLVGGFDFLRVIGCGGVA
              ||||||||||||||||||||||||||||||||||||||||||||||||||||||||||||
    a539      MEDLQEIGFDVAAVKVGRQREHHRLHHPQPGNGEADDVLFAFFLVGGFDFLRVIGCGGVA
                   10         20         30         40         50         60
```

```
                70          80          90         100         110        120
m539.pep  YLPDFQQNVGKADFAVVPDDAAAVRAVIEVDADDAVCTQKLLFDQPDAGGAGDAAEGXNR
          ||||||||||||||||||||||||||||||||||||||||||||||||||||||||||||
a539      YLPDFQQNVGKADFAVVPDDAAAVRAVIEVDADDAVCTQKLLFDQPDAGGAGDAAEGXNR
                70          80          90         100         110        120

130         140         150         160         170        180
m539.pep  LARAAVGFHKVGLDFGQVVQADLVEDFLGRQLGFLRVGGALFVITAQARVNNALCDRLTA
          ||||||||||||||||||||||||||||||||||||||||||||||||||||||||| |:
a539      LARAAVGFHKVGLDFGQVVQADLVEDFLGRQLGFLRVGGALFVITAQARVNNALCDCLTT
               130         140         150         160         170        180

190         200         210         220         230        240
m539.pep  GAQGFAVFVFVTDSQVEVFGNIQTAVETGFFHGISVSSVFGAAAQDSAMASRSASIPVFS
          || |||||||||||:|::||||:| ||||||||||||||||||||| |||||||||||||
a539      GAAGFAVFVFVTDGQMQVFGNVQPAVETGFFHGISVSSVFGAAAQYSAMASRSASIPVFS
               190         200         210         220         230        240

250         260         270         280         290        300
m539.pep  ATEMRTAAIFPAASRHMPVFCSSDGSRSVLLYTLMHGISPAWISCSTFSTSSICCPLFGA
          ||||||||||||||||||||||||||||||||||||||||||||||||||||||||||||
a539      ATEMRTAAIFPAASRHMPVFCSSDGSRSVLLYTLMHGISPAWISCSTFSTSSICCPLFGA
               250         260         270         280         290        300

310         320         330         340
m539.pep  AASTTCSSTSACAVSSSVAXKAEISLCGRSLTNPTVSVRIMLHSG
          |||||||||||||||||||| ||||||||||||||||||||||||
a539      AASTTCSSTSACAVSSSVAEKAEISLCGRSLTNPTVSVRIMLHSGLMYSRRAVVSSVAKS
               310         320         330         340         350        360 a539      WSFAYMPDLVSRLNRLDLPTLVX
               370         380
```

The following partial DNA sequence was identified in *N. gonorrhoeae* <SEQ ID 1567>:

```
g540.seq
   1  atgccgccct cccgacgcgg caacggggtg ttttatcaaa acggcaaact 51  tgccaatgcg gtttccgctt gccgattgcc aaaccggcaa accttccccg 101  tgccggtgcc gaacccgatg ccgtctgaac cttcagacgg catcgggtgt 151  ttatttgtcc actcggacgg gtgcaggttc gtattgtgtc gattcgtcgc 201  cgtaatacag cacgccgagt ttgacgggga tgcgtccctg cgatttgcgg 251  tgggcgttgg aatcgcgcaa ggaatacgcg cagccgcagt attcctgctg 301  gtagaagttt tcgcgtttgc tgatttcaat catacgcgcg ccgccgccgc 351  ctttgcgcca gttgaagtcc caataggcca catcatcgta aggcgcggcg 401  gcacggtgtc cgcagtcgtt gatttgcgcc atattttttcc agcgtga
```

This corresponds to the amino acid sequence <SEQ ID 1568; ORF 540.ng>:

```
g540.pep
   1  MPPSRRGNGV FYQNGKLANA VSACRLPNRQ TFPVPVPNPM PSEPSDGIGC

51  LFVHSDGCRF VLCRFVAVIQ HAEFDGDASL RFAVGVGIAQ GIRAAAVFLL

101  VEVFAFADFN HTRAAAAFAP VEVPIGHIIV RRGGTVSAVV DLRHIFPA *
```

The following partial DNA sequence was identified in *N. meningitidis* <SEQ ID 1569>:

```
m540.seq (partial)
   1    ..CCGAACCCGA TGCCGTCTGA ACCTTCAGAC GGCATCGGGT GTTTATTTGT

51    CCACCCGGAT GGGGGCAGGT TCGTATTGTG TCGATTCGTC GCCGTAATAC

101    AGCACGCCGA GTTTGATGGG GATTCTGCCC TGTGATTTGC GGTGGGCATT

151    GGAATCCCTC AGGGAATAGG CACAACCGCA ATATTCCTGC TGGTAGAAGT
```

-continued
```
   201    TTTCACGTTT GCTGATTTCA ATCATGCGCG CGCTGCCGCC GCCTTTGCGC

251    CAGTTGAAAT CCCAATACAC CACATCATCG TAAGGCGCGG CGGCGCGGTG

301    TCCGCAGTCG TTGATTTGCG CCATATTTTT CCAGCGTGA
```

This corresponds to the amino acid sequence <SEQ ID 1570; ORF 540>:

```
m540.pep (partial)
     1    ..PNPMPSEPSD GIGCLFVHPD GGRFVLCRFV AVIQHAEFDG DSAL*FAVGI

51    GIPQGIGTTA IFLLVEVFTF ADFNHARAAA AFAPVEIPIH HIIVRRGGAV

101    SAVVDLRHIF PA*
```

Computer analysis of this amino acid sequence gave the following results:
Homology with a Predicted ORF from N. gonorrhoeae
ORF 540 shows 85.7% identity over a 112 aa overlap with a predicted ORF (ORF 540.ng) from N. gonorrhoeae:

```
    m540/g540
                                                  10         20         30
    m540.pep                                      PNPMPSEPSDGIGCLFVHPDGGRFVLCRFV
                                                  |||||||||||||||| || ||||||||
    g540       GNGVFYQNGKLANAVSACRLPNRQTFPVPVPNPMPSEPSDGIGCLFVHSDGCRFVLCRFV
                        10         20         30         40         50         60

40         50         60         70         80         90
    m540.pep   AVIQHAEFDGDSALXFAVGIGIPQGIGTTAIFLLVEVFTFADFNHARAAAAFAPVEIPIH
               ||||||||||::| ||||:|| ||| ::|:||||||:||||||:||||||||||||:||
    g540       AVIQHAEFDGDASLRFAVGVGIAQGIRAAAVFLLVEVFAFADFNHTRAAAAFAPVEVPIG
                        70         80         90        100        110        120

100        110
    m540.pep   HIIVRRGGAVSAVVDLRHIFPAX
               ||||||||:||||||||||||||
    g540       HIIVRRGGTVSAVVDLRHIFPAX
                       130        140
```
L' estermita' N-terminale di meningococco e' asente perche' interviene la ine del contig The following partial DNA sequence was identified in N. meningitidis <SEQ ID 1571>:

```
a540.seq
     1    ATGCCGTCCT CCCGACGCGG CAACGGGGTG TTTTATCAAA ACGGCAAACT

51    TGCCAATGCG GTTTCCGATT GCAGATTGCC AAACCGGCAA ACCTTTCCCG

101    TGCCGATGCC GAACCCGATG CCGTCTGAAC CTTCAGACGG CATCGGGTGT

151    TTATTTGTCC ACCCGGATGG GTGCAGGTTC GTATTGTGTC GATTCGTCGC

201    CGTAATACAG CACGCCGAGT TTGATGGGGA TTCTGCCCTG TGATTTGCGG

251    TGGGCGTTGG AATCCCTCAG GGAATAGGCA CAACCGCAAT ATTCCTGCTG

301    GTAGAAGTTT TCACGTTTGC TGATTTCAAT CATACGCGCG CTGCCGCCGC

351    CTTTGCGCCA GTTGAAATCC CAATACACCA CATCATCGTA AGGCGCGGCG

401    GCGCGGCGGC CGCAGTCGTT AATCTGGTTC ATGTTTTCC A
```

This corresponds to the amino acid sequence <SEQ ID 1572; ORF 540.a>:

```
a540.pep (partial)
    1   MPSSRRGNGV FYQNGKLANA VSDCRLPNRQ TFPVPMPNPM PSEPSDGIGC

51   LFVHPDGCRF VLCRFVAVIQ HAEFDGDSAL *FAVGVGIPQ GIGTTAIFLL

101   VEFTFADFN HTRAAAAFAP VEIPIHHIIV RRGGAAAAVV NLVHVFP
``` m540/a540 92.8% identity in 111 aa overlap

```
                                              10         20         30
    m540.pep                              PNPMPSEPSDGIGCLFVHPDGGRFVLCRFV
                                          ||||||||||||||||||||| ||||||||
       a540   GNGVFYQNGKLANAVSACRLPNRQTFPVPNPMPSEPSDGIGCLFVHPDGCRFVLCRFV
                    10        20        30        40        50        60
                       40         50         60         70         80         90
    m540.pep   AVIQHAEFDGDSALXFAVGIGIPQGIGTTAIFLLVEVFTFADFNHARAAAAFAPVEIPIH
               |||||||||||||||:|||||||||||||||||||||||||||||:||||||||||||
       a540   AVIQHAEFDGDSALXFAVGVGIPQGIGTTAIFLLVEVFTFADFNHTRAAAAFAPVEIPIH
                  70        80        90       100       110       120
                           100        110
    m540.pep   HIIVRRGGAVSAVVDLRHIFPAX
               |||||||||::|||:|  |:||
       a540   HIIVRRGGAAAAVVNLVHVFP
                  130        140
```

The following partial DNA sequence was identified in *N. gonorrhoeae* <SEQ ID 1573>:

```
g542.seq
    1   atgccgaaat ggtcgcgcat acggcgttgc agcgtccttt cgctgatgtt 51   cagcgcggct gtcagccggt tgacttggtg tgcgccgccg tcgaacgcgg 101   cattcagggt gcggctgaag tcttcagacg gcatagcgtc tgcttccgcc 151   gtttgccccg ccgccggctc gatgccgtct gaaaccgtgt cccacaaatc 201   cgacagcagc cgcaacacgt ccgcctcgcg gcgcaatgtt tcgcccaaat 251   gcccctttgg gacggtttgc aggcaggatg ccgccaagcc gcgcaggttt 301   gggggcaaat cccatatcct gaccggttcg cggtaa
```

This corresponds to the amino acid sequence <SEQ ID 1574; ORF 542.ng>:

```
g542.pep
    1   MPKWSRIRRC SVLSLMFSAA VSRLTWCAPP SNAAFRVRLK SSDGIASASA

51   VCPAAGSMPS ETVSHKSDSS RNTSASRRNV SPKCPFGTVC RQDAAKPRRF

101   GGKSHILTGS R*
```

The following partial DNA sequence was identified in *N. meningitidis* <SEQ ID 1575>:

```
m542.seq
    1   ATGCCGAAAT GGTCGCGCAT ACGGCGTTGC AGCGTCCTTT CACTGATGTT

51   CAGCGCGTCT GTCAGCCGGT TGACTTGGTG TGCGCCGTCG GCAAACGCGG

101   CATTTAGGGT GCGGCTGAAG TCTTCAGACG GCATAGCGTC TGCTTCCGCC

151   GTTTGCCCCG CCGCCGGCCC GATGCCGTCT GAAACCGTGT CCCACAAGTC

201   CGACAGCAGC CGCAACACGT CCGCCTCGCG .CGCAATGTT TCGCCCAAAT

251   GCCCCTTTGG GACGGCTTTC AGGCAGGATG CCGCCAAGCC GCGCAGGTTC

301   GGGGGCAAAT CCCATATCCT GACCGGTTCG CGGTAA
```

This corresponds to the amino acid sequence <SEQ ID 1576; ORF 542>:

```
m542.pep
    1   MPKWSRIRRC SVLSLMFSAS VSRLTWCAPS ANAAFRVRLK SSDGIASASA

51   VCPAAGPMPS ETVSHKSDSS RNTSASRAMF RPNAPLGRNV SPKCPFGTAF

101   RQDAAKPRRF GGKSHILTGS R*
```

Computer analysis of this amino acid sequence gave the following results:
Homology with a Predicted ORF from *N. gonorrhoeae*
ORF 542 shows 93.7% identity over a 111 aa overlap with a predicted ORF (ORF 542.ng) from *N. gonorrhoeae*:

```
m542/g542
                 10         20         30         40         50         60
    m542.pep  MPKWSRIRRCSVLSLMFSASVSRLTWCAPSANAAFRVRLKSSDGIASASAVCPAAGPMPS
              |||||||||||||||||||:||||||||| :|||||||||||||||||||||||| |||
    g542      MPKWSRIRRCSVLSLMFSAAVSRLTWCAPPSNAAFRVRLKSSDGIASASAVCPAAGSMPS
                 10         20         30         40         50         60
                 70         80         90        100        110
    m542.pep  ETVSHKSDSSRNTSASXRNVSPKCPFGTAFRQDAAKPRRFGGKSHILTGSRX
              ||||||||||||||||| ||||||||||:|||||||||||||||||||||||
    g542      ETVSHKSDSSRNTSASRRNVSPKCPFGTVCRQDAAKPRRFGGKSHILTGSRX
                 70         80         90        100        110
```

The following partial DNA sequence was identified in *N. meningitidis* <SEQ ID 1577>:

```
a542.seq
    1   ATGCCGAAAT GGTCGCGCAT ACGGCGTTGC AGCGTCCTTT CGCTGATGTT

51   CAGCGTGTCT GCCAGCCGGT TGACTTGATG TGCGCCGCCG GCAAACGCGG

101   CATTCAGGAT GCGGCTGAAG TCTTCAGACG GCATAGCGTC TGCTTCCGCC

151   GTTTGCCCCG CCGCCGGCCC GATGCCGTCT GAAACCGTGT CCCACAAGTC

201   CGACAGCAGC CGCAACACGT CCGCCTCGCG GCGCAATGTT TCGCCCAAAT

251   GCCCCTTTGG GACGGCTTTC AGGCAGGATG CCGCCAAGCC GCGCAGGTTC

301   GGGGGCAAAT CCCATATCCT GACCGGTTCG CGGTAA
```

This corresponds to the amino acid sequence <SEQ ID 1578; ORF 542.a>:

```
a542.pep
    1   MPKWSRIRRC SVLSLMFSVS ASRLT*CAPP ANAAFRMRLK SSDGIASASA

51   VCPAAGPMPS ETVSHKSDSS RNTSASRRNV SPKCPFGTAF RQDAAKPRRF

101   GGKSHILTGS R*
``` m542/a542 94.6% identity in 111 aa overlap

```
                 10         20         30         40         50         60
    m542.pep  MPKWSRIRRCSVLSLMFSASVSRLTWCAPSANAAFRVRLKSSDGIASASAVCPAAGPMPS
              |||||||||||||||||||:|:||| ||| ||||||:|||||||||||||||||||||||
    a542      MPKWSRIRRCSVLSLMFSVSASRLTXCAPPANAAFRMRLKSSDGIASASAVCPAAGPMPS
                 10         20         30         40         50         60

70         80         90        100        110
    m542.pep  ETVSHKSDSSRNTSASXRNVSPKCPFGTAFRQDAAKPRRFGGKSHILTGSRX
              ||||||||||||||||| ||||||||||||||||||||||||||||||||||
    a542      ETVSHKSDSSRNTSASRRNVSPKCPFGTAFRQDAAKPRRFGGKSHILTGSRX
                 70         80         90        100        110
```

The following partial DNA sequence was identified in *N. gonorrhoeae* <SEQ ID 1579>:

```
g543.seq
     1  atggtttgtc ggttatttgc cgccgttttt ggctttcaac tcggcaatca
    51  gcccgtcgat gcctttggct ttgatgattt cgccgaattg gttgcggtac
   101  acggtaacca ggctcgtgcc ttcgatggcg acgttgtagg tacggtattt
   151  gccgccgctt tggtaggtgg taaagtccat attgacgggc ttctgaccgg
   201  ggatgccgac ttcggcacgg acgacgattt ccttgccgcc cttattgacg
   251  atgggattgt ctttgacgtt gacggtcgcg tttttgaatt tcagcatcgt
   301  gccggaatag gtgcggatca gcagggtttg aaattctttg gccaacgctt
   351  gtttttgcgc gtcggacgcg gtacgccaag ggttgccgac cgccaatgcg
   401  gtcatacgtt ggaaatcgaa atagggaacc gcataggctt cggcttttgg
   451  gcgtgcagaa gccgcgtcgc cgcttttgag gatggtcaaa acctgtgtgg
   501  cgttttggcg gatttgtccc actgcgtcgg ccggggaggc aaatgccatg
   551  ccgatgctca aaataccgat gcccaatgcg ctgatgaagg aggatttttt
   601  cacgatgtct ttcctgaaaa tggatgtgta tgtttattct gcggcttttt
   651  ccgcattgcc gccctcagcg tttttctcgg cgaagctggt catgaattta
   701  ccgatcaggt tttccagaac cattgcagaa ctggttacgg agatggtgtc
   751  gccggcagca aggttttccg tatcgccgcc ctgctgcagc ccgatgtact
   801  gttcgcccaa aagtcccgaa gtcaggattt gcgcggaaac gtcactgctg
   851  aactgatact tgccgtccaa atcaaggcgc accctcgcct gataggattt
   901  cgggtcaagc ccgatagcgc cgacgcgccc gaccaatacg cctgcggatt
   951  tgacgggggc attgaccttc aaaccgccga tgtcgccgaa atcggcataa
  1001  acggcgtaag ttttgtccga accgccgaac gccgcgccgc ccgccacgcg
  1051  gaaagcgaga aaggcaaccg ccgccgcgcc gatcaagacg aacagtccga
  1101  cccaaaattc caatatgttc tttttcatta a
```

This corresponds to the amino acid sequence <SEQ ID 1580; ORF 543.ng>:

```
g543.pep
     1  MVCRLFAAVF GFQLGNQPVD AFGFDDFAEL VAVHGNQARA FDGDVVGTVF
    51  AAALVGGKVH IDGLLTGDAD FGTDDDFLAA LIDDGIVFDV DGRVFEFQHR
   101  AGIGADQQGL KFFGQRLFLR VGRGTPRVAD RQCGHTLEIE IGNRIGFGFW
   151  ACRSRVAAFE DGQNLCGVLA DLSHCVGRGG KCHADAQNTD AQCADEGGFF
   201  HDVFPENGCV CLFCGFFRIA ALSVFLGEAG HEFTDQVFQN HCRTGYGDGV
   251  AGSKVFRIAA LLQPDVLFAQ KSRSQDLRGN VTAELILAVQ IKAHPRLIGF
   301  RVKPDSADAP DQYACGFDGG IDLQTADVAE IGINGVSFVR TAERRAARHA
   351  ESEKGNRRRA DQDEQSDPKF QYVLFH*
```

The following partial DNA sequence was identified in *N. meningitidis* <SEQ ID 1581>:

```
m543.seq
    1  ATGGTTTGTC GGTTATTTGC CGCCGTTTTT GGCTTTCAAC TCGGCAATCA
   51  GTCCGTCCAC GCCTTTCGCT TTGATAATTT CGCCGAATTG GTTGCGGTAC
  101  ACGGTAACCA GGCTCGCGCC TTCGATGGCG ACGTTGTAGG TACGGTATTT
  151  ACCGCCGCTT TGGTAGGTGG TGAAGTCCAT GTTGACGGGT TTTTGCCCGG
  201  GTACGCCGAC TTCGGCGCGG ACGATGATTT CTTTGCCGCC TTTATTGACG
  251  ATGGGATTGT CTTTGACGTT GACGTTGGCG TTTTTTAATT TCAGCATCGT
  301  GCCGGAATAG GTGCGGATCA GCAGGGTTTG AAATTCTTTG CCAACGCTT
  351  GTTTTTGCGC GTCGGACGCG GTGCGCCAAG GGTTGCCGAC CGCCAATGCG
  401  GTCATACGTT GGAAATCGAA ATAGGGAATC GCATAGGCTT CGGCTTTTTG
  451  GCGAGCGGTG TTGGCATCGC CGTTTTTTAA GATGCTCAAT ACTTGAGTGG
  501  CGTTTTGACG GATTTGGCTT ACCGCGTCGG CAGGGGCGGC AAATGCCATG
  551  CCGATGCTCA AAATACCGAT GCCCAATGCG CTGATGAGGG AGGATTTTTT
  601  CATGATTAAG TGTCCTAGTT TGAATATGAT GGCATACGTT TATTCGGCGG
  651  CTTTTTCCGC ATTGCCGCCG TCGGCATTTT TCTCGGCAAA ACTCGTCATG
  701  AATTTGCCGA TAAGGTTTTC CAGAACCATT GCAGAACTGG TTACGGAGAT
  751  GGTGTCGCCG GCAGCAAGGT TTTCCGTGTC GCCGCCCTGC TGCAGCCCGA
  801  TGTACTGCTC GCCCAAAAGT CCCGAAGTCA GGATTTGCGC GGAAACGTCG
  851  CTGCTGAACT GATACTTGCC GTCCAAATCG AGGCGCACCC TCGCCTGATA
  901  GGATTTCGGG TCAAGTCCGA TAGCGCCGAC GCGCCCGACC AATACGCCTG
  951  CGGATTTGAC GGGGGCATTG ACCTTCAAAC CGCCGATGTC GCCGAAATCG
 1001  GCATAAACGG CGTAAGTTTT GTCCGAACCG CCGAACGCCG CACCGCCGGC
 1051  CACGCGGAAA GCGAGAAAGG CAACCGCCGC CGCGCCAATC AGGACGAACA
 1101  GTCCGACCCA AAATTCCAAT ATGTTCTTCT TCATTAA
```

This corresponds to the amino acid sequence <SEQ ID 1582; ORF 543>:

```
m543.pep
    1  MVCRLFAAVF GFQLGNQSVH AFRFDNFAEL VAVHGNQARA FDGDVVGTVF
   51  TAALVGGEVH VDGFLPGYAD FGADDDFFAA FIDDGIVFDV DVGVFXFQHR
  101  AGIGADQQGL KFFGQRLFLR VGRGAPRVAD RQCGHTLEIE IGNRIGFGFL
  151  ASGVGIAVFX DAQYLSGVLT DLAYRVGRGG KCHADAQNTD AQCADEGGFF
  201  HDXVSXFEYD GIRLFGGFFR IAAVGIFLGK TRHEFADKVF QNHCRTGYGD
  251  GVAGSKVFRV AALLQPDVLL AQKSRSQDLR GNVAAELILA VQIEAHPRLI
  301  GFRVKSDSAD APDQYACGFD GGIDLQTADV AEIGINGVSF VRTAERRTAG
  351  HAESEKGNRR RANQDEQSDP KFQYVLLH*
```

Computer analysis of this amino acid sequence gave the following results:

Homology with a Predicted ORF from *N. gonorrhoeae*

ORF 543 shows 84.2% identity over a 379 aa overlap with a predicted ORF (ORF 543.ng) from *N. gonorrhoeae*:

```
m543/g543
                      10        20        30        40        50        60
m543.pep      MVCRLFAAVFGFQLGNQSVHAFRFDNFAELVAVHGNQARAFDGDVVGTVFTAALVGGEVH
              ||||||||||||||||| | || ||:|||||||||||||||||||||:|||||||||:||
g543          MVCRLFAAVFGFQLGNQPVDAFGFDDFAELVAVHGNQARAFDGDVVGAVFTAALVGGKVH
                      10        20        30        40        50        60

70        80        90       100       110       120
m543.pep      VDGFLPGYADFGADDDFFAAFIDDGIVFDVDVGVFXFQHRAGIGADQQGLKFFGQRLFLR
              :||:| | ||||:||||:||:||||||||||  || ||||||||||||||||||||||||
g543          IDGLLTGDADFGTDDDFLAALIDDGIVFDVDGRVFEFQHRAGIGADQQGLKFFGQRLFLR
                      70        80        90       100       110       120

130       140       150       160       170       180
m543.pep      VGRGAPRVADRQCGHTLEIEIGNRIGFGFLASGVGIAVFXDAQYLSGVLTDLAYRVGRGG
              ||||:|||||||||||||||||||||||| |    :|:| |:| | |||:||:: |||||
g543          VGRGTPRVADRQCGHTLEIEIGNRIGFGFWACRSRVAAFEDGQNLCGVLADLSHCVGRGG
                     130       140       150       160       170       180

190       200       210        220       230      239
m543.pep      KCHADAQNTDAQCADEGGFFHDXVSXFEYDG-IRLFGGFFRIAAVGIFLGKTRHEFADKV
              ||||||||||||||||||||||    |  :| : || |||||||:::|||:: |||: :|
g543          KCHADAQNTDAQCADEGGFFHDV---FPENGCVCLFCGFFRIAALSVFLGEAGHEFTDQV
                     190       200          210       220       230

240       250       260       270       280       290      299
m543.pep      FQNHCRTGYGDGVAGSKVFRVAALLQPDVLLAQKSRSQDLRGNVAAELILAVQIEAHPRL
              ||||||||||||||||||||:||||||||||:|||||||||||||:|||||||||:||||
g543          FQNHCRTGYGDGVAGSKVFRIAALLQPDVLFAQKSRSQDLRGNVTAELILAVQIKAHPRL
              240       250       260       270       280       290

300       310       320       330       340       350      359
m543.pep      IGFRVKSDSADAPDQYACGFDGGIDLQTADVAEIGINGVSFVRTAERRTAGHAESEKGNR
              |||||| ||||||||||||||||||||||||||||||||||||||||||:| ||||||||
g543          IGFRVKPDSADAPDQYACGFDGGIDLQTADVAEIGINGVSFVRTAERRAARHAESEKGNR
              300       310       320       330       340       350

360       370      379
m543.pep      RRANQDEQSDPKFQYVLLHX
              |||:|||||||||||||:||
g543          RRADQDEQSDPKFQYVLFHX
              360       370
```

The following partial DNA sequence was identified in *N. meningitidis* <SEQ ID 1583>:

```
a543.seq
     1  ATGGCTTATG GATTACTTGC TGCCGTTTNT AGCCTTCAAC TCGNCAATCA

51  GTCCGTCCAC GCCTTTCGCT TTGATAATTT CGCCGAATTG GTTGCGGTAC

101  ACGGTAACCA GGCTCGCGCC TTCGATGGCG ACGTTGTAGG TACGGTATTT

151  ACCGCCGCTT TGGTAGGTGG TGAAGTCCAT GTTGACGGGT TTTTGCCCGG

201  NNACGCCGAC TTCGGCGCGG ACGATGATTT CTTTGCCGCC TTTATTGACG

251  ATNGGATTGT CTTTGACGTT GACGTTGGCG TTTTTTAATT TCAGCATCGT

301  GCCGGAATAG GTGCGGATCA GCAGGGTTTG AAATTCTTTG GCCAACGCTT

351  GTTTTTGCGC GTCGGACGCG GTGCGCCAAG GGTTGCCGAC CGCCAATGCG

401  GTCATACGTT GGAAATCGAA ATAGGGAATC GCATAGGCTT CGGCTTTTTG

451  GCGGGCGGTG TTGGCATCAC CGCTTTTTAA GATGCTCAAT ACTTGAGTGG

501  CGTTTTGACG GATTTGGTTT ACCGCGTCGG CAGGGGCGGC AAATGCCATG

551  CCGATGCTCA AAATACCGAT GCCCAATGCG CTGATGAAGG AGGATTTTTT

601  CATGATTAAG TGTCCTAGTT TGAATATGAT GGCATACGTT TATTCGGCGG

651  CTTTTTCCGC ATTGCCGCCG TCGGCATTTT TCTCGGCAAA ACTCGTCATG

701  AATTTGCCGA TAAGGTTTTC CAGAACCATT GCAGAACTGG TTACGGAGAT

751  GGTGTCGCCG GCAGCAAGGT TTTCCGTGTC GCCGCCCTGC TGCAGCCCGA

801  TGTACTGCTC GCCCAAAAGT CCCGAAGTCA GGATTTGCGC GGAAACGTCG
```

```
 851  CTGCTGAACT GATACTTGCC GTCCAAATCG AGGCGCACCC TCGCCTGATA

901  GGATTTCGGG TCAAGTCCGA TAGCGCCGAC GCGCCCGACC AATACGCCTG

951  CGGATTTGAC GGGGGCATTG ACCTTCAAAC CGCCGATGTC GCCGAAATCG

1001  GCATAAACGG CGTAAGTTTT GTCCGAACCG CCGAACGCCG CACCGCCGGC

1051  CACGCGGAAA GCGAGAAAGG CAACCGCCGC CGCGCCAATC AGGACGAACA

1101  GTCCGACCCA AAATTCCAAT ATGTTCTTTT TCATTAA
```

This corresponds to the amino acid sequence <SEQ ID 1584; ORF 543.a>:

```
a543.pep
    1   MAYGLLAAVX SLQLXNQSVH AFRFDNFAEL VAVHGNQARA FDGDVVGTVF

51   TAALVGGEVH VDGFLPGXAD FGADDDFFAA FIDDXIVFDV DVGVF*FQHR

101   AGIGADQQGL KFFGQRLFLR VGRGAPRVAD RQCGHTLEIE IGNRIGFGFL

151   AGGVGITAF* DAQYLSGVLT DLVYRVGRGG KCHADAQNTD AQCADEGGFF

201   HD*VS*FEYD GIRLFGGFFR IAAVGIFLGK TRHEFADKVF QNHCRTGYGD

251   GVAGSKVFRV AALLQPDVLL AQKSRSQDLR GNVAAELILA VQIEAHPRLI

301   GFRVKSDSAD APDQYACGFD GGIDLQTADV AEIGINGVSF VRTAERRTAG

351   HAESEKGNRR RANQDEQSDP KFQYVLFH*
``` m543/a543 96.0% identity in 378 aa overlap

```
                 10         20         30         40         50         60
m543.pep  MVCRLFAAVFGFQLGNQSVHAFRFDNFAELVAVHGNQARAFDGDVVGTVFTAALVGGEVH
          |:   |:|||  ::||  ||||||||||||||||||||||||||||||||||||||||||
a543      MAYGLLAAVXSLQLXNQSVHAFRFDNFAELVAVHGNQARAFDGDVVGTVFTAALVGGEVH
                 10         20         30         40         50         60

70         80         90        100        110        120
m543.pep  VDGFLPGYADFGADDDFFAAFIDDGIVFDVDVGVFXFQGRAGIGADQQGLKFFGQRLFLR
          ||||||   ||||||||||||||||:||||||||||||||||||||||||||||||||||
a543      VDGFLPGXADFGADDDFFAAFIDDXIVFDVDVGVFXFQGRAGIGADQQGLKFFGQRLFLR
                 70         80         90        100        110        120

130        140        150        160        170        180
m543.pep  VGRGAPRVADRQCGHTLEIEIGNRIGFGFLASGVGIAVFXDAQYLSGVLTDLAYRVGRGG
          |||||||||||||||||||||||||||||||:  ||||::|||||||||||||:||||||
a543      VGRGAPRVADRQCGHTLEIEIGNRIGFGFLAGGVGITAFXDAQYLSGVLTDLVYRVGRGG
                130        140        150        160        170        180

190        200        210        220        230        240
m543.pep  KCHADAQNTDAQCADEGGFFHDXVSXFEYDGIRLFGGFFRIAAVGIFLGKTRHEFADKVF
          ||||||||||||||||||||||||||||||||||||||||||||||||||||||||||||
a543      KCHADAQNTDAQCADEGGFFHDXVSXFEYDGIRLFGGFFRIAAVGIFLGKTRHEFADKVF
                190        200        210        220        230        240

250        260        270        280        290        300
m543.pep  QNHCRTGTGDGVAGSKVFRVAALLQPDVLLAQKSRSQDLRGNVAAELILAVQIEAHPRLI
          ||||||||||||||||||||||||||||||||||||||||||||||||||||||||||||
a543      QNHCRTGTGDGVAGSKVFRVAALLQPDVLLAQKSRSQDLRGNVAAELILAVQIEAHPRLI
                250        260        270        280        290        300

310        320        330        340        350        360
m543.pep  GFRVKSDSADAPDQYACGFDGGIDLQTADVAEIGINGVSFVRTAERRTAGHAESEKGNRR
          ||||||||||||||||||||||||||||||||||||||||||||||||||||||||||||
a543      GFRVKSDSADAPDQYACGFDGGIDLQTADVAEIGINGVSFVRTAERRTAGHAESEKGNRR
                310        320        330        340        350        360

370        379
m543.pep  RANQDEQSDPKFQYVLLHX
          |||||||||||||||||:|
a543      RANQDEQSDPKFQYVLLHX
                370
```

The following partial DNA sequence was identified in *N. gonorrhoeae* <SEQ ID 1585>:

g544.seq

```
  1  atgaaaaaaa tactcaccgc cgccgccgtc gcactgatcg gcatcctcct
 51  cgccaccgtc ctcatccccg acagtaaaac cgcgcccgcc ttctccctgc
101  ccgacctgca cggaaaaacc gtttccaacg ccgacctgca aggcaaagtc
151  accctgatta attttggtt tccctcctgt ccggttgtg tgagcgaaat
201  gcccaaagtc accaaaacgg caaacgacta caaaaataaa gatttccaag
251  tcctcgccgt tgcccagccc atcgatccga tagaaagcgt ccgccaatac
301  gtcaaagact acggactgcc gtttaccgtc atttatgatg cggacaaagc
351  cgtcggacag gcattcggca cacaggttta tccgacttcc gtccttatcg
401  gcaaaaaagg cgaaatcctc aaaacttatg tcggcgaacc cgatttcggc
451  aaactctacc aagaaatcga taccgcgctg gcgcaatag
```

This corresponds to the amino acid sequence <SEQ ID 1586; ORF 544.ng>:

g544.pep

```
  1  MKKILTAAAV ALIGILLATV LIPDSKTAPA FSLPDLHGKT VSNADLQGKV
 51  TLINFWFPSC PGCVSEMPKV TKTANDYKNK DFQVLAVAQP IDPIESVRQY
101  VKDYGLPFTV IYDADKAVGQ AFGTQVYPTS VLIGKKGEIL KTYVGEPDFG
151  KLYQEIDTAL AQ*
```

The following partial DNA sequence was identified in *N. meningitidis* <SEQ ID 1587>:

m544.seq

```
  1  ATGAwAAAAA TACTCACCGC CGCCGTCGTC GCACTGATCG GCATCCTCCT
 51  TGCCATCGTC CTCmTCCCCG ACAGCAAAAC CGCGCCCGCC TTCTCCmTGC
101  CCGACCTGCA CGGAAAAACC GTTTCCAACG CCGACCTGCA AGGCAAAGTA
151  ACCCTGATTA ATTTTTGGTT TCCCTCCTGT CCGGGTTGTG TGAGCGAwAT
201  GCCCAAAATC ATTAAAACGG CAAATGACTA TAAAAwCAAA AACTTCCAAG
251  TACTTGCCGT CGCCCAGCCC ATCGATCCGA TAGAAAGCGT CCGCCAATAT
301  GTCAAAGACT ACGGTTTGCC GTTTACCGTC ATGTATGATG CGGACAAAGC
351  TGTCGGACAG GCGTTCGGCA CACAGGTTTA TCCGACTTCC GTCCTTATCG
401  GCAAATAAGG CGAAATCTTC AAAACCTACG TCGGCGAACC CGATTTCGGC
451  AAACTCTACC AAGAAATCGA TACGCGCGTG GCGCAATAG
```

This corresponds to the amino acid sequence <SEQ ID 1588; ORF 544>:

m544.pep

```
  1  MXKILTAAVV ALIGILLAIV LXPDSKTAPA FSXPDLHGKT VSNADLQGKV
 51  TLINFWFPSC PGCVSXMPKI IKTANDYKXK NFQVLAVAQP IDPIESVRQY
101  VKDYGLPFTV MYDADKAVGQ AFGTQVYPTS VLIGK*GEIF KTYVGEPDFG
151  KLYQEIDTRV AQ*
```

Computer analysis of this amino acid sequence gave the following results:

Homology with a Predicted ORF from *N. gonorrhoeae*
ORF 544 shows 90.7% identity over a 162 aa overlap with a predicted ORF (ORF 544.ng) from *N. gonorrhoeae*:

```
m544/g544
                    10         20         30         40         50         60
   m544.pep  MXKILTAAVVALIGILLAIVLXPDSKTAPAFSXPDLHGKTVSNADLQGKVTLINFWFPSC
             | ||||||:|||||||||| || |||||||||| ||||||||||||||||||||||||||
   g544      MKKILTAAAVALIGILLATVLIPDSKTAPAFSLPDLHGKTVSNADLQGKVTLINFWFPSC
                    10         20         30         40         50         60

70         80         90        100        110        120
   m544.pep  PGCVSXMPKIIKTANDYKXKNFQVLAVAQPIDPIESVRQYVKDYGLPFTVMYDADKAVGQ
             ||||| |||: ||||||| |:|||||||||||||||||||||||||||||||||||||||
   g544      PGCVSEMPKVTKTANDYKNKDFQVLAVAQPIDPIESVRQYVKDYGLPFTVMYDADKAVGQ
                    70         80         90        100        110        120

130        140        150        160
   m544.pep  AFGTQVYPTSVLIGKXGEIFKTYVGEPDFGKLYQEIDTRVAQX
             ||||||||||||||| |||:|||||||||||||||||| :|||
   g544      AFGTQVYPTSVLIGKKGEILKTYVGEPDFGKLYQEIDTALAQX
                   130        140        150        160
```

The following partial DNA sequence was identified in *N. meningitidis* <SEQ ID 1589>:

```
a544.seq
    1  ATGAAAAAAA TACTCACCGC CGCCGTCGTC GCACTGATCG GCATCCTCCT

51  TGCCATCGTC CTCATCCCCG ACAGCAAAAC CGCGCCCGCT TTCTCCCTGT

101  CCGANCTGCA CGGAAAAANC GTTTNCAACG CCGACCTGCA AGGCNAAGTT

151  ANCCTGATTA ANTTTTGGTT TCCCTCCTGT CCGGGTTGTG TGAGCGAAAT

201  GNCCANAATC ATTAAAACGG CAAATGACTA TAAAAACAAA AACTTCCAAG

251  TCCTTGCCGT CGCCCAGCCC ATCGATCCGA TAGAAAGCGT CCGCCAATAT

301  GTCAAAGACT ACGGTTTGCC GTTTACCGTC ATGTATGATG CGGACAAAGC

351  TGTCGGACAG GCGTTCGGCA CACAGGTTTA TCCGACTTCC GTCCTTATCG

401  GCAAAAAGG CGAAATCCTC AAAACTTATG TCGGCGAACC CGATTTCGGC

451  AAACTCTACC AAGAAATCGA TACCGCGCTG GCACAATAG
```

This corresponds to the amino acid sequence <SEQ ID 1590; ORF 544.a>:

```
a544.pep
    1  MKKILTAAVV ALIGILLAIV LIPDSKTAPA FSLSXLHGKX VXNADLQGXV

51  XLIXFWFPSC PGCVSEMXXI IKTANDYKNK NFQVLAVAQP IDPIESVRQY

101  VKDYGLPFTV MYDADKAVGQ AFGTQVYPTS VLIGKKGEIL KTYVGEPDFG

151  KLYQEIDTAL AQ*
``` m544/a544 88.9% identity in 162 aa overlap

```
                    10         20         30         40         50         60
   m544.pep  MXKILTAAVVALIGILLAIVLXPDSKTAPAFSXPDLHGKTVSNADLQGKVTLINFWFPSC
             | |||||||||||||||||| |||||||||||||| ||||:||||||| :|| ||||||
   a544      MKKILTAAVVALIGILLAIVLIPDSKTAPAFSLSXLHGKXVXNADLQGXVXLIXFWFPSC
                    10         20         30         40         50         60

70         80         90        100        110        120
   m544.pep  PGCVSXMPKIIKTANDYKXKNFQVLAVAQPIDPIESVRQYVKDYGLPFTVMYDADKAVGQ
             ||||| |  ||||||||| |||||||||||||||||||||||||||||||||||||||||
   a544      PGCVSEMXXIIKTANDYKNKNFQVLAVAQPIDPIESVRQYVKDYGLPFTVMYDADKAVGQ
                    70         80         90        100        110        120
```

```
                   130          140          150         160
m544.pep   AFGTQVYPTSVLIGKXGEIFKTYVGEPDFGKLYQEIDTRVAQX
           ||||||||||||||| |||:|||||||||||||||||||:|||
a544       AFGTQVYPTSVLIGKKGEILKTYVGEPDFGKLYQEIDTALAQX
                   130          140          150         160
```

The following partial DNA sequence was identified in *N. gonorrhoeae* <SEQ ID 1591>:

```
g547.seq
     1   atgttcgtag ataacggatt taataaaacg gtagcgagtt ttgcccaaat
    51   cgtcgaaact ttcgacgtat tcttctttag aacgattgc gccttttta
   101   cgcagatgaa acagcggtgc ggttgggtct gctcgttggt atatctcgtt
   151   gatatattta caagatgcgg cttcgagatt ccgaaccgct cctttaaaga
   201   gcttgggctt ttgatacaga taagtctgtc ggaacgtttt aggactaatg
   251   ccgaagtcga gatggatgcc cattacttcc ccttactcag aaaatattta
   301   aaatttataa tgttacatat agttacaaat attagagttt tttgtgtgtg
   351   cgtcaaggaa ttgttgacaa ttttagttaa aaatttgtct ccaaacggaa
   401   aaaagcggtt tgtttttgt tgttaa
```

This corresponds to the amino acid sequence <SEQ ID 1592; ORF 547.ng>:

```
g547.pep
     1   MFVDNGFNKT VASFAQIVET FDVFFFRNDC AFFTQMKQRC GWVCSLVYLV
    51   DIFTRCGFEI PNRSFKELGL LIQISLSERF RTNAEVEMDA HYFPLLRKYL
   101   KFIMLHIVTN IRVFCVCVKE LLTILVKNLS PNGKKRFVFC C*
```

The following partial DNA sequence was identified in *N. meningitidis* <SEQ ID 1593>:

```
m547.seq
     1   ATGTTCGTAG ATAACGGATT TAATAAAACG GTAGCGAGTT TTGCCCAAAT
    51   CGTCGAAACT TTCGACGTAT TCTTCTTTAG GAACGATTGC GCCTTTTTA
   101   CGCAGATGAA ACAGCGGTGC GGTTGGGTCT GCTCGTTGGT ATATCTCGTT
   151   GATATCTTTC CAAGATGCGG ATTCGAGATT CCGAACCGCT CCTTTAAAGA
   201   GCTTGGGCTT TTGATACAGA TAAGTCTGTC GGAACGTTTT AGGACTAATG
   251   CCGAAGTCGA GATGGATGCT CATTACTTCC CCTTACTCAG AAAATATTTA
   301   AAATTTATAA TGTTACATAT ATTTACAAAT ATTAAAGTTT TTTwTTGTGT
   351   GTGCGTCAAG GAATTGTTGA CAATTTTAGT TAAAAATTTG TCTCCAAACG
   401   GAAAAAAGCG GTTTGTTTTT TGTTGTTAA
```

This corresponds to the amino acid sequence <SEQ ID 1594; ORF 547>:

```
m547.pep
     1   MFVDNGFNKT VASFAQIVET FDVFFFRNDC AFFTQMKQRC GWVCSLVYLV
    51   DIFPRCGFEI PNRSFKELGL LIQISLSERF RTNAEVEMDA HYFPLLRKYL
   101   KFIMLHIFTN IKVFXCVCVK ELLTILVKNL SPNGKKRFVF CC*
```

Computer analysis of this amino acid sequence gave the following results:
Homology with a Predicted ORF from *N. gonorrhoeae*
ORF 547 shows 97.2% identity over a 142 aa overlap with a predicted ORF (ORF 547.ng) from *N. gonorrhoeae*:

```
m547/g547
                    10        20        30        40        50        60
   m547.pep  MFVDNGFNKTVASFAQIVETFDVFFFRNDCAFFTQMKQRCGWVCSLVYLVDIFPRCGFEI
             |||||||||||||||||||||||||||||||||||||||||||||||||||| ||||||
   g547      MFVDNGFNKTVASFAQIVETFDVFFFRNDCAFFTQMKQRCGWVCSLVYLVDIFTRCGFEI
                    10        20        30        40        50        60

70        80        90       100       110       120
   m547.pep  PNRSFKELGLLIQISLSERFRTNAEVEMDAHYFPLLRKYLKFIMLHIFTNIKVFXCVCVK
             ||||||||||||||||||||||||||||||||||||||||||||||||| |||:|| |||||
   g547      PNRSFKELGLLIQISLSERFRTNAEVEMDAHYFPLLRKYLKFIMLHIVTNIRVF-CVCVK
                    70        80        90       100       110

130       140
   m547.pep  ELLTILVKNLSPNGKKRFVFCCX
             |||||||||||||||||||||||
   g547      ELLTILVKNLSPNGKKRFVFCCX
                   120       130       140
```

The following partial DNA sequence was identified in *N. meningitidis* <SEQ ID 1595>:

```
a547.seq
     1   ATGTTCGTAG ATAACGGATT TAATAAAACG GTAGCGAGTT TTGCCCAAAT

51   CGTCGAAACT TTCGACGTAT TCTTCTTTAG GAACAATTGC ACCTTTTTTA

101   CGCAGATGAA ACAGCGGTGC GGTTGGGTCT GCTCGTTGGT ATATCTCGTT

151   GATATCTTTC CAAGATGCGG CTTCGAGATT CCGAACCGCT CCTTTAAAGA

201   GCTTGGGCTT TTGATACAGA TAAGTCTGTC GGAACGTTTT AGGACTAATG

251   CCGAAGTCGA GATAGATGCT CATTACTTCC CCTTACTCAG AAAATATTTA

301   AAATTTATAA TGTTACATAT ATTTACAAAT ATTAAAGTTT TTTT.TGTGT

351   GTGCGTCAAG GAATTGTTGA CAATTTTAGT T
```

This corresponds to the amino acid sequence <SEQ ID 1596; ORF 547.a>:

```
a547.pep
     1   MFVDNGFNKT VASFAQIVET FDVFFFRNNC TFFTQMKQRC GWVCSLVYLV

51   DIFPRCGFEI PNRSFKELGL LIQISLSERF RTNAEVEIDA HYFPLLRKYL

101   KFIMLHIFTN IKVFXCVCVK ELLTILV
``` m547/a547 97.6% identity in 127 aa overlap

```
                    10        20        30        40        50        60
   m547.pep  MFVDNGFNKTVASFAQIVETFDVFFFRNDCAFFTQMKQRCGWVCSLVYLVDIFPRCGFEI
             ||||||||||||||||||||||||||||:|:|||||||||||||||||||||||||||||
   a547      MFVDNGFNKTVASFAQIVETFDVFFFRNNCTFFTQMKQRCGWVCSLVYLVDIFPRCGFEI
                    10        20        30        40        50        60

70        80        90       100       110       120
   m547.pep  PNRSFKELGLLIQISLSERFRTNAEVEMDAHYFPLLRKYLKFIMLHIFTNIKVFXCVCVK
             ||||||||||||||||||||||||||||||:|||||||||||||||||||||||||||||
   a547      PNRSFKELGLLIQISLSERFRTNAEVEIDAHYFPLLRKYLKFIMLHIFTNIKVFXCVCVK
                    70        80        90       100       110       120

130       140
   m547.pep  ELLTILVKNLSPNGKKRFVFCCX
             |||||||
   a547      ELLTILV
```

The following partial DNA sequence was identified in *N. gonorrhoeae* <SEQ ID 1597>:

```
g548.seq
     1    atgttttccg taccgcgttc cttttgccg ggcgttttcg tacttgccgc 51    gcttgccgcc tgcaaacctc aagacaacag tgcggcgcaa gccgcttctt 101    caagtgcatc cgcgccggct gcggaaaatg cggcaaagcc gcaaacgcgc 151    ggtacggata tgcgtaagga agacatcggc ggcgatttca cactgaccga 201    cggcgaaggc aagcctttca gcctgagcga tttgaaaggc aaggtcgtga 251    ttctgtcttt cggctttacg cactgtcccg atgtctgccc gacagggctt 301    ttgacgtaca gcgacacttt gaagcagttg ggcgggcagg ctaaggacgt 351    gaaagtggtg ttcgtcagca tcgatccgga acgcgacacg cctgaaatca 401    tcggcaagta tgccaaacag ttcaatccgg actttatcgg tctgacggca 451    acgggcggcc aaaacctgcc ggtcatcaag cagcaatacc gcgtggtttc 501    tgccaaaatc aatcaaaaag acgacagcga aaactatttg gtcgaccact 551    cttccggtgc gtatcttatc gataaaaacg gtgaggttgc cattttctcg 601    ccttacggaa gcgagccgga aacgattgct gccgatgtaa ggaccctgct 651    ctga
```

This corresponds to the amino acid sequence <SEQ ID 1598; ORF 548.ng>:

```
g548.pep
     1    MFSVPRSFLP GVFVLAALAA CKPQDNSAAQ AASSSASAPA AENAAKPQTR

51    GTDMRKEDIG GDFTLTDGEG KPFSLSDLKG KVVILSFGFT HCPDVCPTGL

101    LTYSDTLKQL GGQAKDVKVV FVSIDPERDT PEIIGKYAKQ FNPDFIGLTA

151    TGGQNLPVIK QQYRVVSAKI NQKDDSENYL VDHSSGAYLI DKNGEVAIFS

201    PYGSEPETIA ADVRTLL*
                                                                        40
```

The following partial DNA sequence was identified in *N. meningitidis* <SEQ ID 1599>:

```
m548.seq
     1    ATGTTTTCCG TACCGCGTTC CTTTTTGCCG GGCGTTTTCG TACTTGCCGC

51    GCTTGCCGCC TGCAAACCTC AAGACAACAG TGCGGCGCAA GTCGCTTCTT

101    CAAGTGCATC CGCGTCGGCT GCGGAAAATG CGGCAAAGCA AnACACGCGC

151    GGTACGGATA TGCGTAAGGA AGACATCGGC GGCGATTTCA CGCTGACCGA

201    CGGCGAAGGC AAGCCTTTCA ACCTGAGCGA TTTGAAAGGC AAGGTCGTGA

251    TTCTGTCTTT CGGCTTTACG CACTGTCCCG ATGTCTGCCC GACAGAGCTT

301    TTGACGTACA GCGACACGTT GAAGCAGTTG GGCGGGCAGG CTAAGGACGT

351    GAAAGTGGTG TTCGTCAGCA TCGATCCGGA ACGCGACACG CCTGAAATCA

401    TCGGCAAGTA TGCCAAACAG TTCAATCCGG ACTTTATCGs TCTGACGGCA

451    ACGGGCGGCC AAAACCTGCC GGTCATCAAG CAGCAATACc GCGTGGTTTC

501    TGCCAAAGTC AATCAAAAmG ACGACAGCGA AAACTATTTG GTCGACCACT

551    CTTCCGGTGC GTATCTCATC GACAAAAACG GTGAGGTTGC CATTTTCTCG
```

```
601  CCTTACGGAA GCGAGCCGGA AACGATTGCT GCCGATGTAA GGACCCTGCT

651  CTGA
```

This corresponds to the amino acid sequence <SEQ ID 1600; ORF 548>:

```
m548.pep
  1  MFSVPRSFLP GVFVLAALAA CKPQDNSAAQ VASSSASASA AENAAKQXTR

51  GTDMRKEDIG GDFTLTDGEG KPFNLSDLKG KVVILSFGFT HCPDVCPTEL

101  LTYSDTLKQL GGQAKDVKVV FVSIDPERDT PEIIGKYAKQ FNPDFIXLTA

151  TGGQNLPVIK QQYRVVSAKV NQXDDSENYL VDHSSGAYLI DKNGEVAIFS

201  PYGSEPETIA ADVRTLL*
```

Computer analysis of this amino acid sequence gave the following results:
Homology with a Predicted ORF from *N. gonorrhoeae*
ORF 548 shows 95.9% identity over a 217 aa overlap with a predicted ORF (ORF 548.ng) from *N. gonorrhoeae*:

```
m548/g548
                    10         20         30         40         50         60
    m548.pep  MFSVPRSFLPGVFVLAALAACKPQDNSAAQVASSSASASAAENAAKQXTRGTDMRKEDIG
              ||||||||||||||||||||||||||||||:|||||||| |||||||| |||||||||||
        g548  MFSVPRSFLPGVFVLAALAACKPQDNSAAQAASSSASAPAAENAAKPQTRGTDMRKEDIG
                    10         20         30         40         50         60

70         80         90        100        110        120
    m548.pep  GDFTLTDGEGKPFNLSDLKGKVVILSFGFTHCPDVCPTELLTYSDTLKQLGGQAKDVKVV
              ||||||||||||:|||||||||||||||||||||||||| ||||||||||||||||||||
        g548  GDFTLTDGEGKPFSLSDLKGKVVILSFGFTHCPDVCPTGLLTYSDTLKQLGGQAKDVKVV
                    70         80         90        100        110        120

130        140        150        160        170        180
    m548.pep  FVSIDPERDTPEIIGKYAKQFNPDFIXLTATGGQNLPVIKQQYRVVSAKVNQXDDSENYL
              |||||||||||||||||||||||||||:||||||||||||||||||||||:||||||||
        g548  FVSIDPERDTPEIIGKYAKQFNPDFIGLTATGGQNLPVIKQQYRVVSAKINQKDDSENYL
                   130        140        150        160        170        180

190        200        210
    m548.pep  VDHSSGAYLIDKNGEVAIFSPYGSEPETIAADVRTLLX
              |||||||||||||||||||||||||||||||||||||
        g548  VDHSSGAYLIDKNGEVAIFSPYGSEPETIAADVRTLLX
                   190        200        210
```

The following partial DNA sequence was identified in *N. meningitidis* <SEQ ID 1601>:

```
a548.seq
  1  ATGTTTTCCG TACCGCGTTC CTTTTTGCCG GGCGTTTTCG TACTTGCCGC

51  GCTTGCCGCC TGCAAACCTC AAGACAACAG TGCGGCGCAA GTCGCTTCTT

101  CAAGTGCATC CGCGTCGGCT GCGGAAAATG CGGCAAAGCC GCAAACGCGC

151  GGTACGGATA TGCGTAAGGA AGACATCGGC GGCGATTTCA CGCTGACCGA

201  CGGCGAAGGC AAGCCTTTCA ACCTGAGCGA TTTGAAAGGC AAGGTCGTGA

251  TTCTGTCTTT CGGCTTTACG CACTGTCCCG ATGTCTGCCC GACAGAGCTT

301  TTGACGTACA GCGACACGTT GAAGCAGTTG GGCGGGCAGG CTAAGGACGT

351  GAAAGTGGTG TTCGTCAGCA TCGATCCGGA ACGCGACACG CCTGAAATCA

401  TCGGCAAGTA TGCCAAACAG TTCAATCCGG ACTTTATCGG TCTGACGGCA

451  ACGGGCGACC AAAACCTGCC GGTCATCAAG CAGCAATACC GCGTGGTTTC

501  TGCCAAAGTC AATCAAAAAG ACGACAGCGA AAACTATTTG GTCGACCACT
```

```
-continued
551  CTTCCGGTGC GTATCTCATC GACAAAAACG GTGAGGTTGC CATTTTCTCG

601  CCTTACGGAA GCGAGCCGGA AACGATTGCT GCCGATGTAA GGACCCTGCT

651  CTGA
```

This corresponds to the amino acid sequence <SEQ ID 1602; ORF 548.a>:

```
a548.pep
    1  MFSVPRSFLP GVFVLAALAA CKPQDNSAAQ VASSSASASA AENAAKPQTR

51  GTDMRKEDIG GDFTLTDGEG KPFNLSDLKG KVVILSFGFT HCPDVCPTEL

101  LTYSDTLKQL GGQAKDVKVV FVSIDPERDT PEIIGKYAKQ FNPDFIGLTA

151  TGDQNLPVIK QQYRVVSAKV NQKDDSENYL VDHSSGAYLI DKNGEVAIFS

201  PYGSEPETIA ADVRTLL*
                                                      20
``` m548/a548 97.7% identity in 217 aa overlap

```
                  10        20        30        40        50        60
m548.pep  MFSVPRSFLPGVFVLAALAACKPQDNSAAQVASSSASASAAENAAKQXTRGTDMRKEDIG
          ||||||||||||||||||||||||||||||||||||||||||||||  ||||||||||||
a548      MFSVPRSFLPGVFVLAALAACKPQDNSAAQVASSSASASAAENAAKPQTRGTDMRKEDIG
                  10        20        30        40        50        60

70        80        90       100       110       120
m548.pep  GDFTLTDGEGKPFNLSDLKGKVVILSFGFTHCPDVCPTELLTYSDTLKQLGGQAKDVKVV
          ||||||||||||||||||||||||||||||||||||||||||||||||||||||||||||
a548      GDFTLTDGEGKPFNLSDLKGKVVILSFGFTHCPDVCPTELLTYSDTLKQLGGQAKDVKVV
                  70        80        90       100       110       120

130       140       150       160       170       180
m548.pep  FVSIDPERDTPEIIGKYAKQFNPDFIXLTATGGQNLPVIKQQYRVVSAKVNQXDDSENYL
          |||||||||||||||||||||||||||||  ||| ||||||||||||||||| |||||||
a548      FVSIDPERDTPEIIGKYAKQFNPDFIGLTATGDQNLPVIKQQYRVVSAKVNQKDDSENYL
                 130       140       150       160       170       180

190       200       210
m548.pep  VDHSSGAYLIDKNGEVAIFSPYGSEPETIAADVRTLLX
          |||||||||||||||||||||||||||||||||||||
a548      VDHSSGAYLIDKNGEVAIFSPYGSEPETIAADVRTLLX
                 190       200       210
```

The following partial DNA sequence was identified in *N. gonorrhoeae* <SEQ ID 1603>:

```
g550.seq
    1  atgataacgg acaggtttca tctctttcat tttccagtat ctttcattta 51  tcaatctgac aacaaaatgc cgcctgaaaa cagttcagac ggcattttaa 101  ccacaaacgg cttacagctt ccattcgccc aacttggcag cgtaagcttc 151  caaatctgca atcggacggg ttgccacgcc gctttccatc gctgctttgg 201  cggcagccgt agcgacgcga ggcagcaggc gggaatcgaa cggagtagga 251  atcaggtatt ccgcgccgaa ttcgaatttc ttaccgtaag cggcaaccac 301  ttcttcggtt acttcttcca tcgccaaatc tgccaaagca tacacgcagg 351  cgcgtttcat ttcttcgttg atggtggttg cgccgacatc aacgcgccc 401  cggaagatga acgggaagca caatacgttg ttcacttggt tcgggaagtc 451  ggagcggccg gtaccgataa ccacgtccgg acgggtttct ttcgccagcg 501  gcggcaggat ttccggattc gggttggcca tggcgaacac gatgggtttt 551  tcgttcatcg tgttcaacat ttcaggcgtc agcaggtttg cgccggagag
```

```
601   gcccaagaag atgtctttgc ctttaaccgc atcggcaagt acgcgccggc 651   cgttgtcttc aacggcgtag aattttttgg attcgtccat gcggtctttg 701   tcttcgcggg tttggtaaat cacgcctttg gagttgcaaa cggttacgtt 751   ttcacgtttc aagcccaaat ccagcagttg gttcaggcag gcaatcgcgg 801   cggcacctgc gccggagcac accaaagtcg cttcttcgat tttacggccg 851   gtataacgca gggcgttcaa tacggcggcg gcggtaatga tggccgtgcc 901   gtgctggtca tcatgaaata cgggganttt gcagcgtttg cgtaa
```

This corresponds to the amino acid sequence <SEQ ID 1604; ORF 550.ng>:

```
g550.pep
    1   MITDRFHLFH FPVSFIYQSD NKMPPENSSD GILTTNGLQL PFAQLGSVSF

51   QICNRTGCHA AFHRCFGGSR SDARQQAGIE RSRNQVFRAE FEFLTVSGNH

101   FFGYFFHRQI CQSIHAGAFH FFVDGGCADI QRAPEDEREA QYVVHLVREV

151   GAAGTDNHVR TGFFRQRRQD FRIRVGHGEH DGFFVHRVQH FRRQQVCAGE

201   AQEDVFAFNR IGKYAPAVVF NGVEFFGFVH AVFVFAGLVN HAFGVANGYV

251   FTFQAQIQQL VQAGNRGGTC AGAHQSRFFD FTAGITQGVQ YGGGGNDGRA

301   VLVIMKYGDF AAFA*
```

The following partial DNA sequence was identified in *N. meningitidis* <SEQ ID 1605>:

```
m550.seq (partial)
    1   ..GACGGCATCG GCAAGCACGC GCTGGCCGTT GTCTTCAATG GCGTAGAACT

51     GTTTGGACTC GTCCATACGG TCTTTGTCTT CGCGGGTTTG GTAAATCACG

101     CCTTTGGAGT CGCAAACGGT CACGTTTTCG CGTTTCAAGC CCAAATCCAG

151     CAATTGGwTC AAGCAGGCAA TCGCGGCCGC ACCTGCGCCG GAACACACCA

201     AAGTCGCTTC TTCGATTTTA CGGCCGGTAA AACGCAkGGC GTTCAATACG

251     GCGGCGGCGG TAATGATGGC CGTGCCGTGC TGGTCGTCGT GGAATACGGG

301     GATTTTGCAG CGTTTGCGTA A
```

This corresponds to the amino acid sequence <SEQ ID 1606; ORF 550>:

```
m550.pep (partial)
    1   ..DGIGKHALAV VFNGVELFGL VHTVFVFAGL VNHAFGVANG HVFAFQAQIQ

51     QLXQAGNRGR TCAGTHQSRF FDFTAGKTXG VQYGGGGNDG RAVLVVVEYG

101     DFAAFA*
```

Computer analysis of this amino acid sequence gave the following results:

Homology with a Predicted ORF from *N. gonorrhoeae*

ORF 550 shows _____% identity over a _____ aa overlap with a predicted ORF (ORF 550.ng) from *N. gonorrhoeae*:

```
m550/g550
                                              10        20        30
m550.pep                              DGIGKHALAVVFNGVELFGLVHTVFVFAGLVN
                                        |||:| ||||||||:||:||:||||||||||
g550      DGFFVHRVQHFRRQQVCAGEAQEDVFAFNRIGKYAPAVVFNGVEFFGFVHAVFVFAGLVN
                 190       200       210       220       230       240

40        50        60        70        80        90
m550.pep  HAFGVANGHVFAFQAQIQQLXQAGNRGRTCAGTHQSRFFDFTAGKTXGVQYGGGGNDGRA
          ||||||||:||:|||||||| |||||| ||||:||||||||||| | |||||||||||||
g550      HAFGVANGYVFTFQAQIQQLVQAGNRGGTCAGAHQSRFFDFTAGITQGVQYGGGGNDGRA
                 250       260       270       280       290       300

100
m550.pep  VLVVVEYGDFAAFAX
          |||||||||||||||
g550      VLVVVEYGDFAAFAX
                 310
```

The following partial DNA sequence was identified in *N. meningitidis* <SEQ ID 1607>:

```
a550.seq
      1  CTATATCAAT CTGACAGCAA AATGCCGCCT GAAAACAGTT CAGACGGCAT

51  TTTAACCGCA AACGGCTTAC AGCTTCCATT CGCTCAGCTT GGCAGCGTAA

101  GCTTCCAAAT CTGCAATCGG ACGGGTTGCC ACGCCGCTTT CCATCGCTGC

151  TTTGGCGGCA GCCGTAGCAA CGCGCGGCAG CAGGCGGGAA TCGAACGGAG

201  TCGGAATCAG GTATTCCGCG CCGAATTCAA ATTTCTTACC GTAAGCGGCA

251  ACCACTTCTT CGGTTACCTC TTCCATCGCC AAATCCGCCA AAGCATACAC

301  GCAGGCGCGT TTCATTTCTT CGTTGATGGT CGTCGCGCCG ACATCCAACG

351  CACCGCGGAA GATGAACGGG AAGCACAATA CATTGTTCAC TTGGTTCGGG

401  AAGTCGGAGC GGCCGGTACC GATAACCACG TCCGGACGGG TTTCTTTCGC

451  CAGCGGCGGC AGGATTTCCG GATTCGGGTT GGCCATAGCG AACACGATGG

501  GTTTTTCGTT CATGGTGTTC AGTATTTCAG GCGTCAGCAG GTTCGCGCCG

551  GAGAGGCCCA AGAAGATGTC TTTGCCTTTG ACGGCATCGG CAAGCACGCG

601  CTGGCCGTTG TCTTCAATGG CGTAGAACTG TTTGGACTCG TCCATACGGT

651  CTTTGTCTTC GCGGGTTTGG TAAATCACGC CTTTGGAGTC GCAAACGGTC

701  ACGTTTTCGC GTTTCAAGCC CAAATCCAGC AATTGGTTCA AGCAGGCAAT

751  CGCGGCCGCA CCTGCGCCGG AACACACCAA AGTCGCTTCT TCGATTTTAC

801  GGCCGGTAAA ACGCAGGGCG TTCAATACGG CAGCGGCGGT AATGATGGCC

851  GTGCCGTGCT GGTCGTCGTG GAATACGGGG ATTTTGCAGC GTTTGCGTAA
```

This corresponds to the amino acid sequence <SEQ ID 1608; ORF 550.a>:

```
a550.pep
      1  LYQSDSKMPP ENSSDGILTA NGLQLPFAQL GSVSFQICNR TGCHAAFHRC

51  FGGSRSNARQ QAGIERSRNQ VFRAEFKFLT VSGNHFFGYL FHRQIRQSIH

101  AGAFHFFVDG RRADIQRTAE DEREAQYIVH LVREVGAAGT DNHVRTGFFR

151  QRRQDFRIRV GHSEHDGFFV HGVQYFRRQQ VRAGEAQEDV FAFDGIGKHA

201  LAVVFNGVEL FGLVHTVFVF AGLVNHAFGV ANGHVFAFQA QIQQLVQAGN

251  RGRTCAGTHQ SRFFDFTAGK TQGVQYGSGG NDGRAVLVVV EYGDFAAFA*
``` m550/a550 97.2% identity in 106 aa overlap

```
                                      10        20        30
    m550.pep                    DGIGKHALAVVFNGVELFGLVHTVFVFAGL
                                |||||||||||||||||||||||||||||
       a550     EHDGFFVHGVQYFRRQQVRAGEAQEDVFAFDGIGKHALAVVFNGVELFGLVHTVFVFAGL
                170       180       190       200       210       220

40        50        60        70        80        90
    m550.pep    VNHAFGVANGHVFAFQAQIQQLXQAGNRGRTCAGTHQSRFFDFTAGKTXGVQYGGGGNDG
                |||||||||||||||||||||| ||||||||||||||||||||||||| ||||:||||
       a550     VNHAFGVANGHVFAFQAQIQQLVQAGNRGRTCAGTHQSRFFDFTAGKTQGVQYGSGGNDG
                230       240       250       260       270       280

100
    m550.pep    RAVLVVVEYGDFAAFAX
                |||||||||||||||||
       a550     RAVLVVVEYGDFAAFAX
                290       300
```

The following partial DNA sequence was identified in *N. gonorrhoeae* <SEQ ID 1609>:

```
g552.seq
     1    atgaagctga aaaccttgtt attgcccttc gccgcactgg cattgtgtgc 51    caacgcattt gccgccccgc ccggcgacgc gtcgttggca cgttggctgg 101    atacgcagaa tttcgaccgg gatatagaaa aaaatatgat tgaaggcttt 151    aatgccggat ttaaaccgta tgcggacaaa gcccttgccg aaatgccgga 201    agcgaaaaaa gatcaggcgg cagaagcctt taatcgttat cgtgagaatg 251    ttttgaaaga tttgattacg cccgaagtga acaggctgt ccgcaatacc 301    ttattgaaga tgcccgtga aatatacacg caagaagaaa ttgacggcat 351    gattgccttt tacggttcgc ctgtcggtca gtccgtcgtt gccaaaaatc 401    cgcgcttaat caagaaatcg atgagtgaaa tagcggtatc ttggactgca 451    ttgtcaggga aaatcgcgcg acatcatctg cccgagttta cggaagagtt 501    acggcgcatc atctgcggcg gtatagtgga ttaa
```

This corresponds to the amino acid sequence <SEQ ID 1610; ORF552.ng>:

```
g552.pep
     1    MKLKTLLLPF AALALCANAF AAPPGDASLA RWLDTQNFDR DIEKNMIEGF

51    NAGFKPYADK ALAEMPEAKK DQAAEAFNRY RENVLKDLIT PEVKQAVRNT

101    LLKNAREIYT QEEIDGMIAF YGSPVGQSVV AKNPRLIKKS MSEIAVSWTA

151    LSGKIARHHL PEFTEELRRI ICGGIVD*
```

The following partial DNA sequence was identified in *N. meningitidis* <SEQ ID 1611>:

```
m552.seq (partial)
     1    ..ATTAAACTGA AAACCTTGTT ATTGCCCTTC GCCACGCTGG CATTGTGCAC

51       CAATGCTTTT GCCGCCCCGC CAGCGACGC GTCGTTGGCG CGTTGGCTGG

101       ATACGCAGAA TTTTGACCGG GATATAGAAA AAAATATGAT TGAGGGCTTT

151       AATGCCGGAT TTAAACCGTA TGCGGACAAA GCCCTTGCCG AAATGCCGGA

201       AGCGAAAAAA GATCAGGCGG CAGAAGCCTT TAACCGTTAT CGTGAGAATG

251       TTTTGAAAGA TTTGATTACG CCCGAAGTGA ACAGGCTGT CCGCAATACT

301       TTATTGAAGA TGCCCGTGA GATATACACG CAAGAAGAAA TTGACGGCAT
```

-continued

```
351    GATTGCCTTT TACGGTTCGC CTGTCGGTCA GTCCGTCGTT GCCAAAAATC

401    CGCGCTTAAT CAAGAAATCG ATGAGTGAAA TAGCGGTATC TTGGACTGCA

451    TTGTCAGGGA AAATCGCGCA ACATCATCTG CCCGAGTTTA CGGAAGAGTT

501    GCGGCGCATC ATCTGCGGCG GTAAAAATCC CGATGCGGGC TGTAAACAAG

551    CCGGACAGGT TGGGAAAAGG CATCAGAAAT AA
```

This corresponds to the amino acid sequence <SEQ ID 1612; ORF 552>:

```
m552.pep (partial)
    1   ..IKLKTLLLPF ATLALCTNAF AAPPSDASLA RWLDTQNFDR DIEKNMIEGF

51   NAGFKPYADK ALAEMPEAKK DQAAEAFNRY RENVLKDLIT PEVKQAVRNT

101   LLKNAREIYT QEEIDGMIAF YGSPVGQSVV AKNPRLIKKS MSEIAVSWTA

151   LSGKIAQHHL PEFTEELRRI ICGGKNPDAG CKQAGQVGKR HQK*
```

Computer analysis of this amino acid sequence gave the following results:
Homology with a Predicted ORF from *N. gonorrhoeae*
ORF 552 shows 97.1% identity over a 174 aa overlap with a predicted ORF (ORF 552.ng) from *N. gonorrhoeae*:

```
m552/g552
                     10         20         30         40         50         60
   m552.pep  IKLKTLLLPFATLALCTNAFAAPPSDASLARWLDTQNFDRDIEKNMIEGFNAGFKPYADK
             :||||||||||:||||:|||||||:||||||||||||||||||||||||||||||||||
   g552      MKLKTLLLPFAALALCANAFAAPPGDASLARWLDTQNFDRDIEKNMIEGFNAGFKPYADK
                     10         20         30         40         50         60

70         80         90        100        110        120
   m552.pep  ALAEMPEAKKDQAAEAFNRYRENVLKDLITPEVKQAVRNTLLKNAREIYTQEEIDGMIAF
             ||||||||||||||||||||||||||||||||||||||||||||||||||||||||||||
   g552      ALAEMPEAKKDQAAEAFNRYRENVLKDLITPEVKQAVRNTLLKNAREIYTQEEIDGMIAF
                     70         80         90        100        110        120

130        140        150        160        170        180
   m552.pep  YGSPVGQSVVAKNPRLIKKSMSEIAVSWTALSGKIAQHHLPEFTEELRRIICGGKNPDAG
             ||||||||||||||||||||||||||||||||||||:|||||||||||||||||||
   g552      YGSPVGQSVVAKNPRLIKKSMSEIAVSWTALSGKIARHHLPEFTEELRRIICGGIVDX
                    130        140        150        160        170

190
   m552.pep  CKQAGQVGKRHQKX
```

The following partial DNA sequence was identified in *N. meningitidis* <SEQ ID 1613>:

```
a552.seq
    1   ATTAAACTGA AAACCTTGTT ATTGCCCTTC GCCACGCTGG CATTGTGCAC

51   CAATGCTTTT GCCGCCCCGC CCAGCGACGC GTCGTTGGCG CGTTGGCTGG

101   ATACGCAGAA TTTTGACCGG GATATAGAAA AAAATATGAT TGAGGGCTTT

151   AATGCCGGAT TTAAACCGTA TGCGGACAAA GCCCTTGCCG AAATGCCGGA

201   AGCGAAAAAA GATCAGGCGG CAGAAGCCTT TAACCGTTAT CGTGAGAATG

251   TTTTGAAAGA TTTGATTACG CCCGAAGTGA AACAGGCTGT CCGCAATACT

301   TTATTGAAGA ATGCCCGTGA GATATACACG CAAGAAGAAA TTGACGGCAT

351   GATTGCCTTT TACGGTTCGC CTGTCGGTCA GTCCGTCGTT GCCAAAAATC

401   CGCGCTTAAT CAAGAAATCG ATGAGTGAAA TAGCGGTATC TTGGACTGCA

451   TTGTCAGGGA AAATCGCGCA ACATCATCTG CCCGAGTTTA CGGAAGAGTT
```

```
-continued
501  GCGGCGCATC ATCTGCGGCG GTAAAAATCC CGATGCGGGC TGTAAACAAG

551  CCGGACAGGT TGGGAAAAGG CATCAGAAAT AA
```

This corresponds to the amino acid sequence <SEQ ID 1614; ORF 552.a>:

```
a552.pep
    1   IKLKTLLLPF ATLALCTNAF AAPPSDASLA RWLDTQNFDR DIEKNMIEGF

51   NAGFKPYADK ALAEMPEAKK DQAAEAFNRY RENVLKDLIT PEVKQAVRNT

101   LLKNAREIYT QEEIDGMIAF YGSPVGQSVV AKNPRLIKKS MSEIAVSWTA

151   LSGKIAQHHL PEFTEELRRI ICGGKNPDAG CKQAGQVGKR HQK*
``` m552/a552 100.0% identity in 193 aa overlap

```
                 10         20         30         40         50         60
   m552.pep  IKLKTLLLPFATLALCTNAFAAPPSDASLARWLDTQNFDRDIEKNMIEGFNAGFKPYADK
             ||||||||||||||||||||||||||||||||||||||||||||||||||||||||||||
   a552      IKLKTLLLPFATLALCTNAFAAPPSDASLARWLDTQNFDRDIEKNMIEGFNAGFKPYADK
                 10         20         30         40         50         60

70         80         90        100        110        120
   m552.pep  ALAEMPEAKKDQAAEAFNRYRENVLKDLITPEVKQAVRNTLLKNAREIYTQEEIDGMIAF
             ||||||||||||||||||||||||||||||||||||||||||||||||||||||||||||
   a552      ALAEMPEAKKDQAAEAFNRYRENVLKDLITPEVKQAVRNTLLKNAREIYTQEEIDGMIAF
                 70         80         90        100        110        120

130        140        150        160        170        180
   m552.pep  YGSPVGQSVVAKNPRLIKKSMSEIAVSWTALSGKIAQHHLPEFTEELRRIICGGKNPDAG
             ||||||||||||||||||||||||||||||||||||||||||||||||||||||||||||
   a552      YGSPVGQSVVAKNPRLIKKSMSEIAVSWTALSGKIAQHHLPEFTEELRRIICGGKNPDAG
                130        140        150        160        170        180

190
   m552.pep  CKQAGQVGKRHQKX
             ||||||||||||||
   a552      CKQAGQVGKRHQKX
                190
```

The following partial DNA sequence was identified in *N. meningitidis* <SEQ ID 1615>:

```
m552-1.seq
    1   TTGAATATTA AACTGAAAAC CTTGTTATTG CCCTTCGCCA CGCTGGCATT

51   GTGCACCAAT GCTTTTGCCG CCCCGCCCAG CGACGCGTCG TTGGCGCGTT

101   GGCTGGATAC GCAGAATTTT GACCGGGATA TAGAAAAAAA TATGATTGAG

151   GGCTTTAATG CCGGATTTAA ACCGTATGCG GACAAAGCCC TTGCCGAAAT

201   GCCGGAAGCG AAAAAAGATC AGGCGGCAGA AGCCTTTAAC CGTTATCGTG

251   AGAATGTTTT GAAAGATTTG ATTACGCCCG AAGTGAAACA GGCTGTCCGC

301   AATACTTTAT TGAAGAATGC CCGTGAGATA TACACGCAAG AAGAAATTGA

351   CGGCATGATT GCCTTTTACG GTTCGCCTGT CGGTCAGTCC GTCGTTGCCA

401   AAAATCCGCG CTTAATCAAG AAATCGATGA GTGAAATAGC GGTATCTTGG

451   ACTGCATTGT CAGGGAAAAT CGCGCAACAT CATCTGCCCG AGTTTACGGA

501   AGAGTTGCGG CGCATCATCT GCGGCGGTAA AAATCCCGAT GCGGGCTGTA

551   AACAAGCCGG ACAGGTTGGG AAAGGCATC AGAAATAA
```

This corresponds to the amino acid sequence <SEQ ID 1616; ORF 552-1>:

```
m552-1.pep
      1     LNIKLKTLLL PFATLALCTN AFAAPPSDAS LARWLDTQNF DRDIEKNMIE

51     GFNAGFKPYA DKALAEMPEA KKDQAAEAFN RYRENVLKDL ITPEVKQAVR

101     NTLLKNAREI YTQEEIDGMI AFYGSPVGQS VVAKNPRLIK KSMSEIAVSW

151     TALSGKIAQH HLPEFTEELR RIICGGKNPD AGCKQAGQVG KRHQK*
```

The following partial DNA sequence was identified in *N. meningitidis* <SEQ ID 1617>:

```
a552-1.seq
      1     TTGAATATTA AACTGAAAAC CTTGTTATTG CCCTTCGCCA CGCTGGCATT

51     GTGCACCAAT GCTTTTGCCG CCCCGCCCAG CGACGCGTCG TTGGCGCGTT

101     GGCTGGATAC GCAGAATTTT GACCGGGATA TAGAAAAAAA TATGATTGAG

151     GGCTTTAATG CCGGATTTAA ACCGTATGCG GACAAAGCCC TTGCCGAAAT

201     GCCGGAAGCG AAAAAAGATC AGGCGGCAGA AGCCTTTAAC CGTTATCGTG

251     AGAATGTTTT GAAAGATTTG ATTACGCCCG AAGTGAAACA GGCTGTCCGC

301     AATACTTTAT TGAAGAATGC CCGTGAGATA TACACGCAAG AAGAAATTGA

351     CGGCATGATT GCCTTTTACG GTTCGCCTGT CGGTCAGTCC GTCGTTGCCA

401     AAAATCCGCG CTTAATCAAG AAATCGATGA GTGAAATAGC GGTATCTTGG

451     ACTGCATTGT CAGGGAAAAT CGCGCAACAT CATCTGCCCG AGTTTACGGA

501     AGAGTTGCGG CGCATCATCT GCGGCGGTAA AAATCCCGAT GCGGGCTGTA

551     AACAAGCCGG ACAGGTTGGG AAAAGGCATC AGAAATAA
```

This corresponds to the amino acid sequence <SEQ ID 1618; ORF 552-1.a>:

```
a552-1.pep
      1     LNIKLKTLLL PFATLALCTN AFAAPPSDAS LARWLDTQNF DRDIEKNMIE

51     GFNAGFKPYA DKALAEMPEA KKDQAAEAFN RYRENVLKDL ITPEVKQAVR

101     NTLLKNAREI YTQEEIDGMI AFYGSPVGQS VVAKNPRLIK KSMSEIAVSW

151     TALSGKIAQH HLPEFTEELR RIICGGKNPD AGCKQAGQVG KRHQK*
``` a552-1/m552-1 100.0% identity in 195 aa overlap

```
                    10        20        30        40        50        60
a552-1.pep  LNIKLKTLLLPFATLALCTNAFAAPPSDASLARWLDTQNFDRDIEKNMIEGFNAGFKPYA
            ||||||||||||||||||||||||||||||||||||||||||||||||||||||||||||
m552-1      LNIKLKTLLLPFATLALCTNAFAAPPSDASLARWLDTQNFDRDIEKNMIEGFNAGFKPYA
                    10        20        30        40        50        60

70        80        90       100       110       120
a552-1.pep  DKALAEMPEAKKDQAAEAFNRYRENVLKDLITPEVKQAVRNTLLKNAREIYTQEEIDGMI
            ||||||||||||||||||||||||||||||||||||||||||||||||||||||||||||
m552-1      DKALAEMPEAKKDQAAEAFNRYRENVLKDLITPEVKQAVRNTLLKNAREIYTQEEIDGMI
                    70        80        90       100       110       120

130       140       150       160       170       180
a552-1.pep  AFYGSPVGQSVVAKNPRLIKKSMSEIAVSWTALSGKIAQHHLPEFTEELRRIICGGKNPD
            ||||||||||||||||||||||||||||||||||||||||||||||||||||||||||||
m552-1      AFYGSPVGQSVVAKNPRLIKKSMSEIAVSWTALSGKIAQHHLPEFTEELRRIICGGKNPD
                   130       140       150       160       170       180

190
a552-1.pep  AGCKQAGQVGKRHQKX
            ||||||||||||||||
m552-1      AGCKQAGQVGKRHQKX
                   190
```

The following partial DNA sequence was identified in *N. gonorrhoeae* <SEQ ID 1619>:

```
g553.seq
    1   atggattatc tgcaaaacct gtctttgggc ttgacaaaaa agctgcccgt 51   tatactgcaa acagaagtag cggagtgtgg cttggcatgt ctagcggctg 101   tggccggatt ttatggtttc tatacggatt gcgcgcact gcgttcaaaa 151   tactgtctgt cacttaaggg tgagaatttg gcagatattg ttcgttttgc 201   tgatgatatg gggctgacgg gacgggcgtt gaggctggat ttagacgaat 251   tgggcagttt gcgcctgccc tgtattctac attgggattt gaatcatttt 301   gtggtgctgg aatcggtatc ttcggacggg gctgccgtca tggatccggc 351   ttcgggacga cgcaaagtca agacggagga aatatcgcgc aagtttacgg 401   gaattgcttt ggaactgtgg ccaaacacgc gtttcgaggc aggggaagaa 451   aagcaggaaa tccgcatcct acccatgttg cgcgggattt ctgggctggg 501   gcggacattg tttcagcttt tggctttggc agcagcaatg gaagtgtttg 551   cttttttaca aaacgtcagc ttcaagatcg gacgtggtga atcgcttgcg 601   ttaatcggac gatcgggctg cggtaaatcg acacttttgg atattttaag 651   cggcaatcta cctcccgaat caggcaaagt catgataaat gggcacgaca 701   tttacagctt accgccacct tttattccgc aatttgagtg cgatggtcaa 751   ggcaggacga tgttttatag tggattaaat ttaaaccggt ag
```

This corresponds to the amino acid sequence <SEQ ID 1620; ORF 553.ng>:

```
g553.pep
    1   MDYLQNLSLG LTKKLPVILQ TEVAECGLAC LAAVAGFYGF YTDLRALRSK

51   YCLSLKGENL ADIVRFADDM GLTGRALRLD LDELGSLRLP CILHWDLNHF

101   VVLESVSSDG AAVMDPASGR RKVKTEEISR KFTGIALELW PNTRFEAGEE

151   KQEIRILPML RGISGLGRTL FQLLALAAAM EVFAFLQNVS FKIGRGESLA

201   LIGRSGCGKS TLLDILSGNL PPESGKVMIN GHDIYSLPPP FIPQFECDGQ

251   GRTMFYSGLN LNR*
```
                                                        45

The following partial DNA sequence was identified in *N. meningitidis* <SEQ ID 1621>:

```
m553.seq (partial)
    1   ATGGATTATT TATCAAGACT GTCCTTTGGA TTTAACAAAA AGCTACCTGT

51   CATTCTGCAA ACAGAAGTTG CTGAATGTGG TTTAGCATGC CTGACATCCA

101   TCTTGTCCTA TTATGGCTTT CACACTGATT TAAGAACGTT ACGCCAAAAA

151   TACACCCTGT CATTAAAGGG CGCAAATCTT GCAGACATCA TGAGATTTGG

201   CAATGAAATG AATTTAACGC CACGAGCTTT GCGTTTAGAG TTAGATGAGC

251   TGTCAAATTT ACAACTACCC TGCATTCTCC ATTGGAACTT AAACCATTTT

301   GTTGTACTTT GTTCCATTTC CAAAGACAGT ATCGTCATTA TGGACCCTGC

351   TGTCGGTATG CGAAAAATCA AAATGGACGA AGTTTCACAA AAATTCACAG
```

-continued

```
401  GGATTGCCCT AGAATTATTC CCCAATACCC ATTTTGAAGA GAAAAAAGAA

451  ACAAAGAAAA TCAAAATATT ATCTCTATTA AGGGGGGG.T CAGGCTTAAA

501  ACGCTCTTTA ATTCAAATGC TTATATTAGC TATTTCTTTG GAAGTCTTTG

551  CATTG...
```

This corresponds to the amino acid sequence <SEQ ID 1622; ORF 553>:

```
m553.pep (partial)
    1  MDYLSRLSFG FNKKLPVILQ TEVAECGLAC LTSILSYYGF HTDLRTLRQK

51  YTLSLKGANL ADIMRFGNEM NLTPRALRLE LDELSNLQLP CILHWNLNHF

101  VVLCSISKDS IVIMDPAVGM RKIKMDEVSQ KFTGIALELF PNTHFEEKKE

151  TKKIKILSLL RGXSGLKRSL IQMLILAISL EVFAL...
```

Computer analysis of this amino acid sequence gave the following results:
Homology with a Predicted ORF from *N. gonorrhoeae*
ORF 553 shows 65.5% identity over a 185 aa overlap with a predicted ORF (ORF 553.ng) from *N. gonorrhoeae*:

```
m553/g553
                  10         20         30         40         50         60
      g553.pep  MDYLQNLSLGLTKKLPVILQTEVAECGLACLAAVAGFYGFYTDLRALRSKYCLSLKGENL
                ||||: ||:|::||||||||||||||||||||:::  ::|||:||||:||:|| ||||  ||
      m553      MDYLSRLSFGFNKKLPVILQTEVAECGLACLTSILSYYGFHTDLRTLRQKYTLSLKGANL
                  10         20         30         40         50         60

70         80         90        100        110        120
      g553.pep  ADIVRFADDMGLTGRALRLDLDELGSLRLPCILHWDLNHFVVLESVSSDGAAVMDPASGR
                |||:||:::|:|| |||||:||||:||||::|||||||:|||||||: :|  ||||| |
      m553      ADIMRFGNEMNLTPRALRLELDELSNLQLPCILHWNLNHFVVLCSISKDSVIVMDPAVGM
                  70         80         90        100        110        120

130        140        150        160        170        180
      g553.pep  RKVKTEEISRKFTGIALELWPNTRPEAGEEKQEIRILPMLRGISGLGRTLFQLLALAAAM
                ||:|  :|:|:||||||||||:|||:||   :|  ::|:||  :|||  |||  |:|:|:|  || ::
      m553      RKIKMDEVSQKFTGIALELFPNTHFEEKKETKKIKILSLLRGXSGLKRSLIQMLILAISL
                 130        140        150        160        170        180

190        200        210        220        230        240
      g553.pep  EVFAFLQNVSFKIGRGESLALIGRSGCGKSTLLDILSGNLPPESGKVMINGHDIYSLPPP
                ||||:
      m553      EVFAL
```

The following partial DNA sequence was identified in *N. meningitidis* <SEQ ID 1623>:

```
a553.seq
    1  ATGCCCCATC TGCAAAACCT GTCTTTGGGC TTAAAGAAAA AGCTGCCTGT

51  TATCCTGCAA ACAGAAATAT CAGAATGCGG CTTGGCATGT CTGGCGGCTG

101  TGGCGGGATT TCATGGTTTC CATACGAATT TACGCGCACT GCGTTCAAAA

151  TAC
```

This corresponds to the amino acid sequence <SEQ ID 1624; ORF 553.a>:

```
a553.pep
    1  MPHLQNLSLG LKKKLPVILQ TEISECGLAC LAAVAGFHGF HTNLRALRSK

51  Y
``` m553/a553 62.7% identity in 51 aa overlap

```
                  10        20        30        40        50        60
m553.pep  MDYLSRLSFGFNKKLPVILQTEVAECGLACLTSILSYYGFHTDLRTLRQKYTLSLKGANL
           :|:  ||:|::||||||||||||::|||||||:::  :::||||:||:||:|
a553      MPHLQNLSLGLKKKLPVILQTEISECGLACLAAVAGFHGFHTNLRALRSKY
                  10        20        30        40        50

70        80        90       100       110       120
m553.pep  ADIMRFGNEMNLTPRALRLELDELSMLQLPCILHWNLNHFVVLCSISKDSIVIMDPAVGM
```

The following partial DNA sequence was identified in *N. gonorrhoeae* <SEQ ID 1625>:

```
g554.seq..
    1    atgacagcac ataaaatcct gcccgtcctt cttcccatca tcttaggcgt
   51    ttctcacgca acggctgcat cgcccgcgcc aacagaccg acggtacacg
  101    ccgccccac gctccaaaca cccgaaaccc tcacggcggc acacatcgtt
  151    atcgacttc aaagcaggca gactttatcc gccaaaaaca ccaataccc
  201    tgtcgaaccg gcggcactaa cccaactgat gaccgcatat ttggttttca
  251    aaaacatgaa atcgggaaat atccaatctg aagaaaactt aaaaatacc
  301    gaatccgcat gggcttcaga aggaagcaga atgtttgtac gtcccggcga
  351    tacggtcagc accgacaaac tcttaaaagg catgattgcc ctatgcgcaa
  401    acgatgccgc cctaaccctt gccgaccggc tgggcaacgg ctcgattgaa
  451    aattttgtgc aacaaatgaa caagaagcc cgacgcttgg gcatgaagaa
  501    caccgtattc aaaaacccga caggcttggg tagagaagga caggtttcca
  551    ccgccaaaga cctctccctg ctgtctgaag cattgatgcg cgactttccg
  601    gaatattacc cgctgttttc catcaaatcg ttcaagtttg aaaacataga
  651    acaaaacaac cgcaatatcc ttttatatag ggacaacaat gtaaacggcc
  701    tgaaagccgg cacacagaa agcggcggct acaaccttgc cgtgtcatac
  751    tccggcaacg gcaggcacat ccttgtcatc acactaggtt cggaatcggc
  801    ggaaacccgc gcatcggaca acagcaagct gctgaaccgg cattgcagg
  851    ccttcgatac gcccaaaata tatccgaaag gcaaaaccgt tgcccaaatc
  901    caaatttccg gaggcagcaa aaaaaccgtc cgcgcaggct cctcaaaga
  951    agcctacatc actctgccac ataaagaagc gaaaatggca gaacagattt
 1001    tggaaaccat acagccgatt cccgccccgg taaaaaaagg gcagatttta
 1051    ggaaaaatca aaatcaggca aaacggacat accattgccg aaaaagaaat
 1101    cgtcgcactg gaaaacgtag aaaaaagaag ccggtggcaa aggctttgga
 1151    cgcgtctgac agggcagtaa
```

This corresponds to the amino acid sequence <SEQ ID 1626; ORF 554.ng>:

```
g554.pep..
    1    MTAHKILPVL LPIILGVSHA TAASPAPNRP TVHAAPTLQT PETLTAAHIV
   51    IDLQSRQTLS AKNTNTPVEP AALTQLMTAY LVFKNMKSGN IQSEENLKIP
  101    ESAWASEGSR MFVRPGDTVS TDKLLKGMIA LCANDAALTL ADRLGNGSIE
  151    NFVQQMNKEA RRLGMKNTVF KNPTGLGREG QVSTAKDLSL LSEALMRDFP
  201    EYYPLFSIKS FKFENIEQNN RNILLYRDNN VNGLKAGHTE SGGYNLAVSY
```

-continued

```
    251  SGNGRHILVI TLGSESAETR ASDNSKLLNR ALQAFDTPKI YPKGKTVAQI

301  QISGGSKKTV RAGFLKEAYI TLPHKEAKMA EQILETIQPI PAPVKKGQIL

351  GKIKIRQNGH TIAEKEIVAL ENVEKRSRWQ RLWTRLTGQ*
```

The following partial DNA sequence was identified in *N. meningitidis* <SEQ ID 1627>:

```
m554.seq..
      1   ATGACAGCAC ATAAAATCCT GCCCGTCCTG CTTTCCATCA TCTTAGGCGT

51   TTCTCACGCA ACGGCTGCAT CGCCCGCGCC CAACAGACCG ACGGTACACG

101   CCGCCCCCAC GTTCCAAACA CCCGAAACCC TCACAGCGGC ACACATCGTT

151   ATCGACCTTC AAAGCAAACA GATTTTATCC GCCAAAAACA TCAATACCCC

201   TGTTGAACCG GCGGCACTAA CCCAACTGAT GACCGCATAT CTGGTTTTCA

251   AAAACATGAA ATCGGGCAAT ATCCAATCTG AAGAAAACTT AAAAATACCC

301   GAATCCGCAT GGGCTTCAGA AGGAAGCAGA ATGTTTGTAC GTCCCGGCGA

351   TACGGTCAGC ACCGACAAAC TCTTAAAAGG CATGATTGCA CTATCCGCAA

401   ACGATGCCGC CCTAACCCTT GCCGGCCGGC TGGGCAACGG CTCGATTGAA

451   AATTTTGTGC AACAAATGAA CAAAGAAGCC CGACGCTTGG GCATGAAGAA

501   CACTGTATTC AAAAACCCGA CAGGCTTGAG TAGAGAAGGA CAGGTTTCCA

551   CCGCCAAAGA CGTCGCACTG CTGTCTGAAG CATTGATGCG CGACTTTCCG

601   GAATATTACC CGCTGTTTTC CATCAAATCT TTCAAATTCA AAAATATAGA

651   ACAAAACAAC CGCAATATCC TTTTATATAG GGACAACAAT GTAAACGGTC

701   TGAAAGCCGG ACACACAGAA AGCGGCGGCT ACAACCTTGC CGTGTCATAC

751   TCCGGCAACG GCAGGCACAT CCTTGTCATC ACATTGGGTT CGGAATCGGC

801   GGAAACACGC GCATCAGACA ACAGCAAGCT GCTGAACTGG GCATTGCAGG

851   CCTTCGATAC GCCCAAAATA TATCCGAAAG GCAAACCGT TGCCCAAATC

901   CAAATTTCCG GAGGCAGCAA AAAACCGTC CGCGCAGGCT TCCTCAAAGA

951   AGCCTACATC ACTCTGCCAC ATAAGGAAGC GAAAATGGCA GAACAAATTC

1001   TAGAAACCAT ACAGCCGATT CCCGCCCCAG TAAAAAAAGG GCAAATTTTA

1051   GGAAAAATCA AAATCAGACA AAACGGATAC ACCATTGCCG AAAAAGAAAT

1101   CGTCGCACTG GAAAATGTAA AAAAAAGAAG CCGGTGGCAA AGGCTTTGGG

1151   CGTGTCTGAC AGGGCAGTAA
```

This corresponds to the amino acid sequence <SEQ ID 1628; ORF 554>:

```
m554.pep..
      1   MTAHKILPVL LSIILGVSHA TAASPAPNRP TVHAAPTFQT PETLTAAHIV

51   IDLQSKQILS AKNINTPVEP AALTQLMTAY LVFKNMKSGN IQSEENLKIP

101   ESAWASEGSR MFVRPGDTVS TDKLLKGMIA LSANDAALTL AGRLGNGSIE

151   NFVQQMNKEA RRLGMKNTVF KNPTGLSREG QVSTAKDLAL LSEALMRDFP

201   EYYPLFSIKS FKFKNIEQNN RNILLYRDNN VNGLKAGHTE SGGYNLAVSY

251   SGNGRHILVI TLGSESAETR ASDNSKLLNW ALQAFDTPKI YPKGKTVAQI
```

```
   301   QISGGSKKTV RAGFLKEAYI TLPHKEAKMA EQILETIQPI PAPVKKGQIL

351   GKIKIRQNGY TIAEKEIVAL ENVKKRSRWQ RLWACLTGQ*
```

Computer analysis of this amino acid sequence gave the following results:

Homology with a Predicted ORF from *N. gonorrhoeae*

ORF 554 shows 96.1% identity over a 389 aa overlap with a predicted ORF (ORF 554.ng) from *N. gonorrhoeae*:

```
m554/g554
                    10         20         30         40         50         60
    m554.pep  MTAHKILPVLLSIILGVSHATAASPAPNRPTVHAAPTFQTPETLTAAHIVIDLQSKQILS
              ||||||||||| |||||||||||||||||||||||:||||||||||||||||||:| ||
    g554      MTAHKILPVLLPIILGVSHATAASPAPNRPTVHAAPTLQTPETLTAAHIVIDLQSRQTLS
                    10         20         30         40         50         60

70         80         90        100        110        120
    m554.pep  AKNINTPVEPAALTQLMTAYLVFKNMKSGNIQSEENLKIPESAWASEGSRMFVRPGDTVS
              ||| ||||||||||||||||||||||||||||||||||||||||||||||||||||||||
    g554      AKNTNTPVEPAALTQLMTAYLVFKNMKSGNIQSEENLKIPESAWASEGSRMFVRPGDTVS
                    70         80         90        100        110        120

130        140        150        160        170        180
    m554.pep  TDKLLKGMIALSANDAALTLAGRLGNGSIENFVQQMNKEARRLGMKNTVFKNPTGLSREG
              |||||||||| ||||||||||:|||||||||||||||||||||||||||||||||:|||
    g554      TDKLLKGMIALCANDAALTLADRLGNGSIENFVQQMNKEARRLGMKNTVFKNPTGLGREG
                   130        140        150        160        170        180

190        200        210        220        230        240
    m554.pep  QVSTAKDLALLSEALMRDFPEYYPLFSIKSFKFKNIEQNNRNILLYRDNNVNGLKAGHTE
              ||||||||:|||||||||||||||||||||||:|||||||||||||||||||||||||||
    g554      QVSTAKDLSLLSEALMRDFPEYYPLFSIKSFKFENIEQNNRNILLYRDNNVNGLKAGHTE
                   190        200        210        220        230        240

250        260        270        280        290        300
    m554.pep  SGGYNLAVSYSGNGRHILVITLGSESAETRASDNSKLLNWALQAFDTPKIYPKGKTVAQI
              |||||||||||||||||||||||||||||||||||||| |||||||||||||||||||||
    g554      SGGYNLAVSYSGNGRHILVITLGSESAETRASDNSKLLNRALQAFDTPKIYPKGKTVAQI
                   250        260        270        280        290        300

310        320        330        340        350        360
    m554.pep  SGGYNLAVSYSGNGRHILVITLGSESAETRASDNSKLLNWALQAFDTPKIYPKGKTVAQI
              |||||||||||||||||||||||||||||||||||||| |||||||||||||||||||||
    g554      SGGYNLAVSYSGNGRHILVITLGSESAETRASDNSKLLNRALQAFDTPKIYPKGKTVAQI
                   310        320        330        340        350        360

370        380        390
    m554.pep  TIAEKEIVALENVKKRSRWQRLWACLTGQX
              |||||||||||||:|||||||||:  ||||
    g554      TIAEKEIVALENVEKRSRWQRLWTRLTGQX
                   370        380        390
```

The following partial DNA sequence was identified in *N. meningitidis* <SEQ ID 1629>:

```
a554.seq
    1    ATGACAGCAC ATAAAATCCT GCCCGTCCTG CTTTCCATCA TCTTAGGCGT

51    TTCTCACGCA ACGGCTGCAT CGCCCGCGCC CAACAGACCG ACGGCACACG

101    CCGCCCCCAC GTTCCAAACA CCCGAAACCC TCACAGCGGC ACACATCGTT

151    ATCGACCTTC AAAGCAAACA GATTTTATCC GCCAAAAACA TCAATACCCC

201    TGTCGAACCG GCGGCACTAA CCCAACTGAT GACCGCATAT CTGGTTTTCA

251    AAAACATGAA ATCGGGAAAT ATCCGATCTG AAGAAAACTT AAAAATACCC

301    GAATCCGCAT GGGCTTCAGA AGGAAGCAGA ATGTTTGTAC GTCCCGGCGA

351    TACGGTCAGC ACCGACAAAC TCTTAAAAGG CATGATTGCA CTATCCGCAA

401    ACGATGCCGC CCTAACCCTT GCCGGCCGGC TGGGCAACGG CTCGATTGAA

451    AATTTTGTGC AACAAATGAA CAAAGAAGCC CGACGCTTGG GCATGAAGAA

501    CACTGTATTC AAAAATCCGA CAGGCTTGAG TAGAGAAGGA CAGGTTTCCA

551    CCGCCAAAGA CCTCGCCCAG CTGTCTGAAG CATTGATGCG CGACTTTCCG
```

```
-continued
 601  GAATATTACC CGCTGTTTTC CATCAAATCT TTCAAATTCA AAAATATAGA
 651  GCAAAACAAC CGCAATATCC TTTTATATAG GGACAACAAT GTAAACGGTC
 701  TGAAAGCCGG ACACACAGAA AGCGGCGGCT ACAACCTTGC CGTGTCATAC
 751  TCCGGCAACG GCAGGCACAT CCTTGTCATC ACATTGGGTT CGGAATCGGC
 801  GGAAACACGC GCATCAGACA ACAGCAAGCT GCTGAACTGG CATTGCAAG
 851  CCTTCGATAC GCCCAAAATA TATCCGAAAG GCAAAACCGT TGCCCAAATC
 901  CAAATTTCCG GAGGCAGCAA AAAAACCGTC CGCGCAGGCT TCCTCAAAGA
 951  AGCCTACATC ACTCTGCCAC ATAAGGAAGC GAAAATGGCA GAACAAATTC
1001  TAGAAACCAT ACAGCCGATT CCCGCCCCAG TAAAAAAAGG GCAAATTTTA
1051  GGAAAAATCA AAATCAGACA AAACGGATAC ACCATTGCCG AAAAAGAAAT
1101  CGTCGCACTG GAAAATGTAA AAAAAAGAAG CCGGTGGCAA AGGCTTTGGG
1151  CGTGTCTGAC AGGGCAGTAA
```

This corresponds to the amino acid sequence <SEQ ID 1630; ORF 554.a>:

```
a554.pep
    1  MTAHKILPVL LSIILGVSHA TAASPAPNRP TAHAAPTFQT PETLTAAHIV

51  IDLQSKQILS AKNINTPVEP AALTQLMTAY LVFKNMKSGN IRSEENLKIP

101  ESAWASEGSR MFVRPGDTVS TDKLLKGMIA LSANDAALTL AGRLGNGSIE

151  NFVQQMNKEA RRLGMKNTVF KNPTGLSREG QVSTAKDLAQ LSEALMRDFP

201  EYYPLFSIKS FKFKNIEQNN RNILLYRDNN VNGLKAGHTE SGGYNLAVSY

251  SGNGRHILVI TLGSESAETR ASDNSKLLNW ALQAFDTPKI YPKGKTVAQI

301  QISGGSKKTV RAGFLKEAYI TLPHKEAKMA EQILETIQPI PAPVKKGQIL

351  GKIKIRQNGY TIAEKEIVAL ENVKKRSRWQ RLWACLTGQ*
``` m554/a554 99.2% identity in 389 aa overlap

```
                 10         20         30         40         50         60
m554.pep  MTAHKILPVLLSIILGVSHATAASPAPNRPTVHAAPTFQTPETLTAAHIVIDLQSKQILS
          ||||||||||||||||||||||||||||||:|||||||||||||||||||||||||||||
a554      MTAHKILPVLLSIILGVSHATAASPAPNRPTAHAAPTFQTPETLTAAHIVIDLQSKQILS
                 10         20         30         40         50         60

70         80         90        100        110        120
m554.pep  AKNINTPVEPAALTQLMTAYLVFKNMKSGNIQSEENLKIPESAWASEGSRMFVRPGDTVS
          |||||||||||||||||||||||||||||:||||||||||||||||||||||||||||||
a554      AKNINTPVEPAALTQLMTAYLVFKNMKSGNIRSEENLKIPESAWASEGSRMFVRPGDTVS
                 70         80         90        100        110        120

130        140        150        160        170        180
m554.pep  TDKLLKGMIALSANDAALTLAGRLGNGSIENFVQQMNKEARRLGMKNTVFKNPTGLSREG
          ||||||||||||||||||||||||||||||||||||||||||||||||||||||||||||
a554      TDKLLKGMIALSANDAALTLAGRLGNGSIENFVQQMNKEARRLGMKNTVFKNPTGLSREG
                130        140        150        160        170        180

190        200        210        220        230        240
m554.pep  QVSTAKDLALLSEALMRDFPEYYPLFSIKSFKFKNIEQNNRNILLYRDNNVNGLKAGHTE
          |||||||||| |||||||||||||||||||||||||||||||||||||||||||||||||
a554      QVSTAKDLAQLSEALMRDFPEYYPLFSIKSFKFKNIEQNNRNILLYRDNNVNGLKAGHTE
                190        200        210        220        230        240

250        260        270        280        290        300
m554.pep  SGGYNLAVSYSGNGRHILVITLGSESAETRASDNSKLLNWALQAFDTPKIYPKGKTVAQI
          ||||||||||||||||||||||||||||||||||||||||||||||||||||||||||||
a554      SGGYNLAVSYSGNGRHILVITLGSESAETRASDNSKLLNWALQAFDTPKIYPKGKTVAQI
                250        260        270        280        290        300
```

```
              310        320        330        340        350        360
m554.pep   QISGGSKKTVRAGFLKEAYITLPHKEAKMAEQILETIQPIPAPVKKGQILGKIKIRQNGY
           ||||||||||||||||||||||||||||||||||||||||||||||||||||||||||||
a554       QISGGSKKTVRAGFLKEAYITLPHKEAKMAEQILETIQPIPAPVKKGQILGKIKIRQNGY
              310        320        330        340        350        360

370        380        390
m554.pep   TIAEKEIVALENVKKRSRWQRLWACLTGQX
           |||||||||||||||||||||||||||||
a554       TIAEKEIVALENVKKRSRWQRLWACLTGQX
              370        380        390
```

The following partial DNA sequence was identified in *N. gonorrhoeae* <SEQ ID 1631>:

```
g556.seq..
     1     atggacaata agaccaaact gcgcttgggc ggcctgattt tactgaccac 51     cgccgtttta agcctcatta tcgtattgat tgtcgattcc tggccgcttg 101     ccatcctgct tgccgccgtc atcgtcgccg ccgctgcggg cggctttgtt 151     tggacatccc gccgacagca acgccagttt atcgaacgtc tgaaaaaatt 201     cgacatcgat cccgaaaaag gcagaatcaa cgaggcaaac ctgcgccgta 251     tgtaccacag cggcggacaa caccagaaag atgcgattac cctgatctgc 301     ctgtcgcaaa aatgttcggt ggacgaggcg cacgctatgt tcaaaaaacg 351     cccgacacgt caggaaatca atcaaatggc ggcaaaacag tcgcgcggtc 401     agaaacgtcc gcaccgttaa
```

This corresponds to the amino acid sequence <SEQ ID 1632; ORF 556.ng>:

```
g556.pep.
     1     MDNKTKLRLG GLILLTTAVL SLIIVLIVDS WPLAILLAAV IVAAAAGGFV

51     WTSRRQQRQF IERLKKFDID PEKGRINEAN LRRMYHSGGQ HQKDAITLIC

101     LSQKCSVDEA HAMFKKRPTR QEINQMAAKQ SRGQKRPHR*
```

The following partial DNA sequence was identified in *N. meningitidis* <SEQ ID 1633>:

```
m556.seq..
     1     ATGGACAATA AGACCAAACT GCGCTTGGGC GGCCTGATTT TACTGACCAC

51     CGCCGTTTTA AGCCTCATTA TCGTATTGAT TGTCGATTCC TGGCCGCTTG

101     CCATCCTGCT TGCAGCCGTC ATTGTCGCTG CCGCTGCGGG CGGTTTTGTT

151     TGGACATCCC GCCGACAGCA ACGCCAGTTT ATCGAACGCC TGAAAAAATT

201     CGACATCGAT CCCGAAAAAG GCAGAATCAA CGAGGCAAAC CTGCGCCGTA

251     TGTACCACAG CGGCGGACAA CACCAGAAAG ATGCGATTAC CCTGATCTGC

301     CTGTCGCAAA AATGTTCGGT GGACGAGGCG CACGCTATGT TCAAAAAACG

351     CCCGACACGT CAGGAAATCA ATCAAATGGC GGCAAAACAG TCGCGCGGTC

401     AGAAACGTCC GCACCGTTAA
```

This corresponds to the amino acid sequence <SEQ ID 1634; ORF 556>:

```
m556.pep..
     1    MDNKTKLRLG GLILLTTAVL SLIIVLIVDS WPLAILLAAV IVAAAAGGFV

51    WTSRRQQRQF IERLKKFDID PEKGRINEAN LRRMYHSGGQ HQKDAITLIC

101    LSQKCSVDEA HAMFKKRPTR QEINQMAAKQ SRGQKRPHR*
```

Computer analysis of this amino acid sequence gave the following results:
Homology with a Predicted ORF from *N. gonorrhoeae* ORF 556 shows 100.0% identity over a 139 aa overlap with a predicted ORF (ORF 556.ng) from *N. gonorrhoeae*:

```
m556/g556
                      10         20         30         40         50         60
   m556.pep   MDNKTKLRLGGLILLTTAVLSLIIVLIVDSWPLAILLAAVIVAAAAGGFVWTSRRQQRQF
              ||||||||||||||||||||||||||||||||||||||||||||||||||||||||||||
   g556       MDNKTKLRLGGLILLTTAVLSLIIVLIVDSWPLAILLAAVIVAAAAGGFVWTSRRQQRQF
                      10         20         30         40         50         60

70         80         90        100        110        120
   m556.pep   IERLKKFDIDPEKGRINEANLRRMYHSGGQHQKDAITLICLSQKCSVDEAHAMFKKRPTR
              ||||||||||||||||||||||||||||||||||||||||||||||||||||||||||||
   g556       IERLKKFDIDPEKGRINEANLRRMYHSGGQHQKDAITLICLSQKCSVDEAHAMFKKRPTR
                      70         80         90        100        110        120

130        140
   m556.pep   QEINQMAAKQSRGQKRPHRX
              ||||||||||||||||||||
   g556       QEINQMAAKQSRGQKRPHRX
                     130        140
```

The following partial DNA sequence was identified in *N. meningitidis* <SEQ ID 1635>:

```
a556.seq
     1    ATGGACAATA AGACCAAACT GCGCTTGGGC GGCCTGATTT TACTGACCAC

51    CGCCGTTTTA AGCCTCATTA TCGTATTGAT TGTCGATTCC TGGCCGCTTG

101    CCATCCTGCT TGCCGCCGTC ATCGTCGCCG CCGCTGCGGG CGGCTTTGTT

151    TGGACATCCC GCCGACAGCA ACGCCAGTTT ATCGAACGTC TGAAAAAATT

201    CGACATCGAT CCCGAAAAAG GCAGAATCAA CGAGGCAAAC CTGCGCCGTA

251    TGTACCACAG CGGCGGACAA CACCAAAAAG ATGCGATTAC CCTGATCTGC

301    CTGTCGCAAA AATGTTCGGT GGACGAGGCG CACGCTATGT TCAAAAAACG

351    CCCGACACGT CAGGAAATCA ATCAAATGGC GGCAAAACAG TCGCGCGGTC

401    AGAAACGTCC GCACCGTTAA
```

This corresponds to the amino acid sequence <SEQ ID 1636; ORF 556.a>:

```
a556.pep
     1    MDNKTKLRLG GLILLTTAVL SLIIVLIVDS WPLAILLAAV IVAAAAGGFV

51    WTSRRQQRQF IERLKKFDID PEKGRINEAN LRRMYHSGGQ HQKDAITLIC

101    LSQKCSVDEA HAMFKKRPTR QEINQMAAKQ SRGQKRPHR*
``` m556/a556 100.0% identity in 139 aa overlap

```
                      10         20         30         40         50         60
   m556.pep   MDNKTKLRLGGLILLTTAVLSLIIVLIVDSWPLAILLAAVIVAAAAGGFVWTSRRQQRQF
              ||||||||||||||||||||||||||||||||||||||||||||||||||||||||||||
   a556       MDNKTKLRLGGLILLTTAVLSLIIVLIVDSWPLAILLAAVIVAAAAGGFVWTSRRQQRQF
                      10         20         30         40         50         60
```

```
                  70         80         90        100        110        120
m556.pep   IERLKKFDIDPEKGRINEANLRRMYHSGGQHQKDAITLICLSQKCSVDEAHAMFKKRPTR
           ||||||||||||||||||||||||||||||||||||||||||||||||||||||||||||
a556       IERLKKFDIDPEKGRINEANLRRMYHSGGQHQKDAITLICLSQKCSVDEAHAMFKKRPTR
                  70         80         90        100        110        120

130        140
m556.pep   QEINQMAAKQSRGQKRPHRX
           ||||||||||||||||||||
a556       QEINQMAAKQSRGQKRPHRX
                 130        140
```

The following partial DNA sequence was identified in *N. gonorrhoeae* <SEQ ID 1637>:

```
g557.seq
     1  atgaacaaaa tattccttac tgccgcagcc ttggtgctgg gcgcgtgcgg 51  tttccacctg aaaggtgcag acggcatttc tccgccgctg acctaccgga 101  gctggcacat cgaaggcgga caggcattgc aatttccttt ggaaaccgcg 151  ctgtatcagg cttcgggcag ggtggacgat gctgccggcg cgcagatgac 201  cctgcgtata gacagcgttt cccaaaacaa ggaaacctat accgttaccc 251  gtgcggcagt catcaacgaa tatcttttga tattgacggt tgaagcgcag 301  gtattgaaac gcggcgagcc ggtcggcaaa ccgatgaccg tgtccgtccg 351  ccgcattttg gattatgccg acaacgaaat tttgggcaaa caggaagaag 401  aagaaaccct gtgggcggaa atgcggcagg atgttgccga acagattgtc 451  cgccgcctga cctttctgaa ggcggaatga
```

This corresponds to the amino acid sequence <SEQ ID 1638; ORF 557.ng>:

```
g557.pep..
     1  MNKIFLTAAA LVLGACGFHL KGADGISPPL TYRSWHIEGG QALQFPLETA

51  LYQASGRVDD AAGAQMTLRI DSVSQNKETY TVTRAAVINE YLLILTVEAQ

101  VLKRGEPVGK PMTVSVRRIL DYADNEILGK QEEETLWAE MRQDVAEQIV

151  RRLTFLKAE*
```

The following partial DNA sequence was identified in *N. meningitidis* <SEQ ID 1639>:

```
m557.seq..
     1  ATGAACAAAC TGTTTCTTAC TGCCGCAGTG CTGATGCTGG GCGCGTGCGG

51  TTTCCACCTG AAAGGTGCAG ACGGCATTTC TCCGCCGCTG ACCTACCGGA

101  GCTGGCACAT CGAAGGCGGA CAGGCATTGC GGTTTCCTTT GGAAACCGCG

151  CTGTATCAGG CTTCGGGCAG GGTGGACGAT GCTGCCGGCG CGCAGATGAC

201  CCTGCGTATA GACAGCGTTT CCCAAAACAA GGAAACCTAC ACCGTTACCC

251  GTGCGGCAGT CATCAACGAA TATCTTTTGA TATTGACGGT TGAAGCGCAG

301  GTATTGAAAC GCGGCGAGCC GGTCGGTAAA CCGATGACCG TGTCCGTCCG

351  CCGCGTCCTT GCTTATGCCG ACAACGAGAT CTTGGGCAAA CAGGAAGAGG

401  AAGCGGCATT GTGGGCGGAA ATGCGGCAGG ATGCCGCCGA ACAGATTGTC

451  CGCCGCCTGA CCTTTCTGAA GGCGGAATGA
```

This corresponds to the amino acid sequence <SEQ ID 1640; ORF 557>:

```
m557.pep..
     1    MNKLFLTAAV LMLGACGFHL KGADGISPPL TYRSWHIEGG QALRFPLETA

51    LYQASGRVDD AAGAQMTLRI DSVSQNKETY TVTRAAVINE YLLILTVEAQ

101    VLKRGEPVGK PMTVSVRRVL AYADNEILGK QEEEAALWAE MRQDAAEQIV

151    RRLTFLKAE*
```

Computer analysis of this amino acid sequence gave the following results:
Homology with a Predicted ORF from N. gonorrhoeae
ORF 557 shows 94.3% identity over a 159 aa overlap with a predicted ORF (ORF 557.ng) from N. gonorrhoeae:

```
m557/g557
                 10         20         30         40         50         60
m557.pep   MNKLFLTAAVLMLGACGFHLKGADGISPPLTYRSWHIEGGQALRFPLETALYQASGRVDD
           |||:||||:|:||||||||||||||||||||||||||||||:||||||||||||||||||
g557       MNKIFLTAAALVLGACGFHLKGADGISPPLTYRSWHIEGGQALQFPLETALYQASGRVDD
                 10         20         30         40         50         60

70         80         90        100        110        120
m557.pep   AAGAQMTLRIDSVSQNKETYTVTRAAVINEYLLILTVEAQVLKRGEPVGKPMTVSVRRVL
           |||||||||||||||||||||||||||||||||||||||||||||||||||||||||||:|
g557       AAGAQMTLRIDSVSQNKETYTVTRAAVINEYLLILTVEAQVLKRGEPVGKPMTVSVRRIL
                 70         80         90        100        110        120

130        140        150        160
m557.pep   AYADNEILGKQEEEAALWAEMRQDAAEQIVRRLTFLKAEX
           |||||||||||:|||||||:|||||||||||||||||||
g557       DYADNEILGKQEEEETLWAEMRQDVAEQIVRRLTFLKAEX
                130        140        150        160
```

The following partial DNA sequence was identified in N. meningitidis <SEQ ID 1641>:

```
a557.seq
     1    ATGAACAAAC TGTTTCTTAC TGCCGCAGTG CTGATGCTGG GCGCGTGCGG

51    TTTCCACCTG AAAGGTGCAG ACGGCATTTC TCCGCCGCTG ACCTACCGGA

101    GCTGGCACAT CGAAGGCGGA CAGGCATTGC AGTTTCCTTT GGAAACCGCG

151    CTGTATCAGG CTTCGGGTAG GGTGGACGAT GCTGCCGGCG CGCAGATGAC

201    CCTGCGTATA GACAGCGTTT CCCAAAACAA GGAAACCTAC ACCGTTACCC

251    GTGCGGCAGT CATCAACGAA TATCTTTTGA TATTGACGGT TGAAGCGCAG

301    GTATTGAAAC GCGGCGAGCC GGTCGGCAAA CCGATGACCG TGTCCGTCCG

351    CCGCGTCCTT GCTTATGCCG ACAACGAGAT CTTGGGCAAA CAGGAAGAGG

401    AAGCGGCATT GTGGGCGGAA ATGCGGCAGG ATGCCGCCGA ACAGATTGTC

451    CGCCGCCTGA CCTTTCTGAA GGCGGAATGA
```

This corresponds to the amino acid sequence <SEQ ID 1642; ORF 557.a>:

```
a557.pep
     1    MNKLFLTAAV LMLGACGFHL KGADGISPPL TYRSWHIEGG QALQFPLETA

51    LYQASGRVDD AAGAQMTLRI DSVSQNKETY TVTRAAVINE YLLILTVEAQ

101    VLKRGEPVGK PMTVSVRRVL AYADNEILGK QEEEAALWAE MRQDAAEQIV

151    RRLTFLKAE*
``` m557/a557 99.4% identity in 159 aa overlap

```
                   10        20        30        40        50        60
     m557.pep  MNKLFLTAAVLMLGACGFHLKGADGISPPLTYRSWHIEGGQALRFPLETALYQASGRVDD
               ||||||||||||||||||||||||||||||||||||||||:|||||||||||||||||||
     a557      MNKLFLTAAVLMLGACGFHLKGADGISPPLTYRSWHIEGGQALQFPLETALYQASGRVDD
                   10        20        30        40        50        60

70        80        90       100       110       120
     m557.pep  AAGAQMTLRIDSVSQNKETYTVTRAAVINEYLLILTVEAQVLKRGEPVGLPMTVSVRRVL
               ||||||||||||||||||||||||||||||||||||||||||||||||||||||||||||
     a557      AAGAQMTLRIDSVSQNKETYTVTRAAVINEYLLILTVEAQVLKRGEPVGLPMTVSVRRVL
                   70        80        90       100       110       120

130       140       150       160
     m557.pep  AYADNEILGKQEEEAALWAEMRQDAAEQIVRRLTFLKAEX
               |||||||||||||||||||||||||||||||||||||||
     a557      AYADNEILGKQEEEAALWAEMRQDAAEQIVRRLTFLKAEX
                  130       140       150       160
```

The following partial DNA sequence was identified in *N. gonorrhoeae* <SEQ ID 1643>:

```
g558.seq..
       1    ATGGATGCTT GTTTTTTCGT CATTCCCGCA CAGGCGGGAA TTCGGAGATT

51    CGGGATTGTT TTCAAACGTT CGGGTCGGAT TCTTGCCGGT GCGGGAATGA

101    TGCCCTTATA TACTTTCTCC GAGCTTTATA TGCTTCAACA GGGGACGGCA

151    CATCAAGCAC CGCACTGCGT GTTGCCCGAA CGAGGCTGCC CTCCGATTAG

201    ATTCTATCGC TATAAACAGA CGGGTTTCAA CCGAAAAGGA ATGGGGATAA

251    AGTCCATTTC CGACACCTCT CGGGCGATGC CGTCTGAAAA CCAATCTCCA

301    CTTTCAGACG GCATTGTTTA G
```

This corresponds to the amino acid sequence <SEQ ID 1644; ORF 558.ng>:

```
g558.pep..
       1    MDACFFVIPA QAGIRRFGIV FKRSGRILAG AGMMPLYTFS ELYMLQQGTA

51    HQAPHCVLPE RGCPPIRFYR YKQTGFNRKG MGIKSISDTS RAMPSENQSP

101    LSDGIV*
```

The following partial DNA sequence was identified in *N. meningitidis* <SEQ ID 1645>:

```
m558.seq..
       1    ATGAATGCTT GTTTTTTCGT CATTCCCACA CAGGCGGGAA TTCGGAGATT

51    CGGGATTGTT TTCAAACGTT CGGGTCGGAT TCTTGCCGGT GCAGGAATGA

101    TGCCCTTATA TACTTTCTCC GAGCTTTATA TGTTTCAACA GGGGACGGCA

151    CATCAAGCAC CGCACTGCGT GTTGCCCGAA CGAGACTACC CTCCGATTAG

201    ATTCTATCGC CATAAACAGA CGGGTTTCAA CCGAAAAGGA ATGGGGATAA

251    AGTCCATTTC CGACATCTsT CGGGCGATGC CGTCTGAAAA CCAATCTCCA

301    CTTTCAGACG GCATTGTTTA G
```

This corresponds to the amino acid sequence <SEQ ID 1646; ORF 558>:

```
m558.pep..
    1    MNACFFVIPT QAGIRRFGIV FKRSGRILAG AGMMPLYTFS ELYMFQQGTA

51    HQAPHCVLPE RDYPPIRFYR HKQTGFNRKG MGIKSISDIX RAMPSENQSP

101    LSDGIV*
```

Computer analysis of this amino acid sequence gave the following results:
Homology with a Predicted ORF from *N. gonorrhoeae*
ORF 558 shows 92.5% identity over a 106 aa overlap with a predicted ORF (ORF 558.ng) from *N. gonorrhoeae*:

```
  m558/g558
                    10         20         30         40         50         60
   m558.pep  MNACFFVIPTQAGIRRFGIVFKRSGRILAGAGMMPLYTFSELYMFQQGTAHQAPHCVLPE
             |:||||||||:|||||||||||||||||||||||||||||||||:||||||||||||||
   g558      MDACFFVIPAQAGIRRFGIVFKRSGRILAGAGMMPLYTFSELYMLQQGTAHQAPHCVLPE
                    10         20         30         40         50         60

70         80         90        100
   m558.pep  RDYPPIRFYRHKQTGFNRKGMGIKSISDIXRAMPSENQSPLSDGIVX
             |  ||||||||:|||||||||||||||||| |||||||||||||||
   g558      RGCPPIRFYRYKQTGFNRKGMGIKSISDTSRAMPSENQSPLSDGIVX
                    70         80         90        100
```

The following partial DNA sequence was identified in *N. meningitidis* <SEQ ID 1647>:

```
a558.seq
    1    ATGAATGCTT GTTTTTTCGT CATTCCCACA CAGGCGGGAA TTCGGAGATT

51    CGGGATTGTT TTCAAACGTT CGGGTCGGAT TCTTGCCGGT GCGGGAATGA

101    TGCCCTTATA TATAGTGGAT TAAATTTAAA TCAGGACAAG GCGACGAAGC

151    CGCAGACAGT ACAAATAGTA CGGCAAGGCG AGGCAACGCC GTACTGGTTT

201    AAATTTAATC CACTATACTT TCTCCGAGCT TTATATGTTT CAACAGAGGA

251    CGGCACATCA AGCACCGCAC TGCGTGTTGC CCGAACGAGA CTGCCCTCCG

301    ATTAGATTCT ATCGCTATAA ACAGACGGGT TTCAACCGAA AAGGAATGGG

351    AATGAAGTCC GTTTCCGACA CCTCTCGGGC GATGCCGTCT GAAAACCAAT

401    CTCCACTTTC AGACGGCATT GTTTAG
```

This corresponds to the amino acid sequence <SEQ ID 1648; ORF 558.a>:

```
a558.pep
    1    MNACFFVIPT QAGIRRFGIV FKRSGRILAG AGMMPLYIVD *I*IRTRRRS

51    RRQYK*YGKA RQRRTGLNLI HYTFSELYMF QQRTAHQAPH CVLPERDCPP

101    IRFYRYKQTG FNRKGMGMKS VSDTSRAMPS ENQSPLSDGI V*
``` m558/a558 70.2% identity in 141 aa overlap

```
                    10         20         30
   m558.pep  MNACFFVIPTQAGIRRFGIVFKRSGRILAGAGMMPLY----------------------
             ||||||||||||||||||||||||||||||||||||
   a558      MNACFFVIPTQAGIRRFGIVFKRSGRILAGAGMMPLYIVDXIXIRTRRRSRRQYKXYGKA
                    10         20         30         40         50         60

40         50         60         70         80
   m558.pep  -----------TFSELYMFQQGTAHQAPHCVLPERDYPPIRFYRHKQTGFNRKGMGIKS
                         ||||||||| ||||||||||||||| |||||||:||||||||||||:||
   a558      RQRRTGLNLIHYTFSELYMFQQRTAHQAPHCVLPERDCPPIRFYRYKQTGFNRKGMGMKS
                    70         80         90        100        110        120
```

-continued

```
                90         100
m558.pep    ISDIXRAMPSENQSPLSDGIVX
            :||  |||||||||||||||||
a558        VSDTSRAMPSENQSPLSDGIVX
                130        140
```

The following partial DNA sequence was identified in *N. gonorrhoeae* <SEQ ID 1649>:

```
g560.seq
      1   atgctcatca tccgcaacct gatttactgg ctgatactct gttccagcct
     51   gattttcctc tttcccttta tgctgctcgc ctcgcctttc cgggacgggg
    101   cgcacaagat ggcgcgggtc tgggtcggca tcctcaactg gtcgctcaaa
    151   cacatcgtcg ggctcaaata ccgcatcatc ggcgcggaac acattccgga
    201   ccgcccctcc gtcatctgcg ccaaacacca aagcggctgg gaaacgctcg
    251   cgctccaaga gattttccg ccgcaggttt acgttgccaa gcgcgagttg
    301   ttcaaaatcc cctttttcgg ctggggcttg aaactggtca aaccatagg
    351   catagaccgc aacaaccgcc gcgaagccaa cgaacagctc ataaaacagg
    401   gtttggcgcg caaaaacgaa ggttattgga ttaccatttt ccccgaaggc
    451   acgcgccttg cgcccggaaa acgcggcaaa tacaaactcg gcggcgcgcg
    501   catggcgaaa atgtttgaga tggacatcgt ccccgtcgcc ctcaacagcg
    551   gcgaattttg gccgaaaaat tcctttctga aatatccggg ggaaatcacc
    601   gtcatcatct gtccgaccat cccgcacgca agcggcagcg aagccgaatt
    651   gatggaaaaa tgcgaacacc tcattgaaac gcaacaaccg cttatttccg
    701   gcgcaggccc gtttgccgcc gaaatgccgt ctgaaaccgc atga
```

This corresponds to the amino acid sequence <SEQ ID 1650; ORF 560.ng>:

```
g560.pep..
      1   MLIIRNLIYW LILCSSLIFL FPFMLLASPF RDGAHKMARV WVGILNWSLK
     51   HIVGLKYRII GAEHIPDRPS VICAKHQSGW ETLALQEIFP PQVYVAKREL
    101   FKIPFFGWGL KLVKTIGIDR NNRREANEQL IKQGLARKNE GYWITIFPEG
    151   TRLAPGKRGK YKLGGARMAK MFEMDIVPVA LNSGEFWPKN SFLKYPGEIT
    201   VIICPTIPHA SGSEAELMEK CEHLIETQQP LISGAGPFAA EMPSET*
```

The following partial DNA sequence was identified in *N. meningitidis* <SEQ ID 1651>:

```
m560.seq
      1   ATGCTCATCA TCCGCAACCT GATTTACTGG CTGATACTCT GTTCCACCCT
     51   GATTTTCCTC TTTCCCTTTA TGCTGCTCGC CTCGCCTTTC CGGGACGGGG
    101   CGCACAAGAT GGCGCGGGTC TGGGTCGGCA TTCTCAACTG GTCGCTCAAA
    151   CACATCGTCG GGCTCAAATA CCGCATCATC GGCGCGGAAA ACATCCCCGA
    201   CCGCCCCGCC GTCATCTGCG CCAAACACCA AAGCGGCTGG GAAACGCTCG
    251   CCCTTCAGGA CATTTTTCCG CCGCAGGTTT ACGTTGCCAA CGCGAGTTG
    301   TTCAAAATCC CCTTTTTCGG CTGGGGCTTG AAACTGGTCA AAACCATAGG
    351   CATAGACCGC AACAACCGCC GCGAAGCCAA CGAGCAGCTC ATAAAACAGG
```

-continued

```
401  GGTTGGTGCG CAAAAACGAA GGCTATTGGA TTACCATTTT CCCCGAAGGC

451  ACGCGCCTTG CGCCCGGAAA ACGCGGCAAA TACAAACTCG GCGGCGCGCG

501  CATGGCGAAA ATGTTTGAGA TGGACATCGT CCCCGTCGCC CTCAACAGCG

551  GCGAATTTTG GCCGAAAAAC TCCTTTCTGA ATATCCGGG GGAAATCACC

601  GTCGTCATCT GTCCGACCAT CCCGCACGCA AGCGGCAGCG AAGCCGAATT

651  GATGGAAAAA TGCGAACATC TCATCGAAAC GCAACAACCG CTTATTTCCG

701  GCGCAGGCCC GTTTGCCGCC AAAATGCCGT CTGAAACCGC ATGA
```

This corresponds to the amino acid sequence <SEQ ID 1652; ORF 560>:

```
m560.pep
    1  MLIIRNLIYW LILCSTLIFL FPFMLLASPF RDGAHKMARV WVGILNWSLK

51  HIVGLKYRII GAENIPDRPA VICAKHQSGW ETLALQDIFP PQVYVAKREL

101  FKIPFFGWGL KLVKTIGIDR NNRREANEQL IKQGLVRKNE GYWITIFPEG

151  TRLAPGKRGK YKLGGARMAK MFEMDIVPVA LNSGEFWPKN SFLKYPGEIT

201  VVICPTIPHA SGSEAELMEK CEHLIETQQP LISGAGPFAA KMPSETA*
```

Computer analysis of this amino acid sequence gave the following results:
Homology with a Predicted ORF from *N. gonorrhoeae*
ORF 560 shows 97.2% identity over a 246 aa overlap with a predicted ORF (ORF 560.ng) from *N. gonorrhoeae*:

```
m560/g560
                  10         20         30         40         50         60
 m560.pep  MLIIRNLIYWLILCSTLIFLFPFMLLASPFRDGAHKMARVWVGILNWSLKHIVGLKYRII
           ||||||||||||||:|||||||||||||||||||||||||||||||||||||||||||||
     g560  MLIIRNLIYWLILCSSLIFLFPFMLLASPFRDGAHKMARVWVGILNWSLKHIVGLKYRII
                  10         20         30         40         50         60

70         80         90        100        110        120
 m560.pep  GAENIPDRPAVICAKHQSGWETLALQDIFPPQVYVAKRELFKIPFFGWGLKLVKTIGIDR
           |||:||||||:|||||||||||||||||:|||||||||||||||||||||||||||||||
     g560  GAEHIPDRPSVICAKHQSGWETLALQEIFPPQVYVAKRELFKIPFFGWGLKLVKTIGIDR
                  70         80         90        100        110        120

130        140        150        160        170        180
 m560.pep  NNRREANEQLIKQGLVRKNEGYWITIFPEGTRLAPGKRGKYKLGGARMAKMFEMDIVPVA
           ||||||||||||||:|||||||||||||||||||||||||||||||||||||||||||||
     g560  NNRREANEQLIKQGLARKNEGYWITIFPEGTRLAPGKRGKYKLGGARMAKMFEMDIVPVA
                 130        140        150        160        170        180

190        200        210        220        230        240
 m560.pep  LNSGEFWPKNSFLKYPGEITVVICPTIPHASGSEAELMEKCEHLIETQQPLISGAGPFAA
           |||||||||||||||||||||:||||||||||||||||||||||||||||||||||||||
     g560  LNSGEFWPKNSFLKYPGEITVIICPTIPHASGSEAELMEKCEHLIETQQPLISGAGPFAA
                 190        200        210        220        230        240 m560.pep  KMPSETAX
           :|||||
     g560  EMPSETX
```

The following partial DNA sequence was identified in *N. meningitidis* <SEQ ID 1653>:

```
a560.seq
    1  ATGCTCATCA TCCGCAACCT GATTTACTGG CTGATACTCT GTTCCACCCT

51  GATTTTCCTC TTTCCCTTTA TGCTGCTCGC CTCGCCTTTC CGAGACGGGG

101  CGCACAAGAT GGCGCGGGTC TGGGTCAAAA TCCTCAACCT CTCGCTCAAA

151  CACATCGTCG GGCTCAAATA CCGCATCATC GGCGCGGAAA ACATCCCCGA
```

```
                          -continued
201   CCGCCCCGCC GTCATCTGCG CCAAACACCA AAGCGGCTGG GAAACGCTCG

251   CCCTTCAGGA CATTTTTCCG CCGCAGGTTT ACGTTGCCAA ACGCGAGTTG

301   TTCAAAATCC CCTTTTTCGG CTGGGGCTTG AAACTGGTCA AAACCATAGG

351   CATAGACCGC AACAACCGCC GCGAAGCCAA CGAGCAGCTC ATAAAACAGG

401   GGTTGGCGCG CAAAAACGAA GGCTATTGGA TTACCATTTT CCCCGAAGGC

451   ACACGCCTTG CGCCCGGAAA ACGCGGCAAA TACAAACTCG GCGGCGCGCG

501   CATGGCGAAA ATGTTTGAGA TGGACATCGT CCCCGTCGCC CTCAACAGCG

551   GCGAATTTTG GCCGAAAAAC TCCTTTCTGA ATATCCGGG GGAAATCACC

601   GTCGTCATCT GTCCGACCAT CCCGCACGCA AGCGGCAGCG AAGCCGAATT

651   GATGGGAAAA TGCGAACACC TCATCGAAAC GCAGCAGCCG CTCATTTCCG

701   GCGCAGGCCC GTTTGCCGCC AAAATGCCGT CTGAAACCGC ATGA
```

This corresponds to the amino acid sequence <SEQ ID 1654; ORF 560.a>:

```
a560.pep
  1   MLIIRNLIYW LILCSTLIFL FPFMLLASPF RDGAHKMARV WVKILNLSLK

51   HIVGLKYRII GAENIPDRPA VICAKHQSGW ETLALQDIFP PQVYVAKREL

101   FKIPFFGWGL KLVKTIGIDR NNRREANEQL IKQGLARKNE GYWITIFPEG

151   TRLAPGKRGK YKLGGARMAK MFEMDIVPVA LNSGEFWPKN SFLKYPGEIT

201   VVICPTIPHA SGSEAELMGK CEHLIETQQP LISGAGPFAA KMPSETA*
``` m560/a560 98.4% identity in 247 aa overlap

```
                 10         20         30         40         50         60
m560.pep   MLIIRNLIYWLILCSTLIFLFPFMLLASPFRDGAHKMARVWVGILNWSLKHIVGLKYRII
           ||||||||||||||||||||||||||||||||||||||||||   |||  ||||||||||
a560       MLIIRNLIYWLILCSTLIFLFPFMLLASPFRDGAHKMARVWVKILNLSLKHIVGLKYRII
                 10         20         30         40         50         60

70         80         90        100        110        120
m560.pep   GAENIPDRPAVICAKHQSGWETLALQDIFPPQVYVAKRELFKIPFFGWGLKLVKTIGIDR
           ||||||||||||||||||||||||||||||||||||||||||||||||||||||||||||
a560       GAENIPDRPAVICAKHQSGWETLALQDIFPPQVYVAKRELFKIPFFGWGLKLVKTIGIDR
                 70         80         90        100        110        120

130        140        150        160        170        180
m560.pep   NNRREANEQLIKQGLVRKNEGYWITIFPEGTRLAPGKRGKYKLGGARMAKMFEMDIVPVA
           |||||||||||||||:||||||||||||||||||||||||||||||||||||||||||||
a560       NNRREANEQLIKQGLARKNEGYWITIFPEGTRLAPGKRGKYKLGGARMAKMFEMDIVPVA
                130        140        150        160        170        180

190        200        210        220        230        240
m560.pep   LNSGEFWPKNSFLKYPGEITVVICPTIPHASGSEAELMEKCEHLIETQQPLISGAGPFAA
           ||||||||||||||||||||||||||||||||||||||| ||||||||||||||||||||
a560       LNSGEFWPKNSFLKYPGEITVVICPTIPHASGSEAELMGKCEHLIETQQPLISGAGPFAA
                190        200        210        220        230        240 m560.pep   KMPSETAX
           ||||||||
a560       KMPSETAX
```

The following partial DNA sequence was identified in *N. meningitidis* <SEQ ID 1655>:

```
m561.seq.
  1   ATGATACTGC CAGCCCGTTT TTCAGACGGC ATCAGCCTTT CCCTGCGCCT

51   GAAACTCCTG ACCGGACTGT GGGTCGGGTT GGCGGCATTG TCTGTCGTTT

101   TGACACTGCT GCTCTCTTTG CGTCTGGAAA ACGCGGCCTC CGTCATCGAA

151   GAGGCGGGCA ACTTGAGAAT GCAGGCATAC CGTCTGGCAT ACATGGCGGG
```

```
 201  TGAAGGCTCG CCCCGTGCGC AAATTGACAA TCAGGTTGCC GAATTTGAAA

251  AAAGTTTAAA ACGCATTGCC CAAAGCGATG CCATCCATCC GCTGATTCCT

301  TCGGACACCC CTCTTGCTTA TGATTTGATA CAATCCATGC TGATTATAGA

351  TTGGCAGGCA CACATCCTCC CCCCGCTCCA GTCCTACCGG CGACCGACTC

401  AGGTCGATCT CTACCGCTTT GCCGGAAACA TCGAACTGTT TTTGCAGGCA

451  TTGGAAAATG CCAACGAAAA AAACACATGG TGGCTCAGGC GTTTTCAATG

501  GGCAATTATG TTGATGACGC TGGTGTCGTC TGTACTGATG CTGTTTTGGC

551  ACCAGATTTG GGTTATCCGG CCGCTGCAGG CGTTAAGGGA AGGTGCGGAA

601  CGCATCGGAC GGAGGTGTTT CGATATTCCG GTTCCCGAAG GCGGTACGCC

651  GGAATTCAAA CAGGTCGGGC GTTGTTTCAA TCAAATGGGC GGCAGGTTGA

701  AAATTTTATA TGATGATTTG GAAGGACAAG TCGCCGAGCA GACACGCAGT

751  CTCGAAAAAC AAAATCAAAA CCTGACCCTG CTGTACCAAA CTACACGGGA

801  CCTGCACCAA TCCTACATAC CGCAACAGGC TGCAGAACAT TTTCTAAACC

851  GTATCCTGCC CGCCGTAGGA GCAGATTCCG GCAGAGTTTG TTTGGACGGC

901  GGATCCGATG TTTATGTTTC CATTCATCAT GCGGATTGCG GCACAGCAGC

951  TTCGGATTTG GGGAAGTACC ATGAGGAAAT CTTCCCCATT GAGTACCAGA

1001  ACGAAACATT GGGCAGGCTG TTGCTCAGCT TTCCAAACGG CATTTCTCTT

1051  GATGAAGACG ACCGCATCCT GCTTCAAACA CTAGGCAGGC AATTGGGCGT

1101  ATCGCTTGCC GGCGCAAAAC AGGAGGAAGA AAAACGCCTG CTTGCAGTAT

1151  TGCAGGAACG CAACCTGATT GCGCAAGGAT TACATGACAG CATCGCACAA

1201  GCATTAACGT TCCTAAACCT ACAGGTACAG ATGCTGGAAA CCGCCTTTGC

1251  CGAAAACAAA CGGGAGGAAG CCGCAGAAAA CATCAGCTTT ATCAAAACAG

1301  GCGTGCAGGA ATGTTATGAA GATGTCCGCG AACTGCTGCT CAACTTCCGT

1351  ACCAAAATCA GCAATAAAGA ATTTCCCGAA GCCGTTGCCG ACCTATTCGC

1401  CCGCTTTACG CAACAAACCG GGATAACGGT CGAAACCGCC TGGGAAAACG

1451  GTTCGTTCCT GCCGCCTCAG GAAGCGCAGC TCCAAATGAT TTTTATCCTG

1501  CAGGAAAGCC TGTCCAACAT CCGCAAACAC GCCCGCGCCA CCCATGTAAA

1551  ATTCACCCTT TCCGAACACG GCGGACGCTT TACCATGACC ATCCAAGACA

1601  ACGGACAAGG TTTCGACACG GAGAAAATAG GAGAACCCAC GGGCAGCCAT

1651  GTCGGACTGC ACATCATGCA GGAGCGTGCC AAACGCATCC ATGCCGTTTT

1701  AGAAATCCGT TCCCAAGCTC AACAGGGAAC CACCGTCTCA TTGACGGTTG

1751  CATCTGAAGA AAGCTTGAAA TGA
```

This corresponds to the amino acid sequence <SEQ ID 1656; ORF 561>:

```
m561.pep
   1  MILPARFSDG ISLSLRLKLL TGLWVGLAAL SVVLTLLLSL RLENAASVIE

51  EAGNLRMQAY RLAYMAGEGS PRAQIDNQVA EFEKSLKRIA QSDAIHPLIP

101  SDTPLAYDLI QSMLIIDWQA HILPPLQSYR RPTQVDLYRF AGNIELFLQA

151  LENANEKNTW WLRRFQWAIM LMTLVSSVLM LFWHQIWVIR PLQALREGAE

201  RIGRRCFDIP VPEGGTPEFK QVGRCFNQMG GRLKILYDDL EGQVAEQTRS
```

-continued

```
251  LEKQNQNLTL LYQTTRDLHQ SYIPQQAAEH FLNRILPAVG ADSGRVCLDG

301  GSDVYVSIHH ADCGTAASDL GKYHEEIFPI EYQNETLGRL LLSFPNGISL

351  DEDDRILLQT LGRQLGVSLA GAKQEEEKRL LAVLQERNLI AQGLHDSIAQ

401  ALTFLNLQVQ MLETAFAENK REEAAENISF IKTGVQECYE DVRELLLNFR

451  TKISNKEFPE AVADLFARFT QQTGITVETA WENGSFLPPQ EAQLQMIFIL

501  QESLSNIRKH ARATHVKFTL SEHGGRFTMT IQDNGQGFDT EKIGEPTGSH

551  VGLHIMQERA KRIHAVLEIR SQAQQGTTVS LTVASEESLK *
```

Computer analysis of this amino acid sequence gave the following results:
Homology with a Predicted ORF from *N. gonorrhoeae*
m561/g561 89.7% identity in 223 aa overlap

```
                   10         20         30         40         50         60
  m561.pep  MILPARFSDGISLSLRLKLLTGLWVGLAALSVVLTLLLSLRLENAASVIEEAGNLRMQAY
            ||||:|||||| |||||||||||||||||||||||||||:||||||||||||||:||||
      g561  MILPTRFSDGIPLSLRLKLLTGLWVGLAALSVVLTLLLSFRLENAASVIEEAGNLKMQAY
                   10         20         30         40         50         60

70         80         90        100        110        120
  m561.pep  RLAYMAGEGSPRAQIDNQVAEFEKSLKRIAQSDAIHPLIPSDTPLAYDLIQSMLIIDWQA
            ||||||||||||||||||:|||||||||||:||||||||||||:||||||||||||||||
      g561  RLAYMAGEGSPRAQIDNQIAEFEKSLKRISQSDAIHPLIPSDNPLAYDLIQSMLIIDWQA
                   70         80         90        100        110        120

130        140        150        160        170        180
  m561.pep  HILPPLQSYRRPTQVDLYRFAGNIELFLQALENANEKNTWWLRRFQWAIMLMTLVSSVLM
            :||||||:||||||::|||||||||||||||||||:||||||||||||:|||||||||||
      g561  NILPPLQAYRRPTQIELYRFAGNIELFLQALENAGEKNTWWLRRFQWVIMLMTLVSSVLM
                  130        140        150        160        170        180

190        200        210        220        230        240
  m561.pep  LFWHQIWVIRPLQALREGAERIGRRCFDIPVPEGGTPEFKQVGRCFNQMGGRLKILYDDL
            |||||||||||||||||||||||||:| ||||||||  |: ::  |
      g561  LFWHQIWVIRPLQALREGAERIGQRHFDIPVPEDVRPNSNRSGGVSTKWRSGX
                  190        200        210        220        230

250        260        270        280        290        300
  m561.pep  EGQVAEQTRSLEKQNQNLTLLYQTTRDLHQSYIPQQAAEHFLNRILPAVGADSGRVCLDG
```

The following partial DNA sequence was identified in *N. meningitidis* <SEQ ID 1657>:

```
a561.seq
    1  ATGATACTGC CAGCCCGTTT TTCAGACGGC ATCAGCCTTT CCCTGCGCCT

51  GAAACTCCTG ACCGGACTGT GGGTCGGGTT GGCGGCATTG TCTGTCGTTT

101  TGACACTGCT GCTCTCTTTG CGTCTGGAAA ACGCGGCCTC CGTCATCGAA

151  GAGGCGGGCA ACTTGAGAAT GCAGGCATAC CGTCTGGCAT ACATGGCGGG

201  TGAAGGCTCG CCCCGTGCGC AAATTGACAA TCAGGTTGCC GAATTTGAAA

251  AAAGTTTAAA ACGCATTGCC CAAAGCGATG CCATCCATCC GCTGATTCCT

301  TCGGACACCC CTCTTGCTTA TGATTTGATA CAATCCATGC TGATTATAGA

351  TTGGCAGGCA CACATCCTCC CCCCGCTCCA GTCCTACCGG CGACCGACTC

401  AGGTCGATCT CTACCGCTTT GCCGGAAACA TCGAACTGTT TTTGCAGGCA

451  TTGGAAAATG CCAACGAAAA AAACACATGG TGGCTCAGGC GTTTTCAATG

501  GGCAATTATG TTGATGACGC TGGTGTCGTC TGTACTGATG CTGTTTTGGC

551  ACCAGATTTG GGTTATCCGG CCGCTGCAGG CGTTAAGGGA AGGTGCGGAA
```

```
-continued
 601  CGCATCGGAC GGAGGTGTTT CGATATTCCG GTTCCCGAAG GCGGTACGCC
 651  GGAATTCAAA CAGGTCGGGC GTTGTTTCAA TCAAATGGGC GGCAGGTTGA
 701  AAATTTTATA TGATGATTTG GAAGGACAAG TCGCCGAGCA GACACGCAGT
 751  CTCGAAAAAC AAAATCAAAA CCTGACCCTG CTGTACCAAA CTACACGGGA
 801  TCTGCACCAA TCCTACATAC CGCAACAGGC TGCAGAACAT TTTCTAAACC
 851  GTATCCTGCC CGCCGTAGGA GCAGATTCCG GCAGAGTTTG TTTGGACGGC
 901  GGATCCGATG TTTATGTTTC CATTCATCAT GCGGATTGCG GCACAGCAGC
 951  TTCGGATTTG GGAAGTACC ATGAGGAAAT CTTCCCCATT GAGTACCAGA
1001  ACGAAACATT GGGCAGGCTG TTGCTCAGCT TTCCAAACGG CATTTCTCTT
1051  GATGAAGACG ACCGCATCCT GCTTCAAACA CTAGGCAGGC AATTGGGCGT
1101  ATCGCTTGCC GGCGCAAAAC AGGAGGAAGA AAAACGCCTG CTTGCAGTAT
1151  TGCAGGAACG CAACCTGATT GCGCAAGGAT TACATGACAG CATCGCACAA
1201  GCATTAACGT TCCTAAACCT ACAGGTACAG ATGCTGGAAA CCGCCTTTGC
1251  CGAAAACAAA CGGGAGGAAG CCGCAGAAAA CATCGGCTTC ATCAAAACAG
1301  GCGTGCAGGA ATGTTATGAA GATGTCCGCG AACTGCTGCT CAACTTCCGT
1351  ACCAAAATCA GTAATAAAGA ATTTCCCGAA GCCGTTGCCG ACCTATTCTC
1401  GCGCTTTACG CAACAGACCG GCACGACTGT CGAAACCGCT TGGGAAAACG
1451  GCACGCACCT GCCTACACAG GACGAGCAGC TCCAAATGAT TTTCATCCTG
1501  CAAGAAAGCT TGTCCAACAT CCGAAAACAT GCCCACGCCA CCCATATCAA
1551  ATTCAGACTG CTCAAACAGG ATGGAAGTTT TACAATGACC ATTCAAGACA
1601  ACGGACAGGG TTTTGACACG GAAAACATTG GAGAACCATC GGGCAGCCAT
1651  GTCGGACTGC ATATCATGCA GGAGCGTGCC AAACGCATCC ATGCCGTTTT
1701  AGAAATCCGT TCCCAAGCTC AACAGGGAAC CACCGTCTCA TTGACGGTTG
1751  CATCTGAAGA AAGCTTGAAA TGA
```

This corresponds to the amino acid sequence <SEQ ID 1658; ORF 561.a>:

```
a561.pep
   1  MILPARFSDG ISLSLRLKLL TGLWVGLAAL SVVLTLLLSL RLENAASVIE
  51  EAGNLRMQAY RLAYMAGEGS PRAQIDNQVA EFEKSLKRIA QSDAIHPLIP
 101  SDTPLAYDLI QSMLIIDWQA HILPPLQSYR RPTQVDLYRF AGNIELFLQA
 151  LENANEKNTW WLRRFQWAIM LMTLVSSVLM LFWHQIWVIR PLQALREGAE
 201  RIGRRCFDIP VPEGGTPEFK QVGRCFNQMG GRLKILYDDL EGQVAEQTRS
 251  LEKQNQNLTL LYQTTRDLHQ SYIPQQAAEH FLNRILPAVG ADSGRVCLDG
 301  GSDVYVSIHH ADCGTAASDL GKYHEEIFPI EYQNETLGRL LLSFPNGISL
 351  DEDDRILLQT LGRQLGVSLA GAKQEEEKRL LAVLQERNLI AQGLHDSIAQ
 401  ALTFLNLQVQ MLETAFAENK REEAAENIGF IKTGVQECYE DVRELLLNFR
 451  TKISNKEFPE AVADLFSRFT QQTGTTVETA WENGTHLPTQ DEQLQMIFIL
 501  QESLSNIRKH AHATHIKFRL LKQDGSFTMT IQDNGQGFDT ENIGEPSGSH
 551  VGLHIMQERA KRIHAVLEIR SQAQQGTTVS LTVASEESLK *
``` m561/a561 96.9% identity in 590 aa overlap

```
                   10        20        30        40        50        60
     m561.pep MILPARFSDGISLSRLKLLTGLWVGLAALSVVLTLLLSRLENAASVIEEAGNLRMQAY
              |||||||||||||||||||||||||||||||||||||||||||||||||||||||||
     a561     MILPARFSDGISLSRLKLLTGLWVGLAALSVVLTLLLSRLENAASVIEEAGNLRMQAY
                   10        20        30        40        50        60

70        80        90       100       110       120
     m561.pep RLAYMAGEGSPRAQIDNQVAEFEKSLKRIAQSDAIHPLIPSDTPLAYDLIQSMLIIDWQA
              ||||||||||||||||||||||||||||||||||||||||||||||||||||||||||||
     a561     RLAYMAGEGSPRAQIDNQVAEFEKSLKRIAQSDAIHPLIPSDTPLAYDLIQSMLIIDWQA
                   70        80        90       100       110       120

130       140       150       160       170       180
     m561.pep HILPPLQSYRRPTQVDLYRFAGNIELFLQALENANEKNTWWLRRFQWAIMLMTLVSSVLM
              ||||||||||||||||||||||||||||||||||||||||||||||||||||||||||||
     a561     HILPPLQSYRRPTQVDLYRFAGNIELFLQALENANEKNTWWLRRFQWAIMLMTLVSSVLM
                  130       140       150       160       170       180

190       200       210       220       230       240
     m561.pep LFWHQIWVIRPLQALREGAERIGRRCFDIPVPEGGTPEFKQVGRCFNQMGGRLKILYDDL
              ||||||||||||||||||||||||||||||||||||||||||||||||||||||||||||
     a561     LFWHQIWVIRPLQALREGAERIGRRCFDIPVPEGGTPEFKQVGRCFNQMGGRLKILYDDL
                  190       200       210       220       230       240

250       260       270       280       290       300
     m561.pep EGQVAEQTRSLEKQNQNLTLLYQTTRDLHQSYIPQQAAEHFLNRILPAVGADSGRVCLDG
              ||||||||||||||||||||||||||||||||||||||||||||||||||||||||||||
     a561     EGQVAEQTRSLEKQNQNLTLLYQTTRDLHQSYIPQQAAEHFLNRILPAVGADSGRVCLDG
                  250       260       270       280       290       300

310       320       330       340       350       360
     m561.pep GSDVYVSIHHADCGTAASDLGKYHEEIFPIEYQNETLGRLLLSFPNGISLDEDDRILLQT
              ||||||||||||||||||||||||||||||||||||||||||||||||||||||||||||
     a561     GSDVYVSIHHADCGTAASDLGKYHEEIFPIEYQNETLGRLLLSFPNGISLDEDDRILLQT
                  310       320       330       340       350       360

370       380       390       400       410       420
     m561.pep LGRQLGVSLAGAKQEEEKRLLAVLQERNLIAQGLHDSIAQALTFLNLQVQMLETAFAENK
              ||||||||||||||||||||||||||||||||||||||||||||||||||||||||||||
     a561     LGRQLGVSLAGAKQEEEKRLLAVLQERNLIAQGLHDSIAQALTFLNLQVQMLETAFAENK
                  370       380       390       400       410       420

430       440       450       460       470       480
     m561.pep REEAAENISFIKTGVQECYEDVRELLLNFRTKISNKEFPEAVADLFARFTQQTGITVETA
              |||||||||:||||||||||||||||||||||||||||||||||||:||||||:|||||
     a561     REEAAENIGFIKTGVQECYEDVRELLLNFRTKISNKEFPEAVADLFSRFTQQTGTTVETA
                  430       440       450       460       470       480

490       500       510       520       530       540
     m561.pep WENGSFLPPQEAQLQMIFILQESLSNIRKHARATHVKFTLSEHGGRFTMTIQDNGQGFDT
              ||||: || :: |||||||||||||||||||:|||:|| | :: ||||||||||||||||
     a561     WENGTHLPTQDEQLQMIFILQESLSNIRKHAHATHIKFRLLKQDGSFTMTIQDNGQGFDT
                  490       500       510       520       530       540

550       560       570       580       590
     m561.pep EKIGEPTGSHVGLHIMQERAKRIHAVLEIRSQAQQGTTVSLTVASEESLKX
              |:||||:|||||||||||||||||||||||||||||||||||||||||||
     a561     ENIGEPSGSHVGLHIMQERAKRIHAVLEIRSQAQQGTTVSLTVASEESLKX
                  550       560       570       580       590
```

45

The following partial DNA sequence was identified in *N. gonorrhoeae* <SEQ ID 1659>:

```
g562.seq..
   1    atggcaagcc cgtcgagtct gcctttcaat tcgggcaaga ccaaaccgac 51    ggcttttgcc gcgccggttt tggtcggaat catgttttcc acgccgctgc 101    gggcgcggcg caggtctttg tggcgcacgt cggtaacggt ttggtcgttg 151    gtcagtgcgt ggatggtggt cattgcgcct ttgacgatgc cgacgctttc 201    gctcaacact ttggcaaccg gcgagaggca gttggtggtg caggaagcgt 251    tggaaacgac ggtcatgtcg gcggtcagga cgctgtcgtt cacgccgtac 301    acgacggttg catcgacatc gtcgccgccc ggtgcggaaa tgaggacttt 351    tttcgcgccg ctttcgaggt ggattttggc ttttctttg ctggtgaacg
```

```
-continued
401    cgccggtgca ttccatgacc aaatcgacac cgagttcttt ccacggcagt 451    tcggcagggt tgcgggtcga gaagaagggg attttgtcgc cgttgacgat 501    gaggttgccg ccgtcgtggg atacgtcggc ttcaaagcgt ccgtgtacgg 551    tgtcgaattt ggtcagatgg gcgttggttt caaggctgcc gctggcgttg 601    acggcgacga tttggagttg gtcttga
```

This corresponds to the amino acid sequence <SEQ ID 1660; ORF 562.ng>:

```
g562.pep
  1    MASPSSLPFN SGKTKPTAFA APVLVGIMFS TPLRARRRSL WRTSVTVWSL

51    VSAWMVVIAP LTMPTLSLNT LATGERQLVV QEALETTVMS AVRTLSFTPY

101    TTVASTSSPP GAEMRTFFAP LSRWILAFSL LVNAPVHSMT KSTPSSFHGS

151    SAGLRVEKKG ILSPLTMRLP PSWDTSASKR PCTVSNLVRW ALVSRLPLAL

201    TATIWSWS*
```

The following partial DNA sequence was identified in *N. meningitidis* <SEQ ID 1661>:

```
m562.seq
  1    ATGGCAAGCC CGTCGAGCCT GCCTTTCAAT TCGGGCAGTA CCAAACCGAC

51    GGCTTTTGCC GCGCCGGTTT TGGTCGGAAT CATGTTTTCC ACGCCGCTGC

101    GGGCGCGGCG CAGGTCTTTG TGGCGCACGT CGGTAACGGT TTGGTCGTTG

151    GTCAGCGCGT GGATGGTGGT CATCGCGCCT TTGACGATGC CGACGCTTTC

201    GCTCAACACT TTGGCAACCG GCGAGAGGCA GTTGGTGGTG CAGGAAGCGT

251    TGGAAACGAC GGTCATGTCG GCGGTCAGGA CGCTGTCGTT CACGCCGTAC

301    ACGACGGTTG CATCGACATC GTCGCCGCCC GGTGCGGAAA TGAGGACTTT

351    TTTCGCGCCG CTTTCGAGGT GGATTTTGGC TTTTTCTTTG CTGGTGAACG

401    CGCCGGTGCA TTCCATGACC AAATCGACAC CGAGTTCTTT CCACGGCAGT

451    TCGGCAGGGT TGCGGGTCGA GAAGAAGGGG ATTTTGTCGC CGTTGACGAT

501    GAGGTTGCCG CCGTCGTGGG ATACGTCGGC TTCAAAGCGT CCGTGCACGG

551    TGTCGAATTT GGTCAGATGG GCGTTGGTTT CAAGGCTGCC GCTGGCGTTG

601    ACGGCGACGA GTTGGAGTTG GTCTTGA
```

This corresponds to the amino acid sequence <SEQ ID 1662; ORF 562>:

```
m562.pep
  1    MASPSSLPFN SGSTKPTAFA APVLVGIMFS TPLRARRRSL WRTSVTVWSL

51    VSAWMVVIAP LTMPTLSLNT LATGERQLVV QEALETTVMS AVRTLSFTPY

101    TTVASTSSPP GAEMRTFFAP LSRWILAFSL LVNAPVHSMT KSTPSSFHGS

151    SAGLRVEKKG ILSPLTMRLP PSWDTSASKR PCTVSNLVRW ALVSRLPLAL

201    TATSWSWS*
```

Computer analysis of this amino acid sequence gave the following results:
Homology with a Predicted ORF from N. gonorrhoeae
m562/g562 99.0% identity in 208 aa overlap

```
                  10         20         30         40         50         60
    m562.pep  MASPSSLPFNSGSTKPTAFAAPVLVGIMFSTPLRARRRSLWRTSVTVESLVSAWMVVIAP
              ||||||||||| :|||||||||||||||||||||||||||||||||||||||||||||||
    g562      MASPSSLPFNSGKTKPTAFAAPVLVGIMFSTPLRARRRSLWRTSVTVESLVSAWMVVIAP
                  10         20         30         40         50         60

70         80         90        100        110        120
    m562.pep  LTMPTLSLNTLATGERQLVVQEALETTVMSAVRTLSFTPYTTVASTSSPPGAEMRTFFAP
              ||||||||||||||||||||||||||||||||||||||||||||||||||||||||||||
    g562      LTMPTLSLNTLATGERQLVVQEALETTVMSAVRTLSFTPYTTVASTSSPPGAEMRTFFAP
                  70         80         90        100        110        120

130        140        150        160        170        180
    m562.pep  LSRWILAFSLLVNAPVHSMTKSTPSSFHGSSAGLRVEKKGILSPLTMRLPPSWDTSASKR
              ||||||||||||||||||||||||||||||||||||||||||||||||||||||||||||
    g562      LSRWILAFSLLVNAPVHSMTKSTPSSFHGSSAGLRVEKKGILSPLTMRLPPSWDTSASKR
                 130        140        150        160        170        180

190        200      209
    m562.pep  PCTVSNLVRWALVSRLPLALTATSWSWSX
              |||||||||||||||||||||||| |||||
    g562      PCTVSNLVRWALVSRLPLALTATIWSWSX
```

The following partial DNA sequence was identified in N. meningitidis <SEQ ID 1663>:

```
a562.seq
      1    ATGGCAAGCC CGTCGAGTTT GTCTTTCAAT TCGGGCAGTA CCAAACCGAC

51    GGCTTTTGCC GCGCCAGTTT TGGTCGGAAT CATGTTTTCC ACGCCGCTGC

101    GGGCGCGGCG CAGGTCTTTG TGGCGCACGT CGGTAACGGT TTGGTCGTTG

151    GTCAGCGCGT GGATGGTGGT CATCGCGCCT TTGACGATGC CGACGCTTTC

201    GCTCAACACT TTGGCAACCG GCGAGAGGCA GTTGGTGGTG CAGGAAGCGT

251    TGGAAACGAC GGTCATGTCG GCGGTCAGGA TGCTGTCGTT CACGCCGTAC

301    ACGACGGTTG CATCGACATC GTCGCCGCCC GGTGCGGAAA TGAGGACTTT

351    TTTCGCGCCG CTTTCCAGAT GAACTTTGGC TTTTTCTTTG CTGGTGAACG

401    CGCCGGTGCA TTCCATGACC AAATCGACAC CGAGTTCTTT CCACGGCAGT

451    TCGGCAGGGT TGCGGGTCNA GAAGAANGGG ATTTTGTCGC CGTTGACGAT

501    GAGGTTGCCG CCGTCGTGGG ATACGTCGGC TTCAAAGCGT CCGTGCACGG

551    TGTCGAATTT GGTGAGGTGG GCGTTGGTTT CAAGGCTGCC GCTGGCGTTG

601    ACGGCGACGA TTTGGAGTTG GTCTTGA
```

This corresponds to the amino acid sequence <SEQ ID 1664; ORF 562.a>:

```
a562.pep
      1    MASPSSLSFN SGSTKPTAFA APVLVGIMFS TPLRARRRSL WRTSVTVWSL

51    VSAWMVVIAP LTMPTLSLNT LATGERQLVV QEALETTVMS AVRMLSFTPY

101    TTVASTSSPP GAEMRTFFAP LSR*TLAFSL LVNAPVHSMT KSTPSSFHGS

151    SAGLRVXKXG ILSPLTMRLP PSWDTSASKR PCTVSNLVRW ALVSRLPLAL

201    TATIWSWS*
``` m562/a562 96.6% identity in 208 aa overlap

```
                 10        20        30        40        50        60
m562.pep  MASPSSLPFNSGSTKPTAFAAPVLVGIMFSTPLRARRRSLWRTSVTVESLVSAWMVVIAP
          ||||||| ||||:|||||||||||||||||||||||||||||||||||||||||||||||
a562      MASPSSLSFNSGKTKPTAFAAPVLVGIMFSTPLRARRRSLWRTSVTVESLVSAWMVVIAP
                 10        20        30        40        50        60

70        80        90       100       110       120
m562.pep  LTMPTLSLNTLATGERQLVVQEALETTVMSAVRTLSFTPYTTVASTSSPPGAEMRTFFAP
          ||||||||||||||||||||||||||||||||||| ||||||||||||||||||||||||
a562      LTMPTLSLNTLATGERQLVVQEALETTVMSAVRMLSFTPYTTVASTSSPPGAEMRTFFAP
                 70        80        90       100       110       120

130       140       150       160       170       180
m562.pep  LSRWILAFSLLVNAPVHSMTKSTPSSFHGSSAGLRVEKKGILSPLTMRLPPSWDTSASKR
          |||  |||||||||||||||||||||||||||||||| | ||||||||||||||||||||
a562      LSRXTLAFSLLVNAPVHSMTKSTPSSFHGSSAGLRVXKXGILSPLTMRLPPSWDTSASKR
                130       140       150       160       170       180

190       200      209
m562.pep  PCTVSNLVRWALVSRLPLALTATSWSWSX
          |||||||||||||||||||||||| ||||
a562      PCTVSNLVRWALVSRLPLALTATIWSWSX
                190       200
```

The following partial DNA sequence was identified in *N. gonorrhoeae* <SEQ ID 1665>:

```
g563.seq
   1  ATGAACAAAA CCCTCTATCG TGTGATTTTC AACCGCAAAC GCGGTGCTGT
  51  GGTAGCTGTT GCCGAAACCA CCAAGCGCGA AGGTAAAAGC TGTGCCGATA
 101  GTGGTTCGGG CAGCGTTTAT GTGAAATCCG TTTCTTTCAT TCCTACTCAT
 151  TCCAAAGCCT TTTGTTTTTC TGCATTAGGC TTTTCTTTAT GTTTGGCTTT
 201  GGGTACGGTC AATATTGCTT TTGCTGACGG CATTATTACT GATAAAGCTG
 251  CTCCTAAAAC CCAACAAGCC ACGATTCTGC AAACAGGTAA CGGCATACCG
 301  CAAGTCAATA TTCAAACCcc tACTTCGGCa ggGGTTTCTG TTAATCAATA
 351  TGCCCAGTTT GATGTGGGTA ATcgcGGGGC GATTTTAAAC AACAGTCGCA
 401  GCAACACCCA AACACAGCTA GGCGGTTGGA TTCAAGGCAA TCCTTGGTTG
 451  ACAAGGGGCG AAGCACGTGT GGTTGTAAAC CAAATCAACA GCAGCCATCC
 501  TTCACAACTG AATGGCTATA TTGAAGTGGG TGGACGACGT GCAGAAGTCG
 551  TTATTGCCAA TCCGGCAGGG ATTGCAGTCA ATGGTGGTGG TTTTATCAAT
 601  GCTTCCCGTG CCACTTTGAC GACAGGCCAA CCGCAATATC AAGCAGGAGA
 651  CTTTAGCGGC TTTAAGATAA GGCAAGGCAA TGCTGTAATC GCCGGACACG
 701  GTTTGGATGC CCGTGATACC GATTTCACAC GTATTCTTTT GTATGCCAAC
 751  AAAATCACCT TGATCAGTAC GGCCGAACAA GCAGGCATTC GTAATCAAGG
 801  GCAGTTGTTT GCTTCTTCCG GTAATGTGGC GATTGATGCA AATGGCCGTT
 851  TGGTCAATAG TGGCACGATG GCTGCCGCCA ATGTGCAAGA TATGAATAAT
 901  ACAGCGGAAC ACAAAGTCAA TATCCGCAGT CAAGCCTTTG AAAACAGCGG
 951  TACGGCGGTA TCGCAACAAG GCACTCAAAT TCACAGTCAA TCGATTCAAA
1001  ACACTGGCAA ATTATTGTCG GCAGGAACAG AGGATTTAGC CGTTTCAGGC
1051  AGCCTGAACA ATCAAAATGG CGAAATAGCG ACCAATCAAC AACTGATTAT
1101  TCACGATGGT CAGCAATCTA CCGTTGTCAT TGATAATACG AATGGCACGA
1151  TACAATCAGG CCGTGATGTT GCCATTCAGG CAAAATCGTT ATCCAACAAC
1201  GGCACACTTG CCGCTGATAA TAAACTGGAT ATTGCGTTAC AAGATGATTT
```

-continued

```
1251  TTATGTAGAA CGCAAGATCG TGGCGGGCAA TGAATTGTCG CTCAGTACAC

1301  GAGGCAGCCT GAAAAATTCA CATACCTTGC AAGCAGGAAA ACGCATTCGG

1351  ATTAAAGCAA ATAACCTTGA TAATGCAGTA CAAGGCAACA TTCAATCCGG

1401  CGGTACGACA GACATTGGCA CGCAGCACAA TTTAACCAAT AGAGGCTTGA

1451  TTGACGGACA ACAAACCAAA ATCCAAGCCG GCAAATGAA TAATATCGGT

1501  ACAGGTCGGA TTTATGGCGA CAATATCGCT ATTGCGGCTA CCCGCTTAGA

1551  CAATCAAGAT GAAAACGGTA CAGGTGCCGC CATTGCGGCA CGCGAAAACC

1601  TGAATTTAGG CATTGAACAA TTAAATAACC GTGAAAACAG TCTGATTTAC

1651  AGCGGTAACG ATATGGCGGT TGGCGGCGCA TTAGATACCA ATGACCAAGC

1701  CACAGGCAAA GCCCAAAGGA TACACAATGC CGGCGCAATC ATTGAAGCTG

1751  CAGGCAAAAT GCGTTTAGGT GTAGAAAAGC TGCACAATAC CAATGAGCAT

1801  TTGAAAACGC AGTTGGTAGA ACAGGGCGC GAGCGTATTG TTGATTACGA

1851  AGCATTTGGA CGACACGAAT TATTGCGAGA AGGCACGCAA CATGAATTAG

1901  GCTGGTTTGT CTACAACAAT GAATCAGACC ACTTACGCAC CCCTGATGGA

1951  GTGGCGCATG AAAATTGGCA TAAATACGAT TATGAAAAAG TAACGCAAGA

2001  AACTCAAGTA ACCGGAACTG CGCCTGCTAA ATCATTGCA GGTAGCGATT

2051  TGATTATTGA TAGCAAAGCA GTCTTCAACA GCGACAGCCG AATCATTGCC

2101  GGCGGCCAAT TGCTTGTGCA AACAGAAAAA GACGGTTTGC ATAACGAGCA

2151  AACCTTTGGC GAGAAGAAAG TCTTCAGCGA AAATGGTAAG TTGCACAACT

2201  ACTGGCGTGC GCGTCGTAAA GGACATGATG AAACAGGGCA TCGTGAACAA

2251  AATTATACTT TGCCGGAGGA ATCACACGC GACATTTCAC TGGGTTCATT

2301  TGCCTATGAA TCGCATAGCA AAGCATTAAG CCGTCATGCG CCCAGCCAAG

2351  GCACTGAGTT GCCACAAAGT AACCGGGATA ATATCCGTAC TGCGAAAAGC

2401  AACGGTATTT CGCTACCCTA TACGCCCAAT TCTTTTACCC CATTACCCGG

2451  CAGCAGCTTA TACATTATCA ATCCTGCCAA TAAAGGCTAT CTTGTTGAAA

2501  CCGATCCACG CTTTGCCAAC TACCGTCAAT GGTTGGGTAG TGACTATATG

2551  CTGGGCAGCC TCAAACTAGA CCCAAACAAT TTACATAAAC GTTTGGGTGA

2601  TGGTTATTAC GAGCAACGTT TAATCAATGA ACAAATCGCA GAGCTGACAG

2651  GGCATCGTCG TTTAGACGGT TATCAAAACG ACGAAGAACA ATTTAAAGCC

2701  TTAATGGATA ATGGCGCGAC TGCGGCACGT TCGATGAATC TCAGCGTTGG

2751  CATTGCATTA AGTGCCGAGC AAGCAGCGCA ACTGACCAGC GATATTGTTT

2801  GGTTGGTACA AAAAGAAGTT AAACTTCCTG ATGGCGGCAC ACAAACCGTA

2851  TTGATGCCAC AGGTTTATGT ACGCGTTAAA AATGGCGGCA TAGACGGTAA

2901  AGGTGCATTG TTGTCAGGCA GCAATACACA AATCAATGTT TCAGGCAGCC

2951  TGAAAAACTC AGGCACGATT GCAGGGCGCA ATGCGCTTAT TATCAATACC

3001  GATACGCTAG ACAATATCGG TGGGCGTATT CATGCGCAAA AATCAGCGGT

3051  TACGGCCACA CAAGACATCA ATAATATTGG CGGCATTCTT TCTGCCGAAC

3101  AGACATTATT GCTCAATGCG GGTAACAACA TCAACAACCA AAGCACGGCC

3151  AAGAGCAGTC AAAATGCACA AGGTAGCAGC ACCTACCTAG ACCGAATGGC

3201  AGGTATTTAT ATCACAGGCA AAGAAAAAGG TGTTTTAGCA GCGCAGGCAG

3251  GCAAAGACAT CAACATCATT GCCGGTCAAA TCAGCAATCA ATCAGATCAA
```

-continued

```
3301  GGGCAAACCC GGCTGCAGGC AGGACGCGAC ATTAACCTGG ATACGGTACA
3351  AACCGGCAAA TATCAAGAAA TCCATTTTGA TGCCGATAAC CATACCATCC
3401  GAGGTTCAAC GAACGAAGTC GGCAGCAGCA TTCAAACAAA AGGCGATGTT
3451  ACCCtatTGT CAGGGAATAA TCTCAATGCC AAAGCTGCCG AAGTCGGCAG
3501  CGCAAAAGGC ACACTTGCCG TGTATGCTAA AAATGACATT ACTATCAGCT
3551  CAGGCATCCA TGCCGGCCAA GTTGATGATG CGTCCAAACA TACAGGCAGA
3601  AGCGGCGGCG GTAATAAATT AGTCATTACC GATAAAGCCC AAAGTCATCA
3651  CGAAACTGCT CAAAGCAGCA CCTTTGAAGG CAAGCAAGTT GTATTGCAGG
3701  CAGGAAACGA TGCCAACATC CTTGGCAGTA ATGTTATTTC CGATAATGGC
3751  ACCCGGATTC AAGCAGGCAA TCATGTTCGC ATTGGTACAA CCCAAACTCA
3801  AAGCCAAAGC GAAACCTATC ATCAAACCCA AAAATCAGGA TTGATGAGTG
3851  CAGGTATCGG CTTCACTATT GGCAGCAAGA CAAACACACA AGAAAACCAA
3901  TCCCAAAGCA ACGAACATAC AGGCAGTACC GTAGGCAGCC TGAAAGGCGA
3951  TACCACCATT GTTGCAAGCA ACACTACGA ACAAACCGGC AGCAACGTTT
4001  CCAGCCCTGA GGGCAACAAC CTTATCAGCA CGCAAAGTAT GGATATTGGC
4051  GCAGCACAAA ACCAATTAAA CAGCAAAACC ACCCAAACCT ACGAACAAAA
4101  AGGCTTAACG GTGGGCATTC AGTTCGCCCG TTACCGATTT GGCACAACAA
4151  GCGATTGCCG TAGCACACAA AGCAGCAAAC AAGTCGGACA AGCAAAAAC
4201  GACCGCGTTA ATGCCATGGC GGCTGCCAAT GCAGGTTGGC AGGCCTATCA
4251  AACAGGCAAA GGCGCACAAA ACTTAGCCAA TGGTACAACC AATGCCAAAC
4301  AAGTCAGCAT CTCCATAACC TACGGCGAAC AGCAAAACCG ACAAACCACC
4351  CAAGTTCAAG CCAATCAAGC CCAAGCGAGT CAAATTCAAG CAGGCGGCAA
4401  AACTACCCTT TATTGCCGAA GGTGCGGCGA CAATCCAAT ATCAACATCA
4451  CAGGCTCAGG TGTTTCAGGC AGAGCAGGAA CCGGCCTGAT TGCCGATAAG
4501  CAAATCCATC TGCAATCAGC CGAGCAAAGC AATACCGAAC GCAGCCAAAA
4551  CAAATCAGCA GGCTGGAACG CAGGTGCTGC CGTATCATTC GGACAAGGAG
4601  GCTGGTCATT AGGCGTTGCC GCAGGCGGCA ATGTCGGCAA AGGCTACGGC
4651  TATGGCGATA GCGTAACCCA CCGCCATAGC CATATTGGCG ACAAAGGCAG
4701  CCAAACCCTT ATCCAAAGTG GTGGCGATAC CATCATCAAA GGCGCGCAAG
4751  TACGCGGCAA AGGCGTACAA GTCAATGCCA AAAACCTAAG CATTCAAAGT
4801  GTACAAGATA GAGAAACTTA TCAAAGCAAA CAACAAAACG CCGGTGCACA
4851  AGTTACCGTA GGTTATGGCT TCAGTGCCAG TGGCGATTAC AGCCAAAGCA
4901  AAATCCGAGC CGACCATGCT TCGGTAACCG AGCAAAGCGG TATTTATGCC
4951  GGAGAAGACG GCTATCAAAT CAAGGTCGGA AACCATACAG GCCTCAAAGG
5001  CGGCATCATC ACCAGCAGCC AAAGCGCAAA AGACAAGGGT AAAAACCGAT
5051  TCAGCACAGG CACACTCGCC GGCAGTGATA TTCAAAATTA CAGCCAATAC
5101  GAAGGAAAAA GTTTTGGATT GGGTGCCAGC GTTGCCGTAA GCGGCAAAAC
5151  ACTGGGACAG GGCGCAAAAA ATAAACCTCA AGACAAACAC CTGACAAGCA
5201  TAGCCGATAA AAACGGCGCA AGTTCATCAG TAGGGTACGG CAGCGACAGC
5251  GACAGTCAAA GCAGCATCAC AAAAAGCGGC ATCAATACCC CCAAAAACAT
```

```
5301  TCAAATCACA GACGAAGCCG CACAAATCAG GCTGACAGGC AAAATAGCGG

5351  CACAAACCAA AGCCGATATT GATACAAACG TAACCACAGA CACCGCCGAA

5401  CGACATTCGG GCAGCCTGAA AAACATATTT GACAAAGATA GAGTGCAAAG

5451  TGAACTGGAT TTACAAAgaA CCGTCAGCCA AGATTTTAGT AAAAATGTTC

5501  AACAAACCAA TACCGAGATT AACCAACATT TAGACAAACT CAAAGCAGAC

5551  AAAGAAGCAG CCGAAACAGC AGCAGCCGAG GCATTAGCCA ATGGCGATAT

5601  GGAAACTGCC AAACGCAAAG CCCATGAAGC TCAAGATGCG GCAGCAAAAG

5651  CAGATAATTG GCAACAAGGC AAAGTCATTC TCAACATGTT AGCCTCAGGT

5701  TTAGCTGAGC CGACCCAAAG CGGAGCgggc ATCGCTGCGG CTACCGCATC

5751  GCCagaCGTA TCGTATGCGA TTGGACAGCA CTTTAAagaT TTAGCCGGTC

5801  AAAACGCGAA TGGCAAACTA ACCGCCAGTC AagaAACCGC TCACGTTCTT

5851  GCCCACGCGG TATTAGGAGC AGCGGTTGCC GCAGCATGAG GCAACAATGC

5901  CCCGGCAGGA GCATTGGGTG CGGGCGGGTc ggAagcggCC GCCCCAATCA

5951  TCGGCAAATG GCTGTACGGC AAAGGAGAcg gcggcagccT GAATgcggag 6001  gaaaAAGaga CCGTTTCGGC GATTACAAGG ATGCTGggta cGgctGCCGG 6051  AGCAGCTGAG GGAAACTCGT CCGCCGATGC TGTGTGGGGT TGTTTTcaaa 6101  cggctTCaga TTTCGCTTCC TCTTTTTCAT ATCCTATAAA CATGTGA
```

This corresponds to the amino acid sequence <SEQ ID 1666; ORF 563.ng>:

```
g563.pep..
     1    MNKTLYRVIF NRKRGAVVAV AETTKREGKS CADSGSGSVY VKSVSFIPTH

51    SKAFCFSALG FSLCLALGTV NIAFADGIIT DKAAPKTQQA TILQTGNGIP

101    QVNIQTPTSA GVSVNQYAQF DVGNRGAILN NSRSNTQTQL GGWIQGNPWL

151    TRGEARVVVN QINSSHPSQL NGYIEVGGRR AEVVIANPAG IAVNGGGFIN

201    ASRATLTTGQ PQYQAGDFSG FKIRQGNAVI AGHGLDARDT DFTRILLYAN

251    KITLISTAEQ AGIRNQGQLF ASSGNVAIDA NGRLVNSGTM AAANVQDMNN

301    TAEHKVNIRS QAFENSGTAV SQQGTQIHSQ SIQNTGKLLS AGTEDLAVSG

351    SLNNQNGEIA TNQQLIIHDG QQSTVVIDNT NGTIQSGRDV AIQAKSLSNN

401    GTLAADNKLD IALQDDFYVE RKIVAGNELS LSTRGSLKNS HTLQAGKRIR

451    IKANNLDNAV QGNIQSGGTT DIGTQHNLTN RGLIDGQQTK IQAGQMNNIG

501    TGRIYGDNIA IAATRLDNQD ENGTGAAIAA RENLNLGIEQ LNNRENSLIY

551    SGNDMAVGGA LDTNDQATGK AQRIHNAGAI IEAAGKMRLG VEKLHNTNEH

601    LKTQLVETGR ERIVDYEAFG RHELLREGTQ HELGWFVYNN ESDHLRTPDG

651    VAHENWHKYD YEKVTQETQV TGTAPAKIIA GSDLIIDSKA VFNSDSRIIA

701    GGQLLVQTEK DGLHNEQTFG EKKVFSENGK LHNYWRARRK GHDETGHREQ

751    NYTLPEEITR DISLGSFAYE SHSKALSRHA PSQGTELPQS NRDNIRTAKS

801    NGISLPYTPN SFTPLPGSSL YIINPANKGY LVETDPRFAN YRQWLGSDYM

851    LGSLKLDPNN LHKRLGDGYY EQRLINEQIA ELTGHRRLDG YQNDEEQFKA

901    LMDNGATAAR SMNLSVGIAL SAEQAAQLTS DIVWLVQKEV KLPDGGTQTV

951    LMPQVYVRVK NGGIDGKGAL LSGSNTQINV SGSLKNSGTI AGRNALIINT
```

-continued

```
1001  DTLDNIGGRI HAQKSAVTAT QDINNIGGIL SAEQTLLLNA GNNINNQSTA
1051  KSSQNAQGSS TYLDRMAGIY ITGKEKGVLA AQAGKDINII AGQISNQSDQ
1101  GQTRLQAGRD INLDTVQTGK YQEIHFDADN HTIRGSTNEV GSSIQTKGDV
1151  TLLSGNNLNA KAAEVGSAKG TLAVYAKNDI TISSGIHAGQ VDDASKHTGR
1201  SGGGNKLVIT DKAQSHHETA QSSTFEGKQV VLQAGNDANI LGSNVISDNG
1251  TRIQAGNHVR IGTTQTQSQS ETYHQTQKSG LMSAGIGFTI GSKTNTQENQ
1301  SQSNEHTGST VGSLKGDTTI VASKHYEQTG SNVSSPEGNN LISTQSMDIG
1351  AAQNQLNSKT TQTYEQKGLT VGIQFARYRF GTTSDCRSTQ SSKQVGQSKN
1401  DRVNAMAAAN AGWQAYQTGK GAQNLANGTT NAKQVSISIT YGEQQNRQTT
1451  QVQANQAQAS QIQAGGKTTL YCRRCGEQSN INITGSGVSG RAGTGLIADK
1501  QIHLQSAEQS NTERSQNKSA GWNAGAAVSF GQGGWSLGVA AGGNVGKGYG
1551  YGDSVTHRHS HIGDKGSQTL IQSGGDTIIK GAQVRGKGVQ VNAKNLSIQS
1601  VQDRETYQSK QQNAGAQVTV GYGFSASGDY SQSKIRADHA SVTEQSGIYA
1651  GEDGYQIKVG NHTGLKGGII TSSQSAKDKG KNRFSTGTLA GSDIQNYSQY
1701  EGKSFGLGAS VAVSGKTLGQ GAKNKPQDKH LTSIADKNGA SSSVGYGSDS
1751  DSQSSITKSG INTPKNIQIT DEAAQIRLTG KIAAQTKADI DTNVTTDTAE
1801  RHSGSLKNIF DKDRVQSELD LQRTVSQDFS KNVQQTNTEI NQHLDKLKAD
1851  KEAAETAAAE ALANGDMETA KRKAHEAQDA AAKADNWQQG KVILNMLASG
1901  LAEPTQSGAG IAAATASPDV SYAIGQHFKD LAGQNANGKL TASQETAHVL
1951  AHAVLGAAVA AAXGNNAPAG ALGAGGSEAA APIIGKWLYG KGDGGSLNAE
2001  EKETVSAITR MLGTAAGAAE GNSSADAVWG CFQTASDFAS SFSYPINM*
```

The following partial DNA sequence was identified in *N. meningitidis* <SEQ ID 1667>:

```
m563.seq..
   1  ATGAATAAAA CTCTCTATCG TGTAATTTTC AACCGCAAAC GTGGGGCTGT
  51  GGTAGCCGTT GCTGAAACTA CCAAGCGCGA AGGTAAAAGC TGTGCCGATA
 101  GTGATTCAGG CAGCGCTCAT GTGAAATCTG TTCCTTTTGG TACTACTCAT
 151  GCACCTGTTT GTCGTTCAAA TATCTTTTCT TTTTCTTTAT TGGGCTTTTC
 201  TTTATGTTTG GCTGTAGGTA CGGCCAATAT TGCTTTTGCT GATGGCATTA
 251  TTGCTGATAA AGCTGCTCCT AAAACTCAAC AAGCCACGAT TCTGCAAACA
 301  GGTAACGGCA TACCGCAAGT CAATATTCAA ACCCCTACTT CGGCAGGGGT
 351  TTCTGTTAAT CAATACGCCC AGTTTGATGT GGGTAATCGC GGGGCGATTT
 401  TAAACAACAG CCGCAGCAAC ACCCAAACAC AGCTAGGCGG TTGGATTCAA
 451  GGTAATCCTT GGTTGGCAAG GGGCGAAGCA CGTGTGGTTG TAAACCAAAT
 501  CAACAGCAGC CATTCTTCAC AAATGAATGG CTATATTGAA GTGGGCGGAC
 551  GACGTGCAGA AGTCGTTATT GCCAATCCGG CAGGGATTGC AGTCAATGGT
 601  GGTGGTTTTA TCAATGCTTC CCGTGCCACT TTGACGACAG GCCAACCGCA
 651  ATATCAAGCA GGAGACCTTA GCGGCTTTAA GATAAGGCAA GGCAATGTTG
 701  TAATCGCCGG ACACGGTTTG GATGCCCGTG ATACCGATTT CACACGTATT
 751  CTCAGTTATC ATTCCAAAAT TGATGCACCC GTATGGGGAC AAGATGTTCG
```

-continued

```
 801   TGTCGTCGCG GGACAAAACG ATGTGGTCGC AACAGGTAAT GCACATTCGC

851   CTATTCTCAA TAATGCTGCT GCCAATACGT CAAACAATAC AGCCAACAAC

901   GGCACACATA TCCCTTTATT TGCGATTGAT ACAGGCAAAT TAGGAGGTAT

951   GTATGCCAAC AAAATCACCT TGATCAGTAC GGCCGAGCAA GCAGGCATTC

1001   GTAATCAAGG GCAGTTGTTT GCTTCTTCCG GTAATGTGGC GATTGATGCA

1051   AATGGCCGTT TAGTCAATAG TGGCACGATG GCTGCCGCCA ATGCGAAAGA

1101   TACGGATAAT ACAGCGGAAC ACAAAGTCAA TATCCGCAGT CAGGGCGTTG

1151   AAAACAGCGG TACGGCGGTA TCGCAACAAG GCACTCAAAT TCACAGTCAG

1201   TCGATTCAAA ACACTGGCAC ATTATTGTCC TCAGGCGAAA TATTGATTCA

1251   CAATTCGGGC AGCCTGAAAA ATGAAACATC AGGCACCATT GAAGCCGCTC

1301   GTTTGGCTAT TGATACCGAC ACACTTAATA ATCAAGGCAA ACTCTCTCAA

1351   ACAGGTTCAC AAAAACTCCA TATTGATGCA CAAGGCAAAA TGGATAACCG

1401   TGGCCGCATG GGTTTACAAG ATACCGCACC AACCGCGTCA AATGGTTCAA

1451   GCAATCAAAC CGGCAATAGT TACAATGCAT CTTTCCATTC ATCCACTACC

1501   ACACCAACAA CGGCAACAGG TACGGGTACT GCAACCGTTT CTATATCAAA

1551   CATAACTGCG CCTACCTTTG CTGATGGGAC AATTCGCACT CATGGTGCAC

1601   TGGATAATTC AGGCAGTATT ATTGCCAATG GTCAAACAGA TGTTAGTGCG

1651   CAACAAGGTT TAAATAATGC AGGACAAATA GACATTCATC AGTTAAATGC

1701   AAAAGGTTCG GCGTTTGACA ATCACAATGG AACAATTATC AGTGATGCGG

1751   TCCACATTCA AGCCGGCAGC CTGAATAATC AAAATGGCAA CATCACAACA

1801   CGCCAACAGT TAGAGATTGA AACCGATCAA CTGGATAACG CTCATGGCAA

1851   GTTATTATCA GCAGAAATAG CGGATTTAGC CGTTTCAGGC AGCCTGAACA

1901   ATCAAAATGG CGAAATAGCG ACCAATCAAC AACTGATTAT TCACGATGGT

1951   CAGCAATCTA CCGCTGTCAT TGATAATACG AATGGCACGA TACAATCAGG

2001   CCGTGATGTT GCTATTCAGG CAAATCGTT ATCCAACAAC GGCACACTTG

2051   CCGCTGATAA TAAACTGGAT ATTGCGTTAC AAGATGATTT TTATGTAGAA

2101   CGCAATATCG TGGCGGGCAA TGAATTGTCG CTCAGTACAC GAGGCAGCCT

2151   GAAAAATTCA CATACTTTGC AAGCAGGAAA ACGCATTCGG ATTAAAGCAA

2201   ATAACCTTGA TAATGCAGCA CAAGGCAACA TTCAATCCGG CGGTACGACA

2251   GACATTGGCA CGCAGCACAA TTTAACCAAT AGAGGCTTGA TTGACGGACA

2301   ACAAACCAAA ATCCAAGCCG GCAAATGAA TAATATCGGT ACAGGTCGGA

2351   TTTATGGCGA CAATATCGCT ATTGCGGCTA CCCGCTTAGA CAATCAAGAT

2401   GAAAACGGTA CAGGTGCCGC CATTGCGGCA CGTGAAAACC TGAATTTAGG

2451   CATCGGACAA TTAAACAACC GTGAAAACAG TCTGATTTAC AGCGGTAACG

2501   ATATGGCGGT TGGCGGCGCA TTAGATACCA ATGGCCAAGC CACAGGCAAA

2551   GCCCAAAGGA TACACAATGC CGGCGCAACC ATTGAAGCTG CAGGCAAAAT

2601   GCGTTTAGGT GTAGAAAAGC TGCACAATAC CAATGAGCAT TTGAAAACGC

2651   AGTTGGTAGA ACAGGGCGC GAGCATATTG TTGATTACGA AGCATTTGGA

2701   CGACACGAAT TATTGCGAGA AGGCACGCAA CATGAATTAG GCTGGTCTGT

2751   CTATAACGAT GAATCAGACC ACTTACGCAC CCCTGATGGA GCGGCGCATG

2801   AAAATTGGCA TAAATACGAT TATGAAAAAG TCACCCAAAA AACCCAAGTT
```

-continued

```
2851  ACCCAAACTG CGCCAGCCAA AATCATTTCA GGTAATGATT TAACCATTGA

2901  TGGTAAAGAA GTATTTAATA CCGATAGCCA AATCATTGCT GGTGGCAATC

2951  TCATTGTACA AACAGAAAAA GACGGTTTGC ATAACGAGCA AACCTTTGGC

3001  GAAAAGAAAG TATTCAGTGA AAATGGCAAA TTACACAGCT ATTGGCGTGA

3051  GAAACATAAA GGACGAGACT CAACGGGACA TAGCGAACAA AATTACACTT

3101  TGCCGGAGGA AATCACACGC AACATTTCAC TGGGTTCATT TGCCTATGAA

3151  TCGCATCGCA AAGCATTAAG CCATCATGCG CCCAGCCAAG GCACTGAGTT

3201  GCCGCAAAGC AACGGTATTT CGCTACCCTA TACGTCCAAT TCTTTTACCC

3251  CATTACCCAG CAGCAGCTTA TACATTATCA ATCCTGTCAA TAAAGGCTAT

3301  CTTGTTGAAA CCGATCCACG CTTTGCCAAC TACCGTCAAT GGTTGGGTAG

3351  TGACTATATG CTGGACAGCC TCAAACTAGA CCCAAACAAT TTACATAAAC

3401  GTTTGGGTGA TGGTTATTAC GAGCAACGTT TAATCAATGA ACAAATCGCA

3451  GAGCTGACAG GGCATCGTCG TTTAGACGGT TATCAAAACG ACGAAGAACA

3501  ATTTAAAGCC TTAATGGATA ATGGCGCGAC TGCGGCACGT TCGATGAATC

3551  TCAGCGTTGG CATTGCATTA AGTGCCGAGC AAGTAGCGCA ACTGACCAGC

3601  GATATTGTTT GGTTGGTACA AAAAGAAGTT AAGCTTCCTG ATGCGGCAC

3651  ACAAACCGTA TTGGTGCCAC AGGTTTATGT ACGCGTTAAA AATGGCGACA

3701  TAGACGGTAA AGGTGCATTG TTGTCAGGCA GCAATACACA AATCAATGTT

3751  TCAGGCAGCC TGAAAAACTC AGGCACGATT GCAGGGCGCA ATGCGCTTAT

3801  TATCAATACC GATACGCTAG ACAATATCGG TGGGCGTATT CATGCGCAAA

3851  AATCAGCGGT TACGGCCACA CAAGACATCA ATAATATTGG CGGCATGCTT

3901  TCTGCCGAAC AGACATTATT GCTCAACGCA GGCAACAACA TCAACAGCCA

3951  AAGCACCACC GCCAGCAGTC AAAATACACA AGGCAGCAGC ACCTACCTAG

4001  ACCGAATGGC AGGTATTTAT ATCACAGGCA AGAAAAAGG TGTTTTAGCA

4051  GCGCAGGCAG GAAAAGACAT CAACATCATT GCCGGTCAAA TCAGCAATCA

4101  ATCAGAGCAA GGGCAAACCC GGCTGCAAGC AGGGCGCGAC ATTAACCTAG

4151  ATACGGTACA AACCAGCAAA CATCAAGCAA CCCATTTTGA TGCCGATAAC

4201  CATGTTATTC GCGGTTCAAC GAACGAAGTC GGCAGCAGCA TTCAAACAAA

4251  AGGCGATGTT ACCCTATTGT CAGGGAATAA CCTCAATGCC AAAGCTGCCG

4301  AAGTCAGCAG CGCAAACGGT ACACTCGCTG TGTCTGCCAA AAATGACATC

4351  AACATCAGCG CAGGCATCAA CACGACCCAT GTTGATGATG CGTCCAAACA

4401  CACAGGCAGA AGCGGTGGTG GCAATAAATT AGTCATTACC GATAAAGCCC

4451  AAAGTCATCA CGAAACCGCC CAAAGCAGCA CCTTTGAAGG CAAGCAAGTT

4501  GTATTGCAGG CAGGAAACGA TGCCAACATC CTTGGCAGCA ATGTTATTTC

4551  CGATAATGGC ACCCAGATTC AAGCAGGCAA TCATGTTCGC ATTGGTACAA

4601  CCCAAACTCA AAGCCAAAGC GAAACCTATC ATCAAACCCA GAAATCAGGA

4651  TTGATGAGTG CAGGTATCGG CTTCACTATT GGCAGCAAGA CAAACACACA

4701  AGAAAACCAA TCCCAAAGCA ACGAACATAC AGGCAGTACC GTAGGCAGCT

4751  TGAAAGGCGA TACCACCATT GTTGCAGGCA ACACTCGACA ACAAATCGGC

4801  AGTACCGTTT CCAGCCCGGA AGGCAACAAT ACCATCTATG CCCAAAGCAT
```

```
                    -continued
4851    AGACATTCAA GCGGCACACA ACAAATTAAA CAGTAATACC ACCCAAACCT
4901    ATGAACAAAA AGGCCTAACG GTGGCATTCA GTTCGCCCGT TACCGATTTG
4951    GCACAACAAG CGATTGCCGT AGCACAAAGC AGCAAACAAG TCGGACAAAG
5001    CAAAAACGAC CGCGTTAATG CCATGGCGGC TGCCAATGCA GGCTGGCAAG
5051    CCTATCAAAC AGGTAAGAGT GCACAAAACT TAGCCAATGG TACAACCAAT
5101    GCCAAACAAG TCAGCATCTC CATAACCTAC GGCGAACAGC AAAACCGACA
5151    AACCACCCAA GTTCAAGCCA ATCAAGCCCA AGCGAGTCAA ATTCAAGCAG
5201    GTGGTAAAAC CACATTAATC GCCACAGGCG CAGCAGAACA ATCCAATATC
5251    AACATCGCAG GCTCAGATGT TGCCGGCAAA GCAGGCACAA TCCTGATTGC
5301    CGATAACGAC ATCACACTCC AATCAGCCGA GCAAAGCAAT ACCGAACGCG
5351    GCCAAAACAA ATCGGCAGGC TGGAACGCAG GTGCTGCCGT ATCATTCGGA
5401    CAAGGAGGCT GGTCATTAGG CGTTACCGCA GGCGGCAATG TCGGCAAAGG
5451    CTACGGCAAT GGCGACAGCA TCACCCACCG CCATAGCCAT ATCGGCGACA
5501    AAGGCAGCCA AACCCTTATC CAAAGCGGTG GCGACACTAC CATCAAAGGC
5551    GCGCAAGTAC GCGGCAAAGG CGTACAAGTC AATGCCAAAA ACCTAAGTAT
5601    TCAAAGCGTA CAAGATAGAG AAACCTATCA AGCAAACAA CAAAACGCCA
5651    GTGCACAAGT TACCGTAGGT TATGGCTTCA GTGCCGGTGG CGATTACAGC
5701    CAAAGCAAAA TCCGAGCCGA CCATGTTTCA GTAACCGAGC AAAGCGGTAT
5751    TTATGCCGGA GAAGACGGCT ATCAAATCAA GGTCGGAAAC CATACAGACC
5801    TCAAAGGCGG CATCATCACC AGTACCCAAA GCGCAGAAGA CAAGGGTAAA
5851    AACCGCTTTC AGACGGCCAC CCTCACCCAT AGCGACATCA AAAACCACAG
5901    CCAATACAAA GGCGAAAGTT TTGGATTGGG CGCAAGTGCG TCCATAAGCG
5951    GCAAAACACT GGGACAGGGC GCACAAAATA AACCTCAAAA CAAACACCTG
6001    ACAAGCGTAG CCGATAAAAA CAGCGCAAGT TCATCAGTGG GTTATGGCAG
6051    CGACAGCGAC AGTCAAAGCA GCATCACAAA AAGCGGCATC AACACCCGCA
6101    ACATTCAAAT CACCGACGAA GCCGCACAAA TCCGGCTGAC AGGCAAAACA
6151    GCGGCACAAA CCAAAGCCGA TATTGATACA AACGTAACCA CAGACACCGC
6201    CGAACGACAT TCGGGCAGCT TGAAGAACAC CTTCAACAAA GAAGCGGTGC
6251    AAAGTGAACT GGATTTACAA AGAACCGTCA GCCAAGATTT TAGTAAAAAT
6301    GTTCAACAAG CCAATACCGA GATTAACCAA CATTTAGACA AACTCAAAGC
6351    AGACAAAGAA GCAGCCGAAA CAGCAGCAGC CGAGGCATTA GCCAATGGCG
6401    ATATGGAAAC TGCCAAACGC AAAGCCCATG AAGCTCAAGA TGCGGCAGCA
6451    AAAGCAGATA ATTGGCAACA AGGCAAAGTC ATTCTCAACA TGTTAGCCTC
6501    AGGTTTAGCT GCGCCGACCC AAAGCGGAGC GGGCATCGCT GCGGCTACCG
6551    CATCGCCAGC CGTATCGTAT GCGATTGGAC AGCACTTTAA AGATTTAGCC
6601    GGTCAAAACG CGAATGGTAA ACTAACCGCC AGTCAAGAAA CCGCACACGT
6651    TCTTGCCCAC GCGGTATTAG GAGCAGCGGT TGCCGCAGTA GGAGACAACA
6701    ATGCTCTAGC AGGAGCATTG AGTGCGGGCG GGTCGGAAGC GGCTGCGCCT
6751    TACATCAGCA AATGGTTATA CGGCAAAGAA AAAGGAAGCG ACTTAACGGC
6801    GGAAGAGAAA GAGACTGTAA CAGCGATTAC AAATGTATTG GGTACGGCTA
6851    CGGGTGCGGC AGTCGGCAAC AGCGCAACAG ATGCAGCGCA AGGCAGCCTG
```

-continued

```
6901  AATGCGCAAA GTGCGGTGGA GAATAATGAT ACTGTAGAGC AAGTGAAATT
6951  TGCTCTTAGG CACCCTAGAA TTGCTATTGC AATTGGATCT GTACATAAAG
7001  ATCCTGGCTC TACATTAGAG CCTAATATTT CAACAATTGC TTCAACTTTT
7051  CAATTAAATT TATTTCCTAA TAGTGAATTT GGTGGTGAAG GTGGAGTTGG
7101  CAATGCATTC AGGCACGTTT TATGGCAAGC AACCATCACA CGAGAATTTG
7151  GCAAAGATAT TGCTGTTAAA GTAGGAAATA GTCATGAAAG TGGGGAAAAA
7201  ATTAATTATT CTATAAGACG TAATCTTTCA TTAGATAAAG CAGATGAAAT
7251  GATTGATCAA CTAAATAACG AAATAGGAAG AGAAATAGCA TTAAATACCA
7301  ATAGGTTAAA CACAAAAGAG TTAGTTGGAT TAATTCTGGA AACTTATAAA
7351  AATAATGGTT TTTATCAAGC AGAAAGAAAC AGTAATGGAA ATTATGATGT
7401  TGTAAGAAAA AGATTATCTG AAAAAGATTA CCAGAATACA AGCAATATAT
7451  TGATTCACTT AGATAATACT GGTGCCGGAT TTAAAATTCA GCAGAGGAGA
7501  AAACAAATCA GAGCACAAAT TTCAGCCAGA CAATGGAGAA GATAA
```

This corresponds to the amino acid sequence <SEQ ID 1668; ORF 563>:

```
m563.pep..
   1  MNKTLYRVIF NRKRGAVVAV AETTKREGKS CADSDSGSAH VKSVPFGTTH
  51  APVCRSNIFS FSLLGFSLCL AVGTANIAFA DGIIADKAAP KTQQATILQT
 101  GNGIPQVNIQ TPTSAGVSVN QYAQFDVGNR GAILNNSRSN TQTQLGGWIQ
 151  GNPWLARGEA RVVVNQINSS HSSQMNGYIE VGGRRAEVVI ANPAGIAVNG
 201  GGFINASRAT LTTGQPQYQA GDLSGFKIRQ GNVVIAGHGL DARDTDFTRI
 251  LSYHSKIDAP VWGQDVRVVA GQNDVVATGN AHSPILNNAA ANTSNNTANN
 301  GTHIPLFAID TGKLGGMYAN KITLISTAEQ AGIRNQGQLF ASSGNVAIDA
 351  NGRLVNSGTM AAANAKDTDN TAEHKVNIRS QGVENSGTAV SQQGTQIHSQ
 401  SIQNTGTLLS SGEILIHNSG SLKNETSGTI EAARLAIDTD TLNNQGKLSQ
 451  TGSQKLHIDA QGKMDNRGRM GLQDTAPTAS NGSSNQTGNS YNASFHSSTT
 501  TPTTATGTGT ATVSISNITA PTFADGTIRT HGALDNSGSI IANGQTDVSA
 551  QQGLNNAGQI DIHQLNAKGS AFDNHNGTII SDAVHIQAGS LNNQNGNITT
 601  RQQLEIETDQ LDNAHGKLLS AEIADLAVSG SLNNQNGEIA TNQQLIIHDG
 651  QQSTAVIDNT NGTIQSGRDV AIQAKSLSNN GTLAADNKLD IALQDDFYVE
 701  RNIVAGNELS LSTRGSLKNS HTLQAGKRIR IKANNLDNAA QGNIQSGGTT
 751  DIGTQHNLTN RGLIDGQQTK IQAGQMNNIG TGRIYGDNIA IAATRLDNQD
 801  ENGTGAAIAA RENLNLGIGQ LNNRENSLIY SGNDMAVGGA LDTNGQATGK
 851  AQRIHNAGAT IEAAGKMRLG VEKLHNTNEH LKTQLVETGR EHIVDYEAFG
 901  RHELLREGTQ HELGWSVYND ESDHLRTPDG AAHENWHKYD YEKVTQKTQV
 951  TQTAPAKIIS GNDLTIDGKE VFNTDSQIIA GGNLIVQTEK DGLHNEQTFG
1001  EKKVFSENGK LHSYWREKHK GRDSTGHSEQ NYTLPEEITR NISLGSFAYE
1051  SHRKALSHHA PSQGTELPQS NGISLPYTSN SFTPLPSSSL YIINPVNKGY
1101  LVETDPRFAN YRQWLGSDYM LDSLKLDPNN LHKRLGDGYY EQRLINEQIA
1151  ELTGHRRLDG YQNDEEQFKA LMDNGATAAR SMNLSVGIAL SAEQVAQLTS
```

```
1201    DIVWLVQKEV KLPDGGTQTV LVPQVYVRVK NGDIDGKGAL LSGSNTQINV

1251    SGSLKNSGTI AGRNALIINT DTLDNIGGRI HAQKSAVTAT QDINNIGGML

1301    SAEQTLLLNA GNNINSQSTT ASSQNTQGSS TYLDRMAGIY ITGKEKGVLA

1351    AQAGKDINII AGQISNQSEQ GQTRLQAGRD INLDTVQTSK HQATHFDADN

1401    HVIRGSTNEV GSSIQTKGDV TLLSGNNLNA KAAEVSSANG TLAVSAKNDI

1451    NISAGINTTH VDDASKHTGR SGGGNKLVIT DKAQSHHETA QSSTFEGKQV

1501    VLQAGNDANI LGSNVISDNG TQIQAGNHVR IGTTQTQSQS ETYHQTQKSG

1551    LMSAGIGFTI GSKTNTQENQ SQSNEHTGST VGSLKGDTTI VAGKHYEQIG

1601    STVSSPEGNN TIYAQSIDIQ AAHNKLNSNT TQTYEQKGLT VAFSSPVTDL

1651    AQQAIAVAQS SKQVGQSKND RVNAMAAANA GWQAYQTGKS AQNLANGTTN

1701    AKQVSISITY GEQQNRQTTQ VQANQAQASQ IQAGGKTTLI ATGAAEQSNI

1751    NIAGSDVAGK AGTILIADND ITLQSAEQSN TERGQNKSAG WNAGAAVSFG

1801    QGGWSLGVTA GGNVGKGYGN GDSITHRHSH IGDKGSQTLI QSGGDTTIKG

1851    AQVRGKGVQV NAKNLSIQSV QDRETYQSKQ QNASAQVTVG YGFSAGGDYS

1901    QSKIRADHVS VTEQSGIYAG EDGYQIKVGN HTDLKGGIIT STQSAEDKGK

1951    NRFQTATLTH SDIKNHSQYK GESFGLGASA SISGKTLGQG AQNKPQNKHL

2001    TSVADKNSAS SSVGYGSDSD SQSSITKSGI NTRNIQITDE AAQIRLTGKT

2051    AAQTKADIDT NVTTDTAERH SGSLKNTFNK EAVQSELDLQ RTVSQDFSKN

2101    VQQANTEINQ HLDKLKADKE AAETAAAEAL ANGDMETAKR KAHEAQDAAA

2151    KADNWQQGKV ILNMLASGLA APTQSGAGIA AATASPAVSY AIGQHFKDLA

2201    GQNANGKLTA SQETAHVLAH AVLGAAVAAV GDNNALAGAL SAGGSEAAAP

2251    YISKWLYGKE KGSDLTAEEK ETVTAITNVL GTATGAAVGN SATDAAQGSL

2301    NAQSAVENND TVEQVKFALR HPRIAIAIGS VHKDPGSTLE PNISTIASTF

2351    QLNLFPNSEF GGEGGVGNAF RHVLWQATIT REFGKDIAVK VGNSHESGEK

2401    INYSIRRNLS LDKADEMIDQ LNNEIGREIA LNTNRLNTKE LVGLILETYK

2451    NNGFYQAERN SNGNYDVVRK RLSEKDYQNT SNILIHLDNT GAGFKIQQRR

2501    KQIRAQISAR QWRR*
```

Computer analysis of this amino acid sequence gave the following results:

Homology with a Predicted ORF from *N. gonorrhoeae*

ORF 563 shows 79.1% identity over a 2316 aa overlap with a predicted ORF (ORF 563.ng) from *N. gonorrhoeae*:

```
m563/g563
                  10         20         30         40         50
g563.pep  MNKTLYRVIFNRKRGAVVAVAETTKREGKSCADSGSGSVYVKSVSFIPTH-----SKAFC
          ||||||||||||||||||||||||||||||||||| |::||||  ||   ||    |: |
m563.pep  MNKTLYRVIFNRKRGAVVAVAETTKREGKSCADSDSGSAHVKSVPFGTTHAPVCRSNIFS
                  10         20         30         40         50         60

60         70         80         90        100        110
g563.pep  FSALGFSLCLALGTVNIAFADGIITDKAAPKTQQATILQTGNGIPQVNIQTPTSAGVSVN
          ||  ||||||||| ||:|||||||| |||||||||||||||||||||||||||||||||
m563.pep  FSLLGFSLCLAVGTANIAFADGIIADKAAPKTQQATILQTGNGIPQVNIQTPTSAGVSVN
                  70         80         90        100        110        120

120        130        140        150        160        170
g563.pep  QYAQFDVGNRGAILNNSRSNTQTQLGGWIQGNPWLTRGEARVVVNQINSSHPSQLNGYIE
          |||||||||||||||||||||||||||||||||||:||||||||||||||| ||:|||| 
m563.pe   QYAQFDVGNRGAILNNSRSNTQTQLGGWIQGNPWLARGEARVVVNQINSSHSSQMNGYIE
                 130        140        150        160        170        180
```

```
           180       190       200       210       220       230
g563.pep   VGGRRAEVVIANPAGIAVNGGGFINASRATLTTGQPQYQAGDFSGFKIRQGNAVIAGHGL
           |||||||||||||||||||||||||||||||||||||||:||||||||||:||||||||
m563.pe    VGGRRAEVVIANPAGIAVNGGGFINASRATLTTGQPQYQAGDLSGFKIRQGNVVIAGHGL
           190       200       210       220       230       240

240
g563.pep   DARDTDFTRIL-------------------------------------------------
           |||||||||||
m563.pe    DARDTDFTRILSYHSKIDAPVWGQDVRVVAGQNDVVATGNAHSPILNNAAANTSNNTANN
           250       260       270       280       290       300

250       260       270       280       290
g563.pep   ----------------LYANKITLISTAEQAGIRNQGQLFASSGNVAIDANGRLVNSGTM
                           :|||||||||||||||||||||||||||||||||||||||||||
m563.pep   GTHIPLFAIDTGKLGGMYANKITLISTAEQAGIRNQGQLFASSGNVAIDANGRLVNSGTM
           310       320       330       340       350       360

300       310       320       330       340
g563.pep   AAANVQDMNNTAEHKVNIRSQAFENSGTAVSQQGTQIHSQSIQNTGKLLSAGT-------
           ||||::|:|||||||||||||:||||||||||||||||||||||||   |||:|
m563.pe    AAANAKDTDNTAEHKVNIRSQGVENSGTAVSQQGTQIHSQSIQNTGTLLSSGEILIHNSG
           370       380       390       400       410       420 g563.pep   ------------------------------------------------------------
m563.pep   SLKNETSGTIEAARLAIDTDTLNNQGKLSQTGSQKLHIDAQGKMDNRGRMGLQDTAPTAS
           430       440       450       460       470       480 g563.pep   ------------------------------------------------------------
m563.pep   NGSSNQTGNSYNASFHSSTTTPTTATGTGTATVSISNITAPTFADGTIRTHGALDNSGSI
           490       500       510       520       530       540 g563.pep   ------------------------------------------------------------
m563.pep   IANGQTDVSAQQGLNNAGQIDIHQLNAKGSAFDNHNGTIISDAVHIQAGSLNNQNGNITT
           550       560       570       580       590       600

350       360       370       380
g563.pep   ---------------------EDLAVSGSLNNQNGEIATNQQLIIHDGQQSTVVIDNT
                                ||||||||||||||||||||||||||||||||:|||||
m563.pep   RQQLEIETDQLDNAHGKLLSAEIADLAVSGSLNNQNGEIATNQQLIIHDGQQSTAVIDNT
           610       620       630       640       650       660

390       400       410       420       430       440
g563.pep   NGTIQSGRDVAIQAKSLSNNGTLAADNKLDIALQDDFYVERKIVAGNELSLSTRGSLKNS
           ||||||||||||||||||||||||||||||||||||||||||:|||||||||||||||||
m563.pe    NGTIQSGRDVAIQAKSLSNNGTLAADNKLDIALQDDFYVERNIVAGNELSLSTRGSLKNS
           670       680       690       700       710       720

450       460       470       480       490       500
g563.pep   HTLQAGKRIRIKANNLDNAVQGNIQSGGTTDIGTQHNLTNRGLIDGQQTKIQAGQMNNIG
           ||||||||||||||||||||||||:|||||||||||||||||||||||||||||||||||
m563.pep   HTLQAGKRIRIKANNLDNAVQGNIQSGGTTDIGTQHNLTNRGLIDGQQTKIQAGQMNNIG
           730       740       750       770       770       780

510       520       530       540       550       560
g563.pep   TGRIYGDNIAIAATRLDNQDENGTGAAIAARENLNLGIEQLNNRENSLIYSGNDMAVGGA
           ||||||||||||||||||||||||||||||||||||||| ||||||||||||||||||||
m563.pep   TGRIYGDNIAIAATRLDNQDENGTGAAIAARENLNLGIGQLNNRENSLIYSGNDMAVGGA
           790       800       810       820       830       840

570       580       590       600       610       620
g563.pep   LDTNDQATGKAQRIHNAGAIIEAAGKMRLGVEKLHNTNEHLKTQLVETGRERIVDYEAFG
           ||||    ||||||||||||||||||||||||||||||||||||||||:|||||||||
m563.pep   LDTNGQATGKAQRIHNAGATIEAAGKMRLGVEKLHNTNEHLKTQLVETGREHIVDYEAFG
           850       860       870       880       890       900

630       640       650       660       670       680
g563.pep   RHELLREGTQHELGWFVYNNESDHLRTPDGVAHENWHKYDYEKVTQETQVTGTAPAKIIA
           ||||||||||||||| |||:||||||||||:|||||||||||||||:||||||||||||:
m563.pe    RHELLREGTQHELGWSVYNDESDHLRTPDGAAHENWHKYDYEKVTQKTQVTQTAPAKIIS
           910       920       930       940       950       960

690       700       710       720       730       740
g563.pep   GSDLIIDSKAVFNSDSRIIAGGQLLVQTEKDGLHNEQTFGEKKVFSENGKLHNYWRARRK
           |:|| ||:|  |||:||:|||||||:|||||||||||||||||||||||||||:  ::|
m563.pe    GNDLTIDGKEVFNTDSQIIAGGNLIVQTEKDGLHNEQTFGEKKVFSENGKLHSYWREKHK
           970       980       990       1000      1010      1020

750       770       770       780       790       800
g563.pep   GHDETGHREQNYTLPEEITRDISLGSFAYESHSKALSRHAPSQGTELPQSNRDNIRTAKS
           |:|  |||:|||||||||||:|||||||||||:||||:|||||||||||
m563.pep   GRDSTGHSEQNYTLPEEITRNISLGSFAYESHRKALSHHAPSQGTELPQSN---------
           1030      1040      1050      1060      1070

810       820       830       840       850       860
g563.pep   NGISLPYTPNSFTPLPGSSLYIINPANKGYLVETDPRFANYRQWLGSDYMLGSLKLDPNN
           ||||||| |||||||||:||||||||||:|||||||||||||||||||||| ||||||||
m563.pep   -GISLPYTSNSFTPLPSSSLYIINPVNKGYLVETDPRFANYRQWLGSDYMLDSLKLDPNN
           1080      1090      1100      1110      1120      1130
```

-continued

```
             870        880        890        900        910        920
g563.pep  LHKRLGDGYYEQRLINEQIAELTGHRRLDGYQNDEEQFKALMDNGATAARSMNLSVGIAL
          ||||||||||||||||||||||||||||||||||||||||||||||||||||||||||||
m563.pep  LHKRLGDGYYEQRLINEQIAELTGHRRLDGYQNDEEQFKALMDNGATAARSMNLSVGIAL
             1140       1150       1160       1170       1180       1190

930        940        950        960        970        980
g563.pep  SAEQAAQLTSDIVWLVQKEVKLPDGGTQTVLMPQVYVRVKNGGIDGKGALLSGSNTQINV
          ||||:|||||||||||||||||||||||||||:||||||||||:|||||||||||||||
m563.pep  SAEQVAQLTSDIVWLVQKEVKLPDGGTQTVLVPQVYVRVKNGDIDGKGALLSGSNTQINV
             1200       1210       1220       1230       1240       1250

990        1000       1010       1020       1030       1040
g563.pep  SGSLKNSGTIAGRNALIINTDTLDNIGGRIHAQKSAVTATQDINNIGGILSAEQTLLLNA
          ||||||||||||||||||||||||||||||||||||||||||||||||||:|||||||||
m563.pep  SGSLKNSGTIAGRNALIINTDTLDNIGGRIHAQKSAVTATQDINNIGGMLSAEQTLLLNA
             1260       1270       1280       1290       1300       1310

1050       1060       1070       1080       1090       1100
g563.pep  GNNINNQSTAKSSQNAQGSSTYLDRMAGIYITGKEKGVLAAQAGKDINIIAGQISNQSDQ
          ||||:|||:  ||||:  ||||||||||||||||||||||||||||||||||||||:|
m563.pep  GNNINSQSTTASSQNTQGSSTYLDRMAGIYITGKEKGVLAAQAGKDINIIAGQISNQSEQ
             1320       1330       1340       1350       1360       1370

1110       1120       1130       1140       1150       1160
g563.pep  GQTRLQAGRDINLDTVQTGKYQEIHFDADNHTIRGSTNEVGSSIQTKGDVTLLSGNNLNA
          ||||||||||||||||||||:|:|  ||||||||:||||||||||||||||||||||||
m563.pep  GQTRLQAGRDINLDTVQTSKHQATHFDADNHVIRGSTNEVGSSIQTKGDVTLLSGNNLNA
             1380       1390       1400       1410       1420       1430

1170       1180       1190       1200       1210       1220
g563.pep  KAAEVGSAKGTLAVYAKNDITISSGIHAGQVDDASKHTGRSGGGNKLVITDKAQSHHETA
          |||||:||:|||||:||||||:|:|:::  :|||||||||||||||||||||||||||||
m563.pe   KAAEVSSANGTLAVSAKNDINISAGINTTHVDDASKHTGRSGGGNKLVITDKAQSHHETA
             1440       1450       1460       1470       1480       1490

1230       1240       1250       1260       1270       1280
g563.pep  QSSTFEGKQVVLQAGNDANILGSNVISDNGTRIQAGNHVRIGTTQTQSQSETYHQTQKSG
          ||||||||||||||||||||||||||||||:|||||||||||||||||||||||||||||
m563.pep  QSSTFEGKQVVLQAGNDANILGSNVISDNGTQIQAGNHVRIGTTQTQSQSETYHQTQKSG
             1500       1510       1520       1530       1540       1550

1290       1300       1310       1320       1330       1340
g563.pep  LMSAGIGFTIGSKTNTQENQSQSNEHTGSTVGSLKGDTTIVASKHYEQTGSNVSSPEGNN
          ||||||||||||||||||||||||||||||||||||||||||:|||||:||  |||||||
m563.pe   LMSAGIGFTIGSKTNTQENQSQSNEHTGSTVGSLKGDTTIVAGKHYEQIGSTVSSPEGNN
             1560       1570       1580       1590       1600       1610

1350       1360       1370       1380       1390       1400
g563.pep  LISTQSMDIGAAQNQLNSKTTQTYEQKGLTVGIQPFARYRFGTTSDCRSTQSSKQVGQSKN
          | :||:|| ||:::|||:||||||||||||||:::      ::   :  :|||||||||
m563.pep  TIYAQSIDIQAAHNKLNSNTTQTYEQKGLTVAFSSPVTDLAQQA-IAVAQSSKQVGQSKN
             1620       1630       1640       1650       1660       1670

1410       1420       1430       1440       1450       1460
g563.pep  DRVNAMAAANAGWQAYQTGKGAQNLANGTTNAKQVSISITYGEQQNRQTTQVQANQAQAS
          ||||||||||||||||||||||:|||||||||||||||||||||||||||||||||||||
m563.pep  DRVNAMAAANAGWQAYQTGKSAQNLANGTTNAKQVSISITYGEQQNRQTTQVQANQAQAS
           1670       1680       1690       1700       1710       1720

1470       1480       1490       1500       1510       1520
g563.pep   QIQAGGKTTLYCRRCGEQSNINITGSGVSGRAGTGLIADKQIHLQSAEQSNTERSQNKSA
                     :|||||||||||  |:|:|||  ||||:|| |||||||||||||:||||
m563.pep   QIQAGGKTTLIATGAAEQSNINIAGSDVAGKAGTILIADNDITLQSAEQSNTERGQNKSA
            1730       1740       1750       1760       1770       1780

1530       1540       1550       1560       1570       1580
g563.pep   GWNAGAAVSFGQGGWSLGVAAGGNVGKGYGYGDSVTHRHSHIGDKGSQTLIQSGGDTIIK
           |||||||||||||||||||:||||||||||:|||:|||||||||||||||||||||:||
m563.pe    GWNAGAAVSFGQGGWSLGVTAGGNVGKGYGNGDSITHRHSHIGDKGSQTLIQSGGDTTIK
            1790       1800       1810       1820       1830       1840

1590       1600       1610       1620       1630       1640
g563.pep   GAQVRGKGVQVNAKNLSIQSVQDRETYQSKQQNAGAQVTVGYGFSASGDYSQSKIRADHA
           |||||||||||||||||||||||||||||||||:||||||||||||:|||||||||||:
m563.pe    GAQVRGKGVQVNAKNLSIQSVQDRETYQSKQQNASAQVTVGYGFSAGGDYSQSKIRADHV
            1850       1860       1870       1880       1890       1900

1650       1660       1670       1680       1690       1700
g563.pep   SVTEQSGIYAGEDGYQIKVGNHTGLKGGIITSSQSAKDKGKNRFSTGTLAGSDIQNYSQY
           |||||||||||||||||||||||:||||||||:||:|||||||:|:|: |||:|:||||
m563.pe    SVTEQSGIYAGEDGYQIKVGNHTDLKGGIITSTQSAEDKGKNRFQTATLTHSDIKNHSQY
            1910       1920       1930       1940       1950       1960

1710       1720       1730       1740       1750       1760
g563.pep   EGKSFGLGASVAVSGKTLGQGAKNKPQDKHLTSIADKNGASSSVGYGSDSDSQSSITKSG
           :|:|||||||:::||||||||||:|||:||||||:|||:|||||||||||||||||||||
m563.pe    KGESFGLGASASISGKTLGQGAQNKPQNKHLTSVADKNSASSSVGYGSDSDSQSSITKSG
            2030       2040       2050       2060       2070       2080
```

-continued

```
                   1830      1840      1840      1860      1870      1880
g563.pep   LQRTVSQDFSKNVQQTNTEINQHLDKLKADKEAAETAAAEALANGDMETAKRKAHEAQDA
           |||||||||||||||:||||||||||||||||||||||||||||||||||||||||||||
m563.pep   LQRTVSQDFSKNVQQANTEINQHLDKLKADKEAAETAAAEALANGDMETAKRKAHEAQDA
         2090      2100      2110      2120      2130      2140

1890      1900      1910      1920      1930      1940
g563.pep   AAKADNWQQGKVILNMLASGLAEPTQSGAGIAAATASPDVSYAIGQHFKDLAGQNANGKL
           |||||||||||||||||||||| ||||||||||||||| |||||||||||||||||||||
m563.pe    AAKADNWQQGKVILNMLASGLAAPTQSGAGIAAATASPAVSYAIGQHFKDLAGQNANGKL
         2150      2160      2170      2180      2190      2200

1950      1960      1970      1980      1990      2000
g563.pep   TASQETAHVLAHAVLGAAVAAAXGNNAPAGALGAGGSEAAAPIIGKWLYGKGDGGSLNAE
           |||||||||||||||||||||:  ||| ||||:||||||||| |:||||||  |::|:||
m563.pep   TASQETAHVLAHAVLGAAVAAVGDNNALAGALSAGGSEAAAPYISKWLYGKEKGSDLTAE
         2210      2220      2230      2240      2250      2260

2010      2020      2030      2040     2049
g563.pep   EKETVSAITRMLGTAAGAAEGNSSADAVWGCFQRASDFASSFSYPINMX
           |||||:||| :||||:||| |||::||: | ::: |
m563.pe    EKETVTAITNVLGTATGAAVGNSATDAAQGSLNAQSAVENNDTVEQVKFALRHPRIAIAI
         2270      2280      2290      2300      2310      2320 m563.pep    GSVHKDPGSTLEPNISTIASTFQLNLFPNSEFGGEGGVGNAFRHVLWQATITREFGKDIA
                    2330      2340      2350      2360      2370      2380
```

The following partial DNA sequence was identified in *N. meningitidis* <SEQ ID 1669>:

```
m564.seq
     1  ATGAACCGCA CCCTGTACAA AGTTGTATTT AACAAACATC GAAACTGCAT

51  GATAGCCGTT GCTGAAAATG CCAAACGCGA GGGCAAAAAC ACAGCCGACA

101  CCCAAGCTGT AGGTATTTTG CCAAATGATA TTGCGGGCTT TGCGGGTTTT

151  ATCCATTCTA TCTCTGTTAT CTCATTCTCC CTTTCATTAC TGCTCGGTTC

201  TGCCCTTATC CTGACTTCTT CTTCTGCTAC TGCCCAAGGT ATCGTTGCCG

251  ACAAATCCGC ACCTGCACAG CAACAGCCTA CCATCCTGCA AACAGGTAAC

301  GGCATACCGC AAGTCAATAT TCAAACCCCT ACTTCGGCAG GGGTTTCTGT

351  TAATCAATAC GCCCAGTTTG ATGTGGGTAA TCGCGGGGCG ATTTTAAACA

401  ACAGTCGCAG CAACACCCAA ACACAGCTAG GCGGTTGGAT TCAAGGCAAT

451  CCTTGGTTGG CAAGGGGCGA AGCACGTGTG GTTGTAAACC AAATCAACAG

501  CAGCCATTCT TCACAACTGA ATGGCTATAT TGAAGTGGGC GGACGACGTG

551  CAGAAGTCGT TATTGCCAAT CCGGCAGGGA TTGCAGTCAA TGGTGGTGGT

601  TTTATCAATG CTTCCCGTGC CACTTTGACG ACAGCCCAAC CGCAATATCA

651  AGCAGGAGAC CTTAGCGGCT TTAAGATAAG GCAAGGCAAT GTTGTAATCG

701  CCGGACACGG TTTGGATGCA CGTGATACCG ATTACACACG TATTCTCAGT

751  TATCATTCCA AAATTGATGC ACCCGTATGG GGACAAGATG TTCGTGTCGT

801  CGCGGGACAA AACGATGTGG CCGCAACAGG TGATGCACAT TCGCCTATTC

851  TCAATAATGC TGCTGCCAAT ACGTCAAACA ATACAGCCAA CAACGGCACA

901  CATATCCCTT TATTTGCGAT TGATACAGGC AAATTAGGAG GTATGTATGC

951  CAACAAAATC ACCTTGATCA GTACGGTCGA GCAAGCAGGC ATTCGTAATC

1001  AAGGGCAATG GTTTGCCTCA GCCGGCAATG TGGCAGTGAA TGCTGAGGGT

1051  AAACTGGTCA ACACGGGCAT GATTGCAGCG ACGGGAGAAA ATCATGCGGT

1101  TTCACTTCAT GCCGGCAATG TTCATAATAG CGGTACGGTT GCCTCACAGG

1151  ATGATGCCAA TATTCACAGC CAGACGCTGG ACAATTCAGG TACGGTCTTA

1201  TCCTCAGGTC GATTGACTGT TCGTAATTTA GGCCGTCTGA AAAACCAAAA
```

-continued

```
1251  CAACGGTACG ATCCAGGCTG CCCGCTTAGA TATGTCAACA GGTGGTTTGG

1301  ATAACACAGG TAATATTACT CAAACAGGTT CACAAGCATT GGATTTGGTA

1351  TCTGCCGGCA AATTCGATAA CAGTGGCAAG ATTGGTGTAA GTGACGTTCC

1401  ACAGACCGGT TTGAATCCCA ATCCATCAGT CATACCACAG ATTCCGAGTA

1451  CTGCAACAGG TTCAGGCAGC AGCACTGTCT CGGTATCTAA GCCTGGTTCA

1501  AACAATCCCG TTTCACCTAC AGCACCTGCA AAAACTACG CCGTAGGACG

1551  CATTCAAACA ACAGGAGCAT TTGACAATGC AGGATCAATT AATGCGGGTG

1601  GGCAAATTGA CATTGCCGCC CAAAACGGTT TGGGAAATTC GGGTAGTCTG

1651  AATGCGGCTA AACTACGAGT ATCAGGCGAT TCATTTAACA ATACGGTAAA

1701  AGGCAAACTC CAGGCACACG ATCTGGCTGT TAACACTCAA ACTGCTAAAA

1751  ACAGCGGTCA CTTATTAACT CAAACCGGCA AGATTGATAA CCGTGAACTG

1801  CATAATGCCG GAGAAATTGC CGCCAACAAT CTGACACTCA TTCATTCGGG

1851  CCGCTTGAGC AATGATAAAA AAGGCAATAT TCGAGCTGCA CATTTACAGC

1901  TTGATACCGC CGGTTTACAT AATGCAGGTA ACATTCTTGC CGATAGTGGA

1951  ACCGTTACCA CCAAGAATAA TCTTCGCAAT ACAGGAAAAG TTTCTGTTGC

2001  ACGACTGAAT ACCGAAGGTC AGACTCTAGA TAATACGCGC GGACGTATAG

2051  AGGCTGAAAC GGTTAACATC CAAAGTCAGC AACTGACTAA CCAAAGCGGC

2101  CATATTACTG CTACCGAACA ACTGACTATC AATAGTCGAA ATGTAGACAA

2151  CCAAAACGGC AAACTCCTAT CTGCAAACCA AGCACAATTA GCTGTTTCAG

2201  ACGGCCTATA CAACCAACAT GGTGAAATTG CCACCAACCG GCAGTTGTCT

2251  ATTCACGATA AAATCAAAA CACTTTGGCG TTAAACAATG CGGATGGCAC

2301  GATTCAATCT GCCGGTAATG TATCGCTACA AGCCAAATCA CTCGCCAACA

2351  ATGGCACATT AACAGCCGGT AACAAACTGG ATATTGCTTT GACGGACGAT

2401  TTCGTCGTAG AGCGCGACCT CACTGCAGGC AAACAATTAA ATCTAAGCAT

2451  AAAAGGCCGT CTGAAAAATA CCCATACCCT ACAAGCAGGC CATACGCTCA

2501  AACTCAATGC CGGCAATATA GATAACCAAG TTACAGGCAA AATTATTGGT

2551  GGAGAACAAA CGGACATCAC ATCCGAACAG CATGTTGACA ACAGGGGCTT

2601  GATCAACAGC GACGGTTTGA CCCACATCGG TGCAGGTCAA ACCCTGACCA

2651  ACACCGGGAC AGGCAAAATC TATGGCAACC ATATTGCCCT GGACGCGCAA

2701  ATACTGCTTA ACCGGGAAGA AACGACGGAA GGCAGTACCA AAGCGGGGC

2751  AATAGCTGCA AGGAAACGTT TGGATATTGG AGCGAAAGAG ATTCATAACC

2801  AAGAAGGTGC CCTACTATCC AGCGAAGGTA TTTTTGCCGT AgGTAATCGA

2851  CTGGATGAAC AACATCATGC GGCAGGCATG GCCGATACCT TTGTTAATGG

2901  CAGTGCCGGT TTGGAAGTAC AAGGTGATGC ATTGATGTCC GTTCGGAATA

2951  TGCAGAATAT CAATAATCAC TTTAAAACAG AGACATACTT AGCCAAAGCG

3001  GAAAAGCAAG TCCGCGACTA CACCGTACTG GGGCAAAATA CCTACTATCA

3051  GGCGGGAAAA GACGGTTTAT TCGACAACTC GCAAGGACAA AAAGACCAAA

3101  CTACTGCTAC GTTCCATTTA AAAAATGGTT CTCGTATTGA GGCCAACCAA

3151  TGGCATGTCC GAGACTACCA CATCGAGACT TATAAAGAAC GCATCATCGA

3201  AAACCGGCCG GCACACATTA CTGTGGGCGG TGATTTGACT GCCTCAGGTC

3251  AAAATTGGCT GAACAAAGAC AGCCGGATTG TAGTAGGCGG GCGTATTATC
```

```
3301  ACTGATGATT TAAACCAGAA AGAAATTACC AATCAAAGTA CAACAGGCAA
3351  AGGTCGCACA GATGCTGTCG GCACACAGTG GGATTCAGTT ACAAAAAAG
3401  GATGGTACAG CGGTAGAAAA AGACAACGCC GTACTGAAAG AAACCATACT
3451  CCTTACCATG ATACCCAACT ATTTACCCAC GACTTCGACA CGCCTGTATC
3501  CGTCATCCAA CAGAATGCCG CCTCCCCTTC CTTTCAACCC GCCGCATCTG
3551  CAATCAAACT GATTGACGGA GTATCCACGG CAGCCGTCAA TGGTCAGCGC
3601  ATCCATACCG GTAATGTGGT CTCGTTAAAT AACGCTACTG TTACTCTGCC
3651  TAACAGCAGC CTCTATACCA CCCATCCTGA CAATAAAGGC TGGTTGGTTG
3701  AAACCGATCC TCAATTTGCA GACTACCGCC GCTGGTTGGG CAGCGACTAC
3751  ATGTTGCAAC AACTGCAATT GGACACCAAT CATCTACACA AACGGCTTGG
3801  CGACGGCTAC TACGAACAAA AACTTGTTAA TGAACAAATC CATCAGTTAA
3851  CAGGCTACCG CCGACTCGAC GGCTACAGGA GTGATGAAGA CAATTCAAA
3901  GCTCTGATGG ACAACGGCCT TACTGCTGCC AAAACATTCG GTCTCACCCC
3951  AGGTATCGCC TTGAGTGCAG AGCAAGTTGC CCGCTTAACT TCAGATATCG
4001  TTTGGATGGA AAATCAAACC GTCACCCTGT CTGACGGTTC GACTCAAACC
4051  GTACTGGTTC CTAAAGTCTA TGCCCTGGCG CGCAAAGGTG ATCTCAATAC
4101  CTCCGGTGGC CTGATTAGTG CCGAACAAGT CTTACTTAAA CTGCAAAACG
4151  GCAACCTGAC TAACAGCGGT ACCATTGCGG GGCGACAGGC CGTACTCATC
4201  CAGGCACGGA ATATTAACAG CAACGGTAAC ATTCAAGCCG ACCAAATCGG
4251  CTTAAAAGCT GAAAAAGTA TCAATATCGA CGGCGGGCAG GTACAAGCAG
4301  GCAGACTGCT GACTGCCCAA GCGCAAAATA TCAACCTTAA CGGTACAACC
4351  CAAACTTCCG GTAATGAACG TAACGGCAAT ACCGCCATCG ATCGTATGGC
4401  CGGCATTAAC GTGGTCGGAA GCCATACTGA ACAAGTAGAT AACAGAACTT
4451  CAGACGGCAT CCTATCCCTG CATGCCAGCA ACGATATCAA CCTCAATGCG
4501  GCCACCGTCT CTAACCAAGT TAAAGACGGC ACTACCCAAA TTACCGCCGG
4551  CAATAATCTC AACCTCGGCA CCATCCGTAC CGAACATCGC GAAGCCTATG
4601  GTACATTAGA TGACGAGAAC CATCGCCATG TCCGCCAAAG TACCGAAGTC
4651  GGCAGCAGTA TCCGCACGCA AAACGGCGCA CTGCTTAGAG CCGGTAACGA
4701  CTTAAAAATC CGCCAAGGCG AACTGGAGGC CGAAGAAGGC AAAACCGTCC
4751  TTGCCGCAGG ACGTGATGTC ACTATCAGCG AAGGACGCCA ATAACCGAA
4801  CTGGATACCT CGGTAAGCGG AAAAAGCAAA GGCATCCTTT CCAGTACCAA
4851  AACACACGAC CGCTACCGCT TCAGTCATGA TGAAGCAGTC GGCAGCAACA
4901  TCGGCGGCGG CAAAATGATT GTTGCAGCCG GGCAGGATAT CAATGTACGC
4951  GGCAGCAACC TTATTTCTGA TAAGGGCATT GTTTTAAAAG CAGGACACGA
5001  CATCGATATT TCTACTGCCC ATAATCGCTA TACCGGCAAT GAATACCACG
5051  AGAGCAAAAA ATCAGGCGTC ATGGGTACTG GCGGATTGGG CTTTACTATC
5101  GGTAACCGGA AAACTACCGA TGACACTGAT CGTACCAATA TTGTCCATAC
5151  AGGCAGCATT ATAGGCAGCC TGAATGGAGA CACCGTTACA GTTGCAGGAA
5201  ACCGCTACCG ACAAACCGGC AGTACCGTCT CCAGCCCCGA GGGGCGCAAT
5251  ACCGTCACAG CCAAAAGCAT AGATGTAGAG TTCGCAAACA ACCGGTATGC
```

-continued

```
5301 CACTGACTAC GCCCATACCC AGGAACAAAA AGGCCTTACC GTCGCCCTCA

5351 ATGTCCCGGT TGTCCAAGCT GCACAAAACT TCATACAAGC AGCCCAAAAT

5401 GTGGGCAAAA GTAAAAATAA ACGCGTTAAT GCCATGGCTG CAGCCAATGC

5451 TGCATGGCAG AGTTATCAAG CAAACAACA AATGCAACAA TTTGCTCCAA

5501 GCAGCAGTGC GGGACAAGGT CAAACAACA ATCAAAGCCC AGTATCAGT

5551 GTGTCCATTA CCTACGGCGA ACAGAAAAGT CGTAACGAGC AAAAAAGACA

5601 TTACACCGAA GCGGCAGCAA GTCAAATTAT CGGCAAAGGG CAAACCACAC

5651 TTGCGGCAAC AGGAAGTGGG GAGCAGTCCA ATATCAATAT TACAGGTTCC

5701 GATGTCATCG GCCATGCAGG TACTGCCCTC ATTGCCGACA ACCATATCAG

5751 ACTCCAATCT GCCAAACAGG ACGGCAGCGA GCAAAGCAAA AACAAAAGCA

5801 GTGGTTGGAA TGCAGGCGTA GCCGTCAAAA TAGGCAACGG CATCAGGTTT

5851 GGAATTACCG CCGGAGGAAA TATCGGTAAA GGTAAAGAGC AAGGGGGAAG

5901 TACTACCCAC CGCCACACCC ATGTCGGCAG CACAACCGGC AAAACTACCA

5951 TCCGAAGCGG CGGGGATACC ACCCTCAAAG GTGTGCAGCT CATCGGCAAA

6001 GGCATACAGG CAGATACGCG CAACCTGCAT ATAGAAAGTG TTCAAGATAC

6051 TGAAACCTAT CAGAGCAAAC AGCAAAACGG CAATGTCCAA GTTACTGTCG

6101 GTTACGGATT CAGTGCAAGC GGCAGTTACC GCCAAAGCAA AGTCAAAGCA

6151 GACCATGCCT CCGTAACCGG GCAAAGCGGT ATTTATGCCG GAGAAGACGG

6201 CTATCAAATC AAAGTCAGAG ACAACACAGA CCTCAAGGGC GGTATCATCA

6251 CGTCTAGCCA AAGCGCAGAA GATAAGGGCA AAAACCTTTT TCAGACGGCC

6301 ACCCTTACTG CCAGCGACAT TCAAAACCAC AGCCGCTACG AAGGCAGAAG

6351 CTTCGGCATA GGCGGCAGTT TCGACCTGAA CGGCGGCTGG GACGGCACGG

6401 TTACCGACAA ACAAGGCAGG CCTACCGACA GGATAAGCCC GGCAGCCGGC

6451 TACGGCAGCG ACGGAGACAG CAAAAACAGC ACCACCCGCA GCGGCGTCAA

6501 CACCCACAAC ATACACATCA CCGACGAAGC GGGACAACTT GCCCGAACAG

6551 GCAGGACTGC AAAAGAAACC GAAGCGCGTA TCTACACCGG CATCGACACC

6601 GAAACTGCGG ATCAACACTC AGGCCATCTG AAAAACAGCT TCGACAAAGA

6651 CGCGGTCGCC AAAGAGATCA ACCTGCAAAG GGAAGTAACG AAGGAGTTCG

6701 GCAGAAACGC CGCCCAAGCC GTAGCGGCCG TTGCCGACAA ACTCGGCAAT

6751 ACCCAAAGTT ACGAACGGTA TCAGGAAGCC CGAACCCTGC TGGAGGCCGA

6801 ACTGCAAAAC ACGGACAGCG AAGCCGAAAA AGCCGCCTTC CGCGCATCCC

6851 TCGGCCAAGT AAACGCCTAT CTTGCCGAAA ACCAAAGCCG CTACGACACC

6901 TGGAAAGAAG GCGGCATAGG CAGGAGCATA CTGCACGGGG CGGCAGGCGG

6951 ACTGACGACC GGCAGCCTCG GCGGCATACT GGCCGGCGGC GGCACTTCCC

7001 TTGCCGCACC GTATTTGGAC AAAGCGGCGG AAAACCTCGG TCCGGCGGGC

7051 AAAGCGGCGG TCAACGCACT GGGCGGTGCG GCCATCGGCT ATGCAACTGG

7101 TGGTAGTGGT GGTGCTGTGG TGGGTGCGAA TGTAGATTGG AACAATAGGC

7151 AGCTGCATCC GAAAGAAATG GCGTTGGCCG ACAAATATGC CGAAGCCCTC

7201 AAGCGCGAAG TTGAAAAACG CGAAGGCAGA AAAATCAGCA GCCAAGAAGC

7251 GGCAATGAGA ATCCGCAGGC AGATACTGCG TTGGGTGGAC AAAGGTTCCC

7301 AAGACGGCTA TACCGACCAA AGCGTCATAT CCCTTATCGG AATGAAAGGC
```

-continued

```
7351 GAAGACAAAG CCTTGGGTTA TACTTGGGAC TACCGCGACT ACGGCGCAAG

7401 AAATCCGCAA ACCTACAACG ATCCGAAGCT GTTTGAGGAA TACCGCCGAC

7451 AGGACAAACC CGAATACCGC AACCTGACCT GGCTGCACAG CGGGACGAAA

7501 GACACCAAAA TCAGGCAGGG AGAGCGGAAA AACGAAGAGT TTGCACTGAA

7551 CGTTGCCGAA GGACTGACGA GCCTTGTCAA CCCCAATCCG AGGATAAAAG

7601 TCCCGATTCT TGCAGGCATC CGCAACCTGA AAACATCAA GCCGACAGTT

7651 ACCGGCAGCG ATCCCTTATT GGCGGGTGCG GGGAATATCC GTATCCCTGC

7701 AAACGGCAAT GTTGCGAAGG GGGACAGGAT TCCGGATACG GCATTGGCTA

7751 GCAAGGGAAT CAAACATAAA GATCGTAAAG ATCAACTGGA GAAAAAATAA
```

This corresponds to the amino acid sequence <SEQ ID 1670;
ORF 564>:

```
m564.pep
    1 MNRTLYKVVF NKHRNCMIAV AENAKREGKN TADTQAVGIL PNDIAGFAGF

51 IHSISVISFS LSLLLGSALI LTSSSATAQG IVADKSAPAQ QQPTILQTGN

101 GIPQVNIQTP TSAGVSVNQY AQFDVGNRGA ILNNSRSNTQ TQLGGWIQGN

151 PWLARGEARV VVNQINSSHS SQLNGYIEVG GRRAEVVIAN PAGIAVNGGG

201 FINASRATLT TAQPQYQAGD LSGFKIRQGN VVIAGHGLDA RDTDYTRILS

251 YHSKIDAPVW GQDVRVVAGQ NDVAATGDAH SPILNNAAAN TSNNTANNGT

301 HIPLFAIDTG KLGGMYANKI TLISTVEQAG IRNQGQWFAS AGNVAVNAEG

351 KLVNTGMIAA TGENHAVSLH ARNVHNSGTV ASQDDANIHS QTLDNSGTVL

401 SSGRLTVRNL GRLKNQNNGT IQAARLDMST GGLDNTGNIT QTGSQALDLV

451 SAGKFDNSGK IGVSDVPQTG LNPNPSVIPQ IPSTATGSGS STVSVSKPGS

501 NNPVSPTAPA KNYAVGRIQT TGAFDNAGSI NAGGQIDIAA QNGLGNSGSL

551 NAAKLRVSGD SFNNTVKGKL QAHDLAVNTQ TAKNSGHLLT QTGKIDNREL

601 HNAGEIAANN LTLIHSGRLS NDKKGNIRAA HLQLDTAGLH NAGNILADSG

651 TVTTKNNLRN TGKVSVARLN TEGQTLDNTR GRIEAETVNI QSQQLTNQSG

701 HITATEQLTI NSRNVDNQNG KLLSANQAQL AVSDGLYNQH GEIATNRQLS

751 IHDKNQNTLA LNNADGTIQS AGNVSLQAKS LANNGTLTAG NKLDIALTDD

801 FVVERDLTAG KQLNLSIKGR LKNTHTLQAG HTLKLNAGNI DNQVTGKIIG

851 GEQTDITSEQ HVDNRGLINS DGLTHIGAGQ TLTNTGTGKI YGNHIALDAQ

901 ILLNREETTE GSTKAGAIAA RKRLDIGAKE IHNQEGALLS SEGIFAVGNR

951 LDEQHHAAGM ADTFVNGSAG LEVQGDALMS VRNMQNINNH FKTETYLAKA

1001 EKQVRDYTVL GQNTYYQAGK DGLFDNSQGQ KDQTTATFHL KNGSRIEANQ

1051 WHVRDYHIET YKERIIENRP AHITVGGDLT ASGQNWLNKD SRIVVGGRII

1101 TDDLNQKEIT NQSTTGKGRT DAVGTQWDSV TKKGWYSGRK RQRRTERNHT

1151 PYHDTQLFTH DFDTPVSVIQ QNAASPSFQP AASAIKLIDG VSTAAVNGQR

1201 IHTGNVVSLN NATVTLPNSS LYTTHPDNKG WLVETDPQFA DYRRWLGSDY

1251 MLQQLQLDTN HLHKRLGDGY YEQKLVNEQI HQLTGYRRLD GYRSDEEQFK

1301 ALMDNGLTAA KTFGLTPGIA LSAEQVARLT SDIVWMENQT VTLSDGSTQT

1351 VLVPKVYALA RKGDLNTSGG LISAEQVLLK LQNGNLTNSG TIAGRQAVLI
```

-continued

```
1401  QARNINSNGN IQADQIGLKA EKSINIDGGQ VQAGRLLTAQ AQNINLNGTT

1451  QTSGNERNGN TAIDRMAGIN VVGSHTEQVD NRTSDGILSL HASNDINLNA

1501  ATVSNQVKDG TTQITAGNNL NLGTIRTEHR EAYGTLDDEN HRHVRQSTEV

1551  GSSIRTQNGA LLRAGNDLKI RQGELEAEEG KTVLAAGRDV TISEGRQITE

1601  LDTSVSGKSK GILSSTKTHD RYRFSHDEAV GSNIGGGKMI VAAGQDINVR

1651  GSNLISDKGI VLKAGHDIDI STAHNRYTGN EYHESKKSGV MGTGGLGFTI

1701  GNRKTTDDTD RTNIVHTGSI IGSLNGDTVT VAGNRYRQTG STVSSPEGRN

1751  TVTAKSIDVE FANNRYATDY AHTQEQKGLT VALNVPVVQA AQNFIQAAQN

1801  VGKSKNKRVN AMAAANAAWQ SYQATQQMQQ FAPSSSAGQG QNNNQSPSIS

1851  VSITYGEQKS RNEQKRHYTE AAASQIIGKG QTTLAATGSG EQSNINITGS

1901  DVIGHAGTAL IADNHIRLQS AKQDGSEQSK NKSSGWNAGV AVKIGNGIRF

1951  GITAGGNIGK GKEQGGSTTH RHTHVGSTTG KTTIRSGGDT TLKGVQLIGK

2001  GIQADTRNLH IESVQDTETY QSKQQNGNVQ VTVGYGFSAS GSYRQSKVKA

2051  DHASVTGQSG IYAGEDGYQI KVRDNTDLKG GIITSSQSAE DKGKNLFQTA

2101  TLTASDIQNH SRYEGRSFGI GGSFDLNGGW DGTVTDKQGR PTDRISPAAG

2151  YGSDGDSKNS TTRSGVNTHN IHITDEAGQL ARTGRTAKET EARIYTGIDT

2201  ETADQHSGHL KNSFDKDAVA KEINLQREVT KEFGRNAAQA VAAVADKLGN

2251  TQSYERYQEA RTLLEAELQN TDSEAEKAAF RASLGQVNAY LAENQSRYDT

2301  WKEGGIGRSI LHGAAGGLTT GSLGGILAGG GTSLAAPYLD KAAENLGPAG

2351  KAAVNALGGA AIGYATGGSG GAVVGANVDW NNRQLHPKEM ALADKYAEAL

2401  KREVEKREGR KISSQEAAMR IRRQILRWVD KGSQDGYTDQ SVISLIGMKG

2451  EDKALGYTWD YRDYGARNPQ TYNDPKLFEE YRRQDKPEYR NLTWLHSGTK

2501  DTKIRQGERK NEEFALNVAE GLTSLVNPNP RIKVPILAGI RNLKNIKPTV

2551  TGSDPLLAGA GNIRIPANGN VAKGDRIPDT ALASKGIKHK DRKDQLEKK*
```

Computer analysis of this amino acid sequence gave the following results:
Homology with a Predicted ORF from *N. gonorrhoeae* m564/fha
ID FHAB_BORPE STANDARD; PRT; 3591 AA.
AC P12255;
DT 1 Oct. 1989 (REL. 12, CREATED)
DT 1 Feb. 1996 (REL. 33, LAST SEQUENCE UPDATE)
DT 1 Feb. 1996 (REL. 33, LAST ANNOTATION UPDATE)
DE FILAMENTOUS HEMAGGLUTININ....
SCORES Init1: 190 Initn: 524 Opt: 594
Smith-Waterman score: 866; 21.7% identity in 2427 aa overlap

```
                       10         20         30         40         50         60
m564.pep     MNRTLYKVVFNKHRNCMIAVAENAKREGKNTADTQAVGILPNDIAGFAGFIHSISVISFS
             ||  :||::||::  |:   |:|:     | ||   ::  |    : :|   | ::  :::
fhab_borpe   MNTNLYRLVFSHVRGMLVPVSEHCTV-G-NTFCGRTRG---QARSGARATSLSVAPNALA
                      10         20         30            40         50

70         80         90        100        110       119
m564.pep     LSLLLG-SALILTSSSATAQGIVADKSAPAQQQPTILQTGNGIPQVNIQTPTSAGVSVNQ
             :|:|: ::| |::    |||:|     | |   :|| || :| |   |:|:|||  |:
fhab_borpe   WALMLACTGLPLVTH---AQGLV-----P-QGQTQVLQGGNKVPVVNIADPNSGGVSHNK
                 60         70              80         90        100

120        130        140        150        160       179
m564.pep     YAQFDVGNRGAILNNSRSNTQTQLGGWIQGNPWLARGEARVVVNQINSSHSSQLNGYIEV
             :  ||:|:|    |:::||   :: :::||   ||:| :| :: :::  ::    |:||
fhab_borpe   FQQFNVANPGVVFNNGLTDGVSRIGGALTKNPNLTR-QASAILAEVTDTSPSRLAGTLEV
                      110        120        130         140        150        160

180        190        200        210        220       239
m564.pep     GGRRAEVVIANPAGIAVNGGGFINASRATLTTAQPQYQAGDLSGFKIRQGNVVIAGHGLD
             |:  |:::||||  |  ||||: :|||       |:    :: ::|||||:|:||: ::
fhab_borpe   YGKGADLIIANPNGISVNGLSTLNASNLTLTTGRPSVNGGRI-GLDVQQGTVTIERGGVN
                      170        180        190        200        210        220
```

```
             240        250        260        270        280        290
m564.pep    ARDTDYTRILSYHSKIDAPV---WGQ---DVRVVAGQNDVAATGDAHSPILNNAAANTSN
             |   |    :::    |::: |     |:     |: ||||    :     :||    ||::  :
fhab_borpe  ATGLGYFDVVARLVKLQGAVSSKQGKPLADIAVVAGANRYDHATRRATPI----AAGARG
             230        240        250        260        270        280

300        310        320        330        340        350
m56.pep     NTANNGTHIPLFAIDTGKLGGMYANKITLISTVEQAGIRNQGQWFASAGNVAVNAEGKLV
             :|:         :|||      |:||::|||:|:       |:|:   |:  ::|   ::|:::|::
fhab_borpe  AAAGA------YAIDGTAAGAMYGKHITLVSSDSGLGVRQLGS-LSSPSAITVSSQGEIA
                        290        300        310        320        330

360        370        380        390        400        410
m564.pep    NTGMIAATGENHAVSLHARNVHNSGTVASQDDANIHSQTLDNSGTVLSSGRLTVRNLGRL
             :  ||  :    :||::  :|   :||    :::  ::|:|      :     ::|       |
fhab_borpe  ---LGDATVQRGPLSLKGAGVVSAGKLASGGGAV----NVAGGGAVKIA---SASSVGNL
                  340        350        360           370        380

420        430        440        450        460        470
m564.pep    KNQNNGTIQAARLDMSTGGLDNTGNITQTGSQALDLVSAGKFDNSGKIGVSDVPQTGLNP
             |::|   :||:  |::            |::  |   |||::|:|||  :|:     |       |
fhab_borpe  AVQGGGKVQATLLNAG-------GTLLVSGRQAVQLGAASSRQALSVNAGGALKADKLSA
                 390        400        410        420        430

480        490        500        510        520        530
m564.pep    NPSV-IPQIPSTATGSGSSTVSVSKPGSNNPVSPTAPAKNYAVGRIQTTGAFD-NAGSIN
             :   |    ::|    ||:|||::    :  |        :|   |:|||::     :   ||
fhab_borpe  TRRVDVDGKQAVALGSASSNALSVRAGGA-----LKAGKLSATGRLDVDGKQAVTLGSVA
                   440        450        460        470        480        490

540        550        55        560        570        579
m564.pep    AGGQIDIAAQNGLGNSGSLNAAKLRVSG------DSFNNT------VKGKLQAHDLAVNT
             :  |    ::::|    ::|  :   :::|:|:| |              |:  :::     : || ||::|   :
fhab_borpe  SDGALSVSAGGNLRANELVSSAQLEVRGQREVALDDASSARGMTVVAAGALAARNLQSKG
                   500        510        520        530        540        550

580        590        600        610        620        630
m564.pep    QTALNSGHLLTQTGKIDNRELH--NAGEIAANNLTLIHSGRLSNDKKGNIRAAHLQLDTA
             : ::|:  :: ::  ::    ||:    :  |::     ::|:    :::  :|:: :   ||      |::|   |:
fhab_borpe  AIGVQGGEAVSVANANSDAELRVRGRGQVDLHDLSAARGADISGEGRVNIGRARSDSDVK
                   560        570        580        590        600        610

640        650        660        670        680        690
m564.pep    GLHNAGNILADSGTVTTKNNLRNTGKVSVARLNTEGQTLDNTRGRIEAETVNIQSQQLTN
             :   |    :   |||   |:         :::    |||:   :  ::| |             :||: :
fhab_borpe  -VSAHGALSIDSMTALGAIGVQAGGSVSAKDMRSRGAVTVSGGG-----AVNLGDVQ---
                  620        630        640        650        660

700        710        720        730        740        750
m564.pep    QSGHITATEQLTINSRNVDNQNGKLLSANQAQLAVSDGLYNQHGEIATNRQLSIHDKNQN
             ::|:: ||      :::  |:|       |    |:||::  |         |   :|:||::
fhab_borpe  SDGQVRATSAGAMTVRDV---------AAAADLALQAGDALQAGFLKSAGAMTVNGRDAV
                  670        680           690        700        710

760        770        780        790        800        810
m564.pep    TLALNNADGTIQSAGNVSLQAKSLANNGTLTAGNKLDIALTDDFVVERDLTAGKQL-NLS
             |       ||| :::|::    |:|:|    |:|||  :  |:|          |:|   |   |
fhab_borpe  RL-----DGA-HAGGQLRVSSDGQAALGSLAAKGELTVSAARAATVA-EL---KSLDNIS
                     720        730        740        750        760

820        830        840        850        860        870
m564.pep    IKGRLK-NTHTLQAGHTLKLNA-GNIDNQVTGKIIGGEQTDITSEQHVDNRGLINSDGLT
             :  |    : ::::::::  |::  ::   |:    :||:    :|::|    :   |:::|:|
fhab_borpe  VTGGERVSVQSVNSASRVAISAHGALD---VGKV--SAKSGIGLE----GWGAVGADSL-
                   770        780        790        800        810

880        890        900        910        920        930
m564.pep    HIGAGQTLTNTGTKIYGNHIALDAQILLNREETTEGSTKAGAIAARKRLDI-GAKEIHN
             |:  :::  :|      ::     |:| |:        :|||::  || ||    :|||:   :
fhab_borpe  --GSDGAISVSGRDAVRVDQARSLADISLG----AEGGATLGAVEAAGSIDVRGGSTV--
                   820        830        840        850        860

940        950        960        970        980        990
m564.pep    QEGALLSSEGIFAVGNRLDEQHHAAGMADTFVNGSAGLEVQGGDALMSVRNMQNINNHFKT
             ::| :::  : :   |:           |   :  |::         ::  |:|    |:::  |:
fhab_borpe  AANSLHANRDVRVSGK--DAVRVTAATSGGGLHVSSGRQLDLGAVQA-RGALALDGGAGV
                   870        880        890        900        910        920

1000       1010       1020       1030       1040       1050
m564.pep    ETYLAKAEK--QVRDYTVLGQNTYYQAGKDGLFDNSQGQKDQTTATFHLKNGSRIEANQ-
             |||    :|:     |  :|    |:    :     :|          :|   |:|    |: ::|::
fhab_borpe  ALQSAKASGTLHVQGGEHLDLGTLAAVGAVDV----NGTGDVRVAKLVSDAGADLQAGRS
                   930        940        950        960        970

1060       1070       1080       1090       1100
m564.pep    --WHVRDYHIETYKERIIENRPAHITVGGDLTASGQNWLNKDSRIVVGGRIITDDLNQKE
             :   |   :    :    :::: ||   |||:: :|:    :||:  :   ::   :|
fhab_borpe  MTLGIVDTTGDLQARAQQKLELGSVKSDGGLQAAAGGALSLAAAEVAFALELS---GQGV
                   980        990        1000       1010       1020       1030

1110       1120       1130       1140       1150       1160
m564.pep    ITNQSTTGKGRTDAVGTQWDSVTKKGWY--SGRKQRRTERNHTPYHDTQLFTHDFDTPV
             ::::::::::|  |:::|:      :: ||       ::   :|  ||:|  |           :|| ||
fhab_borpe  TVDRASADRARIDSTGSVGIGALKAGAVEAASPRRARRALR------------QDFFTPG
                   1040       1050       1060       1070       1080
```

```
              1170      1180      1190      1200      1210      1220
m564.pep   SVI---QQNAASPSFQPAASAIKLIDGVSTAAVNGQRIHTGNVVSLNNATVTLPNSSLYT
           ||:   |  ||::    :|   :::   |:   |    :|  :     |   :|:|||:  :|
fhab_borpe SVVVRAQGNVTVGRGDPHQGVLAQGDIIMDA--KGGTLLLRNDALTENGTVTISADSAVL
              1090      1100      1110      1120      1130      1140

1230      1240      1250      1270      1270      1280
m564.pep   THPDNKGWLVETD-PQFADYRRWLGSDYMLQQLQLDTNHLHKRLGDGYYEQKLVNEQIHQ
           |   ::   :: :    :|   :    |  :   :|  |  |      :   ::|:   :: :  ::||
fhab_borpe EHSTIESKISQSVLAAKGDKGKPAVSVKVAKKLFL--NGTLRAVNDN--NETMSGRQIDV
              1150      1160      1170      1180      1190

1290      1300      1310      1320      1330      1340
m564.pep   LTGYRRLDGYRSDEEQFKALMDNGLTAAKTFGLTPG-IALSAEQVARLTSDIVWMENQTV
           :  |   ::   :|      :|     |:::::   ::     |    |  |::|:  :: |  | |:
fhab_borpe VDGRPQI----TDAVTGEARKDESVVSDAALVADGGPIVVEAGELVSHAGGIGNGRNK--
              1200      1210      1220      1230      1240      1250

1350      1360      1370      1380      1390      1400
m564.pep   TLSDGSTQTVLVPKVYALARKGDLNTSGGLISAEQVLLKLQNGNLTNSGTIAGRQAVLIQ
             :|:::  ||         |:|:::  :|::    :|     |   |||
fhab_borpe --ENGASVTVRTT--------GNLVNKGYISAGKQGVLEV-GGALTNEFLVGSDGTQRIE
                 1260      1270      1280      1290      1300

1410      1420      1430      1440      1450
m564.pep   ARNINSNGNIQ-------ADQIGLKAEKSINIDGGQVQAGRLLLTAQ----AQNINLNGTT
           |:  |::  ::|              |   : :||  ::|  ||  :| :|         |
fhab_borpe AQRIENRGTFQSQAPAGTAGALVVKAAEAIVHDGVMATKGEMQIAGKGGGSPTVTAGAKA
              1310      1320      1330      1340      1350      1360

1460      1470      1480      1490      1500
m564.pep   QTSGNERNGNTAI-DRMAGINVV-GSHTEQVDNRTSD-GILSLHASNDINLNAATVSNQV
           ||:|:|  :: ::|  |  :::::  |:          |     | |  ||    :   :|  ||
fhab_borpe TTSANKLSVDVASWDNAGSLDIKKGGAQVTVAGRYAEHGEVSIQGDYTVSADAIALAAQV
              1370      1380      1390      1400      1410      1420

1510      1520      1530      1540      1550
m564.pep   --KDGTTQITAGNNLNLGT-IRTE---HREAYGTLDDENHRHVRQST---------EVGS
             :  |::::|:  ::   ::: ||    :  :|  | ::: ::  :|:::         |:|:
fhab_borpe TQRGGAANLTSRHDTRFSNKIRLMGPLQVNAGGPVSNTGNLKVREGVTVTAASFDNETGA
              1430      1440      1450      1460      1470      1480

1560      1580      1590      1600
m564.pep   SIRTQNGALLRAGNDLKIRQGELEAEEGKTVLAAGRDV--TISEGRQITELDTS---VSG
           :   : :::::|   :|       :    |:::::|:   |::||| :   |::|::||   : :         |
fhab_borpe EVMAKSATLTTSGAARN--AGKMQVKEAATIVAASCSNPGTFTAGKDITVTSRGGFDNEG
              1490      1500      1510      1520      1530

1610      1620      1630      1640      1650      1660
m564.pep   K---SKGILSSTKTHDRYRF---SHDEAV-GSNIGGGKMIVAAGQDINVRGSNLISDKGI
           |    |:  |: :|:    :   |    : ||  :|   | : ::    ||  ||:|::|:::  :   |::
fhab_borpe KMESNKDIVIKTEQFSNGRVLDAKHDLTVTASGQADNRGSLKAGHDFTVQAQRI--DNSG
           1540      1550      1560      1570      1580      1590

1670      16  1680      1690      1700      1710
m564.pep   VLKAGHDIDISTAHNRYTG-----NEYHESKKSGVMGTGGLGFTIGNRKTTDDTDRTNIV
           ::  ||||   :::  | |  ||        ::  |   :  :  :||   :|
fhab_borpe TMAAGHDATLKAPHLRNTGQVVAGHDIHIINSAKLENTGRV--DARNDIALDVADFTN--
              1600      1610      1620      1630      1640      1650

1720      1730      1   1740      1750      1760      1770
m564.pep   HTGSIIGSLNGDTVTVAGNRYRQT----GSTVSSPEGRNTVTAKSIDVEFANNRYATDYA
           |||: : |||:|:| :      :  ||   :    :|  :|:|:  :| :
fhab_borpe -TGSLYAEHDA-TLTLAQGTQRDLVVDQDHILPVAEGTLRVKAKSLTTEIETGNPGSLIA
              1660      1670      1680      1690      1700      1710

1780      1790      1800      1810      1820      1830
m564.pep   HTQEQKGLTVALNVPVVQAAQNFIQAAQNVGKSNKRVNAMAAANAA-WQSYQATQQMQQ
           ::||         |:      ||       ||          |:::::::      |::   |     |||   ||
fhab_borpe EVQE--------NIDNKQA----IVVGKDLTLS-SAHGNVANEANALLWAAGELTVKAQN
                       1720      1730      1740      1750

1840      1850      1860      1870      1880      1890
m564.pep   FAPSSSAGQGQNNNQSPSISVSITYFEQKSRNEQKRHYTEAAASQIIGKGQTTLAATGSG
           ::   :|    ::|     :: :|::          :  |    : |  |:|   :::     :|
fhab_borpe ITNKRAALIEAGGNARLTAAVALLNKLGRIRAGEDMHLD---APRI----ENTAKLSGEV
              1760      1770      1780      1790      1800      1810

1900      1910      1920      1930      1940      1950
m564.pep   EQSNINITGSDVIGHAGTALIADNHIRLQSAKQDGSEQSKNKSSGWNAGVAVKIGNGIRF
           ::::::  :|:   |: :   ::      :|    ::|:  |:       :: |  :|      |:
fhab_borpe QRKGVQDVGGGEHGRWSGIGYVNYWLRAGNGKKAGT-----IAAPWYGGDLTAEQSLIEV
              1820      1830      1840      1850      1860

1960      1970      1980      1990      2000      2010
m564.pep   GITAGGNIGKGKEQGGSTTHRHTHVGSTTGKTTIRSGGDTTLKGVQLIGKGIQADTRNLH
           |    |    |   |::    |||              ::   :|::||    :     ::|:|:::
fhab_borpe GKDLYLNAGARKDE-----HRHL------LNEGVIQAGGHGIGG--------DVDNRSV-
              1870      1880      1890      1900

2020      2030      2040      2050      2060
m564.pep   IESVQDTETYQSKQQNGNVQVTGYGFSASGSYRQSKVKA-----DHASVTGQSGIYAGE
           :::|:   |    :::    :  :   :|  :|      ||     :       |:        |:|
fhab_borpe VRTVSAMEYFKTPLPVSLTALDNRAGLSPATWNFQSTYELLDYLLDQNRYEYIWGKYPTY
              1910      1920      1930      1940      1950      1960
```

-continued

```
              2070      2080      2090      2100      2110      2120
m564.pep    DGYQIKVRDNTDLKGGIITSSQSAEDKGKNLFQTATLTASDIQHNS--RYEGRSFGIGGS
            ::::: |||  |      ::|     |            |:::|:    |||:: :|
fhab_borpe  TEWSVNTLKNLDL-GYQAKPAPTAPPMPKA-------PELDLRGHTLESAEGRKI-FGEY
              1970      1980      1990      2000      2010

2130      2140      2150      2160      2170
m564.pep    FDLNGGWDGT-----VTDKQGRPTDRISPAAGYGSDGDSKNSTTRSGVNTHNIHITDEAG
            |:| :: :       :::    |: | |:      |        :: : : :|::::: ::
fhab_borpe  KKLQGEYEKAKMAVQAVEAYGEATRRVHDQLG------QRYGKALGGMDAETKEVDGIIQ
              2020      2030      2040           2050      2060      2070

2180      2190      2200      2210      2220      2230
m564.pep    QLARTGRTAKETEARIYTGIDTETADQHSGHLKNSFDKDAVAKEINLQREVTKEFGRNAA
            ::|    ||:    :|      |  ||:|| |: : :  |:::|    || :        :||  ::: :
fhab_borpe  EFAADLRTVYAKQADQAT-IDAET-DKVAQRYKSQID--AVRLQAIQPGRVT--LAKALS
              2080      2090      2100      2110      2120

2240      2250      2260      2270      2280      2290
m564.pep    QAVAAVADKLGNTQSYERYQEARTLLE-AELQNTDSEAEKAAFRASLGQVNAYL------
            |::|       ||::|  ::|:::  ::   : ||:       :|    |     |:|    |: :
fhab_borpe  AALGADWRALGHSQLMQRWKDFKAGKRGAEIAFYPKEQTVLAAGAGLTLSNGAIHNGENA
              2130      2140      2150      2160      2170      2180

2300      2310      2320      2330      2340      2350
m564.pep    AENQSRYDTWKEGGIGRSILHGAAGGLTTGSLGGILAGGGTSLAAPYLDKAAENLGPAGK
            |:|::|  :   |  |:  : :: :|:    :|
fhab_borpe  AQNRGRPEGLKIGAHSATSVSGSFDALRDVGLEKRLDIDDALAAVLVNPHIFTRIGAAQT
              2190      2200      2210      2220      2230      2240
```

The following partial DNA sequence was identified in *N. gonorrhoeae* <SEQ ID 1671>:

```
g565.seq
    1   atggacagca cattgtctaa aacgtgttgc gtttcgtgca tattgttgag 51   cgtaaccacc accattttcg cccgtcccag accggcggct tccaatactt 101   ccctgcgttt cgcatcgccg aacgacaccg gctcgcctgc acttctggct 151   acctgcacgc gtgcgatgtc caagtcgagc gcgaaatacg gaatatcctc 201   tttgggcgaa gacgcgtccg accgtctgcc cgcccctgcc gaagccgaca 251   atcagcacat gatcagactt gctcatcgct tccaccaaca tgctgtgcag 301   atcgagcgac ttcatgtccc agcttga
```

This corresponds to the amino acid sequence <SEQ ID 1672; ORF 565.ng>:

```
g565.pep
    1   MDSTLSKTCC VSCILLSVTT TIFARPRPAA SNTSLRFASP NDTGSPALLA

51   TCTRAMSKSS AKYGISSLGE DASDRLPAPA EADNQHMIRL AHRFHQHAVQ

101   IERLHVPA*
```

The following partial DNA sequence was identified in *N. meningitidis* <SEQ ID 1673>:

```
m565.seq
    1   ATGGACAGCA CATTGTCTAA AACGTGTTGC GTTTCGTGCA TATTGTTGAG

51   CGTAACCACC ACCATTTTCG CCCGTCCCAG ACCGGCGGCT TCCAATACTT

101   CCCTGCGTTT CGCATCGCCG AACGACACCG GTTCGCCCGC ACTTCTGGCA

151   ACCTGCACCC GCGCAATGTC CAAGTCGAGC GCGAAATACG GAATATCCTC

201   TTGGGCAAGG ACGCGTCCGA CCGTCTGCCC GCCCCTGCCG AAGCCGACAA

251   TCAGCACATG GTCGGACTTG CTCATGGTTT CTACCAGCAT ACTGTGCAGA

301   TCGAGCGACT TCATGTCCCA GCTTGACTTG ACCAAACGCC CGACCAGCGC
```

```
                        -continued
351    ATCGCTGCCG CCCAAGAGGA AGGGCGCGAT AATCATCGAC AGCAGAACCG

401    CCGCCGTCGC CGCCTGTTCC CATTCTGGCG AAACCATATC AAGCTGCCCG

451    GCAATGGCCA GCATCACGAA GCCGAACTCG CCGCCCTGCG CGAGATACAA

501    AGCCGTTTTG AGGCTGTCGC CGACCGAATG TTTCATTTTG AAGGCAATGG

551    CAAACACAAC CAGTGCCTTC AACACCAGCA GCATTGCCAA CAGCATCAAT

601    ACCTGCCGCC AGCCGCCGAT CAATGCCTGA
```

This corresponds to the amino acid sequence <SEQ ID 1674; ORF 565>:

```
m565.pep
     1    MDSTLSKTCC VSCILLSVTT TIFARPRPAA SNTSLRFASP NDTGSPALLA

51    TCTRAMSKSS AKYGISSWAR TRPTVCPPLP KPTISTWSDL LMVSTSILCR

101    SSDFMSQLDL TKRPTSASLP PKRKGAIIID SRTAAVAACS HSGETISSCP

151    AMASITKPNS PPCARYKAVL RLSPTECFIL KAMANTTSAF NTSSIANSIN

201    TCRQPPINA*
```

Computer analysis of this amino acid sequence gave the following results:
Homology with a Predicted ORF from *N. gonorrhoeae*
m565/g565 100.0% identity in 67 aa overlap

```
                  10         20         30         40         50         60
m565.pep  MDSTLSKTCCVSCILLSVTTTIFARPRPAASNTSLRFASPNDTGSPALLATCTRAMSKSS
          ||||||||||||||||||||||||||||||||||||||||||||||||||||||||||||
g565      MDSTLSKTCCVSCILLSVTTTIFARPRPAASNTSLRFASPNDTGSPALLATCTRAMSKSS
                  10         20         30         40         50         60

70         80         90        100        110        120
m565.pep  AKYGISSWARTRPTVCPPLPKPTISTWSDLLMVSTSILCRSSDFMSQLDLTKRPTSASLP
          |||||||
g565      AKYGISSLGEDASDRLPAPAEADNQHMIRLAHRFHQHAVQIERLHVPAX
```

The following partial DNA sequence was identified in *N. meningitidis* <SEQ ID 1675>:

```
a565.seq
     1    ATGGACAGCA CATTGTCTAA AACGTGTTGC GTTTCGTGCA TATTGTTGAG

51    CGTAACCACC ACCATTTTCG CCCGTCCCAG ACCGGCGGCT TCCAATACTT

101    CCCTGCGTTT CGCATCGCCG AACGACACCG GTTCGCCCGC ACTTCTGGCA

151    ACCTGCACCC GCGCAATGTC CAAGTCGAGC GCGAAATACG GAATATCCTC

201    TTGGGCAAGG ACGCGTCCGA CCGTCTGCCC GCCCCTGCCG AAGCCGACAA

251    TCAGCACATG GTCGGACTTG CTCATGGTTT CTACCAGCAT ACTGTGCAGA

301    TCGAGCGACT TCATGTCCCA GCTTGACTTG ACCAAACGCC CGACCAGTGC

351    ATCGCTGCCG CCCAAGAGGA AGGGCGCGAT AATCATCGAC AGCAGAACCG

401    CCGCCGTCGC CGCCTGTTCC CATTCTAGCG AAACCATATC AAGCTGCCCG

451    GCAATGGCCA GCATCACGAA GCCGAACTCG CCGCCCTGCG CGAGATACAA

501    AGCCGTTTTG AGGCTGTCGC CGACCGAATG TTTCATTTTG AAGGCAATGG

551    CAAACACAAC CAGTGCCTTC AACACCAGCA GCATTGCCAA CAGCATCAAT

601    ACCTGCCGCC AGCCGCCGAT TAATGCCTGA
```

This corresponds to the amino acid sequence <SEQ ID 1676; ORF 565.a>:

```
a565.pep
    1   MDSTLSKTCC VSCILLSVTT TIFARPRPAA SNTSLRFASP NDTGSPALLA

51   TCTRAMSKSS AKYGISSWAR TRPTVCPPLP KPTISTWSDL LMVSTSILCR

101   SSDFMSQLDL TKRPTSASLP PKRKGAIIID SRTAAVAACS HSSETISSCP

151   AMASITKPNS PPCARYKAVL RLSPTECFIL KAMANTTSAF NTSSIANSIN

201   TCRQPPINA*
``` m565/a565 99.5% identity in 209 aa overlap

```
                   10         20         30         40         50         60
m565.pep   MDSTLSKTCCVSCILLSVTTTIFARPRPAASNTSLRFASPNDTGSPALLATCTRAMSKSS
           ||||||||||||||||||||||||||||||||||||||||||||||||||||||||||||
a565       MDSTLSKTCCVSCILLSVTTTIFARPRPAASNTSLRFASPNDTGSPALLATCTRAMSKSS
                   10         20         30         40         50         60

70         80         90        100        110        120
m565.pep   AKYGISSWARTRPTVCPPLPKPTISTWSDLLMVSTSILCRSSDFMSQLDLTKRPTSASLP
           ||||||||||||||||||||||||||||||||||||||||||||||||||||||||||||
a565       AKYGISSWARTRPTVCPPLPKPTISTWSDLLMVSTSILCRSSDFMSQLDLTKRPTSASLP
                   70         80         90        100        110        120

130        140        150        160        170        180
m565.pep   PKRKGAIIIDSRTAAVAACSHSGETISSCPAMASITKPNSPPCARYKAVLRLSPTECFIL
           |||||||||||||||||||||||||||||:||||||||||||||||||||||||||||||
a565       PKRKGAIIIDSRTAAVAACSHSSETISSCPAMASITKPNSPPCARYKAVLRLSPTECFIL
                  130        140        150        160        170        180

190        200        210
m565.pep   KAMANTTSAFNTSSIANSINTCRQPPINAX
           |||||||||||||||||||||||||||||
a565       KAMANTTSAFNTSSIANSINTCRQPPINAX
                  190        200        210
```

The following partial DNA sequence was identified in *N. gonorrhoeae* <SEQ ID 1677>:

```
g566.seq..
    1   atgccgtctg aacaatatct tttcagacgg cattttgtat gggggttaac 51   ggttgttcag cccgagtacg tcctgcatat cgtacaaacc cgttttgccg 101   tttacccaaa ctgcggcgcg gacggcaccg gcggcaaagg tcatgcggct 151   gccggctttg tgggtgattt ccacgcgttc gccgtcggtg gcgaagaggg 201   cggtgtggtc gccgactatg tcgcctgcgc ggacggtggc aaagccgatg 251   gtggaaggat cgcgcggacc agtgtggcct tcgcggccgt aaacggcgca 301   ttgtttgagg tcgcggccga gcgcgccggc gatgacttcg cccattcgta 351   a
```

This corresponds to the amino acid sequence <SEQ ID 1678; ORF 566.ng>:

```
g566.pep..
    1   MPSEQYLFRR HFVWGLTVVQ PEYVLHIVQT RFAVYPNCGA DGTGGKGHAA

51   AGFVGDFHAF AVGGEEGGVV ADYVACADGG KADGGRIART SVAFAAVNGA

101   LFEVAAERAG DDFAHS*
```

The following partial DNA sequence was identified in *N. meningitidis* <SEQ ID 1679>:

```
m566.seq..
    1    ATGCCGTCTG AACAATATCT TTTCAGACGG CATTTTGTAT GGGGGTTAAC

51    GGTTGTTCAG CCCGAGTACG TCCTGCATAT CGTACAAACC CGTTTTGCCG

101    TTGACCCAAA CTGCGGCGCG GACGGCACCG GCGGCAAAGG TCATGCGGCT

151    GCTGGCCTTG TGGGTGATTT CCACGCGCTC GCCGTCGGTG GCGAAGAGGG

201    CGGTGTGGTC GCCGACGATG TCGCCTGCGC GGACGGTGGC AAAGCCGATG

251    GTCGACGGAT CGCGCGGACC GGTGTGGCCT TCGCGGCCGT AAACGGCGCA

301    TTGTTTGAGG TCTCTGCCGA GCGCGCCGGC GATGACTTCG CCCATGCGTA

351    A
```

This corresponds to the amino acid sequence <SEQ ID 1680; ORF 566>:

```
m566.pep..
    1    MPSEQYLFRR HFVWGLTVVQ PEYVLHIVQT RFAVDPNCGA DGTGGKGHAA

51    AGLVGDFHAL AVGGEEGGVV ADDVACADGG KADGRRIART GVAFAAVNGA

101    LFEVSAERAG DDFAHA*
```

Computer analysis of this amino acid sequence gave the following results:
Homology with a Predicted ORF from *N. gonorrhoeae*
  m566/g566 93.1% identity in 116 aa overlap

```
                  10         20         30         40         50         60
    m566.pep  MPSEQYLFRRHFVWGLTVVQPEYVLHIVQTRFAVDPNCGADGTGGKGHAAAGLVGDFHAL
              ||||||||||||||||||||||||||||||||||||| ||||||||||||:||||||:
    g566      MPSEQYLFRRHFVWGLTVVQPEYVLHIVQTRFAVYPNCGADGTGGKGHAAAGFVGDFHAF
                  10         20         30         40         50         60

70         80         90        100        110
    m566.pep  AVGGEEGGVVADDVACADGGKADGRRIARTGVAFAAVNGALFEVSAERAGDDFAHAX
              ||||||||||| |||||||||||||| ||||:||||||||||||||:|||||||||:|
    g566      AVGGEEGGVVADYVACADGGKADGGRIARTSVAFAAVNGALFEVAAERAGDDFAHSX
                  70         80         90        100        110
```

The following partial DNA sequence was identified in *N. meningitidis* <SEQ ID 1681>:

```
a566.seq
    1    ATGCCGTCTG AACAATATCT TTTCAGACGG CATTTTGTAT GGGGGTTAAC

51    GGTTGTTCAG CCCGAGTACG TCCTGCATAT CGTACAAACC CGTTTTACCG

101    TTTACCCAAA CTGCGGCGCG GACGGCGCCG GCGGCAAAGG TCATGCGGCT

151    GCTTGCCTTG TGGGTGATTT CCACGCGCTC GCCGTCGGTG GCGAAGAGGG

201    CGGTGTGGTC GCCGACGATG TCGCCCGCGC GGACGGTGGC AAAGCCGATG

251    GTGGACGGAT CGCGCGGGCC GGTGTGGCCT TCGCGGCCGT AAACGGCGCA

301    TTGTTTGAGG TCTCTGCCGA GCGCGCCGGC GATGACTTCG CCCATGCGTA

351    A
```

This corresponds to the amino acid sequence <SEQ ID 1682; ORF 566.a>:

```
a566.pep
    1   MPSEQYLFRR HFVWGLTVVQ PEYVLHIVQT RFTVYPNCGA DGAGGKGHAA

51   ACLVGDFHAL AVGGEEGGVV ADDVARADGG KADGGRIARA GVAFAAVNGA

101   LFEVSAERAG DDFAHA*
``` m566/a566 94.0% identity in 116 aa overlap

```
                  10         20         30         40         50         60
  m566.pep  MPSEQYLFRRHFVWGLTVVQPEYVLHIVQTRFAVDPNCGADGTGGKGHAAAGLVGDFHAL
            ||||||||||||||||||||||||||||||:| |||||||:|||||||| ||||||||
  a566      MPSEQYLFRRHFVWGLTVVQPEYVLHIVQTRFTVYPNCGADGAGGKGHAAACLVGDFHAL
                  10         20         30         40         50         60

70         80         90        100        110
  m566.pep  AVGGEEGGVVADDVACADGGKADGRRIARTGVAFAAVNGALFEVSAERAGDDFAHAX
            |||||||||||||| |||||||| ||||:||||||||||||||||||||||||||||
  a566      AVGGEEGGVVADDVARADGGKADGGRIARASVAFAAVNGALFEVSAERAGDDFAHAX
                  70         80         90        100        110
```

The following partial DNA sequence was identified in *N. gonorrhoeae* <SEQ ID 1683>:

```
g567.seq..
    1   atgcgacgac gggcagcggc atcgacaagg cgggtttgca gtccggcgtt 51   tatcaggtct tattgggcga tgcggacgtg cagtcggcgg cggtacgcag 101   caaagagggc ggatacggcg tgttgggtgc gaacgcgcgc gcttgccggc 151   gcggaaatcg agctggtgca ggaaatcgcc cgggaagtgc gtttgaaaaa 201   cgcgctcaag gcagtggcgg aagattacga ctttatcctg atcgactgtc 251   cgccttcgct gacgctgttg acgcttaacg gcttggtggc ggcgggcggc 301   gtgattgtgc cgatgttgtg cgaatattac gcgctggaag ggatttccga 351   tttgattgcg accgtgcgca aaatccgtca ggcggtcaat cccgatttgg 401   acatcacggg catcgtgcgt acgatgtacg acagccgcag caggctggtt 451   gccgaagtca gcgaacagtt gcgcagccat ttcggggatt tgcttttga 501   aaccgccatc ccgcgcaata tccgccttgc ggaagcgccg agccacggta 551   tgccggtgat ggcttacgac gcgcaggcaa agggtgccaa ggcgtatctt 601   gccttggcgg acgaactggc ggcgagggtg tcggggaaat ag
```

This corresponds to the amino acid sequence <SEQ ID 1684; ORF 567.ng>:

```
g567.pep
    1   MRRRAAASTR RVCSPAFIRS YWAMRTCSRR RYAAKRADTA CWVRTRALAG

51   AEIELVQEIA REVRLKNALK AVAEDYDFIL IDCPPSLTLL TLNGLVAAGG

101   VIVPMLCEYY ALEGISDLIA TVRKIRQAVN PDLDITGIVR TMYDSRSRLV

151   AEVSEQLRSH FGDLLFETAI PRNIRLAEAP SHGMPVMAYD AQAKGAKAYL

201   ALADELAARV SGK*
```

The following partial DNA sequence was identified in *N. meningitidis* <SEQ ID 1685>:

```
m567.seq..
      1    ATGAGTGCGA ACATCCTTGC CATCGCCAAT CAGAAGGGCG GTGTGGGCAA

51    AACGACGACG ACGGTAAATT TGGCGGCTTC GCTGGCATCG CGCGGCAAAC

101    GCGTGCTGGT GGTCGATTTG GATCCGCAGG GCAATGCGAC GACGGGCAGC

151    GGCATCGACA AGGCGGGTTT GCAGTCCGGC GTTTATCAGG TCTTATTGGG

201    CGATGCGGAC GTGCAGTCGG CGGCGGTACG CAGCAAAGAG GGCGGATACG

251    CTGTGTTGGG TGCGAACCGC GCGCTGGCCG GCGCGGAAAT CGAACTGGTG

301    CAGGAAATCG CCCGGGAAGT GCGTTTGAAA AACGCGCTCA AGGCAGTGGA

351    AGAAGATTAC GACTTTATCC TGATCGACTG CCCGCCTTCG CTGACGCTGT

401    TGACGCTTAA CGGGCTGGTG GCGGCGGGCG GCGTGATTGT GCCGATGTTG

451    TGCGAATATT ACGCGCTGGA AGGGATTTCC GATTTGATTG CGACCGTGCG

501    CAAAATCCGT CAGGCGGTCA ATCCCGATTT GGACATCACG GGCATCGTGC

551    GCACGATGTA CGACAGCCGC AGCAGGCTGG TTGCCGAAGT CAGCGAACAG

601    TTGCGCAGCC ATTTCGGGGA TTTGCTTTTT GAAACCGTCA TCCCGCGCAA

651    TATCCGCCTT GCGGAAGCGC CGAGCCACGG TATGCCGGTG ATGGCTTACG

701    ACGCGCAGGC AAAGGGTACC AAGGCGTATC TTGCCTTGGC GGACGAGCTG

751    GCGGCGAGGG TGTCGGGGAA ATAG
```

This corresponds to the amino acid sequence <SEQ ID 1686; ORF 567>:

```
m567.pep..
      1    MSANILAIAN QKGGVGKTTT TVNLAASLAS RGKRVLVVDL DPQGNATTGS

51    GIDKAGLQSG VYQVLLGDAD VQSAAVRSKE GGYAVLGANR ALAGAEIELV

101    QEIAREVRLK NALKAVEEDY DFILIDCPPS LTLLTLNGLV AAGGVIVPML

151    CEYYALEGIS DLIATVRKIR QAVNPDLDIT GIVRTMYDSR SRLVAEVSEQ

201    LRSHFGDLLF ETVIPRNIRL AEAPSHGMPV MAYDAQAKGT KAYLALADEL

251    AARVSGK*
```

Computer analysis of this amino acid sequence gave the following results:

Homology with a Predicted ORF from *N. gonorrhoeae* m567/g567 98.2% identity in 168 aa overlap

```
                60        70        80        90       100       110       119
m567.pep   GVYQVLLGDADVQSAAVRSKEGGYAVLGANRALAGAEIELVQEIAREVRLKNALKAVEED
                                          |||||||||||||||||||||||||||| ||
g567       AFIRSTWAMRTCSRRRYAAKRADTACWVRTRALAGAEIELVQEIAREVRLKNALKAVAED
                   20        30        40        50        60        70

120       130       140       150       160       170       179
m567.pep   YDFILIDCPPSLTLLTLNGLVAAGGVIVPMLCEYYALEGISDLIATVRKIRQAVNPDLDI
           ||||||||||||||||||||||||||||||||||||||||||||||||||||||||||||
g567       YDFILIDCPPSLTLLTLNGLVAAGGVIVPMLCEYYALEGISDLIATVRKIRQAVNPDLDI
                   80        90       100       110       120       130

180       190       200       210       220       230       239
m562.pep   TGIVRTMYDSRSRLVAEVSEQLRSHFGDLLFETVIPRNIRLAEAPSHGMPVMAYDAQAKG
           ||||||||||||||||||||||||||||||||:|||||||||||||||||||||||||||
g562       TGIVRTMYDSRSRLVAEVSEQLRSHFGDLLFETAIPRNIRLAEAPSHGMPVMAYDAQAKG
                  140       150       160       170       180       190
```

-continued

```
              240        250
m562.pep    TKAYLALADELAARVSGKX
            :||||||||||||||||||
g562        AKAYLALADELAARVSGKX
              200        210
```

The following partial DNA sequence was identified in *N. meningitidis* <SEQ ID 1687>:

```
a567.seq
     1    ATGAGTGCGA ACATCCTTGC CATCGCCAAT CAGAAGGGCG GTGTGGGCAA

51    AACGACGACG ACGGTAAATT TGGCGGCTTC GCTGGCATCG CGCGGCAAAC

101    GCGTGCTGGT GGTCGATTTG GATCCGCAGG GCAATGCGAC GACGGGCAGC

151    GGCATCGACA AGGCGAGTTT GCAGTCCGGC GTTTATCAGG TCTTATTGGG

201    CGATGCGGAC GTGAAATCGG CGGCGGTACG CAGCAAAGAG GGCGGATACG

251    GCGTGTTGGG TGCGAACCGC GCGCTGGCCG GCGCGGAAAT CGAGCTGGTG

301    CAGGAAATCG CCCGGGAAGT GCGTTTGAAA AACGCGCTCA AGGCAGTGGC

351    GGAAGATTAC GACTTTATCC TGATCGACTG CCCGCCTTCG CTGACGCTGT

401    TGACGCTTAA CGGCTTGGTG GCGGCAGGCG GCGTGATTGT GCCGATGTTG

451    TGCGAATATT ACGCGCTGGA AGGGATTTCC GATTTGATTG CGACCGTGCG

501    CAAAATCCGT CAGGCGGTCA ATCCCGATTT GGATATCACG GGCATCGTGC

551    GTACGATGTA CGACAGCCGC AGCAGGCTAG TTGCCGAAGT CAGCGAACAG

601    TTGCGCAGCC ATTTCGGGGA TTTGCTGTTT GAAACCGTCA TCCCGCGCAA

651    TATCCGCCTT GCGGAAGCGC CGAGCCACGG TATGCCGGTG ATGGCTTATG

701    ATGCGCAGGC AAAGGGTGCC AAGGCGTATC TTGCCTTGGC GGACGAGCTG

751    ATGGCGAGGG TGTCGGGGAA ATAG
```

This corresponds to the amino acid sequence <SEQ ID 1688; ORF 567.a>:

```
a567.pep
     1    MSANILAIAN QKGGVGKTTT TVNLAASLAS RGKRVLVVDL DPQGNATTGS

51    GIDKASLQSG VYQVLLGDAD VKSAAVRSKE GGYGVLGANR ALAGAEIELV

101    QEIAREVRLK NALKAVAEDY DFILIDCPPS LTLLTLNGLV AAGGVIVPML

151    CEYYALEGIS DLIATVRKIR QAVNPDLDIT GIVRTMYDSR SRLVAEVSEQ

201    LRSHFGDLLF ETVIPRNIRL AEAPSHGMPV MAYDAQAKGA KAYLALADEL

251    MARVSGK*
``` m567/a567 97.7% identity in 257 aa overlap

```
                 10         20         30         40         50         60
m567.pep  MSANILAIANQKGGVGKTTTTVNLAASLASRGKRVLVVDLDPQGNATTGSGIDKAGLQSG
          ||||||||||||||||||||||||||||||||||||||||||||||||||||:||||
a567      MSANILAIANQKGGVGKTTTTVNLAASLASRGKRVLVVDLDPQGNATTGSGIDKASLQSG
                 10         20         30         40         50         60

70         80         90        100        110        120
m567.pep  VYQVLLGDADVQSAAVRSKEGGYAVLGANRALAGAEIELVQEIAREVRLKNALKAVEEDY
          ||||||||||:|||||||||||:|||||||||||||||||||||||||||||||||:|||
a567      VYQVLLGDADVKSAAVRSKEGGYGVLGANRALAGAEIELVQEIAREVRLKNALKAVAEDY
                 70         80         90        100        110        120
```

```
                       130        140        150        160        170        180
    m567.pep   DFILIDCPPSLTLLTLNGLVAAGGVIVPMLCEYYALEGISDLIATVRKIRQAVNPDLDIT
               ||||||||||||||||||||||||||||||||||||||||||||||||||||||||||||
    a567       DFILIDCPPSLTLLTLNGLVAAGGVIVPMLCEYYALEGISDLIATVRKIRQAVNPDLDIT
                       130        140        150        160        170        180
                       190        200        210        220        230        240
    m567.pep   GIVRTMYDSRSRLVAEVSEQLRSHFGDLLFETVIPRNIRLAEAPSHGMPVMAYDAQAKGT
               |||||||||||||||||||||||||||||||||||||||||||||||||||||||||||:
    a567       GIVRTMYDSRSRLVAEVSEQLRSHFGDLLFETVIPRNIRLAEAPSHGMPVMAYDAQAKGA
                       190        200        210        220        230        240
                       250
    m567.pep   KAYLALADELAARVSGKX
               |||||||||| |||||||
    a567       KAYLALADELMARVSGKX
```

The following partial DNA sequence was identified in *N. gonorrhoeae* <SEQ ID 1689>:

```
g568.seq
      1   atgctcaggg tcagaccggt attatttgcc gtcaaggctt ccgcctcttc 51   gataccttgc agaatctgcc gattaaagcg ttcgcggctg cccaatattt 101   tcaggcgcat attgttttcg tgcaggcggc gtacctgttt ttgcaaagcc 151   tgtaaaaaca gccccatcag gaacgaaact tcgtcttcgg ggcgacgcca 201   gttttcggtt gaaaaggcaa acacggtcag atattgcacg cccagtttgg 251   cgcaatgctt caccatattt tccaacgcgt ccaagccgcg tttgtgtccc 301   attatacgcg ggagaaaacg ttttttcgcc caacggccgt tgccgtccat 351   aattacggcg atgtgcctcg ggatggcggt gtgttccaaa atggtctgcg 401   tgctgctctt catatctgcc tttcgcggtt cggcgttcaa atgccgtctg 451   aacgccgcgc cgtga
```

This corresponds to the amino acid sequence <SEQ ID 1690; ORF 568.ng>:

```
g568.pep
      1   MLRVRPVLFA VKASASSIPC RICRLKRSRL PNIFRRILFS CRRRTCFCKA

51   CKNSPIRNET SSSGRRQFSV EKANTVRYCT PSLAQCFTIF SNASKPRLCP

101   IIRGRKRFFA QRPLPSIITA MCLGMAVCSK MVCVLLFISA FRGSAFKCRL
                                 ‾‾‾‾‾‾‾‾‾‾ ‾‾‾‾‾‾‾‾‾‾

151   NAAP*
```

The following partial DNA sequence was identified in *N. meningitidis* <SEQ ID 1691>:

```
m568.seq
      1   ATGCTCAGGG TCAGGCCGGT ATTGTTTGCC GTCAACGCTT CCGCCTCTTC

51   GATGCCTTGC AGAATCTGCC GGTTGAAGCG TTCGCGGCTG CCCAATATCT

101   TCAGGCGCAT ATTGTTTTCG TGCAGGCGGC GTACCTGTTT TTGCAAAGCC

151   TGTAAAAACA GCCCCATCAG GAACGAAACT TCGTCTTCGG GGCGGCGCCA

201   GTTTTCGGTT GAAAAGGCAA ACACGGTCAG ATATTGCACA CCCAGTTTGG

251   CGCAATGCTT CACCATATTT TCCAATGCGT CCAAACCGCG TTTGTGTCCC

301   ATTATGCGCG GGAGGAAACG TTTTTTCGCC CAACGGCCGT TGCCGTCCAT

351   AATCACGGCG ATATGCTTGG GAATGGCGGT GTGTTCCAAA ACGGCCTGCG

401   TGCTGCTTTT CATGTCTGCC TTTCGCGGTT CGGCATTCAA ATGCCGTCTG
```

```
-continued
451    AACGCCGAAC CGTGCAGGTT AAATTGCCAT CAAATCTTCT TCTTTGGCAG

501    TCAGGAGTTT GTCGGCTTCG GTAATGTATT TGTCGGTCAG TTTTTGAACC

551    GCTTCTTCGC CGCGACGTGC CTCGTCTTCG GAAATTTCTT TGTCTTTGAG

601    GAGTTTTTTG ATGTGGTCGT TGGCATCGCG GCGCACGTTG CGGATAGAGA

651    CGCGGCCTTC TTCCGCTTCG CCGCGTACGA CTTTAATCAG GTCTTTGCGG

701    CGTTCCTCGG TCAGCATGGG CATCGGCACG CGGATCAGGT CGCCGACAGC

751    TGCCGGGTTC AGTCCCAAGT TTGA
```

This corresponds to the amino acid sequence <SEQ ID 1692;
ORF 568>:

```
m568.pep..
      1    MLRVRPVLFA VNASASSMPC RICRLKRSRL PNIFRRILFS CRRRTCFCKA

51    CKNSPIRNET SSSGRRQFSV EKANTVRYCT PSLAQCFTIF SNASKPRLCP

101    IMRGRKRFFA QRPLPSIITA ICLGMAVCSK TACVLLFMSA FRGSAFKCRL

151    NAEPCRLNCH QIFFFGSQEF VGFGNVFVGQ FLNRFFAATC LVFGNFFVFE

201    EFFDVVVGIA AHVADRDAAF FRFAAYDFNQ VFAAFLGQHG HRHADQVADS

251    CRVQSQV*
```

Computer analysis of this amino acid sequence gave the following results:
Homology with a Predicted ORF from *N. gonorrhoeae*
m568/g568 94.8% identity in 154 aa overlap

```
                10         20         30         40         50         60
m568.pep   MLRVRPVLFAVNASASSMPCRICRLKRSRLPNIFRRILFSCRRRTCFCKACKNSPIRNET
           ||||||||||:|||||:||||||||||||||||||||||||||||||||||||||||||
g568       MLRVRPVLFAVKASASSIPCRICRLKRSRLPNIFRRILFSCRRRTCFCKACKNSPIRNET
                10         20         30         40         50         60

70         80         90        100        110        120
m568.pep   SSSGRRQFSVEKANTVRYCTPSLAQCFTIFSNASKPRLCPIMRGRKRFFAQRPLPSIITA
           |||||||||||||||||||||||||||||||||||||||||:||||||||||||||||||
g568       SSSGRRQFSVEKANTVRYCTPSLAQCFTIFSNASKPRLCPIIRGRKRFFAQRPLPSIITA
                70         80         90        100        110        120

130        140        150        160        170        180
m568.pep   ICLGMAVCSKTACVLLFMSAFRGSAFKCRLNAEPCRLNCHQIFFFGSQEFVGFGNVFVGQ
           :|||||||| :|||||:|||||||||||| |
g568       MCLGMAVCSKMVCVLLFISAFRGSAFKCRLNAAPX
               130        140        150

190        200        210        220        230        240
m568.pep   FLNRFFAATCLVFGNFFVFEEFFDVVVGIAAHVADRDAAFFRFAAYDFNQVFAAFLGQHG
```

The following partial DNA sequence was identified in *N. meningitidis* <SEQ ID 1693>:

```
a568.seq
      1    ATGCTCAGGG TCAGGCCGGT ATTGTTTGCC GTCAAGGCTT CCGCCTCTTC

51    GATGCCCTTC AGGATTTGAC GGTTGAAGCG TTCGCGGCTG CCCAGTATTT

101    TCAGGCGCAT ATTGTTTTCG TGCAGGCGGC GTACCTGTTT TTGCAAAGCC

151    TGTAAAAACA GCCCCATCAG GAACGAAACT TCGTCTTCGG GGCGGCGCCA

201    GTTTTCGGTT GAAAAGGCAA ACACGGTCAG ATATTGCACA CCCAGTTTGG

251    CGCAATGCTT CACCATATTT TCCAATGCGT CCAAACCGCG TTTGTGTCCC

301    ATTATGCGCG GGAGGAAACG TTTTTTCGCC CAACGGCCGT TGCCGTCCAT

351    AATCACGGCG ATATGCTTGG GAATGGCGGT GTGTTCCAAA ACGGCCTGCG
```

-continued

```
401  TGCTGCTTTT CATGTCTGCC TTTCGCGGTT CGGCATTCAA ATGCCGTCTG
451  AACGCCGAAC CGTGCAGGTT AAATTGCCAT CAAATCTTCT TCTTTGGCAG
501  TCAGGAGTTT GTCGGCTTCG GTAATGTATT TGTCGGTCAG TTTTTGAACC
551  GCTTCTTCGC CGCGACGTGC CTCGTCTTCG GAAATTTCTT TGTCTTTGAG
601  GAGTTTTTTG ATGTGGTCGT TGGCATCGCG GCGCACGTTG CGGATGGAGA
651  CGCGGCCTTC TTCCGCTTCG CCGCGTACGA CTTTAATCAG GTCTTTGCGG
701  CGTTCCTCGG TCAGCATGGG CATCGGCACG CGGATCAGGT CGCCGACAGC
751  TGCCGGGTTC AGTCCCAAGT TTGA
```

This corresponds to the amino acid sequence <SEQ ID 1694; ORF 568.a>:

```
a568.pep
  1  MLRVRPVLFA VKASASSMPF RI*RLKRSRL PSIFRRILFS CRRRTCFCKA
 51  CKNSPIRNET SSSGRRQFSV EKANTVRYCT PSLAQCFTIF SNASKPRLCP
101  IMRGRKRFFA QRPLPSIITA ICLGMAVCSK TACVLLFMSA FRGSAFKCRL
151  NAEPCRLNCH QIFFFGSQEF VGFGNVFVGQ FLNRFFAATC LVFGNFFVFE
201  EFFDVVVGIA AHVADGDAAF FRFAAYDFNQ VFAAFLGQHG HRHADQVADS
251  CRVQSQV*
``` m568/a568 98.1% identity in 257 aa overlap

```
                10         20         30         40         50         60
m568.pep  MLRVRPVLFAVNASASSMPCRICRLKRSRLPNIFRRILFSCRRRTCFCKACKNSPIRNET
          ||||||||||:|||||| || ||||||||:||||||||||||||||||||||||||||||
a568      MLRVRPVLFAVKASASSMPFRIXRLKRSRLPSIFRRILFSCRRRTCFCKACKNSPIRNET
                10         20         30         40         50         60

70         80         90        100        110        120
m568.pep  SSSGRRQFSVEKANTVRYCTPSLAQCFTIFSNASKPRLCPIMRGRKRFFAQRPLPSIITA
          ||||||||||||||||||||||||||||||||||||||||||||||||||||||||||||
a568      SSSGRRQFSVEKANTVRYCTPSLAQCFTIFSNASKPRLCPIMRGRKRFFAQRPLPSIITA
                70         80         90        100        110        120

130        140        150        160        170        180
m568.pep  ICLGMAVCSKTACVLLFMSAFRGSAFKCRLNAEPCRLNCHQIFFFGSQEFVGFGNVFVGQ
          ||||||||||||||||||||||||||||||||||||||||||||||||||||||||||||
a568      ICLGMAVCSKTACVLLFMSAFRGSAFKCRLNAEPCRLNCHQIFFFGSQEFVGFGNVFVGQ
               130        140        150        160        170        180

190        200        210        220        230        240
m568.pep  FLNRFFAATCLVFGNFFVFEEFFDVVVGIAAHVADRDAAFFRFAAYDFNQVFAAFLGQHG
          |||||||||||||||||||||||||||||||||||:||||||||||||||||||||||||
a568      FLNRFFAATCLVFGNFFVFEEFFDVVVGIAAHVADGDAAFFRFAAYDFNQVFAAFLGQHG
               190        200        210        220        230        240

250
m568.pep  HRHADQVADSCRVQSQVX
          ||||||||||||||||||
a568      HRHADQVADSCRVQSQVX
               250
```

The following partial DNA sequence was identified in *N. gonorrhoeae* <SEQ ID 1695>:

```
g569.seq..
  1    atgctgaaac aacgggtaat aaccgctatg tggctgctgc cgctgatgct
 51    gggcatgctg ttttacgcgc cgcaatggct gtgggctgca ttttgcgggc
101    tgattgccct gaccgccttg tgggagtatg cccgtatggc cggtttgtgc
151    aaaaccgaaa ccaaccatta cctcgccgca accttggttt tcggcgtagt
```

```
-continued
201    tgcctatgcg ggcggctgga tgctgcctaa tttggtttgg tatgttgttt 251    tggcattttg gctcgccgtt atgcctttgt ggttgagatt caaatggagg 301    ctcaacggcg gttggcaggt ttatgccgtc ggctggcttt tgctcatgcc 351    gttttggttc gcgctcgtat ccctggcgcc cgcatcccga tga
```

This corresponds to the amino acid sequence <SEQ ID 1696; ORF 569.ng>:

```
g569.pep
    1   MLKQRVITAM WLLPLMLGML FYAPQWLWAA FCGLIALTAL WEYARMAGLC

51   KTETNHYLAA TLVFGVVAYA GGWMLPNLVW YVVLAFWLAV MPLWLRFKWR

101   LNGGWQVYAV GWLLLMPFWF ALVSLAPASR *
```

The following partial DNA sequence was identified in *N. meningitidis* <SEQ ID 1697>:

```
m569.seq..
    1       ATGCTGAAAC AACGGGTAAT AACCGCCATG TGGCTGCTGC CGCTGATGCT

51       GGGCATGCTG TTTTACGCGC CGCAATGGTT GTGGGCTGCA TTTTGCGGAC

101       TGATTGCCCT GATTGCCTTG TGGGAATATG CCCGTATGGG CGGTTTGTGC

151       AAAATTAAAA CCAACCATTA CCTCGCCGCA ACCTTGGTTT TCGGCGTGGT

201       TGCCTATGCG GGCGGCTGGA TGCTGCCTAA TTTGGTTTGG TATGTTGTTT

251       TGGCATTTTG GCTCGCCGTT ATGCCTTTAT GGTTGAGATT CAAATGGAGG

301       CTCAACGGCG GTTGGCAGGT TTATGCCGTC GGCTGGCTTC TGGTCATGCC

351       GTTTTGGTTC GCGCTCGTAT CCCTGCGCCC GCATCCCGAT GATGCCCTGC

401       CGCTGCTCGC CGTGATGGGT TTGGTGTGGG TTGCCGATAT TTGCGCGTAT

451       TTCAGCGGCA AGGCGTTCGG CAAACACAAA ATCGCGCCGG CAATCAGCCC

501       CGGCAAAAGC TGGGAAGGTG CAATCGGCGG CGCGGTTTGC GTGGCAGTGT

551       ACATGACCGC CGTACGAAGT GCCGGCTGGC TGGCATTCGA TACAGGCTGG

601       TTCGATACCG TGTTAATCGG TTTGGTGCTG ACCGTTGTCA GCGTATGCGG

651       CGACCTTTTG GAAAGCTGGC TCAAGCGCGC GGCAGGCATC AAAGACAGCA

701       GCAAGCTGCT GCCCGGACAC GGCGGCGTGT TCGACCGTAC CGACAGCCTG

751       ATTGCCGTTA TCAGCGTCTA TGCAGCGATG ATGTCGGTTT TAAATTGA
```

This corresponds to the amino acid sequence <SEQ ID 1698; ORF 569>:

```
m569.pep..
    1       MLKQRVITAM WLLPLMLGML FYAPQWLWAA FCGLIALIAL WEYARMGGLC

51       KIKTNHYLAA TLVFGVVAYA GGWMLPNLVW YVVLAFWLAV MPLWLRFKWR

101       LNGGWQVYAV GWLLVMPFWF ALVSLRPHPD DALPLLAVMG LVWVADICAY

151       FSGKAFGKHK IAPAISPGKS WEGAIGGAVC VAVYMTAVRS AGWLAFDTGW

201       FDTVLIGLVL TVVSVCGDLL ESWLKRAAGI KDSSKLLPGH GGVFDRTDSL

251       IAVISVYAAM MSVLN*
``` m569/g569 95.3% identity in 127 aa overlap

```
                 10         20         30         40         50         60
    m569.pep  MLKQRVITAMWLLPMLGMLFYAPQWLWAAFCGLIALIALWEYARMGGLCKIKTNHYLAA
              |||||||||||||||||||||||||||||||| ||||||||||||||:||||  :||||||||
    g569      MLKQRVITAMWLLPMLGMLFYAPQWLWAAFCGLTALIALWEYARMAGLCKTETNHYLAA
                 10         20         30         40         50         60

70         80         90        100        110        120
    m569.pep  TLVFGVVAYAGGWMLPNLVWYVVLAFWLAVMPLWLRFKWRLNGGWQVYAVGWLLVMPFWF
              ||||||||||||||||||||||||||||||||||||||||||||||||||||||:|||||
    g569      TLVFGVVAYAGGWMLPNLVWYVVLAFWLAVMPLWLRFKWRLNGGWQVYAVGWLLLMPFWF
                 70         80         90        100        110        120

130        140        150        160        170        180
    m569.pep  ALVSLRPHPDDALPLLAVMGLVWVADICAYFSGKAFGKHKIAPAISPGKSWEGAIGGAVC
              |||||  |
    g569      ALVSLAPASRX
                130
```

The following partial DNA sequence was identified in *N. meningitidis* <SEQ ID 1699>:

```
a569.seq
    1   ATGCTGAAAC AACGGGTGAT AACCGCCATG TGGCTGCTGC CGCTGATGCT

51   GGGCATGCTG TTTTACGCGC CGCAATGGTT GTGGGCTGCA TTTTGCGGAC

101   TGATTGCCCT GATTGCCTTG TGGGAATATG CCCGTATGGG CGGTTTGTGC

151   AAAATTAAAA CCAACCATTA CCTCGCCGCA ACCTTGGTTT TCGGCGTGGT

201   TGCCTATGCG GGCGGCTGGA TGCTGCCTAA TTTGGTTTGG TATGTTGTTT

251   TGGCATTTTG GCTCGCCGTT ATGCCTTTAT GGTTGAGATT CAAATGGAGG

301   CTCAACGGCG GTTGGCAGGT TTATGCCGTC GGCTGGCTTC TGGTCATGCC

351   GTTTTGGTTC GCGCTCGTAT CCCTGCGCCC GCATCCCGAT GATGCCCTGC

401   CGCTGCTCGC CGTGATGGGT TTGGTGTGGG TTGCCGATAT TTGCGCGTAT

451   TTCAGCGGCA AGGCGTTCGG CAAACACAAA ATCGCACCGG CAATCAGCCC

501   CGGCAAAAGC TGGGAAGGTG CAATCGGCGG CGCGGTTTGC GTGGCCGTGT

551   ACATGACCGC CGTACGAAGT GCCGGCTGGC TGGCATTCGA TACAGGCTGG

601   TTCGATACCG TGTTAATCGG TTTGGTGTTG ACCGTTGTCA GCGTATGCGG

651   CGACCTTTTG GAAAGCTGGC TCAAGCGCGC GGCAGGCATC AAAGACAGCA

701   GCAACCTGCT GCCCGGACAC GGCGGCGTGT TCGACCGCAC CGACAGCCTG

751   ATTGCCGTTA TCAGCGTCTA TGCAGCGATG ATGTCGGTTT AAATTGA
```

This corresponds to the amino acid sequence <SEQ ID 1700; ORF 569.a>:

```
a569.pep
    1   MLKQRVITAM WLLPLMLGML FYAPQWLWAA FCGLIALIAL WEYARMGGLC

51   KIKTNHYLAA TLVFGVVAYA GGWMLPNLVW YVVLAFWLAV MPLWLRFKWR

101   LNGGWQVYAV GWLLVMPFWF ALVSLRPHPD DALPLLAVMG LVWVADICAY

151   FSGKAFGKHK IAPAISPGKS WEGAIGGAVC VAVYMTAVRS AGWLAFDTGW

201   FDTVLIGLVL TVVSVCGDLL ESWLKRAAGI KDSSNLLPGH GGVFDRTDSL

251   IAVISVYAAM MSVLN*
``` m569/a569 99.6% identity in 265 aa overlap

```
                 10         20         30         40         50         60
m569.pep  MLKQRVITAMWLLPLMLGMLFYAPQWLWAAFCGLIALIALWEYARMGGLCKIKTNHYLAA
          ||||||||||||||||||||||||||||||||||||||||||||||||||||||||||||
a569      MLKQRVITAMWLLPLMLGMLFYAPQWLWAAFCGLIALIALWEYARMGGLCKIKTNHYLAA
                 10         20         30         40         50         60

70         80         90        100        110        120
m569.pep  TLVFGVVAYAGGWMLPNLVWYVVLAFWLAVMPLWLRFKWRLNGGWQVYAVGWLLVMPFWF
          ||||||||||||||||||||||||||||||||||||||||||||||||||||||||||||
a569      TLVFGVVAYAGGWMLPNLVWYVVLAFWLAVMPLWLRFKWRLNGGWQVYAVGWLLVMPFWF
                 70         80         90        100        110        120

130        140        150        160        170        180
m569.pep  ALVSLRPHPDDALPLLAVMGLVWVADICAYFSGKAFGKHKIAPAISPGKSWEGAIGGAVC
          ||||||||||||||||||||||||||||||||||||||||||||||||||||||||||||
a569      ALVSLRPHPDDALPLLAVMGLVWVADICAYFSGKAFGKHKIAPAISPGKSWEGAIGGAVC
                130        140        150        160        170        180

190        200        210        220        230        240
m569.pep  VAVYMTAVRSAGWLAFDTGWFDTVLIGLVLTVVSVCGDLLESWLKRAAGIKDSSKLLPGH
          |||||||||||||||||||||||||||||||||||||||||||||||||||||:||||
a569      VAVYMTAVRSAGWLAFDTGWFDTVLIGLVLTVVSVCGDLLESWLKRAAGIKDSSNLLPGH
                190        200        210        220        230        240

250        260
m569.pep  GGVFDRTDSLIAVISVYAAMMSVLNX
          ||||||||||||||||||||||||||
a569      GGVFDRTDSLIAVISVYAAMMSVLNX
                250        260
```

The following partial DNA sequence was identified in *N. gonorrhoeae* <SEQ ID 1701>:

```
g570.seq..
     1     atgatccgtt tgacccgcgc gtttgccgcc gccctgatcg gtttatgctg
    51     caccacaggc gcgcacgccg acaccttcca aaaaatcggc tttatcaaca
   101     ccgagcgcat ctacctcgaa tccaagcagg cgcgcaacat ccaaaaaacg
   151     ctggacggcg aattttccgc ccgtcaggac gaattgcaaa aactgcaacg
   201     cgaaggcttg gatttggaaa ggcagctcgc cggcggcaaa cttaaggacg
   251     caaaaaaggc gcaagccgaa gaaaaatggc gcgggctggt cgaagcgttc
   301     cgcaaaaaac aggcgcagtt tgaagaagac tacaacctcc gccgcaacga
   351     agagtttgcc tccctccagc aaaacgccaa ccgcgtcatc gtcaaaatcg
   401     ccaaacagga aggttacgat gtcattttgc aggacgtgat ttacgtcaac
   451     acccaatacg acgttaccga cagcgtcatt aaagaaatga acgcccgctg
   501     a
```

This corresponds to the amino acid sequence <SEQ ID 1702; ORF 570.ng>:

```
g570.pep..
     1     MIRLTRAFAA ALIGLCCTTG AHADTFQKIG FINTERIYLE SKQARNIQKT
    51     LDGEFSARQD ELQKLQREGL DLERQLAGGK LKDAKKAQAE EKWRGLVEAF
   101     RKKQAQFEED YNLRRNEEFA SLQQNANRVI VKIAKQEGYD VILQDVIYVN
   151     TQYDVTDSVI KEMNAR*
```

The following partial DNA sequence was identified in *N. meningitidis* <SEQ ID 1703>:

```
m570.seq..
    1    ATGACCCGTT TGACCCGCGC GTTTGCCGCG GCTCTGATCG GTTTGTGCTG

51    CACCGCAGGC GCGCACGCCG ACACCTTCCA AAAAATCGGC TTTATCAACA

101    CCGAGCGCAT CTACCTCGAA TCCAAGCAGG CGCGCAAGAT TCAAAAAACG

151    CTGGACAGCG AATTTTCCGC TCGTCAGGAC GAATTGCAAA AACTGCAACG

201    CGAAGGTCTG GATTTGGAAA GGCAGCTTGC CGAAGGCAAA CTCAGAAACG

251    CAAAAAAGGC GCAAGCCGAA GAAAAATGGC GCGGGCTGGT CGCAGCGTTC

301    CGCAAAAAAC AGGCGCAGTT TGAAGAAGAC TACAACCTCC GCCGCAACGA

351    AGAGTTTGCC TCCCTCCAGC AAAACGCCAA CCGCGTCATC GTCAAAATCG

401    CCAAACAGGA AGGTTACGAT GTCATTTTGC AGAACGTGAT TTACGTCAAC

451    ACCCAATACG ACGTTACCGA CAGCGTCATT AAAGAAATGA ACGCCCGCTG

501    A
```

This corresponds to the amino acid sequence <SEQ ID 1704; ORF 570>:

```
m570.pep
    1    MTRLTRAFAA ALIGLCCTAG AHADTFQKIG FINTERIYLE SKQARKIQKT

51    LDSEFSARQD ELQKLQREGL DLERQLAEGK LRNAKKAQAE EKWRGLVAAF

101    RKKQAQFEED YNLRRNEEFA SLQQNANRVI VKIAKQEGYD VILQNVIYVN

151    TQYDVTDSVI KEMNAR*
``` m570/g570 94.6% identity in 166 aa overlap

```
                10         20         30         40         50         60
m570.pep  MTRLTRAFAAALIGLCCTAGAHADTFQKIGFINTERIYLESKQARKIQKTLDSEFSARQD
          ||||||||||||||||||||:||||||||||||||||||||||||:|||||:|||||||
g570      MIRLTRAFAAALIGLCCTTGAHADTFQKIGFINTERIYLESKQARNIQKTLDGEFSARQD
                10         20         30         40         50         60

70         80         90        100        110        120
m570.pep  ELQKLQREGLDLERQLAEGKLRNAKKAQAEEKWRGLVAAFRKKQAQFEEDYNLRRNEEFA
          ||||||||||||||||||:::|||:|||||||||||||:|||||||||||||||||||||
g570      ELQKLQREGLDLERQLAGGKLKDAKKAQAEEKWRGLVEAFRKKQAQFEEDYNLRRNEEFA
                70         80         90        100        110        120

130        140        150        160
m570.pep  SLQQNANRVIVKIAKQEGYDVILQNVIYVNTQYDVTDSVIKEMNARX
          ||||||||||||||||||||||:|||||||||||||||||||||||
g570      SLQQNANRVIVKIAKQEGYDVILQDVIYVNTQYDVTDSVIKEMNARX
               130        140        150        160
```

The following partial DNA sequence was identified in *N. meningitidis* <SEQ ID 1705>:

```
a570.seq
    1    ATGACCCGTT TGACCCGCGC GTTTGCCGCG GCTCTGATCG GTTTGTGCTG

51    CACCGCAGGC GCGCACGCCG ACACCTTCCA AAAAATCGGC TTTATCAACA

101    CCGAGCGCAT CTACCTCGAA TCCAAGCAGG CGCGCAAGAT TCAAAAAACG

151    CTGGACAGCG AATTTTCCGC CCGCCAGGAC GAATTGCAAA AACTGCAACG

201    CGAAGGTCTG GATTTGGAAA GGCAGCTTGC CGAAGGCAAA CTCAAAGACG

251    CAAAAAAGGC GCAAGCCGAA GAAAAATGGT GCGGGCTGGT CGCAGCGTTC

301    CGCAAAAAAC AGGCGCAGTT TGAAGAAGAC TACAACCTCC GCCGCAACGA

351    AGAGTTTGCC TCCCTCCAGC AAAACGCCAA CCGCGTCATC GTCAAAATCG
```

```
                    -continued
401  CCAAACAGGA AGGTTACGAT GTCATTTTGC AGGACGTGAT TTACGTCAAC

451  ACCCAATACG ACGTTACCGA CAGCGTCATT AAAGAAATGA ACGCCCGCTG

501  A
```

This corresponds to the amino acid sequence <SEQ ID 1706; ORF 570.a>:

```
a570.pep
   1   MTRLTRAFAA ALIGLCCTAG AHADTFQKIG FINTERIYLE SKQARKIQKT

51   LDSEFSARQD ELQKLQREGL DLERQLAEGK LKDAKKAQAE EKWCGLVAAF

101   RKKQAQFEED YNLRRNEEFA SLQQNANRVI VKIAKQEGYD VILQDVIYVN

151   TQYDVTDSVI KEMNAR*
``` m570/a570 97.6% identity in 166 aa overlap

```
                 10        20        30        40        50        60
m570.pep  MTRLTRAFAAALIGLCCTAGAHADTFQKIGFINTERIYLESKQARKIQKTLDSEFSARQD
          ||||||||||||||||||||||||||||||||||||||||||||||||||||||||||||
a570      MTRLTRAFAAALIGLCCTAGAHADTFQKIGFINTERIYLESKQARKIQKTLDSEFSARQD
                 10        20        30        40        50        60
                 70        80        90       100       110       120
m570.pep  ELQKLQREGLDLERQLAEGKLRNAKKAQAEEKWRGLVAAFRKKQAQFEEDYNLRRNEEFA
          ||||||||||||||||||||::||||||||||| ||||||||||||||||||||||||||
a570      ELQKLQREGLDLERQLAEGKLKDAKKAQAEEKWCGLVAAFRKKQAQFEEDYNLRRNEEFA
                 70        80        90       100       110       120
                130       140       150       160
m570.pep  SLQQNANRVIVKIAKQEGYDVILQNVIYVNTQYDVTDSVIKEMNARX
          |||||||||||||||||||||||:|||||||||||||||||||||||
a570      SLQQNANRVIVKIAKQEGYDVILQDVIYVNTQYDVTDSVIKEMNARX
                130       140       150       160
```

The following partial DNA sequence was identified in *N. gonorrhoeae* <SEQ ID 1707>:

```
g571.seq (partial)
   1   atgcgcgttt tccgagtaaa ccgatttgtt gttaccgttt tcggcggcgg 51   tataggttct gccgtcccac acgctgcctg cgtcggcaaa caggctcagg 101   cggacggtgc gtgcgtcttt cgcaccgggc atcgggaaga gcagctcggc 151   ggagacgttg gcttttttgt tgccgccgta gctgattttt tcgccgtatt 201   cgtcatacac tttcgggccg agcgtgccgc tttcgtagcc gcgcaccgaa 251   cccaggccgc cgccgtagaa gttttcaaag aaggggattt ctttggttct 301   gccgtagccg cccgcaatgc cgacttcgcc gccgagcatc agcgtgaagg 351   ttttgct...
```

This corresponds to the amino acid sequence <SEQ ID 1708; ORF 571.ng>:

```
g571.pep (partial)
   1   MRVFRVNRFV VTVFGGGIGS AVPHAACVGK QAQADGACVF RTGHREEQLG

51   GDVGFFVAAV ADFFAVFVIH FRAERAAFVA AHRTQAAAVE VFKEGDFFGS

101   AVAARNADFA AEHQREGFA...
```

The following partial DNA sequence was identified in *N. meningitidis* <SEQ ID 1709>:

```
m571.seq
    1    ATGGGTATTG CCGGCGCCGT AAATGTTTTG AACCCTGCCG CCGGTCGCGG

51    AACTGCTGTT GTCGTCGTAG GTTTTGCCGT CCCACACGCT GCCTGCGTCG

101    GCAAACAGGC TCAGGCGGAC GGTGCGCGCG TCTTTCGCGC CGGGCATCGG

151    GAAGAGCAGC TCGGCGGAGA CGTTGGCTTT TTTGTTGCCG CCGTAGCTGA

201    TTTTTTCGCC GTATTCGTCA TAGACTTTCG GACCGAGCGT GCCGCTTTCG

251    TATCCGCGCA CCGAACCCAG GCCGCCGCCG TAGAAGTTTT CAAAGAAGGG

301    GATTTCTTTG GTTCTGCCGT AGCCGCCCGC AATGCCGACT TCGCCGCCGA

351    GCATCAGCGT GAAGGTTTTG CTCAGGGGGA AGAACCAGGT TTGGTTGTGG

401    GTGGCGGAGT AGTATTGCAG TTTGCTGCCA GGCAGGGCGA TTTCGGCGTT

451    CACGCCCGTC AGGTAGCCGC GCGTCGGCCA TAA
```

This corresponds to the amino acid sequence <SEQ ID 1710; ORF 571>:

```
m571.pep
    1    MGIAGAVNVL NPAAGRGTAV VVVGFAVPHA ACVGKQAQAD GARVFRAGHR

51    EEQLGGDVGF FVAAVADFFA VFVIDFRTER AAFVSAHRTQ AAAVEVFKEG

101    DFFGSAVAAR NADFAAEHQR EGFAQGEEPG LVVGGGVVLQ FAARQGDFGV

151    HARQVAARRP *
``` m571/g571 93.1% identity in 102 aa overlap

```
                  10         20         30         40         50         60
  m571.pep  MGIAGAVNVLNPAAGRGTAVVVVGFAVPHAACVGKQAQADGARVFRAGHREEQLGGDVGF
                 :| |||||||||||||||| |||:||||||||||||
  g571          MRVFRVNRFVVTVFGGGIGSAVPHAACVGKQAQADGACVFRTGHREEQLGGDVGF
                        10         20         30         40         50
                  70         80         90        100        110        120
  m571.pep  FVAAVADFFAVFVIDFRTERAAFVSAHRTQAAAVEVFKEGDFFGSAVAARNADFAAEHQR
            |||||||||||| ||:||||| :|||||||||||||||||||||||||||||||||||||
  g571      FVAAVADFFAVFVIHFRAERAAFVAAHRTQAAAVEVFKEGDFFGSAVAARNADFAAEHQR
                  60         70         80         90        100        110
                 130        140        150        160
  m571.pep  EGFAQGEEPGLVVGGGVVLQFAARQGDFGVHARQVAARRPX
            ||||
  g571      EGFA
             119
```

The following partial DNA sequence was identified in *N. meningitidis* <SEQ ID 1711>:

```
a571.seq
    1    ATGGGTATTG CCGGCGCCGT AAATGTTTTG AACCCTGCCG CCGGTCGCGG

51    AACTGCTGTT GTCGTCGTAG GTTTTGCCGT CCCACACGCT GCCTGCGTCG

101    GCAAACAGGC TCAGGCGGAC GGTGCGCGCG TCTTTCGCGC CGGGCATCGG

151    GAAGAGCAGC TCGGCGGAGA CGTTGGCTTT TTTGTTGCCG CCGTAGCTGA

201    TTTTTTCGCC GTATTCGTCA TACACTTTCG GACCGAGCGT GCCGCTTTCG

251    TATCCGCGCA CCGAACCCAG GCCGCCGCCG TAGAAGTTTT CAAAGAAGGG

301    GATTTCTTTG GTTCTGCCGT AGCCGCCCGC AATGCCGACT TCGCCGCCGA

351    GCATCAGCGT GAAGGTTTTG CTTAAGGGGA AGAACCAGGT TTGGTTGTGG
```

-continued
```
401  GTGGCGGAGT AGTATTGCAG TTTGCTGCCG GGCAGGGCGA TTTCGGCGTT

451  CACGCCCGTC AGGTAGCCGC GCGTCGGCCA TAA
```

This corresponds to the amino acid sequence <SEQ ID 1712; ORF 571.a>:

```
a571.pep
    1   MGIAGAVNVL NPAAGRGTAV VVVGFAVPHA ACVGKQAQAD GARVFRAGHR

51   EEQLGGDVGF FVAAVADFFA VFVIHFRTER AAFVSAHRTQ AAAVEVFKEG

101   DFFGSAVAAR NADFAAEHQR EGFA*GEEPG LVVGGGVVLQ FAAGQGDFGV

151   HARQVAARRP *
``` m571/a571 98.1% identity in 160 aa overlap

```
                 10         20         30         40         50         60
m571.pep  MGIAGAVNVLNPAAGRGTAVVVVGFAVPHAACVGKQAQADGARVFRAGHREEQLGGDVGF
          ||||||||||||||||||||||||||||||||||||||||||||||||||||||||||||
a571      MGIAGAVNVLNPAAGRGTAVVVVGFAVPHAACVGKQAQADGARVFRAGHREEQLGGDVGF
                 10         20         30         40         50         60
                 70         80         90        100        110        120
m571.pep  FVAAVADFFAVFVIDFRTERAAFVSAHRTQAAAVEVFKEGDFFGSAVAARNADFAAEHQR
          |||||||||||| ||||||||||||||||||||||||||||||||||||||||||||||
a571      FVAAVADFFAVFVIHFRTERAAFVSAHRTQAAAVEVFKEGDFFGSAVAARNADFAAEHQR
                 70         80         90        100        110        120
                130        140        150        160
m571.pep  EGFAQGEEPGLVVGGGVVLQFAARQGDFGVHARQVAARRPX
          ||||  ||||||||||||||||||| ||||||||||||||
a571      EGFAXGEEPGLVVGGGVVLQFAAGQGDFGVHARQVAARRPX
                130        140        150        160
```

The following partial DNA sequence was identified in *N. gonorrhoeae* <SEQ ID 1713>:

```
g572.seq..
     1     atgtgcgcca tcgtcgggc ggcggggctg ccttccgcgc tcgcagcggc 51     gcaaaaaggc aaaaccattt atctggcaaa caagaaacg ctggtggttt 101     ccggcgcgtt gtttatggaa accgcccgcg caaacggcgc ggcagtgttg 151     cccgtcgaca gcgaacacaa cgccattttc caagttttgc cgcgcgatta 201     cacagaccgt ctgaacgaac acggcatcga ttcgattatc ctgaccgctt 251     ccggcggccc gttttaaca accgatttaa gcacgttcga cagcattacg 301     cccgagcagg cggtcaaaca ccccaattgg cgtatggggc gcaaaatctc 351     cgtcgattca gccactatgg caaacaaggg cttggaactg attgaagcgc 401     attggctgtt caactgtccg cccgacaaac tcgaagtcgt catccatccc 451     caatccgtga tacacagtat ggtgcgctac cgcgacggct ccgtgctggc 501     gcaactgggc aatcccgata tgcgaacgcc catcgcctat tgtttgggct 551     tgcccgagcg catcgattcg ggtgtcggca aactcgattt cggcgcattg 601     tccgcgctga ccttccaaaa gcccgacttc ggccgcttcc cctgcctgaa 651     gttcgcctat gaaaccataa acgcaggcgg agccgcgccc tgcgtattga 701     acgccgccaa cgaaaccgcc gtcgccgcct ttttggacgg acagattaag 751     tttaccgaca ttgccaaaac cgtcgcccac tgtcttgcac aagacttttc
```

```
    801  aaacggcatg  ggcgatatag  aaggactgtt  ggcgcaagat  gcccggacac 851  gcgcacaagc  gcgggcattt  atcggcacac  tgcgctga
```

This corresponds to the amino acid sequence <SEQ ID 1714; ORF 572.ng>:

```
g572.pep..
      1    MCAIVGAAGL  PSALAAAQKG  KTIYLANKET  LVVSGALFME  TARANGAAVL

51    PVDSEHNAIF  QVLPRDYTDR  LNEHGIDSII  LTASGGPFLT  TDLSTFDSIT

101    PEQAVKHPNW  RMGRKISVDS  ATMANKGLEL  IEAHWLFNCP  PDKLEVVIHP

151    QSVIHSMVRY  RDGSVLAQLG  NPDMRTPIAY  CLGLPERIDS  GVGKLDFGAL

201    SALTFQKPDF  GRFPCLKFAY  ETINAGGAAP  CVLNAANETA  VAAFLDGQIK
```

The following partial DNA sequence was identified in *N. meningitidis* <SEQ ID 1715>:

```
m572.seq..
      1    ATGTGCGCCA  TCGTCGGGGC  GGTGGGGCTG  CCTTCCGCGC  TCGCAGCGGC

51    GCAAAAGGC   AAAACCATTT  ATCTGGCAAA  CAAAGAAACG  CTGGTGGTTT

101    CCGGCGCGTT  GTTTATGGAA  ACCGCCCGTG  CAAACGGCGC  GGCAGTGCTG

151    CCCGTCGACA  GCGAACACAC  CGCCGTTTTC  CAAGTTTTGC  CGCGCGATTA

201    CGCCGGCCGT  CTGAACGAAC  ACGGCATCGC  TTCGATTATC  CTGACCGCTT

251    CCGGCGGCCC  GTTTCTGACC  GCCGATTTAA  ACACGTTCGA  CCGCATTACG

301    CCCGCCCAAG  CGGTCAAACA  CCCCAATTGG  CGTATGGGAC  GCAAAATCTC

351    CGTCGATTCC  GCCACCATGA  TGAACAAAGG  TTTGGAGCTG  ATTGAAGCGC

401    ATTGGCTGTT  CAACTGTCCG  CCCGACAAAC  TCGAAGTCGT  CATCCATCCG

451    CAATCCGTGA  TACACAGCAT  GGTGCGCTAC  CGCGACGGCT  CCGTGCTGGC

501    GCAACTGGGC  AATCCCGATA  TGCGAACGCC  CATCGCTTAT  TGTTTGGGTT

551    TGCCCGAGCG  CATCGATTCG  GGTGTCGGCG  ACCTGGATTT  CGACGCATTG

601    TCCGCGCTGA  CCTTCCAAAA  GCCCGACTTT  GACCGCTTCC  CCTGCCTGAG

651    GCTCGCCTAT  GAAGCCATGA  ACGCAGGCGG  AGCCGCGCCC  TGCGTATTGA

701    ACGCCGCCAA  CGAAGCCGCC  GTCGCCGCCT  TTTTGGACGG  ACAGATTAAG

751    TTTACCGACA  TTGCCAAAAC  CGTCGCCCAC  TGTCTTGCAC  AAGACTTTTC

801    AGACGGCATA  GGCGATATAG  GGGGGCTCTT  GGCGCAAGAT  GCCCGGACAC

851    GCGCACAAGC  GCGAGCATTT  ATCGGCACAC  TGCGCTGA
```

This corresponds to the amino acid sequence <SEQ ID 1716; ORF 572>:

```
m572.pep..
      1    MCAIVGAVGL  PSALAAAQKG  KTIYLANKET  LVVSGALFME  TARANGAAVL

51    PVDSEHNAVF  QVLPRDYAGR  LNEHGIASII  LTASGGPFLT  ADLNTFDRIT

101    PAQAVKHPNW  RMGRKISVDS  ATMMNKGLEL  IEAHWLFNCP  PDKLEVVIHP

151    QSVIHSMVRY  RDGSVLAQLG  NPDMRTPIAY  CLGLPERIDS  GVGDLDFDAL

201    SALTFQKPDF  DRFPCLRLAY  EAMNAGGAAP  CVLNAANEAA  VAAFLDGQIK

251    FTDIAKTVAH  CLAQDFSDGI  GDIGGLLAQD  ARTRAQARAF  IGTLR*
``` m572/g572 92.9% identity in 295 aa overlap

```
                    10        20        30        40        50        60
     m572.pep  MCAIVGAVGLPSALAAAQKGKTIYLANKETLVVSGALFMETARANGAAVLPVDSEHNAVF
               |||||||:||||||||||||||||||||||||||||||||||||||||||||||||||:|
     g572      MCAIVGAAGLPSALAAAQKGKTIYLANKETLVVSGALFMETARANGAAVLPVDSEHNAIF
                    10        20        30        40        50        60

70        80        90       100       110       120
     m572.pep  QVLPRDYAGRLNEHGIASIILTASGGPFLTADLNTFDRITPAQAVKHPNWRMGRKISVDS
               ||||||:|||||||||:|||||||||||||::|||:|||:|||||||||||||||||||
     g572      QVLPRDYTDRLNEHGIDSIILTASGGPFLTTDLSTFDSITPEQAVKHPNWRMGRKISVDS
                    70        80        90       100       110       120

130       140       150       160       170       180
     m572.pep  ATMMNKGLELIEAHWLFNCPPDKLEVVIHPQSVIHSMVRYRDGSVLAQLGNPDMRTPIAY
               |||:||||||||||||||||||||||||||||||||||||||||||||||||||||||
     g572      ATMANKGLELIEAHWLFNCPPDKLEVVIHPQSVIHSMVRYRDGSVLAQLGNPDMRTPIAY
                   130       140       150       160       170       180

190       200       210       220       230       240
     m572.pep  CLGLPERIDSGVGDLDFDALSALTFQKPDFDRFPCLRLAYEAMNAGGAAPCVLNAANEAA
               ||||||||||||| ||||:||||||||||| |||:||:|::|||||||||||||||:|
     g572      CLGLPERIDSGVGKLDFGALSALTFQKPDFGRFPCLKFAYETINAGGAAPCVLNAANETA
                   190       200       210       220       230       240

250       260       270       280       290
     m572.pep  VAAFLDGQIKFTDIAKTVAHCLAQDFSDGIGDIGGLLAQDARTRAQARAFIGTLRX
               |||||||||||||||||||||||||||:|:|||||||||||||||||||||||||
     g572      VAAFLDGQIKFTDIAKTVAHCLAQDFSNGMGDIEGLLAQDARTRAQARAFIGTLRX
                   250       260       270       280       290
```

25
The following partial DNA sequence was identified in *N. meningitidis* <SEQ ID 1717>:

```
a572.seq
    1    ATGTGCGCCA TCGTCGGGGC GGTGGGGCTG CCTTCCGCGC TCGCAGCGGC

51    GCAAAAAGGC AAAACCATTT ATCTGGCGAA CAAAGAGACG CTGGTGGTTT

101    CCGGCGCGTT GTTTATGGAA ACCGCCCGTG CAAACGGCGC GGCAGTGCTG

151    CCCGTCGACA GCGAACACAA CGCCGTTTTC CAAGTTTTGC CGCGCGATTA

201    CACAGGTCGC CTGAACGAAC ACGGCATCGC TTCGATTATC CTGACCGCTT

251    CCGGCGGCCC GTTTCTGACC GCCGATTTAA ACACGTTCGA CAGCATTACG

301    CCCGACCAAG CGGTCAAACA CCCCAATTGG CGTATGGGAC GCAAAATCTC

351    CGTCGATTCC GCCACCATGA TGAACAAAGG TTTGGAGCTG ATTGAAGCGC

401    ATTGGCTGTT CAACTGTCCG CCCGACAAAC TCGAAGTCGT CATCCATCCG

451    CAATCTGTGA TACACAGCAT GGTGCGCTAC CGCGACGGCT CCGTGTTGGC

501    GCAACTGGGC AATCCCGATA TGCGAACGCC TATCGCTTAT TGTTTGGGTT

551    TGCCCGAGCG CATCGATTCG GGTGTCGGCG ACCTGGATTT CGACGCATTG

601    TCCGCGCTGA CCTTCCAAAA GCCCGACTTT GACCGCTTCC CCTGCCTGAA

651    GCTCGCCTAT GAAGCCATGA ACGCAGGCGG AGCCGCGCCC TGCGTATTGA

701    ACGCCGCCAA CGAAGCCGCC GTCGCCGCCT TTTTGGACGG ACAGATTAAG

751    TTTACCGACA TTGCCAAAAC CGTCGCCCAT TGTCTTTCAC AAGACTTTTC

801    AGACGGCATA GGCGACATAG GGGGCTCTT GGCGCAAGAT GCCCGGACAC

851    GCGCACAAGC GCGGGCATTT ATCGGCACAC TGCGCTGA
```

This corresponds to the amino acid sequence <SEQ ID 1718; ORF 572.a>:

```
a572.pep
    1    MCAIVGAVGL PSALAAAQKG KTIYLANKET LVVSGALFME TARANGAAVL

51    PVDSEHNAVF QVLPRDYTGR LNEHGIASII LTASGGPFLT ADLNTFDSIT
```

-continued

```
101    PDQAVKHPNW RMGRKISVDS ATMMNKGLEL IEAHWLFNCP PDKLEVVIHP

151    QSVIHSMVRY RDGSVLAQLG NPDMRTPIAY CLGLPERIDS GVGDLDFDAL

201    SALTFQKPDF DRFPCLKLAY EAMNAGGAAP CVLNAANEAA VAAFLDGQIK

251    FTDIAKTVAH CLSQDFSDGI GDIGGLLAQD ARTRAQARAF IGTLR*
``` m572/a572 98.3% identity in 295 aa overlap

```
                   10         20         30         40         50         60
m572.pep   MCAIVGAVGLPSALAAAQKGKTIYLANKETLVVSGALFMETARANGAAVLPVDSEHNAVF
           ||||||||||||||||||||||||||||||||||||||||||||||||||||||||||||
a572       MCAIVGAVGLPSALAAAQKGKTIYLANKETLVVSGALFMETARANGAAVLPVDSEHNAVF
                   10         20         30         40         50         60

70         80         90        100        110        120
m572.pep   QVLPRDYAGRLNEHGIASIILTASGGPFLTADLNTFDRITPAQAVKHPNWRMGRKISVDS
           ||||||| :||||||||||||||||||||||||||||| ||| |||||||||||||||||
a572       QVLPRDYIGRLNEHGIASIILTASGGPFLTADLNTFDSITPDQAVKHPNWRMGRKISVDS
                   70         80         90        100        110        120

130        140        150        160        170        180
m572.pep   ATMMNKGLELIEAHWLFNCPPDKLEVVIHPQSVIHSMVRYRDGSVLAQLGNPDMRTPIAY
           ||||||||||||||||||||||||||||||||||||||||||||||||||||||||||||
a572       ATMMNKGLELIEAHWLFNCPPDKLEVVIHPQSVIHSMVRYRDGSVLAQLGNPDMRTPIAY
                  130        140        150        160        170        180

190        200        210        220        230        240
m572.pep   CLGLPERIDSGVGDLDFDALSALTFQKPDFDRFPCLRLAYEAMNAGGAAPCVLNAANEAA
           |||||||||||||||||||||||||||||||||||| :||||||||||||||||||||||
a572       CLGLPERIDSGVGDLDFDALSALTFQKPDFDRFPCLKLAYEAMNAGGAAPCVLNAANEAA
                  190        200        210        220        230        240

250        260        270        280        290
m572.pep   VAAFLDGQIKFTDIAKTVAHCLAQDFSDGIGDIGGLLAQDARTRAQARAFIGTLRX
           |||||||||||||||||||||| :|||||||||||||||||||||||||||||||
a572       VAAFLDGQIKFTDIAKTVAHCLSQDFSDGIGDIGGLLAQDARTRAQARAFIGTLRX
                  250        260        270        280        290
```

The following partial DNA sequence was identified in *N. gonorrhoeae* <SEQ ID 1719>:

```
g573.seq..
     1     atgccctgtt tgtgccgcct taatcgcaat atcggcagtt tccaaatcac 51     gaatctcacc gaccataatg atgtccgggt cctgacgcag gaaagacttc 101     aaagcagcgg caaaagtcag accctgctta tcattgacgt taacctgatt 151     gatgcccggc aggttaatct cggcagggtc ttccgccgtt gcaatattta 201     ccgactccgt attcaaaata ttcaaacagg tatagagcga caccgtctta 251     cccgaacccg tcggaccggt taccagcacc atcccgtaag gacggtgaat 301     cgcttccaac aacaattttt tctggaacgg ctcaaaaccg agctggtcga 351     tgttcaaaga cgcggcatcg gaattcaaaa tccgcatcac gacctttttcg 401     ccaaacagcg tcggcaatgt gctgacacgg aaatcgacag gcttgccgcc 451     cttttgaaag gtcagctgca tcctaccgtc ctgcggtatc cgttttttcgg 501     aaatgtccaa acgcgacatt accttaatcc gggaagcaag ctgcccccctt 551     accgcaatgg gcggctgaac cacctcgcgg agctgcccgt ccacacggaa 601     acggatacgc gcattgtgtt cgtaaaactc gaaatggatg tcggatgccc 651     cgctacgcaa ggcatccgac aaagttttat ggataaacct cggaacaggg 701     ccgtcttctg cctcctcgtc gtcgatatac agggtgtggc tttcctcttc 751     ctcttgcccc tccccaagct cctgaagcag cgatgtcgaa cgcgaaccca 801     cccaatcgag caaacccgcc aactggtcat cctcgacaat gaccaactca
```

-continued

```
851     accgcaatcc ctgcggcaga aaccgttttc tgaatttgcg gcatctgggt 901     cggatcggaa accgcaaaaa atactttgtc gcccccacgg aaaaccggca 951     cacagtggaa ctccaccatc tgctcctccg tcaacacccc catcagcacc 1001    ctgtggcgcg gataatgacg caaatcaaga atcgaataac tgaacaccct 1051    cgcaatcaat gccgcaagcg acttgggcga aatgacaccg tctga
```

This corresponds to the amino acid sequence <SEQ ID 1720; ORF 573.ng>:

```
g573.pep..
  1     MPCLCRLNRN IGSFQITNLT DHNDVRVLTQ ERLQSSGKSQ TLLIIDVNLI

51     DARQVNLGRV FRRCNIYRLR IQNIQTGIER HRLTRTRRTG YQHHPVRTVN

101     RFQQQFFLER LKTELVDVQR RGIGIQNPHH DLFAKQRRQC ADTEIDRLAA

151     LLKGQLHPTV LRYPFFGNVQ TRHYLNPGSK LPPYRNGRLN HLAELPVHTE

201     TDTRIVFVKL EMDVGCPATQ GIRQSFMDKP RNRAVFCLLV VDIQGVAFLF

251     LLPLPKLLKQ RCRTRTHPIE QTRQLVILDN DQLNRNPCGR NRFLNLRHLG

301     RIGNRKKYFV APTENRHTVE LHHLLLRQHP HQHPVARIMT QIKNRITEHP

351     RNQCRKRLGR NDTV*
```

The following partial DNA sequence was identified in *N. meningitidis* <SEQ ID 1721>:

```
m573.seq..
  1     ATGCCCTGTT TGTGCCGCCT TAATCGCAAT ATCGGCAGTT TCCAAATCAC

51     GAATCTCACC GACCATAATG ATGTCCGGGT CCTGACGCAG GAAAGACTTC

101     AAAGCAGCGG CAAAAGTCAG GCCCTGCTTA TCATTGACGT TAACCTGATT

151     GATGCCCGGC AGGTTAATCT CGGCAGGGTC TTCCGCCGTT GCAATATTTA

201     CCGACTCCGT ATTCAAAATA TTCAAACAGG TATAGAGCGA CACCGTCTTA

251     CCCGAACCCG TCGGACCGGT TACCAGCACC ATCCCGTAGG GACGGTGAAT

301     CGCTACCAAC aCaw.TTTTT TCTGAAACGG CTCAAAACCG AGCTGGTCGA

351     TGTTCAAAGA CGCGGCATCG GAATTCAAAA TCCGCATCAC GACCTTTTCG

401     CCAAACAGCG TCGGCAATGT GCTGACACGG AAATCGACAG GCTTGCCGCC

451     CTTTTGAAAG GTCAGCTGCA TCCTGCCGTC CTGCGGTATC CGTTTTTCGG

501     AAATGTCCAA ACGCGACATT ACCTTAATCC GTGAAGCAAG CTGCCCCCTT

551     ACCGCAATGG GCGGCTGAAC CACCTCGCGG AGCTGCCCGT CCACACGGAA

601     ACGGATACGG GCATTGTGTT CGTAAAACTC GAAATGGATG TCCGATGCCC

651     CGCTGCGCAA GGCATCCGAC AAAGTCTTAT GGATAAACCT CGGAACAGGG

701     CCGTCTTCTG CCTCCTCGTT GTCGATATAC AGGGTGTGGC TTTCCTCTTC

751     CTCCTGCCCC TCCCCAAGCT CCTGAAGCAG CGATGTCGAA CGCGAACCCA

801     CCCAATCGAG CAAACCCGCC AACTGGTCAT CCTCGACAAT GACCAACTCA

851     ACCTCAATCC CTGCGGCAGA AACGGTTTTC TGAATTTGCG GCATCTGTGT

901     CGGATCGGAA ACCGCAAAAA ATACTTTGTC GCCCCGACGG AAAACCGGCA

951     CACAGTGGAA CTCCACCATC TGCTCCTCCG TCAACACCCC CATCAGCACC
```
-continued

```
1001    CTGTGGCGCG GATAATGACG CAAATCAAGA ATCGAATAAC TGAACACCCT

1051    CGCAATCAAT GCCGCAAGCG ACTTGGGCGA AATGACACCG TCTGA
```

This corresponds to the amino acid sequence <SEQ ID 1722; ORF 573>:

```
m573.pep..
   1    MPCLCRLNRN IGSFQITNLT DHNDVRVLTQ ERLQSSGKSQ ALLIIDVNLI

51    DARQVNLGRV FRRCNIYRLR IQNIQTGIER HRLTRTRRTG YQHHPVGTVN

101    RYQHXFFLKR LKTELVDVQR RGIGIQNPHH DLFAKQRRQC ADTEIDRLAA

151    LLKGQLHPAV LRYPFFGNVQ TRHYLNP*SK LPPYRNGRLN HLAELPVHTE

201    TDTGIVFVKL EMDVRCPAAQ GIRQSLMDKP RNRAVFCLLV VDIQGVAFLF

251    LLPLPKLLKQ RCRTRTHPIE QTRQLVILDN DQLNLNPCGR NGFLNLRHLC

301    RIGNRKKYFV APTENRHTVE LHHLLLRQHP HQHPVARIMT QIKNRITEHP

351    RNQCRKRLGR NDTV*
``` m573/g573 95.9% identity in 364 aa overlap

```
                   10        20        30        40        50        60
m573.pep   MPCLCRLNRNIGSFQITNLTDHNDVRVLTQERLQSSGKSQALLIIDVNLIDARQVNLGRV
           |||||||||||||||||||||||||||||||||||||||:||||||||||||||||||||
g573       MPCLCRLNRNIGSFQITNLTDHNDVRVLTQERLQSSGKSQTLLIIDVNLIDARQVNLGRV
                   10        20        30        40        50        60

70        80        90       100       110       120
m573.pep   FRRCNIYRLRIQNIQTGIERHRLTRTRRTGYQHHPVGTVNRYQHXFFLKRLKTELVDVQR
           |||||||||||||||||||||||||||||||||||| ||||:|: |||:|||||||||||
g573       FRRCNIYRLRIQNIQTGIERHRLTRTRRTGYQHHPVRTVNRFQQQFFLERLKTELVDVQR
                   70        80        90       100       110       120

130       140       150       160       170       180
m573.pep   RGIGIQNPHHDLFAKQRRQCADTEIDRLAALLKGQLHPAVLRYPFFGNVQTRHYLNPXSK
           |||||||||||||||||||||||||||||||||||||||:|||||||||||||||||| ||
g573       RGIGIQNPHHDLFAKQRRQCADTEIDRLAALLKGQLHPTVLRYPFFGNVQTRHYLNPGSK
                  130       140       150       160       170       180

190       200       210       220       230       240
m573.pep   LPPYRNGRLNHLAELPVHTETDTGIVFVKLEMDVRCPAAQGIRQSLMDKPRNRAVFCLLV
           |||||||||||||||||||||| |||||||||| |||:||||||:||||||||||||||
g573       LPPYRNGRLNHLAELPVHTETDTRIVFVKLEMDVGCPATQGIRQSFMDKPRNRAVFCLLV
                  190       200       210       220       230       240

250       260       270       280       290       300
m573.pep   VDIQGVAFLFLLPLPKLLKQRCRTRTHPIEQTRQLVILDNDQLNLNPCGRNGFLNLRHLC
           |||||||||||||||||||||||||||||||||||||||||||| |||||| |||||||
g573       VDIQGVAFLFLLPLPKLLKQRCRTRTHPIEQTRQLVILDNDQLNRNPCGRNRFLNLRHLG
                  250       260       270       280       290       300

310       320       330       340       350       360
m573.pep   RIGNRKKYFVAPTENRHTVELHHLLLRQHPHQHPVARIMTQIKNRITEHPRNQCRKRLGR
           ||||||||||||||||||||||||||||||||||||||||||||||||||||||||||||
g573       RIGNRKKYFVAPTENRHTVELHHLLLRQHPHQHPVARIMTQIKNRITEHPRNQCRKRLGR
                  310       320       330       340       350       360 m573.pep   NDTVX
           |||||
g573       NDTVX
```

The following partial DNA sequence was identified in *N. meningitidis* <SEQ ID 1723>:

```
a573.seq
     1  ATGCCCTGTT TGTGCCGCCT TAATCGCAAT ATCGGCAGTT TCCAAATCAC

51  GAATCTCACC GACCATAATG ATGTCCGGGT CCTGACGCAG GAAAGACTTC

101  AAAGCAGCGG CAAAAGTCAG ACCCTGCTTA TCATTGACGT TAACCTGATT

151  GATGCCCGGC AGGTTAATCT CGGCAGGGTC TTCCGCCGTT GCAATATTTA
```

```
 201  CCGACTCCGT ATTCAAAATA TTCAAACAGG TATAGAGCGA CACCGTCTTA
 251  CCCGAACCCG TCGGACCGGT TACCAGCACC ATCCCGTAGG GACGGTGAAT
 301  CGCTTCCAAC AACAATTTTT TCTGAAACGG CTCAAAACCG AGCTGGTCGA
 351  TGTTCAAAGA CGCGGCATCG GAATTCAAAA TCCGCATCAC GACCTTTTCG
 401  CCAAACAGCG TCGGCAATGT GCTGACACGG AAATCGACAG GCTTGCCGCC
 451  CTTTTGAAAG GTCAGCTGCA TCCTGCCGTC CTGCGGTATC CGTTTTTCGG
 501  AAATGTCCAA ACGCGACATT ACCTTAATCC GGGAAGCAAG CTGCCCCCTT
 551  ACCGCAATGG GCGGCTGAAC CACCTCGCGG AGCTGCCCGT CCACACGGAA
 601  ACGGATACGG GCATTGTGTT CGTAAAACTC GAAATGGATG TCCGATGCCC
 651  CGCTGCGCAA GGCATCCGAC AAAGTCTTAT GGATAAACCT CGGAACAGGG
 701  CCGTCTTCTG CCTCCTCGTT GTCGATATAC AGGGTGTGGC TTTCCTCTTC
 751  CTCCTGCCCC TCCCCAAGCT CCTGAAGCAG CGATGTCGAA CGCGAACCCA
 801  CCCAATCGAG CAAACCCGCC AACTGGTCAT CCTCGACAAT GACCAACTCA
 851  ACCTCAATCC CTGCGGCAGA AACGGTTTTC TGAATTTGCG GCATCTGTGT
 901  CGGATCGGAA ACCGCAAAAA ATACTTTGTC GCCCCGACGG AAAACCGGCA
 951  CACAGTGGAA CTCCACCATC TGCTCCTCCG TCAACACCCC CATCAGCACC
1001  CTGTGGCGCG GATAATGACG CAAATCAAGA ATCGAATAAC TGAACACCCT
1051  CGCAATCAAT GCCGCAAGCG ACTTGGGCGA AATGACACCG TCTGA
```

This corresponds to the amino acid sequence <SEQ ID 1724; ORF 573.a>:

```
a573.pep
   1   MPCLCRLNRN IGSFQITNLT DHNDVRVLTQ ERLQSSGKSQ TLLIIDVNLI

51   DARQVNLGRV FRRCNIYRLR IQNIQTGIER HRLTRTRRTG YQHHPVGTVN

101   RFQQQFFLKR LKTELVDVQR RGIGIQNPHH DLFAKQRRQC ADTEIDRLAA

151   LLKGQLHPAV LRYPFFGNVQ TRHYLNPGSK LPPYRNGRLN HLAELPVHTE

201   TDTGIVFVKL EMDVRCPAAQ GIRQSLMDKP RNRAVFCLLV VDIQGVAFLF

251   LLPLPKLLKQ RCRTRTHPIE QTRQLVILDN DQLNLNPCGR NGFLNLRHLC

301   RIGNRKKYFV APTENRHTVE LHHLLLRQHP HQHPVARIMT QIKNRITEHP

351   RNQCRKRLGR NDTV*
``` m573/a573 98.6% identity in 364 aa overlap

```
                   10         20         30         40         50         60
  m573.pep  MPCLCRLNRNIGSFQITNLTDHNDVRVLTQERLQSSGKSQALLIIDVNLIDARQVNLGRV
            ||||||||||||||||||||||||||||||||||||||||:|||||||||||||||||||
  a573      MPCLCRLNRNIGSFQITNLTDHNDVRVLTQERLQSSGKSQTLLIIDVNLIDARQVNLGRV
                   10         20         30         40         50         60

70         80         90        100        110        120
  m573.pep  FRRCNIYRLRIQNIQTGIERHRLTRTRRTGYQHHPVGTVNRYQHXFFLKRLKTELVDVQR
            |||||||||||||||||||||||||||||||||||||||||:|: |||||||||||||||
  a573      FRRCNIYRLRIQNIQTGIERHRLTRTRRTGYQHHPVGTVNRFQQQFFLKRLKTELVDVQR
                   70         80         90        100        110        120

130        140        150        160        170        180
  m573.pep  RGIGIQNPHHDLFAKQRRQCADTEIDRLAALLKGQLHPAVLRYPFFGNVQTRHYLNPXSK
            ||||||||||||||||||||||||||||||||||||||||||||||||||||||||| ||
  a573      RGIGIQNPHHDLFAKQRRQCADTEIDRLAALLKGQLHPAVLRYPFFGNVQTRHYLNPGSK
                  130        140        150        160        170        180
```

```
              190       200       210       220       230       240
m573.pep  LPPYRNGRLNHLAELPVHTETDTGIVFVKLEMDVRCPAAQGIRQSLMDKPRNRAVFCLLV
          ||||||||||||||||||||||||||||||||||||||||||||||||||||||||||||
a573      LPPYRNGRLNHLAELPVHTETDTGIVFVKLEMDVRCPAAQGIRQSLMDKPRNRAVFCLLV
              190       200       210       220       230       240

250       260       270       280       290       300
m573.pep  VDIQGVAFLFLLPLPKLLKQRCRTRTHPIEQTRQLVILDNDQLNLNPCGRNGFLNLRHLC
          ||||||||||||||||||||||||||||||||||||||||||||||||||||||||||||
a573      VDIQGVAFLFLLPLPKLLKQRCRTRTHPIEQTRQLVILDNDQLNLNPCGRNGFLNLRHLC
              250       260       270       280       290       300

310       320       330       340       350       360
m573.pep  RIGNRKKYFVAPTENRHTVELHHLLLRQHPHQHPVARIMTQIKNRITEHPRNQCRKRLGR
          ||||||||||||||||||||||||||||||||||||||||||||||||||||||||||||
a573      RIGNRKKYFVAPTENRHTVELHHLLLRQHPHQHPVARIMTQIKNRITEHPRNQCRKRLGR
              310       320       330       340       350       360 m573.pep  NDTVX
          |||||
a573      NDTVX
```

The following partial DNA sequence was identified in *N. gonorrhoeae* <SEQ ID 1725>:

```
g574.seq
    1 atgctgccga atctgccaaa cagccttaag aaagccgata tggacaacga 51 attgtggatt atcctgctgc cgattatcct tttgcccgtc ttcttcacga 101 tgggctggtt tgccgcccgc gtggatatga aaaccgtatt gaagcaggca 151 aaaagcatcc cttcgggatt ttataaaagc ctggacgctt tggtcgaccg 201 caacagcggg cgcgcggcaa gggagttggc ggaagtcgtc gacggccggc 251 cgcaatcgta tgatttgaac cttaccctcg gcaaacttta ccgtcagcgc 301 ggcgaaaacg acaaagccat caacatacac cggacaatgc tcgattctcc 351 cgatacggtc ggcgaaaagc gcgcgcgcgt cctgtttgaa ttggcgcaaa 401 actaccaaag cgcgggtttg gtcgatcgtg ccgaacagat ttttttgggg 451 ctgcaagacg gtgaaatggc gcgtgaagcc agacagcacc tgctcaatat 501 ctaccagcag gacagggatt gggaaaaagc ggttgaaacc gcccaacttc 551 ttagtcacga cgaacagaca tatcagtttg agattgcaca gttttattgc 601 gaacttgccc aagccgcgct gttcaagtcc aatttcgatg ccgcgcgttt 651 caatgtcggc aaggcactcg aagccaacaa aaaatgcacc cgcgccaaca 701 tgattttggg cgacattgaa caccgacaag gcaatttccc tgccgccgtc 751 gaagcctatg ccgccatcga gcagcaaaac catgcatact tgagcatggt 801 cggcgagaag ctttacgaag cctatgccgc gcagggaaaa cctgaagaag 851 gcttgaaccg tctgacagga tatatgcaga cgtttcccga acttgacctg 901 atcaatgtcg tgtacgagaa atccctgctg cttaagggcg agaaagaagc 951 cgcgcaaacc gccgtcgagc ttgtccgccg caagcccgac cttaacggcg 1001 tgtaccgcct gctcggtttg aaactcagcg atttggatcc ggcttggaaa 1051 gccgatgccg acatgatgcg ttcggttatc ggacggcagc tccagcgcag 1101 cgtgatgtac cgttgccgca actgccactt caaatcccaa gtctttttct 1151 ggcactgtcc cgcctgcaac aaatggcaga cgtttacgcc gaataaaatc 1201 gaagtttaa
```

This corresponds to the amino acid sequence <SEQ ID 1726; ORF 574.ng>:

```
g574.pep..
     1   MLPNLPNSLK KADMDNELWI ILLPIILLPV FFTMGWFAAR VDMKTVLKQA
    51   KSIPSGFYKS LDALVDRNSG RAARELAEVV DGRPQSYDLN LTLGKLYRQR
   101   GENDKAINIH RTMLDSPDTV GEKRARVLFE LAQNYQSAGL VDRAEQIFLG
   151   LQDGEMAREA RQHLLNIYQQ DRDWEKAVET AQLLSHDEQT YQFEIAQFYC
   201   ELAQAALFKS NFDAARFNVG KALEANKKCT RANMILGDIE HRQGNFPAAV
   251   EAYAAIEQQN HAYLSMVGEK LYEAYAAQGK PEEGLNRLTG YMQTFPELDL
   301   INVVYEKSLL LKGEKEAAQT AVELVRRKPD LNGVYRLLGL KLSDLDPAWK
   351   ADADMMRSVI GRQLQRSVMY RCRNCHFKSQ VFFWHCPACN KWQTFTPNKI
   401   EV*
```

The following partial DNA sequence was identified in *N. meningitidis* <SEQ ID 1727>:

```
m574.seq..
     1   ATGCGCCCGA ATCTACCAAA CAGCCTTAAG AAAGCCGATA TGGACAACGA
    51   ATTGTGGATT ATCCTGCTGC CGATTATCCT TTTGCCCGTC TTCTTCGCGA
   101   TGGGCTGGTT TGCCGCCCGC GTGGATATGA AAACCGTATT GAAGCAGGCA
   151   AAAAGCATCC CTTCGGGATT TTATAAAAGC TTGGACGCTT TGGTCGACCG
   201   CAACAGCGGG CGCGCGGCAA GGGAGTTGGC GGAAGTCGTC GACGGCCGGC
   251   CGCAATCGTA TGATTTGAAC CTCACCCTCG GCAAACTTTA CCGCCAGCGT
   301   GGCGAAAACG ACAAAGCCAT CAACATACAC CGGACAATGC TCGATTCTCC
   351   CGATACGGTC GGCGAAAAGC GCGCGCGCGT CCTGTTTGAA TTGGCGCAAA
   401   ACTACCAAAG TGCGGGGTTG GTCGATCGTG CCGAACAGAT TTTTTTGGGG
   451   CTGCAAGACG GTAAAATGGC GCGTGAAGCC AGACAGCACC TGCTCAATAT
   501   CTACCAACAG GACAGGGATT GGGAAAAAGC GGTTGAAACC GCCCGGCTGC
   551   TCAGCCATGA CGATCAGACC TATCAGTTTG AAATCGCCCA GTTTTATTGC
   601   GAACTTGCCC AAGCCGCGCT GTTCAAGTCC AATTTCGATG TCGCGCGTTT
   651   CAATGTCGGC AAGGCACTCG AAGCCAACAA AAAATGCACC CGCGCCAACA
   701   TGATTTTGGG CGACATCGAA CACCGACAAG GCAATTTCCC TGCCGCCGTC
   751   GAAGCCTATG CCGCCATCGA GCAGCAAAAC CATGCATACT TGAGCATGGT
   801   CGGCGAGAAG CTTTACGAAG CCTATGCCGC GCAGGGAAAA CCTGAAGAAG
   851   GCTTGAACCG TCTGACAGGA TATATGCAGA CGTTTCCCGA ACTTGACCTG
   901   ATCAATGTCG TGTACGAGAA ATCCCTGCTG CTTAAGTGCG AGAAAGAAGC
   951   CGCGCAAACC GCCGTCGAGC TTGTCCGCCG CAAGCCCGAC CTTAACGGCG
  1001   TGTACCGCCT GCTCGGTTTG AAACTCAGCG ATATGAATCC GGCTTGGAAA
  1051   GCCGATGCCG ACATGATGCG TTCGGTTATC GGACGGCAGC TACAGCGCAG
  1101   CGTGATGTAC CGTTGCCGCA ACTGCCACTT CAAATCCCAA GTCTTTTTCT
  1151   GGCACTGCCC CGCCTGCAAC AAATGGCAGA CGTTTACCCC GAATAAAATC
  1201   GAAGTTTAA
```

This corresponds to the amino acid sequence <SEQ ID 1728; ORF 574>:

```
m574.pep..
     1    MRPNLPNSLK KADMDNELWI ILLPIILLPV FFAMGWFAAR VDMKTVLKQA

51    KSIPSGFYKS LDALVDRNSG RAARELAEVV DGRPQSYDLN LTLGKLYRQR

101    GENDKAINIH RTMLDSPDTV GEKRARVLFE LAQNYQSAGL VDRAEQIFLG

151    LQDGKMAREA RQHLLNIYQQ DRDWEKAVET ARLLSHDDQT YQFEIAQFYC

201    ELAQAALFKS NFDVARFNVG KALEANKKCT RANMILGDIE HRQGNFPAAV

251    EAYAAIEQQN HAYLSMVGEK LYEAYAAQGK PEEGLNRLTG YMQTFPELDL

301    INVVYEKSLL LKCEKEAAQT AVELVRRKPD LNGVYRLLGL KLSDMNPAWK

351    ADADMMRSVI GRQLQRSVMY RCRNCHFKSQ VFFWHCPACN KWQTFTPNKI

401    EV*
``` m573/g573 97.8% identity in 402 aa overlap

```
                     10        20        30        40        50        60
m574.pep    MRPNLPNSLKKADMDNELWIILLPIILLPVFFAMGWFAARVDMKTVLKQAKSIPSGFYKS
            | ||||||||||||||||||||||||||||||||:|||||||||||||||||||||||||
g574        MLPNLPNSLKKADMDNELWIILLPIILLPVFFTMGWFAARVDMKTVLKQAKSIPSGFYKS
                     10        20        30        40        50        60

70        80        90       100       110       120
m574.pep    LDALVDRNSGRAARELAEVVDGRPQSYDLNLTLGKLYRQRGENDKAINIHRTMLDSPDTV
            ||||||||||||||||||||||||||||||||||||||||||||||||||||||||||||
g574        LDALVDRNSGRAARELAEVVDGRPQSYDLNLTLGKLYRQRGENDKAINIHRTMLDSPDTV
                     70        80        90       100       110       120

130       140       150       160       170       180
m574.pep    GEKRARVLFELAQNYQSAGLVDRAEQIFLGLQDGKMAREARQHLLNIYQQDRDWEKAVET
            ||||||||||||||||||||||||||||||||||||:|||||||||||||||||||||||
g574        GEKRARVLFELAQNYQSAGLVDRAEQIFLGLQDGEMAREARQHLLNIYQQDRDWEKAVET
                    130       140       150       160       170       180

190       200       210       220       230       240
m574.pep    ARLLSHDDQTYQFEIAQFYCELAQAALFKSNFDVARFNVGKALEANKKCTRANMILGDIE
            |:|||||:|||||||||||||||||||||||||:||||||||||||||||||||||||||
g574        AQLLSHDEQTYQFEIAQFYCELAQAALFKSNFDAARFNVGKALEANKKCTRANMILGDIE
                    190       200       210       220       230       240

250       260       270       280       290       300
m574.pep    HRQGNFPAAVEAYAAIEQQNHAYLSMVGEKLYEAYAAQGKPEEGLNRLTGYMQTFPELDL
            ||||||||||||||||||||||||||||||||||||||||||||||||||||||||||||
g574        HRQGNFPAAVEAYAAIEQQNHAYLSMVGEKLYEAYAAQGKPEEGLNRLTGYMQTFPELDL
                    250       260       270       280       290       300

310       320       330       340       350       360
m574.pep    INVVYEKSLLLKCEKEAAQTAVELVRRKPDLNGVYRLLGLKLSDMNPAWKADADMMRSVI
            ||||||||||| ||||||||||||||||||||||||||||||::||||||||||||||||
g574        INVVYEKSLLLKGEKEAAQTAVELVRRKPDLNGVYRLLGLKLSDLDPAWKADADMMRSVI
                    310       320       330       340       350       360

370       380       390       400
m574.pep    GRQLQRSVMYRCRNCHFKSQVFFWHCPACNKWQTFTPNKIEVX
            ||||||||||||||||||||||||||||||||||||||||||
g574        GRQLQRSVMYRCRNCHFKSQVFFWHCPACNKWQTFTPNKIEVX
                    370       380       390       400
```

The following partial DNA sequence was identified in *N. meningitidis* <SEQ ID 1729>:

```
a574.seq
     1   ATGCGCCCGA ATCTGCCAAA CAGCCTTGAG AAAGCCGATA TGGACAATGA

51   ATTGTGGATT ATCCTGCTGC CGATTATCCT TTTGCCCGTT TTCTTCGCGA

101   TGGGCTGGTT TGCCGCCCGC GTGGATATGA AGACTGTATT AAAGCAGGCA

151   AAAAGCATAC CGTCGGGATT TTATAAAAGT CTGGATGCCT TGGTTGACCG

201   CAACAGCGGG CGCGCGGCAA GGGAGTTGGC GGAAGTCGTC GACGGCCGGC

251   CGCAATCGTA TGATTTGAAC CTCACCCTCG GCAAACTTTA CCGCCAGCGT

301   GGCGAAAACG ACAAAGCCAT CAATATGCAC CAAACATTGC TTGACTCTCC
```

```
                           -continued
 351    CGATACAACC GGAGCCAAGC GCGCGCGCGT CCTGTTTGAA TTGGCGCAAA

401    ACTACCAAAG TGCGGGGTTG GTCGATCGTG CCGAACAGAT TTTTTTGGGG

451    CTGCAAGACG GTGAAATGGC GCGTGAAGCC AGACAGCACC TGCTCAATAT

501    CTACCAACAG GACAGGGATT GGGAAAAAGC GGTTGAAACC GCCCGGCTGC

551    TCAGCCATGA CGATCAGACC TATCAGTTTG AAATCGCCCA GTTTTATTGC

601    GAACTTGCCC AAGCCGCGCT GTTCAAGTCC AATTTCGATG CCGCGCGTTT

651    CAATGTCGGC AAGGCACTCG AAGCCAACAA AAAATGCACC CGCGCCAACA

701    TGATTTTGGG CGACATCGAA CACCGACAAG GCAATTTCCC TGCCGCCGTC

751    GAAGCCTATG CCGCCATCGA GCAGCAAAAC CATGCATACT TGAGTATGGT

801    CGGCGAGAAG CTTTACGAAG CCTATGCCGC GCAGGGAAAA CCTGAAGAAG

851    GCTTGAACCG TCTGACAGGA TATATGCAGA CGTTTCCCGA ACTTGACCTG

901    ATCAATGTCG TGTACGAGAA ATCCCTGCTG CTTAAGTGCG AGAAAGAAGC

951    CGCGCAAACC GCCGTCGAGC TTGTCCGCCG CAAGCCCGAC CTCAACGGCG

1001    TGTACCGCCT GCTTGGTTTG AAACTCAGCG ATTTGGATCC GGCTTGGAAA

1051    GCCGATGCCG ATATGATGCG TTCGGTTATC GGACGGCAGC TACAGCGCAG

1101    CGTGATGTAC CGGTGCCGAA ACTGCCACTT CAAATCACAA GTCTTTTTCT

1151    GGCATTGTCC TGCCTGCAAC AAATGGCAGA CGTTTACGCC AAACAAAATC

1201    GAAGTTTAA
```

This corresponds to the amino acid sequence <SEQ ID 1730; ORF 574.a>:

```
a574.pep
   1    MRPNLPNSLE KADMDNELWI ILLPIILLPV FFAMGWFAAR VDMKTVLKQA

51    KSIPSGFYKS LDALVDRNSG RAARELAEVV DGRPQSYDLN LTLGKLYRQR

101    GENDKAINMH QTLLDSPDTT GAKRARVLFE LAQNYQSAGL VDRAEQIFLG

151    LQDGEMAREA RQHLLNIYQQ DRDWEKAVET ARLLSHDDQT YQFEIAQFYC

201    ELAQAALFKS NFDAARFNVG KALEANKKCT RANMILGDIE HRQGNFPAAV

251    EAYAAIEQQN HAYLSMVGEK LYEAYAAQGK PEEGLNRLTG YMQTFPELDL

301    INVVYEKSLL LKCEKEAAQT AVELVRRKPD LNGVYRLLGL KLSDLDPAWK

351    ADADMMRSVI GRQLQRSVMY RCRNCHFKSQ VFFWHCPACN KWQTFTPNKI

401    EV*
``` m574/a574 97.5% identity in 402 aa overlap

```
                  10         20         30         40         50         60
  m574.pep  MRPNLPNSLKKADMDNELWIILLPIILLPVFFAMGWFAARVDMKTVLKQAKSIPSGFYKS
            ||||||||| :|||||||||||||||||||||||||||||||||||||||||||||||||
  a574      MRPNLPNSLEKADMDNELWIILLPIILLPVFFAMGWFAARVDMKTVLKQAKSIPSGFYKS
                  10         20         30         40         50         60

70         80         90        100        110        120
  m574.pep  LDALVDRNSGRAARELAEVVDGRPQSYDLNLTLGKLYRQRGENDKAINIHRTMLDSPDTV
            ||||||||||||||||||||||||||||||||||||||||||||||||:|:||||||||:
  a574      LDALVDRNSGRAARELAEVVDGRPQSYDLNLTLGKLYRQRGENDKAINMHQTLLDSPDTT
                  70         80         90        100        110        120

130        140        150        160        170        180
  m574.pep  GEKRARVLFELAQNYQSAGLVDRAEQIFLGLQDGKMAREARQHLLNIYQQDRDWEKAVET
            | |||||||||||||||||||||||||||||||||:||||||||||||||||||||||||
  a574      GAKRARVLFELAQNYQSAGLVDRAEQIFLGLQDGEMAREARQHLLNIYQQDRDWEKAVET
                 130        140        150        160        170        180
```

```
              190       200       210       220       230       240
m574.pep  ARLLSHDDQTYQFEIAQFYCELAQAALFKSNFDVARFNVGKALEANKKCTRANMILGDIE
          ||||||||||||||||||||||||||||||:|||||||||||||||||||||||||||||
a574      ARLLSHDDQTYQFEIAQFYCELAQAALFKSNFDAARFNVGKALEANKKCTRANMILGDIE
              190       200       210       220       230       240

250       260       270       280       290       300
m574.pep  HRQGNFPAAVEAYAAIEQQNHAYLSMVGEKLYEAYAAQGKPEEGLNRLTGYMQTFPELDL
          ||||||||||||||||||||||||||||||||||||||||||||||||||||||||||||
a574      HRQGNFPAAVEAYAAIEQQNHAYLSMVGEKLYEAYAAQGKPEEGLNRLTGYMQTFPELDL
              250       260       270       280       290       300

310       320       330       340       350       360
m574.pep  INVVYEKSLLLKCEKEAAQTAVELVRRKPDLNGVYRLLGLKLSDMNPAWKADADMMRSVI
          |||||||||||||||||||||||||||||||||||||||||||::|||||||||||||||
a574      INVVYEKSLLLKCEKEAAQTAVELVRRKPDLNGVYRLLGLKLSDLDPAWKADADMMRSVI
              310       320       330       340       350       360

370       380       390       400
m574.pep  GRQLQRSVMYRCRNCHFKSQVFFWHCPACNKWQTFTPNKIEVX
          ||||||||||||||||||||||||||||||||||||||||||
a574      GRQLQRSVMYRCRNCHFKSQVFFWHCPACNKWQTFTPNKIEVX
              370       380       390       400
```

The following partial DNA sequence was identified in *N. gonorrhoeae* <SEQ ID 1731>:

```
g575.seq (partial)
    1    ..atgccgtgcc tccgccggca agcagcaagg tgtacgaacc gccgaacaga
   51      ccgtcaaaca gtccgctttc ggtttcttct cggcagaaa cctgttcgac
  101      aggttcggca acgggttcgg cggcaacttc actggctgtt tccgcaacag
  151      gttcggaaac ggtgttaccg gtttcgtcgg tcggcgtgtc gatggcagaa
  201      gcggcggctt cttgggggg cggattcggc agcggtttcc gatgcggcag
  251      tatttgcagc gggtacaggt ccggttggc gttctgtcgc cgaagccgga
  301      gtttcggaca ctgcgggttt gggttcgggt cgaacggccg gttttccgc
  351      ttttgcttcg ggcgcggcaa cttttgcttc aggttttca accggttttt
  401      cgacaggttt ctctatcggt ttctccacag ttgcctgttt ggacggttca
  451      gacggcatgg atgcagtttc ggctttgggt ttcgccgttt gcggtttggg
  501      ttgttccgct ttgattttt tgggtgctgc cgctttgatc ctgttcagat
  551      tcggaatgtg a*
```

This corresponds to the amino acid sequence <SEQ ID 1732; ORF 575.ng>:

```
g575.pep (partial)
    1    ..MPCLRRQAAR CTNRRTDRQT VRFRFLLRQK PVRQVRQRVR RQLHWLFPQQ
   51      VRKRCYRFRR SACRWQKRRL LGGADSAAVS DAAVFAAGTG PGWRSVAEAG
  101      VSDTAGLGSG RTAGFSAFAS GAATFASGFS TGFSTGFSIG FSTVACLDGS
  151      DGMDAVSALG FAVCGLGCSA LIFLGAAALI LFRFGM*
```

The following partial DNA sequence was identified in *N. meningitidis* <SEQ ID 1733>:

```
m575.seq..
    1    ATGGTTTCGG GCGAGGAAGC CTTCAGGAAG CCTGCCAGTC CGGAGGGTGA
   51    GGCAGGTTTT GCGGAAGCTG TTTCTTCTGT GCCGATATGG TTGTTTGAGG
  101    GCAGGTTGTC GGAGAAATCG GTATCGACGG TTTCCGGTTT GTTTTCGGCA
  151    GTTTGGGCGA CAGATTCCGG TTCGGGCGTG TCGATGACGA TTTCGACAGG
```

-continued

```
   201    GTTGTACGGG TTGAAGGTCT CGGGCTCGTA CACGCTGTCT GTGGATTCGA

251    TGGCGTTCCA ATCGGCATCC GCGCGTTTTT GGGTTTCTTC ATCCTGCGTA

301    AGTGCGCCGG ATAAAATGCC GTTTTGCGCG GCTGCCAGGC TGTCGAAATC

351    CAAGTCGATG CGGTTGGAAG GCGTATCGGT TTCGACATCG AACGTTTGTT

401    TTGCCGATAA CTCTTCTTCA GATTCCCCAT CTAAGGCAAG TGTGTCGTTT

451    ACATCGTTTT TCGGAGCGGG TTCGGGCGTT GCCGGAGTTT CGACTTCGGC

501    AAAGGTGATT TCTATGCCGT CGTCTGCCGC GTCGTCAAGG TCAGGCTCTT

551    CCTCAGGGAC GGATTCTTCG GTACGGCGCG CGCGTTTGGA TTGGGCAAGG

601    CGCAAAGCA GCAGCAGGGC GATTAATGCC GCGCCTCCGC CGGCAAGCAG

651    CAAGGTGTAC GAACCGCCGA ACAGACCGTC AAACAGTCCG CTTTCGGTTT

701    CTTCTTCGGC AGAAACCTGT TCGACAGGTT CGGAAACGGC GTTACCGGTT

751    TCGTCGGTCG GCGTGTCGAT GGCAGAAGCG GCGGCTTCTT GGGGGGCGGA

801    TTCGGCAGCG GTTTCCGATG CGGCAGTATT GCAGCGGGT ACAGGTTCGG

851    GTCGAACGGC CGGTTTTTCC GCTTTTGCTT CGGGCGCGGC AACTTTTGCT

901    TCAGGTTTTT CAACCGGTTT CTCTACCGTT GCCTGTTTGG ACGGTTCGGA

951    CGGCATGGAT GCGGTTTCGG CTTTGGGTTT CGCCGTTTGC GGTTTGGGTT

1001    GTTCCGCTTT GATCCTGTTC AGATTCGGAA TGTGA
```

This corresponds to the amino acid sequence <SEQ ID 1734; ORF 575>:

```
m575.pep
     1    MVSGEEAFRK PASPEGEAGF AEAVSSVPIW LFEGRLSEKS VSTVSGLFSA

51    VWATDSGSGV SMTISTGLYG LKVSGSYTLS VDSMAFQSAS ARFWVSSSCV

101    SAPDKMPFCA AARLSKSKSM RLEGVSVSTS NVCFADNSSS DSPSKASVSF

151    TSFFGAGSGV AGVSTSAKVI SMPSSAASSR SGSSSGTDSS VRRARLDWAR

201    RKSSSRAINA APPPASSKVY EPPNRPSNSP LSVSSSAETC STGSETALPV

251    SSVGVSMAEA AASWGADSAA VSDAAVFAAG TGSGRTAGFS AFASGAATFA

301    SGFSTGFSTV ACLDGSDGMD AVSALGFAVC GLGCSALILF RFGM*
``` m575/g575 70.2% identity in 114 aa overlap

```
                240       250       260       270       280
m575.pep  SSAETCSTGSETALPVSSVGVSMAEAAASWGADSAAVSDAAVFAAGTG------------
                         ||||||||||||||||||
g575      LHWLFPQQVRKRCYRFRRSACRWQKRRLLGGADSAAVSDAAVFAAGTGPGWRSVAEAGVS
                  50        60        70        80        90       100

290       300       309       310       320
m575.pep  ------SGRTAGFSAFASGAATFASGFSTGFST--------VACLDGSDGMDAVSALGFA
                ||||||||||||||||||||||||||||         ||||||||||||||||||
g575      DTAGLGSGRTAGFSAFASGAATFASGFSTGFSTGFSIGFSTVACLDGSDGMDAVSALGFA
                 110       120       130       140       150       160

330       340
m575.pep  VCGLGCSALI--------LFRFGMX
          ||||||||||        |||||||
g575      VCGLGCSALIFLGAAALILFRFGMX
                 170       180
```

The following partial DNA sequence was identified in *N. meningitidis* <SEQ ID 1735>:

```
a575.seq
    1   ATGGTTTCGG GCGAGGAAGC CTTCAGGAAG CCTGCCAGTC CGGAGGGTGA
   51   GGCAGGTTTT GCGGAAGCTG TTTCTTCTGT GCCGATATGG TTGTTTGAGG
  101   GCAGGTTGTC GGAGAAATCG GTATCGACGG TTTCCGGTTT GTTTTCGGCA
  151   GTTTGGGCGA CAGATTCCGG TTCGGGCGTG TCGATGACGA TTTCGACAGG
  201   GTTGTACGGG TTGAAGGTCT CGGGCTCGTA CACGCTGTCT GTGGATTCGA
  251   TGGCGTTCCA ATCGGCATCC GCGCGTTTTT GGGTTTCTTC ATCCTGCGTA
  301   AGTGCGCCGG ATAAAATGCC GTTTTGCGCG GCTGCCAGGC TGTCGAAATC
  351   CAAGTCGATG CGGTTGGAAG GCGTATCGGT TTCGACATCG AACGTTTGTT
  401   TTGCCGACAA CTCTTCTTCA GATTCCCCAT CTAAGGCAAG TGTGTCGTTT
  451   ACATCGTTTT TCGGAGCGGG TTCGGGCGTT GCCGGAGTTT CGACTTCGGC
  501   AAAGGTGATT TCTATGCCGT CGTCTGCCGC GTCGTCAAGG TCAGGCTCTT
  551   CCTCAGGGAC GGATTCTTCG GTACGGCGCG CGCGTTTGGA TTGGGCAAGG
  601   CGCAAAAGCA GCAGCAGGGC GATCAATGCC GCGCCTCCGC CGGCAAGCAG
  651   CAAGGTGTAC GAACCGCCGA ACAGTCCGCT TTCGGTTTCT TCTTCGGCAG
  701   AAACCTGTTC GACAGGTTCG GAAACGGCGT TACCGGTTTC GTCGGTCGGC
  751   GTGTCGATGG CAGAAGCGGC GGCTTCTTGG GGGGCGGATT CGGCAGCGGT
  801   TTCCGATGCG GCAGTATTTG CAGCGGGTAC AGGTTCGGGT CGAACGGCCG
  851   GTTTTTCCGC TTTTGCTTCG GGCGCGGCAA CTTTTGCTTC AGGTTTTTCA
  901   ACCGGTTTCT CTACCGTTGC CTGTTTGGAC GGTTCGGACG GCATGGATGC
  951   GGTTTCGGCT TTGGGTTTCG CCGTTTGCGG TTTGGGTTGT TCCGCTTTGA
 1001   TCCTGTTCAG ATTCGGAATG TGA
```

This corresponds to the amino acid sequence <SEQ ID 1736; ORF 575.a>:

```
a575.pep
    1   MVSGEEAFRK PASPEGEAGF AEAVSSVPIW LFEGRLSEKS VSTVSGLFSA
   51   VWATDSGSGV SMTISTGLYG LKVSGSYTLS VDSMAFQSAS ARFWVSSSCV
  101   SAPDKMPFCA AARLSKSKSM RLEGVSVSTS NVCFADNSSS DSPSKASVSF
  151   TSFFGAGSGV AGVSTSAKVI SMPSSAASSR SGSSSGTDSS VRRARLDWAR
  201   RKSSSRAINA APPPASSKVY EPPNSPLSVS SSAETCSTGS ETALPVSSVG
  251   VSMAEAAASW GADSAAVSDA AVFAAGTGSG RTAGFSAFAS GAATFASGFS
  301   TGFSTVACLD GSDGMDAVSA LGFAVCGLGC SALILFRFGM *
``` m575/a575 98.8% identity in 344 aa overlap

```
                10         20         30         40         50         60
  m575.pep  MVSGEEAFRKPASPEGEAGFAEAVSSVPIWLFEGRLSEKSVSTVSGLFSAVWATDSGSGV
            ||||||||||||||||||||||||||||||||||||||||||||||||||||||||||||
  a575      MVSGEEAFRKPASPEGEAGFAEAVSSVPIWLFEGRLSEKSVSTVSGLFSAVWATDSGSGV
                10         20         30         40         50         60

70         80         90        100        110        120
  m575.pep  SMTISTGLYGLKVSGSYTLSVDSMAFQSASARFWVSSSCVSAPDKMPFCAAARLSKSKSM
            ||||||||||||||||||||||||||||||||||||||||||||||||||||||||||||
  a575      SMTISTGLYGLKVSGSYTLSVDSMAFQSASARFWVSSSCVSAPDKMPFCAAARLSKSKSM
                70         80         90        100        110        120
```

```
                       130        140        150        160        170        180
m575.pep   RLEGVSVSTSNVCFADNSSSDSPSKASVSFTSFFGAGSGVAGVSTSAKVISMPSSAASSR
           ||||||||||||||||||||||||||||||||||||||||||||||||||||||||||||
a575       RLEGVSVSTSNVCFADNSSSDSPSKASVSFTSFFGAGSGVAGVSTSAKVISMPSSAASSR
                       130        140        150        160        170        180

190        200        210        220        230        240
m575.pep   SGSSSGTDSSVRRARLDWARRKSSSRAINAAPPPASSKVYEPPNRPSNSPLSVSSSAETC
           ||||||||||||||||||||||||||||||||||||||||||||    ||||||||||||
a575       SGSSSGTDSSVRRARLDWARRKSSSRAINAAPPPASSKVYEPPN----SPLSVSSSAETC
                       190        200        210        220                230

250        260        270        280        290        300
m575.pep   STGSETALPVSSVGVSMAEAAASWGADSAAVSDAAVFAAGTGSGRTAGFSAFASGAATFA
           ||||||||||||||||||||||||||||||||||||||||||||||||||||||||||||
a575       STGSETALPVSSVGVSMAEAAASWGADSAAVSDAAVFAAGTGSGRTAGFSAFASGAATFA
                       240        250        260        270        280        290

310        320        330        340
m575.pep   SGFSTGFSTVACLDGSDGMDAVSALGFAVCGLGCSALILFRFGMX
           |||||||||||||||||||||||||||||||||||||||||||||
a575       SGFSTGFSTVACLDGSDGMDAVSALGFAVCGLGCSALILFRFGMX
                       300        310        320        330        340
```

The following partial DNA sequence was identified in *N. gonorrhoeae* <SEQ ID 1737>:

```
g576.seq.. (partial)
      1    ..atgggcgtgg acatcggacg ctccctgaaa caaatgaagg aacagggcgc
     51      ggaaatcgat ttgaaagtct ttaccgatgc catgcaggca gtgtatgacg
    101      gcaaagaaat caaaatgacc gaagagcagg cccaggaagt gatgatgaaa
    151      ttcctgcagg agcagcaggc taaagccgta gaaaaacaca aggcggatgc
    201      gaaggccaac aaagaaaaag gcgaagcctt cctgaaggaa atgccgccg
    251      aagacggcgt gaagaccact gcttccggtc tgcagtacaa aatcaccaaa
    301      cagggtgaag gcaaacagcc gacaaaagac gacatcgtta ccgtggaata
    351      cgaaggccgc ctgattgacg gtaccgtatt cgacagcagc aaagccaacg
    401      gcggcccggc caccttccct ttgagccaag tgattccggg ttggaccgaa
    451      ggcgtacggc ttctgaaaga aggcggcgaa gccacgttct acatcccgtc
    501      caaccttgcc taccgcgaac agggtgcggg cgaaaaaatc ggtccgaacg
    551      ccactttggt atttgacgtg aaactggtca aaatcggcgc acccgaaaac
    601      gcgcccgcca agcagccgga tcaagtcgac atcaaaaaag taaattaa
                                                          45
```

This corresponds to the amino acid sequence <SEQ ID 1738; ORF 576.ng>:

```
g576.pep.. (partial)
      1    ..MGVDIGRSLK QMKEQGAEID LKVFTDAMQA VYDGKEIKMT EEQAQEVMMK
     51      FLQEQQAKAV EKHKADAKAN KEKGEAFLKE NAAEDGVKTT ASGLQYKITK
    101      QGEGKQPTKD DIVTVEYEGR LIDGTVFDSS KANGGPATFP LSQVIPGWTE
    151      GVRLLKEGGE ATFYIPSNLA YREQGAGEKI GPNATLVFDV KLVKIGAPEN
    201      APAKQPDQVD IKKVN*
```

The following partial DNA sequence was identified in *N. meningitidis* <SEQ ID 1739>:

```
m576.seq.. (partial)
      1    ..ATGCAGCAGG CAAGCTATGC GATGGGCGTG GACATCGGAC GCTCCCTGAA
     51      GCAAATGAAG GAACAGGGCG CGGAAATCGA TTTGAAAGTC TTTACCGAAG
```

-continued

```
101    CCATGCAGGC AGTGTATGAC GGCAAAGAAA TCAAAATGAC CGAAGAGCAG

151    GCTCAGGAAG TCATGATGAA ATTCCTTCAG GAACAACAGG CTAAAGCCGT

201    AGAAAAACAC AAGGCGGACG CGAAGGCCAA TAAAGAAAAA GGCGAAGCCT

251    TTCTGAAAGA AAATGCCGCC AAAGACGGCG TGAAGACCAC TGCTTCCGGC

301    CTGCAATACA AAATCACCAA ACAGGGCGAA GGCAAACAGC CGACCAAAGA

351    CGACATCGTT ACCGTGGAAT ACGAAGGCCG CCTGATTGAC GGTACGGTAT

401    TCGACAGCAG CAAAGCCAAC GGCGGCCCGG TCACCTTCCC TTTGAGCCAA

451    GTGATTCCGG GTTGGACCGA AGgCGTACAG CTTCTGAAAG AAGGCGGCGA

501    AGCCACGTTC TACATCCCGT CCAACCTTGC CTACCGCGAA CAGGGTGCGG

551    GCGACAAAAT CGGTCCGAAC GCCACTTTGG TATTTGATGT GAAACTGGTC

601    AAAATCGGCG CACCCGAAAA CGCGCCCGCC AAGCAGCCGG CTCAAGTCGA

651    CATCAAAAAA GTAAATTAA
```

This corresponds to the amino acid sequence <SEQ ID 1740; ORF 576>:

```
m576.pep.. (partial)
     1    ..MQQASYAMGV DIGRSLKQMK EQGAEIDLKV FTEAMQAVYD GKEIKMTEEQ

51    AQEVMMKFLQ EQQAKAVEKH KADAKANKEK GEAFLKENAA KDGVKTTASG

101    LQYKITKQGE GKQPTKDDIV TVEYEGRLID GTVFDSSKAN GGPVTFPLSQ

151    VIPGWTEGVQ LLKEGGEATF YIPSNLAYRE QGAGDKIGPN ATLVFDVKLV

201    KIGAPENAPA KQPAQVDIKK VN*
```

Computer analysis of this amino acid sequence gave the following results:
Homology with a Predicted ORF from *N. gonorrhoeae*
m576/g576 97.2% identity in 215 aa overlap

```
                    10         20         30         40         50         60
m576.pep    MQQASYAMGVDIGRSLKQMKEQGAEIDLKVFTEAMQAVYDGKEIKMTEEQAQEVMMKFLQ
                     ||||||||||||||||||||||||:||||||||||||||||||||||||||
g576                 MGVDIGRSLKQMKEQGAEIDLKVFTDAMQAVYDGKEIKMTEEQAQEVMMKFLQ
                             10         20         30         40         50
                    70         80         90        100        110        120
m576.pep    EQQAKAVEKHKADAKANKEKGEAFLKENAAKDGVKTTASGLQYKITKQGEGKQPTKDDIV
            ||||||||||||||||||||||||||||||:|||||||||||||||||||||||||||||
g576        EQQAKAVEKHKADAKANKEKGEAFLKENAAEDGVKTTASGLQYKITKQGEGKQPTKDDIV
                    60         70         80         90        100        110
                   130        140        150        160        170        180
m576.pep    TVEYEGRLIDGTVFDSSKANGGPVTFPLSQVIPGWTEGVQLLKEGGEATFYIPSNLAYRE
            |||||||||||||||||||||||:||||||||||||||:|||||||||||||||||||||
g576        TVEYEGRLIDGTVFDSSKANGGPATFPLSQVIPGWTEGVRLLKEGGEATFYIPSNLAYRE
                   120        130        140        150        160        170
                   190        200        210        220
m576.pep    QGAGDKIGPNATLVFDVKLVKIGAPENAPAKQPAQVDIKKVNX
            ||||:||||||||||||||||||||||||||| |||||||||
g576        QGAGEKIGPNATLVFDVKLVKIGAPENAPAKQPDQVDIKKVNX
                   180        190        200        210
```

The following partial DNA sequence was identified in *N. meningitidis* <SEQ ID 1741>:

```
a576.seq
     1    ATGAACACCA TTTTCAAAAT CAGCGCACTG ACCCTTTCCG CCGCTTTGGC

51    ACTTTCCGCC TGCGGCAAAA AAGAAGCCGC CCCCGCATCT GCATCCGAAC
```

-continued

```
 101   CTGCCGCCGC TTCTTCCGCG CAGGGCGACA CCTCTTCGAT CGGCAGCACG
 151   ATGCAGCAGG CAAGCTATGC GATGGGCGTG GACATCGGAC GCTCCCTGAA
 201   GCAAATGAAG GAACAGGGCG CGGAAATCGA TTTGAAAGTC TTTACCGAAG
 251   CCATGCAGGC AGTGTATGAC GGCAAAGAAA TCAAAATGAC CGAAGAGCAG
 301   GCTCAGGAAG TCATGATGAA ATTCCTTCAG GAACAACAGG CTAAAGCCGT
 351   AGAAAAACAC AAGGCGGACG CGAAGGCCAA TAAAGAAAAA GGCGAAGCCT
 401   TTCTGAAAGA AAATGCCGCC AAAGACGGCG TGAAGACCAC TGCTTCCGGC
 451   CTGCAATACA AAATCACCAA ACAGGGCGAA GGCAAACAGC CGACCAAAGA
 501   CGACATCGTT ACCGTGGAAT ACGAAGGCCG CCTGATTGAC GGTACGGTAT
 551   TCGACAGCAG CAAAGCCAAC GGCGGCCCGG TCACCTTCCC TTTGAGCCAA
 601   GTGATTCTGG GTTGGACCGA AGGCGTACAG CTTCTGAAAG AAGGCGGCGA
 651   AGCCACGTTC TACATCCCGT CCAACCTTGC CTACCGCGAA CAGGGTGCGG
 701   GCGACAAAAT CGGCCCGAAC GCCACTTTGG TATTTGATGT GAAACTGGTC
 751   AAAATCGGCG CACCCGAAAA CGCGCCCGCC AAGCAGCCGG CTCAAGTCGA
 801   CATCAAAAAA GTAAATTAA
```

This corresponds to the amino acid sequence <SEQ ID 1742; ORF 576.a>:

```
a576.pep
   1   MNTIFKISAL TLSAALALSA CGKKEAAPAS ASEPAAASSA QGDTSSIGST
  51   MQQASYAMGV DIGRSLKQMK EQGAEIDLKV FTEAMQAVYD GKEIKMTEEQ
 101   AQEVMMKFLQ EQQAKAVEKH KADAKANKEK GEAFLKENAA KDGVKTTASG
 151   LQYKITKQGE GKQPTKDDIV TVEYEGRLID GTVFDSSKAN GGPVTFPLSQ
 201   VILGWTEGVQ LLKEGGEATF YIPSNLAYRE QGAGDKIGPN ATLVFDVKLV
 251   KIGAPENAPA KQPAQVDIKK VN*
``` m576/a576 99.5% identity in 222 aa overlap

```
                             10         20         30
   m576.pep                  MQQASYAMGVDIGRSLKQMKEQGAEIDLKV
                             |||||||||||||||||||||||||||||
   a576       CGKKEAAPASASEPAAASSAQGDTSSIGSTMQQASYAMGVDIGRSLKQMKEQGAEIDLKV
                      30        40        50        60        70        80

40        50        60        70        80        90
   m576.pep  FTEAMQAVYDGKEIKMTEEQAQEVMMKFLQEQQAKAVEKHKADAKANKEKGEAFLKENAA
             ||||||||||||||||||||||||||||||||||||||||||||||||||||||||||||
   a576      FTEAMQAVYDGKEIKMTEEQAQEVMMKFLQEQQAKAVEKHKADAKANKEKGEAFLKENAA
                      90       100       110       120       130       140

100       110       120       130       140       150
   m576.pep  KDGVKTTASGLQYKITKQGEGKQPTKDDIVTVEYEGRLIDGTVFDSSKANGGPVTFPLSQ
             ||||||||||||||||||||||||||||||||||||||||||||||||||||||||||||
   a576      KDGVKTTASGLQYKITKQGEGKQPTKDDIVTVEYEGRLIDGTVFDSSKANGGPVTFPLSQ
                     150       160       170       180       190       200

160       170       180       190       200       210
   m576.pep  VIPGWTEGVQLLKEGGEATFYIPSNLAYREQGAGDKIGPNATLVFDVKLVKIGAPENAPA
             || |||||||||||||||||||||||||||||||||||||||||||||||||||||||||
   a576      VILGWTEGVQLLKEGGEATFYIPSNLAYREQGAGDKIGPNATLVFDVKLVKIGAPENAPA
                     210       220       230       240       250       260

220
   m576.pep  KQPAQVDIKKVNX
             |||||||||||||
   a576      KQPAQVDIKKVNX
                     270
```

The following partial DNA sequence was identified in *N. gonorrhoeae* <SEQ ID 1743>:

```
g576-1.seq
       1    ATGAACACCA TTTTCAAAAT CAGCGCACTG ACCCTTTCCG CCGCTTTGGC
      51    ACTTTCCGCC TGCGGCAAAA AAGAAGCCGC CCCCGCATCT GCATCCGAAC
     101    CTGCCGCCGC TTCTGCCGCG CAGGGCGACA CCTCTTCAAT CGGCAGCACG
     151    ATGCAGCAGG CAAGCTATGC AATGGGCGTG GACATCGGAC GCTCCCTGAA
     201    ACAAATGAAG GAACAGGGCG CGGAAATCGA TTTGAAAGTC TTTACCGATG
     251    CCATGCAGGC AGTGTATGAC GGCAAAGAAA TCAAAATGAC CGAAGAGCAG
     301    GCCCAGGAAG TGATGATGAA ATTCCTGCAG GAGCAGCAGG CTAAAGCCGT
     351    AGAAAAACAC AAGGCGGATG CGAAGGCCAA CAAAGAAAAA GGCGAAGCCT
     401    TCCTGAAGGA AAATGCCGCC AAAGACGGCG TGAAGACCAC TGCTTCCGGT
     451    CTGCAGTACA AAATCACCAA ACAGGGTGAA GGCAAACAGC CGACAAAAGA
     501    CGACATCGTT ACCGTGGAAT ACGAAGGCCG CCTGATTGAC GGTACCGTAT
     551    TCGACAGCAG CAAAGCCAAC GGCGGCCCGG CCACCTTCCC TTTGAGCCAA
     601    GTGATTCCGG GTTGGACCGA AGGCGTACGG CTTCTGAAAG AAGGCGGCGA
     651    AGCCACGTTC TACATCCCGT CCAACCTTGC CTACCGCGAA CAGGGTGCGG
     701    GCGAAAAAAT CGGTCCGAAC GCCACTTTGG TATTTGACGT GAAACTGGTC
     751    AAAATCGGCG CACCCGAAAA CGCGCCCGCC AAGCAGCCGG ATCAAGTCGA
     801    CATCAAAAAA GTAAATTAA
```

This corresponds to the amino acid sequence <SEQ ID 1744; ORF 576-1.ng>:

```
g576-1.pep
       1    MNTIFKISAL TLSAALALSA CGKKEAAPAS ASEPAAASAA QGDTSSIGST
      51    MQQASYAMGV DIGRSLKQMK EQGAEIDLKV FTDAMQAVYD GKEIKMTEEQ
     101    AQEVMMKFLQ EQQAKAVEKH KADAKANKEK GEAFLKENAA KDGVKTTASG
     151    LQYKITKQGE GKQPTKDDIV TVEYEGRLID GTVFDSSKAN GGPATFPLSQ
     201    VIPGWTEGVR LLKEGGEATF YIPSNLAYRE QGAGEKIGPN ATLVFDVKLV
     251    KIGAPENAPA KQPDQVDIKK VN*
```

The following partial DNA sequence was identified in *N. meningitidis* <SEQ ID 1745>:

```
m576-1.seq
       1    ATGAACACCA TTTTCAAAAT CAGCGCACTG ACCCTTTCCG CCGCTTTGGC
      51    ACTTTCCGCC TGCGGCAAAA AAGAAGCCGC CCCCGCATCT GCATCCGAAC
     101    CTGCCGCCGC TTCTTCCGCG CAGGGCGACA CCTCTTCGAT CGGCAGCACG
     151    ATGCAGCAGG CAAGCTATGC GATGGGCGTG GACATCGGAC GCTCCCTGAA
     201    GCAAATGAAG GAACAGGGCG CGGAAATCGA TTTGAAAGTC TTTACCGAAG
     251    CCATGCAGGC AGTGTATGAC GGCAAAGAAA TCAAAATGAC CGAAGAGCAG
     301    GCTCAGGAAG TCATGATGAA ATTCCTTCAG GAACAACAGG CTAAAGCCGT
     351    AGAAAAACAC AAGGCGGACG CGAAGGCCAA TAAAGAAAAA GGCGAAGCCT
     401    TTCTGAAAGA AAATGCCGCC AAAGACGGCG TGAAGACCAC TGCTTCCGGC
```

```
                         -continued
451     CTGCAATACA AAATCACCAA ACAGGGCGAA GGCAAACAGC CGACCAAAGA

501     CGACATCGTT ACCGTGGAAT ACGAAGGCCG CCTGATTGAC GGTACGGTAT

551     TCGACAGCAG CAAAGCCAAC GGCGGCCCGG TCACCTTCCC TTTGAGCCAA

601     GTGATTCCGG GTTGGACCGA AGGCGTACAG CTTCTGAAAG AAGGCGGCGA

651     AGCCACGTTC TACATCCCGT CCAACCTTGC CTACCGCGAA CAGGGTGCGG

701     GCGACAAAAT CGGTCCGAAC GCCACTTTGG TATTTGATGT GAAACTGGTC

751     AAAATCGGCG CACCCGAAAA CGCGCCCGCC AAGCAGCCGG CTCAAGTCGA

801     CATCAAAAAA GTAAATTAA
```

This corresponds to the amino acid sequence <SEQ ID 1746; ORF 576-1>:

```
m576-1.pep
    1   MNTIFKISAL TLSAALALSA CGKKEAAPAS ASEPAAASSA QGDTSSIGST

51   MQQASYAMGV DIGRSLKQMK EQGAEIDLKV FTEAMQAVYD GKEIKMTEEQ

101   AQEVMMKFLQ EQQAKAVEKH KADAKANKEK GEAFLKENAA KDGVKTTASG

151   LQYKITKQGE GKQPTKDDIV TVEYEGRLID GTVFDSSKAN GGPVTFPLSQ

201   VIPGWTEGVQ LLKEGGEATF YIPSNLAYRE QGAGDKIGPN ATLVFDVKLV

251   KIGAPENAPA KQPAQVDIKK VN*
``` g576-1/m576-1 97.8% identity in 272 aa overlap

```
                   10         20         30         40         50         60
g576-1.pep MNTIFKISALTLSAALALSACGKKEAAPASASEPAAASAAQGDTSSIGSTMQQASYAMGV
           |||||||||||||||||||||||||||||||||||||||:||||||||||||||||||||
m576-1     MNTIFKISALTLSAALALSACGKKEAAPASASEPAAASSAQGDTSSIGSTMQQASYAMGV
                   10         20         30         40         50         60

70         80         90        100        110        120
g576-1.pep DIGRSLKQMKEQGAEIDLKVFTDAMQAVYDGKEIKMTEEQAQEVMMKFLQEQQAKAVEKH
           ||||||||||||||||||||||:|||||||||||||||||||||||||||||||||||||
m576-1     DIGRSLKQMKEQGAEIDLKVFTEAMQAVYDGKEIKMTEEQAQEVMMKFLQEQQAKAVEKH
                   70         80         90        100        110        120

130        140        150        160        170        180
g576-1.pep KADAKANKEKGEAFLKENAAKDGVKTTASGLQYKITKQGEGKQPTKDDIVTVEYEGRLID
           ||||||||||||||||||||||||||||||||||||||||||||||||||||||||||||
m576-1     KADAKANKEKGEAFLKENAAKDGVKTTASGLQYKITKQGEGKQPTKDDIVTVEYEGRLID
                  130        140        150        160        170        180

190        200        210        220        230        240
g576-1.pep GTVFDSSKANGGPATFPLSQVIPGWTEGVRLLKEGGEATFYIPSNLAYREQGAGEKIGPN
           ||||||||||||:|||||||||||||||||:|||||||||||||||||||||||:|||||
m576-1     GTVFDSSKANGGPVTFPLSQVIPGWTEGVQLLKEGGEATFYIPSNLAYREQGAGDKIGPN
                  190        200        210        220        230        240

250        260        270
g576-1.pep ATLVFDVKLVKIGAPENAPAKQPDQVDIKKVNX
           ||||||||||||||||||||||||| ||||||||
m576-1     ATLVFDVKLVKIGAPENAPAKQPAQVDIKKVNX
                  250        260        270
```

The following partial DNA sequence was identified in *N. meningitidis* <SEQ ID 1747>:

```
a576-1.seq
    1   ATGAACACCA TTTTCAAAAT CAGCGCACTG ACCCTTTCCG CCGCTTTGGC

51   ACTTTCCGCC TGCGGCAAAA AAGAAGCCGC CCCCGCATCT GCATCCGAAC

101   CTGCCGCCGC TTCTTCCGCG CAGGGCGACA CCTCTTCGAT CGGCAGCACG

151   ATGCAGCAGG CAAGCTATGC GATGGGCGTG ACATCGGAC GCTCCCTGAA

201   GCAAATGAAG GAACAGGGCG CGGAAATCGA TTTGAAAGTC TTTACCGAAG
```

```
-continued
251  CCATGCAGGC AGTGTATGAC GGCAAAGAAA TCAAAATGAC CGAAGAGCAG

301  GCTCAGGAAG TCATGATGAA ATTCCTTCAG GAACAACAGG CTAAAGCCGT

351  AGAAAAACAC AAGGCGGACG CGAAGGCCAA TAAAGAAAAA GGCGAAGCCT

401  TTCTGAAAGA AAATGCCGCC AAAGACGGCG TGAAGACCAC TGCTTCCGGC

451  CTGCAATACA AAATCACCAA ACAGGGCGAA GGCAAACAGC CGACCAAAGA

501  CGACATCGTT ACCGTGGAAT ACGAAGGCCG CCTGATTGAC GGTACGGTAT

551  TCGACAGCAG CAAAGCCAAC GGCGGCCCGG TCACCTTCCC TTTGAGCCAA

601  GTGATTCTGG GTTGGACCGA AGGCGTACAG CTTCTGAAAG AAGGCGGCGA

651  AGCCACGTTC TACATCCCGT CCAACCTTGC CTACCGCGAA CAGGGTGCGG

701  GCGACAAAAT CGGCCCGAAC GCCACTTTGG TATTTGATGT GAAACTGGTC

751  AAAATCGGCG CACCCGAAAA CGCGCCCGCC AAGCAGCCGG CTCAAGTCGA

801  CATCAAAAAA GTAAATTAA
```

This corresponds to the amino acid sequence <SEQ ID 1748; ORF 576-1.a>:

```
a576-1.pep
   1  MNTIFKISAL TLSAALALSA CGKKEAAPAS ASEPAAASSA QGDTSSIGST

51  MQQASYAMGV DIGRSLKQMK EQGAEIDLKV FTEAMQAVYD GKEIKMTEEQ

101  AQEVMMKFLQ EQQAKAVEKH KADAKANKEK GEAFLKENAA KDGVKTTASG

151  LQYKITKQGE GKQPTKDDIV TVEYEGRLID GTVFDSSKAN GGPVTFPLSQ

201  VILGWTEGVQ LLKEGGEATF YIPSNLAYRE QGAGDKIGPN ATLVFDVKLV

251  KIGAPENAPA KQPAQVDIKK VN*
``` a576-1/m576-1 99.6% identity in 272 aa overlap

```
                    10         20         30         40         50         60
a576-1.pep  MNTIFKISALTLSAALALSACGKKEAAPASASEPAAASSAQGDTSSIGSTMQQASYAMGV
            ||||||||||||||||||||||||||||||||||||||||||||||||||||||||||||
m576-1      MNTIFKISALTLSAALALSACGKKEAAPASASEPAAASSAQGDTSSIGSTMQQASYAMGV
                    10         20         30         40         50         60

70         80         90        100        110        120
a576-1.pep  DIGRSLKQMKEQGAEIDLKVFTEAMQAVYDGKEIKMTEEQAQEVMMKFLQEQQAKAVEKH
            ||||||||||||||||||||||||||||||||||||||||||||||||||||||||||||
m576-1      DIGRSLKQMKEQGAEIDLKVFTEAMQAVYDGKEIKMTEEQAQEVMMKFLQEQQAKAVEKH
                    70         80         90        100        110        120

130        140        150        160        170        180
a576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                   130        140        150        160        170        180

190        200        210        220        230        240
a576-1.pep  GTVFDSSKANGGPVTFPLSQVILGWTEGVQLLKEGGEATFYIPSNLAYREQGAGDKIGPN
            |||||||||||||||||||||| |||||||||||||||||||||||||||||||||||||
m576-1      GTVFDSSKANGGPVTFPLSQVIPGWTEGVQLLKEGGEATFYIPSNLAYREQGAGDKIGPN
                   190        200        210        220        230        240

250        260        270
a576-1.pep  ATLVFDVKLVKIGAPENAPAKQPAQVDIKKVNX
            |||||||||||||||||||||||||||||||||
m576-1      ATLVFDVKLVKIGAPENAPAKQPAQVDIKKVNX
                   250        260        270
```

Expression of ORF 576

Figure 3A:
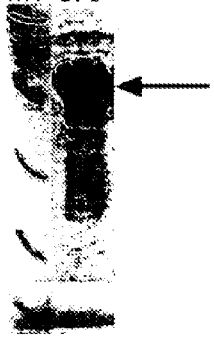
FIG. 3A through FIG. 3D illustrate the products of (FIG. 3A) protein expression and purification, (FIG. 3B) western blot, (FIG. 3C) FACs analysis, and (FIG. 3D) bactericidal assay. The result of the ELISA assay of the predicted ORF 519-1 as cloned and expressed in *E. coli* was positive.
Figure 3B:
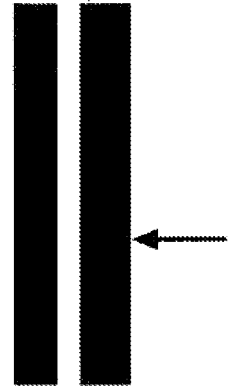
Figure 3C:
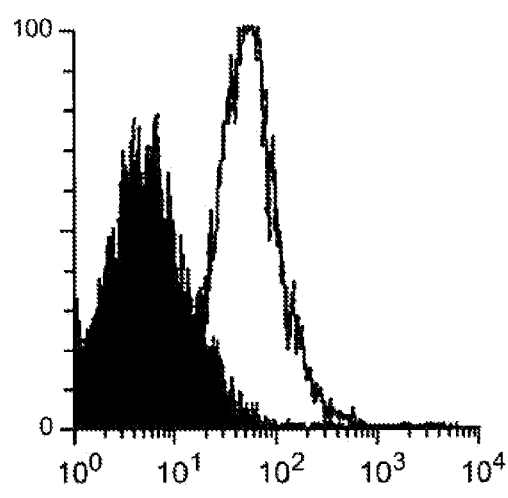

The primer described in Table 1 for ORF 576 was used to locate and clone ORF 576. ORF 576 was cloned in pET and pGex vectors and expressed in *E. coli* as above described. The products of protein expression and purification were analyzed by SDS-PAGE. FIG. 3A shows the results of affinity purification and FIG. 3B shows the expression in *E. coli*. Purified His-fusion protein was used to immunize mice, whose sera were used for ELISA (positive result), FACS analysis (FIG.

Figure 3D:
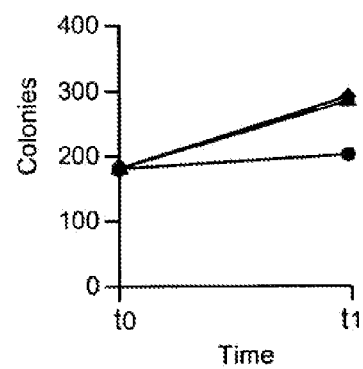

3C), western blot (FIG. 3D). These experiments confirm that ORF 576 is a surface-exposed protein and that it is a useful immunogen. The hydrophilicity plots, antigenic index, and amphipatic regions of ORF 576 are provided in FIG. 7. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

The following partial DNA sequence was identified in *N. gonorrhoeae* <SEQ ID 1749>:

```
g577.seq..
       1   atggaaagga gcggtgtatt tggtaaaatt gtcggcaatc gcatactccg
      51   tatgccgtcc gaacacgctg ccgcattcta tccgaaaccg tgcaaatcgt
     101   ttaaactaac gcaatcttgg ttcagagtgc gaagctgtcc gtgcggcgtt
     151   tttatttacg gagcaaacat gaaacttatc tataccgtca tcaaaatcat
     201   tatcctgctg ctcttcctgc tgcttgccgt cattaatatg gatgccgtta
     251   ccttttccta tcttccgggg cagagtgtca atctgccgct gattgtcgta
     301   ttgttcggcg cgtttgtcgt cggcatcgtg ttcggaatgt ttgccctgtt
     351   cgggcggctg ctgtccttgc gcggcgaaaa cagccgcctg cgtgcggaag
     401   tgaagaaaag tgcgcgcttg agcggacaga aattgactgc accgccgata
     451   caaaatgctg ccgaatctgc aaacagcct taa
```

This corresponds to the amino acid sequence <SEQ ID 1750; ORF 577.ng>:

```
g577.pep
       1   MERSGVFGKI VGNRILRMPS EHAAAFYPKP CKSFKLTQSW FRVRSCPCGV
      51   FIYGANMKLI YTVIKIIILL LFLLLAVINM DAVTFSYLPG QSVNLPLIVV
     101   LFGAFVVGIV FGMFALFGRL LSLRGENSRL RAEVKKSARL SGQKLTAPPI
     151   QNAAESAKQP *
```

The following partial DNA sequence was identified in *N. meningitidis* <SEQ ID 1751>:

```
m577.seq..
       1   ATGGAAAGGA ACGGTGTATT TGGTAAAATT GTCGGCAATC GCATACTCCG
      51   TATGTCGTCC GAACACGCTG CCGCATCCTA TCCGAAACCG TGCAAATCGT
     101   TTAAACTAGC GCAATCTTGG TTCAGAGTGC GAAGCTGTCT GGGCGGCGTT
     151   TTTATTTACG GAGCAAACAT GAAACTTATC TATACCGTCA TCAAAATCAT
     201   TATCCTGCTG CTCTTCCTGC TGCTTGCCGT CATTAATACG GATGCCGTTA
     251   CCTTTTCCTA CCTGCCGGGG CAAAAATTCG ATTTGCCGCT GATTGTCGTA
     301   TTGTTCGGCG CATTTGTAGT CGGTATTATT TTTGGAATGT TTGCCTTGTT
     351   CGGACGGTTG TTGTCGTTAC GTGGCGAGAA CGGCAGGTTG CGTGCCGAAG
     401   TAAAGAAAAA TGCGCGTTTG ACGGGGAAGG AGCTGACCGC ACCACCGGCG
     451   CAAAATGCGC CGAATCTAC CAAACAGCCT TAA
```

This corresponds to the amino acid sequence <SEQ ID 1752; ORF 577>:

```
m577.pep..
       1   MERNGVFGKI VGNRILRMSS EHAAASYPKP CKSFKLAQSW FRVRSCLGGV
      51   FIYGANMKLI YTVIKIIILL LFLLLAVINT DAVTFSYLPG QKFDLPLIVV
```

```
101   LFGAFVVGII FGMFALFGRL LSLRGENGRL RAEVKKNARL TGKELTAPPA

151   QNAPESTKQP *
```

Computer analysis of this amino acid sequence gave the following results:
Homology with a Predicted ORF from *N. gonorrhoeae*
m577/g577 88.1% identity in 160 aa overlap

```
                  10         20         30         40         50         60
m577.pep  MERNGVFGKIVGNRILRMSSEHAAASYPKPCKSFKLAQSWFRVRSCLGGVFIYGANMKLI
          |||:||||||||||||| |||||| ||||||||||:|||||||| |||||||||||||
g577      MERSGVFGKIVGNRILRMPSEHAAAFYPKPCKSFKLTQSWFRVRSCPGGVFIYGANMKLI
                  10         20         30         40         50         60

70         80         90        100        110        120
m577.pep  YTVIKIIILLLFLLLAVINTDAVTFSYLPGQKFDLPLIVVLFGAFVVGIIFGMFALFGRL
          ||||||||||||||||||||: :|||||||||| ::||||||||||||:|||||||||
g577      YTVIKIIILLLFLLLAVINMDAVTFSYLPGQSVNLPLIVVLFGAFVVGIVFGMFALFGRL
                  70         80         90        100        110        120

130        140        150        160
m577.pep  LSLRGENGRLRAEVKKNARLTGKELTAPPAQNAPESTKQPX
          ||||||||:||||||||:|||:|::||||| ||| ||:|||
g577      LSLRGENSRLRAEVKKSARLSGQKLTAPPIQNAAESAKQPX
                 130        140        150        160
```

The following partial DNA sequence was identified in *N. meningitidis* <SEQ ID 1753>:

```
a577.seq
     1   ATGGAAAGGA ACGGTGTATT TGGTAAAATT GTCGGCAATC GCATACTCCG

51   TATGTCGTCC GAACACGCTG CCGCATCCTA TCCGAAACCG TGCAAATCGT

101   TTAAACTAGC GCAATCTTGG TTCAGAGTGC GAAGCTGTCC GGGCGGCGTT

151   TTTATTTACG GAGCAAACAT GAAACTTATC TATACCGTCA TCAAAATCAT

201   TATCCTGCTG CTCTTCCTGC TGCTTGCTGT CATTAATACG GATGCCGTTA

251   CCTTTTCCTA CCTGCCGGGG CAAAAATTCG ATTTGCCGCT GATTGTCGTA

301   TTGTTCGGCG CGTTTGTCGT CGGCATCGTG TTCGGAATGT TTGCCTTGTT

351   CGGACGGTTG TTGTCGTTAC GTGGCGAGAA CGGCAGGTTG CGTGCCGAAG

401   TAAAGAAAAA TGCGCGTTTG ACGGGGAAGG AGCTGACCGC ACCACCGGCG

451   CAAAATGCGC CGAATCTGC CAAACAGCCT TGA
```

This corresponds to the amino acid sequence <SEQ ID 1754; ORF 577.a>:

```
a577.pep
     1   MERNGVFGKI VGNRILRMSS EHAAASYPKP CKSFKLAQSW FRVRSCPGGV

51   FIYGANMKLI YTVIKIIILL LFLLLAVINT DAVTFSYLPG QKFDLPLIVV

101   LFGAFVVGIV FGMFALFGRL LSLRGENGRL RAEVKKNARL TGKELTAPPA

151   QNAPESAKQP *
``` m577/a577 98.1% identity in 160 aa overlap

```
                  10         20         30         40         50         60
m577.pep  MERNGVFGKIVGNRILRMSSEHAAASYPKPCKSFKLAQSWFRVRSCLGGVFIYGANMKLI
          |||||||||||||||||||||||||||||||||||||||||||||| |||||||||||||
a577      MERNGVFGKIVGNRILRMSSEHAAASYPKPCKSFKLAQSWFRVRSCPGGVFIYGANMKLI
                  10         20         30         40         50         60
```

```
                70         80         90         100        110        120
m577.pep    YTVIKIIILLLFLLLAVINTDAVTFSYLPGQKFDLPLIVVLFGAFVVGIIFGMFALFGRL
            ||||||||||||||||||||||||||||||||||||||||||||||||:|||||||||||
a577        YTVIKIIILLLFLLLAVINTDAVTFSYLPGQKFDLPLIVVLFGAFVVGIVFGMFALFGRL
                70         80         90         100        110        120

130        140        150        160
m577.pep    LSLRGENGRLRAEVKKNARLTGKELTAPPAQNAPESTKQPX
            ||||||||||||||||||||||||||||||||||||:|||
a577        LSLRGENGRLRAEVKKNARLTGKELTAPPAQNAPESAKQPX
               130        140        150        160
```

The following partial DNA sequence was identified in *N. gonorrhoeae* <SEQ ID 1755>:

```
g578.seq..
      1    atgggaaagc tcgacatcgg gatattgttt gccgatttct tcaaagattt 51    cgcgccacag ttcggtggtt tccaaaacgt tggctttgcc tacggagcag 101    acttttttgc tgcgtttttg ggcggattgg aaggccacgt gggcgatgcg 151    gcggatttcg ctttcgctgt atttcatggt gttgtagcct tcgtgttcgc 201    cgttttccaa aacacggatg ccgcgcggtt cgccgaaata aatatcgccg 251    gtaagttcgc gcacaatcaa aatatccaaa ccggcaacga tttcaggctt 301    gagcgtggag gcgttggcta a
```

This corresponds to the amino acid sequence <SEQ ID 1756; ORF 578.ng>:

```
g578.pep
      1    MGKLDIGILF ADFFKDFAPQ FGGFQNVGFA YGADFFAAFL GGLEGHVGDA

51    ADFAFAVFHG VVAFVFAVFQ NTDAARFAEI NIAGKFAHNQ NIQTGNDFRL

101    ERGGVG*
```

The following partial DNA sequence was identified in *N. meningitidis* <SEQ ID 1757>:

```
m578.seq..
      1    ATGGGAAAGC TCGACATCAG GGTACTCTTT GCCGATTTCT TCAAAGATTT

51    CGCGCCACAA TTCGGTGGTT TCCAAAACGT TGGCTTTGCC TACGGAACAG

101    ACTTTTTTGC TGCGTTTTTG GGCGGATTGG AAGGCAACAT GGGCAATACG

151    GCGGATTTCG CTTTCGCTGT ATTTCATGGT GTTGTAGCCT TCGCGTTCGC

201    CGTTTTCCAG AACGCGGATG CCGCGCGGTT CGCCGAAATA GATGTCGCCG

251    GTGAGTTCGC GCACAATCAA AATATCCAAA CCGGCAACGA TTTCAGGCTT
```

This corresponds to the amino acid sequence <SEQ ID 1758; ORF 578>:

```
m578.pep..
      1    MGKLDIRVLF ADFFKDFAPQ FGGFQNVGFA YGTDFFAAFL GGLEGNMGNT

51    ADFAFAVFHG VVAFAFAVFQ NADAARFAEI DVAGEFAHNQ NIQTGNDFRL

101    QRGGVG*
``` m578/g578 87.7% identity in 106 aa overlap

```
                 10         20         30         40         50         60
  m578.pep  MGKLDIRVLFADFFKDFAPQFGGFQNVGFAYGTDFFAAFLGGLEGNMGNTADFAFAVFHG
            ||||||:|||||||||||||||||||||||||:|||||||||||::|::||||||||||
  g578      MGKLDIGILFADFFKDFAPQFGGFQNVGFAYGADFFAAFLGGLEGHVGDAADFAFAVFHG
                 10         20         30         40         50         60

70         80         90        100
  m578.pep  VVAFAFAVFQNADAARFAEIDVAGEFAHNQNIQTGNDFRLQRGGVGX
            ||||:|||||:||||||||::||:|||||||||||||||:||||||
  g578      VVAFVFAVFQNTDAARFAEINIAGKFAHNQNIQTGNDFRLERGGVGX
                 70         80         90        100
```

The following partial DNA sequence was identified in *N. meningitidis* <SEQ ID 1759>:

```
a578.seq
    1    ATGGGAAAGC TCGACATCAG GGTATTCTTT GCCGATTTCT TCAAAGATTT
   51    CGCGCCACAA TTCGGTGGTT TCCAAAACGT TGGCTTTGCC TACGGAGCAG
  101    ACTTTTTTGC TGCGTTTTTG GGCGGATTGG AAGGCGACGT GGGCAATACG
  151    GCGGATTTCG CTTTCGCTGT ATTTCATGGT GTTGTAGCCT TCGCGTTCGC
  201    CGTTTTCCAG AACACGGATG CCGCGCGGTT CGCCGAAATA AATATCGCCG
  251    GTGAGTTCGC GCACAATCAA AATATCCAAA CCCGCAACGA TTTCAGACTT
  301    GAGCGTGGAG GCGTTGGCTA G
```

This corresponds to the amino acid sequence <SEQ ID 1760; ORF 578.a>:

```
a578.pep
    1    MGKLDIRVFF ADFFKDFAPQ FGGFQNVGFA YGADFFAAFL GGLEGDVGNT
   51    ADFAFAVFHG VVAFAFAVFQ NTDAARFAEI NIAGEFAHNQ NIQTRNDFRL
  101    ERGGVG*
``` m578/a578 91.5% identity in 106 aa overlap

```
                 10         20         30         40         50         60
  m578.pep  MGKLDIRVLFADFFKDFAPQFGGFQNVGFAYGTDFFAAFLGGLEGNMGNTADFAFAVFHG
            ||||||||:||||||||||||||||||||||||:|||||||||||:|||||::|||||||||||
  a578      MGKLDIRVFFADFFKDFAPQFGGFQNVGFAYGADFFAAFLGGLEGDVGNTADFAFAVFHG
                 10         20         30         40         50         60

70         80         90        100
  m578.pep  VVAFAFAVFQNADAARFAEIDVAGEFAHNQNIQTGNDFRLQRGGVGX
            |||||||||||:|||||||||::|||||||||||||| |||:||||||
  a578      VVAFAFAVFQNTDAARFAEINIAGEFAHNQNIQTRNDFRLERGGVGX
                 70         80         90        100
```

The following partial DNA sequence was identified in *N. gonorrhoeae* <SEQ ID 1761>:

```
g579.seq..
    1     ATGAGGGCGG CGATGACGCG CGCGCAGGTC GATGCCACGC TGATTAGTTT
   51     TTTGTGTAAT GTTGCCAATA TCGGCTTATT GATTTTGGTG ATTATTGCCG
  101     CATTGGGACG GTTGGGCGTT TCCACAACAT CCGTAACCGC CTTAATCGGC
  151     GGCGCGGGTT TGGCGGTGGC GTTGTCCTTA AAAGACCAGC TGTCCAATTT
  201     TGCCGCCGGC GCGCTGATTA TCCTGTTCCG CCCGTTCAAA GTCGGCGACT
  251     TTATCCGTGT CGGCGGTTTT GAAGGATATG TCCGGGAAAT CAAAATGGTG
```

```
301   CAGACTTCTT TGCGGACGAC CGACAACGAA GAAGTCGTGC TGCCCAACAG

351   CGTGGTGATG GGCAACAGCA TCGTCAACCG TTCCAGCCTG CCGCTTTGCC

401   GCGCCCAAGT GATAGTCGGC GTCGATTACA ACTGCGATTT GAAAGTGGCG

451   AAAGAGGCGG TGTTGAAAGC CGCCGCCGAA CACCCCTTGA GCGTTCAAAA

501   CGAAGAGCGG CAGCCCGCCG CCTACATCAC CGCCTTGGGC GACAATGCCA

551   TCGAAATCAC ATTATGGGCT TGGGCAAACG AAGCAGACCG CTGGACGCTG

601   CAATGCGACT TGAACGAACA AGTGGTCGAA AACCTCCGCA AAGTCAATAT

651   CAACATCCCG TTCCCGCAAC GCGACATACA CATCATCAAT TCTTAA
```

This corresponds to the amino acid sequence <SEQ ID 1762; ORF 579.ng>:

```
g579.pep..
    1   MRAAMTRAQV DATLISFLCN VANIGLLILV IIAALGRLGV STTSVTALIG

51   GAGLAVALSL KDQLSNFAAG ALIILFRPFK VGDFIRVGGF EGYVREIKMV

101   QTSLRTTDNE EVVLPNSVVM GNSIVNRSSL PLCRAQVIVG VDYNCDLKVA

151   KEAVLKAAAE HPLSVQNEER QPAAYITALG DNAIEITLWA WANEADRWTL

201   QCDLNEQVVE NLRKVNINIP FPQRDIHIIN S*
```

The following partial DNA sequence was identified in *N. meningitidis* <SEQ ID 1763>:

```
m579.seq..
    1   ATGAGGGCGG CGATGACGCG CGCGCAGGTC GATGCCACGC TGATTAGTTT

51   TTTGTGTAAT GTTGCCAATA TCGGCTTATT GATTTTGGTG ATTATTGCCG

101   CATTGGGCAG ATTGGGCGTT TCCACAACAT CCGTAACCGC CTTAATCGGC

151   GGCGCGGGTT TGGCGGTGGC GTTGTCCCTG AAAGACCAGC TGTCCAATTT

201   TGCCGCCGGC GCACTGATTA TCCTGTTCCG CCCGTTCAAA GTCGGCGATT

251   TTATCCGCGT CGGCGGTTTT GAAGGATATG TCCGAGAGAT TAAAATGGTG

301   CAGACTTCTT TGCGGACGAC CGACAACGAA GAAGTCGTGC TGCCCAACAG

351   CGTGGTGATG GGCAACAGCA TCGTCAACCG TTCCACACTG CCGCTGTGCC

401   GCGCCCAAGT GATAGTCGGC GTCGATTACA ACTGCGATTT GAAAGTGGCG

451   AAAGAGGCGG TGTTGAAAGC CGCCGTCGAA CACCCCTTGA GCGTTCAAAA

501   CGAAGAGCGG CAGGCTGCCG CCTACATCAC CGCCTTGGGC GACAATGCCA

551   TCGAAATCAC ATTATGGGCT TGGGCAAACG AAGCAGACCG CTGGACGCTG

601   CAATGCGACT TGAACGAACA AGTGGTCGAA AACCTCCGCA AAGTCAATAT

651   CAACATCCCG TTCCCGCAAC GCGACATACA CATCATCAAT TCTTAA
```

This corresponds to the amino acid sequence <SEQ ID 1764; ORF 579>:

```
m579.pep..
    1   MRAAMTRAQV DATLISFLCN VANIGLLILV IIAALGRLGV STTSVTALIG

51   GAGLAVALSL KDQLSNFAAG ALIILFRPFK VGDFIRVGGF EGYVREIKMV

101   QTSLRTTDNE EVVLPNSVVM GNSIVNRSTL PLCRAQVIVG VDYNCDLKVA
```

```
151  KEAVLKAAVE HPLSVQNEER QAAAYITALG DNAIEITLWA WANEADRWTL

201  QCDLNEQVVE NLRKVNINIP FPQRDIHIIN S*
```

Computer analysis of this amino acid sequence gave the following results:
Homology with a Predicted ORF from *N. gonorrhoeae*
m579/g579 98.7% identity in 231 aa overlap

```
                  10         20         30         40         50         60
m579.pep  MRAAMTRAQVDATLISFLCNVANIGLLILVIIAALGRLGVSTTSVTALIGGAGLAVALSL
          ||||||||||||||||||||||||||||||||||||||||||||||||||||||||||||
g579      MRAAMTRAQVDATLISFLCNVANIGLLILVIIAALGRLGVSTTSVTALIGGAGLAVALSL
                  10         20         30         40         50         60

70         80         90        100        110        120
m579.pep  KDQLSNFAAGALIILFRPFKVGDFIRVGGFEGYVREIKMVQTSLRTTDNEEVVLPNSVVM
          ||||||||||||||||||||||||||||||||||||||||||||||||||||||||||||
g579      KDQLSNFAAGALIILFRPFKVGDFIRVGGFEGYVREIKMVQTSLRTTDNEEVVLPNSVVM
                  70         80         90        100        110        120

130        140        150        160        170        180
m579.pep  GNSIVNRSTLPLCRAQVIVGVDYNCDLKVAKEAVLKAAVEHPLSVQNEERQAAAYITALG
          ||||||||:|||||||||||||||||||||||||||||||:|||||||||||| ||||||
g579      GNSIVNRSSLPLCRAQVIVGVDYNCDLKVAKEAVLKAAAEHPLSVQNEERQPAAYITALG
                 130        140        150        160        170        180

190        200        210        220        230
m579.pep  DNAIEITLWAWANEADRWTLQCDLNEQVVENLRKVNINIPFPQRDIHIINSX
          |||||||||||||||||||||||||||||||||||||||||||||||||||
g579      DNAIEITLWAWANEADRWTLQCDLNEQVVENLRKVNINIPFPQRDIHIINSX
                 190        200        210        220        230
```

The following partial DNA sequence was identified in *N. meningitidis* <SEQ ID 1765>:

```
a579.seq
   1  ATGAGGGCGG CGATGACGCG CGCGCAGGTC GATGCCACGC TGATTAGTTT

51  TTTGTGTAAT GTTGCCAATA TCGGCTTATT GATTTTGGTG ATTATTGCCG

101  CATTGGGCAG ATTGGGCGTT TCCACAACAT CCGTAACCGC CTTAATCGGC

151  GGCGCGGGTT TGGCGGTGGC GTTGTCCTTG AAAGACCAGC TGTCCAATTT

201  TGCCGCCGGC GCGCTGATTA TCCTGTTCCG CCCGTTCAAA GTCGGCGATT

251  TTATCCGCGT CGGCGGTTTT GAAGGATATG TCCGAGAGAT TAAAATGGTG

301  CAGACTTCTT TGCGGACGAC CGACAACGAA GAAGTCGTGC TGCCCAACAG

351  CGTGGTGATG GGCAACAGCA TCGTCAACCG TTCCACACTG CCGCTGTGCC

401  GCGCCCAAGT GATAGTCGGC GTCGATTACA ACTGCGATTT GAAAGTGGCG

451  AAAGAGGCGG TGTTGAAAGC CGCCGTCGAA CACCCCTTGA GCGTTCAAAA

501  CGAAGAGCGG CAGGCCGCCG CCTACATCAC CGCCTTGGGC GACAATGCCA

551  TCGAAATCAC ATTATGGGCT TGGGCAAACG AAGCAGACCG CTGGACGCTG

601  CAATGCGACT TGAACGAACA AGTGGTCGAA AACCTCCGCA AAGTCAATAT

651  CAACATCCCG TTCCCGCAAC GCGACATACA CATCATCAAT TCTTAA
```

This corresponds to the amino acid sequence <SEQ ID 1766; ORF 579.a>:

```
a579.pep
   1  MRAAMTRAQV DATLISFLCN VANIGLLILV IIAALGRLGV STTSVTALIG

51  GAGLAVALSL KDQLSNFAAG ALIILFRPFK VGDFIRVGGF EGYVREIKMV

101  QTSLRTTDNE EVVLPNSVVM GNSIVNRSTL PLCRAQVIVG VDYNCDLKVA
```

```
-continued
151  KEAVLKAAVE HPLSVQNEER QAAAYITALG DNAIEITLWA WANEADRWTL

201  QCDLNEQVVE NLRKVNINIP FPQRDIHIIN S*
``` m579/a579 100.0% identity in 231 aa overlap

```
               10         20         30         40         50         60
m579.pep  MRAAMTRAQVDATLISFLCNVANIGLLILVIIAALGRLGVSTTSVTALIGGAGLAVALSL
          ||||||||||||||||||||||||||||||||||||||||||||||||||||||||||||
a579      MRAAMTRAQVDATLISFLCNVANIGLLILVIIAALGRLGVSTTSVTALIGGAGLAVALSL
               10         20         30         40         50         60

70         80         90        100        110        120
m579.pep  KDQLSNFAAGALIILFRPFKVGDFIRVGGFEGYVREIKMVQTSLRTTDNEEVVLPNSVVM
          ||||||||||||||||||||||||||||||||||||||||||||||||||||||||||||
a579      KDQLSNFAAGALIILFRPFKVGDFIRVGGFEGYVREIKMVQTSLRTTDNEEVVLPNSVVM
               70         80         90        100        110        120

130        140        150        160        170        180
m579.pep  GNSIVNRSTLPLCRAQVIVGVDYNCDLKVAKEAVLKAAVEHPLSVQNEERQAAAYITALG
          |||||||||||||||||||||||||||||||||||||||:|||||||||||| |||||||
a579      GNSIVNRSTLPLCRAQVIVGVDYNCDLKVAKEAVLKAAAEHPLSVQNEERQPAAYITALG
              130        140        150        160        170        180

190        200        210        220        230
m579.pep  DNAIEITLWAWANEADRWTLQCDLNEQVVENLRKVNINIPFPQRDIHIINSX
          ||||||||||||||||||||||||||||||||||||||||||||||||||||
a579      DNAIEITLWAWANEADRWTLQCDLNEQVVENLRKVNINIPFPQRDIHIINSX
              190        200        210        220        230
```

The following partial DNA sequence was identified in *N. gonorrhoeae* <SEQ ID 1767>:

```
g579-1.seq
    1   ATGGACTTCA AACAATTTGA TTTTTTACAC CTGATCAGTG TTTCCGGTTG

51   GGGGCATCTG GCTGAAAAGG CGTGGGCGTT CGGGCTGAAC CTTGCCGCCG

101   CGCTGCTTAT TTTCTTGGTC GGGAAATGGG CGGCGAAACG CATTGTCGCC

151   GTAATGAGGG CGGCGATGAC GCGCGCGCAG GTCGATGCCA CGCTGATTAG

201   TTTTTTGTGT AATGTTGCCA ATATCGGCTT ATTGATTTTG GTGATTATTG

251   CCGCATTGGG ACGGTTGGGC GTTTCCACAA CATCCGTAAC CGCCTTAATC

301   GGCGGCGCGG GTTTGGCGGT GGCGTTGTCC TTAAAAGACC AGCTGTCCAA

351   TTTTGCCGCC GGCGCGCTGA TTATCCTGTT CCGCCCGTTC AAAGTCGGCG

401   ACTTTATCCG TGTCGGCGGT TTTGAAGGAT ATGTCCGGGA AATCAAAATG

451   GTGCAGACTT CTTTGCGGAC GACCGACAAC GAAGAAGTCG TGCTGCCCAA

501   CAGCGTGGTG ATGGGCAACA GCATCGTCAA CCGTTCCAGC CTGCCGCTTT

551   GCCGCGCCCA AGTGATAGTC GGCGTCGATT ACAACTGCGA TTTGAAAGTG

601   GCGAAAGAGG CGGTGTTGAA AGCCGCCGCC GAACACCCCT TGAGCGTTCA

651   AAACGAAGAG CGGCAGCCCG CCGCCTACAT CACCGCCTTG GGCGACAATG

701   CCATCGAAAT CACATTATGG GCTTGGGCAA ACGAAGCAGA CCGCTGGACG

751   CTGCAATGCG ACTTGAACGA ACAAGTGGTC GAAAACCTCC GCAAAGTCAA

801   TATCAACATC CCGTTCCCGC AACGCGACAT ACACATCATC AATTCTTAA
```

This corresponds to the amino acid sequence <SEQ ID 1768; ORF 008.ng>:

```
g579-1.pep
    1   MDFKQFDFLH LISVSGWGHL AEKAWAFGLN LAAALLIFLV GKWAAKRIVA

51   VMRAAMTRAQ VDATLISFLC NVANIGLLIL VIIAALGRLG VSTTSVTALI
```

-continued

```
101   GGAGLAVALS LKDQLSNFAA GALIIILFRPF KVGDFIRVGG FEGYVREIKM

151   VQTSLRTTDN EEVVLPNSVV MGNSIVNRSS LPLCRAQVIV GVDYNCDLKV

201   AKEAVLKAAA EHPLSVQNEE RQPAAYITAL GDNAIEITLW AWANEADRWT

251   LQCDLNEQVV ENLRKVNINI PFPQRDIHII NS*
```

The following partial DNA sequence was identified in *N. meningitidis* <SEQ ID 1769>:

```
m579-1.seq
  1   ATGGACTTCA AACAATTTGA TTTTTTACAC CTGATCAGTG TTTCCGGTTG

51   GGAGCATCTG GCTGAAAAGG CGTGGGCGTT CGGGCTGAAC CTTGCCGCCG

101   CGCTGCTTAT TTTTTTGGTC GGAAAATGGG CGGCGAAACG CATTGTCGCT

151   GTGATGAGGG CGGCGATGAC GCGCGCGCAG GTCGATGCCA CGCTGATTAG

201   TTTTTTGTGT AATGTTGCCA ATATCGGCTT ATTGATTTTG GTGATTATTG

251   CCGCATTGGG CAGATTGGGC GTTTCCACAA CATCCGTAAC CGCCTTAATC

301   GGCGGCGCGG GTTTGGCGGT GGCGTTGTCC CTGAAAGACC AGCTGTCCAA

351   TTTTGCCGCC GGCGCACTGA TTATCCTGTT CCGCCCGTTC AAAGTCGGCG

401   ATTTTATCCG CGTCGGCGGT TTTGAAGGAT ATGTCCGAGA GATTAAAATG

451   GTGCAGACTT CTTTGCGGAC GACCGACAAC GAAGAAGTCG TGCTGCCCAA

501   CAGCGTGGTG ATGGGCAACA GCATCGTCAA CCGTTCCACA CTGCCGCTGT

551   GCCGCGCCCA AGTGATAGTC GGCGTCGATT ACAACTGCGA TTTGAAAGTG

601   GCGAAAGAGG CGGTGTTGAA AGCCGCCGTC GAACACCCCT TGAGCGTTCA

651   AAACGAAGAG CGGCAGGCTG CCGCCTACAT CACCGCCTTG GGCGACAATG

701   CCATCGAAAT CACATTATGG GCTTGGGCAA ACGAAGCAGA CCGCTGGACG

751   CTGCAATGCG ACTTGAACGA ACAAGTGGTC GAAAACCTCC GCAAAGTCAA

801   TATCAACATC CCGTTCCCGC AACGCGACAT ACACATCATC AATTCTTAA
```

This corresponds to the amino acid sequence <SEQ ID 1770; ORF 579-1>:

```
m579-1.pep
  1   MDFKQFDFLH LISVSGWEHL AEKAWAFGLN LAAALLIFLV GKWAAKRIVA

51   VMRAAMTRAQ VDATLISFLC NVANIGLLIL VIIAALGRLG VSTTSVTALI

101   GGAGLAVALS LKDQLSNFAA GALIIILFRPF KVGDFIRVGG FEGYVREIKM

151   VQTSLRTTDN EEVVLPNSVV MGNSIVNRST LPLCRAQVIV GVDYNCDLKV

201   AKEAVLKAAV EHPLSVQNEE RQAAAYITAL GDNAIEITLW AWANEADRWT

251   LQCDLNEQVV ENLRKVNINI PFPQRDIHII NS*
``` m579-1/g579-1 98.6% identity in 282 aa overlap

```
                    10        20        30        40        50        60
m579-1.pep  MDFKQFDFLHLISVSGWEHLAEKAWAFGLNLAAALLIFLVGKWAAKRIVAVMRAAMTRAQ
            ||||||||||||||||| ||||||||||||||||||||||||||||||||||||||||||
g579-1      MDFKQFDFLHLISVSGWGHLAEKAWAFGLNLAAALLIFLVGKWAAKRIVAVMRAAMTRAQ
                    10        20        30        40        50        60

70        80        90       100       110       120
m579-1.pep  VDATLISFLCNVANIGLLILVIIAALGRLGVSTTSVTALIGGAGLAVALSLKDQLSBFAA
            ||||||||||||||||||||||||||||||||||||||||||||||||||||||||||||
g579-1      VDATLISFLCNVANIGLLILVIIAALGRLGVSTTSVTALIGGAGLAVALSLKDQLSBFAA
                    70        80        90       100       110       120
```

```
                 130        140        150        160        170        180
m579-1.pep  GALIILFRPFKVGDFIRVGGFEGYVREIKMVQTSLRTTDNEEVVLPNSVVMGNSIVNRST
            ||||||||||||||||||||||||||||||||||||||||||||||||||||||||||:
g579-1      GALIILFRPFKVGDFIRVGGFEGYVREIKMVQTSLRTTDNEEVVLPNSVVMGNSIVNRSS
                 130        140        150        160        170        180

190        200        210        220        230        240
m579-1.pep  LPLCRAQVIVGVDYNCDLKVAKEAVLKAAVEHPLSVQNEERQAAAYITALGDNAIEITLW
            ||||||||||||||||||||||||||||||:|||||||||||| ||||||||||||||||
g579-1      LPLCRAQVIVGVDYNCDLKVAKEAVLKAAAEHPLSVQNEERQPAAYITALGDNAIEITLW
                 190        200        210        220        230        240

250        260        270        280
m579-1.pep  AWANEADRWTLQCDLNEQVVENLRKVNINIPFPQRDIHIINSX
            ||||||||||||||||||||||||||||||||||||||||||
g579-1      AWANEADRWTLQCDLNEQVVENLRKVNINIPFPQRDIHIINSX
                 250        260        270        280
```

The following partial DNA sequence was identified in *N. meningitidis* <SEQ ID 1771>:

```
a579-1.seq
    1    ATGGACTTCA AACAATTTGA TTTTTTACAC CTGATAAGTG CTTCCGGCTG

51    GGAGCATCTG GCTGAAAAGG CGTGGGCGTT CGGGCTGAAC CTTGCCGCCG

101    CGCTGCTTAT TTTTTTGGTC GGAAAATGGG CGGCGAAACG CATTGTCGCC

151    GTGATGAGGG CGGCGATGAC GCGCGCGCAG GTCGATGCCA CGCTGATTAG

201    TTTTTTGTGT AATGTTGCCA ATATCGGCTT ATTGATTTTG GTGATTATTG

251    CCGCATTGGG CAGATTGGGC GTTTCCACAA CATCCGTAAC CGCCTTAATC

301    GGCGGCGCGG GTTTGGCGGT GGCGTTGTCC TTGAAAGACC AGCTGTCCAA

351    TTTTGCCGCC GGCGCGCTGA TTATCCTGTT CCGCCCGTTC AAAGTCGGCG

401    ATTTTATCCG CGTCGGCGGT TTTGAAGGAT ATGTCCGAGA GATTAAAATG

451    GTGCAGACTT CTTTGCGGAC GACCGACAAC GAAGAAGTCG TGCTGCCCAA

501    CAGCGTGGTG ATGGGCAACA GCATCGTCAA CCGTTCCACA CTGCCGCTGT

551    GCCGCGCCCA AGTGATAGTC GGCGTCGATT ACAACTGCGA TTTGAAAGTG

601    GCGAAAGAGG CGGTGTTGAA AGCCGCCGTC GAACACCCCT TGAGCGTTCA

651    AAACGAAGAG CGGCAGGCCG CCGCCTACAT CACCGCCTTG GGCGACAATG

701    CCATCGAAAT CACATTATGG GCTTGGGCAA ACGAAGCAGA CCGCTGGACG

751    CTGCAATGCG ACTTGAACGA ACAAGTGGTC GAAAACCTCC GCAAAGTCAA

801    TATCAACATC CCGTTCCCGC AACGCGACAT ACACATCATC AATTCTTAA
```

This corresponds to the amino acid sequence <SEQ ID 1772; ORF 579-1.a>:

```
a579-1.pep
    1    MDFKQFDFLH LISASGWEHL AEKAWAFGLN LAAALLIFLV GKWAAKRIVA

51    VMRAAMTRAQ VDATLISFLC NVANIGLLIL VIIAALGRLG VSTTSVTALI

101    GGAGLAVALS LKDQLSNFAA GALIILFRPF KVGDFIRVGG FEGYVREIKM

151    VQTSLRTTDN EEVVLPNSVV MGNSIVNRST LPLCRAQVIV GVDYNCDLKV

201    AKEAVLKAAV EHPLSVQNEE RQAAAYITAL GDNAIEITLW AWANEADRWT

251    LQCDLNEQVV ENLRKVNINI PFPQRDIHII NS*
``` a579-1/m579-1 99.6% identity in 282 aa overlap

```
                    10        20        30        40        50        60
a579-1.pep  MDFKQFDFLHLISASGWEHLAEKAWAFGLNLAAALLIFLVGKWAAKRIVAVMRAAMTRAQ
            ||||||||||||:|||||||||||||||||||||||||||||||||||||||||||||||
m579-1      MDFKQFDFLHLISVSGWEHLAEKAWAFGLNLAAALLIFLVGKWAAKRIVAVMRAAMTRAQ
                    10        20        30        40        50        60

70        80        90       100       110       120
a579-1.pep  VDATLISFLCNVANIGLLILVIIAALGRLGVSTTSVTALIGGAGLAVALSLKDQLSNFAA
            ||||||||||||||||||||||||||||||||||||||||||||||||||||||||||||
m579-1      VDATLISFLCNVANIGLLILVIIAALGRLGVSTTSVTALIGGAGLAVALSLKDQLSNFAA
                    70        80        90       100       110       120

130       140       150       160       170       180
a579-1.pep  GALIILFRPFKVGDFIRVGGFEGYVREIKMVQTSLRTTDNEEVVLPNSVVMGNSIVNRST
            ||||||||||||||||||||||||||||||||||||||||||||||||||||||||||||
m579-1      GALIILFRPFKVGDFIRVGGFEGYVREIKMVQTSLRTTDNEEVVLPNSVVMGNSIVNRST
                   130       140       150       160       170       180

190       200       210       220       230       240
a579-1.pep  LPLCRAQVIVGVDYNCDLKVAKEAVLKAAVEHPLSVQNEERQAAAYITALGDNAIEITLW
            ||||||||||||||||||||||||||||||||||||||||||||||||||||||||||||
m579-1      LPLCRAQVIVGVDYNCDLKVAKEAVLKAAVEHPLSVQNEERQAAAYITALGDNAIEITLW
                   190       200       210       220       230       240

250       260       270       280
a579-1.pep  AWANEADRWTLQCDLNEQVVENLRKVNINIPFPQRDIHIINSX
            ||||||||||||||||||||||||||||||||||||||||||
m579-1      AWANEADRWTLQCDLNEQVVENLRKVNINIPFPQRDIHIINSX
                   250       260       270       280
```

25

The following partial DNA sequence was identified in *N. gonorrhoeae* <SEQ ID 1773>:

```
g580.seq
   1  atggattcgc ccaaggtcgg gtgcgggtgg atggttttgc cgatgtctgc 51  cgcgtcgcag cccatttcga tggcaaggca gacttcgccg atcatgtcgc 101  caccgttcgg accgacaatg ccgccgccga tgatgcggcc ggtttcggca 151  tcgaaaatca gcttggtaaa gccgttgtcg caaccgttgg caatcgcacg 201  accggaagcc gcccatggga agttggcttt ggtaattttg cggcctgatg 251  ctttggcaga caattcggtt tcaccgaccc atgccacttc gggggaagtg 301  tag
```

This corresponds to the amino acid sequence <SEQ ID 1774; ORF 580.ng>:

```
g580.pep..
   1  MDSPKVGCGW MVLPMSAASQ PISMARQTSP IMSPPFGPTM PPPMMRPVSA

51  SKISLVKPLS QPLAIARPEA AHGKLALVIL RPDALADNSV SPTHATSGEV

101  *
```

The following partial DNA sequence was identified in *N. meningitidis* <SEQ ID 1775>:

```
m580.seq..
   1  ATGGATTCGC CCAAGGTCGG GTGCGGGTGG ATGGTTTTGC CGATGTCTGC

51  CGCGTCGCAG CCCATTTCGA TGGCAAGGCA GACTTCGCCG ATCATATCGC

101  CACCGTTCGG ACCGACAATG CCGCCGCCGA TGATGCGGCC GGTTTCGGCA

151  TCAAAAATCA GCTTGGTAAA GCCGTTGTCG CAACCGTTGG CAATCGCACG

201  GCCGGAAGCC GCCCACGGGA AGTTGGCTTT GGTGATTTTG CGGCCGGAGG
```

```
-continued
     251   CTTTGGCGGA CAGTTCGGTT TCGCCCACCC ACGCCACTTC GGGGGAAGTG

301   TAG
```

This corresponds to the amino acid sequence <SEQ ID 1776; ORF 580>:

```
m580.pep..
       1   MDSPKVGCGW MVLPMSAASQ PISMARQTSP IISPPFGPTM PPPMMRPVSA

51   SKISLVKPLS QPLAIARPEA AHGKLALVIL RPEALADSSV SPTHATSGEV

101   *
``` m580/g580 97.0% identity in 100 aa overlap

```
                       10         20         30         40         50         60
     m580.pep   MDSPKVGCGWMVLPMSAASQPISMARQTSPIISPPFGPTMPPPMMRPVSASKISLVKPLS
                ||||||||||||||||||||||||||||||||:||||||||||||||||||||||||||
     g580       MDSPKVGCGWMVLPMSAASQPISMARQTSPIMSPPFGPTMPPPMMRPVSASKISLVKPLS
                       10         20         30         40         50         60

70         80         90        100
     m580.pep   QPLAIARPEAAHGKLALVILRPEALADSSVSPTHATSGEVX
                ||||||||||||||||||||||||:||||:||||||||||
     g580       QPLAIARPEAAHGKLALVILRPDALADNSVSPTHATSGEVX
                       70         80         90        100
```

The following partial DNA sequence was identified in *N. meningitidis* <SEQ ID 1777>:

```
a580.seq
       1   ATGGATTCGC CCAAGGTCGG GTGCGGGTGG ATGGTTTTGC CGATGTCTGC

51   CGCGTCGCAG CCCATTTCGA TGGCAAGGCA GACTTCGCCG ATCATGTCGC

101   CACCGTTCGG ACCGACAATG CCGCCGCCGA TGATGCGGCC GGTTTCAGCA

151   TCAAAAATCA GCTTGGTGAA ACCATTGTCG CAACCGTTGG CAATCGCACG

201   GCCGGAAGCA GCCCATGGGA AGTTGGCTTT GGTGATTTTG CGGCCGGAGG

251   CTTTGGCAGA CAATTCGGTT TCGCCCACCC ATGCCACTTC AGGAGAAGTG

301   TAA
```

This corresponds to the amino acid sequence <SEQ ID 1778; ORF 580.a>:

```
a580.pep
       1   MDSPKVGCGW MVLPMSAASQ PISMARQTSP IMSPPFGPTM PPPMMRPVSA

51   SKISLVKPLS QPLAIARPEA AHGKLALVIL RPEALADNSV SPTHATSGEV

101   *
``` m580/a580 98.0% identity in 100 aa overlap

```
                       10         20         30         40         50         60
     m580.pep   MDSPKVGCGWMVLPMSAASQPISMARQTSPIISPPFGPTMPPPMMRPVSASKISLVKPLS
                ||||||||||||||||||||||||||||||||:||||||||||||||||||||||||||
     a580       MDSPKVGCGWMVLPMSAASQPISMARQTSPIMSPPFGPTMPPPMMRPVSASKISLVKPLS
                       10         20         30         40         50         60

70         80         90        100
     m580.pep   QPLAIARPEAAHGKLALVILRPEALADSSVSPTHATSGEVX
                ||||||||||||||||||||||||:||||||||||||||||
     a580       QPLAIARPEAAHGKLALVILRPEALADNSVSPTHATSGEVX
                       70         80         90        100
```

The following partial DNA sequence was identified in *N. gonorrhoeae* <SEQ ID 1779>:

```
g581.seq..
    1    atgcacttcg cccagcttgt gggtcaaacc ggtatagaac aaaatacgtt
   51    ctgtcgtcgt ggttttaccc gcatcgatat gggcggaaat accgatgttg
  101    cggtacaggc tgatcggggt cttacgagcc attttattag cctttcaaaa
  151    ttagaaacgg aagtgagaga atgctttgtt ggcttcagcc atacggtgta
  201    cttcttcacg ttttttcaac gcaccgccac ggccttcgga cgcatcaatc
  251    aactcgcctg ccaaacgcag atccatggat ttctcaccac gtttgcgggc
  301    cgcgtcgcga acccaacgca ttgccaaagc cagacggcgt ga
```

This corresponds to the amino acid sequence <SEQ ID 1780; ORF 581.ng>:

```
g581.pep..
    1    MHFAQLVGQT GIEQNTFCRR GFTRIDMGGN TDVAVQADRG LTSHFISLSK
   51    LETEVRECFV GFSHTVYFFT FFQRTATAFG RINQLACQTQ IHGFLTTFAG
  101    RVANPTHCQS QTA*
```

The following partial DNA sequence was identified in *N. meningitidis* <SEQ ID 1781>:

```
m581.seq..
    1    ATGCACTTCG CCCAGCTTGT GGGTCAAACC GGTATAGAAC AAAATACGTT
   51    CTGTCGTCGT GGTTTTACCC GCGTCAATAT GGGCGGAAAT ACCGATGTTA
  101    CGGTACAGGC TGATCGGGGT CTTACGAGCC ATTTTATTAG CCTTTCAAAA
  151    TTAGAAACGG AAGTGAGAGA ATGCTTTGTT GGCTTCAGCC ATACGGTGTA
  201    CTTCTTCACG TTTTTTCAAC GCACCGCCAC GGCCTTCGGA CGCATCAATC
  251    AATTCGCCTG CCAAACGCAG GTCCATGGAT TTCTCACCAC GTTTGCGGGC
  301    CGCATCGCGA ACCCAGCGCA TTGCCAAAGC CAAACGGCGT GA
```

This corresponds to the amino acid sequence <SEQ ID 1782; ORF 581>:

```
m581.pep..
    1    MHFAQLVGQT GIEQNTFCRR GFTRVNMGGN TDVTVQADRG LTSHFISLSK
   51    LETEVRECFV GFSHTVYFFT FFQRTATAFG RINQFACQTQ VHGFLTTFAG
  101    RIANPAHCQS QTA*
``` m581/g581 93.8% identity in 113 aa overlap

```
                    10         20         30         40         50         60
    m581.pep  MHFAQLVGQTGIEQNTFCRRGFTRVNMGGNTDVTVQADRGLTSHFISLSKLETEVRECFV
              ||||||||||||||||||||||||::||||||:|||||||||||||||||||||||||||
    g581      MHFAQLVGQTGIEQNTFCRRGFTRIDMGGNTDVAVQADRGLTSHFISLSKLETEVRECFV
                    10         20         30         40         50         60

70         80         90        100        110
    m581.pep  GFSHTVYFFTFFQRTATAFGRINQFACQTQVHGFLTTFAGRIANPAHCQSQTAX
              |||||||||||||||||||||||:||||||:|||||||||:|||:|||||||||
    g581      GFSHTVYFFTFFQRTATAFGRINQLACQTQIHGFLTTFAGRVANPTKCQSQTAX
                    70         80         90        100        110
```

The following partial DNA sequence was identified in *N. meningitidis* <SEQ ID 1783>:

```
a581.seq
     1   ATGCACTTCG CCCAGCTTGT GGGTCAAACC GGTATAGAAC AAAATACGTT

51   CTGTCGTCGT GGTTTTACCC GCATCGATAT GGGCGGAAAT ACCGATGTTA

101   CGGTACAGGC TGATCGGGGT CTTACGAGCC ATTTTATTAG CCTTTCAAAA

151   TTAGAAACGG AAGTGAGAGA ATGCTTTGTT GGCTTCAGCC ATACGGTGTA

201   CTTCTTCACG TTTTTTCAAC GCACCGCCAC GGCCTTCGGA CGCATCAATC

251   AATTCGCCTG CCAAACGCAG GTCCATGGAT TTCTCACCAC GTTTGCGGGC

301   CGCATCGCGA ACCCAGCGCA TTGCCAAAGC CAAACGGCGT GA
```

This corresponds to the amino acid sequence <SEQ ID 1784; ORF 581.a>:

```
a581.pep
     1   MHFAQLVGQT GIEQNTFCRR GFTRIDMGGN TDVTVQADRG LTSHFISLSK

51   LETEVRECFV GFSHTVYFFT FFQRTATAFG RINQFACQTQ VHGFLTTFAG

101   RINPAHCQS QTA*
``` m581/a581 98.2% identity in 113 aa overlap

```
                     10        20        30        40        50        60
m581.pep   MHFAQLVGQTGIEQNTFCRRGFTRVNMGGNTDVTVQADRGLTSHFISLSKLETEVRECFV
           ||||||||||||||||||||||||::||||||||||||||||||||||||||||||||||
a581       MHFAQLVGQTGIEQNTFCRRGFTRIDMGGNTDVTVQADRGLTSHFISLSKLETEVRECFV
                     10        20        30        40        50        60

70        80        90       100       110
m581.pep   GFSHTVYFFTFFQRTATAFGRINQFACQTQVHGFLTTFAGRIANPAHCQSQTAX
           ||||||||||||||||||||||||||||||||||||||||||||||||||||||
a581       GFSHTVYFFTFFQRTATAFGRINQFACQTQVHGFLTTFAGRIANPAHCQSQTAX
                     70        80        90       100       110
```

The following partial DNA sequence was identified in *N. gonorrhoeae* <SEQ ID 1785>:

```
g582.seq..
      1    atgcgctata ttcttttgac aggactgttg ccgacggcat ccgcttttgg 51    agagaccgcg ctgcaatgcg ccgctttgac ggacaatgtt acgcgtttgg 101    cgtgttacga caggattttt gcggcacagc ttccgtcttc ggcagggcag 151    gaagggcagg agtcgaaagc cgtactcaat ctgacggaaa ccgtccgcag 201    cagcttggat aagggcgagg cggtcattgt tgttgaaaaa ggcggggatg 251    cgcttcctgc cgacagtgcg ggcgaaaccg ccgatatcta tacgcctttg 301    agcctgatgt acgacttgga caaaaacgat ttgcgcgggc tgttgggcgt 351    acgcgaacac aatccgatgt accttatgcc gttttggtat aacaattcgc 401    ccaactatgc cccgagttcg ccgacgcgcg gtacgactgt acaggaaaaa 451    ttcggacagc agaaacgtgc ggaaaccaaa ttgcaggttt cgttcaaaag 501    caaaattgcc gaaaatttgt ttaaaacccg cgcggatctg tggttcggct 551    acacccaaag atccgattgg cagatttaca accaaggcag gaaatccgcg 601    ccgttccgca atacggatta caaacctgaa attttcctga cccagcctgt 651    gaaggcggat ttgccgttcg gcggcaggct gcgtatgctc ggtgcgggtt
```

-continued

```
 701   ttgtccacca gtccaacgga cagagccgtc ccgaatcgcg ttcgtggaac
 751   aggatttatg ccatggcagg catggaatgg ggcaaattga cggtgattcc
 801   gcgcgtgtgg gtgcgtgcgt tcgatcagag cggcgataaa aacgacaatc
 851   ccgatattgc cgactatatg gggtatggcg acgtgaagct gcagtaccgc
 901   ctgaacgaca ggcagaatgt gtattccgta ttgcgctaca accccaaaac
 951   gggctacggc gcgattgaag ccgcctacac gtttccgatt aagggcaaac
1001   tcaaaggcgt ggtacgcgga ttccacggtt acggcgagag cctgatcgac
1051   tacaaccaca agcagaacgg tatcggtatc gggttgatgt tcaacgactg
1101   ggacggcatc tga
```

This corresponds to the amino acid sequence <SEQ ID 1786; ORF 582.ng>:

```
g582.pep ..
   1   MRYILLTGLL PTASAFGETA LQCAALTDNV TRLACYDRIF AAQLPSSAGQ
  51   EGQESKAVLN LTETVRSSLD KGEAVIVVEK GGDALPADSA GETADIYTPL
 101   SLMYDLDKND LRGLLGVREH NPMYLMPFWY NNSPNYAPSS PTRGTTVQEK
 151   FGQQKRAETK LQVSFKSKIA ENLFKTRADL WFGYTQRSDW QIYNQGRKSA
 201   PFRNTDYKPE IFLTQPVKAD LPFGGRLRML GAGFVHQSNG QSRPESRSWN
 251   RIYAMAGMEW GKLTVIPRVW VRAFDQSGDK NDNPDIADYM GYGDVKLQYR
 301   LNDRQNVYSV LRYNPKTGYG AIEAAYTFPI KGKLKGVVRG FHGYGESLID
 351   YNHKQNGIGI GLMFNDWDGI *
```

The following partial DNA sequence was identified in *N. meningitidis* <SEQ ID 1787>:

```
m582.seq ..
   1   ATGCGCTATA TTCTTTTGAC AGGACTGTTG CCGATGGCAT CCGCTTTTGG
  51   AGAGACCGCG CTGCAATGCG CCGCTTTGAC GGACAATGTT ACGCGTTTGG
 101   CGTGTTACGA CAGGATTTTT GCGGCACAGC TTCCGTCTTC GGCAGGGCAG
 151   GAAGGGCAGG AGTCGAAAGC CGTACTCAAT CTGACGGAAA CCGTCCGCAG
 201   CAGCCTGGAT AAGGGCGAGG CGGTCATTGT TGTTGAAAAA GGCGGGGATG
 251   CGCTTCCTGC CGACAGTGCG GGCGAAACCG CCGACATCTA TACGCCTTTG
 301   AGCCTGATGT ACGACTTGGA CAAAAACGAT TTGCGCGGGC TGTTGGGCGT
 351   ACGCGAACAC AATCCGATGT ACCTTATGCC GCTCTGGTAC AACAATTCGC
 401   CCAACTATGC CCCGGGTTCG CCGACGCGCG GTACGACTGT ACAGGAAAAA
 451   TTCGGACAGC AGAAACGTGC GGAAACCAAA TTGCAGGTTT CGTTCAAAAG
 501   CAAAATTGCC GAAGATTTGT TTAAAACCCG CGCGGATCTG TGGTTCGGCT
 551   ACACCCAAAG ATCCGATTGG CAGATTTACA ACCAAGGCAG GAAATCCGCG
 601   CCGTTCCGCA ATACGGATTA CAAACCTGAA ATTTTCCTGA CCCAGCCTGT
 651   GAAGGCGGAT TTGCCGTTCG GCGGCAGGCT GCGTATGCTC GGTGCGGGTT
 701   TTGTCCACCA GTCCAACGGA CAGAGCCGTC CGAATCGCG TTCGTGGAAC
 751   AGGATTTACG CCATGGCAGG CATGGAATGG GGCAAATTGA CGGTGATTCC
 801   GCGCGTGTGG GTGCGTGCGT TCGATCAGAG CGGCGATAAA AACGACAATC
```

```
    -continued
 851  CCGATATTGC CGACTATATG GGGTATGGCG ACGTGAAGCT GCAGTACCGC

901  CTGAACGACA GGCAGAATGT GTATTCCGTA TTGCGCTACA ACCCCAAAAC

951  GGGCTACGGC GCGATTGAAG CCGCCTACAC GTTTCCGATT AAGGGCAAAC

1001  TCAAAGGCGT GGTACGCGGA TTCCACGGTT ACGGCGAGAG CCTGATCGAC

1051  TACAACCACA AGCAGAACGG TATCGGTATC GGGTTGATGT TCAACGACTT

1101  GGACGGCATC TGA
```

This corresponds to the amino acid sequence <SEQ ID 1788; ORF 582>:

```
m582.pep
    1   MRYILLTGLL PMASAFGETA LQCAALTDNV TRLACYDRIF AAQLPSSAGQ

51   EGQESKAVLN LTETVRSSLD KGEAVIVVEK GGDALPADSA GETADIYTPL

101   SLMYDLDKND LRGLLGVREH NPMYLMPLWY NNSPNYAPGS PTRGTTVQEK

151   FGQQKRAETK LQVSFKSKIA EDLFKTRADL WFGYTQRSDW QIYNQGRKSA

201   PFRNTDYKPE IFLTQPVKAD LPFGGRLRML GAGFVHQSNG QSRPESRSWN

251   RIYAMAGMEW GKLTVIPRVW VRAFDQSGDK NDNPDIADYM GYGDVKLQYR

301   LNDRQNVYSV LRYNPKTGYG AIEAAYTFPI KGKLKGVVRG FHGYGESLID

351   YNHKQNGIGI GLMFNDLDGI *
``` m582/g582 98.6% identity in 370 aa overlap

```
                 10         20         30         40         50         60
m582.pep  MRYILLTGLLPMASAFGETALQCAALTDNVTRLACYDRIFAAQLPSSAGQEGQESKAVLN
          ||||||||||||||||||||||||||||||||||||||||||||||||||||||||||||
g582      MRYILLTGLLPMASAFGETALQCAALTDNVTRLACYDRIFAAQLPSSAGQEGQESKAVLN
                 10         20         30         40         50         60

70         80         90        100        110        120
m582.pep  LTETVRSSLDKGEAVIVVEKGGDALPADSAGETADIYTPLSLMYDLDKNDLRGLLGVREH
          ||||||||||||||||||||||||||||||||||||||||||||||||||||||||||||
g582      LTETVRSSLDKGEAVIVVEKGGDALPADSAGETADIYTPLSLMYDLDKNDLRGLLGVREH
                 70         80         90        100        110        120

130        140        150        160        170        180
m582.pep  NPMYLMPLWYNNSPNYAPGSPTRGTTVQEKFGQQKRAETKLQVSFKSKIAEDLFKTRADL
          ||||||| :||||||||||||:|||||||||||||||||||||||||||| :||||||||
g582      NPMYLMPFWYNNSPNYAPSSPTRGTTVQEKFGQQKRAETKLQVSFKSKIAENLFKTRADL
                130        140        150        160        170        180

190        200        210        220        230        240
m582.pep  WFGYTQRSDWQIYNQGRKSAPFRNTDYKPEIFLTQPVKADLPFGGRLRMLGAGFVHQSNG
          ||||||||||||||||||||||||||||||||||||||||||||||||||||||||||||
g582      WFGYTQRSDWQIYNQGRKSAPFRNTDYKPEIFLTQPVKADLPFGGRLRMLGAGFVHQSNG
                190        200        210        220        230        240

250        260        270        280        290        300
m582.pep  QSRPESRSWNRIYAMAGMEWGKLTVIPRVWVRAFDQSGDKNDNPDIADYMGYGDVKLQYR
          ||||||||||||||||||||||||||||||||||||||||||||||||||||||||||||
g582      QSRPESRSWNRIYAMAGMEWGKLTVIPRVWVRAFDQSGDKNDNPDIADYMGYGDVKLQYR
                250        260        270        280        290        300

310        320        330        340        350        360
m582.pep  LNDRQNVYSVLRYNPKTGYGAIEAAYTFPIKGKLKGVVRGFHGYGESLIDYNHKQNGIGI
          ||||||||||||||||||||||||||||||||||||||||||||||||||||||||||||
g582      LNDRQNVYSVLRYNPKTGYGAIEAAYTFPIKGKLKGVVRGFHGYGESLIDYNHKQNGIGI
                310        320        330        340        350        360

370
m582.pep  GLMFNDLDGIX
          |||||| ||||
g582      GLMFNDWDGIX
                370
```

The following partial DNA sequence was identified in *N. meningitidis* <SEQ ID 1789>:

```
a582.seq
    1  ATGCGCTATA TTCTTTTGAC AGGACTGTTG CCGATGGCAT CCGCTTTTGG
   51  AGAGACCGCG CTGCAATGCG CCGCTTTGAC GGACAATGTT ACGCGTTTGG
  101  CGTGTTACGA CAGGATTTTT GCGGCACAGC TTCCGTCTTC GGCAGGGCAG
  151  GAAGGGCAGG AGTCGAAAGC CGTACTCAAT CTGACGGAAA CCGTCCGCAG
  201  CAGCCTGGAT AAGGGCGAGG CGGTCATTGT TGTTGAAAAA GGCGGGGATG
  251  CGCTTCCTGC CGACAGTGCG GGCGAAACCG CCGACATCTA TACGCCTTTG
  301  AGCCTGATGT ACGACTTGGA CAAAAACGAT TTGCGCGGGC TGTTGGGCGT
  351  ACGCGAACAC AATCCGATGT ACCTTATGCC GCTCTGGTAC AACAATTCGC
  401  CCAACTATGC CCCGGGTTCG CCGACGCGCG GTACGACTGT ACAGGAAAAA
  451  TTCGGACAGC AGAAACGTGC GGAAACCAAA TTGCAGGTTT CGTTCAAAAG
  501  CAAAATTGCC GAAGATTTGT TTAAAACCCG CGCGGATCTG TGGTTCGGCT
  551  ACACCCAAAG ATCCGATTGG CAGATTTACA ACCAAGGCAG GAAATCCGCG
  601  CCGTTCCGCA ATACGGATTA CAAACCTGAA ATTTTCCTGA CCCAGCCTGT
  651  GAAGGCGGAT TTGCCGTTCG GCGGCAGGCT GCGTATGCTC GGTGCGGGTT
  701  TTGTCCACCA GTCCAACGGA CAGAGCCGTC CCGAATCGCG TTCGTGGAAC
  751  AGGATTTACG CCATGGCAGG CATGGAATGG GGCAAATTGA CGGTGATTCC
  801  GCGCGTGTGG GTGCGTGCGT TCGATCAGAG CGGCGATAAA AACGACAATC
  851  CCGATATTGC CGACTATATG GGGTATGGCG ACGTGAAGCT GCAGTACCGC
  901  CTGAACGACA GGCAGAATGT GTATTCCGTA TTGCGCTACA ATCCCAAAAC
  951  GGGCTACGGC GCGATTGAAG CCGCCTACAC GTTTCCGATT AAGGGCAAAC
 1001  TCAAAGGCGT GGTACGCGGA TTCCACGGTT ACGGCGAGAG CCTGATCGAC
 1051  TACAACCACA AGCAGAACGG TATCGGTATC GGGTTGATGT TCAACGACTT
 1101  GGACGGCATC TGA
```

This corresponds to the amino acid sequence <SEQ ID 1790; ORF 582.a>:

```
a582.pep
    1  MRYILLTGLL PMASAFGETA LQCAALTDNV TRLACYDRIF AAQLPSSAGQ
   51  EGQESKAVLN LTETVRSSLD KGEAVIVVEK GGDALPADSA GETADIYTPL
  101  SLMYDLDKND LRGLLGVREH NPMYLMPLWY NNSPNYAPGS PTRGTTVQEK
  151  FGQQKRAETK LQVSFKSKIA EDLFKTRADL WFGYTQRSDW QIYNQGRKSA
  201  PFRNTDYKPE IFLTQPVKAD LPFGGRLRML GAGFVHQSNG QSRPESRSWN
  251  RIYAMAGMEW GKLTVIPRVW VRAFDQSGDK NDNPDIADYM GYGDVKLQYR
  301  LNDRQNVYSV LRYNPKTGYG AIEAAYTFPI KGKLKGVVRG FHGYGESLID
  351  YNHKQNGIGI GLMFNDLDGI *
``` m582/a582 100.0% identity in 370 aa overlap

```
                10         20         30         40         50         60
  m582.pep  MRYILLTGLLPMASAFGETALQCAALTDNVTRLACYDRIFAAQLPSSAGQEGQESKAVLN
            ||||||||||||||||||||||||||||||||||||||||||||||||||||||||||||
     a582   MRYILLTGLLPMASAFGETALQCAALTDNVTRLACYDRIFAAQLPSSAGQEGQESKAVLN
                10         20         30         40         50         60
```

```
                    70         80         90        100        110        120
m582.pep    LTETVRSSLDKGEAVIVVEKGGDALPADSAGETADIYTPLSLMYDLDKNDLRGLLGVREH
            ||||||||||||||||||||||||||||||||||||||||||||||||||||||||||||
a582        LTETVRSSLDKGEAVIVVEKGGDALPADSAGETADIYTPLSLMYDLDKNDLRGLLGVREH
                    70         80         90        100        110        120

130        140        150        160        170        180
m582.pep    NPMYLMPLWYNNSPNYAPGSPTRGTTVQEKFGQQKRAETKLQVSFKSKIAEDLFKTRADL
            ||||||||||||||||||||||||||||||||||||||||||||||||||||||||||||
a582        NPMYLMPLWYNNSPNYAPGSPTRGTTVQEKFGQQKRAETKLQVSFKSKIAEDLFKTRADL
                   130        140        150        160        170        180

190        200        210        220        230        240
m582.pep    WFGYTQRSDWQIYNQGRKSAPFRNTDYKPEIFLTQPVKADLPFGGRLRMLGAGFVHQSNG
            ||||||||||||||||||||||||||||||||||||||||||||||||||||||||||||
a582        WFGYTQRSDWQIYNQGRKSAPFRNTDYKPEIFLTQPVKADLPFGGRLRMLGAGFVHQSNG
                   190        200        210        220        230        240

250        260        270        280        290        300
m582.pep    QSRPESRSWNRIYAMAGMEWGKLTVIPRVWVRAFDQSGDKNDNPDIADYMGYGDVKLQYR
            ||||||||||||||||||||||||||||||||||||||||||||||||||||||||||||
a582        QSRPESRSWNRIYAMAGMEWGKLTVIPRVWVRAFDQSGDKNDNPDIADYMGYGDVKLQYR
                   250        260        270        280        290        300

310        320        330        340        350        360
m582.pep    LNDRQNVYSVLRYNPKTGYGAIEAAYTFPIKGKLKGVVRGFHGYGESLIDYNHKQNGIGI
            ||||||||||||||||||||||||||||||||||||||||||||||||||||||||||||
a582        LNDRQNVYSVLRYNPKTGYGAIEAAYTFPIKGKLKGVVRGFHGYGESLIDYNHKQNGIGI
                   310        320        330        340        350        360

370
m582.pep    GLMFNDLDGIX
            |||||||||||
a582        GLMFNDLDGIX
                   370
```

The following partial DNA sequence was identified in *N. gonorrhoeae* <SEQ ID 1791>:

```
g583.seq..
      1     atgataattg accaaagcca aatatttacc catcttgcct tctgtgcctt 51     ttgcgggatt ggagccgtaa ctgccggcaa tcgactgcat aatcggatgt 101     ataatgccgc cgccgcgcgc ggtattggaa ggggtaacgg gagccagcag 151     cagttcggaa agagcgagac tgtaaccgat gcccagcgtt tttcttccaa 201     aaacggcgat aaacaaatat ccgatacgca tccccagccc tgttttgagc 251     aaaccgcgcg aaatcataac tgcgatggca atcagccaaa tcaacggatt 301     ggcgaacgca ctcaacgcat cgctcatcgc cgcgcccggt tgtcggcgg 351     ttacgccggt tactgcgacc aacccgacgg caataatcga cagcgcgccc 401     aacggcataa ccttgccgat aatggcggca atcacaccga caaacatagc 451     cagcagcgtc aagcctgag gcttgacccc gtcgggtacg ggcagtgcca 501     aaaccagggc gcacaatact gcggcaatgg cgaggggtat cggtttgaaa 551     cccaatttca tcatattgac ctccgtaaaa aagaccgtcc cgaaaaatcg 601     gaaaaataa
```

This corresponds to the amino acid sequence <SEQ ID 1792; ORF 583.ng>:

```
g583.pep..
      1     MIIDQSQIFT HLAFCAFCGI GAVTAGNRLH NRMYNAAAAR GIGRGNGSQQ

51     QFGKSETVTD AQRFSSKNGD KQISDTHPQP CFEQTARNHN CDGNQPNQRI

101     GERTQRIAHR RARFVGGYAG YCDQPDGNNR QRAQRHNLAD NGGNHTDKHS

151     QQRPSLRLDP VGYGQCQNQG AQYCGNGEGY RFETQFHHID LRKKDRPEKS

201     EK*
```

The following partial DNA sequence was identified in *N. meningitidis* <SEQ ID 1793>:

```
m583.seq..
     1    ATGATAGTTG ACCAAAGCCA AATATTTACC CATCTTGCCT TCTGTGCCTT

51    TTGCGGGATT GGAGCCGTAA CTGCCGGCAA TCGACTGCAT AATCGGATGT

101    ATAATGCCGC CGCCGCGCGC GGTATTGGAA GGGGTAACGG GAGCCAGCAG

151    CAGTTCGGAA AGAGCGAGAC TGTAACCGAT GCCCAGCGTT TTTCTTCCAA

201    AAACGGCGAT AAACAAATAT CCGATACGCA TCCCCAGCCC TGTTTTGAGC

251    AAACCGCGCG AAATCATAAC TGCGATGGCA ATCAGCCAAA TCAACGGATT

301    GGCGAACGCA CTCAACGCAT CGCTCATCGC CGCGCCCGGT TTGTCGGCGG

351    TTACGCCGGT TACTGCGACC AACCCGACGG CAATAATCGA CAGCGCGCCC

401    AACGGCATGG CCTTGCCGAT AATGGCGGCA ATCACACCGA CAAACATGGC

451    CAGCAGCGTC CAAGCCTGAG GCTTGACCCC GTCGGGTACG GGCAGTGCCA

501    AAACCAGGGC GCACAATACT GCGGCAATGG CGAGGGGTAT CGGTTTGAAA

551    CCCAATTTCA TCATATTGAC CTCCGTAAAA AAGACCGTCC CGAAAAATCG

601    GAAAAATAA
```

This corresponds to the amino acid sequence <SEQ ID 1794; ORF 583>:

```
m583.pep..
     1    MIVDQSQIFT HLAFCAFCGI GAVTAGNRLH NRMYNAAAAR GIGRGNGSQQ

51    QFGKSETVTD AQRFSSKNGD KQISDTHPQP CFEQTARNHN CDGNQPNQRI

101    GERTQRIAHR RARFVGGYAG YCDQPDGNNR QRAQRHGLAD NGGNHTDKHG

151    QQRPSLRLDP VGYGQCQNQG AQYCGNGEGY RFETQFHHID LRKKDRPEKS

201    EK*
``` m583/g583 98.5% identity in 202 aa overlap

```
                   10        20        30        40        50        60
m583.pep   MIVDQSQIFTHLAFCAFCGIGAVTAGNRLHNRMYNAAAARGIGRGNGSQQQFGKSETVTD
           ||:|||||||||||||||||||||||||||||||||||||||||||||||||||||||||
g583       MIIDQSQIFTHLAFCAFCGIGAVTAGNRLHNRMYNAAAARGIGRGNGSQQQFGKSETVTD
                   10        20        30        40        50        60

70        80        90       100       110       120
m583.pep   AQRFSSKNGDKQISDTHPQPCFEQTARNHNCDGNQPNQRIGERTQRIAHRRARFVGGYAG
           ||||||||||||||||||||||||||||||||||||||||||||||||||||||||||||
g583       AQRFSSKNGDKQISDTHPQPCFEQTARNHNCDGNQPNQRIGERTQRIAHRRARFVGGYAG
                   70        80        90       100       110       120

130       140       150       160       170       180
m583.pep   YCDQPDGNNRQRAQRHGLADNGGNHTDKHGQQRPSLRLDPVGYGQCQNQGAQYCGNGEGY
           ||||||||||||||||:||||||||||||:||||||||||||||||||||||||||||||
g583       YCDQPDGNNRQRAQRHNLADNGGNHTDKHSQQRPSLRLDPVGYGQCQNQGAQYCGNGEGY
                  130       140       150       160       170       180

190       200
m583.pep   RFETQFHHIDLRKKDRPEKSEKX
           |||||||||||||||||||||||
g583       RFETQFHHIDLRKKDRPEKSEKX
                  190       200
```

The following partial DNA sequence was identified in *N. meningitidis* <SEQ ID 1795>:

a583.seq
```
   1    ATGATAGTTG ACCAAAGCCA AATATTTACC CATCTTGCCT TCTGTGCCTT

51    TTGCGGGATT GGAGCCGTAA CTGCCGGCAA TCGACTGCAT AATCGGATGT

101    ATAATGCCGC CGCCGCGCGC GGTATTGGAA GGGGTAACGG GAGCCAGCAG

151    CAGTTCGGAA AGAGCGAGAC TGTAACCGAT GCCCAGCGTT TTTCTTCCAA

201    AAACGGCGAT AAACAAATAT CCGATACGCA TCCCCAGCCC TGTTTTGAGC

251    AAACCGCGCG AAATCATAAC TGCGATGGCA ATCAGCCAAA TCAACGGATT

301    GGCGAACGCA CTCAACGCAT CGCTCATCGC CGCACCCGGT TGTCGGCGG

351    TTACGCCGGT TACTGCGACC AACCCGACGG CAATAATCGA CAGCGCACCC

401    AACGGCATGG CCTTGCCGAT AATGGCGGCA ATCACACCGA TAAACATGGC

451    CAGCAGCGTC CAAGCCTGAG GCTTGACCCC GTCGGGTACG GGCAGTGCCA

501    AAACCAAGGC GCACAATACT GCGGCAATGG CGAGGGGTAT CGGTTTGAAA

551    CCCAATTTCA TCATATTGAC CTCCGTAAAA AAGACCGTCC CGAAAAATCG

601    GAAAAATAA
```

This corresponds to the amino acid sequence <SEQ ID 1796; ORF 583.a>:

a583.pep
```
   1    MIVDQSQIFT HLAFCAFCGI GAVTAGNRLH NRMYNAAAAR GIGRGNGSQQ

51    QFGKSETVTD AQRFSSKNGD KQISDTHPQP CFEQTARNHN CDGNQPNQRI

101    GERTQRIAHR RTRFVGGYAG YCDQPDGNNR QRTQRHGLAD NGGNHTDKHG

151    QQRPSLRLDP VGYGQCQNQG AQYCGNGEGY RFETQFHHID LRKKDRPEKS

201    EK*
``` m583/a583 99.0% identity in 202 aa overlap

```
                  10         20         30         40         50         60
   m583.pep  MIVDQSQIFTHLAFCAFCGIGAVTAGNRLHNRMYNAAAARGIGRGNGSQQQFGKSETVTD
             ||||||||||||||||||||||||||||||||||||||||||||||||||||||||||||
   a583      MIVDQSQIFTHLAFCAFCGIGAVTAGNRLHNRMYNAAAARGIGRGNGSQQQFGKSETVTD
                  10         20         30         40         50         60

70         80         90        100        110        120
   m583.pep  AQRFSSKNGDKQISDTHPQPCFEQTARNHNCDGNQPNQRIGERTQRIAHRRARFVGGYAG
             |||||||||||||||||||||||||||||||||||||||||||||||||||:||||||||
   a583      AQRFSSKNGDKQISDTHPQPCFEQTARNHNCDGNQPNQRIGERTQRIAHRRTRFVGGYAG
                  70         80         90        100        110        120

130        140        150        160        170        180
   m583.pep  YCDQPDGNNRQRAQRHGLADNGGNHTDKHGQQRPSLRLDPVGYGQCQNQGAQYCGNGEGY
             |||||||||||:||||||||||||||||||||||||||||||||||||||||||||||||
   a583      YCDQPDGNNRQRTQRHGLADNGGNHTDKHGQQRPSLRLDPVGYGQCQNQGAQYCGNGEGY
                 130        140        150        160        170        180

190        200
   m583.pep  RFETQFHHIDLRKKDRPEKSEKX
             |||||||||||||||||||||||
   a583      RFETQFHHIDLRKKDRPEKSEKX
                 190        200
```

The following partial DNA sequence was identified in *N. gonorrhoeae* <SEQ ID 1797>:

g584.seq..
```
   1    atgctgcgtt ctattttggc ggcttccctg ctggcggtat cttttccggc 51    ggcggctgag gcattgaatt acaatattgt cgaatttttcc gaatcggcgg 101    gtatcgaggt ggctcaggat acaatgtccg cgcgtttcca ggtggcggcg
```

```
       151   gaaggacggg acaaaaatgc cgtcaatgcc gagtttgtta aaaaattcaa 201   caatttcacc agaaaatcga aaaatggtag ctttaaaacc gaattggtat 251   cgcgcagtgc gatgccgcgc tatcaatata ccaacggcag acgcattcaa 301   acaggctggg aggagcgtgc ggaatttaag gcggagggca gggattttga 351   tgctttaaac cgttttattg ctgatgttca gacggatgct tcgcttgaag 401   ataccgattt cagcgtgtcg cgcgaacgcc gaaacgaggt catcgatcag 451   gtcagcaagg atgccgtttt gcgtttcaag gcgcgtgccg aaaaactggc 501   gggcgttctg ggtgcgtccg gttataaaat cgtcaaattg aattttgggc 551   aaatcggcag ccatattgcg ggcgatgggg ctgttcgggc aaaaatgctg 601   cgcgcgatgc cgatggcggc aagcgtcaat atgaagggta cggattcagc 651   cgcaccgggt gtggaggaaa tcagcatcag catcaatggg acggttcagt 701   tctaa
```

This corresponds to the amino acid sequence <SEQ ID 1798; ORF 584.ng>:

```
g584.pep Length:..
     1   MLRSILAASL LAVSFPAAAE ALNYNIVEFS ESAGIEVAQD TMSARFQVAA

51   EGRDKNAVNA EFVKKFNNFT RKSKNGSFKT ELVSRSAMPR YQYTNGRRIQ

101   TGWEERAEFK AEGRDFDALN RFIADVQTDA SLEDTDFSVS RERRNEVIDQ

151   VSKDAVLRFK ARAEKLAGVL GASGYKIVKL NFGQIGSHIA GDGAVRAKML

201   RAMPMAASVN MKGTDSAAPG VEEISISING TVQF*
```

The following partial DNA sequence was identified in *N. meningitidis* <SEQ ID 1799>:

```
m584.seq..
     1   ATGTTGCGTC TTGTTTTGGC GGCTTCGCTG TCGGCGGTAT CTTTTCCGGC

51   AGCGGCTGAA GCATTGAATT ACAATATTGT CGAATTTTCC GAATCGGCGG

101   GTGTCGAGGT GGCTCAGGAT ACAATGTCCG CACGTTTCCA AGTGACGGCG

151   GAAGGACGGG ACAAAAATGC CGTCAATGCT GAGTTTGTTA AAAAATTCAA

201   CAAGTTCATC AGAAAATCGA AAAATGGTAG CTTTAAAACC GAATTGGTAT

251   CGCGCAGTGC GATGCCGCGC TATCAATATA CCAACGGCAG ACGCATTCAA

301   ACAGGCTGGG AGGAGCGTGC GGAATTTAAG GTCGAAGGTA GAGATTTTGA

351   TGAGTTAAAC CGTTTTATTG CCGATATTCA AGCAGATGCC GCGTTGGmAT

401   ATACGGATTT CCATGTGTCG CGCGAACGCC GCAACGAGGT CATCkATCAG

451   GTCAGCAAGG ATGCCGTTTT GCGTTTCAAG GCGCGTGCCG AAAAGTTGGC

501   GGGCGTTTTG GGTGCGTCCG GTTATAAAAT CGTCAAATTG AATTTGGGAC

551   ACATCGGCAG CCATATCGCG GGAGGGGGAG CTGCTCAGGC AAAAATGCTT

601   CGTGCCATGC CGATGGCGGC AAGCGTCAAT ATGGAGGGTG CGGATTCCGC

651   CGCGCCTGGT GTGGAGGAAA TCAGCATCAG CGTCAATGGG ACGGTTCAGT

701   TCTGA
```

This corresponds to the amino acid sequence <SEQ ID 1800; ORF 584>:

```
m584.pep..
     1     MLRLVLAASL SAVSFPAAAE ALNYNIVEFS ESAGVEVAQD TMSARFQVTA

51     EGRDKNAVNA EFVKKFNKFI RKSKNGSFKT ELVSRSAMPR YQYTNGRRIQ

101     TGWEERAEFK VEGRDFDELN RFIADIQADA ALXYTDFHVS RERRNEVIXQ

151     VSKDAVLRFK ARAEKLAGVL GASGYKIVKL NLGHIGSHIA GGGAAQAKML

201     RAMPMAASVN MEGADSAAPG VEEISISVNG TVQF*
``` m584/g584 89.7% identity in 234 aa overlap

```
                  10         20         30         40         50         60
    m584.pep  MLRLVLAASLSAVSFPAAAEALNYNIVEFSESAGVEVAQDTMSARFQVTAEGRDKNAVNA
              |||:||||| |||||||||||||||||||:|||||||||||||||||:||||||||||||
        g584  MLRSILAASLLAVSFPAAAEALNYNIVEFSESAGIEVAQDTMSARFQVAAEGRDKNAVNA
                  10         20         30         40         50         60
                  70         80         90        100        110        120
    m584.pep  EFVKKFNKFIRKSKNGSFKTELVSRSAMPRYQYTNGRRIQTGWEERAEFKVEGRDFDELN
              ||||||||:| |||||||||||||||||||||||||||||||||||||||| ||||| ||
        g584  EFVKKFNNFTRKSKNGSFKTELVSRSAMPRYQYTNGRRIQTGWEERAEFKAEGRDFDALN
                  70         80         90        100        110        120

130        140        150        160        170        180
    m584.pep  RFIADIQADAALXYTDFHVSRERRNEVIXQVSKDAVLRFKARAEKLAGVLGASGYKIVKL
              |||||:|:||:|   ||| ||||||||||| |||||||||||||||||||||||||||||
        g584  RFIADVQTDASLEDTDFSVSRERRNEVIDQVSKDAVLRFKARAEKLAGVLGASGYKIVKL
                 130        140        150        160        170        180

190        200        210        220        230
    m584.pep  NLGHIGSHIAGGGAAQAKMLRAMPMAASVNMEGADSAAPGVEEISISVNGTVQFX
              |:|:||||||| ||::||||||||||||||:|:|||||||||||||||:||||||
        g584  NFGQIGSHIAGDGAVRAKMLRAMPMAASVNMKGTDSAAPGVEEISISINGTVQFX
                 190        200        210        220        230
```

The following partial DNA sequence was identified in *N. meningitidis* <SEQ ID 1801>:

```
a584.seq
     1     ATGTTGCGTT CTATTTTGGC GGCTTCCCTG CTG....... ..........

51     .......... .......... .....ATTGT CGAATTTTCT GAATCGGCGG

101     GTGTCGAGGC GGTTCAGGAT ACAATGTCCG CACGTTTCCA AGTGACGGCG

151     GAAGGACGGG ACAAAAATGC CGTCAATGCC GAGTTTGTTA AAAAATTCAA

201     CAATTTCACC AGAAAATCAA AAAATGGTAG CTTTAAAACC GAATTGGTAT

251     CGCGCAGTGC GATGCCGCGC TATCAATATA CCAACGGCAG ACGCATTCAA

301     ACAGGTTGGG AGGAGCGTGC GGAATTTAAG GTCGAGGGTA GGAATTTTGA

351     TGCGTTGAAC CGTTTTATTG CCGATGTTCA GGCAGATGCC GCGTTGGAAT

401     ATACGGATTT CCATGTGTCG CGCGAACGCC GCAACGAGGT CATCGATCAG

451     GTCAGCAAGG ATGCCGTTTT GCGTTTCAAG GCGCGTGCCG AAAAGTTGGC

501     GGGCGTTTTG GGTGCGTCCG GTTATAAAAT CGTCAAATTG AATTTGGGAC

551     ACATCGGCAG CCATATCGCG GGAGGGGGAG CTGCTCAGGC AAAAATGCTT

601     CGTGCCATGC CGATGGCGGC AAGCGTCAAT ATGGAGGGTG CGGATTCCGC

651     CGCGCCTGGT GTGGAGGAAA TCAGCATCAG CGTCAATGGG ACGGTTCAGT

701     TCTGA
```

This corresponds to the amino acid sequence <SEQ ID 1802; ORF 584.a>:

```
a584.pep
    1   MLRSILAASL L......... .....IVEFS ESAGVEAVQD TMSARFQVTA

51   EGRDKNAVNA EFVKKFNNFT RKSKNGSFKT ELVSRSAMPR YQYTNGRRIQ

101   TGWEERAEFK VEGRNFDALN RFIADVQADA ALEYTDFHVS RERRNEVIDQ

151   VSKDAVLRFK ARAEKLAGVL GASGYKIVKL NLGHIGSHIA GGGAAQAKML

201   RAMPMAASVN MEGADSAAPG VEEISISVNG TVQF*
``` m584/a584 88.9% identity in 234 aa overlap

```
                 10         20         30         40         50         60
    m584.pep  MLRLVLAASLSAVSFPAAAEALNYNIVEFSESAGVEVAQDTMSARFQVTAEGRDKNAVNA
              ||| :|||||             ||||||||||||::|||||||||||||||||||||||
    a584      MLRSILAASLL-------------IVEFSESAGVEAVQDTMSARFQVTAEGRDKNAVNA
                 10                    20         30         40

70         80         90        100        110        120
    m584.pep  EFVKKFNKFIRKSKNGSFKTELVSRSAMPRYQYTNGRRIQTGWEERAEFKVEGRDFDELN
              ||||||:| |||||||||||||||||||||||||||||||||||||||||||||:|| ||
    a584      EFVKKFNNFTRKSKNGSFKTELVSRSAMPRYQYTNGRRIQTGWEERAEFKVEGRNFDALN
                 50         60         70         80         90        100

130        140        150        160        170        180
    m584.pep  RFIADIQADAALXYTDFHVSRERRNEVIXQVSKDAVLRFKARAEKLAGVLGASGYKIVKL
              ||||| :|||||  ||||||||||||||  ||||||||||||||||||||||||||||||
    a584      RFIADVQADAALEYTDFHVSRERRNEVIDQVSKDAVLRFKARAEKLAGVLGASGYKIVKL
                110        120        130        140        150        160

190        200        210        220        230
    m584.pep  NLGHIGSHIAGGGAAQAKMLRAMPMAASVNMEGADSAAPGVEEISISVNGTVQFX
              ||||||||||||||||||||||||||||||||||||||||||||||||||||||
    a584      NLGHIGSHIAGGGAAQAKMLRAMPMAASVNMEGADSAAPGVEEISISVNGTVQFX
                170        180        190        200        210        220
```

The following partial DNA sequence was identified in *N. gonorrhoeae* <SEQ ID 1803>:

```
g585.seq..
    1     atgaaactgt tccaacgcat tttcgccaca ttttgcgcgg ttatcgtctg 51     cgcaatcttt gtggcgagtt tttcttttg gctggtgcag aacacccttg 101     ccgaaaacca attcaaccaa cgccgcacca tcgaaaccac attgatgggc 151     agcattattt ccgcattcaa gacacggggc gacaacggcg cgcgcgaaat 201     cctgaccgaa tggaaaaaca gccccgtctc atccgccgtt tacgtcatac 251     agggcgacga gaaaaaagac atcttaaacc gctatatcga caattacacc 301     atagaacgcg cccggctgtt tgccgccaac aacccccatt ccaaccttgt 351     ccgcatcgaa tacgaccgtt cggcgaaga ataccctgttc ttcattaaag 401     gctgggacaa ccaccaggca caacgcctgc ccagcccgct gtttatcccg 451     ggcctgccgc ttgccccgat ttggcacgaa ttcatcatcc tctccttcat 501     catcattgtc ggactgctga tggcatatat ccttgccggc aacattgcca 551     aacccatcag aatcttaggc aacggcatgg acagggtggc agaacgagaa 601     cttgaagacc gcgtttgcca acaggttcgc gaccgcgacg acgaattggc 651     cgatgttgcc atgcaattcg acacaatggt ggaaaaactg gaataa
```

This corresponds to the amino acid sequence <SEQ ID 1804; ORF 585.ng>:

```
g585.pep..
    1     MKLFQRIFAT FCAVIVCAIF VASFSFWLVQ NTLAENQFNQ RRTIETTLMG

51     SIISAFKTRG DNGAREILTE WKNSPVSSAV YVIQGDEKKD ILNRYIDNYT
```

-continued

```
101    IERARLFAAN NPHSNLVRIE YDRFGEEYLF FIKGWDNHQA QRLPSPLFIP

151    GLPLAPIWHE FIILSFIIIV GLLMAYILAG NIAKPIRILG NGMDRVAERE

201    LEDRVCQQVR DRDDELADVA MQFDTMVEKL E*
```

The following partial DNA sequence was identified in *N. meningitidis* <SEQ ID 1805>:

```
m585.seq..
    1    ATGAAACTGT TCCAACGCAT TTTCGCCACA TTTTGCGCGG TTATCGTCTG

51    TGCAATCTTT GTGGCGAGTT TTTCTTTCTG GCTGGTGCAG AACACCCTTG

101    CCGAAAACCA GTTCAACCAA CGCCGCACCA TCGAAACCAC TTTGATGGGC

151    AGCATCATTT CCGCATTCCG GGCACGCGGG GACGCGGGTG CGCGCGAAAT

201    CCTGACGGAA TGGAAAGACA GCCCCGTCTC ATCGGGCGTG TACGTTATAC

251    AGGGCGACGA GAAAAAGAT ATCCTGAACC GGTATATCGA CAGCTATACC

301    ATCGAACGCG CCCGGCTTTT CGCCGCCGGA CACCCGCATT CCAACCTCGT

351    CCATATCGAA TACGACCGCT TCGGCGAAGA ATACCTGTTC TTCACCAAAG

401    ACTGGGACAA ACTCCAAGCC CGCCGCCTGC CCAGCCCCCT GTTGATCCCC

451    GGCCTGCCGC TCGCCCCGAT TTGGCACGAA CTCATCATAT TGTCCTTCAT

501    CATCATCGTC GGACTGCTGA TGGCATATAT CCTCGCCGGC AACATTGCCA

551    AACCCATCAG AATCTTAGGC AACGGCATGG ACAGGGTGGC AAACGGAGAA

601    CTTGAAACCC GTATCTCCCA ACAGGTCGAC GACCGCGACG ACGAATTGTC

651    CCATCTTGCC ATCCAATTCG ACAAAATGGT GGAAAAACTC GAAAAACTCG

701    TTGCCAAAGA ACGCCACCTG CTCCATCACG TCTCCCATGA AATGCGTTCT

751    CCCCTTGCGC GCATGCAGGC AATTGTCGGA CTGATTCAGG CGCAGCCCCA

801    AAAACAGGAG CAATATCTCA AACGGCTGGA AGGCGAACTG ACCCGCATGG

851    ATACGCTGGC CGGGGAACTG TTAACCCTGT CCCGTCTCGA AACTTCCAAT

901    ATGGCTTTGG AAAAAGAAAG CCTGAAACTC CTGCCCTTCC TGGGCAACCT

951    GGTAGAAGAC AATCAAAGCA TTGCCCAGAA AAACGGACAA ACGGTTACCC

1001    TGTCTGCCGA CGGAAAAATC CCCGAAAACA CAACCATCCT TGCCAACGAA

1051    AGCTACCTGT ACCGCGCCTT CGACAACGTC ATCCGCAACG CCGTCAACTA

1101    CAGTCCCGAA GGCAGCACCA TCCTGATCAA CATCGGACAA GACCACAAAC

1151    ACTGGATAAT CGACGTTACC GACAACGGCC CCGGCGTGGA CGAAATGCAG

1201    CTCCCGCACA TCTTCACCGC TTTCTACCGT GCAGACTCCA GTGCCAACAA

1251    ACCCGGAACA GGACTGGGGC TTGCATTGAC CCAACATATT ATTGAACAGC

1301    ACTGCGGCAA AATCATCGCC GAAAACATCA AACCGAACGG TCTGCGGATG

1351    CGCTTTATCC TGCCCAAGAA AAAACCGGT TCCAAAACAG AAAAAGTGC

1401    GAACTGA
```

This corresponds to the amino acid sequence <SEQ ID 1806; ORF 585>:

```
m585.pep..
    1    MKLFQRIFAT FCAVIVCAIF VASFSFWLVQ NTLAENQFNQ RRTIETTLMG

51    SIISAFRARG DAGAREILTE WKDSPVSSGV YVIQGDEKKD ILNRYIDSYT
```

-continued

```
101     IERARLFAAG HPHSNLVHIE YDRFGEEYLF FTKDWDKLQA RRLPSPLLIP

151     GLPLAPIWHE LIILSFIIIV GLLMAYILAG NIAKPIRILG NGMDRVANGE

201     LETRISQQVD DRDDELSHLA IQFDKMVEKL EKLVAKERHL LHHVSHEMRS

251     PLARMQAIVG LIQAQPQKQE QYLKRLEGEL TRMDTLAGEL LTLSRLETSN

301     MALEKESLKL LPFLGNLVED NQSIAQKNGQ TVTLSADGKI PENTTILANE

351     SYLYRAFDNV IRNAVNYSPE GSTILINIGQ DHKHWIIDVT DNGPGVDEMQ

401     LPHIFTAFYR ADSSANKPGT GLGLALTQHI IEQHCGKIIA ENIKPNGLRM

451     RFILPKKKTG SKTEKSAN*
``` m585/g585 88.3% identity in 231 aa overlap

```
                    10        20        30        40        50        60
m585.pep    MKLFQRIFATFCAVIVCAIFVASFSFWLVQNTLAENQFNQRRTIETTLMGSIISAFRARG
            ||||||||||||||||||||||||||||||||||||||||||||||||||||||||::||
g585        MKLFQRIFATFCAVIVCAIFVASFSFWLVQNTLAENQFNQRRTIETTLMGSIISAFKTRG
                    10        20        30        40        50        60

70        80        90       100       110       120
m585.pep    DAGAREILTEWKDSPVSSGVYVIQGDEKKDILNRYIDSYTIERARLFAAGHPHSNLVHIE
            | ||||||||||:|||||:||||||||||||||||||:|||||||||||::||||||:||
g585        DNGAREILTEWKNSPVSSAVYVIQGDEKKDILNRYIDNYTIERARLFAANNPHSNLVRIE
                    70        80        90       100       110       120

130       140       150       160       170       180
m585.pep    YDRFGEEYLFFTKDWDKLQARRLPSPLLIPGLPLAPIWHELIILSFIIIVGLLMAYILAG
            ||||||||||| | ||: ||:||||||:||||||||||||:|||||||||||||||||||
g585        YDRFGEEYLFFIKGWDNHQAQRLPSPLFIPGLPLAPIWHEFIILSFIIIVGLLMAYILAG
                   130       140       150       160       170       180

190       200       210       220       230       240
m585.pep    NIAKPIRILGNGMDRVANGELETRISQQVDDRDDELSHLAIQFDKMVEKLEKLVAKERHL
            |||||||||||||||||: ||| |: ||| ||||||: :|:||| ||||||
g585        NIAKPIRILGNGMDRVAERELEDRVCQQVRDRDDELADVAMQFDTMVEKLEX
                   190         200     210       220       230

250       260       270       280       290       300
m585.pep    LHHVSHEMRSPLARMQAIVGLIQAQPQKQEQYLKRLEGELTRMDTLAGELLTLSRLETSN
```

The following partial DNA sequence was identified in *N. meningitidis* <SEQ ID 1807>:

```
a585.seq
     1  ATGAAACTGT TCCAACGCAT CTTCGCCACA TTTTGCGCGG TTATCGTCTG

51  TGCAATCTTT GTGGCGAGTT TTTCTTTCTG GCTGGTGCAG AACACCCTTG

101  CCGAAAACCA GTTCAACCAA CGCCGCACCA TCGAAACCAC TTTGATGGGC

151  AGCATCATTT CCGCATTCCG GGCACGCGGG GACGCGGGTG CGCGCGAAAT

201  CCTGACGGAA TGGAAAGACA GCCCCGTCTC ATCGGGCGTG TACGTTATAC

251  AGGGCGACGA GAAAAAAGAT ATCCTGCACC GGTATATCGA CAGCTACACC

301  ATCGAACGCG CCCGGCTTTT CGCCGCCGGA CACCCGCATT CCAACCTCGT

351  CCATATCGAA TACGACCGCT TCGGCGAAGA ATACCTGTTC TTCACCAAAG

401  ACTGGGACAA ACTCCAAGCC CGCCGCCTGC CCAGCCCCCT GTTGATCCCC

451  GGCCTGCCGC TCGCCCCGAT TTGGCACGAA CTCATCATAT TGTCCTTCAT

501  CATCATCGTC GGACTGCTGA TGGCGTACAT CCTCGCCGGC AACATTGCCA

551  AACCCATCAG AATCTTAGGC AACGGCATGG ACAGGGTGGC AAACGGAGAA

601  CTTGAAACCC GTATCTCCCA ACAGGTCGAC GACCGCGACG ACGAATTGTC

651  CCATCTTGCC ATCCAATTCG ACAAAATGGT GGAAAAACTC GAAAAACTCG

701  TTGCCAAAGA ACGCCACCTG CTCCATCACG TCTCCCATGA AATGCGTTCT
```

```
 751 CCCCTTGCGC GCATGCAGGC AATTGTCGGA CTGATTCAGG CGCAGCCCCA

801 AAAACAGGAG CAATATCTCA ACGGCTGGA AGGCGAACTG AACGGCATGG

851 ATACGCTGGC CGGGGAACTG TTAACCCTGT CCCGTCTCGA AACTTCCAAT

901 ATGGCTTTGG AAAAAGAAAG CCTGAAACTC CTGCCCTTCC TGGGCAACCT

951 GGTAGAAGAC AATCAAAGCA TTGCCCAGAA AAACGGACAA ACGGTTACCC

1001 TGTCTGCCGA CGGAAAAATC CCCGAAAACA CAACCATCCT TGCCAACGAA

1051 AGCTACCTGT ACCGCGCCTT CGACAACGTC ATCCGCAACG CCGTCAACTA

1101 CAGTCCCGAA GGCAGCACCA TCCTGATCAA CATCGGACAA GACCACAAAC

1151 ACTGGATAAT CGACGTTACC GACAACGGCC CCGGCGTGGA CGAAATGCAG

1201 CTCCCGCACA TCTTCACCGC TTTCTACCGT GCAGACTCCA GTGCCAACAA

1251 ACCCGGAACA GGACTGGGGC TTGCATTGAC CCAACATATT ATTGAACAGC

1301 ACTGCGGCAA AATCATCGCC GAAAACATCA AACCGAACGG TCTGCGGATG

1351 CGCTTTATCC TGCCCAAGAA AAAAACCGGT TCCAAAACAG AAAAAAGTGC

1401 GAACTGA
```

This corresponds to the amino acid sequence <SEQ ID 1808; ORF 585.a>:

```
a585.pep
    1 MKLFQRIFAT FCAVIVCAIF VASFSFWLVQ NTLAENQFNQ RRTIETTLMG

51 SIISAFRARG DAGAREILTE WKDSPVSSGV YVIQGDEKKD ILHRYIDSYT

101 IERARLFAAG HPHSNLVHIE YDRFGEEYLF FTKDWDKLQA RRLPSPLLIP

151 GLPLAPIWHE LIILSFIIIV GLLMAYILAG NIAKPIRILG NGMDRVANGE

201 LETRISQQVD DRDDELSHLA IQFDKMVEKL EKLVAKERHL LHHVSHEMRS

251 PLARMQAIVG LIQAQPQKQE QYLKRLEGEL TRMDTLAGEL LTLSRLETSN

301 MALEKESLKL LPFLGNLVED NQSIAQKNGQ TVTLSADGKI PENTTILANE

351 SYLYRAFDNV IRNAVNYSPE GSTILINIGQ DHKHWIIDVT DNGPGVDEMQ

401 LPHIFTAFYR ADSSANKPGT GLGLALTQHI IEQHCGKIIA ENIKPNGLRM

451 RFILPKKKTG SKTEKSAN*
``` m585/a585 99.8% identity in 468 aa overlap

```
                 10         20         30         40         50         60
m585.pep  MKLFQRIFATFCAVIVCAIFVASFSFWLVQNTLAENQFNQRRTIETTLMGSIISAFRARG
          ||||||||||||||||||||||||||||||||||||||||||||||||||||||||||||
a585      MKLFQRIFATFCAVIVCAIFVASFSFWLVQNTLAENQFNQRRTIETTLMGSIISAFRARG
                 10         20         30         40         50         60

70         80         90        100        110        120
m585.pep  DAGAREILTEWKDSPVSSGVYVIQGDEKKDILNRYIDSYTIERARLFAAGHPHSNLVHIE
          |||||||||||||||||||||||||||||||:||||||||||||||||||||||||||||
a585      DAGAREILTEWKDSPVSSGVYVIQGDEKKDILHRYIDSYTIERARLFAAGHPHSNLVHIE
                 70         80         90        100        110        120

130        140        150        160        170        180
m585.pep  YDRFGEEYLFFTKDWDKLQARRLPSPLLIPGLPLAPIWHELIILSFIIIVGLLMAYILAG
          ||||||||||||||||||||||||||||||||||||||||||||||||||||||||||||
a585      YDRFGEEYLFFTKDWDKLQARRLPSPLLIPGLPLAPIWHELIILSFIIIVGLLMAYILAG
                130        140        150        160        170        180

190        200        210        220        230        240
m585.pep  NIAKPIRILGNGMDRVANGELETRISQQVDDRDDELSHLAIQFDKMVEKLEKLVAKERHL
          ||||||||||||||||||||||||||||||||||||||||||||||||||||||||||||
a585      NIAKPIRILGNGMDRVANGELETRISQQVDDRDDELSHLAIQFDKMVEKLEKLVAKERHL
                190        200        210        220        230        240
```

```
              250        260        270        280        290        300
m585.pep  LHHVSHEMRSPLARMQAIVGLIQAPQKQEQYLKRLEGELTRMDTLAGELLTLSRLETSN
          ||||||||||||||||||||||||||||||||||||||||||||||||||||||||||
a585      LHHVSHEMRSPLARMQAIVGLIQAPQKQEQYLKRLEGELTRMDTLAGELLTLSRLETSN
              250        260        270        280        290        300

310        320        330        340        350        360
m585.pep  MALEKESLKLLPFLGNLVEDNQSIAQKNGQTVTLSADGKIPENTTILANESYLYRAFDNV
          ||||||||||||||||||||||||||||||||||||||||||||||||||||||||||
a585      MALEKESLKLLPFLGNLVEDNQSIAQKNGQTVTLSADGKIPENTTILANESYLYRAFDNV
              310        320        330        340        350        360

370        380        390        400        410        420
m585.pep  IRNAVNYSPEGSTILINIGQDHKHWIIDVTDNGPGVDEMQLPHIFTAFYRADSSANKPGT
          ||||||||||||||||||||||||||||||||||||||||||||||||||||||||||
a585      IRNAVNYSPEGSTILINIGQDHKHWIIDVTDNGPGVDEMQLPHIFTAFYRADSSANKPGT
              370        380        390        400        410        420

430        440        450        460   469
m585.pep  GLGLALTQHIIEQHCGKIIAENIKPNGLRMRFILPKKKTGSKTEKSANX
          |||||||||||||||||||||||||||||||||||||||||||||||
a585      GLGLALTQHIIEQHCGKIIAENIKPNGLRMRFILPKKKTGSKTEKSANX
              430        440        450        460
```

The following partial DNA sequence was identified in *N. gonorrhoeae* <SEQ ID 1809>:

```
g586.seq..
    1    atggcagccc atctcgaaga acaacaagag ttagacaact ttaaatattt 51    ttggaaaacc acgggcaaat ggctgtttgc cctgctgatt ttggcggcac 101    tcggctactt gggatacacg gtttaccaaa accgtgcggc ttcccaaaat 151    caggaagcgg cggcggtgct ggcaaacatc gtggaaaagg cgcaaaacaa 201    agccccgcaa agcgaaatca atgccgaact gtccaaactc caacaaagct 251    accccattc catttccgcc gcccaagcca cgctgatggc ggcggcaacc 301    gaatttgacg cgcagcgtta cgatgttgcc gaaggtcatt tgaaatgggt 351    gttgtccaac caaaaagaca gcctgattca ggcgttggcg gcgcagcgtc 401    tgggcgttgt gttgttgcaa caaaaaaaat acgatgccgc gcttgccgca 451    ctcgacacgc cggttgaggc ggacttcgcc cccctgctga tggaaactaa 501    aggcgatgtt tatgccgcac aggaaaaaag ccaggaagcc ttaaaaaact 551    acggacaggc tttggaaaaa atgcctcaag attctgtcgg tcgcgaattg 601    cttcaaatga aactcgattc gctgaaataa
                                           45
```

This corresponds to the amino acid sequence <SEQ ID 1810; ORF 586.ng>:

```
g586.pep..
    1    MAAHLEEQQE LDNFKYFWKT TGKWLFALLI LAALGYLGYT VYQNRAASQN

51    QEAAAVLANI VEKAQNKAPQ SEINAELSKL QQSYPHSISA AQATLMAAAT

101    EFDAQRYDVA EGHLKWVLSN QKDSLIQALA AQRLGVVLLQ QKKYDAALAA

151    LDTPVEADFA PLLMETKGDV YAAQEKSQEA LKNYGQALEK MPQDSVGREL

201    LQMKLDSLK*
```

The following partial DNA sequence was identified in *N. meningitidis* <SEQ ID 1811>:

```
m586.seq
    1    ATGGCAGCCC ATCTCGAAGA ACAACAAGAG TTAGACAACT TTAAATATTT

51    TTGGAAAACC ACGGGCAAAT GGCTGTTTGC CTTGCTGATT TTGGCGGCAC
```

-continued

```
 101   TCGGCTACTT GGGATACACG GTTTACCAAA ACCGTAAAGT TTCCCAAAAT

151   CAGGAAGCGG CGGCGGTGCT GGCAAACATC GTAGAAAAGG CGCAAAGCAA

201   AGCCCCGCAA AGCGAAATCA ATGCCGAATT GACCAAACTC AACAAAGCT

251   ACCCGCATTC CATTTCCGCC GCCCAAGCCA CACTGATGGC GGCGGCAACC

301   GAATTTGACG CGCAGCGTTA CGATGTTGCC GAAGGCCATT TGAAATGGGT

351   GTTGTCCAAC CAAAAGACA GCCTGATTCA AGCGTTGGCG GCGCAGCGTC

401   TGGGCGTTGT GTTGTTGCAA CAAAAAAAT ACGATGCCGC GCTTGCCGCG

451   CTCGATACGC CGGTTGAAGC GGACTTCGCC CCCCTGCTGA TGGAAACCAA

501   AGGCGATGTC TATGCCGCAC AGGGAAAAAG CCAGGAAGCC TTAAAAAACT

551   ACGGACAGGC TTTAGAAAAA ATGCCTCAAG ATTCTGTCGG TCGCGAATTG

601   GTTCAAATGA AACTTGATTC GCTGAAATAA
```

This corresponds to the amino acid sequence <SEQ ID 1812; ORF 586>:

```
m586.pep
   1   MAAHLEEQQE LDNFKYFWKT TGKWLFALLI LAALGYLGYT VYQNRKVSQN

51   QEAAAVLANI VEKAQSKAPQ SEINAELTKL QQSYPHSISA AQATLMAAAT

101   EFDAQRYDVA EGHLKWVLSN QKDSLIQALA AQRLGVVLLQ QKKYDAALAA

151   LDTPVEADFA PLLMETKGDV YAAQGKSQEA LKNYGQALEK MPQDSVGREL

201   VQMKLDSLK*
``` m586/g586 97.1% identity in 209 aa overlap

```
                   10         20         30         40         50         60
   m586.pep  MAAHLEEQQELDNFKYFWKTTGKWLFALLILAALGYLGYTVYQNRKVSQNQEAAAVLANI
             ||||||||||||||||||||||||||||||||||||||||||||:||||||||||||||
   g586      MAAHLEEQQELDNFKYFWKTTGKWLFALLILAALGYLGYTVYQNRAASQNQEAAAVLANI
                   10         20         30         40         50         60
                   70         80         90        100        110        120
   m586.pep  VEKAQSKAPQSEINAELTKLQQSYPHSISAAQATLMAAATEFDAQRYDVAEGHLKWVLSN
             |||||:||||||||||||:|||||||||||||||||||||||||||||||||||||||||
   g586      VEKAQNKAPQSEINAELSKLQQSYPHSISAAQATLMAAATEFDAQRYDVAEGHLKWVLSN
                   70         80         90        100        110        120
                  130        140        150        160        170        180
   m586.pep  QKDSLIQALAAQRLGVVLLQQKKYDAALAALDTPVEADFAPLLMETKGDVYAAQGKSQEA
             ||||||||||||||||||||||||||||||||||||||||||||||||||||||| ||||
   g586      QKDSLIQALAAQRLGVVLLQQKKYDAALAALDTPVEADFAPLLMETKGDVYAAQEKSQEA
                  130        140        150        160        170        180
                  190        200        210
   m586.pep  LKNYGQALEKMPQDSVGRELVQMKLDSLKX
             ||||||||||||||||||||:|||||||||
   g586      LKNYGQALEKMPQDSVGRELLQMKLDSLKX
                  190        200        210
```

The following partial DNA sequence was identified in *N. meningitidis* <SEQ ID 1813>:

```
a586.seq
   1   ATGGCAGCCC ATTTGGAAGA ACAACAAGAG TTGGACAACT TTAAATATTT

51   TTGGAAAACC ACGGGCAAAT GGCTGTTTGC CGTGCTGATT TTGGCGGCAC

101   TCGGCTACTT GGGATACACG GTTTACCAAA ACCGTGCGGC TTCCCAAAAT

151   CAGGAAGCGG CGGCGGTGCT GGCAAACATC GTGGAAAAGG CGCAAAACAA

201   AGCCCCGCAA AGCGAAATCA ATGCCGAATT GGCCAAGCTC AACAAAGCT
```

-continued

```
251  ACCCCCATTC CATTTCCGCC GCCCAAGCCA CGCTGATGGC GGCAGCAACC

301  GAATTTGACG CGCAGCGTTA CGATGTTGCC GAAGGCCATT TGAAATGGGT

351  ATTGTCCAAC CAAAAAGACA GCCTGATCCA GGCGTTGGCG GCGCAGCGTC

401  TGGGCGTTGT GTTGTTGCAA CAAAAAAAAT ACGATGCCGC GCTTGCCGCA

451  CTCGACACGC CGGTTGAAGC GGACTTCGCC CCCTGCTGA TGGAAACCAA

501  AGGCGATGTC TATGCCGCAC AGGGAAAAAG CCAGGAAGCC TTAAAAAACT

551  ACGGACAGGC TTTAGAAAAA ATGCCTCAAG ATTCTGTCGG TCGCGAATTG

601  GTTCAAATGA AACTTGATTC GCTGAAATAA
```

This corresponds to the amino acid sequence <SEQ ID 1814; ORF 586.a>:

```
a586.pep
   1  MAAHLEEQQE LDNFKYFWKT TGKWLFAVLI LAALGYLGYT VYQNRAASQN

51  QEAAAVLANI VEKAQNKAPQ SEINAELAKL QQSYPHSISA AQATLMAAAT

101  EFDAQRYDVA EGHLKWVLSN QKDSLIQALA AQRLGVVLLQ QKKYDAALAA

151  LDTPVEADFA PLLMETKGDV YAAQGKSQEA LKNYGQALEK MPQDSVGREL

201  VQMKLDSLK*
``` m586/a586 97.6% identity in 209 aa overlap

```
                10         20         30         40         50         60
    m586.pep  MAAHLEEQQELDNFKYFWKTTGKWLFALLILAALGYLGYTVYQNRKVSQNQEAAAVLANI
              ||||||||||||||||||||||||||:|||||||||||||||||:|||||||||||||||
    a586      MAAHLEEQQELDNFKYFWKTTGKWLFAVLILAALGYLGYTVYQNRAASQNQEAAAVLANI
                10         20         30         40         50         60

70         80         90        100        110        120
    m586.pep  VEKAQSKAPQSEINAELTKLQQSYPHSISAAQATLMAAATEFDAQRYDVAEGHLKWVLSN
              |||||:|||||||||||:||||||||||||||||||||||||||||||||||||||||||
    a586      VEKAQNKAPQSEINAELAKLQQSYPHSISAAQATLMAAATEFDAQRYDVAEGHLKWVLSN
                70         80         90        100        110        120

130        140        150        160        170        180
    m586.pep  QKDSLIQALAAQRLGVVLLQQKKYDAALAALDTPVEADFAPLLMETKGDVYAAQGKSQEA
              ||||||||||||||||||||||||||||||||||||||||||||||||||||||||||||
    a586      QKDSLIQALAAQRLGVVLLQQKKYDAALAALDTPVEADFAPLLMETKGDVYAAQGKSQEA
               130        140        150        160        170        180

190        200        210
    m586.pep  LKNYGQALEKMPQDSVGRELVQMKLDSLKX
              |||||||||||||||||||||||||||||
    a586      LKNYGQALEKMPQDSVGRELVQMKLDSLKX
               190        200        210
```

The following partial DNA sequence was identified in *N. gonorrhoeae* <SEQ ID 1815>:

```
g587.seq..
   1  atgaaacgta tcttttttgcc cgccttgccc gccatcctgc ctttatccgc 51  ttatgccgac ctgcccttga cgattgaaga cataatgacc gacaagggaa 101  aatggaaact ggaaacttcc cttacctatc tgaatagcga aacagccgc 151  gccgcacttg ccgcaccggt ttacattcaa accggcgcaa cctcgtttat 201  ccccattccg accgaaattc aagaaaacgg cagcaatacc gatatgctcg 251  ccggcacgct cggtttgcgc tacggactga ccggcaatac cgacatttac 301  ggcagcggca gctatctgtg gcacgaagaa cgcaaactcg acggcaacgg 351  caaaacccgc aacaaacgga tgtccgacat atccgccggc atcagccaca
```

-continued

```
  401   ccttccttaa agacggcaaa aacccagccc taatcagctt tcttgaaagc
  451   acggtttacg aaaaatcgcg caacaaagcc tcgttaatca aaaaaggggg
  501   gctttgcccc ttttataact taaggataaa ttatgaatat taa
```

This corresponds to the amino acid sequence <SEQ ID 1816; ORF 587.ng>:

```
g587.pep..
    1   MKRIFLPALP AILPLSAYAD LPLTIEDIMT DKGKWKLETS LTYLNSENSR
   51   AALAAPVYIQ TGATSFIPIP TEIQENGSNT DMLAGTLGLR YGLTGNTDIY
  101   GSGSYLWHEE RKLDGNGKTR NKRMSDISAG ISHTFLKDGK NPALISFLES
  151   TVYEKSRNKA SLIKKRGLCP FYNLRINYEY *
```

The following partial DNA sequence was identified in *N. meningitidis* <SEQ ID 1817>:

```
m587.seq..
    1   ATGAAGCGCA TCTTTTTGCC CGCCTTGCCC GCCATCCTGC CTTTATCCAC
   51   TTATGCCGAC CTGCCCTTGA CGATTGAAGA CATAATGACC GACAAGGGAA
  101   AATGGAAACT GGAAACTTCC CTTACCTACC TGAACAGCGA AAACAACCGC
  151   GCCGAACTTG CCGCACCGGT TTACATTCAA ACCGGCGCAA CCTCGTTTAT
  201   CCCCATTCCG ACCGAAATCC AAGAAAACGG CAGCAATACC GATATGCTCG
  251   TCGGCACGCT CGGTTTGCGC TACGGACTGA CCGGGAATAC CGACATTTAC
  301   GGCAGCGGCA GCTATCTGTG GCACGAAGAA CGCAAACTCG ACGGCAACAG
  351   CAAAACCCGC AACAAACGGA TGTCCGACGT ATCCCTCGGC ATCAGCCACA
  401   CTTTCCTTAA AGACGACAAA AACCCCGCCC TAATCAGCTT TCTTGAAAGC
  451   ACGGTTTACG AAAAATCGCG CAACAAAGCC TCGTCGGGAA ATCCTGGCT
  501   CATCGGCGCC ACCACCTACA AAGCCATAGA TCCGATTGTC CTTTCCTTCA
  551   CCGCCGCCTA CCGCATCAAC GGCAGCAAAA CCCTTTCAGA CGGCATCCGC
  601   TACAAATCGG GCAACTACCT GCTGCTCAAC CCCAACATCT CATTTGCTGC
  651   CAACGACAGA ATCAGCCTGA CCGGAGGCAT CCAATGGCTG GGCAGGCAGC
  701   CCGACCGGAC GGACGGCAAA CGGGAATCCT CCAGAAACAC ATCCACCTAC
  751   GCCCATTTCG GCGCAGGTTT CGGTTTCACC AAAACCACGG CTTTAAACGC
  801   ATCCGCACGT TTCAACGTTT CAGGGCAAAG CAGTTCCGAA CTGAAATTTG
  851   GCGTACAGCA TACATTTTAA
```

This corresponds to the amino acid sequence <SEQ ID 1818; ORF 587>:

```
m587.pep..
    1   MKRIFLPALP AILPLSTYAD LPLTIEDIMT DKGKWKLETS LTYLNSENNR
   51   AELAAPVYIQ TGATSFIPIP TEIQENGSNT DMLVGTLGLR YGLTGNTDIY
  101   GSGSYLWHEE RKLDGNSKTR NKRMSDVSLG ISHTFLKDDK NPALISFLES
  151   TVYEKSRNKA SSGKSWLIGA TTYKAIDPIV LSLTAAYRIN GSKTLSDGIR
  201   YKSGNYLLLN PNISFAANDR ISLTGGIQWL GRQPDRTDGK RESSRNTSTY
  251   AHFGAGFGFT KTTALNASAR FNVSGQSSSE LKFGVQHTF*
```

Computer analysis of this amino acid sequence gave the following results:
Homology with a Predicted ORF from *N. gonorrhoeae*
m587/g587 95.0% identity in 161 aa overlap

```
              10         20         30         40         50         60
m587.pep  MKRIFLPALPAILPLSTYADLPLTIEDIMTDKGKWKLETSLTYLNSENNRAELAAPVYIQ
          ||||||||||||||||:||||||||||||||||||||||||||||||:|| ||||||||
g587      MKRIFLPALPAILPLSAYADLPLTIEDIMTDKGKWKLETSLTYLNSENSRAALAAPVYIQ
              10         20         30         40         50         60

70         80         90        100        110        120
m587.pep  TGATSFIPIPTEIQENGSNTDMLVGTLGLRYGLTGNTDIYGSGSYLWHEERKLDGNSKTR
          ||||||||||||||||||||||||:|||||||||||||||||||||||||||||||:|||
g587      TGATSFIPIPTEIQENGSNTDMLAGTLGLRYGLTGNTDIYGSGSYLWHEERKLDGNGKTR
              70         80         90        100        110        120

130        140        150        160        170        180
m587.pep  NKRMSDVSLGISHTFLKDDKNPALISFLESTVYEKSRNKASSGKSWLIGATTYKAIDPIV
          ||||||:| |||||||||| |||||||||||||||||||||||
g587      NKRMSDISAGISHTFLKDGKNPALISFLESTVYEKSRNKASLIKKRGLCPFYNLRINYEY
             130        140        150        160        170        180

190        200        210        220        230        240
m587.pep  LSLTAAYRINGSKTLSDGIRYKSGNYLLLNPNISFAANDRISLTGGIQWLGRQPDRTDGK g587      X
```

The following partial DNA sequence was identified in *N. meningitidis* <SEQ ID 1819>:

```
a587.seq
    1   ATGAAGCGCA TCTTTTTGCC CGCCTTGCCC GCCATCCTGC CTTTATCCGC

51   TTATGCCGAC CTGCCCTTGA CGATTGAAGA CATAATGACC GACAAGGGCA

101   AATGGAAACT GGAAACTTCC CTTACCTACC TGAACAGCGA AAACAACCGC

151   GCCGAACTTG CCGCACCGGT TTACATCCAA ACCGGCGCAA CCTCGTTTAT

201   CCCCATTCCG ACCGAAATCC AAGAAAACGG CAGCAATACC GATATGCTCG

251   TTGGCACGCT CGGTTTGCGC TACGGACTGA CCGGGAATAC CGACATTTAC

301   GGCAGCGGCA GCTATCTGTG GCACGAAGAA CGCAAACTCG ACGGCAACGG

351   CAAAACCCGA ACAAACGGA TGTCCGACGT ATCCCTCGGC ATCAGCCACA

401   CCTTCCTTAA AGACGACAAA AACCCCGCCC TAATCAGCTT TCTTGAAAGC

451   ACGGTTTACG AAAAATCGCG CAACAAAGCC TCGTCGGGAA AATCCTGGCT

501   CATCGGCGCC ACCACCTACA AAGCCATCGA CCCCGTCGTC CTCTCATTGA

551   CCGCTGCCTA CCGTATCAAC GGCAGCAAAA CCCTTTCAAG CAACACCAAA

601   TACAAAGCAG GCAATTACTG GATGCTGAAT CCCAATATAT CCTTCGCCGC

651   CAACGACAGA ATCAGCCTCA CGGGCGGCAT CCAATGGCTG GGCAAGCAGC

701   CCGACCGTCT GGACGGCAAA AAAGAATCCG CAAGAAACAC ATCCACCTAT

751   GCCCATTTCG GCGCAGGTTT CGGTTTCACC AAAACCACGG CTTTAAACGC

801   ATCCGCACGT TTCAACGTTT CAGGGCAAAG CAGTTCCGAA CTGAAATTTG

851   GCGTACAGCA TACGTTTTAA
```

This corresponds to the amino acid sequence <SEQ ID 1820; ORF 587.a>:

```
a587.pep
    1   MKRIFLPALP AILPLSAYAD LPLTIEDIMT DKGKWKLETS LTYLNSENNR

51   AELAAPVYIQ TGATSFIPIP TEIQENGSNT DMLVGTLGLR YGLTGNTDIY
```

-continued

```
101  GSGSYLWHEE RKLDGNGKTR NKRMSDVSLG ISHTFLKDDK NPALISFLES

151  TVYEKSRNKA SSGKSWLIGA TTYKAIDPVV LSLTAAYRIN GSKTLSSNTK

201  YKAGNYWMLN PNISFAANDR ISLTGGIQWL GKQPDRLDGK KESARNTSTY

251  AHFGAGFGFT KTTALNASAR FNVSGQSSSE LKFGVQHTF*
``` m587/a587 95.2% identity in 289 aa overlap

```
                    10         20         30         40         50         60
m587.pep    MKRIFLPALPAILPLSTYADLPLTIEDIMTDKGKWKLETSLTYLNSENNRAELAAPVYIQ
            ||||||||||||||||| :||||||||||||||||||||||||||||||||||||||||
a587        MKRIFLPALPAILPLSAYADLPLTIEDIMTDKGKWKLETSLTYLNSENNRAELAAPVYIQ
                    10         20         30         40         50         60

70         80         90        100        110        120
m587.pep    TGATSFIPIPTEIQENGSNTDMLVGTLGLRYGLTGNTDIYGSGSYLWHEERKLDGNSKTR
            |||||||||||||||||||||||||||||||||||||||||||||||||||||||:|||
a587        TGATSFIPIPTEIQENGSNTDMLVGTLGLRYGLTGNTDIYGSGSYLWHEERKLDGNGKTR
                    70         80         90        100        110        120

130        140        150        160        170        180
m587.pep    NKRMSDVSLGISHTFLKDDKNPALISFLESTVYEKSRNKASSGKSWLIGATTYKAIDPIV
            |||||||||||||||||||||||||||||||||||||||||||||||||||||||||:|
a587        NKRMSDVSLGISHTFLKDDKNPALISFLESTVYEKSRNKASSGKSWLIGATTYKAIDPVV
                   130        140        150        160        170        180

190        200        210        220        230        240
m587.pep    LSLTAAYRINGSKTLSDGIRYKSGNYLLLNPNISFAANDRISLTGGIQWLGRQPDRTDGK
            |||||||||||||||::  :||:|||  :|||||||||||||||||||||||:||| |||
a587        LSLTAAYRINGSKTLSSNTKYKAGNYWMLNPNISFAANDRISLTGGIQWLGKQPDRLDGK
                   190        200        210        220        230        240

250        260        270        280        290
m587.pep    RESSRNTSTYAHFGAGFGFTKITALNASARFNVSGQSSSELKFGVQHTFX
            :||:||||||||||||||||||||||||||||||||||||||||||||||
a587        KESARNTSTYAHFGAGFGFTKITALNASARFNVSGQSSSELKFGVQHTFX
                   250        260        270        280        290
```

The following partial DNA sequence was identified in *N. gonorrhoeae* <SEQ ID 1821>:

```
g588.seq
    1   atgcttaaac atctcgcatt cctactgccc gccatgatgt tcgccctccc 51   cgcccagacc gccgtcctaa gcccctatca ggaaaccggc tgcacctacg 101   aaggcgggat cggaaaagac gggcttcctt caggcaaagg catatggcgt 151   tgccgggatg ggcgcggtta taccggttca ttcaaaaacg gcaaattcga 201   cgggcaaggc gtttataccg ttgccgccgg ccgcgaagta tttctcgagc 251   cgttcaattc cgacagtacc aaattccgca atatggcatt gtcgggcacg 301   ttcaaacaag gcttggcaca cggcaggttc gccgcctcgc aaaacggcga 351   aaccctcttt tattatgaaa tgcgaacacg gcatgattaa
```

This corresponds to the amino acid sequence <SEQ ID 1822; ORF 588.ng>:

```
g588.pep..
    1   MLKHLAFLLP AMMFALPAQT AVLSPYQETG CTYEGGIGKD GLPSGKGIWR

51   CRDGRGYTGS FKNGKFDGQG VYTVAAGREV FLEPFNSDST KFRNMALSGT

101   FKQGLAHGRF AASQNGETLF YYEMRTRHD*
```

The following partial DNA sequence was identified in *N. meningitidis* <SEQ ID 1823>:

```
m588.seq..
       1   ATGCTTAAAC ATCTCGCATT CCTACTGCCC GCCATGATGT TCGCCCTCCC

51   CACTTCGGCC GCCGTCCTGA CTTCCTATCA AGAACCAGGC TGCACCTACG

101   ACGGCAATGT CGGCAAAGAC GGTAAACCCG CCGGCAAAGG CACATGGCGC

151   TGCCAAGACG GGCGCAACTA TACCGGTTCG TTTAAAAACG GCAAATTCGA

201   CGGGCAAGGC GTTTATACCG TTGCCGCCAA CCGCGAAATA TTTATCGAAC

251   CGTTCAATTC CGACAGTACC AAATTCCGCA ACATGGTACT CTCGGGCACG

301   TTCAAAAAAG GCTTGGCACA CGGCAGATTT ACCGTCTCGC AAAACGGCGA

351   AACCCTCTTC ATTATGAAAT GCGAAAACGG CATGATTAAA GAAGTGAAAC

401   TGCCCAAAAA CAAATAA
```

This corresponds to the amino acid sequence <SEQ ID 1824; ORF 588>:

```
m588.pep..
       1   MLKHLAFLLP AMMFALPTSA AVLTSYQEPG CTYDGNVGKD GKPAGKGTWR

51   CQDGRNYTGS FKNGKFDGQG VYTVAANREI FIEPFNSDST KFRNMVLSGT

101   FKKGLAHGRF TVSQNGETLF IMKCENGMIK EVKLPKNK*
```

Computer analysis of this amino acid sequence gave the following results:
Homology with a Predicted ORF from N. gonorrhoeae
  m588/g588 82.5% identity in 120 aa overlap

```
                   10         20         30         40         50         60
   m588.pep  MLKHLAFLLPAMMFALPTSAAVLTSYQEPGCTYDGNVGKDGKPAGKGTWRCQDGRNYTGS
             ||||||||||||||||||::::|||:|||||||:::|||:|:||||||:||||:||||
       g588  MLKHLAFLLPAMMFALPAQTAVLSPYQETGCTYEGGIGKDGLPSGKGIWRCRDGRGYTGS
                   10         20         30         40         50         60

70         80         90        100        110        120
   m588.pep  FKNGKFDGQGVYTVAANREIFIEPFNSDSTKFRNMVLSGTFKKGLAHGRFTVSQNGETLF
             |||||||||||||||::||:|:||||||||||||||:|||||::||||||::|||||||
       g588  FKNGKFDGQGVYTVAAGREVFLEPFNSDSTKFRNMALSGTFKQGLAHGRFAASQNGETLF
                   70         80         90        100        110        120

130       139
   m588.pep  IMKCENGMIKEVKLPKNKX
       g588  YYEMRTRHDX
                  130
```

The following partial DNA sequence was identified in N. meningitidis <SEQ ID 1825>:

```
a588.seq
       1   ATGCTTAAAC ATCTCGCATT CCTACTGCCC GCCATGATGT TCGCCCTCCC

51   CGCCGCGTCC GCCGTTCTGA CTTCCTATCA AGAACCCGGC TGCACCTACG

101   AAGGCGATGT CGGCAAAGAC GGTAAACCCG CCGGCAAAGG CACATGGCGC

151   TGCCAAGACG GGCGCAACTA TACCGGTTCG TTTAAAAATG GCAAATTCGA

201   CGGACAAGGC GTTTATACCG TTGCCGCCAA CCGCGAAATA TTTATCGAAC

251   CGTTCAATTC CGACAGTACC AAATTCCGCA ACATGGTACT CTCGGGCACA

301   TTCAAAAAAG GCTTGGCACA CGGCAGATTT ACCGTCTCGC AAAACGGCGA

351   AACCCTCTTC ATTATGAAAT GCGAAAACGG CATGATTAAA GAAGTGAAGC

401   TGCCCAAAAA CAAATAA
```

This corresponds to the amino acid sequence <SEQ ID 1826; ORF 588.a>:

```
a588.pep
    1   MLKHLAFLLP AMMFALPAAS AVLTSYQEPG CTYEGDVGKD GKPAGKGTWR

51   CQDGRNYTGS FKNGKFDGQG VYTVAANREI FIEPFNSDST KFRNMVLSGT

101   FKKGLAHGRF TVSQNGETLF IMKCENGMIK EVKLPKNK*
``` m588/a588 96.4% identity in 138 aa overlap

```
                 10        20        30        40        50        60
m588.pep    MLKHLAFLLPAMMFALPTSAAVLTSYQEPGCTYDGNVGKDGKPAGKGTWRCQDGRNYTGS
            ||||||||||||||||||:::||||||||||||:|:||||||||||||||||||||||||
a588        MLKHLAFLLPAMMFALPAASAVLTSYQEPGCTYEGDVGKDGKPAGKGTWRCQDGRNYTGS
                 10        20        30        40        50        60

70        80        90       100       110       120
m588.pep    FKNGKFDGQGVYTVAANREIFIEPFNSDSTKFRNMVLSGTFKKGLAHGRFTVSQNGETLF
            ||||||||||||||||||||||||||||||||||||||||||||||||||||||||||||
a588        FKNGKFDGQGVYTVAANREIFIEPFNSDSTKFRNMVLSGTFKKGLAHGRFTVSQNGETLF
                 70        80        90       100       110       120

130       139
m588.pep    IMKCENGMIKEVKLPKNKX
            |||||||||||||||||||
a588        IMKCENGMIKEVKLPKNKX
                130
```

The following partial DNA sequence was identified in *N. gonorrhoeae* <SEQ ID 1827>:

```
g589.seq..
    1    atgcaacaaa aaatccgttt ccaaatcgag gcgatgacct gtcaggcatg 51    tgcttcgcgc attgaaaaag tgttgaacaa aaaagatttt gtcgaatcgg 101    cgggagtgaa ctttgccagt gaggaagcgc aggttacgtt tgacggcagc 151    aaaacctcgg ttgccgacat tgccaaaatc attgagaaaa ccggttacgg 201    cgcgaaggaa aaaacggaag atacattgcc gcaacctgaa gcagaacacc 251    atatcggctg gcggttgtgg cttttgctga ccatcaatat cccgttcctt 301    atcggtatgg tagggatgat gctaaaaggg ctgaattgga cacggcacga 351    ttggatgatt ccgcctgtat ggcagtttgt actggcaagc atagtgcaac 401    tttggctggc aatcccgttt tacaaaagcg cgtgggcaag cattaaaggc 451    gggctggcga atatggacgt actcgttacc atcggcacgg tgtcgattta 501    cctgtattcc gtttatatgc tgttttttcag ttcgcatgcg gcgcacggta 551    tggcgcatgt gtattttgaa gcgggcgtga tggtgatcgg ttttgtgtcg 601    ctgggtaagt ttttggaaca ccgcaccaaa aaatccagcc tgaacagctt 651    gggcttactg ctaaaactca cgccgaccca agtcaacgtg caacgcaacg 701    gcgaatggaa acaactgccc atcgaccaag tgcaaatcgg cgaccttatc 751    cgcaccaacc acggcgaacg catcgctgcc gacggcatta tcgaaagcgg 801    cagcggttgg gcggacgaaa gccaccttac cggcgaatcc aatcccgaag 851    agaaaaaggc gggcggcaaa gtgttggcgg gcgcgctgat gaccgaaggc 901    agcgtggtgt accgcgccgc gcagctcggc agccaaaccc tgctcggcga 951    catgatgaac gcgctctctg aagcacaagg cagtaaagca ccgattgcgc 1001    gcgtggccga taaagcggcg gcggtatttg tgccaactgt cgtgggcatc 1051    gcgcttctga ctttttatcgt tgcttggctg attaagggcg attggacggt
```

```
1101   cgcactgatg cacgccgttg ccgttttggt gattgcctgc ccgtgcgcgc
1151   tcggtctggc gaccoctgcc gcgattatgg tcggcatggg caaagcggtg
1201   aaacacggca tttggtttaa agacgcggcg gcaatggagg aagcagccca
1251   cgtcgatgcc gtcgtattgg acaaaaccgg tacgctgacc gaaggcaggc
1301   cgcaggttgc cgccgtttat tacgttcccg acagcggctt tgacgaagac
1351   gctttgtacc gcatcgccgc cgccgtcgag caaaacgccg cccacccgct
1401   cgcccgcgcc atcgtctccg ccgcacaagc gcgcggtttg gagattcccg
1451   ctgcacaaaa tgcgcaaacc gttgtcggag caggcattac cgccgaagtg
1501   gaaggcgtgg gtttggtgaa atcaggcaaa gccgaatttg ccgaactgac
1551   cttgccgaag ttttcagacg gcgtttggga atcgccagt gcggttaccg
1601   tatctgtaaa cggcaaaccg atcggcgcat cgcactctc cgacgcgttg
1651   aaagccgata ccgccgaagc cataggccgt ctgaaaaaac acaatatcga
1701   tgtctatatt atgagcggcg ataaccaaag tacggtcgaa tacgtcgcca
1751   aacaactggg catcgcacac gccttcggta atatgagtcc gtgcgacaaa
1801   gccgccgaag tgcagaaact caaagccgcc ggcaaaaccg tggcgatggt
1851   cggcgacggc atcaacgacg cgcccgcgct tgccgccgcc aacgtcagct
1901   tcgccatgaa aggcggtgcg gacgttgccg aacacaccgc ctccgccacg
1951   ctgatgcagc attcggtcaa tcagctcgcc gatgccctgc tgatatcgca
2001   ggcaacgttg gaaaacatca agcaaaacct attttcgcc ttcttctaca
2051   atatattggg cattccgctc gccgcgctcg gcttttaaa tcccgtcata
2101   gcaggcgcgg caatggcggc aagctcggtt tcggtattgg gcaatgccct
2151   gcgcctgaaa tgggtaaaaa tcgattga
```

This corresponds to the amino acid sequence <SEQ ID 1828; ORF 589.ng>:

```
g589.pep..
   1    MQQKIRFQIE AMTCQACASR IEKVLNKKDF VESAGVNFAS EEAQVTFDGS
  51    KTSVADIAKI IEKTGYGAKE KTEDTLPQPE AEHHIGWRLW LLLTINIPFL
 101    IGMVGMMLKG LNWTRHDWMI PPVWQFVLAS IVQLWLAIPF YKSAWASIKG
 151    GLANMDVLVT IGTVSIYLYS VYMLFFSSHA AHGMAHVYFE AGVMVIGFVS
 201    LGKFLEHRTK KSSLNSLGLL LKLTPTQVNV QRNGEWKQLP IDQVQIGDLI
 251    RTNHGERIAA DGIIESGSGW ADESHLTGES NPEEKKAGGK VLAGALMTEG
 301    SVVYRAAQLG SQTLLGDMMN ALSEAQGSKA PIARVADKAA AVFVPTVVGI
 351    ALLTFIVAWL IKGDWTVALM HAVAVLVIAC PCALGLATPA AIMVGMGKAV
 401    KHGIWFKDAA AMEEAAHVDA VVLDKTGTLT EGRPQVAAVY YVPDSGFDED
 451    ALYRIAAAVE QNAAHPLARA IVSAAQARGL EIPAAQNAQT VVGAGITAEV
 501    EGVGLVKSGK AEFAELTLPK FSDGVWEIAS AVTVSVNGKP IGAFALSDAL
 551    KADTAEAIGR LKKHNIDVYI MSGDNQSTVE YVAKQLGIAH AFGNMSPCDK
 601    AAEVQKLKAA GKTVAMVGDG INDAPALAAA NVSFAMKGGA DVAEHTASAT
 651    LMQHSVNQLA DALLISQATL ENIKQNLFFA FFYNILGIPL AALGFLNPVI
 701    AGAAMAASSV SVLGNALRLK WVKID*
```

The following partial DNA sequence was identified in *N. meningitidis* <SEQ ID 1829>:

```
m589.seq..
      1   ATGCAACAAA AATCCGTTTT CCAAATCGAA GGCATGACCT GCCAGGCCTG
     51   CGCTTCGCGC ATTGAAAAAG TGTTGAACAA AAAAGATTTT GTCGAATCGG
    101   CGGGGGTAAA CTTCGCCAGC GAAGAGGCGC AGGTAGTGTT TGACGACAGC
    151   AAAACCTCAG TAGCCGACAT TGCCAAAATC ATTGAGAAAA CCGGTTACGG
    201   CGCGAAGGAA AAAACGGAAG ATACATTGCC GCAACCCGAA GCAGAACACC
    251   ATATCGGCTG GCGGCTGTGG CTGCTGTTCA CCATCAACGT CCCGTTCCTT
    301   ATCGGCATGG CGGGGATGAT GATCGGCAGA CACGATTGGA TGATTCCGCC
    351   GTTGTGGCAG TTCGCATTGG CAAGCGTGGT GCAGCTTTGG CTGGCAATCC
    401   CGTTTTACAA AAGCGCGTGG GCGAGCATTA AGGGCGGACT GGCGAATATG
    451   GACGTGCTGG TTACCATCGG CACGGTCTCG ATTTACCTGT ATTCCGTCTA
    501   TATGCTGTTT TTCAGCCCGC ACGCGGCGTA CGGTATGGCG CATGTGTATT
    551   TTGAAGTGGG CGTGATGGTG ATCGGTTTTG TGTCACTGGG TAAATTTTTG
    601   GAACACCGTA CCAAAAAATC CAGCCTCAAC AGCTTGGGCT TGCTGCTCAA
    651   ACTTACACCA ACCCAAGTCA ACGTGCAACG CAACGGCGAA TGGAAACAGC
    701   TTCCCATCGA CCAAGTGCAA ATCGGCGACC TTATCCGCGC CAACCACGGC
    751   GAACGCATTG CCGCAGACGG CATCATTGAA AGCGGCAGCG GTTGGGCGGA
    801   CGAGAGCCAT CTTACCGGCG AATCCAATCC TGAAGAAAAA AAGGCGGGCG
    851   GCAAAGTGTT GGCGGGCGCG TTAATGACCG AAGGCAGTGT GGTGTACCGC
    901   GCCACGCAGC TCGGCAGCCA AACCCAGCTC GGCGACATGA TGAACGCGCT
    951   CTCTGAAGCA CAAGGCAGTA AAGCACCGAT TGCGCGCGTA GCCGATAAAG
   1001   CGGCTGCGGT ATTCGTGCCT GCCGTCGTGG GCATTGCGTT GTTGACTTTT
   1051   ATTGTTACTT GGCTGATTAA GGGCGATTGG ACGGTTGCGC TGATGCACGC
   1101   CGTCGCCGTT TTGGTGATTG CCTGCCCGTG CGCGCTGGGT CTGGCAACCC
   1151   CTGCCGCGAT TATGGTCGGT ATGGGCAAAG CGGTTAAACA CGGTATTTGG
   1201   TTTAAAGACG CGGCAGCAAT GGAGGAAGCC GCCCACGTCG ATGCCGTCGT
   1251   GTTGGACAAA ACCGGTACGC TGACCGAAGG CAGCCCGCAG GTTGCCGCCG
   1301   TTTATTGCGT TCCCGACAGC GGCTTTGACG AAGACGCTTT GTACCGCATC
   1351   GCCGCCGCCG TCGAACAAAA CGCCGCCCAT CCGCTCGCCC GTGCCATCGT
   1401   CTCCGCCGCC CAAGCGCGCG GTTTGGACAT TCCCGCCGCA CAAAACGCAC
   1451   AAACCGTTGT CGGCGCAGGC ATTACCGCCG AAGTGGAAGG CGTGGGTTTG
   1501   GTGAAAGCAG GCAAAGCCGA ATTTGCCGAA CTGGCCTTGC CGAAGTTTTT
   1551   AGACGGCGTT TGGGATATTG CAAGCATTGT TGCGGTCTCA GTCGATAACA
   1601   AACCCATCGG CGCATTCGCA CTTGCCGACG CGTTGAAAGC CGATACCGCC
   1651   GAAGCCATAG GCCGTCTGAA AAAACACAAT ATCGATGTCT ATATTATGAG
   1701   CGGCGACAAC CAAGGCACGG TCGAATACGT CGCCAAACAA CTGGGCATCG
   1751   CACACGCCTT CGGCAACATG AGTCCGCGCG ATAAAGCTGC CGAAGTGCAA
   1801   AAACTCAAAG CCGCCGGCAA AACCGTGGCG ATGGTCGGCG ACGGCATCAA
   1851   CGACGCGCCC GCGCTTGCCG CCGCTAACGT CAGCTTCGCC ATGAAAGGCG
   1901   GAGCGGACGT TGCCGAACAT ACCGCATCCG CCACGCTGAT GCAGCATTCG
```

-continued

```
1951    GTCAACCAAC TCGCCGATGC TCTGCTGGTG TCGCAAGCCA CTTTGAAAAA

2001    CATCAAGCAA AACCTGTTTT TCGCCTTCTT CTACAATATT TTGGGCATTC

2051    CTCTCGCCGC GCTTGGCTTT TTAAATCCCG TCATCGCTGG CGCGGCAATG

2101    GCGGCAAGCT CGGTTTCCGT GTTGAGCAAT GCCTTGCGCC TGAAACGGGT

2151    AAAAATCGAT TAG
```

This corresponds to the amino acid sequence <SEQ ID 1830; ORF 589>:

```
m589.pep..
    1    MQQKIRFQIE GMTCQACASR IEKVLNKKDF VESAGVNFAS EEAQVVFDDS

51    KTSVADIAKI IEKTGYGAKE KTEDTLPQPE AEHHIGWRLW LLFTINVPFL

101    IGMAGMMIGR HDWMIPPLWQ FALASVVQLW LAIPFYKSAW ASIKGGLANM

151    DVLVTIGTVS IYLYSVYMLF FSPHAAYGMA HVYFEVGVMV IGFVSLGKFL

201    EHRTKKSSLN SLGLLLKLTP TQVNVQRNGE WKQLPIDQVQ IGDLIRANHG

251    ERIAADGIIE SGSGWADESH LTGESNPEEK KAGGKVLAGA LMTEGSVVYR

301    ATQLGSQTQL GDMMNALSEA QGSKAPIARV ADKAAAVFVP AVVGIALLTF

351    IVTWLIKGDW TVALMHAVAV LVIACPCALG LATPAAIMVG MGKAVKHGIW

401    FKDAAAMEEA AHVDAVVLDK TGTLTEGSPQ VAAVYCVPDS GFDEDALYRI

451    AAAVEQNAAH PLARAIVSAA QARGLDIPAA QNAQTVVGAG ITAEVEGVGL

501    VKAGKAEFAE LALPKFLDGV WDIASIVAVS VDNKPIGAFA LADALKADTA

551    EAIGRLKKHN IDVYIMSGDN QGTVEYVAKQ LGIAHAFGNM SPRDKAAEVQ

601    KLKAAGKTVA MVGDGINDAP ALAAANVSFA MKGGADVAEH TASATLMQHS

651    VNQLADALLV SQATLKNIKQ NLFFAFFYNI LGIPLAALGF LNPVIAGAAM

701    AASSVSVLSN ALRLKRVKID *
```

Computer analysis of this amino acid sequence gave the following results:
Homology with a Predicted ORF from *N. gonorrhoeae*
m589/g589 94.2% identity in 725 aa overlap

```
                 10         20         30         40         50         60
m589.pep  MQQKIRFQIEGMTCQACASRIEKVLNKKDFVESAGVNFASEEAQVVFDDSKTSVADIAKI
          ||||||||||:|||||||||||||||||||||||||||||||||:|| ||||||||||||
g589      MQQKIRFQIEAMTCQACASRIEKVLNKKDFVESAGVNFASEEAQVTFDGSKTSVADIAKI
                 10         20         30         40         50         60

70         80         90        100     1         110
m589.pep  IEKTGYGAKEKTEDTLPQPEAEHHIGWRLWLLFTINVPFLIGMAGMMIG-----RHDWMI
          ||||||||||||||||||||||||||||||||:|||:||||||:|||:      ||||||
g589      IEKTGYGAKEKTEDTLPQPEAEHHIGWRLWLLLTINIPFLIGMVGMMLKGLNWTRHDWMI
                 70         80         90        100        110        120

120        130        140        150        160        170
m589.pep  PPLWQFALASVVQLWLAIPFYKSAWASIKGGLANMDVLVTIGTVSIYLYSVYMLFFSPHA
          ||:|||:|||:|||||||||||||||||||||||||||||||||||||||||||||| ||
g589      PPVWQFVLASIVQLWLAIPFYKSAWASIKGGLANMDVLVTIGTVSIYLYSVYMLFFSSHA
                 130        140        150        160        170        180

180        190        200        210        220        230
m589.pep  AYGMAHVYFEVGVMVIGFVSLGKFLEHRTKKSSLNSLGLLLKLTPTQVNVQRNGEWKQLP
          |:|||||||||:||||||||||||||||||||||||||||||||||||||||||||||||
g589      AHGMAHVYFEAGVMVIGFVSLGKFLEHRTKKSSLNSLGLLLKLTPTQVNVQRNGEWKQLP
                 190        200        210        220        230        240

240        250        260        270        280        290
m589.pep  IDQVQIGDLIRANHGERIAADGIIESGSGWADESHLTGESNPEEKKAGGKVLAGALMTEG
          |||||||||||:||||||||||||||||||||||||||||||||||||||||||||||||
g589      IDQVQIGDLIRTNHGERIAADGIIESGSGWADESHLTGESNPEEKKAGGKVLAGALMTEG
                 250        260        270        280        290        300
```

-continued

```
                300        310        320        330        340        350
m589.pep    SVVYRATQLGSQTQLGDMMNALSEAQGSKAPIARVADKAAAVFVPAVVGIALLTFIVTWL
            ||||||:|||||| |||||||||||||||||||||||||||||||:|||||||||||:||
g589        SVVYRAAQLGSQTLLGDMMNALSEAQGSKAPIARVADKAAAVFVPTVVGIALLTFIVAWL
                      310        320        330        340        350        360
```

The following partial DNA sequence was identified in *N. meningitidis* <SEQ ID 1831>:

```
a589.seq
     1  ATGCAACAAA AAGTCCGTTT CCAAATCGAA GGCATGACCT GCCAGGCATG

51  TGCTTCGCGC ATTGAAAAAG TGTTGAACAA AAAAGATTTT GTCGAATCGG

101  CGGGGGTAAA CTTCGCCAGC GAAGAGGCTC AGGTAGTGTT TGACGACAGC

151  AAAACCTCAG TAGCCGACAT TGCCAAAATC ATTGAGAAAA CCGGTTACGG

201  CGCGAAGGAA AAAACGGAAG ATACATTGCC GCAACCCGAA GCAGAACACC

251  ATATCGGCTG GAGGTTGTGG CTTTTGCTGG CCATCAATAT CCCGTTCCTT

301  ATCGGTATGG TAGGGATGAT GCTAAAAGGG CTGAATTGGA CACGGCATGA

351  TTGGATGTTG TCGCCCTTGT TGCAGTTTGC ATTGGCGAGT GTGGTGCAGC

401  TTTGGCTGGC GGTGCCATTT TACAAAAGCG CGTGGGCGAG CATTAAAGGC

451  GGGCTGGCGA ATATGGACGT ACTCGTTACC ATCGGCACGG TCTCGATTTA

501  CCTGTATTCC GTCTATATGC TGTTTTTCAG CCCGCACGCG GCGTACGGTA

551  TGGCGCATGT GTATTTTGAA GTAGGCATAA TGGTGATTGG TTTTGTGTCA

601  CTGGGTAAAT TTTTGGAACA CCGCACCAAA AAATCCAGCC TGAACAGCTT

651  GGGCTTGCTG CTCAAACTCA CGCCAACCCA AGTCAACGTG CAACGCGATG

701  GCGAATGGCG GCAGCTACCC ATCGACCAAG TGCAAATCGG CGACCTAATC

751  CGCGCCAATC ACGGCGAACG CATTGCCGCC GACGGCATCA TAGAAAGCGG

801  CAGCGGCTGG GCGGACGAAA GCCATCTTAC CGGCGAATCC AATCCCGAAG

851  AGAAAAAGGC AGGCGGCAAA GTATTGGCGG GCGCGCTGAT GACTGAAGGC

901  AGCGTGGTGT ACCGCGCCGC GCAGCTCGGC AGCCAAACCC TGCTCGGCGA

951  CATGATGAAC GCGCTCTCCG AAGCGCAAGG CAGTAAAGCA CCGATTGCGC

1001  GTGTGGCGGA CAAGGCGGCG GCGGTATTCG TGCCTGCCGT TGTGGGCATC

1051  GCACTTTTGA CTTTTATCGC TACTTGGCTG ATTAAGGGCG ATTGGACGCT

1101  CGCATTGATG CACGCCGTCG CCGTTTTGGT GATTGCCTGC CCGTGTGCAC

1151  TCGGTTTGGC AACCCCTGCT GCGATTATGG TCGGTATGGG CAAAGCGGTT

1201  AAACACGGTA TTTGGTTTAA AGACGCGGCA GCAATGGAAG AAGCCGCCCA

1251  CGTTGATGCC GTCGTGCTGG ACAAAACCGG CACGCTGACC GAAGGCAAGC

1301  CGCAGGTTGC CGCCGTTTAT TGTGTTCCCG ACAGCGGCTT TGACGAAGAC

1351  GCTTTGTACC GCATCGCCGC CGCCGTCGAA CAAAACGCCG CCCATCCGCT

1401  CGCCCGTGCC ATCGTCTCCG CCGCCCAGGC GCGCGGTTTG GAGATTCCCA

1451  CCGCACAAAA TGCCCAAACC ATTGTCGGCG CGGGCATTAC CGCCGAAGTA

1501  AAAGGCGCGG GTTTGGTAAA AGCAGGCAAA GCCGAATTTG CCGAACTGAC

1551  CTTGCCGAAG TTTTCAGACG GCGTTTGGGA AATCGCCAGT GTGGTTGCCG

1601  TATCTGTAAA CGGCAAACCT ATCGGCGCAT TCGCACTCGC CGACGCGTTG

1651  AAAGCCGATA CCGCCGAAGC CATAGGCCGT CTGAAAAAAC ACAATATCGA
```

-continued

```
1701  TGTCTATATT ATGAGCGGCG ATAACCAAGG CACGGTCGAG TACGTCGCCA
1751  AACAACTGGG CATCGCACAC GCCTTCGGTA ATATGAGTCC GCGCGACAAA
1801  GCCGCCGAAG TGCAGAAACT CAAAGCCGCC GGCAAAACCG TGGCGATGGT
1851  CGGCGACGGC ATCAACGACG CGCCCGCGCT CGCCGCCGCC AACGTCAGCT
1901  TCGCCATGAA AGGCGGTGCA GACGTTGCCG AACACACCGC ATCCGCCACA
1951  CTGATGCAGC ATTCGGTCAA CCAGCTCGCC GATGCGCTAT CGGTATCGCG
2001  AGCGACGTTG AAAAACATCA AGCAAAACCT GTTTTTCGCC TTCTTCTACA
2051  ATATTTTGGG CATTCCGCTC GCCGCGCTCG GCTTTTTAAA CCCCGTCATC
2101  GCAGGCGCGG CAATGGCGGC AAGCTCGGTT TCCGTGTTGA GCAACGCCTT
2151  GCGCCTGAAA CGGGTAAAAA TCGATTGA
```

This corresponds to the amino acid sequence <SEQ ID 1832; ORF 589.a>:

```
a589.pep
   1  MQQKVRFQIE GMTCQACASR IEKVLNKKDF VESAGVNFAS EEAQVVFDDS
  51  KTSVADIAKI IEKTGYGAKE KTEDTLPQPE AEHHIGWRLW LLLAINIPFL
 101  IGMVGMMLKG LNWTRHDWML SPLLQFALAS VVQLWLAVPF YKSAWASIKG
 151  GLANMDVLVT IGTVSIYLYS VYMLFFSPHA AYGMAHVYFE VGIMVIGFVS
 201  LGKFLEHRTK KSSLNSLGLL LKLTPTQVNV QRDGEWRQLP IDQVQIGDLI
 251  RANHGERIAA DGIIESGSGW ADESHLTGES NPEEKKAGGK VLAGALMTEG
 301  SVVYRAAQLG SQTLLGDMMN ALSEAQGSKA PIARVADKAA AVFVPAVVGI
 351  ALLTFIATWL IKGDWTLALM HAVAVLVIAC PCALGLATPA AIMVGMGKAV
 401  KHGIWFKDAA AMEEAAHVDA VVLDKTGTLT EGKPQVAAVY CVPDSGFDED
 451  ALYRIAAAVE QNAAHPLARA IVSAAQARGL EIPTAQNAQT IVGAGITAEV
 501  KGAGLVKAGK AEFAELTLPK FSDGVWEIAS VVAVSNGKP IGAFALADAL
 551  KADTAEAIGR LKKHNIDVYI MSGDNQGTVE YVAKQLGIAH AFGNMSPRDK
 601  AAEVQKLKAA GKTVAMVGDG INDAPALAAA NVSFAMKGGA DVAEHTASAT
 651  LMQHSVNQLA DALSVSRATL KNIKQNLFFA FFYNILGIPL AALGFLNPVI
 701  AGAAMAASSV SVLSNALRLK RVKID*
``` m589/a589 94.9% identity in 725 aa overlap

```
                  10         20         30         40         50         60
m589.pep  MQQKIRFQIEGMTCQACASRIEKVLNKKDPVESAGVNFASEEAQVVFDDSKTSVADIAKI
          ||||:||||||||||||||||||||||||||||||||||||||||||||||||||||||
a589      MQQKVRFQIEGMTCQACASRIEKVLNKKDPVESAGVNFASEEAQVVFDDSKTSVADIAKI
                  10         20         30         40         50         60

70         80         90        100          1        110
m589.pep  IEKTGYGAKEKTEDTLPQPEAEHHIGWRLWLLFTINVPFLIGMAGMMIG-----RHDWMI
          ||||||||||||||||||||||||||||||||::||:||||||||:||     ||||:
a589      IEKTGYGAKEKTEDTLPQPEAEHHIGWRLWLLLAINIPFLIGMVGMMLKGLNWTRHDWML
                  70         80         90        100        110        120

120        130        140        150        160        170
m589.pep  PPLWQFALASVVQLWLAIPFYKSAWASIKGGLANMDVLVTIGTVSIYLYSVYMLFFSPHA
          ||:|||||||||||||||:|||||||||||||||||||||||||||||||||||||||||
a589      SPLLQFALASVVQLWLAVPFYKSAWASIKGGLANMDVLVTIGTVSIYLYSVYMLFFSPHA
                 130        140        150        160        170        180
```

```
              180       190       200       210       220       230
m589.pep   AYGMAHVYFEVGVMVIGFVSLGKFLEHRTKKSSLNSLGLLLKLTPTQVNVQRNGEWKQLP
           ||||||||||||||||:|||||||||||||||||||||||||||||||||||:|||:|||
a589       AYGMAHVYFEVGIMVIGFVSLGKFLEHRTKKSSLNSLGLLLKLTPTQVNVQRDGEWRQLP
              190       200       210       220       230       240

240       250       260       270       280       290
m589.pep   IDQVQIGDLIRANHGERIAADGIIESGSGWADESHLTGESNPEEKKAGGKVLAGALMTEG
           ||||||||||||||||||||||||||||||||||||||||||||||||||||||||||||
a589       IDQVQIGDLIRANHGERIAADGIIESGSGWADESHLTGESNPEEKKAGGKVLAGALMTEG
              250       260       270       280       290       300

300       310       320       330       340       350
m589.pep   SVVYRATQLGSQTQLGDMMNALSEAQGSKAPIARVADKAAAVFVPAVVGIALLTFIVTWL
           |||||:|||||| |||||||||||||||||||||||||||||||||||||||||:|||
a589       SVVYRAAQLGSQTLLGDMMNALSEAQGSKAPIARVADKAAAVFVPAVVGIALLTFIATWL
              310       320       330       340       350       360

360       370       380       390       400       410
m589.pep   IKGDWTVALMHAVAVLVIACPCALGLATPAAIMVGMGKAVKHGIWFKDAAAMEEAAHVDA
           ||||||:|||||||||||||||||||||||||||||||||||||||||||||||||||||
a589       IKGDWTLALMHAVAVLVIACPCALGLATPAAIMVGMGKAVKHGIWFKDAAAMEEAAHVDA
              370       380       390       400       410       420

420       430       440       450       460       470
m589.pep   VVLDKTGTLTEGSPQVAAVYCVPDSGFDEDALYRIAAAVEQNAAHPLARAIVSAAQARGL
           |||||||||||||:||||||||||||||||||||||||||||||||||||||||||||||
a589       VVLDKTGTLTEGKPQVAAVYCVPDSGFDEDALYRIAAAVEQNAAHPLARAIVSAAQARGL
              430       440       450       460       470       480

480       490       500       510       520       530
m589.pep   DIPAAQNAQTVVGAGITAEVEGVGLVKAGKAEFAELALPKFLDGVWDIASIVAVSVDNKP
           :||:|||||||:|||||||||:|:|||||||||||:||||  ||||:|||:|||||::||
a589       EIPTAQNAQTIVGAGITAEVKGAGLVKAGKAEFAELTLPKFSDGVWEIASVVAVSVNGKP
              490       500       510       520       530       540

540       550       560       570       580       590
m589.pep   IGAFALADALKADTAEAIGRLKKHNIDVYIMSGDNQGTVEYVAKQLGIAHAFGNMSPRDK
           ||||||||||||||||||||||||||||||||||||||||||||||||||||||||||||
a589       IGAFALADALKADTAEAIGRLKKHNIDVYIMSGDNQGTVEYVAKQLGIAHAFGNMSPRDK
              550       560       570       580       590       600

600       610       620       630       640       650
m589.pep   AAEVQKLKAAGKTVAMVGDGINDAPALAAANVSFAMKGGADVAEHTASATLMQHSVNQLA
           ||||||||||||||||||||||||||||||||||||||||||||||||||||||||||||
a589       AAEVQKLKAAGKTVAMVGDGINDAPALAAANVSFAMKGGADVAEHTASATLMQHSVNQLA
              610       620       630       640       650       660

660       670       680       690       700       710
m589.pep   DALLVSQATLKNIKQNLFFAFFYNILGIPLAALGFLNPVIAGAAMAASSVSVLSNALRLK
           |||  ||:|||||||||||||||||||||||||||||||||||||||||||||||||||
a589       DALSVSRATLKNIKQNLFFAFFYNILGIPLAALGFLNPVIAGAAMAASSVSVLSNALRLK
              670       680       690       700       710       720

720
m589.pep   RVKIDX
           ||||||
a589       RVKIDX
```

The following partial DNA sequence was identified in *N. gonorrhoeae* <SEQ ID 1833>:

```
g590.seq..
      1    atgaaaaaac ctttgatttc agttgcggca gtattgctcg gcgttgcttt 51    gggtacacct tattatttgg gtgtcaaagc agaagaaagt ctgacgcagc 101    agcaaaaaat attgcagaaa acgggctttt tgaccgtcga atcgcaccag 151    tatgatcgag gctggtttac ctctacggaa cgacggtca tccgtctgaa 201    acccgagttg ctgcataatg cgcagaaata cctgccggat aacttgaaaa 251    tagtgttgga acagccggtt acgctggtaa accatatcac gcacggccct 301    ttcgccggcg gattcggcac gcaggcgcac attgaaaccg agttcaaata 351    cgcgcctgaa acggaaaaag ttttggaacg cttttttggg aaacaagttc 401    cggtttccct tgccaatacc gtttatttca acggcagcgg taaaatggaa 451    gtcagtgttc cgctttcga ttatgaagaa ctgtcgggca tcaggctgca 501    ctgggaaggc ctgacggggg aaacggttta tcaaaaaggt ttcaaaagct 551    accgcaacag ctatgatgcg cccttgttca aaatcaagct ggcagacaaa
```

-continued

```
 601    ggcgatgccg cgtttgaaaa agcgcatttc gattcggaaa cttcagacgg
 651    catcaatccg cttgctttgg gcagcagcaa tctgactttg gaaaaatttt
 701    cgctcgaatg gaaagagggt gtcgattaca acgtcaaatt gaacgaactg
 751    gtcaacctcg ttaccgattt gcagatcggc gcgtttatca atcccaacgg
 801    cagcatcgca ccttccaaaa tcgaagtcgg caagctggct ttttcaacca
 851    agaccgggga atcgggcgcg tttatcgaca gcgaagggcg gttccgtttc
 901    gatacgttgg tgtacggcga tgaaaaatac ggcccgctgg acatccatat
 951    cgctgccgaa cacctcgatg cttctgcctt aaccgtattg aaacgcaagt
1001    ttgcacaaat ttctgccaaa aaaatgactg aggaacaaat ccgcaatgat
1051    ttgattgcgg cagtcaaagg cgatgcttcc ggattattta cccatgaccc
1101    ggtactaaat atcaaaattt tccgtttcac cctgcctcag ggaaaaattg
1151    atgtgggcgg aaaaatcatg tttaaaggca tgaagaagga agatttgaac
1201    caattgggac tgatgttaaa gaaaaccgag gcaaacatca gaatgagtat
1251    tcctcaaaaa atgttggaag atttggcggt aagtcaggct ggaaatattt
1301    tcagtgtaaa tgccgaagat gaggcggaag ccagagcaag cattgccgat
1351    attaatgaaa cattgcgcct gatggtggac agtacggtcc aaagtatggc
1401    aagggaaaaa tatcttactt tagacggtaa tcagattgat acggtcattt
1451    cccttaaaaa caacgccctg aagttaaacg ggaaaacgct gcaaaatgaa
1501    cccgatcctg attttgacga gggagatatg gtttccggcc agccgcatta
1551    a
```

This corresponds to the amino acid sequence <SEQ ID 1834; ORF 590.ng>:

```
g590.pep..
     1    MKKPLISVAA VLLGVALGTP YYLGVKAEES LTQQQKILQK TGFLTVESHQ
    51    YDRGWFTSTE TTVIRLKPEL LHNAQKYLPD NLKIVLEQPV TLVNHITHGP
   101    FAGGFGTQAH IETEFKYAPE TEKVLERFFG KQVPVSLANT VYFNGSGKME
   151    VSVPAFDYEE LSGIRLHWEG LTGETVYQKG FKSYRNSYDA PLFKIKLADK
   201    GDAAFEKAHF DSETSDGINP LALGSSNLTL EKFSLEWKEG VDYNVKLNEL
   251    VNLVTDLQIG AFINPNGSIA PSKIEVGKLA FSTKTGESGA FIDSEGRFRF
   301    DTLVYGDEKY GPLDIHIAAE HLDASALTVL KRKFAQISAK KMTEEQIRND
   351    LIAAVKGDAS GLFTHDPVLN IKIFRFTLPQ GKIDVGGKIM FKGMKKEDLN
   401    QLGLMLKKTE ANIRMSIPQK MLEDLAVSQA GNIFSVNAED EAEARASIAD
   451    INETLRLMVD STVQSMAREK YLTLDGNQID TVISLKNNAL KLNGKTLQNE
   501    PDPDFDEGDM VSGQPH*
```

The following partial DNA sequence was identified in *N. meningitidis* <SEQ ID 1835>:

```
m590.seq (partial) ..
     1    ..TGGTTTACCT CTATGGAAAC GACGGTCATC CGTCTGAAAC CCGAGTTGCT
    51    GAATAATGCC CGAAAATACC TGCCGGATAA CCTGAAAACA GTGTTGGAAC
```

```
101   AGCCGGTTAC GCTGGTTAAC CATATCACGC ACGGCCCTTT CGCCGGCGGA
151   TTCGGCACGC AGGCGTACAT TGAAACCGAG TTCAAATACG CGCCTGAAAC
201   GGAAAAAGTT CTGGAACGCT TTTTTGGAAA ACAAGTCCCG GCTTCCCTTG
251   CCAATACCGT TTATTTTAAC GGCAGCGGTA AATGGAAGT CAGTGTTCCC
301   GCCTTCGATT ATGAAGAGCT GTCGGGCATc AG.CTGCACT GGGAAkGCCT
351   GACGGGAGAA ACGGTTTATC AAAAAGGTTT CAAAAGCTAC CGGAACGGCT
401   ATGATGCCCC CTTGTTTAAA ATCAAGCTGG CAGACAAAGG CGATGCCGCG
451   TTTGAAAAAG TGCATTTCGA TTCGGAAACT TCAGACGGCA TCAATCCGCT
501   TGCTTTGGGC AGCAGCAATC TGACCTTGGA AAAATTCTCC CTAGAATGGA
551   AAGAGGGTGT CGATTACAAC GTCAAGTTAA ACGAACTGGT CAATCTTGTT
601   ACCGATTTGC AGATTGGCGC GTTTATCAAT CCCAACGGCA GCATCGCACC
651   TTCCAAAATC GAAGTCGGCA AACTGGCTTT TTCAACCAAG ACCGGGGAAT
701   CAGGCGCGTT TATCAACAGT GAAGGGCAGT TCCGTTTCGA TACACTGGTG
751   TACGGCGATG AAAAATACGG CCCGCTGGAC ATCCATATCG CTGCCGAACA
801   CCTCGATGCT TCTGCCTTAA CCGTATTGAA ACGCAAGTTT GCACAAATTT
851   CCGCCAAAAA AATGACCGAG GAACAAATCC GCAATGATTT GATTGCCGCC
901   GTCAAAGGAG AGGCTTCCGG ACTGTTCACC AACAATCCCG TATTGGACAT
951   TAAAACTTTC CGATTCACGC TGCCATCGGG AAAAATCGAT GTGGGCGGAA
1001  AAATCATGTT TAAAGACATG AAGAAGGAAG ATTTGAATCA ATTGGGTTTG
1051  ATGCTGAAGA AAACCGAAGC CGACATCAGA ATGAGTATTC CCCAAAAAAT
1101  GCTGGAAGAC TTGGCGGTCA GTCAAGCAGG CAATATTTTC AGCGTCAATG
1151  CCGAAGATGA GGCGGAAGGC AGGGCAAGTC TTGACGACAT CAACGAGACC
1201  TTGCGCCTGA TGGTGGACAG TACGGTTCAG AGTATGGCAA GGGAAAAATA
1251  TCTGACTTTG AACGGCGACC AGATTGATAC TGCCATTTCT CTGAAAAACA
1301  ATCAGTTGAA ATTGAACGGT AAAACGTTGC AAAACGAACC GGAGCCGGAT
1351  TTTGATGAAG GCGGTATGGT TTCAGAGCCG CAGCAGTAA
```

This corresponds to the amino acid sequence <SEQ ID 1836; ORF 590>:

```
m590.pep.. (partial)
    1    ..WFTSMETTVI RLKPELLNNA RKYLPDNLKT VLEQPVTLVN HITHGPFAGG
   51       FGTQAYIETE FKYAPETEKV LERFFGKQVP ASLANTVYFN GSGKMEVSVP
  101       AFDYEELSGI XLHWEXLTGE TVYQKGFKSY RNGYDAPLFK IKLADKGDAA
  151       FEKVHFDSET SDGINPLALG SSNLTLEKFS LEWKEGVDYN VKLNELVNLV
  201       TDLQIGAFIN PNGSIAPSKI EVGKLAFSTK TGESGAFINS EGQFRFDTLV
  251       YGDEKYGPLD IHIAAEHLDA SALTVLKRKF AQISAKKMTE EQIRNDLIAA
  301       VKGEASGLFT NNPVLDIKTF RFTLPSGKID VGGKIMFKDM KKEDLNQLGL
  351       MLKKTEADIR MSIPQKMLED LAVSQAGNIF SVNAEDEAEG RASLDDINET
  401       LRLMVDSTVQ SMAREKYLTL NGDQIDTAIS LKNNQLKLNG KTLQNEPEPD
  451       FDEGGMVSEP QQ*
``` m590/g590 93.1% identity in 462 aa overlap

```
                          10        20        30
m590.pep                  WFTSMETTVIRLKPELLNNARKYLPDNLKT
                          ||||  ||||||||||||| :||||||||||
g590     VKAEESLTQQQKILQKTGFLTVESHQYDRGWFTSTETTVIRLKPELLHNAQKYLPDNLKT
                  30        40        50        60        70        80

40        50        60        70        80        90
m590.pep VLEQPVTLVNHITHGPFAGGFGTQAYIETEFKYAPETEKVLERFFGKQVPASLANTVYFN
         |||||||||||||||||||||||||| |||||||||||||||||||||||| ||||||||
g590     VLEQPVTLVNHITHGPFAGGFGTQAHIETEFKYAPETEKVLERFFGKQVPVSLANTVYFN
                  90       100       110       120       130       140

100       110       120       130       140       150
m590.pep GSGKMEVSVPAFDYEELSGIXLHWEXLTGETVYQKGFKSYRNGYDAPLFKIKLADKGDAA
         |||||||||||||||||||| |||| ||||||||||||||||: ||||||||||||||||
g590     GSGKMEVSVPAFDYEELSGIRLHWEGLTGETVYQKGFKSYRNSYDAPLFKIKLADKGDAA
                 150       160       170       180       190       200

160       170       180       190       200       210
m590.pep FEKVHFDSETSDGINPLALGSSNLTLEKFSLEWKEGVDYNVKLNELVNLVTDLQIGAFIN
         |||:||||||||||||||||||||||||||||||||||||||||||||||||||||||||
g590     FEKAHFDSETSDGINPLALGSSNLTLEKFSLEWKEGVDYNVKLNELVNLVTDLQIGAFIN
                 210       220       230       240       250       260

220       230       240       250       260       270
m590.pep PNGSIAPSKIEVGKLAFSTKTGESGAFINSEGQFRFDTLVYGDEKYGPLDIHIAAEHLDA
         |||||||||||||||||||||||||||||:|||:||||||||||||||||||||||||||
g590     PNGSIAPSKIEVGKLAFSTKTGESGAFIDSEGRFRFDTLVYGDEKYGPLDIHIAAEHLDA
                 270       280       290       300       310       320

280       290       300       310       320       330
m590.pep SALTVLKRKFAQISAKKMTEEQIRNDLIAAVKGEASGLFTNNPVLDIKTFRFTLPSGKID
         ||||||||||||||||||||||||||||||||:||||||::|||:|| ||||||:||||
g590     SALTVLKRKFAQISAKKMTEEQIRNDLIAAVKGDASGLFTHDPVLNIKIFRFTLPQGKID
                 270       280       290       300       310       320

340       350       360       370       380       390
m590.pep VGGKIMFKDMKKEDLNQLGLMLKKTEADIRMSIPQKLMEDLAVSQAGNIFSVNAEDEAEG
         ||||||||  ||||||||||||||||| |||||||||||||||||||||||||||||||:
g590     VGGKIMFKGMKKEDLNQLGLMLKKTEANIRMSIPQKLMEDLAVSQAGNIFSVNAEDEAEA
                 390       400       410       420       430       440

400       410       420       430       440       450
m590.pep RASLDDINETLRLMVDSTVQSMAREKYLTLNGDQIDTAISLKNNQLKLNGKTLQNEPEPD
         |||:||||||||||||||||||||||||||:|:||||: ||||||||| ||||||||| ||
g590     RASIADINETLRLMVDSTVQSMAREKYLTLDGNQIDTVISLKNNALKLNGKTLQNEPDPD
                 450       460       470       480       490       500

460
m590.pep FDEGGMVS-EPQQX
         ||||  ||| :|:
g590     FDEGDMVSGQPHX
                 510
```

The following partial DNA sequence was identified in *N. meningitidis* <SEQ ID 1837>:

```
a590.seq
    1    ATGAAAAAAC CTTTGATTTC GGTTGCGGCA GCATTGCTCG GCGTTGCTTT

51    GGGCACGCCT TATTATTTGG GTGTCAAAGC CGAAGAAAGC TTGACGCAGC

101    AGCAAAAAAT ATTGCAGGAA GCGGGCTTCT TGACCGTCGA ATCGCACCAA

151    TATGAGCGCG GCTGGTTTAC CTCTACGGAA ACGACGGTCA TCCGCTTGAA

201    ACCCGAGTTG CTGCATAATG CGCAGAAATA CCTGCCGGAT AACCTGAAAA

251    CAGTGTTGGA ACAGCCGGTT ACGCTGGTAA ACCATATCAC GCACGGTCCT

301    TTTGCCGGCG GATTCGGCAC GCAGGCGTAC ATTGAAACCG AGTTCAAATA

351    CGCGCCTGAA ACGGAAAAAG TTCTGGAACG CTTTTTTGGA AAACAAGTCC

401    CGGTTTCCCT TGCCAATACC GTTTATTTTA ACGGCAGCGG TAAAATGGAA

451    GTCAGTGTTC CCGCCTTCGA TTATGAAGAG CTGTCGGGCA TCAGGCTGCA

501    CTGGGAAGGC TGACGGGAG AAACGGTTTA TCAAAAAGGT TTCAAAGCT

551    ACCGGAACGG CTATGATGCC CCCTTGTTTA AAATCAAGCT GGCAGACAAA

601    GGCGATGCCG CGTTTGAAAA AGTGCATTTC GATTCGGAAA CTTCAGACGG
```

-continued

```
 651  CATCAACCCG CTTGCTTTGG GCAGCAGCAA TCTGACCTTG GAAAAATTTT
 701  CCTTAGAATG GAAAGAGGGT GTCGATTACA ACGTCAAGTT AAACGAACTG
 751  GTCAATCTTG TTACCGATTT GCAGATTGGC GCGTTTATCA ATCCCAACGG
 801  CAGCATCGCA CCTTCCAAAA TCGAAGTCGG CAAGCTGGCT TTTTCAACCA
 851  AGACCGGGGA ATCGGGCGCG TTTATCGATA GCGAAGGGCA GTTCCGTTTT
 901  GGCACGCTGG TTTACGGCGA TGAAAAATAC GGCCCTCTGG ACATCCATAT
 951  CGCTGCCGAA CACCTCGATG CTTCTGCCTT AACCGTATTG AAACGCAAGT
1001  TTGCACGAAT TTCTGCCAAA AAAATGACTG AAGAACAAAT CCGCAATGAT
1051  TTGATTGCGG CAGTCAAAGG CGAGGCTTCC GGATTATTTA CCCATAACCC
1101  AGTATTGGAC ATTAAAACTT TCCGATTCAC GCTGCCATCG GGAAAAATCG
1151  ATGTGGGCGG AAAAATCATG TTTAAAGACA TGAAGAAGGA AGATTTGAAC
1201  CAATTGGGTT TGATGCTGAA GAAAACCGAA GCCGACATCA GAATGAGTAT
1251  TCCCCAAAAA ATGCTGGAAG ACTTGGCGGT CAGTCAAGCA GGCAATATTT
1301  TCAGCGTCAA TGCCGAAGAT GAGGCGGAAG GCAGGGCAAG TCTTGACGAC
1351  ATCAACGAGA CCTTGCGCCT GATGGTGGAC AGTACGGTTC AGAGTATGGC
1401  AAGGGAAAAA TATCTGACTT TGAACGGCGA CCAGATTGAT ACTGCCATTT
1451  CTCTGAAAAA CAATCAGTTG AAATTGAACG GTAAAACGTT GCAAAACGAA
1501  CCGGAGCCGG ATTTTGATGA AGGCGGTATG GTTTCAGAGC CGCAGCAGTA
1551  A
```

This corresponds to the amino acid sequence <SEQ ID 1838;
ORF 590.a>:

```
a590.pep
   1  MKKPLISVAA ALLGVALGTP YYLGVKAEES LTQQQKILQE AGFLTVESHQ

51  YERGWFTSTE TTVIRLKPEL LHNAQKYLPD NLKTVLEQPV TLVNHITHGP

101  FAGGFGTQAY IETEFKYAPE TEKVLERFFG KQVPVSLANT VYFNGSGKME

151  VSVPAFDYEE LSGIRLHWEG LTGETVYQKG FKSYRNGYDA PLFKIKLADK

201  GDAAFEKVHF DSETSDGINP LALGSSNLTL EKFSLEWKEG VDYNVKLNEL

251  VNLVTDLQIG AFINPNGSIA PSKIEVGKLA FSTKTGESGA FIDSEGQFRF

301  GTLVYGDEKY GPLDIHIAAE HLDASALTVL KRKFARISAK KMTEEQIRND

351  LIAAVKGEAS GLFTHNPVLD IKTFRFTLPS GKIDVGGKIM FKDMKKEDLN

401  QLGLMLKKTE ADIRMSIPQK MLEDLAVSQA GNIFSVNAED EAEGRASLDD

451  INETLRLMVD STVQSMAREK YLTLNGDQID TAISLKNNQL KLNGKTLQNE

501  PEPDFDEGGM VSEPQQ*
``` m590/a590 97.8% identity in 462 aa overlap

```
                                  10         20         30
    m590.pep                 WFTSMETTVIRLKPELLNNARKYLPDNLKT
                             |||| ||||||||||||||:||:||||||||
    a590     VKAEESLTQQQKILQEAGFLTVESHQYERGWFTSTETTVIRLKPELLHNAQKYLPDNLKT
                30        40        50        60        70        80
```

-continued

```
                  40        50        60        70        80        90
m590.pep  VLEQPVTLVNHITHGPFAGGFGTQAYIETEFKYAPETEKVLERFFGKQVPASLANTVYFN
          ||||||||||||||||||||||||||||||||||||||||||||||||||:|||||||||
a590      VLEQPVTLVNHITHGPFAGGFGTQAYIETEFKYAPETEKVLERFFGKQVPVSLANTVYFN
              90       100       110       120       130       140

100       110       120       130       140       150
m590.pep  GSGKMEVSVPAFDYEELSGIXLHWEXLTGETVYQKGFKSYRNGYDAPLFKIKLADKGDAA
          |||||||||||||||||||| |||| ||||||||||||||||||||||||||||||||||
a590      GSGKMEVSVPAFDYEELSGIRLHWEGLTGETVYQKGFKSYRNGYDAPLFKIKLADKGDAA
             150       160       170       180       190       200

160       170       180       190       200       210
m590.pep  FEKVHFDSETSDGINPLALGSSNLTLEKFSLEWKEGVDYNVKLNELVNLVTDLQIGAFIN
          ||||||||||||||||||||||||||||||||||||||||||||||||||||||||||||
a590      FEKVHFDSETSDGINPLALGSSNLTLEKFSLEWKEGVDYNVKLNELVNLVTDLQIGAFIN
             210       220       230       240       250       260

220       230       240       250       260       270
m590.pep  PNGSIAPSKIEVGKLAFSTKTGESGAFINSEGQFRFDTLVYGDEKYGPLDIHIAAEHLDA
          ||||||||||||||||||||||||||||:||||||| |||||||||||||||||||||||
a590      PNGSIAPSKIEVGKLAFSTKTGESGAFIDSEGQFRFGTLVYGDEKYGPLDIHIAAEHLDA
             270       280       290       300       310       320

280       290       300       310       320       330
m590.pep  SALTVLKRKFAQISAKKMTEEQIRNDLIAAVKGEASGLFTNNPVLDIKTFRFTLPSGKID
          |||||||||||:||||||||||||||||||||||||||||:|||||||||||||||||||
a590      SALTVLKRKFARISAKKMTEEQIRNDLIAAVKGEASGLFTHNPVLDIKTFRFTLPSGKID
             330       340       350       360       370       380

340       350       360       370       380       390
m590.pep  VGGKIMFKDMKKEDLNQLGLMLKKTEADIRMSIPQKMLEDLAVSQAGNIFSVNAEDEAEG
          ||||||||||||||||||||||||||||||||||||||||||||||||||||||||||||
a590      VGGKIMFKDMKKEDLNQLGLMLKKTEADIRMSIPQKMLEDLAVSQAGNIFSVNAEDEAEG
             390       400       410       420       430       440

400       410       420       430       440       450
m590.pep  RASLDDINETLRLMVDSTVQSMAREKYLTLNGDQIDTAISLKNNQLKLNGKTLQNEPEPD
          ||||||||||||||||||||||||||||||||||||||||||||||||||||||||||||
a590      RASLDDINETLRLMVDSTVQSMAREKYLTLNGDQIDTAISLKNNQLKLNGKTLQNEPEPD
             450       460       470       480       490       500

460
m590.pep  FDEGGMVSEPQQX
          |||||||||||||
a590      FDEGGMVSEPQQX
             510
```

The following partial DNA sequence was identified in *N. meningitidis* <SEQ ID 1839>:

```
m590-1.seq
     1   ATGAAAAAAC CTTTGATTTC GGTTGCGGCA GCATTGCTCG GCGTTGCTTT
    51   GGGCACGCCT TATTATTTGG GTGTCAAAGC CGAAGAAAGC TTGACGCAGC
   101   AGCAAAAAAT ATTGCAGGAA ACGGGCTTCT TGACCGTCGA ATCGCACCAA
   151   TATGAGCGCG GCTGGTTTAC CTCTATGGAA ACGACGGTCA TCCGTCTGAA
   201   ACCCGAGTTG CTGAATAATG CCCGAAAATA CCTGCCGGAT AACCTGAAAA
   251   CAGTGTTGGA ACAGCCGGTT ACGCTGGTTA ACCATATCAC GCACGGCCCT
   301   TTCGCCGGCG GATTCGGCAC GCAGGCGTAC ATTGAAACCG AGTTCAAATA
   351   CGCGCCTGAA ACGGAAAAAG TTCTGGAACG CTTTTTTGGA AAACAAGTCC
   401   CGGCTTCCCT TGCCAATACC GTTTATTTTA ACGGCAGCGG TAAAATGGAA
   451   GTCAGTGTTC CCGCCTTCGA TTATGAAGAG CTGTCGGGCA TCAGGCTGCA
   501   CTGGGAAGGC CTGACGGGAG AAACGGTTTA TCAAAAAGGT TTCAAAAGCT
   551   ACCGGAACGG CTATGATGCC CCCTTGTTTA AAATCAAGCT GGCAGACAAA
   601   GGCGATGCCG CGTTTGAAAA AGTGCATTTC GATTCGGAAA CTTCAGACGG
   651   CATCAATCCG CTTGCTTTGG GCAGCAGCAA TCTGACCTTG GAAAAATTCT
   701   CCCTAGAATG GAAAGAGGGT GTCGATTACA ACGTCAAGTT AAACGAACTG
   751   GTCAATCTTG TTACCGATTT GCAGATTGGC GCGTTTATCA ATCCCAACGG
```

```
-continued
 801    CAGCATCGCA CCTTCCAAAA TCGAAGTCGG CAAACTGGCT TTTTCAACCA
 851    AGACCGGGGA ATCAGGCGCG TTTATCAACA GTGAAGGGCA GTTCCGTTTC
 901    GATACACTGG TGTACGGCGA TGAAAAATAC GGCCCGCTGG ACATCCATAT
 951    CGCTGCCGAA CACCTCGATG CTTCTGCCTT AACCGTATTG AAACGCAAGT
1001    TTGCACAAAT TTCCGCCAAA AAAATGACCG AGGAACAAAT CCGCAATGAT
1051    TTGATTGCCG CCGTCAAAGG AGAGGCTTCC GGACTGTTCA CCAACAATCC
1101    CGTATTGGAC ATTAAAACTT TCCGATTCAC GCTGCCATCG GGAAAAATCG
1151    ATGTGGGCGG AAAAATCATG TTTAAAGACA TGAAGAAGGA AGATTTGAAT
1201    CAATTGGGTT TGATGCTGAA GAAAACCGAA GCCGACATCA GAATGAGTAT
1251    TCCCCAAAAA ATGCTGGAAG ACTTGGCGGT CAGTCAAGCA GGCAATATTT
1301    TCAGCGTCAA TGCCGAAGAT GAGGCGGAAG GCAGGGCAAG TCTTGACGAC
1351    ATCAACGAGA CCTTGCGCCT GATGGTGGAC AGTACGGTTC AGAGTATGGC
1401    AAGGGAAAAA TATCTGACTT TGAACGGCGA CCAGATTGAT ACTGCCATTT
1451    CTCTGAAAAA CAATCAGTTG AAATTGAACG GTAAAACGTT GCAAAACGAA
1501    CCGGAGCCGG ATTTTGATGA AGGCGGTATG GTTTCAGAGC CGCAGCAGTA
1551    A
```

This corresponds to the amino acid sequence <SEQ ID 1840;
ORF 590-1>:

```
m590-1.pep
   1    MKKPLISVAA ALLGVALGTP YYLGVKAEES LTQQQKILQE TGFLTVESHQ
  51    YERGWFTSME TTVIRLKPEL LNNARKYLPD NLKTVLEQPV TLVNHITHGP
 101    FAGGFGTQAY IETEFKYAPE TEKVLERFFG KQVPASLANT VYFNGSGKME
 151    VSVPAFDYEE LSGIRLHWEG LTGETVYQKG FKSYRNGYDA PLFKIKLADK
 201    GDAAFEKVHF DSETSDGINP LALGSSNLTL EKFSLEWKEG VDYNVKLNEL
 251    VNLVTDLQIG AFINPNGSIA PSKIEVGKLA FSTKTGESGA FINSEGQFRF
 301    DTLVYGDEKY GPLDIHIAAE HLDASALTVL KRKFAQISAK KMTEEQIRND
 351    LIAAVKGEAS GLFTNNPVLD IKTFRFTLPS GKIDVGGKIM FKDMKKEDLN
 401    QLGLMLKKTE ADIRMSIPQK MLEDLAVSQA GNIFSVNAED EAEGRASLDD
 451    INETLRLMVD STVQSMAREK YLTLNGDQID TAISLKNNQL KLNGKTLQNE
 501    PEPDFDEGGM VSEPQQ*
``` m590-1/g590 93.6% identity in 516 aa overlap

```
                   10         20         30         40         50         60
m590-1.pep  MKKPLISVAAALLGVALGTPYYLGVKAEESLTQQQKILQETGFLTVESHQYERGWFTSME
            ||||||||||:||||||||||||||||||||||||||||:|||||||||:||||||
     g590   MKKPLISVAAVLLGVALGTPYYLGVKAEESLTQQQKILQKTGFLTVESHQYDRGWFTSTE
                   10         20         30         40         50         60

70         80         90        100        110        120
m590-1.pep  TTVIRLKPELLNNARKVLPDNLKTVLEQPVTLVNHITHGPFAGGFGTQAYIETEFKYAPE
            ||||||||||||:||:||||||||:|||||||||||||||||||||||||:|||||||||
     g590   TTVIRLKPELLHNAQKVLPDNLKIVLEQPVTLVNHITHGPFAGGFGTQAHIETEFKYAPE
                   70         80         90        100        110        120

130        140        150        160        170        180
m590-1.pep  TEKVLERFFGKQVPASLANTVYFNGSGKMEVSVPAFDYEELSGIRLHWEGLTGETVYQKG
            |||||||||||||:||||||||||||||||||||||||||||:|||||||||||||||||
     g590   TEKVLERFFGKQVPVSLANTVYFNGSGKMEVSVPAFDYEELSGIRLHWEGLTGETVYQKG
                  130        140        150        160        170        180
```

```
              190       200       210       220       230       240
m590-1.pep  FKSYRNGYDAPLFKIKLADKGDAAFEKVHFDSETSDGINPLALGSSNLTLEKFSLEWKEG
            ||||||:|||||||||||||||||||||:|||||||||||||||||||||||||||||||
g590        FKSYRNSYDAPLFKIKLADKGDAAFEKAHFDSETSDGINPLALGSSNLTLEKFSLEWKEG
              190       200       210       220       230       240

250       260       270       280       290       300
m590-1.pep  VDYNVKLNELVNLVTDLQIGAFINPNGSIAPSKIEVGKLAFSTKTGESGAFINSEGQFRF
            |||||||||||||||||||||||||||||||||||||||||||||||||||:|||:|||
g590        VDYNVKLNELVNLVTDLQIGAFINPNGSIAPSKIEVGKLAFSTKTGESGAFIDSEGRFRF
              250       260       270       280       290       300

310       320       330       340       350       360
m590-1.pep  DTLVYGDEKYGPLDIHIAAEHLDASALTVLKRKFAQISAKKMTEEQIRNDLIAAVKGEAS
            |||||||||||||||||||||||||||||||||||||||||||||||||||||||:||
g590        DTLVYGDEKYGPLDIHIAAEHLDASALTVLKRKFAQISAKKMTEEQIRNDLIAAVKGDAS
              310       320       330       340       350       360

370       380       390       400       410       420
m590-1.pep  GLFTNNPVLDIKTFRFTLPSGKIDVGKIMFKDMKKEDLNQLGLMLKKTEADIRMSIPQK
            ||||::|||:||||||:|||||||||||||||||||||||||||||||||||:||||||
g590        GLFTHDPVLNIKTFRFTLPQGKIDVGKIMFKGMKKEDLNQLGLMLKKTEANIRMSIPQK
              370       380       390       400       410       420

430       440       450       460       470       480
m590-1.pep  MLEDLAVSQAGNIFSVNAEDEAEGRASLDDINETLRLMVDSTVQSMAREKYLTLNGDQID
            |||||||||||||||||||||||||:|||:||||||||||||||||||||||:|:|||
g590        MLEDLAVSQAGNIFSVNAEDEAEARASIADINETLRLMVDSTVQSMAREKYLTLDGNQID
              430       440       450       460       470       480

490       500       510
m590-1.pep  TAISLKNNQLKLNGKTLQNEPEPDFDEGGMVS-EPQQX
            |:|||||| ||||||||||||:||||| ||| :|:
g590        TVISLKNNALKLNGKTLQNEPDPDFDEGDMVSGQPHX
              490       500       510
``` a590/m590-1 98.3% identity in 516 aa overlap

```
              10        20        30        40        50        60
a590.pep    MKKPLISVAAALLGVALGTPYYLGVKAEESLTQQQKILQEAGFLTVESHQYERGWFTSTE
            ||||||||||||||||||||||||||||||||||||||:||||||||||||||||||| |
m590-1      MKKPLISVAAALLGVALGTPYYLGVKAEESLTQQQKILQETGFLTVESHQYERGWFTSME
              10        20        30        40        50        60

70        80        90        100       110       120
a590.pep    TTVIRLKPELLHNAQKYLPDNLKTVLEQPVTLVNHITHGPFAGGFGTQAYIETEFKYAPE
            |||||||||||:|:|||||||||||||||||||||||||||||||||||||||||||||
m590-1      TTVIRLKPELLNNARKYLPDNLKTVLEQPVTLVNHITHGPFAGGFGTQAYIETEFKYAPE
              70        80        90        100       110       120

130       140       150       160       170       180
a590.pep    TEKVLERFFGKQVPVSLANTVYFNGSGKMEVSVPAFDYEELSGIRLHWEGLTGETVYQKG
            ||||||||||||||:|||||||||||||||||||||||||||||||||||||||||||
m590-1      TEKVLERFFGKQVPASLANTVYFNGSGKMEVSVPAFDYEELSGIRLHWEGLTGETVYQKG
              130       140       150       160       170       180

190       200       210       220       230       240
a590.pep    FKSYRNGYDAPLFKIKLADKGDAAFEKVHFDSETSDGINPLALGSSNLTLEKFSLEWKEG
            ||||||||||||||||||||||||||||||||||||||||||||||||||||||||||||
m590-1      FKSYRNGYDAPLFKIKLADKGDAAFEKVHFDSETSDGINPLALGSSNLTLEKFSLEWKEG
              190       200       210       220       230       240

250       260       270       280       290       300
a590.pep    VDYNVKLNELVNLVTDLQIGAFINPNGSIAPSKIEVGKLAFSTKTGESGAFIDSEGQFRF
            |||||||||||||||||||||||||||||||||||||||||||||||||||:||||||
m590-1      VDYNVKLNELVNLVTDLQIGAFINPNGSIAPSKIEVGKLAFSTKTGESGAFINSEGQFRF
              250       260       270       280       290       300

310       320       330       340       350       360
a590.pep    GTLVYGDEKYGPLDIHIAAEHLDASALTVLKRKFARISAKKMTEEQIRNDLIAAVKGEAS
            :|||||||||||||||||||||||||||||||||:|||||||||||||||||||||||
m590-1      DTLVYGDEKYGPLDIHIAAEHLDASALTVLKRKFAQISAKKMTEEQIRNDLIAAVKGEAS
              310       320       330       340       350       360

370       380       390       400       410       420
a590.pep    GLFTHNPVLDIKTFRFTLPSGKIDVGGKIMFKDMKKEDLNQLGLMLKKTEADIRMSIPQK
            ||||:|||||||||||||||||||||||||||||||||||||||||||||||||||||
m590-1      GLFTNNPVLDIKTFRFTLPSGKIDVGGKIMFKDMKKEDLNQLGLMLKKTEADIRMSIPQK
              370       380       390       400       410       420

430       440       450       460       470       480
a590.pep    MLEDLAVSQAGNIFSVNAEDEAEGRASLDDINETLRLMVDSTVQSMAREKYLTLNGDQID
            ||||||||||||||||||||||||||||||||||||||||||||||||||||||||||||
m590-1      MLEDLAVSQAGNIFSVNAEDEAEGRASLDDINETLRLMVDSTVQSMAREKYLTLNGDQID
              430       440       450       460       470       480
```

-continued

```
             490        500        510
a590.pep  TAISLKNNQLKLNGKTLQNEPEPDFDEGGMVSEPQQX
          ||||||||||||||||||||||||||||||||||||
m590-1    TAISLKNNQLKLNGKTLQNEPEPDFDEGGMVSEPQQX
             490        500        510
```

The following partial DNA sequence was identified in *N. gonorrhoeae* <SEQ ID 1841>:

```
g591.seq
   1 TTGCAAACCC TTCTAGCTTT TATCTTCGCC ATCCTGATTT TGGTCAGCCT
  51 GCACGAATTC GGACACTACA TCGTCGCCAG GTTGTGCGGC GTCAAGGTTG
 101 TGCGTTTTTC CGTCGGCTTC GGCAAACCGT TTTTCACCCG AAAGCGCGGC
 151 GACACCGAAT GGTGCCTCGC CCCGATTCCG TTGGGCGGCT ACGTCAAAAT
 201 GGTCGATACG CGCGAAGGCG AAGTATCAGA AGCCGATTTA CCCTACGCTT
 251 TTGACAAACA ACACCCCGCC AAGCGCATCG CCATCGTCGC CGCCGGTCCG
 301 CTGACCAACC TCGCActggc ggTTTTGCTG TACGGACTGa gctTttcctt
 351 cggcgtaaCC GAACTGCGGC CCtatgtcgg cacagtcgaA cccgacaccg
 401 ttgccgCCCG CACCGGCTTC caaagcggcg acaaAATACa atccgtcaac
 451 ggcgtTtccg tCCAAGACTG GAGCAGCGCG CAAACCGAAA TCGTcctcAA
 501 CCTCGAAGCC Ggcaaagtcg ccgtcggcgT TCAGACGGCA TCGGGCGCGC
 551 AAACCGTCCG CACCAtcgAT GCCGCAGGCA CGCCGGAAGC CGGTAAAATC
 601 GCAAAAAACC AAGGCTACAT CGGACTGATG CCCTTTAAAA TCACAACCGT
 651 TGCCGGCGGC GTGGAAAAAG CAGCCCCGC CGAAAAAGCA GGCCTGAAAC
 701 CGGGCGACAG GCTGACTGCC GCCGACGGCA AACCCATCGc ctcaTGGCAG
 751 GAATGggcaa acctgACccg cCAAAGCCCg ggcAAAAAAA Tcaccctgac
 801 ctacgAaCGC GCcggacaaa cccaTAccgc CGACATCCGC CccgATactg
 851 TCGAAcagcc cgACCACACC CTGATCgggc gcgTCGGCCT CCGtccgcaG
 901 CCGGACAGGG CGTGGGACGC GCAAATCCGC CGCAGCTACC GTCCGTCTGT
 951 TGTCCGCGCA TTCGGCATGG GCTGGGAAAA AACCGTTTCC CACTCGTGGA
1001 CAACCCTCAA ATTTTTCGGC AAACTAATCA GCGGCAACGC CTCTGTCAGC
1051 CATATTTCCG GGCCGCTGAC CATTGCCGAC ATTGCCGGAC AGTCCGCCGA
1101 ACTCGGCTTG CAAAGTTATT TGGAATTTTT AGCGTTGGTC AGCATCAGCC
1151 TCGGCGTGCT GAACCTGCTG CCCGTCCCCG TTTTGGACGG CGGGCACCTC
1201 GTGTTTTATA CTGTCGAATG GATACGCGGC AAACCTTTGG GCGAACGTGT
1251 CCAAAACATC GGTTTGCGCT TCGGGCTCGC CCTGATGATG CTGATGATGG
1301 CGGCCGCCTT CTTCAACGAC GTTACCCGGC TGATCGGTTA G
```

This corresponds to the amino acid sequence <SEQ ID 1842; ORF 591.ng>:

```
g591.pep..
   1 LQTLLAFIFA ILILVSLHEF GHYIVARLCG VKVVRFSVGF GKPFFTRKRG
  51 DTEWCLAPIP LGGYVKMVDT REGEVSEADL PYAFDKQHPA KRIAIVAAGP
 101 LTNLALAVLL YGLSFSFGVT ELRPYVGTVE PDTVAARTGF QSGDKIQSVN
 151 GVSVQDWSSA QTEIVLNLEA GKVAVGVQTA SGAQTVRTID AAGTPEAGKI
```

-continued

```
201   AKNQGYIGLM PFKITTVAGG VEKGSPAEKA GLKPGDRLTA ADGKPIASWQ
251   EWANLTRQSP GKKITLTYER AGQTHTADIR PDTVEQPDHT LIGRVGLRPQ
301   PDRAWDAQIR RSYRPSVVRA FGMGWEKTVS HSWTTLKFFG KLISGNASVS
351   HISGPLTIAD IAGQSAELGL QSYLEFLALV SISLGVLNLL PVPVLDGGHL
401   VFYTVEWIRG KPLGERVQNI GLRFGLALMM LMMAAAFFND VTRLIG*
```

The following partial DNA sequence was identified in *N. meningitidis* <SEQ ID 1843>:

```
m591.seq
   1  TTGCACACCC TTCTAGCTTT TATCTTCGCC ATCCTGATTT TGGTCAGCCT

51  GCACGAGTTC GGACACTACA TCGTTGCCAG ATTGTGCGGC GTCAAAGTCG

101  TACGCTTTTC CGTCGGCTTC GGCAAACCGT TTTTCACCCG AAAGCGCGGC

151  GACACCGAAT GGTGCCTCGC CCCGATTCCG TTGGGCGGTT ACGTCAAAAT

201  GGTCGATACG CGCGAAGGCG AAGTATCAGA AGCCGATTTA CCCTACGCTT

251  TTGACAAACA ACACCCCGCC AAGCGCATCG CCATCGTCGC CGCCGGCCCA

301  CTGACCAACC TCGCACTGGC GGTTTTGCTG TACGGACTGA GCTTTTCCTT

351  CGGCGTAACC GAACTGCGCC CCTACGTCGG CACAGTCGAA CCCGACACCA

401  TTGCCGCCCG CGCCGGCTTC CAAAGCGGCG ACAAAATACA ATCCGTCAAC

451  GGCACACCCG TTGCAGATTG GGGCAGCGCG CAAACCGAAA TCGTCCTCAA

501  CCTCGAAGCC GGCAAAGTCG CCGTCGGCGT TCAGACGGCA TCGGGCGCGC

551  AAACCGTCCG CACCATCGAT GCCGCAGGCA CGCCGGAAGC CGGTAAAATC

601  GCAAAAAACC AAGGCTACAT CGGACTGATG CCCTTTAAAA TCACAACCGT

651  TGCCGGCGGC GTGGAAAAAG GCAGCCCCGC CGAAAAAGCA GGCCTGAAAC

701  CGGGCGACAG GCTGACTGCC GCCGACGGCA AACCCATCGC CTCATGGCAA

751  GAATGGGCAA ACCTGACCCG CCAAAGCCCC GGCAAAAAAA TCACCCTGAA

801  CTACGAACGC GCCGGACAAA CCCATACCGC CGACATCCGC CCCGATACTG

851  TCGAACAGTC CGACCACACC CTGATCGGGC GCGTCGGCCT CCGTCCGCAG

901  CCGGACAGGG CGTGGGACGC GCAAATCCGC CGCAGCTACC GTCCGTCTGT

951  TGTCCGCGCA TTCGGCATGG GCTGGGAAAA AACCGTTTCC CACTCGTGGA

1001  CAACCCTCAA ATTTTTCGGC AAACTAATCA GCGGCAACGC CTCCGTCAGC

1051  CATATTTCCG GGCCGCTGAC CATTGCCGAC ATTGCCGGAC AGTCCGCCGA

1101  ACTCGGCTTG CAAAGTTATT TGGAATTTTT AGCACTGGTC AGCATCAGCC

1151  TCGGCGTGCT GAACCTACTG CCCGTCCCTG TTTTGGACGG CGGGCACCTC

1201  GTGTTTTATA CTGCCGAATG GATACGCGGC AAACCTTTGG GCGAACGCGT

1251  CCAAAACATC GGTTTGCGCT TCGGGCTCGC CCTCATGATG CTGATGATGG

1301  CGGTCGCCTT CTTCAACGAC GTTACCCGGC TGCTCGGTTA G
```

This corresponds to the amino acid sequence <SEQ ID 1844; ORF 591>:

```
m591.pep..
   1   LHTLLAFIFA ILILVSLHEF GHYIVARLCG VKVVRFSVGF GKPFFTRKRG

51   DTEWCLAPIP LGGYVKMVDT REGEVSEADL PYAFDKQHPA KRIAIVAAGP
```

-continued

```
101    LTNLALAVLL YGLSFSFGVT ELRPYVGTVE PDTIAARAGF QSGDKIQSVN

151    GTPVADWGSA QTEIVLNLEA GKVAVGVQTA SGAQTVRTID AAGTPEAGKI

201    AKNQGYIGLM PFKITTVAGG VEKGSPAEKA GLKPGDRLTA ADGKPIASWQ

251    EWANLTRQSP GKKITLNYER AGQTHTADIR PDTVEQSDHT LIGRVGLRPQ

301    PDRAWDAQIR RSYRPSVVRA FGMGWEKTVS HSWTTLKFFG KLISGNASVS

351    HISGPLTIAD IAGQSAELGL QSYLEFLALV SISLGVLNLL PVPVLDGGHL

401    VFYTAEWIRG KPLGERVQNI GLRFGLALMM LMMAVAFFND VTRLLG*
```

Computer analysis of this amino acid sequence gave the following results:
Homology with a Predicted ORF from *N. gonorrhoeae*
m591/g591 97.3% identity in 446 aa overlap

```
                10         20         30         40         50         60
m591.pep  LHTLLAFIFAILILVSLHEFGHYIVARLCGVKVVRFSVGFGKPFFTRKRGDTEWCLAPIP
          |:||||||||||||||||||||||||||||||||||||||||||||||||||||||||||
g591      LQTLLAFIFAILILVSLHEFGHYIVARLCGVKVVRFSVGFGKPFFTRKRGDTEWCLAPIP
                10         20         30         40         50         60

70         80         90        100        110        120
m591.pep  LGGYVKMVDTREGEVSEADLPYAFDKQHPAKRIAIVAAGPLTNLALAVLLYGLSFSFGVT
          ||||||||||||||||||||||||||||||||||||||||||||||||||||||||||||
g591      LGGYVKMVDTREGEVSEADLPYAFDKQHPAKRIAIVAAGPLTNLALAVLLYGLSFSFGVT
                70         80         90        100        110        120

130        140        150        160        170        180
m591.pep  ELRPYVGTVEPDTIAARAGFQSGDKIQSVNGTPVADWGSAQTEIVLNLEAGKVAVGVQTA
          ||||||||||||:|||:|||||||||||||:||||:||||||||||||||||||||||||
g591      ELRPYVGTVEPDTVAARTGFQSGDKIQSVNGVSVQDWSSAQTEIVLNLEAGKVAVGVQTA
               130        140        150        160        170        180

190        200        210        220        230        240
m591.pep  SGAQTVRTIDAAGTPEAGKIAKNQGYIGLMPFKITTVAGGVEKGSPAEKAGLKPGDRLTA
          ||||||||||||||||||||||||||||||||||||||||||||||||||||||||||||
g591      SGAQTVRTIDAAGTPEAGKIAKNQGYIGLMPFKITTVAGGVEKGSPAEKAGLKPGDRLTA
               190        200        210        220        230        240

250        260        270        280        290        300
m591.pep  ADGKPIASWQEWANLTRQSPGKKITLNYERAGQTHTADIRPDTVEQSDHTLIGRVGLRPQ
          |||||||||||||||||||||||||||:||||||||||||||||||:|||||||||||||
g591      ADGKPIASWQEWANLTRQSPGKKITLTYERAGQTHTADIRPDTVEQPDHTLIGRVGLRPQ
               250        260        270        280        290        300

310        320        330        340        350        360
m591.pep  PDRAWDAQIRRSYRPSVVRAFGMGWEKTVSHSWTTLKFFGKLISGNASVSHISGPLTIAD
          ||||||||||||||||||||||||||||||||||||||||||||||||||||||||||||
g591      PDRAWDAQIRRSYRPSVVRAFGMGWEKTVSHSWTTLKFFGKLISGNASVSHISGPLTIAD
               310        320        330        340        350        360

370        380        390        400        410        420
m591.pep  IAGQSAELGLQSYLEFLALVSISLGVLNLLPVPVLDGGHLVFYTAEWIRGKPLGERVQNI
          |||||||||||||||||||||||||||||||||||||||||||:||||||||||||||||
g591      IAGQSAELGLQSYLEFLALVSISLGVLNLLPVPVLDGGHLVFYTVEWIRGKPLGERVQNI
               370        380        390        400        410        420

430        440
m591.pep  GLRFGLALMMLMMAVAFFNDVTRLLGX
          ||||||||||||:|||||||||:||
g591      GLRFGLALMMLMMAAAFFNDVTRLIGX
               430        440
```

The following partial DNA sequence was identified in *N. meningitidis* <SEQ ID 1845>:

```
a591.seq
    1   TTGCACACCC TTCTAGCTTT TATCTTCGCC ATCCTGATTT TGGTCAGCCT

51   GCACGAATTC GGACACTACA TCGTCGCCAG ATTGTGCGGC GTCAAGGTTG

101   TGCGTTTTTC CGTCGGCTTC GGCAAACCGT TTTTCACCCG AAAGCGCGGC

151   GACACCGAAT GGTGCCTCGC CCCGATTCCG TTGGGCGGTT ACGTCAAAAT

201   GGTCGACACG CGCGAAGGCG AAGTATCAGA AGCCGATTTA CCCTACGCTT
```

```
-continued
 251   TTGACAAACA ACACCCCGCC AAGCGCATCG CCATCGTCGC CGCCGGCCCG
 301   CTGACCAACC TCGCACTGGC GGTTTTGCTG TACGGACTGA GCTTTTCCTT
 351   CGGCGTTACC GAACTGCGCC CCTATGTCGG CACAGTCGAA CCCGACACCA
 401   TTGCCGCCCG CGCCGGCTTC AAAGCGGCG ACAAAATACA ATCCGTCAAC
 451   GGCACACCCG TTGCAGATTG GGCAGCGCG CAAACCGAAA TCGTCCTCAA
 501   CCTCGAAGCC GGCAAAGTCG CCGTCGGCGT TCAGACGGCA TCGGGCGCGC
 551   AAACCGTCCG CACCATCGAT GCCGCAGGCA CGCCGGAAGC CGGTAAAATC
 601   GCAAAAAACC AAGGCTACAT CGGACTGATG CCCTTTAAAA TCACAACCGT
 651   TGCCGGCGGC GTGGAAAAAG GCAGCCCCGC CGAAAAAGCA GGCCTGAAAC
 701   CGGGCGACAG GCTGACTGCC GCCGACGGCA AACCCATCGC CTCATGGCAA
 751   GAATGGGCAA ACCTGACCCG CCAAAGCCCC GGCAAAAAAA TCACCCTGAC
 801   CTACGAACGC GCCGGACAAA CCCATACCGC CGACATCCGC CCCGATACTG
 851   TCGAACAGCC CGACCACACC CTGATCGGGC GCGTCGGCCT CCGTCCGCAG
 901   CCGGACAGGG CGTGGGACGC GCAAATCCGC CGCAGCTACC GTCCGTCTGT
 951   TGTCCGCGCA TTCGGCATGG CTGGGAAAA AACCGTTTCC CACTCGTGGA
1001   CAACCCTCAA ATTTTTCGGC AAACTAATCA GCGGCAACGC CTCCGTCAGC
1051   CATATTTCCG GTCCGCTGAC CATTGCCGAT ATTGCCGGAC AGTCCGCCGA
1101   ACTCGGCTTG CAAAGTTATT TGGAATTTTT GGCACTGGTC AGCATCAGCC
1151   TCGGCGTGCT GAACCTGCTG CCCGTCCCCG TTTTGGACGG CGGCCACCTC
1201   GTGTTTTATA CTGCCGAATG GATACGCGGC AAACCTTTGG GCGAACGCGT
1251   CCAAAACATC GGTTTGCGCT TCGGGCTTGC CCTCATGATG CTGATGATGG
1301   CGGTCGCCTT CTTCAACGAC GTTACCCGGC TGCTCGGTTA G
```

This corresponds to the amino acid sequence <SEQ ID 1846; ORF 591.a>:

```
a591.pep
    1   LHTLLAFIFA ILILVSLHEF GHYIVARLCG VKVVRFSVGF GKPFFTRKRG

51   DTEWCLAPIP LGGYVKMVDT REGEVSEADL PYAFDKQHPA KRIAIVAAGP

101   LTNLALAVLL YGLSFSFGVT ELRPYVGTVE PDTIAARAGF QSGDKIQSVN

151   GTPVADWGSA QTEIVLNLEA GKVAVGVQTA SGAQTVRTID AAGTPEAGKI

201   AKNQGYIGLM PFKITTVAGG VEKGSPAEKA GLKPGDRLTA ADGKPIASWQ

251   EWANLTRQSP GKKITLTYER AGQTHTADIR PDTVEQPDHT LIGRVGLRPQ

301   PDRAWDAQIR RSYRPSVVRA FGMGWEKTVS HSWTTLKFFG KLISGNASVS

351   HISGPLTIAD IAGQSAELGL QSYLEFLALV SISLGVLNLL PVPVLDGGHL

401   VFYTAEWIRG KPLGERVQNI GLRFGLALMM LMMAVAFFND VTRLLG*
``` m591/a591 99.6% identity in 446 aa overlap

```
                 10         20         30         40         50         60
m591.pep  LHTLLAFIFAILILVSLHEFGHYIVARLCGVKVVRFSVGFGKPFFTRKRGDTEWCLAPIP
          ||||||||||||||||||||||||||||||||||||||||||||||||||||||||||||
a591      LHTLLAFIFAILILVSLHEFGHYIVARLCGVKVVRFSVGFGKPFFTRKRGDTEWCLAPIP
                 10         20         30         40         50         60
```

```
              70         80         90        100        110        120
m591.pep  LGGYVKMVDTREGEVSEADLPYAFDKQHPAKRIAIVAAGPLTNLALAVLLYGLSFSFGVT
          ||||||||||||||||||||||||||||||||||||||||||||||||||||||||||||
a591      LGGYVKMVDTREGEVSEADLPYAFDKQHPAKRIAIVAAGPLTNLALAVLLYGLSFSFGVT
              70         80         90        100        110        120

130        140        150        160        170        180
m591.pep  ELRPYVGTVEPDTIAARAGFQSGDKIQSVNGTPVADWGSAQTEIVLNLEAGKVAVGVQTA
          ||||||||||||||||||||||||||||||||||||||||||||||||||||||||||||
a591      ELRPYVGTVEPDTIAARAGFQSGDKIQSVNGTPVADWGSAQTEIVLNLEAGKVAVGVQTA
             130        140        150        160        170        180

190        200        210        220        230        240
m591.pep  SGAQTVRTIDAAGTPEAGKIAKNQGYIGLMPFKITTVAGGVEKGSPAEKAGLKPGDRLTA
          ||||||||||||||||||||||||||||||||||||||||||||||||||||||||||||
a591      SGAQTVRTIDAAGTPEAGKIAKNQGYIGLMPFKITTVAGGVEKGSPAEKAGLKPGDRLTA
             190        200        210        220        230        240

250        260        270        280        290        300
m591.pep  ADGKPIASWQEWANLTRQSPGKKITLNYERAGQTHTADIRPDTVEQSDHTLIGRVGLRPQ
          |||||||||||||||||||||||||||:||||||||||||||||||:|||||||||||||
a591      ADGKPIASWQEWANLTRQSPGKKITLTYERAGQTHTADIRPDTVEQPDHTLIGRVGLRPQ
             250        260        270        280        290        300

310        320        330        340        350        360
m591.pep  PDRAWDAQIRRSYRPSVVRAFGMGWEKTVSHSWTTLKFFGKLISGNASVSHISGPLTIAD
          ||||||||||||||||||||||||||||||||||||||||||||||||||||||||||||
a591      PDRAWDAQIRRSYRPSVVRAFGMGWEKTVSHSWTTLKFFGKLISGNASVSHISGPLTIAD
             310        320        330        340        350        360

370        380        390        400        410        420
m591.pep  IAGQSAELGLQSYLEFLALVSISLGVLNLLPVPVLDGGHLVFYTAEWIRGKPLGERVQNI
          ||||||||||||||||||||||||||||||||||||||||||||||||||||||||||||
a591      IAGQSAELGLQSYLEFLALVSISLGVLNLLPVPVLDGGHLVFYTAEWIRGKPLGERVQNI
             370        380        390        400        410        420

430        440
m591.pep  GLRFGLALMMLMMAVAFFNDVTRLLGX
          |||||||||||||||||||||||||||
a591      GLRFGLALMMLMMAVAFFNDVTRLLGX
             430        440
```

The following partial DNA sequence was identified in *N. gonorrhoeae* <SEQ ID 1847>:

```
g592.seq..
     1    atgattccgg acgtgttcgg tcagattttt tcgggcgcgt tcaaattcga
    51    cgcggcagca ggcggcttac tcggcggtct gatttcgcaa acgatgatga
   101    tgggcatcaa acgcggcctg tattccaacg aggcgggtat gggttccgcg
   151    ccgaacgccg ccgccgccgc cgaagtgaaa caccctgttt cgcaaggtat
   201    gattcaaatg ctgggcgtgt tgtcgatac catcatcgtt tgttcttgca
   251    ccgccttcat catcttgatt taccaacagc cttatggcga tttgagcggt
   301    gcggcgctga cgcaggcggc gattgtcagc caagtggggc aatgggcgc
   351    gggtttcctc gccgtcatcc tgtttatgtt tgccttttcc accgttatcg
   401    gcaactatgc ctatgccgag tccaacgtcc aattcatcaa aagccattgg
   451    ctgattaccg ccgttttccg tatgctggtt ttggcgtggg tctatttcgg
   501    cgcggttgcc aatgtgcctt ggtctgggga tatggcggat atggcgatgg
   551    gcatcatggc gtggatcaac ctcgtcgcca tcctgctgct ctcgccattg
   601    gcgtttatgc tgctgcgcga ttacaccgcc aagctgaaaa tgggcaaaga
   651    ccccgagttc aaactttccg aacatccggg cctgaaacgc cgcatcaaat
   701    ccgatgtttg gtaa
```

This corresponds to the amino acid sequence <SEQ ID 1848; ORF 592.ng>:

```
g592.pep ..
     1  MIPDVFGQIF SGAFKFDAAA GGLLGGLISQ TMMMGIKRGL YSNEAGMGSA

51  PNAAAAAEVK HPVSQGMIQM LGVFVDTIIV CSCTAFIILI YQQPYGDLSG

101  AALTQAAIVS QVGQWGAGFL AVILFMFAFS TVIGNYAYAE SNVQFIKSHW

151  LITAVFRMLV LAWVYFGAVA NVPLVWDMAD MAMGIMAWIN LVAILLLSPL

201  AFMLLRDYTA KLKMGKDPEF KLSEHPGLKR RIKSDVW*
```

The following partial DNA sequence was identified in *N. meningitidis* <SEQ ID 1849>:

```
m592.seq ..
     1  ATGATTCCGG ACGTGTTCGG TCAGATTTTT TCGGGCGCGT TCAAATTCGA

51  CGCGGCAGCA GGCGGCTTAC TCGGCGGTCT GATTTCGCAA ACGATGATGA

101  TGGGCATCAA ACGCGGCCTG TATTCCAACG AGGCGGGTAT GGGTTCCGCG

151  CCGAACGCCG CCGCCGCCGC CGAAGTGAAA CACCCTGTTT CGCAAGGTAT

201  GATTCAAATG CTGGGCGTGT TTGTCGATAC CATCATCGTT TGTTCTTGCA

251  CCGCCTTCAT CATCTTGATT TACCAACAGC CTTACGGCGA TTTGAGCGGT

301  GCGGCGCTGA CGCAGGCGGC GATTGTCAGC CAAGTGGGGC AATGGGGCGC

351  GGGCTTCCTC GCCGTCATCC TGTTTATGTT TGCCTTTTCC ACCGTTATCG

401  GCAACTATGC CTATGCCGAG TCCAACGTCC AATTCATCAA AAGCCATTGG

451  CTGATTACCG CCGTTTTCCG TATGCTGGTT TTGGCGTGGG TCTATTTCGG

501  CGCGGTTGCC AATGTGCCTT TGGTCTGGGA TATGGCGGAT ATGGCGATGG

551  GCATTATGGC GTGGATCAAC CTTGTCGCCA TCCTGCTGCT CTCGCCCTTG

601  GCGTTTATGC TGCTGCGCGA TTACACCGCC AAGCTGAAAA TGGGCAAAGA

651  CCCCGAGTTC AAACTTTCCG AACATCCGGG CCTGAAACGC CGTATCAAAT

701  CCGACGTTTG GTAA
```

This corresponds to the amino acid sequence <SEQ ID 1850; ORF 592>:

```
m592.pep ..
     1  MIPDVFGQIF SGAFKFDAAA GGLLGGLISQ TMMMGIKRGL YSNEAGMGSA

51  PNAAAAAEVK HPVSQGMIQM LGVFVDTIIV CSCTAFIILI YQQPYGDLSG

101  AALTQAAIVS QVGQWGAGFL AVILFMFAFS TVIGNYAYAE SNVQFIKSHW

151  LITAVFRMLV LAWVYFGAVA NVPLVWDMAD MAMGIMAWIN LVAILLLSPL

201  AFMLLRDYTA KLKMGKDPEF KLSEHPGLKR RIKSDVW*
``` m592/g592 100.0% identity in 237 aa overlap

```
                    10        20        30        40        50        60
m592.pep    MIPDVFGQIFSGAFKFDAAAGGLLGGLISQTMMMGIKRGLYSNEAGMGSAPNAAAAAEVK
            ||||||||||||||||||||||||||||||||||||||||||||||||||||||||||||
g592        MIPDVFGQIFSGAFKFDAAAGGLLGGLISQTMMMGIKRGLYSNEAGMGSAPNAAAAAEVK
                    10        20        30        40        50        60

70        80        90       100       110       120
m592.pep    HPVSQGMIQMLGVFVDTIIVCSCTAFIILIYQQPYGDLSGAALTQAAIVSQVGQWGAGFL
            ||||||||||||||||||||||||||||||||||||||||||||||||||||||||||||
g592        HPVSQGMIQMLGVFVDTIIVCSCTAFIILIYQQPYGDLSGAALTQAAIVSQVGQWGAGFL
                    70        80        90       100       110       120
```

-continued

```
                130       140       150       160       170       180
m592.pep  AVILFMFAFSTVIGNYAYAESNVQFIKSHWLITAVFRMLVLAWVYFGAVANVPLVWDMAD
          ||||||||||||||||||||||||||||||||||||||||||||||||||||||||||||
g592      AVILFMFAFSTVIGNYAYAESNVQFIKSHWLITAVFRMLVLAWVYFGAVANVPLVWDMAD
                130       140       150       160       170       180

190       200       210       220       230
m592.pep  MAMGIMAWINLVAILLLSPLAFMLLRDYTAKLKMGKDPEFKLSEHPGLKRRIKSDVWX
          ||||||||||||||||||||||||||||||||||||||||||||||||||||||||||
g592      MAMGIMAWINLVAILLLSPLAFMLLRDYTAKLKMGKDPEFKLSEHPGLKRRIKSDVWX
                190       200       210       220       230
```

The following partial DNA sequence was identified in *N. meningitidis* <SEQ ID 1851>:

```
a592.seq
     1  ATGATTCCGG ACGTGTTCGG TCAGATTTTT TCGGGCGCGT TCAAATTCGA

51  CGCGGCAGCA GGCGGCTTAC TCGGCGGTCT GATTTCGCAA ACGATGATGA

101  TGGGCATCAA ACGCGGCCTG TATTCCAACG AGGCGGGTAT GGGTTCCGCG

151  CCGAACGCCG CCGCCGCCGC CGAAGTGAAA CACCCTGTTT CGCAAGGTAT

201  GATTCAAATG CTGGGCGTGT TTGTCGATAC CATCATCGTT TGTTCTTGCA

251  CCGCCTTCAT CATCTTGATT TACCAACAGC CTTACGGCGA TTTGAGCGGT

301  GCGGCGCTGA CGCAGGCGGC GATTGTCAGC CAAGTGGGGC AATGGGGCGC

351  GGGCTTCCTC GCCGTCATCC TGTTTATGTT TGCCTTTTCC ACCGTTATCG

401  GCAACTATGC CTATGCCGAG TCCAACGTCC AATTCATCAA AAGCCATTGG

451  CTGATTACCG CCGTTTTCCG TATGCTGGTT TTGGCGTGGG TCTATTTCGG

501  CGCGGTTGCC AATGTGCCTT TGGTCTGGGA TATGGCGGAT ATGGCGATGG

551  GCATTATGGC GTGGATCAAC CTTGTCGCCA TCCTGCTGCT CTCGCCCTTG

601  GCGTTTATGC TGCTGCGCGA TTACACCGCC AAGCTGAAAA TGGGCAAAGA

651  CCCCGAGTTC AAACTTTCCG AACATCCGGG CCTGAAACGC CGTATCAAAT

701  CCGACGTTTG GTAA
```

This corresponds to the amino acid sequence <SEQ ID 1852; ORF 592.a>:

```
a592.pep
     1  MIPDVFGQIF SGAFKFDAAA GGLLGGLISQ TMMMGIKRGL YSNEAGMGSA

51  PNAAAAAEVK HPVSQGMIQM LGVFVDTIIV CSCTAFIILI YQQPYGDLSG

101  AALTQAAIVS QVGQWGAGFL AVILFMFAFS TVIGNYAYAE SNVQFIKSHW

151  LITAVFRMLV LAWVYFGAVA NVPLVWDMAD MAMGIMAWIN LVAILLLSPL

201  AFMLLRDYTA KLKMGKDPEF KLSEHPGLKR RIKSDVW*
``` m592/a592 100.0% identity in 237 aa overlap

```
                 10        20        30        40        50        60
m592.pep  MIPDVFGQIFSGAFKFDAAAGGLLGGLISQTMMMGIKRGLYSNEAGMGSAPNAAAAAEVK
          ||||||||||||||||||||||||||||||||||||||||||||||||||||||||||||
a592      MIPDVFGQIFSGAFKFDAAAGGLLGGLISQTMMMGIKRGLYSNEAGMGSAPNAAAAAEVK
                 10        20        30        40        50        60

70        80        90       100       110       120
m592.pep  HPVSQGMIQMLGVFVDTIIVCSCTAFIILIYQQPYGDLSGAALTQAAIVSQVGQWGAGFL
          ||||||||||||||||||||||||||||||||||||||||||||||||||||||||||||
a592      HPVSQGMIQMLGVFVDTIIVCSCTAFIILIYQQPYGDLSGAALTQAAIVSQVGQWGAGFL
                 70        80        90       100       110       120
```

```
                     130        140        150        160        170        180
m592.pep   AVILFMFAFSTVIGNYAYAESNVQFIKSHWLITAVFRMLVLAWVYFGAVANVPLVWDMAD
           ||||||||||||||||||||||||||||||||||||||||||||||||||||||||||||
a592       AVILFMFAFSTVIGNYAYAESNVQFIKSHWLITAVFRMLVLAWVYFGAVANVPLVWDMAD
                     130        140        150        160        170        180

190        200        210        220        230
m592.pep   MAMGIMAWINLVAILLLSPLAFMLLRDYTAKLKMGKDPEFKLSEHPGLKRRIKSDVWX
           |||||||||||||||||||||||||||||||||||||||||||||||||||||||||
a592       MAMGIMAWINLVAILLLSPLAFMLLRDYTAKLKMGKDPEFKLSEHPGLKRRIKSDVWX
                     190        200        210        220        230
```

The following partial DNA sequence was identified in *N. gonorrhoeae* <SEQ ID 1853>:

```
g593.seq..
     1     atgcttgaac tgaacggact ctgcaaatgc ttcggcggca aaacggtcgc 51     cgacaacatc tgcctgactg tcgggcgcgg caaaatactc gccgtactgg 101     ggcggtcggg ctgcggcaaa tccaccctgc tgaatatgat tgcgggcatc 151     gtccggccgg acggcggcga aattcggctg aacggggaaa acattacctg 201     tatgccgccc gaaaaacgcc gtatctcgct gatgtttcaa gattacgcgc 251     tgtttcccca tatgagtgcg ctggaaaata cggcattcgg tttgaaaatg 301     caaaaaatgc cgaaagccga agccgaacgc ctcgccttgt cggcacttgc 351     cgaagtcggg ctggaaaacg aggcgcaccg caagcctgaa aaactttccg 401     gaggcgagaa gcaacggttg gcactggcgc gcgctttggt tgtccgccct 451     tccctgctgt tgctggatga atcgttttcc agtttggaca cgcatttgcg 501     cgaccggctg cgccgtatga ccgccgaacg catccgcaag ggcggcatcc 551     ctgccgtttt ggtaacgcat tcgcccgaag aggcctgcac ggcggcggac 601     gaaatcgccg tcatgcacga ggggaaaatc cttcaatgcg gtacgcccga 651     aaccttgatt caaacgcctg ccggcgtgca ggtcgcccgt ctgatggggc 701     tgcccaatac cgacgatgac cgccatattc cgcaaaatgc cgtgtgcttg 751     gacaatcatg gaacggaatg ccgtctgctg tccctcgtcc gcctgcccga 801     ctcgctccgg cttccgccg tccatcccga acacggcgag ctgaccttaa 851     acctgactgt cggacaacat acggacggta tttccggaaa cggtacggtc 901     cgcatccgcg tcgatgaagg gcgtatcgtc cgtttccgat ga
```

This corresponds to the amino acid sequence <SEQ ID 1854; ORF 593.ng>:

```
g593.pep..
     1     MLELNGLCKC FGGKTVADNI CLTVGRGKIL AVLGRSGCGK STLLNMIAGI

51     VRPDGGEIRL NGENITCMPP EKRRISLMFQ DYALFPHMSA LENTAFGLKM

101     QKMPKAEAER LALSALAEVG LENEAHRKPE KLSGGEKQRL ALARALVVRP

151     SLLLLDESFS SLDTHLRDRL RRMTAERIRK GGIPAVLVTH SPEEACTAAD

201     EIAVMHEGKI LQCGTPETLI QTPAGVQVAR LMGLPNTDDD RHIPQNAVCL

251     DNHGTECRLL SLVRLPDSLR LSAVHPEHGE LTLNLTVGQH TDGISGNGTV

301     RIRVDEGRIV RFR*
```

The following partial DNA sequence was identified in *N. meningitidis* <SEQ ID 1855>:

```
m593.seq
    1   ATGCTTGAAC TGAACGGACT CTGCAAACGC TTCGGCAATA AAACCGTCGC
   51   CGACAACATC TGCCTGACTG TCGGGCGCGG CAAAATACTC GCCGTTTTGG
  101   GGCGGTCGGG CTGCGGAAAA TCCACCCTGC TGAATATAAT TGCGGGGATT
  151   GTCCGGCCGG ACGGCGGGGA AATATGGCTG AACGGAGAAA ACATTACCCG
  201   TATGCCGCCC GAAAACGCC GTATCTCGCT GATGTTTCAA GATTACGCGC
  251   TGTTTCCCCA TATGAGTGCG CTGGAAAATG CGGCATTCGG TTTGAAAATG
  301   CAAAAAATGC CGAAAGCCGA AGCCGAACGC CTCGCCATGG CGGCACTTGC
  351   CGAAGTCGGA CTGGAAAACG AGGCGCACCG CAAGCCTGAA AAACTTTCCG
  401   GAGGCGAGAA GCAACGGCTG GCGTTGGCGC GCGCTTTGGT TGTCCGCCCT
  451   TCCCTGCTGC TGTTGGACGA ATCGTTTTCC AGTTTGGACA CGCATTTGCG
  501   CGGCACGCTG CGCCGTATGA CTGCCGAACG TATCCGAAAC GGCGGCATCC
  551   CTGCCGTTTT GGTAACGCAT TCGCCCGAAG AAGCCTGTAC GACGGCAGAC
  601   GAAATCGCCG TGATGCATAA AGGGAGGATT CTACAATACG GTACGCCCGA
  651   AACATTGGTC AAAACACCAT CCTGCGTGCA GGTCGCCCGA CTGATGGGTT
  701   TGCCCAATAC CGACGATAAC CGCCATATTC CGCAACATGC GGTGCGTTTC
  751   GACCAAGACG GCATGGAGTG CCGCGTATTA TCCCGTACCT GTTTGCCCGA
  801   ATCGTTCAGC CTGTCCGTCC TCCATCCGGA ACACGGCATC CTGTGGCTGA
  851   ACCTCGATAT GCGGCACGCC GGGGCGGTAT CGGGCAAGGA TACGGTACGC
  901   ATCCATATCG AAGAACGGGA AATCGTCCGC TTCCGCTGA
```

This corresponds to the amino acid sequence <SEQ ID 1856; ORF 593>:

```
m593.pep ..
    1   MLELNGLCKR FGNKTVADNI CLTVGRGKIL AVLGRSGCGK STLLNIIAGI
   51   VRPDGGEIWL NGENITRMPP EKRRISLMFQ DYALFPHMSA LENAAFGLKM
  101   QKMPKAEAER LAMAALAEVG LENEAHRKPE KLSGGEKQRL ALARALVVRP
  151   SLLLLDESFS SLDTHLRGTL RRMTAERIRN GGIPAVLVTH SPEEACTTAD
  201   EIAVMHKGRI LQYGTPETLV KTPSCVQVAR LMGLPNTDDN RHIPQHAVRF
  251   DQDGMECRVL SRTCLPESFS LSVLHPEHGI LWLNLDMRHA GAVSGKDTVR
  301   IHIEEREIVR FR*
```

Computer analysis of this amino acid sequence gave the following results:
Homology with a Predicted ORF from *N. gonorrhoeae*
  m593/g593 83.4% identity in 313 aa overlap

```
                   10         20         30         40         50         60
    m593.pep  MLELNGLCKRFGNKTVADNICLTVGRGKILAVLGRSGCGKSTLLNIIAGIVRPDGGEIWL
              ||||||||||  ||:||||||||||||||||||||||||||||||:||||||||||||| |
        g593  MLELNGLCKCFGGKTVADNICLTVGRGKILAVLGRSGCGKSTLLNMIAGIVRPDGGEIRL
                   10         20         30         40         50         60

70         80         90        100        110        120
    m593.pep  NGENITRMPPEKRRISLMFQDYALFPHMSALENAAFGLKMQKMPKAEAERLAMAALAEVG
              ||||||  |||||||||||||||||||||||||:||||||||||||||||||||::||||
        g593  NGENITCMPPEKRRISLMFQDYALFPHMSALENTAFGLKMQKMPKAEAERLALSALAEVG
                   70         80         90        100        110        120
```

```
              130        140        150        160        170        180
m593.pep  LENEAHRKPEKLSGGEKQRLALARALVVRPSLLLLDESFSSLDTHLRGTLRRMTAERIRN
          |||||||||||||||||||||||||||||||||||||||||||| ||||||||||||:
g593      LENEAHRKPEKLSGGEKQRLALARALVVRPSLLLLDESFSSLDTHLRDRLRRMTAERIRK
              130        140        150        160        170        180
              190        200        210        220        230        240
m593.pep  GGIPAVLVTHSPEEACTTADEIAVMHKGRILQYGTPETLVKTPSCVQVARIMGLPNTDDN
          ||||||||||||||||||:|||||||:|:|||  ||||||::||: ||||||||||||:
g593      GGIPAVLVTHSPEEACTAADEIAVMHEGKILQYGTPETLIQTPAGVQVARIMGLPNTDDD
              190        200        210        220        230        240
              250        260        270        280        290        299
m593.pep  RHIPQHAVRFDQDGMECRVLSRTCLPESFSLSVLHPEHGILWLNLDM-RHAGAVSGKDTV
          |||||:||  :|:  |||:||  : ||:|: ||::|||||  |||   :|:  ::||:||
g593      RHIPQNAVCLDNHGTECRLLSLVRLPDSLRLSAVHPEHGELTLNLTVGQHTDGISGNGTV
              250        260        270        280        290        299
              300        310
m593.pep  RIHIEEREIVRFRX
          ||:::| :||||||
g593      RIRVDEGRIVRFRX
              310
```

The following partial DNA sequence was identified in *N. meningitidis* <SEQ ID 1857>:

```
a593.seq
    1   ATGCTTGAAC TGAACGGACT CTGCAAACGC TTCGGCGGCA AAACGGTTGC

51   CGACGATATC TGCCTGACTG TCGGGCGCGG CAAAATACTC GCCGTTTTGG

101   GGCGGTCGGG CTGCGGCAAA TCCACCCTGC TGAATATGAT TGCGGGCATC

151   GTCCGGCCGG ACGGCGGGGA AATATGGCTG AATGGGGAAA ACATTACCCG

201   TATGCCGCCC GAAAAACGCC GTATTTCGCT GATGTTTCAA GATTACGCGC

251   TGTTTCCCCA TATGAGTGCA CTGGAAAATG CGGCATTCGG TTTGAAAATG

301   CAAAAAATGC CGAAAGCCGA AGCCGAAAGC CTCGCCATGG CGGCACTTGC

351   CGAAGTCGGA CTGGAAAACG AGGCGCACCG CAAGCCTGAN AAACTTTCCG

401   GAGGCGAAAA GCAACGGTTG GCACTGGCGC GCGCTTTGGT TGTCCGCCCT

451   TCCCTGCTGC TGTTGGACGA ATCGTTTTCC AGTTTGGACA CGCATTTGCG

501   CGACCGGCTG CGCCGCATGA CTGCCGAACG TATCCGCAAG GGCGGCATCC

551   CTGCCGTTTT GGTAACGCAT TCGCCCGAAG AGGCCTGCAC GGCGGCAGAC

601   GAAATCGCCG TCATGCACGA GGGGAAAATC CTTCAATGCG GTACGCCCGA

651   AACCTTGGTT CAAACGCCTG CCGGCGTGCA GGTCGCCCAT CTGATGGGGC

701   TGCCCAATAC CGACGATGAC CGCCATATTC CGCAACATGC GGTGCGTTTC

751   GACCAAGACG GCATGGAGTG CCGCGTATTA TCCCGTACCT GTTTGCCCGA

801   ATCGTTCAGC CTGTCCGTCC TCCATCCGGA ACACGGCATC CTGTGGCTGA

851   ACCTCGATAT GCCGCACGCC GGTGAAATAT CGGGAAACGA TACGGTACGC

901   ATCCATATCG AAGACAGGGA AATCGTCCGC TTCCGCTGA
```

This corresponds to the amino acid sequence <SEQ ID 1858; ORF 593.a>:

```
a593.pep
    1   MLELNGLCKR FGGKTVADDI CLTVGRGKIL AVLGRSGCGK STLLNMIAGI

51   VRPDGGEIWL NGENITRMPP EKRRISLMFQ DYALFPHMSA LENAAFGLKM

101   QKMPKAEAES LAMAALAEVG LENEAHRKPX KLSGGEKQRL ALARALVVRP

151   SLLLLDESFS SLDTHLRDRL RRMTAERIRK GGIPAVLVTH SPEEACTAAD
```

-continued

```
201  EIAVMHEGKI LQCGTPETLV QTPAGVQVAH LMGLPNTDDD RHIPQHAVRF

251  DQDGMECRVL SRTCLPESFS LSVLHPEHGI LWLNLDMPHA GEISGNDTVR

301  IHIEDREIVR FR*
``` m593/a593 92.9% identity in 312 aa overlap

```
                  10         20         30         40         50         60
m593.pep  MLELNGLCKRFGNKTVADNICLTVGRGKILAVLGRSGCGKSTLLNIIAGIVRPDGGEIWL
          |||||||||||:|||||:||||||||||||||||||||||||||:|||||||||||||||
a593      MLELNGLCKRFGGKTVADDICLTVGRGKILAVLGRSGCGKSTLLNMIAGIVRPDGGEIWL
                  10         20         30         40         50         60

70         80         90        100        110        120
m593.pep  NGENITRMPPEKRRISLMFQDYALFPHMSALENAAFGLKMQKMPKAEAERLAMAALAEVG
          |||||||||||||||||||||||||||||||||||||||||||||||| |||||||||||
a593      NGENITRMPPEKRRISLMFQDYALFPHMSALENAAFGLKMQKMPKAEAESLAMAALAEVG
                  70         80         90        100        110        120

130        140        150        160        170        180
m593.pep  LENEAHRKPEKLSGGEKQRLALARALVVRPSLLLLDESFSSLDTHLRGTLRRMTAERIRN
          |||||||||:|||||||||||||||||||||||||||||||||||||||:|||||||||:
a593      LENEAHRKPXKLSGGEKQRLALARALVVRPSLLLLDESFSSLDTHLRDRLRRMTAERIRK
                 130        140        150        160        170        180

190        200        210        220        230        240
m593.pep  GGIPAVLVTHSPEEACTTADEIAVMHKGRILQYGTPETLVKTPSCVQVARLMGLPNTDDN
          |||||||||||||||||:|||||||:|||::|||||||||:||||:||||:|||||||||
a593      GGIPAVLVTHSPEEACTAADEIAVMHEGKILQCGTPETLVQTPAGVQVAHLMGLPNTDDD
                 190        200        210        220        230        240

250        260        270        280        290        300
m593.pep  RHIPQHAVRFDQDGMECRVLSRTCLPESFSLSVLHPEHGILWLNLDMRHAGAVSGKDTVR
          ||||||||||||||||||||||||||||||||||||||||||||||||:||:||||
a593      RHIPQHAVRFDQDGMECRVLSRTCLPESFSLSVLHPEHGILWLNLDMPHAGEISGNDTVR
                 250        260        270        280        290        300

310
m593.pep  IHIEEREIVRFRX
          ||||:||||||||
a593      IHIEDREIVRFRX
                 310
```

The following partial DNA sequence was identified in *N. gonorrhoeae* <SEQ ID 1859>:

```
g594.seq..
    1    atgggtgcag ataccgatgg cgacaaggat gttcggctta atcgaacggg 51    tctcgttttt agcatactcc ggctgctgtt ccgcatcgga attgggatcg 101    gtaagttcgc cgttcaggcc tttcaggtct ttaagctgct gatctgtacg 151    gttgagcacc caaatcggtt tgccttgcca ctcggcggtc agcagctgac 201    ccgcttcgat tttactgaca tccacctcga cggcagcacc ggaggccttg 251    gcttttccg aagggaaaaa actggccaca acggcgttg ccacacccaa 301    tgctgccact ccgcccgcgc cgcaggtcgc aagtgtcagg aaacggcggc 351    ggccgttgtt gatttcttga ttatccatta ttcagtcgtc ctaatatttt 401    gggaatgccg agccattaaa cattgcaatt ttacccagtt tgcagtgata 451    ctcaaagcat tatttaaaat aaggtaa
```

This corresponds to the amino acid sequence <SEQ ID 1860; ORF 594.ng>:

```
g594.pep
    1    MGADTDGDKD VRLNRTGLVF SILRLLFRIG IGIGKFAVQA FQVFKLLICT

51    VEHPNRFALP LGGQQLTRFD FTDIHLDGST GGLGFFRREK TGHKRRCHTQ
```

```
101    CCHSARAAGR KCQETAAAVV DFLIIHYSVV LIFWECRAIK HCNFTQFAVI

151    LKALFKIR*
```

The following partial DNA sequence was identified in *N. meningitidis* <SEQ ID 1861>:

```
m594.seq
   1   ATGGGTGCAG ATACCGATGG CGACAAGGAT GTTCGGCTTA ATCGAACGGG

51   TCTCGTTTTT AGCATACTCC GGCTGCTGTT CCGCATCGGA ATTGGGATCG

101   GTAAGTTCGC CGTTCAGGCC TTTCAGGTCT TTAAGCTGCT GATCTGTACG

151   GTTGAGCACC CAAATCGGTT TGCCTTGCCA CTCGGCGGTC AGCAGCTGAC

201   CCGCTTCGAT TTTACTGACA TCCACCTCGA CGGCAGCACC GGCGGCCTTG

251   GCTTTTTCCG AAGGGAAAAA ACTGGCCACA AACGGCGTTG CCACACCCAA

301   TGCTGCCACT CCGCCCGCGC CGCAGGTCGC GAGTGTCAGG AAACGGCGGC

351   GGCCGTTGTT GATTTCTTGA TTATCCATTA TTCAGTCGTC CTAATATTTT

401   GGGAATACCG AGCCATTAAA CGTTGCAATT TTACCCAGTT TGCAGTGATA

451   CTCAAAGCAT TATTTAAAAT AAGGTAA
```

This corresponds to the amino acid sequence <SEQ ID 1862; ORF 594>:

```
m594.pep
   1   MGADTDGDKD VRLNRTGLVF SILRLLFRIG IGIGKFAVQA FQVFKLLICT

51   VEHPNRFALP LGGQQLTRFD FTDIHLDGST GGLGFFRREK TGHKRRCHTQ

101   CCHSARAAGR ECQETAAAVV DFLIIHYSVV LIFWEYRAIK RCNFTQFAVI

151   LKALFKIR*
```

Computer analysis of this amino acid sequence gave the following results:
Homology with a Predicted ORF from *N. gonorrhoeae*
m594/g594 98.1% identity in 158 aa overlap

```
                10         20         30         40         50         60
m594.pep  MGADTDGDKDVRLNRTGLVFSILRLLFRIGIGIGKFAVQAFQVFKLLICTVEHPNRFALP
          ||||||||||||||||||||||||||||||||||||||||||||||||||||||||||||
g594      MGADTDGDKDVRLNRTGLVFSILRLLFRIGIGIGKFAVQAFQVFKLLICTVEHPNRFALP
                10         20         30         40         50         60

70         80         90        100        110        120
m594.pep  LGGQQLTRFDFTDIHLDGSTGGLGFFRREKTGHKRRCHTQCCHSARAAGRECQETAAAVV
          |||||||||||||||||||||||||||||||||||||||||||||||||:||||||||||
g594      LGGQQLTRFDFTDIHLDGSTGGLGFFRREKTGHKRRCHTQCCHSARAAGRKCQETAAAVV
                70         80         90        100        110        120

130        140        150       159
m594.pep  DFLIIHYSVVLIFWEYRAIKRCNFTQFAVILKALFKIRX
          |||||||||||||||||:||||||||||||||||||||
g594      DFLIIHYSVVLIFWECRAIKHCNFTQFAVILKALFKIRX
                130        140        150
```

The following partial DNA sequence was identified in *N. meningitidis* <SEQ ID 1863>:

```
a594.seq
   1   ATGGGTGCAG ATACCGATGG CGACAAGGAT GTTCGGCTTA ATCGAACGGG

51   TCTCGTTTTT AGCATACTCC GGCTGCTGTT CCGCATCGGA ATTGGGATCG

101   GTAAGTTCGC CGTTCAGGCC TTTCAGGTCT TTAAGCTGCT GATCTGTACG
```

-continued

```
151 GTTGAGCACC CAAATCGGTT TGCCTTGCCA CTCGGCGGTC AGCAACTGAC

201 CCGCTTCGAT TTTACTGACA TCCACCTCGA CGGCAGCACC GGCGGCCTTG

251 GCTTTTTCCG AAGGGAAAAA ACTGGCCACA AACGGCGTTG CCACACCCAA

301 TGCTGCCACT CCGCCCGCGC CGCAGGTCGC GAGTGTCAGG AAACGGCGGC

351 GGCCGTTGTT GATTTCTTGA TTATCCATTA TTCAGTCGTC CTAATATTTT

401 GGGAATACCG AGCCATTAAA CGTTGCAATT TTACCCAGTT TGCAGTGATA

451 CTCAAAGCAT TATTTAAAAT AAGGTAA
```

This corresponds to the amino acid sequence <SEQ ID 1864; ORF 594.a>:

```
a594.pep
    1   MGADTDGDKD VRLNRTGLVF SILRLLFRIG IGIGKFAVQA FQVFKLLICT

51   VEHPNRFALP LGGQQLTRFD FTDIHLDGST GGLGFFRREK TGHKRRCHTQ

101   CCHSARAAGR ECQETAAAVV DFLIIHYSVV LIFWEYRAIK RCNFTQFAVI

151   LKALFKIR*
``` m594/a594 100.0% identity in 158 aa overlap

```
                  10         20         30         40         50         60
    m594.pep   MGADTDGDKDVRLNRTGLVFSILRLLFRIGIGIGKFAVQAFQVFKLLICTVEHPNRFALP
               ||||||||||||||||||||||||||||||||||||||||||||||||||||||||||||
    a594       MGADTDGDKDVRLNRTGLVFSILRLLFRIGIGIGKFAVQAFQVFKLLICTVEHPNRFALP
                  10         20         30         40         50         60

70         80         90        100        110        120
    m594.pep   LGGQQLTRFDFTDIHLDGSTGGLGFFRREKTGHKRRCHTQCCHSARAAGRECQETAAAVV
               ||||||||||||||||||||||||||||||||||||||||||||||||||||||||||||
    a594       LGGQQLTRFDFTDIHLDGSTGGLGFFRREKTGHKRRCHTQCCHSARAAGRECQETAAAVV
                  70         80         90        100        110        120

130        140        150    159
    m594.pep   DFLIIHYSVVLIFKEYRAIKRCNFTQFAVILKALFKIRX
               |||||||||||||||||||||||||||||||||||||||
    a594       DFLIIHYSVVLIFKEYRAIKRCNFTQFAVILKALFKIRX
                 130        140        150
```

The following partial DNA sequence was identified in *N. gonorrhoeae* <SEQ ID 1865>:

```
g595.seq..
     1     atgagaaaat tcaatttgac cgcattgtcc gtgatgcttg ccttgggttt 51     gaccgcgtgc cagccgccgg aggcggagaa agccgcgccg gccgcgtccg 101     gtgagaccca atccgccaac gaaggcggtt cggtcggtat cgccgtcaac 151     gacaatgcct gcgaaccgat gaatctgacc gtgccgagcg acaggttgt 201     gttcaatatt aaaaacaaca gcggccgcaa gctcgaatgg gaaatcctga 251     agggcgtgat ggtggtggac gaacgcgaaa atatcgcccc ggggctttcc 301     gacaaaatga accgtaacct gctgccgggc gaatacgaaa tgacctgcgg 351     ccttttgacc aatccgcgcg gcaagctggt ggtagccgac agcggcttta 401     aagacaccgc caacgaagcg gatttggaaa aactgcccca accgctcgcc 451     gactataaag cctacgttca aggcgaggtt aaagagctgg cggcgaaaac 501     caaaaccttt accgaagccg tcaaagcagg cgacattgaa aaggcgaaat 551     ccctgtttgc cgccacccgc gtccattacg aacgcatcga accgattgcc
```

```
-continued
 601    gagcttttca gcgaactcga ccccgtcatc gatgcgtgtg aagacgactt
 651    caaagacggt gcgaaagatg ccgggtttac cggcttccac cgtatcgaac
 701    acgcccttg  ggtggaaaaa gacgtatccg gcgtgaagga accgcggcc
 751    aaactgatga ccgatgtcga agccctgcaa aaagaaatcg acgcattggc
 801    gttccctccg ggcaaagtgg tcggcggcgc gtccgaactg attgaagaag
 851    cggcgggcag taaaatcagc ggcgaagaag accgttacag ccacaccgat
 901    ttgagcgact tccaagctaa tgcggacgga tctaaaaaaa tcgtcgattt
 951    gttccgtccg ttgattgagg ccaaaaacaa agccttgttg gaaaaaaccg
1001    ataccaactt caaacaggtc aacgaaattc tggcgaaata ccgcaccaaa
1051    gacggttttg aaacctacga caagctgagc gaagccgacc gcaaagcatt
1101    acaggctcct attaacgcgc ttgccgaaga ccttgcccaa cttcgcggca
1151    tactcggctt gaaataa
```

This corresponds to the amino acid sequence <SEQ ID 1866; ORF 595.ng>:

```
g595.pep ..
  1    MRKFNLTALS VMLALGLTAC QPPEAEKAAP AASGETQSAN EGGSVGIAVN
 51    DNACEPMNLT VPSGQVVFNI KNNSGRKLEW EILKGVMVVD ERENIAPGLS
101    DKMNRNLLPG EYEMTCGLLT NPRGKLVVAD SGFKDTANEA DLEKLPQPLA
151    DYKAYVQGEV KELAAKTKTF TEAVKAGDIE KAKSLFAATR VHYERIEPIA
201    ELFSELDPVI DACEDDFKDG AKDAGFTGFH RIEHALWVEK DVSGVKETAA
251    KLMTDVEALQ KEIDALAFPP GKVVGGASEL IEEAAGSKIS GEEDRYSHTD
301    LSDFQANADG SKKIVDLFRP LIEAKNKALL EKTDTNFKQV NEILAKYRTK
351    DGFETYDKLS EADRKALQAP INALAEDLAQ LRGILGLK*
```

The following partial DNA sequence was identified in *N. meningitidis* <SEQ ID 1867>:

```
m595.seq
  1    ATGAGAAAAT TCAATTTGAC CGCATTGTCC GTGATGCTTG CCTTAGGTTT
 51    GACCGCGTGC CAGCCGCCGG AGGCGGAGAA AGCTGCGCCG GCAGCGTCCG
101    GTGAGGCGCA AACCGCCAAC GAGGGCGGTT CGGTCAGTAT CGCCGTCAAC
151    GACAATGCCT GCGAACCGAT GGAACTGACC GTGCCGAGCG ACAGGTTGT
201    GTTCAATATT AAAAACAACA GCGGCCGCAA GCTCGAATGG GAAATCCTGA
251    AAGGCGTGAT GGTGGTGGAC GAGCGCGAAA ACATCGCCCC CGGACTTTCC
301    GATAAAATGA CCGTCACCCT GTTGCCGGGC GAATACGAAA TGACTTGCGG
351    TCTTTTGACC AATCCGCGCG GCAAGCTGGT GGTAACCGAC AGCGGCTTTA
401    AAGACACCGC CAACGAAGCG GATTTGGAAA AACTGTCCCA ACCGCTCGCC
451    GACTATAAAG CCTACGTTCA AGGCGAGGTT AAAGAGCTGG TGGCGAAAAC
501    CAAAACTTTT ACCGAAGCCG TCAAAGCAGG CGACATTGAA AAGGCGAAAT
551    CCCTGTTTGC CGACACCCGC GTCCATTACG AACGCATCGA ACCGATTGCC
601    GAGCTTTTCA GCGAACTCGA CCCCGTCATC GATGCGCGTG AAGACGACTT
651    CAAAGACGGC GCGAAAGATG CCGGATTTAC CGGCTTTCAC CGTATCGAAT
```

```
-continued
 701   ACGCCCTTTG GGTGGAAAAA GACGTGTCCG GCGTGAAGGA AATTGCAGCG

751   AAACTGATGA CCGATGTCGA AGCCCTGCAA AAAGAAATCG ACGCATTGGC

801   GTTTCCTCCG GCCAAGGTGG TCGGCGGCGC GTCCGAACTG ATTGAAGAAG

851   TGGCGGGCAG TAAAATCAGC GGCGAAGAAG ACCGGTACAG CCACACCGAT

901   TTGAGCGACT TCCAAGCCAA TGTGGACGGA TCTAAAAAAA TCGTCGATTT

951   GTTCCGTCCG CTGATCGAGG CCAAAAACAA AGCCTTGTTG GAAAAAACCG

1001   ATACCAACTT CAAACAGGTC AACGAAATTC TGGCGAAATA CCGGACTAAA

1051   GACGGTTTTG AAACCTACGA CAAGCTGGGC GAAGCCGACC GCAAAGCGTT

1101   ACAGGCCTCT ATTAACGCGC TTGCCGAAGA CCTTGCCCAA CTTCGCGGCA

1151   TACTCGGCTT GAAATAA
```

This corresponds to the amino acid sequence <SEQ ID 1868; ORF 595>:

```
m595.pep
    1  MRKFNLTALS VMLALGLTAC QPPEAEKAAP AASGEAQTAN EGGSVSIAVN

51  DNACEPMELT VPSGQVVFNI KNNSGRKLEW EILKGVMVVD ERENIAPGLS

101  DKMTVTLLPG EYEMTCGLLT NPRGKLVVTD SGFKDTANEA DLEKLSQPLA

151  DYKAYVQGEV KELVAKTKTF TEAVKAGDIE KAKSLFADTR VHYERIEPIA

201  ELFSELDPVI DAREDDFKDG AKDAGFTGFH RIEYALWVEK DVSGVKEIAA

251  KLMTDVEALQ KEIDALAFPP GKVVGGASEL IEEVAGSKIS GEEDRYSHTD

301  LSDFQANVDG SKKIVDLFRP LIEAKNKALL EKTDTNFKQV NEILAKYRTK

351  DGFETYDKLG EADRKALQAS INALAEDLAQ LRGILGLK*
```

Computer analysis of this amino acid sequence gave the following results:
Homology with a Predicted ORF from *N. gonorrhoeae*
  m595/g595 95.4% identity in 388 aa overlap

```
                 10         20         30         40         50         60
m595.pep  MRKFNLTALSVMLALGLTACQPPEAEKAAPAASGEAQTANEGGSVSIAVNDNACEPMELT
          ||||||||||||||||||||||||||||||||||||:|:||||||:||||||||||:||
g595      MRKFNLTALSVMLALGLTACQPPEAEKAAPAASGETQSANEGGSVGIAVNDNACEPMNLT
                 10         20         30         40         50         60

70         80         90        100        110        120
m595.pep  VPSGQVVFNIKNNSGRKLEWEILKGVMVVDERENIAPGLSDKMTVTLLPGEYEMTCGLLT
          |||||||||||||||||||||||||||||||||||||||||||: :||||||||||||||
g595      VPSGQVVFNIKNNSGRKLEWEILKGVMVVDERENIAPGLSDKMNRNLLPGEYEMTCGLLT
                 70         80         90        100        110        120

130        140        150        160        170        180
m595.pep  NPRGKLVVTDSGFKDTANEADLEKLSQPLADYKAYVQGEVKELVAKTKTFTEAVKAGDIE
          ||||||||:|||||||||||||||| |||||||||||||||||:||||||||||||||||
g595      NPRGKLVVADSGFKDTANEADLEKLPQPLADYKAYVQGEVKELAAKTKTFTEAVKAGDIE
                130        140        150        160        170        180

190        200        210        220        230        240
m595.pep  KAKSLFADTRVHYERIEPIAELFSELDPVIDAREDDFKDGAKDAGFTGFHRIEYALWVEK
          ||||||| |||||||||||||||||||||||| |||||||||||||||||||:||||||
g595      KAKSLFAATRVHYERIEPIAELFSELDPVIDACEDDFKDGAKDAGFTGFHRIEHALWVEK
                190        200        210        220        230        240

250        260        270        280        290        300
m595.pep  DVSGVKEIAAKLMTDVEALQKEIDALAFPPGKVVGGASELIEEVAGSKISGEEDRYSHTD
          ||||||| ||||||||||||||||||||||||||||||||||: ||||||||||||||||
g595      DVSGVKETAAKLMTDVEALQKEIDALAFPPGKVVGGASELIEEAAGSKISGEEDRYSHTD
                250        260        270        280        290        300

310        320        330        340        350        360
m595.pep  LSDFQANVDGSKKIVDLFRPLIEAKNKALLEKTDTNFKQVNEILAKYRTKDGFETYDKLG
          ||||||||:|||||||||||||||||||||||||||||||||||||||||||||||||:
g595      LSDFQANADGSKKIVDLFRPLIEAKNKALLEKTDTNFKQVNEILAKYRTKDGFETYDKLS
                310        320        330        340        350        360
```

-continued

```
                370        380       389
m595.pep    EADRKALQASINALAEDLAQLRGILGLKX
            ||||||||| |||||||||||||||||||
g595        EADRKALQAPINALAEDLAQLRGILGLKX
                370        380
```

The following partial DNA sequence was identified in *N. meningitidis* <SEQ ID 1869>:

```
a595.seq
   1  ATGAGAAAAT TCAATTTGAC CGCATTGTCC GTGATGCTTG CCTTAGGTTT
  51  GACCGCGTGC CAGCCGCCGG AGGCGGAGAA AGCTGCGCCG GCAGCGTCCG
 101  GTGAGGCGCA AACCGCCAAC GAGGGCGGTT CGGTCAGTAT CGCCGTCAAC
 151  GACAATGCCT GCGAACCGAT GGAACTGACC GTGCCGAGCG GACAGGTTGT
 201  GTTCAATATT AAAAACAACA GCGGCCGCAA GCTCGAATGG GAAATCCTGA
 251  AAGGCGTGAT GGTGGTGGAC GAGCGCGAAA ACATCGCCCC CGGACTTTCC
 301  GATAAAATGA CCGTCACCCT GTTGCCGGGC GAATACGAAA TGACTTGCGG
 351  TCTTTTGACC AATCCGCGCG GCAAGCTGGT GGTAACCGAC AGCGGCTTTA
 401  AAGACACCGC CAACGAAGCG GATTTGGAAA AACTGTCCCA ACCGCTCGCC
 451  GACTATAAAG CCTATGTTCA AGGCGAAGTC AAAGAGCTGG TGGCGAAAAC
 501  CAAAACCTTT ACCGAAGCCG TCAAAGCAGG CGACATTGAA AAGGCGAAAT
 551  CCCTGTTTGC CGACACCCGC GTCCATTACG AACGCATCGA ACCGATTGCC
 601  GAGCTTTTCA GCGAACTCGA CCCCGTCATC GATGCGCGTG AAGACGACTT
 651  CAAAGACGGC GCGAAAGATG CCGGATTTAC CGGCTTCCAC CGTATCGAAT
 701  ACGCCCTTTG GGTGGAAAAA GACGTGTCCG GCGTGAAGGA AATTGCAGCG
 751  AAACTGATGA CCGATGTCGA AGCCCTGCAA AAAGAAATCG ACGCATTGGC
 801  GTTTCCTCCG GGCAAGGTGG TCGGCGGCGC GTCCGAACTG ATTGAAGAAG
 851  TGGCGGGCAG TAAAATCAGC GGCGAAGAAG ACCGGTACAG CCACACCGAT
 901  TTGAGCGACT TCCAAGCCAA TGTGGACGGA TCGAAAAAAA TCGTCGATTT
 951  GTTCCGTCCG TTGATCGAGA CCAAAAACAA AGCCTTGTTG GAAAAAACCG
1001  ATACCAACTT CAAACAGGTC AACGAAATTC TGGCGAAATA CCGGACTAAA
1051  GACGGTTTTG AAACCTACGA CAAGCTGGGC GAAGCCGACC GCAAAGCGTT
1101  ACAGGCCTCT ATTAACGCGC TTGCCGAAGA CCTTGCCCAA CTTCGCGGCA
1151  TACTCGGCTT GAAATAA
```

This corresponds to the amino acid sequence <SEQ ID 1870; ORF 595.a>:

```
a595.pep
   1  MRKFNLTALS VMLALGLTAC QPPEAEKAAP AASGEAQTAN EGGSVSIAVN
  51  DNACEPMELT VPSGQVVFNI KNNSGRKLEW EILKGVMVVD ERENIAPGLS
 101  DKMTVTLLPG EYEMTCGLLT NPRGKLVVTD SGFKDTANEA DLEKLSQPLA
 151  DYKAYVQGEV KELVAKTKTF TEAVKAGDIE KAKSLFADTR VHYERIEPIA
 201  ELFSELDPVI DAREDDFKDG AKDAGFTGFH RIEYALWVEK DVSGVKEIAA
 251  KLMTDVEALQ KEIDALAFPP GKVVGGASEL IEEVAGSKIS GEEDRYSHTD
```

```
301  LSDFQANVDG SKKIVDLFRP LIETKNKALL EKTDTNFKQV NEILAKYRTK

351  DGFETYDKLG EADRKALQAS INALAEDLAQ LRGILGLK*
``` m595/a595 99.7% identity in 388 aa overlap

```
                  10         20         30         40         50         60
m595.pep  MRKFNLTALSVMLALGLTACQPPEAEKAAPAASGEAQTANEGGSVSIAVNDNACEPMELT
          ||||||||||||||||||||||||||||||||||||||||||||||||||||||||||||
a595      MRKFNLTALSVMLALGLTACQPPEAEKAAPAASGEAQTANEGGSVSIAVNDNACEPMELT
                  10         20         30         40         50         60
                  70         80         90        100        110        120
m595.pep  VPSGQVVFNIKNNSGRKLEWEILKGVMVVDERENIAPGLSDKMTVTLLPGEYEMTCGLLT
          ||||||||||||||||||||||||||||||||||||||||||||||||||||||||||||
a595      VPSGQVVFNIKNNSGRKLEWEILKGVMVVDERENIAPGLSDKMTVTLLPGEYEMTCGLLT
                  70         80         90        100        110        120
                 130        140        150        160        170        180
m595.pep  NPRGKLVVTDSGFKDTANEADLEKLSQPLADYKAYVQGEVKELVAKTKTFTEAVKAGDIE
          ||||||||||||||||||||||||||||||||||||||||||||||||||||||||||||
a595      NPRGKLVVTDSGFKDTANEADLEKLSQPLADYKAYVQGEVKELVAKTKTFTEAVKAGDIE
                 130        140        150        160        170        180
                 190        200        210        220        230        240
m595.pep  KAKSLFADTRVHYERIEPIAELFSELDPVIDAREDDFKDGAKDAGFTGFHRIEYALWVEK
          ||||||||||||||||||||||||||||||||||||||||||||||||||||||||||||
a595      KAKSLFADTRVHYERIEPIAELFSELDPVIDAREDDFKDGAKDAGFTGFHRIEYALWVEK
                 190        200        210        220        230        240
                 250        260        270        280        290        300
m595.pep  DVSGVKEIAAKLMTDVEALQKEIDALAFPPGKVVGGASELIEEVAGSKISGEEDRYSHTD
          ||||||||||||||||||||||||||||||||||||||||||||||||||||||||||||
a595      DVSGVKEIAAKLMTDVEALQKEIDALAFPPGKVVGGASELIEEVAGSKISGEEDRYSHTD
                 250        260        270        280        290        300
                 310        320        330        340        350        360
m595.pep  LSDFQANVDGSKKIVDLFRPLIEAKNKALLEKTDTNFKQVNEILAKYRTKDGFETYDKLG
          |||||||||||||||||||||||||:||||||||||||||||||||||||||||||||||
a595      LSDFQANVDGSKKIVDLFRPLIETKNKALLEKTDTNFKQVNEILAKYRTKDGFETYDKLG
                 310        320        330        340        350        360
                 370        380       389
m595.pep  EADRKALQASINALAEDLAQLRGILGLKX
          ||||||||||||||||||||||||||||
a595      EADRKALQASINALAEDLAQLRGILGLKX
                 370        380
```

The following partial DNA sequence was identified in *N. gonorrhoeae* <SEQ ID 1871>:

```
g596.seq. (partial).
  1    ..atgctgtct tggacgagcc gaccaaccac ttggatgcgg aatcggtgga
 51      atggctggag caattcctcg tgcgcttccc cggcacagtg gtcgcggtaa
101      cgcacgaccg ctacttcctc gacaacgccg ccgaatggat tttggaactc
151      gaccgcggac acggcattcc gtggaaaggc aattactcgt cttggctgga
201      gcagaaagaa aaacgcttgg aaaacgaggc gaaatccgaa gccgcgcgcg
251      tgaaggcgat gaagcaggaa ttggaatggg tgcgccaaaa tgccaaaggc
301      cgccaagcca agcccaaagc gcgtttggcg cgttttgaag aaatgagcaa
351      ctacgaatac caaaaacgca acgaaactca ggaaatcttt atccctgttg
401      ccgagcgttt gggtaacgaa gtgattgaat tgtgaatgt ttccaaatcg
451      ttcggcgata aagtgctgat tgacggtttg agcttcaaag tgccggcggg
501      cgcgattgtc ggcatcatcg gcccgaacgg cgcgggtaaa tcgacgctgt
551      tcaaaatgat tgcgggcaaa gagcagcccg attcgggcga agtgaaaatc
601      gggcaaaccg tgaaaatgag cttgattgac caaagccgcg aaggtttgca
651      aaacgacaaa accgtgttcg acaacattgc cgaaggtcgc gatatttttgc
```

-continued

```
 701    aggtcggaca gtttgaaatc cccgcccgcc aatatttggg acgcttcaac
 751    tttaaaggca gcgaccaaag caaaatcgca aggcagcttt ccggcggcga
 801    acgcggccgt ctgcacttgg caaaaacctt gttgggcggc ggcaatgtgt
 851    tgctgctgga cgaaccgtcc aacgatctcg acgtggaaac cctgcgcgcg
 901    ttggaagacg cattgttgga atttgccggc agcgtgatgg tgatttcgca
 951    cgaccgctgg tttctcgacc gcatagccac gcatatcttg gcgtgtgaag
1001    gcgactccaa atgggtgttc ttcgacggca actatcaaga atacgaagcc
1051    gacaagaaac gccgactcgg caaagaaggc gcgaaaccga aacgcatcaa
1101    atacaaaccg gtaacgcgtt aa
```

This corresponds to the amino acid sequence <SEQ ID 1872; ORF 596.ng>:

```
g596.pep (partial).
   1   ..MLLLDEPTNH LDAESVEWLE QFLVRFPGTV VAVTHDRYFL DNAAEWILEL
  51   DRGHGIPWKG NYSSWLEQKE KRLENEAKSE AARVKAMKQE LEWVRQNAKG
 101   RQAKPKARLA RFEEMSNYEY QKRNETQEIF IPVAERLGNE VIEFVNVSKS
 151   FGDKVLIDGL SFKVPAGAIV GIIGPNGAGK STLFKMIAGK EQPDSGEVKI
 201   GQTVKMSLID QSREGLQNDK TVFDNIAEGR DILQVGQFEI PARQYLGRFN
 251   FKGSDQSKIA RQLSGGERGR LHLAKTLLGG GNVLLLDEPS NDLDVETLRA
 301   LEDALLEFAG SVMVISHDRW FLDRIATHIL ACEGDSKWVF FDGNYQEYEA
 351   DKKRRLGKEG AKPKRIKYKP VTR*
```

The following partial DNA sequence was identified in *N. meningitidis* <SEQ ID 1873>:

```
m596.seq..
   1    ATGTCCCAAC AATACGTCTA TTCTATGCTG CGCGTGAGCA AGGTTGTGCC
  51    GCCGCAGAAA ACCATCATTA AAGATATTTC CCTTTCTTTC TTCCCCGGCG
 101    CGAAAATCGG CCTGCTCGGT TGAACGGCG CGGGCAAGTC CACCGTGCTG
 151    CGGATTATGG CGGGCGTGGA TAAGGAATTT GAGGGCGAAG CCGTGCCGAT
 201    GGGCGGCATC AAAATCGGCT ACCTGCCGCA AGAGCCTGAG CTTGATCCGG
 251    AAAAAACCGT GCGCGAGGAA GTGGAAAGCG GTTTGGGCGA AGTGGCTGCC
 301    GCGCAGAAAC GTTTGGAAGA AGTGTATGCC GAGTACGCCA ATCCTGATGC
 351    GGATTTTGAC GCGTTGGCAG AAGAGCAGGG CCGCTTGGAA GCGATTATTG
 401    CGGCAGGTTC GTCCACGGGC GGCGGTGCGG AACACGAATT GGAAATCGCC
 451    GCCGACGCGC TGCGCCTGCC GGAATGGGAT GCCAAAATCG ATAATTTGTC
 501    CGGCGGTGAA AAACGCCGCG TTGCCTTGTG CAAACTCTTG TTGAGCAAGC
 551    CCGATATGCT TTTGCTGGAC GAGCCGACCA ACCACTTGGA TGCGGAATCG
 601    GTCGAGTGGC TGGAGCAATT TCTCGTGCGC TTCCCCGGCA CAGTCGTTGC
 651    GGTAACGCAC GACCGCTACT TCCTCGACAA CGCCGCCGAA TGGATTTTGG
 701    AACTCGACCG CGGCCATGGT ATTCCGTGGA AAGGCAATTA CTCGTCTTGG
 751    CTGGAGCAGA AAGAAAAACG CTTGGAAAAC GAGGCAAAAT CCGAAGCCGC
 801    GCGCGTGAAG GCGATGAAGC AGGAATTGGA ATGGGTGCGC CAAAATGCCA
```

-continued

```
 851    AAGGCCGCCA AGCCAAGTCC AAAGCGCGTT TGGCTCGTTT TGAAGAAATG
 901    AGCAACTACG AATACCAAAA ACGCAATGAA ACGCAGGAAA TCTTTATTCC
 951    CGTTGCCGAG CGTTTGGGTA ACGAAGTGAT TGAATTTGTA AATGTTTCCA
1001    AATCGTTCGG CGATAAAGTG CTGATTGACG ATTTGAGCTT CAAAGTGCCT
1051    GCGGGCGCGA TTGTCGGCAT CATCGGCCCG AACGGCGCGG GTAAATCTAC
1101    GCTGTTCAAA ATGATTTCGG GCAAAGAGCA GCCTGATTCC GGCGAGGTGA
1151    AAATCGGACA AACCGTGAAA ATGAGCTTGA TTGACCAAAG CCGCGAAGGT
1201    TTGCAAAACG ACAAAACCGT GTTCGACAAC ATTGCCGAAG CCGCGACAT
1251    TTTGCAGGTT GGTCAGTTTG AAATTCCCGC CCGCCAATAT TTGGGGCGTT
1301    TCAACTTCAA AGGCAGCGAC CAAAGCAAAA TTGCAGGTCA ATTGTCTGGC
1351    GGCGAACGCG GTCGTCTGCA CTTGGCAAAA ACCTTGTTGA GCGGCGGCAA
1401    TGTATTGCTG CTGGATGAAC CGTCTAACGA CCTTGACGTG GAAACCCTGC
1451    GCGCGTTGGA AGACGCATTG TTGGAATTTG CCGGCAGCGT GATGGTGATT
1501    TCGCACGACC GTTGGTTCCT CGACCGCATC GCCACGCATA TCTTGGCGTG
1551    TGAAGGCGAC TCTAAATGGG TGTTCTTCGA CGGCAACTAT CAGGAATACG
1601    AAGCCGACAA GAAACGCCGT TTGGGCGAAG AAGGCGCGAA ACCGAAACGC
1651    ATCAAATACA AACCGGTAAC GCGTTAA
```

This corresponds to the amino acid sequence <SEQ ID 1874; ORF 596>:

```
m596.pep..
  1    MSQQYVYSML RVSKVVPPQK TIIKDISLSF FPGAKIGLLG LNGAGKSTVL

51    RIMAGVDKEF EGEAVPMGGI KIGYLPQEPE LDPEKTVREE VESGLGEVAA

101    AQKRLEEVYA EYANPDADFD ALAEEQGRLE AIIAAGSSTG GGAEHELEIA

151    ADALRLPEWD AKIDNLSGGE KRRVALCKLL LSKPDMLLLD EPTNHLDAES

201    VEWLEQFLVR FPGTVVAVTH DRYFLDNAAE WILELDRGHG IPWKGNYSSW

251    LEQKEKRLEN EAKSEAARVK AMKQELEWVR QNAKGRQAKS KARLARFEEM

301    SNYEYQKRNE TQEIFIPVAE RLGNEVIEFV NVSKSFGDKV LIDDLSFKVP

351    AGAIVGIIGP NGAGKSTLFK MISGKEQPDS GEVKIGQTVK MSLIDQSREG

401    LQNDKTVFDN IAEGRDILQV GQFEIPARQY LGRFNFKGSD QSKIAGQLSG

451    GERGRLHLAK TLLSGGNVLL LDEPSNDLDV ETLRALEDAL LEFAGSVMVI

501    SHDRWFLDRI ATHILACEGD SKWVFFDGNY QEYEADKKRR LGEEGAKPKR

551    IKYKPVTR*
```

Computer analysis of this amino acid sequence gave the following results:
Homology with a Predicted ORF from *N. gonorrhoeae*
m596 g596 98.4% identity in 373 aa overlap

```
               160        170        180        190        200        210
m596.pep   LPEWDAKIDNLSGGEKRRVALCKLLLSKPDMLLLDEPTNHLDAESVEWLEQFLVRFPGTV
                                  |||||||||||||||||||||||||||||||||||
g596                              MLLLDEPTNHLDAESVEWLEQFLVRFPGTV
                                          10         20         30
```

-continued

```
             220        230        240        250        260        270
m596.pep  VAVTHDRYFLDNAAEWILELDRGHGIPWKGNYSSWLEQKEKRLENEAKSEAARVKAMKQE
          ||||||||||||||||||||||||||||||||||||||||||||||||||||||||||||
g596      VAVTHDRYFLDNAAEWILELDRGHGIPWKGNYSSWLEQKEKRLENEAKSEAARVKAMKQE
                  40         50         60         70         80         90

280        290        300        310        320        330
m596.pep  LEWVRQNAKGRQAKSKARLARFEEMSNYEYQKRNETQEIFIPVAERLGNEVIEFVNVSKS
          ||||||||||||| ||||||||||||||||||||||||||||||||||||||||||||||
g596      LEWVRQNAKGRQAKPKARLARFEEMSNYEYQKRNETQEIFIPVAERLGNEVIEFVNVSKS
                 100        110        120        130        140        150

340        350        360        370        380        390
m596.pep  FGDKVLIDDLSFKVPAGAIVGIIGPNGAGKSTLFKMISGKEQPDSGEVKIGQTVKMSLID
          |||||||| |||||||||||||||||||||||||||:|||||||||||||||||||||||
g596      FGDKVLIDGLSFKVPAGAIVGIIGPNGAGKSTLFKMIAGKEQPDSGEVKIGQTVKMSLID
                 160        170        180        190        200        210

400        410        420        430        440        450
m596.pep  QSREGLQNDKTVFDNIAEGRDILQVGQFEIPARQYLGRFNFKGSDQSKIAGQLSGGERGR
          ||||||||||||||||||||||||||||||||||||||||||||||||||| ||||||||
g596      QSREGLQNDKTVFDNIAEGRDILQVGQFEIPARQYLGRFNFKGSDQSKIARQLSGGERGR
                 220        230        240        250        260        270

460        470        480        490        500        510
m596.pep  LHLAKTLLSGGNVLLLDEPSNDLDVETLRALEDALLEFAGSVMVISHDRWFLDRIATHIL
          ||||||||:|||||||||||||||||||||||||||||||||||||||||||||||||||
g596      LHLAKTLLGGGNVLLLDEPSNDLDVETLRALEDALLEFAGSVMVISHDRWFLDRIATHIL
                 280        290        300        310        320        330

520        530        540        550       559
m596.pep  ACEGDSKWVFFDGNYQEYEADKKRRLGEEGAKPKRIKYKPVTRX
          ||||||||||||||||||||||||||||:|||||||||||||||
g596      ACEGDSKWVFFDGNYQEYEADKKRRLGKEGAKPKRIKYKPVTRX
                 340        350        360        370
```

The following partial DNA sequence was identified in *N. meningitidis* <SEQ ID 1875>:

```
a596.seq
     1  ATGTCCCAAC AATACGTCTA TTCTATGCTG CGCGTGAGCA AGGTTGTGCC
    51  GCCGCAGAAA ACCATCATTA AAGATATTTC CCTTTCTTTC TTCCCCGGCG
   101  CGAAAATCGG TTTGCTCGGT TTGAACGGCG CGGGCAAGTC CACCGTGCTG
   151  CGGATTATGG CGGGCGTGGA TAAAGAATTT GAGGGCGAAG CCGTGCCGAT
   201  GGGCGGTATT AAAATCGGCT ACCTGCCGCA AGAGCCTGAG CTTGATCCGG
   251  AAAAAACCGT GCGTGAGGAA GTGGAAAGCG GTTTGGGCGA AGTGGCTGCC
   301  GCGCAGAAAC GTTTGGAGGA AGTGTATGCC GAGTACGCCA ATCCCGATGC
   351  GGATTTTGAC GCGTTGGCGG AAGAGCAGGG GCGTTTGGAA GCGATTATTG
   401  CGGCGGGTTC GTCCACGGGC GGCGGTGCGG AACACGAATT GGAAATCGCT
   451  GCCGACGCGC TGCGCCTGCC GGAATGGGAT GCCAAAATCG ATAATTTGTC
   501  CGGCGGTGAA AAACGCCGCG TCGCTTTGTG CAAACTCTTG TTGAGCAAGC
   551  CCGATATGCT TTTGCTGGAC GAGCCGACCA ACCACTTGGA TGCGGAATCG
   601  GTCGAGTGGC TGGAGCAATT TCTCGTGCGC TTCCCCGGTA CAGTCGTTGC
   651  CGTAACACAC GACCGCTACT TCCTCGACAA CGCCGCCGAA TGGATTTTGG
   701  AACTCGACCG CGGGCACGGT ATTCCGTGGA AAGGAAATTA CTCGTCTTGG
   751  TTGGAGCAGA AAGAAAAACG TTTGGAAAAC GAGGCGAAAT CCGAAGCCGC
   801  GCGCGTGAAA GCGATGAAGC AGGAATTGGA ATGGGTGCGC CAAAATGCCA
   851  AAGGCCGTCA AGCCAAGTCC AAAGCGCGTT TGGCGCGTTT TGAAGAAATG
   901  AGCAACTATG AATACCAAAA ACGCAATGAA ACGCAGGAAA TCTTCATTCC
   951  CGTCGCCGAG CGTTTGGGTA ACGAAGTGAT TGAATTTGTG AATGTTTCCA
  1001  AATCGTTCGG CGACAAAGTG CTGATTGACG ATTTGAGCTT CAAAGTGCCT
```

```
1051  GCGGGCGCGA TTGTCGGCAT CATCGGTCCG AACGGCGCGG GTAAATCGAC

1101  ACTGTTTAAA ATGATTGCGG GCAAAGAGCA GCCCGATTCC GGTGAAGTGA

1151  AAATCGGGCA AACCGTGAAA ATGAGCTTGA TTGACCAAAG CCGCGAAGGT

1201  TTGCAAAACG ACAAAACCGT GTTCGACAAC ATTGCCGAAG GTCGCGATAT

1251  TTTACAGGTC GGGCAGTTTG AAATCCCCGC CCGCCAATAT TTGGGACGCT

1301  TCAATTTCAA AGGCAGCGAC CAAAGCAAAA TCACGGGGCA GCTTTCCGGC

1351  GGCGAACGCG GACGTTTGCA CTTGGCAAAA ACCTTGTTGG GCGGTGGCAA

1401  TGTGTTGCTG CTGGACGAAC CGTCCAACGA CCTCGACGTG GAAACCCTGC

1451  GCGCGTTGGA AGACGCATTG CTGGAATTTG CCGGCAGCGT GATGGTGATT

1501  TCGCACGACC GCTGGTTCCT CGACCGTATT GCTACGCATA TCTTGGCTTG

1551  CGAAGGCGAC TCCAAATGGG TGTTCTTTGA CGGCAACTAT CAGGAATACG

1601  AAGCCGACAA GAAACGCCGA CTCGGCGAAG AAGGCACGAA ACCGAAACGC

1651  ATCAAATACA AACCGGTAAC GCGTTAA
```

This corresponds to the amino acid sequence <SEQ ID 1876; ORF 596.a>:

```
a596.pep
   1  MSQQYVYSML RVSKVVPPQK TIIKDISLSF FPGAKIGLLG LNGAGKSTVL

51  RIMAGVDKEF EGEAVPMGGI KIGYLPQEPE LDPEKTVREE VESGLGEVAA

101  AQKRLEEVYA EYANPDADFD ALAEEQGRLE AIIAAGSSTG GGAEHELEIA

151  ADALRLPEWD AKIDNLSGGE KRRVALCKLL LSKPDMLLLD EPTNHLDAES

201  VEWLEQFLVR FPGTVVAVTH DRYFLDNAAE WILELDRGHG IPWKGNYSSW

251  LEQKEKRLEN EAKSEAARVK AMKQELEWVR QNAKGRQAKS KARLARFEEM

301  SNYEYQKRNE TQEIFIPVAE RLGNEVIEFV NVSKSFGDKV LIDDLSFKVP

351  AGAIVGIIGP NGAGKSTLFK MIAGKEQPDS GEVKIGQTVK MSLIDQSREG

401  LQNDKTVFDN IAEGRDILQV GQFEIPARQY LGRFNFKGSD QSKITGQLSG

451  GERGRLHLAK TLLGGGNVLL LDEPSNDLDV ETLRALEDAL LEFAGSVMVI

501  SHDRWFLDRI ATHILACEGD SKWVFFDGNY QEYEADKKRR LGEEGTKPKR

551  IKYKPVTR*
``` m596/a596 99.3% identity in 558 aa overlap

```
                10         20         30         40         50         60
m596.pep  MSQQYVYSMLRVSKVVPPQKTIIKDISLSFFPGAKIGLLGLNGAGKSTVLRIMAGVDKEF
          ||||||||||||||||||||||||||||||||||||||||||||||||||||||||||||
a596      MSQQYVYSMLRVSKVVPPQKTIIKDISLSFFPGAKIGLLGLNGAGKSTVLRIMAGVDKEF
                10         20         30         40         50         60

70         80         90        100        110        120
m596.pep  EGEAVPMGGIKIGYLPQEPELDPEKTVREEVESGLGEVAAAQKRLEEVYAEYANPDADFD
          ||||||||||||||||||||||||||||||||||||||||||||||||||||||||||||
a596      EGEAVPMGGIKIGYLPQEPELDPEKTVREEVESGLGEVAAAQKRLEEVYAEYANPDADFD
                70         80         90        100        110        120

130        140        150        160        170        180
m596.pep  ALAEEQGRLEAIIAAGSSTGGGAEHELEIAADALRLPEWDAKIDNLSGGEKRRCALCKLL
          ||||||||||||||||||||||||||||||||||||||||||||||||||||||||||||
a596      ALAEEQGRLEAIIAAGSSTGGGAEHELEIAADALRLPEWDAKIDNLSGGEKRRCALCKLL
               130        140        150        160        170        180

190        200        210        220        230        240
m596.pep  LSKPDMLLLDEPTNHLDAESVEWLEQFLVRFPGTVVAVTHDRYFLDNAAEWILELDRGHG
          ||||||||||||||||||||||||||||||||||||||||||||||||||||||||||||
a596      LSKPDMLLLDEPTNHLDAESVEWLEQFLVRFPGTVVAVTHDRYFLDNAAEWILELDRGHG
               190        200        210        220        230        240
```

```
               250        260        270        280        290        300
m596.pep  IPWKGNYSSWLEQKEKRLENEAKSEAARVKAMKQELEWVRQNAKGRQAKSKARLARFEEM
          ||||||||||||||||||||||||||||||||||||||||||||||||||||||||||||
a596      IPWKGNYSSWLEQKEKRLENEAKSEAARVKAMKQELEWVRQNAKGRQAKSKARLARFEEM
               250        260        270        280        290        300

310        320        330        340        350        360
m596.pep  SNYEYQKRNETQEIFIPVAERLGNEVIEFVNVSKSFGDKVLIDDLSFKVPAGAIVGIIGP
          ||||||||||||||||||||||||||||||||||||||||||||||||||||||||||||
a596      SNYEYQKRNETQEIFIPVAERLGNEVIEFVNVSKSFGDKVLIDDLSFKVPAGAIVGIIGP
               310        320        330        340        350        360

370        380        390        400        410        420
m596.pep  NGAGKSTLFKMISGKEQPDSGEVKIGQTVKMSLIDQSREGLQNDKTVFDNIAEGRDILQV
          |||||||||||:||||||||||||||||||||||||||||||||||||||||||||||||
a596      NGAGKSTLFKMIAGKEQPDSGEVKIGQTVKMSLIDQSREGLQNDKTVFDNIAEGRDILQV
               370        380        390        400        410        420

430        440        450        460        470        480
m596.pep  GQFEIPARQYLGRFNFKGSDQSKIAGQLSGGERGRLHLAKTLLSGGNVLLLDEPSNDLDV
          |||||||||||||||||||||||||:|||||||||||||||||||:||||||||||||||
a596      GQFEIPARQYLGRFNFKGSDQSKITGQLSGGERGRLHLAKTLLGGGNVLLLDEPSNDLDV
               430        440        450        460        470        480

490        500        510        520        530        540
m596.pep  ETLRALEDALLEFAGSVMVISHDRWFLDRIATHILACEGDSKWVFFDGNYQEYEADKKRR
          ||||||||||||||||||||||||||||||||||||||||||||||||||||||||||||
a596      ETLRALEDALLEFAGSVMVISHDRWFLDRIATHILACEGDSKWVFFDGNYQEYEADKKRR
               490        500        510        520        530        540

550        559
m596.pep  LGEEGAKPKRIKYKPVTRX
          |||||:|||||||||||||
a596      LGEEGTKPKRIKYKPVTRX
               550
```

The following partial DNA sequence was identified in *N. gonorrhoeae* <SEQ ID 1877>:

```
g597.seq
   1  ATGCTGCTTC ATGTCAGCAA TTCCCTCAAA CAGCTTCAGG AAGAGCGTAT

51  CCGCCAAGAA CGTATCCGCC AAGAGCGTAT CCGTCAGGCG CGCGGCAACC

101  TTGCTTCCGT CAACCGCAAA CAGCGCGAGG CTTGGGACAA ATTCCAAAAA

151  CTCAATACCG AGCTGAACCG TTTGAAAACG GAAGTCGCCG CTACGAAAGC

201  GCAGATTTCC CGTTTCGTAT CGGGGAACTA TAAAAACAGC CGGCCGAATG

251  CGGTTGCCCT GTTCCTGAAA AACGCCGAAC CGGGTCAGAA AAACCGCTTT

301  TTGCGTTATA CGCGTTATGT AAACGCCTCC AATCGGGAAG TTGTCAAGGA

351  TTTGGAAAAA CAGCAGAAGG CTTTGGCGGT ACAAGAGCAG AAAATCAACA

401  ATGAGCTTGC CCGTTTGAAG AAAATTCAGG CAAACGTGCA ATCCCTGCTG

451  AAAAAACAGG GTGTAACCGA TGCGGCGGAA CAGACGGAAA GCCGCAGACA

501  GAATGCCAAA ATCTCCAAAG ATGCCCGAAA ACTGCTGGAA CAGAAAGGGA

551  ACGAGCAGCA GCTGAACAAG CTCTTGAGCA ATTTGgagaa aaAAAaagcc 601  gaacaccgCA TTcaggAtgc ggAagcaaAA agaAAATTGG CTGAagcCaa 651  actGgcggca gccgAAAAAG CCAGAAAAGA AGCGGCGCAG CAGAAGGCTG

701  AAGCGCGACG TGCGGAAATG TCCAACCTGA CCGCCGAAGA CAGGAACATC

751  CAAGCGCCTT CGGTTATGGG TATCGGCAGT GCCGACGgTT TCAGCCGCAT

801  GCAGGGACGT TTGAAAAAAC CGGTTGACGG TGTGCCGACC GGGCTTTTCG

851  GGCAGAACCG GAGCGGcggC GATGTTTGGA AAGGCGTGTT CTATTCCACT

901  GCGCCTGCAA CGGTTGAAAG CATTGCGCcg gGAACggtaa GCTATGCGGA 951  cgaGTTGGAC GGCTACGGCA AAGTGGTCGT GATCGATCAC GGCGAGAACT

1001  ACATCAGCAT CTATGCCGGT TTGAGCGAAA TTTCCGCCGG CAAGGGTTAT
```

-continued

```
1051  ACGGTCGCGG CAGGAAGCAA AATCGGCACG AGCGGGTCGC TGCCGGACGG

1101  GGAAGAGGGG CTTTACCTGC AAATACGTTA TCGAGGTCAG GTGTTGAACC

1151  CTTCGGGCTG GATACGTTGA
```

This corresponds to the amino acid sequence <SEQ ID 1878; ORF 597>:

```
g597.pep
    1   MLLHVSNSLK QLQEERIRQE RIRQERIRQA RGNLASVNRK QREAWDKFQK

51   LNTELNRLKT EVAATKAQIS RFVSGNYKNS RPNAVALFLK NAEPGQKNRF

101   LRYTRYVNAS NREVVKDLEK QQKALAVQEQ KINNELARLK KIQANVQSLL

151   KKQGVTDAAE QTESRRQNAK ISKDARKLLE QKGNEQQLNK LLSNLEKKKA

201   EHRIQDAEAK RKLAEAKLAA AEKARKEAAQ QKAEARRAEM SNLTAEDRNI

251   QAPSVMGIGS ADGFSRMQGR LKKPVDGVPT GLFGQNRSGG DVWKGVFYST

301   APATVESIAP GTVSYADELD GYGKVVVIDH GENYISIYAG LSEISAGKGY

351   TVAAGSKIGT SGSLPDGEEG LYLQIRYRGQ VLNPSGWIR*
```

The following partial DNA sequence was identified in *N. meningitidis* <SEQ ID 1879>:

```
m597.seq
    1   ATGCTGCTTC ATGTCAGCAA TTCCCTCAAA CAGCTTCAGG AAGAGCGTAT

51   CCGCCAAGAG CGTATCCGTC AGGCGCGCGG CAACCTTGCT TCCGTCAACC

101   GCAAACAGCG CGAGGCTTGG GACAAGTTCC AAAAACTCAA TACCGAGCTG

151   AACCGTTTGA AAACGGAAGT CGCCGCTACG AAAGCGCAGA TTTCCCGTTT

201   CGTATCGGGG AACTATAAAA ACAGCCAGCC GAATGCGGTT GCCCTGTTCC

251   TGAAAAACGC CGAACCGGGT CAGAAAAACC GCTTTTTGCG TTATACGCGT

301   TATGTAAACG CCTCCAATCG GGAAGTTGTC AAGGATTTGG AAAAACAGCA

351   GAAGGCTTTG GCGGTACAAG AGCAGAAAAT CAACAATGAG CTTGCCCGTT

401   TGAAGAAAAT TCAGGCAAAC GTGCAATCTC TGCTGAAAAA ACAGGGTGTA

451   ACCGATGCGG CGGAACAGAC GGAAAGCCGC AGACAGAATG CCAAAATCGC

501   CAAAGATGCC CGAAAACTGC TGGAACAGAA AGGGAACGAG CAGCAGCTGA

551   ACAAGCTCTT GAGCAATTTG GAGAAGAAAA AGGCCGAACA CCGCATTCAG

601   GATGCGGAAG CAAAAGAAA ATTGGCTGAA GCCAGACTGG CGGCAGCCGA

651   AAAAGCCAGA AAAGAAGCGG CGCAGCAGAA GGCTGAAGCA CGACGTGCGG

701   AAATGTCCAA CCTGACCGCC GAAGACAGGA ACATCCAAGC GCCTTCGGTT

751   ATGGGTATCG GCAGTGCCGA CGGTTTCAGC CGCATGCAAG GACGTTTGAA

801   AAAACCGGTT GACGGTGTGC CGACCGGACT TTTCGGGCAG AACCGGAGCG

851   GCGGCGATAT TTGGAAAGGC GTGTTCTATT CCACTGCACC GGCAACGGTT

901   GAAAGCATTG CGCCGGGAAC GGTAAGCTAT GCGGACGAGT TGGACGGCTA

951   CGGCAAAGTG GTCGTGGTCG ATCACGGCGA GAACTACATC AGCATCTATG

1001   CCGGTTTGAG CGAAATTTCC GTCGGCAAGG GTTATATGGT CGCGGCAGGA

1051   AGCAAAATCG GCTCGAGCGG GTCGCTGCCG GACGGGAAG AGGGGCTTTA
```

-continued

```
1101  CCTGCAAATA CGTTATCAAG GTCAGGTATT GAACCCTTCG AGCTGGATAC

1151  GTTGA
```

This corresponds to the amino acid sequence <SEQ ID 1880;
ORF 597>:

```
m597.pep
    1  MLLHVSNSLK QLQEERIRQE RIRQARGNLA SVNRKQREAW DKFQKLNTEL

51  NRLKTEVAAT KAQISRFVSG NYKNSQPNAV ALFLKNAEPG QKNRFLRYTR

101  YVNASNREVV KDLEKQQKAL AVQEQKINNE LARLKKIQAN VQSLLKKQGV

151  TDAAEQTESR RQNAKIAKDA RKLLEQKGNE QQLNKLLSNL EKKKAEHRIQ

201  DAEAKRKLAE ARLAAAEKAR KEAAQQKAEA RRAEMSNLTA EDRNIQAPSV

251  MGIGSADGFS RMQGRLKKPV DGVPTGLFGQ NRSGGDIWKG VFYSTAPATV

301  ESIAPGTVSY ADELDGYGKV VVVDHGENYI SIYAGLSEIS VGKGYMVAAG

351  SKIGSSGSLP DGEEGLYLQI RYQGQVLNPS SWIR*
```

Computer analysis of this amino acid sequence gave the following results:
Homology with a Predicted ORF from *N. gonorrhoeae*
ORF 597 shows 96.1% identity over a 389 aa overlap with a predicted ORF (ORF 597) from *N. gonorrhoeae*:
m597/g597 96.1% identity in 389 aa overlap

```
                   10         20         30         40         50         60
    g597.pep  MLLHVSNSLKQLQEERIRQERIRQERIRQARGNLASVNRKQREAWDKFQKLNTELNRLKT
              |||||||||||||||||||||||              ||||||||||||||||||||||||
    m597      MLLHVSNSLKQLQEERIRQERIRQ-----ARGNLASVNRKQREAWDKFQKLNTELNRLKT
                   10         20              30         40         50

70         80         90        100        110        120
    g597.pep  EVAATKAQISRFVSGNYKNSRPNAVALFLKNAEPGQKNRFLRYTRYVNASNREVVKDLEK
              ||||||||||||||||||||:|||||||||||||||||||||||||||||||||||||||
    m597      EVAATKAQISRFVSGNYKNSQPNAVALFLKNAEPGQKNRFLRYTRYVNASNREVVKDLEK
                   60         70         80         90        100        110

130        140        150        160        170        180
    g597.pep  QQKALAVQEQKINNELARLKKIQANVQSLLKKQGVTDAAEQTESRRQNAKISKDARKLLE
              |||||||||||||||||||||||||||||||||||||||||||||||||:||||||||||
    m597      QQKALAVQEQKINNELARLKKIQANVQSLLKKQGVTDAAEQTESRRQNAKIIKDARKLLE
                  120        130        140        150        160        170

190        200        210        220        230        240
    g597.pep  QKGNEQQLNKLLSNLEKKKAEHRIQDAEAKRKLAEAKLAAAEKARKEAAQQKAEARRAEM
              |||||||||||||||||||||||||||||||||||:||||||||||||||||||||||||
    m597      QKGNEQQLNKLLSNLEKKKAEHRIQDAEAKRKLAEARLAAAEKARKEAAQQKAEARRAEM
                  180        190        200        210        220        230

250        260        270        280        290        300
    g597.pep  SNLTAEDRNIQAPSVMGIGSADGFSRMQGRLKKPVDGVPTGLFGQNRSGGDVWKGVFYST
              |||||||||||||||||||||||||||||||||||||||||||||||||:||||||||||
    m597      SNLTAEDRNIQAPSVMGIGSADGFSRMQGRLKKPVDGVPTGLFGQNRSGGDIWKGVFYST
                  240        250        260        270        280        290

310        320        330        340        350        360
    g597.pep  APATVESIAPGTVSYADELDGYGKVVVIDHGENYISIYAGLSEISAGKGYTVAAGSKIGT
              |||||||||||||||||||||||||||:|||||||||||||||||:||| |||||||:
    m597      APATVESIAPGTVSYADELDGYGKVVVVDHGENYISIYAGLSEISVGKGYMVAAGSKIGS
                  300        310        320        330        340        350

370        380        390
    g597.pep  SGSLPDGEEGLYLQIRYRGQVLNPSGWIRX
              ||||||||||||||||||:|||||||:||||
    m597      SGSLPDGEEGLYLQIRYQGQVLNPSSWIRX
                  360        370        380
```

The following partial DNA sequence was identified in *N. meningitidis* <SEQ ID 1881>:

```
a597.seq
   1 ATGCTGCTTC ATGTCAGCAA TTCCCTCAAG CAGCTTCAGG AAGAGCGTAT

51 CCGCCAAGAA CGTATCCGCC AAGAGCGTAT CCGTCAGGCG CGCGGCAACC

101 TTGCTTCCGT CAACCGCAAA CAGCGCGAGG CTTGGGACAA GTTCCAAAAA

151 CTCAATACCG AGCTGAACCG TTTGAAAACG GAAGTCGCCG CTACGAAAGC

201 GCAGATTTCC CGTTTCGTAT CGGGGAACTA TAAAAACAGC CAGCCGAATG

251 CGGTTGCCCT GTTCCTGAAA AACGCCGAAC CGGGTCAGAA AAACCGCTTT

301 TTGCGTTATA CGCGTTATGT AAACGCCTCC AATCGGGAAG TTGTCAAGGA

351 TTTGGAAAAA CAGCAGAAGG CTTTGGCGGT ACAAGAGCAG AAAATCAACA

401 ATGAGCTTGC CCGTTTGAAG AAAATTCAGG CAAACGTGCA ATCCCTGCTG

451 AAAAAACAGG GTGTAACCGA TGCGGCGGAA CAGACGGAAA GCCGCAGACA

501 GAATGCCAAA ATCGCCAAAG ATGCCCGAAA ACTGCTGGAA CAGAAAGGGA

551 ACGAGCAGCA GCTGAACAAG CTCTTGAGCA ATTTGGAGAA GAAAAAGGCC

601 GAACACCGCA TTCAGGATGC GGAAGCAAAA AGAAAATTGG CTGAAGCCAG

651 ACTGGCGGCA GCCGAAAAAG CCAGAAAAGA AGCGGCGCAG CAGAAGGCTG

701 AAGCACGACG TGCGGAAATG TCCAACCTGA CCGCCGAAGA CAGGAACATC

751 CAAGCGCCTT CGGTTATGGG TATCGGCAGT GCCGACGGTT TCAGCCGCAT

801 GCAAGGACGT TTGAAAAAAC CGGTTGACGG TGTGCCGACC GGACTTTTCG

851 GGCAGAACCG GAGCGGCGGC GATGTTTGGA AAGGCGTGTT CTATTCCACT

901 GCACCGGCAA CGGTTGAAAG CATTGCGCCG GAACGGTAA GCTATGCGGA

951 CGAGTTGGAC GGCTACGGCA AGTGGTCGT GGTCGATCAC GGCGAGAACT

1001 ACATCAGCAT CTATGCCGGT TTGAGCGAAA TTTCCGTCGG CAAGGGTTAT

1051 ATGGTCGCGG CAGGAAGCAA AATCGGCTCG AGCGGGTCGC TGCCGGACGG

1101 GGAAGAGGGG CTTTACCTGC AAATACGTTA TCAAGGTCAG GTATTGAACC

1151 CTTCGAGCTG GATACGTTGA
```

This corresponds to the amino acid sequence <SEQ ID 1882; ORF 597.a>:

```
a597.pep
   1 MLLHVSNSLK QLQEERIRQE RIRQERIRQA RGNLASVNRK QREAWDKFQK

51 LNTELNRLKT EVAATKAQIS RFVSGNYKNS QPNAVALFLK NAEPGQKNRF

101 LRYTRYVNAS NREVVKDLEK QQKALAVQEQ KINNELARLK KIQANVQSLL

151 KKQGVTDAAE QTESRRQNAK IAKDARKLLE QKGNEQQLNK LLSNLEKKKA

201 EHRIQDAEAK RKLAEARLAA AEKARKEAAQ QKAEARRAEM SNLTAEDRNI

251 QAPSVMGIGS ADGFSRMQGR LKKPVDGVPT GLFGQNRSGG DVWKGVFYST

301 APATVESIAP GTVSYADELD GYGKVVVVDH GENYISIYAG LSEISVGKGY

351 MVAAGSKIGS SGSLPDGEEG LYLQIRYQGQ VLNPSSWIR*
```

Computer analysis of this amino acid sequence gave the following results:
Homology with a Predicted ORF from *N. meningitidis*
ORF 597 shows 98.5% identity over a 389 aa overlap with a predicted ORF (ORF 597) from *N. meningitidis*
m597/a597 98.5% identity in 389 aa overlap

```
                  10        20        30        40        50        60
   a597.pep  MLLHVSNSLKQLQEERIRQERIRQERIRQARGNLASVNRKQREAWDKFQKLNTELNRLKT
             ||||||||||||||||||||||||||         |||||||||||||||||||||||||
   m597      MLLHVSNSLKQLQEERIRQERIRQ-----ARGNLASVNRKQREAWDKFQKLNTELNRLKT
                  10        20             30        40        50

70        80        90       100       110       120
   a597.pep  EVAATKAQISRFVSGNYKNSQPNAVALFLKNAEPGQKNRFLRYTRYVNASNREVVKDLEK
             ||||||||||||||||||||||||||||||||||||||||||||||||||||||||||||
   m597      EVAATKAQISRFVSGNYKNSQPNAVALFLKNAEPGQKNRFLRYTRYVNASNREVVKDLEK
                  60        70        80        90       100       110

130       140       150       160       170       180
   a597.pep  QQKALAVQEQKINNELARLKKIQANVQSLLKKQGVTDAAEQTESRRQNAKIAKDARKLLE
             ||||||||||||||||||||||||||||||||||||||||||||||||||||||||||||
   m597      QQKALAVQEQKINNELARLKKIQANVQSLLKKQGVTDAAEQTESRRQNAKIAKDARKLLE
                 120       130       140       150       160       170

190       200       210       220       230       240
   a597.pep  QKGNEQQLNKLLSNLEKKKAEHRIQDAEAKRKLAEARLAAAEKARKEAAQQKAEARRAEM
             ||||||||||||||||||||||||||||||||||||||||||||||||||||||||||||
   m597      QKGNEQQLNKLLSNLEKKKAEHRIQDAEAKRKLAEARLAAAEKARKEAAQQKAEARRAEM
                 180       190       200       210       220       230

250       260       270       280       290       300
   a597.pep  SNLTAEDRNIQAPSVMGIGSADGFSRMQGRLKKPVDGVPTGLFGQNRSGGDVWKGVFYST
             |||||||||||||||||||||||||||||||||||||||||||||||||||:||||||||
   m597      SNLTAEDRNIQAPSVMGIGSADGFSRMQGRLKKPVDGVPTGLFGQNRSGGDIWKGVFYST
                 240       250       260       270       280       290

310       320       330       340       350       360
   a597.pep  APATVESIAPGTVSYADELDGYGKVVVVDHGENYISIYAGLSEISVGKGYMVAAGSKIGS
             ||||||||||||||||||||||||||||||||||||||||||||||||||||||||||||
   m597      APATVESIAPGTVSYADELDGYGKVVVVDHGENYISIYAGLSEISVGKGYMVAAGSKIGS
                 300       310       320       330       340       350

370       380       390
   a597.pep  SGSLPDGEEGLYLQIRYQGQVLNPSSWIRX
             |||||||||||||||||||||||||||||
   m597      SGSLPDGEEGLYLQIRYQGQVLNPSSWIRX
                 360       370       380
```

The following partial DNA sequence was identified in *N. gonorrhoeae* <SEQ ID 1883>:

```
g601.seq
    1   ATGTTCCCAA CCGGCAATTT GGTCGACGAA ATTGATGTGC CGAATATAGG

51   TCGTCTGAAA GCCACGCTCA TCAACGCGGG CATTCCGACC GTTTTCCTGA

101   ACGCCGCCGA CTTGGGCTAC ACGGGCAAAG AGTTGCAGGA CGACATCAAC

151   AACGATGCCG CCGCGCTGGA AAAATTTGAA ACCATCCGCG CATATGGCGC

201   GCTGAAAATG GGTTTGATCA GCGACGTATC CGAAGCCGCC GCCCGCGCGC

251   GCACGCCGAA ACCCGCCTTC GTCGCGCCCG CCGCCGATTA CACCGCCTCC

301   AGCGGCAAAA CCGTAAACGC CGCCGACATC GATTTGCCGG TACGCGCCCT

351   GAGCATGGGC AAACTGCACC ACGCTATGAT GGGCATCGCC TCGGTCGCCA

401   TCGCCGCCGC CGTGCTCGGT ACGCTGGTCA ACCTTGCCGC AGGCGGCGGA

451   ACGCGTAAAG AAGTGCGCTT CGGGCATCCG TCAGGTACGC TGCGTGTCGG

501   TGCTGCCGCC GAATGTCAGG ACGGACAATG GACGGCCGCc aaagcggtca 551   tgaGCCGCAG CGCACgcgtg attatggaaa gttgGGTGCg cgttcccgat 601   gattGTTTTT GA
```

This corresponds to the amino acid sequence <SEQ ID 1884; ORF 601.ng>:

```
g601.pep
     1   MFPTGNLVDE IDVPNIGRLK ATLINAGIPT VFLNAADLGY TGKELQDDIN

51   NDAAALEKFE TIRAYGALKM GLISDVSEAA ARARTPKPAF VAPAADYTAS

101   SGKTVNAADI DLPVRALSMG KLHHAMMGIA SVAIAAAVLG TLVNLAAGGG

151   TRKEVRFGHP SGTLRVGAAA ECQDGQWTAA KAVMSRSARV IMESWVRVPD

201   DCF*
```

The following partial DNA sequence was identified in *N. meningitidis* <SEQ ID 1885>:

```
m601.seq
     1   ATGTTCCCAA CCGGCAATTT GGTCGATGAA ATTGATGTGC CGAATATAGG

51   CCGTTTGAAA GCCACGCTCA TCAACGCGGG CATTCCGACC GTTTTCTTGA

101   ATGCCGCCGA CTTGGGCTAC ACAGGCAAAG AGTTGCAAGA CGACATCAAC

151   AACGATGCCG CGGCTTTGGA AAAATTCGAG AAAATCCGCG CTTACGGTGC

201   GCTGAAAATG GGTCTGATCA GCGACGTATC CGAAGCTGCC GCTCGCGCGC

251   ACACGCCGAA AGTCGCCTTC GTCGCGCCCG CCGCCGATTA CACCGCCTCC

301   AGTGGCAAAA CCGTGAACGC CGCCGACATC GATTTGCTGG TACGCGCCCT

351   GAGCATGGGC AAACTGCACC ACGCGATGAT GGGTACCGCC TCTGTTGCCA

401   TTGCGACCGC CGCCGCCGTA CCCGGTACGC TGGTCAACCT TGCCGCAGGC

451   GGCGGAACGC GTAAAGAAGT GCGCTTCGGG CATCCTTCCG GCACATTGCG

501   CGTCGGTGCA GCCGCCGAAT GTCAGGACGG ACAATGGACG GCCACCAAAG

551   CGGTCATGAG CCGTAGCGCA CGCGTGATGA TGGAAGGTTG GGTCAGGGTG

601   CCTGAGGATT GTTTTTAA
```

This corresponds to the amino acid sequence <SEQ ID 1886; ORF 601>:

```
m601.pep
     1   MFPTGNLVDE IDVPNIGRLK ATLINAGIPT VFLNAADLGY TGKELQDDIN

51   NDAAALEKFE KIRAYGALKM GLISDVSEAA ARAHTPKVAF VAPAADYTAS

101   SGKTVNAADI DLLVRALSMG KLHHAMMGTA SVAIATAAAV PGTLVNLAAG

151   GGTRKEVRFG HPSGTLRVGA AAECQDGQWT ATKAVMSRSA RVMMEGWVRV

201   PEDCF*
```

Computer analysis of this amino acid sequence gave the following results:

Homology with a Predicted ORF from *N. gonorrhoeae*

ORF 601 shows 94.1% identity over a 205 aa overlap with a predicted ORF (ORF 601.ng) from *N. gonorrhoeae*:

```
m601/g601
                     10        20        30        40        50        60
m601.pep     MFPTGNLVDEIDVPNIGRLKATLINAGIPTVFLNAADLGYTGKELQDDINNDAAALEKFE
             ||||||||||||||||||||||||||||||||||||||||||||||||||||||||||||
g601         MFPTGNLVDEIDVPNIGRLKATLINAGIPTVFLNAADLGYTGKELQDDINNDAAALEKFE
                     10        20        30        40        50        60

70        80        90       100       110       120
m601.pep    KIRAYGALKMGLISDVSEAAARAHTPKVAFVAPAADYTASSGKTVNAADIDLLVRALSMG
             ||||||||||||||||||||||:||| |||||||||||||||||||||||| |||||||
g601        TIRAYGALKMGLISDVSEAAARARTPKPAFVAPAADYTASSGKTVNAADIDLPVRALSMG
                    70        80        90       100       110       120
```

-continued

```
                  130        140        150        160        170        180
m601.pep   KLHHAMMGTASVAIATAAAVPGTLVNLAAGGGTRKEVRFGHPSGTLRVGAAAECQDGQWT
           |||||||| |||||  |||| |||||||||||||||||||||||||||||||||||||||
g601       KLHHAMMGIASVAI--AAAVLGTLVNLAAGGGTRKEVRFGHPSGTLRVGAAAECQDGQWT
                  130          140        150        160        170

190        200
m601.pep   ATKAVMSRSARVMMEGWVRVPEDCFX
           |:||||||||||:||:|||||:||||
g601       AAKAVMSRSARVIMESWVRVPDDCFX
          180        190        200
```

The following partial DNA sequence was identified in *N. meningitidis* <SEQ ID 1887>:

```
a601.seq
     1   ATGTTCCCAA CCGGCAATTT GGTCGATGAA ATTGATGTGC CGAATATAGG

51   CCGTTTGAAA GCCACGCTCA TCAACGCGGG CATTCCGACC GTTTTCCTGA

101   ATGCCGCCGA CTTGGGCTAC ACGGGCAAAG AGTTGCAAGA CGACATCAAC

151   AACGATGCCG CAGCTTTGGA AAAATTCGAG AAAATCCGCG CTTACGGTGC

201   GCTGAAAATG GGTCTGATCA GCGACGTATC CGAAGCTGCC GCCCGCGCGC

251   ACACGCCGAA AGTCGCCTTC GTCGCGCCCG CCGCCGATTA CACCGCCTCC

301   AGTGGCAAAA CCGTGAATGC CGCCGACATC GATTTGCTGG TACGCGCCCT

351   GAGCATGGGC AAATTGCACC ACGCGATGAT GGGTACCGCC TCTGTTGCCA

401   TTGCGACCGC CGCCGCCGTG CCCGGTACGC TGGTCAACCT TGCCGCAGGC

451   GGCGGAACGC GTAAAGAAGT GCGCTTCGGG CATCCTTCCG GCACATTGCG

501   CGTCGGTGCA GCCGCCGAAT GTCAGGACGG ACAATGGACG GCCACCAAAG

551   CGGTTATGAG CCGCAGCGCA CGCGTGATGA TGGAAGGTTG GGTCAGGGTG

601   CCGGAAGATT GTTTTTAA
```

This corresponds to the amino acid sequence <SEQ ID 1888; ORF 601.a>:

```
a601.pep
     1   MFPTGNLVDE IDVPNIGRLK ATLINAGIPT VFLNAADLGY TGKELQDDIN

51   NDAAALEKFE KIRAYGALKM GLISDVSEAA ARAHTPKVAF VAPAADYTAS

101   SGKTVNAADI DLLVRALSMG KLHHAMMGTA SVAIATAAAV PGTLVNLAAG

151   GGTRKEVRFG HPSGTLRVGA AAECQDGQWT ATKAVMSRSA RVMMEGWVRV

201   PEDCF*
``` m601/a601 100.0% identity in 205 aa overlap

```
                   10         20         30         40         50         60
m601.pep   MFPTGNLVDEIDVPNIGRLKATLINAGIPTVFLNAADLGYTGKELQDDINNDAAALEKFE
           ||||||||||||||||||||||||||||||||||||||||||||||||||||||||||||
a601       MFPTGNLVDEIDVPNIGRLKATLINAGIPTVFLNAADLGYTGKELQDDINNDAAALEKFE
                   10         20         30         40         50         60

70         80         90        100        110        120
m601.pep   KIRAYGALKMGLISDVSEAAARAHTPKVAFVAPAADYTASSGKTVNAADIDLLVRALSMG
           ||||||||||||||||||||||||||||||||||||||||||||||||||||||||||||
a601       KIRAYGALKMGLISDVSEAAARAHTPKVAFVAPAADYTASSGKTVNAADIDLLVRALSMG
                   70         80         90        100        110        120
```

```
              130        140        150        160        170        180
m601.pep  KLHHAMMGTASVAIATAAAVPGTLVNLAAGGGTRKEVRFGHPSGTLRVGAAAECQDGQWT
          ||||||||||||||||||||||||||||||||||||||||||||||||||||||||||||
a601      KLHHAMMGTASVAIATAAAVPGTLVNLAAGGGTRKEVRFGHPSGTLRVGAAAECQDGQWT
              130        140        150        160        170        180

190        200
m601.pep  ATKAVMSRSARVMMEGWVRVPEDCFX
          ||||||||||||||||||||||||||
a601      ATKAVMSRSARVMMEGWVRVPEDCFX
              190        200
```

The following partial DNA sequence was identified in *N. gonorrhoeae* <SEQ ID 1889>:

```
g602.seq
    1   ATGTTGCTCC ATCAATGCGA CAAAGCGCGA CATATGCGTC CCTTTCTGCT

51   CGGCGGGCAG ATAAACCGTC ATCGTCAGGC GAGCAACCGT GGATTGTGTT

101   CCTTCGGCGG TTTTCAGGGT AATCGGGAAG CGCAGGTCTT TAATGCCGAC

151   CTGATTGATC GGCAGGTTGC GCAAATCTCT GCTGGATTGC ACGTCTGCAA

201   TGGCGTTCAT GCGTTGTTTG TCCTTAATAT TCAGATAATT ATTGAGATGT

251   GTGTATTGTA TGGCAGGcag atgccgtctg aAAAAacgct gtcggCCGCC

301   TGCCTGCAAA TgcgagattA TATCACTTGC TTTtggcgGC TGCATTGA
```

This corresponds to the amino acid sequence <SEQ ID 1890; ORF 602.ng>:

```
g602.pep
    1   MLLHQCDKAR HMRPFLLGGQ INRHRQASNR GLCSFGGFQG NREAQVFNAD

51   LIDRQVAQIS AGLHVCNGVH ALFVLNIQII IEMCVLYGRQ MPSEKTLSAA

101   CLQMRDYITC FWRLH*
```

The following partial DNA sequence was identified in *N. meningitidis* <SEQ ID 1891>:

```
m602.seq
    1   ATGTTGCTCC ATCAATGCGA CAAAACGCGA CATATGCGTC CCCTTCTGCT

51   CAGCAGGCAG GTAAACCGTC ATGGTCAGAC GGGCAATGGT GGACTGGATG

101   CCTTCTGCAG TTTGCAGGGT AATCGGAAAG CGCAGGTCTT TGATACCGAC

151   CTGATTGATC GGCAGATTGC GCAAATCTCG GCTGGATTGC ACGTCTGCAA

201   TAGTGTTCAT GAGTTGTTTT TCCTTAATAT TCATGTAATT GTTGAGATGT

251   GTGCATGGTA TGGCGTTTCC GCCGGGGAAT ATACCGTCAA TCTGCAAATG

301   CGAGATTATA TCACTCGCTT TTAGCAGCTG CATTGA
```

This corresponds to the amino acid sequence <SEQ ID 1892; ORF 602>:

```
m602.pep
    1   MLLHQCDKTR HMRPLLLSRQ VNRHGQTGNG GLDAFCSLQG NRKAQVFDTD

51   LIDRQIAQIS AGLHVCNSVH ELFFLNIHVI VEMCAWYGVS AGEYTVNLQM

101   RDYITRF*QL H*
``` m602/g602 65.2% identity in 115 aa overlap

```
                10         20         30         40         50         60
m602.pep  MLLHQCDKTRHMRPLLLSRQVNTHGQTGNGGLDAFCSLQGNRKAQVFDTDLIDRQIAQIS
          ||||||||:||||  |:|||  |::  ||   :|  ::||||:||||::|||||:||||
g602      MLLHQCDKARHMRPFLLGGQINTHRQASNRGLCSFGGFQGNREAQVFNADLIDRQVAQIS
                10         20         30         40         50         60

70         80         90        100        110
m602.pep  AGLHVCNSVHELFFLNIHVIVEMCAWYGVSA-GEYTVN---LQMRDYITRFXQLHX
          ||||||:|| ||  |||:|||| ||   :|  | |::  |||||||| | :|||
g602      AGLHVCNGVHALFVLNIQIIIEMCVLYGRQMPSEKTLSAACLQMRDYITCFWRLHX
                70         80         90        100        110
```

The following partial DNA sequence was identified in *N. meningitidis* <SEQ ID 1893>:

```
a602.seq
    1   ATGTTGCTCC ATCAATGCGA CAAAGCGCGA CATATGCGTA CCCTTCTGCT
   51   CGGCAGGCAG GTAAACCGTC ATGGTCAGAC GGGCAACTGT GGACTGGATG
  101   CCTTCTGCAG TTTGCAGGGT AATCGGAAAG CGCAGGTCTT TGATACCGAC
  151   CTGATTGATC GGCAGATTGC GCAAATCTCG GCTGGATTGC ACGTCTGCAA
  201   TAGTGTTCAT GAGTTGTTTT TCCTTAATAT TCATGTAATT GTTGAGATGT
  251   GTGCATGGTA TGGCGTTTCC ACCGGGGAAT ATACCGTCAA TCTGCAAATG
  301   CGAGATTATA TCACTCGCTT TTAGCAGCTG CATTGA
```

This corresponds to the amino acid sequence <SEQ ID 1894; ORF 602.a>:

```
a602.pep
    1   MLLHQCDKAR HMRTLLLGRQ VNRHGQTGNC GLDAFCSLQG NRKAQVFDTD
   51   LIDRQIAQIS AGLHVCNSVH ELFFLNIHVI VEMCAWYGVS TGEYTVNLQM
  101   RDYITRF*QL H*
``` m602/a602 95.5% identity in 111 aa overlap

```
                10         20         30         40         50         60
m602.pep  MLLHQCDKTRHMRPLLLSRQVNTHGQTGNGGLDAFCSLQGNRKAQVFDTDLIDRQIAQIS
          ||||||||:||||   |||:|||||||||| |||||||||||||||||||||||||||||
a602      MLLHQCDKARHMRTLLLGRQVNRHGQTGNCGLDAFCSLQGNRKAQVFDTDLIDRQIAQIS
                10         20         30         40         50         60

70         80         90        100        110
m602.pep  AGLHVCNSVHELFFLNIHVIVEMCAWYGVSAGEYTVNLQMRDYITRFXQLHX
          |||||||||||||||||||||||||||||:||||||||||||||||||||||
a602      AGLHVCNSVHELFFLNIHVIVEMCAWYGVSTGEYTVNLQMRDYITRFXQLHX
                70         80         90        100        110
```

The following partial DNA sequence was identified in *N. gonorrhoeae* <SEQ ID 1895>:

```
g603.seq
    1   ATGGATTCCC GCCTGCGTGG GAATGACGCT AGGAAATACG GCATACGCTT
   51   TGCCCAAAGA GGCCGTCTGA ACACACTCC GCCCAACGCC CATCCTTTTT
  101   CAGACGGCCC CGCACCAAAA AAACAACCAC AAACTACAAG GAGAAACATC
  151   ATGTCCGACC AACTCATTCT TGTCCTGAAC TGCGTCAGTT CATCGCTCAA
  201   AGGCGCCGTT ATCGACCGCA AAAGCGGCAG CGTCGTCCTA AGCTGCCTCG
  251   GGGAACGCCT GACTACGCCC GAAGCCGTCA TTACCTTCAA CAAAGACGGC
```

-continued

```
 301   AACAAACGCC AAGTTCCCCT GAGCGGCCGC AACTGCCACG CCGGCGCGGT

351   GGGTATGCTG TTGAACGAAC TGGAAAAACA CGGACTGCAC GACCGCATCA

401   AAGCCATCGG CCGCCGCATC GCCCACGGCG GCGAAAAATA TCACGAGTCC

451   GTCCTCATCG ACCAAGACGT CCTTGACGAA CTGAAAGCCT GCATCCCGTT

501   CGCCCCGCTG CACAACCCCG CCAACATCAG CGGCATCCTC GCCGCGCAGG

551   AACACTTTCC CGGCCTGCCC AACGTCGGCG TGATGGACAC CTCGTTCCAC

601   CAAACCATGC CGGAGCGGGC CTACACTTAT GCCGTGCCGC GCGAATTGCG

651   CAAAAAATAC GCCTTCCGCC GCTACGGTTT CCACGGTACC GGTATGCGTT

701   ACGTCGCCCC TGAAGCCGCA CGCATCTTGG GCAAACCTct ggaaGACATC

751   CGCATGATTA TTGCCCACTT AGGCAACGGC GCATCTATTA CCGCCGTCAA

801   AAACGGCAAA TCCGTCGATA CCGGTATGGG TTTCACGCCG ATCGAAGGTT

851   TGGTAATGGG TACACGTTGC GGCGACACCG ATCCGGGCGT ATACAGCTAT

901   CCGACTTTCC ACGCAGGGAT GGATGTTGCC CAAGTTGATG AAATGCTGAA

951   CGAAAAATCA GGTTTCCCCG GTATTTCcgA actTCCCAAC GACTGCCGCA

1001   CCCTCGAAAT CGCCGCCGAC GAAGGCCGCG AAGGCGCGCG CCTCGCCCTc 1051   gaAGTCATGA CCTGCCGCCT CGCCAAATAC ATCGCTTCGA TGGCTGTGGC

1101   CTGCGGCAGT GTTGACGCAC TCGTGTTCAC CGGCGGTATC GGCGAAAACT

1151   CGCGTAATAT CCGTGCCAAA ACCGTTTCCT ATCTTGATTT CTTGGGTCTG

1201   CACATCGACA CCAAAGCCAA TATGGAAAAA CGCTACGGCA ATTCGGGCAT

1251   TATCAGCCCG ACCGATTCTT CTCCGGCTGT TTTGGTCGTC CCGACCAATG

1301   AAGAACTGAT GATTGCCTGC GACACTGCCG AACTTGCCGG CATCTTGTAG
```

This corresponds to the amino acid sequence <SEQ ID 1895;
ORF 603.ng>:

```
g603.pep
   1   MDSRLRGNDA RKYGIRFAQR GRLKHTPPNA HPFSDGPAPK KQPQTTRRNI

51   MSDQLILVLN CVSSSLKGAV IDRKSGSVVL SCLGERLTTP EAVITFNKDG

101   NKRQVPLSGR NCHAGAVGML LNELEKHGLH DRIKAIGRRI AHGGEKYHES

151   VLIDQDVLDE LKACIPFAPL HNPANISGIL AAQEHFPGLP NVGVMDTSFH

201   QTMPERAYTY AVPRELRKKY AFRRYGFHGT GMRYVAPEAA RILGKPLEDI

251   RMIIAHLGNG ASITAVKNGK SVDTGMGFTP IEGLVMGTRC GDTDPGVYSY

301   PTFHAGMDVA QVDEMLNEKS GFPGISELPN DCRTLEIAAD EGREGARLAL

351   EVMTCRLAKY IASMAVACGS VDALVFTGGI GENSRNIRAK TVSYLDFLGL

401   HIDTKANMEK RYGNSGIISP TDSSPAVLVV PTNEELMIAC DTAELAGIL*
```

The following partial DNA sequence was identified in N. meningitidis <SEQ ID 1897>:

```
m603.seq
   1   CTGTCCTCGC GTAGGCGGGG ACGGAATAAC GATAGAAAAT GCGGCATACG

51   CTTTGCCCAA AGAGGCCGTC TGAAACACCT TGCGCCTGAT GTCTGC.CTT

101   TTTCAGACGA CCCCACACTA AAAAACAAC CACAAACTAC AAGGAGAAAC

151   ATCATGTCCG ACCAACTCAT CCTCGTTCTG AACTGCGGCA GTTCATCGCT
```

-continued

```
 201  CAAAGGCGCC GTTATCGACC GAmAAAGCGG CAGCGTCGTC CTAAGCTGCC
 251  TCGGCGAACG cCtGACCACG CCCGAAGCCG TCATTACGTT CAACAAAGAC
 301  GGCAACAAAC GCCAAGTTCC CCTGAGCGGC CGAAATTGCC ACGCCGGCGC
 351  GGTGGGTATG CTTTTGAACG AACTGGAAAA ACACGGTCTG CACGACCGCA
 401  TCAAAGCCAT CGGCCACCGC ATCGCCCACG GCGGCGAAAA ATACAGCGAG
 451  TCTGTTTTGA TCGACCAGGC CGTAATGGAC GAACTCAATG CCTGCATTCC
 501  GCTTGCGCCG CTGCACAACC CCGCCAACAT CAGCGGCATC CTTGCCGCAC
 551  AGGAACATTT CCCCGGTCTG CCCAATGTCG GCGTGATGGA TACTTCGTTC
 601  CACCAAACCA TGCCGGAGCG TGCCTACACT TATGCCGTGC CGCGCGAGTT
 651  GCGTAAAAAA TACGCTTTCC GCCGCTACGG TTTCCACGGC ACCAGTATGC
 701  GTTACGTTGC CCCTGAAGCC GCACGCATCT TGGGCAAACC TCTGGAAGAC
 751  ATCCGCATGA TTATTGCCCA CTTAGGCAAC GGCGCATCCA TTACCGCCAT
 801  CAAAAACGGC AAATCCGTCG ATACCAGTAT GGGTTTCACG CCGATCGAAG
 851  GTTTGGTAAT GGGTACACGT TGCGGCGACA TCGATCCGGG CGTATACAGC
 901  TATCTGACTT CCCACGCCGG GATGGATGTT GCCCAAGTGG ATGAAATGCT
 951  GAACAAAAAA TCAGGTTTGC TCGGTATTTC CGAACTTTCC AACGACTGCC
1001  GCACCCTCGA AATCGCCGCC GACGAAGGCC ACGAAGGCGC GCGCCTCGCC
1051  CTCGAAGTCA TGACCTACCG CCTCGCCAAA TACATCGCTT CGATGGCTGT
1101  GGGCTGCGGC GGCGTTGACG CACTCGTGTT CACCGGCGGT ATCGGCGAAA
1151  ACTCGCGTAA TATCCGTGCC AAAACCGTTT CCTATCTTGA TTTCTTGGGT
1201  CTGCACATCG ACACCAAAGC CAATATGGAA AAACGCTACG GCAATTCGGG
1251  CATTATCAGC CCGACCGATT CTTCTCCGGC TGTTTTGGTT GTCCCGACCA
1301  ATGAAGAACT GATGATTGCC TGCGACACTG CCGAACTTGC CGGCATCTTG
1351  TAG
```

This corresponds to the amino acid sequence <SEQ ID 1898; ORF 603>:

```
m603.pep
   1  LSSRRRGRNN DRKCGIRFAQ RGRLKHLAPD VCXFSDDPTL KKQPQTTRRN
  51  IMSDQLILVL NCGSSSLKGA VIDRXSGSVV LSCLGERLTT PEAVITFNKD
 101  GNKRQVPLSG RNCHAGAVGM LLNELEKHGL HDRIKAIGHR IAHGGEKYSE
 151  SVLIDQAVMD ELNACIPLAP LHNPANISGI LAAQEHFPGL PNVGVMDTSF
 201  HQTMPERAYT YAVPRELRKK YAFRRYGFHG TSMRYVAPEA ARILGKPLED
 251  IRMIIAHLGN GASITAIKNG KSVDTSMGFT PIEGLVMGTR CGDIDPGVYS
 301  YLTSHAGMDV AQVDEMLNKK SGLLGISELS NDCRTLEIAA DEGHEGARLA
 351  LEVMTYRLAK YIASMAVGCG GVDALVFTGG IGENSRNIRA KTVSYLDFLG
 401  LHIDTKANME KRYGNSGIIS PTDSSPAVLV VPTNEELMIA CDTAELAGIL
 451  *
```

Computer analysis of this amino acid sequence gave the following results:
Homology with a Predicted ORF from *N. gonorrhoeae*
ORF 603 shows 91.6% identity over a 450 aa overlap with a predicted ORF (ORF 603.ng) from *N. gonorrhoeae*:

```
m603/g603
                  10        20        30        40        50        60
m603.pep  LSSRRRGRNNDRKCGIRFAQRGRLKHLAPDVCXFSDDPTLKKQPQTTRRNIMSDQLILVL
          ::|| || |: || ||||||||||||  |::  ||| |: ||||||||||||||||||||
g603      MDSRLRG-NDARKYGIRFAQRGRLKHTPPNAHPFSDGPAPKKQPQTTRRNIMSDQLILVL
                   10        20        30        40        50

70        80        90       100       110       120
m603.pep  NCGSSSLKGAVIDRXSGSVVLSCLGERLTTPEAVITFNKDGNKRQVPLSGRNCHAGAVGM
          || ||||||||||| |||||||||||||||||||||||||||||||||||||||||||||
g603      NCVSSSLKGAVIDRKSGSVVLSCLGERLTTPEAVITFNKDGNKRQVPLSGRNCHAGAVGM
         60        70        80        90       100       110

130       140       150       160       170       180
m603.pep  LLNELEKHGLHDRIKAIGHRIAHGGEKYSESVLIDQAVMDELNACIPLAPLHNPANISGI
          ||||||||||||||||||:||||||||| ||||||| |:|||:||||:||||||||||||
g603      LLNELEKHGLHDRIKAIGRRIAHGGEKYHESVLIDQDVLDELKACIPFAPLHNPANISGI
        120       130       140       150       160       170

190       200       210       220       230       240
m603.pep  LAAQEHFPGLPNVGVMDTSFHQTMPERAYTYAVPRELRKKYAFRRYGFHGTSMRYVAPEA
          |||||||||||||||||||||||||||||||||||||||||||||||||||:||||||||
g603      LAAQEHFPGLPNVGVMDTSFHQTMPERAYTYAVPRELRKKYAFRRYGFHGTGMRYVAPEA
        180       190       200       210       220       230

250       260       270       280       290       300
m603.pep  ARILGKPLEDIRMIIAHLGNGASITAIKNGKSVDTSMGFTPIEGLVMGTRCGDIDPGVYS
          ||||||||||||||||||||||||||:||||||||:||||||||||||||||| ||||||
g603      ARILGKPLEDIRMIIAHLGNGASITAVKNGKSVDTGMGFTPIEGLVMGTRCGDTDPGVYS
        240       250       260       270       280       290

310       320       330       340       350       360
m603.pep  YLTSHAGMDVAQVDEMLNKKSGLLGISELSNDCRTLEIAADEGHEGARLALEVMTYRLAK
          | | ||||||||||||||:|||: ||||| |||||||||||||:||||||||||| ||||
g603      YPTFHAGMDVAQVDEMLNEKSGFPGISELPNDCRTLEIAADEGREGARLALEVMTCRLAK
        300       310       320       330       340       350

370       380       390       400       410       420
m603.pep  YIASMAVGCGGVDALVFTGGIGENSRNIRAKTVSYLDFLGLHIDTKANMEKRYGNSGIIS
          |||||||:||:|||||||||||||||||||||||||||||||||||||||||||||||||
g603      YIASMAVACGSVDALVFTGGIGENSRNIRAKTVSYLDFLGLHIDTKANMEKRYGNSGIIS
        360       370       380       390       400       410

430       440       450
m603.pep  PTDSSPAVLVVPTNEELMIACDTAELAGILX
          ||||||||||||||||||||||||||||||
g603      PTDSSPAVLVVPTNEELMIACDTAELAGILX
        420       430       440       450
```

The following partial DNA sequence was identified in *N. meningitidis* <SEQ ID 1899>:

```
a603.seq
      1  CTGTCCTCGC GTAGGCGGGG ACGGAATAAC GATAGAAAAT GCGGCATACG

51  CTTTGCCCAA AGAGGCCGTC TGAAACACAC TCCGCCCAAC GCCCATCCTT

101  TTTCAGACGA CCCCACACC. AAAAAACAAC CACAAACTAC AAGGAGAAAC

151  ATCATGTCCG ACCAACTCAT TCTTGTTCTG AACTGCGGCA GTTCATCGCT

201  CAAAGGTGCC GTTATCGACC GCAAAAGCGG CAGCGTCGTC CTAAGCTGCC

251  TCGGCGAACG CCTGACCACG CCCGAAGCCG TCATTACGTT CAGCAAAGAC

301  GGCAACAAAC GCCAAGTTCC CCTGAGCGGC CGGAACTGCC ACGCCGGCGC

351  GGTGGGTATG CTGTTGAACG AACTGGAAAA ACACGAACTG CACGACCGCA

401  TTCAAGCCGT CGGCCACCGC ATCGCCCACG GCGGCGAAAA ATACAGCGAG

451  TCTGTTTTGA TCGACCAGGC CGTAATGGAC GAACTCAATG CCTGCATTCC

501  GCTTGCGCCG CTGCACAACC CCGCCAACAT CAGCGGCATC CTCGCCGCAC

551  AGGAACATTT CCCCGGTCTG CCCAATGTCG GCGTGATGGA TACTTCGTTC

601  CACCAAACCA TGCCGGAGCG TGCCTACACT TATGCCGTGC CGCGCGAGTT

651  GCGTAAAAAA TACGCTTTCC GCCGCTACGG TTTCCACGGC ACCAGTATGC

701  GTTACGTTGC CCCTGAAGCC GCATGCATCT TGGGCAAACC TCTGGAAGAC

751  ATCCGCATGA TTATTGCCCA CTTAGGCAAC GGCGCATCCA TTACCGCCAT
```

-continued

```
 801 CAAAAACGGC AAATCCGTCG ATACCAGTAT GGGTTTCACG CCGATCGAAG

851 GTTTGGTAAT GGGTACGCGC TGCGGCGATA TCGACCCGGG CGTATACAGC

901 TATCTGACTT CACACGCCGG TTTGGATGTT GCACAAGTTG ATGAAATGCT

951 GAATAAAAAA TCAGGCTTGC TCGGTATTTC CGAACTCTCC AACGACTGCC

1001 GCACCCTCGA AATCGCCGCC GACGAAGGCC ACGAAGGCGC GCGCCTCGCC

1051 CTCGAAGTTA TGACCTACCG CCTCGCCAAA TACATCGCTT CGATGGCTGT

1101 GGGCTGCGGC GGCGTTGACG CACTCGTGTT CACCGGCGGT ATCGGCGAAA

1151 ACTCGCGTAA TATCCGTGCC AAAACCGTTT CCTATCTTGA TTTCTTGGGT

1201 CTGCACATCG ACACCAAAGC CAATATGGAA AAACGCTACG GCAATTCGGG

1251 TATTATCAGC CCGACCGATT CTTCTCCGGC TGTTTTGGTT GTCCCGACCA

1301 ATGAAGAACT GATGATTGCC TGCGACACTG CCGAACTTGT CGGCATCTTG

1351 TAG
```

This corresponds to the amino acid sequence <SEQ ID 1900; ORF 603.a>:

```
a603.pep
    1 LSSRRRGRNN DRKCGIRFAQ RGRLKHTPPN AHPFSDDPTX KKQPQTTRRN

51 IMSDQLILVL NCGSSSLKGA VIDRKSGSVV LSCLGERLTT PEAVITFSKD

101 GNKRQVPLSG RNCHAGAVGM LLNELEKHEL HDRIQAVGHR IAHGGEKYSE

151 SVLIDQAVMD ELNACIPLAP LHNPANISGI LAAQEHFPGL PNVGVMDTSF

201 HQTMPERAYT YAVPRELRKK YAFRRYGFHG TSMRYVAPEA ACILGKPLED

251 IRMIIAHLGN GASITAIKNG KSVDTSMGFT PIEGLVMGTR CGDIDPGVYS

301 YLTSHAGLDV AQVDEMLNKK SGLLGISELS NDCRTLEIAA DEGHEGARLA

351 LEVMTYRLAK YIASMAVGCG GVDALVFTGG IGENSRNIRA KTVSYLDFLG

401 LHIDTKANME KRYGNSGIIS PTDSSPAVLV VPTNEELMIA CDTAELVGIL

451 *
``` m603/a603 96.7% identity in 450 aa overlap

```
                 10         20         30         40         50         60
  m603.pep  LSSRRRGRNNDRKCGIRFAQRGRLKHLAPDVCXFSDDPTLKKQPQTTRRNIMSDQLILVL
            ||||||||||||||||||||||||||||| |::  |||||| ||||||||||||||||||
      a603  LSSRRRGRNNDRKCGIRFAQRGRLKHTPPNAHPFSDDPTXKKQPQTTRRNIMSDQLILVL
                 10         20         30         40         50         60

70         80         90        100        110        120
  m603.pep  NCGSSSLKGAVIDRXSGSVVLSCLGERLTTPEAVITFNKDGNKRQVPLSGRNCHAGAVGM
            ||||||||||||||| ||||||||||||||||||||||:|||||||||||||||||||||
      a603  NCGSSSLKGAVIDRKSGSVVLSCLGERLTTPEAVITFSKDGNKRQVPLSGRNCHAGAVGM
                 70         80         90        100        110        120

130        140        150        160        170        180
  m603.pep  LLNELEKHGLHDRIKAIGHRIAHGGEKYSESVLIDQAVMDELNACIPLAPLHNPANISGI
            ||||||||:||||| :|:||||||||||||||||||||||||||||||||||||||||||
      a603  LLNELEKHELHDRIQAVGHRIAHGGEKYSESVLIDQAVMDELNACIPLAPLHNPANISGI
                130        140        150        160        170        180

190        200        210        220        230        240
  m603.pep  LAAQEHFPGLPNVGVMDTSFHQTMPERAYTYAVPRELRKKYAFRRYGFHGTSMRYVAPEA
            ||||||||||||||||||||||||||||||||||||||||||||||||||||||||||||
      a603  LAAQEHFPGLPNVGVMDTSFHQTMPERAYTYAVPRELRKKYAFRRYGFHGTSMRYVAPEA
                190        200        210        220        230        240

250        260        270        280        290        300
  m603.pep  ARILGKPLEDIRMIIAHLGNGASITAIKNGKSVDTSMGFTPIEGLVMGTRCGDIDPGVYS
            | ||||||||||||||||||||||||||||||||||||||||||||||||||||||||||
      a603  ACILGKPLEDIRMIIAHLGNGASITAIKNGKSVDTSMGFTPIEGLVMGTRCGDIDPGVYS
                250        260        270        280        290        300
```

```
               310        320        330        340        350        360
m603.pep  YLTSHAGMDVAQVDEMLNKKSGLLGISELSNDCRTLEIAADEGHEGARLALEVMTYRLAK
          |||||||:||||||||||||||||||||||||||||||||||||||||||||||||||
a603      YLTSHAGLDVAQVDEMLNKKSGLLGISELSNDCRTLEIAADEGHEGARLALEVMTYRLAK
               310        320        330        340        350        360
               370        380        390        400        410        420
m603.pep  YIASMAVGCGGVDALVFTGGIGENSRNIRAKTVSYLDFLGLHIDTKANMEKRYGNSGIIS
          ||||||||||||||||||||||||||||||||||||||||||||||||||||||||||||
a603      YIASMAVGCGGVDALVFTGGIGENSRNIRAKTVSYLDFLGLHIDTKANMEKRYGNSGIIS
               370        380        390        400        410        420
               430        440        450
m603.pep  PTDSSPAVLVVPTNEELMIACDTAELAGILX
          |||||||||||||||||||||||||||:||||
a603      PTDSSPAVLVVPTNEELMIACDTAELVGILX
               430        440        450
```

The following partial DNA sequence was identified in *N. gonorrhoeae* <SEQ ID 1901>:

```
g604.seq
    1   ATGCCCGAAG CGCACTTCTT TACGCGTTCC GCCGCCTGCG GCAAGGTTGA
   51   CCAGCGTACC GAGCACGGCG GCGGCGATGG CGACCGAGGC GATGCCCATC
  101   ATAGCGTGGT GCAGTTTGCC CATGCTCAGG GCGCGTACCG GCAAATCGAT
  151   GTCGGCGGCG TTTACGGTTT TGCCGCTGGA GGCGGTGTAA TCGGCGGCGG
  201   GCGCGACGAA GGCGGGTTTC GGCGTGCGCG CGCGGGCGGC GGCTTCGGAT
  251   ACGTCGCTGA TCAAACCCAT TTTCAGCGCG CCATATGCGC GGATGGTTTC
  301   AAATTTTTCC AGCGCGGCGG CATCGTTGTT GATGTCGTCC TGCAACTCTT
  351   TGCCCGTGTA GCCCAAGTCG GCGGCGTTCA GGAAAACGGT CGGAATGCCC
  401   GCGTTGATGA GCGTGGCTTT CAGACGACCT ATATTCGGCA CATCAATTTC
  451   GTCGACCAAA TTGCCGGTTG GGAACATACT GCCTTcgcCG TCGGCTGGAT
  501   CTAA
```

This corresponds to the amino acid sequence <SEQ ID 1902; ORF 604.ng>:

```
g604.pep
    1   MPEAHFFTRS AACGKVDQRT EHGGGDGDRG DAHHSVVQFA HAQGAYRQID
   51   VGGVYGFAAG GGVIGGGRDE GGFRRARAGG GFGYVADQTH FQRAICADGF
  101   KFFQRGGIVV DVVLQLFARV AQVGGVQENG RNARVDERGF QTTYIRHINF
  151   VDQIAGWEHT AFAVGWI*
```

The following partial DNA sequence was identified in *N. meningitidis* <SEQ ID 1903>:

```
m604.seq
    1   ATGCCCGAAG CGCACTTCTT TACGCGTTCC GCCGCCTGCG GCAAGGTTGA
   51   CCAGCGTACC GGGTACGGCG GCGGCGGTCG CAATGGCAAC AGAGGCGGTA
  101   CCCATCATCG CGTGGTGCAG TTTGCCCATG CTCAGGGCGC GTACCAGCAA
  151   ATCGATGTCG GCGGCGTTCA CGGTTTTGCC ACTGGAGGCG GTGTAATCGG
  201   CGGCGGGCGC GACGAAGGCG ACTTTCGGCG TGTGCGCGCG AGCGGCAGCT
  251   TCGGATACGT CGCTGATCAG ACCCATTTTC AGCGCACCGT AAGCGCGGAT
  301   TTTCTCGAAT TTTTCCAAAG CCGCGGCATC GTTGTTGATG TCGTCTTGCA
  351   ACTCTTTGCC TGTGTAGCCC AAGTCGGCGG CATTCAAGAA AACGGTCGGA
```

-continued

```
401  ATGCCCGCGT TGATGAGCGT GGCTTTCAAA CGGCCTATAT TCGGCACATC

451  AATTTCATCG ACCAAATTGC CGGTTGGGAA CATACTGCCT TCGCCGTCGG

501  CTGGATC
```

This corresponds to the amino acid sequence <SEQ ID 1904; ORF 604>:

```
m604.pep
    1  MPEAHFFTRS AACGKVDQRT GYGGGGRNGN RGGTHHRVVQ FAHAQGAYQQ

51  IDVGGVHGFA TGGGVIGGGR DEGDFRRVRA SGSFGYVADQ THFQRTVSAD

101  FLEFFQSRGI VVDVVLQLFA CVAQVGGIQE NGRNARVDER GFQTAYIRHI

151  NFIDQIAGWE HTAFAVGWI
```

Computer analysis of this amino acid sequence gave the following results:
Homology with a Predicted ORF from *N. gonorrhoeae*
ORF 604 shows 83.4% identity over a 169 aa overlap with a predicted ORF (ORF 604.ng) from *N. gonorrhoeae*:

```
m604/g604
                    10         20         30         40         50         60
m604.pep   MPEAHFFTRSAACGKVDQRTGYGGGGRNGNRGGTHHRVVQFAHAQGAYQQIDVGGVHGFA
           |||||||||||||||||||| :|||    :|:||  :|| |||||||||||:|||||||:|||
g604       MPEAHFFTRSAACGKVDQRTEHGGG--DGDRGDAHHSVVQFAHAQGAYRQIDVGGVYGFA
                    10         20           30         40         50
                    70         80         90        100        110        120
m604.pep   TGGGVIGGGRDEGDFRRVRASGSFGYVADQTHFQRTVSADFLEFFQSRGIVVDVVLQLFA
           :|||||||||||  |||:||:|:|||||||||||||||||::  ||   :|||  |||||||||||
g604       AGGGVIGGGRDEGGFRRARAGGGFGYVADQTHFQRAICADGFKFFQRGGIVVDVVLQLFA
                    60         70         80         90        100        110
                   130        140        150        160    169
m604.pep   CVAQVGGIQENGRNARVDERGFQTAYIRHINFIDQIAGWEHTAFAVGWI
           ||||||:||||||||||||||||||| :|||||||||||:|||||||||||||
g604       RVAQVGGVQENGRNARVDERGFQTTYIRHINFVDQIAGWEHTAFAVGWIX
                   120        130        140        150        160
```

The following partial DNA sequence was identified in *N. meningitidis* <SEQ ID 1905>:

```
a604.seq
    1  ATGCCCGAAG CGCACTTCTT TACGCGTTCC GCCGCCTGCG GCAAGGTTGA

51  CCAGCGTACC GGGCACGGCG GCGGCGGTCG CAATGGCAAC AGAGGCGGTA

101  CCCATCATCG CGTGGTGCAA TTTGCCCATG CTCAGGGCGC GTACCAGCAA

151  ATCGATGTCG GCGGCATTCA CGGTTTTGCC ACTGGAGGCG GTGTAATCGG

201  CGGCGGGCGC GACGAAGGCG ACTTTCGGCG TGTGCGCGCG GGCGGCAGCT

251  TCGGATACGT CGCTGATCAG ACCCATTTTC AGCGCACCGT AAGCGCGGAT

301  TTTCTCGAAT TTTTCCAAAG CTGCGGCATC GTTGTTGATG TCGTCTTGCA

351  ACTCTTTGCC CGTGTAGCCC AAGTCGGCGG CATTCAGGAA AACGGTCGGA

401  ATGCCCGCGT TGATGAGCGT GGCTTTCAAA CGGCCTATAT TCGGCACATC

451  AATTTCATCG ACCAAATTGC CGGTTGGGAA CATACTGCCT TCGCCGTCGG

501  CTGGATCAAG AAATTCGATT TGTACTTCGG CTGCCGGGAA CGTTACGCCG

551  TCGAGCTCAA AATCGCCTGT TTCCAAAACT GCGCCGTTTT GCATCGGTAC
```

-continued

```
601 ATGGGCAATA ATGGTTTTGC CGATGTTTTT CTGCCAGATT TTGACTGTGC

651 AGATGCCGTC TGA
```

This corresponds to the amino acid sequence <SEQ ID 1906; ORF 604.a>:

```
a604.pep
  1  MPEAHFFTRS AACGKVDQRT GHGGGGRNGN RGGTHHRVVQ FAHAQGAYQQ

51  IDVGGIHGFA TGGGVIGGGR DEGDFRRVRA GGSFGYVADQ THFQRTVSAD

101  FLEFFQSCGI VVDVVLQLFA RVAQVGGIQE NGRNARVDER GFQTAYIRHI

151  NFIDQIAGWE HTAFAVGWIK KFDLYFGCRE RYAVELKIAC FQNCAVLHRY

201  MGNNGFADVF LPDFDCADAV *
``` m604/a604 97.0% identity in 169 aa overlap

```
                   10         20         30         40         50         60
    m604.pep  MPEAHFFTRSAACGKVDQRTGYGGGGRNGNRGGTHHRVVQFAHAQGAYQQIDVGGVHGFA
              ||||||||||||||||||||| :||||||||||||||||||||||||||||||||:||||
    a604      MPEAHFFTRSAACGKVDQRTGHGGGGRNGNRGGTHHRVVQFAHAQGAYQQIDVGGIHGFA
                   10         20         30         40         50         60

70         80         90        100        110        120
    m604.pep  TGGGVIGGGRDEGDFRRVRASGSFGYVADQTHFQRTVSADFLEFFQSRGIVVDVVLQLFA
              ||||||||||||||||||||: |||||||||||||||||||||||||||  |||||||||
    a604      TGGGVIGGGRDEGDFRRVRAGGSFGYVADQTHFQRTVSADFLEFFQSCGIVVDVVLQLFA
                   70         80         90        100        110        120

130        140        150        160        169
    m604.pep  CVAQVGGIQENGRNARVDERGFQTAYIRHINFIDQIAGWEHTAFAVGWI
              |||||||||||||||||||||||||||||||||||||||||||||||||
    a604      CVAQVGGIQENGRNARVDERGFQTAYIRHINFIDQIAGWEHTAFAVGWIKKFDLYFGCRE
                  130        140        150        160        170        180 a604      RYAVELKIACFQNCAVLHRYMGNNGFADVFLPDFDCADAVX
                  190        200        210        220
```

The following partial DNA sequence was identified in *N. gonorrhoeae* <SEQ ID 1907>:

```
g605.seq
  1  ATGATGACCG AAATGCAACA ACGCGCCCAA CTGCACCGCC AAATTTGGAA

51  AATCGCCGAC GAAGTACGCG GCGCGGTGGA TGGCTGGGAC TTTAAACAAT

101  ACGTTCTCGG CACACTTTTC TACCGCTTTA TCAGCGAAAA CTTCACCGAC

151  TATATGCAGG CCGGCGACAG CAGCATTGAT TACGCCGCta tGCCGGACAG

201  CATCATCACG CCCGAAATCA AAGACGATgc cgtcaaagtc aaAGGCTATT

251  TCATCtacCc cgGCCAGCTT TTTTgcaata ttgccgccga agcCCATCAA

301  AACGAAGAGC TCAACACCAA GCTGAAAGAa atCTTTACCG CGATTGAAAG

351  CTCCGCCTCC GGCTAcccgT CCGAACAAGG CATCAAAGGC TTGTTTGACG

401  ACTTCgACAC CACCAGCAGC CGGCTCGGCA GCACCGTTGC CGACAAAAAC

451  AAACGCCTTG CCGCCGTCCT TAAAGGCGTG GCGGAACTCG ATTTCGGCAA

501  TTTTGAAGAC CACCGCATCG ACCTTTTCGG TGATGCCTAC GAATACCTGA

551  TTTCCAACTA CGCcgcCAAC GCAGGCAAAT CCGGCGGCGA ATTTTTCACC

601  CCGCAAAGCG TCTCCAAGCT GATTGCGCGG CTGGCGGTGC ACGGGCAGGA

651  GAAAGTCAAC AAAATCTACG ACCCCGCCTG CGGCTCGGGC AGCCTGCTCT

701  TGCAGGCGAA AAAACAGTTT GACGAACACA TCATCGAAGA AGGCTTCTTC
```

```
 751  GGGCAGGAAA TCAACCACAC CACCTACAAC CTCGCCCGCA TGAATATGTT

801  TCTGCACAAC GTCAATTACA ACAAATTCCA CATCGAATTG GGCGACACGC

851  TGACCAACCC CAAACTCAAA GACAGCAAAC CCTTTGATGC CGTCGTCTCC

901  AATCCGCCCT ATTCCATCGA CTGGATAGGC AGCGACGACC CCACCTtgaT

951  CAACGACGAC CGCTTTGCCC CCGCAGGCGT ACTCGCACCG AAATCCAAAG

1001  CCGATTTTGC CTTCATCCTG CACGCACTGA ACTACCTTTC CGGCAGAGGC

1051  CGCGCCGCTA TCGTCTCATT CCCCGGCATT TTCTATCGCG GCGGCGCAGA

1101  GCAGAAAATc CGCCAATATC TGGTGGAGGG CAACTATGTG GAAACCGTGA

1151  TTGCCCTTGC GCCCAATCTC TTTTACGGCA CCTGCATCGC CGTCAATATC

1201  CTGGTTTTGT CCAAACACAA AGACAATACC GACATCCAAT TCATCGACGC

1251  AAGCGGCTTC TTTAAAAAAG AAACCAACAA CAACGTCTTA ACCGAAGAAC

1301  ACATTGCCGA AATCGTCAAA CTCTTCGCCG ACAAAGCCGA TGTGCCGCAT

1351  ATCGCCCAAA ACGCCGCCCA GCAAACCGTC AAAGACAACG GCTACAACCT

1401  CGCCGTCAGC AGCTATGTCG AAGCCGAAGA CACCCGCGAG GTCATCGACA

1451  TCAGACAGCT CAACGCCGAA ATCAGCGAAA CCgtcgCcaa AATCGAACGG

1501  CTGCGGCGTG AAATTGACGA AGTGATTGCA GAGATTGAAA CCTAG
```

This corresponds to the amino acid sequence <SEQ ID 1908; ORF 605.ng>:

```
g605.pep
   1  MMTEMQQRAQ LHRQIWKIAD EVRGAVDGWD FKQYVLGTLF YRFISENFTD

51  YMQAGDSSID YAAMPDSIIT PEIKDDAVKV KGYFIYPGQL FCNIAAEAHQ

101  NEELNTKLKE IFTAIESSAS GYPSEQGIKG LFDDFDTTSS RLGSTVADKN

151  KRLAAVLKGV AELDFGNFED HRIDLFGDAY EYLISNYAAN AGKSGGEFFT

201  PQSVSKLIAR LAVHGQEKVN KIYDPACGSG SLLLQAKKQF DEHIIEEGFF

251  GQEINHTTYN LARMNMFLHN VNYNKFHIEL GDTLTNPKLK DSKPFDAVVS

301  NPPYSIDWIG SDDPTLINDD RFAPAGVLAP KSKADFAFIL HALNYLSGRG

351  RAAIVSFPGI FYRGGAEQKI RQYLVEGNYV ETVIALAPNL FYGTCIAVNI

401  LVLSKHKDNT DIQFIDASGF KKETNNNVL TEEHIAEIVK LFADKADVPH

451  IAQNAAQQTV KDNGYNLAVS SYVEAEDTRE VIDIRQLNAE ISETVAKIER

501  LRREIDEVIA EIET*
```

The following partial DNA sequence was identified in *N. meningitidis* <SEQ ID 1909>:

```
m605.seq
   1  ATGATGACCG AAATGCAACA ACGCGCCCAA CTGCACCGCC AAATTTGGAA

51  AATTGCCGAC GAAGTACGCG GCGCGGTGGA TGGCTGGGAC TTTAAACAAT

101  ACGTTCTCGG CACACTTTTC TACCGCTTTA TCAGCGAAAA CTTCACCGAC

151  TATATGCAGG CAGGCGACAG CAGTATTGAT TACGCCGCTA TGCCGGACAG

201  CATCATCACG CCCGAAATCA AGACGATGC CGTCAAAGTT AAAGGCTATT

251  TCATCTACCC CGGCCAGCTT TTTTGCAATA TTGCCGCCGA AGCCCATCAA

301  AACGAAGAGC TCAACACCAA GCTGAAAGAA ATTTTTACCG CGATTGAAAG
```

-continued

```
 351 CTCCGCCTCC GGCTATCCGT CCGAACAGGA CATCAAAGGC CTGTTTGACG
 401 ACTTCGACAC CACCAGCAGC CGGCTCGGCA GCACTGTTGC CGACAAGAAC
 451 AAACGCCTTG CCGCCGTCCT CAAAGGCGTG GCGGAACTCG ATTTCGGCAA
 501 TTTTGAAAAC CACCACATCG ACCTTTTCGG CGATGCCTAC GAATACCTGA
 551 TTTCCAACTA CGCTGCCAAC GCAGGCAAAT CCGGCGGCGA ATTTTTCACC
 601 CCGCAAAGCG TATCCAAGCT GATTGCGCGG CTGGCGGTGC ACGGACAGGA
 651 GAAAGTCAAC AAAATCTACG ACCCAGCTTG CGGCTCGGGC AGTCTGCTCT
 701 TGCAGGCGAA AAAACAGTTT GACGAGCACA TCATCGAAGA AGGCTTCTTC
 751 GGGCAGGAAA TCAACCACAC CACCTACAAC CTCGCCCGCA TGAACATGTT
 801 CCTGCACAAC GTCAATTACA ACCAATTCCA CATCGAATTG GGCGACACAC
 851 TGACCAACCC AAAGCTCAAA GACAGCAAAC CCTTTGATGC CATCGTTTCC
 901 AATCCGCCTT ATTCCATCAA CTGGATAGGC AGCGACGACC CCACCTTAAT
 951 CAACGACGAC CGCTTTGCCC CCGCAGGCGT ACTTGCCCCG AAATCCAAAG
1001 CCGATTTTGC CTTCATCCTG CACGCACTGA ACTACCTTTC CGGCAGAGGC
1051 CGCGCCGCCA TCGTCTCATT CCCCGGCATT TTCTATCGCG GCGGCGCAGA
1101 ACAGAAAATC CGCCAATATC TGGTGGAGGG CAACTACGTG AAACCGTGA
1151 TTGCCCTTGC GCCCAATCTC TTTTACGGCA CCGGCATCGC CGTCAATATC
1201 CTGGTTTTGT CCAAACACAA AGACAATACC GACATCCAAT TCATCGACGC
1251 AAGCGGCTTC TTTAAAAAAG AAACCAACAA CAACGTCTTA ATCGAAGAAC
1301 ACATTGCTGA AATCGTCAAA CTCTTCGCCG ATAAAGCCGA TGTGCCGCAT
1351 ATCGCCCAAA ACGCTGCCCA GCAAACCGTC AAAGACAACG GCTACAACCT
1401 CGCCGTCAGC AGCTATGTCG AAGCCGAAGA CACACGCGAA ATTATCGACA
1451 TCAAACAGCT CAACGCCGAA ATCGGCGAAA CCGTCGCCAA AATCGAACGG
1501 CTGCGGCGTG AAATTGACGA AGTGATTGCA GAGATTGAAG CATGA
```

40

This corresponds to the amino acid sequence <SEQ ID 1910; ORF 605>:

```
m605.pep
   1 MMTEMQQRAQ LHRQIWKIAD EVRGAVDGWD FKQYVLGTLF YRFISENFTD

51 YMQAGDSSID YAAMPDSIIT PEIKDDAVKV KGYFIYPGQL FCNIAAEAHQ

101 NEELNTKLKE IFTAIESSAS GYPSEQDIKG LFDDFDTTSS RLGSTVADKN

151 KRLAAVLKGV AELDFGNFEN HHIDLFGDAY EYLISNYAAN AGKSGGEFFT

201 PQSVSKLIAR LAVHGQEKVN KIYDPACGSG SLLLQAKKQF DEHIIEEGFF

251 GQEINHTTYN LARMNMFLHN VNYNQFHIEL GDTLTNPKLK DSKPFDAIVS

301 NPPYSINWIG SDDPTLINDD RFAPAGVLAP KSKADFAFIL HALNYLSGRG

351 RAAIVSFPGI FYRGGAEQKI RQYLVEGNYV ETVIALAPNL FYGTGIAVNI

401 LVLSKHKDNT DIQFIDASGF FKKETNNNVL IEEHIAEIVK LFADKADVPH

451 IAQNAAQQTV KDNGYNLAVS SYVEAEDTRE IIDIKQLNAE IGETVAKIER

501 LRREIDEVIA EIEA*
```

Computer analysis of this amino acid sequence gave the following results:
Homology with a Predicted ORF from *N. gonorrhoeae*
ORF 605 shows 97.9% identity over a 513 aa overlap with a predicted ORF (ORF 605.ng) from *N. gonorrhoeae*:

```
m605/g605
                    10         20         30         40         50         60
    m605.pep  MMTEMQQRAQLHRQIWKIADEVRGAVDGWDFKQYVLGTLFYRFISENFTDYMQAGDSSID
              ||||||||||||||||||||||||||||||||||||||||||||||||||||||||||||
        g605  MMTEMQQRAQLHRQIWKIADEVRGAVDGWDFKQYVLGTLFYRFISENFTDYMQAGDSSID
                    10         20         30         40         50         60

70         80         90        100        110        120
    m605.pep  YAAMPDSIITPEIKDDAVKVKGYFIYPGQLFCNIAAEAHQNEELNTKLKEIFTAIESSAS
              ||||||||||||||||||||||||||||||||||||||||||||||||||||||||||||
        g605  YAAMPDSIITPEIKDDAVKVKGYFIYPGQLFCNIAAEAHQNEELNTKLKEIFTAIESSAS
                    70         80         90        100        110        120

130        140        150        160        170        180
    m605.pep  GYPSEQDIKGLFDDFDTTSSRLGSTVADKNKRLAAVLKGVAELDFGNFENHHIDLFGDAY
              ||||||  ||||||||||||||||||||||||||||||||||||||||||:|:||||||
        g605  GYPSEQGIKGLFDDFDTTSSRLGSTVADKNKRLAAVLKGVAELDFGNFEDHRIDLFGDAY
                   130        140        150        160        170        180

190        200        210        220        230        240
    m605.pep  EYLISNYAANAGKSGGEFFTPQSVSKLIARLAVHGQEKVNKIYDPACGSGSLLLQAKKQF
              ||||||||||||||||||||||||||||||||||||||||||||||||||||||||||||
        g605  EYLISNYAANAGKSGGEFFTPQSVSKLIARLAVHGQEKVNKIYDPACGSGSLLLQAKKQF
                   190        200        210        220        230        240

250        260        270        280        290        300
    m605.pep  DEHIIEEGFFGQEINHTTYNLARMNMFLHNVNYNQFHIELGDTLTNPKLKDSKPFDAIVS
              ||||||||||||||||||||||||||||||||||||:|||||||||||||||:|||::||
        g605  DEHIIEEGFFGQEINHTTYNLARMNMFLHNVNYNKFHIELGDTLTNPKLKDSXPFDAVVS
                   250        260        270        280        290        300

310        320        330        340        350        360
    m605.pep  NPPYSINWIGSDDPTLINDDRFAPAGVLAPKSKADFAFILHALNYLSGRGRAAIVSFPGI
              ||||||:|||||||||||||||||||||||||||||||||||||||||||||||||||||
        g605  NPPYSIDWIGSDDPTLINDDRFAPAGVLAPKSKADFAFILHALNYLSGRGRAAIVSFPGI
                   310        320        330        340        350        360

370        380        390        400        410        420
    m605.pep  FYRGGAEQKIRQYLVEGNYVETVIALAPNLFYGTGIAVNILVLSKHKDNTDIQFIDASGF
              |||||||||||||||||||||||||||||||| |||||||||||||||||||||||||||
        g605  FYRGGAEQKIRQYLVEGNYVETVIALAPNLFYGTCIAVNILVLSKHKDNTDIQFIDASGF
                   370        380        390        400        410        420

430        440        450        460        470        480
    m605.pep  FKKETNNNVLIEEHIAEIVKLFADKADVPHIAQNAAQQTVKDNGYNLAVSSYVEAEDTRE
              |||||||||| |||||||||||||||||||||||||||||||||||||||||||||||||
        g605  FKKETNNNVLTEEHIAEIVKLFADKADVPHIAQNAAQQTVKDNGYNLAVSSYVEAEDTRE
                   430        440        450        460        470        480

490        500        510
    m605.pep  IIDIKQLNAEIGETVAKIERLRREIDEVIAEIEAX
              :|||:||||||:|||||||||||||||||||||:
        g605  VIDIRQLNAEISETVAKIERLRREIDEVIAEIETX
                   490        500        510
```

The following partial DNA sequence was identified in *N. meningitidis* <SEQ ID 1911>:

```
a605.seq
     1    ATGATGACCG AAATACAACA ACGCGCCCAA CTGCACCGCC AAATTTGGAA

51    AATTGCCGAC GAAGTACGCG GCGCGGTGGA TGGCTGGGAC TTCAAACAAT

101    ACGTTCTCGG CACACTTTTC TACCGCTTTA TCAGCGAAAA CTTTACCGAC

151    TATATGCAGG CAGGCGACAG CAGTATTGAT TACGCCGCTA TGCCGGACAG

201    CATCATCACG CCCGAAATCA AGACGATGC CGTCAAAGTC AAAGGCTATT

251    TCATCTACCC CGGCCAGCTT TTTTGCAATA TTGCCGCCGA AGCCCATCAA

301    AACGAAGAGC TCAACACCAA GCTGAAAGAA ATTTTTACCG CGATTGAAAG

351    CTCCGCCTCC GGCTATCCGT CCGAACAAGA CATTAAAGGC CTGTTTGACG

401    ACTTCGACAC CACCAGCAGC CGGCTCGGCA GCACCGTTGC CGACAAGAAC

451    AAACGCCTTG CCGCCGTCCT AAAAGGCGTG GCGGAACTCG ATTTCGGCAG
```

-continued

```
 501  TTTTGAAGAC CACCACATCG ACCTTTTCGG CGATGCCTAC GAATACCTGA
 551  TTTCCAACTA CGCTGCCAAC GCAGGCAAAT CCGGCGGCGA ATTTTTCACC
 601  CCGCAAAGCG TATCCAAGCT GATTGCGCGG CTGGCGGTGC ACGGGCAGGA
 651  GAAAGTAAAC AAAATCTACG ACCCAGCTTG CGGCTCGGGC AGCCTGCTCT
 701  TGCAGGCGAA AAAACAGTTT GACGAGCACA TCATCGAAGA AGGCTTCTTC
 751  GGGCAGGAAA TCAACCACAC CACCTACAAC CTCGCCCGCA TGAATATGTT
 801  TCTGCACAAC GTCAATTACA ACAAATTCCA CATCGAATTG GGCGACACAC
 851  TGACCAATCC CAAACTCAAA GACAGCAAAC CCTTTGATGC CGTCGTTTCC
 901  AATCCGCCCT ATTCCATCAA CTGGATAGGC AGCGGCGACC CCACCTTAAT
 951  CAACGACGAC CGCTTTGCCC CTGCAGGCGT ACTCGCCCCG AAATCCAAAG
1001  CCGATTTTGC CTTCATTCTG CACGCACTGA ACTACCTTTC CGGCAGAGGC
1051  CGCGCCGCCA TCGTCTCATT CCCCGGCATT TTCTATCGCG GCGGCGCAGA
1101  GCAGAAAATC CGCCAATATC TGGTGGAGGG CAACTACGTG GAAACCGTCA
1151  TCGCCCTTGC GCCCAATCTC TTTTACGGCA CCGGCATCGC CGTCAATATA
1201  CTGGTTTTGT CCAAACACAA AGACAATACC GACATCCAAT TCATCGACGC
1251  AGGCGGCTTC TTTAAAAAAG AAACCAACAA CAACGTCTTA ACCGAAGAAC
1301  ACATTGCCGA AATCGTCAAA CTCTTCGCCG ATAAAGCCGA TGTGCCGCAT
1351  ATCGCCCAAA ACGCCGCCCA GCAAACCGTC AAAGACAACG GCTACAACCT
1401  CGCCGTCAGC AGCTATGTTG AACCCGAAGA CACCCGCGAA ATTATCGACA
1451  TCAAACAGCT TAACGCCGAA ATCAGCGAAA CCGTTGCCAA AATCGAACGG
1501  CTGCGGCGTG AAATTGACGA AGTGATTGCA GAGATTGAAG CATGA
```

This corresponds to the amino acid sequence <SEQ ID 1912; ORF 605.a>:

```
a605.pep
   1  MMTEIQQRAQ LHRQIWKIAD EVRGAVDGWD FKQYVLGTLF YRFISENFTD
  51  YMQAGDSSID YAAMPDSIIT PEIKDDAVKV KGYFIYPGQL FCNIAAEAHQ
 101  NEELNTKLKE IFTAIESSAS GYPSEQDIKG LFDDFDTTSS RLGSTVADKN
 151  KRLAAVLKGV AELDFGSFED HHIDLFGDAY EYLISNYAAN AGKSGGEFFT
 201  PQSVSKLIAR LAVHGQEKVN KIYDPACGSG SLLLQAKKQF DEHIIEEGFF
 251  GQEINHTTYN LARMNMFLHN VNYNKFHIEL GDTLTNPKLK DSKPFDAVVS
 301  NPPYSINWIG SGDPTLINDD RFAPAGVLAP KSKADFAFIL HALNYLSGRG
 351  RAAIVSFPGI FYRGGAEQKI RQYLVEGNYV ETVIALAPNL FYGTGIAVNI
 401  LVLSKHKDNT DIQFIDAGGF FKKETNNNVL TEEHIAEIVK LFADKADVPH
 451  IAQNAAQQTV KDNGYNLAVS SYVEPEDTRE IIDIKQLNAE ISETVAKIER
 501  LRREIDEVIA EIEA*
``` m605/a605 98.1% identity in 514 aa overlap

```
                 10         20         30         40         50         60
m605.pep  MMTEMQQRAQLHRQIWKIADEVRGAVDGWDFKQYVLGTLFYRFISENFTDYMQAGDSSID
          ||||:|||||||||||||||||||||||||||||||||||||||||||||||||||||||
a605      MMTEIQQRAQLHRQIWKIADEVRGAVDGWDFKQYVLGTLFYRFISENFTDYMQAGDSSID
                 10         20         30         40         50         60
```

```
             70         80         90        100        110        120
m605.pep  YAAMPDSIITPEIKDDAVKVKGYFIYPGQLFCNIAAEAHQNEELNTKLKEIFTAIESSAS
          ||||||||||||||||||||||||||||||||||||||||||||||||||||||||||||
a605      YAAMPDSIITPEIKDDAVKVKGYFIYPGQLFCNIAAEAHQNEELNTKLKEIFTAIESSAS
             70         80         90        100        110        120

130        140        150        160        170        180
m605.pep  GYPSEQDIKGLFDDPDTTSSRLGSTVADKNKRLAAVLKGVAELDFGNFENHHIDLFGDAY
          |||||||||||||||||||||||||||||||||||||||||||||:|||||||||||||
a605      GYPSEQDIKGLFDDPDTTSSRLGSTVADKNKRLAAVLKGVAELDFGSFEDHHIDLFGDAY
            130        140        150        160        170        180

190        200        210        220        230        240
m605.pep  EYLISNYAANAGKSGGEFFTPQSVSKLIARLAVHGQEKVNKIYDPACGSGSLLLQAKKQF
          ||||||||||||||||||||||||||||||||||||||||||||||||||||||||||||
a605      EYLISNYAANAGKSGGEFFTPQSVSKLIARLAVHGQEKVNKIYDPACGSGSLLLQAKKQF
            190        200        210        220        230        240

250        260        270        280        290        300
m605.pep  DEHIIEEGFFGQEINHTTYNLARMNMFLHNVNYNQFHIELGDTLTNPKLKDSKPFDAIVS
          |||||||||||||||||||||||||||||||||||:|||||||||||||||||||:||
a605      DEHIIEEGFFGQEINHTTYNLARMNMFLHNVNYNKFHIELGDTLTNPKLKDSKPFDAVVS
            250        260        270        280        290        300

310        320        330        340        350        360
m605.pep  NPPYSINWIGSDDPTLINDDRFAPAGVLAPKSKADFAFILHALNYLSGRGRAAIVSFPGI
          |||||||||||:||||||||||||||||||||||||||||||||||||||||||||||||
a605      NPPYSINWIGSGDPTLINDDRFAPAGVLAPKSKADFAFILHALNYLSGRGRAAIVSFPGI
            310        320        330        340        350        360

370        380        390        400        410        420
m605.pep  FYRGGAEQKIRQYLVEGNYVETVIALAPNLFYGTGIAVNILVLSKHKDNTDIQFIDASGF
          |||||||||||||||||||||||||||||||||||||||||||||||||||||||||:||
a605      FYRGGAEQKIRQYLVEGNYVETVIALAPNLFYGTGIAVNILVLSKHKDNTDIQFIDAGGF
            370        380        390        400        410        420

430        440        450        460        470        480
m605.pep  FKKETNNNVLIEEHIAEIVKLFADKADVPHIAQNAAQQTVKDNGYNLAVSSYVEAEDTRE
          ||||||||||| |||||||||||||||||||||||||||||||||||||||||||| |||
a605      FKKETNNNVLTEEHIAEIVKLFADKADVPHIAQNAAQQTVKDNGYNLAVSSYVEPEDTRE
            430        440        450        460        470        480

490        500        510
m605.pep  IIDIKQLNAEIGETVAKIERLRREIDEVIAEIEAX
          ||||||||||:||||||||||||||||||||||||
a605      IIDIKQLNAEISETVAKIERLRREIDEVIAEIEAX
            490        500        510
```

The following partial DNA sequence was identified in *N. gonorrhoeae* <SEQ ID 1913>:

```
g606.seq
    1  ATGTCCAAAT TTATCGCCAA ACAATCGGTC GGTGCGGAAG TCATCGACAC

51  GCCGcgCACC GAAGAAGAAG CCTGGCTTCT GAACACTGTC GAAGCCCAAg 101  cgcGGCAATG GAATCTGAAA ACGCCAGAAG TCGCCATCTA CCACTCCCCC

151  GAACCCAATG CCTTTGCCAC GGGCGCATCG AGAAACAGCT CCCTGATCGC

201  CGTCAGCacc ggtttgctcg accaTAtgaC GCGCGACgaa gtggaagccg 251  tgTTGGCGCA CGAAATGGCG CACGTCGGCA ACGGCGACAT GGTTACGCTG 301  ACGCTGAtTC AAGGCGTGGT CAATACCTTT GTCGTGTTCC TGTCGCGCAT

351  TATTGCCAAC CTGATTGCCC GAAACAACGA CGGCAGCCAG TCCCAGGGAA

401  CTTATTTCCT AGTCAGCATG GTATTCCAAA TCCTGTTCGG CTTCCTTGCC

451  AGCCTGATTG TCATGTGGTT CAGCCGCCAA CGCGAATACC GCGCCGAcgc 501  gggCGcggCA AAACTGGTCG GCGCACCGAA AATGATTTCC GCCCTGCAAA

551  GGCTTAAAGG CAACCCGGTC GATTTGCCCG AAGAAATGAA CGCAATGGGC

601  ATCGCCGGAG ATACGCGCGA CTCCCTGCTC AGCACCCACC CTTCGCTGGA

651  CAACCGAATC GCCCGCCTCA AATCGCTTTA A
```

This corresponds to the amino acid sequence <SEQ ID 1914; ORF606.ng>:

```
g606.pep
     1   MSKFIAKQSV GAEVIDTPRT EEEAWLLNTV EAQARQWNLK TPEVAIYHSP

51   EPNAFATGAS RNSSLIAVST GLLDHMTRDE VEAVLAHEMA HVGNGDMVTL

101   TLIQGVVNTF VVFLSRIIAN LIARNNDGSQ SQGTYFLVSM VFQILFGFLA

151   SLIVMWFSRQ REYRADAGAA KLVGAPKMIS ALQRLKGNPV DLPEEMNAMG

201   IAGDTRDSLL STHPSLDNRI ARLKSL*
```

The following partial DNA sequence was identified in *N. meningitidis* <SEQ ID 1915>:

```
m606.seq
     1   ATGTCCAAAT TTATCGCCAA ACAATCGGTC GGCGCGGAAG TTATCGACAC

51   GCCGCGCACC GAAGAAGAAG CCTGGCTTTT GAACACTGTC GAAGCCCAAG

101   CGCGGCAATG GAACCTGAAA ACGCCCGAAG TCGCCATCTA CCACTCCCCC

151   GAACCCAATG CCTTTGCCAC GGGCGCATCG AGAAACAGCT CCCTGATCGC

201   CGTCAGCACC GGTTTGCTCG ACCATATGAC GCGTGACGAA GTGGAAGCCG

251   TATTGGCGCA CGAAATGGCA CACGTCGGCA ACGGCGATAT GGTTACGCTG

301   ACGCTGATTC AAGGCGTGGT CAATACCTTT GTCGTGTTCC TGTCGCGCAT

351   TATTGCCAAC CTGATTGCCC GAAACAACGA CGGCAGCCAG TCCCAGGGAA

401   CTTATTTCCT GGTCAGCATG GTATTCCAAA TCCTGTTCGG CTTCCTTGCC

451   AGCTTAATTG TCATGTGGTT CAGCCGACAA CGCGAATACC GCGCCGATGC

501   GGGCGCGGCA AAACTGGTCG GCGCGCCGAA AATGATTTCC GCCCTGCAAA

551   GGCTCAAAGG CAACCCGGTC GATTTGCCCG AAGAAATGAA CGCAATGGGC

601   ATCGCCGGAG ATACGCGCGA CTCCCTGCTC AGCACCCACC CTTCGCTGGA

651   CAACCGTATC GCCCGCCTCA AATCGCTTTA A
```

This corresponds to the amino acid sequence <SEQ ID 1916; ORF 606>:

```
m606.pep
     1   MSKFIAKQSV GAEVIDTPRT EEEAWLLNTV EAQARQWNLK TPEVAIYHSP

51   EPNAFATGAS RNSSLIAVST GLLDHMTRDE VEAVLAHEMA HVGNGDMVTL

101   TLIQGVVNTF VVFLSRIIAN LIARNNDGSQ SQGTYFLVSM VFQILFGFLA

151   SLIVMWFSRQ REYRADAGAA KLVGAPKMIS ALQRLKGNPV DLPEEMNAMG

201   IAGDTRDSLL STHPSLDNRI ARLKSL*
```

Computer analysis of this amino acid sequence gave the following results:

Homology with a Predicted ORF from *N. gonorrhoeae*

ORF 606 shows 100.0% identity over a 225 aa overlap with a predicted ORF (ORF 606.ng) from *N. gonorrhoeae*:

```
m606/g606
                   10        20        30        40        50        60
m606.pep   MSKFIAKQSVGAEVIDTPRTEEEAWLLNTVEAQARQWNLKTPEVAIYHSPEPNAFATGAS
           ||||||||||||||||||||||||||||||||||||||||||||||||||||||||||||
g606       MSKFIAKQSVGAEVIDTPRTEEEAWLLNTVEAQARQWNLKTPEVAIYHSPEPNAFATGAS
                   10        20        30        40        50        60
```

```
             70         80         90        100        110        120
m606.pep  RNSSLIAVSTGLLDHMTRDEVEAVLAHEMAHVGNGDMVTLTLIQGVVNTFVVFLSRIIAN
          ||||||||||||||||||||||||||||||||||||||||||||||||||||||||||||
g606      RNSSLIAVSTGLLDHMTRDEVEAVLAHEMAHVGNGDMVTLTLIQGVVNTFVVFLSRIIAN
             70         80         90        100        110        120

130        140        150        160        170        180
m606.pep  LIARNNDGSQSQGTYFLVSMVFQILFGFLASLIVMWFSRQREYRADAGAAKLVGAPKMIS
          ||||||||||||||||||||||||||||||||||||||||||||||||||||||||||||
g606      LIARNNDGSQSQGTYFLVSMVFQILFGFLASLIVMWFSRQREYRADAGAAKLVGAPKMIS
            130        140        150        160        170        180

190        200        210        220
m606.pep  ALQRLKGNPVDLPEEMNAMGIAGDTRDSLLSTHPSLDNRIARLKSLX
          |||||||||||||||||||||||||||||||||||||||||||||||
g606      ALQRLKGNPVDLPEEMNAMGIAGDTRDSLLSTHPSLDNRIARLKSLX
            190        200        210        220
```

The following partial DNA sequence was identified in *N. meningitidis* <SEQ ID 1917>:

```
a606.seq
    1   ATGTCCAAAT TCATCGCCAA ACAATCGGTC GGCGCGGAAG TTATCGACAC

51   GCCGCGCACC GAAGAAGAAG CCTGGCTTTT GAACACTGTC GAAGCCCAAG

101   CGCGGCAATG GAACCTGAAA ACGCCCGAAG TCGCCATCTA CCACTCCCCC

151   GAACCCAATG CCTTTGCCAC GGGCGCATCG AGAAACAGCT CCCTGATCGC

201   CGTCAGCACC GGTTTGCTCG ACCATATGAC GCGTGACGAA GTGGAAGCCG

251   TATTGGCGCA CGAAATGGCA CACGTCGGCA ACGGCGATAT GGTTACGCTG

301   ACGCTGATTC AAGGCGTGGT CAATACCTTT GTCGTGTTCC TGTCGCGCAT

351   TATTGCCAAC CTGATTGCCC GAAACAACGA CGGCAGCCAG TCCCAGGGAA

401   CTTATTTCCT GGTCAGCATG GTATTCCAAA TCCTGTTCGG CTTCCTTGCC

451   AGCTTAATTG TCATGTGGTT CAGCCGACAA CGCGAATACC GCGCCGACGC

501   GGGCGCGGCA AAACTGGTCG GCGCGCCGAA AATGATTTCC GCCCTGCAAA

551   GGCTTAAAGG CAACCCGGTC GATTTGCCCG AAGAAATGAA CGCAATGGGC

601   ATCGCCGGAG ATACGCGCGA CTCCCTGCTC AGCACCCACC CTTCGCTGGA

651   CAACCGAATC GCCCGCCTCA AATCGCTTTA A
                                           45
```

This corresponds to the amino acid sequence <SEQ ID 1918; ORF 606.a>:

```
a606.pep
    1   MSKFIAKQSV GAEVIDTPRT EEEAWLLNTV EAQARQWNLK TPEVAIYHSP

51   EPNAFATGAS RNSSLIAVST GLLDHMTRDE VEAVLAHEMA HVGNGDMVTL

101   TLIQGVVNTF VVFLSRIIAN LIARNNDGSQ SQGTYFLVSM VFQILFGFLA

151   SLIVMWFSRQ REYRADAGAA KLVGAPKMIS ALQRLKGNPV DLPEEMNAMG

201   IAGDTRDSLL STHPSLDNRI ARLKSL*
``` m606/a606 100.0% identity in 226 aa overlap

```
              10         20         30         40         50         60
m606.pep  MSKFIAKQSVGAEVIDTPRTEEEAWLLNTVEAQARQWNLKTPEVAIYHSPEPNAFATGAS
          ||||||||||||||||||||||||||||||||||||||||||||||||||||||||||||
a606      MSKFIAKQSVGAEVIDTPRTEEEAWLLNTVEAQARQWNLKTPEVAIYHSPEPNAFATGAS
              10         20         30         40         50         60
```

```
                    70         80         90        100        110        120
m606.pep  RNSSLIAVSTGLLDHMTRDEVEAVLAHEMAHVGNGDMVTLTLIQGVVNTFVVFLSRIIAN
          ||||||||||||||||||||||||||||||||||||||||||||||||||||||||||||
a606      RNSSLIAVSTGLLDHMTRDEVEAVLAHEMAHVGNGDMVTLTLIQGVVNTFVVFLSRIIAN
                    70         80         90        100        110        120

130        140        150        160        170        180
m606.pep  LIARNNDGSQSQGTYFLVSMVFQILFGFLASLIVMWFSRQREYRADAGAAKLVGAPKMIS
          ||||||||||||||||||||||||||||||||||||||||||||||||||||||||||||
a606      LIARNNDGSQSQGTYFLVSMVFQILFGFLASLIVMWFSRQREYRADAGAAKLVGAPKMIS
                   130        140        150        160        170        180

190        200        210        220
m606.pep  ALQRLKGNPVDLPEEMNAMGIAGDTRDSLLSTHPSLDNRIARLKSLX
          |||||||||||||||||||||||||||||||||||||||||||||||
a606      ALQRLKGNPVDLPEEMNAMGIAGDTRDSLLSTHPSLDNRIARLKSLX
                   190        200        210        220
```

15

The following partial DNA sequence was identified in *N. gonorrhoeae* <SEQ ID 1919>:

```
g607.seq
    1  ATGCTGCTCG accTcgaCCG CTTTTCCTtt tccGTCTTCC TGAAAGAAAT
   51  CCGCCTGCTG ACCGCCCTTG CCCTGCCCAT GCTGTTGGCG CAGGTCGCGC
  101  AGGTGGGCAT CGGTTTCGTC GATACCGTGA TGGCGGGCGG TGCGGGCAAG
  151  GAAGATTTGG CGGCGGTGGC TTTGGGCAGC AGCGCGTTTG CCACGGTTTA
  201  TATTACCTTT ATGGGCATTA TGGCGGCGCT GAACCCGATG ATTGCCCAGC
  251  TTTACGGCGC GGGTAAAACC GgtgAAGCAG GCGAAACGGG GCGGCAGGGG
  301  ATTTGGTTCG GGCTGATTTT GGGGATTTTC GGCATGATTT TGATGTGGGC
  351  GGCGATTACG CCGTTCCGCA ACTGGCTGAC TTTGAGCGAT TATGTGGAAG
  401  gcacAAtggc gcAGTATATG CTGTTCACCA GCTTGGCGAT GCCGGCGGCA
  451  ATGGTACACC GCGCACTGCA CGCCTACGCT TCCAGCCTGA ACCGCCCGCG
  501  CCTGATTATG TTGGTCAGCT TTGCGGCGTT TGTGTTGAAC GTGCCGCTGA
  551  ACTATATTTT CGTTTACGGC AAATTCGGTA TGCCCGCTTT GGGTGGCGCA
  601  GGTTGCGGCG TGGCGACAAT GGCGGTGTTT TGGTTCAGCG CGCTGGCATT
  651  GTGGATTTAT ATCGCCAAGG AAAAATTCTT CCGCCCGTTC GGACTGACAG
  701  CGAAATTCGg caaACCGGat tGGgcGGTGT TCAAACAGAT TtGGAAAATC
  751  gGcgcgCCCA TCGGGCTGTC TTATTTTTTG GAAgccaGcg cGTTTTCGTT
  801  TATCGTGTTT TTGATTGCGC CTttcggCGA GGATTATGTG GCGGCGCAGC
  851  AGGTCGGCAT CAGTTTGTCG GGGATTCTCT ATATGATTCC GCAAAGCGTC
  901  GGCTCGGCAG GGACGGTGCG CATCGGCTTT TCGCTTGGGC GGCGCGAATT
  951  TTCGCGGGCG CGTTATATTT CAGGAGTGTC GCTGGTGTCG GGCTGGGTGC
 1001  TCGCCGTGAT TACCGTGCTT TCCTTGGTAT TATTCCGTTC GCCGCTGGCA
 1051  AGCATGTACA ACGATGaTCC GGCAGTTTTA AGCATCGCCT CCACCGTCCT
 1101  GCTGTTCGCC GGCCTGTtcc aACCGGCAGA CTTCACCCAA TGTATCGCGT
 1151  CCTATGCCCT GCGCGGCTAC AAAGTCACCA AGGTGCCGAT GTTCATCCAC
 1201  GCCGCCGCCT TCTGGGGCTG CGGCCTGCTG CCGGGCTATC TGCTCGCCTA
 1251  CCGTTTCGAT ATGGGCATTT ACGGCTTCTG GACGGCATTG ATTGCCTCGC
 1301  TCACCATCGC AGCCGTCGCC TTGGTGTGGT GCTTGGAAAA ATACAGTATG
 1351  GAGTTGGTCA AATCACACAA GGCCGTCTGA
```

This corresponds to the amino acid sequence <SEQ ID 1920; ORF 607.ng>:

```
g607.pep
     1   MLLDLDRFSF SVFLKEIRLL TALALPMLLA QVAQVGIGFV DTVMAGGAGK
    51   EDLAAVALGS SAFATVYITF MGIMAALNPM IAQLYGAGKT GEAGETGRQG
   101   IWFGLILGIF GMILMWAAIT PFRNWLTLSD YVEGTMAQYM LFTSLAMPAA
   151   MVHRALHAYA SSLNRPRLIM LVSFAAFVLN VPLNYIFVYG KFGMPALGGA
   201   GCGVATMAVF WFSALALWIY IAKEKFFRPF GLTAKFGKPD WAVFKQIWKI
   251   GAPIGLSYFL EASAFSFIVF LIAPFGEDYV AAQQVGISLS GILYMIPQSV
   301   GSAGTVRIGF SLGRREFSRA RYISGVSLVS GWVLAVITVL SLVLFRSPLA
   351   SMYNDDPAVL SIASTVLLFA GLFQPADFTQ CIASYALRGY KVTKVPMFIH
   401   AAAFWGCGLL PGYLLAYRFD MGIYGFWTAL IASLTIAAVA LVWCLEKYSM
   451   ELVKSHKAV*
```

The following partial DNA sequence was identified in *N. meningitidis* <SEQ ID 1921>:

```
m607.seq
     1   ATGCTGCTCG ACCTCAACCG CTTTTCCTTT CCCGTCTTCC TGAAAGAAGT
    51   CCGCCTGCTG ACCACTCTTG CCCTGCCCAT GCTGTTGGCG CAGGTCGCGC
   101   AGGTGGGCAT CGGTTTTGTC GATACTGTGA TGGCGGGCGG TGCGGGCAAG
   151   GAAGACTTGG CGGCGGTGGC TTTGGGCAGC AGCGCGTTTG CCACGGTTTA
   201   TATTACCTTT ATGGGCATTA TGGCGGCGCT GAACCCGATG ATTGCCCAGC
   251   TTTACGGCGC GGGTAAAACC GACGAAGTGG GCGAAACGGG GCGGCAGGGG
   301   ATTTGGTTCG GGCTGTTTTT GGGCGTGTTC GGCATGGTCT TGATGTGGGC
   351   GGCGATTACG CCGTTCCGCA ACTGGCTGAC CTTGAGCGAT TATGTGGAAG
   401   GCACGATGGC GCAGTATATG TTGTTCACCA GCTTGGCGAT GCCGGCGGCA
   451   ATGGTACACC GCGCGCTGCA CGCCTACACT TCCAGCCTGA ACCGCCCGCG
   501   CCTGATTATG TTGGTCAGCT TTGCGGCGTT TGTGTTGAAC GTGCCGCTGA
   551   ACTATATTTT CGTTTACGGC AAATTCGGTA TGCCCGCTTT GGGCGGCGCA
   601   GGCTGCGGAC TGGCGACGAT GGCGGTGTTT TGGTTCAGCG CGCTGGCATT
   651   GTGGATTTAT ATCGCCAAGG AAAATTTCTT CCGCCCATTC GGACTGACGG
   701   CGAAATTCGG CAAACCGGAT TGGGCGGTGT TCAAACAGAT TTGGAAAATC
   751   GGCGCACCCA TCGGGCTGTC TTATTTTTTG GAAGCCAGCG CGTTTTCGTT
   801   TATCGTGTTT TTGATTGCGC CTTTCGGCGA GGATTATGTG GCGGCGCAGC
   851   AGGTCGGCAT CAGTTTGTCG GGGATTCTCT ATATGATTCC GCAAAGCGTC
   901   GGCTCGGCGG GGACGGTGCG CATCGGCTTT TCGCTTGGGC GGCGCGAATT
   951   TTCGCGGGCG CGTTATATTT CGGGCGTGTC ACTGGTGTTA GGATGGATGC
  1001   TCGCCGTGAT TACCGTGCTT TCCTTGGTAT TATTCCGTTC GCCGCTGGTA
  1051   AGTATGTACA ACAATGATCC GGCGGTTTTA AGCATCGCCG CCACCGTCTT
  1101   ACTGTTCGCC GGCTTGTTCC AACCGGCAGA CTTCACCCAA TGTATCGCCT
  1151   CCTACGCCTT GCGCGGCTAC AAAGTTACAA AGGTGCCGAT GTTCATCCAC
  1201   GCCGCCGCCT TTTGGGGCTG CGGCCTGCTG CCGGGCTATC TGCTCGCCTA
```

```
-continued
1251  CCGTTTCAAT ATGGGCATTT ACGGCTTCTG GACGGCATTG ATTGCCTCGC

1301  TCACCATCGC CGCCATCGCC TTGGTGTGGT GCTTGGAATT GTGCAGTAGG

1351  GAGATGGTCA GATCGCATAA GGCCGTCTGA
```

This corresponds to the amino acid sequence <SEQ ID 1922; ORF 607>:

```
m607.pep
    1   MLLDLNRFSF PVFLKEVRLL TTLALPMLLA QVAQVGIGFV DTVMAGGAGK

51   EDLAAVALGS SAFATVYITF MGIMAALNPM IAQLYGAGKT DEVGETGRQG

101   IWFGLFLGVF GMVLMWAAIT PFRNWLTLSD YVEGTMAQYM LFTSLAMPAA

151   MVHRALHAYT SSLNRPRLIM LVSFAAFVLN VPLNYIFVYG KFGMPALGGA

201   GCGLATMAVF WFSALALWIY IAKENFFRPF GLTAKFGKPD WAVFKQIWKI

251   GAPIGLSYFL EASAFSFIVF LIAPFGEDYV AAQQVGISLS GILYMIPQSV

301   GSAGTVRIGF SLGRREFSRA RYISGVSLVL GWMLAVITVL SLVLFRSPLV

351   SMYNNDPAVL SIAATVLLFA GLFQPADFTQ CIASYALRGY KVTKVPMFIH

401   AAAFWGCGLL PGYLLAYRFN MGIYGFWTAL IASLTIAAIA LVWCLELCSR

451   EMVRSHKAV*
```

Computer analysis of this amino acid sequence gave the following results:
Homology with a Predicted ORF from *N. gonorrhoeae*
ORF 607 shows 94.8% identity over a 459 aa overlap with a predicted ORF (ORF 607.ng) from *N. gonorrhoeae*:

```
    m607/g607
                      10         20         30         40         50         60
    m607.pep  MLLDLNRFSFPVFLKEVRLLTTLALPMLLAQVAQVGIGFVDTVMAGGAGKEDLAAVALGS
              |||||:||||  |||||:||||:||||||||||||||||||||||||||||||||||||
    g607      MLLDLDRFSFSVFLKEIRLLTALALPMLLAQVAQVGIGFVDTVMAGGAGKEDLAAVALGS
                      10         20         30         40         50         60

70         80         90        100        110        120
    m607.pep  SAFATVYITFMGIMAALNPMIAQLYGAGKTDEVGETGRQGIWFGLFLGVFGMVLMWAAIT
              ||||||||||||||||||||||||||||||| :||||||||||| |:||:|||:||||||
    g607      SAFATVYITFMGIMAALNPMIAQLYGAGKTGEAGETGRQGIWFGLILGFGMILMWAAIT
                      70         80         90        100        110        120

130        140        150        160        170        180
    m607.pep  PFRNWLTLSDYVEGTMAQYMLFTSLAMPAAMVHRALHAYTSSLNRPRLIMLVSFAAFVLN
              ||||||||||||||||||||||||||||||||||||||||:|||||||||||||||||||
    g607      PFRNWLTLSDYVEGTMAQYMLFTSLAMPAAMVHRALHAYASSLNRPRLIMLVSFAAFVLN
                     130        140        150        160        170        180

190        200        210        220        230        240
    m607.pep  VPLNYIFVYGKFGMPALGGAGCGLATMAVFWFSALALWIYIAKENFFRPFGLTAKFGKPD
              |||||||||||||||||||||:||||||||||||||||||||||:|||||||||||||||
    g607      VPLNYIFVYGKFGMPALGGAGCGVATMAVFWFSALALWIYIAKEKFFRPFGLTAKFGKPD
                     190        200        210        220        230        240

250        260        270        280        290        300
    m607.pep  WAVFKQIWKIGAPIGLSYFLEASAFSFIVFLIAPFGEDYVAAQQVGISLSGILYMIPQSV
              ||||||||||||||||||||||||||||||||||||||||||||||||||||||||||||
    g607      WAVFKQIWKIGAPIGLSYFLEASAFSFIVFLIAPFGEDYVAAQQVGISLSGILYMIPQSV
                     250        260        270        280        290        300

310        320        330        340        350        360
    m607.pep  GSAGTVRIGFSLGRREFSRARYISGVSLVLGWMLAVITVLSLVLFRSPLVSMYNNDPAVL
              ||||||||||||||||||||||||||||| ||:|||||||||||||||:||||:|||||
    g607      GSAGTVRIGFSLGRREFSRARYISGVSLVSGWVLAVITVLSLVLFRSPLASMYNDDPAVL
                     310        320        330        340        350        360

370        380        390        400        410        420
    m607.pep  SIAATVLLFAGLFQPADFTQCIASYALRGYKVTKVPMFIHAAAFWGCGLLPGYLLAYRFN
              |||:||||||||||||||||||||||||||||||||||||||||||||||||||||||:
    g607      SIASTVLLFAGLFQPADFTQCIASYALRGYKVTKVPMFIHAAAFWGCGLLPGYLLAYRFD
                     370        380        390        400        410        420
```

```
                       -continued
                 430        440        450        460
m607.pep    MGIYGFWTALIASLTIAAIALVWCLELCSREMVRSHKAVX
            ||||||||||||||||||:||||||   | |:|:||||||
g607        MGIYGFWTALIASLTIAAVALVWCLEKYSMELVKSHKAVX
                 430        440        450        460
```

The following partial DNA sequence was identified in *N. meningitidis* <SEQ ID 1923>:

```
a607.seq
    1   ATGCTGCTCG ACCTCAACCG CTTTTCCTTT TCCGTCTTCC TGAAAGAAGT
   51   CCGCCTGCTG ACCGCTCTTG CCCTGCCCAT GCTGTTGGCG CAGGTCGCGC
  101   AGGTGGGCAT CGGTTTTGTC GATACCGTGA TGGCGGGCGG TGCGGGCAAG
  151   GAAGACTTGG CGGCGGTGGC TTTGGGCAGC AGCGCGTTTG CCACGGTTTA
  201   TATTACCTTT ATGGGCATTA TGGCGGCGCT GAACCCGATG ATTGCCCAGC
  251   TTTACGGCGC GGGTAAAACC GACGAAGTGG GCGAAACGGG ACGGCAGGGG
  301   ATTTGGTTCG GCTGTTTTT GGGCGTGTTC GGCATGGTCT TGATGTGGGC
  351   GGCGATTACG CCGTTCCGCA ACTGGCTGAC CTTGAGCGAT TATGTGGAAG
  401   GCACAATGGC GCAGTATATG CTGTTCACCA GCTTGGCGAT GCCGGCGGCA
  451   ATGGTACACC GCGCACTGCA CGCCTACGCC TCCAGCCTGA ACCGCCCGCG
  501   CCTGATTATG TTGGTCAGCT TGCGGCGTT TGTGTTGAAC GTGCCGCTGA
  551   ACTATATTTT CGTTTACGGC AAATTCGGTA TGCCCGCTTT GGGCGGCGCA
  601   GGCTGCGGAC TGGCGACGAT GGCGGTGTTT TGGTTCAGCG CGCTGGCATT
  651   GTGGATTTAT ATCGCCAAGG AAAATTTCTT CCGCCCATTC GGACTGACGG
  701   CGAAATTCGG CAAACCGGAT TGGGCGGTGT TCAAACAGAT TTGGAAAATC
  751   GGCGCACCCA TCGGGCTGTC TTATTTTTTG GAAGCCAGCG CGTTTTCGTT
  801   TATCGTGTTT TTGATTGCGC CTTTCGGCGA GGATTATGTG GCGGCGCAGC
  851   AGGTCGGCAT CAGTTTGTCG GGGATTCTCT ATATGATTCC GCAAAGCGTC
  901   GGCTCGGCGG GGACGGTGCG CATCGGCTTT TCGCTTGGGC GGCGCGAATT
  951   TTCGCGGGCG CGTTATATTT CGGGCGTGTC ACTGGTGTCA GGATGGATGC
 1001   TCGCCGTGAT TACCGTGCTT TCCTTGGTAT TATTCCGTTC GCCGCTGGTA
 1051   AGTATGTACA ACAATGATCC GGCGGTTTTA AGCATCGCCG CCACCGTCTT
 1101   ACTGTTCGCC GGCTTGTTCC AACCGGCAGA CTTCACCCAA TGTATCGCCT
 1151   CCTACGCCTT GCGCGGCTAC AAAGTTACAA AGGTGCCGAT GTTCATCCAC
 1201   GCCGCCGCCT TTTGGGGCTG CGGTCTGCTG CCGGGCTACC TGCTCGCCTA
 1251   CCGTTTCGAT ATGGGCATTT ACGGCTTCTG GACGGCATTG ATTGCCTCGC
 1301   TCACCATCGC CGCCATCGCC TTGGTGTGGT GCTTGGAATT GTGCAGTAGG
 1351   GAGATGGTCA GATCGCATAA GGCTGTCTGA
```

This corresponds to the amino acid sequence <SEQ ID 1924; ORF 607.a>:

```
a607.pep
    1   MLLDLNRFSF SVFLKEVRLL TALALPMLLA QVAQVGIGFV DTVMAGGAGK
   51   EDLAAVALGS SAFATVYITF MGIMAALNPM IAQLYGAGKT DEVGETGRQG
  101   IWFGLFLGVF GMVLMWAAIT PFRNWLTLSD YVEGTMAQYM LFTSLAMPAA
```

```
151  MVHRALHAYA SSLNRPRLIM LVSFAAFVLN VPLNYIFVYG KFGMPALGGA

201  GCGLATMAVF WFSALALWIY IAKENFFRPF GLTAKFGKPD WAVFKQIWKI

251  GAPIGLSYFL EASAFSFIVF LIAPFGEDYV AAQQVGISLS GILYMIPQSV

301  GSAGTVRIGF SLGRREFSRA RYISGVSLVS GWMLAVITVL SLVLFRSPLV

351  SMYNNDPAVL SIAATVLLFA GLFQPADFTQ CIASYALRGY KVTKVPMFIH

401  AAAFWGCGLL PGYLLAYRFD MGIYGFWTAL IASLTIAAIA LVWCLELCSR

451  EMVRSHKAV*
``` m607/a607 98.9% identity in 459 aa overlap

```
                 10         20         30         40         50         60
m607.pep  MLLDLNRFSFPVFLKEVRLLTTLALPMLLAQVAQVGIGFVDTVMAGGAGKEDLAAVALGS
          ||||||||||  |||||||||| :|||||||||||||||||||||||||||||||||||
a607      MLLDLNRFSFSVFLKEVRLLTALALPMLLAQVAQVGIGFVDTVMAGGAGKEDLAAVALGS
                 10         20         30         40         50         60

70         80         90        100        110        120
m607.pep  SAFATVYITFMGIMAALNPMIAQLYGAGKTDEVGETGRQGIWFGLFLGVFGMVLMWAAIT
          ||||||||||||||||||||||||||||||||||||||||||||||||||||||||||||
a607      SAFATVYITFMGIMAALNPMIAQLYGAGKTDEVGETGRQGIWFGLFLGVFGMVLMWAAIT
                 70         80         90        100        110        120

130        140        150        160        170        180
m607.pep  PFRNWLTLSDYVEGTMAQYMLFTSLAMPAAMVHRALHAYTSSLNRPRLIMLVSFAAFVLN
          |||||||||||||||||||||||||||||||||||||||||:||||||||||||||||||
a607      PFRNWLTLSDYVEGTMAQYMLFTSLAMPAAMVHRALHAYASSLNRPRLIMLVSFAAFVLN
                130        140        150        160        170        180

190        200        210        220        230        240
m607.pep  VPLNYIFVYGKFGMPALGGAGCGLATMAVFWFSALALWIYIAKENFFRPFGLTAKFGKPD
          ||||||||||||||||||||||||||||||||||||||||||||||||||||||||||||
a607      VPLNYIFVYGKFGMPALGGAGCGLATMAVFWFSALALWIYIAKENFFRPFGLTAKFGKPD
                190        200        210        220        230        240

250        260        270        280        290        300
m607.pep  WAVFKQIWKIGAPIGLSYFLEASAFSFIVFLIAPFGEDYVAAQQVGISLSGILYMIPQSV
          ||||||||||||||||||||||||||||||||||||||||||||||||||||||||||||
a607      WAVFKQIWKIGAPIGLSYFLEASAFSFIVFLIAPFGEDYVAAQQVGISLSGILYMIPQSV
                250        260        270        280        290        300

310        320        330        340        350        360
m607.pep  GSAGTVRIGFSLGRREFSRARYISGVSLVLGWMLAVITVLSLVLFRSPLVSMYNNDPAVL
          |||||||||||||||||||||||||||||| |||||||||||||||||||||||||||||
a607      GSAGTVRIGFSLGRREFSRARYISGVSLVSGWMLAVITVLSLVLFRSPLVSMYNNDPAVL
                310        320        330        340        350        360

370        380        390        400        410        420
m607.pep  SIAATVLLFAGLFQPADFTQCIASYALRGYKVTKVPMFIHAAAFWGCGLLPGYLLAYRFN
          |||||||||||||||||||||||||||||||||||||||||||||||||||||||||||:
a607      SIAATVLLFAGLFQPADFTQCIASYALRGYKVTKVPMFIHAAAFWGCGLLPGYLLAYRFD
                370        380        390        400        410        420

430        440        450        460
m607.pep  MGIYGFWTALIASLTIAAIALVWCLELCSREMVRSHKAVX
          ||||||||||||||||||||||||||||||||||||||||
a607      MGIYGFWTALIASLTIAAIALVWCLELCSREMVRSHKAVX
                430        440        450        460
```

The following partial DNA sequence was identified in *N. gonorrhoeae* <SEQ ID 1925>:

```
g608.seq
      1  ATGTCCGCCC TCCTCCCCAT CATCAACCGC CTGATTCTGC AAAGCCCGGA

51  CAGCCGCTCG GAACTTACCT CCTTTGCAGG CAAAACACTG ACCCTGAACA

101  TTGCCGGGCT GAAACTGGCG GGACGCATCA CAGAAGACGG TTTGCTCTCG

151  GCGGGAAACG GCTTTGCAGA CACCGAAATT ACCTTCCGCA ACAGCGCGAT

201  ACGGAAAATC CTCCAAGGCG GCGAACCCGG GGCTGGCGAC ATCAGGCTCG

251  AAGGCGACCT CATCCTCGGC ATcGCGGGTAC TGTCCCTGCT CGGCAGCCTG

301  CGTTCCCGCG CATCGGacgA ATTGGCACGG ATTTTCGGCA CGCAGGCAGg
```

-continued

```
  351   catcggcagc CGTGCCACCG ACATCGGACA CGGCaTCaaa cAAATCGGCA

401   GGAACATCGC CGAACAAATC GGCGGATTTT CCCGCGAACC CGAGTCcgCa 451   aacaccggca acgaagccct tgccgactgc ctCGACGAAA TAAGCAGACT

501   GCGCGACGGC GTGGAACGCC TCAACGAACG CCTCGACAGG CTCGAACGCG

551   ACATTTGGAT AGACTAA
```

This corresponds to the amino acid sequence <SEQ ID 1926; ORF 608.ng>:

```
g608.pep
    1   MSALLPIINR LILQSPDSRS ELTSFAGKTL TLNIAGLKLA GRITEDGLLS

51   AGNGFADTEI TFRNSAIRKI LQGGEPGAGD IRLEGDLILG IAVLSLLGSL

101   RSRASDELAR IFGTQAGIGS RATDIGHGIK QIGRNIAEQI GGFSREPESA

151   NTGNEALADC LDEISRLRDG VERLNERLDR LERDIWID*
```

The following partial DNA sequence was identified in *N. meningitidis* <SEQ ID 1927>:

```
m608.seq
    1   ATGTCCGCCC TCCTCCCCAT CATCAACCGC CTGATTCTGC AAAGCCCGGA

51   CAGCCGCTCG GAACTTGCCG CCTTTGCAGG CAAAACACTG ACCCTGAACA

101   TTGCCGGGCT GAAACTGGCG GGACGCATCA CGGAAGACGG TTTGCTCTCG

151   GCGGGAAACG GCTTTGCAGA CACCGAAATT ACCTTCCGCA ACAGCGCGGT

201   ACAGAAAATC CTCCAAGGAG GCGAACCCGG GGCGGGCGAC ATCGGGCTCG

251   AAGGCGACCT CATCCTCGGC ATCGCGGTAC TGTCCCTGCT CGGCAGCCTG

301   CGTTCCCGCG CATCGGACGA ATTGGCACGG ATTTTCGGCA CGCAGGCAGA

351   CATCGGCAGC CGTGCCGCCG ACATCGGACA CGGCATCAAA CAAATCGGCA

401   GGAACATCGC CGAACAAATC GGCGGATTTT CCCGCGAATC CGAGTCCGCA

451   AACATCGGCA ACGAAGCCCT TGCCGACTGC CTCGACGAAA TAAGCAGACT

501   GCGCGACGGC GTGGAACGCC TCAACGAACG CCTCGACCGG CTCGAACGCG

551   ACATTTGGAT AGACTAA
```

This corresponds to the amino acid sequence <SEQ ID 1928; ORF 608>:

```
m608.pep
    1   MSALLPIINR LILQSPDSRS ELAAFAGKTL TLNIAGLKLA GRITEDGLLS

51   AGNGFADTEI TFRNSAVQKI LQGGEPGAGD IGLEGDLILG IAVLSLLGSL

101   RSRASDELAR IFGTQADIGS RAADIGHGIK QIGRNIAEQI GGFSRESESA

151   NIGNEALADC LDEISRLRDG VERLNERLDR LERDIWID*
```

Computer analysis of this amino acid sequence gave the following results:
Homology with a Predicted ORF from *N. gonorrhoeae*
ORF 608 shows 95.2% identity over a 188 aa overlap with a predicted ORF (ORF 608.ng) from *N. gonorrhoeae*:

```
m608/g608
                  10         20         30         40         50         60
    m608.pep  MSALLPIINRLILQSPDSRSELAAFAGKTLTLNIAGLKLAGRITEDGLLSAGNGFADTEI
              |||||||||||||||||||::|||||||||||||||||||||||||||||||||||||||
        g608  MSALLPIINRLILQSPDSRSELTSFAGKTLTLNIAGLKLAGRITEDGLLSAGNGFADTEI
                  10         20         30         40         50         60

70         80         90        100        110        120
    m608.pep  TFRNSAVQKILQGGEPGAGDIGLEGDLILGIAVLSLLGSLRSRASDELARIFGTQADIGS
              ||||||::|||||||||||||||||||||||||||||||||||||||||||||||||||
        g608  TFRNSAIRKILQGGEPGAGDIRLEGDLILGIAVLSLLGSLRSRASDELARIFGTQAGIGS
                  70         80         90        100        110        120

130        140        150        160        170        180
    m608.pep  RAADIGHGIKQIGRNIAEQIGGFSRESESANIGNEALADCLDEISRLRDGVERLNERLDR
              ||:|||||||||||||||||||||||||:|||:|||||||||||||||||||||||||||
        g608  RATDIGHGIKQIGRNIAEQIGGFSREPESANTGNEALADCLDEISRLRDGVERLNERLDR
                 130        140        150        160        170        180

189
    m608.pep  LERDIWIDX
              |||||||||
        g608  LERDIWIDX
```

The following partial DNA sequence was identified in *N. meningitidis* <SEQ ID 1929>:

```
a608.seq
   1    ATGTCCGCCC TCCTCCCCAT CATCAACCGC CTGATTCTGC AAAGCCCGGA

51    CAGCCGCTCG GAACTTGCCG CCTTCGCAGG CAAAACACTG ACCCTGAACA

101    TTGCCGGGTT GAAACTGGCG GGACGCATCA CGGAAGACGG TTTGCTCTCG

151    GCGGGAAACG GCTTTGCAGA CACCGAAATC ACCTTCCGCA ACAGCGCGGT

201    ACAGAAAATC CTCCAAGGCG GCGAACCCGG GGCGGGCGAC ATCGGGCTCG

251    AAGGCGACCT CATCCTCGGC ATCGCGGTAC TGTCCCTGCT CGGCAGCCTG

301    CGTTCCCGCG CATCGGACGA ATTGGCACGG ATTTTCGGCA CGCAGGCAGA

351    CATCGGCAGC CGTGCCGCCG ACATCGGACA CGGCATCAAA CAAATCGGCA

401    GGAACATCGC CGAACAAATC GGCAGATTTT CCCGCGAACC CGAGTCCGCA

451    AACATCGGCA ACGAAGCCCT TGCCGACTGC CTCGACGAAA TAAGCAGACT

501    GCGCGACGGC GTGGAACGCC TCAACGAACG CCTCGACCGG CTCGAACGCG

551    ACATTTGGAT AGACTAA
```

This corresponds to the amino acid sequence <SEQ ID 1930; ORF 608.a>:

```
a608.pep
   1   MSALLPIINR LILQSPDSRS ELAAFAGKTL TLNIAGLKLA GRITEDGLLS

51   AGNGFADTEI TFRNSAVQKI LQGGEPGAGD IGLEGDLILG IAVLSLLGSL

101   RSRASDELAR IFGTQADIGS RAADIGHGIK QIGRNIAEQI GRFSREPESA

151   NIGNEALADC LDEISRLRDG VERLNERLDR LERDIWID*
``` m608/a608 98.9% identity in 188 aa overlap

```
                  10         20         30         40         50         60
    m608.pep  MSALLPIINRLILQSPDSRSELAAFAGKTLTLNIAGLKLAGRITEDGLLSAGNGFADTEI
              ||||||||||||||||||||||||||||||||||||||||||||||||||||||||||||
        a608  MSALLPIINRLILQSPDSRSELAAFAGKTLTLNIAGLKLAGRITEDGLLSAGNGFADTEI
                  10         20         30         40         50         60

70         80         90        100        110        120
    m608.pep  TFRNSAVQKILQGGEPGAGDIGLEGDLILGIAVLSLLGSLRSRASDELARIFGTQADIGS
              ||||||||||||||||||||||||||||||||||||||||||||||||||||||||||||
        a608  TFRNSAVQKILQGGEPGAGDIGLEGDLILGIAVLSLLGSLRSRASDELARIFGTQADIGS
                  70         80         90        100        110        120
```

```
              130        140        150        160        170        180
m608.pep  RAADIGHGIKQIGRNIAEQIGGFSRESESANIGNEALADCLDEISRLRDGVERLNERLDR
          ||||||||||||||||||||||||| |||| |||||||||||||||||||||||||||||
a608      RAADIGHGIKQIGRNIAEQIGRFSREPESANIGNEALADCLDEISRLRDGVERLNERLDR
              130        140        150        160        170        180

189
m608.pep  LERDIWIDX
          |||||||||
a608      LERDIWIDX
```

The following partial DNA sequence was identified in *N. gonorrhoeae* <SEQ ID 1931>:

```
g609.seq
    1    ATGGTTGTGG ATAGACTCGA AATTCTCGCT CTCGACGACG AAACTCTTGA

51    TGCGTTTGTC GGCAATCAGC GAAGTAGCGA CATCGCGCAC CATATCTTCC

101    ACGAATTTCG GGTTTTCGTA GGCCTTTTCG GTAACGTATT TTTCATCGGG

151    GCGTTTGAGC AGGCCGTAGA GTTGGCAGCT CGCCTGCGTT TCCACATAAT

201    CGATAACTTC CTCGATACCG ACTTCGGCAT CGGAAGTCAG GCTGACGGTA

251    ACGTGCGAAC GCTGATTATG CGCGCCATAT TGGGAAATTT CTTTGGAACA

301    CGGGCAAAGC GAGGTTACGG GAATCATGAC CTTCATACTG TGGCCGTATG

351    CCCCGTCTTT CATTTCACCC GTGAGGCTGA CATCATAATC CAGtaa
```

This corresponds to the amino acid sequence <SEQ ID 1932; ORF 609.ng>:

```
g609.pep
    1    MVVDRLEILA LDDETLDAFV GNQRSSDIAH HIFHEFRVFV GLFGNVFFIG

51    AFEQAVELAA RLRFHIIDNF LDTDFGIGSQ ADGNVRTLIM RAILGNFFGT

101    RAKRGYGNHD LHTVAVCPVF HFTREADIII Q*
```

The following partial DNA sequence was identified in *N. meningitidis* <SEQ ID 1933>:

```
m609.seq
    1    ATGGTTGTGG ATAGACTCGA AATTCTCGCT CTCGACGACG AAACTCTTGA

51    TGCGTTTGTC GGCAATCAGC GAAGTAGCGA CATCGCGCAC CATATCTTCC

101    ACGAATTTCG GGTTTTCGTA GGCTTTTTCG GTAACGTATT TTTCATCGGG

151    GCGTTTGAGC AGGCCGTAGA GTTGGCAGCT CGCCTGCGCC TCCACATAAT

201    CGATGACTTC CTCGATACCG ACTTCGGCAT CGGCAGTCAG GCTGACGGTA

251    ACGTGCGAAC GCTGGTTGTG CGCGCCGTAT TGGGAAATTT CTTTGGAACA

301    CGGGCAAAGC GAGGTTACGG GAATCATGAC CTTCATACTG TGGCCGTATG

351    CCCCGTCTTT GATTTCGCCC GTGAGACAGA CATCATAATC CAGTAA
```

This corresponds to the amino acid sequence <SEQ ID 1934; ORF 609>:

```
m609.pep
    1    MVVDRLEILA LDDETLDAFV GNQRSSDIAH HIFHEFRVFV GFFGNVFFIG

51    AFEQAVELAA RLRLHIIDDF LDTDFGIGSQ ADGNVRTLVV RAVLGNFFGT

101    RAKRGYGNHD LHTVAVCPVF DFARETDIII Q*
``` m609/g609 93.1% identity in 131 aa overlap

```
                 10        20        30        40        50        60
m609.pep   MVVDRLEILALDDETLDAFVGNQRSSDIAHHIFHEFRVFVGFFGNVFFIGAFEQAVELAA
           ||||||||||||||||||||||||||||||||||||||||:|||||||||||||||||||
g609       MVVDRLEILALDDETLDAFVGNQRSSDIAHHIFHEFRVFVGLFGNVFFIGAFEQAVELAA
                 10        20        30        40        50        60

70        80        90       100       110       120
m609.pep   RLRLHIIDDFLDTDFGIGSQADGNVRTLVVRAVLGNFFGTRAKRGYGNHDLHTVAVCPVF
           |||:||||:|||||||||||||||||||::||:|||||||||||||||||||||||||||
g609       RLRFHIIDNFLDTDFGIGSQADGNVRTLIMRAILGNFFGTRAKRGYGNHDLHTVAVCPVF
                 70        80        90       100       110       120

130
m609.pep   DFARETDIIIQX
           |:||:|||||||
g609       HFTREADIIIQX
                130
```

The following partial DNA sequence was identified in *N. meningitidis* <SEQ ID 1935>:

```
a609.seq
    1   ATGGTTGTGG ATAGACTCGA AATTCTCGCT CTCGACGACG AAACTCTTGA

51   TGCGTTTGTC GGCAATCAGC GAAGTAGCGA CATCGCGCAC CATATCTTCC

101   ACGAATTTCG GGTTTTCGTA GGCTTTTTCG GTAACGTATT TTTCATCGGG

151   GCGTTTGAGC AGGCCGTAGA GTTGGCAGCT CGCCTGCGCC TCCACATAAT

201   CGATGACTTC CTCGATACCG ACTTCGGCAT CGGCAGTCAG GCTGACGGTA

251   ACGTGCGAAC GCTGGTTGTG CGCGCCATAT TGGGAAATTT CTTTGGAACA

301   CGGGCAAAGC GAGGTTACGG GAATCATGAC CTTCATACTG TGGCCGTATG

351   CACCGTCTTT CATTTCGCCC GTGAGGCTGA CATCATAATC CAGTAA
```

This corresponds to the amino acid sequence <SEQ ID 1936; ORF 609.a>:

```
a609.pep
    1   MVVDRLEILA LDDETLDAFV GNQRSSDIAH HIFHEFRVFV GFFGNVFFIG

51   AFEQAVELAA RLRLHIIDDF LDTDFGIGSQ ADGNVRTLVV RAILGNFFGT

101   RAKRGYGNHD LHTVAVCTVF HFAREADIII Q*
``` m609/a609 96.9% identity in 131 aa overlap

```
                 10        20        30        40        50        60
m609.pep   MVVDRLEILALDDETLDAFVGNQRSSDIAHHIFHEFRVFVGFFGNVFFIGAFEQAVELAA
           |||||||||||||||||||||||||||||||||||||||||||||||||||||||||||||
a609       MVVDRLEILALDDETLDAFVGNQRSSDIAHHIFHEFRVFVGLFGNVFFIGAFEQAVELAA
                 10        20        30        40        50        60

70        80        90       100       110       120
m609.pep   RLRLHIIDDFLDTDFGIGSQADGNVRTLVVRAVLGNFFGTRAKRGYGNHDLHTVAVCPVF
           |||||||||||||||||||||||||||||:||||||||||||||||||||||||||||||
a609       RLRFHIIDDFLDTDFGIGSQADGNVRTLIMRAILGNFFGTRAKRGYGNHDLHTVAVCPVF
                 70        80        90       100       110       120

130
m609.pep   DFARETDIIIQX
           ||||:|||||||
a609       HFAREADIIIQX
```

The following partial DNA sequence was identified in *N. gonorrhoeae* <SEQ ID 1937>:

```
g610.seq
    1   ATGATTGGAG GGCTTATGCA ATTTCCTTAC CGCAATGTTC CGGCTTCGCG

51   TATGCGCCGT ATGCGCAGGG ATGATTTTTC ACGCCGCCTG ATGCGCGAGC

101   ATATGCTGAC CGCCGATGAT TTGATTTATC CGGTGTTCGT ATTGGAGGGG

151   GCGGCGCGCG AGGAGGATGT GCCTTCTATG CCGGGCGTGA AGCGTCAGAG

201   TTTGGACAGG CTGCTGTTTA CGGCGGAAGA GGCGGTGAAG CTCGGTATTC

251   CGATGTTGGC ACTCTTTCCC GTGGTTACGG CAAACAAAAC CGGGCGTGCG

301   CAGGAGGCGT ACAATCCCGA AGGACTCGTG CCGTCAACTG tccgagccTT

351   GCGCGAGAGG TtttcCcgaac tggggattat gacggatgtc gcgctcgAtc 401   cttatacggt gcacGGTCAG GACGGACTGA CGGACgaaaa cggttaCGTG 451   ATGAatgATg aaaCCGTAGA AGTCTTGGTG AAACAGGCTT TATGTCATGC

501   AGAGGCGGGC ACGCAGGTCG TTGCTCCTTC CGATATGATG GACGGGCGTA

551   TCGGCGCCAT CCGCGAGGCT TTGGAGGATG CCGGACATAT CCATACGCGG

601   ATTATGGCAT ATTCCGCCAA ATATGCTTCT GCATTCTACG GCCCTTTCCG

651   TGATGCGGTA GGCAGTTCGG GCAATTTGGG AAAGGCAGAT AAAAAGACCT

701   ATCAGATGGA TCCTGCAAAT ACCGATGAGG CGCTGCATGA AGTGGCGCTC

751   GATATTCAGG AAGGTGCGGA TATGGTGATG GTGAAGCCCG GTTTGCCGTA

801   TTTGGACGTT GTCCGCCGCG TGAAGGACGA GTTCGGCGTA CCGACTTATG

851   CCTATCAGGT TTCGGGCGAA TATGCGATGT TGCAGGCGGC GGTTGCCAAC

901   GGCTGGCTGG ACGGCGGCAA AGTGGTTTTG GAAAGCCTGC TGGCATTCAA

951   ACGTGCGGGT GCGGACGGGA TTTTGACCTA TTACGCCATT GAGGCGGCAA

1001   AGATGCTGAA GCGTTGA
```

This corresponds to the amino acid sequence <SEQ ID 1938;
ORF 610.ng>:

```
g610.pep
    1   MIGGLMQFPY RNVPASRMRR MRRDDFSRRL MREHMLTADD LIYPVFVLEG

51   AAREEDVPSM PGVKRQSLDR LLFTAEEAVK LGIPMLALFP VVTANKTGRA

101   QEAYNPEGLV PSTVRALRER FPELGIMTDV ALDPYTVHGQ DGLTDENGYV

151   MNDETVEVLV KQALCHAEAG TQVVAPSDMM DGRIGAIREA LEDAGHIHTR

201   IMAYSAKYAS AFYGPFRDAV GSSGNLGKAD KKTYQMDPAN TDEALHEVAL

251   DIQEGADMVM VKPGLPYLDV VRRVKDEFGV PTYAYQVSGE YAMLQAAVAN

301   GWLDGGKVVL ESLLAFKRAG ADGILTYYAI EAAKMLKR*
```

The following partial DNA sequence was identified in *N. meningitidis* <SEQ ID 1939>:

```
m610.seq
    1   ATGATTGGAG GGCTTATGCA GTTTCCTTAC CGCAATGTTC CGGCTTCGCG

51   TATGCGCCGT ATGCGCAGGG ACGATTTTTC ACGCCGCCTG ATGCGCGAAC

101   ACACGCTGAC CGCCGATGAT TTGATTTATC CGGTGTTCGT ATTGGAGGGG

151   TCGGCGCGCG AGGAGGATGT GCCTTCTATG CCGGGTGTGA AGCGTCAAAG

201   TTTGGACAGG CTGCTGTTTA CGGCGGAAGA GGCGGTAAAG CTCGGTATTC

251   CGATGTTGGC ACTGTTCCCC GTGGTTACGG CAAACAAAAC CGAGCGTGCG
```

```
 301  CAGGAGGCGT ACAATCCCGA AGGACTCGTG CCGTCAACTG TCCGCGCCTT

351  GCGCGAGAGG TTTCCCGAAC TGGGCATTAT GACGGATGTC GCGCTCGATC

401  CTTATACGGT TCACGGTCAG GACGGGCTGA CGGACGAAAA CGGTTATGTG

451  ATGAACGATG AAACCGTAGA GGTTTTGGTC AAGCAGGCTT TGTGCCACGC

501  TGAAGCGGGC GCGCAGGTGG TTGCCCCTTC CGATATGATG GACGGGCGTA

551  TCGGTGCGAT TCGCGAGGCG TTGGAGGATG CCGGGCATAT CCATACGCGG

601  ATTATGGCGT ATTCCGCCAA ATATGCTTCT GCATTTTACG GCCCTTTCCG

651  TGATGCGGTA GGCAGTTCGG GCAATTTGGG CAAGGCAGAT AAAAAGACCT

701  ACCAGATGGA TCCGGCAAAT ACCGATGAGG CGTTGCACGA AGTGGCGTTG

751  GACATTCAGG AAGGTGCGGA TATGGTAATG GTCAAGCCCG GTTTGCCGTA

801  TTTGGACGTT GTCCGCCGCG TAAAGGACGA GTTCGGTGTG CCGACTTATG

851  CCTATCAGGT TTCGGGAGAA TACGCGATGT TGCAGGCAGC GATTGCCAAC

901  GGCTGGCTGG ACGGCGGCAA AGTGGTTTTG GAAAGCCTGC TGGCATTCAA

951  ACGTGCGGGT GCGGACGGGA TTTTGACCTA TTACGCTATT GAGGCGGCAA

1001  AGATGTTGAA GCGTTGA
```

This corresponds to the amino acid sequence <SEQ ID 1940; ORF 610>:

```
m610.pep
    1  MIGGLMQFPY RNVPASRMRR MRRDDFSRRL MREHTLTADD LIYPVFVLEG

51  SAREEDVPSM PGVKRQSLDR LLFTAEEAVK LGIPMLALFP VVTANKTERA

101  QEAYNPEGLV PSTVRALRER FPELGIMTDV ALDPYTVHGQ DGLTDENGYV

151  MNDETVEVLV KQALCHAEAG AQVVAPSDMM DGRIGAIREA LEDAGHIHTR

201  IMAYSAKYAS AFYGPFRDAV GSSGNLGKAD KKTYQMDPAN TDEALHEVAL

251  DIQEGADMVM VKPGLPYLDV VRRVKDEFGV PTYAYQVSGE YAMLQAAIAN

301  GWLDGGKVVL ESLLAFKRAG ADGILTYYAI EAAKMLKR*
``` m610/g610 98.5% identity in 338 aa overlap

```
                10         20         30         40         50         60
    m610.pep MIGGLMQFPYRNVPASRMRRMRRDDFSRRLMREHTLTADDLIYPVFVLEGSAREEDVPSM
            ||||||||||||||||||||||||||||||||||:|||||||||||||||:|||||||||
        g610 MIGGLMQFPYRNVPASRMRRMRRDDFSRRLMREHMLTADDLIYPVFVLEGAAREEDVPSM
                10         20         30         40         50         60

70         80         90        100        110        120
    m610.pep PGVKRQSLDRLLFTAEEAVKLGIPMLALFPVVTANKTERAQEAYNPEGLVPSTVRALRER
            ||||||||||||||||||||||||||||||||||||||:|||||||||||||||||||||
        g610 PGVKRQSLDRLLFTAEEAVKLGIPMLALFPVVTANKTGRAQEAYNPEGLVPSTVRALRER
                70         80         90        100        110        120

130        140        150        160        170        180
    m610.pep FPELGIMTDVALDPYTVHGQDGLTDENGYVMNDETVEVLVKQALCHAEAGAQVVAPSDMM
            |||||||||||||||||||||||||||||||||||||||||||||||||||:||||||||
        g610 FPELGIMTDVALDPYTVHGQDGLTDENGYVMNDETVEVLVKQALCHAEAGTQVVAPSDMM
               130        140        150        160        170        180

190        200        210        220        230        240
    m610.pep DGRIGAIREALEDAGHIHTRIMAYSAKYASAFYGPFRDAVGSSGNLGKADKKTYQMDPAN
            ||||||||||||||||||||||||||||||||||||||||||||||||||||||||||||
        g610 DGRIGAIREALEDAGHIHTRIMAYSAKYASAFYGPFRDAVGSSGNLGKADKKTYQMDPAN
               190        200        210        220        230        240

250        260        270        280        290        300
    m610.pep TDEALHEVALDIQEGADMVMVKPGLPYLDVVRRVKDEFGVPTYAYQVSGEYAMLQAAIAN
            ||||||||||||||||||||||||||||||||||||||||||||||||||||||||:||
        g610 TDEALHEVALDIQEGADMVMVKPGLPYLDVVRRVKDEFGVPTYAYQVSGEYAMLQAAVAN
               250        260        270        280        290        300
```

```
                    310         320         330       339
m610.pep   GWLDGGKVVLESLLAFKRAGADGILTYYAIEAAKMLKRX
           ||||||||||||||||||||||||||||||||||||||
g610       GWLDGGKVVLESLLAFKRAGADGILTYYAIEAAKMLKRX
                    310         320         330
```

The following partial DNA sequence was identified in *N. meningitidis* <SEQ ID 1941>:

```
a610.seq
     1   ATGATTGGAG GGCTTATGCA GTTTCCTTAC CGCAATGTTT CGGCTTCGCG

51   TATGCGCCGT ATGCGCAGGG ACGATTTTTC ACGCCGCCTG ATGCGCGAGC

101   ATACGCTGAC TGCCGATGAT TTGATTTATC CGGTGTTCGT ATTGGAGGGG

151   TCGGCGCGCG AGGAGGATGT GCCTTCTATG CCGGGCGTGA AGCGTCAGAG

201   TTTGGACAGG CTGCTGTTTA CGGCGGAAGA GGCGGTAAAG CTCGGTATTC

251   CGATGTTGGC ACTGTTCCCC GTGGTTACGG CAAACAAAAC CGAGCGTGCG

301   CAGGAGGCGT ACAATCCCGA AGGACTCGTG CCGTCAACTG TCCGCGCCTT

351   GCGCGAGAGG TTTCCCGAAC TGGGCATTAT GACGGATGTC GCGCTCGATC

401   CTTATACGGT GCACGGTCAG GACGGGCTGA CGGACGAAAA CGGTTATGTG

451   ATGAACGATG AAACCGTAGA GGTTTTGGTC AAGCAGGCTT TGTGTCATGC

501   AGAGGCAGGC GCACAGGTCG TTGCTCCTTC CGATATGATG GATGGGCGTA

551   TCGGTGCGAT TCGCGAGGCG TTGGAGGATG CCGGGCATAT CCATACGCGG

601   ATTATGGCGT ATTCCGCCAA ATATGCTTCT GCATTTTACG GCCCTTTCCG

651   TGATGCGGTA GGCAGTTCGG GCAATTTGGG CAAGGCAGAT AAAAAGACCT

701   ACCAGATGGA TCCGGCAAAT ACCGATGAGG CGTTGCACGA AGTGGCGTTG

751   GACATTCAGG AAGGTGCGGA TATGGTGATG GTCAAGCCCG GTTTGCCGTA

801   TTTGGACGTT GTCCGCCGCG TGAAGGACGA GTTCGGCGTG CCGACTTATG

851   CCTATCAGGT TTCGGGAGAA TACGCGATGC TGCAGGCGGC GGTTGCCAAC

901   GGCTGGCTGG ACGGCGGCAA AGTGGTTTTG GAAAGCCTGC TGGCATTCAA

951   ACGTGCGGGT GCGGATGGGA TTTTGACCTA TTACGCCATT GAGGCGGCAA

1001   AGATGCTGAA GCGTTGA
```

This corresponds to the amino acid sequence <SEQ ID 1942; ORF 610.a>:

```
a610.pep
     1   MIGGLMQFPY RNVSASRMRR MRDDFSRRL MREHTLTADD LIYPVFVLEG

51   SAREEDVPSM PGVKRQSLDR LLFTAEEAVK LGIPMLALFP VVTANKTERA

101   QEAYNPEGLV PSTVRALRER FPELGIMTDV ALDPYTVHGQ DGLTDENGYV

151   MNDETVEVLV KQALCHAEAG AQVVAPSDMM DGRIGAIREA LEDAGHIHTR

201   IMAYSAKYAS AFYGPFRDAV GSSGNLGKAD KKTYQMDPAN TDEALHEVAL

251   DIQEGADMVM VKPGLPYLDV VRRVKDEFGV PTYAYQVSGE YAMLQAAVAN

301   GWLDGGKVVL ESLLAFKRAG ADGILTYYAI EAAKMLKR*
``` m610/a610 99.4% identity in 338 aa overlap

```
                 10        20        30        40        50        60
    m610.pep  MIGGLMQFPYRNVPASRMRRMRRDDFSRRLMREHTLTADDLIYPVFVLEGSAREEDVPSM
              ||||||||||||| ||||||||||||||||||||||||||||||||||||||||||||
    a610      MIGGLMQFPYRNVSASRMRRMRRDDFSRRLMREHTLTADDLIYPVFVLEGSAREEDVPSM
                 10        20        30        40        50        60

70        80        90       100       110       120
    m610.pep  PGVKRQSLDRLLFTAEEAVKLGIPMLALFPVVTANKTERAQEAYNPEGLVPSTVRALRER
              ||||||||||||||||||||||||||||||||||||||||||||||||||||||||||||
    a610      PGVKRQSLDRLLFTAEEAVKLGIPMLALFPVVTANKTERAQEAYNPEGLVPSTVRALRER
                 70        80        90       100       110       120

130       140       150       160       170       180
    m610.pep  FPELGIMTDVALDPYTVHGQDGLTDENGYVMNDETVEVLVKQALCHAEAGAQVVAPSDMM
              ||||||||||||||||||||||||||||||||||||||||||||||||||||||||||||
    a610      FPELGIMTDVALDPYTVHGQDGLTDENGYVMNDETVEVLVKQALCHAEAGAQVVAPSDMM
                130       140       150       160       170       180

190       200       210       220       230       240
    m610.pep  DGRIGAIREALEDAGHIHTRIMAYSAKYASAFYGPFRDAVGSSGNLGKADKKTYQMDPAN
              ||||||||||||||||||||||||||||||||||||||||||||||||||||||||||||
    a610      DGRIGAIREALEDAGHIHTRIMAYSAKYASAFYGPFRDAVGSSGNLGKADKKTYQMDPAN
                190       200       210       220       230       240

250       260       270       280       290       300
    m610.pep  TDEALHEVALDIQEGADMVMVKPGLPYLDVVRRVKDEFGVPTYAYQVSGEYAMLQAAIAN
              |||||||||||||||||||||||||||||||||||||||||||||||||||||||:|||
    a610      TDEALHEVALDIQEGADMVMVKPGLPYLDVVRRVKDEFGVPTYAYQVSGEYAMLQAAVAN
                250       260       270       280       290       300

310       320       330   339
    m610.pep  GWLDGGKVVLESLLAFKRAGADGILTYYAIEAAKMLKRX
              ||||||||||||||||||||||||||||||||||||||
    a610      GWLDGGKVVLESLLAFKRAGADGILTYYAIEAAKMLKRX
                310       320       330
```

The following partial DNA sequence was identified in *N. gonorrhoeae* <SEQ ID 1943>:

```
g611.seq
    1  ATGCCGTCTG AAAACGGGAT GGGAAAACGG CAGCTTGCGG GCTGCCGTTT

51  GTTCGGGAAG TTAAGCCTTG TTTTCAGGCT GCTGCCCGGA CTCTGTCGAG

101  GCGGTGTCTG CCGGGGCAGG TGCTTCGGTT TTTTCCCGAG TCGGAGCGTG

151  CGGCGCGTTA TCTTCCGCCG CGTCCGCATT Ctcgcgcagg ttgtGGCtgt 201  tatcctTGGG CGGGCTGggt tgtttgcccg ccataaTTtc cagtacctgA 251  TcgcgGTCta tggtttcCCa ttCcatcagg gctttgcaca TCGTTTCCAT 301  cttgTCGCGG TTTTcatcga ggaTTTTGTA ggcaacCTGA TACTgctcgt 351  ccaaaAtccg Gcggatttcc gcgtcgAtgt cctgctgggt tTTCTCGGAA 401  ATGTTTTGCG AACGGttac gctGCGCCCC AAGAAGACTT CGCCTTCGTT 451  TTCCGCATAA ACCATCACGC CCATTTTGtc gCTCAtgcCG TAGCGCGTTA

501  CCATTTCGCG TGCCATTTGG GTTGCGCGTT CAAAGTCGTT TGA
```

This corresponds to the amino acid sequence <SEQ ID 1944; ORF 611.ng>:

```
g611.pep
    1  MPSENGMGKR QLAGCRLFGK LSLVFRLLPG LCRGGVCRGR CFGFFPSRSV

51  RRVIFRRVRI LAQVVAVILG RAGLFARHNF QYLIAVYGFP FHQGFAHRFH

101  LVAVFIEDFV GNLILLVQNP ADFRVDVLLG FLGNVLRTGY AAPQEDFAFV

151  FRINHHAHFV AHAVARYHFA CHLGCAFKVV *
```

The following partial DNA sequence was identified in *N. meningitidis* <SEQ ID 1945>:

```
m611.seq
    1   ATGCCGTCTG AAAACGGGAT GGGAAAACGG CAGCTTGCGG GCTGCCGTTT

51   GTTCGGGAAG TTAAGCCTTG TTTTCAGGCT GCTGCTCGGA CTCTGTCGAA

101   GCGGTGTCTG CCGGGGCAGG TGCTTCGGTT TCTTCCCGAG TCGGAGCGTG

151   CGGCGCGTTA TCTTCCGCCG CGTCCGCATT CTCGCGCAGG TTGTGGCTGT

201   AATCTTTGGG CGGGCTGGGT TGTTTGCCCG CCATGATTTC CAGTACCTGA

251   TCGCGGTCGA TGGTTTCCCA TTCCATCAGG GCTTTGCACA TCGTTTCCAT

301   CTTGTCGCGG TTTTCATCGA GGATTTTGTA GGCAACCTGA TATTGCTCGT

351   CCAAAATCCG GCGGATTTCC GCGTCGATGT CCTGCTGGGT TTTCTCGGAA

401   ATGTTTTGCG AACGGGTTAC GCTGCGTCCC AAGAAGACTT CGCCTTCGTT

451   TTCCGCATAA ACCATCACGC CCATTTTGTC GCTCATGCCG TAGCGCGTTA

501   CCATTTCGCG CGCCATTTGG GTTGCGCGTT CAAAGTCGTT TGA
```
                                                                20

This corresponds to the amino acid sequence <SEQ ID 1946; ORF 611>:

```
m611.pep
    1   MPSENGMGKR QLAGCRLFGK LSLVFRLLLG LCRSGVCRGR CFGFFPSRSV

51   RRVIFRRVRI LAQVVAVIFG RAGLFARHDF QYLIAVDGFP FHQGFAHRFH

101   LVAVFIEDFV GNLILLVQNP ADFRVDVLLG FLGNVLRTGY AASQEDFAFV

151   FRINHHAHFV AHAVARYHFA RHLGCAFKVV *
``` m611/g611 96.1% identity in 180 aa overlap

```
                     10         20         30         40         50         60
    m611.pep  MPSENGMGKRQLAGCRLFGKLSLVFRLLLGLCRSGVCRGRCFGFFPSRSVRRVIFRRVRI
              ||||||||||||||||||||||||||||  ||||:|||||||||||||||||||||||||
    g611      MPSENGMGKRQLAGCRLFGKLSLVFRLLPGLCRGGVCRGRCFGFFPSRSVRRVIFRRVRI
                     10         20         30         40         50         60

70         80         90        100        110        120
    m611.pep  LAQVVAVIFGRAGLFARHDFQYLIAVDGFPFHQGFAHRFHLVAVFIEDFVGNLILLVQNP
              |||||||||:||||||||||:||||| |||||||||||||||||||||||||||||||||
    g611      LAQVVAVILGRAGLFARHNFQYLIAVYGFPFHQGFAHRFHLVAVFIEDFVGNLILLVQNP
                     70         80         90        100        110        120

130        140        150        160        170        180
    m611.pep  ADFRVDVLLGFLGNVLRTGYAASQEDFAFVFRINHHAHFVAHAVARYHFARHLGCAFKVV
              ||||||||||||||||||||||| |||||||||||||||||||||||||||| |||||||
    g611      ADFRVDVLLGFLGNVLRTGYAAPQEDFAFVFRINHHAHFVAHAVARYHFACHLGCAFKVV
                    130        140        150        160        170        180 m611.pep  X
              |
    g611      X
```

The following partial DNA sequence was identified in N. meningitidis <SEQ ID 1947>:

```
a611.seq
    1   ATGCCGTCTG AAAACAGGAT GGGAAAACGG CAGCTTGCGG GCTGCCGTTT

51   GTTCGGGAAG TTAAGCCTTG TTTTCAGGCT GCTGCTCGGA CTCTGTCGAA

101   GCGGTGTCTG CCGGGGCAGG TGCTTCGGTT TCTTCCCGAG TCGGAGCGTG

151   CGGCGCGTTA TCTTCCGCCG CGTCCGCATT CTCGCGCAGG TTGTGGCTGT

201   AATCTTTGGG CGGGCTGGGT TGTTTGCCCG CCATGATTTC CAGTACCTGA
```

-continued

```
251  TCGCGGTCGA TGGTTTCCCA TTCCATCAGG GCTTTGCACA TCGTTTCCAT

301  CTTGTCGCGG TTTTCATCGA GGATTTTGTA GGCAACCTGA TACTGCTCGT

351  CCAAAATCCG GCGGATTTCC GCATCGATGT CCTGCTGGGT TTTCTCGGAA

401  ATGTTTTGCG AACGGGTTAC GCTGCGTCCC AAGAAGACTT CGCCTTCGTT

451  TTCCGCATAA ACCATCACGC CCATTTTGTC GCTCATGCCG TAGCGCGTTA

501  CCATTTCGCG CGCCATTTGG GTTGCGCGTT CAAAGTCGTT TGA
```

This corresponds to the amino acid sequence <SEQ ID 1948; ORF 611.a>:

```
a611.pep
  1  MPSENRMGKR QLAGCRLFGK LSLVFRLLLG LCRSGVCRGR CFGFFPSRSV

51  RRVIFRRVRI LAQVVAVIFG RAGLFARHDF QYLIAVDGFP FHQGFAHRFH

101  LVAVFIEDFV GNLILLVQNP ADFRIDVLLG FLGNVLRTGY AASQEDFAFV

151  FRINHHAHFV AHAVARYHFA RHLGCAFKVV *
``` m611/a611 98.9% identity in 180 aa overlap

```
                  10         20         30         40         50         60
m611.pep  MPSENGMGKRQLAGCRLFGKLSLVFRLLLGLCRSGVCRGRCFGFFPSRSVRRVIFRRVRI
          |||||  ||||||||||||||||||||||||||||||||||||||||||||||||||||
a611      MPSENRMGKRQLAGCRLFGKLSLVFRLLLGLCRSGVCRGRCFGFFPSRSVRRVIFRRVRI
                  10         20         30         40         50         60

70         80         90        100        110        120
m611.pep  LAQVVAVIFGRAGLFARHDFQYLIAVDGPPFHQGFAHRFPHLVAVFIEDFVGNLILLVQNP
          ||||||||||||||||||||||||||||||||||||||||||||||||||||||||||||
a611      LAQVVAVIFGRAGLFARHDFQYLIAVDGFPFHQGFAHRFPHLVAVFIEDFVGNLILLVQNP
                  70         80         90        100        110        120

130        140        150        160        170        180
m611.pep  ADFRVDVLLGFLGNVLRTGYAASQEDFAFVFRINHHAHFVAHAVARYHFARHLGCAFKVV
          ||||:|||||||||||||||||||||||||||||||||||||||||||||||||||||||
a611      ADFRIDVLLGFLGNVLRTGYAASQEDFAFVFRINHHAHFVAHAVARYHFARHLGCAFKVV
                 130        140        150        160        170        180 m611.pep  X
          |
a611      X
```

The following partial DNA sequence was identified in *N. gonorrhoeae* <SEQ ID 1949>:

```
g612.seq
  1  ATGGgcttcg gcggcaatat tgcAAAAAAG CTGGCcggGg taGATGAAAT

51  AGCCTttgac tttgacggcA TCGTCTTTGA TTTCGGGCGT GATGATGCTG

101  TCCGGCataG CGGCGTAATC AATGCTGCTG TCGCCGGCCT GCATATAGTC

151  GGTGAAGTTT TCGCTGATAA AGCGGTAGAA AAGTGTGCCG AGAACGTATT

201  GTTTAAAGTC CCAGCCATCC ACCGCGCCGC GTACTTCGTC GGCGATTTTC

251  CAAATTTGGC GGTGCAGTTG GGCGCGTTGT TGCATTTCGG TCATCATCGA

301  AATCCATATA TAAAGTTAAA CAAATCAAAA TCGCCTGATA TTTTCAGACG

351  ATTTTTTTAC GGGCATTCAA ATTAA
```

This corresponds to the amino acid sequence <SEQ ID 1950; ORF 612.ng>:

```
g612.pep
    1    MGFGGNIAKK LAGVDEIAFD FDGIVFDFGR DDAVRHSGVI NAAVAGLHIV

51    GEVFADKAVE KCAENVLFKV PAIHRAAYFV GDFPNLAVQL GALLHFGHHR

101    NPYIKLNKSK SPDIFRRFFY GHSN*
```

The following partial DNA sequence was identified in *N. meningitidis* <SEQ ID 1951>:

```
m612.seq
    1    ATGGGCTTCG GCGGCAATAT TGCAAAAAAG CTGGCCGGGG TAGATGAAAT

51    AGCCTTTAAC TTTGACGGCA TCGTCTTTGA TTTCGGGCGT GATGATGCTG

101    TCCGGCATAG CGGCGTAATC AATACTGCTG TCGCCTGCCT GCATATAGTC

151    GGTGAAGTTT TCGCTGATAA AGCGGTAGAA AAGTGTGCCG AGAACGTATT

201    GTTTAAAGTC CCAGCCATCC ACCGCGCCGC GTACTTCGTC GGCAATTTTC

251    CAAATTTGGC GGTGCAGTTG GGCGCGTTGT TGCATTTCGG TCATCATCGA

301    AATCCATATA .AAAGTTAAA CAAATCAAAA TCGCCTGATA TTTTCAGACG

351    ATTTTTTTAC GGGCATTCAA ATTAA
```
                                                               25

This corresponds to the amino acid sequence <SEQ ID 1952; ORF 612>:

```
m612.pep
    1    MGFGGNIAKK LAGVDEIAFN FDGIVFDFGR DDAVRHSGVI NTAVACLHIV

51    GEVFADKAVE KCAENVLFKV PAIHRAAYFV GNFPNLAVQL GALLHFGHHR

101    NPYXKLNKSK SPDIFRRFFY GHSN*
```
                                                               35 m612/g612 96.0% identity in 124 aa overlap

```
                   10         20         30         40         50         60
   m612.pep   MGFGGNIAKKLAGVDEIAFNFDGIVFDFGRDDAVRHSGVINTAVACLHIVGEVFADKAVE
              ||||||||||||||||||||:||||||||||||||||||||:|||  ||||||||||||
   g612       MGFGGNIAKKLAGVDEIAFDFDGIVFDFGRDDAVRHSGVINAAVAGLHIVGEVFADKAVE
                   10         20         30         40         50         60

70         80         90        100        110        120
   m612.pep   KCAENVLFKVPAIHRAAYFVGNFPNLAVQLGALLHFGHHRNPYXKLNKSKSPDIFRRFFY
              ||||||||||||||||||||:|||||||||||||||||||  ||||||||||||||||||
   g612       KCAENVLFKVPAIHRAAYFVGDFPNLAVQLGALLHFGHHRNPYIKLNKSKSPDIFRRFFY
                   70         80         90        100        110        120 m612.pep   GHSNX
              |||||
   g612       GHSNX
```

The following partial DNA sequence was identified in *N. meningitidis* <SEQ ID 1953>:

```
a612.seq
    1    ATGGGCTTCG GCGGCAATAT TGCAAAAAAG CTGGCCGGGG TAGATGAAAT

51    AGCCTTTGAC TTTGACGGCA TCGTCTTTGA TTTCGGGCGT GATGATGCTG

101    TCCGGCATAG CGGCGTAATC AATACTGCTG TCGCCTGCCT GCATATAGTC

151    GGTAAAGTTT TCGCTGATAA AGCGGTAGAA AAGTGTGCCG AGAACGTATT

201    GTTTGAAGTC CCAGCCATCC ACCGCGCCGC GTACTTCGTC GGCAATTTTC

251    CAAATTTGGC GGTGCAGTTG GGCGCGTTGT TGTATTTCGG TCATCATCGA
```

```
                               -continued
301    AATCCATAT. AAAAGTTAAA CAAATCAAAA TCGCCTGATA TTTTCAGACG

351    ATTTTTT.AC GGGCATTCAA ATTAA
```

This corresponds to the amino acid sequence <SEQ ID 1954; ORF 612.a>:

```
a612.pep
    1   MGFGGNIAKK LAGVDEIAFD FDGIVFDFGR DDAVRHSGVI NTAVACLHIV

51   GKVFADKAVE KCAENVLFEV PAIHRAAYFV GNFPNLAVQL GALLYFGHHR

101   NPYXKLNKSK SPDIFRRFFX GHSN*
``` m612/a612 96.0% identity in 124 aa overlap

```
                     10         20         30         40         50         60
   m612.pep   MGFGGNIAKKLAGVDEIAFNFDGIVFDFGRDDAVRHSGVINTAVACLHIVGEVFADKAVE
              ||||||||||||||||||||:|||||||||||||||||||||||||||||||:|||||||
      a612   MGFGGNIAKKLAGVDEIAFDFDGIVFDFGRDDAVRHSGVINTAVACLHIVGKVFADKAVE
                     10         20         30         40         50         60
                     70         80         90        100        110        120
   m612.pep   KCAENVLFKVPAIHRAAYFVGNFPNLAVQLGALLHFGHHRNPYXKLNKSKSPDIFRRFFY
              |||||||||:|||||||||||||||||||||||||:|||||||||||||||||||||||:
      a612   KCAENVLFEVPAIHRAAYFVGNFPNLAVQLGALLYFGHHRNPYXKLNKSKSPDIFRRFFX
                     70         80         90        100        110        120
   m612.pep   GHSNX
              |||||
      a612   GHSNX
```

The following partial DNA sequence was identified in *N. gonorrhoeae* <SEQ ID 1955>:

```
g613.seq
    1   ATGTCGCGTT CGAGCCTGTC GAGGCGTTCG TTGAGGCGTT CCACGCCGTC

51   GCGCAGTCTG CTTATTTCGT CGaggcagtc ggcaagggct tcgttgccgg 101   tgtttGcgGA CTCGGGTTCG CGGGAAAATC CGCCGATTTG TTCGGCGATG 151   TTCCTGCCGA TTTgtttGAt GCCGTGTCCG ATGTCGGTGG CACGgctgcc 201   gatgcCTGCC TGCGTGCCGA AAATCCGTGC CAATTcgtCC GATGCGCGGG 251   AACGCAGGCT GCCGAGCAGG GACAGTACCG CgATGCCGAG GATGAGGTCG

301   CCTTCGAGCC TGATGTCGCC AGCCCCGGGT TCGCCGCCTT GGAGGATTTT

351   CCGTATCGCG CTGTTGCGGA AGGTAATTTC GGTGTCTGCA AAGCCGTTTC

401   CCGCCGAGAG CAAACCGTCT TCTGTGATGC GTCCCGCCAG TTTCAGCCCG

451   GCAATGTTCA GGGTCAGTGT TTTGCCTGCA AAGGAGGTAA GTTCCGAGCG

501   GCTGTCCGGG CTTTGCAGAA TCAGGCGGTT GATGATGGGG AGGAGGGCGG

551   ACATATTTTC TGATTGGGGC GGAGAATGCC TGTTGTTGCT GTTGCCGCTT

601   ATTTTACAGG CTTAA
```

This corresponds to the amino acid sequence <SEQ ID 1956; ORF 613.ng>:

```
g613.pep
    1   MSRSSLSRRS LRRSTPSRSL LISSRQSARA SLPVFADSGS RENPPICSAM

51   FLPICLMPCP MSVARLPMPA CVPKIRANSS DARERRLPSR DSTAMPRMRS

101   PSSLMSPAPG SPPWRIFRIA LLRKVISVSA KPFPAESKPS SVMRPASFSP
```

```
151  AMFRVSVLPA KEVSSERLSG LCRIRRLMMG RRADIFSDWG GECLLLLLPL

201  ILQA*
```

The following partial DNA sequence was identified in *N. meningitidis* <SEQ ID 1957>:

```
m613.seq
    1  ATGTCGCGTT CGAGCCGGTC GAGGCGTTCG TTGAGGCGTT CCACGCCGTC

51  GCGCAGTCTG CTTATTTCGT CGAGGCAGTC GGCAAGGGCT TCGTTGCCGA

101  TGTTTGCGGA CTCGGATTCG CGGGAAAATC CGCCGATTTG TTCGGCGATG

151  TTCCTGCCGA TTTGTTTGAT GCCGTGTCCG ATGTCGGCGG CACGGCTGCC

201  GATGTCTGCC TGCGTGCCGA AAATCCGTGC CAATTCGTCC GATGCGCGGG

251  AACGCAGGCT GCCGAGCAGG GACAGTACCG CGATGCCGAG GATGAGGTCG

301  CCTTCGAGCC CGATGTCGCC CGCCCCGGGT TCGCCTCCTT GGAGGATTTT

351  CTGTACCGCG CTGTTGCGGA AGGTAATTTC GGTGTCTGCA AAGCCGTTTC

401  CCGCCGAGAG CAAACCGTCT TCCGTGATGC GTCCCGCCAG TTTCAGCCCG

451  GCAATGTTCA GGGTCAGTGT TTTGCCTGCA AAGGCGGCAA GTTCCGAGCG

501  GCTGTCCGGG CTTTGCAGAA TCAGGCGGTT GATGATGGGG AGGAGGGCGG

551  ACATATTTTC TGATCGGGGC GGAGAATGCC TGTTGTTGCT GTTGCCGCTT

601  ATTTTACAGG CTTAA
```

This corresponds to the amino acid sequence <SEQ ID 1958; ORF 613>:

```
m613.pep
    1  MSRSSRSRRS LRRSTPSRSL LISSRQSARA SLPMFADSDS RENPPICSAM

51  FLPICLMPCP MSAARLPMSA CVPKIRANSS DARERRLPSR DSTAMPRMRS

101  PSSPMSPAPG SPPWRIFCTA LLRKVISVSA KPFPAESKPS SVMRPASFSP

151  AMFRVSVLPA KAASSERLSG LCRIRRLMMG RRADIFSDRG GECLLLLLPL

201  ILQA*
```

Computer analysis of this amino acid sequence gave the following results:
Homology with a Predicted ORF from *N. gonorrhoeae*
m613/g613 94.6% identity in 204 aa overlap

```
                   10         20         30         40         50         60
m613.pep  MSRSSRSRRSLRRSTPSRSLLISSRQSARASLPMFADSDSRENPPICSAMFLPICLMPCP
          |||||||||||||||||||||||||||||||||||:||||||||||||||||||||||||
g613      MSRSSRSRRSLRRSTPSRSLLISSRQSARASLPVFADSGSRENPPICSAMFLPICLMPCP
                   10         20         30         40         50         60

70         80         90        100        110        120
m613.pep  MSAARLPMSACVPKIRANSSDARERRLPSRDSTAMPRMRSPSSPMSPAPGSPPWRIFCTA
          ||:|||||||:|||||||||||||||||||||||||||||||| |||||||||||||| |
g613      MSVARLPMPACVPKIRANSSDARERRLPSRDSTAMPRMRSPSSLMSPAPGSPPWRIFRIA
                   70         80         90        100        110        120

130        140        150        160        170        180
m613.pep  LLRKVISVSAKPFPAESKPSSVMRPASFSPAMFRVSVLPAKAASSERLSGLCRIRRLMMG
          |||||||||||||||||||||||||||||||||||||||||:||||||||||||||||||
g613      LLRKVISVSAKPFPAESKPSSVMRPASFSPAMFRVSVLPAKEVSSERLSGLCRIRRLMMG
                   130        140        150        160        170        180
```

-continued
```
                     190        200
m613.pep    RRADIFSDRGGECLLLLLPLILQAX
            |||||||| ||||||||||||||||
g613        RRADIFSDWGGECLLLLLPLILQAX
                     190        200
```

The following partial DNA sequence was identified in *N. meningitidis* <SEQ ID 1959>:

```
a613.seq
     1  ATGTCGCGTT CGAGCCGGTC GAGGCGTTCG TTGAGGCGTT CCACGCCGTC

51  GCGCAGTCTG CTTATTTCGT CGAGGCAGTC GGCAAGGGCT TCGTTGCCGA

101  TGTTTGCGGA CTCGGGTTCG CGGGAAAATC TGCCGATTTG TTCGGCGATG

151  TTCCTGCCGA TTTGTTTGAT GCCGTGTCCG ATGTCGGCGG CACGGCTGCC

201  GATGTCTGCC TGCGTGCCGA AAATCCGTGC CAATTCGTCC GATGCGCGGG

251  AACGCAGGCT GCCGAGCAGG GACAGTACCG CGATGCCGAG GATGAGGTCG

301  CCTTCGAGCC CGATGTCGCC CGCCCCGGGT TCGCCGCCTT GGAGGATTTT

351  CTGTACCGCG CTGTTGCGGA AGGTGATTTC GGTGTCTGCA AAGCCGTTTC

401  CCGCCGAGAG CAAACCGTCT TCCGTGATGC GTCCCGCCAG TTTCAACCCG

451  GCAATGTTCA GGGTCAGTGT TTTGCCTGCG AAGGCGGCAA GTTCCGAGCG

501  GCTGTCCGGG CTTTGCAGAA TCAGGCGGTT GATGATGGGG AGGAGGGCGG

551  ACATATTTTC TGATCGGGGC GGAGAATGCC TGTTGTTGCT GTTGACGCTT

601  ATTTTACAGG CTTAA
```

This corresponds to the amino acid sequence <SEQ ID 1960; ORF 613.a>:

```
a613.pep
     1  MSRSSRSRRS LRRSTPSRSL LISSRQSARA SLPMFADSGS RENLPICSAM

51  FLPICLMPCP MSAARLPMSA CVPKIRANSS DARERRLPSR DSTAMPRMRS

101  PSSPMSPAPG SPPWRIFCTA LLRKVISVSA KPFPAESKPS SVMRPASFNP

151  AMFRVSVLPA KAASSERLSG LCRIRRLMMG RRADIFSDRG GECLLLLLTL

201  ILQA*
``` m613/a613 98.0% identity in 204 aa overlap

```
                   10         20         30         40         50         60
m613.pep    MSRSSRSRRSLRRSTPSRSLLISSRQSARASLPMFADSDSRENPPICSAMFLPICLMPCP
            |||||||||||||||||||||||||||||||||||||| ||||| |||||||||||||||
a613        MSRSSRSRRSLRRSTPSRSLLISSRQSARASLPMFADSGSRENLPICSAMFLPICLMPCP
                   10         20         30         40         50         60

70         80         90        100        110        120
m613.pep    MSAARLPMSACVPKIRANSSDARERRLPSRDSTAMPRMRSPSSPMSPAPGSPPWRIFCTA
            ||||||||||||||||||||||||||||||||||||||||||||||||||||||||||||
a613        MSAARLPMSACVPKIRANSSDARERRLPSRDSTAMPRMRSPSSPMSPAPGSPPWRIFCTA
                   70         80         90        100        110        120

130        140        150        160        170        180
m613.pep    LLRKVISVSAKPFPAESKPSSVMRPASFSPAMFRVSVLPAKAASSERLSGLCRIRRLMMG
            |||||||||||||||||||||||||||||:||||||||||||||||||||||||||||||
a613        LLRKVISVSAKPFPAESKPSSVMRPASFNPAMFRVSVLPAKAASSERLSGLCRIRRLMMG
                  130        140        150        160        170        180

190        200
m613.pep    RRADIFSDRGGECLLLLLPLILQAX
            ||||||||||||||||| |||||||
a613        RRADIFSDRGGECLLLLLTLILQAX
                  190        200
```

The following partial DNA sequence was identified in *N. gonorrhoeae* <SEQ ID 1961>:

```
g614.seq
   1  AtggcTgcgt tcAacgcttt ggacggcaaa aaagaagaca acgggcaaat 51  cgaaTATTCT CAGTTCATCC GACAGGTCAA CAACGGCGAA GTATCCGGCG

101  TCAACATCGA AGGATCCGTC GTCAGCGGTT ACCTGATTAA AGGCGAGCGC

151  ACCGACAAAA GCACCTTCTT CACCAACGCG CCCTTGGATG ACAACCTGAT

201  TCAAACCCTT TTGAACAAAA ACGTCCGCGT AAAAGTAACG CCGGAAGAAA

251  AACCGAGCGC GCTGACTGCC CTGTTTTACA GCCTGCTGCC CGTCCTGCTG

301  CTGATTGGCG CATGGTTCTA CTTTATGCGT ATGCAGGCGG GCGGCGGCGG

351  AAAAGGCGGC GCATTCTCCT TCGGCAAAAG CCGCGCCCGC CTGCTGGACA

401  AAGATGCCAA CAAAGTTACC TTTGCCGATG TCGCCGGCTG CGACGAAGCC

451  AAAGAAGAAG TGCAGGAAAT CGTCGATTAC CTCAAAGCAC CGAACCGCta 501  tcaAAGcctc ggcggccgtg ttcCGCGCGG CATCCtgCtg gcgGgcagcc 551  CGGGAaccgg taaAACACTC TTGGCGAAAG CCATTGCAGG CGAGGCCGGC

601  GTGCCGTTCT TCAGCATTTC CGGTTCCGAT TTTGTCGAAA TGTTCGTCGG

651  TGTCGGTGCA AGCCGCGTCC GCGATATGTT CGAGCAGGCA AAGAAAAACG

701  CCCCATGCAT TATCTTTATC GACGAGATTG ACGCGGTAGG CCGCCAACGC

751  GGCGCAGgTT TGGGCGGCGG CAATGATGAG CGCGAGCAAA CATTAAACCA

801  ATTATTGGTT GAAATGGACG GTTTTGAGAG CAATCAGACT GTAATTGTGA

851  TTGCGGCAAC CAACCGCCCC GACGTACTCG ATCCTGCGCT GCAACGCCCC

901  GGCCGCTTCG ACCGCCAAGT CGTCGTCCCC CTGCCGGACA TCCGGGGGCG

951  CGAACAGatn ttGAACGTCC ATTCtaaAAA AGTGCctttTG gacgaATCTg 1001  tggaTTTATT GTCCCTCGCG CGCGGCACGC ccggttttTTc cggcgcggat 1051  tTggcgaaac tggtcaacga agccccctg tttgccggcc gccgcaacaa 1101  agtgaaagtc gatcaaagcg attTGAAGAC GCCAAAGACA AAATCTATAT

1151  GGGTCCGGAA CGCCGCAGTA TGGTGA
```

This corresponds to the amino acid sequence <SEQ ID 1962; ORF 614.ng>:

```
g614.pep
   1  MAAFNALDGK KEDNGQIEYS QFIRQVNNGE VSGVNIEGSV VSGYLIKGER

51  TDKSTFFTNA PLDDNLIQTL LNKNVRVKVT PEEKPSALTA LFYSLLPVLL

101  LIGAWFYFMR MQAGGGGKGG AFSFGKSRAR LLDKDANKVT FADVAGCDEA

151  KEEVQEIVDY LKAPNRYQSL GGRVPRGILL AGSPGTGKTL LAKAIAGEAG

201  VPFFSISGSD FVEMFVGVGA SRVRDMFEQA KKNAPCIIFI DEIDAVGRQR

251  GAGLGGGNDE REQTLNQLLV EMDGFESNQT VIVIAATNRP DVLDPALQRP

301  GRFDRQVVVP LPDIRGREQX LNVHSKKVPL DESVDLLSLA RGTPGFSGAD

351  LAKLVNEAPL FAGRRNKVKV DQSDLKTPKT KSIWVRNAAV W*
```

The following partial DNA sequence was identified in *N. meningitidis* <SEQ ID 1963>:

```
m614.seq
    1 ATGGCTGCGT TCAACGCTTT AGACGGTAAA AAAGAAGACA ACGGGCAAAT

51 CGAATACTCT CAGTTCATCC AACAGGTCAA CAACGGCGAA GTATCCGGCG

101 TCAACATCGA AGGATCCGTC GTCAGCGGCT ACCTGATTAA GGGCGAGCGC

151 ACCGACAAAA GCACTTTCTT CACCAACGCG CCTTTGGACG ACAACCTAAT

201 TAAAACACTG CTCGACAAAA ACGTCCGCGT AAAAGTAACG CCGGAAGAAA

251 AACCGAGCGC GCTGGCTGCC CTGTTTTACA GCCTGCTGCC CGTCCTGCTG

301 CTGATTGGCG CATGGTTCTA CTTCATGCGT ATGCAGACGG GCGGCGGCGG

351 AAAAGGCGGC GCATTCTCAT TCGGTAAAAG CCGCGCCCGC CTGCTGGACA

401 AAGATGCCAA CAAAGTGACC TTTGCCGATG TCGCCGGCTG CGACGAAGCC

451 AAAGAAGAAG TACAGGAAAT CGTCGATTAC CTCAAAGCGC CGAACCGCTA

501 TCAAAGCCTG GGCGGGCGCG TGCCGCGCGG CATCCTGCTG GCGGGCAGCC

551 CGGGTACGGG TAAGACGCTT TTGGCGAAAG CGATTGCAGG CGAAGCCGGC

601 GTGCCGTTCT TCAGCATTTC AGGTTCCGAC TTTGTCGAAA TGTTCGTCGG

651 TGTCGGTGCG AGCCGCGTCC GCGATATGTT CGAGCAGGCG AAGAAAAACG

701 CCCCCTGCAT CATCTTTATC GACGAGATTG ACGCAGTCGG CCGCCAACGC

751 GGCGCAGGTT TGGGCGGCGG CAATGATGAG CGCGAGCAAA CATTAAACCA

801 ATTGTTGGTT GAAATGGACG GTTTTGAGAG CAATCAGACT GTAATTGTGA

851 TTGCGGCAAC CAACCGCCCC GACGTACTCG ATCCTGCGCT GCAACGCCCC

901 GGCCGTTTCG ACCGCCAAGT GGTTGTCCCC CTGCCGGACA TCCGAGGGCG

951 CGAACAGATT TTGAACGTCC ATTCTAAAAA AGTGCCTTTG GACGAATCTG

1001 TGGATTTATT GTCCCTCGCG CGCGGCACGC CGGGTTTTTC CGGCGCGGAT

1051 TTGGCGAACT TGGTCAACGA AGCCGCCCTG TTTGCCGGCC GCCGCAATAA

1101 AGTCAAAGTC GATCAGAGCG ATTTGAAGAC GCCAAAGACA AAATCTATAT

1151 GGGTCCGGAA CGCCGCAGTA TGGTGA
```

This corresponds to the amino acid sequence <SEQ ID 1964; ORF 614>:

```
m614.pep
    1 MAAFNALDGK KEDNGQIEYS QFIQQVNNGE VSGVNIEGSV VSGYLIKGER

51 TDKSTFFTNA PLDDNLIKTL LDKNVRVKVT PEEKPSALAA LFYSLLPVLL

101 LIGAWFYFMR MQTGGGGKGG AFSFGKSRAR LLDKDANKVT FADVAGCDEA

151 KEEVQEIVDY LKAPNRYQSL GGRVPRGILL AGSPGTGKTL LAKAIAGEAG

201 VPFFSISGSD FVEMFVGVGA SRVRDMFEQA KKNAPCIIFI DEIDAVGRQR

251 GAGLGGGNDE REQTLNQLLV EMDGFESNQT VIVIAATNRP DVLDPALQRP

301 GRFDRQVVVP LPDIRGREQI LNVHSKKVPL DESVDLLSLA RGTPGFSGAD

351 LANLVNEAAL FAGRRNKVKV DQSDLKTPKT KSIWVRNAAV W*
```

Computer analysis of this amino acid sequence gave the following results:

Homology with a Predicted ORF from *N. gonorrhoeae* m614/g614 98.0% identity in 391 aa overlap

```
              10         20         30         40         50         60
m614.pep   MAAFNALDGKKEDNGQIEYSQFIQQVNNGEVSGVNIEGSVVSGYLIKGERTDKSTFFTNA
           |||||||||||||||||||||||:||||||||||||||||||||||||||||||||||||
g614       MAAFNALDGKKEDNGQIEYSQFIRQVNNGEVSGVNIEGSVVSGYLIKGERTDKSTFFTNA
              10         20         30         40         50         60

70         80         90        100        110        120
m614.pep   PLDDNLIKTLLDKNVRVKVTPEEKPSALAALFYSLLPVLLLIGAWFYFMRMQTGGGGKGG
           ||||||:|||:|||||||||||||||||:|||||||||||||||||||||||:|||||||
g614       PLDDNLIQTLLNKNVRVKVTPEEKPSALTALFYSLLPVLLLIGAWFYFMRMQAGGGGKGG
              70         80         90        100        110        120

130        140        150        160        170        180
m614-pep   AFSFGKSRARLLDKDANKVTFADVAGCDEAKEEVQEIVDYLKAPNRYQSLGGRVPRGILL
           ||||||||||||||||||||||||||||||||||||||||||||||||||||||||||||
g614       AFSFGKSRARLLDKDANKVTFADVAGCDEAKEEVQEIVDYLKAPNRYQSLGGRVPRGILL
             130        140        150        160        170        180

190        200        210        220        230        240
m614.pep   AGSPGTGKTLLAKAIAGEAGVPFFSISGSDFVEMFVGVGASRVRDMFEQAKKNAPCIIFI
           ||||||||||||||||||||||||||||||||||||||||||||||||||||||||||||
g614       AGSPGTGKTLLAKAIAGEAGVPFFSISGSDFVEMFVGVGASRVRDMFEQAKKNAPCIIFI
             190        200        210        220        230        240

250        260        270        280        290        300
m614.pep   DEIDAVGRQRGAGLGGGNDEREQTLNQLLVEMDGFESNQTVIVIAATNRPDVLDPALQRP
           ||||||||||||||||||||||||||||||||||||||||||||||||||||||||||||
g614       DEIDAVGRQRGAGLGGGNDEREQTLNQLLVEMDGFESNQTVIVIAATNRPDVLDPALQRP
             250        260        270        280        290        300

310        320        330        340        350        360
m614.pep   GRFDRQVVVPLPDIRGREQILNVHSKKVPLDESVDLLSLARGTPGFGGADLANLVNEAAL
           ||||||||||||||||||| |||||||||||||||||||||||||:||||| |||||| |
g614       GRFDRQVVVPLPDIRGREQXLNVHSKKVPLDESVDLLSLARGTPGFSGADLAKLVNEAPL
             310        320        330        340        350        360

370        380        390
m614.pep   FAGRRNKVKVDQSDLKTPKTKSIWVRNAAVWX
           |||||||||||||||||||||||||||||||
g614       FAGRRNKVKVDQSDLKTPKTKSIWVRNAAVWX
             370        380        390
```

The following partial DNA sequence was identified in *N. meningitidis* <SEQ ID 1965>:

```
a614.seq
   1   ATGGCTGCGT TCAACGCTTT AGACGGTAAA AAAGAAGACA ACGGGCAAAT

51   CGAATATTCT CAGTTCATCC AACAGGTCAA CAACGGCGAA GTATCCGGCG

101   TCAACATCGA AGGATCCGTC GTCAGCGGCT ACCTGATTAA GGGCGAGCGC

151   ACCGACAAAA GCACCTTCTT CACCAACGCG CCTTTGGACG ACAACCTGAT

201   TAAACACTG CTCGACAAAA ACGTCCGTGT AAAAGTAACG CCGGAAGAAA

251   AACCGAGCGC GCTGGCTGCC CTGTTTTACA GCCTGCTGCC CGTCCTGCTG

301   CTGATTGGCG CGTGGTTCTA CTTTATGCGT ATGCAGACGG GCGGCGGCGG

351   AAAAGGCGGC GCATTCTCAT TCGGCAAAAG CCGCGCCCGC CTACTGGACA

401   AAGATGCCAA CAAAGTTACC TTTGCCGATG TCGCCGGCTG CGACGAAGCC

451   AAAGAAGAAG TGCAGGAAAT CGTCGATTAC CTCAAAGCGC CGAACCGCTA

501   TCAAAGCCTG GGCGGGCGCG TGCCGCGCGG CATCCTGCTG GCGGGCAGCC

551   CGGGTACGGG TAAGACGCTT TTGGCGAAAG CGATTGCAGG CGAAGCCGGC

601   GTGCCGTTCT TCAGCATTTC AGGTTCCGAC TTTGTCGAAA TGTTCGTCGG

651   TGTCGGTGCA AGCCGCGTCC GCGATATGTT CGAGCAGGCG AAGAAAAACG

701   CCCCCTGCAT CATCTTTATC GACGAGATTG ACGCAGTCGG CCGCCAACGC

751   GGCGCAGGTT TGGGCGGCGG TAATGATGAG CGCGAGCAAA CATTAAACCA
```

-continued

```
 801  ATTGTTGGTT GAAATGGACG GTTTTGAGAG CAATCAGACT GTAATTGTGA

851  TTGCGGCAAC CAACCGCCCC GACGTACTCG ATCCTGCGCT GCAACGCCCC

901  GGCCGTTTCG ACCGCCAAGT GGTTGTCCCC CTGCCGGACA TCCGGGGGCG

951  CGAACAGATT TTGAACGTCC ACTCTAAAAA AGTGCCTTTG ACAAATCTG

1001  TGGATTTATT GTCCCTCGCG CGCGGCACGC CGGGTTTTTC CGGCGCGGAT

1051  TTGGCGAACT TGGTCAACGA AGCCGCCCTG TTTGCCGGCC GCCGCAATAA

1101  AGTCAAAGTC GATCAGAGCG ATTTGAAGAC GCCAAAGACA AAATCTATAT

1151  GGGTCCGGAA CGCCGCAGTA TGGTGA
```

15

This corresponds to the amino acid sequence <SEQ ID 1966; ORF 614.a>:

```
a614.pep
    1  MAAFNALDGK KEDNGQIEYS QFIQQVNNGE VSGVNIEGSV VSGYLIKGER

51  TDKSTFFTNA PLDDNLIKTL LDKNVRVKVT PEEKPSALAA LFYSLLPVLL

101  LIGAWFYFMR MQTGGGGKGG AFSFGKSRAR LLDKDANKVT FADVAGCDEA

151  KEEVQEIVDY LKAPNRYQSL GGRVPRGILL AGSPGTGKTL LAKAIAGEAG

201  VPFFSISGSD FVEMFVGVGA SRVRDMFEQA KKNAPCIIFI DEIDAVGRQR

251  GAGLGGGNDE REQTLNQLLV EMDGFESNQT VIVIAATNRP DVLDPALQRP

301  GRFDRQVVVP LPDIRGREQI LNVHSKKVPL DKSVDLLSLA RGTPGFSGAD

351  LANLVNEAAL FAGRRNKVKV DQSDLKTPKT KSIWVRNAAV W*
``` m614/a614 99.7% identity in 391 aa overlap

```
                  10         20         30         40         50         60
    m614.pep  MAAFNALDGKKEDNGQIEYSQFIQQVNNGEVSGVNIEGSVVSGYLIKGERTDKSTFFTNA
              ||||||||||||||||||||||||||||||||||||||||||||||||||||||||||||
        a614  MAAFNALDGKKEDNGQIEYSQFIQQVNNGEVSGVNIEGSVVSGYLIKGERTDKSTFFTNA
                  10         20         30         40         50         60

70         80         90        100        110        120
    m614.pep  PLDDNLIKTLLDKNVRVKVTPEEKPSALAALFYSLLPVLLLIGAWFYFMRMQTGGGGKGG
              ||||||||||||||||||||||||||||||||||||||||||||||||||||||||||||
        a614  PLDDNLIKTLLDKNVRVKVTPEEKPSALAALFYSLLPVLLLIGAWFYFMRMQTGGGGKGG
                  70         80         90        100        110        120

130        140        150        160        170        180
    m614.pep  AFSFGKSRARLLDKDANKVTFADVAGCDEAKEEVQEIVDYLKAPNRYQSLGGRVPRGILL
              ||||||||||||||||||||||||||||||||||||||||||||||||||||||||||||
        a614  AFSFGKSRARLLDKDANKVTFADVAGCDEAKEEVQEIVDYLKAPNRYQSLGGRVPRGILL
                 130        140        150        160        170        180

190        200        210        220        230        240
    m614.pep  AGSPGTGKTLLAKAIAGEAGVPFFSISGSDFVEMFVGVGASRVRDMFEQAKKNAPCIIFI
              ||||||||||||||||||||||||||||||||||||||||||||||||||||||||||||
        a614  AGSPGTGKTLLAKAIAGEAGVPFFSISGSDFVEMFVGVGASRVRDMFEQAKKNAPCIIFI
                 190        200        210        220        230        240

250        260        270        280        290        300
    m614.pep  DEIDAVGRQRGAGLGGGNDEREQTLNQLLVEMDGFESNQTVIVIAATNRPDVLDPALQRP
              ||||||||||||||||||||||||||||||||||||||||||||||||||||||||||||
        a614  DEIDAVGRQRGAGLGGGNDEREQTLNQLLVEMDGFESNQTVIVIAATNRPDVLDPALQRP
                 250        260        270        280        290        300

310        320        330        340        350        360
    m614.pep  GRFDRQVVVPLPDIRGREQILNVHSKKVPLDESVDLLSLARGTPGFSGADLANLVNEAAL
              ||||||||||||||||||||||||||||||||:|||||||||||||||||||||||||||
        a614  GRFDRQVVVPLPDIRGREQILNVHSKKVPLDKSVDLLSLARGTPGFSGADLANLVNEAAL
                 310        320        330        340        350        360

370        380        390
    m614.pep  FAGRRNKVKVDQSDLKTPKTKSIWVRNAAVWX
              |||||||||||||||||||||||||||||||
        a614  FAGRRNKVKVDQSDLKTPKTKSIWVRNAAVWX
                 370        380        390
```

The following partial DNA sequence was identified in *N. gonorrhoeae* <SEQ ID 1967>:

```
g615.seq
    1 ATGTGGAAAC GGCGGCGGCG CGGTGtcggC AGCTTtgaag agcagcGaAT
   51 agatgCCGCC GGCAAACCAC AATGCGGAAa gcaggCtgaa gcGGTTgcgC
  101 GGCagcTTca tGCCGCCTCC TcGTCCaGCC ACGtttGgca gattttggac
  151 aggcgcAGga ATTTGCcgCc gcgtgcggCA agtatgtcgc gcCAttgtgc
  201 cacttcttcg gcggacggTG cttcgtcgaT gctgCATTCG TACagcagga
  251 aatcgagggt ttcttcgatg acggGgatgg AttccgTTTG GataAgCTgc
  301 ttgagttcgt tcatgactGt TCgGATAcgg aaatcgggaa aatgccgtct
  351 gAaagggctt CAGACGGCat tggATTATTT GCTGTGCAGG AAgcgcgttg
  401 cctcttccca tttgcCGGAA AtgATGTCGg gtacggcctg cAGGGATttg
  451 gCGACGGcat cgtcgatttg ccgGcggtgc ttCcgcgctc ggtttGTTca
  501 agacgtagcc gaCGACGagg ttgcggtcGC CGGGGtggcC GATGCCGAGG
  551 CGCAGGCGGt aatagtctgC CGTGCCGAGT TTTGCctgAA TGTCTTTCAA
  601 GCCGTTGTGT CcgcCGttgc cgcCGCCGAG TTTGAATTTg ATCCGTCCGC
  651 AAGGGATGTC GAGTTCGTCG TGGACGACGA GGATTTCTTC GGGTTTGATT
  701 TTGTAGAACT GTGCAAGCGC GGCAACCGCC TGTCCGGAAC GGTTCATGAA
  751 CGTGGCCGGT TTGAGCAGCC AAACATCGCC GTCGGGCAGG GCGGCGCGGG
  801 CAACTTCGCC GAAGAATTTT TTTTCTTCTT TAAACGAAGC CTTCCATTTC
  851 CACGCCAGTT CGTCGAGGAA CCAAAAGCCC GCATTGTGGC GGGTCTGTTC
  901 GTATTCTTTG CCCGGGTTGC CCAAGCCGAC AACCATTTTG ATTGTGttcg
  951 acatgataTT TtccgtgTTT CTgTCGaatg cggtCtgaAG GCTTCAGacg
 1001 gcatggTtaT TCTTCTTgaT TTtgaACgcg tgtgcggCGC GCTTCTTTGG
 1051 GGTCGATCAA CAGCGGGCGG TACACTTCGA TGCGGTCGCC GTCGCGCAGC
 1101 GGCGTGTCGT CTTTGA
```

This corresponds to the amino acid sequence <SEQ ID 1968; ORF 615.ng>:

```
g615.pep
    1 MWKRRRRGVG SFEEQRIDAA GKPQCGKQAE AVARQLHAAS SSSHVWQILD
   51 RRRNLPPRAA SMSRHCATSS ADGASSMLHS YSRKSRVSSM TGMDSVWISC
  101 LSSFMTVRIR KSGKCRLKGL QTALDYLLCR KRVASSHLPE MMSGTACRDL
  151 ATASSICRRC FRARFVQDVA DDEVAVAGVA DAEAQAVIVC RAEFCLNVFQ
  201 AVVSAVAAAE FEFDPSARDV EFVVDDEDFF GFDFVELCKR GNRLSGTVHE
  251 RGRFEQPNIA VGQGGAGNFA EEFFFFFKRS LPFPRQFVEE PKARIVAGLF
  301 VFFARVAQAD NHFDCVRHDI FRVSVECGLK ASDGMVILLD FERVCGALLW
  351 GRSTAGGTLR CGRRAAACR L*
```

The following partial DNA sequence was identified in *N. meningitidis* <SEQ ID 1969>:

```
m615.seq Length: 1116
    1 ATGCGGAAAA GGCGGTGGCG CGGTTTCGGC AGCTTTGAAA AGCAGTGAGT
   51 AAATGCTGCC TGCAAACCAC AATGCCGAGA GCAGGATAAA GCGGTTGCGT
  101 GGCAGATTCA TGCTTGTTCC TCTTCAAGCC ATGTCTGGCA TAGTTTGGAT
  151 AGGCGCAGGA ATTTTCCGCC GCGTGCGGCC AGCATATCGC GCCAAACGGC
  201 AATTTCTTCG GCGGAGGGGG CATCGTCTAT GCTGCATTCG TAGAGCAGGA
  251 AATCGAGGGT TCTTCGATG ACGGGGATGG ATTCGGTTTG ATAAGCTGC
  301 TTGAGTTCGG TCATGACTGT TCGGATATGG AAATCGGGAA CATGCCGTCT
  351 GAAAGGGCTT CAGACGGCAT CGGGTCATTT GCTGTGCAGG AAGCGGGTTG
  401 CTTCTTCCCA TTTGCCGGCA AGGATGTCGG GTATGGCTTG CAGGGATTTG
  451 GCGACGGCAT CGTCAATCTG TCGGCGGTGT .TCCGTACTG GGTTTGTTCA
  501 GGACATAGCC GACGACGAGG TTGCGGTCGC CCGGGTGGCC GATGCCGAGG
  551 CGCAGGCGGT AATAGTCTGC CGTGCCGAGT TTTGCCTGAA TGTCTTTCAA
  601 GCCGTTGTGT CCGCCGTTGC CGCCGCCGAG TTTGAATTTG ATCCGTCCGC
  651 AGGGAATGTC GAGTTCGTCG TGGACGACGA GGATTTCTTC GGGTTTGATT
  701 TTGTAGAACT GTGCAAGCGC GGCAACTGCC TGTCCGGAAC GGTTCATGAA
  751 CGTGGCAGGT TGAGCAGCC AAACGTCGCC GTCGGGCAGG GCGGCACGGG
  801 CGACTTCGCC GAAGAATTTT TTTTCTTCTT TAAATGAAGC CTTCCATTTC
  851 CACGCCAGTT CGTCGAGGAA CCAAAAACCC GCATTGTGGC GTGTCTGTTC
  901 GTATTCTTTG CCCGGGTTGC CCAAGCCGAC AACCATTTTG ATTGTGTTTG
  951 ACATGATATT TTCCGTGTTT CTGTCGAATG CTGTCTGAAG CTTCAGACG
 1001 GCATGGTTAT TCTTCTTGAT TTTGAACGCG TTTGCGGCGC GCTTCTTTGG
 1051 GGTCGATCAA CAGCGGGCGG TACACTTCGA TGCGGTCGCC GTCGCGCAGC
 1101 GGCGTGTCGT CTTTGA
```

This corresponds to the amino acid sequence <SEQ ID 1970; ORF 615>:

```
m615.pep Length: 372
    1 MRKRRWRGFG SFEKQXVNAA CKPQCREQDK AVAWQIHACS SSHVWHSLD
   51 RRRNFPPRAA SISRQTAISS AEGASSMLHS XSRKSRVSSM TGMDSVWISC
  101 LSSVMTVRIW KSGTCRLKGL QTASGHLLCR KRVASSHLPA RMSGMACRDL
  151 ATASSICRRC XRTGFVQDIA DDEVAVARVA DAEAQAVIVC RAEFCLNVFQ
  201 AVVSAVAAAE FEFDPSAGNV EFVVDDEDFF GFDFVELCKR GNCLSGTVHE
  251 RGRFEQPNVA VGQGGTGDFA EEFFFFFKXS LPFPRQFVEE PKTRIVACLF
  301 VFFARVAQAD NHFDCVXHDI FRVSVECCLK ASDGMVILLD FERVCGALLW
  351 GRSTAGGTLR CGRRRAAACR L*
```

Computer analysis of this amino acid sequence gave the following results:

Homology with a Predicted ORF from *N. gonorrhoeae* m615/g615 86.8% identity in 371 aa overlap

```
                    10        20        30        40        50        60
m615.pep    MRKRRWRGFGSFEKQXVNAACKPQCREQDKAVAWQIHACSSSSHVWHSLDRRRNFPPRAA
            | ||| || ||||:| ::|| |||| :| :||| |:|| |||||||: ||||||:|||||
g615        MWKRRRRGVGSFEEQRIDAAGKPQCGKQAEAVARQLHAASSSSHVWQILDRRRNLFPPRA
                    10        20        30        40        50        60

70        80        90       100       110       120
m615.pep    SISRQTAISSAEGASSMLHSXSRKSRVSSMTGMDSVWISCLSSVMTVRIWKSGTCRLKGL
            |:||: | |||:|||||||| |||||||||||||||||||||| ||||| ||| ||||||
g615        SMSRHCATSSADGASSMLHSYSRKSRVSSMTGMDSVWISCLSSFMTVRIRKSGKCRLKGL
                    70        80        90       100       110       120

130       140       150       160       170       180
m615.pep    QTASGHLLCRKRVASSHLPARMSGMACRDLATASSICRRCXRTGFVQDIADDEVAVARVA
            |||  :|||||||||||||  ||| ||||||||||||||| |: ||||:|||||||| ||
g615        QTALDYLLCRKRVASSHLPEMMSGTACRDLATASSICRRCFRARFVQDVADDEVAVAGVA
                   130       140       150       160       170       180

190       200       210       220       230       240
m615.pep    DAEAQAVIVCRAEFCLNVFQAVVSAVAAAEFEFDPSAGNVEFVVDDEDFFGFDFVELCKR
            ||||||||||||||||||||||||||||||||||||| :|||||||||||||||||||||
g615        DAEAQAVIVCRAEFCLNVFQAVVSAVAAAEFEFDPSARDVEFVVDDEDFFGFDFVELCKR
                   190       200       210       220       230       240

250       260       270       280       290       300
m615.pep    GNCLSGTVHERGRFEQPNVAVGQGGTGDFAEEFFFFFKXSLPFPRQFVEEPKTRIVACLF
            || |||||||||||||||:||||||:|:|||||||||| |||||||||||||:|||| ||
g615        GNRLSGTVHERGRFEQPNIAVGQGGAGNFAEEFFFFFKRSLPFPRQFVEEPKARIVAGLF
                   250       260       270       280       290       300

310       320       330       340       350       360
m615.pep    VFFARVAQADNHFDCVXHDIFRVSVECCLKASDGMVILLDFERVCGALLWGRSTAGGTLR
            |||||||||||||||| |||||||||| ||||||||||||||||||||||||||||||||
g615        VFFARVAQADNHFDCVRHDIFRVSVECGLKASDGMVILLDFERVCGALLWGRSTAGGTLR
                   310       320       330       340       350       360

370
m615.pep    CGRRRAAACRLX
            ||||||||||||
g615        CGRRRAAACRLX
                   370
```

The following partial DNA sequence was identified in *N. meningitidis* <SEQ ID 1971>:

```
a615.seq
     1  ATGCGGAAAC GGCGGCGGCG CGGTGTCGGC AGCTTTGAAG AGCAGCGAAT

51  AGATGCCGCC GGCAAACCAC AATGCGGAAA GCAGGCTGAA GCGGTTGCGC

101  GGCAGCTTCA TGCCGCCTCC TCGTCCAGCC ACGTTTGGCA GATTTTGGAC

151  AGGCGCAGGA ATTTGCCGCC GCGTGCGGCA AGTATGTCGC GCCATTGTGC

201  CACTTCTTCG GCGGATGGTG CGTCGTCGAT GCTGCATTCG TACAGCAGGA

251  AATCGAGGGT TTCTTCGATG ACGGGGATGG ATTCGGTTTG GATAAGCTGC

301  TTGAGTTCGG TCATGACTGT TCGGATATGG AAATCGGGAA CATGCCGTCT

351  GAAAGGGCTT CAGACGGCAT CGGGTCATTT GCTGTGCAGG AAGCGGGTTG

401  CCTCTTCACA TTTGCCGGCA AGGATGTCGG GTATGGCTTG CAGGGATTTG

451  GCGACGGCAT CGTCAATCTG TCGGCGGTG. TTCCGTACTG GGTTTGTTCA

501  GGACATAGCC GACGACGAGG TTGCGGTCGC CCGGGTGGCC GATGCCGAGG

551  CGCAGGCGGT AATAGTCTGC CGTGCCGAGT TTTGCCTGAA TGTCTTTCAA

601  GCCGTTGTGT CCACCGTTGC CGCCGCCGAG TTTGAATTTG ATCCGTCCGC

651  AGGGAATGTC GAGTTCGTCG TGGACGACGA GGATTTCTTC GGGTTTGATT

701  TTATAAAACT GCGCAAGGGC GGCAACTGCC TGTCCGGAAC GGTTCATGAA

751  CGTGGTCGGC TTGAGCAGCC AGACATCGCC GTCGGGCAGG GTAGCACGGG
```

```
 801  CGACTTCGCC GAAGAATTTT TTTTCTTCTT TAAATGAAGC CTTCCATTTC

851  CACGCCAGTT CGTCGAGGAA CCAAAAACCC GCATTGTGGC GTGTCTGTTC

901  GTATTCTTTG CCCGGGTTGC CCAAGCCGAC AACCATTTTG ATTGTGTTTG

951  ACATGATATT TTCCGTGTTT CTGCCGAATG CCGTCTGAAG GCTTCAGACG

1001  GCATGGTTAT TCTTCTTGAT TTTGAACGCG TTTGCGGCGC GCTTCTTTGG

1051  GGTCGATCAA CAGCGGGCGG TACACTTCGA TGCGGTCGCC GTCGCGCAGC

1101  GGCGTGTCGT CTTTGA
```

This corresponds to the amino acid sequence <SEQ ID 1972; ORF 615.a>:

```
a615.pep
  1   MRKRRRRGVG SFEEQRIDAA GKPQCGKQAE AVARQLHAAS SSSHVWQILD

51   RRRNLPPRAA SMSRHCATSS ADGASSMLHS YSRKSRVSSM TGMDSVWISC

101   LSSVMTVRIW KSGTCRLKGL QTASGHLLCR KRVASSHLPA RMSGMACRDL

151   ATASSICRRX FRTGFVQDIA DDEVAVARVA DAEAQAVIVC RAEFCLNVFQ

201   AVVSTVAAAE FEFDPSAGNV EFVVDDEDFF GFDFIKLRKG GNCLSGTVHE

251   RGRLEQPDIA VGQGSTGDFA EEFFFFFK*S LPFPRQFVEE PKTRIVACLF

301   VFFARVAQAD NHFDCV*HDI FRVSAECRLK ASDGMVILLD FERVCGALLW

351   GRSTAGGTLR CGRRRAAACR L*
``` m615/a615 90.3% identity in 371 aa overlap

```
                 10         20         30         40         50         60
m615.pep  MRKRRWRGFGSFEKQXVNAACKPQCREQDKAVAWQIHACSSSSHVWHSLDRRRNFPPRAA
          |||||  || ||||:|  ::|| ||||  :|  :||| |:|| |||||||: |||||:|||||
a615      MRKRRRGVGSFEEQRIDAAGKPQCGKQAEAVARQLHAASSSHVWQILDRRRNLPPRAA
                 10         20         30         40         50         60
                 70         80         90        100        110        120
m615.pep  SISRQTAISSAEGASSMLHSXSRKSRVSSMTGMDSVWISCLSSVMTVRIWKSGTCRLKGL
          | :| :  |||:||||||||||||||||||||||||||||||||||||||||||||
a615      SMSRHCATSSADGASSMLHSYSRKSRVSSMTGMDSVWISCLSSVMTVRIWKSGTCRLKGL
                 70         80         90        100        110        120
                130        140        150        160        170        180
m615.pep  QTASGHLLCRKRVASSHLPARMSGMACRDLATASSICRRXRTGFVQDIADDEVAVARVA
          |||  ||||||||||||||| ||| | |||||||||||| | ||||| |||||||| ||
a615      QTALDYLLCRKRVASSHLPEMMSGTACRDLATASSICRRXFRARFVQDVADDEVAVAGVA
                130        140        150        160        170        180
                190        200        210        220        230        240
m615.pep  DAEAQAVIVCRAEFCLNVFQAVVSAVAAAEFEFDPSAGNVEFVVDDEDFFGFDFVELCKR
          ||||||||||||||||||||||||:||||||||||||||||||||||||||||||::| |
a615      DAEAQAVIVCRAEFCLNVFQAVVSTVAAAEFEFDPSAGNVEFVVDDEDFFGFDFIKLRKG
                190        200        210        220        230        240
                250        260        270        280        290        300
m615.pep  GNCLSGTVHERGRFEQPNVAVGQGGTGDFAEEFFFFFKXSLPFPRQFVEEPKTRIVACLF
          ||||||||||||:|||::|||| :||||||||||||||||||||||||||||||||||
a615      GNCLSGTVHERGRLEQPDIAVGQGSTGDFAEEFFFFFKXSLPFPRQFVEEPKTRIVACLF
                250        260        270        280        290        300
                310        320        330        340        350        360
m615.pep  VFFARVAQADNHFDCVXHDIFRVSVECCLKASDGMVILLDFERVCGALLWGRSTAGGTLR
          |||||||||||||||||||||||||:||||||||||||||||||||||||||||
a615      VFFARVAQADNHFDCVXHDIFRVSAECRLKASDGMVILLDFERVCGALLWGRSTAGGTLR
                310        320        330        340        350        360
                370
m615.pep  CGRRRAAACRLX
          ||||||||||||
a615      CGRRRAAACRLX
                370
```

The following partial DNA sequence was identified in *N. gonorrhoeae* <SEQ ID 1973>:

```
g616.seq
   1  atgtcgaaCA CAATCAAAAT GGTTGTCGGC TTGGGCAACC CGGGCAAAGA
  51  ATACGAACAG ACCCGCCACA ATGCGGGCTT TTGGTTCCTC GACGAACTGG
 101  CGTGGAAATG GAAGGCTTCG TTTAAAGAAG AAAAAAAATT CTTCGGCGAA
 151  GTTGCCCGCG CCGCCCTGCC CGACGGCGAT GTTTGGCTGC TCAAACCGGC
 201  CACGTTCATG AACCGTTCCG GACAGGCGGT TGCCGCGCTT GCACAGTTCT
 251  ACAAAATCAA ACCCGAAGAA ATCCTCGTCG TCCACGACGA ACTCGACATC
 301  CCTTGCGGAC GGATcAAATT CAAACTCGGC GgcggcaaCG gcgGACACAA
 351  CGGCTTGAAA GACATTcagG CAAAACTCGG CACGGcagac tattaCCGCC
 401  TGCGCCTCGG CATCGgccaC CCCGGCgacc gcaacctCGT CGtcggctac
 451  gtcttgAACa aaccgagcgc gGaagcaccg Ccggcaaatc gacgatgCCG
 501  TCGccaaATC CCTgcaggcc gtaccCGACA TcaTTTCCGg caaatgggaa
 551  gaggcaacgc gcTTCCTGCA CAGCAAATAA TccaatGCCG TCTGaagccc
 601  ttTcagacgg cattttcccg atttccgTAT CcGAaCagtc atgaacgaac
 651  tcaagcAGcT tatCCAAAcg gaaTccatcC ccgtcatcga agaaccctc
 701  gatttcctgc tGTACGAATG cagcAtcgac gaagCAccgt ccgccgaaga
 751  agtggcacaa TGgcgcgaca tactTGccgc acgcgGcgGC AAATtcCTgc
 801  gcctgtccaa aatctgcCaa aCGTGGCtGG ACgAGGAGGC GGCatgAAgc
 851  tGCCGcgcAA CCgcttcaGc ctgctTTCCG CATTGTGGTT TGCCGGCGGc
 901  atctATtCgc tgctcttcaA AGCTGccgaC ACCGCGCCGC CGCCGTTTCC
 951  ACATTtcgaC AAAGCAGCAC ACCTTGCCCT GTTTTTCGCA CAaatCTTgt
1001  tTctGGCCAA AGCATTCAAA ACCGGAAAAC TTCCCATCCC CTACCGCAGC
1051  CTGATTGCGT TCGCCTTCTG TTTTGCCGTC GGCAGCGAAT GCGCGCAGGC
1101  ATGGTTTACC GCAACGCGAA CCGGCAGTTT GGGCGATGTC CTTGCCgACC
1151  TGACGGGCGC AGCCCTTGCC CTCTTTGCCG CGCGTTCTGC CTGCCGcccg
1201  gactaa
```

This corresponds to the amino acid sequence <SEQ ID 1974; ORF 616.ng>:

```
g616.pep
   1  MSNTIKMVVG LGNPGKEYEQ TRHNAGFWFL DELAWKWKAS FKEEKKFFGE
  51  VARAALPDGD VWLLKPATFM NRSGQAVAAL AQFYKIKPEE ILVVHDELDI
 101  PCGRIKFKLG GGNGGHNGLK DIQAKLGTAD YYRLRLGIGH PGDRNLVVGY
 151  VLNKPSAEAP PANRRCRRQI PAGRTRHHFR QMGRGNALPA QQIIQCRLKP
 201  FQTAFSRFPY PNSHERTQAA YPNGIHPRHR RNPRFPAVRM QHRRSTVRRR
 251  SGTMARHTCR TRRQIPAPVQ NLPNVAGRGG GMKLPRNRFS LLSALWFAGG
 301  IYSLLFKAAD TAPPPFPHFD KAAHLALFFA QILFLAKAFK TGKLPIPYRS
 351  LIAFAFCFAV GSECAQAWFT ATRTGSLGDV LADLTGAALA LFAARSACRP
 401  D*
```

The following partial DNA sequence was identified in *N. meningitidis* <SEQ ID 1975>:

```
m616.seq
    1 ATGTCAAACA CAATCAAAAT GGTTGTCGGC TTGGGCAACC CGGGCAAAGA
   51 ATACGAACAG ACACGCCACA ATGCGGGTTT TTGGTTCCTC GACGAACTGG
  101 CGTGGAAATG GAAGGCTTCA TTTAAAGAAG AAAAAAAATT CTTCGGCGAA
  151 GTCGCCCGTG CCGCCCTGCC CGACGGCGAC GTTTGGCTGC TCAAACCTGC
  201 CACGTTCATG AACCGTTCCG GACAGGCAGT TGCCGCGCTT GCACAGTTCT
  251 ACAAAATCAA ACCCGAAGAA ATCCTCGTCG TCCACGACGA ACTCGACATT
  301 CCCTGCGGAC GGATCAAATT CAAACTCGGC GGCGGCAACG GCGGACACAA
  351 CGGCTTGAAA GACATTCAGG CAAAACTCGG CACGGCAGAC TATTACCGCC
  401 TGCGCCTCGG CATCGGCCAC CCGGGCGACC GCAACCTCGT CGTCGGCTAT
  451 GTCCTGAACA AACCCAGTAC GGAACA.CCG CCGACAGATT GACGATGCCG
  501 TCGCCAAATC CCTGCAAGCC ATACCCGACA TCCTTGCCGG CAAATGGGAA
  551 GAAGCAACCC GCTTCCTGCA CAGCAAATGA CCCGATGCCG TCTGAAGCCC
  601 TTTCAGACGG CATGTTCCCG ATTTCCATAT CCGAACAGTC ATGACCGAAC
  651 TCAAGCAGCT TATCCAAACC GAATCCATCC CCGTCATCGA AGAAACCCTC
  701 GATTTCCTGC TCTACGAATG CAGCATAGAC GATGCCCCCT CCGCCGAAGA
  751 AATTGCCGTT TGGCGCGATA TGCTGGCCGC ACGCGGCGGA AAATTCCTGC
  801 GCCTATCCAA ACTATGCCAG ACATGGCTTG AAGAGGAACA AGCATGAATC
  851 TGCCACGCAA CCGCTTTATC CTGCTCTCGG CATTGTGGTT TGCAGGCAGC
  901 ATTTACTCAC TGCTTTTCAA AGCTGCCGAA ACCGCGCCAC CGCCTTTTCC
  951 GCATTTTGAC AAAGTGGCGC ACCTCGCCCT GTTTTTCGCA CAAATCTGGC
 1001 TTCTGACCAA AGCATTCAGA ACCGACAACC GCCCCATCCC CTATCGCAGC
 1051 CTGATGGTCT TTGCCCTCTG TTTCGCCCTC TTCAGCGAAT GCGCGCAGGC
 1101 ATGGTTTACC GCAACGAGAA CCGGCAGTTT GGGCGATGTC CTTGCCGACC
 1151 TGACGGGCGC AGCCCTTGCC CTCTTTACCG CGCGAGCTGC CTGCCGCCCG
 1201 GACTAA
```

This corresponds to the amino acid sequence <SEQ ID 1976; ORF 616>:

```
m616.pep
    1 MSNTIKMVVG LGNPGKEYEQ TRHNAGFWFL DELAWKWKAS FKEEKKFFGE
   51 VARAALPDGD VWLLKPATFM NRSGQAVAAL AQFYKIKPEE ILVVHDELDI
  101 PCGRIKFKLG GGNGGHNGLK DIQAKLGTAD YYRLRLGIGH PGDRNLVVGY
  151 VLNKPSTEXP PTDXRCRRQI PASHTRHPCR QMGRSNPLPA QQMTRCRLKP
  201 FQTACSRFPY PNSHDRTQAA YPNRIHPRHR RNPRFPALRM QHRRCPLRRR
  251 NCRLARYAGR TRRKIPAPIQ TMPDMAXRGT SMNLPRNRFI LLSALWFAGS
  301 IYSLLFKAAE TAPPPFPHFD KVAHLALFFA QIWLLTKAFR TDNRPIPYRS
  351 LMVFALCFAL FSECAQAWFT ATRTGSLGDV LADLTGAALA LFTARAACRP
  401 D*
``` m616/g616 86.0% identity in 401 aa overlap

```
                   10        20        30        40        50        60
m616.pep   MSNTIKMVVGLGNPGKEYEQTRHNAGFWFLDELAWKWKASFKEEKKFFGEVARAALPDGD
           ||||||||||||||||||||||||||||||||||||||||||||||||||||||||||||
g616       MSNTIKMVVGLGNPGKEYEQTRHNAGFWFLDELAWKWKASFKEEKKFFGEVARAALPDGD
                   10        20        30        40        50        60

70        80        90       100       110       120
m616.pep   VWLLKPATFMNRSGQAVAALAQFYKIKPEEILVVHDELDIPCGRIKFKLGGGNGGHNGLK
           ||||||||||||||||||||||||||||||||||||||||||||||||||||||||||||
g616       VWLLKPATFMNRSGQAVAALAQFYKIKPEEILVVHDELDIPCGRIKFKLGGGNGGHNGLK
                   70        80        90       100       110       120

130       140       150       160       170       180
m616.pep   DIQAKLGTADYYRLRLGIGHPGDRNLVVGYVLNKPSTEXPPTDXRCRRQIPASHTRHPCR
           ||||||||||||||||||||||||||||||||||||:| ||:: ||||||||::|||  |
g616       DIQAKLGTADYYRLRLGIGHPGDRNLVVGYVLNKPSAEAPPANRRCRRQIPAGRTRHHFR
                  130       140       150       160       170       180

190       200       210       220       230       240
m616.pep   QMGRSNPLPAQQMTRCRLKPFQTACSRFPYPNSHDRTQAAYPNRIHPRHRRNPRFPALRM
           ||||:| |||||: :||||||||| |||||||||:|||||||| |||||||||||||:||
g616       QMGRGNALPAQQIIQCRLKPFQTAFSRFPYPNSHERTQAAYPNGIHPRHRRNPRFPAVRM
                  190       200       210       220       230       240

250       260       270       280       290       300
m616.pep   QHRRCPLRRRNCRLARYAGRTRRKIPAPIQTMPDMAXRGTSMNLPRNRFILLSALWFAGS
           ||||  :|||:  :||:: ||||:||||:|::|::| || :|:|||||| |||||||||:
g616       QHRRSTVRRRSGTMARHTCRTRRQIPAPVQNLPNVAGRGGGMKLPRNRFSLLSALWFAGG
                  250       260       270       280       290       300

310       320       330       340       350       360
m616.pep   IYSLLFKAAETAPPPFPHFDKVAHLALFFAQIWLLTKAFRTDNRPIPYRSLMVFALCFAL
           |||||||||:|||||||||||:|||||||||| :|:|||:| : |||||||::||:|||:
g616       IYSLLFKAADTAPPPFPHFDKAAHLALFFAQILFLAKAFKTGKLPIPYRSLIAFAFCFAV
                  310       320       330       340       350       360

370       380       390       400
m616.pep   FSECAQAWFTATRTGSLGDVLADLTGAALALFTARAACRPDX
            |||||||||||||||||||||||||||||||:||:||||||
g616       GSECAQAWFTATRTGSLGDVLADLTGAALALFAARSACRPDX
                  370       380       390       400
```

The following partial DNA sequence was identified in *N. meningitidis* <SEQ ID 1977>:

```
a616.seq
      1  ATGTCAAACA CAATCAAAAT GGTTGTCGGC TTGGGCAACC CGGGCAAAGA

51  ATACGAACAG ACACGCCACA ATGCGGGTTT TTGGTTCCTC GACGAACTGG

101  CGTGGAAATG GAAGGCTTCA TTTAAAGAAG AAAAAAAATT CTTCGGCGAA

151  GTCGCCCGTG CTACCCTGCC CGACGGCGAT GTCTGGCTGC TCAAGCCGAC

201  CACGTTCATG AACCGTTCCG GACAGGCAGT TGCCGCCCTT GCGCAGTTTT

251  ATAAAATCAA ACCCGAAGAA ATCCTCGTCG TCCACGACGA ACTCGACATT

301  CCCTGCGGAC GGATCAAATT CAAACTCGGC GGCGGCAACG GTGGACACAA

351  CGGCTTGAAA GACATTCAGG CAAAACTCGG CACGGCAGAC TATTACCGCC

401  TGCGCCTCGG CATCGGCCAC CCGGGCGACC GCAACCTCGT CGTCGGCTAT

451  GTCCTGAACA AACCCAGTAC GGAA.CACCG CCGACAGATT GACGATGCCG

501  TCGCCAAATC CCTGCAAGCC ATACCCGACA TCCTTGCCGG CAAATGTGAA

551  GAGGCAACCC GCTTCCTGCA CAGCAAATGA CCCGATGCCG TCTGAAGCCC

601  TTTCAGACGG CATGTTCCCG ATTTCCATAT CCGAACAGTC ATGACCGAAC

651  TCAAGCAGCT TATCCAAACC GAATCCATCC CCGTCATCGA AGAAACCCTC

701  GATTTCCTGC TGTACGAATG CAGCATCGAC GACGCACCAT CCGCCGAAGA

751  AGTGGCACAA TGGCGCGACA TACTTGCCGC ACGCGGCGGC AAATTCCTGC

801  GCCTGTCCAA AATCTGCCAA ACGTGGCTGG ACGAGGAGGC GGCATGAAGC

851  TGCCGCGCAA CCGCTTCAGC CTGCTTTCCG CATTGTGGTT TGCCGGCGGC
```

-continued

```
 901   ATCTATTCGC TGCTCTTCAA AGCTGCCGAC ACCGCGCCGC CGCCGTTTCC

951   GCATTTCGAC AAAGCAGCAC ACCTTGCCCT GTTTTTCGCA CAAATCTGGC

1001   TTTTGACCAA AGCATTCAAA ACCGGAAAAC TTCCCATCCC CTACCGCAGC

1051   CTGATGGTCT TTGCCCTCTG TTTCGCCCTC TTCAGCGAAT GCGCGCAGGC

1101   ATGATTTACC GCAACGAGAA CCGGCAGTTT GGGCGATGTT CTTGCCGATA

1151   TGGCAGGTAC GGTTCTCGCA CTCTTTGCCG CCCGCGCCGC CGACCGCCCG

1201   GACTGA
```

This corresponds to the amino acid sequence <SEQ ID 1978;
ORF 616.a>:

```
a616.pep
    1   MSNTIKMVVG LGNPGKEYEQ TRHNAGFWFL DELAWKWKAS FKEEKKFFGE

51   VARATLPDGD VWLLKPTTFM NRSGQAVAAL AQFYKIKPEE ILVVHDELDI

101   PCGRIKFKLG GGNGGHNGLK DIQAKLGTAD YYRLRLGIGH PGDRNLVVGY

151   VLNKPSTEXP PTD*RCRRQI PASHTRHPCR QM*RGNPLPA QQMTRCRLKP

201   FQTACSRFPY PNSHDRTQAA YPNRIHPRHR RNPRFPAVRM QHRRRTIRRR

251   SGTMARHTCR TRRQIPAPVQ NLPNVAGRGG GMKLPRNRFS LLSALWFAGG

301   IYSLLFKAAD TAPPPFPHFD KAAHLALFFA QIWLLTKAFK TGKLPIPYRS

351   LMVFALCFAL FSECAQA*FT ATRTGSLGDV LADMAGTVLA LFAARAADRP

401   D*
``` m616/a616 90.0% identity in 401 aa overlap

```
                10         20         30         40         50         60
   m616.pep  MSNTIKMVVGLGNPGKEYEQTRHNAGFWFLDELAWKWKASFKEEKKFFGEVARAALPDGD
             ||||||||||||||||||||||||||||||||||||||||||||:||||||||:|||||
       a616  MSNTIKMVVGLGNPGKEYEQTRHNAGFWFLDELAWKWKASFKEEXKFFGEVARATLPDGD
                10         20         30         40         50         60

70         80         90        100        110        120
   m616.pep  VWLLKPATFMNRSGQAVAALAQFYKIKPEEILVVHDELDIPCGRIKFKLGGGNGGHNGLK
             ||||||:|||||||||||||||||||||||||||||||||||||||||||||||||||||
       a616  VWLLKPTTFMNRSGQAVAALAQFYKIKPEEILVVHDELDIPCGRIKFKLGGGNGGHNGLK
                70         80         90        100        110        120

130        140        150        160        170        180
   m616.pep  DIQAKLGTADYYRLRLGIGHPGDRNLVVGYVLNKPSTEXPPTDXRCRRQIPASHTRHPCR
             ||||||||||||||||||||||||||||||||||||||||||||||||||||||||||||
       a616  DIQAKLGTADYYRLRLGIGHPGDRNLVVGYVLNKPSTEXPPTDXRCRRQIPASHTRHPCR
               130        140        150        160        170        180

190        200        210        220        230        240
   m616.pep  QMGRSNPLPAQQMTRCRLKPFQTACSRFPYPNSHDRTQAAYPNRIHPRHRRNPRFPALRM
             || :|||||||||||||||||||||||||||||||||||||||||||||||||||||:||
       a616  QMXRGNPLPAQQMTRCRLKPFQTACSRFPYPNSHDRTQAAYPNRIHPRHRRNPRFPAVRM
               190        200        210        220        230        240

250        260        270        280        290        300
   m616.pep  QHRRCPLRRRNCRLARYAGRTRRKIPAPIQTMPDMAXRGTSMNLPRNRFILLSALWFAGS
             ||||  :|||:  :||::  ||||:||||:|::|::| ||  :|:|||||  ||||||||:
       a616  QHRRRTIRRRSGTMARHTCRTRRQIPAPVQNLPNVAGRGGGMKLPRNRFSLLSALWFAGG
               250        260        270        280        290        300

310        320        330        340        350        360
   m616.pep  IYSLLFKAAETAPPPFPHFDKVAHLALFFAQIWLLTKAFRTDNRPIPYRSLMVFALCFAL
             ||||||||||:||||||||||||:||||||||||||||||||:  ||||||||||||||||
       a616  IYSLLFKAADTAPPPFPHFDKAAHLALFFAQIWLLTKAFKTGKLPIPYRSLMVFALCFAL
               310        320        330        340        350        360

370        380        390        400
   m616.pep  FSECAQAWFTATRTGSLGDVLADLTGAALALFTARAACRPDX
             ||||||| ||||||||||||||||:::|::||||:|||| |||
       a616  FSECAQAXFTATRTGSLGDVLADMAGTVLALFAARAADRPDX
               370        380        390        400
```

The following partial DNA sequence was identified in *N. gonorrhoeae* <SEQ ID 1979>:

```
g619.seq
     1  ATGCCGTCTG AAAAAAATAT CGGTTTTATG GCAGGAAGCA GCCGTCCGTT
    51  GCGGGTCGCC TTTGCGCTGT TGCTGGTTTC CTGCATCCTG TTTATGACGC
   101  TCAACGTCAA AGGAGATTGG GACTTTGTCT TGCACCTGCG CCTGACCAAG
   151  CTTGCCGCGC TGCTGATGGT CGCCTATGCG GTCGGCGTGT CCACTCAACT
   201  CTTCCAAACG CTGACCAACA ACCCGATTCT GACCCCTTCG ATTTTGGGTT
   251  TCGATTCGCT GTATGTGTTT TTGCAGACCT TGCTGgtGTT TACGTtcgGC
   301  GGCGTGGGCT ATAcatccct gccgttgacg gGCAAATTCG GCTTTGAACT
   351  GGTTGTTATG ATGGGCGGCT CGCTGCTGCT GTTTTACACG CTCATCCGTC
   401  AGGGCGGGCG CGATTTGCCG CACATGATTT TAATCGGCGT GATTTTCGGG
   451  ATTTTGTTCC GCAGCCTTTC CTCGCTGCTT TCGCGCATGA TAGACCCCGA
   501  AGAATTTACC GCCGCGCAGG CGAATATGTT TGCCGGATTC AATACCGTCC
   551  GCAGCGAGCT TTTAGGCATA GGCGCGCTGG TCCTGCTCGT CAGCGCGGCG
   601  GTCGTTTGGC ACGAACGCTA CCGCTCGGAC GTACACCTTT TGGGGCGCGA
   651  CCAAGCCGTC AATTTGGGCA TCAGCTACAC GCGCAACACC TTATGGATAC
   701  TGCTTTGGAT TGCCGCATTG GTGGCGACGG CGACCGCCGT TGTCGGCCCG
   751  GTGAGCTTTT TCGGGCTTCT CGCCGCCTCG CTTGCCAACC ACTTTTCCCc
   801  gtCCGTGCGC CATTCCGTCC GCCTGCcgat gacggtttGC gtcgGcggCA
   851  TCCTCTTGgt cggCggacaA ACCGTATTCG AACACTTCTT GGGCATGAag
   901  gCggTATTAA GCGTGGTGGt cgAATTTGCG ggcggactcG TTTTCCTCTA
   951  TCTCGTTTTA AAACACAAAA AATGA
```

This corresponds to the amino acid sequence <SEQ ID 1980; ORF 619.a>:

```
g619.pep
     1  MPSEKNIGFM AGSSRPLRVA FALLLVSCIL FMTLNVKGDW DFVLHLRLTK
    51  LAALLMVAYA VGVSTQLFQT LTNNPILTPS ILGFDSLYVF LQTLLVFTFG
   101  GVGYTSLPLT GKFGFELVVM MGGSLLLFYT LIRQGGRDLP HMILIGVIFG
   151  ILFRSLSSLL SRMIDPEEFT AAQANMFAGF NTVRSELLGI GALVLLVSAA
   201  VVWHERYRSD VHLLGRDQAV NLGISYTRNT LWILLWIAAL VATATAVVGP
   251  VSFFGLLAAS LANHFSPSVR HSVRLPMTVC VGGILLVGGQ TVFEHFLGMK
   301  AVLSVVVEFA GGLVFLYLVL KHKK*
```

The following partial DNA sequence was identified in *N. meningitidis* <SEQ ID 1981>:

```
m619.seq
     1  ATGCCGTCTG AAAAAAATAT CGGTTTTATG GCAGGAAGCA GCCGCCCGTT
    51  GTGGGTCGCC TTTGCGCTGT TGCTGGTTTC CTGCGTCCTG TTTATGACGC
   101  TCAACGTCAA AGGCGATTGG GATTTTGTTT TGCAACTGCG GCTGACCAAA
   151  CTTGCCGCGC TGCTGATGGT CGCCTATGCG GTCGGCGTGT CCACGCAACT
   201  CTTCCAAACG CTGACCAATA ATCCGATTCT GACCCCTTCA ATTTTGGGTT
```

```
-continued
251    TCGATTCGCT GTATGTGTTT TTGCAGACCT TGCTGGTGTT TACGTTCGGC

301    GGCGTGGGCT ATGCTTCCCT GCCGTTGACG GGCAAATTCG GCTTTGAACT

351    GGTCGTCATG ATGGGCGGCT CGCTGCTGCT GTTCTACACG CTCATCAAAC

401    AGGGCGGACG CGATTTGTCG CGCATGATTT TAATCGGCGT GATTTTCGGG

451    ATTTTGTTCC GCAGCCTGTC GTCGCTGCTT TCGCGCATGA TCGATCCCGA

501    AGAATTTACC GCCGCGCAGG CGAATATGTT TGCCGGATTC AATACCGTCC

551    ACAGCGAGCT TTTGGGCATA GGCGCGCTGA TTCTGCTCGT CAGCGCGGCG

601    GTCGTTTGGC GCGAACGCTA CCGCTTGGAC GTTTACCTTT TGGGGCGTGA

651    CCAAGCCGTC AATTTGGGCA TCAGCTACAC GCGCAACACC TTATGGATAC

701    TGCTTTGGAT TGCCGCATTG GTGGCGACGG CGACCGCCGT GGTCGGCCCC

751    GTAAGCTTTT TCGGGCTTCT CGCCGCCTCG CTTGCCAACC ACTTTTCCCC

801    GTCGGTCAAA CATTCCGTCC GCCTGCCGAT GACGGTTTGT ATCGGCGGCA

851    TCCTCTTGGT CGGCGGACAG ACCGTGTTCG AACACCTGCT CGGTATGCAG

901    GCAGTGTTGA GCGTAGTAGT AGAATTTGCC GGCGGACTCG TTTTCCTCTA

951    TCTCGTTTTA AAACACAAAA AATGA
```

This corresponds to the amino acid sequence <SEQ ID 1982;
ORF 619>:

```
m619.pep
    1  MPSEKNIGFM AGSSRPLWVA FALLLVSCVL FMTLNVKGDW DFVLQLRLTK

51  LAALLMVAYA VGVSTQLFQT LTNNPILTPS ILGFDSLYVF LQTLLVFTFG

101  GVGYASLPLT GKFGFELVVM MGGSLLLFYT LIKQGGRDLS RMILIGVIFG

151  ILFRSLSSLL SRMIDPEEFT AAQANMFAGF NTVHSELLGI GALILLVSAA

201  VVWRERYRLD VYLLGRDQAV NLGISYTRNT LWILLWIAAL VATATAVVGP

251  VSFFGLLAAS LANHFSPSVK HSVRLPMTVC IGGILLVGGQ TVFEHLLGMQ

301  AVLSVVVEFA GGLVFLYLVL KHKK*
``` m619/g619 95.1% identity in 324 aa overlap

```
                  10         20         30         40         50         60
m619.pep  MPSEKNIGFMAGSSRPLWVAFALLLVSCVLFMTLNVKGDWDFVLQLRLTKLAALLMVAYA
          ||||||||||||||||||| ||||||||||:|||||||||||||:||||||||||||||
g619      MPSEKNIGFMAGSSRPLRVAFALLLVSCILFMTLNVKGDWDFVLHLRLTKLAALLMVAYA
                  10         20         30         40         50         60

70         80         90        100        110        120
m619.pep  VGVSTQLFQTLTNNPILTPSILGFDSLYVFLQTLLVFTFGGVGYASLPLTGKFGFELVVM
          |||||||||||||||||||||||||||||||||||||||||||||:|||||||||||||
g619      VGVSTQLFQTLTNNPILTPSILGFDSLYVFLQTLLVFTFGGVGYTSLPLTGKFGFELVVM
                  70         80         90        100        110        120

130        140        150        160        170        180
m619.pep  MGGSLLLFYTLIKQGGRDLSRMILIGVIFGILFRSLSSLLSRMIDPEEFTAAQANMFAGF
          |||||||||||:||||||  :|||||||||||||||||||||||||||||||||||||
g619      MGGSLLLFYTLIRQGGRDLPHMILIGVIFGILFRSLSSLLSRMIDPEEFTAAQANMFAGF
                 130        140        150        160        170        180

190        200        210        220        230        240
m619.pep  NTVHSELLGIGALILLVSAAVVWRERYRLDVYLLGRDQAVNLGISYTRNTLWILLWIAAL
          |||:|||||||||:||||||||| ||:||| :|||||||||||||||||||||||||||
g619      NTVRSELLGIGALVLLVSAAVVWHERYRSDVHLLGRDQAVNLGISYTRNTLWILLWIAAL
                 190        200        210        220        230        240

250        260        270        280        290        300
m619.pep  VATATAVVGPVSFFGLLAASLANHFSPSVKHSVRLPMTVCIGGILLVGGQTVFEHLLGMQ
          ||||||||||||||||||||||||||||:|||||||||||:|||||||||||||:|||:
g619      VATATAVVGPVSFFGLLAASLANHFSPSVRHSVRLPMTVCVGGILLVGGQTVFEHFLGMK
                 250        260        270        280        290        300
```

```
                  310         320
m619.pep    AVLSVVVEFAGGLVFLYLVLKHKKX
            ||||||||||||||||||||||||
g619        AVLSVVVEFAGGLVFLYLVLKHKKX
                  310         320
```

The following partial DNA sequence was identified in *N. meningitidis* <SEQ ID 1983>:

```
a619.seq
    1   ATGCCGTCTG AAAAAAATAT CGGTTTTATG GCAGGAAGCA GCCGTCCGTT
   51   GTGGGTTGCC TTTGCGCTGT TGCTGGTTTC CTGCATCCTG TTTATGACGC
  101   TCAACGTCAA AGGCGATTGG GATTTTGTTT TGCACCTGCG CCTGACCAAG
  151   CTTGCCGCGC TGCTGATGGT CGCCTATGCG GTCGGCGTTT CGACCCAGCT
  201   TTTTCAAACG CTGACCAACA ATCCGATTCT GACCCCTTCG ATTTTGGGTT
  251   TCGATTCGCT GTATGTGTTT TTGCAGACCT TGCTGGTGTT TACGTTCGGC
  301   GGCGTGGGCT ATGCTTCCCT GCCGTTGACG GGCAAATTCG GCTTTGAACT
  351   GGTCGTTATG ATGGGCGGCT CGCTGCTGCT GTTTTACACG CTCATCAAAC
  401   AGGGCGGGCG CGATTTGCCG CGTATGATTT TAATCGGCGT GATTTTCGGG
  451   ATTTTGTTCC GCAGCCTGTC GTCGCTGCTT TCGCGCATGA TCGACCCCGA
  501   AGAATTTACG GCGGCGCAGG CGAATATGTT TGCCGGATTC AATACCGTCC
  551   ACAGCGAGCT TTTAGGCATA GGCGCGCTGA TTCTGCTCGT CAGCGCGGCG
  601   GTCGTTTGGC GCGAACGCTA CCGCTTGGAC GTACACCTTT TGGGGCGCGA
  651   CCAAGCCATA AATTTGGGCA TCAGCTACAC GCGCAACACC TTATGGATAC
  701   TGCTTTGGAT TGCCGCGCTG GTGGCGACGG CGACCGCCGT TGTCGGCCCG
  751   GTAAGCTTTT TCGGGCTTCT CGCCGCCTCG CTTGCCAACC ACTTTTCCCC
  801   GTCGGTCAAA CATTCCGTCC GCCTGCCGAT GACGGTTTGT GTCGGCGGCA
  851   TCCTCTTGGT CGGCGGACAG ACCGTATTCG AACACTTCTT GGGCATGAAG
  901   GCGGTATTAA GCGTGGTGGT CGAATTTGCG GGCGGACTCG TTTTCCTCTA
  951   TCTCGTTTTA AGACACAAAA AATGA
```

This corresponds to the amino acid sequence <SEQ ID 1984; ORF 619.a>:

```
a619.pep
    1   MPSEKNIGFM AGSSRPLWVA FALLLVSCIL FMTLNVKGDW DFVLHRLTK
   51   LAALLMVAYA VGVSTQLFQT LTNNPILTPS ILGFDSLYVF LQTLLVFTFG
  101   GVGYASLPLT GKFGFELVVM MGGSLLLFYT LIKQGGRDLP RMILIGVIFG
  151   ILFRSLSSLL SRMIDPEEFT AAQANMFAGF NTVHSELLGI GALILLVSAA
  201   VVWRERYRLD VHLLGRDQAI NLGISYTRNT LWILLWIAAL VATATAVVGP
  251   VSFFGLLAAS LANHFSPSVK HSVRLPMTVC VGGILLVGGQ TVFEHFLGMK
  301   AVLSVVVEFA GGLVFLYLVL RHKK*
``` m619/a619 97.2% identity in 324 aa overlap

```
                 10        20        30        40        50        60
    m619.pep  MPSEKNIGFMAGSSRPLWVAFALLLVSCVLFMTLNVKGDWDFVLQLRLTKLAALLMVAYA
              ||||||||||||||||||||||||||||:|||||||||||||||:|||||||||||||||
    a619      MPSEKNIGFMAGSSRPLWVAFALLLVSCILFMTLNVKGDWDFVLHLRLTKLAALLMVAYA
                 10        20        30        40        50        60

70        80        90       100       110       120
    m619.pep  VGVSTQLFQTLTNNPILTPSILGFDSLYVFLQTLLVFTFGGVGYASLPLTGKFGFELVVM
              ||||||||||||||||||||||||||||||||||||||||||||||||||||||||||||
    a619      VGVSTQLFQTLTNNPILTPSILGFDSLYVFLQTLLVFTFGGVGYASLPLTGKFGFELVVM
                 70        80        90       100       110       120

130       140       150       160       170       180
    m619.pep  MGGSLLLFYTLIKQGGRDLSRMILIGVIFGILFRSLSSLLSRMIDPEEFTAAQANMFAGF
              ||||||||||||||||||||| ||||||||||||||||||||||||||||||||||||||
    a619      MGGSLLLFYTLIKQGGRDLPRMILIGVIFGILFRSLSSLLSRMIDPEEFTAAQANMFAGF
                130       140       150       160       170       180

190       200       210       220       230       240
    m619.pep  NTVHSELLGIGALILLVSAAVVWRERYRLDVYLLGRDQAVNLGISYTRNTLWILLWIAAL
              |||||||||||||||||||||||||||||||||:||||||:|||||||||||||||||||
    a619      NTVHSELLGIGALILLVSAAVVWRERYRLDVHLLGRDQAINLGISYTRNTLWILLWIAAL
                190       200       210       220       230       240

250       260       270       280       290       300
    m619.pep  VATATAVVGPVSFFGLLAASLANHFSPSVKHSVRLPMTVCIGGILLVGGQTVFEHLLGMQ
              ||||||||||||||||||||||||||||||||||||||||||:||||||||||||:|||:
    a619      VATATAVVGPVSFFGLLAASLANHFSPSVKHSVRLPMTVCVGGILLVGGQTVFEHFLGMK
                250       260       270       280       290       300

310       320
    m619.pep  AVLSVVVEFAGGLVFLYLVLKHKKX
              ||||||||||||||||||||:||||
    a619      AVLSVVVEFAGGLVFLYLVLRHKKX
                310       320
```

The following partial DNA sequence was identified in *N. gonorrhoeae* <SEQ ID 1985>:

```
g620.seq
     1   ATGAAGAAAA  CCCTGTTGGc  AATTGTTGCC  gtTTTCGCCT  TAAGTGCCTG 51   CCGGCaggcg  gaAGaggcac  cgccgCCTTT  ACCCCGGCAG  AtTAGCGacc 101   gttcggtcgg  aCACTAttgC  Agtatgaacc  tgaccgaaca  caacggcccc 151   aaagcccaga  ttttttttgaa  cGGCAAACCC  GATCAGCCCG  TTTGGTTCTC 201   CACCGTcaag  cagatgttcg  GCTATACCAA  GCTGCCCGAA  GAGCCCAAAG

251   GCATCCGCGT  GATTTACGTT  ACCGATATGG  GCAATGTTAC  CGATTGGACG

301   AATCCTAATG  CCGACACGGA  GTGGATAGAT  GCGAAAAAAG  CCTTTTACGT

351   CATCGACAGC  GGCTTTATCG  GCGGTATGGG  CGCGGAAGAC  GCGCTGCCGT

401   TCGGCAACAA  GGAGCAGGCT  GAAAAATTTG  CAAAGGATAA  AGGCGGCAAG

451   GTCGTCGGTT  TTGACGATAT  GCCCGATGCT  TACATTTTCA  AGTAA
```

This corresponds to the amino acid sequence <SEQ ID 1986; ORF 620.ng>:

```
g620.pep
     1   MKKTLLAIVA  VFALSACRQA  EEAPPPLPRQ  ISDRSVGHYC  SMNLTEHNGP

51   KAQIFLNGKP  DQPVWFSTVK  QMFGYTKLPE  EPKGIRVIYV  TDMGNVTDWT

101   NPNADTEWID  AKKAFYVIDS  GFIGGMGAED  ALPFGNKEQA  EKFAKDKGGK

151   VVGFDDMPDA  YIFK*
```

The following partial DNA sequence was identified in *N. meningitidis* <SEQ ID 1987>:

```
m620.seq
    1    ATGAAAAAAA CCCTGTTGGC AATTGTTGCC GTTTCCGCCT TAAGTGCCTG

51    CCGGCAGGCG AAGAGGGAC CGCCGCCTTT ACCCCGGCAG ATTAGCGACC

101    GTTCGGTCGG ACACTATTGC AGTATGAACC TGACCGAACA CAACGGCCCC

151    AAAGCCCAGA TTTTCTTGAA CGGCAAACCC GATCAGCCCG TTTGGTTCTC

201    CACCATCAAG CAGATGTTCG GCTATACCAA GCTGCCCGAA GAGCCTAAAG

251    GCATCCGCGT GATTTACGTT ACCGATATGG GCAATGTTAC CGATTGGACG

301    AATCCCAATG CCGACACGGA GTGGATGGAT GCGAAAAAAG CCTTTTACGT

351    CATCGACAGC GGCTTTATCG GCGGTATGGG TGCGGAAGAC GCGCTGCCGT

401    TCGGCAACAA AGAGCAGGCT GAGAAATTTG CAAAGGATAA AGGCGGTAAG

451    GTTGTCGGTT TCGACGATAT GCCTGATACC TATATTTTCA AATAA
```

This corresponds to the amino acid sequence <SEQ ID 1988; ORF 620>:

```
m620.pep
    1    MKKTLLAIVA VSALSACRQA EEGPPPLPRQ ISDRSVGHYC SMNLTEHNGP

51    KAQIFLNGKP DQPVWFSTIK QMFGYTKLPE EPKGIRVIYV TDMGNVTDWT

101    NPNADTEWMD AKKAFYVIDS GFIGGMGAED ALPFGNKEQA EKFAKDKGGK

151    VVGFDDMPDT YIFK*
``` m620/g620 97.0% identity in 164 aa overlap

```
                10         20         30         40         50         60
m620.pep   MKKTLLAIVAVSALSACRQAEEGPPPLPRQISDRSVGHYCSMNLTEHNGPKAQIFLNGKP
           ||||||||||| ||||||||||:|||||||||||||||||||:|||||||||||||||||
g620       MKKTLLAIVAVFALSACRQAEEAPPPLPRQISDRSVGHYCCMNLTEHNGPKAQIFLNGKP
                10         20         30         40         50         60

70         80         90        100        110        120
m620.pep   DQPVWFSTIKQMFGYTKLPEEPKGIRVIYVTDMGNVTDWTNPNADTEWMDAKKAFYVIDS
           ||||||||:|||||||||||||||||||||||||||||||||||||||:|||||||||||
g620       DQPVWFSTVKQMFGYTKLPEEPKGIRVIYVTDMGNVTDWTNPNADTEWIDAKKAFYVIDS
                70         80         90        100        110        120

130        140        150        160
m620.pep   GFIGGMGAEDALPFGNKEQAEKFAKDKGGKVVGFDDMPDTYIFKX
           |||||||||||||||||||||||||||||||||||||||:||||
g620       GFIGGMGAEDALPFGNKEQAEKFAKDKGGKVVGFDDMPDAYIFKX
               130        140        150        160
```

The following partial DNA sequence was identified in *N. meningitidis* <SEQ ID 1989>:

```
a620.seq
    1    ATGAAAAAAA CCCTGTTGGC AATTGTTGCC GTTTCCGCCT TAAGTGCCTG

51    CCGGCAGGCG AAGAGGGAC CGCCGCCTTT ACCCCGGCAG ATTAGCGACC

101    GTTCGGTCGG ACACTATTGC AGTATGAACC TGACCGAACA CAACGGCCCC

151    AAAGCCCAGA TTTTCTTGAA CGGCAAACCC GATCAGCCCG TTTGGTTCTC

201    CACCATCAAG CAGATGTTCG GCTATACCAA GCTGCCCGAA GAGCCTAAAG

251    GCATCCGCGT GATTTACGTT ACCGATATGG GCAATGTTAC CGATTGGACG

301    AATCCCAATG CCGACACGGA GTGGATGGAT GCGAAAAAAG CCTTTTACGT

351    CATCGACAGC GGCTTTATCG GCGGTATGGG TGCGGAAGAC GCGCTGCCGT
```

-continued

```
401  TCGGCAACAA AGAGCAGGCT GAGAAATTTG CAAAGGATAA AGGCGGTAAG
451  GTTGTCGGTT TCGACGATAT GCCTGATACC TATATTTTCA AATAA
```

This corresponds to the amino acid sequence <SEQ ID 1990; ORF 620.a>:

```
a620.pep
  1  MKKTLLAIVA VSALSACRQA EEGPPPLPRQ ISDRSVGHYC SMNLTEHNGP

51  KAQIFLNGKP DQPVWFSTIK QMFGYTKLPE EPKGIRVIYV TDMGNVTDWT

101  NPNADTEWMD AKKAFYVIDS GFIGGMGAED ALPFGNKEQA EKFAKDKGGK

151  VVGFDDMPDT YIFK*
``` m620/a620 100.0% identity in 164 aa overlap

```
                10         20         30         40         50         60
m620.pep  MKKTLLAIVAVSALSACRQAEEGPPPLPRQISDRSVGHYCGMNLTEHNGPKAQIFLNGKP
          ||||||||||||||||||||||||||||||||||||||| |||||||||||||||||||
a620      MKKTLLAIVAVSALSACRQAEEGPPPLPRQISDRSVGHYCCMNLTEHNGPKAQIFLNGKP
                10         20         30         40         50         60

70         80         90        100        110        120
m620.pep  DQPVWFSTIKQMFGYTKLPEEPKGIRVIYVTDMGNVTDWTNPNADTEWMDAKKAFYVIDS
          ||||||||||||||||||||||||||||||||||||||||||||||||||||||||||||
a620      DQPVWFSTIKQMFGYTKLPEEPKGIRVIYVTDMGNVTDWTNPNADTEWMDAKKAFYVIDS
                70         80         90        100        110        120

130        140        150        160
m620.pep  GFIGGMGAEDALPFGNKEQAEKFAKDKGGKVVGFDDMPDTYIFKX
          |||||||||||||||||||||||||||||||||||||||||||||
a620      GFIGGMGAEDALPFGNKEQAEKFAKDKGGKVVGFDDMPDTYIFKX
                130        140        150        160
```

The following partial DNA sequence was identified in *N. gonorrhoeae* <SEQ ID 1991>:

```
g622.seq
  1  ATGCAactta ccgctgtcgg ACTCAATCAT CAAACCGCAC CTTTAAGCAT
 51  ACGGGAAAag ctggCGTTTG CCGCCGCCGC CCTGCCAGAA gccgTccgCA
101  ATCTTGCCCG AAGCAATGCG GCAACGGAGG CGGTAATCCT TTCTACCTGC
151  AACCGCACCG AGCTTTACTG CGTCGGCGAT TCGGAAgaaa TCATCCGATG
201  GCTTGCCGAT TACCACAGTT TGCCGATTGA AGAAATCCGT CCGTATCTGT
251  ACACGCTGGA TATGCAGGAA ACCGTGCGCC ACGCCTTCCG CGTTGCCTGC
301  GGCTTGGATT CGATGGTTTT GGGCGAGCCG CAGATTTTGG GGCAGATTAA
351  AGATGCGGTG CGTGCGGCTC AAGAACAGGA AAGTATGGGG GCAAAACTCA
401  ATGCCCTGTT CCAAAAAACC TTTTCCGTTG CTAAAGAAGT CCGTACCGAT
451  ACCGCTGTCG GCGAAAATTC GGTTTCGATG GCTTCCGCGT CCGTCAAGTT
501  GGCGGAACAG ATTTTTCCCG ACATCGGCGA TTTGAACGTA TTGTTTATCG
551  GCGCAGGCGA AATGATTGAG CTGGTTGCCA CTTATTTTGC CGCCAAAAAT
601  CCCCGGCTGA TGACGGTTGC CAACCGGACG CTGGCGCGTG CACAGGAGTT
651  GTGCGACAAG CTCGGTGTTA ACGCCGAACC GTGCCTGCTG TCCGATCTGC
701  CTGCCATTCT GCACGATTAC GACGTGGTGG TTTCTTCAAC GGCGAGCCAG
751  CTTCCGATAG TCGGCAAAGG CATGGTCGAA CGCGCATTGA ACAGCGTCA
801  GAGTATGCCG TTGTTCATGC TTGACTTGGC CGTGCCGCGC GATATTGAAG
```

-continued

```
 851  CGGAAGTCGG CGATTTGAAC GATGCGTATC TTTATACGGT GGACGATATG

901  GTCAACATCG TCCAAAGCGg caaggaggca aggcagaaag ccgccgcCgc 951  cgccgaaacg ctggTGTCCG AAAAGGTTGC CGAATTTGTC AGGCAGCAGC 1001  AGGGCAGGCA GagcgttcCG CTGATTAAGG CCTTGCGGGA CGAGGGCGAG

1051  AAAGCGCGCA AGCAGGTGTT GGAAAATGCG ATGAAACAGC TTGCCAAAGG

1101  CGcaaCGGCG GAAGaggttt TGgaacggct gtccgtcCAA CTGACCAACA

1151  AGCTGCTGCA TTCGCCAACT CAAACCTTGA ATAAGGCGGG GGAAGAAGAT

1201  AAAGatttGG TTCATGCCgt cGCGCAGATt tatcatttGG ACAAATAA
```

This corresponds to the amino acid sequence <SEQ ID 1992; ORF 622.ng>:

```
g622.pep
   1  MQLTAVGLNH QTAPLSIREK LAFAAAALPE AVRNLARSNA ATEAVILSTC

51  NRTELYCVGD SEEIIRWLAD YHSLPIEEIR PYLYTLDMQE TVRHAFRVAC

101  GLDSMVLGEP QILGQIKDAV RAAQEQESMG AKLNALFQKT FSVAKEVRTD

151  TAVGENSVSM ASASVKLAEQ IFPDIGDLNV LFIGAGEMIE LVATYFAAKN

201  PRLMTVANRT LARAQELCDK LGVNAEPCLL SDLPAILHDY DVVVSSTASQ

251  LPIVGKGMVE RALKQRQSMP LFMLDLAVPR DIEAEVGDLN DAYLYTVDDM

301  VNIVQSGKEA RQKAAAAAET LVSEKVAEFV RQQQGRQSVP LIKALRDEGE

351  KARKQVLENA MKQLAKGATA EEVLERLSVQ LTNKLLHSPT QTLNKAGEED

401  KDLVHAVAQI YHLDK*
```

The following partial DNA sequence was identified in *N. meningitidis* <SEQ ID 1993>:

```
m622.seq
   1  ATGCAACTTA CCGCTGTCGG ACTCAATCAT CAAACCGCAC CTTTAAGCAT

51  ACGGGAAAAG CTGGCGTTTG CCGCCGCCGC CCTGCCTAAA GCCGTCCGCA

101  ATCTTGCCCG AAGCAATGCG GCAACGGAGG CGGTAATCCT TTCTACCTGC

151  AACCGCACCG AGCTTTACTG CGTCGGTGAT TCGGAAGAAA TCATCCGATG

201  GCTTGCCGAT TACCACAGTT TGCCGATTGA AGAAATCCGT CCGTATCTGT

251  ACGCGCTGGA TATGCAGGAG ACTGTGCGCC ATGCTTTCCG CGTCGCCTGC

301  GGGCTGGATT CGATGGTGTT GGGCGAGCCG CAGATTTTAG GACAGATTAA

351  GGATGCCGTT AGGGTTGCTC AAGAGCAGGA AAGTATGGGT AAGAAACTCA

401  ATGCCCTGTT CCAAAAAACC TTTTCCGTTG CTAAAGAGGT CCGTACCGAT

451  ACTGCCGTCG GCGAAAACTC GGTTTCCATG GCTTCCGCTT CCGTCAAATT

501  GGCGGAACAG ATTTTTCCCG ACATCGGCGA TTTGAATGTC TTGTTTATCG

551  GCGCAGGCGA AATGATTGAG CTGGTTGCCA CTTATTTTGC CGCCAAAAGT

601  CCCCGGCTGA TGACGGTTGC CAACCGGACG CTGGCGCGTG CACAGGAGTT

651  GTGCGACAAG CTCGGTGTCA ACGCCGAACC GTGCCTGCTG TCCGATCTGC

701  CTGCCATTCT GCACGATTAC GACGTAGTGG TTTCTTCAAC GGCAAGCCAG

751  TTGCCCATTG TCGGCAAAGG CATGGTGGAG CGTGCATTGA AACAAAGGCA

801  GAGTATGCCG TTGTTCATGC TTGATTTGGC AGTGCCGCGT GACATTGAAG
```

```
-continued
 851  CGGAAGTCGG CGATTTGAAT GATGCCTATC TTTATACGGT GGACGATATG

901  GTCAATATCG TCCAAAGCGG CAAGGAGGCA AGGCAGAAGG CCGCCGCCGC

951  CGCCGAAACG CTGGTGTCCG AGAAAGTTGC CGAATTTGTC AGGCAGCAGC

1001  AGGGCAGGCA GAGTGTCCCC TTGATTAAGG CGTTGCGGGA CGAGGGCGAG

1051  AAAGCGCGCA ACAGGTGTT GGAAAATGCC ATGAAACAGC TTGCCAAAGG

1101  CGCAACGGCA GAAGAGGTTT TGGAACGGCT GTCCGTCCAA CTGACCAACA

1151  AGCTGCTGCA TTCGCCGACC CAAACCTTGA ATAAGGCGGG GGAAGAAGAT

1201  AAAGATTTGG TTCATGCCGT CGCGCAGATT TATCATTTGG ACAAATAA
```

This corresponds to the amino acid sequence <SEQ ID 1994; ORF 622>:

```
m622.pep
    1   MQLTAVGLNH QTAPLSIREK LAFAAAALPK AVRNLARSNA ATEAVILSTC

51   NRTELYCVGD SEEIIRWLAD YHSLPIEEIR PYLYALDMQE TVRHAFRVAC

101   GLDSMVLGEP QILGQIKDAV RVAQEQESMG KKLNALFQKT FSVAKEVRTD

151   TAVGENSVSM ASASVKLAEQ IFPDIGDLNV LFIGAGEMIE LVATYFAAKS

201   PRLMTVANRT LARAQELCDK LGVNAEPCLL SDLPAILHDY DVVVSSTASQ

251   LPIVGKGMVE RALKQRQSMP LFMLDLAVPR DIEAEVGDLN DAYLYTVDDM

301   VNIVQSGKEA RQKAAAAAET LVSEKVAEFV RQQQGRQSVP LIKALRDEGE

351   KARKQVLENA MKQLAKGATA EEVLERLSVQ LTNKLLHSPT QTLNKAGEED

401   KDLVHAVAQI YHLDK*
``` m622/g622 98.8% identity in 415 aa overlap

```
                 10         20         30         40         50         60
m622.pep  MQLTAVGLNHQTAPLSIREKLAFAAAALPKAVRNLARCNAATEAVILSTCNRTELYCVGD
          ||||||||||||||||||||||||||||||:|||||||||||||||||||||||||||||
g622      MQLTAVGLNHQTAPLSIREKLAFAAAALPEAVRNLARCNAATEAVILSTCNRTELYCVGD
                 10         20         30         40         50         60

70         80         90        100        110        120
m622.pep  SEEIIRWLADYHSLFIEEIRPYLYALDMQETVRHAFRVACGLDSMVLGEPQILGQIKDAV
          |||||||||||||||||||||||||:||||||||||||||||||||||||||||||||||
g622      SEEIIRWLADYHSLFIEEIRPYLYTLDMQETVRHAFRVACGLDSMVLGEPQILGQIKDAV
                 70         80         90        100        110        120

130        140        150        160        170        130
m622.pep  RVAQEQESMGKKLNALFQKTFSVAKEVRTDTAVGENSVSMASASVKLAEQIFPDIGDLNV
          |:||||||||| |||||||||||||||||||||||||||||||||||||||||||||||
g622      RAAQEQESMGAKLNALFQKTFSVAKEVRTDTAVGENSVSMASASVKLAEQIFPDIGDLNV
                130        140        150        160        170        180

190        200        210        220        230        240
m622.pep  LFIGAGEMIELVATVFAAKSPRLMTVANRTLARAQELCDKLGVNAEPCLLSDLPAILHDY
          ||||||||||||||||||||:|||||||||||||||||||||||||||||||||||||||
g622      LFIGAGEMIELVATVFAAKNPRLMTVANRTLARAQELCDKLGVNAEPCLLSDLPAILHDY
                190        200        210        220        230        240

250        260        270        280        290        300
m622.pep  DVVVSSTASQLPIVGKGMVERALKQRQSMPLFMLDLAVPRDIEAEVGDLNDAYLYTVDDM
          ||||||||||||||||||||||||||||||||||||||||||||||||||||||||||||
g622      DVVVSSTASQLPIVGKGMVERALKQRQSMPLFMLDLAVPRDIEAEVGDLNDAYLYTVDDM
                250        260        270        280        290        300

310        320        330        340        350        360
m622.pep  VNIVQSGKEAROKAAAAAETLVCEKVAEFVRQQQGRQSVPLIKALRDEGEKARKQVLENA
          ||||||||||| |||||||||:||||||||||||||||||||||||||||||||||||||
g622      VNIVQSGKEARQKAAAAAETLVGEKVAEFVRQQQGRQSVPLIKALRDEGEKARKQVLENA
                310        320        330        340        350        360

370        380        390        400        410
m622.pep  MKQLAKGATAEEVLERLSVQLTNKLLHSPTQTLNKAGEEDKDLVHAVAQIYHLDKX
          |||||||||||||||||||||||||||||||||||||||||||||||||||||||
g622      MKQLAKGATAEEVLERLSVQLTNKLLHSPTQTLNKAGEEDKDLVHAVAQIYHLDKX
                370        380        390        400        410
```

The following partial DNA sequence was identified in *N. meningitidis* <SEQ ID 1995>:

```
a622.seq
   1  ATGCAACTTA CCGCTGTCGG ACTCAATCAT CAAACCGCAC CTTTAAGCAT
  51  ACGGGAAAAG CTGGCGTTTG CCGCGGCCTG CCTGCCCGAA GCCGTCCGCA
 101  ATCTTGCCCG AAGCAATGCG GCAACGGAGG CGGTAATCCT TTCTACCTGC
 151  AACCGTACCG AGCTTTACTG TGTAGGTGAT TCGGAAGAAA TCATCCGTTG
 201  GCTCGCAGAC TATCACAGCC TTCCCATAGA AGAAATCAGC CCCTACCTTT
 251  ATACTTTGGG GATGCAGGAG ACTGTGCGCC ATGCTTTCCG CGTCGCCTGC
 301  GGCTTGGATT CGATGGTGTT GGGCGAGCCG CAGATTTTAG GACAGATTAA
 351  GGATGCGGTC AGGGTTGCTC AAGAGCAGGA AAGTATGGGT AAGAAACTCA
 401  ATGCCCTGTT CCAAAAAACC TTTTCTGTTG CTAAAGAGGT CCGTACCGAT
 451  ACTGCCGTCG GCGAAAACTC GGTTTCCATG GCTTCCGCTT CCGTCAAGTT
 501  GGCAGAGCAG ATTTTCCCCG ACATCGGCGA TTTGAATGTC TTGTTTATCG
 551  GTGCGGGTGA GATGATTGAG CTGGTTGCCA CTTATTTTGC CGCCAAAAGT
 601  CCCCGGCTGA TGACGGTTGC CAACCGGACG CTGGCGCGTG CACAGGAGTT
 651  GTGCGACAAG CTCGGTGTCA ACGCCGAACC GTGCCTGCTG TCCGATCTGC
 701  CTGCCATTTT GCATGAGTAC GACGTGGTGG TTTCTTCAAC GGCAAGCCAG
 751  TTGCCCATTG TCGGCAAAGG TATGGTGGAG CGCGCATTGA AACAAAGGCA
 801  GAGTATGCCG TTGTTTATGC TTGACTTGGC CGTGCCGCGA GACATTGAGG
 851  CGGAAGTCGG AGATTTGAAC GATGCCTATC TTTATACGGT GGACGATATG
 901  GTCAATATCG TCCAAAGCGG CAAGGAGGCA AGGCAGAAGG CCGCCGCCGC
 951  CGCCGAAACG CTGGTGTCCG AGAAGGTTGC CGAATTTGTC AGGCAGCAGC
1001  AGGGCAGGCA GAGTGTCCCG TTAATCAGGG CATTGAGGGA TGAGGGAGAG
1051  AAAGCGCGCA AACAGGTCTT GGAAAATGCG ATGAAACAGC TTGCCAAAGG
1101  CGCAACGGCA GAAGAGGTTT TGGAAAGGCT GTCGATCCAA CTGACCAACA
1151  AGCTGCTGCA TTCGCCGACC CAAACCTTGA ATAAGGCGGG GGAAGAAGAT
1201  AAAGATTTGG TTCACGCCGT CGCGCAGATT TATCATTTGG ACAAATAA
```

This corresponds to the amino acid sequence <SEQ ID 1996; ORF 622.a>:

```
a622.pep
   1  MQLTAVGLNH QTAPLSIREK LAFAAACLPE AVRNLARSNA ATEAVILSTC
  51  NRTELYCVGD SEEIIRWLAD YHSLPIEEIS PYLYTLGMQE TVRHAFRVAC
 101  GLDSMVLGEP QILGQIKDAV RVAQEQESMG KKLNALFQKT FSVAKEVRTD
 151  TAVGENSVSM ASASVKLAEQ IFPDIGDLNV LFIGAGEMIE LVATYFAAKS
 201  PRLMTVANRT LARAQELCDK LGVNAEPCLL SDLPAILHEY DVVVSSTASQ
 251  LPIVGKGMVE RALKQRQSMP LFMLDLAVPR DIEAEVGDLN DAYLYTVDDM
 301  VNIVQSGKEA RQKAAAAAET LVSEKVAEFV RQQQGRQSVP LIRALRDEGE
 351  KARKQVLENA MKQLAKGATA EEVLERLSIQ LTNKLLHSPT QTLNKAGEED
 401  KDLVHAVAQI YHLDK*
``` m622/a622 98.1% identity in 415 aa overlap

```
              10        20        30        40        50        60
m622.pep  MQLTAVGLNHQTAPLSIREKLAFAAAALPKAVRNLARSNAATEAVILSTCNRTELYCVGD
          ||||||||||||||||||||||||||  ||:||||||||||||||||||||||||||||
a622      MQLTAVGLNHQTAPLSIREKLAFAAACLPEAVRNLARSNAATEAVILSTCNRTELYCVGD
              10        20        30        40        50        60

70        80        90       100       110       120
m622.pep  SEEIIRWLADYHSLPIEEIRPYLYALDMQETVRHAFRVACGLDSMVLGEPQILGQIKDAV
          |||||||||||||||||||  ||||  :||||||||||||||||||||||||||||||||
a622      SEEIIRWLADYHSLPIEEISPYLYTLGMQETVRHAFRVACGLDSMVLGEPQILGQIKDAV
              70        80        90       100       110       120

130       140       150       160       170       180
m622.pep  RVAQEQESMGKKLNALFQKTFSVAKEVRTDTAVGENSVSMASASVKLAEQIFPDIGDLNV
          ||||||||||||||||||||||||||||||||||||||||||||||||||||||||||||
a622      RVAQEQESMGKKLNALFQKTFSVAKEVRTDTAVGENSVSMASASVKLAEQIFPDIGDLNV
             130       140       150       160       170       180

190       200       210       220       230       240
m622.pep  LFIGAGEMIELVATYFAAKSPRLMTVANRTLARAQELCDKLGVNAEPCLLSDLPAILHDY
          |||||||||||||||||||||||||||||||||||||||||||||||||||||||||:|
a622      LFIGAGEMIELVATYFAAKSPRLMTVANRTLARAQELCDKLGVNAEPCLLSDLPAILHEY
             190       200       210       220       230       240

250       260       270       280       290       300
m622.pep  DVVVSSTASQLPIVGKGMVERALKQRQSMPLFMLDLAVPRDIEAEVGDLNDAYLYTVDDM
          ||||||||||||||||||||||||||||||||||||||||||||||||||||||||||||
a622      DVVVSSTASQLPIVGKGMVERALKQRQSMPLFMLDLAVPRDIEAEVGDLNDAYLYTVDDM
             250       260       270       280       290       300

310       320       330       340       350       360
m622.pep  VNIVQSGKEARQKAAAAAETLVSEKVAEFVRQQQGRQSVPLIKALRDEGEKARKQVLENA
          |||||||||||||||||||||||||||||||||||||||||:||||||||||||||||||
a622      VNIVQSGKEARQKAAAAAETLVSEKVAEFVRQQQGRQSVPLIRALRDEGEKARKQVLENA
             310       320       330       340       350       360

370       380       390       400       410
m622.pep  MKQLAKGATAEEVLERLSVQLTNKLLHSPTQTLNKAGEEDKDLVHAVAQIYHLDKX
          ||||||||||||||||||:|||||||||||||||||||||||||||||||||||||
a622      MKQLAKGATAEEVLERLSIQLTNKLLHSPTQTLNKAGEEDKDLVHAVAQIYHLDKX
             370       380       390       400       410
```

The following partial DNA sequence was identified in *N. gonorrhoeae* <SEQ ID 1997>:

```
g624.seq
    1  ATGATCCGTT ATCTTTTAAT TGCCTGCGGC GGCATCTCCC TGCTGTTGGG

51  GATAATCGGC ATTTTTTTGC CGCTGTTGCC GACCACGCCG TTCGTACTAC

101  TCTCCGCCGC CTGCTGGGCA AAGGCAtccc cgcgcTTTCa ccgCTGGCTG

151  CACcgGCacc gCTATTTCGG CCCGATGGTT CATAACTGGG AACAAAACGG

201  CGCAGTGCCG CGCAAAGCCA AGATTTTCGC CATCAGCATG AtaaccgcAt 251  cctgcctcat gatctTTtgg CattTTCccc aacnctggtg ggtcGGGGCG 301  GTTTCATCGG TTTTTTGTTC CCTTGTcacC ATacggatgt gGcacAGacC 351  cgaatCTTGA
```

This corresponds to the amino acid sequence <SEQ ID 1998; ORF 624.ng>:

```
g624.pep
    1  MIRYLLIACG GISLLLGIIG IFLPLLPTTP FVLLSAACWA KASPRFHRWL

51  HRHRYFGPMV HNWEQNGAVP RKAKIFAISM ITASCLMIFW HFPQXWWVGA

101  VSSVFCSLVT IRMWHRPES*
```

The following partial DNA sequence was identified in *N. meningitidis* <SEQ ID 1999>:

```
m624.seq
    1   ATGATACGTT ATCTTTTAAT TGCCTGCGGC TGCATTTCCC TACTGTTGGG

51   TATCATCGGC ATTTTTTGC CGCTGTTGCC GACCACGCCG TTCGTACTGC

101   TCTCCGCCGC CTGCTGGGCA AAGGCATCCC CGCGCTTTTA CCGCTGGCTG

151   CACCGGCACC GCTATTTCGG CCCGATGGTT CATAACTGGG AACAAAACGG

201   CGCAGTGCCG CGCAAAGCCA AAATATTCGC CATCAGTATG ATGACCGCAT

251   CCTGCCTGAT AATGTTTTGG CAGTTTCCCC AACGCTGGTG GGTCGGGGCG

301   GTTTCATCGG TTTTTTGTTC CCTTGTCGCC ATATGGATGT GGCGCAGGCC

351   CGAATCTTGA
```

This corresponds to the amino acid sequence <SEQ ID 2000; ORF 624>:

```
m624.pep
    1   MIRYLLIACG CISLLLGIIG IFLPLLPTTP FVLLSAACWA KASPRFYRWL

51   HRHRYFGPMV HNWEQNGAVP RKAKIFAISM MTASCLIMFW QFPQRWWVGA

101   VSSVFCSLVA IWMWRRPES*
``` m624/g624 91.6% identity in 119 aa overlap

```
                 10        20        30        40        50        60
    m624.pep  MIRYLLIACGCISLLLGIIGIFLPLLPTTPFVLLSAACWAKASPRFYRWLHRHRYFGPMV
              |||||||||| |||||||||||||||||||||||||||||||||||:||||||||||||
        g624  MIRYLLIACGGISLLLGIIGIFLPLLPTTPFVLLSAACWAKASPRFHRWLHRHRYFGPMV
                 10        20        30        40        50        60

70        80        90       100       110       120
    m624.pep  HNWEQNGAVPRKAKIFAISMMTASCLIMFWQFPQRWWVGAVSSVFCSLVAIWMWRRPESX
              ||||||||||||||||||||:||||:||::||:|||||| ||||||||||:| ||:||||
        g624  HNWEQNGAVPRKAKIFAISMITASCLMIFWHFPQXWWVGAVSSVFCSLVTIRMWHRPESX
                 70        80        90       100       110       120
```

The following partial DNA sequence was identified in *N. meningitidis* <SEQ ID 2001>:

```
a624.seq
    1   ATGATACGTT ATCTTTTAAT TGCCTGCGGC TGCATTTCCC TGCTGTTGGG

51   TATCATCGGC ATTTTTTGC CGCTGTTGCC GACCACGCCG TTCGTACTGC

101   TCTCCGCCGC CTGCTGGGCA AAGGCATCCC CGCGCTTTCA CCGCTGGCTG

151   CACCGGCACC GCTATTTCGG TCCGATGGTT CATAACTGGG AACAAAACGG

201   CGCAGTGCCG CGCAAAGCCA AAATATTCGC CATCAGTATG ATGACCGCAT

251   CCTGCCTGAT AATGTTTTGG CAGTTTCCCC AACGCTGGTG GGTCGGGGCG

301   GTTTCATCGG TTTTTTGTTC CCTTGTCGCC ATATGGATGT GGCGCAGGCC

351   CGAATCTTGA
```

This corresponds to the amino acid sequence <SEQ ID 2002; ORF 624.a>:

```
a624.pep
    1   MIRYLLIACG CISLLLGIIG IFLPLLPTTP FVLLSAACWA KASPRFHRWL

51   HRHRYFGPMV HNWEQNGAVP RKAKIFAISM MTASCLIMFW QFPQRWWVGA

101   VSSVFCSLVA IWMWRRPES*
``` m624/a624 99.2% identity in 119 aa overlap

```
              10        20        30        40        50        60
m624.pep  MIRYLLIACGCISLLLGIIGIFLPLLPTTPFVLL3AACWAKASPRFYRWLHRHRYFGPMV
          ||||||||||||||||||||||||||||||||||||||||||||:||||||||||||||
a624      MIRYLLIACGCISLLLGIIGIFLPLLPTTPFVLL3AACWAKASPRFHRWLHRHRYFGPMV
              10        20        30        40        50        60

70        80        90       100       110       120
m624.pep  HNWEQNGAVPRKAKIFAISMMTASCLIMFWQFPQRWWVGAVSSVFCSLVAIWMWRRPESX
          ||||||||||||||||||||||||||||||||||||||||||||||||||| : ||||||
a624      HNWEQNGAVPRKAKIFAISMMTASCLIMFWQFPQRWWVGAVSSVFCSLVAIRMWHRPESX
              70        80        90       100       110       120
```

The following partial DNA sequence was identified in *N. meningitidis* <SEQ ID 2003>:

```
a625.seq
    1    ATGTTTGCAA CCAGGAAAAT GAAGAAGATG ACGATGTGCA CGCGGCGGGT
   51    ACGGTTTTGG TTGGCTTTCA GCAGCGGACG AATCATCAGC ATTGCTGCGC
  101    CGGTCGTTCC CATGATAGAG GCAAGTGCCG TACCGACGGC AAGCAGGGCG
  151    GTGTTGAGCT TGGGTGTGCC GTTCAAGTCG CCCCAAACCA AAATGCCGCC
  201    TGAAATGGTG TACAGGGCAA GCAGCAGCAG GATGAAAGGG ATGTATTCTT
  251    CAACGAGTGC GTGTGCGACG GTATGGATAC CGGCGGACGC GCCAAAAACC
  301    AAACTGAACG GGATGAGGAA GAGCAATGTC CAAAAGGCGG TAATTTTGCC
  351    GTAA
```

The following partial DNA sequence was identified in *N. gonorrhoeae* <SEQ ID 2004>:

```
g625.seq
    1    atGTTTGCAA CCAGGAAAAT GAAGAAGATG ACGATGTGCA CGCGGCGGGT
   51    ACGGtcTTGG TTGGCTTTCA GCAGCGGACG AATCATCAGC AttgCCGCGC
  101    CGGtcgttcC CATGATAGAG GCAAGTGCCG TACCGACGGC AAGCAGGGCG
  151    GTGTTGAGCT TGGGTGTGCC GTTCAAGTCG CCCCAAACCA AAATGCCGCC
  201    TGAAATGGTG TACAGGGCAA GCAGCAGCAG GATGAAGGGG ATATATTCTT
  251    CAACGAGTGC GTGTGCGACG GTATGGATAC CGGCGGACGC GCCAAAAACC
  301    AAACTGAACG GGATGAGGAA GAGCAATGTC CAAAAGGCGG TGATTTTGCc
  351    gtAA
```

This corresponds to the amino acid sequence <SEQ ID 2005; ORF 625.ng>:

```
g625.pep
    1    MFATRKMKKM TMCTRRVRSW LAFSSGRIIS IAAPVVPMIE ASAVPTASRA
   51    VLSLGVPFKS PQTKMPPEMV YRASSSRMKG IYSSTSACAT VWIPADAPKT
  101    KLNGMRKSNV QKAVILP*
```

The following partial DNA sequence was identified in *N. meningitidis* <SEQ ID 2006>:

```
m625.seq
    1    ATGTTTGCAA CCAGGAAAAT GAAGAAGATG ACGATGTGCA CGCGGCGGGT
   51    ACGGTTTTGG TTGGCTTTCA GCAGCGGACG AATCATCAGC ATTGCTGCGC
```

-continued

```
101   CGGTCGTTCC CATGATAGAG GCAAGTGCCG TACCGACGGC AAGCAGGGCG

151   GTGTTGAGCT TGGGTGTGCC GTTCAAGTCG CCCCAAACCA AAATGCCGCC

201   TGAAATGGTG TACAGGGCAA GCAGCAGCAG GATGAAAGGG ATGTATTCTT

251   CAACGAGTGC GTGTGCGACG GTATGGATAC CGGCGGACGC GCCAAAAACC

301   AAACTGAACG GGATGAGGAA GAGCAATGTC CAAAAGGCGG TAATTTTGCC

351   GTAA
```

This corresponds to the amino acid sequence <SEQ ID 2007; ORF 625>:

```
m625.pep
    1   MFATRKMKKM TMCTRRVRFW LAFSSGRIIS IAAPVVPMIE ASAVPTASRA

51   VLSLGVPFKS PQTKMPPEMV YRASSSRMKG MYSSTSACAT VWIPADAPKT

101   KLNGMRKSNV QKAVILP*
``` m625/g625 98.3% identity in 117 aa overlap

```
                    10         20         30         40         50         60
    m625.pep  MFATRKMKKMTMCTRRVRFWLAFSSGRIISIAAPVVPMIEASAVPTASRAVLSLGVPFKS
              ||||||||||||||||||| ||||||||||||||||||||||||||||||||||||||||
        g625  MFATRKMKKMTMCTRRVRSWLAFSSGRIISIAAPVVPMIEASAVPTASRAVLSLGVPFKS
                    10         20         30         40         50         60

70         80         90        100        110
    m625.pep  PQTKMPPEMVYRASSSRMKGMYSSTSACATVWIPADAPKTKLNGMRKSNVQKAVILPX
              |||||||||||||||||||||:||||||||||||||||||||||||||||||||||||
        g625  PQTKMPPEMVYRASSSRMKGIYSSTSACATVWIPADAPKTKLNGMRKSNVQKAVILPX
                    70         80         90        100        110
```

This corresponds to the amino acid sequence <SEQ ID 2008; ORF 625.a>:

```
a625.pep
    1   MFATRKMKKM TMCTRRVRFW LAFSSGRIIS IAAPVVPMIE ASAVPTASRA

51   VLSLGVPFKS PQTKMPPEMV YRASSSRMKG MYSSTSACAT VWIPADAPKT

101   KLNGMRKSNV QKAVILP*
``` m625/a625 100.0% identity in 117 aa overlap

```
                    10         20         30         40         50         60
    m625.pep  MFATRKMKKMTMCTRRVRFWLAFSSGRIISIAAPVVPMIEASAVPTASRAVLSLGVPFKS
              ||||||||||||||||||||||||||||||||||||||||||||||||||||||||||||
        a625  MFATRKMKKMTMCTRRVRFWLAFSSGRIISIAAPVVPMIEASAVPTASRAVLSLGVPFKS
                    10         20         30         40         50         60

70         80         90        100        110
    m625.pep  PQTKMPPEMVYRASSSRMKGMYSSTSACATVWIPADAPKTKLNGMRKSNVQKAVILPX
              ||||||||||||||||||||||||||||||||||||||||||||||||||||||||||
        a625  PQTKMPPEMVYRASSSRMKGMYSSTSACATVWIPADAPKTKLNGMRKSNVQKAVILPX
                    70         80         90        100        110
```

The following partial DNA sequence was identified in *N. gonorrhoeae* <SEQ ID 2009>:

```
g627.seq
    1   ATGTCCGGCC TTTGGAAACC CGAACACCCG GGATTTGAAA TCCTCGGCAG

51   CCGTTACGCC CTGCAAAACC TTGTCCGCGA TGTCATCCTG ATTACATTGA
```

-continued

```
101   CCGCCGTATC TATGGCAATC ACGCCCAAAC AAGTCCGCGC AGGCAACGAA

151   TTCAACTTTG AACCCATCGC CGAAGTGGGC AAACTCTTCC TCGGCATCTT

201   CATCACCATC TTCCCCGTCC TGAGCATTCT GAAAGCAGGC GAGGCAGGCG

251   CGCTGGGCGG GGTGGTATCG CTGGTTCACG ATACGGCAGG TCATCCGATT

301   AATACGATGT ATTTCTGGAT GAGCGGCATA TTGTCGGCAT TCTTGGATAA

351   CGCGCCCACT TATCTCGTGT TTTTCAATAT GGCGGGCGGC GATGCCCAAG

401   CCTTAATGAC GGGTCCCCTG TTTCATTcgc TGCTGGCGGT TTCTAtgggT 451   tCGGTATTCA TGGCGCACT GaccTACATc gGCAAcgcac cgaactTCAT 501   GGTcaaggcc aTTGCCGaaC agcgcgGCgt accgaTGCcg actTTCTTcc 551   ggtaTAtgat gtggtcggtc gcCTTCCTGa caCCCGTCTT CAtcgTACAT 601   ACCCTcgtCT TTTTcgTTtt cAAACTACTg taa
```

This corresponds to the amino acid sequence <SEQ ID 2010; ORF 627.ng>:

```
g627.pep
  1   MSGLWKPEHP GFEILGSRYA LQNLVRDVIL ITLTAVSMAI TPKQVRAGNE

51   FNFEPIAEVG KLFLGIFITI FPVLSILKAG EAGALGGVVS LVHDTAGHPI

101   NTMYFWMSGI LSAFLDNAPT YLVFFNMAGG DAQALMTGPL FHSLLAVSMG

151   SVFMGALTYI GNAPNFMVKA IAEQRGVPMP TFFRYMMWSV AFLTPVFIVH

201   TLVFFVFKLL *
```

The following partial DNA sequence was identified in *N. meningitidis* <SEQ ID 2011>:

```
m627.seq
  1   ATGTCCGGCC TTTGGAAACC CGAACACCCG GGATTTGAAA TCCTCGGCAG

51   CCGTTACGCC CTGCAAAACC TCGTCCGCGA TGTCATCCTG ATTGCATTGA

101   CCGCCGTATC TATGGCAATC ACGCCCAAAC AAGTCCGCGC AGGCAACGAA

151   TTCAACTTTG AACCCATCGC CGAAGTGGGC AAACTCTTCC TCGGCATCTT

201   CATCACCATC TTTCCCGTCC TGAGCATTCT GAAAGCAGGC GAGGCAGGCG

251   CGCTGGGCGG GGTGGTATCG CTGGTTCACG ATACGGCAGG TCATCCGATT

301   AATGTGATGT ATTTTTGGAT GAGCGGCATA TTGTCGGCAT TCTTGGATAA

351   CGCGCCCACT TATCTCGTTT TTTTCAATAT GGCGGGCGGC GATGCCCAAG

401   CCTTGATGAC GGGTACCCTG TTTCATTCGC TGCTGGCGGT TTCTATGGGT

451   TCGGTATTCA TGGGCGCACT GACCTACATC GGCAACGCAC CGAACTTCAT

501   GGTCAAGGCC ATTGCCGAAC AGCGCGGCGT ACCGATGCCG ACTTTCTTCG

551   GCTATATGAT GTGGTCGGTC GCCTTCCTGA CACCCGTCTT CATCGTACAT

601   ACCCTTATCT TTTTCGTTTT CAAACTGCTG TAA
```

This corresponds to the amino acid sequence <SEQ ID 2012; ORF 627>:

```
m627.pep
  1   MSGLWKPEHP GFEILGSRYA LQNLVRDVIL IALTAVSMAI TPKQVRAGNE

51   FNFEPIAEVG KLFLGIFITI FPVLSILKAG EAGALGGVVS LVHDTAGHPI
```

```
-continued
101    NVMYFWMSGI LSAFLDNAPT YLVFFNMAGG DAQALMTGTL FHSLLAVSMG

151    SVFMGALTYI GNAPNFMVKA IAEQRGVPMP TFFGYMMWSV AFLTPVFIVH

201    TLIFFVFKLL *
```

Computer analysis of this amino acid sequence gave the following results:
Homology with a Predicted ORF from *N. gonorrhoeae*
m627/g627 97.6% identity in 210 aa overlap

```
                  10         20         30         40         50         60
m627.pep  MSGLWKPEHPGFEILGSRYALQNLVRDVILIALTAVSMAITPKQVRAGNEFNFEPIAEVG
          ||||||||||||||||||||||||||||| :||||||||||||||||||||||||||||
g627      MSGLWKPEHPGFEILGSRYALQNLVRDVILITLTAVSMAITPKQVRAGNEFNFEPIAEVG
                  10         20         30         40         50         60

70         80         90        100        110        120
m627.pep  KLFLGIFITIFPVLSILKAGEAGALGGVVSLVHDTAGHPINVMYFWMSGILSAFLDNAPT
          |||||||||||||||||||||||||||||||||||||||||:||||||||||||||||||
g627      KLFLGIFITIFPVLSILKAGEAGALGGVVSLVHDTAGHPINTMYFWMSGILSAFLDNAPT
                  70         80         90        100        110        120

130        140        150        160        170        180
m627.pep  YLVFFNMAGGDAQALMTGTLFHSLLAVSMGSVFMGALTYIGNAPNFMVKAIAEQRGVPMP
          |||||||||||||||||||| |||||||||||||||||||||||||||||||||||||||
g627      YLVFFNMAGGDAQALMTGPLFHSLLAVSMGSVFMGALTYIGNAPNFMVKAIAEQRGVPMP
                 130        140        150        160        170        180

190        200        210
m627.pep  TFFGYMMWSVAFLTPVFIVHTLIFFVFKLLX
          ||| ||||||||||||||||||:|||||||
g627      TFFRYMMWSVAFLTPVFIVHTLVFFVFKLLX
                 190        200        210
```

The following partial DNA sequence was identified in *N. meningitidis* <SEQ ID 2013>:

```
a627.seq
     1    ATGTCCGGCC TTTGGAAACC CGAACACCCG GGATTTGAAA TCCTCGGCAG

51    CCGTTACGCC CTGCAAAACC TCGTCCGCGA TGTCATCCTG ATTGCATTGA

101    CCGCCGTATC TATGGCAATC ACGCCCAAAC AAGTCCGCGC AGGCAACGAA

151    TTCAACTTTG AACCCATCGC CGAAGTGGGC AAACTCTTCC TCGGCATCTT

201    CATCACCATC TTTCCCGTCC TGAGCATTCT GAAAGCAGGC GAGGCAGGCG

251    CGCTGGGCGG GGTGGTATCG CTGGTTCACG ATACGGCAGG TCATCCGATT

301    AATGTGATGT ATTTTTGGAT GAGCGGCATA TTGTCGGCAT TCTTGGATAA

351    CGCGCCCACT TATCTCGTTT TTTTCAATAT GGCGGGCGGC GATGCCCAAG

401    CCTTGATGAC GGGTTCCCTG TTTCATTCGC TGCTGGCGGT TTCTATGGGT

451    TCGGTATTCA TGGGCGCACT GACCTACATC GGCAACGCAC CGAACTTCAT

501    GGTCAAGGCC ATTGCCGAAC AGCGCGGCGT ACCGATGCCG ACTTTCTTCG

551    GCTATATGAT GTGGTCGGTC GCCTTCCTGA CACCCGTCTT CATCGTACAT

601    ACCCTTATCT TTTTCGTTTT CAAACTGCTG TAA
```

This corresponds to the amino acid sequence <SEQ ID 2014; ORF 627.a>:

```
a627.pep
     1    MSGLWKPEHP GFEILGSRYA LQNLVRDVIL IALTAVSMAI TPKQVRAGNE

51    FNFEPIAEVG KLFLGIFITI FPVLSILKAG EAGALGGVVS LVHDTAGHPI

101    NVMYFWMSGI LSAFLDNAPT YLVFFNMAGG DAQALMTGSL FHSLLAVSMG
```

```
-continued
151    SVFMGALTYI GNAPNFMVKA IAEQRGVPMP TFFGYMMWSV AFLTPVFIVH

201    TLIFFVFKLL *
``` m627/a627 99.5% identity in 210 aa overlap

```
                 10         20         30         40         50         60
m627.pep  MSGLWKPEHPGFEILGSRYALQNLVRDVILIALTAVSMAITPKQVRAGNEFNFEPIAEVG
          ||||||||||||||||||||||||||||||||||||||||||||||||||||||||||||
a627      MSGLWKPEHPGFEILGSRYALQNLVRDVILIALTAVSMAITPKQVRAGNEFNFEPIAEVG
                 10         20         30         40         50         60

70         80         90        100        110        120
m627.pep  KLFLGIFITIFPVLSILKAGEAGALGGVVSLVHDTAGHPINVMYFWMSGILSAFLDNAPT
          ||||||||||||||||||||||||||||||||||||||||||||||||||||||||||||
a627      KLFLGIFITIFPVLSILKAGEAGALGGVVSLVHDTAGHPINVMYFWMSGILSAFLDNAPT
                 70         80         90        100        110        120

130        140        150        160        170        180
m627.pep  YLVFFNMAGGDAQALMTGTLFHSLLAVSMGSVFMGALTYIGNAPNFMVKAIAEQRGVPMP
          ||||||||||||||||||||:|||||||||||||||||||||||||||||||||||||||
a627      YLVFFNMAGGDAQALMTGSLFHSLLAVSMGSVFMGALTYIGNAPNFMVKAIAEQRGVPMP
                130        140        150        160        170        180

190        200        210
m627.pep  TFFGYMMWSVAFLTPVFIVHTLIFFVFKLLX
          |||||||||||||||||||||||||||||||
a627      TFFGYMMWSVAFLTPVFIVHTLIFFVFKLLX
                190        200        210
```

The following partial DNA sequence was identified in *N. gonorrhoeae* <SEQ ID 2015>:

```
g628.seq
     1    ATGTGCGTGC CACTCAAGCC GGCAGGATGC GGGCCGCCAA ATTCATGTGT

51    TTCGATATTG GCAGCATTTT CAGACGGCAC GTCTGCGCCT GCTGCTTTAC

101    ACACATGGAT TTTACGTTCG GTCAGGCGGC TCAATACCAA CAGGCCGCGT

151    TTGAAGTCTT CGGCGGCTTC TTTGATGATG ACCGTAGGGT CGGCAGCCAG

201    CGGATTGGTG TCCATCGCAT TGACGAAGAT GGCGAACGGC TCGGCATCTA

251    CGGCAGGGAT TTTGCTGAAC GGACGGGTGC GAAGCGCAGT CCATAAGCCT

301    GATTGAATCA GGTTGCGGCG CACTTTTTCG CTGCTCAATT TGCCAGCGCC

351    TTCAGGTacg TAG
```

This corresponds to the amino acid sequence <SEQ ID 2016; ORF 628.ng>:

```
g628.pep
     1    MCVPLKPAGC GPPNSCVSIL AAFSDGTSAP AALHTWILRS VRRLNTNRPR

51    LKSSAASLMM TVGSAASGLV SIALTKMANG SASTAGILLN GRVRSAVHKP

101    D*IRLRRTFS LLNFASASGT *
```

The following partial DNA sequence was identified in *N. meningitidis* <SEQ ID 2017>:

```
m628.seq
     1    ATGTGCGTGC CACTCAAACC GGCAGGATGC GGGCCGCCGA ATTCATGTGT

51    TTCGATGTTG GCAGCATTTT CAGACGGCAC GTCTGCGCCA GCTGCCTTAC

101    AAACATGGAT TTGCGTTCG GTCAAACGGC TCAATACCAA CAGGCCGCGT

151    TTGAAATCCT CGGCGGCTTC TTTGATAATG ACCGTAGGGT CGGCAGCCAG
```

-continued

```
201  CGGATTGGTG TCCATCGCAT TGACGAAGAT GGCGAACGGC TCGGCATCGA

251  CGGCAGGAAT TTTGCTGAAC GGACGGGTGC GCAGCGCAGT CCACAAACCG

301  GATTGGATCA GGTTGCGGCG CACTTCTTCG CCGCTTAAGT TTGCCAGCGC

351  TTCAGGTGCG TAG
```

This corresponds to the amino acid sequence <SEQ ID 2018; ORF 628>:

```
m628.pep
  1  MCVPLKPAGC GPPNSCVSML AAFSDGTSAP AALQTWILRS VKRLNTNRPR

51  LKSSAASLIM TVGSAASGLV SIALTKMANG SASTAGILLN GRVRSAVHKP

101  DWIRLRRTSS PLKFASASGA *
```

Computer analysis of this amino acid sequence gave the following results:
Homology with a Predicted ORF from *N. gonorrhoeae*
  m628/g628 93.3% identity in 119 aa overlap

```
                  10         20         30         40         50         60
m628.pep  MCVPLKPAGCGPPNSCVSMLAAFSDGTSAPAALQTWILRSVKRLNTNRPRLKSSAASLIM
          ||||||||||||||||||||:|||||||||||||||:||||||:|||||||||||||||:|
g628      MCVPLKPAGCGPPNSCVSILAAFSDGTSAPAALHTWILRSVRRLNTNRPRLKSSAASLMM
                  10         20         30         40         50         60
                  70         80         90        100        110        120
m628.pep  TVGSAASGLVSIALTKMANGSASTAGILLNGRVRSAVHKPDWIRLRRTSSPLKFASASGA
          |||||||||||||||||||||||||||||||||||||||| |||||| | |:|||||:
g628      TVGSAASGLVSIALTKMANGSASTAGILLNGRVRSAVHKPDXIRLRRTFSLLNFASASGT
                  70         80         90        100        110        120
m628.pep  X g628      X
```

The following partial DNA sequence was identified in *N. meningitidis* <SEQ ID 2019>:

```
a628.seq
  1  ATGTGCGTGC CACTCAAACC GGCCGGATGC GGGCCGCCGA ATTCATGTGT

51  TTCGATGTTG GCAGCATTTT CAGACGGCAC GTCTGCGCCA GCTGCCTTAC

101  ACACATGGAT TTTACGCTCG GTCAAACGGC TCAATACCAG CAAACCTCGT

151  CTGAAATCCT CGGCGGCTTC TTTGATCACA ACCACAGGGT CTGCCGCCAG

201  CGGATTGGTG TCCATCGCAT TGACGAAGAT GGCGAACGGC TCGGCATCGA

251  CGGCAGGGAT TTTGCTGAAC GGACGGGTAC GCAGCGCAGT CCACAAACCG

301  GATTGGATCA GATTGCGGCG CACTTCTTCG CCGCTTAAGT TTGCCAACGC

351  TTCGGGCGCG TAG
```

This corresponds to the amino acid sequence <SEQ ID 2020; ORF 628.a>:

```
a628.pep
  1  MCVPLKPAGC GPPNSCVSML AAFSDGTSAP AALHTWILRS VKRLNTSKPR

51  LKSSAASLIT TTGSAASGLV SIALTKMANG SASTAGILLN GRVRSAVHKP

101  DWIRLRRTSS PLKFANASGA *
``` m628/a628 95.0% identity in 120 aa overlap

```
              10         20         30         40         50         60
m628.pep  MCVPLKPAGCGPPNSCVSMLAAFSDGTSAPAALQTWILRSVKRLNTNRPRLKSSAASLIM
          ||||||||||||||||||||||||||:|||||||||||||||||::||||||||||||
a628      MCVPLKPAGCGPPNSCVSMLAAFS2GTSAPAALHTWILRSVKRLNTSKPRLKSSAASLIT
              10         20         30         40         50         60

70         80         90        100        110        120
m628.pep  TVGSAASGLVSIALTKMANGSASTAGILLNGRVRSAVHKPDWIRLRRTSSPLKFASASGA
          |:||||||||||||||||||||||||||||||||||||||||||||||||||:||||
a628      TTGSAASGLVSIALTKMANGSASTAGILLNGRVRSAVHKPDWIRLRRTSSPLKFANASGA
              70         80         90        100        110        120 m628.pep  X
          |
a628      X
```

The following partial DNA sequence was identified in *N. gonorrhoeae* <SEQ ID 2021>:

```
g629.seq
    1  ATGACTGCca aacCTTTTTC CCTCAACCTG GCcaaCCTCC TGCTGCCggc
   51  ggtatTGTTT GCCGTCAGcc tGtcggTCGG cattgccgaT TTCCGCTGGT
  101  CGGATGTGTT TTCGCTGTCC GACAGCCAGC AAGTGATGTT CATCAGCCGC
  151  CTGCCGCGCA CGTTTGcgaT TGTGTTGACG GGCgcgtcga tagcgGtggc
  201  gGGGAtgatt atgcagATTC TGATGCGCAA CcgtTTTGTC GAGCCTtcta
  251  tggcgGGTGC GGGCCAAAGt gcgGCTTTGG GTttgcttct gAtgtccctg
  301  ctgctgcctg CcgcGccgct gccggtcaAA ATGTCGGtag Ccgccgttgc
  351  CGCGCTGATC GGGATGTTGG tctTtatgct gctaatccgC Cgcctgccac
  401  cgacggcgca gctgatgGTg ccgCTGGTGG Gg.ttATTTT CGGCGGCGTG
  451  GttgaGGCGG TGGCGACGTT TGTCGCGTAT GAGTTTGAGA TGCTGCAAAT
  501  GTTGGGCGTG TGGCAGCAGG GCGACTTTTC AAGCGTGCTG CTGGGGCGGT
  551  ACGAGCTGCT TTGGATTACG GGCGGTTTGG CGGTGTTTGC CTACCTGATT
  601  GCCGACCGGC TGACGATTTT GGGGCTGGGC GAGACGGTGA GCGTGAATTT
  651  GGGTTTGAAC CGGACGGCGG TGTTGTGGTC GGGTTTGATT ATTGTGGCAC
  701  TGATTACATC GCTGGTCATT GTAACGGTCG GCAATATTCC GTTTATCGGG
  751  CTGGTCGTGC CGAATATCGT CAGCCGCCTG ATGGGCGACA GGCTGCGCCA
  801  AAGCCTGCCT GCGGTCGCCC TCTTGGGCGC GTCTTTGGTT TTATTGTGCG
  851  ACATTATCGG ACGCATGATT GTGTTTCCGT TTGAAATTCC GGTCTCCACG
  901  GTTTTTGGTG TGTTGGGTAC GGCTTTGTTT TTGTGGCTTT TGTTGAGGAA
  951  ACCCGCCTAT GCCGTCTGA
```

This corresponds to the amino acid sequence <SEQ ID 2022; ORF 629.ng>:

```
g629.pep
    1  MTAKPFSLNL ANLLLPAVLF AVSLSVGIAD FRWSDVFSLS DSQQVMFISR

51  LPRTFAIVLT GASIAVAGMI MQILMRNRFV EPSMAGAGQS AALGLLLMSL

101  LLPAAPLPVK MSVAAVAALI GMLVFMLLIR RLPPTAQLMV PLVGXIFGGV

151  VEAVATFVAY EFEMLQMLGV WQQGDFSSVL LGRYELLWIT GGLAVFAYLI
```

-continued

```
 201    ADRLTILGLG ETVSVNLGLN RTAVLWSGLI IVALITSLVI VTVGNIPFIG

251    LVVPNIVSRL MGDRLRQSLP AVALLGASLV LLCDIIGRMI VFPFEIPVST

301    VFGVLGTALF LWLLLRKPAY AV*
```

The following partial DNA sequence was identified in *N. meningitidis* <SEQ ID 2023>:

```
m629.seq
   1    ATGACTGCCA AACCTTTTTC CCTCAACCTG ACCAACCTGC TGCTGCTGGC

51    GGTGTTGTTT GCCGTCAGCC TGTCGGTGGG CGTTGCCGAT TTCCGCTGGT

101    CTGATGTGTT TTCACTGTCC GACAGCCAGC AGGTCATGTT CATCAGCCGC

151    CTGCCGCGCA CGTTTGCGAT TGTGCTGACG GGCGCGTCGA TGGCGGTGGC

201    CGGCATGATT ATGCAGATTT TGATGCGCAA CCGTTTTGTC GAACCGTCGA

251    TGGTGGGCGC AAGCCAAAGC GCGGCTTTAG GTTTGCTGCT GATGACCCTG

301    CTGCTGCCGG CCGCGCCGCT GCCGGCGAAA ATGTCGGTTG CCGCCGTTGC

351    CGCGCTGATC GGGATGTTGG TCTTTATGCT GCTGATCCGC CGCCTGCCGC

401    CGACCGCGCA ACTGATGGTG CCTTTGGTCG GGATTATTTT CGGCGGTGTG

451    ATTGAGGCGG TAGCCACCTT TATCGCGTAT GAAAACGAAA TGCTGCAAAT

501    GCTCGGCGTG TGGCAGCAGG GCGATTTTTC GAGCGTGCTG CTGGGGCGGT

551    ACGAGCTGCT TTGGATTACG GGCGGTTTGG CGGTGTTTGC CTATCTGATT

601    GCCGACCGGC TGACGATTTT GGGGCTGGGC GAAACGGTAA GCGTGAATTT

651    GGGTTTGAAC CGGACGGCGG TGTTGTGGTC GGGTTTGATT ATTGTGGCTT

701    TGATTACGTC GCTGGTTATC GTTACGGTCG GCAATATTCC GTTTATCGGG

751    CTGGTCGTGC CGAACATCAT CAGCCGCCTG ATGGGCGACA GGTTGCGCCA

801    AAGCCTGCCT GCGGTGGCCT TGCTGGGCGC ATCTTTGGTG TTGCTGTGCG

851    ACATTATCGG ACGCGTGATT GTGTTTCCGT TTGAAATTCC GGTCTCTACG

901    GTTTTTGGTG TATTGGGTAC GGCTTTGTTT TTGTGGCTTT TGTTGAGGAA

951    ACCCGCCTAT GCCGTCTGA
```

This corresponds to the amino acid sequence <SEQ ID 2024; ORF 629>:

```
m629.pep
   1    MTAKPFSLNL TNLLLLAVLF AVSLSVGVAD FRWSDVFSLS DSQQVMFISR

51    LPRTFAIVLT GASMAVAGMI MQILMRNRFV EPSMVGASQS AALGLLLMTL

101    LLPAAPLPAK MSVAAVAALI GMLVFMLLIR RLPPTAQLMV PLVGIIFGGV

151    IEAVATFIAY ENEMLQMLGV WQQGDFSSVL LGRYELLWIT GGLAVFAYLI

201    ADRLTILGLG ETVSVNLGLN RTAVLWSGLI IVALITSLVI VTVGNIPFIG

251    LVVPNIISRL MGDRLRQSLP AVALLGASLV LLCDIIGRVI VFPFEIPVST

301    VFGVLGTALF LWLLLRKPAY AV*
```

Computer analysis of this amino acid sequence gave the following results:
Homology with a Predicted ORF from *N. gonorrhoeae*
m629/g629 95.7% identity in 322 aa overlap

```
              10         20         30         40         50         60
m629.pep  MTAKPFSLNLTNLLLLAVLFAVSLSVGVADFRWSDVFSLSDSQQVMFISRLPRTFAIVLT
          ||||||||||:||||||||||||||||:||||||||||||||||||||||||||||||||
g629      MTAKPFSLNLANLLLPAVLFAVSLSVGIADFRWSDVFSLSDSQQVMFISRLPRTFAIVLT
              10         20         30         40         50         60

70         80         90        100        110        120
m629.pep  GASMAVAGMIMQILMRNRFVEPSMVGASQSAALGLLLMTLLLPAAPLPAKMSVAAVAALI
          |||:|||||||||||||||||||||:||:|||||||||:|||||||||:|||||||||||
g629      GASIAVAGMIMQILMRNRFVEPSMAGAGQSAALGLLLMSLLLPAAPLPVKMSVAAVAALI
              70         80         90        100        110        120

130        140        150        160        170        180
m629.pep  GMLVFMLLIRRLPPTAQLMVPLVGIIFGGVIEAVATFIAYENEMLQMLGVWQQGDFSSVL
          ||||||||||||||||||||||||:|||||:|||||||:|||||||||||||||||||||
g629      GMLVFMLLIRRLPPTAQLMVPLVGXIFGGVVEAVATFVAYEFEMLQMLGVWQQGDFSSVL
             130        140        150        160        170        180

190        200        210        220        230        240
m629.pep  LGRYELLWITGGLAVFAYLIADRLTILGLGETVSVNLGLNRTAVLWSGLIIVALITSLVI
          ||||||||||||||||||||||||||||||||||||||||||||||||||||||||||||
g629      LGRYELLWITGGLAVFAYLIADRLTILGLGETVSVNLGLNRTAVLWSGLIIVALITSLVI
             190        200        210        220        230        240

250        260        270        280        290        300
m629.pep  VTVGNIPFIGLVVPNIISRLMGDRLRQSLPAVALLGASLVLLCDIIGRVIVFPFEIPVST
          ||||||||||||||||:|||||||||||||||||||||||||||||:|||||||||||||
g629      VTVGNIPFIGLVVPNIVSRLMGDRLRQSLPAVALLGASLVLLCDIIGRMIVFPFEIPVST
             250        260        270        280        290        300

310        320
m629.pep  VFGVLGTALFLWLLLRKPAYAVX
          |||||||||||||||||||||||
g629      VFGVLGTALFLWLLLRKPAYAVX
             310        320
```

The following partial DNA sequence was identified in *N. meningitidis* <SEQ ID 2025>:

```
a629.seq
    1    ATGACTGCCA AACCTTTTTC CCTCAACCTG ACTAACCTCC TGCTGCTGGC

51    GGTGTTGTTT GCCGTCAGCC TGTCGGTGGG CGTTGCCGAT TTCCGCTGGT

101    CGGATGTGTT TTCGCTGTCG GACAGCCAGC AGGTTATGTT CATCAGCCGC

151    CTGCCGCGCA CGTTTGCGAT TGTGTTGACG GCGCGTCGA TGGCGGTGGC

201    GGGGATGATT ATGCAGATTC TGATGCGTAA CCGTTTTGTC GAGCCTTCTA

251    TGGCGGGCGC GGGTCAGAGT GCGGCTTTGG GTTTGCTTCT GATGTCCCTG

301    CTGCTGCCTG CCGCGCCGCT GCCGGTCAAA ATGTCGGTTG CCGCCGTTGC

351    CGCGTTAATC GGGATGTTGG TGTTTATGAT GCTTATCCGC CGCCTGCCGC

401    CGACGGCGCA ACTGATGGTG CCTTTGGTCG GGATTATTTT CGGCGGCGTG

451    GTTGAGGCGG TGGCCACCTT TATTGCGTAT GAAAACGAAA TGCTGCAAAT

501    GCTGGGCGTG TGGCAACAGG GCGATTTTTC CGGCGTGTTG CTCGGACGGT

551    ATGAACTGTT GTGGGCAACG GGGATTTTGG CTTTGTTTGC CTATTTGATT

601    GCCGACCAGC TGACGATTTT GGGTTTGGGC GAAACGGTAA GCGTGAACTT

651    GGGGCTGAAC CGGACGGCGA TTCTGTGGTC GGGGCTGATT ATTGTGGCTT

701    TGATTACGTC GCTGGTTATC GTTACGGTCG GCAATATTCC GTTTATCGGG

751    CTGGTCGTGC CGAACATCAT CAGCCGCCTG ATAGGCGACA GGCTGCGCCA

801    AAGCCTGCCT GCGGTGGCTT TGCTGGGTGC GTCTTTGGTT TTATTGTGCG

851    ACATTATCGG ACGAGTGATT GTGTTTCCGT TTGAAATTCC GGTATCGACC
```

```
-continued
901  GTCTTCGGCG TATTGGGTAC GGCGTTGTTT TTATGGCTTT TGTTAAGGAA

951  ACCTGCTCAT GCCGTCTGA
```

This corresponds to the amino acid sequence <SEQ ID 2026;
ORF 629.a>:

```
a629.pep
  1  MTAKPFSLNL TNLLLLAVLF AVSLSVGVAD FRWSDVFSLS DSQQVMFISR

51  LPRTFAIVLT GASMAVAGMI MQILMRNRFV EPSMAGAGQS AALGLLLMSL

101  LLPAAPLPVK MSVAAVAALI GMLVFMMLIR RLPPTAQLMV PLVGIIFGGV

151  VEAVATFIAY ENEMLQMLGV WQQGDFSGVL LGRYELLWAT GILALFAYLI

201  ADQLTILGLG ETVSVNLGLN RTAILWSGLI IVALITSLVI VTVGNIPFIG

251  LVVPNIISRL IGDRLRQSLP AVALLGASLV LLCDIIGRVI VFPFEIPVST

301  VFGVLGTALF LWLLLRKPAH AV*
``` m629/a629 95.7% identity in 322 aa overlap

```
                  10         20         30         40         50         60
m629.pep  MTAKPFSLNLTNLLLLAVLFAVSLSVGVADFRWSDVFSLSDSQQVMFISRLPRTFAIVLT
          ||||||||||||||||||||||||||||||||||||||||||||||||||||||||||||
a629      MTAKPFSLNLTNLLLLAVLFAVSLSVGVADFRWSDVFSLSDSQQVMFISRLPRTFAIVLT
                  10         20         30         40         50         60

70         80         90        100        110        120
m629.pep  GASMAVAGMIMQILMRNRFVEPSMVGASQSAALGLLLMTLLLPAAPLPAKMSVAAVAALI
          ||||||||||||||||||||||||||:||:||||||||||:|||||||:|||||||||||
a629      GASMAVAGMIMQILMRNRFVEPSMAGAGQSAALGLLLMSLLLPAAPLPVKMSVAAVAALI
                  70         80         90        100        110        120

130        140        150        160        170        180
m629.pep  GMLVFMLLIRRLPPTAQLMVPLVGIIFGGVIEAVATFIAYENEMLQMLGVWQQGDFSSVL
          ||||||:|||||||||||||||||||||||:|||||||||||||||||||||||||||:||
a629      GMLVFMMLIRRLPPTAQLMVPLVGIIFGGVVEAVATFIAYENEMLQMLGVWQQGDFSGVL
                 130        140        150        160        170        180

190        200        210        220        230        240
m629.pep  LGRYELLWITGGLAVFAYLIADRLTILGLGETVSVNLGLNRTAVLWSGLIIVALITSLVI
          ||||||||| || ||:|||||||:||||||||||||||||||:||||||||||||||||
a629      LGRYELLWATGILALFAYLIADQLTILGLGETVSVNLGLNRTAILWSGLIIVALITSLVI
                 190        200        210        220        230        240

250        260        270        280        290        300
m629.pep  VTVGNIPFIGLVVPNIISRLMGDRLRQSLPAVALLGASLVLLCDIIGRVIVFPFEIPVST
          |||||||||||||||||||:||||||||||||||||||||||||||||||||||||||||
a629      VTVGNIPFIGLVVPNIISRLIGDRLRQSLPAVALLGASLVLLCDIIGRVIVFPFEIPVST
                 250        260        270        280        290        300

310        320
m629.pep  VFGVLGTALFLWLLLRKPAYAVX
          ||||||||||||||||||||:|||
a629      VFGVLGTALFLWLLLRKPAHAVX
                 310        320
```

The following partial DNA sequence was identified in *N. gonorrhoeae* <SEQ ID 2027>:

```
g630.seq (partial)
  1  aTgatGATTT TGGTGTGGCT ggctttgttt cccccatgt tttacggcat 51  gtacaacgtc GGCGCACAGG CATTCGGTGC CTTAACGCCC GAtttgctgc 101  aacaaagcat cgcccacgac ggcaattacg ccctcgccaa cgctttgggc 151  atcaatatgt cccccgaaGc gggcgtgtTg ggcaaaatgc tgttcgGCGC 201  GATttacttc ctgccgattt acgcgaccgt aTTTATTGTG GGcggcttct 251  ggGaagtCTT GTTCGCATCc gtACGCAAAC ACGAAATCAA CGAAGGTTTC

301  TTCGTTACTT CGATTCTGTT TGCCTTAATC GTTCCGCCCA CGCTGCCGCT
```

```
351  GTGGCAGGCG GCTTTGGGTA TTTCTTTCGG CGTTGTGGTT GCGAAAGAAG

401  TATTCGGCGG TACAGGTAAA AACTTCATGA ACCCTGCGCT GGCAGGCCGC

451  GCCTTCCTGT TCTTCGCCTA CCCCGCCAAC TTGAGCGGCG ATGCGGTTTG

501  GACGGCGGTT GACGGCTATT CCGGCGCAAC CGCGCTGGCG CAATGGGCGG

551  CACACGGTGC AGACGGCCTG AAAAACGCCG TAACCGGTCA AACCATCACT

601  TGGATGGACG CGTTTATCGG CAAACTGCCC GGCTCCATCG GCGAAGTCTC

651  CACTTTGGCA CTCTTAATCG GCGGCGCGTT TATCGTGTTT GCCCGCATCG

701  CTtcttgGCG CATTATTGCc ggCGTGATGA TCGGTatGat tGcgatgTCT 751  tcgctgatta acttcatCGg ttctgacacc aaagctatgt ttgctatgca 801  cttggtacat ggcacttggt GGAaagatGa ttAtcactca ctgtacatta 851  aa.....
```

This corresponds to the amino acid sequence <SEQ ID 2028; ORF 630.ng>:

```
g630.pep
  1  MMILVWLALF PPMFYGMYNV GAQAFGALTP DLLQQSIAHD GNYALANALG
 51  INMSPEAGVL GKMLFGAIYF LPIYATVFIV GGFWEVLFAS VRKHEINEGF
101  FVTSILFALI VPPTLPLWQA ALGISFGVVV AKEVFGGTGK NFMNPALAGR
151  AFLFFAYPAN LSGDAVWTAV DGYSGATALA QWAAHGADGL KNAVTGQTIT
201  WMDAFIGKLP GSIGEVSTLA LLIGGAFIVF ARIASWRIIA GVMIGMIAMS
251  SLINFIGSDT KAMFAMHLVH GTWWKDDYHS LYIK....
```

The following partial DNA sequence was identified in *N. meningitidis* <SEQ ID 2029>:

```
m630.seq
  1  ATGATGATTT TGGTGTGGCT GGCTTTGTTC CCTGCCATGT TCTACGGTAT
 51  GTACAACGTC GGCGCGCAGG CATTCGGTGC GTTAACGCCT GATTTGCTGC
101  AACAAAACAT CGCCAACGAC TGGCATTACG CCTTTGCCAA CGCTTTGGGC
151  ATCAATATGT CGTCTGAAGC GGGCGTGTCG GACAAAATGC TGTTTGGCGC
201  GATTTACTTC CTGCCGATTT ACGCGACTGT ATTTGTTGTG GGCGGTTTCT
251  GGGAAGTTTT GTTCGCCACC GTGCGCAAAC ACGAAATCAA CGAAGGTTTC
301  TTCGTTACTT CGATTCTGTT TGCCTTAATC GTTCCGCCCA CGCTGCCGCT
351  GTGGCAGGCG GCTTTGGGTA TTTCTTTCGG CGTTGTGGTT GCGAAAGAAG
401  TATTCGGCGG TACAGGTAAA AACTTCATGA ACCCTGCGCT GGCAGGCCGT
451  GCTTTCCTGT TCTTCGCCTA CCCTGCCAAC TTGAGCGGCG ATGCGGTTTG
501  GACGGCGGTT GACGGCTATT CCGGCGCAAC CGCACTGGCG CAATGGGCGG
551  CACACGGTGC AGACGGCCTG AAAAACGCCG TAACCGGTCA AACCATCACT
601  TGGATGGACG CGTTTATCGG CAAACTGCCC GGCTCCATTG GCGAAGTCTC
651  CACTTTGGCA CTCTTAATCG GCGGCGCGTT TATCGTGTTT GCCCGCATCG
701  CTTCTTGGCG CATTATTGCC GGCGTGATGA TCGGTATGAT TGCGATGTCT
751  TCGCTGTTCA ACTTCATCGG TTCGGACACC AACGCTATGT TTGCTATGCC
801  TTGGTACTGG CACTTGGTGG TCGGCGGCTT CGCCATCGGT ATGCTGTTTA
```

-continued

```
 851   TGGCGACCGA CCCTGTTTCC GCTTCCTTTA CCAATGTCGG CAAATGGTGG

901   TACGGCGCAC TGATCGGTGT GATGTGCGTA TTAATCCGCG TGGTCAATCC

951   GGCTTACCCC GAAGGCATGA TGTTGGCGAT TCTGTTTGCC AACCTGTTTG

1001   CCCCGATTTT CGACTATTTC GTCGCACAAG CGAACATCAA ACGCAGAAAG

1051   GCGCGCAGCA ATGGCTAA
```

This corresponds to the amino acid sequence <SEQ ID 2030; ORF 630>:

```
m630.pep
    1  MMILVWLALF PAMFYGMYNV GAQAFGALTP DLLQQNIAND WHYAFANALG

51  INMSSEAGVS DKMLFGAIYF LPIYATVFVV GGFWEVLFAT VRKHEINEGF

101  FVTSILFALI VPPTLPLWQA ALGISFGVVV AKEVFGGTGK NFMNPALAGR

151  AFLFFAYPAN LSGDAVWTAV DGYSGATALA QWAAHGADGL KNAVTGQTIT

201  WMDAFIGKLP GSIGEVSTLA LLIGGAFIVF ARIASWRIIA GVMIGMIAMS

251  SLFNFIGSDT NAMFAMPWYW HLVVGGFAIG MLFMATDPVS ASFTNVGKWW

301  YGALIGVMCV LIRVVNPAYP EGMMLAILFA NLFAPIFDYF VAQANIKRRK

351  ARSNG*
``` m630/g630 93.5% identity in 275 aa overlap

```
                  10         20         30         40         50         60
    m630.pep  MMILVWLALFPAMFYGMYNVGAQAFGALTPDLLQQNIANDWHYAFANALGINMSSEAGVS
              |||||||||| ||||||||||||||||||||||||::||:|  ::||:|||||||||:||
    g630      MMILVWLALFPPMFYGMYNVGAQAFGALTPDLLQQSIAHDGNYALANALGINMSPEAGVL
                  10         20         30         40         50         60

70         80         90        100        110        120
    m630.pep  DKMLFGAIYFLPIYATVFVVGGFWEVLFATVRKHEINEGFFVTSILFALIVPPTLPLWQA
              |||||||||||||||||||:||||||||||:||||||||||||||||||||||||||||
    g630      GKMLFGAIYFLPIYATVFIVGGFWEVLFASVRKHEINEGFFVTSILFALIVPPTLPLWQA
                  70         80         90        100        110        120

130        140        150        160        170        180
    m630.pep  ALGISFGVVVAKEVFGGTGKNFMNPALAGRAFLFFAYPANLSGDAVWTAVDGYSGATALA
              ||||||||||||||||||||||||||||||||||||||||||||||||||||||||||||
    g630      ALGISFGVVVAKEVFGGTGKNFMNPALAGRAFLFFAYPANLSGDAVWTAVDGYSGATALA
                 130        140        150        160        170        180

190        200        210        220        230        240
    m630.pep  QWAAHGADGLKNAVTGQTITWMDAFIGKLPGSIGEVSTLALLIGGAFIVFARIASWRIIA
              ||||||||||||||||||||||||||||||||||||||||||||||||||||||||||||
    g630      QWAAHGADGLKNAVTGQTITWMDAFIGKLPGSIGEVSTLALLIGGAFIVFARIASWRIIA
                 190        200        210        222        230        240

250        260        270        280        290        300
    m630.pep  GVMIGMIAMSSLFNFIGSDTNAMFAMPWYWHLVVGGFAIGMLFMATDPVSASFTNVGKWW
              ||||||||||||:|||||||:||||    |||  |
    g630      GVMIGMIAMSSLINFIGSDTKAMFAM----HLVHGTWWKDDYHSLYIK.
                 250        260        270        280

310        320        330        340        350
    m630.pep  YGALIGVMCVLIRWNPAYPEGMMLAILFANLFAPIFDYFVAQANIKRRKARGNGX
```

The following partial DNA sequence was identified in *N. meningitidis* <SEQ ID 2031>:

```
a630.seq
    1  ATGATGATTT TGGTGTGGCT GGCTTTGTTC CCTGCCATGT TCTACGGTAT

51  GTACAACGTC GGCGCACAGG CATTCGGTGC GTTAACGCCC GATTTGCTGC

101  AACAAAGCAT CGCCAACGAC TGGCATTACG CCCTTGCCAA CGCTTTGGGC

151  ATCAATATGT CGTCTGAAGC GGGCGTGTTG GGCAAAATGC TGTTCGGCGC
```

```
-continued
201  GATTTACTTC CTGCCGATTT ACGCGACCGT ATTTATTGTC GGCGGTTTCT
251  GGGAAGTTTT GTTCGCCACC GTGCGCAAAC ATGAAATCAA CGAAGGTTTC
301  TTTGTTACCT CGATTCTGTT TGCCTTAATC GTTCCGCCCA CGCTGCCGCT
351  GTGGCAGGCA GCTTTGGGTA TTTCTTTCGG CGTTGTGGTT GCGAAAGAAG
401  TATTCGGCGG TACAGGTAAA AACTTCATGA ACCCTGCGCT GGCAGGCCGT
451  GCCTTCCTGT TCTTCGCCTA CCCTGCCAAC TTGAGCGGCG ATGCGGTTTG
501  GACGGCGGTT GACGGCTATT CCGGCGCAAC CGCGCTGGCG CAATGGGCGG
551  CACACGGTGC AGACGGCCTG AAAAACGCCA TAACCGGTCA AACCATCACT
601  TGGATGGATG CGTTTATCGG CAAACTGCCC GGCTCCATCG GCGAAGTCTC
651  CACTTTGGCA CTCTTAATCG GCGGCGCGTT TATCGTGTTT GCCCGCATCG
701  CTTCTTGGCG CATTATTGCC GGCGTGATGA TCGGTATGAT TGCCATGTCT
751  TCGCTGTTCA ACTTCATCGG TTCGGACACC AACGCTATGT TTGCTATGCC
801  TTGGTACTGG CATTTGGTCG TCGGCGGCTT CGCCATCGGT ATGCTGTTTA
851  TGGCGACCGA CCCCGTTTCC GCTTCCTTTA CCAATGTCGG CAAATGGTGG
901  TACGGCGCAC TGATCGGTGT GATGTGCGTA TTAATCCGCG TGGTCAATCC
951  GGCTTACCCC GAAGGCATGA TGTTGGCGAT TCTGTTTGCC AACCTGTTTG
1001 CCCCGATTTT CGACTATTTC GTCGCACAAG CGAACATCAA ACGCAGAAAG
1051 GCGCGCAGCA ATGGCTAA
```

This corresponds to the amino acid sequence <SEQ ID 2032; ORF 630.a>:

```
a630.pep
    1  MMILVWLALF PAMFYGMYNV GAQAFGALTP DLLQQSIAND WHYALANALG

51  INMSSEAGVL GKMLFGAIYF LPIYATVFIV GGFWEVLFAT VRKHEINEGF

101  FVTSILFALI VPPTLPLWQA ALGISFGVVV AKEVFGGTGK NFMNPALAGR

151  AFLFFAYPAN LSGDAVWTAV DGYSGATALA QWAAHGADGL KNAITGQTIT

201  WMDAFIGKLP GSIGEVSTLA LLIGGAFIVF ARIASWRIIA GVMIGMIAMS

251  SLFNFIGSDT NAMFAMPWYW HLVVGGFAIG MLFMATDPVS ASFTNVGKWW

301  YGALIGVMCV LIRVVNPAYP EGMMLAILFA NLFAPIFDYF VAQANIKRRK

351  ARSNG*
``` m630/a630 98.3% identity in 355 aa overlap

```
              10         20         30         40         50         60
m630.pep  MMILVWLALFPAMFYGMYNVGAQAFGALTPDLLQQNIANDWHYAFANALGINMSSEAGVS
          |||||||||||||||||||||||||||||||||||:||||||||:|||||||||||||||
a630      MMILVWLALFPAMFYGMYNVGAQAFGALTPDLLQQSIANDWHYALANALGINMSSEAGVL
              10         20         30         40         50         60

70         80         90        100        110        120
m630.pep  DKMLFGAIYFLPIYATVFVVGGFWEVLFATVRKHEINEGFFVTSILFALIVPPTLPLWQA
          :|||||||||||||||||||:|||||||||||||||||||||||||||||||||||||||
a630      GKMLFGAIYFLPIYATVFIVGGFWEVLFATVRKHEINEGFFVTSILFALIVPPTLPLWQA
              70         80         90        100        110        120

130        140        150        160        170        180
m630.pep  ALGISFGVVVAKEVFGGTGKNFMNPALAGRAFLFFAYPANLSGDAVWTAVDGYSGATALA
          ||||||||||||||||||||||||||||||||||||||||||||||||||||||||||||
a630      ALGISFGVVVAKEVFGGTGKNFMNPALAGRAFLFFAYPANLSGDAVWTAVDGYSGATALA
             130        140        150        160        170        180
```

```
                  190        200        210        220        230        240
m630.pep   QWAAHGADGLKNAVTGQTITWMDAFIGKLPGSIGEVSTLALLIGGAFIVFARIASWRIIA
           |||||||||||||:||||||||||||||||||||||||||||||||||||||||||||||
a630       QWAAHGADGLKNAITGQTITWMDAFIGKLPGSIGEVSTLALLIGGAFIVFARIASWRIIA
                  190        200        210        220        230        240

250        260        270        280        290        300
m630.pep   GVMIGMIAMSSLFNFIGSDTNAMFAMPWYWHLVVGGFAIGMLFMATDPVSASFTNVGKWW
           ||||||||||||||||||||||||||||||||||||||||||||||||||||||||||||
a630       GVMIGMIAMSSLFNFIGSDTNAMFAMPWYWHLVVGGFAIGMLFMATDPVSASFTNVGKWW
                  250        260        270        280        290        300

310        320        330        340        350
m630.pep   YGALIGVMCVLIRVVNPAYPEGMMLAILFANLFAPIFDYFVAQANIKRRKARSNGX
           |||||||||||||||||||||||||||||||||||||||||||||||||||||||
a630       YGALIGVMCVLIRVVNPAYPEGMMLAILFANLFAPIFDYFVAQANIKRRKARSNGX
                  310        320        330        340        350
```

The following partial DNA sequence was identified in *N. gonorrhoeae* <SEQ ID 2033>:

```
g635.seq
    1   ATGACCCGGC GACGGGTCGG CAAGCAAAAC CGTATTGCCA TCCACTCCGC

51   GCAATACCGA AAAATGGTCG TCTTTGCGGT ATTTCAGATA CACGATGACG

101   GGGATTTTCA ACTGCGCGAG CTGTTCGAAA GACAGGGCAT AGCCTTTCGC

151   CTCAAAACCC AAATCGGGCA TAATGCGCCG CATATCCTCA AACGACGCGC

201   GCATCTGTTC CTTACCCAGT TTTTCCAACA CTTCTTCTTC CGTCAGCTTT

251   TGCCCGTAAA AATTGTTCAA AAGCGTCGCC ACCGAAGCCG CCCCGCAGGA

301   AAAATCCAAA TCCTGCTTTA CAATATTGAA ATCCCGCCGC GCTTTCCAAC

351   TCTGCAATTT GATTTTTCCG TAAACAACAG GATTATCGTT AAACATCGGT

401   GCAGCATTCA AACGATAAGA CAAGGGTCTG TACCAGATTA G
```

This corresponds to the amino acid sequence <SEQ ID 2034; ORF 635.ng>:

```
g635.pep
    1   MTRRRVGKQN RIAIHSAQYR KMVVFAVFQI HDDGDFQLRE LFERQGIAFR

51   LKTQIGHNAP HILKRRAHLF LTQFFQHFFF RQLLPVKIVQ KRRHRSRPAG

101   KIQILLYNIE IPPRFPTLQF DFSVNNRIIV KHRCSIQTIR QGSVPD*
```

The following partial DNA sequence was identified in *N. meningitidis* <SEQ ID 2035>:

```
m635.seq
    1   ATGACCCAGC GACGGGTCGG CAAGCAAAAC CGTATTGCCG TCTATACCGC

51   GCAATACCGA GAAATGATCA TCCTTGCGGT ATTTCAGATA CACGATGACG

101   GGGATTTGCA ACTGTGCAAG CTGCTCGAAA GACAGGGCAT AGCCTTTCGC

151   TTCAAAACCC AAATCAGGCA TAATGCGCCG CATATCCTCA AACGACGCGG

201   GCATCTGCTC CTTATCCAGT TTTTTTAACA CGTCCTCTTC CGTCAGCTTT

251   TGCCCGTAAA AATTGTTCAA AAGCGTCACC ACCGAAGCCG CCCCGCAGGA

301   AAAATCCAAA TCCTGCTTTA CAATATTGAA ATCGCGCCTT TCTTTCCAAC

351   TCTGCACTTT GATTTTTCCA TAAGCAACAG GATTATAGTG GATTAA
```

This corresponds to the amino acid sequence <SEQ ID 2036; ORF 635>:

```
m635.pep
    1   MTQRRVGKQN RIAVYTAQYR EMIILAVFQI HDDGDLQLCK LLERQGIAFR

51   FKTQIRHNAP HILKRRGHLL LIQFF*HVLF RQLLPVKIVQ KRHHRSRPAG

101   KIQILLYNIE IAPFFPTLHF DFSISNRIIV D*
``` m635/g635 80.0% identity in 130 aa overlap

```
                  10         20         30         40         50         60
    m635.pep  MTQRRVGKQNRIAVYTAQYREMIILAVFQIHDDGDLQLCKLLERQGIAFRFKTQIRHNAP
              ||:|||||||||||::::||||:|:::|||||||||||:||  :|:||||||||:||| ||||
    g635      MTRRRVGKQNRIAIHSAQYRKMVVFAVFQIHDDGDFQLRELFERQGIAFRLKTQIGHNAP
                  10         20         30         40         50         60

70         80         90        100        110        120
    m635.pep  HILKRRGHLLLIQFFXHVLFRQLLPVKIVQKRHHRSRPAGKIQILLYNIEIAPFFPTLHF
              ||||||:||:| ||| |:|||||||||||||:||||||||||||||||||| | ||||:|
    g635      HILKRRAHLFLTQFFQHFFFRQLLPVKIVQKRHHRSRPAGKIQILLYNIEIPPRFPTLQF
                  70         80         90        100        110        120

130
    m635.pep  DFSISNRIIVDX
              |||::|||||
    g635      DFSVNNRIIVKHRCSIQTIRQGSVPDX
                 130        140
```

The following partial DNA sequence was identified in *N. meningitidis* <SEQ ID 2037>:

```
a635.seq
    1   ATGACCCAGC GACGGGTCGG CAAGCAAAAC CGTATTGCCG TCTATACCGC

51   GCAATACCGA GAAATGATCA TCCTTGCGGT ATTTCAGATA CACGATGACG

101   GGGATTTGCA ACTGTGCAAG CTGCTCGAAA GACAGGGCAT AGCCTTTCGC

151   CTCAAAACCC AAATCAGGCA TGATGCGCCG CATATCCTCA AACGACGCGC

201   GCATCTGCTC CTTATCCAGC TTTTTCAACA CGTCCTCTTC CGTCAGCTTT

251   TGCCCGTGAA AATTGTTCAA AAGCGTCGCC ACCGAAGCCG CCCCGCAGGA

301   AAAATCCAAA TCCTGCTTTA CAATATTGAA ATCGCGCCTT TCTTTCCAAC

351   TCTGCACTTT GATTTTTCCA TAAGCAACAG GATTATAGTG GATTAA
```

This corresponds to the amino acid sequence <SEQ ID 2038; ORF 635.a>:

```
a635.pep
    1   MTQRRVGKQN RIAVYTAQYR EMIILAVFQI HDDGDLQLCK LLERQGIAFR

51   LKTQIRHDAP HILKRRAHLL LIQLFQHVLF RQLLPVKIVQ KRRHRSRPAG

101   KIQILLYNIE IAPFFPTLHF DFSISNRIIV D*
``` m635/a635 95.4% identity in 131 aa overlap

```
                  10         20         30         40         50         60
    m635.pep  MTQRRVGKQNRIAVYTAQYREMIILAVFQIHDDGDLQLCKLLERQGIAFRFKTQIRHNAP
              |||||||||||||||||||||||||||||||||||||||||||||||||:||||||:||
    a635      MTQRRVGKQNRIAVYTAQYREMIILAVFQIHDDGDLQLCKLLERQGIAFRLKTQIRHDAP
                  10         20         30         40         50         60

70         80         90        100        110        120
    m635.pep  HILKRRGHLLLIQFFXHVLFRQLLPVKIVQKRHHRSRPAGKIQILLYNIEIAPFFPTLHF
              ||||||:||||||:| |||||||||||||||:|||||||||||||||||||||||||||
    a635      HILKRRAHLLLIQLFQHVLFRQLLPVKIVQKRRHRSRPAGKIQILLYNIEIAPFFPTLHF
                  70         80         90        100        110        120
```

-continued

```
             130
m635.pep  DFSISNRIIVDX
          ||||||||||||
a635      DFSISNRIIVDX
             130
```

The following partial DNA sequence was identified in *N. gonorrhoeae* <SEQ ID 2039>:

```
g638.seq
    1  ATGATTGGCG GACAGTTTAT CGTAGttgGc atTGTAGGCA AAAACGCACT
   51  TGCCCGCTTT GTTGATAATA ttgtcGTGAA TAtcGGAATA GTTGACATAG
  101  TTGAGCATGA TGCCCTAATC GCGGCTGCCG ACGGCGATAT TGTCGAACAC
  151  TTTGAGCCGT TCGGAAAACA TCAGCACATA GCCCATATTG TtgcCCACGG
  201  AAATATTGCC GCTGacttcg ctgtcgTTGG TGTACATATA GTGGACGGCG
  251  AAACGCAGGT CGCTGAAGCG GTTGTTTTTA TAGGTGTTGT GCGTGCTGGT
  301  ATTGGAAAAA ATGCCGTCCC GCCCTTTGGA AATGTCGTTG ccgACGACCT
  351  GCGCgccggg CgcgtTCCAA ACGGTAACGC CATTGCCGCG CTCATTCACG
  401  CGCAAGGTcg catcgCCGAC GATTTTATTC TCGCGCACCA TCGCATCGGC
  451  AGAACCATGA AGGTATACGC CGAACGAATT ATCAAAAATA TTGTTGTGTT
  501  CAACCAGGGC GCGCGGGGCG GCTTTTTCGA GATAAATACC GGCATCCATT
  551  GCTGGCAGGC TCATACCGGA ACGGGTAACG GTCAGGTTGC GGAGCGTTAC
  601  GTCCGGCGCG TGTACGGCTA TGGTACGCCC GCTCTTGTCC CCTTCGATGG
  651  TTGCGGAACG GTCGGCAGGC CCTTCAATCG TAATCGGTTT GTCGATATAA
  701  AGTTTGGTTT GATATACGCC GGAAGCCAGT TTGATCGTAT CGCCCGCCCG
  751  GGCGCGGGCA AAAATTTCGG CAAGGTTGTC TTGCGGGGAA ACGTGGACGA
  801  CGGCTGCCGA TGCCGTCTGA AAAATGCTGC CGGCGGCAAG TATCAGCACG
  851  GCCTTCAGCC ATATACGGAG CGCGGATGTG TGCATAGTGT CCCTCTGTTT
  901  CGTTCGGTAT GGCCGAACAA AATAAAGCAT CATTCAAATG TGCCTGTTTT
  951  TATAGCGAAA CCGCCTGAAA CGGTACGGCA AGCGGTTTGG CTATAA
```

This corresponds to the amino acid sequence <SEQ ID 2040; ORF 638.ng>:

```
g638.pep
    1  MIGGQFIVVG IVGKNALARF VDNIVVNIGI VDIVEHDALI AAADGDIVEH
   51  FEPFGKHQHI AHIVAHGNIA ADFAVVGVHI VDGETQVAEA VVFIGVVRAG
  101  IGKNAVPPFG NVVADDLRAG RVPNGNAIAA LIHAQGRIAD DFILAHHRIG
  151  RTMKVYAERI IKNIVVFNQG ARGGFFEINT GIHCWQAHTG TGNGQVAERY
  201  VRRVYGYGTP ALVPFDGCGT VGRPFNRNRF VDIKFGLIYA GSQFDRIARP
  251  GAGKNFGKVV LRGNVDDGCR CRLKNAAGGK YQHGLQPYTE RGCVHSVPLF
  301  RSVWPNKIKH HSNVPVFIAK PPETVRQAVW L*
```

The following partial DNA sequence was identified in *N. meningitidis* <SEQ ID 2041>:

```
m638.seq
    1  ATGATTGGCG AAAAGTTTAT CGTAGTTGGC ATTATAGGCA AATACGCACT
   51  TGCCTGCCTT GTTGATAATG TTGTCGTGAA TATCGGAATA GTTGACATAG
  101  TTGAGCATAA TGCCCTGATC GCGGCTGCCG ACGGCGATAT TGTCGAATAC
  151  TTTGAGCCGC TCGGAAAACA TCAGCACATA GCCCATATTG TTGCCCACGG
  201  AAATATTGCC GCTGATTTCG CTGTCGTTGG TGTACATATA GTGGACGGCG
  251  AAACGCAAAT CGCTGAAGCG GTTGTTTTTG TAGGTGTTGT GCGTGCTGGT
  301  ATTGGAAAAA ATGCCGTCCC GCCCTTTGGA AATGTCGTTG CCGACGACCT
  351  GCGCACCGGG TGCGTTCCAA ACGGTAACGC CGTTGCCGCG CTCGTTCACG
  401  CGCAAAGTCG CGTCGCCGAC GATTTTATTC TCGCGCACCA TCGCATCGGC
  451  AGAACCATGC AGATATACGC CGACCGAATT ATCCAAAATA TTGTTGTGTT
  501  CAATCAGGGC GCGCGGGGCA GTTTCTTCGA GATAAATACC GGCATCCATT
  551  GCGGGCAGGC TCATACCGGA ACGGGTAACG GTCAGGTTGC GGAGCGTTAC
  601  GTCCGGCGCG TGTACGGCTA TGGTACGCCC GCTCCTGTCG CCTTCGATGG
  651  TTGCGGAACG GTCGGCAGGC CCTTCAATCG TAATCGGTTT GTCAATGTGA
  701  AGTTTGGTTT TATATACGCC GGAAGCCAGT TTGAGCGTAT CGCCCGCCCG
  751  GGCGCGGGCA AATGCGGGAT ACCGATCAGC ATAATCGGTT CGTGA
```

This corresponds to the amino acid sequence <SEQ ID 2042; ORF 638>:

```
m638.pep
    1  MIGEKFIVVG IIGKYALACL VDNVVVNIGI VDIVEHNALI AAADGDIVEY
   51  FEPLGKHQHI AHIVAHGNIA ADFAVVGVHI VDGETQIAEA VVFVGVVRAG
  101  IGKNAVPPFG NVVADDLRTG CVPNGNAVAA LVHAQSRVAD DFILAHHRIG
  151  RTMQIYADRI IQNIVVFNQG ARGSFFEINT GIHCGQAHTG TGNGQVAERY
  201  VRRVYGYGTP APVAFDGCGT VGRPFNRNRF VNVKFGFIYA GSQFERIARP
  251  GAGKCGIPIS IIGS*
``` m638/g638 88.2% identity in 254 aa overlap

```
                  10         20         30         40         50         60
m638.pep  MIGEKFIVVGIIGKYALACLVDNVVVNIGIVDIVEHNALIAAADGDIVEYFEPLGKHQHI
          ||| :||||||:|| |||  :|||:||||||||||||:||||||||||:|||:||||||
g638      MIGGQFIVVGIVGKNALARFVDNIVVNIGIVDIVEHDALIAAADGDIVEHFEPFGKHQHI
                  10         20         30         40         50         60

70         80         90        100        110        120
m638.pep  AHIVAHGNIAADFAVVGVHIVDGETQIAEAVVFVGVVRAGIGKNAVPPFGNVVADDLRTG
          ||||||||||||||||||||||||||:||||||:||||||||||||||||||||||||:|
g638      AHIVAHGNIAADFAVVGVHIVDGETQVAEAVVFIGVVRAGIGKNAVPPFGNVVADDLRAG
                  70         80         90        100        110        120

130        140        150        160        170        180
m638.pep  CVPNGNAVAALVHAQSRVADDFILAHHRIGRTMQIYADRIIQNIVVFNQGARGSFFEINT
           ||||||:|||:|||| ||:||||||||||||||:|||:||:|||||||||||| ||||||
g638      RVPNGNAIAALIHAQGRIADDFILAHHRIGRTMKVYAERIIKNIVVFNQGARGGFFEINT
                 130        140        150        160        170        180

190        200        210        220        230        240
m638.pep  GIHCGQAHTGTGNGQVAERYVRRVYGYGTPAPVAFDGCGTVGRPFNRNRFVNVKFGFIYA
          ||||  |||||||||||||||||||||||||  | |||||||||||||||| ::|||:||
g638      GIHCWQAHTGTGNGQVAERYVRRVYGYGTPALVPFDGCGTVGRPFNRNRPVDIKFGLIYA
                 190        200        210        220        230        240
```

```
                    250         260
m638.pep   GSQFERIARPGAGKCGIPISIIGSX
           ||||:||||||||
     g638  GSQFDRIARPGAGKNFGKVVLRGNVDDGCRCRLKNAAGGKYQHGLQPYTERGCVHSVPLF
                    250         260         270         280         290         300
```

The following partial DNA sequence was identified in *N. meningitidis* <SEQ ID 2043>:

```
a638.seq
     1   ATGATTGGCG GACAGTTTAT CGTAGTTGGC ATTGTAGGCA AAAACGCACT

51   TGCCCGCTTT GTTGATAATG TTGTCGTGAA TATCGGAATA GTTGACATAG

101   TTGAGCATGA TGCCTTGGTC GCGGCTGCCG ACGGCGATAT TGTCAAACAC

151   TTTGAGCCGC TCGGAAAACA TCAGCACATA GCCCATATTG TTGCCCACGG

201   AAATATTGCC GCTGATTTCG CTGTCGTTGG TGTACATATA GTGGACGGCG

251   AAACGCAAAT CGCTGAAGCG GTTGTTTTTA TAGGTGTTGT GCGTGCTGGT

301   ATTGGAAAAA ATGCCGTCCC GCCCTTTGGA AATATCGTTG CCGACGACCT

351   GCGCGCCGGG CGCGTTCCAA ACGGTAACGC CATTGCCGCG CTCGTTCACG

401   CGCAAAGTCG CGTCGCCGAC GATTTTATTC TCCCGCACCA TCGCATCGGC

451   AGAACCATGC AGATAGACGC CGACCGAATT ATCCAAAATA TTATTGTGTT

501   CAATCAGGGC GCGCGGGGCA GTTTCTTCGA GATAAATACC GGCATCCATT

551   GCGGGCAGGC TCATACCGGA ACGGGTAACG GTCAGGTTGC GGAGCGTTAC

601   GTCCGGCGCG TGTACGGCTA TGGTACGCCC GCTCCTGTCT CCTTCGATGG

651   TTGCAGAACG GTCGGCAGGC CCTTCAATCG TAATCGGTTT GTCGATGTGA

701   AGTTTGGTTT GATATACGCC GGAAGCCAGT TTGAGCGTAT CGCCCGCCCG

751   GGCGCGGGCA AATGCGGGAT ACCGATCAGC ATAATCGACT CATGGTGA
```

This corresponds to the amino acid sequence <SEQ ID 2044; ORF 638.a>:

```
a638.pep
     1   MIGGQFIVVG IVGKNALARF VDNVVVNIGI VDIVEHDALV AAADGDIVKH

51   FEPLGKHQHI AHIVAHGNIA ADFAVVGVHI VDGETQIAEA VVFIGVVRAG

101   IGKNAVPPFG NIVADDLRAG RVPNGNAIAA LVHAQSRVAD DFILPHHRIG

151   RTMQIDADRI IQNIIVFNQG ARGSFFEINT GIHCGQAHTG TGNGQVAERY

201   VRRVYGYGTP APVSFDGCRT VGRPFNRNRF VDVKFGLIYA GSQFERIARP

251   GAGKCGIPIS IIDSW*
``` m638/a638 91.3% identity in 264 aa overlap

```
                    10         20         30         40         50         60
m638.pep   MIGEKFIVVGIIGKYALACLVDNVVVNIGIVDIVEHNALIAAADGDIVEYFEPLGKHQHI
           |||:||||||:||:|||:||||||||||||||||||:||:||||||::|||||||||
     a638  MIGGQFIVVGIVGKNALARFVDNVVVNIGIVDIVEHDALVAAADGDIVKHFEPLGKHQHI
                    10         20         30         40         50         60

70         80         90        100        110        120
m638.pep   AHIVAHGNIAADFAVVGVHIVDGETQIAEAVVFVGVVRAGIGKNAVPPFGNVVADDLRTG
           ||||||||||||||||||||||||||||||||:||||||||||||||||||:|||||:|
     a638  AHIVAHGNIAADFAVVGVHIVDGETQIAEAVVFIGVVRAGIGKNAVPPFGNIVADDLRAG
                    70         80         90        100        110        120
```

```
                    130        140        150        160        170        180
m638.pep  CVPNGNAVAALVHAQSRVADDFILAHHRIGRTMQIYADRIIQNIVVFNQGARGSFFEINT
          ||||||:||||||||||||||| |||||||||| ||||||||:|||||||||||||||
a638      RVPNGNAIAALVHAQSRVADDFILPHHRIGRTMQIDADRIIQNIIVFNQGARGSFFEINT
                    130        140        150        160        170        180

190        200        210        220        230        240
m638.pep  GIHCGQAHTGTGNGQVAERYVRRVYGYGTPAPVAFDGCGTVGRPFNRNRFVNVKFGFIYA
          ||||||||||||||||||||||||||||||||||:||||  ||||||||||:||||:|||
a638      GIHCGQAHTGTGNGQVAERYVRRVYGYGTPAPVSFDGCRTVGRPFNRNRFVDVKFGLIYA
                    190        200        210        220        230        240

250        260
m638.pep  GSQFERIARPGAGKCGIPISIIGSX
          |||||||||||||||||||||| |
a638      GSQFERIARPGAGKCGIPISIIDSWX
                    250        260
```

15

The following partial DNA sequence was identified in *N. gonorrhoeae* <SEQ ID 2045>:

```
g639-1.seq
     1    ATGAGCCTGC CAGCAATGGA TGCCGGTATT TATCTCGAAA AAGCCGCCCC
    51    GCGCGCCCTG GTTGAACACA ACAATATTTT TGATAATTCG TTCGGCGTAT
   101    ACCTTCATGG TTCTGCCGAT GCGATGGTGC GCGAGAATAA AATCGTCGGC
   151    GATGCGACCT TGCGCGTGAA TGAGCGCGGC AATGGCGTTA CCGTTTGGAA
   201    CGCGCCCGGC GCGCAGGTCG TCGGCAACGA CATTTCCAAA GGGCGGGACG
   251    GCATTTTTTC CAATACCAGC ACGCACAACA CCTATAAAAA CAACCGCTTC
   301    AGCGACCTGC GTTTCGCCGT CCACTATATG TACACCAACG ACAGCGAAGT
   351    CAGCGGCAAT ATTTCCGTGG CAACAATAT GGGCTATGTG CTGATGTTTT
   401    CCGAACGGCT CAAAGTGTTC GACAATATCG CCGTCGGCAG CCGCGATTAG
   451    GGCATCATGC TCAACTATGT CAACTATTCC GATATTCACG ACAATATTAT
   501    CAACAAAGCG GGCAAGTGCG TTTTTGCCTA CAATGCCAAC TACGATAAAC
   551    TGTCCGCCAA TCATTTTGAA AACTGCCAAA TCGGCATGCA CTTTACCGCC
   601    GCCATCGAAG GCACGTCCCT GCACGACAAT TCCTTTATCA CAACGGAAG
   651    CCAGGTCAAA TATGTCAGTA CGCGCTTTCT CGACTGGAGC GAGGGCGGAC
   701    ACGGCAACTA CTGGAGCGAC AACAGCCCGT TCGATTTGAA CGGCGACGGC
   751    TTCGGAGACA GCGCGTACCG TCCCGACGGC ATCATCGACC AAATCATCTG
   801    GCGCGCGCCC GTATCGCGCC TCTTGATGAA CAGTCCCGCA ATCAGCATCG
   851    TCAAATGGGC GCAGGCGCAG TTTCCCGCCG TTCTGCCCGG CGGCGTGGTG
   901    GACAGCAAAC CGCTGATGAA GCCTTATGCC CCCAAAATTC AAACCCGTTA
   951    TCAGGCGATG AAGGACGAGT TGCTCAAAGA AGCCGAAACG CGGCAGTCGG
  1001    AACGGGGCAG GGCGGAAAAC GGTTCTTTGA ACTAG
```

This corresponds to the amino acid sequence <SEQ ID 2046; ORF 639-1.ng>:

```
g639-1.pep
     1    MSLPAMDAGI YLEKAAPRAL VEHNNIFDNS FGVYLHGSAD AMVRENKIVG
    51    DATLRVNERG NGVTVWNAPG AQVVGNDISK GRDGIFSNTS THNTYKNNRF
   101    SDLRFAVHYM YTNDSEVSGN ISVGNNMGYV LMFSERLKVF DNIAVGSRD*
```

-continued

```
151    GIMLNYVNYS DIHDNIINKA GKCVFAYNAN YDKLSANHFE NCQIGMHFTA

201    AIEGTSLHDN SFINNGSQVK YVSTRFLDWS EGGHGNYWSD NSPFDLNGDG

251    FGDSAYRPDG IIDQIIWRAP VSRLLMNSPA ISIVKWAQAQ FPAVLPGGVV

301    DSKPLMKPYA PKIQTRYQAM KDELLKEAET RQSERGRAEN GSLN*
```

The following partial DNA sequence was identified in *N. meningitidis* <SEQ ID 2047>:

```
m639-1.seq
   1   ATGAGCCTGC CCGCAATGGA TGCCGGTATT TATCTCGAAG AAACTGCCCC

51   GCGCGCCCTG ATTGAACACA ACAATATTTT GGATAATTCG GTCGGCGTAT

101   ATCTGCATGG TTCTGCCGAT GCGATGGTGC GCGAGAATAA AATCGTCGGC

151   GACGCGACTT TGCGCGTGAA CGAGCGCGGC AACGGCGTTA CCGTTTGGAA

201   CGCACCCGGT GCGCAGGTCG TCGGCAACGA CATTTCCAAA GGGCGGGACG

251   GCATTTTTTC CAATACCAGC ACGCACAACA CCTACAAAAA CAACCGCTTC

301   AGCGATTTGC GTTTCGCCGT CCACTATATG TACACCAACG ACAGCGAAAT

351   CAGCGGCAAT ATTTCCGTGG GCAACAATAT GGGCTATGTG CTGATGTTTT

401   CCGAGCGGCT CAAAGTATTC GACAATATCG CCGTCGGCAG CCGCGATCAG

451   GGCATTATGC TCAACTATGT CAACTATTCC GATATTCACG ACAACATTAT

501   CAACAAGGCA GGCAAGTGCG TATTTGCCTA TAATGCCAAC TACGATAAAC

551   TTTTCGCCAA TCATTTTGAA AACTGTCAAA TCGGCATACA CTTTACCGCC

601   GCCATCGAAG GCACGTCCTT GCATGACAAT TCCTTTATCA ACAACGAAAG

651   CCAGGTCAAA TACGTCAGCA CGCGCTTTCT CGATTGGAGC GAGGGCGGAC

701   ACGGCAACTA TTGGAGCGAC AACAGCGCGT TCGATTTGAA CGGCGACGGC

751   TTCGGAGACA GCGCGTACCG CCCCAACGGC ATCATCGACC AAATCATCTG

801   GCGCGCGCCC GTATCGCGCC TTTTGATGAA CAGTCCCGCA ATCAGCATCG

851   TCAAATGGGC GCAGGCGCAG TTTCCCGCCG TTCTGCCTGG CGGCGTGGTG

901   GACAGCAAAC CGCTGATGAA GCCTTATGCC CCCAAAATTC AAACCCGTTA

951   TCAGGCGATG AAGGACGAGC TACTCAAAGA AGTCGAAACG CGGCAGTCGG

1001   AATGGGGCAG GGCGGAAAAC GGTTCTTTGA ACTAG
```

This corresponds to the amino acid sequence <SEQ ID 2048; ORF 639-1>:

```
m639-1.pep
   1   MSLPAMDAGI YLEETAPRAL IEHNNILDNS VGVYLHGSAD AMVRENKIVG

51   DATLRVNERG NGVTVWNAPG AQVVGNDISK GRDGIFSNTS THNTYKNNRF

101   SDLRFAVHYM YTNDSEISGN ISVGNNMGYV LMFSERLKVF DNIAVGSRDQ

151   GIMLNYVNYS DIHDNIINKA GKCVFAYNAN YDKLFANHFE NCQIGIHFTA

201   AIEGTSLHDN SFINNESQVK YVSTRFLDWS EGGHGNYWSD NSAFDLNGDG

251   FGDSAYRPNG IIDQIIWRAP VSRLLMNSPA ISIVKWAQAQ FPAVLPGGVV

301   DSKPLMKPYA PKIQTRYQAM KDELLKEVET RQSEWGRAEN GSLN*
``` g639-1/m639-1 95.9% identity in 344 aa overlap

```
                       10        20        30        40        50        60
g639-1.pep      MSLPAMDAGIYLEKAAPRALVEHNNIFDNSFGVYLHGSADAMVRENKIVGDATLRVNERG
                |||||||||||||::|||||:|||||:||| |||||||||||||||||||||||||||||
m639-1          MSLPAMDAGIYLEETAPRALIEHNNILDNSVGVYLHGSADAMVRENKIVGDATLRVNERG
                       10        20        30        40        50        60

70        80        90       100       110       120
g639-1.pep      NGVTVWNAPGAQVVGNDISKGRDGIFSNTSTHNTYKNNRFSDLRFAVHYMYTNDSEVSGN
                |||||||||||||||||||||||||||||||||||||||||||||||||||||||:||||
m639-1          NGVTVWNAPGAQVVGNDISKGRDGIFSNTSTHNTYKNNRFSDLRFAVHYMYTNDSEISGN
                       70        80        90       100       110       120

130       140       150       160       170       180
g639-1.pep      ISVGNNMGYVLMFSERLKVFDNIAVGSRDXGIMLNYVNYSDIHDNIINKAGKCVFAYNAN
                ||||||||||||||||||||||||||||| ||||||||||||||||||||||||||||||
m639-1          ISVGNNMGYVLMFSERLKVFDNIAVGSRDQGIMLNYVNYSDIHDNIINKAGKCVFAYNAN
                      130       140       150       160       170       180

190       200       210       220       230       240
g639-1.pep      YDKLSANHFENCQIGMHFTAAIEGTSLHDNSFINNGSQVKYVSTRFLDWSEGGHGNYWSD
                |||| ||||||||||:||||||||||||||||||| ||||||||||||||||||||||||
m639-1          YDKLFANHFENCQIGIHFTAAIEGTSLHDNSFINNESQVKYVSTRFLDWSEGGHGNYWSD
                      190       200       210       220       230       240

250       260       270       280       290       300
g639-1.pep      NSPFDLNGDGFGDSAYRPDGIIDQIIWRAPVSRLLMNSPAISIVKWAQAQFPAVLPGGVV
                || |||||||||||||||:|||||||||||||||||||||||||||||||||||||||||
m639-1          NSAFDLNGDGFGDSAYRPNGIIDQIIWRAPVSRLLMNSPAISIVKWAQAQFPAVLPGGVV
                      250       260       270       280       290       300

310       320       330       340
g639-1.pep      DSKPLMKPYAPKIQTRYQAMKDELLKEAETRQSERGRAENGSLNX
                |||||||||||||||||||||||||||:|||||| ||||||||||
m639-1          DSKPLMKPYAPKIQTRYQAMKDELLKEVETRQSEWGRAENGSLNX
                      310       320       330       340
```

The following partial DNA sequence was identified in *N. meningitidis* <SEQ ID 2049>:

```
a639-1.seq
      1   ATGAGCCTGC CCGCAATGGA TGCCGGTATT TATCTCGAAG AAACTGCCCC

51   GCGCGCCCTG ATTGAACACA ATAATATTTT GGATAATTCG GTCGGCGTCT

101   ATCTGCATGG TTCTGCCGAT GCGATGGTGC GGGAGAATAA AATCGTCGGC

151   GACGCGACTT TGCGCGTGAA CGAGCGCGGC AATGGCGTTA CCGTTTGGAA

201   CGCGCCCGGC GCGCAGGTCG TCGGCAACGA TATTTCCAAA GGGCGGGACG

251   GCATTTTTTC CAATACCAGC ACGCACAACA CCTATAAAAA CAACCGCTTC

301   AGCGATTTGC GTTTCGCCGT CCACTATATG TACACCAACG ACAGCGAAAT

351   CAGCGGCAAT ATTTCCGTGG GCAACAATAT GGGCTATGTG CTGATGTTTT

401   CCGAGCGGCT CAAAGTGTTT GACAATATCG CCGTCGGCAG CCGCGACCAA

451   GGCATCATGC TCAACTATGT CAACTATTCC GATATTCACG ACAACATTAT

501   CAACAAAGCG GGCAAGTGCG TTTTTGCCTA CAATGCCAAC TACGATAAAC

551   TGTCCGCCAA TCATTTTGAA AACTGCCAAA TCGGCATACA CTTTACCGCC

601   GCCATCGAAG GCACGTCCCT GCACGACAAT TCCTTTATCA ACAACGAAAG

651   CCAGGTCAAA TACGTCAGCA CGCGCTTTCT CGACTGGAGC GAGGGCGGAC

701   ACGGCAACTA TTGGAGCGAC AACAGCGCGT TCGATTTGAA CGGCGACGGC

751   TTCGGAGACA GCGCGTACCG TCCCAACGGC ATCATCGACC AAATCATCTG

801   GCGCGCACCC GTATCGCGCC TCTTGATGAA CAGTCCCGCA ATCAGCATCG

851   TCAAATGGGC GCAGGCGCAA TTTCCCGCCG TTTTGCCTGG CGGCGTGGTG

901   GACAGCAAAC CGCTGATGAA GCCTTATGCC CCCAAAATTC AAACCCGTTA
```

```
 951    TCAGGCGATG AAGGACGGGC TGCTCAAAAA AGTCGAAACG CGGCAGTTGG

1001    AATGGGGCAG GGCGGAAAAC GGTTCTTTGA ACTAG
```

This corresponds to the amino acid sequence <SEQ ID 2050; ORF 639-1.a>:

```
a639-1.pep
     1    MSLPAMDAGI YLEETAPRAL IEHNNILDNS VGVYLHGSAD AMVRENKIVG

51    DATLRVNERG NGVTVWNAPG AQVVGNDISK GRDGIFSNTS THNTYKNNRF

101    SDLRFAVHYM YTNDSEISGN ISVGNNMGYV LMFSERLKVF DNIAVGSRDQ

151    GIMLNYVNYS DIHDNIINKA GKCVFAYNAN YDKLSANHFE NCQIGIHFTA

201    AIEGTSLHDN SFINNESQVK YVSTRFLDWS EGGHGNYWSD NSAFDLNGDG

251    FGDSAYRPNG IIDQIIWRAP VSRLLMNSPA ISIVKWAQAQ FPAVLPGGVV

301    DSKPLMKPYA PKIQTRYQAM KDGLLKKVET RQLEWGRAEN GSLN*
``` a639-1/m639-1 98.8% identity in 344 aa overlap

```
                   10         20         30         40         50         60
a639-1.pep  MSLPAMDAGIYLEETAPRALIEHNNILDNSVGVYLHGSADAMVRENKIVGDATLRVNERG
            ||||||||||||||||||||||||||||||||||||||||||||||||||||||||||||
m639-1      MSLPAMDAGIYLEETAPRALIEHNNILDNSVGVYLHGSADAMVRENKIVGDATLRVNERG
                   10         20         30         40         50         60

70         80         90        100        110        120
a639-1.pep  NGVTVWNAPGAQVVGNDISKGRDGIFSNTSTHNTYKNNRFSDLRFAVHYMYTNDSEISGN
            ||||||||||||||||||||||||||||||||||||||||||||||||||||||||||||
m639-1      NGVTVWNAPGAQVVGNDISKGRDGIFSNTSTHNTYKNNRFSDLRFAVHYMYTNDSEISGN
                   70         80         90        100        110        120

130        140        150        160        170        180
a639-1.pep  ISVGNNMGYVLMFSERLKVFDNIAVGSRDQGIMLNYVNYSDIHDNIINKAGKCVFAYNAN
            ||||||||||||||||||||||||||||||||||||||||||||||||||||||||||||
m639-1      ISVGNNMGYVLMFSERLKVFDNIAVGSRDQGIMLNYVNYSDIHDNIINKAGKCVFAYNAN
                  130        140        150        160        170        180

190        200        210        220        230        240
a639-1.pep  YDKLSANHFENCQIGIHFTAAIEGTSLHDNSFINNESQVKYVSTRFLDWSEGGHGNYWSD
            ||||  ||||||||||||||||||||||||||||||||||||||||||||||||||||||
m639-1      YDKLFANHFENCQIGIHFTAAIEGTSLHDNSFINNESQVKYVSTRFLDWSEGGHGNYWSD
                  190        200        210        220        230        240

250        260        270        280        290        300
a639-1.pep  NSAFDLNGDGFGDSAYRPNGIIDQIIWRAPVSRLLMNSPAISIVKWAQAQFPAVLPGGVV
            ||||||||||||||||||||||||||||||||||||||||||||||||||||||||||||
m639-1      NSAFDLNGDGFGDSAYRPNGIIDQIIWRAPVSRLLMNSPAISIVKWAQAQFPAVLPGGVV
                  250        260        270        280        290        300

310        320        330        340
a639-1.pep  DSKPLMKPYAPKIQTRYQAMKDGLLKKVETRQLEWGRAENGSLNX
            |||||||||||||||||||||||   :|||| ||||||||||||
m639-1      DSKPLMKPYAPKIQTRYQAMKDELLKEVETRQSEWGRAENGSLNX
                  310        320        330        340
```

The following partial DNA sequence was identified in *N. gonorrhoeae* <SEQ ID 2051>:

```
g640.seq
     1    ATGATTCATA TAATATCAAT ATTAAAGAGT ATCGGTATAT CGGGGATAGC

51    TATGTCCTGT TTTTCAATCC GGCGTATGTC TGCGTTTCGG GCGCGGATAA

101    CGGCGTTTTT TACCGCCTTT GTCTTTTTGA CGGcggcACT GCCCGCTTAT

151    GcggAgcgTc tgcctGATTT TCTGgcgAAA ATacAgcctT CGGAAATTTT

201    TCCGGGTGCG GATCGTTACG GCAAGCCGGA aggcAAGCCT AtggtTGCCC

251    GCgtttACAA AGgcgATGAG CAGCTCGGTT TGGTTTATAT CACGACCGAT

301    GCGGTCAATA CGCGCGGTTA TTCGAGCAAA CCGATCGATA CGCTGATGGC
```

-continued

```
 351  TTTGGCAAAC GACGGCACGA TAGCCGGGGC GAAACTGGTC GATCATCACG
 401  AACCGATTAT GCTGATCGGT ATCCCGCAAT CGCGTGTCGA TAAGTTCATC
 451  GACAAATATA TCGGTCTGAA TTTTATTAAA AATCCGCCGA CCCCGAGCGT
 501  GGCGCCGGGC GACATCATCA GcggtGCGAC TgttaCACTG ATGGTGGTTA
 551  ACGACAGCAT CCAGCGTTCG TACAAGGTCA TTGCCAACCA ATACCGTCTG
 601  GGTTCGGACA AGGCCCTTCA GACGGCATCC GCTTCCGATG TTCGGGAAGC
 651  CGCGCCTGCG TCAGAAACCC GTCCGCGCCG TATGGCAAAT CCCGACAAGC
 701  AGGATATTTT GTCTTGGGAC GAACTTTTGA AACAAAAGGC CGTCGGCCAT
 751  CTGCATATCA CGCTCGATCA AATCAACAAA CTGTTTGAGA AAGGCGGCAA
 801  GGCCGGCGTG GCCGATCACG CCGAACAGGG CGATCCTGAC GATACCTTTA
 851  TTGATTTGTA TGTTGCCTTG GTCAGCCAGC CTTCCATCGG TAAAAGCCTG
 901  CTGGGTGAGG ACGGCTGGGC GCATCTGCAA AAACGGCTGA AACCCGGGCA
 951  GCAGGCGGTT TTGGTTGCCG GAGAGGGCCG TTATTCTTGG AAAGGTTCGG
1001  GCTATGTGCG CGGCGGTATT TTCGACCGTA TCGAGATGAT TCAGGGGGAG
1051  AACAGCTTCC GTTTTACCGA TGCCCAACAC GAACGCGTCG TCGAGCTGTC
1101  TGCCGCCGAT GCGCCGCGTT TTAAAGAAGT TTCTTGGTTT ACCATCCCTG
1151  AAGGCGTAGC GTTTGACGGT GCGGAGCCGT GGCGGCTGTA A
```

This corresponds to the amino acid sequence <SEQ ID 2052; ORF 640.ng>:

```
g640.pep
   1  MIHIISILKS IGISGIAMSC FSIRRMSAFR ARITAFFTAF VFLTAALPAY
  51  AERLPDFLAK IQPSEIFPGA DRYGKPEGKP MVARVYKGDE QLGLVYITTD
 101  AVNTRGYSSK PIDTLMALAN DGTIAGAKLV DHHEPIMLIG IPQSRVDKFI
 151  DKYIGLNFIK NPPTPSVAPG DIISGATVTL MVVNDSIQRS YKVIANQYRL
 201  GSDKALQTAS ASDVREAAPA SETRPRRMAN PDKQDILSWD ELLKQKAVGH
 251  LHITLDQINK LFEKGGKAGV ADHAEQGDPD DTFIDLYVAL VSQPSIGKSL
 301  LGEDGWAHLQ KRLKPGQQAV LVAGEGRYSW KGSGYVRGGI FDRIEMIQGE
 351  NSFRFTDAQH ERVVELSAAD APRFKEVSWF TIPEGVAFDG AEPWRL*
```

The following partial DNA sequence was identified in *N. meningitidis* <SEQ ID 2053>:

```
m640.seq (partial)
   1  ATGATTCATA TAATATCAAT ATTAAAGAGT ATCGGTATAT CGGGGATAGT
  51  CATGTCCTGT TTTTCAATCA AACGTATGTC CGCGTTTCGG GCGCGGATAA
 101  CGGCGTTTTT TGCCGCCTTT GTCTTTTTGA CGGCGGCACT GCCCGCTTAT
 151  GCGGAGCGTC TGCCTGATTT TCTGGCGAAA ATACAGCCTT CGGAAATTTT
 201  TCCGGGTGCG GACCGTTACG GCAAGCCGGA AGGTAAGCCT ATGGTTGCCC
 251  GCGTTTACAA AGGCGATGAG CAGTTGGGCT TGGTCTATAT CACGACCGAT
 301  GCGGTCAATA CGCGCGGTTA TTCGAGCAAA CCGATTGATA CGCTGATGGT
 351  GTTGGCAAAC GACGGCACGA TAGCCGGGGC GAAACTGGTC GACCATCACG
 401  AACCGATTAT GCTGATCGGT ATCCCGCAT...
```

This corresponds to the amino acid sequence <SEQ ID 2054; ORF 640>:

```
m640.pep (partial)
    1   MIHIISILKS IGISGIVMSC FSIKRMSAFR ARITAFFAAF VFLTAALPAY

51   AERLPDFLAK IQPSEIFPGA DRYGKPEGKP MVARVYKGDE QLGLVYITTD

101   AVNTRGYSSK PIDTLMVLAN DGTIAGAKLV DHHEPIMLIG IPH...
``` m640/g640 96.5% identity in 143 aa overlap

```
                10         20         30         40         50         60
m640.pep   MIHIISILKSIGISGIVMSCFSIKRMSAFRARITAFFAAFVFLTAALPAYAERLPDFLAK
           ||||||||||||||||||:||||||:||||||||||||||:|||||||||||||||||||
g640       MIHIISILKSIGISGIAMSCFSIRRMSAFRARITAFFTAFVFLTAALPAYAERLPDFLAK
                10         20         30         40         50         60
                70         80         90        100        110        120
m640.pep   IQPSEIFPGADRYGKPEGKPMVARVYKGDEQLGLVYITTDAVNTRGYSSKPIDTLMVLAN
           |||||||||||||||||||||||||||||||||||||||||||||||||||||||||:|||
g640       IQPSEIFPGADRYGKPEGKPMVARVYKGDEQLGLVYITTDAVNTRGYSSKPIDTLMALAN
                70         80         90        100        110        120
               130        140
m640.pep   DGTIAGAKLVDHHEPIMLIGIPH
           ||||||||||||||||||||||:
g640       DGTIAGAKLVDHHEPIMLIGIPQSRVDKFIDKYIGLNFIKNPPTPSVAPGDIISGATVTL
               130        140        150        160        170        180
```

The following partial DNA sequence was identified in *N. meningitidis* <SEQ ID 2055>:

```
a640.seq (partial)
    1   ATGATTCATA TAATATCAAT ATTAAAGAGT ATCGGTATAT CGGGGATAGT

51   CATGTCCTGT TTTTCAATCA AACGTATGTC CGCGTTTCGG GCGCGGATAA

101   CGGCGTTTTT TGCCGCCTTT GTCTTTTTGA CGGCGGCACT GCCCGCTTAT

151   GCGGAGCGTC TGCCTGATTT TCTGGCGAAA ATACAGCCTT CGGAAATTGT

201   TCCGGGTGCG GACCGTTACA GCAAGCCGGA AGGTAAGCCT ATGGTTGCCC

251   GCGTTTACAA AGGCGATGAG CAGTTGGGCT TGGTCTATAT CACGACCGAT

301   GCGGTCAATA CGCGCGGTTA TTCGAGCAAA CCGATTGATA CGCTGATGGC

351   GTTGGCTAAA GACGGTACGA TAGCCGGAGC GAAATTGGTT GATCACCATG

401   AGTCGATTAT GCTGATCGGT ATCCCGCAT...
```

This corresponds to the amino acid sequence <SEQ ID 2056; ORF 640.a>:

```
a640.pep (partial) Length: 143
    1   MIHIISILKS IGISGIVMSC FSIKRMSAFR ARITAFFAAF VFLTAALPAY

51   AERLPDFLAK IQPSEIVPGA DRYSKPEGKP MVARVYKGDE QLGLVYITTD

101   AVNTRGYSSK PIDTLMALAK DGTIAGAKLV DHHESIMLIG IPH...
``` m640/a640 96.5% identity in 143 aa overlap

```
                10         20         30         40         50         60
m640.pep   MIHIISILKSIGISGIVMSCFSIKRMSAFRARITAFFAAFVFLTAALPAYAERLPDFLAK
           ||||||||||||||||||||||||||||||||||||||||||||||||||||||||||||
a640       MIHIISILKSIGISGIVMSCFSIKRMSAFRARITAFFAAFVFLTAALPAYAERLPDFLAK
                10         20         30         40         50         60
```

```
                 70         80         90        100        110        120
m640.pep   IQPSEIFPGADRYGKPEGKPMVARVYKGDEQLGLVYITTDAVNTRGYSSKPIDTLMVLAN
           ||||||  ||||||:|||||||||||||||||||||||||||||||||||||||||||:
a640       IQPSEIVPGADRYSKPEGKPMVARVYKGDEQLGLVYITTDAVNTRGYSSKPIDTLMALAK
                 70         80         90        100        110        120

130        140
m640.pep   DGTIAGAKLVDHHEPIMLIGIPH
           ||||||||||||||| |||||||
a640       DGTIAGAKLVDHHESIMLIGIPH
                130        140
```

The following partial DNA sequence was identified in *N. gonorrhoeae* <SEQ ID 2057>:

```
g642.seq
     1   ATGCGGTATC CGCCGCAATC GGCGGTTTTG CAGAATGCCG CGCGTTGCCT

51   TTTGCGCCGC CCGAAATCTG CCTGCCGCCG TATTTGCCCG CTATCCGCAA

101   TATCGGCAGT CCAATATATC TTTGCGGATG TCGTTCAGCA GGAAGGCTGT

151   GGTGTCTTCG TGTTCCTCCT GTACGAAGAC AAAAAGTCGG GCGATGATTT

201   TGCCGATGAA GACTTTTTGC AGGGCGCAGG CGTCGGTCAG GGTGTGTTCC

251   TGCAGGAAGC TGCGGATGTC TTCGGGCAAA GCGTAgtCgc gGGCAACGGC

301   GGcaaagcgG ACatcggtTT Gcacggcgtc gagCAGGGtt tggtTTTTGT

351   CCAACTTAAT GCCTGCTTCT TTTTCTTCGG CGGTGGCGCG GACGAACTGG

401   TCGTAAATTT CGGCATAAAG CATATCGTTC GGGCCTTCAA AAATCGTGAA

451   GGGGCGGATA TCGATGGCGA TATTGCCGGC TGGGTGTCCG CGTTCAAAAC

501   CCTTCGCGCC AAGAGTTTTT TGCAACATTT GCGCGGCGgc gTAAGTGTAT

551   TCCGTGGCGa ggGTTTTGAc gatgTTCGCC TCCATCAATT GATGGGCGAc 601   ggGCGcgacg ggCGAAACGG AATGGCAGAC GTAGCGGTAA AGGATTTCGG

651   AAACCTGATG GCGGCGTTGG ATTTCGCGGC GTTCGTAATC GACGAATCTG

701   ATATCGTTGC GGACATATCG GTTCAGGTTG TCAAGGATGT ATTCCATAAT

751   GCCGTGCGTC ATGCCGATCA GTTGCAGGCG GCTGCGGATA AAGATGTTTT

801   GGAACGCGCG CAAACCGGCA GCGTCGCCCC GGGAGAGTTT CATCACGGCG

851   GTTGCAGGCA TTTCGGCATC GATGCGGTTG ACGGCGTAAC GGACGGCGCG

901   CAGGCCTTCG GATGCGAGGG TTTCGCAGCG GATGTATGTT TTGGGGACGA

951   GCAGCAGGTC GATGactttg gcgagtttgC Cgtttttgcg ctctttggcg 1001   gcaacgaggA GGAAGTCGCT TTGCGAATTG CCCTGCCAGT ATTTCGCGGC 1051   GttgACGTAA ATGGTTtgtt cgtcggtata ttcgtagcag gactgcaTTT 1101   CGCGTGCAAt cgCcgcgccg gaggtTtcgg gttcggtaAc gcccaaacgg 1151   cggctttcgc ctTTGAAAAT CATGTCCAAA CCTTGTGCGA CTTGCgcttc 1201   gccgccgaac tCTTGCAGAG GCTGCAACAC CAGCGCGCCT TCGATGCCGG

1251   TACGCAGCGT AACGGGCACG CCGTAATGCC CCGCAATCCT TAG
```

This corresponds to the amino acid sequence <SEQ ID 2058; ORF 642.ng>:

```
g642.pep
     1   MRYPPQSAVL QNAARCLLRR PKSACRRICP LSAISAVQYI FADVVQQEGC

51   GVFVFLLYED KKSGDDFADE DFLQGAGVGQ GVFLQEAADV FGQSVVAGNG
```

-continued
```
101    GKADIGLHGV EQGLVFVQLN ACFFFFGGGA DELVVNFGIK HIVRAFKNRE

151    GADIDGDIAG WVSAFKTLRA QEFLQHLRGG VSVFRGEGFD DVRLHQLMGD

201    GRDGRNGMAD VAVKDFGNLM AALDFAAFVI DESDIVADIS VQVVKDVFHN

251    AVRHADQLQA AADKDVLERA QTGSVAPGEF HHGGCRHFGI DAVDGVTDGA

301    QAFGCEGFAA DVCFGDEQQV DDFGEFAVFA LFGGNEEEVA LRIALPVFRG

351    VDVNGLFVGI FVAGLHFACN RRAGGFGFGN AQTAAFAFEN HVQTLCDLRF

401    AAELLQRLQH QRAFDAGTQR NGHAVMPRNP *
```

The following partial DNA sequence was identified in *N. meningitidis* <SEQ ID 2059>:

```
m642.seq (partial)
      1   GCCTGCCGCC GTATTTGCCC GCTACCCGCA ATATCGGCAG TCCAATATAT

51   CTTTGCGGAT GTCGTTCAGC AGGAAGGCTG CGGTGTCTTC GTGTTTCGCC

101   TGTACGAAGA CAAAGAGTCG GGCGATGATT TTGCCGATAA AGACTTTTTG

151   CAGGGCGCAG GCATCGGTCA GGGTGTGTTC CTGCAGGAAG CTGCGGATGT

201   CTTCAGGCAA AGTGTAGTCG CGGGCGACGG CGGCAAAGCG GGCATCGGTT

251   TGCAGGCGGT CGAGCAGGGT TTGGTTTTTG TCCAACTTCA TGCCTGCTTC

301   TTTTTCTTCG GCGGTGGCGC GGACAAACTG GTCGTAAATT TCGGCATAAA

351   GCATATCGTT CGGGCCTTCA AAAATCGTGA AGGGGCGGAT GTCGATAGCG

401   ATATTGCCGG CGGTGTGTCC GCGTTCAAAA CCCTTCGCAC CCAAGAGTTT

451   TTGCAACATT TGCGCGGCGG CGTAAGTGTA TTCCGTGGCG AGGGTTTTGA

501   CGATGTTCGC CTCCATCAGC TGATGGGCGA CGGGGGCAAC AGGCGAAACG

551   GAATGGCAGA CGTAGCGGTA AAGAATCTCG GAAACCTGAT GGCGGCGCCG

601   GATTTCGCGG CGTTCGTAAT CGACGAATTT GATGTCGTTG CGGACGTATC

651   GTTCCAGATT TTCAAGGATG TATTCCATAA TGCCGTGCGT CATGCCGATC

701   AGTTGCAGGC GGCTGCGGAT AAAGATGTTT TGGAACGCGC GCAAACCGGC

751   AGCGTCGCTC TGGGAGAGTT TCATCACGGC GGTTGCAGGC ATTTCGGCAT

801   CGATGCGGTT GACGGCGTAA CGGACGGCGC GCAAGCCTTC GGATGCGAGG

851   GTTTCGCAGC GGATGTATGT TTTGGGGACG AGCAGCAGGT CGATGACTTT

901   GGCGAGTTTG CCGTTTTTGC GCTCTTTGGC GGCAACGAGG AGGAAGTCGC

951   TTTTGCGAGTT GCCCTGCCAG TATTTCGCGG CGTTGACGTA AATGGTTTGT

1001   CCGTCGATAT ATTCGTAGTA GGACTGCATT TCGCGTGCAA TCGCCGCGCC

1051   GGAGGTTTCG GGTTCGGTAA CACCCAAACC GCCGCCCTCG CCTTTGAAAA

1101   TCATCTCCAA ACCTTGCGCG ACTTGCGCTT CATCGCCGAA CTCTTGCAGT

1151   GGCTGCAACA CCAGCGCGCC TTCGATGCCG GTACGCAGCG TAACGGGCAC

1201   GCCGTAATGC CCCGCAATCC G
```

This corresponds to the amino acid sequence <SEQ ID 2060; ORF 642>:

```
m642.pep (partial)
      1   ACRRICPLPA ISAVQYIFAD VVQQEGCGVF VFRLYEDKES GDDFADKDFL

51   QGAGIGQGVF LQEAADVFRQ SVVAGDGGKA GIGLQAVEQG LVFVQLHACF
```

```
                              -continued
 101    FFFGGGADKL  VVNFGIKHIV  RAFKNREGAD  VDSDIAGGVS  AFKTLRTQEF

151    LQHLRGGVSV  FRGEGFDDVR  LHQLMGDGGN  RRNGMADVAV  KNLGNLMAAP

201    DFAAFVIDEF  DVVADVSFQI  FKDVFHNAVR  HADQLQAAAD  KDVLERAQTG

251    SVALGEFHHG  GCRHFGIDAV  DGVTDGAQAF  GCEGFAADVC  FGDEQQVDDF

301    GEFAVFALFG  GNEEEVALRV  ALPVFRGVDV  NGLSVDIFVV  GLHFACNRRA

351    GGFGFGNTQT  AALAFENHLQ  TLRDLRFIAE  LLQWLQHQRA  FDAGTQRNGH

401    AVMPRNP
``` m642/g642 90.4% identity in 407 aa overlap

```
                                   10         20         30
       m642.pep                    ACRRICPLPAISAVQYIFADVVQQEGCGVFVFRLYED
                                   ||||||||| ||||||||||||||||||||| ||||
       g642     MRYPPQSAVLQNAARCLLRRPKSACRRICPLSAISAVQYIFADVVQQEGCGVFVFLLYED
                         10        20        30        40        50        60

40         50         60         70         80         90
       m642.pep  KESGDDFADKDFLQGAGIGQGVFLQEAADVFRQSVVAGDGGKAGIGLQAVEQGLVFVQLH
                 |:|||||||: ||||||:||||||||||||||| |||||:|||| ||| |||||||||:
       g642      KKSGDDFADEDFLQGAGVGQGVFLQEAADVFGQSVVAGNGGKADIGLHGVEQGLVFVQLN
                        70        80        90       100       110       120

100        110        120        130        140        150
       m642.pep  ACFFFFGGGADKLVVNFGIKHIVRAFKNREGADVDSDIAGGVSAFKTLRTQEFLQHLRGG
                 |||||||||||:|||||||||||||||||||||:|:|||| ||||||||:||||||||||
       g642      ACFFFFGGGADELVVNFGIKHIVRAFKNREGADIDGDIAGWVSAFKTLRAQEFLQHLRGG
                       130       140       150       160       170       180

160        170        180        190        200        210
       m642.pep  VSVFRGEGFDDVRLHQLMGDGGNRRNGMADVAVKNLGNLMAAPDFAAFVIDEFDVVADVS
                 |||||||||||||||||||||| :|||||||||::|||||| ||||||||||:|:|:|:|
       g642      VSVFRGEGFDDVRLHQLMGDGRDGRNGMADVAVKDFGNLMAALDFAAFVIDESDIVADIS
                       190       200       210       220       230       240

220        230        240        250        260        270
       m642.pep  FQIFKDVFHNAVRHADQLQAAADKDVLERAQTGSVALGEFHHGGCRHFGIDAVDGVTDGA
                 |: |||||||||||||||||||||||||||||||| |||||||||||||||||||||||
       g642      VQVVKDVFHNAVRHADQLQAAADKDVLERAQTGSVAPGEFHHGGCRHFGIDAVDGVTDGA
                       250       260       270       280       290       300

280        290        300        310        320        330
       m642.pep  QAFGCEGFAADVCFGDEQQVDDFGEFAVFALFGGNEEEVALRVALPVFRGVDVNGLSVDI
                 ||||||||||||||||||||||||||||||||||||||||||:||||||||||||| | |
       g642      QAFGCEGFAADVCFGDEQQVDDFGEFAVFALFGGNEEEVALRIALPVFRGVDVNGLFVGI
                       310       320       330       340       350       360

340        350        360        370        380        390
       m642.pep  FVVGLHFACNRRAGGFGFGNTQTAALAFENHLQTLRDLRFIAELLQWLQHQRAFDAGTQR
                 ||:||||||||||||||||||:||||:|||||:|||:|||||||| ||||| ||||||||
       g642      FVAGLHFACNRRAGGFGFGNAQTAAFAFENHVQTLCDLRFAAELLQRLQHQRAFDAGTQR
                       370       380       390       400       410       420

400
       m642.pep  NGHAVMPRNP
                 ||||||||||
       g642      NGHAVMPRNPX
                       430
```

50

The following partial DNA sequence was identified in *N. meningitidis* <SEQ ID 2061>:

```
a642.seq (partial)
      1    GCCTGCCGCC  GTATTTGCCC  GCTATCCGCA  ATATCGGCAG  TCCAATATGT

51    CTTTGCGGAT  GTCGTTCAGC  AGGAAGGCTG  CGGTGTCTTC  GTGTTCCGCC

101    TGTACGAAGA  CAAAGAGTCG  GGCGATGATT  TTGCCGATAA  AGACTTTTTG

151    CAGGGCGCAG  GCATCGGTCA  GGGTGTGTTC  CTGCAGGAAG  CTGCGGATGT

201    CTTCGGGCAA  AGTGTAGTCG  CGGGCGACGG  CGGCAAAGCG  GGCATCGGTT

251    TGCAGGCGGT  CGAGCAGGGT  TTGGTTTTTG  TCCAACTTCA  TGCCTGCTTC

301    TTTTTCTTCG  GCGGTGGCGC  GGACAAACTG  GTCGTAAATT  TCGGCATAAA
```

```
-continued
 351   GCATATCGTT CGGGCCTTCA AAAATCGTGA AGGGGCGGAT GTCGATAGCG

401   ATATTGCCGG CGGTGTGTCC GCGTTCAAAA CCCTTCGCGC CAAGAGTTT

451   TTGCAACATT TGCGCGGCGG CGTAAGTGTA TTCCGTGGCG AGGGTTTTGA

501   CGATGTTCGC CTCCATCAGT TGATGGGCGA CGGGTGCAAC GGGCGAAACG

551   GAATGGCAGA CGTAGCGGTA AGAATCTCG GAAACCTGAT GGCGGCGCCG

601   GATTTCGCGG CGTTCGTAAT CGACGAATCT GATGTCGTTG CGGACGTATC

651   GTTCCAGGTT TTCAAGGGTG TATTCCATAA TGCCGTGCGT CATGCCGATC

701   AGTTGCAGGC GGCTGCGGAT AAAGATGTTT TGGAACGCGC GCAAACCGGC

751   AGCGTCGCTC TGGGAGAGTT TCATCACGGC GGTTGCAGGC ATTTCGGCAT

801   CGATGCGGTT GACGGCGTAA CGGACGGCGC GCAAGCCTTC GGATGCGAGG

851   GTTTCGCAGC GGATGTATGT TTTGGGGACG AGCAGCAGGT CGATGACTTT

901   GGCGAGTTTG CCGTTTTTGC GCTCTTTGGC GGCAACGAGG AGGAAGTCGC

951   TTTGCGAGTT GCCCTGCCAG TATTTCGCGG CGTTGACGTA AATGGTTTGT

1001   CCGTCGGTAT ATTCGTAGTA AGACTGCATT TCTCGGGCAA TCGCCGCGCC

1051   GGAGGTTTCG GGTTCGGTAA CGCCTAAACC GCCGCCCTCG CCTTTGAAAA

1101   CCATGTCCAA ACCCTGTGCG ATTTGCGCTT CATCGCCGAA CTCTTGCAGT

1151   GGCTGCAACA CCAGCGCGCC TTCGATGCCG GTACGCAGCG TAACGGGCAC

1201   GCCGTAATGC CCCGCAATCC G
```

This corresponds to the amino acid sequence <SEQ ID 2062;
ORF 642.a>:

```
a642.pep Length: 407
     1   ACRRICPLSA ISAVQYVFAD VVQQEGCGVF VFRLYEDKES GDDFADKDFL

51   QGAGIGQGVF LQEAADVFGQ SVVAGDGGKA GIGLQAVEQG LVFVQLHACF

101   FFFGGGADKL VVNFGIKHIV RAFKNREGAD VDSDIAGGVS AFKTLRAQEF

151   LQHLRGGVSV FRGEGFDDVR LHQLMGDGCN GRNGMADVAV KNLGNLMAAP

201   DFAAFVIDES DVVADVSFQV FKGVFHNAVR HADQLQAAAD KDVLERAQTG

251   SVALGEFHHG GCRHFGIDAV DGVTDGAQAF GCEGFAADVC FGDEQQVDDF

301   GEFAVFALFG GNEEEVALRV ALPVFRGVDV NGLSVGIFVV RLHFSGNRRA

351   GGFGFGNA*T AALAFENHVQ TLCDLRFIAE LLQWLQHQRA FDAGTQRNGH

401   AVMPRNP
``` m642/a642 95.8% identity in 407 aa overlap

```
                10         20         30         40         50         60
    m642.pep  ACRRICPLPAISAVQYIFADVVQQEGCGVFVFRLYEDKESGDDFADKDFLQGAGIGQGVF
              |||||||| |||||||:|||||||||||||||||||||||||||||||||||||||||||
        a642  ACRRICPLSAISAVQYVFADVVQQEGCGVFVFRLYEDKESGDDFADKDFLQGAGIGQGVF
                10         20         30         40         50         60

70         80         90        100        110        120
    m642.pep  LQEAADVFRQSVVAGDGGKAGIGLQAVEQGLVFVQLHACFFFFGGADKLVVNFGIKHIV
              ||||||| |||||||||||||||||||||||||||||||||||||||||||||||||||
        a642  LQEAADVFGQSVVAGDGGKAGIGLQAVEQGLVFVQLHACFFFFGGGADKLVVNFGIKHIV
                70         80         90        100        110        120

130        140        150        160        170        180
    m642.pep  RAFKNREGADVDSDIAGGVSAFKTLRTQEFLQHLRGGVSVFRGEGFDDVRLHQLMGDGGN
              ||||||||||||||||||||||||||:||||||||||||||||||||||||||||||| |
        a642  RAFKNREGADVDSDIAGGVSAFKTLRAQEFLQHLRGGVSVFRGEGFDDVRLHQLMGDGCN
               130        140        150        160        170        180
```

-continued

```
              190        200        210        220        230        240
m642.pep    RRNGMADVAVKNLGNLMAAPDFAAFVIDEFDVVADVSFQIFKDVFHNAVRHADQLQAAAD
            ||||||||||||||||||||||||||| ||||||||:|| ||||||||||||||||||||
a642        GRNGMADVAVKNLGNLMAAPDFAAFVIDESDVVADVSFQVFKGVFHNAVRHADQLQAAAD
              190        200        210        220        230        240

250        260        270        280        290        300
m642.pep    KDVLERAQTGSVALGEFHHGGCRHFGIDAVDGVTDGAQAFGCEGFAADVCFGDEQQVDDF
            ||||||||||||||||||||||||||||||||||||||||||||||||||||||||||||
a642        KDVLERAQTGSVALGEFHHGGCRHFGIDAVDGVTDGAQAFGCEGFAADVCFGDEQQVDDF
              250        260        270        280        290        300

310        320        330        340        350        360
m642.pep    GEFAVFALFGGNEEEVALRVALPVFRGVDVNGLSVDIFVVGLHFACNRRAGGFGFGNTQT
            |||||||||||||||||||||||||||||||||||| |||  |:|||||||||||||:|
a642        GEFAVFALFGGNEEEVALRVALPVFRGVDVNGLSVGIFVVRLHFSGNRRAGGFGFGNAXT
              310        320        330        340        350        360

370        380        390        400
m642.pep    AALAFENHLQTLRDLRFIAELLQWLQHQRAFDAGTQRNGHAVMPRNP
            ||||||||:||| |||||||||||||||||||||||||||||||||
a642        AALAFENHVQTLCDLRFIAELLQWLQHQRAFDAGTQRNGHAVMPRNP
              370        380        390        400
```

The following partial DNA sequence was identified in *N. gonorrhoeae* <SEQ ID 2063>:

```
g643.seq
     1    ATGGTGTTGC CTTTGATGTT GTTGGCGACA ATCAGgTcgg CTACGCTGAc 51    gttgtancGt TTGGcaATGt tGaaCAgggt gtcgccTTCT ACAACGCGGT 101    GGATGCTGGC ATGGagcGGG GAGGTTTCGG CTTCGCCGTC GGCAGCTTTG 151    GCTACGCGCG TTTCCAAACG TGCCCGGCGT TtgCCGTCGG CGGCAACGGT

201    ATGTTGCGGA GATGAGGAAA TGTTGTGTTC GGCAACTGTG TCAGGCGTGC

251    CGATGACGGC GGagaTGGTT TCTTCAGCCT GCCGGCGCag gTTGTTTCGG

301    GCAACAAGCT GCATGAGTTC GTCTGCCGCC TGCATGTCGT TTGGGGGAt

351    GACCTGCGCg aGTGtTGCGG TTTGGGTTTC agacgGCATG GCAGTCTGTT

401    TTTcggTTTG a
```

This corresponds to the amino acid sequence <SEQ ID 2064; ORF 643>:

```
g643.pep
     1    MVLPLMLLAT IRSATLTLXR LAMLNRVSPS TTRWMLAWSG EVSASPSAAL

51    ATRVSKRARR LPSAATVCCG DEEMLCSATV SGVPMTAEMV SSACRRRLFR

101    ATSCMSSSAA CMSFGGMTCA SVAVWVSDGM AVCFSV*
```

The following partial DNA sequence was identified in *N. meningitidis* <SEQ ID 2065>:

```
m643.seq
     1    ATGGTGTTGC CTTTGATGTT GTTGGCGACA ATCAGGTCGG CTACACTGAC

51    GTTGTAGCGT TTGGCAATGT TGAACAGGGT GTCGCCTTCT ACAACGCGGT

101    GGATGCTGGC ATGGAGCGGG GAGATTTCGG CTTCGCCGTC GGCAGCTTTG

151    GCTACGCGCG TTTCCAAACG TACCCGGCGT TTGCCGTCGG CGGCAGCGGT

201    ATGTTGCGGA GATGCGGAAA TTTTGTGTTC GGCAACTGTG TCAGGCGTGC

251    CGATGACGGC GGAGATGGTT TCTTCAGCCT GTCGGCGCAG GTTGTTTCGG

301    GCAACAAGCT GCATGAGTTC GTCTGCCGCC TGCATGTCGT TTGGGGGAT
```

```
351  GATCTGCGCG AGTGTTGCGG TTTGGGTTTC AGACGGCATG GCGGTCTGTT

401  TTTCGGTTTG A
```

This corresponds to the amino acid sequence <SEQ ID 2066; ORF 643>:

```
m643.pep
  1  MVLPLMLLAT IRSATLTL*R LAMLNRVSPS TTRWMLAWSG EISASPSAAL

51  ATRVSKRTRR LPSAAAVCCG DAEILCSATV SGVPMTAEMV SSACRRRLFR

101  ATSCMSSSAA CMSFWGMICA SVAVWVSDGM AVCFSV*
```

Computer analysis of the amino acid sequences gave the following results:
Homology with a Predicted ORF from *N. meningitidis* menA with menB
ORF 643 shows 94.9% identity over a 136 aa overlap with a predicted ORF (ORF643.a) from *N. gonorrhoeae*:

```
m643/g643
                   10         20         30         40         50         60
m643.pep  MVLPLMLLATIRSATLTLXRLAMLNRVSPSTTRWMLAWSGEISASPSAALATRVSKRTRR
          ||||||||||||||||||||||||||||||||||||||||:||||||||||||||||:||
g643      MVLPLMLLATIRSATLTLXRLAMLNRVSPSTTRWMLAWSGEVSASPSAALATRVSKRARR
                   10         20         30         40         50         60
                   70         80         90        100        110        120
m643.pep  LPSAAAVCCGDAEILCSATVSGVPMTAEMVSSACRRRLFRATSCMSSSAACMSFWGMICA
          |||||:||||| :|||||||||||||||||||||||||||||:||||||||||||| ||
g643      LPSAATVCCGDEEMLCSATVSGVPMTAEMVSSACRRRLFRATSCMSSSAACMSFGGMTCA
                   70         80         90        100        110        120
                  130
m643.pep  SVAVWVSDGMAVCFSVX
          |||||||||||||||||
g643      SVAVWVSDGMAVCFSVX
                  130
```

The following partial DNA sequence was identified in *N. meningitidis* <SEQ ID 2067>:

```
a643.seq
  1  ATGGTGTTGC CTTTGATGTT GTTGGCGACA ATCAGGTCGG CTACACTGAC

51  GTTGTAGCGT TTGGCAATGT TGAACAGGGT GTCGCCTTCT ACAACGCGGT

101  GGATGCTGGC ATGGAGCGGG GAGATTTCGG CTTCGCCGTC GGCAGCTTTG

151  GCTACGCGCG TTTCCAAACG TACCCGGCGT TTGCCGTCGG CGGCAACGGT

201  ATGTTGCGGA GATGAGGAAA TGTTGTGTTC GGCAACTGTG TCAGGCGTGC

251  CGATGACGGC AGAGATGGTT TCTTCAGCCT GTCGGCGCAG GTTGTTTCGG

301  GCAACAAGCT GCATGAGTTC GTCTGCCGCC TGCATGTCGT TTTGGGGGAC

351  GATCTGCGCG AGTGTTGCGG TTTGGGTTTC AGACGGCATG GCGGTCTGTT

401  TTTCGGTTTG A
```

This corresponds to the amino acid sequence <SEQ ID 2068; ORF 643.a>:

```
a643.pep
  1  MVLPLMLLAT IRSATLTL*R LAMLNRVSPS TTRWMLAWSG EISASPSAAL

51  ATRVSKRTRR LPSAATVCCG DEEMLCSATV SGVPMTAEMV SSACRRRLFR

101  ATSCMSSSAA CMSFWGTICA SVAVWVSDGM AVCFSV*
``` m643/a643 97.1% identity in 136 aa overlap

```
                  10        20        30        40        50        60
 m643.pep  MVLPLMLLATIRSATLTLXRLAMLNRVSPSTTRWMLAWSGEISASPSAALATRVSKRTRR
           ||||||||||||||||||||||||||||||||||||||||||||||||||||||||||||
 a643      MVLPLMLLATIRSATLTLXRLAMLNRVSPSTTRWMLAWSGEISASPSAALATRVSKRTRR
                  10        20        30        40        50        60

70        80        90       100       110       120
 m643.pep  LPSAAAVCCGDAEILCSATVSGVPMTAEMVSSACRRRLFRATSCMSSSAACMSFWGMICA
           |||||:||||| |:||||||||||||||||||||||||||||||||||||||||| |||
 a643      LPSAATVCCGDEEMLCSATVSGVPMTAEMVSSACRRRLFRATSCMSSSAACMSFWGTICA
                  70        80        90       100       110       120

130
 m643.pep  SVAVWVSDGMAVCFSVX
           |||||||||||||||||
 a643      SVAVWVSDGMAVCFSVX
                 130
```

The following partial DNA sequence was identified in *N. gonorrhoeae* <SEQ ID 2069>:

```
g644.seq
    1  ATGCCGTCTG AAAGGccgGC GGATTGTTGC CCGGTGCACT TTGTGGTAAA
   51  GTTTAGAAAA TTAACTCTAA ACTGTGGCAG GCGGTTTGAC CGGCCGCCGA
  101  TTAATGGGAA CCGACAGAGG AAGCCGATGA TACACACCGA ACCGAGCGCG
  151  CAGCCGTCAA CCATGGACAC GGCTGCTTTT TTAAagcaca tcgaatCCGC
  201  ATTcCCCCGC ATTTTTTCAG ACGGCATCGA CCTGATGCGA TACCTGCCCG
  251  AAGACAAATG GCTTGCCTTG AAGCAGGCGG GTTTGCTGTT GCCCTTCCTC
  301  GACAAAAAAC ACGGCGGGCG CAAGGGCAGT CAGTTTGAAA TCCAAGAAGT
  351  CCTAAGGATT GCGGGGCATT ACGGCGTGCC CGTTACGCTG CGTACCGGCA
  401  TCGAAGGCGC GCTGGTGTTG CAGCCTCTGC AAGagttcgg cggcgaagcG
  451  CAAGTCGCAC AAGGTTTGGA CATGATTTTC AAaggcgaaa gccgccgttt
  501  gggcgTtacc gaacccgaAa cctccggcgc gGcgaTTGCA CGCGAAAtgc
  551  agtcctgcta cgaatatacc gacgaacaAA CCATTTACGT caaCGCCGCG
  601  AAATACTGGC AGGGCAATTC GCAAAGCGAC TTCCTcctcg ttgccgccaa
  651  agagcgcaaa aacGGcaaac tcgccaaagt CATCGACCTG CTGCTCGTCC
  701  CCAAAACATA CATCCGCTGC GAAACCCTCG CATCCGAAGG CCTGCGCGCC
  751  GTCCGTTACG CCGTCAACCG CATCGATGCC GAAATGCCTG CAACCGCCGT
  801  GATGAAACTC TCCCGGGGCG ACGCTGCCGG TTTGCGCGCG TTCCAAAACA
  851  TCTTTATCCG CAGCCGCCTG CAACTGATCG GCATGACGCA CGGCATTATG
  901  GAATACATCC TTGACAACCT GAACCGATAT GTCCGCAACG ATATCAGATT
  951  CGTCGATTAC GAACGCCGCG AAATCCAACG CCGCCATCAG GTTTCCGAAA
 1001  TCCTTTACCG CTACGTCTGC CATTCCGTTT CGcccgtcgC GCccgTCGCC
 1051  CATCAATTGA TGGAGGCGAA catcgTCAAA ACcctCGCCA CGGAATACAC
 1101  TTAcgcCGCC GCGCAAATGT TGCAAAAACT CTTGGGCGCG AAGGGTTTTG
 1151  AACGCGGACA CCCAGCCGGC AATATCGCCA TCGATATCCG CCCCTTCACG
 1201  ATTTTTGAAG GCCCGAACGA TATGCTTTAT GCCGAAATTT ACGACCAGTT
 1251  CGTCCGCGCC ACCGCCGAAG AAAAAGAAGC AGGCATTAAG TTGGACAAAA
 1301  accaaaCCCT Gctcgacgcc gtgCAAaccg atGTCcgctt tgCCGCCGTT
 1351  GCCcgcGacT ACGCTTTGCC CGAAGACATC CGCAGCTTCC TGCAGGAACA
```

-continued

```
1401   CACCCTGACC GACGCCTGCG CCCTGCAAAA AGTCTTCATC GGCAAAATCA

1451   TCGCCCGACT TTTTGTCTTC GTACAGGAGG AACACGAAGA CACCACAGCC

1501   TTCCTGCTGA ACGACATCCG CAAAGATATA TTGGACTGCC GATATTGCGG

1551   ATAG
```

This corresponds to the amino acid sequence <SEQ ID 2070; ORF 644.ng>:

```
g644.pep
     1   MPSERPADCC PVHFVVKFRK LTLNCGRRFD RPPINGNRQR KPMIHTEPSA

51   QPSTMDTAAF LKHIESAFPR IFSDGIDLMR YLPEDKWLAL KQAGLLLPFL

101   DKKHGGRKGS QFEIQEVLRI AGHYGVPVTL RTGIEGALVL QPLQEFGGEA

151   QVAQGLDMIF KGESRRLGVT EPETSGAAIA REMQSCYEYT DEQTIYVNAA

201   KYWQGNSQSD FLLVAAKERK NGKLAKVIDL LLVPKTYIRC ETLASEGLRA

251   VRYAVNRIDA EMPATAVMKL SRGDAAGLRA FQNIFIRSRL QLIGMTHGIM

301   EYILDNLNRY VRNDIRFVDY ERREIQRRHQ VSEILYRYVC HSVSPVAPVA

351   HQLMEANIVK TLATEYTYAA AQMLQKLLGA KGFERGHPAG NIAIDIRPFT

401   IFEGPNDMLY AEIYDQFVRA TAEEKEAGIK LDKNQTLLDA VQTDVRFAAV

451   ARDYALPEDI RSFLQEHTLT DACALQKVFI GKIIARLFVF VQEEHEDTTA

501   FLLNDIRKDI LDCRYCG*
```

The following partial DNA sequence was identified in *N. meningitidis* <SEQ ID 2071>:

```
m644.seq
     1   ATGCCGTCTG AAAGGTCGGC GGATTGTTGC CCGGCGCACT TTGTGGTAAA

51   GTTTAGAAAA TCAACTCTAA ACTGTGGCAG GCGGTTTGAC CGGCCGCCGA

101   TTAATGGGAA CCGACAGAGG AAGCCGATGA TACACACCGA ACCGAGCGCG

151   CAGCCGTCAA CTATGGACAC GGCTGCTTTT TTAAAGCACA TCGAATCCGC

201   ATTCCGCCGC ATTTTTTCAG ACGGTATCGA CCTGATGCGA TACCTGCCCG

251   AAGACAAATG GCTTGCCTTG AAGCAGGCGG GTTTGCTGTT GCCCTTCCTC

301   GACAAAAAAT ACGGCGGGCG CAAGGGCAGC CAGTTTGAAA TCCAAGAAGT

351   CcTGCGGATT GCGGGGCATT ACGGCGTGCC CGTTACGCTG CGTACCGGCA

401   TCGAAGGCGC GCTGGTGTTG CAGCCACTGC AAGAGTTCGG CGATGAAGCG

451   CAAGTCGCGC AAGGTTTGGA GATGATTTTC AAAGGCGAGG GCGGCGGTTT

501   GGGTGTTACC GAACCCGAAA CCTCCGGCGC GGCGATTGCA CGCGAAATGC

551   AGTCCTACTA CGAATATATC GACGGACAAA CCATTTACGT CAACGCCGCG

601   AAATACTGGC AGGGCAACTC GCAAAGCGAC TTCCTCCTCG TTGCCGCCAA

651   AGAGCGCAAA AACGGCAAAC TCGCCAAAGT CATCGACCTG CTGCTCGTCC

701   CCAAAACATA CATCCGCTGC GAAACCCTCG CATCCGAAGG CTTGCGCGCC

751   GTCCGTTACG CCGTCAACCG CATCGATGCC GAAATGCCTG CAACCGCCGT

801   GATGAAACTC TCCCAGAGCG ACGCTGCCGG TTTGCGCGCG TTCCAAAACA

851   TCTTTATCCG CAGCCGCCTG CAACTGATCG GCATGACGCA CGGCATTATG

901   GAATACATCC TTGAAAATCT GGAACGATAC GTCCGCAACG ACATCAAATT
```

-continued

```
 951  CGTCGATTAC GAACGCCGCG AAATCCGGCG CCGCCATCAG GTTTCCGAGA
1001  TTCTTTACCG CTACGTCTGC CATTCCGTTT CGCCTGTTGC CCCCGTCGCC
1051  CATCAGCTGA TGGAGGCGAA CATCGTCAAA ACCCTCGCCA CGGAATACAC
1101  TTACGCCGCC GCGCAAATGT TGCAAAAACT CTTGGGTGCG AAGGGTTTTG
1151  AACGCGGACA CACCGCCGGC AATATCGCTA TCGACATCCG CCCCTTCACG
1201  ATTTTTGAAG GCCCGAACGA TATGCTTTAT GCCGAAATTT ACGACCAGTT
1251  TGTCCGCGCC ACCGCCGAAG AAAAAGAAGC AGGCATGAAG TTGGACAAAA
1301  ACCAAACCCT GCTCGACCGC CTGCAAACCG ATGCCCGCTT TGCCGCCGTC
1351  GCCCGCGACT ACACTTTGCC TGAAGACATC CGCAGCTTCC TGCAGGAACA
1401  CACCCTGACC GATGCCTGCG CCCTGCAAAA AGTCTTTATC GGCAAAATCA
1451  TCGCCCGACT CTTTGTCTTC GTACAGGCGA AACACGAAGA CACCGCAGCC
1501  TTCCTGCTGA ACGACATCCG CAAAGATATA TTGGACTGCC GATATTGCGG
1551  GTAG
```

This corresponds to the amino acid sequence <SEQ ID 2072; ORF 644>:

```
m644.pep
    1  MPSERSADCC PAHFVVKFRK STLNCGRRFD RPPINGNRQR KPMIHTEPSA

51  QPSTMDTAAF LKHIESAFRR IFSDGIDLMR YLPEDKWLAL KQAGLLLPFL

101  DKKYGGRKGS QFEIQEVLRI AGHYGVPVTL RTGIEGALVL QPLQEFGDEA

151  QVAQGLEMIF KGEGGGLGVT EPETSGAAIA REMQSYYEYI DGQTIYVNAA

201  KYWQGNSQSD FLLVAAKERK NGKLAKVIDL LLVPKTYIRC ETLASEGLRA

251  VRYAVNRIDA EMPATAVMKL SQSDAAGLRA FQNIFIRSRL QLIGMTHGIM

301  EYILENLERY VRNDIKFVDY ERREIRRRHQ VSEILYRYVC HSVSPVAPVA

351  HQLMEANIVK TLATEYTYAA AQMLQKLLGA KGFERGHTAG NIAIDIRPFT

401  IFEGPNDMLY AEIYDQFVRA TAEEKEAGMK LDKNQTLLDR LQTDARFAAV

451  ARDYTLPEDI RSFLQEHTLT DACALQKVFI GKIIARLFVF VQAKHEDTAA

501  FLLNDIRKDI LDCRYCG*
``` m644/g644 94.6% identity in 517 aa overlap

```
                 10         20         30         40         50         60
m644.pep  MPSERSADCCPAHFVVKFRKSTLNCGRRFDRPPINGNRQRKPMIHTEPSAQPSTMDTAAF
          |||||  |||| ||||||||| |||||||||||||||||||||||||||||||||||||
g644      MPSERPADCCPVHFVVKFRKLTLNCGRRFDRPPINGNRQRKPMIHTEPSAQPSTMDTAAF
                 10         20         30         40         50         60

70         80         90        100        110        120
m644.pep  LKHIESAFRRIFSDGIDLMRYLPEDKWLALKQAGLLLPFLDKKYGGRKGSQFEIQEVLRI
          |||||||| |||||||||||||||||||||||||||||||||||| |||||||||||||
g644      LKHIESAFPRIFSDGIDLMRYLPEDKWLALKQAGLLLPFLDKKHGGRKGSQFEIQEVLRI
                 70         80         90        100        110        120

130        140        150        160        170        180
m644.pep  AGHYGVPVTLRTGIEGALVLQPLQEFGDEAQVAQGLEMIFKGEGGGLGVTEPETSGAAIA
          |||||||||||||||||||||||||||| ||||||| ||||||:|||:  |||||||||
g644      AGHYGVPVTLRTGIEGALVLQPLQEFGGEAQVAQGLDMIFKGESRRLGVTEPETSGAAIA
                130        140        150        160        170        180

190        200        210        220        230        240
m644.pep  REMQSYYEYIDGQTIYVNAAKYWQGNSQSDFLLVAAKERKNGKLAKVIDLLLVPKTYIRC
          ||||| ||| | |||||||||||||||||||||||||||||||||||||||||||||||
g644      REMQSCYEYTDEQTIYVNAAKYWQGNSQSDFLLVAAKERKNGKLAKVIDLLLVPKTYIRC
                190        200        210        220        230        240
```

-continued

```
                250       260       270       280       290       300
m644.pep  ETLASEGLRAVRYAVNRIDAEMPATAVMKLSQSDAAGLRAFQNIFIRSRLQLIGMTHGIM
          |||||||||||||||||||||||||||||||::|||||||||||||||||||||||||||
g644      ETLASEGLRAVRYAVNRIDAEMPATAVMKLSRGDAAGLRAFQNIFIRSRLQLIGMTHGIM
                250       260       270       280       290       300

310       320       330       340       350       360
m644.pep  EYILENLERYVRNDIKFVDYERREIRRHQVSEILYRYVCHSVSPVAPVAHQLMEANIVK
          ||||:||:|||||||:||||||||||:|||||||||||||||||||||||||||||||||
g644      EYILDNLNRYVRNDIRFVDYERREIQRHQVSEILYRYVCHSVSPVAPVAHQLMEANIVK
                310       320       330       340       350       360

370       380       390       400       410       420
m644.pep  TLATEYTYAAAQMLQKLLGAKGFERGHTAGNIAIDIRPFTIFEGPNDMLYAEIYDQFVRA
          ||||||||||||||||||||||||||| ||||||||||||||||||||||||||||||||
g644      TLATEYTYAAAQMLQKLLGAKGFERGHPAGNIAIDIRPFTIFEGPNDMLYAEIYDQFVRA
                370       380       390       400       410       420

430       440       450       460       470       480
m644.pep  TAEEKEAGMKLDKNQTLLDRLQTDARFAAVARDYTLPEDIRSFLQEHTLTDACALQKVFI
          ||||||||:|||||||||| :|||:|||||||||:|||||||||||||||||||||||||
g644      TAEEKEAGIKLDKNQTLLDAVQTDVRFAAVARDYALPEDIRSFLQEHTLTDACALQKVFI
                430       440       450       460       470       480

490       500       510
m644.pep  GKIIARLFVFVQAKHEDTAAFLLNDIRKDILDCRYCGX
          |||||||||||| :||||:|||||||||||||||||||
g644      GKIIARLFVFVQEEHEDTTAFLLNDIRKDILDCRYCGX
                490       500       510
```

The following partial DNA sequence was identified in *N. meningitidis* <SEQ ID 2073>:

```
a644.seq
     1  ATGCCGTCTG AAAGGTCGGC GGATTGTTGC CCGGCGCACT TTGTGGTAAA

51  GTTTAGAAAA TCAACTCTAA ACTGTGGCAG GCGGTTTGAC CGGCCGCCGA

101  TTAATGGGAA CCGACAGAGG AAGCCGATGA TACACACCGA ACCGAGCGCG

151  CAGCCGTCAA CTATGGACAC GGCTGCTTTT TTAAAGCACA TCGAATCCGC

201  ATTCCGCCGC ATTTTTGCAG ACGGTATCGA CCTGATGCGA TACCTGCCCG

251  AAGACAAATG GCTTGCCTTG AAGCAGGCGG GTTTGCTGTT GCCCTTCCTC

301  GACAAAAAAT ACGGCGGGCG CAAGGGCAGC CAGTTTGAAA TTCAGGAAGT

351  CTTGCGGATT GCGGGGCATT ACGGCGTGCC CGTTANNNNN NNNNNNNNNN

401  NNGAAGGCGC GCTGGTGTTG CAGCCACTGC AAGAGTTCGG CGATGAAGCG

451  CAAATCGCAC AGGGTTTGGA CATGGTTTTC AAAGGCGAGG GCGGCGGTTT

501  AGGCGTTACC GAACCCGAAA CCTCCGGCGC GGCGATTGCC CGAGAAATGC

551  AGTCTTACTA CGAATATACC GACGGACAAA CCATTTACGT CAACGCCGCG

601  AAATACTGGC AGGGCAACTC GCAAAGCGAC TTCCTCCTCG TTGCCGCCAA

651  AGAGCGCAAA AACGGCAAAC TCGCCAAAGT CATCGACCTG CTGCTCGTCC

701  CCAAAACATA CATCCGCTGC GAAACCCTCG CATCCGAAGG CTTGCGCGCC

751  GTCCGTTACG CCGTCAACCG CATCGATGCC GAAATGCCTG CAACCGCCGT

801  GATGAAACTC TCCCAGAGCG ACGCTGCCGG TTTGCGCGCG TTCCAAAACA

851  TCTTTATCCG CAGCCGCCTG CAACTGATCG GCATGACGCA CGGCATTATG

901  GAATACACCC TTGAAAACCT GGAACGATAC GTCCGCAACG ACATCAGATT

951  CGTCGATTAC GAACGCCGCG AAATCCGGCG CCGCCATCAG GTTTCCGAGA

1001  TTCTTTACCG CTACGTCTGC CATTCCGTTT CGCCCGTTGC ACCCGTCGCC

1051  CATCAACTGA TGGAGGCGAA CATCGTCAAA ACCCTCGCCA CGGAATACAC

1101  TTACGCCGCC GCGCAAATGT TGCAAAAACT CTTGGGCGCG AAGGGTTTTG

1151  AACGCGGACA CACCGCCGGC AATATCGCTA TCGACATCCG CCCCTTCACG
```

```
-continued
1201  ATTTTTGAAG GCCCGAACGA TATGCTTTAT GCCGAAATTT ACGACCAGTT

1251  TGTCCGCGCC ACCGCCGAAG AAAAAGAAGC AGGCATGAAG TTGGACAAAA

1301  ACCAAACCCT GCTCGACCGC CTGCAAACCG ATGCCCGCTT TGCCGCCGTC

1351  GCCCGCGACT ACACTTTGCC CGAAGACATC CGCAGCTTCC TGCAGGAACA

1401  CACCCTGACC GATGCCTGCG CCCTGCAAAA AGTCTTTATC GGCAAAATCA

1451  TCGCCCGACT CTTTGTCTTC GTACAGGCGG AACACGAAGA CACCGCAGCC

1501  TTCCTGCTGA ACGACATCCG CAAAGACATA TTGGACTGCC GATATTGCGG

1551  ATAG
```

This corresponds to the amino acid sequence <SEQ ID 2074; ORF 644.a>:

```
a644.pep
   1  MPSERSADCC PAHFVVKFRK STLNCGRRFD RPPINGNRQR KPMIHTEPSA

51  QPSTMDTAAF LKHIESAFRR IFADGIDLMR YLPEDKWLAL KQAGLLLPFL

101  DKKYGGRKGS QFEIQEVLRI AGHYGVPVXX XXXXEGALVL QPLQEFGDEA

151  QIAQGLDMVF KGEGGGLGVT EPETSGAAIA REMQSYYEYT DGQTIYVNAA

201  KYWQGNSQSD FLLVAAKERK NGKLAKVIDL LLVPKTYIRC ETLASEGLRA

251  VRYAVNRIDA EMPATAVMKL SQSDAAGLRA FQNIFIRSRL QLIGMTHGIM

301  EYTLENLERY VRNDIRFVDY ERREIRRRHQ VSEILYRYVC HSVSPVAPVA

351  HQLMEANIVK TLATEYTYAA AQMLQKLLGA KGFERGHTAG NIAIDIRPFT

401  IFEGPNDMLY AEIYDQFVRA TAEEKEAGMK LDKNQTLLDR LQTDARFAAV

451  ARDYTLPEDI RSFLQEHTLT DACALQKVFI GKIIARLFVF VQAEHEDTAA

501  FLLNDIRKDI LDCRYCG*
``` m644/a644 97.3% identity in 517 aa overlap

```
                    10         20         30         40         50         60
m644.pep  MPSERSADCCPAHFVVKFRKSTLNCGRRFDRPPINGNRQRKPMIHTEPSAQPSTMDTAAF
          ||||||||||||||||||||||||||||||||||||||||||||||||||||||||||||
a644      MPSERSADCCPAHFVVKFRKSTLNCGRRFDRPPINGNRQRKPMIHTEPSAQPSTMDTAAF
                    10         20         30         40         50         60

70         80         90        100        110        120
m644.pep  LKHIESAFRRIFSDGIDLMRYLPEDKWLALKQAGLLLPFLDKKYGGRKGSQFEIQEVLRI
          ||||||||||||:|||||||||||||||||||||||||||||||||||||||||||||||
a644      LKHIESAFRRIFADGIDLMRYLPEDKWLALKQAGLLLPFLDKKYGGRKGSQFEIQEVLRI
                    70         80         90        100        110        120

130        140        150        160        170        180
m644.pep  AGHYGVPVTLRTGIEGALVLQPLQEFGDEAQVAQGLEMIFKGEGGGLGVTEPETSGAAIA
          ||||||||:  :||||||||||||||||||:||||:|:||||||||||||||||||||||
a644      AGHYGVPVXXXXXXXEGALVLQPLQEFGDEAQIAQGLDMVFKGEGGGLGVTEPETSGAAIA
                   130        140        150        160        170        180

190        200        210        220        230        240
m644.pep  REMQSYYEYIDGQTIYVNAAKYWQGNSQSDFLLVAAKERKNGKLAKVIDLLLVPKTYIRC
          |||||||||  |||||||||||||||||||||||||||||||||||||||||||||||||
a644      REMQSYYEYTDGQTIYVNAAKYWQGNSQSDFLLVAAKERKNGKLAKVIDLLLVPKTYIRC
                   190        200        210        220        230        240

250        260        270        280        290        300
m644.pep  ETLASEGLRAVRYAVNRIDAEMPATAVMKLSQSDAAGLRAFQNIFIRSRLQLIGMTHGIM
          ||||||||||||||||||||||||||||||||||||||||||||||||||||||||||||
a644      ETLASEGLRAVRYAVNRIDAEMPATAVMKLSQSDAAGLRAFQNIFIRSRLQLIGMTHGIM
                   250        260        270        280        290        300

310        320        330        340        350        360
m644.pep  EYILENLERYVRNDIKFVDYERREIRRRHQVSEILYRYVCHSVSPVAPVAHQLMEANIVK
          ||:|||||||||||:|||||||||||||||||||||||||||||||||||||||||||||
a644      EYTLENLERYVRNDIRFVDYERREIRRRHQVSEILYRYVCHSVSPVAPVAHQLMEANIVK
                   310        320        330        340        350        360
```

```
                370        380        390        400        410        420
m644.pep    TLATEYTYAAAQMLQKLLGAKGFERGHTAGNIAIDIRPFTIFEGPNDMLYAEIYDQFVRA
            ||||||||||||||||||||||||||||||||||||||||||||||||||||||||||||
a644        TLATEYTYAAAQMLQKLLGAKGFERGHTAGNIAIDIRPFTIFEGPNDMLYAEIYDQFVRA
                370        380        390        400        410        420

430        440        450        460        470        480
m644.pep    TAEEKEAGMKLDKNQTLLDRLQTDARFAAVARDYTLPEDIRSFLQEHTLTDACALQKVFI
            ||||||||||||||||||||||||||||||||||||||||||||||||||||||||||||
a644        TAEEKEAGMKLDKNQTLLDRLQTDARFAAVARDYTLPEDIRSFLQEHTLTDACALQKVFI
                430        440        450        460        470        480

490        500        510
m644.pep    GKIIARLFVFVQAKHEDTAAFLLNDIRKDILDCRYCGX
            |||||||||||||:||||||||||||||||||||||||
a644        GKIIARLFVFVQAEHEDTAAFLLNDIRKDILDCRYCGX
                490        500        510
```

The following partial DNA sequence was identified in *N. gonorrhoeae* <SEQ ID 2075>:

```
g645.seq
    1  ATGATGATGG TGTTGGCGTT GGGGATGTCG ATGCCGGTTT CGATGATGGT

51  GGAACAGAGC AACACATTGA ATCTTTGCTG CAAAAAGTCG CGCATGACTT

101  GTTCCAGCTC GCGCTCACGC AGTTGTCCGT GCGCCACGCC GATACGGGCT

151  TCGGGCAGCA GGGTTTCCAG CCGCTCGCGC ATATTCTCAA TCGTATCTAC

201  TTCATTGTGC AGGAAAAata cCTGTCCTCC GCGTTTGAGT TCGCGCAACA

251  CGGCTTCGCG CACGCTGCCT TCGCTGAACG GTTTGACAAA GGTTTTCACG

301  GCGAGGCGGC GGCTCGGTGC AGTGGTAATC AGCGAGAAGT CGCGCAGACC

351  TTCGAGCGCC ATGCTGAGGG TGCGCGGAAT CGGCGTGGCG GTCATGGTTA

401  GGATGTCGAC ATTGGCGCGC AGGCGTTTGA GCTGCTCTTT CTGTCGCACG

451  CCGAAGCGGT GTTCTTCATC GATAATCAAT AAACCTAAGT TTTTGAATTT

501  TATGTCGTCC TGCACCAATT TGTGCGTACC GATAACGATA TCGACAGTAC

551  CGTCCGCCAT GCCTTCGAGC GTGGCTTTGG TGGCTTTGCT GTTGTTGAAA

601  CGCGAAAGGC TGGCGACTTT CACGGGGAAA TCGGCGAAAC GGTCGGCGAA

651  GTTTTGCGCG TGCTGCTCGA CCAGAAGCGT GGTCGGGGCG AGTACGGCGA

701  CCTGTTTGCC GCCCATCACC GCCACAAACG CGGCGCGAAG GGCGACTTCG

751  GTTTTGCCGA AACCGACATC GCCGCACACA AGTCGGTCCA TCGGCTTCGC

801  CTGCGTCAAA TCTTTAATCA CGGcggcgat ggcggcggcC TGGTCTTCGG

851  TTTCCTCGTA G
```

This corresponds to the amino acid sequence <SEQ ID 2076; ORF 645.ng>:

```
g645.pep
    1  MMMVLALGMS MPVSMMVEQS NTLNLCCKKS RMTCSSSRSR SCPCATPIRA

51  SGSRVSSRSR IFSIVSTSLC RKNTCPPRLS SRNTASRTLP SLNGLTKVFT

101  ARRRLGAVVI SEKSRRPSSA MLRVRGIGVA VMVRMSTLAR RRLSCSFCRT

151  PKRCSSSIIN KPKFLNFMSS CTNLCVPITI STVPSAMPSS VALVALLLLK

201  RERLATFTGK SAKRSAKFCA CCSTRSVVGA STATCLPPIT ATNAARRATS

251  VLPKPTSPHT SRSIGFACVK SLITAAMAAA WSSVSS*
```

The following partial DNA sequence was identified in *N. meningitidis* <SEQ ID 2077>:

```
m645.seq
    1   ATGATGATGG TGTTGGCGTT GGGGATATCG ATACCGGTTT CGATGATGGT

51   GGAACAGAGC AACACGTTAA ATCGTTGCTG CAAAAAGTCG CGCATGACTT

101   GTTCCAGCTC GCGCTCGCGC AGTTGTCCGT GCGCCACGCC GATGCGGGCT

151   TCGGGCAGCA GGGTTTCCAG CCGCTCGCGC ATATTTTCAA TCGTATCTAC

201   TTCATTGTGC AGGAAAAATA CCTGTCCTCC GCGTTTGAGT CGCGCAACA

251   CGGCTTCGCG CACGCTGCCT TCGCTAAAGG GTTTGACAAA GGTTTTGACG

301   GCGAGGCGGC GGCTGGGCGC GGTGGTAATC AGCGAGAAGT CGCGCAGTCC

351   TTCCAACGCC ATACTTAAAG TACGCGGAAT CGGCGTGGCG GTCATGGTAA

401   GGATATCAAC ATTGGCGCGC AGGCGTTTGA GCTGCTCTTT CTGACGCACG

451   CCGAAGCGGT GTTCTTCGTC GATAATCACT AAACCTAAGT TTTTGAATTT

501   GATGTCGTCC TGCACCAGTT TGTGCGTACC GATAACAATA TCGACCGTGC

551   CGTCTGCCAT GCCTTCCAGC GCGGCTTTGG TGGCTTTGCT GTTGTTGAAA

601   CGCGAAAGGC TGGCGACTTT CACGGGGAAA TCGGCGAAAC GGTCGGCGAA

651   GTTTTGCGCG TGCTGCTCGA CCAAAAGCGT GGTCGGAGCA AGTACGGCGA

701   CCTGTTTGCC GCCCATCACC GCCACAAACG CGGCGCGCAG GGCGACTTCG

751   GTTTTGCCGA AGCCGACATC GCCGCACACA AGGCGATCCA TCGGCTTCGC

801   TTGCGTCAAA TCTTTAATCA CGGCGGCGAT GGCGGCGGCC TGGTCTTCGG

851   TTTCCTCGTA G
```

This corresponds to the amino acid sequence <SEQ ID 2078; ORF 645>:

```
m645.pep
    1   MMMVLALGIS IPVSMMVEQS NTLNRCCKKS RMTCSSSRSR SCPCATPMRA

51   SGSRVSSRSR IFSIVSTSLC RKNTCPPRLS SRNTASRTLP SLKGLTKVLT

101   ARRRLGAVVI SEKSRSPSNA ILKVRGIGVA VMVRISTLAR RRLSCSF*RT

151   PKRCSSSIIT KPKFLNLMSS CTSLCVPITI STVPSAMPSS AALVALLLLK

201   RERLATFTGK SAKRSAKFCA CCSTKSVVGA STATCLPPIT ATNAARRATS

251   VLPKPTSPHT RRSIGFACVK SLITAAMAAA WSSVSS*
``` m645/g645 93.7% identity in 286 aa overlap

```
                 10         20         30         40         50         60
   m645.pep  MMMVLALGISIPVSMMVEQSNTLNRCCKKSRMTCSSSRSRSCPCATPMRASGSRVSSRSR
             |||||||| : :|||||||||||||| ||||||||||||||||||||| |||||||||||
       g645  MMMVLALGMSMPVSMMVEQSNTLNLCCKKSRMTCSSSRSRSCPCATPIRASGSRVSSRSR
                 10         20         30         40         50         60

70         80         90        100        110        120
   m645.pep  IFSIVSTSLCRKNTCPPRLSSRNTASRTLPSLKGLTKVLTARRRLGAVVISEKSRSPSNA
             ||||||||||||||||||||:||||||||||||:||||:|||||||||||||||| ||||
       g645  IFSIVSTSLCRKNTCPPRLSSRNTASRTLPSLNGLTKVFTARRRLGAVVISEKSRRPSSA
                 70         80         90        100        110        120

130        140        150        160        170        180
   m645.pep  ILKVRGIGVAVMVRISTLARRRLSCSFXRTPKRCSSSIITKPKFLNLMSSCTSLCVPITI
             :|:||||||||||||:|||||||||||||:|||||||||||:||||||:||||:||||||
       g645  MLRVRGIGVAVMVRMSTLARRRLSCSFCRTPKRCSSSIINKPKFLNFMSSCTNLCVPITI
                130        140        150        160        170        180

190        200        210        220        230        240
   m645.pep  STVPSAMPSSAALVALLLLKRERLATFTGKSAKRSAKFCACCSTKSVVGASTATCLPPIT
             ||||||||||:|||||||||||||||||||||||||||||||||||:|||||||||||||
       g645  STVPSAMPSSVALVALLLLKRERLATFTGKSAKRSAKFCACCSTRSVVGASTATCLPPIT
                190        200        210        220        230        240
```

-continued

```
              250       260       270       280
m645.pep  ATNAARRATSVLPKPTSPHTRRSIGFACVKSLITAAMAAAWSSVSSX
          |||||||||||||||||||| ||||||||||||||||||||||||||
g645      ATNAARRATSVLPKPTSPHTSRSIGFACVKSLITAAMAAAWSSVSSX
              250       260       270       280
```

The following partial DNA sequence was identified in *N. meningitidis* <SEQ ID 2079>:

```
a645.seq
  1   ATGATGATGG TGTTGGCGTT GGGAATGTCG ATACCGGTTT CGATGATGGT
 51   GGAACAGAGC AACACGTTAA ATCGTTGCTG CAAAAAGTCG CGCATGACTT
101   GTTCCAGCTC GCGCTCGCGC AGTTGTCCGT GCGCCACGCC GATGCGGGCT
151   TCGGGCAGCA GGGTTTCCAG CCGCTCACGC ATGTTTTCGA TGGTATCCAC
201   TTCATTGTGC AGGAAAAATA CTTGCCCGCC GCGTTTGAGT TCGCGCAATA
251   CGGCTTCGCG CACGCTGCCT TCGCTGAACG GTTTGACAAA GGTTTTGACG
301   GCGAGGCGGC GGCTGGGCGC AGTGGTAATC AGCGAGAAGT CGCGCAGTCC
351   TTCCAGCGCC ATACTTAAAG TACGCGGAAT CGGCGTAGCG GTCATGGTAA
401   GGATGTCGAC ATTGGCGCGC AGGCGTTTGA GCTGCTCTTT CTGACGCACG
451   CCGAAGCGGT GTTCTTCGTC GATAATCACT AAACCTACGT TTTTGAATTT
501   TATGTCGTCC TGCACCAGTT TGTGCGTACC GATAACAATA TCGACCGTGC
551   CGTCCGCCAT GCCTTCCAGC GCGGCTTTGG TGGCTTTGCT GTTGTTGAAA
601   CGCGAAAGGC TGGCGACTTT CACGGGGAAA TCGGCGAAGC GGTCGGCAAA
651   ATTTTGCGCG TGCTGCTCGA CCAGAAGCGT GGTCGGTGCG AGTACGGCAA
701   CTTGTTTGCC ACCCATTACC GCCACAAACG CGGCGCGCAG GGCGACTTCG
751   GTTTTGCCGA AACCGACATC GCCGCACACG AGGCGGTCCA TCGGCTTCGC
801   CTGCGTCAAA TCTTTAATCA CGGCGGCGAT GGCGGCTGCC TGGTCTTCGG
851   TTTCTTCGTA G
```

This corresponds to the amino acid sequence <SEQ ID 2080; ORF 645.a>:

```
a645.pep
  1   MMMVLALGMS IPVSMMVEQS NTLNRCCKKS RMTCSSSRSR SCPCATPMRA
 51   SGSRVSSRSR MFSMVSTSLC RKNTCPPRLS SRNTASRTLP SLNGLTKVLT
101   ARRRLGAVVI SEKSRSPSSA ILKVRGIGVA VMVRMSTLAR RRLSCSF*RT
151   PKRCSSSIIT KPTFLNFMSS CTSLCVPITI STVPSAMPSS AALVALLLLK
201   RERLATFTGK SAKRSAKFCA CCSTRSVVGA STATCLPPIT ATNAARRATS
251   VLPKPTSPHT RRSIGFACVK SLITAAMAAA WSSVSS*
``` m645/a645 96.9% identity in 286 aa overlap

```
                  10        20        30        40        50        60
m645.pep  MMMVLALGISIPVSMMVEQSNTLNRCCKKSRMTCSSSRSRSCPCATPMRASGSRVSSRSR
          ||||||||:|||||||||||||||||||||||||||||||||||||||||||||||||||
a645      MMMVLALGMSIPVSMMVEQSNTLNRCCKKSRMTCSSSRSRSCPCATPMRASGSRVSSRSR
                  10        20        30        40        50        60
```

```
                       70         80         90        100        110        120
m645.pep    IFSIVSTSLCRKNTCPPRLSSRNTASRTLPSLKGLTKVLTARRRLGAVVISEKSRSPSNA
            :||:||||||||||||||||||||||||||||:|||||||||||||||||||||||||:|
a645        MFSMVSTSLCRKNTCPPRLSSRNTASRTLPSLNGLTKVLTARRRLGAVVISEKSRSPSSA
                       70         80         90        100        110        120

130        140        150        160        170        180
m645.pep    ILKVRGIGVAVMVRISTLARRRLSCSFXRTPKRCSSSIITKPKFLNLMSSCTSLCVPITI
            ||||||||||||||:|||||||||||||||||||||||||| |||:||||||||||||||
a645        ILKVRGIGVAVMVRMSTLARRRLSCSFXRTPKRCSSSIITKPTFLNFMSSCTSLCVPITI
                      130        140        150        160        170        180

190        200        210        220        230        240
m645.pep    STVPSAMPSSAALVALLLLKRSRLATFTGKSAKRSAKFCACCSTKSVVGASTATCLPPIT
            |||||||||||||||||||||||||||||||||||||||||||:||||||||||||||||
a645        STVPSAMPSSAALVALLLLKRSRLATFTGKSAKRSAKFCACCSTRSVVGASTATCLPPIT
                      190        200        210        220        230        240

250        260        270        280
m645.pep    ATNAARRATSVLPKPTSPHTRRSIGFACVKSLITAAMAAAWSSVSSX
            |||||||||||||||||||||||||||||||||||||||||||||||
a645        ATNAARRATSVLPKPTSPHTRRSIGFACVKSLITAAMAAAWSSVSSX
                      250        260        270        280
```

The following partial DNA sequence was identified in *N. gonorrhoeae* <SEQ ID 2081>:

```
g647.seq
    1   ATGCAAAGGC TCGCCGCAGA CGGCATCCAA ATCTTTTTTG TAGGTGTCGA

51   TGGGCAGTTT GCCTTGCGAA TAAACGGTTT GGTTAAAGAG CGTGCACGCT

101   CCGTATTCTT TGGCAAGGTT TGCCGATGCT TTGAGCAGGT AATACTGTAT

151   GGCTTCAAAG GTACGGTGGG TCAGACCGAG CGCGGAACCG TCGCTGTAGC

201   GGACACCGTT TTTCGCCAGA TAGTAGGCGT AGTTGATGAC ACCGATGCCG

251   AGCGAACGGC GGTCCATAGT AGAGGTACGC GCGGCTTCTA CCGGATATCC

301   CTGATAATCT AA
```

This corresponds to the amino acid sequence <SEQ ID 2082; ORF 647.ng>:

```
g647.pep
    1   MQRLAADGIQ IFFVGVDGQF ALRINGLVKE RARSVFFGKV CRCFEQVILY

51   GFKGTVGQTE RGTVAVADTV FRQIVGVVDD TDAERTAVHS RGTRGFYRIS

101   LII*
```

The following partial DNA sequence was identified in *N. meningitidis* <SEQ ID 2083>:

```
m647.seq
    1   ATGCAAAGGC TCGCCGCAGA CGGCATCCAA ATCTTTTTTG TAAGTGTCGA

51   TGGGCAGTTT GCCTTGCGAA TAAACGGTTT GGTTAAAGAG CGTGCACGCA

101   CCGTATTCTT TGGCAAGGTT TGCCGATGCT TTGAGCAGGT AATACTGTAT

151   GGCTTCAAAG GTACGGTGGG TCAGACCGAG CGCGGAACCG TCGCTGTAGC

201   GGACACCGTT TTTCGCCAGA TAATAAGCAT AGTTAATCAC GCCGATGCCG

251   AGCGAACGGC GGCCCATAGT AGAGGTACGC GCGGCTTCTA CCGGATATCC

301   CTGATAATCT AA
```

This corresponds to the amino acid sequence <SEQ ID 2084; ORF 647>:

```
m647.pep
    1   MQRLAADGIQ IFFVSVDGQF ALRINGLVKE RARTVFFGKV CRCFEQVILY

51   GFKGTVGQTE RGTVAVADTV FRQIISIVNH ADAERTAAHS RGTRGFYRIS

101   LII*
``` m647/g647 91.3% identity in 103 aa overlap

```
                  10         20         30         40         50         60
    m647.pep  MQRLAADGIQIFFVSVDGQFALRINGLVKERARTVFFGKVCRCFEQVILYGFKGTVGQTE
              ||||||||||:||||||||||||||||||||:|||||||||||||||||||||||||||
        g647  MQRLAADGIQIFFVGVDGQFALRINGLVKERARSVFFGKVCRCFEQVILYGFKGTVGQTE
                  10         20         30         40         50         60

70         80         90        100
    m647.pep  RGTVAVADTVFRQIISIVNHADAERTAAHSRGTRGFYRISLIIX
              ||||||||||||||:::|: :||||||:||||||||||||||||
        g647  RGTVAVADTVFRQIVGVVDDTDAERTAVHSRGTRGFYRISLIIX
                  70         80         90        100
```

The following partial DNA sequence was identified in N. meningitidis <SEQ ID 2085>:

```
a647.seq
    1   GTGCAAAGGC TCGTTACACA CAGCGTCCAA GTCTTTTTTG TAGGTGTCGA

51   TGGGCAGTTT GCCTTGCGAA TAAACGGTTT GGTTAAAGAG CGTGCACGCA

101   CCGTATTCTT TGGCAAGGTT TGCCGATGCT TTGAGCAGGT AATACTGTAT

151   GGCTTCAAAG GTACGGTGGG TCAGACCGAG CGCGGAGCCG TCGCTGTAGC

201   GGACACCGTT TTTCGCCAAA TAATACGCAT AGTTGATCAC GCCGATACCG

251   AGCGAACGGC GGCCCATAGT GGAGGTACGC GCGGCTTCTA CCGGATATCC

301   CTGATAATCT AA
```

This corresponds to the amino acid sequence <SEQ ID 2086; ORF 647.a>:

```
a647.pep
    1   VQRLVTHSVQ VFFVGVDGQF ALRINGLVKE RARTVFFGKV CRCFEQVILY

51   GFKGTVGQTE RGAVAVADTV FRQIIRIVDH ADTERTAAHS GGTRGFYRIS

101   LII*
``` m647/a647 87.4% identity in 103 aa overlap

```
                  10         20         30         40         50         60
    m647.pep  MQRLAADGIQIFFVSVDGQFALRINGLVKERARTVFFGKVCRCFEQVILYGFKGTVGQTE
              :|||:: ::|:|||:|||||||||||||||||||||||||||||||||||||||||||||
        a647  VQRLVTHSVQVFFVGVDGQFALRINGLVKERARTVFFGKVCRCFEQVILYGFKGTVGQTE
                  10         20         30         40         50         60

70         80         90        100
    m647.pep  RGTVAVADTVFRQIISIVNHADAERTAAHSRGTRGFYRISLIIX
              ||:||||||||||||  ||:|||:||||||| ||||||||||||
        a647  RGAVAVADTVFRQIIRIVDHADTERTAAHSGGTRGFYRISLIIX
                  70         80         90        100
```

The following partial DNA sequence was identified in N. gonorrhoeae <SEQ ID 2087>:

```
g648.seq
    1    ATGAACAGGC GCAACGCGCG GATCGAACGG GCTGTGCGTA TTGCAGTGAT

51    CGACGTTTTG AATGTAGATG CGCCCGGTCC CGGCACGCTC CTGCATCAGC

101    GTGGAAAACA GGTCGGCAGC CGGAATGATA CGCTTGCGTA TGTTCGGGTC

151    TTGCTCGTAT TTCGTATAGA GCCGCTCAAA TTCGTCTTGG TCGGCAAAAA

201    ACGCTTCGTA CAACCCCGAA ACCTCGTTGG GCGAAAACAG CGTAATGTTG

251    CCGCCCTTAA TCAGGCGGGT GTACAGCAGG CGGTTGATTT GCACGCCATA

301    ATCAAGCTGG CGGATACGGT TGTCTTCCAC GCCCCGGTTG TTTTTCAACA

351    CCAGCAGGCT TTCGGCTTCA ATATGCCACA AGGGGTAGAA CAAGGTTGCC

401    GCGCCGCCGC GCACGCCACC TTGCGAACAA GATTTGACCG CCGCCTGAAA

451    CATCTTAAAG AAGGGAATGC AGCCGGTATG CCGGGCTTCA CCGCCCCGGA

501    TTTCGCTGTC CAGCCCGCGG ATACGTCCGG CATTGATGCC GATGCCCGCG

551    CGTTGGGAAA CGTATTTCAC AATCGCGCTG GTAGTGGCAT TGATGGAATC

601    CAAACTATCG TCGCATTCAA TCAGCACACA GCTTGA
```

This corresponds to the amino acid sequence <SEQ ID 2088; ORF 648.ng>:

```
g648.pep
    1    MNRRNARIER AVRIAVIDVL NVDAPGPGTL LHQRGKQVGS RNDTLAYVRV

51    LLVFRIEPLK FVLVGKKRFV QPRNLVGRKQ RNVAALNQAG VQQAVDLHAI

101    IKLADTVVFH APVVFQHQQA FGFNMPQGVE QGCRAAAHAT LRTRFDRRLK

151    HLKEGNAAGM PGFTAPDFAV QPADTSGIDA DARALGNVFH NRAGSGIDGI

201    QTIVAFNQHT A*
```

The following partial DNA sequence was identified in *N. meningitidis* <SEQ ID 2089>:

```
m648.seq
    1    ATGAACAGGC GCGACGCGCG GATCGAACGG GCTGTGCGTA TTGCAGTGAT

51    CGACGTTTTG AATGTAGATG CGCCCGGTTC CGGCACGCTC CTGCATCAGC

101    GTGGAAAACA GGTCGGCAGC CGGAATGATG CGCTTGCGGA TATCAGGGTC

151    TTGCTCGTAT TTCGTATAGA GCCGCTCAAA TTCGTCTTGG TCGGCAAAAA

201    ACGCTTCGTA CAATCCCGGA ACCTCGTTGG GCGAAAACAG CGTAATGTTG

251    CCGCCCTTAA TCAGGCGGGT GTACAGCAGG CGGTTGATTT GCACGCCGTA

301    ATCAAGCTGA CGGATACGGT TGTCTTCCAC ACCGCGGTTG TTTTTCAACA

351    CCAGCAGGCT TTCGGCTTCG ATATGCCACA AGGGGTAGAA CAAGGTTGCC

401    GCGCCGCCGC GCACGCCGCC TTGCGAACAG GATTTGACCG CCGCCTGAAA

451    CATTTTAAAG AAGGGAATGC AGCCGGTATG CCGCGCTTCG CCGCCCCGGA

501    TTTCGCTGTC CAAACCGCGG ATACGTCCGG CATTGATGCC GATGCCCGCA

551    CGCTGGGAAA CGTATTTCAC AATCGCGCTG GTAGTGGCAT TGATGGAATC

601    CAAACTATCG TCGCATTCAA TCAGCACACA GCTTGA
```

This corresponds to the amino acid sequence <SEQ ID 2090; ORF 648>:

```
m648.pep
    1   MNRRDARIER AVRIAVIDVL NVDAPGSGTL LHQRGKQVGS RNDALADIRV

51   LLVFRIEPLK FVLVGKKRFV QSRNLVGRKQ RNVAALNQAG VQQAVDLHAV

101   IKLTDTVVFH TAVVFQHQQA FGFDMPQGVE QGCRAAAHAA LRTGFDRRLK

151   HFKEGNAAGM PRFAAPDFAV QTADTSGIDA DARTLGNVFH NRAGSGIDGI

201   QTIVAFNQHT A*
``` m648/g648 91.5% identity in 211 aa overlap

```
                 10         20         30         40         50         60
  m648.pep   MNRRDARIERAVRIAVIDVLNVDAPGSGTLLHQRGKQVGSRNDALADIRVLLVFRIEPLK
             ||||:||||||||||||||||||||| ||||||||||||||| :||||||:|||||||||
  g648       MNRRNARIERAVRIAVIDVLNVDAPGPGTLLHQRGKQVGSRNDTLAYVRVLLVFRIEPLK
                 10         20         30         40         50         60
                 70         80         90        100        110        120
  m648.pep   FVLVGKKRFVQSRNLVGRKQRNVAALNQAGVQQAVDLHAVIKLTDTVVFHTAVVFQHQQA
             ||||||||||||:|||||||||||||||||||||||||||:|||:|||||| |||||||
  g648       FVLVGKKRFVQPRNLVGRKQRNVAALNQAGVQQAVDLHAIIKLADTVVFHAPVVFQHQQA
                 70         80         90        100        110        120
                130        140        150        160        170        180
  m648.pep   FGFDMPQGVEQGCRAAAHAALRTGFDRRLKHFKEGNAAGMPRFAAPDFAVQTADTSGIDA
             |||:|||||||||||||||| ||||:||||||:|||||||||| :||||||| |||||||
  g648       FGFNMPQGVEQGCRAAAHATLRTRFDRRLKHLKEGNAAGMPGFTAPDFAVQPADTSGIDA
                130        140        150        160        170        180
                190        200        210
  m648.pep   DARTLGNVFHNRAGSGIDGIQTIVAFNQHTAX
             |||:|||||||||||||||||||||||||||
  g648       DARALGNVFHNRAGSGIDGIQTIVAFNQHTAX
                190        200        210
```

The following partial DNA sequence was identified in *N. meningitidis* <SEQ ID 2091>:

```
a648.seq
    1   ATGAACAGGC GCAACGCGCG GATCGAACGG GCTGTGCGTA TTGCAGTGAT

51   CGACGTTTTG AATGTAGATG CGCCCGGTTC CGGCACGCTC CTGCATCAGC

101   GTGGAAAACA GGTCGGCAGC CGGAATGATG CGCTTGCCGA TATCAGGGTC

151   TTGCTCGTAT TTCGTATAGA GCCGCTCAAA TTCGTCTTGG TCGGCAAAAA

201   ACGCTTCGTA CAATCCCGGA ACCTCGTTGG GCGAAAACAG CGTAATGTTG

251   CCGCCCTTAA TCAGGCGGGT GTACAGCAGG CGGTTGATTT GCACGCCGTA

301   ATCAAGCTGA CGGATACGGT TGTCTTCCAC GCCCCGGTTG TTTTTCAACA

351   CCAGCAGGCT TTCGGCTTCG ATATGCCACA AGGGGTAGAA CAAGGTTGCC

401   GCGCCGCCGC GCACGCCACC TTGCGAACAG GATTTGACTG CCGCCTGAAA

451   CATTTTAAAG AAGGGAATGC AGCCGGTATG CCGTGCTTCG CCGCCCCGGA

501   TTTCGCTGTC CAGTCCGCGG ATACGTCCGG CATTGATGCC GATGCCCGCA

551   CGCTGGGAAA CGTATTTCAC AATCGCGCTG GTAGTGGCGT TGATGGAATC

601   CAGGCTGTCG TCGCATTCGA TCAATACGCA GCTTGA
```

This corresponds to the amino acid sequence <SEQ ID 2092; ORF 648.a>:

```
a648.pep
    1   MNRRNARIER AVRIAVIDVL NVDAPGSGTL LHQRGKQVGS RNDALADIRV

51   LLVFRIEPLK FVLVGKKRFV QSRNLVGRKQ RNVAALNQAG VQQAVDLHAV

101   IKLTDTVVFH APVVFQHQQA FGFDMPQGVE QGCRAAAHAT LRTGFDCRLK
```

-continued

```
151   HFKEGNAAGM PCFAAPDFAV QSADTSGIDA DARTLGNVFH NRAGSGVDGI

201   QAVVAFDQYA A*
``` m648/a648 93.8% identity in 211 aa overlap

```
                  10         20         30         40         50         60
m648.pep  MNRRDARIERAVRIAVIDVLNVDAPGSGTLLHQRGKQVGSRNDALADIRVLLVFRIEPLK
          ||||:|||||||||||||||||||||||||||||||||||||||||||||||||||||||
a648      MNRRNARIERAVRIAVIDVLNVDAPGSGTLLHQRGKQVGSRNDALADIRVLLVFRIEPLK
                  10         20         30         40         50         60
                  70         80         90        100        110        120
m648.pep  FVLVGKKRFVQSRNLVGRKQRNVAALNQAGVQQAVDLHAVIKLTDTVVFPHTAVVFQHOQA
          ||||||||||||||||||||||||||||||||||||||||||||||||||:||||||||
a648      FVLVGKKRFVQSRNLVGRKQRNVAALNQAGVQQAVDLHAVIKLTDTVVFPHAPVVFQHOQA
                  70         80         90        100        110        120
                 130        140        150        160        170        180
m648.pep  FGFDMPQGVEQGCRAAAHAALRTGFDRRLKHFKEGNAAGMPRFAAPDFAVQTADTSGIDA
          ||||||||||||||||||:|||||||:|||||||||||||| ||||||||:|||||||
a648      FGFDMPQGVEQGCRAAAHATLRTGFDCRLKHFKEGNAAGMPCFAAPDFAVQSADTSGIDA
                 130        140        150        160        170        180
                 190        200        210
m648.pep  DARTLGNVFHNRAGSGIDGIQTIVAFNQHTAX
          ||||||||||||||||:||||::|||:|::||
a648      DARTLGNVFHNRAGSGVDGIQAVVAFDQYAAX
                 190        200        210
```

The following partial DNA sequence was identified in *N. gonorrhoeae* <SEQ ID 2093>:

```
g649.seq
    1   ATGCTTGCCA TACTGTTGTC TGCAATACTG GGACTGGTAT CAACAACTGC

51   CGCTGCCGGT ACGTCAGAAC CCGCCCACCG ACATACCAAA CATATCAGCA

101   AGGCAAACAA GCAGATGCTG CACCCCGAAT GCAGGAAATA TTTGGAACGC

151   CGTGCCGCGT GGTACCGATC GCAAGGCAAC GTGCAGGAAT TGCGCGAAAA

201   CAAAAAGGCG CGCAAAGCAT TCCGCACCCT GCCTTATGCG GAACAGAAAA

251   TCCAATGCCG GGCGGCTTAT GAGGCTTTCG ATGATTTCGA CGGCGGCAGG

301   TTCCGCCGTT AA
```

This corresponds to the amino acid sequence <SEQ ID 2094; ORF 649.ng>:

```
g649.pep
    1   MLAILLSAIL GLVSTTAAAG TSEPAHRHTK HISKANKQML HPECRKYLER

51   RAAWYRSQGN VQELRENKKA RKAFRTLPYA EQKIQCRAAY EAFDDFDGGR

101   FRR*
```

The following partial DNA sequence was identified in *N. meningitidis* <SEQ ID 2095>:

```
m649.seq
    1   ATGCTTGCCA TACTGTTGTC TGCAATATTG GGACTGGTAT CGACAACTGC

51   CGCTGCCGGT ACGTCAGAAC CCGCCCACCG CGATACCAAA CATATCCGCA

101   AGGCAAACAA GCAGATGCTG CACCCCGAAT GCAGGAAATA TTTGGAACGC

151   CGTGCCGCGT GGTACCGATC GCAAGGCAAC GTGCAGGAAT TGCGCGAAAA

201   CAAAAAGGCG CGCAAAGCAT TCCGCTCCCT GCCTTATGCG GAACAGAAAA
```

```
251  TCCAATGCCG GGCGGCTTAT GAGGCTTTCG ATGATTTCGA CGGCGGCAGT

301  TTCCGCCGTT AA
```

This corresponds to the amino acid sequence <SEQ ID 2096; ORF 649>:

```
m649.pep
   1  MLAILLSAIL GLVSTTAAAG TSEPAHRDTK HIRKANKQML HPECRKYLER

51  RAAWYRSQGN VQELRENKKA RKAFRSLPYA EQKIQCRAAY EAFDDFDGGS

101  FRR*
``` m649/g649 96.1% identity in 103 aa overlap

```
                    10         20         30         40         50         60
   m649.pep  MLAILLSAILGLVSTTAAAGTSEPAHRDTKHIRKANKQMLHPECRKYLERRAAWYRSQGN
             ||||||||||||||||||||||||||||    ||||  |||||||||||||||||||||||
       g649  MLAILLSAILGLVSTTAAAGTSEPAHRHTKHISKANKQMLHPECRKYLERRAAWYRSQGN
                    10         20         30         40         50         60

70         80         90        100
   m649.pep  VQELRENKKARKAFRSLPYAEQKIQCRAAYEAFDDFDGGSFRRX
             ||||||||||||||||:||||||||||||||||||||||| |||
       g649  VQELRENKKARKAFRTLPYAEQKIQCRAAYEAFDDFDGGRFRRX
                    70         80         90        100
```

The following partial DNA sequence was identified in *N. meningitidis* <SEQ ID 2097>:

```
a649.seq
   1  ATGCTTGCCA TACTGTTGTC TGCAATATTG GGACTGGTAT CGACAACTGC

51  CGCTGCCGGT ACGTCAGAAC CCGCCCACCG CGATACCAAA CATATCCGCA

101  AGGCAAACAA GCAGATGCTG CACCCCGAAT GCAGGAAATA TTTGGAACGC

151  CGTGCCGCGT GGTACCGATC GCAAGGCAAC GTGCAGGAAT TGCGCGAAAA

201  CAAAAAGGCG CGCAAAGCAT TCCGCTCCCT GCCTTATAAG GAACAGAAAA

251  CCCAATGCCG GGCGGCTTAT GAGGCTTTCG ATGATTTCGA CGGCAGCAGG

301  TTCCGCCGTT AA
```

This corresponds to the amino acid sequence <SEQ ID 2098; ORF 649.a>:

```
a649.pep
   1  MLAILLSAIL GLVSTTAAAG TSEPAHRDTK HIRKANKQML HPECRKYLER

51  RAAWYRSQGN VQELRENKKA RKAFRSLPYK EQKTQCRAAY EAFDDFDGSR

101  FRR*
``` m649/a649 96.1% identity in 103 aa overlap

```
                    10         20         30         40         50         60
   m649.pep  MLAILLSAILGLVSTTAAAGTSEPAHRDTKHIRKANKQMLHPECRKYLERRAAWYRSQGN
             ||||||||||||||||||||||||||||||||||||||||||||||||||||||||||||
       a649  MLAILLSAILGLVSTTAAAGTSEPAHRDTKHIRKANKQMLHPECRKYLERRAAWYRSQGN
                    10         20         30         40         50         60

70         80         90        100
   m649.pep  VQELRENKKARKAFRSLPYAEQKIQCRAAYEAFDDFDGGSFRRX
             ||||||||||||||||||||   |||||||||||||||:||||
       a649  VQELRENKKARKAFRSLPYKEQKTQCRAAYEAFDDFDGSRFRRX
                    70         80         90        100
```

The following partial DNA sequence was identified in *N. gonorrhoeae* <SEQ ID 2099>:

```
g650.seq
    1  ATGTCCAAAC TCAAAACCAT CGCCCTGACC GCATCAGGTC TGTCCGTTTG
   51  TCCGGGTTTC CTATATGCCC AAAACACCTC ATCACACCAA GTCGGTTTAG
  101  CGATTATGCG GTTAAACTCT TCAATACTCG ACCTGCCACC GACAAAACAA
  151  TATTTCCAAT CCGGCAGCCT GTGGGACGAG CTGCGCCAAG GCTTCCGGAT
  201  GGGCGAAGTC AATCCCGAAC TGGTACGCCG CCACGAAAGC AAATTCATCG
  251  CAAGCCGCAG CTATTTCGAC AGGGTCGTCA ACCGGAGCCG ACCCTATATG
  301  TACCATATCG CCAACGAAGT CAAAAAACGC AATATGCCCG CCGAAGCCGC
  351  CCTGCTTCCC TTCATCGAAA GCGCGTTCGT CACCAAAGCC AAATCACACG
  401  TCGGCGCATC GGGCCTGTGG CAGTTCATGC CCGCTACCGG CAGGCATTAC
  451  GGCTTGGAAA AAACaccgGT TTACGacggc aggcacGacg TTtacgcaGc
  501  taccgatgcc gcacTCAACT AtctGcAATA TCTCTAtggA CTGTTCGGCG
  551  ACTGGCCGCT CGCCTTTGCC GCCTACAACT GGGGTGAAGG CAACGTCGGA
  601  CGCGCCGTCA ACCGCGCCCG CGACCAAGGG CTCGAACCGA CCTACGAAAA
  651  CCTGCGTATG CCCAACGAAA CGCGCAACTA TGTCCCCAAG CTGCTCGCCG
  701  TGCGCAACAT TATTGCCACC CCCCAATCTT TCGGCATGAA TATCAGCGAC
  751  ATAGACAACA AACCCTATTT TCAGGCAGTC GAACCGGGCC GTCCGCTCGA
  801  caacGAagcC ATCGCCCGGC TTGCCGGCAT CACGCAAAGC GAGCTGCTCG
  851  CCCTGAATCC TGCATTCAAC GTCCCCGCgt tcatCCCCAA AAAcaaacgc
  901  aaacTGCTGC TTCCTGTCGC GTCCGTCCAA ACCTTccaaa gcaACTACCT
  951  CAACGCCGCA CCCGACAGCC TGTTTTCATG GGAAGTCTAT ACGCCTGCCG
 1001  CCAAAACCAG CCTGTCCGAC ATCTCGACGG CAACCGGCAT GAGCATTGCC
 1051  GACATCAAAC GCCTCAACAA CCTGAACGGC AACCTTGTCA ACGCAGGACG
 1101  CAGCATCCTT GTCGCCAAGA ACGGCAAGAC CCTTCATACG GCATCGGAat
 1151  ccGTCGTTTC CATCGACATC GACAATACGC CcgacacCTa ccgttccaaT
 1201  ATGCcggcag gcaCGGTGAA CGTCAGCATt gccCgaatcc aacCCgccgc
 1251  cgcaCAGACA gcggacatta ccgtcgcacc tttgccgcaa gaaaccgtcc
 1301  gtacgggaac ccgatcccct tgtccgcaTt accgaacccg ccctTGCGAC
 1351  AGCCGCAGCg CaacctCAAA ccgAAAAACA GACTGCCATG CcgtctGA
```

This corresponds to the amino acid sequence <SEQ ID 2100; ORF 650.ng>:

```
g650.pep
    1  MSKLKTIALT ASGLSVCPGF LYAQNTSSHQ VGLAIMRLNS SILDLPPTKQ
   51  YFQSGSLWDE LRQGFRMGEV NPELVRRHES KFIASRSYFD RVVNRSRPYM
  101  YHIANEVKKR NMPAEAALLP FIESAFVTKA KSHVGASGLW QFMPATGRHY
  151  GLEKTPVYDG RHDVYAATDA ALNYLQYLYG LFGDWPLAFA AYNWGEGNVG
  201  RAVNRARDQG LEPTYENLRM PNETRNYVPK LLAVRNIIAT PQSFGMNISD
  251  IDNKPYFQAV EPGRPLDNEA IARLAGITQS ELLALNPAFN VPAFIPKNKR
  301  KLLLPVASVQ TFQSNYLNAA PDSLFSWEVY TPAAKTSLSD ISTATGMSIA
```

```
-continued
351  DIKRLNNLNG NLVNAGRSIL VAKNGKTLHT ASESVVSIDI DNTPDTYRSN

401  MPAGTVNVSI ARIQPAAAQT ADITVAPLPQ ETVRTGTRSP CPHYRTRPCD

451  SRSATSNRKT DCHAV*
```

The following partial DNA sequence was identified in *N. meningitidis* <SEQ ID 2101>:

```
m650.seq
    1  ATGTCCAAAC TCAAAACCAT CGCTCTGACC GCATCAGGTC TGTCCGTTTG

51  TCCGGGTTTC CTATACGCCC AAAACACCTC ATCACACCAA ATCGGTTTGG

101  CGATTATGCG CTTAAACTCT TCAATACTCG ACCTGCCCCC GACAAAACAA

151  TATTTCCAAT CCGGCAGCCT GTGGGGCGAG CTGCGCCAAG GCTTCCGGAT

201  GGGCGAAGTC AATCCCGAAC TGGTACGCCG CCACGAAAGC AAATTCATCG

251  CAAGCCACAG CTATTTCAAC AGGGTCATCA ACCGGAGTAG ACCCTATATG

301  TACCATATCG CCAACGAAGT CAAAAAACGC AATATGCCCG CCGAAGCCGC

351  CCTGCTTCCC TTCATCGAAA GCGCGTTCGT CACCAAAGCC AAATCACACG

401  TCGGCGCATC AGGATTATGG CAGTTTATGC CCGCTACCGG CAGGCATTAC

451  GGCCTGGAAA AACACCGGT TTACGACGGC AGGCACGACG TTTACGCCGC

501  CACCGATGCC GCACTCAACT ATCTGCAATA CCTCTATGGA CTGTTCGGCG

551  ACTGGCCGCT TGCCTTTGCC GCCTACAACT GGGGTGAAGG CAACGTCGGA

601  CGCGCCATCA ACCGCGCCCG CGCCCAAGGG CTCGAACCGA CCTACGAAAA

651  CCTGCGTATG CCCAACGAAA CGCGCAACTA TGTCCCCAAG CTGCTCGCCG

701  TGCGCAACAT TATTGCCACT CCCCAATCTT TCGGCATGAA TATCAGCGAC

751  ATAGACAACA AACCCTATTT TCAGGCAGTC GAACCGGATC GTCCGCTCGA

801  CAACGAAGCC ATCGCCCGGC TTGCCGGCAT CACGCAAAGC GAGCTGCTCG

851  CCCTAAACCC CGCATTCAAC GTCCCCGCGT TTATCCCCAA AAGCAAACGC

901  AAACTGCTGC TTCCTGTCGC GTCCGTACAA ACCTTCCAAA GCAACTACCT

951  CAACGCCGCA CCCGACAGCC TGTTTTCATG GGAAGTCTAT ACGCCTGCCG

1001  CCAAAACCAG CCTGTCCGAC ATCTCGACGG CAACCGGCAT GAGCATTGCC

1051  GACATCAAAC GCCTCAACAA CCTGAACGGC AACCTTGTCA ACGCAGGACG

1101  CAGCATCCTT GTCGCCAAGA ACGGCAAAAC CCTTCAGACG GCATCGGAAT

1151  CCGTCGTTTC CATCGACATC GACAATACGC CCGACACCTA CCGTTCCAAT

1201  ATGCCGGCAG GCACGGTGAA CGTCGGCATT GCCCGAATCC GACCCGCCGC

1251  CGCACAGACA GCGGACATTA CCGTCGCACC TTTGCCGCAG AAAACCGTCC

1301  GTACGG.AAC CCGATCCCCT TGTCCGTATT GCCGAACCTG CCCTTGCGAC

1351  AGCCGCAGCG CAACCTCAAA CCGAAAAACA GACCGCCATG CCGTCTGA
```

This corresponds to the amino acid sequence <SEQ ID 2102; ORF 650>:

```
m650.pep
    1  MSKLKTIALT ASGLSVCPGF LYAQNTSSHQ IGLAIMRLNS SILDLPPTKQ

51  YFQSGSLWGE LRQGFRMGEV NPELVRRHES KFIASHSYFN RVINRSRPYM

101  YHIANEVKKR NMPAEAALLP FIESAFVTKA KSHVGASGLW QFMPATGRHY
```

```
151    GLEKTPVYDG RHDVYAATDA ALNYLQYLYG LFGDWPLAFA AYNWGEGNVG

201    RAINRARAQG LEPTYENLRM PNETRNYVPK LLAVRNIIAT PQSFGMNISD

251    IDNKPYFQAV EPDRPLDNEA IARLAGITQS ELLALNPAFN VPAFIPKSKR

301    KLLLPVASVQ TFQSNYLNAA PDSLFSWEVY TPAAKTSLSD ISTATGMSIA

351    DIKRLNNLNG NLVNAGRSIL VAKNGKTLQT ASESVVSIDI DNTPDTYRSN

401    MPAGTVNVGI ARIRPAAAQT ADITVAPLPQ KTVRTXTRSP CPYCRTCPCD

451    SRSATSNRKT DRHAV*
``` m650/g650 96.1% identity in 465 aa overlap

```
                  10         20         30         40         50         60
m650.pep  MSKLKTIALTASGLSVCPGFLYAQNTSSHQIGLAIMRLNSSILDLPPTKQYFQSGSLWGE
          ||||||||||||||||||||||||||||:|||||||||||||||||||||||||||| |
g650      MSKLKTIALTASGLSVCPGFLYAQNTSSHQVGLAIMRLNSSILDLPPTKQYFQSGSLWDE
                  10         20         30         40         50         60

70         80         90        100        110        120
m650.pep  LRQGFRMGEVNPELVRRHESKFIASHSYFNRVINRSRPYMYHIANEVKKRNMPAEAALLP
          |||||||||||||||||||||||||:|||:||:|||||||||||||||||||||||||||
g650      LRQGFRMGEVNPELVRRHESKFIASRSYFDRVVNRSRPYMYHIANEVKKRNMPAEAALLP
                  70         80         90        100        110        120

130        140        150        160        170        180
m650.pep  FIESAFVTKAKSHVGASGLWQFMPATGRHYGLEKTPVYDGRHDVYAATDAALNYLQYLYG
          ||||||||||||||||||||||||||||||||||||||||||||||||||||||||||||
g650      FIESAFVTKAKSHVGASGLWQFMPATGRHYGLEKTPVYDGRHDVYAATDAALNYLQYLYG
                 130        140        150        160        170        180

190        200        210        220        230        240
m650.pep  LFGDWPLAFAAYNWGEGNVGRAINRARAQGLEPTYENLRMPNETRNYVPKLLAVRNIIAT
          |||||||||||||||||||||||:||||:|||||||||||||||||||||||||||||||
g650      LFGDWPLAFAAYNWGEGNVGRAVNRARDQGLEPTYENLRMPNETRNYVPKLLAVRNIIAT
                 190        200        210        220        230        240

250        260        270        280        290        300
m650.pep  PQSFGMNISDIDNKPYFQAVEPDRPLDNEAIARLAGITQSELLALNPAFNVPAFIPKSKR
          |||||||||||||||||||||:|||||||||||||||||||||||||||||||||||:||
g650      PQSFGMNISDIDNKPYFQAVEPGRPLDNEAIARLAGITQSELLALNPAFNVPAFIPKNKR
                 250        260        270        280        290        300

310        320        330        340        350        360
m650.pep  KLLLPVASVQTFQSNYLNAAPDSLFSWEVYTPAAKTSLSDISTATGMSIADIKRLNNLNG
          ||||||||||||||||||||||||||||||||||||||||||||||||||||||||||||
g650      KLLLPVASVQTFQSNYLNAAPDSLFSWEVYTPAAKTSLSDISTATGMSIADIKRLNNLNG
                 310        320        330        340        350        360

370        380        390        400        410        420
m650.pep  NLVNAGRSILVAKNGKTLQTASESVVSIDIDNTPDTYRSNMPAGTVNVGIARIRPAAAQT
          ||||||||||||||||||||:|||||||||||||||||||||||||||:||||:||||||
g650      NLVNAGRSILVAKNGKTLHTASESVVSIDIDNTPDTYRSNMPAGTVNVSIARIQPAAAQT
                 370        380        390        400        410        420

430        440        450        460
m650.pep  ADITVAPLPQKTVRTXTRSPCPYCRTCPCDSRSATSNRKTDRHAVX
          ||||||||||:|||| |||||||:|| |||||||||||||| ||||
g650      ADITVAPLPQETVRTGTRSPCPHYRTRPCDSRSATSNRKTDCHAVX
                 430        440        450        460
```

50

The following partial DNA sequence was identified in *N. meningitidis* <SEQ ID 2103>:

```
a650.seq
    1    ATGTCCAAAC TCAAAACCAT CGCCCTGACC GCGTCAGGTC TGTCCGTTTG

51    TCCGGGTTTC CTATACGCCC AAAACACCTC ATCACACCAA ATCGGTTTGG

101    CGATTATGCG CTTAAACTCT TCAATACTCG ACCTGCCACC GACAAAACAA

151    TATTTCCAAT CCGGCAGCCT GTGGAGCGAG CTGCGCCAAG CTTCCGGAT

201    GGGCGAAGTC AATCCCGAAC TGGTACGCCG CCACGAAAGC AAATTCATCG

251    CAAGCCACAG CTATTTCAAC AGGGTCATCA ACCGGAGTAG ACCCTATATG

301    TACCATATCG CCAACGAAGT CAAAAAACGC AATATGCCCG CCGAAGCCGC
```

```
 351 CCTGCTTCCC TTCATCGAAA GCGCGTTCGT CACCAAAGCC AAATCACACG

401 TCGGCGCATC GGGCCTGTGG CAGTTCATGC CCGCTACCGG CAGGCATTAC

451 GGCCTGGAAA AACACCGGT TTACGACGGC AGGCACGACA TTTACGCCGC

501 CACCGATGCC GCACTCAACT ATCTGCAATA CCTCTATGGA CTGTTCGGCG

551 ACTGGCCGCT CGCCTTTGCC GCCTACAACT GGGGTGAAGG CAACGTCGGA

601 CGCGCCATCA ACCGCGCCCG CGCCCAAGGG CTCGAACCGA CCTACGAAAA

651 CCTGCGTATG CCCAACGAAA CGCGCAACTA TGTTCCCAAG CTGCTCGCCG

701 TGCGCAACAT CATTGCCGCC CCCCAATCTT TCGGCATGAA TATCAGCGAC

751 ATAGACAACA AACCGTATTT TCAGGCAGTC GAACCGGACC GTCCGCTCGA

801 CAACGAAGCC ATCGCCCGGC TTGCCGGCAT CACGCAAAGC GAGCTGCTCG

851 CCCTAAACCC CGCATTCAAC GTCCCCGCGT TCATCCCCAA AAGCAAACGC

901 AAACTGCTGC TTCCTGTCGC GTCCGTACAA ACCTTCCAAA GCAACTACCT

951 CAACGCCGCA CCCGACAGCC TGTTTTCATG GGAAGTCTAT ACGCCTGCCG

1001 CCAAAACCAG CTTGTCCGAC ATCTCGACGG CAACCGGCAT GAGCATTGCC

1051 GACATCAAAC GCCTCAACAA CCTGAACGGC AACCTTGTCA ACGCAGGACG

1101 CAGCATCCTT GTCGCCAAGA ACGGCAAAAC CCTTCAGACG GCATCGGAAT

1151 CCGTCGTTTC CATCGACATC GACAATACGC CCAACACCTA CCGTTCCAAT

1201 ATGCCGGCAG GCACGGTGAA CGTCGGCATT GCCCGAATCC GACCCGCCGC

1251 CGCACAGACA GCGGACATTA CCGTCGCACC TTTGCCGCAG AAAACCGTCC

1301 GTACGG.AAC CCGATCCCCT TGTCCGTATT GCCGAACCTG CCCTTGCGAC

1351 AGCCGCAGCG CAACCTCAAA CCGAAAAACA GACCGCCATG CCGTCTGA
                                                        35
```

This corresponds to the amino acid sequence <SEQ ID 2104; ORF 650.a>:

```
a650.pep
   1   MSKLKTIALT ASGLSVCPGF LYAQNTSSHQ IGLAIMRLNS SILDLPPTKQ

51   YFQSGSLWSE LRQGFRMGEV NPELVRRHES KFIASHSYFN RVINRSRPYM

101   YHIANEVKKR NMPAEAALLP FIESAFVTKA KSHVGASGLW QFMPATGRHY

151   GLEKTPVYDG RHDIYAATDA ALNYLQYLYG LFGDWPLAFA AYNWGEGNVG

201   RAINRARAQG LEPTYENLRM PNETRNYVPK LLAVRNIIAA PQSFGMNISD

251   IDNKPYFQAV EPDRPLDNEA IARLAGITQS ELLALNPAFN VPAFIPKSKR

301   KLLLPVASVQ TFQSNYLNAA PDSLFSWEVY TPAAKTSLSD ISTATGMSIA

351   DIKRLNNLNG NLVNAGRSIL VAKNGKTLQT ASESVVSIDI DNTPNTYRSN

401   MPAGTVNVGI ARIRPAAAQT ADITVAPLPQ KTVRTXTRSP CPYCRTCPCD

451   SRSATSNRKT DRHAV*
``` m650/a650 99.1% identity in 465 aa overlap

```
                 10         20         30         40         50         60
m650.pep  MSKLKTIALTASGLSVCPGFLYAQNTSSHQIGLAIMRLNSSILDLPPTKQYFQSGSLWGE
          ||||||||||||||||||||||||||||||||||||||||||||||||||||||||||:|
a650      MSKLKTIALTASGLSVCPGFLYAQNTSSHQIGLAIMRLNSSILDLPPTKQYFQSGSLWSE
                 10         20         30         40         50         60
```

-continued

```
              70         80         90        100        110        120
m650.pep  LRQGFRMGEVNPELVRRHESKFIASHSYFNRVINRSRPYMYHIANEVKKRNMPAEAALLP
          ||||||||||||||||||||||||||||||||||||||||||||||||||||||||||||
a650      LRQGFRMGEVNPELVRRHESKFIASHSYFNRVINRSRPYMYHIANEVKKRNMPAEAALLP
              70         80         90        100        110        120

130        140        150        160        170        180
m650.pep  FIESAFVTKAKSHVGASGLWQFMPATGRHYGLEKTPVYDGRHDVYAATDAALNYLQYLYG
          ||||||||||||||||||||||||||||||||||||||||||:|||||||||||||||||
a650      FIESAFVTKAKSHVGASGLWQFMPATGRHYGLEKTPVYDGRHDIYAATDAALNYLQYLYG
             130        140        150        160        170        180

190        200        210        220        230        240
m650.pep  LFGDWPLAFAAYNWGEGNVGRAINRARAQGLEPTYENLRMPNETRNYVPKLLAVRNIIAT
          |||||||||||||||||||||||||||||||||||||||||||||||||||||||||||:
a650      LFGDWPLAFAAYNWGEGNVGRAINRARAQGLEPTYENLRMPNETRNYVPKLLAVRNIIAA
             190        200        210        220        230        240

250        260        270        280        290        300
m650.pep  PQSFGMNISDIDNKPYFQAVEPDRPLDNEAIARLAGITQSELLALNPAFNVPAFIPKSKR
          ||||||||||||||||||||||||||||||||||||||||||||||||||||||||||||
a650      PQSFGMNISDIDNKPYFQAVEPDRPLDNEAIARLAGITQSELLALNPAFNVPAFIPKSKR
             250        260        270        280        290        300

310        320        330        340        350        360
m650.pep  KLLLPVASVQTFQSNYLNAAPDSLFSWEVYTPAAKTSLSDISTATGMSIADIKRLNNLNG
          ||||||||||||||||||||||||||||||||||||||||||||||||||||||||||||
a650      KLLLPVASVQTFQSNYLNAAPDSLFSWEVYTPAAKTSLSDISTATGMSIADIKRLNNLNG
             310        320        330        340        350        360

370        380        390        400        410        420
m650.pep  NLVNAGRSILVAKNGKTLQTASESVVSIDIDNTPDTYRSNMPAGTVNVGIARIRPAAAQT
          |||||||||||||||||||||||||||||||||||||:||||||||||||||||||||||
a650      NLVNAGRSILVAKNGKTLQTASESVVSIDIDNTPNTYRSNMPAGTVNVGIARIRPAAAQT
             370        380        390        400        410        420

430        440        450        460
m650.pep  ADITVAPLPQKTVRTXTRSPCPYCRTCPCDSRSATSNRKTDRHAVX
          |||||||||||||||||||||||||||||||||||||||||||||
a650      ADITVAPLPQKTVRTXTRSPCPYCRTCPCDSRSATSNRKTDRHAVX
             430        440        450        460
```

The following partial DNA sequence was identified in *N. gonorrhoeae* <SEQ ID 2105>:

```
g652.seq
    1   ATGATCGAAT TGGACGGTAC TGAAAACAAA GGCAATTTGG GTGCGAATGC

51   GACTTTGGCG GTCTCTATGG CGGTTGCACG CGCCGCTGCC GAAGACTCAG

101   GCCTGCCGCT TTACCGCTAC TTGGGGGGCG CAGGTCCGAT GTCCCTGCCC

151   GTACCGATGA TGAACGTCAT CAACGGCGGC GAACACGCCA CAACAGCCT

201   GAACATCCAA GAGTTTATGA TTATGCCCGT CGGCGCAAAA TCTTTCCGCG

251   AAGCGTTGCG CTGCGGTGCG GAAATTTTCC ACGCCTTGAA AAAACTGTGC

301   GACAGTAAAG GCTTCCCGAC CACAGTCGGC GACGAAGGCG GTTTCGCCCC

351   CAACCTGAAC AGCCACAAAG AAGCCCTGCA ACTGATGGTC GAAGCGGCCG

401   AAGCCGCCGG CTACAAGGCG GGCGAAGACG TATTATTCGC ATTGGACTGC

451   GCGTCCAGCG AGTTCTACAA AGACGGCAAA TACCACTTGG AAGCCGAAGG

501   CCGCTCCTAC ACCAACGCGG AATTTGCCGA ATACTTGGAA GGCTTGGTTA

551   ACGAATTCCC GATTATTTCC ATTGAAGACG GGATGGACGA AAACGACTGG

601   GAAGGCTGGA AACTGCTGAC CGAAAAATTG GGCAAAAAAG TTCAATTGGT

651   CGGCGACGAC TTGTTCGTAA CCAATCCGAA AATTCTTGCC GAAGGCATCG

701   AAAAAGGCGT AGCAAACGCA TTGCTGGTCA AAGTCAACCA AATCGGTACT

751   TTAAGCGAAA CCCTGAAAGc cgtcgatctg gCAAAATGCA accgctacGc 801   cagCGTGATG AGCCAccgct ccggCGAAAC CGAAGACAGT Accattgccg 851   ACTTGGCAGT CGCCACCAAC TGTATGCAGA TTAAAAccgG TTCTTTGAGc 901   cgTTCCGACC GCATGGCGAA ATACAACCAa ctGCTGCGTA TCGAGGAAGA
```

-continued

```
 951  ATTGGCGGAA GCcgcctACT ACCCCGGCAA AGCCGCATTC TACCAACTGG

1001  GCAAATAA
```

This corresponds to the amino acid sequence <SEQ ID 2106; ORF 652.ng>:

```
g652.pep
   1  MIELDGTENK GNLGANATLA VSMAVARAAA EDSGLPLYRY LGGAGPMSLP

51  VPMMNVINGG EHANNSLNIQ EFMIMPVGAK SFREALRCGA EIFHALKKLC

101  DSKGFPTTVG DEGGFAPNLN SHKEALQLMV EAAEAAGYKA GEDVLFALDC

151  ASSEFYKDGK YHLEAEGRSY TNAEFAEYLE GLVNEFPIIS IEDGMDENDW

201  EGWKLLTEKL GKKVQLVGDD LFVTNPKILA EGIEKGVANA LLVKVNQIGT

251  LSETLKAVDL AKCNRYASVM SHRSGETEDS TIADLAVATN CMQIKTGSLS

301  RSDRMAKYNQ LLRIEEELAE AAYYPGKAAF YQLGK*
```

The following partial DNA sequence was identified in *N. meningitidis* <SEQ ID 2107>:

```
m652.seq
   1  ATGATCGAAT TGGACGGTAC TGAAAACAAA GGCAATTTGG GTGCGAATGC

51  GACTTTGGCG GTTTCTATGG CGGTTGCACG CGCCGCTGCC GAAGACTCAG

101  GCCTGCCGCT TTACCGCTAC TTGGGCGGCG CAGGCCCGAT GTCCCTGCCC

151  GTACCGATGA TGAACGTCAT CAACGGCGGC GAACACGCCA ACAACAGCCT

201  GAACATCCAA GAGTTTATGA TTATGCCCGT CGGCGCAAAA TCTTTCCGCG

251  AAGCGTTGCG CTGCGGTGCG GAAATTTTCC ACGCCTTGAA AAAACTGTGC

301  GACAGCAAAG GCTTCCCGAC CACAGTCGGC GACGAAGGCG GTTTCGCCCC

351  CAACCTGAAC AGCCACAAAG AAGCCCTGCA ACTGATGGTC GAGGCGACCG

401  AAGCCGCCGG CTACAAAGCG GGCGAAGACG TATTATTCGC ATTGGACTGC

451  GCCTCCAGCG AGTTCTACAA AGACGGCAAA TACCACTTGG AAGCCGAAGG

501  CCGCTCCTAC ACCAACGCGG AATTTGCCGA ATATCTGGAA GGCCTGGTCA

551  ACGAGTTCCC CATCATCTCC ATCGAAGACG GCATGGATGA AAACGACTGG

601  GAAGGCTGGA AACTGCTGAC CGAAAAACTG GGCGGTAGAG TTCAATTGGT

651  TGGCGACGAC TTGTTCGTAA CCAATCCAAA AATCTTGGCC GAAGGCATCG

701  AAAAAGGCGT AGCAAACGCA TTGCTGGTCA AAGTCAATCA AATCGGTACT

751  TTGAGCGAGA CCCTGAAAGC CGTCGACTTA GCCAAACGCA ACCGCTACGC

801  CAGCGTAATG AGCCACCGCT CCGGCGAAAC CGAAGACAGC ACCATTGCCG

851  ACTTGGCAGT CGCCACCAAC TGTATGCAGA TCAAAACCGG TTCTTTGAGC

901  CGTTCCGACC GCATGGCGAA ATACAACCAA CTGCTGCGTA TCGAGGAAGA

951  ATTGGCGGAA GCCGCCGACT ACCCCAGCAA AGCCGCATTC TACCAACTGG

1001  GCAAATAA
```

This corresponds to the amino acid sequence <SEQ ID 2108; ORF 652>:

```
m652.pep
     1  MIELDGTENK GNLGANATLA VSMAVARAAA EDSGLPLYRY LGGAGPMSLP

51  VPMMNVINGG EHANNSLNIQ EFMIMPVGAK SFREALRCGA EIFHALKKLC

101  DSKGFPTTVG DEGGFAPNLN SHKEALQLMV EATEAAGYKA GEDVLFALDC

151  ASSEFYKDGK YHLEAEGRSY TNAEFAEYLE GLVNEFPIIS IEDGMDENDW

201  EGWKLLTEKL GGRVQLVGDD LFVTNPKILA EGIEKGVANA LLVKVNQIGT

251  LSETLKAVDL AKRNRYASVM SHRSGETEDS TIADLAVATN CMQIKTGSLS

301  RSDRMAKYNQ LLRIEEELAE AADYPSKAAF YQLGK*
``` m652/g652 98.2% identity in 335 aa overlap

```
                  10        20        30        40        50        60
m652.pep  MIELDGTENKGNLGANATLAVSMAVARAAAEDSGLPLYRYLGGAGPMSLPVPMMNVINGG
          ||||||||||||||||||||||||||||||||||||||||||||||||||||||||||||
g652      MIELDGTENKGNLGANATLAVSMAVARAAAEDSGLPLYRYLGGAGPMSLPVPMMNVINGG
                  10        20        30        40        50        60

70        80        90       100       110       120
m652.pep  EHANNSLNIQEFMIMPVGAKSFREALRCGAEIFHALKKLCDSKGFPTTVGDEGGFAPNLN
          ||||||||||||||||||||||||||||||||||||||||||||||||||||||||||||
g652      EHANNSLNIQEFMIMPVGAKSFREALRCGAEIFHALKKLCDSKGFPTTVGDEGGFAPNLN
                  70        80        90       100       110       120

130       140       150       160       170       180
m652.pep  SHKEALQLMVEATEAAGYKAGEDVLFALDCASSEFYKDGKYHLEAEGRSYTNAEFAEYLE
          |||||||||||:||||||||||||||||||||||||||||||||||||||||||||||||
g652      SHKEALQLMVEAAEAAGYKAGEDVLFALDCASSEFYKDGKYHLEAEGRSYTNAEFAEYLE
                 130       140       150       160       170       180

190       200       210       220       230       240
m652.pep  GLVNEFPIISIEDGMDENDWEGWKLLTEKLGGRVQLVGDDLFVTNPKILAEGIEKGVANA
          ||||||||||||||||||||||||||||||| :|||||||||||||||||||||||||||
g652      GLVNEFPIISIEDGMDENDWEGWKLLTEKLGKKVQLVGDDLFVTNPKILAEGIEKGVANA
                 190       200       210       220       230       240

250       260       270       280       290       300
m652.pep  LLVKVNQIGTLSETLKAVDLAKRNRYASVMSHRSGETEDSTIADLAVATNCMQIKTGSLS
          |||||||||||||||||||||| |||||||||||||||||||||||||||||||||||||
g652      LLVKVNQIGTLSETLKAVDLAKCNRYASVMSHRSGETEDSTIADLAVATNCMQIKTGSLS
                 250       260       270       280       290       300

310       320       330
m652.pep  RSDRMAKYNQLLRIEEELAEAADYPSKAAFYQLGKX
          |||||||||||||||||||||| ||:||||||||||
g652      RSDRMAKYNQLLRIEEELAEAAYYPGKAAFYQLGKX
                 310       320       330
```

The following partial DNA sequence was identified in *N. meningitidis* <SEQ ID 2109>:

```
a652.seq
     1  ATGATCGAAT TGGACGGTAC TGAAAACAAA GGCAATTTGG GTGCGAATGC

51  GACTTTGGCG GTTTCTATGG CGGTTGCACG CGCCGCTGCC GAAGACTCAG

101  GCCTGCCGCT TTACCGCTAC TTGGGCGGCG CAGGCCCGAT GTCCCTGCCC

151  GTACCGATGA TGAACGTCAT CAACGGCGGC GAACACGCCA ACAACAGCCT

201  GAACATCCAA GAGTTTATGA TTATGCCCGT CGGCGCAAAA TCTTTCCGCG

251  AAGCGTTGCG CTGCGGTGCG GAAATTTTCC ACGCCTTGAA AAAACTGTGC

301  GACAGCAAAG GCTTCCCGAC CACAGTCGGC GACGAAGGCG GTTTCGCCCC

351  CAACCTGAAC AGCCACAAAG AAGCCCTGCA ACTGATGGTC GAGGCGACCG

401  AAGCCGCCGG CTACAAAGCG GGCGAAGACG TATTATTCGC ATTGGACTGC

451  GCGTCCAGCG AGTTCTACAA AGACGGCAAA TACCACTTGG AAGCCGAAGG

501  CCGCTCCTAC ACCAACGCGG AATTTGCCGA ATATCTGGAA GGCCTGGTCA
```

```
 551  ACGAGTTCCC CATCATCTCC ATCGAAGACG GGATGGATGA AAACGACTGG

601  GAAGGCTGGA AACTGCTGAC CGAAAAACTG GGCGGCAAAG TCCAACTCGT

651  TGGCGACGAC CTCTTCGTTA CCAACCCGAA AATCCTTGCC GAAGGCATTG

701  AAAAAGGCGT GGCAAACGCA CTATTGGTCA AAGTCAACCA AATCGGTACT

751  TTGAGTGAAA CCCTGAAAGC CGTCGACTTA GCCAAACGCA ACCGCTACGC

801  CAGCGTAATG AGCCACCGCT CCGGCGAAAC CGAAGACAGC ACCATTGCCG

851  ACTTGGCAGT CGCCACCAAC TGTATGCAGA TCAAAACCGG TTCTTTGAGC

901  CGTTCCGACC GCATGGCGAA ATACAACCAA CTGCTGCGTA TCGAGGAAGA

951  ATTGGCGGAA GCCGCCGACT ACCCCAGCAA AGCCGCATTC TACCAACTGG

1001  GCAAATAA
```

This corresponds to the amino acid sequence <SEQ ID 2110; ORF 652.a>:

```
a652.pep
   1  MIELDGTENK GNLGANATLA VSMAVARAAA EDSGLPLYRY LGGAGPMSLP

51  VPMMNVINGG EHANNSLNIQ EFMIMPVGAK SFREALRCGA EIFHALKKLC

101  DSKGFPTTVG DEGGFAPNLN SHKEALQLMV EATEAAGYKA GEDVLFALDC

151  ASSEFYKDGK YHLEAEGRSY TNAEFAEYLE GLVNEFPIIS IEDGMDENDW

201  EGWKLLTEKL GGKVQLVGDD LFVTNPKILA EGIEKGVANA LLVKVNQIGT

251  LSETLKAVDL AKRNRYASVM SHRSGETEDS TIADLAVATN CMQIKTGSLS

301  RSDRMAKYNQ LLRIEEELAE AADYPSKAAF YQLGK*
``` m652/a652 99.7% identity in 335 aa overlap

```
                 10         20         30         40         50         60
    m652.pep  MIELDGTENKGNLGANATLAVSMAVARAAAEDSGLPLYRYLGGAGPMSLPVPMMNVINGG
              ||||||||||||||||||||||||||||||||||||||||||||||||||||||||||||
    a652      MIELDGTENKGNLGANATLAVSMAVARAAAEDSGLPLYRYLGGAGPMSLPVPMMNVINGG
                 10         20         30         40         50         60

70         80         90        100        110        120
    m652.pep  EHANNSLNIQEFMIMPVGAKSFREALRCGAEIFHALKKLCDSKGFPTTVGDEGGFAPNLN
              ||||||||||||||||||||||||||||||||||||||||||||||||||||||||||||
    a652      EHANNSLNIQEFMIMPVGAKSFREALRCGAEIFHALKKLCDSKGFPTTVGDEGGFAPNLN
                 70         80         90        100        110        120

130        140        150        160        170        180
    m652.pep  SHKEALQLMVEATEAAGYKAGEDVLFALDCASSEFYKDGKYHLEAEGRSYTNAEFAEYLE
              ||||||||||||||||||||||||||||||||||||||||||||||||||||||||||||
    a652      SHKEALQLMVEATEAAGYKAGEDVLFALDCASSEFYKDGKYHLEAEGRSYTNAEFAEYLE
                130        140        150        160        170        180

190        200        210        220        230        240
    m652.pep  GLVNEFPIISIEDGMDENDWEGWKLLTEKLGGRVQLVGDDLFVTNPKILAEGIEKGVANA
              |||||||||||||||||||||||||||||||||:||||||||||||||||||||||||||
    a652      GLVNEFPIISIEDGMDENDWEGWKLLTEKLGGKVQLVGDDLFVTNPKILAEGIEKGVANA
                190        200        210        220        230        240

250        260        270        280        290        300
    m652.pep  LLVKVNQIGTLSETLKAVDLAKRNRYASVMSHRSGETEDSTIADLAVATNCMQIKTGSLS
              ||||||||||||||||||||||||||||||||||||||||||||||||||||||||||||
    a652      LLVKVNQIGTLSETLKAVDLAKRNRYASVMSHRSGETEDSTIADLAVATNCMQIKTGSLS
                250        260        270        280        290        300

310        320        330
    m652.pep  RSDRMAKYNQLLRIEEELAEAADYPSKAAFYQLGKX
              |||||||||||||||||||||||||||||||||||
    a652      RSDRMAKYNQLLRIEEELAEAADYPSKAAFYQLGKX
                310        320        330
```

The following partial DNA sequence was identified in *N. gonorrhoeae* <SEQ ID 2111>:

```
g652-1.seq
      1  ATGAGCGCAA TCGTTGATAT TTTCGCCCGC GAAATTTTGG ACTCACGCGG
     51  CAACCCCACA GTCGAGTGTG ATGTATTGCT CGAATCCGGC GTAATGGGAC
    101  GTGCGGCCGT ACCGAGCGGC GCATCCACCG GTCAGAAAGA AGCTTTGGAA
    151  CTTCGCGACG GCGACAAATC CCGCTATTCC GGCAAAGGCG TATTGAAGGC
    201  CGTCGAACAC GTCAACAACC AAATCGCCCA AGCCCTCATC GGTATCGATG
    251  CCAACGAGCA ATCTTATATC GACCAAATCA TGATCGAATT GGACGGTACT
    301  GAAAACAAAG GCAATTTGGG TGCGAATGCG ACTTTGGCGG TCTCTATGGC
    351  GGTTGCACGC GCCGCTGCCG AAGACTCAGG CCTGCCGCTT TACCGCTACT
    401  TGGGGGGCGC AGGTCCGATG TCCCTGCCCG TACCGATGAT GAACGTCATC
    451  AACGGCGGCG AACACGCCAA CAACAGCCTG AACATCCAAG AGTTTATGAT
    501  TATGCCCGTC GGCGCAAAAT CTTTCCGCGA AGCGTTGCGC TGCGGTGCGG
    551  AAATTTTCCA CGCCTTGAAA AAACTGTGCG ACAGTAAAGG CTTCCCGACC
    601  ACAGTCGGCG ACGAAGGCGG TTTCGCCCCC AACCTGAACA GCCACAAAGA
    651  AGCCCTGCAA CTGATGGTCG AAGCGGCCGA AGCCGCCGGC TACAAGGCGG
    701  GCGAAGACGT ATTATTCGCA TTGGACTGCG CGTCCAGCGA GTTCTACAAA
    751  GACGGCAAAT ACCACTTGGA AGCCGAAGGC CGCTCCTACA CCAACGCGGA
    801  ATTTGCCGAA TACTTGGAAG GCTTGGTTAA CGAATTCCCG ATTATTTCCA
    851  TTGAAGACGG GATGGACGAA AACGACTGGG AAGGCTGGAA ACTGCTGACC
    901  GAAAAATTGG GCAAAAAAGT TCAATTGGTC GGCGACGACT TGTTCGTAAC
    951  CAATCCGAAA ATTCTTGCCG AAGGCATCGA AAAGGCGTA GCAAACGCAT
   1001  TGCTGGTCAA AGTCAACCAA ATCGGTACTT TAAGCGAAAC CCTGAAAGCC
   1051  GTCGATCTGG CAAAATGCAA CCGCTACGCC AGCGTGATGA GCCACCGCTC
   1101  CGGCGAAACC GAAGACAGTA CCATTGCCGA CTTGGCAGTC GCCACCAACT
   1151  GTATGCAGAT TAAAACCGGT TCTTTGAGCC GTTCCGACCG CATGGCGAAA
   1201  TACAACCAAC TGCTGCGTAT CGAGGAAGAA TTGGCGGAAG CCGCCTACTA
   1251  CCCCGGCAAA GCCGCATTCT ACCAACTGGG CAAATAA
```

This corresponds to the amino acid sequence <SEQ ID 2112; ORF 652-1.ng>:

```
g652-1.pep
      1  MSAIVDIFAR EILDSRGNPT VECDVLLESG VMGRAAVPSG ASTGQKEALE
     51  LRDGDKSRYS GKGVLKAVEH VNNQIAQALI GIDANEQSYI DQIMIELDGT
    101  ENKGNLGANA TLAVSMAVAR AAAEDSGLPL YRYLGGAGPM SLPVPMMNVI
    151  NGGEHANNSL NIQEFMIMPV GAKSFREALR CGAEIFHALK KLCDSKGFPT
    201  TVGDEGGFAP NLNSHKEALQ LMVEAAEAAG YKAGEDVLFA LDCASSEFYK
    251  DGKYHLEAEG RSYTNAEFAE YLEGLVNEFP IISIEDGMDE NDWEGWKLLT
    301  EKLGKKVQLV GDDLFVTNPK ILAEGIEKGV ANALLVKVNQ IGTLSETLKA
    351  VDLAKCNRYA SVMSHRSGET EDSTIADLAV ATNCMQIKTG SLSRSDRMAK
    401  YNQLLRIEEE LAEAAYYPGK AAFYQLGK*
```

The following partial DNA sequence was identified in *

```
m652-1.seq
       1    ATGAGCGCAA TCGTTGATAT TTTCGCCCGC GAAATTTTGG ACTCACGCGG

51    CAACCCCACA GTCGAGTGTG ATGTATTGCT CGAATCCGGC GTAATGGGAC

101    GCGCAGCCGT ACCGAGCGGC GCGTCCACCG GTCAAAAGA GGCTTTGGAA

151    CTTCGCGACG GCGACAAATC CCGTTATTCG GGCAAGGGCG TATTGAAGGC

201    GGTCGAACAC GTCAACAACC AAATCGCCCA AGCCCTCATT GGTATCGATG

251    CCAACGAGCA ATCTTATATC GACCAAATCA TGATCGAATT GGACGGTACT

301    GAAAACAAAG GCAATTTGGG TGCGAATGCG ACTTTGGCGG TTTCTATGGC

351    GGTTGCACGC GCCGCTGCCG AAGACTCAGG CCTGCCGCTT TACCGCTACT

401    TGGGCGGCGC AGGCCCGATG TCCCTGCCCG TACCGATGAT GAACGTCATC

451    AACGGCGGCG AACACGCCAA CAGCCTG AACATCCAAG AGTTTATGAT

501    TATGCCCGTC GGCGCAAAAT CTTTCCGCGA AGCGTTGCGC TGCGGTGCGG

551    AAATTTTCCA CGCCTTGAAA AAACTGTGCG ACAGCAAAGG CTTCCCGACC

601    ACAGTCGGCG ACGAAGGCGG TTTCGCCCCC AACCTGAACA GCCACAAAGA

651    AGCCCTGCAA CTGATGGTCG AGGCGACCGA AGCCGCCGGC TACAAAGCGG

701    GCGAAGACGT ATTATTCGCA TTGGACTGCG CCTCCAGCGA GTTCTACAAA

751    GACGGCAAAT ACCACTTGGA AGCCGAAGGC CGCTCCTACA CCAACGCGGA

801    ATTTGCCGAA TATCTGGAAG GCCTGGTCAA CGAGTTCCCC ATCATCTCCA

851    TCGAAGACGG CATGGATGAA AACGACTGGG AAGGCTGGAA ACTGCTGACC

901    GAAAAACTGG GCGGTAGAGT TCAATTGGTT GGCGACGACT TGTTCGTAAC

951    CAATCCAAAA ATCTTGGCCG AAGGCATCGA AAAAGGCGTA GCAAACGCAT

1001    TGCTGGTCAA AGTCAATCAA ATCGGTACTT TGAGCGAGAC CCTGAAAGCC

1051    GTCGACTTAG CCAAACGCAA CCGCTACGCC AGCGTAATGA GCCACCGCTC

1101    CGGCGAAACC GAAGACAGCA CCATTGCCGA CTTGGCAGTC GCCACCAACT

1151    GTATGCAGAT CAAAACCGGT TCTTTGAGCC GTTCCGACCG CATGGCGAAA

1201    TACAACCAAC TGCTGCGTAT CGAGGAAGAA TTGGCGGAAG CCGCCGACTA

1251    CCCCAGCAAA GCCGCATTCT ACCAACTGGG CAAATAA
```

This corresponds to the amino acid sequence <SEQ ID 2114; ORF 652-1>:

```
m652-1.pep
       1    MSAIVDIFAR EILDSRGNPT VECDVLLESG VMGRAAVPSG ASTGQKEALE

51    LRDGDKSRYS GKGVLKAVEH VNNQIAQALI GIDANEQSYI DQIMIELDGT

101    ENKGNLGANA TLAVSMAVAR AAAEDSGLPL YRYLGGAGPM SLPVPMMNVI

151    NGGEHANNSL NIQEFMIMPV GAKSFREALR CGAEIFHALK KLCDSKGFPT

201    TVGDEGGFAP NLNSHKEALQ LMVEATEAAG YKAGEDVLFA LDCASSEFYK

251    DGKYHLEAEG RSYTNAEFAE YLEGLVNEFP IISIEDGMDE NDWEGWKLLT

301    EKLGGRVQLV GDDLFVTNPK ILAEGIEKGV ANALLVKVNQ IGTLSETLKA

351    VDLAKRNRYA SVMSHRSGET EDSTIADLAV ATNCMQIKTG SLSRSDRMAK

401    YNQLLRIEEE LAEAADYPSK AAFYQLGK*
``` m652-1/g652-1 98.6% identity in 428 aa overlap

```
                  10        20        30        40        50        60
m652-1    MSAIVDIFAREILDSRGNPTVECDVLLESGVMGRAAVPSGASTGQKEALELRDGDKSRYS
          ||||||||||||||||||||||||||||||||||||||||||||||||||||||||||||
g652-1    MSAIVDIFAREILC3RGNPTVECDVLLESGVMGRAAVPSGASTGQKEALELRDGDKSRYS
                  10        20        30        40        50        60

70        80        90       100       110       120
m652-1    GKGVLKAVEHVNNQIAQALIGIDANEQSYIDQIMIELDGTENKGNLGANATLAVSMAVAR
          ||||||||||||||||||||||||||||||||||||||||||||||||||||||||||||
g652-1    GKGVLKAVEHVNNQIAQALIGIDANEQSYIDQIMIELDGTENKGNLGANATLAVSMAVAR
                  70        80        90       100       110       120

130       140       150       160       170       180
m652-1    AAAEDSGLPLYRYLGGAGPMGLPVPMMNVINGGEHANNSLNIQEFMIMPVGAKSFREALR
          ||||||||||||||||||||||||||||||||||||||||||||||||||||||||||||
g652-1    AAAEDSGLPLYRYLGGAGPMGLPVPMMNVINGGEHANNSLNIQEFMIMPVGAKSFREALR
                 130       140       150       160       170       180

190       200       210       220       230       240
m652-1    CGAEIFHALKKLCDSKGFPTTVGDEGGFAPNLNSHKEALQLMVEATEAAGYKAGEDVLFA
          |||||||||||||||||||||||||||||||||||:||||||||||||||||||||||||
g652-1    CGAEIFHALKKLCDSKGFPTTVGDEGGFAPNLNSHKEALQLMVEAAEAAGYKAGEDVLFA
                 190       200       210       220       230       240

250       260       270       280       290       300
m652-1    LDCASSEFYKDGKYHLEAEGRSYTNAEFAEYLEGLVNEFPIISIEDGMDENDWEGWKLLT
          ||||||||||||||||||||||||||||||||||||||||||||||||||||||||||||
g652-1    LDCASSEFYKDGKYHLEAEGRSYTNAEFAEYLEGLVNEFPIISIEDGMDENDWEGWKLLT
                 250       260       270       280       290       300

310       320       330       340       350       360
m652-1    EKLGGRVQLVGDDLFVTNPKILAEGIEKGVANALLVKVNQIGTLSETLKAVDLAKRNRYA
          |||| :||||||||||||||||||||||||||||||||||||||||||||||||| ||||
g652-1    EKLGKKVQLVGDDLFVTNPKILAEGIEKGVANALLVKVNQIGTLSETLKAVDLAKCNRYA
                 310       320       330       340       350       360

370       380       390       400       410       420
m652-1    SVMSHRSGETEDSTIADLAVATNCMQIKTGSLSRSDRMAKYNQLLRIEEELAEAADYPSK
          ||||||||||||||||||||||||||||||||||||||||||||||||||||||| ||:|
g652-1    SVMSHRSGETEDSTIADLAVATNCMQIKTGSLSRSDRMAKYNQLLRIEEELAEAAYYPGK
                 370       380       390       400       410       420

429
m652-1    AAFYQLGKX
          |||||||||
g652-1    AAFYQLGKX
```

The following partial DNA sequence was identified in *N. meningitidis* <SEQ ID 2115>:

```
a652-1.seq
      1   ATGAGCGCAA TCGTTGATAT TTTCGCCCGC GAAATTTTGG ACTCACGCGG

51   CAACCCCACA GTCGAGTGTG ATGTATTGCT CGAATCCGGC GTAATGGGAC

101   GCGCAGCCGT ACCGAGCGGC GCGTCCACCG GTCAAAAAGA GGCTTTGGAA

151   CTTCGCGACG GCGACAAATC CCGTTATTCG GGCAAGGGCG TATTGAAGGC

201   GGTCGAACAC GTCAACAACC AAATCGCCCA AGCCCTCATT GGTATCGATG

251   CCAACGAGCA ATCTTATATC GACCAAATCA TGATCGAATT GGACGGTACT

301   GAAAACAAAG GCAATTTGGG TGCGAATGCG ACTTTGGCGG TTTCTATGGC

351   GGTTGCACGC GCCGCTGCCG AAGACTCAGG CCTGCCGCTT TACCGCTACT

401   TGGGCGGCGC AGGCCCGATG TCCCTGCCCG TACCGATGAT GAACGTCATC

451   AACGGCGGCG AACACGCCAA CAACAGCCTG AACATCCAAG AGTTTATGAT

501   TATGCCCGTC GGCGCAAAAT CTTTCCGCGA AGCGTTGCGC TGCGGTGCGG

551   AAATTTTCCA CGCCTTGAAA AAACTGTGCG ACAGCAAAGG CTTCCCGACC

601   ACAGTCGGCG ACGAAGGCGG TTTCGCCCCC AACCTGAACA GCCACAAAGA

651   AGCCCTGCAA CTGATGGTCG AGGCGACCGA AGCCGCCGGC TACAAAGCGG

701   GCGAAGACGT ATTATTCGCA TTGGACTGCG CGTCCAGCGA GTTCTACAAA

751   GACGGCAAAT ACCACTTGGA AGCCGAAGGC CGCTCCTACA CCAACGCGGA
```

```
-continued
 801   ATTTGCCGAA TATCTGGAAG GCCTGGTCAA CGAGTTCCCC ATCATCTCCA

851   TCGAAGACGG GATGGATGAA AACGACTGGG AAGGCTGGAA ACTGCTGACC

901   GAAAAACTGG GCGGCAAAGT CCAACTCGTT GGCGACGACC TCTTCGTTAC

951   CAACCCGAAA ATCCTTGCCG AAGGCATTGA AAAAGGCGTG GCAAACGCAC

1001   TATTGGTCAA AGTCAACCAA ATCGGTACTT TGAGTGAAAC CCTGAAAGCC

1051   GTCGACTTAG CCAAACGCAA CCGCTACGCC AGCGTAATGA GCCACCGCTC

1101   CGGCGAAACC GAAGACAGCA CCATTGCCGA CTTGGCAGTC GCCACCAACT

1151   GTATGCAGAT CAAAACCGGT TCTTTGAGCC GTTCCGACCG CATGGCGAAA

1201   TACAACCAAC TGCTGCGTAT CGAGGAAGAA TTGGCGGAAG CCGCCGACTA

1251   CCCCAGCAAA GCCGCATTCT ACCAACTGGG CAAATAA
```

This corresponds to the amino acid sequence <SEQ ID 2116;
ORF 652-1.a>:

```
a652-1.pep
    1   MSAIVDIFAR EILDSRGNPT VECDVLLESG VMGRAAVPSG ASTGQKEALE

51   LRDGDKSRYS GKGVLKAVEH VNNQIAQALI GIDANEQSYI DQIMIELDGT

101   ENKGNLGANA TLAVSMAVAR AAAEDSGLPL YRYLGGAGPM SLPVPMMNVI

151   NGGEHANNSL NIQEFMIMPV GAKSFREALR CGAEIFHALK KLCDSKGFPT

201   TVGDEGGFAP NLNSHKEALQ LMVEATEAAG YKAGEDVLFA LDCASSEFYK

251   DGKYHLEAEG RSYTNAEFAE YLEGLVNEFP IISIEDGMDE NDWEGWKLLT

301   EKLGGKVQLV GDDLFVTNPK ILAEGIEKGV ANALLVKVNQ IGTLSETLKA

351   VDLAKRNRYA SVMSHRSGET EDSTIADLAV ATNCMQIKTG SLSRSDRMAK

401   YNQLLRIEEE LAEAADYPSK AAFYQLGK*
``` m652-1/a652-1 99.8% identity in 428 aa overlap

```
                10         20         30         40         50         60
m652-1  MSAIVDIFAREILDSRGNPTVECDVLLESGVMGRAAVPSGASTGQKEALELRDGDKSRYS
        ||||||||||||||||||||||||||||||||||||||||||||||||||||||||||||
a652-1  MSAIVDIFAREILDSRGNPTVECDVLLESGVMGRAAVPSGASTGQKEALELRDGDKSRYS
                10         20         30         40         50         60

70         80         90        100        110        120
m652-1  GKGVLKAVEHVNNQIAQALIGIDANEQSYIDQIMIELDGTENKGNLGANATLAVSMAVAR
        ||||||||||||||||||||||||||||||||||||||||||||||||||||||||||||
a652-1  GKGVLKAVEHVNNQIAQALIGIDANEQSYIDQIMIELDGTENKGNLGANATLAVSMAVAR
                70         80         90        100        110        120

130        140        150        160        170        180
m652-1  AAAEDSGLPLYRYLGGAGPMSLPVPMMNVINGGEHANNSLNIQEFMIMPVGAKSFREALR
        ||||||||||||||||||||||||||||||||||||||||||||||||||||||||||||
a652-1  AAAEDSGLPLYRYLGGAGPMSLPVPMMNVINGGEHANNSLNIQEFMIMPVGAKSFREALR
               130        140        150        160        170        180

190        200        210        220        230        240
m652-1  CGAEIFHALKKLCDSKGFPTTVGDEGGFAPNLNSHKEALQLMVEATEAAGYKAGEDVLFA
        ||||||||||||||||||||||||||||||||||||||||||||||||||||||||||||
a652-1  CGAEIFHALKKLCDSKGFPTTVGDEGGFAPNLNSHKEALQLMVEATEAAGYKAGEDVLFA
               190        200        210        220        230        240

250        260        270        280        290        300
m652-1  LDCASSEFYKDGKYHLEAEGRSYTNAEFAEYLEGLVNEFPIISIEDGMDENDWEGWKLLT
        ||||||||||||||||||||||||||||||||||||||||||||||||||||||||||||
a652-1  LDCASSEFYKDGKYHLEAEGRSYTNAEFAEYLEGLVNEFPIISIEDGMDENDWEGWKLLT
               250        260        270        280        290        300

310        320        330        340        350        360
m652-1  EKLGGRVQLVGDDLFVTNPKILAEGIEKGVANALLVKVNQIGTLSETLKAVDLAKRNRYA
        |||||:||||||||||||||||||||||||||||||||||||||||||||||||||||||
a652-1  EKLGGKVQLVGDDLFVTNPKILAEGIEKGVANALLVKVNQIGTLSETLKAVDLAKRNRYA
               310        320        330        340        350        360
```

```
               370        380        390        400        410        420
m652-1   SVMSHRSGETEDSTIADLAVATNCMQIKTGSLSRSDRMAKYNQLLRIEEELAEAADYPSK
         ||||||||||||||||||||||||||||||||||||||||||||||||||||||||||||
a652-1   SVMSHRSGETEDSTIADLAVATNCMQIKTGSLSRSDRMAKYNQLLRIEEELAEAADYPSK
               370        380        390        400        410        420

429
m652-1   AAFYQLGKX
         |||||||||
a652-1   AAFYQLGKX
```

The following partial DNA sequence was identified in *N. gonorrhoeae* <SEQ ID 2117>:

```
g653.seq
    1    ATGGCGGcgg aaccgatgcg gAtgccggag gtaAcgtaCG GTTTTTCCGG

51    ATCGTTCGGG ATGGCGTTTT TGTtgacggT GATGTGCGCt ttgcccaAAG

101    CGGCTtcggc ggctttgcCg gtgaTTTTCA TCGGTTGCAG GtcgacgaGG

151    AAaacgTGGC TTTCGGTGCG GCCGGAAacg atgcgCaaac cgCGTttaac 201    caactcttcc gcCATGACGG CAGCATTGAT TTTCACTTGT TTTGCGTATT 251    GTTTGAactC GGGTTGcaac gcttctTTAA acgctACGGC TttgGCGGCG 301    ATAACGTgca tcaACGGAcc gCCTTGCAGG CTTGGGAAGA TGGAAGAGTT

351    CAGCGCTTTT TCGTGGGTAT TGTCACGGCA CAAAATCACA CCGCCGCGAG

401    GGCCGCGTAG GGTTTTGTGG GTGGTAGTGg ttACgaaGTc GCAGAatggc

451    ACGGGgttag gatattcgcc gccGGCAACC AgtccgGCAT Ag
```

This corresponds to the amino acid sequence <SEQ ID 2118; ORF 653.ng>:

```
g653.pep
    1    MAAEPMRMPE VTYGFSGSFG MAFLLTVMCA LPKAASAALP VIFIGCRSTR

51    KTWLSVRPET MRKPRLTNSS AMTAALIFTC FAYCLNSGCN ASLNATALAA

101    ITCINGPPCR LGKMEEFSAF SWVLSRHKIT PPRGPRRVLW VVVVTKSQNG

151    TGLGYSPPAT SPA*
```

The following partial DNA sequence was identified in *N. meningitidis* <SEQ ID 2119>:

```
m653.seq
    1    ATGGCAGCGG AGCCGATGCG GATGCCGGAG GTAACGAAGG GTTTTTCCGG

51    ATCGTTCGGA ATGGCGTTTT TGTTGACGGT GATGTGCGCT TTGCCCAAAG

101    CGGCTTCGGC GGCTTTGCCG GTAATTTTCA TCGGTTGCAG GTCAACGAGG

151    AAAACGTGGC TTTCGGTGCG GCCGGAAACG ATGCGCAAAC CGCGTTTAAC

201    CAACTCTTCC GCCATGGCGG CTGCATTGAT TTTCACTTGT TTTGCGTATT

251    GTTTGAACTC GGGTTGCAAT GCTTCTTTAA ACGCCACGGC TTTGGCGGCG

301    ATAACGTGCA TCAGCGGACC GCCTTGCAGG CTTGGGAAGA TGGAAGAGTT

351    CAACGCTTTT TCGTGGGTAT TGTCGCGGCA CAAAATTACG CCGCCGCGAG

401    GACCGCGCAG GGTTTTGTGG GTGGTGGTGG TCACGAAGTC GCAGAACGGC

451    ACCGGGTTGG GATATTCGCC GCCGGCAACC AGACCGGCAT AG
```

This corresponds to the amino acid sequence <SEQ ID 2120; ORF 653>:

```
m653.pep
    1   MAAEPMRMPE VTKGFSGSFG MAFLLTVMCA LPKAASAALP VIFIGCRSTR

51   KTWLSVRPET MRKPRLTNSS AMAAALIFTC FAYCLNSGCN ASLNATALAA

101   ITCISGPPCR LGKMEEFNAF SWVLSRHKIT PPRGPRRVLW VVVVTKSQNG

151   TGLGYSPPAT RPA*
``` m653/g653 96.9% identity in 163 aa overlap

```
                  10         20         30         40         50         60
  m653.pep  MAAEPMRMPEVTKGFSGSFGMAFLLTVMCALPKAASAALPVIFIGCRSTRKTWLSVRPET
            ||||||||||| ||||||||||||||||||||||||||||||||||||||||||||||||
      g653  MAAEPMRMPEVTYGFSGSFGMAFLLTVMCALPKAASAALPVIFIGCRSTRKTWLSVRPET
                  10         20         30         40         50         60
                  70         80         90        100        110        120
  m653.pep  MRKPRLTNSSAMAAALIFTCFAYCLNSGCNASLNATALAAITCISGPPCRLGKMEEFNAF
            ||||||||||:|||||||||||||||||||||||||||||||:|||||||||||||:||
      g653  MRKPRLTNSSAMTAALIFTCFAYCLNSGCNASLNATALAAITCINGPPCRLGKMEEFSAF
                  70         80         90        100        110        120
                 130        140        150        160
  m653.pep  SWVLSRHKITPPRGPRRVLWVVVVTKSQNGTGLGYSPPATRPAX
            |||||||||||||||||||||||||||||||||||||||| |||
      g653  SWVLSRHKITPPRGPRRVLWVVVVTKSQNGTGLGYSPPATSPAX
                 130        140        150        160
```

The following partial DNA sequence was identified in *N. meningitidis* <SEQ ID 2121>:

```
a653.seq
    1   ATGGCGGCGG AACCGATGCG GATGCCGGAG GTAACGAAGG GTTTTTCCGG

51   ATCATTCGGG ATGGCGTTTT TGTTGACAGT GATGTGCGCT TTGCCCAAAG

101   CAGCTTCGGC GGCTTTGCCG GTAATTTTCA TCGGTTGCAG GTCAACGAGG

151   AAAACGTGGC TTTCGGTGCG GCCGGAAACG ATGCGCAAAC CGCGTTTAAC

201   CAACTCTTCC GCCATGGCGG CTGCATTGAT TTTCACTTGT TTTGCGTATT

251   GTTTGAACTC GGGTTGCAAT GCTTCTTTAA ACGCCACGGC TTTGGCGGCG

301   ATAACGTGCA TCAGCGGGCC ACCTTGCAGG CTTGGGAAGA TGGAAGAGTT

351   CAACGCTTTT TCGTGGGTAT TGTCGCGGCA CAAAATTACG CCGCCGCGAG

401   GACCGCGCAG GGTTTTGTGG GTGGTGGTGG TAACGAAGTC GCAGAACGGC

451   ACGGGATTGG GATATTCGCC GCCGGCAACC AGACCGGCAT AG
```

This corresponds to the amino acid sequence <SEQ ID 2122; ORF 653.a>:

```
a653.pep
    1   MAAEPMRMPE VTKGFSGSFG MAFLLTVMCA LPKAASAALP VIFIGCRSTR

51   KTWLSVRPET MRKPRLTNSS AMAAALIFTC FAYCLNSGCN ASLNATALAA

101   ITCISGPPCR LGKMEEFNAF SWVLSRHKIT PPRGPRRVLW VVVVTKSQNG

151   TGLGYSPPAT RPA*
``` m653/a653 100.0% identity in 163 aa overlap

```
                  10         20         30         40         50         60
  m653.pep  MAAEPMRMPEVTKGFSGSFGMAFLLTVMCALPKAASAALPVIFIGCRSTRKTWLSVRPET
            ||||||||||||||||||||||||||||||||||||||||||||||||||||||||||||
      a653  MAAEPMRMPEVTKGFSGSFGMAFLLTVMCALPKAASAALPVIFIGCRSTRKTWLSVRPET
                  10         20         30         40         50         60
```

-continued

```
                 70         80         90        100        110        120
m653.pep  MRKPRLTNSSAMAAALIFTCFAYCLNSGCNACLNATALAAITCISGPPCRLGKMEEFNAF
          ||||||||||||||||||||||||||||||||||||||||||||||||||||||||||
a653      MRKPRLTNSSAMAAALIFTCFAYCLNSGCNACLNATALAAITCISGPPCRLGKMEEFNAF
                 70         80         90        100        110        120

130        140        150        160
m653.pep  SWVLSRHKITPPRGPRRVLWVVVVTKSQNGTGLGYSPPATRPAX
          |||||||||||||||||||||||||||||||||||||||||||
a653      SWVLSRHKITPPRGPRRVLWVVVVTKSQNGTGLGYSPPATRPAX
                130        140        150        160
```

The following partial DNA sequence was identified in *N. gonorrhoeae* <SEQ ID 2123>:

```
g656.seq
    1   ATGCCGCGTT TCTCCGGTTC GATTTCTTCG ATGATTTCCA TCGCGCGGAC

51   TTTtggcGCG CCGGAGAGTG TGCcggcagg gAAGGTGGCG GCGAGGATGT

101   CCATATTGGT AACGCCCTCT TTCAAACAGc ctTCGACGTT GGAAACGATG

151   TGCATCACAT GGGAGTATTT TTCAATCACC ATTTTGTCGG TGACTTTGAC

201   TTCGCCTGTT TTGCTGATGC GTCCGACATC GTTGCGCCCC AAATCGATAA

251   GCATAACGTG TTCGGCgatt TCTTTGGCGT CGCTTAACAA ATCTTGTTCG

301   TTGGCAAGGT CTTCGGCGGG GGTTTTGCCG CGCAGGCGCG TGCCGGCGAT

351   GGGGCGGACG ATGACGTcat CGCGTTCGCG GCGGACGAGG ATTTCGGGCG

401   AGGAACCGAC GATGTGGAAA TCGCCGAAAT CGTAG
```

This corresponds to the amino acid sequence <SEQ ID 2124; ORF 656.ng>:

```
g656.pep
    1   MPRFSGSISS MISIARTFGA PESVPAGKVA ARMSILVTPS FKQPSTLETM

51   CITWEYFSIT ILSVTLTSPV LLMRPTSLRP KSISITCSAI SLASLNKSCS

101   LARSSAGVLP RRRVPAMGRT MTSSRSRRTR ISGEEPTMWK SPKS*
```

The following partial DNA sequence was identified in *N. meningitidis* <SEQ ID 2125>:

```
m656.seq
    1   ATGCCGCGTT TGCTCGGTTC GACTTCTTCG ATGATTTCCA TGGCGCGGAC

51   TTTGGGTGCG CCGGAGAGTG TGCCGGCAGG GAAGGTAGCG GCGAGGATGT

101   CCATGTTGGT CATGCCGTCT TTCAGACGGC CTTCGACGTT GGAAACGATG

151   TGCATTACAT GGGAGTATTT TTCAATCACC ATTTTGTCGG TAACTTTGAC

201   TTCGCCGGTT TTACTGATGC GGCCGACGTC GTTGCGTCCT AAGTCAATCA

251   ACATGACGTG TTCGGCGATT TCTTTGGCAT CGCTTAACAA ATCTTGTTCG

301   TTGGCAAGGT CTTCGGCGGG GGTTTTGCCG CGCAGGCGCG TGCCGGCGAT

351   GGGGCGGACG ATAACGTCGT TGCGTTCGCG TCGGACGAGG ATTTCGGGCG

401   AGGAGCCGAC GATGTGGAAA TCGCCGAAAT CGTAG
```

This corresponds to the amino acid sequence <SEQ ID 2126; ORF 656>:

```
m656.pep
    1   MPRLLGSTSS MISMARTLGA PESVPAGKVA ARMSMLVMPS FRRPSTLETM

51   CITWEYFSIT ILSVTLTSPV LLMRPTSLRP KSINMTCSAI SLASLNKSCS

101   LARSSAGVLP RRRVPAMGRT ITSLRSRRTR ISGEEPTMWK SPKS*
```

Computer analysis of this amino acid sequence gave the following results:
Homology with a Predicted ORF from *N. gonorrhoeae* m656/g656 91.0% identity in 144 aa overlap

```
                   10         20         30         40         50         60
    m656.pep   MPRLLGSTSSMISMARTLGAPESVPAGKVAARMSMLVMPSFRRPSTLETMCITWEYFSIT
               |||: || |||||:|||:||||||||||||||| || |||::||||||||||||||||||
    g656       MPRFSGSISSMISIARTFGAPESVPAGKVAARMSILVTPSFKQPSTLETMCITWEYFSIT
                   10         20         30         40         50         60
                   70         80         90        100        110        120
    m656.pep   ILSVTLTSPVLLMRPTSLRPKSINMTCSAISLASLNKSCSLARSSAGVLPRRRVPAMGRT
               |||||||||||||||||||||||::||||||||||||||||||||||||||||||||||
    g656       ILSVTLTSPVLLMRPTSLRPKSISITCSAISLASLNKSCSLARSSAGVLPRRRVPAMGRT
                   70         80         90        100        110        120
                  130        140
    m656.pep   ITSLRSRRTRISGEEPTMWKSPKSX
               :|| ||||||||||||||||||||
    g656       MTSSRSRRTRISGEEPTMWKSPKSX
                  130        140
```

The following partial DNA sequence was identified in *N. meningitidis* <SEQ ID 2127>:

```
a656.seq
    1   ATGCCGCGTT TGCTCGGTTC GACTTCTTCG ATGATTTCCA TGGCGCGGAC

51   TTTGGGTGCG CCGGAGAGTG TGCCGGCAGG GAAGGTAGCG GCGAGGATGT

101   CCATGTTGGT CATGCCGTCT TTCAGACGGC CTTCGACGTT GGAAACGATG

151   TGCATTACAT GGGAGTATTT TTCAATCACC ATTTTGTCGG TAACTTTGAC

201   TTCGCCGGTT TTACTGATGC GGCCGACGTC GTTGCGTCCT AAGTCAATCA

251   ACATGACGTG TTCGGCGATT TCTTTGGCAT CGCTTAACAA ATCTTGTTCG

301   TTGGCAAGGT CTTCGGCGGG GGTTTTGCCG CGCAGGCGCG TGCCGGCGAT

351   GGGGCGGACG ATGACATCGT CGCGTTCGCG GCGGACGAGG ATTTCGGGCG

401   AGGAGCCGAC GATGTGGAAA TCGCCGAAAT CGTAG
```

This corresponds to the amino acid sequence <SEQ ID 2128; ORF 656.a>:

```
a656.pep
    1   MPRLLGSTSS MISMARTLGA PESVPAGKVA ARMSMLVMPS FRRPSTLETM

51   CITWEYFSIT ILSVTLTSPV LLMRPTSLRP KSINMTCSAI SLASLNKSCS

101   LARSSAGVLP RRRVPAMGRT MTSSRSRRTR ISGEEPTMWK SPKS*
``` m656/a656 98.6% identity in 144 aa overlap

```
                   10         20         30         40         50         60
    m656.pep   MPRLLGSTSSMISMARTLGAPESVPAGKVAARMSMLVMPSFRRPSTLETMCITWEYFSIT
               ||||||||||||||||||||||||||||||||||||||||||||||||||||||||||||
    a656       MPRLLGSTSSMISMARTLGAPESVPAGKVAARMSMLVMPSFRRPSTLETMCITWEYFSIT
                   10         20         30         40         50         60
```

```
                 70         80         90        100        110        120
m656.pep   ILSVTLTSPVLLMRPTSLRPKSINMTCSAISLASLNKSCSLARSSAGVLPRRRVPAMGRT
           ||||||||||||||||||||||||||||||||||||||||||||||||||||||||||||
a656       ILSVTLTSPVLLMRPTSLRPKSINMTCSAISLASLNKSCSLARSSAGVLPRRRVPAMGRT
                 70         80         90        100        110        120

130        140
m656.pep   ITSLRSRRTRISGEEPTMWKSPKGX
           :|| |||||||||||||||||||||
a656       MTSSRSRRTRISGEEPTMWKSPKSX
                130        140
```

The following partial DNA sequence was identified in *N. gonorrhoeae* <SEQ ID 2129>:

```
g657.seq
    1  ATGAACACAC CCCCCATCCT TCCTCCCGCC ATGCTCGGCA TCCTCGGCGG
   51  CGGACAATTa ggcagAATGT TTGCCGTTGC CGCTAAAACC ATGGGCTACA
  101  AAGTAACCGT TCTCGATCCC GACCCGAATG CGCCGGCGGC GGAATTTGCC
  151  GACCGCCATT TGTGCGCGCC GTTTGACGAC CGGGCCGCGT TGGACGAATT
  201  GGCAAAATGC GCGGCGGTta cgACCGAATT TGAAAacgtc aaTGCCGACG
  251  CGATGCGCTC TCTGGCAAAG CATACCAACG TTTCCCCCAG CGGCGACTGC
  301  GTGTCCATTG CACAAAACCG CATTCAGGAA AAAGCGTGGA TACGCAAAGC
  351  AGGCTTGCAA ACCGCGCCGT ATCAGGCGGT TTGCAAGGCC GAAGACATTA
  401  CTGAAGCAAG CGCGCAATTT TTGCCCGGCA TCCTGAAAAC GGCTACGTTG
  451  GGCTACGACG GCAAAGGTCA AATCCGCGTC AAAACGTTGG ACGAACTCAA
  501  AGCCGCGTTT GCCGAACACG GCGGCGTGGA TTGCGTTTTG GAAAAAATGG
  551  TGGACTTGCG CGGCGAGATT TCCGTGATCG TATGCCGTCT GAACGATGAA
  601  AACGTGCAAA CCTTCGACCC CGCCGAAAAC ATCCACGAAA ACGGCATCTT
  651  GGCTTattcC ATCGTCcccg CGCGGCTGAG TGCCGACGTG CAGCAACAGG
  701  CGCGGCAGAC GGCGCAACgc tTGGCGGACG AATTGGATTA TGTCGGCgta
  751  TTGGCGGTAG AAATGTTTGT TGTCGGCGAC ACACATGAAT TGCTCGTCAA
  801  TGAAACCGCC CCGCGCACGC ACAATTCCGG CCACCATACG ATAGATGCCT
  851  GCGCCGCAGA CCAGTTCCAA CAGCAGGTAC GCATTATGTG CAAcctGCCG
  901  cccGccgACA CCAAATTATT aTCCCCttgC TGTATGGCGA ATATTTTGGg
  951  CGACGTTTGG CAGGAAGATG GCGGCGAACC GGATTGGCTG CCGTTGCAAA
 1001  GCCGGCCGAA TGCACACCTG CACCTATACG GAAAAAAAAC CGCACAGAAA
 1051  GGTCGGAAAA TGGGACACTT TaccgTTTTG ACCACCGATT CGGACaccgC
 1101  ATTTCAAGAA GCAAAAAAAC TGCATCAGTC CCTATAA
```

This corresponds to the amino acid sequence <SEQ ID 2130; ORF 657.ng>:

```
g657.pep
    1    MNTPPILPPA MLGILGGGQL GRMFAVAAKT MGYKVTVLDP DPNAPAAEFA

51    DRHLCAPFDD RAALDELAKC AAVTTEFENV NADAMRSLAK HTNVSPSGDC

101    VSIAQNRIQE KAWIRKAGLQ TAPYQAVCKA EDITEASAQF LPGILKTATL

151    GYDGKGQIRV KTLDELKAAF AEHGGVDCVL EKMVDLRGEI SVIVCRLNDE

201    NVQTFDPAEN IHENGILAYS IVPARLSADV QQQARQTAQR LADELDYVGV
```

```
251    LAVEMFVVGD THELLVNETA PRTHNSGHHT IDACAADQFQ QQVRIMCNLP

301    PADTKLLSPC CMANILGDVW QEDGGEPDWL PLQSRPNAHL HLYGKKTAQK

351    GRKMGHFTVL TTDSDTAFQE AKKLHQSL*
```

The following partial DNA sequence was identified in *N. meningitidis* <SEQ ID 2131>:

```
m657.seq
   1   ATGAAAAACA TATCTCTTTC TCCGCCCGCC ATGCTTGGCA TCCTCGGCGG

51   CGGACAATTA GGCAGAATGT TTACCGTTGC CGCCAAAACC ATGGGCTACA

101   AAGTAACCGT TCTCGACCCC GATCCGGACG CGCCGGCAGC AGAATTTGCC

151   GACCGCCATT TGTGCGCGCC GTTTAACGAC CAAGCTGCTT TGGACGAATT

201   GGCAAAATGC GCGGCGGTGA CCACTGAATT TGAAAACGTC AATGCCGATG

251   CGATGCGCTT TTTGGCAAAA CATACCAATG TTTCCCCTAG CGGCGATTGT

301   GTGGCGATTG CACAAAACCG CATTCAGGAA AAGGCATGGA TACGCAAAGC

351   GGGATTGCAA ACCGCGCCGT ATCAAGTGGT TTGTAAGGCT GAAGACATCA

401   CTGAAGCAAG CGCGCAATTT TGCCCGGCA TCCTGAAAAC GGCTACGTTG

451   GGCTACGACG GCAAAGGTCA AATCCGCGTA AAACATTGG ATGAACTCAA

501   AGCCGCGTTT GCCGAACACG GCGGCGTGGA TTGCGTTTTG GAAAAAATGG

551   TGGATTTGCG CAGTGAAATT TCCGTAATCG TATGCCGTTT GAACAATGAC

601   AACGTGCAAA CTTTCGACCC TGCCGAAAAC ATCCACGAAA ACGGCATCTT

651   GGCTTATTCC ATCGTCCCCG CGCGACTGAG TGCCGACGTG CAGCAACAGG

701   CGCGGCAGAT GGCGCAACGC TTGGCGGACG AATTGGATTA TGTCGGCGTA

751   TTGGCGGTAG AAATGTTTGT TGTCGGTGAC ACGCATGAAT TGGTCGTCAA

801   CGAAATCGCC CCGCGCCCGC ACAATTCCGG ACACCATACG ATAGATGCCT

851   GCGCAGCAGA CCAGTTCCAG CAGCAGGTAC GCATTATGTG CAACCTGCCG

901   CCTGCCGATA CCAAATTACT GAGTTCTTGC TGTATGGCAA ATATTTTGGG

951   CGACGTTTGG CAGGAAGACG GCGGCGAACC GGATTGGCTG CCCTTGCAAA

1001   GCCATCCGAA TGCACACCTG CACCTTTACG GCAAAAAAAC CGCGCACAAA

1051   GGGCGGAAAA TGGGACACTT TACCGTTTTA ACCACCGATT CGGACACCGC

1101   ATTTCAAGAA GCAAAAAAAC TGCATCAGTC CCTATAA
```

This corresponds to the amino acid sequence <SEQ ID 2132; ORF 657>:

```
m657.pep
   1   MKNISLSPPA MLGILGGGQL GRMFTVAAKT MGYKVTVLDP DPDAPAAEFA

51   DRHLCAPFND QAALDELAKC AAVTTEFENV NADAMRFLAK HTNVSPSGDC

101   VAIAQNRIQE KAWIRKAGLQ TAPYQVVCKA EDITEASAQF LPGILKTATL

151   GYDGKGQIRV KTLDELKAAF AEHGGVDCVL EKMVDLRSEI SVIVCRLNND

201   NVQTFDPAEN IHENGILAYS IVPARLSADV QQQARQMAQR LADELDYVGV

251   LAVEMFVVGD THELVVNEIA PRPHNSGHHT IDACAADQFQ QQVRIMCNLP

301   PADTKLLSSC CMANILGDVW QEDGGEPDWL PLQSHPNAHL HLYGKKTAHK

351   GRKMGHFTVL TTDSDTAFQE AKKLHQSL*
```

Computer analysis of this amino acid sequence gave the following results:
Homology with a Predicted ORF from *N. gonorrhoeae* m657/g657 93.9% identity in 378 aa overlap

```
              10        20        30        40        50        60
m657.pep  MKNISLSPPAMLGILGGGQLGRMFTVAAKTMGYKVTVLDPDPDAPAAEFADRHLCAPFND
          |::   : ||||||||||||||||:||||||||||||||||:|||||||||||||||||:|
g657      MNTPPILPPAMLGILGGGQLGRMFAVAAKTMGYKVTVLDPDPNAPAAEFADRHLCAPFDD
              10        20        30        40        50        60

70        80        90       100       110       120
m657.pep  QAALDELAKCAAVTTEFENVNADAMRFLAKHTNVSPSGDCVAIAQNRIQEKAWIRKAGLQ
          :|||||||||||||||||||||||||||  ||||||||||||:|||||||||||||||||
g657      RVGHEYFHNWTGNRVTCRDWFQLSLKSGLTVFRDQEFSGDRSSRAVRRIENIRLLRQHQF
              70        80        90       100       110       120

130       140       150       160       170       180
m657.pep  TAPYQVVCKAEDITEASAQFLPGILKTATLGYDGKGQIRVKTLDELKAAFAEHGGVDCVL
          |||||:||||||||||||||||||||||||||||||||||||||||||||||||||||||
g657      TAPYQAVCKAEDITEASAQFLPGILKTATLGYDGKGQIRVKTLDELKAAFAEHGGVDCVL
             130       140       150       160       170       180

190       200       210       220       230       240
m657.pep  EKMVDLRSEISVIVCRLNNDNVQTFDPAENIHENGILAYSIVPARLSADVQQQARQMAQR
          |||||||:|||||||||||::||||||||||||||||||||||||||||||||||:|||
g657      EKMVDLRGEISVIVCRLNDENVQTFDPAENIHENGILAYSIVPARLSADVQQQARQTAQR
             190       200       210       220       230       240

250       260       270       280       290       300
m657.pep  LADELDYVGVLAVEMFVVGDTHELVVNEIAPRPHNSGHHTIDACAADQFQQQVRIMCNLP
          |||||||||||||||||||||||||:||| ||| ||||||||||||||||||||||||||
g657      LADELDYVGVLAVEMFVVGDTHELLVNETAPRTHNSGHHTIDACAADQFQQQVRIMCNLP
             250       260       270       280       290       300

310       320       330       340       350       360
m657.pep  PADTKLLSSCCMANILGDVWQEDGGEPDWLPLQSHPNAHLHLYGKKTAHKGRKMGHFTVL
          ||||||||| ||||||||||||||||||||||||:||||||||||||:|||||||||||
g657      PADTKLLSPCCMANILGDVWQEDGGEPDWLPLQSRPNAHLHLYGKKTAQKGRKMGHFTVL
             310       320       330       340       350       360

370       379
m657.pep  TTDSDTAFQEAKKLHQSLX
          |||||||||||||||||||
g657      TTDSDTAFQEAKKLHQSLX
             370
```

The following partial DNA sequence was identified in *N. meningitidis* <SEQ ID 2133>:

```
a657.seq
    1  ATGAAAAACA TATCTCTTTC TCCGCCCGCC ATGCTCGGCA TTCTTGGCGG

51  CGGACAATTA GGCAGAATGT TTACTGTTGC TGCCAAAACC ATGGGCTACA

101  AAGTAACCGT ACTCGATCCC AACCCGAATG CGCCGGCAGC GGAATTTGCC

151  GACCGCCATT TGTGTGCGCC GTTTGACAAC CAAACCGCTT TGGAAGAATT

201  GGCAAAATGT GCGGCTGTTA CGACCGAGTT CGAAAACGTC AATGCCGATG

251  CGATGCGTTT TCTCGCCAAA CATACCAATG TTTCCCCCAG CGGCGACTGC

301  GTTGCCATCG CGCAAAACCG CATTCAGGAA AAGGCATGGA TACGCAAAGC

351  AGGCCTGCAA ACCGCGCCGT ATCAAGCAAT TTGCAAAGCC GAAGACATCA

401  CTGAAGAAAG CATACAATTT CTGCCCGGCA TCCTGAAAAC CGCTACATTG

451  GGCTATGACG GCAAAGGCCA AATCCGCGTC AAAACGGTGG ATGAACTCAA

501  AGCCGCGTTT GCCGAACACC GCGGCGTGGA TTGCGTTTTG GAAAAAATGG

551  TGGACTTGCG CGGCGAAATT TCCGTTATCG TATGCCGTCT GAACAATGAC

601  AACGTGCAAA CTTTCGATCC TGCCGAAAAC ATTCACGAAA ACGGTATCCT

651  CGCCTACTCC ATCGTCCCAG CCCGACTGAG TGCCGACATT CAGCAACAGG

701  CGCGACAAAT GGCGCAGCGT TTGGCCGATG AATTGAACTA CGTCGGCGTA

751  TTGGCGGTAG AAATGTTTGT TGTCGGCGAC ACGCATGAAT TGGTCGTCAA
```

-continued

```
 801  CGAAATCGCG CCGCGTCCGC ACAATTCCGG CCACCATACC GTCGACGCCT

851  GCGCGGCAGA CCAATTCCAG CAACAGGTCC GCCTGATGTG CAACCTGCCA

901  CCTGCTGACA CCAAATTGCT GAGTTCTTGC TGTATGGCGA ATATTTTGGG

951  CGACGTTTGG CAGGAAGACG GCGGCGAACC GGATTGGTTT CCCCTGCAAA

1001  GCCGGCCGGA CGCGCACCTG CACCTTTACG GCAAAAAAAC CGCGCACAAA

1051  GGGCGGAAAA TGGGACACTT TACCATTTTA AGCACCGATT CGGACACCGC

1101  ATTTCAAGAA GCAAAAAAAC TGCATCAGTC CCTATAA
```

This corresponds to the amino acid sequence <SEQ ID 2134; ORF 657.a>:

```
a657.pep
    1   MKNISLSPPA MLGILGGGQL GRMFTVAAKT MGYKVTVLDP NPNAPAAEFA

51   DRHLCAPFDN QTALEELAKC AAVTTEFENV NADAMRFLAK HTNVSPSGDC

101   VAIAQNRIQE KAWIRKAGLQ TAPYQAICKA EDITEESIQF LPGILKTATL

151   GYDGKGQIRV KTVDELKAAF AEHRGVDCVL EKMVDLRGEI SVIVCRLNND

201   NVQTFDPAEN IHENGILAYS IVPARLSADI QQQARQMAQR LADELNYVGV

251   LAVEMFVVGD THELVVNEIA PRPHNSGHHT VDACAADQFQ QQVRLMCNLP

301   PADTKLLSSC CMANILGDVW QEDGGEPDWF PLQSRPDAHL HLYGKKTAHK

351   GRKMGHFTIL STDSDTAFQE AKKLHQSL*
``` m657/a657 94.2% identity in 378 aa overlap

```
                 10         20         30         40         50         60
   m657.pep  MKNISLSPPAMLGILGGGQLGRMFTVAAKTMGYKVTVLDPDPDAPAAEFADRHLCAPFND
             ||||||||||||||||||||||||||||||||||||||||| : ||||||||||||||::
   a657      MKNISLSPPAMLGILGGGQLGRMFTVAAKTMGYKVTVLDPNPNAPAAEFADRHLCAPFDN
                 10         20         30         40         50         60

70         80         90        100        110        120
   m657.pep  QAALDELAKCAAVTTEFENVNADAMRFLAKHTNVSPSGDCVAIAQNRIQEKAWIRKAGLQ
             | : |:||||||||||||||||||||||||||||||||||||||||||||||||||||||
   a657      QTALEELAKCAAVTTEFENVNADAMRFLAKHTNVSPSGDCVAIAQNRIQEKAWIRKAGLQ
                 70         80         90        100        110        120

130        140        150        160        170        180
   m657.pep  TAPYQVVCKAEDITEASAQFLPGILKTATLGYDGKGQIRVKTLDELKAAFAEHGGVDCVL
             |||||::|||||||| : |||||||||||||||||||||||| :|||||||||| |||||
   a657      TAPYQAICKAEDITEESIQFLPGILKTATLGYDGKGQIRVKTVDELKAAFAEHRGVDCVL
                130        140        150        160        170        180

190        200        210        220        230        240
   m657.pep  EKMVDLRSEISVIVCRLNNDNVQTFDPAENIHENGILAYSIVPARLSADVQQQARQMAQR
             |||||||:|||||||||||||||||||||||||||||||||||||||||:||||||||||
   a657      EKMVDLRGEISVIVCRLNNDNVQTFDPAENIHENGILAYSIVPARLSADIQQQARQMAQR
                190        200        210        220        230        240

250        260        270        280        290        300
   m657.pep  LADELDYVGVLAVEMFVVGDTHELVVNEIAPRPHNSGHHTIDACAADQFQQQVRIMCNLP
             ||||| ||||||||||||||||||||||||||||||||||:|||||||||||||:|||||
   a657      LADELNYVGVLAVEMFVVGDTHELVVNEIAPRPHNSGHHTVDACAADQFQQQVRLMCNLP
                250        260        270        280        290        300

310        320        330        340        350        360
   m657.pep  PADTKLLSSCCMANILGDVWQEDGGEPDWLPLQSHPNAHLHLYGKKTAHKGRKMGHFTVL
             |||||||||||||||||||||||||||||:||||:|:||||||||||||||||||||:|
   a657      PADTKLLSSCCMANILGDVWQEDGGEPDWFPLQSRPDAHLHLYGKKTAHKGRKMGHFTIL
                310        320        330        340        350        360

370       379
   m657.pep  TTDSDTAFQEAKKLHQSLX
             :||||||||||||||||||
   a657      STDSDTAFQEAKKLHQSLX
                370
```

The following partial DNA sequence was identified in *N. gonorrhoeae* <SEQ ID 2135>:

```
g658.seq
    1   ATGGTGGCCG GAATTGTGCG TGCGCGGGGC GGTTTCATTG ACGAGCAATT
   51   CATGTGTGTC GCCGACAACA AACATTTCTA CCGCCAAtac GCCGACATAA
  101   TCCAATTCGT CCGCCAagcG TTGCGCCGTC TGCCGCGCCT GTTGCTGCAC
  151   GTCGGCACTC AGCCGCGcgg gGACGATGga atAAGCCAAG ATGCCGTTTT
  201   CGTGGATGTT TTCGGCGGGG TCGAAGGTTT GCACGTTTTC ATCGTTCAGA
  251   CGGCATACGA TCACGGAAAT CTCGCCGCGC AAGTCCACCA TTTTTTCCAA
  301   AACGCAATCC ACGCCGCCGT GTTCGGCAAA CGCGGCTTTG AGTTCGTCCA
  351   ACGTTTTGAC GCGGATTTGA CCTTTGCCGT CGTAGCCCAA CGTAGCCGTT
  401   TTCAGGATGC CGGGCAAAAA TTGCGCGCTT GCTTCAGTAA TGTCTTCGGC
  451   CTTGCAAACC GCCTGATACG GCGCGGTTTG CAAGCCTGCT TTGCGTATCC
  501   ACGCTTTTTC CTGAATGCGG TTTTGTGCAA TGGACACGCA GTCGCCGCTG
  551   GGGGAAACGT TGGTATGCTT TGCCAGAGAG CGCATCGCGT CGGCAttgac
  601   gtTTTCAAAT TCGGTcgtaA CCGCCGCGCA TTTTGCCAAT TCGTCCAACG
  651   CGGCCCGGTC GTCAAACGGC GCGCACAAAT GGCGGTCGGC AAATTCCGCC
  701   GCCGGCGCAT TCGGGTCGGG ATCGAGAACG GTTACTTTGT AGCCCATGGT
  751   TTTAGCGGCA ACGGCAAACA TTctgcctAA
```

This corresponds to the amino acid sequence <SEQ ID 2136; ORF 658.ng>:

```
g658.pep
    1   MVAGIVRARG GFIDEQFMCV ADNKHFYRQY ADIIQFVRQA LRRLPRLLLH
   51   VGTQPRGDDG ISQDAVFVDV FGGVEGLHVF IVQTAYDHGN LAAQVHHFFQ
  101   NAIHAAVFGK RGFEFVQRFD ADLTFAVVAQ RSRFQDAGQK LRACFSNVFG
  151   LANRLIRRGL QACFAYPRFF LNAVLCNGHA VAAGGNVGML CQRAHRVGID
  201   VFKFGRNRRA FCQFVQRGPV VKRRAQMAVG KFRRRRIRVG IENGYFVAHG
  251   FSGNGKHSA*
```

The following partial DNA sequence was identified in *N. meningitidis* <SEQ ID 2137>:

```
m658.seq
    1   ATGGTGTCCG GAATTGTGCG GGCGCGGGGC GATTTCGTTG ACGACCAATT
   51   CATGCGTGTC ACCGACAACA AACATTTCTA CCGCCAATAC GCCGACATAA
  101   TCCAATTCGT CCGCCAAGCG TTGCGCCATC TGCCGCGCCT GTTGCTGCAC
  151   GTCGGCACTC AGTCGCGCGG GGACGATGGA ATAAGCCAAG ATGCCGTTTT
  201   CGTGGATGTT TTCGGCAGGG TCGAAAGTTT GCACGTTGTC ATTGTTCAAA
  251   CGGCATACGA TTACGGAAAT TTCACTGCGC AAATCCACCA TTTTTTCCAA
  301   AACGCAATCC ACGCCGCCGT GTTCGGCAAA CGCGGCTTTG AGTTCATCCA
  351   ATGTTTTTAC GCGGATTTGA CCTTTGCCGT CGTAGCCCAA CGTAGCCGTT
  401   TTCAGGATGC CGGGCAAAAA TTGCGCGCTT GCTTCAGTGA TGTCTTCAGC
  451   CTTACAAACC ACTTGATACG GCGCGGTTTG CAATCCCGCT TTGCGTATCC
  501   ATGCCTTTTC CTGAATGCGG TTTTGTGCAA TCGCCACACA ATCGCCGCTA
  551   GGGGAAACAT TGGTATGTTT TGCCAAAAAG CGCATCGCAT CGGCATTGAC
```

-continued

```
601  GTTTTCAAAT TCAGTGGTCA CCGCCGCGCA TTTTGCCAAT TCGTCCAAAG

651  CAGCTTGGTC GTTAAACGGC GCGCACAAAT GGCGGTCGGC AAATTCTGCT

701  GCCGGCGCGT CCGGATCGGG GTCGAGAACG GTTACTTTGT AGCCCATGGT

751  TTTGGCGGCA ACGGTAAACA TTCTGCCTAA
```

This corresponds to the amino acid sequence <SEQ ID 2138; ORF 658>:

```
m658.pep
  1   MVSGIVRARG DFVDDQFMRV TDNKHFYRQY ADIIQFVRQA LRHLPRLLLH

51   VGTQSRGDDG ISQDAVFVDV FGRVESLHVV IVQTAYDYGN FTAQIHHFFQ

101   NAIHAAVFGK RGFEFIQCFY ADLTFAVVAQ RSRFQDAGQK LRACFSDVFS

151   LTNHLIRRGL QSRFAYPCLF LNAVLCNRHT IAARGNIGMF CQKAHRIGID

201   VFKFSGHRRA FCQFVQSSLV VKRRAQMAVG KFCCRRVRIG VENGYFVAHG

251   FGGNGKHSA*
```

Computer analysis of this amino acid sequence gave the following results:
Homology with a Predicted ORF from *N. gonorrhoeae*
m658/g658 82.2% identity in 259 aa overlap

```
                  10         20         30         40         50         60
m658.pep  MVSGIVRARGDFVDDQFMRVTDNKHFYRQYADIIQFVRQALRHLPRLLLHVGTQSRGDDG
          ||:|||||| |:|:||| |:||||||||||||||||||:|||||||||| |||||
g658      MVAGIVRARGGFIDEQFMCVADNKHFYRQYADIIQFVRQALRRLPRLLLHVGTQPRGDDG
                  10         20         30         40         50         60

70         80         90        100        110        120
m658.pep  ISQDAVFVDVFGRVESLHVVIVQTAYDYGNFTAQIHHFFQNAIHAAVFGKRGFEFIQCFY
          |||||||||| ||:||| ||||||:||::||:||||||||||||||||||||: |
g658      ISQDAVFVDVFGGVEGLHVFIVQTAYDHGNLAAQVHHFFQNAIHAAVFGKRGFEFVQRFD
                  70         80         90        100        110        120

130        140        150        160        170        180
m658.pep  ADLTFAVVAQRSRFQDAGQKLRACFSDVFSLTNHLIRRGLQSRFAYPCLFLNAVLCNRHT
          |||||||||||||||||||||||||||:|:|:|||||:||| :||||| |||||||:|
g658      ADLTFAVVAQRSRFQDAGQKLRACFSNVFGLANRLIRRGLQACFAYPRFFLNAVLCNGHA
                 130        140        150        160        170        180

190        200        210        220        230        240
m658.pep  IAARGNIGMFCQKAHRIGIDVFKFSGHRRAFCQFVQSSLVVKRRAQMAVGKFCCRRVRIG
          :|| ||:||:|||:|||||||||||:|||||||||: :|||||||||||||| ||:|:|
g658      VAAGGNVGMLCQRAHRVGIDVFKFGRNRRAFCQFVQRGPVVKRRAQMAVGKFRRRRIRVG
                 190        200        210        220        230        240

250        260
m658.pep  VENGYFVAHGFGGNGKHSAX
          :||||||||||:||||||||
g658      IENGYFVAHGFSGNGKHSAX
                 250        260
```

The following partial DNA sequence was identified in *N. meningitidis* <SEQ ID 2139>:

```
a658.seq
  1   ATGGTGGCCG GAATTGTGCG GACGCGGCGC GATTTCGTTG ACGACCAATT

51   CATGCGTGTC GCCGACAACA AACATTTCTA CCGCCAATAC GCCGACGTAG

101   TTCAATTCAT CGGCCAAACG CTGCGCCATT TGTCGCGCCT GTTGCTGAAT

151   GTCGGCACTC AGTCGGGCTG GACGATGGA GTAGGCGAGG ATACCGTTTT

201   CGTGAATGTT TTCGGCAGGA TCGAAAGTTT GCACGTTGTC ATTGTTCAGA

251   CGGCATACGA TAACGGAAAT TTCGCCGCGC AAGTCCACCA TTTTTTCCAA
```

```
-continued
301   AACGCAATCC ACGCCGCGGT GTTCGGCAAA CGCGGCTTTG AGTTCATCCA
351   CCGTTTTGAC GCGGATTTGG CCTTTGCCGT CATAGCCCAA TGTAGCGGTT
401   TTCAGGATGC CGGGCAGAAA TTGTATGCTT TCTTCAGTGA TGTCTTCGGC
451   TTTGCAAATT GCTTGATACG GCGCGGTTTG CAGGCCTGCT TTGCGTATCC
501   ATGCCTTTTC CTGAATGCGG TTTTGCGCGA TGGCAACGCA GTCGCCGCTG
551   GGGGAAACAT TGGTATGTTT GGCGAGAAAA CGCATCGCAT CGGCATTGAC
601   GTTTTCGAAC TCGGTCGTAA CAGCCGCACA TTTTGCCAAT TCTTCCAAAG
651   CGGTTTGGTT GTCAAACGGC GCACACAAAT GGCGGTCGGC AAATTCCGCT
701   GCCGGCGCAT TCGGGTTGGG ATCGAGTACG GTTACTTTGT AGCCCATGGT
751   TTTGGCAGCA ACAGTAAACA TTCTGCCTAA
```

This corresponds to the amino acid sequence <SEQ ID 2140; ORF 658.a>:

```
a658.pep
  1   MVAGIVRTRR DFVDDQFMRV ADNKHFYRQY ADVVQFIGQT LRHLSRLLLN
 51   VGTQSGWDDG VGEDTVFVNV FGRIESLHVV IVQTAYDNGN FAAQVHHFFQ
101   NAIHAAVFGK RGFEFIHRFD ADLAFAVIAQ CSGFQDAGQK LYAFFSDVFG
151   FANCLIRRGL QACFAYPCLF LNAVLRDGNA VAAGGNIGMF GEKTHRIGID
201   VFELGRNSRT FCQFFQSGLV VKRRTQMAVG KFRCRRIRVG IEYGYFVAHG
251   FGSNSKHSA*
``` m658/a658 75.3% identity in 259 aa overlap

```
                 10         20         30         40         50         60
    m658.pep  MVSGIVRARGDFVDDQFMRVTDNKHFYRQYADIIQFVRQALRHLPRLLLHVGTQSRGDDG
              ||:||||:| |||||||||||||||||||||||:||: |:|||| ||||:|||||:|||
    a658      MVAGIVRTRRDFVDDQFMRVADNKHFYRQYADVVQFIGQTLRHLRLLLHNGTQSRGWDDG
                 10         20         30         40         50         60

70         80         90        100        110        120
    m658.pep  ISQDAVFVDVFGRVESLHVVIVQTAYDYGNFTAQIHHFFQNAIHAAVFGKRGFEFIQCFY
              :::|:|||:||||:|||||||||||||||:|||:||||||||||||||||||||||||: |
    a658      VGEDTVFVNVFGRIESLHVVIVQTAYDNGNFAAQVHHFFQNAIHAAVFGKRGFEFIHRFD
                 70         80         90        100        110        120

130        140        150        160        170        180
    m658.pep  ADLTFAVVAQRSRFQDAGQKLRACFSDVFSLTNHLIRRGLQSRFAYPCLFLNAVLCNRHT
              |||:|||:|| | |||||||||:  |||||||:::| ||||||:||||||||||||  :  ::
    a658      ADLAFAVIAQCSGFQDAGQKLYAFFSDVFGFANCLIRRGLQACFAYPCLFLNAVLRDGNA
                130        140        150        160        170        180

190        200        210        220        230        240
    m658.pep  IAARGNIGMFCQKAHRIGIDVFKFSGHRRAFCQFVQSSLVVKRRAQMAVGKFCCRRVRIG
              :|| ||||||:|: ||||||||:::: : |:|||| ||:|||||:||||||||:| : |
    a658      VAAGGNIGMFGEKTHRIGIDVFELGRNSRTFCQFFQSGLVVKRRTQMAVGKFRCRRIRVG
                190        200        210        220        230        240

250        260
    m658.pep  VENGYFVAHGFGGNGKHSAX
              :| |||||||||:|:|||||
    a658      IEYGYFVAHGFGSNSKHSAX
                250        260
```

The following partial DNA sequence was identified in *N. gonorrhoeae* <SEQ ID 2141>:

```
g661.seq
  1   ATGCACATCG GCGGTTATTT TATCGACAAC CCCATCGCAC TTGCGCCGAT
 51   GGCGGGCATT GCCGACAAAC CCTTCCGCCG CCTCTGTCGG GCGTTTGGCG
```

-continued

```
101   CAGGTTGGGC GGTGTGCGAA ATGCTGGCCA GCGATCCGAC GCTCAGGAAT
151   ACCGGAAAAA CCCtgcaccg cagtgaTTTt gccgatgaag gCGGCATCGT
201   TGCCGTGCAG ATTGCCGGCA GCGACCccga acaGATGGCG Gatgcggcgc
251   gttacAACGT CGGACTCGGG GCGCAGGTCA TCGACATcaa TATGGGCTGC
301   cccgccaaGA AAGTGTGCAA CGTCCAAGCC GGTAGCGCgc tGATGCAGGA
351   CGAGccgctg gttgcCgcca tTTtggaggc ggtggtcAAG GCGGCGGgcg
401   TACCCGTTAC cctCAAAACc cgtTtgggtt ggcacgacga cgatcaaaac
451   ctgcCcgccg tcgccaaaat cgccgaagat tgcggcattg ccgcccCttgc
501   cgttccacgg gcgCGCgcgC ACGCAAATGT ACAAAGGCGA GGCgcGTTAC
551   Gaactcatcg CCGAGACCAA AAGccgTCTG AACATCCCGG cctGggtCAA
601   CGGCGACATC actTCgccgc AAAAAGCCGC CGccgTCCTC AAACAAACCG
651   CCGCCGACGG CATCATGATA GGGCGCGGCG CGCAAGGCAG GCCGTGGTTT
701   TTCCGCGATT TGAAGCATTA TGCCGAACAC GGCGTTTTAC CGCCTGCCTT
751   GAGTTTGGCA GAATGCAGAG CCGCCATTTT GAACCACATC CGCGCCATGC
801   ACGCGTTTTA TGGTGAGACC GTCGGTGTGC GCATCGCACG CAAACACATA
851   GGCTGGTACA TCGGCGAAAT GCCCGACGGC GAACAGGCGC GGCGTGA
```

This corresponds to the amino acid sequence <SEQ ID 2142; ORF 661.ng>:

```
g661.pep
  1   MHIGGYFIDN PIALAPMAGI ADKPFRRLCR AFGAGWAVCE MLASDPTLRN
 51   TGKTLHRSDF ADEGGIVAVQ IAGSDPEQMA DAARYNVGLG AQVIDINMGC
101   PAKKVCNVQA GSALMQDEPL VAAILEAVVK AAGVPVTLKT RLGWHDDDQN
151   LPAVAKIAED CGIAALAVPR ARAHANVQRR GALRTHRRDQ KPSEHPGLGQ
201   RRHHFAAKSR RRPQTNRRRR HHDRARRARQ AVVFPRFEAL CRTRRFTACL
251   EFGRMQSRHF EPHPRHARVL WXDRRCAHRT QTHRLVHRRN ARRRTGAA*
```

The following partial DNA sequence was identified in *N. meningitidis* <SEQ ID 2143>:

```
m661.seq
  1   ATGCACATCG GCGGCTATTT TATCGACAAC CCCATCGCAC TTGCGCCGAT
 51   GGCGGGCATT ACCGACAAAC CGTTCCGCCG ACTTTGCCGA GATTTTGGCG
101   CAGGTTGGGC GGTGTGCGAA ATGCTGACCA GCGACCCGAC GCTCAGAAAT
151   ACTAGAAAAA CCTTGCACCG CAGCGATTTT GCCGATGAAG GCGGCATTGT
201   TGCCGTGCAG ATTGCCGGAA GCGATCCGCA GCAGATGGCG GATGCCGCGC
251   GTTACAACGT CAGCCTTGGG GCGCAGCTTA TCGACATCAA CATGGGCTGT
301   CCCGCTAAAA AAGTCTGCAA TGTCCAAGCC GGTAGCGCGC TGATGCAGAA
351   CGAGCCGCTG GTTGCCGCCA TTTTGGAAGC CGTCGTCCGT GCGGCAGGCG
401   TACCCGTTAC CCTCAAAACC CGTTTGGGTT GGCACGACGA CCATCAAAAC
451   CTGCCCGTCA TCGCCAAAAT CGCCGAAGAT TGCGGCATCG CCGCCCTTGC
501   CGTCC.ACGG ACGCACGCGT ACGCAAATGT ACAAAGGCGA AGCGCGTTAC
551   GAACTCATCG CCGAAACCAA ATGCCGTCTG AACATCCCGG TCTGGGTCAA
```

-continued

```
601    CGGCGACATT ACTTCGCCGC AAAAAGCCCA AGCCGTCCTC AAACAAACCG

651    CCGCCGACGG CATTATGATA GGGCGCGGCG CGCAAGGCAG GCCGTGGTTC

701    TTCCGCGATT TGAAACATTA TGCCGAACAC GGTGTTTTGC CGCCTGCCTT

751    GAGTTTGGCA GAATGCGCCG CCGCTATTTT GAACCACATC CGCGCCATAC

801    ACGCGTTTTA CGGCGACACC GCCGGTGTGC GCATCGCACG CAAACACATA

851    GGCTGGTACA TCGACGAAAT GCCCGACGGC GAACAGACAC GTCGTGA
```

This corresponds to the amino acid sequence <SEQ ID 2144; ORF 661>:

```
m661.pep
     1    MHIGGYFIDN PIALAPMAGI TDKPFRRLCR DFGAGWAVCE MLTSDPTLRN

51    TRKTLHRSDF ADEGGIVAVQ IAGSDPQQMA DAARYNVSLG AQLIDINMGC

101    PAKKVCNVQA GSALMQNEPL VAAILEAVVR AAGVPVTLKT RLGWHDDHQN

151    LPVIAKIAED CGIAALAVXR THAYANVQRR SALRTHRRNQ MPSEHPGLGQ

201    RRHYFAAKSP SRPQTNRRRR HYDRARRARQ AVVLPRFETL CRTRCFAACL

251    EFGRMRRRYF EPHPRHTRVL RRHRRCAHRT QTHRLVHRRN ARRRTDTS*
```

Computer analysis of this amino acid sequence gave the following results:
Homology with a Predicted ORF from *N. gonorrhoeae*
m661/g661 88.5% identity in 295 aa overlap

```
                  10         20         30         40         50         60
m661.pep  MHIGGYFIDNPIALAPMAGITDKPFRRLCRDFGAGWAVCEMLTSDPTLRNTRKTLHRSDF
          ||||||||||||||||||||||:||||||||| |||||||||||:||||||||| ||||||
g661      MHIGGYFIDNPIALAPMAGIADKPFRRLCRAFGAGWAVCEMLASDPTLRNTGKTLHRSDF
                  10         20         30         40         50         60

70         80         90        100        110        120
m661.pep  ADEGGIVAVQIAGSDPQQMADAARYNVSLGAQLIDINMGCPAKKVCNVQAGSALMQNEPL
          ||||||||||||||||:||||||||||||:||||:|||||||||||||||||||||||:|||
g661      ADEGGIVAVQIAGSDPEQMADAARYNVGLGAQVIDINMGCPAKKVCNVQAGSALMQDEPL
                  70         80         90        100        110        120

130        140        150        160        170        180
m661.pep  VAAILEAVVRAAGVPVTLKTRLGWHDDHQNLPVIAKIAEDCGIAALAVXRTHAYANVQRR
          |||||||||:||||||||||||||||||:||||::|||||||||||||||| |::|:||||||
g661      VAAILEAVVKAAGVPVTLKTRLGWHDDDQNLPAVAKIAEDCGIAALAVPRARAHANVQRR
                 130        140        150        160        170        180

190        200        210        220        230        240
m661.pep  SALRTHRRNQMPSEHPGLGQRRHYFAAKSPSRPQTNRRRRHYDRARRARQAVVLPRFETL
          :|||||||:| |||||||||||||:|||||:||||| |||||||:|||||||||||:|||:|
g661      GALRTHRRDQKPSEHPGLGQRRHHFAAKSRRRPQTNRRRRHHDRARRARQAVVFPRFEAL
                 190        200        210        220        230        240

250        260        270        280        290    299
m661.pep  CRTRCFAACLEFGRMRRRYFEPHPRHTRVLRRHRRCAHRTQTHRLVHRRNARRRTDTSX
          ||||  |:||||||||:  |:|||||||||||:||| ||||||||||||||||||||||
g661      CRTRRFTACLEFGRMQSRHFEPHPRHARVLWXDRRCAHRTQTHRLVHRRNARRRTGAAX
                 250        260        270        280        290
```

The following partial DNA sequence was identified in *N. meningitidis* <SEQ ID 2145>:

```
a661.seq
     1    ATGCACATCG GCGGCTATTT TATCGACAAC CCCATCGCAC TTGCGCCGAT

51    GGCGGGCATT ACCGACAAAC CGTTCCGCCG ACTTTGCCGA GATTTTGGCG

101    CAGGTTGGGC GGTGTGCGAA ATGCTGACCA GCGACCCGAC GCTCAGAAAT

151    ACTAGAAAAA CCTTGCACCG CAGCGATTTT GCCGATGAAG GCGGCATTGT

201    TGCCGTGCAG ATTGCCGGAA GCGATCCGCA GCAGATGGCG GATGCCGCGC
```

-continued

```
251  GTTACAACGT CAGCCTTGGG GCGCAGCTTA TCGACATCAA CATGGGCTGT

301  CCCGCTAAAA AAGTCTGCAA TGTCCAAGCC GGTAGCGCGC TGATGCAGAA

351  CGAGCCGCTG GTTGCCGCCA TTTTGGAGGC GGTGGTCAAA GCGGCGGGCG

401  TACCCGTTAC CCTCAAAACC CGTTTGGGTT GGCACGACGA CCATCAAAAC

451  CTGCCCGTCA TCGCCAAAAT CGCCGAAGAT TGCGGCATTG CCGCCCTTGC

501  CG.TCCACGG ACGCACGCGC ACGCAAATGT ACAAAGGCGA AGCGGCTTAC

551  GACCTGATTG CCGAAACCAA ATGCCGTCTG AACATCCCGG TCTGGGTCAA

601  CGGCGACATT ACCTCGCCGC AAAAGCCCA AGCCGTCCTC AAACAAACCG

651  CCGCAGACGG CATTATGATA GGGCGCGGCG CGCAAGGCAG ACCGTGGTTC

701  TTCCGCGATT TGAAACATTA CGCCGAACAC GGTGTTTTAC CGCCTGCCTT

751  GAGTTTGGCA AATGTACCG CCACTATTTT GAACCACATC CGAGCCATGC

801  ACGCGTTTTA CGGCGACACC GCCGGTGTGC GCATCGCACG CAAACACATA

851  GGCTGGTACA TCGACGAAAT GCCCGACGGC GAACAGACAC GTCGTGA
```

This corresponds to the amino acid sequence <SEQ ID 2146;
ORF 661.a>:

```
a661.pep
  1  MHIGGYFIDN PIALAPMAGI TDKPFRRLCR DFGAGWAVCE MLTSDPTLRN

51  TRKTLHRSDF ADEGGIVAVQ IAGSDPQQMA DAARYNVSLG AQLIDINMGC

101  PAKKVCNVQA GSALMQNEPL VAAILEAVVK AAGVPVTLKT RLGWHDDHQN

151  LPVIAKIAED CGIAALAXPR THAHANVQRR SGLRPDCRNQ MPSEHPGLGQ

201  RRHYLAAKSP SRPQTNRRRR HYDRARRARQ TVVLPRFETL RRTRCFTACL

251  EFGRMYRHYF EPHPSHARVL RRHRRCAHRT QTHRLVHRRN ARRRTDTS*
``` m661/a661 94.6% identity in 298 aa overlap

```
                  10         20         30         40         50         60
   m661.pep  MHIGGYFIDNPIALAPMAGITDKPFRRLCRDFGAGWAVCEMLTSDPTLRNTRKTLHRSDF
             ||||||||||||||||||||||||||||||||||||||||||||||||||||||||||||
       a661  MHIGGYFIDNPIALAPMAGITDKPFRRLCRDFGAGWAVCEMLTSDPTLRNTRKTLHRSDF
                  10         20         30         40         50         60

70         80         90        100        110        120
   m661.pep  ADEGGIVAVQIAGSDPQQMADAARYNVSLGAQLIDINMGCPAKKVCNVQAGSALMQNEPL
             ||||||||||||||||||||||||||||||||||||||||||||||||||||||||||||
       a661  ADEGGIVAVQIAGSDPQQMADAARYNVSLGAQLIDINMGCPAKKVCNVQAGSALMQNEPL
                  70         80         90        100        110        120

130        140        150        160        170        180
   m661.pep  VAAILEAVVRAAGVPVTLKTRLGWHDDHQNLPVIAKIAEDCGIAALAVXRTHAYANVQRR
             |||||||||:||||||||||||||||||||||||||||||||||    ||||:||||||
       a661  VAAILEAVVKAAGVPVTLKTRLGWHDDHQNLPVIAKIAEDCGIAALAXPRTHAHANVQRR
                 130        140        150        160        170        180

190        200        210        220        230        240
   m661.pep  SALRTHRRNQMPSEHPGLGQRRHYFAAKSPSRPQTNRRRRHYDRARRARQAVVLPRFETL
             |:||   |||||||||||||||||:|||||||||||||||||||||||||:||||||||
       a661  SGLRPDCRNQMPSEHPGLGQRRHYLAAKSPSRPQTNRRRRHYDRARRARQTVVLPRFETL
                 190        200        210        220        230        240

250        260        270        280        290        299
   m661.pep  CRTRCFAACLEFGRMRRRYFEPHPRHTRVLRRHRRCAHRTQTHRLVHRRNARRRTDTSX
             |||||:|||||| |:||||| |:|||||||||||||||||||||||||||||||||||
       a661  RRTRCFTACLEFGRMYRHYFEPHPSHARVLRRHRRCAHRTQTHRLVHRRNARRRTDTSX
                 250        260        270        280        290
```

The following partial DNA sequence was identified in *N. gonorrhoeae* <SEQ ID 2147>:

```
g663.seq
    1   ATGTGTACCG AGATGAAATT TATATTTTTT GTACTGTATG TTTTGCAGTT
   51   TCTGCCGTTT GCGCTGCTGC ACAAGATTGC CGGCCTGATC GGTTCGCTTG
  101   CCTACCTTCT GGTCAAACCG CGCCGCCGTA TCGGCGAAAT CAATTTGGCA
  151   AAATGTTTTC CCGAATGGGA CGAAGAAAAG CGTAAAACCG TGTTGAAACA
  201   GCATTTCAAA CACATGGCAA AACTGATGCT CGAATACGGC TTATATTGGT
  251   ACGCGtctGC CAAATGCCTG AAATCGCTGG TGCGCTACCG CAATAAGCAT
  301   TATTTGGACG ACGCGCTGGC GGCGGGGGAA AAAGTCATCA TCCTGTACCC
  351   GCACTTTACC GCGTTCGAGA TGGCGGTGTA CGCGCTTAAT CAGGATGTCC
  401   CGCTGATCAG TATGTATTCC CACCAAAAAA ACAAGATATT GGACGAACAG
  451   ATTTTGAAAg gccgcaACCG CTATCACAAC GTCTTCCTTA TCGGGCGCAC
  501   CGAagggctg cgCGCCCtcg TCAAACAGTT CCGCAAAAGC AGTGCGCCGT
  551   TCCTGTATCT GCCCGATCAG GATTCGGAC GCAACAATTC GGTTTTTGTG
  601   GATTTTTCG GCATtcagaC GGCAACGATT ACCGGCTTGA GCCGCATTGC
  651   CGCGCTTGCA AATGCAAAAG TGATACCCGC CATTCCCGTC CGCGAGGCGG
  701   ACAATACGGT TACATTGCAA TTCTATCCCG CTTGGAAATC CTTTCCGAGT
  751   GAAGACGCGC AAGCCGACGC GCAACGTATG AACCGCTTTA TCGAAGAACG
  801   CGTGCGCGAA CACCCGGAAC AATATTTCTG GCTGCACAAG CGTTTCAAAA
  851   CCCGTCCGGA AGGCAGCCCC GATTTTACT GA
```

This corresponds to the amino acid sequence <SEQ ID 2148; ORF 663.ng>:

```
g663.pep
    1   MCTEMKFIFF VLYVLQFLPF ALLHKIAGLI GSLAYLLVKP RRRIGEINLA
   51   KCFPEWDEEK RKTVLKQHFK HMAKLMLEYG LYWYASAKCL KSLVRYRNKH
  101   YLDDALAAGE KVIILYPHFT AFEMAVYALN QDVPLISMYS HQKNKILDEQ
  151   ILKGRNRYHN VFLIGRTEGL RALVKQFRKS SAPFLYLPDQ DFGRNNSVFV
  201   DFFGIQTATI TGLSRIAALA NAKVIPAIPV READNTVTLQ FYPAWKSFPS
  251   EDAQADAQRM NRFIEERVRE HPEQYFWLHK RFKTRPEGSP DFY*
```

The following partial DNA sequence was identified in *N. meningitidis* <SEQ ID 2149>:

```
m663.seq
    1   ATGTGTATCG AGATGAAATT TATATTTTTT GTACTGTATG TTTTGCAGTT
   51   TCTGCCGTTT GCGCTGCTGC ACAAGATTGC CGACCTGACG GGTTTGCTTG
  101   CCTACCTTCT GGTCAAACCG CGCCGCCGTA TCGGCGAAAT CAATTTGGCA
  151   AAATGTTTTT CCGAATGGAG TGAGGAAAAG CGTAAAACCG TGTTGAAACA
  201   GCATTTCAAA CACATGGCGA AACTGATGTT GGAATACGGT TTATATTGGT
  251   ACGCGCCTGC CGGACGTTTG AAATCGCTGG TGCGCTACCG CAATAAGCAT
  301   TATTTGGACG ACGCGCTGGC GGCGGGGGAA AAAGTCATCA TCCTGTATCC
  351   GCACTTCACC GCGTTCGAGA TGGCGGTGTA CGCGCTTAAT CAGGATATCC
  401   CGCTGATCAG TATGTATTCC CATCAAAAAA ACAAGATATT GGACGAACAG
  451   ATTTTGAAAG GCCGCAACCG CTATCACAAC GTCTTCCTTA TCGGGCGCAC
```

-continued

```
501  CGAAGGGCTG CGCGCCCTCG TCAAACAGTT CCGCAAAAGC AGCGCGCCGT
551  TTCTGTATCT GCCCGATCAG GATTTCGGAC GCAACGATTC GGTTTTTGTG
601  GATTTTTTCG GTATTCAGAC GGCAACGATT ACCGGATTGA GCCGCATTGC
651  CGCGCTTGCA AATGCAAAAG TGATACCCGC CATTCCCGTC CGCGAGGCAG
701  ACAATACGGT TACATTGCAT TTCTACCCTG CTTGGAAATC CTTTCCGGGT
751  GAAGACGCGA AAGCCGACGC GCAGCGCATG AACCGTTTTA TCGAAGACAG
801  GGTGCGCGAA CATCCGGAAC AATATTTTTG GCTGCACAAG CGTTTTAAAA
851  CCCGTCCGGA AGGCAGCCCC GATTTTTACT GA
```

This corresponds to the amino acid sequence <SEQ ID 2150; ORF 663>:

```
m663.pep
  1  MCIEMKFIFF VLYVLQFLPF ALLHKIADLT GLLAYLLVKP RRRIGEINLA
 51  KCFSEWSEEK RKTVLKQHFK HMAKLMLEYG LYWYAPAGRL KSLVRYRNKH
101  YLDDALAAGE KVIILYPHFT AFEMAVYALN QDIPLISMYS HQKNKILDEQ
151  ILKGRNRYHN VFLIGRTEGL RALVKQFRKS SAPFLYLPDQ DFGRNDSVFV
201  DFFGIQTATI TGLSRIAALA NAKVIPAIPV READNTVTLH FYPAWKSFPG
251  EDAKADAQRM NRFIEDRVRE HPEQYFWLHK RFKTRPEGSP DFY*
```

Computer analysis of this amino acid sequence gave the following results:
Homology with a Predicted ORF from *N. gonorrhoeae*
m663/g663 94.9% identity in 293 aa overlap

```
                10         20         30         40         50         60
m663.pep  MCIEMKFIFFVLYVLQFLPFALLHKIADLTGLLAYLLVKPRRRIGEINLAKCFSEWSEEK
          ||  ||||||||||||||||||||||||| | |||||||||||||||||||||||| :|||
g663      MCTEMKFIFFVLYVLQFLPFALLHKIAGLIGSLAYLLVKPRRRIGEINLAKCFPEWDEEK
                10         20         30         40         50         60

70         80         90        100        110        120
m663.pep  RKTVLKQHFKHMAKLMLEYGLYWYAPAGRLKSLVRYRNKHYLDDALAAGEKVIILYPHFT
          |||||||||||||||||||||||||| |  ||||||||||||||||||||||||||||||
g663      RKTVLKQHFKHMAKLMLEYGLYWYASAKCLKSLVRYRNKHYLDDALAAGEKVIILYPHFT
                70         80         90        100        110        120

130        140        150        160        170        180
m663.pep  AFEMAVYALNQDIPLISMYSHQKNKILDEQILKGRNRYHNVFLIGRTEGLRALVKQFRKS
          |||||||||||:||||||||||||||||||||||||||||||||||||||||||||||||
g663      AFEMAVYALNQDVPLISMYSHQKNKILDEQILKGRNRYHNVFLIGRTEGLRALVKQFRKS
               130        140        150        160        170        180

190        200        210        220        230        240
m663.pep  SAPFLYLPDQDFGRNDSVFVDFFGIQTATITGLSRIAALANAKVIPAIPVREADNTVTLH
          |||||||||||||||:||||||||||||||||||||||||||||||||||||||||||:
g663      SAPFLYLPDQDFGRNNSVFVDFFGIQTATITGLSRIAALANAKVIPAIPVREADNTVTLQ
               190        200        210        220        230        240

250        260        270        280        290
m663.pep  FYPAWKSFPGEDAKADAQRMNRFIEDRVREHPEQYFWLHKRFKTRPEGSPDFYX
          ||||||||| :|||:|||||||||||  :|||||||||||||||||||||||||
g663      FYPAWKSFPSEDAQADAQRMNRFIEERVREHPEQYFWLHKRFKTRPEGSPDFYX
               250        260        270        280        290
```

The following partial DNA sequence was identified in *N. meningitidis* <SEQ ID 2151>:

```
a663.seq
  1  ATGTGTATCG AGATGAAATT TATATTTTTT GTACTGTATG TTTTGCAGTT
 51  TCTGCCGTTT GCGCTGCTGC ACAAACTTGC TGATCTGACA GGCTTGCTCG
```

```
101  CCTACCTTTT GGTCAAACCC CGCCGCCGTA TCGGCGAAAT CAATTTGGCA

151  AAATGCTTTC CCGAGTGGGA CGGAAAAAAG CGTAAAACCG TGTTGAAACA

201  GCATTTCAAA CATATGGCGA AACTGATGTT GGAATACGGT TTATATTGGT

251  ACGCGCCCGC CGGGCGTTTG AAATCACTGG TGCGCTACCG CAACAAACAT

301  TATTTGGACG ACGCTCTGGC GGCAGGGGAA AAAGTCATCA TCCTGTATCC

351  GCACTTCACC GCGTTCGAGA TGGCGGTGTA CGCGCTCAAT CAGGATGTTC

401  CGCTGATCAG TATGTATTCC CACCAAAAAA ACAAGATATT GGACGAACAG

451  ATTTTGAAAG GCCGCAACCG CTATCACAAC GTTTTCCTTA TCGGGCGCAC

501  CGAAGGGCTG CGCGCCCTCG TCAAACAGTT CCGCAAAAGC AGCGCGCCGT

551  TTCTGTATCT GCCCGATCAG GATTTCGGAC GCAACGATTC GGTTTTTGTC

601  GATTTCTTCG GTATTCGGAC GGCAACGATT ACCGGCTTGA GCCGCATTGC

651  CGCGCTTGCA AATGCAAAAG TGATACCCGC CATCCCTGTC CGCGAGGCGG

701  ACAATACGGT TACATTGCAT TTCTACCCTG CTTGGGAATC CTTTCCGAGT

751  GAAGATGCGC AGGCCGACGC GCAGCGCATG AACCGTTTTA TCGAGGAACG

801  CGTGCGCGAA CATCCCGAGC AGTATTTTTG GCTGCACAAG CGTTTCAAAA

851  CCCGTCCGGA AGGCAGCCCC GATTTTTACT GA
```

This corresponds to the amino acid sequence <SEQ ID 2152; ORF 663.a>:

```
a663.pep
   1 MCIEMKFIFF VLYVLQFLPF ALLHKLADLT GLLAYLLVKP RRRIGEINLA

51 KCFPEWDGKK RKTVLKQHFK HMAKLMLEYG LYWYAPAGRL KSLVRYRNKH

101 YLDDALAAGE KVIILYPHFT AFEMAVYALN QDVPLISMYS HQKNKILDEQ

151 ILKGRNRYHN VFLIGRTEGL RALVKQFRKS SAPFLYLPDQ DFGRNDSVFV

201 DFFGIRTATI TGLSRIAALA NAKVIPAIPV READNTVTLH FYPAWESFPS

251 EDAQADAQRM NRFIEERVRE HPEQYFWLHK RFKTRPEGSP DFY*
``` m663/a663 96.2% identity in 293 aa overlap

```
                   10         20         30         40         50         60
   m663.pep  MCIEMKFIFFVLYVLQFLPFALLHKIADLTGLLAYLLVKPRRRIGEINLAKCFSEWSEEK
             ||||||||||||||||||||||||:||||||||||||||||||||||||||  ||  : |
       a663  MCIEMKFIFFVLYVLQFLPFALLHKLADLTGLLAYLLVKPRRRIGEINLAKCFPEWDGKK
                   10         20         30         40         50         60

70         80         90        100        110        120
   m663.pep  RKTVLKQHFKHMAKLMLEYGLYWYAPAGRLKSLVRYRNKHYLDDALAAGEKVIILYPHFT
             ||||||||||||||||||||||||||||||||||||||||||||||||||||||||||||
       a663  RKTVLKQHFKHMAKLMLEYGLYWYAPAGRLKSLVRYRNKHYLDDALAAGEKVIILYPHFT
                   70         80         90        100        110        120

130        140        150        160        170        180
   m663.pep  AFEMAVYALNQDIPLISMYSHQKNKILDEQILKGRNRYHNVFLIGRTEGLRALVKQFRKS
             |||||||||||:||||||||||||||||||||||||||||||||||||||||||||||||
       a663  AFEMAVYALNQDVPLISMYSHQKNKILDEQILKGRNRYHNVFLIGRTEGLRALVKQFRKS
                  130        140        150        160        170        180

190        200        210        220        230        240
   m663.pep  SAPFLYLPDQDFGRNDSVFVDFFGIQTATITGLSRIAALANAKVIPAIPVREADNTVTLH
             |||||||||||||||||||||||||:||||||||||||||||||||||||||||||||||
       a663  SAPFLYLPDQDFGRNDSVFVDFFGIRTATITGLSRIAALANAKVIPAIPVREADNTVTLH
                  190        200        210        220        230        240

250        260        270        280        290
   m663.pep  FYPAWKSFPGEDAKADAQRMNRFIEDRVREHPEQYFWLHKRFKTRPEGSPDFYX
             |||||:|||:|||:||||||||||||:||||||||||||||||||||||||||
       a663  FYPAWESFPSEDAQADAQRMNRFIEERVREHPEQYFWLHKRFKTRPEGSPDFYX
                  250        260        270        280        290
```

The following partial DNA sequence was identified in *N. gonorrhoeae* <SEQ ID 2153>:

```
g664.seq
     1  ATGATACATC CGCACCACTT CCGCGCCTTT TTCATAAACG GTCATGGTGT

51  AGAAATTGTT CATCTCCTCA TAGCTGAcgg gGCGCACCGG ATGGGCGGTC

101  GGGCCTGCGT CTTCGGGGAA CTGGTTCTGG CGCAGCAGGC GGATGTTCTC

151  GATGCGGCGC ACGGCGCGGC CGGCGCGGTC GCCGGAAAAC TCTTGGTCGC

201  GGAACACGGT CAGCCCTTCC TTCAGCGAAA GCTGGAACCA GTCGCGGCAG

251  GTTACGCGGT TGCCCGTCCA GTTGTGGAAA TATTCGTGTC CGACCACGGA

301  TTCAATGCCT TCGAAATCGG TATCGGTGGC GGTGCGGCTG TCGGCGAGGA

351  CGAACTTGGT GTTAAAAATG TTCAAACCCT TGTTTTCCAT CGCGCCCATA

401  TTGAAATCGC CTACGGCGAC GACCATGAaa atatccaagt cataTTCcaa 451  cCcgaagcgc gtttcgtcCc acttcatcgC gtTTTTTCAA cgaTTCCACG

501  GCAAAGCCGA CCTTGGGTTT GTCCGCTTCG GTGGTGTAAA ACTCGATTTT

551  GA
```

This corresponds to the amino acid sequence <SEQ ID 2154; ORF 664.ng>:

```
g664.pep
     1  MIHPHHFRAF FINGHGVEIV HLLIADGAHR MGGRACVFGE LVLAQQADVL

51  DAAHGAAGAV AGKLLVAEHG QPFLQRKLEP VAAGYAVARP VVEIFVSDHG

101  FNAFEIGIGG GAAVGEDELG VKNVQTLVFH RAHIEIAYGD DHENIQVIFQ

151  PEARFVPLHR VFSTIPRQSR PWVCPLRWCK TRF*
```

The following partial DNA sequence was identified in *N. meningitidis* <SEQ ID 2155>:

```
m664.seq
     1  GTGATACATC CGCACTACTT CCGCGCCTTT TTCATAAACG GTCATGGTGT

51  AGAAATTGTT CATCTCCTCA TAGCTGGCGG GGCGCACCGG ATGGGCGGTC

101  GGGCCTGCGT CTTCGGGGAA CTGGTGCTGG CGCAGCAGGC GGATGTTTTC

151  GATGCGGCGC ACGGCGCGGC TGGCGCGGTC GCCGGAAAAT TCTTGGTCGC

201  GGAACACGGT CAGCCCTTCC TTCAGCGAAA GCTGGAACCA GTCGCGGCAG

251  GTTACGCGGT TGCCCGTCCA GTTGTGGAAA TACTCGTGTC CGACCACGGA

301  TTCGATGCCT TCGAAATCGG TATCGGTGGC GGTGCGGCTG TCGGCAAGGA

351  CGAACTTGGT GTTAAAGATG TTCAAACCCT TGTTTTCCAT CGCGCCCATA

401  TTGAAATCGC CCACGGCGAC GACCATGAAA ATATCCAAGT CGTATTCCAA

451  ACCGAAGCGC GTTTCGTCCC ATTTCATCGC GTTTTT.CAA CGATTCCACG

501  GCAAAGCCGA CCTTGGGCTT GTCCGCTTCG GTGGTGTAAA ACTCGATTTT

551  GA
```

This corresponds to the amino acid sequence <SEQ ID 2156; ORF 664>:

```
m664.pep
     1   VIHPHYFRAF FINGHGVEIV HLLIAGGAHR MGGRACVFGE LVLAQQADVF

51   DAAHGAAGAV AGKFLVAEHG QPFLQRKLEP VAAGYAVARP VVEILVSDHG

101   FDAFEIGIGG GAAVGKDELG VKDVQTLVFH RAHIEIAHGD DHENIQVVFQ

151   TEARFVPFHR VFXTIPRQSR PWACPLRWCK TRF*
```

Computer analysis of this amino acid sequence gave the following results:

Homology with a Predicted ORF from *N. gonorrhoeae*
m664/g664 91.8% identity in 183 aa overlap

```
                    10         20         30         40         50         60
m664.pep   VIHPHYFRAFFINGHGVEIVHLLIAGGAHRMGGRACVFGELVLAQQADVFDAAHGAAGAV
           :||||:|||||||||||||||||||| ||||||||||||||||||||||||:||||||||
g664       MIHPHHFRAFFINGHGVEIVHLLIADGAHRMGGRACVFGELVLAQQADVLDAAHGAAGAV
                    10         20         30         40         50         60

70         80         90        100        110        120
m664.pep   AGKFLVAEHGQPFLQRKLEPVAAGYAVARPVVEILVSDHGFDAFEIGIGGGAAVGKDELG
           |||:||||||||||||||||||||||||||||||:|||||||:|||||||||||:||||
g664       AGKLLVAEHGQPFLQRKLEPVAAGYAVARPVVEIFVSDHGFNAFEIGIGGGAAVGEDELG
                    70         80         90        100        110        120

130        140        150        160        170        180
m664.pep   VKDVQTLVFHRAHIEIAHGDDHENIQVVFQTEARFVPFHRVFXTIPRQSRPWACPLRWCK
           ||:|||||||||||||:|||||||||:||  ||||||:|||||:||||||||:|||||||
g664       VKNVQTLVFHRAHIEIAYGDDHENIQVIFQPEARFVPLHRVFSTIPRQSRPWVCPLRWCK
                   130        140        150        160        170        180 m664.pep   TRFX
           ||||
g664       TRFX
```

The following partial DNA sequence was identified in *N. meningitidis* <SEQ ID 2157>:

```
a664.seq
     1   GTGATACATC CGCACCACTT CCGCGCCTTT TTCATAAACG GTCATGGTGT

51   AGAAATTGTT CATCTCCTCA TATCGGGCGG GGCGCACCGG ATGTGCGGTC

101   GGACCTGCGT CTTCGGGGAA CTGGTGCTGG CGCAGCAGGC GGATGTTTTC

151   GATACGGCGC ACGGCGCGGC TGGCGCGGTC GCCGGAAAAT TCTTGGTCGC

201   GGAACACGGT CAACCCTTCC TTCAGCGAAA GCTGGAACCA GTCGCGGCAG

251   GTCACGCGGT TGCCCGTCCA GTTGTGGAAA TATTCGTGTC CGACCACGGA

301   TTCGATGCCT TCAAAATCGG TATCGGTGGC GGTACGGCTG TCGGCAAGGA

351   CGAACTTGGT GTTAAAGATG TTCAAACCCT TGTTTTCCAT CGCACCCATA

401   TTGAAATCGC CCACGGCGAC GACCATGAAA ATATCCAAGT CGTATTCCAA

451   ACCGAAGCGC GTTTCGTCCC ACTTCATTGC GTTTTT.CAG CGATTCCACG

501   GCAAAGCCGA CCTTGGGCTT GTCCGCTTCG GTGGTGTAAA ACTCGATTTT

551   GA
```

This corresponds to the amino acid sequence <SEQ ID 2158; ORF 664.a>:

```
a664.pep
     1   VIHPHHFRAF FINGHGVEIV HLLISGGAHR MCGRTCVFGE LVLAQQADVF

51   DTAHGAAGAV AGKFLVAEHG QPFLQRKLEP VAAGHAVARP VVEIFVSDHG

101   FDAFKIGIGG GTAVGKDELG VKDVQTLVFH RTHIEIAHGD DHENIQVVFQ

151   TEARFVPLHC VFXAIPRQSR PWACPLRWCK TRF*
``` m664/a664 92.9% identity in 183 aa overlap

```
                 10        20        30        40        50        60
   m664.pep  VIHPHYFRAFFINGHGVEIVHLLIAGGAHRMGGRACVFGELVLAQQADVFDAAHGAAGAV
              ||||:||||||||||||||||||:|||||| ||:||||||||||||||||:|||||||
   a664      VIHPHHFRAFFINGHGVEIVHLLISGGAHRMCGRTCVFGELVLAQQADVFDTAHGAAGAV
                 10        20        30        40        50        60

70        80        90       100       110       120
   m664.pep  AGKFLVAEHGQPFLQRKLEPVAAGYAVARPVVEILVSDHGFDAFEIGIGGGAAVGKDELG
              |||||||||||||||||||||||:|||||||||:|||||||||:|||||||:||||||
   a664      AGKFLVAEHGQPFLQRKLEPVAAGHAVARPVVEIFVSDHGFDAFKIGIGGGTAVGKDELG
                 70        80        90       100       110       120

130       140       150       160       170       180
   m664.pep  VKDVQTLVFPHRAHIEIAHGDDHENIQVVFQTEARFVPFHRVFXTIPRQSRPWACPLRWCK
              ||||||||||:|||||||||||||||||||||||||:| ||||:|||||||||||||||
   a664      VKDVQTLVFPHRTHIEIAHGDDHENIQVVFQTEARFVPLHCVFXAIPRQSRPWACPLRWCK
                130       140       150       160       170       180 m664.pep  TRFX
              ||||
   a664      TRFX
```

The following partial DNA sequence was identified in *N. gonorrhoeae* <SEQ ID 2159>:

```
g665.seq
    1    atgaagtgGg acgaaacgcg cttcgGgttg GAAtatgact tggatatttT
   51    CATGGTCGTC GCCGTAGGCG ATTTCAATAT GGGCGCGATG GAAAACAAGG
  101    GTTTGAACAT TTTTAACACC AAGTTCGTCC TCGCCGACAG CCGCACCGCC
  151    ACCGATACCG ATTTCGAAGG CATTGAATCC GTGGTCGGAC ACGAATATTT
  201    CCACAACTGG ACGGGCAACC GCGTAACCTG CCGCGACTGG TTCCAGCTTT
  251    CGCTGAAGGA AGGGCTGACC GTGTTCCGCG ACCAAGAGTT TTCCGGCGAC
  301    CGCGCCGGCC GCGCCGTGCG CCGCATCGAG AACATCCGCC TGCTGCGCCA
  351    GAACCAGTTC CCCGAAGACG CAGGCCCGAC CGCCCATCCG GTGCGCcccg
  401    TCAGCTATGA GGAGATGAAC AATTTCTACA CCATGACCGT TTATGAAAAA
  451    GGCGCGGAAG TGGTGCGGAT GTATCATACC CTGCTCGGCG AAGAGGGCTT
  501    CCAAAAAGGC ATGAAGCTAT ATTTCcaacg CCACGACGGA CAGGCAGTGA
  551    CCTGCGACGA TTTCCGCGCG GCGatggcgg ATGCGAACGG CATCAATCTC
  601    GACCAGTTCG CCTTGTGGTA CAGCCAGGCG GGCACGCCCG TTTTGGAAGC
  651    CGAAGGCCGT CTGAAAAACA ATGTTTTCGA GTTAACCATT AAACAAACCG
  701    TGCCGCCCAC GCCCGATATG GCGGACAAAC AGCCGATGAT GATTCCCGTC
  751    AAAGTCGGGC TTCTGAACCG CAACGGCGAA GCGGTGGCAT TCGATTATCA
  801    GGGCAAACGC GCAACCGAAG CCGTGTTGCT GATGACCGAA GCCGAACagg
  851    CCTTCCCGCT CGAAGGTGTA ACCGAAGCCG TCGTTCCCTC GCTGCTGCGC
  901    GGGTTCAGCG CGCCAGTGTA TCTGAACTAT CCGTACAGCG ACGACGACCT
  951    GCTGCTCCTG CTCGCCCACG ACAGCGACGC TTTCACGTGC TGGGAAGCCG
 1001    CCCAAACGCT CTACCGTCGC GCCGTCGCCG CCAACCTTGC CGCGCTTTCA
 1051    GACGGCATCG GGTTGCCGAA ACACGAAAAA CTGCTTGCCG CCGTCGAAAA
 1101    AGTCATTTCA GACGACCTCT TGGACAACGC CTTCAAAGCC CTGCTTTTGG
 1151    GCGTGCCGTC CGAAGCCGAa ctGTGGGACG GCACGGAAAA CATcgaCCCG
 1201    CTGCGCTACC ATCAGGCGCG CGAAGCCTTG TTGGATACGC TTGCCGtcCG
 1251    CttcctgcCG AAATGGCACG AATTGGaccg tcaggcggcg aagCAggaaa
```

```
-continued
1301  accaaagtTA CGAATACAGC CCCGAAACCG CCGACTGGCG CACGCTGCGC

1351  AACGTCTGCC GCGCCTtcgt cctGCGCGCC GACCCCGCGC acatcgAAAC

1401  TGTTGCCGAA Aaatacggcg AAATGGCGCA AAACATGACC CACGAATGGG

1451  GCATCCTGTC CGCCGTCAAC GGCAACGAAA GCGATACGCG CAACTGCCTG

1501  CTGGCGCAGT TTGCCGAcaa gTtttcAGAC GACGCGCTGG TGATGGACAA

1551  ATATTTCGCC CTTATCGGCT CAAGccgccg cagCGACACC CTGCAACAGG

1601  TTCAAACCGC CTTGCAGCAT CCGAAATTCA GTCTCGAAAA CCCCAACAAA

1651  GCCCGTTCGC TCATCGGCAG CTTCAGCCGC AACGTCCCGC ATTTTCACGC

1701  ACAAGACGGC AGCGGCTACC GCTTCATCGC CGACAAAGTC ATCGAAATCG

1751  ACCGCTTCAA cCCGCAggtc gccGCCCGCC TGGTGCAGGC GTTCAACCTC

1801  TGCAACAAGC TCGAGCCGCA CCGCAAAAAC TTgGTGAAAC AAGAATTGCA

1851  GTGCATTCGG GCGCAGGAAG GATTGTCGAA AGacGTGGGC GAaatcgtCG

1901  GCAAGATTTT GGGTTGA
```

This corresponds to the amino acid sequence <SEQ ID 2160; ORF 665.ng>:

```
g665.pep
   1  MKWDETRFGL EYDLDIFMVV AVGDFNMGAM ENKGLNIFNT KFVLADSRTA

51  TDTDFEGIES VVGHEYFHNW TGNRVTCRDW FQLSLKEGLT VFRDQEFSGD

101  RAGRAVRRIE NIRLLRQNQF PEDAGPTAHP VRPVSYEEMN NFYTMTVYEK

151  GAEVVRMYHT LLGEEGFQKG MKLYFQRHDG QAVTCDDFRA AMADANGINL

201  DQFALWYSQA GTPVLEAEGR LKNNVFELTI KQTVPPTPDM ADKQPMMIPV

251  KVGLLNRNGE AVAFDYQGKR ATEAVLLMTE AEQAFPLEGV TEAVVPSLLR

301  GFSAPVYLNY PYSDDDLLLL LAHDSDAFTC WEAAQTLYRR AVAANLAALS

351  DGIGLPKHEK LLAAVEKVIS DDLLDNAFKA LLLGVPSEAE LWDGTENIDP

401  LRYHQAREAL LDTLAVRFLP KWHELDRQAA KQENQSYEYS PETADWRTLR

451  NVCRAFVLRA DPAHIETVAE KYGEMAQNMT HEWGILSAVN GNESDTRNCL

501  LAQFADKFSD DALVMDKYFA LIGSSRRSDT LQQVQTALQH PKFSLENPNK

551  ARSLIGSFSR NVPHFHAQDG SGYRFIADKV IEIDRFNPQV AARLVQAFNL

601  CNKLEPHRKN LVKQELQCIR AQEGLSKDVG EIVGKILG*
```

The following partial DNA sequence was identified in *N. meningitidis* <SEQ ID 2161>:

```
m665.seq
   1  ATGAAATGGG ACGAAACGCG CTTCGGTTTG GAATACGACT TGGATATTTT

51  CATGGTCGTC GCCGTGGGCG ATTTCAATAT GGGCGCGATG GAAAACAAGG

101  GTTTGAACAT CTTTAACACC AAGTTCGTCC TTGCCGACAG CCGCACCGCC

151  ACCGATACCG ATTTCGAAGG CATCGAATCC GTGGTCGGAC ACGAGTATTT

201  CCACAACTGG ACGGGCAACC GCGTAACCTG CCGCGACTGG TTCCAGCTTT

251  CGCTGAAGGA AGGGCTGACC GTGTTCCGCG ACCAAGAATT TTCCGGCGAC

301  CGCGCCAGCC GCGCCGTGCG CCGCATCGAA AACATCCGCC TGCTGCGCCA

351  GCACCAGTTC CCCGAAGACG CAGGCCCGAC CGCCCATCCG GTGCGCCCCG
```

```
-continued
 401 CCAGCTATGA GGAGATGAAC AATTTCTACA CCATGACCGT TTATGAAAAA

451 GGCGCGGAAG TAGTGCGGAT GTATCACACC CTGCTCGGCG AAGAGGGCTT

501 CCAGAAAGGC ATGAAGCTCT ATTTCCAACG CCACGACGGA CAGGCCGTTA

551 CCTGCGACGA TTTCCGCGCG GCGATGGCGG ACGCGAACGG CATCAATCTC

601 GACCAGTTCG CCTTGTGGTA CAGCCAGGCG GGCACGCCCG TTTTGGAAGC

651 GGAAGGTCGT CTGAAAAACA ATATTTTCGA GTTGACCGTC AAACAAACCG

701 TGCCGCCCAC GCCCGATATG ACGGATAAAC AGCCGATGAT GATTCCCGTC

751 AAGGTCGGGC TGCTGAACCG CAACGGCGAA GCGGTGGCAT TCGACTATCA

801 GGGCAAACGC GCGACCGAAG CCGTGTTGCT GCTGACCGAA GCCGAACAGA

851 CCTTCCTGCT CGAAGGCGTA ACCGAAGCCG TCGTTCCCTC GCTGCTGCGC

901 GGGTTCAGCG CGCCGGTGCA TCTGAACTAT CCGTACAGCG ACGACGACCT

951 GCTGCTCCTG CTCGCCCATG ACAGCGACGC CTTCACGCGC TGGGAAGCCG

1001 CCCAAACGCT CTACCGCCGC GCCGTCGCCG CCAACCTTGC CACGCTTTCA

1051 GACGGCGTTG AGCTGCCGAA ACACGAAAAA CTGCTTGCCG CCGTCGAAAA

1101 AGTCATTTCA GACGACCTCT TAGACAACGC CTTCAAAGCC CTGCTTTTGG

1151 GCGTGCCATC CGAAGCCGAG CTGTGGGACG CGCAGAAAAA CATCGACCCG

1201 CTGCGCTACC ATCAGGCGCG CGAAGCCTTG TTGGATACGC TTGCCGTCCA

1251 CTTCCTGCCG AAATGGCACG AATTGAACCG TCAGGCGGCG AAGCAGGAAA

1301 ACCAAAGCTA CGAATACAGC CCCGAAGCCG CCGGCTGGCG CACGCTGCGC

1351 AACGTCTGCC GCGCCTTTGT CCTGCGCGCC GACCCCGCGC ACATCGAAAC

1401 CGTTGCCGAA AAATACGGCG AAATGGCGCA AAACATGACC CACGAATGGG

1451 GCATCCTGTC CGCCGTCAAC GGCAACGAAA GCGATACGCG CAACCGCCTG

1501 CTGGCGCAGT TGCCGACAA GTTTTCAGAC GACGCGCTGG TGATGGACAA

1551 ATATTTTGCC CTCGTCGGCT CAAGCCGCCG CAGCGACACC CTGCAACAGG

1601 TTCGAACCGC CTTGCAGCAT CCGAAATTCA GCCTCGAAAA CCCCAACAAA

1651 GCCCGTTCGC TCATCGGCAG CTTCAGCCGC AACGTCCCGC ATTTCCACGC

1701 AGAAGACGGC AGCGGCTACC GCTTCATCGC CGACAAAGTC ATCGAAATCG

1751 ACCGCTTCAA CCCGCAGGTC GCCGCCCGCT TAGTGCAGGC GTTCAACCTC

1801 TGCAACAAGC TCGAGCCGCA CCGCAAAAAC TTGGTGAAAC AAGCATTGCA

1851 GCGCATTCGG GCGCAGGAAG GATTGTCGAA AGACGTGGGC GAAATCGTCG

1901 GCAAAATTTT GGATTGA
```

This corresponds to the amino acid sequence <SEQ ID 2162; ORF 665>:

```
m665.pep
    1  MKWDETRFGL EYDLDIFMVV AVGDFNMGAM ENKGLNIFNT KFVLADSRTA

51  TDTDFEGIES VVGHEYFHNW TGNRVTCRDW FQLSLKEGLT VFRDQEFSGD

101  RASRAVRRIE NIRLLRQHQF PEDAGPTAHP VRPASYEEMN NFYTMTVYEK

151  GAEVVRMYHT LLGEEGFQKG MKLYFQRHDG QAVTCDDFRA AMADANGINL

201  DQFALWYSQA GTPVLEAEGR LKNNIFELTV KQTVPPTPDM TDKQPMMIPV

251  KVGLLNRNGE AVAFDYQGKR ATEAVLLLTE AEQTFLLEGV TEAVVPSLLR
```

```
-continued
301  GFSAPVHLNY PYSDDDLLLL LAHDSDAFTR WEAAQTLYRR AVAANLATLS

351  DGVELPKHEK LLAAVEKVIS DDLLDNAFKA LLLGVPSEAE LWDGAENIDP

401  LRYHQAREAL LDTLAVHFLP KWHELNRQAA KQENQSYEYS PEAAGWRTLR

451  NVCRAFVLRA DPAHIETVAE KYGEMAQNMT HEWGILSAVN GNESDTRNRL

501  LAQFADKFSD DALVMDKYFA LVGSSRRSDT LQQVRTALQH PKFSLENPNK

551  ARSLIGSFSR NVPHFHAEDG SGYRFIADKV IEIDRFNPQV AARLVQAFNL

601  CNKLEPHRKN LVKQALQRIR AQEGLSKDVG EIVGKILD*
```

Computer analysis of this amino acid sequence gave the following results:

Homology with a Predicted ORF from *N. gonorrhoeae*
m665/g665 96.1% identity in 637 aa overlap

```
                   10         20         30         40         50         60
m665.pep   MKWDETRFGLEYDLDIFMVVAVGDFNMGAMENKGLNIFNTKFVLADSRTATDTDFEGIES
           ||||||||||||||||||||||||||||||||||||||||||||||||||||||||||||
g665       MKWDETRFGLEYDLDIFMVVAVGDFNMGAMENKGLNIFNTKFVLADSRTATDTDFEGIES
                   10         20         30         40         50         60

70         80         90        100        110        120
m665.pep   VVGHEYFHNWTGNRVTCRDWFQLSLKEGLTVFRDQEFSGDRASRAVRRIENIRLLRQHQF
           ||||||||||||||||||||||||||||||||||||||||:||||||||||||||||:||
g665       VVGHEYFHNWTGNRVTCRDWFQLSLKEGLTVFRDQEFSGDRAGRAVRRIENIRLLRQNQF
                   70         80         90        100        110        120

130        140        150        160        170        180
m665.pep   PEDAGPTAHPVRPASYEEMNNFYTMTVYEKGAEVVRMYHTLLGEEGFQKGMKLYFQRHDG
           ||||||||||||||:|||||||||||||||||||||||||||||||||||||||||||||
a665       PEDAGPTAHPVRPVSYEEMNNFYTMTVYEKGAEVVRMYHTLLGEEGFQKGMKLYFQRHDG
                  130        140        150        160        170        180

190        200        210        220        230        240
m665.pep   QAVTCDDFRAAMADANGINLDQFALWYSQAGTPVLEAEGRLKNNIFELTVKQTVPPTPDM
           |||||||||||||||||||||||||||||||||||||||||||:||||:|||||||||||
g665       QAVTCDDFRAAMADANGINLDQFALWYSQAGTPVLEAEGRLKNNVFELTIKQTVPPTPDM
                  190        200        210        220        230        240

250        260        270        280        290        300
m665.pep   TDKQPMMIPVKVGLLNRNGEAVAFDYQGKRATEAVLLLTEAEQTFLLEGVTEAVVPSLLR
           :|||||||||||||||||||||||||||||||||||:||||:|||:|||||||||||||
g665       ADKQPMMIPVKVGLLNRNGEAVAFDYQGKRATEAVLLMTEAEQAFPLEGVTEAVVPSLLR
                  250        260        270        280        290        300

310        320        330        340        350        360
m665.pep   GFSAPVHLNYPYSDDDLLLLLAHDSDAFTRWEAAQTLYRRAVAANLATLSDGVELPKHEK
           ||||||:|||||||||||||||||||||| |||||||||||||||||:||||:||||||
g665       GFSAPVYLNYPYSDDDLLLLLAHDSDAFTCWEAAQTLYRRAVAANLAALSDGIGLPKHEK
                  310        320        330        340        350        360

370        380        390        400        410        420
m665.pep   LLAAVEKVISDDLLDNAFKALLLGVPSEAELWDGAENIDPLRYHQAREALLDTLAVHFLP
           |||||||||||||||||||||||||||||||||||:|||||||||||||||||||:|||
g665       LLAAVEKVISDDLLDNAFKALLLGVPSEAELWDGTENIDPLRYHQAREALLDTLAVRFLP
                  370        380        390        400        410        420

430        440        450        460        470        480
m665.pep   KWHELNRQAAKQENWSYEYSPEAAGWRTLRNVCRAFVLRADPAHIETVAEKYGEMAQNMT
           |||||:||||||||||||||:|||||||||||||||||||||||||||||||||||||||
g665       KWHELDRQAAKQENWSYEYSPETADWRTLRNVCRAFVLRADPAHIETVAEKYGEMAQNMT
                  430        440        450        460        470        480

490        500        510        520        530        540
m665.pep   IGLLNCNGEAVAFDYQGKRATEAVLLLTEAEQTFQFESVTEAVVPSLLRGFSAPVHLNYP
              |||| ||||||||||||||||||||||||||| |||||||||||||||||||||||
g665       VGLLNRNGEAVAFDYQGKRATEAVLLLTEAEQTFLLEGVTEAVVPSLLRGFSAPVHLNYP
                  490        500        510        520        530        540

490        500        510        520        530        540
m665.pep   HEWGILSAVNGNESDTRNRLLAQFADKFCDDALVMDKYFALVGSSRRSDTLQQVRTALQH
           ||||||||||||||||||| ||||||||:|||||||||||:|||||||||||:|||||
g665       HEWGILSAVNGNESDTRNCLLAQFADKFSDDALVMDKYFALIGSSRRSDTLQQVQTALQH
                  490        500        510        520        530        540

610        620        630       639
m665.pep   CNKLEPHRKNLVKQALQRIRAQEGLSKDVGEIVGKILDX
           ||||||||||||| || |||||||||||||||||||
g665       CNKLEPHRKNLVKQELQCIRAQEGLSKDVGEIVGKILGX
                  610        620        630
```

The following partial DNA sequence was identified in *N. meningitidis* <SEQ ID 2163>:

```
a665.seq
   1  ATGAAGTGGG ACGAAACGCG CTTCGGTTTG GAATACGACT TGGATATTTT
  51  CATGGTCGTC GCCGTGGGCG ATTTCAATAT GGGTGCGATG GAAAACAAGG
 101  GTTTGAACAT CTTTAACACC AAGTTCGTCC TTGCCGACAG CCGTACCGCC
 151  ACCGATACCG ATTTTGAAGG CATCGAATCC GTGGTCGGAC ACGAATATTT
 201  CCACAACTGG ACGGGCAACC GCGTGACCTG CCGCGACTGG TTCCAGCTTT
 251  CGCTGAAGGA AGGGTTGACC GTGTTCCGCG ACCAAGAATT TTCCGGCGAC
 301  CGCGCCAGCC GCGCCGTGCG CCGTATCGAA AACATCCGCC TGCTGCGCCA
 351  GCACCAGTTC CCCGAAGACG CAGGTCCGAC CGCACATCCG GTGCGCCCCG
 401  CCCGATATGA GGAGATGAAC AATTTCTACA CCATGACCGT TTATGAAAAA
 451  GGCGCGGAAG TGGTGCGGAT GTATCACACC TTGCTCGGCG AAGAGGGCTT
 501  CCAAAAAGGT ATGAAGCTCT ATTTCCAACG CCACGACGGA CAGGCTGTTA
 551  CCTGCGACGA TTTCCGCGCG GCGATGGTGG ACGCGAACGG CATCAACCTC
 601  GACCAATTCG CCTTGTGGTA CAGCCAAGCA GGTACGCCGG TTTTAGATGC
 651  TCAAGGGCGT CTGAAAAACA ATGTGTTCGA GTTAACCATC AAACAAACCG
 701  TGCCGCCCAC GCCCGATATG GCGGACAAAC AGCCGATGAT GATTCCCGTC
 751  AAAATCGGGC TGCTGAACTG CAACGGCGAA GCGGTGGCAT TTGATTATCA
 801  GGGCAAACGC GCGACCGAAG CCGTGTTGCT GCTGACCGAA GCCGAACAGA
 851  CCTTCCAGTT CGAAAGCGTA ACCGAAGCCG TCGTTCCCTC GCTGCTGCGC
 901  GGGTTCAGCG CGCCGGTGCA TCTGAACTAT CCGTACAGCG ACGACGACCT
 951  GCTGCTTCTG CTCGCCCATG ACAGCGACGC CTTCACGCGC TGGGAAGCCG
1001  CACAAACGCT CTACCGCCGT GCCGTCGCCG CCAACCTTGC CGCGCTTTCA
1051  GACGGCGTCG AGTTGCCGAA ACACGAAAAA CTGCTTGCCG CCGTCGAAAA
1101  AGTCATTTCA GACGACCTCT TAGACAACGC TTTCAAAGCC CTGCTTTTGG
1151  GTGTGCCGTC TGAAGCCGAG CTGTGGGACG GCGCGGAAAA CATCGACCCG
1201  CTGCGCTACC ATCAGGCGCG CGAAGCCTTG TTGGATATAC TTGCCGTCCG
1251  CTTTCTGCCG AAATGGCACG AATTGAACCG TCAGGCGGCG AAGCAGGAAA
1301  ACCAAAGCTA CGAGTACAGC CCCGAAGCCG CCGGTTGGCG CACGCTGCGC
1351  AATGTCTGCC GCGCCTTCGT CCTGCGCGCC GATCCCGCGC ACATCGAAAC
1401  CGTTGCCGAG AAATACGCCG AAATGGCGCA AAACATGACC CACGAATGGG
1451  GCATCCTGTC CGCCGTCAAC GGCAACGAAA GCGATACGCG CAACCGCCTG
1501  CTGGCGCAGT TTGCCGACAA GTTTTCAGAC GACGCGCTGG TGATGGACAA
1551  ATATTTCGCC CTCGTCGGCT CAAGCCGCCG CAGCGACACC CTGCAACAGG
1601  TTCAAACCGC CTTGCAGCAT CCGAAGTTCA GCCTCGAAAA TCCCAACAAA
1651  GCCCGCTCGC TCATCGGCAG CTTCAGCCGC AACGTCCCGC ATTTCCACGC
1701  AGAAGACGGC AGCGGCTACC GCTTCATCGC CGACAAAGTC ATCGAAATCG
1751  ACCGCTTTAA CCCGCAGGTC GCCGCCCGCC TGGTGCAGGC GTTCAACCTC
1801  TGCAACAAGC TCGAGCCGCA CCGCAAAAAC TTGGTGAAAC AAGCATTGCA
1851  GCGCATTCGG GCGCAGGAAG GATTGTCGAA AGACGTGGGC GAAATCGTCG
1901  GCAAAATTTT GGATTGA
```

This corresponds to the amino acid sequence <SEQ ID 2164; ORF 665.a>:

```
a665.pep
    1  MKWDETRFGL EYDLDIFMVV AVGDFNMGAM ENKGLNIFNT KFVLADSRTA

51  TDTDFEGIES VVGHEYFHNW TGNRVTCRDW FQLSLKEGLT VFRDQEFSGD

101  RASRAVRRIE NIRLLRQHQF PEDAGPTAHP VRPARYEEMN NFYTMTVYEK

151  GAEVVRMYHT LLGEEGFQKG MKLYFQRHDG QAVTCDDFRA AMVDANGINL

201  DQFALWYSQA GTPVLDAQGR LKNNVFELTI KQTVPPTPDM ADKQPMMIPV

251  KIGLLNCNGE AVAFDYQGKR ATEAVLLLTE AEQTFQFESV TEAVVPSLLR

301  GFSAPVHLNY PYSDDDLLLL LAHDSDAFTR WEAAQTLYRR AVAANLAALS

351  DGVELPKHEK LLAAVEKVIS DDLLDNAFKA LLLGVPSEAE LWDGAENIDP

401  LRYHQAREAL LDILAVRFLP KWHELNRQAA KQENQSYEYS PEAAGWRTLR

451  NVCRAFVLRA DPAHIETVAE KYAEMAQNMT HEWGILSAVN GNESDTRNRL

501  LAQFADKFSD DALVMDKYFA LVGSSRRSDT LQQVQTALQH PKFSLENPNK

551  ARSLIGSFSR NVPHFHAEDG SGYRFIADKV IEIDRFNPQV AARLVQAFNL

601  CNKLEPHRKN LVKQALQRIR AQEGLSKDVG EIVGKILD*
``` m665/a665 97.3% identity in 638 aa overlap

```
                10         20         30         40         50         60
m665.pep  MKWDETRFGLEYDLDIFMVVAVGDFNMGAMENKGLNIFNTKFVLADSRTATDTDFEGIES
          ||||||||||||||||||||||||||||||||||||||||||||||||||||||||||||
a665      MKWDETRFGLEYDLDIFMVVAVGDFNMGAMENKGLNIFNTKFVLADSRTATDTDFEGIES
                10         20         30         40         50         60

70         80         90        100        110        120
m665.pep  VVGHEYFHNWTGNRVTCRDWFQLSLKEGLTVFRDQEFSGDRASRAVRRIENIRLLRQHQF
          ||||||||||||||||||||||||||||||||||||||||||||||||||||||||||||
a665      VVGHEYFHNWTGNRVTCRDWFQLSLKEGLTVFRDQEFSGDRASRAVRRIENIRLLRQHQF
                70         80         90        100        110        120

130        140        150        160        170        180
m665.pep  PEDAGPTAHPVRPASYEEMNNFYTMTVYEKGAEVVRMYHTLLGEEGFQKGMKLYFQRHDG
          ||||||||||||||||||||||||||||||||||||||||||||||||||||||||||||
a665      PEDAGPTAHPVRPASYEEMNNFYTMTVYEKGAEVVRMYHTLLGEEGFQKGMKLYFQRHDG
               130        140        150        160        170        180

190        200        210        220        230        240
m665.pep  QAVTCDDFRAAMADANGINLDQFALWYSQAGTPVLEAEGRLKNNIFELTVKQTVPPTPDM
          |||||||||||:||||||||||||||||||||||||:|:||||||:|||::|||||||||
a665      QAVTCDDFRAAMVDANGINLDQFALWYSQAGTPVLDAQGRLKNNVFELTIKQTVPPTPDM
               190        200        210        220        230        240

250        260        270        280        290        300
m665.pep  TDKQPMMIPVKVGLLNRNGEAVAFDYQGKRATEAVLLLTEAEQTFLLEGVTEAVVPSLLR
          :|||||||||:||||  ||||||||||||||||||||||||||| ::|:||||||||||
a665      ADKQPMMIPVKIGLLNCNGEAVAFDYQGKRATEAVLLLTEAEQTFQFESVTEAVVPSLLR
               250        260        270        280        290        300

310        320        330        340        350        360
m665.pep  GFSAPVHLNYPYSDDDLLLLLAHDSDAFTRWEAAQTLYRRAVAANLATLSDGVELPKHEK
          ||||||||||||||||||||||||||||||||||||||||||||||||:|||||||||||
a665      GFSAPVHLNYPYSDDDLLLLLAHDSDAFTRWEAAQTLYRRAVAANLAALSDGVELPKHEK
               310        320        330        340        350        360

370        380        390        400        410        420
m665.pep  LLAAVEKVISDDLLDNAFKALLLGVPSEAELWDGAENIDPLRYHQAREALLDTLAVHFLP
          ||||||||||||||||||||||||||||||||||||||||||||||||||| |||:|||
a665      LLAAVEKVISDDLLDNAFKALLLGVPSEAELWDGAENIDPLRYHQAREALLDILAVRFLP
               370        380        390        400        410        420

430        440        450        460        470        480
m665.pep  KWHELNRQAAKQENQSYEYSPEAAGWRTLRNVCRAFVLRADPAHIETVAEKYGEMAQNMT
          ||||||||||||||||||||||||||||||||||||||||||||||||||:|||||||||
a665      KWHELNRQAAKQENQSYEYSPEAAGWRTLRNVCRAFVLRADPAHIETVAEKYAEMAQNMT
               430        440        450        460        470        480

490        500        510        520        530        540
m665.pep  HEWGILSAVNGNESDTRNRLLAQFADKFSDDALVMDKYFALVGSSRRSDTLQQVRTALQH
          ||||||||||||||||||||||||||||||||||||||||||||||||||||||:||||
a665      HEWGILSAVNGNESDTRNRLLAQFADKFSDDALVMDKYFALVGSSRRSDTLQQVQTALQH
               490        500        510        520        530        540
```

```
                550       560        570        580        590        600
m665.pep   PKFSLENPNKARSLIGSFSRNVPHFHAEDGSGYRFIADKVIEIDRFNPQVAARLVQAFNL
           ||||||||||||||||||||||||||||||||||||||||||||||||||||||||||||
a665       PKFSLENPNKARSLIGSFSRNVPHFHAEDGSGYRFIADKVIEIDRFNPQVAARLVQAFNL
                550       560        570        580        590        600

610       620        630       639
m665.pep   CNKLEPHRKNLVKQALQRIRAQEGLSKDVGEIVGKILDX
           ||||||||||||||||||||||||||||||||||||||
a665       CNKLEPHRKNLVKQALQRIRAQEGLSKDVGEIVGKILD
                610       620        630
```

The following partial DNA sequence was identified in *N. gonorrhoeae* <SEQ ID 2165>:

```
g665-1.seq
     1    ATGAGCAAAA CCGTCCGTTA TCTGAAAGAT TACCAAACGC CTGCCTACCG

51    CATTCTTGAA ACCGAACTGC ATTTCGACAT TGCCGAACCG CAAACCGTCG

101    TGAAGTCGCG TTTGACGGTC GAGCCGCAGA GGGCGGGCGA GCCGCTGGTG

151    TTGGACGGTT CGGCAAAACT CTTGTCCGTC AAAATCAACG GCGCGGCGGC

201    GGATTATGTG TTGGAAGGCG AGACGCTGAC GATTGCAGAC GTACCGTCCG

251    AACGCTTCAC CGTCGAAGTG GAAACCGAAA TCCTGCCGGC GGAAAACAAA

301    TCGCTGATGG GGCTGTATGC TTCCGGCGGC AATCTGTTTA CCCAGTGCGA

351    GCCGGAGGGC TTCCGCAAAA TCACGTTCTA CATCGACCGT CCGGATGTGA

401    TGTCCAAGTT CACGACCACC ATCGTCGCGG ACAAAAAACG CTATCCCGTT

451    TTGCTTTCCA ACGGCAACAA AATCGACGGC GGCGAGTTTT CAGACGGCCG

501    CCATTGGGTG AAATGGGAAG ACCCGTTTGC CAAACCGAGT TATCTGTTTG

551    CTTTGGTCGC GGGCGATTTG GCGGTAACGG AAGACCGTTT CACCACCATG

601    AGCGGCAGAA ACGTCAAAAT CGAGTTTTAC ACCACCGAAG CGGACAAACC

651    CAAGGTCGGC TTTGCCGTGG AATCGTTGAA AAACGCGATG AAGTGGGACG

701    AAACGCGCTT CGGGTTGGAA TATGACTTGG ATATTTTCAT GGTCGTCGCC

751    GTAGGCGATT TCAATATGGG CGCGATGGAA ACAAGGGGTT TGAACATTTT

801    TAACACCAAG TTCGTCCTCG CCGACAGCCG CACCGCCACC GATACCGATT

851    TCGAAGGCAT TGAATCCGTG GTCGGACACG AATATTTCCA CAACTGGACG

901    GGCAACCGCG TAACCTGCCG CGACTGGTTC CAGCTTTCGC TGAAGGAAGG

951    GCTGACCGTG TTCCGCGACC AAGAGTTTTC CGGCGACCGC GCCGGCCGCG

1001    CCGTGCGCCG CATCGAGAAC ATCCGCCTGC TGCGCCAGAA CCAGTTCCCC

1051    GAAGACGCAG GCCCGACCGC CCATCCGGTG CGCCCCGTCA GCTATGAGGA

1101    GATGAACAAT TTCTACACCA TGACCGTTTA TGAAAAAGGC GCGGAAGTGG

1151    TGCGGATGTA TCATACCCTG CTCGGCGAAG AGGGCTTCCA AAAAGGCATG

1201    AAGCTATATT CCAACGCCA CGACGGACAG GCAGTGACCT GCGACGATTT

1251    CCGCGCGGCG ATGGCGGATG CGAACGGCAT CAATCTCGAC CAGTTCGCCT

1301    TGTGGTACAG CCAGGCGGGC ACGCCCGTTT TGGAAGCCGA AGGCCGTCTG

1351    AAAAACAATG TTTTCGAGTT AACCATTAAA CAAACCGTGC CGCCCACGCC

1401    CGATATGGCG GACAAACAGC CGATGATGAT TCCCGTCAAA GTCGGGCTTC

1451    TGAACCGCAA CGGCGAAGCG GTGGCATTCG ATTATCAGGG CAAACGCGCA

1501    ACCGAAGCCG TGTTGCTGAT GACCGAAGCC GAACAGGCCT TCCCGCTCGA
```

```
-continued
1551    AGGTGTAACC GAAGCCGTCG TTCCCTCGCT GCTGCGCGGG TTCAGCGCGC

1601    CAGTGTATCT GAACTATCCG TACAGCGACG ACGACCTGCT GCTCCTGCTC

1651    GCCCACGACA GCGACGCTTT CACGTGCTGG AAGCCGCCC AAACGCTCTA

1701    CCGTCGCGCC GTCGCCGCCA ACCTTGCCGC GCTTTCAGAC GGCATCGGGT

1751    TGCCGAAACA CGAAAAACTG CTTGCCGCCG TCGAAAAAGT CATTTCAGAC

1801    GACCTCTTGG ACAACGCCTT CAAAGCCCTG CTTTTGGGCG TGCCGTCCGA

1851    AGCCGAACTG TGGGACGGCA CGGAAAACAT CGACCCGCTG CGCTACCATC

1901    AGGCGCGCGA AGCCTTGTTG GATACGCTTG CCGTCCGCTT CCTGCCGAAA

1951    TGGCACGAAT TGGACCGTCA GGCGGCGAAG CAGGAAAACC AAAGTTACGA

2001    ATACAGCCCC GAAACCGCCG ACTGGCGCAC GCTGCGCAAC GTCTGCCGCG

2051    CCTTCGTCCT GCGCGCCGAC CCCGCGCACA TCGAAACTGT TGCCGAAAAA

2101    TACGGCGAAA TGGCGCAAAA CATGACCCAC GAATGGGGCA TCCTGTCCGC

2151    CGTCAACGGC AACGAAAGCG ATACGCGCAA CTGCCTGCTG GCGCAGTTTG

2201    CCGACAAGTT TTCAGACGAC GCGCTGGTGA TGGACAAATA TTTCGCCCTT

2251    ATCGGCTCAA GCCGCCGCAG CGACACCCTG CAACAGGTTC AAACCGCCTT

2301    GCAGCATCCG AAATTCAGTC TCGAAAACCC CAACAAAGCC CGTTCGCTCA

2351    TCGGCAGCTT CAGCCGCAAC GTCCCGCATT TTCACGCACA AGACGGCAGC

2401    GGCTACCGCT TCATCGCCGA CAAAGTCATC GAAATCGACC GCTTCAACCC

2451    GCAGGTCGCC GCCCGCCTGG TGCAGGCGTT CAACCTCTGC AACAAGCTCG

2501    AGCCGCACCG CAAAAACTTG GTGAAACAAG AATTGCAGTG CATTCGGGCG

2551    CAGGAAGGAT TGTCGAAAGA CGTGGGCGAA ATCGTCGGCA AGATTTTGGG

2601    TTGA
```

This corresponds to the amino acid sequence <SEQ ID 2166; ORF 665-1.ng>:

```
g665-1.pep
    1   MSKTVRYLKD YQTPAYRILE TELHFDIAEP QTVVKSRLTV EPQRAGEPLV

51   LDGSAKLLSV KINGAAADYV LEGETLTIAD VPSERFTVEV ETEILPAENK

101   SLMGLYASGG NLFTQCEPEG FRKITFYIDR PDVMSKFTTT IVADKKRYPV

151   LLSNGNKIDG GEFSDGRHWV KWEDPFAKPS YLFALVAGDL AVTEDRFTTM

201   SGRNVKIEFY TTEADKPKVG FAVESLKNAM KWDETRFGLE YDLDIFMVVA

251   VGDFNMGAME NKGLNIFNTK FVLADSRTAT DTDFEGIESV VGHEYFHNWT

301   GNRVTCRDWF QLSLKEGLTV FRDQEFSGDR AGRAVRRIEN IRLLRQNQFP

351   EDAGPTAHPV RPVSYEEMNN FYTMTVYEKG AEVVRMYHTL LGEEGFQKGM

401   KLYFQRHDGQ AVTCDDFRAA MADANGINLD QFALWYSQAG TPVLEAEGRL

451   KNNVFELTIK QTVPPTPDMA DKQPMMIPVK VGLLNRNGEA VAFDYQGKRA

501   TEAVLLMTEA EQAFPLEGVT EAVVPSLLRG FSAPVYLNYP YSDDDLLLLL

551   AHDSDAFTCW EAAQTLYRRA VAANLAALSD GIGLPKHEKL LAAVEKVISD

601   DLLDNAFKAL LLGVPSEAEL WDGTENIDPL RYHQAREALL DTLAVRFLPK

651   WHELDRQAAK QENQSYEYSP ETADWRTLRN VCRAFVLRAD PAHIETVAEK

701   YGEMAQNMTH EWGILSAVNG NESDTRNCLL AQFADKFSDD ALVMDKYFAL
```

```
            -continued
751    IGSSRRSDTL QQVQTALQHP KFSLENPNKA RSLIGSFSRN VPHFHAQDGS

801    GYRFIADKVI EIDRFNPQVA ARLVQAFNLC NKLEPHRKNL VKQELQCIRA

851    QEGLSKDVGE IVGKILG*
```

The following partial DNA sequence was identified in *N. meningitidis* <SEQ ID 2167>:

```
m665-1.seq
   1    ATGAGCAAAA CCGTGCATTA TCTCAAAGAC TATCAAACGC CCGCCTACCA

51    TATTCTCAAA ACCGATTTAC ATTTTGATAT TAATGAACCG CAAACCGTCG

101    TGAAGTCGCG TTTGACGGTT GAGCCGCAGA GGGTAGGGGA GCCGCTGGTG

151    TTGGACGGTT CGGCGAAACT CTTGTCCGTC AAAATCAACG GGGCGGCGGC

201    GGATTATGTG TTGGAAGGAG AGACGCTGAC GATTGCGGGC GTGCCGTCCG

251    AACGCTTCAC CGTCGAAGTG GAAACCGAAA TCCTGCCGGC GGAAAACAAA

301    TCGCTGATGG GGCTGTATGC TTCCGGCGGC AATTTGTTTA CCCAGTGCGA

351    GCCGGAGGGC TTCCGCAAAA TCACATTTTA CATCGACCGT CCGGATGTGA

401    TGTCCAAGTT CACCACCACC ATCGTCGCCG ACAAAAAACG CTATCCCGTT

451    TTGCTTTCCA ACGGCAACAA AATCGACGGC GGCGAGTTTT CAGACGGCCG

501    CCATTGGGTG AAATGGGAAG ACCCGTTTTC CAAACCGAGC TATCTGTTTG

551    CTTTGGTCGC GGGCGATTTG GCGGTAACGG AAGACTATTT CACCACCATG

601    AGCGGCAGAA ACGTCAAAAT CGAGTTTTAC ACCACCGAAG CGGACAAGCC

651    CAAGGTCGGC TTTGCCGTGG AATCGTTGAA AAACGCGATG AAATGGGACG

701    AAACGCGCTT CGGTTTGGAA TACGACTTGG ATATTTTCAT GGTCGTCGCC

751    GTGGGCGATT TCAATATGGG CGCGATGGAA ACAAGGGTT TGAACATCTT

801    TAACACCAAG TTCGTCCTTG CCGACAGCCG CACCGCCACC GATACCGATT

851    TCGAAGGCAT CGAATCCGTG GTCGGACACG AGTATTTCCA CAACTGGACG

901    GGCAACCGCG TAACCTGCCG CGACTGGTTC CAGCTTTCGC TGAAGGAAGG

951    GCTGACCGTG TTCCGCGACC AAGAATTTTC CGGCGACCGC GCCAGCCGCG

1001    CCGTGCGCCG CATCGAAAAC ATCCGCCTGC TGCGCCAGCA CCAGTTCCCC

1051    GAAGACGCAG GCCCGACCGC CCATCCGGTG CGCCCCGCCA GCTATGAGGA

1101    GATGAACAAT TTCTACACCA TGACCGTTTA TGAAAAAGGC GCGGAAGTAG

1151    TGCGGATGTA TCACACCCTG CTCGGCGAAG AGGGCTTCCA GAAAGGCATG

1201    AAGCTCTATT TCCAACGCCA CGACGGACAG GCCGTTACCT GCGACGATTT

1251    CCGCGCGGCG ATGGCGGACG CGAACGGCAT CAATCTCGAC CAGTTCGCCT

1301    TGTGGTACAG CCAGGCGGGC ACGCCCGTTT TGGAAGCGGA AGGTCGTCTG

1351    AAAAACAATA TTTTCGAGTT GACCGTCAAA CAAACCGTGC CGCCCACGCC

1401    CGATATGACG GATAAACAGC CGATGATGAT TCCCGTCAAG GTCGGGCTGC

1451    TGAACCGCAA CGGCGAAGCG GTGGCATTCG ACTATCAGGG CAAACGCGCG

1501    ACCGAAGCCG TGTTGCTGCT GACCGAAGCC GAACAGACCT TCCTGCTCGA

1551    AGGCGTAACC GAAGCCGTCG TTCCCTCGCT GCTGCGCGGG TTCAGCGCGC

1601    CGGTGCATCT GAACTATCCG TACAGCGACG ACGACCTGCT GCTCCTGCTC

1651    GCCCATGACA GCGACGCCTT CACGCGCTGG GAAGCCGCCC AAACGCTCTA
```

```
-continued
1701    CCGCCGCGCC GTCGCCGCCA ACCTTGCCAC GCTTTCAGAC GGCGTTGAGC

1751    TGCCGAAACA CGAAAAACTG CTTGCCGCCG TCGAAAAAGT CATTTCAGAC

1801    GACCTCTTAG ACAACGCCTT CAAAGCCCTG CTTTTGGGCG TGCCATCCGA

1851    AGCCGAGCTG TGGGACGGCG CAGAAAACAT CGACCCGCTG CGCTACCATC

1901    AGGCGCGCGA AGCCTTGTTG GATACGCTTG CCGTCCACTT CCTGCCGAAA

1951    TGGCACGAAT TGAACCGTCA GGCGGCGAAG CAGGAAAACC AAAGCTACGA

2001    ATACAGCCCC GAAGCCGCCG GCTGGCGCAC GCTGCGCAAC GTCTGCCGCG

2051    CCTTTGTCCT GCGCGCCGAC CCCGCGCACA TCGAAACCGT TGCCGAAAAA

2101    TACGGCGAAA TGGCGCAAAA CATGACCCAC GAATGGGGCA TCCTGTCCGC

2151    CGTCAACGGC AACGAAAGCG ATACGCGCAA CCGCCTGCTG GCGCAGTTTG

2201    CCGACAAGTT TTCAGACGAC GCGCTGGTGA TGGACAAATA TTTTGCCCTC

2251    GTCGGCTCAA GCCGCCGCAG CGACACCCTG CAACAGGTTC GAACCGCCTT

2301    GCAGCATCCG AAATTCAGCC TCGAAAACCC CAACAAAGCC CGTTCGCTCA

2351    TCGGCAGCTT CAGCCGCAAC GTCCCGCATT TCCACGCAGA AGACGGCAGC

2401    GGCTACCGCT TCATCGCCGA CAAAGTCATC GAAATCGACC GCTTCAACCC

2451    GCAGGTCGCC GCCCGCTTAG TGCAGGCGTT CAACCTCTGC AACAAGCTCG

2501    AGCCGCACCG CAAAAACTTG GTGAAACAAG CATTGCAGCG CATTCGGGCG

2551    CAGGAAGGAT TGTCGAAAGA CGTGGGCGAA ATCGTCGGCA AAATTTTGGA

2601    TTGA
```

This corresponds to the amino acid sequence <SEQ ID 2168;
ORF 665-1>:

```
m665-1.pep
  1     MSKTVHYLKD YQTPAYHILK TDLHFDINEP QTVVKSRLTV EPQRVGEPLV

51     LDGSAKLLSV KINGAAADYV LEGETLTIAG VPSERFTVEV ETEILPAENK

101     SLMGLYASGG NLFTQCEPEG FRKITFYIDR PDVMSKFTTT IVADKKRYPV

151     LLSNGNKIDG GEFSDGRHWV KWEDPFSKPS YLFALVAGDL AVTEDYFTTM

201     SGRNVKIEFY TTEADKPKVG FAVESLKNAM KWDETRFGLE YDLDIFMVVA

251     VGDFNMGAME NKGLNIFNTK FVLADSRTAT DTDFEGIESV GHEYFHNWT

301     GNRVTCRDWF QLSLKEGLTV FRDQEFSGDR ASRAVRRIEN IRLLRQHQFP

351     EDAGPTAHPV RPASYEEMNN FYTMTVYEKG AEVVRMYHTL LGEEGFQKGM

401     KLYFQRHDGQ AVTCDDFRAA MADANGINLD QFALWYSQAG TPVLEAEGRL

451     KNNIFELTVK QTVPPTPDMT DKQPMMIPVK VGLLNRNGEA VAFDYQGKRA

501     TEAVLLLTEA EQTFLLEGVT EAVVPSLLRG FSAPVHLNYP YSDDDLLLLL

551     AHDSDAFTRW EAAQTLYRRA VAANLATLSD GVELPKHEKL LAAVEKVISD

601     DLLDNAFKAL LLGVPSEAEL WDGAENIDPL RYHQAREALL DTLAVHFLPK

651     WHELNRQAAK QENQSYEYSP EAAGWRTLRN VCRAFVLRAD PAHIETVAEK

701     YGEMAQNMTH EWGILSAVNG NESDTRNRLL AQFADKFSDD ALVMDKYFAL

751     VGSSRRSDTL QQVRTALQHP KFSLENPNKA RSLIGSFSRN VPHFHAEDGS

801     GYRFIADKVI EIDRFNPQVA ARLVQAFNLC NKLEPHRKNL VKQALQRIRA

851     QEGLSKDVGE IVGKILD*
``` m665-1/a665-1 96.1% identity in 866 aa overlap

```
              10        20        30        40        50        60
m665-1.pep   MSKTVHYLKDYQTPAYHILKTDLHFDINEPQTVVKSRLTVEPQRVGEPLVLDGSAKLLSV
             ||||:||||||||||:||:|||||||||:||||||||||||||:|||||||||||||||
g665-1       MSKTVRYLKDYQTPAYRILETELHFDIAEPQTVVKSRLTVEPQRAGEPLVLDGSAKLLSV
              10        20        30        40        50        60

70        80        90       100       110       120
m665-1.pep   KINGAAADYVLEGETLTIAGVPSERFTVEVETEILPAENKSLMGLYASGGNLFTQCEPEG
             |||||||||||||||||||:||||||||||||||||||||||||||||||||||||||||
g665-1       KINGAAADYVLEGETLTIADVPSERFTVEVETEILPAENKSLMGLYASGGNLFTQCEPEG
              70        80        90       100       110       120

130       140       150       160       170       180
m665-1.pep   FRKITFYIDRPDVMSKFTTTIVADKKRYPVLLSNGNKIDGGEFSDGRHWVKWEDPFSKPS
             ||||||||||||||||||||||||||||||||||||||||||||||||||||||||:|||
g665-1       FRKITFYIDRPDVMSKFTTTIVADKKRYPVLLSNGNKIDGGEFSDGRHWVKWEDPFAKPS
             130       140       150       160       170       180

190       200       210       220       230       240
m665-1.pep   YLFALVAGDLAVTEDYFTTMSGRNVKIEFYTTEADKPKVGFAVESLKNAMKWDETRFGLE
             ||||||||||||||||:|||||||||||||||||||||||||||||||||||||||||||
g665-1       YLFALVAGDLAVTEDRFTTMSGRNVKIEFYTTEADKPKVGFAVESLKNAMKWDETRFGLE
             190       200       210       220       230       240

250       260       270       280       290       300
m665-1.pep   YDLDIFMVVAVGDFNMGAMENKGLNIFNTKFVLADSRTATDTDFEGIESVVGHEYFHNWT
             |||||||||||||||||||||||||||||||||||||||||||||||||||||||||||
g665-1       YDLDIFMVVAVGDFNMGAMENKGLNIFNTKFVLADSRTATDTDFEGIESVVGHEYFHNWT
             250       260       270       280       290       300

310       320       330       340       350       360
m665-1.pep   GNRVTCRDWFQLSLKEGLTVFRDQEFSGDRASRAVRRIENIRLLRQHQFPEDAGPTAHPV
             |||||||||||||||||||||||||||||||:|||||||||||||:|||||||||||||
g665-1       GNRVTCRDWFQLSLKEGLTVFRDQEFSGDRAGRAVRRIENIRLLRQNQFPEDAGPTAHPV
             310       320       330       340       350       360

370       380       390       400       410       420
m665-1.pep   RPASYEEMNNFYTMTVYEKGAEVVRMYHTLLGEEGFQKGMKLYFQRHDGQAVTCDDFRAA
             ||:|||||||||||||||||||||||||||||||||||||||||||||||||||||||
g665-1       RPVSYEEMNNFYTMTVYEKGAEVVRMYHTLLGEEGFQKGMKLYFQRHDGQAVTCDDFRAA
             370       380       390       400       410       420

430       440       450       460       470       480
m665-1.pep   MADANGINLDQFALWYSQAGTPVLEAEGRLKNNIFELTVKQTVPPTPDMTDKQPMMIPVK
             ||||||||||||||||||||||||||||||||:||||:||||||||||:||||||||||
g665-1       MADANGINLDQFALWYSQAGTPVLEAEGRLKNNVFELTIKQTVPPTPDMADKQPMMIPVK
             430       440       450       460       470       480

490       500       510       520       530       540
m665-1.pep   VGLLNRNGEAVAFDYQGKRATEAVLLLTEAEQTFLLEGVTEAVVPSLLRGFSAPVHLNYP
             |||||||||||||||||||||||||:|||||:|||||||||||||||||||||:||||
g665-1       VGLLNRNGEAVAFDYQGKRATEAVLLMTEAEQAFPLEGVTEAVVPSLLRGFSAPVYLNYP
             490       500       510       520       530       540

550       560       570       580       590       600
m665-1.pep   YSDDDLLLLLAHDSDAFTRWEAAQTLYRRAVAANLATLSDGVELPKHEKLLAAVEKVISD
             ||||||||||||||||||:|||||||||||||||||:||||:|||||||||||||||||
g665-1       YSDDDLLLLLAHDSDAFTCWEAAQTLYRRAVAANLAALSDGIGLPKHEKLLAAVEKVISD
             550       560       570       580       590       600

610       620       630       640       650       660
m665-1.pep   DLLDNAFKALLLGVPSEAELWDGAENIDPLRYHQAREALLDTLAVHFLPKWHELNRQAAK
             ||||||||||||||||||||||||:|||||||||||||||||||:||||||||:||||
g665-1       DLLDNAFKALLLGVPSEAELWDGTENIDPLRYHQAREALLDTLAVRFLPKWHELDRQAAK
             610       620       630       640       650       660

670       680       690       700       710       720
m665-1.pep   QENQSYEYSPEAAGWRTLRNVCRAFVLRADPAHIETVAEKYGEMAQNMTHEWGILSAVNG
             ||||||||||:|||||||||||||||||||||||||||||||||||||||||||||||
g665-1       QENQSYEYSPETADWRTLRNVCRAFVLRADPAHIETVAEKYGEMAQNMTHEWGILSAVNG
             670       680       690       700       710       720

730       740       750       760       770       780
m665-1.pep   NESDTRNRLLAQFADKFSDDALVMDKYFALVGSSRRSDTLQQVRTALQHPKFSLENPNKA
             ||||||||:|||||||||||||||||||||:||||||||||||:|||||||||||||||
g665-1       NESDTRNCLLAQFADKFSDDALVMDKYFALIGSSRRSDTLQQVQTALQHPKFSLENPNKA
             730       740       750       760       770       780

790       800       810       820       830       840
m665-1.pep   RSLIGSFSRNVPHFHAEDGSGYRFIADKVIEIDRFNPQVAARLVQAFNLCNKLEPHRKNL
             ||||||||||||||||:|||||||||||||||||||||||||||||||||||||||||
g665-1       RSLIGSFSRNVPHFHAQDGSGYRFIADKVIEIDRFNPQVAARLVQAFNLCNKLEPHRKNL
             790       800       810       820       830       840

850       860
m665-1.pep   VKQALQRIRAQEGLSKDVGEIVGKILDX
             |||:|| :||||||||||||||||||||
g665-1       VKQELQCIRAQEGLSKDVGEIVGKILGX
             850       860
```

The following partial DNA sequence was identified in *N. meningitidis* <SEQ ID 2169>:

```
a665-1.seq
      1   ATGAGCAAAA CCGTGCATTA TCTCAAAGAC TATCAAACGC CCGCCTACCA
     51   TATTCTCAAA ACCGATTTAC ATTTTGATAT TAACGAACCG CAAACCATTG
    101   TGAAGTCGCG TTTGACGGTC GAGCCGAAGA GGGTGGGAGA GCCGCTGGTG
    151   TTGGACGGTT CGGCGAAACT CTTGTCCGTC AAAATCAACG GCGTGGCGGC
    201   GGATTATGTG TTGGAAGGCG AGACGCTGAC GATTGCGGAC GTGCCGTCCG
    251   AACGCTTCAC CGTCGAAGTG GAAACCGAAA TCCTGCCGGC GGAAAACAAA
    301   TCGCTGATGG GGCTGTATGC GTCCGCCGGT AACCTGTTTA CCCAGTGCGA
    351   GCCGGAGGGC TTCCGCAAAA TCACGTTCTA TATCGACCGT CCGGATGTCA
    401   TGTCCAAGTT CACGACCACC ATCGTCGCGG ACAAAAAACG CTATCCCGTT
    451   TTGCTCTCCA ACGGCAACAA AATCGACGGC GGCGAGTATT CAGACGGCCG
    501   CCATTGGGTG AAATGGGAAG ACCCGTTTGC CAAACCGAGT TATCTGTTTG
    551   CTTTGGTCGC GGGCGATTTG GCGGTCACGG AAGACTATTT CACCACCATG
    601   AGCGGCAGAA ACGTCAAAAT CGAGTTTTAC ACCACCGAAG CGGACAAGCC
    651   CAAGGTCGGC TTTGCCGTGG AATCGCTGAA AAACGCAATG AAGTGGGACG
    701   AAACGCGCTT CGGTTTGGAA TACGACTTGG ATATTTTCAT GGTCGTCGCC
    751   GTGGGCGATT TCAATATGGG TGCGATGGAA AACAAGGGTT TGAACATCTT
    801   TAACACCAAG TTCGTCCTTG CCGACAGCCG TACCGCCACC GATACCGATT
    851   TTGAAGGCAT CGAATCCGTG GTCGGACACG AATATTTCCA CAACTGGACG
    901   GGCAACCGCG TGACCTGCCG CGACTGGTTC CAGCTTTCGC TGAAGGAAGG
    951   GTTGACCGTG TTCCGCGACC AAGAATTTTC CGGCGACCGC GCCAGCCGCG
   1001   CCGTGCGCCG TATCGAAAAC ATCCGCCTGC TGCGCCAGCA CCAGTTCCCC
   1051   GAAGACGCAG GTCCGACCGC ACATCCGGTG CGCCCCGCCC GATATGAGGA
   1101   GATGAACAAT TTCTACACCA TGACCGTTTA TGAAAAAGGC GCGGAAGTGG
   1151   TGCGGATGTA TCACACCTTG CTCGGCGAAG AGGGCTTCCA AAAAGGTATG
   1201   AAGCTCTATT TCCAACGCCA CGACGGACAG GCTGTTACCT GCGACGATTT
   1251   CCGCGCGGCG ATGGTGGACG CGAACGGCAT CAACCTCGAC CAATTCGCCT
   1301   TGTGGTACAG CCAAGCAGGT ACGCCGGTTT TAGATGCTCA AGGGCGTCTG
   1351   AAAAACAATG TGTTCGAGTT AACCATCAAA CAAACCGTGC CGCCCACGCC
   1401   CGATATGGCG GACAAACAGC CGATGATGAT TCCCGTCAAA ATCGGGCTGC
   1451   TGAACTGCAA CGGCGAAGCG GTGGCATTTG ATTATCAGGG CAAACGCGCG
   1501   ACCGAAGCCG TGTTGCTGCT GACCGAAGCC GAACAGACCT TCCAGTTCGA
   1551   AAGCGTAACC GAAGCCGTCG TTCCCTCGCT GCTGCGCGGG TTCAGCGCGC
   1601   CGGTGCATCT GAACTATCCG TACAGCGACG ACGACCTGCT GCTTCTGCTC
   1651   GCCCATGACA GCGACGCCTT CACGCGCTGG GAAGCCGCAC AAACGCTCTA
   1701   CCGCCGTGCC GTCGCCGCCA ACCTTGCCGC GCTTTCAGAC GGCGTCGAGT
   1751   TGCCGAAACA CGAAAAACTG CTTGCCGCCG TCGAAAAAGT CATTTCAGAC
   1801   GACCTCTTAG ACAACGCTTT CAAAGCCCTG CTTTTGGGTG TGCCGTCTGA
   1851   AGCCGAGCTG TGGGACGGCG CGGAAAACAT CGACCCGCTG CGCTACCATC
   1901   AGGCGCGCGA AGCCTTGTTG GATATACTTG CCGTCCGCTT TCTGCCGAAA
```

```
1951  TGGCACGAAT TGAACCGTCA GGCGGCGAAG CAGGAAAACC AAAGCTACGA

2001  GTACAGCCCC GAAGCCGCCG GTTGGCGCAC GCTGCGCAAT GTCTGCCGCG

2051  CCTTCGTCCT GCGCGCCGAT CCCGCGCACA TCGAAACCGT TGCCGAGAAA

2101  TACGCCGAAA TGGCGCAAAA CATGACCCAC GAATGGGGCA TCCTGTCCGC

2151  CGTCAACGGC AACGAAAGCG ATACGCGCAA CCGCCTGCTG GCGCAGTTTG

2201  CCGACAAGTT TTCAGACGAC GCGCTGGTGA TGGACAAATA TTTCGCCCTC

2251  GTCGGCTCAA GCCGCCGCAG CGACACCCTG CAACAGGTTC AAACCGCCTT

2301  GCAGCATCCG AAGTTCAGCC TCGAAAATCC CAACAAAGCC CGCTCGCTCA

2351  TCGGCAGCTT CAGCCGCAAC GTCCCGCATT TCCACGCAGA AGACGGCAGC

2401  GGCTACCGCT TCATCGCCGA CAAAGTCATC GAAATCGACC GCTTTAACCC

2451  GCAGGTCGCC GCCCGCCTGG TGCAGGCGTT CAACCTCTGC AACAAGCTCG

2501  AGCCGCACCG CAAAAACTTG GTGAAACAAG CATTGCAGCG CATTCGGGCG

2551  CAGGAAGGAT TGTCGAAAGA CGTGGGCGAA ATCGTCGGCA AAATTTTGGA

2601  TTGA
```

This corresponds to the amino acid sequence <SEQ ID 2170; ORF 665-1.a>:

```
a665-1.pep
    1   MSKTVHYLKD YQTPAYHILK TDLHFDINEP QTIVKSRLTV EPKRVGEPLV

51   LDGSAKLLSV KINGVAADYV LEGETLTIAD VPSERFTVEV ETEILPAENK

101   SLMGLYASAG NLFTQCEPEG FRKITFYIDR PDVMSKFTTT IVADKKRYPV

151   LLSNGNKIDG GEYSDGRHWV KWEDPFAKPS YLFALVAGDL AVTEDYFTTM

201   SGRNVKIEFY TTEADKPKVG FAVESLKNAM KWDETRFGLE YDLDIFMVVA

251   VGDFNMGAME NKGLNIFNTK FVLADSRTAT DTDFEGIESV VGHEYFHNWT

301   GNRVTCRDWF QLSLKEGLTV FRDQEFSGDR ASRAVRRIEN IRLLRQHQFP

351   EDAGPTAHPV RPARYEEMNN FYTMTVYEKG AEVVRMYHTL LGEEGFQKGM

401   KLYFQRHDGQ AVTCDDFRAA MVDANGINLD QFALWYSQAG TPVLDAQGRL

451   KNNVFELTIK QTVPPTPDMA DKQPMMIPVK IGLLNCNGEA VAFDYQGKRA

501   TEAVLLLTEA EQTFQFESVT EAVVPSLLRG FSAPVHLNYP YSDDDLLLLL

551   AHDSDAFTRW EAAQTLYRRA VAANLAALSD GVELPKHEKL LAAVEKVISD

601   DLLDNAFKAL LLGVPSEAEL WDGAENIDPL RYHQAREALL DILAVRFLPK

651   WHELNRQAAK QENQSYEYSP EAAGWRTLRN VCRAFVLRAD PAHIETVAEK

701   YAEMAQNMTH EWGILSAVNG NESDTRNRLL AQFADKFSDD ALVMDKYFAL

751   VGSSRRSDTL QQVQTALQHP KFSLENPNKA RSLIGSFSRN VPHFHAEDGS

801   GYRFIADKVI EIDRFNPQVA ARLVQAFNLC NKLEPHRKNL VKQALQRIRA

851   QEGLSKDVGE IVGKILD*
``` a665-1/m665-1 97.2% identity in 867 aa overlap

```
                  10         20         30         40         50         60
a665-1.pep  MSKTVHYLKDYQTPAYHILKTDLHFDINEPQTIVKSRLTVEPKRVGEPLVLDGSAKLLSV
            ||||||:|||||||||:|:|:|||||:|||||:|||||||||:|||||||||||||||||
m665-1      MSKTVRYLKDYQTPAYRILETELHFDIAEPQTVVKSRLTVEPQRAGEPLVLDGSAKLLSV
                  10         20         30         40         50         60
```

```
                70        80        90       100       110       120
a665-1.pep  KINGVAADYVLEGETLTIADVPSERFTVEVETEILPAENKSLMGLYASAGNLFTQCEPEG
            ||||:||||||||||||||| |||||||||||||||||||||||||||:|||||||||||
m665-1      KINGAAADYVLEGETLTIAGVPSERFTVEVETEILPAENKSLMGLYASGGNLFTQCEPEG
                70        80        90       100       110       120

130       140       150       160       170       180
a665-1.pep  FRKITFYIDRPDVMSKFTTTIVADKKRYPVLLSNGNKIDGGEYSDGRHWVKWEDPFAKPS
            |||||||||||||||||||||||||||||||||||||||:|||||||||||||||:|||
m665-1      FRKITFYIDRPDVMSKFTTTIVADKKRYPVLLSNGNKIDGGEFSDGRHWVKWEDPFSKPS
               130       140       150       160       170       180

190       200       210       220       230       240
a665-1.pep  YLFALVAGDLAVTEDYFTTMSGRNVKIEFYTTEADKPKVGFAVESLKNAMKWDETRFGLE
            ||||||||||||||||||||||||||||||||||||||||||||||||||||||||||||
m665-1      YLFALVAGDLAVTEDYFTTMSGRNVKIEFYTTEADKPKVGFAVESLKNAMKWDETRFGLE
               190       200       210       220       230       240

250       260       270       280       290       300
a665-1.pep  YDLDIFMVVAVGDFNMGAMENKGLNIFNTKFVLADSRTATDTDFEGIESVVGHEYFHNWT
            ||||||||||||||||||||||||||||||||||||||||||||||||||||||||||||
m665-1      YDLDIFMVVAVGDFNMGAMENKGLNIFNTKFVLADSRTATDTDFEGIESVVGHEYFHNWT
               250       260       270       280       290       300

310       320       330       340       350       360
a665-1.pep  GNRVTCRDWFQLSLKEGLTVFRDQEFSGDRASRAVRRIENIRLLRQHQFPEDAGPTAHPV
            ||||||||||||||||||||||||||||||||||||||||||||||||||||||||||||
m665-1      GNRVTCRDWFQLSLKEGLTVFRDQEFSGDRASRAVRRIENIRLLRQHQFPEDAGPTAHPV
               310       320       330       340       350       360

370       380       390       400       410       420
a665-1.pep  RPARYEEMNNFYTMTVYEKGAEVVRMYHTLLGEEGFQKGMKLYFQRHDGQAVTCDDFRAA
            ||| ||||||||||||||||||||||||||||||||||||||||||||||||||||||||
m665-1      RPASYEEMNNFYTMTVYEKGAEVVRMYHTLLGEEGFQKGMKLYFQRHDGQAVTCDDFRAA
               370       380       390       400       410       420

430       440       450       460       470       480
a665-1.pep  MVDANGINLDQFALWYSQAGTPVLDAQGRLKNNVFELTIKQTVPPTPDMADKQPMMIPVK
            |:||||||||||||||||||||||||:|:||||||:||||:|||||||||:|||||||||
m665-1      MADANGINLDQFALWYSQAGTPVLEAEGRLKNNIFELTVKQTVPPTPDMTDKQPMMIPVK
               430       440       450       460       470       480

490       500       510       520       530       540
a665-1.pep  IGLLNCNGEAVAFDYQGKRATEAVLLLTEAEQTFQFESVTEAVVPSLLRGFSAPVHLNYP
            :|||| |||||||||||||||||||||||||||| :|:||||||||||||||||||||||
m665-1      VGLLNRNGEAVAFDYQGKRATEAVLLLTEAEQTFLLEGVTEAVVPSLLRGFSAPVHLNYP
               490       500       510       520       530       540

550       560       570       580       590       600
a665-1.pep  YSDDDLLLLLAHDSDAFTRWEAAQTLYRRAVAANLAALSDGVELPKHEKLLAAVEKVISD
            ||||||||||||||||||||||||||||||||||||:|||||||||||||||||||||||
m665-1      YSDDDLLLLLAHDSDAFTRWEAAQTLYRRAVAANLATLSDGVELPKHEKLLAAVEKVISD
               550       560       570       580       590       600

610       620       630       640       650       660
a665-1.pep  DLLDNAFKALLLGVPSEAELWDGAENIDPLRYHQAREALLDILAVRFLPKWHELNRQAAK
            |||||||||||||||||||||||||||||||||||||||||:||| |||||||||||||
m665-1      DLLDNAFKALLLGVPSEAELWDGAENIDPLRYHQAREALLDTLAVHFLPKWHELNRQAAK
               610       620       630       640       650       660

670       680       690       700       710       720
a665-1.pep  QENQSYEYSPEAAGWRTLRNVCRAFVLRADPAHIETVAEKYAEMAQNMTHEWGILSAVNG
            |||||||||||||||||||||||||||||||||||||||||:||||||||||||||||||
m665-1      QENQSYEYSPEAAGWRTLRNVCRAFVLRADPAHIETVAEKYGEMAQNMTHEWGILSAVNG
               670       680       690       700       710       720

730       740       750       760       770       780
a665-1.pep  NESDTRNRLLAQFADKFSDDALVMDKYFALVGSSRRSDTLQQVQTALQHPKFSLENPNKA
            |||||||||||||||||||||||||||||||||||||||||||:||||||||||||||||
m665-1      NESDTRNRLLAQFADKFSDDALVMDKYFALVGSSRRSDTLQQVRTALQHPKFSLENPNKA
               730       740       750       760       770       780

790       800       810       820       830       840
a665-1.pep  RSLIGSFSRNVPHFHAEDGSGYRFIADKVIEIDRFNPQVAARLVQAFNLCNKLEPHRKNL
            ||||||||||||||||||||||||||||||||||||||||||||||||||||||||||||
m665-1      RSLIGSFSRNVPHFHAEDGSGYRFIADKVIEIDRFNPQVAARLVQAFNLCNKLEPHRKNL
               790       800       810       820       830       840

850       860
a665-1.pep  VKQALQRIRAQEGLSKDVGEIVGKILDX
            ||||||||||||||||||||||||||||
m665-1      VKQALQRIRAQEGLSKDVGEIVGKILDX
               850       860
```

The following partial DNA sequence was identified in *N. gonorrhoeae* <SEQ ID 2171>:

```
g666.seq
    1   ATGCTTTGTA TGAATTATCA ATCAAACTCA GGCGAAGGAG TGCTTGTAGC
   51   TAAAACATAT TTATTGACTG CATTGATAAT GTCTATGGTA ATCTCCGGAT
  101   GTCAAGTCAT CCATGCCAAT CAAGGTAAGG TTAATACTAA TTCTGCTGTC
  151   ATCGCAGGTG CAGACGCTCA CACGCCTGAA CATGTAACGG GACTGACCGA
  201   ACAAAAGCAG GTGATTGCAA GTGATTTTAT AGTAGCGTCA GCCAATCCAT
  251   TAGCAACACA AGCTGGCTAT GATATCTTAA AGCAAGGCGG TAGCGCTGCA
  301   GATGCGATGG TGGCGGTGCA GACGACACTA AGCTTGGTAG AGCCACAGTC
  351   GTCAGGCTTG GCGGTGGTG CATTTGTGTT GTATTGGGAC AATACCGCCA
  401   AAACATTGAC CACATTTGAT GGGCGTGAGA CGGCACCGAT GCGTGCGACG
  451   CCAGAATTAT TTTTGGATAA AGATGGTTAA CCATTGAAAT TTATGGAAGC
  501   GGTGGTCGCT CGGTAGGTAC GCCTGCTATC CCTAAACTGA
```

This corresponds to the amino acid sequence <SEQ ID 2172; ORF 666.ng>:

```
g666.pep
    1   MLCMNYQSNS GEGVLVAKTY LLTALIMSMV ISGCQVIHAN QGKVNTNSAV
   51   IAGADAHTPE HVTGLTEQKQ VIASDFIVAS ANPLATQAGY DILKQGGSAA
  101   DAMVAVQTTL SLVEPQSSGL GGGAFVLYWD NTAKTLTTFD GRETAPMRAT
  151   PELFLDKDGX PLKFMEAVVA RXVRLLSLN*
```

The following partial DNA sequence was identified in *N. meningitidis* <SEQ ID 2173>:

```
m666.seq
    1   ATGCCTTGTA TGAATCATCA ATCAAACTCA GGCGAAGGAG TGCTTGTGGC
   51   TAAAACATAT TTATTGACTG CATTGATAAT GTCTATGACA ATCTCTGGAT
  101   GTCAAGTCAT CCATGCCAAT CAAGGTAAGG TTAATACTCA TTCTGCTGTC
  151   ATCACAGGTG CAGACGCTCA CACGCCTGAA CATGCAACGG GACTGACCGA
  201   ACAAAAGCAG GTGATTGCAA GTGATTTTAT GGTAGCGTCA GCCAATCCAT
  251   TAGCAACACA AGCTGGCTAT GATATCTTAA AGCAAGGCGG TAGCGCTGCA
  301   GATGCGATGG TGGCGGTGCA GACGACACTA AGCTTGGTAG AGCCACAGTC
  351   GTCAGGCTTG GCGGTGGTG CATTTGTGTT GTATTGGGAT AATACCGCCA
  401   AAACATTGAC CACATTTGAT GGGCGTGAGA CGGCACCGAT GCGTGCGACG
  451   CCGGAATTAT TTTTGGATAA AGATGGTCAA CCATTGAAAT TTATGGAAGC
  501   GGTGGTCGTG GTCGCTCGGT GGGTACGCCT GCTATCCCTA AACTGA
```

This corresponds to the amino acid sequence <SEQ ID 2174; ORF 666>:

```
m666.pep
    1   MPCMNHQSNS GEGVLVAKTY LLTALIMSMT ISGCQVIHAN QGKVNTHSAV
   51   ITGADAHTPE HATGLTEQKQ VIASDFMVAS ANPLATQAGY DILKQGGSAA
  101   DAMVAVQTTL SLVEPQSSGL GGGAFVLYWD NTAKTLTTFD GRETAPMRAT
  151   PELFLDKDGQ PLKFMEAVVV VARWVRLLSL N*
```

Computer analysis of this amino acid sequence gave the following results:
Homology with a Predicted ORF from *N. gonorrhoeae*
  m666/g666 93.9% identity in 181 aa overlap

```
                   10         20         30         40         50         60
   m666.pep  MPCMNHQSNSGEGVLVAKTYLLTALIMSMTISGCQVIHANQGKVNTHSAVITGADAHTPE
             | |||:||||||||||||||||||||:||||||||||||||:||||:|||||||||
   g666      MLCMNYQSNSGEGVLVAKTYLLTALIMSMVISGCQVIHANQGKVNTNSAVIAGADAHTPE
                   10         20         30         40         50         60

70         80         90        100        110        120
   m666.pep  HATGLTEQKQVIASDFMVASANPLATQAGYDILKQGGSAADAMVAVQTTLSLVEPQSSGL
             |:|||||||||||:||||||||||||||||||||||||||||||||||||||||||||||
   g666      HVTGLTEQKQVIASDFIVASANPLATQAGYDILKQGGSAADAMVAVQTTLSLVEPQSSGL
                   70         80         90        100        110        120

130        140        150        160        170        180
   m666.pep  GGGAFVLYWDNTAKTLTTFDGRETAPMRATPELFLDKDGQPLKFMEAVVVVARWVRLLSL
             ||||||||||||||||||||||||||||||||||||||| ||||||||||   ||||||||
   g666      GGGAFVLYWDNTAKTLTTFDGRETAPMRATPELFLDKDGXPLKFMEAVV--ARXVRLLSL
                  130        140        150        160        170 m666.pep  NX
             ||
   g666      NX
             180
```

The following partial DNA sequence was identified in *N. meningitidis* <SEQ ID 2175>:

```
a666.seq
    1   ATGCCTTGTA TGAATCATCA ATCAAACTCA GGCGAAGGAG TGCTTGTGGC

51   TAAAACATAT TTATTGACTG CATTGATAAT GTCTATGACA ATCTCTGGAT

101   GTCAAGTCAT CCATGCCAAT CAAGGTAAGG TTAATACTCA TTCTGCTGTC

151   ATCACAGGTG CAGACGCTCA CACGCCTGAA CATGCAACGG GACTGACCGA

201   ACAAAAGCAG GTGATTGCAA GTGATTTTAT GGTAGCGTCA GCCAATCCAT

251   TAGCAACACA AGCTGGCTAT GATATCTTAA AGCAAGGCGG TAGCGCTGCA

301   GATGCGATGG TGGCGGTGCA GACGACACTA AGCTTGGTAG AGCCACAGTC

351   GTCAGGCTTG GGCGGTGGTG CATTTGTGTT GTATTGGGAT AATACCGCCA

401   AAACATTGAC CACATTTGAT GGGCGTGAGA CGGCACCGAT GCGTGCGACG

451   CCGGAATTAT TTTTGGATAA AGATGGTCAA CCATTGAAAT TTATGGAAGC

501   GGTGGTCGTG GTCGCTCGGT GGGTACGCCT GCTATCCCTA AACTGA
```

This corresponds to the amino acid sequence <SEQ ID 2176; ORF 666.a>:

```
a666.pep
    1   MPCMNHQSNS GEGVLVAKTY LLTALIMSMT ISGCQVIHAN QGKVNTHSAV

51   ITGADAHTPE HATGLTEQKQ VIASDFMVAS ANPLATQAGY DILKQGGSAA

101   DAMVAVQTTL SLVEPQSSGL GGGAFVLYWD NTAKTLTTFD GRETAPMRAT

151   PELFLDKDGQ PLKFMEAVVV VARWVRLLSL N*
``` m666/a666 100.0% identity in 181 aa overlap

```
                   10         20         30         40         50         60
   m666.pep  MPCMNHQSNSGEGVLVAKTYLLTALIMSMTISGCQVIHANQGKVNTHSAVITGADAHTPE
             ||||||||||||||||||||||||||||||||||||||||||||||||||||||||||||
   a666      MPCMNHQSNSGEGVLVAKTYLLTALIMSMTISGCQVIHANQGKVNTHSAVITGADAHTPE
                   10         20         30         40         50         60
```

-continued

```
                    70         80         90        100        110        120
m666.pep   HATGLTEQKQVIASDFMVASANPLATQAGYDILKQGGSAADAMVAVQTTLSLVEPQSSGL
           ||||||||||||||||||||||||||||||||||||||||||||||||||||||||||||
a666       HATGLTEQKQVIASDFMVASANPLATQAGYDILKQGGSAADAMVAVQTTLSLVEPQSSGL
                    70         80         90        100        110        120

130        140        150        160        170        180
m666.pep   GGGAFVLYWDNTAKTLTTFDGRETAPMRATPELFLDKDGQPLKFMEAVVVVARWVRLLSL
           ||||||||||||||||||||||||||||||||||||||||||||||||||||||||||||
a666       GGGAFVLYWDNTAKTLTTFDGRETAPMRATPELFLDKDGQPLKFMEAVVVVARWVRLLSL
                   130        140        150        160        170        180 m666.pep   NX
           ||
a666       NX
```

The following partial DNA sequence was identified in *N. gonorrhoeae* <SEQ ID 2177>:

```
g667.seq
    1   atgcggtttg tcttctgttt gggcgGAGAG ATAGtttctg atccgtgtga 51   tttccAtttg gtattcgtcc gcgtcgaatc tgccgctgAc CAGAcagaaa 101   cgCAGataca tCaaatacgt attcacggca tcggtttcgc aatAAttgcg 151   GAtttccttc agcgtgcccg cgtgGAacgc ttcccacact ttgctgccgt 201   ccataCCCAg ctTGCCCGGA AAGCCGCACA GTTTcgcCat atcgtccagC 251   GGCACATTcg ccctcggctG GTAAAGCGCG AGCAAATCCA TCAAATCGCA 301   GTGGCGTTGG TGATAACGGC TGATGTAGTT GTTCCActtg AAATCGCGGC 351   tgtcgccgAA ATCGccgTCG CCCGTATCCC AATAGCGCGC GGCGTTGATG

401   CCGTATATCA GGGAGCGGTA ATGCAGTACG GGCAGGTCGA AACCGCCGCC

451   GTTCCAGCTG ACCAGTTGCG GCGTATGTTT TTCAACCAAT TCGAAAAACT

501   TGGCAATCAC GACTTCTTCG CCATCGTCCA TCTCGCCGAT GGTGCCGACA

551   TGAACCTTGT CCTGCCCCCA GCGCATACAG CAGGAAACCG CCACAACCTG

601   ATGGAGGTGG TGCTGCATAA AATCGCCGCC GGTCTGTGCG CGGCGTTTCT

651   GCTGCGCGAA CAGCACCACT TCGTCATCCG GCAGGGAAGA CGGCAAGTCA

701   TACAACGTAC GGATACCCTG CACATCGGGT ACGGTTTCAA TATCGAAAGC

751   CAAAATCGTA TTCATGGCAg tACCTTGCAT tcaAAAACAG ACtTGCGCCT

801   ATTgTgtcaT TAA
```

This corresponds to the amino acid sequence <SEQ ID 2178; ORF 667.ng>:

```
g667.pep
    1   MRFVFCLGGE IVSDPCDFHL VFVRVESAAD QTETQIHQIR IHGIGFAIIA

51   DFLQRARVER FPHFAAVHTQ LARKAAQFRH IVQRHIRPRL VKREQIHQIA

101   VALVITADVV VPLEIAAVAE IAVARIPIAR GVDAVYQGAV MQYGQVETAA

151   VPADQLRRMF FNQFEKLGNH DFFAIVHLAD GADMNLVLPP AHTAGNRHNL

201   MEVVLHKIAA GLCAAFLLRE QHHFVIRQGR RQVIQRTDTL HIGYGFNIES

251   QNRIHGSTLH SKTDLRLLCH *
```

The following partial DNA sequence was identified in *N. meningitidis* <SEQ ID 2179>:

```
m667.seq (PARTIAL)
    1   ATGCGGCTTT TCCCCGGCTT GTGCGGACAG GTAATTCCGC ATCCGTTTGA
   51   TTTCCATTTC GTATTCGTCC GCATCCAGCC TGCCGCTGAC CAGACAGAAA
  101   CGCAGGTACA TCAGATAAGT GTTTGCCGCG TCGGTTTCGC AATAATTGCG
  151   GATTTCCTTC AGCCTGCCCG TATGGAATGC CTCCCAAACC TTGCTGCCGT
  201   CCATACCCAG CTTGCCCGGA AAACCGCACA GTTTCGCCAT ATCGTCCAGC
  251   GGCACGTTTG CCCTCGGCTG GTAAAGCGCG AGCAAATCCA TCAAATCGCA
  301   GTGGCGTTGG TGATAACGGC TGATGTAGTT GTTCCACTTG AAATCGCGGC
  351   TGTCGCCGAA ATCGCCGTCG CCCATATCCC AATAGCGCGC GGCGTTGATG
  401   CCGTATATCA GGGAGCGGTA ATGCAGTACG GCAGATCGA AACCGCCGCC
  451   GTTCCAACTG ACCAGTTGCG GCGTATGTTT TTCAATCAAT TCGAAAAATT
  501   TAGCAATGAC CACTTCCTCG CCGTCATCCA TCTCGCCGAT GGTGCCGACA
  551   TGTACTTTAT CCTGCCCCCA ACGCATGCAG CACGAAATCG CCACAACCTG
  601   ATGAAGATGA TGCTGCATAA AATCGCCGCC CGTCTGAGCA CGGCGTTTGT
  651   GCTGGGCAAT CAGCACCACT TG...
```

This corresponds to the amino acid sequence <SEQ ID 2180; ORF 667>:

```
m667.pep (partial)
    1   MRLFPGLCGQ VIPHPFDFHF VFVRIQPAAD QTETQVHQIS VCRVGFAIIA
   51   DFLQPARMEC LPNLAAVHTQ LARKTAQFRH IVQRHVCPRL VKREQIHQIA
  101   VALVITADVV VPLEIAAVAE IAVAHIPIAR GVDAVYQGAV MQYGQIETAA
  151   VPTDQLRRMF FNQFEKFSND HFLAVIHLAD GADMYFILPP THAARNRHNL
  201   MKMMLHKIAA RLSTAFVLGN QHHL...
```

Computer analysis of this amino acid sequence gave the following results:
Homology with a Predicted ORF from *N. gonorrhoeae*
m667/g667 75.0% identity in 224 aa overlap

```
                 10         20         30         40         50         60
   m667.pep  MRLFPGLCGQVIPHPFDFHFVFVRIQPAADQTETQVHQISVCRVGFAIIADFLQPARMEC
             ||:    |  |:::    |   |||:||||::  ||||||||:|||   :   :||||||  ||:|
      g667   MRFVFCLGGEIVSDPCDFHLVFVRVESAADQTETQIHQIRIHGIGFAIIADFLQRARVER
                 10         20         30         40         50         60

70         80         90        100        110        120
   m667.pep  LPNLAAVHTQLARKTAQFRHIVQRHVCPRLVKREQIHQIAVALVITADVVVPLEIAAVAE
             :|::||||||||||||:|||||||||:  ||||||||||||||||||||||||||||||||
      g667   FPHFAAVHTQLARKAAQFRHIVQRHIRPRLVKREQIHQIAVALVITADVVVPLEIAAVAE
                 70         80         90        100        110        120

130        140        150        160        170        180
   m667.pep  IAVAHIPIARGVDAVYQGAVMQYGQIETAAVPTDQLRRMFFNQFEKFSNDHFLAVIHLAD
             ||||:|||||||||||||||||||||:||||||:|||||||||||||::|  |:|::||||
      g667   IAVARIPIARGVDAVYQGAVMQYGQVETAAVPADQLRRMFFNQFEKLGNHDFFAIVHLAD
                130        140        150        160        170        180

190        200        210        220
   m667.pep  GADMYFILPPTHAARNRHNLMKMMLHKIAARLSTAFVLGNQHHL
             ||||  ::|||:|:|  ||||||:::||||||  |  :||:|   :|||:
      g667   GADMNLVLPPAHTAGNRHNLMEVVLHKIAAGLCAAFLLREQHHFVIRQGRRQVIQRTDTL
                190        200        210        220        230        240 g667   HIGYGFNIESQNRIHGSTLHSKTDLRLLCHX
                250        260        270
```

The following partial DNA sequence was identified in *N. meningitidis* <SEQ ID 2181>:

```
a667.seq
    1   ATGCGGTTTG TCTTCTGTTT GGGCGGAGAG ATAGTTTCTG ATCCGCTTGA

51   TTTCCATTTC GTATTCGTCT GCGTCGAATC TGCCGCTGAC CAGACAGAAA

101   CGCAGATACA TCAGATAGGT ATTTACCGCA TCGGTTTCGC AATAATTGCG

151   GATTTCCTTC AGCCTGCCCG CGTGGAACGC CTCCCACACC TTGCTGCCGT

201   CCATACCCAG CTTGCCCGGA AAACCGCACA GTTTCGCCAT ATCGTCCAAC

251   GGCACATTCG CCCTCGGCTG GTAAAGCGCG AGCAAATCCA TCAAATCGCA

301   ATGACGTTGG TGGTAGCGGC TGATGTAGTT GTTCCACTTG AAATCGCGGC

351   TGTCGCCGAA ATCGCCGTCG CCCATATCCC AATAGCGCGC GGCGTTGATG

401   CCGTGTAGCA GCGAACGGTA ATGCAGAACC GGCAGGTCGA AACCGCCGCC

451   GTTCCAACTG ACCAGTTGCG GCGTATGTTT TCAATCAAC TCGAAAAATT

501   TGGCGATAAC CACTTCCTCG CCGTCATCCA TCTCGCCGAT GTACCGACA

551   TGGACTTTAT CCTGCCCCCA ACGCATGCAG CACGAAATCG CCACAATCTG

601   ATGAAGATGA TGCTGCATAA ATCCCCACC CGTCTGAGCA CGGCGTTTTT

651   GCTGGGCAAA CAGCACCACT TCATCGTCGG GCAGCGAGGA CGGCAAGTCA

701   TACAGCGTAC GGATACACTG CACATCGGGT ACGGTTTCAA TATCGAAAGC

751   CAAAATCGTG GTCATGACAG CACCTTGTAT TTAAAA.CAG ACTTGCGCCT

801   ATTGTGTCAT TAA
```

This corresponds to the amino acid sequence <SEQ ID 2182; ORF 667.a>:

```
a667.pep
    1   MRFVFCLGGE IVSDPLDFHF VFVCVESAAD QTETQIHQIG IYRIGFAIIA

51   DFLQPARVER LPHLAAVHTQ LARKTAQFRH IVQRHIRPRL VKREQIHQIA

101   MTLVVAADVV VPLEIAAVAE IAVAHIPIAR GVDAV*QRTV MQNRQVETAA

151   VPTDQLRRMF FNQLEKFGDN HFLAVIHLAD CTDMDFILPP THAARNRHNL

201   MKMMLHKIPT RLSTAFLLGK QHHFIVGQRG RQVIQRTDTL HIGYGFNIES

251   QNRGHDSTLY LKXDLRLLCH *
``` m667/a667 79.0% identity in 224 aa overlap

```
                 10         20         30         40         50         60
   m667.pep  MRLFQGLCGQVIPHPFDFHFVFVRIQPAADQTETQVHQISVCRVGFAIIADFLQPARMEC
             ||:   |  |:::  |:|||||||  ::  ||||||||:|||:: |:||||||||||||:|
   a667      MRFVFCLGGEIVSDPLDFHFVFVCVESAADQTETQIHQIGIYRIGFAIIADFLQPARVER
                 10         20         30         40         50         60

70         80         90        100        110        120
   m667.pep  LPNLAAVHTQLARKTAQFRHIVQRHVCPRLVKREQIHQIAVALVITADVVVPLEIAAVAE
             ||:|||||||||||||||||||||||:  |||||||||||||||:|:::||||||||||||
   a667      LPHLAAVHTQLARKTAQFRHIVQRHIRPRLVKREQIHQIAMTLVVAADVVVPLEIAAVAE
                 70         80         90        100        110        120

130        140        150        160        170        180
   m667.pep  IAVAHIPIARGVDAVYQGAVMQYGQIETAAVPTDQLRRMFFNQFEKFSNDHFLAVIHLAD
             ||||||||||||||||   :|||  :  ||:||||||||||||||:|||||:|:|||||||||
   a667      IAVAHIPIARGVDAVXQRTVMQNRQVETAAVPTDQLRRMFFNQLEKFGDNHFLAVIHLAD
                130        140        150        160        170        180

190        200        210        220
   m667.pep  GADMYFILPPTHAARNRHNLMKMMLHKIAARLSTAFVLGNQHHL
              :|| |||||||||||||||||||||||||||  :|||||| ||:|||:
   a667      CTDMDFILPPTHAARNRHNLMKMMLHKIPTRLSTAFLLGKQHHFIVGQRGRQVIQRTDTL
                190        200        210        220        230        240 a667      HIGYGFNIESQNRGHDSTLYLKXDLRLLCHX
                250        260        270
```

The following partial DNA sequence was identified in *N. gonorrhoeae* <SEQ ID 2183>:

```
g669.seq
    1   ATGCGCCGCA TCGTTAAAAA ACACCAGCCC GTAAACGCGC CACATATCGT

51   TTTGGAAATT CGGATAATGA AACTGCATCG CGCGTTTGTC TTCCTTGGGC

101   GGAAACGTCC CCATCATCAT GACCGCAGCC TTCGGCGGCA ACACGGGATC

151   GAAGGGATGG GTTTCGATTT CAAGCAGATT TTCAGACACG TTCAATCCTC

201   CAACAGGCAA AGCGGCAGAC AGCCGGTTTG CACCAAACCG CCAAACACGG

251   CAAGCCTTCA AACAGCATTA TCACGCCCTG CCGTTTTCGG TTACAATGCC

301   GACATCAAAC GGATACTGTA A
```

This corresponds to the amino acid sequence <SEQ ID 2184; ORF 669.ng>:

```
g669.pep
    1   MRRIVKKHQP VNAPHIVLEI RIMKLHRAFV FLGRKRPHHH DRSLRRQHGI

51   EGMGFDFKQI FRHVQSSNRQ SGRQPVCTKP PNTASLQTAL SRPAVFGYNA

101   DIKRIL*
```

The following partial DNA sequence was identified in *N. meningitidis* <SEQ ID 2185>:

```
m669.seq
    1   ATGCGCCGCA TCATTAAAAA ACACCAGCCC ATAAACGCGC CACATATCGT

51   TTTGGAAATT CGGATAATGA AACTGCATCG CGCGTTTGTC TTCCTTGGGC

101   GGAAACGTCC CCATCATCAT GACAGCAGCC TTCGGCGGCA ACACGGGATC

151   GAAGGGATGG GTTTCGATTT CAAGCAGATT TTCAGACACG TTCAATCCTC

201   CAACAGGCAA AACGGCAGAC AGCCGGTTTG CACCAAACCG CCAAACACGG

251   CAAGCCTTCA AACAGCATTA TCACGCCCTG CCGTTTTCGG TTACAATGCC

301   GACATCAAAC GGATACTGTA A
```

This corresponds to the amino acid sequence <SEQ ID 2186; ORF 669>:

```
m669.pep
    1   MRRIIKKHQP INAPHIVLEI RIMKLHRAFV FLGRKRPHHH DSSLRRQHGI

51   EGMGFDFKQI FRHVQSSNRQ NGRQPVCTKP PNTASLQTAL SRPAVFGYNA

101   DIKRIL*
```

Computer analysis of this amino acid sequence gave the following results:
Homology with a Predicted ORF from *N. gonorrhoeae*
  m669/g669 96.2% identity in 106 aa overlap

```
                   10         20         30         40         50         60
   m669.pep  MRRIIKKHQPINAPHIVLEIRIMKLHRAFVFLGRKRPHHHDSSLRRQHGIEGMGFDFKQI
             ||||:||||| :||||||||||||||||||||||||||||| |||||||||||||||||||
       g669  MRRIVKKHQPVNAPHIVLEIRIMKLHRAFVFLGRKRPHHHDRSLRRQHGIEGMGFDFKQI
                   10         20         30         40         50         60
```

-continued

```
                70        80        90       100
m669.pep   FRHVQSSNRQNGRQPVCTKPPNTASLQTALSRPAVFGYNADIKRILX
           |||||||||||:|||||||||||||||||||||||||||||||||||
     g669  FRHVQSSNRQSGRQPVCTKPPNTASLQTALSRPAVFGYNADIKRILX
                70        80        90       100
```

The following partial DNA sequence was identified in *N. meningitidis* <SEQ ID 2187>:

```
a669.seq
     1   ATGCGCCGCA TCATTAAAAA ACACCAGCCC GTAAACGCGC CACATATCGT

51   TTTGGAAATT CGGATAATGA AACTGCATCG CGCGTTTGTC TTCCTTGGGC

101   GGAAACGTCC CCATCATCAT GACCGCAGCC TTCGGCGGCA ACACGGAATC

151   GAAGGGATGG GTTTCGATTT CAAGCAGATT TCAGACACG TTCAATCCTC

201   CAACAGGCAA AACGGCAGAC AGCCGGTTTG CACCAAACCG CCAAACACGG

251   CAAGCCTTCA AACAGCATTA TCACGCCCTG CCGTTTTCGG TTACAATGCC

301   GACATCAAAC GGATACTGTA A
```

This corresponds to the amino acid sequence <SEQ ID 2188; ORF 669.a>:

```
a669.pep
     1   MRRIIKKHQP VNAPHIVLEI RIMKLHRAFV FLGRKRPHHH DRSLRRQHGI

51   EGMGFDFKQI FRHVQSSNRQ NGRQPVCTKP PNTASLQTAL SRPAVFGYNA

101   DIKRIL*
``` m669/a669 98.1% identity in 106 aa overlap

```
                10        20        30        40        50        60
m669.pep   MRRIIKKHQPINAPHIVLEIRIMKLHRAFVFLGRKRPHHHDSSLRRQHGIEGMGFDFKQI
           |||||||||:|||||||||||||||||||||||||||||| ||||||||||||||||||
     a669  MRRIIKKHQPVNAPHIVLEIRIMKLHRAFVFLGRKRPHHHDRSLRRQHGIEGMGFDFKQI
                10        20        30        40        50        60
                70        80        90       100
m669.pep   FRHVQSSNRQNGRQPVCTKPPNTASLQTALSRPAVFGYNADIKRILX
           |||||||||||||||||||||||||||||||||||||||||||||||
     a669  FRHVQSSNRQNGRQPVCTKPPNTASLQTALSRPAVFGYNADIKRILX
                70        80        90       100
```

The following partial DNA sequence was identified in *N. gonorrhoeae* <SEQ ID 2189>:

```
g670.seq
     1   ATGACTTGTT GCAGGAACTG CTTGGCGCGT TCGTGTTTCG GGTTGGTGAA

51   AAACGCTTCC GGCGTTTCGT CTTCAAGGAT TGCCCTTTA TCGACGAAAA

101   TCACGCGGTC GGCAACTTCG CGGGCAAACC CCATTTCGTG GGTTACGCAC

151   ATCATCGTCA TGCCGCTTTC CGCCAAGTCT TTCATCACTT TCAACACTTC

201   GCCGACCATT TCGGGGTCGA GTGCGGAAGT CGGCTCGTCA AACAGCATCA

251   CGCGCGGCTC CATCGCCAGC CCGCGCGCAA TCGCCACGCG TTGCTGCTGG

301   CCGCCGGAAA GTTGGGAAGG GAAGGCGTCT TTTTTGTGTG CCAGTCCGAC

351   GCGTTCCAAA AGCTCCATTG CCTTTTTCTC CGCCTGTTCC GCATTTTGCC

401   CCTTAACCTT CATCGGTGCG AGGGTGATGT TGTCCAACAC GGTCAGGTGC

451   GGGTAG
```

This corresponds to the amino acid sequence <SEQ ID 2190; ORF 670.ng>:

```
g670.pep
    1   MTCCRNCLAR SCFGLVKNAS GVSSSRICPL STKITRSATS RANPISWVTH

51   IIVMPLSAKS FITFNTSPTI SGSSAEVGSS NSITRGSIAS PRAIATRCCW

101   PPESWEGKAS FLCASPTRSK SSIAFFSACS AFCPLTFIGA RVMLSNTVRC

151   G*
```

The following partial DNA sequence was identified in *N. meningitidis* <SEQ ID 2191>:

```
m670.seq
    1   ATGACCTGTT GCAGGAACTG CTTGGCGCGT TCGTGTTTCG GGTTGGTAAA

51   AAACGCTTCG GGCGTTTCGT CTTCGAGGAT TTGCCCTTTA TCGACGAAAA

101   TCACGCGGTC GGCAACTTCG CGGGCAAACC CCATTTCGTG GGTTACGCAC

151   ATCATCGTCA TGCCGCTTTC TGCCAAGTCT TTCATCACTT TCAACACTTC

201   GCCGACCATT TCGGGGTCGA GTGCGGAGGT CGGTTCGTCA ACAACATTA

251   CGCGCGGTTC CATCGCCAAA CCGCGTGCAA TCGCCACGCG TTGCTGCTGG

301   CCGCCGGAAA GTTGGGAAGG GAAGGCGTCT TTTTTGTGTG CCAGTCCGAC

351   GCGTTCCAAA AGCTCCATTG CCTTTTTCTC CGCCTGTTCC GCATTTTGCC

401   CCTTAACCTT CATCGGTGCG AGGGTAATGT TTTCCAACAC GGTCAGGTGC

451   GGGTAG
```

This corresponds to the amino acid sequence <SEQ ID 2192; ORF 670>:

```
m670.pep
    1   MTCCRNCLAR SCFGLVKNAS GVSSSRICPL STKITRSATS RANPISWVTH

51   IIVMPLSAKS FITFNTSPTI SGSSAEVGSS NNITRGSIAK PRAIATRCCW

101   PPESWEGKAS FLCASPTRSK SSIAFFSACS AFCPLTFIGA RVMFSNTVRC

151   G*
```

Computer analysis of this amino acid sequence gave the following results:
Homology with a Predicted ORF from *N. gonorrhoeae*
 m670/g670 98.0% identity in 151 aa overlap

```
                    10         20         30         40         50         60
      m670.pep  MTCCRNCLARSCFGLVKNASGVSSSRICPLSTKITRSATSRANPISWVTHIIVMPLSAKS
                ||||||||||||||||||||||||||||||||||||||||||||||||||||||||||||
      g670      MTCCRNCLARSCFGLVKNASGVSSSRICPLSTKITRSATSRANPISWVTHIIVMPLSAKS
                    10         20         30         40         50         60

70         80         90        100        110        120
      m670.pep  FITFNTSPTISGSSAEVGSSNNITRGSIAKPRAIATRCCWPPESWEGKASFLCASPTRSK
                |||||||||||||||||||||:||||||:|||||||||||||||||||||||||||||||
      g670      FITFNTSPTISGSSAEVGSSNSITRGSIASPRAIATRCCWPPESWEGKASFLCASPTRSK
                    70         80         90        100        110        120

130        140        150
      m670.pep  SSIAFFSACSAFCPLTFIGARVMFSNTVRCGX
                |||||||||||||||||||||||:||||||||
      g670      SSIAFFSACSAFCPLTFIGARVMLSNTVRCGX
                   130        140        150
```

The following partial DNA sequence was identified in *N. meningitidis* <SEQ ID 2193>:

```
a670.seq
    1   ATGACCTGTT GCAGGAACTG CTTGGCGCGT TCGTGTTTCG GGTTGGTAAA

51   AAACGCTTCC GGCGTTTCGT CTTCGAGGAT TTGCCCTTTA TCGACGAAAA

101   TCACGCGGTC GGCAACTTCG CGGGCAAACC CCATTTCGTG GGTTACGCAC

151   ATCATGGTCA TACCGCTTTC CGCCAAGTCT TTCATCACTT TCAACACTTC

201   GCCGACCATT TCGGGGTCGA GTGCGGAGGT CGGTTCGTCA ACAACATTA

251   CGCGCGGTTC CATCGCCAAA CCGCGTGCAA TCGCCACGCG TTGCTGCTGG

301   CCGCCGGAAA GTTGGGAAGG GAAGGCGTCT TTTTTGTGTG CCAGTCCGAC

351   GCGTTCCAAA AGTTCCATCG CTTTTTTCTC TGCCTGTTCC GCATTTTGAC

401   CTTTAACCTT CATCGGTGCG AGGGTAATGT TTTCCAACAC GGTCAGGTGC

451   GGGTAG
```

This corresponds to the amino acid sequence <SEQ ID 2194; ORF 670.a>:

```
a670.pep
    1   MTCCRNCLAR SCFGLVKNAS GVSSSRICPL STKITRSATS RANPISWVTH

51   IMVIPLSAKS FITFNTSPTI SGSSAEVGSS NNITRGSIAK PRAIATRCCW

101   PPESWEGKAS FLCASPTRSK SSIAFFSACS AF*PLTFIGA RVMFSNTVRC

151   G*
``` m670/a670 98.0% identity in 151 aa overlap

```
                10         20         30         40         50         60
m670.pep  MTCCRNCLARSCFGLVKNASGVSSSRICPLSTKITRSATSRANPISWVTHIIVMPLSAKS
          ||||||||||||||||||||||||||||||||||||||||||||||||||:|:||||||
a670      MTCCRNCLARSCFGLVKNASGVSSSRICPLSTKITRSATSRANPISWVTHIMVIPLSAKS
                10         20         30         40         50         60

70         80         90        100        110        120
m670.pep  FITFNTSPTISGSSAEVGSSNNITRGSIAKPRAIATRCCWPPESWEGKASFLCASPTRSK
          ||||||||||||||||||||||||||||||||||||||||||||||||||||||||||||
a670      FITFNTSPTISGSSAEVGSSNNITRGSIAKPRAIATRCCWPPESWEGKASFLCASPTRSK
                70         80         90        100        110        120

130        140        150
m670.pep  SSIAFFSACSAFCPLTFIGARVMFSNTVRCGX
          |||||||||||| |||||||||||||||||||
a670      SSIAFFSACSAFXPLTFIGARVMFSNTVRCGX
                130        140        150
```

The following partial DNA sequence was identified in *N. gonorrhoeae* <SEQ ID 2195>:

```
g671.seq
    1   ATGATCAGCA GGGTAACAAT CAAAACGCCT TCAATGCAC CGAATACACC

51   GCCCAAAATG CGGTTGGCAA AGCCCAGACC GACCGCCGAA ACTGCGCCGG

101   TCAGCAGCGA ACGGAGCATT TTCTGGATCA GACAGGCAAT GACGAACAGG

151   GAAATGAATG ACAGagccaa TGCAAACAgg cggggTTGGA ACGaggCAAA

201   GGCGAGGTcg gcgaaggGTG CGGCaaAGAG TTTggcaaAA AAGAaggAAA 251   ccaccCATGC cACCATCgaa ccTGCTTCCG CAATCACGCC GCGCATCGTG 301   GAAATGACGA TGCAGGCGGC GATGACGGcg gAGGCGAGGA GGTCGGCAAT

351   GGGGAGGCTA TTCATTCGTT ACCTGGCCGG CGATGCCGTG CACGCGCAGT

401   TGTTCAAAT CGCGTTCGGC ATCCCTTGCG TTTTTATAGT TGCTTGA
```

This corresponds to the amino acid sequence <SEQ ID 2196; ORF 671.ng>:

```
g671.pep
    1   MISRVTIKTP FNAPNTPPKM RLAKPRPTAE TAPVSSERSI FWIRQAMTNR

51   EMNDRANANR RGWNEAKARS AKGAAKSLAK KKETTHATIE PASAITPRIV

101   EMTMQAAMTA EARRSAMGRL FIRYLAGDAV HAQFVQIAFG IPCVFIVA*
```

The following partial DNA sequence was identified in *N. meningitidis* <SEQ ID 2197>:

```
m671.seq
    1   ATGACCAGCA GGGTAACAAT CAAAACGCCT TTCAATGCAC CGAATACGCC

51   GCCCAAAATG CGGTTGGCAA AGCCCAAACC GACCGCCGAA ACTGCGCTGG

101   TCAGCAGCGA ACGGAGCATT TTCTGGATCA GACAGGCAAT GACGAACAGG

151   GAAATGAACG ACAGAGCCAA TGCAAACAGG CGGGGTTGGA ACGAGGCAAA

201   GGCGAGGTCG GCGAAGGAGG CGGCAAAGAT TTGGCGAAA AAGAAGGAAA

251   CCACCCATGC CGCCATTGAG CCTGCCTCCG CAATCACGCC GCGCATCGCG

301   GATAGCACGA TGCAGGCGGC GATGACGGCG GAGACGAGGA GGTCGGCAAT

351   GGGGAGGCTA TTCATTCGTT ACCTGACCGG CGATACCGTG TACGCGCAAT

401   TTGTTCAAAT CGCGTTCGGC ATCCCTTGCG TTTTTATAGT TGCTTGA
```

This corresponds to the amino acid sequence <SEQ ID 2198; ORF 671>:

```
m671.pep
    1   MTSRVTIKTP FNAPNTPPKM RLAKPKPTAE TALVSSERSI FWIRQAMTNR

51   EMNDRANANR RGWNEAKARS AKEAAKSLAK KKETTHAAIE PASAITPRIA

101   DSTMQAAMTA ETRRSAMGRL FIRYLTGDTV YAQFVQIAFG IPCVFIVA*
```

Computer analysis of this amino acid sequence gave the following results:
Homology with a Predicted ORF from *N. gonorrhoeae*
  m671/g671 91.9% identity in 148 aa overlap

```
                   10         20         30         40         50         60
   m671.pep  MTSRVTIKTPFNAPNTPPKMRLAKPKPTAETALVSSERSIFWIRQAMTNREMNDRANANR
             ||||||||||||||||||||||||| :||||| |||||||||||||||||||||||||||
       g671  MTSRVTIKTPFNAPNTPPKMRLAKPRPTAETAPVSSERSIFWIRQAMTNREMNDRANANR
                   10         20         30         40         50         60

70         80         90        100        110        120
   m671.pep  RGWNEAKARSAKEAAKSLAKKKETTHAAIEPASAITPRIADSTMQAAMTAETRRSAMGRL
             |||||||||||| ||||||||||||||| :||||||||||:: ||||||||:||||||||
       g671  RGWNEAKARSAKGAAKSLAKKKETTHATIEPASAITPRIVEMTMQAAMTAEARRSAMGRL
                   70         80         90        100        110        120

130        140       149
   m671.pep  FIRYLTGDTVYAQFVQIAFGIPCVFIVAX
             |||||:||:|:|||||||||||||||||
       g671  FIRYLAGDAVHAQFVQIAFGIPCVFIVAX
                  130        140
```

The following partial DNA sequence was identified in *N. meningitidis* <SEQ ID 2199>:

```
a671.seq
    1   ATGACCAGCA GGGTAATAAT CAAAATGCCT TTCAATGCAC CGAATACGCC

51   GCCCAAAATG CGGTTGGCAA AGCCCAAACC GACCGCCGAA ACTGCCCCGG
```

```
-continued
101   TCAGCAGCGA GCGGAGTATT TTCTGGATCA GACAGGCAAT GACGAATAGG

151   GAAATGAACG ACAGAGCCAA TGCAAACAGG CGGGGTTGGA ACGATGCAAA

201   GGCGATGTCG GCGAAGGGTG CGGCAAAGAG TTTGGCGAAA AAAAAGGCAA

251   CCACCCATGC CGCCATTGAG CCAGCCTCCG CAATCACGCC GCGCATCGCG

301   GATAGCACGA TGCAGGCGGC GATGATGGCG GAGACGAGGA GGTCGGCAAC

351   GGGGAGGTTA TTCATTCGTT ACCTGACCGG CGATACCGTG TACGCGCAAT

401   TTGTTCAAAT CGCGTTCGGC ATCCCTTGCG TTTTTATAGT TGCTTGA
```

This corresponds to the amino acid sequence <SEQ ID 2200; ORF 671.a>:

```
a671.pep
    1   MTSRVIIKMP FNAPNTPPKM RLAKPKPTAE TAPVSSERSI FWIRQAMTNR

51   EMNDRANANR RGWNDAKAMS AKGAAKSLAK KKATTHAAIE PASAITPRIA

101   DSTMQAAMMA ETRRSATGRL FIRYLTGDTV YAQFVQIAFG IPCVFIVA*
``` m671/a671 93.9% identity in 148 aa overlap

```
                  10         20         30         40         50         60
m671.pep   MTSRVTIKTPFNAPNTPPKMRLAKPKPTAETALVSSERSIFWIRQAMTNREMNDRANANR
           ||||| || ||||||||||||||||||||| |||||||||||||||||||||||||||||
a671       MTSRVIIKMPFNAPNTPPKMRLAKPKPTAETAPVSSERSIFWIRQAMTNREMNDRANANR
                  10         20         30         40         50         60

70         80         90        100        110        120
m671.pep   RGWNEAKARSAKEAAKSLAKKKETTHAAIEPASAITPRIADSTMQAAMTAETRRSAMGRL
           ||||:||| ||| |||||||||| |||||||||||||||||||||||| |||||||:||
a671       RGWNDAKAMSAKGAAKSLAKKKATTHAAIEPASAITPRIADSTMQAAMMAETRRSATGRL
                  70         80         90        100        110        120

130        140       149
m671.pep   FIRYLTGDTVYAQFVQIAFGIPCVFIVAX
           |||||||||||||||||||||||||||||
a671       FIRYLTGDTVYAQFVQIAFGIPCVFIVAX
                 130        140
```

The following partial DNA sequence was identified in *N. gonorrhoeae* <SEQ ID 2201>:

```
g672.seq
    1   ATGAGGAAAA TCCGCACCAA AATCTGCGGC ATCACCACAC CGGAAGACGC

51   ACTGTATGCC GCCCACGCCG GCGCAGACGC ATTGGGACTG GTTTTTTACC

101   CCCAAAGCCC CCGCGCTATC GACATCATTA AGCACAAAA AATCGCCGCC

151   GCACTGCCGC CGTTTGTCAG CGTTGTCGCC CTTTTCGTCA ACGAAAGCGC

201   GCAAACATC CGCCGCATCC TTGCCGAAGT GCCGATACAC ATCATCCAAT

251   TCCACGGCGA CGAAGACGAT GCATTCTGCC GGCAGTTCGA CCGCCCCTAT

301   ATTAAAGCCA TTCGTGTTCA GACGGCATCA GACATCCGAA ACGCCGCCAC

351   GCGCTTCCCC AACGCTCAGG CACTGCTGTT CGATGCCTAT CACCCTTCGG

401   AATACGGCGG CACCGGACAC CGCTTCGact GGacgctgtt ggcggAATAT

451   TCGGGCAAGC CGTGGGTGCT TGCCGGCGGG CTGACCCCTG AAAACGTCGG

501   CGAAGCCGTC CGCATCACCG GAGCGGAAGC GGTCGACGTA TCCGGCGGCG

551   TGGAAGCGTC TAAAGGCAAA AAAGACCCCG CCAAAGTCGC CGCCTTTATC

601   GCAACCGCCA ACCGCCTATC CCGTTAA
```

This corresponds to the amino acid sequence <SEQ ID 2202; ORF 672.ng>:

```
g672.pep
    1   MRKIRTKICG ITTPEDALYA AHAGADALGL VFYPQSPRAI DIIKAQKIAA

51   ALPPFVSVVA LFVNESAQNI RRILAEVPIH IIQFHGDEDD AFCRQFDRPY

101   IKAIRVQTAS DIRNAATRFP NAQALLFDAY HPSEYGGTGH RFDWTLLAEY

151   SGKPWVLAGG LTPENVGEAV RITGAEAVDV SGGVEASKGK KDPAKVAAFI

201   ATANRLSR*
```

The following partial DNA sequence was identified in *N. meningitidis* <SEQ ID 2203>:

```
m672.seq
    1   ATGAGGAAAA TCCGCACCAA AATCTGCGGC ATCACCACAC CGGAAGACGC

51   AGCTGCCGCC GCAGCGGCAG GTGCGGATGC CGTCGGGCTG GTCTTTTTCC

101   AAGGCAGCAG CCGGGCCGTC GATATTGCCC GCGCCAAAAA AATCACCGCC

151   GCACTGCCGC CGTTTGTCAG CGTTGTCGCC CTTTTCGTCA ACGAAAGCGC

201   GCAAAACATC CGCCGCATCC TTGCCGAAGT GCCGATACAC ATCATCCAAT

251   TCCACGGCGA CGAAGACGAC GCATTCTGCC GCCAGTTCCA CCGCCCCTAT

301   ATCAAAGCCA TTCGTGTTCA GACGGCATCA GACATCCGAA ACGCCGCCAC

351   GCGCTTCCCC GACGCTCAGG CACTGCTGTT CGATGCCTAC CATCCTTCGG

401   AATACGGCGG CACCGGAAAC CGCTTCGACT GGACGCTGCT GGCGGAATAT

451   TCGGGCAAAC CGTGGGTGCT TGCCGGCGGG CTGACCCCTG AAAACGTCGG

501   CGAAGCCGTC CGCATCACCG GAGCGGAATC GGTCGATGTA TCCGGCGGTG

551   TGGAAGCGTC TAAAGGCAAA AAAGATGCCG CCAAAGTCGC CGCCTTTATC

601   GCAACCGCCA ACCGCCTATC CCGTTAA
```

This corresponds to the amino acid sequence <SEQ ID 2204; ORF 672>:

```
m672.pep
    1   MRKIRTKICG ITTPEDAAAA AAAGADAVGL VFFQGSSRAV DIARAKKITA

51   ALPPFVSVVA LFVNESAQNI RRILAEVPIH IIQFHGDEDD AFCRQFHRPY

101   IKAIRVQTAS DIRNAATRFP DAQALLFDAY HPSEYGGTGN RFDWTLLAEY

151   SGKPWVLAGG LTPENVGEAV RITGAESVDV SGGVEASKGK KDAAKVAAFI

201   ATANRLSR*
```

Computer analysis of this amino acid sequence gave the following results:
Homology with a Predicted ORF from *N. gonorrhoeae*
m672/g672 91.3% identity in 208 aa overlap

```
                   10         20         30         40         50         60
    m672.pep  MRKIRTKICGITTPEDAAAAAAAGADAVGLVFFQGSSRAVDIARAKKITAALPPFVSVVA
              ||||||||||||||||  ||  |||:||||: | ||:||  :|:||:||||||||||||
    g672      MRKIRTKICGITTPEDALYAAHAGADALGLVFYPQSPRAIDIIKAQKIAALPPFVSVVA
                   10         20         30         40         50         60

70         80         90        100        110        120
    m672.pep  LFVNESAQNIRRILAEVPIHIIQFHGDEDDAFCRQFHRPYIKAIRVQTASDIRNAATRFP
              ||||||||||||||||||||||||||||||||||||| ||||||||||||||||||||||
    g672      LFVNESAQNIRRILAEVPIHIIQFHGDEDDAFCRQFDRPYIKAIRVQTASDIRNAATRFP
                   70         80         90        100        110        120
```

-continued

```
                  130       140       150       160       170       180
m672.pep   DAQALLFDAYHPSEYGGTGNRFDWTLLAEYSGKPWVLAGGLTPENVGEAVRITGAESVDV
           :||||||||||||||||||:|||||||||||||||||||||||||||||||||||||:|||
g672       NAQALLFDAYHPSEYGGTGHRFDWTLLAEYSGKPWVLAGGLTPENVGEAVRITGAEAVDV
                  130       140       150       160       170       180

190       200      209
m672.pep   SGGVEASKGKKDAAKVAAFIATANRLSRX
           |||||||||||| ||||||||||||||||
g672       SGGVEASKGKKDPAKVAAFIATANRLSRX
                  190       200
```

The following partial DNA sequence was identified in *N. meningitidis* <SEQ ID 2205>:

```
a672.seq
     1  ATGAGGAAAA TCCGCACCAA AATCTGCGGC ATCACCACAC CGGAAGACGC

51  ACTGTATGCC GCCCACGCCG GCGCAGACGC ATTGGGACTG GTTTTTTACC

101  CCCAAAGCCC CCGCGCTGTC GACATCATTA AAGCACAAAA AATCACCGCC

151  GCACTGCCGC CGTTTGTCAG CGTTGTCGCC CTTTTCGTCA ACGAAAGCGC

201  GCAAAACATC CGCCGCATCC TTGCCGAAGT ACCGATACAC ATCATCCAAT

251  TCCACGGCGA CGAAGACGAC GCATTCTGCC GCCAGTTCCA CCGCCCCTAT

301  ATCAAGGCCA TTCGTGTTCA GACGGCATCA GACATCCGAA ACGCCGCCGA

351  CCGCTTCCCC GACGCTCAGG CACTGCTGTT CGATGCCTAC CATCCTTCGG

401  AATACGGCGG CACCGGACAC CGCTTCGACT GGACGCTGTT GGCGGAATAT

451  TCGGGCAAAC CGTGGGTGCT TGCCGGCGGG CTGACCCCTG AAAACGTCGA

501  CGAAGCCATC CGCATCACCG GAGCGGAAGC GGTCGATGTA TCCGGCGGCG

551  TGGAAGCGTC TAAAGGCAAA AAAGACCCAG CCAAAGTTGC CGCCTTTATC

601  GCAACCGCCA ACCGCCTATC CCGTTAA
```

This corresponds to the amino acid sequence <SEQ ID 2206; ORF 672.a>:

```
a672.pep
     1  MRKIRTKICG ITTPEDALYA AHAGADALGL VFYPQSPRAV DIIKAQKITA

51  ALPPFVSVVA LFVNESAQNI RRILAEVPIH IIQFHGDEDD AFCRQFHRPY

101  IKAIRVQTAS DIRNAADRFP DAQALLFDAY HPSEYGGTGH RFDWTLLAEY

151  SGKPWVLAGG LTPENVDEAI RITGAEAVDV SGGVEASKGK KDPAKVAAFI

201  ATANRLSR*
``` m672/a672 91.8% identity in 208 aa overlap

```
                   10        20        30        40        50        60
m672.pep   MRKIRTKICGITTPEDAAAAAAAGADAVGLVFFQGSSRAVDIARAKKITAALPPFVSVVA
           |||||||||||||||||  || |||||:||||:  | ||||| :|:||||||||||||||
a672       MRKIRTKICGITTPEDALYAAHAGADALGLVFYPQSPRAVDIIKAQKITAALPPFVSVVA
                   10        20        30        40        50        60

70        80        90       100       110       120
m672.pep   LFVNESAQNIRRILAEVPIHIIQFHGDEDDAFCRQFHRPYIKAIRVQTASDIRNAATRFP
           |||||||||||||||||||||||||||||||||||||||||||||||||||||||| |||
a672       LFVNESAQNIRRILAEVPIHIIQFHGDEDDAFCRQFHRPYIKAIRVQTASDIRNAADRFP
                   70        80        90       100       110       120

130       140       150       160       170       180
m672.pep   DAQALLFDAYHPSEYGGTGNRFDWTLLAEYSGKPWVLAGGLTPENVGEAVRITGAESVDV
           |||||||||||||||||||:|||||||||||||||||||||||||| ||:||||||:|||
a672       DAQALLFDAYHPSEYGGTGHRFDWTLLAEYSGKPWVLAGGLTPENVDEAIRITGAEAVDV
                  130       140       150       160       170       180
```

-continued

```
                     190        200       209
m672.pep    SGGVEASKGKKDAAKVAAFIATANRLSRX
            ||||||||||| ||||||||||||||||
a672        SGGVEASKGKKDPAKVAAFIATANRLSRX
                     190        200
```

The following partial DNA sequence was identified in *N. gonorrhoeae* <SEQ ID 2207>:

```
g673.seq
      1    ATGGATATTG AAACCTTCCT TGCAGGGGAA CGCGCCGCCG GCGGATACCG

51    TTGCGGCTTC GTGGCGATTG TCGGTCGTCC GAACGTGGGC AAATCAACGC

101    TGATGAACCA TCTCATCGGT CAGAAAATCA GTATTACCAG CAAAAAGGCG

151    CAGACGACGC GCAACCGCGT AACGGGGATT TATACCGACG ATACCGCGCA

201    GTTCGTGTTT GTCGATACGC CGGGCTTTCA AACCGACCAC CGCAACGCGC

251    TCAACGACAG GCTGAATCAA AATGTTACCG AGGCGCTCGG CGGTGTGGAT

301    GTGGTGGTTT TCGTCGTGGA GGCGATGCGC CTTACCGATG CCGACCGCGT

351    CGTGTTGAAA CAACTGCCCA AGCACACGCC GGTCATTTTA GTGATCAACA

401    AAATCGACAA GGACAAGGCG AAAGACCGTT ACGCGCTGGA GGCGTTTGTT

451    GCCCAAGTGC GCGCCGAATT TGAATTTGCG GCGGCGGAGG CGGTCAGTGC

501    GAAACACGGT TTGCGGATTG CCAACCTGTT GGAGCTGCTC AAGCCGTATC

551    TGCCCGAAAG CGTACCGATG TATCCCGAAG ACATGGTTAC GGACAAATCG

601    GCGCGTTTTT TGGCGATGGA AATCGTGCGT GAAAAACTCT TCCGCTATTT

651    GGGCGAGGAG CTGCCTTATG CGATGAACGT CGAAGTGGAG CAGTTTGAAG

701    AGGGAGACGG TTTGAACCGC ATCTACatcg cCGTTTTGGT CGACAAAGAA

751    AGCCAAAAGG CGATTTTGAT CGGTAAAGGC GGGGAGCGTT TGAAAAAAAT

801    TTCCACCGAA GCGCGGCTGG ATATGGAAAA ACTGTTTGAT AACAAAGTAT

851    TTTTGAAGGT CTGGGTCAAA GTCAAATCCG GTTGGGCAGA CGACATTCGC

901    TTCCTGCGCG AGCTGGGTTT GTAG
```

This corresponds to the amino acid sequence <SEQ ID 2208; ORF 673.ng>:

```
g673.pep
      1    MDIETFLAGE RAAGGYRCGF VAIVGRPNVG KSTLMNHLIG QKISITSKKA

51    QTTRNRVTGI YTDDTAQFVF VDTPGFQTDH RNALNDRLNQ NVTEALGGVD

101    VVVFVVEAMR LTDADRVVLK QLPKHTPVIL VINKIDKDKA KDRYALEAFV

151    AQVRAEFEFA AAEAVSAKHG LRIANLLELL KPYLPESVPM YPEDMVTDKS

201    ARFLAMEIVR EKLFRYLGEE LPYAMNVEVE QFEEGDGLNR IYIAVLVDKE

251    SQKAILIGKG GERLKKISTE ARLDMEKLFD NKVFLKVWVK VKSGWADDIR

301    FLRELGL*
```

The following partial DNA sequence was identified in *N. meningitidis* <SEQ ID 2209>:

```
m673.seq
      1    ATGGATATTG AAACCTTCCT TGCAGGGGAA CGCGCCGCCG GCGGATACCG

51    TTGCGGCTTC GTAGCGATTG TCGGCCGTCC GAACGTGGGC AAATCAACGC
```

-continued

```
101  TGATGAACCA TCTCATCGGT CAGAAAATCA GTATTACCAG CAAAAGGCG

151  CAGACGACGC GCAACCGCGT AACGGGGATT TATACCGACG ATACCGCGCA

201  GTTCGTGTTT GTCGATACGC CCGGCTTTCA AACCGACCAC CGCAACGCGC

251  TCAACGACAG GCTGAATCAA AATGTTACCG AGGCGCTCGG CGGCGTGGAT

301  GTGGTGGTTT TCGTCGTGGA GGCGATGCGC TTTACCGATG CCGACCGCGT

351  CGTGTTGAAA CAACTGCCCA AGCACACGCC GGTCATTTTA GTGGTCAACA

401  AAATCGACAA GGACAAGGCG AAAGACCGTT ACGCGCTGGA GGCGTTTGTT

451  GCCCAAGTGC GCGCCGAATT TGAATTTGCG GCGGCGGAGG CGGTCAGCGC

501  GAAACACGGA TTGCGGATTG CCAACCTGTT GGAGCTGATT AAGCCGTATC

551  TGCCCGAAAG CGTGCCGATG TATCCCGAAG ATATGGTTAC GGACAAATCG

601  GCGCGTTTTT TGGCGATGGA AATCGTGCGT GAAAAATTGT TCCGCTATTT

651  GGGCGAGGAA TTGCCTTATG CGATGAACGT CGAAGTGGAG CAGTTTGAAG

701  AGGAAGACGG TTTGAACCGC ATCTATATCG CCGTTTTGGT CGATAAGGAA

751  AGCCAAAAGG CAATTTTAAT CGGTAAAGGC GGAGAACGTT TGAAGAAAAT

801  TTCCACCGAA GCGCGGTTGG ATATGGAAAA ACTGTTTGAT ACCAAAGTAT

851  TTTTGAAGGT CTGGGTCAAA GTCAAATCCG GTTGGGCGGA CGACATCCGC

901  TTCCTGCGCG AGCTGGGTTT GTAG
```

This corresponds to the amino acid sequence <SEQ ID 2210; ORF 673>:

```
m673.pep
   1  MDIETFLAGE RAAGGYRCGF VAIVGRPNVG KSTLMNHLIG QKISITSKKA

51  QTTRNRVTGI YTDDTAQFVF VDTPGFQTDH RNALNDRLNQ NVTEALGGVD

101  VVVFVVEAMR FTDADRVVLK QLPKHTPVIL VVNKIDKDKA KDRYALEAFV

151  AQVRAEFEFA AAEAVSAKHG LRIANLLELI KPYLPESVPM YPEDMVTDKS

201  ARFLAMEIVR EKLFRYLGEE LPYAMNVEVE QFEEEDGLNR IYIAVLVDKE

251  SQKAILIGKG GERLKKISTE ARLDMEKLFD TKVFLKVWVK VKSGWADDIR

301  FLRELGL*
```

Computer analysis of this amino acid sequence gave the following results:
Homology with a Predicted ORF from *N. gonorrhoeae*
  m673/g673 98.4% identity in 307 aa overlap

```
                 10         20         30         40         50         60
  m673.pep  MDIETFLAGERAAGGYRCGFVAIVGRPNVGKSTLMNHLIGQKISITSKKAQTTRNRVTGI
            ||||||||||||||||||||||||||||||||||||||||||||||||||||||||||||
      g673  MDIETFLAGERAAGGYRCGFVAIVGRPNVGKSTLMNHLIGQKISITSKKAQTTRNRVTGI
                 10         20         30         40         50         60

70         80         90        100        110        120
  m673.pep  YTDDTAQFVFVDTPGFQTDHRNALNDRLNQNVTEALGGVDVVVFVVEAMRFTDADRVVLK
            |||||||||||||||||||||||||||||||||||||||||||||||||:||||||||||
      g673  YTDDTAQFVFVDTPGFQTDHRNALNDRLNQNVTEALGGVDVVVFVVEAMRLTDADRVVLK
                 70         80         90        100        110        120

130        140        150        160        170        180
  m673.pep  QLPKHTPVILVVNKIDKDKAKDRYALEAFVAQVRAEFEFAAAEAVSAKHGLRIANLLELI
            |||||||||||:||||||||||||||||||||||||||||||||||||||||||||||||:
      g673  QLPKHTPVILVINKIDKDKAKDRYALEAFVAQVRAEFEFAAAEAVSAKHGLRIANLLEIL
                130        140        150        160        170        180
```

-continued

```
                190        200        210        220        230        240
m673.pep   KPYLPESVPMYPEDMVTDKSARFLAMEIVREKLFRYLGEELPYAMNVEVEQFEEEDGLNR
           |||||||||||||||||||||||||||||||||||||||||||||||||||||| |||||
g673       KPYLPESVPMYPEDMVTDKSARFLAMEIVREKLFRYLGEELPYAMNVEVEQFEEGDGLNR
                190        200        210        220        230        240

250        260        270        280        290        300
m673.pep   IYIAVLVDKESQKAILIGKGGERLKKISTEARLDMEKLFDTKVFLKVWVKVKSGWADDIR
           |||||||||||||||||||||||||||||||||||||||:||||||||||||||||||||
g673       IYIAVLVDKESQKAILIGKGGERLKKISTEARLDMEKLFDNKVFLKVWVKVKSGWADDIR
                250        260        270        280        290        300 m673.pep   FLRELGLX
           ||||||||
g673       FLRELGLX
```

The following partial DNA sequence was identified in *N. meningitidis* <SEQ ID 2211>:

```
a673.seq
     1   ATGGATATTG AAACCTTCCT TGCAGGGGAA CGCGCCGCCG ACGGATACCG

51   TTGCGGCTTC GTAGCGATTG TCGGCCGTCC GAACGTGGGC AAATCAACGC

101   TGATGAATCA TCTCATCGGT CAGAAAATCA GTATTACCAG CAAAAAGGCG

151   CAGACGACGC GCAACCGCGT AACGGGGATT TATACCGACG ATACCGCGCA

201   GTTTGTGTTT GTCGATACGC CCGGTTTTCA AACCGACCAC CGCAACGCGC

251   TCAACGACCG TTTGAATCAA AACGTTACCG AGGCACTCGG CGGCGTGGAT

301   GTGGTGGTTT TCGTCGTGGA AGCGATGCGT TTTACCGATG CCGACCGCGT

351   CGTGTTGAAA CAACTGCCCA AGCACACGCC GGTCATTTTA GTGGTCAACA

401   AAATCGATAA GGACAAGGCG AAAGACCGTT ACGCGCTGGA GGCGTTTGTT

451   GCCCAGGTGC GCGCCGAATT TGAATTTGCG GCGGCGGAGG CGGTCAGCGC

501   GAAACACGGA TTGCGGATTG CCAACCTGTT GGAGCTGATT AAGCCGTATC

551   TGCCCGAAAG CGTGCCGATG TATCCCGAAG ATATGGTTAC GGACAAATCG

601   GCGCGTTTTT TAGCGATGGA AATCGTGCGT GAAAAATTGT TCCGCTATTT

651   GGGCGAGGAA TTGCCTTATG CGATGAACGT CGAAGTGGAG CAGTTTGAAG

701   AGGAAGACGG TTTGAACCGC ATCTATATCG CCGTTTTGGT CGATAAGGAA

751   AGCCAAAAGG CGATTTTAAT CGGCAAAGGC GGGGAGCGTT TGAAGAAAAT

801   TTCCACCGAA GCGCGGTTGG ATATGGAAAA ACTGTTTGAT ACCAAAGTAT

851   TTTTGAAGGT CTGGGTCAAA GTCAAATCCG GTTGGGCGGA CGACATCCGC

901   TTCCTGCGCG AGCTGGGTTT GTAG
```

This corresponds to the amino acid sequence <SEQ ID 2212; ORF 673.a>:

```
a673.pep
     1   MDIETFLAGE RAADGYRCGF VAIVGRPNVG KSTLMNHLIG QKISITSKKA

51   QTTRNRVTGI YTDDTAQFVF VDTPGFQTDH RNALNDRLNQ NVTEALGGVD

101   VVVFVVEAMR FTDADRVVLK QLPKHTPVIL VVNKIDKDKA KDRYALEAFV

151   AQVRAEFEFA AAEAVSAKHG LRIANLLELI KPYLPESVPM YPEDMVTDKS

201   ARFLAMEIVR EKLFRYLGEE LPYAMNVEVE QFEEEDGLNR IYIAVLVDKE

251   SQKAILIGKG GERLKKISTE ARLDMEKLFD TKVFLKVWVK VKSGWADDIR

301   FLRELGL*
``` m673/a673 99.7% identity in 307 aa overlap

```
              10        20        30        40        50        60
m673.pep  MDIETFLAGERAAGGYRCGFVAIVGRPNVGKSTLMNHLIGQKISITSKKAQTTRNRVTGI
          |||||||||||| |||||||||||||||||||||||||||||||||||||||||||||||
a673      MDIETFLAGERAADGYRCGFVAIVGRPNVGKSTLMNHLIGQKISITSKKAQTTRNRVTGI
              10        20        30        40        50        60

70        80        90       100       110       120
m673.pep  YTDDTAQFVFVDTPGFQTDHRNALNDRLNQNVTEALGGVDVVVFVVEAMRFTDADRVVLK
          ||||||||||||||||||||||||||||||||||||||||||||||||||||||||||||
a673      YTDDTAQFVFVDTPGFQTDHRNALNDRLNQNVTEALGGVDVVVFVVEAMRFTDADRVVLK
              70        80        90       100       110       120

130       140       150       160       170       180
m673.pep  QLPKHTPVILVVNKIDKDKAKDRYALEAFVAQVRAEFEFAAAEAVSAKHGLRIANLLEII
          ||||||||||||||||||||||||||||||||||||||||||||||||||||||||||||
a673      QLPKHTPVILVVNKIDKDKAKDRYALEAFVAQVRAEFEFAAAEAVSAKHGLRIANLLEII
             130       140       150       160       170       180

190       200       210       220       230       240
m673.pep  KPYLPESVPMYPEDMVTDKSARFLAMEIVREKLFRYLGEELPYAMNVEVEQFEEEDGLNR
          ||||||||||||||||||||||||||||||||||||||||||||||||||||||||||||
a673      KPYLPESVPMYPEDMVTDKSARFLAMEIVREKLFRYLGEELPYAMNVEVEQFEEEDGLNR
             190       200       210       220       230       240

250       260       270       280       290       300
m673.pep  IYIAVLVDKESQKAILIGKGGERLKKISTEARLDMEKLFDTKVFLKVWVKVKSGWADDIR
          ||||||||||||||||||||||||||||||||||||||||||||||||||||||||||||
a673      IYIAVLVDKESQKAILIGKGGERLKKISTEARLDMEKLFDTKVFLKVWVKVKSGWADDIR
             250       260       270       280       290       300 m673.pep  FLRELGLX
          ||||||||
a673      FLRELGLX
```

The following partial DNA sequence was identified in *N. gonorrhoeae* <SEQ ID 2213>:

```
g674.seq
    1    ATGAAAACAG CCCGCCGCCG TTCCCGCGAG CTTGCCGTAC AAGCCGTTTA

51    CCAATCCCTT ATCAACCGCA CCGCCGCGCC CGAAATTGCT AAAAACATCC

101    GCGAAATGTC CGACTTTGCC AAAGCGGACG AAGAATTGTT CAACAAACTC

151    TTCTTCGGCA CACAAACCAA TGCAGCGGAC TACATCCAAA AAATCCGCCC

201    GCTGCTCGAC AGGGACGAAA AAGACCTCAA CCCCATCGAA CGCGCCGTTT

251    TGCTGACCGC CTGCCACGAG CTTTCCGCTA TGCCCGAAAC GCCCTACCCC

301    GTCATTATCA ACGAAGCCAT CGAAGTTACC AAAACCTTCG GCGGCACGGA

351    CGGGCACAAA TTCGTCAACG GCATCCTCGA CAAACTCGCC GCCCAAATCC

401    GCCCAGACGA GCCCAAACGC CGTTGA
```

This corresponds to the amino acid sequence <SEQ ID 2214; ORF 674.ng>:

```
g674.pep
    1    MKTARRRSRE LAVQAVYQSL INRTAAPEIA KNIREMSDFA KADEELFNKL

51    FFGTQTNAAD YIQKIRPLLD RDEKDLNPIE RAVLLTACHE LSAMPETPYP

101    VIINEAIEVT KTFGGTDGHK FVNGILDKLA AQIRPDEPKR R*
```

The following partial DNA sequence was identified in *N. meningitidis* <SEQ ID 2215>:

```
m674.seq
    1    ATGAAAACAG CCCGCCGCCG TTCCCGCGAG CTTGCCGTAC AAGCCGTTTA

51    CCAATCCCTT ATCAACCGCA CCGCCGCGCC CGAAATTGCT AAAAACATCC
```

-continued

```
101    GCGAAATGTC CGACTTTGCC AAGGCAGACG AAGAATTGTT CAACAAACTT

151    TTCTTCGGCA CGCAAACCAA TGCGGCAGAG TATATCCGAC AAATCCGCCC

201    GCTACTTGAC AGGGACGAAA AAGACCTCAA CCCCATCGAA CGCGCCGTTT

251    TGCTGACCGC CTGCCACGAG CTGTCCGCCA TGCCCGAAAC GCCCTACCCC

301    GTCATTATCA ACGAAGCCAT CGAAGTTACC AAAACCTTCG GCGGCACGGA

351    CGGGCACAAA TTCGTCAACG GCATCCTCGA CAAACTCGCC GCCCAAATCC

401    GCCCCGACGA GCCCAAACGC CGTTGA
```

This corresponds to the amino acid sequence <SEQ ID 2216; ORF 674>:

```
m674.pep
    1    MKTARRRSRE LAVQAVYQSL INRTAAPEIA KNIREMSDFA KADEELFNKL

51    FFGTQTNAAE YIRQIRPLLD RDEKDLNPIE RAVLLTACHE LSAMPETPYP

101    VIINEAIEVT KTFGGTDGHK FVNGILDKLA AQIRPDEPKR R*
```

Computer analysis of this amino acid sequence gave the following results:
Homology with a Predicted ORF from *N. gonorrhoeae*
m674/g674 97.9% identity in 141 aa overlap

```
                    10         20         30         40         50         60
m674.pep   MKTARRRSRELAVQAVYQSLINRTAAPEIAKNIREMSDFAKADEELFNKLFFGTQTNAAE
           ||||||||||||||||||||||||||||||||||||||||||||||||||||||||||| :
g674       MKTARRRSRELAVQAVYQSLINRTAAPEIAKNIREMSDFAKADEELFNKLFFGTQTNAAD
                    10         20         30         40         50         60

70         80         90        100        110        120
m674.pep   YIRQIRPLLDRDEKDLNPIERAVLLTACHELSAMPETPYPVIINEAIEVTKTFGGTDGHK
           ||:::|||||||||||||||||||||||||||||||||||||||||||||||||||||||
g674       YIQKIRPLLDRDEKDLNPIERAVLLTACHELSAMPETPYPVIINEAIEVTKTFGGTDGHK
                    70         80         90        100        110        120

130        140
m674.pep   FVNGILDKLAAQIRPDEPKRRX
           ||||||||||||||||||||||
g674       FVNGILDKLAAQIRPDEPKRRX
                   130        140
```

The following partial DNA sequence was identified in *N. meningitidis* <SEQ ID 2217>:

```
a674.seq
    1    ATGAAAACAG CCCGCCGCCG TTCCCGCGAG CTTGCCGTAC AAGCCGTTTA

51    CCAATCCCTT ATCAACCGCA CCGCCGCGCC CGAGATTGCT AAAAACATCC

101    GCGAAATGCC CGACTTTGCC AAGGCAGACG AAGAATTGTT CAACAAACTT

151    TTCTTCGGCA CGCAAACCAA TGCGGCAGAG TACATCCGAC AAATCCGCCC

201    CCTGCTCGAC CGCGACGAAA AAGACCTCAA CCCCATCGAA CGCGCCGTCC

251    TGCTGACCGC CTGCCACGAG CTGTCCGCCA TGCCCGAAAC GCCCTACCCC

301    GTCATCATCA ACGAAGCCAT CGAAGTAACC AAAACCTTCG GCGGCACGGA

351    CGGGCACAAA TTCGTCAACG GCATCCTCGA CAAACTCGCC GCCCAAATCC

401    GTCCCGACGA GCCCAAACGC CGTTGA
```

This corresponds to the amino acid sequence <SEQ ID 2218; ORF 674.a>:

```
a674.pep
    1   MKTARRRSRE LAVQAVYQSL INRTAAPEIA KNIREMPDFA KADEELFNKL

51   FFGTQTNAAE YIRQIRPLLD RDEKDLNPIE RAVLLTACHE LSAMPETPYP

101   VIINEAIEVT KTFGGTDGHK FVNGILDKLA AQIRPDEPKR R*
``` m674/a674 99.3% identity in 141 aa overlap

```
                    10         20         30         40         50         60
    m674.pep   MKTARRRSRELAVQAVYQSLINRTAAPEIAKNIREMSDFAKADEELFNKLFFGTQTNAAE
               ||||||||||||||||||||||||||||||||||||||||||||||||||||||||||||
    a674       MKTARRRSRELAVQAVYQSLINRTAAPEIAKNIREMSDFAKADEELFNKLFFGTQTNAAE
                    10         20         30         40         50         60
                    70         80         90        100        110        120
    m674.pep   YIRQIRPLLDRDEKDLNPIERAVLLTACHELSAMPETPYPVIINEAIEVTKTFGGTDGHK
               ||||||||||||||||||||||||||||||||||||||||||||||||||||||||||||
    a674       YIRQIRPLLDRDEKDLNPIERAVLLTACHELSAMPETPYPVIINEAIEVTKTFGGTDGHK
                    70         80         90        100        110        120
                   130        140
    m674.pep   FVNGILDKLAAQIRPDEPKRRX
               ||||||||||||||||||||||
    a674       FVNGILDKLAAQIRPDEPKRRX
                   130        140
```

The following partial DNA sequence was identified in *N. gonorrhoeae* <SEQ ID 2219>:

```
g675.seq
    1   ATGAACACCA TCGCCCCcaa cctcgacgGC AAACACCTCC GCATCGGCAT

51   CGTACAGGCA CGCTTCACCA ACGAAATCGG CAGCCAAATG CTCAAAGTCT

101   GCTGCCGCAC CCTCCAAGAA TTGGGCGTAG CAGACGAAAa catcaccgtc 151   gCCACCGTAC CCGGCGCGCT TGAAATCCCC ATCGCGCTGA TGAACTTTGC

201   CTCTTCCGAA AAATTTGACG CACTGATTGC CATCGGCGTC GTCATCCGTG

251   GCGAAACCTA CCATTTCGAG CTGGTTGCCA ACGAATCCGG CGCAGGGATC

301   GGCCGCGTCG CACTCGACTA CAACATCCCG ATTGCCAACG CCGTCCTGAC

351   CACCGAAAAC GACGCGCAGG CAATTGAACG GATTGGAGAA AAAGCCTCGG

401   ATGCCGCCAA AGTCGCCGTA GAATGCGCCA ACCTCGTCAA CCTTCTGCTC

451   GAAGAACAGT TTGAAGACGA AGAATAA
```

This corresponds to the amino acid sequence <SEQ ID 2220; ORF 675.ng>:

```
g675.pep
    1   MNTIAPNLDG KHLRIGIVQA RFTNEIGSQM LKVCCRTLQE LGVADENITV

51   ATVPGALEIP IALMNFASSE KFDALIAIGV VIRGETYHFE LVANESGAGI

101   GRVALDYNIP IANAVLTTEN DAQAIERIGE KASDAAKVAV ECANLVNLLL

151   EEQFEDEE*
```

The following partial DNA sequence was identified in *N. meningitidis* <SEQ ID 2221>:

```
m675.seq
    1   ATGAACACCA TCGCCCCCAA CCTCGACGGC AAACACCTCC GCATCGGCAT

51   CGTACAGGCA CGCTTCACCA ACGAAATCGG CAGCGAAATG CTCAAAGTCT

101   GCTGCCGCAC CCTCCAAGAA TTGGGCGTGG CAGACGAAAA CATTACCGTC
```

-continued

```
151  GCCACCGTAC CCGGCGCGCT TGAAATCCCC ATCGCGCTGA TGAACTTTGC

201  CTCTTCCGAA AAGTTTGACG CACTGATTGC CATCGGCGTC GTCATCCGTG

251  GCGAAACCTA CCATTTCGAG CTGGTTTCCA ACGAATCCGG AGCAGGCGTC

301  AGCCGCGTCG CACTCGACTA CAATATCCCG ATTGCCAATG CCGTCCTAAC

351  CACCGAAAAC GACGCGCAGG CAATCGAACG GATTGAAGAA AAAGCCTCGG

401  ATGCCGCCAA AGTCGCCGTC GAATGCGCCA ACCTCGTCAA CCTGCTGCTC

451  GAAGAACAGT TTGAAGACGA AGAATAA
```

This corresponds to the amino acid sequence <SEQ ID 2222; ORF 675>:

```
m675.pep
   1  MNTIAPNLDG KHLRIGIVQA RFTNEIGSEM LKVCCRTLQE LGVADENITV

51  ATVPGALEIP IALMNFASSE KFDALIAIGV VIRGETYHFE LVSNESGAGV

101  SRVALDYNIP IANAVLTTEN DAQAIERIEE KASDAAKVAV ECANLVNLLL

151  EEQFEDEE*
```

Computer analysis of this amino acid sequence gave the following results:
Homology with a Predicted ORF from *N. gonorrhoeae*
m675/g675 96.8% identity in 158 aa overlap

```
                 10        20        30        40        50        60
    m675.pep  MNTIAPNLDGKHLRIGIVQARFTNEIGSEMLKVCCRTLQELGVADENITVATVPGALEIP
              ||||||||||||||||||||||||||||:|||||||||||||||||||||||||||||||
    g675      MNTIAPNLDGKHLRIGIVQARFTNEIGSQMLKVCCRTLQELGVADENITVATVPGALEIP
                 10        20        30        40        50        60

70        80        90       100       110       120
    m675.pep  IALMNFASSEKFDALIAIGVVIRGETYHFELVSNESGAGVSRVALDYNIPIANAVLTTEN
              ||||||||||||||||||||||||||||||||||||:|||||::||||||||||||||||
    g675      IALMNFASSEKFDALIAIGVVIRGETYHFELVANESGAGIGRVALDYNIPIANAVLTTEN
                 70        80        90       100       110       120

130       140       150      159
    m675.pep  DAQAIERIEEKASDAAKVAVECANLVNLLLEEQFEDEEX
              ||||||||| |||||||||||||||||||||||||||||
    g675      DAQAIERIGEKASDAAKVAVECANLVNLLLEEQFEDEEX
                130       140       150
```

The following partial DNA sequence was identified in *N. meningitidis* <SEQ ID 2223>:

```
a675.seq
   1  ATGAACACCA TCGCCCCCAA CCTCGACGGC AAACACCTCC GCATCGGCAT

51  CGTACAGGCA CGCTTCACCA ACGAAATCGG CAGCGAAATG CTCAAAGTCT

101  GCTGCCGCAC CCTCCAAGAA TTGGGCGTGG CAGACGAAAA CATTACCGTC

151  GCCACCGTAC CCGGCGCGCT TGAAATCCCC ATCGCGCTGA TGAACTTTGC

201  CTCTTCTGAA AAATTTGACG CACTGATTGC CATCGGCGTC GTTATCCGTG

251  GCGAAACCTA CCATTTCGAG CTGGTTTCCA ACGAATCCGG AGCAGGGGTC

301  AGCCGCGTCG CACTCGACTA CAACATCCCG ATTGCCAATG CCGTCCTGAC

351  CACGGAAAAC GACGCACAGG CAATCGAACG GATTGAAGAA AAAGCCTCGG

401  ATGCCGCCAA AGTCGCCGTA GAATGCGCCA ACCTCGTCAA CCTCCTGCTC

451  GAAGAACAGT TTGAAGACGA AGAATAA
```

This corresponds to the amino acid sequence <SEQ ID 2224; ORF 675.a>:

```
a675.pep
     1   MNTIAPNLDG KHLRIGIVQA RFTNEIGSEM LKVCCRTLQE LGVADENITV

51   ATVPGALEIP IALMNFASSE KFDALIAIGV VIRGETYHFE LVSNESGAGV

101   SRVALDYNIP IANAVLTTEN DAQAIERIEE KASDAAKVAV ECANLVNLLL

151   EEQFEDEE*
``` m675/a675 100.0% identity in 158 aa overlap

```
                  10         20         30         40         50         60
    m675.pep  MNTIAPNLDGKHLRIGIVQARFTNEIGSEMLKVCCRTLQELGVADENITVATVPGALEIP
              ||||||||||||||||||||||||||||||||||||||||||||||||||||||||||||
    a675      MNTIAPNLDGKHLRIGIVQARFTNEIGSEMLKVCCRTLQELGVADENITVATVPGALEIP
                  10         20         30         40         50         60

70         80         90        100        110        120
    m675.pep  IALMNFASSEKFDALIAIGVVIRGETYHFELVSNESGAGVSRVALDYNIPIANAVLTTEN
              ||||||||||||||||||||||||||||||||||||||||||||||||||||||||||||
    a675      IALMNFASSEKFDALIAIGVVIRGETYHFELVSNESGAGVSRVALDYNIPIANAVLTTEN
                  70         80         90        100        110        120

130        140        150       159
    m675.pep  DAQAIERIEEKASDAAKVAVECANLVNLLLEEQFEDEEX
              |||||||||||||||||||||||||||||||||||||||
    a675      DAQAIERIEEKASDAAKVAVECANLVNLLLEEQFEDEEX
                 130        140        150
```

The following partial DNA sequence was identified in *N. gonorrhoeae* <SEQ ID 2225>:

```
g677.seq
     1   ATGCCGCAGA TTTTGGTGCG GATTTTCCTC ATTCGGTATT CCTTTATTtg 51   ggAAACGGTG CGCTTGTGCC GTTTCAGACG GCATTCCCGA TCAGTCGATT

101   TTGATGTATT CGACAGAAAG GATTTCAATT TCCTCACGGC CTTCCGGCGT

151   GTTCAAAACC ACTTCGTCGC CTTCGCGCGC TTTAATCAGG CAACGCGCCA

201   ACGGCGAAAT CCAAGAAATT TTGTTTTGCG CGGTATCGAT TTCATCGACG

251   CCGACGATTT TGACGGTTTG CTCGCGCCCG TCGCCGCGCA ACAGACCGAC

301   GGTCGCGCCG AAAAATACTT GGTCGGTCGC TTCGCGCAAT TCGGGATCGA

351   CGACGACGGC AGCCTCCAAA CGTTTGGTCA GGAAACGGAT GCGGCGGTCG

401   ATTTCGCGCA TACGGCGTTT GCCGTAAAGA TAGTCGCCGT TTTCGCTGCG

451   GTCGCCGTTG CCTGCCGCCC AGTTGACGAT TTGGACGATT TCGGGGCGTT

501   CTTTATTGAC CAGTTGATAA AGCTCGTCTT TCAATGCCTG CCATCCGGCG

551   GGCGTAATGT AGTTTTTGGT TTCGGTACTC ATATTGTGTG CGGATGA
```

This corresponds to the amino acid sequence <SEQ ID 2226; ORF 677.ng>:

```
g677.pep
     1   MPQILVRIFL IRYSFIWETV RLCRFRRHSR SVDFDVFDRK DFNFLTAFRR

51   VQNHFVAFAR FNQATRQRRN PRNFVLRGID FIDADDFDGL LAPVAAQQTD

101   GRAEKYLVGR FAQFGIDDDG SLQTFGQETD AAVDFAHTAF AVKIVAVFAA

151   VAVACRPVDD LDDFGAFFID QLIKLVFQCL PSGGRNVVFG FGTHIVCG*
```

The following partial DNA sequence was identified in *N. meningitidis* <SEQ ID 2227>:

```
m677.seq
    1   ATGCCGCAGA TTTTGGTGCG GATTTTCCTC ATTCGGTATT CCTTTATTTG

51   GGAAACGGCG CGCTTTTGCC GTTTCAGACG GCATTCCCGA TCAGTCGATT

101   TTGATGTATT CGACAGAAAG GATTTCAATT TCCTCACGCC CTTCCGGCGT

151   GTTCAAAACC ACTTCGTCGC CTTCGCGCGC TTTAATCAGA CAACGAGCCA

201   GCGGCGAAAT CCAAGAAATT TGTTTTGCG CGGTATCGAT TTCATCGATG

251   CCGACGATTT TGACGGTTTG CTCGCGCCCG TCGTCGCGCA ACAGTCCGAC

301   CGTCGCGCCG AAAAACACTT GGTCGGTCGC TTCGCGCAAT CGGGATCGA

351   CGACGACGGC AGCCTCCAAA CGTTTGGTCA GGAAACGGAT GCGGCGGTCG

401   ATTTCGCGCA TACGGCGTTT GCCGTAAAGA TAGTCGCCGT TTTCGCTGCG

451   GTCGCCGTTG CCTGCCGCCC AGTTGACGAT TTGGACGATT TCGGGCGTT

501   CTTTGTTGAC CAGTTGATAA AGCTCGTCTT TCAATGCCTG CCATCCGGCG

551   GGCGTAATGT AGTTTTTGGT TTCGGTACTC ATATTGTGTG CGGATGA
```

This corresponds to the amino acid sequence <SEQ ID 2228; ORF 677>:

```
m677.pep
    1   MPQILVRIFL IRYSFIWETA RFCRFRRHSR SVDFDVFDRK DFNFLTPFRR

51   VQNHFVAFAR FNQTTSQRRN PRNFVLRGID FIDADDFDGL LAPVVAQQSD

101   RRAEKHLVGR FAQFGIDDDG SLQTFGQETD AAVDFAHTAF AVKIVAVFAA

151   VAVACRPVDD LDDFGAFFVD QLIKLVFQCL PSGGRNVVFG FGTHIVCG*
```

Computer analysis of this amino acid sequence gave the following results:
Homology with a Predicted ORF from *N. gonorrhoeae*
m677/g677 94.9% identity in 198 aa overlap

```
                10         20         30         40         50         60
m677.pep MPQILVRIFLIRYSFIWETARFCRFRRHSRSVDFDVFDRKDFNFLTPFRRVQNHFVAFAR
         |||||||||||||||||||||:|:||||||||||||||||||||| ||||||||||||||
g677     MPQILVRIFLIRYSFIWETVRLCRFRRHSRSVDFDVFDRKDFNFLTAFRRVQNHFVAFAR
                10         20         30         40         50         60

70         80         90        100        110        120
m677.pep FNQTTSQRRNPRNFVLRGIDFIDADDFDGLLAPVVAQQSDRRAEKHLVGRFAQFGIDDDG
         |||:| |||||||||||||||||||||||||||||:|||:| ||||:|||||||||||||
g677     FNQATRQRRNPRNFVLRGIDFIDADDFDGLLAPVAAQQTDGRAEKYLVGRFAQFGIDDDG
                70         80         90        100        110        120

130        140        150        160        170        180
m677.pep SLQTFGQETDAAVDFAHTAFAVKIVAVFAAVAVACRPVDDLDDFGAFFVDQLIKLVFQCL
         ||||||||||||||||||||||||||||||||||||||||||||||||:|||||||||||
g677     SLQTFGQETDAAVDFAHTAFAVKIVAVFAAVAVACRPVDDLDDFGAFFIDQLIKLVFQCL
               130        140        150        160        170        180

190        199
m677.pep PSGGRNVVFGFGTHIVCGX
         ||||||||||||||||||
g677     PSGGRNVVFGFGTHIVCGX
               190
```

The following partial DNA sequence was identified in *N. meningitidis* <SEQ ID 2229>:

```
a677.seq
    1   ATGCCGCAGA TTTTGGTGCG GATTTTCCTC ATTCGGTATT CCTTTATTTG

51   GGAAACGGCG CGTTTGTGCC GTTTCAGACG GCATTCCCGA TCAGTCGATT

101   TTGATGTATT CGACAGAAAG GATTTCAATT TCCTCACGCC CTTCCGGCGT
```

-continued

```
151  GTTTAAAACC ACTTCGTCGC CTTCACGCGC TTTAATCAGA CAACGAGCCA

201  GCGGCGAAAT CCAAGAAATT TTGTTTTGCG CGGTATCGAT TTCATCGATG

251  CCGACGATTT TGACGGTTTG CTCGCGCCCG TCGCCGCGCA ACAGACCGAC

301  GGTCGCGCCG AAAAACACTT GGTCGGTCGC TTCGCGCAAT TCGGGATCAA

351  CGACGACGGC GGCTTCCAAA CGCTTGGTCA GGAAACGGAT GCGGCGGTCG

401  ATTTCGCGCA TACGGCGTTT GCCGTAAAGG TAGTCGCCGT TTTCGCTGCG

451  GTCGCCGTTG CCTGCCGCCC AGTTGACGAT TTGGACGATT TCGGGGCGTT

501  CTTTATTAAC CAGTTGATAA AGCTCGTCTT TCAATGCCTG CCATCCGGCG

551  GGCGTAATGT AGTTTTTGGT TTCGGTACTC ATATTGTGTG CGGATGA
```

This corresponds to the amino acid sequence <SEQ ID 2230; ORF 677.a>:

```
a677.pep
    1   MPQILVRIFL IRYSFIWETA RLCRFRRHSR SVDFDVFDRK DFNFLTPFRR

51   V*NHFVAFTR FNQTTSQRRN PRNFVLRGID FIDADDFDGL LAPVAAQQTD

101   GRAEKHLVGR FAQFGINDDG GFQTLGQETD AAVDFAHTAF AVKVVAVFAA

151   VAVACRPVDD LDDFGAFFIN QLIKLVFQCL PSGGRNVVFG FGTHIVCG*
``` m677/a677 93.4% identity in 198 aa overlap

```
                 10         20         30         40         50         60
    m677.pep  MPQILVRIFLIRYSFIWETARFCRFRRHSRSVDFDVFDRKDFNFLTPFRRVQNHFVAFAR
              ||||||||||||||||||||| :|||||||||||||||||||||||||||| ||||||:|
    a677      MPQILVRIFLIRYSFIWETARLCRFRRHSRSVDFDVFDRKDFNFLTPFRRXQNHFVAFTR
                 10         20         30         40         50         60

70         80         90        100        110        120
    m677.pep  FNQTTSQRRNPRNFVLRGIDFIDADDFDGLLAPVVAQQSDRRAEKHLVGRFAQFGIDDDG
              ||||||||||||||||||||||||||||||||||| :|||:| ||||||||||||||||
    a677      FNQTTSQRRNPRNFVLRGIDFIDADDFDGLLAPVAAQQTDGRAEKHLVGRFAQFGINDDG
                 70         80         90        100        110        120

130        140        150        160        170        180
    m677.pep  SLQTFGQETDAAVDFAHTAFAVKIVAVFAAVAVACRPVDDLDDFGAFFVDQLIKLVFQCL
              ::||:|||||||||||||||||:||||||||||||||||||||||||| ::||||||||
    a677      GFQTLGQETDAAVDFAHTAFAVKVVAVFAAVAVACRPVDDLDDFGAFFINQLIKLVFQCL
                130        140        150        160        170        180

190        199
    m677.pep  PSGGRNVVFGFGTHIVCGX
              |||||||||||||||||||
    a677      PSGGRNVVFGFGTHIVCGX
                190
```

The following partial DNA sequence was identified in *N. gonorrhoeae* <SEQ ID 2231>:

```
g678.seq
    1   ATGAATAGCC TCCCCATTGC CGACCTCCTC GCCTccgCCG TCATCGCCGC

51   CTGCATCGTC ATTTCCACGA TGCGCGGCGT GATTGCGGAA GCAggttcGA

101   TGGTgGCATG ggtggTTTcc tTCTTTTttg ccAAACTCTt tGCCGCACcc 151   ttcgccgACC TCGCCTTTGc ctCGTTCCAA ccccgccTGT TTGCAttggc 201   tCTGTCATTC ATTTCCCTGT TCGTCATTGC CTGTCTGATC CAGAAAATGC

251   TCCGTTCGCT GCTGACCGGC GCAGTTTCGG CGGTCGGTCT GGGCTTTGCC

301   AACCGCATTT TGGGCGGTGT ATTCGGTGCA TTGAAAGGCG TTTTGATTGT

351   TACCCTGCTG ATCATGCTTG CTTCAAAAAC CGACCTGCCC GATACCGAAG
```

-continued

```
401  AATGGCAACA GTCCTATACC GTACCGTTTT TCGTATCGCT TTCCGAAGCG

451  GTGTTAAACC atacggaCAA CGCacccgaa tCCCtcgacg acgactaa
```

This corresponds to the amino acid sequence <SEQ ID 2232; ORF 678.ng>:

```
g678.pep
    1  MNSLPIADLL ASAVIAACIV ISTMRGVIAE AGSMVAWVVS FFFAKLFAAP

51  FADLAFASFQ PRLFALALSF ISLFVIACLI QKMLRSLLTG AVSAVGLGFA

101  NRILGGVFGA LKGVLIVTLL IMLASKTDLP DTEEWQQSYT VPFFVSLSEA

151  VLNHTDNAPE SLDDD*
```

The following partial DNA sequence was identified in *N. meningitidis* <SEQ ID 2233>:

```
m678.seq
    1  ATGAATAGCC TCCCCATTGC CGACCTCCTC GTCTCCGCCG TCATCGCCGC

51  CTGCATCGTG CTATCCGCGA TGCGCGGCGT GATTGCGGAG GCAGGCTCAA

101  TGGCGGCATG GGTGGTTTCC TTCTTTTTCG CCAAACTCTT TGCCGCCTCC

151  TTCGCCGACC TCGCCTTTGC CTCGTTCCAA CCCCGCCTGT TTGCATTGGC

201  TCTGTCGTTC ATTTCCCTGT TCGTCATTGC CTGTCTGATC CAGAAAATGC

251  TCCGTTCGCT GCTGACCAGC GCAGTTTCGG CGGTCGGTTT GGGCTTTGCC

301  AACCGCATTT TGGGCGGCGT ATTCGGTGCA TTGAAAGGCG TTTTGATTGT

351  TACCCTGCTG GTCATGCTTG CTTCAAAAAC CGACCTGCCC GATACCGAAG

401  AATGGCGGCA ATCTTACACA CTGCCGTTTT TCGTATCGCT TTCCGAAGCC

451  GTGTTGAACC ATAGCGGCGG CACGGCGGAA ACTCCGGAAG ACGATTGA
```

This corresponds to the amino acid sequence <SEQ ID 2234; ORF 678>:

```
m678.pep
    1  MNSLPIADLL VSAVIAACIV LSAMRGVIAE AGSMAAWVVS FFFAKLFAAS

51  FADLAFASFQ PRLFALALSF ISLFVIACLI QKMLRSLLTS AVSAVGLGFA

101  NRILGGVFGA LKGVLIVTLL VMLASKTDLP DTEEWRQSYT LPFFVSLSEA

151  VLNHSGGTAE TPEDD*
```

Computer analysis of this amino acid sequence gave the following results:
Homology with a Predicted ORF from *N. gonorrhoeae*
 m678/g678 89.7% identity in 165 aa overlap

```
                10         20         30         40         50         60
m678.pep  MNSLPIADLLVSAVIAACIVLSAMRGVIAEAGSMAAWVVSFFFAKLFAASFADLAFASFQ
          ||||||||||:||||||||||:|:|||||||||||||:||||||||||||  ||||||||||
g678      MNSLPIADLLASAVIAACIVISTMRGVIAEAGSMVAWVVSFFFAKLFAAPFADLAFASFQ
                10         20         30         40         50         60

70         80         90        100        110        120
m678.pep  PRLFALALSFISLFVIACLIQKMLRSLLTSAVSAVGLGFANRILGGVFGALKGVLIVTLL
          ||||||||||||||||||||||||||||||:|||||||||||||||||||||||||||||
g678      PRLFALALSFISLFVIACLIQKMLRSLLTGAVSAVGLGFANRILGGVFGALKGVLIVTLL
                70         80         90        100        110        120
```

```
                130        140        150        160
m678.pep    VMLASKTDLPDTEEWRQSYTLPFFVSLSEAVLNHSGGTAETPEDDX
            :|||||||||||||:||||:||||||||||||||:  ::  |: :|||
g678        IMLASKTDLPDTEEWQQSYTVPFFVSLSEAVLNHTDNAPESLDDDX
                130        140        150        160
```

The following partial DNA sequence was identified in *N. meningitidis* <SEQ ID 2235>:

```
a678.seq
     1    ATGAATAACC TCCCCGTTGC CGACCTCCTC GTCTCCGCCA TCATCGCCGC

51    CTGCATCGTG CTATCCGCGA TGCGCGGCGT GATTGCGGAG GCTGGCTCAA

101    TGGCGGCATG GGTGGTTGCC TTTTTTTTCG CCAAACTCTT TGCCGCACCC

151    TTCGCCGACA TCGCCTTTGC ATCGTTCCAA CCCCGCCTGT TTGCATTGGC

201    TCTGTCGTTC ATTTCCCTAT TCGTCATTGC CTGTCTGATC CAGAAAATAC

251    TCCGCTCGCT GCTGACCGGG GCAGTTTCGG CGGTCGGTTT GGGCTTTGCC

301    AACCGCATTT TGGGCGGCGT ATTCGGTGCA TTGAAAGGCA TTTTGATTAT

351    TACCCTGCTG GTCATGCTCG CTTCAAAAAC CGACCTGCCC GATACCGAAG

401    AATGGCGGCA ATCTTACACA CTGCCGTTTT TCGTATCGCT TTCCGAAGCC

451    GTGTTGAACC ATAGCGGCGG CACGGCGGAA ACTCCGGAAG ACGATTGA
```

This corresponds to the amino acid sequence <SEQ ID 2236; ORF 678.a>:

```
a678.pep
     1    MNNLPVADLL VSAIIAACIV LSAMRGVIAE AGSMAAWVVA FFFAKLFAAP

51    FADIAFASFQ PRLFALALSF ISLFVIACLI QKILRSLLTG AVSAVGLGFA

101    NRILGGVFGA LKGILIITLL VMLASKTDLP DTEEWRQSYT LPFFVSLSEA

151    VLNHSGGTAE TPEDD*
``` m678/a678 93.9% identity in 165 aa overlap

```
                10         20         30         40         50         60
m678.pep    MNSLPIADLLVSAVIAACIVLSAMRGVIAEAGSMAAWVVSFFFAKLFAASFADLAFASFQ
            ||:|||||||||:|||||||||||||||||||||||||||:|||||||||  |||:||||||
a678        MNNLPVADLLVSAIIAACIVLSAMRGVIAEAGSMAAWVVAFFFAKLFAAPFADIAFASFQ
                10         20         30         40         50         60

70         80         90        100        110        120
m678.pep    PRLFALALSFISLFVIACLIQKMLRSLLTSAVSAVGLGFANRILGGVFGALKGVLIVTLL
            ||||||||||||||||||||||:||||||:||||||||||||||||||||||||||:|||:|||
a678        PRLFALALSFISLFVIACLIQKILRSLLTGAVSAVGLGFANRILGGVFGALKGILIITLL
                70         80         90        100        110        120

130        140        150        160
m678.pep    VMLASKTDLPDTEEWRQSYTLPFFVSLSEAVLNHSGGTAETPEDDX
            ||||||||||||||||||||||||||||||||||||||||||||||
a678        VMLASKTDLPDTEEWRQSYTLPFFVSLSEAVLNHSGGTAETPEDDX
                130        140        150        160
```

The following partial DNA sequence was identified in *N. gonorrhoeae* <SEQ ID 2237>:

```
g680.seq
     1    ATGACGAAGG GCAGTTCGGC GATGTCCAGC CCACGCGCGG CGATATCGGT

51    GGCGACGAGG ACGCGCAGGC TGCCGTCTTT GAAGGCGTTG AGTGTTTCGA
```

```
101  GCCTGCTTTG TTGGGAACGG TCGCCGTGTA TCGCCTGTGC GGACAGGTTG

151  CGGCGCACCA GTTCGCGCGT TACGCGGTCG ACGCTTTGTT TGGTtttgCA

201  AAAGACGATA ACTTGGTTCA TATGCAGATC GACAATCAGC CGTTCGAGCA

251  GGTTGCGCTT TTGGAAGGTA TCGACGGCGA TGATGTgttg ttcGACGTTG

301  GCGTTGGTGG TGTTTTGGGC GGCAACCTCG ACGGTTTCGG GCGCGTTCAT

351  GAAGTCTTGC GCCAGTTTGC GTATCGGTGC GGAGAAGGTG GCGGAAAAGA

401  GCAGGGTTTG GCGTTGGCGG GGCAGCATCT GCATGATTTT GCGGATGTCG

451  TCGATAAACC CCATATCCAA CATGCGGTCT GCTTCGTCCA GAACGACGAT

501  TTCGGCTTTG TTTAAACTGA TGTTTTTCTG TTTCACATGG TCGAGCAGCC

551  GTCCGACGGT GGCGACGACT ATTTCGCAGC CGGCACGCAG GTCGGCGGTT

601  TGTTTGTCCA TGTTGACACC GCCGAAGAGG ACGGTATGCC GCAGCGGCAG

651  GTTTTTAATg tag
```

This corresponds to the amino acid sequence <SEQ ID 2238; ORF 680.ng>:

```
g680.pep
  1  MTKGSSAMSS PRAAISVATR TRRLPSLKAL SVSSLLCWER SPCIACADRL

51  RRTSSRVTRS TLCLVLQKTI TWFICRSTIS RSSRLRFWKV STAMMCCSTL

101  ALVVFWAATS TVSGAFMKSC ASLRIGAEKV AEKSRVWRWR GSICMILRMS

151  SINPISNMRS ASSRTTISAL FKLMFFCFTW SSSRPTVATT ISQPARRSAV

201  CLSMLTPPKR TVCRSGRFLM *
```

The following partial DNA sequence was identified in *N. meningitidis* <SEQ ID 2239>:

```
m680.seq
  1  ATGACGAAGG GCAGTTCGGC AATGTCCAGC CCGCGCGCGG CGATGTCGGT

51  GGCGACGAGG ACGCGCAGGT TGCCGTCTTT GAAGGCGTTG AGTGTTTCGA

101  GCCGGCTTTG TTGGGAACGG TCGCCGTGTA TCGCCTGTGC GGACAGGTTG

151  CGGCGCACCA GTTCGCGCGT TACGCGGTCG ACGCTTTGTT TGGTTTTGCA

201  GAACACGATG ACCTGGTTCA TATGCAAATC GACAATCAGC CGTTCGAGCA

251  GGTTGCGCTT CTGAATGGTA TCGACGGCGA TGATGTGCTG CTCGACGTTG

301  GCGTTGGTGG TGTTTTGCGC GGCGACTTCG ACGGTTTCGG GCGCGTTCAT

351  GAAGTCTTGC GCCAGTTTGC GTATCGGGGC GGAGAAGGTG GCGGAAAAGA

401  GCAGGGTTTG GCGTTGGCGG GGCAGCATCT GCATGATTTT GCGGATGTCG

451  TCGATAAAAC CCATATCCAG CATACGGTCG GCTTCGTCCA AAACGACGAT

501  TTCGACTTTG TTCAAATGGA TGTTTTTCTG TTTCACGTGG TCGAGCAGCC

551  GTCCGACGGT GGCGACGACG ATTTCGCAGC CGGCACGCAG GTCGGCGGTC

601  TGTTTGTCCA TATTCATACC GCCGAACAAG ACGGTGTGGC GCAGCGGCAG

651  GTTTTTGATG TAG
```

This corresponds to the amino acid sequence <SEQ ID 2240; ORF 680>:

```
m680.pep
    1   MTKGSSAMSS PRAAMSVATR TRRLPSLKAL SVSSRLCWER SPCIACADRL

51   RRTSSRVTRS TLCLVLQNTM TWFICKSTIS RSSRLRF*MV STAMMCCSTL

101   ALVVFCAATS TVSGAFMKSC ASLRIGAEKV AEKSRVWRWR GSICMILRMS

151   SIKPISSIRS ASSKTTISTL FKWMFFCFTW SSSRPTVATT ISQPARRSAV

201   CLSIFIPPNK TVWRSGRFLM *
```

Computer analysis of this amino acid sequence gave the following results:
Homology with a Predicted ORF from *N. gonorrhoeae*
m680/g680 90.9% identity in 220 aa overlap

```
                   10         20         30         40         50         60
   m680.pep  MTKGSSAMSSPRAAMSVATRTRRLPSLKALSVSSRLCWERSPCIACADRLRRTSSRVTRS
             ||||||||||||||:||||||||||||||||||||  ||||||||||||||| ||||||||
       g680  MTKGSSAMSSPRAAISVATRTRRLPSLKALSVSSLLCWERSPCIACADRLRRTSSRVTRS
                   10         20         30         40         50         60

70         80         90        100        110        120
   m680.pep  TLCLVLQNTMTWFICKSTISRSSRLRFXMVSTAMMCCSTLALVVFCAATSTVSGAFMKSC
             ||||||:|:||||| ||||||||||||||   ||||||||||||||  ||||||||||||
       g680  TLCLVLQKTITWFICRSTISRSSRLRFWKVSTAMMCCSTLALVVFWAATSTVSGAFMKSC
                   70         80         90        100        110        120

130        140        150        160        170        180
   m680.pep  ASLRIGAEKVAEKSRVWRWRGSICMILRMSSIKPISSIRSASSKTTISTLFKWMFFCFTW
             ||||||||||||||||||||||||||||||:|||::||||||||:|||  |||||||||
       g680  ASLRIGAEKVAEKSRVWRWRGSICMILRMSSINPISNMRSASSRTTISALFKLMFFCFTW
                  130        140        150        160        170        180

190        200        210        220
   m680.pep  SSSRPTVATTISQPARRSAVCLSIFIPPNKTVWRSGRFLMX
             ||||||||||||||||||||||||::   ||::||  |||||||||
       g680  SSSRPTVATTISQPARRSAVCLSMLTPPKRTVCRSGRFLMX
                  190        200        210        220
```

The following partial DNA sequence was identified in *N. meningitidis* <SEQ ID 2241>:

```
a680.seq
    1   ATGACGAAGG GCAGTTCGGC AATATCCAGC CCCCGCGCGG CGATATCGGT

51   GGCGACGAGG ACGCGCAGGT TGCCGTCTTT GAAGGCGTTG AGTGTTTCGA

101   GCCGGCTTTG TTGGGAACGG TCGCCGTGTA TCGCCTGTGC GGACAGGTTG

151   CGGCGCACCA GTTCGCGCGT TACGCGGTCG ACGCTTTGTT TGGTTTTGCA

201   GAACACGATG ACCTGGTTCA TATGCAAATC GACAATCAGC CGTTCGAGCA

251   GGTTGCGCTT CTGAATGGTA TCGACGGCGA TGATGTGCTG CTCGACGTTG

301   GCGTTGGTGG TGTCTTGCGC GGCGACTTCG ACGGTTTCGG GCGCGTTCAT

351   GAAGTCTTGC GCCAGTTTGC GTATCGGGGC GGAGAAGGTG GCGGAAAAGA

401   GCAGGGTTTG GCGTTGGCGG GGCAGCATCT GCATGATTTT GCGGATGTCG

451   TCGATAAAAC CCATATCCAG CATACGGTCG GCTTCGTCCA AAACGACGAT

501   TTCGACTTTG TTCAAATGGA TGTTTTTCTG TTTCACGTGG TCGAGCAGCC

551   GTCCGACGGT GGCGACGACG ATTTCGCAGC CGGCACGCAG GTCGGCGGTC

601   TGTTTGTCCA TATTCATACC GCCGAACAAG ACGGTGTGGC GCAGCGGCAG

651   GTTTTTGATG TAG
```

This corresponds to the amino acid sequence <SEQ ID 2242; ORF 680.a>:

```
a680.pep
    1   MTKGSSAISS PRAAISVATR TRRLPSLKAL SVSSRLCWER SPCIACADRL

51   RRTSSRVTRS TLCLVLQNTM TWFICKSTIS RSSRLRF*MV STAMMCCSTL

101   ALVVSCAATS TVSGAFMKSC ASLRIGAEKV AEKSRVWRWR GSICMILRMS

151   SIKPISSIRS ASSKTTISTL FKWMFFCFTW SSSRPTVATT ISQPARRSAV

201   CLSIFIPPNK TVWRSGRFLM *
``` m680/a680 98.6% identity in 220 aa overlap

```
                    10         20         30         40         50         60
   m680.pep  MTKGSSAMSSPRAAMSVATRTRRLPSLKALSVSSRLCWERSPCIACADRLRRTSSRVTRS
             ||||||:||||||:||||||||||||||||||||||||||||||||||||||||||||||
   a680      MTKGSSAISSPRAAISVATRTRRLPSLKALSVSSRLCWERSPCIACADRLRRTSSRVTRS
                    10         20         30         40         50         60
                    70         80         90        100        110        120
   m680.pep  TLCLVLQNTMTWFICKSTISRSSRLRFXMVSTAMMCCSTLALVVFCAATSTVSGAFMKSC
             ||||||||||||||||||||||||||||||||||||||||||||:|||||||||||||||
   a680      TLCLVLQNTMTWFICKSTISRSSRLRFXMVSTAMMCCSTLALVVSCAATSTVSGAFMKSC
                    70         80         90        100        110        120
                   130        140        150        160        170        180
   m680.pep  ASLRIGAEKVAEKSRVWRWRGSICMILRMSSIKPISSIRSASSKTTISTLFKWMFFCFTW
             ||||||||||||||||||||||||||||||||||||||||||||||||||||||||||||
   a680      ASLRIGAEKVAEKSRVWRWRGSICMILRMSSIKPISSIRSASSKTTISTLFKWMFFCFTW
                   130        140        150        160        170        180
                   190        200        210        220
   m680.pep  SSSRPTVATTISQPARRSAVCLSIFIPPNKTVWRSGRFLMX
             ||||||||||||||||||||||||||||||||||||||||
   a680      SSSRPTVATTISQPARRSAVCLSIFIPPNKTVWRSGRFLMX
                   190        200        210        220
```

The following partial DNA sequence was identified in *N. gonorrhoeae* <SEQ ID 2243>:

```
g681.seq
    1   ATGACGACGC CGATGGCAAT CAGTGCGTCA AATTTTTCGG AAGAGGCAAA

51   GTTCATCAGC GCGATGGGGA TTTCAAGCGC GCCGGGTACG GTGGcgacgg 101   tgatgtTTTC GTCTGCTACG CCCAATTCTT GGAGGGTGCG GCAGCAGACT

151   TTGAGCATTT GGCTGCCGAT TCGTTGGTG AAGCGTGCCT GTACGATGCC

201   GATGCGGAGG TGTTTGCcgt cgaggttgGG GGCGATGGTG TTCATTGGGT

251   GTCCTTTGGT ATTCGGGGTT TCGGAATGCC GTCTGAAGGT TTCAGTCTTG

301   CGGCTGCCAG TCGGCAACGG TTTGGAATGT GCCGTCTTCG GCAAGCTCCC

351   ACGCGCTGCC TTCGGGTTGG GAAAGCAGTG CGGCGGTTTC AGGGTTGGTT

401   TTGGTGATGT CGGCGAGGCT GACGATGCTG AAGTTGTCGG GGTCGTCGGT

451   GTATTCGTCG GTTTCGTCGC CGCTGAAGAA ACGCCAGCCG CTGTCGTTTT

501   CAAAAACGGG GGCTTCGCGG TAAAGGAAGC CGACGGGCCG GTTTTGTTTG

551   GCGACGGTGT TGGTGGCGAT GCAGCGGTCG AGTGCCGAGG AAAGTGCTTG

601   TGCAAATGCG TTCATTGCGG GAATACGTTG GGGGGGGGGA AACTTGCGGA

651   TTTTACCACG ATTCCCGCGT TGTCGGCAGA CGGCGGCGGT TTGGTGGTAC

701   AATGTGCGCC GTTTGCAGCC TTAAGGTGTT TCTGTATTTT TGGAGTATGG

751   AAACGCATTC GGGCTGTTTT TTGCGGAAGA CGGTAA
```

This corresponds to the amino acid sequence <SEQ ID 2244; ORF 681>:

```
g681.pep
     1  MTTPMAISAS NFSEEAKFIS AMGISSAPGT VATVMFSSAT PNSWRVRQQT

51  LSIWLPISLV KRACTMPMRR CLPSRLGAMV FIGCPLVFGV SECRLKVSVL

101  RLPVGNGLEC AVFGKLPRAA FGLGKQCGGF RVGFGDVGEA DDAEVVGVVG

151  VFVGFVAAEE TPAAVVFKNG GFAVKEADGP VLFGDGVGGD AAVECRGKCL

201  CKCVHCGNTL GGGKLADFTT IPALSADGGG LVVQCAPFAA LRCFCIFGVW

251  KRIRAVFCGR R*
```

The following partial DNA sequence was identified in *N. meningitidis* <SEQ ID 2245>:

```
m681.seq
     1  ATGACGACGC CGATGGCAAT CAGTGCGTCA AACTTTTCGG AAGAGGCAAA

51  GTTCATCAGC GCGATGGGGA TTTCAAGCGC GCCGGGTACG GTGGCGACGG

101  TAATGTTTTC GTCTGCCACG CCCAATTCTT GGAGGGTGCG GCAGCAGACT

151  TTGAGCATTT CGCTGCCGAT TTCGTTGGTG AAGCGTGCCT GTACGATGCC

201  GATGCGGAGG TGTTTGCCGT CGAGGTTGGG GGCGATGGTG TTCATTGGGT

251  GTCCTTTGGT ATTCGGAGTT TCGGAATGCC GTCTGAAGGT TTCAGTCTTG

301  CGGCTGCCAG TCGGCGACGG TTTGGAATGT GCCGTCTTCG GCAAGCTCCC

351  ATGCGCTGCC TTCGGGTTGG GAGAGCAGTG CGGCGGTTTC AGGGTTGGTT

401  TTGGCGATGT CGGCGAGGCT GACGATGCTG AAGTTGTCCG GATCGTCGGT

451  GTATTCGTCG GTCTCGTCGC CGCTGAAGAA ACGCCAGCCG CTGTCGTTTT

501  CAAAAACGGG GGCTTCGCGG TAGAGGAAGC CGACGGGCCG GTTTTGTTTG

551  GCGACGGTGT TGGTGGCGAT ACAGCGGTCG AGTGCCGAGG AAAGTGCTTG

601  TGCAAATGCG TTCATTACGG GAATACGTTG GGGG.AAAAC TTACGGATTT

651  TACCACGATT CGTGCGTTGT CGGCAGACGG CGGCGGTTTG GTGGTACAAT

701  GTGCGCCGTT TGCAGCCTTA AGGTGTTTCT GTATTTTTGG AGTATGGAAA

751  CGCATTCGGG CTGTTTTTTG CGGAAGACGG TAA
```

This corresponds to the amino acid sequence <SEQ ID 2246; ORF 681>:

```
m681.pep
     1  MTTPMAISAS NFSEEAKFIS AMGISSAPGT VATVMFSSAT PNSWRVRQQT

51  LSISLPISLV KRACTMPMRR CLPSRLGAMV FIGCPLVFGV SECRLKVSVL

101  RLPVGDGLEC AVFGKLPCAA FGLGEQCGGF RVGFGDVGEA DDAEVVRIVG

151  VFVGLVAAEE TPAAVVFKNG GFAVEEADGP VLFGDGVGGD TAVECRGKCL

201  CKCVHYGNTL GXKLTDFTTI RALSADGGGL VVQCAPFAAL RCFCIFGVWK

251  RIRAVFCGRR *
```

Computer analysis of the amino acid sequences gave the following results:

Homology with a Predicted ORF from *N. meningitidis* menA with menB

ORF 681 shows 94.6% identity over a 261 aa overlap with a predicted ORF (ORF681.a) from *N. gonorrhoeae*:

```
m681/g681
                  10         20         30         40         50         60
m681.pep  MTTPMAISASNFSEEAKFISAMGISSAPGTVATVMFSSATPNSWRVRQQTLSISLPISLV
          ||||||||||||||||||||||||||||||||||||||||||||||||||| ||||||
g681      MTTPMAISASNFSEEAKFISAMGISSAPGTVATVMFSSATPNSWRVRQQTLSIWLPISLV
                  10         20         30         40         50         60
                  70         80         90        100        110        120
m681.pep  KRACTMPMRRCLPSRLGAMVFIGCPLVFGVSECRLKVSVLRLPVGDGLECAVFGKLPCAA
          ||||||||||||||||||||||||||||||||||||||||||||:||||||||||| ||
g681      KRACTMPMRRCLPSRLGAMVFIGCPLVFGVSECRLKVSVLRLPVGNGLECAVFGKLPRAA
                  70         80         90        100        110        120
                 130        140        150        160        170        180
m681.pep  FGLGEQCGGFRVGFGDVGEADDAEVVRIGVFVGLVAAEETPAAVVFKNGGFAVEEADGP
          ||||:||||||||||||||||||||||:||||||||||:|||||||||||||||:||||
g681      FGLGKQCGGFRVGFGDVGEADDAEVVGVVGVFVGFVAAEETPAAVVFKNGGFAVKEADGP
                 130        140        150        160        170        180
                 190        200        210        220        230        239
m681.pep  VLFGDGVGGDTAVECRGKCLCKCVHYGNTLGX-KLTDFTTIRALSADGGGLVVQCAPFAA
          ||||||||||:||||||||||||||| |||| ||:||||| |||||||||||||||||
g681      VLFGDGVGGDAAVECRGKCLCKCVHCGNTLGGGKLADFTTIPALSADGGGLVVQCAPFAA
                 190        200        210        220        230        240
                  240        250        260
m681.pep  LRCFCIGVWKRIRAVFCGRRX
          |||||||||||||||||||||
g681      LRCFCIGVWKRIRAVFCGRRX
                  250        260
```

The following partial DNA sequence was identified in *N. meningitidis* <SEQ ID 2247>:

```
a681.seq
   1  ATAACGACGC CGATGGCAAT CAGTGCGTCA AATTTTTCAG AAGAGGCAAA
  51  GTTCATCAGC GCGATGGGGA TTTCAAGCGC GCCGGGTACG GTGGCGACGG
 101  TAATGTTTTC GTCTGCCACG CCCAATTCTT GGAGGGTGCG GCAGCAGACT
 151  TTGAGCATTT CGCTGCCGAT TTCGTTGGTG AAGCGTGCCT GTACGATGCC
 201  GATGCGGAGG TGTTTGCCGT CGAGGTTGGG GGCGATGGTG TTCATTGAGT
 251  GTCCTTTGGT ATTCGGAGGT TTCGGAATGC CGTCTGAAGG GTCAGTCCTT
 301  AGGTTGCCAG TCGGCGACGG TTTGGAATGT GCCGTCTTCT GCCAATTCCC
 351  ACGCGCTGCC TTCAGGTTGG GAGAGCAGTG CGGCGGTTTC AGGGTTGGTT
 401  TTGGTGATAT CGGCGAGGCT GACGATGCTG AAGTTGTCCG GGTCGTCGGT
 451  GTATTCGTCG GTCTCGTCGC CGCTGAAGAA ACGCCAGCCG CTGTCGTTTT
 501  CAAAAACGGG GGCTTCGCGG TAGAGGAAGC CGACGGGCTG GTTTTGTTTG
 551  GCGACGGTGT TGGTGGCGAT GCAGCGGTCG AGTGCCGAGG AAAGTGCTTG
 601  TGCAAATGCG TTCATTGCGG GAATACGTT. GGGGGAAAAC TTGCGGATTT
 651  TACCACGATT CTTGCGTTGT CGGCAGACGG CGGCGGTTTG GTGGTACAAT
 701  GTGCGCCGTT TGCAGCCTTA AGGTGTTTCT GTATTTTTGG AGTATGGAAA
 751  CGCATTCGGG CTGTTTTTTG CGGAAGACGG TAA
```

This corresponds to the amino acid sequence <SEQ ID 2248; ORF 681.a>:

```
a681.pep
   1  ITTPMAISAS NFSEEAKFIS AMGISSAPGT VATVMFSSAT PNSWRVRQQT

51  LSISLPISLV KRACTMPMRR CLPSRLGAMV FIECPLVFGG FGMPSEGSVL

101  RLPVGDGLEC AVFCQFPRAA FRLGEQCGGF RVGFGDIGEA DDAEVVRVVG
```

```
151   VFVGLVAAEE TPAAVVFKNG GFAVEEADGL VLFGDGVGGD AAVECRGKCL

201   CKCVHCGNTX GGKLADFTTI LALSADGGGL VVQCAPFAAL RCFCIFGVWK

251   RIRAVFCGRR *
``` m681/a681 90.8% identity in 260 aa overlap

```
                   10         20         30         40         50         60
m681.pep   MTTPMAISASNFSEEAKFISAMGISSAPGTVATVMFSSATPNSWRVRQQTLSISLPISLV
           :||||||||||||||||||||||||||||||||||||||||||||||||||||||||||
a681       ITTPMAISASNFSEEAKFISAMGISSAPGTVATVMFSSATPNSWRVRQQTLSISLPISLV
                   10         20         30         40         50         60

70         80         90        100        110        120
m681.pep   KRACTMPMRRCLPSRLGAMVFIGCPLVFGVSECRLKVSVLRLPVGDGLECAVFGKLPCAA
           ||||||||||||||||||||||||| ||||||  :  |||||||||||||||| :: ||
a681       KRACTMPMRRCLPSRLGAMVFIECPLVFGGFGMPSEGSVLRLPVGDGLECAVFCQFPRAA
                   70         80         90        100        110        120

130        140        150        160        170        180
m681.pep   FGLGEQCGGFRVGFGDVGEADDAEVVRIVGVFVGLVAAEETPAAVVFKNGGFAVEEADGP
           | |||||||||||||||:|||||||||:||||||||||||||||||||||||||||||
a681       FRLGEQCGGFRVGFGDIGEADDAEVVRVVGVFVGLVAAEETPAAVVFKNGGFAVEEADGL
                  130        140        150        160        170        180

190        200        210        220        230        240
m681.pep   VLFGDGVGGDTAVEVRGKCLCKCVHYGNTLGXKLTDFTTIRALSADGGGLVVQCAPFAAL
           |||||||||:||||||||||||||||||| ||| | |:||||| ||||||||||||||
a681       VLFGDGVGGDAAVEVRGKCLCKCVHCGNTXGGKLADFTTILALSADGGGLVVQCAPFAAL
                  190        200        210        220        230        240

250        260
m681.pep   RCFCIFGVWKRIRAVFCGRRX
           |||||||||||||||||||||
a681       RCFCIFGVWKRIRAVFCGRRX
                  250        260
```

The following partial DNA sequence was identified in *N. gonorrhoeae* <SEQ ID 2249>:

```
g682.seq
     1    ATGCGCGATT TCGCCGTATG GGTGCCTTAC GGGGAACGGC GGAAAAATTG

51    GGACATAAGG TATTGCCTCC CGCACCTTAT TCGCCTGAGC CCAACCCGAT

101    TGAGAAAGTG TGGGCGAATA TTAAGCGGTA TCTGCGAACC GTTTTGTCTG

151    ATTACGCCCG ATTTGACGAT GCACTACTGT CCTATTTTGA TTTTAATTGA

201    CTATATTTGT GTGAATGATG AAATAAAAAT GCCGTCTGAA CCCGATTGGA

251    TTCAGACGGC ATTTTGTATG GCAGGATTTA TTCGCTTTCC AACTGACCGA

301    CCTATTTTGA CAAGGCAGTC AGGCGTTGTT CGGATTTCGC CACGAACGGG

351    TTTTCGGTAT CCCACGCGTA GCCTGCCAAA ATCGAAGAAA GCATACGGCT

401    GA
```

This corresponds to the amino acid sequence <SEQ ID 2250; ORF 682>:

```
g682.pep
     1    MRDFAVWVPY GERRKNWDIR YCLPHLIRLS PTRLRKCGRI LSGICEPFCL

51    ITPDLTMHYC PILILIDYIC VNDEIKMPSE PDWIQTAFCM AGFIRFPTDR

101    PILTRQSGVV RISPRTGFRY PTRSLPKSKK AYG*
```

The following partial DNA sequence was identified in *N. meningitidis* <SEQ ID 2251>:

```
m682.seq
    1   ATGCGTGATT TCACCGTATG GGTGTCTTAC GGGAAATGGC GGAAAAATTG

51   GGACATAAGG TATTGCCTCT TGCACCTTAT TCACCTGAGC TCAACCCGAT

101   TGAGAAAGTG TGGGCGAATA TTAAGCGGTA TCTGCGAACC GTTTTGTCTG

151   ATTACGCCCG ATTTGACGAT GCACTACTGT CCTATTTTGA TTTTAATTGA

201   CTAT...... ......GAAA TGGCAATGCC GTCTGAACCC GATTGGATTC

251   AGACGGCATT TTGTATGGCG TACGGATTTA TTCGGTTTCC AACTGACCGA

301   CCCATTCGGA CAAGGCAGTC AGGCGTTGTT CGGATTTCGC ACGAACGGG

351   TTTTCGGTAT CCCACGCGTA GCCTGCCAAA ATCGAAGAAA GCATACGGCT

401   GA
```

This corresponds to the amino acid sequence <SEQ ID 2252; ORF 682>:

```
m682.pep
    1   MRDFTVWVSY GKWRKNWDIR YCLLHLIHLS STRLRKCGRI LSGICEPFCL

51   ITPDLTMHYC PILILIDY.. ..EMAMPSEP DWIQTAFCMA YGFIRFPTDR

101   PIRTRQSGVV RISPRTGFRY PTRSLPKSKK AYG*
```

Computer analysis of the amino acid sequences gave the following results:
Homology with a Predicted ORF from N. meningitidis menA with menB
ORF 682 shows 88.1% identity over a 134 aa overlap with a predicted ORF (ORF682.a) from N. gonorrhoeae:

```
m682/g682
                  10         20         30         40         50         60
   m682.pep   MRDFTVWVSYGKWRKNWDIRYCLLHLIHLSSTRLRKCGRILSGICEPFCLITPDLTMHYC
              ||||:||| ||: ||||||||||| |||:|| ||||||||||||||||||||||||||||
   g682       MRDFAVWVPYGERRKNWDIRYCLPHLIRLSPTRLRKCGRILSGICEPFCLITPDLTMHYC
                  10         20         30         40         50         60

70         80         90        100        110
   m682.pep   PILILIDY-----EMAMPSEPDWIQTAFCMAYGFIRFPTDRPIRTRQSGVVRISPRTGFR
              ||||||||     |: |||||||||||||| |||||||||||| ||||||||||||||||
   g682       PILILIDYICVNDEIKMPSEPDWIQTAFCMA-GFIRFPTDRPILTRQSGVVRISPRTGFR
                       70         80         90        100        110

120        130
   m682.pep   YPTRSLPKSKKAYGX
              |||||||||||||||
   g682       YPTRSLPKSKKAYGX
                  120        130
```

The following partial DNA sequence was identified in N. meningitidis <SEQ ID 2253>:

```
a682.seq
    1   ATGCGCGATT TTACCGTATG GGTGTCTTAC GGGAAATGGC GGAAAAATTG

51   GGACATAAGG TATTGCCTCT TGCACCTTAT TCACCTGAGC TCAACCCGAT

101   TGAGAAAGTG TGGGCGAATA TTAAGCGGTA TCTGCGAACC GTTTTGTCTG

151   ATTACGCCCG ATTTGACGAT GCACTACTGT CCTATTTTGA TTTTAATTGA

201   ATAT...... .......... .......... .......... ..........

251   .......... .......... ......TATA TTCGGTTTCC AACTGACCGA

301   CCCATTCTGA CAAGGCCGAC AGGCGTTGTT CGGATTTCGC ACGAACGGG
```

-continued

```
351     TTTTCGGTAT CCCACGCGTA GCCTGCCAAA ATCGAAGAAA GCATACGGCT

401     GA
```

This corresponds to the amino acid sequence <SEQ ID 2254; ORF 682.a>:

```
a682.pep
    1   MRDFTVWVSY GKWRKNWDIR YCLLHLIHLS STRLRKCGRI LSGICEPFCL

51   ITPDLTMHYC PILILIEY..  .......... ..........  ..YIRFPTDR

101   PILTRPTGVV RISPRTGFRY PTRSLPKSKK AYG*
``` m682/a682 80.6% identity in 129 aa overlap

```
                   10         20         30         40         50         60
    m682.pep   MRDFTVWVSYGKWRKNWDIRYCLLHLIHLSSTRLRKCGRILSGICEPFCLITPDLTMHYC
               ||||||||||||||||||||||||||||||||||||||||||||||||||||||||||||
    a682       MRDFTVWVSYGKWRKNWDIRYCLLHLIHLSSTRLRKCGRILSGICEPFCLITPDLTMHYC
                   10         20         30         40         50         60

70         80         90        100        110        120
    m682.pep   PILILIDYEMAMPSEPDWIQTAFCMAYGFIRFPTDRPIRTRQSGVVRISPRTGFRYPTRS
               ||||||:|                   :||||||||| ||  :|||||||||||||||||
    a682       PILILIEY-------------------YIRFPTDRPILTRPTGVVRISPRTGFRYPTRS
                                              70         80         90        100

130
    m682.pep   LPKSKKAYGX
               ||||||||||
    a682       LPKSKKAYGX
                  110
```

The following partial DNA sequence was identified in *N. gonorrhoeae* <SEQ ID 2255>:

```
g683.seq
    1   ATGATTAAGG AAACCCTAAT GCGCCCAATC TTCCTATCTT TCGTTTTACT

51   CCCTATTTTG ATAACCGCCT GCAGCACACC GGACAAGTCT GCCCGATGGG

101   AAAATATCGG CACAATCTCA AACGGCAATA TTCATACATA TATTAATAAA

151   GACAGTGTGA GAAAAAACGG AAATCTGATG ATTTTCCAAG ATAAAAAAGT

201   TGTTACCAAT CTGAAACAAG AACGTTTTGC CAACACCCCC GCATACAAGA

251   CTGCCATTGC CGAGTGGGAA ATCCACTGCA ACAACAAAAC ATACCGCTTA

301   AGTTCGCTAC AGTTATTTGA TACAAAAAAC ACGGAAATTT CCACACAAAA

351   CTACACAGCC TCTTCCCTCC GCCCGATGAG CATCCTGTCC GGGACATTAA

401   CTGAAAAACA ATATGAAACC GTATGCGGGA AAAAACTCTG A
```

This corresponds to the amino acid sequence <SEQ ID 2256; ORF 683>:

```
g683.pep
    1   MIKETLMRPI FLSFVLLPIL ITACSTPDKS ARWENIGTIS NGNIHTYINK

51   DSVRKNGNLM IFQDKKVVTN LKQERFANTP AYKTAIAEWE IHCNNKTYRL

101   SSLQLFDTKN TEISTQNYTA SSLRPMSILS GTLTEKQYET VCGKKL*
```

The following partial DNA sequence was identified in *N. meningitidis* <SEQ ID 2257>:

```
m683.seq..
    1    ATGATTAAGG AAACCCTAAT GCGCCCAATC TTCCTATCTT TCGTTTTATT

51    CCCTATTTTG ATAACCGCCT GCAGCACACC GGACAAGTCT GCCCGATGGG

101    AAAATATCGG CACAATCTCA AACGGCAATA TTCATACATA TATCAATAAA

151    GACAGCGTGA GAAAAAACGG AAATCTGATG ATTTTCCAAG ATAAAAAAGT

201    TGTTACCAAT CTAAAACAAG AACGTTTTGC CAACACCCCC GCATACAAGA

251    CTGCCATTGC CGAGTGGGAA ATCCACTGCA ACAACAAAAC ATACCGCTTA

301    AGTTCGCTAC AGTTGTTTGA TACAAAAAAC ACGGAAATTT CCACACAAAA

351    CTACACAGCC TCTTCCCTCC GCCCGATGAG CATCCTGTCC GGGACATTAA

401    CCGAAAAACA ATATGAAACC GTATGCGGAA AAAAACTCTG A
```

This corresponds to the amino acid sequence <SEQ ID 2258; ORF 683>:

```
m683.pep..
    1    MIKETLMRPI FLSFVLFPIL ITACSTPDKS ARWENIGTIS NGNIHTYINK

51    DSVRKNGNLM IFQDKKVVTN LKQERFANTP AYKTAIAEWE IHCNNKTYRL

101    SSLQLFDTKN TEISTQNYTA SSLRPMSILS GTLTEKQYET VCGKKL*
```

Computer analysis of this amino acid sequence gave the following results:
Homology with a Predicted ORF from *N. gonorrhoeae*
ORF 683 shows 99.3% identity over a 146 aa overlap with a predicted ORF (ORF 683) from *N. gonorrhoeae*:
m683/g683 99.3% identity in 146 aa overlap

```
                   10        20        30        40        50        60
    m683.pep  MIKETLMRPIFLSFVLFPILITACSTPDKSARWENIGTISNGNIHTYINKDSVRKNGNLM
              ||||||||||||||:|||||||||||||||||||||||||||||||||||||||||||||
    g683      MIKETLMRPIFLSFVLLPILITACSTPDKSARWENIGTISNGNIHTYINKDSVRKNGNLM
                   10        20        30        40        50        60

70        80        90       100       110       120
    m683.pep  IFQDKKVVTNLKQERFANTPAYKTAIAEWEIHCNNKTYRLSSLQLFDTKNTEISTQNYTA
              ||||||||||||||||||||||||||||||||||||||||||||||||||||||||||||
    g683      IFQDKKVVTNLKQERFANTPAYKTAIAEWEIHCNNKTYRLSSLQLFDTKNTEISTQNYTA
                   70        80        90       100       110       120

130       140
    m683.pep  SSLRPMSILSGTLTEKQYETVCGKKLX
              |||||||||||||||||||||||||||
    g683      SSLRPMSILSGTLTEKQYETVCGKKLX
                  130       140
```

The following partial DNA sequence was identified in *N. meningitidis* <SEQ ID 2259>:

```
a683.seq
    1    ATGATTAAGG AAACCCTAAT GCGCCCAATC TTCCTATCTT TCGTTTTATT

51    CCCTATTTTG ATAACCGCCT GCAGCACACC GGACAAGTCT GCCCGATGGG

101    AAAATATCGG CACAATCTCA AACGGCAATA TTCATACATA TATCAATAAA

151    GACAGCGTGA GAAAAAACGG AAATCTGATG ATTTTCCNAG ATAAAAAAGT

201    TGTTACCAAT CTAAAACAAG AACGTTTTGC CNACACCCCC GCATACAAGA

251    CTGCCATTGC CGAGTGGGAA ATCCACTGCA ACAACAAAAC ATACCGCTTA

301    AGTTCGCTAC AATTGTTTGA TACAAAAAAC ACGGAAATTT CCACACAAAA
```

```
-continued
351  NTACACAGCC TCTTCCCTCC GCCCGATGAG CATCCTGTCC GGGACATTAA

401  CCGAAAAACA ATATGAAACC GTATGCGGAA AAAAACTCTG A
```

This corresponds to the amino acid sequence <SEQ ID 2260; ORF 683.a>:

```
a683.pep
   1    MIKETLMRPI FLSFVLFPIL ITACSTPDKS ARWENIGTIS NGNIHTYINK

51    DSVRKNGNLM IFXDKKVVTN LKQERFAXTP AYKTAIAEWE IHCNNKTYRL

101    SSLQLFDTKN TEISTQXYTA SSLRPMSILS GTLTEKQYET VCGKKL*
```

Computer analysis of this amino acid sequence gave the following results:
Homology with a Predicted ORF from *N. meningitidis*
ORF 683 shows 97.9% identity over a 146 aa overlap with a predicted ORF (ORF 683) from *N. meningitidis*:
m683/a683 97.9% identity in 146 aa overlap

```
                  10         20         30         40         50         60
    m683.pep  MIKETLMRPIFLSFVLFPILITACSTPDKSARWENIGTISNGNIHTYINKDSVRKNGNLM
              ||||||||||||||||||||||||||||||||||||||||||||||||||||||||||||
    a683      MIKETLMRPIFLSFVLFPILITACSTPDKSARWENIGTISNGNIHTYINKDSVRKNGNLM
                  10         20         30         40         50         60

70         80         90        100        110        120
    m683.pep  IFQDKKVVTNLKQERFANTPAYKTAIAEWEIHCNNKTYRLSSLQLFDTKNTEISTQNYTA
              || |||||||||||||| ||||||||||||||||||||||||||||||||||||||| |||
    a683      IFXDKKVVTNLKQERFAXTPAYKTAIAEWEIHCNNKTYRLSSLQLFDTKNTEISTQXYTA
                  70         80         90        100        110        120

130        140
    m683.pep  SSLRPMSILSGTLTEKQYETVCGKKLX
              |||||||||||||||||||||||||||
    a683      SSLRPMSILSGTLTEKQYETVCGKKLX
                 130        140
```

The following partial DNA sequence was identified in *N. gonorrhoeae* <SEQ ID 2261>:

```
g684.seq
   1    ATGCGCCTTT TCCCCATCGC CGCCGCCCTG ACGCTTGCCG CCTGCGGTAC

51    TGTGCAAAGC ACACAATATT TCGTGTTGCC CGACAGCCGC TACATCCGTC

101    CTGCAACGCA AGGCGGCGAA ACCGCCGTCG AAGTCCGTCT TGCCGAACCG

151    CTCAAACGCG GCGGACTGGT CTATCAAACC GACCCCTACC GCATCAACAC

201    CGCACAAAAC CATGTTTGGG CAGACACCTT GGACGATATG CTCGAAGCGG

251    CGTTGAGCAA TGCATTCAAC CGTTTGGACA GCACACGCAC CTTTGTTCCT

301    GCCTCACGCA GCGGCAGTAC CGACAAATGG ACGGTCTATA TCGACGCATT

351    CCAAGGCAGC TACACGGGCA AAACCCTCAT CAGCGGCTAC GCCGTCCTAC

401    CCGACGGTAC GAACAGACCC TTCCATATCG AAACCGAACA GCAGGGTGAC

451    GGCTACGCCG CCATGACCGC CGCACTCGAA CAGGGACTGA AACAGGCGGC

501    GCAACAGATG GTCGAGTAA
```

This corresponds to the amino acid sequence <SEQ ID 2262; ORF 684>:

```
g684.pep
   1    MRLFPIAAAL TLAACGTVQS TQYFVLPDSR YIRPATQGGE TAVEVRLAEP

51    LKRGGLVYQT DPYRINTAQN HVWADTLDDM LEAALSNAFN RLDSTRTFVP
```

```
    101   ASRSGSTDKW TVYIDAFQGS YTGKTLISGY AVLPDGTNRP FHIETEQQGD

151   GYAAMTAALE QGLKQAAQQM VE*
```

The following partial DNA sequence was identified in *N. meningitidis* <SEQ ID 2263>:

```
m684.seq
      1   ATGCGCCTTT TCCCGATTGC CGCCGCCCTG TCGCTTGCCG CCTGCGGTAC

51   TGTGCAAAGC ACACAATATT TCGTGTTGCC CGACAGCCGC TACATCCGTC

101   CTGCAACGCA AGGCGGCGAA ACTGCCGTCG AAGTCCGTCT TGCCGAACCG

151   CTCAAACGCG GCGGACTGGT CTATCAAACC GACCCCTACC GCCTCAACAC

201   CGCACAAAAC CACGTCTGGG CAGACACCTT GGACGATATG CTCGAAGCGG

251   CGTTGAGCAA TGCATTCAAC CGTTTGGACA GCACACGCAT CTTTGTTCCT

301   GCCTCACGCA GCGGCAGTAC CGAAAAATGG ACGGTCTATA TCGACGCATT

351   CCAAGGCAGC TACACGGGCA AAACCCTCAT CAGCGGCTAC GCCGTCCTAC

401   CCGACGGTAC GAACAGACCC TTCCATATCG AAACCGAACA GCAGGGTGAC

451   GGCTACGCCG CGATGACCGC CGCACTCGAA CAGGGACTGA AACAGGCGGC

501   GCAACAGATG GTCGAGTAA
```

This corresponds to the amino acid sequence <SEQ ID 2264; ORF 684>:

```
m684.pep
      1   MRLFPIAAAL SLAACGTVQS TQYFVLPDSR YIRPATQGGE TAVEVRLAEP

51   LKRGGLVYQT DPYRLNTAQN HVWADTLDDM LEAALSNAFN RLDSTRIFVP

101   ASRSGSTEKW TVYIDAFQGS YTGKTLISGY AVLPDGTNRP FHIETEQQGD

151   GYAAMTAALE QGLKQAAQQM VE*
```

Computer analysis of this amino acid sequence gave the following results:
Homology with a Predicted ORF from *N. gonorrhoeae*
ORF 684 shows 97.7% identity over a 172 aa overlap with a predicted ORF (ORF 684) from *N. gonorrhoeae*:
m684/g684 97.7% identity in 172 aa overlap

```
                    10        20        30        40        50        60
    m684.pep  MRLFPIAAALSLAACGTVQSTQYFVLPDSRYIRPATQGGETAVEVRLAEPLKRGGLVYQT
              |||||||||:||||||||||||||||||||||||||||||||||||||||||||||||||
    g684      MRLFPIAAALTLAACGTVQSTQYFVLPDSRYIRPATQGGETAVEVRLAEPLKRGGLVYQT
                    10        20        30        40        50        60

70        80        90       100       110       120
    m684.pep  DPYRLNTAQNHVWADTLDDMLEAALSNAFNRLDSTRIFVPASRSGSTEKWTVYIDAFQGS
              ||||:||||||||||||||||||||||||||||||||:| ||||||||||:|||||||||
    g684      DPYRINTAQNHVWADTLDDMLEAALSNAFNRLDSTRTFVPASRSGSTDKWTVYIDAFQGS
                    70        80        90       100       110       120

130       140       150       160       170
    m684.pep  YTGKTLISGYAVLPDGTNRPFHIETEQQGDGYAAMTAALEQGLKQAAQQMVEX
              ||||||||||||||||||||||||||||||||||||||||||||||||||||
    g684      YTGKTLISGYAVLPDGTNRPFHIETEQQGDGYAAMTAALEQGLKQAAQQMVEX
                   130       140       150       160       170
```

The following partial DNA sequence was identified in *N. meningitidis* <SEQ ID 2265>:

```
a684.seq
    1   ATGCGCCTCT TCCCGATTGC CGCCGCCCTG ACGCTTGCCG CCTGCGGTAC

51   TGTGCAAAGC ACACAATATT TCGTGTTGCC CGACAGCCGC TACATCCGTC

101   CTGCAACGCA AGGCGGCGAA ACTGCCGTCG AAGTCCGTCT TGCCGAACCG

151   CTCAAACGCG GCGGACTGGT CTATCAAACC GACCCCTACC GCCTCAACAC

201   CGCACAAAAC CACGTCTGGG CAGACACCTT GGACGATATG CTCGAAGCGG

251   CGTTGAGCAA TGCATTCAAC CGTTTGGACA GCACACGCAT CTTTGTTCCT

301   GCCTCACGCA GCGGCAGTAC CGAAAAATGG ACGGTCTATA TCGACGCATT

351   CCAAGGCAGC TACACGGGCA AAACCCTCAT CAGCGGCTAC GCCGTCCTAC

401   CCGACGGTAC GAACAGACCC TTCCATATCG AAACCGAACA GCAGGGTGAC

451   GGCTACGCCG CCATGACCGC CGCACTCGAA CAGGGACTGA AACAGGCGGC

501   GCAACAGATG GTCGAGTAA
```

This corresponds to the amino acid sequence <SEQ ID 2266; ORF 684.a>:

```
a684.pep
    1   MRLFPIAAAL TLAACGTVQS TQYFVLPDSR YIRPATQGGE TAVEVRLAEP

51   LKRGGLVYQT DPYRLNTAQN HVWADTLDDM LEAALSNAFN RLDSTRIFVP

101   ASRSGSTEKW TVYIDAFQGS YTGKTLISGY AVLPDGTNRP FHIETEQQGD

151   GYAAMTAALE QGLKQAAQQM VE*
```

Computer analysis of this amino acid sequence gave the following results:
Homology with a Predicted ORF from *N. meningitidis*
ORF 684 shows 99.4% identity over a 172 aa overlap with a predicted ORF (ORF 684) from *N. meningitidis*
m684/a684 99.4% identity in 172 aa overlap

```
                    10         20         30         40         50         60
m684.pep    MRLFPIAAALSLAACGTVQSTQYFVLPDSRYIRPATQGGETAVEVRLAEPLKRGGLVYQT
            |||||||||| :||||||||||||||||||||||||||||||||||||||||||||||||
a684        MRLFPIAAALTLAACGTVQSTQYFVLPDSRYIRPATQGGETAVEVRLAEPLKRGGLVYQT
                    10         20         30         40         50         60

70         80         90        100        110        120
m684.pep    DPYRLNTAQNHVWADTLDDMLEAALSNAFNRLDSTRIFVPASRSGSTEKWTVYIDAFQGS
            ||||||||||||||||||||||||||||||||||||||||||||||||||||||||||||
a684        DPYRLNTAQNHVWADTLDDMLEAALSNAFNRLDSTRIFVPASRSGSTEKWTVYIDAFQGS
                    70         80         90        100        110        120

130        140        150        160        170
m684.pep    YTGKTLISGYAVLPDGTNRPFHIETEQQGDGYAAMTAALEQGLKQAAQQMVEX
            |||||||||||||||||||||||||||||||||||||||||||||||||||||
a684        YTGKTLISGYAVLPDGTNRPFHIETEQQGDGYAAMTAALEQGLKQAAQQMVEX
                   130        140        150        160        170
```

The following partial DNA sequence was identified in *N. gonorrhoeae* <SEQ ID 2267>:

```
g685.seq
    1   TTGTTTTGCC GTATCGGGAA TTTTGCGTTT TGCGGCGTGG TTTCTGCAGG

51   TTGTTTGCTT AATAATAAAC ATTCTTATTC GTATGCAAAG GAACCGCACA

101   CCGTGAAACC GCGTTTTTAT TGGGCAGcct GCGCCGTCCT GCCGGCCGCC

151   TGTTCGCCCG AACCTGCCGC CGAAAAAACT GTATccgCCG CATCCCAAGC

201   CGCATCCACA CCTGTCGCCA CGCTGACCGT GCCGACCGCG CGGGGCGATG
```

```
 251   CCGTTGTGCC GAAGAATCCC GAACgcgtcg ccgtgtAcga CtggGCGGCG

301   TtggaTACGC TGACCGAGCC GGGCGTGAAT GTGGGCGCAA CCACCGCGCC

351   GGTGCGCGTG GACTATTTGC AGCCTGCATT TGACAAGGCG GCAACGGTGG

401   GGACGCTGTT TGAGCCCGAT TGCGAATCCC TGCACCGCCA CAATCCGCAG

451   TTTGTCATTA CCGGCGGGCC GGGTGCGGAA GCGTATGAAC AGTTGGCGAA

501   AAACGCGACC ACCATAGATT TGACGGTGGA CAACGGCAAT ATCCGCACCA

551   GCGGCGAGAA GCAGATGGAG ACCCTGTCGC GGATTTTCGG TAAGGAAGCG

601   CGCGTGGCGG AATTGAATGC GCAGATTGAC GCGCTGTTCG CCCAAAAGCG

651   CGAAGCCGCC AAAGGCAAAG GACGCGGGCT GGTGCTGTCG GTTACAGGCA

701   ACAAGGTGTC CGCCTTCGGC ACGCAATCGC GGTTGGCAAG TTGGATACAC

751   GGCGACATCG GCCTGCCGCC CGTGGACGAA TCTTTACGCA ACGAAGGGCA

801   CGGGCAGCCC GTTTCCTTCG AATACATCAA AGAGAAAAAC CCCGGCTGGA

851   TTTTCATCAT CGACCGCACC GCCGCCATCG GCAGGAAGG GCCGGCTGCC

901   GTGGAAGTGT TGGATAACGC GCTGGTATGC GGCACGAACG CTTGGAAGCG

951   CAAGCAAATC ATCGTCATGC CTGCCGCGAA CTACATTGTC GCGGGCGGCG

1001   CGCGGCAGTT GATACAGGCG GCGGAACAGT TGAAGGCGGC GTTTGAAAAG

1051   GCAGAACCCG TTGCGGCGCA GTAG
```

This corresponds to the amino acid sequence <SEQ ID 2268; ORF 685>:

```
g685.pep
   1   LFCRIGNFAF CGVVSAGCLL NNKHSYSYAK EPHTVKPRFY WAACAVLPAA

51   CSPEPAAEKT VSAASQAAST PVATLTVPTA RGDAVVPKNP ERVAVYDWAA

101   LDTLTEPGVN VGATTAPVRV DYLQPAFDKA ATVGTLFEPD CESLHRHNPQ

151   FVITGGPGAE AYEQLAKNAT TIDLTVDNGN IRTSGEKQME TLSRIFGKEA

201   RVAELNAQID ALFAQKREAA KGKGRGLVLS VTGNKVSAFG TQSRLASWIH

251   GDIGLPPVDE SLRNEGHGQP VSFEYIKEKN PGWIFIIDRT AAIGQEGPAA

301   VEVLDNALVC GTNAWKRKQI IVMPAANYIV AGGARQLIQA AEQLKAAFEK

351   AEPVAAQ*
```

The following partial DNA sequence was identified in *N. meningitidis* <SEQ ID 2269>:

```
m685.seq
   1   TTGTTTTGCC GTATCGGGAA TTTTGCGTTT TGCGGCGTGG TTTCTGCAGG

51   TTGTTTGCTT AATAATAAAC ATTCTTATTC GTATGCAAAG GAACCGCACA

101   CCGTGAAACC GCGTTTTTAT TGGGCAGCCT GCGCCGTCCT GCTGACCGCC

151   TGTTCGCCCG AACCTGCCGC CGAAAAAACT GTATCCGCCG CATCCGCATC

201   TGCCGCCACG CTGACCGTGC CGACCGCGCG GGCGATGCC GTTGTGCCGA

251   AGAATCCCGA ACGCGTCGCC GTGTACGACT GGGCGGCGTT GGATACGCTG

301   ACCGAATTGG GCGTGAATGT GGGCGCAACC ACCGCGCCGG TGCGCGTGGA

351   TTATTTGCAG CCTGCATTTG ACAAGGCGGC AACGGTGGGG ACGCTGTTCG

401   AGCCCGATTA CGAAGCCCTG CACCGCTACA ATCCTCAGCT TGTCATTACC
```

```
 451  GGCGGGCCGG GCGCGGAAGC GTATGAACAG TTAGCGAAAA ACGCGACCAC

501  CATAGATCTG ACGGTGGACA ACGGCAATAT CCGCACCAGC GGCGAAAAGC

551  AGATGGAGAC CTTGGCGCGG ATTTTCGGCA AGGAAGCGCG CGCGGCGGAA

601  TTGAAGGCGC AGATTGACGC GCTGTTCGCC CAAACGCGCG AAGCCGCCAA

651  AGGCAAAGGA CGCGGGCTGG TGCTGTCGGT TACGGGCAAC AAGGTGTCCG

701  CCTTCGGCAC GCAGTCGCGG TTGGCAAGTT GGATACACGG CGACATCGGC

751  CTACCGCCTG TAGACGAATC TTTACGCAAC GAGGGGCACG GGCAGCCTGT

801  TTCCTTCGAA TACATCAAAG AGAAAAACCC CGATTGGATT TTCATCATCG

851  ACCGTACCGC CGCCATCGGG CAGGAAGGGC CGGCGGCTGT CGAAGTATTG

901  GATAACGCGC TGGTACGCGG CACGAACGCT TGGAAGCGCA AGCAAATCAT

951  CGTCATGCCT GCCGCGAACT ACATTGTCGC GGGCGGCGCG CGGCAGTTGA

1001  TTCAGGCGGC GGAGCAGTTG AAGGCGGCGT TTAAAAAGGC AGAACCCGTT

1051  GCGGCGGGGA AAAAGTAG
```

This corresponds to the amino acid sequence <SEQ ID 2270; ORF 685>:

```
m685.pep
   1  LFCRIGNFAF CGVVSAGCLL NNKHSYSYAK EPHTVKPRFY WAACAVLLTA

51  CSPEPAAEKT VSAASASAAT LTVPTARGDA VVPKNPERVA VYDWAALDTL

101  TELGVNVGAT TAPVRVDYLQ PAFDKAATVG TLFEPDYEAL HRYNPQLVIT

151  GGPGAEAYEQ LAKNATTIDL TVDNGNIRTS GEKQMETLAR IFGKEARAAE

201  LKAQIDALFA QTREAAKGKG RGLVLSVTGN KVSAFGTQSR LASWIHGDIG

251  LPPVDESLRN EGHGQPVSFE YIKEKNPDWI FIIDRTAAIG QEGPAAVEVL

301  DNALVRGTNA WKRKQIIVMP AANYIVAGGA RQLIQAAEQL KAAFKKAEPV

351  AAGKK*
```

Computer analysis of this amino acid sequence gave the following results:
Homology with a Predicted ORF from *N. gonorrhoeae*
ORF 685 shows 94.4% identity over a 356 aa overlap with a predicted ORF (ORF 685) from *N. gonorrhoeae*:
m685/g685 94.4% identity in 356 aa overlap

```
                  10        20        30        40        50        60
m685.pep  LFCRIGNFAFCGVVSAGCLLNNKHSYSYAKEPHTVKPRFYWAACAVLLTACSPEPAAEKT
          ||||||||||||||||||||||||||||||||||||||||||||||| :||||||||||
g685      LFCRIGNFAFCGVVSAGCLLNNKHSYSYAKEPHTVKPRFYWAACAVLPAACSPEPAAEKT
                  10        20        30        40        50        60

70        80        90       100       110
m685.pep  VSAASASA----ATLTVPTARGDAVVPKNPERVAVYDWAALDTLTELGVNVGATTAPVRV
          ||||| :|    ||||||||||||||||||||||||||||||||| ||||||||||||||
g685      VSAASQAASTPVATLTVPTARGDAVVPKNPERVAVYDWAALDTLTEPGVNVGATTAPVRV
                  70        80        90       100       110       120

120       130       140       150       160       170
m685.pep  DYLQPAFDKAATVGTLFEPDYEALHRYNPQLVITGGPGAEAYEQLAKNATTIDLTVDNGN
          |||||||||||||||||||| |:|||:||:||||||||||||||||||||||||||||||
g685      DYLQPAFDKAATVGTLFEPDCESLHRHNPQFVITGGPGAEAYEQLAKNATTIDLTVDNGN
                 130       140       150       160       170       180

180       190       200       210       220       230
m685.pep  IRTSGEKQMETLARIFGKEARAAELKAQIDALFAQTREAAKGKGRGLVLSVTGNKVSAFG
          ||||||||||||:|||||||: |||:|||||||||:||||||||||||||||||||||||
g685      IRTSGEKQMETLSRIFGKEARVAELNAQIDALFAQKREAAKGKGRGLVLSVTGNKVSAFG
                 190       200       210       220       230       240
```

-continued

```
              240       250       260       270       280       290
m685.pep   TQSRLASWIHGDIGLPPVDESLRNEGHGQPVSFEYIKEKNPDWIFIIDRTAAIGQEGPAA
           ||||||||||||||||||||||||||||||||||||||||| ||||||||||||||||||
g685       TQSRLASWIHGDIGLPPVDESLRNEGHGQPVSFEYIKEKNPGWIFIIDRTAAIGQEGPAA
                    250       260       270       280       290       300

300       310       320       330       340       350
m685.pep   VEVLDNALVRGTNAWKRKQIIVMPAANYIVAGGARQLIQAAEQLKAAFKKAEPVAAGKKX
           ||||||||| ||||||||||||||||||||||||||||||||||||||:|||||||
g685       VEVLDNALVCGTNAWKRKQIIVMPAANYIVAGGARQLIQAAEQLKAAFEKAEPVAAQX
                    310       320       330       340       350
```

The following partial DNA sequence was identified in *N. meningitidis* <SEQ ID 2271>:

```
a685.seq
     1  TTGTTTTGCC GTATCGGGAA TTTTGCGTTT TGCGGCGTGG TTTCTGCAGG

51  TTGTTTGCTT AATAATAAAC ATTCTTATTC GTATGCAAAG GAACCGCACA

101  CCGTGAAACC GCGTTTTTAT TGGGCAGCCT GCGCCGTCCT GCTGACCGCC

151  TGTTCGCCCG AACCTGCCGC CGAAAAAACT GTATCCGCCG CATCCGCATC

201  TGCCGCCACA CTGACCGTGC CGACCGCGCG GGGCGATGCC GTTGTGCCGA

251  AGAATCCCGA ACGCGTCGCC GTGTACGACT GGGCGGCGTT GGATACGCTG

301  ACCGAATTGG GTGTGAATGT GGGCGCAACC ACCGCGCCGG TGCGCGTGGA

351  TTATTTGCAG CCTGCATTTG ACAAGGCGGC AACGGTGGGG ACGCTGTTCG

401  AGCCCGATTA CGAAGCCCTG CACCGCTACA ATCCTCAGCT TGTCATTACC

451  GGCGGGCCGG GCGCGGAAGC GTATGAACAG TTGGCGAAAA ACGCGACCAC

501  CATAGATCTG ACGGTGGACA ACGGCAATAT CCGCACCAGC GGCGAAAAGC

551  AGATGGAGAC CTTGGCGCGG ATTTTCGGCA AGGAAGCGCG CGCGGCGGAA

601  TTGAAGGCGC AGATTGACGC GCTGTTCGCC CAAACGCGCG AAGCCGCCAA

651  AGGCAAAGGA CGCGGGCTGG TGCTGTCGGT TACGGGCAAC AAGGTGTCCG

701  CCTTCGGCAC GCAGTCGCGG TTGGCAAGTT GGATACACGG CGACATCGGC

751  CTACCGCCTG TAGACGAATC TTTACGCAAC GAGGGGCACG GGCAGCCTGT

801  TTCCTTCGAA TACATCAAAG AGAAAAACCC CGATTGGATT TTCATCATCG

851  ACCGTACCGC CGCCATCGGG CAGGAAGGGC CGGCGGCTGT CGAAGTATTG

901  GATAACGCGC TGGTACGCGG CACGAACGCT TGGAAGCGCA AGCAAATCAT

951  CGTCATGCCT GCCGCGAACT ACATTGTCGC GGGCGGCTCG CGGCAGTTGA

1001  TTCAGGCGGC GGAGCAGTTG AAGGAGGCGT TTGAAAAGGC AGAACCCGTT

1051  GCGGCGGGGA AAGAGTAG
```

This corresponds to the amino acid sequence <SEQ ID 2272; ORF 685.a>:

```
a685.pep
     1  LFCRIGNFAF CGVVSAGCLL NNKHSYSYAK EPHTVKPRFY WAACAVLLTA

51  CSPEPAAEKT VSAASASAAT LTVPTARGDA VVPKNPERVA VYDWAALDTL

101  TELGVNVGAT TAPVRVDYLQ PAFDKAATVG TLFEPDYEAL HRYNPQLVIT

151  GGPGAEAYEQ LAKNATTIDL TVDNGNIRTS GEKQMETLAR IFGKEARAAE

201  LKAQIDALFA QTREAAKGKG RGLVLSVTGN KVSAFGTQSR LASWIHGDIG

251  LPPVDESLRN EGHGQPVSFE YIKEKNPDWI FIIDRTAAIG QEGPAAVEVL
```

-continued
```
301  DNALVRGTNA WKRKQIIVMP AANYIVAGGS RQLIQAAEQL KEAFEKAEPV

351  AAGKE*
```

Computer analysis of this amino acid sequence gave the following results:
Homology with a Predicted ORF from *N. meningitidis*
ORF 685 shows 98.9% identity over a 355 aa overlap with a predicted ORF (ORF 685) from *N. meningitidis*:
m685/a685 98.9% identity in 355 aa overlap

```
                  10         20         30         40         50         60
m685.pep  LFCRIGNFAFCGVVSAGCLLNNKHSYSYAKEPHTVKPRFYWAACAVLLTACSPEPAAEKT
          ||||||||||||||||||||||||||||||||||||||||||||||||||||||||||||
a685      LFCRIGNFAFCGVVSAGCLLNNKHSYSYAKEPHTVKPRFYWAACAVLLTACSPEPAAEKT
                  10         20         30         40         50         60

70         80         90        100        110        120
m685.pep  VSAASASAATLTVPTARGDAVVPKNPERVAVYDWAALDTLTELGVNVGATTAPVRVDYLQ
          ||||||||||||||||||||||||||||||||||||||||||||||||||||||||||||
a685      VSAASASAATLTVPTARGDAVVPKNPERVAVYDWAALDTLTELGVNVGATTAPVRVDYLQ
                  70         80         90        100        110        120

130        140        150        160        170        180
m685.pep  PAFDKAATVGTLFEPDYEALHRYNPQLVITGGPGAEAYEQLAKNATTIDLTVDNGNIRTS
          ||||||||||||||||||||||||||||||||||||||||||||||||||||||||||||
a685      PAFDKAATVGTLFEPDYEALHRYNPQLVITGGPGAEAYEQLAKNATTIDLTVDNGNIRTS
                 130        140        150        160        170        180

190        200        210        220        230        240
m685.pep  GEKQMETLARIFGKEARAAELKAQIDALFAQTREAAKGKGRGLVLSVTGNKVSAFGTQSR
          ||||||||||||||||||||||||||||||||||||||||||||||||||||||||||||
a685      GEKQMETLARIFGKEARAAELKAQIDALFAQTREAAKGKGRGLVLSVTGNKVSAFGTQSR
                 190        200        210        220        230        240

250        260        270        280        290        300
m685.pep  LASWIHGDIGLPPVDESLRNEGHGQPVSFEYIKEKNPDWIFIIDRTAAIGQEGPAAVEVL
          ||||||||||||||||||||||||||||||||||||||||||||||||||||||||||||
a685      LASWIHGDIGLPPVDESLRNEGHGQPVSFEYIKEKNPDWIFIIDRTAAIGQEGPAAVEVL
                 250        260        270        280        290        300

310        320        330        340        350
m685.pep  DNALVRGTNAWKRKQIIVMPAANYIVAGGARQLIQAAEQLKAAFKKAEPVAAGKKX
          |||||||||||||||||||||||||||||||:||||||||||  ||:||||||||:|
a685      DNALVRGTNAWKRKQIIVMPAANYIVAGGSRQLIQAAEQLKEAFEKAEPVAAGKEX
                 310        320        330        340        350
```

The following partial DNA sequence was identified in *N. gonorrhoeae* <SEQ ID 2273>:

```
g686.seq (partial)
     1   ..AATTTCTCCT GCCGCGCCGA TGATGTTTTT GACGATATCT GCAGTGCCGT 51   TGAAGGCTTC ggcgGCATTG CCCGATCTGT CCAGCTCGGG GCTGTATCGG

101   GTGGCGCGTT TGAATCCGTC GCCTACTCCT TGCGTCAGCA TAGCGCCGGC

151   ATTGTGGAAA CGGTCGGCAA GCCGTTGTCC GGTGCTGCGG TTGTCGGTCA

201   GGTTGAGGCG GATATTTTGG GCAACGCCTT TTATGTCGTA GCTGTATATA

251   TCCCTCGCGC CTTTGGGAGC GGGATAGCCG CCGCCCTGTG GCCCGTCATA

301   GCCGTCGGCG GGATGGTGTT CGTATCCGTC CCAATGGATG CGGTAAAGGC

351   TGAATCCGTC AACGGGACTA CCGGCTTCGT CAGAATCGGA ATGTGA
```

This corresponds to the amino acid sequence <SEQ ID 2274; ORF 686>:

```
g686.pep (partial)
     1   ..NFSCRADDVF DDICSAVEGF GGIARSVQLG AVSGGAFESV AYSLRQHSAG

51   IVETVGKPLS GAAVVGQVEA DILGNAFYVV AVYIPRAFGS GIAAALWPVI

101   AVGGMVFVSV PMDAVKAESV NGTTGFVRIG M*
```

The following partial DNA sequence was identified in *N. meningitidis* <SEQ ID 2275>:

```
m686.seq..
     1      ATGATGTTGA AAAAATTCGT ACTCGGCGGT ATTGCCGCAT TGGTTTTGGC

51      GGCCTGCGGC GGTTCGGAAG GCGGCAGCGG AGCGNNNNNN NNNNNNAATT

101      TCTCCTGCAG CGCCGATGAT GTTTTTAACG ATATCTGCAG TGCCGTTGAA

151      GGCTTCGGCG GCATTGCCCG ATCTGTCCAG CTCGGGGCTG TATCGGGTGG

201      CGCGTTTGAA TCCGTCGCCT ACTCCTTGCG TCAGCATACT ACCGGCATTG

251      TGGAAACGGT CGGCAAGCCG TTGTCCGGTG CTGCGGTTGT CGGTCAGGTT

301      GAGGCGGATA TTTTGGGCAA CGCCTTTTAT GTCGTAGCTG TATATATCCC

351      TCGCGCCTTT GGGAGCGGGA TAGCCGCCGC CCTGTGGCCC GTCATAGCCG

401      TCGGCGGGAT GGTGTTCGTA TCCGTCCCAA TGGATGCGGT AAAGGCTAAA

451      TCCGTCAACG GGACTACCGG CTTCATCAGA ATCGGAATGT GA
```

This corresponds to the amino acid sequence <SEQ ID 2276; ORF 686>:

```
m686.pep
     1     MMLKKFVLGG IAALVLAACG GSEGGSGAXX XXNFSCSADD VFNDICSAVE

51     GFGGIARSVQ LGAVSGGAFE SVAYSLRQHT TGIVETVGKP LSGAAVVGQV

101     EADILGNAFY VVAVYIPRAF GSGIAAALWP VIAVGGMVFV SVPMDAVKAK

151     SVNGTTGFIR IGM*
```

Computer analysis of this amino acid sequence gave the following results:
Homology with a Predicted ORF from *N. gonorrhoeae*
ORF 686 shows 95.4% identity over a 131 aa overlap with a predicted ORF (ORF 686) from *N. gonorrhoeae*
g686/m686 95.4% identity in 131 aa overlap

```
                                        10         20         30
    g686.pep                      NFSCRADDVFDDICSAVEGFGGIARSVQLG
                                  ||||  |||||:||||||||||||||||||
    m686       LKKFVLGGIAALVLAACGGSEGGSGAXXXXNFSCSADDVFNDICSAVEGFGGIARSVQLG
                   10         20         30         40         50         60

40         50         60         70         80         90
    g686.pep   AVSGGAFESVAYSLRQHSAGIVETVGKPLSGAAVVGQVEADILGNAFYVVAVYIPRAFGS
               ||||||||||||||||||::||||||||||||||||||||||||||||||||||||||||
    m686       AVSGGAFESVAYSLRQHTTGIVETVGKPLSGAAVVGQVEADILGNAFYVVAVYIPRAFGS
                   70         80         90        100        110        120

100        110        120        130
    g686.pep   GIAAALWPVIAVGGMVFVSVPMDAVKAESVNGTTGFVRIGMX
               ||||||||||||||||||||||||||||:||||||||:||||
    m686       GIAAALWPVIAVGGMVFVSVPMDAVKAKSVNGTTGFIRIGMX
                  130        140        150        160
```

The following partial DNA sequence was identified in *N. meningitidis* <SEQ ID 2277>:

```
a686.seq (partial)
     1     ..AATTTCTCCT GCCGCGCCGA TGATGTTTTT GACGATATCT GCAGTGCCGT

51     TGAAAGCTTC GGCGGCATTG CCCGATCTGT CCAGCTCGGG GCTGTATCGG

101     GTGGCGCGTT TGAATCCGTC GCCTACTCCT GCGTCAGCA TACTACCGGT

151     ATTGTGGAAA CGGTCGACAA GCCGTTGTCC GGTGCTGCGG TTGTCGGTCA

201     GGTTGAGGCG GATATTTTGG GCAACGCCTT TTATGTCGTA GCTGTATATA
```

-continued

```
251    TCCCTCGCGC CTTTGGGAGC GGGATAGCCG CCGCCCTGTG GCCCGTCATA

301    GCCGTCGGCG GGATGGTGTT CGTATCCGTC CCAATGGATG CGGTAAAGGC

351    TGAATCCGTC AACGGGACTA CCGGCTTCAT CAGAATCGGA ATGTGA
```

This corresponds to the amino acid sequence <SEQ ID 2278; ORF 686.a>:

```
a686.pep (partial)
    1   ..NFSCRADDVF DDICSAVESF GGIARSVQLG AVSGGAFESV AYSLRQHTTG

51   IVETVDKPLS GAAVVGQVEA DILGNAFYVV AVYIPRAFGS GIAAALWPVI

101   AVGGMVFVSV PMDAVKAESV NGTTGFIRIG M*
```

Computer analysis of this amino acid sequence gave the following results:
Homology with a Predicted ORF from *N. meningitidis*   20
ORF 686 shows 96.2% identity over a 131 aa overlap with a predicted ORF (ORF 686) from *N meningitidis*:
m686/a686 96.2% identity in 131 aa overlap

```
                  10         20         30         40         50         60
m696.pep   LKKFVLGGIAALVLAACGGSEGGSGAXXXXNFSCSADDVFNDICSAVEGFGGIARSVQLG
                               ||||  ||||| :|||||||  :|||||||||
a686                           NFSCRADDVFDDICSAVESFGGIARSVQLG
                                                  10         20         30

70         80         90        100        110        120
m696.pep   AVSGGAFESVAYSLRQHTTGIVETVGKPLSGAAVVGQVEADILGNAFYVVAVYIPRAFGS
           ||||||||||||||||||||||||| |||||||||||||||||||||||||| |||||||
a686       AVSGGAFESVAYSLRQHTTGIVETVDKPLSGAAVVGQVEADILGNAFYVVAVYIPRAFGS
                 40         50         60         70         80         90

130        140        150        160
m696.pep   GIAAALWPVIAVGGMVFVSVPMDAVKAKSVNGTTGFIRIGMX
           ||||||||||||||||||||||||||| :||||||||||||
a686       GIAAALWPVIAVGGMVFVSVPMDAVKAESVNGTTGFIRIGMX
                100        110        120        130
```

The following partial DNA sequence was identified in *N.* 40 *gonorrhoeae* <SEQ ID 2279>:

```
g687.seq
    1   ATGAAATCCA GACACCTCGC CCTCGCCCTC GGCGTTGCCG CCCTGTTCGC

51   CCTTGCCGCG TGCGACAGCA AAGTCCAAAC CAGCGTCCCC GCCGACAGCG

101   CGCCTGCCGC TTCGGCAGCC GCCGCCCCGG CAGGACTGGT CGAAGGGCAA

151   AACTACACCG TCCTTGCCAA CCCGATTCCC CAACAGCAGG CAGGCAAGGT

201   TGAAGTGCTT GAGTTTTTCG GCTATTTTTG TCCGCACTGC GCCCGCCTcg

251   AACCTGTTTT GAGCAAACAC GCCAAGTCTT TTAAAGACGA TATGTACCTG

301   CGTACCGAAC ACGTCGTCTG GCAGAAAGAA ATGCTGCCGC TGGCACGCct 351   cGCCGCCGCC GTCGATATGG CTGCCGCCGA AAGCAAAGAT GTGGCGAACA

401   GCCATATTTT CGATGCGATG GTCAACCAAA AAATCAAGCT GCAAGAGCCG

451   GAAGTCCTCA AAAATGGCT GGGCGAACAa ACcgcctTTG ACGGCAAAAA

501   AGTCCTTGCC GCCTACGAAT CCCCGAAAG TCAGGCGCGC GCcggcAAAA

551   TGCAGGAGCT GACCGAAACC TTCCAAATCG ACGGTACGCC CACGGTTATC

601   GTCGGCGGCA AATATAAAGT CGAATTTGCC GACTGGGAGT CCGGTATGAA
```

-continued

```
   651    CACCATCGAC CTTTTGGCGG ACAAAGTACG TGAAGAACAA AAAGCCGCGC

701    AGTAG
```

This corresponds to the amino acid sequence <2280 ID 724; ORF 687>:

```
g687.pep
     1    MKSRHLALAL GVAALFALAA CDSKVQTSVP ADSAPAASAA AAPAGLVEGQ

51    NYTVLANPIP QQQAGKVEVL EFFGYFCPHC ARLEPVLSKH AKSFKDDMYL

101    RTEHVVWQKE MLPLARLAAA VDMAAAESKD VANSHIFDAM VNQKIKLQEP

151    EVLKKWLGEQ TAFDGKKVLA AYESPESQAR AGKMQELTET FQIDGTPTVI

201    VGGKYKVEFA DWESGMNTID LLADKVREEQ KAAQ*
```

The following partial DNA sequence was identified in *N. meningitidis* <SEQ ID 2281>:

```
m687.seq
     1    ATGAAATCCA GACACCTTGC CCTCgGCGTT GCCGCCCTGT TCGCCCTTGC

51    CGCGTGCGAC AGCAAAGTCC AAACCAGCGT CCCCGCCGAC AGCGCGCCTG

101    CCGCTTCGGC AGCCGCCGCC CCGGCAGGGC TGGTCGAAGG CAAAACTAT

151    ACCGTCCTTG CCAACCCGAT TCCCCAACAG CAGGCAGGCA AAGTCGAAGT

201    CCTTGAGTTT TTCGGCTATT TCTGTCCGCA CTGCGCCCAC CTCGAACCTG

251    TTTTAAGCAA ACACGCCAAG TCTTTTAAAG ACGATATGTA CCTGCGTACC

301    GAACACGTCG TCTGGCAGAA AGAAATGCTG ACGCTGGCAC GCCTCGCCGC

351    CGCCGTCGAT ATGGCTGCCG CCGACAGCAA AGATGTGGCG AACAGCCATA

401    TTTTCGATGC GATGGTCAAC CAAAAAATCA AGCTGCAAAA TCCGGAAGTC

451    CTCAAAAAAT GGCTGGGCGA ACAAACCGCC TTTGACGGCA AAAAAGTCCT

501    TGCCGCCTAC GAGTCCCCCG AAAGCCAGGC GCGCGCCGAC AAAATGCAGG

551    AGCTGACCGA AACCTTCCAA ATCGACGGTA CGCCCACGGT TATCGTCGGC

601    GGTAAATATA AAGTTGAATT TGCCGACTGG GAGTCCGGTA TGAACACCAT

651    CGACCTTTTG GCGGACAAAG TACGCGAAGA ACAAAAAGCC GCGCAGTAA
```

This corresponds to the amino acid sequence <SEQ ID 2282; ORF 687>:

```
m687.pep
     1    MKSRHLALGV AALFALAACD SKVQTSVPAD SAPAASAAAA PAGLVEGQNY

51    TVLANPIPQQ QAGKVEVLEF FGYFCPHCAH LEPVLSKHAK SFKDDMYLRT

101    EHVVWQKEML TLARLAAAVD MAAADSKDVA NSHIFDAMVN QKIKLQNPEV

151    LKKWLGEQTA FDGKKVLAAY ESPESQARAD KMQELTETFQ IDGTPTVIVG

201    GKYKVEFADW ESGMNTIDLL ADKVREEQKA AQ*
```

Computer analysis of this amino acid sequence gave the following results:
Homology with a Predicted ORF from *N. gonorrhoeae*
ORF 687 shows 97.0% identity over a 234 aa overlap with a predicted ORF (ORF 687) from *N. gonorrhoeae*:
m687/g687 97.0% identity in 234 aa overlap

```
              10        20        30        40        50
m687.pep  MKSRHLAL--GVAALFALAACDSKVQTSVPADSAPAASAAAAPAGLVEGQNYTVLANPIP
          ||||||||  |||||||||||||||||||||||||||||||||||||||||||||||||
g687      MKSRHLALALGVAALFALAACDSKVQTSVPADSAPAASAAAAPAGLVEGQNYTVLANPIP
              10        20        30        40        50        60

60        70        80        90       100       110
m687.pep  QQQAGKVEVLEFFGYFCPHCAHLEPVLSKHAKSFKDDMYLRTEHVVWQKEMLTLARLAAA
          |||||||||||||||||||||:||||||||||||||||||||||||||||||| ||||||
g687      QQQAGKVEVLEFFGYFCPHCARLEPVLSKHAKSFKDDMYLRTEHVVWQKEMLPLARLAAA
              70        80        90       100       110       120

120       130       140       150       160       170
m687.pep  VDMAAADSKDVANSHIFDAMVNQKIKLQNPEVLKKWLGEQTAFDGKKVLAAYESPESQAR
          ||||||:||||||||||||||||||||||:||||||||||||||||||||||||||||||
g687      VDMAAAESKDVANSHIFDAMVNQKIKLQEPEVLKKWLGEQTAFDGKKVLAAYESPESQAR
              130       140       150       160       170       180

180       190       200       210       220       230
m687.pep  ADKMQELTETFQIDGTPTVIVGGKYKVEFADWESGMNTIDLLADKVREEQKAAQX
          | ||||||||||||||||||||||||||||||||||||||||||||||||||||
g687      AGKMQELTETFQIDGTPTVIVGGKYKVEFADWESGMNTIDLLADKVREEQKAAQX
              190       200       210       220       230
```

The following partial DNA sequence was identified in *N. meningitidis* <SEQ ID 2283>:

```
a687.seq
    1   ATGAAATCCA AACACCTCGC CCTCGGCGTT GCCGCCCTGT TCGCACTTGC

51   CGCGTGCGAC AGCAAAGTCC AAACCAGCGT CCCCGCCGAC AGCGCGCCTG

101   CCGCTTCGGC AGCCGCCGCC CCGGCAGGGC TGGTCGAAGG CAAAACTAT

151   ACTGTCCTTG CCAACCCGAT TCCCCAACAG CAGGCAGGCA AAGTCGAAGT

201   CCTTGAGTTT TTCGGCTATT TCTGTCCGCA CTGCGCCCAC CTCGAACCTG

251   TTTTAAGCAA ACACGCCAAG TCTTTTAAAG ACGATATGTA CCTGCGTACC

301   GAACACGTCG TCTGGCAGAA AGAAATGCTG ACGCTCGCAC GCCTCGCCGC

351   CGCCGTCGAT ATGGCTGCCG CCGACAGCAA AGATGTGGCG AACAGCCATA

401   TTTTCGATGC GATGGTCAAC CAAAAAATCA AGCTGCAAGA GCCGGAAGTC

451   CTCAAAAAAT GGCTGGGCGA ACAAACCGCC TTTGACGGCA AAAAAGTCCT

501   TGCCGCTTAC GAATCTCCCG AAAGCCAGGC GCGCGCCGAC AAAATGCAGG

551   AGCTGACCGA AACCTTCCAA ATCGACGGTA CGCCCACGGT TATCGTCGGC

601   GGCAAATATA AAGTCGAATT TGCCGACTGG GAGTCCGGTA TGAACACCAT

651   CGACCTTTTG GCGGACAAAG TACGCGAAGA ACAAAAAGCC GCGCACTAA
```

This corresponds to the amino acid sequence <SEQ ID 2284; ORF 687.a>:

```
a687.pep
    1   MKSKHLALGV AALFALAACD SKVQTSVPAD SAPAASAAAA PAGLVEGQNY

51   TVLANPIPQQ QAGKVEVLEF FGYFCPHCAH LEPVLSKHAK SFKDDMYLRT

101   EHVVWQKEML TLARLAAAVD MAAADSKDVA NSHIFDAMVN QKIKLQEPEV

151   LKKWLGEQTA FDGKKVLAAY ESPESQARAD KMQELTETFQ IDGTPTVIVG

201   GKYKVEFADW ESGMNTIDLL ADKVREEQKA AH*
```

Computer analysis of this amino acid sequence gave the following results:
Homology with a Predicted ORF from N. meningitidis
ORF 687 shows 98.7% identity over a 232 aa overlap with a predicted ORF (ORF 687) from N meningitidis:
m687/a687 98.7% identity in 232 aa overlap

```
                   10        20        30        40        50        60
    m687.pep  MKSRHLALGVAALFALAACDSKVQTSVPADSAPAASAAAAPAGLVEGQNYTVLANPIPQQ
              |||:||||||||||||||||||||||||||||||||||||||||||||||||||||||||
    a687      MKSKHLALGVAALFALAACDSKVQTSVPADSAPAASAAAAPAGLVEGQNYTVLANPIPQQ
                   10        20        30        40        50        60

70        80        90       100       110       120
    m687.pep  QAGKVEVLEFFGYFCPHCAHLEPVLSKHAKSFKDDMYLRTEHVVWQKEMLTLARLAAAVD
              ||||||||||||||||||||||||||||||||||||||||||||||||||||||||||||
    a687      QAGKVEVLEFFGYFCPHCAHLEPVLSKHAKSFKDDMYLRTEHVVWQKEMLTLARLAAAVD
                   70        80        90       100       110       120

130       140       150       160       170       180
    m687.pep  MAAADSKDVANSHIFDAMVNQKIKLQNPEVLKKWLGEQTAFDGKKVLAAYESPESQARAD
              ||||||||||||||||||||||||||||:|||||||||||||||||||||||||||||||
    a687      MAAADSKDVANSHIFDAMVNQKIKLQEPEVLKKWLGEQTAFDGKKVLAAYESPESQARAD
                  130       140       150       160       170       180

190       200       210       220       230
    m687.pep  KMQELTETFQIDGTPTVIVGGKYKVEFADWESGMNTIDLLADKVREEQKAAQX
              |||||||||||||||||||||||||||||||||||||||||||||||||||:|
    a687      KMQELTETFQIDGTPTVIVGGKYKVEFADWESGMNTIDLLADKVREEQKAAHX
                  190       200       210       220       230
```

The following partial DNA sequence was identified in N. gonorrhoeae <SEQ ID 2285>:

```
g688.seq
    1    GTGCTACACT AGACATCCCG ATTTGCACAG AAAGGTTCTC CCGTGAACAA

51    AACCCTCATC CTCGCCCTTT CCGCCCTGTT CAGCCTGACC GCGTGCAGCG

101    TCGAACGCGT CTCGCTGTTT CCCTCCTACA AACTCAAAAT CATCCAAGGC

151    AACGAACTCG AACCGCGCGC CGTTGCCGCC CTGCGCCCCG GCATGACCAA

201    AGACCAAGTC CTGCTCCTGC TCGGCAGCCC CATACTGCGC GACGCTTTCC

251    ATACCGACCG CTGGGACTAT ACCTTCAACA CCTCCCGCAA CGGCATCATC

301    AAAGAACGCA GCAACCTGAC CGTCTATTTT GAAAACGGCG TACTCGTCCG

351    CACCGAAGGC GACGCCCTCC AAAATGCCGC CGAAGCCCTC CGCGCGAAAC

401    AAAACGCAGA CAAACAATAA
                                                         45
```

This corresponds to the amino acid sequence <SEQ ID 2286; ORF 688>:

```
g688.pep
    1    VLH*TSRFAQ KGSPVNKTLI LALSALFSLT ACSVERVSLF PSYKLKIIQG

51    NELEPRAVAA LRPGMTKDQV LLLLGSPILR DAFHTDRWDY TFNTSRNGII

101    KERSNLTVYF ENGVLVRTEG DALQNAAEAL RAKQNADKQ*
                                                         55
```

The following partial DNA sequence was identified in N. meningitidis <SEQ ID 2287>:

```
m688.seq
    1    GTGTTACACT ACCCATCCCG ATTTGCACAG AAAGGCATTT CCGTGAACAA

51    AACCCTCATC CTCGCCCTTT CCGCCCTCCT CGGCCTTGCC GCGTGCAGTG

101    CCGAACGCGT TTCACTGTTC CCCTCGTACA AACTCAAAAT CATCAGGGC

151    AACGAACTCG AACCGCGCGC CGTTGCCGCC CTCCGCCCCG GCATGACCAA
```

-continued

```
201    AGACCAAGTC CTGCTCCTGC TCGGCAGCCC CATACTGCGC GACGCATTCC

251    ATACCGACCG CTGGGACTAT ACCTTCAACA CCTCCCGCAA CGGCATCATC

301    AAAGAACGCA GCAATCTGAC CGTCTATTTT GAAAACGGCG TACTCGTCCG

351    CACCGAAGGC GACGTCCTGC AAAACGCTGC CGAAGCCCTC AAAGACCGCC

401    AAAACACAGA CAAACCATAA
```

This corresponds to the amino acid sequence <SEQ ID 2288; ORF 688>:

```
m688.pep
    1   VLHYPSRFAQ KGISVNKTLI LALSALLGLA ACSAERVSLF PSYKLKIIQG

51   NELEPRAVAA LRPGMTKDQV LLLLGSPILR DAFHTDRWDY TFNTSRNGII

101   KERSNLTVYF ENGVLVRTEG DVLQNAAEAL KDRQNTDKP*
```

Computer analysis of this amino acid sequence gave the following results:
Homology with a Predicted ORF from *N. gonorrhoeae*
ORF 688 shows 90.6% identity over a 138 aa overlap with a predicted ORF (ORF 688) from *N. gonorrhoeae*:
m688/g688 90.6% identity in 138 aa overlap

```
                   10         20         30         40         50         60
   m688.pep  VLHYPSRFAQKGISVNKTLILALSALLGLAACSAERVSLFPSYKLKIIQGNELEPRAVAA
             |||  |||||||  ||||||||||||::|:|||:||||||||||||||||||||||||||
   g688      VLHXTSRFAQKGSPVNKTLILALSALFSLTACSVERVSLFPSYKLKIIQGNELEPRAVAA
                   10         20         30         40         50         60

70         80         90        100        110        120
   m688.pep  LRPGMTKDQVLLLLGSPILRDAFHTDRWDYTFNTSRNGIIKERSNLTVYFENGVLVRTEG
             ||||||||||||||||||||||||||||||||||||||||||||||||||||||||||||
   g688      LRPGMTKDQVLLLLGSPILRDAFHTDRWDYTFNTSRNGIIKERSNLTVYFENGVLVRTEG
                   70         80         90        100        110        120

130        140
   m688.pep  DVLQNAAEALKDRQNTDKPX
             |:||||||||| :||:||
   g688      DALQNAAEALRAKQNADKQX
                  130        140
```

The following partial DNA sequence was identified in *N. meningitidis* <SEQ ID 2289>:

```
a688.seq
    1   GTGTTACACT ACCCATCCCG ATTTGCACAG AAAGGCATTT CCGTGAACAA

51   AACCCTCATC CTCGCCCTTT CCGCCCTCCT CGGCCTTGCC GCGTGCAGCG

101   TCGAACGCGT TTCACTGTTC CCCTCGTACA AACTCAAAAT CATACAGGGC

151   AACGAACTCG AACCTCGCGC CGTCGCCTCC CTCCGCCCCG GTATGACCAA

201   AGACCAAGTC CTGCTCCTGC TCGGCAGCCC CATACTGCGC GACGCATTCC

251   ATACCGACCG CTGGGACTAT ACCTTCAACA CCTCCCGCAA CGGCATCATC

301   AAAGACCGAA GCAATCTGAC CGTCTATTTT GAAAACGGCG TGCTCGTCCG

351   CACCGAAGGC AACGCCCTGC AAAATGCCGC CGAAGCCCTC CGCGTAAAAC

401   AAAACGCAGA CAAACAATAA
```

This corresponds to the amino acid sequence <SEQ ID 2290; ORF 688.a>:

```
a688.pep
    1   VLHYPSRFAQ KGISVNKTLI LALSALLGLA ACSVERVSLF PSYKLKIIQG

51   NELEPRAVAS LRPGMTKDQV LLLLGSPILR DAFHTDRWDY TFNTSRNGII

101   KDRSNLTVYF ENGVLVRTEG NALQNAAEAL RVKQNADKQ*
```

Computer analysis of this amino acid sequence gave the following results:
Homology with a Predicted ORF from N. meningitidis
ORF 688 shows 93.5% identity over a 138 aa overlap with a predicted ORF (ORF 688) from N. meningitidis
m688/a688 93.5% identity in 138 aa overlap

```
                  10         20         30         40         50         60
    m688.pep  VLHYPSRFAQKGISVNKTLILALSALLGLAACSAERVSLFPSYKLKIIQGNELEPRAVAA
              ||||||||||||||||||||||||||||||||:|||||||||||||||||||||||||||:
    a688      VLHYPSRFAQKGISVNKTLILALSALLGLAACSVERVSLFPSYKLKIIQGNELEPRAVAS
                  10         20         30         40         50         60

70         80         90        100        110        120
    m688.pep  LRPGMTKDQVLLLLGSPILRDAFHTDRWDYTFNTSRNGIIKERSNLTVYFENGVLVRTEG
              |||||||||||||||||||||||||||||||||||||||||:||||||||||||||||||
    a688      LRPGMTKDQVLLLLGSPILRDAFHTDRWDYTFNTSRNGIIKDRSNLTVYFENGVLVRTEG
                  70         80         90        100        110        120

130        140
    m688.pep  DVLQNAAEALKDRQNTDKPX
              ::||||||||::||:||
    a688      NALQNAAEALRVKQNADKQX
                 130        140
```

The following partial DNA sequence was identified in N. gonorrhoeae <SEQ ID 2291>:

```
g689.seq (partial)
    1   ..TCTCCGCCCC TTCCTCCGAT GAGCGGAAAA CTGATGGCGG TTTTGATGGC

51   GGTACTGGTC GCGCTGATGC CGTTTTCCAT CGATGCCTAC CTGCCCGCGA

101   TTCCCGAAAT GGCGCAGCCG CTGAACGCGG ATATCCACCG TATCGAATAG

151   AGTCTGAGTT TGTTTATGTT CGGCACGGCG TTCGGGCAAG TGGCCGGCGG

201   CGCGGTGTCC GACATCAAAG GCGCAAACC CGTCGCCCTG ACCGGTTTGA

251   TTGTATATTG CCTTGCCGTT GCCGCCATCG TATTTGCTTC GAGTACCGAA

301   CAGCTCCTTA ACCTGCGTGC GGTACAGGCG TTCGGCGCAG GCATGGCTGT

351   AGTCATCGTc ggtgcgatgg tgcgcgatTA TTATTCCGGA CGCAAAGCCG 401   cgcAGATGTT TGCCCTTATC GGCATCATTC TGATGGTTGT GCCGCTGGCC

451   GCACCCATGG TCGGCGCATT GTTGCAGGGA TTGGGCGGAT GGCGGGCGAT

501   TTTCGTTTTC ttggcGgcgT ATTCGCCGGT GCTGCCCGGT TTGGTACAGT

551   ATTTCCTGCC CAATCCCGCC GTCGGCGGCA AAATCGGCAG GGATGTGTTC

601   GGGCTGGTGG CGGGGCGGTT CAAGCGCGTA TTGAAAACCC GTGCCGCGAT

651   GGGTtatCTG TTTTTTCAGG CATTCAGCTT CGGTTCGATG TTCGCCTTTC

701   TGACCGAATC TTCCTTCGTG TACCGGCAGC TCTACCACGT TACGCCGCAC

751   CGGTACGCAT GGGTGTTTGC ACTCAACATC ATCACGATGA TGTTTTTCAG

801   CCGCGTTACC GCGTGGCGGC TTAAAACCGG CGCGCATCCG CAAAGCATCC

851   TGCTGCGGGG GATTGTCGTC CAATTTGCCG CCAACCCGTC CCAACTCGCC

901   GCCGTGCTGT TTTCGGGTT GCCCCCGTTT TGGCTGCCGG TCGCGTGCGT

951   GATGTTTTCC GTCGGTACGC AGGGCCTGGT CGGTGCGGAC ACGCAGGCAT
```

-continued

```
1001    GCTTTATGTC TTATTTCAAA GAAGAGGGCG GCAGCGCGAA CGCCGTGTCG
1051    GGTGTATTCC GGTCCTTAAT CGGCGCGGGC GTGGTCATGG CGGCAACCGT
1101    GATGGCGGCA ACCATGACCG CGTCCGCCTC TTGCGGCATT GCGCTTTTGT
1151    GGCTCTGCTC GCACAAGGCG TGGAAGGAAA ACGAAAAAAA GCGAATACTT
```

This corresponds to the amino acid sequence <SEQ ID 2292; ORF 689>:

```
g689.pep (partial)
    1    ..SPPLPPMSGK LMAVLMAVLV ALMPFSIDAY LPAIPEMAQP LNADIHRIE*
   51    SLSLFMFGTA FGQVAGGAVS DIKGRKPVAL TGLIVYCLAV AAIVFASSTE
  101    QLLNLRAVQA FGAGMAVVIV GAMVRDYYSG RKAAQMFALI GIILMVVPLA
  151    APMVGALLQG LGGWRAIFVF LAAYSPVLPG LVQYFLPNPA VGGKIGRDVF
  201    GLVAGRFKRV LKTRAAMGYL FFQAFSFGSM FAFLTESSFV YRQLYHVTPH
  251    RYAWVFALNI ITMMFFSRVT AWRLKTGAHP QSILLRGIVV QFAANPSQLA
  301    AVLFFGLPPF WLPVACVMFS VGTQGLVGAD TQACFMSYFK EEGGSANAVS
  351    GVFRSLIGAG VVMAATVMAA TMTASASCGI ALLWLCSHKA WKENEKKRIL
```

The following partial DNA sequence was identified in *N. meningitidis* <SEQ ID 2293>:

```
m689.seq
    1    TTGTTAATCC ACTATATCGT TCCGGTTCGT CCGGTTTTGC CGGGGCTTTT
   51    GTTGCCGCCT GTTTGTGCCG GTGTGTTAAA ATTTTCCGTT TCCGCGTATT
  101    GTGTTTTCCG CCGCCGGGCG GTTTGTTTGC GAATCGGACG AGAATTTATG
  151    CCTTCTGCCC ATTATCCTGA AATGAGCGAA AAACTGATGG CGGTTTTGAT
  201    GGCGATGCTG GTTACGCTGA TGCCGTTTTC CATCGATGCC TACCTGCCCG
  251    CGATTCCCGA AATGGCGCAA TCGCTGAACG CGGATGTTCA CCGCATCGAA
  301    CAGAGTTTGA GTTTGTTTAT GTTCGGCACG GCGTTCGGAC AGGTGGTCGG
  351    CGGTTCGGTG TCCGACATCA AAGGGCGCAA ACCCGTCGCC CTGACCGGTT
  401    TGATTGTATA TTGCCTTGCC GTTGCCGCCA TCGTATTTGT TTCGAGTGCC
  451    GAACAGCTCC TCAACCTGCG CGTCGTGCAG GCATTCGGTG CGGGCATGAC
  501    TGTGGTCATC GTCGGCGCAA TGGTGCGCGA TTATTATTCC GGACGCAAAG
  551    CCGCCCAGAT GTTTGCCCTT ATCGGCATCA TTTTGATGGT TGTGCCGCTG
  601    GTCGCACCCA TGGTCGGCGC ATTGTTGCAG GGCTTGGGTG GCTGGCAGGC
  651    GATTTTTGTT TTTCTGGCGG CGTATTCGCT GGTGCTGCTC GGTTTGGTAC
  701    AGTATTTCCT GCCCAAGCCC GCCGTCGGCG GCAAAATCGG ACGGGACGTG
  751    TTCGGGCTGG TGGCGGGGCG GTTCAAGCGC GTATTGAAAA CCCGTGCTGC
  801    GATGGGTTAT CTGTTTTTTC AGGCATTCAG CTTCGGTTCG ATGTTCGCCT
  851    TTCTGACCGA ATCTTCCTTC GTGTACCAGC AGCTCTACCG TGTTACGCCT
  901    CATCAATACG CTTGGGCGTT TGCACTCAAC ATCATCACGA TGATGTTTTT
  951    CAACCGCGTT ACCGCGTGGC GGCTCAAAAC CGGCGTGCAT CCGCAAAGCA
 1001    TCCTGCTGTG GGGGATTGTC GTCCAGTTTG CCGCCAACCT GTCCCAACTC
 1051    GCCGCCGTGC TGTTTTTCGG GTTGCCCCCG TTTTGGCTGC TGGTCGCGTG
```

```
-continued
1101  CGTGATGTTT TCCGTCGGTA CGCAGGGCTT GGTCGGTGCA ACACGCAGG

1151  CGTGTTTTAT GTCCTATTTC AAAGAAGAGG GCGGCAGCGC AAACGCCGTA

1201  TTGGGTGTAT TCCAATCTTT AATCGGCGCG GGGGTGGGTA TGGCGGCGAC

1251  CTTCTTGCAC GACGGTTCGG CAACCGTGAT GGCGGCAACG ATGACCGCGT

1301  CCACCTCTTG CGGCATTGCG CTTCTGTGGC TCTGCTCGCA TCGTGCGTGG

1351  AAAGAAAACG GGCAAAGCGA ATACCTTTAA
```

This corresponds to the amino acid sequence <SEQ ID 2294; ORF 689>:

```
m689.pep
   1  LLIHYIVPVR PVLPGLLLPP VCAGVLKFSV SAYCVFRRRA VCLRIGREFM

51  PSAHYPEMSE KLMAVLMAML VTLMPFSIDA YLPAIPEMAQ SLNADVHRIE

101  QSLSLFMFGT AFGQVVGGSV SDIKGRKPVA LTGLIVYCLA VAAIVFVSSA

151  EQLLNLRVVQ AFGAGMTVVI VGAMVRDYYS GRKAAQMFAL IGIILMVVPL

201  VAPMVGALLQ GLGGWQAIFV FLAAYSLVLL GLVQYFLPKP AVGGKIGRDV

251  FGLVAGRFKR VLKTRAAMGY LFFQAFSFGS MFAFLTESSF VYQQLYRVTP

301  HQYAWAFALN IITMMFFNRV TAWRLKTGVH PQSILLWGIV VQFAANLSQL

351  AAVLFFGLPP FWLLVACVMF SVGTQGLVGA NTQACFMSYF KEEGGSANAV

401  LGVFQSLIGA GVGMAATFLH DGSATVMAAT MTASTSCGIA LLWLCSHRAW

451  KENGQSEYL*
```

Computer analysis of this amino acid sequence gave the following results:
Homology with a Predicted ORF from *N. gonorrhoeae*
ORF 689 shows 88.0% identity over a 408 aa overlap with a predicted ORF (ORF 689) from *N. gonorrhoeae*:
m689/a689 88.0% identity in 408 aa overlap

```
                    30         40         50         60         70         80
m689.pep   CAGVLKFSVSAYCVFRRRAVCLRIGREFMPSAHYPEMSEKLMAVLMAMLVTLMPFSIDAY
                     |   |  ||  ||||||||| : || : ||||||||
g689                             SPPLPPMSGKLMAVLMAVLVALMPFSIDAY
                                               10         20         30

90        100        110        120        130        140
m689.pep   LPAIPEMAQSLNADVHRIEQSLSLFMFGTAFGQVVGGSVSDIKGRKPVALTGLIVYCLAV
           ||||||||| |||| ||||:|||||||||||||| ||:|||||||||||||||||||||
g689       LPAIPEMAQPLNADIHRIEXSLSLFMFGTAFGQVAGGSASDIKGRKPVALTGLIVYCLAV
                    40         50         60         70         80         90

150        160        170        180        190        200
m689.pep   AAIVFVSSAEQLLNLRVVQAFGAGMTVVIVGAMVRDYYSGRKAAQMFALIGIILMVVPLV
           ||||:||:|||||||||||||||||||||||||||||||||||||||||||||||||||:
g689       LPAIPAMATPLNADIHAIEXSLSLFAFGTAFGQVAGGSASDIKGRKPVALTGLIVYCLAA
                   100        110        120        130        140        150

210        220        230        240        250        260
m689.pep   APMVGALLQGLGGWQAIFVFLAAYSLVLLGLVQYFLPKPAVGGKIGRDVFGLVAGRFKRV
           |||||||||||||||:||||||||| || ||||||||||:|||||||||||||||||||
g689       APMVGALLQGLGGWRAIFVFLAAYSPVLPGLVQYFLPNPAVGGKIGRDVFGLVAGRFKRV
                   160        170        180        190        200        210

270        280        290        300        310        320
m689.pep   LKTRAAMGYLFFQAFSFGSMFAFLTESSFVYQQLYRVTPHQYAWAFALNIITMMFFNRVT
           ||||||||||||||||||||||||||||||:|||:|||:|||:||||||||||||:|||
g689       LKTRAAMGYLFFQAFSFGSMFAFLTESSFVYRQLYHVTPHRYAWVFALNIITMMFFSRVT
                   220        230        240        250        260        270

330        340        350        360        370        380
m689.pep   AWRLKTGVHPQSILLWGIVVQFAANLSQLAAVLFFGLPPFWLLVACVMFSVGTQGLVGAN
           ||||||:|||||||| ||||||||||| ||||||||||||||| |||||||||||||||:
g689       AWRLKTGAHPQSILLRGIVVQFAANPSQLAAVLFFGLPPFWLPVACVMFSVGTQGLVGAD
                   280        290        300        310        320        330
```

-continued

```
                390        400        410        420        430        440
m689.pep  TQACFMSYFKEEGGSANAVLGVFQSLIGAGVGMAATFLHDGSATVMAATMTASTSCGIAL
          ||||||||||||||||||| |||:||||||| ||||        |||||||||:||||||
g689      TQACFMSYFKEEGGSANAVSGVFRSLIGAGVVMAAT--------VMAATMTASASCGIAL
                  340       350       360                 370       380

450        460
m689.pep  LWLCSHRAWKENGQSEYLX
          ||||||:||||| ::: |
g689      LWLCSHKAWKENEKKRIL
               390       400
```

The following partial DNA sequence was identified in *N. meningitidis* <SEQ ID 2295>:

```
a689.seq
     1  TTGTTAATCC ACTATATCGT TCCGGTTCGT CCGGTTTTGC CGGGGCTTTT

51  GTTGCCGCCT GTTTGTGCCG GTGTGTTAAA ATTTTCCGTT TCCGCGTATT

101  GTGTTTTCCG CCGCCGGGCG GTTTGTTTGC GAATCGGACG AGAATTTATG

151  CCTTCTGCCC ATTATCCTGA AATGAGCGAA AAACTGATGG CGGTTTTGAT

201  GGCGATGCTG GTTACGCTGA TGCCGTTTTC CATCGATGCC TACCTGCCCG

251  CGATTCCCGA AATGGCGCAG TCGCTGAACG CGGATGTCCA CCGCATCGAA

301  CAGAGCCTGA GTTTGTTTAT GTTCGGCACG GCGTTCGGAC AGGTGGTCGG

351  CGGTTCGGTG TCCGACATCA AAGGGCGCAA ACCCGTCGCG CTGACCGGAC

401  TGGCCGTCTA CTGCCTTGCC GTTGCCGCCA TCGTATTTGC TTCGAGTGCC

451  GAACAGCTCC TCAACCTGCG CGTCGTGCAG GCATTCGGTG CGGGCATGAC

501  TGTGGTCATC GTCGGCGCAA TGGTGCGCGA TTATTATTCC GGACGCAAAG

551  CCGCCCAGAT GTTTGCCCTT ATCGGCATCA TTTTGATGGT TGTGCCGCTG

601  GTCGCACCCA TGGTCGGCGC ATTGTTGCAG GGCTTGGGTG GCTGGCAGGC

651  GATTTTTGTT TTTCTGGCGG CGTATTCGCT GGTGCTGCTC GGTTTGGTAC

701  AGTATTTCCT GCCCAAGCCC GCCGTCGGCG GCAAAATCGG CAGGGATGTG

751  TTCGGGCTGG TGGCTGGGCG GTTCAAACGC GTATTGAAAA CCCGTGCCGC

801  GATGGGTTAT CTGTTTTTTC AGGCATTCAG CTTCGGTTCG ATGTTCGCCT

851  TTCTGACCGA ATCTTCCTTC GTGTACCAGC AGCTCTACCA CGTTACGCCG

901  CACCAGTACG CTTGGGCGTT TGCACTCAAC ATCATCACGA TGATGTTTTT

951  CAACCGTATT ACCGCGTGGC GGCTCAAAAC CGGCGTGCAT CCGCAAAGCA

1001  TCCTGCTGTG GGGGATTGTC GTCCAGTTTG CCGCCAACCT GTCCCAACTC

1051  GCCGCCGTGC TGTTTTTCGG GTTGCCCCCG TTTTGGCTGC TGGTCGCGTG

1101  CGTGATGTTT TCCGTCGGTA CGCAGGGCTT GGTCGGTGCA AACACGCAGG

1151  CGTGTTTTAT GTCCTATTTC AAAGAAGAGG GCGGCAGCGC AAACGCCGTA

1201  TTGGGTGTAT TCCAATCTTT AATCGGCGCG GGGGTGGGTA TGGCGGCGAC

1251  CTTCTTGCAC GACGGTTCGG CAACCGTGAT GGCGGCAACC ATGACCGCGT

1301  CTACCTCTTG CGGCATTGCG CTTTTGTGGC TCTGCTCGCA TCGTGCGTGG

1351  AAAGAAAACG GGCAAAGCGA ATACCTTTAA
```

This corresponds to the amino acid sequence <SEQ ID 2296; ORF 689.a>:

```
a689.pep
    1   LLIHYIVPVR PVLPGLLLPP VCAGVLKFSV SAYCVFRRRA VCLRIGREFM

51   PSAHYPEMSE KLMAVLMAML VTLMPFSIDA YLPAIPEMAQ SLNADVHRIE

101   QSLSLFMFGT AFGQVVGGSV SDIKGRKPVA LTGLAVYCLA VAAIVFASSA

151   EQLLNLRVVQ AFGAGMTVVI VGAMVRDYYS GRKAAQMFAL IGIILMVVPL

201   VAPMVGALLQ GLGGWQAIFV FLAAYSLVLL GLVQYFLPKP AVGGKIGRDV

251   FGLVAGRFKR VLKTRAAMGY LFFQAFSFGS MFAFLTESSF VYQQLYHVTP

301   HQYAWAFALN IITMMFFNRI TAWRLKTGVH PQSILLWGIV VQFAANLSQL

351   AAVLFFGLPP FWLLVACVMF SVGTQGLVGA NTQACFMSYF KEEGGSANAV

401   LGVFQSLIGA GVGMAATFLH DGSATVMAAT MTASTSCGIA LLWLCSHRAW

451   KENGQSEYL*
```

Computer analysis of this amino acid sequence gave the following results:
Homology with a Predicted ORF from *N. meningitidis*
ORF 689 shows 99.1% identity over a 459 aa overlap with a predicted ORF (ORF 689) from *N. meningitidis*:
m689/a689 99.1% identity in 459 aa overlap

```
                    10         20         30         40         50         60
    m689.pep  LLIHYIVPVRPVLPGLLLPPVCAGVLKFSVSAYCVFRRRAVCLRIGREFMPSAHYPEMSE
              ||||||||||||||||||||||||||||||||||||||||||||||||||||||||||||
    a689      LLIHYIVPVRPVLPGLLLPPVCAGVLKFSVSAYCVFRRRAVCLRIGREFMPSAHYPEMSE
                    10         20         30         40         50         60

70         80         90        100        110        120
    m689.pep  KLMAVLMAMLVTLMPFSIDAYLPAIPEMAQSLNADVHRIEQSLSLFMFGTAFGQVVGGSV
              ||||||||||||||||||||||||||||||||||||||||||||||||||||||||||||
    a689      KLMAVLMAMLVTLMPFSIDAYLPAIPEMAQSLNADVHRIEQSLSLFMFGTAFGQVVGGSV
                    70         80         90        100        110        120

130        140        150        160        170        180
    m689.pep  SDIKGRKPVALTGLIVYCLAVAAIVFVSSAEQLLNLRVVQAFGAGMTVVIVGAMVRDYYS
              |||||||||||| ||||||||||||||:||||||||||||||||||||||||||||||||
    a689      SDIKGRKPVALTGLAVYCLAVAAIVFASSAEQLLNLRVVQAFGAGMTVVIVGAMVRDYYS
                   130        140        150        160        170        180

190        200        210        220        230        240
    m689.pep  GRKAAQMFALIGIILMVVPLVAPMVGALLQGLGGWQAIFVFLAAYSLVLLGLVQYFLPKP
              ||||||||||||||||||||||||||||||||||||||||||||||||||||||||||||
    a689      GRKAAQMFALIGIILMVVPLVAPMVGALLQGLGGWQAIFVFLAAYSLVLLGLVQYFLPKP
                   190        200        210        220        230        240

250        260        270        280        290        300
    m689.pep  AVGGKIGRDVFGLVAGRFKRVLKTRAAMGYLFFQAFSFGSMFAFLTESSFVYQQLYRVTP
              |||||||||||||||||||||||||||||||||||||||||||||||||||||||:|||
    a689      AVGGKIGRDVFGLVAGRFKRVLKTRAAMGYLFFQAFSFGSMFAFLTESSFVYQQLYHVTP
                   250        260        270        280        290        300

310        320        330        340        350        360
    m689.pep  HQYAWAFALNIITMMFFNRVTAWRLKTGVHPQSILLWGIVVQFAANLSQLAAVLFFGLPP
              |||||||||||||||||||:||||||||||||||||||||||||||||||||||||||||
    a689      HQYAWAFALNIITMMFFNRITAWRLKTGVHPQSILLWGIVVQFAANLSQLAAVLFFGLPP
                   310        320        330        340        350        360

370        380        390        400        410        420
    m689.pep  FWLLVACVMFSVGTQGLVGANTQACFMSYFKEEGGSANAVLGVFQSLIGAGVGMAATFLH
              ||||||||||||||||||||||||||||||||||||||||||||||||||||||||||||
    a689      FWLLVACVMFSVGTQGLVGANTQACFMSYFKEEGGSANAVLGVFQSLIGAGVGMAATFLH
                   370        380        390        400        410        420

430        440        450        460
    m689.pep  DGSATVMAATMTASTSCGIALLWLCSHRAWKENGQSEYLX
              ||||||||||||||||||||||||||||||||||||||||
    a689      DGSATVMAATMTASTSCGIALLWLCSHRAWKENGQSEYLX
                   430        440        450        460
```

The following partial DNA sequence was identified in *N. gonorrhoeae* <SEQ ID 2297>:

```
g690.seq (partial)
    1   ATGAAAAACA AAACGTCATC ACTTCCCTTA TGGCTTGCCG CAATCATGCT
   51   GGCCGCGCGT TCCCCGAGCA AGAAGATAA  AACGAAAGAA AACGGCGCAT
  101   CCGCCGCTTC GTCTTCCGCG TCATCGGCTT CTTCCCAAAC CGATTTGCAA
  151   CCGGCCGCAT CCGCCCCTGA TAACGTCAAG CAGGCAGAAA GCGCGCCACT
  201   GTGAAATTGC ACCGGCCTGC ACCCCGCCGC CGGCATTGGC GATCTCATAC
  251   AGCAAATCGC CGAACACATC GACTCGGACT GTCTGTTTGC CCTTTCCCAT
  301   AACGAACTGG AAACCCGTTT CGGCTTACCC GGCGGCGGCT ATGACAACAT
  351   ACAGCGGctG CTgtttCCCG ACATCCGCCC TGAAGATCCC GACTACCATC
  401   AGAAAATCAT GCTGGCAATC GAAGACTTGC GTTACGGAAC GCGCACCATC
  451   AGccgGCAGG CACAAGATGC CATAATGGAA CAGGAACGCC gcctccGaGa
  501   agCGACGCTG ATGCTGACAC AGGGCAGTCA AAAAACCCGC GGaCAAGGCG
  551   AGGAACCGAA ACGCGCACGT TATTTTGAAG TTTCGGCAAC ATCtgCCtaT
  601   TTgaaccggC ACAAcaacGG ACTTggcgGC AATTTCCAAT ACATCGGCCA
  651   ATTGCCCGGC TATCTGAAAA TGCACGGAGA AATGCTTGAA AACCAATCAC
  701   TCTTCCGGCT GTCCAACCGT GAACGCAATC CCGACAAACC GTTTTTAGAC
  751   ATCCATTTTG ACGAAAATGG CAAAATCACG CGTATTGTCG TTTACGAAAA
  801   AAATATCTAT...
```

This corresponds to the amino acid sequence <SEQ ID 2298; ORF 690>:

```
g690.pep (partial)
    1   MKNKTSSLPL WLAAIMLAAR SPSKEDKTKE NGASAASSSA SSASSQTDLQ
   51   PAASAPDNVK QAESAPL*NC TGLHPAAGIG DLIQQIAEHI DSDCLFALSH
  101   NELETRFGLP GGGYDNIQRL LFPDIRPEDP DYHQKIMLAI EDLRYGTRTI
  151   SRQAQDAIME QERRLREATL MLTQGSQKTR GQGEEPKRAR YFEVSATSAY
  201   LNRHNNGLGG NFQYIGQLPG YLKMHGEMLE NQSLFRLSNR ERNPDKPFLD
  251   IHFDENGKIT RIVVYEKNIY ...
```

The following partial DNA sequence was identified in *N. meningitidis* <SEQ ID 2299>:

```
m690.seq..
    1     ATGAAAAACA AAACCTCATC ACTTCTCTTA TGGCTTACCG CAATCATGCT
   51     GACCGCGTGT TCTCCGAGCA AGACGATAA  AACCAAAGAA GTCGGTGCAT
  101     CCGCTGCTTC GTCCTCCGCG TCATCAGCTC CTTCCCAAAC CGATTTGCAA
  151     CCGACCGCAT CCGCCCCTGA TAACGTCAAG CAGGCAGAAA GCGCGCCGCC
  201     GTCAAATTGC ACCAGCCTGC ACCCCGCCAC CGGCATTGAC GATCTCATGC
  251     AGCAAATCGC CGAACACATT GACTCGGACT GTCTGTTTGC CCTTTCCCAT
  301     CACGAACTGG AAACCCGTTT CGGCTTACCC GACGGTGGCT ATGACAACAT
  351     ACAGCGGCTG CTGTTTCCCG ACATCCGCCC TGAAGATCCC GACTACCATC
  401     AGAAAATCAT ACTGGCAATT GAAGACTTGC GTTACGGAAA GCGCACGATC
  451     AGCCGGCAGG CACAAAATGC CTTGATGGAA CAGGAACGCC GCCTCCGAGA
  501     AGCGACGCTG TTGCTGATAC AGGGCAGTCA AGAAACCCGC GGACAAGGCG
```

-continued

```
551    AGGAGCCGAA ACGCACGCGT TATTTTGAAG TTTCGGCAAC CCCTGCCTAT

601    TCGAGCCGGC ACAACAACGG ACTTGGCGGC AATTTCCAAT ACATCAGCCA

651    ATTGCCCGGC TATCTGAAAA TACACGGAGA ATGCTTGAA AACCAATCAC

701    TCTTCCGGCT GTCCAACCGT GAACGCAATC CCGACAAACC GTTTTTAGAC

751    ATCCATTTTG ACGAAAATGG CAAAATCACG CGTATTGTCG TTTACGAAAA

801    AAACATCTAC TTCAATCCAA ACACGGGGCG AATATAA
```

This corresponds to the amino acid sequence <SEQ ID 2300; ORF 690>:

```
m690.pep
    1   MKNKTSSLLL WLTAIMLTAC SPSKDDKTKE VGASAASSSA SSAPSQTDLQ

51   PTASAPDNVK QAESAPPSNC TSLHPATGID DLMQQIAEHI DSDCLFALSH

101   HELETRFGLP DGGYDNIQRL LFPDIRPEDP DYHQKIILAI EDLRYGKRTI

151   SRQAQNALME QERRLREATL LLIQGSQETR GQGEEPKRTR YFEVSATPAY

201   SSRHNNGLGG NFQYISQLPG YLKIHGEMLE NQSLFRLSNR ERNPDKPFLD

251   IHFDENGKIT RIVVYEKNIY FNPNTGRI*
```

Computer analysis of this amino acid sequence gave the following results:
Homology with a Predicted ORF from *N. gonorrhoeae*
ORF 690 shows 89.3% identity over a 408 aa overlap with a predicted ORF (ORF 690) from *N. gonorrhoeae*:
m690/g690 89.3% identity in 408 aa overlap

```
                    10         20         30         40         50         60
    m690.pep  MKNKTSSLLLWLTAIMLTACSPSKDDKTKEVGASAASSSASSAPSQTDLQPTASAPDNVK
              ||||||| |||:||||:| ||||:||||| |||||||||||||| ||||||| |||||||
    g690      MKNKTSSLPLWLAAIMLAARSPSKEDKTKENGASAASSSASSASSQTDLQPAASAPDNVK
                    10         20         30         40         50         60

70         80         90        100        110        120
    m690.pep  QAESAPPSNCTSLHPATGIDDLMQQIAEHIDSDCLFALSHHELETRFGLPDGGYDNIQRL
              ||||||  |||:||||:||  ||:|||||||||||||||:||||||||||  ||||||||
    g690      QAESAPLXNCTGLHPAAGIGDLIQQIAEHIDSDCLFALSHNELETRFGLPGGGYDNIQRL
                    70         80         90        100        110        120

130        140        150        160        170        180
    m690.pep  LFPDIRPEDPDYHQKIILAIEDLRYGKRTISRQAQNALMEQERRLREATLLLIQGSQETR
              |||||||||||||||| |||||||| |||||||||:|||||||||||||:| ||||:||
    g690      LFPDIRPEDPDYHQKIMLAIEDLRYGTRTISRQAQDAIMEQERRLREATLMLTQGSQKTR
                   130        140        150        160        170        180

190        200        210        220        230        240
    m690.pep  GQGEEPKRTRYFEVSATPAYSSRHNNGLGGNFQYISQLPGYLKIHGEMLENQSLFRLSNR
              ||||||||| |||||||:|| :||||||||||||| |||||||:||||||||||||||||
    g690      GQGEEPKRARYFEVSATSAYLNRHNNGLGGNFQYIGQLPGYLKMHGEMLENQSLFRLSNR
                   190        200        210        220        230        240

250        260        270        279
    m690.pep  ERNPDKPFLDIHFDENGKITRIVVYEKNIYFNPNTGRIX
              ||||||||||||||||||||||||||||||
    g690      ERNPDKPFLDIHFDENGKITRIVVYEKNIY
                   250        260        270
```

The following partial DNA sequence was identified in *N. meningitidis* <SEQ ID 2301>:

```
a690.seq
    1   ATGAAAAACA AAACCTCATC ACTTCTCTTA TGGCTTGCCG CAATGATGCT

51   GACCGCGTGT TCCCCGAGCA AGAAGATAA AACGAAAGAA AACGGCGCAT

101   CCGCCGCCTC GTCCACGGCA TCCGCCGCTT CGTCTTCCGC GCCCCAAACC
```

```
151   GATTTGCAAC CGGCCGCATC CGCCCCTGAT AACGTCAAGC AGGCAGAAAG

201   CGTGCCGCCG TCAAATTGCA CCGACCTGCA CCCCGCCACC GGCATTGACG

251   ATCTCATGCA GCAAATCGCC GAACACATTG ACTCGGACTG TCTGTTTGCC

301   CTTTCCCATC ACGAACTGGA AACCCGTTTC GGCTTACCCG GCGGCGGCTA

351   TGACAACATA CAGCGGCTGC TGTTTCCCGA CATCCGCCCT GAAGATCCCG

401   ACTACCATCA GAAAATCATA CTGGCAATTG AAGACTTGCG TTACGGAAAG

451   CGCACGATCA GCCGGCAGGC ACAAGATGCC TTGATGGAAC AGGAACGCCG

501   CCTCCGAGAA GCGACGCTGT TGCTGATACA GGGCAGTCAA GAAACCCGCG

551   GACAAGGCGA GGAGCCGAAA CGCACGCGTT ATTTTGAAGT TTCGGCAACC

601   CCTGCCTATT CGAGCCGGCA CAACAACGGA CTTGGCGGCA ATTTCCAATA

651   CATCGGCCAA TTGCCCGGCT ATCTGAAAAT ACACGGAGAA ATGCTTGAAA

701   ACCAATCACT CTTCCGGCTG TCCAACCGTG AACGCAATCC CGACAAACCG

751   TTTTTAGACA TCCATTTTGA CGAAAATGGC AAAATCACGC GTATTGTCGT

801   TTACGAAAAA AACATCTACT TCAATCCAAA CTTGGGGCGA AGATAA
```

This corresponds to the amino acid sequence <SEQ ID 2302; ORF 690.a>:

```
a690.pep
    1   MKNKTSSLLL WLAAMMLTAC SPSKEDKTKE NGASAASSTA SAASSSAPQT

51   DLQPAASAPD NVKQAESVPP SNCTDLHPAT GIDDLMQQIA EHIDSDCLFA

101   LSHHELETRF GLPGGGYDNI QRLLFPDIRP EDPDYHQKII LAIEDLRYGK

151   RTISRQAQDA LMEQERRLRE ATLLLIQGSQ ETRGQGEEPK RTRYFEVSAT

201   PAYSSRHNNG LGGNFQYIGQ LPGYLKIHGE MLENQSLFRL SNRERNPDKP

251   FLDIHFDENG KITRIVVYEK NIYFNPNLGR R*
```

Computer analysis of this amino acid sequence gave the following results:
Homology with a Predicted ORF from *N. meningitidis*
ORF 690 shows 93.9% identity over a 280 aa overlap with a predicted ORF (ORF 690) from *N. meningitidis*:
m690/a690 93.9% identity in 280 aa overlap

```
                  10         20         30         40         50
   m690.pep  MKNKTSSLLLWLTAIMLTACSPSKDDKTKEVGASAASSSASSAPS---QTDLQPTASAPD
             ||||||||||||:|:|||||||||:||||| |||||||:||||      ||||||:||||
   a690      MKNKTSSLLLWLAAMMLTACSPSKEDKTKENGASAASSTASAASSSAPQTDLQPAASAPD
                  10         20         30         40         50         60

60         70         80         90        100        110
   m690.pep  NVKQAESAPPSNCTSLHPATGIDDLMQQIAEHIDSDCLFALSHHELETRFGLPDGGYDNI
             |||||||:||||||:|||||||||||||||||||||||||||||||||||||||:|||||
   a690      NVKQAESVPPSNCTDLHPATGIDDLMQQIAEHIDSDCLFALSHHELETRFGLPGGGYDNI
                  70         80         90        100        110        120

120        130        140        150        160        170
   m690.pep  QRLLFPDIRPEDPDYHQKIILAIEDLRYGKRTISRQAQNALMEQERRLREATLLLIQGSG
             |||||||||||||||||||||||||||||||||||||:||||||||||||||||||||||
   a690      QRLLFPDIRPEDPDYHQKIILAIEDLRYGKRTISRQAQDALMEQERRLREATLLLIQGSG
                 130        140        150        160        170        180

180        190        200        210        220        230
   m690.pep  ETRGQGEEPKRTRYFEVSATPAYSSRHNNGLGGNFQYISQLPGYLKIHGEMLENQSLFRL
             |||||||||||||||||||||||||||||||||||||:||||||||||||||||||||||
   a690      ETRGQGEEPKRTRYFEVSATPAYSSRHNNGLGGNFQYIGQLPGYLKIHGEMLENQSLFRL
                 190        200        210        220        230        240
```

```
                      250         260         270       279
m690.pep   ERNPDKPFLDIHFDENGKITRIVVYEKNIYFNPNTGRIX
           ||||||||||||||||||||||||||||||||||  ||
a690       ERNPDKPFLDIHFDENGKITRIVVYEKNIYFNPNLGRRX
                      250         260         270        280
```

The following partial DNA sequence was identified in *N. gonorrhoeae* <SEQ ID 2303>:

```
g691.seq
    1   GTGCCGCTGC CTGCTCCCTG CCGTTTTGCC AAACCTGCCG CCTCTTTTTT

51   AAGTATGGCT TTGCTTTCCT GCCAGCTTTC CCACGCCGCC ACGGCTTATA

101   TCCCCCCGAA CGATTTTCAA CCGAACTGCG ACATACGCCG GCTCGGGCTG

151   ACACAGGGTC AGCACAATGA GCTGCGTAAA ATCCGCGCCG CCTTCAAAAT

201   GGCGGGCGAC AGGGCGCGTT TGAAGGTTAT GCATTCCGAA CACAGCCGCC

251   GCCGCTCTGT CGTCGAAATC ATTTCTTCGG ATGTTTTTAA TCGGAACGAG

301   GCGCGCGATT ATGTCGAAAG CCGCTACCAC TCCAGCATGG ATTTTGCGGT

351   GGACGAATTG GAAATCCAAC ACCGCTTCTT CCATATTCTC ACACCGCAAC

401   AGCAGCAAAT GTGGCTTTCT TCCTGCCTCA AATAA
```

This corresponds to the amino acid sequence <SEQ ID 2304; ORF 691>:

```
g691.pep
    1   VPLPAPCRFA KPAASFLSMA LLSCQLSHAA TAYIPPNDFQ PNCDIRRLGL

51   TQGQHNELRK IRAAFKMAGD RARLKVMHSE HSRRRSVVEI ISSDVFNRNE

101   ARDYVESRYH SSMDFAVDEL EIQHRFFHIL TPQQQQMWLS SCLK*
```

The following partial DNA sequence was identified in *N. meningitidis* <SEQ ID 2305>:

```
m691.seq
    1   GTGCCACTGC CTGCTCCCTG CCGTTTTGCC AAACCTGCCG CCTCTTTTTT

51   AAGTATGGCT TTGCTTTCCT GTCAGCTTTC CCACGCCGCC ACGGCTTATA

101   TCCCCCCGAA CGATTTTCAA CCGAACTGCG ACATACGCCG ACTCGGGCTG

151   ACCCAAAGTC AGCACAATGA GCTGCGTAAA ATCCGCACCG CCTTCAAAAT

201   GGCGGGCGAC AGGGCGCGTT TGAAGGTTAT GCATTCCGAA CACAGCCGCC

251   GCCGGTCTGT CGTCGAAATC ATTTCCTCGG ATGTTTTTAA TCGGAACGAG

301   GCGCGCGATT ATGTCGAAAG CCGCTATTTG TCCGGTATGG ATTTTGCGGT

351   GGACGAATTG GAAATCCAAC ACCGGTTCTT CCATATCCTC ACACCGCAAC

401   AGCAGCAAAT GTGGCTTTCT TCCTGCCTCA AATAA
```

This corresponds to the amino acid sequence <SEQ ID 2306; ORF 691>:

```
m691.pep
    1   VPLPAPCRFA KPAASFLSMA LLSCQLSHAA TAYIPPNDFQ PNCDIRRLGL

51   TQSQHNELRK IRTAFKMAGD RARLKVMHSE HSRRRSVVEI ISSDVFNRNE

101   ARDYVESRYL SGMDFAVDEL EIQHRFFHIL TPQQQQMWLS SCLK*
```

Computer analysis of this amino acid sequence gave the following results:
Homology with a Predicted ORF from *N. gonorrhoeae*
ORF 691 shows 97.2% identity over a 144 aa overlap with a predicted ORF (ORF 691) from *N. gonorrhoeae*:
m691/g691 97.2% identity in 144 aa overlap

```
                    10         20         30         40         50         60
    m691.pep  VPLPAPCRFAKPAASFLSMALLSCQLSHAATAYIPPNDFQPNCDIRRLGLTQSQHNELRK
              ||||||||||||||||||||||||||||||||||||||||||||||||||||:||||||
    g691      VPLPAPCRFAKPAASFLSMALLSCQLSHAATAYIPPNDFQPNCDIRRLGLTQGQHNELRK
                    10         20         30         40         50         60

70         80         90        100        110        120
    m691.pep  IRTAFKMAGDRARLKVMHSEHSRRRSVVEIISSDVFNRNEARDYVESRYLSGMDFAVDEL
              ||:|||||||||||||||||||||||||||||||||||||||||||||||| :|||||||
    g691      IRAAFKMAGDRARLKVMHSEHSRRRSVVEIISSDVFNRNEARDYVESRYHSSMDFAVDEL
                    70         80         90        100        110        120

130        140
    m691.pep  EIQHRFFHILTPQQQQMWLSSCLKX
              |||||||||||||||||||||||||
    g691      EIQHRFFHILTPQQQQMWLSSCLKX
                   130        140
```

The following partial DNA sequence was identified in *N. meningitidis* <SEQ ID 2307>:

```
a691.seq
    1   GTGCCACTGC NTGCTCCCTG CCGTTTTGCC AAACCTGCCG CCTCTTTTTT

51   AAGTATGGCT TTGCTTTCCT GCCAGCTTTC CCACGCCGCC ACGGCTTATA

101   TCCCCCTGAA CGATTTTCAA CCGAACTGCG ACATACGCCG GCTCGGACTG

151   ACACAGGGTC AGCACAATGA ACTGCGTAAA ATCCGCGCCG CCTTCAAAAT

201   GGCGGGCGAC AGGGCGCGTT TGAAGGTTAT GCATTCCGAA CACAGCCGCC

251   GTCGGTCTGT CGTCGAAATC ATTTCCTCGG ATGTTTTTAA TCGGAACGAG

301   GCGCGCGATT ATGTCGAAAG CCGCTATTTG TCCGGTATGG ATTTTGCGGT

351   GGACGAATTG GAAATCCAAC ACCGGTTCTT CCATATCCTC ACACCGCAAC

401   AGCAGCAAAT GTGGCTTTCT TCCTGCCTCA AATAA
```

This corresponds to the amino acid sequence <SEQ ID 2308; ORF 691.a>:

```
a691.pep
    1   VPLXAPCRFA KPAASFLSMA LLSCQLSHAA TAYIPLNDFQ PNCDIRRLGL

51   TQGQHNELRK IRAAFKMAGD RARLKVMHSE HSRRRSVVEI ISSDVFNRNE

101   ARDYVESRYL SGMDFAVDEL EIQHRFFHIL TPQQQQMWLS SCLK*
```

Computer analysis of this amino acid sequence gave the following results:
Homology with a Predicted ORF from *N. meningitidis*
ORF 691 shows 97.2% identity over a 144 aa overlap with a predicted ORF (ORF 691) from *N. meningitidis*:
m691/a691 97.2% identity in 144 aa overlap

```
                    10         20         30         40         50         60
    m691.pep  VPLPAPCRFAKPAASFLSMALLSCQLSHAATAYIPPNDFQPNCDIRRLGLTQSQHNELRK
              |||:||||||||||||||||||||||||||||||| |||||||||||||||:||||||
    a691      VPLXAPCRFAKPAASFLSMALLSCQLSHAATAYIPLNDFQPNCDIRRLGLTQGQHNELRK
                    10         20         30         40         50         60
```

```
                    70         80         90        100        110        120
m691.pep  IRTAFKMAGDRARLKVMHSEHSRRRSVVEIISSDVFNRNEARDYVESRYLSGMDFAVDEL
          ||:|||||||||||||||||||||||||||||||||||||||||||||||||||||||
a691      IRAAFKMAGDRARLKVMHSEHSRRRSVVEIISSDVFNRNEARDYVESRYLSGMDFAVDEL
                    70         80         90        100        110        120

130        140
m691.pep  EIQHRFFHILTPQQQQMWLSSCLKX
          |||||||||||||||||||||||||
a691      EIQHRFFHILTPQQQQMWLSSCLKX
                   130        140
```

The following partial DNA sequence was identified in *N. gonorrhoeae* <SEQ ID 2309>:

```
g692.seq
    1  GTATCGCACA CACGCTGTCG CTGTTCGGAA TCGAtacGCC GGATTTGGCG

51  GAATGGCAGG GAATGGCGGA TTAAAGGACA AAAATGCCGT CTGAACACGG

101  ATGCGGTTCA GACGGCATCA TTTTATACGA CTGCCTTATT TGGCTGCGCC

151  TTCATTCCAT GCGGCAGGGT ATTTGTAGCC CTCGAAGCGT TTGTGCGCGT

201  AGGCTTTGAA CGCGTCGGAG TTATAGGCCT CGGTTACGTC TTTAAGCCAT

251  TGGCTGTCTT TGTCGGCGGT TTTgacGGCA GACCAGTTGA CATAGGCAAA

301  GCTCGGCTCT TGGAACAGGG CTTCGGTCAG CTTCATGCCG CTGCTTATGG

351  CGTAGTTGCC GTTGACGACG GCAAAATCCA CGTCGGCGCG GCTGCGCGGC

401  AGTTGTGCGG CTTCAAGCTC GACGATTTTG ATGTTTTTCA GGTTTTCCGC

451  GATGTCGGCT TTGGATGCGG TCAGCGGATT GATGCCGTCT TTGAGTTTGA

501  TCCAACCCAG TTCGTTCAGC ATCACCAAGG CGCGTGCGAA GTTGGAcggG

551  TcgtTGGGCG CGGATACGGT GCTGCCGTCT TTGACTTCTT CCAGCGATTT

601  CAGTTTGCCC GGATACAGTC CCAAAGGCGC GGTCGGCACT TGGAAGGCTT

651  CGGTGATGTC CAGGTTGTGT TCTTTTTTGA AATCGTCAAG ATAGGGTTTG

701  TGTTGGAAGA CGTTGATGTC CAACTCGCCC TCCGCCAATG CCAGATTCGG

751  GCGCACATAG TCggTAAATT cgaccaatTT gacgGTGTag cCTTTTTTCT

801  CCAGCTCGgc tTGGATTTGT TCTTTGACCA TATcgccgaa gtcgcccacg 851  gTCGTGCCGA agacgaTTTC TTTTTTCGCc GcgcCGTTAT CGGCAGAAGG 901  GGCGGCGgca gaggctgcGG GCGCGCTGTC TTTTtgaccG ccgCAGGCTG 951  CGAGGATGAG CGCGAGtgcg gcggcggaaa ggGTTTTGAA GAAGGTTTTc 1001  atATTTTCTc ctga
```

This corresponds to the amino acid sequence <SEQ ID 2310; ORF 692>:

```
g692.pep
    1  VSHTRCRCSE SIRRIWRNGR EWRIKGQKCR LNTDAVQTAS FYTTALFGCA

51  FIPCGRVFVA LEAFVRVGFE RVGVIGLGYV FKPLAVFVGG FDGRPVDIGK

101  ARLLEQGFGQ LHAAAYGVVA VDDGKIHVGA AARQLCGFKL DDFDVFQVFR

151  DVGFGCGQRI DAVFEFDPTQ FVQHHQGACE VGRVVGRGYG AAVFDFFQRF

201  QFARIQSQRR GRHLEGFGDV QVVFFFEIVK IGFVLEDVDV QLALRQCQIR
```

-continued

```
    251 AHIVGKFDQF DGVAFFLQLG LDLFFDHIAE VAHGRAEDDF FFRRAVIGRR

301 GGGRGCGRAV FLTAAGCEDE RECGGGKGFE EGFHIFS*
```

The following partial DNA sequence was identified in *N. meningitidis* <SEQ ID 2311>:

```
m692.seq
      1 GTGTTGCACA CGCTTTGTCG CTGTTCGGAA TCGATACGCC GGATTCGGCG

51 GAATGGCAGG GAATGGCGGA TTAAAGGACA AAAATGCCGT CTGAACACGG

101 ATACAGTTCA GACGGCATCA TTTTATACGA CTGCCTTATT TGGCTGCGCC

151 TTCATTCCAT GCGGCAGGGG ATTTGTAGCC CTCGAAGCGT TGTGCGCGT

201 AGGCTTTGAA CGCGTCGGAG TTATAGGCCT CGGTTACGTC TTTAAGCCAT

251 TGGCTGTCTT TGTCGGCGGT TTTGACGGCA GACCAGTTGA CATAGGCAAA

301 GCTCGGTTCT TGGAACAGGG CTTCGGTCAG CTTCATGCCG CTGCTTATGG

351 CGTAGTTGCC GTTGACGACG GCAAAATCCA CGTCGGCGCG GCTACGCGGC

401 AGTTGCGCGG CTTCAAGCTC GACGATTTTG ATGTTTTTCA GGTTCTCGGC

451 GATGTCCGCT TTGGATGCGG TCAACGGATT GATGCCGTCT TGAGTTTGA

501 TCCAACCCAG TTCGTCGAGC ATCACCAAGA CGCGGGCGAA GTTGGACGGG

551 TCGTTGGGCG CGGATACGGT GCTGCCGTCT TTGACTTCTT CCAGCGATTT

601 CAGCTTGCCC GGGTACAGTC CCAAAGGCGC GGTCGGCACT TGGAAGACTT

651 CGGTGATGTC CAGATTGTGT TCTTTTTTGA AGTCGTCAAG ATAGGGTTTG

701 TGTTGGAAGA CGTTGATGTC CAACTCGCCC TCAGCCAATG CCAGATTCGG

751 GCGTACATAG TCGGTAAACT CGACCAGTTT GACGGTGTAG CCTTTTTTCT

801 CCAGCTCGGC TTGGATTTGT TCTTTGACCA TATCGCCGAA GTCGCCGACG

851 GTCGTGCCGA AGACGATTTC TTTTTTCGCC GCGCCGTTGT CGGCGGCGGC

901 AGAAGCGGAT GCGGCGGGCG CGCTGTCTTT TTGACCGCCG CAGGCGGCGA

951 GGATGAGCGC GAGTGCGGCG GCGGAAAGGG TTTTGAAGAA GGTTTTCATA

1001 TTTTCTCCTG A
```
                                                              50

This corresponds to the amino acid sequence <SEQ ID 2312; ORF 692>:

```
m692.pep
      1 VLHTLCRCSE SIRRIRRNGR EWRIKGQKCR LNTDTVQTAS FYTTALFGCA

51 FIPCGRGFVA LEAFVRVGFE RVGVIGLGYV FKPLAVFVGG FDGRPVDIGK

101 ARFLEQGFGQ LHAAAYGVVA VDDGKIHVGA ATRQLRGFKL DDFDVFQVLG

151 DVRFGCGQRI DAVFEFDPTQ FVEHHQDAGE VGRVVGRGYG AAVFDFFQRF

201 QLARVQSQRR GRHLEDFGDV QIVFFFEVVK IGFVLEDVDV QLALSQCQIR

251 AYIVGKLDQF DGVAFFLQLG LDLFFDHIAE VADGRAEDDF FFRRAVVGGG

301 RSGCGGRAVF LTAAGGEDER ECGGGKGFEE GFHIFS*
```

Computer analysis of this amino acid sequence gave the following results:
Homology with a Predicted ORF from N. gonorrhoeae
ORF 692 shows 91.1% identity over a 338 aa overlap with a predicted ORF (ORF 692) from N. gonorrhoeae:
m692/g692 91.1% identity in 338 aa overlap

```
                  10        20        30        40        50        60
m692.pep   VLHTLCRCSESIRRIRRNGREWRIKGQKCRLNTDTVQTASFYTTALFGCAFIPCGRGFVA
            | ||  |||||||||||  ||||||||||||||||:||||||||||||||||||| |||
g692       VSHTRCRCSESIRRIWRNGREWRIKGQKCRLNTDAVQTASFYTTALFGCAFIPCGRVFVA
                  10        20        30        40        50        60

70        80        90       100       110       120
m692.pep   LEAFVRVGFERVGVIGLGYVFKPLAVFVGGFDGRPVDIGKARFLEQGFGQLHAAAYGVVA
           ||||||||||||||||||||||||||||||||||||||||||:|||||||||||||||||
g692       LEAFVRVGFERVGVIGLGYVFKPLAVFVGGFDGRPVDIGKARLLEQGFGQLHAAAYGVVA
                  70        80        90       100       110       120

130       140       150       160       170       180
m692.pep   VDDGKIHVGAATRQLRGFKLDDFDVFQVLGDVRFGCGQRIDAVFEFDPTQFVEHHQDAGE
           |||||||||||:|||  |||||||||||||:  || ||||||||||||||||||:||| ||
g692       VDDGKIHVGAAARQLCGFKLDDFDVFQVFRDVGFGCGQRIDAVFEFDPTQFVQHHQGACE
                 130       140       150       160       170       180

190       200       210       220       230       240
m692.pep   VGRVVGRGTGAAVFDFFQRFQLARVQSQRRGRHLEDFGDVQIVFFFEVVKIGFVLEDVDV
           ||||||||||||||||||||||||:||:||||||||| |||||:|||||||||||||||||
g692       VGRVVGRGTGAAVFDFFQRFQFARIQSQRRGRHLEGFGDVQVVFFFEIVKIGFVLEDVDV
                 190       200       210       220       230       240

250       260       270       280       290
m692.pep   QLALSQCQIRAYIVGKLDQFDGVAFFLQLGLDLFFDHIAEVADGRAEDDFFFRRAVVG--
           ||||  ||||||:|||::|||||||||||||||||||||||||  ||||||||||||:|
g692       QLALRQCQIRAHIVGKFDQFDGVAFFLQLGLDLFFDHIAEVAHGRAEDDFFFRRAVIGRR
                 250       260       270       280       290       300

300       310        32       330
m692.pep   GGRSGCGGRAVFLTAAGGEDERECGGGKGFEEGFHIFSX
           || |||  ||||||| |||||||||||||||||||||||
g692       GGGRGCG-RAVFLTAAGCEDERECGGGKGFEEGFHIFSX
                  310       320       330
```

The following partial DNA sequence was identified in *N. meningitidis* <SEQ ID 2313>:

```
a692.seq
    1    GTGTTGCACA CGCTTTGTCG CTGTTCGGAA TCGATACGCC GGATTCGGCG

51    GAATGGCAGG GAATGGCGGA TTAAAGGACA AAAATGCCGT CTGAACACGG

101    ATACGGTTCA GACGGCATCA TTTTATACGA CTGCCTTATT TGGCTGCGCC

151    TTCATTCCAT GCGGCAGGGG ATTTGTAGCC CTCGAAGCGT TTGTGCGCGT

201    AGGCTTTGAA CGCGTCGGAG TTATAGGCCT CGGTTACGTC TTTAAGCCAT

251    TGGCTGTCTT TGTCGGCGGT TTTGACGGCA GACCAGTTGA CATAGGCAAA

301    GCTCGGTTCT TGGAACAGGG CTTCGGTCAG CTTCATGCCG CTGCTTATGG

351    CGTAGTTGCC GTTGACGACG GCAAAATCCA CGTCGGCGCG GCTACGCGGC

401    AGTTGCGCGG CTTCAAGCTC GACGATTTTG ATGTTTTTCA GGTTTTCGGC

451    AATGTCCGCT TTGGATGCGG TCAGCGGATT GATGCCGTCT TTGAGTTTGA

501    TCCAACCCAG TTCGTCGAGC ATCACCAAGA CGCGGGCGAA GTTGGACGGG

551    TCGTTGGGCG CGGATACGGT GCTGCCGTCT TTGACTTCTT CCAGCGATTT

601    CAGCTTGCCC GGGTACAGTC CCAAAGGCGC GGTCGGCACT TGGAAGACTT

651    CGGTGATGTC CAGATTGTGT TCTTTTTTGA AGTCGTCAAG ATAGGGTTTG

701    TGTTGGAAGA CGTTGATGTC CAACTCGCCC TCAGCCAATG CCAGATTCGG

751    GCGCACATAG TCGGTAAACT CGACCAGTTT GACGGTGTAG CCTTTTTTCT

801    CCAGCTCGGG TTGGATTTGT TCTTTGACCA TATCGCCGAA GTCGCCGACG
```

```
-continued
 851   GTCGTGCCGA AGACGATTTC TTTTTTCGCC GCGCCGTTGT CGGCGGCGGC

901   AGAAGCGGAT GCGGCGGGCG CGCTATCTTT TTGACCGCCG CAGGCGGCGA

951   GGATGAGCGC GAGTGCGGCG GCGGAAAGGG TTTTGAAGAA GGTTTTCATA

1001   TTTTCTCCTG A
```

This corresponds to the amino acid sequence <SEQ ID 2314; ORF 692.a>:

```
a692.pep
   1   VLHTLCRCSE SIRRIRRNGR EWRIKGQKCR LNTDTVQTAS FYTTALFGCA

51   FIPCGRGFVA LEAFVRVGFE RVGVIGLGYV FKPLAVFVGG FDGRPVDIGK

101   ARFLEQGFGQ LHAAAYGVVA VDDGKIHVGA ATRQLRGFKL DDFDVFQVFG

151   NVRFGCGQRI DAVFEFDPTQ FVEHHQDAGE VGRVVGRGYG AAVFDFFQRF

201   QLARVQSQRR GRHLEDFGDV QIVFFFEVVK IGFVLEDVDV QLALSQCQIR

251   AHIVGKLDQF DGVAFFLQLG LDLFFDHIAE VADGRAEDDF FFRRAVVGGG

301   RSGCGGRAIF LTAAGGEDER ECGGGKGFEE GFHIFS*
```

Computer analysis of this amino acid sequence gave the following results:
Homology with a Predicted ORF from *N. meningitidis*
ORF 692 shows 98.8% identity over a 336 aa overlap with a predicted ORF (ORF 692) from *N. meningitidis*:
m692/a692 98.8% identity in 336 aa overlap

```
                  10        20        30        40        50        60
m692.pep  VLHTLCRCSESIRRIRRNGREQRIKGQKCRLNTDTVQTASFYTTALFGCAFIPCGRGFVA
          ||||||||||||||||||||||||||||||||||||||||||||||||||||||||||||
a692      VLHTLCRCSESIRRIRRNGREQRIKGQKCRLNTDTVQTASFYTTALFGCAFIPCGRGFVA
                  10        20        30        40        50        60

70        80        90       100       110       120
m692.pep  LEAFVRVGFERVGVIGLGYVFKPLAVFVGGFDGRPVDIGKARFLEQGFGQLHAAATGVVA
          ||||||||||||||||||||||||||||||||||||||||||||||||||||||||||||
a692      LEAFVRVGFERVGVIGLGYVFKPLAVFVGGFDGRPVDIGKARFLEQGFGQLHAAATGVVA
                  70        80        90       100       110       120

130       140       150       160       170       180
m692.pep  VDDGKIHVGAATRQLRGFKLDDFDVFQVLGDVRFGCGQRIDAVFEFDPTQFVEHHQDAGE
          ||||||||||||||||||||||||||||||:|:|||||||||||||||||||||||||||
a692      VDDGKIHVGAATRQLRGFKLDDFDVFQVFGNVRFGCGQRIDAVFEFDPTQFVEHHQDAGE
                 130       140       150       160       170       180

190       200       210       220       230       240
m692.pep  VGRVVGRGYGAAVFDFFQRFQLARVQSQRRGRHLEDFGDVQIVFFFEVVKIGFVLEDVDV
          ||||||||||||||||||||||||||||||||||||||||||||||||||||||||||||
a692      VGRVVGRGYGAAVFDFFQRFQLARVQSQRRGRHLEDFGDVQIVFFFEVVKIGFVLEDVDV
                 190       200       210       220       230       240

250       260       270       280       290       300
m692.pep  QLALSQCQIRAYIVGKLDQFDGVAFFLQLGLDLFFDHIAEVADGRAEDDFFFRRAVVGGG
          ||||||||||:|||||||||||||||||||||||||||||||||||||||||||||||||
a692      QLALSQCQIRAHIVGKLDQFDGVAFFLQLGLDLFFDHIAEVADGRAEDDFFFRRAVVGGG
                 250       260       270       280       290       300

310       320       330
m692.pep  RSGCGGRAVFLTAAGGEDERECGGGKGFEEGFHIFSX
          ||||||||:||||||||||||||||||||||||||||
a692      RSGCGGRAIFLTAAGGEDERECGGGKGFEEGFHIFSX
                 310       320       330
```

The following partial DNA sequence was identified in *N. gonorrhoeae* <SEQ ID 2315>:

```
g694.seq
   1   TCGGCATTTG TGTTGCCCAA ACATCCGATG CCTGCGTTAA CGCCTGCGTC

51   AACGTTTGCA CAAATCGGGT TTGGTTTCGC CCTCGCGGCG CAGCTCCTTG
```

-continued

```
 101   GGCAGGACGA ACACGATGCT TTCTTCCGCG CCCCCCCCTT CGCGCACGGT
 151   TTCATGCCCC CATCCGCGTA TGGTTGCCAA TACTTCCCGC ACCAACACTT
 201   CGGGCGCGGA CGCGCCTGCC GTTACGCCGA CTTTGCTTTT GCCTTCAAAC
 251   CACGTGCGTT GCaggTAGGA CGCGTTGTCC ACCATATACG CATCGATTCC
 301   GCGCGATGCC GCCACTTCGC GCAGGCGGTT GCTGTTGGAC GAATTGGGCG
 351   AACCGACCAC AATCACGATG TCGCACTGTT CCGCCAGCTC TTTGACGGCG
 401   GTTTGCCGGT TGGTCGTCGC ATAGCAGATG TCTTCCTTGT GCGGATTGCG
 451   GATATTGGGG AAACGCGCGT TCAGCGCGGC GATGATGTCT TTGGTTTCAT
 501   CGACCGAGAG CGTGGTTTGG CTGACATAGG CGAGTTTGTC GGGGTTTCTG
 551   ACTTCGAGTT TTGCCACATC TCCGACCGTT TCGACCAAAA GCATTTTGCC
 601   CGGTGCAAGC TGCCCCATCG TGCCTTCGAC CTCGGCGTGC CCCTTATGCC
 651   CGATCATGAT GATTTCACAG TCTTGGGCAT CCAGTCGGGC GACTTCCTTA
 701   TGCACTTTCG TCACCAGCGG GCAAGTCGCA TCAAATACCC GGAAACCGCG
 751   CTCCGCCGCT TCCTGCTGCA CCGCCTTCGA TACGCCGTGT GCCGAATAAA
 801   CCAGTGTCGC GCCCGGCGGC ACTTCCGCCA AGTCTTCGAT AAACACCGCG
 851   CCTTTTTCGC GCAGGTTGTC CACGACGAAT TTGTTGTGGA CGACTTCGTG
 901   GCGCACATAA ACCGGCGCGC CGAATTCTTC CAAAGCACGT TCGACAATAC
 951   TGATTGCCCG ATCCACACCG GCGCAGAAGC CGCGCGGATT GGCAAGGATG
1001   ATGGTTTTTC CGTTCATAAG TTTTGCATTC CGTGTTCAGA CGGCATTCAC
1051   GTTTTTTTGC TNNATCTTTG CGATGGACGA TATTGTCAAG CACCGCCAAC
1101   ACCGCACCGA CGCAGATAA
```

This corresponds to the amino acid sequence <SEQ ID 2316; ORF 694>:

```
g694.pep (partial)
   1   SAFVLPKHPM PALTPASTFA QIGFGFALAA QLLGQDEHDA FFRAPPFAHG
  51   FMPPSAYGCQ YFPHQHFGRG RACRYADFAF AFKPRALQVG RVVHHIRIDS
 101   ARCRHFAQAV AVGRIGRTDH NHDVALFRQL FDGGLPVGRR IADVFLVRIA
 151   DIGETRVQRG DDVFGFIDRE RGLADIGEFV GVSDFEFCHI SDRFDQKHFA
 201   RCKLPHRAFD LGVPLMPDHD DFTVLGIQSG DFLMHFRHQR ASRIKYPETA
 251   LRRFLLHRLR YAVCRINQCR ARRHFRQVFD KHRAFFAQVV HDEFVVDDFV
 301   AHINRRAEFF QSTFDNTDCP IHTGAEAARI GKDDGFSVHK FCIPCSDGIH
 351   VFLLXLCDGR YCQAPPTPHR RR*
```

The following partial DNA sequence was identified in *N. meningitidis* <SEQ ID 2317>:

```
m694.seq
   1   TTGGTTTCCG CATCCGGCAC ACGGCAAAAA TGCCGTCTGA AGCCTGTTCA
  51   GACGGCATTT GTGTTGCCCA ACATTCAAC GCCTGCGTCA ACGTTTGCAC
 101   AAATCGGGTT TGGTTTCGCC CTCGCGGCGC AACTCTTTGG GCAGGACGAA
 151   CACAATGCTT TCTTCCGCAC CCTCGCCTTC GCGTACGGTT TCGTGCCCCC
 201   ATCCGCGTAT GGTTGCCAGT ACTTCCCGCA CCAACACTTC GGGCGCGGAC
```

```
 251  GCGCCTGCCG TTACGCCGAC TTTGTTTTTG CCCTCAAACC ATGCGCGTTG

301  CAGGTAGCCT GCATTATCCA CCATATACGC ATCGATTCCG CGCGATGCCG

351  CCACTTCGCG CAAGCGGTTG CTGTTGGACG AATTGGGCGA ACCGACCACA

401  ATCACGATGT CGCACTGTTC TGCCAACTCT TTGACGGCGG TTTGCCGGTT

451  GGTCGTCGCA TAGCAGATAT CTTCCTTGTG CGGATTGCGG ATATTGGGGA

501  AACGCGCGTT CAGCGCGGCG ATGATGTCTT TGGTTTCATC GACCGAGAGC

551  GTGGTTTGGC TGACATAGGC GAGTTTGTCG GGGTTTCTGA CTTCGAGTTT

601  TGCCACATCT CCGACCGTTT CGACCAAAAG CATTTTGCCC GGCGCAAGCT

651  GCCCCATCGT TCCTTCGACC TCGACGTGCC CCTTATGCCC GATCATGATG

701  ATTTCACAGT CTTGGGCATC CAGTCGGGCG ACTTCCTTAT GCACTTTCGT

751  CACCAGCGGG CAAGTCGCAT CAAACACGCG GAAACCGCgC TCCGCCGCTT

801  CTTGCCGCAC CGCCTTCGAT ACGCCGTGTG CCGAATAAAC CAGTGTCGCG

851  CCCGGCGGCA CTTCCGCCAA GTCTTCAATA AACACCGCAC CTTTTTCACG

901  CAGGTTGTCC ACGACGAATT TGTTGTGAAC GACTTCGTGG CGCACATAAA

951  TCGGCGCGCC GAACTCTTCC AAAGCACGTT CGACAATACT GATT GCCCGA

1001  TCCACACCAG CGCAGAAGCC GCGCGGATTG GCAAGGATGA TGGTTTTCTC

1051  GTTCATAAGC CCGGTATTTC GTTTTCAGAC GGCATCAATA TTTTTCTTCT

1101  TGGGTTTTAC GGTGGACGAT GTTGTCCAAC ACCGCCAACA CCGCACCGAC

1151  GCAGATAA
```

This corresponds to the amino acid sequence <SEQ ID 2318; ORF 694>:

```
m694.pep
    1  LVSASGTRQK CRLKPVQTAF VLPKHSTPAS TFAQIGFGFA LAAQLFGQDE

51  HNAFFRTLAF AYGFVPPSAY GCQYFPHQHF GRGRACRYAD FVFALKPCAL

101  QVACIIHHIR IDSARCRHFA QAVAVGRIGR TDHNHDVALF CQLFDGGLPV

151  GRRIADIFLV RIADIGETRV QRGDDVFGFI DRERGLADIG EFVGVSDFEF

201  CHISDRFDQK HFARRKLPHR SFDLDVPLMP DHDDFTVLGI QSGDFLMHFR

251  HQRASRIKHA ETALRRFLPH RLRYAVCRIN QCRARRHFRQ VFNKHRTFFT

301  QVVHDEFVVN DFVAHINRRA ELFQSTFDNT DCPIHTSAEA ARIGKDDGFL

351  VHKPGISFSD GINIFLLGFY GGRCCPTPPT PHRRR*
```

Computer analysis of this amino acid sequence gave the following results:
Homology with a Predicted ORF from *N. gonorrhoeae*
ORF 694 shows 86.8% identity over a 372 aa overlap with a predicted ORF (ORF 694) from *N. gonorrhoeae*:
m694/g694 86.8% identity in 372 aa overlap

```
                 10        20        30        40        50
m694.pep   LVSASGTRQKCRLKPVQTAFVLPKHS----TPASTFAQIGFGFALAAQLFGQDEHNAFFR
           :||||||           ||||||||:||||||||||||||||||:||||:||||
g694             SAFVLPKHPMPALTPASTFAQIGFGFALAAQLLGQDEHDAFFR
                       10        20        30        40
```

-continued

```
                60        70        80        90       100       110
m694.pep  TLAFAYGFVPPSAYHCQYFPHQHFGRGRACRYADFVFALKPCALQVACIIHHIRIDSARC
          :  ||:||:||||||||||||||||||||||||||:||:|| ||||: ::||||||||||
g694      APPFAHGFMPPSAYHCQYFPHQHFGRGRACRYADFAFAFKPRALQVGVRRHHIRIDSARC
                  50        60        70        80        90       100

120       130       140       150       160       170
m694.pep  RHFAQAVAVGRIGRTDHNHDVALFCQLFDGGLPVGRRIADIFLVRIADIGETRVQRGDDV
          |||||||||||||||||||||||| |||||||||||||||:|||||||||||||||||||
g694      RHFAQAVAVGRIGRTDHNHDVALFRQLFDGGLPVGRRIADVFLVRIADIGETRVQRGDDV
                 110       120       130       140       150       160

180       190       200       210       220       230
m694.pep  FGFIDRERGLADIGEFVGVSDFEFCHISDRFDQKHFARRKLPHRSFDLDVPLMPDHDDFT
          |||||||||||||||||||||||||||||||||||||| |||||:||| |||||||||||
g694      FGFIDRERGLADIGEFVGVSDFEFCHISDRFDQKHFARCKLPHRAFDLGVPLMPDHDDFT
                 170       180       190       200       210       220

240       250       260       270       280       290
m694.pep  VLGIQSGDFLMHFRHQRASRIKHAETALRRFLPHRLYAVCRINQCRARRHFRQVFNKHR
          ||||||||||||||||||||||: |||||||| |||||||||||||||||||||||:|||
g694      VLGIQSGDFLMHFRHQRASRIKYPETALRRFLLHRLYAVCRINQCRARRHFRQVFDKHR
                 230       240       250       260       270       280

300       310       320       330       340       350
m694.pep  TFFTQVVHDEFVVNDFVAHINRRAELFQSTFDNTDCPIHTSAEAARIGKDDGFLVHKPGI
          :||:|||||||||:|||||||||||:||||||||||||||:|||||||||||| |||  |
g694      AFFAQVVHDEFVVDDFVAHINRRAEFFQSTFDNTDCPIHTGAEAARIGKDDGFSVHKFCI
                 290       300       310       320       330       340

360       370       380
m694.pep  SFSDGINIFLLGFYGGRCCPTPPTPHRRRX
            ||||::||  :  || | :|||||||||
g694      PCSDGIHVFLXXLCDGRYCQAPPTPHRRRX
                 350       360       370
```

The following partial DNA sequence was identified in *N. meningitidis* <SEQ ID 2319>:

```
a694.seq
     1  TTGGTTTCCG CATCCGGCAC ACGGCAAAAA TGCCGTCTGA AGCCTGTTCA

51  GACGGCATTT GTGTTGCCCA AACATTCAAC GCCTGCGTCA ACGTTTGCAC

101  AAATCGGGTT TGGTTTCGCC CTCGCGGCGC AACTCTTTGG GCAGGACGAA

151  CACAATGCTT TCTTCCGCAC CCTCGCCTTC GCGTACGGTT TCGTGCCCCC

201  ATCCGCGTAT GGTTGCCAGT ACTTCCCGCA CCAACACTTC GGGCGCGGAC

251  GCGCCTGCCG TTACGCCGAC TTTGTTTTTG CCCTCAAACC ATGCGCGTTG

301  CAGGTAGCCT GCATTATCCA CCATATACGC ATCGATTCCG CGCGATGCCG

351  CCACTTCGCG CAAGCGGTTG CTGTTGGACG AATTGGGCGA ACCGACCACA

401  ATCACGATGT CGCACTGTTC TGCCAACTCT TTGACGGCGG TTTGCCGGTT

451  GGTCGTCGCA TAGCAGATAT CTTCCTTGTG CGGATTGCGG ATATTGGGGA

501  AACGCGCGTT CAGCGCGGCG ATGATGTCTT TGGTTTCATC GACCGAGAGC

551  GTGGTTTGGC TGACATAGGC GAGTTTGTCG GGGTTTCTGA CTTCGAGTTT

601  TGCCACATCT CCGACCGTTT CGACCAAAAG CATTTTGCCC GGCGCAAGCT

651  GCCCCATCGT TCCTTCGACC TCGACGTGCC CCTTATGCCC GATCATGATG

701  ATTTCACAGT CTTGGGCATC CAGTCGGGCG ACTTCCTTAT GCACTTTCGT

751  CACCAGCGGG CAAGTCGCAT CAAACACGCG GAAACCGCGC TCCGCCGCTT

801  CTTGCCGCAC CGCCTTCGAT ACGCCGTGTG CCGAATAAAC CAGTGTCGCG

851  CCCGGCGGCA CTTCCGCCAA GTCTTCAATA AACACCGCAC CTTTTTCACG

901  CAGGTTGTCC ACGACGAATT TGTTGTGAAC GACTTCGTGG CGCACATAAA

951  TCGGCGCGCC GAACTCTTCC AAAGCACGTT CGACAATACT GATTGCCCGA

1001  TCCACACCAG CGCAGAAGCC GCGCGGATTG GCAAGGATGA TGGTTTTCTC
```

```
                  -continued
1051    GTTCATAAGC CCGGTATTTC GTTTTCAGAC GGCATCAATA TTTTTCTTCT

1101    TGGGTTTTAC GGTGGACGAT GTTGTCCAAC ACCGCCAACA CCGCACCGAC

1151    GCAGATAA
```

This corresponds to the amino acid sequence <SEQ ID 2320; ORF 694.a>:

```
a694.pep
   1    LVSASGTRQK CRLKPVQTAF VLPKHSTPAS TFAQIGFGFA LAAQLFGQDE

51    HNAFFRTLAF AYGFVPPSAY GCQYFPHQHF GRGRACRYAD FVFALKPCAL

101    QVACIIHHIR IDSARCRHFA QAVAVGRIGR TDHNHDVALF CQLFDGGLPV

151    GRRIADIFLV RIADIGETRV QRGDDVFGFI DRERGLADIG EFVGVSDFEF

201    CHISDRFDQK HFARRKLPHR SFDLDVPLMP DHDDFTVLGI QSGDFLMHFR

251    HQRASRIKHA ETALRRFLPH RLRYAVCRIN QCRARRHFRQ VFNKHRTFFT

301    QVVHDEFVVN DFVAHINRRA ELFQSTFDNT DCPIHTSAEA ARIGKDDGFL

351    VHKPGISFSD GINIFLLGFY GGRCCPTPPT PHRRR*
```

Computer analysis of this amino acid sequence gave the following results:
Homology with a Predicted ORF from *N. meningitidis*
ORF 694 shows 100% identity over a 385 aa overlap with a predicted ORF (ORF 694) from *N. meningitidis*:
m694/a694 100.0% identity in 385 aa overlap

```
                  10         20         30         40         50         60
  m694.pep  LVSASGTRQKCRLKPVQTAFVLPKHSTPASTFAQIGFGFALAAQLFGQDEHNAFFRTLAF
            ||||||||||||||||||||||||||||||||||||||||||||||||||||||||||||
  a694      LVSASGTRQKCRLKPVQTAFVLPKHSTPASTFAQIGFGFALAAQLFGQDEHNAFFRTLAF
                  10         20         30         40         50         60

70         80         90        100        110        120
  m694.pep  AYGFVPPSAYGCQYFPHQHFGRGRACRYADFVFALKPCALQVACIIHHIRIDSARCRHFA
            ||||||||||||||||||||||||||||||||||||||||||||||||||||||||||||
  a694      AYGFVPPSAYGCQYFPHQHFGRGRACRYADFVFALKPCALQVACIIHHIRIDSARCRHFA
                  70         80         90        100        110        120

130        140        150        160        170        180
  m694.pep  QAVAVGRIGRTDHNHDVALFCQLFDGGLPVGRRIADIFLVRIADIGETRVQRGDDVFGFI
            ||||||||||||||||||||||||||||||||||||||||||||||||||||||||||||
  a694      QAVAVGRIGRTDHNHDVALFCQLFDGGLPVGRRIADIFLVRIADIGETRVQRGDDVFGFI
                 130        140        150        160        170        180

190        200        210        220        230        240
  m694.pep  DRERGLADIGEFVGVSDFEFCHISDRFDQKHFARRKLPHRSFDLDVPLMPDHDDFTVLGI
            ||||||||||||||||||||||||||||||||||||||||||||||||||||||||||||
  a694      DRERGLADIGEFVGVSDFEFCHISDRFDQKHFARRKLPHRSFDLDVPLMPDHDDFTVLGI
                 190        200        210        220        230        240

250        260        270        280        290        300
  m694.pep  QSGDFLMHFRHQRASRIKHAETALRRFLPHRLRYAVCRINQCRARRHFRQVFNKHRTFFT
            ||||||||||||||||||||||||||||||||||||||||||||||||||||||||||||
  a694      QSGDFLMHFRHQRASRIKHAETALRRFLPHRLRYAVCRINQCRARRHFRQVFNKHRTFFT
                 250        260        270        280        290        300

310        320        330        340        350        360
  m694.pep  QVVHDEFVVNDFVAHINRRAELFQSTFDNTDCPIHTSAEAARIGKDDGFLVHKPGISFSD
            ||||||||||||||||||||||||||||||||||||||||||||||||||||||||||||
  a694      QVVHDEFVVNDFVAHINRRAELFQSTFDNTDCPIHTSAEAARIGKDDGFLVHKPGISFSD
                 310        320        330        340        350        360

370        380
  m694.pep  GINIFLLGFYGGRCCPTPPTPHRRX
            |||||||||||||||||||||||||
  a694      GINIFLLGFYGGRCCPTPPTPHRRX
                 370        380
```

The following partial DNA sequence was identified in *N. gonorrhoeae* <SEQ ID 2321>:

```
g695.seq
     1   TTGCCTCAAA CTCGTCCGGC AAGGCGGCAT CATCGCCATC GACAATATTT

51   TGTTGAACGG AAGGGTGATG CGCGAAGCGG CTTTTGATGC GCCGCCCAGT

101   GTCAAAATTC TCAAAGATTT CAATCAAAAC CTGCCGAACG ATACGCGGAT

151   TGTCCCCATC ACCCTGCCCG TCGGCGACGG TTTGACCCTG CTTCTGAAAA

201   AATAATGAAG ACCAAATTAC CGCTTTTTAT CATTTGGCTG TCTGTGTCTG

251   CCTCCTGTGC TTCCGTTTTA CCCGTTCCGG AGGGCAGCCG AACCGAAATG

301   CCGACACAGG AAAATGCTTC AGACGGCATT CCCTATCCCG TTCCCACTCT

351   GCAAGACCGT TTGGACTATC TGGAAGGCAA AATCGTCCGG CTGTCGAACG

401   AAGTGGAAAT GTTAAACGGG AAAGTCAAAG CATTGGAGCA TACGAAAATA

451   CACCCTTCCG GCAGGACATA CGTCCAAAAA CTCGACGACC GCAAATTGAA

501   AGAGCATTAC CTCAATACCG AAGGCGGCAG CGCATCCGCA CATACCGTCG

551   AAACCGCACA AAACCTCTAC AATCAGGCAC TCAAACACTA TCAAAACGGC

601   AGGTTTTCTG CCGCAGCCGC CTTGTTGAAG GGGGCGGACG GCGGAGACGG

651   CGGCAGCATC GCGCAACGCA GTATGTACCT GTTGCTGCAA AGCAGGGCGC

701   GTATGGGGAA CTGTGAATCT GTCATCGAAA TCGGAGGGCG TTACGCCAAC

751   CGTTTCAAAG ACAGCCCAAC CGCGCCCGAA GTCATATTCA AAATCGGCGA

801   ATGCCAATAC AGGCTTCAGC AAAAAGACAT TGCAAGGGCG ACTTGGCGCA

851   GCCTGATACA GACCTATCCC GGCAGCCCGG CGGCAAAACG CGCCGCCGCA

901   GCCGTACGCA AACGATAG
```

This corresponds to the amino acid sequence <SEQ ID 2322; ORF 695>:

```
g695.pep
     1   LPQTRPARRH HRHRQYFVER KGDARSGF*C AAQCQNSQRF QSKPAERYAD

51   CPHHPARRRR FDPASEKIMK TKLPLFIIWL SVSASCASVL PVPEGSRTEM

101   PTQENASDGI PYPVPTLQDR LDYLEGKIVR LSNEVEMLNG KVKALEHTKI

151   HPSGRTYVQK LDDRKLKEHY LNTEGGSASA HTVETAQNLY NQALKHYQNG

201   RFSAAAALLK GADGGDGGSI AQRSMYLLLQ SRARMGNCES VIEIGGRYAN

251   RFKDSPTAPE VIFKIGECQY RLQQKDIARA TWRSLIQTYP GSPAAKRAAA

301   AVRKR*
```

The following partial DNA sequence was identified in *N. meningitidis* <SEQ ID 2323>:

```
m695.seq
     1   TTGCCTCAAA CTCGTCCGTC AAGGCGGCAT CATCGCCATC GACAATATTT

51   TGCTGAACGG AAGGGTGATG CGCGAAGCGG CTTCCGATGC GCCGCCCAGC

101   GTCGGCATCC TCAAAGATTT CAATCAAAAC CTGCCGAACG ACCCGCGCAT

151   CGTCCCCATC ACCCTGCCCG TCGGCGACGG CTTGACCCTG CTTCTGAAAA

201   AATAATGAAG ATCAAATTAC CGCTTTTTAT CATTTGGCTG TCTGTGTCCG

251   CCTCCTGTGC TTCCGTTTCA CCCGTTCCGG CAGGCAGCCA AACCGAAATG

301   TCGACACGGG AAAATGCTTC AGACGGCATT CCCTATCCCG TTCCGACCTT

351   GCAAGACCGT TTGGACTATC TGGAAGGCAA AATCGTCCGG CTGTCGAACG
```

-continued

```
401  AAGTGGAAAC CTTAAACGGC AAAGTCAAAG CACTGGAACA CGCAAAAACA

451  CATTCTTCCG GCAGGGCATA CGTCCAAAAA CTCGACGACC GCAAGTTGAA

501  AGAGCATTAC CTCAATACCG AAGGCGGCAG CGCATCCGCA CATACTGTCG

551  AAACCGCACA AAACCTCTAC AATCAGGCAC TCAAACACTA TAAAAGCGGC

601  AAGTTTTCTG CCGCTGCCTC CCTGTTGAAA GGCGCGGACG GAGGCGACGG

651  CGGCAGCATC GCGCAACGCA GTATGTACCT GTTGCTGCAA AGCAGGGCGC

701  GTATGGGCAA CTGCGAATCC GTCATCGAAA TCGGAGGGCG TTACGCCAAC

751  CGTTTCAAAG ACAGCCCAAC CGCGCCTGAA GCCATGTTCA AAATCGGCGA

801  ATGCCAATAC AGGCTTCAGC AAAAAGACAT TGCAAGGGCG ACTTGGCGCA

851  GCCTGATACA GACCTATCCC GGCAGCCCGG CGGCAAAACG CGCCGCCGCA

901  GCCGTGCGCA AACGATAG
```

This corresponds to the amino acid sequence <SEQ ID 2324; ORF 695>:

```
m695.pep
  1  LPQTRPSRRH HRHRQYFAER KGDARSGFRC AAQRRHPQRF QSKPAERPAH

51  RPHHPARRRR LDPASEKIMK IKLPLFIIWL SVSASCASVS PVPAGSQTEM

101  STRENASDGI PYPVPTLQDR LDYLEGKIVR LSNEVETLNG KVKALEHAKT

151  HSSGRAYVQK LDDRKLKEHY LNTEGGSASA HTVETAQNLY NQALKHYKSG

201  KFSAAASLLK GADGGDGGSI AQRSMYLLLQ SRARMGNCES VIEIGGRYAN

251  RFKDSPTAPE AMFKIGECQY RLQQKDIARA TWRSLIQTYP GSPAAKRAAA

301  AVRKR*
```

Computer analysis of this amino acid sequence gave the following results:
Homology with a Predicted ORF from *N. gonorrhoeae*
ORF 694 shows 90.8% identity over a 305 aa overlap with a predicted ORF (ORF 695) from *N. gonorrhoeae*:
m695/g695 90.8% identity in 305 aa overlap

```
                  10         20         30         40         50         60
m695.pep  LPQTRPSRRHHRHRQYFAERKGDARSGFRCAAQRRHPQRFQSKPAERPAHRPHHPARRRR
          ||||||:|||||||||||:||||||||||| ||||  :: ||||||||||| ||||||||
g695      LPQTRPARRHHRHRQYFVERKGDARSGFXCAAQCQNSQRFQSKPAERYADCPHHPARRRR
                  10         20         30         40         50         60

70         80         90        100        110        120
m695.pep  LDPASEKIMKIKLPLFIIWLSVSASCASVSPVPAGSQTEMSTRENASDGIPYPVPTLQDR
          :|||||||||| ||||||||||||||||| ||| ||:||| :||||||||||||||||||
g695      FDPASEKIMKTKLPLFIIWLSVSASCASVLPVPEGSRTEMPTQENASDGIPYPVPTLQDR
                  70         80         90        100        110        120

130        140        150        160        170        180
m695.pep  LDYLEGKIVRLSNEVETLNGKVKALEHAKTHSSGRAYVQKLDDRKLKEHYLNTEGGSASA
          |||||||||||||||| ||||||||| ||:| ||| |||||||||||||||||||||||
g695      LDYLEGKIVRLSNEVEMLNGKVKALEHTKIHPSGRTYVQKLDDRKLKEHYLNTEGGSASA
                 130        140        150        160        170        180

190        200        210        220        230        240
m695.pep  HTVETAQNLYNQALKHYKSGKFSAAASLLKGADGGDGGSIAQRSMYLLLQSRARMGNCES
          ||||||||||||||||| ::|:||||  ||||||||||||||||||||||||||||||||
g695      HTVETAQNLYNQALKHYQNGRFSAAAALLKGADGGDGGSIAQRSMYLLLQSRARMGNCES
                 190        200        210        220        230        240

250        260        270        280        290        300
m695.pep  VIEIGGRYANRFKDSPTAPEAMFKIGECQYRLQQKDIARATWRSLIQTYPGSPAAKRAAA
          |||||||||||||||||||| ::|||||||||||||||||||||||||||||||||||||
g695      VIEIGGRYANRFKDSPTAPEVIFKIGECQYRLQQKDIARATWRSLIQTYPGSPAAKRAAA
                 250        260        270        280        290        300
```

```
m695.pep   AVRKRX
           ||||||
g695       AVRKRX
```

The following partial DNA sequence was identified in *N. meningitidis* <SEQ ID 2325>:

```
a695.seq
    1   TTGCCTCAAG CTTGTCCGGC AAGGCGGCAT CATTGCCATC GACAATATTT

51   TGTTGAACGG AAGGGTGATG CGCGAAGCGG CTTCCGATGC GCCGCCCAGC

101   GTCGGCATCC TCAAAGATTT TAATCAAAAC CTGCCGAACG ATACGCGGAT

151   TGTCCCCATC ACCCTGCCCG TCGGCGACGG TTTGACCCTG CTTCTGAAAA

201   AATAATGAAG ACCAAATTAC CGCTTTTTAT CATTTGGCTG TCCGTATCCG

251   CCGCCTGTTC TTCCCCTGTT TCCCGCAATA TTCAGGATAT GCGGCTCGAA

301   CCGCAGGCAG AGGCAGGTAG TTCGGACGCT ATTCCCTATC CCGTTCCCAC

351   TCTGCAAGAC CGTTTGGATT ATCTGGAAGG CACACTCGTC CGCCTGTCGA

401   ACGAAGTGGA AACCTTAAAC GGCAAAGTCA AGCACTGGA GCATGCGAAA

451   ACACACCCTT CCAGCAGGGC ATACGTCCAA AAACTCGACG ACCGCAAGTT

501   GAAAGAGCAT TACCTCAATA CCGAAGGCGG CAGCGCATCC GCACATACCG

551   TCGAAACCGC ACAAAACCTC TACAATCAGG CACTCAAACA CTATAAAAGC

601   GGCAGGTTTT CTGCCGCTGC CTCCCTGTTG AAAGGCGCGG ACGGAGGCGA

651   CGGCGGCAGC ATCGCGCAAC GCAGTATGTA CCTGTTGCTG CAAAGCAGGG

701   CGCGTATGGG CAACTGCGAA TCCGTCATCG AAATCGGAGG GCGTTACGCC

751   AACCGTTTCA AGACAGCCC AACCGCGCCT GAAGCCATGT TCAAAATCGG

801   CGAATGCCAA TACAGGCTTC AGCAAAAAGA CATTGCAAGG GCGACTTGGC

851   GCAGCCTGAT ACAGACCTAT CCCGGCAGCC CGGCGGCAAA ACGCGCCGCC

901   GCAGCCGTGC GCAAACGATA G
```

This corresponds to the amino acid sequence <SEQ ID 2326; ORF 695.a>:

```
a695.pep
    1   LPQACPARRH HCHRQYFVER KGDARSGFRC AAQRRHPQRF *SKPAERYAD

51   CPHHPARRRR FDPASEKIMK TKLPLFIIWL SVSAACSSPV SRNIQDMRLE

101   PQAEAGSSDA IPYPVPTLQD RLDYLEGTLV RLSNEVETLN GKVKALEHAK

151   THPSSRAYVQ KLDDRKLKEH YLNTEGGSAS AHTVETAQNL YNQALKHYKS

201   GRFSAAASLL KGADGDGGS IAQRSMYLLL QSRARMGNCE SVIEIGGRYA

251   NRFKDSPTAP EAMFKIGECQ YRLQQKDIAR ATWRSLIQTY PGSPAAKRAA

301   AAVRKR*
```

Computer analysis of this amino acid sequence gave the following results:
Homology with a Predicted ORF from *N. meningitidis*
ORF 695 shows 88.3% identity over a 308 aa overlap with a predicted ORF (ORF 695) from *N. meningitidis*:
m695/a695 88.3% identity in 308 aa overlap

```
                    10        20        30        40        50        60
m695.pep    LPQTRPSRRHHRHRQYFAERKGDARSGFRCAAQRRHPQRFQSKPAERPAHRPHHPARRRR
            ||| : |:|||| |||||:||||||||||||||||||||| |||||| | ||||||||||
a695        LPQACPARRHHCHRQYFVERKGDARSGFRCAAQRRHPQRFXSKPAERYADCPHHPARRRR
                    10        20        30        40        50        60

70        80        90       100       110
m695.pep    LDPASEKIMKIKLPLFIIWLSVSASCASVSPVPAGSQT---EMSTRENACDGIPYPVPTL
            :|||||||| ||||||||||||||||:|:| ||  : |    | ::: ::||:|||||||
a695        FDPASEKIMKTKLPLFIIWLSVSAACSS--PVSRNIQDMRLEPQAEAGSSDAIPYPVPTL
                    70        80        90       100       110

120       130       140       150       160       170
m695.pep    QDRLDYLEGKIVRLSNEVETLNGKVKALEHAKTHSSGRAYVQKLDDRKLKEHYLNTEGGS
            |||||||| :|||||||||||||||||||||||:|| ||||||| |||||||||||||||
a695        QDRLDYLEGTLVRLSNEVETLNGKVKALEHAKTHPSSRAYVQKLDCRKLKEHYLNTEGGS
                   120       130       140       150       160       170

180       190       200       210       220       230
m695.pep    ASAHTVETAQNLYNQALKHYKSGKFSAAASLLKGADGGDGGSIAQRSMYLLLQSRARMGN
            ||||||||||||||||||||||||:||||||||||||||||||||||||||||||||||
a695        ASAHTVETAQNLYNQALKHYKSGRFSAAASLLKGADGGDGGSIAQRSMYLLLQSRARMGN
                   180       190       200       210       220       230

240       250       260       270       280       290
m695.pep    CESVIEIGGRYANRFKDSPTAPEAMFKIGECQYRLQQKDIARATWRSLIQTYPGSPAAKR
            ||||||||||||||||||||||||||||||||||||||||||||||||||||||||||||
a695        CESVIEIGGRYANRFKDSPTAPEAMFKIGECQYRLQQKDIARATWRSLIQTYPGSPAAKR
                   240       250       260       270       280       290

300
m695.pep    AAAAVRKRX
            |||||||||
a695        AAAAVRKRX
                   300
```

The following partial DNA sequence was identified in *N. gonorrhoeae*
g696.seq: not found
This corresponds to the amino acid sequence <ORF 696.ng>:
g696.pep: not found
The following partial DNA sequence was identified in *N. meningitidis* <SEQ ID 2327>:

```
m696.seq
     1  TTGGGTTGCC GGCAGGCGGC ATCCCATCAT TTTTGCCAAG GCAACAAATT

51  ATTTGGCGGC ATCTTTCATT TTGTCTGCCG CTTCCTGAGT CGCGTCGGCA

101  GCTTTGTTCA AAGTATCTTT AGCTGCTTCA GTTACAGCTT CTTTGGCTTC

151  AGTTACAGCT TCCTCGGCAC TTGCCTTTGC ATCAGCCGCA GCATCTTTGA

201  CTTGGTCTTT CGCTTCTTCG ACGGCAGAAG CGGCAGACTC GGCGGCAGAA

251  GCCGCAGTGT CTTTAACATC GGACTCAACG GCTTGAACCG CTTCCTTAAC

301  CTCCTGTTTG GCTTCTTGCG AACAAGCTGC CAAGGCAGCC GCCATCATTG

351  CGGCAATCAA TAA
```

This corresponds to the amino acid sequence <SEQ ID 2328; ORF 696>:

```
m696.pep
     1  LGCRQAASHH FCQGNKLFGG IFHFVCRFLS RVGSFVQSIF SCFSYSFFGF

51  SYSFLGTCLC ISRSIFDLVF RFFDGRSGRL GGRSRSVFNI GLNGLNRFLN

101  LLFGFLRTSC QGSRHHCGNQ *
```

The following partial DNA sequence was identified in *N. meningitidis* <SEQ ID 2329>:

```
a696.seq
     1   TTGGGTTGCC GGCAGGCGGC ATCCCATCAT TTTTGCCAAG GCAACAAATT

51   ATTTGGCGGC ATCTTTCATT TTGTCTGCCG CTTCCTGAGT CGCGTCGGCA

101   GCTTTGTTCA AAGTATCTTT AGCTGCTTCA GTTACAGCTT CTTTGGCTTC

151   AGTTACAGCT TCCTCGGCAC TTGCCTTTGC ATCAGCCGCA GCATCTTTGA

201   CTTGGTCTTT CGCTTCTTCG ACGGCAGAAG CGGCAGACTC GGCGGCAGAA

251   GCCGCAGTGT CTTTAACATC GGACTCAACG GCTTGAACCG CTTCCTTAAC

301   CTCCTGTTTG GCTTCTTGCG AACAAGCTGC CAAGGCAGCC GCCATCATTG

351   CGGCAATCAA TAA
```

This corresponds to the amino acid sequence <SEQ ID 2330; ORF 696.a>:

```
a696.pep
     1   LGCRQAASHH FCQGNKLFGG IFHFVCRFLS RVGSFVQSIF SCFSYSFFGF

51   SYSFLGTCLC ISRSIFDLVF RFFDGRSGRL GGRSRSVFNI GLNGLNRFLN

101   LLFGFLRTSC QGSRHHCGNQ *
```

Computer analysis of this amino acid sequence gave the following results:
Homology with a Predicted ORF from *N. meningitidis*
ORF 696 shows 100.0% identity over a 120 aa overlap with a predicted ORF (ORF 696) from *N. meningitidis*:
m696/a696 100.0% identity in 120 aa overlap

```
                    10         20         30         40         50         60
    m696.pep  LGCRQAASHHFCQGNKLFGGIFHFVCRFLSRVGSFVQSIFSCFSYSFFGFSYSFLGTCLC
              ||||||||||||||||||||||||||||||||||||||||||||||||||||||||||||
    a696      LGCRQAASHHFCQGNKLFGGIFHFVCRFLSRVGSFVQSIFSCFSYSFFGFSYSFLGTCLC
                    10         20         30         40         50         60

70         80         90        100        110        120
    m696.pep  ISRSIFDLVFRFFDGRSGRLGGRSRSVFNIGLNGLNRFLNLLFGFLRTSCQGSRHHCGNQ
              ||||||||||||||||||||||||||||||||||||||||||||||||||||||||||||
    a696      ISRSIFDLVFRFFDGRSGRLGGRSRSVFNIGLNGLNRFLNLLFGFLRTSCQGSRHHCGNQ
                    70         80         90        100        110        120 m696.pep  X
              |
    a696      X
```

The following partial DNA sequence was identified in *N. gonorrhoeae* <SEQ ID 2331>:

```
g700.seq
     1   ATGAGCAGCC TGATGACGTT GTTTTCGGTA TTGGTACCGA TGTTTGCCGG

51   ATTTTTTATC CGTGTTCCCA AGCCTTACCT GCCCGCTTCG GACAAGGTGC

101   TGTCGGTTTT GGTGTATGCC GTGCTGCTGC TGATCGGCGT ATCGTTGTCG

151   CGCGTGGAGG ATTTGGGTTC GCGGTTGGGC GATATGGCGT TGACGGTTCT

201   GTGGCTGTTT GTTTGTACGG TAGGGGCGAA CCTGCTTGCC TTGGCAGTGT

251   TGGGAAAGTT GTCCCCGTGG CGGATAGGGG AAAAGGGAA GGGCGTTTCG

301   GTCGGCGTGT CGGGCAGTGT GAGGCAGCTC GGATGCGTAC TGCTCGGTTT

351   TGTGTCCGGC AAATTGATGT GCGATATTTG GATGCCGTCT GAAAACGCGG
```

```
-continued
401  GTATGTACTG CCTGATGCTG CTGGTGTTCC TCATCGGCGT ACAGCTCAAA

451  AGTAGCGGCG TATCGTTGCG GCAGGTTTTG CTTAACCGGC GGGGCATCCG

501  GCTGTCGGTT TGGTTTATAT TGTCATCTCT TTCAGGCGGG CTGCTGTTTG

551  CCGCATCGGC AGATGGTGTG TCGTGGACGA AAGGTTTGGC GATGGCTTCC

601  GGCTTCGGTT GGTATTCCCT CTCGGGTTTG GTAATGACCG AGGCTTACGG

651  GGCGGTATGG GGCAGCATCA TGCTGCTGAA CGATTTGGCA CGAGAGCTGT

701  TTGCACTGGC ATTTATTCCG CTGCTGATGA AGCGTTTTCC GGATGCGGCG

751  GTGGGGGTCG GCGGCGCGAC CAGTATGGAT TTCACATTGC CCGTAATTCA

801  GGGTGCGGGC GGTTTGGAAG TCGTGCCGGT AGCGGTCAGC TTCGGCGTGG

851  TGGTCAATAT CGCCGCCCCG TTTCTGATGG TGGTGTTTTC CACGCTGGGC

901  TGA
```

This corresponds to the amino acid sequence <SEQ ID 2332; ORF 700>:

```
g700.pep
  1  MSSLMTLFSV LVPMFAGFFI RVPKPYLPAS DKVLSVLVYA VLLLIGVSLS

51  RVEDLGSRLG DMALTVLWLF VCTVGANLLA LAVLGKLSPW RIGGKGKGVS

101  VGVSGSVRQL GCVLLGFVSG KLMCDIWMPS ENAGMYCLML LVFLIGVQLK

151  SSGVSLRQVL LNRRGIRLSV WFILSSLSGG LLFAASADGV SWTKGLAMAS

201  GFGWYSLSGL VMTEAYGAVW GSIMLLNDLA RELFALAFIP LLMKRFPDAA

251  VGVGGATSMD FTLPVIQGAG GLEVVPVAVS FGVVVNIAAP FLMVVFSTLG

301  *
```

The following partial DNA sequence was identified in *N. meningitidis* <SEQ ID 2333>:

```
m700.seq
  1  ATGGACAGCC TGATGACGTT GCTTTCGGTA TTGATACCGA TGTTTGCCGG

51  ATTTTTTATC CGTGTGCCCA AGCCTTACCT GCCCGCTTTG GATAAGGTGC

101  TATCGGTCTT GGTGTATGCT GTGCTGCTGC TGATCGGCGT CTCGTTGTCG

151  CGCGTGGAGG ATTTGGGTTC GCGGTTGGAC GATATGGCGT TGACGGTTCT

201  GTGGCTGTTT GTTTGTACGG TCGGGGCGAA CCTGCTTGCT TTGGCAGTGT

251  TGGGAAAGTT ATTCCCGTGG CGGATAAAGG GGAAAGGGAA GGGCGTTTCG

301  GTCGGCGTGT CGGGCAGTGT GGGGCAGCTC GGATGCGTGC TGCTCGGATT

351  TGCATTCGGC AAACTGATGC GCGATATTTG GATGCCGTCT GAAAGCGCGG

401  GCATGTATTG TCTGATGCTG CTGGTGTTCC TCATCGGCGT ACAGCTCAAA

451  AGCAGCGGCG TATCGTTGCG GCAGGTTTTG GTCAACCGCA GGGGTATTCG

501  GTTGTCGGTC TGGTTTATGC TTTCATCTCT TTCGGGCGGG CTGCTGTTTG

551  CCGCATCGAC AGACGGTGTG TCGTGGACGA AAGGTTTGGC GATGGCTTCC

601  GGCTTCGGTT GGTATTCCCT CTCGGGTTTG GTCATGACCG AGGCTTACGG

651  CGCGGTATGG GGCAGCATCA TGCTGCTGAA CGATTTGGCA CGAGAGCTGT

701  TTGCACTGGC ATTTATCCCG CTGCTGATGA AGCGTTTTCC AGATGCGGCG

751  GTGGGGGTTG GCGGTGCGAC CAGTATGGAT TTTACATTGC CCGTGATTCA
```

```
-continued
801  GGGTGCGGGC GGTTTGGAAG TCGTGCCGGT AGCGGTCAGC TTCGGCGTGG

851  TGGTCAATAT CGCCGCCCCG TTTCTGATGG TGGTGTTTTC CGCTTTGGGT

901  TGA
```

This corresponds to the amino acid sequence <SEQ ID 2334; ORF 700>:

```
m700.pep
  1    MDSLMTLLSV LIPMFAGFFI RVPKPYLPAL DKVLSVLVYA VLLLIGVSLS

51    RVEDLGSRLD DMALTVLWLF VCTVGANLLA LAVLGKLFPW RIKGKGKGVS

101    VGVSGSVGQL GCVLLGFAFG KLMRDIWMPS ESAGMYCLML LVFLIGVQLK

151    SSGVSLRQVL VNRRGIRLSV WFMLSSLSGG LLFAASTDGV SWTKGLAMAS

201    GFGWYSLSGL VMTEAYGAVW GSIMLLNDLA RELFALAFIP LLMKRFPDAA

251    VGVGGATSMD FTLPVIQGAG GLEVVPVAVS FGVVVNIAAP FLMVVFSALG

301    *
```

Computer analysis of the amino acid sequences gave the following results:
Homology with a Predicted ORF from *N. meningitidis* menA with menB
ORF 700 shows 94.7% identity over a 300 aa overlap with a predicted ORF (ORF700.ng) from *N. gonorrhoeae*:

```
m700/g700
                    10         20         30         40         50         60
    m700.pep  MDSLMTLLSVLIPMFAGFFIRVPKPYLPALDKVLSVLVYAVLLLIGVSLSRVEDLGSRLD
              |:||||:|||:||||||||||||||||||| ||||||||||||||||||||||||||||
    g700      MSSLMTLFSVLVPMFAGFFIRVPKPYLPASDKVLSVLVYAVLLLIGVSLSRVEDLGSRLG
                    10         20         30         40         50         60

70         80         90        100        110        120
    m700.pep  DMALTVLWLFVCTVGANLLALAVLGKLFPWRIKGKGKGVSVGVSGSVGQLGCVLLGFAFG
              ||||||||||||||||||||||||||| |||||| |||||||||||||||:|||||||:|
    g700      DMALTVLWLFVCTVGANLLALAVLGKLSPWRIGGKGKGVSVGVSGSVGQLRGCVLLGFVSG
                    70         80         90        100        110        120

130        140        150        160        170        180
    m700.pep  KLMRDIWMPSESAGMYCLMLLVFLIGVQLKSSGVSLRQVLVNRRGIRLSVWFMLSSLSGG
              |||  ||||||||:||||||||||||||||||||||||||||:||||||||||:||||||
    g700      KLMCDIWMPSENAGMYCLMLLVFLIGVQLKSSGVSLRQVLLNRRGIRLSVWFILSSLSGG
                   130        140        150        160        170        180

190        200        210        220        230        240
    m700.pep  LLFAASTDGVSWTKGLAMASGFGWYSLSGLVMTEAYGAVWGSIMLLNDLARELFALAFIP
              ||||||:|||||||||||||||||||||||||||||||||||||||||||||||||||||
    g700      LLFAASADGVSWTKGLAMASGFGWYSLSGLVMTEAYGAVWGSIMLLNDLARELFALAFIP
                   190        200        210        220        230        240

250        260        270        280        290        300
    m700.pep  LLMKRFPDAAVGVGGATSMDFTLPVIQGAGGLEVVPVAVSFGVVVNIAAPFLMVVFSALG
              |||||||||||||||||||||||||||||||||||||||||||||||||||||||||:||
    g700      LLMKRFPDAAVGVGGATSMDFTLPVIQGAGGLEVVPVAVSFGVVVNIAAPFLMVVFSTLG
                   250        260        270        280        290        300 m700.pep  X
              |
    g700      X
```

The following partial DNA sequence was identified in *N. meningitidis* <SEQ ID 2335>:

```
a700.seq
  1    ATGGACAGCC TGATGACGTT GCTTTCGGTA TTGATACCGA TGTTTGCCGG

51    ATTTTTTATC CGTGTGCCCA AGCCTTACCT GCCCGCTTTG GATAAGGTGC

101    TATCGGTCTT GGTGTATGCT GTGCTGCTGC TGATCGGCGT CTCGTTGTCG
```

```
-continued
151  CGCGTGGAGG ATTTGGGTTC GCGGTTGGAC GATATGGCGT TGACGGTTCT

201  GTGGCTGTTT GTTTGTACGG TCGGGCGAA CCTGCTTGCT TTGGCAGTGT

251  TGGGAAAGTT ATTCCCGTGG CGGATAAAGG GGAAAGGGAA GGGCGTTTCG

301  GTCGGTGTGT CGGGCAGTGT GGGGCAGCTC GGATGCGTGC TGCTCGGATT

351  TGCATCCGGC AAACTGATGC GCGATATTTG GATGCCGTCT GAAAACGCGG

401  GTATGTATTG TCTGATGCTG CTGGTGCTCN TCATCGGCGT ACAGCTCAAA

451  AGCAGCGGCG TATCGTTGCG GCAGGTTTTG GTCAACCGCA GGGGTATTCG

501  GTTGTCGGTC TGGTTTATGC TTTCATCTCT TTCAGGCGGG CTGCTGTTTG

551  CCGCATCGGC AGACGGTGTG TCGTGGGTGA AAGGTTTGGC GATGGCTTCC

601  GGCTTCGGTT GGTATTCCCT CTCGGGTTTG GTGATGACCG AGGCTTACGG

651  CGCGGTATGG GGCAGTATCG CGCTTTTGAA CGATTTGGCA CGAGAGCTGT

701  TCGCGCTGGC ATTTATTCCG CTGCTGATGA AGCGTTTTCC CGATGCGGCA

751  GTGGGGGTCG GCGGCGCGAC CAGTATGGAT TTCACATTGC CCGTGATTCG

801  GGGTGCGGGC GGCTTGGAAG CCGTACCGGT AGCGGTCAGC TTCGGCGTGG

851  TGGTCAATAT CGCCGCTCCG TTTCTGATGG TGGTGTTTTC CGCTTTGGGC

901  TGA
```

This corresponds to the amino acid sequence <SEQ ID 2336; ORF 700.a>:

```
a700.pep
  1  MDSLMTLLSV LIPMFAGFFI RVPKPYLPAL DKVLSVLVYA VLLLIGVSLS

51  RVEDLGSRLD DMALTVLWLF VCTVGANLLA LAVLGKLFPW RIKGKGKGVS

101  VGVSGSVGQL GCVLLGFASG KLMRDIWMPS ENAGMYCLML LVLXIGVQLK

151  SSGVSLRQVL VNRRGIRLSV WFMLSSLSGG LLFAASADGV SWVKGLAMAS

201  GFGWYSLSGL VMTEAYGAVW GSIALLNDLA RELFALAFIP LLMKRFPDAA

251  VGVGGATSMD FTLPVIRGAG GLEAVPVAVS FGVVVNIAAP FLMVVFSALG

301  *
``` m700/a700 97.0% identity in 300 aa overlap

```
                10         20         30         40         50         60
m700.pep  MDSLMTLLSVLIPMFAGFFIRVPKPYLPALDKVLSVLVYAVLLLIGVSLSRVEDLGSRLD
          ||||||||||||||||||||||||||||||||||||||||||||||||||||||||||||
a700      MDSLMTLLSVLIPMFAGFFIRVPKPYLPALDKVLSVLVYAVLLLIGVSLSRVEDLGSRLD
                10         20         30         40         50         60

70         80         90        100        110        120
m700.pep  DMALTVLWLFVCTVGANLLALAVLGKLFPWRIKGKGKGVSVGVSGSVGQLGCVLLGFAFG
          ||||||||||||||||||||||||||||||||||||||||||||||||||||||||||| |
a700      DMALTVLWLFVCTVGANLLALAVLGKLFPWRIKGKGKGVSVGVSGSVGQLGCVLLGFASG
                70         80         90        100        110        120

130        140        150        160        170        180
m700.pep  KLMRDIWMPSESAGMYCLMLLVFLIGVQLKSSGVSLRQVLVNRRGIRLSVWFMLSSLSGG
          ||||||||||||:||||||||||:|||||||||||||||||||||||||||||||||||
a700      KLMRDIWMPSENAGMYCLMLLVLXIGVQLKSSGVSLRQVLVNRRGIRLSVWFMLSSLSGG
               130        140        150        160        170        180

190        200        210        220        230        240
m700.pep  LLFAASTDGVSWTKGLAMASGFGWYSLSGLVMTEAYGAVWGSIMLLNDLARELFALAFIP
          ||||||:||||:|||||||||||||||||||||||||||||| ||||||||||||||||
a700      LLFAASADGVSWVKGLAMASGFGWYSLSGLVMTEAYGAVWGSIALLNDLARELFALAFIP
               190        200        210        220        230        240
```

```
                250        260        270        280        290        300
m700.pep  LLMKRFPDAAVGVGGATSMDFTLPVIQGAGGLEVVPVAVSFGVVVNIAAPFLMVVFSALG
          ||||||||||||||||||||||||||||:||||||:||||||||||||||||||||||||
a700      LLMKRFPDAAVGVGGATSMDFTLPVIRGAGGLEAVPVAVSFGVVVNIAAPFLMVVFSALG
                250        260        270        280        290        300 m700.pep  X
          |
a700      X
```

The following partial DNA sequence was identified in *N. gonorrhoeae* <SEQ ID 2337>:

```
g701.seq
    1  ATGTCTTGGC ACATATTCCA AGTTGCAGGG ATACCGACCG CTTCGATGGC
   51  ACAATCTACG CCGTCTTCGC CGACGATGGC GAAAACTTGT TTGGAGACGT
  101  CGCCGGAAGC GGGGCTGATG GTATGGGTCG CGCCCAACTC TTTCGCCGGT
  151  TTCAAACGGT TTTCGTCCAT ATCGCACACG ATAATGGCGG CAGGGCTATA
  201  CAGTTGGGCG GTCAACAAGG CGGACATACC GACAGGGCCG GCACCTGCGA
  251  TGAATACGGT ATCGCCGGGT TTCACATCGC CGTATTGCAC GCCGATTTCG
  301  TGGGCGGTCG GTAAAGCGTC GCTCAACAGC AGGGCGATTT CTTCGTTGAC
  351  GTTGTCGTGC GGCGGCACGA GGCTGTTGTC GGCATAA
```

This corresponds to the amino acid sequence <SEQ ID 2338; ORF 701>:

```
g701.pep
    1  MSWHIFQVAG IPTASMAQST PSSPTMAKTC LETSPEAGLM VWVAPNSFAG
   51  FKRFSSISHT IMAAGLYSWA VNKADIPTGP APAMNTVSPG FTSPYCTPIS
  101  WAVGKASLNS RAISSLTLSC GGTRLLSA*
```

The following partial DNA sequence was identified in *N. meningitidis* <SEQ ID 2339>:

```
m701.seq
    1  ATGTCTTGGC ACATATTCCA TGTAGCAGGG ATACCGACGG CTTCGATGGC
   51  GCAATCCACG CCGTCTTCGC CGACGATGGC AAAGACTTGT TTGGATACTT
  101  CGCCGGAAGC AGGGTTAATG GTATGGGTCG CACCCAATTC TTTCGCCAGT
  151  TTCAAACGGT TTTCGTCCAT ATCGCAAACG ATGATGGCGG CGGGACTGTA
  201  CAGTTGGGCG GTCAACAGGG CGGACATACC GACAGGGCCT GCCCCAGCGA
  251  TGAATACGGT GTCGCCGGGT TTGACATCGC CGTATTGCAC GCCGATTTCG
  301  TGGGCGGTCG GCAAAGCGTC GCTCAACAAC AGGGCGATTT CTTCGTTGAC
  351  ATTATCGGGC AGCGGAACGA GGCTGTTGTC GGCATAA
```

This corresponds to the amino acid sequence <SEQ ID 2340; ORF 701>:

```
m701.pep
    1  MSWHIFHVAG IPTASMAQST PSSPTMAKTC LDTSPEAGLM VWVAPNSFAS
   51  FKRFSSISQT MMAAGLYSWA VNRADIPTGP APAMNTVSPG LTSPYCTPIS
  101  WAVGKASLNN RAISSLTLSG SGTRLLSA*
```

Computer analysis of the amino acid sequences gave the following results:
Homology with a Predicted ORF from *N. meningitidis* menA
with menB
ORF 701 shows 92.2% identity over a 128 aa overlap with a predicted ORF (ORF701.a) from *N. gonorrhoeae*:

```
    m701/g701
                         10        20        30        40        50        60
    m701.pep   MSWHIFHVAGIPTASMAQSTPSSPTMAKTCLDTSPEAGLMVWVAPNSFASFKRFSSISQT
               ||||||:|||||||||||||||||||||||:||||||||||||||||:|||||||||:|
    g701       MSWHIFQVAGIPTASMAQSTPSSPTMAKTCLETSPEAGLMVWVAPNSFAGFKRFSSISHT
                         10        20        30        40        50        60

70        80        90       100       110       120
    m701.pep   MMAAGLYSWAVNRADIPTGPAPAMNTVSPGLTSPYCTPISWAVGKASLNNRAISSLTLSG
               :|||||||||||:||||||||||||||||||:||||||||||||||||||:|||||||||
    g701       IMAAGLYSWAVNKADIPTGPAPAMNTVSPGFTSPYCTPISWAVGKASLNSRAISSLTLSC
                         70        80        90       100       110       120

129
    m701.pep   SGTRLLSAX
               :||||||||
    g701       GGTRLLSAX
```

The following partial DNA sequence was identified in *N. meningitidis* <SEQ ID 2341>:

```
a701.seq
     1   ATGTCTTGGC ACATATTCCA AGTTGCAGGG ATACCGACGG CTTCGATCGC

51   GCAGTCCACG CCGTCTTCGC CGACGATAGC GGCAACTTGC TTGCTTACAT

101   CGCCGGAAGC AGGGTTAATG GTATGGGTTG CGCCCAACTC TTTCGCCAGT

151   TTCAAACGGT TTTCGTCCAT ATCGCAAACA ATGATGGCGG CGGGGCTGTA

201   CAGTTGGGCG GTCGGCAAGG CGGACATACC GACAGGAGCG GCACCTGCGA

251   TGAATACGGT GTCGCCGGGT TTGACATCGC CGTATTGCAC GCCGATTTCG

301   TGTGCGGTCG GCAAAGCGTC GCTCAACAAC AGGGCGACTT CTTCGTTGAC

351   GTTGTCGGGC AGCGGCACGA GGCTGTTGTC GGCATAA
```

This corresponds to the amino acid sequence <SEQ ID 2342; ORF 701.a>:

```
a701.pep
     1   MSWHIFQVAG IPTASIAQST PSSPTIAATC LLTSPEAGLM VWVAPNSFAS

51   FKRFSSISQT MMAAGLYSWA VGKADIPTGA APAMNTVSPG LTSPYCTPIS

101   CAVGKASLNN RATSSLTLSG SGTRLLSA*
``` m701/a701 92.2% identity in 128 aa overlap

```
                         10        20        30        40        50        60
    m701.pep   MSWHIFHVAGIPTASMAQSTPSSPTMAKTCLDTSPEAGLMVWVAPNSFASFKRFSSISQT
               ||||||:|||||||||:||||||||||||:| |||  ||||||||||||||||||||||
    a701       MSWHIFQVAGIPTASIAQSTPSSPTIAATCLLTSPEAGLMVWVAPNSFASFKRFSSISQT
                         10        20        30        40        50        60

70        80        90       100       110       120
    m701.pep   MMAAGLYSWAVNRADIPTGPAPAMNTVSPGLTSPYCTPISWAVGKASLNNRAISSLTLSG
               |||||||||| ::|||||| |||||||||||| ||||||||||:|||||||||||||||||
    a701       MMAAGLYSWAVGKADIPTGAAPAMNTVSPGLTSPYCTPISCAVGKASLNNRATSSLTLSG
                         70        80        90       100       110       120

129
    m701.pep   SGTRLLSAX
               |||||||||
    a701       SGTRLLSAX
```

The following partial DNA sequence was identified in *N. gonorrhoeae* <SEQ ID 2343>:

```
g702.seq
    1   ATGCCGTGTt ccaAAGCCAG TTGGACTTCG CCCGGAGtgg cAACGCCGGG

51   AATCAGGGGA ATGCCGCTGT TGCGGCCGGC TCTGGCGAGG GATTCGTGCA

101   AACCCGGGCT GATGGCGAAA ACCGCGCCTG CGTCTTCGAC GGCTTTGAGC

151   TGTTCGGGAT TGGTTACCGT ACCTGCGCCG ATGATGGCGT TGGGCATTTC

201   TTTGGCAATC AGGCGGATGG CCTCGAGTCC GACGGGGTG  CGCAAGGTAA

251   TTTCGAGGGT GGGGATGCCG CCTTCGACAA GGGCGCGGGA CAAATCGACG

301   GCGGTGCTTA AGTCGTCAAt cgCCATCACA GGCACAACTG CGCCGGCGGT

351   CAGGATTTCG cgggggggtca gttga
```

This corresponds to the amino acid sequence <SEQ ID 2344; ORF 702>:

```
g702.pep
    1   MPCSKASWTS PGVATPGIRG MPLLRPALAR DSCKPGLMAK TAPASSTALS

51   CSGLVTVPAP MMALGISLAI RRMASSPTGV RKVISRVGMP PSTRARDKST

101   AVLKSSIAIT GTTAPAVRIS RGVS*
```

The following partial DNA sequence was identified in *N. meningitidis* <SEQ ID 2345>:

```
m702.seq
    1   ATGCCGTGTT CCAAAGCCAG TTGGATTTCG CCCGGGGTGG CAACACCGGG

51   AATCAGGGGG ATGCCGCTGT TGTGGCCGGC TTTGGCGAGG GATTCATGCA

101   GCCCCGGGCT GATGGCGAAA ACCGCGCCTG CGTCTTCGAC GGCTTTGAGC

151   TGTTCGGGAT TGGTTACCGT ACCTGCGCCG ACGATGGCGT TGGGCACTTC

201   TTTGGCAATC AGGCGGATGG CATCGAGGCC GACAGGGGTG CGCAGGGTGA

251   TTTCGAGGGT AGGGATGCCG CCTTCGACAA GGGCGTGGGA CAAATCGATG

301   GCGGTGCTTA AGTCGTCAAT CGCCATTACC GGCACAACTG CGCCGGCGGT

351   CAAAATTTCG CGGGGGGTCA GTTTGGACAT TTCGGTTCTC CGGGTGGAAT

401   GGGGTATTTT ATTAAGATGG GACAGGTTGT AG
```

This corresponds to the amino acid sequence <SEQ ID 2346; ORF 702>:

```
m702.pep
    1   MPCSKASWIS PGVATPGIRG MPLLWPALAR DSCSPGLMAK TAPASSTALS

51   CSGLVTVPAP TMALGTSLAI RRMASRPTGV RRVISRVGMP PSTRAWDKSM

101   AVLKSSIAIT GTTAPAVKIS RGVSLDISVL RVEWGILLRW DRL*
```

Computer analysis of the amino acid sequences gave the following results:

Homology with a Predicted ORF from *N. meningitidis* menA with menB

ORF 702 shows 91.9% identity over a 124 aa overlap with a predicted ORF (ORF702.a) from *N. gonorrhoeae*:

```
m702/g702
                 10         20         30         40         50         60
m702.pep  MPCSKASWISPGVATPGIRGMPLLWPALARDSCSPGLMAKTAPASSTALSCSGLVTVPAP
          ||||||||| |||||||||||||| ||||||||:|||||||||||||||||||||||||||
g702      MPCSKASWTSPGVATPGIRGMPLLRPALARDSCKPGLMAKTAPASSTALSCSGLVTVPAP
                 10         20         30         40         50         60

70         80         90        100        110        120
m702.pep  TMALGTSLAIRRMASRPTGVRRVISRVGMPPSTRAWDKSMAVLKSSIAITGTTAPAVKIS
          ||||  |||||||||||  ||||| :||||||||||||||  ||| ||||||||||||||:||
g702      MMALGISLAIRRMASSPTGVRKVISRVGMPPSTRARDKSTAVLKSSIAITGTTAPAVRIS
                 70         80         90        100        110        120

130        140
m702.pep  RGVSLDISVLRVEWGILLRWDRLX
          ||||
g702      RGVSX
```

The following partial DNA sequence was identified in *N. meningitidis* <SEQ ID 2347>:

```
a702.seq
    1   ATGCCGTGTT CCAAAGCCAG TTGGATTTCG CCCGGGGTGG CAACACCGGG

51   AATCAGGGGG ATGCCGCTGT TGTGGCCGGC TTTGGCGAGG GATTCATGCA

101   GCCCCGGGCT GATGGCGAAA ACCGCGCCTG CGTCTTCGAC GGCTTTGAGC

151   TGTTCGGGAT TGGTTACCGT ACCTGCGCCG ACGATGGCGT TGGGCACTTC

201   TTTGGCAATC AGGCGGATGG CATCGAGGCC GACAGGGGTG CGCAGGGTGA

251   TTTCGAGGGT AGGGATGCCG CCTTCGACAA GGGCGTGGGA CAAATCGATG

301   GCGGTGCTTA AGTCGTCAAT CGCCATTACC GGCACAACTG CGCCGGCGGT

351   CAAAATTTCG CGGGGGGTCA GTTTGGACAT TTCGGTTCTC CGGGTGGAAT

401   GGGGTATTTT ATTAAGATGG GACAGGTTGT AG
```

This corresponds to the amino acid sequence <SEQ ID 2348; ORF 702.a>:

```
a702.pep
    1   MPCSKASWIS PGVATPGIRG MPLLWPALAR DSCSPGLMAK TAPASSTALS

51   CSGLVTVPAP TMALGTSLAI RRMASRPTGV RRVISRVGMP PSTRAWDKSM

101   AVLKSSIAIT GTTAPAVKIS RGVSLDISVL RVEWGILLRW DRL*
``` m702/a702 100.0% identity in 143 aa overlap

```
                 10         20         30         40         50         60
m702.pep  MPCSKASWISPGVATPGIRGMPLLWPALARDSCSPGLMAKTAPASSTALSCSGLVTVPAP
          ||||||||||||||||||||||||||||||||||||||||||||||||||||||||||||
a702      MPCSKASWISPGVATPGIRGMPLLWPALARDSCSPGLMAKTAPASSTALSCSGLVTVPAP
                 10         20         30         40         50         60

70         80         90        100        110        120
m702.pep  TMALGTSLAIRRMASRPTGVRRVISRVGMPPSTRAWDKSMAVLKSSIAITGTTAPAVKIS
          ||||||||||||||||||||||||||||||||||||||||||||||||||||||||||||
a702      TMALGTSLAIRRMASRPTGVRRVISRVGMPPSTRAWDKSMAVLKSSIAITGTTAPAVKIS
                 70         80         90        100        110        120

130        140
m702.pep  RGVSLDISVLRVEWGILLRWDRLX
          ||||||||||||||||||||||||
a702      RGVSLDISVLRVEWGILLRWDRLX
                130        140
```

The following partial DNA sequence was identified in *N. gonorrhoeae* <SEQ ID 2349>:

```
g703.seq
     1    ATGAAAGCAA AAATCCTGAC TTCCGTTGCG CTGCTTGCCT GTTCCGGCAG
    51    CCTGTTTGCC CAAACGCTGG CAACCGTTAA CGGTCAGAAA ATCGACAGTT
   101    CCGTCATCGA TGCGCAGGTT GCCGCATTCC GTGCGGAAAA CAGCCGTGCC
   151    GAAGACACGC CGCAACTGCG CCAATCCCTG CTGGAAAACG AAGTGGTCAA
   201    CACCGTGGTC GCACAGGAAG TGAAACGCCT GAAACTCGAC CGGTCGGCAG
   251    AGTTTAAAGA TGCGCTTGCC AAATTGCGTG CCGAAGCGAA AAAGTCGGGC
   301    GACGACAAGA AACCGTCCTT CAAAACCGTT TGGCAGGCGG TAAAATATGG
   351    CTTGAACGGC GAGGCATACG CACTGCATAT CGCCAAAACC CAACCGGTTT
   401    CCGAGCAGGA AGTAAAAGCC GTTTACGACA ATATCAGCGG TTTTTATAAA
   451    GGCACGCAGG AAGTCCAGTT GGGCGAAATC CTGACCGACA AGGAAGAAAA
   501    TGCGAAAAAA GCGGTTGCCG ATTTGAAGGC GAAAAAAGGT TTTGATGCCG
   551    TTTTGAAACA ATACTCGCTC AACGACCGCA CCAAACGGAC CGGCGCGCCG
   601    GACGGATATG TGCCGCTGAA AGATTTGGAA CAGGGTGTTC CGCCGCTTTA
   651    TCAGGCAATT AAGGACTTGA AAAAGGCGA ATTTACGGCA ACGCCGCTGA
   701    AAAACGGCGA TTTCTACGGC GTTTATTATG TCAACGACAG CCGcgaggTG
   751    AAAGTGCCTT CTTTTGACGA ATGAAAGGA CAGATTGCCG GCAACCTTCA
   801    GGCGGAACGG ATTGACCGTG CCGTctgTGc gcTGTTgggt aaggCAAACA
   851    TCAAACCTGC AAAATAA
```

This corresponds to the amino acid sequence <SEQ ID 2350; ORF 703>:

```
g703.pep
     1    MKAKILTSVA LLACSGSLFA QTLATVNGQK IDSSVIDAQV AAFRAENSRA
    51    EDTPQLRQSL LENEVVNTVV AQEVKRLKLD RSAEFKDALA KLRAEAKKSG
   101    DDKKPSFKTV WQAVKYGLNG EAYALHIAKT QPVSEQEVKA VYDNISGFYK
   151    GTQEVQLGEI LTDKEENAKK AVADLKAKKG FDAVLKQYSL NDRTKRTGAP
   201    DGYVPLKDLE QGVPPLYQAI KDLKKGEFTA TPLKNGDFYG VYYVNDSREV
   251    KVPSFDEMKG QIAGNLQAER IDRAVCALLG KANIKPAK*
```

The following partial DNA sequence was identified in *N. meningitidis* <SEQ ID 2351>:

```
m703.seq
     1    ATGAAAGCAA AAATCCTGAC TTCCGTTGCA CTGCTTGCCT GTTCCGGCAG
    51    CCTGTTTGCC CAAACGCTGG CAACCGTCAA CGGTCAGAAA ATCGACAGTT
   101    CCGTCATCGA TGCGCAGGTT GCCGCATTCC GTGCGGAAAA CAGCCGTGCC
   151    GAAGACACGC CGCAACTGCG CCAATCCCTG CTGGAAAACG AAGTGGTCAA
   201    TACCGTGGTC GCACAGGAAG TGAAACGCCT GAAACTCGAC CGGTCGGCAG
   251    AGTTTAAAAA TGCGCTTGCC AAATTGCGTG CCGAAGCGAA AAAGTCGGGC
   301    GACGACAAGA AACCGTCCTT CAAAACCGTT TGGCAGGCGG TAAAATATGG
   351    CTTGAACGGC GAGGCATACG CATTGCATAT CGCCAAAACC CAACCGGTTT
   401    CCGAGCAGGA AGTAAAAGCC GCATATGACA ATATCAGCGG TTTTTACAAA
```

-continued

```
451  GGTACGCAGG AAGTCCAGTT GGGCGAAATC CTGACCGACA AGGAAGAAAA

501  TGCAAAAAAA GCGGTTGCCG ACTTGAAGGC GAAAAAAGGT TTCGATGCCG

551  TCTTGAAACA ATATTCCCTC AACGACCGTA CCAAACAGAC CGGTGCGCCG

601  GTCGGATATG TGCCGCTGAA AGATTTGGAA CAGGGTGTTC CGCCGCTTTA

651  TCAGGCAATT AAGGACTTGA AAAAAGGCGA ATTTACGGCA ACGCCGCTGA

701  AAAACGGCGA TTTCTACGGC GTTTATTATG TCAACGACAG CCGCGAGGTA

751  AAAGTGCCTT CTTTTGATGA AATGAAAGGA CAGATTGCGG GCAACCTTCA

801  GGCGGAACGG ATTGACCGTG CCGTCGGTGC ACTGTTGGGC AAGGCAAACA

851  TCAAACCTGC AAAATAA
```

This corresponds to the amino acid sequence <SEQ ID 2352; ORF 703>:

```
m703.pep
  1  MKAKILTSVA LLACSGSLFA QTLATVNGQK IDSSVIDAQV AAFRAENSRA

51  EDTPQLRQSL LENEVVNTVV AQEVKRLKLD RSAEFKNALA KLRAEAKKSG

101  DDKKPSFKTV WQAVKYGLNG EAYALHIAKT QPVSEQEVKA AYDNISGFYK

151  GTQEVQLGEI LTDKEENAKK AVADLKAKKG FDAVLKQYSL NDRTKQTGAP

201  VGYVPLKDLE QGVPPLYQAI KDLKKGEFTA TPLKNGDFYG VYYVNDSREV

251  KVPSFDEMKG QIAGNLQAER IDRAVGALLG KANIKPAK*
```

Computer analysis of the amino acid sequences gave the following results:
Homology with a Predicted ORF from N. meningitidis menA with menB
ORF 703 shows 98.3% identity over a 288 aa overlap with a predicted ORF (ORF703.a) from N. gonorrhoeae:

```
m703/g703
                 10         20         30         40         50         60
    m703.pep  MKAKILTSVALLACSGSLFAQTLATVNGQKIDSSVIDAQVAAFRAENSRAEDTPQLRQSL
              ||||||||||||||||||||||||||||||||||||||||||||||||||||||||||||
        g703  MKAKILTSVALLACSGSLFAQTLATVNGQKIDSSVIDAQVAAFRAENSRAEDTPQLRQSL
                 10         20         30         40         50         60

70         80         90        100        110        120
    m703.pep  LENEVVNTVVAQEVKRLKLDRSAEFKNALAKLRAEAKKSGDDKKPSFKTVWQAVKYGLNG
              |||||||||||||||||||||||||||||:||||||||||||||||||||||||||||||
        g703  LENEVVNTVVAQEVKRLKLDRSAEFKDALAKLRAEAKKSGDDKKPSFKTVWQAVKYGLNG
                 70         80         90        100        110        120

130        140        150        160        170        180
    m703.pep  EAYALHIAKTQPVSEQEVKAAYDNISGFYKGTQEVQLGEILTDKEENAKKAVADLKAKKG
              |||||||||||||||||||||:||||||||||||||||||||||||||||||||||||||
        g703  EAYALHIAKTQPVSEQEVKAVYDNISGFYKGTQEVQLGEILTDKEENAKKAVADLKAKKG
                130        140        150        160        170        180

190        200        210        220        230        240
    m703.pep  FDAVLKQYSLNDRTKQTGAPVGYVPLKDLEQGVPPLYQAIKDLKKGEFTATPLKNGDFYG
              ||||||||||||||:||||  ||||||||||||||||||||||||||||||||||||||
        g703  FDAVLKQYSLNDRTKRTGAPDGYVPLKDLEQGVPPLYQAIKDLKKGEFTATPLKNGDFYG
                190        200        210        220        230        240

250        260        270        280       289
    m703.pep  VYYVNDSREVKVPSFDEMKGQIAGNLQAERIDRAVGALLGKANIKPAKX
              |||||||||||||||||||||||||||||||||||  ||||||||||||
        g703  VYYVNDSREVKVPSFDEMKGQIAGNLQAERIDRAVCALLGKANIKPAKX
                250        260        270        280
```

The following partial DNA sequence was identified in N. meningitidis <SEQ ID 2353>:

a703.seq

```
  1  ATGAAAGCAA AAATCCTGAC TTCCGTTGCA CTGCTTGCCT GTTCCGGCAG
 51  CCTGTTTGCC CAAACGCTGG CAACCGTCAA CGGTCAGAAA ATCGACAGTT
101  CCGTCATTGA TGCGCAGGTT GCCGCATTCC GTGCGGAAAA CAGCCGTGCC
151  GAAGACACGC CGCAACTGCG CCAATCCCTG CTGGAAAACG AAGTGGTCAA
201  CACCGTGGTC GCACAGGAAG TGAAACGCCT GAAACTCGAC CGGTCGGCAG
251  AGTTTAAAAA TGCGCTTGCC AAATTGCGTG CCGAAGCGAA AAAGTCGGGC
301  GACGACAAGA AACCGTCCTT CAAAACCGTT TGGCAGGCGG TAAAATATGG
351  CTTGAACGGC GAGGCATACG CGCTGCATAT CGCCAAAACC CAACCGGTTT
401  CCGAGCAGGA AGTAAAAGCC GCATATGACA ATATCAGCGG TTTTTACAAA
451  GGTACGCAGG AAGTCCAGTT GGGCGAAATC CTGACCGACA AGGAAGAAAA
501  TGCAAAAAAA GCGGTTGCCG ACTTGAAGGC GAAAAAAGGT TTCGATGCCG
551  TCTTGAAACA ATATTCCCTC AACGACCGTA CCAAACAGAC CGGTGCGCCG
601  GTCGGATATG TGCCGCTGAA AGATTTGGAA CAGGGTGTTC CGCCGCTTTA
651  TCAGGCAATT AAGGACTTGA AAAAGGCGA ATTTACGGCA ACGCCGCTGA
701  AAAACGGCGA TTTCTACGGC GTTTATTATG TCAACGACAG CCGCGAGGTA
751  AAAGTGCCTT CTTTTGATGA AATGAAAGGA CAGATTGCGG GCAACCTTCA
801  GGCGGAACGG ATTGACCGTG CCGTCGGTGC ACTGTTGGGC AAGGCAAACA
851  TCAAACCTGC AAAATAA
```

This corresponds to the amino acid sequence <SEQ ID 2354; ORF 703.a>:

a703.pep

```
  1  MKAKILTSVA LLACSGSLFA QTLATVNGQK IDSSVIDAQV AAFRAENSRA
 51  EDTPQLRQSL LENEVVNTVV AQEVKRLKLD RSAEFKNALA KLRAEAKKSG
101  DDKKPSFKTV WQAVKYGLNG EAYALHIAKT QPVSEQEVKA AYDNISGFYK
151  GTQEVQLGEI LTDKEENAKK AVADLKAKKG FDAVLKQYSL NDRTKQTGAP
201  VGYVPLKDLE QGVPPLYQAI KDLKKGEFTA TPLKNGDFYG VYYVNDSREV
251  KVPSFDEMKG QIAGNLQAER IDRAVGALLG KANIKPAK*
``` m703/a703 100.0% identity in 288 aa overlap

```
                 10         20         30         40         50         60
m703.pep  MKAKILTSVALLACSGSLFAQTLATVNGQKIDSSVIDAQVAAFRAENSRAEDTPQLRQSL
          ||||||||||||||||||||||||||||||||||||||||||||||||||||||||||||
a703      MKAKILTSVALLACSGSLFAQTLATVNGQKIDSSVIDAQVAAFRAENSRAEDTPQLRQSL
                 10         20         30         40         50         60

70         80         90        100        110        120
m703.pep  LENEVVNTVVAQEVKRLKLDRSAEFKNALAKLRAEAKKSGDDKKPSFKTVWQAVKYGLNG
          ||||||||||||||||||||||||||||||||||||||||||||||||||||||||||||
a703      LENEVVNTVVAQEVKRLKLDRSAEFKNALAKLRAEAKKSGDDKKPSFKTVWQAVKYGLNG
                 70         80         90        100        110        120

130        140        150        160        170        180
m703.pep  EAYALHIAKTQPVSEQEVKAAYDNISGFYKGTQEVQLGEILTDKEENAKKAVADLKAKKG
          ||||||||||||||||||||||||||||||||||||||||||||||||||||||||||||
a703      EAYALHIAKTQPVSEQEVKAAYDNISGFYKGTQEVQLGEILTDKEENAKKAVADLKAKKG
                130        140        150        160        170        180

190        200        210        220        230        240
m703.pep  FDAVLKQYSLNDRTKQTGAPVGYVPLKDLEQGVPPLYQAIKDLKKGEFTATPLKNGDFYG
          ||||||||||||||||||||||||||||||||||||||||||||||||||||||||||||
a703      FDAVLKQYSLNDRTKQTGAPVGYVPLKDLEQGVPPLYQAIKDLKKGEFTATPLKNGDFYG
                190        200        210        220        230        240
```

```
                                   -continued
                    250          260        270         280    289
m703.pep  VYYVNDSREVKVPSFDEMKGQIAGNLQAERIDRAVGALLGKANIKPAKX
          ||||||||||||||||||||||||||||||||||||||||||||||||
a703      VYYVNDSREVKVPSFDEMKGQIAGNLQAERIDRAVGALLGKANIKPAKX
                    250          260        270         280
```

The following partial DNA sequence was identified in *N. meningitidis* <SEQ ID 2355>:

```
a704.seq
    1  ATGAAAAAAA CCTGTTTCCA CTGCGGGCTG GACGTTCCCG AAAACCTGCA

51  TCTGACCGTC CGTTACGAAA ACGAAGACCG CGAAACCTGC TGCGCCGGTT

101  GTCAGGCAGT CGCACAAAGC ATTATTGACG CGGGCTTGGG CAGTTATTAC

151  AAACAACGCA CCGCCGACGC GCAAAAAACC GAGCTGCCGC CCCAAGAAAT

201  CCTCGACCAA ATCCGCCTGT ACGACCTGCC CGAAGTCCAG TCCGACTTTG

251  TGGAAACCCA CGGCGGCACG CGCGAGGCGG TTTTAATGCT CGGCGGCATC

301  ACCTGCGCCG CCTGCGTCTG GCTGATCGAA CAGCAGCTTT GCGTACAGA

351  CGGCATCGTC CGCATCGACC TCAATTACAG CACGCACCGC TGCCGCGTCG

401  TCTGGGACGA CGGCAAAATC CGCCTTTCCG ACATTCTGTT GAAAATCAGG

451  CAGATAGGCT ACACCGCCGC ACCCTATGAC GCGCAAAAAA TCGAAGCCGC

501  CAACCAAAAA GAACGCAAAC AATACATCGT CCGCCTCGCC GTTGCCGGGC

551  TGGGGATGAT GCAGACGATG ATGTTCGCGC TGCCGACCTA CCTTTACGGC

601  GGCGACATCG AACCCGATTT CCTGCAAATC CTCCATTGGG GCGGCTTTTT

651  AATGGTGCTG CCCGTCGTAT TCTATTGCGC CGTCCCGTTT TATCAAGGCG

701  CGCTGCGCGA CTTGAAAAAC CGCCGCGTCG GCATGGATAC GCCGATTACC

751  GTCGCCATCA TCATGACCTT TATCGCCGGC GTTTACAGCC TTGCGACAAA

801  TGCGGGGCAG GGGATGTATT TCGAATCCAT CGCGATGCTG CTGTTTTTCC

851  TGCTGGGCGG ACGCTTTATG GAACACATTG CCCGCCGTAA GGCAGGCGAT

901  GCCGCCGAGA GGCTGGTGAA GCTGATTCCT GCGTTTTGCC ATCATATGCC

951  CGATTACCCC GATACGCAGG AAACCTGCGA GGCAGCTGTC GTCAAATTGA

1001  AGGCGGGCGA TATCGTGCTG GTCAAACCGG CGAAACCAT CCCCGTTGAC

1051  GGCACGGTGC TGGAAGGAAG CAGTGCCGTC AACGAATCTA TGCTGACCGG

1101  CGAGAGCCTG CCCGTCGCCA AAATGCCGTC TGAAAAGTA ACCGCCGGCA

1151  CACTCAACAC GCAAAGCCCC CTGATTATAC GCACCGACCG CACCGGCGGC

1201  GGCACGCGAC TGTCGCACAT CGTCCGCCTG CTCGACCGCG CCTTAGCGCA

1251  AAAACCGCGC ACTGCCGAGT TGGCGGAACA ATACGCCTCG TCTTTCATAT

1301  TCGGCGAACT CCTGCTTGCC GTCCCCGTCT TCATCGGCTG GACGCTGTAC

1351  GCCGACGCGC ACACCGCATT GTGGATTACC GTCGCCCTGC TGGTCATTAC

1401  CTGCCCCTGC GCCTTATCGC TTGCCACGCC GACCGCGCTG GCAGCTTCTA

1451  CCGGTACGCT GGCGCGCGAA GGTATTTTAA TCGGCGGAAA GCAGGCAATC

1501  GAAACCCTCG CCCAAACCAC CGACATCATC TTCGACAAAA CCGGCACGCT

1551  GACCCAAGGC AAACCCGCCG TCCGCCGTAT CTCATTGTTG AGAGGCACAG
```

```
-continued
1601  ACGAAGCCTT TGTTCTCGCG GTGGCGCAGG CTTTAGAACA ACAGTCCGAA

1651  CATCCCCTTG CCCGCGCCAT CCTCAACTGC CGCATTTCAG ACGGCAGCGT

1701  CCCCGACATC GCTATTAAAC AACGCCTCAA CCGCATCGGC GAAGGCGTGG

1751  GCGCGCAACT GACCGTCAAC GGCGAAACAC AGGTTTGGGC ATTGGGCAGG

1801  GCATCCTATG TCGCCGAAAT TTCAGGTAAA GAACCGCAAA CAGAAGGCGG

1851  CGGCAGCGCG GTTTACCTCG GCAGTCAAAG CGGTTTCCAA GCCGTGTTCT

1901  ACCTGCAAGA CCCGCTCAAA GACAGCGCGG CGGAGGCGGT GCGGCAGTTG

1951  GCAGGCAAAA ACCTGACGCT GCACATTCTC AGCGGCGACC GTGAAACCGC

2001  CGTTGCCGAA ACCGCACGCG CCCTGGGTGT CGCGCACTAC CGCGCCCAAG

2051  CCATGCCCGA GGACAAACTG GAATACGTCA AAGCCTTGCA AAAAGAAGGG

2101  AAAAAAGTGC TGATGATAGG CGACGGCATC AACGACGCGC CCGTTTTGGC

2151  GCAGGCAGAC GTATCCGCCG CCGCAGCGGG CGGGACGGAT ATTGCGAGGG

2201  ACGGCGCGGA CATTGTGTTA TTGAACGAAG ATTTGCGTAC CGTCGCCCAC

2251  CTGCTCGATC AGGCGCGGCG CACCCGCCAT ATTATCCGGC AAAACCTGAT

2301  ATGGGCGGGC GCGTACAATA TCATTGCCGT ACCGCTTGCC GTTTTGGGCT

2351  ATGTCCAACC GTGGATAGCC GCACTGGGTA TGAGCTTCAG TTCGCTGGCG

2401  GTTTTGGGCA ACGCCCTGCG CCTTCACAAA CGGGGGAAAA TGCAGTCTGA

2451  AAAAATGCCG TCCGAACAAT GA
```

This corresponds to the amino acid sequence <SEQ ID 2356; ORF 703>:

```
a704.pep
    1  MKKTCFHCGL DVPENLHLTV RYENEDRETC CAGCQAVAQS IIDAGLGSYY

51  KQRTADAQKT ELPPQEILDQ IRLYDLPEVQ SDFVETHGGT REAVLMLGGI

101  TCAACVWLIE QQLLRTDGIV RIDLNYSTHR CRVVWDDGKI RLSDILLKIR

151  QIGYTAAPYD AQKIEAANQK ERKQYIVRLA VAGLGMMQTM MFALPTYLYG

201  GDIEPDFLQI LHWGGFLMVL PVVFYCAVPF YQGALRDLKN RRVGMDTPIT

251  VAIIMTFIAG VYSLATNAGQ GMYFESIAML LFFLLGGRFM EHIARRKAGD

301  AAERLVKLIP AFCHHMPDYP DTQETCEAAV VKLKAGDIVL VKPGETIPVD

351  GTVLEGSSAV NESMLTGESL PVAKMPSEKV TAGTLNTQSP LIIRTDRTGG

401  GTRLSHIVRL LDRALAQKPR TAELAEQYAS SFIFGELLLA VPVFIGWTLY

451  ADAHTALWIT VALLVITCPC ALSLATPTAL AASTGTLARE GILIGGKQAI

501  ETLAQTTDII FDKTGTLTQG KPAVRRISLL RGTDEAFVLA VAQALEQQSE

551  HPLARAILNC RISDGSVPDI AIKQRLNRIG EGVGAQLTVN GETQVWALGR

601  ASYVAEISGK EPQTEGGGSA VYLGSQSGFQ AVFYLQDPLK DSAAEAVRQL

651  AGKNLTLHIL SGDRETAVAE TARALGVAHY RAQAMPEDKL EYVKALQKEG

701  KKVLMIGDGI NDAPVLAQAD VSAAAGGTD IARDGADIVL LNEDLRTVAH

751  LLDQARRTRH IIRQNLIWAG AYNIIAVPLA VLGYVQPWIA ALGMSFSSLA

801  VLGNALRLHK RGKMQSEKMP SEQ*
``` m704/a704 99.8% identity in 823 aa overlap

```
                   10         20         30         40         50         60
m704.pep   MKKTCFHCGLDVPEHLHLTVRYENEDRETCCAGCQAVAQSIIDAGLGSYYKQRTADAQKT
           ||||||||||||||:|||||||||||||||||||||||||||||||||||||||||||||
a704       MKKTCFHCGLDVPENLHLTVRYENEDRETCCAGCQAVAQSIIDAGLGSYYKQRTADAQKT
                   10         20         30         40         50         60

70         80         90        100        110        120
m704.pep   ELPPQEILDQIRLYDLPEVQSDFVETHGGTREAVLMLGGITCAACVWLIEQQLLRTDGIV
           ||||||||||||||||||||||||||||||||||||||||||||||||||||||||||||
a704       ELPPQEILDQIRLYDLPEVQSDFVETHGGTREAVLMLGGITCAACVWLIEQQLLRTDGIV
                   70         80         90        100        110        120

130        140        150        160        170        180
m704.pep   RIDLNYSTHRCRVVWDDGKIRLSDILLKIRQIGYTAAPYDAQKIEAANQKERKQYIVRLA
           ||||||||||||||||||||||||||||||||||||||||||||||||||||||||||||
a704       RIDLNYSTHRCRVVWDDGKIRLSDILLKIRQIGYTAAPYDAQKIEAANQKERKQYIVRLA
                  130        140        150        160        170        180

190        200        210        220        230        240
m704.pep   VAGLGMMQTMMFALPTYLYGGDIEPDFLQILHWGGFLMVLQVVFYCAVPFYQGALRDLKN
           ||||||||||||||||||||||||||||||||||||||||||||||||||||||||||||
a704       VAGLGMMQTMMFALPTYLYGGDIEPDFLQILHWGGFLMVLQVVFYCAVPFYQGALRDLKN
                  190        200        210        220        230        240

250        260        270        280        290        300
m704.pep   RRVGMDTPITVAIIMTFIAGVYSLATNAGQGMYFESIAMLLFFLLGGRFMEHIARRKAGD
           ||||||||||||||||||||||||||||||||||||||||||||||||||||||||||||
a704       RRVGMDTPITVAIIMTFIAGVYSLATNAGQGMYFESIAMLLFFLLGGRFMEHIARRKAGD
                  250        260        270        280        290        300

310        320        330        340        350        360
m704.pep   AAERLVKLIPAFCHHMPDYPDTQETCEAAVVKLKAGDIVLVKPGETIPVDGTVLEGSSAV
           ||||||||||||||||||||||||||||||||||||||||||||||||||||||||||||
a704       AAERLVKLIPAFCHHMPDYPDTQETCEAAVVKLKAGDIVLVKPGETIPVDGTVLEGSSAV
                  310        320        330        340        350        360

370        380        390        400        410        420
m704.pep   NESMLTGESLPVAKMPSEKVTAGTLNTQSPLIIRTDRTGGGTRLSHIVRLLDRALAQKPR
           ||||||||||||||||||||||||||||||||||||||||||||||||||||||||||||
a704       NESMLTGESLPVAKMPSEKVTAGTLNTQSPLIIRTDRTGGGTRLSHIVRLLDRALAQKPR
                  370        380        390        400        410        420

430        440        450        460        470        480
m704.pep   TAELAEQYASSFIFGELLLAVPVFIGWTLYADAHTALWITVALLVITCPCALSLATPTAL
           ||||||||||||||||||||||||||||||||||||||||||||||||||||||||||||
a704       TAELAEQYASSFIFGELLLAVPVFIGWTLYADAHTALWITVALLVITCPCALSLATPTAL
                  430        440        450        460        470        480

490        500        510        520        530        540
m704.pep   AASTGTLAREGILIGGKQAIETLAQTTDIIFDKTGTLTQGKPAVRRISLLRGTDEAFVLA
           ||||||||||||||||||||||||||||||||||||||||||||||||||||||||||||
a704       AASTGTLAREGILIGGKQAIETLAQTTDIIFDKTGTLTQGKPAVRRISLLRGTDEAFVLA
                  490        500        510        520        530        540

550        560        570        580        590        600
m704.pep   VAQALEQQSEHPLARAILNCRISDGSVPDIAIKQRLNRIGEGVGAQLTVNGETQVWALGR
           ||||||||||||||||||||||||||||||||||||||||||||||||||||||||||||
a704       VAQALEQQSEHPLARAILNCRISDGSVPDIAIKQRLNRIGEGVGAQLTVNGETQVWALGR
                  550        560        570        580        590        600

610        620        630        640        650        660
m704.pep   ASYVAEISGKEPQTEGGGSAVYLGSQSGFQAVFYLTDPLKDSAAEAVRQLAGKNLTLHIL
           |||||||||||||||||||||||||||||||||||| |||||||||||||||||||||||
a704       ASYVAEISGKEPQTEGGGSAVYLGSQSGFQAVFYLQDPLKDSAAEAVRQLAGKNLTLHIL
                  610        620        630        640        650        660

670        680        690        700        710        720
m704.pep   SGDRETAVAETARALGVAHYRAQAMPEDKLEYVKALQKEGKKVLMIGDGINDAPVLAQAD
           ||||||||||||||||||||||||||||||||||||||||||||||||||||||||||||
a704       SGDRETAVAETARALGVAHYRAQAMPEDKLEYVKALQKEGKKVLMIGDGINDAPVLAQAD
                  670        680        690        700        710        720

730        740        750        760        770        780
m704.pep   VSAAAAGGTDIARDGADIVLLNEDLRTVAHLLDQARRTRHIIRQNLIWAGAYNIIAVPLA
           ||||||||||||||||||||||||||||||||||||||||||||||||||||||||||||
a704       VSAAAAGGTDIARDGADIVLLNEDLRTVAHLLDQARRTRHIIRQNLIWAGAYNIIAVPLA
                  730        740        750        760        770        780

790        800        810        820
m704.pep   VLGYVQPWIAALGMSFSSLAVLGNALRLHKRGKMQSEKMPSEQX
           |||||||||||||||||||||||||||||||||||||||||||
a704       VLGYVQPWIAALGMSFSSLAVLGNALRLHKRGKMQSEKMPSEQX
                  790        800        810        820
```

The following partial DNA sequence was identified in *N. gonorrhoeae* <SEQ ID 2357>:

g705.seq
```
  1    GTGTTCAATA ATTTCCttgC CTCTCTGCCG TTTATGACGG AAACACGCGC
 51    TGATATGCTC ATCAGCGCGT TTTGGCCCAT GGTTAAAGCC GGCTTTACAG
101    TGTCTTtgcC TTTGGCGATC GCTTCTTTCG TTATCGGCAT GATTATTGCC
151    GTAGCCGTTG CTTTGGTAAG AATCATGCCT TCCGGCGGTA TTTTCCAAAA
201    ATGCTTGTTG AAGCTGGTGG AATTTTATAT TTCCGTCGTT CGCGGTACGC
251    CGCTGTTGGT TCAGCTTGTG ATTGTGTTTT ACGGGCTGCC GTCCGTCGGC
301    ATCTATATCA ATCCGATTCC CGCCGCCATC ATCGGCTTTT CGCTCAATGT
351    CGGCGCATAC GCTTCCGAAA CCATACGCGC GGCGATTTTG TCCGTGCCGA
401    AAGGGCAGTG GGAAGCAGGT TTCTCCATCG GTATGACCTA TATGCAGACG
451    TTCCGCCGCA TCGTCGCACC GCAGGCATTC CGCGTCGCCG TTCCGCCGTT
501    GAGCAACGAG TTTATCGGCT TGTTCAAAAA CACCTCGCTT GCCGCCGTGG
551    TAACGGTAAC GGAGCTTTTC CGTGTCGCAC AGGAAACGGC AAACCGCACT
601    TATGACTTTT TGCCTGTCTA TATCGAAGCT GCATTGGTTT ATTGGTGTTT
651    CTGTAAAGTG CTGTTTTTGA TTCAGGCGCG TTTGGAAAAA CGTTTCGACC
701    GTTATGTCGC CAAATAA
```

This corresponds to the amino acid sequence <SEQ ID 2358; ORF 705>:

g705.pep
```
  1    VFNNFLASLP FMTETRADML ISAFWPMVKA GFTVSLPLAI ASFVIGMIIA
 51    VAVALVRIMP SGGIFQKCLL KLVEFYISVV RGTPLLVQLV IVFYGLPSVG
101    IYINPIPAAI IGFSLNVGAY ASETIRAAIL SVPKGQWEAG FSIGMTYMQT
151    FRRIVAPQAF RVAVPPLSNE FIGLFKNTSL AAVVTVTELF RVAQETANRT
201    YDFLPVYIEA ALVYWCFCKV LFLIQARLEK RFDRYVAK*
```

The following partial DNA sequence was identified in *N. meningitidis* <SEQ ID 2359>:

m705.seq
```
  1    GTGTTCAATA ATTTCCTTGC TTCGCTGCCG TTTATGACGG AAACACGCGC
 51    CGATATGATT GTCAGCGCGT TTTTGCCTAT GGTCAAAGCC GGCTTCGCGG
101    TCTCTCTGCC TTTGGCGGCA GCTTCTTTCG TTATCGGTAT GATGATTGCG
151    GTAGCCGTGG CTTTGGTGCG GATTATGCCC GCCGGCGGCA TCGTGCGGAA
201    AATCCTGCTG AAATTGGTGG AATTTTATAT TTCCGTCATT CGCGGTACGC
251    CGCTGTTGGT TCAGCTTGTG ATTGTGTTTT ACGGGCTGCC TTCCGTCGGC
301    ATCTATATCG ACCCGATTCC TGCCGCCATC ATCGGCTTTT CGCTCAATGT
351    CGGCGCATAC GCTTCCGAAA CCATACGCGC GGCAATTTTG TCCGTACCTA
401    AAGGCCAATG GGAAGCAGGT TTCTCCATCG GCATGACCTA TATGCAGACG
451    TTCCGCCGCA TTGTCGCGCC GCAGGCATTC CGCGTTGCCG TGCCGCCTTT
501    GAGCAACGAG TTTATCGGTT TGTTTAAAAA CACCTCGCTC GCGGCAGTCG
551    TGACGGTAAC GGAATTATTC CGCGTCGCGC AGGAAACGGC AAACCGCACT
601    TATGACTTTT TGCCCGTCTA TATCGAAGCC GCTTTGGTTT ACTGGTGTTT
```

```
651  TTGTAAAGTG CTGTTCCTGA TTCAGGCGCG TTTGGAAAAA CGTTTCGACC

701  GCTACGTCGC CAAATAA
```

This corresponds to the amino acid sequence <SEQ ID 2360; ORF 705>:

```
m705.pep
  1  VFNNFLASLP FMTETRADMI VSAFLPMVKA GFAVSLPLAA ASFVIGMMIA

51  VAVALVRIMP AGGIVRKILL KLVEFYISVI RGTPLLVQLV IVFYGLPSVG

101  IYIDPIPAAI IGFSLNVGAY ASETIRAAIL SVPKGQWEAG FSIGMTYMQT

151  FRRIVAPQAF RVAVPPLSNE FIGLFKNTSL AAVVTVTELF RVAQETANRT

201  YDFLPVYIEA ALVYWCFCKV LFLIQARLEK RFDRYVAK*
```

Computer analysis of this amino acid sequence gave the following results:
Homology with a Predicted ORF from *N. gonorrhoeae*
ORF 705 shows 95.0% identity over a 238 aa overlap with a predicted ORF (ORF 705) from *N. gonorrhoeae*:
m705/g705 95.0% identity in 238 aa overlap

```
                 10         20         30         40         50         60
m705.pep  VFNNFLASLPFMTETRADMIVSAFLPMVKAGFAVSLPLAAASFVIGMMIAVAVALVRIMP
          ||||||||||||||||||||::|||  ||||||||:||||||  ||||||:|||||||||||
g705      VFNNFLASLPFMTETRADMLISAFWPMVKAGFTVSLPLAIASFVIGMIIAVAVALVRIMP
                 10         20         30         40         50         60

70         80         90        100        110        120
m705.pep  AGGIVRKILLKLVEFYISVIRGTPLLVQLVIVFYGLPSVGIYIDPIPAAIIGFSLNVGAY
          :|||  :| ||||||||||||:||||||||||||||||||||||:||||||||||||||||
g705      SGGIFQKCLLKLVEFYISVVRGTPLLVQLVIVFYGLPSVGIYINPIPAAIIGFSLNVGAY
                 70         80         90        100        110        120

130        140        150        160        170        180
m705.pep  ASETIRAAILSVPKGQWEAGFSIGMTYMQTFRRIVAPQAFRVAVPPLSNEFIGLFKNTSL
          ||||||||||||||||||||||||||||||||||||||||||||||||||||||||||||
g705      ASETIRAAILSVPKGQWEAGFSIGMTYMQTFRRIVAPQAFRVAVPPLSNEFIGLFKNTSL
                130        140        150        160        170        180

190        200        210        220        230       239
m705.pep  AAVVTVTELFRVAQETANRTYDFLPVYIEAALVYWCFCKVLFLIQARLEKRFDRYVAKX
          |||||||||||||||||||||||||||||||||||||||||||||||||||||||||||
g705      AAVVTVTELFRVAQETANRTYDFLPVYIEAALVYWCFCKVLFLIQARLEKRFDRYVAKX
                190        200        210        220        230
```

The following partial DNA sequence was identified in *N. meningitidis* <SEQ ID 2361>:

```
a705.seq
  1  GTGTTCAATA ATTTCCTTGC TTCGCTGCCG TTTATGACGG AAACACGCGC

51  CGATATGATT GTCAGCGCGT TTTTGCCTAT GGTCAAAGCC GGCTTCGCGG

101  TCTCTCTGCC TTTGGCGGCA GCTTCTTTCG TTATCGGTAT GATGATTGCG

151  GTAGCCGTGG CTTTGGTGCG GATTATGCCC GCCGGCGGCA TCGTGCGGAA

201  AATCCTGCTG AAATTGGTGG AATTTTATAT TTCCGTCATT CGCGGTACGC

251  CGCTGTTGGT TCAGCTTGTG ATTGTGTTTT ACGGGCTGCC TTCCGTCGGC

301  ATCTATATCG ACCCGATTCC TGCCGCCATC ATCGGCTTTT CGCTCAATGT

351  CGGCGCATAT GCTTCCGAAA CCATACGCGC GGCAATTTTG TCCGTACCGA

401  AAGGCCAATG GGAAGCAGGT TTCTCCATCG GCATGACCTA TATGCAGACG

451  TTCCGCCGCA TCGTCGCGCC GCAGGCATTT CGCGTTGCCG TGCCGCCTTT

501  GAGCAACGAG TTTATCGGTT TGTTTAAAAA CACCTCGCTC GCGGCAGTCG
```

-continued

```
551  TGACGGTAAC GGAATTATTC CGCGTCGCGC AGGAAACGGC AAACCGCACT

601  TATGACTTTT TGCCCGTCTA TATCGAAGCC GCTTTGGTTT ACTGGTGTTT

651  TTGTAAAGTG CTGTTCCTGA TTCAGGCGCG TTTGGAAAAA CGTTTCGACC

701  GCTACGTCGC CAAATAA
```

This corresponds to the amino acid sequence <SEQ ID 2362; ORF 705.a>:

```
a705.pep
   1   VFNNFLASLP FMTETRADMI VSAFLPMVKA GFAVSLPLAA ASFVIGMMIA

51   VAVALVRIMP AGGIVRKILL KLVEFYISVI RGTPLLVQLV IVFYGLPSVG

101   IYIDPIPAAI IGFSLNVGAY ASETIRAAIL SVPKGQWEAG FSIGMTYMQT

151   FRRIVAPQAF RVAVPPLSNE FIGLFKNTSL AAVVTVTELF RVAQETANRT

201   YDFLPVYIEA ALVYWCFCKV LFLIQARLEK RFDRYVAK*
```

Computer analysis of this amino acid sequence gave the following results:
Homology with a Predicted ORF from *N. meningitidis*
ORF 705 shows 100.0% identity over a 238 aa overlap with a predicted ORF (ORF 705) from *N. meningitidis*:
a705/m705 100.0% identity in 238 aa overlap

```
                 10         20         30         40         50         60
    a705.pep  VFNNFLASLPFMTETRADMIVSAFLPMVKAGFAVSLPLAAASFVIGMMIAVAVALVRIMP
              ||||||||||||||||||||||||||||||||||||||||||||||||||||||||||||
    m705      VFNNFLASLPFMTETRADMIVSAFLPMVKAGFAVSLPLAAASFVIGMMIAVAVALVRIMP
                 10         20         30         40         50         60

70         80         90        100        110        120
    a705.pep  AGGIVRKILLKLVEFYISVIRGTPLLVQLVIVFYGLPSVGIYIDPIPAAIIGFSLNVGAY
              ||||||||||||||||||||||||||||||||||||||||||||||||||||||||||||
    m705      AGGIVRKILLKLVEFYISVIRGTPLLVQLVIVFYGLPSVGIYIDPIPAAIIGFSLNVGAY
                 70         80         90        100        110        120

130        140        150        160        170        180
    a705.pep  ASETIRAAILSVPKGQWEAGFSIGMTYMQTFRRIVAPQAFRVAVPPLSNEFIGLFKNTSL
              ||||||||||||||||||||||||||||||||||||||||||||||||||||||||||||
    m705      ASETIRAAILSVPKGQWEAGFSIGMTYMQTFRRIVAPQAFRVAVPPLSNEFIGLFKNTSL
                130        140        150        160        170        180

190        200        210        220        230     239
    a705.pep  AAVVTVTELFRVAQETANRTYDFLPVYIEAALVYWCFCKVLFLIQARLEKRFDRYVAKX
              |||||||||||||||||||||||||||||||||||||||||||||||||||||||||||
    m705      AAVVTVTELFRVAQETANRTYDFLPVYIEAALVYWCFCKVLFLIQARLEKRFDRYVAKX
                190        200        210        220        230
```

The following partial DNA sequence was identified in *N. gonorrhoeae* <SEQ ID 2363>:

```
g706.seq
   1   ATGAACTCCT CGCAACGCAA ACGCCTTTCC GgccGCTGGC TCAACTCCTA

51   CGAACGCTac cGCCaccGCC GCCTCATACA TGCCGTGCGG CTCGGCggaa 101   ccgtCCTGTT CGCCACCGCA CTCGCCCGgc tACTCCACCT CCAacacggc 151   gAATGGATAG GGAtgaCCGT CTTCGTCGTC CTCGGCATGC TCCAGTTCCA 201   AGGCgcgatt tActccaacg cggtgGAacg taTGctcggt acggtcatcg 251   ggctgGGCGC GGGTTTGGgc gTTTTATGGC TGAACCAGCA TTAtttccac 301   ggcaacCTcc tcttctacct gaccatcggc acggcaagcg cactggccgg 351   ctGGGCGGCG GTCGGCAAAA acggctacgt ccctatgctg GCGGGGctgA 401   CGATGTGCAT gctcatcggc gACAACGGCA GCGAATGGCT CGACAGCGGC
```

-continued

```
 451    CTGATGCGCG CGATGAACGT CCTCATCGGC GCCGCCATCG CCATTGCCGC
 501    CGCCAAACTG CTGCCGCTGA ATCCACACT GATGTGGCGT TTCATGCTTG
 551    CCGACAACCT GGCCGACTGC AGCAAAATGA TTGCCGAAAT CAGCAACGGC
 601    AGGCGTATGA CGCGCGAACG TTTGGAGCAG AATATGGTCA AAATGCGCCA
 651    AATCAACGCA CGCATGGTCA AAAGCCGCAG CCACCTCGCC GCCACATCGG
 701    GCGAAAGCCG CATCAGCCCC TCCATGATGG AAGCCATGCA GCACGCCCAC
 751    CGCAAAATCG TCAACACCAC CGAGCTGCTC CTGACCACCG CCGCCAAGCT
 801    GCAATCTCCC AAACTCAACG GCAGCGAAAT CCGGCTGCTC GACCGCCACT
 851    TCACACTGCT CCAAACCGAC CTGCAACAAA CCGCCGCCCT CATCAACGGC
 901    AGACACGCCC GCCGCATCCG CATCGACACC GCCATCAACC CCGAACTGGA
 951    AGCCCTCGCC GAACACCTCC ACTACCAATG GCAGGGCTTC CTCTGGCTCA
1001    GCACCAATAT GCGTCAGGAA ATTTCCGCCC TCGTCATCCT GCTGCAACGC
1051    ACCCGCCGCA AATGGCTGGA TGCCCACGAA CGCCAACACC TGCGCCAAAG
1101    CCTGCTTGAA ACACGGGAAC ACGGCTGA
```

This corresponds to the amino acid sequence <SEQ ID 2364; ORF 706.ng>:

```
g706.pep
   1    MNSSQRKRLS GRWLNSYERY RHRRLIHAVR LGGTVLFATA LARLLHLQHG
  51    EWIGMTVFVV LGMLQFQGAI YSNAVERMLG TVIGLGAGLG VLWLNQHYFH
 101    GNLLFYLTIG TASALAGWAA VGKNGYVPML AGLTMCMLIG DNGSEWLDSG
 151    LMRAMNVLIG AAIAIAAAKL LPLKSTLMWR FMLADNLADC SKMIAEISNG
 201    RRMTRERLEQ NMVKMRQINA RMVKSRSHLA ATSGESRISP SMMEAMQHAH
 251    RKIVNTTELL LTTAAKLQSP KLNGSEIRLL DRHFTLLQTD LQQTAALING
 301    RHARRIRIDT AINPELEALA EHLHYQWQGF LWLSTNMRQE ISALVILLQR
 351    TRRKWLDAHE RQHLRQSLLE TREHG*
```

The following partial DNA sequence was identified in *N. meningitidis* <SEQ ID 2365>:

```
m706.seq
   1    ATGAACACCT CGCAACGCAA CCGCCTCGTC AGCCGCTGGC TCAACTCCTA
  51    CGAACGCTAC CGCTACCGCC GCCTCATCCA CGCCGTCCGG CTCGGCGGGG
 101    CCGTCCTGTT CGCCACCGCC TCCGCCCGGC TGCTCCACCT CCAACACGGC
 151    GAGTGGATAG GGATGACCGT CTTCGTCGTC CTCGGCATGC TCCAGTTTCA
 201    AGGGGCGATT TACTCCAAGG CGGTGGAACG TATGCTCGGC ACGGTCATCG
 251    GGCTGGGCGC GGGTTTGGGC GTTTTATGGC TGAACCAGCA TTATTTCCAC
 301    GGCAACCTCC TCTTCTACCT CACCGTCGGC ACGGCAAGCG CACTGGCCGG
 351    CTGGGCGGCG GTCGGCAAAA ACGGCTACGT CCCTATGCTG GCAGGGCTGA
 401    CGATGTGTAT GCTCATCGGC GACAACGGCA GCGAATGGCT CGACAGCGGA
 451    CTCATGCGCG CCATGAACGT CCTCATCGGC GCGGCCATCG CCATCGCCGC
 501    CGCCAAACTG CTGCCGCTGA ATCCACACT GATGTGGCGT TTCATGCTTG
 551    CCGACAACCT GGCCGACTGC AGCAAAATGA TTGCCGAAAT CAGCAACGGC
```

```
-continued
 601 AGGCGCATGA CCCGCGAACG CCTCGAGGAG AACATGGCGA AAATGCGCCA
 651 AATCAACGCA CGCATGGTCA AAGCCGCAG CCATCTCGCC GCCACATCGG
 701 GCGAAAGCCG CATCAGCCCC GCCATGATGG AAGCCATGCA GCACGCCCAC
 751 CGTAAAATCG TCAACACCAC CGAGCTGCTC CTGACCACCG CCGCCAAGCT
 801 GCAATCTCCC AAACTCAACG GCAGCGAAAT CCGGCTGCTT GACCGCCACT
 851 TCACACTGCT CCAAACCGAC CTGCAACAAA CCGTCGCCCT TATCAACGGC
 901 AGACACGCCC GCCGCATCCG CATCGACACC GCCATCAACC CCGAACTGGA
 951 AGCCCTCGCC GAACACCTCC ACTACCAATG GCAGGGCTTC CTCTGGCTCA
1001 GCACCAATAT GCGTCAGGAA ATTTCCGCCC TCGTCATCCT GCTGCAACGC
1051 ACCCGCCGCA AATGGCTGGA TGCCCACGAA CGCCAACACC TGCGCCAAAG
1101 CCTGCTTGAA ACACGGGAAC ACGGCTGA
```

This corresponds to the amino acid sequence <SEQ ID 2366; ORF 706>:

```
m706.pep
  1 MNTSQRNRLV SRWLNSYERY RYRRLIHAVR LGGAVLFATA SARLLHLQHG
 51 EWIGMTVFVV LGMLQFQGAI YSKAVERMLG TVIGLGAGLG VLWLNQHYFH
101 GNLLFYLTVG TASALAGWAA VGKNGYVPML AGLTMCMLIG DNGSEWLDSG
151 LMRAMNVLIG AAIAIAAAKL LPLKSTLMWR FMLADNLADC SKMIAEISNG
201 RRMTRERLEE NMAKMRQINA RMVKSRSHLA ATSGESRISP AMMEAMQHAH
251 RKIVNTTELL LTTAAKLQSP KLNGSEIRLL DRHFTLLQTD LQQTVALING
301 RHARRIRIDT AINPELEALA EHLHYQWQGF LWLSTNMRQE ISALVILLQR
351 TRRKWLDAHE RQHLRQSLLE TREHG*
``` m706/g706 96.5% identity in 375 aa overlap

```
              10         20         30         40         50         60
m706.pep MNTSQRNRLVSRWLNSYERYRYRRLIHAVRLGGAVLFATASARLLHLQHGEWIGMTVFVV
         ||:|||:||  :|||||||||:|||||||||||:|||||  ||||||||||||||||||
g706     MNSSQRKRLSGRWLNSYERHRYRRLIHAVRLGGTVLFATALARLLHLQHGEWIGMTVFVV
              10         20         30         40         50         60

70         80         90        100        110        120
m706.pep LGMLQFQGAIYSKAVERMLGTVIGLGAGLGVLWLNQHYFHGNLLFYLTVGTASALAGWAA
         |||||||||||:||||||||||||||||||||||||||||||||||:|||||||||||||
g706     LGMLQFQGAIYSNAVERMLGTVIGLGAGLGVLWLNQHYFHGNLLFYLTIGTASALAGWAA
              70         80         90        100        110        120

130        140        150        160        170        180
m706.pep VGKNGYVPMLAGLTMCMLIGDNGSEWLDSGLMRAMNVLIGAAIAIAAAKLLPLKSTLMWR
         ||||||||||||||||||||||||||||||||||||||||||||||||||||||||||||
g706     VGKNGYVPMLAGLTMCMLIGDNGSEWLDSGLMRAMNVLIGAAIAIAAAKLLPLKSTLMWR
             130        140        150        160        170        180

190        200        210        220        230        240
m706.pep FMLADNLADCSKMIAEISNGRRMTRERLEENMAKMRQINARMVKSRSHLAATSGESRISP
         |||||||||||||||||||||||||||||||:||:|||||||||||||||||||||||||
g706     FMLADNLADCSKMIAEISNGRRMTRERLEQNMVKMRQINARMVKSRSHLAATSGESRISP
             190        200        210        220        230        240

250        260        270        280        290        300
m706.pep AMMEAMQHAHRKIVNTTELLLTTAAKLQSPKLNGSEIRLLDRGFTLLQTDLQQTVALING
         :||||||||||||||||||||||||||||||||||||||||||:|||||||||||:||||
g706     SMMEAMQHAHRKIVNTTELLLTTAAKLQSPKLNGSEIRLLDRGFTLLQTDLQQTAALING
             250        260        270        280        290        300

310        320        330        340        350        360
m706.pep RHARRIRIDTAINPELEALAEHLHYQWQGFLWLSTNMRQEISALVILLQRTRRKWLDAHE
         ||||||||||||||||||||||||||||||||||||||||||||||||||||||||||||
g706     RHARRIRIDTAINPELEALAEHLHYQWQGFLWLSTNMRQEISALVILLQRTRRKWLDAHE
             310        320        330        340        350        360
```

```
                     370
m706.pep    RQHLRQSLLETREHGX
            ||||||||||||||||
g706        RQHLRQSLLETREHGX
                     370
```

The following partial DNA sequence was identified in *N. meningitidis* <SEQ ID 2367>:

```
a706.seq
    1   ATGAACACCT CGCAACGCAA CCGCCTCGTC AGCCGCTGGC TCAACTCCTA
   51   CGAACGCTAC CGCTACCGCC GCCTCATCCA CGCCGTCCGG CTCGGCGGGG
  101   CCGTCCTGTT CGCCACCGCC TCCGCCCGGC TGCTCCACCT CCAACACGGC
  151   GAGTGGATAG GGATGACCGT CTTCGTCGTC CTCGGCATGC TCCAGTTTCA
  201   AGGGGCGATT TACTCCAAGG CGGTGGAACG TATGCTCGGC ACGGTCATCG
  251   GGCTGGGCGC GGGTTTGGGC GTTTTATGGC TGAACCAGCA TTATTTCCAC
  301   GGCAACCTCC TCTTCTACCT CACCGTCGGC ACGGCAAGCG CACTGGCCGG
  351   CTGGGCGGCG GTCGGCAAAA ACGGCTACGT CCCTATGCTG GCGGGGCTGA
  401   CGATGTGCAT GCTCATCGGC GACAACGGCA GCGAATGGTT CGACAGCGGC
  451   CTGATGCGCG CGATGAACGT CCTCATCGGC GCGGCCATCG CCATCGCCGC
  501   CGCCAAACTG CTGCCGCTGA AATCCACACT GATGTGGCGT TTCATGCTTG
  551   CCGACAACCT GACCGACTGC AGCAAAATGA TTGCCGAAAT CAGCAACGGC
  601   AGGCGCATGA CCCGCGAACG CCTCGAAGAG AACATGGCGA AAATGCGCCA
  651   AATCAACGCA CGCATGGTCA AAAGCCGCAG CCACCTCGCC GCCACATCGG
  701   GCGAAAGCCG CATCAGCCCC GCCATGATGG AAGCCATGCA GCACGCCCAC
  751   CGTAAAATTG TCAACACCAC CGAGCTGCTC CTGACCACCG CCGCCAAGCT
  801   GCAATCTCCC AAACTCAACG GCAGCGAAAT CCGGCTGCTT GACCGCCACT
  851   TCACACTGCT CCAAACCGAC CTGCAACAAA CCGTCGCCCT TATCAACGGC
  901   AGACACGCCC GCCGCATCCG CATCGACACC GCCATCAACC CCGAACTGGA
  951   AGCCCTCGCC GAACACCTCC ACTACCAATG GCAGGGCTTC CTCTGGCTCA
 1001   GCACCAATAT GCGTCAGGAA ATTTCCGCCC TCGTCATCCT GCTGCAACGC
 1051   ACCCGCCGCA AATGGCTGGA TGCCCACGAA CGCCAACACC TGCGCCAAAG
 1101   CCTGCTTGAA ACACGGGAAC ACAGTTGA
```

This corresponds to the amino acid sequence <SEQ ID 2368; ORF 706.a>:

```
a706.pep
    1   MNTSQRNRLV SRWLNSYERY RYRRLIHAVR LGGAVLFATA SARLLHLQHG
   51   EWIGMTVFVV LGMLQFQGAI YSKAVERMLG TVIGLGAGLG VLWLNQHYFH
  101   GNLLFYLTVG TASALAGWAA VGKNGYVPML AGLTMCMLIG DNGSEWFDSG
  151   LMRAMNVLIG AAIAIAAAKL LPLKSTLMWR FMLADNLTDC SKMIAEISNG
  201   RRMTRERLEE NMAKMRQINA RMVKSRSHLA ATSGESRISP AMMEAMQHAH
  251   RKIVNTTELL LTTAAKLQSP KLNGSEIRLL DRHFTLLQTD LQQTVALING
  301   RHARRIRIDT AINPELEALA EHLHYQWQGF LWLSTNMRQE ISALVILLQR
  351   TRRKWLDAHE RQHLRQSLLE TREHS*
``` a706/m706 99.5% identity in 374 aa overlap

```
             10         20         30         40         50         60
a706.pep  MNTSQRNRLVSRWLNSYERYRYRRLIHAVRLGGAVLFATASARLLHLQHGEWIGMTVFVV
          ||||||||||||||||||||||||||||||||||||||||||||||||||||||||||||
m706      MNTSQRNRLVSRWLNSYERYRYRRLIHAVRLGGAVLFATASARLLHLQHGEWIGMTVFVV
             10         20         30         40         50         60

70         80         90        100        110        120
a706.pep  LGMLQFQGAIYSKAVERMLGTVIGLGAGLGVLWLNQHYFHGNLLFYLTVGTASALAGWAA
          ||||||||||||||||||||||||||||||||||||||||||||||||||||||||||||
m706      LGMLQFQGAIYSKAVERMLGTVIGLGAGLGVLWLNQHYFHGNLLFYLTVGTASALAGWAA
             70         80         90        100        110        120

130        140        150        160        170        180
a706.pep  VGKNGYVPMLAGLTMCMLIGDNGSEWFDSGLMRAMNVLIGAAIAIAAAKLLPLKSTLMWR
          |||||||||||||||||||||||||||||| |||||||||||||||||||||||||||||
m706      VGKNGYVPMLAGLTMCMLIGDNGSEWLDSGLMRAMNVLIGAAIAIAAAKLLPLKSTLMWR
            130        140        150        160        170        180

190        200        210        220        230        240
a706.pep  FMLADNLTDCSKMIAEISNGRRMTRERLEENMAKMRQINARMVKSRSHLAATSGESRISP
          ||||||| ||||||||||||||||||||||||||||||||||||||||||||||||||||
m706      FMLADNLADCSKMIAEISNGRRMTRERLEENMAKMRQINARMVKSRSHLAATSGESRISP
            190        200        210        220        230        240

250        260        270        280        290        300
a706.pep  AMMEAMQHAHRKIVNTTELLLTTAAKLQSPKLNGSEIRLLDRGFTLLQTDLQQTVALING
          ||||||||||||||||||||||||||||||||||||||||||||||||||||||||||||
m706      AMMEAMQHAHRKIVNTTELLLTTAAKLQSPKLNGSEIRLLDRGFTLLQTDLQQTVALING
            250        260        270        280        290        300

310        320        330        340        350        360
a706.pep  RHARRIRIDTAINPELEALAEHLHYQWQGFLWLSTNMRQEISALVILLQRTRRKWLDAHE
          ||||||||||||||||||||||||||||||||||||||||||||||||||||||||||||
m706      RHARRIRIDTAINPELEALAEHLHYQWQGFLWLSTNMRQEISALVILLQRTRRKWLDAHE
            310        320        330        340        350        360

370
a706.pep  RQHLRQSLLETREHSX
          ||||||||||||||:|
m706      RQHLRQSLLETREHGX
            370
``` g707.seq not found
g707.pep not found
The following partial DNA sequence was identified in *N. meningitidis* <SEQ ID 2369>:

```
m707.seq
   1    ATGGAAATTA TTAACGATGC AGAACTTATC CGTTCCATGC AGCGTCAGCA

51    GCACATAGAT GCTGAATTGT TAACTGATGC AAATGTCCGT TTCGAGCAAC

101    CATTGGAGAA GAACAATTAT GTCCTGAGTG AAGATGAAAC ACCGTGTACT

151    CGGGTAAATT ACATTAGTTT AGATGATAAG ACGGTGCGCA AATTTTCTTT

201    TCTTCCTTCT GTGCTCATGA AGAAACAGC TTTTAAAACT GGGATGTGTT

251    TAGGTTCCAA TAATTTGAGC AGGCTACAAA AAGCCGCGCA ACAGATACTG

301    ATCGTGCGTG GCTACCTCAC TTCCCAAGCT ATTATCCAAC ACAGAATAT

351    GGATTCGGGA ATTCTGAAAT TACGGGTATC AGCAGGCGAA ATAGGGGATA

401    TCCGCTATGA AGAAAAACGG GATGGGAAGT CTGCCGAGGG CAGTATTAGT

451    GCATTCAATA ACAAATTTCC CTTATATAGG AACAAAATTC TCAATCTTCG

501    CGATGTAGAG CAGGGCTTGG AAAAACCTGCG TCGTTTGCCG AGTGTTAAAA

551    CAGATATTCA GATTATACCG TCCGAAGAAG AAGGCAAAAG CGATTTACAG

601    ATCAAATGGC AGCAGAATAA ACCCATACGG TTCAGTATCG GTATAGATGA

651    TGCGGGCGGC AAAACGACCG GCAAATATCA AGGAAATGTC GCTTTATCGT

701    TCGATAACCC TTTGGGCTTA AGCGATTTGT TTTATGTTTC ATATGGACGC

751    GGTTTGGCGC ACAAAACGGA CTTGACTGAT GCCACCGGTA CGGAAACTGA

801    AAGCGGATCC AGAAGTTACA GCGTGCATTA TTCGGTGCCC GTAAAAAAAT
```

```
                                 -continued
 851    GGCTGTTTTC TTTTAATCAC AATGGACATC GTTACCACGA AGCAACCGAA

901    GGCTATTCCG TCAATTACGA TTACAACGGC AAACAATATC AGAGCAGCCT

951    GGCCGCCGAG CGCATGCTTT GGCGTAACAG ACTTCATAAA ACTTCAGTCG

1001    GAATGAAATT ATGGACACGC CAAACCTATA AATACATCGA CGATGCCGAA

1051    ATCGAAGTAC AACGCCGCCG CTCTGCAGGC TGGGAAGCCG AATTGCGCCA

1101    CCGTGCTTAC CTCAACCGTT GGCAGCTTGA CGGCAAGTTG TCTTACAAAC

1151    GCGGGACCGG CATGCGCCAA AGTATGCCTG CACCGGAAGA AAACGGCGGC

1201    GATATTCTTC CAGGTACATC TCGTATGAAA ATCATTACTG CCAGTTTGGA

1251    CGCAGCCGCC CCATTTATTT TAGGCAAACA GCAGTTTTTC TACGCAACCG

1301    CCATTCAAGC TCAATGGAAC AAAACGCCGT TGGTTGCCCA AGATAAATTG

1351    TCAATCGGCA GCCGCTACAC CGTTCGCGGA TTTGATGGGG AGCAGAGTCT

1401    TTTCGGAGAG CGAGGTTTCT ACTGGCAGAA TACTTTAACT TGGTATTTTC

1451    ATCCGAACCA TCAGTTCTAT CTCGGTGCGG ACTATGGCCG CGTATCTGGC

1501    GAAAGTGCAC AATATGTATC GGGCAAGCAG CTGATGGGTG CAGTGGTCGG

1551    CTTCAGAGGA GGGCATAAAG TAGGCGGTAT GTTTGCTTAT GATCTGTTTG

1601    CCGGCAAGCC GCTTCATAAA CCCAAAGGCT TTCAGACGAC CAACACCGTT

1651    TACGGCTTCA ACTTGAATTA CAGTTTCTAA
```

This corresponds to the amino acid sequence <SEQ ID 2370; ORF 707>:

```
m707.pep
   1    MEIINDAELI RSMQRQQHID AELLTDANVR FEQPLEKNNY VLSEDETPCT

51    RVNYISLDDK TVRKFSFLPS VLMKETAFKT GMCLGSNNLS RLQKAAQQIL

101    IVRGYLTSQA IIQPQNMDSG ILKLRVSAGE IGDIRYEEKR DGKSAEGSIS

151    AFNNKFPLYR NKILNLRDVE QGLENLRRLP SVKTDIQIIP SEEEGKSDLQ

201    IKWQQNKPIR FSIGIDDAGG KTTGKYQGNV ALSFDNPLGL SDLFYVSYGR

251    GLAHKTDLTD ATGTETESGS RSYSVHYSVP VKKWLFSFNH NGHRYHEATE

301    GYSVNYDYNG KQYQSSLAAE RMLWRNRLHK TSVGMKLWTR QTYKYIDDAE

351    IEVQRRRSAG WEAELRHRAY LNRWQLDGKL SYKRGTGMRQ SMPAPEENGG

401    DILPGTSRMK IITASLDAAA PFILGKQQFF YATAIQAQWN KTPLVAQDKL

451    SIGSRYTVRG FDGEQSLFGE RGFYWQNTLT WYFHPNHQFY LGADYGRVSG

501    ESAQYVSGKQ LMGAVVGFRG GHKVGGMFAY DLFAGKPLHK PKGFQTTNTV

551    YGFNLNYSF*
```

The following partial DNA sequence was identified in *N. meningitidis* <SEQ ID 2371>:

```
a707.seq
   1    NTGAAAGAAA CAGCTTTTAA AACTGGGATG TGTTTAGGTT CCAATAATTT

51    GAGCAGGCTA CAAAAAGCCG CGCAACAGAT ACTGATTGTG CGTGGCTACC

101    TCACTTCCCA AGCTATTATC CAACCACAGA ATATGGATTC GGGAATTCTG

151    AAATTACGGG TATCAGCAGG CGAAATAGGN GATATCCGCT ATGAAGAAAA

201    ACGGGATGNG AAGTCTGCCG AGGGCAGTAT TAGTGCATTC AATAACAAAN
```

```
-continued
 251    TTCCCTTATA TAGGAACAAA ATTCTCAATC TTCGCGATGT AGAGCAGGGC

301    TTGGAAAACC TGCGTCGTTT GCCGAGTGTT AAAACAGATA TTCAGATTAT

351    ACCGTCCGAA GAAGAAGGCA AAAGCGATTT ACAGATCAAA TGGCAGCAGA

401    ATAAACCCAT ACGGTTCAGT ATCGGTATAG ATGATGCGGG CGGCAAAACG

451    ACCGGCAAAT ATCAAGGAAA TGTCGCTTTA TCGTNCGATA ACCCTTTGGG

501    NTTAAGCGAT TNGTTTTATG TTTCATATGG ACGCGGTTTG GTGCACAAAA

551    CGGACTTGAC TGNTGCCACC GGTACGGAAA CTGAAAGCGG ATCCAGAAGT

601    TACAGCGTGC ATTATTCGGT GNNCGTAAAA AAATGGCTGT TTTCTTTTAA

651    TCACAATGGA CATCGTTACC ACGAAGCAAC CGAAGGCTAT TCCGTCAATT

701    ACGATTACAA CGGCAAACAA TATCAGAGCA GCCTGGCCGC CGAGCGCATG

751    CTTTGGNNNN NNAGNTTTCN TNAAACTTCA GTCNGAATGA AATTATGGAC

801    ACGCCAAACC TATAAATACA TCGACGATGC CGAAATCGAA GTGCAACGCC

851    GCCGCTCTGC AGGCTGGGAA GCCGAATTGC GCCACCGTGC TTACCTCNAC

901    CGTTGGCAGC TTGACGGCAA GTTGTCTTAC AAACGCGGGA CCGGCATGCG

951    CCAAAGTATG CCCGCACCTG AAGAAACGG CGGCGGTACT ATTCCAGNCA

1001    NATCCCGTAT GAAAATCATA ACCGCCGGAT TGGATGCAGC GGCCCCGTNT

1051    ATGTTGGGCA AACAGCAGTT TTTCTACGCA ACCGCCATTC AAGCTCAATG

1101    GAACAAAACG CCTTTGGTTG CCCAAGACAA GTTGTCTATC GGCAGCCGCT

1151    ACACCGTTCG CGGATTTGAT GGGGAGCAGA GTCTTTTCGG AGAGCGAGGT

1201    TTCTACTGGC AGAATACTTT AACTTGGTAT TTTCATCCGA ACCATCAGTT

1251    CTATCTCGGT GCGGACTATG GCCGCGTATC TGGCGAAAGT GCACAATATG

1301    TATCGGGCAA GCAGCTGATG GGTGCAGTGG TCGGCTTCAG AGGAGGGCAT

1351    AAAGTAGGCG GTATGTTTGC TTATGATCTG TTTGCCGGCA AGCCGCTTCA

1401    TAAACCCAAA GGCTTTCAGA CGACCAACAC CGTTTACGGC TTCAACTTGA

1451    ATTACAGTTT CTAA
```

This corresponds to the amino acid sequence <SEQ ID 2372; ORF 707.a>:

```
a707.pep
   1    XKETAFKTGM CLGSNNLSRL QKAAQQILIV RGYLTSQAII QPQNMDSGIL

51    KLRVSAGEIG DIRYEEKRDX KSAEGSISAF NNKXPLYRNK ILNLRDVEQG

101    LENLRRLPSV KTDIQIIPSE EEGKSDLQIK WQQNKPIRFS IGIDDAGGKT

151    TGKYQGNVAL SXDNPLGLSD XFYVSYGRGL VHKTDLTXAT GTETESGSRS

201    YSVHYSVXVK KWLFSFNHNG HRYHEATEGY SVNYDYNGKQ YQSSLAAERM

251    LWXXXFXXTS VXMKLWTRQT YKYIDDAEIE VQRRRSAGWE AELRHRAYLX

301    RWQLDGKLSY KRGTGMRQSM PAPEENGGGT IPXXSRMKII TAGLDAAAPX

351    MLGKQQFFYA TAIQAQWNKT PLVAQDKLSI GSRYTVRGFD GEQSLFGERG

401    FYWQNTLTWY FHPNHQFYLG ADYGRVSGES AQYVSGKQLM GAVVGFRGGH

451    KVGGMFAYDL FAGKPLHKPK GFQTTNTVYG FNLNYSF*
``` a707/m707 95.3% identity in 486 aa overlap

```
                          10        20        30
a707.pep          XKETAFKTGMCLGSNNLSRLQKAAQQILIVR
                  ||||||||||||||||||||||||||||||
m707     EDETPCTRVNYISLDDKTVRKFSFLPSVLMKETAFKTGMCLGSNNLSRLQKAAQQILIVR
            50        60        70        80        90       100

40        50        60        70        80        90
a707.pep GYLTSQAIIQPQNMDSGILKLRVSAGEIGDIRYEEKRDXKSAEGSISAFNNKXPLYRNKI
         |||||||||||||||||||||||||||||||||||| ||||||||||||| |||||||
m707     GYLTSQAIIQPQNMDSGILKLRVSAGEIGDIRYEEKRDGKSAEGSISAFNNKFPLYRNKI
           110       120       130       140       150       160

100       110       120       130       140       150
a707.pep LNLRDCEQGLENLRRLPSVKTDIQIIPSEEEGKSDLQIKWQQNKPIRFSIGIDDAGGKTT
         ||||||||||||||||||||||||||||||||||||||||||||||||||||||||||||
m707     LNLRDCEQGLENLRRLPSVKTDIQIIPSEEEGKSDLQIKWQQNKPIRFSIGIDDAGGKTT
           170       180       190       200       210       220

160       170       180       190       200       210
a707.pep GKYQGNVALSXDNPLGLSDXFYVSYGRGLVHKTDLTXATGTETESGSRSYSVHYSVXVKK
         ||||||||||| ||||||||| ||||||||| |||||| ||||||||||||||||| |||
m707     GKYQGNVALSFDNPLGLSDLFYVSYGRGLAHKTDLTDATGTETESGSRSYSVHYSVPVKK
           230       240       250       260       270       280

220       230       240       250       260       270
a707.pep WLFSFNHNGHRYHEATEGYSVNYDYNGKQYQSSLAAERMLWXXXFXXTSVXMKLWTRQTY
         ||||||||||||||||||||||||||||||||||||||||| : ||| ||||||||||||
m707     WLFSFNHNGHRYHEATEGYSVNYDYNGKQYQSSLAAERMLWRNLHKTSVGMKLWTRQTY
           290       300       310       320       330       340

280       290       300       310       320       330
a707.pep KYIDDAEIEVQRRRSAGWEAELRHRAYLXRWQLDGKLSYKRGTGMRQSMPAPEENGGGTI
         |||||||||||||||||||||||||||| ||||||||||||||||||||||||||||| :
m707     KYIDDAEIEVQRRRSAGWEAELRHRAYLNRWQLDGKLSYKRGTGMRQSMPAPEENGGDIL
           350       360       370       380       390       400

340       350       360       370       380       390
a707.pep PXXSRMKIITAGLDAAAPXMLGKQQFFYATAIQAQWNKTPLVAQDKLSIGSRYTVRGFDG
         | :|||||||| :||||||| :||||||||||||||||||||||||||||||||||||||
m707     PGTSRMKIITASLDAAAPFILGKQQFFYATAIQAQWNKTPLVAQDKLSIGSRYTVRGFDG
           410       420       430       440       450       460

400       410       420       430       440       450
a707.pep EQSLFGERGFYWQNTLTWYFHPNHQFYLGADYGRVSGESAQYVSGKQLMGAVVGFRGGHK
         ||||||||||||||||||||||||||||||||||||||||||||||||||||||||||||
m707     EQSLFGERGFYWQNTLTWYFHPNHQFYLGADYGRVSGESAQYVSGKQLMGAVVGFRGGHK
           470       480       490       500       510       520

460       470       480
a707.pep VGGMFAYDLFAGKPLHKPKGFQTTNTVYGFNLNYSFX
         |||||||||||||||||||||||||||||||||||||
m707     VGGMFAYDLFAGKPLHKPKGFQTTNTVYGFNLNYSFX
           530       540       550       560
```

The following partial DNA sequence was identified in *N. gonorrhoeae* <SEQ ID 2373>:

```
g708.seq
   1  ATGCCTTTTA AGCCATCCAA ACGAATCTCT TTATTACTTG TTCTTGCCTT

51  GGGCGCGTGC AGCACTTCCT ACCGCCCCTC GCGGGCAGAA AAAGCCAATC

101  AGGTTTCCAA TATCAAAACC CAGTTGGCGA TGGAATATAT GCGCGGTCAG

151  GACTACCGTC AGGCAACGGC AAGTATTGAA GATGCCTTGA AATCGAACCC

201  TAAAAACGAA CTTGCCTGGC TGGTCCGTGC CGAAATCTAT CAATACCTGA

251  AAGTTAACGA CAAGGCGCAG GAAAGTTTCC GGCAAGCCCT CTCCATCAAA

301  CCCGACAGTG CCGAAATCAA CAACAACTAC GGCTGGTTCC TGTGCGGCAG

351  GCTCAACCGC CCTGCCGAAT CTATGGCATA TTTCGACAAA GCCCTGGCCG

401  ACCCCACCTA CCCGACCCCT TATATTGCCA ACCTGAATAA AGGTATATGC

451  AGCGCAAAAC AGGGGCAATT CGGATTGGCG GAAGCCTATT TGAAACGTTC

501  CCTCGCCGCC CAGCCGCAGT TCCCACCCGC ATTTAAAGAA CTGGCGCGCA

551  CCAAAATGCT GGCCGGGCAG TTGGGCGATG CCGATTACTA CTTTAAAAAA

601  TACCAAAGCA GGGTAGAAGT CCTTCAGGCC GATGATTTGC TGCTAGGCTG
```

-continued

```
   651   GAAAATTGCC AAAGCCCTCG GCAACGTGCA GGCGGCATAC GAATATGAAG
   701   CACAATTGCA GGCAAATTTC CCCTACTCGG AAGAATTGCA AACCGTCCTC
   751   ACCGGTCAAT AA
```

This corresponds to the amino acid sequence <SEQ ID 2374; ORF 708.ng>:

```
g708.pep
     1   MPFKPSKRIS LLLVLALGAC STSYRPSRAE KANQVSNIKT QLAMEYMRGQ
    51   DYRQATASIE DALKSNPKNE LAWLVRAEIY QYLKVNDKAQ ESFRQALSIK
   101   PDSAEINNNY GWFLCGRLNR PAESMAYFDK ALADPTYPTP YIANLNKGIC
   151   SAKQGQFGLA EAYLKRSLAA QPQFPPAFKE LARTKMLAGQ LGDADYYFKK
   201   YQSRVEVLQA DDLLLGWKIA KALGNVQAAY EYEAQLQANF PYSEELQTVL
   251   TGQ*
```

The following partial DNA sequence was identified in *N. meningitidis* <SEQ ID 2375>:

```
m708.seq
     1   ATGCCTTTTA AGCCATCCAA ACGAATCTCT TTATTACTCG TTCTTGCCTT
    51   GGGCGCGTGC AGCACTTCCT ACCGCCCCTC GCGGGCAGAA AAAGCCAATC
   101   AGGTTTCCAA TATCAAAACC CAGTTGGCAA TGGAATATAT GCGCGGTCAG
   151   GACTACCGTC AGGCGACGGC AAGTATTGAA GACGCCCTGA AATCGGACCC
   201   TAAAAACGAG CTTGCCTGGC TGGTCCGTGC CGAAATCTAT CAATACCTGA
   251   AAGTTAACGA CAAGGCGCAG GAAAGTTTCC GGCAAGCCCT CTCCATCAAA
   301   CCCGACAGTG CCGAAATCAA CAACAACTAC GGTTGGTTCC TATGCGGCAG
   351   GCTCAACCGC CCTGCCGAAT CTATGGCATA TTTCGACAAA GCTCTGGCCG
   401   ACCCCACCTA CCCGACCCCT TATATTGCCA ACCTGAATAA AGGCATATGC
   451   AGCGCAAAAC AGGGGCAATT CGGATTGGCG GAAGCCTATT TGAAACGTTC
   501   CCTCGCCGCC CAGCCGCAGT TCCCACCCGC ATTTAAAGAA CTGGCGCGCA
   551   CCAAAATGCT GGCCGGGCAG TTGGGCGATG CCGATTACTA CTTTAAAAAA
   601   TACCAAAGCA GGGTAGAAGT CCTTCAGGCC GATGATTTGC TGCTAGGCTG
   651   GAAAATTGCC AAAGCCCTCG GCAACGCACA GGCGGCATAC GAATATGAAG
   701   CACAATTGCA GGCGAATTTC CCCTACTCGG AAGAATTGCA AACCGTCCTC
   751   ACCGGTCAAT AA
```

This corresponds to the amino acid sequence <SEQ ID 2376; ORF 708>:

```
m708.pep
     1   MPFKPSKRIS LLLVLALGAC STSYRPSRAE KANQVSNIKT QLAMEYMRGQ
    51   DYRQATASIE DALKSDPKNE LAWLVRAEIY QYLKVNDKAQ ESFRQALSIK
   101   PDSAEINNNY GWFLCGRLNR PAESMAYFDK ALADPTYPTP YIANLNKGIC
   151   SAKQGQFGLA EAYLKRSLAA QPQFPPAFKE LARTKMLAGQ LGDADYYFKK
   201   YQSRVEVLQA DDLLLGWKIA KALGNAQAAY EYEAQLQANF PYSEELQTVL
   251   TGQ*
``` m708/g708 99.2% identity in 253 aa overlap

```
                  10        20        30        40        50        60
   m708.pep  MPFKPSKRISLLLVLALGACSTSYRPSRAEKANQVSNIKTQLAMEYMRGQDYRQATASIE
             ||||||||||||||||||||||||||||||||||||||||||||||||||||||||||||
   g708      MPFKPSKRISLLLVLALGACSTSYRPSRAEKANQVSNIKTQLAMEYMRGQDYRQATASIE
                  10        20        30        40        50        60

70        80        90       100       110       120
   m708.pep  DALKSDPKNELAWLVRAEIYQYLKVNDKAQESFRQALSIKPDSAEINNNYGWFLCGRLNR
             |||||:||||||||||||||||||||||||||||||||||||||||||||||||||||||
   g708      DALKSNPKNELAWLVRAEIYQYLKVNDKAQESFRQALSIKPDSAEINNNYGWFLCGRLNR
                  70        80        90       100       110       120

130       140       150       160       170       180
   m708.pep  PAESMAYFDKALADPTYPTPYIANLNKGICSAKQGQFGLAEAYLKRSLAAQPQFPPAFKE
             ||||||||||||||||||||||||||||||||||||||||||||||||||||||||||||
   g708      PAESMAYFDKALADPTYPTPYIANLNKGICSAKQGQFGLAEAYLKRSLAAQPQFPPAFKE
                 130       140       150       160       170       180

190       200       210       220       230       240
   m708.pep  LARTKMLAGQLGDADYYFKKYQSRVEVLQADDLLLGWKIAKALGNAQAAYEYEAQLQANF
             ||||||||||||||||||||||||||||||||||||||||||||:|||||||||||||||
   g708      LARTKMLAGQLGDADYYFKKYQSRVEVLQADDLLLGWKIAKALGNVQAAYEYEAQLQANF
                 190       200       210       220       230       240

250
   m708.pep  PYSEELQTVLTGQX
             ||||||||||||||
   g708      PYSEELQTVLTGQX
                 250
```

25

The following partial DNA sequence was identified in *N. meningitidis* <SEQ ID 2377>:

```
a708.seq
     1  ATGCCTTTTA AGCCATCCAA ACGAATCTCT TTATTACTTG TCCTTGCCTT

51  GGGCGCGTGC AGCACTTCCT ACCGCCCCTC GCGGGCAGAA AAAGCCAATC

101  AGGTTTCCAA TATCAAAACC CAGTTGGCAA TGGAATATAT GCGCGGTCAG

151  GACTACCGTC AGGNGACGGC AAGTATTGAA GACGCCTTGA AATCAGACCC

201  TAAAAACGAG CTTGCCTGGC TGGTCCGTGC CGAAATCTAT CAATACCTGA

251  AAGTTAACGA CAAGGCGCAG GAAAGTTTCC GGCAAGNCCT CTCCATCAAA

301  CCCGACAGTG CCGAAATCAA CAACAACTAC NGCTGGTTCC TGTGCGGCAG

351  GCTCAACCGC CCTGCCGAAT CTATGGCATA TTTCGACAAA GCCCTGGCCG

401  ACCCCACNTA CCCGANCCCT TATATTGCCA ACCTGAATAA AGGCATATGC

451  AGCGCAAAAC AGGGGCAATT CGGATTGGCG GAAGCCTATT TGAAACGTTC

501  CCTCGCCGCC CAGCCGCAGT TCCCACCCGC ATTTAAAGAA CTGGCGCGCA

551  CCAAAATGCT GGCCGGGCAG TTGGGCGATG CCGATTACTA CTTTAAAAAA

601  TACCAAAGCA GGGTAGAAGT CCTTCAGGCC GATGATTTGC TGCTAGGCTG

651  GAAAATTGCC AAAGCCCTCG GCAACGCACA GGCGGCATAC GAATATGAAG

701  CACAATTGCA GGCGAATTTC CCCTACTCGG AAGAATTGCA AACCGTCCTC

751  ATCGGTCAAT AA
```

This corresponds to the amino acid sequence <SEQ ID 2378; ORF 708.a>:

```
a708.pep
     1  MPFKPSKRIS LLLVLALGAC STSYRPSRAE KANQVSNIKT QLAMEYMRGQ

51  DYRQXTASIE DALKSDPKNE LAWLVRAEIY QYLKVNDKAQ ESFRQXLSIK

101  PDSAEINNNY XWFLCGRLNR PAESMAYFDK ALADPTYPXP YIANLNKGIC

151  SAKQGQFGLA EAYLKRSLAA QPQFPPAFKE LARTKMLAGQ LGDADYYFKK
```

```
201  YQSRVEVLQA DDLLLGWKIA KALGNAQAAY EYEAQLQANF PYSEELQTVL

251  IGQ*
``` a708/m708 98.0% identity in 253 aa overlap

```
                 10         20         30         40         50         60
a708.pep  MPFKPSKRISLLLVLALGACSTSYRPSRAEKANQVSNIKTQLAMEYMRGQDYRQXTASIE
          ||||||||||||||||||||||||||||||||||||||||||||||||||||||| ||||
m708      MPFKPSKRISLLLVLALGACSTSYRPSRAEKANQVSNIKTQLAMEYMRGQDYRQATASIE
                 10         20         30         40         50         60

70         80         90        100        110        120
a708.pep  DALKSDPKNELAWLVRAEIYQYLKVNDKAQESFRQXLSIKPDSAEINNNYXWFLCGRLNR
          ||||| |||||||||||||||||||||||||||||| |||||||||||||||| ||||||
m708      DALKSNPKNELAWLVRAEIYQYLKVNDKAQESFRQALSIKPDSAEINNNYGWFLCGRLNR
                 70         80         90        100        110        120

130        140        150        160        170        180
a708.pep  PAESMAYFDKALADPTYPXPYIANLNKGICSAKQGQFGLAEAYLKRSLAAQPQFPPAFKE
          ||||||||||||||||||| ||||||||||||||||||||||||||||||||||||||||
m708      PAESMAYFDKALADPTYPTPYIANLNKGICSAKQGQFGLAEAYLKRSLAAQPQFPPAFKE
                130        140        150        160        170        180

190        200        210        220        230        240
a708.pep  LARTKMLAGQLGDADYYFKKYQSRVEVLQADDLLLGWKIAKALGNAQAAYEYEAQLQANF
          |||||||||||||||||||||||||||||||||||||||||||||| ||||||||||||
m708      LARTKMLAGQLGDADYYFKKYQSRVEVLQADDLLLGWKIAKALGNVQAAYEYEAQLQANF
                190        200        210        220        230        240

250
a708.pep  PYSEELQTVLIGQX
          |||||||||| |||
m708      PYSEELQTVLTGQX
                250
```

The following partial DNA sequence was identified in *N. gonorrhoeae* <SEQ ID 2379>:

```
g709.seq
    1  ATGTTTGCTT TCAAATCCTT ACTCGATATG CCGCGCGGTG AGGCACTTGC

51  CGTCGTCGTC GCTCTGATTG CCGCAATGGG CTATACCATC ATTTCATTGG

101  AGTGGCTGCC GCATATGTCC ATTATTGCCG CCATCGTCGT GCTGATTTTG

151  TACGGCTTGG CGCGCGGTTT GAAATACAAC GATATGCAGG CAGGGATGAT

201  AGGCGCGTTG AATCAGGGTA TGGGCGCGGT TTACCTGTTT TTCTTCATCG

251  GGCTGATGGT CAGCGCGCTG ATGATGAGCG GCGCGATTCC GACGCTGATG

301  TATTACGGTT TCGGGCTGAT TTCCCCGACT TATTTTTATT TTTCCGCCTT

351  CGCGCTGTGT TCCGTCATCG GCGTGTCCAT CGGCAGCAGC CTGACCGCCT

401  GCGCCACTGT CGGCGTTGCC TTTATGGGGA TGGCGGCGGC GTTTCAGGCC

451  GATATGGCGA TGACGgcggg cgcgattgTT tccggTGTGT TTTTCGGCGA

501  TAAAATGTCC CCGCTTTCCG ACACCACGGG CATTTCCGCG TCCATCGTCG

551  GTATCGACCT GTTTGAACAC ATCAAAAACA TGATGTACAC CACCATCCCT

601  GCGTGGCTTA TCAGCGCGGC ACTGATGCTT GGCTTCTTC CCAGCGTCGC

651  CGCGCAGGAT TTGAACAGCG TCGAATCCTT CCGCAGCCAG CTTGAAGCCA

701  CGGGATTGGT GCACGGCTAT TCGCTGATTC CGTTTGCACT GTTGGTCGTT

751  TTGGCATTGA TGCGCGTCAA TGCCGTGGTC GCCATGCTCT TTACCGTCAT

801  TGCCGCCGTT GCCGTAACGT ATCTGCACAG CACGCCCGAT CTGCGTCAGC

851  TCGGCGCGTG GTTTATGGC GGCTACAAAC TCGAAGGCGA AGCGTTTAAA

901  GACATTGCCA AACTGATTTC GCGCGGCGGC TTGGAGAGTA TGTTCTTTAC
```

```
-continued
 951   GCAGACCATC GTTATCCTCG GTATGAGTTT GGGCGGGCTG CTGTTTGCGC
1001   TCGGTGTGAT TCCTTCCTTG CTGGAGGCCG TCCGTACCTT CTTGACGAAT
1051   GCCGGACGCG CGACGTTCAG CGTTGCCATG ACTTCGGTCG GGGTCAATTT
1101   CCTGATTGGA GAGCAATATT TGAGCATCCT GCTTTCGGGA GAAACGTTCA
1151   AACCCGTTTA CGACAAACTC GGCCTGCATT CGTGCAACCT GTCGCGGACT
1201   CTGGAAGATG CGGGGACGGT GATTAACCCG CTCGTGCCGT GGAGCGTGTG
1251   CGGCGTATTT ATCAGCCACG CCCTTGGCGT ACCCGTTTGG GAATATCTGC
1301   CTTATGCCTT TTTCTGCTAT TTGAGTTTGG CTTTAACCCT GTTATTCGGC
1351   TGGACGGGGC TGACTTTGAG CAAAAAATAA
```

This corresponds to the amino acid sequence <SEQ ID 2380; ORF 709.ng>:

```
g709.pep
   1   MFAFKSLLDM PRGEALAVVV ALIAAMGYTI ISLEWLPHMS IIAAIVVLIL
  51   YGLARGLKYN DMQAGMIGAL NQGMGAVYLF FFIGLMVSAL MMSGAIPTLM
 101   YYGFGLISPT YFYFSAFALC SVIGVSIGSS LTACATVGVA FMGMAAAFQA
 151   DMAMTAGAIV SGVFFGDKMS PLSDTTGISA SIVGIDLFEH IKNMMYTTIP
 201   AWLISAALML WLLPSVAAQD LNSVESFRSQ LEATGLVHGY SLIPFALLVV
 251   LALMRVNAVV AMLFTVIAAV AVTYLHSTPD LRQLGAWFYG GYKLEGEAFK
 301   DIAKLISRGG LESMFFTQTI VILGMSLGGL LFALGVIPSL LEAVRTFLTN
 351   AGRATFSVAM TSVGVNFLIG EQYLSILLSG ETFKPVYDKL GLHSCNLSRT
 401   LEDAGTVINP LVPWSVCGVF ISHALGVPVW EYLPYAFFCY LSLALTLLFG
 451   WTGLTLSKK*
```

The following partial DNA sequence was identified in *N. meningitidis* <SEQ ID 2381>:

```
m709.seq
   1   ATGTTCGCTT TCAAATCCTT ACTCGATATG CCGCGCGGTG AGGCACTTGC
  51   CGTCGTCGTC GCTCTGATTG CCGCGATGGG CTATACCATC ATTTCATTGG
 101   AGTGGTTGCC GCATATGTCC ATTATTGCCG CCATCGTCGT GCTGATTTTG
 151   TACGGCTTGG CGCGCGGTTT GAAATACAAC GATATGCAGC AGGGCATGAT
 201   AGGCGCGTTG AATCAGGGTA TGGGCGCGAT TTACCTGTTT TTCTTCATCG
 251   GGCTGATGGT CAGCGCGCTG ATGATGAGCG GCGCGATTCC GACGCTGATG
 301   TATTACGGTT TCGGACTGAT TTCCCCGACT TATTTTTATT TTTCCTCCTT
 351   CGCGCTGTGT TCCGTCATCG GCGTGTCCAT CGGCAGCAGC CTGACCACCT
 401   GCGCCACTGT CGGCGTTGCC TTTATGGGGA TGGCGGCGGC GTTTCAGGCC
 451   GATATGGCGA TGACGGCGGG CGCGATTGTT TCGGGCGCAT TTTTTGGCGA
 501   CAAAATGTCC CCGCTTTCGG ATACGACGGG TATTTCCGCG TCCATCGTCG
 551   GCATCGACTT GTTTGAGCAC ATCAAAAATA TGATGTACAC CACCATCCCC
 601   GCGTGGCTCA TTAGTGCGGC ACTGATGCTT TGGCTTTTGC CGAATGTCGC
 651   CGCGCAGGAT TTGAACAGCG TCGAATCCTT CCGCAGCCAG CTTGAAGCCA
 701   CGGGATTGGT GCACGGCTAT TCGCTGATTC CGTTTGCGCT GTTGGTCATT
```

```
-continued
 751 TTGGCATTGA TGCGCATCAA CGCCGTCGTC GCCATGCTCT TTACCGTCAT

801 GGTTGCCGTT GCTGTAACGT ATCTGCACAG CACGCCCGAT CTGCGTCAGC

851 TCGGTGCGTG GTTTTACGGC GGCTACAAAC TCGAAGGCGA AGCGTTTAAA

901 GATGTTGTCA AACTGATTTC GCGCGGCGGT TTGGAAAGTA TGTTTTTCAC

951 GCAAACCATC GTGATTCTCG GGATGAGTTT GGGCGGACTG TTGTTTGCGC

1001 TCGGTGTGAT TCCTTCCCTG TTGGAGGCCA TCCGTACCTT CTTGACGAAT

1051 GCCGGACGCG CGACGTTCAG CGTTGCCATG ACTTCGGTCG GGGTTAATTT

1101 CCTGATCGGC GAGCAATATT TGAGTATTTT GTTGTCGGGT GAAACGTTCA

1151 AACCCGTTTA CGATAAGCTC GGTCTGCATT CGCGCAATCT GTCGCGGACG

1201 CTGGAAGATG CGGGGACGGT GATTAACCCG CTCGTACCGT GGAGCGTATG

1251 CGGCGTGTTC ATCAGCCACG CGCTGGGCGT GCCGGTTTGG GAATATCTGC

1301 CGTATGCCTT TTTCTGCTAT TTGAGTTTGG CTTTGACCCT GTTATTCGGT

1351 TGGACGGGGC TGACTTTGAG CAAAAAATAA
```

This corresponds to the amino acid sequence <SEQ ID 2382; ORF 709>:

```
m709.pep
   1  MFAFKSLLDM PRGEALAVVV ALIAAMGYTI ISLEWLPHMS IIAAIVVLIL

51  YGLARGLKYN DMQQGMIGAL NQGMGAIYLF FFIGLMVSAL MMSGAIPTLM

101  YYGFGLISPT YFYFSSFALC SVIGVSIGSS LTTCATVGVA FMGMAAAFQA

151  DMAMTAGAIV SGAFFGDKMS PLSDTTGISA SIVGIDLFEH IKNMMYTTIP

201  AWLISAALML WLLPNVAAQD LNSVESFRSQ LEATGLVHGY SLIPFALLVI

251  LALMRINAVV AMLFTVMVAV AVTYLHSTPD LRQLGAWFYG GYKLEGEAFK

301  DVVKLISRGG LESMFFTQTI VILGMSLGGL LFALGVIPSL LEAIRTFLTN

351  AGRATFSVAM TSVGVNFLIG EQYLSILLSG ETFKPVYDKL GLHSRNLSRT

401  LEDAGTVINP LVPWSVCGVF ISHALGVPVW EYLPYAFFCY LSLALTLLFG

451  WTGLTLSKK*
``` m709/g709 96.9% identity in 459 aa overlap

```
                  10         20         30         40         50         60
m709.pep  MFAFKSLLDMPRGEALAVVVALIAAMGYTIISLEWLPHMSIIAAIVVLILYGLARGLKYN
          ||||||||||||||||||||||||||||||||||||||||||||||||||||||||||||
    g709  MFAFKSLLDMPRGEALAVVVALIAAMGYTIISLEWLPHMSIIAAIVVLILYGLARGLKYN
                  10         20         30         40         50         60

70         80         90        100        110        120
m709.pep  DMQQGMIGALNQGMGAIYLFFFIGLMVSALMMSGAIPTLMYYGFGLISPTYFYFSSFALC
          |||:||||||||||||||:|||||||||||||||||||||||||||||||||||||:|||
    g709  DMQAGMIGALNQGMGAVYLFFFIGLMVSALMMSGAIPTLMYYGFGLISPTYFYFSAFALC
                  70         80         90        100        110        120

130        140        150        160        170        180
m709.pep  SVIGVSIGSSLTTCATVGVAFMGMAAAFQADMAMTAGAIVSGAFFGDKMSPLSDTTGISA
          ||||||||||||:|||||||||||||||||||||||||||:|||||||||||||||||||
    g709  SVIGVSIGSSLTACATVGVAFMGMAAAFQADMAMTAGAIVSGVFFGDKNSPLSDTTGISA
                 130        140        150        160        170        180

190        200        210        220        230        240
m709.pep  SIVGIDLFEHIKNMMYTTIPAWLISAALMLWLLPNVAAQDLNSVESFRSQLEATGLVHGY
          ||||||||||||||||||||||||||||||||||:|||||||||||||||||||||||||
    g709  SIVGIDLFEHIKNMMYTTIPAWLISAALMLWLLPSVAAQDLNSVESFRSQLEATGLVHGY
                 190        200        210        220        230        240
```

-continued

```
             250        260        270        280        290        300
m709.pep  SLIPFALLVILALMRINAVVAMLFTVMVAVAVTYLHSTPDLRQLGAWFYGGYKLEGEAFK
          |||||||||:|||||:||||||||||::||||||||||||||||||||||||||||||||
g709      SLIPFALLVVLALMRVNAVVAMLFTVIAAVAVTYLHSTPDLRQLGAWFYGGYKLEGEAFK
             250        260        270        280        290        300

310        320        330        340        350        360
m709.pep  DVVKLISRGGLESMFFTQTIVILGMSLGGLLFALGVIPSLLEAIRTFLTNAGRATFSVAM
          |::|||||||||||||||||||||||||||||||||||||||||:||||||||||||||||
g709      DIAKLISRGGLESMFFTQTIVILGMSLGGLLFALGVIPSLLEAVRTFLTNAGRATFSVAM
             310        320        330        340        350        360

370        380        390        400        410        420
m709.pep  TSVGVNFLIGEQYLSILLSGETFKPVYDKLGLHSRNLSRTLEDAGTVINPLVPWSVCGVF
          |||||||||||||||||||||||||||||||||| |||||||||||||||||||||||||
g709      TSVGVNFLIGEQYLSILLSGETFKPVYDKLGLHSCNLSRTLEDAGTVINPLVPWSVCGVF
             370        380        390        400        410        420

430        440        450        460
m709.pep  ISHALGVPVWEYLPYAFFCYLSLALTLLFGWTGLTLSKKX
          ||||||||||||||||||||||||||||||||||||||||
g709      ISHALGVPVWEYLPYAFFCYLSLALTLLFGWTGLTLSKKX
             430        440        450        460
```

The following partial DNA sequence was identified in *N. meningitidis* <SEQ ID 2383>:

```
a709.seq
     1  ATGTTCGCTT TCNAATCCTT ACTCGATATG CCGCGCGGTG AGGCNCTTGC
    51  CGTCGTCGTC GCTCTGATTG CCGCGATGGG CTATACCATC ATTTNNTTGG
   101  AGTGGCTGCC GCATATGTCC ATTATTGCCG CCATCGTNGT GCTGATTTTG
   151  TACGGCTTGG CGCGCGGTTT GAAATACAAC GATATGCAGC AGGGCATGAT
   201  AGGCGCGTTG AATCAGGGTA TGGGCGCGAT TTACCTNTTT TTCTTCATCG
   251  GGCTGATGGT CAGCGCGCTG ATGATGAGCG GCGCGATTCC GACGCTGATG
   301  TATTACGGTT TCGGACTGAT TTCCCCGACT TATTTTTATT TTTCCGCCTT
   351  CGCGCTGTGT TCCGTCATCG GCGTGTCCAT CGGCAGCAGC CTGACCACCT
   401  GCGCCACTGT CGGCGTTGCC TTNATGGGTA TNNNGNCGGC GTTTCNGGCC
   451  NANATGGNGN NGNNGNNGGN CNNGATTGTN NNGGNCGCAT TNTTNGGCGN
   501  CAAAATGTCN CCGCTTTCCG ATACGNCGGG CATNTCCGCG TCCATTGTCG
   551  GTATCGACCT GTTTGAACAC ATCAAAAATA TGATGTACAC NACCATTCCC
   601  GCGTGGCTCA TCAGTGNNNC ACTGATGCTG TNGCTTCTTC CCAGCGTCGC
   651  CGCGCAGGAT TTGAACAGCG TCGAATCCTT CCGCAGCCAG CTTGAAGCCA
   701  CGGGATTGGT GCACTGCTAT TCGCTGATTC CGTTTGCGCT GTTGGTCGTT
   751  TTGGCATTGA TGCGCGTCAA TGCCGTGGTC GCTATGCTCT TTACCGTCAT
   801  TGCCGCCGTT GCCGTAACGT ATCTGCACAG CACGCCCGAT CTGCGTCAGC
   851  TCGGCGCGTG GTTTTACGGC GGCTACAAAC TCGAAGGCGA AGCGTNTANA
   901  GACATTGCCA AACTCATTTC TCGCGGCGGT TTGGAAAGTA TGTTTTTCAC
   951  GCAGACCATC GTGATTCTTG GGATGAGCCT TGGCGGGCTG CTGTTTGCAC
  1001  TGGGCGCGAT TCCTTCCCTG CTGGATGCCG TCCGCAGCTT TTTGACGAAT
  1051  GCCGGGCGTN CCACATTCAG CGTTGCCATG ACTTCGGTCG GGGTTAATTT
  1101  CCTGATCGGC GAGCAATATT TGAGTATTTT GTTGTCNGGT GAAACGTTCA
  1151  AACCTGTTTA CGATAAGCTC GGTCTGCATT CGCGCAATCT GTCGCGGACG
  1201  CTGGAAGATG CGGGGACGGT CATCAACCCG CTCGTACCGT GGAGCGTATG
  1251  CGGCGTGTTC ATCANCCACG CGCTGGGCGT GCCGGTTTGG GAATATCTGC
```

```
-continued
1301 CGTATGCCTT TTTCTGCTAT TTGAGTTTGG CTTTGACCCT GTTATTCGGT

1351 TGGACGGGGC TGACTTTGAG CAAAAAATAA
```

This corresponds to the amino acid sequence <SEQ ID 2384; ORF 709.a>:

```
a709.pep
   1 MFAFXSLLDM PRGEALAVVV ALIAAMGYTI IXLEWLPHMS IIAAIVVLIL

51 YGLARGLKYN DMQQGMIGAL NQGMGAIYLF FFIGLMVSAL MMSGAIPTLM

101 YYGFGLISPT YFYFSAFALC SVIGVSIGSS LTTCATVGVA XMGXXXAFXA

151 XMXXXXXXIV XXAXXGXKMS PLSDTXGXSA SIVGIDLFEH IKNMMYTTIP

201 AWLISXXLML XLLPSVAAQD LNSVESFRSQ LEATGLVHCY SLIPFALLVV

251 LALMRVNAVV AMLFTVIAAV AVTYLHSTPD LRQLGAWFYG GYKLEGEAXX

301 DIAKLISRGG LESMFFTQTI VILGMSLGGL LFALGAIPSL LDAVRSFLTN

351 AGRXTFSVAM TSVGVNFLIG EQYLSILLSG ETFKPVYDKL GLHSRNLSRT

401 LEDAGTVINP LVPWSVCGVF IXHALGVPVW EYLPYAFFCY LSLALTLLFG

451 WTGLTLSKK*
``` a709/m709 91.1% identity in 459 aa overlap

```
                10         20         30         40         50         60
a709.pep  MFAFXSLLDMPRGEALAVVVALIAAMGYTIIXLEWLPHMSIIAAIVVLILYGLARGLKYN
          ||||  ||||||||||||||||||||||||| |||||||||||||||||||||||||||
m709      MFAFKSLLDMPRGEALAVVVALIAAMGYTIISLEWLPHMSIIAAIVVLILYGLARGLKYN
                10         20         30         40         50         60

70         80         90        100        110        120
a709.pep  DMQQGMIGALNQGMGAIYLFFFIGLMVSALMMSGAIPTLMYYGFGLISPTYFYFSAFALC
          |||:||||||||||||:||||||||||||||||||||||||||||||||||||||:||||
m709      DMQAGMIGALNQGMGAVYLFFFIGLMVSALMMSGAIPTLMYYGFGLISPTYFYFSSFALC
                70         80         90        100        110        120

130        140        150        160        170        180
a709.pep  SVIGVSIGSSLTTCATVGVAXMGXXXAFXAXMXXXXXXIVXXAXXGXKMSPLSDTXGXSA
          ||||||||||||||||||||:|||   |  :      ||  |  | ||||||||: ||||
m709      SVIGVSIGSSLTTCATVGVAFMGMAAAFQADMAMTAGAIVSGAFFGDKMSPLSDTTGISA
               130        140        150        160        170        180

190        200        210        220        230        240
a709.pep  SIVGIDLFEHIKNMMYTTIPAWLISXXLMLXLLPSVAAQDLNSVESFRSQLEATGLVHCY
          ||||||||||||||||||||||||  |||  |||:|||||||||||||||||||||:||
m709      SIVGIDLFEHIKNMMYTTIPAWLISAALMLWLLPNVAAQDLNSVESFRSQLEATGLVHGY
               190        200        210        220        230        240

250        260        270        280        290        300
a709.pep  SLIPFALLVVLALMRVNAVVAMLFTVIAAVAVTYLHSTPDLRQLGAWFYGGYKLEGEAXX
          ||||||||| :|||||:|||||||||::||||||||||||||||||||||||||||| 
m709      SLIPFALLVILALMRINAVVAMLFTVMVAVAVTYLHSTPDLRQLGAWFYGGYKLEGEAFK
               250        260        270        280        290        300

310        320        330        340        350        360
a709.pep  DIAKLISRGGLESMFFTQTIVILGMSLGGLLFALGAIPSLLDAVRSFLTNAGRXTFSVAM
          |::|||||||||||||||||||||||||||||||:|||| :|:|:|||||||| ||||||
m709      DVVKLISRGGLESMFFTQTIVILGMSLGGLLFALGVIPSLLEAIRTFLTNAGRATFSVAM
               310        320        330        340        350        360

370        380        390        400        410        420
a709.pep  TSVGVNFLIGEQYLSILLSGETFKPVYDKLGLHSRNLSRTLEDAGTVINPLVPWSVCGVF
          ||||||||||||||||||||||||||||||||||| |||||||||||||||||||||||
m709      TSVGVNFLIGEQYLSILLSGETFKPVYDKLGLHSCNLSRTLEDAGTVINPLVPWSVCGVF
               370        380        390        400        410        420

430        440        450        460
a709.pep  IXHALGVPVWEYLPYAFFCYLSLALTLLFGWTGLTLSKKX
          | |||||||||||||||||||||||||||||||||||||
m709      ISHALGVPVWEYLPYAFFCYLSLALTLLFGWTGLTLSKKX
               430        440        450        460
``` g710.seq not found
g710.pep not found
The following partial DNA sequence was identified in N. meningitidis <SEQ ID 2385>:

```
m710.seq
    1   ATGGAAACCC ACGAAAAAAT CCGCCTGATG CGCGAATTGA ATAAATGGTC

51   CCAGGAGGAT ATGGCGGAAA AGCTGGCGAT GTCGGCAGGC GGGTATGCCA

101   AAATCGAACG GGGCGAAACG CAGTTAAATA TCCCGCGTTT GGAGCAGTTG

151   GCTCAGATTT TCAAAATCGA TATGTGGGAC TTGCTCAAAT CGGGCGGTGG

201   TGGGATGGTG TTTCAGATTA ATGAAGGTGA TAGTGGTGGC GATATTGCGT

251   TGTATGCGTC GGGTGATGTT TCGATGAAAA TAGAATTTTT AAAAATGGAG

301   TTGAAACACT GCAAAGAAAT GTTGGAACAA AAAGACAAAG AAATCGAGCT

351   GCTCCGCAAG CTGACCGAAA CCGTTTAA
```

This corresponds to the amino acid sequence <SEQ ID 2386; ORF 710>:

```
m710.pep
    1   METHEKIRLM RELNKWSQED MAEKLAMSAG GYAKIERGET QLNIPRLEQL

51   AQIFKIDMWD LLKSGGGGMV FQINEGDSGG DIALYASGDV SMKIEFLKME

101   LKHCKEMLEQ KDKEIELLRK LTETV*
```

The following partial DNA sequence was identified in N. meningitidis <SEQ ID 2387>:

```
a710.seq
    1   ATGGAAACCC ACGAAAAAAT CCGCCTGATG CGCGAATTGA ATAAATGGTC

51   CCAGGAGGAT ATGGCGGAAA AGCTGGCGAT GTCGGCAGGC GGGTATGCCA

101   AAATCGAACG AGGCGAAACG CAGTTGAATA TCCCGCGTTT GGAGCAGTTG

151   GCGCAGATTT TCAAAATTGA TATGTGGGAC TTGCTCAAAT CGGGCGGCGG

201   CGGGATGGTG TTGCAGATTA ACGATGTGGA TACCAACAGC GGGGAATTTG

251   CAATCTATAC CGCTCAGGAT GCATCNGGTA AGCTGGATT TGTTAAAATG

301   GAATTAAAAC ACTGTAAAGA AATGTTGGAA CACAAAGACA AAGAAATCGA

351   GCTGCTCCGC AAGCTGACCG AAACCGTTTA A
```

This corresponds to the amino acid sequence <SEQ ID 2388; ORF 710.a>:

```
a710.pep
    1   METHEKIRLM RELNKWSQED MAEKLAMSAG GYAKIERGET QLNIPRLEQL

51   AQIFKIDMWD LLKSGGGGMV LQINDVDTNS GEFAIYTAQD ASGKAGFVKM

101   ELKHCKEMLE HKDKEIELLR KLTETV*
``` a710/m710 85.7% identity in 126 aa overlap

```
                10         20         30         40         50         60
a710.pep  METHEKIRLMRELNKWSQEDMAEKLAMSAGGYAKIERGETQLNIPRLEQLAQIFKIDMWD
          ||||||||||||||||||||||||||||||||||||||||||||||||||||||||||||
m710      METHEKIRLMRELNKWSQEDMAEKLAMSAGGYAKIERGETQLNIPRLEQLAQIFKIDMWD
                10         20         30         40         50         60
```

-continued

```
                    70        80        90        100       110       120
a710.pep   LLKSGGGGMVLQINDVDTNSGEFAIYTAQDASGKAGFVKMELKHCKEMLEHKDKEIELLR
           ||||||||||:|||: |:: |::|:|:: |:| |  |:||||||||||||:|||||||||
m710       LLKSGGGGMVFQINEGDSG-GDIALYASGDVSMKIEFLKMELKHCKEMLEQKDKEIELLR
                    70         80        90        100       110 a710.pep   KLTETVX
           |||||||
m710       KLTETVX
         120
``` g711.seq not found g711.pep not found

The following partial DNA sequence was identified in *N. meningitidis* <SEQ ID 2389>:

```
m711.seq
     1  ATGCCCGCGC CTGATTTGGG ATTTGCCTTA AGTCTGCCGC CAAAAAAGGC

51  AATCGAGTGG CTGGAAAGTA AAAAGGTTAC GGCGGAGAGC TACCGCAATC

101  TGACAGCCTC CGAAATTGCC AAAGTCTATA CGATTGCCCG CATGACCGAC

151  TTGGATATGC TCAACGACAT CAAAACTTCG ATGGTTGAAT CGGCAAAAAG

201  TGGACAGTCG TTTGACGATT GGCGAAAAGG TATCTTGAAT CTGCTCAGCA

251  ACAAGGGCTG GCTGCATCCG AACGGGCATA ACGGTAAGGA TATCATCGAC

301  CCAGCCACCG GCGAGGTATT CGGTTCGCCG CGGAGGTTGG AGACGATTTA

351  CCGTACCAAT ATGCAAACTG CCTACAACGC CGGTCAATAT CAAGGATATA

401  TGGCAAATAT TGATGCACGA CCTTATTGGA TGTATGACGC GGTAGGCGAC

451  AGCCGCACCC GTCCGGCGCA TTCGGCAATA GACGGGCTGG TGTACCGCTA

501  CGACGACCCG TTTTGGGCAA CGTTTTACCC GCCCAACGGC TACAACTGCC

551  GCTGCTCGGT CATCGCGCTG TCGGAGCGGG ATGTGGAACG CCAGGGGCGG

601  ATTGTTGGGC AAAGCACGGC GGACAATCTG GTCGAGACCC ATAAAATCTA

651  CAACAAAAAA GGCGATACTT ATCTGACCCT TGCCTATAAA GCACCGGATG

701  GCAGTCTGTA CACGACCGAT CGAGGATTTG ATTACAACGC CGGACGAATG

751  AACTACCGCC CCGATTTAGA CAAGTACGAC CGTGCGTTGG CGCATCAATT

801  TGCCAAAGCG GAAATGGGTG GTGCGGATTT TAAAACCAGC TTTAAACAGC

851  TTGAAAAAGA GTTTTATGAA GTCAAGCAAC GTTTGGATAT TGATGGCAAG

901  CCCGATAAAG AGCAGAAAAT CAAAATCCGA AATGCGCTAT CAAGACAGCT

951  TAAATTTGCT GCGGGTGTAT TGAGCAAGGA AACGCAAGAA TTGGCAGGTA

1001  TGACACGAGC GACGGTGTGG CTGTCTGATG ATACGTTGGT TAAACAGGTA

1051  GACAGCCGTG AGGGGCAGAA TTTCGATGAC TCCTACTATG CTTTTTTGCC

1101  GGATATGCTG CAAAACCCTG AACATGTCAT CCGCGACAAT CGTGAATTGA

1151  TTTTCACAGC TCGCTATAAA GGCTCGGCAT TGTGGGCAGT TTTAAAATAT

1201  ATTAAGGAGG TGGATGAGAT TTATCTACAG TCGTACCGAA TCAGTAACGA

1251  CAAAGAGATT GCCAAATTTA TGGCGAAGAA GAAAGTATTG AAATAG
```

This corresponds to the amino acid sequence <SEQ ID 2390; ORF 711>:

```
m711.pep
    1  MPAPDLGFAL SLPPKKAIEW LESKKVTAES YRNLTASEIA KVYTIARMTD

51  LDMLNDIKTS MVESAKSGQS FDDWRKGILN LLSNKGWLHP NGHNGKDIID
```

-continued

```
101  PATGEVFGSP  RRLETIYRTN  MQTAYNAGQY  QGYMANIDAR  PYWMYDAVGD

151  SRTRPAHSAI  DGLVYRYDDP  FWATFYPPNG  YNCRCSVIAL  SERDVERQGR

201  IVGQSTADNL  VETHKIYNKK  GDTYLTLAYK  APDGSLYTTD  RGFDYNAGRM

251  NYRPDLDKYD  RALAHQFAKA  EMGGADFKTS  FKQLEKEFYE  VKQRLDIDGK

301  PDKEQKIKIR  NALSRQLKFA  AGVLSKETQE  LAGMTRATVW  LSDDTLVKQV

351  DSREGQNFDD  SYYAFLPDML  QNPEHVIRDN  RELIFTARYK  GSALWAVLKY

401  IKEVDEIYLQ  SYRISNDKEI  AKFMAKKKVL  K*
```

The following partial DNA sequence was identified in *N. meningitidis* <SEQ ID 2391>:

```
a711.seq
    1  ATGCCCGCGC  CTGATTTGGG  ATTTGCCTTA  AGTCTGCCGC  CAAAAAGGC

51  AATCGAGTGG  CTGGAAAGTA  AAAGGTTAC   GGCGGAGAGC  TACCGCAATC

101  TGACAGCCTC  CGAAATTGCC  AAAGTCTATA  CGATTGCCCG  CATGACCGAC

151  TTGGATATGC  TCAACGACAT  CAAAACTTCG  ATGGTTGAAT  CGGCAAAAAG

201  TGGACAGTCG  TTTGACGATT  GGCGAAAAGG  TATCTTGAAT  CTGCTCAGCA

251  ACAAGGGCTG  GCTGCATCCG  AACGGGCATA  ACGGTAAGGA  TATCATCGAC

301  CCAGCCACCG  GCGAGGTATT  CGGTTCGCCG  CGGAGGTTGG  AGACGATTTA

351  CCGTACCAAC  ATGCAAACTG  CCTACAACGC  CGGTCAATAT  CAAGGATATA

401  TGGCAAATAT  TGATGCACGA  CCTTATTGGA  TGTATGACGC  GGTAGGCGAC

451  AGCCGCACCC  GTCCGGCGCA  TTCGGCAATA  GACGGGCTGG  TGTACCGCTA

501  CGACGACCCG  TTTTGGGCAA  CGTTTTACCC  GCCCAACGGC  TACAACTGCC

551  GTTGCTCGGT  CATCGCGCTG  TCGGAGCGGG  ATGTGGAACG  CCAGGGGCGG

601  ATTGTCGGGC  AAAGCACGTC  GGACAATCTT  GTTGAGACCC  ATAAAATCTA

651  CAACAAAAAA  GGCGATACTT  ATCTGACCCT  TGCCTATAAA  GCACCGGATG

701  GCAGTCTGTA  CACGACCGAT  CGAGGATTTG  ATTACAACGC  CGGACGAATG

751  AACTACCGCC  CCGATTTAGA  CAAGTACGAC  CGTGCGTTGG  CGCATCAATT

801  TGCCAAAGCG  GAAATGGGTG  GTGCGGATTT  TAAAACCAGC  TTTAAACAGC

851  TTGAAAAAGA  GTTTTATGAA  GTCAAGCAAC  GTTTGGATAT  TGATGGCAAG

901  CCCGATAAAG  AGCAGAAAAT  CAAAATCCGA  AATGCGCTAT  CAAGACAGCT

951  TAAATTTGCT  GCGGGTGTAT  TGAGCAAGGA  AACGCAAGAA  TTGGCAGGTA

1001  TGACACGAGC  GACGGTGTGG  CTGTCTGATG  ATACGTTGGT  TAAACAGGTA

1051  GACAGCCGTG  AAGGGCAGAA  TTTCGATGAC  TCCTACTATG  CTTTTTTGCC

1101  GGATATGCTG  CAAAACCCTG  AACATGTCAT  CCGCGACAAT  CGTGAATTGA

1151  TTTTCACAGC  TCGCTATAAA  GGCTCGGCAT  TGTGGGCAGT  TTTAAAATAT

1201  ATTAAGGAGG  TGGATGAGAT  TTATCTACAG  TCGTACCGAA  TCAGTAACGA

1251  CAAAGAGATT  GCCAAATTTA  TGGCGAAGAA  GAAAGTATTG  AAATAG
```

This corresponds to the amino acid sequence <SEQ ID 2392; ORF 711.a>:

```
a711.pep
     1  MPAPDLGFAL SLPPKKAIEW LESKKVTAES YRNLTASEIA KVYTIARMTD

51  LDMLNDIKTS MVESAKSGQS FDDWRKGILN LLSNKGWLHP NGHNGKDIID

101  PATGEVFGSP RRLETIYRTN MQTAYNAGQY QGYMANIDAR PYWMYDAVGD

151  SRTRPAHSAI DGLVYRYDDP FWATFYPPNG YNCRCSVIAL SERDVERQGR

201  IVGQSTSDNL VETHKIYNKK GDTYLTLAYK APDGSLYTTD RGFDYNAGRM

251  NYRPDLDKYD RALAHQFAKA EMGGADFKTS FKQLEKEFYE VKQRLDIDGK

301  PDKEQKIKIR NALSRQLKFA AGVLSKETQE LAGMTRATVW LSDDTLVKQV

351  DSREGQNFDD SYYAFLPDML QNPEHVIRDN RELIFTARYK GSALWAVLKY

401  IKEVDEIYLQ SYRISNDKEI AKFMAKKKVL K*
``` a711/m711 99.8% identity in 431 aa overlap

```
                     10         20         30         40         50         60
       a711.pep  MPAPDLGFALSLPPKKAIEWLESKKVTAESYRNLTASEIAKVYTIARMTDLDMLNDIKTS
                 ||||||||||||||||||||||||||||||||||||||||||||||||||||||||||||
          m711  MPAPDLGFALSLPPKKAIEWLESKKVTAESYRNLTASEIAKVYTIARMTDLDMLNDIKTS
                     10         20         30         40         50         60
                     70         80         90        100        110        120
       a711.pep  MVESAKSGQSFDDWRKGILNLLSNKGWLHPNGHNGKDIIDPATGEVFGSPRRLETIYRTN
                 ||||||||||||||||||||||||||||||||||||||||||||||||||||||||||||
          m711  MVESAKSGQSFDDWRKGILNLLSNKGWLHPNGHNGKDIIDPATGEVFGSPRRLETIYRTN
                     70         80         90        100        110        120
                    130        140        150        160        170        180
       a711.pep  MQTAYNAGQYQGYMANIDARPYWMYDAVGDSRTRPAHSAIDGLVYRYDDPFWATFYPPNG
                 ||||||||||||||||||||||||||||||||||||||||||||||||||||||||||||
          m711  MQTAYNAGQYQGYMANIDARPYWMYDAVGDSRTRPAHSAIDGLVYRYDDPFWATFYPPNG
                    130        140        150        160        170        180
                    190        200        210        220        230        240
       a711.pep  YNCRCSVIALSERDCERQGRIVGQSTSDNLVETHKIYNKKGDTYLTLAYKAPDGSLYTTD
                 |||||||||||||||||||||||||||:||||||||||||||||||||||||||||||||
          m711  YNCRCSVIALSERDCERQGRIVGQSTADNLVETHKIYNKKGDTYLTLAYKAPDGSLYTTD
                    190        200        210        220        230        240
                    250        260        270        280        290        300
       a711.pep  RGFDYNAGRMNYRPDLDKYDRALAHQFAKAEMGGADFKTSFKQLEKEFYEVKQRLDIDGK
                 ||||||||||||||||||||||||||||||||||||||||||||||||||||||||||||
          m711  RGFDYNAGRMNYRPDLDKYDRALAHQFAKAEMGGADFKTSFKQLEKEFYEVKQRLDIDGK
                    250        260        270        280        290        300
                    310        320        330        340        350        360
       a711.pep  PDKEQKIKIRNALSRQLKFAAGVLSKETQELAGMTRATVWLSDDTLVKQVDSREGQNFDD
                 ||||||||||||||||||||||||||||||||||||||||||||||||||||||||||||
          m711  PDKEQKIKIRNALSRQLKFAAGVLSKETQELAGMTRATVWLSDDTLVKQVDSREGQNFDD
                    310        320        330        340        350        360
                    370        380        390        400        410        420
       a711.pep  SYYAFLPDMLQNPEHVIRDNRELIFTARYKGSALWAVLKYIKEVDEIYLQSYRISNDKEI
                 ||||||||||||||||||||||||||||||||||||||||||||||||||||||||||||
          m711  SYYAFLPDMLQNPEHVIRDNRELIFTARYKGSALWAVLKYIKEVDEIYLQSYRISNDKEI
                    370        380        390        400        410        420
                    430
       a711.pep  AKFMAKKKVLKX
                 ||||||||||||
          m711  AKFMAKKKVLKX
                    430
``` g712.seq not found yet
g712.pep not found yet
The following partial DNA sequence was identified in *N. meningitidis* <SEQ ID 2393>:

```
m712.seq
     1  ATGATGCCCC ATATTGATTT TGACACGATT CCGGGCAGCA TCCGCGTGCC

51  CGGGCAGTAT ATTGAATTTA ACACCCGCAA TGCCGTACAA GGTTTGCCGC

101  AAAATCCGCA AAAGGTATTG ATG

```
 151 CAGACCGTCT TAGAGCCGGT GCAACTATTT AGCGATGCCG AGGCGGCCGA

201 TTTGTTCGGA CAAGGCTCGC TGGCGCATTT GATGGTGCGC AAGCATTTG

251 CCAACAACCC TTATTTGGAT TTGACCGTTA TCGGTATTGC CGACCACAGC

301 GCAGGCGTGC AGGCAACCGC AACCGTTACC CTTTCCGGCA CGGCCACCGC

351 GCCGGGCGTG GTGGAAATCA CGATTGGCGG CAAGCAGGTA AGCACGGCCG

401 TTAACACCGG CGAGACCGCC GCCACAGTGG CAGACCGTCT GAAAACCGCC

451 ATCACTGCCG CCGATGTAAC CGTTACCGCA TCCGGCAGCG GCGCAGCCGT

501 TACGCTGACG GCCAAACACA AAGGCGAGAT CGGCAACGAG AGCGGCTTAA

551 CCGTGAGCAC CGGCAATACC GGCCTAACTT ATCAAGCCAA TGCCTTTACC

601 GGCGGTGCCA AAAATGCGGA CATTGCCACG GCCTTGTCCA AAGTGGCGGG

651 CAAGCATTAT CACATTATTT GCAGCCCGTT TAGCGATGAC GCCAACGCCA

701 AAGCCTTGAG CAACCATATT ACCAACGTAT CCAACGCCAT CGAGCAGCGC

751 GGCTGTATCG GCGTATTGGG TATGAGTGCG GCCTTGAGCA CGGCCACCAC

801 CGCTACCGGC GAAATCAACG ACGGCCGCAT GACCTGTGCT TGGTACAAAG

851 GTGCGGTAGA GCCAAACGGC ATCATCGCCG CAGGTTATGC GGCGGTGTTG

901 GCCTTTGAAG AAGACCCTGC CAAGCCGCTG AACACGCTGG AAATCAAAGG

951 GCTGGCCGTT ACACCTGATG CGCAATGGCC GCTGTTTGCA GAATGCAACA

1001 ATGCGCTGTA CAACGGCTTG ACCCCGCTCA CAGTGGTCAA CAACCGCGTG

1051 CAGATTATGC GTGCCGTATC CACCTATACC AAGTCGGCCA ACAACACCGA

1101 CGACCCGGCA CTACTCGACA TTACCACCAT CCGCACGCTG GATTATGTGC

1151 GCCGCAGCGT TAAAGAGCGC ATTGCCCTGC GTTTTCCGCG CGACAAATTG

1201 AGCGACCGCC TGCTGCCCAA GGTTAAGAGC GAGATTTTGG ACGTGCTGAT

1251 TAAGCTCGAC CAAGCCGAAA TCATCGAAAA CGCCGAGGCC AACAAAGGCA

1301 AGCTGGTGGT GGCGCGTGCG CAAAACGACC CCAACCGTGT TAATGCCATT

1351 ATCACTGCCG ATGTGGTCAA CGGCCTGCAC GTCTTTGCCG GGCGCATTGA

1401 TTTGATTTTG TAA
```

This corresponds to the amino acid sequence <SEQ ID 2394; ORF 712>:

```
m712.pep
   1 MMPHIDFDTI PGSIRVPGQY IEFNTRNAVQ GLPQNPQKVL MVAPMLTAGI

51 QPALEPVQLF SDAEAADLFG QGSLAHLMVR QAFANNPYLD LTVIGIADHS

101 AGVQATATVT LSGTATAPGV VEITIGGKQV STAVNTGETA ATVADRLKTA

151 ITAADVTVTA SGSGAAVTLT AKHKGEIGNE SGLTVSTGNT GLTYQANAFT

201 GGAKNADIAT ALSKVAGKHY HIICSPFSDD ANAKALSNHI TNVSNAIEQR

251 GCIGVLGMSA ALSTATTATG EINDGRMTCA WYKGAVEPNG IIAAGYAAVL

301 AFEEDPAKPL NTLEIKGLAV TPDAQWPLFA ECNNALYNGL TPLTVVNNRV

351 QIMRAVSTYT KSANNTDDPA LLDITTIRTL DYVRRSVKER IALRFPRDKL

401 SDRLLPKVKS EILDVLIKLD QAEIIENAEA NKGKLVVARA QNDPNRVNAI

451 IPADVVNGLH VFAGRIDLIL *
``` a712.seq not found yet
a712.pep not found yet
g713.seq not found yet
g713.pep not found yet The following partial DNA sequence was identified in *N. meningitidis* <SEQ ID 2395>:

```
m713.seq
   1  ATGCAAAATA ATTCATACGG CTATGCCGTG TCGGTGCGCG TGGGCGGTAA

51  AGAGCACCGC CACTGGGAGC GCTACGACAT CGACAGCGAC TTTTTAATCC

101  CTGCCGACAG CTTCGATTTT GTCATCGGCA GGTTGGGACC GGAGGCGGCC

151  ATACCCGATT TAAGCGGAGA GAGCTGCGAG GTAGTGATAG ACGGGCAAAT

201  CGTGATGACG GGCATCATCG GCAGCCAGCG CCACGGCAAA AGCAAGGGCA

251  GCCGCGAGTT GAGCTTGAGC GGGCGTGATT TGGCCGGTTT TTTGGTGGAT

301  TGCTCCGCGC CGCAGCTCAA TGTAAAGGGC ATGACGGTAT TGGATGCAGC

351  CAAAAAGCTG GCCGCGCCGT GGCCGCAGAT TAAAGCGGTG GTGCTTAAGG

401  CCGAAAACAA CCCCGCTTTG GGCAAAATCG ACATCGAGCC GGGCGAAACC

451  GTATGGCAGG CATTAACCCA TATTGCCAAC TCGGTCGGGC TGCATCCGTG

501  GCTGGAGCCG GACGGCACGT TGGTGGTGGG CGGTGCGGAT TACAGCAGCC

551  CGCCGGTGGC GACATTGTGT TGGAGCCGCA CCGACAGCCG CTGCAATATC

601  GAGCGCATGG ACATTGAGTG GGATACCGAC AACCGCTTTT CCGAGGTTAC

651  TTTTTTGGCG CAATCGCACG GCCGCAGCGG CGACAGCGCC AAACACGATT

701  TAAAGTGGGT GTACAAAGAC CCGACGATGA CGCTGCACCG CCCTAAAACG

751  GTGGTGGTGT CCGATGCCGA CAATTTGGCC GCATTGCAAA AGCAGGCTAA

801  AAAGCAGCTG GCCGACTGGC GGCTGGAGGG ATTTACACTC ACGATAACCG

851  TGGGCGGCCA TAAAACCCGC GACGGCGTAT TGTGGCAACC TGGCCTGCGT

901  GTGCATGTGA TCGACGACGA GCACGGTATC GATGCGGTGT TTTTTCTGAT

951  GGGGCGGCGG TTTATGCTAT CCCGCATGGA TGGTACGCAA ACCGAGCTGC

1001  GGCTCAAAGA GGACGGTATT TGGACACCCG ACGCTTACCC CAAAAAGGCC

1051  GAGGCGGCGC GCAAGCGCAA AGGCAAACGC AAAGGCGTGA GCCATAAGGG

1101  CAAAAAAGGC GGCAAAAAAC AAGCAGAAAC GGCGGTGTTT GAATGA
```

This corresponds to the amino acid sequence <SEQ ID 2396; ORF 713>:

```
m713.pep
   1  MQNNSYGYAV SVRVGGKEHR HWERYDIDSD FLIPADSFDF VIGRLGPEAA

51  IPDLSGESCE VVIDGQIVMT GIIGSQRHGK SKGSRELSLS GRDLAGFLVD

101  CSAPQLNVKG MTVLDAAKKL AAPWPQIKAV VLKAENNPAL GKIDIEPGET

151  VWQALTHIAN SVGLHPWLEP DGTLVVGGAD YSSPPVATLC WSRTDSRCNI

201  ERMDIEWDTD NRFSEVTFLA QSHGRSGDSA KHDLKWVYKD PTMTLHRPKT

251  VVVSDADNLA ALQKQAKKQL ADWRLEGFTL TITVGGHKTR DGVLWQPGLR

301  VHVIDDEHGI DAVFFLMGRR FMLSRMDGTQ TELRLKEDGI WTPDAYPKKA

351  EAARKRKGKR KGVSHKGKKG GKKQAETAVF E*
```

The following partial DNA sequence was identified in *N. meningitidis* <SEQ ID 2397>:

```
a713.seq
    1 ATGCAAAATA ATTCATACGG CTATGCCGTG TCGGTGCGCG TGGGCGGTAA
   51 AGAGCACCGC CACTGGGAGC GCTACGACAT CGACAGCGAC TTTTTAATCC
  101 CTGCCGACAG CTTCGATTTT GTCATCGGCA GGTTGGGGCC GGAGGCGGCC
  151 ATACCCGATT TAAGCGGAGA GAGCTGCGAG GTAGTGATAG ACGGGCAAAT
  201 CGTGATGACG GGCATCATCG GCAGCCAGCG CCACGGCAAA AGCAAGGGCG
  251 GCCGCGAGTT GAGCTTGAGC GGGCGTGATT TGGCCGGTTT TTTGGTGGAT
  301 TGCTCCGCGC CGCAGCTCAA TGTAAAGGGC ATGACGGTAT TGGATGCAGC
  351 CAAAAAGCTG GCCGCGCCGT GGCCGCAGAT TAAAGCGGTG GTGCTTAAGG
  401 TCGAAAACAA CCCCGCTTTG ACAAAATCG ACATCGAGCC GGGCGAAACC
  451 GTATGGCAGG CATTAACCCA TATTGCCAAC TCGGTCGGGC TGCATCCGTG
  501 GCTGGAGCCG GACGGCACGT TGGTGGTGGG CGGTGTGGAT TACAGCAGCC
  551 CGCCGGTGGC GACATTGTGT TGGAGCCGCA CCGACAGCCG CCGCAATATC
  601 GAGCGCATGG ACATTGAGTG GGATACCGAC AACCGCTTTT CTGAGGTTAC
  651 TTTTTTGGCG CAATCGCACG GCCGCAGCGG CGACAGCGCC AAACACGATT
  701 TAAAGTGGGT GTACAAAGAC CCGACGATGA CGCTGCACCG CCCTAAAACG
  751 GTGGTGGTGT CCGATGCCGA CAATTTGGCC GCATTGCAAA AGCAGGCTAA
  801 AAAGCAGCTG GCCGACTGGC GGCTGGAGGG ATTTACACTC ACGATAACCG
  851 TGGGCGGCCA TAAAACCCGC GACGGCGTAT TGTGGCAACC TGGCCAGCGT
  901 GTGCATGTGA TCGACGACGA GCACGGTATC GATGCGGTGT TTTTTCTGAT
  951 GGGGCGGCGG TTTATGCTAT CTCGCATGGA TGGCACGCAA ACCGAGCTGC
 1001 GGCTCAAAGA GGACGGTATT TGGACACCCG ACGCTTACCC CAAAAAGGCC
 1051 GAGGCGGCGC GCAAGCGCAA AGGCAAACGC AAAGGCGTGA GCCATAAGGG
 1101 CAAAAAGGC GGCAAAAAAC AAGCAGAAAC GGCGGTGTTT GAATGA
```

This corresponds to the amino acid sequence <SEQ ID 2398; ORF 713.a>:

```
a713.pep
    1 MQNNSYGYAV SVRVGGKEHR HWERYDIDSD FLIPADSFDF VIGRLGPEAA
   51 IPDLSGESCE VVIDGQIVMT GIIGSQRHGK SKGGRELSLS GRDLAGFLVD
  101 CSAPQLNVKG MTVLDAAKKL AAPWPQIKAV VLKVENNPAL DKIDIEPGET
  151 VWQALTHIAN SVGLHPWLEP DGTLVVGGVD YSSPPVATLC WSRTDSRRNI
  201 ERMDIEWDTD NRFSEVTFLA QSHGRSGDSA KHDLKWVYKD PTMTLHRPKT
  251 VVVSDADNLA ALQKQAKKQL ADWRLEGFTL TITVGGHKTR DGVLWQPGQR
  301 VHVIDDEHGI DAVFFLMGRR FMLSRMDGTQ TELRLKEDGI WTPDAYPKKA
  351 EAARKRKGKR KGVSHKGKKG GKKQAETAVF E*
``` a713/m713 98.4% identity in 381 aa overlap

```
                    10         20         30         40         50         60
     a713.pep   MQNNSYGYAVSVRVGGKEHRHWERYDIDSDFLIPADSFDFVIGRLGPEAAIPDLSGESCE
                ||||||||||||||||||||||||||||||||||||||||||||||||||||||||||||
     m713       MQNNSYGYAVSVRVGGKEHRHWERYDIDSDFLIPADSFDFVIGRLGPEAAIPDLSGESCE
                    10         20         30         40         50         60
```

```
                70         80         90        100        110        120
a713.pep   VVIDGQIVMTGIIGSQRHGKSKGGRELSLSGRDLAGFLVDCSAPQLNVKGMTVLDAAKKL
           ||||||||||||||||||||||||:|||||||||||||||||||||||||||||||||||
m713       VVIDGQIVMTGIIGSQRHGKSKGSRELSLSGRDLAGFLVDCSAPQLNVKGMTVLDAAKKL
                70         80         90        100        110        120

130        140        150        160        170        180
a713.pep   AAPWPQIKAVVLKVENNPALDKIDIEPGETVWQALTHIANSVGLHPWLEPDGTLVVGGVD
           ||||||||||||:|||||| ||||||||||||||||||||||||||||||||||||||:|
m713       AAPWPQIKAVVLKAENNPALGKIDIEPGETVWQALTHIANSVGLHPWLEPDGTLVVGGAD
               130        140        150        160        170        180

190        200        210        220        230        240
a713.pep   YSSPPVATLCWSRTDSRRNIERMDIEWDTDNRFSEVTFLAQSHGRSGDSAKHDLKWVYKD
           |||||||||||||||||| ||||||||||||||||||||||||||||||||||||||||
m713       YSSPPVATLCWSRTDSRCNIERMDIEWDTDNRFSEVTFLAQSHGRSGDSAKHDLKWVYKD
               190        200        210        220        230        240

250        260        270        280        290        300
a713.pep   PTMTLHRPKTVVVSDADNLAALQKQAKKQLADWRLEGFTLTITVGGHKTRDGVLWQPGQR
           |||||||||||||||||||||||||||||||||||||||||||||||||||||||||| |
m713       PTMTLHRPKTVVVSDADNLAALQKQAKKQLADWRLEGFTLTITVGGHKTRDGVLWQPGLR
               250        260        270        280        290        300

310        320        330        340        350        360
a713.pep   VHVIDDEHGIDAVFFLMGRRFMLSRMDGTQTELRLKEDGIWTPDAYPKKAEAARKRKGKR
           ||||||||||||||||||||||||||||||||||||||||||||||||||||||||||||
m713       VHVIDDEHGIDAVFFLMGRRFMLSRMDGTQTELRLKEDGIWTPDAYPKKAEAARKRKGKR
               310        320        330        340        350        360

370        380
a713.pep   KGVSHKGKKGGKKQAETAVFEX
           ||||||||||||||||||||||
m713       KGVSHKGKKGGKKQAETAVFEX
               370        380
``` g714.seq not found yet
g714.pep not found yet
The following partial DNA sequence was identified in *N. meningitidis* <SEQ ID 2399>:

```
m714.seq
    1   ATGAGCTATC AAGACATCTT GCGGGGCCTG TTGCCCCCCG TGTCGTATGC

51   CCGCAATGCC CCGCGTGTGC GGGCGCAGGC AGAAATAGAC GGCGCAGCGC

101   TGGATGCGGT GGCGGAATCG GCTCAAAGCG TTGCCGATGC CGTCGACCCG

151   CGCAGCGCCG GCCAAATGCT GGCCGATTGG GAGCGCGTAT TAGGTTTGGA

201   CGGTACGGGC AAAAACCGCC AGCACCGTGT GTTGGCCGTC ATGGCCAAGC

251   TAAACGAAAC AGGCGGCTTG AGTATTCCTT ATTTTGTGCG TTTGGCCGAG

301   GCGGCGGGCT ATCAAATCCA AATCGACGAA CCGCAGCCGT TCCGCGCCGG

351   TGTAAACCGC GCCGGCGACC GTCTTGCGCC GCAGGAAATC ATGTGGGTGT

401   GGCACGTTAA CGTGCGCGGC GGCAACAACC GCATTACCCG ATTCCGCGCC

451   GGTATCTCGG CGGCGGGCGA CAGGCTGACC GATTACAGCG ATGCCGTGAT

501   CGAGAGCCTG TTCAACCGCC TCAAGCCCGC CCACACCGCT ATCCGATTTA

551   CCTACCGCTA A
```

This corresponds to the amino acid sequence <SEQ ID 2400; ORF 714>:

```
m714.pep
    1   MSYQDILRGL LPPVSYARNA PRVRAQAEID GAALDAVAES AQSVADAVDP

51   RSAGQMLADW ERVLGLDGTG KNRQHRVLAV MAKLNETGGL SIPYFVRLAE

101   AAGYQIQIDE PQPFRAGVNR AGDRLAPQEI MWVWHVNVRG GNNRITRFRA

151   GISAAGDRLT DYSDAVIESL FNRLKPAHTA IRFTYR*
```

The following partial DNA sequence was identified in *N. meningitidis* <SEQ ID 2401>:

```
a714.seq
     1   ATGAGCTATC AAGACATCTT GCGGGGTCTG TTGCCCCCCG TGTCGTATGC

51   CCGCAATGCC CCGCGTGTGC GGGCGCAGGC AGAAATAGAC GGCGCAGCGC

101   TGGATGCGGT GGCGGAATCG GCTCAAAGCG TTGCCGATGC CGTCGACCCG

151   AGCAGCGCCG GCCAAATGCT GGCCGATTGG GAGCGCGTAT TAGGTTTGGA

201   CGGTACGGGC AAAAACCGCC AGCGCCGTGT GTTGGCCGTC ATGGCCAAGC

251   TAAACGAAAC AGGCGGCTTG AGTATTCCTT ATTTTGTGCG TTTGGCCGAG

301   GCGGCGGGCT ATCAAATCCA AATCGACGAA CCGCAGCCGT TCCGCGCCGG

351   TGTAAACCGC GCCGGCGACC GTCTTGCGCC GCAGGAAATC ATGTGGGTGT

401   GGCACGTTAA CGTGCGCGGC GGCAACAACC GCATTACCCG ATTCCGCGCC

451   GGTATCTCGG CGGCGGGCGA CAGGCTGACC GATTACAGCG ATGCCGTGAT

501   CGAGAGCCTG TTCAACCGCC TCAAGCCCGC CCACACCGCT ATCCGATTTA

551   CCTACCGATA A
```

This corresponds to the amino acid sequence <SEQ ID 2402; ORF 714.a>:

```
a714.pep
     1   MSYQDILRGL LPPVSYARNA PRVRAQAEID GAALDAVAES AQSVADAVDP

51   SSAGQMLADW ERVLGLDGTG KNRQRRVLAV MAKLNETGGL SIPYFVRLAE

101   AAGYQIQIDE PQPFRAGVNR AGDRLAPQEI MWVWHVNVRG GNNRITRFRA

151   GISAAGDRLT DYSDAVIESL FNRLKPAHTA IRFTYR*
``` a714/m714 98.9% identity in 186 aa overlap

```
                        10        20        30        40        50        60
a714.pep     MSYQDILRGLLPPVSYARNAPRVRAQAEIDGAALDAVAESAQSVADAVDPSSAGQMLADW
             |||||||||||||||||||||||||||||||||||||||||||||||||| |||||||||
m714         MSYQDILRGLLPPVSYARNAPRVRAQAEIDGAALDAVAESAQSVADAVDPRSAGQMLADW
                        10        20        30        40        50        60

70        80        90       100       110       120
a714.pep     ERVLGLDGTGKNRQRRVLAVMAKLNETGGLSIPYFVRLAEAAGYQIQIDEPQPFRAGVNR
             ||||||||||||||:|||||||||||||||||||||||||||||||||||||||||||||
m714         ERVLGLDGTGKNRQHRVLAVMAKLNETGGLSIPYFVRLAEAAGYQIQIDEPQPFRAGVNR
                        70        80        90       100       110       120

130       140       150       160       170       180
a714.pep     AGDRLAPQEIMWVWHVNVRGGNNRITRFRAGISAAGDRLTDYSDAVIESLFNRLKPAHTA
             ||||||||||||||||||||||||||||||||||||||||||||||||||||||||||||
m714         AGDRLAPQEIMWVWHVNVRGGNNRITRFRAGISAAGDRLTDYSDAVIESLFNRLKPAHTA
                       130       140       150       160       170       180 a714.pep     IRFTYRX
             |||||||
m714         IRFTYRX
``` g715.seq not found yet g715.pep not found yet

The following partial DNA sequence was identified in *N. meningitidis* <SEQ ID 2403>:

```
m715.seq
     1   ATGATTGATG TCAAAATAGA CAATATCTTT GTCGTCCTAA ACCAAATCGA

51   GCGGCTTGGC AACGGGATCG AAAACCGCTA CCTGCTGATG CGCCGACTGT

101   CCGAAACCAT GCACACGGCG GTCAAGCTCA ATTTCCGCTA CGCAGGCCGT
```

-continued

```
   151  CCGAAATGGG TTGGGCTAAA ATACCGCGAC GGCAAGCCGC TTTCGGATTC

201  GGGTCGTCTG AAAGACAGTT TTTCCACACT GTCAGACAAC GATACAGCCC

251  TTGTCGGTAC GAATATCGTC TATGCCGCCA TCCACAACTT CGGCGGTATG

301  GCGGGGCGCA ACCGCAAAGT TCGGATTCCG CAACGGGAAT TTTTGACGCT

351  GACGGACGAC GACAAACAGG CTTTGATGGA CGATGTGCAG GATTATTTTT

401  CGGGTCTGAT ACCGTGA
```

This corresponds to the amino acid sequence <SEQ ID 2404; ORF 715>:

```
m715.pep
     1  MIDVKIDNIF VVLNQIERLG NGIENRYLLM RRLSETMHTA VKLNFRYAGR

51  PKWVGLKYRD GKPLSDSGRL KDSFSTLSDN DTALVGTNIV YAAIHNFGGM

101  AGRNRKVRIP QREFLTLTDD DKQALMDDVQ DYFSGLIP*
```

The following partial DNA sequence was identified in N. meningitidis <SEQ ID 2405>:

```
a715.seq
     1  ATGATTGATG TCAAAATAGA CAATATCTTT GTCGTCCTAA ACCAAATCGA

51  GCGGCTTGGC AACGGGATCG AAAACCGCTA CCTGCTGATG CGCCGACTGT

101  CCGAAACCAT GCACACGGCG GTCAAGCTCA ATTTCCGCTA CGCAGGCCGT

151  CCGAAATGGT TGGGGCTAAA ATACCGCGAC GGCAAGCCGC TTTCGGATTC

201  GGGTCGTCTG AAAGACAGTT TTTCCACACT GTCAGACAAC GATACAGCCC

251  TTGTCGGTAC GAATATCGTC TATGCCGCCA TCCACAACTT CGGCGGTATG

301  GCGGGGCGCA ACCGCAAAGT TCGGATTCCG CAACGGGAAT TTTTGACGCT

351  GACGGACGAC GACAAACAGG CTTTGATGGA CGATGTGCAG GATTATTTTT

451  CGGGTCTGAT ACCGTGA
```

This corresponds to the amino acid sequence <SEQ ID 2406; ORF 715.a>:

```
a715.pep
     1  MIDVKIDNIF VVLNQIERLG NGIENRYLLM RRLSETMHTA VKLNFRYAGR

51  PKWLGLKYRD GKPLSDSGRL KDSFSTLSDN DTALVGTNIV YAAIHNFGGM

101  AGRNRKVRIP QREFLTLTDD DKQALMDDVQ DYFSGLIP*
```

The following partial DNA sequence was identified in N. gonorrhoeae <SEQ ID 2407>:

```
g716.seq
     1  ATGAACAAAA ATATTGCTGC CGCACTCGCC GGTGCTTTAT CCCTGTCTCT

51  GGCCGCCGGC GCCGTTGCCG CCCACAAACC GGCAAGCAAC GCAACAGGCG

101  TTCAAAAATC CGCCCAAGGC TCTTGCGGCG CATCCAAATC TGCCGAAGGT

151  TCGTGCGGCG CATCCAAATC TGCCGAAGGT TCGTGCGGCG CGGCTGCTTC

201  TAAAGCAGGC GAAGGCAAAT GCGGCGAGGG CAAATGCGGT GCAACTGTAA
```

-continued

```
251   AAAAAGCCCA CAAACACACC AAAGCATCTA AAGCCAAAGC CAAATCTGCC

301   GAAGGCAAAT GCGGCGAAGG CAAATGCGGT TCTAAATAA
```

This corresponds to the amino acid sequence <SEQ ID 2408;
ORF 716.ng>:

```
g716.pep
    1   MNKNIAAALA GALSLSLAAG AVAAHKPASN ATGVQKSAQG SCGASKSAEG

51   SCGASKSAEG SCGAAASKAG EGKCGEGKCG ATVKKAHKHT KASKAKAKSA

101   EGKCGEGKCG SK*
```

The following partial DNA sequence was identified in *N. meningitidis* <SEQ ID 2409>:

```
m716.seq
    1   ATGAACAAAA ACATTGCTGC CGCTCTCGCC GGTGCTTTAT CCCTGTCTTT

51   GGCCGCCGGT GCAGTTGCTG CCAACAAACC GGCAAGCAAC GCAACAGGCG

101   TTCATAAATC CGCCCATGGC TCTTGCGGCG CGTCCAAATC TGCCGAAGGT

151   TCGTGCGGCG CGGCTGGTTC TAAAGCAGGC GAAGGCAAAT GCGGCGAGGG

201   CAAATGCGGT GCGACCGTAA AAAAAACCCA CAAACACACC AAAGCATCTA

251   AAGCCAAGGC CAAATCTGCC GAAGGCAAAT GCGGCGAAGG CAAATGCGGT

301   TCTAAATAA
```

This corresponds to the amino acid sequence <SEQ ID 241
ORF 716>:

```
m716.pep
    1   MNKNIAAALA GALSLSLAAG AVAANKPASN ATGVHKSAHG SCGASKSAEG

51   SCGAAGSKAG EGKCGEGKCG ATVKKTHKHT KASKAKAKSA EGKCGEGKCG

101   SK*
``` m716/g716 86.6% identity in 112 aa overlap

```
                10        20        30        40        50
   m716.pep  MNKNIAAALAGALSLSLAAGAVAANKPASNATGVHKSAHGSCGASKSAEGSCGA------
             ||||||||||||||||||||||||:||||||||:|||:|||||||||||||
   g716      MNKNIAAALAGALSLSLAAGAVAAHKPASNATGVQKSAQGSCGASKSAEGSCGASKSAEG
                10        20        30        40        50        60

60        70        80        90       100
   m716.pep  ----AGSKAGEGKCGEGKCGATVKKTHKHTKASKAKAKSAEGKCGEGKCGSKX
                |:|||||||||||||||||:||||||||||||||||||||||||||||
   g716      SCGAAASKAGEGKCGEGKCGATVKKAHKHTKASKAKAKSAEGKCGEGKCGSKX
                70        80        90       100       110
```

The following partial DNA sequence was identified in *N. meningitidis* <SEQ ID 2411>:

```
a716.seq
    1   ATGAACAAAA ACATTGCTGC CGCACTCGCC GGTGCTTTAT CCCTGTCTTT

51   GGCCGCCGGT GCAGTTGCTG CCAACAAACC GGCAAGCAAC GCAACAGGCG

101   TTCATAAATC CGCCCATGGC TCTTGCGGCG CGTCCAAATC TGCCGAAGGT

151   TCGTGCGGCG CGGCTGGTTC TAAAGCAGGC GAAGGCAAAT GCGGCGAGGG
```

```
-continued
201  CAAATGCGGT GCGACCGTAA AAAAAACCCA CAAACACACC AAAGCATCTA

251  AAGCCAAGGC CAAATCTGCC GAAGGCAAAT GCGGCGAAGG CAAATGCGGT

301  TCTAAATAA
```

The following partial DNA sequence was identified in *N. meningitidis* <SEQ ID 2412.a>:

```
a716.pep
   1  MNKNIAAALA GALSLSLAAG AVAANKPASN ATGVHKSAHG SCGASKSAEG

51  SCGAAGSKAG EGKCGEGKCG ATVKKTHKHT KASKAKAKSA EGKCGEGKCG

101  SK*
``` a716/m716 100.0% identity in 102 aa overlap

```
                    10        20        30        40        50        60
    a716.pep  MNKNIAAALAGALSLSLAAGAVAANKPASNATGVHKSAHGSCGASKSAEGSCGAAGSKAG
              ||||||||||||||||||||||||||||||||||||||||||||||||||||||||||||
       m716   MNKNIAAALAGALSLSLAAGAVAANKPASNATGVHKSAHGSCGASKSAEGSCGAAGSKAG
                    10        20        30        40        50        60

70        80        90       100
    a716.pep  EGKCGEGKCGATVKKTHKHTKASKAKAKSAEGKCGEGKCGSKX
              ||||||||||||||||||||||||||||||||||||||||||
       m716   EGKCGEGKCGATVKKTHKHTKASKAKAKSAEGKCGEGKCGSKX
                    70        80        90       100
```

The following partial DNA sequence was identified in *N. gonorrhoeae* <SEQ ID 2413>:

```
g717.seq
    1  ATGGACACAA AAGAAATCCT CGGCTACGCG GCAGGCTCGA TCGGCAGCGC

51  GGTTTTAGCC GTCATCATCC TGCCGCTGCT GTCGTGGTAT TTCcccgCCG

101  ACGACATCGG GCGCATCGTG CTGATGCAGA CGGCGGCGGG ACTGACGGTG

151  TCGGTATTGT GCCTCGGGCT GGATCAGGCA TACGTCCGCG AATACTATGC

201  CGCCGCCGAC AAAGACACTT TGTTCAAAAC CCTGTTCCTG CCGCCGCTGC

251  TGTTTTCCGC CGCGATAGCC GCCCTGCTGC TTTCCCGCCC GTCCCTGCCG

301  TCTGAAATCC TGTTTTCGCT CGACGATGCC GCCGCCGGCA TCGGGCTGGT

351  GCTGTTTGAA CTGAGCTTCC TGCCCATCCG CTTTCTCTTA CTGGTTTTGC

401  GTATGGAAGG GCGCGCCCTT GCCTTTTCGT CCGCGCAACT CGTGCCCAAA

451  CTCGCCATTC TGCTGCTGTT GCCGCTGACG GTCGGGCTGC TGCACTTTCC

501  GGCGAACACC TCCGTCCTGA CCGCCGTTTA CGCGCTGGCA AACCTTGCCG

551  CCGCCGCCTT TTTGCTGTTT CAAAACCGAT GCCGTCTGAA GGCCGTCCGG

601  CGCGCGCCGT TTTCGCCCGC CGTCCTGCAC CGGGGGCTGC GCTACGGCAT

651  ACCGCTCGCA CTGAGCAGCC TTGCCTATTG GGGGCTGGCA TCCGCCGACC

701  GTTTGTTCCT GAAAAAATAT GCGGGCCTGG AACAGCTCGG CGTTTATTCG

751  ATGGGTATTT CGTTCGGCGG GGCGGCATTA TTGCTCCAAA GCATCTTTTC

801  AACGGTCTGG ACACCGTATA TTTTCCGTGC AATCGAAGAA AACGCCACGC

851  CCGCCCGCCT CTCGGCAACG GCAGAATCCG CCGCCGCCCT GCTTGCCTCC

901  GCCCTCTGCC TGACCGGAAT TTTCTCGCCC CTCGCCTCCC TCCTGCTGCC

951  GGAAAACTAC GCCGCCGTCC GGTTTACCGT CGTATCGTGT ATGCTGccgc
```

-continued

```
1001  cgctGTTTTA CACGCTGACC GAAATCAGCG GCATCGGTTT GAACGTCGTC
1051  CGCAAAACGC GTCCGATCGC GCTTGCCACC TTGGGCGCGC TGGCGGCAAA
1101  CCTGCTGCTG CTGGGGCTTG CCGTACCGTC CGGCGGCACG CGCGGCGCGG
1151  CGGTTGCCTG TGCCGCCTCA TTCTGGTTGT TTTTTGTTTT CAAGACAGAA
1201  AGCTCCTGCC GCCTGTGGCA GCCGCTCAAA CGCCTGCCGC TTTATATGCA
1251  CACATTGTTC TGCCTgGCCT CCTCGGCGGC CTACACCTGC TTCGGCACAC
1301  CGGCAAACTA CCCcctgttt gccggcgtAT GGGCGGCATA TCTGGCAGGC
1351  TGCATCCTGC GCCACCGGAA AAATTTGCAC AAACTGTTTC ATTATTTGAA
1401  AAAACAAGGT TTCCCATTAT GA
```

This corresponds to the amino acid sequence <SEQ ID 2414;
ORF 717.ng>:

```
g717.pep
    1  MDTKEILGYA AGSIGSAVLA VIILPLLSWY FPADDIGRIV LMQTAAGLTV
   51  SVLCLGLDQA YVREYYAAAD KDTLFKTLFL PPLLFSAAIA ALLLSRPSLP
  101  SEILFSLDDA AAGIGLVLFE LSFLPIRFLL LVLRMEGRAL AFSSAQLVPK
  151  LAILLLLPLT VGLLHFPANT SVLTAVYALA NLAAAAFLLF QNRCRLKAVR
  201  RAPFSPAVLH RGLRYGIPLA LSSLAYWGLA SADRLFLKKY AGLEQLGVYS
  251  MGISFGGAAL LLQSIFSTVW TPYIFRAIEE NATPARLSAT AESAAALLAS
  301  ALCLTGIFSP LASLLLPENY AAVRFTVVSC MLPPLFYTLT EISGIGLNVV
  351  RKTRPIALAT LGALAANLLL LGLAVPSGGT RGAAVACAAS FWLFFVFKTE
  401  SSCRLWQPLK RLPLYMHTLF CLASSAAYTC FGTPANYPLF AGVWAAYLAG
  451  CILRHRKNLH KLFHYLKKQG FPL*
```

The following partial DNA sequence was identified in *N. meningitidis* <SEQ ID 2415>:

```
m717.seq
    1  ATGGACACAA AAGAAATCCT CGGCTACGCG GCAGGCTCGA TCGGCAGCGC
   51  GGTTTTAGCC GTCATCATCC TGCCGCTGCT GTCGTGGTAT TTCCCCGCCG
  101  ACGACATCGG GCGCATCGTG CTGATGCAGA CGGCGGCGGG GCTGACGGTG
  151  TCGGTGTTGT GCCTCGGGCT GGATCAGGCA TACGTCCGCG AATACTATGC
  201  CACCGCCGAC AAAGACACCT TGTTCAAAAC CCTGTTCCTG CCGCCGCTGC
  251  TGTCTGCCGC CGCGATAGCC GCCCTGCTGC TTTCCCGCCC GTCCCTGCCG
  301  TCTGAAATCC TGTTTTCACT CGACGATGCC GCCGCCGGCA TCGGGCTGGT
  351  GCTGTTTGAA CTGAGCTTCC TGCCCATCCG CTTTCTCTTA CTGGTTTTGC
  401  GTATGGAAGG ACGCGCCCTT GCCTTTTCGT CCGCGCAACT CGTGCCCAAG
  451  CTCGCCATCC TGCTGCTGCT GCCGCTGACG GTCGGGCTGC TGCACTTTCC
  501  AGCGAACACC GCCGTCCTGA CCGCCGTTTA CGCGCTGGCA AACCTTGCCG
  551  CCGCCGCCTT TTTGCTGTTT CAAAACCGAT GCCGTCTGAA GGCCGTCCGG
  601  CACGCACCGT TTTCGCCCGC CGTCCTGCAC CGGGGGCTGC GCTACGGCAT
  651  ACCGATCGCA CTGAGCAGCA TCGCCTATTG GGGGCTGGCA TCCGCCGACC
  701  GTTTGTTCCT GAAAAAATAT GCCGGCCTGG AACAGCTCGG CGTTTATTCG
```

```
 751  ATGGGTATTT CGTTCGGCGG GGCGGCATTA TTGTTCCAAA GCATCTTTTC

801  AACGGTCTGG ACACCGTATA TTTTCCGCGC AATCGAAGAA AACGCCCCGC

851  CCGCCCGCCT CTCGGCAACG GCAGAATCCG CCGCCGCCCT GCTTGCCTCC

901  GCCCTCTGCC TGACCGGCAT TTTCTCGCCC CTTGCCTCCC TCCTGCTGCC

951  GGAAAACTAC GCCGCCGTCC GGTTTATCGT CGTATCGTGT ATGCTGCCGC

1001  CGCTGTTTTG CACGCTGGCG GAAATCAGCG GCATCGGTTT GAACGTCGTC

1051  CGCAAAACGC GCCCGATCGC GCTCGCCACC TTGGGCGCGC TGGCGGCAAA

1101  CCTGCTGCTG CTGGGGCTTG CCGTGCCGTC CGGCGGCGCG CGCGGCGCGG

1151  CGGTTGCCTG TGCCGCCTCA TTCTGGCTGT TTTTTGCCTT CAAGACCGAA

1201  AGCTCCTGCC GCCTGTGGCA GCCGCTCAAA CGCCTGCCGC TTTATCTGCA

1251  CACATTGTTC TGCCTGACCT CCTCGGCGGC CTACACCTGC TTCGGCACGC

1301  CGGCAAACTA CCCCTGTTTT GCCGGCGTAT GGGCGGCATA TCTGGCAGGC

1351  TGCATCCTGC GCCACCGGAA AGATTTGCAC AAACTGTTTC ATTATTTGAA

1401  AAAACAAGGT TTCCCATTAT GA
```

This corresponds to the amino acid sequence <SEQ ID 2416; ORF 717>:

```
m717.pep
    1  MDTKEILGYA AGSIGSAVLA VIILPLLSWY FPADDIGRIV LMQTAAGLTV

51  SVLCLGLDQA YVREYYATAD KDTLFKTLFL PPLLSAAAIA ALLLSRPSLP

101  SEILFSLDDA AAGIGLVLFE LSFLPIRFLL LVLRMEGRAL AFSSAQLVPK

151  LAILLLLPLT VGLLHFPANT AVLTAVYALA NLAAAAFLLF QNRCRLKAVR

201  HAPFSPAVLH RGLRYGIPIA LSSIAYWGLA SADRLFLKKY AGLEQLGVYS

251  MGISFGGAAL LFQSIFSTVW TPYIFRAIEE NAPPARLSAT AESAAALLAS

301  ALCLTGIFSP LASLLLPENY AAVRFIVVSC MLPPLFCTLA EISGIGLNVV

351  RKTRPIALAT LGALAANLLL LGLAVPSGGA RGAAVACAAS FWLFFAFKTE

401  SSCRLWQPLK RLPLYLHTLF CLTSSAAYTC FGTPANYPLF AGVWAAYLAG

451  CILRHRKDLH KLFHYLKKQG FPL*
``` m717/g717 96.4% identity in 473 aa overlap

```
                 10         20         30         40         50         60
m717.pep  MDTKEILGYAAGSIGSAVLAVIILPLLSWYFPADDIGRIVLMQTAAGLTVSVLCLGLDQA
          ||||||||||||||||||||||||||||||||||||||||||||||||||||||||||||
g717      MDTKEILGYAAGSIGSAVLAVIILPLLSWYFPADDIGRIVLMQTAAGLTVSVLCLGLDQA
                 10         20         30         40         50         60

70         80         90        100        110        120
m717.pep  YVREYYATADKDTLFKTLFLPPLLSAAAIAALLLSRPSLPSEILFSLDDAAAGIGLVLFE
          |||||||:||||||||||||||||||:|||||||||||||||||||||||||||||||
g717      YVREYYAAADKDTLFKTLFLPPLLSAAAIAALLLSRPSLPSEILFSLDDAAAGIGLVLFE
                 70         80         90        100        110        120

130        140        150        160        170        180
m717.pep  LSFLPIRFLLLVLRMEGRALAFSSAQLVPKLAILLLLPLTVGLLHFPANTAVLTAVYALA
          |||||||||||||||||||||||||||||||||||||||||||||||||||:||||||||
g717      LSFLPIRFLLLVLRMEGRALAFSSAQLVPKLAILLLLPLTVGLLHFPANTSVLTAVYALA
                130        140        150        160        170        180

190        200        210        220        230        240
m717.pep  NLAAAAFLLFQNRCRLKAVRHAPFSPAVLHRGLRYGIPIALSSIAYWGLASADRLFLKKY
          ||||||||||||||||||||:|||||||||||||||||||:||||||||||||||||||
g717      NLAAAAFLLFQNRCRLKAVRRAPFSPAVLHRGLRYGIPIPLSSLAYWGLASADRLFLKKY
                190        200        210        220        230        240
```

-continued

```
                  250       260       270       280       290       300
m717.pep  AGLEQLGVYSMGISFGGAALLFQSIFSTVWTPYIFRAIEENAPPARLSATAESAAALLAS
          |||||||||||||||||||||:|||||||||||||||||||| |||||||||||||||||
g717      AGLEQLGVYSMGISFGGAALLLQSIFSTVWTPYIFRAIEENATPARLSATAESAAALLAS
                  250       260       270       280       290       300

310       320       330       340       350       360
m717.pep  ALCLTGIFSPLASLLLPENYAAVRFIVVSCMLPPLFCTLAEISGIGLNVVRKTRPIALAT
          ||||||||||||||||||||||||| |||||||||| ||:||||||||||||||||||||
g717      ALCLTGIFSPLASLLLPENYAAVRFTVVSCMLPPLFYTLTEISGIGLNVVRKTRPIALAT
                  310       320       330       340       350       360

370       380       390       400       410       420
m717.pep  LGALAANLLLLGLAVPSGGARGAAVACAASFWLFFAFKTESSCRLWQPLKRLPLYLHTLF
          |||||||||||||||||||:|||||||||||||||:|||||||||||||||||||:||||
g717      LGALAANLLLLGLAVPSGGTRGAAVACAASFWLFFVFKTESSCRLWQPLKRLPLYMHTLF
                  370       380       390       400       410       420

430       440       450       460       470
m717.pep  CLTSSAAYTCFGTPANYPLFAGVWAAYLAGCILRHRKDLHKLFHYLKKQGFPLX
          ||:||||||||||||||||||||||||||||||||||:||||||||||||||||
g717      CLASSAAYTCFGTPANYPLFAGVWAAYLAGCILRHRKNLHKLFHYLKKQGFPLX
                  430       440       450       460       470
```

The following partial DNA sequence was identified in *N. meningitidis* <SEQ ID 2417>:

```
a717.seq
   1  ATGGACACAA AAGAAATCCT CGGCTACGCG GCAGGCTCGA TCGGCAGCGC

51  GGTTTTAGCC GTCATCATCC TGCCGCTGCT GTCGTGGTAT TTCCCTGCCG

101  ACGACATCGG ACGCATCGTG CTGATGCAGA CGGCGGCGGG GCTGACGGTG

151  TCGGTGTTGT GCCTCGGGCT GGATCAGGCA TACGTCCGCG AATACTATGC

201  CGCCGCCGAC AAAGACACTT TGTTCAAAAC CCTGTTCCTG CCGCCGCTGC

251  TGTCTGCCGC CGCGATAGCC GCCCTGCTGC TTTTCCGCGC ATCCCTGCCG

301  TCTGAAATCC TGTTTTCGCT CGACGATGCC GCCGCCGGCA TCGGGCTGGT

351  GCTGTTTGAA CTGAGCTTCC TGCCCATCCG CTTTCTCTTA CTGGTTTTGC

401  GTATGGAAGG ACGCGCCCTT GCCTTTTCGT CCGCGCAACT CGTGTCCAAG

451  CTCGCCATCC TGCTGCTGCT GCCGCTGACG GTCGGGCTGC TGCACTTTCC

501  GGCGAACACC GCCGTCCTGA CCGCCGTTTA CGCGCTGGCA AACCTTGCCG

551  CCGCCGCCTT TTTGCTGTTT CAAAACCGAT GCCGTCTGAA GGCCGTCCGG

601  CGCGCACCGT TTTCATCCGC CGTCCTGCAT CGCGGCCTGC GCTACGGCAT

651  ACCGATCGCA CTAAGCAGCA TCGCCTATTG GGGGCTGGCA TCCGCCGACC

701  GTTTGTTCCT GAAAAAATAT GCCGGCCTAG AACAGCTCGG CGTTTATTCG

751  ATGGGTATTT CGTTCGGCGG AGCGGCATTA TTGTTCCAAA GCATCTTTTC

801  AACGGTCTGG ACACCGTATA TTTTCCGCGC AATCGAAGCA AACGCCCCGC

851  CCGCCCGCCT CTCGGCAACG GCAGAATCCG CCGCCGCCTT GCTTGCCTCC

901  GCCCTCTGCC TGACCGGCAT TTTCTCGCCC CTCGCCTCCC TCCTGCTGCC

951  GGAAAACTAC GCCGCCGTCC GGTTTATCGT CGTATCGTGT ATGCTGCCTC

1001  CGCTGTTTTG CACGCTGGTA GAAATCAGCG GCATCGGTTT GAACGTCGTC

1051  CGAAAAACAC GCCCGATCGC GCTCGCCACC TTGGGCGCGC TGGCGGCAAA

1101  CCTGCTGCTG CTGGGGCTTG CCGTACCGTC CGGCGGCGCG CGCGGCGCGG

1151  CGGTTGCCTG TGCCGCCTCA TTTTGGCTGT TTTTTGTTTT CAAGACCGAA

1201  AGCTCCTGCC GCCTGTGGCA GCCGCTCAAA CGCCTGCCGC TTTATATGCA

1251  CACATTGTTC TGCCTGGCCT CCTCGGCGGC CTACACCTGC TTCGGCACTC
```

```
-continued
1301  CGGCAAACTA CCCCCTGTTT GCCGGCGTAT GGGCGGTATA TCTGGCAGGC

1351  TGCATCCTGC GCCACCGGAA AGATTTGCAC AAACTGTTTC ATTATTTGAA

1401  AAAACAAGGT TTCCCATTAT GA
```

This corresponds to the amino acid sequence <SEQ ID 2418; ORF 717.a>:

```
a717.pep
  1   MDTKEILGYA AGSIGSAVLA VIILPLLSWY FPADDIGRIV LMQTAAGLTV

51   SVLCLGLDQA YVREYYAAAD KDTLFKTLFL PPLLSAAAIA ALLLSRPSLP

101   SEILFSLDDA AAGIGLVLFE LSFLPIRFLL LVLRMEGRAL AFSSAQLVSK

151   LAILLLLPLT VGLLHFPANT AVLTAVYALA NLAAAAFLLF QNRCRLKAVR

201   RAPFSSAVLH RGLRYGIPIA LSSIAYWGLA SADRLFLKKY AGLEQLGVYS

251   MGISFGGAAL LFQSIFSTVW TPYIFRAIEA NAPPARLSAT AESAAALLAS

301   ALCLTGIFSP LASLLLPENY AAVRFIVVSC MLPPLFCTLV EISGIGLNVV

351   RKTRPIALAT LGALAANLLL LGLAVPSGGA RGAAVACAAS FWLFFVFKTE

401   SSCRLWQPLK RLPLYMHTLF CLASSAAYTC FGTPANYPLF AGVWAVYLAG

451   CILRHRKDLH KLFHYLKKQG FPL*
``` a717/m717 97.9% identity in 473 aa overlap

```
                  10        20        30        40        50        60
      a717.pep  MDTKEILGYAAGSIGSAVLAVIILPLLSWTFPADDIGRIVLMQTAAGLTVSVLCLGLDQA
                ||||||||||||||||||||||||||||||||||||||||||||||||||||||||||||
      m717      MDTKEILGYAAGSIGSAVLAVIILPLLSWTFPADDIGRIVLMQTAAGLTVSVLCLGLDQA
                  10        20        30        40        50        60

70        80        90       100       110       120
      a717.pep  YVREYYAAADKDTLFKTLFLPPLLSAAAIAALLLSRPSLPSEILFSLDDAAAGIGLVLFE
                ||||||| :||||||||||||||||||||||||||||||||||||||||||||||||||
      m717      YVREYYATADKDTLFKTLFLPPLLSAAAIAALLLSRPSLPSEILFSLDDAAAGIGLVLFE
                  70        80        90       100       110       120

130       140       150       160       170       180
      a717.pep  LSFLPIRFLLLVLRMEGRALAFSSAQLVSKLAILLLLPLTVGLLHFPANTAVLTAVYALA
                ||||||||||||||||||||||||||||| ||||||||||||||||||||||||||||||
      m717      LSFLPIRFLLLVLRMEGRALAFSSAQLVPKLAILLLLPLTVGLLHFPANTAVLTAVYALA
                 130       140       150       160       170       180

190       200       210       220       230       240
      a717.pep  NLAAAAFLLFQNRCRLKAVRRAPFSSAVLHRGLRYGIPIALSSIAYWGLASADRLFLKKY
                |||||||||||||||||||:||||:||||||||||||||||||||||||||||||||||
      m717      NLAAAAFLLFQNRCRLKAVRHAPFSPAVLHRGLRYGIPIALSSIAYWGLASADRLFLKKY
                 190       200       210       220       230       240

250       260       270       280       290       300
      a717.pep  AGLEQLGVYSMGISFGGAALLFQSIFSTVWTPYIFRAIEANAPPARLSATAESAAALLAS
                |||||||||||||||||||||||||||||||||||||||:||||||||||||||||||||
      m717      AGLEQLGVYSMGISFGGAALLFQSIFSTVWTPYIFRAIEENAPPARLSATAESAAALLAS
                 250       260       270       280       290       300

310       320       330       340       350       360
      a717.pep  ALCLTGIFSPLASLLLPENYAAVRFIVVSCMLPPLFCTLVEISGIGLNVVRKTRPIALAT
                |||||||||||||||||||||||||||||||||||||||:|:|||||||||||||||||
      m717      ALCLTGIFSPLASLLLPENYAAVRFIVVSCMLPPLFCTLAEISGIGLNVVRKTRPIALAT
                 310       320       330       340       350       360

370       380       390       400       410       420
      a717.pep  LGALAANLLLLGLAVPSGGARGAAVACAASFWLFFVFKTESSCRLWQPLKRLPLYMHTLF
                ||||||||||||||||||||||||||||||||||:|||||||||||||||||||:||||
      m717      LGALAANLLLLGLAVPSGGARGAAVACAASFWLFFAFKTESSCRLWQPLKRLPLYLHTLF
                 370       380       390       400       410       420

430       440       450       460       470
      a717.pep  CLASSAAYTCFGTPANYPLFAGVWAVYLAGCILRHRKDLHKLFHYLKKQGFPLX
                ||:|||||||||||||||||||||||:|||||||||||||||||||||||||||
      m717      CLTSSAAYTCFGTPANYPLFAGVWAAYLAGCILRHRKDLHKLFHYLKKQGFPLX
                 430       440       450       460       470
``` g718.seq not found yet
g718.pep not found yet
The following partial DNA sequence was identified in *N. meningitidis* <SEQ ID 2419>:

```
m718.seq
    1   TCAGACGGCC TTTACGTACC CCGAAACTTT ATCCACCGCC CGCAAAGCTG

51   GTTCAAATGG GACAAAGACA ACGGGCTGCT GCTGCGTACC CGCGAAAATC

101   CGGAAGGCGA AGCGTTGTGG CCGCTGGGCT GGGTCGTTCA TACCCAAAAA

151   TCGCGCAGCG TCCAGCAGGC GCGCAACGGG CTTTTCCGCA CGCTTTCCTG

201   GCTGTATATG TTCAAACACT ACGCCGTCCA CGATTTTGCC GAGTTTTTGG

251   AGCTGTACGG CATGCCCATC CGTATCGGCA AATACGGCGC GGGCGCAACC

301   AAAGAGGAAA AAAACACCCT GCTTCGAGCG GTGGCGGAAA TCGGTCACAA

351   CGCGGCAGGC ATCATGCCAG AAGGTATGGA AATAGAGCTC CACAACGCGG

401   CAAACGGTAC GACGGCAACC AGCAATCCGT TTTTGCAGAT GGCCGACTGG

451   TGCGAAAAAT CGGCGGCGCG GCTGATTTTG GGGCAAACGC TGACCAGCGG

501   TGCGGACGGA AAATCCAGCA CCAACGCGCT GGGCAATATC CACAACGAGG

551   TACGCCGCGA TTTGCTGGTG TCGGACGCAA AACAGGTGGC GCAAACCATC

601   ACAAGCCAAA TCATCGGACC GTTCCTGCAA ATCAACTATC CCCATGCCGA

651   CCCCAAACCGC GTGCCGAAAT TTGAATTTGA CACGCGCGAG CCGAAAGACA

701   TCGCGGTCTT TGCCGACGCT ATCCCGAAAC TGGTGGATGT CGGCGTACAA

751   ATCCCCGAAA GCTGGGTGCG CGACAAACTG GTCATTCCAG ATGTGCAGGA

801   GGGTGAGGCT GTGTTGGTGC GGCAGGTACC GGACAATCCG GTAAACAGAA

851   CTGCATTGGC GGCTTTATCC GCCCACACCG TACCATCTAA GGCTACGGGC

901   AGGCATCAGG AAATATTGGA CGGCGCGTTG GATGACGCGC TGGTTGAGCC

951   CGATTTCAAT TCTCAGCTCA ACCCGATGGT GCGTCAGGCG GTTGCCGCAC

1001   TTAATGCTTG CAACAGCTAC GAGGAGGCAG ATGCCGCACT GAATGCGCTT

1051   TATCCGAATT TGGACAACGC GAAACTGCGT ACCTATATGC AGCAGGCCTT

1101   GTTTATCAGC GATATTTTGG GACAAGACCA TGCCCGCGCC TGA
```

This corresponds to the amino acid sequence <SEQ ID 2420; ORF 718>:

```
m718.pep
    1   SDGLYVPRNF IHRPQSWFKW DKDNGLLLRT RENPEGEALW PLGWVVHTQK

51   SRSVQQARNG LFRTLSWLYM FKHYAVHDFA EFLELYGMPI RIGKYGAGAT

101   KEEKNTLLRA VAEIGHNAAG IMPEGMEIEL HNAANGTTAT SNPFLQMADW

151   CEKSAARLIL GQTLTSGADG KSSTNALGNI HNEVRRDLLV SDAKQVAQTI

201   TSQIIGPFLQ INYPHADPNR VPKFEFDTRE PKDIAVFADA IPKLVDVGVQ

251   IPESWVRDKL VIPDVQEGEA VLVRQVPDNP VNRTALAALS AHTVPSKATG

301   RHQEILDGAL DDALVEPDFN SQLNPMVRQA VAALNACNSY EEADAALNAL

351   YPNLDNAKLR TYMQQALFIS DILGQDHARA *
```

The following partial DNA sequence was identified in *N. meningitidis* <SEQ ID 2421>:

```
a718.seq
     1  ATGGAGCCGA TAATGGCAAA AAAGAACAAT AAAACTAAAA TCCAAAAGCC
    51  CGAAGCTGCA TTGCAGACGG ACGTGGCTCA AATTACAGCG ACCGGTCGAG
   101  TTATCGCCGA GCATCCATCC AATTTTATTA CGCCGCAAAA GATGCGCGCC
   151  CTCTTCGAGG ACGCAGAAAG CGGTGACATC CGCGCCCAAC ACGAGCTTTT
   201  CGCGGACATT GAGGAGCGCG ACAGCGACAT CGCGGCAAAT ATGGGGACGC
   251  GCAAACGCGC GCTGCTGACG CTCAACTGGC GCGTCGCCCC GCCGCGAAAT
   301  GCGACGCCCG AAGAAGAAAA GCTGTCCGAC CAAGCCTACG AAATGATGGA
   351  CAGCCTGCCT ACCCTCGAAG ACCTGATTAT GGATTTGATG GACGCGGTAG
   401  GGCACGGATT TTCTGCGTTG GAGGTCGAGT GGGTATTTTC AGACGGCCTT
   451  TACCTACCCC GAAACTTTAT CCACCGCCCG CAAAGCTGGT TCAAATGGGA
   501  CAAAGACAAC GGGCTGCTGC TGCGTACCCG CGAAAATCCG GAAGGCGAAG
   551  CGTTGTGGCC GCTGGGCTGG GTCGTTCATA CCCAAAAATC GCGCAGCGTC
   601  CAGCAGGCGC GCAACGGGCT TTTCCGCACG CTTTCCTGGC TGTATATGTT
   651  CAAACACTAC GCCGTCCACG ATTTTGCCGA GTTTTTGGAG CTGTACGGCA
   701  TGCCCATCCG TATCGGCAAA TACGGCGCGG GCGCAACCAA AGAGGAAAAA
   751  AACACCCTGC TTCGAGCGGT GGCGGAAATC GGTCACAACG CGGCAGGCAT
   801  CATGCCAGAA GGTATGGAAA TCGAGCTGCA CAACGCGGCA AACGGCATGA
   851  CTTCCGCCGG CAATCCGTTT TTGCAGATGG CCGACTGGTG CGAAAAAATCG
   901  GCGGCGCGGC TGATTTTGGG GCAAACGCTA ACCAGCGGTG CGGACGGAAA
   951  ATCCAGCACC AACGCGCTGG GCAATATCCA CAACGAGATA CGCCGCGATT
  1001  TGCTGGTGTC GGACGCAAAA CAGGTGGCGC AAACCATCAC AAGCCAAATC
  1051  ATCGGACCGT TCCTGCAAAT CAACTATCCC CATGCCGACC CAAACCGCGT
  1101  GCCGAAATTT GAATTTGACA CGCGCGAGCC GAAAGACATC GCGGTCTTTG
  1151  CCGACGCTAT CCCGAAACTG GTGGATGTCG GCGTACAAAT CCCCGAAAGC
  1201  TGGGTGCGCG ACAAACTGGT CATTCCAGAT GTGCAGGAGG GTGAGGCTGT
  1251  GTTGGTGCGG CAGGTACCGG ACAATCCGGT AAACAGAACT GCATTGGCGG
  1301  CTTTATCCGC CCACACCGTA CCATCTAAGG CTACGGGCAG GCATCAGGAA
  1351  ATATTGGACG GCGCGTTGGA TGACGCGCTG GTTGAGCCCG ATTTCAATTC
  1401  TCAGCTCAAC CCGATGGTGC GTCAGGCGGT TGCCGCACTT AATGCTTGCA
  1451  ACAGCTACGA GGAGGCAGAT GCCGCACTGA ATGCGCTTTA TCCGAATTTG
  1501  GACAACGCGA AACTGCGTAC CTATATGCAG CAGGCCTTGT TTATCAGCGA
  1551  TATTTTGGGA CAAGACCATG CCCGCGCCTG A
```

This corresponds to the amino acid sequence <SEQ ID 2422; ORF 718.a>:

```
a718.pep
     1  MEPIMAKKNN KTKIQKPEAA LQTDVAQITA TGRVIAEHPS NFITPQKMRA
    51  LFEDAESGDI RAQHELFADI EERDSDIAAN MGTRKRALLT LNWRVAPPRN
   101  ATPEEEKLSD QAYEMMDSLP TLEDLIMDLM DAVGHGFSAL EVEWVFSDGL
```

```
-continued
151    YLPRNFIHRP QSWFKWDKDN GLLLRTRENP EGEALWPLGW VVHTQKSRSV

201    QQARNGLFRT LSWLYMFKHY AVHDFAEFLE LYGMPIRIGK YGAGATKEEK

251    NTLLRAVAEI GHNAAGIMPE GMEIELHNAA NGMTSAGNPF LQMADWCEKS

301    AARLILGQTL TSGADGKSST NALGNIHNEI RRDLLVSDAK QVAQTITSQI

351    IGPFLQINYP HADPNRVPKF EFDTREPKDI AVFADAIPKL VDVGVQIPES

401    WVRDKLVIPD VQEGEAVLVR QVPDNPVNRT ALAALSAHTV PSKATGRHQE

451    ILDGALDDAL VEPDFNSQLN PMVRQAVAAL NACNSYEEAD AALNALYPNL

501    DNAKLRTYMQ QALFISDILG QDHARA*
``` a718/m718 98.4% identity in 380 aa overlap

```
                120        130        140        150        160        170
    a718.pep    DSLPTLEDLIMDLMDAVGHGFSALEVEWVFSDGLYLPRNFIHRPQSWFKWDKDNGLLLRT
                     :||||||||||||||||||||||||||||||||||||
    m718                                 SDGLYVPRNFIHRPQSWFKWDKDNGLLLRT
                                              10         20         30
                180        190        200        210        220        230
    a718.pep    RENPEGEALWPLGWVVHTQKSRSVQQARNGLFRTLSWLYMFKHYAVHDFAEFLELYGMPI
                ||||||||||||||||||||||||||||||||||||||||||||||||||||||||||||
    m718        RENPEGEALWPLGWVVHTQKSRSVQQARNGLFRTLSWLYMFKHYAVHDFAEFLELYGMPI
                          40         50         60         70         80         90
                240        250        260        270        280        290
    a718.pep    RIGKYGAGATKEEKNTLLRAVAEIGHNAAGIMPEGMEIELHNAANGMTSAGNPFLQMADW
                ||||||||||||||||||||||||||||||||||||||||||||||:::||||||||
    m718        RIGKYGAGATKEEKNTLLRAVAEIGHNAAGIMPEGMEIELHNAANGTTATSNPFLQMADW
                         100        110        120        130        140        150
                300        310        320        330        340        350
    a718.pep    CEKSAARLILGQTLTSGADGKSSTNALGNIHNEIRRDLLVSDAKQVAQTITSQIIGPFLQ
                ||||||||||||||||||||||||||||||||||||:|||||||||||||||||||||||
    m718        CEKSAARLILGQTLTSGADGKSSTNALGNIHNEVRRDLLVSDAKQVAQTITSQIIGPFLQ
                         160        170        180        190        200        210
                360        370        380        390        400        410
    a718.pep    INYPHADPNRVPKFEFDTREPKDIAVFADAIPKLVDVGVQIPESWVRDKLVIPDVQEGEA
                ||||||||||||||||||||||||||||||||||||||||||||||||||||||||||||
    m718        INYPHADPNRVPKFEFDTREPKDIAVFADAIPKLVDVGVQIPESWVRDKLVIPDVQEGEA
                         220        230        240        250        260        270
                420        430        440        450        460        470
    a718.pep    VLVRQVPDNPVNRTALAALSAHTVPSKATGRHQEILDGALDDALVEPDFNSQLNPMVRQA
                ||||||||||||||||||||||||||||||||||||||||||||||||||||||||||||
    m718        VLVRQVPDNPVNRTALAALSAHTVPSKATGRHQEILDGALDDALVEPDFNSQLNPMVRQA
                         280        290        300        310        320        330
                480        490        500        510        520
    a718.pep    VAALNACNSYEEADAALNALYPNLDNAKLRTYMQQALFISDILGQDHARAX
                |||||||||||||||||||||||||||||||||||||||||||||||||||
    m718        VAALNACNSYEEADAALNALYPNLDNAKLRTYMQQALFISDILGQDHARAX
                         340        350        360        370        380
```

The following partial DNA sequence was identified in *N. meningitidis* <SEQ ID 2423>:

```
m718-1.seq
    1      ATGGAGCCGA TAATGGCAAA AAAGAACAAT AAAACTAAAA TCCAAAAGCC

51      CGAAGCTGCA TTGCAGACGG ACGTGGCTCA AATTACGGCG ACCGGTCGGG

101      TTATCGCCGA GCATCCGTCC AATTTTATTA CGCCGCAAAA GATGCGGGCC

151      CTCTTCGAGG ACGCAGAAAG CGGCGACATC CGCGCCCAAC ACGAGCTTTT

201      CGCGGACATT GAGGAGCGCG ACAGCGACAT CGCGGCAAAT ATGGGGACGC

251      GCAAACGCGC GCTGCTGACG CTCAACTGGC GCGTCGCCCC GCCGCGAAAT

301      GCGACGCCCG AAGAAGAAAA GCTGTCCGAC CAAGCCTACG AAATGATGGA

351      CAGCCTGCCT ACCCTCGAAG ACCTGATTAT GGATTTGATG GACGCGGTAG

401      GGCACGGATT TTCTGCGTTG GAGGTCGAGT GGGTATTTTC AGACGGCCTT
```

```
    451     TACCTACCCC GAAACTTTAT CCACCGCCCG CAAAGCTGGT TCAAATGGGA

501     CAAAGACAAC GGGCTGCTGC TGCGTACCCG CGAAAATCCG GAAGGCGAAG

551     CGTTGTGGCC GCTGGGCTGG GTCGTTCATA CCCAAAAATC GCGCAGCGTC

601     CAGCAGGCGC GCAACGGGCT TTTCCGCACG CTTTCCTGGC TGTATATGTT

651     CAAACACTAC GCCGTCCACG ATTTTGCCGA GTTTTTGGAG CTGTACGGCA

701     TGCCCATCCG TATCGGCAAA TACGGCGCGG GCGCAACCAA AGAGGAAAAA

751     AACACCCTGC TTCGAGCGGT GGCGGAAATC GGTCACAACG CGGCAGGCAT

801     CATGCCAGAA GGTATGGAAA TAGAGCTCCA CAACGCGGCA AACGGTACGA

851     CGGCAACCAG CAATCCGTTT TTGCAGATGG CCGACTGGTG CGAAAAATCG

901     GCGGCGCGGC TGATTTTGGG GCAAACGCTG ACCAGCGGTG CGGACGGAAA

951     ATCCAGCACC AACGCGCTGG GCAATATCCA CAACGAGGTA CGCCGCGATT

1001     TGCTGGTGTC GGACGCAAAA CAGGTGGCGC AAACCATCAC AAGCCAAATC

1051     ATCGGACCGT TCCTGCAAAT CAACTATCCC CATGCCGACC CAAACCGCGT

1101     GCCGAAATTT GAATTTGACA CGCGCGAGCC GAAAGACATC GCGGTCTTTG

1151     CCGACGCTAT CCCGAAACTG GTGGATGTCG GCGTACAAAT CCCCGAAAGC

1201     TGGGTGCGCG ACAAACTGGT CATTCCAGAT GTGCAGGAGG GTGAGGCTGT

1251     GTTGGTGCGG CAGGTACCGG ACAATCCGGT AAACAGAACT GCATTGGCGG

1301     CTTTATCCGC CCACACCGTA CCATCTAAGG CTACGGGCAG GCATCAGGAA

1351     ATATTGGACG GCGCGTTGGA TGACGCGCTG GTTGAGCCCG ATTTCAATTC

1401     TCAGCTCAAC CCGATGGTGC GTCAGGCGGT TGCCGCACTT AATGCTTGCA

1451     ACAGCTACGA GGAGGCAGAT GCCGCACTGA ATGCGCTTTA TCCGAATTTG

1501     GACAACGCGA AACTGCGTAC CTATATGCAG CAGGCCTTGT TTATCAGCGA

1551     TATTTTGGGA CAAGACCATG CCCGCGCCTG A
```

This corresponds to the amino acid sequence <SEQ ID 2424; ORF 718-1>:

```
m718-1.pep.
     1     MEPIMAKKNN KTKIQKPEAA LQTDVAQITA TGRVIAEHPS NFITPQKMRA

51     LFEDAESGDI RAQHELFADI EERDSDIAAN MGTRKRALLT LNWRVAPPRN

101     ATPEEEKLSD QAYEMMDSLP TLEDLIMDLM DAVGHGFSAL EVEWVFSDGL

151     YLPRNFIHRP QSWFKWDKDN GLLLRTRENP EGEALWPLGW VVHTQKSRSV

201     QQARNGLFRT LSWLYMFKHY AVHDFAEFLE LYGMPIRIGK YGAGATKEEK

251     NTLLRAVAEI GHNAAGIMPE GMEIELHNAA NGTTATSNPF LQMADWCEKS

301     AARLILGQTL TSGADGKSST NALGNIHNEV RRDLLVSDAK QVAQTITSQI

351     IGPFLQINYP HADPNRVPKF EFDTREPKDI AVFADAIPKL VDGVQIPES

401     WVRDKLVIPD VQEGEAVLVR QVPDNPVNRT ALAALSAHTV PSKATGRHQE

451     ILDGALDDAL VEPDFNSQLN PMVRQAVAAL NACNSYEEAD AALNALYPNL

501     DNAKLRTYMQ QALFISDILG QDHARA*
```

The following partial DNA sequence was identified in *N. meningitidis* <SEQ ID 2425>:

```
a718.seq
    1 ATGGAGCCGA TAATGGCAAA AAAGAACAAT AAAACTAAAA TCCAAAAGCC
   51 CGAAGCTGCA TTGCAGACGG ACGTGGCTCA AATTACAGCG ACCGGTCGAG
  101 TTATCGCCGA GCATCCATCC AATTTTATTA CGCCGCAAAA GATGCGCGCC
  151 CTCTTCGAGG ACGCAGAAAG CGGTGACATC CGCGCCCAAC ACGAGCTTTT
  201 CGCGGACATT GAGGAGCGCG ACAGCGACAT CGCGGCAAAT ATGGGGACGC
  251 GCAAACGCGC GCTGCTGACG CTCAACTGGC GCGTCGCCCC GCCGCGAAAT
  301 GCGACGCCCG AAGAAGAAAA GCTGTCCGAC CAAGCCTACG AAATGATGGA
  351 CAGCCTGCCT ACCCTCGAAG ACCTGATTAT GGATTTGATG GACGCGGTAG
  401 GGCACGGATT TTCTGCGTTG GAGGTCGAGT GGGTATTTTC AGACGGCCTT
  451 TACCTACCCC GAAACTTTAT CCACCGCCCG CAAAGCTGGT TCAAATGGGA
  501 CAAAGACAAC GGGCTGCTGC TGCGTACCCG CGAAAATCCG GAAGGCGAAG
  551 CGTTGTGGCC GCTGGGCTGG GTCGTTCATA CCCAAAAATC GCGCAGCGTC
  601 CAGCAGGCGC GCAACGGGCT TTTCCGCACG CTTTCCTGGC TGTATATGTT
  651 CAAACACTAC GCCGTCCACG ATTTTGCCGA GTTTTTGGAG CTGTACGGCA
  701 TGCCCATCCG TATCGGCAAA TACGGCGCGG GCGCAACCAA AGAGGAAAAA
  751 AACACCCTGC TTCGAGCGGT GGCGGAAATC GGTCACAACG CGGCAGGCAT
  801 CATGCCAGAA GGTATGGAAA TCGAGCTGCA CAACGCGGCA AACGGCATGA
  851 CTTCCGCCGG CAATCCGTTT TTGCAGATGG CCGACTGGTG CGAAAAATCG
  901 GCGGCGCGGC TGATTTTGGG GCAAACGCTA ACCAGCGGTG CGGACGGAAA
  951 ATCCAGCACC AACGCGCTGG GCAATATCCA CAACGAGATA CGCCGCGATT
 1001 TGCTGGTGTC GGACGCAAAA CAGGTGGCGC AAACCATCAC AAGCCAAATC
 1051 ATCGGACCGT TCCTGCAAAT CAACTATCCC CATGCCGACC CAAACCGCGT
 1101 GCCGAAATTT GAATTTGACA CGCGCGAGCC GAAAGACATC GCGGTCTTTG
 1151 CCGACGCTAT CCCGAAACTG GTGGATGTCG GCGTACAAAT CCCCGAAAGC
 1201 TGGGTGCGCG ACAAACTGGT CATTCCAGAT GTGCAGGAGG GTGAGGCTGT
 1251 GTTGGTGCGG CAGGTACCGG ACAATCCGGT AAACAGAACT GCATTGGCGG
 1301 CTTTATCCGC CCACACCGTA CCATCTAAGG CTACGGGCAG GCATCAGGAA
 1351 ATATTGGACG GCGCGTTGGA TGACGCGCTG GTTGAGCCCG ATTTCAATTC
 1401 TCAGCTCAAC CCGATGGTGC GTCAGGCGGT TGCCGCACTT AATGCTTGCA
 1451 ACAGCTACGA GGAGGCAGAT GCCGCACTGA ATGCGCTTTA TCCGAATTTG
 1501 GACAACGCGA AACTGCGTAC CTATATGCAG CAGGCCTTGT TTATCAGCGA
 1551 TATTTTGGGA CAAGACCATG CCCGCGCCTG A
```

This corresponds to the amino acid sequence <SEQ ID 2426; ORF 718-1.a>:

```
a718.pep
    1 MEPIMAKKNN KTKIQKPEAA LQTDVAQITA TGRVIAEHPS NFITPQKMRA
   51 LFEDAESGDI RAQHELFADI EERDSDIAAN MGTRKRALLT LNWRVAPPRN
  101 ATPEEEKLSD QAYEMMDSLP TLEDLIMDLM DAVGHGFSAL EVEWVFSDGL
  151 YLPRNFIHRP QSWFKWDKDN GLLLRTRENP EGEALWPLGW VVHTQKSRSV
  201 QQARNGLFRT LSWLYMFKHY AVHDFAEFLE LYGMPIRIGK YGAGATKEEK
```

-continued

```
251   NTLLRAVAEI GHNAAGIMPE GMEIELHNAA NGMTSAGNPF LQMADWCEKS

301   AARLILGQTL TSGADGKSST NALGNIHNEI RRDLLVSDAK QVAQTITSQI

351   IGPFLQINYP HADPNRVPKF EFDTREPKDI AVFADAIPKL VDVGVQIPES

401   WVRDKLVIPD VQEGEAVLVR QVPDNPVNRT ALAALSAHTV PSKATGRHQE

451   ILDGALDDAL VEPDFNSQLN PMVRQAVAAL NACNSYEEAD AALNALYPNL

501   DNAKLRTYMQ QALFISDILG QDHARA*
``` a718/m718-1 99.0% identity in 526 aa overlap

```
                 10         20         30         40         50         60
a718.pep  MEPIMAKKNNKTKIQKPEAALQTDVAQITATGRVIAEHPSNFITPQKMRALFEDAESGDI
          ||||||||||||||||||||||||||||||||||||||||||||||||||||||||||||
m718-1    MEPIMAKKNNKTKIQKPEAALQTDVAQITATGRVIAEHPSNFITPQKMRALFEDAESGDI
                 10         20         30         40         50         60

70         80         90        100        110        120
a718.pep  RAQHELFADIEERDSDIAANMGTRKRALLTLNWRVAPPRNATPEEEKLSDQAYEMMDSLP
          ||||||||||||||||||||||||||||||||||||||||||||||||||||||||||||
m718-1    RAQHELFADIEERDSDIAANMGTRKRALLTLNWRVAPPRNATPEEEKLSDQAYEMMDSLP
                 70         80         90        100        110        120

130        140        150        160        170        180
a718.pep  TLEDLIMDLMDAVGHGFSALEVEWVFSDGLYLPRNFIHRPQSWFKWDKDNGLLLRTRENP
          ||||||||||||||||||||||||||||||||||||||||||||||||||||||||||||
m718-1    TLEDLIMDLMDAVGHGFSALEVEWVFSDGLYLPRNFIHRPQSWFKWDKDNGLLLRTRENP
                130        140        150        160        170        180

190        200        210        220        230        240
a718.pep  EGEALWPLGWVVHTQKSRSVQQARNGLFRTLSWLYMFKHYAVHDFAEFLELYGMPIRIGK
          ||||||||||||||||||||||||||||||||||||||||||||||||||||||||||||
m718-1    EGEALWPLGWVVHTQKSRSVQQARNGLFRTLSWLYMFKHYAVHDFAEFLELYGMPIRIGK
                190        200        210        220        230        240

250        260        270        280        290        300
a718.pep  YGAGATKEEKNTLLRAVAEIGHNAAGIMPEGMEIELHNAANGMTSAGNPFLQMADWCEKS
          |||||||||||||||||||||||||||||||||||||||||||:::|||||||||||||
m718-1    YGAGATKEEKNTLLRAVAEIGHNAAGIMPEGMEIELHNAANGTTATSNPFLQMADWCEKS
                250        260        270        280        290        300

310        320        330        340        350        360
a718.pep  AARLILGQTLTSGADGKSSTNALGNIHNEIRRDLLVSDAKQVAQTITSQIIGPFLQINYP
          ||||||||||||||||||||||||||||||||||:|||||||||||||||||||||||||
m718-1    AARLILGQTLTSGADGKSSTNALGNIHNEVRRDLLVSDAKQVAQTITSQIIGPFLQINYP
                310        320        330        340        350        360

370        380        390        400        410        420
a718.pep  HADPNRVPKFEFDTREPKDIAVFADAIPKLVDVGVQIPESWVRDKLVIPDVQEGEAVLVR
          ||||||||||||||||||||||||||||||||||||||||||||||||||||||||||||
m718-1    HADPNRVPKFEFDTREPKDIAVFADAIPKLVDVGVQIPESWVRDKLVIPDVQEGEAVLVR
                370        380        390        400        410        420

430        440        450        460        470        480
a718.pep  QVPDNPVNRTALAALSAHTVPSKATGRHQEILDGALDDALVEPDFNSQLNPMVRQAVAAL
          ||||||||||||||||||||||||||||||||||||||||||||||||||||||||||||
m718-1    QVPDNPVNRTALAALSAHTVPSKATGRHQEILDGALDDALVEPDFNSQLNPMVRQAVAAL
                430        440        450        460        470        480

490        500        510        520
a718.pep  NACNSYEEADAALNALYPNLDNAKLRTYMQQALFISDILGQDHARAX
          |||||||||||||||||||||||||||||||||||||||||||||||
m718-1    NACNSYEEADAALNALYPNLDNAKLRTYMQQALFISDILGQDHARAX
                490        500        510        520
``` g719.seq not found yet
g719.pep not found yet
The following partial DNA sequence was identified in *N. meningitidis* <SEQ ID 2427>:

```
m719.seq
    1   ATGGCAAACG GAACATGAA ACTGTCGTTG GTGTTAACCG CCCGAGATGA

51   CGGAGCGAGA CGGCTACTGG CTGATACTCA ACGACAATTA GATCGTACCG

101   CGAAATCGCG GGCGCAACTT GAACGGCAAA GCCATACTTA TGCGTTGACC

151   GGCATCCGCT CAGAAAAACA GATTCAACGC GAAATCATGC TGACACAGGC
```

-continued

```
 201 TGCGTTTAAC CGTTTGGCGC GCAGCGGCAA GGCATCACAA AATGATTTGG
 251 CACGGGCGGC GGTCGCTACG CGTAACCGAA TTCGCGAGCT GAACGCGGAA
 301 CTGAAACAGG GCACGGGATT TGCGGACAAG ATGGGAAAAA TCGGAAGATT
 351 CGGTGCAGCT GCGGTGGCTG GTGGCGCGGC AGCGTATACG GTGCTTAAGC
 401 CTGCTATGGA CAACAGAAAG CAGCTTGATG AGAACATCAA CCGCGTGTCC
 451 AGACAGGCAT TTATTGAGGA TAACAGTAAA TCGGCAGCGT GGATTGCAAC
 501 TGAAGGTGCG CAACAGATCA AGGATTTGGC ACTTGAACTT GTCGAGAAAA
 551 ATGGCGGGAC CCACGATAAG GCTTTGGATT TAATCAGCGG CATGATGACC
 601 ACCGGTCTGA ATTTTGCCCA AACCAAGAAT GAAGCGCAGG CGGCATATGC
 651 TTTTGCACTT GCCTCAGAAG GCAGTGGCGA GGATACGGCA AAACTGATTA
 701 AAACCCTGAA AGATGGCGGC ATGAGCGGTA AGACCTGCA ACTCGGGCTT
 751 GAGCACGTCT TGCAATCGGG TTTAGACGGC ACTTTCGAGG TGCGGGATAT
 801 GGTTCGGGAG CTGCCGAGCC TGCTCTCTGC CGCGCAACAG GCAGGGATGA
 851 ATGGTGTCGG CGGTTTGGAC TACCTGCTCT CACTCTTACA ATCTGCGGCG
 901 AATAAATCGG GCAGTCCTGC CGAAGCGGCG ACTAATGTGC AAAATCTTTT
 951 GAGTAAAACT CTGTCGCCTG ACACGATAGG TCGTCTGAAG AAGATGGCAA
1001 ATCCGAATGA CCCGAAGAAA GGTGTCGATT GGATAGGCTC GGTTGTGCAA
1051 GGCAAGCAAA ACGGCGAAAA CGCAGTGCAG GTGTTGTCCC GTCTTGCCGA
1101 TGCCATGCTA GTAAAGGATA AGCAATACCA AGATTATAAG AAACGCGCGG
1151 CTGCAGGCGA TAAGACGGCG GCGGAGCAGG CAAATATGCT TAAGGGCGCG
1201 CTTTTGGCGC AACTGCTGCC TGATTTGCAG GCAAAACAAG GTTTGCTGGC
1251 TGCAACGGAT ATGACGCAAA TCCGTGAATA TATGGCTTCG TTGGCTGGCG
1301 TAACGTTGGA TAACGGAAAA ATTGCTAAGA CAACGAGGC GCGAATGTTG
1351 TCGGCAGCGG CGCAACAAGA GCAACAGGAA TCGCTGGCAA TGTTGCGGGA
1401 AAGTCTGACG GGAACATTGG TGGATATGGA AACCTCGTTT AAAAAGCTGG
1451 CAGCGGAATA CCCTAATGCC ACTCTAGCCC TGCAAGCATT GACGACGGCG
1501 GCAACAGCGG CGTCTGCCGC AATGTTATTA CCGCCGGTG GCGGTAAAGG
1551 TGCAGGCTTT CTGAAAGATG TAGGTAGTAA AGCGTTGGGA TGGGGTAAGG
1601 CTTCCGCAGG CGGCGTGGCA GCAGGTGCCA CAGCGGCAGG CGGTAAGTTG
1651 CTGTCATGGG GAAAATCTGC CGGTAGCGGG CTCATGAATA ATCCAGCGTT
1701 AGTTAAACGG GCGGGTTTGT TAGGTATGTT GCTGTATTCC GAGTCTTTGG
1751 GTGACGGCAC ATTGCCAAAG GGTTTGCGTG GTACCAAGAC AACTCCTGAA
1801 ATGATTAATC GTCTGAAAAA CAACGGTATC CGATTTGAAC CTGCGCCGAA
1851 GCGGGAACAG GCGCGGGGTG GTGTCCCTCA GTATTTGGCT GCTCCGTCAG
1901 CGCAGCCTAC CGATAAGATG TTGTCTCCGT TGTTTTCAAC TCAGACGGCG
1951 GCGTATCAGG CAGCCATTCA GCAGCAGACG GCGGCGTATC AGGCAGCATT
2001 GGCGCAGGAT ACGGCTGCAG TTACAACAGG TTTGGCACAA GTGCAAAGTG
2051 CGATGGCGTC GGCAAGTCAG ACCATCAATA CCAATGTGAG CCTGAATATC
2101 GACGGACGTG TTATCGCGAA TGAGGTATCG CGGTATCAAG TGGCCATGTT
2151 CGGCCGTGGA GCGGGTCAAT AA
```

This corresponds to the amino acid sequence <SEQ ID 2428; ORF 719>:

```
m719.pep
      1  MANGNMKLSL VLTARDDGAR RLLADTQRQL DRTAKSRAQL ERQSHTYALT

51  GIRSEKQIQR EIMLTQAAFN RLARSGKASQ NDLARAAVAT RNRIRELNAE

101  LKQGTGFADK MGKIGRFGAA AVAGGAAAYT VLKPAMDNRK QLDENINRVS

151  RQAFIEDNSK SAAWIATEGA QQIKDLALEL VEKNGGTHDK ALDLISGMMT

201  TGLNFAQTKN EAQAAYAFAL ASEGSGEDTA KLIKTLKDGG MSGKDLQLGL

251  EHVLQSGLDG TFEVRDMVRE LPSLLSAAQQ AGMNGVGGLD YLLSLLQSAA

301  NKSGSPAEAA TNVQNLLSKT LSPDTIGRLK KMANPNDPKK GVDWIGSVVQ

351  GKQNGENAVQ VLSRLADAML VKDKQYQDYK KRAAAGDKTA AEQANMLKGA

401  LLAQLLPDLQ AKQGLLAATD MTQIREYMAS LAGVTLDNGK IAKNNEARML

451  SAAAQQEQQE SLAMLRESLT GTLVDMETSF KKLAAEYPNA TLALQALTTA

501  ATAASAAMLL TAGGGKGAGF LKDVGSKALG WGKASAGGVA AGATAAGGKL

551  LSWGKSAGSG LMNNPALVKR AGLLGMLLYS ESLGDGTLPK GLRGTKTTPE

601  MINRLKNNGI RFEPAPKREQ ARGGVPQYLA APSAQPTDKM LSPLFSTQTA

651  AYQAAIQQQT AAYQAALAQD TAAVTTGLAQ VQSAMASASQ TINTNVSLNI

701  DGRVIANEVS RYQVAMFGRG AGQ*
``` a719.seq not found yet
a719.pep not found yet
g720.seq not found yet
g720.pep not found yet The following partial DNA sequence was identified in *N. meningitidis* <SEQ ID 2429>:

```
m720.seq
      1  ATGAGCGGAT GGCATACCTT ATTGCAGGAC GCATCTTACA AGGGCGTCGG

51  CTTTGATATT GAGGTGGTGG ACGAGAGCAA CGGCAAGGCA TTGGCCGAGC

101  ATGCGCGGCC GTTTGTGCAG GGTATCGACC TTGAAGACAT GGGCATGACC

151  GGGCGGCAGG TGCAGATTAA TGCGGTGTTT TGGGGCAAGG GCTATGCAGG

201  CCGTCTGAAA AAGCTGCTGG ATGCGCTGGA GCAGCCGGGC GGCGGCGTGC

251  TGGTGCACCC TGTTTGGGGG CGGATGCACA ACATGATTGC GGCATCATGG

301  AGTTACCGAC ATGAGGCCGA TTATGTGGAT TATGCGGGCA TCGATATTAC

351  TTTCCGCGAG GCGGCCGAAG CGCAGGAAAT CTTTGTTTTT GAAAACGCCT

401  TTTTGGTCGA GCTTGAGGCG TTGATTGCTA ATATCGACAC CTACCGCGAG

451  GCGGCTATCG GCTTTGTTGA TGCGGTGTTG GCGGTGGATG CGGGCGTATC

501  AGCTTTATGG GGCAGCGCGC TGGGCATTTG GAGTGCGGCA TCGGGTACGT

551  TTGGCGCGGT GCGCCGTTTG TTTGATTTGG ACAAAATTGC CTTTCCCGAT

601  CGGGGCGGAT ACAGTGCAGC GGCGTTTAAA AACGGCTCGG CCAAGCTGTT

651  TGCGGATATA TCGGTCATGG TAGATACTGG CATACGCCGT GAGGCGGGTT

701  TGGCCGATAA TGCCATGCAC CATGCCGGTT GGTCGCCGCG ACAGCGGTTT

751  GACGGGGCTG CGGCTGTTGC CGACCGCGCC GCCGCTATCC CTGATAATTT

801  GCTGACCGGC CGCTTTTCAG ACGGCCTGCA AAACCGCCTG AACCGGTTAA

851  CCGCCAAACA GGTGCAGCCG GTAGCGCAGG CGGTGCGCCT GTTATCCACG
```

-continued
```
 901   TCATCGCTGT TGTCGGTGGC AACGGCATTA ATCGAGGCGC ATGGCGAAGA

951   GATGACCGCG CCCGATTTGA TTGAGGTTAA CCGCGCCATG CGCCGCCGTA

1001   TGCAGGCCGA GATTGCCGCC TTGCGGGCGG TGCAGACGGC TGCTGCCGAG

1051   TCTGGTGGGC TGACGGCCAA CGCCGTGTAT ACCGAGGCTT ACCAAACGGC

1101   AGAATCCCTG CGCGCGGCGG CAGGCCGTCT GAATGCGTTG GTTGCGGCGG

1151   TCATCAACCA AAAGCCGCCG CTGATTGTGC GCCAAGCCCC AATCGACGGT

1201   ACGATACACC AAATCGCCCA CGAGTTTTAC GGCGATATAG CCCGCGCAGC

1251   AGAGCTGGTG CGGCTCAATC CCCATATCCA CCACCCCGCG TTTATCAAGC

1301   GCGGCACTTT GGTCAACAGC TATGCAAAAT AA
```

This corresponds to the amino acid sequence <SEQ ID 2430; ORF 720>:

```
m720.pep
    1   MSGWHTLLQD ASYKGVGFDI EVVDESNGKA LAEHARPFVQ GIDLEDMGMT

51   GRQVQINAVF WGKGYAGRLK KLLDALEQPG GGVLVHPVWG RMHNMIAASW

101   SYRHEADYVD YAGIDITFRE AAEAQEIFVF ENAFLVELEA LIANIDTYRE

151   AAIGFVDAVL AVDAGVSALW GSALGIWSAA SGTFGAVRRL FDLDKIAFPD

201   RGGYSAAAFK NGSAKLFADI SVMVDTGIRR EAGLADNAMH HAGWSPRQRF

251   DGAAAVADRA AAIPDNLLTG RFSDGLQNRL NRLTAKQVQP VAQAVRLLST

301   SSLLSVATAL IEAHGEEMTA PDLIEVNRAM RRRMQAEIAA LRAVQTAAAE

351   SGGLTANAVY TEAYQTAESL RAAAGRLNAL VAAVINQKPP LIVRQAPIDG

401   TIHQIAHEFY GDIARAAELV RLNPHIHHPA FIKRGTLVNS YAK*
```

The following partial DNA sequence was identified in *N. meningitidis* <SEQ ID 2431>:

```
a720.seq (partial)
    1   GGCCTGCAAA ACCGCCTGAA CCGGTTAACC GCCAAACAGG TGCAGCCGGT

51   AGCGCAGGCG GTGCGCCTGT TATCCACGTC ATCGCTGTTG TCGGTGGCAA

101   CGGCATTAAT CGAGGCGCAT GGCGAAGAGA TGACCGCGCC CGATTTGATT

151   GAGGTTAACC GCGCCATGCG CCGCCGTATG CAGGCCGAGA TTGCCGCCTT

201   ACGGGCGGTG CAGACGGCTG CTGCCGAGTC TGGTGGGCTG ACGGCCAACG

251   CCGTGTATAC CGAGGCTTAC CAAACGGCAG AATCCCTGCG CGCGGCGGCA

301   GGCCGTCTGA ATGCGTTGGT TGCGGCGGTC ATCAACCAAA AGCCGCCGCT

351   GATTGTGCGC CAAGCCCCAA TCGACGGTAC GATACACCAA ATCGCCCACG

401   AGTTTTACGG CGATATAGCC CGCGCAGCAG AGCTGGTGCG GCTCAATCCC

451   CATATCCACC ACCCCGCGTT TATCAAGCGC GGCACTTTGG TCAACAGCTA

501   TGCAAAATAA
```

This corresponds to the amino acid sequence <SEQ ID 2432; ORF 720.a>:

```
a720.pep (partial)
    1   GLQNRLNRLT AKQVQPVAQA VRLLSTSSLL SVATALIEAH GEEMTAPDLI

51   EVNRAMRRRM QAEIAALRAV QTAAAESGGL TANAVYTEAY QTAESLRAAA
```

```
                                -continued
101    GRLNALVAAV INQKPPLIVR QAPIDGTIHQ IAHEFYGDIA RAAELVRLNP

151    HIHHPAFIKR GTLVNSYAK*
``` m720/a720 100.0% identity in 169 aa overlap

```
                 250        260        270        280        290        300
m720.pep   SPRQRFDGAAAVADRAAAIPDNLLTGRFSDGLQNRLNRLTAKQVQPVAQAVRLLSTSSLL
                                         ||||||||||||||||||||||||||||||
a720                                     GLQNRLNRLTAKQVQPVAQAVRLLSTSSLL
                                                 10         20         30
                 310        320        330        340        350        360
m720.pep   SVATALIEAHGEEMTAPDLIEVNRAMRRRMQAEIAALRAVQTAAAESGGLTANAVYTEAY
           ||||||||||||||||||||||||||||||||||||||||||||||||||||||||||||
a720       SVATALIEAHGEEMTAPDLIEVNRAMRRRMQAEIAALRAVQTAAAESGGLTANAVYTEAY
                   40         50         60         70         80         90
                 370        380        390        400        410        420
m720.pep   QTAESLRAAAGRLNALVAAVINQKPPLIVRQAPIDGTIHQIAHEFYGDIARAAELVRLNP
           ||||||||||||||||||||||||||||||||||||||||||||||||||||||||||||
a720       QTAESLRAAAGRLNALVAAVINQKPPLIVRQAPIDGTIHQIAHEFYGDIARAAELVRLNP
                  100        110        120        130        140        150
                 430        440
m720.pep   HIHHPAFIKRGTLVNSYAKX
           ||||||||||||||||||||
a720       HIHHPAFIKRGTLVNSYAKX
                  160        170
``` g721.seq not found
g721.pep not found
The following partial DNA sequence was identified in *N. meningitidis* <SEQ ID 2433>:

```
m721.seq
    1    ATGTCCAAAA ATGCACAAAA AACCCTACTT GCCGTGTGCA GTTTCGAGGT

51    GCAGCCAAAA GACGGGCGAA TCCAACTGCT GCCATATGGC GAATTTCGCG

101    CAGTAGACGG TCGTCCGACT GATGTCCCTG CGTGGTATCT GACCGAAGAA

151    AACGGTCATG ATGTCGCGTT GTTGGCCAAC AGCTCGCGCA ATCAGTTGGT

201    TGTCGATTAT GAACACCAGA CGCTCTACAA AGAGAAAAAC GGACAACCTG

251    CACCTGCCGC CGGTTGGATG CGTTGGCTGG AGTTCACGCC TAAAGGCATG

301    TTTGCCGAAG TGGAGTGGAC GGACAAGGCG GCTGCGGCAA TTGCCGCAAA

351    AGAGTATCGC TACATCTCTG CTGTGTTTTC CTATGACACA AAGGGATATG

401    TAAGCAAAAT TTTTCACGCC GCGCTGACAA ATTTCCCCGC GTTGGACGGT

451    ATGGACGAGG TGCTGGCGGC AGCGTCGGCG CAAATTTTAA AACCGGAAAC

501    GGAGCAAAAC CCTATGAAAG AGTTGTTACA GCAACTGTTC GACCTGCCTG

551    ATGCGGGCGA AGAAGAACTG AAGGCGGCAT TGTCCGCGCT CGTGGAAGCC

601    AAGCCGAAAG ACGTGGCATT GTCTGCCGAC GTGTTCGCGC AGCTGGCGGA

651    AAAAGACAGC CGCATCGCGG CATTGACGGC GCAAACCGCC AAGCCTGATT

701    TGACTAAATA CGCGCCTATC TCAGTGGTTC AAGAGCTGCA AAGCAAAGTC

751    GCCGCGCTGA CTGCCAAGCA GGAAGCAGAC AAAGGCAACG AATTGATTAC

801    CGCCGCGCTG ACTTCAGGCA AATTGCTGCC TGCTCAGAAG GAGTGGGCAA

851    AAGGCGTATT GAAACAGCCG GGCGGCTTGG CATTTTTGAC CGGCTTTATT

901    GAAAACGCCC AGCCGGTCGC TGCACTGGCA GGCTCGCAAA CGGGCGGCAA

951    AGCACCCGAC GAACGCGTCG CCGCACTGAC TGCGGAAGAG GCAGCCGCAG
```

-continued

```
1001   CAAAAATGCT  GGGCATGTCC  GGCGAAGAAT  TTGTAAAAAT  CAAAGAAAGC

1051   GAAGGTAAGT  AA
```

This corresponds to the amino acid sequence <SEQ ID 2434; ORF 721>:

```
m721.pep
    1   MSKNAQKTLL  AVCSFEVQPK  DGRIQLLPYG  EFRAVDGRPT  DVPAWYLTEE

51   NGHDVALLAN  SSRNQLVVDY  EHQTLYKEKN  GQPAPAAGWM  RWLEFTPKGM

101   FAEVEWTDKA  AAAIAAKEYR  YISAVFSYDT  KGYVSKIFHA  ALTNFPALDG

151   MDEVLAAASA  QILKPETEQN  PMKELLQQLF  DLPDAGEEEL  KAALSALVEA

201   KPKDVALSAD  VFAQLAEKDS  RIAALTAQTA  KPDLTKYAPI  SVVQELQSKV

251   AALTAKQEAD  KGNELITAAL  TSGKLLPAQK  EWAKGVLKQP  GGLAFLTGFI

301   ENAQPVAALA  GSQTGGKAPD  ERVAALTAEE  AAAAKMLGMS  GEEFVKIKES

351   EGK*
```

The following partial DNA sequence was identified in *N. meningitidis* <SEQ ID 2435>:

```
a721.seq
    1   ATGTCCAAAA  ATGCACAAAA  AACCCTACTT  GCCGTGTGCA  GTTTCGAGGT

51   GCAGCCAAAA  GACGGGCGAA  TCCAACTGCT  GCCATATGGC  GAATTTCGCG

101   CAGTAGACGG  TCGTCCGACT  GATGTCCCTG  CGTGGTATCT  GACCGAAGAA

151   AACGGTCATG  ATGTCGCGTT  GTTGGCCAAC  AGCTCGCGCA  ATCAGTTGGT

201   TGTCGATTAT  GAACACTAGA  CGCTCTACAA  AGAGAAAAAC  GGACAACCTG

251   CACCTGCCGC  CGGTTGGATG  CGTTGGCTGG  AGTTCACGCC  TAAAGGCATG

301   TTTGCCGAAG  TGGAGTGGAC  GGACAAGGCG  GCTGCGGCAA  TTGCCGCAAA

351   AGAGTATCGC  TACATCTCTG  CTGTGTTTTC  CTATGACACA  AAGGGATATG

401   TAAGCAAAAT  TTTTCACGCC  GCGCTGACAA  ATTTCCCCGC  GTTGGACGGT

451   ATGGACGAGG  TGCTGGCGGC  AGCGTCGGCG  CAAATTTTAA  AACCGGAAAC

501   GGAGCAAAAC  CCTATGAAAG  AGTTGTTACA  GCAACTGTTC  GGTCTGCCTG

551   ATGCGGGCGA  AGAAGAACTG  AAGGCGGCAT  TGTCCGCGCT  CGTGGAAGCC

601   AAGCCGAAAG  ACGTGGCATT  GTCTGCCGAC  GTGTTCGCGC  AGCTGGCGGA

651   AAAAGACAGC  CGCATCGCGG  CATTGACGGC  GCAAACCGCC  AAGCCTGATT

701   TGACTAAATA  CGCGCCTATC  TCAGTGGTTC  AAGAGCTGCA  AAGCAAAGTC

751   GCCGCGCTGA  CTGCCAAGCA  GGAAGCAGAC  AAAGGCAACG  AATTGATTAC

801   CGCCGCGCTG  ACTTCAGGCA  AATTGCTGCC  TGCTCAGAAG  GAGTGGGCAG

851   AAGGCGTATT  GAAACAGCCG  GGCGGCTTGG  CATTTTTGAC  CGGCTTTATT

901   GAAAACGCCC  AGCCGGTCGC  TGCACTGGCA  GGCTCGCAAA  CGGGCGGTAA

951   AGCACCCGAC  GAACGCGTCG  CCGCACTGAC  TGCGGAAGAG  GCAGCCGCAG

1001   CAAAAATGCT  GGGCATGTCC  GGCGAAGAAT  TTGTAAAAAT  CAAAGAAAGC

1051   GAAGGTAAGT  AA
```

This corresponds to the amino acid sequence <SEQ ID 2436; ORF 721.a>:

```
a721.pep
    1   MSKNAQKTLL  AVCSFEVQPK  DGRIQLLPYG  EFRAVDGRPT  DVPAWYLTEE

51   NGHDVALLAN  SSRNQLVVDY  EH*TLYKEKN  GQPAPAAGWM  RWLEFTPKGM

101   FAEVEWTDKA  AAAIAAKEYR  YISAVFSYDT  KGYVSKIFHA  ALTNFPALDG

151   MDEVLAAASA  QILKPETEQN  PMKELLQQLF  GLPDAGEEEL  KAALSALVEA

201   KPKDVALSAD  VFAQLAEKDS  RIAALTAQTA  KPDLTKYAPI  SVVQELQSKV

251   AALTAKQEAD  KGNELITAAL  TSGKLLPAQK  EWAEGVLKQP  GGLAFLTGFI

301   ENAQPVAALA  GSQTGGKAPD  ERVAALTAEE  AAAAKMLGMS  GEEFVKIKES

351   EGK*
``` a721/m721 99.2% identity in 353 aa overlap

```
                 10         20         30         40         50         60
   a721.pep  MSKNAQKTLLAVCSFEVQPKDGRIQLLPYGEFRAVDGRPTDVPAWYLTEENGHDVALLAN
             ||||||||||||||||||||||||||||||||||||||||||||||||||||||||||||
   m721      MSKNAQKTLLAVCSFEVQPKDGRIQLLPYGEFRAVDGRPTDVPAWYLTEENGHDVALLAN
                 10         20         30         40         50         60
                 70         80         90        100        110        120
   a721.pep  SSRNQLVVDYEHXTLYKEKNGQPAPAAGWMRWLEFTPKGMFAEVEWTDKAAAAIAAKEYR
             ||||||||||||||  ||||||||||||||||||||||||||||||||||||||||||||
   m721      SSRNQLVVDYEHQTLYKEKNGQPAPAAGWMRWLEFTPKGMFAEVEWTDKAAAAIAAKEYR
                 70         80         90        100        110        120
                130        140        150        160        170        180
   a721.pep  YISAVFSYDTKGYVSKIFHAALTNFPALDGMDEVLAAASAQILKPETEQNPMKELLQQLF
             ||||||||||||||||||||||||||||||||||||||||||||||||||||||||||||
   m721      YISAVFSYDTKGYVSKIFHAALTNFPALDGMDEVLAAASAQILKPETEQNPMKELLQQLF
                130        140        150        160        170        180
                190        200        210        220        230        240
   a721.pep  GLPDAGEEELKAALSALVEAKPKDVALSADVFAQLAEKDSRIAALTAQTAKPDLTKYAPI
              |||||||||||||||||||||||||||||||||||||||||||||||||||||||||||
   m721      DLPDAGEEELKAALSALVEAKPKDVALSADVFAQLAEKDSRIAALTAQTAKPDLTKYAPI
                190        200        210        220        230        240
                250        260        270        280        290        300
   a721.pep  SVVQELQSKVAALTAKQEADKGNELITAALTSGKLLPAQKEWAEGVLKQPGGLAFLTGFI
             |||||||||||||||||||||||||||||||||||||||||:||||||||||||||||||
   m721      SVVQELQSKVAALTAKQEADKGNELITAALTSGKLLPAQKEWAKGVLKQPGGLAFLTGFI
                250        260        270        280        290        300
                310        320        330        340        350
   a721.pep  ENAQPVAALAGSQTGGKAPDERVAALTAEEAAAAKMLGMSGEEFVKIKESEGKX
             |||||||||||||||||||||||||||||||||||||||||||||||||||||
   m721      ENAQPVAALAGSQTGGKAPDERVAALTAEEAAAAKMLGMSGEEFVKIKESEGKX
                310        320        330        340        350
``` g722.seq not found yet
g722.pep not found yet
The following partial DNA sequence was identified in *N. meningitidis* <SEQ ID 2437>:

```
m722.seq
    1   GTGTTTGAAA  CGCCGACATT  TGAGCAAATC  CGCGAGCGTA  TCCTGCGCGA

51   TACCAAAAGC  CTGTGGCCGG  ATGCCGATAT  CAGCCCCGAC  AGCGACCATT

101   ATGTGCACGC  CAGCCGTTTG  GCCAGCTGCG  CCGAAGGGCA  ATATGCGCAT

151   CAAAGCTGGA  TTGTGCGGCA  GATTTTCCCT  GATACCGCCG  ACCGCGAGTA

201   TTTGGAGCGG  CATGCCTCCA  TGCGCGGCTT  GAGCCGCCGC  AATCCTACCA

251   CGGCCAGCGG  CACGCTGACC  GTAAGCGGTA  TTGCGCAATC  CATGCTTTCA

301   GACGACCTGC  AAGTGCGTAT  CGGCCAGCGT  TTTTACCGCA  CTACCGCCCG

351   CGCCGTTATC  GGCAGCGGCG  GCACGGCGGA  ATACCGGCA  ATCGCCGACG

401   AGCCGGGCGC  GGCCGCCAAT  GTGGGCGACG  GCGAGGCGCA  ACTGATGGCC
```

```
-continued
 451   GCCCCCGCCG GTGTGGCCAC CGAATGCCGC CTTACCGTAC AAGGCGGCAC

501   CGACCGAGAA AGCGATGCCT CACTGCTGGC GCGTCTGTTG GAAATCATCC

551   GCCGACCGCC CGCAGGCGGC AACCGTTACG ACTATAAAAA CTGGGCGTTG

601   AGTGTTGACG GCGTAACCAG CGCATATGTT TATCCGCTGC GCCGCGGCTT

651   GGGTACGGTG GATATTGCCA TTACCTCCGC CGACGGTGTG TCGTCGGAAG

701   AAACTGTGCG CCGCGTACAG GCTTATATCG ACGAGATGCG CCCGGTAACG

751   GCAAAAAATG CGCTGGTACT CAAGCCAACC GTAACGGCGG TGCCTGTTAC

801   CGTGCAAGTC AAGCTCGACG GTATCGACTT GGACGAGGCC AAGCGCCGCA

851   TACGGACGGC CCTAAAAGAA TATTTCGACA CCCTGATCCC CGGCGACGGC

901   CTGACTGTGT CGCAAATCGA GGCTGCTATC AGCAATGTGG ATGGTGTGAT

951   CGACCGCCGT CTGACTGCGC CGACGGCCAA CCGTGCCGCC GATACGGTTA

1001   ACCGCATCGA GTGGTTTAAA GCGGGCGCGA TTAATGTAAC GGAGATGCCG

1051   TCATGA
```

This corresponds to the amino acid sequence <SEQ ID 2438; ORF 722>:

```
m722.pep
   1   VFETPTFEQI RERILRDTKS LWPDADISPD SDHYVHASRL ASCAEGQYAH

51   QSWIVRQIFP DTADREYLER HASMRGLSRR NPTTASGTLT VSGIAQSMLS

101   DDLQVRIGQR FYRTTARAVI GSGGTAEIPA IADEPGAAAN VGDGEAQLMA

151   APAGVATECR LTVQGGTDRE SDASLLARLL EIIRRPPAGG NRYDYKNWAL

201   SVDGVTSAYV YPLRRGLGTV DIAITSADGV SSEETVRRVQ AYIDEMRPVT

251   AKNALVLKPT VTAVPVTVQV KLDGIDLDEA KRRIRTALKE YFDTLIPGDG

301   LTVSQIEAAI SNVDGVIDRR LTAPTANRAA DTVNRIEWFK AGAINVTEMP

351   S*
```

40

The following partial DNA sequence was identified in *N. meningitidis* <SEQ ID 2439>:

```
a722.seq
   1   GTGTTTGAAA CGCCGACATT TGAGCAAATC CGCGAGCGTA TCCTGCGCGA

51   TACCAAAAGC CTGTGGCCGG ATGCCGATAT CAGCCCCGAC AGCGACCATT

101   ATGTGCACGC CAGCCGTTTG GCCAGCTGCG CCGAAGGGCA ATATGCGCAT

151   CAAAGCTGGA TTGTGCGGCA GATTTTCCCT GATACCGCCG ACCGCGAGTA

201   TTTGGAGCGG CATGCCTCCA TGCGCGGCTT GCGCCGCCGC AATCCTACCA

251   CGGCCAGCGG CACGCTGACC GTAAGCGGTA TTGCGCAATC CATGCTTTCA

301   GACGGCCTGC AAGTGCGTAT CGGCCAGCGT TTTTACCGCA CTACCGCCCG

351   CGCCGTTATC GGCAGCGGCG GCACGGCGGA ATACCGGCA ATCGCCGACG

401   AGCCGGGCGC GGCCGCCAAT GTGCGCGACG GCGAGGCGCA ACTGATGGCC

451   GCCCCCGCCG GTGTGTCCAC CGAATGCCGC CTTACCGTAC AAGGCGGCAC

501   CGACCGAGAA AGCGATGCCT CACTGCTGGC GCGTCTGTTG GAAATCATCC

551   GCCGACCGCC CGCAGGCGGC AACCGTTACG ACTATAAAAA CTGGGCGTTG

601   AGTGTTGACG GCGTAACCAG CGCATATGTT TATCCGCTGC GCCGCGGCTT
```

-continued

```
 651   GGGTACGGTG GATATTGCCA TTACCTCCGC CGACGGTGTG CCATCGGAAG

701   AAACTGTGCG CCGCGTACAG GCTTATATCG ACGAGATGCG CCCGGTAACG

751   GCAAAAAATG CGCTGGTACT CAAGCCAACC GTAACGGCGG TGCCTGTTAC

801   CGTGCAAGTC AAGCTCGACG GCATCGACTT GGACGAGGCC AAGCGCCGCA

851   TACGGACGGC CCTAAAAGAA TATTTCGACA CCCTGATCCC CGGCGACGGC

901   CTGACTGTGT CGCAAATCGA GGCGGCTATC AGCAATGTGG ATGGTGTGAT

951   CGACCTCCGT CTGACTGCGC CGACGGCCAA CCGTGCCGCC GATACGGTTA

1001   ACCGCATCGA GTGGTTTAAA GCGGGCGCGA TTAATGTAAC GGAGATGCCG

1051   TCATGA
```

This corresponds to the amino acid sequence <SEQ ID 2440; ORF 722.a>:

```
a722.pep
  1   VFETPTFEQI RERILRDTKS LWPDADISPD SDHYVHASRL ASCAEGQYAH

51   QSWIVRQIFP DTADREYLER HASMRGLRRR NPTTASGTLT VSGIAQSMLS

101   DGLQVRIGQR FYRTTARAVI GSGGTAEIPA IADEPGAAAN VRDGEAQLMA

151   APAGVSTECR LTVQGGTDRE SDASLLARLL EIIRRPPAGG NRYDYKNWAL

201   SVDGVTSAYV YPLRRGLGTV DIAITSADGV PSEETVRRVQ AYIDEMRPVT

251   AKNALVLKPT VTAVPVTVQV KLDGIDLDEA KRRIRTALKE YFDTLIPGDG

301   LTVSQIEAAI SNVDGVIDLR LTAPTANRAA DTVNRIEWFK AGAINVTEMP

351   S*
``` g723.seq not found yet
g723.pep not found yet
The following partial DNA sequence was identified in *N. meningitidis* <SEQ ID 2441>:

```
m723.seq
  1   ATGCGACCCA AGCCCCGTTT CAGACGGTCT GTTATCGCTT GCTCAATATC

51   AGTGATCACG CCCGAACACC TTATTTTTAC CGTTTACAAA CACAATACCG

101   TCTTCGCCCG CGGCCACTTC TTCGCCGCTA TCATCCACGC CCAGCTGCAC

151   TTCGCCTTTG GCCATAGCAC GCAGCAGGTC GAGCACGTCG ATTTTGTAGC

201   GGTTGCGGAT TCGTCGGTA ATCAACACGC CCTGAGCCGC CGTCAGACGG

251   TAGCGGGCAA TGTCGCAGCA AAGGCGCACC AAGATGGGCG GCAGATCCTC

301   AAAAGGTCGT CTGAACCGCC CCAGATACGC GTCGATTTCG GCAGTGGCGT

351   CCACCAGCGC GGTTTGTGCG ACCTCGCGGT CAATCAGCCC CTCGTTGTTG

401   CGGTCGGTGA GCTGCAAGAC TTCCAGCTCA CCGAAACGCG CAACCATATC

451   CTCAACCGTC GCGTATGCCA TTACTCGACC GCCTTGCGTT GCAGCATAGG

501   CTCGGCGCAG ATTGCCTTCC ACACCGCTTC GCCGACTTCG GCGCGCTTCA

551   CTTCGCGCCA GCCGCCGTCA ACAGCAGGC CGCCGCGCCA AAATTCTTTG

601   CCGTCTGCGC CGGTACTGAC GAGCATCACA TCGCGGCTGT CCGCCAAAGC

651   GTCGGCGGCA CGTTGCGTAT GCTGCACTTT GAGTTCGGCA AGTTCGGCGG

701   ACAGTGCCTT TTTGTCGTCT TCGGCTTTTT CCAAGGCTGT GGTCAGCATT

751   TCGACATCGT TTCGGGCGGC GGCAAGCTCT GCCTGCACGG CGTCCAATTC
```

```
-continued
801   GGCTTTGATG TCTTCAAACG ACGGGCGGC GGTTTCGGCG GTTTCTGGTT

851   TGTTGTTGGT TTTTGCCATG ATGACTCCTT GTTTCAGACG GCGGCGGATT

901   CGCATTTGA
```

This corresponds to the amino acid sequence <SEQ ID 2442; ORF 723>:

```
m723.pep
    1   MRPKPRFRRS VIACSISVIT PEHLIFTVYK HNTVFARGHF FAAIIHAQLH

51   FAFGHSTQQV EHVDFVAVAD FVGNQHALSR RQTVAGNVAA KAHQDGRQIL

101   KRSSEPPQIR VDFGSGVHQR GLCDLAVNQP LVVAVGELQD FQLTETRNHI

151   LNRRVCHYST ALRCSIGSAQ IAFHTASPTS ARFTSRQPPS NSRPPRQNSL

201   PSAPVLTSIT SRLSAKASAA RCVCCTLSSA SSADSAFLSS SAFSKAVVSI

251   STSFRAAASS ACTASNSALM SSNDGAAVSA VSGLLLVFAM MTPCFRRRRI

301   RI*
``` a723.seq not found yet
a723.pep not found yet
g724.seq not found yet
g724.pep not found yet The following partial DNA sequence, shown with its encoded amino acid sequence, was identified in *N. meningitidis* <SEQ ID 2443>:

```
m724.map
         ATGAGTTTGAGTAAATTGGCGAAAAAAACGGCACAAACTGCTAAAAATATCGGCGAAACC
      1  ---------+---------+---------+---------+---------+---------+   60
         TACTCAAACTCATTTAACCGCTTTTTTTGCCGTGTTTGACGATTTTTATAGCCGCTTTGG
a        M  S  L  S  K  L  A  K  K  T  A  Q  T  A  K  N  I  G  E  T   -

CTGCGCGCGGCCTTTCGGGGAAAAATCACGCTGGTGGTGTCGTCCGAGCCGATACAGCGC
     61  ---------+---------+---------+---------+---------+---------+   120
         GACGCGCGCCGGAAAGCCCCTTTTTAGTGCGACCACCACAGCAGGCTCGGCTATGTCGCG
a        L  R  A  A  F  R  G  K  I  T  L  V  V  S  S  E  P  I  Q  R   -

GTGCAGTTGAGCGGCTTGGCCGACGAAACCCTGCAAGACCTTGAACATTTGCAGGAATAC
    121  ---------+---------+---------+---------+---------+---------+   180
         CACGTCAACTCGCCGAACCGGCTGCTTTGGGACGTTCTGGAACTTGTAAACGTCCTTATG
a        V  Q  L  S  G  L  A  D  E  T  L  Q  D  L  E  H  L  Q  E  Y   -

GGCTTTGCCAGCCATCCGCCCGACGGCAGCGAAGCGGTAGTGATACCGCTGGGCGGCAAT
    181  ---------+---------+---------+---------+---------+---------+   240
         CCGAAACGGTCGGTAGGCGGGCTGCCGTCGCTTCGCCATCACTATGGCGACCCGCCGTTA
a        G  F  A  S  H  P  P  D  G  S  E  A  V  V  I  P  L  G  G  N   -

ACTTCGCACGGTGTGATTGTGTGCAGCCAGCACGGCAGCTACCGCATCAAAAACCTTAAG
    241  ---------+---------+---------+---------+---------+---------+   300
         TGAAGCGTGCCACACTAACACACGTCGGTCGTGCCGTCGATGGCGTAGTTTTTGGAATTC
a        T  S  H  G  V  I  V  C  S  Q  H  G  S  Y  R  I  K  N  L  K   -

CCCGGCGAGACGGCGATTTTTAATCATGAGGGTGCAAAAATCGTGATTAAGCAAGGCAAA
    301  ---------+---------+---------+---------+---------+---------+   360
         GGGCCGCTCTGCCGCTAAAAATTAGTACTCCCACGTTTTTAGCACTAATTCGTTCCGTTT
a        P  G  E  T  A  I  F  N  H  E  G  A  K  I  V  I  K  Q  G  K   -

ATCATTGAGGCCGATTGCGACGTGTACCGGGTTAACTGCAAACAATACGAGGTTAATGCG
    361  ---------+---------+---------+---------+---------+---------+   420
         TAGTAACTCCGGCTAACGCTGCACATGGCCCAATTGACGTTTGTTATGCTCCAATTACGC
a        I  I  E  A  D  C  D  V  Y  R  V  N  C  K  Q  Y  E  V  N  A   -

GCCACGGATGCCAAATTTAACGCTCCGTTGGTGGAGACCAGTGCAGTGTTGACGGCGCAA
    421  ---------+---------+---------+---------+---------+---------+   480
         CGGTGCCTACGGTTTAAATTGCGAGGCAACCACCTCTGGTCACGTCACAACTGCCGCGTT
a        A  T  D  A  K  F  N  A  P  L  V  E  T  S  A  V  L  T  A  Q   -
```

-continued

```
              GGCCAAATCAACGGCAACGGCGGCATGGCCGTCGAGGGCGGCGACGGAGCCACCTTTAGC
       481    ---------+---------+---------+---------+---------+---------+  540
              CCGGTTTAGTTGCCGTTGCCGCCGTACCGGCAGCTCCCGCCGCTGCCTCGGTGGAAATCG
   a            G  Q  I  N  G  N  G  G  M  A  V  E  G  G  D  G  A  T  F  S       -

GGCGATGTTAACCAAACGGGCGGCAGCTTTAACACCGACGGCGACGTGGTGGCCGGCAAT
       541    ---------+---------+---------+---------+---------+---------+  600
              CCGCTACAATTGGTTTGCCCGCCGTCGAAATTGTGGCTGCCGCTGCACCACCGGCCGTTA
   a            G  D  V  N  Q  T  G  G  S  F  N  T  D  G  D  V  V  A  G  N       -

ATATCGTTGCGCCAGCACCCGCATACCGACAGCATCGGCGGCAAAACCTTACCGGCGGAA
       601    ---------+---------+---------+---------+---------+---------+  660
              TATAGCAACGCGGTCGTGGGCGTATGGCTGTCGTAGCCGCCGTTTTGGAATGGCCGCCTT
   a            I  S  L  R  Q  H  P  H  T  D  S  I  G  G  K  T  L  P  A  E       -

CCGGCATAG
       661    ---------                                                      669
              GGCCGTATC
   a            P  A  *                                                         -
Enzymes that do cut: NONE
Enzymes that do not cut: BamHI BglII EcoRI HindIII KpnI NdeI NheI PstI SacI SalI
SmaI SphI XbaI XhoI
```

This corresponds to the amino acid sequence <SEQ ID 2444;
ORF 724>:

```
m724.pep
     1    MSLSKLAKKT AQTAKNIGET LRAAFRGKIT LVVSSEPIQR VQLSGLADET

51    LQDLEHLQEY GFASHPPDGS EAVVIPLGGN TSHGVIVCSQ HGSYRIKNLK

101    PGETAIFNHE GAKIVIKQGK IIEADCDVYR VNCKQYEVNA ATDAKFNAPL

151    VETSAVLTAQ GQINGNGGMA VEGGDGATFS GDVNQTGGSF NTDGDVVAGN

201    ISLRQHPHTD SIGGKTLPAE PA*
```

The following partial DNA sequence was identified in *N. meningitidis* <SEQ ID 2445>:

```
a724.seq
     1    ATGAGTTTGA GTAAATTGGC GAAAAAAACG GCACAAACTG CTAAAAATAT

51    CGGCGAAACC CTGCGCGCGG CCTTTCGGGG AAAAATCACG CTGGTGGTGT

101    CGTCCGAGCC GATACAGCGC GTGCAGTTGA GCGGCTTGGC CGACGAAACC

151    CTGCAAGACC TTGAACATTT GCAGGAATAC GGCTTTGCCA GCCATCCGCC

201    CGACGGCAGC GAAGCGGTAG TGATACCGCT GGGCGGCAAT ACTTCGCACG

251    GTGTGATTGT GTGCAGCCAG CACGGCAGCT ACCGCATCAA AAACCTTAAG

301    CCCGGCGAGA CGGCGATTTT TAATCATGAG GGTGCAAAAA TCGTGATTAA

351    GCAAGGCAAA ATCATTGAGG CCGATTGCGA CGTGTACCGG GTTAACTGCA

401    AACAATACGA GGTTAATGCG GCCACGGATG CCAAATTTAA CGCTCCGTTG

451    GTGGAGACCA GTGCAGTGTT GACGGCGCAA GGCCAAATCA ACGGCAACGG

501    CGGCATGGCC GTCGAGGGCG GCGACGGAGC CACCTTTAGC GGCGATGTTA

551    ACCAAACGGG CGGCAGCTTT AACACCGACG GCGACGTGGT GGCCGGCAAT

601    ATATCGTTGC GCCAGCACCC GCATACCGAC AGCATCGGCG GCAAAACCTT

651    ACCGGCGGAA CCGGCATAG
```

This corresponds to the amino acid sequence <SEQ ID 2446;
ORF 724.a>:

```
a724.pep
    1   MSLSKLAKKT AQTAKNIGET LRAAFRGKIT LVVSSEPIQR VQLSGLADET

51   LQDLEHLQEY GFASHPPDGS EAVVIPLGGN TSHGVIVCSQ HGSYRIKNLK

101   PGETAIFNHE GAKIVIKQGK IIEADCDVYR VNCKQYEVNA ATDAKFNAPL

151   VETSAVLTAQ GQINGNGGMA VEGGDGATFS GDVNQTGGSF NTDGDVVAGN

201   ISLRQHPHTD SIGGKTLPAE PA*
``` a724/m724 100.0% identity in 222 aa overlap

```
                   10         20         30         40         50         60
    a724.pep   MSLSKLAKKTAQTAKNIGETLRAAFRGKITLVVSSEPIQRVQLSGLADETLQDLEHLQEY
               ||||||||||||||||||||||||||||||||||||||||||||||||||||||||||||
    m724       MSLSKLAKKTAQTAKNIGETLRAAFRGKITLVVSSEPIQRVQLSGLADETLQDLEHLQEY
                   10         20         30         40         50         60
                   70         80         90        100        110        120
    a724.pep   GFASHPPDGSEAVVIPLGGNTSHGVIVCSQHGSYRIKNLKPGETAIFNHEGAKIVIKQGK
               ||||||||||||||||||||||||||||||||||||||||||||||||||||||||||||
    m724       GFASHPPDGSEAVVIPLGGNTSHGVIVCSQHGSYRIKNLKPGETAIFNHEGAKIVIKQGK
                   70         80         90        100        110        120
                  130        140        150        160        170        180
    a724.pep   IIEADCDVYRVNCKQYEVNAATDAKFNAPLVETSAVLTAQGQINGNGGMAVEGGDGATFS
               ||||||||||||||||||||||||||||||||||||||||||||||||||||||||||||
    m724       IIEADCDVYRVNCKQYEVNAATDAKFNAPLVETSAVLTAQGQINGNGGMAVEGGDGATFS
                  130        140        150        160        170        180
                  190        200        210        220
    a724.pep   GDVNQTGGSFNTDGDVVAGNISLRQHPHTDSIGGKTLPAEPAX
               ||||||||||||||||||||||||||||||||||||||||||
    m724       GDVNQTGGSFNTDGDVVAGNISLRQHPHTDSIGGKTLPAEPAX
                  190        200        210        220
``` g725.seq not found yet
g725.pep not found yet
The following partial DNA sequence was identified in *N. meningitidis* <SEQ ID 2447>:

```
m725.seq
    1   ATGGTGCGCA CGGTTAAAAG CTACAACGGC GAGGCCGACG ATTTGGCGGG

51   GCAAATCCAT ACGCTGCCTG CGGTTTGGGT AACGTATGGC GGCAGCAAAG

101   TTGAGCCTGC CAGCACCGGC GGCGTATGCG GACGTTATCA GGATACCGCC

151   GAATTTGTGG TGATGGTGGC GGCCCGCAAT CTGCGCAACG AGCAGGCGCA

201   GCGGCAAGGC GGCATCGACA GCCGCGAAAT CGGCAGCAAC GATTTAATCC

251   GCGCTGTTCG CCGCCTGCTT GACGGCCAGC GGCTCGGTTT TGCCGATAGC

301   CGCGGCTTGG TGCCCAAAGC GGTGCGCGCG ATTGCCAATC ATGTGCTGGT

351   GCAAAACGCC GCAGTAAGCA TATATGCGGT TGAGTATGCC ATCCGCTTTA

401   ACACCTGCGG GTTGGAAAAT GACCGCTACC CCGAACGCAC CGACAATCCC

451   GACGACCCCA ACCATATCTT TACCAAGTAT CAGGGTACAT TGAGCGAGCC

501   GTGGCCTGAT TTCGAGGGGT TGGACGGCAA AATTTACGAC CCGCAATCCG

551   CCGATGAAAT ACCTGTAAAC CTAACCCTTA AGGATAAGCA ATGA
```

This corresponds to the amino acid sequence <SEQ ID 2448; ORF 725>:

```
m725.pep
    1   MVRTVKSYNG EADDLAGQIH TLPAVWVTYG GSKVEPASTG GVCGRYQDTA

51   EFVVMVAARN LRNEQAQRQG GIDSREIGSN DLIRAVRRLL DGQRLGFADS
```

-continued
```
101    RGLVPKAVRA IANHVLVQNA AVSIYAVEYA IRFNTCGLEN DRYPERTDNP

151    DDPNHIFTKY QGTLSEPWPD FEGLDGKIYD PQSADEIPVN LTLKDKQ*
``` a725.seq not found yet
a725.pep not found yet
g726.seq not found yet
g726.pep not found yet The following partial DNA sequence was identified in *N. meningitidis* <SEQ ID 2449>:

```
m726.seq
    1    ATGACCATCT ATTTCAAAAA CGGCTTTTAC GACGACACAT TGGGCGGCAT

51    CCCCGAAGGC GCGGTTGCCG TCCGCGCCGA AGAATACGCC GCCCTTTTGG

101    CAGGACAGGC GCAGGGCGGG CAGATTGCCG CAGATTCCGA CGGCCGCCCC

151    GTTTTAACCC CGCCGCGCCC GTCCGATTAC CACGAATGGG ACGGCAAAAA

201    ATGGAAAATC AGCAAAGCCG CCGCCGCCGC CCGTTTCGCC AAACAAAAA

251    CCGCCTTGGC ATTCCGCCTC GCGGAAAAGG CGGACGAACT CAAAAACAGC

301    CTCTTGGCGG GCTATCCCCA AGTGGAAATC GACAGCTTTT ACAGGCAGGA

351    AAAAGAAGCC CTCGCGCGGC AGGCGGACAA CAACGCCCCG ACCCCGATGC

401    TGGCGCAAAT CGCCGCCGCA AGGGGCGTGG AATTGGACGT TTTGATTGAA

451    AAAGTTATCG AAAAATCCGC CCGCCTGGCT GTTGCCGCCG GCGCGATTAT

501    CGGAAAGCGT CAGCAGCTCG AAGACAAATT GAACACCATC GAAACCGCGC

551    CCGGATTGGA CGCGCTGGAA AAGGAAATCG AAGAATGGAC GCTAAACATC

601    GGCTGA
```

This corresponds to the amino acid sequence <SEQ ID 2450; ORF 726>:

```
m726.pep
    1    MTIYFKNGFY DDTLGGIPEG AVAVRAEEYA ALLAGQAQGG QIAADSDGRP

51    VLTPPRPSDY HEWDGKKWKI SKAAAAARFA KQKTALAFRL AEKADELKNS

101    LLAGYPQVEI DSFYRQEKEA LARQADNNAP TPMLAQIAAA RGVELDVLIE

151    KVIEKSARLA VAAGAIIGKR QQLEDKLNTI ETAPGLDALE KEIEEWTLNI

201    G*
```

The following partial DNA sequence was identified in *N. meningitidis* <SEQ ID 2451>:

```
a726.seq
    1    ATGACCATCT ATTTCAAAAA CGGCTTTTAC GACGACACCT TGGGCAGCAT

51    CCCCGAAGGC GCGGTTGCCG TCCGCGCCGA AGAATACGCC GCCCTTTTGG

101    CAGGACAGGC GCAGGGCGGG CAGATTGCCG CAGATTCCGA CGGCCGCCCC

151    GTTTTAACCC CGCCGCGCCC GTCCGAATAC CACGAATGGG ACGGCAAGAA

201    ATGGGAAATC GGCGAAGCCG CTGCCGCCGC CCGTTTCGCC GAACAAAAAA

251    CCGCCACGGC ATTCCGCCTC GCGGCAAAGG CGGACGAACT CAAAAACAGC

301    CTCTTGGCGG GCTATCCCCA AGTGGAAATC GACAGCTTTT ACAGGCAGGA

351    AAAAGAAGCC CTCGCGCGGC AGGCGGACAA CAACGCCCCG ACCCCGATGC

401    TGGCGCAAAT CGCCGCCGCA AGGGGCGTGG AATTGGACGT TTTGATTGAA
```

-continued

```
451  AAAGTTGTCG AAAAATCCGC CCGCCTGGCC GTTGCCGCCG GCGCGATTAT

501  CGGAAAGCGG CAGCAGCTCG AAGACAAATT GAACACCATC GAAACCGCGC

551  CAGGATTGGA CGCGCTGGAA AAGGAAATCG AAGAATGGAC GCTAAACATC

601  GGCTGA
```

This corresponds to the amino acid sequence <SEQ ID 2452; ORF 726.a>:

```
a726.pep
  1  MTIYFKNGFY DDTLGSIPEG AVAVRAEEYA ALLAGQAQGG QIAADSDGRP

51  VLTPPRPSEY HEWDGKKWEI GEAAAAARFA EQKTATAFRL AAKADELKNS

101  LLAGYPQVEI DSFYRQEKEA LARQADNNAP TPMLAQIAAA RGVELDVLIE

151  KVVEKSARLA VAAGAIIGKR QQLEDKLNTI ETAPGLDALE KEIEEWTLNI

201  G*
``` a726/m726 95.5% identity in 201 aa overlap

```
                    10         20         30         40         50         60
   a726.pep  MTIYFKNGFYDDTLGSIPEGAVAVRAEEYAALLAGQAQGGQIAADSDGRPVLTPPRPSEY
              ||||||||||||||||:||||||||||||||||||||||||||||||||||||||||:|
       m726  MTIYFKNGFYDDTLGGIPEGAVAVRAEEYAALLAGQAQGGQIAADSDGRPVLTPPRPSDY
                    10         20         30         40         50         60

70         80         90        100        110        120
   a726.pep  HEWDGKKWEIGEAAAAARFAEQKTATAFRLAAKADELKNSLLAGYPQVEIDSFYRQEKEA
              ||||||||:|::||||||:||||| |||||:||||||||||||||||||||||||||||
       m726  HEWDGKKWKISKAAAAARFAKQKTALAFRLAEKADELKNSLLAGYPQVEIDSFYRQEKEA
                    70         80         90        100        110        120

130        140        150        160        170        180
   a726.pep  LARQADNNAPTPMLAQIAAARGVELDVLIEKVVEKSARLAVAAGAIIGKRQQLEDKLNTI
              |||||||||||||||||||||||||||||||:||||||||||||||||||||||||||||
       m726  LARQADNNAPTPMLAQIAAARGVELDVLIEKVIEKSARLAVAAGAIIGKRQQLEDKLNTI
                   130        140        150        160        170        180

190        200
   a726.pep  ETAPGLDALEKEIEEWTLNIGX
              ||||||||||||||||||||||
       m726  ETAPGLDALEKEIEEWTLNIGX
                   190        200
``` g727.seq not found yet
g727.pep not found yet
The following partial DNA sequence was identified in *N. meningitidis* <SEQ ID 2453>:

```
m727.seq
  1  ATGAATCTCG TGAAACTGCT GGCGAATAAC TGGCAACCGA TTGCCATTAT

51  CGCGCTTGTC GGCACGGGCT TGGCTGTGTC GCACCATCAA GGCTACAAGT

101  CGGCATTTGC GAAGCAGCAG GCGGTCATCG ACAAGATGGA GCGCGACAAG

151  GCGCAAGCCC TGCTGTTGTC GGCTCAAAAC TATGCGCGCG AACTGGAACT

201  GGCACGCGCG GAAGCTAAAA AATATGAAGT CAAGGCGCAC GCTGTCGGCA

251  TGGCTTTGGC GAAAAAACAG GCGGAAGTCA GCCGTCTGAA AACGGAAAGA

301  GACCTTTGCA AAATTCCTTT CCCTCCCGAC AGCCGAAACC CAAACACAGG

351  TTTTCGGCTG TTTTCGCCCC AAATACCGCC TAATTTTACC CAAATACCCC

401  CTTAA
```

This corresponds to the amino acid sequence <SEQ ID 2454; ORF 727>:

```
m727.pep
     1    MNLVKLLANN WQPIAIIALV GTGLAVSHHQ GYKSAFAKQQ AVIDKMERDK

51    AQALLLSAQN YARELELARA EAKKYEVKAH AVGMALAKKQ AEVSRLKTER

101    DLCKIPFPPD SRNPNTGFRL FSPQIPPNFT QIPP*
```

The following partial DNA sequence was identified in *N. meningitidis* <SEQ ID 2455>:

```
a727.seq
     1    ATGAATCTCG TGAAACTGCT GGCGAATAAC TGGCAACCGA TTGCCATCAT

51    CGCGCTTGTC GGCACGGGTT TGGCGGTGTC GCACCATCAA GGCTACAAGT

101    CGGCTTTTGC GAAGCAGCAG GCGGTCATTG AGAAAATGAA GCGCGACAAG

151    GCGCAAGCCC TGCTGTTGTC GGCTCAAAAC TACGCCCGCG AACTGGAACA

201    GGCGCGTGCG GAAGCTAAAA AATATGAAGT CAAGGCGCAC GCCGTCGGCA

251    TGGCTTTGGC GAAAAAACAG GCGGAAGTCA GCCGTCTGAA AACGGAAAAT

301    AAAAAGGAAA TCGAAAATGT CCTTACTCAA GACCGTAAAA ATGCAGGCGG

351    CGGTTGTATT GACGGCTTTG GCCATCACGG CTTGCAGCTC TACAAGCGCG

401    CCCTCGGCTA CGGAAATTAA
```

This corresponds to the amino acid sequence <SEQ ID 2456; ORF 727.a>:

```
a727.pep
     1    MNLVKLLANN WQPIAIIALV GTGLAVSHHQ GYKSAFAKQQ AVIEKMKRDK

51    AQALLLSAQN YARELEQARA EAKKYEVKAH AVGMALAKKQ AEVSRLKTEN

101    KKEIENVLTQ DRKNAGGGCI DGFGHHGLQL YKRALGYGN*
``` a727/m727 83.2% identity in 119 aa overlap

```
                  10         20         30         40         50         60
a727.pep  MNLVKLLANNWQPIAIIALVGTGLAVSHHQGYKSAFAKQQAVIEKMKRDKAQALLLSAQN
          |||||||||||||||||||||||||||||||||||||||||:||:|||||||||||||||
m727      MNLVKLLANNWQPIAIIALVGTGLAVSHHQGYKSAFAKQQAVIDKMERDKAQALLLSAQN
                  10         20         30         40         50         60

70         80         90        100        110      119
a727.pep  YARELEQARAEAKKYEVKAHAVGMALAKKQAEVSRLKTENKKEIENV-LTQDRKNAGGGC
          ||||||:|||||||||||||||||||||||||||||||||  :::  ::  :  | :| :
m727      YARELELARAEAKKYEVKAHAVGMALAKKQAEVSRLKTE--RDLCKIPFPPDSRNPNTGF
                  70         80         90        100        110

120        130        140
a727.pep  IDGFGHHGLQLYKRALGYGNX m727      RLFSPQIPPNFTQIPPX
                 120        130
```

The following partial DNA sequence was identified in *N. gonorrhoeae* <SEQ ID 2457>:

```
g728.seq
     1    ATGTTTAAAA AATTCAAACC GGTACTGTTG TCATTTTTTG CACTTGTATT

51    TGCCTTTTGG CTGGGAACAG GTATTGCCTA TGAGATTAAT CCGCGTTGGT

101    TTTTGAGCGA TACGGCAACT GAAGTACCTG AAAATCCGAA TGCTTTTGTG
```

-continued
```
 151   GCGAAACTTG CCCGCCTGTT CCGAAATGCC GACAGGGCGG TTGTCATCGT

201   GAAGGAATCG ATGAGGACGG AGGAAAGCCT TGCCGGAGCT GTGGATGACG

251   GTCCGTTGCA GTCGGAGAAG GATTATCTCG CGCTCGCTAT CCGGCTCAGT

301   CGTTTGAAAG AAAAGGCGAA ATGGTTTCAC GTAACGGAGC AGGAACATGG

351   GGAAGAGGTT TGGCTGGATT ACTATATCGG CGAGGGCGGT TTGGTTGCGG

401   TTTCGCTTTC GCAACGCTCG CCGGAAGCGT TTGTTAATGC CGAATATCTG

451   TATCGGAACG ATCGTCCGTT TTCTGTAAAT GTGTACGGCG AACGGCTCA

501   CGGGGAAAAT TATGAAACGA CAGGAGAATA TCGGGTTGTT TGGCAACCGG

551   ACGGTTCGGT ATTTGATGCG GCGGGGCGCG GAAAATCGG GGAAGATGTT

601   TATGAGCATT GCCTCGGGTG TTATCAGATG GCCCAGGTAT ATTTGGCGAA

651   ATACCGGGAT GTCGCGAATG ACGAGCAGAA GGTTTGGGAC TTCCGCGAAG

701   AGAGCAACCG GATTGCATCG GACTCGCGCG ATTATGTGTT TTATCAGAAT

751   ATGCGGGAAT TGATGCCCCG GGGGATGAAG GCGAACAGTC TTGTGGTCGG

801   CTATGATGCG GACGGTCTGC CGCAAAAAGT CTATTGGAGT TTCGACAATG

851   GAAAAAAACG CCAGAGTTTC GAATATTATT TGAAAAACGG AAATCTTTTT

901   ATTGCACAAT CTTCGACGGT AGCATTGAAA GCGGATGGCG TAACGGCGGA

951   TATGCAGACC TATCATGCGC AACAGACGTG GTATTTGGAT GGCGGGCGGA

1001   TTATCCGCGA AGAGAAACAG GGAGACAGAC TGCCTGATTT TCCTTTGAAC

1051   TTGGAAGATT TGGAAAAAGA GGTGAGCCGT TATGCAGAGG CTGCGGCGAG

1101   ACGTTCGGGC GGCAGGCGCG GCCTTTCTCA CTGA
```

This corresponds to the amino acid sequence <SEQ ID 2458; ORF 728>:

```
g728.pep
   1   MFKKFKPVLL SFFALVFAFW LGTGIAYEIN PRWFLSDTAT EVPENPNAFV

51   AKLARLFRNA DRAVVIVKES MRTEESLAGA VDDGPLQSEK DYLALAIRLS

101   RLKEKAKWFH VTEQEHGEEV WLDYYIGEGG LVAVSLSQRS PEAFVNAEYL

151   YRNDRPFSVN VYGGTAHGEN YETTGEYRVV WQPDGSVFDA AGRGKIGEDV

201   YEHCLGCYQM AQVYLAKYRD VANDEQKVWD FREESNRIAS DSRDYVFYQN

251   MRELMPRGMK ANSLVVGYDA DGLPQKVYWS FDNGKKRQSF EYYLKNGNLF

301   IAQSSTVALK ADGVTADMQT YHAQQTWYLD GGRIIREEKQ GDRLPDFPLN

351   LEDLEKEVSR YAEAAARRSG GRRGLSH*
```

The following partial DNA sequence was identified in *N. meningitidis* <SEQ ID 2459>:

```
m728.seq
   1   ATGTTTAAAA AATTCAAACC GGTACTGTTG TCATTTTTTG CACTTGTATT

51   TGCCTTTTGG CTGGGAACGG GTATTGCCTA TGAGATTAAT CCGCGTTGGT

101   TTTTGAGCGA TACGGCAACT GAAGTACCTA AAAATCCGAA TGCTTTTGTG

151   GCGAAACTTG CCCGCCTGTT CCGAAATGCC GACAGGGCGG TTGTCATCGT

201   GAAGGAATCG ATAAGGACGG AGGAAAATCT TGCCGGAACT GTGGATGACG

251   GTCCGTTGCA GTCGGAGAAG GATTATCTCG CGCTCGCTAT CCGGCTCAGT
```

```
-continued
 301   CGTTTGAAAG AAAAGGCGAA ATGGTTTCAC GTAACGGAGC AGGAACATGG
 351   GAAAGAGGTT TGGCTGGATT ACCATATCGG CGAGGGCGGT TTGGTTGCGG
 401   TTTCGCTTTC GCAACGCTCG CCGGAAGCAT TTGTTAATGC CGAATATCTG
 451   TATCGGAACG ATCGTCCGTT TTCTGTAAAT GTGTACGGCG GAACGGTTCA
 501   CGGGGAAAAT TATGAAACGA CAGGAGAATA TCGGGTTGTT TGGCAACCAG
 551   ACGGTTCGGT ATTTGATGCG GCGGGGCGCG GGAAAATCGG GGAAGATGTT
 601   TATGAGCATT GCCTCGGGTG TTATCAGATG GCCCAGGTAT ATTTGGCGAA
 651   ATACCGGGAT GTCGCGAATG ACGAGCAGAA GGTTTGGGAC TTCCGCAAAG
 701   AGAGCAACCG AATTGCGTCG GACTCGCGCA ATTCTGTGTT TTATCAGAAT
 751   ATGCGGGAAT TGATGCCCCG AGGGATGAAG GCGAACAGTC TTGTGGTCGG
 801   CTATGATGCG GACGGTCTGC CGCAAAAAGT CTATTGGAGT TTCGACAATG
 851   GAAAAAAACG CCAGAGTTTC GAATATTATT TGAAAAACGG AAATCTTTTT
 901   ATTGCACAAT CTTCGACGGT AGCATTGAAA GCGGATGGCG TAACGGCGGA
 951   TATGCAGACC TATCATGCGC AACAGACGTG GTATTTGGAT GGCGGGCGGA
1001   TTGTCCGCGA AGAGAAACAG GGAGACAGAC TGCCTGATTT TCCTTTGAAC
1051   TTGGAAAATT TGGAAAAAGA GGTGCGCCGT TATGCAGAGG CTGCGGCGAG
1101   ACGTTCGGGC GGCAGGCGCG ACCTTTCTCA CTGA
```

This corresponds to the amino acid sequence <SEQ ID 2460;
ORF 728>:

```
m728.pep
    1   MFKKFKPVLL SFFALVFAFW LGTGIAYEIN PRWFLSDTAT EVPKNPNAFV

51   AKLARLFRNA DRAVVIVKES IRTEENLAGT VDDGPLQSEK DYLALAIRLS

101   RLKEKAKWFH VTEQEHGKEV WLDYHIGEGG LVAVSLSQRS PEAFVNAEYL

151   YRNDRPFSVN VYGGTVHGEN YETTGEYRVV WQPDGSVFDA AGRGKIGEDV

201   YEHCLGCYQM AQVYLAKYRD VANDEQKVWD FRKESNRIAS DSRNSVFYQN

251   MRELMPRGMK ANSLVVGYDA DGLPQKVYWS FDNGKKRQSF EYYLKNGNLF

301   IAQSSTVALK ADGVTADMQT YHAQQTWYLD GGRIVREEKQ GDRLPDFPLN

351   LENLEKEVRR YAEAAARRSG GRRDLSH*
```

Computer analysis of the amino acid sequences gave the following results:
Homology with a Predicted ORF from *N. meningitidis* menA with menB
ORF 728 shows 96.3% identity over a 377 aa overlap with a predicted ORF (ORF728.a) from *N. gonorrhoeae*:

```
m728/g728
                    10         20         30         40         50         60
      m728.pep  MFKKFKPVLLSFFALVFAFWLGTGIAYEINPRWFLSDTATEVPKNPNAFVAKLARLFRNA
                ||||||||||||||||||||||||||||||||||||||||:|||||||||||||||||||
          g728  MFKKFKPVLLSFFALVFAFWLGTGIAYEINPRWFLSDTATEIPKNPNAFVAKLARLFRNA
                    10         20         30         40         50         60

70         80         90        100        110        120
      m728.pep  DRAVVIVKESIRTEENLAGTVDDGPLQSEKDYLALAIRLSRLKEKAKWFHVTEQEHGKEV
                ||||||||||:||||:|||:||||||||||||||||||||||||||||||||||||:||
          g728  MVESAKSGQSMDDWRSGILALLSNKGWLHPNGHNGKDIIDPATGEVFGSPRRLETIYETN
                    70         80         90        100        110        120
```

-continued

```
              130        140        150        160        170        180
m728.pep  WLDYHIGEGGLVAVSLSQRSPEAFVNAEYLYRNDRPFSVNVYGGTVHGENYETTGEYRVV
          ||||:||||||||||||||||||||||||||||||||||||||||:|||||||||||||
g728      WLDYYIGEGGLVAVSLSQRSPEAFVNAEYLYRNDRPFSVNVYGGTAHGENYETTGEYRVV
              130        140        150        160        170        180

190        200        210        220        230        240
m728.pep  WQPDGSVFDAAGRGKIGEDVYEHCLGCYQMAQVYLAKYRDVANDEQKVWDFRKESNRIAS
          |||||||||||||||||||||||||||||||||||||||||||||||||||:||||||
g728      WQPDGSVFDAAGRGKIGEDVYEHCLGCYQMAQVYLAKYRDVANDEQKVWDFREESNRIAS
              190        200        210        220        230        240

250        260        270        280        290        300
m728.pep  DSRNSVFYQNMRELMPRGMKANSLVVGYDADGLPQKVYWSFDNGKKRQSFEYYLKNGNLF
          |||:|||||||||||||||||||||||||||||||||||||||||||||||||||||||
g728      RGFDYNAGRMNYRPDLDKYDRALAHQFAKAEMGGADFKTSFKQLEKEFYEVKQRLDIDGK
              250        260        270        280        290        300

310        320        330        340        350        360
m728.pep  IAQSSTVALKADGVTADMQTYHAQQTWYLDGGRIVREEKQGDRLPDFPLNLENLEKEVRR
          |||||||||||||||||||||||||||||||||:|||||||||||||||||:|||||| |
g728      IAQSSTVALKADGVTADMQTYHAQQTWYLDGGRIIREEKQGDRLPDFPLNLEDLEKEVSR
              310        320        330        340        350        360

370
m728.pep  YAEAAARRSGGRRDLSHX
          ||||||||||||| ||||
g728      YAEAAARRSGGRRGLSHX
              370
```

The following partial DNA sequence was identified in *N. meningitidis* <SEQ ID 2461>:

```
a728.seq
    1  ATGTTTAAAA AATTCAAACC GGTACTGTTG TCATTTTTTG CACTTGTATT

51  TGCCTTTTGG CTGGGAACGG GTATTGCCTA TGAGATTAAT CCGCGTTGGT

101  TTTTGAGCGA TACGGCAACT GAAAATCCGA ATGCTTTTGT GGCGAAACTT

151  GCCCGCCTGT TCCGAAATGC CGACAGGGCG GTTGTCATCG TGAAGGAATC

201  GATGAGGACG GAGGAAAGTC TTGCCGGAGC TGTGGATGAC GGTCCGTTGC

251  AGTCGGAGAA GGATTATCTT GCACTCGCTG TCCGGCTCAG TCGTTTGAAA

301  GAAAAGGCGA AATGGTTTCA CGTAACGGAG CAGGAACATG GGGAAGAGGT

351  TTGGCTGGAT TACTATATCG GCGAGGGCGG TTTGGTTGCG GTTTCGCTTT

401  CGCAACGCTC GCCGGAAGCG TTTGTTAATG CCGAATATCT GTATCGGAAC

451  GATCGTCCGT TTTCTGTAAA TGTGTACGGC GGAACGGTTC ACGGGGAAAA

501  TTATGAAACG ACAGGAGAAT ATCGGGTTGT TTGGCAACCG GACGGTTCGG

551  TATTTGATGC GTCGGGGCGC GGGAAAATCG GGAAGATGT TTATGAGCAT

601  TGCCTCGGGT GTTATCAGAT GGCCCAGGTA TATTTGGCGA AATATCGGGA

651  TGTCGCGAAT GATGAGCAGA AGGTTTGGGA CTTCCGCGAA GAGAGTAACC

701  GGATTGCGTC GGACTCGCGC GATTCTGTGT TTTATCAGAA TATGCGGGAA

751  TTGATGCCCC GAGGGATGAA GGCAAACAGT CTTGTGGTCG GCTATGATGC

801  GGACGGTCTG CCGCAGAAAG TCTATTGGAG TTTCGACAAT GGGAAAAAAC

851  GCCAGAGTTT CGAATATTAT TTGAAAAACG GAAATCTTTT TATTGCACAA

901  TCTTCGACGG TAGCATTGAA AGCGGATGGC GTAACGGCGG ATATGCAGAC

951  CTATCATGCG CAACAGACGT GGTATTTAGA TGGCGGGCGG ATTGTCCGCG

1001  AAGAGAAACA GGGGGACAGA CTGCCTGATT TTCCTTTGAA CTTGGAAGAT

1051  TTGGAAAAAG AGGTGAGCCG TTATGCAGAG GCTGCGGCGA GACGTTCGGG

1101  CGGCAGGCGC GACCTTTCTC ACTGA
```

This corresponds to the amino acid sequence <SEQ ID 2462; ORF 728.a>:

```
a728.pep
    1 MFKKFKPVLL SFFALVFAFW LGTGIAYEIN PRWFLSDTAT ENPNAFVAKL

51 ARLFRNADRA VVIVKESMRT EESLAGAVDD GPLQSEKDYL ALAVRLSRLK

101 EKAKWPHVTE QEHGEEVWLD YYIGEGGLVA VSLSQRSPEA FVNAEYLYRN

151 DRPFSVNVYG GTVHGENYET TGEYRVVWQP DGSVFDASGR GKIGEDVYEH

201 CLGCYQMAQV YLAKYRDVAN DEQKVWDFRE ESNRIASDSR DSVFYQNMRE

251 LMPRGMKANS LVVGYDADGL PQKVYWSFDN GKKRQSFEYY LKNGNLFIAQ

301 SSTVALKADG VTADMQTYHA QQTWYLDGGR IVREEKQGDR LPDFPLNLED

351 LEKEVSRYAE AAARRSGGRR DLSH*
``` a728/m728 96.3% identity in 377 aa overlap

```
                 10        20        30        40        50
    a728.pep MFKKFKPVLLSFFALVFAFWLGTGIAYEINPRWFLSDTATE---NPNAFVAKLARLFRNA
             ||||||||||||||||||||||||||||||||||||||||   ||||||||||||||||
    m728    MFKKFKPVLLSFFALVFAFWLGTGIAYEINPRWFLSDTATEVPKNPNAFVAKLARLFRNA
                 10        20        30        40        50        60
                60        70        80        90       100       110
    a728.pep DRAVVIVKESMRTEESLAGAVDDGPLQSEKDYLALAVRLSRLKEKAKWPHVTEQEHGEEV
             |||||||||||:||||:|||:|||||||||||||||:|||||||||||||||||||||:||
    m728    DRAVVIVKESIRTEENLAGTVDDGPLQSEKDYLALAIRLSRLKEKAKWPHVTEQEHGKEV
                 70        80        90       100       110       120
               120       130       140       150       160       170
    a728.pep WLDYYIGEGGLVAVSLSQRSPEAFVNAEYLYRNDRPFSVNVYGGTVHGENYETTGEYRVV
             ||||:|||||||||||||||||||||||||||||||||||||||||||||||||||||||
    m728    WLDYHIGEGGLVAVSLSQRSPEAFVNAEYLYRNDRPFSVNVYGGTVHGENYETTGEYRVV
                130       140       150       160       170       180
               180       190       200       210       220       230
    a728.pep WQPDGSVFDASGRGKIGEDVYEHCLGCYQMAQVYLAKYRDVANDEQKVWDFREESNRIAS
             |||||||||||:||||||||||||||||||||||||||||||||||||||||:|||||||
    m728    WQPDGSVFDAAGRGKIGEDVYEHCLGCYQMAQVYLAKYRDVANDEQKVWDFRKESNRIAS
                190       200       210       220       230       240
               240       250       260       270       280       290
    a728.pep DSRDSVFYQNMRELMPRGMKANSLVVGYDADGLPQKVYWSFDNGKKRQSFEYYLKNGNLF
             |||:||||||||||||||||||||||||||||||||||||||||||||||||||||||||
    m728    DSRNSVFYQNMRELMPRGMKANSLVVGYDADGLPQKVYWSFDNGKKRQSFEYYLKNGNLF
                250       260       270       280       290       300
               300       310       320       330       340       350
    a728.pep IAQSSTVALKADGVTADMQTYHAQQTWYLDGGRIVREEKQGDRLPDFPLNLEDLEKEVSR
             |||||||||||||||||||||||||||||||||||||||||||||||||||||:||||| |
    m728    IAQSSTVALKADGVTADMQTYHAQQTWYLDGGRIVREEKQGDRLPDFPLNLENLEKEVRR
                310       320       330       340       350       360
               360       370
    a728.pep YAEAAARRSGGRRDLSHX
             ||||||||||||||||||
    m728    YAEAAARRSGGRRDLSHX
                370
```

The following partial DNA sequence was identified in *N. gonorrhoeae* <SEQ ID 2463>:

```
g729.seq
    1 ATGAATACTA CATTGAAAAC TACCTTGACC TCTGTTGCAG CAGCCTTTGC

51 ATTGTCTGCC TGCACCATGA TTCCTCAATA CGAGCAGCCC AAAGTCGAAG

101 TTGCGGAAAC CTTCCAAAAC GACACATCGG TTTCTTCCAT CCGCGCGGTT

151 GATTTGGGTT GGCATGACTA TTTTGCCGAC CCGCGCCTGC AAAAGCTGAT

201 CGACATCGCA CTCGAGCGCA ATACCAGTTT GCGTACAGCC GTATTGAACA

251 GCGAAATCTA CCGCAAACAA TACATGATCG AGCGCAACAA CCTCCTGCCC

301 ACGCTTGCCG CCAATGCGAA CGGCTCGCGC CAAGGCAGCT TGAGCGGCgg
```

-continued

```
 351   caaTGTCAGC AGCAGCTACA ATGTCGGACT GGGTGcGGca tCTTACGAAC
 401   TCGATCTGTT CgGGCGCGTG CGCagcaacA GcgaagcAGC ACTGcaggGC
 451   tATTTTGCCA GCGTTGCCAA CcgcGATGCG GCACATTTGa ttCtGATTGC
 501   CACCGTTGCC AAAGCCTATT TCAAcgaGcG TTATGCCGAA AAAGcgatgT
 551   CTTTGGCGCa gcGTGTCTTG AAAACGCGCG AGGAAACCTA CAAGCTGTCC
 601   GAATTGCGGT ACAAGGCAGG CGTGATTTCC GCCGTCGCCC TGCGCCAGCA
 651   GGAAGCCTTG ATTGAATCTG CCAAAGCCGA TTATGCCCAT GCCGCGCGCa
 701   gcCGCGAACA GGCGCGCAAT GCCTTGGCAA CCTTGATTAA ccGTCCGATA
 751   CCCGAagaCC TGCCCGCCGG TTTGCCGTTG GACAagcAGT TTTTTGTTGA
 801   AAAACTGCCT GCCGGTTTGA GTTCCGAAGT ATTGCTCGAC CGTCCCGACA
 851   TCCGCGCCGC CGAACACGCG CTCAAACAGG CAAACGCCAA TATCGGTGCG
 901   gcgCGCGCCg ccTTTTTCCC GTCCATCCGC CTGACCGGAA GCGTCGGTAC
 951   GGGTTCTGTC GAATTGGGCG GCTGTTCAA AAGCGGCACG GGCGTTTGGG
1001   CGTTCGCTCC GTCTATTACC CTGCCGATTT TTACTTGGGG AACGAACAAG
1051   GCGAACCTTG ATGTGGCAAA ACTGCGCCAA CAGGCACAAA TTGTTGCCTA
1101   TGAATCCGCC GTCCAATCCG CCTTTCAAGA CGTGGCAAAC GCATTGGCGG
1151   CGCGCGAGCA GCTGGATAAA GCCTATGACG CTTTAAGCAA ACAAAGCCGC
1201   GCCTCTAAAG AAGCGTTGCG CTTGGTCGGA CTGCGTTACA ACACGGCGT
1251   ATCCGGCGCG CTCGATTTGC TCGATGCGGA ACGCATCAGC TATTCGGCGG
1301   AAGGTGCGGC TTTGTCGGCA CAACTGACCC GCGCCGAAAA CCTTGCCGAT
1351   TTGTACAAGG CGCTCgacGG CGGATTGAAA CGGGATACCC AAACCGGCAA
1401   ATAA
```

This corresponds to the amino acid sequence <SEQ ID 2464; ORF 729>:

```
g729.pep
   1   MNTTLKTTLT SVAAAFALSA CTMIPQYEQP KVEVAETFQN DTSVSSIRAV
  51   DLGWHDYFAD PRLQKLIDIA LERNTSLRTA VLNSEIYRKQ YMIERNNLLP
 101   TLAANANGSR QGSLSGGNVS SSYNVGLGAA SYELDLFGRV RSNSEAALQG
 151   YFASVANRDA AHLILIATVA KAYFNERYAE KAMSLAQRVL KTREETYKLS
 201   ELRYKAGVIS AVALRQQEAL IESAKADYAH AARSREQARN ALATLINRPI
 251   PEDLPAGLPL DKQFFVEKLP AGLSSEVLLD RPDIRAAEHA LKQANANIGA
 301   ARAAFFPSIR LTGSVGTGSV ELGGLFKSGT GVWAFAPSIT LPIFTWGTNK
 351   ANLDVAKLRQ QAQIVAYESA VQSAFQDVAN ALAAREQLDK AYDALSKQSR
 401   ASKEALRLVG LRYKHGVSGA LDLLDAERIS YSAEGAALSA QLTRAENLAD
 451   LYKALDGGLK RDTQTGK*
```

The following partial DNA sequence was identified in N. meningitidis <SEQ ID 2465>:

```
m729.seq
   1   ATGGATACTA CATTGAAAAC CACCTTGACT TCTGTTGCAG CAGCCTTTGC
  51   ATTGTCTGCC TGCACCATGA TTCCCCAATA CGAGCAGCCC AAAGTCGAAG
```

-continued

```
 101    TTGCCGAAAC GTTCAAAAAC GATACCGCCG ACAGCGGCAT CCGCGCCGTC
 151    GATTTAGGTT GGCATGACTA TTTTGCCGAC CCGCGCCTGC AAAAGCTGAT
 201    CGACATCGCA CTCGAGCGCA ATACCAGTTT GCGTACCGCC GTATTGAACA
 251    GCGAAATCTA CCGCAAACAA TACATGATTG AGCGCAACAA CCTCCTGCCC
 301    ACGCTTGCCG CCAATGCGAA CGACTCGCGC CAAGGCAGCT TGAGCGGCGG
 351    CAATGTAAGC AGCAGCTACA AAGTCGGACT GGGTGCGGCA TCTTACGAAC
 401    TCGATCTGTT CGGGCGTGTA CGCAGCAGCA GCGAGGCGGC ACTGCAAGGC
 451    TATTTCGCCA GCACCGCCAA CCGCGATGCG GCACATTTGA GCCTGATTGC
 501    CACCGTTGCC AAAGCCTATT TCAACGAACG TTACGCCGAA GAAGCGATGT
 551    CTTTGGCGCA ACGTGTTTTG AAAACGCGCG AGGAAACCTA CAAGCTGTCC
 601    GAATTACGTT ACAAGGCAGG CGTGATTTCC GCCGTCGCCC TACGTCAGCA
 651    GGAAGCCCTG ATCGAATCTG CCAAAGCCGA TTATGCCCAT GCCGCGCGCA
 701    GCCGCGAACA GGCGCGCAAT GCCTTGGCAA CCTTGATTAA CCAACCGATA
 751    CCCGAAGACC TGCCTGCCGG TTTGCCGCTG GACAAGCAGT TTTTTGTTGA
 801    AAAACTGCCG GCCGGTTTGA GTTCCGAAGT ATTGCTCGAC CGTCCCGATA
 851    TCCGTGCTGC CGAACACGCG CTCAAACAGG CAAACGCCAA TATCGGTGCG
 901    GCACGCGCCG CCTTTTTCCC ATCCATCCGC CTGACCGGAA CCGTCGGTAC
 951    GGGTTCTGCC GAATTGGGTG GGTTGTTCAA AAGCGGCACG GGCGTTTGGT
1001    CGTTCGCGCC GTCTATTACC CTGCCGATTT TACCTGGGG TACGAACAAG
1051    GCGAACCTTG ATGTAGCCAA GCTGCGCCAA CAGGTACAAA TCGTTGCCTA
1101    TGAATCCGCC GTCCAATCCG CATTTCAAGA CGTGGCAAAC GCATTGGCGG
1151    CGCGCGAGCA GCTGGATAAA GCCTATGACG CTTTAAGCAA ACAAAGCCGC
1201    GCCTCTAAAG AAGCGTTGCG CTTGGTCGGC CTGCGTTACA AGCACGGCGT
1251    ATCCGGCGCG CTCGACTTGC TCGATGCGGA ACGCAGCAGC TATGCGGCGG
1301    AGGGTGCGGC TTTGTCGGCA CAACTGACCC GCGCCGAAAA CCTTGCCGAT
1351    TTGTACAAGG CACTCGGCGG CGGATTGAAA CGGGATACCC AAACCGACAA
1401    ATAA
```

This corresponds to the amino acid sequence <SEQ ID 2466; ORF 729>:

```
m729.pep
    1   MDTTLKTTLT SVAAAFALSA CTMIPQYEQP KVEVAETFKN DTADSGIRAV
   51   DLGWHDYFAD PRLQKLIDIA LERNTSLRTA VLNSEIYRKQ YMIERNNLLP
  101   TLAANANDSR QGSLSGGNVS SSYKVGLGAA SYELDLFGRV RSSSEAALQG
  151   YFASTANRDA AHLSLIATVA KAYFNERYAE EAMSLAQRVL KTREETYKLS
  201   ELRYKAGVIS AVALRQQEAL IESAKADYAH AARSREQARN ALATLINQPI
  251   PEDLPAGLPL DKQFFVEKLP AGLSSEVLLD RPDIRAAEHA LKQANANIGA
  301   ARAAFFPSIR LTGTVGTGSA ELGGLFKSGT GVWSFAPSIT LPIFTWGTNK
  351   ANLDVAKLRQ QVQIVAYESA VQSAFQDVAN ALAAREQLDK AYDALSKQSR
  401   ASKEALRLVG LRYKHGVSGA LDLLDAERSS YAAEGAALSA QLTRAENLAD
  451   LYKALGGGLK RDTQTDK*
```

Computer analysis of the amino acid sequences gave the following results:
Homology with a Predicted ORF from N. meningitidis menA with menB
ORF 729 shows 95.7% identity over a 467 aa overlap with a predicted ORF (ORF729.a) from N. gonorrhoeae:
m729/g729 95.7% identity in 467 aa overlap

```
                  10        20        30        40        50        60
m729.pep  MDTTLKTTLTSVAAAFALSACTMIPQYEQPKVEVAETFKNDTADSGIRAVDLGWHDYFAD
          :|||||||||||||||||||||||||||||||||:|||: |:||||||||||||||||||
g729      MNTTLKTTLTSVAAAFALSACTMIPQYEQPKVEVAETFQNDTSVSSIRAVDLGWHDYFAD
                  10        20        30        40        50        60

70        80        90       100       110       120
m729.pep  PRLQKLIDIALERNTSLRTAVLNSEIYRKQYMIERNNLLPTLAANANDSRQGSLSGGNVS
          ||||||||||||||||||||||||||||||||||||||||||||||| ||||||||||||
g729      PRLQKLIDIALERNTSLRTAVLNSEIYRKQYMIERNNLLPTLAANANGSRQGSLSGGNVS
                  70        80        90       100       110       120

130       140       150       160       170       180
m729.pep  SSYKVGLGAASYELDLFGRVRSSSEAALQGYFASTANRDAAHLSLIATVAKAYFNERYAE
          |||:|||||||||||||||||||:||||||||||:||||||||||:|||||||||||||
g729      SSYNVGLGAASYELDLFGRVRSNSEAALQGYFASVANRDAAHLILIATVAKAYFNERYAE
                 130       140       150       160       170       180

190       200       210       220       230       240
m729.pep  EAMSLAQRVLKTREETYKLSELRYKAGVISAVALRQQEALIESAKADYAHAARSREQARN
          :|||||||||||||||||||||||||||||||||||||||||||||||||||||||||||
g729      KAMSLAQRVLKTREETYKLSELRYKAGVISAVALRQQEALIESAKADYAHAARSREQARN
                 190       200       210       220       230       240

250       260       270       280       290       300
m729.pep  ALATLINQPIPEDLPAGLPLDKQFFVEKLPAGLSSEVLLDRPDIRAAEHALKQANANIGA
          |||||||:||||||||||||||||||||||||||||||||||||||||||||||||||||
g729      ALATLINRPIPEDLPAGLPLDKQFFVEKLPAGLSSEVLLDRPDIRAAEHALKQANANIGA
                 250       260       270       280       290       300

310       320       330       340       350       360
m729.pep  ARAAFFPSIRLTGTVGTGSAELGGLFKSGTGVWSFAPSITLPIFTWGTNKANLDVAKLRQ
          ||||||||||||:|||||:|||||||||||||:||||||||||||||||||||||||||
g729      ARAAFFPSIRLTGSVGTGSVELGGLFKSGTGVWAFAPSITLPIFTWGTNKANLDVAKLRQ
                 310       320       330       340       350       360

370       380       390       400       410       420
m729.pep  QVQIVAYESAVQSAFQDVANALAAREQLDKAYDALSKQSRASKEALRLVGLRYKHGVSGA
          |:||||||||||||||||||||||||||||||||||||||||||||||||||||||||||
g729      QAQIVAYESAVQSAFQDVANALAAREQLDKAYDALSKQSRASKEALRLVGLRYKHGVSGA
                 370       380       390       400       410       420

430       440       450       460
m729.pep  LDLLDAERSSYAAEGAALSAQLTRAENLADLYKALGGGLKRDTQTDKX
          ||||||||  ||:|||||||||||||||||||||||| ||||||| ||
g729      LDLLDAERISYSAEGAALSAQLTRAENLADLYKALDGGLKRDTQTGKX
                 430       440       450       460
```

The following partial DNA sequence was identified in N. meningitidis <SEQ ID 2467>:

```
a729.seq
    1   ATGGATACTA CATTGAAAAC CACCTTGACT TCTGTTGCAG CAGCCTTCGC

51   ATTATCCGCC TGCACCATGA TTCCCCAATA CGAGCAGCCC AAAGTCGAAG

101   TTGCCGAAAC GTTCAAAAAC GATACCGCCG ACAGCGGCAT CCGTGCGGTC

151   GATTTGGGTT GGCATGACTA TTTTGCCGAC CCGCGCCTGC AAAAGCTGAT

201   CGACATCGCA CTCGAGCGCA ATACCAGTTT GCGTACCGCC GTATTGAACA

251   GCGAAATCTA CCGCAAACAA TACATGATTG AGCGCAACAA CCTCCTGCCC

301   ACGCTTGCCG CCAATGCGAA CGACTCGCGC CAAGGCAGCT TGAGCGGCGG

351   CAATGTAAGC AGCAGCTACA AAGTCGGACT GGGTGCGGCA TCTTACGAAC

401   TCGATCTGTT CGGGCGTGTA CGCAGCAGCA GCGAGGCGGC ACTGCAAGGC

451   TATTTCGCCA GCACCGCCAA CCGCGATGCG GCACATTTGA GCCTGATTGC

501   CACCGTTGCC AAAGCCTATT TCAACGAACG TTATGCCGAA GAAGCGATGT

551   CTTTGGCGCA ACGTGTTTTG AAAACGCGCG AGGAAACCTA CAAGCTGTCC
```

```
 601  GAATTACGTT ACAAGGCAGG CGTGATTTCC GCCGTCGCCC TACGTCAGCA

651  GGAAGCCCTA ATCGAATCTG CCAAAGCCGA TTATGCCCAT GCCGCGCGCA

701  GCCGCGAACA GGCGCGCAAT GCCTTGGCAA CCCTGATTAA CCAACCGATA

751  CCCGACGACC TGCCCGCCGG TTTGCCGTTG GACAAGCAGT TTTTTGTTGA

801  GAAGCTGCCG GCCGGTTTGA GTTCCGAAGT ATTGCTCGAC CGTCCCGATA

851  TCCGTGCTGC CGAACACGCG CTCAAACAGG CAAACGCCAA TATCGGTGCG

901  GCACGCGCCG CCTTTTTCCC ATCCATCCGC CTGACCGGAA GCGTCGATAC

951  GCATTCTGCC GAATTGGGCG GGCTGTTCAA AAGCGGCACC GGCGTTTGGT

1001  TGTTCGCACC TTCCATTACC CTGCCGATTT TTACCTGGGG TACGAACAAG

1051  GCGAACCTCG ATGTAGCCAA GCTGCGCCAA CAGGCACAAA TCGTTGCCTA

1101  TGAAGCCGCC GTCCAATCCG CATTTCAAGA CGTGGCAAAC GCATTGACCG

1151  CGCGCGAGCA GTTGGATAAA GCCTATGACG CTTTAAGCAA ACAAAGCCGC

1201  GCCTCTAAAG AAGCGTTGCG TTTGGTCGGT CTGCGTTACA ACACGGCGT

1251  ATCCGGCGCG CTCGACTTGC TCGATGCGGA ACGCAGCAGC TATTCGGCGG

1301  AAGGTGCGGC TTTGTCGGCA CAACTGACCC GCGCCGAAAA CCTTGCCGAT

1351  TTGTACAAGG CACTCGGCGG CGGATTGAAA CGGGATACCC AAACCGACAA

1401  ATAA
```

This corresponds to the amino acid sequence <SEQ ID 2468; ORF 729.a>:

```
a729.pep
   1  MDTTLKTTLT SVAAAFALSA CTMIPQYEQP KVEVAETFKN DTADSGIRAV

51  DLGWHDYFAD PRLQKLIDIA LERNTSLRTA VLNSEIYRKQ YMIERNNLLP

101  TLAANANDSR QGSLSGGNVS SSYKVGLGAA SYELDLFGRV RSSSEAALQG

151  YFASTANRDA AHLSLIATVA KAYFNERYAE EAMSLAQRVL KTREETYKLS

201  ELRYKAGVIS AVALRQQEAL IESAKADYAH AARSREQARN ALATLINQPI

251  PDDLPAGLPL DKQFFVEKLP AGLSSEVLLD RPDIRAAEHA LKQANANIGA

301  ARAAFFPSIR LTGSVDTHSA ELGGLFKSGT GVWLFAPSIT LPIFTWGTNK

351  ANLDVAKLRQ QAQIVAYEAA VQSAFQDVAN ALTAREQLDK AYDALSKQSR

401  ASKEALRLVG LRYKHGVSGA LDLLDAERSS YSAEGAALSA QLTRAENLAD

451  LYKALGGGLK RDTQTDK*
``` a729/m729 98.1% identity in 467 aa overlap

```
                 10         20         30         40         50         60
a729.pep  MDTTLKTTLTSVAAAFALSACTMIPQYEQPKVEVAETFKNDTADSGIRAVDLGWHDYFAD
          ||||||||||||||||||||||||||||||||||||||||||||||||||||||||||||
m729      MDTTLKTTLTSVAAAFALSACTMIPQYEQPKVEVAETFKNDTADSGIRAVDLGWHDYFAD
                 10         20         30         40         50         60

70         80         90        100        110        120
a729.pep  PRLQKLIDIALERNTSLRTAVLNSEIYRKQYMIERNNLLPTLAANANDSRQGSLSGGNVS
          ||||||||||||||||||||||||||||||||||||||||||||||||||||||||||||
m729      PRLQKLIDIALERNTSLRTAVLNSEIYRKQYMIERNNLLPTLAANANDSRQGSLSGGNVS
                 70         80         90        100        110        120

130        140        150        160        170        180
a729.pep  SSYKVGLGAASYELDLFGRVRSSSEAALQGYFASTANRDAAHLSLIATVAKAYFNERYAE
          |||||||||||||||||||||||||||||||||||||||||||||||||||||||||||
m729      SSYKVGLGAASYELDLFGRVRSSSEAALQGYFASTANRDAAHLSLIATVAKAYFNERYAE
                130        140        150        160        170        180
```

```
              190        200        210        220        230        240
a729.pep   EAMSLAQRVLKTREETYKLSELRYKAGVISAVALRQQEALIESAKADYAHAARSREQARN
           ||||||||||||||||||||||||||||||||||||||||||||||||||||||||||||
m729       EAMSLAQRVLKTREETYKLSELRYKAGVISAVALRQQEALIESAKADYAHAARSREQARN
              190        200        210        220        230        240

250        260        270        280        290        300
a729.pep   ALATLINQPIPDDLPAGLPLDKQFFVEKLPAGLSSEVLLDRPDIRAAEHALKQANANIGA
           ||||||||||| ||||||||||||||||||||||||||||||||||||||||||||||||
m729       ALATLINQPIPEDLPAGLPLDKQFFVEKLPAGLSSEVLLDRPDIRAAEHALKQANANIGA
              250        260        270        280        290        300

310        320        330        340        350        360
a729.pep   ARAAFFPSIRLTGSVDTHSAELGGLFKSGTGVWLFAPSITLPIFTWGTNKANLDVAKLRQ
           ||||||||||||| | ||||||||||||||||||| ||||||||||||||||||||||||
m729       ARAAFFPSIRLTGTVGTGSAELGGLFKSGTGVWSFAPSITLPIFTWGTNKANLDVAKLRQ
              310        320        330        340        350        360

370        380        390        400        410        420
a729.pep   QAQIVAYEAAVQSAFQDVANALTAREQLDKAYDALSKQSRASKEALRLVGLRYKHGVSGA
           | |||||| |||||||||||||| |||||||||||||||||||||||||||||||||||
m729       QVQIVAYESAVQSAFQDVANALAAREQLDKAYDALSKQSRASKEALRLVGLRYKHGVSGA
              370        380        390        400        410        420

430        440        450        460
a729.pep   LDLLDAERSSYSAEGAALSAQLTRAENLADLYKALGGGLKRDTQTDKX
           |||||||||| |||||||||||||||||||||||||||||||||||||
m729       LDLLDAERSSYAAEGAALSAQLTRAENLADLYKALGGGLKRDTQTDKX
              430        440        450        460
```

The following partial DNA sequence was identified in *N. gonorrhoeae* <SEQ ID 2469>:

```
g730.seq
    1   GTGAAACCGC TGCGCAGACT GACAAACCTC CTTGCCGCCT GCGCCGTAGC

51   GGCGGTCGCA CTCATACAGC CCGCCCTCGC GGCGGACTTG GCGCAAGACC

101   CGTTCATTAC CGATAACACC CAACGGCAGC ACTACGAACC CGGCGGCAAA

151   TACCACCTCT TCGGcgaCCC GCGCGGCAGC GTTTCCGACC GCACCGGCAA

201   AATCAACGTC ATCCAAGACT ATACCCACCA GATGGGCAAC CTGCTCATCC

251   AACAGGCGGC AATCCAAGGC AATCTTGGTT ACACCGTCCG CTTTTCCGGA

301   CACGGACACG AAGAACACGC CCCCTTCGAC AACCACGCCG CCGACAGCGC

351   AAGCGAAGAA AAAGGCAACG TTGACGACGG CTTTACCGTG TACCGGCTCA

401   ACTGGGAAGG ACACGAACAT CATCCCGCCG ATGCCTACGA CGGCCCGAAG

451   GGCGGCAATT ACCCCAAACC TACGGGCGCA CGAGACGAAT ACACCTATCA

501   CGTCAACGGC ACAGCCCGCA GTATCAAACT CAATCCGACC GACACCCGCA

551   GCATCCGGCA ACGCATATTC GACAACTACA CAACCTCGG CAGCAATTTC

601   TCCGACCGCG CCGATGAAGC CAACAGAAAA ATGTTCGAGC ACAATGCCAA

651   GCTCGACCGC TGGGGCAACA GCATGGAGTT TGTCAACGGC GTCGCCGCCG

701   GCGCGCTCAA CCCCTTTATC AGCGCGGGCG AAGCCTTGGG CATAGGCGAC

751   ATACTGTACG GAACGCGCTA TGCCATAGAC AAAGCCGCGA TGCGCAACAT

801   CGCCCCCTTA CCCGCCGAGG GCAAATTCGC CGCCATCGGC GGCTTGGGCA

851   GCGCGGCGGG CTTTGAAAAA AATACGCGCG AAGCCGTTGA CCGGTGGATA

901   CAGGAAAACC CCAATGCCGC CGAAACCGTC GAAGCCCTGG TCAACGTCCT

951   GCCGTTTGCC AAAGTCAAAA ACCTGACAAA GGCGGCAAAA CCGGGGAAGG

1001   CTGCGGTTAG TGGGGATTTT TCTAAATCCT ACACCTGCTC CTTCCACGGC

1051   AGCACCTTGG TCAAAACGGC AGACGGCTAC AAAGCCATTG CCCATATTCA

1101   AGCCGGAGAC CGCGTCCTTT CCAAGGACGA GGCAAGCGGA GAAACGGGAT

1151   ACAAACCCGT TACCGCCCGA TACGGCAATC CGTATCAAGA AACCGTTTAC
```

-continued

```
1201  ATTGAAGTTT CAGACGGCAT CGGCAACAGC CAAACCCTGA TTTCCAACCG
1251  CATCCACCCG TTTTATTCGG ACGGCAAATG GATTAAGGCG GAAGATTTAA
1301  AAGCGGGAAG CCGGCTGTTA TCCGAAAGCG GCAAAACCCA AACCGTCCGC
1351  AACATCGTTG TCAAACCAAA ACCGCTCAAA GCCTACAATC TGACCGTTGC
1401  CGATTGGCAT ACCTACTTCG TCAAGGGTAA TCAGGCGGAA ACGGAAGGGG
1451  TTTGGGTTCA TAATGATTGT CCGCCTAAAC CAAAACCAAC CAATCATGCC
1501  CAACAAAGAA AAGAAGAAGC TAAAAACGAT TCTCATCGAA GTGTGGGAGA
1551  TTCCAATCGT GTCGTTCGCG AAGGAAAGCA ATATTTAGAT TCCGACACAG
1601  GAAACCATGT TTATGTAAAA GGAGATAAAG TGGTTATTCT AACTCCTGAT
1651  GGAAGACAGG TAACTCAATT TAAGAACTCG AAAGCCAATA CGTCAAAAAG
1701  GGTAAAAAAT GGGAAATGGA CACCAAAATA A
```

This corresponds to the amino acid sequence <SEQ ID 2470; ORF 730.ng>:

```
g730.pep
    1  VKPLRRLTNL LAACAVAAVA LIQPALAADL AQDPFITDNT QRQHYEPGGK
   51  YHLFGDPRGS VSDRTGKINV IQDYTHQMGN LLIQQAAIQG NLGYTVRFSG
  101  HGHEEHAPFD NHAADSASEE KGNVDDGFTV YRLNWEGHEH HPADAYDGPK
  151  GGNYPKPTGA RDEYTYHVNG TARSIKLNPT DTRSIRQRIF DNYNNLGSNF
  201  SDRADEANRK MFEHNAKLDR WGNSMEFVNG VAAGALNPFI SAGEALGIGD
  251  ILYGTRYAID KAAMRNIAPL PAEGKFAAIG GLGSAAGFEK NTREAVDRWI
  301  QENPNAAETV EALVNVLPFA KVKNLTKAAK PGKAAVSGDF SKSYTCSFHG
  351  STLVKTADGY KAIAHIQAGD RVLSKDEASG ETGYKPVTAR YGNPYQETVY
  401  IEVSDGIGNS QTLISNRIHP FYSDGKWIKA EDLKAGSRLL SESGKTQTVR
  451  NIVVKPKPLK AYNLTVADWH TYFVKGNQAE TEGVWVHNDC PPKPKPTNHA
  501  QQRKEEAKND SHRSVGDSNR VVREGKQYLD SDTGNHVYVK GDKVVILTPD
  551  GRQVTQFKNS KANTSKRVKN GKWTPK*
```

The following partial DNA sequence was identified in *N. meningitidis* <SEQ ID 2471>:

```
m730.seq
    1  GTGAAACCGC TGCGCAGACT GACAAACCTC CTTGCCGCCT GCGCCGTAGC
   51  GGCGGCCGCA CTCATACAGC CCGCCCTCGC GGCGGACTTG GCGCAAGACC
  101  CGTTCATTAC CGATAACGCC CAACGGCAGC ACTACGAACC CGGCGGCAAA
  151  TACCACCTCT TCGGCGACCC GCGCGGCAGC GTTTCCGACC GCACCGGCAA
  201  AATCAACGTC ATCCAAGACT ATACCCACCA GATGGGCAAC CTGCTCATCC
  251  AACAGGCAAA CATCAACGGC ACAATCGGCT ACCACACCCG CTTTTCCGGA
  301  CACGGACACG AAGAACACGC CCCCTTCGAC AACCACGCCG CCGACAGCGC
  351  GAGCGAAGAA AAAGGCAACG TTGACGAAGG CTTTACCGTA TACCGGCTCA
  401  ACTGGGAAGG ACACGAACAT CATCCCGCCG ATGCCTACGA CGGCCCGAAG
  451  GGCGGCAATT ACCCCAAACC TACGGGCGCA CGAGACGAAT ACACCTATCA
  501  CGTCAACGGC ACAGCCCGCA GTATCAAACT CAATCCGACC GACACCCGCA
```

-continued

```
 551  GCATCCGGCA ACGCATATCC GACAATTACA GCAACCTCGG CAGCAATTTC
 601  TCCGACCGCG CCGATGAAGC CAACAGAAAA ATGTTCGAGC ACAATGCCAA
 651  GCTCGACCGC TGGGGCAACA GCATGGAGTT TATCAACGGC GTCGCCGCCG
 701  GCGCGCTCAA CCCCTTTATC AGCGCGGGCG AAGCCTTGGG CATAGGCGAC
 751  ATACTGTACG GAACGCGCTA TGCCATAGAC AAAGCCGCAA TGCGCAACAT
 801  CGCCCCCTTG CCCGCCGAGG GCAAATTCGC CGTCATCGGC GGCTTGGGCA
 851  GCGTGGCGGG CTTTGAAAAG AATACGCGCG AAGCCGTTGA CCGGTGGATA
 901  CAGGAAAATC CCAATGCCGC CGAAACCGTC GAAGCCGTCT TCAACGTTGC
 951  CGCAGCAGCC AAAGTCGCGA AGTTGGCAAA GGCGGCAAAA CCAGGGAAGG
1001  CTGCGGTTAG CGGGGATTTT GCTGATTCTT ATAAAAAGAA ATTGGCTTTG
1051  TCTGATAGTG CGAGACAGTT ATATCAAAAT GCAAAGTATA GAGAAGCTCT
1101  AGATATACAT TATGAAGATT TAATTAGAAG AAAAACTGAT GGTTCATCAA
1151  AATTTATTAA CGGCAGAGAA ATTGACGCTG TTACGAATGA TGCTTTAATA
1201  CAAGCCAAAA GAACAATTTC AGCAATAGAT AAACCTAAAA ATTTCTTAAA
1251  TCAAAAAAAT AGAAAGCAAA TTAAAGCAAC CATCGAAGCA GCAAACCAAC
1301  AGGGAAAACG TGCAGAATTT TGGTTTAAAT ACGGTGTTCA TTCACAAGTT
1351  AAGTCATATA TTGAATCAAA AGGCGGCATT GTTAAAACAG GTTTAGGAGA
1401  TTAA
```

This corresponds to the amino acid sequence <SEQ ID 2472; ORF 730>:

```
m730.pep
   1  VKPLRRLTNL LAACAVAAAA LIQPALAADL AQDPFITDNA QRQHYEPGGK
  51  YHLFGDPRGS VSDRTGKINV IQDYTHQMGN LLIQQANING TIGYHTRFSG
 101  HGHEEHAPFD NHAADSASEE KGNVDEGFTV YRLNWEGHEH HPADAYDGPK
 151  GGNYPKPTGA RDEYTYHVNG TARSIKLNPT DTRSIRQRIS DNYSNLGSNF
 201  SDRADEANRK MFEHNAKLDR WGNSMEFING VAAGALNPFI SAGEALGIGD
 251  ILYGTRYAID KAAMRNIAPL PAEGKFAVIG GLGSVAGFEK NTREAVDRWI
 301  QENPNAAETV EAVFNVAAAA KVAKLAKAAK PGKAAVSGDF ADSYKKKLAL
 351  SDSARQLYQN AKYREALDIH YEDLIRRKTD GSSKFINGRE IDAVTNDALI
 401  QAKRTISAID KPKNFLNQKN RKQIKATIEA ANQQGKRAEF WFKYGVHSQV
 451  KSYIESKGGI VKTGLGD*
``` g730/m730 93.0% identity in 344 aa overlap

```
                10         20         30         40         50         60
g730.pep  VKPLRRLTNLLAACAVAAVALIQPALAADLAQDPFITDNTQRQHYEPGGKYHLFGDPRGS
          ||||||||||||||||||| ||||||||||||||||||:||||||||||||||||||||
m730      VKPLRRLTNLLAACAVAAAALIQPALAADLAQDPFITDNAQRQHYEPGGKYHLFGDPRGS
                10         20         30         40         50         60

70         80         90        100        110        120
g730.pep  VSDRTGKINVIQDYTHQMGNLLIQQAAIQGNLGYTVRFSGHGHEEHAPFDNHAADSASEE
          ||||||||||||||||||||||||||:|:::||:|||||||||||||||||||||||||
m730      VSDRTGKINVIQDYTHQMGNLLIQQANINGTIGYHTRFSGHGHEEHAPFDNHAADSASEE
                70         80         90        100        110        120
```

-continued

```
                130        140        150        160        170        180
g730.pep  KGNVDDGFTVYRLNWEGHEHHPADAYDGPKGGNYPKPTGARDEYTYHVNGTARSIKLNPT
          |||||:||||||||||||||||||||||||||||||||||||||||||||||||||||||
m730      KGNVDEGFTVYRLNWEGHEHHPADAYDGPKGGNYPKPTGARDEYTYHVNGTARSIKLNPT
                130        140        150        160        170        180

190        200        210        220        230        240
g730.pep  DTRSIRQRIFDNYNNLGSNFSDRADEANRKMFEHNAKLDRWGNSMEFVNGVAAGALNPFI
          ||||||||| |||:|||||||||||||||||||||||||||||||||:||||||||||||
m730      DTRSIRQRISDNYSNLGSNFSDRADEANRKMFEHNAKLDRWGNSMEFINGVAAGALNPFI
                190        200        210        220        230        240

250        260        270        280        290        300
g730.pep  SAGEALGIGDILYGTRYAIDKAAMRNIAPLPAEGKFAAIGGLGSAAGFEKNTREAVDRWI
          |||||||||||||||||||||||||||||||||||||:||||||:|||||||||||||||
m730      SAGEALGIGDILYGTRYAIDKAAMRNIAPLPAEGKFAVIGGLGSVAGFEKNTREAVDRWI
                250        260        270        280        290        300

310        320        330        340        350        360
g730.pep  QENPNAAETVEALVNVLPFAKVKNLTKAAKPGKAAVSGDFSKSYTCSFHGSTLVKTADGY
          ||||||||||||: ||   ||| :|:||||||||||||||: ||
m730      QENPNAAETVEAVFNVAAAAKVAKLAKAAKPGKAAVSGDFADSYKKKLALSDSARQLYQN
                310        320        330        340        350        360

370        380        390        400        410        420
g730.pep  LAIAHIQAGDRVLSKDEASGETGYKPVTARYGNPYQETVYIEVSDGIGNSQTLISNRIHP m730      AKYREALDIHYEDLIRRKTDGSSKFINGREIDAVTNDALIQAKRTISAIDKPKNFLNQKN
                370        380        390        400        410        420
```

The following partial DNA sequence was identified in *N. meningitidis* <SEQ ID 2473>:

```
a730.seq
     1  GTGAAACCGC TGCGAAGACT CATCAAGCTC CTTGCCGCCT GTGCCGTAGC

51  GGCGGCCGCA CTCATACAGC CCGCCCTCGC GGCGGACTTG GCGCAAGACC

101  CGTTCATTAC CGATAACGCC CAACGGCAGC ACTACGAACC CGGAGGCAAA

151  TACCACCTCT TCGGCGACCC GCGCGGCAGC GTCTCCGACC GCACCGGTCA

201  AATCAACGTC ATCCAAGACT ATACCCACCG GATGGGCAAC CTGCTCATCC

251  AGCAGGCAAA CATCAACGGC ACAATCGGCT ACCACACCCG CTTTTCCGGA

301  CACGGATACG AAGAACACGC CCCCTTCGAC AACCACGCCG CCGACAGCGC

351  GAGCGAAGAA AAAGGCAACG TTGACGAAGG CTTTACCGTA TACCGGCTCA

401  ACTGGGAAGG ACACGAACAT CATCCCGCCG ATGCCTACGA CGGCCCGAAG

451  GGCGGCAATT ACCCCAAACC TACGGGTGCA CGCGACGAAT ACACCTATCA

501  CGTCAACGGC ACAGCACGCA GCATCAAACT CAATCCGACC GACACCCGCA

551  GCATCCGGCA ACGCATATCC GACAATTACA GCAACCTCGG CAGCAATTTC

601  TCCGACCGCG CCGATGAAGC CAACAGAAAA ATGTTCGAGC ACAATGCCAA

651  GCTCGACCGC TGGGGCAACA GCATGGAGTT TATCAACGGC GTCGCCGCCG

701  GCGCGCTCAA CCCCTTTATC AGCGCGGGCG AAGCCTTGGG CATAGGCGAC

751  ATACTGTACG GAACGCGCTA TGCCATAGAC AAAGCCGCAA TGCGCAACAT

801  CGCCCCCTTG CCCGCCGAGG GCAAATTCGC CGTCATCGGC GGCTTGGGCA

851  GCGTGGCGGG CTTTGAAAAA AATACGCGCG AAGCCGTTGA CCGGTGGATA

901  CAGGAAAACC CCAATGCCGC CGAAACCGTC GAAGCCCTGG TCAACGTCCT

951  GCCGTTTGCC AAAGTCAAAA ACCTGACAAA GGCGGCAAAA CCGGGGAAGG

1001  CTGCGGTTAG CGGGGATTTT TCTGCTGCAT ACAATACAAG AACAACTAGA

1051  AAAGTTACTA CAGAAACAGA GGGGTTAAAT AGAATCAGAC AGAACCAGAA

1101  AAATAGTAAT ATACATGAGA AAAATTATGG AAGAGATAAT CCTAATCATA

1151  TTAATGTTTT ATCTGGAAAT TCTATACAAC ATATACTGTA TGGAGATGAA
```

-continued

```
1201  GCAGGAGGTG GGCATCTTTT TCCTGGCAAA CCTGGTAAGA CAACATTCCC

1251  CCAACATTGG TCAGCCAGTA AAATAACTCA TGAAATTAGT GATATCGTTA

1301  CATCCCCAAA AACGCAATGG TATGCACAGA CTGGAACAGG CGGCAAATAT

1351  ATTGCTAAAG GAAGACCAGC TAGGTGGGTA TCATATGAAA CGAGAGATGG

1401  AATTCGTATC AGAACAGTTT ATGAACCTGC AACAGGAAAA GTGGTAACTG

1451  CATTCCCCGA TAGAACCTCT AATCCCAAAT ATAACCCTGT AAAATAA
```

This corresponds to the amino acid sequence <SEQ ID 2474; ORF 730.a>:

```
a730.pep
    1  VKPLRRLIKL LAACAVAAAA LIQPALAADL AQDPFITDNA QRQHYEPGGK

51  YHLFGDPRGS VSDRTGQINV IQDYTHRMGN LLIQQANING TIGYHTRFSG

101  HGYEEHAPFD NHAADSASEE KGNVDEGFTV YRLNWEGHEH HPADAYDGPK

151  GGNYPKPTGA RDEYTYHVNG TARSIKLNPT DTRSIRQRIS DNYSNLGSNF

201  SDRADEANRK MFEHNAKLDR WGNSMEFING VAAGALNPFI SAGEALGIGD

251  ILYGTRYAID KAAMRNIAPL PAEGKFAVIG GLGSVAGFEK NTREAVDRWI

301  QENPNAAETV EALVNVLPFA KVKNLTKAAK PGKAAVSGDF SAAYNTRTTR

351  KVTTETEGLN RIRQNQKNSN IHEKNYGRDN PNHINVLSGN SIQHILYGDE

401  AGGGHLFPGK PGKTTFPQHW SASKITHEIS DIVTSPKTQW YAQTGTGGKY

451  IAKGRPARWV SYETRDGIRI RTVYEPATGK VVTAFPDRTS NPKYNPVK*
``` a730/m730 88.6% identity in 376 aa overlap

```
                 10         20         30         40         50         60
    a730.pep  VKPLRRLIKLLAACAVAAAALIQPALAADLAQDPFITDNAQRQHYEPGGKYHLFGDPRGS
              ||||||:|||||||||||||||||||||||||||||||||||||||||||||||||||||
    m730      VKPLRRLTNLLAACAVAAAALIQPALAADLAQDPFITDNAQRQHYEPGGKYHLFGDPRGS
                 10         20         30         40         50         60

70         80         90        100        110        120
    a730.pep  VSDRTGQINVIQDYTHRMGNLLIQQANINGTIGYHTRFSGHGYEEHAPFDNHAADSASEE
              ||||||:|||||||||:|||||||||||||||||||||||||:|||||||||||||||||
    m730      VSDRTGKINVIQDYTHQMGNLLIQQANINGTIGYHTRFSGHGHEEHAPFDNHAADSASEE
                 70         80         90        100        110        120

130        140        150        160        170        180
    a730.pep  KGNVDEGFTVYRLNWEGHEHHPADAYDGPKGGNYPKPTGARDEYTYHVNGTARSIKLNPT
              ||||||||||||||||||||||||||||||||||||||||||||||||||||||||||||
    m730      KGNVDEGFTVYRLNWEGHEHHPADAYDGPKGGNYPKPTGARDEYTYHVNGTARSIKLNPT
                130        140        150        160        170        180

190        200        210        220        230        240
    a730.pep  DTRSIRQRISDNYSNLGSNFSDRADEANRKMFEHNAKLDRWGNSMEFINGVAAGALNPFI
              ||||||||||||||||||||||||||||||||||||||||||||||||||||||||||||
    m730      DTRSIRQRISDNYSNLGSNFSDRADEANRKMFEHNAKLDRWGNSMEFINGVAAGALNPFI
                190        200        210        220        230        240

250        260        270        280        290        300
    a730.pep  SAGEALGIGDILYGTRYAIDKAAMRNIAPLPAEGKFAVIGGLGSVAGFEKNTREAVDRWI
              ||||||||||||||||||||||||||||||||||||||||||||||||||||||||||||
    m730      SAGEALGIGDILYGTRYAIDKAAMRNIAPLPAEGKFAVIGGLGSVAGFEKNTREAVDRWI
                250        260        270        280        290        300

310        320        330        340        350        360
    a730.pep  QENPNAAETVEALVNVLPFAKVKNLTKAAKPGKAAVSGDFSAAYNTRTTRKVTTETEGLN
              ||||||||||||:  ||   |||  :|:|||||||||||||:  :|     :|  : :::
    m730      QENPNAAETVEAVFNVAAAAKVAKLAKAAKPGKAAVSGDFADSY-----KKKLALSDSAR
                310        320        330        340             350

370        380        390        400        410        420
    a730.pep  RIRQNQKNSNIHEKNYGRDNPNHINVLSGNSIQHILYGDEAGGGHLFPGKPGKTTFPQHW
              ::  |||   |   :   :  :|
    m730      QLYQNAKYREALDIHYEDLIRRKTDGSSKFINGREIDAVTNDALIQAKRTISAIDKPKNF
                360        370        380        390        400        410
```

The following partial DNA sequence was identified in *N. gonorrhoeae* <SEQ ID 2475>:

```
g731.seq
     1  gattttcgag cgttttcatG CGAGAACGGT TTGTCTGTGC GCGTCCGCAA

51  TTTGGACGGC GGCAAAATCG CGTTGCGGCT GGACGGCAGG CGTGCCGTCC

101  TCTCTTCCGA CGTTGCCGCA TCCGGCGAAC GCTATACCGC CGAACACGGT

151  TTGTTCGGAA ACGGAACCGA GTGGCACCAG AAAGGCGGCG AAGCCTTTTT

201  CGGCTTTACC GATGCCTACG GCAATTCGGT CGAAACTTCC TGCCGCGCCC

251  GTTAA
```

This corresponds to the amino acid sequence <SEQ ID 2476; ORF 731.ng>:

```
g731.pep
     1  DFRAFSCENG LSVRVRNLDG GKIALRLDGR RAVLSSDVAA SGERYTAEHG

51  LFGNGTEWHQ KGGEAFFGFT DAYGNSVETS CRAR*
```

The following partial DNA sequence was identified in *N. meningitidis* <SEQ ID 2477>:

```
m731.seq
     1  ATGAATATCA GGTTTTTCGC GCTGACCGTA CCGGTTTTGT CTTTGGCGGC

51  CTGTGCCGTG CCGGAGGCGT ATGATGACGG CGGACGCGGG CATATGCCGC

101  CCGTTCAAAA CCAAGCCGGC ACGGACGATT TCGGGCGTT TTCCTGCGAG

151  AACGGTTTGT CTGTGCGCGT CCGCCATTTG GACAGCGGCA AAGTCGCGTT

201  GCGGCTGGAC GGCAGGCGTG CCGTCCTCTC TTCCGACGTT GCCGCATCCG

251  GCGAACGCTA TACCGCCGAA CACGGTTTGT TCGGAAACGC AACCGAGTGG

301  CACCAGAAAG GCGGCGAAGC CTTTTTCGGC TTTACCGATG CCTACGGCAA

351  TTCGGTCGAA ACTTCCTGCC GCGCCCGTTA A
```

This corresponds to the amino acid sequence <SEQ ID 2478; ORF 731>:

```
m731.pep
     1  MNIRFFALTV PVLSLAACAV PEAYDDGGRG HMPPVQNQAG TDDFRAFSCE

51  NGLSVRVRHL DSGKVALRLD GRRAVLSSDV AASGERYTAE HGLFGNATEW

101  HQKGGEAFFG FTDAYGNSVE TSCRAR*
``` g731/m731 95.2% identity in 84 aa overlap

```
                           10        20        30
g731.pep                   DFRAFSCENGLSVRVRNLDGGKIALRLDGR
                           ||||||||||||||||:||:||:||||||
m731     LSLAACAVPEAYDDGGRGHMPPVQNQAGTDDFRAFSCENGLSVRVRHLDSGKVALRLDGR
              20        30        40        50        60        70

40        50        60        70        80
g731.pep RAVLSSDVAASGERYTAEHGLFGNGTEWHQKGGEAFFGFTDAYGNSVETSCRARX
         |||||||||||||||||||||||:||||||||||||||||||||||||||||||
m731     RAVLSSDVAASGERYTAEHGLFGNATEWHQKGGEAFFGFTDAYGNSVETSCRARX
              80        90       100       110       120
```

The following partial DNA sequence was identified in *N. meningitidis* <SEQ ID 2479>:

```
a731.seq
    1   ATGAATATCA GGTTTTTCGC GCTGACCGTA CCGGTTTTGT CTTTGGCGGC

51   CTGTGCCGTG CCGGAGGCGT ATGATGACGG CGGACGAGGG CATATGCCGC

101   CCGTTCAAAA CCAAGCCGGC ACGGCAGATT TCGGGCATT TTCCTGCGAG

151   AACGGTTTGT CTGTGCACGT CCGCCGTTTG GACGGCGGCA GAATCGCGTT

201   GCGGTTGGAC GGCAGGCGTG CCGTCCTCTC TTCCGACGTT GCCGCATCCG

251   GCGAACGCTA TACCGCCGAA CACGGTTTGT TCGGAAACGG AACCGAGTGG

301   CATCAGAAAG GCGGCGAAGC CTTTTTCGGC TTTACCGATG CCTACGGCAA

351   TTCGGTCGAA ACCTCCTGCC GCGAACGCTA A
```

This corresponds to the amino acid sequence <SEQ ID 2480; ORF 731.a>:

```
a731.pep
    1   MNIRFFALTV PVLSLAACAV PEAYDDGGRG HMPPVQNQAG TADFRAFSCE

51   NGLSVHVRRL DGGRIALRLD GRRAVLSSDV AASGERYTAE HGLFGNGTEW

101   HQKGGEAFFG FTDAYGNSVE TSCRAR*
``` a731/m731 94.4% identity in 126 aa overlap

```
                  10         20         30         40         50         60
a731.pep  MNIRFFALTVPVLSLAACAVPEAYDDGGRGHMPPVQNQAGTADFRAFSCENGLSVHVRRL
          ||||||||||||||||||||||||||||||||||||||||  ||||||||||||:||:|
m731      MNIRFFALTVPVLSLAACAVPEAYDDGGRGHMPPVQNQAGTDDFRAFSCENGLSVRVRHL
                  10         20         30         40         50         60

70         80         90        100        110        120
a731.pep  DGGRIALRLDGRRAVLSSDVAASGERYTAEHGLFGNGTEWHQKGGEAFFGFTDAYGNSVE
          |:|::|||||||||||||||||||||||||||||:|||||||||||||||||||||||||
m731      DSGKVALRLDGRRAVLSSDVAASGERYTAEHGLFGNATEWHQKGGEAFFGFTDAYGNSVE
                  70         80         90        100        110        120 a731.pep  TSCRARX
          |||||||
m731      TSCRARX
```

The following partial DNA sequence was identified in *N. gonorrhoeae* <SEQ ID 2481>:

```
g732.seq
    1   ATGTCGAAAC CTGTTTTTAA GAAAATCGCA CTTTATACTT TGGGTGCAAT

51   CAGCGGCGTG GCCGTAAGTC TGGCGGTGCA GGGTTTTGCC GCCGagaagg

101   ACGGgcgGGA TAACGAagtC CTGCCGGTGC AATCCATCCG TACGATGGCG

151   GAGGTTTACG GTCAGATTAA GGCAAACTAC TATCATGACA AACCCGATGC

201   CGATTTGTTT GAAGGTGCGA TGAAGGGTAT GGTGGCCGGT TTGGATCCGC

251   ATTCCGAATA TATGGATAAA AAAGGTTATG CCGAGATAAA GGAGTCCACC

301   AGCGGCGAAT TTGGCGGCTT GGGGATGGAA ATCGGGCAGG AAGACGGTTT

351   TGTCAAAGTG GTTTCGCCGA TTGAGGACAC GCCTGCCGAA CGGGCGGAGG

401   TGAAAAGCGG CGATTTCATT GTGAAAATCG ATAATGTTTC GACGCGCGGT

451   ATGACGGTCA GCGAAGCGGT GAAAAAATG CGGGGCAAGC CGGGTACGAA

501   GATTACTTTG ACGTTGTCGC GCAAAAATGC CGACAAGCCG ATAGTCGTCA

551   ACCTGACCCG TGCCATTATT AAAGTGAAAA GCGTCCGCCA TCACCTGATC

601   GAACCCGATT ACGGCTATAT CCGCGTGTCG CAGTTCCAAG AGCGGACGGT
```

```
-continued
 651 CGAAAGCGTC AATACCGCCG CAAAAGAGCT GGTAAAGGAA AATAAAGGAA

701 AACCGCTCAA GGGGCTGGTG TTGGATTTGC GCGACGACCC CGGCGGGCTT

751 TTGACCGGCG CGGTCGGCGT GTCGGCGGCG TTTCTGCCGT CTGAAGCGGT

801 CGTCGTCAGC ACCAAGGGAC GCGACGGCAA AGACGGCATG GTACTGAAAG

851 CCGTTCCCGA GGATTATGTG TACGGTATGG GCGGCGACCC TTTGGCGGGT

901 ATTCCTGCCG AGTTGAAAAC GATTCCGATG ACGgtaTTGG TcaaTTCCGG

951 TTCggcttCC GCGTCGGAGA TTGtcgCCGG CGCATTGCAG GACCACAAAC

1001 GCGCGGTCAT CGTCGGTACG CAGAGCTTCG GTAAAGGTTC GGTTCAGACT

1051 TTGATTCCTT TGTCCAACGG CAGCGCGGTC AAGTTGACGA CCGCCCTGTA

1101 TTACACGCCG AACGACCGTT CCATTCAGGC ACAGGGGATT GTTCCCGATG

1151 TCgaaGTAAA AGATAAGGAA CGTACTTTTG AAAGCCGCGA GGCGGACCTG

1201 GTCGGACACA TCGGCAATCC CTTgggcGGC GAGGATGTGA ACAGTGAAAC

1251 CCttgcCGTA CCGCTTGAAA AGATGCGGA TAAGCCCGCT GCAAAAGAAA

1301 AAGGTAAAAA GAAAAAGGAC GAGGATTTGT CTTCAAGGCG GATTCCGAAC

1351 CCTGCGAAAG ACGATCAGTT GCGTAAGGCT TTGGATTTGG TCAAGTCGCC

1401 CGAGCAGTGG CAGAAGTCTT TGGGGCTGGC GGCGAAAAAA CCGGTTTCAA

1451 ATAAAGATAA AAAGATAAG AAGTAG
```

This corresponds to the amino acid sequence <SEQ ID 2482; ORF 732>:

```
g732.pep
   1 MSKPVFKKIA LYTLGAISGV AVSLAVQGFA AEKDGRDNEV LPVQSIRTMA

51 EVYGQIKANY YHDKPDADLF EGAMKGMVAG LDPHSEYMDK KGYAEIKEST

101 SGEFGGLGME IGQEDGFVKV VSPIEDTPAE RAEVKSGDFI VKIDNVSTRG

151 MTVSEAVKKM RGKPGTKITL TLSRKNADKP IVVNLTRAII KVKSVRHHLI

201 EPDYGYIRVS QFQERTVESV NTAAKELVKE NKGKPLKGLV LDLRDDPGGL

251 LTGAVGVSAA FLPSEAVVVS TKGRDGKDGM VLKAVPEDYV YGMGGDPLAG

301 IPAELKTIPM TVLVNSGSAS ASEIVAGALQ DHKRAVIVGT QSFGKGSVQT

351 LIPLSNGSAV KLTTALYYTP NDRSIQAQGI VPDVEVKDKE RTFESREADL

401 VGHIGNPLGG EDVNSETLAV PLEKDADKPA AKEKGKKKKD EDLSSRRIPN

451 PAKDDQLRKA LDLVKSPEQW QKSLGLAAKK PVSNKDKKDK K*
                                                    50
```

The following partial DNA sequence was identified in N. meningitidis <SEQ ID 2483>:

```
m732.seq
   1 ATGTCGAAAC CTGTTTTTAA GAAAATCGCA CTTTATACTT TGGGTGCAAT

51 CAGCGGCGTG GCCGTCAGTC TGGCGGTGCA GGGTTTTGCC GCCGAGAAGG

101 ACAGGCGGGA TAACGAAGTC CTGCCGGTGC AATCCATCCG CACAATGGCG

151 GAGGTTTACG GTCAAATCAA GGCAAACTAC TATCAGGACA AACCCGATGC

201 CGATTTGTTT GAAGGTGCGA TGAAGGGTAT GGTGGCCGGT TTGGATCCGC
```

-continued

```
 251   ATTCCGAATA TATGGATAAA AAAGGTTATG CCGAGATAAA GGAGTCCACC
 301   AGCGGCGAAT TTGGCGGCTT GGGGATGGAA ATCGGGCAGG AAGACGGATT
 351   TGTCAAAGTG GTTTCGCCGA TTGAGGACAC GCCTGCGGAA CGGGCGGGGG
 401   TGAAAAGCGG CGATTTCATT GTGAAAATCG ATAATGTTTC GACACGCGGC
 451   ATGACGGTCA GCGAAGCGGT GAAGAAAATG CGGGGCAAGC CGGGTACGAA
 501   GATTACTTTG ACGCTGTCGC GCAAAAATGC CGACAAGCCG ATAGTCGTCA
 551   ACCTGACCCG TGCCATTATT AAAGTGAAAA GCGTCCGCCA TCACCTGATC
 601   GAACCCGATT ACGGCTATAT CCGCGTGTCG CAGTTCCAAG AGCGGACGGT
 651   CGAAAGCGTC AATACCGCCG CAAAAGAGCT GGTAAAGGAA AATAAAGGAA
 701   AACCGCTCAA GGGGCTGGTG TTGGATTTGC GCGACGACCC CGGCGGGCTT
 751   TTGACTGGCG CGGTCGGCGT GTCGGCGGCA TTTCTGCCGT CTGAAGCAGT
 801   CGTCGTCAGC ACCAAGGGAC GCGACGGCAA AGACCGCATG GTACTGAAAG
 851   CCATTCCTGA AGATTATGTG TACGGGATGG GCGGCGATTC GTTGGCGGGC
 901   ATTCCTGCCG AGTTGAAAAC CATACCGATG ACGGTATTGG TCAATTCCGG
 951   TTCGGCTTCC GCGTCGGAGA TTGTCGCAGG TGCATTGCAG GATCATAAAC
1001   GCGCGGTCAT CGTCGGTACG CAGAGCTTCG GCAAAGGTTC GGTTCAGACT
1051   TTGATTCCTT TGTCCAACGG CAGCGCGGTC AAGCTGACAA CGGCACTGTA
1101   TTATACGCCG AACGACCGTT CTATTCAGGC GCAGGGGATT GTTCCCGATG
1151   TCGAAGTAAA AGATAAGGAA CGCATTTTTG AAAGCCGCGA GGCGGATTTG
1201   GTCGGACACA TCGGCAATCC CTTGGGCGGC GAGGATGTGA ACGGTGAAAC
1251   CCTTGCCGTG CCGCTTGAAA AGATGCGGA TAAGCCCGCT GTAAAAGAAA
1301   AAGGTAAAAA GAAAAAGGAC GAGGATTTGT CTTCAAGGCG GATTCCCAAC
1351   CCTGCCAAAG ACGACCAGTT GCGGAAAGCT TTGGATTTAG TCAAGTCGCC
1401   CGAGCAGTGG CAGAAGTCTT TGGGGCTGGC GGCGAAAAAG CCGGTTTCAA
1451   ATAAAGATAA GAAAGATAAA AAGATAAGA AGTAG
```

This corresponds to the amino acid sequence <SEQ ID 2484; ORF 732>:

```
m732.pep
    1   MSKPVFKKIA LYTLGAISGV AVSLAVQGFA AEKDRRDNEV LPVQSIRTMA

51   EVYGQIKANY YQDKPDADLF EGAMKGMVAG LDPHSEYMDK KGYAEIKEST

101   SGEFGGLGME IGQEDGFVKV SPIEDTPAE RAGVKSGDFI VKIDNVSTRG

151   MTVSEAVKKM RGKPGTKITL TLSRKNADKP IVVNLTRAII KVKSVRHHLI

201   EPDYGYIRVS QFQERTVESV NTAAKELVKE NKGKPLKGLV LDLRDDPGGL

251   LTGAVGVSAA FLPSEAVVVS TKGRDGKDRM VLKAIPEDYV YGMGGDSLAG

301   IPAELKTIPM TVLVNSGSAS ASEIVAGALQ DHKRAVIVGT QSFGKGSVQT

351   LIPLSNGSAV KLTTALYYTP NDRSIQAQGI VPDVEVKDKE RIFESREADL

401   VGHIGNPLGG EDVNGETLAV PLEKDADKPA VKEKGKKKKD EDLSSRRIPN

451   PAKDDQLRKA LDLVKSPEQW QKSLGLAAKK PVSNKDKKDK KDKK*
```

Computer analysis of the amino acid sequences gave the following results:
Homology with a Predicted ORF from N. meningitidis menA with menB
ORF 732 shows 98.2% identity over a 491 as overlap with a predicted ORF (ORF732.a) from N. gonorrhoeae:
m732/g732 98.2% identity in 491 aa overlap

```
                   10        20        30        40        50        60
    m732.pep  MSKPVFKKIALYTLGAISGVAVSLAVQGFAAEKDRRDNEVLPVQSIRTMAEVYGQIKANY
              ||||||||||||||||||||||||||||||||| ||||||||||||||||||||||||||
    g732      MSKPVFKKIALYTLGAISGVAVSLAVQGFAAEKDGRDNEVLPVQSIRTMAEVYGQIKANY
                   10        20        30        40        50        60

70        80        90       100       110       120
    m732.pep  YQDKPDADLFEGAMKGMVAGLDPHSEYMDKKGYAEIKESTSGEFGGLGMEIGQEDGFVKV
              |:||||||||||||||||||||||||||||||||||||||||||||||||||||||||||
    g732      YHDKPDADLFEGAMKGMVAGLDPHSEYMDKKGYAEIKESTSGEFGGLGMEIGQEDGFVKV
                   70        80        90       100       110       120

130       140       150       160       170       180
    m732.pep  VSPIEDTPAERAGVKSGDFIVKIDNVSTRGMTVSEAVKKMRGKPGTKITLTLSRKNADKP
              |||||||||||| ||||||||||||||||||||||||||||||||||||||||||||||
    g732      VSPIEDTPAERAEVKSGDFIVKIDNVSTRGMTVSEAVKKMRGKPGTKITLTLSRKNADKP
                  130       140       150       160       170       180

190       200       210       220       230       240
    m732.pep  IVVNLTRAIIKVKSVRHHLIEPDYGYIRVSQFQERTVESVNTAAKELVKENKGKPLKGLV
              ||||||||||||||||||||||||||||||||||||||||||||||||||||||||||||
    g732      IVVNLTRAIIKVKSVRHHLIEPDYGYIRVSQFQERTVESVNTAAKELVKENKGKPLKGLV
                  190       200       210       220       230       240

250       260       270       280       290       300
    m732.pep  LDLRDDPGGLLTGAVGVSAAFLPSEAVVVSTKGRDGKDRMVLKAIPEDYVYGMGGDSLAG
              |||||||||||||||||||||||||||||||||||||| |||||:|||||||||||| ||
    g732      LDLRDDPGGLLTGAVGVSAAFLPSEAVVVSTKGRDGKDGMVLKAVPEDYVYGMGGDPLAG
                  250       260       270       280       290       300

310       320       330       340       350       360
    m732.pep  IPAELKTIPMTVLVNSGSASASEIVAGALQDHKRAVIVGTQSFGKFSVQTLIPLSNGSAV
              ||||||||||||||||||||||||||||||||||||||||||||||||||||||||||||
    g732      IPAELKTIPMTVLVNSGSASASEIVAGALQDHKRAVIVGTQSFGKFSVQTLIPLSNGSAV
                  310       320       330       340       350       360

370       380       390       400       410       420
    m732.pep  KLTTALYYTPNDRSIQAQGIVPDVEVKDKERIFESREADLVGHIGNPLGGEDVNGETLAV
              |||||||||||||||||||||||||||||||| |||||||||||||||||||||:||||
    g732      KLTTALYYTPNDRSIQAQGIVPDVEVKDKERTFESREADLVGHIGNPLGGEDVNSETLAV
                  370       380       390       400       410       420

430       440       450       460       470       480
    m732.pep  PLEKDADKPAVKEKGKKKKDEDLSSRRIPNPAKDDQLRKALDLVKSPEQWQKSLGLAAKK
              |||||||||:||||||||||||||||||||||||||||||||||||||||||||||||||
    g732      PLEKDADKPAAKEKGKKKKDEDLSSRRIPNPAKDDQLRKALDLVKSPEQWQKSLGLAAKK
                  430       440       450       460       470       480

490
    m732.pep  PVSNKDKKDKKDKKX
              |||||||||||
    g732      PVSNKDKKDKKX
                  490
```

The following partial DNA sequence was identified in N. meningitidis <SEQ ID 2485>:

```
a732.seq
    1    ATGTCGAAAC CTGTTTTTAA GAAAATCGCA CTTTATACTT TGGGTGCAAT

51    CAGCGGCGTG GCCGTCAGTC TGGCGGTGCA GGGTTTTGCC GCCGAGAAGG

101    ACAGGCGGGA TAACGAAGTC CTGCCGGTGC AATCCATCCG CACAATGGCG

151    GAGGTTTACG GTCAAATCAA GGCAAACTAC TATCAGGACA AACCCGATGC

201    CGATTTGTTT GAAGGTGCGA TGAAGGGTAT GGTGGCCGGT TTGGATCCGC

251    ATTCCGAATA TATGGATAAA AAAGGTTATG CCGAGATAAA GGAGTCCACC

301    AGCGGCGAAT TTGGCGGCTT GGGGATGGAA ATCGGGCAGG AAGACGGATT

351    TGTCAAAGTG GTTTCGCCGA TTGAGGACAC GCCTGCGGAA CGGGCGGGGG

401    TGAAAAGCGG CGATTTCATT GTGAAAATCG ATAATGTTTC GACACGCGGC
```

-continued

```
 451  ATGACGGTCA GCGAAGCGGT GAAGAAAATG CGGGGCAAGC CGGGTACGAA
 501  GATTACTTTG ACGCTGTCGC GCAAAAATGC CGACAAGCCG ATAGTCGTCA
 551  ACCTGACCCG TGCCATTATT AAAGTGAAAA GCGTCCGCCA TCACCTGATC
 601  GAACCCGATT ACGGCTATAT CCGCGTGTCG CAGTTCCAAG AGCGGACGGT
 651  CGAAAGCGTC AATACCGCCG CAAAAGAGCT GGTAAAGGAA AATAAAGGAA
 701  AACCGCTCAA GGGGCTGGTG TTGGATTTGC GCGACGACCC CGGCGGGCTT
 751  TTGACTGGCG CGGTCGGCGT GTCGGCGGCA TTTCTGCCGT CTGAAGCAGT
 801  CGTCGTCAGC ACCAAGGGAC GCGACGGCAA AGACCGCATG GTACTGAAAG
 851  CCGTTCCTGA AGATTATGTG TACGGGATGG GCGGCGATTC GTTGGCGGGC
 901  ATTCCTGCCG AGTTGAAAAC CATACCGATG ACGGTATTGG TCAATTCCGG
 951  TTCGGCTTCC GCGTCGGAGA TTGTCGCAGG TGCATTGCAG ATCATAAAC
1001  GCGCGGTCAT CGTCGGTACG CAGAGCTTCG GCAAAGGTTC GGTTCAGACT
1051  TTGATTCCTT TGTCCAACGG CAGCGCGGTC AAGCTGACAA CGGCACTGTA
1101  TTATACGCCG AACGACCGTT CTATTCAGGC GCAGGGGATT GTTCCCGATG
1151  TCGAAGTAAA AGATAAGGAA CGCATTTTTG AAAGCCGCGA GGCGGATTTG
1201  GTCGGACACA TCGGCAATCC TTTGGGCGGC GAGGATGTGA ACAGTGAAAC
1251  CCTTGCCGTG CCGCTTGAAA AGATGCGGA TAAGCCCGCT GTAAAAGAAA
1301  AAGGTAAAAA GAAAAAGGAC GAGGATTTGT CTTCAAGGCG GATTCCCAAC
1351  CCTGCCAAAG ACGACCAGTT GCGGAAAGCT TTGGATTTAG TCAAGTCGCC
1401  CGAGCAGTGG CAGAAGTCTT TGGGGCTGGC GGCGAAAAAG CCGGTTTCAA
1451  ATAAAGATAA GAAAGATAAA AAGATAAGA AGTAG
```

35

This corresponds to the amino acid sequence <SEQ ID 2486; ORF 732.a>:

```
a732.pep
    1  MSKPVFKKIA LYTLGAISGV AVSLAVQGFA AEKDRRDNEV LPVQSIRTMA

51  EVYGQIKANY YQDKPDADLF EGAMKGMVAG LDPHSEYMDK KGYAEIKEST

101  SGEFGGLGME IGQEDGFVKV VSPIEDTPAE RAGVKSGDFI VKIDNVSTRG

151  MTVSEAVKKM RGKPGTKITL TLSRKNADKP IVVNLTRAII KVKSVRHHLI

201  EPDYGYIRVS QFQERTVESV NTAAKELVKE NKGKPLKGLV LDLRDDPGGL

251  LTGAVGVSAA FLPSEAVVVS TKGRDGKDRM VLKAVPEDYV YGMGGDSLAG

301  IPAELKTIPM TVLVNSGSAS ASEIVAGALQ DHKRAVIVGT QSFGKGSVQT

351  LIPLSNGSAV KLTTALYYTP NDRSIQAQGI VPDVEVKDKE RIFESREADL

401  VGHIGNPLGG EDVNSETLAV PLEKDADKPA VKEKGKKKKD EDLSSRRIPN

451  PAKDDQLRKA LDLVKSPEQW QKSLGLAAKK PVSNKDKKDK KDKK*
``` a732/m732 99.6% identity in 494 aa overlap

```
                 10         20         30         40         50         60
a732.pep  MSKPVFKKIALYTLGAISGVAVSLAVQGFAAEKDRRDNEVLPVQSIRTMAEVYGQIKANY
          ||||||||||||||||||||||||||||||||||||||||||||||||||||||||||||
m732      MSKPVFKKIALYTLGAISGVAVSLAVQGFAAEKDRRDNEVLPVQSIRTMAEVYGQIKANY
                 10         20         30         40         50         60
```

```
                      70        80        90       100       110       120
a732.pep   YQDKPDADLFEGAMKGMVAGLDPHSEYMDKKGYAEIKESTSGEFGGLGMEIGQEDGFVKV
           ||||||||||||||||||||||||||||||||||||||||||||||||||||||||||||
m732       YQDKPDADLFEGAMKGMVAGLDPHSEYMDKKGYAEIKESTSGEFGGLGMEIGQEDGFVKV
                      70        80        90       100       110       120

130       140       150       160       170       180
a732.pep   VSPIEDTPAERAGVKSGDFIVKIDNVSTRGMTVSEAVKKMRGKPGTKITLTLSRKNADKP
           ||||||||||||||||||||||||||||||||||||||||||||||||||||||||||||
m732       VSPIEDTPAERAGVKSGDFIVKIDNVSTRGMTVSEAVKKMRGKPGTKITLTLSRKNADKP
                     130       140       150       160       170       180

190       200       210       220       230       240
a732.pep   IVVNLTRAIIKVKSVRHHLIEPDYGYIRVSQFQERTVESVNTAAKELVKENKGKPLKGLV
           ||||||||||||||||||||||||||||||||||||||||||||||||||||||||||||
m732       IVVNLTRAIIKVKSVRHHLIEPDYGYIRVSQFQERTVESVNTAAKELVKENKGKPLKGLV
                     190       200       210       220       230       240

250       260       270       280       290       300
a732.pep   LDLRDDPGGLLTGAVGVSAAFLPSEAVVVSTKGRDGKDRMVLKAVPEDYVYGMGGDSLAG
           ||||||||||||||||||||||||||||||||||||||||||:|||||||||||| |||
m732       LDLRDDPGGLLTGAVGVSAAFLPSEAVVVSTKGRDGKDRMVLKAIPEDYVYGMGGDPLAG
                     250       260       270       280       290       300

310       320       330       340       350       360
a732.pep   IPAELKTIPMTVLVNSGSASASEIVAGALQDHKRAVIVGTQSFGKFSVQTLIPLSNGSAV
           ||||||||||||||||||||||||||||||||||||||||||||||||||||||||||||
m732       IPAELKTIPMTVLVNSGSASASEIVAGALQDHKRAVIVGTQSFGKFSVQTLIPLSNGSAV
                     310       320       330       340       350       360

370       380       390       400       410       420
a732.pep   KLTTALYYTPNDRSIQAQGIVPDVEVKDKERIFESREADLVGHIGNPLGGEDVNSETLAV
           |||||||||||||||||||||||||||||||| ||||||||||||||||||||:||||
m732       KLTTALYYTPNDRSIQAQGIVPDVEVKDKERTFESREADLVGHIGNPLGGEDVNGETLAV
                     370       380       390       400       410       420

430       440       450       460       470       480
a732.pep   PLEKDADKPAVKEKGKKKKDEDLSSRRIPNPAKDDQLRKALDLVKSPEQWQKSLGLAAKK
           ||||||||||||||||||||||||||||||||||||||||||||||||||||||||||||
m732       PLEKDADKPAVKEKGKKKKDEDLSSRRIPNPAKDDQLRKALDLVKSPEQWQKSLGLAAKK
                     430       440       450       460       470       480

490
a732.pep   PVSNKDKKDKKDKKX
           |||||||||||||||
m732       PVSNKDKKDKKDKKX
                     490
```

The following partial DNA sequence was identified in *N. gonorrhoeae* <SEQ ID 2487>:

```
g733.seq
    1   ATGATGAATC CGAAAACCTT GGGCCGTTTG TCGCTGTGTG CGGCGGTCTT

51   GGCTCTGACC GCCTGCGCCG GCGGCGGGCA TAAAAACCTG TATTATTACG

101   GCGGTTATCC CGATACCGTC TATGAAGGTT TGAAAAACGa cgACACTTCG

151   TTGGGCAAGC AGACCGAAAA GATGGAAAAA TACTTTGCGG AAGCCGCCAA

201   CAAAAAAATG AATGCCGCCC CGGGTGCGCA CGCCCATTTG GGACTGCTGC

251   TTTCCCGTTC GGGAGACAAA GAGGGCGCGT TCCGCCAATT TGAAGAAGAG

301   AAAAGGCTGT TCCCCGAATC GGGCGTATTT ATGGACTTCC TGATGAAAAC

351   CGGtaaAGGA GGCAAGCGAT GA
```

This corresponds to the amino acid sequence <SEQ ID 2488; ORF 733>:

```
g733.pep
    1   MMNPKTLGRL SLCAAVLALT ACAGGGHKNL YYYGGYPDTV YEGLKNDDTS

51   LGKQTEKMEK YFAEAANKKM NAAPGAHAHL GLLLSRSGDK EGAFRQFEEE

101   KRLFPESGVF MDFLMKTGKG GKR*
```

The following partial DNA sequence was identified in *N. meningitidis* <SEQ ID 2489>:

```
m733.seq
    1   ATGATGAATC CGAAAACCTT GAGCCGTTTG TCGCTGTGTG CGGCGGTCTT

51   GGCTCTGACC GCCTGCGGCG GCAACGGGCA AAAATCCCTG TATTATTACG

101   GCGGCTATCC CGATACCGTC TATGAAGGTT TGAAAAACGA CGACACTTCG

151   TTGGGCAAGC AGACCGAAAA GATGGAAAAA TACTTTGTGG AAGCCGGCAA

201   CAAAAAAATG AATGCCGCCC CGGGTGCGCA CGCCCATCTG GGACTGCTGC

251   TTTCCCGTTC GGGAGACAAA GAGGGCGCGT TCCGCCAGTT TGAAGAAGAG

301   AAAAGGCTGT TCCCGAATCG GGCGTATTT ATGGACTTCC TGATGAAAAC

351   CGGTAAAGGA GGCAAGCGAT GA
```

This corresponds to the amino acid sequence <SEQ ID 2490; ORF 733>:

```
m733.pep
    1   MMNPKTLSRL SLCAAVLALT ACGGNGQKSL YYYGGYPDTV YEGLKNDDTS

51   LGKQTEKMEK YFVEAGNKKM NAAPGAHAHL GLLLSRSGDK EGAFRQFEEE

101   KRLFPESGVF MDFLMKTGKG GKR*
```

Computer analysis of the amino acid sequences gave the following results:
Homology with a Predicted ORF from *N. meningitidis* menA with menB
ORF 733 shows 94.3% identity over a 123 aa overlap with a predicted ORF (ORF733.a) from *N. gonorrhoeae*:

```
m733/g733
                    10         20         30         40         50         60
    m733.pep  MMNPKTLSRLSLCAAVLALTACGGNGQKSLYYYGGYRDTVYEGLKNDDTSLGKQTEKMEK
              |||||||:||||||||||||||:|:|:|:||||||||||||||||||||||||||||||
    g733      MMNPKTLGRLSLCAAVLALTACAGGGHKNLYYYGGYRDTVYEGLKNDDTSLGKQTEKMEK
                    10         20         30         40         50         60
                    70         80         90        100        110        120
    m733.pep  YFVEAGNKKMNAAPGAHAHLGLLLSRSGDKEGAFRQFEEEKRLFPESGVFMDFLMKTGKG
              ||:||:||||||||||||||||||||||||||||||||||||||||||||||||||||
    g733      YFAEAANKKMNAAPGAHAHLGLLLSRSGDKEGAFRQFEEEKRLFPESGVFMDFLMKTGKG
                    70         80         90        100        110        120
    m733.pep  GKRX
              ||||
    g733      GKRX
```

The following partial DNA sequence was identified in *N. meningitidis* <SEQ ID 2491>:

```
a733.seq
    1   ATGATGAATC CGAAAACCTT GAGCCGTTTG TCGCTGTGTG CGGCGGTCTT

51   GGCTCTGACC GCCTGCGGCG GCAACGGGCA AAAATCCCTG TATTATTACG

101   GCGGCTATCC CGATACCGTC TATGAAGGTT TGAAAAACGA CGACACTTCG

151   TTGGGCAAGC AGACCGAAAA GATGGAAAAA TACTTTGTGG AAGCCGGCAA

201   CAAAAAAATG AATGCCGCCC CGGGTGCGCA CGCCCATCTG GGACTGCTGC

251   TTTCCCGTTC GGGAGACAAA GAGGGCGCGT TCCGCCAGTT TGAAGAAGAG

301   AAAAGGCTGT TCCCGAATCG GGCGTATTT ATGGACTTCC TGATGAAAAC

351   CGGTAAAGGA GGCAAGCGAT GA
```

This corresponds to the amino acid sequence <SEQ ID 2492; ORF 733.a>:

```
a733.pep
    1   MMNPKTLSRL SLCAAVLALT ACGGNGQKSL YYYGGYPDTV YEGLKNDDTS

51   LGKQTEKMEK YFVEAGNKKM NAAPGAHAHL GLLLSRSGDK EGAFRQFEEE

101   KRLFPESGVF MDFLMKTGKG GKR*
``` a733/m733 100.0% identity in 123 aa overlap

```
                 10         20         30         40         50         60
    a733.pep  MMNPKTLSRLSLCAAVLALTACGGNGQKSLYYYGGYPDTVYEGLKNDDTSLGKQTEKMEK
              ||||||||||||||||||||||||||||||||||||||||||||||||||||||||||||
    m733      MMNPKTLSRLSLCAAVLALTACGGNGQKSLYYYGGYPDTVYEGLKNDDTSLGKQTEKMEK
                 10         20         30         40         50         60

70         80         90        100        110        120
    a733.pep  YFVEAGNKKMNAAPGAHAHLGLLLSRSGDKEGAFRQFEEEKRLFPESGVFMDFLMKTGKG
              ||||||||||||||||||||||||||||||||||||||||||||||||||||||||||||
    m733      YFVEAGNKKMNAAPGAHAHLGLLLSRSGDKEGAFRQFEEEKRLFPESGVFMDFLMKTGKG
                 70         80         90        100        110        120 a733.pep  GKRX
              ||||
    m733      GKRX
```

The following partial DNA sequence was identified in *N. gonorrhoeae* <SEQ ID 2493>:

```
g734.seq
    1   ATGATGAAAA AGATACTGGC AGTATCGGCA CTATGCCTGA TGACTGCGGC

51   GGCACAGGCT GCCGATACTT ACGGCTATCT CGCCGTTTGG CAGAATCCGC

101   AGGATGCAAA CGATGTTTTG CAGGTTAAAA CCACAAAAGA AGATTCGGCG

151   AAAAGCGAAG CGTTTGCCGA GTTGGAAGCC TTTTGCAAAG GTCAGGACAC

201   GCTTGCGGGC ATTGCCGAAG ACGAGCCGAC CGGATGCCGG TCGGTCGTGT

251   CGCTGAACAA TACCTGTGTC TCGCTGGCAT ACCCGAAAGC CTTGGGCGCG

301   ATGCGCGTTG AAAACGCCGT CGTGATTACT TCTCCGCGTT TTACGAGCGT

351   TCATCAGGTC GCACTCAACC AGTGCATAAA AAAATACGGC GCACAGGGAC

401   AATGCGGCTT GGAAACAGTG TATTGCACGT CATCTTCTTA TTACGGCGGG

451   GCTGTTCGCT CCTTAATCCA ACACCTGAAA TAA
```

This corresponds to the amino acid sequence <SEQ ID 2494; ORF 734.ng>:

```
g734.pep
    1   MMKKILAVSA LCLMTAAAQA ADTYGYLAVW QNPQDANDVL QVKTTKEDSA

51   KSEAFAELEA FCKGQDTLAG IAEDEPTGCR SVVSLNNTCV SLAYPKALGA

101   MRVENAVVIT SPRFTSVHQV ALNQCIKKYG AQGQCGLETV YCTSSSYYGG

151   AVRSLIQHLK *
```

The following partial DNA sequence was identified in *N. meningitidis* <SEQ ID 2495>:

```
m734.seq (partial)
    1   TCGGGCATTG CTGAAGACGA GCCGACCGGA TGCCGGTCGG TCGTGTCGCT

51   GAACAATACC TGTGTCGCGC TGGCATACCC GAAAGCCTTG GGCGCGCTGC
```

```
                          -continued
        101   GTGTCGACAA CGCCGTCGTG ATTACTTCTC CGCGTTTTAC GAGCGTTCAT

151   CAGGTCGCAC TCAACCAGTG CATCAAAAAA TACGGCGTAC AGGGACAATG

201   CGGCTTGGAA ACAGTGTATT GCACATCTTC TTCTTATTAC GGCGGAACTG

251   TGCGCTCTTT GATTCAAAAT CTCAAATAA
```

This corresponds to the amino acid sequence <SEQ ID 2496; ORF 734>:

```
m734.pep (partial)
        1     SGIAEDEPTG CRSVVSLNNT CVALAYPKAL GALRVDNAVV ITSPRFTSVH

51    QVALNQCIKK YGVQGQCGLE TVYCTSSSYY GGTVRSLIQN LK*
``` m734/g734 92.4% identity in 92 aa overlap

```
                                         10         20         30
     m734.pep                     SGIAEDEPTGCRSVVSLNNTCVALAYPKAL
                                  :||||||||||||||||||||:||||||||
     g734     VLQVKTTKEDSAKSEAFAELEAFCKGQDTLAGIAEDEPTGCRSVVSLNNTCVSLAYPKAL
              40         50         60         70         80         90

40         50         60         70         80         90
     m734.pep GALRVDNAVVITSPRFTSVHQVALNQCIKKYGVQGQCGLETVYCTSSSYYGGTVRSLIQN
              ||:||:||||||||||||||||||||||||||:|||||||||||||||||||:||||||:
     g734     GAMRVENAVVITSPRFTSVHQVALNQCIKKYGAQGQCGLETVYCTSSSYYGGAVRSLIQH
              100        110        120        130        140        150 m734.pep LKX
              |||
     g734     LKX
              160
```

The following partial DNA sequence was identified in N. meningitidis <SEQ ID 2497>:

```
a734.seq
        1     ATGATGAAAA AGATACTGGC CGTATCGGCA CTATGCCTGA TGACTGCGGC

51    GGCACGGGCT GCCGATACTT ACGGCTATCT CGCCGTTTGG CAGAATCCGC

101   AGAATGCAAA CGATGTTTTG CAGGTTAAAA CCACAAAAGA AGATTCGACG

151   AAAAGCGAAG CGTTTGCCGA GTTGGAAGCT TTCTGCAAAG GTCAGGACAC

201   GCTTGCGGGC ATTGCCGAAG ACGAGCCGAC CGGATGCCGG TCGGTCGTGT

251   CGCTGAACAA TACCTGTGTC GCGCTGGCAT ACCCGAAAGC CTTGGGCGCG

301   ATGCGCGTTG AAAACGCCGT TGTGATTACT TCTCCGCGTT TTACGAGCGT

351   TTATCAGGTC GCACTCAACC AGTGCATCAA AAAATACGGC GCACAGGGAC

401   AATGCGGCTT GGAAACAGTG TATTGCACGT CTTCTTCTTA TTACGGGGGA

451   ACTGTGCGCT CTTTGATTCA AAATCTCAAA TAA
```

This corresponds to the amino acid sequence <SEQ ID 2498; ORF 734.a>:

```
a734.pep
        1     MMKKILAVSA LCLMTAAARA ADTYGYLAVW QNPQNANDVL QVKTTKEDST

51    KSEAFAELEA FCKGQDTLAG IAEDEPTGCR SVVSLNNTCV ALAYPKALGA

101   MRVENAVVIT SPRFTSVYQV ALNQCIKKYG AQGQCGLETV YCTSSSYYGG

151   TVRSLIQNLK *
``` a734/g734 95.6% identity in 160 aa overlap

```
                10         20         30         40         50         60
a734.pep  MMKKILAVSALCLMTAAARAADTYGYLAVWQNPQNANDVLQVKTTKEDSTKSEAFAELEA
          ||||||||||||||||:|||||||||||||||:|||||||||||||||:|||||||||||
g734      MMKKILAVSALCLMTAAAQAADTYGYLAVWQNPQDANDVLQVKTTKEDSAKSEAFAELEA
                10         20         30         40         50         60

70         80         90        100        110        120
a734.pep  FCKGQDTLAGIAEDEPTGCRSVVSLNNTCVALAYPKALGAMRVENAVVITSPRFTSVYQV
          ||||||||||||||||||||||||||||||||:|||||||||||||||||||||||:||
g734      FCKGQDTLAGIAEDEPTGCRSVVSLNNTCVSLAYPKALGAMRVENAVVITSPRFTSVHQV
                70         80         90        100        110        120

130        140        150        160
a734.pep  ALNQCIKKYGAQGQCGLETVYCTSSSYYGGTVRSLIQNLKX
          |||||||||||||||||||||||||||||||:||||||:|||
g734      ALNQCIKKYGAQGQCGLETVYCTSSSYYGGAVRSLIQHLKX
               130        140        150        160
``` g735.seq not found yet
g735.pep not found yet
The following partial DNA sequence was identified in *N. meningitidis* <SEQ ID 2499>:

```
m735.seq
    1   ATGAATCTCG TGAAACTGCT GGCGAATAAC TGGCAACCGA TTGCCATTAT

51   CGCGCTTGTC GGCACGGGCT TGGCTGTGTC GCACCATCAA GGCTACAAGT

101   CGGCATTTGC GAAGCAGCAG GCGGTCATCG ACAAGATGGA GCGCGACAAG

151   GCGCAAGCCC TGCTGTTGTC GGCTCAAAAC TATGCGCGCG AACTGGAACT

201   GGCACGCGCG GAAGCTAAAA AATATGAAGT CAAGGCGCAC GCTGTCGGCA

251   TGGCTTTGGC GAAAAAACAG GCGGAAGTCA GCCGTCTGAA AACGGAAAAT

301   AAAAAGGAAA TCGAAAATGT CCTTACTCAA GACCGTAAAA ATGCAAGCGG

351   CGGTTGCATT GACGGCTTTG GCTCTCACGG CCTGCAGCTC TACAACCGCG

401   CCCTCGGCTA CGGAAATTAA
```

This corresponds to the amino acid sequence <SEQ ID 2500; ORF 735>:

```
m735.pep
    1   MNLVKLLANN WQPIAIIALV GTGLAVSHHQ GYKSAFAKQQ AVIDKMERDK

51   AQALLLSAQN YARELELARA EAKKYEVKAH AVGMALAKKQ AEVSRLKTEN

101   KKEIENVLTQ DRKNASGGCI DGFGSHGLQL YNRALGYGN*
```

The following partial DNA sequence was identified in *N. meningitidis* <SEQ ID 2501>:

```
a735.seq
    1   ATGAATCTCG TGAAACTGCT GGCGAATAAC TGGCAACCGA TTGCCATCAT

51   CGCGCTTGTC GGCACGGGTT TGGCGGTGTC GCACCATCAA GGCTACAAGT

101   CGGCTTTTGC GAAGCAGCAG GCGGTCATTG AGAAAATGAA GCGCGACAAG

151   GCGCAAGCCC TGCTGTTGTC GGCTCAAAAC TACGCCCGCG AACTGGAACA

201   GGCGCGTGCG GAAGCTAAAA AATATGAAGT CAAGGCGCAC GCCGTCGGCA

251   TGGCTTTGGC GAAAAAACAG GCGGAAGTCA GCCGTCTGAA AACGGAAAAT

301   AAAAAGGAAA TCGAAAATGT CCTTACTCAA GACCGTAAAA ATGCAGGCGG

351   CGGTTGTATT GACGGCTTTG GCCATCACGG CTTGCAGCTC TACAAGCGCG

401   CCCTCGGCTA CGGAAATTAA
```

This corresponds to the amino acid sequence <SEQ ID 2502; ORF 735.a>:

```
a735.pep
    1   MNLVKLLANN WQPIAIIALV GTGLAVSHHQ GYKSAFAKQQ AVIEKMKRDK

51   AQALLLSAQN YARELEQARA EAKKYEVKAH AVGMALAKKQ AEVSRLKTEN

101   KKEIENVLTQ DRKNAGGGCI DGFGHHGLQL YKRALGYGN*
``` a735/m735 95.7% identity in 139 aa overlap

```
                  10         20         30         40         50         60
     a735.pep  MNLVKLLANNWQPIAIIALVGTGLAVSHHQGYKSAFAKQQAVIEKMKRDKAQALLLSAQN
               ||||||||||||||||||||||||||||||||||||||||||:||:||||||||||||
     m735      MNLVKLLANNWQPIAIIALVGTGLAVSHHQGYKSAFAKQQAVIDKMERDKAQALLLSAQN
                  10         20         30         40         50         60
                  70         80         90        100        110        120
     a735.pep  YARELEQARAEAKKYEVKAHAVGMALAKKQAEVSRLKTENKKEIENVLTQDRKNAGGGCI
               ||||||  ||||||||||||||||||||||||||||||||||||||||||||||:||||
     m735      YARELELARAEAKKYEVKAHAVGMALAKKQAEVSRLKTENKKEIENVLTQDRKNASGGCI
                  70         80         90        100        110        120
                 130        140
     a735.pep  DGFGHHGLQLYKRALGYGNX
               ||||  ||||||:|||||||
     m735      DGFGSHGLQLYNRALGYGNX
                 130        140
```

The following partial DNA sequence was identified in *N. gonorrhoeae* <SEQ ID 2503>:

```
g736.seq
    1   ATGAATTTTA TCCGTTCCGT CGGGGCGAAA ACCCTCGGCC TTATTCAATC

51   CTTCGGCAGT ATCACGCTGT TTCTGCTGAA CATTTTGGCG AAATCCGGCA

101   CGGCTTTCGC CCGTCCGCGC CTGAGCGTGC GCCAAGTGTA TTTTGCCGGC

151   GTGCTGTCGG TGCTGATTGT TGCCGTTTCG GGGCTGTTCG TCGGTATGGT

201   TTTGGGTTTG CAGGGCTATA CGCAGTTGTC GAAATTCAAA TCCGCCGATA

251   TTTTGGGCTA TATGGTCGCG GCTTCTCTGT TGCGCGAACT GGGTCCCGTG

301   TTGGCGGCGA TTCTGTTTGC CAGCAGCGCG GGCGGTGCGA TGACCAGCGA

351   AATCGGTTTG ATGAAAACGA CCGGACAGCT CGAAGCGATG AACGTGATGG

401   CGGTCAACCC CGTCGCCCGC GTGGTTGCCC CGCGTTTTTG GGCGGGCGTG

451   TTTTCTATGC CGCTTTTGGC TTCGATTTTC AACGTCGCGG CATTTTCGG

501   CGCGTATTTG GTCGGCGTGA GCTGGCTGGG TTTGGACAGC GGTATTTTCT

551   GGCCGCAGAT GCAGAACAAC ATTACGATAC ATTACGATGT AATCAACGGT

601   TTGATCAAAT CCGCCGCGTT CGGCGTGGCG GTAACGCTGA TTGCCGTGCA

651   TCAGGGCTTC CACTGCATCC CGACTTCGGA AGGCATTTTG CGCGCCAGCA

701   CGCGCACGGT GGTTTCGTCC GCCCTGACGA TTTTGGCGGT CGATTTTATA

751   TTGACCGCGT GGATGTTTAC AGATTGA
```

This corresponds to the amino acid sequence <SEQ ID 2504; ORF 736>:

```
g736.pep
    1   MNFIRSVGAK TLGLIQSFGS ITLFLLNILA KSGTAFARPR LSVRQVYFAG

51   VLSVLIVAVS GLFVGMVLGL QGYTQLSKFK SADILGYMVA ASLLRELGPV

101   LAAILFASSA GGAMTSEIGL MKTTGQLEAM NVMAVNPVAR VVAPRFWAGV
```

-continued

```
151  FSMPLLASIF NVAGIFGAYL VGVSWLGLDS GIFWPQMQNN ITIHYDVING

201  LIKSAAFGVA VTLIAVHQGF HCIPTSEGIL RASTRTVVSS ALTILAVDFI

251  LTAWMFTD*
```

The following partial DNA sequence was identified in *N. meningitidis* <SEQ ID 2505>:

```
m736.seq
   1  ATGAATTTTA TCCGTTCCGT CGGGGCGAAA ACCCTCGGCC TTATTCAATC

51  CTTCGGCAGT ATCACGCTGT TTCTGCTGAA CATTTTGGCG AAATCCGGCA

101  CGGCTTTCGC CCGTCCGCGC CTGAGCGTGC GCCAAGTGTA TTTTGCCGGC

151  GTGCTGTCGG TGCTGATTGT TGCCGTTTCG GGGCTGTTCG TCGGTATGGT

201  TTTGGGTTTG CAGGGCTATA CGCAGTTGTC GAAATTCAAA TCCGCCGATA

251  TTTTGGGCTA TATGGTCGCG GCTTCTCTGT TGCGCGAACT GGGTCCCGTG

301  TTGGCGGCGA TTCTGTTTGC CAGCAGCGCG GGCGGTGCGA TGACCAGCGA

351  AATCGGTTTG ATGAAAACGA CCGGACAGCT CGAAGCGATG AACGTGATGG

401  CGGTCAACCC CGTCGCCCGC GTGGTTGCCC CGCGTTTTTG GGCGGGCGTG

451  TTTTCTATGC CGCTTTTGGC TTCGATTTTC AACGTCGCGG GCATTTTCGG

501  CGCGTATTTG GTCGGCGTGA GCTGGCTGGG TTTGGACAGC GGTATTTTCT

551  GGCCGCAGAT GCAGAACAAC ATTACGATAC ATTACGATGT AATCAACGGT

601  TTGATCAAAT CCGCCGCGTT CGGCGTGGCG GTAACGCTGA TTGCCGTGCA

651  TCAGGGCTTC CACTGCATCC CGACTTCGGA AGGCATTTTG CGCGCCAGCA

701  CGCGCACGGT GGTTTCGTCC GCCCTGACGA TTTTGGCGGT CGATTTTATA

751  TTGACCGCGT GGATGTTTAC AGATTGA
```

This corresponds to the amino acid sequence <SEQ ID 2506; ORF 736>:

```
m736.pep
   1  MNFIRSVGAK TLGLIQSLGS ITLFLLNILA KSGTAFVRPR LSVRQVYFAG

51  VLSVLIVAVS GLFVGMVLGL QGYTQLSKFK SADILGYMVA ASLLRELGPV

101  LAAILFASSA GGAMTSEIGL MKTTEQLEAM NVMAVNPVAR VVAPRFWAGV

151  FSMPLLASIF NVAGIFGAYL VGVTWLGLDS GIFWSQMQNN ITIHYDVING

201  LIKSAAFGVA VTLIAVHQGF HCVPTSEGIL RASTRTVVSS ALTILAVDFI

251  LTAWMFTD*
```

Computer analysis of the amino acid sequences gave the following results:
Homology with a Predicted ORF from *N. meningitidis* menA with menB
ORF 736 shows 97.7% identity over a 258 aa overlap with a predicted ORF (ORF736.ng) from *N. gonorrhoeae*:

```
m736/g736
                  10         20         30         40         50         60
     m736.pep  MNFIRSVGAKTLGLIQSLGSITLFLLNILAKSGTAFVRPRLSVRQVYFAGVLSVLIVAVS
               ||||||||||||||||||:|||||||||||||||||:|||||||||||||||||||||||
     g736      MNFIRSVGAKTLGLIQSFGSITLFLLNILAKSGTAFARPRLSVRQVYFAGVLSVLIVAVS
                  10         20         30         40         50         60
```

-continued

```
              70         80         90        100        110        120
m736.pep  GLFVGMVLGLQGYTQLSKFKSADILGYMVAASLLRELGPVLAAILFASSAGGAMTSEIGL
          ||||||||||||||||||||||||||||||||||||||||||||||||||||||||||||
g736      GLFVGMVLGLQGYTQLSKFKSADILGYMVAASLLRELGPVLAAILFASSAGGAMTSEIGL
              70         80         90        100        110        120

130        140        150        160        170        180
m736.pep  MKTTEQLEAMNVMAVNPVARVVAPRFWAGVFSMPLLASIFNVAGIFGAYLVGVTWLGLDS
          ||||  ||||||||||||||||||||||||||||||||||||||||||||||||:|||||
g736      MKTTGQLEAMNVMAVNPVARVVAPRFWAGVFSMPLLASIFNVAGIFGAYLVGVSWLGLDS
             130        140        150        160        170        180

190        200        210        220        230        240
m736.pep  GIFWSQMQNNITIHYDVINGLIKSAAFGVAVTLIAVHQGFHCVPTSEGILRASTRTVVSS
          ||||  ||||||||||||||||||||||||||||||||||||||:|||||||||||||||
g736      GIFWPQMQNNITIHYDVINGLIKSAAFGVAVTLIAVHQGFHCIPTSEGILRASTRTVVSS
             190        200        210        220        230        240

250       259
m736.pep  ALTILAVDFILTAWMFTDX
          |||||||||||||||||||
g736      ALTILAVDFILTAWMFTDX
             250
```

The following partial DNA sequence was identified in *N. meningitidis* <SEQ ID 2507>:

```
a736.seq
    1  ATGAATTTTA TCCGTTCCGT CGGGGCGAAA ACCCTCGGCC TTATTCAATC

51  TCTCGGCAGT ATCACGCTGT TTCTGCTGAA TATTCTGGCG AAATCCGGTA

101  CGGCTTTCGT CCGTCCGCGC CTGAGCGTGC GCCAAGTGTA TTTTGCCGGC

151  GTGCTGTCGG TGTTGATTGT TGCCGTTTCA GGGCTGTTTG TCGGCATGGT

201  CTTGGGTTTG CAGGGCTATA CGCAGTTGTC GAAATTCAAA TCCGCCGATA

251  TTTTGGGCTA TATGGTCGCG GCTTCGCTGT TGCGCGAACT GGGTCCGGTG

301  TTGGCGGCGA TTCTGTTTGC CAGCAGCGCG GCGGTGCGA TGACCAGCGA

351  AATCGGTTTG ATGAAAACGA CCGAACAGCT CGAAGCGATG AACGTGATGG

401  CGGTAAACCC CGTCGCCCGA GTGGTTGCGC CGCGCTTTTG GGCGGGCGTG

451  TTTTCCATGC CGCTTTTGGC TTCGATTTTC AACGTGGCGG GTATTTTCGG

501  CGCGTATTTG GTCGGTGTAA CCTGGCTGGG CTTGGACAGC GGTATTTTCT

551  GGTCGCAAAT GCAGAACAAC ATCACGATAC ATTACGATGT AATCAACGGT

601  CTGATCAAAT CCGCCGCGTT CGGCGTGGCG GTAACGCTGA TTGCCGTGCA

651  TCAGGGCTTC CACTGCGTCC CGACCTCGGA AGGCATTTTG CGCGCCAGCA

701  CGCGCACGGT GGTTTCGTCC GCCCTGACGA TTTTGGCGGT CGATTTTATA

751  TTGACCGCGT GGATGTTTAC AGATTGA
```

This corresponds to the amino acid sequence <SEQ ID 2508; ORF 736.a>:

```
a736.pep
    1  MNFIRSVGAK TLGLIQSLGS ITLFLLNILA KSGTAFVRPR LSVRQVYFAG

51  VLSVLIVAVS GLFVGMVLGL QGYTQLSKFK SADILGYMVA ASLLRELGPV

101  LAAILFASSA GGAMTSEIGL MKTTEQLEAM NVMAVNPVAR VVAPRFWAGV

151  FSMPLLASIF NVAGIFGAYL VGVTWLGLDS GIFWSQMQNN ITIHYDVING

201  LIKSAAFGVA VTLIAVHQGF HCVPTSEGIL RASTRTVVSS ALTILAVDFI

251  LTAWMFTD*
``` a736/m736 100.0% identity in 258 aa overlap

```
              10        20        30        40        50        60
a736.pep  MNFIRSVGAKTLGLIQSLGSITLFLLNILAKSGTAFVRPRLSVRQVYFAGVLSVLIVAVS
          ||||||||||||||||||||||||||||||||||||||||||||||||||||||||||||
m736      MNFIRSVGAKTLGLIQSLGSITLFLLNILAKSGTAFVRPRLSVRQVYFAGVLSVLIVAVS
              10        20        30        40        50        60

70        80        90       100       110       120
a736.pep  GLFVGMVLGLQGYTQLSKFKSADILGYMVAASLLRELGPVLAAILFASSAGGAMTSEIGL
          ||||||||||||||||||||||||||||||||||||||||||||||||||||||||||||
m736      GLFVGMVLGLQGYTQLSKFKSADILGYMVAASLLRELGPVLAAILFASSAGGAMTSEIGL
              70        80        90       100       110       120

130       140       150       160       170       180
a736.pep  MKTTEQLEAMNVMAVNPVARVVAPRFWAGVFSMPLLASIFNVAGIFGAYLVGVTWLGLDS
          ||||||||||||||||||||||||||||||||||||||||||||||||||||||||||||
m736      MKTTEQLEAMNVMAVNPVARVVAPRFWAGVFSMPLLASIFNVAGIFGAYLVGVTWLGLDS
             130       140       150       160       170       180

190       200       210       220       230       240
a736.pep  GIFWSQMQNNITIHYDVINGLIKSAAFGVAVTLIAVHQGFHCVPTSEGILRASTRTVVSS
          ||||||||||||||||||||||||||||||||||||||||||||||||||||||||||||
m736      GIFWSQMQNNITIHYDVINGLIKSAAFGVAVTLIAVHQGFHCVPTSEGILRASTRTVVSS
             190       200       210       220       230       240

250       259
a736.pep  ALTILAVDFILTAWMFTDX
          |||||||||||||||||||
m736      ALTILAVDFILTAWMFTDX
             250
```

The following partial DNA sequence was identified in *N. gonorrhoeae* <SEQ ID 2509>:

```
g737.seq
     1   atgaACATCA AACACCTTCT CTTGACCGCC GCCGCAACCG CACTGTTGGG

51   CATTTCCGCC CCCGCACTCG CCCACCACGA CGGACACGGC GATGACGACC

101   ACGGACACGC CGCACACCAA CACGGCAAAC AAGACAAAAT CATCAGCCGC

151   GCCCAAGCCG AAAAAGCGGC TTGGGCGCGT GTCGGCGGCA AAATCACCGA

201   CATCGATCTC GAACACGACG ACGGCCGTCC GCACTATGAT GTCGAAATCG

251   TCAAAAACGG ACAGGAATAC AAAGTCGTTG TCGATGCCCG TACCGGCCGC

301   GTGATTTCCT CCCGCCGCGA CGACTGA
```

This corresponds to the amino acid sequence <SEQ ID 2510; ORF 737>:

```
g737.pep
     1   MNIKHLLLTA AATALLGISA PALAHHDGHG DDDHGHAAHQ HGKQDKIISR

51   AQAEKAAWAR VGGKITDIDL EHDDGRPHYD VEIVKNGQEY KVVVDARTGR

101   VISSRRDD*
```

The following partial DNA sequence was identified in *N. meningitidis* <SEQ ID 2511>:

```
m737.seq..
     1    ATGAACATCA AACACCTTCT CTTGACCTCC GCCGCAACCG CACTGCTGAG

51    CATTTCCGCC CCCGCGCTCG CCCACCACGA CGGACACGGC GATGACGACC

101    ACGGACACGC CGCACACCAA CACAACAAAC AAGACAAAAT CATCAGCCGC

151    GCCCAAGCCG AAAAAGCAGC GTTGGCGCGT GTCGGCGGCA AAATCACCGA
```

-continued

```
   201   CATCGATCTC GAACACGACA ACGGCCGTCC GCACTATGAT GTCGAAATCG

251   TCAAAAACGG ACAGGAATAC AAAGTCGTTG TCGATGCCCG TACCGGCCGC

301   GTGATTTCCT CCCGCCGCGA CGACTGA
```

This corresponds to the amino acid sequence <SEQ ID 2512; ORF 737>:

```
m737.pep
     1   MNIKHLLLTS AATALLSISA PALAHHDGHG DDDHGHAAHQ HNKQDKIISR

51   AQAEKAALAR VGGKITDIDL EHDNGRPHYD VEIVKNGQEY KVVVDARTGR

101   VISSRRDD*
```

Computer analysis of the amino acid sequences gave the following results:
Homology with a Predicted ORF from N. meningitidis menA 20 with menB
ORF 737 shows 95.4% identity over a 108 aa overlap with a predicted ORF (ORF737.a) from N. gonorrhoeae:

```
   m737/g737
                    10         20         30         40         50         60
      m737.pep   MNIKHLLLTSAATALLSISAPALAHHDGHGDDDHGHAAHQHNKQDKIISRAQAEKAALAR
                 ||||||||:||||||:|||||||||||||||||||||||:||||||||||||||| ||
          g737   MNIKHLLLTAAATALLGISAPALAHHDGHGDDDHGHAAHQHGKQDKIISRAQAEKAAWAR
                    10         20         30         40         50         60

70         80         90        100       109
      m737.pep   VGGKITDIDLEHDNGRPHYDVEIVKNGQEYKVVVDARTGRVISSRRDDX
                 ||||||||||:|||||||||||||||||||||||||||||||||||||
          g737   VGGKITDIDLEHDDGRPHYDVEIVKNGQEYKVVVDARTGRVISSRRDDX
                    70         80         90        100
```

The following partial DNA sequence was identified in N. meningitidis <SEQ ID 2513>:

```
a737.seq
     1   ATGAACTTCA AACGCCTTCT CTTGACCGCC GCCGCAACCG CACTGATGGG

51   CATTTCCGCC CCCGCACTCG CCCACCACGA CGGACACGGC GATGACGACC

101   ACGGACACGC CGCACACCAA CACAGCAAAC AAGACAAAAT CATCAGCCGC

151   GCCCAAGCCG AAAAAGCAGC GTTGGCGCGT GTCGGCGGCA AAATCACCGA

201   CATCGATCTC GAACACGACA ACGGCCGTCC GCACTATGAT GTCGAAATCG

251   TCAAAAACGG ACAGGAATAC AAAGTCGTTG TCGATGCCCG TACCGGCCGC

301   GTGATTTCCT CCCGCCGCGA CGACTGA
```

This corresponds to the amino acid sequence <SEQ ID 2514; ORF 737.a>:

```
a737.pep
     1   MNFKRLLLTA AATALMGISA PALAHHDGHG DDDHGHAAHQ HSKQDKIISR

51   AQAEKAALAR VGGKITDIDL EHDNGRPHYD VEIVKNGQEY KVVVDARTGR

101   VISSRRDD*
``` a737/m737 94.4% identity in 108 aa overlap

```
              10        20        30        40        50        60
a737.pep  MNFKRLLLTAAATALMGISAPALAHHDGHGDDDHGHAAHQHSKQDKIISRAQAEKAALAR
          ||:|:||||:|||||::||||||||||||||||||||||:||||||||||||||||||
m737      MNIKHLLLTSAATALLSISAPALAHHDGHGDDDHGHAAHQHNKQDKIISRAQAEKAALAR
              10        20        30        40        50        60

70        80        90       100       109
a737.pep  VGGKITDIDLEHDNGRPHYDVEIVKNGQEYKVVVDARTGRVISSRRDDX
          |||||||||||||||||||||||||||||||||||||||||||||||
m737      VGGKITDIDLEHDNGRPHYDVEIVKNGQEYKVVVDARTGRVISSRRDDX
              70        80        90       100
```

The following partial DNA sequence was identified in *N. gonorrhoeae* <SEQ ID 2515>:

```
g738.seq
   1   ATGTCCGCTG AAACGACCGT ATCCGGCGCG CGCCCCGCCG CCAAACTGCC
  51   GATTTACATC CTGCCCTGCT TCCTTTGGAT AGGCATCATC CCCTTTACCT
 101   TCGCACTCAG GCTGAAACCG TCGCCCGACT TTTACCACGA TGCCGCCGCC
 151   GCGGCCGGCC TGATTGTCCT GTTGTTCCTC ACGGCAGGAA AAAAGCTGTT
 201   TGATGTCAAA ATCCCCGCCA TCAGCTTCCT CCTGTTTGCA ATGGCGGCAT
 251   TTTGGTGGCT TCAGGCACGC CTGATGAACC TGATTTATCC CGGAATGAAC
 301   GACATCGCCT CTTGGGTTTT CATCTTGCTC GCCGTCAGCG CGTGGGCCTG
 351   CAAGAGTTTG GTCGCACACT ACGGACAAGA ACGCAtcgtT ACCCTGTTTG
 401   CCTGGTCGCT GCTTATCGGC TCCCTGCTTC AATCCTGCAT CGTcgtCATC
 451   CAGTTTGCCG GCTGGGAAAA CACCCCCCTG CTTCAAAACA TCATCGTTCA
 501   CAGAGGGCAA GGCGTAATCG ACACATCGG GCAGCGCAAC AACCTCGGAC
 551   ACTACCTCAT GTGGGGCATA CTCGCCTCCG CCTACCTCAA CGGACAACGA
 601   AAAATCCCCG CAGCCCTCGG CGCAATCTGC CTGATTATGC AGACCGCCGT
 651   TTTAGGTTTG GTCAATTCGC GCACCATCTT GACCTACATA GCCGCCATCG
 701   CCCTCATCCT TCCCTTCTGG TATTTCCGTT CGGACAAATC CAACAGACGG
 751   ACGATGCTCG GCATAGCCGC AGCCGTATTC CTTACCGCGC TGTTCCAATT
 801   TTCCATGAAC GCCATTCTGG AAACCTTTAC AGGCATCCGC TACGAAACTG
 851   CCGTCGAACG CGTCGCCAAC GGCGGTTTCA CAGACTTGCC GCGCCAAAGC
 901   GAATGGAATA AAGCCCTTGC CGCCTTCCAG TCCGCCCCGA TATTCGGGCA
 951   CGGCTGGAAC AGTTTTGCCC AACAAACCTT CCTGATCAAT GCCGAACAGC
1001   ACACCATACA CGACAACTTC CTCAGCACCT TGTTCACCCA TTCCCACAAC
1051   ATCATCCTCC AACTCCTTGC AGAAATGGGG ATCAGCGGCA CGCTTCTGGT
1101   TGCCGCAACC CTGCTGACGG GCATTGCCGG GCTGCTGAAA CGCTCCCTGA
1151   CCCCCGCATC ACTTTTCCTG CTGTGCGCGC TTGCCGTCAG TATGTGCCAC
1201   AGTATGCTCG AATATCCTTT GTGGTATGTC TATTTCCTCA TCCCCTTCGG
1251   ACTGATGCTC TTTCTGTCCC CCGCAGAGGC TTCAGACGGC ATCGCCTTCA
1301   AAAAAGCCGC CAATCTCGGC ATACTGACCG CCTCCGCCGC CATATTCGCA
1351   GGATTGCTGC ACTTGGACTG GACATACACC CGGCTGGTTA ACTCCTTTTC
1401   CCCCGCCGCT GACGACAGTG CCAAAACCCT CAACCGGAAA ATCAACGAAC
1451   TGCGCTATAT TTCCGCAAAC AGCCCGATGC TGTCCTTTTA TGCCGACTTC
```

-continued

```
1501  TCCCTCGTAA ACTTCGCCCT GCCGGAATAC CCCGAAACCC AGACTTGGGC

1551  GGAAGAAGCA ACCCTCAAAG CACTAAAATA CCGCCCCTAC TCCGCCACCT

1601  ACCGCATCGC CCTCTACTTG ATGCGGCAAG GCAAAGTTGC AGAAGCAAAA

1651  CAATGGATGC GGGCAACACA GTCCTATTAC CCCTACCTGA TGCCCCGATA

1701  CGCCGACGAA ATCCGCAAAC TGCCCGTATG GGCACCGCTG CTGCCCGAAC

1751  TGCTCAAAGA CTGCAAAGCC TTCGCCGCCG CTCCCGGCCA TCCGGAAACA

1801  AAACCCTGCA AATGA
```

This corresponds to the amino acid sequence <SEQ ID 2516; ORF 738>:

```
g738.pep
    1  MSAETTVSGA RPAAKLPIYI LPCFLWIGII PFTFALRLKP SPDFYHDAAA

51  AAGLIVLLFL TAGKKLFDVK IPAISFLLFA MAAFWWLQAR LMNLIYPGMN

101  DIASWVFILL AVSAWACKSL VAHYGQERIV TLFAWSLLIG SLLQSCIVVI

151  QFAGWENTPL LQNIIVHRGQ GVIGHIGQRN NLGHYLMWGI LASAYLNGQR

201  KIPAALGAIC LIMQTAVLGL VNSRTILTYI AAIALILPFW YFRSDKSNRR

251  TMLGIAAAVF LTALFQFSMN AILETFTGIR YETAVERVAN GGFTDLPRQS

301  EWNKALAAFQ SAPIFGHGWN SFAQQTFLIN AEQHTIHDNF LSTLFTHSHN

351  IILQLLAEMG ISGTLLVAAT LLTGIAGLLK RSLTPASLFL LCALAVSMCH

401  SMLEYPLWYV YFLIPFGLML FLSPAEASDG IAFKKAANLG ILTASAAIFA

451  GLLHLDWTYT RLVNSFSPAA DDSAKTLNRK INELRYISAN SPMLSFYADF

501  SLVNFALPEY PETQTWAEEA TLKALKYRPY SATYRIALYL MRQGKVAEAK

551  QWMRATQSYY PYLMPRYADE IRKLPVWAPL LPELLKDCKA FAAAPGHPET

601  KPCK*
```

The following partial DNA sequence was identified in N. meningitidis <SEQ ID 2517>:

```
m738.seq
    1  ATGCCCGCTG AAACGACCGT ATCCGGCGCG CACCCCGCCG CCAAACTGCC

51  GATTTACATC CTGCCCTGCT TCCTTTGGAT AGGCATCGTC CCCTTTACCT

101  TCGCGCTCAA ACTGAAACCG TCGCCCGACT TTTACCACGA TGCCGCCGCC

151  GCAGCCGGCC TGATTGTCCT GTTGTTCCTC ACGGCAGGAA AAAAACTGTT

201  TGATGTCAAA ATCCCCGCCA TCAGCTTCCT TCTGTTTGCA ATGGCGGCGT

251  TTTGGTATCT TCAGGCACGC CTGATGAACC TGATTTACCC CGGTATGAAC

301  GACATCGTCT CTTGGATTTT CATCTTGCTC GCCGTCAGCG CGTGGGCCTG

351  CCGGAGCTTG GTCGCACACT TCGGACAAGA ACGCATCGTG ACCCTGTTTG

401  CCTGGTCGCT GCTTATCGGC TCCCTGCTTC AATCCTGCAT CGTCGTCATC

451  CAGTTTGCCG GCTGGGAAGA CACCCCTCTG TTTCAAAACA TCATCGTTTA

501  CAGCGGGCAA GGCGTAATCG GACACATCGG GCAGCGCAAC AACCTCGGAC

551  ACTACCTCAT GTGGGGCATA CTCGCCGCCG CCTACCTCAA CGGACAACGA

601  AAAATCCCCG CCGCCCTCGG CGTAATCTGC CTGATTATGC AGACCGCCGT

651  TTTAGGTTTG GTCAACTCGC GCACCATCTT GACCTACATA GCCGCCATCG
```

```
-continued
 701  CCCTCATCCT TCCCTTCTGG TATTTCCGTT CGGACAAATC CAACAGGCGG
 751  ACGATGCTCG GCATAGCCGC AGCCGTATTC CTTACCGCGC TGTTCCAATT
 801  TTCCATGAAC ACCATTCTGG AAACCTTTAC TGGCATCCGC TACGAAACTG
 851  CCGTCGAACG CGTCGCCAAC GGCGGTTTCA CAGACTTGCC GCGCCAAATC
 901  GAATGGAATA AAGCCCTTGC CGCCTTCCAG TCCGCCCCGA TATTCGGGCA
 951  CGGCTGGAAC AGTTTTGCCC AACAAACCTT CCTCATCAAT GCCGAACAGC
1001  ACAACATATA CGACAACCTC CTCAGCAACT TGTTCACCCA TTCCCACAAC
1051  ATCGTCCTCC AACTCCTTGC AGAGATGGGA ATCAGCGGCA CGCTTCTGGT
1101  TGCCGCAACC CTGCTGACGG GCATTGCCGG GCTGCTTAAA CGCCCCCTGA
1151  CCCCCGCATC GCTTTTCCTA ATCTGCACGC TTGCCGTCAG TATGTGCCAC
1201  AGTATGCTCG AATATCCTTT GTGGTATGTC TATTTCCTCA TCCCTTTCGG
1251  ACTGATGCTC TTCCTGTCCC CCGCAGAGGC TTCAGACGGC ATCGCCTTCA
1301  AAAAGCCGC CAATCTCGGC ATACTGACCG CCTCCGCCGC CATATTCGCA
1351  GGATTGCTGC ACTTGGACTG GACATACACC CGGCTGGTTA ACGCCTTTTC
1401  CCCCGCCACT GACGACAGTG CCAAAACCCT CAACCGGAAA ATCAACGAGT
1451  TGCGCTATAT TTCCGCAAAC AGTCCGATGC TGTCCTTTTA TGCCGACTTC
1501  TCCCTCGTAA ACTTCGCCCT GCCGGAATAC CCCGAAACCC AGACTTGGGC
1551  GGAAGAAGCA ACCCTCAAAT CACTAAAATA CCGCCCCCAC TCCGCCACCT
1601  ACCGCATCGC CCTCTACCTG ATGCGGCAAG GCAAAGTTGC AGAAGCAAAA
1651  CAATGGATGC GGGCGACACA GTCCTATTAC CCgTACCTGA TGCCCCGATA
1701  CGCCGACGAA ATCCGCAAAC TGCCCGTATG GGCGCCGCTG CTACCCGAAC
1751  TGCTCAAAGA CTGCAAAGCC TTCGCCGCCG CGCCCGGTCA TCCGGAAGCA
1801  AAACCCTGCA AATGA
```

This corresponds to the amino acid sequence <SEQ ID 2518; ORF 738>:

```
m738.pep
   1  MPAETTVSGA HPAAKLPIYI LPCFLWIGIV PFTFALKLKP SPDFYHDAAA
  51  AAGLIVLLFL TAGKKLFDVK IPAISFLLFA MAAFWYLQAR LMNLIYPGMN
 101  DIVSWIFILL AVSAWACRSL VAHFGQERIV TLFAWSLLIG SLLQSCIVVI
 151  QFAGWEDTPL FQNIIVYSGQ GVIGHIGQRN NLGHYLMWGI LAAAYLNGQR
 201  KIPAALGVIC LIMQTAVLGL VNSRTILTYI AAIALILPFW YFRSDKSNRR
 251  TMLGIAAAVF LTALFQFSMN TILETFTGIR YETAVERVAN GGFTDLPRQI
 301  EWNKALAAFQ SAPIFGHGWN SFAQQTFLIN AEQHNIYDNL LSNLFTHSHN
 351  IVLQLLAEMG ISGTLLVAAT LLTGIAGLLK RPLTPASLFL ICTLAVSMCH
 401  SMLEYPLWYV YFLIPFGLML FLSPAEASDG IAFKKAANLG ILTASAAIFA
 451  GLLHLDWTYT RLVNAFSPAT DDSAKTLNRK INELRYISAN SPMLSFYADF
 501  SLVNFALPEY PETQTWAEEA TLKSLKYRPH SATYRIALYL MRQGKVAEAK
 551  QWMRATQSYY PYLMPRYADE IRKLPVWAPL LPELLKDCKA FAAAPGHPEA
 601  KPCK*
```

Computer analysis of the amino acid sequences gave the following results:
Homology with a Predicted ORF from *N. meningitidis* menA with menB
ORF 738 shows 95.0% identity over a 604 aa overlap with a predicted ORF (ORF738.a) from *N. gonorrhoeae*:

```
m738/g738
                  10        20        30        40        50        60
    m738.pep  MPAETTVSGAHPAAKLPIYILPCFLWIGIVPFTFALKLKPSPDFYHDAAAAAGLIVLLFL
              | ||||||| :|||||||||||||||||| :||||||:|||||||||||||||||||||||
    g738      MSAETTVSGARPAAKLPIYILPCFLWIGIIPFTFALRLKPSPDFYHDAAAAAGLIVLLFL
                  10        20        30        40        50        60

70        80        90       100       110       120
    m738.pep  TAGKKLFDVKIPAISFLLFAMAAFWYLQARLMNLIYPGMNDIVSWIFILLAVSAWACRSL
              |||||||||||||||||||||||||||:||||||||||||||:|||:|||||||||:||
    g738      TAGKKLFDVKIPAISFLLFAMAAFWWLQARLMNLIYPGMNDIASWVFILLAVSAWACKSL
                  70        80        90       100       110       120

130       140       150       160       170       180
    m738.pep  VAHFGQERIVTLFAWSLLIGSLLQSCIVVIQFAGWEDTPLFQNIIVYSGQGVIGHIGQRN
              |||:||||||||||||||||||||||||||||||||:|||||||:|||| |||||||||
    g738      VAHYGQERIVTLFAWSLLIGSLLQSCIVVIQFAGWENTPLLQNIIVHRGQGVIGHIGQRN
                 130       140       150       160       170       180

190       200       210       220       230       240
    m738.pep  NLGHYLMWGILAAAYLNGQRKIPAALGVICLIMQTAVLGLVNSRTILTYIAAIALILPFW
              |||||||||||::|||||||||||||| :|||||||||||||||||||||||||||||
    g738      NLGHYLMWGILASAYLNGQRKIPAALGAICLIMQTAVLGLVNSRTILTYIAAIALILPFW
                 190       200       210       220       230       240

250       260       270       280       290       300
    m738.pep  YFRSDKSNRRTMLGIAAAVFLTALFQFSMNTILETFTGIRYETAVERVANGGFTDLPRQI
              ||||||||||||||||||||||||||||||:|||||||||||||||||||||||||||
    g738      YFRSDKSNRRTMLGIAAAVFLTALFQFSMNAILETFTGIRYETAVERVANGGFTDLPRQS
                 250       260       270       280       290       300

310       320       330       340       350       360
    m738.pep  EWNKALAAFQSAPIFGHGWNSFAQQTFLINAEQHNIYDNLLSNLFTHSHNIVLQLLAEMG
              |||||||||||||||||||||||||||||||||||:|:||:||:||||||||:||||||
    g738      EWNKALAAFQSAPIFGHGWNSFAQQTFLINAEQHTIHDNFLSTLFTHSHNIILQLLAEMG
                 310       320       330       340       350       360

370       380       390       400       410       420
    m738.pep  ISGTLLVAATLLTGAIGLLKRPLTPASLFLICTLAVSMCHSMLEYPLWYVYFLIPFGLML
              ||||||||||||||||||||||| |||||||:|:|||||||||||||||||||||||||
    g738      ISGTLLVAATLLTGAIGLLKRSLTPASLFLLCALAVSMCHSMLEYPLWYVYFLIPFGLML
                 370       380       390       400       410       420

430       440       450       460       470       480
    m738.pep  FLSPAEASDGIAFKKAANLGILTASAAIFAGLLHLDWTYTRLVNAFSPATDDSAKTLNRK
              |||||||||||||||||||||||||||||||||||||||||||:||||:|||||||||
    g738      FLSPAEASDGIAFKKAANLGILTASAAIFAGLLHLDWTYTRLVNSFSPAADDSAKTLNRK
                 430       440       450       460       470       480

490       500       510       520       530       540
    m738.pep  INELRYISANSPMLSFYADFSLVNFALPEYPETQTWAEEEATLKSLKYRPHSATYRIALYL
              |||||||||||||||||||||||||||||||||||||||||||:|||||||:||||||||
    g738      INELRYISANSPMLSFYADFSLVNFALPEYPETQTWAEEEATLKALKYRPYSATYRIALYL
                 490       500       510       520       530       540

550       560       570       580       590       600
    m738.pep  MRQGKVAEAKQWMRATQSYYPYLMPRYADEIRKLPVWAPLLPELLKDCKAFAAAPGHPEA
              ||||||||||||||||||||||||||||||||||||||||||||||||||||||||||:
    g738      MRQGKVAEAKQWMRATQSYYPYLMPRYADEIRKLPVWAPLLPELLKDCKAFAAAPGHPET
                 550       560       570       580       590       600 m738.pep  KPCKX
              |||||
    g738      KPCKX
```

The following partial DNA sequence was identified in *N. meningitidis* <SEQ ID 2519>:

```
a738.seq
    1    ATGCCCGCTG AAACGACCGT ATCCGGCGCG CACCCCGCCG CCAAACTGCC

51    GATTTACATC CTGCCCTGCT TCCTTTGGAT AGGCATCGTC CCCTTTACCT

101    TTGCGCTCAG GCTGCAACCG TCGCCCGACT TTTACCACGA TGCCGCCGCC

151    GCAGCCGGCC TGATTGTCCT GTTGTTCCTC ACGGCAGGAA AAAAGCTGTT

201    TGATGTCAAA ATCCCACCTA TCAGCTTCCT TCTGTTTGCA ATGGCGGCGT
```

```
-continued
 251  TTTGGTATCT TCAGGCACGC CTGATGAACC TGATTTACCC CGGTATGAAC
 301  GACATCGTCT CTTGGATTTT CATCTTACTC GCCGTCAGCG CGTGGGCCTG
 351  CCGGAGCTTG GTCGCACACT ACGGACAAGA ACGCATCGTT ACCCTGTTTG
 401  CCTGGTCGCT GCTTATCGGC TCCCTGCTTC AATCCTGCAT CGTCGTCATC
 451  CAGTTTGCCG GCTGGGAAGA CACCCCTCTG TTTCAAAACA TCATTGTTTA
 501  CAGCGGGCAA GGCGTAATCG GACACATCGG ACAGCGCAAC AACCTCGGAC
 551  ACTACCTCAT GTGGGGCATA CTCGCCGCCG CCTACCTCAA CGGACAACGA
 601  AAAATCCCGC CGCCTTGGG TGCAATCTGC CTGATTATGC AGACCGCCGT
 651  TTTAGGTTTG GTCAATTCGC GCACCATCTT GACCTACATA GCCGCCATCG
 701  CCCTCATCCT TCCCTTCTGG TATTTCCGTT CGGACAAATC CAACAGGCGG
 751  ACGATACTCG GCATAGCCGC AGCCGTATTC CTTACCGCGC TGTTCCAATT
 801  TTCCATGAAC ACCATTCTGG AAACCTTTAC CGGCATCCGC TACGAAACCG
 851  CCGTCGAACG CGTCGCCAAC GGCGGTTTCA CAGACCTGCC GCGCCAAATC
 901  GAATGGCGCA AAGCCCTCGC CGCCTTCCAG TCCGCCCCGA TATTCGGGCA
 951  CGGCTGGAAC AGTTTTGCCC AACAAACCTT CCTCATCAAT GCCGAACAGC
1001  ACAACATACA CGACAACCTC CTCAGCAACT TGTTCACCCA TTCCCACAAC
1051  ATCGTTCTCC AACTCCTTGC AGAGATGGGG ATCAGCGGCA CGCTTCTGGT
1101  TGCCGCAACC CTGCTGACGG GCATTGCCGG GCTGCTGAAA CGCCCCCTGA
1151  CCCCCGCATC GCTTTTCCTG ATCTGCACAC TTGCCGTCAG TATGTGCCAC
1201  AGTATGCTCG AATATCCTTT GTGGTATGTC TATTTCCTCA TCCCCTTCGG
1251  ACTGATGCTC TTTCTGTCCC CCGCAGAGGC TTCAGACGGC ATCGCCTTCA
1301  AAAAAGCCGC CAATCTCGGC ATACTAACCG CCTCCGCCGC CATATTCGCA
1351  GGATTGCTGC ACTTGGACTG GACATACACC CGGATGGTTA ACGCCTTTTC
1401  CCCCGCCACT GACGACAGTG CCAAAACCCT CAACCGGAAA ATCAACGAGT
1451  TGCGCTATAT TTCCGCAAAC AGTCCGATGC TGTCCTTTTA TGCCGACTTC
1501  TCCCTCGTAA ACTTCGCCCT GCCGGAATAC CCCGAAACCC AGACTTGGGC
1551  GGAAGAAGCA ACCCTCAAAT CACTAAAATA CCGCCCCCAC TCCGCCACCT
1601  ACCGCATCGC CCTCTACCTG ATGCGGCAAG GCAAAGTTGC AGAAGCAAAA
1651  CAATGGATGC GGGCGACACA GTCCTATTAC CCCTACCTGA TGCCCCGATA
1701  CGCCGACGAA ATCCGCAAAC TGCCCGTATG GGCGCCGCTG CTACCCGAAC
1751  TGCTCAAAGA CTGCAAAGCC TTCGCCGCCG CGCCCGGTCA TCCGGAAGCA
1801  AAACCCTGCA AATGA
```

This corresponds to the amino acid sequence <SEQ ID 2520; ORF 738.a>:

```
a738.pep
   1  MPAETTVSGA HPAAKLPIYI LPCFLWIGIV PFTFALRLQP SPDFYHDAAA
  51  AAGLIVLLFL TAGKKLFDVK IPPISFLLFA MAAFWYLQAR LMNLIYPGMN
 101  DIVSWIFILL AVSAWACRSL VAHYGQERIV TLFAWSLLIG SLLQSCIVVI
 151  QFAGWEDTPL FQNIIVYSGQ GVIGHIGQRN NLGHYLMWGI LAAAYLNGQR
 201  KIPPALGAIC LIMQTAVLGL VNSRTILTYI AAIALILPFW YFRSDKSNRR
```

```
-continued

251  TILGIAAAVF LTALFQFSMN TILETFTGIR YETAVERVAN GGFTDLPRQI

301  EWRKALAAFQ SAPIFGHGWN SFAQQTFLIN AEQHNIHDNL LSNLFTHSHN

351  IVLQLLAEMG ISGTLLVAAT LLTGIAGLLK RPLTPASLFL ICTLAVSMCH

401  SMLEYPLWYV YFLIPFGLML FLSPAEASDG IAFKKAANLG ILTASAAIFA

451  GLLHLDWTYT RMVNAFSPAT DDSAKTLNRK INELRYISAN SPMLSFYADF

501  SLVNFALPEY PETQTWAEEA TLKSLKYRPH SATYRIALYL MRQGKVAEAK

551  QWMRATQSYY PYLMPRYADE IRKLPVWAPL LPELLKDCKA FAAAPGHPEA

601  KPCK*
``` a738/m738 98.3% identity in 604 aa overlap

```
                10         20         30         40         50         60
a738.pep  MPAETTVSGAHPAAKLPIYILPCFLWIGIVPFTFALRLQPSPDFYHDAAAAAGLIVLLFL
          |||||||||||||||||||||||||||||||||||:|:||||||||||||||||||||||
m738      MPAETTVSGAHPAAKLPIYILPCFLWIGIVPFTFALKLKPSPDFYHDAAAAAGLIVLLFL
                10         20         30         40         50         60

70         80         90        100        110        120
a738.pep  TAGKKLFDVKIPPISFLLFAMAAFWYLQARLMNLIYPGMNDIVSWIFILLAVSAWACRSL
          ||||||||||||| ||||||||||||||||||||||||||||||||||||||||||||||
m738      TAGKKLFDVKIPAISFLLFAMAAFWYLQARLMNLIYPGMNDIVSWIFILLAVSAWACRSL
                70         80         90        100        110        120

130        140        150        160        170        180
a738.pep  VAHYGQERIVTLFAWSLLIGSLLQSCIVVIQFAGWEDTPLFQNIIVYSGQGVIGHIGQRN
          |||:||||||||||||||||||||||||||||||||||||||||||||||||||||||||
m738      VAHFGQERIVTLFAWSLLIGSLLQSCIVVIQFAGWEDTPLFQNIIVYSGQGVIGHIGQRN
               130        140        150        160        170        180

190        200        210        220        230        240
a738.pep  NLGHYLMWGILAAAYLNGQRKIPPALGAICLIMQTAVLGLVNSRTILTYIAAIALILPFW
          ||||||||||||||||||||||||:|||||||||||||||||||||||||||||||||||
m738      NLGHYLMWGILAAAYLNGQRKIPAALGVICLIMQTAVLGLVNSRTILTYIAAIALILPFW
               190        200        210        220        230        240

250        260        270        280        290        300
a738.pep  YFRSDKSNRRTILGIAAAVFLTALFQFSMNTILETFTGIRYETAVERVANGGFTDLPRQI
          |||||||||||:||||||||||||||||||||||||||||||||||||||||||||||||
m738      YFRSDKSNRRTMLGIAAAVFLTALFQFSMNTILETFTGIRYETAVERVANGGFTDLPRQI
               250        260        270        280        290        300

310        320        330        340        350        360
a738.pep  EWRKALAAFQSAPIFGHGWNSFAQQTFLINAEQHNIHDNLLSNLFTHSHNIVLQLLAEMG
          ||:|||||||||||||||||||||||||||||||||:||||||||||||||||||||||
m738      EWNKALAAFQSAPIFGHGWNSFAQQTFLINAEQHTIYDNFLSTLFTHSHNIILQLLAEMG
               310        320        330        340        350        360

370        380        390        400        410        420
a738.pep  ISGTLLVAATLLTGAIGLLKRPLTPASLFLICTLAVSMCHSMLEYPLWYVYFLIPFGLML
          ||||||||||||||||||||||||||||||||||||||||||||||||||||||||||||
m738      ISGTLLVAATLLTGAIGLLKRPLTPASLFLICTLAVSMCHSMLEYPLWYVYFLIPFGLML
               370        380        390        400        410        420

430        440        450        460        470        480
a738.pep  FLSPAEASDGIAFKKAANLGILTASAAIFAGLLHLDWTYTRMVNAFSPATDDSAKTLNRK
          |||||||||||||||||||||||||||||||||||||||||:||||||||||||||||||
m738      FLSPAEASDGIAFKKAANLGILTASAAIFAGLLHLDWTYTRLVNAFSPATDDSAKTLNRK
               430        440        450        460        470        480

490        500        510        520        530        540
a738.pep  INELRYISANSPMLSFYADFSLVNFALPEYPETQTWAEEATLKSLKYRPHSATYRIALYL
          ||||||||||||||||||||||||||||||||||||||||||||||||||||||||||||
m738      INELRYISANSPMLSFYADFSLVNFALPEYPETQTWAEEATLKSLKYRPHSATYRIALYL
               490        500        510        520        530        540

550        560        570        580        590        600
a738.pep  MRQGKVAEAKQWMRATQSYYPYLMPRYADEIRKLPVWAPLLPELLKDCKAFAAAPGHPEA
          ||||||||||||||||||||||||||||||||||||||||||||||||||||||||||||
m738      MRQGKVAEAKQWMRATQSYYPYLMPRYADEIRKLPVWAPLLPELLKDCKAFAAAPGHPEA
               550        560        570        580        590        600 a738.pep  KPCKX
          |||||
m738      KPCKX
```

The following partial DNA sequence was identified in *N. gonorrhoeae* <SEQ ID 2521>:

```
g739.seq
    1   ATGGCAAAAA AACCGAACAA ACCCTTCAGG CTGACCCCCA AACTCCTGAT
   51   ACGCGCCGTA TTGCTCATCT GTATCACCGC CATCGGCGCA TTGGCAGTAG
  101   GCATCGTCAG CACATTCAAC CCGAACGGCG ACAAAACCCT CCAAACCGAA
  151   CCGCAACACA CCGACAGCCC CCGCGAAACC GAATTCTGGC TGCCAAACGG
  201   CGCCGTCGGA CAAGATGCCG CCCAACCCGA ACACCACCAC GCCGCCTCAT
  251   CCGAACCCGC ACAGCCGGAC GGCACAGAAG AAAGCGGCAG CGGACTGCCG
  301   TCCCCTGCCG CACCCAAGAA AAACCGGGTc AAACCGCGCC CTTCGGATGC
  351   GGCCCGGGCA GCCGATTCGT TAACCGGCAC CGGAACACAA GCTGAAAACA
  401   CACTCAAAGA AACCCCCGTA CTGCCCACAA ACGCCCCCCA TCCCGAACCC
  451   CGAAAAGAAA CACCCGAAAA ACAGGCGCAG CCCAAAGAAA CACCCAAAGA
  501   AAAAGAAACG CCCAAAGAAA ACCATACCAA ACCGGACACC CGAAAAACA
  551   CGCCGGCCAA ACCCCATAAA GAGATTCTCG ACAACCTCTT TTGA
```

This corresponds to the amino acid sequence <SEQ ID 2522; ORF 739>:

```
g739.pep
    1   MAKKPNKPFR LTPKLLIRAV LLICITAIGA LAVGIVSTFN PNGDKTLQTE
   51   PQHTDSPRET EFWLPNGAVG QDAAQPEHHH AASSEPAQPD GTEESGSGLP
  101   SPAAPKKNRV KPRPSDAARA ADSLTGTGTQ AENTLKETPV LPTNAPHPEP
  151   RKETPEKQAQ PKETPKEKET PKENHTKPDT PKNTPAKPHK EILDNLF*
```

The following partial DNA sequence was identified in *N. meningitidis* <SEQ ID 2523>:

```
m739.seq
    1   ATGGCAAAAA AACCGAACAA ACCCTTCAGG CTGACCCCCA AACTCCTGAT
   51   ACGCGCCGTA TTGCTCATCT GTATCGCCGC CATCGGCGCA TTGGCAATAG
  101   GCATCGTCAG CACATTCAAC CCGAACGGCG ACAAAACCCT TCAAGCCGAA
  151   CCGCAACACA CCGACAGCCC CCGCGAAACC GAATTCTGGC TGCCAAACGG
  201   CGTAGTCGGA CAAGATGCCG CCCAACCCGA ACACCACCAC GCCGCCTCAT
  251   CCGAACCCGC ACAGCCGGAC GGCACAGACG AAAGCGGCAG CGGACTGCCG
  301   TCCCCTGCCG CACCCAAGAA AAACCGGGTC AAACCGCAAC CTGCCGACAC
  351   AGCTCAAACC GACAGGCAGC CGGACGACGC CGGAACACAA GCTGAAAACA
  401   CACTCAAAGA AACCCCCGTA CTGCCCACAA ACGTCCCCCG TCCCGAACCC
  451   CGAAAAGAAA CACCCGAAAA ACAGGCGCAG CCCAAAGAAA CGCCCAAAGA
  501   AAACCATACC AAACCGGACA CCCCGAAAAA CACGCCGCCC AAACCCCATA
  551   AAGAAATTCT CGACAAACTC TTC
```

This corresponds to the amino acid sequence <SEQ ID 2524; ORF 739>:

```
m739.pep
    1   MAKKPNKPFR LTPKLLIRAV LLICIAAIGA LAIGIVSTFN PNGDKTLQAE
   51   PQHTDSPRET EFWLPNGVVG QDAAQPEHHH AASSEPAQPD GTDESGSGLP
```

```
101   SPAAPKKNRV KPQPADTAQT DRQPDDAGTQ AENTLKETPV LPTNVPRPEP

151   RKETPEKQAQ PKETPKENHT KPDTPKNTPP KPHKEILDKL F
```

Computer analysis of the amino acid sequences gave the following results:
Homology with a Predicted ORF from *N. meningitidis* menA with menB
ORF 739 shows 86.3% identity over a 197 aa overlap with a predicted ORF (ORF739.a) from *N. gonorrhoeae*:

```
m739/g739
                      10         20         30         40         50         60
    m739.pep  MAKKPNKPFRLTPKLLIRAVLLICIAAIGALAIGIVSTFNPNGDKTLQAEPQHTDSPRET
              |||||||||||||||||||||||:||||||:|||||||||||||||||||:||||||||
    g739      MAKKPNKPFRLTPKLLIRAVLLICITAIGALAVGIVSTFNPNGDKTLQTEPQHTDSPRET
                      10         20         30         40         50         60

70         80         90        100        110        120
    m739.pep  EFWLPNGVVGQDAAQPEHHHAASSEPAQPDGTDESGSGLPSPAAPKKNRVKPQPADTAQT
              ||||||||:||||||||||||||||||||||||:||||||||||||||||||||:|:|::
    g739      EFWLPNGAVGQDAAQPEHHHAASSEPAQPDGTEESGSGLPSPAAPKKNRVKPRPSDAARA
                      70         80         90        100        110        120

130        140        150        160              170
    m739.pep  DRQPDDAGTQAENTLKETPVLPTNVPRPEPRKETPEKQAQPKETPKE------NHTKPDT
              :   :||||||||||||||||||||:|:||||||||||||||||||      ||||||
    g739      ADSLTGTGTQAENTLKETPVLPTNAPHPEPRKETPEKQAQPKETPKEKETPKENHTKPDT
                     130        140        150        160        170        180

180        190
    m739.pep  PKNTPPKPHKEILDKLF
              |||||  |||||||:||
    g739      PKNTPAKPHKEILDNLFX
                     190
```

The following partial DNA sequence was identified in *N. meningitidis* <SEQ ID 2525>:

```
a739.seq
    1   ATGGCAAAAA AACCGAACAA ACCCTTCAGG CTGACCCCCA AACTCCTGAT

51   ACGCGCCGTA TTGCTCATCT GTATCACCGC CATCGGCGCA TTGGCAATAG

101   GCATCGTCAG CACATTCAAC CCGAACGGCG ACAAAACCCT CCAAACCGAA

151   CCGCAACACA CCGACAGCCC CCGCGAAACC GAATTCTGGC TGCCAAACGG

201   CGTAGTCGGA CAAGATGCCG CCCAACCCGA ACACCACCAC GCCTCCTCAT

251   CCGCACCCGC ACAGCCGGAC GGCACAGACG AAAGCGGCAG CGGACTGCCG

301   TCCCCTGCCG CACCCAAGAA AAACCGGGTC AAACCGCAAC CTGCCGACAC

351   AGCTCAAACC GACAGGCAGC CGGACGACGC CGGAGCACAA GCTGAAAACA

401   CACTCAAAGA AACCCCCGTA CTGCCCACAA ACGTCCCCCG TCCCGAACCC

451   CGAAAAGAAA CACCCGAAAA ACAGGCACAG CCCAAAGAAA CACCCAAAGA

501   AAAAGAAACG CCCAAAGAAA ACCATACCAA ACCGGACACC CCGAAAAACA

551   CGCCGCCTAA ACCCCATAAA GAAATTCTCG ACAACCTCTT CTGA
```

This corresponds to the amino acid sequence <SEQ ID 2526; ORF 739.a>:

```
a739.pep
    1   MAKKPNKPFR LTPKLLIRAV LLICITAIGA LAIGIVSTFN PNGDKTLQTE

51   PQHTDSPRET EFWLPNGVVQ QDAAQPEHHH ASSSAPAQPD GTDESGSGLP

101   SPAAPKKNRV KPQPADTAQT DRQPDDAGAQ AENTLKETPV LPTNVPRPEP

151   RKETPEKQAQ PKETPKEKET PKENHTKPDT PKNTPPKPHK EILDNLF*
``` a739/m739 93.9% identity in 197 aa overlap

```
                10         20         30         40         50         60
a739.pep  MAKKPNKPFRLTPKLLIRAVLLICITAIGALAIGIVSTFNPNGDKTLQTEPQHTDSPRET
          ||||||||||||||||||||||||:|||||||||||||||||||||||:|||||||||||
m739      MAKKPNKPFRLTPKLLIRAVLLICIAAIGALAIGIVSTFNPNGDKTLQAEPQHTDSPRET
                10         20         30         40         50         60

70         80         90        100        110        120
a739.pep  EFWLPNGVVGQDAAQPEHHHASSSAPAQPDGTDESGSGLPSPAAPKKNRVKPQPADTAQT
          |||||||||||||||||||||||:||||||||||||||||||||||||||||||||||||
m739      EFWLPNGVVGQDAAQPEHHHAASSEPAQPDGTDESGSGLPSPAAPKKNRVKPQPADTAQT
                70         80         90        100        110        120

130        140        150        160        170        180
a739.pep  DRQPDDAGAQAENTLKETPVLPTNVPRPEPRKETPEKQAQPKETPKEKETPKENHTKPDT
          |||||||:||||||||||||||||||||||||||||||||||||||      ||||||||
m739      DRQPDDAGTQAENTLKETPVLPTNVPRPEPRKETPEKQAQPKETPK------ENHTKPDT
               130        140        150        160        170

190
a739.pep  PKNTPPKPHKEILDNLFX
          ||||||||||||||:||
m739      PKNTPPKPHKEILDKLF
               180        190
```

The following partial DNA sequence was identified in *N. gonorrhoeae* <SEQ ID 2527>:

```
g740.seq
    1   ATGTCCCGAA ACCTGCTTGT CCGCTGGCTC GCCGTCTGCC TCATCCCCTT

51   GgcgACGCTT GCCGTTTTCG CCGCCAATcc gcCCGAAGAC AAACCCCAGC

101   ATCTGATCAA CGGCATCATC CTTGCCTGCG AAGCGACGTT TTTGTTTAAa 151   ttcgtgctCT TTGAAACCAT CAAGCATCAT CTTAaacaag gGTTTGATTT 201   GAAACgtcaa ACCATGTTTC TGTTTATTCC GATTGTTTTG CTGGTTGTGT 251   ATTTGTTCCA CTATTTCGGC GCGTTTTag
```

This corresponds to the amino acid sequence <SEQ ID 2528; ORF 740.ng>:

```
g740.pep
    1   MSRNLLVRWL AVCLIPLATL AVFAANPPED KPQHLINGII LACEATFLFK

51   FVLFETIKHH LKQGFDLKRQ TMFLFIPIVL LVVYLFHYFG AF*
```

The following partial DNA sequence was identified in *N. meningitidis* <SEQ ID 2529>:

```
m740.seq
    1   ATGTCCCGAA ACCTGCTTGT CCGCTGGCTT GCCGTCTGCC TCATCCCGTT

51   GGCGACGCTT GCCGTTTTCG CCGCCAATCC GCCCGAAGAC AAACTCCAGC

101   ATCTGATCAA CGGCATCATC CTTGCCTGCG AAGCGACGTT TTTGTTTAAA

151   TTCGTCCTTT TCGACACCAT CAAGCATCAT TTGAAACAAG AGTTTGATTT

201   GAAACGTCAA ACTATGTTGC TGTTTATTCC GATTATTTTG CTGATTGTGT

251   ATTTGTTCCA CTATTTTGGC GCGTTTTAG
```

This corresponds to the amino acid sequence <SEQ ID 2530; ORF 740>:

```
m740.pep
    1   MSRNLLVRWL AVCLIPLATL AVFAANPPED KLQHLINGII LACEATFLFK

51   FVLFDTIKHH LKQEFDLKRQ TMLLFIPIIL LIVYLFHYFG AF*
``` m740/g740 93.5% identity in 92 aa overlap

```
                  10         20         30         40         50         60
     m740.pep  MSRNLLVRWLAVCLIPLATLAVFAANPPEDKLQHLINGIILACEATFLFKFVLFDTIKHH
               ||||||||||||||||||||||||||||||  ||||||||||||||||||||||| ||||
     g740      MSRNLLVRWLAVCLIPLATLAVFAANPPEDKPQHLINGIILACEATFLFKFVLFETIKHH
                  10         20         30         40         50         60

70         80         90
     m740.pep  LKQEFDLKRQTMLLFIPIILLIVYLFHYFGAFX
               ||| ||||||||| ||||| || ||||||||||
     g740      LKQGFDLKRQTMFLFIPIVLLVVYLFHYFGAFX
                  70         80         90
```

The following partial DNA sequence was identified in *N. meningitidis* <SEQ ID 2531>:

```
a740.seq
    1   ATGTCCCGAA ACCTGCTTGT CCGCTGGCTT GTCGTCTGCC TGATACCCTT

51   GGCGACGCTT GCCGTTTTCG CCGCCAATCC GCCCGAAGAC AAACCCCAGC

101   ATCTGATTAA CGGCATCATC CTTGCCTGCG AAGCGACGTT TTTGTTCAAA

151   TTCGTCCTTT TCGACACCAT CAAGCATCAT TTGAAACAAG AGTTTGATTT

201   GAAACGTCAA ACTATGTTGC TGTTTATTCC GATTATTTTG CTGATTGTGT

251   ATTTGTTCCA CTATTTTGGC GCGTTTTAG
```

This corresponds to the amino acid sequence <SEQ ID 2532; ORF 740.a>:

```
a740.pep
    1   MSRNLLVRWL VVCLIPLATL AVFAANPPED KPQHLINGII LACEATFLFK

51   FVLFDTIKHH LKQEFDLKRQ TMLLFIPIIL LIVYLFHYFG AF*
``` a740/m740 97.8% identity in 92 aa overlap

```
                  10         20         30         40         50         60
     a740.pep  MSRNLLVRWLVVCLIPLATLAVFAANPPEDKPQHLINGIILACEATFLFKFVLFDTIKHH
               ||||||||||:||||||||||||||||||| ||||||||||||||||||||||||||||
     m740      MSRNLLVRWLAVCLIPLATLAVFAANPPEDKLQHLINGIILACEATFLFKFVLFDTIKHH
                  10         20         30         40         50         60

70         80         90
     a740.pep  LKQEFDLKRQTMLLFIPIILLIVYLFHYFGAFX
               ||||||||||||||||||||||||||||||||
     m740      LKQEFDLKRQTMLLFIPIILLIVYLFHYFGAFX
                  70         80         90
```

The following partial DNA sequence was identified in *N. gonorrhoeae* <SEQ ID 2533>:

```
g741.seq
    1   GTGAACCGAA CTACCTTCTG CTGCCTTTCT TTGACCGCCG GCCCTGATTC

51   TGACCGCCTG CAGCAGCGGA GGGGCGGAGG CGGTGGTGTC GCCGCCGACA

101   TCGGCACGGG GCTTGCCGAT GCATTAACCG CGCCGCTCGA CCATAAAGAC

151   AAAGGTTTGA ATCCCTAAC ATTGGAAGCC TCCATTCCCC AAAACGGAAC

201   ACTGACCCTG TCGGCACAAG GTGCGGAAAA AACTTTCAAA GCCGGCGGCA

251   AAGACAACAG CCTCAACACG GGCAAACTGA AGAACGACAA AATCAGCCGC

301   TTCGACTTCG TGCAAAAAAT CGAAGTGGAC GGACAAACCA TCACACTGGC

351   AAGCGGCGAA TTTCAAATAT ACAAACAGGA TCACTCCGcc gtcgtTgcCC
```

-continued

```
   401   TacgGATTGA AAAAATCAAC AACCCCGACA AAATCGACAG CCTGATAAAC
   451   CAACGCTCCT TCCTTGTCAG CGATTTGGGC GGAGAACATA CCGCCTTCAA
   501   CCAACTGCCT GACGGCAAAG CCGAGTATCA CGGCAAAGCA TTCAGCTCCG
   551   ACGATGCCGA CGGAAAACTG ACCTATACCA TAGATTTCGC CGCCAAACAG
   601   GGACACGGCA AAATCGAACA CCTGAAAACA CCCGAGCAGA ATGTTGAGCT
   651   TGCCTCCGCC GAACTCAAAG CAGATGAAAA ATCACACGCC GTCATTTTGG
   701   GCGACACGCG CTACGGCGGC GAAGAGAAAG CACTTACCG CCTCGCCCTT
   751   TTCGGCGACC GCGCCCAAGA AATCGCTGGC TCGGCAACCG TGAAGATAGG
   801   GGAAAAGGTT CACGAAATCG GCATCGCCGA CAAACAGTAG
```

This corresponds to the amino acid sequence <SEQ ID 2534; ORF 741.ng>:

```
g741.pep
     1   VNRTTFCCLS LTAGPDSDRL QQRRGGGGGV AADIGTGLAD ALTAPLDHKD
    51   KGLKSLTLEA SIPQNGTLTL SAQGAEKTFK AGGKDNSLNT GKLKNDKISR
   101   FDFVQKIEVD GQTITLASGE FQIYKQDHSA VVALRIEKIN NPDKIDSLIN
   151   QRSFLVSDLG GEHTAFNQLP DGKAEYHGKA FSSDDADGKL TYTIDFAAKQ
   201   GHGKIEHLKT PEQNVELASA ELKADEKSHA VILGDTRYGG EEKGTYRLAL
   251   FGDRAQEIAG SATVKIGEKV HEIGIADKQ*
```

The following partial DNA sequence was identified in *N. meningitidis* <SEQ ID 2535>:

```
m741.seq
     1   GTGAATCGAA CTGCCTTCTG CTGCCTTTCT CTGACCACTG CCCTGATTCT
    51   GACCGCCTGC AGCAGCGGAG GGGGTGGTGT CGCCGCCGAC ATCGGTGCGG
   101   GGCTTGCCGA TGCACTAACC GCACCGCTCG ACCATAAAGA CAAAGGTTTG
   151   CAGTCTTTGA CGCTGGATCA GTCCGTCAGG AAAAACGAGA AACTGAAGCT
   201   GGCGGCACAA GGTGCGGAAA AAACTTATGG AAACGGTGAC AGCCTCAATA
   251   CGGGCAAATT GAAGAACGAC AAGGTCAGCC GTTTCGACTT TATCCGCCAA
   301   ATCGAAGTGG ACGGGCAGCT CATTACCTTG GAGAGTGGAG AGTTCCAAGT
   351   ATACAAACAA AGCCATTCCG CCTTAACCGC CTTTCAGACC GAGCAAATAC
   401   AAGATTCGGA GCATTCCGGG AAGATGGTTG CGAAACGCCA GTTCAGAATC
   451   GGCGACATAG CGGGCGAACA TACATCTTTT GACAAGCTTC CCGAAGGCGG
   501   CAGGGCGACA TATCGCGGGA CGGCGTTCGG TTCAGACGAT GCCGGCGGAA
   551   AACTGACCTA CACCATAGAT TTCGCCGCCA AGCAGGGAAA CGGCAAAATC
   601   GAACATTTGA AATCGCCAGA ACTCAATGTC GACCTGGCCG CCGCCGATAT
   651   CAAGCCGGAT GGAAAACGCC ATGCCGTCAT CAGCGGTTCC GTCCTTTACA
   701   ACCAAGCCGA GAAAGGCAGT TACTCCCTCG GTATCTTTGG CGGAAAAGCC
   751   CAGGAAGTTG CCGGCAGCGC GGAAGTGAAA ACCGTAAACG GCATACGCCA
   801   TATCGGCCTT GCCGCCAAGC AATAA
```

This corresponds to the amino acid sequence <SEQ ID 2536; ORF 741>:

```
m741.pep
  1   VNRTAFCCLS LTTALILTAC SSGGGGVAAD IGAGLADALT APLDHKDKGL

51   QSLTLDQSVR KNEKLKLAAQ GAEKTYGNGD SLNTGKLKND KVSRFDFIRQ

101   IEVDGQLITL ESGEFQVYKQ SHSALTAFQT EQIQDSEHSG KMVAKRQFRI

151   GDIAGEHTSF DKLPEGGRAT YRGTAFGSDD AGGKLTYTID FAAKQGNGKI

201   EHLKSPELNV DLAAADIKPD GKRHAVISGS VLYNQAEKGS YSLGIFGGKA

251   QEVAGSAEVK TVNGIRHIGL AAKQ*
``` m741/g741 61.4% identity in 280 aa overlap

```
                      10           20        30        40        50
m741.pep      VNRTAFCCLSLTT---ALILTACSSGGGGVAADIGAGLADALTAPLDHKDKGLQSLTLDQ
              ||||:|||||||:   :  |    :||||||||||:|||||||||||||||||:||||:
g741          VNRTTFCCLSLTAGPDSDRLQQRRGGGGGVAADIGTGLADALTAPLDHKDKGLKSLTLEA
                      10        20        30        40        50        60

60        70           80        90       100       110
m741.pep      SVRKNEKLKLAAQGAEKTY---GNGDSLNTGKLKNDKVSRFDFIRQIEVDGQLITLESGE
              |: :|  | |:|||||||:   |: :|||||||||||:|||||:::|||||| ||| |||
g741          SIPQNGTLTLSAQGAEKTFKAGGKDNSLNTGKLKNDKISRFDFVQKIEVDGQTITLASGE
                      70        80        90       100       110       120

120       130       140       150       160       170
m741.pep      FQVYKQSHSALTAFQTEQIQDSEHSGLMVAKRQFRIGDIAGEHTSFDKLPEGGRATYRGT
              ||:|||:|||::|:: |:|:: ::  ::: :|:| ::|::||||:|::||:| :| |:|
g741          FQIYKQDHSAVVALRIEKINNPDKIDSLINQRSFLVSDLGGEHTAFNQLPDG-KAEYHGK
                     130       140       150       160       170

180       190       200       210       220       230
m741.pep      AFGSDDAGGKLTYTIDFAAKQGNGKIEHLKSPELNVDLAAADIKPDGKRHAVISGSVLYN
              ||:|||| ||||||||||||||:|||||||:|| ||:||:|::| | | |||| |:: |:
g741          AFSSDDADGKLTYTIDFAAKQGHGKIEHLKTPEQNVELASAELKADEKSHAVILGDTRYG
            180       190       200       210       220       230

240       250       260       270
m741.pep      QAEKGSYSLGIFGGKAQEVAGSAEVKTVNGIRHIGLAAKQX
                |||:| |::|| :|||:|||| ||  : :::||:| |||
g741          GEEKGTYRLALFGDRAQEIAGSATVKIGEKVHEIGIADKQX
            240       250       260       270       280
```

The following partial DNA sequence was identified in *N. meningitidis* <SEQ ID 2537>:

```
a741.seq
  1   GTGAACCGAA CTGCCTTCTG CTGCCTTTCT TTGACCGCCG CCCTGATTCT

51   GACCGCCTGC AGCAGCGGAG GCGGCGGTGT CGCCGCCGAC ATCGGCGCGG

101   TGCTTGCCGA TGCACTAACC GCACCGCTCG ACCATAAAGA CAAAAGTTTG

151   CAGTCTTTGA CGCTGGATCA GTCCGTCAGG AAAAACGAGA AACTGAAGCT

201   GGCGGCACAA GGTGCGGAAA AAACTTATGG AAACGGCGAC AGCCTCAATA

251   CGGGCAAATT GAAGAACGAC AAGGTCAGCC GCTTCGACTT TATCCGTCAA

301   ATCGAAGTGG ACGGGCAGCT CATTACCTTG GAGAGCGGAG AGTTCCAAGT

351   GTACAAACAA AGCCATTCCG CCTTAACCGC CCTTCAGACC GAGCAAGTAC

401   AAGATTCGGA GCATTCAGGG AAGATGGTTG CGAAACGCCA GTTCAGAATC

451   GGCGATATAG CGGGTGAACA TACATCTTTT GACAAGCTTC CCGAAGGCGG

501   CAGGGCGACA TATCGCGGGA CGGCATTCGG TTCAGACGAT GCCAGTGGAA

551   AACTGACCTA CACCATAGAT TTCGCCGCCA AGCAGGGACA CGGCAAAATC

601   GAACATTTGA AATCGCCAGA ACTCAATGTT GACCTGGCCG CCTCCGATAT

651   CAAGCCGGAT AAAAAACGCC ATGCCGTCAT CAGCGGTTCC GTCCTTTACA

701   ACCAAGCCGA GAAAGGCAGT TACTCTCTAG GCATCTTTGG CGGGCAAGCC
```

```
751  CAGGAAGTTG CCGGCAGCGC AGAAGTGGAA ACCGCAAACG GCATACGCCA

801  TATCGGTCTT GCCGCCAAGC AGTAA
```

This corresponds to the amino acid sequence <SEQ ID 2538; ORF 741.a>:

```
a741.pep
    1  VNRTAFCCLS LTAALILTAC SSGGGGVAAD IGAVLADALT APLDHKDKSL

51  QSLTLDQSVR KNEKLKLAAQ GAEKTYGNGD SLNTGKLKND KVSRFDFIRQ

101  IEVDGQLITL ESGEFQVYKQ SHSALTALQT EQVQDSEHSG KMVAKRQFRI

151  GDIAGEHTSF DKLPEGGRAT YRGTAFGSDD ASGKLTYTID FAAKQGHGKI

201  EHLKSPELNV DLAASDIKPD KKRHAVISGS VLYNQAEKGS YSLGIFGGQA

251  QEVAGSAEVE TANGIRHIGL AAKQ*
``` a741/m741 95.6% identity in 274 aa overlap

```
                  10        20        30        40        50        60
    a741.pep  VNRTAFCCLSLTAALILTACSSGGGVAADIGAVLADALTAPLDHKDKSLQSLTLDQSVR
              ||||||||||||:|||||||||||||||||| ||||||||||||||||:||||||||||
    m741      VNRTAFCCLSLTTALILTACSSGGGGVAADIGAGLADALTAPLDHKDKGLQSLTLDQSVR
                  10        20        30        40        50        60

70        80        90       100       110       120
    a741.pep  KNEKLKLAAQGAEKTYGNGDSLNTGKLKNDKVSRFDFIRQIEVDGQLITLESGEFQVYKQ
              ||||||||||||||||||||||||||||||||||||||||||||||||||||||||||||
    m741      KNEKLKLAAQGAEKTYGNGDSLNTGKLKNDKVSRFDFIRQIEVDGQLITLESGEFQVYKQ
                  70        80        90       100       110       120

130       140       150       160       170       180
    a741.pep  SHSALTALQTEQVQDSEHSGKMVAKRQFRIGDIAGEHTSFDKLPEGGRATYRGTAFGSDD
              ||||||:||||:||||||||||||||||||||||||||||||||||||||||||||||||
    m741      SHSALTAFQTEQIQDSEHSGKMVAKRQFRIGDIAGEHTSFDKLPEGGRATYRGTAFGSDD
                 130       140       150       160       170       180

190       200       210       220       230       240
    a741.pep  ASGKLTYTIDFAAKQGHGKIEHLKSPELNVDLAASDIKPDKKRHAVISGSVLYNQAEKGS
              |:||||||||||||||:|||||||||||||||||:|||||:|||||||||||||||||||
    m741      AGGKLTYTIDFAAKQGNGKIEHLKSPELNVDLAAADIKPDGKRHAVISGSVLYNQAEKGS
                 190       200       210       220       230       240

250       260       270
    a741.pep  YSLGIFGGQAQEVAGSAEVETANGIRHIGLAAKQX
              ||||||||:|||||||||||:|:||||||||||||
    m741      YSLGIFGGKAQEVAGSAEVKTKNGIRHIGLAAKQX
                 250       260       270
``` g742.seq not found yet
g742.pep not found yet
The following partial DNA sequence was identified in *N. meningitidis* <SEQ ID 2539>:

```
m742.seq
    1  ATGGTTTACG GCATTGCCGA AGCCGATGCG GGCGACAGCA GTGTGCTTAC

51  TTTGGGCGGC ATGTATCAGA AGAGTAGGGA GGTTCCTGAT TTTTCGGGCA

101  TTATTTTGCC CTGTGAAAAT CAGAAAACTG CCCCGTTCAG TTCAACGCCT

151  GCCTGCAACC GGCCTTTGCA ACTGCCGCGC AACACTTATT TGGGGGAGGA

201  TTGGTCGCGG TTAAGTGCCG ACAAATACAA CCTTTTCTCA GGATTCAAAC

251  ATGTGTTTGA CAACGGTTGG CAGCTCAATG CCGAAGTGTC TTATACCAAG

301  AATGAATCCG ATGCGAAGGT GGGGCAGTTT TTTCTGAAAA ACGAATATGC

351  GGCGGGTTTG TCGGGTGAGG ATGCGGTAGG CTTTTTGACT GAAAAAACG

401  AAGTCATCCC GTTCGAGCCG AAAGATAAGG CATTGGAGAA ACTGAAAGCA
```

-continued

```
 451  TATCGTGATG AAACCGCCAA GGAATACCGG GAGCGCAAAG ACGATTTTGT
 501  TAAAAACCGT TTCGATAATA CTGCTTTCGA ACAGTATCGC AGCCGCCGTG
 551  CCGCAGAACG CAAAGCCGGT TTTGACAAGT GTATGAGTGA CCCTTTCGCG
 601  CTGGACTTTA TCTGTCAAGG TTCTTGGGGG GATCCGGGCG TTGATGCCGA
 651  CAAGGCGGAA TTTGTCGATA AGCCCTTGC GAAGGAGGGC ATCTTTAATA
 701  ATGCGGCACA ACGTTTTCCA AACAGCCTGT ATGACTCTTC CTTTAATCGG
 751  AAGGCTACCG CCAACCGACG ATACAGTTAT ATGCCGTTGC GGCATACCAA
 801  AGACGACCGC CAATGGGGAA TTAAACTTGA CCTGACCGGC ACATATGGGC
 851  TGTTCGGGCG GGAGCATGAT TTCTTTGTCG GCTATGCCTA CGGTGATGAA
 901  AAGATACGTT CGGAATATCT AGAAATCTAC GAACGCCGCT ACAGAGTACG
 951  TCCGAATACG GGGCAACGC ACGGCGTGTA TGCGGGAAGT TGTCAGGAGG
1001  AGCCGGACGG CGATTTGTCG TCTCCTTTGG TCAGGGGCA TAAAGAACCC
1051  GATTGGCAGG CGTACGATGA AAAAGGCAAC CGTACCGTTT ATGCCGAAGA
1101  ATGCAGGAAC GCCAAGAAAA TAAAAACCGA GCCCAAGCTC GATGCCGAAG
1151  GCAAGCAGGT GTATTACTAT GACGAATACA GCGGCAGCCG ACACCGGTA
1201  TATGTCGATG TATATGAGCT GGACGAAAAA GGCAACAAGA TTCAGGAGAC
1251  CAATCCCGAC GGCACGCCTG CCTTTACCGG TTTTTCCGGT ACGGTGCCGG
1301  TTTGGAAAAC CGTCAAAGTG GCAGACGACC ATGTTCCTGC GCTGTATAAC
1351  TACGCCAAAT ACCTCAACAC CAACAAAACC CATTCGCTGA CTGCCAGCAC
1401  GCGTTTCAAC GTAACCGGCC GACTGCACCT TTTGGGCGGG CTGCACTACA
1451  CGCGCTATGA GACTTCGCAA ACCAAAGATA TGCCTGTCCG CTATGGGCAG
1501  CCGGCAAGCG ATTTTCAGAC GGCATCGAGC ATTAGGGCGG ATCAGGACCA
1551  TTACACGGCC AAGATGCAAG GTCATAAATT GACGCCCTAT GCAGGCATTA
1601  CCTATGACTT GACACCGCAA CAGAGTATTT ACGGAAGTTA TACCAAAATC
1651  TTCAAACAGC AGGATAATGT CGATGTCAGT GCCAAAACCG TTTTACCGCC
1701  TTTGGTCGGC ACAAACTATG AGGTAGGCTG GAAAGGCGCG TTCTTGCAAG
1751  GACGGCTGAA TGCTTCGTTC GCATTGTTTT ACCTCGAACA GAAAAACCGC
1801  ACGGTCGTCG ATTTCGGCTA TGTTCCCGGA GCAGGCGGCA AGCAGGGGTC
1851  GTTCCAAACC GTTGCCAAAC CGATAGGCAA AGTGGTCAGC AGGGGTGCGG
1901  AATTCGAGTT GTCGGGTGAG TTGAACGAAG ATTGGAAAGT CTTTGCGGGT
1951  TACACCTACA ACAAGAGCCG CTACAAAAAC GCCGCCGAAG TCAACGCCGA
2001  ACGCCTTGCC AAAAATTCCA GTGCAGACCC GTACAACTTC AGCAATTTCA
2051  CACCCGTGCA CATATTCCGT TTCGGAACGA GCTTCCATAT ACCGAATACG
2101  GGGCTGACCG TCGGCGGCGG CGTGTCCGCA CAAAGCGGCA CAAGCAGTCT
2151  GTATAACATC AGGCAGGGCG GCTACGGGCT GATAGACGGT TTCGTCCGTT
2201  ACGAATTGGG CAAACACGCC AAATTGAGCC TCATCGGTAC GAACTTAAAC
2251  GGACGCACTT ATTTTGAGAA CAACTACAAC CGTACGCGCG GCGCAAACAA
2301  CTTCTACGGA GAGCCGCGCA CTGTCAGCAT GAAACTGGAT TGGCAGTTTT
2351  AA
```

This corresponds to the amino acid sequence <SEQ ID 2540; ORF 742>:

```
m742.pep
     1  MVYGIAEADA GDSSVLTLGG MYQKSREVPD FSGIILPCEN QKTAPFSSTP
    51  ACNRPLQLPR NTYLGEDWSR LSADKYNLFS GFKHVFDNGW QLNAEVSYTK
   101  NESDAKVGQF FLKNEYAAGL SGEDAVGFLT EKNEVIPFEP KDKALEKLKA
   151  YRDETAKEYR ERKDDFVKNR FDNTAFEQYR SRRAAERKAG FDKCMSDPFA
   201  LDFICQGSWG DPGVDADKAE FVDKALAKEG IFNNAAQRFP NSLYDSSFNR
   251  KATANRRYSY MPLRHTKDDR QWGIKLDLTG TYGLFGREHD FFVGYAYGDE
   301  KIRSEYLEIY ERRYRVRPNT GATHGVYAGS CQEEPDGDLS SPLVRGHKEP
   351  DWQAYDEKGN RTVYAEECRN AKKIKTEPKL DAEGKQVYYY DEYSGSRTPV
   401  YVDVYELDEK GNKIQETNPD GTPAFTGFSG TVPVWKTVKV ADDHVPALYN
   451  YAKYLNTNKT HSLTASTRFN VTGRLHLLGG LHYTRYETSQ TKDMPVRYGQ
   501  PASDFQTASS IRADQDHYTA KMQGHKLTPY AGITYDLTPQ QSIYGSYTKI
   551  FKQQDNVDVS AKTVLPPLVG TNYEVGWKGA FLQGRLNASF ALFYLEQKNR
   601  TVVDFGYVPG AGGKQGSFQT VAKPIGKVVS RGAEFELSGE LNEDWKVFAG
   651  YTYNKSRYKN AAEVNAERLA KNSSADPYNF SNFTPVHIFR FGTSFHIPNT
   701  GLTVGGGVSA QSGTSSLYNI RQGGYGLIDG FVRYELGKHA KLSLIGTNLN
   751  GRTYFENNYN RTRGANNFYG EPRTVSMKLD WQF*
```

The following partial DNA sequence was identified in *N. meningitidis* <SEQ ID 2541>:

```
a742.seq
     1  ATGGTTTACG GCATTGCCGA AGCCGATGCG GGCGACAGCA GTGTGCTTAC
    51  TTTGGGCGGC ATGTATCAGA AGAGTAGGGA GGTTCCTGAT TTTTCGGGCA
   101  TTATTTTGTC CTGTGAAAAT CAGAAAACTG CCCCGTTCAG TTCAACGCCT
   151  GCCTGCAACC GGCCTTTGCA ACTGCCGCGC AACACTTATT TGGGGGAGGA
   201  TTGGTCGCGG TTGAGTGCTG ACAAATACAA CCTTTTCTCA GGTTTCAAAC
   251  ATGTGTTTGA CAACGGTTGG CAGCTCAATG CCGAAGTGTC TTATACCAAG
   301  AATGAATCCG ATGCGAAGGT GGGGCAGTTT TTTCTGAAAA ACGAACATGC
   351  GGCGGGTTTG TCAGATGAGG ATGCGGTAGG CTTTTTGACC GAAAAAAACG
   401  AAGTCATCCC GTTCGAGCCG AAAGATAAGG CATTGGAGAA ACTGAAAGCA
   451  TATCGTGACG AAACCGCCAA GGAATACCGT GAGCGCAAAG ACGATTTTGT
   501  TAAAAACCGT TTCGATAATA CTGCTTTCGA GCAGTACCGC AGCCGCCGTG
   551  CCGCAGAACG CAAAGCCGGT TTTGACGAGT GTATGAGTGC CCCTTTTGCG
   601  CTGGACTTTA TCTGTCAAGG TTCTTGGGGG GATCCGGGTG TTGATGCCGA
   651  CAAGTCGGAA TTTGTCGATA AAGCCCTTGC GAAGGAAGGC ATCTTTAATA
   701  ATGCGGCACA ACGTTTTCCA AACAGCCTGT ATGACTCTTC CTTTAATCGG
   751  AAGGCTACCG CCAACCGACG ATACAGTTAT ATGCCGTTGC GGCATACCAA
   801  AGACGACCGC CAATGGGGAA TTAAACTTGA CCTGACCGGC ACATATGGGC
   851  TGTTCGGGCG GGAGCATGAT TTCTTTGTCG GCTATGCCTA CGGCGATGAA
   901  AAGATACGTT CCGAATATCT GGAAATCTAC GAACGCCGCC ACAGAGTACG
   951  TCCGAATACA GGGGCAACGC ACGGCGTGTA TGCGGGAAGT TGTCAGGGGG
  1001  AGCCGGACGG TGATTTGTCT TCTCCTTTGG TCAGGGGGCA TAAAGAACCC
```

```
1051  GATTGGCAGG CGTACGATGA AAAAGGCAAC CGTACCGTTT ATGCCGAAGA

1101  ATGCAGGAAT GCCAAGAAAA TAAAAACCGA GCCCAAGCTC GATGCCGAAG

1151  GCAAGCAGGT GTATTACTAT GACGAATACA GCGGCAGCCG GACGCCAGTA

1201  TATGTCGATG TATATGAACT GGATGAAAAA GGCAATAAGA TTCAGGAGAC

1251  CAATCCCGAC GGCACGCCTG CCTTTACCGG TTTTTCCGGT ACGGTGCCGG

1301  TTTGGAAAAC CGTCAAAGTG GCCGACGACC ATGTTCCTGC GCTGTATAAC

1351  TACGCCAAAT ACCTCAACAC CAACAAAACC CATTCGCTGA CTGCCGGCAC

1401  GCGTTTCAAC GTAACCGGCC GACTGCATCT TTTGGGCGGG CTGCACTACA

1451  CGCGCTATGA AACCTCGCAA ACCAAGATA TGCCTGTCCG CTATGGGCAG

1501  CCGGCAAGCG ATTTTCAGAC GGCATCGAGC ATTAAGGCGG ATCAGGACCA

1551  TTATACGGCC AAGATGCAAG GTCATAAATT GACGCCCTAT GCAGGCATTA

1601  CCTATGATTT GACACCGCAA CAGAGTATTT ACGGAAGTTA TACCAAAATC

1651  TTCAAACAGC AGGATAATGT CGATGTCAGT GCCAAAACCG TTTTACCGCC

1701  TTTGGTCGGC ACAAACTATG AGGTAGGCTG GAAAGGCGCG TTCTTGCAAG

1751  GACGGCTGAA TGCTTCGTTC GCATTGTTTT ACCTCGAACA GAAAAACCGC

1801  ACGGTCGTCG ATTTGGCTA TGTTCCCGGA GCAGGCGGCA AGCAGGGGTC

1851  GTTCCAAACC GTTGCCAAAC CGATAGGCAA AGTGGTCAGC AGGGGTGCGG

1901  AATTCGAGTT GTCGGGTGAG TTGAACGAAG ATTGGAAAGT CTTTGCGGGT

1951  TACACCTACA ACAAGAGCCG CTACAAAAAC GCCGCCGAAG TCAACGCCGA

2001  ACGCCTCGCC AAAAACACAG GCGCAGACCC GTACAACTTC AGCAATTTCA

2051  CACCCGTGCA CATATTCCGT TTCGGAACGA GCTTCCATAT ACCGAATACG

2101  GGGCTGACCG TCGGCGGCGG CGTGTCCGCA CAAAGCGGCA CAAGCAGTCT

2151  GTATAACATC AGGCAGGGCG GCTACGGGCT GATAGACGGT TTCGTCCGTT

2201  ACGAATTGGG CAAACACGCT AAATTGAGCC TCATCGGTAC GAACTTAAAC

2251  GGACGCACTT ATTTTGAGAA CAACTACAAC CGTACGCGCG GCGCAAACAA

2301  CTTCTATGGA GAGCCGCGCA CTGTCAGCAT GAAACTGGAT TGGCAGTTTT

2351  AA
```

This corresponds to the amino acid sequence <SEQ ID 2542; ORF 742.a>:

```
a742.pep
  1   MVYGIAEADA GDSSVLTLGG MYQKSREVPD FSGIILSCEN QKTAPFSSTP

51   ACNRPLQLPR NTYLGEDWSR LSADKYNLFS GFKHVFDNGW QLNAEVSYTK

101   NESDAKVGQF FLKNEHAAGL SDEDAVGFLT EKNEVIPFEP KDKALEKLKA

151   YRDETAKEYR ERKDDFVKNR FDNTAFEQYR SRRAAERKAG FDECMSAPFA

201   LDFICQGSWG DPGVDADKSE FVDKALAKEG IFNNAAQRFP NSLYDSSFNR

251   KATANRRYSY MPLRHTKDDR QWGIKLDLTG TYGLFGREHD FFVGYAYGDE

301   KIRSEYLEIY ERRHRVRPNT GATHGVYAGS CQGEPDGDLS SPLVRGHKEP

351   DWQAYDEKGN RTVYAEECRN AKKIKTEPKL DAEGKQVYYY DEYSGSRTPV

401   YVDVYELDEK GNKIQETNPD GTPAFTGFSG TVPVWKTVKV ADDHVPALYN

451   YAKYLNTNKT HSLTAGTRFN VTGRLHLLGG LHYTRYETSQ TKDMPVRYGQ
```

-continued

```
501  PASDFQTASS IKADQDHYTA KMQGHKLTPY AGITYDLTPQ QSIYGSYTKI

551  FKQQDNVDVS AKTVLPPLVG TNYEVGWKGA FLQGRLNASF ALFYLEQKNR

601  TVVDFGYVPG AGGKQGSFQT VAKPIGKVVS RGAEFELSGE LNEDWKVFAG

651  YTYNKSRYKN AAEVNAERLA KNTGADPYNF SNFTPVHIFR FGTSFHIPNT

701  GLTVGGGVSA QSGTSSLYNI RQGGYGLIDG FVRYELGKHA KLSLIGTNLN

751  GRTYFENNYN RTRGANNFYG EPRTVSMKLD WQF*
``` a742/m742 98.5% identity in 783 aa overlap

```
                10         20         30         40         50         60
a742.pep  MVYGIAEADAGDSSVLTLGGMYQKSREVPDFSGIILSCENQKTAPFSSTPACNRPLQLPR
          |||||||||||||||||||||||||||||||||| ||||||||||||||||||||||||
m742      MVYGIAEADAGDSSVLTLGGMYQKSREVPDFSGIILPCENQKTAPFSSTPACNRPLQLPR
                10         20         30         40         50         60

70         80         90        100        110        120
a742.pep  NTYLGEDWSRLSADKYNLFSGFKHVFDNGWQLNAEVSYTKNESDAKVGQFFLKNEHAAGL
          |||||||||||||||||||||||||||||||||||||||||||||||||||||:||||
m742      NTYLGEDWSRLSADKYNLFSGFKHVFDNGWQLNAEVSYTKNESDAKVGQFFLKNEYAAGL
                70         80         90        100        110        120

130        140        150        160        170        180
a742.pep  SDEDAVGFLTEKNEVIPFEPKDKALEKLKAYRDETAKEYRERKDDFVKNRFDNTAFEQYR
          | ||||||||||||||||||||||||||||||||||||||||||||||||||||||||
m742      SGEDAVGFLTEKNEVIPFEPKDKALEKLKAYRDETAKEYRERKDDFVKNRFDNTAFEQYR
               130        140        150        160        170        180

190        200        210        220        230        240
a742.pep  SRRAAERKAGFDECMSAPFALDFICQGSWGDPGVDADKSEFVDKALAKEGIFNNAAQRFP
          ||||||||||||:|||||:|||||||||||||||||:|||||||||||||||||||||
m742      SRRAAERKAGFDKCMSDPFALDFICQGSWGDPGVDADKAEFVDKALAKEGIFNNAAQRFP
               190        200        210        220        230        240

250        260        270        280        290        300
a742.pep  NSLYDSSFNRKATANRRYSYMPLRHTKDDRQWGIKLDLTGTYGLFGREHDFFVGYAYGDE
          ||||||||||||||||||||||||||||||||||||||||||||||||||||||||||
m742      NSLYDSSFNRKATANRRYSYMPLRHTKDDRQWGIKLDLTGTYGLFGREHDFFVGYAYGDE
               250        260        270        280        290        300

310        320        330        340        350        360
a742.pep  KIRSEYLEIYERRHRVRPNTGATHGVYAGSCQGEPDGDLSSPLVRGHKEPDWQAYDEKGN
          |||||||||||||:||||||||||||||||||:|||||||||||||||||||||||||
m742      KIRSEYLEIYERRYRVRPNTGATHGVYAGSCQEEPDGDLSSPLVRGHKEPDWQAYDEKGN
               310        320        330        340        350        360

370        380        390        400        410        420
a742.pep  RTVYAEECRNAKKIKTEPKLDAEGKQVYYYDEYSGSRTPVYVDVYELDEKGNKIQETNPD
          ||||||||||||||||||||||||||||||||||||||||||||||||||||||||||
m742      RTVYAEECRNAKKIKTEPKLDAEGKQVYYYDEYSGSRTPVYVDVYELDEKGNKIQETNPD
               370        380        390        400        410        420

430        440        450        460        470        480
a742.pep  GTPAFTGFSGTVPVWKTVKVADDHVPALYNYAKYLNTNKTHSLTAGTRFNVTGRLHLLGG
          |||||||||||||||||||||||||||||||||||||||||||:|||||||||||||||
m742      GTPAFTGFSGTVPVWKTVKVADDHVPALYNYAKYLNTNKTHSLTASTRFNVTGRLHLLGG
               430        440        450        460        470        480

490        500        510        520        530        540
a742.pep  LHYTRYETSQTKDMPVRYGQPASDFQTASSIKADQDHYTAKMQGHKLTPYAGITYDLTPQ
          |||||||||||||||||||||||||||||||:||||||||||||||||||||||||||
m742      LHYTRYETSQTKDMPVRYGQPASDFQTASSIRADQDHYTAKMQGHKLTPYAGITYDLTPQ
               490        500        510        520        530        540

550        560        570        580        590        600
a742.pep  QSIYGSYTKIFKQQDNVDVSAKTVLPPLVGTNYEVGWKGAFLQGRLNASFALFYLEQKNR
          ||||||||||||||||||||||||||||||||||||||||||||||||||||||||||
m742      QSIYGSYTKIFKQQDNVDVSAKTVLPPLVGTNYEVGWKGAFLQGRLNASFALFYLEQKNR
               550        560        570        580        590        600

610        620        630        640        650        660
a742.pep  TVVDFGYVPGAGGKQGSFQTVAKPIGKVVSRGAEFELSGELNEDWKVFAGYTYNKSRYKN
          ||||||||||||||||||||||||||||||||||||||||||||||||||||||||||
m742      TVVDFGYVPGAGGKQGSFQTVAKPIGKVVSRGAEFELSGELNEDWKVFAGYTYNKSRYKN
               610        620        630        640        650        660

670        680        690        700        710        720
a742.pep  AAEVNAERLAKNTGADPYNFSNFTPVHIFRFGTSFHIPNTGLTVGGGVSAQSGTSSLYNI
          ||||||||||::|||||||||||||||||||||||||||||||||||||||||||||||
m742      AAEVNAERLAKNSSADPYNFSNFTPVHIFRFGTSFHIPNTGLTVGGGVSAQSGTSSLYNI
               670        680        690        700        710        720
```

```
                    730        740        750        760        770        780
a742.pep  RQGGYGLIDGFVRYELGKHAKLSLIGTNLNGRTYFENNYNRTRGANNFYGEPRTVSMKLD
          ||||||||||||||||||||||||||||||||||||||||||||||||||||||||||||
m742      RQGGYGLIDGFVRYELGKHAKLSLIGTNLNGRTYFENNYNRTRGANNFYGEPRTVSMKLD
                    730        740        750        760        770        780 a742.pep  WQFX
          ||||
m742      WQFX
``` a742 (SEQ ID 2542)/p25184 (SEQ ID 4167)

```
sp|P25184|PUPA_PSEPU FERRIC-PSEUDOBACTIN 358 RECEPTOR PRECURSOR
>gI|94923|pir|S15169
ferric-pseudobactin receptor precursor - Pseudomonas putida >gi|45723
(X56605) pseudobactin uptake protein [Pseudomonas putida]Length = 819
Score = 152 bits (381), Expect = 6e-36
Identities = 110/356 (30%), Positives = 170/356 (46%),
Gaps = 55/356 (15%)
Query: 436 KTVKVADDHV-PALYNYAKYLNTNKTHSLTAGTRFNVTGRLHLLGGLHYTRYETSQTKDM    494
           +T K  DD + P +      +Y +N+      +RFN+T LHL+ G    + Y
Sbjct: 511 QTPKPGDDEIIPGIQYNISNRQSGYFVASRFNLTDDLHLILGARASNYRFDYAL--       564

Query: 495 PVRYGQPASDFQTASSIKADQDHYTAKMQGHKLTPYAGITYDLTPQQSIYGSYTKIFKQQ    554
             R G    + ++          ++     +TPYAGI YDLT +QS+Y SYT IFK Q
Sbjct: 565 -WRIGNEPAPYKM-------------VERGVVTPYAGIVYDLTNEQSVYASYTDIFKPQ    609

Query: 555 DNVDVSAKTVLPPLVGTNYEVGWKGAFLQGRLNASFALFYLEQKNRTVVDFGYVPGAGGK    614
           +NVD++ K  L P VG NYE+GWKG FL+GRLNA+ AL+ +++ N       VP +GG
Sbjct: 610 NNVDITGKP-LDPEVGKNYELGWKGEFLEGRLNANIALYMVKRDNLAESTNEVVPDSGGL    668

Query: 615 QGSFQTVAKPIGKVVSRGAEFELSGELNEDWKVFAGYTYNKSRYKNAAEVNAERLAKNTG    674
             S      + +     ++G + ELSGE+    W VF GY++ ++
Sbjct: 669 IAS-----RAVDGAETKGVDVELSGEVLPGWNVFTGYSHTRTE----------------D    707

Query: 675 ADPYNFSNFTPVHIFRFGTSFHIPN--TGLTVGGGVSAQSGTS---SLYN--IRQGGYGL    727
           AD    + P+ FRF ++ +P    LT+GGGV+ S ++   + YN + Q Y +
Sbjct: 708 ADGKRLTPQLPMDTFRFWNTYRLPGEWEKLTLGGGVNWNSKSTLNFARYNSHVTQDDYFV    767

Query: 728 IDGFVRYELGKHAKLSLIGTNLNGRTYFENNYNRTRGANNFYGEPRTVSMKLDWQF       783
              RY + +  +L  N+ + Y   Y      G+   YG PR ++ L + F
Sbjct: 768 TSLMARYRINESLAATLNVNNIFDKKY----YAGMAGSYGHYGAPRNATVTLRYDF       819
``` g743.seq not found yet
g743.pep not found yet

The following partial DNA sequence was identified in *N. meningitidis* <SEQ ID 2543>:

```
m743.seq
    1   ATGAATCAAA ATCATTTTTC ACTTAAAATT CTGACCGTTA TGCTGTTATC

51   GGCTTACGGT GGTTCTTTTG CAGACGGTGT TGTGCCTGTT TCAGACGGCA

101   ATACCGTCAG TCTGGATACG GTCAATGTAC GCGGCTCTCA TGCTTTGTTG

151   GGCAAGACCG AAAAGACCCG TTCTTATACG ATAGATCGGA TGTCCACCGC

201   CACAGGTATG AGGATTGCGG GCAAGGATAC GCCGCAGTCG GTCAGCGTCA

251   TCACGCGCAG CCGCCTTGAC GATAAGGCGG TGCATACGCT TGAAGAGGCA

301   ATGAAAAACA CGACGGGTGT CAACGTTGTG CGCGATTCAG GCTTGCAGAC

351   GCGGTTTTTG TCACGCGGTT TCTATATTGA TCAGATTGGT GAAGACGGTA

401   TGACCGTCAA TGTTGCAGGC CGTTCGGGAT ATACGGCGAA AATCGACGTG

451   TCTCCGAGTA CCGATTTGGC GGTTTATGAC CATATTGAAG TTGTACGGGG

501   TGCAACGGGG TTGACCCAAT CCAATTCAGA GCCGGGAGGA ACCGTCAATT

551   TGATCCGTAA GTGA
```

This corresponds to the amino acid sequence <SEQ ID 2544; ORF 743>:

```
m743.pep
    1   MNQNHFSLKI LTVMLLSAYG GSFADGVVPV SDGNTVSLDT VNVRGSHALL

51   GKTEKTRSYT IDRMSTATGM RIAGKDTPQS VSVITRSRLD DKAVHTLEEA

101   MKNTTGVNVV RDSGLQTRFL SRGFYIDQIG EDGMTVNVAG RSGYTAKIDV

151   SPSTDLAVYD HIEVVRGATG LTQSNSEPGG TVNLIRK*
```

The following partial DNA sequence was identified in *N. meningitidis* <SEQ ID 2545>:

```
a743.seq
    1   ATGAATCAAA ATCATTTTTC ACTTAAAATT CTGACCGTTA TGCTGTTATC

51   GGCTTACGGT GGTTCTTTTG CAGACGGTGT TGTGCCTGTT TCAGACGGCA

101   ATACCGTCAG TTTGGATACG GTCAATGTAC GCGGCTCTCA TGCTCTGTCG

151   GGCAAGACCG AGAAGACCCG TTCTTATACG ATAGATCGGA TGTCCACCGC

201   CACAGGTATG AGGATTGCGG GCAAGGATAC GCCGCAGTCG GTCAGCGTCA

251   TCACGCGCAG CCGCCTTGAC GATAAGGCGG TGCATACGCT TGAAGAGGCA

301   ATGAAAAACA CGACGGGTGT CAACGTTGTG CGCGATTCAG GCTTGCAGAC

351   GCGGTTTTTG TCACGCGGTT TCTATATTGA TCAGATTGGT GAAGACGGTA

401   TTACCGTCAA TGTTGCAGGC CGTTCGGGAT ATACGGCGAA AATCGACGTG

451   TCTCCGAGTA CCGATTTGGC GGTTTATGAC CATATTGAAG TTGTACGGGG

501   TGCAACGGGG TTGACCCAAT CCAATTCAGA GCCGGGTGGA ACCGTCAATT

551   TGATCCGTAA GCGA
```

This corresponds to the amino acid sequence <SEQ ID 2546; ORF 743.a>:

```
a743.pep
    1   MNQNHFSLKI LTVMLLSAYG GSFADGVVPV SDGNTVSLDT VNVRGSHALS

51   GKTEKTRSYT IDRMSTATGM RIAGKDTPQS VSVITRSRLD DKAVHTLEEA

101   MKNTTGVNVV RDSGLQTRFL SRGFYIDQIG EDGITVNVAG RSGYTAKIDV

151   SPSTDLAVYD HIEVVRGATG LTQSNSEPGG TVNLIRKR
``` a743/m743 98.9% identity in 187 aa overlap

```
                    10         20         30         40         50         60
      a743.pep  MNQNHFSLKILTVMLLSAYGGSFADGVVPVSDGNTVSLDTVNVRGSHALSGKTEKTRSYT
                |||||||||||||||||||||||||||||||||||||||||||||||| |||||||||||
      m743      MNQNHFSLKILTVMLLSAYGGSFADGVVPVSDGNTVSLDTVNVRGSHALLGKTEKTRSYT
                    10         20         30         40         50         60

70         80         90        100        110        120
      a743.pep  IDRMSTATGMRIAGKDTPQSVSVITRSRLDDKAVHTLEEAMKNTTGVNVVRDSGLQTRFL
                ||||||||||||||||||||||||||||||||||||||||||||||||||||||||||||
      m743      IDRMSTATGMRIAGKDTPQSVSVITRSRLDDKAVHTLEEAMKNTTGVNVVRDSGLQTRFL
                    70         80         90        100        110        120

130        140        150        160        170        180
      a743.pep  SRGFYIDQIGEDGITVNVAGRSGYTAKIDVSPSTDLAVYDHIEVVRGATGLTQSNSEPGG
                ||||||||||||| ||||||||||||||||||||||||||||||||||||||||||||||
      m743      SRGFYIDQIGEDGMTVNVAGRSGYTAKIDVSPSTDLAVYDHIEVVRGATGLTQSNSEPGG
                   130        140        150        160        170        180 a743.pep  TVNLIRKR
                |||||||
      m743      TVNLIRKX
``` g744.seq not found yet
g744.pep not found yet
The following partial DNA sequence was identified in *N. meningitidis* <SEQ ID 2547>:

```
m744.seq
    1   ATGAAACCGT TAAAAACATT AGAATTTGGA TTTGTGGATG CTGCAAACTA
   51   CAGAAGAAGA GAAAATAAAG ATTTATTTAA CCGAATATTT GTAAAAGGAG
  101   AATATTTGGA TGAATTATGT GAACCAAATA TTTCGTTTTT AATCGGAGAA
  151   AAGGGAACTG GAAAGACAGC ATATGCTGTT TATTTAACTA ATAACTTCTA
  201   TAAAAACATA CATGCCACTA CTAAGTTTGT TCGTGAAACC GATTATTCAA
  251   AATTTATTCA GCTAAAGAAA GCAAGACACT TAACTGTTTC AGATTTTACA
  301   AGTATTTGGA AAGTCATTTT ATATCTGTTG ATATCAAATC AAATCAAATG
  351   TAAAGAAAAC GGAATATTAT CTTCAATATT TAATAAATTT AAAGCCTTAG
  401   ATGAGGCTAT AAATGAATAT TATTATGGCG CTTTTGATCC GGAAATTGTA
  451   CAAGCAATAA CTTTAATAGA AAATTCAAAA GAAGCTGCGG AAATGATTTT
  501   TGGAAAATTT GTTAAACTAG GTGAAGAGGA ATCCCAACAA ATAACTTTTA
  551   CAGAAAGTAA ATTCCAAGCA AATTTAGGTT TTATTGAAAG AAAATTTAAA
  601   GATGCTTTAT CTCAGTTAAA GCTAAAGAT AATCATATTT TGTTTATTGA
  651   TGGGATAGAT ATTAGACCAT CACAGATTCC ATTTGATGAA TATCATGAGT
  701   GTGTAAAAGG TCTTGCTAAC GCCATATGGA TGTTAAATAA TGATATCTTC
  751   CCTTCCATTA AAGATAGTAA GGGAAGGATG AGAGTTGTGT TATTGATTAG
  801   ACCTGATATC TTTGATTCAT TAGGTTTACA AAATCAAAAT ACCAAACTTC
  851   AAGATAATTC AGTATTTTTA GACTGGAGGA CGGATTATAA ATCTTATAGA
  901   AGTTCAAAGA TTTTTGGCGT TTTTGATCAT CTTTTGAGAA CCCAGCAAGA
  951   AAAACAAGAT AGTTTAGAAA AAGGCAACTC ATGGGATTAT TATTTTCCAT
 1001   GGAATGCTCC TAATTTACAT GATGAGTATA AAAATTTAAC TTCATTTATT
 1051   AGCTTCCTAA GAAAATCGTA TTATCGACCT CGCGATATTC TTCAGATGCT
 1101   TACTTTGCTA CAAAAAAATA AGAAAAGTAA GGAAGATTAT GTCGTAGCAG
 1151   AAGATTTTGA TAATACTTCT TTTCAAAGAG AATACTCGAT ATATTTACTT
 1201   GGTGAAATCA AAGATCATCT TTTGTTTTAT TATAGTCAAA GTGATTATCA
 1251   AAATTTCCTG AAATTTTTTG AATTTTTAAA CGGGAAAGAT AGATTTAAAT
 1301   ATAGTGATTT TTTAAAAGCA TTTGAACGTT TGAAAAAGCA CTTACAAACA
 1351   ACATCAGTGG AAATACCTAA ATTTATGAGT ACTGCTAATG AGTTTTTGCA
 1401   ATTTTTATTT GACTTGAATG TTATTGCTTA TTTAGATAAC CCAGAAGATG
 1451   AAACGAAACC ATATATCCAT TGGTGCTTTA AGATAGAAA TTATGCAAAT
 1501   ATTTCTCCTA AAATAAAAAC TGAAACTGAA TATTTAATAT TTTCAGGATT
 1551   ATCAAAAGCC CTTGATGTTG GTACTCCATT TAAGAACAAA CAGTAA
```

This corresponds to the amino acid sequence <SEQ ID 2548; ORF 744>:

```
m744.pep
    1   MKPLKTLEFG FVDAANYRRR ENKDLFNRIF VKGEYLDELC EPNISFLIGE
   51   KGTGKTAYAV YLTNNFYKNI HATTKFVRET DYSKFIQLKK ARHLTVSDFT
```

```
-continued
101  SIWKVILYLL  ISNQIKCKEN  GILSSIFNKF  KALDEAINEY  YYGAFDPEIV

151  QAITLIENSK  EAAEMIFGKF  VKLGEEESQQ  ITFTESKFQA  NLGFIERKFK

201  DALSQLKLKD  NHILFIDGID  IRPSQIPFDE  YHECVKGLAN  AIWMLNNDIF

251  PSIKDSKGRM  RVVLLIRPDI  FDSLGLQNQN  TKLQDNSVFL  DWRTDYKSYR

301  SSKIFGVFDH  LLRTQQEKQD  SLEKGNSWDY  YFPWNAPNLH  DEYKNLTSFI

351  SFLRKSYYRP  RDILQMLTLL  QKNKKSKEDY  VVAEDFDNTS  FQREYSIYLL

401  GEIKDHLLFY  YSQSDYQNFL  KFFEFLNGKD  RFKYSDFLKA  FERLKKHLQT

451  TSVEIPKFMS  TANEFLQFLF  DLNVIAYLDN  PEDETKPYIH  WCFKDRNYAN

501  ISPKIKTETE  YLIFSGLSKA  LDVGTPFKNK  Q*
``` g745.seq not found yet
g745.pep not found yet
The following partial DNA sequence was identified in *N. meningitidis* <SEQ ID 2549>:

```
m745.seq
    1  ATGTTTTGGC  AACTGACCGT  TGTTTCAGTA  ACCGCCGTCA  TTGCACTGGG

51  GACAATATTC  ATCAATAAGA  AAACTTCAAA  GCAAAAGGCG  ACATTAGATG

101  TTATTTTGAA  TGATTACCAA  GATGCACAAT  TTGTAGAAGC  CGACAATCAT

151  ATTTCGCCTT  ATATTCGCGG  CACGGCAGTT  GACGACAACA  ACGCGCGGAT

201  CGACCTGTAT  GAAATTTATC  AAAATAAGGG  CGGACAATGG  GAAAAGAGA

251  GAGGGCATTT  ACTTACCGTA  ATCAATCGGC  ACGAGTTTTA  TGCGTGCGCA

301  ATCAACTCGG  GAGTATTGGA  TGAGGATTTG  TTTAAACGGC  TGCATTGCAC

351  CAACTTCATA  AAATTGTGGA  ATGCAGTTTC  GCCTCTTGTT  ATGAAAATAC

401  GCGAAGAAGA  ACGCAAAGAC  ACAATATTTA  GAGAGTTGGA  AATTTTGGTT

451  GCATTATGGA  AAGCAAACCC  CCTAAAGGCA  TCTGATTTGT  GA
```

This corresponds to the amino acid sequence <SEQ ID 2550; ORF 745>:

```
m745.pep
    1  MFWQLTVVSV  TAVIALGTIF  INKKTSKQKA  TLDVILNDYQ  DAQFVEADNH

51  ISPYIRGTAV  DDNNARIDLY  EIYQNKGGQW  EKERGHLLTV  INRHEFYACA

101  INSGVLDEDL  FKRLHCTNFI  KLWNAVSPLV  MKIREEERKD  TIFRELEILV

151  ALWKANPLKA  SDL*
``` a745.seq not found yet
a745.pep not found yet
The following partial DNA sequence was identified in *N. gonorrhoeae* <SEQ ID 2551>:

```
g746.seq
    1  ATGTCCGAAA  ACAAACAAAA  CGAAGTCCTG  ACCGGTTACG  AACAGCTGAA

51  ACGGCGCAAC  CGCCGCCGCC  TCGTAACGGC  AAGCTCCCTG  GTTGCCGCCT

101  CCTGCATCCT  GCTGGCAGCC  GCACTCAGTT  CCGATCCTGC  CGACAGCAAT

151  CCCGCACCGC  AGGCCGGCGA  AACCGGCGCA  ACGGAAAGCC  AAACGGCAAA

201  CACGGCACAA  ACCCCTGCCT  TGAAATCCGC  CGCCGAAAAC  GGGGAAACCG

251  CCGCCGACAA  ACCGCAGGAC  TTGGCAGGCG  AAGACAAGCC  TTCTGCCGCC
```

-continued

```
 301    GACAGCGAAA TCAGCGAGCC TGAAAACGTA GGCGCGCCGC TGGTGCTGAT

351    TAACGACCGG CTCGAAGACA GCAACATCAA AGGTTTGGAA GAATCCGAGA

401    AACTGCAACA GGCAGAAACC GCCAAAACCG AACCGAAGCA GGCAAAACAA

451    CGCGCTGCCG AAAAAGTGTC GGCAACTGCC GACAGTACGG ATACGGTAGC

501    GGTTGAAAAA CCGAAACGCA CTGCCGAACC CAAACCGCAA AAAGCGGAAC

551    GCACTGCCGA AGCCAAGCCC AAAGCCAAAG AAACCAAAAC CGCCGAAAAA

601    GTTGCCGACA AACCGAAAAC TGCTGCCGAA AAACCAAAC CGGATACGGC

651    AAAATCCGAC AGCGCGGTAA AGAAGCGAA AAAAGCCGAC AAGGCTGAAG

701    GCAAAAGAC AGCCGAAAAA GACCGTTCGG ACGGCAAAAA ACACGAAACG

751    GCGCAAAAAA CCGACAAAGC GGACAAAACC AAAACCGCCG AGAAGGAAAA

801    ATCCGGCAAG GCGGGCAAAA AAGCCGCCAT TCAGGCAGGT TATGCCGAAA

851    AAGAACGCGC CTTGAGCCTC CAGCGCAAAA TGAAGGCGGC GGGTATCGAT

901    TCGACCATCA CCGAAATCAT GACCGACAAC GGCAAAGTTT ACCGCGTCAA

951    ATCAAGCAAC TATAAAAACG CAAGGGATGC CGAACGCGAT TTGAACAAAC

1001    TGCGCGTGCA CGGCATCGCC GGCCAGGTAA CGAATGAATA G
```

This corresponds to the amino acid sequence <SEQ ID 2552; ORF 746.ng>:

```
g746.pep
   1    MSENKQNEVL TGYEQLKRRN RRRLVTASSL VAASCILLAA ALSSDPADSN

51    PAPQAGETGA TESQTANTAQ TPALKSAAEN GETAADKPQD LAGEDKPSAA

101    DSEISEPENV GAPLVLINDR LEDSNIKGLE ESEKLQQAET AKTEPKQAKQ

151    RAAEKVSATA DSTDTVAVEK PKRTAEPKPQ KAERTAEAKP KAKETKTAEK

201    VADKPKTAAE KTKPDTAKSD SAVKEAKKAD KAEGKKTAEK DRSDGKKHET

251    AQKTDKADKT KTAEKEKSGK AGKKAAIQAG YAEKERALSL QRKMKAAGID

301    STITEIMTDN GKVYRVKSSN YKNARDAERD LNKLRVHGIA GQVTNE*
```

The following partial DNA sequence was identified in N. meningitidis <SEQ ID 2553>:

```
m746.seq
   1    ATGTCCGAAA ACAAACAAAA CGAAGTCCTG AGCGGTTACG AACAACTCAA

51    ACGGCGCAAC CGCCGCCGCC TCGTAACGGC AAGTTGCCTG GTTGCCGCCT

101    CCTGCATCCT GCTGGCAGCC GCCCTCAGTT CCGGCCCTGC CGAACAGACT

151    GCCGGCGAAA CAAGCGGCGT AGAAAACAAA GCGGCAGGTG CGGCACAAAC

201    CCCTGCCTTG AAATCCGCCG CCGACAAACC GCAGGACTTG CAGGCGAAG

251    ACAAGCCTTC TGCCGCCGAC AGCGAAATCA GCGAGCCTGA AAACGTAGGC

301    GCGCCGCTGG TGCTGATTAA CGAGCGCCTC GAAGACAGCA ACATCAAAGG

351    TTTGGAAGCA TCCGAGAAAC TGCAACAGGC AGAAACCGCC AAAACCGCAC

401    CGAAGCAGGC AAAACAACGC GCTGCCGAAA AGTGCCGGC AACTGCCGAC

451    AGTACGGATA CGGTAGCGGT TGAAAACCG AAACGCACTG CCGAAACAAA

501    ACCGCAAAAA GCGGAACGCA CTGCCAAAGC CAAGCCCAAA GCCAAGAAAA

551    CCAAAACCGC CGAAAAGTT GCCGACAAAC CGAAAACTGC CGCCGAAAAA
```

-continued

```
601  ACCAAACCGG ATACGGCAAA ATCCGACAGC GCGGTAAAAG AAGCGAAAAA
651  AGCCGACAAG GCTGAAAGCA AAAAAACAGC CGAAAAAGAC CGTTCGGACG
701  GCAAAAAACA CGAAACGGCA CAAAAACCG  ACAAAGCGGA CAAGACCAAA
751  ACCGCCGAGA AGGAAAAATC CGGTAAAAAA GCCGCCATTC AGGCAGGTTA
801  TGCCGAAAAA GAACGCGCCT TAAGCCTCCA GCGCAAAATG AAGGCGGCGG
851  GTATCGATTC GACCATCACC GAAATTATGA CCGACAACGG CAAAGTTTAC
901  CGCGTCAAAT CAAGCAACTA TAAAAACGCA AGGGATGCCG AACGCGATTT
951  GAACAAATTG CGCGTACACG GTATCGCCGG TCAGGTAACG AATGAATAG
```

This corresponds to the amino acid sequence <SEQ ID 2554; ORF 746>:

```
m746.pep
  1  MSENKQNEVL SGYEQLKRRN RRRLVTASCL VAASCILLAA ALSSGPAEQT
 51  AGETSGVENK AAGAAQTPAL KSAADKPQDL AGEDKPSAAD SEISEPENVG
101  APLVLINERL EDSNIKGLEA SEKLQQAETA KTAPKQAKQR AAEKVPATAD
151  STDTVAVEKP KRTAETKPQK AERTAKAKPK AKETKTAEKV ADKPKTAAEK
201  TKPDTAKSDS AVKEAKKADK AESKKTAEKD RSDGKKHETA QKTDKADKTK
251  TAEKEKSGKK AAIQAGYAEK ERALSLQRKM KAAGIDSTIT EIMTDNGKVY
301  RVKSSNYKNA RDAERDLNKL RVHGIAGQVT NE*
```

Computer analysis of this amino acid sequence gave the following results:
Homology with a Predicted ORF from *N. gonorrhoeae*
ORF 746 shows 89.9% identity over a 346 aa overlap with a predicted ORF (ORF 746) from *N. gonorrhoeae*:
m746/g746 89.9% identity in 346 aa overlap

```
                 10        20        30        40        50
m746.pep MSENKQNEVLSGYEQLKRRNRRRLVTASCLVAASCILLAAALSSGPAEQT----AGETSG
         ||||||||||:||||||||||||||||||:|||||||||||||||||::::    ||||::
g746     MSENKQNEVLTGYEQLKRRNRRRLVTASSLVAASCILLAAALSSDPADSNPAPQAGETGA
                 10        20        30        40        50        60

60        70        80        90       100       109
m746.pep VENKAAGAAQTPALKSAA-------DKPQDLAGEDKPSAADSEISEPENVGAPLVLINER
         :|:::|::|||||||||||       ||||||||||||||||||||||||||||||||:|
g746     TESQTANTAQTPALKSAAENGETAADKPQDLAGEDKPSAADSEISEPENVGAPLVLINDR
                 70        80        90       100       110       120

110       120       130       140       150       160       169
m746.pep LEDSNIKGLEASEKLQQAETAKTAPKQAKQRAAEKVPATADSTDTVAVEKPKRTAETKPQ
         ||||||||||  |||||||||||||  |||||||||||| ||||||||||||||||| ||
g746     LEDSNIKGLEESEKLQQAETAKTEPKQAKQRAAEKVSATADSTDTVAVEKPKRTAEPKPQ
                 130       140       150       160       170       180

170       180       190       200       210       220       229
m746.pep KAERTAKAKPKAKETKTAEKVADKPKTAAEKTKPDTAKSDSAVKEAKKADKAESKKTAEK
         |||||:|||||||||||||||||||||||||||||||||||||||||||||:||||||
g746     KAERTAEAKPKAKETKTAEKVADKPKTAAEKTKPDTAKSDSAVKEAKKADKAEGKKTAEK
                 190       200       210       220       230       240

230       240       250       260       270       280
m746.pep DRSDGKKHETAQKTDKADKTKTAEKEKSGK---KAAIQAGYAEKERALSLQRKMKAAGID
         |||||||||||||||||||||||||||||||   |||||||||||||||||||||||||
g746     DRSDGKKHETAQKTDKADKTKTAEKEKSGKAGKKAAIQAGYAEKERALSLQRKMKAAGID
                 250       260       270       280       290       300

290       300       310       320       330
m746.pep STITEIMTDNGKVYRVKSSNYKNARDAERDLNKLRVHGIAGQVTNEX
         |||||||||||||||||||||||||||||||||||||||||||||||
g746     STITEIMTDNGKVYRVKSSNYKNARDAERDLNKLRVHGIAGQVTNEX
                 310       320       330       340
```

The following partial DNA sequence was identified in *N. meningitidis* <SEQ ID 2555>:

```
a746.seq
     1  ATGTCCGAAA ACAAACAAAA CGAAGTCCTG AGCGGTTACG AACAACTCAA

51  ACGGCGCAAC CGCCGCCGCC TCGTAACGGC AAGTTGCCTG GTTGCCGCCT

101  CCTGCATCCT GCTGGCAGCC GCCCTCAGTT CCGGCCCTGC CGAACAGACT

151  GCCGGCGAAA CAAGCGGCGT AGAAAACAAA GCGGCAGGTG CGGCACAAAC

201  CCCTGCCTTG AAATCCGCCG CCGACAAACC GCAGGACTTG GCAGGCGAAG

251  ACAAGCCTTC TGCCGCCGAC AGCGAAATCA GCGAGCCTGA AAACGTAGGC

301  GCGCCGCTGG TGCTGATTAA CGACCGCCTC GAAGACAGCA ACATCAAAGG

351  TTTGGAAGCA TCCGAGAAAC TGCAACAGGC AGAAACCGCC AAAACCGCAC

401  CGAAGCAGGC AAAACAACGC GCTGCCGAAA AAGTGCCGGC AACTGCCGAC

451  AGTACGGATA CGGTAGCGGT TGAAAAACCG AAACGCACTG CCGAAACAAA

501  ACCGCAAAAA GCGGAACGCA CTGCCAAAGC CAAGCCCAAA GCCAAAGAAA

551  CCAAAACCGC CGAAAAAGTT GCCGACAAAC CGAAAACTGC CGCCGAAAAA

601  ACCAAACCGG ATACGGCAAA ATCCGACAGC GCGGTAAAAG AAGCGAAAAA

651  AGCCGACAAG GCTGAAAGCA AAAAAACAGC CGAAAAAGAC CGTTCGGACG

701  GCAAAAAACA CGAAACGGCA CAAAAAACCG ACAAAGCGGA CAAGACCAAA

751  ACCGCCGAGA AGGAAAAATC CGGTAAAAAA GCCGCCATTC AGGCAGGTTA

801  TGCCGAAAAA GAACGCGCCT TAAGCCTCCA GCGCAAAATG AAGGCGGCGG

851  GTATCGATTC GACCATCACC GAAATTATGA CCGACAACGG CAAAGTTTAC

901  CGCGTCAAAT CAAGCAACTA TAAAAACGCA AGGGATGCCG AACGCGATTT

951  GAACAAATTG CGCGTACACG GTATCGCCGG TCAGGTAACG AATGAATAA
```

This corresponds to the amino acid sequence <SEQ ID 2556; ORF 746.a>:

```
a746.pep
     1  MSENKQNEVL SGYEQLKRRN RRRLVTASCL VAASCILLAA ALSSGPAEQT

51  AGETSGVENK AAGAAQTPAL KSAADKPQDL AGEDKPSAAD SEISEPENVG

101  APLVLINDRL EDSNIKGLEA SEKLQQAETA KTAPKQAKQR AAEKVPATAD

151  STDTVAVEKP KRTAETKPQK AERTAKAKPK AKETKTAEKV ADKPKTAAEK

201  TKPDTAKSDS AVKEAKKADK AESKKTAEKD RSDGKKHETA QKTDKADKTK

251  TAEKEKSGKK AAIQAGYAEK ERALSLQRKM KAAGIDSTIT EIMTDNGKVY

301  RVKSSNYKNA RDAERDLNKL RVHGIAGQVT NE*
```

Computer analysis of this amino acid sequence gave the following results:

Homology with a Predicted ORF from *N. meningitidis*

ORF 746 shows 99.7% identity over a 332 aa overlap with a predicted ORF (ORF 746) from *N. meningitidis:* a746/m746; 99.7% identity in 332 aa overlap

```
                   10        20        30        40        50        60
a746.pep   MSENKQNEVLSGYEQLKRRNRRRLVTASCLVAASCILLAAALSSGPAEQTAGETSGVENK
           ||||||||||||||||||||||||||||||||||||||||||||||||||||||||||||
m746       MSENKQNEVLSGYEQLKRRNRRRLVTASCLVAASCILLAAALSSGPAEQTAGETSGVENK
                   10        20        30        40        50        60
```

```
                    70         80         90        100        110        120
a746.pep  AAGAAQTPALKSAADKPQDLAGEDKPSAADSEISEPENVGAPLVLINDRLEDSNIKGLEA
          ||||||||||||||||||||||||||||||||||||||||||||:|||||||||||||
m746      AAGAAQTPALKSAADKPQDLAGEDKPSAADSEISEPENVGAPLVLINERLEDSNIKGLEA
                    70         80         90        100        110        120

130        140        150        160        170        180
a746.pep  SEKLQQAETAKTAPKQAKQRAAEKVPATADSTDTVAVEKPKRTAETKPQKAERTAKAKPK
          ||||||||||||||||||||||||||||||||||||||||||||||||||||||||||||
m746      SEKLQQAETAKTAPKQAKQRAAEKVPATADSTDTVAVEKPKRTAETKPQKAERTAKAKPK
                   130        140        150        160        170        180

190        200        210        220        230        240
a746.pep  AKETKTAEKVADKPKTAAEKTKPDTAKSDSAVKEAKKADKAESKKTAEKDRSDGKKHETA
          ||||||||||||||||||||||||||||||||||||||||||||||||||||||||||||
m746      AKETKTAEKVADKPKTAAEKTKPDTAKSDSAVKEAKKADKAESKKTAEKDRSDGKKHETA
                   190        200        210        220        230        240

250        260        270        280        290        300
a746.pep  QKTDKADKTKTAEKEKSGKKAAIQAGYAEKERALSLQRKMKAAGIDSTITEIMTDNGKVY
          ||||||||||||||||||||||||||||||||||||||||||||||||||||||||||||
m746      QKTDKADKTKTAEKEKSGKKAAIQAGYAEKERALSLQRKMKAAGIDSTITEIMTDNGKVY
                   250        260        270        280        290        300

310        320        330
a746.pep  RVKSSNYKNARDAERDLNKLRVHGIAGQVTNEX
          ||||||||||||||||||||||||||||||||
m746      RVKSSNYKNARDAERDLNKLRVHGIAGQVTNEX
                   310        320        330
``` g747.seq not found yet
g747.pep not found yet
The following partial DNA sequence was identified in *N. meningitidis* <SEQ ID 2557>:

```
m747.seq
    1   CTGACCCCTT GGGCGGATGC ATATGCAGAT TTGCGCGGCA AAACCAAAGT

51   GATGACGACC CAGATGGGTG CTTCCCGCGA TGTCAGCAAA AGCGCCAAAG

101   GTTGGAGTGT CGGTATCGGT CTGAATGTAG GCAAACAGTT GACCGACAGC

151   GTCGGTCTCG AGTTTGATCC ATACTACCGT CACAAAACAA TCTACAAACC

201   CCGTGAGATT GTCTTGGACG GTGACAAAAC CAAAATGGGC CGCTCCAAAT

251   CCAACGAGTA CGGCTTCCGC GTAGCCGCAA CGTTCTATAG TCAATTAAAA

301   TCAAAATAG
```

This corresponds to the amino acid sequence <SEQ ID 2558; ORF 747>:

```
m747.pep
    1   LTPWADAYAD LRGKTKVMTT QMGASRDVSK SAKGWSVGIG LNVGKQLTDS

51   VGLEFDPYYR HKTIYKPREI VLDGDKTKMG RSKSNEYGFR VAATFYSQLK

101   SK*
```

The following partial DNA sequence was identified in *N. meningitidis* <SEQ ID 2559>:

```
a747.seq
    1   CTAACCCCTT GGGCGGATGC ATATGCAGAT TTGCGCGGCA AAACCAAAGT

51   GATGACGACC CAGATGTGTG CTTCCCGCGA TGTCAGCAAA AGCGCCAAAG

101   GTTGGAGTGT CGGTATCGGT CTGAATGTAG GCAAACAGTT GACCGACAGC

151   GTCGGTCTCG AGTTTGATCC ATACTACCGT CACAAAACAA TCTGCAAACC

201   CCGTGAGATT GTTTTGGACG GCGACAAAAC CAAAATGGGC CGCTCCAAAT
```

-continued

```
251  CCAACGAGTA CGGCTTCCGC GTAACCGCAA CGTTCTATAG TCAATTAAAA

301  TCAAAGTAG
```

This corresponds to the amino acid sequence <SEQ ID 2560; ORF 747.a>:

```
a747.pep
   1  LTPWADAYAD LRGKTKVMTT QMCASRDVSK SAKGWSVGIG LNVGKQLTDS

51  VGLEFDPYYR HKTICKPREI VLDGDKTKMG RSKSNEYGFR VTATFYSQLK

101  SK*
```

Computer analysis of this amino acid sequence gave the following results:
Homology with a Predicted ORF from *N. meningitidis*
ORF 747 shows 97.1% identity over a 102 aa overlap with a predicted ORF (ORF 746) from *N. meningitidis*:
a747/m747 97.1% identity in 102 aa overlap

```
                    10         20         30         40         50         60
    a747.pep  LTPWADAYADLRGKTKVMTTQMCASRDVSKSAKGWSVGIGLNVGKQLTDSVGLEFDPYYR
              |||||||||||||||||||||||| |||||||||||||||||||||||||||||||||||
    m747      LTPWADAYADLRGKTKVMTTQMGASRDVSKSAKGWSVGIGLNVGKQLTDSVGLEFDPYYR
                    10         20         30         40         50         60
                    70         80         90        100
    a747.pep  HKTICKPREIVLDGDKTKMGRSKSNEYGFRVTATFYSQLKSKX
              ||||  ||||||||||||||||||||||||||||:|||||||||
    m747      HKTIYKPREIVLDGDKTKMGRSKSNEYGFRVAATFYSQLKSKX
                    70         80         90        100
``` a747 (SEQ ID 2560)/m80195 (SEQ ID 4168)

```
gi|150271 (M80195) outer membrane protein [Neisseria meningitidis]
Length = 272  Score = 59.3 bits (141), Expect = 6e-09
Identities = 29/99 (29%), Positives = 51/99 (51%), Gaps = 4/99 (4%)
Query:   1 LTPWADAYADLRGKTKVMTTQMCASRDVSKSAKGWSVGIGLNVGKQLTDSVGLEFDPYYR   60
           + PW++    DL + K+ T     +D+++   GW  G+G N+GK+L +S  +E   P+Y+
Sbjct: 174 INPWSEVKFDLNSRYKLNTGVTNLKKDINQKTNGWGFGLGANIGKKLGESASIEAGPFYK  233

Query:  61 HKTICKPREIVL---DGD-KTKMGRSKSNEYGFRVTATF                       95
           +T  + E  +    GD    + ++   EYG RV  F
Sbjct: 234 QRTYKESGEFSVTTKSGDVSLTIPKTSIREYGLRVGIKF                      272
                                                                        45
```

The following partial DNA sequence was identified in *N. gonorrhoeae* <SEQ ID 2561>:

```
g748.seq
   1  ATGAGTCAAA ACCAACCCGC ACAACCGACC AAACGCAATC TGTTCAAAAC

51  CGCCCTTGCC GTCGGCGCAA TCGGCGCAAT CGGAGGTTAT TTCGGCGGCA

101  AAAAACAGGG CGAAACCGCC GAACGCACCG CCGAAAGCCA ACACTCGCCC

151  CAAGCCTATC CCTGCTACGG CGAACATCAG GCAGGTATCG TTACGCCGCG

201  GCAGGCGTTT TCCATTATGT GCGCCTTCGA CGTAACCGCG CAAAGTGCCA

251  AGCAGCTGGA AAACCTGTTC CGCACACTGA CCGCCCGCAT CGAGTTTCTC

301  ACCCAAGGCG AGAATACCA AGACGGCGAC GACAAACTCC CGTCAGCCGG

351  CAGCGGCATT TTGGGTAAAG CCTTCAACCC CGACGGATTG ACCGTTACCG

401  TGGGGGTGGG CAGCAGCCTG TTTGACGGCC GGTTCGGACT CAAAGACAAA

451  AAAACGGTTC ATTTGCAGGA AATGCGCGAC TTCCCCAACG ATAAGCTGCA
```

-continued

```
 501  AAAAAGCTGG TGCGACGGCG ATTTGAGCCT GCAAATCTGC GCCTTCACCC

551  CCGAAACCTG CCAAACCGCC CTGCGCGACA TCATCAAACA CACCGCCCAA

601  ACCGCCGTCA TCCGCTGGAG TATCGACGGG TGGCAGCCTA AATCCGAACC

651  CGGCGCGATG GCGGCGCGCA ACCTGTTGGG CTTCCGAGAC GGCACGGGCA

701  ACCCCAAGGT TTCCGATCCC AAAACCGCCG ACGAGGTTTT ATGGACGGGC

751  GTGGCCGCCA ACAGCCTCGA CGAACCGGAG TGGGCGAAAA ACGGCAGCTA

801  TCAGGCAGTC CGCCTTATCC GCCGCTTTGT CGAGTTTTGG GACAGGACGC

851  CGCTTCAAGA GCAAACCGAC ATTTTCGGGC GGCGAAAATA CAGCGGGGCG

901  CCGATGGACG GCAAAAAAGA AGCCGACCAA CCGGATTTCG CCAAAGACCC

951  CGAGGGTGAT ATCACGCCCA AGACAGCCA TATGCGCCTG GCGAATCCGC

1001  GCGATCCCGA ATTCCTCAAA AAACACTGCC TCTTCCGCCG CGCCTACAGC

1051  TATTCTCGCG GACCCGCCTC AAGCGGACAG CTTGATGTCG GGCTGGTGTT

1101  CGTCTGCTAT CAGGCAAATC TTGCCGACGG TTTCATCTTC GTGCAAAACC

1151  TCCTCAACGG CGAACCGCTG GAAGAATACA TCAGCCCCTT CGGCGGCGGC

1201  TATTTCTTCG TCTTGCCCGG CGTGGGAAAA GGCGGATTCT TGGGACAAGG

1251  GCTGCCGGGC GTATAA
```

This corresponds to the amino acid sequence <SEQ ID 2562; ORF 748.ng>:

```
g748.pep
  1  MSQNQPAQPT KRNLFKTALA VGAIGAIGGY FGGKKQGETA ERTAESQHSP

51  QAYPCYGEHQ AGIVTPRQAF SIMCAFDVTA QSAKQLENLF RTLTARIEFL

101  TQGGEYQDGD DKLPSAGSGI LGKAFNPDGL TVTVGVGSSL FDGRFGLKDK

151  KTVHLQEMRD FPNDKLQKSW CDGDLSLQIC AFTPETCQTA LRDIIKHTAQ

201  TAVIRWSIDG WQPKSEPGAM AARNLLGFRD GTGNPKVSDP KTADEVLWTG

251  VAANSLDEPE WAKNGSYQAV RLIRRFVEFW DRTPLQEQTD IFGRRKYSGA

301  PMDGKKEADQ PDFAKDPEGD ITPKDSHMRL ANPRDPEFLK KHCLFRRAYS

351  YSRGPASSGQ LDVGLVFVCY QANLADGFIF VQNLLNGEPL EEYISPFGGG

401  YFFVLPGVGK GGFLGQGLPG V*
```

The following partial DNA sequence was identified in *N. meningitidis* <SEQ ID 2563>:

```
m748.seq
  1  ATGAGCAAAA AACAACCCGC ACAACCGACC AGGCGCACTC TTTTTAAAAC

51  CGCGATCGCA GCCGGAGCAG TCGGCGCAAT CGGAGGTTAT CTCGGCGGCA

101  AAAACAGGG CGAAACCGCC GAACGCACCG CCGAAAGCCA ACACTCGCCC

151  CAAGCCTATC CCTGCTACGG CGAACATCAG GCAGGCATCG TTACGCCGCA

201  GCAGGCGTTT TCGATTATGT GCGCCTTCGA CGTAACCGCG CAAAGTGCCA

251  AGCAGCTGGA AAACCTGTTC CGCACGCTGA CCGCCCGCAT CGAGTTTCTC

301  ACCCAAGGCG GCGAATACCA AGACGGCGAC GACAAACTTC CGCCAGCCGG

351  CAGCGGCATT TGGGCAAAG CCTTCAACCC CGACGGGTTG ACCGTTACCG

401  TGGGGGTGGG CAGCAGCCTG TTTGACGGCC GGTTCGGACT CAAAGACAAA
```

-continued

```
 451   AAACCGATTC ATTTGCAGGA AATGCGCGAC TTCTCCAACG ATAAGCTGCA

501   AAAAAGCTGG TGCGACGGCG ATTTGAGCCT GCAAATCTGT GCCTTCACCC

551   CCGAAACCTG CCAAGCCGCC CTGCGCGACA TCATCAAACA CACCGTCCAA

601   ACCGCCGTTA TCCGTTGGAG TATCGACGGG TGGCAGCCCA AATCCGAACC

651   CGGCGCGATG GCGGCGCGCA ACCTGTTGGG CTTCAGGGAC GGCACGGGCA

701   ACCCCAAAGT TTCCGATCCC AAAACTGCCG ACGAGGTTTT GTGGACGGGG

751   GTGGCCGCCA ACAGCCTCGA CGAACCGGAG TGGGCGAAAA ACGGCAGCTA

801   TCAGGCAGTC CGCCTTATCC GCCACTTTGT CGAGTTTTGG GACAGGACGC

851   CGCTTCAAGA GCAAACCGAC ATTTTCGGGC GGCGCAAATA CAGCGGTGCG

901   CCGATGGACG GCAAAAAAGA AGCCGACCAA CCGGATTTTG CCAAAGACCC

951   CGAGGGTGAT ATCACGCCCA AGACAGCCA TATACGCCTG GCGAATCCGC

1001   GCGATCCCGA ATTCCTCAAA AACACCGCC TCTTCCGCCG CGCCTACAGC

1051   TATTCGCGCG GACTCGCCTC AAGCGGACAG CTTGATGTCG GGCTGGTGTT

1101   CGTCTGCTAT CAGGCAAACC TTGCCGACGG ATTCATCTTC GTGCAAAACC

1151   TCCTCAACGG CGAACCGCTG GAAGAATACA TCAGCCCCTT CGGCGGCGGC

1201   TATTTCTTCG TCTTGCCCGG CGTGGAAAAA GGCGGCTTTT TGGGGCAAGG

1251   GCTGCTGGGC GTATAA
```

This corresponds to the amino acid sequence <SEQ ID 2564; ORF 748>:

```
m748.pep
   1   MSKKQPAQPT RRTLFKTAIA AGAVGAIGGY LGGKKQGETA ERTAESQHSP

51   QAYPCYGEHQ AGIVTPQQAF SIMCAFDVTA QSAKQLENLF RTLTARIEFL

101   TQGGEYQDGD DKLPPAGSGI LGKAFNPDGL TVTVGVGSSL FDGRFGLKDK

151   KPIHLQEMRD FSNDKLQKSW CDGDLSLQIC AFTPETCQAA LRDIIKHTVQ

201   TAVIRWSIDG WQPKSEPGAM AARNLLGFRD GTGNPKVSDP KTADEVLWTG

251   VAANSLDEPE WAKNGSYQAV RLIRHFVEFW DRTPLQEQTD IFGRRKYSGA

301   PMDGKKEADQ PDFAKDPEGD ITPKDSHIRL ANPRDPEFLK KHRLFRRAYS

351   YSRGLASSGQ LDVGLVFVCY QANLADGFIF VQNLLNGEPL EEYISPFGGG

401   YFFVLPGVEK GGFLGQGLLG V*
```

Computer analysis of this amino acid sequence gave the following results:
Homology with a Predicted ORF from *N. gonorrhoeae*
ORF 748 shows 95.0% identity over a 421 aa overlap with a predicted ORF (ORF 748) from *N. gonorrhoeae*
m748/g748 95.0% identity in 421 aa overlap

```
                   10         20         30         40         50         60
   m748.pep  MSKKQPAQPTRRTLFKTAIAAGAVGAIGGYLGGKKQGETAERTAESQHSPQAYPCYGEHQ
             ||::||||||:|:|||||:|:||:||||||:||||||||||||||||||||||||||||
       g748  MSQNQPAQPTKRNLFKTALAVGAIGAIGGYFGGKKQGETAERTAESQHSPQAYPCYGEHQ
                   10         20         30         40         50         60

70         80         90        100        110        120
   m748.pep  AGIVTPQQAFSIMCAFDVTAQSAKQLENLFRTLTARIEFLTQGGEYQDGDDKLPPAGSGI
             ||||||:|||||||||||||||||||||||||||||||||||||||||||||||||||:
       g748  AGIVTPRQAFSIMCAFDVTAQSAKQLENLFRTLTARIEFLTQGGEYQDGDDKLPSAGSGI
                   70         80         90        100        110        120
```

-continued

```
                130       140       150       160       170       180
m748.pep  LGKAFNPDGLTVTVGVGSSLFDGRFGLKDKKPIHLQEMRDFSNDKLQKSWCDGDLSLQIC
          ||||||||||||||||||||||||||||||| :|||||||| ||||||||||||||||||
g748      LGKAFNPDGLTVTVGVGSSLFDGRFGLKDKKTVHLQEMRDFPNDKLQKSWCDGDLSLQIC
                130       140       150       160       170       180

190       200       210       220       230       240
m748.pep  AFTPETCQAALRDIIKHTVQTAVIRWSIDGWQPKSEPGAMAARNLLGFRDGTGNPKVSDP
          ||||||||:|||||||||:|||||||||||||||||||||||||||||||||||||||||
g748      AFTPETCQTALRDIIKHTAQTAVIRWSIDGWQPKSEPGAMAARNLLGFRDGTGNPKVSDP
                190       200       210       220       230       240

250       260       270       280       290       300
m748.pep  KTADEVLWTGVAANSLDEPEWAKNGSYQAVRLIRHFVEFWDRTPLQEQTDIFGRRKYSGA
          ||||||||||||||||||||||||||||||||||:||||||||||||||||||||| |||
g748      KTADEVLWTGVAANSLDEPEWAKNGSYQAVRLIRRFVEFWDRTPLQEQTDIFGRRKYSGA
                250       260       270       280       290       300

310       320       330       340       350       360
m748.pep  PMDGKKEADQPDFAKDPEGDITPKDSHIRLANPRDPEFLKKHRLFRRAYSYSRGLASSGQ
          |||||||||||||||||||||||||||:|||||||||||||| ||||||||||| |||||
g748      PMDGKKEADQPDFAKDPEGDITPKDSHMRLANPRDPEFLKKHCLFRRAYSYSRGPASSGQ
                310       320       330       340       350       360

370       380       390       400       410       420
m748.pep  LDVGLVFVCYQANLADGFIFVQNLLNGEPLEEYISPFGGGYFFVLPGVEKGGFLGQGLLG
          |||||||||||||||||||||||||||||||||||||||||||||||| ||||||||| |
g748      LDVGLVFVCYQANLADGFIFVQNLLNGEPLEEYISPFGGGYFFVLPGVGKGGFLGQGLGG
                370       380       390       400       410       420 m748.pep  VX
          ||
g748      VX
```

The following partial DNA sequence was identified in *N. meningitidis* <SEQ ID 2565>:

```
a748.seq
   1  ATGAGCAAAA ACCAACCCGC ACAACCGACC AGGCGCACTC TTTTTAAAAC

51  CGCGATCGCA GCTGGAGCAG TCGGCGCAAT CGGAGGTTAT CTCGGCGGCA

101  AAAAACGGGG CGAAACCGCC GAACGCACCG CCGAAAGCCA ACACTCGCCC

151  CAAGCCTATC CCTGCTACGG CGAACATCAG GCAGGCATCG TTACGCCGCA

201  GCAGGCGTTT TCGATTATGT GCGCCTTCGA CGTAACCGCG CAAAGTGCCA

251  AGCAGCTGGA AAACCTGTTC CGCACGCTGA CCGCCCGCAT CGAGTTTCTC

301  ACCCAAGGCG GCGAATACCA AGACGGCGAC GACAAACTTC CGCCAGCCGG

351  CAGCGGCATT TTGGGCAAAG CCTTCAACCC CGACGGGTTG ACCGTTACCG

401  TGGGGGTGGG CAGCAGCCTG TTTGACGGCC GGTTCGGACT CAAAGACAAA

451  AAACCGATTC ATTTGCAGGA AATGCGCGAC TTCTCCAACG ATAAGCTGCA

501  AAAAAGCTGG TGCGACGGCG ATTTGAGCCT GCAAATCTGT GCCTTCACCC

551  CCGAAACCTG CCAAGCCGCC CTGCGCGACA TCATCAAACA CACCGTCCAA

601  ACCGCCGTTA TCCGCTGGAG TATCGACGGG TGGCAGCCTA AATCCGAACC

651  CGGCGCGATG GCGGCGCGCA ACCTGTTGGG CTTCCGCGAC GGCACGGGCA

701  ACCCCAAAGT TTCCGACCCC AAAACTGCCG ACGAGGTTTT GTGGACGGGG

751  GTGGCCGCCA ACAGCCTCGA CGAACCGGAG TGGGCGAAAA ACGGCAGCTA

801  TCAGGCAGTC CGCCTTATCC GCCACTTTGT TGAGTTTTGG GACAGGACGC

851  CGCTTCAAGA GCAAACCGAC ATTTTCGGGC GGCGCAAATA CAGCGGCGCG

901  CCGATGGACG GCAAAAAAGA AGCCGACCAA CCGGATTTTG CCAAAGACCC

951  CGAGGGGAAT ACCACGCCCA AAGACAGCCA TATACGCCTG GCGAATCCGC

1001  GCGATCCCGA GTTCCTTAAA AAACACCGCC TCTTCCGCCG CGCCTACAGC

1051  TATTCGCGCG GACTCGCCTC AAGCGGACAG CTTGATGTCG GGCTGGTGTT
```

```
-continued
1101  CGTCTGCTAT CAGGCAAACC TTGCCGACGG ATTCATCTTC GTGCAAAACC

1151  TCCTCAACGG CGAACCGCTG GAAGAATACA TCAGCCCCTT CGGCGGCGGC

1201  TATTTCTTCG TCTTGCCCGG CGTGGAAAAA GGCGGCTTTT TGGGGCAAGG

1251  GCTGCTGGGC GTATAA
```

This corresponds to the amino acid sequence <SEQ ID 2566; ORF 748.a>:

```
a748.pep
    1   MSKNQPAQPT RRTLFKTAIA AGAVGAIGGY LGGKKRGETA ERTAESQHSP

51   QAYPCYGEHQ AGIVTPQQAF SIMCAFDVTA QSAKQLENLF RTLTARIEFL

101   TQGGEYQDGD DKLPPAGSGI LGKAFNPDGL TVTVGVGSSL FDGRFGLKDK

151   KPIHLQEMRD FSNDKLQKSW CDGDLSLQIC AFTPETCQAA LRDIIKHTVQ

201   TAVIRWSIDG WQPKSEPGAM AARNLLGFRD GTGNPKVSDP KTADEVLWTG

251   VAANSLDEPE WAKNGSYQAV RLIRHFVEFW DRTPLQEQTD IFGRRKYSGA

301   PMDGKKEADQ PDFAKDPEGN TTPKDSHIRL ANPRDPEFLK KHRLFRRAYS

351   YSRGLASSGQ LDVGLVFVCY QANLADGFIF VQNLLNGEPL EEYISPFGGG

401   YFFVLPGVEK GGFLGQGLLG V*
```

Computer analysis of this amino acid sequence gave the following results:
Homology with a Predicted ORF from *N. meningitidis*
ORF 748 shows 99.0% identity over a 421 aa overlap with a predicted ORF (ORF 748) from *N. meningitidis*:
a748/m748 99.0% identity in 421 aa overlap

```
                   10         20         30         40         50         60
    a748.pep  MSKNQPAQPTRRTLFKTAIAAGAVGAIGGYLGGKKRGETAERTAESQHSPQAYPCYGEHQ
              |||:||||||||||||||||||||||||||||||||:|||||||||||||||||||||||
    m748      MSKKQPAQPTRRTLFKTAIAAGAVGAIGGYLGGKKQGETAERTAESQHSPQAYPCYGEHQ
                   10         20         30         40         50         60

70         80         90        100        110        120
    a748.pep  AGIVTPQQAFSIMCAFDVTAQSAKQLENLFRTLTARIEFLTQGGEYQDGDDKLPPAGSGI
              ||||||||||||||||||||||||||||||||||||||||||||||||||||||||||||
    m748      AGIVTPQQAFSIMCAFDVTAQSAKQLENLFRTLTARIEFLTQGGEYQDGDDKLPPAGSGI
                   70         80         90        100        110        120

130        140        150        160        170        180
    a748.pep  LGKAFNPDGLTVTVGVGSSLFDGRFGLKDKKPIHLQEMRDFSNDKLQKSWCDGDLSLQIC
              ||||||||||||||||||||||||||||||||||||||||||||||||||||||||||||
    m748      LGKAFNPDGLTVTVGVGSSLFDGRFGLKDKKPIHLQEMRDFSNDKLQKSWCDGDLSLQIC
                  130        140        150        160        170        180

190        200        210        220        230        240
    a748.pep  AFTPETCQAALRDIIKHTVQTAVIRWSIDGWQPKSEPGAMAARNLLGFRDGTGNPKVSDP
              ||||||||||||||||||||||||||||||||||||||||||||||||||||||||||||
    m748      AFTPETCQAALRDIIKHTVQTAVIRWSIDGWQPKSEPGAMAARNLLGFRDGTGNPKVSDP
                  190        200        210        220        230        240

250        260        270        280        290        300
    a748.pep  KTADEVLWTGVAANSLDEPEWAKNGSYQAVRLIRHFVEFWDRTPLQEQTDIFGRRKYSGA
              ||||||||||||||||||||||||||||||||||||||||||||||||||||||||||||
    m748      KTADEVLWTGVAANSLDEPEWAKNGSYQAVRLIRHFVEFWDRTPLQEQTDIFGRRKYSGA
                  250        260        270        280        290        300

310        320        330        340        350        360
    a748.pep  PMDGKKEADQPDFAKDPEGNTTPKDSHIRLANPRDPEFLKKHRLFRRAYSYSRGLASSGQ
              |||||||||||||||||||||:||||||||||||||||||||||||||||||||||||||
    m748      PMDGKKEADQPDFAKDPEGDITPKDSHIRLANPRDPEFLKKHRLFRRAYSYSRGLASSGQ
                  310        320        330        340        350        360

370        380        390        400        410        420
    a748.pep  LDVGLVFVCYQANLADGFIFVQNLLNGEPLEEYISPFGGGYFFVLPGVEKGGFLGQGLLG
              ||||||||||||||||||||||||||||||||||||||||||||||||||||||||||||
    m748      LDVGLVFVCYQANLADGFIFVQNLLNGEPLEEYISPFGGGYFFVLPGVEKGGFLGQGLLG
                  370        380        390        400        410        420
```

```
a748.pep  VX
          ||
m748      VX
```

The following partial DNA sequence was identified in *N. gonorrhoeae* <SEQ ID 2567>:

```
g749.seq
     1  ATGAGAAAAT TCAATTTGAC CGCATTGTCC GTGATGCTTG CCTTGGGTTT

51  GACCGCGTGC CAGCCGCCGG AGGCGGAGAA AGCCGCGCCG GCCGCGTCCG

101  GTGAGACCCA ATCCGCCAAC GAAGGCGGTT CGGTCGGTAT CGCCGTCAAC

151  GACAATGCCT GCGAACCGAT GAATCTGACC GTGCCGAGCG GACAGGTTGT

201  GTTCAATATT AAAAACAACA GCGGCCGCAA GCTCGAATGG GAAATCCTGA

251  AGGGCGTGAT GGTGGTGGAC GAACGCGAAA ATATCGCCCC GGGGCTTTCC

301  GACAAAATGA CCGTAAccct GCTGCCGGGC GAATACGAAA TGACCTGCGG

351  CCTTTTGACC AATCCGCGCG GCAAGCTGGT GGTAGCCGAC AGCGGCTTTA

401  AAGACACCGC CAACGAAGCG GATTTGGAAA AACTGCCCCA ACCGCTCGCC

451  GACTATAAAG CCTACGTTCA AGGCGAGGTT AAAGAGCTGG CGGCGAAAAC

501  CAAAACCTTT ACCGAAGCCG TCAAAGCAGG CGACATTGAA AAGGCGAAAT

551  CCCTGTTTGC CGCCACCCGC GTCCATTACG AACGCATCGA ACCGATTGCC

601  GAGCTTTTCA GCGAACTCGA CCCCGTCATC GATGCGTGTG AAGACGACTT

651  CAAAGACGGT GCGAAAGATG CCGGGTTTAC CGGCTTCCAC CGTATCGAAC

701  ACGCCCTTTG GGTGGAAAAA GACGTATCCG GCGTGAAGGA AACCGCGGCC

751  AAACTGATGA CCGATGTCGA AGCCCTGCAA AAAGAAATCG ACGCATTGGC

801  GttccctCCG GGCAAAGTGG TCGGCGGCGC GTCCGAACTG ATTGAAGAAG

851  CGGCGGGCAG TAAAATCAGC GGCGAAGAAG ACCgttaCAG CCACACCGAT

901  TTGAGCGACT TCCAAGCTAA TGCGGACGGA TCTAAAAAAA TCGTCGATTT

951  GTTCCGTCCG TTGATTGAGG CCAAAAACAA AGCCTTGTTG GAAAAAACCG

1001  ATACCAACTT CAAACAGGTC AACGAAATTC TGGCGAAATA CCGCACCAAA

1051  GACGGTTTTG AAACCTACGA CAAGCTGAGC GAAGCCGACC GCAAAGCATT

1101  ACAGGCTCCT ATTAACGCGC TTGCCGAAGA CCTTGCCCAA CTTCGCGGCA

1151  TACTCGGCTT GAAATAA
```

This corresponds to the amino acid sequence <SEQ ID 2568; ORF 749.ng>:

```
g749.pep
     1  MRKFNLTALS VMLALGLTAC QPPEAEKAAP AASGETQSAN EGGSVGIAVN

51  DNACEPMNLT VPSGQVVFNI KNNSGRKLEW EILKGVMVVD ERENIAPGLS

101  DKMTVTLLPG EYEMTCGLLT NPRGKLVVAD SGFKDTANEA DLEKLPQPLA

151  DYKAYVQGEV KELAAKTKTF TEAVKAGDIE KAKSLFAATR VHYERIEPIA

201  ELFSELDPVI DACEDDFKDG AKDAGFTGFH RIEHALWVEK DVSGVKETAA

251  KLMTDVEALQ KEIDALAFPP GKVVGGASEL IEEAAGSKIS GEEDRYSHTD

301  LSDFQANADG SKKIVDLFRP LIEAKNKALL EKTDTNFKQV NEILAKYRTK

351  DGFETYDKLS EADRKALQAP INALAEDLAQ LRGILGLK*
```

The following partial DNA sequence was identified in *N. meningitidis* <SEQ ID 2569>:

```
m749.seq
     1   ATGAGAAAAT TCAATTTGAC CGCATTGTCC GTGATGCTTG CCTTAGGTTT
    51   GACCGCGTGC CAGCCGCCGG AGGCGGAGAA AGCTGCGCCG GCAGCGTCCG
   101   GTGAGGCGCA AACCGCCAAC GAGGGCGGTT CGGTCAGTAT CGCCGTCAAC
   151   GACAATGCCT GCGAACCGAT GGAACTGACC GTGCCGAGCG GACAGGTTGT
   201   GTTCAATATT AAAAACAACA GCGGCCGCAA GCTCGAATGG GAAATCCTGA
   251   AAGGCGTGAT GGTGGTGGAC GAGCGCGAAA ACATCGCCCC CGGACTTTCC
   301   GATAAAATGA CCGTCACCCT GTTGCCGGGC GAATACGAAA TGACTTGCGG
   351   TCTTTTGACC AATCCGCGCG GCAAGCTGGT GGTAACCGAC AGCGGCTTTA
   401   AAGACACCGC CAACGAAGCG GATTTGGAAA AACTGTCCCA ACCGCTCGCC
   451   GACTATAAAG CCTACGTTCA AGGCGAGGTT AAAGAGCTGG TGGCGAAAAC
   501   CAAAACTTTT ACCGAAGCCG TCAAAGCAGG CGACATTGAA AAGGCGAAAT
   551   CCCTGTTTGC CGACACCCGC GTCCATTACG AACGCATCGA ACCGATTGCC
   601   GAGCTTTTCA GCGAACTCGA CCCCGTCATC GATGCGCGTG AAGACGACTT
   651   CAAAGACGGC GCGAAAGATG CCGGATTTAC CGGCTTTCAC CGTATCGAAT
   701   ACGCCCTTTG GGTGGAAAAA GACGTGTCCG GCGTGAAGGA AATTGCAGCG
   751   AAACTGATGA CCGATGTCGA AGCCCTGCAA AAAGAAATCG ACGCATTGGC
   801   GTTTCCTCCG GGCAAGGTGG TCGGCGGCGC GTCCGAACTG ATTGAAGAAG
   851   TGGCGGGCAG TAAAATCAGC GGCGAAGAAG ACCGGTACAG CCACACCGAT
   901   TTGAGCGACT TCCAAGCCAA TGTGGACGGA TCTAAAAAAA TCGTCGATTT
   951   GTTCCGTCCG CTGATCGAGG CCAAAAACAA AGCCTTGTTG GAAAAAACCG
  1001   ATACCAACTT CAAACAGGTC AACGAAATTC TGGCGAAATA CCGGACTAAA
  1051   GACGGTTTTG AAACCTACGA CAAGCTGGGC GAAGCCGACC GCAAAGCGTT
  1101   ACAGGCCTCT ATTAACGCGC TTGCCGAAGA CCTTGCCCAA CTTCGCGGCA
  1151   TACTCGGCTT GAAATAA
```

This corresponds to the amino acid sequence <SEQ ID 2570; ORF 749>:

```
m749.pep
     1   MRKFNLTALS VMLALGLTAC QPPEAEKAAP AASGEAQTAN EGGSVSIAVN
    51   DNACEPMELT VPSGQVVFNI KNNSGRKLEW EILKGVMVVD ERENIAPGLS
   101   DKMTVTLLPG EYEMTCGLLT NPRGKLVVTD SGFKDTANEA DLEKLSQPLA
   151   DYKAYVQGEV KELVAKTKTF TEAVKAGDIE KAKSLFADTR VHYERIEPIA
   201   ELFSELDPVI DAREDDFKDG AKDAGFTGFH RIEYALWVEK DVSGVKEIAA
   251   KLMTDVEALQ KEIDALAFPP GKVVGGASEL IEEVAGSKIS GEEDRYSHTD
   301   LSDFQANVDG SKKIVDLFRP LIEAKNKALL EKTDTNFKQV NEILAKYRTK
   351   DGFETYDKLG EADRKALQAS INALAEDLAQ LRGILGLK*
```

Computer analysis of this amino acid sequence gave the following results:
Homology with a Predicted ORF from *N. gonorrhoeae*
ORF 749 shows 96.1% identity over a 388 aa overlap with a predicted ORF (ORF 749) from *N. gonorrhoeae*
m749/g749 96.1% identity in 388 aa overlap

```
                  10        20        30        40        50        60
m749.pep  MRKFNLTALSVMLALGLTACQPPEAEKAAPAASGEAQTANEGGSVSIAVNDNACEPMELT
          |||||||||||||||||||||||||||||||||||:|:||||||:|||||||||||:||
g749      MRKFNLTALSVMLALGLTACQPPEAEKAAPAASGETQSANEGGSVGIAVNDNACEPMNLT
                  10        20        30        40        50        60

70        80        90       100       110       120
m749.pep  VPSGQVVFNIKNNSGRKLEWEILKGVMVVDERENIAPGLSDKMTVTLLPGEYEMTCGLLT
          ||||||||||||||||||||||||||||||||||||||||||||||||||||||||||||
g749      VPSGQVVFNIKNNSGRKLEWEILKGVMVVDERENIAPGLSDKMTVTLLPGEYEMTCGLLT
                  70        80        90       100       110       120

130       140       150       160       170       180
m749.pep  NPRGKLVVTDSGFKDTANEADLEKLSQPLADYKAYVQGEVKELVAKTKTFTEAVKAGDIE
          ||||||||:||||||||||||||||| ||||||||||||||||:||||||||||||||||
g749      NPRGKLVVADSGFKDTANEADLEKLPQPLADYKAYVQGEVKELAAKTKTFTEAVKAGDIE
                 130       140       150       160       170       180

190       200       210       220       230       240
m749.pep  KAKSLFADTRVHYERIEPIAELFSELDPVIDAREDDFKDGAKDAGFTGFHRIEYALWVEK
          |||||||:|||||||||||||||||||||||:|||||||||||||||||||:||||||
g749      KAKSLFAATRVHYERIEPIAELFSELDPVIDACEDDFKDGAKDAGFTGFHRIEHALWVEK
                 190       200       210       220       230       240

250       260       270       280       290       300
m749.pep  DVSGVKEIAAKLMTDVEALQKEIDALAFPPGKVVGGASELIEEVAGSKISGEEDRYSHTD
          |||||||:||||||||||||||||||||||||||||||||||:|||||||||||||||||
g749      DVSGVKETAAKLMTDVEALQKEIDALAFPPGKVVGGASELIEEAAGSKISGEEDRYSHTD
                 250       260       270       280       290       300

310       320       330       340       350       360
m749.pep  LSDFQANVDGSKKIVDLFRPLIEAKNKALLEKTDTNFKQVNEILAKYRTKDGFETYDKLG
          ||||||||:|||||||||||||||||||||||||||||||||||||||||||||||||:
g749      LSDFQANADGSKKIVDLFRPLIEAKNKALLEKTDTNFKQVNEILAKYRTKDGFETYDKLS
                 310       320       330       340       350       360

370       380      389
m749.pep  EADRKALQASINALAEDLAQLRGILGLKX
          |||||||||  ||||||||||||||||||
g749      EADRKALQAPINALAEDLAQLRGILGLKX
                 370       380
```

The following partial DNA sequence was identified in *N. meningitidis* <SEQ ID 2571>:

```
a749.seq
    1   ATGAGAAAAT TCAATTTGAC CGCATTGTCC GTGATGCTTG CCTTAGGTTT

51   GACCGCGTGC CAGCCGCCGG AGGCGGAGAA AGCTGCGCCG GCAGCGTCCG

101   GTGAGGCGCA AACCGCCAAC GAGGGCGGTT CGGTCAGTAT CGCCGTCAAC

151   GACAATGCCT GCGAACCGAT GGAACTGACC GTGCCGAGCG GACAGGTTGT

201   GTTCAATATT AAAAACAACA GCGGCCGCAA GCTCGAATGG GAAATCCTGA

251   AAGGCGTGAT GGTGGTGGAC GAGCGCGAAA ACATCGCCCC CGGACTTTCC

301   GATAAAATGA CCGTCACCCT GTTGCCGGGC GAATACGAAA TGACTTGCGG

351   TCTTTTGACC AATCCGCGCG GCAAGCTGGT GGTAACCGAC AGCGGCTTTA

401   AAGACACCGC CAACGAAGCG GATTTGGAAA AACTGTCCCA ACCGCTCGCC

451   GACTATAAAG CCTATGTTCA AGGCGAAGTC AAAGAGCTGG TGGCGAAAAC

501   CAAAACCTTT ACCGAAGCCG TCAAAGCAGG CGACATTGAA AAGGCGAAAT

551   CCCTGTTTGC CGACACCCGC GTCCATTACG AACGCATCGA ACCGATTGCC

601   GAGCTTTTCA GCGAACTCGA CCCCGTCATC GATGCGCGTG AAGACGACTT

651   CAAAGACGGC GCGAAAGATG CCGGATTTAC CGGCTTCCAC CGTATCGAAT

701   ACGCCCTTTG GGTGGAAAAA GACGTGTCCG GCGTGAAGGA AATTGCAGCG
```

-continued

```
 751    AAACTGATGA CCGATGTCGA AGCCCTGCAA AAAGAAATCG ACGCATTGGC

801    GTTTCCTCCG GGCAAGGTGG TCGGCGGCGC GTCCGAACTG ATTGAAGAAG

851    TGGCGGGCAG TAAAATCAGC GGCGAAGAAG ACCGGTACAG CCACACCGAT

901    TTGAGCGACT TCCAAGCCAA TGTGGACGGA TCGAAAAAAA TCGTCGATTT

951    GTTCCGTCCG TTGATCGAGA CCAAAAACAA AGCCTTGTTG GAAAAAACCG

1001    ATACCAACTT CAAACAGGTC AACGAAATTC TGGCGAAATA CCGGACTAAA

1051    GACGGTTTTG AAACCTACGA CAAGCTGGGC GAAGCCGACC GCAAAGCGTT

1101    ACAGGCCTCT ATTAACGCGC TTGCCGAAGA CCTTGCCCAA CTTCGCGGCA

1151    TACTCGGCTT GAAATAA
```

This corresponds to the amino acid sequence <SEQ ID 2572; ORF 749.a>:

```
a749.pep
   1    MRKFNLTALS VMLALGLTAC QPPEAEKAAP AASGEAQTAN EGGSVSIAVN

51    DNACEPMELT VPSGQVVFNI KNNSGRKLEW EILKGVMVVD ERENIAPGLS

101    DKMTVTLLPG EYEMTCGLLT NPRGKLVVTD SGFKDTANEA DLEKLSQPLA

151    DYKAYVQGEV KELVAKTKTF TEAVKAGDIE KAKSLFADTR VHYERIEPIA

201    ELFSELDPVI DAREDDFKDG AKDAGFTGFH RIEYALWVEK DVSGVKEIAA

251    KLMTDVEALQ KEIDALAFPP GKVVGGASEL IEEVAGSKIS GEEDRYSHTD

301    LSDFQANVDG SKKIVDLFRP LIETKNKALL EKTDTNFKQV NEILAKYRTK

351    DGFETYDKLG EADRKALQAS INALAEDLAQ LRGILGLK*
```

Computer analysis of this amino acid sequence gave the following results:
Homology with a Predicted ORF from *N. meningitidis*
ORF 749 shows 99.7% identity over a 388 aa overlap with a predicted ORF (ORF 749) from *N. meningitidis*:
a749/m749 99.7% identity in 388 aa overlap

```
                   10         20         30         40         50         60
a749.pep   MRKFNLTALSVMLALGLTACQPPEAEKAAPAASGEAQTANEGGSVSIAVNDNACEPMELT
           ||||||||||||||||||||||||||||||||||||||||||||||||||||||||||||
m749       MRKFNLTALSVMLALGLTACQPPEAEKAAPAASGEAQTANEGGSVSIAVNDNACEPMELT
                   10         20         30         40         50         60

70         80         90        100        110        120
a749.pep   VPSGQVVFNIKNNSGRKLEWEILKGVMVVDERENIAPGLSDKMTVTLLPGEYEMTCGLLT
           ||||||||||||||||||||||||||||||||||||||||||||||||||||||||||||
m749       VPSGQVVFNIKNNSGRKLEWEILKGVMVVDERENIAPGLSDKMTVTLLPGEYEMTCGLLT
                   70         80         90        100        110        120

130        140        150        160        170        180
a749.pep   NPRGKLVVTDSGFKDTANEADLEKLSQPLADYKAYVQGEVKELVAKTKTFTEAVKAGDIE
           ||||||||||||||||||||||||||||||||||||||||||||||||||||||||||||
m749       NPRGKLVVTDSGFKDTANEADLEKLSQPLADYKAYVQGEVKELVAKTKTFTEAVKAGDIE
                  130        140        150        160        170        180

190        200        210        220        230        240
a749.pep   KAKSLFADTRVHYERIEPIAELFSELDPVIDAREDDFKDGAKDAGFTGPHRIEYALWVEK
           ||||||||||||||||||||||||||||||||||||||||||||||||||||||||||||
m749       KAKSLFADTRVHYERIEPIAELFSELDPVIDAREDDFKDGAKDAGFTGPHRIEYALWVEK
                  190        200        210        220        230        240

250        260        270        280        290        300
a749.pep   DVSGVKEIAAKLMTDVEALQKEIDALAFPPGKVVGGASELIEEVAGSKISGEEDRYSHTD
           ||||||||||||||||||||||||||||||||||||||||||||||||||||||||||||
m749       DVSGVKEIAAKLMTDVEALQKEIDALAFPPGKVVGGASELIEEVAGSKISGEEDRYSHTD
                  250        260        270        280        290        300
```

```
                310         320        330        340        350         360
a749.pep  LSDFQANVDGSKKIVDLFRPLIETKNKALLEKTDTNFKQVNEILAKYRTKDGFETYDKLG
          ||||||||||||||||||||||||:|||||||||||||||||||||||||||||||||||
m749      LSDFQANVDGSKKIVDLFRPLIEAKNKALLEKTDTNFKQVNEILAKYRTKDGFETYDKLG
                310         320        330        340        350         360

370         380        389
a749.pep  EADRKALQASINALAEDLAQLRGILGLKX
          |||||||||||||||||||||||||||||
m749      EADRKALQASINALAEDLAQLRGILGLKX
                370         380
```

The following partial DNA sequence was identified in *N. gonorrhoeae* <SEQ ID 2573>:

```
g750.seq
    1  GTGAAACCGC GTTTTTATTG GGCAGcctGC GCCGTCCTGC CGGCCGCCTG
   51  TTCGCCCGAA CCTGCCGCCG AAAAAACTGT ATccgCCGCA TCCCAAGCCG
  101  CATCCACACC TGTCGCCACG CTGACCGTGC CGACCGCGCG GGGCGATGCC
  151  GTTGTGCCGA AGAATCCCGA ACgcgtcgcc gtgtAcgaCt ggGCGGCGTt
  201  ggaTACGCTG ACCGAGCCGG GCGTGAATGT GGGCGCAACC ACCGCGCCGG
  251  TGCGCGTGGA CTATTTGCAG CCTGCATTTG ACAAGGCGGC AACGGTGGGG
  301  ACGCTGTTTG AGCCCGATTG CGAATCCCTG CACCGCCACA ATCCGCAGTT
  351  TGTCATTACC GGCGGGCCGG GTGCGGAAGC GTATGAACAG TTGGCGAAAA
  401  ACGCGACCAC CATAGATTTG ACGGTGGACA ACGGCAATAT CCGCACCAGC
  451  GGCGAGAAGC AGATGGAGAC CCTGTCGCGG ATTTTCGGTA AGGAAGCGCG
  501  CGTGGCGGAA TTGAATGCGC AGATTGACGC GCTGTTCGCC CAAAAGCGCG
  551  AAGCCGCCAA AGGCAAAGGA CGCGGGCTGG TGCTGTCGGT TACAGGCAAC
  601  AAGGTGTCCG CCTTCGGCAC GCAATCGCGG TTGGCAAGTT GGATACACGG
  651  CGACATCGGC CTGCCGCCCG TGGACGAATC TTTACGCAAC GAAGGGCACG
  701  GGCAGCCCGT TTCCTTCGAA TACATCAAAG AGAAAAACCC CGGCTGGATT
  751  TTCATCATCG ACCGCACCGC CGCCATCGGG CAGGAAGGGC CGGCTGCCGT
  801  GGAAGTGTTG GATAACGCGC TGGTATGCGG CACGAACGCT TGGAAGCGCA
  851  AGCAAATCAT CGTCATGCCT GCCGCGAACT ACATTGTCGC GGGCGGCGCG
  901  CGGCAGTTGA TACAGGCGGC GGAACAGTTG AAGGCGGCGT TTGAAAAGGC
  951  AGAACCCGTT GCGGCGCAGT AG
```

This corresponds to the amino acid sequence <SEQ ID 2574; ORF 750.ng>:

```
g750.pep
    1  VKPRFYWAAC AVLPAACSPE PAAEKTVSAA SQAASTPVAT LTVPTARGDA
   51  VVPKNPERVA VYDWAALDTL TEPGVNVGAT TAPVRVDYLQ PAFDKAATVG
  101  TLFEPDCESL HRHNPQFVIT GGPGAEAYEQ LAKNATTIDL TVDNGNIRTS
  151  GEKQMETLSR IFGKEARVAE LNAQIDALFA QKREAAKGKG RGLVLSVTGN
  201  KVSAFGTQSR LASWIHGDIG LPPVDESLRN EGHGQPVSFE YIKEKNPGWI
  251  FIIDRTAAIG QEGPAAVEVL DNALVCGTNA WKRKQIIVMP AANYIVAGGA
  301  RQLIQAAEQL KAAFEKAEPV AAQ*
```

The following partial DNA sequence was identified in *N. meningitidis* <SEQ ID 2575>:

```
m750.seq
    1   GTGAAACCGC GTTTTTATTG GGCAGCCTGC GCCGTCCTGC TGACCGCCTG

51   TTCGCCCGAA CCTGCCGCCG AAAAAACTGT ATCCGCCGCA TCCGCATCTG

101   CCGCCACGCT GACCGTGCCG ACCGCGCGGG GCGATGCCGT TGTGCCGAAG

151   AATCCCGAAC GCGTCGCCGT GTACGACTGG GCGGCGTTGG ATACGCTGAC

201   CGAATTGGGC GTGAATGTGG GCGCAACCAC CGCGCCGGTG CGCGTGGATT

251   ATTTGCAGCC TGCATTTGAC AAGGCGGCAA CGGTGGGGAC GCTGTTCGAG

301   CCCGATTACG AAGCCCTGCA CCGCTACAAT CCTCAGCTTG TCATTACCGG

351   CGGGCCGGGC GCGGAAGCGT ATGAACAGTT AGCGAAAAAC GCGACCACCA

401   TAGATCTGAC GGTGGACAAC GGCAATATCC GCACCAGCGG CGAAAAGCAG

451   ATGGAGACCT TGGCGCGGAT TTTCGGCAAG GAAGCGCGCG CGGCGGAATT

501   GAAGGCGCAG ATTGACGCGC TGTTCGCCCA AACGCGCGAA GCCGCCAAAG

551   GCAAAGGACG CGGGCTGGTG CTGTCGGTTA CGGGCAACAA GGTGTCCGCC

601   TTCGGCACGC AGTCGCGGTT GGCAAGTTGG ATACACGGCG ACATCGGCCT

651   ACCGCCTGTA GACGAATCTT TACGCAACGA GGGGCACGGG CAGCCTGTTT

701   CCTTCGAATA CATCAAAGAG AAAAACCCCG ATTGGATTTT CATCATCGAC

751   CGTACCGCCG CCATCGGGCA GGAAGGGCCG GCGGCTGTCG AAGTATTGGA

801   TAACGCGCTG GTACGCGGCA CGAACGCTTG GAAGCGCAAG CAAATCATCG

851   TCATGCCTGC CGCGAACTAC ATTGTCGCGG GCGGCGCGCG GCAGTTGATT

901   CAGGCGGCGG AGCAGTTGAA GGCGGCGTTT AAAAAGGCAG AACCCGTTGC

951   GGCGGGGAAA AAGTAG
```

This corresponds to the amino acid sequence <SEQ ID 2576; ORF 750>:

```
m750.pep
    1   VKPRFYWAAC AVLLTACSPE PAAEKTVSAA SASAATLTVP TARGDAVVPK

51   NPERVAVYDW AALDTLTELG VNVGATTAPV RVDYLQPAFD KAATVGTLFE

101   PDYEALHRYN PQLVITGGPG AEAYEQLAKN ATTIDLTVDN GNIRTSGEKQ

151   METLARIFGK EARAAELKAQ IDALFAQTRE AAKGKGRGLV LSVTGNKVSA

201   FGTQSRLASW IHGDIGLPPV DESLRNEGHG QPVSFEYIKE KNPDWIFIID

251   RTAAIGQEGP AAVEVLDNAL VRGTNAWKRK QIIVMPAANY IVAGGARQLI

301   QAAEQLKAAF KKAEPVAAGK K*
```

Computer analysis of this amino acid sequence gave the following results:
Homology with a Predicted ORF from *N. gonorrhoeae*
ORF 750 shows 93.8% identity over a 322 aa overlap with a predicted ORF (ORF 750) from *N. gonorrhoeae*
m750/g750 93.8% identity in 322 aa overlap

```
                     10        20        30        40        50
         m750.pep    VKPRFYWAACAVLLTACSPEPAAEKTVSAASASA----ATLTVPTARGDAVVPKNPERVA
                     ||||||||||||:|||||||||||||||||:|    ||||||||||||||||||||||
         g750        VKPRFYWAACAVLPAACSPEPAAEKTVSAASQAASTPVATLTVPTARGDAVVPKNPERVA
                             10        20        30        40        50        60
```

-continued

```
              60         70         80         90        100        110
m750.pep   VYDWAALDTLTELGVNVGATTAPVRVDYLQPAFDKAATVGTLFEPDYEALHRYNPQLVIT
           ||||||||||| |||||||||||||||||||||||||||||||||| |:|||:|||:|||
g750       VYDWAALDTLTEPGVNVGATTAPVRVDYLQPAFDKAATVGTLFEPDCESLHRHNPQFVIT
                  70         80         90        100        110        120

120        130        140        150        160        170
m750.pep   GGPGAEAYEQLAKNATTIDLTVDNGNIRTSGEKQMETLARIFGKEARAAELKAQIDALFA
           ||||||||||||||||||||||||||||||||||||||:||||||||:|||:||||||||
g750       GGPGAEAYEQLAKNATTIDLTVDNGNIRTSGEKQMETLSRIFGKEARVAELNAQIDALFA
                  130        140        150        160        170        180

180        190        200        210        220        230
m750.pep   QTREAAKGKGRGLVLSVTGNNVSAFGTQSRLASWIHGDIGLPPVDESLRNEGHGQPVSFE
           | ||||||||||||||||||||||||||||||||||||||||||||||||||||||||||
g750       QKREAAKGKGRGLVLSVTGNNVSAFGTQSRLASWIHGDIGLPPVDESLRNEGHGQPVSFE
                  190        200        210        220        230        240

240        250        260        270        280        290
m750.pep   YIKEKNPDWIFIIDRTAAIGQEGPAAVEVLDNALVRGTNAWKRKQIIVMPAANYIVAGGA
           ||||||| ||||||||||||||||||||||||||||||||||||||||||||||||||||
g750       YIKEKNPGWIFIIDRTAAIGQEGPAAVEVLDNALVRGTNAWKRKQIIVMPAANYIVAGGA
                  250        260        270        280        290        300

300        310        320
m750.pep   RQLIQAAEQLKAAFKKAEPVAAGKKX
           ||||||||||||||:|||||||
g750       RQLIQAAEQLKAAFEKAEPVAAQX
                  310        320
```

The following partial DNA sequence was identified in *N. meningitidis* <SEQ ID 2577>:

a750.seq

1 GTGAAACCGC GTTTTTATTG GGCAGCCTGC GCCGTCCTGC TGACCGCCTG

51 TTCGCCCGAA CCTGCCGCCG AAAAAACTGT ATCCGCCGCA TCCGCATCTG

101 CCGCCACACT GACCGTGCCG ACCGCGCGGG GCGATGCCGT TGTGCCGAAG

151 AATCCCGAAC GCGTCGCCGT GTACGACTGG GCGGCGTTGG ATACGCTGAC

201 CGAATTGGGT GTGAATGTGG GCGCAACCAC CGCGCCGGTG CGCGTGGATT

251 ATTTGCAGCC TGCATTTGAC AAGGCGGCAA CGGTGGGGAC GCTGTTCGAG

301 CCCGATTACG AAGCCCTGCA CCGCTACAAT CCTCAGCTTG TCATTACCGG

351 CGGGCCGGGC GCGGAAGCGT ATGAACAGTT GGCGAAAAAC GCGACCACCA

401 TAGATCTGAC GGTGGACAAC GGCAATATCC GCACCAGCGG CGAAAAGCAG

451 ATGGAGACCT TGGCGCGGAT TTTCGGCAAG GAAGCGCGCG CGGCGGAATT

501 GAAGGCGCAG ATTGACGCGC TGTTCGCCCA AACGCGCGAA GCCGCCAAAG

551 GCAAAGGACG CGGGCTGGTG CTGTCGGTTA CGGGCAACAA GGTGTCCGCC

601 TTCGGCACGC AGTCGCGGTT GGCAAGTTGG ATACACGGCG ACATCGGCCT

651 ACCGCCTGTA GACGAATCTT TACGCAACGA GGGGCACGGG CAGCCTGTTT

701 CCTTCGAATA CATCAAAGAG AAAAACCCCG ATTGGATTTT CATCATCGAC

751 CGTACCGCCG CCATCGGGCA GGAAGGGCCG GCGGCTGTCG AAGTATTGGA

801 TAACGCGCTG GTACGCGGCA CGAACGCTTG GAAGCGCAAG CAAATCATCG

851 TCATGCCTGC CGCGAACTAC ATTGTCGCGG GCGGCTCGCG GCAGTTGATT

901 CAGGCGGCGG AGCAGTTGAA GGAGGCGTTT GAAAAGGCAG AACCCGTTGC

951 GGCGGGGAAA GAGTAG

This corresponds to the amino acid sequence <SEQ ID 2578; ORF 750.a>:

```
a750.pep
    1   VKPRFYWAAC AVLLTACSPE PAAEKTVSAA SASAATLTVP TARGDAVVPK

51   NPERVAVYDW AALDTLTELG VNVGATTAPV RVDYLQPAFD KAATVGTLFE

101   PDYEALHRYN PQLVITGGPG AEAYEQLAKN ATTIDLTVDN GNIRTSGEKQ

151   METLARIFGK EARAAELKAQ IDALFAQTRE AAKGKGRGLV LSVTGNKVSA

201   FGTQSRLASW IHGDIGLPPV DESLRNEGHG QPVSFEYIKE KNPDWIFIID

251   RTAAIGQEGP AAVEVLDNAL VRGTNAWKRK QIIVMPAANY IVAGGSRQLI

301   QAAEQLKEAF EKAEPVAAGK E*
```

Computer analysis of this amino acid sequence gave the following results:
Homology with a Predicted ORF from *N. meningitidis*
ORF 750 shows 98.8% identity over a 321 aa overlap with a predicted ORF (ORF 750) from *N. meningitidis*:
a750/m750 98.8% identity in 321 aa overlap

```
                    10         20         30         40         50         60
      a750.pep  VKPRFYWAACAVLLTACSPEPAAEKTVSAASASAATLTVPTARGDAVVPKNPERVAVYDW
                ||||||||||||||||||||||||||||||||||||||||||||||||||||||||||||
      m750      VKPRFYWAACAVLLTACSPEPAAEKTVSAASASAATLTVPTARGDAVVPKNPERVAVYDW
                    10         20         30         40         50         60
                    70         80         90        100        110        120
      a750.pep  AALDTLTELGVNVGATTAPVRVDYLQPAFDKAATVGTLFEPDYEALHRYNPQLVITGGPG
                ||||||||||||||||||||||||||||||||||||||||||||||||||||||||||||
      m750      AALDTLTELGVNVGATTAPVRVDYLQPAFDKAATVGTLFEPDYEALHRYNPQLVITGGPG
                    70         80         90        100        110        120
                   130        140        150        160        170        180
      a750.pep  AEAYEQLAKNATTIDLTVDNGNIRTSGEKQMETLARIFGKEARAAELKAQIDALFAQTRE
                ||||||||||||||||||||||||||||||||||||||||||||||||||||||||||||
      m750      AEAYEQLAKNATTIDLTVDNGNIRTSGEKQMETLARIFGKEARAAELKAQIDALFAQTRE
                   130        140        150        160        170        180
                   190        200        210        220        230        240
      a750.pep  AAKGKGRGLVLSVTGNKVSAFGTQSRLASWIHGDIGLPPVDESLRNEGHGQPVSFEYIKE
                ||||||||||||||||||||||||||||||||||||||||||||||||||||||||||||
      m750      AAKGKGRGLVLSVTGNKVSAFGTQSRLASWIHGDIGLPPVDESLRNEGHGQPVSFEYIKE
                   190        200        210        220        230        240
                   250        260        270        280        290        300
      a750.pep  KNPDWIFIIDRTAAIGQEGPAAVEVLDNALVRGTNAWKRKQIIVMPAANYIVAGGSRQLI
                |||||||||||||||||||||||||||||||||||||||||||||||||||||||:||||
      m750      KNPDWIFIIDRTAAIGQEGPAAVEVLDNALVRGTNAWKRKQIIVMPAANYIVAGGARQLI
                   250        260        270        280        290        300
                   310        320
      a750.pep  QAAEQLKEAFEKAEPVAAGKEX
                |||||||  ||:|||||||||:|
      m750      QAAEQLKAAFKKAEPVAAGKKX
                   310        320
``` g751.seq not found yet
g751.pep not found yet
The following partial DNA sequence was identified in *N. meningitidis* <SEQ ID 2579>:

```
m751.seq..
    1   ATGGCTTGGA GTATGTTTGC CACAACCCAA GCCGATAGAG CGGTAAGGTC

51   TGCAACTGCA CCTAAAGAAA TGTGGTTCCA TAAGAAGATA ATAGATGAAA

101   AAACAGGTAA AGTATCCTTT GATACCAGAC AAATTTGGTC ATTGAATGAT

151   TTAAGCAAGG AAGAACTGGC AAGCATTCAA GACACAAATG GCAAAGTTAT

201   TACTGTGTCT AATCCTGGTA TTTTCAATAA TCGAGAAGAT TCATTAAGCA

251   ACGCAGCAAA ACAAAATCGT AATAGTACAA CGGTAGTGG TGTTATTGCA

301   GTCATGAATC CTCCAACAGG GAAATATAAA TCTGATTCTA ATAACAAAAT
```

```
       351   AAAAGATTTT TTATGGCTCG GTTCAAGTCT TGTTTCTGAA CTGATGTATG

401   TCGGTTACGA CCAATTAAAT AATAAAGTGT TCCAAGGCTA TTTACCCAAA

451   ACCAATTCAG AAAAACTGAA TCAAGATATT TATCGAGAGG TTCAAAAAAT

501   GGGTAACGGC TGGTCGGTTG ATACCAGTAA TCACAGTCGT GGGGGAATTA

551   CAGCAAGCGT TTCCTTAAAA GATTGGGTAA CAATCAAAA ACAAAATGGC

601   ATTGCCCCAA TCAGAAAAGC ACGTTTCTAT GGTACAGCCA CAAATGTGCA

651   GAATGATTAC GCCGATGTTT TACAGAAAAA CGGCTATACC TATACGGGTG

701   CAGACGGCAA AACTTATAAC AGCGGATCCT ACTCAATCGT GCATGATAAA

751   GATTTTGTGG GGAACAAATG GATACCTTTC TTGCTAGGAA CCAATGACAC

801   CACACAAGGT ACATGTAAGG GGTTGTGCTA TTCGCATAGC AGTTATTTTG

851   CGGAGGTGCC AAAAGCAGGT ACAAAAGAAT TTGATGACTA TGTAAAAATA

901   TGGGGTGAAG TTGAATATGA CGCTCAAGGT AAGCCAATTA ACAAATCTAA

951   ACCCATACTG GTAGAACCAA ACAAACAAA AGATAATGAA AAATATGAAA

1001   AAGAAGCTTT CTAA
```

This corresponds to the amino acid sequence <SEQ ID 2580; ORF 751>:

```
m751.pep..
         1   MAWSMFATTQ ADRAVRSATA PKEMWFHKKI IDEKTGKVSF DTRQIWSLND

51   LSKEELASIQ DTNGKVITVS NPGIFNNRED SLSNAAKQNR NSTNGSGVIA

101   VMNPPTGKYK SDSNNKIKDF LWLGSSLVSE LMYVGYDQLN NKVFQGYLPK

151   TNSEKLNQDI YREVQKMGNG WSVDTSNHSR GGITASVSLK DWVNNQKQNG

201   IAPIRKARFY GTATNVQNDY ADVLQKNGYT YTGADGKTYN SGSYSIVHDK

251   DFVGNKWIPF LLGTNDTTQG TCKGLCYSHS SYFAEVPKAG TKEFDDYVKI

301   WGEVEYDAQG KPINKSKPIL VEPNKTKDNE KYEKEAF*
``` a751.seq not found yet
a751.pep not found yet
  g752.seq not found yet
  g752.pep not found yet The following partial DNA sequence was identified in *N. meningitidis* <SEQ ID 2581>:

```
m752.seq..
         1   ATGAAAATTT CCAGACCTCC GGAATTTACC CTGTTGCAAC AGGAATATAT

51   GCAGCATCTC ACTGAAAGAA TGACGCAAAT TGCCAAGCTG CTGAATTCTT

101   CCGCAAACAA TCCTGATATA GACATTCCCG ATTTTCTTAC TGAAATCAAA

151   GATTATTCAG AATTTTCCGT GACAGATGAA AATGGAACCT ACCTGCATTG

201   GGACAAATTC CGCCGGATTC ACACGGAAGA TACGCGGATG AAATGGCGCG

251   CCGTTAAGGA AAGCCGCAAA AAAATCCAAA AACCAATTGA TTTCCCGTTT

301   GAACATCAGT TTTGGTTCTG CATTCCCGAC TCTTTGCAGG CACGGCTTCA

351   TTTGATTGAC AAAAGCTGCG GCAGTTCTAT CGGCACGTCT AGCTTGGGTG

401   GCTTCGGCAG AAGCGAGCAA AACAGATTCT TGCTCAAGTC TCTGATTATG

451   GAAGAAGCGA TTACATCCGC CCAACTGGAA GGTGCGGCTA CCACGCGTAA

501   AGTGGCCAAG GATATGCTCA AATCGCAGCG TAAACCCAAA ACAAAAGACG
```

```
 551    AAATCATGAT AGTGAACAAC TATCACTTGA TGAAAAAAGC GGTAGAATTG

601    AAAAATACGC CGTTAAGTGT TGAAATGATT TTGGATTTGC ACCGCATTGC

651    TACCAGTAAC GCTATTGAAA ACAAGGCCGA GCCCGGACAA TTCAGGCAGG

701    ATGACGAAAT CTTTATCGCC GATATCAATG GTAACAGCCT GTATCAACCA

751    CCGCCGCACG GACAGGTTCA TACGCTGATG GAAGAGGTGT GTGCGTTTGC

801    CAATAATACC TATGACGGCG TGGAAAATCC GTTTATCCAT CCGGTTGTCC

851    AAGCTATTAT CTTGCATTTC CTCATCGGCT ACATCCACCC ATTTGGTGAT

901    GGCAACGGGC GGACAGCGCG GCTTTGTTC TATTGGTTTA TGCTCAAAAA

951    CGGCTACTGG CTATTTGAAT ACATATCCAT CAGCCGTCTT CTGAAAAACG

1001    CTCCTGCCCA ATACGCCAAA TCCTATTTGT ATGCGGAAAC TGACGATTTA

1051    GATTTAACCT ATTTCATCTA TTACCAATGC GATATTATCA AGCGGGCGGT

1101    TGCCGATTTG GAGCACTACA TTTCCGACAA ACAAAAACAC CAACAGGAAT

1151    TCAAAGCAGC GATTGCCCAA TATACTGAAA AGATAGGAAA GTTGAACCAA

1201    CGGCAAATTG GTATCCTGCA AAAAGCAGTG GAAGAAAGCG GAAAAATCTT

1251    TACTGCACAA GAAATTGCCA ACCAATACGG CATCTCCCTG AATACTGCCC

1301    GTAGCGATTT GAGTAAACTG GGAGAATATA GATTCCTAGT GCCGTTCAAA

1351    TCAGGAAATG CTTTAGAGTA TGTTGCTCCT CAGGATTTAT TGGAAAGGTT

1401    AGAAAAAAAA TAG
```

This corresponds to the amino acid sequence <SEQ ID 2582; ORF 752>:

```
m752.pep
   1    MKISRPPEFT LLQQEYMQHL TERMTQIAKL LNSSANNPDI DIPDFLTEIK

51    DYSEFSVTDE NGTYLHWDKF RRIHTEDTRM KWRAVKESRK KIQKPIDFPF

101    EHQFWFCIPD SLQARLHLID KSCGSSIGTS SLGGFGRSEQ NRFLLKSLIM

151    EEAITSAQLE GAATTRKVAK DMLKSQRKPK TKDEIMIVNN YHLMKKAVEL

201    KNTPLSVEMI LDLHRIATSN AIENKAEPGQ FRQDDEIFIA DINGNSLYQP

251    PPHGQVHTLM EEVCAFANNT YDGVENPFIH PVVQAIILHF LIGYIHPFGD

301    GNGRTARALF YWFMLKNGYW LFEYISISRL LKNAPAQYAK SYLYAETDDL

351    DLTYFIYYQC DIIKRAVADL EHYISDKQKH QQEFKAAIAQ YTEKIGKLNQ

401    RQIGILQKAV EESGKIFTAQ EIANQYGISL NTARSDLSKL GEYRFLVPFK

451    SGNALEYVAP QDLLERLEKK *
```

The following partial DNA sequence was identified in N. meningitidis <SEQ ID 2583>:

```
m752-1.seq
   1    ATGAAAATTT CCAGACCTCC GGAATTTACC CTGTTGCAAC AGGAATATAT

51    GCAGCATCTC ACTGAAAGAA TGACGCAAAT TGCCAAGCTG CTGAATTCTT

101    CCGCAAACAA TCCTGATATA GACATTCCCG ATTTTCTTAC TGAAATCAAA

151    GATTATTCAG AATTTTCCGT GACAGATGAA AATGGAACCT ACCTGCATTG
```

```
     201    GGACAAATTC CGCCGGATTC ACACGGAAGA TACGCGGATG AAATGGCGCG

251    CCGTTAAGGA AAGCCGCAAA AAAATCCAAA AACCAATTGA TTTCCCGTTT

301    GAACATCAGT TTTGGTTCTG CATTCCCGAC TCTTTGCAGG CACGGCTTCA

351    TTTGATTGAC AAAAGCTGCG GCAGTTCTAT CGGCACGTCT AGCTTGGGTG

401    GCTTCGGCAG AAGCGAGCAA AACAGATTCT TGCTCAAGTC TCTGATTATG

451    GAAGAAGCGA TTACATCCGC CCAACTGGAA GGTGCGGCTA CCACGCGTAA

501    AGTGGCCAAG GATATGCTCA AATCGCAGCG TAAACCCAAA ACAAAAGACG

551    AAATCATGAT AGTGAACAAC TATCACTTGA TGAAAAAAGC GGTAGAATTG

601    AAAAATACGC CGTTAAGTGT TGAAATGATT TTGGATTTGC ACCGCATTGC

651    TACCAGTAAC GCTATTGAAA ACAAGGCCGA GCCCGGACAA TTCAGGCAGG

701    ATGACGAAAT CTTTATCGCC GATATCAATG GTAACAGCCT GTATCAACCA

751    CCGCCGCACG GACAGGTTCA TACGCTGATG GAAGAGGTGT GTGCGTTTGC

801    CAATAATACC TATGACGGCG TGGAAAATCC GTTTATCCAT CCGGTTGTCC

851    AAGCTATTAT CTTGCATTTC CTCATCGGCT ACATCCACCC ATTTGGTGAT

901    GGCAACGGGC GGACAGCGCG GGCTTTGTTC TATTGGTTTA TGCTCAAAAA

951    CGGCTACTGG CTATTTGAAT ACATATCCAT CAGCCGTCTT CTGAAAAACG

1001    CTCCTGCCCA ATACGCCAAA TCCTATTTGT ATGCGGAAAC TGACGATTTA

1051    GATTTAACCT ATTTCATCTA TTACCAATGC GATATTATCA AGCGGGCGGT

1101    TGCCGATTTG GAGCACTACA TTTCCGACAA ACAAAAACAC CAACAGGAAT

1151    TCAAAGCAGC GATTGCCCAA TATACTGAAA AGATAGGAAA GTTGAACCAA

1201    CGGCAAATTG GTATCCTGCA AAAAGCAGTG GAAGAAAGCG GAAAAATCTT

1251    TACTGCACAA GAAATTGCCA ACCAATACGG CATCTCCCTG AATACTGCCC

1301    GTAGCGATTT GAGTAAACTG GGAGAATATA GATTCCTAGT GCCGTTCAAA

1351    TCAGGAAATG CTTTAGAGTA TGTTGCTCCT CAGGATTTAT GGAAAGGTT

1401    AGAAAAAAAA TAG
```

This corresponds to the amino acid sequence <SEQ ID 2584;
ORF 752-1>:

```
m752-1.pep
      1    MKISRPPEFT LLQQEYMQHL TERMTQIAKL LNSSANNPDI DIPDFLTEIK

51    DYSEFSVTDE NGTYLHWDKF RRIHTEDTRM KWRAVKESRK KIQKPIDFPF

101    EHQFWFCIPD SLQARLHLID KSCGSSIGTS SLGGFGRSEQ NRFLLKSLIM

151    EEAITSAQLE GAATTRKVAK DMLKSQRKPK TKDEIMIVNN YHLMKKAVEL

201    KNTPLSVEMI LDLHRIATSN AIENKAEPGQ FRQDDEIFIA DINGNSLYQP

251    PPHGQVHTLM EEVCAFANNT YDGVENPFIH PVVQAIILHF LIGYIHPFGD

301    GNGRTARALF YWFMLKNGYW LFEYISISRL LKNAPAQYAK SYLYAETDDL

351    DLTYFIYYQC DIIKRAVADL EHYISDKQKH QQEFKAAIAQ YTEKIGKLNQ

401    RQIGILQKAV EESGKIFTAQ EIANQYGISL NTARSDLSKL GEYRFLVPFK

451    SGNALEYVAP QDLLERLEKK *
``` a752.seq not found yet
a752.pep not found yet
  g753.seq not found yet
  g753.pep not found yet
The following partial DNA sequence was identified in *N. meningitidis* <SEQ ID 2585>:

```
m753.seq
    1   ATGCCCATCA CTCCACCCTT AAACATCATC TCTCCTAAAC TCTACCCCAA

51   TGAACAATGG AACGAAAGCG AAGCACTCGG TGCCATCACT TGGCTATGGT

101   ATCAGTCGCC TACGCATCGC CAAGTACCTA TTGTGGAGAT GATGACGTAT

151   ATATTGCCTG TGTTAAAAAA CGGGCAGTTC GCTTTGTTTT GCAAGGGTAC

201   CCAACCAATC GGTTATATCT CATGGGCTTA TTTTGATGAA GTGGCGCAGG

251   CGCATTATTT AGAATCTGAC CGCCATTTGC GTGACAACAG CGATTGGAAC

301   TGTGGCGACA ATATTTGGCT GATTCAATGG TTTGCGCCAT GGGACACAG

351   TCATCAAATG CGCTCAGCTG TGCGCCAGTT ATTTCCTAGT ACGACAGTAC

401   GCGCCTTGTA TCATAAAGGG AGCGATAAGG GTTTGAGAAT TTTAACTTTT

451   AAAACTTGA
```

This corresponds to the amino acid sequence <SEQ ID 2586; ORF 753>:

```
m753.pep
    1   MPITPPLNII SPKLYPNEQW NESEALGAIT WLWYQSPTHR QVPIVEMMTY

51   ILPVLKNGQF ALFCKGTQPI GYISWAYFDE VAQAHYLESD RHLRDNSDWN

101   CGDNIWLIQW FAPLGHSHQM RSAVRQLFPS TTVRALYHKG SDKGLRILTF

151   KT*
``` a753.seq not found yet
  a753.pep not found yet
  g754.seq not found yet
  g754.pep not found yet
The following partial DNA sequence was identified in *N. meningitidis* <SEQ ID 2587>:

```
m754.seq
    1   ATGATGAAGT CTATCCTCAC CGTATCCGGA AATCGTATGC GTAAACCCAG

51   AATCACCTAT TTGGATGTTT GGGCAAACGA TGAAAGAATC GGTACTTTGG

101   AAAAGGGGGC CATGTATCGG TTCGCATACG ACAATCCCAA TTCTTCGTTG

151   CTGGGCCTGC ATTATCAAGA CAGAAGCAAG GTATATATCA GCAACAATAT

201   GCCGCATATC TTTGCACAGT ATTTTCCGGA AGGCTTTTTG GATGCACACA

251   TCACAAGCAA ATATGCTTTT CATGATGCGC CTTTTGAAGA CAATGAGATG

301   CTGCGCTTGG CAATTCTGTG CAGAGAGACT TTGGGTCGGA TACATGTGCG

351   CTGTAATGAC CCGCTTTTTA ATGAATGGAT TGACGGGTTG GAGATGAAAA

401   ATCCAAGAAT ATTGACTGAA CGGGATTTGC TGGGCATAAA TGCCCGACAG

451   GTTTTTCAGC AATATATGGC AGAAATCTTC CATCACGGCC GTTTCGTCAG

501   TGTATCCGGG ATACAGCAGA AGATGTCCTT AGATGCCATC CGCAGAAATA

551   CCAAGCAAAC TGCCTCATAT ATTGCCAAAG GTTTTGATGC ATCCGAATAT

601   CCTTGCTTGG CTGCCAATGA ATTTTTATGC ATGCAGACCA TCAAACAAGC
```

```
 651  CGGCATTGCC GTTGCACAGA CCAGCCTGTC GGAAGATTCA TCAGTCTTAT

701  TGGTACGTCG GTTTGATGTC AGTGAACAGG GTTATTTTTT AGGGATGGAA

751  GACTTTACCA GTCTGCGCCA GTATTCGGTA GAAGATAAAT ATAAAGGCAG

801  TTATGCGGCT ATTGCACAGA TTATCCGACA GATATCCGGC AGACCAGATG

851  AAGATTTAAT CCATTTCTTT AATCAGCTTG CTGCCAGTTG CATATTGAAA

901  AACGGCGATG CACACCTCAA AAATTTTTCA GTACTCTATC ATGACGAATA

951  CGATGTTCGT CTTGCACCTG TCTATGATGT ATTGGATACA TCAATATACA

1001  GGGTTGGAAC ACAAGGAATT TTTGATGCTT ATGACGATAC GCTGGCATTA

1051  AACCTGACTA ACCACGGTAA GAAAACATAT CCTTCCAAGA ATACATTGTT

1101  GGATTTTGCT GAGAAATATT GCGATTTGGG AAGAGAAGAT GCATCCTTTA

1151  TGATAGATAC AATCGTTCAA GCTAAAGAAC AGGTTCTTGT TAAATACTCG

1201  GATGTATTGC GTGAGAATGA ATGGTTGGCG CAGAAGTGGC ATTTTATCCC

1251  GGATGAAAAT GAAGAAGGTC TACCGTTTAC ATTCCGGTAG
```

This corresponds to the amino acid sequence <SEQ ID 2588; ORF 754>:

```
m754.pep
   1  MMKSILTVSG NRMRKPRITY LDVWANDERI GTLEKGAMYR FAYDNPNSSL

51  LGLHYQDRSK VYISNNMPHI FAQYFPEGFL DAHITSKYAF HDAPFEDNEM

101  LRLAILCRET LGRIHVRCND PLFNEWIDGL EMKNPRILTE RDLLGINARQ

151  VFQQYMAEIF HHGRFVSVSG IQQKMSLDAI RRNTKQTASY IAKGFDASEY

201  PCLAANEFLC MQTIKQAGIA VAQTSLSEDS SVLLVRRFDV SEQGYFLGME

251  DFTSLRQYSV EDKYKGSYAA IAQIIRQISG RPDEDLIHFF NQLAASCILK

301  NGDAHLKNFS VLYHDEYDVR LAPVYDVLDT SIYRVGTQGI FDAYDDTLAL

351  NLTNHGKKTY PSKNTLLDFA EKYCDLGRED ASFMIDTIVQ AKEQVLVKYS

401  DVLRENEWLA QKWHFIPDEN EEGLPFTFR*
``` a754.seq not found yet
a754.pep not found yet
g755.seq not found yet
g755.pep not found yet The following partial DNA sequence was identified in *N. meningitidis* <SEQ ID 2589>:

```
m755.seq..
   1    ATGAGCCGTT ACCTGATTAC CTTTGATATG GATACCAACT GCCTGAAAGA

51    CAATTACCAC GGAAATAACT ATACCAATGC CTACTCCGAT ATTAAAACCA

101    TCTTGGCTAG ACATGGATTT GAGAACATTC AGGGCAGTGT TTATCTAGGC

151    CGTGAAGGCA TCAGTGAAGC ACACGGAACA ATAGCCATTC AGGAACTGAC

201    CGCTCGGTTT GATTGGTTTT ACTCCTGTAT TTCAAACATT AAGTTTTACC

251    GCCTTGAAAG TGATTTGAAC GCACAATTTA TCGCTGATGG TGTGTATCAA

301    GCCAAACAGG CTTTCCTTCA ACGTGTTGAA CAACTTCGTA TATCCCTAAC

351    AGAAGCTGGA TTGTCTGATG AGCAAATCAA TCAGGTTCTG GAAAAACAGA

401    AATTTGAATT GGAAAGTCCT AACCTGAAAT TAAATTAA
```

This corresponds to the amino acid sequence <SEQ ID 2590; ORF 755>:

```
m755.pep..
      1    MSRYLITFDM DTNCLKDNYH GNNYTNAYSD IKTILARHGF ENIQGSVYLG

51    REGISEAHGT IAIQELTARF DWFYSCISNI KFYRLESDLN AQFIADGVYQ

101    AKQAFLQRVE QLRISLTEAG LSDEQINQVL EKQKFELESP NLKLN*
``` a755.seq not found yet
a755.pep not found yet
g756.seq not found yet
g756.pep not found yet
The following partial DNA sequence was identified in *N. meningitidis* <SEQ ID 2591>:

```
m756.seq
      1    ATGACCGCCA ACTTTGCACA GACGCTGGTC GAAATACAGG ACAGTCTGTA

51    CAGGGTTGTG TCAACCGTCC AATACGGGGA TGACAACCTC AAGCGGTTGA

101    CAGCGGACAA ACGGAAGCAG TATGAGTTGA ACTTCAAGAT TTCCGAGGGT

151    TCTACGCGTG TAGAGTCCGA CTTTAAAGAG ACTTTGGTTC GGTTCGGTAG

201    AGATATGCTT CAAGATATGC CCCCTAAAAT CCGTTCGGCA ACGCTGGTAG

251    CGTTGACGAC CCTGCTTGTC GGAGGGGCGT TGGGTTACGG TTATTTGGAA

301    TACCTGAAGC AGGTTGCTTC GGAAGGGTAT CAGACCGAGC GTCTGTATAA

351    TGCCGTCGAC CGTCTTGCAG AATCCCAAGA ACGGATAACG TCCGCCATCC

401    TGAAGGGTGC TAGAGGTGCC GATTTCGTGC AAATCGGCAG ACGTTCCTAC

451    AGTAGGGAGG ATATATCGGA GGCAAATAGA CGTGCAGAGC GTGTCCCGTA

501    TGGCGCAGAG TTGGTTTCAG ACGGCAATTT TACCGCTGTT TTATCTGATA

551    TAGGGATTA A
```

This corresponds to the amino acid sequence <SEQ ID 2592; ORF 756>:

```
m756.pep
      1    MTANFAQTLV EIQDSLYRVV STVQYGDDNL KRLTADKRKQ YELNFKISEG

51    STRVESDFKE TLVRFGRDML QDMPPKIRSA TLVALTTLLV GGALGYGYLE

101    YLKQVASEGY QTERLYNAVD RLAESQERIT SAILKGARGA DFVQIGRRSY

151    SREDISEANR RAERVPYGAE LVSDGNFTAV LSDIGD*
```

The following partial DNA sequence was identified in *N. meningitidis* <SEQ ID 2593>:

```
a756.seq
      1    ATGACCGCCA ACTTTGCACA GACGCTGGTC GAAATACAGG ACAGTCTGTA

51    NAGGGTTGTG TCAACCGTCC AATACGGGGA TGACAACCTC AAGCGGTTGA

101    CAGCGGACAA ACGGAAGCAG TATGAGTTGA ACTTCAAGAT TTCCGAGGGT

151    TCTACGCGTG TAGAGTCCGA CTTTAAAGAG ACTTTGGTTC GGTTCGGTAG

201    AGATATGCTT CAAGATATGC CCCCTAAAAT CCGTTCGGCA ACGCTGGTAG

251    CGTTGACGAC CCTGCTTGTC GGAGGGGCGT TGGGTTACGG TTATTTGGAA

301    TACCTGAAGC AGGTTGCTTC GGAAGGGTAT CAGACCGAGC GTCTGTATAA

351    TGCCGTCGAC CGTCTTGCAG AATCCCAAGA ACGGATAACG TCCGCCATCC
```

-continued

```
401  TGAAGGGTGC TAGAGGTGCC GATTTCGTGC AAATCGGCAG ACGTTCCTAC
451  AGTAGGGAGG ATATATCGGA GGCAAATAGA CGTGCAGAGC GTGTCCCGTA
501  TGGCGCAGAG TTGGTTTCAG ACGGCAATTT TACCGCTGTT TTATCTGATA
551  TAGGGGATTA A
```

This corresponds to the amino acid sequence <SEQ ID 2594; ORF 756.a>:

```
a756.pep
   1  MTANFAQTLV EIQDSLXRVV STVQYGDDNL KRLTADKRKQ YELNFKISEG
  51  STRVESDFKE TLVRFGRDML QDMPPKIRSA TLVALTTLLV GGALGYGYLE
 101  YLKQVASEGY QTERLYNAVD RLAESQERIT SAILKGARGA DFVQIGRRSY
 151  SREDISEANR RAERVPYGAE LVSDGNFTAV LSDIGD*
``` m756/a756 99.5% identity in 186 aa overlap

```
                  10         20         30         40         50         60
m756.pep  MTANFAQTLVEIQDSLYRVVSTVQYGDDNLKRLTADKRKQYELNFKISEGSTRVESDFKE
          ||||||||||||||| ||||||||||||||||||||||||||||||||||||||||||||
a756      MTANFAQTLVEIQDSLXRVVSTVQYGDDNLKRLTADKRKQYELNFKISEGSTRVESDFKE
                  10         20         30         40         50         60

70         80         90        100        110        120
m756.pep  TLVRFGRDMLQDMPPKIRSATLVALTTLLVGGALGYGYLEYLKQVASEGYQTERLYNAVD
          ||||||||||||||||||||||||||||||||||||||||||||||||||||||||||||
a756      TLVRFGRDMLQDMPPKIRSATLVALTTLLVGGALGYGYLEYLKQVASEGYQTERLYNAVD
                  70         80         90        100        110        120

130        140        150        160        170        180
m756.pep  RLAESQERITSAILKGARGADFVQIGRRSYSREDISEANRRAERVPYGAELVSDGNFTAV
          ||||||||||||||||||||||||||||||||||||||||||||||||||||||||||||
a756      RLAESQERITSAILKGARGADFVQIGRRSYSREDISEANRRAERVPYGAELVSDGNFTAV
                 130        140        150        160        170        180 m756.pep  LSDIGDX
          |||||||
a756      LSDIGDX
``` g757.seq not found yet
g757.pep not found yet
The following partial DNA sequence was identified in *N. meningitidis* <SEQ ID 2595>:

```
m757.seq
   1  ATGAAAATAC TCGCTTTATT AATTGCCGCT ACCTGTGCTT TATCTGCGTG
  51  TGGCAGCCAA TCTGAAGAAC AACCGGCATC TGCACAACCC AAGAGCAGG
 101  CACAATCCGA ATTAAAAACC ATGCCGGTAA GCTATACCGA CTATCAATCA
 151  GCAGCCAATA AAGGGCTGAA TGACCAAAAA ACCGGTCTGA CCCTTCCTGA
 201  ACATGTTGTC CCTATCGACA ATGCGGAAGG AAAGAATCTG CTGCATGACT
 251  TTTCAGACGG CCTCACAATC TTAACCGTTG ATACCGATAA AGCCGACAAA
 301  ATTACTGCTG TCCGAGTAGT CTGGAATACA GATGCAATGC CTCAAAAAGC
 351  GGAAAAACTG TCCAAAGCTG CCGCAGCCTT GATTGCGGCA ACCGCTCCGG
 401  AAGACCGCAC AATGCTGCGT GATACCGGCG ACCAAATCGA ATGGCGATT
 451  GACAGCCATA ATGCGCAAAA AGAGCCAACC CGAGAATGGG CGCGTGGTGG
 501  GATTGCTTAT AAAGTCACTG TTACCAATTT ACCGAGCGTG GTTTTGACGG
 551  CAAAAGCTGA GTAA
```

This corresponds to the amino acid sequence <SEQ ID 2596; ORF 757>:

```
m757.pep (lipoprotein)
    1   MKILALLIAA TCALSACGSQ SEEQPASAQP QEQAQSELKT MPVSYTDYQS

51   AANKGLNDQK TGLTLPEHVV PIDNAEGKNL LHDFSDGLTI LTVDTDKADK

101   ITAVRVVWNT DAMPQKAEKL SKAAAALIAA TAPEDRTMLR DTGDQIEMAI

151   DSHNAQKEPT REWARGGIAY KVTVTNLPSV VLTAKAE*
``` a757.seq not found yet
a757.pep not found yet
g758.seq not found yet
g758.pep not found yet The following partial DNA sequence was identified in *N. meningitidis* <SEQ ID 2597>:

```
m758.seq
    1   ATGAACAATC TGACCGTGTT TACCCGTTTC GATACCGATT TGGCGACGCT

51   TGCCGATGAA TTGCAATATG TGTGGGAACA CACCGCCGTT ACAGACCATC

101   AGGGCAAACT GGTGGAAATT CCCGTCTGCT ACGGCGGCGA ATACGGCCCG

151   GATTTGGCGG AAGTCGCTGC TTTCCATCAG ACGGTTATTT CCGAAATCGT

201   CCGCCGCCAT ACGGCGCAAA CTTATACCGT ATTTATGATG GGCTTCCAGC

251   CCGGTTTCCC TTATCTGGGC GGCTTGCCCG AAGCATTGCA CACGCCCCGC

301   CGTGCCGTGC CGAGAACGTC CGTTCCTGCC GGTTCGGTCG GTATCGGCGG

351   CAGTCAGACC GGTGTGTATC CGTTCGCTTC GCCCGGCGGC TGGCAGATTA

401   TCGGCAGAAC CGAATTACCC TTGTTCCGAG CCGATTTGAA TCCGCCGACC

451   CTGCTGGCGG CGGGTGACCA AGTCCGCTTT GTTGCAGAAA GGATTGAGCC

501   ATGA
```

This corresponds to the amino acid sequence <SEQ ID 2598; ORF 758>:

```
m758.pep
    1   MNNLTVFTRF DTDLATLADE LQYVWEHTAV TDHQGKLVEI PVCYGGEYGP

51   DLAEVAAFHQ TVISEIVRRH TAQTYTVFMM GFQPGFPYLG GLPEALHTPR

101   RAVPRTSVPA GSVGIGGSQT GVYPFASPGG WQIIGRTELP LFRADLNPPT

151   LLAAGDQVRF VAERIEP*
```

The following partial DNA sequence was identified in *N. meningitidis* <SEQ ID 2599>:

```
a758.seq
    1   ATGAACAATC TGACCGTGTT CACCCGTTTC GATACCGATT TGGCGACGCT

51   TGCCGATGAA TTGCAATATG TGTGGGAACA CACCGCCGTT ACAGACCATC

101   AGGGCAAACT GGTGGAAATT CCCGTCTGCT ACGGCGGCGA ATACGGCCCG

151   GATTTGGCGG AAGTCGCTGC TTTCCATCAG ACGGTTATTT CCGAAATCGT

201   CCGCCGCCAT ACGGCGCAAA CTTATACCGT ATTTATGATG GGCTTCCAGC

251   CTGGTTTCCC TTATCTGGGC GGCTTGCCCG AAGCATTGCA CACGCCCCGC

301   CGTGCCGTGC CGAGAACGTC CGTTCCTGCC GGTTCGGTCG GTATCGGCGG

351   CAGTCAGACC GGTGTGTATC CGTTCGCTTC GCCCGGCGGC TGGCAGATTA
```

-continued

```
401   TCGGCAGAAC CGAATTACCC TTGTTCCGAG CCGATTTGAA TCCGCCGACC

451   CTGCTGGCGG CGGGTGACCA AGTCCGCTTT GTTGCAGAAA GGATTGAGCC

501   ATGA
```

This corresponds to the amino acid sequence <SEQ ID 2600; ORF 758.a>:

```
a758.pep..
    1     MNNLTVFTRF DTDLATLADE LQYVWEHTAV TDHQGKLVEI PVCYGGEYGP

51     DLAEVAAFHQ TVISEIVRRH TAQTYTVFMM GFQPGFPYLG GLPEALHTPR

101     RAVPRTSVPA GSVGIGGSQT GVYPFASPGG WQIIGRTELP LFRADLNPPT

151     LLAAGDQVRF VAERIEP*
``` m758/a758 100.0% identity in 167 aa overlap

```
                  10        20        30        40        50        60
m758.pep   MNNLTVFTRFDTDLATLADELQYVWEHTAVTDHQGKLVEIPVCYGGEYGPDLAEVAAFHQ
           ||||||||||||||||||||||||||||||||||||||||||||||||||||||||||||
a758       MNNLTVFTRFDTDLATLADELQYVWEHTAVTDHQGKLVEIPVCYGGEYGPDLAEVAAFHQ
                  10        20        30        40        50        60

70        80        90       100       110       120
m758.pep   TVISEIVRRHTAQTYTVFMMGFQPGFPYLGGLPEALHTPRRAVPRTSVPAGSVGIGGSQT
           ||||||||||||||||||||||||||||||||||||||||||||||||||||||||||||
a758       TVISEIVRRHTAQTYTVFMMGFQPGFPYLGGLPEALHTPRRAVPRTSVPAGSVGIGGSQT
                  70        80        90       100       110       120

130       140       150       160
m758.pep   GVYPFASPGGWQIIGRTELPLFRADLNPPTLLAAGDQVRFVAERIEPX
           ||||||||||||||||||||||||||||||||||||||||||||||||
a758       GVYPFASPGGWQIIGRTELPLFRADLNPPTLLAAGDQVRFVAERIEPX
                 130       140       150       160
``` g759.seq not found yet g759.pep not found yet

The following partial DNA sequence was identified in *N. meningitidis* <SEQ ID 2601>:

```
m759.seq
    1   ATGCGCTTCA CACACACCAC CCCATTTTGT TCCGTATTGT CCACCCTCGG

51   TCTTTTTGCC GTTTCCCCTG CTTACTCATC CATTGTCCGC AACGATGTCG

101   ATTACCAATA TTTTCGCGAC TTTGCCGAAA ATAAAGGCGC GTTCACCGTA

151   GGTGCAAGCA ATATTTCCAT CCAAGACAAG CAAGGCAAAA TATTAGGCAG

201   GGTTCTCAAC GGCATCCCCA TGCCCGACTT CCGCGTCAGC AACCGCCAAA

251   CCGCCATCGC CACCCTGGTT CACCCCCAAT ACGTCAACAG TGTCAAACAC

301   AACGTCGGCT ACGGTTCCAT ACAATTCGGC AACGACACCC AAAATCCAGA

351   AGAACAAGCC TATACCTACC GCCTCGTATC ACGCAACCCG CACCCGGACT

401   ACGACTACCA CCTTCCCCGC CTCAACAAAC TGGTTACCGA AATCTCACCT

451   ACCGCACTCA GCAGCGTACC CTTGCTTGGA AACGGCCAGC CAAAGGCCAA

501   TGCCTACCTC GATACCGACC GCTTCCCCTA CTTTGTACGA CTCGGCTCAG

551   GCACGCAACA AGTCCGCAAA GCAGACGGCA CGCGTACACG AACCGCCCCG

601   GCATACCAAT ACCTGACCGG CGGCACGCCG CTGAAAGTAT TGGGGTTCCA

651   AAACCACGGC TTACTCGTCG GCGGCAGCCT GACCGACCAA CCCCTTAACA

701   CCTACGCAAT CGCCGGAGAC AGCGGTTCCC CCTGTTTGC CTTCGACAAG
```

```
 751 CATGAAAACC GCTGGGTGCT TGCGGGCGTA CTCAGCACCT ACGCCGGCTT
 801 CGATAATTTC TTCAACAAAT ACATCGTCAC GCAACCCGAA TTCATCCGTT
 851 CCACCATCCG CCAATACGAA ACCCGGCTGG ATGTCGGGCT GACCACCAAC
 901 GAACTCATAT GGCGCGACAA CGGTAATGGC AACAGCACCC TGCAAGGGCT
 951 CAACGAACGC ATCACCCTGC CCATTGCAAA CCCTTCGCTT GCCCCACAAA
1001 ACGACAGCAG GCACATGCCG TCTGAAGATG CCGGCAAAAC GCTCATCCTA
1051 TCCAGCAGGT TCGACAACAA AACACTGATG CTGGCAGACA ATATCAACCA
1101 AGGCGCAGGC GCATTGCAGT TCGACAGCAA CTTCACCGTC GTCGGTAAAA
1151 ACCACACATG GCAAGGTGCA GGCGTTATCG TAGCCGACGG CAAACGCGTC
1201 TTCTGGCAAG TCAGCAACCC CAAAGGCGAC CGGCTCTCCA AACTGGGCGC
1251 AGGCACGCTT ATCGCCAACG GACAAGGCAT CAACCAGGGC GACATCAGCA
1301 TCGGGAAGG CACTGTCGTA CTCGCCCAAA AAGCTGCTTC AGACGGCAGC
1351 AAACAAGCAT TCAACCAAGT CGGCATCACC AGCGGCAGGG GCACGGCCGT
1401 CCTCGCCGAC AGCCAGCAAA TCAAACCCGA AAACCTCTAT TTCGGCTTCA
1451 GGGGCGGACG GCTCGACCTC AACGGCAACA ACCTTGCCTT TACCCATATC
1501 CGCCATGCGG ACGGCGGCGC GCAAATCGTC AATCACAACC CTGACCAAGC
1551 CGCGACACTG ACGCTGACCG GCAACCCCGT CCTCAGTCCC GAGCATGTCG
1601 AGTGGGTGCA ATGGGCAAC CGTCCGCAAG GCAACGCGGC GGTTTACGAA
1651 TACATCAACC CGCACCGCAA CCGTCGGACC GACTACTTCA TACTCAAACC
1701 CGGCGGCAAC CCGCGCGAAT TTTTCCCGTT AAATATGAAA AACTCAACAA
1751 GCTGGCAATT TATCGGCAAC AACAGGCAAC AGGCCGCCGA ACAAGTCGCC
1801 CAAGCCGAAA ATGCCCGCCC CGACCTGATT ACCTTCGGCG GATACTTGGG
1851 TGAAAACGCG CAAACGGGCA AAGCCGCGCC GAGTTACAGC AAAACCAATG
1901 AAGCAGCCAT AGAAAAAACC CGCCATATCG CAAATGCCGC CGTATACGGC
1951 CGGCCCGAAT ACCGTTACAA CGGCGCACTC AACCTGCACT ATCGTCCCAA
2001 ACGCACCGAC AGCACGCTGT TGCTCAACGG CGGCATGAAC CTTAACGGGG
2051 AAGTCTTGAT TGAGGGCGGC AATATGATTG TGTCAGGCAG GCCCGTACCC
2101 CATGCCTACG ACCACCAGGC CAAACGCGAA CCCGTTCTTG AAAACGAATG
2151 GACCGACGGC AGCTTCAAGG CTGCACGGTT CACCCTGCGA ACCATGCCC
2201 GACTGACGGC AGGGCGCAAT ACCGCGCATC TGGACGGCGA CATAACCGCA
2251 TACGATCTGT CCGGCATCGA CCTCGGCTTT ACCCAAGGCA AAACACCGGA
2301 ATGCTACCGC TCCTACCATA GCGGCAGCAC CCACTGCACA CCCAACGCCG
2351 TTTTAAAAGC CGAAAACTAT CGTGCACTAC CTGCAACGCA AGTACGCGGC
2401 GACATTACCC TTAACGACCG TTCAGAGCTC CGCCTGGGCA AGCACACCT
2451 GTACGGCAGC ATCCGTGCCG GCAAAGACAC CGCAGTCCGC ATGGAAGCAG
2501 ACAGCAACTG GACACTTTCC CAGTCCAGCC ACACCGGCGC ACTGACGCTT
2551 GACGGCGCAC AAATTACCCT GAACCCCGAT TTCGCCAATA ATACACACAA
2601 CAACCGCTTC AACACACTGA CCGTCAACGG CACACTTGAC GGGTTCGGCA
2651 CATTCCGATT CCTGACCGGC ATCGTCCGAA AACAAAATGC CCCCCCCTC
2701 AAACTGGAAG GGGACAGCCG CGGCGCATTC CAAATCCACG TCAAAAACAC
```

```
2751  CGGACAAGAA CCTCAAACAA CCGAATCGCT TGCACTTGTG AGCCTCAATC

2801  CGAAACACAG CCACCAAGCC CGATTCACCC TCCAAAACGG CTATGCCGAT

2851  TTGGGTGCCT ACCGCTACAT CCTCCGCAAA ACAACAACG GATACAGCCT

2901  GTACAACCCG CTCAAAGAGG CCGAACTTCA AATTGAAGCC ACGCGTGCGG

2951  AACATGAGCG CAACCAACAG GCATACAACC AATTACAGGC AACCGACATC

3001  AGCAGACAGG TTCAACATGA CTCTGACGCG ACCAGGCAGG CACTACAGGC

3051  CTGGCAGAAC AGTCAAACCG AACTTGCCCG CATCGACAGC CAAGTCCAAT

3101  ATCTGTCCGC CCAATTGAAA CAGACAGACC CGCTGACCGG CATTCTGACG

3151  CGTGCCCAAA ACCTGTGTGC CGCACAAGGA TACAGTGCCG ATATCTGCCG

3201  TCAGGTTGCC AAAGCCGCCG ACACGAACGA CCTGACACTC TTCGAAACCG

3251  AACTGGATAC GTATATAGAA CGTGTAGAAA TGGCCGAATC CGAACTTGAC

3301  AAAGCACGGC AAGGCGGCGA TGCGCAAGCC GTCGAAACAG CCCGGCACGC

3351  CTACCTGAAC GCACTCAACC GTCTGTCCCG ACAAATCCAC AGTTTGAAAA

3401  CCGGCGTTGC CGGCATCCGT ATGCCGAACC TGGCCGAACT GATCAGCCGG

3451  TCGGCCAACA CCGCCGTTTC CGAACAGGCC GCCTACAATA CCGGCCGGCA

3501  ACAGGCGGGA CGCCGCATCG ACCGCCACCT TACCGATCCG CAGCAGCAAA

3551  ACATCTGGCT GGAAACCGGT ACGCAACAAA CCGACTACCA TAGCGGCACA

3601  CACCGTCCCT ACCAACAAAC TACCAACTAT GCACATATCG GCATCCAAAC

3651  CGGCATCACC GACCGTCTCA GTGTCGGTAC GATTTTAACC GATGAGCGCA

3701  CAAACAACCG TTTTGATGAA GGCGTATCCG CCCGAAACCG CAGCAACGGC

3751  GCACATCTGT TCGTCAAAGG GGAAAACGGC GCACTCTTTG CCGCGGCAGA

3801  TTTAGGCTAC AGCAACAGCC GTACCCGATT TACCGATTAT GACGGGGCTG

3851  CCGTCCGCCG CCACGCATGG GATGCAGGCA TCAACACCGG CATCAAAATC

3901  GATACCGGCA TCAACCTCAG ACCCTATGCC GGCATCCGTA TAAACCGCAG

3951  CAACGGCAAC CGGTACGTAC TCGACGGCGC AGAGATAAAC AGCCCGGCGC

4001  AAATCCAAAC CACATGGCAT GCCGGCATCC GTCTCGATAA AACCGTCGAA

4051  CTGGGTCAAG CCAAGCTGAC CCCCGCCTTC AGCAGCGATT ACTACCATAC

4101  CCGCCAAAAC AGCGGTTCCG CCCTCAGCGT CAACGACCGT ACCTTACTGC

4151  AGCAAGCCGC CCACGGCACA CTGCATACCC TGCAAATCGA CGCCGGATAC

4201  AAAGGCTGGA ACGCCAAACT TCATGCCGCT TACGGCAAAG ACAGCAACAC

4251  CGCCCGCCAC AAACAGGCAG GAATCAAAAT AGGCTACAAC TGGTAA
```

This corresponds to the amino acid sequence <SEQ ID 2602; ORF 759>:

```
m759.pep
    1  MRFTHTTPFC SVLSTLGLFA VSPAYSSIVR NDVDYQYFRD FAENKGAFTV

51  GASNISIQDK QGKILGRVLN GIPMPDFRVS NRQTAIATLV HPQYVNSVKH

101  NVGYGSIQFG NDTQNPEEQA YTYRLVSRNP HPDYDHLPR LNKLVTEISP

151  TALSSVPLLG NGQPKANAYL DTDRFPYFVR LGSGTQQVRK ADGTRTRTAP
```

```
 201 AYQYLTGGTP LKVLGFQNHG LLVGGSLTDQ PLNTYAIAGD SGSPLFAFDK

251 HENRWVLAGV LSTYAGFDNF FNKYIVTQPE FIRSTIRQYE TRLDVGLTTN

301 ELIWRDNGNG NSTLQGLNER ITLPIANPSL APQNDSRHMP SEDAGKTLIL

351 SSRFDNKTLM LADNINQGAG ALQFDSNFTV VGKNHTWQGA GVIVADGKRV

401 FWQVSNPKGD RLSKLGAGTL IANGQGINQG DISIGEGTVV LAQKAASDGS

451 KQAFNQVGIT SGRGTAVLAD SQQIKPENLY FGFRGGRLDL NGNNLAFTHI

501 RHADGGAQIV NHNPDQAATL TLTGNPVLSP EHVEWVQWGN RPQGNAAVYE

551 YINPHRNRRT DYFILKPGGN PREFFPLNMK NSTSWQFIGN NRQQAAEQVA

601 QAENARPDLI TFGGYLGENA QTGKAAPSYS KTNEAAIEKT RHIANAAVYG

651 RPEYRYNGAL NLHYRPKRTD STLLLNGGMN LNGEVLIEGG NMIVSGRPVP

701 HAYDHQAKRE PVLENEWTDG SFKAARFTLR NHARLTAGRN TAHLDGDITA

751 YDLSGIDLGF TQGKTPECYR SYHSGSTHCT PNAVLKAENY RALPATQVRG

801 DITLNDRSEL RLGKAHLYGS IRAGKDTAVR MEADSNWTLS QSSHTGALTL

851 DGAQITLNPD FANNTHNNRF NTLTVNGTLD GFGTFRFLTG IVRKQNAPPL

901 KLEGDSRGAF QIHVKNTGQE PQTTESLALV SLNPKHSHQA RFTLQNGYAD

951 LGAYRYILRK NNNGYSLYNP LKEAELQIEA TRAEHERNQQ AYNQLQATDI

1001 SRQVQHDSDA TRQALQAWQN SQTELARIDS QVQYLSAQLK QTDPLTGILT

1051 RAQNLCAAQG YSADICRQVA KAADTNDLTL FETELDTYIE RVEMAESELD

1101 KARQGGDAQA VETARHAYLN ALNRLSRQIH SLKTGVAGIR MPNLAELISR

1151 SANTAVSEQA AYNTGRQQAG RRIDRHLTDP QQQNIWLETG TQQTDYHSGT

1201 HRPYQQTTNY AHIGIQTGIT DRLSVGTILT DERTNNRFDE GVSARNRSNG

1251 AHLFVKGENG ALFAAADLGY SNSRTRFTDY DGAAVRRHAW DAGINTGIKI

1301 DTGINLRPYA GIRINRSNGN RYVLDGAEIN SPAQIQTTWH AGIRLDKTVE

1351 LGQAKLTPAF SSDYYHTRQN SGSALSVNDR TLLQQAAHGT LHTLQIDAGY

1401 KGWNAKLHAA YGKDSNTARH KQAGIKIGYN W*
```

The following partial DNA sequence was identified in *N. gonorrhoeae* <SEQ ID 2603>:

```
g760.seq (partial)
   1 AACAACCGCA ACACCCGTTA CGCCGCATTG GGCAAACGCG TGATGGAAGG

51 CGTTGAGACC GAAATCAGCG GTGCGATTAC ACCGAAATGG CAAATCCATG

101 CAGGTTACAG CTATCTGCAC AGCCAAATCA AAACCGCCGC CAATCCACGC

151 GACGACGGCA TCTTCCTGCT GGTGCCCAAA CACAGCGCAA ACCTGTGGAC

201 GACTTACCAA GTTACGCCCG GCTGACCGT CGGCGGCGGC GTGAACGCGA

251 TGAGCGGCAT TACTTCATCT GCAGGGATGC ATGCAGGCGG TTATGCCACG

301 TTCGATGCGA TGGCGGCATA CCGCTTCACG CCCAAGCTGA AGCTGCAAAT

351 CAATGCCGAC AACATCTTCA ACCGCCATTA CTACGCCCGC GTCGGCGGCA

401 CGAACACCTT TAACATTCCC GGTTCGGAGC GCAGCCTGAC GGCAAACCTG

451 CGTTACAGTT TTTAA
```

This corresponds to the amino acid sequence <SEQ ID 2604; ORF 760.ng>:

```
g760.pep (partial)
     1  NNRNTRYAAL GKRVMEGVET EISGAITPKW QIHAGYSYLH SQIKTAANPR

51  DDGIFLLVPK HSANLWTTYQ VTPGLTVGGG VNAMSGITSS AGMHAGGYAT

101  FDAMAAYRFT PKLKLQINAD NIFNRHYYAR VGGTNTFNIP GSERSLTANL

151  RYSF*
```

The following partial DNA sequence was identified in *N. meningitidis* <SEQ ID 2605>:

```
m760.seq
     1  ATGGGACAGT TTATGTCAGT TTTCCGCATC AATATGACCG CCGCCACGGT

51  TTTGGCAGCA CTCTCGTCTT CGGTTTTTGC CGCACAAACG GAAGGTTTGG

101  AAACCGTCCA TATTAAGGGT CAGCGTTCTT ACAACGCGAT TGCCACCGAG

151  AAAAACGGCG ATTACAGCTC GTTTGCCGCC ACCGTCGGTA CAAAAATCCC

201  CGCTTCTTTG CGCGAAATTC CGCAATCCGT CAGCATCATT ACCAACCAGC

251  AGGTCAAAGA CCGCAATGTT GATACGTTTG ACCAGTTGGC ACGCAAAACG

301  CCCGGCCTGC GCGTGTTGAG CAACGACGAC GGACGCTCTT CGGTTTACGC

351  GCGCGGTTAC GAATACAGCG AATACAACAT CGACGGCCTG CCCGCGCAGA

401  TGCAGAGTAT CAACGGCACG CTGCCCAACC TGTTCGCCTT CGACCGCGTG

451  GAAGTGATGC GCGGGCCGAG CGGACTGTTC GACAGCAGCG GCGAGATGGG

501  CGGCATCGTG AATCTGGTGC GCAAACGCCC GACCAAAGCG TTCCAAGGTC

551  ATGCGGCGGC AGGGTTCGGT ACGCACAAAC AATATAAAGC CGAGGCGGAC

601  GTATCGGGCA GCCTCAATTC AGACGGCAGC GTGCGCGGCC GCGTGATGGC

651  GCAGACCGTC GGCGCGTCTC CGCGTCCCGC CGAGAAAAAC AACCGGCGCG

701  AAACCTTCTA CGCGGCGGCG GATTGGGACA TCAACCCCGA TACGGTTTTG

751  GGCGCGGGCT ATCTTTACCA GCAACGCCGC CTCGCGCCGT ACAACGGCCT

801  GCCTGCCGAT GCCAATAACA AATTACCGTC CCTGCCGCAA CACGTATTTG

851  TCGGCGCGGA TTGGAACAAA TTTAAAATGC ACAGCCACGA CGTGTTCGCC

901  GATTTGAAAC ATTACTTCGG CAACGGCGGC TACGGCAAAG TCGGTATGCG

951  CTATTCCGAT CGGAAAGCCG ATTCCAATTA TACGTTTGCG GGCAGCAAAC

1001  TCAACAATAC CGGACAAGCC GACGTAGCGG GTTTGGGTAC GGACATTAAA

1051  CAAAAAGCCT TTGCGGTTGA CGCAAGTTAC AGCCGTCCGT TTGCCTTGGG

1101  CAACACCGCC AACGAATTTG TGATTGGTGC AGACTACAAC CGCTTGCGCA

1151  GTACTAATGA ACAAGGGCGT TCGACTTTGT CAAAAAGCGT CGCTTTAGAT

1201  GGTTTCCGCG CTTTGCCTTA TAACGGCATA CTTCAGAACG CCCGCGCCGG

1251  AAACAAAGGT TTCAATCACT CCGTTACCGA AGAAAACCTC GACGAAACCG

1301  GTTTGTATGC CAAGACGGTG TTCCGTCCTC TGGAAGGTTT GTCGTTGATT

1351  GCAGGCGGAC GTGTAGGACA TCACAAAATC GAGTCGGGCG ACGGCAAAAC

1401  CCTGCATAAA GCTTCGAAAA CCAAATTTAC AAGCTACGCC GGCGCGGTTT

1451  ACGATATAGA CGGCAGCAAC AGCCTGTACG CTTCCGCCTC CCAACTCTAC

1501  ACACCGCAAA CCAGCATCGG CACCGACGGC AAGCTGCTCA AACCGCGCGA

1551  AGGCAACCAG TTTGAAATCG GCTACAAAGG CAGCTACATG GACGACCGCC

1601  TCAATACCCG GGTTTCGTTC TACCGCATGA AGGATAAAAA CGCCGCCGCA
```

```
-continued
1651  CCGCTGGACT CAAACAACAA AAAAACCCGT TACGCCGCAT TGGGCAAACG

1701  CGTGATGGAA GGTGTTGAGA CCGAAATCAG CGGCGCGATG ACACCGAAAT

1751  GGCAAATCCA TGCAGGTTAC AGCTACCTGC ACAGCCAAAT CAAAACCGCC

1801  TCCAATTCGC GCGACGAAGG CATCTTCCTG CTGATGCCCA ACACAGCGC

1851  AAACCTGTGG ACGACTTACC AAGTTACGTC CGGGCTGACC ATCGGCGGCG

1901  GCGTGAACGC GATGAGCGGC ATTACTTCAT CTGCAGGGAT ACATGCAGGC

1951  GGTTATGCCA CGTTCGATGC GATGGCGGCA TACCGCTTCA CGCCCAAACT

2001  GAAGCTGCAA ATCAACGCCG ACAACATCTT CAACCGCCAT TACTACGCCC

2051  GCGTCGGCAG CGAGAGCACC TTTAACATTC CCGGTTCGGA GCGCAGCCTG

2101  ACGGCAAACC TGCGTTACAG TTTTTAA
```

This corresponds to the amino acid sequence <SEQ ID 2606; ORF 760>:

```
m760.pep
   1    MGQFMSVFRI NMTAATVLAA LSSSVFAAQT EGLETVHIKG QRSYNAIATE

51    KNGDYSSFAA TVGTKIPASL REIPQSVSII TNQQVKDRNV DTFDQLARKT

101    PGLRVLSNDD GRSSVYARGY EYSEYNIDGL PAQMQSINGT LPNLFAFDRV

151    EVMRGPSGLF DSSGEMGGIV NLVRKRPTKA FQGHAAAGFG THKQYKAEAD

201    VSGSLNSDGS VRGRVMAQTV GASPRPAEKN NRRETFYAAA DWDINPDTVL

251    GAGYLYQQRR LAPYNGLPAD ANNKLPSLPQ HVFVGADWNK FKMHSHDVFA

301    DLKHYFGNGG YGKVGMRYSD RKADSNYTFA GSKLNNTGQA DVAGLGTDIK

351    QKAFAVDASY SRPFALGNTA NEFVIGADYN RLRSTNEQGR STLSKSVALD

401    GFRALPYNGI LQNARAGNKG FNHSVTEENL DETGLYAKTV FRPLEGLSLI

451    AGGRVGHHKI ESGDGKTLHK ASKTKFTSYA GAVYDIDGSN SLYASASQLY

501    TPQTSIGTDG KLLKPREGNQ FEIGYKGSYM DDRLNTRVSF YRMKDKNAAA

551    PLDSNNKKTR YAALGKRVME GVETEISGAM TPKWQIHAGY SYLHSQIKTA

601    SNSRDEGIFL LMPKHSANLW TTYQVTSGLT IGGGVNAMSG ITSSAGIHAG

651    GYATFDAMAA YRFTPKLKLQ INADNIFNRH YYARVGSEST FNIPGSERSL

701    TANLRYSF*
``` m760/g760 91.6% identity in 154 aa overlap

```
                530        540        550        560        570        580
m760.pep   YKGSYMDDRLNTRVSFYRMKDKNAAAPLDSNNKKTRYAALGKRVMEGVETEISGAMTPKW
                                           ||::|||||||||||||||||||:||||
g760                                       NNRNTRYAALGKRVMEGVETEISGAITPKW
                                                  10         20         30

590        600        610        620        630        640
m760.pep   QIHAGYSYLHSQIKTASNSRDEGIFLLMPKHSANLWTTYQVTSGLTIGGGVNAMSGITSS
           ||||||||||||||||:|  ||:|||||:|||||||||| |||:||||||||||||||||
g760       QIHAGYSYLHSQIKTAANPRDDGIFLLVPKHSANLWTTYQVTPGLTVGGGVNAMSGITSS
                  40         50         60         70         80         90

650        660        670        680        690        700
m760.pep   AGIHAGGYATFDAMAAYRFTPKLKLQINADNIFNRHYYARVGSESTFNIPGSERSLTANL
           ||:|||||||||||||||||||||||||||||||||||||:  ||||||||||||||||
g760       AGMHAGGYATFDAMAAYRFTPKLKLQINADNIFNRHYYARVGGTNTFNIPGSERSLTANL
                 100        110        120        130        140        150
```

-continued

```
                 709
m760.pep   RYSFX
           |||||
g760       RYSFX
``` g761.seq not found yet
g761.pep not found yet
The following partial DNA sequence was identified in *N. meningitidis* <SEQ ID 2607>:

```
m761.seq
      1  ATGAAAATAT CATTTCATTT AGCTTTATTA CCCACGCTGA TTATTGCTTC
     51  CTTCCCTGTT GCTGCCGCCG ATACGCAGGA CAATGGTGAA CATTACACCG
    101  CCACTCTGCC CACCGTTTCC GTGGTCGGAC AGTCCGACAC CAGCGTACTC
    151  AAAGGCTACA TCAACTACGA CGAAGCCGCC GTTACCCGCA ACGGACAGCT
    201  CATCAAAGAA ACGCCGCAAA CCATCGATAC GCTCAATATC CAGAAAAACA
    251  AAAATTACGG TACGAACGAT TTGAGTTCCA TCCTCGAAGG CAATGCCGGC
    301  ATCGACGCTG CCTACGATAT GCGCGGTGAA AGCATTTTCC TGCGCGGTTT
    351  TCAAGCCGAC GCATCCGATA TTTACCGCGA CGGCGTGCGC GAAAGCGGAC
    401  AAGTGCGCCG CAGTACTGCC AACATCGAGC GCGTGGAAAT CCTGAAAGGC
    451  CCGTCTTCCG TGCTTTACGG CCGCACCAAC GGCGGCGGCG TCATCAACAT
    501  GGTCAGCAAA TACGCCAACT TCAAACAAAG CCGCAACATC GGAGCGGTTT
    551  ACGGCTCATG GCAAACCGC AGCCTGAATA TGGACATTAA CGAAGTGCTG
    601  AACAAAAACG TCGCCATCCG TCTCACCGGC GAAGTCGGGC GCGCCAATTC
    651  GTTCCGCAGC GGCATAGACA GCAAAAATGT CATGGTTTCG CCCAGCATTA
    701  CCGTCAAACT CGACAACGGC TTGAAGTGGA CGGGGCAATA CACCTACGAC
    751  AATGTGGAGC GCACGCCCGA CCGCAGTCCG ACCAAGTCCG TGTACGACCG
    801  CTTCGGACTG CCTTACCGCA TGGGGTTCGC CCACCGGAAC GATTTTGTCA
    851  AAGACAAGCT GCAAGTTTGG CGTTCCGACC TTGAATACGC CTTCAACGAC
    901  AAATGGCGTG CCCAATGGCA GCTCGCCCAC CGCACGGCGG CGCAGGATTT
    951  TGATCATTTC TATGCAGGCA GCGAAAATGG CAACTTAATC AAACGTAACT
   1001  ACGCCTGGCA GCAGACCGAC AACAAAACCC TGTCGTCCAA CTTAACGCTC
   1051  AACGGCGACT ACACCATCGG CCGTTTTGAA ACCACCTGA CCGTAGGCAT
   1101  GGATTACAGC CGCGAACACC GCAACCCGAC ATTGGGTTTC AGCAGCGCCT
   1151  TTTCCGCCTC CATCAACCCC TACGACCGCG CAAGCTGGCC GGCTTCGGGC
   1201  AGATTGCAGC CTATTCTGAC CCAAAACCGC CACAAAGCCG ACTCCTACGG
   1251  CATCTTTGTG CAAAACATCT TCTCCGCCAC GCCCGATTTG AAATTCGTCC
   1301  TCGGCGGCCG TTACGACAAA TACACCTTTA ATTCCGAAAA CAAACTCACC
   1351  GGCAGCAGCC GCCAATACAG CGGACACTCG TTCAGCCCCA ACATCGGCGC
   1401  AGTGTGGAAC ATCAATCCCG TCCACACACT TTACGCCTCG TATAACAAAG
   1451  GCTTCGCGCC TTATGGCGGA CGCGGCGGCT ATTTGAGCAT CGATACGTTG
   1501  TCTTCCGCCG TGTTCAACGC CGACCCCGAG TACACCCGCC AATACGAAAC
   1551  CGGCGTGAAA AGCAGTTGGC TGGACGACCG CCTCAGCACT ACGTTGTCTG
   1601  CCTACCAAAT CGAACGCTTC AATATCCGCT ACCGCCCCGA TCCAAAAAAC
```

```
-continued
1651  AACCCTTATA TTTATGCGGT TAGCGGCAAA CACCGTTCGC GCGGCGTGGA

1701  ATTGTCCGCC ATCGGGCAAA TCATCCCCAA AAAACTCTAT CTGCGCGGTT

1751  CGTTGGGCGT GATGCAGGCG AAAGTCGTTG AAGACAAAGA AAATCCCGAC

1801  CGAGTGGGCA TCCATTTGAA TAATACCAGC AACGTTACCG GCAACCTGTT

1851  TTTCCGTTAT ACCCCGACCG AAAACCTCTA CGGCGAAATC GGCGTAACCG

1901  GTACAGGCAA ACGCTACGGT TACAACTCAA GAAATAAAGA AGTGACTACG

1951  CTTCCAGGCT TTGCCCGAGT TGATGCCATG CTTGGCTGGA ACCATAAAAA

2001  TGTTAACGTT ACCTTTGCCG CAGCCAATCT GCTCAATCAA AAATATTGGC

2051  GTTCGGACTC TATGCCGGGT AATCCGCGCG GCTATACTGC CCGGGTAAAT

2101  TACCGTTTCT GA
```

This corresponds to the amino acid sequence <SEQ ID 2608; ORF 761>:

```
m761.pep
    1  MKISFHLALL PTLIIASFPV AAADTQDNGE HYTATLPTVS VVGQSDTSVL

51  KGYINYDEAA VTRNGQLIKE TPQTIDTLNI QKNKNYGTND LSSILEGNAG

101  IDAAYDMRGE SIFLRGFQAD ASDIYRDGVR ESGQVRRSTA NIERVEILKG

151  PSSVLYGRTN GGGVINMVSK YANFKQSRNI GAVYGSWANR SLNMDINEVL

201  NKNVAIRLTG EVGRANSFRS GIDSKNVMVS PSITVKLDNG LKWTGQYTYD

251  NVERTPDRSP TKSVYDRFGL PYRMGFAHRN DFVKDKLQVW RSDLEYAFND

301  KWRAQWQLAH RTAAQDFDHF YAGSENGNLI KRNYAWQQTD NKTLSSNLTL

351  NGDYTIGRFE NHLTVGMDYS REHRNPTLGF SSAFSASINP YDRASWPASG

401  RLQPILTQNR HKADSYGIFV QNIFSATPDL KFVLGGRYDK YTFNSENKLT

451  GSSRQYSGHS FSPNIGAVWN INPVHTLYAS YNKGFAPYGG RGGYLSIDTL

501  SSAVFNADPE YTRQYETGVK SSWLDDRLST TLSAYQIERF NIRYRPDPKN

551  NPYIYAVSGK HRSRGVELSA IGQIIPKKLY LRGSLGVMQA KVVEDKENPD

601  RVGIHLNNTS NVTGNLFFRY TPTENLYGEI GVTGTGKRYG YNSRNKEVTT

651  LPGFARVDAM LGWNHKNVNV TFAAANLLNQ KYWRSDSMPG NPRGYTARVN

701  YRF*
```

The following partial DNA sequence was identified in *N. meningitidis* <SEQ ID 2609>:

```
a761.seq
    1  ATGAAAATAT CATTTCATTT AGCTTTATTA CCCACGCTGA TTATTGCTTC

51  CTTCCCTGTT GCTGCCGCCG ATACGCAGGA CAATGGTGAA CATTACACCG

101  CCACTCTGCC CACCGTTTCC GTGGTCGGAC AGTCCGACAC CAGCGTACTC

151  AAAGGCTACA TCAACTACGA CGAAGCCGCC GTTACCCGCA ACGGACAGCT

201  CATCAAAGAA ACGCCGCAAA CCATCGATAC GCTCAATATC CAGAAAAACA

251  AAAATTACGG CACGAACGAT TTGAGTTCCA TCCTCGAAGG CAATGCCGGC

301  ATCGACGCCG CCTACGATAT GCGCGGCGAA AGCATTTTCC TGCGCGGCTT

351  TCAAGCCGAC GCATCTGATA TTTACCGCGA CGGCGTACGC GAAAGCGGGC

401  AGGTGCGCCG TAGCACCGCC AACATCGAGC GCGTGGAAAT CCTGAAAGGT
```

```
-continued
 451   CCGTCCTCCG TGCTTTATGG GCGTACCAAC GGCGGCGGTG TCATCAACAT

501   GGTCAGCAAA TACGCCAACT TCAAACAAAG CCGTAATATC GGTACGGTTT

551   ATGGTTCGTG GGCAAACCGC AGCCTGAATA TGGACATCAA CGAAGTGCTG

601   AACAAAAACG TCGCCATCCG TCTCACCGGC GAAGTCGGGC GCGCCAATTC

651   GTTCCGCAGC GGCATAGACA GCAAAAATGT CATGGTTTCG CCCAGCATTA

701   CCGTCAAACT CGACAACGGC TTGAAGTGGA CGGGGCAATA CACCTACGAC

751   AATGTGGAGC GCACGCCCGA CCGCAGTCCG ACCAAGTCCG TGTACGACCG

801   CTTCGGACTG CCTTACCGCA TGGGGTTCGC CCACCGGAAC GATTTTGTCA

851   AAGACAAGCT GCAAGTTTGG CGTTCCGACC TTGAATACGC CTTCAACGAC

901   AAATGGCGTG CCCAATGGCA GCTCGCCCAC CGCACGGCGG CGCAGGATTT

951   TGATCATTTC TATGCAGGCA GCGAAAATGG CAACTTAATC AAACGTAACT

1001   ACGCCTGGCA GCAGACCGAC AACAAAACCC TGTCGTCCAA CTTAACGCTC

1051   AACGGCGACT ACACCATCGG CCGTTTTGAA AACCACCTGA CCGTAGGCAT

1101   GGATTACAGC CGCGAACACC GCAACCCGAC ATTGGGTTTC AGCAGCGCCT

1151   TTTCCGCCTC CATCAACCCC TACGACCGCG CAAGCTGGCC GGCTTCGGGC

1201   AGATTGCAGC CTATTCTGAC CCAAAACCGC CACAAAGCCG ACTCCTACGG

1251   CATCTTTGTG CAAAACATCT TCTCCGCCAC GCCCGATTTG AAATTCGTCC

1301   TCGGCGGCCG TTACGACAAA TACACCTTTA ATTCCGAAAA CAAACTCACC

1351   GGCAGCAGCC GCCAATACAG CGGACACTCG TTCAGCCCCA ACATCGGCGC

1401   AGTGTGGAAC ATCAATCCCG TCCACACACT TTACGCCTCG TATAACAAAG

1451   GCTTCGCGCC TTATGGCGGA CGCGGCGGCT ATTTGAGCAT CGATACGTTG

1501   TCTTCCGCCG TGTTCAACGC CGACCCCGAG TACACCCGCC AATACGAAAC

1551   CGGCGTGAAA AGCAGTTGGC TGGACGACCG CCTCAGCACT ACGTTGTCTG

1601   CCTACCAAAT CGAACGCTTC AATATCCGCT ACCGCCCCGA TCCAAAAAAC

1651   AACCCTTATA TTTATGCGGT TAGCGGCAAA CACCGTTCGC GCGGCGTGGA

1701   ATTGTCCGCC ATCGGGCAAA TCATCCCCAA AAAACTCTAT CTGCGCGGTT

1751   CGTTGGGCGT GATGCAGGCG AAAGTCGTTG AAGACAAAGA AAATCCCGAC

1801   CGAGTGGGCA TCCATTTGAA TAACACCAGC AACGTTACCG GCAACCTGTT

1851   TTTCCGTTAT ACCCCGACCG AAAACCTCTA CGGCGAAATC GGCGTAACCG

1901   GTACAGGCAA ACGCTACGGT TACGACTCAA GAAATAAAGA AGTGACTACG

1951   CTTCCAGGCT TTGCCCGAGT TGATGCCATG CTTGGCTGGA CCATAAAAA

2001   TGTTAACGTT ACCTTTGCCG CAGCCAATCT GTTCAATCAA AAATATTGGC

2051   GTTCGGACTC TATGCCGGGT AATCCGCGCG GCTATACTGC CCGGGTAAAT

2101   TACCGTTTCT GA
```

This corresponds to the amino acid sequence <SEQ ID 2610; ORF 761.a>:

```
a761.pep
    1   MKISFHLALL PTLIIASFPV AAADTQDNGE HYTATLPTVS VVGQSDTSVL

51   KGYINYDEAA VTRNGQLIKE TPQTIDTLNI QKNKNYGTND LSSILEGNAG

101   IDAAYDMRGE SIFLRGFQAD ASDIYRDGVR ESGQVRRSTA NIERVEILKG
```

```
-continued
151  PSSVLYGRTN GGGVINMVSK YANFKQSRNI GTVYGSWANR SLNMDINEVL

201  NKNVAIRLTG EVGRANSFRS GIDSKNVMVS PSITVKLDNG LKWTGQYTYD

251  NVERTPDRSP TKSVYDRFGL PYRMGFAHRN DFVKDKLQVW RSDLEYAFND

301  KWRAQWQLAH RTAAQDFDHF YAGSENGNLI KRNYAWQQTD NKTLSSNLTL

351  NGDYTIGRFE NHLTVGMDYS REHRNPTLGF SSAFSASINP YDRASWPASG

401  RLQPILTQNR HKADSYGIFV QNIFSATPDL KFVLGGRYDK YTFNSENKLT

451  GSSRQYSGHS FSPNIGAVWN INPVHTLYAS YNKGFAPYGG RGGYLSIDTL

501  SSAVFNADPE YTRQYETGVK SSWLDDRLST TLSAYQIERF NIRYRPDPKN

551  NPYIYAVSGK HRSRGVELSA IGQIIPKKLY LRGSLGVMQA KVVEDKENPD

601  RVGIHLNNTS NVTGNLFFRY TPTENLYGEI GVTGTGKRYG YDSRNKEVTT

651  LPGFARVDAM LGWNHKNVNV TFAAANLFNQ KYWRSDSMPG NPRGYTARVN

701  YRF*
``` m761/a761 99.6% identity in 703 aa overlap

```
                10         20         30         40         50         60
m761.pep  MKISFHLALLPTLIIASFPVAAADTQDNGEHYTATLPTVSVVGQSDTSVLKGYINYDEAA
          ||||||||||||||||||||||||||||||||||||||||||||||||||||||||||||
a761      MKISFHLALLPTLIIASFPVAAADTQDNGEHYTATLPTVSVVGQSDTSVLKGYINYDEAA
                10         20         30         40         50         60

70         80         90        100        110        120
m761.pep  VTRNGQLIKETPQTIDTLNIQKNKNYGTNDLSSILEGNAGIDAAYDMRGESIFLRGFQAD
          ||||||||||||||||||||||||||||||||||||||||||||||||||||||||||||
a761      VTRNGQLIKETPQTIDTLNIQKNKNYGTNDLSSILEGNAGIDAAYDMRGESIFLRGFQAD
                70         80         90        100        110        120

130        140        150        160        170        180
m761.pep  ASDIYRDGVRESGQVRRSTANIERVEILKGPSSVLYGRTNGGGVINMVSKYANFKQSRNI
          ||||||||||||||||||||||||||||||||||||||||||||||||||||||||||||
a761      ASDIYRDGVRESGQVRRSTANIERVEILKGPSSVLYGRTNGGGVINMVSKYANFKQSRNI
               130        140        150        160        170        180

190        200        210        220        230        240
m761.pep  GAVYGSWANRSLNMDINEVLNKNVAIRLTGEVGRANSFRSGIDSKNVMVSPSITVKLDNG
          |:||||||||||||||||||||||||||||||||||||||||||||||||||||||||||
a761      GTVYGSWANRSLNMDINEVLNKNVAIRLTGEVGRANSFRSGIDSKNVMVSPSITVKLDNG
               190        200        210        220        230        240

250        260        270        280        290        300
m761.pep  LKWTGQYTYDNVERTPDRSPTKSVYDRFGLPYRMGFAHRNDFVKDKLQVWRSDLEYAFND
          ||||||||||||||||||||||||||||||||||||||||||||||||||||||||||||
a761      LKWTGQYTYDNVERTPDRSPTKSVYDRFGLPYRMGFAHRNDFVKDKLQVWRSDLEYAFND
               250        260        270        280        290        300

310        320        330        340        350        360
m761.pep  KWRAQWQLAHRTAAQDFDHFYAGSENGNLIKRNYAWQQTDNKTLSSNLTLNGDYTIGRFE
          ||||||||||||||||||||||||||||||||||||||||||||||||||||||||||||
a761      KWRAQWQLAHRTAAQDFDHFYAGSENGNLIKRNYAWQQTDNKTLSSNLTLNGDYTIGRFE
               310        320        330        340        350        360

370        380        390        400        410        420
m761.pep  NHLTVGMDYSREHRNPTLGFSSAFSASINPYDRASWPASGRLQPILTQNRHKADSYGIFV
          ||||||||||||||||||||||||||||||||||||||||||||||||||||||||||||
a761      NHLTVGMDYSREHRNPTLGFSSAFSASINPYDRASWPASGRLQPILTQNRHKADSYGIFV
               370        380        390        400        410        420

430        440        450        460        470        480
m761.pep  QNIFSATPDLKFVLGGRYDKYTFNSENKLTGSSRQYSGHSFSPNIGAVWNINPVHTLYAS
          ||||||||||||||||||||||||||||||||||||||||||||||||||||||||||||
a761      QNIFSATPDLKFVLGGRYDKYTFNSENKLTGSSRQYSGHSFSPNIGAVWNINPVHTLYAS
               430        440        450        460        470        480

490        500        510        520        530        540
m761.pep  YNKGFAPYGGRGGYLSIDTLSSAVFNADPEYTRQYETGVKSSWLDDRLSTTLSAYQIERF
          ||||||||||||||||||||||||||||||||||||||||||||||||||||||||||||
a761      YNKGFAPYGGRGGYLSIDTLSSAVFNADPEYTRQYETGVKSSWLDDRLSTTLSAYQIERF
               490        500        510        520        530        540

550        560        570        580        590        600
m761.pep  NIRYRPDPKNNPYIYAVSGKHRSRGVELSAIGQIIPKKLYLRGSLGVMQAKVVEDKENPD
          ||||||||||||||||||||||||||||||||||||||||||||||||||||||||||||
a761      NIRYRPDPKNNPYIYAVSGKHRSRGVELSAIGQIIPKKLYLRGSLGVMQAKVVEDKENPD
               550        560        570        580        590        600
```

```
                           610        620        630        640        650        660
m761.pep     RVGIHLNNTSNVTGNLFFRYTPTENLYGEIGVTGTKRYGYNSRNKEVTTLPGFARVDAM
             ||||||||||||||||||||||||||||||||||||||:|||||||||||||||||||
a761         RVGIHLNNTSNVTGNLFFRYTPTENLYGEIGVTGTKRYGYDSRNKEVTTLPGFARVDAM
                           610        620        630        640        650        660

670        680        690        700
m761.pep     LGWNHKNVNVTFAAANLLNQKYWRSDSMPGNPRGYTARVNYRFX
             ||||||||||||||||||||||||||||||||||||||||||||
a761         LGWNHKNVNVTFAAANLLNQKYWRSDSMPGNPRGYTARVNYRFX
                           670        680        690        700
``` g762.seq Not yet found
g762.pep Not yet found
The following partial DNA sequence was identified in *N. meningitidis* <SEQ ID 2611>:

```
m762.seq
    1    ATGAAGTGGT TATTAAATAT GATAATGAGA CCTATTAAAT TTAGTATGGT

51    AAATACGTTA TTATTTATTG TTATATGTAG TTCATTTTTT GATCTGCTCG

101    TTCAATTATG TACAATTTTA TTTCATAGCC AAAAAATATA CTTTATTACA

151    TTATTTTTAT TATTTATTTT TAATTTTGTT ACAAAATCTA TCTATATGGC

201    AATTATTTAT CCTATTTTAT ATTTTTTTAC GATAAAAAAA TATTATCCTT

251    ACTCTAGGAA AGTGATAATT CTATTATCAT TAGCATTATC TATATATTTT

301    AGTTTTATGG ACTTTTACTT TTTTTCCATA TATTCAGATA ACCTTAGCTA

351    TGAAACGGAG CCTTTACATT TATACATCCC TATTATTATT AATTTTTTCT

401    CACTTTTAGT TTCTAATTTT ATTTTATCTT TTATCAACAA GTAA
```

This corresponds to the amino acid sequence <SEQ ID 2612; ORF 762>:

```
m762.pep
    1    MKWLLNMIMR PIKFSMVNTL LFIVICSSFF DLLVQLCTIL FHSQKIYFIT

51    LFLLFIFNFV TKSIYMAIIY PILYFFTIKK YYPYSRKVII LLSLALSIYF

101    SFMDFYFFSI YSDNLSYETE PLHLYIPIII NFFSLLVSNF ILSFINK*
```

The following partial DNA sequence was identified in *N. meningitidis* <SEQ ID 2613>:

```
a762.seq
    1    ATGAAGTGGT TATTAAATAT GATAATGAGA CCTATTAAAT TTAGTATGGT

51    AAATACGTTA TTATTTATTG TTATATGTAG TTCATTTTTT GATCTGCTCG

101    TTCAATTATG TACAATTTTA TTTCATAGCC AAAAAATATA CTTTATTACA

151    TTATTTTTAT TATTTATTTT TAATTTTGTT ACAAAATCTA TCTATATGGC

201    AATTATTTAT CCTATTTTAT ATTTTTTTAC GATAAAAAAA TATTATCCTT

251    ACTCTAGGAA AGTGATAATT CTATTATCAT TAGCATTATC TATATATTTT

301    AGTTTTATGG ACTTTTACTT TTTTTCCATA TATTCAGATA ACCTTAGCTA

351    TGAAACGGAG CCTTTACATT TATACATCCC TATTATTATT AATTTTTTCT

401    CACTTTTAGT TTCTAATTTT ATTTTATCTT TTATCAACAA GTAA
```

This corresponds to the amino acid sequence <SEQ ID 2614; ORF 762.a>:

```
a762.pep
    1   MKWLLNMIMR PIKFSMVNTL LFIVICSSFF DLLVQLCTIL FHSQKIYFIT

51   LFLLFIFNFV TKSIYMAIIY PILYFFTIKK YYPYSRKVII LLSLALSIYF

101   SFMDFYFFSI YSDNLSYETE PLHLYIPIII NFFSLLVSNF ILSFINK*
``` m762/a762 100.0% identity in 147 an overlap

```
                  10         20         30         40         50         60
    m762.pep  MKWLLNMIMRPIKFSMVNTLLFIVICSSFFDLLVQLCTILFHSQKIYFITLFLLFIFNFV
              ||||||||||||||||||||||||||||||||||||||||||||||||||||||||||||
    a762      MKWLLNMIMRPIKFSMVNTLLFIVICSSFFDLLVQLCTILFHSQKIYFITLFLLFIFNFV
                  10         20         30         40         50         60
                  70         80         90        100        110        120
    m762.pep  TKSIYMAIIYPILYFFTIKKYYPYSRKVIILLSLALSIYFSFMDFYFFSIYSDNLSYETE
              ||||||||||||||||||||||||||||||||||||||||||||||||||||||||||||
    a762      TKSIYMAIIYPILYFFTIKKYYPYSRKVIILLSLALSIYFSFMDFYFFSIYSDNLSYETE
                  70         80         90        100        110        120
                 130        140
    m762.pep  PLHLYIPIIINFFSLLVSNPILSFINKX
              ||||||||||||||||||||||||||||
    a762      PLHLYIPIIINFFSLLVSNPILSFINKX
                 130        140
``` g763.seq not yet found
g763.pep not yet found
The following partial DNA sequence was identified in *N. meningitidis* <SEQ ID 2615>:

```
m763.seq
    1   ATGACATTGC TCAATCTAAT GATAATGCAA GATTACGGTA TTTCCGTTTG

51   CCTGACACTG ACGCCCTATT TGCAACATGA ACTATTTTCG GCTATGAAAT

101   CCTATTTTTC CAAATATATC CTACCCGTTT CACTTTTTAC CTTGCCACTA

151   TCCCTTTCCC CATCCGTTTC GGCTTTTACG CTGCCTGAAG CATGGCGGGC

201   GGCGCAGCAA CATTCGGCTG ATTTTCAAGC GTCCCATTAC CAGCGTGATG

251   CAGTGCGCGC ACGGCAACAA CAAGCCAAGG CCGCATTCCT TCCCCATGTA

301   TCCGCCAATG CCAGCTACCA GCGCCAGCCG CCATCGATTT CTTCCACCCG

351   CGAAACACAG GGATGGAGCG TGCAGGTGGG ACAAACCTTA TTTGACGCTG

401   CCAAATTTGC ACAATACCGC CAAAGCAGGT TCGATACGCA GGCTGCAGAA

451   CAGCGTTTCG ATGCGGCACG CGAAGAATTG CTGTTGAAAG TTGCCGAAAG

501   TTATTTCAAC GTTTTACTCA GCCGAGACAC CGTTGCCGCC CATGCGGCGG

551   AAAAAGAGGC TTATGCCCAG CAGGTAAGGC AGGCGCAGGC TTTATTCAAT

601   AAAGGTGCTG CCACCGCGCT GGATATTCAC GAAGCCAAAG CCGGTTACGA

651   CAATGCCCTG GCCCAAGAAA TCGCCGTATT GGCTGAGAAA CAAACCTATG

701   AAAACCAGTT GAACGACTAC ACCGACCTGG ATAGCAAACA AATCGAGGCC

751   ATAGATACCG CCAACCTGTT GGCACGCTAT CTGCCCAAGC TGGAACGTTA

801   CAGTCTGGAT GAATGGCAGC GCATTGCCTT ATCCAACAAT CATGAATACC

851   GGATGCAGCA GCTTGCCCTG CAAAGCAGCG GACAGGCGCT TCGGGCAGCA

901   CAGAACAGCC GCTATCCCAC CGTTTCTGCC CATGTCGGCT ATCAGAATAA

951   CCTCTACACT TCATCTGCGC AGAATAATGA CTACCACTAT CGGGGCAAAG

1001   GGATGAGCGT CGGCGTACAG TTGAATTTGC CGCTTTATAC CGGCGGAGAA
```

-continued

```
1051  TTGTCGGGCA AAATCCATGA AGCCGAAGCG CAATACGGGG CCGCCGAAGC
1101  ACAGCTGACC GCAACCGAGC GGCACATCAA ACTCGCCGTA CGCCAGGCTT
1151  ATACCGAAAG CGGTGCGGCG CGTTACCAAA TCATGGCGCA AGAACGGGTT
1201  TTGGAAAGCA GCCGTTTGAA ACTGAAATCG ACCGAAACCG GCCAACAATA
1251  CGGCATCCGC AACCGGCTGG AAGTAATACG GGCGCGGCAG GAAGTCGCCC
1301  AAGCAGAACA GAAACTGGCT CAAGCACGGT ATAAATTCAT GCTGGCTTAT
1351  TTGCGCTTGG TGAAAGAGAG CGGGTTAGGG TTGGAAACGG TATTTGCGGA
1401  ATAA
```

This corresponds to the amino acid sequence <SEQ ID 2616; ORF 763>:

```
m763.pep
   1  MTLLNLMIMQ DYGISVCLTL TPYLQHELFS AMKSYFSKYI LPVSLFTLPL
  51  SLSPSVSAFT LPEAWRAAQQ HSADFQASHY QRDAVRARQQ QAKAAFLPHV
 101  SANASYQRQP PSISSTRETQ GWSVQVGQTL FDAAKFAQYR QSRFDTQAAE
 151  QRFDAAREEL LLKVAESYFN VLLSRDTVAA HAAEKEAYAQ QVRQAQALFN
 201  KGAATALDIH EAKAGYDNAL AQEIAVLAEK QTYENQLNDY TDLDSKQIEA
 251  IDTANLLARY LPKLERYSLD EWQRIALSNN HEYRMQQLAL QSSGQALRAA
 301  QNSRYPTVSA HVGYQNNLYT SSAQNNDYHY RGKGMSVGVQ LNLPLYTGGE
 351  LSGKIHEAEA QYGAAEAQLT ATERHIKLAV RQAYTESGAA RYQIMAQERV
 401  LESSRLKLKS TETGQQYGIR NRLEVIRARQ EVAQAEQKLA QARYKFMLAY
 451  LRLVKESGLG LETVFAE*
```

The following partial DNA sequence was identified in *N. meningitidis* <SEQ ID 2617>:

```
a763.seq
   1  ATGACATTGC TCAATCTAAT GATAATGCAA GATTACGGTA TTTCCGTTTG
  51  CCTGACACTG ACGCCCTATT TGCAACATGA ACTATTTTCG GCTATGAAAT
 101  CCTATTTTTC CAAATATATC CTACCCGTTT CACTTTTTAC CTTGCCACTA
 151  TCCCTTTCCC CATCCGTTTC GGCTTTTACG CTGCCTGAAG CATGGCGGGC
 201  GGCGCAGCAA CATTCGGCTG ATTTTCAAGC GTCCCATTAC CAGCGTGATG
 251  CAGTGCGCGC ACGGCAACAA CAAGCCAAGG CCGCATTCCT TCCCCATGTA
 301  TCCGCCAATG CCAGCTACCA GCGCCAGCCG CCATCGATTT CTTCCACCCG
 351  CGAAACACAG GGATGGAGCG TGCAGGTGGG ACAAACCTTA TTTGACGCTG
 401  CCAAATTTGC ACAATACCGC CAAAGCAGGT TCGATACGCA GGCTGCAGAA
 451  CAGCGTTTCG ATGCGGCACG CGAAGAATTG CTGTTGAAAG TTGCCGAAAG
 501  TTATTTCAAC GTTTTACTCA GCCGAGACAC CGTTGCCGCC CATGCGGCGG
 551  AAAAAGAGGC TTATGCCCAG CAGGTAAGGC AGGCGCAGGC TTTATTCAAT
 601  AAAGGTGCTG CCACCGCGCT GGATATTCAC GAAGCCAAAG CCGGTTACGA
 651  CAATGCCCTG GCCCAAGAAA TCGCCGTATT GGCTGAGAAA CAAACCTATG
 701  AAAACCAGTT GAACGACTAC ACCGGCCTGG ACAGCAAACA AATCGAGGCC
 751  ATAGATACCG CCAACCTGTT GGCACGCTAT CTGCCGAAGC TGGAACGTTA
```

-continued

```
 801  CAGTCTGGAT GAATGGCAGC GCATTGCCTT ATCCAACAAT CATGAATACC
 851  GGATGCAGCA GCTTGCCCTG CAAAGCAGCG ACAGGCGCT TCGGGCAGCA
 901  CAGAACAGCC GCTATCCCAC CGTTTCTGCC CATGTCGGCT ATCAGAATAA
 951  CCTCTACACT TCATCTGCGC AGAATAATGA CTACCACTAT CGGGGCAAAG
1001  GGATGAGCGT CGGCGTACAG TTGAATTTGC CGCTTTATAC CGGCGGAGAA
1051  TTGTCGGGCA AAATCCATGA AGCCGAAGCG CAATACGGGG CTGCCGAAGC
1101  ACAGCTGACC GCAACCGAGC GGCACATCAA ACTCGCCGTA CGCCAGGCTT
1151  ATACCGAAAG CGGTGCGGCG CGTTACCAAA TCATGGCGCA AGAACGGGTT
1201  TTGGAAAGCA GCCGTTTGAA ACTGAAATCG ACCGAAACCG GCCAACAATA
1251  CGGCATCCGC AACCGGCTGG AAGTAATACG GGCGCGGCAG GAAGTCGCCC
1301  AAGCAGAACA GAAACTGGCT CAAGCACGGT ATAAATTCAT GCTGGCTTAT
1351  TTGCGCTTGG TGAAAGAGAG CGGGTTAGGG TTGGAAACGG TATTTGCGGA
1401  ATAA
```

This corresponds to the amino acid sequence <SEQ ID 2618; ORF 763.a>:

```
a763.pep
    1  MTLLNLMIMQ DYGISVCLTL TPYLQHELFS AMKSYFSKYI LPVSLFTLPL

51  SLSPSVSAFT LPEAWRAAQQ HSADFQASHY QRDAVRARQQ QAKAAFLPHV

101  SANASYQRQP PSISSTRETQ GWSVQVGQTL FDAAKFAQYR QSRFDTQAAE

151  QRFDAAREEL LLKVAESYFN VLLSRDTVAA HAAEKEAYAQ QVRQAQALFN

201  KGAATALDIH EAKAGYDNAL AQEIAVLAEK QTYENQLNDY TGLDSKQIEA

251  IDTANLLARY LPKLERYSLD EWQRIALSNN HEYRMQQLAL QSSGQALRAA

301  QNSRYPTVSA HVGYQNNLYT SSAQNNDYHY RGKGMSVGVQ LNLPLYTGGE

351  LSGKIHEAEA QYGAAEAQLT ATERHIKLAV RQAYTESGAA RYQIMAQERV

401  LESSRLKLKS TETGQQYGIR NRLEVIRARQ EVAQAEQKLA QARYKFMLAY

451  LRLVKESGLG LETVFAE*
``` m763/a763 99.8% identity in 467 aa overlap

```
                  10         20         30         40         50         60
m763.pep  MTLLNLMIMQDYGISVCLTLTPYLQHELFSAMKSYFSKYILPVSLFTLPLSLSPSVSAFT
          ||||||||||||||||||||||||||||||||||||||||||||||||||||||||||||
a763      MTLLNLMIMQDYGISVCLTLTPYLQHELFSAMKSYFSKYILPVSLFTLPLSLSPSVSAFT
                  10         20         30         40         50         60

70         80         90        100        110        120
m763.pep  LPEAWRAAQQHSADFQASHYQRDAVRARQQQAKAAFLPHVSANASYQRQPPSISSTRETQ
          ||||||||||||||||||||||||||||||||||||||||||||||||||||||||||||
a763      LPEAWRAAQQHSADFQASHYQRDAVRARQQQAKAAFLPHVSANASYQRQPPSISSTRETQ
                  70         80         90        100        110        120

130        140        150        160        170        180
m763.pep  GWSVQVGQTLFDAAKFAQYRQSRFDTQAAEQRFDAAREELLLKVAESYFNVLLSRDTVAA
          ||||||||||||||||||||||||||||||||||||||||||||||||||||||||||||
a763      GWSVQVGQTLFDAAKFAQYRQSRFDTQAAEQRFDAAREELLLKVAESYFNVLLSRDTVAA
                 130        140        150        160        170        180

190        200        210        220        230        240
m763.pep  HAAEKEAYAQQVRQAQALFNKGAATALDIHEAKAGYDNALAQEIAVLAEKQTYENQLNDY
          ||||||||||||||||||||||||||||||||||||||||||||||||||||||||||||
a763      HAAEKEAYAQQVRQAQALFNKGAATALDIHEAKAGYDNALAQEIAVLAEKQTYENQLNDY
                 190        200        210        220        230        240
```

-continued

```
                250        260        270        280        290        300
m763.pep   TDLDSKQIEAIDTANLLARYLPKLERYSLDEWQRIALSNNHEYRMQQLALQSSGQALRAA
           | |||||||||||||||||||||||||||||||||||||||||||||||||||||||||||
a763       TGLDSKQIEAIDTANLLARYLPKLERYSLDEWQRIALSNNHEYRMQQLALQSSGQALRAA
                250        260        270        280        290        300

310        320        330        340        350        360
m763.pep   QNSRYPTVSAHVGYQNNLYTSSAQNNDYHYRGKGMSVGVQLNLPLYTGGELSGKIHEAEA
           ||||||||||||||||||||||||||||||||||||||||||||||||||||||||||||
a763       QNSRYPTVSAHVGYQNNLYTSSAQNNDYHYRGKGMSVGVQLNLPLYTGGELSGKIHEAEA
                310        320        330        340        350        360

370        380        390        400        410        420
m763.pep   QYGAAEAQLTATERHIKLAVRQAYTESGAARYQIMAQERVLESSRLKLKSTETGQQYGIR
           ||||||||||||||||||||||||||||||||||||||||||||||||||||||||||||
a763       QYGAAEAQLTATERHIKLAVRQAYTESGAARYQIMAQERVLESSRLKLKSTETGQQYGIR
                370        380        390        400        410        420

430        440        450        460
m763.pep   NRLEVIRARQEVAQAEQKLAQARYKFMLAYLRLVKESGLGLETVFAEX
           ||||||||||||||||||||||||||||||||||||||||||||||||
a763       NRLEVIRARQEVAQAEQKLAQARYKFMLAYLRLVKESGLGLETVFAEX
                430        440        450        460
``` g764.seq not found yet g764.pep not found yet

The following partial DNA sequence was identified in *N. meningitidis* <SEQ ID 2619>:

```
m764.seq
      1  ATGTTTTTCT CCGCCCTGAA ATCCTTTCTT TCTCGATACA TTACTGTATG
     51  GCGCAATGTT TGGGCGGTGC GCGACCAGTT GAAACCGCCC AAACGCACGG
    101  CGGAAGAACA GGCGTTTTTG CCCGCGCATT TGGAACTGAC CGATACGCCG
    151  GTCTCTGCCG CTCCGAAATG GGCGGCGCGT TTTATTATGG CGTTTGCGCT
    201  TTTGGCTTTG TTGTGGTCCT GGTTCGGCAA AATCGATATT GTGGCGGCGG
    251  CTTCGGGCAA AACGGTGTCG GGCGGGCGCA GCAAAACCAT CCAGCCGCTG
    301  GAAACGGCGG TGGTTAAGGC GGTACATGTG CGCGACGGGC AGCATGTGAA
    351  ACAGGGAGAA ACGCTGGCGG AACTGGAGGC TGTGGGAACA GACAGCGATG
    401  TGGTGCAGTC GGAGCAGGCT TTGCAGGCTG CCCAATTGTC CAAACTGCGT
    451  TATGAAGCGG TATTGGCGGC ATTGGAAAGC CGTACCGTGC CGCATATCGA
    501  TATGGCGCAA GCACGGTCTT TAGGTCTCTC CGATGCCGAT GTGCAATCGG
    551  CGCAGGTGTT GGCGCAGCAC CAGTATCAGG CATGGGCGGC GCAGGATGCG
    601  CAATTGCAGT CGGCTTTGCG CGGCCATCAG GCGGAATTGC AGTCGGCCAA
    651  GGCGCAGGAG CAGAAGCTGG TTTCGGTGGG GGCGATCGAG CAGCAGAAAA
    701  CAGCAGACTA CCGCCGTTTG CGGGCCGACA ATTTTATTTC GGAACATGCG
    751  TTTTTGGAGC AGCAGAGCAA ATCGGTCAGC AATTGGAACG ATTTGGAAAG
    801  TACGCGCGGT CAGATGAGGC AGATTCAGGC GGCCATTGCA CAGGCGGAGC
    851  AGAATCGGGT GCTGAATACG CAGAACCTGA AACGCGATAC GCTGGATGCG
    901  CTGCGCCAGG CAAACGAACA GATTGACCAA TACCGCGGCC AAACGGATAA
    951  GGCAAAGCAG CGGCAGCAGC TGATGACAAT ACAGTCGCCT GCGGACGGCA
   1001  CGGTGCAGGA ATTGGCTACC TATACGGTGG GCGGTGTGGT GCAGGCTGCC
   1051  CAAAAAATGA TGGTGATTGC GCCCGATGAC GACAAAATGG ACGTGGAAGT
   1101  TTTGGTATTG AACAAAGACA TCGGTTTTGT GGAACAGGGA CAGGATGCGG
   1151  TGGTGAAGAT TGAGAGCTTT CCCTATACGC GCTACGGTTA TCTGACGGGC
   1201  AAGGTGAAAA GTGTCAGCCA TGATGCGGTA AGCCACGAAC AGTTGGGCTT
```

```
-continued
1251  GGTTTATACG GCGGTGGTGT CGCTGGACAA ACATACCTTG AATATTGACG

1301  GCAAAGCAGT GAATCTGACG GCGGGCATGA ATGTCACGGC GGAGATTAAA

1351  ACGGGTAAAC GGCGGGTGCT GGATTATCTG TTAAGCCCGC TGCAAACCAA

1401  ATTGGACGAA AGCTTTAGGG AGCGATAG
```

This corresponds to the amino acid sequence <SEQ ID 2620; ORF 764>:

```
m764.pep
    1  MFFSALKSFL SRYITVWRNV WAVRDQLKPP KRTAEEQAFL PAHLELTDTP

51  VSAAPKWAAR FIMAFALLAL LWSWFGKIDI VAAASGKTVS GGRSKTIQPL

101  ETAVVKAVHV RDGQHVKQGE TLAELEAVGT DSDVVQSEQA LQAAQLSKLR

151  YEAVLAALES RTVPHIDMAQ ARSLGLSDAD VQSAQVLAQH QYQAWAAQDA

201  QLQSALRGHQ AELQSAKAQE QKLVSVGAIE QQKTADYRRL RADNFISEHA

251  FLEQQSKSVS NWNDLESTRG QMRQIQAAIA QAEQNRVLNT QNLKRDTLDA

301  LRQANEQIDQ YRGQTDKAKQ RQQLMTIQSP ADGTVQELAT YTVGGVVQAA

351  QKMMVIAPDD DKMDVEVLVL NKDIGFVEQG QDAVVKIESF PYTRYGYLTG

401  KVKSVSHDAV SHEQLGLVYT AVVSLDKHTL NIDGKAVNLT AGMNVTAEIK

451  TGKRRVLDYL LSPLQTKLDE SFRER*
```

The following partial DNA sequence was identified in *N. meningitidis* <SEQ ID 2621>:

```
a764.seq (partial)
    1  ATGTTTTTCT CCGCCCTGAA ATCCTTTCTT TCCCGCTACA TTACCGTATG

51  GCGCAATGTT TGGGCGGTGC GCGACCAGTT GGAACCGCCC AAACGCACGG

101  CGGAAGAACA GGCGTTTTTG CCCGCGCATT TGGAACTGAC CGATACGCCG

151  GTCTCTGCCG CTCCGAAATG GGCGGCGCGT TTTATTATGG CGTTTGCGCT

201  TTTGGCTTTG TTGTGGTCCT GGTTCGGCAA AATCGATATT GTGGCGGCGG

251  CTTCGGGCAA AACGGTGTCG GGCGGGCGCA GCAAAACCAT CCAGCCGCTG

301  GAAACGGTGG TGGTTAAGGC GGTACATGTG CGCGACGGGC AGCATGTGAA

351  ACAGGGAGAA ACGCTGGCGG AACTGGAGGC TGTGGGAACA GACAGCGATG

401  TGGTGCAGTC GGAGCAGGCT TTGCAGGCTG CCCAATTGTC CAAACTGCGT

451  TATGAAGCGG TATTGGCGGC ATTGGAAAGC CGTACCGTGC CGCATATCGA

501  TATGGCGCAA GCACGGTCTT TAGGTCTCTC CGATGCCGAT GTGCAATCGG

551  CGCAGGTGTT GGCGCAGCAC CAGTATCAGG CATGGGCGGC GCAGGATGCG

601  CAATTGCAGT CGGCTTTGCG CGGCCATCAG GCGGAATTGC AGTCGGCCAA

651  GGCGCAGGAG CAGAAGCTGG TTTCGGTGGG GGCGATCGAG CAGCAGAAAA

701  CAGCAGACTA CCGCCGTTTG CGGGCCGACA ATTTTATTTC GGAACATGCG

751  TTTTTGGAGC AGCAGAGCAA ATCGGTCAGC AATTGAACG ATTTGGAAAG

801  TACGCGCGGT CAGATGAGGC AGATTCAGGC GGCCATTGCA CAGGCGGAGC

851  AGAATCGGGT GCTGAATACG CAGAACCTGA AACGCGATAC GCTGGATGCG

901  CTGCGCCAGG CAAACGAACA GATTGACCAA TACCGCGGCC AAACGGATAA

951  GGCAAAGCAG CGGCAGCAGC TGATGACAAT ACAGTCGCCT GCGGACGGCA
```

```
                           -continued
1001    CGGTGCAGGA ATTGGCCACC TATACGGTGG GCGGTGTGGT GCAGGCTGCC

1051    CAAAAAATGA TGGTGGTTGC GCCCGATGAC GACAAAATGG ACGTGGAAGT

1101    TTTGGTATTG AACAAAGACA TCGGTTTTGT GGAACAGGGA CAGGATGCGG

1151    TGGTGAAGAT TGAGAGTTTT CCCTATACGC GCTACGGTTA TCTGACGGGC

1201    AAGGTGAAAA GTGTCAGCCA TGATGCGGTA AGCCACGAAC AGTTGGGCTT

1251    GGTTTATACG GCGGTGGTGT CGCTGGACAA ACATACCTTG AATATTGACG

1301    GCAAA
```

This corresponds to the amino acid sequence <SEQ ID 2622; ORF 764.a>:

```
a764.pep (partial)
   1    MFFSALKSFL SRYITVWRNV WAVRDQLEPP KRTAEEQAFL PAHLELTDTP

51    VSAAPKWAAR FIMAFALLAL LWSWFGKIDI VAAASGKTVS GGRSKTIQPL

101    ETVVVKAVHV RDGQHVKQGE TLAELEAVGT DSDVVQSEQA LQAAQLSKLR

151    YEAVLAALES RTVPHIDMAQ ARSLGLSDAD VQSAQVLAQH QYQAWAAQDA

201    QLQSALRGHQ AELQSAKAQE QKLVSVGAIE QQKTADYRRL RADNFISEHA

251    FLEQQSKSVS NWNDLESTRG QMRQIQAAIA QAEQNRVLNT QNLKRDTLDA

301    LRQANEQIDQ YRGQTDKAKQ RQQLMTIQSP ADGTVQELAT YTVGGVVQAA

351    QKMMVVAPDD DKMDVEVLVL NKDIGFVEQG QDAVVKIESF PYTRYGYLTG

401    KVKSVSHDAV SHEQLGLVYT AVVSLDKHTL NIDGK
``` m764/a764 99.3% identity in 435 aa overlap

```
                  10         20         30         40         50         60
m764.pep  MFFSALKSFLSRYITVWRNVWAVRDQLKPPKRTAEEQAFLPAHLELTDTPVSAAPKWAAR
          ||||||||||||||||||||||||||| :||||||||||||||||||||||||||||||
a764      MFFSALKSFLSRYITVWRNVWAVRDQLEPPKRTAEEQAFLPAHLELTDTPVSAAPKWAAR
                  10         20         30         40         50         60

70         80         90        100        110        120
m764.pep  FIMAFALLALLWSWFGKIDIVAAASGKTVSGGRSKTIQPLETAVVKAVHVRDGQHVKQGE
          |||||||||||||||||||||||||||||||||||||||||| :|||||||||||||||
a764      FIMAFALLALLWSWFGKIDIVAAASGKTVSGGRSKTIQPLETVVVKAVHVRDGQHVKQGE
                  70         80         90        100        110        120

130        140        150        160        170        180
m764.pep  TLAELEAVGTDSDVVQSEQALQAAQLSKLRYEAVLAALESRTVPHIDMAQARSLGLSDAD
          ||||||||||||||||||||||||||||||||||||||||||||||||||||||||||||
a764      TLAELEAVGTDSDVVQSEQALQAAQLSKLRYEAVLAALESRTVPHIDMAQARSLGLSDAD
                 130        140        150        160        170        180

190        200        210        220        230        240
m764.pep  VQSAQVLAQHQYQAWAAQDAQLQSALRGHQAELQSAKAQEQKLVSVGAIEQQKTADYRRL
          ||||||||||||||||||||||||||||||||||||||||||||||||||||||||||||
a764      VQSAQVLAQHQYQAWAAQDAQLQSALRGHQAELQSAKAQEQKLVSVGAIEQQKTADYRRL
                 190        200        210        220        230        240

250        260        270        280        290        300
m764.pep  RADNFISEHAFLEQQSKSVSNWNDLESTRGQMRQIQAAIAQAEQNRVLNTQNLKRDTLDA
          ||||||||||||||||||||||||||||||||||||||||||||||||||||||||||||
a764      RADNFISEHAFLEQQSKSVSNWNDLESTRGQMRQIQAAIAQAEQNRVLNTQNLKRDTLDA
                 250        260        270        280        290        300

310        320        330        340        350        360
m764.pep  LRQANEQIDQYRGQTDKAKQRQQLMTIQSPADGTVQELATYTVGGVVQAAQKMMVIAPDD
          |||||||||||||||||||||||||||||||||||||||||||||||||||||| :|||
a764      LRQANEQIDQYRGQTDKAKQRQQLMTIQSPADGTVQELATYTVGGVVQAAQKMMVVAPDD
                 310        320        330        340        350        360

370        380        390        400        410        420
m764.pep  DKMDVEVLVLNKDIGFVEQGQDAVVKIESFPYTRYGYLTGKVKSVSHDAVSHEQLGLVYT
          ||||||||||||||||||||||||||||||||||||||||||||||||||||||||||||
a764      DKMDVEVLVLNKDIGFVEQGQDAVVKIESFPYTRYGYLTGKVKSVSHDAVSHEQLGLVYT
                 370        380        390        400        410        420
```

```
                         430       440        450        460        470
m764.pep    AVVSLDKHTLNIDGKAVNLTAGMNVTAEIKTGKRRVLDYLLSPLQTKLDESFRERX
            ||||||||||||||
a764        AVVSLDKHTLNIDGK
                         430
``` g765.seq not yet found
g765.pep not yet found
The following partial DNA sequence was identified in *N. meningitidis* <SEQ ID 2623>:

```
m765.seq
     1    ATGTTAAGAT GCCGTCCGAA ATCCGTTTTG GATTCAGACG GCATTTTTTT

51    GAAATTTAAT TTTTTAAGGA GTAAACCTAA ATATGAAATT TCCTTCCTTC

101    CTTCCTTTAA ACGGATACTC TGCCTGTCGG CAGTAATCTC GGTATTGGGG

151    GCTTGTGCGG TCGTTGCTGA TGTTTACGGT CATGATTCCG CCACAATGAA

201    CGCTGCGGCT GCCAAAGATT ATATGAAAAC GGTTGAGTTA ACAAGTCTG

251    CCGGCAATGT CGATACCACA TCCAGAACAG CCCGCAGGGT GCAGGCAGTA

301    TTTCGACGTA TGCTGCCTTA TGCCGATGCG GCAAATAATA CCAGCCATAA

351    GTTTGACTGG AAAATGACGG TTTTCAAAAA CGATGAGCTG AACGCGTGGG

401    CAATGCCCGG TGGAAAAATG GCGTTTTATA CGGGGATAGT CGACAAACTC

451    AAGCTGACCG ATGACGAAAT TGCCGCCATT ATGGGGCATG AAATGACGCA

501    CGCCCTGCAT GAACACGGTA AAAATAAGGT CGGGCAGCAA ATCTTGACCA

551    ATACGGCGGC GCAGATAGGC ACGCAGATTA TATTAGACAA AAAACCGGAT

601    ACTAATCCGG AATTGGTCGG ATTGGGTATG GATATTTTGG GGACGTACGG

651    TCTTACCTTG CCTTATAGCC GCAGCTTGGA AGAAGAAGCC GATGAGGGGG

701    GAATGATGTT GATGGCGCAG GCAGGCTATC ATCCGGCGGC CGCTGTCAGG

751    GTTTGGGAAA AAATGAATCA GGAAAACGAC CAAAACGGCT TTATTTATGC

801    TATTACCTCT ACTCATCCGA CAAACAATGC CGTATAGAA AATCTAAAAC

851    GGTTGTTGCC GACCGTTATG CCGGTTTATG AGCAAAGTGT CAGAAATAAG

901    GGGCGCGTTA ATAAAAAACG TCGGCGTTAA
```

This corresponds to the amino acid sequence <SEQ ID 2624; ORF 765>:

```
m765.pep
     1    MLRCRPKSVL DSDGIFLKFN FLRSKPKYEI SFLPSFKRIL CLSAVISVLG

51    ACAVVADVYG HDSATMNAAA AKDYMKTVEL NKSAGNVDTT SRTARRVQAV

101    FRRMLPYADA ANNTSHKFDW KMTVFKNDEL NAWAMPGGKM AFYTGIVDKL

151    KLTDDEIAAI MGHEMTHALH EHGKNKVGQQ ILTNTAAQIG TQIILDKKPD

201    TNPELVGLGM DILGTYGLTL PYSRSLEEEA DEGGMMLMAQ AGYHPAAAVR

251    VWEKMNQEND QNGFIYAITS THPTNNARIE NLKRLLPTVM PVYEQSVRNK

301    GRVNKKRRR*
```

The following partial DNA sequence was identified in *N. meningitidis* <SEQ ID 2625>:

```
a765.seq
     1   ATGTTAAGAT GCCGTCCGAA ATCCGTTTTG GATTCAGACG GCATTTTTTT

51   GAAATTTAAT TTTTTAAGGA GTAAACCTAA ATATGAAATT TCCTTCCTTC

101   CTTCCTTTAA ACGGATACTC TGCCTGTCGG CAGTAATCTC GGTATTGGGG

151   GCTTGTACGG TCGTTGCTGA TGTTTACGGT CAGGATTCCG CCACAATGAA

201   TGCTGCGGCT GCCGAAGATT ATATGAAAAC GGTTGAGTTG AACAAGTCTG

251   CCGGCAATGT CGATACTACA TCCAAAACAG CCCGTAGGGT GCAGGCAGTA

301   TTTCGACGTA TGTTGCCTTA TGCCGATGCG GCAAATAATA CCGGCCATAA

351   GTTTGACTGG AAAATGACGG TTTTCAAAAA CGATGAGCTG AACGCGTGGG

401   CAATGCCCGG CGGGAAAATG GCGTTTTATA CGGGGATAGT CGATAAACTT

451   AAGCTGACCG ATGGCGAAAT TGCCGCCATT ATGGGGCATG AAATGACGCA

501   TGCCCTGCAT GAACACGGTA AAAATAAGGT CGGGCAGAAA ATCTTGACTA

551   ATATGGCGGC GCAGATAGGC ACGCAGATTA TATTAGACAA AAAACCGGAC

601   ACTAATCCGG AATTGGTCGG ATTGGGTATG GATATTTTGG GGATGTACGG

651   CATTACCTTG CCTTATAGCC GCAGCTTGGA AGAAGAAGCC GATGAGGGGG

701   GAATGATGTT GATGGCGCAG GCAGGCTATC ATCCGGCAGC CGCTGTCAGG

751   GTTTGGGAAA AAATGAATCA GGAAAACGAC CAAAACGGCT TTATTTATGC

801   TATTACCTCT ACTCATCCGA CAAACAATGC CCGTATAGAA AATCTAAAAC

851   GGTTGTTGCC GACCGTTATG CCGGTTTATG AGCACAGTGT TAGAAATAAG

901   GGGCGCGTTA ATAAAAACCG TCGGCGTTAA
```

This corresponds to the amino acid sequence <SEQ ID 2626; ORF 765.a>:

```
a765.pep
     1   MLRCRPKSVL DSDGIFLKFN FLRSKPKYEI SFLPSFKRIL CLSAVISVLG

51   ACTVVADVYG QDSATMNAAA AEDYMKTVEL NKSAGNVDTT SKTARRVQAV

101   FRRMLPYADA ANNTGHKFDW KMTVFKNDEL NAWAMPGGKM AFYTGIVDKL

151   KLTDGEIAAI MGHEMTHALH EHGKNKVGQK ILTNMAAQIG TQIILDKKPD

201   TNPELVGLGM DILGMYGITL PYSRSLEEEA DEGGMMLMAQ AGYHPAAAVR

251   VWEKMNQEND QNGFIYAITS THPTNNARIE NLKRLLPTVM PVYEHSVRNK

301   GRVNKNRRR*
```

Computer analysis of this amino acid sequence gave the following results:

Homology with a Predicted ORF from *N. meningitidis*

ORF 765 shows 96.18% identity over a 309 aa overlap with a predicted ORF (ORF 765) from *N. meningitidis:* m765/a765 96.1% identity in 309 aa overlap

```
                   10        20        30        40        50        60
m765.pep   MLRCRPLSVLDSDGIFLKFNFLRSKPKYEISFLPSFKRILCLSAVISVLGACAVVADVYG
           ||||||||||||||||||||||||||||||||||||||||||||||||||||:|||||||
a765       MLRCRPLSVLDSDGIFLKFNFLRSKPKYEISFLPSFKRILCLSAVISVLGACTVVADVYG
                   10        20        30        40        50        60
```

```
              70         80         90        100        110        120
m765.pep  HDSATMNAAAAKDYMKTVELNKSAGNVDTTSRTARRVQAVFRRMLPYADAANNTSHKFDW
          :||||||||||:||||||||||||||||||:|||||||||||||||||||||||:||||
a765      QDSATMNAAAAEDYMKTVELNKSAGNVDTTSKTARRVQAVFRRMLPYADAANNTGHKFDW
              70         80         90        100        110        120

130        140        150        160        170        180
m765.pep  KMTVFKNDELNAWAMPGGKMAFYTGIVDKLKLTDDEIAAIMGHEMTHALHEHGKNKVGQQ
          |||||||||||||||||||||||||||||||||| |||||||||||||||||||||||:
a765      KMTVFKNDELNAWAMPGGKMAFYTGIVDKLKLTDGEIAAIMGHEMTHALHEHGKNKVGQK
             130        140        150        160        170        180

190        200        210        220        230        240
m765.pep  ILTNTAAQIGTQIILDKKPDTNPELVGLGMDILGTYGLTLPYSRSLEEEADEGGMMLMAQ
          ||||:|||||||||||||||||||||||||||||| ||:|||||||||||||||||||
a765      ILTNMAAQIGTQIILDKKPDTNPELVGLGMDILGMYGITLPYSRSLEEEADEGGMMLMAQ
             190        200        210        220        230        240

250        260        270        280        290        300
m765.pep  AGYHPAAAVRVWEKMNQENDQNGFIYAITSTHPTNNARIENLKRLLPTVMPVYEQSVRNK
          ||||||||||||||||||||||||||||||||||||||||||||||||||||:||||
a765      AGYHPAAAVRVWEKMNQENDQNGFIYAITSTHPTNNARIENLKRLLPTVMPVYEHSVRNK
             250        260        270        280        290        300

310
m765.pep  GRVNKKRRRX
          |||||:||||
a765      GRVNKNRRRX
             310
```

The following partial DNA sequence was identified in *N. gonorrhoeae* <SEQ ID 2627>:

```
g767.seq
    1    ATGAAGTTTA AACATCTGTT GCCGCTGCTG CTGTCGGCAG TGTTGTCCGC

51    GCAGGCATAT GCCCTGACGG AAGGGGAAGA CTATCTTGTG TTGGATAAAC

101    CCATTCCTCA AGAACAGCCG GGAAAAATTG AGGTTTTGGA ATTTTTCGGC

151    TATTTTTGCG TACATTGCCA TCATTTCGAT CCTTTGTTAT TGAAACTGGG

201    CAAGGCATTG CCGTCTGATA CTTATCTGCG GACGGAGCAC GTGGTCTGGC

251    GGCCTGAAAT GCTCGGTCTG GCAAGAATGG CTGCTGCGGT CAAGCTGTCG

301    GGTTTGAAAT ATCAGGCAAA CTCTGCTGTG TTTAAAGCAG TTTACGAACA

351    AAAAATCCGT TTGGAAAACA GGGCTGTTGC CGGGAAATGG GCTTTATCTC

401    AAAAAGGTTT TGACGGCAAA AAACTGATGC GCGCCTATGA TTCCCCCGAA

451    GCTGCCGCCG TCGCATTAAA AATGCAGAAA CTGACGGAAC AATACGGTAT

501    TGACAGCACG CCGACCGTTA TTGTCGGCGG AAAATACCGC GTTATCTTCA

551    ATAATGGCTT TGATGGCGGC GTTCATACGA TTAAAGAATT GGTTGCCAAA

601    GTCAGGGAAG AACGCAAGCG TCAGACCCCT GCTGTACAGA AATAG
```

This corresponds to the amino acid sequence <SEQ ID 2628; ORF 767.ng>:

```
g767.pep
    1    MKFKHLLPLL LSAVLSAQAY ALTEGEDYLV LDKPIPQEQP GKIEVLEFFG

51    YFCVHCHHFD PLLLKLGKAL PSDTYLRTEH VVWRPEMLGL ARMAAAVKLS

101    GLKYQANSAV FKAVYEQKIR LENRAVAGKW ALSQKGFDGK KLMRAYDSPE

151    AAAVALKMQK LTEQYGIDST PTVIVGGKYR VIFNNGFDGG VHTIKELVAK

201    VREERKRQTP AVQK*
```

The following partial DNA sequence was identified in *N. meningitidis* <SEQ ID 2629>:

```
m767.seq
    1   ATGAAGCTCA AACATCTGTT GCCGCTGCTG CTGTCGGCAG TGTTGTCCGC

51   GCAGGCATAT GCCCTGACGG AAGGGGAAGA CTATCTTGTG TTGGATAAAC

101   CCATTCCTCA AGAACAGTCG GGTAAAATTG AGGTTTTGGA ATTTTTCGGC

151   TATTTCTGCG TACATTGCCA TCATTTCGAT CCTTTGTTAT TGAAACTGGG

201   CAAGGCATTG CCGTCTGATG CCTATTTGAG GACGGAGCAC GTGGTCTGGC

251   AGCCTGAAAT GCTCGGTTTG CTAGGATGG CGGCTGCCGT CAATTTGTCG

301   GGTTTGAAAT ATCAGGCAAA CCCTGCTGTG TTTAAAGCAG TTTACGAACA

351   AAAAATCCGC TTGGAAAACA GGTCGGTTGC CGGAAAATGG GCTTTGTCTC

401   AAAAAGGCTT TGACGGCAAA AAACTGATGC GCGCCTATGA TTCCCCCGAA

451   GCTGCCGCCG CCGCATTAAA AATGCAGAAA CTGACGGAAC AATACCGCAT

501   CGACAGCACG CCGACCGTTA TTGTCGGCGG AAAATACCGC GTTATCTTCA

551   ATAACGGCTT TGACGGCGGC GTTCATACGA TTAAAGAATT GGTTGCCAAA

601   GTCAGGGAAG AACGCAAGCG TCAGACCCCT GCTGTACAGA AATAG
```

This corresponds to the amino acid sequence <SEQ ID 2630; ORF 767>:

```
m767.pep
    1   MKLKHLLPLL LSAVLSAQAY ALTEGEDYLV LDKPIPQEQS GKIEVLEFFG

51   YFCVHCHHFD PLLLKLGKAL PSDAYLRTEH VVWQPEMLGL ARMAAAVNLS

101   GLKYQANPAV FKAVYEQKIR LENRSVAGKW ALSQKGFDGK KLMRAYDSPE

151   AAAAALKMQK LTEQYRIDST PTVIVGGKYR VIFNNGFDGG VHTIKELVAK

201   VREERKRQTP AVQK*
```

Computer analysis of this amino acid sequence gave the following results:
Homology with a Predicted ORF from *N. gonorrhoeae*
ORF 767 shows 95.8% identity over a 214 aa overlap with a predicted ORF (ORF 767) from *N. gonorrhoeae*
m767/g767 95.8% identity in 214 aa overlap

```
                   10         20         30         40         50         60
     g767.pep  MKFKHLLPLLLSAVLSAQAYALTEGEDYLVLDKPIPQEQPGKIEVLEFFGYFCVHCHHFD
               ||:|||||||||||||||||||||||||||||||||||| ||||||||||||||||||||
     m767      MKLKHLLPLLLSAVLSAQAYALTEGEDYLVLDKPIPQEQSGKIEVLEFFGYFCVHCHHFD
                   10         20         30         40         50         60

70         80         90        100        110        120
     g767.pep  PLLLKLGKALPSDTYLRTEHVVWRPEMLGLARMAAAVKLSGLKYQANSAVFKAVYEQKIR
               ||||||||||||| |||||||||| |||||||||||||:||||||||| |||||||||||
     m767      PLLLKLGKALPSDAYLRTEHVVWQPEMLGLARMAAAVNLSGLKYQANPAVFKAVYEQKIR
                   70         80         90        100        110        120

130        140        150        160        170        180
     g767.pep  LENRAVAGKWALSQKGFDGKKLMRAYDSPEAAAVALKMQKLTEQYGIDSTPTVIVGGKYR
               ||||:||||||||||||||||||||||||||||| |||||||||||| ||||||||||||
     m767      LENRSVAGKWALSQKGFDGKKLMRAYDSPEAAAAALKMQKLTEQYRIDSTPTVIVGGKYR
                  130        140        150        160        170        180

190        200        210
     g767.pep  VIFNNGFDGGVHTIKELVAKVREERKRQTPAVQKX
                |||||||||||||||||||||||||||||||||
     m767      VIFNNGFDGGVHTIKELVAKVREERKRQTPAVQK
                  190        200        210
```

The following partial DNA sequence was identified in *N. meningitidis* <SEQ ID 2631>:

```
a767.seq
    1   ATGAAGCTCA AACATCTGTT GCCGCTGCTG CTGTCGGCAG TGTTGTCCGC
   51   GCAGGCATAT GCCCTGACGG AAGGGGAAGA CTATCTTGTG TTGGATAAAC
  101   CCATTCCTCA AAAACAGTCG GGCAAAATTG AGGTTTTGGA ATTTTTCGGC
  151   TATTTCTGCG TACATTGCCA TCATTTCGAT CCTTTGTTAT TGAAATTGGG
  201   CAAGGCATTG CCGTCTGATG CCTATTTAAG GACGGAGCAC GTGGTCTGGC
  251   AGCCTGAAAT GCTCGGTCTG GCAAGAATGG CTGCTGCGGT CAAGCTGTCA
  301   GGTTTGAAAT ATCAGGCAAA CCCTGCCGTG TTTAAAGCAG TTTACGAACA
  351   AAAAATCCGC TTGGAAAACA GGTCGGTTGC CGAAAAATGG GCTTTGTCTC
  401   AAAAAGGCTT TGACGGCAAA AAACTGATGC GCGCCTACGA CTCTCCTGCG
  451   GCAGCGGCTG CTGCATCAAA AATGCAGCAA TTGACGGAAC AGTACCGCAT
  501   CGACAGTACG CCGACCGTTG TCGTCGGCGG AAAATACCGC GTTATCTTCA
  551   ATAATGGCTT TGACGGCGGT GTTCATACGA TTAAAGAATT GGTTGCCAAA
  601   GTCAGGGAAG AACGCAAGCG TCAGACCCCT GCTGTACAGA AATAG
```

This corresponds to the amino acid sequence <SEQ ID 2632; ORF 767.a>:

```
a767.pep
    1   MKLKHLLPLL LSAVLSAQAY ALTEGEDYLV LDKPIPQKQS GKIEVLEFFG

51   YFCVHCHHFD PLLLKLGKAL PSDAYLRTEH VVWQPEMLGL ARMAAAVKLS

101   GLKYQANPAV FKAVYEQKIR LENRSVAEKW ALSQKGFDGK KLMRAYDSPA

151   AAAAASKMQQ LTEQYRIDST PTVVVGGKYR VIFNNGFDGG VHTIKELVAK

201   VREERKRQTP AVQK*
```

Computer analysis of this amino acid sequence gave the following results:
Homology with a Predicted ORF from *N. meningitidis*
ORF 767 shows 96.7% identity over a 214 aa overlap with a predicted ORF (ORF 767) from *N. meningitidis*:
m767/a767 96.7% identity in 214 aa overlap

```
                    10         20         30         40         50         60
      a767.pep  MKLKHLLPLLLSAVLSAQAYALTEGEDYLVLDKPIPQKQSGKIEVLEFFGYFCVHCHHFD
                ||||||||||||||||||||||||||||||||||||:|||||||||||||||||||||||
      m777      MKLKHLLPLLLSAVLSAQAYALTEGEDYLVLDKPIPQESGKIEVLEFFGYFCVHCHHFD
                    10         20         30         40         50         60

70         80         90        100        110        120
      a767.pep  PLLLKLGKALPSDAYLRTEHVVWQPEMLGLARMAAAVKLSGLKYQANPAVFKAVYEQKIR
                |||||||||||||||||||||||||||||||||||:||||||||||||||||||||||||
      m767      PLLLKLGKALPSDAYLRTEHVVWQPEMLGLARMAAAVNLSGLKYQANPAVFKAVYEQKIR
                    70         80         90        100        110        120

130        140        150        160        170        180
      a767.pep  LENRSVAEKWALSQKGFDGKKLMRAYDSPAAAAAASKMQQLTEQYRIDSTPTVVVGGKYR
                |||||| ||||||||||||||||||||||| ||||| |||:||||||||||||:||||||
      m767      LENRSVAGKWALSQKGFDGKKLMRAYDSPEAAAAALKMQKLTEQYRIDSTPTVIVGGKYR
                   130        140        150        160        170        180

190        200        210
      a767.pep  VIFNNGFDGGVHTIKELVAKVREERKRQTPAVQKX
                |||||||||||||||||||||||||||||||||||
      m767      VIFNNGFDGGVHTIKELVAKVREERKRQTPAVQKX
                   190        200        210
```

The following partial DNA sequence was identified in *N. gonorrhoeae* <SEQ ID 2633>:

```
g768.seq
    1   ATGAATATCA AACAATTGAT TACCGCCGCA CTCATTGCCT CAGCCGCCTT

51   TGCCACGCAG GCAGCCCCGC AAAAACCCGT ATCCGCCGCC CAAACCGCGC

101   AACATTCAGC CGTTTGGATC GATGTCCGTT CCGAACAGGA ATTTAGCGAA

151   GGTCATTTGC ACAACGCGGT CAACATCCCC GTCGACCAAA TCGTCCGCCG

201   CATATACGAA GCCGCGCCCG ACAAAGACAC GCCGGTCAAC CTCTACTGCC

251   GCAGCGGACG GCGTGCCGAA GCCGCCCTTC AAGAGCTGAA AAAAGCAGGT

301   TATACAAATG TTGCCAATCA CGGCGGTTAT GAAGACCTGC TCAAAAAGG

351   GATGAAATGA
```

This corresponds to the amino acid sequence <SEQ ID 2634; ORF 768.ng>:

```
g768.pep
    1   MNIKQLITAA LIASAAFATQ AAPQKPVSAA QTAQHSAVWI DVRSEQEFSE

51   GHLHNAVNIP VDQIVRRIYE AAPDKDTPVN LYCRSGRRAE AALQELKKAG

101   YTNVANHGGY EDLLKKGMK*
```

The following partial DNA sequence was identified in *N. meningitidis* <SEQ ID 2635>:

```
m768.seq
    1   ATGAATATCA AACACCTGAT TACCGCCGCA CTCATTGCCT CAGCCGCCTT

51   TGCCGCGCAG GCAGCCCCGC AAAAACCCGT ATCCGCCGCC CAAACCGCGC

101   AACATCCGGC CGTTTGGATC GATGTCCGTT CCGAACAGGA ATTTAGCGAA

151   GGGCATTTGC ACAACGCGGT CAACATCCCC GTCGACCAAA TCGTCCGCCG

201   CATACACGAA GCCGCGCCCG ACAAAGACAC GCCGGTCAAC CTCTACTGCC

251   GCAGCGGACG GCGTGCCGAA GCCGCCCTTC AAGAGCTGAA AAAAGCAGGT

301   TATACAAATG TTGCCAATCA CGGCGGTTAT GAAGACCTGC TCAAAAAGG

351   GATGAAATGA
```

This corresponds to the amino acid sequence <SEQ ID 2636; ORF 768>:

```
m768.pep
    1   MNIKHLITAA LIASAAFAAQ AAPQKPVSAA QTAQHPAVWI DVRSEQEFSE

51   GHLHNAVNIP VDQIVRRIHE AAPDKDTPVN LYCRSGRRAE AALQELKKAG

101   YTNVANHGGY EDLLKKGMK*
```

Computer analysis of this amino acid sequence gave the following results:
Homology with a Predicted ORF from *N. gonorrhoeae*
ORF 768 shows 96.6% identity over a 119 aa overlap with a predicted ORF (ORF 768) from *N. gonorrhoeae*
m768/g768 96.6% identity in 119 aa overlap

```
                    10         20         30         40         50         60
   g768.pep  MNIKQLITAALIASAAFATQAAPQKPVSAAQTAQHSAVWIDVRSEQEFSEGHLHNAVNIP
             ||||:||||||||||||||:||||||||||||||||| |||||||||||||||||||||
       m768  MNIKHLITAALIASAAFAAQAAPQKPVSAAQTAQHPAVWIDVRSEQEFSEGHLHNAVNIP
                    10         20         30         40         50         60
```

```
             70        80        90       100       110       120
g768.pep  VDQIVRRIYEAAPDKDTPVNLYCRSGRRAEAALQELKKAGYTNVANHGGYEDLLKKGMKX
          ||||||||:|||||||||||||||||||||||||||||||||||||||||||||||||||
m768      VDQIVRRIHEAAPDKDTPVNLYCRSGRRAEAALQELKKAGYTNVANHGGYEDLLKKGMKX
             70        80        90       100       110       120
```

The following partial DNA sequence was identified in *N. meningitidis* <SEQ ID 2637>:

```
a768.seq
    1   ATGAATATCA AACACCTGAT TACCGCCGCA CTCATTGCCT CAGCCGCCTT

51   TGCCGCGCAG GCAGCCCCGC AAAAACCCGT ATCCGCCGCC CAAACCGCGC

101   AACATTCAGC CGTTTGGATC GATGTCCGCA GCGAACAGGA ATTTAGCGAA

151   GGTCATTTGC ACAACGCGGT CAACATCCCC GTCGACCAAA TCGTCCGCCG

201   CATACACGAA GCCGCGCCCG ACAAAGACAC GCCGGTCAAC CTCTACTGCC

251   GCAGCGGACG GCGTGCCGAA GCCGCCCTTC AAGAACTGAA AAAAGCAGGC

301   TATACGAATG TTGCCAATCA CGGCGGTTAT GAAGACCTGC TCAAAAAAGG

351   GATGAAATGA
```

This corresponds to the amino acid sequence <SEQ ID 2638; ORF 768.a>:

```
a768.pep
    1   MNIKHLITAA LIASAAFAAQ AAPQKPVSAA QTAQHSAVWI DVRSEQEFSE

51   GHLHNAVNIP VDQIVRRIHE AAPDKDTPVN LYCRSGRRAE AALQELKKAG

101   YTNVANHGGY EDLLKKGMK*
```

Computer analysis of this amino acid sequence gave the following results:
Homology with a Predicted ORF from *N. meningitidis*
ORF 768 shows 99.2% identity over a 119 aa overlap with a predicted ORF (ORF 768) from *N. meningitidis*:
m768/a768 99.2% identity in 119 aa overlap

```
             10        20        30        40        50        60
a768.pep  MNIKHLITAALIASAAFAAQAAPQKPVSAAQTAQHSAVWIDVRSEQEFSEGHLHNAVNIP
          |||||||||||||||||||||||||||||||||||| ||||||||||||||||||||||
m768      MNIKHLITAALIASAAFAAQAAPQKPVSAAQTAQHPAVWIDVRSEQEFSEGHLHNAVNIP
             10        20        30        40        50        60

70        80        90       100       110       120
a768.pep  VDQIVRRIHEAAPDKDTPVNLYCRSGRRAEAALQELKKAGYTNVANHGGYEDLLKKGMKX
          ||||||||||||||||||||||||||||||||||||||||||||||||||||||||||||
m768      VDQIVRRIHEAAPDKDTPVNLYCRSGRRAEAALQELKKAGYTNVANHGGYEDLLKKGMKX
             70        80        90       100       110       120
```

The following partial DNA sequence was identified in *N. gonorrhoeae* <SEQ ID 2639>:

```
g769.seq
    1   TTGATAATGG TTATTTTTTA TTTTTATTTT TGTGGGAAGA CATTTATGCC

51   TGCACGAAAC AGATGGATGC TGCTGCCTTT ATTGGCAAGC GCGGCATACG

101   CCGAAgaAAC ACCgtgCGAA CCGGATTTGA GAAGCCGTCC CGAGTTCAGG

151   CTTCATGAAG CGGAGGTCAA ACCGATCGAC AGGGAGAAGG TACCGGGGCA
```

-continued

```
 201 GGTGCGGGAA AAAGGAAAAG TTTTGCAGGT TGACGgcGAA ACCCTGCTGA

251 AAAATCCCGA ATTGTTGTCG CGTGCCATGT ATTCCGCAGT GGTCTCAAAC

301 AATATTGCCG GTATCCGCGT GATTTTGCCG ATTTACCTAC AACAGGCGCG

351 GCAGGATAAG ATGTTGGCAC TTTATGCACA AGGGATTTTG GCGCAGGCAG

401 AGGGCAGGGT GAAGGAGGCG GTTTCCCATT ACCGGGAATT GATTGCCGCC

451 CAACCCGACG CGCCCGCCGT CCGTATGCGT TTGGCGGCGG CATTGTTTGA

501 AGACAGGCAG AACGAGGCGG CGGCAGACCA GTTCGACCGC CTGAAAACAG

551 AAGATCTGCC GCCGCAGCTT ATGGAGCAGG TCGAGCTGTA CCGCAAGGCA

601 TTGCGCGAAC GCGATGCGTG GAAGGTAAAC GGCGGTTTCA GCGTTACCCG

651 CGAACACAAT ATCAACCAAG CCCCGAAACA GCAGCAGTAC GGCAATTGGA

701 CTTTCCCGAA ACAGGTGGAC GGCACGGCAG TCAATTACCG GTTCGGCGCG

751 GAGAAAAAAT GGTCGCTGAA AAACGGCTGG TACACGACGG CGGGCGGCGA

801 CGTGTCCGGC AGGGTTTATC CGGGGAATAA GAAATTCAAC GATATGACGG

851 CAGGTGTTTC CGGCGGCATC GGTTTTGCCG ACCGGCGTAA AGATGTCGGG

901 CTGGCAGTGT TCCACGAACG CCGCACCTAC GGCAACGACG CTTATTCTTA

951 CGCCAACGGC GCACGCCTTT ATTTCAACCG TTGGCAAACC CCGAGATGGC

1001 AAACGCTGTC TTCGGCGGAG TGGGGGCGTT TGAAGAATAC GCGCCGGGCG

1051 CGTTCCGACA ATACCCATTT GCAAATTTCC AATTCGCTGG TGTTTTACCG

1101 GAATGCGCGC CAATATTGGA CGGGCGGTTT GGATTTTTAC CGCGAGCGCA

1151 ACCCCGCCGA CCGTGGCGAC AATTTCAACC GTTACGGCCT GCGCTTTGCC

1201 TGGGGGCAGG AATGGGGCGG CAGCGGCCTG TCTTCGCTGT TCCGCCTCGG

1251 CGTGGCGAAA CGGCATTATG AAAAACCCGG CTTCTTCAGC AGTTTTAAAG

1301 GGGAAAGGCG CAGGGATAAA GAATCGGACA CATCCTTGAG CCTTTGGCAC

1351 CGGGCATTGC ATTTCAAAGG CATCACGCCG CGCCTGACGC TGTCGCACCG

1401 CGAAACGTGG AGCAACGATG TGTTTAACGA ATACGAGAAA AACAGGGCGT

1451 TTGTCGAGTT TAACAAAACG TTCTGA
```

This corresponds to the amino acid sequence <SEQ ID 2640; ORF 769.ng>:

```
g769.pep
   1 LIMVIFYFYF CGKTFMPARN RWMLLPLLAS AAYAEETPCE PDLRSRPEFR

51 LHEAEVKPID REKVPGQVRE KGKVLQVDGE TLLKNPELLS RAMYSAVVSN

101 NIAGIRVILP IYLQQARQDK MLALYAQGIL AQAEGRVKEA VSHYRELIAA

151 QPDAPAVRMR LAAALFEDRQ NEAAADQFDR LKTEDLPPQL MEQVELYRKA

201 LRERDAWKVN GGFSVTREHN INQAPKQQQY GNWTFPKQVD GTAVNYRFGA

251 EKKWSLKNGW YTTAGGDVSG RVYPGNKKFN DMTAGVSGGI GFADRRKDVG

301 LAVFHERRTY GNDAYSYANG ARLYFNRWQT PRWQTLSSAE WGRLKNTRRA

351 RSDNTHLQIS NSLVFYRNAR QYWTGGLDFY RERNPADRGD NFNRYGLRFA

401 WGQEWGGSGL SSLFRLGVAK RHYEKPGFFS SFKGERRRDK ESDTSLSLWH

451 RALHFKGITP RLTLSHRETW SNDVFNEYEK NRAFVEFNKT F*
```

The following partial DNA sequence was identified in *N. meningitidis* <SEQ ID 2641>:

```
m769.seq
     1  TTGATAATGG TTATTTTTTA TTTTTGTGGG AAGACATTTA TGCCTGCACG
    51  AAACAGATGG ATGCTGCTGC TGCCTTTATT GGCAAGCGCG GCATATGCCG
   101  AAGAAACACC GCGCGAACCG GATTTGAGAA GCCGTCCCGA GTTCAGGCTT
   151  CATGAAGCGG AGGTCAAACC GATCGACAGG GAGAAGGTGC CGGGGCAGGT
   201  GCGGGAAAAA GGAAAAGTTT TGCAGATTGA CGGCGAAACC CTGCTGAAAA
   251  ATCCCGAATT GTTGTCCCGC GCGATGTATT CCGCAGTGGT CTCAAACAAT
   301  ATTGCCGGTA TCCGCGTTAT TTTGCCGATT TACCTACAAC AGGCGCAGCA
   351  GGATAAGATG TTGGCACTTT ATGCACAAGG GATTTTGGCG CAGGCAGACG
   401  GTAGGGTGAA GGAGGCGATT TCCCATTACC GGGAATTGAT TGCCGCCCAA
   451  CCCGACGCGC CCGCCGTCCG TATGCGTTTG GCGGCAGCAT TGTTTGAAAA
   501  CAGGCAGAAC GAGGCGGCGG CAGACCAGTT CGACCGCCTG AAGGCGGAAA
   551  ACCTGCCGCC GCAGCTGATG GAGCAGGTCG AGCTGTACCG CAAGGCATTG
   601  CGCGAACGCG ATGCGTGGAA GGTAAATGGC GGCTTCAGCG TCACCCGCGA
   651  ACACAATATC AACCAAGCCC CGAAACGGCA GCAGTACGGC AAATGGACTT
   701  TCCCGAAACA GGTGGACGGC ACGGCGGTCA ATTACCGGCT CGGCGCGGAG
   751  AAAAAATGGT CGCTGAAAAA CGGCTGGTAC ACGACGGCGG GCGGCGACGT
   801  GTCCGGCAGG GTTTATCCGG GGAATAAGAA ATTCAACGAT ATGACGGCAG
   851  GCGTTTCCGG CGGCATCGGT TTTGCCGACC GGCGCAAAGA TGCCGGGCTG
   901  GCAGTGTTCC ACGAACGCCG CACCTACGGC AACGACGCTT ATTCTTACAC
   951  CAACGGCGCA CGCCTTTATT TCAACCGTTG GCAAACCCCG AAATGGCAAA
  1001  CGTTGTCTTC GGCGGAGTGG GGGCGTTTGA AGAATACGCG CCGGGCGCGT
  1051  TCCGACAATA CCCATTTGCA AATTTCCAAT TCGCTGGTGT TTTACCGGAA
  1101  TGCGCGCCAA TATTGGATGG GCGGTTTGGA TTTTTACCGC GAGCGCAACC
  1151  CCGCCGACCG GGGCGACAAT TTCAACCGTT ACGGCCTGCG CTTTGCCTGG
  1201  GGGCAGGAAT GGGGCGGCAG CGGCCTGTCT TCGCTGTTGC GCCTCGGCGC
  1251  GGCGAAACGG CATTATGAAA AACCCGGCTT TTTCAGCGGT TTTAAAGGGG
  1301  AAAGGCGCAG GGATAAAGAA TTGAACACAT CCTTGAGCCT TTGGCACCGG
  1351  GCATTGCATT TCAAAGGCAT CACGCCGCGC CTGACGTTGT CGCACCGCGA
  1401  AACGCGGAGT AACGATGTGT TCAACGAATA CGAGAAAAAT CGGGCGTTTG
  1451  TCGAGTTTAA TAAAACGTTC TGA
```

This corresponds to the amino acid sequence <SEQ ID 2642; ORF 769>:

```
m769.pep
     1  LIMVIFYFCG KTFMPARNRW MLLLPLLASA AYAEETPREP DLRSRPEFRL
    51  HEAEVKPIDR EKVPGQVREK GKVLQIDGET LLKNPELLSR AMYSAVVSNN
   101  IAGIRVILPI YLQQAQQDKM LALYAQGILA QADGRVKEAI SHYRELIAAQ
   151  PDAPAVRMRL AAALFENRQN EAAADQFDRL KAENLPPQLM EQVELYRKAL
   201  RERDAWKVNG GFSVTREHNI NQAPKRQQYG KWTFPKQVDG TAVNYRLGAE
```

```
251  KKWSLKNGWY TTAGGDVSGR VYPGNKKFND MTAGVSGGIG FADRRKDAGL

301  AVFHERRTYG NDAYSYTNGA RLYFNRWQTP KWQTLSSAEW GRLKNTRRAR

351  SDNTHLQISN SLVFYRNARQ YWMGGLDFYR ERNPADRGDN FNRYGLRFAW

401  GQEWGGSGLS SLLRLGAAKR HYEKPGFFSG FKGERRRDKE LNTSLSLWHR

451  ALHFKGITPR LTLSHRETRS NDVFNEYEKN RAFVEFNKTF *
```

Computer analysis of this amino acid sequence gave the following results:
Homology with a Predicted ORF from *N. gonorrhoeae*
ORF 769 shows 95.1% identity over a 492 aa overlap with a predicted ORF (ORF 769) from *N. gonorrhoeae*
m769/g769 95.1% identity in 492 aa overlap

```
                  10        20        30        40        50        59
g769.pep  LIMVIFYFYFCGKTFMPARNRWMLL-PLLASAAYAEETPCEPDLRSRPEFRLHEAEVKPI
          |||||||   |||||||||||||||  |||||||||||||||||||||||||||||||||
m769      LIMVIFY--FCGKTFMPARNRWMLLLPLLASAAYAEETPCEPDLRSRPEFRLHEAEVKPI
                    10        20        30        40        50

60        70        80        90       100       110      119
g769.pep  DREKVPGQVREKGKVLQVDGETLLKNPELLSRAMYSAVVSNNIAGIRVILPIYLQQARQD
          |||||||||||||||||:||||||||||||||||||||||||||||||||||||||||||
m769      DREKVPGQVREKGKVLQIDGETLLKNPELLSRAMYSAVVSNNIAGIRVILPIYLQQARQD
                    60        70        80        90       100       110

120       130       140       150       160       170      179
g769.pep  KMLALYAQGILAQAEGRVKEAVSHYRELIAAQPDAPAVRMRLAAALFEDRQNEAAADQFD
          ||||||||||||||:||||||:||||||||||||||||||||||||:|||||||||||||
m769      KMLALYAQGILAQADGRVKEAISHYRELIAAQPDAPAVRMRLAAALFENRQNEAAADQFD
                   120       130       140       150       160       170

180       190       200       210       220       230      239
g769.pep  RLKTEDLPPQLMEQVELYRKALRERDAWKVNGGFSVTREHNINQAPKQQQYGNWTFPKQV
          |||:|:|||||||||||||||||||||||||||||||||||||||||:||||:|||||||
m769      RLKAENLPPQLMEQVELYRKALRERDAWKVNGGFSVTREHNINQAPKRQQYGKWTFPKQV
                   180       190       200       210       220       230

240       250       260       270       280       290      299
g769.pep  DGTAVNYRFGAEKKWSLKNGWYTTAGGDVSGRVYPGNKKFNDMTAGVSGGIGFADRRKDV
          ||||||||:||||||||||||||||||||||||||||||||||||||||||||||||||:
m769      RLKAENLPLQLMEQVELYRKALRERDAWKVNGGFSVTREHNINQAPKRQQYGKWTFPKQA
                   240       250       260       270       280       290

300       310       320       330       340       350      359
g769.pep  GLAVFHERRTYGNDAYSYANGARLYFNRWQTPRWQTLSSAEWGRLKNTRRARSDNTHLQI
          ||||||||||||||||||:||||||||||||||:|||||||||||||||||||||||||
m769      GLAVFHERRTYGNDAYSYTNGARLYFNRWQTPKWQTLSSAEWGRLKNTRRARSDNTHLQI
                   300       310       320       330       340       350

360       370       380       390       400       410      419
g769.pep  SNSLVFYRNARQYWTGGLDPYRERNPADRGDNFRYGLRFAWGQEWGGSGLSSLFRLGVA
          |||||||||||||||:||||||||||||||||||||||||||||||||||||||:|||:
m769      SNSLVFYRNARQYWMGGLDFYRERNPADRGDNFNRYGLRFAWGQEWGGSGLSSLLRLGAA
                   360       370       380       390       400       410

420       430       440       450       460       470      479
g769.pep  KRHYEKPGFFSSFKGERRRDKESDTSLSLWHRALHFKGITPRLTLSHRETWSNDVFNEYE
          |||||||||||:||||||||||:|||||||||||||||||||||||||||||| ||||||
m769      KRHYEKPGFFSGFKGERRRDKELNTSLSLWHRALHFKGITPRLTLSHRETRSNDVFNEYE
                   420       430       440       450       460       470

480       490
g769.pep  KNRAFVEFNKTFX
          |||||||||||||
m769      KNRAFVEFNKTFX
                   490
```

The following partial DNA sequence was identified in *N. meningitidis* <SEQ ID 2643>:

```
a769.seq
    1    TTGATAATGG TTATTTTTTA TTTTTGTGGG AAGACATTTA TGCCTGCACG

51    AAACAGATGG ATGCTGCTGC TGCCTTTATT GGCAAGCGCG GCATATGCCG

101    AAGAAACACC GCGCGAACCG GATTTGAGAA GCCGTCCCGA GTTCAGGCTT

151    CATGAAGCGG AGGTCAAACC AATCGACAGG GAGAAGGTAC CGGGGCAGGT
```

-continued

```
 201 GCGGGAAAAA GGAAAAGTTT TGCAGATTGA CGGCGAAACC CTGCTGAAAA

251 ATCCCGAATT GCTGTCCCGC GCGATGTATT CCGCAGTGGT CTCAAACAAT

301 ATTGCCGGTA TCCGCGTTAT TTTGCCGATT TACCTACAAC AGGCGCAGCA

351 GGATAAGATG TTGGCACTTT ATGCACAAGG GATTTTGGCG CAGGCAGACG

401 GTAGGGTGAA GGAGGCGATT TCCCATTACC GGGAATTGAT TGTCGCCCAA

451 CCCGACGCGC CGCCGTCCG TATGCGTTTG GCGGCGGCAT TGTTTGAAAA

501 CAGGCAGAAC GAGGCGGCGG CAGACCAGTT CGACCGCCTG AAGGCGGAAA

551 ACCTGCCGCC GCAGCTGATG GAGCAGGTCG AGCTGTACCG CAAGGCATTG

601 CGCGAACGCG ATGCGTGGAA GGTAAATGGC GGCTTCAGCG TTACCCGCGA

651 ACACAATATC AACCAAGCCC CGAAACGGCA GCAGTACGGC AAATGGACTT

701 TCCCGAAACA GGTGGACGGC ACGGCGGTCA ATTACCGGCT CGGCGCGGAG

751 AAAAAATGGT CGCTGAAAAA CGGCTGGTAC ACGACGGCGG GCGGCGACGT

801 GTCCGGCAGG GTTTATCCGG GGAATAAGAA ATTCAACGAT ATGACGGCAG

851 GCGTTTCCGG CGGCATCGGT TTTGCCGACC GGCGCAAAGA TGCCGGGCTG

901 GCAGTGTTCC ACGAACGCCG CACCTACGGC AACGACGCTT ATTCTTACAC

951 CAACGGCGCA CGCCTTTATT CAACCGTTG GCAAACCCCG AAATGGCAAA

1001 CGTTGTCTTC GGCGGAGTGG GGGCGTTTGA AGAATACGCG CCGGGCGCGT

1051 TCCGACAATA CCCATTTGCA AATTTCCAAT CGCTGGTGT TTTACCGGAA

1101 TGCGCGCCAA TATTGGATGG GCGGTTTGGA TTTTTACCGC GAGCGCAACC

1151 CCGCCGACCG GGGCGACAAT TTCAACCGTT ACGGCCTGCG CTTTGCCTGG

1201 GGGCAGGAAT GGGGCGGCAG CGGCCTGTCT TCGCTGTTGC GCCTCGGCGC

1251 GGCGAAACGG CATTATGAAA AACCCGGCTT TTTCAGCGGT TTTAAAGGGG

1301 AAAGGCGCAG GGATAAAGAA TTGAACACAT CCTTGAGCCT TTGGCACCGG

1351 GCATTGCATT TCAAAGGCAT CACGCCGCGC CTGACGTTGT CGCACCGCGA

1401 AACGCGGAGT AACGATGTGT TCAACGAATA CGAGAAAAAT CGGGCGTTTG

1451 TCGAGTTTAA TAAAACGTTC TGA
```

This corresponds to the amino acid sequence <SEQ ID 2644; ORF 769.a>:

```
a769.pep
   1 LIMVIFYFCG KTFMPARNRW MLLLPLLASA AYAEETPREP DLRSRPEFRL

51 HEAEVKPIDR EKVPGQVREK GKVLQIDGET LLKNPELLSR AMYSAVVSNN

101 IAGIRVILPI YLQQAQQDKM LALYAQGILA QADGRVKEAI SHYRELIVAQ

151 PDAPAVRMRL AAALFENRQN EAAADQFDRL KAENLPPQLM EQVELYRKAL

201 RERDAWKVNG GFSVTREHNI NQAPKRQQYG KWTFPKQVDG TAVNYRLGAE

251 KKWSLKNGWY TTAGGDVSGR VYPGNKKFND MTAGVSGGIG FADRRKDAGL

301 AVFHERRTYG NDAYSYTNGA RLYFNRWQTP KWQTLSSAEW GRLKNTRRAR

351 SDNTHLQISN SLVFYRNARQ YWMGGLDFYR ERNPADRGDN FNRYGLRFAW

401 GQEWGGSGLS SLLRLGAAKR HYEKPGFFSG FKGERRRDKE LNTSLSLWHR

451 ALHFKGITPR LTLSHRETRS NDVFNEYEKN RAFVEFNKTF *
```

Computer analysis of this amino acid sequence gave the following results:

Homology with a Predicted ORF from *N. meningitidis*
ORF 769 shows 99.8% identity over a 490 aa overlap with a predicted ORF (ORF 769) from *N. meningitidis*:
m769/a769 99.8% identity in 490 aa overlap

```
                10         20         30         40         50         60
a769.pep  LIMVIFYFCGKTFMPARNRWMLLLPLLASAAYAEETPREPDLRSRPEFRLHEAEVKPIDR
          ||||||||||||||||||||||||||||||||||||||||||||||||||||||||||||
m769      LIMVIFYFCGKTFMPARNRWMLLLPLLASAAYAEETPREPDLRSRPEFRLHEAEVKPIDR
                10         20         30         40         50         60

70         80         90        100        110        120
a769.pep  EKVPGQVREKGKVLQIDGETLLKNPELLSRAMYSAVVSNNIAGIRVILPIYLQQAQQDKM
          ||||||||||||||||||||||||||||||||||||||||||||||||||||||||||||
m769      EKVPGQVREKGKVLQIDGETLLKNPELLSRAMYSAVVSNNIAGIRVILPIYLQQAQQDKM
                70         80         90        100        110        120

130        140        150        160        170        180
a769.pep  LALYAQGILAQADGRVKEAISHYRELIVAQPDAPAVRMRLAAALFENRQNEAAADQFDRL
          |||||||||||||||||||||||||||||:||||||||||||||||||||||||||||||
m769      LALYAQGILAQADGRVKEAISHYRELIAAQPDAPAVRMRLAAALFENRQNEAAADQFDRL
               130        140        150        160        170        180

190        200        210        220        230        240
a769.pep  KAENLPPQLMEQVELYRKALRERDAWKVNGGFSVTREHNINQAPKRQQYGKWTFPKQVDG
          ||||||||||||||||||||||||||||||||||||||||||||||||||||||||||||
m769      KAENLPPQLMEQVELYRKALRERDAWKVNGGFSVTREHNINQAPKRQQYGKWTFPKQVDG
               190        200        210        220        230        240

250        260        270        280        290        300
a769.pep  TAVNYRLGAEKKWSLKNGWYTTAGGDVSGRVYPGNKKFNDMTAGVSGGIGFADRRKDAGL
          ||||||||||||||||||||||||||||||||||||||||||||||||||||||||||||
m769      TAVNYRLGAEKKWSLKNGWYTTAGGDVSGRVYPGNKKFNDMTAGVSGGIGFADRRKDAGL
               250        260        270        280        290        300

310        320        330        340        350        360
a769.pep  AVFHERRTYGNDAYSYTNGARLYFNRWQTPKWQTLSSAEWGRLKNTRRARSDNTHLQISN
          ||||||||||||||||||||||||||||||||||||||||||||||||||||||||||||
m769      AVFHERRTYGNDAYSYTNGARLYFNRWQTPKWQTLSSAEWGRLKNTRRARSDNTHLQISN
               310        320        330        340        350        360

370        380        390        400        410        420
a769.pep  SLVFYRNARQYWMGGLDFYRERNPADRGDNFNRYGLRFAWGQEWGGSGLSSLLRLGAAKR
          ||||||||||||||||||||||||||||||||||||||||||||||||||||||||||||
m769      SLVFYRNARQYWMGGLDFYRERNPADRGDNFNRYGLRFAWGQEWGGSGLSSLLRLGAAKR
               370        380        390        400        410        420

430        440        450        460        470        480
a769.pep  HYEKPGFFSGFKGERRRDKELNTSLSLWHRALHFKGITPRLTLSHRETRSNDVFNEYEKN
          ||||||||||||||||||||||||||||||||||||||||||||||||||||||||||||
m769      HYEKPGFFSGFKGERRRDKELNTSLSLWHRALHFKGITPRLTLSHRETRSNDVFNEYEKN
               430        440        450        460        470        480

490
a769.pep  RAFVEFNKTFX
          |||||||||||
m769      RAFVEFNKTFX
               490
```

The following partial DNA sequence was identified in *N. gonorrhoeae* <SEQ ID 2645>:

```
g770.seq
    1    ATGAACAGAC TGCTACTGCT GTCTGCCGCC GTCCTGCCGA CTGCCTGCGG

51    CAGCGGCGAA ACCGATAAAA TCGGACGGGC AAGTACCGTT TTCAACATGT

101    TGGGCAAAAA CGACCGTATC GAAGTGGAAG GATTCGACGA TCCCGACGTT

151    CAAGGGGTTG CCTGTTATAT TTCGTATGCA AAAAAAGGCG GCTTGAAGGA

201    AATGGTCAAT TTGGAAGAGG ACGCGTCCGA CGCATCGGTT TCGTGCGTTC

251    AGACGGCATC TTCGATTTCT TTTGACGAAA CCGCCGTGCG CAAACCGAAA

301    GAAGTTTTCA AGCGCGGTAC GGGCTTCGCG TTCAAGAGCC GGCAGATTGT

351    CCGTTATTAC GACCCCAAAC GCAAAGCCTT CGCCTATTTG GTTTACAGCG

401    ATAAAATCGT CCAAGGATCG CCGAAAAATT CCTTAAGCGC GGTTTCCTGT

451    TTCGGCAGCG GCATACCGCA AACCGACGGG GTGCAAGCCG ATACTTCCGG
```

-continued

```
501  CAAACTGCTT GCCGGCGCCT GCATTATTTC CAACCCGATA AAAAATCCCG
551  ACAAACGCTG A
```

This corresponds to the amino acid sequence <SEQ ID 2646; ORF 770.ng>:

```
g770.pep
  1  MNRLLLLSAA VLPTACGSGE TDKIGRASTV FNMLGKNDRI EVEGFDDPDV
 51  QGVACYISYA KKGGLKEMVN LEEDASDASV SCVQTASSIS FDETAVRKPK
101  EVFKRGTGFA FKSRQIVRYY DPKRKAFAYL VYSDKIVQGS PKNSLSAVSC
151  FGSGIPQTDG VQADTSGKLL AGACIISNPI KNPDKR*
```

The following partial DNA sequence was identified in *N. meningitidis* <SEQ ID 2647>:

```
m770.seq
  1  ATGAACAGAC TGCTACTGCT GTCTGCCGCC GTCCTGCTGA CTGCCTGCGG
 51  CAGCGGCGAA ACCGATAAAA TCGGACGGGC AAGTACCGTT TTCAACATAC
101  TGGGCAAAAA CGACCGTATC GAAGTGGAAG GATTCGACGA TCCCGACGTT
151  CAAGGGGTTG CCTGTTATAT TTCGTATGCA AAAAAAGGCG GCTTGAAGGA
201  AATGGTCAAT TTGGAAGAGG ACGCGTCCGA CGCATCGGTT TCGTGCGTTC
251  AGACGGCATC TTCGATTTCT TTTGACGAAA CCGCCGTGCG CAAACCGAAA
301  GAAGTTTTCA AACACGGTGC GAGCTTCGCG TTCAAGAGCC GGCAGATTGT
351  CCGTTATTAC GACCCCAAAC GCAAAACCTT CGCCTATTTG GTGTACAGCG
401  ATAAAATCAT CCAAGGCTCG CCGAAAAATT CCTTAAGCGC GGTTTCCTGT
451  TTCGGCGGCG GCATACCGCA AACCGATGGG GTGCAAGCCG ATACTTCCGG
501  CAACCTGCTT GCCGGCGCCT GCATGATTTC CAACCCGATA GAAAATCTCG
551  ACAAACGCTG A
```

This corresponds to the amino acid sequence <SEQ ID 2648; ORF 770>:

```
m770.pep
  1  MNRLLLLSAA VLLTACGSGE TDKIGRASTV FNILGKNDRI EVEGFDDPDV
 51  QGVACYISYA KKGGLKEMVN LEEDASDASV SCVQTASSIS FDETAVRKPK
101  EVFKHGASFA FKSRQIVRYY DPKRKTFAYL VYSDKIIQGS PKNSLSAVSC
151  FGGGIPQTDG VQADTSGNLL AGACMISNPI ENLDKR*
```

Computer analysis of this amino acid sequence gave the following results:
Homology with a Predicted ORF from *N. gonorrhoeae*
ORF 770 shows 93.5% identity over a 186 aa overlap with a predicted ORF (ORF 770) from *N. gonorrhoeae*
m770/g770 93.5% identity in 186 aa overlap

```
                   10         20         30         40         50         60
    g770.pep  MNRLLLLSAAVLPTACGSGETDKIGRASTVFNMLGKNDRIEVEGFDDPDVQGVACYISYA
              ||||||||||  |||||||||||||||||||| :||||||||||||||||||||||||||
       m770   MNRLLLLSAAVLLTACGSGETDKIGRASTVFNILGKNDRIEVEGFDDPDVQGVACYISYA
                   10         20         30         40         50         60
```

-continued

```
                    70         80         90        100        110        120
g770.pep    KKGGLKEMVNLEEDASDASVSCVQTASSISFDETAVRKPKEVFKRGTGFAFKSRQIVRYY
            ||||||||||||||||||||||||||||||||||||||||:|::|||||||||||||
m770        KKGGLKEMVNLEEDASDASVSCVQTASSISFDETAVRKPKEVFKHGASFAFKSRQIVRYY
                    70         80         90        100        110        120

130        140        150        160        170        180
g770.pep    DPKRKAFAYLVYSDKIVQGSPKNSLSAVSCFGSGIPQTDGVQADTSGKLLAGACIISNPI
            |||||:||||||||||:||||||||||||||:|||||||||||||||:||||||:||||
m770        DPKRKTFAYLVYSDKIIQGSPKNSLSAVSCFGGGIPQTDGVQADTSGNLLAGACMISNPI
                   130        140        150        160        170        180 g770.pep    KNPDKRX
            :|  ||||
m770        ENLDKRX
```

The following partial DNA sequence was identified in *N. meningitidis* <SEQ ID 2649>:

```
a770.seq
   1   ATGAACAGAC TGCTACTGCT GTCTGCCGCC GTCCTGCTGA CTGCCTGCGG

51   CAGCGGCGAA ACCGATAAAA TCGGACGGGC AAGTACCGTT TTCAACATAC

101   TGGGCAAAAA CGACCGTATC GAAGTGGAAG GATTCGACGA TCCCGACGTT

151   CAAGGGGTTG CCTGTTATAT TTCGTATGCA AAAAAAGGCG GCTTGAAGGA

201   AATGGTCAAT TTGGAAGAGG ACGCGTCCGA CGCATCGGTT TCGTGCGTTC

251   AGACGGCATC TTCGATTTCT TTTGACGAAA CCGCCGTGCG CAAACCGAAA

301   GAAGTTTTCA AACACGGTGC GAGCTTCGCG TTCAAGAGCC GGCAGATTGT

351   CCGTTATTAC GACCCCAAAC GCAAAACCTT CGCCTATTTG GTGTACAGCG

401   ATAAAATCAT CCAAGGCTCG CCGAAAAATT CCTTAAGCGC GGTTTCCTGT

451   TTCGGCGGCG GCATACCGCA AACCGATGGG GTGCAAGCCG ATACTTCCGG

501   CAACCTGCTT GCCGGCGCCT GCATGATTTC CAACCCGATA GAAAATCCCG

551   ACAAACGCTG A
```

This corresponds to the amino acid sequence <SEQ ID 2650; ORF 770.a>:

```
a770.pep
   1   MNRLLLLSAA VLLTACGSGE TDKIGRASTV FNILGKNDRI EVEGFDDPDV

51   QGVACYISYA KKGGLKEMVN LEEDASDASV SCVQTASSIS FDETAVRKPK

101   EVFKHGASFA FKSRQIVRYY DPKRKTFAYL VYSDKIIQGS PKNSLSAVSC

151   FGGGIPQTDG VQADTSGNLL AGACMISNPI ENPDKR*
```

Computer analysis of this amino acid sequence gave the following results:
Homology with a Predicted ORF from *N. meningitidis*
ORF 770 shows 99.5% identity over a 186 aa overlap with a predicted ORF (ORF 770) from *N. meningitidis*:
m770/a770 99.5% identity in 186 aa overlap

```
                    10         20         30         40         50         60
a770.pep    MNRLLLLSAAVLLTACGSGETDKIGRASTVFNILGKNDRIEVEGFDDPDVQGVACYISYA
            ||||||||||||||||||||||||||||||||||||||||||||||||||||||||||||
m770        MNRLLLLSAAVLLTACGSGETDKIGRASTVFNILGKNDRIEVEGFDDPDVQGVACYISYA
                    10         20         30         40         50         60

70         80         90        100        110        120
a770.pep    KKGGLKEMVNLEEDASDASVSCVQTASSISFDETAVRKPKEVFKHGASFAFKSRQIVRYY
            ||||||||||||||||||||||||||||||||||||||||||||||||||||||||||||
m770        KKGGLKEMVNLEEDASDASVSCVQTASSISFDETAVRKPKEVFKHGASFAFKSRQIVRYY
                    70         80         90        100        110        120
```

```
            130        140        150        160        170        180
a770.pep  DPKRKTFAYLVYSDKIIQGSPKNSLSAVSCFGGGIPQTDGVQADTSGNLLAGACMISNPI
          ||||||||||||||||||||||||||||||||||||||||||||||||||||||||||||
m770      DPKRKTFAYLVYSDKIIQGSPKNSLSAVSCFGGGIPQTDGVQADTSGNLLAGACMISNPI
            130        140        150        160        170        180 a770.pep  ENPDKRX
          || ||||
m770      ENLDKRX
```

The following partial DNA sequence was identified in *N. gonorrhoeae* <SEQ ID 2651>:

```
g771.seq
   1  ATGGATTTAT TATCGGTTTT CCACAAATAC CGTCTGAAAT ATGCGGTGGC
  51  GGTGCTGACG ATGCTGCTTT TGGCGGCAGT CGGGCTGCAC GCTTCCGTAT
 101  ATCGCACCTT CACGCCCGAA AACATCCGCA GCCGCCTCCA ACAAAGCATT
 151  GCCCATACCC ACCGGAAAAT CTCGTTTGAT GCGGATATAC GGCGCAGGCT
 201  TCTGCCCCGC CCGACCGTCA TCCTGAAAAA CCTGACCATT ACCGAACCCG
 251  ACGGCGGCCG GGTCGCCGTT TCCGTCAAAG AAACCAAAAT CGGATTGAGC
 301  TGGAAAAACC TGTGGTCGGA TCGGATACAG GTTGAAAAAT GGGTGGTTTC
 351  GGGTGCGGAT CTTGCCCTGA CGCGCGACAG AAACGGCGCT TGGAACATCC
 401  AAGACCTGTT CGACGGCGCG AAACACTCCG CCTCAGTCAA CCGCATTATC
 451  GTCGAAAACA GCACCGTCCG CCTCAATTTC CTGCAGCAAC AGCTTATCCT
 501  GAAGGAAATC AGCCTCAACC TGCAATCCCC CGATTCGTCG GGCAGCAGT
 551  TTGAAAGTTC GGGCATACTG GTTTGGAGAA AGCTGTCCGT CCCGTGGAAA
 601  AGCAGGGGGC TGTTCCTTTC AGACGGCATC GGCACGCCCG AAATCTCACC
 651  GTTCCATTTT GAAGCTTCCA CTTCGCTGGA CGGACACGGC ATCACCATTT
 701  CCACCACCGG CAGCCCTTCT GTCCGCTTCA ACGCCGGCGG AGCGGATGCC
 751  GCCGGCCTCG GCCTGCGTGC AGACACTTCC TTCCGCAACC TCCACCTGAC
 801  CGCGCAAATC CCCGCACTGG CACTCAAAAA CAACAGCATC AAAACCGGCA
 851  CGGTCAACGG CACGTTTACC GCCGGCGGCG AATATGCCCG ATGGGACGGT
 901  TCGTTCAAAC TCGACAAAGC CAACCTGCAC TCCGGCATCG CCAACATCGG
 951  CAACGCCGAA ATCTCCGGCA GCTTCAAAAC ACCGCGCCTT CAAACCAATT
1001  TCTCCCTCGG CTCGCCGTTG GTTTGGAGTC GGGACAACGG GCTGGACGCC
1051  CCGCGCCTGC ACATATCGAC CCTTCAGGAT ACCGTCGACC GCCTGCCGCA
1101  ACCCCGTTTC ATCAGCCGGC TCGACGGTTC GCTGTCCATA CCGAATCTGC
1151  AAAATTGGAA TGCCGAATTA ACGGCACAT TCGACCGCCA ACCCGTTGCC
1201  GCAAAATTCA AATATACGCG GGAAGGCGCA CCGCACCTGG AAGCCGCCGC
1251  CGCGCTGCAA AAATTAAACC TCGCCCCCTA TCTTGACGAA TTTCGGCAAC
1301  AAAACGGCAA AATATTCCCC GACATCCTCG GCAGGCTGTC CGGCAACGTC
1351  GAGGCACACC TCAAAATCGG CAGCATCCAA CTCCCCGGCT TGCAACTGGA
1401  CGATATGGAA ACCTACCTCC ACGCCGACAA AGACCATATC GCGCTCAGCC
1451  GTTTCAAGTC AGGGCTTTAC GGCGGCCATA CCGAAGGCGG CATCAGCATC
1501  GCCAACACCC GTCCCGCCAC TTACCGCCTG CAACAGAATG CAAGCAACAT
1551  CCAAATCCAA CCGCTGCTGC AAGACCTGTT CGGCTTCCAC AGCTTCAGCG
```

```
1601  GCAACGGCGA TGCGGTCATC GACCTGACCG CAAGCGGCGA AAACCGCAAA

1651  CAGCTTATCC GCTCGCTGCA AGGCAGCCTG TCGCTGAATA TTTCCAACGG

1701  CGCGTGGCAC GGCATCGATA TGGACAGCAT TTTAAAAAAC GGCCTTTCCG

1751  GGAAAATCTC GGGCAGCACA CCCTTCTACC GATTCACGCT CAACAGCGAA

1801  ATTTCAGACG GCATCAGCCG CCACATCGAT ACCGAACTCT TCTCCGACAG

1851  CCTCTATGTT ACCAGCAACG GCTATACCAA TCTGGATACG CAGGAATTGT

1901  CTGAAGATGT CCTTATCCGC AACGCCGTCC ATCCGAAAAA CAAACCGATT

1951  CCCCTGAAAA TCACCGGTAC GGTGGACAAG CCGTCCATTA CCGTCGATTA

2001  CGGCAGGCTG ACCGGCGGCA TCAATTCGCG CAAAGAGAAA CAGAAAATCC

2051  TCGAAGACAC CCTGCTGGAA CAATGGCAGT GGCTCAAACC TAAAGAACCG

3051  TAA
```

This corresponds to the amino acid sequence <SEQ ID 2652; ORF 771.ng>:

```
g771.pep
   1  MDLLSVFHKY RLKYAVAVLT MLLLAAVGLH ASVYRTFTPE NIRSRLQQSI

51  AHTHRKISFD ADIRRRLLPR PTVILKNLTI TEPDGGRVAV SVKETKIGLS

101  WKNLWSDRIQ VEKWVVSGAD LALTRDRNGA WNIQDLFDGA KHSASVNRII

151  VENSTVRLNF LQQQLILKEI SLNLQSPDSS GQQFESSGIL VWRKLSVPWK

201  SRGLFLSDGI GTPEISPFHF EASTSLDGHG ITISTTGSPS VRFNAGGADA

251  AGLGLRADTS FRNLHLTAQI PALALKNNSI KTGTVNGTFT AGGEYARWDG

301  SFKLDKANLH SGIANIGNAE ISGSFKTPRL QTNFSLGSPL VWSRDNGLDA

351  PRLHISTLQD TVDRLPQPRF ISRLDGSLSI PNLQNWNAEL NGTFDRQPVA

401  AKFKYTREGA PHLEAAAALQ KLNLAPYLDE FRQQNGKIFP DILGRLSGNV

451  EAHLKIGSIQ LPGLQLDDME TYLHADKDHI ALSRFKSGLY GGHTEGGISI

501  ANTRPATYRL QQNASNIQIQ PLLQDLFGFH SFSGNGDAVI DLTASGENRK

551  QLIRSLQGSL SLNISNGAWH GIDMDSILKN GLSGKISGST PFYRFTLNSE

601  ISDGISRHID TELFSDSLYV TSNGYTNLDT QELSEDVLIR NAVHPKNKPI

651  PLKITGTVDK PSITVDYGRL TGGINSRKEK QKILEDTLLE QWQWLKPKEP

701  *
```

The following partial DNA sequence was identified in *N. meningitidis* <SEQ ID 2653>:

```
m771.seq
   1  ATGGATTTAT TATCGGTTTT CCACAAATAC CGTCTGAAAT ATGCGGTGGC

51  CGTGCTGACG ATACTGCTTT TGGCGGCAGT CGGGCTGCAC GCTTCCGTAT

101  ATCGCACCTT CACGCCTGAA AACATCCGCA GCCGCCTACA ACAAAGCATT

151  GCACACACAC ACCGGAAAAT CTCGTTTGAT GCGGACATTC AGCGCAGGCT

201  CCTGCCCCGG CCGACCGTCA TCCTGAAAAA CCTGACCATT ACCGAACCCG

251  GCGGCGACCA GACTGCCGTT TCCGTCCAAG AAACCAAAAT CGGATTGAGC

301  TGGAAAAACC TGTGGTCGGA TCAGATACAG ATTGAAAAAT GGGTGGTTTC

351  GAGTGCGGAA CTTGCCCTGA CGCGCGACGG GAAAGGTGTT TGGAACATCC
```

```
-continued
 401  AAGACCTGAT CGACAGCCAA AAACGCCAAG CCTCAGTCAA CCGCATTATC
 451  GTCGAAAACA GCACCGTCCG CCTCAATTTC CTGCAGGAAC AGCTTATCCT
 501  GAAGGAAATC AACCTCAACC TGCAATCCCC CGATTCGTCG GGGCAGCCGT
 551  TTGAAAGTTC GGGCATACTG GTTTGGGGAA AGCTGTCCGT CCCGTGGAAA
 601  AGCAGGGGGC TGTTCCTTTC AAACGGCATC GGCCCGCCCG AAATCTCACC
 651  GTTCCATTTT GAAGCTTCCA CTTCGCTGGA CGGACACGGC ATTACCATTT
 701  CCACCACCGG CAGCCCTTCT GTCCGCTTCA ACGCCGGCGG AGCGGATGCC
 751  GCCGGCCTCG GCCTGCGTGC AGACACTTCC TTCCGCAACC TCCACCTGAC
 801  CGCCCAAATC CCCGCGCTGG CACTCAGGAA CAACAGCATT AAAATTGAAA
 851  CCGTCAACGG CGCATTTACC GCCGGCGGCG AATATGCCCG ATGGGACGGT
 901  TCGTTCAAAC TCGACAAAGC CAACCTGCAC TCCGGCATCG CCAACATCGG
 951  CAACGCCGAA ATCTCCGGCA GCTTCAAAAC ACCGCGCCAC CAGACCAACT
1001  TCTCCCTCAA TTCGCCGCTC GTATGGACGG AAAACAAAGG GCTGGACGCG
1051  CCGCGCCTGT ATGTATCGAC CCTTCAGGAT ACCGTCAACC GCCTGCCGCA
1101  ACCCCGTTTC ATCAGCCGGC TCGACGGTTC GCTGTCCGTA CCGAATCTGC
1151  AAAATTGGAA TGCCGAATTA ACGGCACAT TCGACCGCCA AACCGTTGCC
1201  GCGAAATTCA GATACACACA TGAAGACGCA CCGCATCTGG AAGCCGCCGT
1251  CGCACTGCAA AAATTGAACC TGACCCCCTA TCTTGACGAC GTGCGGCAAC
1301  AAAACGGCAA ATATTTCCC GACACCCTCG CCAAGCTGTC CGGCGACATC
1351  GAGGCGCACC TGAAAATCGG AAAAGTCCAA CTTCCCGGCC TGCAACTGGA
1401  CGATATGGAA ACCTACCTCC ACGCCGACAA AGGCCATATC GCGCTCAGCC
1451  GTTTCAAGTC AGGGCTTTAC GGCGGCCATA CCGAAGGCGG CATCAGCATC
1501  GCCAACACCC GTCCCGCCAC TTACCGCCTG CAACAGAATG CAAGCAACAT
1551  CCAAATCCAA CCGCTGCTGC AAGACCTGTT CGGCTTCCAC AGCTTCAGCG
1601  GCAACGGCGA CGCGGTCATC GACCTGACCG CGGGCGGCGA AACCCGAAAA
1651  GAGCTTATCC GCTCGCTTCA GGGCAGCCTG TCGCTAAATA TTTCCAACGG
1701  TGCATGGCAC GGTATCGACA TGGACAATAT CCTGAAAAAC GGCATTTCGG
1751  GCAAAACTGC CGACAATGCC GCACCCAGCA CACCCTTCCA CCGATTCACG
1801  CTCAACAGCG AAATTTCAGA CGGCATCAGC CGCCACATCG ATACCGAACT
1851  CTTCTCCGAC AGCCTCTATG TTACCAGCAA CGGCTATACC AATCTGGATA
1901  CGCAGGAATT GTCTGAAGAT GTCCTTATCC GCAACGCCGT CCATCCGAAA
1951  AACAAACCGA TTCCCCTGAA ATCACCGGC ACGGTGGACA AACCGTCCAT
2001  TACCGTCGAT TACGGCAGGC TGACCGGCGG CATCAATTCG CGCAAAGAGA
2051  AACAGAAAAT CCTCGAAGAC ACCCTGCTGG AACAATGGCA GTGGCTCAAA
2101  CCTAAAGAAC CGTA
```

This corresponds to the amino acid sequence <SEQ ID 2654; ORF 771>:

```
m771.pep
   1  MDLLSVFHKY RLKYAVAVLT ILLLAAVGLH ASVYRTFTPE NIRSRLQQSI

51  AHTHRKISFD ADIQRRLLPR PTVILKNLTI TEPGGDQTAV SVQETKIGLS
```

-continued

```
101  WKNLWSDQIQ IEKWVVSSAE LALTRDGKGV WNIQDLIDSQ KRQASVNRII

151  VENSTVRLNF LQEQLILKEI NLNLQSPDSS GQPFESSGIL VWGKLSVPWK

201  SRGLFLSNGI GPPEISPFHF EASTSLDGHG ITISTTGSPS VRFNAGGADA

251  AGLGLRADTS FRNLHLTAQI PALALRNNSI KIETVNGAFT AGGEYARWDG

301  SFKLDKANLH SGIANIGNAE ISGSFKTPRH QTNFSLNSPL VWTENKGLDA

351  PRLYVSTLQD TVNRLPQPRF ISRLDGSLSV PNLQNWNAEL NGTFDRQTVA

401  AKFRYTHEDA PHLEAAVALQ KLNLTPYLDD VRQQNGKIFP DTLAKLSGDI

451  EAHLKIGKVQ LPGLQLDDME TYLHADKGHI ALSRFKSGLY GGHTEGGISI

501  ANTRPATYRL QQNASNIQIQ PLLQDLFGFH SFSGNGDAVI DLTAGGETRK

551  ELIRSLQGSL SLNISNGAWH GIDMDNILKN GISGKTADNA APSTPFHRFT

601  LNSEISDGIS RHIDTELFSD SLYVTSNGYT NLDTQELSED VLIRNAVHPK

651  NKPIPLKITG TVDKPSITVD YGRLTGGINS RKEKQKILED TLLEQWQWLK

701  PKEP*
```

Computer analysis of this amino acid sequence gave the following results:
Homology with a Predicted ORF from *N. gonorrhoeae*
ORF 771 shows 90.3% identity over a 704 aa overlap with a predicted ORF (ORF 771) from *N. gonorrhoeae*
m771/g771 90.3% identity in 704 aa overlap

```
                  10        20        30        40        50        60
g771.pep  MDLLSVFHKYRLKYAVAVLTMLLLAAVGLHASVYRTFTPENIRSRLQQSIAHTHRKISFD
          ||||||||||||||||||||:|||||||||||||||||||||||||||||||||||||||
m771      MDLLSVFHKYRLKYAVAVLTILLLAAVGLHASVYRTFTPENIRSRLQQSIAHTHRKISFD
                  10        20        30        40        50        60

70        80        90       100       110       120
g771.pep  ADIRRRLLPRPTVILKNLTITEPDGGRVAVSVKETKIGLSWKNLWSDRIQVEKWVVSGAD
          |||:|||||||||||||||||||| | ::||||:|||||||||||||||:|:|||||:|:
m771      ADIQRRLLPRPTVILKNLTITEPGGDQTAVSVQETKIGLSWKNLWSDQIQIEKWVVSSAE
                  70        80        90       100       110       120

130       140       150       160       170       180
g771.pep  LALTRDRNGAWNIQDLFDGAKHSASVNRIIVENSTVRLNFLQQQLILKEISLNLQSPDSS
          ||||||:|:||||||||:| |::||||||||||||||||:|||||||||:||||||||||
m771      LALTRDGKGVWNIQDLIDSQKRQASVNRIIVENSTVRLNFLQEQLILKEINLNLQSPDSS
                 130       140       150       160       170       180

190       200       210       220       230       240
g771.pep  GQQFESSGILVWRKLSVPWKSRGLFLSDGIGTPEISPFHFEASTSLDGHGITISTTGSPS
          ||  |||||||||| |||||||||||||:||| |||||||||||||||||||||||||||
m771      GQPFESSGILVWGKLSVPWKSRGLFLSNGIGPPEISPFHFEASTSLDGHGITISTTGSPS
                 190       200       210       220       230       240

250       260       270       280       290       300
g771.pep  VRFNAGGADAAGLGLRADTSFRNLHLTAQIPALALKNNSIKTGTVNGTFTAGGEYARWDG
          |||||||||||||||||||||||||||||||||||:||||| ||||:|||||||||||||
m771      VRFNAGGADAAGLGLRADTSFRNLHLTAQIPALALRNNSIKIETVNGAFTAGGEYARWDG
                 250       260       270       280       290       300

310       320       330       340       350       360
g771.pep  SFKLDKANLHSGIANIGNAEISGSFKTPRLQTNFSLGSPLVWSRDNGLDAPRLHISTLQD
          |||||||||||||||||||||||||||||:||||||:|||::::|||||::|||
m771      SFKLDKANLHSGIANIGNAEISGSFKTPRHQTNFSLNSPLVWTENKGLDAPRLYVSTLQD
                 310       320       330       340       350       360

370       380       390       400       410       420
g771.pep  TVDRLPQPRFISRLDGSLSIPNLQNWNAELNGTFDRQPVAAKFKYTREGAPHLEAAAALQ
          ||:|||||||||||||||| ||||||||||||||||:||||||:|:| ||||||||||||
m771      TVNRLPQPRFISRLDGSLSVPNLQNWNAELNGTFDRQTVAAKFRYTHEDAPHLEAAVALQ
                 370       380       390       400       410       420

430       440       450       460       470       480
g771.pep  KLNLAPYLDEFRQQNGKIFPDILGRLSGNVEAHLKIGSIQLPGLQLDDMETYLHADKDHI
          ||||:||||: ||||||||||:::||||:::||||||:|||||||||||||||||||||
m771      KLNLTPYLDDVRQQNGKIFPDTLAKLSGDIEAHLKIGKVQLPGLQLDDMETYLHADKGHI
                 430       440       450       460       470       480
```

-continued

```
                 490        500        510        520        530        540
g771.pep  ALSRFKSGLYGGHTEGGISIANTRPATYRLQQNASNIQIQPLLQDLFGFHSFSGNGDAVI
          ||||||||||||||||||||||||||||||||||||||||||||||||||||||||||||
m771      ALSRFKSGLYGGHTEGGISIANTRPATYRLQQNASNIQIQPLLQDLFGFHSFSGNGDAVI
                 490        500        510        520        530        540

550        560        570        580            590
g771.pep  DLTASGENRKQLIRSLQGSLSLNISNGAWHGIDMDSILKNGLSGKISG----STPFYRFT
          ||||:||:||:||||||||||||||||||||||||:|||||:||| :     ||||:|||
m771      DLTAGGETRKELIRSLQGSLSLNISNGAWHGIDMDNILKNGISGKTADNAAPSTPFHRFT
                 550        560        570        580        590        600

600        610        620        630        640        650
g771.pep  LNSEISDGISRHIDTELFSDSLYVTSNGYTNLDTQELSEDVLIRNAVHPKNKPIPLKITG
          ||||||||||||||||||||||||||||||||||||||||||||||||||||||||||||
m771      LNSEISDGISRHIDTELFSDSLYVTSNGYTNLDTQELSEDVLIRNAVHPKNKPIPLKITG
                 610        620        630        640        650        660

660        670        680        690        700
g771.pep  TVDKPSITVDYGRLTGGINSRKEKQKILEDTLLEQWQWLKPKEPX
          |||||||||||||||||||||||||||||||||||||||||||||
m771      TVDKPSITVDYGRLTGGINSRKEKQKILEDTLLEQWQWLKPKEPX
                 670        680        690        700
```

The following partial DNA sequence was identified in *N. meningitidis* <SEQ ID 2655>:

```
a771.seq
     1  ATGGATTTAT TATCGGTCTT CCACAAATAC CGTCTGAAAT ATGCGGTAGC

51  CGTGCTGACG ATACTGCTTT TGGCGGCAAT CGGGCTGCAC GCTTCCGTAT

101  ATCGCATCTT CACACCTGAA AACATCCGAA GCCGCCTCCA ACAAAGCATT

151  GCCCATACGC ACCGGAAAAT CTCGTTTGAT GCGGATATAC AGCGCAGGCT

201  TCTGCCCCGG CCGACCGTCA TCCTGAAAAA CCTGACCATT ACCGAACCCG

251  GCGGCGACCG GACTGCCGTT TCCGTCCAAG AAACCAAAAT CGGATTGAGC

301  TGGAAAAACC TGTGGTCGGA TCAGATACAG ATTGAAAAAT GGGTGGTTTC

351  GAGTGCGGAA CTTGCCCTGA CGCGCGACGG GAAAGGTGTT TGGAACATCC

401  AAGACCTGAT CGACAGCCAA AAACGCCAAG CCTCAGTCAA CCGCATTATC

451  GTCGAAAACA GCACCGTCCG CCTCAATTTC CTGCAGGAAC AGCTTATCCT

501  GAAGGAAATC AACCTCAACC TGCAATCCCC CGATTCGTCG GGGCAGCCGT

551  TTGAAAGTTC GGGCATACTG GTTTGGGGAA AGCTGTCCGT CCCGTGGAAA

601  AGCAGGGGGC TGTTCCTTTC AGACGGCATC GGCACGCCCA AAATCTCACC

651  GTTCCATTTT GAAGCTTCCA CTTCGCTGGA CGGACACGGC ATTACCATTT

701  CCACCACCGG CAGCCCTTCT GTCCGCTTCA ACGCCGGCGG AGCGGATGCC

751  GCCGGCCTCG GCCTGCGTGC AGACACTTCC TTCCGCAACC TCCACCTGAC

801  CGCCCAAATC CCTACGCTGG CACTCAGGAA CAACAGCATT AAAATTGAAA

851  CCGTCAACGG CGCATTTACC GCCGGCGGCG AATATGCCCA ATGGGACGGT

901  TCGTTCAAAC TCGACAAAGC CAACCTGCAC TCCGGCATCG CCAACATCGG

951  CAACGCCGAA ATCTCCGGCA GCTTCAAAAC ACCGCGCCAC CAGACCAACT

1001  TCTCCCTCAA TTCGCCGCTC GTATGGACGG AAAACAAAGG GCTGGACGCG

1051  CCGCGCCTGT ATGTATCGAC CCTTCAGGAT ACCGTCAACC GCCTGCCGCA

1101  ACCCCGTTTC ATCAGCCGGC TCGACGGTTC GCTGTCCGTA CCGAATCTGC

1151  AAAATTGGAA TGCCGAATTA AACGGCACAT TCGACCGCCA AACCGTTGCC
```

```
-continued
1201  GCGAAATTCA GATACACACA TGAAGACGCA CCGCATCTGG AAGCCGCCGT

1251  CGCACTGCAA AAATTGAACC TGACCCCCTA TCTTGACGAC GTGCGGCAAC

1301  AAAACGGCAA AATATTTCCC GACACCCTCG CCAAGCTGTC CGGCGACATC

1351  GAGGCGCACC TGAAAATCGG AAAAGTCCAA CTTCCCGGCC TGCAACTGGA

1401  CGATATGGAA ACCTACCTCC ACGCCGACAA AGGCCATATC GCGCTCAGCC

1451  GTTTCAAGTC AGGGCTTTAC GGCGGCCATA CCGAAGGCGG CATCAGCATC

1501  GCCAACACCC GTCCCGCCAC TTACCGCCTG CAACAGAATG CAAGCAACAT

1551  CCAAATCCAA CCGCTGCTGC AAGACCTGTT CGGCTTCCAC AGCTTCAGCG

1601  GCAACGGCGA CGCGGTCATC GACCTGACCG CGGGCGGCGA AACCCGAAAA

1651  GAGCTTATCC GCTCGCTTCA GGGCAGCCTG TCGCTAAATA TTTCCAACGG

1701  TGCATGGCAC GGTATCGACA TGGACAATAT CCTGAAAAAC GGCATTTCGG

1751  GCAAAACTGC CGACAATGCC GCACCCAGCA CACCCTTCCA CCGATTCACG

1801  CTCAACAGCG AAATTTCAGA CGGCATCAGC CGCCACATCG ATACCGAACT

1851  CTTCTCCGAC AGCCTCTATG TTACCAGCAA CGGCTATACC AATCTGGATA

1901  CGCAGGAATT GTCTGAAGAT GTCCTTATCC GCAACGCCGT CCATCCGAAA

1951  AACAAACCGA TTCCCCTGAA AATCACCGGT ACGGTGGACA AACCGTCCAT

2001  TACCGTCGAT TACGGCAGGC TGACCGGCGG CATCAATTCG CGCAAAGAGA

2051  AACAGAAAAT CCTCGAAGAC ACCCTGCTGG AACAATGGCA GTGGCTCAAA

2101  CCTAAAGAAC CGTAA
```

This corresponds to the amino acid sequence <SEQ ID 2656; ORF 771.a>:

```
a771.pep
    1  MDLLSVFHKY RLKYAVAVLT ILLLAAIGLH ASVYRIFTPE NIRSRLQQSI

51  AHTHRKISFD ADIQRRLLPR PTVILKNLTI TEPGGDRTAV SVQETKIGLS

101  WKNLWSDQIQ IEKWVVSSAE LALTRDGKGV WNIQDLIDSQ KRQASVNRII

151  VENSTVRLNF LQEQLILKEI NLNLQSPDSS GQPFESSGIL VWGKLSVPWK

201  SRGLFLSDGI GTPKISPFHF EASTSLDGHG ITISTTGSPS VRFNAGGADA

251  AGLGLRADTS FRNLHLTAQI PTLALRNNSI KIETVNGAFT AGGEYAQWDG

301  SFKLDKANLH SGIANIGNAE ISGSFKTPRH QTNFSLNSPL VWTENKGLDA

351  PRLYVSTLQD TVNRLPQPRF ISRLDGSLSV PNLQNWNAEL NGTFDRQTVA

401  AKFRYTHEDA PHLEAAVALQ KLNLTPYLDD VRQQNGKIFP DTLAKLSGDI

451  EAHLKIGKVQ LPGLQLDDME TYLHADKGHI ALSRFKSGLY GGHTEGGISI

501  ANTRPATYRL QQNASNIQIQ PLLQDLFGFH SFSGNGDAVI DLTAGGETRK

551  ELIRSLQGSL SLNISNGAWH GIDMDNILKN GISGKTADNA APSTPFHRFT

601  LNSEISDGIS RHIDTELFSD SLYVTSNGYT NLDTQELSED VLIRNAVHPK

651  NKPIPLKITG TVDKPSITVD YGRLTGGINS RKEKQKILED TLLEQWQWLK

701  PKEP*
```

Computer analysis of this amino acid sequence gave the following results:
Homology with a Predicted ORF from *N. meningitidis*
ORF 771 shows 98.9% identity over a 704 aa overlap with a predicted ORF (ORF 771) from *N. meningitidis*
m771/a771 98.9% identity in 704 aa overlap

```
                   10        20        30        40        50        60
a771.pep  MDLLSVFHKYRLKYAVAVLTILLLAAIGLHASVYRIFTPENIRSRLQQSIAHTHRKISFD
          ||||||||||||||||||||||||||||||:||||||||||||||||||||||||||||
m771      MDLLSVFHKYRLKYAVAVLTILLLAAVGLHASVYRTFTPENIRSRLQQSIAHTHRKISFD
                   10        20        30        40        50        60

70        80        90       100       110       120
a771.pep  ADIQRRLLPRPTVILKNLTITEPGGDRTAVSVQETKIGLSWKNLWSDQIQIEKWVVSSAE
          |||||||||||||||||||||||||:||||||||||||||||||||||||||||||||||
m771      ADIQRRLLPRPTVILKNLTITEPGGDQTAVSVQETKIGLSWKNLWSDQIQIEKWVVSSAE
                   70        80        90       100       110       120

130       140       150       160       170       180
a771.pep  LALTRDGKGVWNIQDLIDSQKRQASVNRIIVENSTVRLNFLQEQLILKEINLNLQSPDSS
          ||||||||||||||||||||||||||||||||||||||||||||||||||||||||||||
m771      LALTRDGKGVWNIQDLIDSQKRQASVNRIIVENSTVRLNFLQEQLILKEINLNLQSPDSS
                  130       140       150       160       170       180

190       200       210       220       230       240
a771.pep  GQPFESSGILVWGKLSVPWKSRGLFLSDGIGTPKISPFHFEASTSLDGHGITISTTGSPS
          ||||||||||||||||||||||||||||:|||  |:||||||||||||||||||||||||
m771      GQPFESSGILVWGKLSVPWKSRGLFLSNGIGPPEISPFHFEASTSLDGHGITISTTGSPS
                  190       200       210       220       230       240

250       260       270       280       290       300
a771.pep  VRFNAGGADAAGLGLRADTSFRNLHLTAQIPTLALRNNSIKIETVNGAFTAGGEYAQWDG
          |||||||||||||||||||||||||||||:|||||||||||||||||||||||||||:|||
m771      VRFNAGGADAAGLGLRADTSFRNLHLTAQIPALALRNNSIKIETVNGAFTAGGEYARWDG
                  250       260       270       280       290       300

310       320       330       340       350       360
a771.pep  SFKLDKANLHSGIANIGNAEISGSFKTPRHQTNFSLNSPLVWTENKGLDAPRLYVSTLQD
          ||||||||||||||||||||||||||||||||||||||||||||||||||||||||||||
m771      SFKLDKANLHSGIANIGNAEISGSFKTPRHQTNFSLNSPLVWTENKGLDAPRLYVSTLQD
                  310       320       330       340       350       360

370       380       390       400       410       420
a771.pep  TVNRLPQPRFISRLDGSLSVPNLQNWNAELNGTFDRQTVAAKFRYTHEDAPHLEAAVALQ
          ||||||||||||||||||||||||||||||||||||||||||||||||||||||||||||
m771      TVNRLPQPRFISRLDGSLSVPNLQNWNAELNGTFDRQTVAAKFRYTHEDAPHLEAAVALQ
                  370       380       390       400       410       420

430       440       450       460       470       480
a771.pep  KLNLTPYLDDVRQQNGKIFPDTLAKLSGDIEAHLKIGKVQLPGLQLDDMETYLHADKGHI
          ||||||||||||||||||||||||||||||||||||||||||||||||||||||||||||
m771      KLNLTPYLDDVRQQNGKIFPDTLAKLSGDIEAHLKIGKVQLPGLQLDDMETYLHADKGHI
                  430       440       450       460       470       480

490       500       510       520       530       540
a771.pep  ALSRFKSGLYGGHTEGGISIANTRPATYRLQQNASNIQIQPLLQDLFGFHSFSGNGDAVI
          ||||||||||||||||||||||||||||||||||||||||||||||||||||||||||||
m771      ALSRFKSGLYGGHTEGGISIANTRPATYRLQQNASNIQIQPLLQDLFGFHSFSGNGDAVI
                  490       500       510       520       530       540

550       560       570       580       590       600
a771.pep  DLTAGGETRKELIRSLQGSLSLNISNGAWHGIDMDNILKNGISGKTADNAAPSTPFHRFT
          ||||||||||||||||||||||||||||||||||||||||||||||||||||||||||||
m771      DLTAGGETRKELIRSLQGSLSLNISNGAWHGIDMDNILKNGISGKTADNAAPSTPFHRFT
                  550       560       570       580       590       600

610       620       630       640       650       660
a771.pep  LNSEISDGISRHIDTELFSDSLYVTSNGYTNLDTQELSEDVLIRNAVHPKNKPIPLKITG
          ||||||||||||||||||||||||||||||||||||||||||||||||||||||||||||
m771      LNSEISDGISRHIDTELFSDSLYVTSNGYTNLDTQELSEDVLIRNAVHPKNKPIPLKITG
                  610       620       630       640       650       660

670       680       690       700
a771.pep  TVDKPSITVDYGRLTGGINSRKEKQKILEDTLLEQWQWLKPKEPX
          |||||||||||||||||||||||||||||||||||||||||||
m771      TVDKPSITVDYGRLTGGINSRKEKQKILEDTLLEQWQWLKPKEPX
                  670       680       690       700
```

The following partial DNA sequence was identified in *N. gonorrhoeae* <SEQ ID 2657>:

```
g772.seq
    1   GTGTTCGGCA CGGTCTTGCG GACTGATGCC GACTGCCTGC AAATCATCGT

51   CGTCGGCAAG TTCTTTCAGG TTGTTGCGTA TGGTTTTGCG GCGTTGGCGG
```

-continued

```
101   AAGGCGAGTT TCACCAGTTT GGCGAAATGA TCGAAATCGT CCGCCTTGCC
151   GATACGGTGT TTCACCGGAA TCATGCGCAC CACTGCGGAA TCGATTTTCG
201   GCGCGGGATC GAACGATTCG GGCGGCACGT CAATCAGCAG CTCCATATCG
251   AAAAAATATT GCAGCATCAC ACCCAAGCGA CCGTAGTCGT TGCTTTTCGG
301   CGCGGCAACC ATGCGCTCGA CCACTTCTTT TTGCAACATA AAGTGCATAT
351   CGGCGACATC GTCCGCCACC TCCGCCAGTT TGAACAAAAG CGGCGTGGAG
401   ATGTTATACG GCAGGTTGCC GACGATTTTC TTTTTGCCTG AGATGCCGTT
451   GAAATCAAAC TGCAACACGT CGCCTTCGTG AATCACCAGT TTATCCGCAA
501   ACGGCAGCGT TTTCAGACGG CATACGATGT CGCGGTCGAT TTCGACAACG
551   TGCAGGCGGT TCAGCTTTTT CGCCAAAGGT TCGGTAATTG CCGCCAAACC
601   CGGGCCGATT TCAATCACGA CATCATCCGC CTGCGGGCGC ACGGCGTTGA
651   CAATATCGCC GATAATCCGC GTGTCCTGCA AAAAATTCTG CCCGAAACGC
701   TTGCGGGCTT TGTGTTCTTT CATCGTGTTT CCTCTTCGGT TGAAACCCCG
751   CCCTTTAGGG CGGCAGGATC AGACTCTGTT TGGGCGGGGC GTAACCCCTT
801   CCAAATCAGG ACGACACATA GGGCGGTGCT TTATGTGTCG TCCTGTGTGT
851   TGGAACATAA ATGTGTTTAC AGTATCCGTT TGATGTCGGC ATTGTAA
```

This corresponds to the amino acid sequence <SEQ ID 2658; ORF 772.ng>:

```
g772.pep
    1   VFGTVLRTDA DCLQIIVVGK FFQVVAYGFA ALAEGEFHQF GEMIEIVRLA
   51   DTVFHRNHAH HCGIDFRRGI ERFGRHVNQQ LHIEKILQHH TQATVVVAFR
  101   RGNHALDHFF LQHKVHIGDI VRHLRQFEQK RRGDVIRQVA DDFLFA*DAV
  151   EIKLQHVAFV NHQFIRKRQR FQTAYDVAVD FDNVQAVQLF RQRFGNCRQT
  201   RADFNHDIIR LRAHGVDNIA DNPRVLQKIL PETLAGFVFF HRVSSSVETP
  251   PFRAAGSDSV WAGRNPFQIR TTHRAVLYVS SCVLEHKCVY SIRLMSAL*
```

The following partial DNA sequence was identified in N. meningitidis <SEQ ID 2659>:

```
m772.seq
    1   ATGTTCGGCG CGGTCTTGCG GATTGATGCC GACTGCCTGC AAATCATCGT
   51   CGCCTGCAAG CTCTTTCAGA TTGTTGCGTA TGGTTTTGCG GCGTTGGTGG
  101   AAGGCGAGTT TCACGAGTTT GGCAAAATGC TCGAAATCGT CCGCCTTGCC
  151   GATGCGGTGT TTCACCGGAA TCATACGGAC GACGGCGGAA TCCACTTTCG
  201   GCGCAGGGTC GAACGATTCG GGCGGTACGT CAATCAGCAT TTCCATATCG
  251   AAAAAATATT GCAGCATCAC GCCCAAGCGG CCGTAGTCGT TGCTTTTCGG
  301   CGCGGCAACC ATACGCTCGA CCACTTCTTT TTGCAGCATA AAGTGCATAT
  351   CGACGACATC GTCCGCCACC TCCGCCAGCT TGAACAAAAG CGGTGTGGAA
  401   ATGTTGTACG GGAGGTTGCC GACGATTTTC TTTTTGCCTG CGATGCCGTT
  451   GAAATCAAAC TGCAATACAT CGCCTTCGTG AATCACCAGT TTATCCGCAA
  501   ACGGCAGCGT TTTCAGACGG CATACGATGT CGCGGTCGAT TTCGACAACG
  551   TGCAGGCGGT TCAGCTTTTT CGCCAAAGGT TCGGTAATCG CCGCCAAACC
```

-continued

```
601   CGGGCCGATT TCAATCACGA CATCATCCGC CTGCGGGCGC ACGGCGTTGA

651   CAATATCGCT GATAATCCGC GTGTCCTGCA AAAAATTCTG CCCGAAACGC

701   TTGCGGGCTT TGTGTTCTTT CATCGTGTTT CCTTTTCGGT TGAAACCCCG

751   CCCTTTAGGG CGGTAGAATC AGACTCTATT TGGGAGGGGC GTAACTCTTT

801   CCAAATCAGG ATGGCACATA GGGCGGTGCT TTATGTGTCG TCCTGTGTGT

851   TGAAACATAA ATGTGTTTAC AGTATCCGTT TGATGTCGGC ATTGTAA
```

This corresponds to the amino acid sequence <SEQ ID 2660; ORF 772>:

```
m772.pep
    1   MFGAVLRIDA DCLQIIVACK LFQIVAYGFA ALVEGEFHEF GKMLEIVRLA

51   DAVFHRNHTD DGGIHFRRRV ERFGRYVNQH FHIEKILQHH AQAAVVVAFR

101   RGNHTLDHFF LQHKVHIDDI VRHLRQLEQK RCGNVVREVA DDFLFACDAV

151   EIKLQYIAFV NHQFIRKRQR FQTAYDVAVD FDNVQAVQLF RQRFGNRRQT

201   RADFNHDIIR LRAHGVDNIA DNPRVLQKIL PETLAGFVFF HRVSFSVETP

251   PFRAVESDSI WEGRNSFQIR MAHRAVLYVS SCVLKHKCVY SIRLMSAL*
```

Computer analysis of this amino acid sequence gave the following results:
Homology with a Predicted ORF from *N. gonorrhoeae*
ORF 772 shows 85.2% identity over a 298 aa overlap with a predicted ORF (ORF 772) from *N. gonorrhoeae*
m772/g772 85.2% identity in 298 aa overlap

```
                  10         20         30         40         50         60
g772.pep  VFGTVLRTDADCLQIIVVGKFFQVVAYGFAALAEGEFHQFGEMIEIVRLADTVFHRNHAH
          :|| ||| |||||||||||:  |:||:|||||||||  ||||:||| |||||||||||||:
m772      MFGAVLRIDADCLQIIVACKLFQIVAYGFAALVEGEFHEFGKMLEIVRLADAVFHRNHTD
                  10         20         30         40         50         60

70         80         90        100        110        120
g772.pep  HCGIDFRRGIERFGRHVNQQLHIEKILQHHTQATVVVAFRRGNHALDHFFLQHKVHIGDI
           ||  ||| :|||||:|||::|||||||||||:||:|||||||||:|||||||||||| |
m772      DGGIHFRRRVERFGRYVNQHFHIEKILQHHAQAAVVVAFRRGNHTLDHFFLQHKVHIDDI
                  70         80         90        100        110        120

130        140        150        160        170        180
g772.pep  VRHLRQFEQKRRGDVIRQVADDFLFAXDAVEIKLQHVAFVNHQFIRKRQRFQTAYDVAVD
          ||||||:|||  |::|:|:|||||||| ||||||| :|||||||||||||||||||||||
m772      VRHLRQLEQKRCGNVVREVADDFLFACDAVEIKLQYIAFVNHQFIRKRQRFQTAYDVAVD
                 130        140        150        160        170        180

190        200        210        220        230        240
g772.pep  FDNVQAVQLFRQRFGNCRQTRADFNHDIIRLRAHGVDNIADNPRVLQKILPETLAGFVFF
          |||||||||||||||| |||||||||||||||||||||||||||||||||||||||||||
m772      FDNVQAVQLFRQRFGNRRQTRADFNHDIIRLRAHGVDNIADNPRVLQKILPETLAGFVFF
                 190        200        210        220        230        240

250        260        270        280        290        299
g772.pep  HRVSSSVETPPFRAAGSDSVWAGRNPFQIRTTHRAVLYVSSCVLEHKCVYSIRLMSALX
          |||| |||||||||| :|||:| ||| ||||  :||||||||||:|||||||||||||||
m772      HRVSFSVETPPFRAVESDSIWEGRNSFQIRMAHRAVLYVSSCVLKHKCVYSIRLMSALX
                 250        260        270        280        290
```

The following partial DNA sequence was identified in *N. meningitidis* <SEQ ID 2661>:

```
a772.seq
    1   ATGTTCGGCG CGGTCTTGCG GATTGATGCC GACTGCCTGC AAATCATCGT

51   CGCCTGCAAG CTCTTTCAGA TTGTTGCGTA TGGTTTTGCG GCGTTGGTGG

101   AAGGCGAGTT TCACGAGTTT GGCGAAATGC TCGAAATCGT CCGCCTTGCC
```

```
                       -continued
151    GATACGGTGT TTCACCGGAA TCATGCGGAC GACGGCCGAA TCCACTTTCG

201    GCGCGGGGTC GAACGATTCG GGCGGCACGT CAATCAGCAT TTCCATATCG

251    AAGAAATATT GCAGCATCAC GCCCAAGCGG CCGTAGTCGT TGCTTTTCGG

301    CGCGGCAACC ATACGATCGA CCACTTCTTT TTGCAGCATA AAGTGCATAT

351    CGACGACATC GTCCGCCACC TCCGCCAGCT TGAACAAAAG CGGCGTGGAA

401    ATGTTGTAGG GCAGGTTGCC GACGATTTTC TTTTTGCCTG CGATGCCGTT

451    GAAATCAAAC TGCAATACAT CGCCTTCGTG AATCACCAGT TTATCCGCAA

501    ACGGCAGCGT TTTCAGACGG CATACGATGT CGCGGTCGAT TTCGACAACG

551    TGCAGGCGGT TCAGCTTTTT CGCCAAAGGT TCGGTAATCG CCGCCAAACC

601    CGGACCGATT TCAATCACGA CATCATCCGC CTGCGGGCGC ACGGCGTTGA

651    CAATATCGCT GATAATCCGC GTGTCCTGCA AAAAATTCTG CCCGAAACGC

701    TTGCGGGCTT TGTGTTCTTT CATCGTGTTT CCTTTTCGGT TGAAACCCCG

751    CCCTTTAGGG CGGTAGAATC AGACTCTATT TGGGAGGGGC GTAACTCCTT

801    CCAAATCAGG ACGGCACATA GGGCGGTGCT TTATGTGTCG TCCTGTGTGT

851    TGAAACATAA ATGTGTTTAC AGTATCCGTT TGATGTCGGC ATTGTAA
```

This corresponds to the amino acid sequence <SEQ ID 2662; ORF 772.a>:

```
a772.pep
   1    MFGAVLRIDA DCLQIIVACK LFQIVAYGFA ALVEGEFHEF GEMLEIVRLA

51    DTVFHRNHAD DGRIHFRRGV ERFGRHVNQH FHIEEILQHH AQAAVVVAFR

101    RGNHTIDHFF LQHKVHIDDI VRHLRQLEQK RRGNVVGQVA DDFLFACDAV

151    EIKLQYIAFV NHQFIRKRQR FQTAYDVAVD FDNVQAVQLF RQRFGNRRQT

201    RTDFNHDIIR LRAHGVDNIA DNPRVLQKIL PETLAGFVFF HRVSFSVETP

251    PFRAVESDSI WEGRNSFQIR TAHRAVLYVS SCVLKHKCVY SIRLMSAL*
```

Computer analysis of this amino acid sequence gave the following results:
Homology with a Predicted ORF from *N. meningitidis*
ORF 772 shows 95.6% identity over a 298 aa overlap with a predicted ORF (ORF 772) from *N. meningitidis*
m772/a772 95.6% identity in 298 aa overlap

```
                  10         20         30         40         50         60
   a772.pep  MFGAVLRIDADCLQIIVACKLFQIVAYGFAALVEGEFHEFGEMLEIVRLADTVFHRNHAD
              ||||||||||||||||||||||||||||||||||||||||:||||||||:||||||:|
   m772      MFGAVLRIDADCLQIIVACKLFQIVAYGFAALVEGEFHEFGKMLEIVRLADAVFHRNHTD
                  10         20         30         40         50         60

70         80         90        100        110        120
   a772.pep  DGRIHFRRGVERFGRHVNQHFHIEEILQHHAQAAVVVAFRRGNHTIDHFFLQHKVHIDDI
              ||  ||||| ||||||:||||||||:|||||||||||||||||||:||||||||||||||
   m772      DGGIHFRRRVERFGRYVNQHFHIEKILQHHAQAAVVVAFRRGNHTLDHFFLQHKVHIDDI
                  70         80         90        100        110        120

130        140        150        160        170        180
   a772.pep  VRHLRQLEQKRRGNVVGQVADDFLFACDAVEIKLQYIAFVNHQFIRKRQRFQTAYDVAVD
              ||||||||||||  ||||:|||||||||||||||||||||||||||||||||||||||||
   m772      VRHLRQLEQKRCGNVVREVADDFLFACDAVEIKLQYIAFVNHQFIRKRQRFQTAYDVAVD
                 130        140        150        160        170        180

190        200        210        220        230        240
   a772.pep  FDNVQAVQLFRQRFGNRRQTRTDFNHDIIRLRAHGVDNIADNPRVLQKILPETLAGFVFF
              |||||||||||||||||||||:||||||||||||||||||||||||||||||||||||||
   m772      FDNVQAVQLFRQRFGNRRQTRADFNHDIIRLRAHGVDNIADNPRVLQKILPETLAGFVFF
                 190        200        210        220        230        240
```

```
                 250        260        270        280        290        299
a772.pep  HRVSFSVETPPFRAVESDSIWEGRNSFQIRTAHRAVLYVSSCVLKHKCVYSIRLMSALX
          |||||||||||||||||||||||||||||||| |||||||||||||||||||||||||||
m772      HRVSFSVETPPFRAVESDSIWEGRNSFQIRMAHRAVLYVSSCVLKHKCVYSIRLMSALX
                 250        260        270        280        290
``` g773.seq not found yet
g773.pep not found yet
The following partial DNA sequence was identified in *N. meningitidis* <SEQ ID 2663>:

```
m773.seq
    1   ATGGGATTGG GTGCAACGAC TTTTGTCGGT TCGGGTGCTA TAGGCGGAGG

51   TCTGTGCAGT ACCGGGATTG GCTGTGCGGC CGGTGGACTT ATTGCAACGG

101   CAGGTATGAC CGGTGGTTAT ACACAGGCCT CAGAAGGAAG CCGGCAATTG

151   TTTGGCACTT ACCAGTCCGA TTTTGGTAAA AAAGTTGTCC TATCTTTGGG

201   TACACCAATA GAATACGAAT CGCCGTTAGT ATCTGATGCG AAAAATCTAG

251   CCGTATGGGG ATTGGAAACG CTGATTACGC GCAAATTGGG AAACTTGGCA

301   ACGGGTGTGA AAACTTCCTT GACTCCGAAA ACTGCTGACG TACAGCGAAA

351   TATCCTGTCC CAATCCGAAG TCGGTATCAA GTGGGGCAAG GGGATTGAAG

401   GACAGGGAAT GCCTTGGGAG GATTATGTCG GTAAGGGCTT GTCTGCCAAT

451   GCAAGGTTAC CTAAAAATTT TAAAACATTT GATTATTTTG ATCGTGGTAC

501   AGGCACGGCA ATCAGTGCCA AAACTCTGGA TACGCAAACT ACGGCACGCC

551   TGTCCAAACC CGAACAGCTT TACAGTACCA TGAAAGGGTA CATCGATAAG

601   ACGGCAAATT TCAAAAGTTA TGAATTATCA GAAGTACCGT TAAGGGCAGA

651   CATGATCAAA CAGCGCGAAA TCCATCTGGC CATACCCGCA CAAACTAATA

701   AGGAGCAAAG ATTGCAGTTG CAACGTGTGG TAGAGTATGG CAAAAGTCAA

751   AACATTACAG TCAAAATTAC GGAGATCGAA TAA
```

This corresponds to the amino acid sequence <SEQ ID 2664; ORF 773>:

```
m773.pep
    1   MGLGATTFVG SGAIGGGLCS TGIGCAAGGL IATAGMTGGY TQASEGSRQL

51   FGTYQSDFGK KVVLSLGTPI EYESPLVSDA KNLAVWGLET LITRKLGNLA

101   TGVKTSLTPK TADVQRNILS QSEVGIKWGK GIEGQGMPWE DYVGKGLSAN

151   ARLPKNFKTF DYFDRGTGTA ISAKTLDTQT TARLSKPEQL YSTMKGYIDK

201   TANFKSYELS EVPLRADMIK QREIHLAIPA QTNKEQRLQL QRVVEYGKSQ

251   NITVKITEIE *
``` a773.seq not found yet
a773.pep not found yet
The following partial DNA sequence was identified in *N. gonorrhoeae* <SEQ ID 2665>:

```
g774.seq
    1   ATGAAGACCA AATTACCGCT TTTTATCATT TGGCTGTCTG TGTCTGCCTC

51   CTGTGCTTCC GTTTTACCCG TTCCGGAGGG CAGCCGAACC GAAATGCCGA

101   CACAGGAAAA TGCTTCAGAC GGCATTCCCT ATCCCGTTCC CACTCTGCAA
```

```
151    GACCGTTTGG ACTATCTGGA AGGCAAAATC GTCCGGCTGT CGAACGAAGT

201    GGAAATGTTA AACGGGAAAG TCAAAGCATT GGAGCATACG AAAATACACC

251    CTTCCGGCAG GACATACGTC CAAAAACTCG ACGACCGCAA ATTGAAAGAG

301    CATTACCTCA ATACCGAAGG CGGCAGCGCA TCCGCACATA CCGTCGAAAC

351    CGCACAAAAC CTCTACAATC AGGCACTCAA ACACTATCAA ACGGCAGGT

401    TTTCTGCCGC AGCCGCCTTG TTGAAGGGGG CGGACGGCGG AGACGGCGGC

451    AGCATCGCGC AACGCAGTAT GTACCTGTTG CTGCAAAGCA GGGCGCGTAT

501    GGGGAACTGT GAATCTGTCA TCGAAATCGG AGGGCGTTAC GCCAACCGTT

551    TCAAAGACAG CCCAACCGCG CCCGAAGTCA TATTCAAAAT CGGCGAATGC

601    CAATACAGGC TTCAGCAAAA AGACATTGCA AGGGCGACTT GGCGCAGCCT

651    GATACAGACC TATCCCGGCA GCCCGGCGGC AAAACGCGCC GCCGCAGCCG

701    TACGCAAACG ATAG
```

This corresponds to the amino acid sequence <SEQ ID 2666; ORF 774.ng>:

```
g774.pep
  1    MKTKLPLFII WLSVSASCAS VLPVPEGSRT EMPTQENASD GIPYPVPTLQ

51    DRLDYLEGKI VRLSNEVEML NGKVKALEHT KIHPSGRTYV QKLDDRKLKE

101    HYLNTEGGSA SAHTVETAQN LYNQALKHYQ NGRFSAAAAL LKGADGGDGG

151    SIAQRSMYLL LQSRARMGNC ESVIEIGGRY ANRFKDSPTA PEVIFKIGEC

201    QYRLQQKDIA RATWRSLIQT YPGSPAAKRA AAAVRKR*
```

The following partial DNA sequence was identified in *N. meningitidis* <SEQ ID 2667>:

```
m774.seq
  1    ATGAAGATCA AATTACCGCT TTTTATCATT TGGCTGTCTG TGTCCGCCTC

51    CTGTGCTTCC GTTTCACCCG TTCCGGCAGG CAGCCAAACC GAAATGTCGA

101    CACGGGAAAA TGCTTCAGAC GGCATTCCCT ATCCCGTTCC GACCTTGCAA

151    GACCGTTTGG ACTATCTGGA AGGCAAAATC GTCCGGCTGT CGAACGAAGT

201    GGAAACCTTA AACGGCAAAG TCAAAGCACT GGAACACGCA AAAACACATT

251    CTTCCGGCAG GCATACGTC CAAAAACTCG ACGACCGCAA GTTGAAAGAG

301    CATTACCTCA ATACCGAAGG CGGCAGCGCA TCCGCACATA CTGTCGAAAC

351    CGCACAAAAC CTCTACAATC AGGCACTCAA ACACTATAAA AGCGGCAAGT

401    TTTCTGCCGC TGCCTCCCTG TTGAAAGGCG CGGACGGAGG CGACGGCGGC

451    AGCATCGCGC AACGCAGTAT GTACCTGTTG CTGCAAAGCA GGGCGCGTAT

501    GGGCAACTGC GAATCCGTCA TCGAAATCGG AGGGCGTTAC GCCAACCGTT

551    TCAAAGACAG CCCAACCGCG CCTGAAGCCA TGTTCAAAAT CGGCGAATGC

601    CAATACAGGC TTCAGCAAAA AGACATTGCA AGGGCGACTT GGCGCAGCCT

651    GATACAGACC TATCCCGGCA GCCCGGCGGC AAAACGCGCC GCCGCAGCCG

701    TGCGCAAACG ATAG
```

This corresponds to the amino acid sequence <SEQ ID 2668; ORF 774>:

```
m774.pep
     1    MKIKLPLFII WLSVSASCAS VSPVPAGSQT EMSTRENASD GIPYPVPTLQ

51    DRLDYLEGKI VRLSNEVETL NGKVKALEHA KTHSSGRAYV QKLDDRKLKE

101    HYLNTEGGSA SAHTVETAQN LYNQALKHYK SGKFSAAASL LKGADGGDGG

151    SIAQRSMYLL LQSRARMGNC ESVIEIGGRY ANRFKDSPTA PEAMFKIGEC

201    QYRLQQKDIA RATWRSLIQT YPGSPAAKRA AAAVRKR*
```

Computer analysis of this amino acid sequence gave the following results:
Homology with a Predicted ORF from *N. gonorrhoeae*
ORF 774 shows 92.8% identity over a 237 aa overlap with a predicted ORF (ORF 774) from *N. gonorrhoeae*
m774/g774 92.8% identity in 237 aa overlap

```
                   10         20         30         40         50         60
g774.pep   MKTKLPLFIIWLSVSASCASVLPVPEGSRTEMPTQENASDGIPYPVPTLQDRLDYLEGKI
           || |||||||||||||||| ||| ||:||| :||||||||||||||||||||||||||||
m774       MKIKLPLFIIWLSVSASCASVSPVPAGSQTEMSTRENASDGIPYPVPTLQDRLDYLEGKI
                   10         20         30         40         50         60

70         80         90        100        110        120
g774.pep   VRLSNEVEMLNGKVKALEHTKIHPSGRTYVQKLDDRKLKEHYLNTEGGSASAHTVETAQN
           |||||||| |||||||||||:|  |||:||||||||||||||||||||||||||||||||
m774       VRLSNEVETLNGKVKALEHAKTHSSGRAYVQKLDDRKLKEHYLNTEGGSASAHTVETAQN
                   70         80         90        100        110        120

130        140        150        160        170        180
g774.pep   LYNQALKHYQNGRFSAAAALLKGADGDGGSIAQRSMYLLLQSRARMGNCESVIEIGGRY
           ||||||||| :: :||||:|||||||||||||||||||||||||||||||||||||||
m774       LYNQALKHYKSGKFSAAASLLKGADGGDGGSIAQRSMYLLLQSRARMGNCESVIEIGGRY
                  130        140        150        160        170        180

190        200        210        220        230
g774.pep   ANRFKDSPTAPEVIFKIGECQYRLQQKDIARATWRSLIQTYPGSPAAKRAAAAVRKRX
           ||||||||||||: :||||||||||||||||||||||||||||||||||||||||||
m774       ANRFKDSPTAPEAMFKIGECQYRLQQKDIARATWRSLIQTYPGSPAAKRAAAAVRKRX
                  190        200        210        220        230
```

The following partial DNA sequence was identified in *N. meningitidis* <SEQ ID 2669>:

```
a774.seq
     1    ATGAAGACCA AATTACCGCT TTTTATCATT TGGCTGTCCG TATCCGCCGC

51    CTGTTCTTCC CCTGTTTCCC GCAATATTCA GGATATGCGG CTCGAACCGC

101    AGGCAGAGGC AGGTAGTTCG GACGCTATTC CCTATCCCGT TCCCACTCTG

151    CAAGACCGTT TGGATTATCT GGAAGGCACA CTCGTCCGCC TGTCGAACGA

201    AGTGGAAACC TTAAACGGCA AAGTCAAAGC ACTGGAGCAT GCGAAAACAC

251    ACCCTTCCAG CAGGGCATAC GTCCAAAAAC TCGACGACCG CAAGTTGAAA

301    GAGCATTACC TCAATACCGA AGGCGGCAGC GCATCCGCAC ATACCGTCGA

351    AACCGCACAA AACCTCTACA ATCAGGCACT CAAACACTAT AAAAGCGGCA

401    GGTTTTCTGC CGCTGCCTCC CTGTTGAAAG GCGCGGACGG AGGCGACGGC

451    GGCAGCATCG CGCAACGCAG TATGTACCTG TTGCTGCAAA GCAGGGCGCG

501    TATGGGCAAC TGCGAATCCG TCATCGAAAT CGGAGGGCGT TACGCCAACC

551    GTTTCAAAGA CAGCCCAACC GCGCCTGAAG CCATGTTCAA AATCGGCGAA

601    TGCCAATACA GGCTTCAGCA AAAAGACATT GCAAGGGCGA CTTGGCGCAG

651    CCTGATACAG ACCTATCCCG GCAGCCCGGC GGCAAAACGC GCCGCCGCAG

701    CCGTGCGCAA ACGATAG
```

This corresponds to the amino acid sequence <SEQ ID 2670; ORF 774.a>:

```
a774.pep
    1   MKTKLPLFII WLSVSAACSS PVSRNIQDMR LEPQAEAGSS DAIPYPVPTL

51   QDRLDYLEGT LVRLSNEVET LNGKVKALEH AKTHPSSRAY VQKLDDRKLK

101   EHYLNTEGGS ASAHTVETAQ NLYNQALKHY KSGRFSAAAS LLKGADGGDG

151   GSIAQRSMYL LLQSRARMGN CESVIEIGGR YANRFKDSPT APEAMFKIGE

201   CQYRLQQKDI ARATWRSLIQ TYPGSPAAKR AAAAVRKR*
```

Computer analysis of this amino acid sequence gave the following results:
Homology with a Predicted ORF from *N. meningitidis*
ORF 774 shows 89.5% identity over a 238 aa overlap with a predicted ORF (ORF 774) from *N. meningitidis*
m774/a774 89.5% identity in 238 aa overlap

```
                   10         20         30         40         50         60
    a774.pep   MKTKLPLFIIWLSVSAACSSPVSRNIQDMRLEPQAEAGSSDAIPYPVPTLQDRLDYLEGT
               || |||||||||||||:|:| ||    :  | :::  ::||:|||||||||||||||||
    m774       MKIKLPLFIIWLSVSASCAS-VSPVPAGSQTEMSTRENASDGIPYPVPTLQDRLDYLEGT
                      10         20         30         40         50
                   70         80         90        100        110        120
    a774.pep   LVRLSNEVETLNGKVKALEHAKTHPSSRAYVQKLDDRKLKEHYLNTEGGSASAHTVETAQ
               :||||||||||||||||||||||||:|:||||||||||||||||||||||||||||||||
    m774       IVRLSNEVETLNGKVKALEHAKTHSSGRAYVQKLDDRKLKEHYLNTEGGSASAHTVETAQ
                   60         70         80         90        100        110
                  130        140        150        160        170        180
    a774.pep   NLYNQALKHYKSGRFSAAASLLKGADGGDGGSIAQRSMYLLLQSRARMGNCESVIEIGGR
               ||||||||||||:|||||||||||||||||||||||||||||||||||||||||||||||
    m774       NLYNQALKHYKSGKFSAAASLLKGADGGDGGSIAQRSMYLLLQSRARMGNCESVIEIGGR
                  120        130        140        150        160        170
                  190        200        210        220        230      239
    a774.pep   YANRFKDSPTAPEAMFKIGECQYRLQQKDIARATWRSLIQTYPGSPAAKRAAAAVRKRX
               |||||||||||||||||||||||||||||||||||||||||||||||||||||||||||
    m774       YANRFKDSPTAPEAMFKIGECQYRLQQKDIARATWRSLIQTYPGSPAAKRAAAAVRKRX
                  180        190        200        210        220        230
``` g790.seq not found yet
g790.pep not found yet
The following partial DNA sequence was identified in *N. meningitidis* <SEQ ID 2671>:

```
m790.seq
    1   ATGGCAAGAA GGTCAAAAAC ATTTGAAGAA GCTGCTGCTG AGGTTGAGGA

51   ACGTTTCGGT CATCGTGGCA TTAAGTTGGT CGAGTTTGAG GGTACAGCCA

101   AGCCGTGTGT AATCAACTGC CCTAAACATG GAAACCAAAC CTGTTCGAGG

151   TACTCCAATA TGTTCATAGG AAGTAGCTGG GGTTGCCCCT CTTGTGGTAA

201   TGAGCAAGCT GCAAAAGCCG GTATAGCGAC CCTTAGGAAG AATCACATAG

251   CGTTAGAAAT GCTGAAACAG GCTGTAACAG GTATGACCAA GCAAGAGCGC

301   ATCACGACGC AAGCCTACAA TGAGATGACC AAATCCGTGG CAGGTTCAAA

351   CAGCATAGTC CTTAACGATG TCCAAGGCGA TACGACCATC AACAACCATC

401   ATACGCATAC GCACAACCAC AGCGATGCCG ATGGCAAAGC ACTGTCGATG

451   AGGCTCACAC CCCGTCCTTT GTTGTCAGAC CGTCAGGCGG CGGCTTTCGC

501   CCGTACAGGC AAACTCACGG GCAGTTTCGA CCTGTTTGCT TCGGTGgTCG

551   CCCCCTCGCA GTACACGTTT GCCGTTGCCA TGCCCGACAC GTCCATGTCG

601   CCGGTTATCG AAAAGGGAGA CTTGCTGGTG GTCGAGCCGC GTATGTGCCC
```

```
      651  TGCGGACGAA GACATCGCGC TGATTGAACT GTCCGACAAG CGGCTGGTCG

701  TCGCGCACCT TGTTATCGAT ATTGCGGGCA GGATGCTGAT TTATCAGACG

751  GGCAGGCCGT CTGAAGCCTT TGACCTGCCC GAAGGCAGCA CGATTTTAGG

801  TGTGGTGCTG GAGTCAAAAA ACGGTTTATG TCCGCCGCAC AGGCAAGAAG

851  GCGTGTTGAT TCGGATTACC GCCCCTGATG TGTGGACGGT TGGTATGATT

901  TCCGCTTCCA AAACGTCGTG TACGCGCCCG ACCGCAGCCC GGAAATCAGC

951  CGTATGCTTT CTTCGATTTT GGCAGGCTAC GCGTGGGATA CCGAAAACCC

1001  GTTCGTGGCG AAATCCGAAC AACGCCTGA
```

This corresponds to the amino acid sequence <SEQ ID 2672; ORF 790>:

```
m790.pep
       1  MARRSKTFEE AAAEVEERFG HRGIKLVEFE GTAKPCVINC PKHGNQTCSR

51  YSNMFIGSSW GCPSCGNEQA AKAGIATLRK NHIALEMLKQ AVTGMTKQER

101  ITTQAYNEMT KSVAGSNSIV LNDVQGDTTI NNHHTHTHNH SDADGKALSM

151  RLTPRPLLSD RQAAAFARTG KLTGSFDLFA SVVAPSQYTF AVAMPDTSMS

201  PVIEKGDLLV VEPRMCPADE DIALIELSDK RLVVAHLVID IAGRMLIYQT

251  GRPSEAFDLP EGSTILGVVL ESKNGLCPPH RQEGVLIRIT APDVWTVGMI

301  SASKTSCTRP TAARKSAVCF LRFWQATRGI PKTRSWRNPN NA*
```

The following partial DNA sequence was identified in *N. meningitidis* <SEQ ID 2673>:

```
a790.seq
       1  ATGGCAAGAA GGTCAAAAAC ATTTGAAGAA GCTGCTGCTG AGGTTGAGGA

51  ACGTTTCGGT CATCGTGGCA TTAAGTTGGT CGAGTTTGAG GGTACAGCCA

101  AGCCGTGTGT AATCAACTGC CCTAAACATG GAAACCAAAC CTGTTCGAGG

151  TACTCCAATA TGTTCATAGG AAGTAGCTGG GGTTGCCCCT CTTGTGGTAA

201  TGAGCAAGCT GCAAAAGCCG GTATAGCGAC CCTTAGGAAG AATCACATAG

251  CGTTAGAAAT GCTGAAACAG GCTGTAACAG GTATGACCAA GCAAGAGCGC

301  ATCACGACGC AAGCCTACAA TGAGATGACC AAATCCGTGG CAGGTTCAAA

351  CAGCATAATC CTTAACGATG TCCAAGGCGA TACGACCATC AACAACCATC

401  ATACGCATAC GCACAACCAC AGCGATGCCG ACGGCAAAGC ACTGTCGATG

451  AGGCTCACAC CCCGTCCTTT GTTGTCAGAC CGTCAGGCGG CGGCTTTCGC

501  CCGTACAGGC AAACTCACGG GCAGTTTCGA CCTGTTTGCT TCGGTGGTCG

551  CCCCTTCACA ATATACGTTT GCCGTTGCCA TGCCCGACAC GTCCATGTCG

601  CCGGTTATCG AAAAGGGGGA TTTGCTGGTG GTCGAGCCGC GTATGCGCCC

651  TGCGGACGAA GACATCGTAC TGATTGAACT GTCCGACAAG CGGCTGGTCG

701  TCGCGCACCT TGTTATCGAT ATTGCGGGCA GGATGCTGAT TTATCAGACG

751  GGCAGGCCGT CTGAAGCCCT CGACCTGCCC GAAGGCAGCG TGATTTTAGG

801  TGTGGTGCTG GAGTCAAAAA ACGGTTTATG TCCGCCGCAC AGGCAAGAAG

851  GCGTGTTGAT TCGGATTACC GCCCCTGATG TGTGGACGGT TGGTACGATT

901  TCCGCTTCCA AAACGTCGTG TACGCGCCCG ACCGCAGCCC GGAAATCAGC
```

-continued

```
 951  CGTATGCTTT CTTCGATTTT GGCAGGCTAC GCGTGGGATA CCGAAAACCC

1001  GTTCGTGGCG AAATCCGAAC AACGCCTGT
```

This corresponds to the amino acid sequence <SEQ ID 2674; ORF 790.a>:

```
a790.pep
   1   MARRSKTFEE AAAEVEERFG HRGIKLVEFE GTAKPCVINC PKHGNQTCSR

51   YSNMFIGSSW GCPSCGNEQA AKAGIATLRK NHIALEMLKQ AVTGMTKQER

101   ITTQAYNEMT KSVAGSNSII LNDVQGDTTI NNHHTHTHNH SDADGKALSM

151   RLTPRPLLSD RQAAAFARTG KLTGSFDLFA SVVAPSQYTF AVAMPDTSMS

201   PVIEKGDLLV VEPRMRPADE DIVLIELSDK RLVVAHLVID IAGRMLIYQT

251   GRPSEALDLP EGSVILGVVL ESKNGLCPPH RQEGVLIRIT APDVWTVGTI

301   SASKTSCTRP TAARKSAVCF LRFWQATRGI PKTRSWRNPN NAC
```

Computer analysis of this amino acid sequence gave the following results:
Homology with a Predicted ORF from *N. meningitidis*
ORF 790 shows 98.2% identity over a 342 aa overlap with a predicted ORF (ORF 790) from *N. meningitidis*
a790/m790 98.2% identity in 342 aa overlap

```
                    10         20         30         40         50         60
    a790.pep  MARRSKTFEEAAAEVEERFGHRGIKLVEFEGTAKPCVINCPKHGNQTCSRYSNMFIGSSW
              ||||||||||||||||||||||||||||||||||||||||||||||||||||||||||||
    m790      MARRSKTFEEAAAEVEERFGHRGIKLVEFEGTAKPCVINCPKHGNQTCSRYSNMFIGSSW
                    10         20         30         40         50         60
                    70         80         90        100        110        120
    a790.pep  GCPSCGNEQAAKAGIATLRKNHIALEMLKQAVTGMTKQERITTQAYNEMTKSVAGSNSII
              |||||||||||||||||||||||||||||||||||||||||||||||||||||||||||:
    m790      GCPSCGNEQAAKAGIATLRKNHIALEMLKQAVTGMTKQERITTQAYNEMTKSVAGSNSIV
                    70         80         90        100        110        120
                   130        140        150        160        170        180
    a790.pep  LNDVQGDTTINNHHTHTHNHSDADGKALSMRLTPRPLLSDRQAAAFARTGKLTGSFDLFA
              ||||||||||||||||||||||||||||||||||||||||||||||||||||||||||||
    m790      LNDVQGDTTINNHHTHTHNHSDADGKALSMRLTPRPLLSDRQAAAFARTGKLTGSFDLFA
                   130        140        150        160        170        180
                   190        200        210        220        230        240
    a790.pep  SVVAPSQYTFAVAMPDTSMSPVIEKGDLLVVEPRMRPADEDIVLIELSDKRLVVAHLVID
              ||||||||||||||||||||||||||||||||||||:|||||:|||||||||||||||||
    m790      SVVAPSQYTFAVAMPDTSMSPVIEKGDLLVVEPRMCPADEDIALIELSDKRLVVAHLVID
                   190        200        210        220        230        240
                   250        260        270        280        290        300
    a790.pep  IAGRMLIYQTGRPSEALDLPEGSVILGVVLESKNGLCPPHRQEGVLIRITAPDVWTVGTI
              |||||||||||||||:||||||||:|||||||||||||||||||||||||||||||||| |
    m790      IAGRMLIYQTGRPSEAFDLPEGSTILGVVLESKNGLCPPHRQEGVLIRITAPDVWTVGMI
                   250        260        270        280        290        300
                   310        320        330        340
    a790.pep  SASKTSCTRPTAARKSAVCFLRFWQATRGIPKTRSWRNPNNAC
              |||||||||||||||||||||||||||||||||||||||||
    m790      SASKTSCTRPTAARKSAVCFLRFWQATRGIPKTRSWRNPNNAX
                   310        320        330        340
```

The following partial DNA sequence was identified in *N. gonorrhoeae* <SEQ ID 2675>:

```
g791.seq
   1   ATGGTAAATT ATTATTCAGC TATGATTAAA AAGATTTTAA CTACTTGTTT

51   TGGTTTGTTT TTTGGTTTTT GTGTATTTGG AGTGGGTCTG GTTGCCATTG

101   CTATTTTGGT AACGTATCCG AAACTGCCGT CTTTGGATTC TTTGCAGCAT

151   TACCAGCCTA AAATGCCGTT GACTATTTAT TCGGCGGATG GAGAAGTCAT
```

```
 201  CGGTATGTAT GGGGAGCAGC GGCGCGAATT TACAAAAATC GGCGATTTCC
 251  CCGAGGTGTT GCGGAATGCG GTTATTGCCG CCGAGGATAA ACGCTTTTAC
 301  CGGCATTGGG GGGTGGATGT TTGGGGTGTT GCCCGCGCTG CCGTCGGCAA
 351  TGTCGTGTCC GGCAGCGTGC AGTCGGGTGC GAGTACGATT ACACAGCAGG
 401  TGGCGAAAAA TTTTTATTTG AGCAGTGAAA AAACGTTCAC ACGCAAATTC
 451  AATGAGGTGT TGCTTGCCTA TAAAATCGAG CAGTCTTTAA GCAAAGACAA
 501  AATCCTTGAG TTGTATTTCA ATCAGATTTA CCTCGGTCAG CGCGCCTATG
 551  GTTTTGCATC TGCCGCGCAA ATCTATTTCA ATAAGAATGT CCGAGATTTG
 601  ACTTTGGCGG AAGCCGCCAT GCTTGCGGGA CTGCCCAAGG CTCCGTCTGC
 651  CTATAATCCG ATTGTTAATC CGGAGCGTGC CAAGTTGCGC CAGAAGTATA
 701  TTTTGAACAA TATGCTCGAG GAGAAGATGA TTACCGTGCA ACAGCGCGAT
 751  CAGGCATTGA ATGAGGAACT GCATTATGAG CGGTTTGTTC GGAAAATCGA
 801  TCAGAGTGCT TTATATGTGG CGGAAATGGT GCGTCGGGAA CTGTATGAGA
 851  AATATGGTGA AGATGCCTAT ACGCAGGGTT TTAAGGTTTA TACCACGGTC
 901  CGCACCGATC ATCAGAAGGC GGCAACCGAG GCATTGCGCA AGGCTCTACG
 951  GAATTTCGAT CGCGGCAGCA GCTACCGCGG TGCGGAAAAC TATATCGATT
1001  TGAGTAAGAG TGAAGATGTC GAGGAGACTG TCAGCCAGTA TCTGTCGGGA
1051  CTCTATACCG TCGATAAAAT GGTTCCCGCC GTTGTGTTGG ATGTTACTAA
1101  AAAGAAAAAT GTCGTCATAC AGCTGCCCGG CGGCAGGCGG GTTGCGCTTG
1151  ACAGGCGCGC CTTGGGTTTT GCGGCCCGAG CGGTCGATAA TGAGAAAATG
1201  GGGGAGGACC GTATCCGCAG GGGCGCGGTC ATCCGTGTCA AAACAACGG
1251  CGGGCGTTGG GCGGTGGTTC AAGAGCCGTT GCTGCAGGGG CTTTGGTTT
1301  CGCTGGATGC AAAAACCGGA GCTGTGCGCG CGCTGGTCGG CGGTTATGAT
1351  TTTCACAGCA AACATTCAA TCGTGCCGTT CAGGCAATGC GGCAGCGGG
1401  TTCGACCTTT AAGCCGTTTG TCTATTCGGC GGCATTATCT AAGGGGATGA
1451  CCGCGTCCAC AGTGGTTAAC GATGCGCCGA TTTCCCTGCC GGGGAAAGGG
1501  CCGAACGGTT CGGTTTGGAC ACCTAAAAAT TCAGACGGCA GATATTCCGG
1551  CTACATTACT TTGAGACAGG CTCTGACGGC TTCCAAGAAT ATGGTTTCCA
1601  TCCGTATTTT GATGTCTATC GGTGTCGGTT ACGCGCAACA GTATATCCGG
1651  CGTTTCGGCT TCAGGCCGTC CGAGCTGCCG GCAAGCCTGT CTATGGCTTT
1701  AGGTACGGGC GAGACGACGC CGTTGAAAGT GGCGGAGGCA TATAGTGTAT
1751  TTGCGAACGG CGGATATAGG GTTTCTTCGC ACGTGATCGA TAAGATTTAT
1801  GACAGAGACG GCAGGTTGCG CGCCCAAATG CAACCTTTGG TGGCAGGGCA
1851  AAATGCGCCT CAGGCAATCG ATCCGCGCAA TGCCTATATT ATGTATAAGA
1901  TTATGCAGGA TGTGGTCCGT GTCGGTACGG CAAGGGGGGC AGCTGCGTTG
1951  GGAAGAACGG ATATTGCCGG TAAAACGGGT ACGACCAACG ACAATAAAGA
2001  TGCGTGGTTT GTCGGTTTTA ACCCTGATGT GGTTACTGCC GTATATATCG
2051  GCTTCGACAA ACCTAAGAGT ATGGGGCGTG CCGGCTACGG CGGTACGATT
2101  GCGGTGCCGG TTTGGGTGGA CTATATGCGT TTTGCGTTGA AAGGAAAGCA
2151  GGGCAAAGGG ATGAAAATGC CTGAAGGTGT GGTCAGCAGC AATGGCGAAT
```

-continued

```
2201    ACTATATGAA GGAACGTATG GTAACCGATC CGGGCTTGAT GCTGGACAAC

2251    AGCGGTATTG CGCCGCAACC TTCCCGACGG GCAAAAGAAG ATGATGAAGC

2301    GGCAGTAGAA AACGAACAGC AGGGAAGGTC TGACGAAACG CGTCAGGACG

2351    TACAGGAAAC GCCGGTGCTT CCGAGCAATA CGGATTCCAA ACAGCAGCAG

2401    TTGGATTCCC TGTTTTAA
```

This corresponds to the amino acid sequence <SEQ ID 2676; ORF 791.ng>:

```
g791.pep
     1  MVNYYSAMIK KILTTCFGLF FGFCVFGVGL VAIAILVTYP KLPSLDSLQH

51  YQPKMPLTIY SADGEVIGMY GEQRREFTKI GDFPEVLRNA VIAAEDKRFY

101  RHWGVDVWGV ARAAVGNVVS GSVQSGASTI TQQVAKNFYL SSEKTFTRKF

151  NEVLLAYKIE QSLSKDKILE LYFNQIYLGQ RAYGFASAAQ IYFNKNVRDL

201  TLAEAAMLAG LPKAPSAYNP IVNPERAKLR QKYILNNMLE EKMITVQQRD

251  QALNEELHYE RFVRKIDQSA LYVAEMVRRE LYEKYGEDAY TQGFKVYTTV

301  RTDHQKAATE ALRKALRNFD RGSSYRGAEN YIDLSKSEDV EETVSQYLSG

351  LYTVDKMVPA VVLDVTKKKN VVIQLPGGRR VALDRRALGF AARAVDNEKM

401  GEDRIRRGAV IRVKNNGGRW AVVQEPLLQG ALVSLDAKTG AVRALVGGYD

451  FHSKTFNRAV QAMRQPGSTF KPFVYSAALS KGMTASTVVN DAPISLPGKG

501  PNGSVWTPKN SDGRYSGYIT LRQALTASKN MVSIRILMSI GVGYAQQYIR

551  RFGFRPSELP ASLSMALGTG ETTPLKVAEA YSVFANGGYR VSSHVIDKIY

601  DRDGRLRAQM QPLVAGQNAP QAIDPRNAYI MYKIMQDVVR VGTARGAAAL

651  GRTDIAGKTG TTNDNKDAWF VGFNPDVVTA VYIGFDKPKS MGRAGYGGTI

701  AVPVWVDYMR FALKGKQGKG MKMPEGVVSS NGEYYMKERM VTDPGLMLDN

751  SGIAPQPSRR AKEDDEAAVE NEQQGRSDET RQDVQETPVL PSNTDSKQQQ

801  LDSLF*
```

The following partial DNA sequence was identified in *N. meningitidis* <SEQ ID 2677>:

```
m791.seq
     1  ATGGTAAATT ATTATTCAGC TATGATTAAA AAGATTTTAA CGACTTGTTT

51  TGGTTTGGTT TTTGGGTTTT GTGTATTTGG AGTGGGTTTG GTTGCCATTG

101  CTATTTTGGT AACGTATCCG AAACTGCCGT CTTTGGATTC TTTGCAGCAT

151  TACCAGCCTA AAATGCCGTT GACTATTTAT TCGGCGGATG GGGAAGTCAT

201  CGGTATGTAT GGGGAGCAGC GGCGCGAATT TACAAAAATC GGCGATTTCC

251  CAGAGGTGTT GCGGAATGCG GTTATCGCCG CCGAGGATAA ACGCTTTTAC

301  CGGCATTGGG GGGTGGATGT TTGGGGTGTT GCCCGCGCTG CCGTCGGCAA

351  TGTCGTGTCC GGCAGCGTGC AGTCGGGTGC GAGTACGATT ACGCAGCAGG

401  TGGCGAAAAA TTTTTATTTG AGCAGTGAAA AAACGTTCAC ACGCAAATTC

451  AATGAGGTGT TGCTTGCCTA TAAAATCGAG CAGTCTTTAA GCAAAGACAA
```

```
 501 AATCCTCGAG TTGTATTTCA ATCAGATTTA CCTCGGTCAG CGCGCCTATG
 551 GTTTTGCATC TGCCGCGCAA ATCTATTTCA ATAAGAATGT CCGAGATTTG
 601 ACTTTGGCGG AAGCCGCCAT GCTTGCGGGA CTGCCCAAGG CTCCGTCTGC
 651 CTATAATCCG ATTGTTAATC CAGAACGTGC CAAGTTGCGC CAGAAGTATA
 701 TTTTGAACAA TATGCTCGAG GAGAAGATGA TTACCGTGCA ACAGCGCGAT
 751 CAGGCGTTGA ATGAGGAACT GCATTACGAG CGGTTTGTTC GGAAAATCGA
 801 TCAGAGTGCG TTATATGTGG CGGAAATGGT GCGTCAGGAA CTGTATGAGA
 851 AATACGGTGA AGATGCCTAT ACGCAGGGTT TTAAGGTTTA TACCACGGTC
 901 CGCGCCGATC ATCAGAAGGT GGCAACCGAG GCATTGCGCA AGGCTCTACG
 951 GAATTTCGAT CGCGGCAGCA GCTACCGCGG TGCGGAAAAC TATATCGATT
1001 TGAGTAAGAG TGAAGATGTC GAGGAGACTG TCAGCCAGTA TCTGTCGGGA
1051 CTCTATACCG TCGATAAAAT GGTTCCCGCC GTTGTGTTGG ATGTGACTAA
1101 AAAGAAAAAT GTCGTCATAC AGCTGCCCGG CGGCAGGCGG GTTACGCTTG
1151 ACAGGCGCGC CTTGGGTTTT GCGGCCCGCG CGGTCAATAA TGAAAAAATG
1201 GGGGAGGACC GTATCCGCAG GGGCGCGGTC ATCCGTGTCA AAACAACGG
1251 CGGGCGTTGG GCGGTGGTTC AAGAGCCGTT GCTGCAGGGG CTTTGGGTT
1301 CGCTGGATGC AAAAACCGGA GCTGTGCGCG CGCTGGTCGG CGGTTATGAT
1351 TTTCACAGCA AAACATTCAA TCGTGCCGTT CAGGCAATGC GGCAGCCGGG
1401 TTCGACCTTT AAGCCGTTTG TCTATTCGGC GGCATTATCT AAGGGGATGA
1451 CCGCGTCCAC AGTGGTTAAC GATGCGCCGA TTTCCCTGCC GGGGAAAGGG
1501 CCGAACGGTT CGGTTTGGAC ACCTAAAAAT TCAGACGGCA GATATTCCGG
1551 CTACATTACT TTGAGACAGG CTCTGACGGC TTCCAAGAAT ATGGTTTCCA
1601 TCCGTATTTT GATGTCTATC GGTGTCGGTT ACGCGCAACA GTATATCCGG
1651 CGTTTCGGCT TCAGGTCGTC CGAGCTGCCG GCAAGCCTGT CTATGGCTTT
1701 AGGTACGGGC GAGACAACGC CGTTGAAAGT GGCGGAGGCA TATAGCGTAT
1751 TTGCGAACGG CGGATATAGG GTTTCTTCGC ACGTAATCGA TAAGATTTAT
1801 GACAGAGACG GCAGGTTGCG CGCCCAAATG CAACCTTTGG TGGCTGGGCA
1851 AAATGCGCCT CAGGCAATCG ATCCGCGCAA TGCCTATATT ATGTATAAGA
1901 TTATGCAGGA TGTGGTCCGT GTTGGTACGG CAAGGGGGGC AGCTGCGTTG
1951 GGAAGAACGG ATATTGCCGG TAAAACGGGT ACGACCAATG ACAATAAGGA
2001 TGCGTGGTTT GTCGGTTTTA ACCCTGATGT GGTTACTGCC GTATATATCG
2051 GCTTCGACAA ACCTAAGAGT ATGGGGCGTG TCGGCTACGG CGGTACGATT
2101 GCGGTGCCGG TTTGGGTGGA CTATATGCGT TTTGCGTTGA AAGGAAAGCA
2151 GGGCAAGGGG ATGAAAATGC CTGAAGGTGT GGTCAGCAGC AATGGCGAAT
2201 ACTATATGAA GGAACGTATG GTAACCGATC CGGGCTTGAC GCTGGACAAC
2251 AGCGGTATTG CGCCGCAACC TTCCCGACGG GCAAAAGAAG ATGACGGGGG
2301 CGCGGCAGAA GGCGGACGGC AGGCGGCGGA TGACGAAGTC CGCCAAGATA
2351 TGCAGGAAAC GCCGGTGCTT CCGAGTAATA CTGGTTCCAA ACAGCAGCAG
2401 TTGGATTCTC TGTTTTAA
```

This corresponds to the amino acid sequence <SEQ ID 2678; ORF 791>:

```
m791.pep
    1   MVNYYSAMIK KILTTCFGLV FGFCVFGVGL VAIAILVTYP KLPSLDSLQH

51   YQPKMPLTIY SADGEVIGMY GEQRREFTKI GDFPEVLRNA VIAAEDKRFY

101   RHWGVDVWGV ARAAVGNVVS GSVQSGASTI TQQVAKNFYL SSEKTFTRKF

151   NEVLLAYKIE QSLSKDKILE LYFNQIYLGQ RAYGFASAAQ IYFNKNVRDL

201   TLAEAAMLAG LPKAPSAYNP IVNPERAKLR QKYILNNMLE EKMITVQQRD

251   QALNEELHYE RFVRKIDQSA LYVAEMVRQE LYEKYGEDAY TQGFKVYTTV

301   RADHQKVATE ALRKALRNFD RGSSYRGAEN YIDLSKSEDV EETVSQYLSG

351   LYTVDKMVPA VVLDVTKKKN VVIQLPGGRR VTLDRRALGF AARAVNNEKM

401   GEDRIRRGAV IRVKNNGGRW AVVQEPLLQG ALGSLDAKTG AVRALVGGYD

451   FHSKTFNRAV QAMRQPGSTF KPFVYSAALS KGMTASTVVN DAPISLPGKG

501   PNGSVWTPKN SDGRYSGYIT LRQALTASKN MVSIRILMSI GVGYAQQYIR

551   RFGFRSSELP ASLSMALGTG ETTPLKVAEA YSVFANGGYR VSSHVIDKIY

601   DRDGRLRAQM QPLVAGQNAP QAIDPRNAYI MYKIMQDVVR VGTARGAAAL

651   GRTDIAGKTG TTNDNKDAWF VGFNPDVVTA VYIGFDKPKS MGRVGYGGTI

701   AVPVWVDYMR FALKGKQGKG MKMPEGVVSS NGEYYMKERM VTDPGLTLDN

751   SGIAPQPSRR AKEDDGGAAE GGRQAADDEV RQDMQETPVL PSNTGSKQQQ

801   LDSLF*
``` g791/m791 97.3% identity in 805 aa overlap

```
                  10         20         30         40         50         60
g791.pep  MVNYYSAMIKKILTTCFGLFFGFCVFGVGLVAIAILVTYPKLPSLDSLQHYQPKMPLTIY
          |||||||||||||||||||| ||||||||||||||||||||||||||||||||||||||||
m791      MVNYYSAMIKKILTTCFGLVFGFCVFGVGLVAIAILVTYPKLPSLDSLQHYQPKMPLTIY
                  10         20         30         40         50         60

70         80         90        100        110        120
g791.pep  SADGEVIGMYGEQRREFTKIGDFPEVLRNAVIAAEDKRFYRHWGVDVWGVARAAVGNVVS
          ||||||||||||||||||||||||||||||||||||||||||||||||||||||||||||
m791      SADGEVIGMYGEQRREFTKIGDFPEVLRNAVIAAEDKRFYRHWGVDVWGVARAAVGNVVS
                  70         80         90        100        110        120

130        140        150        160        170        180
g791.pep  GSVQSGASTITQQVAKNFYLSSEKTFTRKFNEVLLAYKIEQSLSKDKILELYFNQIYLGQ
          ||||||||||||||||||||||||||||||||||||||||||||||||||||||||||||
m791      GSVQSGASTITQQVAKNFYLSSEKTFTRKFNEVLLAYKIEQSLSKDKILELYFNQIYLGQ
                 130        140        150        160        170        180

190        200        210        220        230        240
g791.pep  RAYGFASAAQIYFNKNVRDLTLAEAAMLAGLPKAPSAYNPIVNPERAKLRQKYILNNMLE
          ||||||||||||||||||||||||||||||||||||||||||||||||||||||||||||
m791      RAYGFASAAQIYFNKNVRDLTLAEAAMLAGLPKAPSAYNPIVNPERAKLRQKYILNNMLE
                 190        200        210        220        230        240

250        260        270        280        290        300
g791.pep  EKMITVQQRDQALNEELHYERFVRKIDQSALYVAEMVRRELYEKYGEDAYTQGFKVYTTV
          ||||||||||||||||||||||||||||||||||||||||:|||||||||||||||||||
m791      EKMITVQQRDQALNEELHYERFVRKIDQSALYVAEMVRQELYEKYGEDAYTQGFKVYTTV
                 250        260        270        280        290        300

310        320        330        340        350        360
g791.pep  RTDHQKAATEALRKALRNFDRGSSYRGAENYIDLSKSEDVEETVSQYLSGLYTVDKMPVA
          |:|||:||||||||||||||||||||||||||||||||||||||||||||||||||||||
m791      RADHQKVATEALRKALRNFDRGSSYRGAENYIDLSKSEDVEETVSQYLSGLYTVDKMPVA
                 310        320        330        340        350        360

370        380        390        400        410        420
g791.pep  VVLDVTKKKNVVIQLPGGRRVALDRRALGFAARAVDNEKMGEDRIRRGAVIRVKNNGGRW
          ||||||||||||||||||||| ||||||||||||||:|||||||||||||||||||||||
m791      VVLDVTKKKNVVIQLPGGRRVTLDRRALGFAARAVNNEKMGEDRIRRGAVIRVKNNGGRW
                 370        380        390        400        410        420

430        440        450        460        470        480
g791.pep  AVVQEPLLQGALVSLDAKTGAVRALVGGYDFHSKTFNRAVQAMRQPGSTFKPFVYSAALS
          |||||||||||| |||||||||||||||||||||||||||||||||||||||||||||||
m791      AVVQEPLLQGALGSLDAKTGAVRALVGGYDFHSKTFNRAVQAMRQPGSTFKPFVYSAALS
                 430        440        450        460        470        480
```

-continued

```
                 490       500       510       520       530       540
g791.pep  KGMTASTVVNDAPISLPGKGPNGSVWTPKNSDGRYSGYITLRQALTASKNMVSIRILMSI
          ||||||||||||||||||||||||||||||||||||||||||||||||||||||||||||
m791      KGMTASTVVNDAPISLPGKGPNGSVWTPKNSDGRYSGYITLRQALTASKNMVSIRILMSI
                 490       500       510       520       530       540

550       560       570       580       590       600
g791.pep  GVGYAQQYIRRFGFRPSELPASLSMALGTGETTPLKVAEAYSVFANGGYRVSSHVIDKIY
          ||||||||||||||| ||||||||||||||||||||||||||||||||||||||||||||
m791      GVGYAQQYIRRFGFRSSELPASLSMALGTGETTPLKVAEAYSVFANGGYRVSSHVIDKIY
                 550       560       570       580       590       600

610       620       630       640       650       660
g791.pep  DRDGRLRAQMQPLVAGQNAPQAIDPRNAYIMYKIMQDVVRVGTARGAAALGRTDIAGKTG
          ||||||||||||||||||||||||||||||||||||||||||||||||||||||||||||
m791      DRDGRLRAQMQPLVAGQNAPQAIDPRNAYIMYKIMQDVVRVGTARGAAALGRTDIAGKTG
                 610       620       630       640       650       660

670       680       690       700       710       720
g791.pep  TTNDNKDAWFVGFNPDVVTAVYIGFDKPKSMGRAGYGGTIAVPVWVDYMRFALKGKQGKG
          |||||||||||||||||||||||||||||||||:||||||||||||||||||||||||||
m791      TTNDNKDAWFVGFNPDVVTAVYIGFDKPKSMGRVGYGGTIAVPVWVDYMRFALKGKQGKG
                 670       680       690       700       710       720

730       740       750       760       770       780
g791.pep  MKMPEGVVSSNGEYYMKERMVTDPGLMLDNSGIAPQPSRRAKEDDEAAVENEQQGRSDET
          |||||||||||||||||||||||||| |||||||||||||||||| :|:|: :|: :||:
m791      MKMPEGVVSSNGEYYMKERMVTDPGLTLDNSGIAPQPSRRAKEDDGGAAEGGRQAADDEV
                 730       740       750       760       770       780

790       800
g791.pep  RQDVQETPVLPSNTDSKQQQLDSLFX
          |||:|||||||||| |||||||||||
m791      RQDMQETPVLPSNTGSKQQQLDSLFX
                 790       800
```

The following partial DNA sequence was identified in *N. meningitidis* <SEQ ID 2679>:

```
a791.seq
      1  ATGGTAAATT ATTATTCAGC TATGATTAAA AAGATTTTAA CGACTTGTTT

51  TGGTTTGGTT TTTGGGTTTT GTGTATTTGG AGTGGGTTTG GTTGCCATTG

101  CTATTTTGGT AACGTATCCG AAACTGCCGT CTTTGGATTC TTTGCAGCAT

151  TACCAGCCTA AAATGCCGTT GACTATTTAT TCGGCGGATG GGGAAGTCAT

201  CGGTATGTAT GGGGAGCAGC GGCGCGAATT TACAAAAATC GGCGATTTCC

251  CAGAGGTGTT GCGGAATGCG GTTATCGCCG CCGAGGATAA ACGCTTTTAC

301  CGGCATTGGG GGGTGGATGT TTGGGGTGTT GCCCGCGCTG CCGTCGGCAA

351  TGTCGTGTCC GGCAGCGTGC AGTCGGGTGC GAGTACGATT ACGCAGCAGG

401  TGGCGAAAAA TTTTTATTTG AGCAGTGAAA AAACGTTCAC ACGCAAATTC

451  AATGAGGTGT TGCTTGCCTA TAAAATCGAG CAGTCTTTAA GCAAAGACAA

501  AATCCTCGAG TTGTATTTCA ATCAGATTTA CCTCGGTCAG CGCGCCTATG

551  GTTTTGCATC TGCCGCGCAA ATCTATTTCA ATAAGAATGT CCGAGATTTG

601  ACTTTGGCGG AAGCCGCCAT GCTTGCGGGA CTGCCCAAGG CTCCGTCTGC

651  CTATAATCCG ATTGTTAATC CAGAACGTGC CAAGTTGCGC CAGAAGTATA

701  TTTTGAACAA TATGCTCGAG GAGAAGATGA TTACCGTGCA ACAGCGCGAT

751  CAGGCGTTGA ATGAGGAACT GCATTACGAG CGGTTTGTTC GGAAAATCGA

801  TCAGAGTGCT TTATATGTGG CGGAAATGGT GCGTCAGGAA CTGTATGAGA

851  AATACGGTGA AGATGCCTAT ACGCAGGGTT TTAAGGTTTA TACCACGGTC

901  CGCGCCGATC ATCAGAAGGT GGCAACCGAG GCATTGCGCA AGGCTCTACG

951  GAATTTCGAT CGCGGCAGCA GCTACCGCGG TGCGGAAAAC TATATCGATT

1001  TGAGTAAGAG TGAAGATGTC GAGGAGACTG TCAGCCAGTA TCTGTCGGGA
```

```
-continued
1051   CTCTATACCG TCGATAAAAT GGTTCCCGCC GTTGTGTTGG ATGTGACTAA

1101   AAAGAAAAAT GTCGTCATAC AGCTGCCCGG CGGCAGGCGG GTTACGCTTG

1151   ACAGGCGCGC CTTGGGTTTT GCGGCCCGCG CGGTCAATAA TGAAAAAATG

1201   GGGGAGGACC GTATCCGCAG GGGCGCGGTC ATCCGTGTCA AAACAACGG

1251   CGGGCGTTGG GCGGTGGTTC AAGAGCCGTT GCTGCAGGGG GCTTTGGTTT

1301   CGCTGGATGC AAAAACCGGA GCTGTGCGCG CGCTGGTCGG CGGTTATGAT

1351   TTTCACAGCA AAACATTCAA TCGTGCCGTT CAGGCAATGC GGCAGCCGGG

1401   TTCGACCTTT AAGCCGTTTG TCTATTCGGC GGCATTATCT AAGGGGATGA

1451   CCGCGTCCAC AGTGGTTAAC GATGCGCCGA TTTCCCTGCC GGGGAAAGGG

1501   CCGAACGGTT CGGTTTGGAC ACCTAAAAAT TCAGACGGCA GATATTCCGG

1551   CTACATTACT TTGAGACAGG CTCTGACGGC TTCCAAGAAT ATGGTTTCCA

1601   TCCGTATTTT GATGTCTATC GGTGTCGGTT ACGCGCAACA GTATATCCGG

1651   CGTTTCGGCT TCAGGTCGTC CGAGCTGCCG GCAAGCCTGT CTATGGCTTT

1701   AGGTACGGGC GAGACAACGC CGTTGAAAGT GGCGGAGGCA TATAGCGTAT

1751   TTGCGAACGG CGGATATAGG GTTTCTTCGC ACGTAATCGA TAAGATTTAT

1801   GACAGAGACG GCAGGTTGCG CGCCCAAATG CAACCTTTGG TGGCCGGGCA

1851   AAATGCGCCT CAGGCAATCG ATCCGCGCAA TGCCTATATT ATGTATAAGA

1901   TTATGCAGGA TGTGGTCCGT GTTGGTACGG CAAGGGGGGC AGCTGCGTTG

1951   GGAAGAACGG ATATTGCCGG TAAAACGGGT ACGACCAATG ACAATAAGGA

2001   TGCGTGGTTT GTCGGTTTTA ACCCTGATGT GGTTACTGCC GTATATATCG

2051   GCTTCGACAA ACCTAAGAGT ATGGGGCGTG TCGGCTACGG CGGTACGATT

2101   GCGGTGCCGG TTTGGGTGGA CTATATGCGT TTTGCGTTGA AAGGAAAGCA

2151   GGGCAAGGGG ATGAAAATGC CTGAAGGTGT GGTCAGCAGC AATGGCGAAT

2201   ACTATATGAA GGAACGTATG GTAACCGATC CGGGCTTGAC GCTGGACAAC

2251   AGCGGTATTG CGCCGCAACC TTCCCGACGG GCAAAAGAAG ATGACGGGGG

2301   CGCGGCAGAA GGCGGACGGC AGGCGGCGGA TGACGAAGTC CGCCAAGATA

2351   TGCAGGAAAC GCCGGTGCTT CCGAGTAATA CTGGTTCCAA ACAGCAGCAG

2401   TTGGATTCTC TGTTTTAA
```

This corresponds to the amino acid sequence <SEQ ID 2680; ORF 791.a>:

```
a791.pep
    1   MVNYYSAMIK KILTTCFGLV FGFCVFGVGL VAIAILVTYP KLPSLDSLQH

51   YQPKMPLTIY SADGEVIGMY GEQRREFTKI GDFPEVLRNA VIAAEDKRFY

101   RHWGVDVWGV ARAAVGNVVS GSVQSGASTI TQQVAKNFYL SSEKTFTRKF

151   NEVLLAYKIE QSLSKDKILE LYFNQIYLGQ RAYGFASAAQ IYFNKNVRDL

201   TLAEAAMLAG LPKAPSAYNP IVNPERAKLR QKYILNNMLE EKMITVQQRD

251   QALNEELHYE RFVRKIDQSA LYVAEMVRQE LYEKYGEDAY TQGFKVYTTV

301   RADHQKVATE ALRKALRNFD RGSSYRGAEN YIDLSKSEDV EETVSQYLSG

351   LYTVDKMVPA VVLDVTKKKN VVIQLPGGRR VTLDRRALGF AARAVNNEKM

401   GEDRIRRGAV IRVKNNGGRW AVVQEPLLQG ALVSLDAKTG AVRALVGGYD
```

```
-continued
451  FHSKTFNRAV QAMRQPGSTF KPFVYSAALS KGMTASTVVN DAPISLPGKG

501  PNGSVWTPKN SDGRYSGYIT LRQALTASKN MVSIRILMSI GVGYAQQYIR

551  RFGFRSSELP ASLSMALGTG ETTPLKVAEA YSVFANGGYR VSSHVIDKIY

601  DRDGRLRAQM QPLVAGQNAP QAIDPRNAYI MYKIMQDVVR VGTARGAAAL

651  GRTDIAGKTG TTNDNKDAWF VGFNPDVVTA VYIGFDKPKS MGRVGYGGTI

701  AVPVWVDYMR FALKGKQGKG MKMPEGVVSS NGEYYMKERM VTDPGLTLDN

751  SGIAPQPSRR AKEDDGGAAE GGRQAADDEV RQDMQETPVL PSNTGSKQQQ

801  LDSLF*
``` a791/m791 99.9% identity in 805 aa overlap

```
                  10         20         30         40         50         60
a791.pep  MVNYYSAMIKKILTTCFGLVFGFCVFGVGLVAIAILVTYPKLPSLDSLQHYQPKMPLTIY
          ||||||||||||||||||||||||||||||||||||||||||||||||||||||||||||
m791      MVNYYSAMIKKILTTCFGLVFGFCVFGVGLVAIAILVTYPKLPSLDSLQHYQPKMPLTIY
                  10         20         30         40         50         60

70         80         90        100        110        120
a791.pep  SADGEVIGMYGEQRREFTKIGDFPEVLRNAVIAAEDKRFYRHWGVDVWGVARAAVGNVVS
          ||||||||||||||||||||||||||||||||||||||||||||||||||||||||||||
m791      SADGEVIGMYGEQRREFTKIGDFPEVLRNAVIAAEDKRFYRHWGVDVWGVARAAVGNVVS
                  70         80         90        100        110        120

130        140        150        160        170        180
a791.pep  GSVQSGASTITQQVAKNFYLSSEKTFTRKFNEVLLAYKIEQSLSKDKILELYFNQIYLGQ
          ||||||||||||||||||||||||||||||||||||||||||||||||||||||||||||
m791      GSVQSGASTITQQVAKNFYLSSEKTFTRKFNEVLLAYKIEQSLSKDKILELYFNQIYLGQ
                 130        140        150        160        170        180

190        200        210        220        230        240
a791.pep  RAYGFASAAQIYFNKNVRDLTLAEAAMLAGLPKAPSAYNPIVNPERAKLRQKYILNNMLE
          ||||||||||||||||||||||||||||||||||||||||||||||||||||||||||||
m791      RAYGFASAAQIYFNKNVRDLTLAEAAMLAGLPKAPSAYNPIVNPERAKLRQKYILNNMLE
                 190        200        210        220        230        240

250        260        270        280        290        300
a791.pep  EKMITVQQRDQALNEELHYERFVRKIDQSALYVAEMVRQELYEKYGEDAYTQGFKVYTTV
          ||||||||||||||||||||||||||||||||||||||||||||||||||||||||||||
m791      EKMITVQQRDQALNEELHYERFVRKIDQSALYVAEMVRQELYEKYGEDAYTQGFKVYTTV
                 250        260        270        280        290        300

310        320        330        340        350        360
a791.pep  RADHQKVATEALRKALRNFDRGSSYRGAENYIDLSKSEDVEETVSQYLSGLYTVDKMVPA
          ||||||||||||||||||||||||||||||||||||||||||||||||||||||||||||
m791      RADHQKVATEALRKALRNFDRGSSYRGAENYIDLSKSEDVEETVSQYLSGLYTVDKMVPA
                 310        320        330        340        350        360

370        380        390        400        410        420
a791.pep  VVLDVTKKKNVVIQLPGGRRVTLDRRALGFAARAVNNEKMGEDRIRRGAVIRVKNNGGRW
          ||||||||||||||||||||||||||||||||||||||||||||||||||||||||||||
m791      VVLDVTKKKNVVIQLPGGRRVTLDRRALGFAARAVNNEKMGEDRIRRGAVIRVKNNGGRW
                 370        380        390        400        410        420

430        440        450        460        470        480
a791.pep  AVVQEPLLQGALVSLDAKTGAVRALVGGYDFHSKTFNRAVQAMRQPGSTFKPFVYSAALS
          |||||||||||||| |||||||||||||||||||||||||||||||||||||||||||||
m791      AVVQEPLLQGALGSLDAKTGAVRALVGGYDFHSKTFNRAVQAMRQPGSTFKPFVYSAALS
                 430        440        450        460        470        480

490        500        510        520        530        540
a791.pep  KGMTASTVVNDAPISLPGKGPNGSVWTPKNSDGRYSGYITLRQALTASKNMVSIRILMSI
          ||||||||||||||||||||||||||||||||||||||||||||||||||||||||||||
m791      KGMTASTVVNDAPISLPGKGPNGSVWTPKNSDGRYSGYITLRQALTASKNMVSIRILMSI
                 490        500        510        520        530        540

550        560        570        580        590        600
a791.pep  GVGYAQQYIRRFGRRSSELPASLSMALGTGETTPLKVAEAYSVFANGGYRVSSHVIDKIY
          ||||||||||||||||||||||||||||||||||||||||||||||||||||||||||||
m791      GVGYAQQYIRRFGRRSSELPASLSMALGTGETTPLKVAEAYSVFANGGYRVSSHVIDKIY
                 550        560        570        580        590        600

610        620        630        640        650        660
a791.pep  DRDGRLRAQMQPLVAGQNAPQAIDPRNAYIMYKIMQDVVRVGTARGAAALGRTDIAGKTG
          ||||||||||||||||||||||||||||||||||||||||||||||||||||||||||||
m791      DRDGRLRAQMQPLVAGQNAPQAIDPRNAYIMYKIMQDVVRVGTARGAAALGRTDIAGKTG
                 610        620        630        640        650        660

670        680        690        700        710        720
a791.pep  TTNDNKDAWFVGFNPDVVTAVYIGFDKPKSMGRVGYGGTIAVPVWVDYMRFALKGKQGKG
          ||||||||||||||||||||||||||||||||||||||||||||||||||||||||||||
m791      TTNDNKDAWFVGFNPDVVTAVYIGFDKPKSMGRVGYGGTIAVPVWVDYMRFALKGKQGKG
                 670        680        690        700        710        720
```

-continued

```
                   730        740        750        760        770        780
a791.pep  MKMPEGVVSSNGEYYMKERMVTDPGLTLDNSGIAPQPSRRAKEDDGGAAEGGRQAADDEV
          ||||||||||||||||||||||||||||||||||||||||||||||||||||||||||||
m791      MKMPEGVVSSNGEYYMKERMVTDPGLTLDNSGIAPQPSRRAKEDDGGAAEGGRQAADDEV
                   730        740        750        760        770        780

790        800
a791.pep  RQDMQETPVLPSNTGSKQQQLDSLFX
          ||||||||||||||||||||||||||
m791      RQDMQETPVLPSNTGSKQQQLDSLFX
                   790        800
```

The following partial DNA sequence was identified in *N. gonorrhoeae* <SEQ ID 2681>:

```
g792.seq
    1  ATGTTCCGCA TCGTCAAATG GCTGATTGCC CTGCCCGTCG GCATCTTTAT
   51  CTTTTTCAAT GCCTATGTGT ACGGCAACAT CATCACCTAC CGCGCCGTCG
  101  CGCCCCATCG GACTGCCTTT ATGTCGATGC GGATGAAGCA GTTTGAACAA
  151  GAAGGTCGCG ATGTCGCACT GGATTACCGC TGGGTGCCCT ACAACCGCAT
  201  TTCCACCAAC CTGAAAAAAG CCCTGATTGC TTCCGAAGAT GTCCGTTTTG
  251  CCggacacgg gggcttcGat GGGGACGGCa tTCAAAACGC CATCAGGCGC
  301  AACCGGAACA GCGGCGAAGT GAAGGCGGGC GGATCGACCA TCAGCCAGCA
  351  GCTTGCCAAA AACCTCTTCC TCAACGAAAG CCGCAACTAT CTGCGCAAAG
  401  GGGAAGAGGC GGCCATTACG GCAATGATGG AAGCTGTTAC CGACAAAAAC
  451  AGGATTTTCG AACTGTATTT AAACTCAATC GAATGGCACT ACGGCgtTTT
  501  CGGCGCGGAA GCTGCGTCCC GGtatTttTA TAAAAAACCG GCcgcaGACC
  551  TGACcAAACA GCAggcggcG aaactgacgg tactcgtccc cgccccgttt
  601  tactactctg accatccaaa aagcaaacgg ctgcgcaaca aaaccaatat
  651  cgtgctcaga cgcatgggtt cggcaaatta ccccaaagcg aaacggactg
  701  attgttccag atatggaaat gccgcctgaa ctggggttcg aacggcatat
  751  gttttctggg acttataa
```

This corresponds to the amino acid sequence <SEQ ID 2682; ORF 792.ng>:

```
g792.pep
    1  MFRIVKWLIA LPVGIFIFFN AYVYGNIITY RAVAPHRTAF MSMRMKQFEQ
   51  EGRDVALDYR WVPYNRISTN LKKALIASED VRFAGHGGFD GDGIQNAIRR
  101  NRNSGEVKAG GSTISQQLAK NLFLNESRNY LRKGEEAAIT AMMEAVTDKN
  151  RIFELYLNSI EWHYGVFGAE AASRYFYKKP AADLTKQQAA KLTVLVPAPF
  201  YYSDHPKSKR LRNKTNIVLR RMGSANYPKA KRTDCSRYGN AA*TGVRTAY
  251  VFWDL*
```

The following partial DNA sequence was identified in *N. meningitidis* <SEQ ID 2683>:

```
m792.seq
    1  ATGTTCCGCA TCATCAAATG GCTGATTGCC CTGCCCGTCG GCATCTTTAT
   51  CTTTTTCAAT GCCTATGTGT ACGGCAACAT CATTACCTAC CGCGCCGTCG
  101  CGCCCCATCG GACTGCCTTT ATGTCGATGC GGATGAAGCA GTTTGAACAG
```

-continued

```
151    GAAGGTCGCG ATGTCGCACT GGATTACCGC TGGATGCCCT ACAAACGCAT

201    TTCCACCAAC CTGAAAAAAG CCCTGATTGC TTCCGAAGAT GCCCGTTTCG

251    CCGGGCACGG CGGCTTCGAT TGGGGCGGCA TTCAAAACGC CATCAGGCGC

301    AACCGGAACA GCGGCAAAGT GAAGGCGGGC GGCTCGACCA TCAGCCAGCA

351    GCTTGCCAAA AACCTGTTTT TAAACGAAAG CCGCAGCTAT ATCCGCAAAG

401    GCGAAGAAGC GGCGATTACC GCGATGATGG AAGCCGTTAC CGACAAAGAC

451    AGGATTTTTG AACTGTATTT AAACTCAATC GAATGGCACT ACGGCGTTTT

501    CGGCGCGGAA GCCGCGTCCC GGTATTTTTA TCAAATACCC GCCGCCAAGC

551    TGACCAAACA GCAGGCGGCA AAACTGACGG CGCGCGTCCC CGCCCCGCTC

601    TACTACGCCG ACCATCCGAA AAGCAAACGG CTCCGCAACA AAACCAATAT

651    CGTGCTCAAA CGCATGGGTT CGGCAGAGTT GCCTGAAAGC GACACGGACT

701    GA
```

This corresponds to the amino acid sequence <SEQ ID 2684; ORF 792>:

```
m792.pep
    1    MFRIIKWLIA LPVGIFIFFN AYVYGNIITY RAVAPHRTAF MSMRMKQFEQ

51    EGRDVALDYR WMPYKRISTN LKKALIASED ARFAGHGGFD WGGIQNAIRR

101    NRNSGKVKAG GSTISQQLAK NLFLNESRSY IRKGEEAAIT AMMEAVTDKD

151    RIFELYLNSI EWHYGVFGAE AASRYFYQIP AAKLTKQQAA KLTARVPAPL

201    YYADHPKSKR LRNKTNIVLK RMGSAELPES DTD*
``` g792/m792 90.4% identity in 230 aa overlap

```
                 10         20         30         40         50         60
g792.pep  MFRIVKWLIALPVGIFIFFNAYVYGNIITYRAVAPHRTAFMSMRMKQFEQEGRDVALDYR
          ||||:|||||||||||||||||||||||||||||||||||||||||||||||||||||||
m792      MFRIIKWLIALPVGIFIFFNAYVYGNIITYRAVAPHRTAFMSMRMKQFEQEGRDVALDYR
                 10         20         30         40         50         60

70         80         90        100        110        120
g792.pep  WVPYNRISTNLKKALIASEDVRFAGHGGFDGDGIQNAIRRNRNSGEVKAGGSTISQQLAK
          |:||:||||||||||||||:||||||||| |||||||||||||||:||||||||||||||
m792      WMPYKRISTNLKKALIASEDARFAGHGGFDWGGIQNAIRRNRNSGKVKAGGSTISQQLAK
                 70         80         90        100        110        120

130        140        150        160        170        180
g792.pep  NLFLNESRNYLRKGEEAAITAMMEAVTDKNRIFELYLNSIEWHYGVFGAEAASRYFYKKP
          ||||||||:|:|||||||||||||||||||:||||||||||||||||||||||||||: |
m792      NLFLNESRSYIRKGEEAAITAMMEAVTDKDRIFELYLNSIEWHYGVFGAEAASRYFYQIP
                130        140        150        160        170        180

190        200        210        220        230        240
g792.pep  AADLTKQQAAKLTVLVPAPFYYSDHPKSKRLRNKTNIVLRRMGSANYPKAKRTDCSRYGN
          ||  |||||||||| : |||| :||:|||||||||||||||||||:   |::
m792      AAKLTKQQAAKLTARVPAPLYYADHPKSKRLRNKTNIVLKRMGSAELPESDTDX
                190        200        210        220        230

250
g792.pep  AAXTGVRTAYVFWDLX
```

The following partial DNA sequence was identified in *N. meningitidis* <SEQ ID 2685>:

```
a792.seq
    1    ATGTTCCGCA TCATCAAATG GCTGATTGCC CTGCCCGTCG GCATCTTTAT

51    CTTTTTCAAT GCCTATGTGT ACGGCAACAT CATTACCTAC CGCGCCGTCG

101    CGCCCCATCG GACTGCCTTT ATGTCGATGC GGATGAAGCA GTTTGAACAG
```

-continued

```
   151   GAAGGTCGCG ATGTCGCACT GGATTACCGC TGGATGCCCT ACAAACGCAT

201   TTCCACCAAC CTGAAAAAAG CCCTGATTGC TTCCGAAGAT GCCCGTTTCG

251   CCGGGCACGG CGGCTTCGAT TGGGGCGGCA TTCAAAACGC CATCAGGCGC

301   AACCGGAACA GCGGCAAAGT GAAGGCGGGC GGCTCGACCA TCAGCCAGCA

351   GCTTGCCAAA AACCTGTTTT TAAACGAAAG CCGCAGCTAT ATCCGCAAAG

401   GCGAAGAAGC GGCGATTACC GCGATGATGG AAGCCGTTAC CGACAAAGAC

451   AGGATTTTTG AACTGTATTT AAACTCAATC GAATGGCACT ACGGCGTTTT

501   CGGCGCGGAA GCCGCGTCCC GGTATTTTTA TCAAATACCC GCCGCCAAGC

551   TGACCAAACA GCAGGCGGCA AAACTGACGG CGCGCGTCCC CGCCCCGCTC

601   TACTACGCCG ACCATCCGAA AAGCAAACGG CTCCGCAACA AAACCAATAT

651   CGTGCTCAGA CGCATGGGTT CGGCAGAGTT GCCTGAAAGC GACACGGACT

701   GA
```

This corresponds to the amino acid sequence <SEQ ID 2686; ORF 792.a>:

```
a792.pep
     1   MFRIIKWLIA LPVGIFIFFN AYVYGNIITY RAVAPHRTAF MSMRMKQFEQ

51   EGRDVALDYR WMPYKRISTN LKKALIASED ARFAGHGGFD WGGIQNAIRR

101   NRNSGKVKAG GSTISQQLAK NLFLNESRSY IRKGEEAAIT AMMEAVTDKD

151   RIFELYLNSI EWHYGVFGAE AASRYFYQIP AAKLTKQQAA KLTARVPAPL

201   YYADHPKSKR LRNKTNIVLR RMGSAELPES DTD*
``` m792/a792 99.6% identity in 233 aa overlap

```
                    10         20         30         40         50         60
    a792.pep  MFRIIKWLIALPVGIFIFFNAYVYGNIITYRAVAPHRTAFMSMRMKQFEQEGRDVALDYR
              ||||||||||||||||||||||||||||||||||||||||||||||||||||||||||||
    m792      MFRIIKWLIALPVGIFIFFNAYVYGNIITYRAVAPHRTAFMSMRMKQFEQEGRDVALDYR
                    10         20         30         40         50         60

70         80         90        100        110        120
    a792.pep  WMPYKRISTNLKKALIASEDARFAGHGGFDWGGIQNAIRRNRNSGKVKAGGSTISQQLAK
              ||||||||||||||||||||||||||||||||||||||||||||||||||||||||||||
    m792      WMPYKRISTNLKKALIASEDARFAGHGGFDWGGIQNAIRRNRNSGKVKAGGSTISQQLAK
                    70         80         90        100        110        120

130        140        150        160        170        180
    a792.pep  NLFLNESRSYIRKGEEAAITAMMEAVTDKDRIFELYLNSIEWHYGVFGAEAASRYFYQIP
              ||||||||||||||||||||||||||||||||||||||||||||||||||||||||||||
    m792      NLFLNESRSYIRKGEEAAITAMMEAVTDKDRIFELYLNSIEWHYGVFGAEAASRYFYQIP
                   130        140        150        160        170        180

190        200        210        220        230
    a792.pep  AAKLTKQQAAKLTARVPAPLYYADHPKSKRLRNKTNIVLRRMGSAELPESDTDX
              |||||||||||||||||||||||||||||||||||||:||||||||||||||||
    m792      AAKLTKQQAAKLTARVPAPLYYADHPKSKRLRNKTNIVLKRMGSAELPESDTDX
                   190        200        210        220        230
```

The following partial DNA sequence was identified in *N. gonorrhoeae* <SEQ ID 2687>:

```
g793.seq
     1   ATGTTGATTA AAAGCGAATA TAAGCCCCGG ATGCTGCCCA AGAAGAGCA

51   GGTCAAAAAG CCGATGACCA GTAACGGACG GATTAGCTTC GTCCTGATGG

101   CAATGGCGGT CTTGTTTGCC TGTCTGATTG CCCGCGGGCT GTATCTGCAG

151   ACGGTAACGT ATAACTTTTT GAAAGAACAG GGCGACAACC GGATTGTGCG
```

-continued

```
 201 GACTCAAGCA TTGCCGGCTA CACGCGGTAC GGTTTCGGAC CGGAACGGTG
 251 CGGTTTTGGC GTTGAGCGCG CCGACGGAGT CCCTGTTTGC CGTGCCTAAA
 301 GATATGAAGG AAATGCCGTC TGCCGCCCAA TTGGAACGCC TGTCCGAGCT
 351 TGTCGATGTG CCGGTCGATG TTTTGAGGAA CAAACTCGAA CAGAAAGGCA
 401 AGTCGTTTAT TTGGATCAAG CGGCAGCTCG ATCCCAAGGT TGCCGAAGAG
 451 GTCAAAGCCT TGGGTTTGGA AAACTTTGTA TTTGAAAAAG AATTAAAACG
 501 CCATTACCCG ATGGGCAACC TGTTTGCACA CGTCATCGGA TTTACCGATA
 551 TTGACGGCAA AGGTCAGGAA GGTTTGGAAC TTTCGCTTGA AGACAGCCTG
 601 TATGGCGAAG ACGGCGCGGA AGTTGTTTTG CGGGACCGGC AGGGCAATAT
 651 TGTGGACAGC TTGGACTCCC CGCGCAATAA AGCACCGCAA AACGGCAAAG
 701 ACATCATCCT TTCCCTCGAT CAGAGGATTC AGACCTTGGC CTATGAAGAG
 751 TTGAACAAGG CGGTCGAATA CCATCAGGCA AAAGCCGGAA CGGTGGTGGT
 801 TTTGGATGCC CGCACGGGGG AAATCCTCGC CTTGGCCAAT ACGCCCGCCT
 851 ACGATCCCAA CAGACCCGGC CGGGCAGACA GCGAACAGCG GCGCAACCGT
 901 GCCGTAACCG ATATGATCGA ACCTGGTTCG GCAATCAAAC CGTTCGTGAT
 951 TGCGAAGGCA TTGGATGCGG GCAAAACCGA TTTGAACGAA CGGCTGAATA
1001 CGCAGCCTTA TAAAATCGGA CCGTCTCCCG TGCGCGATGA TACCCATGTT
1051 TACCCCTCTT TGGATGTGCG CGGCATTATG CAGAAATCGT CCAACGTCGG
1101 CACAAGCAAA CTGTCTGCGC GTTTCGGCGC CGAAGAAATG TATGACTTCT
1151 ATCATGAATT GGGCATCGGT GTGCGTATGC ACTCGGGCTT TCCGGGGGAA
1201 ACTGCAGGTT TGTTGAGAAA TTGGCGCAGG TGGCGGCCCA TCGAACAGGC
1251 GACGATGTCT TTCGGTTACG GTCTGCAATT GAGCCTGCTG CAATTGGCGC
1301 GCGCCTATAC CGCACTGACG CACGACGGCG TTTTGCTGCC GCTCAGCTTT
1351 GAGAAGCAGG CGGTTGCGCC GCAAGGCAAA CGCATATTCA AGAATCGAC
1401 CGCGCGCGAG GTACGCAATC TGATGGTTTC CGTAACCGAG CCGGGCGGCA
1451 CCGGTACGGC GGGTGCGGTG GACGGTTTCG ATGTCGGCGC TAAAACCGGC
1501 ACGGCGCGCA AGTTCGTCAA CGGGCGTTAT GCCGACAACA AACACGTCGC
1551 TACCTTTATC GGTTTTGCCC CCGCCAAAAA CCCCCGTGTG ATTGTGGCGG
1601 TAACCATCGA CGAACCGACT GCCCACGGCT ATTACGGCGG CGTAGTGGCA
1651 GGGCCGCCCT TCAAAAAAAT TATGGGCGGC AGCCTGAACA TCTTGGGCAT
1701 TTCCCCGACC AAGCCACTGA CCGCCGCAGC CGTCAAAACA CCGTCTTAA
```

This corresponds to the amino acid sequence <SEQ ID 2688; ORF 793.ng>:

```
g793.pep
   1 MLIKSEYKPR MLPKEEQVKK PMTSNGRISF VLMAMAVLFA CLIARGLYLQ

51 TVTYNFLKEQ GDNRIVRTQA LPATRGTVSD RNGAVLALSA PTESLFAVPK

101 DMKEMPSAAQ LERLSELVDV PVDVLRNKLE QKGKSFIWIK RQLDPKVAEE

151 VKALGLENFV FEKELKRHYP MGNLFAHVIG FTDIDGKGQE GLELSLEDSL

201 YGEDGAEVVL RDRQGNIVDS LDSPRNKAPQ NGKDIILSLD QRIQTLAYEE

251 LNKAVEYHQA KAGTVVVLDA RTGEILALAN TPAYDPNRPG RADSEQRRNR
```

-continued

```
301  AVTDMIEPGS AIKPFVIAKA LDAGKTDLNE RLNTQPYKIG PSPVRDDTHV
351  YPSLDVRGIM QKSSNVGTSK LSARFGAEEM YDFYHELGIG VRMHSGFPGE
401  TAGLLRNWRR WRPIEQATMS FGYGLQLSLL QLARAYTALT HDGVLLPLSF
451  EKQAVAPQGK RIFKESTARE VRNLMVSVTE PGGTGTAGAV DGFDVGAKTG
501  TARKFVNGRY ADNKHVATFI GFAPAKNPRV IVAVTIDEPT AHGYYGGVVA
551  GPPFKKIMGG SLNILGISPT KPLTAAAVKT PS*
```

The following partial DNA sequence was identified in *N. meningitidis* <SEQ ID 2689>:

```
m793.seq
   1  ATGTTGATTA AGAGCGAATA TAAGCCTCGG ATGCTGCCCA AAGAAGAGCA
  51  GGTCAAAAAG CCGATGACCA GTAACGGACG GATCAGCTTC GTCCTGATGG
 101  CAATAGCGGT CTTGTTTGCC GGTCTGATTG CTCGCGGACT GTATCTGCAG
 151  ACGGTAACGT ATAACTTTTT GAAAGAACAG GGCGACAACC GGATTGTGCG
 201  GACTCAAACA TTGCCGGCTA CACGCGGTAC GGTTTCGGAC CGGAACGGTG
 251  CGGTTTTGGC GTTGAGTGCG CCGACGGAGT CCCTGTTTGC CGTGCCTAAA
 301  GAGATGAAGG AAATGCCGTC TGCCGCACAA TTGGAACGCC TGTCCGAGCT
 351  TGTCGATGTG CCGGTTGATG TTTTGAGGAA CAAGCTCGAA CAGAAAGGCA
 401  AGTCGTTTAT CTGGATTAAG CGGCAGCTCG ATCCCAAGGT TGCCGAAGAG
 451  GTCAAAGCCT TGGGTTTGGA AAACTTTGTA TTTGAAAAAG AATTAAAACG
 501  CCATTACCCG ATGGGCAACC TGTTTGCACA CGTCATCGGA TTTACCGATA
 551  TTGACGGCAA AGGTCAGGAA GGTTTGGAAC TTTCGCTTGA AGACAGCCTG
 601  CATGGCGAAG ACGGCGCGGA AGTCGTTTTG CGGGACCGGC AGGGCAATAT
 651  TGTGGACAGC TTGGACTCCC CGCGCAATAA AGCCCCGAAA AACGGCAAAG
 701  ACATCATCCT TTCCCTCGAT CAGAGGATTC AGACCTTGGC CTATGAAGAG
 751  TTGAACAAGG CGGTCGAATA CCATCAGGCA AAAGCCGGAA CGGTGGTGGT
 801  TTTGGATGCC CGCACGGGGG AAATCCTCGC CTTGGCCAAT ACGCCCGCCT
 851  ACGATCCCAA CAGGCCCGGC CGGGCAGACA GCGAACAGCG GCGCAACCGT
 901  GCCGTAACCG ATATGATCGA ACCCGGTTCG GCAATCAAAC CGTTTGTGAT
 951  TGCGAAGGCA TTGGATGCGG GCAAAACCGA TTTGAACGAA CGGCTGAATA
1001  CGCAGCCTTA TAAAATCGGA CCGTCTCCCG TGCGCGATAC CCATGTTTAC
1051  CCCTCTTTGG ATGTGCGCGG CATCATGCAG AAATCGTCCA ACGTCGGCAC
1101  AAGCAAACTG TCTGCGCGTT TCGGTGCCGA AGAAATGTAT GACTTCTATC
1151  ATGAGTTGGG CATCGGTGTG CGTATGCACT CGGGCTTTCC GGGCGAAACT
1201  GCAGGTTTGT TGAGAAATTG GCGCAGGTGG CGGCCTATCG AACAGGCGAC
1251  GATGTCTTTC GGTTACGGCC TGCAATTGAG CCTGCTGCAA TTGGCGCGCG
1301  CCTATACCGC ACTGACGCAC GACGGCGTTT TACTGCCGGT CAGCTTTGAA
1351  AAACAGGCGG TTGCGCCGCA AGGCAAACGC ATATTCAAAG AATCGACCGC
1401  GCGCGAGGTA CGCAATCTGA TGGTTTCCGT AACCGAGCCG GGCGGCACCG
1451  GTACGGCGGG TGCGGTGGAC GGTTTCGATG TCGGCGCGAA AACCGGCACG
1501  GCGCGCAAGT TCGTCAACGG GCGTTATGCC GACAACAAAC ACATCGCTAC
```

-continued

```
1551  CTTTATCGGT TTTGCCCCCG CCAAAAATCC CCGTGTGATT GTGGCGGTAA
1601  CCATTGACGA ACCGACTGCC CACGGTTATT ACGGCGGCGT AGTGGCAGGG
1651  CCGCCCTTCA AAAAATTAT GGGCGGCAGC CTGAACATCT TGGGCATTTC
1701  CCCGACCAAG CCACTGACCG CCGCAGCCGT CAAAACACCG TCTTAA
```

This corresponds to the amino acid sequence <SEQ ID 2690; ORF 793>:

```
m793.pep
   1    MLIKSEYKPR MLPKEEQVKK PMTSNGRISF VLMAIAVLFA GLIARGLYLQ

51    TVTYNFLKEQ GDNRIVRTQT LPATRGTVSD RNGAVLALSA PTESLFAVPK

101    EMKEMPSAAQ LERLSELVDV PVDVLRNKLE QKGKSFIWIK RQLDPKVAEE

151    VKALGLENFV FEKELKRHYP MGNLFAHVIG FTDIDGKGQE GLELSLEDSL

201    HGEDGAEVVL RDRQGNIVDS LDSPRNKAPK NGKDIILSLD QRIQTLAYEE

251    LNKAVEYHQA KAGTVVVLDA RTGEILALAN TPAYDPNRPG RADSEQRRNR

301    AVTDMIEPGS AIKPFVIAKA LDAGKTDLNE RLNTQPYKIG PSPVRDTHVY

351    PSLDVRGIMQ KSSNVGTSKL SARFGAEEMY DFYHELGIGV RMHSGFPGET

401    AGLLRNWRRW RPIEQATMSF GYGLQLSLLQ LARAYTALTH DGVLLPVSFE

451    KQAVAPQGKR IFKESTAREV RNLMVSVTEP GGTGTAGAVD GFDVGAKTGT

501    ARKFVNGRYA DNKHIATFIG FAPAKNPRVI VAVTIDEPTA HGYYGGVVAG

551    PPFKKIMGGS LNILGISPTK PLTAAAVKTP S*
``` g793/m793 98.5% identity in 582 aa overlap

```
                10         20         30         40         50         60
g793.pep MLIKSEYKPRMLPKEEQVKKPMTSNGRISFVLMAMAVLFACLIARGLYLQTVTYNFLKEQ
         ||||||||||||||||||||||||||||||||||||:|||||  |||||||||||||||
m793     MLIKSEYKPRMLPKEEQVKKPMTSNGRISFVLMAIAVLFAGLIARGLYLQTVTYNFLKEQ
                10         20         30         40         50         60

70         80         90        100        110        120
g793.pep GDNRIVRTQALPATRGTVSDRNGAVLALSAPTESLFAVPKDMKEMPSAAQLERLSELVDV
         ||||||||| :|||||||||||||||||||||||||||||:|||||||||||||||||||
m793     SADGEVIGMTGEQRREFTKIGDFPEVLRNAVIAAEDKRFYEHWGVDVWGVARAAVGNVVS
                70         80         90        100        110        120

130        140        150        160        170        180
g793.pep PVDVLRNKLEQKGKSFIWIKRQLDPKVAEEVKALGLENFVFEKELKRHYPMGNLFAHVIG
         ||||||||||||||||||||||||||||||||||||||||||||||||||||||||||||
m793     PVDVLRNKLEQKGKSFIWIKRQLDPKVAEEVKALGLENFVFEKELKRHYPMGNLFAHVIG
               130        140        150        160        170        180

190        200        210        220        230        240
g793.pep FTDIDGKGQEGLELSLEDSLYGEDGAEVVLRDRQGNIVDSLDSPRNKAPQNGKDIILSLD
         ||||||||||||||||||||:|||||||||||||||||||||||||||||:|||||||||
m793     FTDIDGKGQEGLELSLEDSLHGEDGAEVVLRDRQGNIVDSLDSPRNKAPKNGKDIILSLD
               190        200        210        220        230        240

250        260        270        280        290        300
g793.pep QRIQTLAYEELNKAVEYHQAKAGTVVVLDARTGEILALANTPAYDPNRPGRADSEQRRNR
         ||||||||||||||||||||||||||||||||||||||||||||||||||||||||||||
m793     QRIQTLAYEELNKAVEYHQAKAGTVVVLDARTGEILALANTPAYDPNRPGRADSEQRRNR
               250        260        270        280        290        300

310        320        330        340        350        360
g793.pep AVTDMIEPGSAIKPFVIAKALDAGKTDLNERLNTQPYKIGPSPVRDDTHVYPSLDVRGIM
         |||||||||||||||||||||||||||||||||||||||||||||| |||||||||||||
m793     AVTDMIEPGSAIKPFVIAKALDAGKTDLNERLNTQPYKIGPSPVRD-THVYPSLDVRGIM
               310        320        330        340         350

370        380        390        400        410        420
g793.pep QKSSNVGTSKLSARFGAEEMYDFYHELGIGVRMHSGFPGETAGLLRNWRRWRPIEQATMS
         ||||||||||||||||||||||||||||||||||||||||||||||||||||||||||||
m793     QKSSNVGTSKLSARFGAEEMYDFYHELGIGVRMHSGFPGETAGLLRNWRRWRPIEQATMS
            360        370        380        390        400        410
```

-continued

```
                 430        440        450        460        470        480
g793.pep   FGYGLQLSLLQLARAYTALTHDGVLLPLSFEKQAVAPQGKRIFKESTAREVRNLMVSVTE
           ||||||||||||||||||||||||||:|||||||||||||||||||||||||||||||||
m793       FGYGLQLSLLQLARAYTALTHDGVLLPVSFEKQAVAPQGKRIFKESTAREVRNLMVSVTE
                 420        430        440        450        460        470

490        500        510        520        530        540
g793.pep   PGGTGTAGAVDGFDVGAKTGTARKFVNGRYADNKHVATFIGFAPAKNPRVIVAVTIDEPT
           ||||||||||||||||||||||||||||||||||||:|||||||||||||||||||||||
m793       PGGTGTAGAVDGFDVGAKTGTARKFVNGRYADNKHIATFIGFAPAKNPRVIVAVTIDEPT
                 480        490        500        510        520        530

550        560        570        580
g793.pep   AHGTTGGVVAGPPFKKIMGGSLNILGISPTKPLTAAAVKTPSX
           ||||||||||||||||||||||||||||||||||||||||||
m793       AHGTTGGVVAGPPFKKIMGGSLNILGISPTKPLTAAAVKTPSX
                 540        550        560        570        580
```

The following partial DNA sequence was identified in *N. meningitidis* <SEQ ID 2691>:

```
a793.seq
   1  ATGTTGATTA AGAGCGAATA TAAGCCTCGG ATGCTGCCCA AGAAGAGCA
  51  GGTCAAAAAG CCGATGACCA GTAACGGACG GATCAGCTTC GTCCTGATGG
 101  CAATAGCGGT CTTGTTTGCC GGTCTGATTG CTCGCGGACT GTATCTGCAG
 151  ACGGTAACGT ATAACTTTTT GAAAGAACAG GGCGACAACC GGATTGTGCG
 201  GACTCAAACA TTGCCGGCTA CACGCGGTAC GGTTTCGGAC CGGAACGGTG
 251  CGGTTTTGGC GTTGAGTGCG CCGACGGAGT CCCTGTTTGC CGTGCCTAAA
 301  GAGATGAAGG AAATGCCGTC TGCCGCACAA TTGGAACGCC TGTCCGAGCT
 351  TGTCGATGTG CCGGTTGATG TTTTGAGGAA CAAGCTCGAA CAGAAAGGCA
 401  AGTCGTTTAT CTGGATTAAG CGGCAGCTCG ATCCCAAGGT TGCCGAAGAG
 451  GTCAAAGCCT TGGGTTTGGA AAACTTTGTA TTTGAAAAAG AATTAAAACG
 501  CCATTACCCG ATGGGCAACC TGTTTGCACA CGTCATCGGA TTTACCGATA
 551  TTGACGGCAA AGGTCAGGAA GGTTTGGAAC TTTCGCTTGA AGACAGCCTG
 601  CATGGCGAAG ACGGCGCGGA AGTCGTTTTG CGGGACCGGC AGGGCAATAT
 651  TGTGGACAGC TTGGACTCCC CGCGCAATAA AGCCCCGAAA AACGGCAAAG
 701  ACATCATCCT TTCCCTCGAT CAGAGGATTC AGACCTTGGC CTATGAAGAG
 751  TTGAACAAGG CGGTCGAATA CCATCAGGCA AAAGCCGGAA CGGTGGTGGT
 801  TTTGGATGCC CGCACGGGGG AAATCCTCGC CTTGGCCAAT ACGCCCGCCT
 851  ACGATCCCAA CAGGCCCGGC CGGGCAGACA GCGAACAGCG GCGCAACCGT
 901  GCCGTAACCG ATATGATCGA ACCCGGTTCG GCAATCAAAC CGTTTGTGAT
 951  TGCGAAGGCA TTGGATGCGG GCAAAACCGA TTTGAACGAA CGGCTGAATA
1001  CGCAGCCTTA TAAAATCGGA CCGTCTCCCG TGCGCGATAC CCATGTTTAC
1051  CCCTCTTTGG ATGTGCGCGG CATCATGCAG AAATCGTCCA ACGTCGGCAC
1101  AAGCAAACTG TCTGCGCGTT TCGGTGCCGA AGAAATGTAT GACTTCTATC
1151  ATGAGTTGGG CATCGGTGTG CGTATGCACT CGGGCTTTCC GGGCGAAACT
1201  GCAGGTTTGT TGAGAAATTG GCGCAGGTGG CGGCCTATCG AACAGGCGAC
1251  GATGTCTTTC GGTTACGGCC TGCAATTGAG CCTGCTGCAA TTGGCGCGCG
1301  CCTATACCGC ACTGACGCAC GACGGCGTTT TACTGCCGGT CAGCTTTGAA
1351  AAACAGGCGG TTGCGCCGCA AGGCAAACGC ATATTCAAAG AATCGACCGC
1401  GCGCGAGGTA CGCAATCTGA TGGTTTCCGT AACCGAGCCG GGCGGCACCG
```

-continued

```
1451  GTACGGCGGG TGCGGTGGAC GGTTTCGATG TCGGCGCGAA AACCGGCACG

1501  GCGCGCAAGT TCGTCAACGG GCGTTATGCC GACAACAAAC ACATCGCTAC

1551  CTTTATCGGT TTTGCCCCCG CCAAAAATCC CCGTGTGATT GTGGCGGTAA

1601  CCATTGACGA ACCGACTGCC CACGGTTATT ACGGCGGCGT AGTGGCAGGG

1651  CCGCCCTTCA AAAAAATTAT GGGCGGCAGC CTGAACATCT TGGGCATTTC

1701  CCCGACCAAG CCACTGACCG CCGCAGCCGT CAAAACACCG TCTTAA
```

This corresponds to the amino acid sequence <SEQ ID 2692; ORF 793.a>:

```
a793.pep
   1   MLIKSEYKPR MLPKEEQVKK PMTSNGRISF VLMAIAVLFA GLIARGLYLQ

51   TVTYNFLKEQ GDNRIVRTQT LPATRGTVSD RNGAVLALSA PTESLFAVPK

101   EMKEMPSAAQ LERLSELVDV PVDVLRNKLE QKGKSFIWIK RQLDPKVAEE

151   VKALGLENFV FEKELKRHYP MGNLFAHVIG FTDIDGKGQE GLELSLEDSL

201   HGEDGAEVVL RDRQGNIVDS LDSPRNKAPK NGKDIILSLD QRIQTLAYEE

251   LNKAVEYHQA KAGTVVVLDA RTGEILALAN TPAYDPNRPG RADSEQRRNR

301   AVTDMIEPGS AIKPFVIAKA LDAGKTDLNE RLNTQPYKIG PSPVRDTHVY

351   PSLDVRGIMQ KSSNVGTSKL SARFGAEEMY DFYHELGIGV RMHSGFPGET

401   AGLLRNWRRW RPIEQATMSF GYGLQLSLLQ LARAYTALTH DGVLLPVSFE

451   KQAVAPQGKR IFKESTAREV RNLMVSVTEP GGTGTAGAVD GFDVGAKTGT

501   ARKFVNGRYA DNKHIATFIG FAPAKNPRVI VAVTIDEPTA HGYYGGVVAG

551   PPFKKIMGGS LNILGISPTK PLTAAAVKTP S*
``` a793/m793 100.0% identity in 581 aa overlap

```
                10         20         30         40         50         60
a793.pep  MLIKSEYKPRMLPKEEQVKKPMTSNGRISFVLMAIAVLFAGLIARGLYLQTVTYNFLKEQ
          ||||||||||||||||||||||||||||||||||||||||||||||||||||||||||||
m793      MLIKSEYKPRMLPKEEQVKKPMTSNGRISFVLMAIAVLFAGLIARGLYLQTVTYNFLKEQ
                10         20         30         40         50         60

70         80         90        100        110        120
a793.pep  GDNRIVRTQTLPATRGTVSDRNGAVLALSAPTESLFAVPKEMKEMPSAAQLERLSELVDV
          ||||||||||||||||||||||||||||||||||||||||||||||||||||||||||||
m793      GDNRIVRTQTLPATRGTVSDRNGAVLALSAPTESLFAVPKEMKEMPSAAQLERLSELVDV
                70         80         90        100        110        120

130        140        150        160        170        180
a793.pep  PVDVLRNKLEQKGKSFIWIKRQLDPKVAEEVKALGLENFVFEKELKRHYPMGNLFAHVIG
          ||||||||||||||||||||||||||||||||||||||||||||||||||||||||||||
m793      PVDVLRNKLEQKGKSFIWIKRQLDPKVAEEVKALGLENFVFEKELKRHYPMGNLFAHVIG
               130        140        150        160        170        180

190        200        210        220        230        240
a793.pep  FTDIDGKGQEGLELSLEDSLHGEDGAEVVLRDRQGNIVDSLDSPRNKAPKNGKDIILSLD
          ||||||||||||||||||||||||||||||||||||||||||||||||||||||||||||
m793      FTDIDGKGQEGLELSLEDSLHGEDGAEVVLRDRQGNIVDSLDSPRNKAPKNGKDIILSLD
               190        200        210        220        230        240

250        260        270        280        290        300
a793.pep  QRIQTLAYEELNKAVEYHQAKAGTVVVLDARTGEILALANTPAYDPNRPGRADSEQRRNR
          ||||||||||||||||||||||||||||||||||||||||||||||||||||||||||||
m793      QRIQTLAYEELNKAVEYHQAKAGTVVVLDARTGEILALANTPAYDPNRPGRADSEQRRNR
               250        260        270        280        290        300

310        320        330        340        350        360
a793.pep  AVTDMIEPGSAIKPFVIAKALDAGKTDLNERLNTQPYKIGPSPVRDTHVYPSLDVRGIMQ
          ||||||||||||||||||||||||||||||||||||||||||||||||||||||||||||
m793      AVTDMIEPGSAIKPFVIAKALDAGKTDLNERLNTQPYKIGPSPVRDTHVYPSLDVRGIMQ
               310        320        330        340        350        360
```

-continued

```
              370        380        390        400        410        420
a793.pep  KSSNVGTSKLSARFGAEEMYDFYHELGIGVRMHSGFPGETAGLLRNWRRWRPIEQATMSF
          ||||||||||||||||||||||||||||||||||||||||||||||||||||||||||||
m793      KSSNVGTSKLSARFGAEEMYDFYHELGIGVRMHSGFPGETAGLLRNWRRWRPIEQATMSF
              370        380        390        400        410        420

430        440        450        460        470        480
a793.pep  GYGLQLSLLQLARAYTALTHDGVLLPVSFEKQAVAPQGKRIFKESTAREVRNLMVSVTEP
          ||||||||||||||||||||||||||||||||||||||||||||||||||||||||||||
m793      GYGLQLSLLQLARAYTALTHDGVLLPVSFEKQAVAPQGKRIFKESTAREVRNLMVSVTEP
              430        440        450        460        470        480

490        500        510        520        530        540
a793.pep  GGTGTAGAVDGFDVGAKTGTARKFVNGRYADNKHIATFIGFAPAKNPRVIVAVTIDEPTA
          ||||||||||||||||||||||||||||||||||||||||||||||||||||||||||||
m793      GGTGTAGAVDGFDVGAKTGTARKFVNGRYADNKHIATFIGFAPAKNPRVIVAVTIDEPTA
              490        500        510        520        530        540

550        560        570        580
a793.pep  HGYYGGVVAGPPFKKIMGGSLNILGISPTKPLTAAAVKTPSX
          |||||||||||||||||||||||||||||||||||||||||
m793      HGYYGGVVAGPPFKKIMGGSLNILGISPTKPLTAAAVKTPSX
              550        560        570        580
```

The following partial DNA sequence was identified in *N. gonorrhoeae* <SEQ ID 2693>:

```
g794.seq
    1   gtgcgtttca ATCATTTCAT AATGGTAACG ATTATTATAT ATGTGATTTC

51   CCCTGCAAAC AAGCCGGTCC GCCGCCCCGG CGTTCCCACT TATCCGGCTT

101   TGCCTTATAA TTGCTTTTTT TATGTAACAG ATTCACCTAT GAATTTCCCC

151   AAAACAGCGG CCTCCCTGCT GCTGCTTCTC GCCTCCCTCG CCGCACACGC

201   GCTCGATACC GGCCGCATTC CGCAAAACGA AATCGCTGTA TATGTCCAAG

251   AGCTTGACAG CGGAAAAGTC ATCATTGACC ACCGTGCCGG CATACCCGTC

301   AATCCCGCGT CCACGATGAA GCTCGTTACC GCGTTTGCCG CCTTCAAAAC

351   CTTCGGCAGC AATTACCGCT GGGCGACCGA GTTTAAAAGC AACGGTACGG

401   TAAACGACGG CACGCTTGAC GGAAACCTGT ATTGGGCGGG CAGCGGCGAC

451   CCCGTTTTCA ATCAGGAAAA CCTGCTTGCC GTCCAACGCC AGTTGCGCGA

501   CAAAGGCATC CGCAATATCA CGGGGCGCCT GATGCTCGAC CACAGCCTGT

551   GGGGCGAAGT CGGCAGTCCC GACCATTTTG AAGCCGACAG CGGTTCGCCG

601   TTTATGACGC CCCCAAATCC GACTATGCTG TCTGCCGGTA TGGTTATGGT

651   GCGCGCCGAA CGCAATGCCG CCGGCAGTAC CGACATCCTC ACCGATCCGC

701   CTTTGCCGCA TATTTTTGCC CAAAACAACT TGAAAATTAC CGCCTCCCAA

751   GCTGCCTGCC CTTCGGTCAA AAAACTGATG CGCGCATCTT TTTCGGGCAA

801   TACGCTGAAA TTGCGCGGCA ATATTCCCGA AAGCTGTTTG GGCAAGCCTG

851   TCGGTGTCCG GATGTTCGCG CTTGACGAAC TGATCCGCCA AAGTTTTACC

901   AACCGCTGGC TGCTCGGCGG CGGACGGATT TCAGACGGCA TCGGCATAGC

951   CGACACACCG GAAGGCGCGC AGACGCTTGC CGTTGCACAC TCCAAACCGA

1001   TGAAGGAAAT TTTGACGGAC ATGAACAAGC GTTCGGACAA TCTGATTGCG

1051   CGTTCCGTCT TCCTCAAACT CGGCGGCGAC GGCAAACTGC CCGCCGTTTC

1101   CGAACAGGCG GCGTCTGCCG TCCGGCGAGA ACTTGCCGTA TCGGGCATCG

1151   ATGTTGCGGA TTTGGTTTTG GAAAACGGTT CGGGTCTGTC CAGAAAAGAA

1201   AGGGTAACGG CGAGAATGAT GGCGCAAATG TTGGAAACGG CTTATTTCAG

1251   CCCGTTTGCA CAAGATTTCA TCGACACGCT GCCCATCGCC GGCACAGACG
```

-continued

```
1301    GGACTTTACG CAACCGCTTC AAACAAAGCG GCGGGCTGTT GCGCTTAAAA
1351    ACCGGCACGC TCAACAATGT CCGCGCCCTT GCAGGTTATT GGCTGGGCGA
1401    CAAACCGATG GCGGTGGTCG TCATCATCAA CAGCGGCCGC GCCGTTTCCC
1451    TGCTGCCCGA CTTGGACAAC TTCGTTGCCA AAAACATCAT CTCCGGCGGC
1501    GACGGCTGGC TGGATGCGAA ACTGATGTGC AAAGAACGCC GCGCCTGA
```

This corresponds to the amino acid sequence <SEQ ID 2694; ORF 794.ng>:

```
g794.pep
  1    VRFNHFIMVT IIIYVISPAN KPVRRPGVPT YPALPYNCFF YVTDSPMNFP
 51    KTAASLLLLL ASLAAHALDT GRIPQNEIAV YVQELDSGKV IIDHRAGIPV
101    NPASTMKLVT AFAAFKTFGS NYRWATEFKS NGTVNDGTLD GNLYWAGSGD
151    PVFNQENLLA VQRQLRDKGI RNITGRLMLD HSLWGEVGSP DHFEADSGSP
201    FMTPPNPTML SAGMVMVRAE RNAAGSTDIL TDPPLPHIFA QNNLKITASQ
251    AACPSVKKLM RASFSGNTLK LRGNIPESCL GKPVGVRMFA LDELIRQSFT
301    NRWLLGGGRI SDGIGIADTP EGAQTLAVAH SKPMKEILTD MNKRSDNLIA
351    RSVFLKLGGD GKLPAVSEQA ASAVRRELAV SGIDVADLVL ENGSGLSRKE
401    RVTARMMAQM LETAYFSPFA QDFIDTLPIA GTDGTLRNRF KQSGGLLRLK
451    TGTLNNVRAL AGYWLGDKPM AVVVIINSGR AVSLLPDLDN FVAKNIISGG
501    DGWLDAKLMC KERRA*
```

The following partial DNA sequence was identified in *N. meningitidis* <SEQ ID 2695>:

```
m794.seq
  1    GTGCGTCTCA ATCATTTCAT AATGATAGCG ATTATTATAT ATGTGATTTC
 51    CCCTGCAAAC AAGCCGGCCC GCCGCCACAG CGTTCCCACT TATCCGGCTT
101    TGCCTTATAA TTGCTTTTTT TATGTAACAG ATTTACCTAT GAATTTCCCC
151    AAAACAGCGG CCTCCCTGCT GCTGCTTCTC GCCTCCCTCG CCGCACACGC
201    GCTCGATACC GGCCGCATTC CGCAAAACGA AATCGCCGTA TATGTCCAAG
251    AGCTTGACAG CGGAAAAGTC ATCATTGACC ACCGCTCGGA TGTCCCCGTC
301    AACCCCGCCT CCACAATGAA ACTCGTTACC GCGTTTGCCG CCTTCAAAAC
351    CTTCGGCAGC AATTACCGCT GGGCGACCGA GTTTAAAAGC AACGGTACGG
401    TAAACGACGG CACGCTTGAC GGAAACCTAT ATTGGGCGGG CAGCGGCGAC
451    CCCGTTTTCA ATCAGGAAAA CCTGCTTGAT GCTCAAAAAC AGTTGCGCGA
501    ACAAGGCATA CTCAATATCA CGGGACACCT GATGCTCGAC CACAGCCTGT
551    GGGGCGAAGT CGGCAGCCCC GACGATTTCG AAGCCGACAG CGGTTCGCCG
601    TTTATGACGC CCCCCAATCC AACTATGCTG TCTGCCGGTA TGGTTATGGT
651    GCGCGCCGAA CGCAATGCCG CCGGCAGTAC CGACATCCTC ACCGATCCGC
701    CTTTGCCGCA TATTTTCGCC CAAAACAACT TGAAAATTAC CGCCTCCCAA
751    GCTGCCTGCC CTTCGATCAA AAAACTGATG CGTGCATCTT TTTCGGACAA
801    TACGCTGAAA TTGCGCGGCA ATATTCCCGA GAGCTGTTTG GGCAAGCCTG
851    TCGGTGTCCG GATGTTCGCG CTTGACGAAC TGATCCGGCA AAGTTTTACC
```

```
 901  AACCACTGGC TGCTCGGCGG CGGACGGATT TCAGACGGTA TCGGCATAGC

951  CGACACGCCG GAAGGCGCGC AGACACTTGC CGTTGCACAC GCCAAACCGA

1001  TGAAAGAAAT TTTGACGGAC ATGAACAAGC GTTCGGACAA TCTAATTGCG

1051  CGTTCCGTCT TCCTCAAACT CGGCGGCGAC GGCAAACTGC CGCCGTTTC

1101  CGAACAGGCG GCGTCTGCCG TCCGGCGCGA ACTTGCCGTA TCGGGCATCG

1151  ATGTTGCGGA TTTGGTTTTG GAAAACGGTT CGGGCCTGTC CAGAAAAGAA

1201  AGGGTAACGG CGAGAATGAT GGCGCAAATG TTGGAAACGG CTTATTTCAG

1251  CCCGTTTGCA CAAGATTTCA TCGACACGCT ACCCATCGCC GGCACAGACG

1301  GAACTTTACG CAACCGCTTC AAACAAAGCG GCGGGCTGTT GCGCTTAAAA

1351  ACCGGCACGC TCAACAATGT CCGCGCCCTT GCAGGTTATT GGCTGGGCGA

1401  CAAACCGATG GCGGTGGTCG TCATCATCAA CAGCGGCCGC GCCGTTTCCC

1451  TGCTGCCAGA CTTGGACAAC TTCGTTGCCA ACAACATCAT CTCCGGCGGC

1501  GATGGCTGGC TGGATGCGAA ACTGATGTGC AAAGAACGCC GAGCCTGA
```

This corresponds to the amino acid sequence <SEQ ID 2696; ORF 794>:

```
m794.pep
  1  VRLNHFIMIA IIIYVISPAN KPARRHSVPT YPALPYNCFF YVTDLPMNFP

51  KTAASLLLLL ASLAAHALDT GRIPQNEIAV YVQELDSGKV IIDHRSDVPV

101  NPASTMKLVT AFAAFKTFGS NYRWATEFKS NGTVNDGTLD GNLYWAGSGD

151  PVFNQENLLD AQKQLREQGI LNITGHLMLD HSLWGEVGSP DDFEADSGSP

201  FMTPPNPTML SAGMVMVRAE RNAAGSTDIL TDPPLPHIFA QNNLKITASQ

251  AACPSIKKLM RASFSDNTLK LRGNIPESCL GKPVGVRMFA LDELIRQSFT

301  NHWLLGGGRI SDGIGIADTP EGAQTLAVAH AKPMKEILTD MNKRSDNLIA

351  RSVFLKLGGD GKLPAVSEQA ASAVRRELAV SGIDVADLVL ENGSGLSRKE

401  RVTARMMAQM LETAYFSPFA QDFIDTLPIA GTDGTLRNRF KQSGGLLRLK

451  TGTLNNVRAL AGYWLGDKPM AVVVIINSGR AVSLLPDLDN FVANNIISGG

501  DGWLDAKLMC KERRA*
``` g794/m794 95.5% identity in 515 aa overlap

```
                 10         20         30         40         50         60
       g794.pep  VRFNHFIMVTIIIYVISPANKPVRRPGVPTYPALPYNCFFYVTDSPMNFPKTAASLLLLL
                 ||:||||::|||||||||||||:||  :|||||||||||||||:|||||||||||||||
       m794      VRLNHFIMIAIIIYVISPANKPARRHSVPTYPALPYNCFFYVTDLPMNFPKTAASLLLLL
                         10         20         30         40         50         60

70         80         90        100        110        120
       g794.pep  ASLAAHALDTGRIPQNEIAVYVQELDSGKVIIDHRAGIPVNPASTMKLVTAFAAFKTFGS
                 |||||||||||||||||||||||||||||||||||:|||||||||||||||||||||||
       m794      ASLAAHALDTGRIPQNEIAVYVQELDSGKVIIDHRSDVPVNPASTMKLVTAFAAFKTFGS
                         70         80         90        100        110        120

130        140        150        160        170        180
       g794.pep  NYRWATEFKSNGTVNDGTLDGNLYWAGSGDPVFNQENLLAVQRQLRDKGIRNITGRLMLD
                 ||||||||||||||||||||||||||||||||||||||| :|:|||::|| ||||:|||
       m794      NYRWATEFKSNGTVNDGTLDGNLYWAGSGDPVFNQENLLDAQKQLREQGILNITGHLMLD
                        130        140        150        160        170        180

190        200        210        220        230        240
       g794.pep  HSLWGEVGSPDHFEADSGSPFMTPPNPTMLSAGMVMVRAERNAAGSTDILTDPPLPHIFA
                 ||||||||||| ||||||||||||||||||||||||||||||||||||||||||||||||
       m794      HSLWGEVGSPDDFEADSGSPFMTPPNPTMLSAGMVMVRAERNAAGSTDILTDPPLPHIFA
                        190        200        210        220        230        240
```

-continued

```
                    250        260        270        280        290        300
g794.pep  QNNLKITASQAACPSVKKLMRASFSGNTLKLRGNIPESCLGKPVGVRMFALDELIRQSFT
          ||||||||||||||:||||||||| |||||||||||||||||||||||||||||||||||
m794      QNNLKITASQAACPSIKKLMRASFSDNTLKLRGNIPESCLGKPVGVRMFALDELIRQSFT
                    250        260        270        280        290        300

310        320        330        340        350        360
g794.pep  NRWLLGGGRISDGIGIADTPEGAQTLAVAHSKPMKEILTDMNKRSDNLIARSVFLKLGGD
          |:|||||||||||||||||||||||||||||:||||||||||||||||||||||||||||
m794      NHWLLGGGRISDGIGIADTPEGAQTLAVAHAKPMKEILTDMNKRSDNLIARSVFLKLGGD
                    310        320        330        340        350        360

370        380        390        400        410        420
g794.pep  GKLPAVSEQAASAVRRELAVSGIDVADLVLENGSGLSRKERVTARMMAQMLETAYFSPFA
          ||||||||||||||||||||||||||||||||||||||||||||||||||||||||||||
m794      GKLPAVSEQAASAVRRELAVSGIDVADLVLENGSGLSRKERVTARMMAQMLETAYFSPFA
                    370        380        390        400        410        420

430        440        450        460        470        480
g794.pep  QDFIDTLPIAGTDGTLRNRFKQSGGLLRLKTGTLNNVRALAGYWLGDKPMAVVVIINSGR
          ||||||||||||||||||||||||| ||||||||||||||||||||||||||||||||||
m794      QDFIDTLPIAGTDGTLRNRFKQSGGLLRLKTGTLNNVRALAGYWLGDKPMAVVVIINSGR
                    430        440        450        460        470        480

490        500        510
g794.pep  AVSLLPDLDNFVAKNIISGGDGWLDAKLMCKERRAX
          |||||||||||||:||||||||||||||||||||||
m794      AVSLLPDLDNFVANNIISGGDGWLDAKLMCKERRAX
                    490        500        510
```

The following partial DNA sequence was identified in *N. meningitidis* <SEQ ID 2697>:

```
a794.seq
     1  GTGCGTCTCA ATCATTTCAT AATGATAGCG ATTATTATAT ATGTGATTTC
    51  CCCTGCAAAC AAGCCGGCCC GCCGCCACAG CGTTCCCACT TATCCGGCTT
   101  TGCCTTATAA TTGCTTTTTT TATGTAACAG ATTTACCTAT GAATTTCCCC
   151  AAAACAGCGG CCTCCCTGCT GCTGCTTCTC GCCTCCCTCG CCGCACACGC
   201  GCTCGATACA GGTCGCATTC CGCAAAACGA AATCGCCGTA TATGTCCAAG
   251  AGCTTGACAG CGGAAAAGTC ATCATTGACC ACCGCTCGGA TGTCCCCGTC
   301  AACCCCGCCT CCACAATGAA ACTCGTTACC GCGTTTGCCG CCTTCAAAAC
   351  CTTCGGCAGC AATTACCGCT GGGCGACCGA GTTTAAAAGC AACGGTACGG
   401  TAAACGACGG CACGCTTGAC GGAAACCTGT ATTGGGCGGG CAGCGGCGAC
   451  CCCGTTTTCA ATCAGGAAAA CCTGCTTGCC GTCCAACGCC AGTTGCGCGA
   501  ACAAGGCATA CGCAATATCA CGGGACACCT GATGCTCGAC CACAGCCTGT
   551  GGGGCGAAGT CGGCAGCCCC GACGATTTCG AAGCCGACAG CGGTTCGCCG
   601  TTTATGACGC CCCCCAATCC AACTATGCTG TCTGCCGGTA TGGTTATGGT
   651  GCGCGCCGAA CGCAATGCCG CCGACAGTAC CGACATCCTC ACCGATCCGC
   701  CTTTGCCGCA TATTTTCGCC CAAAACAACT TGAAAATTAC CGCCTCCCAA
   751  GCTGCCTGCC CTTCGATCAA AAAACTGATG CGTGCATCTT TTTCGGACAA
   801  TACGCTGAAA TTGCGCGGCA ATATTCCCGA GAGCTGTTTG GGCAAGCCTG
   851  TCGGTGTCCG GATGTTCGCG CTTGACGAAC TGATCCGGCA AAGTTTTACC
   901  AACCACTGGC TGCTCGGCGG CGGACGGATT TCAGACGGCA TCGGCATATC
   951  CGACACGCCG GAAGGCGCGC AGACGCTTGC CGTTGCACAC TCAAAGCCGA
  1001  TGAAGGAAAT TTTGACGGAC ATGAACAAGC GTTCGGACAA TCTAATTGCG
  1051  CGTTCCGTCT TCCTCAAACT CGGCGGCGAC GGCAAACTGC CCGCCGTTTC
  1101  CGAACAGGCA GCGTCTGCCG TCCGGCGTGA ACTTGCCGTG TCGGGCATCG
  1151  ATGTTGCGGA TTTGGTTTTG GAAAACGGTT CAGGTCTGTC CAGAAAAGAA
```

-continued

```
1201  AGGGTAACGG CGAGAATGAT GGCGCAAATG TTGGAAACGG CTTATTTCAG

1251  CCCGTTTGCA CAAGATTTCA TCGATACGCT GCCCATCGCC GGCACAGACG

1301  GGACTTTACG CAACCGCTTC AAACAAAGCG GCGGGCTGTT GCGCTTAAAA

1351  ACCGGCACGC TCAACAATGT CCGCGCCCTT GCAGGTTATT GGCTGGGCGA

1401  CAAACCGATG GCGGTGGTCG TCATCATCAA CAGCGGCCGC GCCGTTTCCC

1451  TGCTGCCCGA CTTGGACAAC TTCGTTGCCA ACAACATCAT CTCCGGCGGC

1501  GATGGCTGGC TGGATGCGAA ACTGATGTGC AAAGAACGCC GAGCCTGA
```

This corresponds to the amino acid sequence <SEQ ID 2698; ORF 794.a>:

```
a794.pep
   1  VRLNHFIMIA IIIYVISPAN KPARRHSVPT YPALPYNCFF YVTDLPMNFP

51  KTAASLLLLL ASLAAHALDT GRIPQNEIAV YVQELDSGKV IIDHRSDVPV

101  NPASTMKLVT AFAAFKTFGS NYRWATEFKS NGTVNDGTLD GNLYWAGSGD

151  PVFNQENLLA VQRQLREQGI RNITGHLMLD HSLWGEVGSP DDFEADSGSP

201  FMTPPNPTML SAGMVMVRAE RNAADSTDIL TDPPLPHIFA QNNLKITASQ

251  AACPSIKKLM RASFSDNTLK LRGNIPESCL GKPVGVRMFA LDELIRQSFT

301  NHWLLGGGRI SDGIGISDTP EGAQTLAVAH SKPMKEILTD MNKRSDNLIA

351  RSVFLKLGGD GKLPAVSEQA ASAVRRELAV SGIDVADLVL ENGSGLSRKE

401  RVTARMMAQM LETAYFSPFA QDFIDTLPIA GTDGTLRNRF KQSGGLLRLK

451  TGTLNNVRAL AGYWLGDKPM AVVVIINSGR AVSLLPDLDN FVANNIISGG

501  DGWLDAKLMC KERRA*
``` a794/m794 98.6% identity in 515 aa overlap

```
                   10         20         30         40         50         60
   a794.pep  VRLNHFIMIAIIIYVISPANKPARRHSVPTYPALPYNCFFYVTDLPMNFPKTAASLLLLL
             ||||||||||||||||||||||||||||||||||||||||||||||||||||||||||||
       m794  VRLNHFIMIAIIIYVISPANKPARRHSVPTYPALPYNCFFYVTDLPMNFPKTAASLLLLL
                   10         20         30         40         50         60

70         80         90        100        110        120
   a794.pep  ASLAAHALDTGRIPQNEIAVYVQELDSGKVIIDHRSDVPVNPASTMKLVTAFAAFKTFGS
             ||||||||||||||||||||||||||||||||||||||||||||||||||||||||||||
       m794  ASLAAHALDTGRIPQNEIAVYVQELDSGKVIIDHRSDVPVNPASTMKLVTAFAAFKTFGS
                   70         80         90        100        110        120

130        140        150        160        170        180
   a794.pep  NYRWATEFKSNGTVNDGTLDGNLYWAGSGDPVFNQENLLAVQRQLREQGIRNITGHLMLD
             ||||||||||||||||||||||||||||||||||||||||| :|:||||||| |||||||
       m794  NYRWATEFKSNGTVNDGTLDGNLYWAGSGDPVFNQENLLDAQKQLREQGILNITGHLMLD
                  130        140        150        160        170        180

190        200        210        220        230        240
   a794.pep  HSLWGEVGSPDDFEADSGSPFMTPPNPTMLSAGMVMVRAERNAADSTDILTDPPLPHIFA
             |||||||||||||||||||||||||||||||||||||||||||| ||||||||||||||
       m794  HSLWGEVGSPDDFEADSGSPFMTPPNPTMLSAGMVMVRAERNAAGSTDILTDPPLPHIFA
                  190        200        210        220        230        240

250        260        270        280        290        300
   a794.pep  QNNLKITASQAACPSIKKLMRASFSDNTLKLRGNIPESCLGKPVGVRMFALDELIRQSFT
             ||||||||||||||||||||||||||||||||||||||||||||||||||||||||||||
       m794  QNNLKITASQAACPSIKKLMRASFSDNTLKLRGNIPESCLGKPVGVRMFALDELIRQSFT
                  250        260        270        280        290        300

310        320        330        340        350        360
   a794.pep  NHWLLGGGRISDGIGISDTPEGAQTLAVAHSKPMKEILTDMNKRSDNLIARSVFLKLGGD
             |||||||||||||||||||:||||||||||:|||||||||||||||||||||||||||||
       m794  NHWLLGGGRISDGIGIADTPEGAQTLAVAHAKPMKEILTDMNKRSDNLIARSVFLKLGGD
                  310        320        330        340        350        360
```

-continued

```
                  370        380        390        400        410        420
a794.pep   GKLPAVSEQAASAVRRELAVSGIDVADLVLENGSGLSRKERVTARMMAQMLETATFSPFA
           ||||||||||||||||||||||||||||||||||||||||||||||||||||||||||||
m794       GKLPAVSEQAASAVRRELAVSGIDVADLVLENGSGLSRKERVTARMMAQMLETATFSPFA
                  370        380        390        400        410        420

430        440        450        460        470        480
a794.pep   QDFIDTLPIAGTDGTLRNRFKQSGGLLRLKTGTLNNVRALAGYWLGDKPMAVVVIINSGR
           ||||||||||||||||||||||||||||||||||||||||||||||||||||||||||||
m794       QDFIDTLPIAGTDGTLRNRFKQSGGLLRLKTGTLNNVRALAGYWLGDKPMAVVVIINSGR
                  430        440        450        460        470        480

490        500        510
a794.pep   AVSLLPDLDNFVANNIISGGDGWLDAKLMCKERRAX
           |||||||||||||||||||||||||||||||||||
m794       AVSLLPDLDNFVANNIISGGDGWLDAKLMCKERRAX
                  490        500        510
```

The following partial DNA sequence was identified in *N. gonorrhoeae* <SEQ ID 2699>:

```
g900.seq
     1   ATGccgTCTG AAATGCCGTC TGAAACGTGG CAGGCGGAGG TTCGGACGGC

51   ATTGGGTTTA TTTCAACGGG CGGATGCCGA CCGCATCGCG TACTTTATCC

101   AACAATTCGC GCGCTTCTTT GCGCGCTTTT TGCGCGcctg cctGCAAAAT

151   CTCTTCGATT TGCGAAGGAT TAGAGGTCAA TGCGTTGTAG CGTTCGCGCA

201   GTTCTGCCAA TTCGGCGTTG ATTTTCGCCG CCGAAAGTTT TTTCGCCTCG

251   CCCCAAGCCA AGCCGTCGGC AAGCATTTGC GTAAATTCCG CCGTTTCAGA

301   CGGCGTGGAG AAGGCTTTAT AGATTTCAAA CAAAGGGCTT TCGTCGGGCT

351   GTTTCGGCTC GCCCGGCTCT TTCATGTTGG TAATGATTTT GTTGACCGAT

401   TTTTGGGTTT TTTTGTCGTT TTCCCAAAGC GGAATGGTAT TGCCGTAGGA

451   TTTGGACATT TTGCGTCCGT CCAAACCGAC CAAGAGTTCG ACGTTTTCGT

501   CGATTTTCAC TTCGGGCagg GTGaagagtt cTTGGAaacc gtgggtgaag 551   cggccggcAa tgtcgcgcgc cATTTcgacg tgttgGATTT GGTCGCGCCC

601   GACGGGGACT TCGTTGGCGT TGAACATCAA AATGTCGGCA GTCATCAGAA

651   TCGGATAACT GAACAAACCC ATTTCCACAC CGAAATCGGG GTCTTCCTGC

701   CCGTTTTCCG CATTGGCTTG AACGGCGGCT TTGTAGGCGT GGGCGCGGTT

751   CATCAAACCC TTGGCGGTGA TGCAGGTCAG AATCCAGTTC AACTCCATCA

801   CTTCGGGAAT GTCGCTTTGG CGGTAGAAGG TGGTGCGCTC GGGGTCGAGT

851   CCGCAGGCAA GCCAAGTGGC GGCAACGGCt tgGGTGGATT GGTGAATCAT

901   CTCCTGCTCG TGGCATTTGA TGATGCCGTG GTAATCGGCG AGGAAGAGGA

951   AGGATTCGGT ATCGGGGTTT TGCGCCGCGC GGACGGCGGG GCGGATGGCG

1001   CCGACGTAGT TGCCCAGATG CGGGGTGCCG GTGGTGGTTA CGCCGGTCAG

1051   AACTCGTTTT TTGCTCATAA AAATGTCCTT ACGGCAGCAA TGCCGTCTGA

1101   AAGGGAAAa. gatgcgCCGA TTATACCCGA TTTGCCACAT ACATCCAGCC

1151   GacaACagaC TTTTCCATAT TAA
```

This corresponds to the amino acid sequence <SEQ ID 2700; ORF 900.ng:

```
g900.pep
     1   MPSEMPSETW QAEVRTALGL FQRADADRIA YFIQQFARFF ARFLRACLQN

51   LFDLRRIRGQ CVVAFAQFCQ FGVDFRRRKF FRLAPSQAVG KHLRKFRRFR
```

-continued

```
101  RRGEGFIDFK QRAFVGLFRL ARLFHVGNDF VDRFLGFFVV FPKRNGIAVG

151  FGHFASVQTD QEFDVFVDFH FGQGEEFLET VGEAAGNVAR HFDVLDLVAP

201  DGDFVGVEHQ NVGSHQNRIT EQTHFHTEIG VFLPVFRIGL NGGFVGVGAV

251  HQTLGGDAGQ NPVQLHHFGN VALAVEGGAL GVESAGKPSG GNGLGGLVNH

301  LLLVAFDDAV VIGEEEEGFG IGVLRRADGG ADGADVVAQM RGAGGGYAGQ

351  NSFFAHKNVL TAAMPSEREK DAPIIPDLPH TSSRQQTFPY *
```

The following partial DNA sequence was identified in *N. meningitidis* <SEQ ID 2701>:

```
m900.seq
   1  ATGCCGTCTG AAACGCGGCA GGCGGAGGTT CGGACGGCAT CGGGTTCATT

51  TCAACGGGCG GATGcCGACC GCATCgG.TA CTTTGTCCAA TAATTCGCGT

101  GCTTCTTTAC GCGCTTTCGC CGCGCCTGCC TGCAAAATCT CTTCGATTTG

151  CGAAGGGTCG GCGGTCAGCT CGTTGTAGCG TTCGCGCGGT TCGGCGAGTT

201  CGGCGTTGAT TTTCGCCGCC AAAAGTTTTT TGGCTTCACC CCACGCCAAG

251  CCGTCGGCAA GCATTTTCGT AAATTCCACC GTTTCAGACG GCGTGGAGAA

301  GGCTTTGTAG ATTTCAAACA ATGGGCTTTC GTCGGGCTGT TTCGGCTCGC

351  CCGGCTCTTT CATATTGGTG ATGATTTTGT TGACCGATTT TTGGGTTTTT 401  tTGTCGTTTT CCCAAAGCGG AATGGTGTTG CCGTAGGATT TGGACATTTT

451  GCGTCCGTCC AAACCGACCA AGAGTTCGAC GTTTTCATCG ATTTTCACTT

501  CGGGCAGGGT GAAGAGTTCC CGGAAGCGGT GGTTGAAGCG GCCGGCGATG

551  TCGCGCGCCA TTTCGACGTG TTGGATTTGG TCGCGCCCGA CgGGCaCTTC

601  GTTGGCGTTG AACATCAGAA TATCGGCAGT CATCAGAATC GGATAACTGA

651  ACAAACCCAT TTCCACACCG AAATCAGGGT CTTCCTGCCC GTTTTCTGCA

701  TTTGCCTGCA CGGCGGCTTT GTAGGCATGG GCGCGGTTCA TCAAACCCTT

751  GGCAGTGATG CAGGTCAGAA TCCAGTTCAA TTCCATCACT TCgGGAGTGT

801  CGCTTTGGCG GTAGAAGGTG GTGCGCTCGG GGTCGAGTCC GCAgGCAAGC

851  CAAGTGGCGG CAACGGCTTG GGTGGATTGG TGAATCATCT CCGGCTCGTG

901  GCATTTGATG ATACCGTGGT AATCGGCGAG GAAGAGGAAG GATTCGGTAT

951  CGAGGTTTTG CGCCGCGCGG ACGGCGGGGC GGATGGCGCC GACGTAGTTG

1001  CCCAGATGCG GGATGCCGGT GGTGGTTACG CCGGTCAGAA CTCGTTTTTT

1051  GCTCATAAAA ATGTCCTTGC GGCATCAATG CCGTCTGAAA GGGAAAAAGA

1101  TGTGCCGATT ATACCCGATT TGCCACCTAC ATCCAGCCGA CAACAGACTT

1151  TTCCATATTA A
```

This corresponds to the amino acid sequence <SEQ ID 2702; ORF 900>:

```
m900.pep
   1  MPSETRQAEV RTASGSFQRA DADRIXYFVQ *FACFFTRFR RACLQNLFDL

51  RRVGGQLVVA FARFGEFGVD FRRQKFFGFT PRQAVGKHFR KFHRFRRRGE

101  GFVDFKQWAF VGLFRLARLF HIGDDFVDRF LGFFVVFPKR NGVAVGFGHF

151  ASVQTDQEFD VFIDFHFGQG EEFPEAVVEA AGDVARHFDV LDLVAPDGHF
```

-continued

```
201  VGVEHQNIGS HQNRITEQTH FHTEIRVFLP VFCICLHGGF VGMGAVHQTL

251  GSDAGQNPVQ FHHFGSVALA VEGGALGVES AGKPSGGNGL GGLVNHLRLV

301  AFDDTVVIGE EEEGFGIEVL RRADGGADGA DVVAQMRDAG GGYAGQNSFF

351  AHKNVLAASM PSEREKDVPI IPDLPPTSSR QQTFPY*
```

Computer analysis of this amino acid sequence gave the following results:
Homology with a Predicted ORF from *N. gonorrhoeae*
ORF 900 shows 87.0% identity over a 386 aa overlap with a predicted ORF (ORF 900.ng) from *N. gonorrhoeae*:

```
m900/g900
                      10         20         30         40         50
    m900.pep  MPSETRQAEVRTASGSFQRADADRIGYFVQXFACFFTRFRRACLQNLFDLRRVGGQ
              |||||  ||||||||| | |||||||||:|| ||  || :||  ||||||||||:  ||
    g900   MPSEMPSETWQAEVRTALGLFQRADADRIAYFIQQFARFFARFLRACLQNLFDLRRIRGQ
                10         20         30         40         50         60

60         70         80         90        100        110
    m900.pep  LVVAFARFGEFGVDFRRQKFFGFTPRQAVGKHFRKFHRFRRRGEGFVDFKQWAFVGLFRL
              |||||:| :||||||||:|||  ::|  |||||:|||:|||||||||||:|||| ||||||||
    g900   CVVAFAQFCQFGVDFRRRKFFRLAPSQAVGKHLRKFRRFRRRGEGFIDFKQRAFVGLFRL
                70         80         90        100        110        120

120        130        140        150        160        170
    m900.pep  ARLFHIGDDFVDRFLGFFVVFPKRNGVAVGFGHFASVQTDQEFDVFIDFHFGQEEFPEA
              |||||:|:||||||||||||||||||||:|||||||||||||||||||:|||||||||||  |:
    g900   ARLFHVGNDFVDRFLGFFVVFPKRNGIAVGFGHFASVQTDQEFDVFVDFHFGQEEFLET
                130        140        150        160        170        180

180        190        200        210        220        230
    m900.pep  VVEAAGDVARHFDVLDLVAPDGHFVGVEHQNIGSHQNRITEQTHFHTEIRVFLPVFCICL
              | ||||:||||||||||||||| ||||||||:||||||||||||||||||| ||||||: ||  | |
    g900   VGEAAGNVARHFDVLDLVAPDGDFVGVEHQNVGSHQNRITEQTHFHTEIGVFLPVFRIGL
                190        200        210        220        230        240

240        250        260        270        280        290
    m900.pep  HGGFVGMGAVHQTLGSDAGQNPVQFHHFGSVALAVEGGALGVESAGKPSGGNGLGGLVNH
              :||||:|||||||||| :|||||||:||||  :||||:||||||||||||||||||||||||||||
    g900   NGGFVGVGAVHQTLGGDAGQNPVQLHHFGNVALAVEGGALGVESAGKPSGGNGLGGLVNH
                250        260        270        280        290        300

300        310        320        330        340        350
    m900.pep  LRLVAFDDTVVIGEEEEGFGIEVLRRADGGADGADVVAQMRDAGGGYAGQNSFFAHKNVL
              |  |||||:||||||||||||||||:||||||||||||||||||||||||||||||||||||
    g900   LLLVAFDDAVVIGEEEEGFGIGVLRRADGGADGADVVAQMRGAGGGYAGQNSFFAHKNVL
                310        320        330        340        350        360

360        370        380
    m900.pep  AASMPSEREKDVPIIPDLPPTSSRQQTFPYX
              :|:||||||||:|||||||| ||||||||||
    g900   TAAMPSEREKDAPIIPDLPHTSSRQQTFPYX
                370        380        390
```

The following partial DNA sequence was identified in *N. meningitidis* <SEQ ID 2703>:

```
a900.seq (partial)
    1  GAGGTTCGGA CGGCATTGGG TTTATTTCAA CGGGCGGATA CCGACCGCAT

51  CACGTACTTT GCCCAATAAT TCGCGTGCTT CTTTACGCGC TTTTTGCGCG

101  CCTGCCTGCA AAATCTCTTC GATTTGCGAA GGGTCGGCGG TCAGCTCGTT

151  GTAGCGTTCG CGCGGTTCGG CGAGTTCGGC GTTGATTTTC GCCGCCAAAA

201  GTTTTTTTGC CTCGCCCCAA GCCAAGCCGT CGGCAAGCAT TTTCGTAAAT

251  TCTGCCGTTT CAGACGGCGT GGAGAAAGCT TTGTAGATTT CAAACAGAGG

301  GCTTTCGTCG GGCTTCTTCG GCTCGCCCGG CTCTTTCATA TTGGTGATGA

351  TTTTGTTGAC CGATTTTTGG GTTTTTTTGT CGTTTTCCCA AAGCGGAATG

401  GTGTTGCCGT AGGATTTGGA CATTTTGCGT CCGTCCAAAC CAACCAAGAG
```

```
-continued
 451   TTCGACGTTT TCGTCGATTT TCACTTCGGG CAGTGTGAAG AGTTCCCGGA

501   AGCGGTGGTT GAAGCGGCCG GCAATATCGC GTGCCATTTC AACGTGTTGG

551   ATTTGGTCGC GACCGACTGG AACTTCATGG GCATTGAACA TGAGAATGTC

601   GGCAGTCATG AGGATAGGGT AGCTGTACAA ACCCATTTCC ACGCCGAAAT

651   CGGGGTCTTC CTGCCCGTTT TCCGCATTTG CCTGCACGGC GGCTTTGTAG

701   GCGTGGGCGC GGTTCATCAA ACCCTTGGCG GTGATGCAGG TCAGAATCCA

751   GTTCAATTCC ATCACTTCGG GAATGTCGCT TTGACGGTAG AAGGTGGTGC

801   GCTCGGGGTC GAGTCCGCAG GCAAGCCAAG TGGCGGCAAC GGCTTGGGTG

851   GATTGGTGAA TCATCTCCGG CTCGTGGCAT TTGATGATAC CGTGGTAATC

901   GGCGAGGAAG AGGAAGGATT CGGTATCAGG GTTTTGCGCC GCGCGGACGG

951   CGGGGCGGAT AGCACCGACG TAGTTGCCCA GATGCGGGAT GCCGGTGGTG

1001   GTTACGCCGG TCAGAACTCG TTTTTTGCTC ATAAAAATGT CCTTGCGGCA

1051   TCAATGCCGT CTGAAAGGGA AAAAGATGCG CCGATTATAC CCGATTTGCC

1101   ACCTACATCC AGCCGACAAC AGACTTTTCC ATATTAA
```

This corresponds to the amino acid sequence <SEQ ID 2704; ORF 900.a>:

```
a900.pep (partial)
    1   EVRTALGLFQ RADTDRITYF AQ*FACFFTR FLRACLQNLF DLRRVGGQLV

51   VAFARFGEFG VDFRRQKFFC LAPSQAVGKH FRKFCRFRRR GESFVDFKQR

101   AFVGLLRLAR LFHIGDDFVD RLGFFVVFP KRNGVAVGFG HFASVQTNQE

151   FDVFVDFHFG QCEEFPEAVV EAAGNIACHF NVLDLVATDW NFMGIEHENV

201   GSHEDRVAVQ THFHAEIGVF LPVFRICLHG GFVGVGAVHQ TLGGDAGQNP

251   VQFHHFGNVA LTVEGGALGV ESAGKPSGGN GLGGLVNHLR LVAFDDTVVI

301   GEEEEGFGIR VLRRADGGAD STDVVAQMRD AGGGYAGQNS FFAHKNVLAA

351   SMPSEREKDA PIIPDLPPTS SRQQTFPY*
``` m900/a900 88.4% identity in 378 aa overlap

```
                 10         20         30         40         50         60
m900.pep  MPSETRQAEVRTASGSFQRADADRIXYFVQXFACFFTRFRRACLQNLFDLRRVGGQLVVA
                ||||| | ||||| :|||:||:|||||||||| |||||||||||||||||||||||
a900            EVRTALGLFQRADTDRITYFAQXFACFFTRFLRACLQNLFDLRRVGGQLVVA
                       10         20         30         40         50

70         80         90        100        110        120
m900.pep  FARFGEFGVDFRRQKFFGFTPRQAVGKHFRKFHRFRRRGEGFVDFKQWAFVGLFRLARLF
          |||||||||||||||||| ::| ||||||||||||| ||||||:|||||| ||||:|||||
a900      FARFGEFGVDFRRQKFFCLAPSQAVGKHFRKFCRFRRRGESFVDFKQRAFVGLLRLARLF
                 60         70         80         90        100        110

130        140        150        160        170        180
m900.pep  HIGDDFVDRFLGFFVVFPKRNGVAVGFGHFASVQTDQEFDVFIDFHFGQEEFPEAVVEA
          ||||||||| ||||||||||||||||||||||||||:||||||:||||| |||||||||
a900      HIGDDFVDRLGFFVVFPKRNGVAVGFGHFASVQTNQEFDVFVDFHFGQCEEFPEAVVEA
                120        130        140        150        160        170

190        200        210        220        230        240
m900.pep  AGDVARHFDVLDLVAPDGHFVGVEHQNIGSHQNRITEQTHFHTEIRVFLPVFCICLHGGF
          ||:| ||:|||||| | :|:|| |:|||::|| |||||:|| |||||||||||||||
a900      AGNIACHFNVLDLVATDWNFMGIEHENVGSHEDRVAVQTHFHAEIGVFLPVFRICLHGGF
                180        190        200        210        220        230

250        260        270        280        290        300
m900.pep  VGMGAVHQTLGSDAGQNPVQFHHFGSVALAVEGGALGVESAGKPSGGNLGGLVNHLRLV
          ||:||||||||::||||||||||||| : ||:|||||||||||||||||||||||||||
a900      VGVGAVHQTLGGDAGQNPVQFHHFGNVALTVEGGALGVESAGKPSGGNGLGGLVNHLRLV
                240        250        260        270        280        290
```

```
                310        320        330        340        350        360
m900.pep  AFDDTVVIGEEEEGFGIEVLRRADGGADGADVVAQMRDAGGGYAGQNSFFAHKNVLAASM
          ||||||||||||||||||||||||::||||||||::||||||||||||||||||||||||
a900      VGVGAVHQTLGGDAGQNRVQFHHFGNVASTVEGGALGVESAGKPSGGNGLGGLVNHLRLV
                300        310        320        330        340        350

370        380
m900.pep  PSEREKDVPIIPDLPPTSSRQQTFPYX
          |||||||:|||||||||||||||||||
a900      PSEREKDAPIIPDLPPTSSRQQTFPYX
                360        370
``` g901.seq not found yet
g901.pep not found yet
The following partial DNA sequence was identified in *N. meningitidis* <SEQ ID 2705>:

```
m901.seq
     1  ATGCCCGATT TTTCGATGTC CAATTTGGCC GTTGCCTTTT CCATCACATT

51  GGCTGCCGGT TTGTTTACCG TATTAkGyAG TGGCTTGGTG ATGTTTTCCA

101  AAACGCCCAA TCCGCGTGTG TTGTCGTTTG GTTTGGCGTT TGCCGGCGGT

151  GCGATGGTAT ATGTTTCCCT GACGGAGATT TTCAGTAAGT CCAGCGAGGC

201  GTTCGCTGAA ATTTATGATA AAGACCACGC GTTTGCGGCG GCGACCATGG

251  CATTTTTGGC CGGGATGGGC GGCATTGCGC TGATTGACCG TCTGGTGCCG

301  AACCCGCATG AAACTTTAGA CGCGCAAGAC CCGTCGTTTC AAGAAAGCAA

351  ACGCCGCCAT ATCGCGCGAG TCGGCATGAT GGCGGCGTTT GCGATTACTG

401  CGCACAATTT CCCCGAAGGC TTGGCGACGT TTTTTGCCAC ATTGGAAAAT

451  CCAGCAGTCG GGATGCCTTT GGCCTTGGCG ATTGCCATCC ATAATATTCC

501  GGAGGGCATT TCCATCGCCG CGCCGGTTTA TTTTGCCACC CGCAGCCGTA

551  AGAAAACGGT GTGGGCGTGT CTGCTATCCG GCTTGGCCGA GCCGTTGGGG

601  GCGGCTTTGG GCTATTTGGT TTTGCAGCCG TTTTTGTCGC CTGCCGTGTT

651  TGGTTCGGTA TTCGGCGTGA TAGCCGGTGT GATGGTGTTT TTGGCGTTGG

701  ACGAGCTGnt GCCGGCTGCC AAACGCTATT CAGACGGCCA TGAAACCGTT

751  TACGGCCTGA CAACGGGTAT GGCGGTGATT GCCGTCAGCC TGGTATTGTT

801  CCATTTTTAA
```

This corresponds to the amino acid sequence <SEQ ID 2706; ORF 901>:

```
m901.pep
     1  MPDFSMSNLA VAFSITLAAG LFTVLXSGLV MFSKTPNPRV LSFGLAFAGG

51  AMVYVSLTEI FSKSSEAFAE IYDKDHAFAA ATMAFLAGMG GIALIDRLVP

101  NPHETLDAQD PSFQESKRRH IARVGMMAAF AITAHNFPEG LATFFATLEN

151  PAVGMPLALA IAIHNIPEGI SIAAPVYFAT RSRKKTVWAC LLSGLAEPLG

201  AALGYLVLQP FLSPAVFGSV FGVIAGVMVF LALDELXPAA KRYSDGHETV

251  YGLTTGMAVI AVSLVLFHF*
```

The following partial DNA sequence was identified in N. meningitidis <SEQ ID 2707>:

```
a901.seq
    1   ATGCCCGATT TTTCGATGTC CAATTTGGCC GTTGCCTTTT CCATTACGTT

51   GGCTGCCGGT TTGTTTACCG TATTAGGCAG CGGCTTGGTG ATGTTTTCCA

101   AAACGCCCAA TCCGCGCGTG TTGTCGTTTG GTTTGGCATT TGCCGGCGGT

151   GCGATGGTGT ATGTTTCCCT GACGGAGATT TTCAGTAAGT CCAGCGAGGC

201   GTTCGCTGAA ATTTATGATA AAGACCACGC GTTTGCGGCG GCGACCATGG

251   CATTTTTGGC AGGGATGGGC GGCATTGCGC TGATTGACCG TCTGGTGCCG

301   AACCCGCATG AAACTTTAGA CGCGCAAGAC CCGTCGTTTC AAGAAAGCAA

351   ACGCCGCCAT ATCGCGCGAG TCGGCATGAT GGCGGCGTTT GCGATTACTG

401   CGCACAATTT CCCCGAAGGC TTGGCGACGT TTTTTGCCAC ATTGGAAAAT

451   CCAGCAGTCG GGATGCCTTT GGCCTTGGCG ATTGCCATCC ATAATATTCC

501   GGAGGGCATT TCCATCGCCG CGCCGGTTTA TTTTGCCACC CGCAGCCGTA

551   AGAAAACGGT GTGGGCGTGT CTGCTATCCG GCTTGGCCGA GCCGTTGGGG

601   GCGGCTTTGG GCTATTTGGT TTTGCAGCCG TTTTTGTCGC CTGCCGTGTT

651   TGGTTCGGTA TTCGGCGTGA TAGCCGGTGT GATGGTGTTT TTGGCGTTGG

701   ACGAGCTGCT GCCGGCTGCC AAACGCTATT CAGACGGCCA TGAAACCGTT

751   TACGGCCTGA CAATGGGCAT GGCGGTGATT GCCGTCAGCC TGGTATTGTT

801   CCATTTTTAA
```

This corresponds to the amino acid sequence <SEQ ID 2708; ORF 901.a>:

```
a901.pep
    1   MPDFSMSNLA VAFSITLAAG LFTVLGSGLV MFSKTPNPRV LSFGLAFAGG

51   AMVYVSLTEI FSKSSEAFAE IYDKDHAFAA ATMAFLAGMG GIALIDRLVP

101   NPHETLDAQD PSFQESKRRH IARVGMMAAF AITAHNFPEG LATFFATLEN

151   PAVGMPLALA IAIHNIPEGI SIAAPVYFAT RSRKKTVWAC LLSGLAEPLG

201   AALGYLVLQP FLSPAVFGSV FGVIAGVMVF LALDELLPAA KRYSDGHETV

251   YGLTMGMAVI AVSLVLFHF*
``` m901/a901 98.9% identity in 269 aa overlap

```
                 10         20         30         40         50         60
    m901.pep  MPDFSMSNLAVAFSITLAAGLFTVLXSGLVMFSKTPNPRVLSFGLAFAGGAMVYVSLTEI
              ||||||||||||||||||||||||| ||||||||||||||||||||||||||||||||||
    a901      MPDFSMSNLAVAFSITLAAGLFTVLGSGLVMFSKTPNPRVLSFGLAFAGGAMVYVSLTEI
                 10         20         30         40         50         60

70         80         90        100        110        120
    m901.pep  FSKSSEAFAEIYDKDHAFAAATMAFLAGMGGIALIDRLVPNPHETLDAQDPSFQESKRRH
              ||||||||||||||||||||||||||||||||||||||||||||||||||||||||||||
    a901      FSKSSEAFAEIYDKDHAFAAATMAFLAGMGGIALIDRLVPNPHETLDAQDPSFQESKRRH
                 70         80         90        100        110        120

130        140        150        160        170        180
    m901.pep  IARVGMMAAFAITAHNFPEGLATFFATLENPAVGMPLALAIAIHNIPEGISIAAPVYFAT
              ||||||||||||||||||||||||||||||||||||||||||||||||||||||||||||
    a901      IARVGMMAAFAITAHNFPEGLATFFATLENPAVGMPLALAIAIHNIPEGISIAAPVYFAT
                130        140        150        160        170        180

190        200        210        220        230        240
    m901.pep  RSRKKTVWACLLSGLAEPLGAALGYLVLQPFLSPAVFGSVFGVIAGVMVFLALDELXPAA
              ||||||||||||||||||||||||||||||||||||||||||||||||||||||||| ||
    a901      RSRKKTVWACLLSGLAEPLGAALGYLVLQPFLSPAVFGSVFGVIAGVMVFLALDELLPAA
                190        200        210        220        230        240
```

```
                         250         260         270
m901.pep   KRYSDGHETVYGLTTGMAVIAVSLVLFHFX
           ||||||||||||| |||||||||||||||
a901       KRYSDGHETVYGLTTGMAVIAVSLVLFHFX
                         250         260         270
```

The following partial DNA sequence was identified in *N. gonorrhoeae* <SEQ ID 2709>:

```
g902.seq
    1   ATGCCGTCCG AACCCGAACG GCGGCATGGC AATACTGCCC TACCCTTCCC

51   GATAGCCGCA CGCCCAACGG TCGGTTTTTC CGGCAAGCCT TTCAAGATAA

101   CCGGCAAGTG TGTCGTATTG CGCCGCCGCA TTGTCCAAGC GGTTGATTTC

151   ACGCCGCGCC TGTTCGCCGT CGGGCATTTC GCCGATGTAC CAGCCTATGT

201   GTTTGCGTGC GATGCGCACA CCGACGGTCT CACCATAAAA CGCGTGCATG

251   GCGCGGATGT GGTTCAAAAT GGCGGCTCTG CATTCTGCCA AACTCAAGGC

301   AGGCGGTAAA ACGCCGTGTT CGGCATAATG CTTCAAATCG CGGAAAAACC

351   ACGGCCTGCC TTGCGCGCCG CGCCCTATCA TGATGCCGTC GGCGGCGGTT

401   TGTTTGAGGA cggCGGCGGC TTTTTgcggc GAagtGATGT CGCCGTTGac 451   cCaggCCGGG ATGTTCAGAc ggCTTTTGGT CTCGGcgatg agttCGTAAC 501   gcGCCTCGCC TTTGTACATT TGCGTGcgcG CGcgcccgtg aacggcaaGg 551   gcggcaatgc cgcaatcttc ggcgattttg gcgacggcgG gcaggttttg 601   atcgtcgtcg tgccaaccca AacggGTTTT GaggGTAACG GGTAcgcCCG 651   CCGCCTTgac caccgcctcc aAAatggcGg caaccagcgg CTCGTCCTGC 701   ATCagcGCGC TACCGGCTTG GACGTTGCAC ACTTTCttgg cgggGCAGCC 751   CATAttgATG TCGATGACCT GCGCCCCGAG TCCGACGTTg taacgcgccg 801   catCCGCCAT CtgttcggGG TCGCTGCCGG CAATCTGCAC GGCAACGATG 851   CCGccttcat cggcaAAAtc actgcggtgc aGGGTTTTTC CGGTATTCCT

901   GAGCGTCGGA TCGCTGGCCA GCATTTCGCA CACCGCCCAA CCTGCGCCAA

951   ACGCCCGACA GAGGCGGCGG AAGGGTTTGT CGGCAATGCC CGCCATCGGC

1001   GCAAGTGCGA TGGGGTTGTC GATAAAATAA CCGCCGATGT GCATAATGGG

1051   CCCGCGTTTC AAAAAGTGC GCCATTGTAC ATTTTTTAA
```

This corresponds to the amino acid sequence <SEQ ID 2710; ORF 902.ng>:

```
g902.pep
    1   MPSEPERRHG NTALPFPIAA RPTVGFSGKP FKITGKCVVL RRRIVQAVDF

51   TPRLFAVGHF ADVPAYVFAC DAHTDGLTIK RVHGADVVQN GGSAFCQTQG

101   RR*NAVFGIM LQIAEKPRPA LRAAPYHDAV GGGLFEDGGG FLRRSDVAVD

151   PGRDVQTAFG LGDEFVTRLA FVHLRARAPV NGKGGNAAIF GDFGDGGQVL

201   IVVVPTQTGF EGNGYARRLD HRLQNGGNQR LVLHQRATGL DVAHFLGGAA
```

```
    251  HIDVDDLRPE SDVVTRRIRH LFGVAAGNLH GNDAAFIGKI TAVQGFSGIP

301  ERRIAGQHFA HRPTCAKRPT EAAEGFVGNA RHRRKCDGVV DKITADVHNG

351  PAFQKSAPLY IF*
```

The following partial DNA sequence was identified in *N. meningitidis* <SEQ ID 2711>:

```
m902.seq
      1  TTGCACTTTC AAAGGATAAT CAAGTGTTCA GAAGGCATTT GGGCGGTAGG

51  CGCACGCCCA ACTGTCGGTT TTTTCGGCAA GTCTTTCAAG ATAACCTGCA

101  AGCATGTCGT ATTGCGCCGC CGCACTGTCC AAGCGGTTGA TTTCACGACG

151  TgTCTgTTCG CCGTcGGGCA TTTCGTCGAT GTACCAGCCT ATGTGTTTGC

201  GTGCGATGCG CACACCGGCG GTGTCGCCGT AAAACGCGTG TATGGCGCGG

251  ATGTGGTTCA AAATAGCGGC GGCGCATTCT GCCAAACTCA AGGCAGGCGG

301  CAAAACACCG TGTTCGGCAT AATGTTTCAA ATCGCGGAAG AACCACGGCC

351  TGCCTTGCGC GCCGCGCCCT ATCATAATGC CGTCGGCGGC GGTTTGTTTG

401  AGGACGGCTT GGGCTTTTTG CGGCGAAGTA ATGTCGCCGT TGACCCAGAC

451  CGGGATGTTC AGACGGCATT TGGTTTCGGC GATGAGTTCG TAACGCGCTT

501  CGCCTTTGTA CATTTGCGTA CGCGTGCGTC CGTGGACGGC AAGGGCGGCG

551  ATGCCGCAAT CTTCGGCGAT TTTGGCGATG ACGGGCAGGT TTTGATGGTC

601  GTCGTGCCAA CCCAAACGGG TTTTGAGGGT AACGGGTACG CCTGCCGCAC

651  GGACGACGGC TTCCAAAATG GCGGCAACCA GCGGCTCGTT CTGCATCAGC

701  GCGCTACCGG CTTGGACATT GCAGACTTTT TTAGCGGGAC AGCCCATGTT

751  GATGTCGATA AGCTGCGCCC CAAGGCTGAC GTTGTAACGC GCGGCATCCG

801  CCATCTGCTG CGGATCGCTT CCGGCAATCT GCACGGCAAC AATGCCGCCT

851  TCATCGGCAA AATCGCTGCG GTGCAAGGTT TTTCTAGTAT TTCTGAGCGT

901  CGGGTCGCTG GTCAGCATTT CGCACACCGC CCAACCTGCG CCAAAATCTC

951  GGCAAAGTCG GCGGAACGGT TTGTCGGTAA TGCCCGCCAT CGGcGCaAGT

1001  GCGATGGGGT TGTCGATAAA ATAGCCGCCG ATGTGCATAA TGGATCCGCG

1051  TTTCAAAAAA GTACGCCATT GTACATTTTT TAA
```

This corresponds to the amino acid sequence <SEQ ID 2712; ORF 902>:

```
m902.pep
      1  LHFQRIIKCS EGIWAVGARP TVGFFGKSFK ITCKHVVLRR RTVQAVDFTT

51  CLFAVGHFVD VPAYVFACDA HTGGVAVKRV YGADVVQNSG GAFCQTQGRR

101  QNTVFGIMFQ IAEEPRPALR AAPYHNAVGG GLFEDGLGFL RRSNVAVDPD

151  RDVQTAFGFG DEFVTRFAFV HLRTRASVDG KGGDAAIFGD FGDDGQVLMV

201  VVPTQTGFEG NGYACRTDDG FQNGGNQRLV LHQRATGLDI ADFFSGTAHV

251  DVDKLRPKAD VVTRGIRHLL RIASGNLHGN NAAFIGKIAA VQGFSSISER

301  RVAGQHFAHR PTCAKISAKS AERFVGNARH RRKCDGVVDK IAADVHNGSA

351  FQKSTPLYIF *
```

Computer analysis of this amino acid sequence gave the following results:
Homology with a Predicted ORF from *N. gonorrhoeae*
ORF 902 shows 80.9% identity over a 345 aa overlap with a predicted ORF (ORF 902.ng) from *N. gonorrhoeae*:

```
m902/g902
                  10        20        30        40        50
   m902.pep  LHFQRIIKCSEGIWAVGARPTVGFFGKSFKITCKHVVLRRRTVQAVDFTTCLFAVGHF
                ::|||||||  ||  ||||  |  |||||||  ||||||||    |||||||
   g902      MPSEPERRHGNTALPFPIAARPTVGFSGKPFKITGKCVVLRRRIVQAVDFTPRLFAVGHF
             10        20        30        40        50        60

60        70        80        90       100       110
   m902.pep  VDVPAYVFACDAHTGGVAVKRVYGADVVQNSGGAFCQTQGRRQNTVFGIMFQIAEEPRPA
             :|||||||||||||||  |:::|||:|||||||||:|:|||||||||||:|||||:||||
   g902      ADVPAYVFACDAHTDGLTIKRVHGADVVQNGGSAFCQTQGRRXNAVFGIMLQIAEKPRPA
             70        80        90       100       110       120

120       130       140       150       160       170
   m902.pep  LRAAPYHNAVGGGLFEDGLGFLRRSNVAVDPDRDVQTAFGFGDEFVTRFAFVHLRTRASV
             ||||||||:||||||||||  ||||||:||||||||||||||:|||||||||:|||||::|
   g902      LRAAPYHDAVGGGLFEDGGGFLRRSDVAVDPGRDVQTAFGLGDEFVTRLAFVHLRARAPV
             130       140       150       160       170       180

180       190       200       210       220       230
   m902.pep  DGKGGDAAIFGDFGDDGQVLMVVVPTQTGFEGNGYACRTDDGFQNGGNQRLVLHQRATGL
             :||||:||||||||||||||  ||||||||||||||||||  |  :|||||||||||||||
   g902      NGKGGNAAIFGDFGDGGQVLIVVVPTQTGFEGNGYARRLDHRLQNGGNQRLVLHQRATGL
             190       200       210       220       230       240

240       250       260       270       280       290
   m902.pep  DIADFFSGTAHVDVDKLRPKADVVTRGIRHLLRIASGNLHGNNAAFIGKIAAVQGFSSIS
             |:| |::::|::|||  |||:::||||| ||||::  :|:|||||||:|||||||:|||||:|
   g902      DVAHFLGGAAHIDVDDLRPESDVVTRRIRHLFGVAAGNLHGNDAAFIGKITAVQGFSGIP
             250       260       270       280       290       300

300       310       320       330       340       350
   m902.pep  ERRVAGQHFAHRPTCAKISAKSAERFVGNARHRRKCDGVVDKIAADVHNGSAFQKSTPLY
             |||:||||||||||||||::  :||||||||||||||||||||||:|||||||||:||
   g902      ERRIAGQHFAHRPTCAKRPTEAAEGFVGNARHRRKCDGVVDKITADVHNGPAFQKSAPLY
             310       320       330       340       350       360

360
   m902.pep  IFX
             |||
   g902      IFX
```

The following partial DNA sequence was identified in *N. meningitidis* <SEQ ID 2713>:

```
a902.seq
     1    TTGCACTTTC AAAGGATAAT CAAGTGTTCA GAAGGCATTT GGGCGGTAGG

51    CGCACGCCCA ACTGTCGGTT TTTTCGGCAA GTCTTTCAAG ATAACCTGCA

101    AACATGTCGT ATTGCGCCGC CGCACTGTCC AAGCGGTTGA TTTCACGACG

151    TGTCTGTTCG CCGTCGGGCA TTTCGTCGAT GTACCAGCCT ATGTGTTTGC

201    GTGCGATGCG CACACCGGCG GTGTCGCCGT AAAACGCGTG CATGGCTCGG

251    ATGTGGTTCA AAATAGTGGC GGTACATTCT GCCAAACTCA AGGCAGGCGG

301    TAAAACACCG TGTTCGGCGT AATGTTTCAA ATCGCGGAAG AACCACGGTC

351    TGCCTTGCGC GCCGCGCCCT ATCATAATGC CGTCTGCGGC GGTTTGTTTG

401    AGGACGGCTT GGGCTTTTTG CGGCGAGGTA ATGTCGCCGT TGACCCAGAC

451    CGGGATGTTC AGACGGCATT TGGTTTCGGC AATCAGGTCG TAAGCCGCTT

501    CGCCTTTGTA CATTTGCGTG CGCGTGCGTC CGTGGACGGC AAGGGCGGCA

551    ATGCCGCAAT CTTCGGCGAT TTTGGCGATG ACGGGCAGGT TTTGATGGTC

601    GTCGTGCCAA CCCAAACGGG TTTTGAGGGT AACGGGTACG CCCGCCGCTT
```

```
 651  TGACCACCGC CTCCAAAATG GCGGCAACCA GCGGCTCGTT CTGCATCAGC

701  GCGCTACCGG CTTGGACATT GCAGACTTTT TTAGCGGGAC AGCCCATGTT

751  GATGTCGATA AGCTGCGCCC CAAGGCTGAC GTTGTAACGC GCGGCATCCG

801  CCATCTGCTG CGGATCGCTT CCGGCAATCT GCACGGCAAC AATGCCGCCT

851  TCATCGGCAA AATCGCTGCG GTGCAAGGTT TTTCTAGTAT TTCTGAGCGT

901  CGGGTCGCTG GTCAGCATTT CGCACACCGC CCAACCTGCG CCAAAATCTC

951  GGCAAAGTCG GCGGAACGGT TTGTCGGTAA TGCCCGCCAT CGGCGCAAGT

1001  GCGATGGGGT TGTCGATAAA ATAGCCGCCG ATGTGCATAA TGGATCCGCG

1051  TTTCAAAAAA GTACGCCATT GTACATTTTT TAA
```

This corresponds to the amino acid sequence <SEQ ID 2714; ORF 902.a>:

```
a902.pep
    1   LHFQRIIKCS EGIWAVGARP TVGFFGKSFK ITCKHVVLRR RTVQAVDFTT

51   CLFAVGHFVD VPAYVFACDA HTGGVAVKRV HGSDVVQNSG GTFCQTQGRR

101   *NTVFGVMFQ IAEEPRSALR AAPYHNAVCG GLFEDGLGFL RRGNVAVDPD

151   RDVQTAFGFG NQVVSRFAFV HLRARASVDG KGGNAAIFGD FGDDGQVLMV

201   VVPTQTGFEG NGYARRFDHR LQNGGNQRLV LHQRATGLDI ADFFSGTAHV

251   DVDKLRPKAD VVTRGIRHLL RIASGNLHGN NAAFIGKIAA VQGFSSISER

301   RVAGQHFAHR PTCAKISAKS AERFVGNARH RRKCDGVVDK IAADVHNGSA

351   FQKSTPLYIF *
``` m902/a902 94.7% identity in 360 aa overlap

```
                 10         20         30         40         50         60
m902.pep  LHFQRIIKCSEGIWAVGARPTVGFFGKSFKITCKHVVLRRRTVQAVDFTTCLFAVGHFVD
          ||||||||||||||||||||||||||||||||||||||||||||||||||||||||||||
a902      LHFQRIIKCSEGIWAVGARPTVGFFGKSFKITCKHVVLRRRTVQAVDFTTCLFAVGHFVD
                 10         20         30         40         50         60

70         80         90        100        110        120
m902.pep  VPAYVFACDAHTGGVAVKRVYGADVVQNSGGAFCQTQGRRQNTVFGIMFQIAEEPRPALR
          ||||||||||||||||||||:|:||||||||:|||||||||||||:|||||||||||:||
a902      VPAYVFACDAHTGGVAVKRVHGSDVVQNSGGTFCQTQGRRXNTVFGVMFQIAEEPRSALR
                 70         80         90        100        110        120

130        140        150        160        170        180
m902.pep  AAPYHNAVGGGLFEDGLGFLRRSNVAVDPDRDVQTAFGFGDEFVTRFAFVHLRTRASVDG
          ||||||||  ||||||||||||  |||||||||||||||| : : |||||||||| ||||
a902      AAPYHNAVCGGLFEDGLGFLRRGNVAVDPDRDVQTAFGFGNQVVSRFAFVHLRARASVDG
                130        140        150        160        170        180

190        200        210        220        230        240
m902.pep  KGGDAAIFGDFGDDGQVLMVVVPTQTGFEGNGYACRTDDGFQNGGNQRLVLHQRATGLDI
          |||:||||||||||||||||||||||||||||||   |  |  :|||||||||||||||
a902      KGGNAAIFGDFGDDGQVLMVVVPTQTGFEGNGYARRFDHRLQNGGNQRLVLHQRATGLDI
                190        200        210        220        230        240

250        260        270        280        290        300
m902.pep  ADFFSGTAHVDVDKLRPKADVVTRGIRHLLRIASGNLHGNNAAFIGKIAAVQGFSSISER
          ||||||||||||||||||||||||||||||||||||||||||||||||||||||||||||
a902      ADFFSGTAHVDVDKLRPKADVVTRGIRHLLRIASGNLHGNNAAFIGKIAAVQGFSSISER
                250        260        270        280        290        300

310        320        330        340        350        360
m902.pep  RVAGQHFAHRPTCAKISAKSAERFVGBARHRRKCDGVVDKIAADVHNGSAFQKSTPLYIF
          ||||||||||||||||||||||||||  ||||||||||||||||||||||||||||||||
a902      RVAGQHFAHRPTCAKISAKSAERFVGBARHRRKCDGVVDKIAADVHNGSAFQKSTPLYIF
                310        320        330        340        350        360 m902.pep  X
          |
a902      X
```

The following partial DNA sequence was identified in *N. gonorrhoeae* <SEQ ID 2715>:

```
g903.seq
    1   ATGGCAACAC AGGTAGGCGG TGCAAattcG gatgaggCAA GCCCCTGCTT
   51   TCCTATTTCT GAGGTGGAaT TGGTGGGTGA aGaaacggct aAATTCCGgt
  101   tTGCGCTcaa ccaTGCCTTG tgccAAACAC ATTTTGtttc cGgcaagtgt
  151   CTGcATGcgg gcgacatTAA TCAAAtcaTG TCCTTAGCAC AAAATGCTTT
  201   GATCGGCAGG GGATATACCA CGACCCGTAT CTTGGCTGCG CCACAGGATT
  251   TGAATAGTGG caaGCTTCAA TTAAccctga tgccggGCTA TCtgcgctcC
  301   ATAcgaATCG atcggtccaa cgatgatcaa ACCCATgcAG GACGTATTGC
  351   AGCATTCCAA AACAAATTTC CCACCCGCTC GAACGATCTG TTGAATCTGC
  401   GTGATTTGGA ACAAGGACTG GAAAATCTCA AATGTCTCCC GACTGCGGAA
  451   GCCGATCTCC AAATCgttcc cgtaGAGAGA GAACcAAACC AAAGTGATGT
  501   CGTGGTGCAA TGGCGGTAAC GTCTGCTGCC CTACTGTGTG AGTGTGGGGA
  551   TGGATAATTC GGGTAGTGAG GCGACAGGAA AATACCAAGG AAATATCACT
  601   TTCTCTGCCG ACAATCCTTT TggactgAGT GATATGTTCT ATGTAAATTA
  651   TGGACGTTCA ATTGGCGGTA CGcccgATGA GGAAAATTTT GACGGCCATC
  701   GCAAGAAGG CGGATCAAAC AATTACGCCG TACATTATTC AGCCCCTTTC
  751   GGTAAATGGA CATGGGCATT CAATCACAAT GGCTACCGTT ACCATCAGGC
  801   GGTTTCCGGA TTATCGGAAG TCTATGACTA TAATGGAAAA AGTTACAACA
  851   CTGATTTCGG CTTCAACCGC CTGTTGTATC GTGATGCCAA ACGCAAAACC
  901   TATCTCAGTG TAAAACTGTG GACGAGGGAA ACAAAAGTT ACATTGATGA
  951   TGCCGAACTG ACTGTACAAC GGCGTAAAAC CACAGGTTGG TTGGCAGAAC
 1001   TTTCCCACAA AGGATATATC GGTCGCAGTA CGGCAGATTT TAAGTTGAAA
 1051   TATAAACACG GCACCGGCAT GAAAGATGCT CTGCGCGCGC CTGAAGAAGC
 1101   CTTTGGCGAA GGCACGTCAC GTATGAAAAT TTGGACGGCA TCGGCTGATG
 1151   TAAATACTCC TTTTCAAATC GGTAAACAGC TATTTGCCTA TGACACATCC
 1201   GTTCATGCAC AATGGAACAA AACCCCGCTA ACATCGCAAG ACAAACTGGC
 1251   TATCGGCGGA CACCACACCG TACGTGGCTT CGACGGTGAA ATGAGTTTGC
 1301   CTGCCGAGCG GGGATGGTAT TGGCGCAACG ATTTGAGCTG GCAATTTAAA
 1351   CCAGGCCATC AGCTTTATCT TGGGGCTGAT GTAGGACATG TTTCAGGACA
 1401   ATCCGCCAAA TGGTTATCGG GCCAAACTCT AGCCGGCACA GCAATTGGGA
 1451   TACGCGGGCA GATAAAGCTT GGCGGCAACC TGCATTACGA TATATTTACC
 1501   GGCCGTGCAT TGAAAAAGCC cgaatatttt cAGACGAAGA AatgggtaacC
 1551   ggggtTTCAG gtgggttatt cgTTTTGA
```

This corresponds to the amino acid sequence <SEQ ID 2716; ORF 903.ng>:

```
g903.pep
    1   MATQVGGANS DEASPCFPIS EVELVGEETA KFRFALNHAL CQTHFVSGKC
   51   LHAGDINQIM SLAQNALIGR GYTTTRILAA PQDLNSGKLQ LTLMPGYLRS
  101   IRIDRSNDDQ THAGRIAAFQ NKFPTRSNDL LNLRDLEQGL ENLKCLPTAE
```

```
151   ADLQIVPVER EPNQSDVVVQ WRXRLLPYCV SVGMDNSGSE ATGKYQGNIT

201   FSADNPFGLS DMFYVNYGRS IGGTPDEENF DGHRKEGGSN NYAVHYSAPF

251   GKWTWAFNHN GYRYHQAVSG LSEVYDYNGK SYNTDFGFNR LLYRDAKRKT

301   YLSVKLWTRE TKSYIDDAEL TVQRRKTTGW LAELSHKGYI GRSTADFKLK

351   YKHGTGMKDA LRAPEEAFGE GTSRMKIWTA SADVNTPFQI GKQLFAYDTS

401   VHAQWNKTPL TSQDKLAIGG HHTVRGFDGE MSLPAERGWY WRNDLSWQFK

451   PGHQLYLGAD VGHVSGQSAK WLSGQTLAGT AIGIRGQIKL GGNLHYDIFT

501   GRALKKPEYF QTKKWVTGFQ VGYSF*
```

The following partial DNA sequence was identified in *N. meningitidis* <SEQ ID 2717>:

```
m903.seq
   1  ATGCAGCGTC AGCAGCACAT AGATGCTGAA TTGTTAACTG ATGCAAATGT
  51  CCGTTTCGAG CAACCATTGG AGAAGAACAA TTATGTCCTG AGTGAAGATG
 101  AAACACCGTG TACTCGGGTA AATTACATTA GTTTAGATGA TAAGACGGTG
 151  CGCAAATTTT CTTTTCTTCC TTCTGTGCTC ATGAAAGAAA CAGCTTTTAA
 201  AACTGGGATG TGTTTAGGTT CCAATAATTT GAGCAGGCTA CAAAAAGCCG
 251  CGCAACAGAT ACTGATCGTG CGTGGCTACC TCACTTCCCA AGCTATTATC
 301  CAaCCACAGA ATATGGATTC GGGAATTCTG AAATTACGGG TATCAGCAGG
 351  CGAAATAGGG GATATCCGCT ATGAAGAAAA ACGGGATGGG AAGTCTGCCG
 401  AGGGCAGTAT TAGTGCATTC AATAACAAAT TTCCCTTATA TAGGAACAAA
 451  ATTCTCAATC TTCGCGATGT AGAGCAGGGC TTGGAAAACC TGCGTCGTTT
 501  GCCGAGTGTT AAAACAGATA TTCAGATTAT ACCGTCCGAA GAAGAAGGCA
 551  AAAGCGATTT ACAGATCAAA TGGCAGCAGA ATAAACCCAT ACGGTTCAGT
 601  ATCGGTATAG ATGATGCGGG CGGCAAAACG ACCGGCAAAT ATCAAGGAAA
 651  TGTCGCTTTA TCGTTCGATA ACCCTTTGGG CTTAAGCGAT TTGTTtTATG
 701  TTTCATATGG ACGCGGTTTG GCGCACAAAA CGGACTTGAC TGATGCCACC
 751  GGTACGGAAA CTGAAAGCGG ATCCAGAAGT TACAGCGTGC ATTATTCGGT
 801  GCCCGTAAAA AAATGGCTGT TTTCTTTTAA TCACAATGGA CATCGTTACC
 851  ACGAAGCAAC CGAAGGCTAT TCCGTCAATT ACGATTACAA CGGCAAACAA
 901  TATCAGAGCA GCCTGGCCGC CGAGCGCATG CTTTGGCGTA ACAGACTTCA
 951  TAAAACTTCA GTCGGAATGA AATTATGGAC ACGCCAAACC TATAAATACA
1001  TCGACGATGC CGAAATCGAA GTACAACGCC GCCGCTCTGC AGGCTGGGAA
1051  GCCGAATTGC GCCACCGTGC TTACCTCAAC CGTTGGCAGC TTGACGGCAA
1101  GTTGTCTTAC AAACGCGGGA CCGGCATGCG CCAAAGTATG CCTGCACCGG
1151  AAGAAACGG CGGCGATATT CTTCCAGGTA CATCTCGTAT GAAAATCATT
1201  ACTGCCAGTT TGGACGCAGC CGCCCCATTT AyTTTAGGCA AACAGCAGTT
1251  TTTCTACGCA ACCGCCATTC AAGCTCAATG GAACAAAACG CCGTTGGTTG
1301  CCCAAGATAA ATTGTCAATC GGCAGCCGCT ACACCGTTCG CGGATTTGAT
1351  GGGGAGCAGA GTCTTTTCGG AGAGCGAGGT TTCTACTGGC AGAATACTTT
1401  AACTTGGTAT TTTCATCCGA ACCATCAGTT CTATCTCGGT GCGGACTATG
```

```
1451  GCCGCGTATC TGGCGAAAGT GCACAATATG TATCGGGCAA GCAGCTGATG

1501  GGTGCAGTGG TCGGCTTCAG AGGAGGGCAT AAAGTAGGCG GTATGTTTGC

1551  TTATGATCTG TTTGCCGGCA AGCCGCTTCA TAAACCCAAA GGCTTTCAGA

1601  CGACCAACAC CGTTTACGGC TTCAACTTGA ATTACAGTTT CTAA
```

This corresponds to the amino acid sequence <SEQ ID 2718; ORF 903>:

```
m903.pep
    1  MQRQQHIDAE LLTDANVRFE QPLEKNNYVL SEDETPCTRV NYISLDDKTV

51  RKFSFLPSVL MKETAFKTGM CLGSNNLSRL QKAAQQILIV RGYLTSQAII

101  QPQNMDSGIL KLRVSAGEIG DIRYEEKRDG KSAEGSISAF NNKFPLYRNK

151  ILNLRDVEQG LENLRRLPSV KTDIQIIPSE EEGKSDLQIK WQQNKPIRFS

201  IGIDDAGGKT TGKYQGNVAL SFDNPLGLSD LFYVSYGRGL AHKTDLTDAT

251  GTETESGSRS YSVHYSVPVK KWLFSFNHNG HRYHEATEGY SVNYDYNGKQ

301  YQSSLAAERM LWRNRLHKTS VGMKLWTRQT YKYIDDAEIE VQRRRSAGWE

351  AELRHRAYLN RWQLDGKLSY KRGTGMRQSM PAPEENGGDI LPGTSRMKII

401  TASLDAAAPF XLGKQQFFYA TAIQAQWNKT PLVAQDKLSI GSRYTVRGFD

451  GEQSLFGERG FYWQNTLTWY FHPNHQFYLG ADYGRVSGES AQYVSGKQLM

501  GAVVGFRGGH KVGGMFAYDL FAGKPLHKPK GFQTTNTVYG FNLNYSF*
```

Computer analysis of this amino acid sequence gave the following results:
Homology with a Predicted ORF from *N. gonorrhoeae*
ORF 903 shows 48.9% identity over a 519 aa overlap with a predicted ORF (ORF 903.ng) from *N. gonorrhoeae*:

```
   m903/g903
                   10         20         30         40         50         60
   m903.pep    MQRQQHIDAELLTDANVRFEQPLEKNNYVLSEDETPCTRVNYISLDDKTVRKFDFLPSVL
                                      |::: :||   ::  :   :  :  ||  |    :
   g903                       MATQVGGANSDEASPCFPISEVELVGEETAKFRFALNHA
                                       10         20         30

70         80         90        100        110        120
   m903.pep    MKETAFKTGMCLGSNNLSRLQKAAQQILIVRGYLTSQAIIQPQNMDSGILKLRVSAGEIG
                : :|  :| ||  :::::::  ||:  ||  |||   :     || ::||  |:|   |  |  :
   g903        LCQTHFVSGKCLHAGDINQIMSLAQNALIGRGYTTTRILAAPQDLNSGKLQLTLMPGYLR
                       40         50         60         70         80         90

130        140        150        160        170        180
   m903.pep    DIRYEEKRDGKSAEGSISAFNNKFPLYRNKILNLRDVEQGLENLRRLPSVKTDIQIIPSE
                :||  :::  |::   |:||:||||    :  ||||||:  ||::::|||||:  |
   g903        SIRIDRSNDDQTHAGRIAAFQNKFPTRSNDLLNLRDLEQGLENLKCLPTAEADLQIVPVE
                       100        110        120        130        140        150

190        200        210        220        230
   m903.pep    EE-GKSDLQIKWQQNK-PIRFSIGIDDAGGKTTGKYQGNVALSFDNPLGLSDLFYVSYGR
                :|  ::||: ::|:     |     |:|:|::|:::|||||||:::| |||:||||:|||:|||
   g903        REPNQSDVVVQWRXRLLPYCVSVGMDNSGSEATGKYQGNITFSADNPFGLSDMFVNYGR
                       160        170        180        190        200        210

240        250        260        270        280        290
   m903.pep    GLAHKTDLTDATGTETESGSRSYSVHYSVPVKKWLFSFNHNGHRYHEATEGYSVNYDYNG
                :::   |   :  | :|||  :|:||||:|  || ::|||||||||:|:|  |  ||||
   g903        SIGGTPDEENFDGHRKEGGSNNYAVHYSAPFGKWTWAFNHNGYRYHQAVSGLSEVYDYNG
                       220        230        240        250        260        270

300        310        320        330        340        350
   m903.pep    KQYQSSLAAERMLWRNRLHKTSVGMKLWTRQTYKYIDDAEIEVQRRRSAGWEAELRHRAY
                |:|::::::  :|:|:|:   :||  :::|||||:|  :|||||||:  ||   ||| |::|
   g903        KSYNTDFGFNRLLYRDAKRKTYLSVKLWTRETKSYIDDAELTVQRRKTTGWLAELSHGKY
                       280        290        300        310        320        330
```

```
              360       370        380       390       400        410
m903.pep  LNRWQLDGKLSYKRGTGMRQSMPAPEENGGDILPGTSRMKIITASLDAAAPFXLGKQQFF
          ::|    ||:|:|||:::: ||||  |:   ||||||||  ||| |: :|| :|||  |
g903      IRGSTADFKLKYKHGTGMKDALRAPEEAFGE---GTSRMKIWTASADVNTPFQIGKQLFA
              340       350        360       370       380        390

420       430        440       450       460        470
m903.pep  YATAIQAQWNKTPLVAQDKLSIGSRYTVRGFDGEQSLFGERGFYWQNTLTWYFHPNHQFY
          |  |:::||||||||||::||||:||:::||||||||||:||  :|||:||:|  |:| :|:||:|
g903      YDTSVHAQWNKTPLTSQDKLAIGGHHTVRGFDGEMSLPAERGWYWRNDLSWQFKPGHQLY
              400       410        420       430       440        450

480       490        500       510       520        530
m903.pep  LGADYGRVSGESAQYVSGKQLMGAVVGFRGGHKVGGMFAYDLFAGKPLHKPKGFQTTNTV
          ||||  |:||:||:::||:  | |::::|:||   |:||   |:|:|:   |:||:  |||  :  |
g903      LGADVGHVSGQSAKWLSGQTLAGTAIGIRGQIKLGGNLHYDIFTGRALKKPEYFQTKKWV
              460       470        480       490       500        510

540
m903.pep  YGFNLNYSFX
          ||:::||||
g903      TGFQVGYSFX
              520
```

The following partial DNA sequence was identified in *N. meningitidis* <SEQ ID 2719>:

```
a903.seq
    1   ATGCAGCGTC AGCAGCACAT AGATGCTGAA TTGTTAACTG ATGCAAATGT

51   CCGTTTCGAG CAACCATTGG AGAAGAACAA TTATGTCCTG AGTGAAGATG

101   AAACACCGTG TACTCGGGTA AATTACATTA GTTTAGATGA TAAGACGGCG

151   CGCAAATTTT CTTTTCTTCC TTCTGTGCTC ATGAAAGAAA CAGCTTTTAA

201   AACTGGGATG TGTTTAGGTT CCAATAATTT GAGCAGGCTA CAAAAAGCCG

251   CGCAACAGAT ACTGATTGTG CGTGGCTACC TCACTTCCCA AGCTATTATC

301   CAACCACAGA ATATGGATTC GGGAATTCTG AAATTACGGG TATCAGCAGG

351   CGAAATAGGG GATATCCGCT ATGAAGAAAA ACGGGATGGG AAGTCTGCCG

401   AGGGCAGTAT TAGTGCATTC AATAACAAAT TTCCCTTATA TAGGAACAAA

451   ATTCTCAATC TTCGCGATGT AGAGCAGGGC TTGGAAAACC TGCGTCGTTT

501   GCCGAGTGTT AAAACAGATA TTCAGATTAT ACCGTCCGAA GAAGAAGGCA

551   AAAGCGATTT ACAGATCAAA TGGCAGCAGA ATAAACCCAT ACGGTTCAGT

601   ATCGGTATAG ATGATGCGGG CGGCAAAACG ACCGGCAAAT ATCAAGGAAA

651   TGTCGCTTTA TCGTTCGATA ACCCTTTGGG CTTAAGCGAT TTGTTTTATG

701   TTTCATATGG ACGCGGTTTG GTGCACAAAA CGGACTTGAC TGATGCCACC

751   GGTACGGAAA CTGAAAGCGG ATCCAGAAGT TACAGCGTGC ATTATTCGGT

801   GCCCGTAAAA AAATGGCTGT TTTCTTTTAA TCACAATGGA CATCGTTACC

851   ACGAAGCAAC CGAAGGCTAT TCCGTCAATT ACGATTACAA CGGCAAACAA

901   TATCAGAGCA GCCTGGCCGC CGAGCGCATG CTTTGGCGTA ACAGGTTTCA

951   TAAAACTTCA GTCGGAATGA AATTATGGAC ACGCCAAACC TATAAATACA

1001   TCGACGATGC CGAAATCGAA GTGCAACGCC GCCGCTCTGC AGGCTGGGAA

1051   GCCGAATTGC GCCACCGTGC TTACCTCAAC CGTTGGCAGC TTGACGGCAA

1101   GTTGTCTTAC AAACGCGGGA CCGGCATGCG CCAAAGTATG CCCGCACCTG

1151   AAGAAAACGG CGGCGGTACT ATTCCAGGCA CATCCCGTAT GAAAATCATA

1201   ACCGCCGGAT TGGATGCAGC GGCCCCGTTT ATGTTGGGCA AACAGCAGTT

1251   TTTCTACGCA ACCGCCATTC AAGCTCAATG GAACAAAACG CCTTTGGTTG
```

```
-continued
1301  CCCAAGACAA GTTGTCTATC GGCAGCCGCT ACACCGTTNG CGGATTTGAT

1351  GGGGAGCAGA GTCTTTTCGG AGAGCGAGGT TTCTACTGGC AGAATACTTT

1401  AACTTGGTAT TTTCATCCGA ACCATCAGTT CTATCTCGGT GCGGACTATG

1451  GCCGCGTATC TGGCGAAAGT GCACAATATG TATCGGGCAA GCAGCTGATG

1501  GGTGCAGTGG TCGGNTTCAG AGGAGGNCAT AAAGTAGGCG GTATGTTTGC

1551  TTATGATCTG TTTGCCGGCA AGCCGCTTCA TAAACCCAAA GGCTTTCAGA

1601  CGACCAACAC CGTTTACGGC TTCAACTTGA ATTACAGTTT CTAA
```

This corresponds to the amino acid sequence <SEQ ID 2720; ORF 903.a>:

```
a903.pep
  1  MQRQQHIDAE LLTDANVRFE QPLEKNNYVL SEDETPCTRV NYISLDDKTA

51  RKFSFLPSVL MKETAFKTGM CLGSNNLSRL QKAAQQILIV RGYLTSQAII

101  QPQNMDSGIL KLRVSAGEIG DIRYEEKRDG KSAEGSISAF NNKFPLYRNK

151  ILNLRDVEQG LENLRRLPSV KTDIQIIPSE EEGKSDLQIK WQQNKPIRFS

201  IGIDDAGGKT TGKYQGNVAL SFDNPLGLSD LFYVSYGRGL VHKTDLTDAT

251  GTETESGSRS YSVHYSVPVK KWLFSFNHNG HRYHEATEGY SVNYDYNGKQ

301  YQSSLAAERM LWRNRFHKTS VGMKLWTRQT YKYIDDAEIE VQRRRSAGWE

351  AELRHRAYLN RWQLDGKLSY KRGTGMRQSM PAPEENGGGT IPGTSRMKII

401  TAGLDAAAPF MLGKQQFFYA TAIQAQWNKT PLVAQDKLSI GSRYTVXGFD

451  GEQSLFGERG FYWQNTLTWY FHPNHQFYLG ADYGRVSGES AQYVSGKQLM

501  GAVVGFRGGH KVGGMFAYDL FAGKPLHKPK GFQTTNTVYG FNLNYSF*
``` m903/a903 98.4% identity in 547 aa overlap

```
                     10         20         30         40         50         60
  m903.pep  MQRQQHIDAELLTDANVRFEQPLEKNNYVLSEDETPCTRVNYISLDDKTVRKFSFLPSVL
            ||||||||||||||||||||||||||||||||||||||||||||||||:||||||||||
  a903      MQRQQHIDAELLTDANVRFEQPLEKNNYVLSEDETPCTRVNYISLDDKTARKFSFLPSVL
                     10         20         30         40         50         60

70         80         90        100        110        120
  m903.pep  MKETAFKTGMCLGSNNLSRLQKAAQQILIVRGYLTSQAIIQPQNMDSGILKLRVSAGEIG
            ||||||||||||||||||||||||||||||||||||||||||||||||||||||||||||
  a903      MKETAFKTGMCLGSNNLSRLQKAAQQILIVRGYLTSQAIIQPQNMDSGILKLRVSAGEIG
                     70         80         90        100        110        120

130        140        150        160        170        180
  m903.pep  DIRYEEKRDGKSAEGSISAFNNKFPLYRNKILNLRDVEQGLENLRRLPSVKTDIQIIPSE
            ||||||||||||||||||||||||||||||||||||||||||||||||||||||||||||
  a903      DIRYEEKRDGKSAEGSISAFNNKFPLYRNKILNLRDVEQGLENLRRLPSVKTDIQIIPSE
                    130        140        150        160        170        180

190        200        210        220        230        240
  m903.pep  EEGKSDLQIKWQQNKPIRFSIGIDDAGGKTTGKYQGNVALSFDNPLGLSDLFYVSYGRGL
            ||||||||||||||||||||||||||||||||||||||||||||||||||||||||||||
  a903      EEGKSDLQIKWQQNKPIRFSIGIDDAGGKTTGKYQGNVALSFDNPLGLSDLFYVSYGRGL
                    190        200        210        220        230        240

250        260        270        280        290        300
  m903.pep  AHKTDLTDATGTETESGSRSYSVHYSVPVKKWLFSFNHNGHRYHEATEGYSVNYDYNGKQ
            :|||||||||||||||||||||||||||||||||||||||||||||||||||||||||||
  a903      VHKTDLTDATGTETESGSRSYSVHYSVPVKKWLFSFNHNGHRYHEATEGYSVNYDYNGKQ
                    250        260        270        280        290        300

310        320        330        340        350        360
  m903.pep  YQSSLAAERMLWRNRLHKTSVGMKLWTRQTYKYIDDAEIEVQRRRSAGWEAELRHRAYLN
            |||||||||||||||:||||||||||||||||||||||||||||||||||||||||||||
  a903      YQSSLAAERMLWRNRFHKTSVGMKLWTRQTYKYIDDAEIEVQRRRSAGWEAELRHRAYLN
                    310        320        330        340        350        360
```

```
              370          380        390         400          410         420
m903.pep  RWQLDGKLSYKRGTGMRQSMPAPEENGGDILPGTSRMKIITASLDAAAPFXLGKQQFFYA
          ||||||||||||||||||||||||||| :|||||||||:|||||| ||||||||
a903      RWQLDGKLSYKRGTGMRQSMPAPEENGGGTIPGTSRMKIITAGLDAAAPFMLGKQQFFYA
              370          380        390         400          410         420

430          440        450         460          470         480
m903.pep  TAIQAQWNKTPLVAQDKLSIGSRYTVRGFDGEQSLFGERGFYWQNTLTWYFHPNHQFYLG
          |||||||||||||||||||||||||||| |||||||||||||||||||||||||||||
a903      TAIQAQWNKTPLVAQDKLSIGSRYTVXGFDGEQSLFGERGFYWQNTLTWYFHPNHQFYLG
              430          440        450         460          470         480

490          500        510         520          530         540
m903.pep  ADYGRVSGESAQYVSGKQLMGAVVGFRGGHKVGGMFAYDLFAGKPLHKPKGFQTTNTVYG
          ||||||||||||||||||||||||||||||||||||||||||||||||||||||||||
a903      ADYGRVSGESAQYVSGKQLMGAVVGFRGGHKVGGMFAYDLFAGKPLHKPKGFQTTNTVYG
              490          500        510         520          530         540 m903.pep  FNLNYSFX
          ||||||||
a903      FNLNYSFX
```

The following partial DNA sequence was identified in *N. gonorrhoeae* <SEQ ID 2721>:

```
g904.seq
   1   ATGATGCAGC ACAATCGTTT CTTCGCGGTC GGGGCCGGTg gaGACGATGG

51   CGACCGGCGC GCCGCAGACT TCTTCAATCC GTTTCAAATA TGCTTTGGCA

101   TTGGCAGGCA ATGCGTCGTA GCTTTTCACG CCGACAGTCG ATTCGCGCCA

151   GCCGGGCATG GTTTCGTAAA TCGGTTTGCA GGTTTCCACC GCATCCGAAC

201   CGCAAGGCAG GATGTCGGTT TTGCCGCCGC CTGGCAATTC GTAGCCGACG

251   CAGATATTGA TGGTTTCAAC GCCGTCCATT ACATCGAGTT TGGTAATGCA

301   CATACCGGAA ATGCCGTTGA TTTGGATGGA GCGTTTCAGG GCGGCGGCAT

351   CAAACCAGCC GCAGCGGCGC GCGCGGCCGG TTACCGAACC GAATTCGTGT

401   CCGCGCTCCG CCAAACCTGC GCCTACTTCG TCGAACAATT CGGTCGGGAA

451   CGGGCCCGAA CCGACGCGCG TGGTATAGGC TTTGACGATG CCCAAAACAT

501   AATCCAGCAT TTGAGGACCT ACGCCCGCGC CTGCCGAAGC CGCGCCGGCG

551   AGACAGTTGG ACGAGGTAAC GAAGGGGTAA GTGCCGTAGT CGATGTCCAA

601   CAACGCACCT TGCGCGCCTT CAAACAGCAG TTTTTCGCCG TTTTTGTTTT

651   TTTCGTTCAA CACGCgggaC acgtcgGCAA TCATCGGCGC AATGCGCGGC

701   GCGACTTTTT CGATAACCGC CATCACGTCT TCCGCTTTAA CCGGTCCGGC

751   GTTATGCAGG TATTGGAGTT GGACGTTGTA ATAGGCAAGG ACGGCATCCA

801   GTTTTTCACG CAGTTTTTCA GGATGCAGCA AATCGGCGGC GCGAATGGCG

851   CGGCGTGCCA CTTTGTCTTC GTAGGCAGGG CCGATGCCGC GGCCGGTCGT

901   GCCGATTTTG CCTTTGCCGC GCGATGCTTC GCGGGCTTGG TCGAGCGCGA

951   TGTGGTAAGG CAGGATCAGC GGGCAGGTCG GCGCGATTTT CAGACGGCCT

1001   TCGACGTTTT TCACGCCTGC CGCGTTCAAC TCGTCGATTT CGCCCAACAG

1051   GGCTTCGGGg gaaacgAcaa cGCCCGAACC gatGAAGCAA TCCAATCCTT

1101   CGTGCAGGAT ACCGCTCGGA ATCAGGCGCA AAATGGTTTT TTTGCCGCCG

1151   ACGACCAAGG TATGGCCCGC ATTGTGGCCG CCTTGGAAGC GCACgacGct 1201   gCCGGCTTCT TCCGCCAGCC AGTCAACGAT TTTACCTTTA CCCTCGTCGC 1251   CCCACTGTgc gccGATTACT ACAACATTTT TAGCCATAGC CATATAACCT 1301   ATCGatatTA A
```

This corresponds to the amino acid sequence <SEQ ID 2722; ORF 904.ng>:

```
g904.pep
     1  MMQHNRFFAV GAGGDDGDRR AADFFNPFQI CFGIGRQCVV AFHADSRFAP

51  AGHGFVNRFA GFHRIRTARQ DVGFAAAWQF VADADIDGFN AVHYIEFGNA

101  HTGNAVDLDG AFQGGGIKPA AAARAAGYRT EFVSALRQTC AYFVEQFGRE

151  RARTDARGIG FDDAQNIIQH LRTYARACRS RAGETVGRGN EGVSAVVDVQ

201  QRTLRAFKQQ FFAVFVFFVQ HAGHVGNHRR NARRDFFDNR HHVFRFNRSG

251  VMQVLELDVV IGKDGIQFFT QFFRMQQIGG ANGAACHFVF VGRADAAAGR

301  ADFAFAARCF AGLVERDVVR QDQRAGRRDF QTAFDVFHAC RVQLVDFAQQ

351  GFGGNDNART DEAIQSFVQD TARNQAQNGF FAADDQGMAR IVAALEAHDA

401  AGFFRQPVND FTFTLVAPLC ADYYNIFSHS HITYRY*
```

The following partial DNA sequence was identified in *N. meningitidis* <SEQ ID 2723>:

```
m904.seq
     1  ATGATGCAGC ACAATCGTTT CTTCTCGGTC GGGGCCGgTG GAGACGATGG

51  CGACCGGCGC GCCGCAGACT TCTTCAATCC GTTTCAAATA TGCTTTGGCG

101  TTTTCGGGCA ATGCGCCGTA GTCCTTCACG CCGAAAGTGG ATTCGCGCCA

151  GCCGGGCATG GTTTCGTAAA TCGGCTTGCA GGTTTCCACC GCATCGGAAC

201  CGCAAGGCAG GATGTCGGTT TTGCCGCCGT CGGGCAATTC ATAGCCGACG

251  CAGATATTGA TGGTTTCAAC GCCGTCCATT ACATCGAGTT TAGTAATACA

301  CATACCGGAA ATGCCGTTGA TTTGGATGGA GCGTTTCAGG GCGGCGGCAT

351  CAAACCAGCC GCAGCGGCGT GCGCGTCCGG TTACCGAACC GAATTCGTGT

401  CCGCGTTCTG CCAAACCTAC GCCTACTTCG TCGAACAATT CGGTCGGGAA

451  CGGGCCCGAA CCGACGCGCG TGGTATAGGC TTTGACGATG CCCAAAACAT

501  AATCCAGCAT TTGAGGACCT ACGCCCGCGC CTGCCGAAGC TGCGCCCGCC

551  AGACAGTTGG ACGAGGTAAC GAAGGGATAA GTGCCGTAGT CGATGTCCAA

601  CAACGCACCT TGCGCGCCTT CAAACAGCAG TTTTTCGCCG TTTTTGTTTT

651  TCTCGTTCAA CACGCGGGAC ACGTCGGTAA TCATCGGCGC AATGCGCGGC

701  GCGACTTTTT CGATAACCGC CATCACGTCT TCCGCTTTAA CCGGCTCGGC

751  ATTGTGCAGA TGTTGCAGTT GGACATTGTA ATAGGCAAGG ACGGCATCCA

801  GTTTTTCACG CAGTTTyTCA GGATGCAGCA AATCGGCGGC GCGAATGGCG

851  CGGCGTGCCA CTTTGTCTTC GTAGGCAGGG CCGATGCCGC GGCCGGTCGT

901  GCCGATTTTG CCTTTGCCGC GCG.ATcTTC GCGGGCTTGG TCGAGCGCGA

951  TGTGGTAAGG CAGGATCAGC GGGCAGGTCG GCGCGATTTT CAGACGGCCT

1001  TCGACGTTTT TCACGCCTGC CGCGTTCAAC TCGTCGATTT CGCCCAACAG

1051  GGCTTCGGGG GAGACGACAA CGCCCGAACC GATGAAGCAG TCCAAACTTT

1101  CATGCAGGAT GCCGCTCGGA ATCAGGCGCA AAATGGTTTT TTTGCCGCCG

1151  ACAACCAAGG TATGGCCCGC ATTGTGGCCG CCTTGGAAGC GCACCaCGCC
```

-continued
```
1201   GCCGGCTTCT TCCGCCAGCC AGTCAACGAT TTTACCTTTA CCCTCGTCGC

1251   CCCACTGTGC GCCGATTAsT ACAACATTTT TAGCCATAGC CATATAACCT

1301   ATCGATATTA A
```

This corresponds to the amino acid sequence <SEQ ID 2724; ORF 904>:

```
m904.pep
     1   MMQHNRFFSV GAGGDDGDRR AADFFNPFQI CFGVFGQCAV VLHAESGFAP

51   AGHGFVNRLA GFHRIGTARQ DVGFAAVGQF IADADIDGFN AVHYIEFSNT

101   HTGNAVDLDG AFQGGGIKPA AAACASGYRT EFVSAFCQTY AYFVEQFGRE

151   RARTDARGIG FDDAQNIIQH LRTYARACRS CARQTVGRGN EGISAVVDVQ

201   QRTLRAFKQQ FFAVFVFLVQ HAGHVGNHRR NARRDFFDNR HHVFRFNRLG

251   IVQMLQLDIV IGKDGIQFFT QFXRMQQIGG ANGAACHFVF VGRADAAAGR

301   ADFAFAAXIF AGLVERDVVR QDQRAGRRDF QTAFDVFHAC RVQLVDFAQQ

351   GFGGDDNART DEAVQTFMQD AARNQAQNGF FAADNQGMAR IVAALEAHHA

401   AGFFRQPVND FTFTLVAPLC ADXYNIFSHS HITYRY*
```

Computer analysis of this amino acid sequence gave the following results:
Homology with a Predicted ORF from *N. gonorrhoeae*
ORF 904 shows 90.4% identity over a 436 aa overlap with a predicted ORF (ORF 904.ng) from *N. gonorrhoeae*:

```
m904/g904
                 10         20         30         40         50         60
m904.pep  MMQHNRFFSVGAGGDDGDRRAADFFNPFQICFGVFGQCAVVLHAESGFAPAGHGFVNRLA
          ||||||||:|||||||||||||||||||||: ||:|::||:| ||||||||||||||:|
g904      MMQHNRFFAVGAGGDDGDRRAADFFNPFQICFGIGRQCVVAFHADSRFAPAGHGFVNRFA
                 10         20         30         40         50         60

70         80         90        100        110        120
m904.pep  GFHRIGTARQDVGFAAVGQFIADADIDGFNAVHYIEFSNTHTGNAVDLDGAFQGGGIKPA
          ||||| ||||||||||:||:||||||||||||||||:|:|||||||||||||||||||
g904      GFHRIRTARQDVGFAAAWQFVADADIDGFNAVHYIEFGNAHTGNAVDLDGAFQGGGIKPA
                 70         80         90        100        110        120

130        140        150        160        170        180
m904.pep  AAACASGYRTEFVSAFCQTYAYFVEQFGRERARTDARGIGFDDAQNIIQHLRTYARACRS
          |||:|||||||||||:|||:||||||||||||||||||||||||||||||||||||||
g904      AAARAAGYRTEFVSALRQTCAYFVEQFGRERARTDARGIGFDDAQNIIQHLRTYARACRS
                130        140        150        160        170        180

190        200        210        220        230        240
m904.pep  CARQTVGRGNEGISAVVDVQQRTLRAFKQQFFAVFVFLVQHAGHVGNHRRNARRDFFDNR
          | :|||||||:|||||||||||||||||||||||||:|||||||||||||||||||||
g904      RAGETVGRGNEGVSAVVDVQQRTLRAFKQQFFAVFVFFVQHAGHVGNHRRNARRDFFDNR
                190        200        210        220        230        240

250        260        270        280        290        300
m904.pep  HHVFRFNRLGIVQMLQLDIVIGKDGIQFFTQFXRMQQIGGANGAACHFVFVGRADAAAGR
          ||||||||:|::|:||:||||||||||||||||:|||||||||||||||||||||||||
g904      HHVFRFNRSGVMQVLELDVVIGKDGIQFFTQFFRMQQIGGANGAACHFVFVGRADAAAGR
                250        260        270        280        290        300

310        320        330        340        350        360
m904.pep  ADFAFAARIFAGLVERDVVRQDQRAGRRDFQTAFDVFHACRVQLVDFAQQGFGGDDNART
          ||||||||  |||||||||||||||||||||||||||||||||||||||||:|||||
g904      ADFAFAARCFAGLVERDVVRQDQRAGRRDFQTAFDVFHACRVQLVDFAQQGFGGNDNART
                310        320        330        340        350        360

370        380        390        400        410        420
m904.pep  DEAVQTFMQDAARNQAQNGFFAADNQGMARIVAALEAHHAAGFFRQPVNDFTFTLVAPLC
          |||:|:|:||:|||||||||||||:|||||||||||||:||||||||||||||||||||
g904      DEAIQDTVMQTARNQAQNGFFAADDQGMARIVAALEAHDAAGFFRQPVNDFTFTLVAPLC
                370        380        390        400        410        420
```

-continued

```
                            430
m904.pep   ADXYNIFSHSHITYRYX
           || |||||||||||||||
g904       ADYYNIFSHSHITYRYX
                            430
```

The following partial DNA sequence was identified in *N. meningitidis* <SEQ ID 2725>:

```
a904.seq
      1   ATGATGCAGC ACAATCGTTT CTTCGCGGTC GGGGCCGGTG GAGACGATGG
     51   CGACCGGCGC ACCGCAGACT TCTTCAATCC GTTTCAAATA TGCTTTGGCA
    101   TTGGCAGGTA ATGCGTCGTA GCTTTTCACG CCGAAAGTGG ATTCGCTCCA
    151   ACCGGGCATG GTTTCGTAAA TCGGCTTGCA GGCTTCTACC GCATCAGAGC
    201   CGCAAGGCAG GATGTCGGTT TTGCCGCCGT CGGGCAATTC GTAGCCGACG
    251   CAGATATTGA TGGTTTCAAC GCCGTCCATT ACATCGAGTT TGGTAATACA
    301   CATACCGGAA ATGCCGTTGA TTTGGATGGA GCGTTTCAGG GCGGCGGCAT
    351   CAAACCAGCC GCAGCGGCGT GCGCGTCCGG TTACCGAACC GAATTCGTGT
    401   CCGCGTTCTG CCAAACCTGC TCCGACTTCG TCAACAATT CGGTCGGGAA
    451   CGGGCCCGAA CCGACGCGCG TGGTATAGGC TTTGACGATG CCCAAAACAT
    501   AATCCAGCAT TTGAGGGCCT ACGCCCGCGC CTGCCGAAGC CGCGCCGGCG
    551   AGGCAGTTGG ACGAAGTAAC GAAGGGGTAA GTGCCGTAGT CGATGTCCAA
    601   CAACGCACCT TGCGCGCCTT CAAACAGCAG TTTTTCGCCG TTTTTGTTTT
    651   TTTCGTTCAA CACGCGGGAC ACGTCGGTAA TCATCGGCGT AATGCGCGGC
    701   GCGACTTTTT CGATAACCGC CATCACGTCT TCCGCTTTCA CCGACTCGGC
    751   ATTGTGCAGA TGTTGCAGTT GGACGTTGTA ATAAGCAAAG ACGGCATCCA
    801   GTTTTTCACG CAGTTTTTCA GGATGCAGCA AATCGGCGGC GCGAATGGCG
    851   CGGCGTGCCA CTTTGTCTTC GTAGGCAGGG CCGATGCCGC GGCCGGTCGT
    901   GCCGATTTTG CCTTTGCCGC GCGATGCTTC TCGGGCTTGG TCAGCGCGA
    951   TGTGATAAGG CAGGATCAGC GGGCAGGTCG GCGCGATTTT CAGACGGCCT
   1001   TCGACGTTTT TCACGCCTGC CGCGTTCAAC TCGTCGATTT CGCCCAACAG
   1051   GGCTTCGGGG GAGACGACAA CGCCCGAACC GATGAAGCAG TCCAGACTTT
   1101   CATGCAGGAT GCCGCTCGGA ATCAGGCGCA AAATGGTTTT TTTGCCGCCG
   1151   ACAACCAAGG TATGACCCGC ATTGTGGCCG CCTTGGAAGC GCACCACGCC
   1201   TCCGGCTTCT TCCGCCAGCC AGTCAACGAT TTTACCTTTA CCCTCGTCGC
   1251   CCCACTGTGC GCCGATTACT ACAACATTTT TAGCCATAGC CATATAACCT
   1301   .TCGATATTA A
```

This corresponds to the amino acid sequence <SEQ ID 2726; ORF 904.a>:

```
a904.pep
      1   MMQHNRFFAV GAGGDDGDRR TADFFNPFQI CFGIGR*CVV AFHAESGFAP
     51   TGHGFVNRLA GFYRIRAARQ DVGFAAVGQF VADADIDGFN AVHYIEFGNT
    101   HTGNAVDLDG AFQGGGIKPA AAACASGYRT EFVSAFCQTC SDFVEQFGRE
    151   RARTDARGIG FDDAQNIIQH LRAYARACRS RAGEAVGRSN EGVSAVVDVQ
```

-continued

```
201  QRTLRAFKQQ FFAVFVFFVQ HAGHVGNHRR NARRDFFDNR HHVFRFHRLG

251  IVQMLQLDVV ISKDGIQFFT QFFRMQQIGG ANGAACHFVF VGRADAAAGR

301  ADFAFAARCF SGLVERDVIR QDQRAGRRDF QTAFDVFHAC RVQLVDFAQQ

351  GFGGDDNART DEAVQTFMQD AARNQAQNGF FAADNQGMTR IVAALEAHHA

401  SGFFRQPVND FTFTLVAPLC ADYYNIFSHS HITXRY*
``` m904/a904 91.3% identity in 436 aa overlap

```
                  10         20         30         40         50         60
  m904.pep   MMQHNRFFSVGAGGDDGDRRAADFFNPFQICFGVFGQCAVVLHAESGFAPAGHGFVNRLA
             ||||||||:||||||||||||:||||||||||||: |:|::||||||||| ||||||||
      a904   MMQHNRFFAVGAGGDDGDRRTADFFNPFQICFGIGRXCVVAFHAESGFAPTGHGFVNRLA
                  10         20         30         40         50         60

70         80         90        100        110        120
  m904.pep   GFHRIGTARQDVGFAAVGQPFIADADIDGFNAVHYIEFSNTHTGNAVDLDGAFQGGGIKPA
             ||:|| :|||||||||||||:||||||||||||||||||:|||||||||||||||||||
      a904   GFYRIRAARQDVGFAAVGQPVADADIDGFNAVHYIEFGNTHTGNAVDLDGAFQGGGIKPA
                  70         80         90        100        110        120

130        140        150        160        170        180
  m904.pep   AAACASGYRTEFVSAFCQTYAYFVEQFGRERARTDARGIGFDDAQNIIQHLRTYARACRS
             |||||||||||||||||||| : |||||||||||||||||||||||||||||:||||||
      a904   AAACASGYRTEFVSAFCQTCSDFVEQFGRERARTDARGIGFDDAQNIIQHLRAYARACRS
                 130        140        150        160        170        180

190        200        210        220        230        240
  m904.pep   CARQTVGRGNEGISAVVDVQQRTLRAFKQQFFAVFVFLVQHAGHVGNHRRNARRDFFDNR
             |  :::|||:|||:|||||||||||||||||||||||:||||||||||||||||||||
      a904   RAGEAVGRSNEGVSAVVDVQQRTLRAFKQQFFAVFVFFVQHAGHVGNHRRNARRDFFDNR
                 190        200        210        220        230        240

250        260        270        280        290        300
  m904.pep   HHVFRFNRLGIVQMLQLDIVIGKDGIQFFTQFXRMQQIGGANGAACHFVFVGRADAAAGR
             |||||| :|||||||||||:||:||||||||| ||||||||||||||||||||||||||
      a904   HHVFRFHRLGIVQMLQLDVVISKDGIQFFTQFFRMQQIGGANGAACHFVFVGRADAAAGR
                 250        260        270        280        290        300

310        320        330        340        350        360
  m904.pep   ADFAFAAXIFAGLVERDVVRQDQRAGRRDFQTAFDVFHACRVQLVDFAQQGFGGDDNART
             ||||||| |:|||||||:||||||||||||||||||||||||||||||||||||||||||
      a904   ADFAFAARCFSGLVERDVIRQDQRAGRRDFQTAFDVFHACRVQLVDFAQQGFGGDDNART
                 310        320        330        340        350        360

370        380        390        400        410        420
  m904.pep   DEAVQTFMQDAARNQAQNGFFAADNQGMARIVAALEAHHAAGFFRQPVNDFTFTLVAPLC
             |||||||||||||||||||||||||||||:||||||||||:|||||||||||||||||||
      a904   DEAVQTFMQDAARNQAQNGFFAADNQGMTRIVAALEAHHASGFFRQPVNDFTFTLVAPLC
                 370        380        390        400        410        420

430
  m904.pep   ADXYNIFSHSHITYRYX
             || ||||||||||  |||
      a904   ADYYNIFSHSHITXRYX
                 430
``` g906.seq not found yet
g906.pep not found yet
The following partial DNA sequence was identified in *N. meningitidis* <SEQ ID 2727>:

```
m906.seq
  1   ATGAAATATA TCGTATCAAT CTCTCTGGCT ATGGGATTGG CTGCCTGTTC

51   GTTTGGGGGA TTTAAACCAA ATCCGTGGGA CGCCGCGTCA TTTTGGGAAT

101   TGAAAAATTA CGCCAATCCC TATCCGGGAT CAGCCTCGGC GGCACTTGAC

151   CAATATCCAT CGAAAGCAAG ACGAAGGCAA CTGAAAGACA TGCAAGAGTG

201   CGGCTATGAC CCAATAGACG GCGGAAAGTC TGAAGCAGAT GCCTGCCTGA

251   GGAAAAAAGG CTGGTGTCGT AAGGGTTTCG ACCCTTATCC CGAAAACAAA

301   AAATACGAAT GGCCTCGAGA AGAAGGAAAA ACAAAATGA
```

This corresponds to the amino acid sequence <SEQ ID 2728; ORF 906>:

```
m906.pep
    1   MKYIVSISLA MGLAACSFGG FKPNPWDAAS FWELKNYANP YPGSASAALD

51   QYPSKARRRQ LKDMQECGYD PIDGGKSEAD ACLRKKGWCR KGFDPYPENK

101   KYEWPREEGK TK*
```

The following partial DNA sequence was identified in *N. gonorrhoeae* <SEQ ID 2729>:

```
g907.seq (partial)
    1   ATGAAAAAAC CGACCGATAC CCTACCCGTC AATCTgcaAC GCCGCCGCCT

51   GCTGTGTGCC GCCGGCGCGC TGTTGATCAG CCCGCTGGCG CACGCCGGCG

101   CGCAACGTGA AGAAACGCtt gCCGACGATG TGGCTTCCGT GATGAGGAGT

151   TCTGTCGGCA GCGTCAATCC GCCGAGGCTG GTGTTCGACA ATCCGAAAGA

201   GGGCGAACGT TGGTTGTCCG CGATGTCGGC ACGTTTGGCA AGATTCGTCC

251   CCGACGAGGG GGAGCGGCGC AGGCTGCTGG TCAATATCCA ATACGAAAGC

301   AGCCGGGCCG GTTTGGATAC GCAGATTGTG TTGGGGCTGa ttgaagtgga 351   aagcgggtac cgagctcgaa tcatatca..
```

This corresponds to the amino acid sequence <SEQ ID 2730; ORF 907.ng>:

```
g907.pep (partial)
    1   MKKPTDTLPV NLQRRRLLCA AGALLISPLA HAGAQREETL ADDVASVMRS

51   SVGSVNPPRL VFDNPKEGER WLSAMSARLA RFVPDEGERR RLLVNIQYES

101   SRAGLDTQIV LGLIEVESGY RARIIS...
```

The following partial DNA sequence was identified in *N. meningitidis* <SEQ ID 2731>:

```
m907.seq
    1   ATGAGAAAAC CGACCGATAC CCTACCCGTT AATCTGCAAC GCCGCCGCCT

51   GTTGTGTGCC GCCGGTGCGT TGTTGCTCAG TCCTCTGGCG CACGCCGGCG

101   CGCAACGTGA GGAAACGCTT GCCGACGATG TGGCTTCCGT GATGAGGAGT

151   TCTGTCGGCA GCGTCAATCC GCCGAGGCTG GTGTTTGACA ATCCGAAAGA

201   GGGCGAGCGT TGGTTGTCTG CCATGTCGGC ACGTTTGGCA AGGTTCGTCC

251   CCGAGGAGGA GGAGCGGCGC AGGCTGCTGG TCAATATCCA GTACGAAAGC

301   AGCCGGGCCG GTTTGGATAC GCAGATTGTG TTGGGGCTGA TTGAGGTGGA

351   AAGCGCGTTC CGCCAGTATG CAATCAGCGG TGTCGGCGCG CGCGGCCTGA

401   TGCAGGTTAT GCCGTTkTGG AAAAACTACA TCGGCAAACC GGCGCACAAC

451   CTGTTCGACA TCCGCACCAA CCTGCGTTAC GGCTGTACCA TCCTGCGCCA

501   TTACCGGAAT CTTGAAAAAG GCAACATCGT CCGCGCGCTT GCCCGCTTTA

551   ACGGCAGCTT GGGCAGCAAT AAATATCCGA ACGCCGTTTT GGgCGCGTGG

601   CGCAACCGCT GGCAGTGGCG TTGA
```

This corresponds to the amino acid sequence <SEQ ID 2732; ORF 907>:

```
m907.pep
     1    MRKPTDTLPV NLQRRRLLCA AGALLLSPLA HAGAQREETL ADDVASVMRS

51    SVGSVNPPRL VFDNPKEGER WLSAMSARLA RFVPEEEERR RLLVNIQYES

101    SRAGLDTQIV LGLIEVESAF RQYAISGVGA RGLMQVMPXW KNYIGKPAHN

151    LFDIRTNLRY GCTILRHYRN LEKGNIVRAL ARFNGSLGSN KYPNAVLGAW

201    RNRWQWR*
```

Computer analysis of this amino acid sequence gave the following results:
Homology with a Predicted ORF from *N. gonorrhoeae*
ORF 907 shows 92.9% identity over a 126 aa overlap with a predicted ORF (ORF 907.ng) from *N. gonorrhoeae*:

```
g907/m907
                      10         20         30         40         50         60
   g907.pep   MKKPTDTLPVNLQRRRLLCAAGALLISPLAHAGAQREETLADDVASVMRSSVGSVNPPRL
              |:||||||||||||||||||:||||||||||||||||||||||||||||||||||||||
   m907       MRKPTDTLPVNLQRRRLLCAAGALLLSPLAHAGAQREETLADDVASVMRSSVGSVNPPRL
                      10         20         30         40         50         60
                      70         80         90        100        110        120
   g907.pep   VFDNPKEGERWLSAMSARLARFVPDEGERRRLLVNIQYESSRAGLDTQIVLGLIEVESGY
              |||||||||||||||||||||||||:|  ||||||||||||||||||||||||||||::
   m907       VFDNPKEGERWLSAMSARLARFVPEEEERRRLLVNIQYESSRAGLDTQIVLGLIEVESAF
                      70         80         90        100        110        120
   g907.pep   RARIIS
              |  ||
   m907       RQYAISGVGARGLMQVMPXWKNYIGKPAHNLFDIRTNLRYGCTILRHYRNLEKGNIVRAL
                     130        140        150        160        170        180
```

The following partial DNA sequence was identified in *N. meningitidis* <SEQ ID 2733>:

```
a907.seq
     1    ATGAAAAAAC CGACCGATAC CCTACCCGTC AATCTGCAAC GCCGCCGCCT

51    ATTGTGTGCT GCCGGCGCGC TGTTGCTCAG CCCGCTGGCA CAAGCCGGCG

101    CGCAACGTGA AGAAACGCTT GCCGACGATG TGGCTTCCGT GATGAGGAGC

151    TCTGTCGGCA GCATAAATCC GCCGAGGCTG GTGTTCGACA ATCCGAAAGA

201    GGGCGAGCGT TGGCTGTCCG CGATGTCTGC TCGGTTGGCA AGGTTCGTCC

251    CCGATGAGGA GGAGCGGCGC AGGCTGCTGG TCAATATCCA GTACGAAAGC

301    AGCCGGGCCG GTTTGGATAC GCAGATTGTG TTGGGGCTGA TTGAGGTGGA

351    AAGCGCGTTC CGCCAGTATG CAATCAGCGG TGTCGGCGCG CGCGGCCTGA

401    TGCAGGTTAT GCCGTTTTGG AAAAACTACA TCGGCAAACC GGCGCACAAC

451    CTGTTCGACA TCCGCACCAA CCTGCGTTAC GGCTGTACCA TCCTGCGCCA

501    TTACCGGAAT CTTGAAAAAG GCAACATCGT CCGCGCACTC GCCCGTTTTA

551    ACGGTAGCCT CGGCAGCAAT AAATATCCGA ACGCCGTTTT GGGCGCGTGG

601    CGCAACCGCT GGCAGTGGCG TTGA
```

This corresponds to the amino acid sequence <SEQ ID 2734; ORF 907.a>:

```
a907.pep
     1    MKKPTDTLPV NLQRRRLLCA AGALLLSPLA QAGAQREETL ADDVASVMRS

51    SVGSINPPRL VFDNPKEGER WLSAMSARLA RFVPDEEERR RLLVNIQYES
```

-continued

```
101   SRAGLDTQIV LGLIEVESAF RQYAISGVGA RGLMQVMPFW KNYIGKPAHN

151   LFDIRTNLRY GCTILRHYRN LEKGNIVRAL ARFNGSLGSN KYPNAVLGAW

201   RNRWQWR*
``` m907/a907 97.6% identity in 207 aa overlap

```
                  10         20         30         40         50         60
m907.pep  MRKPTDTLPVNLQRRRLLCAAGALLLSPLAHAGAQREETLADDVASVMRSSVGSVNPPRL
          |:||||||||||||||||||||||||||||||||:||||||||||||||||||||:||||
a907      MKKPTDTLPVNLQRRRLLCAAGALLLSPLAQAGAQREETLADDVASVMRSSVGSINPPRL
                  10         20         30         40         50         60

70         80         90        100        110        120
m907.pep  VFDNPKEGERWLSAMSARLARFVPEEEERRRLLVNIQYESSRAGLDTQIVLGLIEVESAF
          |||||||||||||||||||||||||:|||||||||||||||||||||||||||||||||
a907      VFDNPKEGERWLSAMSARLARFVPDEEERRRLLVNIQYESSRAGLDTQIVLGLIEVESAF
                  70         80         90        100        110        120

130        140        150        160        170        180
m907.pep  RQYAISGVGARGLMQVMPXWKNYIGKPAHNLFDIRTNLRYGCTILRHYRNLEKGNIVRAL
          ||||||||||||||||||| ||||||||||||||||||||||||||||||||||||||||
a907      RQYAISGVGARGLMQVMPFWKNYIGKPAHNLFDIRTNLRYGCTILRHYRNLEKGNIVRAL
                 130        140        150        160        170        180

190        200
m907.pep  ARFMGSLGSNKYPNAVLGAWRNRWQWRX
          ||||||||||||||||||||||||||||
a907      ARFMGSLGSNKYPNAVLGAWRNRWQWRX
                 190        200
```

The following partial DNA sequence was identified in *N. gonorrhoeae* <SEQ ID 2735>:

```
g908.seq
    1   ATGAG.AAAA GCCGTCTAAG CCGGTATAAA CAAAATAAAC TCATTGGGCT

51   ATTTGTCGCA GGTGTAACTG CAAGAACAGC GGCAGAGTTG GTAGGCATTA

101   ATAAAAATAC CGCAGCCTAT GATTTTCATC GTTTACGATG ACTGATTTAT

151   CAAAACGGTC CGCATTTAGA AATGTTTGAT GGCGAAGTAG AAGCAGATGA

201   AAGTTATTTT GGCGGACAAC GCAAAGGCAA ACGCGGTCGC GGTGCTGCCG

251   GTAAAGTCGC CGTATTCGGT CTTTTGAAGC GAAATGGTAA GGTTTATACG

301   GTTACAGTAC CGAATACTCA AACCGCTACT TTATTTCCTA TTATCCGTGA 351   acaagtgaaa cctgacagta ttgtttatac ggattgttat CgTAGCTATG 401   ATGTATTAGA Tgtgagcgaa tttagccatT TTagcttcgc tgaaacttcg 451   ttttcgtaTC AATCACAGCA CACATTTTGC CGAACGACAA AACCATATTA

501   A
```

This corresponds to the amino acid sequence <SEQ ID 2736; ORF 908.ng>:

```
g908.pep
    1   MXKSRLSRYK QNKLIGLFVA GVTARTAAEL VGINKNTAAY DFHRLR*LIY

51   QNGPHLEMFD GEVEADESYF GGQRKGKRGR GAAGKVAVFG LLKRNGKVYT

101   VTVPNTQTAT LFPIIREQVK PDSIVYTDCY RSYDVLDVSE FSHFSFAETS

151   FSYQSQHTFC RTTKPY*
```

The following partial DNA sequence was identified in *N. meningitidis* <SEQ ID 2737>:

```
m908.seq
    1   ATGAGAAAAA GTCGTCTAAG CCAGTATAAA CAAAmTAAAC TCATTGAACT

51   GTTTGTCACA GGTGTAACTG CAAGAACGGC AGCAGAGTTA GTAGGCGTTA

101   ATAAAAATAC CGCAGCCTAT TATTTTCATC GTTTACGATT ACTTATTTAT

151   CAAAACAGTC CGCATTTGGA AATGTTTGAT GGCGAAGTAG AAGCAGATGA

201   AAGTTATTTT GGCGGACAAC GCAAAGGCAA ACGCGGTCGC GGTGCTGCCG

251   GTAAAGTCGC CGTATTCGGT CTTTTGAAGC GAAATGGTAA GGTTTATACG

301   GTTACAGTAC CGAATACTCA AACCGCTACT TTATTTCCTA TTATCCGTGA

351   ACAAGTGAAA CCTGACAGCA TTTTTTATAC GGATTGTTAT CGTAGCTATG

401   ATGTATTAGA TGTGCGCGAA TTTAGCCATT TTAGCTTCGC TGAAACTTCG

451   TTTTCGTATC AATCACAGCA CACATTTTGC CGAACGACAA AACCATATTA

501   A
```

This corresponds to the amino acid sequence <SEQ ID 2738; ORF 908>:

```
m908.pep
    1   MRKSRLSQYK QXKLIELFVT GVTARTAAEL VGVNKNTAAY YFHRLRLLIY

51   QNSPHLEMFD GEVEADESYF GGQRKGKRGR GAAGKVAVFG LLKRNGKVYT

101   VTVPNTQTAT LFPIIREQVK PDSIFYTDCY RSYDVLDVRE FSHFSFAETS

151   FSYQSQHTFC RTTKPY*
```

Computer analysis of this amino acid sequence gave the following results:
Homology with a Predicted ORF from *N. gonorrhoeae*
ORF 908 shows 93.4% identity over a 166 aa overlap with a predicted ORF (ORF 908.ng) from *N. gonorrhoeae*:

```
g908/m908
                    10         20         30         40         50         60
    g908.pep  MXKSRLSRYKQNKLIGLFVAGVTARTAAELVGINKNTAAYDFHRLRLXIYQNGPHLEMFD
              | |||||:||| ||| |||:|||||||||||||:|||||| ||||| |||||:|||||||
    m908      MRKSRLSQYKQXKLIELFVTGVTARTAAELVGVNKNTAAYYFHRLRLLIYQNSPHLEMFD
                    10         20         30         40         50         60

70         80         90        100        110        120
    g908.pep  GEVEADESYFGGQRKGKRGRGAAGKVAVFGLLKRNGKVYTVTVPNTQTATLFPIIREQVK
              ||||||||||||||||||||||||||||||||||||||||||||||||||||||||||||
    m908      GEVEADESYFGGQRKGKRGRGAAGKVAVFGLLKRNGKVYTVTVPNTQTATLFPIIREQVK
                    70         80         90        100        110        120

130        140        150        160
    g908.pep  PDSIVYTDCYRSYDVLDVSEFSHFSFAETSFSYQSQHTFCRTTKPYX
              |||| |||||||||||||| |||||||||||||||||||||||||||
    m908      PDSIFYTDCYRSYDVLDVREFSHFSFAETSFSYQSQHTFCRTTKPYX
                   130        140        150        160
```

The following partial DNA sequence was identified in *N. meningitidis* <SEQ ID 2739>:

```
a908.seq
    1   ATGAGAAAAA GTCGTCTAAG CCAGTATAAA CAAAATAAAC TCATTGAGCT

51   ATTTGTCGCA GGTGTAACTG CAAGAACGGC AGCAGAGTTA GTAGGCGTTA

101   ATAAAAATAC CGCAGCCTAT TATTTTCATC GTTTACGATT ACTTATTTAT

151   CAAAACAGTC CGCATTTGGA AATGTTTGAT GGCGAAGTAG AAGCAGATGA

201   AAGTTATTTT GGCGGACAAC GCAAAGGCAA ACGCGGTCGC GGTGCTGCCG
```

```
251  GTAAAGTCGC CGTATTCGGT CTTTTGAAGC GAAATGGTAA GGTTTATACG

301  GTTACAGTAC CGAATACTCA AACCGCTACT TTATTTCCTA TTATCCGTGA

351  ACAAGTGAAA CCTGACAGCA TTGTTTATAC GGATTGTTAT CGTAGCTATG

401  ATGTATTAGA TGTGCGCGAA TTTAGCCATT TTAGCTTCGC TGAAACTTCG

451  TTTTCGTATC AATCACAGCA CACATTTTGC CGAACGACAA AACCATATTA

501  A
```

This corresponds to the amino acid sequence <SEQ ID 2740; ORF 908.a>:

```
a908.pep
  1  MRKSRLSQYK QNKLIELFVA GVTARTAAEL VGVNKNTAAY YFHRLRLLIY

51  QNSPHLEMFD GEVEADESYF GGQRKGKRGR GAAGKVAVFG LLKRNGKVYT

101  VTVPNTQTAT LFPIIREQVK PDSIVYTDCY RSYDVLDVRE FSHFSFAETS

151  FSYQSQHTFC RTTKPY*
``` m908/a908 98.2% identity in 166 aa overlap

```
                  10         20         30         40         50         60
   m908.pep   MRKSRLSQYKQXKLIELFVTGVTARTAAELVGVNKNTAAYYFHRLRLLIYQNSPHLEMFD
              ||||||||||| ||||||||:|||||||||||||||||||||||||||||||||||||||
   a908       MRKSRLSQYKQNKLIELFVAGVTARTAAELVGVNKNTAAYYFHRLRLLIYQNSPHLEMFD
                  10         20         30         40         50         60

70         80         90        100        110        120
   m908.pep   GEVEADESYFGGQRKGKRGRGAAGKVAVFGLLKRNGKVYTVTVPNTQTATLFPIIREQVK
              ||||||||||||||||||||||||||||||||||||||||||||||||||||||||||||
   a908       GEVEADESYFGGQRKGKRGRGAAGKVAVFGLLKRNGKVYTVTVPNTQTATLFPIIREQVK
                  70         80         90        100        110        120

130        140        150        160
   m908.pep   PDSIFYTDCYRSYDVLDVREFSHFSFAETSFSYQSQHTFCRTTKPYX
              |||| ||||||||||||||||||||||||||||||||||||||||||
   a908       PDSIVYTDCYRSYDVLDVREFSHFSFAETSFSYQSQHTFCRTTKPYX
                 130        140        150        160
```

40
The following partial DNA sequence was identified in *N. gonorrhoeae* <SEQ ID 2741>:

```
g909.seq (partial)
  1  atgcgtaaaa ccgtacttat cCTgaccatc tccgccgccc ttttgtcggg 51  ctgcacatgG gaaacttatc aagacggcag cggcaaaacc gccgtccgtg 101  caaaatgttc caccggcacg ccgctgtgtt ggcaagacgg gcgcggctcg 151  aaaaaggtgg actgcgacga gtacggtggc gaacgccggg ccgtgttgcg 201  caaccaaaag cgggggaagc ccgcgacgag gagagccgca acgctgggga 251  aaccgagttt ccgggcgagg gacgggggg ggcgggtgaa cagggcagaa 301  acggggagg ggaagcgatc ggcgagg..
```

This corresponds to the amino acid sequence <SEQ ID 2742; ORF 909.ng>:

```
g909.pep (partial)
  1  MRKTVLILTI SAALLSGCTW ETYQDGSGKT AVRAKCSTGT PLCWQDGRGS

51  KKVDCDEYGG ERRAVLRNQK RGKPATRRAA TLGKPSFRAR DGGGRVNRAE

101  TGEGKRSAR..
```

The following partial DNA sequence was identified in *N. meningitidis* <SEQ ID 2743>:

```
m909.seq
    1   ATGCGTAAAA CCTTCCTCTT CCTGACCGCT GCCGCCGCCC TTTTGTCGGG

51   CTGCGCGTGG GAAACTTATC AAGACGGCAA CGGCAAGACC GCCGTCCGTC

101   AAAAATATCC CGCCGGCACG CCCGTTTATT ACCAAGACGG CAGCTACTCG

151   AAAAATATGA ACTACAACCA ATACCGTCCC GAACGCCATG CCGTGTTACC

201   CAATCAAACC GGCAACAACG CCGACGAAGA GCATCGCCAA CACTGGCAAA

251   AACCAAAGTT TCAAAACCGA TAA
```

This corresponds to the amino acid sequence <SEQ ID 2744; ORF 909>:

```
m909.pep
    1   MRKTFLFLTA AAALLSGCAW ETYQDGNGKT AVRQKYPAGT PVYYQDGSYS

51   KNMNYNQYRP ERHAVLPNQT GNNADEEHRQ HWQKPKFQNR *
```

Computer analysis of this amino acid sequence gave the following results:
Homology with a Predicted ORF from *N. gonorrhoeae*
ORF 909 shows 53.3% identity over a 90 aa overlap with a predicted ORF (ORF 909.ng) from *N. gonorrhoeae*:

```
m909/g909
                10         20         30         40         50         60
    m909.pep    MRKTFLFLTAAAALLSGCAWETYQDGNGKTAVRQKYPAGTPVYYQDGSYSKNMNYNQYRP
                ||||  : ||  :||||||||| :||||||||  :||||||   :|||:   :|||   ||::: ::|
        g909    MRKTVLILTISAALLSGCTWETYQDGSGKTAVRAKCSTGTPLCWQDGRGSKKVDCDEYGG
                10         20         30         40         50         60

70         80         90
    m909.pep    ERHAVLPNQTGNNADEEHRQHWQKPKFQNRX
                ||:||| ||   ::    ::       ||:|: |
        g909    ERRAVLRNQKRGKPATRRAATLGKPSFRARDGGGRVNRAETGEGKRSAR
                70         80         90        100
```

The following partial DNA sequence was identified in *N. meningitidis* <SEQ ID 2745>:

```
a909.seq
    1   ATGCGTAAAA CCTTCCTTAT CCTGATGACT GCCGCCGCCC TTTTGTCGGG

51   CTGCGCGTGG GAAACTTATC AAGACGGCAA CGGCAAGACC GCCGTCCGTC

101   AAAAATATCC CGCCGGCACG CCCGTTTATT ACCAAGACGG CAGCTACTCG

151   AAAAATATGA ACTACAACCA ATACCGTCCC GAACGCCATG CCGTGTTACC

201   CAACCAAACC GGCAACAACG CCGACGAAGA GCATCGCCAA CACTGGCAAA

251   AGCCCAAATT TCAAAACCGA TAA
```

This corresponds to the amino acid sequence <SEQ ID 2746; ORF 909.a>:

```
a909.pep
    1   MRKTFLILMT AAALLSGCAW ETYQDGNGKT AVRQKYPAGT PVYYQDGSYS

51   KNMNYNQYRP ERHAVLPNQT GNNADEEHRQ HWQKPKFQNR *
``` m909/a909 96.7% identity in 90 aa overlap

```
              10        20        30        40        50        60
m909.pep  MRKTFLFLTAAAALLSGCAWETYQDGNGKTAVRQKYPAGTPVYYQDGSYSKNMNYNQYRP
          ||||||:|  :|||||||||||||||||||||||||||||||||||||||||||||||||
a909      MRKTFLILMTAAALLSGCAWETYQDGNGKTAVRQKYPAGTPVYYQDGSYSKNMNYNQYRP
              10        20        30        40        50        60

70        80        90
m909.pep  ERHAVLPNQTGNNADEEHRQHWQKPKFQNRX
          ||||||||||||||||||||||||||||||
a909      ERHAVLPNQTGNNADEEHRQHWQKPKFQNRX
              70        80        90
```

The following partial DNA sequence was identified in *N. gonorrhoeae* <SEQ ID 2747>:

```
g910.seq
    1   ATGAAAAAAC TGTTATTGGC CGCCGTTGTT TCCCTAAATG CCGCAACCGC

51   ATTTGCCGGC GACTCTGCCG AGCGTCAGAT TTACGGCGAT CCCCATTTTG

101   AACAAACCG CACAAAAGCC GTGAAAATGT TGGAACAGCG CGGTTATCAG

151   GTTTACGATG TCGATGCCGA CGACTACTGG GGCAAACCTG TTTTGGAAGT

201   GGAAGCCTAT AAAGACGGCC GCGAATACGA CATCGTGTTG TCTTACCCCG

251   ACCTGAAAAT CATCAAAGAG CAGCTCGATC GCTGA
```

This corresponds to the amino acid sequence <SEQ ID 2748; ORF 910.ng>:

```
g910.pep
    1   MKKLLLAAVV SLNAATAFAG DSAERQIYGD PHFEQNRTKA VKMLEQRGYQ

51   VYDVDADDYW GKPVLEVEAY KDGREYDIVL SYPDLKIIKE QLDR*
```

The following partial DNA sequence was identified in *N. meningitidis* <SEQ ID 2749>:

```
m910.seq
    1   ATGAAAAAAC TGTTATTGGC TGCCGTTGTT CTCTGAGTG CCGCTGCCGC

51   ATTTGCCGGC GACTCTGCCG AGCGTCAGAT TTACGGCGAT CCCCATTTTG

101   AACAAACCG CACAAAAGCT GTGAAAATGT TGGAGCAGCG CGGTTATCAG

151   GTTTACGATG TCGATGCCGA CGACCATTGG GGTAAGCCTG TGCTGGAAGT

201   GGAAGCCTAT AAAGACGGCC GCGAATACGA CATCGTGTTG TCTTACCCCG

251   ACCTGAAAAT CATCAAAGAG CAGCTCGATC GCTGA
```

This corresponds to the amino acid sequence <SEQ ID 2750; ORF 910>:

```
m910.pep
    1   MKKLLLAAVV SLSAAAAFAG DSAERQIYGD PHFEQNRTKA VKMLEQRGYQ

51   VYDVDADDHW GKPVLEVEAY KDGREYDIVL SYPDLKIIKE QLDR*
```

Computer analysis of this amino acid sequence gave the following results:
Homology with a Predicted ORF from *N. gonorrhoeae*
ORF 910 shows 96.8% identity over a 94 aa overlap with a predicted ORF (ORF 910.ng) from *N. gonorrhoeae*:

```
     g910/m910
                      10        20        30        40        50        60
        g910.pep  MKKLLLAAVVSLNAATAFAGDSAERQIYGDPHFEQNRTKAVKMLEQRGYQVYDVDADDYW
                  ||||||||||||:||:||||||||||||||||||||||||||||||||||||||||||:|
            m910  MKKLLLAAVVSLSAAAAFAGDSAERQIYGDPHFEQNRTKAVKMLEQRGYQVYDVDADDHW
                      10        20        30        40        50        60

70        80        90
        g910.pep  GKPVLEVEAYKDGREYDIVLSYPDLKIIKEQLDRX
                  |||||||||||||||||||||||||||||||||||
            m910  GKPVLEVEAYKDGREYDIVLSYPDLKIIKEQLDRX
                      70        80        90
```

The following partial DNA sequence was identified in *N. meningitidis* <SEQ ID 2751>:

```
a910.seq
    1   ATGAAAAAAC TGTTATTGGT CGCCGTTGTT TCCTTGAGTG CCGCAACCGC

51   ATTTGCCGGC GACTCTGCCG AGCGTCAGAT TTACGGCGAT CCCTATTTTG

101   AACAAAACCG CACAAAAGCC GTGAAAATGT TGGAACAGCG CGGTTATCAG

151   GTTCACGATG TCGATGCCGA CGACCATTGG GGCAAACCTG TTTTGGAAGT

201   GGAAGCCTAT AAAGACGGCC GCGAATACGA CATTGTGTTG TCTTACCCCG

251   ACCTGAAAAT CATCAAAGAG CAGCTCGATC GCTGA
```

This corresponds to the amino acid sequence <SEQ ID 2752; ORF 910.a>:

```
a910.pep
    1   MKKLLLVAVV SLSAATAFAG DSAERQIYGD PYFEQNRTKA VKMLEQRGYQ

51   VHDVDADDHW GKPVLEVEAY KDGREYDIVL SYPDLKIIKE QLDR*
                                                       40
``` m910/a910 95.7% identity in 94 aa overlap

```
                      10        20        30        40        50        60
        m910.pep  MKKLLLAAVVSLSAAAAFAGDSAERQIYGDPHFEQNRTKAVKMLEQRGYQVYDVDADDHW
                  ||||||:|||||||:|||||||||||||||:||||||||||||||||||||:||||||||
            a910  MKKLLLVAVVSLSAATAFAGDSAERQIYGDPYFEQNRTKAVKMLEQRGYQVHDVDADDHW
                      10        20        30        40        50        60

70        80        90
        m910.pep  GKPVLEVEAYKDGREYDIVLSYPDLKIIKEQLDRX
                  |||||||||||||||||||||||||||||||||||
            a910  GKPVLEVEAYKDGREYDIVLSYPDLKIIKEQLDRX
                      70        80        90
```

The following partial DNA sequence was identified in *N. gonorrhoeae* <SEQ ID 2753>:

```
g911.seq
    1   ATGAAAAAGA ACATATTGGA ATTTTGGGTC GGACTGTTCG TCTTGATCGG

51   CGCGGCGGCG GTTGCCTTTC TCGCTTTCCG CGTGGCGGGC GGCGCGGCGT

101   TCGGCGGTTC GGACAAAACT TACGCCGTTT ATGCCGATTT CGGCGACATC

151   GGCGGTTTGA AGGTCAATGC CCCCGTCAAA TCCGCAGGCG TATTGGTCGG

201   GCGCGTCGGC GCTATCGGGC TTGACCCGAA ATCCTATCAG GCGAGGGTGC
```

```
                              -continued
251   GCCTTGATTT GGACGGCAAG TATCAGTTCA GCAGTGACGT TTCCGCGCAA

301   ATCCTGACTT CGGGACTTTT GGGCGAACAG TACATCGGGC TGCAGCAGGG

351   CGGCGATACG GAAAACCTTG CTGCCGGCGA CACCATCTCC GTAACCAGTT

401   CTGCAATGGT TCTGGAAAAC CTGATCGGTA AATTCATGAC CAGCTTCGCC

451   GAGAAAAACG CTGAGGGCGG CAATGCGGAA AAAGCCGcag aAtaa
```

This corresponds to the amino acid sequence <SEQ ID 2754; ORF 911.ng>:

```
g911.pep
    1   MKKNILEFWV GLFVLIGAAA VAFLAFRVAG GAAFGGSDKT YAVYADFGDI

51   GGLKVNAPVK SAGVLVGRVG AIGLDPKSYQ ARVRLDLDGK YQFSSDVSAQ

101   ILTSGLLGEQ YIGLQQGGDT ENLAAGDTIS VTSSAMVLEN LIGKFMTSFA

151   EKNAEGGNAE KAAE*
```

The following partial DNA sequence was identified in *N. meningitidis* <SEQ ID 2755>:

```
m911.seq
    1   ATGAAGAAGA ACATATTGGA ATTTTGGGTC GGACTGTTCG TCCTGATTGG

51   CGCGGCGGCG GTTGCCTTTC TCGCTTTCCG CGTGGCCGGC GGTGCGGCGT

101   TCGGCGGTTC GGACAAAACT TACGCCGTTT ATGCCGATTT CGGCGACATC

151   GGCGGTTTGA AGGTCAATGC CCCCGTCAAA TCCGCAGGCG TATTGGTCGG

201   GCGCGTCGGC GCTATCGGAC TTGACCCGAA ATCCTATCAG GCGAGGGTGC

251   GCCTCGATTT GGACGGCAAG TATCAGTTCA GCAGCGACGT TTCCGCGCAA

301   ATCCTGACTT CGGGACTTTT GGGCGAGCAG TACATCGGGC TGCAGCAGGG

351   CGGCGACACG GAAAACCTTG CTGCCGGCGA CACCATCTCC GTAACCAGTT

401   CTGCAATGGT TCTGGAAAAC CTTATCGGCA AATTCATGAC GAGTTTTGCC

451   GAGAAAAATG CCGACGGCGG CAATGCGGAA AAAGCCGCCG AATAA
```

This corresponds to the amino acid sequence <SEQ ID 2756; ORF 911>:

```
m911.pep
    1   MKKNILEFWV GLFVLIGAAA VAFLAFRVAG GAAFGGSDKT YAVYADFGDI

51   GGLKVNAPVK SAGVLVGRVG AIGLDPKSYQ ARVRLDLDGK YQFSSDVSAQ

101   ILTSGLLGEQ YIGLQQGGDT ENLAAGDTIS VTSSAMVLEN LIGKFMTSFA

151   EKNADGGNAE KAAE*
```

Computer analysis of this amino acid sequence gave the following results:
Homology with a Predicted ORF from *N. gonorrhoeae*
ORF 911 shows 99.4% identity over a 164 aa overlap with a predicted ORF (ORF 911.ng) from *N. gonorrhoeae*:

```
g911/m911
                  10         20         30         40         50         60
      g911.pep  MKKNILEFWVGLFVLIGAAAVAFLAFRVAGGAAFGGSDKTYAVYADFGDIGGLKVNAPVK
                ||||||||||||||||||||||||||||||||||||||||||||||||||||||||||||
          m911  MKKNILEFWVGLFVLIGAAAVAFLAFRVAGGAAFGGSDKTYAVYADFGDIGGLKVNAPVK
                  10         20         30         40         50         60
```

-continued

```
                 70        80        90       100       110       120
g911.pep  SAGVLVGRVGAIGLDPKSYQARVRLDLDGKYQFSSDVSAQILTSGLLGEQYIGLQQGGDT
          ||||||||||||||||||||||||||||||||||||||||||||||||||||||||||||
m911      SAGVLVGRVGAIGLDPKSYQARVRLDLDGKYQFSSDVSAQILTSGLLGEQYIGLQQGGDT
                 70        80        90       100       110       120

130       140       150       160
g911.pep  ENLAAGDTISVTSSAMVLENLIGKFMTSFAEKNAEGGNAEKAAEX
          ||||||||||||||||||||||||||||||||||:||||||||||
m911      ENLAAGDTISVTSSAMVLENLIGKFMTSFAEKNADGGNAEKAAEX
                130       140       150       160
```

The following partial DNA sequence was identified in *N. meningitidis* <SEQ ID 2757>:

```
a911.seq
     1  ATGAAAAAGA ACATATTGGA ATTTTGGGTC GGACTGTTCG TCCTGATTGG

51  CGCGGCGGCG GTTGCCTTTC TCGCTTTCCG CGTGGCCGGC GGTGCGGCGT

101  TCGGCGGTTC GGACAAAACT TACGCCGTTT ATGCCGATTT CGGCGACATC

151  GGCGGTTTGA AGGTCAATGC CCCCGTCAAA TCCGCAGGCG TATTGGTCGG

201  GCGCGTCGGC GCTATCGGAC TTGACCCGAA ATCCTATCAG GCGAGGGTGC

251  GCCTCGATTT GGACGGCAAG TATCAGTTCA GCAGCGACGT TTCCGCGCAA

301  ATCCTGACTT CGGGACTTTT GGGCGAGCAG TACATCGGGC TGCAGCAGGG

351  CGGCGACACG GAAAACCTTG CTGCCGGCGA CACCATCTCC GTAACCAGTT

401  CTGCAATGGT TCTGGAAAAC CTTATCGGCA AATTCATGAC GAGTTTTGCC

451  GAGAAAAATG CCGACGGCGG CAATGCGGAA AAAGCCGCCG AATAA
```

This corresponds to the amino acid sequence <SEQ ID 2758; ORF 911.a>:

```
a911.pep
     1  MKKNILEFWV GLFVLIGAAA VAFLAFRVAG GAAFGGSDKT YAVYADFGDI

51  GGLKVNAPVK SAGVLVGRVG AIGLDPKSYQ ARVRLDLDGK YQFSSDVSAQ

101  ILTSGLLGEQ YIGLQQGGDT ENLAAGDTIS VTSSAMVLEN LIGKFMTSFA

151  EKNADGGNAE KAAE*
``` m911/a911 100.0% identity in 164 aa overlap

```
                 10        20        30        40        50        60
m911.pep  MKKNILEFWVGLFVLIGAAAVAFLAFRVAGGAAFGGSDKTYAVYADFGDIGGLKVNAPVK
          ||||||||||||||||||||||||||||||||||||||||||||||||||||||||||||
a911      MKKNILEFWVGLFVLIGAAAVAFLAFRVAGGAAFGGSDKTYAVYADFGDIGGLKVNAPVK
                 10        20        30        40        50        60

70        80        90       100       110       120
m911.pep  SAGVLVGRVGAIGLDPKSYQARVRLDLDGKYQFSSDVSAQILTSGLLGEQYIGLQQGGDT
          ||||||||||||||||||||||||||||||||||||||||||||||||||||||||||||
a911      SAGVLVGRVGAIGLDPKSYQARVRLDLDGKYQFSSDVSAQILTSGLLGEQYIGLQQGGDT
                 70        80        90       100       110       120

130       140       150       160
m911.pep  ENLAAGDTISVTSSAMVLENLIGKFMTSFAEKNADGGNAEKAAEX
          |||||||||||||||||||||||||||||||||||||||||||||
a911      ENLAAGDTISVTSSAMVLENLIGKFMTSFAEKNADGGNAEKAAEX
                130       140       150       160
```

The following partial DNA sequence was identified in *N. gonorrhoeae* <SEQ ID 2759>:

```
g912.seq
     1  gtgAAAAaat cctcctTcat cagcGCATTG GGCATCGgtA TTTTGAGCAT

51  CGGCATGGCA TTTGCCTCCC CGGCCGACGC AGTGGGACAA ATCCGCCAAA

101  ACGCCACACA GGTTTTGACC ATCCTCAAAA GCGGCGACGC GGCTTCTGCA

151  CGCCCAAAAG CCGAAGCCTA TGCGGTTCCC TATTTCGATT CCAACGTAT

201  GACCGCATTG GCGGTCGGCA ACCCTTGGCG TACCGCGTCC GACGCGCAAA

251  AACAAGCGTT GGCCAAAGAA TTTCAAACCC TGCTGATCCG CACCTATTCC

301  GGCACGATGC TGAAATTCAA AAACGCGACC GTCAACGTCA AGACAATCC

351  CATCGTCAAT AAGGGCGGCA AGGAAATCGT CGTCCGTGCC GAAGTCGGCA

401  TCCCCGGTCA GAAGCCCGTC AATATGGACT TTACCACCTA CCAAAGCGGC

451  GGCAAATACC GTACCTACAA CGTCGCCATC GAAGGCACGA GCCTGGTTAC

501  CGTGTACCGC AACCAATTCG GCGAAATCAT CAAAGCCAAA GGCATCGACG

551  GGCTGATTGC CGAGTTGAAA GCCAAAAACG GCGGCAAATA A
```

This corresponds to the amino acid sequence <SEQ ID 2760; ORF 912.ng>:

```
g912.pep
     1  VKKSSFISAL GIGILSIGMA FASPADAVGQ IRQNATQVLT ILKSGDAASA

51  RPKAEAYAVP YFDFQRMTAL AVGNPWRTAS DAQKQALAKE FQTLLIRTYS

101  GTMLKFKNAT VNVKDNPIVN KGGKEIVVRA EVGIPGQKPV NMDFTTYQSG

151  GKYRTYNVAI EGTSLVTVYR NQFGEIIKAK GIDGLIAELK AKNGGK*
```

The following partial DNA sequence was identified in *N. meningitidis* <SEQ ID 2761>:

```
m912.seq
     1  ATGAAAAAAT CCTCCCTCAT CAGCGCATTG GGCATCGGTA TTTTGAGCAT

51  CGGCATGGCA TTTGCCGCCC CTGCCGACGC GGTAAGCCAA ATCCGTCAAA

101  ACGCCACTCA AGTATTGAGC ATCTTAAAAA ACGGCGATGC CAACACCGCT

151  CGCCAAAAAG CCGAAGCCTA TGCGATTCCC TATTTCGATT CCAACGTAT

201  GACCGCATTG GCGGTCGGCA ACCCTTGGCG CACCGCGTCC GACGCGCAAA

251  AACAAGCGTT GGCCAAAGAA TTTCAAACCC TGCTGATCCG CACCTATTCC

301  GGCACGATGC TGAAATTAAA AAACGCCAAC GTCAACGTCA AGACAATCC

351  CATCGTCAAT AAAGGCGGCA AAGAAATCAT CGTCCGCGCC GAAGTCGGCG

401  TACCCGGGCA AAAACCCGTC AACATGGACT TCACCACCTA CCAAAGCGGC

451  GGTAAATACC GTACCTACAA CGTCGCCATC GAAGGCGCGA GCCTGGTTAC
```

-continued

```
501  CGTGTACCGC AACCAATTCG GCGAAATTAT CAAAGCGAAA GGCGTGGACG

551  GACTGATTGC CGAGTTGAAA GCCAAAAACG GCGGCAAATA A
```

This corresponds to the amino acid sequence <SEQ ID 2762; ORF 912>:

```
m912.pep
   1  MKKSSLISAL GIGILSIGMA FAAPADAVSQ IRQNATQVLS ILKNGDANTA

51  RQKAEAYAIP YFDFQRMTAL AVGNPWRTAS DAQKQALAKE FQTLLIRTYS

101  GTMLKLKNAN VNVKDNPIVN KGGKEIIVRA EVGVPGQKPV NMDFTTYQSG

151  GKYRTYNVAI EGASLVTVYR NQFGEIIKAK GVDGLIAELK AKNGGK*
```

Computer analysis of this amino acid sequence gave the following results:
Homology with a Predicted ORF from *N. gonorrhoeae* 20
ORF 912 shows 91.8% identity over a 196 aa overlap with a predicted ORF (ORF 912.ng) from *N. gonorrhoeae*:

```
g912/m912
                 10         20         30         40         50         60
   g912.pep  VKKSSFISALGIGILSIGMAFASPADAVGQIRQNATQVLTILKSGDAASARPKAEAYAVP
             :||||:||||||||||||||:|||||:||||||||||:|||:|||  :|| ||||||:|
   m912      MKKSSLISALGIGILSIGMAFAAPADAVSQIRQNATQVLSILKNGDANTARQKAEAYAIP
                 10         20         30         40         50         60

70         80         90        100        110        120
   g912.pep  YFDFQRMTALAVGNPWRTASDAQKQALAKEFQTLLIRTYSGTMLKFKNATVNVKDNPIVN
             ||||||||||||||||||||||||||||||||||||||||||||| :||:||||||||||
   m912      YFDFQRMTALAVGNPWRTASDAQKQALAKEFQTLLIRTYSGTMLKLKNANVNVKDNPIVN
                 70         80         90        100        110        120

130        140        150        160        170        180
   g912.pep  KGGKEIVVRAEVGIPGQKPVNMDFTTYQSGGKYRTYNVAIEGTSLVTVYRNQFGEIIKAK
             ||||||:||||||:||||||||||||||||||||||||||||:|||||||||||||||||
   m912      KGGKEIIVRAEVGVPGQKPVNMDFTTYQSGGKYRTYNVAIEGASLVTVYRNQFGEIIKAK
                130        140        150        160        170        180

190
   g912.pep  GIDGLIAELKAKNGGKX
             |:|||||||||||||||
   m912      GVDGLIAELKAKNGGKX
                190
```

The following partial DNA sequence was identified in *N. meningitidis* <SEQ ID 2763>:

```
a912.seq
   1  ATGAAAAAAT CCTCCTTCAT CAGCGCATTG GGCATCGGTA TTTTGAGCAT

51  CGGCATGGCA TTTGCCGCCC CTGCCGACGC GGTAAACCAA ATCCGTCAAA

101  ACGCCACTCA AGTATTGAGC ATCTTAAAAA GCGGTGATGC CAACACCGCC

151  CGCCAAAAAG CCGAAGCCTA TGCGATTCCC TATTTCGATT TCCAACGTAT

201  GACCGCATTG GCGGTCGGCA ACCCTTGGCG CACCGCGTCC GACGCGCAAA

251  AACAAGCGTT GGCCAAAGAA TTTCAAACCC TGCTGATCCG CACCTATTCC

301  GGCACGATGC TGAAATTAAA AAACGCCAAC GTCAACGTCA AGACAATCC

351  CATCGTCAAT AAAGGCGGCA AAGAAATCAT CGTCCGCGCC GAAGTCGGCG

401  TACCCGGGCA AAAACCCGTC AACATGGACT TCACCACCTA CCAAAGCGGC

451  GGTAAATACC GTACCTACAA CGTCGCCATC GAAGGCGCGA GCCTGGTTAC

501  CGTGTACCGC AACCAATTCG GCGAAATTAT CAAAGCGAAA GGCGTGGACG

551  GACTGATTGC CGAGTTGAAG GCTAAAAACG GCAGCAAGTA A
```

This corresponds to the amino acid sequence <SEQ ID 2764; ORF 912.a>:

```
a912.pep
    1   MKKSSFISAL GIGILSIGMA FAAPADAVNQ IRQNATQVLS ILKSGDANTA

51   RQKAEAYAIP YFDFQRMTAL AVGNPWRTAS DAQKQALAKE FQTLLIRTYS

101   GTMLKLKNAN VNVKDNPIVN KGGKEIIVRA EVGVPGQKPV NMDFTTYQSG

151   GKYRTYNVAI EGASLVTVYR NQFGEIIKAK GVDGLIAELK AKNGSK*
``` m912/a912 98.0% identity in 196 aa overlap

```
                  10         20         30         40         50         60
   m912.pep   MKKSSLISALGIGILSIGMAFAAPADAVSQIRQNATQVLSILKNGDANTARQKAEAYAIP
              ||||:||||||||||||||||||||||||:|||||||||||||:||||||||||||||||
   a912       MKKSSFISALGIGILSIGMAFAAPADAVNQIRQNATQVLSILKSGDANTARQKAEAYAIP
                  10         20         30         40         50         60
                  70         80         90        100        110        120
   m912.pep   YFDFQRMTALAVGNPWRTASDAQKQALAKEFQTLLIRTYSGTMLKLKNANVNVKDNPIVN
              ||||||||||||||||||||||||||||||||||||||||||||||||||||||||||||
   a912       YFDFQRMTALAVGNPWRTASDAQKQALAKEFQTLLIRTYSGTMLKLKNANVNVKDNPIVN
                  70         80         90        100        110        120
                 130        140        150        160        170        180
   m912.pep   KGGKEIIVRAEVGVPGQKPVNMDFTTYQSGGKYRTYNVAIEGASLVTVYRNQFGEIIKAK
              ||||||||||||||||||||||||||||||||||||||||||||||||||||||||||||
   a912       KGGKEIIVRAEVGVPGQKPVNMDFTTYQSGGKYRTYNVAIEGASLVTVYRNQFGEIIKAK
                 130        140        150        160        170        180
                 190
   m912.pep   GVDGLIAELKAKNGGKX
              |||||||||||||:||
   a912       GVDGLIAELKAKNGSKX
                 190
```

The following partial DNA sequence was identified in *N. gonorrhoeae* <SEQ ID 2765>:

```
g913.seq
    1   atGAAAAAAA CCGCCTACGC CATCCTCCTG CTGATCGGGT TCGCTTCCGC

51   CCCTGCATTT GCAGAAACCC GCCCCGCCGA CCCTTATGAA GGCTACAACC

101   GCGCCGTTTC CAAATTCAAC GACCAAGCCG ACCGCTACAT TTTCGCCCCT

151   GCCGCGCGCG GCTACCGCAA AGTTACGCCG AAACCCGTCC GCGCCGGCGT

201   GTCCAATTTT TTTAACAACC TGCGCGACGT GGTCAGTTTC GGCAGCAATA

251   TCTTGCGTTT GGAcatCAAA cgcgcAAGcg aAGACCtcgT CCGcgtcggc 301   atCAATACCA CCTTCGGTTT GGGcgGGCTC ATTGATATTG CCGGcgcGGg 351   cggcgttccc gacaataaaa AcacTtttgGg cgacacgttt gcctcgtGGG 401   GctgGAAAaa cagcaATTAT TTCGtgttgc CCGtcttagg cccgtccacc 451   gtccgcgacg cgctcggcac gggcattacc tCTGTTTATC CGCccaagaa 501   tatcgttttc catacccctg ccggacgctg GGgcacgact gCCGCTGCCG 551   CCGTcagtac gcgcgaaggc ctcctcgatt tgaccgacag TCtggacgaa 601   gccgccatCG ACAAATACAG CTACACGCGc gacctctata tgAAAGTCCG 651   CGcacgGCag AccgGTGCAA CACCTGCCGA AGgtacggaa gataacatcg 701   acatcgacat cgACGAATTG GTCGAAAGTG CCGAAACCGG CGCGGCAGAG

751   CCCGCCGTTC ACGAAGATTC CGTATCCGAA ACACAGGCAG AAGCAGCAGG

801   GGAAGCCGAA ACGCAACCTG GAACACAACC CTAA
```

This corresponds to the amino acid sequence <SEQ ID 2766; ORF 913.ng>:

```
g913.pep
    1   MKKTAYAILL LIGFASAPAF AETRPADPYE GYNRAVSKFN DQADRYIFAP

51   AARGYRKVTP KPVRAGVSNF FNNLRDVVSF GSNILRLDIK RASEDLVRVG

101   INTTFGLGGL IDIAGAGGVP DNKNTLGDTF ASWGWKNSNY FVLPVLGPST

151   VRDALGTGIT SVYPPKNIVF HTPAGRWGTT AAAAVSTREG LLDLTDSLDE

201   AAIDKYSYTR DLYMKVRARQ TGATPAEGTE DNIDIDIDEL VESAETGAAE

251   PAVHEDSVSE TQAEAAGEAE TQPGTQP*
```

The following partial DNA sequence was identified in *N. meningitidis* <SEQ ID 2767>:

```
m913.seq
    1   ATGAAAAAAA CCGCCTATGC CTTCCTCCTG CTGATCGGGT TCGCTTCCGC

51   CCCTGCATTT GCCGAAACCC GCCCCGCCGA CCCTTATGAA GGCTACAACC

101   GCGCCGTTTT CAAATTCAAC GACCAAGCCG ACCGCTACAT TTTCGCCCCT

151   GCCGCGCGCG GCTACCGCAA AGTTGCGCCG AAACCCGTCC GCGCCGGCGT

201   GTCCAATTTT TTTAACAACC TGTGCGACGT GGTCAGCTTC GGCAGCAATA

251   TCTTGCGCTT GGACATCAAA CGCGCAAGCG AAGACCTTGT CCGCGTCGGC

301   ATCAACACCA CTTTCGGTTT GGGCGGGCTT ATCGACATCG CCGGCGCGGG

351   CGGCATTCCC GACAATAAAA ACACCTTGGG CGACACGTTT GCCTCGTGGG

401   GATGGAAAAA CAGCAATTAT TTCGTGTTGC CCGTCTTAGG GCCGTCCACC

451   GTCCGCGACG CGCTCGGCAC GGGTATTACC TCCGTTTATT CGCCCAAGAA

501   TATCGTCTTC CGCACCCCTG TCGGACGCTG GGGCACGACT GCCGTATCCG

551   CCGTCAGTAC GCGCGAAGGC CTgCTCGATT TGACCGACAG TCTGGACGAA

601   GCCGCCATCG ACAAATACAG CTACACGCGC GACCTCTATA TGAAAGTCCG

651   TGCGCGGCAG ACCGGTGCAA CACCTGCCGA AGgTACGGAA GATAACATCG

701   ACATCGACGA ATTGGTCGAA AGTGCCGAAA CCGGCGCGGC GGAAACTGCC

751   GTTCAAGAAG ATTCCGTATC CGAAACACAG GCAGAAGCAG CAGGGGAAGC

801   CGAAACGCAA CCTGGAACAC AACCTTAA
```

This corresponds to the amino acid sequence <SEQ ID 2768; ORF 913>:

```
m913.pep
    1   MKKTAYAFLL LIGFASAPAF AETRPADPYE GYNRAVFKFN DQADRYIFAP

51   AARGYRKVAP KPVRAGVSNF FNNLCDVVSF GSNILRLDIK RASEDLVRVG

101   INTTFGLGGL IDIAGAGGIP DNKNTLGDTF ASWGWKNSNY FVLPVLGPST

151   VRDALGTGIT SVYSPKNIVF RTPVGRWGTT AVSAVSTREG LLDLTDSLDE

201   AAIDKYSYTR DLYMKVRARQ TGATPAEGTE DNIDIDELVE SAETGAAETA

251   VQEDSVSETQ AEAAGEAETQ PGTQP*
```

Computer analysis of this amino acid sequence gave the following results:

Homology with a Predicted ORF from *N. gonorrhoeae*

ORF 913 shows 94.9% identity over a 277 aa overlap with a predicted ORF (ORF 913.ng) from *N. gonorrhoeae*:

```
g913/m913
                    10         20         30         40         50         60
g913.pep  MKKTAYAILLLIGFASAPAFAETRPADPYEGYNRAVSKFNDQADRYIFAPAARGYRKVTP
          ||||||| :||||||||||||||||||||||||||| |||||||||||||||||||||||:|
m913      MKKTAYAFLLLIGFASAPAFAETRPADPYEGYNRAVFKFNDQADRYIFAPAARGYRKVAP
                    10         20         30         40         50         60

70         80         90        100        110        120
g913.pep  KPVRAGVSNFFNNLRDVVSFGSNILRLDIKRASEDLVRVGINTTFGLGGLIDIAGAGGVP
          |||||||||||||| |||||||||||||||||||||||||||||||||||||||||||:|
m913      KPVRAGVSNFFNNLCDVVSFGSNILRLDIKRASEDLVRVGINTTFGLGGLIDIAGAGGIP
                    70         80         90        100        110        120

130        140        150        160        170        180
g913.pep  DNKNTLGDTFASWGWKNSNYFVLPVLGPSTVRDALGTGITSVYPPKNIVFHTPAFRWGTT
          |||||||||||||||||||||||||||||||||||||||||||| ||||||:||:|||||
m913      DNKNTLGDTFASWGWKNSNYFVLPVLGPSTVRDALGTGITSVYSPKNIVFRTPVFRWGTT
                   130        140        150        160        170        180

190        200        210        220        230        240
g913.pep  AAAAVSTREGLLDLTDSLDEAAIDKYSYTRDLYMKVRARQTGATPAEGTEDNIDIDIDEL
          |::|||||||||||||||||||||||||||||||||||||||||||||||||||  |||
m913      AVSAVSTREGLLDLTDSLDEAAIDKYSYTRDLYMKVRARQTGATPAEGTEDNIDI--DEL
                   190        200        210        220        230

250        260        270
g913.pep  VESAETGAAEPAVHEDSVSETQAEAAGEAETQPGTQPX
          |||||||||| ||:|||||||||||||||||||||||
m913      VESAETGAAETAVQEDSVSETQAEAAGEAETQPGTQPX
                   240        250        260        270
```

The following partial DNA sequence was identified in *N. meningitidis* <SEQ ID 2769>:

```
a913.seq
    1   ATGAAAAAAA CCGCCTATGC CTTCCTCCTG CTGATCGGGT TCGCTTCCGC
   51   CCCTGCATTT GCCGAAACCC GCCCCGCCGA CCCTTATGAA GGCTACAACC
  101   GCGCCGTTTT CAAATTCAAC GACCAAGCCG ACCGCTACAT TTTCGCCCCT
  151   GCCGCGCGCG GCTACCGCAA AGTTGCGCCG AAACCCGTCC GCGCCGGCGT
  201   GTCCAATTTT TTTAACAACC TGTGCGACGT GGTCAGCTTC GGCAGCAATA
  251   TCTTGCGCTT AGACATCAAA CGCGCAAGCG AAGACCTTGT CCGCGTCGGT
  301   ATCAACACCA CTTTCGGTTT GGGCGGGCTT ATCGACATCG CCGGCGCGGG
  351   CGGCATTCCC GACAATAAAA ACACCTTGGG CGACACGTTT GCTTCGTGGG
  401   GATGGAAAAA CAGCAATTAT TTCGTGTTGC CCGTCTTAGG GCCGTCCACC
  451   GTCCGCGACG CGCTCGGCAC GGGTATTACC TCCGTTTATT CGCCCAAGAA
  501   TATCGTCTTC CGCACCCCTG TCGGACGCTG GGGCACGACT GCCGTATCCG
  551   CCGTCAGTAC GCGCGAAGGC CTGCTCGATT TGACCGACAG TCTGGACGAA
  601   GCCGCCATCG ACAAATACAG CTACACGCGC GACCTCTATA TGAAAGTCCG
  651   TGCGCGGCAG ACCGGTGCAA CACCTGCCGA AGGTACGGAA GATAACATCG
  701   ACATCGACGA ATTGGTCGAA AGTGCCGAAA CCGGCGCGGC GGAAACTGCC
  751   GTTCAAGAAG ATTCCGTATC CGAAACACAG GCAGAAGCAG CAGGGGAAGC
  801   CGAAACGCAA CCTGGAACAC AACCTGGAAC ACAACCTTAA
```

This corresponds to the amino acid sequence <SEQ ID 2770; ORF 913.a>:

```
a913.pep
    1   MKKTAYAFLL LIGFASAPAF AETRPADPYE GYNRAVFKFN DQADRYIFAP

51   AARGYRKVAP KPVRAGVSNF FNNLCDVVSF GSNILRLDIK RASEDLVRVG
```

-continued

```
101   INTTFGLGGL  IDIAGAGGIP  DNKNTLGDTF  ASWGWKNSNY  FVLPVLGPST

151   VRDALGTGIT  SVYSPKNIVF  RTPVGRWGTT  AVSAVSTREG  LLDLTDSLDE

201   AAIDKYSYTR  DLYMKVRARQ  TGATPAEGTE  DNIDIDELVE  SAETGAAETA

251   VQEDSVSETQ  AEAAGEAETQ  PGTQPGTQP*
``` m913/a913 100.0% identity in 275 aa overlap

```
                  10         20         30         40         50         60
m913.pep  MKKTAYAFLLLIGFASAPAFAETRPADPYEGYNRAVFKFNDQADRYIFAPAARGYRKVAP
          ||||||||||||||||||||||||||||||||||||||||||||||||||||||||||||
a913      MKKTAYAFLLLIGFASAPAFAETRPADPYEGYNRAVFKFNDQADRYIFAPAARGYRKVAP
                  10         20         30         40         50         60

70         80         90        100        110        120
m913.pep  KPVRAGVSNFFNNLCDVVSFGSNILRLDIKRASEDLVRVGINTTFGLGGLIDIAGAGGIP
          ||||||||||||||||||||||||||||||||||||||||||||||||||||||||||||
a913      KPVRAGVSNFFNNLCDVVSFGSNILRLDIKRASEDLVRVGINTTFGLGGLIDIAGAGGIP
                  70         80         90        100        110        120

130        140        150        160        170        180
m913.pep  DNKNTLGDTFASWGWKNSNYFVLPVLGPSTVRDALGTGITSVYSPKNIVFRTPVGRWGTT
          ||||||||||||||||||||||||||||||||||||||||||||||||||||||||||||
a913      DNKNTLGDTFASWGWKNSNYFVLPVLGPSTVRDALGTGITSVYSPKNIVFRTPVGRWGTT
                 130        140        150        160        170        180

190        200        210        220        230        240
m913.pep  AVSAVSTREGLLDLTDSLDEAAIDKYSYTRDLYMKVRARQTGATPAEGTEDNIDIDELVE
          ||||||||||||||||||||||||||||||||||||||||||||||||||||||||||||
a913      AVSAVSTREGLLDLTDSLDEAAIDKYSYTRDLYMKVRARQTGATPAEGTEDNIDIDELVE
                 190        200        210        220        230        240

250        260        270
m913.pep  SAETGAAETAVQEDSVSETQAEAAGEAETQPGTQPX
          |||||||||||||||||||||||||||||||||||
a913      SAETGAAETAVQEDSVSETQAEAAGEAETQPGTQPGTQPX
                 250        260        270        280
```

The following partial DNA sequence was identified in *N. gonorrhoeae* <SEQ ID 2771>:

```
g914.seq
    1   ATGAAAAAAT GTATTTTGGG CATTTTGACC GCGTGTGCCG CCATGCCTGC

51   ATTTGCCGAC AGAATCAGCG ATTTGGAAGC ACGTCTGGCG CAGTTGGAAC

101   ACCGTGTCGC CGTATTGGAA AGCGGCGGCA ATACCGTCAA AATCGACCTT

151   TTCGGTTCAA ATTCCACCAT GTATGTATGC AGCGTTACGC CTTTTCAGAA

201   GacgtttGag gCAAGCGATC GGAATGAAGG CGTGGCGCGG CAGAAAGTGC

251   GTCAGGCGTG CAACCGCGAA ACTTCGGCAA TGTTTTGCGG AGATGAGGCA

301   ATCCGATGCA GAAAATTCGA TTGATGTATC GGTTGGACGG ATAAAGAAAC

351   GGATACGGAG CTTGGCTTCC GTCTCTGTTT TTCTCTGCCC GATTTTCCAT

401   GCATCGGGTT TCAGACGGCA TTGGAGTGTC AGTCGTGTTC TGCCGATTCG 451   taggctTCGA CGATTTTTTG CACCAGAGGA TGCCGGACAA CGTCTTCGCC

501   GGTGAAGGTA TGGAAATACA GTCCTGCCAC GCCGTGCAGT TTCTCACGTG

551   CGTCTTTCAA TCCCGATTTG ATGTTTTTGG GCAGGTcgaT TTGGCTGGTG

601   TCGCCGGTAA TGACGGCTTT CGCgccgaag ccGATGCGGG TCAGGAACAT

651   TTTCATTTGT TCGGGCGTGg tgTtttGcgC TTCGTCGAGG ATGATGTATG

701   CGCCGTTGAg cgTCCTGCCG CGCATATAG
```

This corresponds to the amino acid sequence <SEQ ID 2772; ORF 914.ng>:

```
g914.pep
     1   MKKCILGILT ACAAMPAFAD RISDLEARLA QLEHRVAVLE SGGNTVKIDL

51   FGSNSTMYVC SVTPFQKTFE ASDRNEGVAR QKVRQACNRE TSAMFCGDEA

101   IRCRKFD*CI GWTDKETDTE LGFRLCFSLP DFPCIGFQTA LECQSCSADS

151   *ASTIFCTRG CRTTSSPVKV WKYSPATPCS FSRASFNPDL MFLGRSIWLV

201   SPVMTAFAPK PMRVRNIFIC SGVVFCASSR MMYAPLSVLP RI*
```

The following partial DNA sequence was identified in *N. meningitidis* <SEQ ID 2773>:

```
m914.seq
     1   ATGAAAAAAT GTATTTTGGG CATTTTGACC GCGTGTGCCG CCATGCCTGC

51   ATTTGCCGAC AGAATCGGCG ATTTGGAAGC ACGTCTGGCG CAGTTGGAAC

101   ACCGTGTCGC CGTATTGGAA AGCGGCGGCA ATACCGTCAA AATCGACCTT

151   TTCGGTTCAA ATTCCACCAT GTATGTATGC AGCGTTACGC CTTTTCAGAA

201   GACGTTTGAG GCAAGCGATC GGAATGAAGG CGTGGCGCGG CAGAAAGTGC

251   GTCAGGCGTG CAACCGCGAA ACTTCGGCAA TGTTTTGCGA AGATGAGGCA

301   ATCCGATGCA GAAAATTCGA TTGATGTATC GGTTGGACGG ATAAAGAAAC

351   GGATACGGAT ACGGAGCTTG GCTTCCGTAT CTGTTTTTCT CTGCCTGATT

401   TTCCATGCAT CGGGTTTCAG ACGGCATTGG AATGTCAGTC GTGTTCTGCC

451   GATTCGTAGG CTTCGACGAT TTTTTGCACC AAAGGATGCC GGACAACGTC

501   TTCGCCGGTA AAGGTGTGGA AATACAGCCC TTCCACGTTG TGCAGTTTCT

551   CACGCGCATC TTTTAATCCC GATTTGATGT TTTTGGGCAG GTCGATTTGG

601   CTGGTGTCGC CGGTAATGAC GGCTTTCGCG CCGAAGCCGA TGCGGGTCAG

651   GAACATTTTC ATTTGTTCGG GCGTGGTGTT TTGCGCTTCG TCGAGGATGA

701   TGTATGCGCC GTTGAGCGTC CTGCCGCGCA TATAG
```

This corresponds to the amino acid sequence <SEQ ID 2774; ORF 914>:

```
m914.pep
     1   MKKCILGILT ACAAMPAFAD RIGDLEARLA QLEHRVAVLE SGGNTVKIDL

51   FGSNSTMYVC SVTPFQKTFE ASDRNEGVAR QKVRQACNRE TSAMFCEDEA

101   IRCRKFDXCI GWTDKETDTD TELGFRICFS LPDFPCIGFQ TALECQSCSA

151   DSXASTIFCT KGCRTTSSPV KVWKYSPSTL CSFSRASFNP DLMFLGRSIW

201   LVSPVMTAFA PKPMRVRNIF ICSGVVFCAS SRMMYAPLSV LPRI*
```

(In both peptide listings, residues 1–20, "MKKCILGILT ACAAMPAFAD", are underlined on the page up to the final D.)

Computer analysis of this amino acid sequence gave the following results:
Homology with a Predicted ORF from *N. gonorrhoeae*
ORF 914 shows 96.7% identity over a 244 aa overlap with a predicted ORF (ORF 914.ng) from *N. gonorrhoeae*:

```
g914/m914
                   10        20        30        40        50        60
g914.pep  MKKCILGILTACAAMPAFADRISDLEARLAQLEHRVAVLESGGNTVKIDLFGSNSTMYVC
          ||||||||||||||||||||||:|||||||||||||||||||||||||||||||||||||||
m914      MKKCILGILTACAAMPAFADRIGDLEARLAQLEHRVAVLESGGNTVKIDLFGSNSTMYVC
                   10        20        30        40        50        60
```

-continued

```
                 70        80        90       100       110      119
g914.pep  SVTPFQKTFEASDRNEGVARQKVRQACNRETSAMFCGDEAIRCRKFDXCIGWTDKETDT-
          |||||||||||||||||||||||||||||||||||| ||||||||||||||||||||||
m914      SVTPFQKTFEASDRNEGVARQKVRQACNRETSAMFCEDEAIRCRKFDXCIGWTDKETDTD
                 70        80        90       100       110       120

120       130       140       150       160       170
g914.pep  -ELGFRLCFSLPDFPCIGFQTALECQSCSADSXASTIFCTRGCRTTSSPVKVWKYSPATP
           |||||:||||||||||||||||||||||||||||||||:||||||||||||||||||:|
m914      TELGFRICFSLPDFPCIGFQTALECQSCSADSXASTIFCTKGCRTTSSPVKVWKYSPSTL
               130       140       150       160       170       180

180       190       200       210       220       230
g914.pep  CSFSRASFNPDLMFLGRSIWLVSPVMTAFAPKPMRVRNIFICSGVVFCASSRMMYAPLSV
          ||||||||||||||||||||||||||||||||||||||||||||||||||||||||||||
m914      CSFSRASFNPDLMFLGRSIWLVSPVMTAFAPKPMRVRNIFICSGVVFCASSRMMYAPLSV
               190       200       210       220       230       240

240
g914.pep  LPRIX
          |||||
m914      LPRIX
```

The following partial DNA sequence was identified in *N. meningitidis* <SEQ ID 2775>:

```
a914.seq
     1  ATGAAAAAAT GTATTTTGGG CATTTTGACC GCGTGTGCCG CCATGCCTGC

51  ATTTGCCGAC AGAATCGGCG ATTTGGAAGC ACGTCTGGCG CAGTTGGAAC

101  ACCGTGTCGC CGTATTGGAA AGCGGCAGCA ATACCGTCAA AATCGACCTT

151  TTCGGTTCAA ATTCCACCAT GTATGTATGC AGCGTTACGC CTTTTCAGAA

201  GACGTTTGAG GCAAGCGATC GGAATGAAGG CGTGGCGCGG CAGAAAGTGC

251  GTCAGGCGTG CAACCGCGAA ACTTCGGCAA TGTTTTGCGA AGATGAGGCA

301  ATCCGATGCA GAAAATTCGA TTGATGTATC GGTTGGACGG ATAAAGAAAC

351  GGATACGGAG CTTGGCTTCC GTATCTGTTT TTCTCTGCCC GATTTTCCAT

401  GCATCGGGTT TCAGACGGCA TTGGAATGTC AGTCGTGTTC TGCCGATTCG

451  TAGGCTTCGA CGATTTTTTG CACCAAAGGA TGCCGGACAA CGTCTTCGCC

501  GGTAAAGGTG TGGAAATACA GCCCTTCCAC GCCGTGCAGT TTCTCACGCG

551  CATCTTTTAA TCCCGATTTG ATGTTTTTGG GCAGGTCGAT TTGGCTGGTG

601  TCGCCGGTAA TGACGGCTTT CGCGCCGAAG CCGATGCGGG TCAGGAACAT

651  TTTCATTTGT TCGGGCGTGG TGTTTTGCGC TTCGTCGAGG ATGATGTATG

701  CGCCGTTGAG CGTCCTGCCG CGCATATAG
```

This corresponds to the amino acid sequence <SEQ ID 2776; ORF 914.a>:

```
a914.pep
     1  MKKCILGILT ACAAMPAFAD RIGDLEARLA QLEHRVAVLE SGSNTVKIDL

51  FGSNSTMYVC SVTPFQKTFE ASDRNEGVAR QKVRQACNRE TSAMFCEDEA

101  IRCRKFD*CI GWTDKETDTE LGFRICFSLP DFPCIGFQTA LECQSCSADS

151  *ASTIFCTKG CRTTSSPVKV WKYSPSTPCS FSRASFNPDL MFLGRSIWLV

201  SPVMTAFAPK PMRVRNIFIC SGVVFCASSR MMYAPLSVLP RI*
``` m914/a914 98.4% identity in 244 aa overlap

```
             10         20         30         40         50         60
m914.pep  MKKCILGILTACAAMPAFADRIGDLEARLAQLEHRVAVLESGGNTVKIDLFGSNSTMYVC
          ||||||||||||||||||||||||||||||||||||||:|||||||||||||||||||||
a914      MKKCILGILTACAAMPAFADRIGDLEARLAQLEHRVAVLESGSNTVKIDLFGSNSTMYVC
             10         20         30         40         50         60

70         80         90        100        110        120
m914.pep  SVTPFQKTFEASDRNEGVARQKVRQACNRETSAMFCEDEAIRCRKFDXCIGWTDKETDTD
          ||||||||||||||||||||||||||||||||||||||||||||||||||||||||
a914      SVTPFQKTFEASDRNEGVARQKVRQACNRETSAMFCEDEAIRCRKFDXCIGWTDKETD--
             70         80         90        100        110

130        140        150        160        170        180
m914.pep  TELGFRICFSLPDFPCIGFQTALECQSCSADSXASTIFCTKGCRTTSSPVKVWKYSPSTL
          |||||||||||||||||||||||||||||||||||||||||||||||||||||||||||:
a914      TELGFRICFSLPDFPCIGFQTALECQSCSADSXASTIFCTKGCRTTSSPVKVWKYSPSTP
            120        130        140        150        160        170

190        200        210        220        230        240
m914.pep  CSFSRASFNPDLMFLGRSIWLVSPVMTAFAPKPMRVRNIFICSGVVFCASSRMMYAPLSV
          |||||||||||||||||||||||||||||||||||||||||||||||||||||||||||
a914      CSFSRASFNPDLMFLGRSIWLVSPVMTAFAPKPMRVRNIFICSGVVFCASSRMMYAPLSV
            180        190        200        210        220        230 m914.pep  LPRIX
          |||||
a914      LPRIX
            240
```

The following partial DNA sequence was identified in *N. gonorrhoeae* <SEQ ID 2777>:

```
g915.seq
    1   ATGAAGAAAA CCCTGTTGGc AATTGTTGCC gtTTTCGCCT TAAGTGCCTG
   51   CCGGCaggcg gaAGaggcac cgccgCCTTT ACCCCGGCAG AtTAGCGacc
  101   gttcggtcgg aCACTAttgC Agtatgaacc tgaccgaaca caacggcccc
  151   aaagcccaga ttttttttgaa cGGCAAACCC GATCAGCCCG TTTGGTTCTC
  201   CACCGTcaag cagatgttcg GCTATACCAA GCTGCCCGAA GAGCCCAAAG
  251   GCATCCGCGT GATTTACGTT ACCGATATGG GCAATGTTAC CGATTGGACG
  301   AATCCTAATG CCGACACGGA GTGGATAGAT GCGAAAAAAG CCTTTTACGT
  351   CATCGACAGC GGCTTTATCG GCGGTATGGG CGCGGAAGAC GCGCTGCCGT
  401   TCGGCAACAA GGAGCAGGCT GAAAAATTTG CAAAGGATAA AGGCGGCAAG
  451   GTCGTCGGTT TTGACGATAT GCCCGATGCT TACATTTTCA AGTAA
                                                      45
```

This corresponds to the amino acid sequence <SEQ ID 2778; ORF 915.ng>:

```
g915.pep
    1   MKKTLLAIVA VFALSACRQA EEAPPPLPRQ ISDRSVGHYC SMNLTEHNGP
   51   KAQIFLNGKP DQPVWFSTVK QMFGYTKLPE EPKGIRVIYV TDMGNVTDWT
  101   NPNADTEWID AKKAFYVIDS GFIGGMGAED ALPFGNKEQA EKFAKDKGGK
  151   VVGFDDMPDA YIFK*
```

The following partial DNA sequence was identified in *N. meningitidis* <SEQ ID 2779>:

```
m915.seq
    1   ATGAAAAAAA CCCTGTTGGC AATTGTTGCC GTTTCCGCCT TAAGTGC.tG
   51   CCGGCAGGCG GAAGAGGGAC CGCCGCCTTT ACCcCGGCAG ATTAGCGACC
  101   GTTCGGTCGG ACACTATTGC AGTATGAACC TGACCGAACA CAACGGCCCC
```

-continued

```
151    AAAGCCCAGA TTTTCTTGAA CGGCAAACCC GATCAGCCCG TtTGGTTCTC

201    CACCATCAAG CAGATGTTCG GCTATACCAA GCTGCCCGAA GAGCCTAAAG

251    GCATCCGCGT GATTTACGTT ACCGATATGG GCAATGTTAC CGATTGGACG

301    AATCCCAATG CCGACACGGA GTGGATGGAT GCGAAAAAAG CCTTTTACGT

351    CATCGACAGC GGCTTTATCG GCGGTATGGG TGCGGAAGAC GCGCTGCCGT

401    TCGGCAACAA AGAGCAGGCT GAGAAATTTG CAAAGGATAA AGGCGGTAAG

451    GTTGTCGGTT TCGACGATAT GCCTGATACC TATATTTTCA AATAA
```

This corresponds to the amino acid sequence <SEQ ID 2780; ORF 915>:

```
m915.pep
    1    MKKTLLAIVA VSALSXCRQA EEGPPPLPRQ ISDRSVGHYC SMNLTEHNGP

51    KAQIFLNGKP DQPVWFSTIK QMFGYTKLPE EPKGIRVIYV TDMGNVTDWT

101    NPNADTEWMD AKKAFYVIDS GFIGGMGAED ALPFGNKEQA EKFAKDKGGK

151    VVGFDDMPDT YIFK*
```

Computer analysis of this amino acid sequence gave the following results:
Homology with a Predicted ORF from *N. gonorrhoeae*
ORF 915 shows 97.0% identity over a 164 aa overlap with a predicted ORF (ORF 915.ng) from *N. gonorrhoeae*:

```
m915/g915
                  10         20         30         40         50         60
m915.pep   MKKTLLAIVAVSALSACRQAEEGPPPLPRQISDRSVGHYCSMNLTEHNGPKAQIFLNGKP
           |||||||||| ||||||||||:||||||||||||||||||||||||||||||||||||||
g915       MKKTLLAIVAVFALSACRQAEEAPPPLPRQISDRSVGHYCSMNLTEHNGPKAQIFLNGKP
                  10         20         30         40         50         60

70         80         90        100        110        120
m915.pep   DQPVWFSTIKQMFGYTKLPEEPKGIRVIYVTDMGNVTDWTNPNADTEWMDAKKAFYVIDS
           ||||||||:|||||||||||||||||||||||||||||||||||||||:|||||||||||
g915       DQPVWFSTVKQMFGYTKLPEEPKGIRVIYVTDMGNVTDWTNPNADTEWIDAKKAFYVIDS
                  70         80         90        100        110        120

130        140        150        160
m915.pep   GFIGGMGAEDALPFGNKEQAEKFAKDKGGKVVGFDDMPDTYIFKX
           ||||||||||||||||||||||||||||||||||||||:||||||
g915       GFIGGMGAEDALPFGNKEQAEKFAKDKGGKVVGFDDMPDAYIFKX
                 130        140        150        160
```

The following partial DNA sequence was identified in *N. meningitidis* <SEQ ID 2781>:

```
a915.seq
    1    ATGAAAAAAA CCCTGTTGGC AATTGTTGCC GTTTCCGCCT TAAGTGCCTG

51    CCGGCAGGCG GAAGAGGGAC CGCCGCCTTT ACCCCGGCAG ATTAGCGACC

101    GTTCGGTCGG ACACTATTGC AGTATGAACC TGACCGAACA CAACGGCCCC

151    AAAGCCCAGA TTTTCTTGAA CGGCAAACCC GATCAGCCCG TTTGGTTCTC

201    CACCATCAAG CAGATGTTCG GCTATACCAA GCTGCCCGAA GAGCCTAAAG

251    GCATCCGCGT GATTTACGTT ACCGATATGG GCAATGTTAC CGATTGGACG

301    AATCCCAATG CCGACACGGA GTGGATGGAT GCGAAAAAAG CCTTTTACGT

351    CATCGACAGC GGCTTTATCG GCGGTATGGG TGCGGAAGAC GCGCTGCCGT
```

-continued

```
401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 2782; ORF 915.a>:

```
a915.pep
   1  MKKTLLAIVA VSALSACRQA EEGPPPLPRQ ISDRSVGHYC SMNLTEHNGP

51  KAQIFLNGKP DQPVWFSTIK QMFGYTKLPE EPKGIRVIYV TDMGNVTDWT

101  NPNADTEWMD AKKAFYVIDS GFIGGMGAED ALPFGNKEQA EKFAKDKGGK

151  VVGFDDMPDT YIFK*
``` m915/a915 99.4% identity in 164 aa overlap

```
                   10         20         30         40         50         60
     m915.pep  MKKTLLAIVAVSALSXCRQAEEGPPPLPRQISDRSVGHYCSMNLTEHNGPKAQIFLNGKP
               |||||||||||||||| |||||||||||||||||||||||||||||||||||||||||||
         a915  MKKTLLAIVAVSALSACRQAEEGPPPLPRQISDRSVGHYCSMNLTEHNGPKAQIFLNGKP
                   10         20         30         40         50         60

70         80         90        100        110        120
     m915.pep  DQPVWFSTIKQMFGYTKLPEEPKGIRVIYVTDMGNVTDWTNPNADTEWMDAKKAFYVIDS
               ||||||||||||||||||||||||||||||||||||||||||||||||||||||||||||
         a915  DQPVWFSTIKQMFGYTKLPEEPKGIRVIYVTDMGNVTDWTNPNADTEWMDAKKAFYVIDS
                   70         80         90        100        110        120

130        140        150        160
     m915.pep  GFIGGMGAEDALPFGNKEQAEKFAKDKGGKVVGFDDMPDTYIFKX
               ||||||||||||||||||||||||||||||||||||||||||||
         a915  GFIGGMGAEDALPFGNKEQAEKFAKDKGGKVVGFDDMPDTYIFKX
                  130        140        150        160
```

The following partial DNA sequence was identified in *N. gonorrhoeae* <SEQ ID 2783>:

```
g917.seq
   1  ATGGTCAAac atctgccacT cgcCGTCctg actgctTtgc tgcttgcagc 51  gtgcGGCGGT Tcggacaaac cgcctgccga Aaaaccggca ccggcgGaAA 101  accaaAacgt atTgaAAATT TataACTGGT CGGAATACGT CGATCCGGAA

151  ACCGTTGCCG ATTTTGAAAA GAAAAACGGC ATCAAGGTTA CTTATGATGT

201  GTACGACAGT GATGAAACGC TGGAAAGCAA GGTGCTGACC GGAAAATCCG

251  GTTACGACAT TGTCGCGCCG TCCAATGCGT TTGTGGGCAG GCAGATTAAG

301  GCAGGTGCGT ATCAGAAAAT CGATAAGTCG ATGATTCCCA ATTATAAACA

351  TCTCAACCCT GAAATGATGA GGCTGATGGA CGGGGTCGAT CCCGACCACG

401  AATACGCCGT GCCGTTTTAT TGGGGGACAA ATACCTTCGC CATCAATACC

451  GAACGCGTGA AAAAGGCTTT GGGTACGGAC AAGCTGCCGG ACAACCAGTG

501  GGATTTGGTG TTCAACCCCG AATACACGTT CAAACTCAAA CAATGCGGCA

551  TCAGCTATTT GGACAGCGCG GCGGAAATTT ATCCCATGGT GTTGAACTAT

601  TTGGGCAAAA ACCCGAACAG CAGCAATACG GAAGACATCA GGGAGGCAAC

651  CGCCCTGCTC AAGAAAAACC GCCCCAATAT CAAACGCTTT ACTTCGTCCG

701  GCTTTATCGA TGATTTGGCG CGCGGCGATA CCTGCGTAAC AATCGGTTTC

751  GGCGGAGATT TGAACATCGC CAAACGCCGT GCCGAAGAAG CGGGCGGCAA

801  GGAAAAAATC CGCGTGATGA TGCCGAAAGA GGGCGTGGGG ATTTGGGTGG
```

-continued
```
 851  ATTCTTTCGT GATTCCGAAA GATGCGAAAA ACGTCGCCAA CGCGCACAAA

901  TACATCAACG ACTTCCTCGA TCCGGAAGTG TCGGCGAAAA ACGGCAATTT 951  cgttacCTAC GCGCCTTCGA GCAAGCCGGC GCGCGATTTG ATGGAGGACG

1001  AATTTAAAAA CGACAATACG ATTTTCCCGA GCGGGGAAGA TTTGAAAAAC

1051  AGCTTTATCA TGGTGCCTAT CCGGCCGGCG GCATTGAAGT TTATGGTGCG

1101  CCAGTGGCAG GATGTGAAGG CGGGGAAATA A
```

This corresponds to the amino acid sequence <SEQ ID 2784; ORF 917.ng>:

```
g917.pep
   1  MVKHLPLAVL TALLLAACGG SDKPPAEKPA PAENQNVLKI YNWSEYVDPE

51  TVADFEKKNG IKVTYDVYDS DETLESKVLT GKSGYDIVAP SNAFVGRQIK

101  AGAYQKIDKS MIPNYKHLNP EMMRLMDGVD PDHEYAVPFY WGTNTFAINT

151  ERVKKALGTD KLPDNQWDLV FNPEYTFKLK QCGISYLDSA AEIYPMVLNY

201  LGKNPNSSNT EDIREATALL KKNRPNIKRF TSSGFIDDLA RGDTCVTIGF

251  GGDLNIAKRR AEEAGGKEKI RVMMPKEGVG IWVDSFVIPK DAKNVANAHK

301  YINDFLDPEV SAKNGNFVTY APSSKPARDL MEDEFKNDNT IFPSGEDLKN

351  SFIMVPIRPA ALKFMVRQWQ DVKAGK*
```

The following partial DNA sequence was identified in *N. meningitidis* <SEQ ID 2785>:

```
m917.seq
   1  ATGACCAAAC ATCTGCCCCT GGCCGTCCTG ACTGCTTTGC TGCTTGCAGC

51  GTGCGGCGGT TCGGACAAAC CGCCTGCCGA AAAACCGGCA CCGGCGGAAA

101  ACCAAAACGT ATTGAAAATT TACAACTGGT CGGAATATGT CGATCCGGAA

151  ACCGTTGCCG ATTTTGAAAA GAAAAACGGC ATCAAGGTTA CTTATGATGT

201  GTACGACAGC GATGAAACGC TGGAAAGCAA GGTGCTGACA GGCAAGTCCG

251  GTTACGACAT TGTCGCGCCG TCCAATGCGT TTGTGGGCAG GCAGATTAAG

301  GCAGGTGCGT ATCAGAAAAT CGATAAGTCG CTGATTCCCA ATTATAAACA

351  CCTCAACCCC GAAATGATGA GGCTGATGGA CGGGGTCGAT CCCGGCCACG

401  AATACGCCGT GCCGTTTTAT TGGGGGACAA ATACCTTCGC CATCAATACC

451  GAACGCGTGA AAAAGGCTTT GGGTACGGAC AAGCTGCCGG ACAACCAGTG

501  GGATTTGGTG TTCGACCCCG AATACACGTC CAAACTCAAG CAATGCGGCA

551  TCAGCTATTT GGACAGCGCG GCGGAAATCT ATCCTATGGT GTTGAACTAT

601  TTGGGTAAAA ACCCGAACAG CAGCAATACG GAAGACATCA GGGAGGCAAC

651  CGCCCTACTC AAGAAAAACC GCCCCAATAT CAAACGCTTT ACTTCGTCCG

701  GCTTTATCGA TGATTTGGCG CGCGGCGATA CCTGCGTAAC AATCGGTTTC

751  GGCGGCGATT TGAACATCGC CAAACGCCGT GCCGAAGAAG CGGGCGGCAA

801  GGAAAAAATC CGCGTGATGA TGCCCAAAGA GGGCGTGGGG ATTTGGGTGG

851  ATTCTTTCGT GATTCCGAAA GATGCGAAAA ACGTCGCCAA CGCGCACAAA

901  TACATCAACG ACTTCCTCGA CCCGGAAGTG TCGGCGAAAA ACGGCAATTT

951  CGTTACTTAC GCGCCTTCGA GCAAGCCTGC GCGTGAGCTG ATGGAAGACG
```

```
-continued
1001  AATTTAAAAA CGACAATACG ATTTTCCCAA CCGAGGAGGA TTTGAAAAAC

1051  AGCTTTATCA TGGTGCCTAT CCAGCCGGCG GCATTGAAGT TTATGGTGCG

1101  CCAGTGGCAG GATGTGAAGG CGGGGAAATA A
```

This corresponds to the amino acid sequence <SEQ ID 2786; ORF 917>:

```
m917.pep
    1   MTKHLPLAVL TALLLAACGG SDKPPAEKPA PAENQNVLKI YNWSEYVDPE

51   TVADFEKKNG IKVTYDVYDS DETLESKVLT GKSGYDIVAP SNAFVGRQIK

101   AGAYQKIDKS LIPNYKHLNP EMMRLMDGVD PGHEYAVPFY WGTNTFAINT

151   ERVKKALGTD KLPDNQWDLV FDPEYTSKLK QCGISYLDSA AEIYPMVLNY

201   LGKNPNSSNT EDIREATALL KKNRPNIKRF TSSGFIDDLA RGDTCVTIGF

251   GGDLNIAKRR AEEAGGKEKI RVMMPKEGVG IWVDSFVIPK DAKNVANAHK

301   YINDFLDPEV SAKNGNFVTY APSSKPAREL MEDEFKNDNT IFPTEEDLKN

351   SFIMVPIQPA ALKFMVRQWQ DVKAGK*
```

Computer analysis of this amino acid sequence gave the following results:
Homology with a Predicted ORF from *N. gonorrhoeae*
ORF 917 shows 97.6% identity over a 376 aa overlap with a predicted ORF (ORF 917.ng) from *N. gonorrhoeae*:

```
m917/g917
                    10         20         30         40         50         60
    m917.pep  MTKHLPLAVLTALLLAACGGSDKPPAEKPAPAENQNVLKIYNWSEYVDPETVADFEKKNG
              |:||||||||||||||||||||||||||||||||||||||||||||||||||||||||||
    g917      MVKHLPLAVLTALLLAACGGSDKPPAEKPAPAENQNVLKIYNWSEYVDPETVADFEKKNG
                    10         20         30         40         50         60

70         80         90        100        110        120
    m917.pep  IKVTYDVYDSDETLESKVLTGKSGYDIVAPSNAFVGRQIKAGAYQKIDKSLIPNYKHLNP
              |||||||||||||||||||||||||||||||||||||||||||||||||:||||||||||
    g917      IKVTYDVYDSDETLESKVLTGKSGYDIVAPSNAFVGRQIKAGAYQKIDKSMIPNYKHLNP
                    70         80         90        100        110        120

130        140        150        160        170        180
    m917.pep  EMMRLMDGVDPGHEYAVPFYWGTNTFAINTERVKKALGTDKLPDNQWDLVFDPEYTSKLK
              |||||||||||:|||||||||||||||||||||||||||||||||||||:||||  |||
    g917      EMMRLMDGVDPDHEYAVPFYWGTNTFAINTERVKKALGTDKLPDNQWDLVFNPEYTFKLK
                   130        140        150        160        170        180

190        200        210        220        230        240
    m917.pep  QCGISYLDSAAEIYPMVLNYLGKNPNSSNTEDIREATALLKKNRPNIKRFTSSGFIDDLA
              ||||||||||||||||||||||||||||||||||||||||||||||||||||||||||||
    g917      QCGISYLDSAAEIYPMVLNYLGKNPNSSNTEDIREATALLKKNRPNIKRFTSSGFIDDLA
                   190        200        210        220        230        240

250        260        270        280        290        300
    m917.pep  RGDTCVTIGFGGDLNIAKRRAEEAGGKEKIRVMMPKEGVGIWVDSFVIPKDAKNVANAHK
              ||||||||||||||||||||||||||||||||||||||||||||||||||||||||||||
    g917      RGDTCVTIGFGGDLNIAKRRAEEAGGKEKIRVMMPKEGVGIWVDSFVIPKDAKNVANAHK
                   250        260        270        280        290        300

310        320        330        340        350        360
    m917.pep  YINDFLDPEVSAKNGNFVTYAPSSKPARELMEDEFKNDNTIFPTEEDLKNSFIMVPIQPA
              |||||||||||||||||||||||||||||:||||||||||||||:|||||||||||:||
    g917      YINDFLDPEVSAKNGNFVTYAPSSKPARDLMEDEFKNDNTIFPSGEDLKNSFIMVPIRPA
                   310        320        330        340        350        360

370
    m917.pep  ALKFMVRQWQDVKAGKX
              |||||||||||||||||
    g917      ALKFMVRQWQDVKAGKX
                   370
```

The following partial DNA sequence was identified in *N. meningitidis* <SEQ ID 2787>:

```
a917.seq
    1 ATGACCAAAC ATCTGCCCCT GGCCGTCCTG ACTGCTTTGC TGCTTGCAGC
   51 GTGCGGCGGT TCGGACAAAC CGCCTGCCGA AAAACCGGCG CCGGCGGAAA
  101 ACCGAAACGT ATTGAAAATT TACAACTGGT CGGAATACGT CGATCCGGAA
  151 ACCGTTGCCG ATTTTGAAAA GAAAAACGGC ATCAAGGTTA CTTATGATGT
  201 GTACGACAGC GATGAAACGC TGGAAAGCAA GGTGCTGACC GGAAAATCTG
  251 GTTACGACAT TGTCGCGCCG TCCAATGCGT TTGTGGGCAG GCAGATTAAG
  301 GCAGGTGCGT ATCAGAAAAT CGATAAGTCG CTGATTCCCA ATTATAAACA
  351 CCTCAACCCC GAAATGATGA GGCTGATGGA CGGGGTCGAT CCCGGCCACG
  401 AATACGCCGT GCCGTTTTAT TGGGGGACAA ATACCTTCGC CATCAATACC
  451 GAACGCGTGA AAAAGGCTTT GGGTACGGAC AAGCTGCCGG ACAACCAGTG
  501 GGATTTGGTG TTCGACCCCG AATACACGTC CAAACTCAAG CAATGCGGCA
  551 TCAGCTATTT GGACAGCGCG GCGGAAATCT ATCCTATGGT GTTGAACTAT
  601 TTGGGTAAAA ACCCGAACAG CAGCAATACG GAAGACATCA GGGAGGCAAC
  651 CGCCCTACTC AAGAAAAACC GCCCAATAT CAAACGCTTT ACTTCGTCCG
  701 GCTTTATCGA TGATTTGGCG CGCGGCGATA CCTGCGTAAC AATCGGTTTC
  751 GGCGGCGATT TGAACATCGC CAAACGCCGT GCCGAAGAAG CGGGCGGCAA
  801 GGAAAAAATC CGCGTGATGA TGCCCAAAGA GGGCGTGGGG ATTTGGGTGG
  851 ATTCTTTCGT GATTCCGAAA GATGCGAAAA ACGTCGCCAA CGCGCACAAA
  901 TACATCAACG ACTTCCTCGA CCCGGAAGTG TCGGCGAAAA ACGGCAATTT
  951 CGTTACTTAC GCGCCTTCGA GCAAGCCTGC GCGTGAGCTG ATGGAAGACG
 1001 AATTTAAAAA CGACAATACG ATTTTCCCAA CCGAGGAGGA TTTGAAAAAC
 1051 AGCTTTATCA TGGTGCCTAT CCAGCCGGCG GCATTGAAGT TTATGGTGCG
 1101 CCAGTGGCAG GATGTGAAGG CGGGGAAATA A
```

This corresponds to the amino acid sequence <SEQ ID 2788; ORF 917.a>:

```
a917.pep
    1 MTKHLPLAVL TALLLAACGG SDKPPAEKPA PAENRNVLKI YNWSEYVDPE
   51 TVADFEKKNG IKVTYDVYDS DETLESKVLT GKSGYDIVAP SNAFVGRQIK
  101 AGAYQKIDKS LIPNYKHLNP EMMRLMDGVD PGHEYAVPFY WGTNTFAINT
  151 ERVKKALGTD KLPDNQWDLV FDPEYTSKLK QCGISYLDSA AEIYPMVLNY
  201 LGKNPNSSNT EDIREATALL KKNRPNIKRF TSSGFIDDLA RGDTCVTIGF
  251 GGDLNIAKRR AEEAGGKEKI RVMMPKEGVG IWVDSFVIPK DAKNVANAHK
  301 YINDFLDPEV SAKNGNFVTY APSSKPAREL MEDEFKNDNT IFPTEEDLKN
  351 SFIMVPIQPA ALKFMVRQWQ DVKAGK*
``` m917/a917 99.7% identity in 376 aa overlap

```
                  10         20         30         40         50         60
   m917.pep  MTKHLPLAVLTALLLAACGGSDKPPAEKPAPAENQNVLKIYNWSEYVDPETVADFEKKNG
              ||||||||||||||||||||||||||||||||||||:||||||||||||||||||||||||
      a917  MTKHLPLAVLTALLLAACGGSDKPPAEKPAPAENRNVLKIYNWSEYVDPETVADFEKKNG
                  10         20         30         40         50         60
```

```
              70         80         90        100        110        120
m917.pep  IKVTYDVYDSDETLESKVLTGKSGYDIVAPSNAFVGRQIKAGAYQKIDKSLIPNYKHLNP
          ||||||||||||||||||||||||||||||||||||||||||||||||||||||||||||
a917      IKVTYDVYDSDETLESKVLTGKSGYDIVAPSNAFVGRQIKAGAYQKIDKSLIPNYKHLNP
              70         80         90        100        110        120

130        140        150        160        170        180
m917.pep  EMMRLMDGVDPGHEYAVPFYWGTNTFAINTERVKKALGTDKLPDNQWDLVFDPEYTSKLK
          ||||||||||||||||||||||||||||||||||||||||||||||||||||||||||||
a917      EMMRLMDGVDPGHEYAVPFYWGTNTFAINTERVKKALGTDKLPDNQWDLVFDPEYTSKLK
             130        140        150        160        170        180

190        200        210        220        230        240
m917.pep  QCGISYLDSAAEIYPMVLNYLGKNPNSSNTEDIREATALLKKNRPNIKRFTSSGFIDDLA
          ||||||||||||||||||||||||||||||||||||||||||||||||||||||||||||
a917      QCGISYLDSAAEIYPMVLNYLGKNPNSSNTEDIREATALLKKNRPNIKRFTSSGFIDDLA
             190        200        210        220        230        240

250        260        270        280        290        300
m917.pep  RGDTCVTIGFGGDLNIAKRRAEEAGGKEKIRVMMPKEGVGIWVDSFVIPKDAKNVANAHK
          ||||||||||||||||||||||||||||||||||||||||||||||||||||||||||||
a917      RGDTCVTIGFGGDLNIAKRRAEEAGGKEKIRVMMPKEGVGIWVDSFVIPKDAKNVANAHK
             250        260        270        280        290        300

310        320        330        340        350        360
m917.pep  YINDFLDPEVSAKNGNFVTYAPSSKPARELMEDEFKNDNTIFPTEEDLKNSFIMVPIQPA
          ||||||||||||||||||||||||||||||||||||||||||||||||||||||||||||
a917      YINDFLDPEVSAKNGNFVTYAPSSKPARELMEDEFKNDNTIFPTEEDLKNSFIMVPIQPA
             310        320        330        340        350        360

370
m917.pep  ALKFMVRQWQDVKAGKX
          |||||||||||||||||
a917      ALKFMVRQWQDVKAGKX
             370
```

The following partial DNA sequence was identified in *N. gonorrhoeae* <SEQ ID 2789>:

```
g919.seq
    1  ATGAAAAAAC ACCTGCTCCG CTCCGCCCTG TACGGcatCG CCGCCgccAT

51  CctcgCCGCC TGCCAAAgca gGAGCATCCA AACCTTTCCG CAACCCGACA

101  CATCCGTCAT CAACGGCCCG GACCGGCCGG CCGGCATCCC CGACCCCGCC

151  GGAACGACGG TTGCCGGCGG CGGGGCCGTC TATACCGTTG TGCCGCACCT

201  GTCCATGCCC CACTGGGCGG CGCaggATTT TGCCAAAAGC CTGCAATCCT

251  TCCGCCTCGG CTGCGCCAAT TTGAAAAACC GCCAAGGCTG GCAGGATGTG

301  TGCGCCCAAG CCTTTCAAAC CCCCGTGCAT TCCTTTCAGG CAAAGcGgTT

351  TTTTGAACGC TATTTCACGC cgtGGCaggt tgcaggcaAC GGAAGcCTTG

401  CaggtacggT TACCGGCTAT TACGAACCGG TGCTGAAGGG CGACGGCAGG

451  CGGACGGAAC GGGCCCGCTT CCCGATTTAC GGTATTCCCG ACGATTTTAT

501  CTCCGTCCCG CTGCCTGCCG GTTTGCGGGG CGGAAAAAAC CTTGTCCGCA

551  TCAGGCAGac ggGGAAAAAC AGCGGCACGA TCGACAATGC CGGCGGCACG

601  CATACCGCCG ACCTCTCCCG ATTCCCCATC ACCGCGCGCA CAACGGcaat 651  caaaGGCAGG TTTGAaggAA GCCGCTTCCT CCCTTACCAC ACGCGCAACC 701  AAAtcaacGG CGGCgcgcTT GACGGCAAag cccCCATCCT CggttacgcC 751  GAagaccCcG tcgaacttTT TTTCATGCAC AtccaaggCT CGGGCCGCCT 801  GAAAACCCcg tccggcaaat acatCCGCAt cggaTacgcc gacAAAAACG 851  AACAtccgTa tgtttccatc ggACGctaTA TGGCGGACAA AGGCTACCTC 901  AAGctcgggc agACCTCGAT GCAGGgcatc aaagcCTATA TGCGGCAAAA

951  TCCGCAACGC CTCGCCGAAG TTTTGGGTCA AAACCCCAGC TATATCTTTT

1001  TCCGCGAGCT TGCCGGAAGC GGCAATGAGG GCCCCGTCGG CGCACTGGGC
```

```
1051  ACGCCACTGA TGGGGGAATA CGCCGGCGCA ATCGACCGGC ACTACATTAC

1101  CTTGGGCGCG CCCTTATTTG TCGCCACCGC CCATCCGGTT ACCCGCAAAG

1151  CCCTCAACCG CCTGATTATG GCGCAGGATA CAGGCAGCGC GATCAAAGGC

1201  GCGGTGCGCG TGGATTATTT TTGGGGTTAC GGCGACGAAG CCGGCGAACT

1251  TGCCGGCAAA CAGAAAACCA CGGGATACGT CTGGCAGCTC CTGCCCAACG

1301  GCATGAAGCC CGAATACCGC CCGTGA
```

This corresponds to the amino acid sequence <SEQ ID 2790; ORF 919.ng>:

```
g919.pep
    1  MKKHLLRSAL YGIAAAILAA CQSRSIQTFP QPDTSVINGP DRPAGIPDPA

51  GTTVAGGGAV YTVVPHLSMP HWAAQDFAKS LQSFRLGCAN LKNRQGWQDV

101  CAQAFQTPVH SFQAKRFFER YFTPWQVAGN GSLAGTVTGY YEPVLKGDGR

151  RTERARFPIY GIPDDFISVP LPAGLRGGKN LVRIRQTGKN SGTIDNAGGT

201  HTADLSRFPI TARTTAIKGR FEGSRFLPYH TRNQINGGAL DGKAPILGYA

251  EDPVELFFMH IQGSGRLKTP SGKYIRIGYA DKNEHPYVSI GRYMADKGYL

301  KLGQTSMQGI KAYMRQNPQR LAEVLGQNPS YIFFRELAGS GNEGPVGALG

351  TPLMGEYAGA IDRHYITLGA PLFVATAHPV TRKALNRLIM AQDTGSAIKG

AVRVDYFWGY GDEAGELAGK QKTTGYVWQL LPNGMKPEYR P*
```

The following partial DNA sequence was identified in *N. meningitidis* <SEQ ID 2791>:

```
m919.seq
    1  ATGAAAAAAT ACCTATTCCG CGCCGCCCTG TACGGCATCG CCGCCGCCAT

51  CCTCGCCGCC TGCCAAAGCA AGAGCATCCA AACCTTTCCG CAACCCGACA

101  CATCCGTCAT CAACGGCCCG GACCGGCCGG TCGGCATCCC CGACCCCGCC

151  GGAACGACGG TCGGCGGCGG CGGGGCCGTC TATACCGTTG TACCGCACCT

201  GTCCCTGCCC CACTGGGCGG CGCAGGATTT CGCCAAAAGC CTGCAATCCT

251  TCCGCCTCGG CTGCGCCAAT TTGAAAAACC GCCAAGGCTG GCAGGATGTG

301  TGCGCCCAAG CCTTTCAAAC CCCCGTCCAT TCCTTTCAGG CAAAACAGTT

351  TTTTGAACGC TATTTCACGC CGTGGCAGGT TGCAGGCAAC GGAAGCCTTG

401  CCGGTACGGT TACCGGCTAT TACGAACCGG TGCTGAAGGG CGACGACAGG

451  CGGACGGCAC AAGCCCGCTT CCCGATTTAC GGTATTCCCG ACGATTTTAT

501  CTCCGTCCCC CTGCCTGCCG GTTTGCGGAG CGGAAAAGCC CTTGTCCGCA

551  TCAGGCAGAC GGGAAAAAAC AGCGGCACAA TCGACAATAC CGGCGGCACA

601  CATACCGCCG ACCTCTCCcG ATTCCCCATC ACCGCGCGCA CAACAGCAAT

651  CAAAGGCAGG TTTGAAGGAA GCCGCTTCCT CCCCTACCAC ACGCGCAACC

701  AAATCAACGG CGGCGCGCTT GACGGCAAAG CCCCGATACT CGGTTACGCC

751  GAAGACCCTG TCGAACTTTT TTTTATGCAC ATCCAAGGCT CGGGCCGTCT

801  GAAAACCCCG TCCGGCAAAT ACATCCGCAT CGGCTATGCC GACAAAAACG

851  AACATCCyTA CGTTTCCATC GGACGCTATA TGGCGGATAA GGGCTACCTC

901  AAACTCGGAC AAACCTCCAT GCAGGGCATT AAGTCTTATA TGCGGCAAAA
```

```
                         -continued
  951  TCCGCAACGC CTCGCCGAAG TTTTGGGTCA AAACCCCAGC TATATCTTTT

1001  TCCGCGAGCT TGCCGGAAGC AGCAATGACG GCCCTGTCGG CGCACTGGGC

1051  ACGCCGCTGA TGGGGGAATA TGCCGGCGCA GTCGACCGGC ACTACATTAC

1101  CTTGGGTGCG CCCTTATTTG TCGCCACCGC CCATCCGGTT ACCCGCAAAG

1151  CCCTCAACCG CCTGATTATG GCGCAGGATA CCGGCAGCGC GATTAAAGGC

1201  GCGGTGCGCG TGGATTATTT TTGGGGATAC GGCGACGAAG CCGGCGAACT

1251  TGCCGGCAAA CAGAAAACCA CGGGATATGT CTGGCAGCTC CTACCCAACG

GTATGAAGCC CGAATACCGc CCGTAA
```

This corresponds to the amino acid sequence <SEQ ID 2792; ORF 919>:

```
m919.pep
    1    MKKYLFRAAL YGIAAAILAA CQSKSIQTFP QPDTSVINGP DRPVGIPDPA

51    GTTVGGGGAV YTVVPHLSLP HWAAQDFAKS LQSFRLGCAN LKNRQGWQDV

101    CAQAFQTPVH SFQAKQFFER YFTPWQVAGN GSLAGTVTGY YEPVLKGDDR

151    RTAQARFPIY GIPDDFISVP LPAGLRSGKA LVRIRQTGKN SGTIDNTGGT

201    HTADLSRFPI TARTTAIKGR FEGSRFLPYH TRNQINGGAL DGKAPILGYA

251    EDPVELFFMH IQGSGRLKTP SGKYIRIGYA DKNEHPYVSI GRYMADKGYL

301    KLGQTSMQGI KSYMRQNPQR LAEVLGQNPS YIFFRELAGS SNDGPVGALG

351    TPLMGEYAGA VDRHYITLGA PLFVATAHPV TRKALNRLIM AQDTGSAIKG

401    AVRVDYFWGY GDEAGELAGK QKTTGYVWQL LPNGMKPEYR P*
```

Computer analysis of this amino acid sequence gave the following results:

Homology with a Predicted ORF from *N. gonorrhoeae*
ORF 919 shows 95.9% identity over a 441 aa overlap with
  a predicted ORF (ORF 919.ng) from *N. gonorrhoeae*:

```
                   10         20         30         40         50         60
  m919.pep  MKKYLFRAALYGIAAAILAACQSKSIQTFPQPDTSVINGPDRPVGIPDPAGTTVGGGGAV
            |||:|:|:||||||||||||||:|||||||||||||||||:|||||||||:||||||||
  g919      MKKHLLRSALYGIAAAILAACQSRSIQTFPQPDTSVINGPDRPAGIPDPAGTTVAGGGAV
                   10         20         30         40         50         60

70         80         90        100        110        120
  m919.pep  YTVVPHLSLPHWAAQDFAKSLQSFRLGCANLKNRQGWQDVCAQAFQTPVHSFQAKQFFER
            ||||||||:|||||||||||||||||||||||||||||||||||||||||||||:||||
  g919      YTVVPHLSMPHWAAQDFAKSLQSFRLGCANLKNRQGWQDVCAQAFQTPVHSFQAKRFFER
                   70         80         90        100        110        120

130        140        150        160        170        180
  m919.pep  YFTPWQVAGNGSLAGTVTGYYEPVLKGDDRRTAQARFPIYGIPDDFISVPLPAGLRSGKA
            ||||||||||||||||||||||||||||| |||:||||||||||||||||||||||:||
  g919      YFTPWQVAGNGSLAGTVTGYYEPVLKGDGRRTERARFPIYGIPDDFISVPLPAGLRGGKN
                  130        140        150        160        170        180

190        200        210        220        230        240
  m919.pep  LVRIRQTGKNSGTIDNTGGTHTADLSRFPITARTTAIKGRFEGSRFLPYHTRNQINGGAL
            |||||||||||||||:||||||||||||||||||||||||||||||||||||||||||||
  g919      LVRIRQTGKNSGTIDNAGGTHTADLSRFPITARTTAIKGRFEGSRFLPYHTRNQINGGAL
                  190        200        210        220        230        240

250        260        270        280        290        300
  m919.pep  DGKAPILGYAEDPVELFFMHIQGSGRLKTPSGKYIRIGYADKNEHPYVSIGRYMADKGYL
            ||||||||||||||||||||||||||||||||||||||||||||||||||||||||||||
  g919      DGKAPILGYAEDPVELFFMHIQGSGRLKTPSGKYIRIGYADKNEHPYVSIGRYMADKGYL
                  250        260        270        280        290        300

310        320        330        340        350        360
  m919.pep  KLGQTSMQGIKSYMRQNPQRLAEVLGQNPSYIFFRELAGSSNDGPVGALGTPLMGEYAGA
            ||||||||||:|||||||||||||||||||||||||||||:|:|||||||||||||||||
  g919      KLGQTSMQGIKAYMRQNPQRLAEVLGQNPSYIFFRELAGSGNEGPVGALGTPLMGEYAGA
                  310        320        330        340        350        360
```

-continued

```
              370       380       390       400       410       420
m919.pep  VDRHYITLGAPLFVATAHPVTRKALNRLIMAQDTGSAIKGAVRVDYFWGYGDEAGELAGK
          :|||||||||||||||||||||||||||||||||||||||||||||||||||||||||||
g919      IDRHYITLGAPLFVATAHPVTRKALNRLIMAQDTGSAIKGAVRVDYFWGYGDEAGELAGK
              370       380       390       400       410       420

430       440
m919.pep  QKTTGYVWQLLPNGMKPEYRPX
          ||||||||||||||||||||||
g919      QKTTGYVWQLLPNGMKPEYRPX
              430       440
```

The following partial DNA sequence was identified in *N. meningitidis* <SEQ ID 2793>:

```
a919.seq
     1  ATGAAAAAAT ACCTATTCCG CGCCGCCCTG TGCGGCATCG CCGCCGCCAT
    51  CCTCGCCGCC TGCCAAAGCA AGAGCATCCA AACCTTTCCG CAACCCGACA
   101  CATCCGTCAT CAACGGCCCG GACCGGCCGG TCGGCATCCC CGACCCCGCC
   151  GGAACGACGG TCGGCGGCGG CGGGGCCGTT TATACCGTTG TGCCGCACCT
   201  GTCCCTGCCC CACTGGGCGG CGCAGGATTT CGCCAAAAGC CTGCAATCCT
   251  TCCGCCTCGG CTGCGCCAAT TTGAAAAACC GCCAAGGCTG GCAGGATGTG
   301  TGCGCCCAAG CCTTTCAAAC CCCCGTCCAT TCCGTTCAGG CAAAACAGTT
   351  TTTTGAACGC TATTTCACGC CGTGGCAGGT TGCAGGCAAC GGAAGCCTTG
   401  CCGGTACGGT TACCGGCTAT TACGAGCCGG TGCTGAAGGG CGACGACAGG
   451  CGGACGGCAC AAGCCCGCTT CCCGATTTAC GGTATTCCCG ACGATTTTAT
   501  CTCCGTCCCC CTGCCTGCCG GTTTGCGGAG CGGAAAAGCC CTTGTCCGCA
   551  TCAGGCAGAC GGGAAAAAAC AGCGGCACAA TCGACAATAC CGGCGGCACA
   601  CATACCGCCG ACCTCTCCCA ATTCCCCATC ACTGCGCGCA CAACGGCAAT
   651  CAAAGGCAGG TTTGAAGGAA GCCGCTTCCT CCCCTACCAC ACGCGCAACC
   701  AAATCAACGG CGGCGCGCTT GACGGCAAAG CCCCGATACT CGGTTACGCC
   751  GAAGACCCCG TCGAACTTTT TTTTATGCAC ATCCAAGGCT CGGGCCGTCT
   801  GAAAACCCCG TCCGGCAAAT ACATCCGCAT CGGCTATGCC GACAAAAACG
   851  AACATCCCTA CGTTTCCATC GGACGCTATA TGGCGGACAA AGGCTACCTC
   901  AAGCTCGGGC AGACCTCGAT GCAGGGCATC AAAGCCTATA TGCAGCAAAA
   951  CCCGCAACGC CTCGCCGAAG TTTTGGGGCA AAACCCCAGC TATATCTTTT
  1001  TCCGAGAGCT TACCGGAAGC AGCAATGACG GCCCTGTCGG CGCACTGGGC
  1051  ACGCCGCTGA TGGGCGAGTA CGCCGGCGCA GTCGACCGGC ACTACATTAC
  1101  CTTGGGCGCG CCCTTATTTG TCGCCACCGC CCATCCGGTT ACCCGCAAAG
  1151  CCCTCAACCG CCTGATTATG GCGCAGGATA CCGGCAGCGC GATTAAAGGC
  1201  GCGGTGCGCG TGGATTATTT TTGGGGATAC GGCGACGAAG CCGGCGAACT
  1251  TGCCGGCAAA CAGAAAACCA CGGGATATGT CTGGCAGCTT CTGCCCAACG
  1301  GTATGAAGCC CGAATACCGC CCGTAA
```

This corresponds to the amino acid sequence <SEQ ID 2794; ORF 919.a>:

```
a919.pep
    1   MKKYLFRAAL CGIAAAILAA CQSKSIQTFP QPDTSVINGP DRPVGIPDPA

51   GTTVGGGGAV YTVVPHLSLP HWAAQDFAKS LQSFRLGCAN LKNRQGWQDV

101   CAQAFQTPVH SVQAKQFFER YFTPWQVAGN GSLAGTVTGY YEPVLKGDDR

151   RTAQARFPIY GIPDDFISVP LPAGLRSGKA LVRIRQTGKN SGTIDNTGGT

201   HTADLSQFPI TARTTAIKGR FEGSRFLPYH TRNQINGGAL DGKAPILGYA

251   EDPVELFFMH IQGSGRLKTP SGKYIRIGYA DKNEHPYVSI GRYMADKGYL

301   KLGQTSMQGI KAYMQQNPQR LAEVLGQNPS YIFFRELTGS SNDGPVGALG

351   TPLMGEYAGA VDRHYITLGA PLFVATAHPV TRKALNRLIM AQDTGSAIKG

401   AVRVDYFWGY GDEAGELAGK QKTTGYVWQL LPNGMKPEYR P*
``` m919/a919 98.6% identity in 441 aa overlap

```
                     10         20         30         40         50         60
   m919.pep  MKKYLFRAALYGIAAAILAACQSKSIQTFPQPDTSVINGPDRPVGIPDPAGTTVGGGGAV
             ||||||||||  ||||||||||||||||||||||||||||||||||||||||||||||||
   a919      MKKYLFRAALCGIAAAILAACQSKSIQTFPQPDTSVINGPDRPVGIPDPAGTTVGGGGAV
                     10         20         30         40         50         60

70         80         90        100        110        120
   m919.pep  YTVVPHLSLPHWAAQDFAKSLQSFRLGCANLKNRQGWQDVCAQAFQTPVHSFQAKQFFER
             |||||||||||||||||||||||||||||||||||||||||||||||||||| |||||||
   a919      YTVVPHLSLPHWAAQDFAKSLQSFRLGCANLKNRQGWQDVCAQAFQTPVHSVQAKQFFER
                     70         80         90        100        110        120

130        140        150        160        170        180
   m919.pep  YFTPWQVAGNGSLAGTVTGYYEPVLKGDDRRTAQARFPIYGIPDDFISVPLPAGLRSGKA
             ||||||||||||||||||||||||||||||||||||||||||||||||||||||||||||
   a919      YFTPWQVAGNGSLAGTVTGYYEPVLKGDDRRTAQARFPIYGIPDDFISVPLPAGLRSGKA
                    130        140        150        160        170        180

190        200        210        220        230        240
   m919.pep  LVRIRQTGKNSGTIDNTGGTHTADLSRFPITARTTAIKGRFEGSRFLPYHTRNQINGGAL
             |||||||||||||||||||||||||||:||||||||||||||||||||||||||||||||
   a919      LVRIRQTGKNSGTIDNTGGTHTADLSQFPITARTTAIKGRFEGSRFLPYHTRNQINGGAL
                    190        200        210        220        230        240

250        260        270        280        290        300
   m919.pep  DGKAPILGYAEDPVELFFMHIQGSGRLKTPSGKYIRIGYADKNEHPYVSIGRYMADKGYL
             ||||||||||||||||||||||||||||||||||||||||||||||||||||||||||||
   a919      DGKAPILGYAEDPVELFFMHIQGSGRLKTPSGKYIRIGYADKNEHPYVSIGRYMADKGYL
                    250        260        270        280        290        300

310        320        330        340        350        360
   m919.pep  KLGQTSMQGIKSYMRQNPQRLAEVLGQNPSYIFFRELAGSSNDGPVGALGTPLMGEYAGA
             ||||||||||:||:||||||||||||||||||||||||:|||||||||||||||||||||
   a919      KLGQTSMQGIKAYMQQNPQRLAEVLGQNPSYIFFRELTGSSNDGPVGALGTPLMGEYAGA
                    310        320        330        340        350        360

370        380        390        400        410        420
   m919.pep  VDRHYITLGAPLFVATAHPVTRKALNRLIMAQDTGSAIKGAVRVDYFWGYGDEAGELAGK
             ||||||||||||||||||||||||||||||||||||||||||||||||||||||||||||
   a919      VDRHYITLGAPLFVATAHPVTRKALNRLIMAQDTGSAIKGAVRVDYFWGYGDEAGELAGK
                    370        380        390        400        410        420

430        440
   m919.pep  QKTTGYVWQLLPNGMKPEYRPX
             ||||||||||||||||||||||
   a919      QKTTGYVWQLLPNGMKPEYRPX
                    430        440
```

Expression of ORF 919

The primer described in Example 1 for ORF 919 was used to locate and clone ORF 919. This sequence was purified and expressed in *E. coli* as provided in FIG. 1 #. The hydrophilicity plots, antigenic index, and amphipatic regions of ORF 919 is provided in FIG. 5 #. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 919 is provided in Exhibit C #.

The following partial DNA sequence was identified in *N. gonorrhoeae* <SEQ ID 2795>:

```
g920.seq (partial)
    1    ..ccgatgcagc tggttaccga aaaAGGTAAG GAAAACATGA TTCAACGCGG
   51    CACATACAAC TACCAATACC GCAGCAACCG TCCGGTCAAA GACGGCAGCT
  101    ACCTCGTTAC CGCCGAATAT CAGCCTACTT TCCGGTCAAA AAACAAAGCA
  151    GGCTGGAAAC AGGCTGGCAT CAAAGAAATG CCTGACGCAA GCTATTGCGA
  201    ACAAACCCGT ATGTTCGGTA AAACATTGT CAACGTGGGA CACGAAAGCG
  251    CGGACACCGC CATCATCACC AAACCGGTCG GACAAAACTT GGAAATCGTC
  301    CCGCTGGACA ATCccgccga caTTCACgtg ggctaacgCt tcaaaGTccg
  351    cgttCtgttc cgtGGCgaac cgCTGcccaa tgccACCgtt accgCtacAT
  401    TTGacggctt cGAcaccagc gaccgcagca aaacgcacaa Aaccgaagcc
  451    caagcctTCT ccgacaccac cgacggcgaa ggcgaagtgg acatcatCCC
  501    CTTGCgccaa GGCTTttgga aAgcGAGTGT CGAATAcaaa gccgAtttcc
  551    CCGATcaaAG CCTGTGccga AAACAggcgA ACTACaCaac TTtaaccttc
  601    caaatcgccc attctCacca tTAa
```

This corresponds to the amino acid sequence <SEQ ID 2796; ORF 920.ng>:

```
g920.pep (partial)
    1    ..PMQLVTEKGK ENMIQRGTYN YQYRSNRPVK DGSYLVTAEY QPTFRSKNKA
   51    GWKQAGIKEM PDASYCEQTR MFGKNIVNVG HESADTAIIT KPVGQNLEIV
  101    PLDNPADIHV GXRFKVRVLF RGEPLPNATV TATFDGFDTS DRSKTHKTEA
  151    QAFSDTTDGE GEVDIIPLRQ GFWKASVEYK ADFPDQSLCR KQANYTTLTF
  201    QIAHSHH*
```

The following partial DNA sequence was identified in N. meningitidis <SEQ ID 2797>:

```
m920.seq
    1    ATGAAGAAAA CATTGACACT GCTCTCCGTT TCCGCCCTAT TGCCACATC
   51    CGCCCACGCC CACCGmGTCT GGGTCGAAAC CGCCCACACG CACGGCGGCG
  101    AATACCTTAA AGCCGACTTG GGCTACGGCG AATTTCCCGA ACTCGAACCC
  151    ATCGCCAAAG ACCGCCTGCA CATCTTCAGC AAACCGATGC AGCTGGTTAC
  201    CGAAAAAGGC AAGGAAAACA TGATTCAACG CGGCACATAC AACTACCAGT
  251    ACCGAAGCAA CCGTCCCGTT AAGGACGGCA GTTACCTCGT CATCGCCGAA
  301    TATCAGCCTA CTTTCTGGTC AAAAwACAAA GCAGGCTGGA AACAGGCGGG
  351    CATCAAAGAA ATGCCTGACG CAAGCTATTG CGAACAAACC CGAATGTTCG
  401    GCAAAAACAT CGTCAACGTC GGACACGAAA GCGCGGACAC CGCCATCATC
  451    ACCAArCCGG TCGGACAAAA CTTGGAAATC GTCCCGCTGG ACAATCCCGC
  501    CAACATTCAC GTAGGCGAAC GCTTCAAAGT CCGCGTTCTG TTCCGTGGCG
  551    AACCGCTGCC CAATGCCACC GTTACCGCCA CCTTTGACGG CTTCGACACC
  601    AGCGACCGCA GCAAAACGCA CAAwmCCGAA GCACAGGCTT TCTCCGACAG
  651    CACAGACGAC AAAGGCGAAG TGGACATCAT CmCCTTGCGC CAAGGCTTCT
  701    GGAAAGCCAA TGTCGAACAC AAAACCGACT TCCCCGATCA AAGCGTGTGC
```

-continued

```
751  CAAAAACAGG CGAACTACTC GACTTTAACC TTCCAAATCG GTCATTCGCA

801  CCATTAA
```

This corresponds to the amino acid sequence <SEQ ID 2798; ORF 920>:

```
m920.pep
   1  MKKTLTLLSV SALFATSAHA HRVWVETAHT HGGEYLKADL GYGEFPELEP

51  IAKDRLHIFS KPMQLVTEKG KENMIQRGTY NYQYRSNRPV KDGSYLVIAE

101  YQPTFWSKXK AGWKQAGIKE MPDASYCEQT RMFGKNIVNV GHESADTAII

151  TKPVGQNLEI VPLDNPANIH VGERFKVRVL FRGEPLPNAT VTATFDGFDT

201  SDRSKTHXXE AQAFSDSTDD KGEVDIIXLR QGFWKANVEH KTDFPDQSVC

251  QKQANYSTLT FQIGHSHH*
                                                            20
```

Computer analysis of this amino acid sequence gave the following results:
Homology with a Predicted ORF from *N. gonorrhoeae*
ORF 920 shows 91.3% identity over a 207 aa overlap with a predicted ORF (ORF 920.ng) from *N. gonorrhoeae*:

```
    g920/m920
                                              10        20        30
         g920.pep                     PMQLVTEKGKENMIQRGTYNYQYRSNRPVK
                                      ||||||||||||||||||||||||||||||
             m920  GGEYLKADLGYGEFPELEPIAKDRLHIFSKPMQLVTEKGKENMIQRGTYNYQYRSNRPVK
                         40        50        60        70        80        90

40        50        60        70        80        90
         g920.pep  DGSYLVTAEYQPTFRSKNKAGWKQAGIKEMPDASYCEQTRMFGKNIVNVGHESADTAIIT
                   ||||||  |||||||  || ||||||||||||||||||||||||||||||||||||||||
             m920  DGSYLVIAEYQPTFWSKXKAGWKQAGIKEMPDASYCEQTRMFGKNIVNVGHESADTAIIT
                        100       110       120       130       140       150

100       110       120       130       140       150
         g920.pep  KPVGQNLEIVPLDNPADIHVGXRFKVRVLFRGEPLPNATVTATFDGFDTSDRSKTHKTEA
                   ||||||||||||||||||:|||| ||||||||||||||||||||||||||||||||:||
             m920  KPVGQNLEIVPLDNPANIHVGERFKVRVLFRGEPLPNATVTATFDGFDTSDRSKTHXXEA
                        160       170       180       190       200       210

160       170       180       190       200
         g920.pep  QAFSDTTDGEGEVDIIPLRQGFWKASVEYKADFPDQSLCRKQANYTTLTFQIAHSHHX
                   ||||||:||  :|||||||  |||||||::||:|:||||||:|||||:||||||:||||
             m920  QAFSDSTDDKGEVDIIXLRQGFWKANVEHKTDFPDQSVCQKQANYSTLTFQIGHSHHX
                        220       230       240       250       260
```

The following partial DNA sequence was identified in *N. meningitidis* <SEQ ID 2799>:

```
a920.seq
   1  TGAAAGAAAA CATTGACACT GCTCGCCGTT TCCGCCCTAT TGCCGCATC

51  CGCCCACGCC CACCGCGTCT GGGTCGAAAC CGCCCACACG CACGGCGGCG

101  AATACCTTAA AGCCGACTTG GGCTACGGCG AATTTCCCGA ACTCGAACCC

151  ATCGCCAAAG ACCGCCTGCA CATCTTCAGC AAACCGATGC AGCTGGTTAC

201  CGAAAAGGC AAGGAAAACA TGATTCAACG CGGCACATAC AACTACCAGT

251  ACCGAAGCAA CCGTCCCGTT AAGGACGGCA GTTACCTCGT CATCGCCGAA

301  TATCAGCCTA CTTTCTGGTC AAAAAACAAA GCAGGCTGGA AACAGGCGGG

351  CATCAAACAA ATGCCTGACG CAAGCTATTG CGAACAAACC CGAATGTTCG

401  GCAAAAACAT CGTCAACGTC GGACACGAAA GCGCGGACAC CGCCATCATC

451  ACCAAACCGG TCGGACAAAA CTTGGAAATC GTCCCGCTGG ACAATCCCGC
```

-continued

```
501  CAACATTCAC GTAGGCGAAC GCTTCAAAGT CCGCGTTCTG TTCCGTGGCG

551  AACCGCTGCC CAATGCCACC GTTACCGCCA CCTTTGACGG CTTCGACACC

601  AGCGACCGCA GCAAAACGCA CAAAACCGAA GCACAGGCTT CTCCGACAG

651  CACAGACGAC AAAGGCGAAG TGGACATCAT CCCCTTGCGC CAAGGCTTCT

701  GGAAAGCCAA TGTCGAACAC AAAGCCGACT TCCCCGATCA AGCGTGTGC

751  CAAAAACAGG CGAACTACTC GACTTTAACC TTCCAAATCG GCCATTCGCA

801  CCATTAA
```

This corresponds to the amino acid sequence <SEQ ID 2800; ORF 920.a>:

```
a920.pep
    1  *KKTLTLLAV SALFAASAHA HRVWVETAHT HGGEYLKADL GYGEFPELEP

51  IAKDRLHIFS KPMQLVTEKG KENMIQRGTY NYQYRSNRPV KDGSYLVIAE

101  YQPTFWSKNK AGWKQAGIKQ MPDASYCEQT RMFGKNIVNV GHESADTAII

151  TKPVGQNLEI VPLDNPANIH VGERFKVRVL FRGEPLPNAT VTATFDGFDT

201  SDRSKTHKTE AQAFSDSTDD KGEVDIIPLR QGFWKANVEH KADFPDQSVC

251  QKQANYSTLT FQIGHSHH*
``` m920/a920 97.0% identity in 267 aa overlap

```
                 10         20         30         40         50         60
   m920.pep  MKKTLTLLSVSALFATSAHAHRVWVETAHTHGGEYLKADLGYGEFPELEPIAKDRLHIFS
             ||||||:||||||:|||||||||||||||||||||||||||||||||||||||||||||
   a920      XKKTLTLLAVSALFAASAHAHRVWVETAHTHGGEYLKADLGYGEFPELEPIAKDRLHIFS
                 10         20         30         40         50         60

70         80         90        100        110        120
   m920.pep  KPMQLVTEKGKENMIQRGTYNYQYRSNRPVKDGSYLVIAEYQPTFWSKXKAGWKQAGIKE
             ||||||||||||||||||||||||||||||||||||||||||||||||| |||||||||:
   a920      KPMQLVTEKGKENMIQRGTYNYQYRSNRPVKDGSYLVIAEYQPTFWSKNKAGWKQAGIKQ
                 70         80         90        100        110        120

130        140        150        160        170        180
   m920.pep  MPDASYCEQTRMFGKNIVNVGHESADTAIITKPVGQNLEIVPLDNPANIHVGERFKVRVL
             ||||||||||||||||||||||||||||||||||||||||||||||||||||||||||||
   a920      MPDASYCEQTRMFGKNIVNVGHESADTAIITKPVGQNLEIVPLDNPANIHVGERFKVRVL
                130        140        150        160        170        180

190        200        210        220        230        240
   m920.pep  FRGEPLPNATVTATFDGFDTSDRSKTHXXEAQAFSDSTDDKGEVDIIXLRQGFWKANVEH
             |||||||||||||||||||||||||||:||||||||||||||||||| |||||||||||
   a920      FRGEPLPNATVTATFDGFDTSDRSKTHKTEAQAFSDSTDDKGEVDIIPLRQGFWKANVEH
                190        200        210        220        230        240

250        260       269
   m920.pep  KTDFPDQSVCQKQANYSTLTFQIGHSHHX
             |:|||||||||||||||||||||||||||
   a920      KADFPDQSVCQKQANYSTLTFQIGHSHHX
                250        260
```

The following partial DNA sequence was identified in *N. gonorrhoeae* <SEQ ID 2801>:

```
g920-1.seq
    1  ATGAAGAAAA CATTGACACT GCTCGCcgtt TcCGCACTAT TTGCCACATC 51  cgCaCACCCC CACCgCGTCT GGGTCGAAAC CgccCACACg cAcgGCGGCG

101  AATACCTTAA AGCCGACTTG GGCTACGGCG AATTCCCCGA ACTCGAACCC

151  ATCGccAAAG ACCgccTGCA CATCTTCAGC AAACCGATGC AGCTGGTTAC

201  CGAAAAAGGT AAGGAAAACA TGATTCAACG CGGCACATAC AACTACCAAT
```

-continued

```
251    ACCGCAGCAA CCGTCCCGTC AAAGACGGCA GCTACCTCGT TACCGCCGAA

301    TATCAGCCTA CTTTCCGGTC AAAAAACAAA GCAGGCTGGA AACAGGCTGG

351    CATCAAAGAA ATGCCTGACG CAAGCTATTG CGAACAAACC CGTATGTTCG

401    GTAAAAACAT TGTCAACGTG GGACACGAAA GCGCGGACAC CGCCATCATC

451    ACCAAACCGG TCGGACAAAA CTTGGAAATC GTCCCGCTGG ACAATCCCGC

501    CAACATTCAC GTAGGCGAAC GCTTCAAAGT CCGCGTTCTG TTCCGTGGCG

551    AACCGCTGCC CAATGCCACC GTTACCGCTA CATTTGACGG CTTCGACACC

601    AGCGACCGCA GCAAAACGCA CAAAACCGAA GCCCAAGCCT TCTCCGACAC

651    CACCGACGGC AAAGGCGAAG TGGACATCAT CCCCTTGCGC CAAGGCTTTT

701    GGAAAGCGAG TGTCGAATAC AAAGCCGATT TCCCCGATCA AAGCCTGTGC

751    CAAAAACAGG CGAACTACAC AACTTTAACC TTCCAAATCG GCCATTCTCA

801    CCATTAA
```

This corresponds to the amino acid sequence <SEQ ID 2802; ORF 920-1.ng>:

```
g920-1.pep
    1    MKKTLTLLAV SALFATSAHP HRVWVETAHT HGGEYLKADL GYGEFPELEP

51    IAKDRLHIFS KPMQLVTEKG KENMIQRGTY NYQYRSNRPV KDGSYLVTAE

101    YQPTFRSKNK AGWKQAGIKE MPDASYCEQT RMFGKNIVNV GHESADTAII

151    TKPVGQNLEI VPLDNPANIH VGERFKVRVL FRGEPLPNAT VTATFDGFDT

201    SDRSKTHKTE AQAFSDTTDG KGEVDIIPLR QGFWKASVEY KADFPDQSLC

251    QKQANYTTLT FQIGHSHH*
```

The following partial DNA sequence was identified in *N. meningitidis* <SEQ ID 2803>:

```
m920-1.seq
    1    ATGAAGAAAA CATTGACACT GCTCGCCGTT TCCGCCCTAT TTGCCACATC

51    CGCCCACGCC CACCGCGTCT GGGTCGAAAC CGCCCACACG CACGGCGGCG

101    AATACCTTAA AGCCGACTTG GGCTACGGCG AATTTCCCGA ACTCGAACCC

151    ATCGCCAAAG ACCGCCTGCA CATCTTCAGC AAACCGATGC AGCTGGTTAC

201    CGAAAAAGGC AAGGAAAACA TGATTCAACG CGGCACATAC AACTACCAGT

251    ACCGAAGCAA CCGTCCCGTT AAGGACGGCA GTTACCTCGT CATCGCCGAA

301    TATCAGCCTA CTTTCTGGTC AAAAAACAAA GCAGGCTGGA AACAGGCGGG

351    CATCAAAGAA ATGCCTGACG CAAGCTATTG CGAACAAACC CGAATGTTCG

401    GCAAAAACAT CGTCAACGTC GGACACGAAA GCGCGGACAC CGCCATCATC

451    ACCAAACCGG TCGGACAAAA CTTGGAAATC GTCCCGCTGG ACAATCCCGC

501    CAACATTCAC GTAGGCGAAC GCTTCAAAGT CCGCGTTCTG TTCCGTGGCG

551    AACCGCTGCC CAATGCCACC GTTACCGCCA CCTTTGACGG CTTCGACACC

601    AGCGACCGCA GCAAAACGCA CAAAACCGAA GCACAGGCTT TCTCCGACAG

651    CACAGACGAC AAAGGCGAAG TGGACATCAT CCCCTTGCGC CAAGGCTTCT

701    GGAAAGCCAA TGTCGAACAC AAAACCGACT TCCCCGATCA AAGCGTGTGC
```

```
751  CAAAAACAGG CGAACTACTC GACTTTAACC TTCCAAATCG GTCATTCGCA

801  CCATTAA
```

This corresponds to the amino acid sequence <SEQ ID 2804; ORF 920-1>:

```
m920-1.pep
    1   MKKTLTLLAV SALFATSAHA HRVWVETAHT HGGEYLKADL GYGEFPELEP

51   IAKDRLHIFS KPMQLVTEKG KENMIQRGTY NYQYRSNRPV KDGSYLVIAE

101   YQPTFWSKNK AGWKQAGIKE MPDASYCEQT RMFGKNIVNV GHESADTAII

151   TKPVGQNLEI VPLDNPANIH VGERFKVRVL FRGEPLPNAT VTATFDGFDT

201   SDRSKTHKTE AQAFSDSTDD KGEVDIIPLR QGFWKANVEH KTDFPDQSVC

251   QKQANYSTLT FQIGHSHH*
``` m920-1/g920-1 96.3% identity in 268 aa overlap

```
                    10         20         30         40         50         60
m920-1.pep  MKKTLTLLAVSALFATSAHAHRVWVETAHTHGGEYLKADLGYGEFPELEPIAKDRLHIFS
            |||||||||||||||||||| ||||||||||||||||||||||||||||||||||||||
g920-1      MKKTLTLLAVSALFATSAHPHRVWVETAHTHGGEYLKADLGYGEFPELEPIAKDRLHIFS
                    10         20         30         40         50         60

70         80         90        100        110        120
m920-1.pep  KPMQLVTEKGKENMIQRGTYNYQYRSNRPVKDGSYLVIAEYQPTFWSKNKAGWKQAGIKE
            |||||||||||||||||||||||||||||||||||||| |||||| ||||||||||||||
g920-1      KPMQLVTEKGKENMIQRGTYNYQYRSNRPVKDGSYLVTAEYQPTFRSKNKAGWKQAGIKE
                    70         80         90        100        110        120

130        140        150        160        170        180
m920-1.pep  MPDASYCEQTRMFGKNIVNVGHESADTAIITKPVGQNLEIVPLDNPANIHVGERFKVRVL
            ||||||||||||||||||||||||||||||||||||||||||||||||||||||||||||
g920-1      MPDASYCEQTRMFGKNIVNVGHESADTAIITKPVGQNLEIVPLDNPANIHVGERFKVRVL
                   130        140        150        160        170        180

190        200        210        220        230        240
m920-1.pep  FRGEPLPNATVTATFDGFDTSDRSKTHKTEAQAFSDSTDDKGEVDIIPLRQGFWKANVEH
            ||||||||||||||||||||||||||||||||||||:|| ||||||||||||||||:||:
g920-1      FRGEPLPNATVTATFDGFDTSDRSKTHKTEAQAFSDTTDGKGEVDIIPLRQGFWKASVEY
                   190        200        210        220        230        240

250        260    269
m920-1.pep  KTDFPDQSVCQKQANYSTLTFQIGHSHHX
            |:||||||:|||||||:|||||||||||
g920-1      KADFPDQSLCQKQANYTTLTFQIGHSHHX
                   250        260
```

The following partial DNA sequence was identified in *N. meningitidis* <SEQ ID 2805>:

```
a920.seq
    1   TGAAAGAAAA CATTGACACT GCTCGCCGTT TCCGCCCTAT TTGCCGCATC

51   CGCCCACGCC CACCGCGTCT GGGTCGAAAC CGCCCACACG CACGGCGGCG

101   AATACCTTAA AGCCGACTTG GGCTACGGCG AATTTCCCGA ACTCGAACCC

151   ATCGCCAAAG ACCGCCTGCA CATCTTCAGC AAACCGATGC AGCTGGTTAC

201   CGAAAAGGGC AAGGAAAACA TGATTCAACG CGGCACATAC AACTACCAGT

251   ACCGAAGCAA CCGTCCCGTT AAGGACGGCA GTTACCTCGT CATCGCCGAA

301   TATCAGCCTA CTTTCTGGTC AAAAAACAAA GCAGGCTGGA AACAGGCGGG

351   CATCAAACAA ATGCCTGACG CAAGCTATTG CGAACAAACC CGAATGTTCG

401   GCAAAAACAT CGTCAACGTC GGACACGAAA GCGCGGACAC CGCCATCATC

451   ACCAAACCGG TCGGACAAAA CTTGGAAATC GTCCCGCTGG ACAATCCCGC
```

-continued

```
501   CAACATTCAC GTAGGCGAAC GCTTCAAAGT CCGCGTTCTG TTCCGTGGCG

551   AACCGCTGCC CAATGCCACC GTTACCGCCA CCTTTGACGG CTTCGACACC

601   AGCGACCGCA GCAAAACGCA CAAAACCGAA GCACAGGCTT TCTCCGACAG

651   CACAGACGAC AAAGGCGAAG TGGACATCAT CCCCTTGCGC CAAGGCTTCT

701   GGAAAGCCAA TGTCGAACAC AAAGCCGACT TCCCCGATCA AAGCGTGTGC

751   CAAAAACAGG CGAACTACTC GACTTTAACC TTCCAAATCG GCCATTCGCA

801   CCATTAA
```

This corresponds to the amino acid sequence <SEQ ID 2806; ORF 920-1.a>:

```
a920.pep
    1   *KKTLTLLAV SALFAASAHA HRVWVETAHT HGGEYLKADL GYGEFPELEP

51   IAKDRLHIFS KPMQLVTEKG KENMIQRGTY NYQYRSNRPV KDGSYLVIAE

101   YQPTFWSKNK AGWKQAGIKQ MPDASYCEQT RMFGKNIVNV GHESADTAII

151   TKPVGQNLEI VPLDNPANIH VGERFKVRVL FRGEPLPNAT VTATFDGFDT

201   SDRSKTHKTE AQAFSDSTDD KGEVDIIPLR QGFWKANVEH KADFPDQSVC

251   QKQANYSTLT FQIGHSHH*
``` m920-1/a920 98.9% identity in 267 aa overlap

```
                    10         20         30         40         50         60
m920-1.pep  MKKTLTLLSVSALFATSAHAHRVWVETAHTHGGEYLKADLGYGEFPELEPIAKDRLHIFS
            ||||||||||:|||||:||||||||||||||||||||||||||||||||||||||||||
a920        XKKTLTLLSVSALFAASAHAHRVWVETAHTHGGEYLKADLGYGEFPELEPIAKDRLHIFS
                    10         20         30         40         50         60

70         80         90        100        110        120
m920-1.pep  KPMQLVTEKGKENMIQRGTYNYQYRSNRPVKDGSYLVIAEYQPTFWSKNKAGWKQAGIKE
            ||||||||||||||||||||||||||||||||||||||||||||||||||||||||||:
a920        KPMQLVTEKGKENMIQRGTYNYQYRSNRPVKDGSYLVIAEYQPTFWSKNKAGWKQAGIKQ
                    70         80         90        100        110        120

130        140        150        160        170        180
m920-1.pep  MPDASYCEQTRMFGKNIVNVGHESADTAIITKPVGQNLEIVPLDNPANIHVGERFKVRVL
            ||||||||||||||||||||||||||||||||||||||||||||||||||||||||||||
a920        MPDASYCEQTRMFGKNIVNVGHESADTAIITKPVGQNLEIVPLDNPANIHVGERFKVRVL
                   130        140        150        160        170        180

190        200        210        220        230        240
m920-1.pep  FRGEPLPNATVTATFDGFDTSDRSKTHKTEAQAFSDSTDDKGEVDIIPLRQGFWKANVEH
            ||||||||||||||||||||||||||||||||||||||||||||||||||||||||||||
a920        FRGEPLPNATVTATFDGFDTSDRSKTHKTEAQAFSDSTDDKGEVDIIPLRQGFWKANVEH
                   190        200        210        220        230        240

250        260    269
m920-1.pep  KTDFPDQSVCQKQANYSTLTFQIGHSHHX
            |:|||||||||||||||||||||||||||
a920        KADFPDQSVCQKQANYSTLTFQIGHSHHX
                   250        260
```

The following partial DNA sequence was identified in *N. gonorrhoeae* <SEQ ID 2807>:

```
g921.seq
    1   ATGAAAAAAT ACCTTATCCC TCTTTCCATT GCGGCAGTCC TTTCCGggtG

51   Ccagtctatt tatGtgccca cattgacggA aatccccgTg aatcccatca 101   ataCCgtcaa aacggaagCA CCTGCAAAAG GTTTTCGCCT CGCCCCTTCG

151   CATTGGGCGG ATGTTGCCAA AATCAGCGAT GAAGCGACGC GCTTGGGCTA

201   TCAGGTGGGT ATCGGTAAAA TGACCAAGGT TCAGGcgGCG CAATATCTGA
```

```
251    ACAACTTCAG AAAACGCCTG GTCGGACGCA ATGCCGTCGA TGACAGTATG

301    TATGAAATCT ACCTGCGTTC GGCGGTAGAC AGCCAGCGCG GCGAAATCAA

351    TACGGAACAG TCCAAGCTGT ATATCGAGAA TGCCTTGCGC GGCTGGCAGC

401    AGCGTtggAA AAATATGGAT GCCAAACCCG ATAATCCCGC ATTTACCAAC

451    TTTTTGATGG AAGTGATGAA GATGCAGCCC TTGAAATGA
```

This corresponds to the amino acid sequence <SEQ ID 2808; ORF 921.ng>:

```
g921.pep
    1    MKKYLIPLSI AAVLSGCQSI YVPTLTEIPV NPINTVKTEA PAKGFRLAPS

51    HWADVAKISD EATRLGYQVG IGKMTKVQAA QYLNNFRKRL VGRNAVDDSM

101    YEIYLRSAVD SQRGEINTEQ SKLYIENALR GWQQRWKNMD AKPDNPAFTN

151    FLMEVMKMQP LK*
```

The following partial DNA sequence was identified in *N. meningitidis* <SEQ ID 2805>:

```
m921.seq
    1    ATGAAAAAAT ACCTTATCCC TCTTTCCATT GCGGCAGTTC TTTCCGGCTG

51    CCAGTCTATT TATGTGCCCA CATTGACGGA AATCCCCGTG AATCCTATCA

101    ATACCGTCAA AACGGAAGCA CCTGCAAAAG GTTTCCGCCT TGCCTCTTCG

151    CATTGGACGG ATGTTGCCAA AATCAGCGAT GAAGCGACGC GCTTGGGCTA

201    TCAGGTGGGT ATCGGTAAAA TGACCAAGGT TCAGGCGGCG CAATATCTGA

251    ACAACTTCAG AAAACGCCTG GTCGGACGCA ATGCCGTCGA TGACAGTATG

301    TATGAAATCT ACCTGCGTTC GGCGATAGAC AGCCAGCGGG GCGCAATCAA

351    TACGGAACAG TCCAAGCTGT ATATCCAGAA TGCCTTGCGC GGCTGGCAGC

401    AGCGTTGGAA AAATATGGAT GTCAAACCCA ACAACCCCGC ATTTACCAAC

451    TTTTTGATGG AAGTGATGAA GATGCAGCCC TTGAAATGA
```

This corresponds to the amino acid sequence <SEQ ID 2810; ORF 921>:

```
m921.pep
    1    MKKYLIPLSI AAVLSGCQSI YVPTLTEIPV NPINTVKTEA PAKGFRLASS

51    HWTDVAKISD EATRLGYQVG IGKMTKVQAA QYLNNFRKRL VGRNAVDDSM

101    YEIYLRSAID SQRGAINTEQ SKLYIQNALR GWQQRWKNMD VKPNNPAFTN

151    FLMEVMKMQP LK*
```

Computer analysis of this amino acid sequence gave the following results:

Homology with a Predicted ORF from *N. gonorrhoeae*
ORF 921 shows 95.7% identity over a 162 aa overlap with a predicted ORF (ORF 921.ng) from *N. gonorrhoeae*:

```
m921/g921
                 10         20         30         40         50         60
    m921.pep    MKKYLIPLSIAAVLSGCQSIYVPTLTEIPVNPINTVKTEAPAKGFRLASSHWTDVAKISD
                ||||||||||||||||||||||||||||||||||||||||||||||||||| :|||||||
       g921    MKKYLIPLSIAAVLSGCQSIYVPTLTEIPVNPINTVKTEAPAKGFRLAPSHWADVAKISD
                 10         20         30         40         50         60
```

-continued

```
                70        80        90       100       110       120
m921.pep  EATRLGYQVGIGKMTKVQAAQYLNNFRKRLVGRNAVDDSMYEIYLRSAIDSQRGAINTEQ
          |||||||||||||||||||||||||||||||||||||||||||||||:||||| |||||
g921      EATRLGYQVGIGKMTKVQAAQYLNNFRKRLVGRNAVDDSMYEIYLRSAVDSQRGEINTEQ
                70        80        90       100       110       120

130       140       150       160
m921.pep  SKLYIQNALRGWQQRWKNMDVKPNNPAFTNFLMEVMKMQPLKX
          |||||:||||||||||||||:||:|||||||||||||||||||
g921      SKLYIENALRGWQQRWKNMDAKPDNPAFTNFLMEVMKMQPLKX
               130       140       150       160
```

The following partial DNA sequence was identified in *N. meningitidis* <SEQ ID 2811>:

```
a921.seq
     1  ATGAAAAAAT ACCTTATCCC TCTTTCCATT GTGGCAGTTC TTTCCGGCTG

51  CCAGTCTATT TATGTGCCCA CATTGACGGA AATCCCCGTG AATCCTATCA

101  ATACCGTCAA AACGGAAGCA CCTGCAAAAG GTTTCCGCCT TGCCTCTTCG

151  CATTGGACGG ATGTTGCCAA AATCAGCGAT GAAGCGACGC GCTTGGGCTA

201  TCAGGTGGGT ATCGGTAAAA TGACCAAGGT TCAGGCGGCG CAATATCTGA

251  ACAACTTCAG AAAACGCCTG GTCGGACGCA ATGCCGTCGA TGACAGTATG

301  TATGAAATCT ACCTGCGTTC GGCGATAGAC AGCCAGCGGG GCGCAATCAA

351  TACGGAACAG TCCAAGCTGT ATATCCAGAA TGCCTTGCGC GGCTGGCAGC

401  AGCGTTGGAA AAATATGGAT GTCAAACCCA ACAACCCCGC ATTTACCAAC

451  TTTTTGATGG AAGTGATGAA GATGCAGCCC TTGAAATGA
```

This corresponds to the amino acid sequence <SEQ ID 2812; ORF 921.a>:

```
a921.pep
     1  MKKYLIPLSI VAVLSGCQSI YVPTLTEIPV NPINTVKTEA PAKGFRLASS

51  HWTDVAKISD EATRLGYQVG IGKMTKVQAA QYLNNFRKRL VGRNAVDDSM

101  YEIYLRSAID SQRGAINTEQ SKLYIQNALR GWQQRWKNMD VKPNNPAFTN

151  FLMEVMKMQP LK*
``` m921/a921 99.4% identity in 162 aa overlap

```
                10        20        30        40        50        60
m921.pep  MKKYLIPLSIAAVLSGCQSIYVPTLTEIPVNPINTVKTEAPAKGFRLASSHWTDVAKISD
          ||||||||||:|||||||||||||||||||||||||||||||||||||||||||||||||
a921      MKKYLIPLSIVAVLSGCQSIYVPTLTEIPVNPINTVKTEAPAKGFRLASSHWTDVAKISD
                10        20        30        40        50        60

70        80        90       100       110       120
m921.pep  EATRLGYQVGIGKMTKVQAAQYLNNFRKRLVGRNAVDDSMYEIYLRSAIDSQRGAINTEQ
          ||||||||||||||||||||||||||||||||||||||||||||||||||||||||||||
a921      EATRLGYQVGIGKMTKVQAAQYLNNFRKRLVGRNAVDDSMYEIYLRSAIDSQRGAINTEQ
                70        80        90       100       110       120

130       140       150       160
m921.pep  SKLYIQNALRGWQQRWKNMDVKPNNPAFTNFLMEVMKMQPLKX
          |||||||||||||||||||||||||||||||||||||||||||
a921      SKLYIQNALRGWQQRWKNMDVKPNNPAFTNFLMEVMKMQPLKX
               130       140       150       160
```

The following partial DNA sequence was identified in *N. gonorrhoeae* <SEQ ID 2813>:

```
g922.seq
     1  ATGGAAAAGA GAAAAATACT GCCGCTGGCA ATTTGTTTGG CGGCTTTGTC
    51  TGCCTGTACG GCGATGGAGG CCCGCACACC CCGGGCAAAT GAAGCCCAAG
   101  CCCCCCGCGC GGATGAAATG AAAAAGAAA GCCGCCCCGC GTTTGACGCG
   151  GCAGCCGTAC CGGTATCCGA CAGCGGGTTT GCCGCCAATG CAAATGTCCG
   201  CCGTTTTGTG GACGATGAAG TCGGGAAAGG GGATTTTTCC CAGGCGGAAT
   251  GGCAGGATTT TTTTGACAAA GCGGCTTACA AGGCGGACAT CGTCAAGATt
   301  ATGCACCGAC CCTCCACATC GCGtCCGTGG TATGtgttcc gCacggGAAa
   351  ttcGGgcagg gcgaaAtttc ACggcgCGCG Caggttttat GcggaaAacc
   401  gcgcggttat cgatgatgtg gcgCAAAAat acggcgtGCC TGCCGAGCTT
   451  ATCGTGGCGA TTATCGGGAT TGAAACGAAT TACGGCAAAA ATACGGGCAG
   501  TTTCCGTGTG GCGGACGCAT TGGCGACTTT AGGCTTTGAT TATCCCCGCC
   551  GCGCCGGGTT TTTCCAAAAA GAATTGGTCG AGCTTTTAAA GCTGGCAAAA
   601  GAAGAAGGCG GTGATGTTTT CGCCTTTAAG GGCagcTATG CGGGTGCAAT
   651  GGGTATGCCG CAATTTATGC CTTCGAGCTA CCGGAAATGG GCGGTGGATT
   701  ATGAcgggga cggacatCGG GATATAtggg GCAACGTcgg tgatgtcgcg
   751  gcatcggTTG CCAATTAtat gaagCAGCAC GGTTGGCGCA CgggcggtAA
   801  AATGTTGGTG TCGGCGAcgt tggcgccggg tgcggATGTT CAggcAATCA
   851  TTGGCGAAAA AACCGCCCTG ACGCGGACGG TGGCGGATTT GAaggCGTAc
   901  ggcatcatcc ccggggaaaC GCTCGCAGAT GATGAAAAGg cgGTTTTGTT
   951  CAAACTGGAA ACCGCACCCG GCGTGTTTGA ATATTATTTG GGCTTGAACA
  1001  ATTTTTATAC GGTATGGCAG TACAACCACA GCCGGATGTA TGTAACGgcg
  1051  gtcaggGACA TTGCCAATTC GCTCGGCGGC CCGGGATTGT Aa
                                                           40
```

This corresponds to the amino acid sequence <SEQ ID 2814; ORF 922.ng>:

```
g922.pep
     1  MEKRKILPLA ICLAALSACT AMEARTPRAN EAQAPRADEM KKESRPAFDA
    51  AAVPVSDSGF AANANVRRFV DDEVGKGDFS QAEWQDFFDK AAYKADIVKI
   101  MHRPSTSRPW YVFRTGNSGR AKFHGARRFY AENRAVIDDV AQKYGVPAEL
   151  IVAIIGIETN YGKNTGSFRV ADALATLGFD YPRRAGFFQK ELVELLKLAK
   201  EEGGDVFAFK GSYAGAMGMP QFMPSSYRKW AVDYDGDGHR DIWGNVGDVA
   251  ASVANYMKQH GWRTGGKMLV SATLAPGADV QAIIGEKTAL TRTVADLKAY
   301  GIIPGETLAD DEKAVLFKLE TAPGVFEYYL GLNNFYTVWQ YNHSRMYVTA
   351  VRDIANSLGG PGL*
```

The following partial DNA sequence was identified in *N. meningitidis* <SEQ ID 2815>:

```
m922.seq
     1  ATGAAAAAGA GAAAAATACT GCCGCTGGCA ATTTGTTTGG CGGCTTTGTC
    51  TGCCTGTACG GCGATGGAGG CACGCCCACC CCGGGCAAAT GAAGCCCAAG
```

```
-continued
 101   CCCCCCGCGC GGTTGAAATG AAAAAAGAAA GCCGCCCCGC GTTTGACGCG

151   GCAGCCGTAT TTGACGCGGC AGCCGTACCG GTATCCGACA GCGGGTTTGC

201   CGCCAATGCA AATGTCCGCC GTTTTGTGGA CGATGAAGTC GGGAAAGGGG

251   ATTTTTCCCG GGCGGAATGG CAGGATTTTT TTGACAAAGC GGCTTACAAG

301   GCGGACATCG TCAAGATTAT GCACCGCCCC TCCACATCGC GTCCGTGGTA

351   TGTGTTCCGC ACGGGAAATT CGGGCAAGGC GAAATTTCGC GGCGCGCGCC

401   GGTTTTATGC GGAAAACCGC GCGCTTATCG ATGATGTGGC GCAAAATAC

451   GGCGTGCCTG CCGAACTTAT CGTGGCGGTT ATCGGGATTG AAACGAATTA

501   CGGCAAAAAT ACGGGCAGTT TCCGTGTGGC GGACGCATTG GCGACCTTAG

551   GCTTTGATTA CCCCGCCGC GCCGGGTTTT TCCAAAAGA ATTGGTCGAG

601   CTTTTAAAGC TGGCAAAAGA AGAAGGCGGC GATGTTTTCG CCTTTAAAGG

651   CAGCTATGCG GGCGCAATGG GGATGCCGCA ATTTATGCCT TCGAGCTACC

701   GGAAATGGGC GGTGGATTAT GACGGGACG GACATCGGGA CATATGGGGC

751   AACGTCGGCG ATGTCGCGGC ATCGGTTGCC AATTATATGA AGCAGCACGG

801   TTGGCGCACG GGCGGGAAAA TGCTGGTGTC TGCAACATTG GCGCCGGGTG

851   CGGATGTTCA GGCAATCATT GGCGAAAAAA CCGCCCTGAC GCGGACGGTG

901   GCGGATTTGA AGGCGTACGG CATCATCCCC GGCGAAGAGC TTGCAGATGA

951   TGAAAAGGCG GTTTTGTTCA AACTGGAAAC CGCACCGGGC GTGTTTGAAT

1001   ATTATTTGGG CTTGAACAAT TTTTATACGG TATGGCAGTA CAACCACAGC

1051   CGGATGTATG TAACGGCGGT CAGGGACATT GCCAATTCGC TTGGCGGCCC

1101   GGGATTGTAA
```

This corresponds to the amino acid sequence <SEQ ID 2816; ORF 922>:

```
m922.pep
    1   MKKRKILPLA ICLAALSACT AMEARPPRAN EAQAPRAVEM KKESRPAFDA

51   AAVFDAAAVP VSDSGFAANA NVRRFVDDEV GKGDFSRAEW QDFFDKAAYK

101   ADIVKIMHRP STSRPWYVFR TGNSGKAKFR GARRFYAENR ALIDDVAQKY

151   GVPAELIVAV IGIETNYGKN TGSFRVADAL ATLGFDYPRR AGFFQKELVE

201   LLKLAKEEGG DVFAFKGSYA GAMGMPQFMP SSYRKWAVDY DGDGHRDIWG

251   NVGDVAASVA NYMKQHGWRT GGKMLVSATL APGADVQAII GEKTALTRTV

301   ADLKAYGIIP GEELADDEKA VLFKLETAPG VFEYYLGLNN FYTVWQYNHS

351   RMYVTAVRDI ANSLGGPGL*
```

Computer analysis of this amino acid sequence gave the following results:
Homology with a Predicted ORF from *N. gonorrhoeae*
ORF 922 shows 95.9% identity over a 369 aa overlap with a predicted ORF (ORF 922.ng) from *N. gonorrhoeae*:

```
m922/g922
                 10         20         30         40         50         60
m922.pep   MKKRKILPLAICLAALSACTAMEARPPRANEAQAPRAVEMKKESRPAFDAAAVFDAAAVP
           |:||||||||||||||||||||||| ||||||||||| |||||||||||||      |||
g922       MEKRKILPLAICLAALSACTAMEARTPRANEAQAPRADMKKESRPAFDAA------AVP
                 10         20         30         40         50
```

-continued

```
                70        80        90       100       110       120
m922.pep  VSDSGFAANANVRRFVDDEVGKGDFSRAEWQDFFDKAAYKADIVKIMHRPSTSRPWYVFR
          |||||||||||||||||||||||||||:||||||||||||||||||||||||||||||||
g922      VSDSGFAANANVRRFVDDEVGKGDFSQAEWQDFFDKAAYKADIVKIMHRPSTSRPWYVFR
              60        70        80        90       100       110

130       140       150       160       170       180
m922.pep  TGNSGKAKFRGARRFYAENRALIDDVAQKYGVPAELIVAVIGIETNYGKNTGSFRVADAL
          |||||:|||:|||||||||||:||||||||||||||||||:|||||||||||||||||||
g922      TGNSGRAKFHGARRFYAENRAVIDDVAQKYGVPAELIVAIIGIETNYGKNTGSFRVADAL
             120       130       140       150       160       170

190       200       210       220       230       240
m922.pep  ATLGFDYPRRAGFFQKELVELLKLAKEEGGDVFAFKGSYAGAMGMPQFMPSSYRKWAVDY
          ||||||||||||||||||||||||||||||||||||||||||||||||||||||||||||
g922      ATLGFDYPRRAGFFQKELVELLKLAKEEGGDVFAFKGSYAGAMGMPQFMPSSYRKWAVDY
             180       190       200       210       220       230

250       260       270       280       290       300
m922.pep  DGDGHRDIWGNVGDVAASVANYMKQHGWRTGGKMLVSATLAPGADVQAIIGEKTALTRTV
          ||||||||||||||||||||||||||||||||||||||||||||||||||||||||||||
g922      DGDGHRDIWGNVGDVAASVANYMKQHGWRTGGKMLVSATLAPGADVQAIIGEKTALTRTV
             240       250       260       270       280       290

310       320       330       340       350       360
m922.pep  ADLKAYGIIPGEELADDEKAVLFKLETAPGVFEYYLGLNNFYTVWQYNHSRMYVTAVRDI
          |||||||||||| |||||||||||||||||||||||||||||||||||||||||||||||
g922      ADLKAYGIIPGETLADDEKAVLFKLETAPGVFEYYLGLNNFYTVWQYNHSRMYVTAVRDI
             300       310       320       330       340       350

370
m922.pep  ANSLGGPGLX
          ||||||||||
g922      ANSLGGPGLX
             360
```

The following partial DNA sequence was identified in *N. meningitidis* <SEQ ID 2817>:

```
a922.seq
     1  ATGAAAAACA GAAAAATACT GCCGCTGGCA ATTTGTTTGG CGGCTTTGTC

51  TGCCTGTACG GCGATGGAGG CACGCCCGCC CCGGGCAAAT GAAGCCCAAG

101  CCCCCCGCGC GGATGAAATG AAAAAAGAAA GCCGCCCCGC GTTTGACGCG

151  GCAGCCGTAT TTGACGCGGC AGCCGTACCG GTATCCGACA GCGGGTTTGC

201  CGCCAATGCA AATGTCCGCC GTTTTGTGGA CGATGAAGTC GGGAAAGGGG

251  ATTTTTCCCG GGCGGAATGG CAGGATTTTT TTGACAAAGC GGCTTACAAG

301  GCGGACATCG TCAAGATTAT GCACCGCCCC TCCACATCGC GTCCGTGGTA

351  TGTGTTCCGC ACGGGAAATT CGGGCAAGGC GAAATTTCGC GGCGCGCGCC

401  GGTTTTATGC GGAAAACCGC GCGCTTATCG ATGATGTGGC GCAAAAATAC

451  GGCGTGCCTG CCGAACTTAT CGTGGCGGTT ATCGGGATTG AAACGAATTA

501  CGGCAAAAAT ACGGGCAGTT TCCGTGTGGC GGACGCATTG GCGACCTTAG

551  GCTTTGATTA CCCCCGCCGC GCCGGGTTTT TCCAAAAAGA ATTGGTCGAG

601  CTTTTAAAGC TGGCAAAAGA AGAAGGCGGC GATGTTTTCG CCTTTAAAGG

651  CAGCTATGCG GGCGCAATGG GGATGCCGCA ATTTATGCCT TCGAGCTACC

701  GGAAATGGGC GGTGGATTAT GACGGGGACG GACATCGGGA CATATGGGGC

751  AATGTTGGCG ATGTCGCGGC ATCGATTGCC AATTATATGA AGCAGCACGG

801  TTGGCGCACG GGCGGGAAAA TACTGGTGTC TGCAACATTG GCGCCGGGTG

851  CGGATGTTCA GGCAATCATT GGCGAAAAAA CCGCCCTGAC GCGGACGGTG

901  GCGGATTTGA AGGCGTACGG CATCATCCCC GGCGAAGAGC TTGCCGATGA

951  TGAAAAGGCG GTTTTGTTCA AACTGGAAAC CGCACCCGGC GTGTTTGAAT

1001  ATTATTTGGG CTTGAACAAT TTTTATACGG TATGGCAGTA CAATCACAGT
```

```
-continued
1051  CGGATGTATG TAACGGCGGT CAGGGACATT GCCAATTCGC TTGGCGGCCC

1101  GGGATTGTAA
```

This corresponds to the amino acid sequence <SEQ ID 2818; ORF 922.a>:

```
a922.pep
    1  MKNRKILPLA ICLAALSACT AMEARPPRAN EAQAPRADEM KKESRPAFDA

51  AAVFDAAAVP VSDSGFAANA NVRRFVDDEV GKGDFSRAEW QDFFDKAAYK

101  ADIVKIMHRP STSRPWYVFR TGNSGKAKFR GARRFYAENR ALIDDVAQKY

151  GVPAELIVAV IGIETNYGKN TGSFRVADAL ATLGFDYPRR AGFFQKELVE

201  LLKLAKEEGG DVFAFKGSYA GAMGMPQFMP SSYRKWAVDY DGDGHRDIWG

251  NVGDVAASIA NYMKQHGWRT GGKILVSATL APGADVQAII GEKTALTRTV

301  ADLKAYGIIP GEELADDEKA VLFKLETAPG VFEYYLGLNN FYTVWQYNHS

351  RMYVTAVRDI ANSLGGPGL*
``` m922/a922 98.9% identity in 369 aa overlap

```
                   10         20         30         40         50         60
  m922.pep MKKRKILPLAICLAALSACTAMEARPPRANEAQAPRAVEMKKESRPAFDAAAVFDAAAVP
           ||:|||||||||||||||||||||||||||||||||||  |||||||||||||||||||
     a922  MKNRKILPLAICLAALSACTAMEARPPRANEAQAPRADEMKKESRPAFDAAAVFDAAAVP
                   10         20         30         40         50         60

70         80         90        100        110        120
  m922.pep VSDSGFAANANVRRFVDDEVGKGDFSRAEWQDFFDKAAYKADIVKIMHRPSTSRPWYVFR
           ||||||||||||||||||||||||||||||||||||||||||||||||||||||||||||
     a922  VSDSGFAANANVRRFVDDEVGKGDFSRAEWQDFFDKAAYKADIVKIMHRPSTSRPWYVFR
                   70         80         90        100        110        120

130        140        150        160        170        180
  m922.pep TGNSGKAKFRGARRFYAENRALIDDVAQKYGVPAELIVAVIGIETNYGKNTGSFRVADAL
           ||||||||||||||||||||||||||||||||||||||||||||||||||||||||||||
     a922  TGNSGKAKFRGARRFYAENRALIDDVAQKYGVPAELIVAVIGIETNYGKNTGSFRVADAL
                  130        140        150        160        170        180

190        200        210        220        230        240
  m922.pep ATLGFDYPRRAGFFQKELVELLKLAKEEGGDVFAFKGSYAGAMGMPQFMPSSYRKWAVDY
           ||||||||||||||||||||||||||||||||||||||||||||||||||||||||||||
     a922  ATLGFDYPRRAGFFQKELVELLKLAKEEGGDVFAFKGSYAGAMGMPQFMPSSYRKWAVDY
                  190        200        210        220        230        240

250        260        270        280        290        300
  m922.pep DGDGHRDIWGNVGDVAASVANYMKQHGWRTGGKMLVSATLAPGADVQAIIGEKTALTRTV
           ||||||||||||||||||:||||||||||||||:||||||||||||||||||||||||||
     a922  DGDGHRDIWGNVGDVAASIANYMKQHGWRTGGKILVSATLAPGADVQAIIGEKTALTRTV
                  250        260        270        280        290        300

310        320        330        340        350        360
  m922.pep ADLKAYGIIPGEELADDEKAVLFKLETAPGVFEYYLGLNNFYTVWQYNHSRMYVTAVRDI
           ||||||||||||||||||||||||||||||||||||||||||||||||||||||||||||
     a922  ADLKAYGIIPGEELADDEKAVLFKLETAPGVFEYYLGLNNFYTVWQYNHSRMYVTAVRDI
                  310        320        330        340        350        360

370
  m922.pep ANSLGGPGLX
           ||||||||||
     a922  ANSLGGPGLX
                  370
```

The following partial DNA sequence was identified in *N. gonorrhoeae* <SEQ ID 2819>:

```
g923.seq
    1  ATGAAGCGGC AGGCTTTCTT CAAACCGATG GCGTGTGCGG CATTTCTGTC

51  CGCCGTTTCG CTGCGCCTCC CCGTATTGGG CGCGTGTTAC GCAATATTGT

101  CCCTCTATGC GTTTGCACTT TACGGCATCG ACAAACGGCG TGCCGTGCGG
```

-continued

```
151    GGAAAACGCC GCATTCCCGA ACACCGCCTG CTCCTGCCTG CCTTGTTCGG

201    CGGTTGGACG GGCGCATACT TGGGTAGTAG GATGTTCAGG CATAAAACGG

251    CGAAAAAGCG TTTTGTTGTG CTGTTCCGTC TGACTGTTTC GGGCAATGTC

301    CTGGCGACCT GCATCCTGAT TGATTATTTC GTTCCGCCCG AACTTTTTGT

351    AAAACTCGGG CAACATCTCT GA
```

This corresponds to the amino acid sequence <SEQ ID 2820; ORF 923.ng>:

```
g923.pep
  1    MKRQAFFKPM ACAAFLSAVS LRLPVLGACY AILSLYAFAL YGIDKRRAVR

51    GKRRIPEHRL LLPALFGGWT GAYLGSRMFR HKTAKKRFVV LFRLTVSGNV

101    LATCILIDYF VPPELFVKLG QHL*
```

The following partial DNA sequence was identified in *N. meningitidis* <SEQ ID 2821>:

```
m923.seq
  1    ATGAAGCGGC AGGCTTTCTT CAAACTGATG GCGTGTGCGG CATTTCTGTC

51    TGCCGTTTCG CTGCGCCTCC CCGTATTGGG CGCGTGTTAC GCAATATTGT

101    CCCTCTATGC GTTTGCACTT TACGGCATCG ACAAACGGTG CGCCATACGG

151    GGGCAACGCC GCATTCCCGA ACACCGCCTG CTGCTGCCTG CATTGCTCGG

201    CGGCTGGGTG GGCGCGTATT TCGGCAGCAT GACATTCAAA CATAAGACAG

251    CGAAAAAGCG TTTTGTTGTG CTGTTCCGTC TGACTGTTTC AGGTAATGTC

301    TTGGCGACCC TCATCCTGAT TTATAGTGGA TTAAATTTAA ACCAGTACGG

351    CGTTGCCTCG CCTTGCCGTA CTATTTGTAC TGTCTGCGGC TTCGTCGCCT

401    TGTCCTGATT TTTGTTAATC CACTATAT.T ATTTTGTCCC GCCTGAATTT

451    TTCGTAAAAC TCGGGCAGAA TACCTGA
```

This corresponds to the amino acid sequence <SEQ ID 2822; ORF 923>:

```
m923.pep
  1    MKRQAFFKLM ACAAFLSAVS LRLPVLGACY AILSLYAFAL YGIDKRCAIR

51    GQRRIPEHRL LLPALLGGWV GAYFGSMTFK HKTAKKRFVV LFRLTVSGNV

101    LATLILIYSG LNLNQYGVAS PCRTICTVCG FVALS*FLLI HYXYFVPPEF

151    FVKLGQNT*
```

Computer analysis of this amino acid sequence gave the following results:
Homology with a Predicted ORF from *N. gonorrhoeae*
ORF 923 shows 68.8% identity over a 157 aa overlap with a predicted ORF (ORF 923.ng) from *N. gonorrhoeae*:

```
g923/m923
                10         20         30         40         50         60
g923.pep   MKRQAFFKPMACAAFLSAVSLRLPVLGACYAILSLYAFALYGIDKRRAVRGKRRIPEHRL
           ||||||||| |||||||||||||||||||||||||||||||||||| :||:||||||||
m923       MKRQAFFKLMACAAFLSAVSLRLPVLGACYAILSLYAFALYGIDKRCAIRGQRRIPEHRL
                10         20         30         40         50         60
```

-continued

```
                 70         80         90        100
g923.pep    LLPALFGGWTGAYLGSRMFRHKTAKKRFVVLFRLTVSGNVLATCILID------------
            |||||:|||:|||:||  |:|||||||||||||||||||||||||  |||
m923        LLPALLGGWVGAYFGSMTFKHKTAKKRFVVLFRLTVSGNVLATLILIYSGLNLNQYGVAS
                 70         80         90        100        110        120

110        120
g923.pep    ----------------------YFVPPELFVKLGQHLX
                                  ||||||:||||||:
m923        PCRTICTVCGFVALSXFLLIHYIYFVPPEFFVKLGQNTX
                 130        140        150
```

The following partial DNA sequence was identified in *N. meningitidis* <SEQ ID 2823>:

```
a923.seq
    1    ATGAAGCGGC AGGCTTTCTT CAAACTGATG GCGTGTGCGG CATTTCTGTC

51    TGCCGTTTCG CTGCGCCTCC CCGTATTGGG CGCGTGTTAC GCAATATTGT

101    CCCTCTATGC GTTTGCACTT TACGGCATCG ACAAACGGCG TGCCGTGCGG

151    GGAAAACGCC GCATTCCCGA ACACCGCCTG CTGCTGCCTG CCTTGTTCGG

201    CGGTTGGGCG GGCGCATACT TGGGCAGCAG GATATTCAGG CATAAAACGG

251    CGAAAAAGCG TTTTGTTGTG CTGTTCCGTC TGACTGTTTC GGGCAATGTC

301    CTGGCGACCC TCATCCTGAT TTATAGTGGA TTAAATTTAA ACCAGTACGG

351    CGTTGCCTCG CCTTA.GCTC AAAGAGAACG ATTCTCTAAG GTGCTGAAGC

401    ACCAAGTGAA TCGGTTCCGT ACTATTTGTA CTGTCTGCGG CTTCGTCGCC

451    TTGTCCTGAT TTTTGTTAAT CCACTAT.AT TATTTTGTCC CGCCTGAATT

501    TTTCGTAAAA CTCGGGCAGA ATACCTGA
```

This corresponds to the amino acid sequence <SEQ ID 2824; ORF 923.a>:

```
a923.pep
    1    MKRQAFFKLM ACAAFLSAVS LRLPVLGACY AILSLYAFAL YGIDKRRAVR

51    GKRRIPEHRL LLPALFGGWA GAYLGSRIFR HKTAKKRFVV LFRLTVSGNV

101    LATLILIYSG LNLNQYGVAS PXAQRERFSK VLKHQVNRFR TICTVCGFVA

151    LS*FLLIHYX YFVPPEFFVK LGQNT*
``` m923/a923 84.6% identity in 175 aa overlap

```
                 10         20         30         40         50         60
m923.pep    MKRQAFFKLMACAAFLSAVSLRLPVLGACYAILSLYAFALYGIDKRCAIRGQRRIPEHRL
            ||||||||||||||||||||||||||||||||||||||||||||||:|||:||||||||
a923        MKRQAFFKLMACAAFLSAVSLRLPVLGACYAILSLYAFALYGIDKRRAVRGKRRIPEHRL
                 10         20         30         40         50         60

70         80         90        100        110        120
m923.pep    LLPALLGGWVGAYFGSMTFKHKTAKKRFVVLFRLTVSGNVLATLILIYSGLNLNQYGVAS
            |||||:|||:|||:||  |:||||||||||||||||||||||||||||||||||||||||
a923        LLPALFGGWAGAYLGSRIFRHKTAKKRFVVLFRLTVSGNVLATLILIYSGLNLNQYGVAS
                 70         80         90        100        110        120

130        140        150        159
m923.pep    PC-------------RTICTVCGFVALSXFLLIHYXYFVPPEFFVKLGQNTX
            |              ||||||||||||||||||||||||||||||||||||
a923        PXAQRERFSKVLKHQVNRFRTICTVCGFVALSXFLLIHYXYFVPPEFFVKLGQNTX
                 130        140        150        160        170
```

The following partial DNA sequence was identified in *N. gonorrhoeae* <SEQ ID 2825>:

```
g925.seq
    1   ATGAAACAAA TGCTTTTGGC cgtcggcgtg ggcGCGGTGT TGGCGGGCTG

51   CGGCAaggat gcCGGCGGtt acgagggtTA TTGGCGCGAA AAGTCGGACA

101   AAAAagaggG CGTGATTGCC GTCAAAAAAA AAGGCAATTA CTTCCTTAAT

151   AAAATCAACG TGTTTACAGG CAAGGAGGAG TCTTTGCTTT TGTCTGAAAA

201   AGACGGCGCG CTTTCGATAA ACACGGGGAT AGGGGAAATC CCGATCAAAC

251   TTTCCGACGA CGGGAAAGAG CTGTATGTCG AACGCAGGCG GTATGTGAAA

301   ACCGATGCGG CGATGAAGGA CAAAATCATC GCCCACCAGA AAAAGTGCGG

351   ACAAACGGCA CAGGCATACC TCGACGCGCG AAATGCGTTG CCGTCAAACC

401   AAACGTATCA GCAGCGTCAG GCGGCGATCG AGCAATTGAA ACGGCGGTTT

451   GAAGCCGAGT TTGACGAATT GGAAAAAGAA ATCAAATGCA ACGGCAAACC

501   GACATTGTTG TTTTAG
```

This corresponds to the amino acid sequence <SEQ ID 2826; ORF 925.ng>:

```
g925.pep
    1   MKQMLLAVGV GAVLAGCGKD AGGYEGYWRE KSDKKEGVIA VKKKGNYFLN

51   KINVFTGKEE SLLLSEKDGA LSINTGIGEI PIKLSDDGKE LYVERRRYVK

101   TDAAMKDKII AHQKKCGQTA QAYLDARNAL PSNQTYQQRQ AAIEQLKRRF

151   EAEFDELEKE IKCNGKPTLL F*
```

The following partial DNA sequence was identified in *N. meningitidis* <SEQ ID 2827>:

```
m925.seq (partial)
    1   ATGAAACAAA TGCTTTTAGC CGTCGGCGTG GTGGCGGTGT TGGCGGGCTG

51   CGGCAAGGAT GCCGGCGGTT ACGAGGGTTA TTGGCGCGAA AAGTCGGACA

101   AAAAGAGGG TATGATTGCC GTCAAAAAAG AAAAGGCAA TTACTTCCTT
        .......
```

This corresponds to the amino acid sequence <SEQ ID 2828; ORF 925>:

```
m925.pep (partial)
    1   MKQMLLAVGV VAVLAGCGKD AGGYEGYWRE KSDKKEGMIA VKKEKGNYFL..
```

Computer analysis of this amino acid sequence gave the following results:
Homology with a Predicted ORF from *N. gonorrhoeae*
ORF 925 shows 94.0% identity over a 50 aa overlap with a predicted ORF (ORF 925.ng) from *N. gonorrhoeae*:

```
m925/g925
                    10        20        30        40        50
    m925.pep  MKQMLLAVGVVAVLAGCGKDAGGYEGYWREKSDKKEGMIAVKKEKGNYFL
              ||||||||||  |||||||||||||||||||||||||||: ||||  ||||||
        g925  MKQMLLAVGVGAVLAGCGKDAGGYEGYWREKSDKKEGVIAVKK-KGNYFLNKINVFTGKE
                    10        20        30        40        50 g925  ESLLLSEKDGALSINTGIGEIPIKLSDDGKELYVERRRYVKTDAAMKDKIIAHQKKCGQT
                    60        70        80        90       100       110
```

The following partial DNA sequence was identified in *N. gonorrhoeae* <SEQ ID 2829>:

```
g925-1.seq
    1   ATGAAACAAA TGCTTTTGGC CGTCGGCGTG GCGGCGGTGT TGGCGGGCTG
   51   CGGCAAGGAT GCCGGCGGTT ACGAGGGTTA TTGGCGCGAA AAGTCGGACA
  101   AAAAGAGGG CGTGATTGCC GTCAAAAAAA AAGGCAATTA CTTCCTTAAT
  151   AAAATCAACG TGTTTACAGG CAAGGAGGAG TCTTTGCTTT TGTCTGAAAA
  201   AGACGGCGCG CTTTCGATAA ACACGGGGAT AGGGGAAATC CCGATCAAAC
  251   TTTCCGACGA CGGGAAAGAG CTGTATGTCG AACGCAGGCG GTATGTGAAA
  301   ACCGATGCGG CGATGAAGGA CAAAATCATC GCCCACCAGA AAAAGTGCGG
  351   ACAAACGGCA CAGGCATACC TCGACGCGCG AAATGCGTTG CCGTCAAACC
  401   AAACGTATCA GCAGCGTCAG GCGGCGATCG AGCAATTGAA ACGGCGGTTT
  451   GAAGCCGAGT TGACGAATT GGAAAAAGAA ATCAAATGCA ACGGCAAACC
  501   GACATTGTTG TTTTAG
```

This corresponds to the amino acid sequence <SEQ ID 2830; ORF 925-1.ng>:

```
g925-1.pep
    1   MKQMLLAVGV AAVLAGCGKD AGGYEGYWRE KSDKKEGVIA VKKKGNYFLN
   51   KINVFTGKEE SLLLSEKDGA LSINTGIGEI PIKLSDDGKE LYVERRRYVK
  101   TDAAMKDKII AHQKKCGQTA QAYLDARNAL PSNQTYQQRQ AAIEQLKRRF
  151   EAEFDELEKE IKCNGKPTLL F*
```

The following partial DNA sequence was identified in *N. meningitidis* <SEQ ID 2831>:

```
m925-1.seq
    1   ATGAAACAAA TGCTTTTAGC CGTCGGCGTG GTGGCGGTGT TGGCGGGCTG
   51   CGGCAAGGAT GCCGGCGGTT ACGAGGGTTA TTGGCGCGAA AAGTCGGACA
  101   AAAAGAGGG TATGATTGCC GTCAAAAAAG AAAAAGGCAA TTACTTCCTT
  151   AATAAAATCC ACGTGGTTAC AGGCAAGGAA GAGTCCTTGC TTTTGTCTGA
  201   AAAAGACGGC GCGCTTTCGA TAAACACAGG GATAGGGGAA ATCCCGATCA
  251   AACTTTCCGA CGACGGGAAA GAGCTGTATG TCGAACGTAG GCAGTATGTC
  301   AAAACCGATG CGGCGATGAA GGACAAAATC ATCGCCCATC AGAAAAAGTG
  351   CGGACAAACA GCACAGGCAT ACCGCGACGC GCGAAATGCG TTGCCGTCAA
  401   ACCAGACGTA TCAGCAGCAT CTGGCGGCGA TCGAGCAATT GAAACGGCGG
  451   TTTGAAGCCG AGTTTGACGA ATTGGAAAAA GAAATCAAAT GCAACGGCAG
  501   AAGCCCGGCA TTGTTGCTTT AG
```

This corresponds to the amino acid sequence <SEQ ID 2832; ORF 925-1>:

```
m925-1.pep..
    1   MKQMLLAVGV VAVLAGCGKD AGGYEGYWRE KSDKKEGMIA VKKEKGNYFL
   51   NKIHVVTGKE ESLLLSEKDG ALSINTGIGE IPIKLSDDGK ELYVERRQYV
```

```
    101    KTDAAMKDKI IAHQKKCGQT AQAYRDARNA LPSNQTYQQH LAAIEQLKRR

151    FEAEFDELEK EIKCNGRSPA LLL*
``` m925/g925 92.5% identity in 173 aa overlap

```
                      10         20         30         40         50         60
   m925-1.pep  MKQMLLAVGVVAVLAGCGKDAGGYRGYWREKSDKKEGMIAVKKEKGNYFLNKIHVVTGKE
                ||||||||||:|||||||||||||||||||||||||:||||| ||||||||||:| ||||
   g925-1      MKQMLLAVGVAAVLAGCGKDAGGYRGYWREKSDKKEGVIAVKK-KGNYFLNKINVFTGKE
                      10         20         30         40         50

70         80         90        100        110        120
   m925-1.pep  ESLLLSEKDGALSINTGIGEIPIKLSDDGKELYVERRQYVKTDAAMKDKIIAHQKKCGQT
                ||||||||||||||||||||||||||||||||||||||:|||||||||||||||||||||
   g925-1      ESLLLSEKDGALSINTGIGEIPIKLSDDGKELYVERRRYVKTDAAMKDKIIAHQKKCGQT
                      60         70         80         90        100        110

130        140        150        160        170
   m925-1.pep  AQAYRDARNALPSNQTYQQHLAAIEQLKRRFEAFDELEKEIKCNGRSPALLLX
                |||| ||||||||||||||: ||||||||||||||||||||||||:|:|||:|
   g925-1      AQAYLDARNALPSNQTYQQRQAAIEQLKRRFEAFDELEKEIKCNGK-PTLLFX
                     120        130        140        150        160        170
```

The following partial DNA sequence was identified in *N. meningitidis* <SEQ ID 2833>:

```
a925-1.seq
      1    AATAAAATCA ACGTGTTTAC AGGTAAGGAA GAATCTATGC TTTTGTCTGA

51    AAAAGACGGC GCGCTTTCGA TAAACACGGG GATAGGGGAA ATCCCGATCA

101    AACTTTCCGA CGACGGGAAA GAGCTGTATG TCGAACGCAG GCAGTATGTC

151    AAAACCGATG CGGCGATGAA GGACAAAATC ATCGCCCATC AGAAAAAGTG

201    CGGACAAACG GCACAGGCAT ATCTCGACGC GCGAAATGCG TTGCCGTCAA

251    ACCAGACGTA TCAGCAGCAT CAGGCGGCGA TCGAGCAGTT GAAACGGCGG

301    TTTGAAGCCG AGTTTGACGA ATTGGAAAAA GAAATCAAAT GCAACGGCAA

351    ACCGACATTG TTGTTTTAG
```

This corresponds to the amino acid sequence <SEQ ID 2834; ORF 925-1.a>:

```
a925-1.pep
      1    NKINVFTGKE ESMLLSEKDG ALSINTGIGE IPIKLSDDGK ELYVERRQYV

51    KTDAAMKDKI IAHQKKCGQT AQAYLDARNA LPSNQTYQQH QAAIEQLKRR

101    FEAEFDELEK EIKCNGKPTL LF*
``` a925-1/m925-1 92.7% identity in 123 aa overlap

```
                                            10         20         30
   a925-1.pep                         NKINVFTGKEESMLLSEKDGALSINTGIGE
                                       |||:| ||||||:|||||||||||||||||
   m925-1      AGGYEGYWREKSDKKEGMIAVKKEKGNYFLNKIHVVTGKEESLLLSEKDGALSINTGIGE
                       30         40         50         60         70         80

40         50         60         70         80         90
   a925-1.pep  IPIKLSDDGKELYVERRQYVKTDAAMKDKIIAHQKKCGQTAQAYLDARNALPSNQTYQQH
                ||||||||||||||||||||||||||||||||||||||||||||| ||||||||||||||
   m925-1      IPIKLSDDGKELYVERRQYVKTDAAMKDKIIAHQKKCGQTAQAYRDARNALPSNQTYQQH
                       90        100        110        120        130        140

100        110        120
   a925-1.pep  QAAIEQLKRRFEAFDELEKEIKCNGK-PTLLFX
                 ||||||||||||||||||||||||||:|:|||:|
   m925-1      LAAIEQLKRRFEAFDELEKEIKCNGRSPALLLX
                     150        160        170
```

The following partial DNA sequence was identified in *N. gonorrhoeae* <SEQ ID 2835>:

```
g926.seq (partial)
    1   ATGAAACACA CCGTATCCGC ATCGGTCATC CTGCTTTTGA CCGCTTGCGC
   51   GCAATTACCT CAAAATAACG AAAACCTGTG GCAGCCGTCC GAACACATCA
  101   GCAGTTTTGC AGCGGAAGGG CGGTTGGCAG TCAAAGCGGA AGGGAAAGGT
  151   TCGTATGCAA ATTTCGATTG GACATACCAA CCGCCCGTGG AAACCATCAA
  201   TATCAACACC CCTTTGGGCA GTACGCTCGG ACAGTTGTGT CAAGacAGGG
  251   ACGGCGCATT GGCAGTGGAC GGCAAAGGAA ATGTCTATCA GGCAGAGGGT
  301   ACGgaagact tGAGCAGGCA GCTGGTCGGT TTCAAACTGC CAATCCAATA
  351   TCTGCATATC TGGGCGGAAG GCAGGCGTGT GGCGGGCGCG CCTtaccGCA
  401   TCCGTTCAGA CGGCATATTG GAACAATAcg GttggACAAT cgggCagaac
  451   tgcCGACAGT GGGGGGCaag tccgaacgtt gcaactGAa...
```

This corresponds to the amino acid sequence <SEQ ID 2836; ORF 926.ng>:

```
g926.pep (partial)
    1   MKHTVSASVI LLLTACAQLP QNNENLWQPS EHISSFAAEG RLAVKAEGKG
   51   SYANFDWTYQ PPVETININT PLGSTLGQLC QDRDGALAVD GKGNVYQAEG
  101   TEDLSRQLVG FKLPIQYLHI WAEGRRVAGA PYRIRSDGIL EQYGWTIGQN
  151   CRQWGASPNV ATE...
```

The following partial DNA sequence was identified in *N. meningitidis* <SEQ ID 2837>:

```
m926.seq
    1   ATGAAACACA CCGTATCCGC ATCGGTCATC CTGCTTTTGA CCGCTTGCGC
   51   GCAATTACCT CAAAATAACG AAAACCTGTG GCAGCCGTCC GAACACATCA
  101   GCAGTTTTGC AGCAGAAGGG CGGTTGGCAG TGAAAGCGGA AGGGAAAGGT
  151   TCGTATGCAA ATTTCGATTG GACATACCAA CCGCCCGTGG AAACCATCAA
  201   TATCAATACC CCTTTGGGCA GTACGCTCGG GCAGTTGTGT CAAGACAGGG
  251   ACGGCGCATT GGCAGTGGAC GGCAAAGGAA ATGTCTATCA GGCGGAAAGT
  301   GCGGAAGAAT TGAGCAGGCA GCTGGTCGGT TTCAAACTGC CAATCCAATA
  351   TCTGCATATC TGGGCAGATG GCAGGCGTGT GGCGGGCGCG CCTTACCGCA
  401   TCCTGCCGGA CGGCATATTG GAACAATACG GTTGGACTGT CGGCAGAACC
  451   GCCGACAGTG GGGGGCAAGT CCGAACGTTG CAACTGAATA CGGAAATTT
  501   GAACATCAGG CTGGTTTTCA CCGAAATCGG TATGCCGTCT GAAACCGAAA
  551   CCCCGGAACG CTGTGCGGCG CGCACGAGAT AA
```

This corresponds to the amino acid sequence <SEQ ID 2838; ORF 926>:

```
m926.pep
    1   MKHTVSASVI LLLTACAQLP QNNENLWQPS EHISSFAAEG RLAVKAEGKG
   51   SYANFDWTYQ PPVETININT PLGSTLGQLC QDRDGALAVD GKGNVYQAES
```

-continued

```
101  AEELSRQLVG FKLPIQYLHI WADGRRVAGA PYRILPDGIL EQYGWTVGRT

151  ADSGGQVRTL QLNNGNLNIR LVFTEIGMPS ETETPERCAA RTR*
``` g926/m926 91.6% identity in 155 aa overlap

```
                  10         20         30         40         50         60
g926.pep  MKHTVSASVILLLTACAQLPQNNENLWQPSEHISSFAAEGRLAVKAEGKGSYANFDWTYQ
          ||||||||||||||||||||||||||||||||||||||||||||||||||||||||||||
m926      MKHTVSASVILLLTACAQLPQNNENLWQPSEHISSFAAEGRLAVKAEGKGSYANFDWTYQ
                  10         20         30         40         50         60

70         80         90        100        110        120
g926.pep  PPVETININTPLGSTLGQLCQDRDGALAVDGKGNVYQAEGTEDLSRQLVGFKLPIQYLHI
          |||||||||||||||||||||||||||||||||||||||::|:||||||||||||||||
m926      PPVETININTPLGSTLGQLCQDRDGALAVDGKGNVYQAESAEELSRQLVGFKLPIQYLHI
                  70         80         90        100        110        120

130        140        150        160
g926.pep  WAEGRRVAGAPYRIRSDGILEQYGWTIGQNCRQWGASPNVATE
          ||:|||||||||||  |||||||||||:|::   :  |
m926      WADGRRVAGAPYRILPDGILEQYGWTVGRTADSGGQVRTLQLNNGNLNIRLVFTEIGMPS
                 130        140        150        160        170        180
``` a926.seq
```
  1  ATGAAACACA CTGTATCCGC ATCGGTCATC CTGCTTTTGA CCGCTTGCGC

51  GCAATTACCT CAAAATAACG AAAACCTGTG GCAGCCGTCC GAACACACCC

101  GCAGTTTCAC GGCGGAAGGG CGGTTGGCAG TGAAAGCGGA AGGGAAAGGT

151  TCGTATGCAA ATTTCGATTG GACATACCAA CCGCCCGTGG AAACCATCAA

201  TATCAACACC CCTTTGGGCA GTACGCTCGG GCAGTTGTGT CAAGACAGGG

251  ACGGCGCATT GGCAGTGGAC GGCAAAGGAA ATGTCTATCA GGCGGAAAGT

301  GCGGAAGAAT TGAGCAGGCA GCTGGTCGGT TTCAAACTGC CAATCCAATA

351  TCTGCATATC TGGGCAGATG GCAGGCCTGT GGCGGGCGCG CCTTACCGCA

401  TCCTGCCGGA CGGCATATTG GAACAATACG GTTGGACTGT CGGCAGAACC

451  GCCGACAGTG GGGGGCAAGT CCGAACGTTG CAACTGAATA ACGGAAATTT

501  GAACATCAGG CTGGTTTTCA CCGAGATTGG TATGCCGTCT GAAACCGAAA

551  CCCAAGAACA ATGCGCGGCA CGCATACAGT AA
``` a926.pep
```
  1  MKHTVSASVI LLLTACAQLP QNNENLWQPS EHTRSFTAEG RLAVKAEGKG

51  SYANFDWTYQ PPVETININT PLGSTLGQLC QDRDGALAVD GKGNVYQAES

101  AEELSRQLVG FKLPIQYLHI WADGRPVAGA PYRILPDGIL EQYGWTVGRT

151  ADSGGQVRTL QLNNGNLNIR LVFTEIGMPS ETETQEQCAA RIQ*
``` m926/a926 96.9% identity in 191 aa overlap

```
                  10         20         30         40         50         60
m926.pep  MKHTVSASVILLLTACAQLPQNNENLWQPSEHISSFAAEGRLAVKAEGKGSYANFDWTYQ
          ||||||||||||||||||||||||||||||||   ||:||||||||||||||||||||||
a926      MKHTVSASVILLLTACAQLPQNNENLWQPSEHTRSFTAEGRLAVKAEGKGSYANFDWTYQ
                  10         20         30         40         50         60

70         80         90        100        110        120
m926.pep  PPVETININTPLGSTLGQLCQDRDGALAVDGKGNVYQAESAEELSRQLVGFKLPIQYLHI
          ||||||||||||||||||||||||||||||||||||||||||||||||||||||||||||
a926      PPVETININTPLGSTLGQLCQDRDGALAVDGKGNVYQAESAEELSRQLVGFKLPIQYLHI
                  70         80         90        100        110        120
```

-continued

```
                     130        140        150        160        170        180
    m926.pep   WADGRRVAGAPYRILPDGILEQYGWTVGRTADSGGQVRTLQLNNGNLNIRLVFTEIGMPS
               |||| |||||||||||||||||||||||||||||||||||||||||||||||||||||
    a926       WADGRPVAGAPYRILPDGILEQYGWTVGRTADSGGQVRTLQLNNGNLNIRLVFTEIGMPS
                     130        140        150        160        170        180

190
    m926.pep   ETETPERCAARTRX
               |||| |:||||
    a926       ETETQEQCAARIQX
                     190
```

The following partial DNA sequence was identified in *N. gonorrhoeae* <SEQ ID 2839>:

```
g927.seq
     1   atgaaaacct acGCAcAggC ACTCTATacc GCAGCCCTGC TCACCGCCTG

51   CAGCCCcgca GCcgatTcaa accaTCCGTC GGGAcAaAAT GCCCCGGCCA

101   ATACCGAATC cgacGgaaAA AACATtaccC TGctcaatgc cTcgtacgat 151   gtGACACGGT ATTTttacaa agaatacgac cacTtgtttg tcggaaCATA

201   CCAATCCGAA CACCCCGGCA CATCCGTCAG CATCCAACAA TCCCACGGCG

251   GCTTCAGCAA ACAGGCATTA TCCGTAGCCA ACGGCCTTCA AGCCGATGTC

301   GTAACCATGA ACCAATCTTC CGACATCGAC CTGCTCGAAA AAAA.GGACT

351   GGTAGAAAAA GGCTGGCAAC AAGCCCTCCC CGATCACGCC GCACCCTACA

401   CCAGCACTAT GGTTTTCCTT GTCCGAAAAA ACAACCCcaa ACAGAtccgC

451   GATTGGAACG ACCTTGCCAA AGACGGCGTT AACATCGTCA TCGCCAAGAC

501   CTCGGGCAAC GGACGCTACG CCTTCCTCGG CGCATACGGT TACGGTCTGA

551   AAGCCAACAA CGGcaaCGAG CAGGAAGCCC AAAAACTCGT CGCATCCATC

601   CTCAAAAACA CACCCGTTTT TGAAAACGGC GGACGCGc.C CGCCGCCACC

651   ACCTTCACAC AACGCAACAT CGGCGACGTA CTCATCACTT TTGAAAACga 701   agCcaactac gtCAGCAAAA AACTGA
```

This corresponds to the amino acid sequence <SEQ ID 2840; ORF 927.ng>:

```
g927.pep
     1   MKTYAQALYT AALLTACSPA ADSNHPSGQN APANTESDGK NITLLNASYD

51   VTRYFYKEYD HLFVGTYQSE HPGTSVSIQQ SHGGFSKQAL SVANGLQADV

101   VTMNQSSDID LLEKXGLVEK GWQQALPDHA APYTSTMVFL VRKNNPKQIR

151   DWNDLAKDGV NIVIAKTSGN GRYAFLGAYG YGLKANNGNE QEAQKLVASI

201   LKNTPVFENG GRXPPPPPSH NATSATYSSL LKTKPTTSAK N*
```

The following partial DNA sequence was identified in *N. meningitidis* <SEQ ID 2837>:

```
m927.seq
     1   ATGAAAACCT ACGCACCGGC ACTCTATACC GCAGCCCTGC TCACCGCCTG

51   CAGCCCCGCA GCCGATTCAA ACCATCCGTC CGGACAAAAT GCCCCGGCCA

101   ATACCGAATC CGACGGAAAA AACATTACCC TGCTCAACGC CTCATACGAT

151   GTGGCACGGG ATTTTTACAA AGAATACAAC CCCTTATTTA TCAAAACATA
```

-continued

```
201  CCAATCCGAA CACCCCGGCA CATCCGTCAG CATCCAACAG TCCCACGGCG
251  GCTCCAGCAA ACAGGCATTA TCCGTAGCCA ACGGCCTTCA AGCCGATGTC
301  GTAACCATGA ACCAATCCTC CGACATCGAC CTGCTCGAAA AAAAGGACT
351  GGTAGAAAAA GGCTGGCAAC AAGCCCTCCC CGACCACGCC GCGCCCTACA
401  CCAGCACTAT GGTTTTCCTT GTCCGAAAAA ACAACCCCAA ACAGATCCGC
451  GATTGGAACG ACCTTGCCAA AGACGGCGTT AACATCGTCA TCGCCAATCC
501  CAAAACCTCG GGCAACGGAC GCTACGCCTT CCTCGGCGCA TACGGTTACG
551  GTCTGAAAAC CACCAACGGC AACGAACAGG AAGCCCAAAA ACTCGTCGCA
601  TCCATCCTCA AAAACACCCC CGTTTTTGAA AACGGCGGAC GCkCgCCACC
651  ACCACCTTCA CACAACGCAA CATCGGCGAC GTACTCATCA CTTTTGAAAA
701  CGAAGCCAAC TACGTCAGCr AAAAACtGA
```

This corresponds to the amino acid sequence <SEQ ID 2842; ORF 927>:

```
m927.pep
  1  MKTYAPALYT AALLTACSPA ADSNHPSGQN APANTESDGK NITLLNASYD
 51  VARDFYKEYN PLFIKTYQSE HPGTSVSIQQ SHGGSSKQAL SVANGLQADV
101  VTMNQSSDID LLEKKGLVEK GWQQALPDHA APYTSTMVFL VRKNNPKQIR
151  DWNDLAKDGV NIVIANPKTS GNGRYAFLGA YGYGLKTTNG NEQEAQKLVA
201  SILKNTPVFE NGGRXPPPPS HNATSATYSS LLKTKPTTSA KN*
```

Computer analysis of this amino acid sequence gave the following results:
Homology with a Predicted ORF from *N. gonorrhoeae*
ORF 927 shows 94.2% identity over a 243 aa overlap with a predicted ORF (ORF 927.ng) from *N. gonorrhoeae*:

```
g927/m927
                  10         20         30         40         50         60
     g927.pep  MKTYAQALYTAALLTACSPAADSNHPSGQNAPANTESDGKNITLLNASYDVTRYFYKEYD
               |||| ||||||||||||||||||||||||||||||||||||||||||||: | |||||:
     m927      MKTYAPALYTAALLTACSPAADSNHPSGQNAPANTESDGKNITLLNASYDVARDFYKEYN
                  10         20         30         40         50         60

70         80         90        100        110        120
     g927.pep  HLFVGTYQSEHPGTSVSIQQSHGGFSKQALSVANGLQADVVTMNQSSDIDLLEKXGLVEK
               ||: |||||||||||||||||| |||||||||||||||||||||||||||||||| ||||
     m927      PLFIKTYQSEHPGTSVSIQQSHGGSSKQALSVANGLQADVVTMNQSSDIDLLEKKGLVEK
                  70         80         90        100        110        120

130        140        150        160        170
     g927.pep  GWQQALPDHAAPYTSTMVFLVRKNNPKQIRDWNDLAKDGVNIVIA--KTSGNGRYAFLGA
               ||||||||||||||||||||||||||||||||||||||||||||| |  ||||||||||||
     m927      GWQQALPDHAAPYTSTMVFLVRKNNPKQIRDWNDLAKDGVNIVIANPKTSGNGRYAFLGA
                 130        140        150        160        170        180

180        190        200        210        220        230
     g927.pep  YGYGLKANNGNEQEAQKLVASILKNTPVFENGGRXPPPPPSHNATSATYSSLLKTKPTTS
               ||||||::||||||||||||||||||||||||||||||| |||||||||||||||||||
     m927      YGYGLKTTNGNEQEAQKLVASILKNTPVFENGGRXPPPP-SHNATSATYSSLLKTKPTTS
                 190        200        210        220        230

240
     g927.pep  AKNX
               ||||
     m927      AKNX
                 240
```

The following partial DNA sequence was identified in *N. meningitidis* <SEQ ID 2843>:

```
a927.seq
     1  ATGAAAACCT ACGCACCGGC ACTCTATACC GCAGCCCTGC TCAGCGCCTG

51  CAGCCCCGCA GCCGATTCAA ACCATCCGTC CGGACAAAAT GCCCCGGCCA

101  ATACCGAATC CGACGGAAAA AACATTACCC TGCTCAACGC CTCATACGAT

151  GTGGCACGGG ATTTTTACAA AGAATACAAC CCCTTATTTA TCAAAACATA

201  CCAATCCGAA CACCCCGGCA CATCCGTCAG CATCCAACAG TCCCACGGCG

251  GCTCCAGCAA ACAGGCATTA TCCGTAGCCA ACGGCCTTCA AGCCGATGTC

301  GTAACCATGA ACCAATCCTC CGACATCGAC CTGCTCGAAA AAAAAGGACT

351  GGTAGAAAAA GGCTGGCAAC AAGCCCTCCC CGACCACGCC GCGCCCTACA

401  CCAGCACTAT GGTTTTCCTT GTCCGAAAAA ACAACCCCAA ACAGATCCGC

451  GATTGGAACG ACCTTGCCAA AGACGGCGTT AACATCGTCA TCGCCAATCC

501  CAAAACCTCG GGCAACGGAC GCTACGCCTT CCTCGGCGCA TACGGTTACG

551  GTCTGAAAAC CACCAACGGC AACGAACAGG AAGCCCAAAA ACTCGTCGCA

601  TCCATCCTCA AAAACACCCC CGTTTTTGAA AACGGCGGAC GCGCGCCACC

651  ACCACCTTCA CACAACGCAA CATCGGCGAC GTACTCATCA CTTTTGAAAA

701  CGAAGCCAAC TACGTCAGCA AAAAACTGA
```

This corresponds to the amino acid sequence <SEQ ID 2844; ORF 927.a>:

```
a927.pep
     1  MKTYAPALYT AALLSACSPA ADSNHPSGQN APANTESDGK NITLLNASYD

51  VARDFYKEYN PLFIKTYQSE HPGTSVSIQQ SHGGSSKQAL SVANGLQADV

101  VTMNQSSDID LLEKKGLVEK GWQQALPDHA APYTSTMVFL VRKNNPKQIR

151  DWNDLAKDGV NIVIANPKTS GNGRYAFLGA YGYGLKTTNG NEQEAQKLVA

201  SILKNTPVFE NGGRAPPPPS HNATSATYSS LLKTKPTTSA KN*
``` m927/a927 99.2% identity in 242 aa overlap

```
                   10        20        30        40        50        60
m927.pep   MKTYAPALYTAALLTACSPAADSNHPSGQNAPANTESDGKNITLLNASYDVARDFYKEYN
           ||||||||||||||:|||||||||||||||||||||||||||||||||||||||||||||||
a927       MKTYAPALYTAALLSACSPAADSNHPSGQNAPANTESDGKNITLLNASYDVARDFYKEYN
                   10        20        30        40        50        60

70        80        90       100       110       120
m927.pep   PLFIKTYQSEHPGTSVSIQQSHGGSSKQALSVANGLQADVVTMNQSSDIDLLEKKGLVEK
           ||||||||||||||||||||||||||||||||||||||||||||||||||||||||||||
a927       PLFIKTYQSEHPGTSVSIQQSHGGSSKQALSVANGLQADVVTMNQSSDIDLLEKKGLVEK
                   70        80        90       100       110       120

130       140       150       160       170       180
m927.pep   GWQQALPDHAAPYTSTMVFLVRKNNPKQIRDWNDLAKDGVNIVIANPKTSGNGRYAFLGA
           ||||||||||||||||||||||||||||||||||||||||||||||||||||||||||||
a927       GWQQALPDHAAPYTSTMVFLVRKNNPKQIRDWNDLAKDGVNIVIANPKTSGNGRYAFLGA
                  130       140       150       160       170       180

190       200       210       220       230       240
m927.pep   YGYGLKTTNGNEQEAQKLVASILKNTPVFENGGRXPPPPSHNATSATYSSLLKTKPTTSA
           |||||||||||||||||||||||||||||||||| |||||||||||||||||||||||||
a927       YGYGLKTTNGNEQEAQKLVASILKNTPVFENGGRAPPPPSHNATSATYSSLLKTKPTTSA
                  190       200       210       220       230       240 m927.pep   KNX
           |||
a927       KNX
```

The following partial DNA sequence was identified in *N. gonorrhoeae* <SEQ ID 2845>:

```
g929.seq
    1 ATGAAATTGG GTTTCAAACC GATACCCCTC GCCATTGCCG CAGTATTGTG
   51 CGCCCTGGTT TTGGCACTGC CCGTACccga CGGGGTCAAG CCTCAGGCTT
  101 GGACGCTGCT GGCTATGTTT GTCGGTGTGA TTGCCGCCAT TATCGGCAAG
  151 GTTATGCCGT TGGGCGCGCT GTCGATTATT GCCGTCGGGT TGGTCGCAGT
  201 AACCGGCGTA ACCGCCGACA AACCGGGCGC GGCGATGAGC GATGCGTTGA
  251 GTGCGTTCGC CAATCCGTTG ATTTGGCTGA TTGCCATCGC AGTTATGATT
  301 TCGCGCGGTT TGCTCAAAAC AGGGCTGGGG ATGCGTATCG GATATTTGTT
  351 TATCGCCGTT TTTGGAAGAA AAAcgctggG CATCGGTTAC AGTCTCGCTC
  401 TTTCCGAACT GCTGCTGGCT CCCGTTACCC CTTCCAATAC CGCGCGCGGC
  451 GGCGGCATTA TACATCcgaT TATGCagtcg attgCcggCA GttacggctC
  501 caatCCCGCA AAAGGCACag aaggcaagat gggtaAATAT TtggcTTtgg
  551 tcaattaTCA TTCcaaTCCC atttcgtcgg ctAtggctat taCTGcaact
  601 gCCCCcaaCC CTTTAATcgt caacttgatt gccGaaaaTt taggcagtag
  651 tttccgtCTT TCttgggggg cgTGGGcgtg ggcaaTGGCT Gttcccggcg
  701 ttatcgcctt TTtcgTTATG CCTTTGATTT TATATTTTTT GTATCCGCCT
  751 GAAATTAAAG AAACGCCCAA TGCTGttcAA TTTGCCAAAG ACCGTCTGAG
  801 CGAGATGGGT AAAATGtcgg CAGACGAAAT CATTATGGCG GTCATTTTCG
  851 GTATCTTGCT GCTGTTGTGG GCAGATGTTC CCGCCCTTAT TACCGGCAAT
  901 CACGCTTTTA GTATCAacgc caccGCCACC GCATTTATCG GATTAAGCCT
  951 GCTTTTGCTT TCCGGTGTAT TGACTTGGGA CGATGTTTTG AAAGAAAAAA
 1001 GCGCGTGGGA TACGATTATT TGGTTTGGCG CATTGATTAT GATGGCCGCA
 1051 TTTTTaAATA AActcggact gattaaatGG TTCTCCGGAG TGTTGGCGGA
 1101 AagtgtcggC GGTTTGGGCG TTAGCGGCAC GGCTGCGGGC GTAATCCTCG
 1151 TGCTTGCtta TATGTATGCG CATTATATGT TTGCCAGTAC TACTGCACAT
 1201 ATTACCGCTA TGTTCGGCGC ATTTCTCGCT GCTGCCGTTT CACTGAATGC
 1251 CCCGGCGATG CCGACTGCGC TGATGATGGC GGCCGCATCC AACATTATGA
 1301 TGACCCTCAC TCATTATGCG ACCGGTACTT CACCTGTGAT TTTCGGCTCG
 1351 GGCTACACCA CAATGGGAGA ATGGTGGAAG GCGGGTTTTA TCATGAGCGT
 1401 AGTCAATTTT CTGATTTTTT CCGTTATCGG CAGCATTTGG TGGAAAGTTC
 1451 TGGGATATTG GTAA
```

This corresponds to the amino acid sequence <SEQ ID 2846; ORF 929.ng>:

```
g929.pep
    1 MKLGFKPIPL AIAAVLCALV LALPVPDGVK PQAWTLLAMF VGVIAAIIGK
   51 VMPLGALSII AVGLVAVTGV TADKPGAAMS DALSAFANPL IWLIAIAVMI
  101 SRGLLKTGLG MRIGYLFIAV FGRKTLGIGY SLALSELLLA PVTPSNTARG
  151 GGIIHPIMQS IAGSYGSNPA KGTEGKMGKY LALVNYHSNP ISSAMAITAT
  201 APNPLIVNLI AENLGSSFRL SWGAWAWAMA VPGVIAFFVM PLILYFLYPP
```

```
251  EIKETPNAVQ FAKDRLSEMG KMSADEIIMA VIFGILLLLW ADVPALITGN

301  HAFSINATAT AFIGLSLLLL SGVLTWDDVL KEKSAWDTII WFGALIMMAA

351  FLNKLGLIKW FSGVLAESVG GLGVSGTAAG VILVLAYMYA HYMFASTTAH

401  ITAMFGAFLA AAVSLNAPAM PTALMMAAAS NIMMTLTHYA TGTSPVIFGS

451  GYTTMGEWWK AGFIMSVVNF LIFSVIGSIW WKVLGYW*
```

The following partial DNA sequence was identified in *N. meningitidis* <SEQ ID 2847>:

m929.seq

```
   1 ATGAAATTGG GTTTCAAACC GATACCCCTC GCCATTGCCG CAGTATTGTG
  51 CGCCCTGGTT TTGGCACTGC CCGTACCCGA CGGGGTCAAG CCTCAGGCTT
 101 GGACGCTGCT GGCCATGTTT GTCGGTGTGA TTGCCGCCAT TATCGGCAAG
 151 GCCATGCCGT TGGGCGCGCT GTCGATTATT GCCGTCGGGT TGGTCGCAGT
 201 AACCGGCGTA ACCGCCGACA AACCGGGCGC GGCGATGAGC GATGCGTTGA
 251 GTGCGTTCGC CAATCCGTTG ATTTGGCTGA TTGCCATCGC AGTTATGATT
 301 TCGCGCGGTT TGCTCAAAAC AGGGCTGGGG ATGCGTATCG GATATTTGTT
 351 TATCGCCGTT TTTGGAAGAA AAACGCTGGG CATCGGTTAC AGTCTCGCTC
 401 TTTCCGAACT GCTGCTGGCT CCCGTTACCC CTTCCAATAC CGCGCGCGGC
 451 GGCGGCATTA TACATCCGAT TATGCAGTCG ATTGCCGGCA GTTACGGCTC
 501 CAATCCCGCA AAAGGCACAG AAGGCAAGAT GGGTAAATAT TTGGCTTTGG
 551 TCAACTATCA TTCCAATCCC ATTTCGTCGG CTATGTTTAT TACTGCAACT
 601 GCCCCCAACC CTTTAATCGT CAACTTGATT GCCGAAAATT TAGGCAGTAG
 651 TTTCCGTCTT TCTTGGGGGG CGTGGGCGTG GGCAATGGCT GTTCCCGGCG
 701 TTATCGCCTT TTTCGTTATG CCTTTGATTT TATATTTwyT GTATCCGCCT
 751 GAAATTAAAG AAACGCCCAA TGCCGTTCAA TTTGCCAAAG ACCGTCTGAG
 801 GGAGATGGGT AAAATGTCGG CAGACGAAAT CATTATGGCG GTCATTTTCG
 851 GTATCTTGCT GCTGTTGTGG GCAGATGTTC CCGCCCTTAT TACCGGCAAT
 901 CACGCTTTTA GTATCAACGC CACCGCCACC GCATTTATCG GATTAAGCCT
 951 GCTTTTGCTT TCCGGTGTAT TGACTTGGGA CGATGTTTTG AAAGAAAAAA
1001 GCGCGTGGGA TACGATTATT TGGTTTGGCG CATTGATTAT GATGGCCGCA
1051 TTTTTAAATA AACTCGGACT GATTAAATGG TTCTCCGGAG TGTTGGCGGA
1101 AAGTGTCGGC GGTTTGGGCG TTAGCGGCAC GGCTGCGGGC GTAATCCTCG
1151 TGCTTGCTTA TATGTATGCG CATTATATGT TTGCCAGTAC TACTGCACAT
1201 ATTACCGCTA TGTTCGGCGC ATTTTTCGCT GCTGCCGTTT CACTGAATGC
1251 CCCGGCGATG CCGACCGCGC TGATGATGGC GgCCGCATCC AACATTATGA
1301 TGACCCTCAC TCATTATGCG ACCGGTACTT CGCCTGTGAT TTTCGGTTCG
1351 GGCTACACCA CAATGGGAGA ATGGTGGAAG GCGGGTTTTA TCATGAGCGT
1401 AGTCAATTTT CTGATTTTTT TCGTTATCGG CAGCATTTGG TGGAAAGTTC
1451 TGGGGTATTG GTAA
```

This corresponds to the amino acid sequence <SEQ ID 2848; ORF 929>:

```
m929.pep
    1  MKLGFKPIPL AIAAVLCALV LALPVPDGVK PQAWTLLAMF VGVIAAIIGK

51  AMPLGALSII AVGLVAVTGV TADKPGAAMS DALSAFANPL IWLIAIAVMI

101  SRGLLKTGLG MRIGYLFIAV FGRKTLGIGY SLALSELLLA PVTPSNTARG

151  GGIIHPIMQS IAGSYGSNPA KGTEGKMGKY LALVNYHSNP ISSAMFITAT

201  APNPLIVNLI AENLGSSFRL SWGAWAWAMA VPGVIAFFVM PLILYXLYPP

251  EIKETPNAVQ FAKDRLREMG KMSADEIIMA VIFGILLLLW ADVPALITGN

301  HAFSINATAT AFIGLSLLLL SGVLTWDDVL KEKSAWDTII WFGALIMMAA

351  FLNKLGLIKW FSGVLAESVG GLGVSGTAAG VILVLAYMYA HYMFASTTAH

401  ITAMFGAFFA AAVSLNAPAM PTALMMAAAS NIMMTLTHYA TGTSPVIFGS

451  GYTTMGEWWK AGFIMSVVNF LIFFVIGSIW WKVLGYW*
```

Computer analysis of this amino acid sequence gave the following results:
Homology with a Predicted ORF from *N. gonorrhoeae*
ORF 929 shows 98.8% identity over a 487 aa overlap with a predicted ORF (ORF 929.ng) from *N. gonorrhoeae*:

```
  g929/m929
                 10        20        30        40        50        60
      g929.pep  MKLGFKPIPLAIAAVLCALVLALPVPDGVKPQAWTLLAMFVGVIAAIIGKVMPLGALSII
                ||||||||||||||||||||||||||||||||||||||||||||||||||:||||||||
      m929      MKLGFKPIPLAIAAVLCALVLALPVPDGVKPQAWTLLAMFVGVIAAIIGKAMPLGALSII
                 10        20        30        40        50        60

70        80        90       100       110       120
      g929.pep  AVGLVAVTGVTADKPGAAMSDALSAFANPLIWLIAIAVMISRGLLKTGLGMRIGYLFIAV
                ||||||||||||||||||||||||||||||||||||||||||||||||||||||||||||
      m929      AVGLVAVTGVTADKPGAAMSDALSAFANPLIWLIAIAVMISRGLLKTGLGMRIGYLFIAV
                 70        80        90       100       110       120

130       140       150       160       170       180
      g929.pep  FGRKTLGIGYSLALSELLLAPVTPSNTARGGGIIHPIMQSIAGSYGSNPAKGTEGKMGKY
                ||||||||||||||||||||||||||||||||||||||||||||||||||||||||||||
      m929      FGRKTLGIGYSLALSELLLAPVTPSNTARGGGIIHPIMQSIAGSYGSNPAKGTEGKMGKY
                130       140       150       160       170       180

190       200       210       220       230       240
      g929.pep  LALVNYHSNPISSAMAITATAPNPLIVNLIAENLGSSFRLSWGAWAWAMAVPGVIAFFVM
                |||||||||||||||| |||||||||||||||||||||||||||||||||||||||||||
      m929      LALVNYHSNPISSAMFITATAPNPLIVNLIAENLGSSFRLSWGAWAWAMAVPGVIAFFVM
                190       200       210       220       230       240

250       260       270       280       290       300
      g929.pep  PLILYFLYPPEIKETPNAVQFAKDRLSEMGKMSADEIIMAVIFGILLLLWADVPALITGN
                |||||:||||||||||||||||||||||||||||||||||||||||||||||||||||||
      m929      PLILYXLYPPEIKETPNAVQFAKDRLREMGKMSADEIIMAVIFGILLLLWADVPALITGN
                250       260       270       280       290       300

310       320       330       340       350       360
      g929.pep  HAFSINATATAFIGLSLLLLSGVLTWDDVLKEKSAWDTIIWFGALIMMAAFLNKLGLIKW
                ||||||||||||||||||||||||||||||||||||||||||||||||||||||||||||
      m929      HAFSINATATAFIGLSLLLLSGVLTWDDVLKEKSAWDTIIWFGALIMMAAFLNKLGLIKW
                310       320       330       340       350       360

370       380       390       400       410       420
      g929.pep  FSGVLAESVGGLGVSGTAAGVILVLAYMYAHYMFASTTAHITAMFGAFLAAAVSLNAPAM
                |||||||||||||||||||||||||||||||||||||||||||||||||:||||||||||
      m929      FSGVLAESVGGLGVSGTAAGVILVLAYMYAHYMFASTTAHITAMFGAFFAAAVSLNAPAM
                370       380       390       400       410       420

430       440       450       460       470       480
      g929.pep  PTALMMAAASNIMMTLTHYATGTSPVIFGSGYTTMGEWWKAGFIMSVVNPLIFSVIGGIW
                |||||||||||||||||||||||||||||||||||||||||||||||||||||||||||
      m929      PTALMMAAASNIMMTLTHYATGTSPVIFGSGYTTMGEWWKAGFIMSVVNPLIFFVIGGIW
                430       440       450       460       470       480 g929.pep  WKVLGYWX
                ||||||||
      m929      WKVLGYWX
```

The following partial DNA sequence was identified in *N. meningitidis* <SEQ ID 2849>:

```
a929.seq
     1  ATGAAATTGG GTTTCAAACC GATACCCCTC GCCATTGCCG CAGTATTGTG
    51  CGCCTTGGTT TTGGCACTGC CCGTACCCGA CGGGGTCAAG CCTCAGGCTT
   101  GGACGCTGCT GGCCATGTTT ATCGGTGTGA TTGCCGCCAT TATCGGCAAG
   151  GCCATGCCGT TGGGTGCGCT GTCGATTATT GCCGTCGGGT TGGTCGCAGT
   201  AACCGGCGTA ACCGCCGACA AACCGGGTGC GGCGATGAGC GATGCGTTGA
   251  GTGCGTTCGC CAATCCGTTG ATTTGGCTGA TTGCCATCGC AGTTATGATT
   301  TCGCGCGGTT TGCTCAAAAC AGGGCTGGGG ATGCGTATCG GATATTTGTT
   351  TATCGCCGTT TTTGGAAGAA AAACGCTGGG CATCGGTTAC AGTCTCGCTC
   401  TTTCCGAACT GCTGCTGGCT CCCGTTACCC CTTCCAATAC CGCGCGCGGC
   451  GGCGGCATTA TACATCCGAT TATGCAGTCG ATTGCCGGCA GTTACGGCTC
   501  CAATCCCGCA AAAGGCACAG AAGGCAAGAT GGGTAAATAT TTGGCTTTGG
   551  TCAACTATCA TTCCAATCCC ATTTCGTCGG CTATGTTTAT TACTGCAACT
   601  GCCCCCAACC CTTTAATCGT CAACTTGATT GCCGAAAATT TAGGCAGTAG
   651  TTTCCGTCTT TCTTGGGGGG CGTGGGCGTG GGCAATGGCT GTTCCCGGCG
   701  TTATCGCCTT TTTCGTTATG CCTTTGATTT TATATTTTTT GTATCCGCCT
   751  GAAATTAAAG AAACGCCCAA TGCCGTTCAA TTTGCCAAAG ACCGTCTGAG
   801  GGAGATGGGT AAAATGTCGG CAGACGAAAT CATTATGGCG GTCATTTTCG
   851  GTATCTTGTT GCTGTTGTGG GCAGATGTTC CCGCCCTTAT TACCGGCAAT
   901  CACGCTTTTA GTATCAACGC CACCGCCACC GCATTTATCG GATTAAGCCT
   951  GCTTTTGCTT TCCGGTGTAT TGACTTGGGA CGATGTTTTG AAAGAAAAAA
  1001  GCGCGTGGGA TACGATTATT TGGTTTGGCG CATTGATTAT GATGGCCGCA
  1051  TTTTTAAATA AACTCGGACT GATTAAATGG TTCTCCGGAG TGTTGGCGGA
  1101  AAGTGTCGGC GGTTTGGGCG TTAGCGGCAC GGCTGCGGGC GTAATCCTCG
  1151  TGCTTGCTTA TATGTATGCG CATTATATGT TTGCCAGTAC TACTGCACAT
  1201  ATTACCGCTA TGTTCGGCGC ATTTTTCGCT GCTGCCGTTT CACTGAATGC
  1251  CCCGGCGATG CCGACCGCGC TGATGATGGC GGCCGCATCT AACATTATGA
  1301  TGACCCTCAC TCATTATGCG ACCGGTACTT CGCCTGTGAT TTTCGGTTCG
  1351  GGCTACACCA CAATGGGAGA ATGGTGGAAG GCGGGTTTTA TCATGAGCGT
  1401  AGTCAATTTT CTGATTTTTT TCGTTATCGG CAGCATTTGG TGGAAAGTTC
  1451  TGGGGTATTG GTAA
```

This corresponds to the amino acid sequence <SEQ ID 2850; ORF 929.a>:

```
a929.pep
     1  MKLGFKPIPL AIAAVLCALV LALPVPDGVK PQAWTLLAMF IGVIAAIIGK
    51  AMPLGALSII AVGLVAVTGV TADKPGAAMS DALSAFANPL IWLIAIAVMI
   101  SRGLLKTGLG MRIGYLFIAV FGRKTLGIGY SLALSELLLA PVTPSNTARG
   151  GGIIHPIMQS IAGSYGSNPA KGTEGKMGKY LALVNYHSNP ISSAMFITAT
   201  APNPLIVNLI AENLGSSFRL SWGAWAWAMA VPGVIAFFVM PLILYFLYPP
```

```
251  EIKETPNAVQ FAKDRLREMG KMSADEIIMA VIFGILLLLW ADVPALITGN

301  HAFSINATAT AFIGLSLLLL SGVLTWDDVL KEKSAWDTII WFGALIMMAA

351  FLNKLGLIKW FSGVLAESVG GLGVSGTAAG VILVLAYMYA HYMFASTTAH

401  ITAMFGAFFA AAVSLNAPAM PTALMMAAAS NIMMTLTHYA TGTSPVIFGS

451  GYTTMGEWWK AGFIMSVVNF LIFFVIGSIW WKVLGYW*
``` m929/a929 99.6% identity in 487 aa overlap

```
                    10         20         30         40         50         60
m929.pep    MKLGFKPIPLAIAAVLCALVLALPVPDGVKPQAWTLLAMFVGVIAAIIGKVMPLGALSII
            ||||||||||||||||||||||||||||||||||||||:|||||||||||||||||||||
a929        MKLGFKPIPLAIAAVLCALVLALPVPDGVKPQAWTLLAMFIGVIAAIIGKvMPLGALSII
                    10         20         30         40         50         60

70         80         90        100        110        120
m929.pep    AVGLVAVTGVTADKPGAAMSDALSAFANPLIWLIAIAVMISRGLLKTGLGMRIGYLFIAV
            ||||||||||||||||||||||||||||||||||||||||||||||||||||||||||||
a929        AVGLVAVTGVTADKPGAAMSDALSAFANPLIWLIAIAVMISRGLLKTGLGMRIGYLFIAV
                    70         80         90        100        110        120

130        140        150        160        170        180
m929.pep    FGRKTLGIGYSLALSELLLAPVTPSNTARGGGIIHPIMQSIAGSYGSNPAKGTEGKMGKY
            ||||||||||||||||||||||||||||||||||||||||||||||||||||||||||||
a929        FGRKTLGIGYSLALSELLLAPVTPSNTARGGGIIHPIMQSIAGSYGSNPAKGTEGKMGKY
                   130        140        150        160        170        180

190        200        210        220        230        240
m929.pep    LALVNYHSNPISSAMAITATAPNPLIVNLIAENLGSSFRLSWGAWAWAMAVPGVIAFFVM
            |||||||||||||||||||||||||||||||||||||||||||||||||||||||||||
a929        LALVNYHSNPISSAMaITATAPNPLIVNLIAENLGSSFRLSWGAWAWAMAVPGVIAFFVM
                   190        200        210        220        230        240

250        260        270        280        290        300
m929.pep    PLILYXLYPPEIKETPNAVQFAKDRLSEMGKMSADEIIMAVIFGILLLLWADVPALITGN
            |||||  |||||||||||||||||||||||||||||||||||||||||||||||||||||
a929        PLILYFLYPPEIKETPNAVQFAKDRLSEMGKMSADEIIMAVIFGILLLLWADVPALITGN
                   250        260        270        280        290        300

310        320        330        340        350        360
m929.pep    HAFSINATATAFIGLSLLLLSGVLTWDDVLKEKSAWDTIIWFGALIMMAAFLNKLGLIKW
            ||||||||||||||||||||||||||||||||||||||||||||||||||||||||||||
a929        HAFSINATATAFIGLSLLLLSGVLTWDDVLKEKSAWDTIIWFGALIMMAAFLNKLGLIKW
                   310        320        330        340        350        360

370        380        390        400        410        420
m929.pep    FSGVLAESVGGLGVSGTAAGVILVLAYMYAHYMFASTTAHITAMFGAFFAAAVSLNAPAM
            ||||||||||||||||||||||||||||||||||||||||||||||||||||||||||||
a929        FSGVLAESVGGLGVSGTAAGVILVLAYMYAHYMFASTTAHITAMFGAFFAAAVSLNAPAM
                   370        380        390        400        410        420

430        440        450        460        470        480
m929.pep    PTALMMAAASNIMMTLTHYATGTSPVIFGSGYTTMGEWWKAGFIMSVVNFLIFFVIGGIW
            ||||||||||||||||||||||||||||||||||||||||||||||||||||||||||||
a929        PTALMMAAASNIMMTLTHYATGTSPVIFGSGYTTMGEWWKAGFIMSVVNFLIFFVIGGIW
                   430        440        450        460        470        480 m929.pep    WKVLGYWX
            ||||||||
a929        WKVLGYWX
```

50 g930.seq not found yet
g930.pep not found yet
The following partial DNA sequence was identified in *N. meningitidis* <SEQ ID 2851>:

```
m930.seq
    1  ATGAAACTTC CTTTATCCTA TTTGCCTAAT ATTCGCTTTT TGTCTTGGTG

51  CTGCTTATTG GCAGGTATCA TTGCTCCTGC TACTTTGTTG GCCTCCCCCA

101  ACCCTGCCGA AATCCGTATG CAGCAAGATA TTCAGCAACG CCAACGCGAA

151  GAGCAGTTGC GCCAAACCAT GCAGCCTGAA AGCGATGTGC GTTTGCATCA

201  AAAAAACACG GGGGAAACGG TTAATCAGTT GATGGGCGAT GACAGCAGCC

251  AACCGTGTTT TGCCATTAAC GAAtGGGTGT TGGAAGGCGA ACACCATGCT
```

-continued
```
301   CGGTTTCAGT TTGCCCTAAA ACGTGCCTTG CGCGAAACGG GTTTTCAGGC

351   TGGCAAGTGT CTGCATGCGG GCAACATTAA TCAAATCATG TCCTTAGCAC

401   AAAATGCTTT GATCGGCAGG GGATATACCA CGACCCGTAT CTTGGCTGCG

451   CCACAGGATT TGAATAgTGG aAGCTTCAAT TAA
```

This corresponds to the amino acid sequence <SEQ ID 2852; ORF 930>:

```
m930.pep
    1   MKLPLSYLPN IRFLSWCCLL AGIIAPATLL ASPNPAEIRM QQDIQQRQRE

51   EQLRQTMQPE SDVRLHQKNT GETVNQLMGD DSSQPCFAIN EWVLEGEHHA

101   RFQFALKRAL RETGFQAGKC LHAGNINQIM SLAQNALIGR GYTTTRILAA

151   PQDLNSGSFN *
```

The following partial DNA sequence was identified in *N. gonorrhoeae* <SEQ ID 2853>:

```
g930-1.seq (partial)
    1       GGCAAGTGTC TGCATGCGGG CGACATTAAT CAAATCATGT CCTTAGCACA

51       AAATGCTTTG ATCGGCAGGG GATATACCAC GACCCGTATC TTGGCTGCGC

101       CACAGGATTT GAATAGTGGC AAGCTTCAAT TAACCCTGAT GCCGGGCTAT

151       CTGCGCTCCA TACGAATCGA TCGGTCCAAC GATGATCAAA CCCATGCAGG

201       ACGTATTGCA GCATTCCAAA ACAAATTTCC CACCCGCTCG AACGATCTGT

251       TGAATCTGCG TGATTTGGAA CAAGGACTGG AAAATCTCAA ATGTCTCCCG

301       ACTGCGGAAG CCGATCTCCA AATCGTTCCC GTAGAGAGAG AACCAAACCA

351       AAGTGATGTC GTGGTGCAAT GGCGGTAACG TCTGCTGCCC TACTGTGTGA

401       GTGTGGGGAT GGATAATTCG GGTAGTGAGG CGACAGGAAA ATACCAAGGA

451       AATATCACTT TCTCTGCCGA CAATCCTTTT GGACTGAGTG ATATGTTCTA

501       TGTAAATTAT GGACGTTCAA TTGGCGGTAC GCCCGATGAG GAAAATTTTG

551       ACGGCCATCG CAAAGAAGGC GGATCAAACA ATTACGCCGT ACATTATTCA

601       GCCCCTTTCG GTAAATGGAC ATGGGCATTC AATCACAATG GCTACCGTTA

651       CCATCAGGCG GTTTCCGGAT TATCGGAAGT CTATGACTAT AATGGAAAAA

701       GTTACAACAC TGATTTCGGC TTCAACCGCC TGTTGTATCG TGATGCCAAA

751       CGCAAAACCT ATCTCAGTGT AAAACTGTGG ACGAGGGAAA CAAAAAGTTA

801       CATTGATGAT GCCGAACTGA CTGTACAACG GCGTAAAACC ACAGGTTGGT

851       TGGCAGAACT TTCCCACAAA GGATATATCG GTCGCAGTAC GGCAGATTTT

901       AAGTTGAAAT ATAAACACGG CACCGGCATG AAAGATGCTC TGCGCGCGCC

951       TGAAGAAGCC TTTGGCGAAG GCACGTCACG TATGAAAATT TGGACGGCAT

1001       CGGCTGATGT AAATACTCCT TTTCAAATCG GTAAACAGCT ATTTGCCTAT

1051       GACACATCCG TTCATGCACA ATGGAACAAA ACCCCGCTAA CATCGCAAGA

1101       CAAACTGGCT ATCGGCGGAC ACCACACCGT ACGTGGCTTC GACGGTGAAA

1151       TGAGTTTGCC TGCCGAGCGG GGATGGTATT GGCGCAACGA TTTGAGCTGG

1201       CAATTTAAAC CAGGCCATCA GCTTTATCTT GGGGCTGATG TAGGACATGT

1251       TTCAGGACAA TCCGCCAAAT GGTTATCGGG CCAAACTCTA GCCGGCACAG
```

```
1301    CAATTGGGAT ACGCGGGCAG ATAAAGCTTG GCGGCAACCT GCATTACGAT

1351    ATATTTACCG GCCGTGCATT GAAAAAGCCC GAATATTTTC AGACGAAGAA

1401    ATGGGTAACG GGGTTTCAGG TGGGTTATTC GTTTTGA
```

This corresponds to the amino acid sequence <SEQ ID 2854; ORF 930-1.ng>:

```
g930-1.pep (partial)
     1    GKCLHAGDIN QIMSLAQNAL IGRGYTTTRI LAAPQDLNSG KLQLTLMPGY

51    LRSIRIDRSN DDQTHAGRIA AFQNKFPTRS NDLLNLRDLE QGLENLKCLP

101    TAEADLQIVP VEREPNQSDV VVQWR*RLLP YCVSVGMDNS GSEATGKYQG

151    NITFSADNPF GLSDMFYVNY GRSIGGTPDE ENFDGHRKEG GSNNYAVHYS

201    APFGKWTWAF NHNGYRYHQA VSGLSEVYDY NGKSYNTDFG FNRLLYRDAK

251    RKTYLSVKLW TRETKSYIDD AELTVQRRKT TGWLAELSHK GYIGRSTADF

301    KLKYKHGTGM KDALRAPEEA FGEGTSRMKI WTASADVNTP FQIGKQLFAY

351    DTSVHAQWNK TPLTSQDKLA IGGHHTVRGF DGEMSLPAER GWYWRNDLSW

401    QFKPGHQLYL GADVGHVSGQ SAKWLSGQTL AGTAIGIRGQ IKLGGNLHYD

451    IFTGRALKKP EYFQTKKWVT GFQVGYSF*
```

The following partial DNA sequence was identified in *N. meningitidis* <SEQ ID 2855>:

```
m930-1.seq
     1    ATGAAACTTC CTTTATCCTA TTTGCCTAAT ATTCGCTTTT TGTCTTGGTG

51    CTGCTTATTG GCAGGTATCA TTGCTCCTGC TACTTTGTTG GCCTCCCCCA

101    ACCCTGCCGA AATCCGTATG CAGCAAGATA TTCAGCAACG CCAACGCGAA

151    GAGCAGTTGC GCCAAACCAT GCAGCCTGAA AGCGATGTGC GTTTGCATCA

201    AAAAAACACG GGGGAAACGG TTAATCAGTT GATGGGCGAT GACAGCAGCC

251    AACCGTGTTT TGCCATTAAC GAAGTGGTGT TGGAAGGCGA ACACCATGCT

301    CGGTTTCAGT TTGCCCTAAA ACGTGCCTTG CGCGAAACGG GTTTTCAGGC

351    TGGCAAGTGT CTGCATGCGG GCAACATTAA TCAAATCATG TCCTTAGCAC

401    AAAATGCTTT GATCGGCAGG GGATATACCA CGACCCGTAT CTTGGCTGCG

451    CCACAGGATT TGAATAGTGG CAAGCTTCAA TTAACCCTGA TACCGAGCTA

501    TCTGCGCTCC ATACGAATCG ATCGGTCTAA CGATGATCAA ACCCATGCAG

551    GACGTATTGC AGCATTCCAG AACAAATTTC CCACCCGCTC GAACGATCTG

601    TTGAATCTGC GTGATTTGGA ACAAGGACTG GAAAATCTCA AACGTCTCCC

651    GACTGCGGAA GCCGATCTCC AAATCGTTCC CGTAGAGGGA GAACCAAACC

701    AAAGTGATGT CGTGGTGCAA TGGCGGCAAC GTCTGCTGCC CTACCGTGTG

751    AGTGTGGGGA TGGATAATTC GGGTAGTGAG GCGACAGGAA AATACCAAGG

801    AAATATCACT TTCTCTGCCG ACAATCCTTT GGGACTGAGT GATATGTTCT

851    ATGTAAATTA TGGACGTTCG ATTGGCGGTA CGCCCGATGA GGAAAGTTTT

901    GACGGCCATC GCAAAGAAGG CGGATCAAAC AATTACGCCG TACATTATTC

951    AGCCCCTTTC GGTAAATGGA CATGGGCATT CAATCACAAT GGCTACCGTT

1001    ACCATCAGGC AGTTTCCGGA TTATCGGAAG TCTATGACTA TAATGGAAAA
```

```
-continued
1051    AGTTACAATA CTGATTTCGG CTTCAACCGC CTGTTGTATC GTGATGCCAA

1101    ACGCAAAACC TATCTCGGTG TAAAACTGTG GATGAGGGAA ACAAAAAGTT

1151    ACATTGATGA TGCCGAACTG ACTGTACAAC GGCGTAAAAC TGCGGGTTGG

1201    TTGGCAGAAC TTTCCCACAA AGAATATATC GGTCGCAGTA CGGCAGATTT

1251    TAAGTTGAAA TATAAACGCG GCACCGGCAT GAAAGATGCT CTGCGCGCGC

1301    CTGAAGAAGC CTTTGGCGAA GGCACGTCAC GTATGAAAAT TTGGACGGCA

1351    TCGGCTGATG TAAATACTCC TTTTCAAATC GGTAAACAGC TATTTGCCTA

1401    TGACACATCC GTTCATGCAC AATGGAACAA AACCCCGCTA ACATCGCAAG

1451    ACAAACTGGC TATCGGCGGA CACCACACCG TACGTGGCTT CGACGGTGAA

1501    ATGAGTTTGT CTGCCGAGCG GGGATGGTAT TGGCGCAACG ATTTGAGCTG

1551    GCAATTTAAA CCAGGCCATC AGCTTTATCT TGGGGCTGAT GTAGGACATG

1601    TTTCAGGACA ATCCGCCAAA TGGTTATCGG GCCAAACTCT AGTCGGCACA

1651    GCAATTGGGA TACGCGGGCA GATAAAGCTT GGCGGCAACC TGCATTACGA

1701    TATATTTACC GGCCGCGCAT TGAAAAAGCC CGAATTTTTC CAATCAAGGA

1751    AATGGGCAAG CGGTTTTCAG GTAGGCTATA CGTTTTAA
```

This corresponds to the amino acid sequence <SEQ ID 2856; ORF 930-1>:

```
m930-1.pep
    1    MKLPLSYLPN IRFLSWCCLL AGIIAPATLL ASPNPAEIRM QQDIQQRQRE

51    EQLRQTMQPE SDVRLHQKNT GETVNQLMGD DSSQPCFAIN EVVLEGEHHA

101    RFQFALKRAL RETGFQAGKC LHAGNINQIM SLAQNALIGR GYTTTRILAA

151    PQDLNSGKLQ LTLIPSYLRS IRIDRSNDDQ THAGRIAAFQ NKFPTRSNDL

201    LNLRDLEQGL ENLKRLPTAE ADLQIVPVEG EPNQSDVVVQ WRQRLLPYRV

251    SVGMDNSGSE ATGKYQGNIT FSADNPLGLS DMFYVNYGRS IGGTPDEESF

301    DGHRKEGGSN NYAVHYSAPF GKWTWAFNHN GYRYHQAVSG LSEVYDYNGK

351    SYNTDFGFNR LLYRDAKRKT YLGVKLWMRE TKSYIDDAEL TVQRRKTAGW

401    LAELSHKEYI GRSTADFKLK YKRGTGMKDA LRAPEEAFGE GTSRMKIWTA

451    SADVNTPFQI GKQLFAYDTS VHAQWNKTPL TSQDKLAIGG HHTVRGFDGE

501    MSLSAERGWY WRNDLSWQFK PGHQLYLGAD VGHVSGQSAK WLSGQTLVGT

551    AIGIRGQIKL GGNLHYDIFT GRALKKPEFF QSRKWASGFQ VGYTF*
``` m930-1/g930-1 95.4% identity in 478 aa overlap

```
                  90        100       110       120       130       140
    m930-1.pep   AINEVVLEGEHHARFQFALKRALRETGFQAGKCLHAGNINQIMSLAQNALIGRGYTTTRI
                                        ||||||||:||||||||||||||||||||||
    g930-1.pep                          GKCLHAGDINQIMSLAQNALIGRGYTTTRI
                                               10        20        30

150       160       170       180       190       200
    m930-1.pep   LAAPQDLNSGKLQLTLIPSYLRSIRIDRSNDDQTHAGRIAAFQNKFPTRSNDLLNLRDLE
                 ||||||||||||||||:|:|||||||||||||||||||||||||||||||||||||||||
    g930-1.pep   LAAPQDLNSGKLQLTLMPGYLRSIRIDRSNDDQTHAGRIAAFQNKFPTRSNDLLNLRDLE
                        40        50        60        70        80        90

210       220       230       240       250       260
    m930-1.pep   QGLENLKRLPTAEADLQIVPVEGEPNQSDVVVQWRQRLLPYRVSVGMDNSGSEATGKYQG
                 |||||| |||||||||||||||| |||||||||||:|||| ||||||||||||||||||
    g930-1.pep   QGLENLKCLPTAEADLQIVPVEREPNQSDVVVQWRXRLLPYCVSVGMDNSGSEATGKYQG
                        100       110       120       130       140       150
```

```
             270       280       290       300       310       320
m930-1.pep   NITFSADNPLGLSDMFYVNYGRSIGGTPDEESFDGHRKEGGSNNYAVHYSAPFGKWTWAF
             ||||||||:||||||||||||||||||||:|||||||||||||||||||||||||||||
g930-1.pep   NITFSADNPFGLSDMFYVNYGRSIGGTPDEENFDGHRKEGGSNNYAVHYSAPFGKWTWAF
             160       170       180       190       200       210

330       340       350       360       370       380
m930-1.pep   NHNGYRYHQAVSGLSEVYDYNGKSYNTDFGFNRLLYRDAKRKTYLGVKLWMRETKSYIDD
             |||||||||||||||||||||||||||||||||||||||||||||:||||:|||||||||
g930-1.pep   NHNGYRYHQAVSGLSEVYDYNGKSYNTDFGFNRLLYRDAKRKTYLSVKLWTRETKSYIDD
             220       230       240       250       260       270

390       400       410       420       430       440
m930-1.pep   AELTVQRRKTAGWLAELSHKEYIGRSTADFKLKYKRGTGMKDALRAPEEAFGEGTSRMKI
             ||||||||||:||||||||||||  |||||||||||:|||||||||||||||||||||||
g930-1.pep   AELTVQRRKTTGWLAELSHKGYIGRSTADFKLKYKHGTGMKDALRAPEEAFGEGTSRMKI
             280       290       300       310       320       330

450       460       470       480       490       500
m930-1.pep   WTASADVNTPFQIGKQLFAYDTSVHAQWNKTPLTSQDKLAIGGHHTVRGFDGEMSLSAER
             ||||||||||||||||||||||||||||||||||||||||||||||||||||||||| |||
g930-1.pep   WTASADVNTPFQIGKQLFAYDTSVHAQWNKTPLTSQDKLAIGGHHTVRGFDGEMSLPAER
             340       350       360       370       380       390

510       520       530       540       550       560
m930-1.pep   GWYWRNDLSWQFKPGHQLYLGADVGHVSGQSAKWLSGQTLVGTAIGIRGQIKLGGNLHYD
             ||||||||||||||||||||||||||||||||||||||||||||||||||||||||||||
g930-1.pep   GWYWRNDLSWQFKPGHQLYLGADVGHVSGQSAKWLSGQTLAGTAIGIRGQIKLGGNLHYD
             400       410       420       430       440       450

570       580       590
m930-1.pep   IFTGRALKKPEFFQSRKWASGFQVGYTF
             ||||||||||:||::||::|||||:|
g930-1.pep   IFTGRALKKPEYFQTKKWVTGFQVGYSFX
             460       470
``` a930-1.seq not yet found
a930-1.pep not yet found
The following partial DNA sequence was identified in *N. gonorrhoeae* <SEQ ID 2857>:

```
g931.seq
   1  ATGAAACCCA AATTCAAAAC CGTTTTAACC GCGCTGCTTT TGGCGGTTTC

51  CCTGCCGTCT ATGGCGGCAA CCCGCGTCCT GATGGAAACC GATATGGGCA

101  ATATCCGTTT GGTTTTGGAC GAATCCAAAG CCTCCAAAAC CGTTGCCAAT

151  TTCGTGCGCT ATGCCCGAAA AGGCTTTTAC GACAACACGA TTTTCCACCG

201  CGTcatCGGC GGCTTCGTCA TCCAAGGCGA CGGATTGACC GAGGACTTGG

251  TGCAAAAGGC AACCGATAAG GCCGTTGCCA ACGAATCCGG caacgGCTTG

301  AAAAACACCG TCGGCACCAT CGCAATGGCG CGGACGGCAG CCCCCGATTC

351  CGCCGCCGCC CAATTCTTTA TCAATCTGGC GGACAACGGT TCGCTCGACT

401  ACAAAAACGG ACAATACGGC TACACCGTTT CGGCAGGGT AGAAAGCGGA

451  ATGGACACCG TTTCCAAAAT CGCCCGCGTC AAAACCGCCA CGCGCGGCTT

501  TTATCAAAAC GTACCCGTAC AGCCCGTCAA AATCCGTCGC GTTGTTGTCG

551  GGCAGTAACA CGCAGACAGA CGTTCAGACG GCGTCGCCCG TTTCCCAAAA

601  AACGCCGTTT AA
```

This corresponds to the amino acid sequence <SEQ ID 2858; ORF 931.ng>:

```
g931.pep
   1  MKPKFKTVLT ALLLAVSLPS MAATRVLMET DMGNIRLVLD ESKASKTVAN

51  FVRYARKGFY DNTIFHRVIG GFVIQGDGLT EDLVQKATDK AVANESGNGL

101  KNTVGTIAMA RTAAPDSAAA QFFINLADNG SLDYKNGQYG YTVFGRVESG

151  MDTVSKIARV KTATRGFYQN VPVQPVKIRR VVVGQ*
```

The following partial DNA sequence was identified in *N. meningitidis* <SEQ ID 2859>:

```
m931.seq
    1   ATGAAACCCA AATTCAAAAC CGTTTTAACC GCGCTGCTTT TGGCGGTTTC

51   CCTGCCGTCT ATGGCGGCAA CCCATGTTTT GATGGAAACC GATATGGGCA

101   ATATCCGTTT GGTTTTGGAC GAATCCAAAG CCCCCAAAAC CGTTGCTAAT

151   TTCGTGCGCT ATGCCCGAAA AGGCTTTTAC GACGACACCG TTTTTCACCG

201   CGTTATCGAC GGTTTTGTTA TCCAGGGCGG TGGATTGACC GAGGACTTGG

251   CACAAAAGGC AAGCGATAAG GCCGTTGCCA ACGAATCCGG CAACGGCTTG

301   AAAAACACCG CCGGCACCAT CGCCATGGCG CGGACGACAG CCCCCGATTC

351   CGCCACCAGC CAATTCTTTA TCAATCTGGC GGACcA.kCT TCGCTCGACT

401   ACAAAAACGG ACAATACGGC TATACCGTTT TCGGCAGGGT CGAAAGCGGC

451   ATGAACACCG TTTCCAAAAT CGCCCGCGTC AAAACCGCCA CGCGCGGCTT

501   TTATCAAAAC GTACCCGTAC AGCCCGTCAA AATCCGTCGC GTTGTTGTCG

551   GGCAGTAA
```

This corresponds to the amino acid sequence <SEQ ID 2860; ORF 931>:

```
m931.pep..
    1   MKPKFKTVLT ALLLAVSLPS MAATHVLMET DMGNIRLVLD ESKAPKTVAN

51   FVRYARKGFY DDTVFHRVID GFVIQGGGLT EDLAQKASDK AVANESGNGL

101   KNTAGTIAMA RTTAPDSATS QFFINLADXX SLDYKNGQYG YTVFGRVESG

151   MNTVSKIARV KTATRGFYQN VPVQPVKIRR VVVGQ*
```

Computer analysis of this amino acid sequence gave the following results:
Homology with a Predicted ORF from *N. gonorrhoeae*
ORF 931 shows 91.9% identity over a 185 aa overlap with a predicted ORF (ORF 931.ng) from *N. gonorrhoeae*:

```
g931/m931
                    10         20         30         40         50         60
      g931.pep  MKPKFKTVLTALLLAVSLPSMAATRVLMETDMGNIRLVLDESKASKTVANFVRYARKGFY
                ||||||||||||||||||||||||:|||||||||||||||||| ||||||||||||||||
      m931      MKPKFKTVLTALLLAVSLPSMAATHVLMETDMGNIRLVLDESKAPKTVANFVRYARKGFY
                    10         20         30         40         50         60

70         80         90        100        110        120
      g931.pep  DNTIFHRVIGGFVIQGDGLTEDLVQKATDKAVANESGNGLKNTVGTIAMARTAAPDSAAA
                |:|:||||| |||||| ||||||:|||:||||||||||||||:|||||||||:||||::
      m931      DDTVFHRVIDGFVIQGGGLTEDLAQKASDKAVANESGNGLKNTAGTIAMARTTAPDSATS
                    70         80         90        100        110        120

130        140        150        160        170        180
      g931.pep  QFFINLADNGSLDYKNGQYGYTVFGRVESGMDTVSKIARVKTATRGFYQNVPVQPVKIRR
                ||||||||  |||||||||||||||||||||:||||||||||||||||||||||||||||
      m931      QFFINLADXXSLDYKNGQYGYTVFGRVESGMNTVSKIARVKTATRGFYQNVPVQPVKIRR
                   130        140        150        160        170        180 g931.pep  VWGQX
                |||||
      m931      VWGQX
```

The following partial DNA sequence was identified in *N. meningitidis* <SEQ ID 2861>:

```
a931.seq
     1   ATGAAACCCA AATTCAAAAC CGTTTTAACC GCGCTGCTTT TGGCGGTTTC

51   CCTGCCGTCT ATGGCGGCAA CCCATGTTTT GATGGAAACC GATATGGGCA

101   ATATCCGTTT GGTTTTGGAC GAATCCAAAG CACCCAAAAC CGTTGCCAAT

151   TTCGTGCGCT ATGCCCGAAA AGGCTTTTAC GACAATACGA TTTTTCACCG

201   CGTCATCGGC GGCTTCGTTA TCCAAGGCGG CGGATTGACC GAGGACTTGG

251   CACAAAAGGC AAGCGATAAG GCCGTTGCCA ACGAATCCGG CAACGGCTTG

301   AAAAACACTG TCGGCACCAT CGCCATGGCG CGGACGGCCG ATCCGGATTC

351   CGCCACCAGC CAATTCTTTA TCAATCTGGT GGACAATGAT TCGCTCAACT

401   ACAAAAACGG ACAATACGGC TATACCGTTT TCGGCAGGGT CGAAAGCGGC

451   ATGAACACCG TTTCCAAAAT CGCCCGCGTC AAAACCGCCA CGCGCGGCTT

501   TTATCAAAAC GTACCCGTAC AGCCCGTCAA AATCCGTCGC GTTGTTGTCG

551   GGCAGTAA
```

This corresponds to the amino acid sequence <SEQ ID 2862; ORF 931.a>:

```
a931.pep
     1   MKPKFKTVLT ALLLAVSLPS MAATHVLMET DMGNIRLVLD ESKAPKTVAN

51   FVRYARKGFY DNTIFHRVIG GFVIQGGGLT EDLAQKASDK AVANESGNGL

101   KNTVGTIAMA RTADPDSATS QFFINLVDND SLNYKNGQYG YTVFGRVESG

151   MNTVSKIARV KTATRGFYQN VPVQPVKIRR VVVGQ*
```

(The segment "MKPKFKTVLT ALLLAVSLPS MA" is underlined.)

m931/a931 94.6% identity in 185 aa overlap

```
                    10        20        30        40        50        60
m931.pep    MKPKFKTVLTALLLAVSLPSMAATHVLMETDMGNIRLVLDESKAPKTVANFVRYARKGFY
            ||||||||||||||||||||||||||||||||||||||||||||||||||||||||||||
a931        MKPKFKTVLTALLLAVSLPSMAATHVLMETDMGNIRLVLDESKAPKTVANFVRYARKGFY
                    10        20        30        40        50        60

70        80        90       100       110       120
m931.pep    DDTVFHRVIDGFVIQGGGLTEDLAQKASDKAVANESGNGLKNTAGTIAMARTTAPDSATS
            |:|:||||| ||||||||||||||||||||||||||||||||:||||||||: ||||||
a931        DNTIFHRVIGGFVIQGGGLTEDLAQKASDKAVANESGNGLKNTVGTIAMARTADPDSATS
                    70        80        90       100       110       120

130       140       150       160       170       180
m931.pep    QFFINLADXXSLDYKNGQYGYTVFGRVESGMNTVSKIARVKTATRGFYQNVPVQPVKIRR
            ||||||:|  ||:|||||||||||||||||||||||||||||||||||||||||||||||
a931        QFFINLVDNDSLNYKNGQYGYTVFGRVESGMNTVSKIARVKTATRGFYQNVPVQPVKIRR
                   130       140       150       160       170       180 m931.pep    VVVGQX
            ||||||
a931        VVVGQX
``` g932.seq not found yet g932.pep not found yet

The following partial DNA sequence was identified in *N. meningitidis* <SEQ ID 2863>:

```
m932.seq
     1   ATGAAATATA TCGTATCAAT CTCTCTGGCT ATGGGATTGG CTGCCTGTTC

51   GTTTGGGGGA TTTAAACCAA ATCCGTGGGA CGCCGCGTCA TTTTGGGAAT

101   TGAAAAATTA CGCCAATCCC TATCCGGGAT CAGCCTCGGC GGCACTTGAC
```

-continued

```
151    CAATATCCAT CGAAAGCAAG ACGAAGGCAA CTGAAAGACA TGCAAGAGTG

201    CGGCTATGAC CCAATAGACG GCGGAAAGTC TGAAGCAGAT GCCTGCCTGA

251    GGAAAAAAGG CTGGTGTCGT AAGGGTTTCG ACCCTTATCC CGAAAACAAA

301    AAATACGAAT GGCCTCGAGA AGAAGGAAAA ACAAAATGA
```

This corresponds to the amino acid sequence <SEQ ID 2864; ORF 932>:

```
m932.pep
  1    MKYIVSISLA MGLAACSFGG FKPNPWDAAS FWELKNYANP YPGSASAALD

51    QYPSKARRRQ LKDMQECGYD PIDGGKSEAD ACLRKKGWCR KGFDPYPENK

101    KYEWPREEGK TK*
```

Computer analysis of this amino acid sequence gave the following results:
Homology with a Predicted ORF from *N. gonorrhoeae*
ORF 932 shows _____% identity over a _____ aa overlap with a predicted ORF (ORF 932.ng) from *N. gonorrhoeae*:
The following partial DNA sequence was identified in *N. gonorrhoeae* <SEQ ID 2865>:

```
g934.seq
  1    ATGAAAAAAA TCATCGCCTC CGCGCTTATC GCAACATTCG CACTCACCGC

51    CTGCCAAGAC GACACGCAGG CGCGGCTCGA ACGGCAGCAG AAACAGATTG

101    AAGCCCTGCA ACAGCAGCTC GCACAGCAGG CAGACGATAC GGTTTACCAA

151    CTGACTCCCG AAGCAGTCAA AGACACCATT CCTGCCCAGG CGCAGGCAAA

201    CGGCAACAAC GGTCAGCCCG TTACCGGCAA .AGAcggGCA GCAGTATATT

251    TACGACCAAT CGACAGGAAG CTGGCTGCTG CAAAGCCTGA TTGGCGCGGC

301    GGCAGGCGCG TTTATCGGCA ACGCGCTGGC AAACAAATTC ACACGGGCGG

351    GCAACCAAGA CAGCCCCGTC GCCCGTCGCG CGCGTGCTGC CTACCATCAG

401    TCCGCACGCC CCAATGCGCG CACCAGCAGG GATTTGAACA CGCGCAGCCT

451    CCGTGCAAAA CAACAGGCGG CGCAGGCGCA GCGTTACCGC CCGACAACGC

501    GCCCGCCCGT CAAttaccgc catcgcgcta tgcGCGGTTT CGgcagAagg 551    cggtaaaCCC GGCGCGTCAA TGCCGTCTGA AGGGCTTTCA GACGGCATTT

601    TTGTATTTGT TAGGGGCATT GTTATGTTGC CGTTTGATTT TCAGACGGCA

651    TTTTGTTTCC AAGCGTTTGA TGTCggGATG GCAATTCTGA
```

This corresponds to the amino acid sequence <SEQ ID 2866; ORF 934.ng>:

```
g934.pep
  1    MKKIIASALI ATFALTACQD DTQARLERQQ KQIEALQQQL AQQADDTVYQ

51    LTPEAVKDTI PAQAQANGNN GQPVTGKRRA AVYLRPIDRK LAAAKPDWRG

101    GRRVYRQRAG KQIHTGGQPR QPRRPSRACC LPSVRTPQCA HQQGFEHAQP

151    PCKTTGGAGA ALPPDNAPAR QLPPSRYARF RQKAVNPARQ CRLKGFQTAF

201    LYLLGALLCC RLIFRRHFVS KRLMSGWQF*
```

The following partial DNA sequence was identified in *N. meningitidis* <SEQ ID 2867>:

```
m934.seq (partial)
    1   ..CGGCTCGAAC AGCAGCAGAA ACAGATTGAA GCCCTGCAAC AGCAGCTCGC
   51   ACAGCAGGCA GACGATACGG TTTACCAACT GACTCCCGAA GCAGTCAAAG
  101   ACACCATTCC TGCCGAAGCA CAGGCAAACG GCAACAACgG GCAACCCGTT
  151   ACCGGTAA.A GACGGGCAGC AGTATATTTA CGACCAATCG ACAGGAAGCT
  201   GGCTGCTGCA AAGCCTGGTC GGCGCGGCGG CAGGCGCGTT TATCGGCAAC
  251   GCGCTGGCAA ACAAATTCAC ACGGGCAGGC AACCAAGACA GTCCCGTCGC
  301   CCGGCGCGCG CGTGCAGCCT ACCATCAGTC CGCACGCCCC AATGCGCGCA
  351   yCAGCAGGGA TTTGAACACG CGCAGCCTCC GTGCAAAACA ACAGGCGGCG
  401   CAkGCGCAGC GTTACCGCCC GACAACGCGC CCGsCCGsCA ATTACCGCCG
  451   CCCCGCTATG CGCGGTTTCG GCAGGAGGCG GTAAACCCGG CGCGCCAATG
  501   CCGTCTGAAG AGCTTTCAGA CGGCATTTnT GCATTTGTTA GGGACATTGT
  551   TATGTTGCCG TTTGATTTTC AGACGGCATT TTGTTTCCAA GCGTTTGATG
  601   TCGGGATGGC AATTCTGA
```

This corresponds to the amino acid sequence <SEQ ID 2868; ORF 934>:

```
m934.pep (partial)
    1   ..RLEQQQKQIE ALQQQLAQQA DDTVYQLTPE AVKDTIPAEA QANGNNGQPV
   51   TGXRRAAVYL RPIDRKLAAA KPGRRGGRRV YRQRAGKQIH TGRQPRQSRR
  101   PARACSLPSV RTPQCAHQQG FEHAQPPCKT TGGAXAALPP DNAPXRQLPP
  151   PRYARFRQEA VNPARQCRLK SFQTAFXHLL GTLLCCRLIF RRHFVSKRLM
  201   SGWQF*
```

Computer analysis of this amino acid sequence gave the following results:
Homology with a Predicted ORF from *N. gonorrhoeae*
ORF 934 shows 91.7% identity over a 205 aa overlap with a predicted ORF (ORF 934.ng) from *N. gonorrhoeae*:

```
m934/g934
                               10         20         30
    m934.pep            RLEQQQKQIEALQQQLAQQADDTVYQLTPEAVKDTI
                        |||:|||||||||||||||||||||||||||||||
    g934    MKKIIASALIATFALTACQDDTQARLERQQKQIEALQQQLAQQADDTVYQLTPEAVKDTI
                10        20        30        40        50        60

40        50        60        70        80        90
    m934.pep   PAEAQANGNNGQPVTGXRRAAVYLRPIDRKLAAAKPGRRGGRRVYRQRAGKQIHTGRQPR
               ||:||||||||||||||:||||||||||||||||||:||||||||||||||||||:|||
    g934       PAQAQANGNNGQPVTGKRRAAVYLRPIDRKLAAAKPDWRGGRRVYRQRAGKQIHTGGQPR
                 70        80        90       100       110       120

100       110       120       130       140       150
    m934.pep   QSRRPARACSLPSVRTPQCAHQQGFEHAQPPCKTTGGAXAALPPDNAPXRQLPPPRYARF
               ||||:|||  |||||||||||||||||||||||||||| ||||||||||  ||||||||
    g934       QPRRPSRACCLPSVRTPQCAHQQGFEHAQPPCKTTGGAGAALPPDNAPARQLPPSRYARF
                 130       140       150       160       170       180
```

```
                    160        170        180        190        200
     m934.pep   RQEAVNPARQCRLKSFQTAFXHLLGTLLCCRLIFRRHFVSKRLMSGWQFX
                ||:||||||||||:||||  :|||:||||||||||||||||||||||||
     g934       RQKAVNPARQCRLKGFQTAFLYLLGALLCCRLIFRRHFVSKRLMSGWQFX
                    190        200        210        220        230
```

The following partial DNA sequence was identified in *N. meningitidis* <SEQ ID 2869>:

```
a934.seq
    1   ATGAAAAAAA TCATCGCCTC CGCGCTTATC GCAACATTCG CACTCGCCGC

51   CTGCCAAGAC GACGCGCAGG CGCGGCTCGA ACAGCAGCAG AAACAGATTG

101   AAGCCCTGCA ACAGCAGCTC GCACAGCAGG CAGACGATAC GGTTTACCAA

151   CTGACTCCCG AAGCAGTCAA AGACACCATT CCTGCCGAAG CACAGGCAAA

201   CGGCAACAAC GGGCAACCCG TTACCGG.TA AAGACGGGCA GCAGTATATT

251   TACGACCAAT CGACAGGAAG CTGGCTGCTG CAAAGCCTGG TCGGCGCGGC

301   GGCAGGCGCG TTTATCGGCA ACGCGCTGGC AAACAAATTC ACACGGGCAG

351   GCAACCAAGA CAGTCCCGTC GGCAGGCGCG CGCGTGCCGC CTACCATCAG

401   TCCGCACATC CCAATGCGCG CACCAGCAGG GATTTGAACA CGCGCAGCCT

451   CCGTGCAAAA CAACAGGCGG CGCAGGCGCA GCGTTACCGC CCGACAACGC

501   GCCCGCCCGC CAATTACCGC CGCCCCGCCA TGCGCGGTTT CGGCAGAAGG

551   CGGTAAATCC GGCGTGCCAA TGCCGTCTGA AGGGCTTTCA GACGGCATTT

601   TTGTATTTGT TAGGGACATT GTTATGTTGC CGTTTGATTT TTAGACGGCA

651   TTTTGTTTCC AAGAGTTTGA TGTCGGGATG GCAATTCTGA
```

This corresponds to the amino acid sequence <SEQ ID 2870; ORF 934.a>:

```
a934.pep
    1   MKKIIASALI ATFALAACQD DAQARLEQQQ KQIEALQQQL AQQADDTVYQ

51   LTPEAVKDTI PAEAQANGNN GQPVTX*RRA AVYLRPIDRK LAAAKPGRRG

101   GRRVYRQRAG KQIHTGRQPR QSRRPARACR LPSVRTSQCA HQQGFEHAQP

151   PCKTTGGAGA ALPPDNAPAR QLPPPRHARF RQKAVNPACQ CRLKGFQTAF

201   LYLLGTLLCC RLIFRRHFVS KSLMSGWQF*
                                                              50
``` m934/a934 94.1% identity in 205 aa overlap

```
                         10         20         30
     m934.pep            RLEQQQKQIEALQQQLAQQADDTVYQLTPEAVKDTI
                         |||||||||||||||||||||||||||||||||||
     a934       MKKIIASALIATFALAACQDDAQARLEQQQKQIEALQQQLAQQADDTVYQLTPEAVKDTI
                         10        20        30        40        50        60

40         50         60         70         80         90
     m934.pep   PAEAQANGNNGQPVTGXRRAAVYLRPIDRKLAAAKPGRRGGRRVYRQRAGKQIHTGRQPR
                ||||||||||||||||  |||||||||||||||||||||||||||||||||||||||||
     a934       PAEAQANGNNGQPVTXXRRAAVYLRPIDRKLAAAKPGRRGGRRVYRQRAGKQIHTGRQPR
                         70        80        90       100       110       120

100        110        120        130        140        150
     m934.pep   QSRRPARACSLPSVRTPQCAHQQGFEHAQPPCKTTGGAXAALPPDNAPXRQLPPPRYARF
                ||||||||| ||||||| |||||||||||||||||||| ||||||||| ||||||||:||
     a934       QSRRPARACRLPSVRTSQCAHQQGFEHAQPPCKTTGGAGAALPPDNAPARQLPPPRHARF
                         130       140       150       160       170       180
```

-continued

```
           160        170        180        190        200
m934.pep  RQEAVNPARQCRLKSFQTAFXHLLGTLLCCRLIFRRHFVSKRLMSGWQFX
          ||:||||| |||||:|||||  :||||||||||||||||||| ||||||||
a934      RQKAVNPACQCRLKGFQTAFLYLLGTLLCCRLIFRRHFVSKSLMSGWQFX
                 190        200        210        220        230
``` g935.seq not found yet g935.pep not found yet

The following partial DNA sequence was identified in *N. meningitidis* <SEQ ID 2871>:

```
m935.seq
     1  ATGTTGTATT TCAGATACGG CTTTTTGGTT GTTTGGTGTG CGGCAGGTGT

51  TTCTGCCGCC TATGGGGCGG ATGCGCCCGC GATTTTGGAT GACAAGGCAT

101  TGTTGCAGGT GCAGCGGTCG GTGTCGGATA AGTGGGCGGA ATCAGATTGG

151  AAAGTTGAAA ATGATGCCCC GCGCGTGGTT GACGGGGATT TTTTGTTGGC

201  GCATCCGAAA ATGTTGGAAC ATAGTTTGCG CGACGCGCTC AACGGCAATC

251  AGGCGGATTT AATCGCTTCG TTGGCGGATT TGTATGCCAA GCTGCCGGAT

301  TATGACGCGG TTTTGTACGG CAGGGCGCGG GCTTTGCTGG CGAAATTGGC

351  GGGAAGGCCG GCGGAGGCGG TGGCGCGGTA TCGGGAACTG CACGGGGAAA

401  ATGCGGCAGA CGAGCGGATT TTGCTGGATT TGGCGGCGGC GGAGTTTGAC

451  GATTTCCGGC TGAAGTCGGC AGAAAGGCAT TTTGCGGAGG CGGCAAAATT

501  GGATTTGCCG GCACCGGTTT TGGAAAATGT GGGGCGTTTT CGGAAAAAAA

551  CGGAGGGGCT GACGGGCTGG CGTTTTTCGG GCGGCATCAG TCCGGCGGTC

601  AATAGAAATG CCAATAATGC CGCGCCGCAA TATTGCCGGC AAAACGGAGG

651  CCGGCAGATA TGCAGTGTCA GCCGGGCGGA GCGGGCGGCA GGGTTGAATT

701  ATGAAATCGA GGCGGAAAAG CTGACGCCGT TGGCAGATAA TCATTATTTG

751  TTGTTCCGTT CCAATATCGG CGGCACGAGC TATTATTTCA GTAAAAAATC

801  AGCTTATGAT GACGGGTTCG GCAGGGCGTA TTTGGGTTGG CAGTATAAAA

851  ATGCACGGCA GACGGCGGGG ATTTTGCCGT TTTATCAGGT GCAGTTGTCG

901  GGCAGCGACG GCTTTGATGC GAAAACAAAA CGGGTAAACA ACCGCCGCCT

951  GCCGCCGTAT ATGCTGGCGC ACGGAGTCGG CGTGCAGCTG TCCCATACTT

1001  ACCGCCCAAA CCCGGGATGG CAATTTTCGG TCGCGCTGGA ACATTACCGC

1051  CAACGCTACC GCGAACAGGA TAGGGCGGAA TACAATAACG GCAGGCAGGA

1101  CGGGTTTTAT GTTTCGTCGG CAAAACGTTT GGGCGAATCG GCAACTGTGT

1151  TCGGCGGCTG GCAGTTTGTG CGGTTTGTGC CGAAACGCGA AACGGTGGGC

1201  GGCGCGGTCA ATAATGCCGC CTACCGGCGC AACGGTGTTT ATGCCGGTTG

1251  GGCGCAGGAG TGGCGGCAGT TGGGCGGTTT GAACAGTCGG GTTTCCGCGT

1301  CTTATGCCCG CCGCAACTAT AAGGGCATTG CGGCTTTCTC GACAGAGGCG

1351  CAACGCAACC GCGAATGGAA TGTCTCGCTG GCTTTGAGCC ACGACAAGTT

1401  GTCGTACAAA GGTATCGTGC CGGCGTTGAA TTATCGTTTC GGCAGGACGG

1451  AAAGTAATGT GCCGTATGCG AAACGCCGCA ACAGCGAGGT GTTTGTGTCG

1501  GCGGATTGGC GGTTTTGA
```

This corresponds to the amino acid sequence <SEQ ID 2872; ORF 935>:

```
m935.pep
     1   MLYFRYGFLV VWCAAGVSAA YGADAPAILD DKALLQVQRS VSDKWAESDW
    51   KVENDAPRVV DGDFLLAHPK MLEHSLRDAL NGNQADLIAS LADLYAKLPD
   101   YDAVLYGRAR ALLAKLAGRP AEAVARYREL HGENAADERI LLDLAAAEFD
   151   DFRLKSAERH FAEAAKLDLP APVLENVGRF RKKTEGLTGW RFSGGISPAV
   201   NRNANNAAPQ YCRQNGGRQI CSVSRAERAA GLNYEIEAEK LTPLADNHYL
   251   LFRSNIGGTS YYFSKKSAYD DGFGRAYLGW QYKNARQTAG ILPFYQVQLS
   301   GSDGFDAKTK RVNNRRLPPY MLAHGVGVQL SHTYRPNPGW QFSVALEHYR
   351   QRYREQDRAE YNNGRQDGFY VSSAKRLGES ATVFGGWQFV RFVPKRETVG
   401   GAVNNAAYRR NGVYAGWAQE WRQLGGLNSR VSASYARRNY KGIAAFSTEA
   451   QRNREWNVSL ALSHDKLSYK GIVPALNYRF GRTESNVPYA KRRNSEVFVS
   501   ADWRF*
```

The following partial DNA sequence was identified in *N. meningitidis* <SEQ ID 2873>:

```
a935.seq
     1   ATGTTGTATT TCAGATACGG TTTTTTGGTT GTTTGGTGTG CGGCAGGTGT
    51   TTCTGCCGCC TATGGGGCGG ATGCGCCCGC GATTTTGGAT GACAAGGCAT
   101   TGTTGCAGGT GCAGCGGTCG GTGTCGGATA AGTGGGCGGA ATCGGATTGG
   151   AAAGTTGACA ATGATGCCCC GCGCGTGGTT GACGGGGATT TTTTGTTGGC
   201   GCATCCGAAA ATGTTGGAAC ATAGTTTGCG CGACGTGCTC AACGGCAATC
   251   AGGCGGATTT GATCGCTTCG TTGGCGGATT TGTATGCCAA GCTGCCGGAT
   301   TATGACGCGG TTTTGTACGG CAGGGCGCGG GCTTTGCTGG CGAAATTGGC
   351   GGGAAGGCCG GCGGAGGCGG TGGCGCGGTA TCGGGAACTG CACGGGGAAA
   401   ATGCGGCAGA CGAGCGGATT TTGCTGGATT TGGCGGCGGC GGAGTTTGAC
   451   GATTTCCGGC TGAAGTCGGC AGAAAGGCAT TTTGCCGAGG CGGAAAAATT
   501   GGATTTGCCG GCGCCGGTTT TGGAAAATGT GGGGCGTTTT CGGAAAAAAG
   551   CGGAGGGGCT GACGGGCTGG CGTTTTTCGG GCGGCATCAG TCCGGCGGTC
   601   AATAGAAATG CCAATAATGC CGCGCCGCAG TATTGCCGGC AAAACGGAGG
   651   CCGGCAGATA TGCAGTGTCA GCCGGGCGGA GCGGGCGGCA GGCTTGAATT
   701   ATGAAATCGA GGCGGAAAAA CTGACGGCGT TGGCAGATAA TCATTATTTG
   751   TTGTTCCGTT CCAATATCGG CGGCACGAGC TATTATTTCA GTAAAAAATC
   801   AGCTTATGAC GACGGGTTCG GCAGAGCGTA TTTGGGTTGG CAGTATAAAA
   851   ATGCACGGCA GACGGCGGGG ATTTTGCCGT TTTATCAGGT GCAGTTGTCG
   901   GGCAGCGACG GCTTTGATGC GAAAACAAAA CGGGTAAACA ACCGCCGCCT
   951   GCCGCCGTAT ATGCTGGCGC ACGGAGTCGG CGTGCAGTTG TCCCATACTT
  1001   ACCGCCCAAA CCCGGGATGG CAATTTTCGG TCGCGCTGGA ACATTACCGC
  1051   CAACGCTACC GCGAACAGGA TAGGGCGGAA TACAATAACG GTCGGCAGGA
  1101   CGGGTTTTAT GTTTCGTCGG CAAAACGTTT GGGCGAATCG GCAACTGTGT
  1151   TCGGCGGCTG GCAGTTTGTG CGGTTTGTGC CGAAACGCGA AACGGTGGGC
```

-continued

```
1201  GGCGCGGTCA ATAATGCCGC CTACCGGCGC AACGGTGTTT ATGCCGGCTG

1251  GGCGCAGGAG TGGCGGCAGT TGGGCGGTTT GAACAGTCGG GTTTCCGCGT

1301  CTTATGCCCG CCGCAACTAT AAGGGCGTTG CGGCTTTCTC GACAGAGGCG

1351  CAACGCAACC GCAATGGAA TGTCTCGCTG GCTTTGAGCC ACGACAAGTT

1401  GTCGTACAAA GGTATCGTGC CCGCGTTGAA TTATCGTTTC GGCAGGACGG

1451  AAAGTAATGT GCCGTATGCG AAACGCCGCA ACAGCGAGGT GTTTGTGTCG

1501  GCGGATTGGC GGTTTTGA
```

This corresponds to the amino acid sequence <SEQ ID 2874; ORF 935.a>:

```
a935.pep
    1  MLYFRYGFLV VWCAAGVSAA YGADAPAILD DKALLQVQRS VSDKWAESDW

51  KVDNDAPRVV DGDFLLAHPK MLEHSLRDVL NGNQADLIAS LADLYAKLPD

101  YDAVLYGRAR ALLAKLAGRP AEAVARYREL HGENAADERI LLDLAAAEFD

151  DFRLKSAERH FAEAEKLDLP APVLENVGRF RKKAEGLTGW RFSGGISPAV

201  NRNANNAAPQ YCRQNGGRQI CSVSRAERAA GLNYEIEAEK LTALADNHYL

251  LFRSNIGGTS YYFSKKSAYD DGFGRAYLGW QYKNARQTAG ILPFYQVQLS

301  GSDGFDAKTK RVNNRRLPPY MLAHGVGVQL SHTYRPNPGW QFSVALEHYR

351  QRYREQDRAE YNNGRQDGFY VSSAKRLGES ATVFGGWQFV RFVPKRETVG

401  GAVNNAAYRR NGVYAGWAQE WRQLGGLNSR VSASYARRNY KGVAAFSTEA

451  QRNREWNVSL ALSHDKLSYK GIVPALNYRF GRTESNVPYA KRRNSEVFVS

501  ADWRF*
``` m935/a935 98.8% identity in 505 aa overlap

```
                  10         20         30         40         50         60
m935.pep  MLYFRYGFLVVWCAAGVSAAYGADAPAILDDKALLQVQRSVSDKWAESDWKVENDAPRVV
          |||||||||||||||||||||||||||||||||||||||||||||||||||:||||||||
a935      MLYFRYGFLVVWCAAGVSAAYGADAPAILDDKALLQVQRSVSDKWAESDWKVDNDAPRVV
                  10         20         30         40         50         60

70         80         90        100        110        120
m935.pep  DGDFLLAHPKMLEHSLRDALNGNQADLIASLADLYAKLPDYDAVLYGRARALLAKLAGRP
          ||||||||||||||||||||:|||||||||||||||||||||||||||||||||||||||
a935      DGDFLLAHPKMLEHSLRDVLNGNQADLIASLADLYAKLPDYDAVLYGRARALLAKLAGRP
                  70         80         90        100        110        120

130        140        150        160        170        180
m935.pep  AEAVARYRELHGENAADERILLDLAAAEFDDFRLKSAERHFAEAAKLDLPAPVLENVGRF
          |||||||||||||||||||||||||||||||||||||||||||| |||||||||||||||
a935      AEAVARYRELHGENAADERILLDLAAAEFDDFRLKSAERHFAEAEKLDLPAPVLENVGRF
                 130        140        150        160        170        180

190        200        210        220        230        240
m935.pep  RKKTEGLTGWRFSGGISPAVNRNANNAAPQYCRQNGGRQICSVSRAERAAGLNYEIEAEK
          |||:||||||||||||||||||||||||||||||||||||||||||||||||||||||||
a935      RKKAEGLTGWRFSGGISPAVNRNANNAAPQYCRQNGGRQICSVSRAERAAGLNYEIEAEK
                 190        200        210        220        230        240

250        260        270        280        290        300
m935.pep  LTPLADNHYLLFRSNIGGTSYYFSKKSAYDDGFGRAYLGWQYKNARQTAGILPFYQVQLS
          || ||||||||||||||||||||||||||||||||||||||||||||||||||||||||
a935      LTALADNHYLLFRSNIGGTSYYFSKKSAYDDGFGRAYLGWQYKNARQTAGILPFYQVQLS
                 250        260        270        280        290        300

310        320        330        340        350        360
m935.pep  GSDGFDAKTKRVNNRRLPPYMLAHGVGVQLSHTYRPNPGWQFSVALEHYRQRYREQDRAE
          ||||||||||||||||||||||||||||||||||||||||||||||||||||||||||||
a935      GSDGFDAKTKRVNNRRLPPYMLAHGVGVQLSHTYRPNPGWQFSVALEHYRQRYREQDRAE
                 310        320        330        340        350        360
```

```
                370        380        390        400        410        420
m935.pep    YNNGRQDGFYVSSAKRLGESATVFGGWQFVRFVPKRETVGGAVNNAAYRRNGVYAGWAQE
            ||||||||||||||||||||||||||||||||||||||||||||||||||||||||||||
a935        YNNGRQDGFYVSSAKRLGESATVFGGWQFVRFVPKRETVGGAVNNAAYRRNGVYAGWAQE
                370        380        390        400        410        420

430        440        450        460        470        480
m935.pep    WRQLGGLNSRVSASYARRNYKGIAAFSTEAQRNREWNVSLALSHDKLSYKGIVPALNYRF
            |||||||||||||||||||||||||:||||||||||||||||||||||||||||||||||
a935        WRQLGGLNSRVSASYARRNYKGVAAFSTEAQRNREWNVSLALSHDKLSYKGIVPALNYRF
                430        440        450        460        470        480

490        500
m935.pep    GRTESNVPYAKRRNSEVFVSADWRFX
            ||||||||||||||||||||||||||
a935        GRTESNVPYAKRRNSEVFVSADWRFX
                490        500
```

The following partial DNA sequence was identified in *N. gonorrhoeae* <SEQ ID 2875>:

```
g936.seq
     1    ATGAAACCCA AACCACACAC CGTCCGCACC CTGATTGCCG CCGTCCTCAG
    51    CCTTGCCCTC GGCGGCTGCT TCAGCGCAGT CGTCGGCGGG GCCGCCGTCG
   101    GCGCAAAATC CGTCATCGAC CGccgAACCA CCGgcgcgca AACCGATGac
   151    aACGTTATGG CGTTGCGTAT CGAAACCACC GCCCGTTCCT ACCTGCGCCA
   201    AAACAACCAA ACCAAAGGCT ACACGCCCCA AATCTCCGTC GTCGGCTACA
   251    ACCGCCACCT GCTGCTGCTC GGACAAGTCG CCACCGAAGG CGAAAAACAG
   301    TTCGTCGGTC AGATTGCACG TTCCGAACAG GCCGCCGAAG GCGTATACAA
   351    CTACATTACC GTCGCCTCCC TGCCGCGCAC TGCGGGCGAC ATCGCCGGCG
   401    ACACTTGGAA CACGTCCAAA GTCCGCGCca cgCTGCTGGG CATCAGCCCC
   451    GCTACACAGG CGCGCGTCAA AATCATTACC TACGGCAATG TAACCTACGT
   501    TATGGGCATC CTCACCCCCG AAGAACAGGC GCAGATTACC CAAAAAGTCA
   551    GCACCAccgT CGGCGTACAA AAAGTCATTA CCCTCTACCA AAACTACGTC
   601    CAACGCTGA
```

This corresponds to the amino acid sequence <SEQ ID 2876; ORF 936.ng>:

```
g936.pep
     1    MKPKPHTVRT LIAAVLSLAL GGCFSAVVGG AAVGAKSVID RRTTGAQTDD
    51    NVMALRIETT ARSYLRQNNQ TKGYTPQISV VGYNRHLLLL GQVATEGEKQ
   101    FVGQIARSEQ AAEGVYNYIT VASLPRTAGD IAGDTWNTSK VRATLLGISP
   151    ATQARVKIIT YGNVTYVMGI LTPEEQAQIT QKVSTTVGVQ KVITLYQNYV
   201    QR*
```

The following partial DNA sequence was identified in *N. meningitidis* <SEQ ID 2877>:

```
m936.seq (partial)
     1    ATGAAACCCA AACCGCACAC CGTCCGCACC CTGATTGCCG CCATTTTCAG
    51    CCTTGCCCTT AGCGGCTGCG TCAGCGCAGT AATCGGAAGC GCCGCCGTCG
   101    GCGCGAAATC CGCCGTCGAC CGCCGAACCA CCGGCGCGCA AACCGACGAC
   151    AACGTTATGG CGTTGCGTAT CGAAACCACC GCCCGTTCCT ATCTGCGCCA
```

```
-continued
201  AAACAACCAA ACCAAAGGCT ACACGCCCCA AATCTCCGTC GTCGGCTACA

251  ACCGCCACCT GCTGCTGCTC GGACAAGTCG CCACCGAAGG CGAAAAACAG

301  TTCGTCGGTC AGATTGCACG TTCCGAACAG GCCGCCGAAG GCGTGTACAA

351  CTATATTACC GTCGCCTCCC TGCCGCGCAC TGCC...
```

This corresponds to the amino acid sequence <SEQ ID 2878; ORF 936>:

```
m936.pep (partial)
   1  MKPKPHTVRT LIAAIFSLAL SGCVSAVIGS AAVGAKSAVD RRTTGAQTDD

51  NVMALRIETT ARSYLRQNNQ TKGYTPQISV VGYNRHLLLL GQVATEGEKQ

101  FVGQIARSEQ AAEGVYNYIT VASLPRTA...
```

Computer analysis of this amino acid sequence gave the following results:
Homology with a Predicted ORF from *N. gonorrhoeae*
ORF 936 shows 93.8% identity over a 128 aa overlap with a predicted ORF (ORF 936.ng) from *N. gonorrhoeae*:

```
m936/g936
                   10         20         30         40         50         60
   m936.pep  MKPKPHTVRTLIAAIFSLALSGCVSAVIGSAAVGAKSAVDRRTTGAQTDDNVMALRIETT
             ||||||||||||::||||:||   |||:|:||||||||::|||||||||||||||||||
       g936  MKPKPHTVRTLIAAVLSLALGGCFSAVVGGAAVGAKSVIDRRTTGAQTDDNVMALRIETT
                   10         20         30         40         50         60

70         80         90        100        110        120
   m936.pep  ARSYLRQNNQTKGYTPQISVVGYNRHLLLLGQVATEGEKQFVGQIARSEQAAEGVYNYIT
             ||||||||||||||||||||||||||||||||||||||||||||||||||||||||||||
       g936  ARSYLRQNNQTKGYTPQISVVGYNRHLLLLGQVATEGEKQFVGQIARSEQAAEGVYNYIT
                   70         80         90        100        110        120

130
   m936.pep  VASLPRTAXXX
             ||||||||
       g936  VASLPRTAGDIAGDTWNTSKVRATLLGISPATQARVKIITYGNVTYVMGILTPEEQAQIT
                  130        140        150        160        170        180
```

The following partial DNA sequence was identified in *N. meningitidis* <SEQ ID 2879>:

```
a936.seq
   1  ATGAAACCCA AACCGCACAC CGTCCGCACC CTGACTGCCG CCGTCCTCAG

51  CCTTGCCCTC GGCGGCTGCG TCAGCGCAGT CGTCGGCGGC GCGGCGGTCG

101  GCGCGAAATC CGCCGTCGAC CGCCGAACCA CCGGCGCGCA AACCGACGAC

151  AACGTAATGG CGCTGCGTAT CGAAACCACC GCCCGCTCCT ATCTGCGCCA

201  AAACAACCAA ACCAAAGGCT ACACGCCCCA AATCTCCGTT GTCGGCTACA

251  ACCGCCACCT GCTGCTGCTC GGACAAGTCG CCACCGAAGG CGAGAAACAG

301  TTCGTCGGTC AGATTGCACG TTCCGAACAG GCCGCCGAAG GCGTGTACAA

351  CTACATTACC GTCGCCTCCC TGCCGCGCAC TGCCGGCGAC ATCGCCGGCG

401  ACACTTGGAA CACATCCAAA GTCCGCGCCA CGCTGTTGGG CATCAGCCCC

451  GCCACACAGG CGCGCGTCAA AATCGTTACC TACGGCAACG TAACCTACGT

501  TATGGGCATC CTCACCCCCG AAGAACAGGC GCAGATTACC CAAAAAGTCA

551  GCACCACCGT CGGCGTACAA AAAGTCATCA CCCTCTACCA AAACTACGTC

601  CAACGCTGA
```

This corresponds to the amino acid sequence <SEQ ID 2880; ORF 936.a>:

```
a936.pep
    1   MKPKPHTVRT LTAAVLSLAL GGCVSAVVGG AAVGAKSAVD RRTTGAQTDD

51   NVMALRIETT ARSYLRQNNQ TKGYTPQISV VGYNRHLLLL GQVATEGEKQ

101   FVGQIARSEQ AAEGVYNYIT VASLPRTAGD IAGDTWNTSK VRATLLGISP

151   ATQARVKIVT YGNVTYVMGI LTPEEQAQIT QKVSTTVGVQ KVITLYQNYV

201   QR*
``` m936/a936 95.3% identity in 128 aa overlap

```
                  10         20         30         40         50         60
m936.pep  MKPKPHTVRTLIAAIFSLALSGCVSAVIGSAAVGAKSAVDRRTTGAQTDDNVMALRIETT
          ||||||||||  ::||||:|||||:|:|||||||||||||||||||||||||||||||||
a936      MKPKPHTVRTLTAAVLSLALGGCVSAVVGGAAVGAKSAVDRRTTGAQTDDNVMALRIETT
                  10         20         30         40         50

70         80         90        100        110        120
m936.pep  ARSYLRQNNQTKGYTPQISVVGYNRHLLLLGQVATEGEKQFVGQIARSEQAAEGVYNYIT
          ||||||||||||||||||||||||||||||||||||||||||||||||||||||||||||
a936      ARSYLRQNNQTKGYTPQISVVGYNRHLLLLGQVATEGEKQFVGQIARSEQAAEGVYNYIT
                  70         80         90        100        110        120 m936.pep  VASLPRTA
          ||||||||
a936      VASLPRTAGDIAGDTWNTSKVRATLLGISPATQARVKIVTYGNVTYVMGILTPEEQAQIT
                  130        140        150        160        170        180
```

The following partial DNA sequence was identified in *N. gonorrhoeae* <SEQ ID 2881>:

```
g936-1.seq
    1   ATGAAACCCA AACCACACAC CGTCCGCACC CTGATTGCCG CCGTCCTCAG

51   CCTTGCCCTC GGCGGCTGCT TCAGCGCAGT CGTCGGCGGG GCCGCCGTCG

101   GCGCAAAATC CGTCATCGAC CGccgAACCA CCGgcgcgca AACCGATGac 151   aACGTTATGG CGTTGCGTAT CGAAACCACC GCCCGTTCCT ACCTGCGCCA

201   AAACAACCAA ACCAAAGGCT ACACGCCCCA AATCTCCGTC GTCGGCTACA

251   ACCGCCACCT GCTGCTGCTC GGACAAGTCG CCACCGAAGG CGAAAAACAG

301   TTCGTCGGTC AGATTGCACG TTCCGAACAG GCCGCCGAAG GCGTATACAA

351   CTACATTACC GTCGCCTCCC TGCCGCGCAC TGCGGGCGAC ATCGCCGGCG

401   ACACTTGGAA CACGTCCAAA GTCCGCGCca cgCTGCTGGG CATCAGCCCC

451   GCTACACAGG CGCGCGTCAA AATCATTACC TACGGCAATG TAACCTACGT

501   TATGGGCATC CTCACCCCCG AAGAACAGGC GCAGATTACC CAAAAAGTCA

551   GCACCAccgT CGGCGTACAA AAAGTCATTA CCCTCTACCA AAACTACGTC

601   CAACGCTGA
```

This corresponds to the amino acid sequence <SEQ ID 2882; ORF 936-1.ng>:

```
g936-1.pep
    1   MKPKPHTVRT LIAAVLSLAL GGCFSAVVGG AAVGAKSVID RRTTGAQTDD

51   NVMALRIETT ARSYLRQNNQ TKGYTPQISV VGYNRHLLLL GQVATEGEKQ

101   FVGQIARSEQ AAEGVYNYIT VASLPRTAGD IAGDTWNTSK VRATLLGISP
```

```
151     ATQARVKIIT YGNVTYVMGI LTPEEQAQIT QKVSTTVGVQ KVITLYQNYV

201     QR*
```

The following partial DNA sequence was identified in *N. meningitidis* <SEQ ID 2883>:

```
m936-1.seq
    1     ATGAAACCCA AACCGCACAC CGTCCGCACC CTGATTGCCG CCATTTTCAG

51     CCTTGCCCTT AGCGGCTGCG TCAGCGCAGT AATCGGAAGC GCCGCCGTCG

101     GCGCGAAATC CGCCGTCGAC CGCCGAACCA CCGGCGCGCA AACCGACGAC

151     AACGTTATGG CGTTGCGTAT CGAAACCACC GCCCGTTCCT ATCTGCGCCA

201     AAACAACCAA ACCAAAGGCT ACACGCCCCA AATCTCCGTC GTCGGCTACA

251     ACCGCCACCT GCTGCTGCTC GGACAAGTCG CCACCGAAGG CGAAAAACAG

301     TTCGTCGGTC AGATTGCACG TTCCGAACAG GCCGCCGAAG GCGTGTACAA

351     CTATATTACC GTCGCCTCCC TGCCGCGCAC TGCCGGCGAC ATCGCCGGCG

401     ACACTTGGAA CACATCCAAA GTCCGCGCCA CGCTGTTGGG CATCAGCCCC

451     GCCACACAGG CGCGCGTCAA AATCGTTACC TACGGCAACG TAACCTACGT

501     TATGGGCATC CTCACCCCCG AAGAACAGGC GCAGATTACC CAAAAAGTCA

551     GCACCACCGT CGGCGTACAA AAAGTCATCA CCCTCTACCA AAACTACGTC

601     CAACGCTGA
```

This corresponds to the amino acid sequence <SEQ ID 2884; ORF 936-1>:

```
m936-1.pep
    1     MKPKPHTVRT LIAAIFSLAL SGCVSAVIGS AAVGAKSAVD RRTTGAQTDD

51     NVMALRIETT ARSYLRQNNQ TKGYTPQISV VGYNRHLLLL GQVATEGEKQ

101     FVGQIARSEQ AAEGVYNYIT VASLPRTAGD IAGDTWNTSK VRATLLGISP

151     ATQARVKIVT YGNVTYVMGI LTPEEQAQIT QKVSTTVGVQ KVITLYQNYV

201     QR*
``` m936-1/g936-1 95.5% identity in 202 aa overlap

```
                    10         20         30         40         50         60
   m936-1.pep  MKPKPHTVRTLIAAIFSLALSGCVSAVIGSAAVGAKSAVDRRTTGAQTDDNVMALRIETT
               ||||||||||||::||||:||   |||:|:||||||||::|||||||||||||||||||
   g936-1      MKPKPHTVRTLIAAVLSLALGGCFSAVVGGAAVGAKSVIDRRTTGAQTDDNVMALRIETT
                    10         20         30         40         50         60

70         80         90        100        110        120
   m936-1.pep  ARSYLRQNNQTKGYTPQISVVGYNRHLLLLGQVATEGEKQFVGQIARSEQAAEGVYNYIT
               ||||||||||||||||||||||||||||||||||||||||||||||||||||||||||||
   g936-1      ARSYLRQNNQTKGYTPQISVVGYNRHLLLLGQVATEGEKQFVGQIARSEQAAEGVYNYIT
                    70         80         90        100        110        120

130        140        150        160        170        180
   m936-1.pep  VASLPRTAGDIAGDTWNTSKVRATLLGISPATQARVKIVTYGNVTYVMGILTPEEQAQIT
               ||||||||||||||||||||||||||||||||||||||:|||||||||||||||||||||
   g936-1      VASLPRTAGDIAGDTWNTSKVRATLLGISPATQARVKIITYGNVTYVMGILTPEEQAQIT
                   130        140        150        160        170        180

190        200
   m936-1.pep  QKVSTTVGVQKVITLYQNYVQRX
               |||||||||||||||||||||||
   g936-1      QKVSTTVGVQKVITLYQNYVQRX
                   190        200
```

The following partial DNA sequence was identified in *N. meningitidis* <SEQ ID 2885>:

```
a936-1.seq
     1   ATGAAACCCA AACCGCACAC CGTCCGCACC CTGACTGCCG CCGTCCTCAG

51   CCTTGCCCTC GGCGGCTGCG TCAGCGCAGT CGTCGGCGGC GCGGCGGTCG

101   GCGCGAAATC CGCCGTCGAC CGCCGAACCA CCGGCGCGCA AACCGACGAC

151   AACGTAATGG CGCTGCGTAT CGAAACCACC GCCCGCTCCT ATCTGCGCCA

201   AAACAACCAA ACCAAAGGCT ACACGCCCCA AATCTCCGTT GTCGGCTACA

251   ACCGCCACCT GCTGCTGCTC GGACAAGTCG CCACCGAAGG CGAGAAACAG

301   TTCGTCGGTC AGATTGCACG TTCCGAACAG GCCGCCGAAG GCGTGTACAA

351   CTACATTACC GTCGCCTCCC TGCCGCGCAC TGCCGGCGAC ATCGCCGGCG

401   ACACTTGGAA CACATCCAAA GTCCGCGCCA CGCTGTTGGG CATCAGCCCC

451   GCCACACAGG CGCGCGTCAA AATCGTTACC TACGGCAACG TAACCTACGT

501   TATGGGCATC CTCACCCCCG AAGAACAGGC GCAGATTACC CAAAAAGTCA

551   GCACCACCGT CGGCGTACAA AAAGTCATCA CCCTCTACCA AAACTACGTC

601   CAACGCTGA
```

This corresponds to the amino acid sequence <SEQ ID 2886; ORF 936-1.a>:

```
a936-1.pep
     1   MKPKPHTVRT LTAAVLSLAL GGCVSAVVGG AAVGAKSAVD RRTTGAQTDD

51   NVMALRIETT ARSYLRQNNQ TKGYTPQISV VGYNRHLLLL GQVATEGEKQ

101   FVGQIARSEQ AAEGVYNYIT VASLPRTAGD IAGDTWNTSK VRATLLGISP

151   ATQARVKIVT YGNVTYVMGI LTPEEQAQIT QKVSTTVGVQ KVITLYQNYV

201   QR*
``` a936-1/m936-1 97.0% identity in 202 aa overlap

```
                     10        20        30        40        50        60
m936-1.pep  MKPKPHTVRTLIAAIFSLALSGCVSAVIGSAAVGAKSAVDRRTTGAQTDDNVMALRIETT
            ||||||||||| ||::||||:||||||:|:||||||||||||||||||||||||||||||
a936-1      MKPKPHTVRTLTAAVLSLALGGCVSAVVGGAAVGAKSAVDRRTTGAQTDDNVMALRIETT
                     10        20        30        40        50        60

70        80        90       100       110       120
m936-1.pep  ARSYLRQNNQTKGYTPQISVVGYNRHLLLLGQVATEGEKQFVGQIARSEQAAEGVYNYIT
            ||||||||||||||||||||||||||||||||||||||||||||||||||||||||||||
a936-1      ARSYLRQNNQTKGYTPQISVVGYNRHLLLLGQVATEGEKQFVGQIARSEQAAEGVYNYIT
                     70        80        90       100       110       120

130       140       150       160       170       180
m936-1.pep  VASLPRTAGDIAGDTWNTSKVRATLLGISPATQARVKIVTYGNVTYVMGILTPEEQAQIT
            ||||||||||||||||||||||||||||||||||||||||||||||||||||||||||||
a936-1      VASLPRTAGDIAGDTWNTSKVRATLLGISPATQARVKIVTYGNVTYVMGILTPEEQAQIT
                    130       140       150       160       170       180

190       200
m936-1.pep  QKVSTTVGVQKVITLYQNYVQRX
            |||||||||||||||||||||||
a936-1      QKVSTTVGVQKVITLYQNYVQRX
                    190       200
```

The following partial DNA sequence was identified in *N. gonorrhoeae* <SEQ ID 2887>:

```
g937.seq
     1    atGAAAAATA TTCTCTTAgt ATTTGTTAGC TTTGTGCCAT TATGTGTCCG
    51    CACTGATCTG CCGCTGAata tCGAAGACAT AATGaccgAC AAGGGAAAAT
   101    GGAAactGGA AACTTccctt acctacctgA acaGCGAAAA cagCCGCGCC
   151    GCACTTGCCT CACCGGTTTA CATTCAGACC GGCTCCGCTT CCTTTATCCC
   201    CGTCCCGACC GAAATTCAGG AAAACGGCAG CAATACCGAT ATGCTCGCCG
   251    GCACGCTCGG TTTGCGCTAC GGACTGAccg GCAataccgA CATTTACGGC
   301    AGCGGCAGCT ATCTGTGGCA CGAAGAACGC AAACTCGacg GCAACGGCAA
   351    AACCCGCAAC AAACGGATGT CCGACATATC CGCCGGCATC AGCCACACCT
   401    TCCttaAAGa cgGCAAAAAT CCCGCACTCA TCGCTTTCCT CGAAAGCACG
   451    GTTTACGAAA AATCGCGCAA CAAAGCCTCG TCGGGAAAAT CGTGGCTCAT
   501    CGGCGCCACC ACCTACAAAG CCATAGATCC GATTGTCCTT TCCCTCACCG
   551    CCGCCTACCG CATCAACGGC AGCAAAACCC TTTCAGACGA CGTCAAATAC
   601    AAAGCAGGCA ATTACTGGAT GCTGAATCCC AACATCTCAT TTGCCGCCAA
   651    CGACAGAATC AGCCTGACCG GAGGCATCCA ATGGCTGGGC AAACAGCCCG
   701    ACCGCATAGA CGGCAAAAAA GAATCCGCAA GAAACACATC CACCTACGCC
   751    CATTTCGGCG CAGGTTTCGG TTTCACCAAA ACCGCGGCTT TAAACGCATC
   801    CGCACGTTTC AACGTTTCAG GGCAAAGCAG TTCCGAACTG AAATTGGGCG
   851    TACAGCATAC ATTTTAA
```

This corresponds to the amino acid sequence <SEQ ID 2888; ORF 937.ng>:

```
g937.pep
     1    MKNILLVFVS FVPLCVRTDL PLNIEDIMTD KGKWKLETSL TYLNSENSRA
    51    ALASPVYIQT GSASFIPVPT EIQENGSNTD MLAGTLGLRY GLTGNTDIYG
   101    SGSYLWHEER KLDGNGKTRN KRMSDISAGI SHTFLKDGKN PALIAFLEST
   151    VYEKSRNKAS SGKSWLIGAT TYKAIDPIVL SLTAAYRING SKTLSDDVKY
   201    KAGNYWMLNP NISFAANDRI SLTGGIQWLG KQPDRIDGKK ESARNTSTYA
   251    HFGAGFGFTK TAALNASARF NVSGQSSSEL KLGVQHTF*
```

The following partial DNA sequence was identified in *N. meningitidis* <SEQ ID 2889>:

```
m937.seq
     1    ATGAAGCGCA TCTTTTTGCC CGCCTTGCCC GCCATCCTGC CTTTATCCAC
    51    TTATGCCGAC CTGCCCTTGA CGATTGAAGA CATAATGACC GACAAGGGAA
   101    AATGGAAACT GGAAACTTCC CTTACCTACC TGAACAGCGA AAACAACCGC
   151    GCCGAACTTG CCGCACCGGT TTACATTCAA ACCGGCGCAA CCTCGTTTAT
   201    CCCCATTCCG ACCGAAATCC AAgAAAaCGG CAGCAATACC GATATGCTCG
   251    TCGGCACGCT CGGTTTGCGC TACGGACTGA CCGGGAATAC CGACATTTAC
   301    GGCAGCGGCA GCTATCTGTG GCACGAAGAA CGCAAACTCG ACGGCAACAG
```

-continued

```
351  CAAAACCCGC AACAAACGGA TGTCCGACGT ATCCCTCGGC ATCAGCCACA
401  CTTTCCTTAA AGACGACAAA AACCCCGCCC TAATCAGCTT TCTTGAAAGC
451  ACGGTTTACG AAAAATCGCG CAACAAAGCC TCGTCGGGAA ATCCTGGCT
501  CATCGGCGCC ACCACCTACA AAGCCATAGA TCCGATTGTC CTTTCCTTAA
551  CCGCCGCCTA CCGCATCAAC GGCAGCAAAA CCCTTTCAGA CGGCATCCGC
601  TACAAATCGG GCAACTACCT GCTGCTCAAC CCCAACATCT CATTTGCTGC
651  CAACGACAGA ATCAGCCTGA CCGGAGGCAT CCAATGGCTG GCAGGCAGC
701  CCGACCGGAC GGACGGCAAA CGGGAATCCT CCAGAAACAC ATCCACCTAC
751  GCCCATTTCG GCGCAGGTTT CGGTTTCACC AAAACCACGG CTTTAAACGC
801  ATCCGCACGT TTCAACGTTT CAGGGCAAAG CAGTTCCGAA CTGAAATTTG
851  GCGTACAGCA TACATTTTAA
```

20

This corresponds to the amino acid sequence <SEQ ID 2890; ORF 937>:

```
m937.pep..
   1    MKRIFLPALP AILPLSTYAD LPLTIEDIMT DKGKWKLETS LTYLNSENNR

51    AELAAPVYIQ TGATSFIPIP TEIQENGSNT DMLVGTLGLR YGLTGNTDIY

101    GSGSYLWHEE RKLDGNSKTR NKRMSDVSLG ISHTFLKDDK NPALISFLES

151    TVYEKSRNKA SSGKSWLIGA TTYKAIDPIV LSLTAAYRIN GSKTLSDGIR

201    YKSGNYLLLN PNISFAANDR ISLTGGIQWL GRQPDRTDGK RESSRNTSTY

251    AHFGAGFGFT KTTALNASAR FNVSGQSSSE LKFGVQHTF*
```

Computer analysis of this amino acid sequence gave the following results:
Homology with a Predicted ORF from *N. gonorrhoeae*  40
ORF 937 shows 86.9% identity over a 289 aa overlap with a predicted ORF (ORF 937.ng) from *N. gonorrhoeae*:

```
g937/m937
                10        20        30        40        50        59
   g937.pep   MKNILL-VFVSFVPLCVRTDLPLNIEDIMTDKGKWKLETSLTYLNSENSRAALASPVYIQ
              || |:| ::::|| :|||||:||||||||||||||||||||||||:|| ||:||||
   m937       MKRIFLPALPAILPLSTYADLPLTIEDIMTDKGKWKLETSLTYLNSENNRAELAAPVYIQ
                10        20        30        40        50        60
                60        70        80        90       100       110       119
   g937.pep   TGSASFIPVPTEIQENGSNTDMLAGTLGLRYGLTGNTDIYGSGSYLWHEERKLDGNGKTR
              ||::||||:|||||||||||||:|||||||||||||||||||||||||||||||:|||
   m937       TGATSFIPIPTEIQENGSNTDMLVGTLGLRYGLTGNTDIYGSGSYLWHEERKLDGNSKTR
                70        80        90       100       110       120
               120       130       140       150       160       170       179
   g937.pep   NKRMSDISAGISHTFLKDGKNPALIAFLESTVYEKSRNKASSGKSWLIGATTYKAIDPIV
              ||||||:| |||||||||| ||||||:|||||||||||||||||||||||||||||||
   m937       NKRMSDVSLGISHTFLKDDKNPALISFLESTVYEKSRNKASSGKSWLIGATTYKAIDPIV
               130       140       150       160       170       180
               180       190       200       210       220       230       239
   g937.pep   LSLTAAYRINGSKTLSDDVKYKAGNYWMLNPNISFAANDRISLTGGIQWLGKQPDRIDGK
              ||||||||||||||||||| ::||:||| :||||||||||||||||||||:||||  |||
   m937       LSLTAAYRINGSKTLSDGIRYKSGNYLLLNPNISFAANDRISLTGGIQWLGRQPDRTDGK
               190       200       210       220       230       240
               240       250       260       270       280       289
   g937.pep   KESARNTSTYAHFGAGFGFTKTAALNASARFNVSGQSSSELKLGVQHTFX
              :||||||||||||||||||||||:|||||||||||||||||:|||||||
   m937       RESSRNTSTYAHFGAGFGFTKTTALNASARFNVSGQSSSELKFGVQHTFX
               250       260       270       280
```

The following partial DNA sequence was identified in *N. meningitidis* <SEQ ID 2891>:

```
a937.seq
     1   ATGAAGCGCA TCTTTTTGCC CGCCTTGCCC GCCATCCTGC CTTTATCCGC

51   TTATGCCGAC CTGCCCTTGA CGATTGAAGA CATAATGACC GACAAGGGCA

101   AATGGAAACT GGAAACTTCC CTTACCTACC TGAACAGCGA AAACAACCGC

151   GCCGAACTTG CCGCACCGGT TTACATCCAA ACCGGCGCAA CCTCGTTTAT

201   CCCCATTCCG ACCGAAATCC AAGAAAACGG CAGCAATACC GATATGCTCG

251   TTGGCACGCT CGGTTTGCGC TACGGACTGA CCGGGAATAC CGACATTTAC

301   GGCAGCGGCA GCTATCTGTG GCACGAAGAA CGCAAACTCG ACGGCAACGG

351   CAAAACCCGA AACAAACGGA TGTCCGACGT ATCCCTCGGC ATCAGCCACA

401   CCTTCCTTAA AGACGACAAA AACCCCGCCC TAATCAGCTT TCTTGAAAGC

451   ACGGTTTACG AAAAATCGCG CAACAAAGCC TCGTCGGGAA AATCCTGGCT

501   CATCGGCGCC ACCACCTACA AAGCCATCGA CCCCGTCGTC CTCTCATTGA

551   CCGCTGCCTA CCGTATCAAC GGCAGCAAAA CCCTTTCAAG CAACACCAAA

601   TACAAAGCAG GCAATTACTG GATGCTGAAT CCCAATATAT CCTTCGCCGC

651   CAACGACAGA ATCAGCCTCA CGGGCGGCAT CCAATGGCTG GGCAAGCAGC

701   CCGACCGTCT GGACGGCAAA AAAGAATCCG CAAGAAACAC ATCCACCTAT

751   GCCCATTTCG GCGCAGGTTT CGGTTTCACC AAAACCACGG CTTTAAACGC

801   ATCCGCACGT TTCAACGTTT CAGGGCAAAG CAGTTCCGAA CTGAAATTTG

851   GCGTACAGCA TACGTTTTAA
```

This corresponds to the amino acid sequence <SEQ ID 2892; ORF 937.a>:

```
a937.pep
     1   MKRIFLPALP AILPLSAYAD LPLTIEDIMT DKGKWKLETS LTYLNSENNR

51   AELAAPVYIQ TGATSFIPIP TEIQENGSNT DMLVGTLGLR YGLTGNTDIY

101   GSGSYLWHEE RKLDGNGKTR NKRMSDVSLG ISHTFLKDDK NPALISFLES

151   TVYEKSRNKA SSGKSWLIGA TTYKAIDPVV LSLTAAYRIN GSKTLSSNTK

201   YKAGNYWMLN PNISFAANDR ISLTGGIQWL GKQPDRLDGK KESARNTSTY

251   AHFGAGFGFT KTTALNASAR FNVSGQSSSE LKFGVQHTF*
``` m937/a937 95.2% identity in 289 aa overlap

```
                    10        20        30        40        50        60
m937.pep    MKRIFLPALPAILPLSTYADLPLTIEDIMTDKGKWKLETSLTYLNSENNRAELAAPVYIQ
            ||||||||||||||||:|||||||||||||||||||||||||||||||||||||||||||
a937        MKRIFLPALPAILPLSAYADLPLTIEDIMTDKGKWKLETSLTYLNSENNRAELAAPVYIQ
                    10        20        30        40        50        60

70        80        90       100       110       120
m937.pep    TGATSFIPIPTEIQENGSNTDMLVGTLGLRYGLTGNTDIYGSGSYLWHEERKLDGNSKTR
            ||||||||||||||||||||||||||||||||||||||||||||||||||||||||:|||
a937        TGATSFIPIPTEIQENGSNTDMLVGTLGLRYGLTGNTDIYGSGSYLWHEERKLDGNGKTR
                    70        80        90       100       110       120

130       140       150       160       170       180
m937.pep    NKRMSDVSLGISHTFLKDDKNPALISFLESTVYEKSRNKASSGKSWLIGATTYKAIDPIV
            ||||||||||||||||||||||||||||||||||||||||||||||||||||||||||:|
a937        NKRMSDVSLGISHTFLKDDKNPALISFLESTVYEKSRNKASSGKSWLIGATTYKAIDPVV
                   130       140       150       160       170       180
```

-continued

```
                190       200       210       220       230       240
m937.pep   LSLTAAYRINGSKTLSDGIRYKSGNYLLLNPNISFAANDRISLTGGIQWLGRQPDRTDGK
           ||||||||||||||||::  :||:|||  :||||||||||||||||||||||:||||  |||
a937       LSLTAAYRINGSKTLSSNTKYKAGNYWMLNPNISFAANDRISLTGGIQWLGKQPDRLDGK
                190       200       210       220       230       240

250       260       270       280       290
m937.pep   RESSRNTSTYAHFGAGFGFTKTTALNASARFNVSGQSSSELKFGVQHTFX
           :||:|||||||||||||||||||||||||||||||||||||||||||||
a937       KESARNTSTYAHFGAGFGFTKTTALNASARFNVSGQSSSELKFGVQHTFX
                250       260       270       280       290
``` g939.seq not found yet
g939.pep not found yet
The following partial DNA sequence was identified in *N. meningitidis* <SEQ ID 2893>:

```
m939.seq (partial)
     1    ATGAAACGAT TGACTTTATT GGCCTTTGTT TTGGCTGCCG GTGCGGTTTC

51    CGCCTCTCCC AAAGCAGACG TGGAAAAAGG CAAACAGGTT GCCGCAACGG

101    TTTGTGCGGC TTGCCATGCA GCAGACGGTA ACAGCGGCAT TGCGATGTAT

151    CCGCGTTTGG CGGCACAGCA TACTGCTTAC ATCTATCATC AAACTATCGG

201    CATCCGCGAC GTAAACGCAC CC...
```

This corresponds to the amino acid sequence <SEQ ID 2894; ORF 939>:

```
m939.pep (partial)
     1    MKRLTLLAFV LAAGAVSASP KADVEKGKQV AATVCAACHA ADGNSGIAMY

51    PRLAAQHTAY IYHQTIGIRD VNAP...
```

The following partial DNA sequence was identified in *N. meningitidis* <SEQ ID 2895>:

```
a939.seq
     1    ATGAAACGAT TGACTTTATT GGCCTTTGTT TTGGCTGCCG GTGCGGTTTC

51    CGCATCTCCC AAAGCAGACG TGGAAAAAGG CAAACAGGTT GCCGCAACGG

101    TTTGTGCGGC TTGCCATGCA GCAGACGGTA ACAGCGGCAT TGCGATGTAT

151    CCGCGTTTGG CGGCACAGCA TACTGCTTAC ATCTATCATC AAACCATCGG

201    CATCCGCGAC GGTAAACGCA CCCACGGTTC GGCAGCTGTG ATGAAACCGG

251    TGGTAATGAA TTTGAGCGAT CAGGATATTT TGAACGTATC CGCATTCTAT

301    GCCAAACAGC AGCCCAAATC CGGTGAAGCC AATCCTAAGG AAAATCCCGA

351    ATTGGGTGCG AAAATCTATC GCGGCGGTTT GAGCGATAAA AAAGTGCCGG

401    CGTGTATGTC CTGCCACGGT CCGAGCGGTG CGGGTATGCC GGGGGGCGGA

451    AGCGAAATTC AGGCTTATCC GCGTTTGGGC GGTCAGCATC AGGCATATAT

501    TGTTGAACAG ATGAATGCCT ACAAGTCCGG TCAGCGTAAA AATACCATCA

551    TGGAAGATAT TGCAAACCGT ATGTCTGAAG AAGATTTGAA AGCGGTCGCC

601    AACTTTATCC AAGGTTTGCG TTAA
```

This corresponds to the amino acid sequence <SEQ ID 2896; ORF 939.a>:

```
a939.pep
    1   MKRLTLLAFV LAAGAVSASP KADVEKGKQV AATVCAACHA ADGNSGIAMY

51   PRLAAQHTAY IYHQTIGIRD GKRTHGSAAV MKPVVMNLSD QDILNVSAFY

101   AKQQPKSGEA NPKENPELGA KIYRGGLSDK KVPACMSCHG PSGAGMPGGG

151   SEIQAYPRLG GQHQAYIVEQ MNAYKSGQRK NTIMEDIANR MSEEDLKAVA

201   NFIQGLR*
``` m939/a939 100.0% identity in 70 aa overlap

```
                  10         20         30         40         50         60
  m939.pep  MKRLTLLAFVLAAGAVSASPKADVEKGKQVAATVCAACHAADGNSGIAMYPRLAAQHTAY
            ||||||||||||||||||||||||||||||||||||||||||||||||||||||||||||
  a939      MKRLTLLAFVLAAGAVSASPKADVEKGKQVAATVCAACHAADGNSGIAMYPRLAAQHTAY
                  10         20         30         40         50         60

70
  m939.pep  IYHQTIGIRDVNAP
            ||||||||||
  a939      IYHQTIGIRDGKRTHGSAAVMKPVVMNLSDQDILNVSAFYAKQQPKSGEANPKENPELGA
                  70         80         90        100        110        120
```

The following partial DNA sequence was identified in *N. gonorrhoeae* <SEQ ID 2897>:

```
g950.seq
    1   ATGAACAAAA ATATTGCTGC CGCACTCGCC GGTGCTTTAT CCCTGTCTCT

51   GGCCGCCGGC GCCGTTGCCG CCCACAAACC GGCAAGCAAC GCAACAGGCG

101   TTCAAAAATC CGCCCAAGGC TCTTGCGGCG CATCCAAATC TGCCGAAGGT

151   TCGTGCGGCG CATCCAAATC TGCCGAAGGT TCGTGCGGCG CGGCTGCTTC

201   TAAAGCAGGC GAAGGCAAAT GCGGCGAGGG CAAATGCGGT GCAACTGTAA

251   AAAAAGCCCA CAAACACACC AAAGCATCTA AAGCCAAAGC CAAATCTGCC

301   GAAGGCAAAT GCGGCGAAGG CAAATGCGGT TCTAAATAA
```

This corresponds to the amino acid sequence <SEQ ID 2898; ORF 950.ng>:

```
g950.pep
    1   MNKNIAAALA GALSLSLAAG AVAAHKPASN ATGVQKSAQG SCGASKSAEG

51   SCGASKSAEG SCGAAASKAG EGKCGEGKCG ATVKKAHKHT KASKAKAKSA

101   EGKCGEGKCG SK*
```

The following partial DNA sequence was identified in *N. meningitidis* <SEQ ID 2899>:

```
m950.seq
    1   ATGAACAAAA ACATTGCTGC CGCTCTCGCC GGTGCTTTAT CCCTGTCTTT

51   GGCCGCCGGT GCAGTTGCTG CCAACAAACC GGCAAGCAAC GCAACAGGCG

101   TTCATAAATC CGCCCATGGC TCTTGCGGCG CGTCCAAATC TGCCGAAGGT

151   TCGTGCGGCG CGGCTGGTTC TAAAGCAGGC GAAGGCAAAT GCGGCGAGGG

201   CAAATGCGGT GCGACCGTAA AAAAAACCCA CAAACACACC AAAGCATCTA
```

```
-continued
251  AAGCCAAGGC CAAATCTGCC GAAGGCAAAT GCGGCGAAGG CAAATGCGGT

301  TCTAAATAA
```

This corresponds to the amino acid sequence <SEQ ID 2900; ORF 950>:

```
m950.pep
    1  MNKNIAAALA GALSLSLAAG AVAANKPASN ATGVHKSAHG SCGASKSAEG

51  SCGAAGSKAG EGKCGEGKCG ATVKKTHKHT KASKAKAKSA EGKCGEGKCG

101  SK
```

Computer analysis of this amino acid sequence gave the following results:
Homology with a Predicted ORF from *N. gonorrhoeae*
ORF 950 shows 86.6% identity over a 112 aa overlap with a predicted ORF (ORF 950) from *N. gonorrhoeae*
m950/g950 86.6% identity in 112 aa overlap

```
                  10        20        30        40        50
m950.pep  MNKNIAAALAGALSLSLAAGAVAANKPASNATGVHKSAHGSCGASKSAEGSCGA------
          |||||||||||||||||||||||||:|||||||||:|||:||||||||||||
g950      MNKNIAAALAGALSLSLAAGAVAAHKPASNATGVQKSAQGSCGASKSAEGSCGASKSAEG
                  10        20        30        40        50        60

60        70        80        90       100
m950.pep  ----AGSKAGEGKCGEGKCGATVKKTHKHTKASKAKAKSAEGKCGEGKCGSK
              |:|||||||||||||||||:||||||||||||||||||||||||||||
g950      SCGAAASKAGEGKCGEGKCGATVKKAHKHTKASKAKAKSAEGKCGEGKCGSKX
                  70        80        90       100       110
```

The following partial DNA sequence was identified in *N. meningitidis* <SEQ ID 2901>:

```
a950.seq
    1  ATGAACAAAA ACATTGCTGC CGCACTCGCC GGTGCTTTAT CCCTGTCTTT

51  GGCCGCCGGT GCAGTTGCTG CCAACAAACC GGCAAGCAAC GCAACAGGCG

101  TTCATAAATC CGCCCATGGC TCTTGCGGCG CGTCCAAATC TGCCGAAGGT

151  TCGTGCGGCG CGGCTGGTTC TAAAGCAGGC GAAGGCAAAT GCGGCGAGGG

201  CAAATGCGGT GCGACCGTAA AAAAAACCCA CAAACACACC AAAGCATCTA

251  AAGCCAAGGC CAAATCTGCC GAAGGCAAAT GCGGCGAAGG CAAATGCGGT

301  TCTAAATAA
```

This corresponds to the amino acid sequence <SEQ ID 2902; ORF 950.a>:

```
a950.pep
    1  MNKNIAAALA GALSLSLAAG AVAANKPASN ATGVHKSAHG SCGASKSAEG

51  SCGAAGSKAG EGKCGEGKCG ATVKKTHKHT KASKAKAKSA EGKCGEGKCG

101  SK*
```

Computer analysis of this amino acid sequence gave the following results:
Homology with a Predicted ORF from N. meningitidis
ORF 950 shows 100.0% identity over a 102 aa overlap with a predicted ORF (ORF 950) from N. meningitidis
a950/m950 100.0% identity in 102 aa overlap

```
              10        20        30        40        50        60
a950.pep  MNKNIAAALAGALSLSLAAGAVAANKPASNATGVHKSAHGSCGASKSAEGSCGAAGSKAG
          ||||||||||||||||||||||||||||||||||||||||||||||||||||||||||||
m950      MNKNIAAALAGALSLSLAAGAVAANKPASNATGVHKSAHGSCGASKSAEGSCGAAGSKAG
              10        20        30        40        50        60

70        80        90       100
a950.pep  EGKCGEGKCGATVKKTHKHTKASKAKAKSAEGKCGEGKCGSKX
          ||||||||||||||||||||||||||||||||||||||||||
m950      EGKCGEGKCGATVKKTHKHTKASKAKAKSAEGKCGEGKCGSK
              70        80        90       100
```

The following partial DNA sequence was identified in N. gonorrhoeae <SEQ ID 2903>:

```
g951.seq
    1  ATGATTATGT TACCCGCCCG TTTCACTATT TTATCTGTCC TCGCAGCAGC

51  CCTGCTTGCC GGACAGGCGT ATGCTGCCGG CGCGGCGGAT GTGGAGCTGC

101  CGAAGGAAGT CGGAAAGGTT TTAAGGAAAC ATCGGCGTTA CAGCGAGGAA

151  GAAATCAAAA ACGAACGCGC ACGGCTTGCG GCAGTGGGCG AACGGGTCAA

201  CAGGGTGTTT ACGCTGTTGG GCGGTGAAAC GGCTTTGCAG AAAGGGCAGG

251  CGGGAACGGC TCTGGCAACC TATATGCTGA TGTTGGAACG CACAAAATCC

301  CCCGAAGTCG CCGAACGCGC CTTGGAAATG GCCGTGTCGC TGAACGCGTT

351  TGAACAGGCG GAAATGATTT ATCAGAAATG GCGGCAGATC GAGCCTATAC

401  CGGGTGAGGC GCAAAAACGG GCGGGGTGGC TGCGGAACGT ATTGAGGGAA

451  GGGGGAAATC AGCATCTGGA CGGGTTGGAA GAGGTGCTGG CGCAATCGGA

501  CGATGTGCAA AAACGCAGGA TATTTTTGCT GCTGGTGCAA GCCGCCGTGC

551  AGCAGGGTGG GGTGGCTCAA AAAGCATCGA AAGCGGTTCG CCGTGCGGCG

601  TTGAAGTATG AACATCTGCC CGAAGCGGCG GTTGCCGATG CGGTGTTCGG

651  CGTACAGGGA CGCGAAAAGG AAAAGGCAAT CGAAGCTTTG CAGCGTTTGG

701  CGAAGCTCGA TACGGAAATA TTGCCCCCCA CTTTAATGAC GTTGCGTCTG

751  ACTGCACGCA AATATCCCGA AATACTCGAC GGCTTTTTCG AGCAGACAGA

801  CACCCAAAAC CTTTCGGCCG TCTGGCAGGA AATGGAAATT ATGAATCTGG

851  TTTCCCTGCG TAAGCCGGAT GATGCCTATG CGCGTTTGAA CGTGCTGTTG

901  GAACACAACC CGAATGCAAA CCTGTATATT CAGGCGGCGA TATTGGCGGC

951  AAACCGAAAA GAAGGTGCGT CCGTTATCGA CGGCTACGCC GAAAAGGCAT

1001  ACGGCAGGGG GACGGGGGAA CAGCGGGGCA GGGCGGCAAT GACGGCGGCG

1051  ATGATATATG CCGACCGCAG GGATTACGCC AAAGTCAGGC AGTGGTTGAA

1101  AAAAGTGTCC GCGCCGGAAT ACCTGTTCGA CAAAGGCGTG CTGGCGGCTG

1151  CGGCGGCTGC CGAATTGGAC GGAGGCCGGG CGGCTTTGCG GCAGATCGGC

1201  AGGGTGCGGA AACTTCCCGA ACAGCAGGGG CGGTATTTTA CGGCAGACAA

1251  TTTGTCCAAA ATACAGATGC TCGCCCTGTC GAAGCTGCCC GACAAACGGG

1301  AAGCCCTGAT CGGGCTGAAC AACATCATCG CCAAACTTTC GGCGGCGGGA
```

-continued

```
1351  AGCACGGAAC CTTTGGCGGA AGCATTGGCA CAGCGTTCCA TTATTTACGA

1401  ACAGTTCGGC AAACGGGGAA AATGATTGC CGACCTTGAA ACCGCGCTCA

1451  AACTTACGCC CGATAATGCA CAAATTATGA ATAATCTGGG CTACAGCCTG

1501  CTTTCCGATT CCAAACGTTT GGACGAGGGT TTCGCCCTGC TTCAGACGGC

1551  ATACCAAATC AACCCGGACG ATACCGCCGT TAACGACAGC ATAGGCTGGG

1601  CGTATTACCT GAAAGGCGAC GCGGAAAGCG CGCTGCCGTA TCTGCGGTAT

1651  TCGTTTGAAA ACGACCCCGA GCCCGAAGTT GCCGCCCATT TGGGCGAAGT

1701  GTTGTGGGCA TTGGGCGAAC GCGATCAGGC GGTTGACGTA TGGACGCAGG

1751  CGGCACACCT TAGGGGAGAC AAGAAAATAT GGCGGGAGAC GCTCAAACGC

1801  TACGGAATCG CCTTGCCCGA GCCTTCCCGA AACCCCGGA AATAA
```

This corresponds to the amino acid sequence <SEQ ID 2904; ORF 951.ng>:

```
g951.pep
    1  MIMLPARFTI LSVLAAALLA GQAYAAGAAD VELPKEVGKV LRKHRRYSEE

51  EIKNERARLA AVGERVNRVF TLLGGETALQ KGQAGTALAT YMLMLERTKS

101  PEVAERALEM AVSLNAFEQA EMIYQKWRQI EPIPGEAQKR AGWLRNVLRE

151  GGNQHLDGLE EVLAQSDDVQ KRRIFLLLVQ AAVQQGGVAQ KASKAVRRAA

201  LKYEHLPEAA VADAVFGVQG REKEKAIEAL QRLAKLDTEI LPPTLMTLRL

251  TARKYPEILD GFFEQTDTQN LSAVWQEMEI MNLVSLRKPD DAYARLNVLL

301  EHNPNANLYI QAAILAANRK EGASVIDGYA EKAYGRGTGE QRGRAAMTAA

351  MIYADRRDYA KVRQWLKKVS APEYLFDKGV LAAAAAAELD GGRAALRQIG

401  RVRKLPEQQG RYFTADNLSK IQMLALSKLP DKREALIGLN NIIAKLSAAG

451  STEPLAEALA QRSIIYEQFG KRGKMIADLE TALKLTPDNA QIMNNLGYSL

501  LSDSKRLDEG FALLQTAYQI NPDDTAVNDS IGWAYYLKGD AESALPYLRY

551  SFENDPEPEV AAHLGEVLWA LGERDQAVDV WTQAAHLRGD KKIWRETLKR

601  YGIALPEPSR KPRK*
```

The following partial DNA sequence was identified in *N. meningitidis* <SEQ ID 2905>:

```
m951.seq
    1  ATGATTATGT TACCTAACCG TTTCAAAATG TTAACTGTGT TGACGGCAAC

51  CTTGATTGCC GGACAGGTAT CTGCCGCCGG AGGCGGTGCG GGGGATATGA

101  AACAGCCGAA GGAAGTCGGA AAGGTTTTCA GAAAGCAGCA GCGTTACAGC

151  GAGGAAGAAA TCAAAAACGA ACGCGCACGG CTTGCGGCAG TGGGCGAGCG

201  GGTTAATCAG ATATTTACGT TGCTGGGAGG GGAAACCGCC TTGCAAAAGG

251  GGCAGGCGGG AACGGCTCTG GCAACCTATA TGCTGATGTT GGAACGCACA

301  AAATCCCCCG AAGTCGCCGA ACGCGCCTTG GAAATGGCCG TGTCGCTGAA

351  CGCGTTTGAA CAGGCGGAAA TGATTTATCA GAAATGGCGG CAGATTGAGC

401  CTATACCGGG TAAGGCGCAA AAACGGGCGG GGTGGCTGCG GAACGTGCTG

451  AGGGAAAGAG GAAATCAGCA TCTGGACGGA CTGGAAGAAG TGCTGGCTCA

501  GGCGGACGAA GGACAGAACC GCAGGGTGTT TTATTGTTG GCACAAGCCG
```

```
 551  CCGTGCAACA GGACGGGTTG GCGCAAAAAG CATCGAAAGC GGTTCGCCGC

601  GCGGCGTTGA AATATGAACA TCTGCCCGAA GCGGCGGTTG CCGATGTGGT

651  GTTCAGCGTA CAGGGACGCG AAAAGGAAAA GGCAATCGGA GCTTTGCAGC

701  GTTTGGCGAA GCTCGATACG GAAATATTGC CCCCCACTTT AATGACGTTG

751  CGTCTGACTG CACGCAAATA TCCCGAAATA CTCGACGGCT TTTTCGAGCA

801  GACAGACACC CAAAACCTTT CGGCCGTCTG GCAGGAAATG GAAATTATGA

851  ATCTGGTTTC CCTGCACAGG CTGGATGATG CCTATGCGCG TTTGAACGTG

901  CTGTTGGAAC GCAATCCGAA TGCAGACCTG TATATTCAGG CAGCGATATT

951  GGCGGCAAAC CGAAAAGAAG GTGCTTCCGT TATCGACGGC TACGCCGAAA

1001  AGGCATACGG CAGGGGGACG GAGGAACAGC GGAGCAGGGC GGCGCTAACG

1051  GCGGCGATGA TGTATGCCGA CCGCAGGGAT TACGCCAAAG TCAGGCAGTG

1101  GCTGAAAAAA GTATCCGCGC CGGAATACCT GTTCGACAAA GGTGTGCTGG

1151  CGGCTGCGGC GGCTGTCGAG TTGGACGGCG GCAGGGCGGC TTTGCGGCAG

1201  ATCGGCAGGG TGCGGAAACT TCCCGAACAG CAGGGGCGGT ATTTTACGGC

1251  AGACAATTTG TCCAAAATAC AGATGCTCGC CCTGTCGAAG CTGCCCGATA

1301  AACGGGAGGC TTTGAGGGGG TTGGACAAGA TTATCGAAAA ACCGCCTGCC

1351  GGCAGTAATA CAGAGTTACA GGCAGAGGCA TTGGTACAGC GGTCAGTTGT

1401  TTACGATCGG CTTGGCAAGC GGAAAAAAAT GATTTCAGAT CTTGAAAGGG

1451  CGTTCAGGCT TGCACCCGAT AACGCTCAGA TTATGAATAA TCTGGGCTAC

1501  AGCCTGCTGA CCGATTCCAA ACGTTTGGAC GAAGGTTTCG CCCTGCTTCA

1551  GACGGCATAC CAAATCAACC CGGACGATAC CGCTGTCAAC GACAGCATAG

1601  GCTGGGCGTA TTACCTGAAA GGCGACGCGG AAAGCGCGCT GCCGTATCTG

1651  CGGTATTCGT TTGAAAACGA CCCCGAGCCC GAAGTTGCCG CCCATTTGGG

1701  CGAAGTGTTG TGGGCATTGG GCGAACGCGA TCAGGCGGTT GACGTATGGA

1751  CGCAGGCGGC ACACCTTACG GGAGACAAGA AAATATGGCG GGAAACGCTC

1801  AAACGTCACG GCATCGCATT GCCCCAACCT TCCCGAAAAC CTCGGAAATA

1851  A
```

This corresponds to the amino acid sequence <SEQ ID 2906; ORF 791>:

```
m951.pep
    1  MIMLPNRFKM LTVLTATLIA GQVSAAGGGA GDMKQPKEVG KVFRKQQRYS

51  EEEIKNERAR LAAVGERVNQ IFTLLGGETA LQKGQAGTAL ATYMLMLERT

101  KSPEVAERAL EMAVSLNAFE QAEMIYQKWR QIEPIPGKAQ KRAGWLRNVL

151  RERGNQHLDG LEEVLAQADE GQNRRVFLLL AQAAVQQDGL AQKASKAVRR

201  AALKYEHLPE AAVADVVFSV QGREKEKAIG ALQRLAKLDT EILPPTLMTL

251  RLTARKYPEI LDGFFEQTDT QNLSAVWQEM EIMNLVSLHR LDDAYARLNV

301  LLERNPNADL YIQAAILAAN RKEGASVIDG YAEKAYGRGT EEQRSRAALT

351  AAMMYADRRD YAKVRQWLKK VSAPEYLFDK GVLAAAAAVE LDGGRAALRQ
```

-continued

```
401  IGRVRKLPEQ QGRYFTADNL SKIQMLALSK LPDKREALRG LDKIIEKPPA

451  GSNTELQAEA LVQRSVVYDR LGKRKKMISD LERAFRLAPD NAQIMNNLGY

501  SLLTDSKRLD EGFALLQTAY QINPDDTAVN DSIGWAYYLK GDAESALPYL

551  RYSFENDPEP EVAAHLGEVL WALGERDQAV DVWTQAAHLT GDKKIWRETL

601  KRHGIALPQP SRKPRK*
```

Computer analysis of this amino acid sequence gave the following results:
Homology with a Predicted ORF from *N. gonorrhoeae*
ORF 951 shows 88.6% identity over a 616 aa overlap with a predicted ORF (ORF 951) from *N. gonorrhoeae*
m951/g951 88.6% identity in 616 aa overlap

```
                  10        20        30        40        50        60
m951.pep  MIMLPNRFKMLTVLTATLIAGQVSAAGGGAGDMKQPKEVGKVFRKQQRYSEEEIKNERAR
          |||||  ||  : | :|:|: ||| : ||    ||:|::  |||||||||:|::||||||||||
g951      MIMLPARFTILSVLAAALLAGQAYAA--GAADVELPKEVGKVLRKHRRYSEEEIKNERAR
                  10        20        30          40        50

70        80        90       100       110       120
m951.pep  LAAVGERVNQIFTLLGGETALQKGQAGTALATYMLMLERTKSPEVAERALEMAVSLNAFE
          ||||||||| ::|||||||||||||||||||||||||||||||||||||||||||||||
g951      LAAVGERVNRVFTLLGGETALQKGQAGTALATYMLMLERTKSPEVAERALEMAVSLNAFE
                  60        70        80        90       100       110

130       140       150       160       170       180
m951.pep  QAEMIYQKWRQIEPIPGKAQKRAGWLRNVLRERGNQHLDGLEEVLAQADEGQNRRVFLLL
          |||||||||||||||||:||||||||||||||| |||||||||||||:|:  |:||:||||
g951      QAEMIYQKWRQIEPIPGEAQKRAGWLRNVLREGGNQHLDGLEEVLAQSDDVQKRRIFLLL
                 120       130       140       150       160       170

190       200       210       220       230       240
m951.pep  AQAAVQQDGLAQKASKAVRRAALKYEHLPEAAVADVVFSVQGREKEKAIGALQRLAKLDT
          :||||||  |:|||||||||||||||||||||||||||:||:|||||||||| |||||||||||
g951      VQAAVQQGGVAQKASKAVRRAALKYEHLPEAAVADAVFGVQGREKEKAIEALQRLAKLDT
                 180       190       200       210       220       230

250       260       270       280       290       300
m951.pep  EILPPTLMTLRLTARKYPEILDGFFEQTDTQNLSAVWQEMEIMNLVSLHRLDDAYARLNV
          |||||||||||||||||||||||||||||||||||||||||||||||||::  |||||||||
g951      EILPPTLMTLRLTARKYPEILDGFFEQTDTQNLSAVWQEMEIMNLVSLRKPDDAYARLNV
                 240       250       260       270       280       290

310       320       330       340       350       360
m951.pep  LLERNPNADLYIQAAILAANRKEGASVIDGYAEKAYGRGTEEQRSRAALTAAMMYADRRD
          |||:|||||:||||||||||||||||||||||||||||||||:|||::|||||::||||||
g951      LLEHNPNANLYIQAAILAANRKEGASVIDGYAEKAYGRGTGEQRGRAAMTAAMIYADRRD
                 300       310       320       330       340       350

370       380       390       400       410       420
m951.pep  YAKVRQWLKKVSAPEYLFDKGVLAAAAAVELDGGRAALRQIGRVRKLPEQQGRYFTADNL
          ||||||||||||||||||||||||||||||:|||||||||||||||||||||||||||||
g951      YAKVRQWLKKVSAPEYLFDKGVLAAAAAAELDGGRAALRQIGRVRKLPEQQGRYFTADNL
                 360       370       380       390       400       410

430       440       450       460       470       480
m951.pep  SKIQMLALSKLPDKREALRGLDKIIEKPPAGSNTELQAEALVQRSVVYDRLGKRKKMISD
          |||||||||||||||||| ||:::|| |:::|| ||||:|||::||  :|||:||:|
g951      SKIQMLALSKLPDKREALIGLNNIIAKLSAAGSTEPLAEALAQRSIIYEQFGKRGKMIAD
                 420       430       440       450       460       470

490       500       510       520       530       540
m951.pep  LERAFRLAPDNAQIMNNLGYSLLTDSKRLDEGFALLQTAYQINPDDTAVNDSIGWAYYLK
          ||  |::|:||||||||||||||:|||||||||||||||||||||||||||||||||||
g951      LETALKLTPDNAQIMNNLGYSLLSDSKRLDEGFALLQTAYQINPDDTAVNDSIGWAYYLK
                 480       490       500       510       520       530

550       560       570       580       590       600
m951.pep  GDAESALPYLRYSFENDPEPEVAAHLGEVLWALGERDQAVDVWTQAAHLTGDKKIWRETL
          ||||||||||||||||||||||||||||||||||||||||||||||||| |||||||||
g951      GDAESALPYLRYSFENDPEPEVAAHLGEVLWALGERDQAVDVWTQAAHLRGDKKIWRETL
                 540       550       560       570       580       590

610
m951.pep  KRHGIALPQPSRKPRK
          ||:|||||:|||||||
g951      KRYGIALPEPSRKPRK
                 600       610
```

The following partial DNA sequence was identified in *N. meningitidis* <SEQ ID 2907>:

```
a951.seq
     1  ATGTTACCCG CCCGTTTCAC CATTTTATCT GTGCTCGCGG CAGCCCTGCT
    51  TGCCGGGCAG GCGTATGCCG CCGGCGCGGC GGATGCGAAG CCGCCGAAGG
   101  AAGTCGGAAA GGTTTTCAGA AAGCAGCAGC GTTACAGCGA GGAAGAAATC
   151  AAAAACGAAC GCGCACGGCT TGCGGCAGTG GGCGAGCGGG TTAATCAGAT
   201  ATTTACGTTG CTGGGAGGGG AAACCGCCTT GCAAAAGGGG CAGGCGGGAA
   251  CGGCTCTGGC AACCTATATG CTGATGTTGG AACGCACAAA ATCCCCCGAA
   301  GTCGCCGAAC GCGCCTTGGA AATGGCCGTG TCGCTGAACG CGTTTGAACA
   351  GGCGGAAATG ATTTATCAGA AATGGCGGCA GATTGAGCCT ATACCGGGTA
   401  AGGCGCAAAA ACGGGCGGGG TGGCTGCGGA ACGTGCTGAG GGAAAGAGGA
   451  AATCAGCATC TAGACGGACT GGAAGAAGTG CTGGCTCAGG CGGACGAAGG
   501  ACAGAACCGC AGGGTGTTTT TATTGTTGGC ACAAGCCGCC GTGCAACAGG
   551  ACGGGTTGGC GCAAAAAGCA TCGAAAGCGG TTCGCCGCGC GGCGTTGAGA
   601  TATGAACATC TGCCCGAAGC GGCGGTTGCC GATGTGGTGT TCAGCGTACA
   651  GGGACGCGAA AAGGAAAAGG CAATCGGAGC TTTGCAGCGT TTGGCGAAGC
   701  TCGATACGGA AATATTGCCC CCCACTTTAA TGACGTTGCG TCTGACTGCA
   751  CGCAAATATC CCGAAATACT CGACGGCTTT TTCGAGCAGA CAGACACCCA
   801  AAACCTTTCG GCCGTCTGGC AGGAAATGGA AATTATGAAT CTGGTTTCCC
   851  TGCACAGGCT GGATGATGCC TATGCGCGTT TGAACGTGCT GTTGGAACGC
   901  AATCCGAATG CAGACCTGTA TATTCAGGCA GCGATATTGG CGGCAAACCG
   951  AAAAGAAGGT GCTTCCGTTA TCGACGGCTA CGCCGAAAAG GCATACGGCA
  1001  GGGGGACGGG GGAACAGCGG GGCAGGGCGG CAATGACGGC GGCGATGATA
  1051  TATGCCGACC GAAGGGATTA CACCAAAGTC AGGCAGTGGT TGAAAAAAGT
  1101  GTCCGCGCCG GAATACCTGT TCGACAAAGG TGTGCTGGCG GCTGCGGCGG
  1151  CTGTCGAGTT GGACGGCGGC AGGGCGGCTT TGCGGCAGAT CGGCAGGGTG
  1201  CGGAAACTTC CCGAACAGCA GGGGCGGTAT TTTACGGCAG ACAATTTGTC
  1251  CAAAATACAG ATGTTCGCCC TGTCGAAGCT GCCCGACAAA CGGGAGGCTT
  1301  TGAGGGGGTT GGACAAGATT ATCGAAAAAC CGCCTGCCGG CAGTAATACA
  1351  GAGTTACAGG CAGAGGCATT GGTACAGCGG TCAGTTGTTT ACGATCGGCT
  1401  TGGCAAGCGG AAAAAAATGA TTTCAGATCT TGAAAGGGCG TTCAGGCTTG
  1451  CACCCGATAA CGCTCAGATT ATGAATAATC TGGGCTACAG CCTGCTTTCC
  1501  GATTCCAAAC GTTTGGACGA AGGCTTCGCC CTGCTTCAGA CGGCATACCA
  1551  AATCAACCCG GACGATACCG CTGTCAACGA CAGCATAGGC TGGGCGTATT
  1601  ACCTGAAAGG CGACGCGGAA AGCGCGCTGC CGTATCTGCG GTATTCGTTT
  1651  GAAAACGACC CCGAGCCCGA AGTTGCCGCC CATTTGGGCG AAGTGTTGTG
  1701  GGCATTGGGC GAACGCGATC AGGCGGTTGA CGTATGGACG CAGGCGGCAC
  1751  ACCTTACGGG AGACAAGAAA ATATGGCGGG AAACGCTCAA ACGTCACGGC
  1801  ATCGCATTGC CCCAACCTTC CCGAAAACCT CGGAAATAA
```

This corresponds to the amino acid sequence <SEQ ID 2908; ORF 951.a>:

```
a951.pep
    1   MLPARFTILS VLAAALLAGQ AYAAGAADAK PPKEVGKVFR KQQRYSEEEI

51   KNERARLAAV GERVNQIFTL LGGETALQKG QAGTALATYM LMLERTKSPE

101   VAERALEMAV SLNAFEQAEM IYQKWRQIEP IPGKAQKRAG WLRNVLRERG

151   NQHLDGLEEV LAQADEGQNR RVFLLLAQAA VQQDGLAQKA SKAVRRAALR

201   YEHLPEAAVA DVVFSVQGRE KEKAIGALQR LAKLDTEILP PTLMTLRLTA

251   RKYPEILDGF FEQTDTQNLS AVWQEMEIMN LVSLHRLDDA YARLNVLLER

301   NPNADLYIQA AILAANRKEG ASVIDGYAEK AYGRGTGEQR GRAAMTAAMI

351   YADRRDYTKV RQWLKKVSAP EYLFDKGVLA AAAAVELDGG RAALRQIGRV

401   RKLPEQQGRY FTADNLSKIQ MFALSKLPDK REALRGLDKI IEKPPAGSNT

451   ELQAEALVQR SVVYDRLGKR KKMISDLERA FRLAPDNAQI MNNLGYSLLS

501   DSKRLDEGFA LLQTAYQINP DDTAVNDSIG WAYYLKGDAE SALPYLRYSF

551   ENDPEPEVAA HLGEVLWALG ERDQAVDVWT QAAHLTGDKK IWRETLKRHG

600   IALPQPSRKP RK*
```

Computer analysis of this amino acid sequence gave the following results:
Homology with a Predicted ORF from *N. meningitidis*
ORF 951 shows 96.4% identity over a 614 aa overlap with a predicted ORF (ORF 951) from *N. meningitidis*
a951/m951 96.4% identity in 614 aa overlap

```
                    10         20         30         40         50
  a951.pep   MLPARFTILSVLAAALLAGQAYAAG--AADAKPPKEVGKVFRKQQRYSEEEIKNERAR
             ||| ||  : | : | : |||  :   |||   : |  ||||||||||||||||||||||
  m951       MIMLPNRFKMLTVLTATLIAGQVSAAGGGAGDMKQPKEVGKVFRKQQRYSEEEIKNERAR
                    10         20         30         40         50         60

60         70         80         90        100        110
  a951.pep   LAAVGERVNQIFTLLGGETALQKGQAGTALATYMLMLERTKSPEVAERALEMAVSLNAFE
             ||||||||||||||||||||||||||||||||||||||||||||||||||||||||||||
  m951       LAAVGERVNQIFTLLGGETALQKGQAGTALATYMLMLERTKSPEVAERALEMAVSLNAFE
                    70         80         90        100        110        120

120        130        140        150        160        170
  a951.pep   QAEMIYQKWRQIEPIPGKAQKRAGWLRNVLRERGNQHLDGLEEVLAQADEGQNRRVFLLL
             ||||||||||||||||||||||||||||||||||||||||||||||||||||||||||||
  m951       QAEMIYQKWRQIEPIPGKAQKRAGWLRNVLRERGNQHLDGLEEVLAQADEGQNRRVFLLL
                   130        140        150        160        170        180

180        190        200        210        220        230
  a951.pep   AQAAVQQDGLAQKASKAVRRAALRYEHLPEAAVADVVFSVQGREKEKAIGALQRLAKLDT
             |||||||||||||||||||||||||:||||||||||||||||||||||||||||||||||
  m951       AQAAVQQDGLAQKASKAVRRAALKYEHLPEAAVADVVFSVQGREKEKAIGALQRLAKLDT
                   190        200        210        220        230        240

240        250        260        270        280        290
  a951.pep   EILPPTLMTLRLTARKYPEILDGFFEQTDTQNLSAVWQEMEIMNLVSLHRLDDAYARLNV
             ||||||||||||||||||||||||||||||||||||||||||||||||||||||||||||
  m951       EILPPTLMTLRLTARKYPEILDGFFEQTDTQNLSAVWQEMEIMNLVSLHRLDDAYARLNV
                   250        260        270        280        290        300

300        310        320        330        340        350
  a951.pep   LLERNPNADLYIQAAILAANRKEGASVIDGYAEKAYGRGTGEQRGRAAMTAAMIYADRRD
             |||||||||||||||||||||||||||||||||||||||||| |:||| :|||:||||||
  m951       LLERNPNADLYIQAAILAANRKEGASVIDGYAEKAYGRGTEEQRSRAALTAAMMYADRRD
                   310        320        330        340        350        360

360        370        380        390        400        410
  a951.pep   YTKVRQWLKKVSAPEYLFDKGVLAAAAAVELDGGRAALRQIGRVRKLPEQQGRYFTADNL
             |:||||||||||||||||||||||||||||||||||||||||||||||||||||||||||
  m951       YAKVRQWLKKVSAPEYLFDKGVLAAAAAVELDGGRAALRQIGRVRKLPEQQGRYFTADNL
                   370        380        390        400        410        420

420        430        440        450        460        470
  a951.pep   SKIQMFALSKLPDKREALRGLDKIIEKPPAGSNTELQAEALVQRSVVYDRLGKRKKMISD
             |||||:||||||||||||||||||||||||||||||||||||||||||||||||||||||
  m951       SKIQMLALSKLPDKREALRGLDKIIEKPPAGSNTELQAEALVQRSVVYDRLGKRKKMISD
                   430        440        450        460        470        480
```

-continued

```
             480        490        500        510        520        530
a951.pep  LERAFRLAPDNAQIMNNLGYSLLSDSKRLDEGFALLQTAYQINPDDTAVNDSIGWAYYLK
          ||||||||||||||||||||||||:|||||||||||||||||||||||||||||||||||
m951      LERAFRLAPDNAQIMNNLGYSLLTDSKRLDEGFALLQTAYQINPDDTAVNDSIGWAYYLK
                 490        500        510        520        530        540

540        550        560        570        580        590
a951.pep  GDAESALPYLRYSFENDPEPEVAAHLGEVLWALGERDQAVDVWTQAAHLTGDKKIWRETL
          ||||||||||||||||||||||||||||||||||||||||||||||||||||||||||||
m951      GDAESALPYLRYSFENDPEPEVAAHLGEVLWALGERDQAVDVWTQAAHLTGDKKIWRETL
                 550        560        570        580        590        600

600        610
a951.pep  KRHGIALPQPSRKPRK
          ||||||||||||||||
m951      KRHGIALPQPSRKPRK
                 610
```

The following partial DNA sequence was identified in *N. gonorrhoeae* <SEQ ID 2909>:

```
g952.seq (partial)
    1    ..TTGTCTTATC GTTTGAATGC TGCACCGATG TTTAACGATA ATCCTGTTGT

51      TTACGGAAAA ATCAAATTGC AGAGTTGGAA AGCGCGGCGG GATTTCAATA

101      TTGTAAAGCA GGATTTGGAT TTTTCCTGCG GGGCGGCTTC GGTGGCGACG

151      CTTTTGAACA ATTTTTACGG GCAAAAGCTG ACGGAAGAAG AAGTGTTGGA

201      AAAACTGGGT AAGGAACAGA TGCGCGCGTC GTTTGAGGAT ATGCGGCGCA

251      TTATGCCCGA TTTGGGTTTT GAGGCGAAAG GCTATGCCCT GTCTTTCGAA

301      CAGCTCGCGC AGTTGAAAAT CCCCGTCATC GTGTATCTGA AATACCGCAA

351      AGACGACCAT TTTTCGGTAT TGCGCGGAGT GGATGGCAAT ACGGTTTTGC

401      TTGCCGACCC GTCGCCGGGT CATGTTTCGA TGAGCAGGGC GCAGTTTTTG

451      GAGGCTTGGC AAACCCGTGA GGGAAATTTG GCAGGCAAAA TTTTGGCGGT

501      CGTGCCGAAA AAAGCGGAGG CGATTTCAAA TAAATTGTTT TTCACACATC

551      ATCCCAAGCG GCAGACGGAG TTTGCAGTCG GACAGGTAAA ATGGTGGCGT

601      GCTTATTGA
```

This corresponds to the amino acid sequence <SEQ ID 2910; ORF 952.ng>:

```
g952.pep (partial)
    1    ..LSYRLNAAPM FNDNPVVYGK IKLQSWKARR DFNIVKQDLD FSCGAASVAT

51      LLNNFYGQKL TEEEVLEKLG KEQMRASFED MRRIMPDLGF EAKGYALSFE

101      QLAQLKIPVI VYLKYRKDDH FSVLRGVDGN TVLLADPSPG HVSMSRAQFL

151      EAWQTREGNL AGKILAVVPK KAEAISNKLF FTHHPKRQTE FAVGQVKWWR

201      AY*
```

The following partial DNA sequence was identified in *N. meningitidis* <SEQ ID 2911>:

```
m952.seq
    1    ATGATGAAGT TCAAATATGT TTTTCTGTTG GCGTGTGTTG TCGTTTCTTT

51    ATCTTATCGT TTGAATGCTG CACCGATGTT TAACGATAAT CCTGTTGTTT

101    ACGGAAAAAT CAAAGTGCAG AGTTGGAAAG CGCGGCGGGA TTTCAATATT

151    GTAAAGCAGG ATTTGGATTT TTCCTGTGGG GCGGCTTCGG TGGCGACGCT
```

-continued
```
  201  TTTGAACAAT TTTTACGGGC AAACGCTGAC GGAAGAAGAA GTGTTGAAAA

251  AGCTGGATAA GGAGCAGATG CGCGCGTCGT TTGAGGATAT GCGGCGCATT

301  ATGCCTGATT TGGGTTTTGA GGCGAAGGGC TATGCCCTGT CTTTCGAGCA

351  GCTCGCGCAG TTGAAAATCC CCGTCATCGT GTATCTGAAA TACCGCAAAG

401  ACGACCATTT TTCGGTATTG CGCGGTATAG ACGGCAATAC GGTTTTGCTT

451  GCCGACCCGT CGCTGGGGCA TGTTTCAATG AGCAGGGCGC AGTTTTTGGA

501  TGCTTGGCAA ACCCGTGAGG GAAATTTGGC AGGTAAGATT TTGGCTGTCA

551  TACCGAAAAA AGCCGAGACA ATTTCAAATA AATTGTTTTT CACACAACAC

601  CCAAAACGGC AGACGGAGTT TACAGTCGGA CAAATCAGGC AAGCACGTGC

651  AGAGTAA
```

This corresponds to the amino acid sequence <SEQ ID 2912; ORF 952>:

```
m952.pep
    1  MMKFKYVFLL ACVVVSLSYR LNAAPMFNDN PVVYGKIKVQ SWKARRDFNI

51  VKQDLDFSCG AASVATLLNN FYGQTLTEEE VLKKLDKEQM RASFEDMRRI

101  MPDLGFEAKG YALSFEQLAQ LKIPVIVYLK YRKDDHFSVL RGIDGNTVLL

151  ADPSLGHVSM SRAQFLDAWQ TREGNLAGKI LAVIPKKAET ISNKLFFTQH

201  PKRQTEFTVG QIRQARAE*
```

Computer analysis of this amino acid sequence gave the following results:
Homology with a Predicted ORF from *N. gonorrhoeae*
ORF 952 shows 92.5% identity over a 201 aa overlap with a predicted ORF (ORF 952) from *N. gonorrhoeae*
g952/m952; 92.5% identity in 201 aa overlap

```
                         10         20         30         40
      g952.pep            LSYRLNAAPMFNDNPVVYGKIKLQSWKARRDFNIVKQDLDFSCG
                          |||||||||||||||||||||||:||||||||||||||||||||
      m952       MMKFKYVFLLACVVVSLSYRLNAAPMFNDNPVVYGKIKVQSWKARRDFNIVKQDLDFSCG
                         10        20        30        40        50        60
                       50        60        70        80        90       100
      g952.pep    AASVATLLNNFYGQKLTEEEVLEKLGKEQMRASFEDMRRIMPDLGFEAKGYALSFEQLAQ
                  |||||||||||||  ||||||:||  |||||||||||||||||||||||||||||||||
      m952        AASVATLLNNFYGQTLTEEEVLKKLDKEQMRASFEDMRRIMPDLGFEAKGYALSFEQLAQ
                         70        80        90       100       110       120
                      110       120       130       140       150       160
      g952.pep    LKIPVIVYLKYRKDDHFSVLRGVDGNTVLLADPSPGHVSMSRAQFLEAWQTREGNLAGKI
                  |||||||||||||||||||||||:|||||||||||| ||||||||||:||||||||||||
      m952        LKIPVIVYLKYRKDDHFSVLRGIDGNTVLLADPSLGHVSMSRAQFLDAWQTREGNLAGKI
                        130       140       150       160       170       180
                      170       180       190       200
      g952.pep    LAVVPKKAEAISNKLFFTHHPKRQTEFAVGQVKWWRAYX
                  |||:|||||:||||||||:|||||||||:|||::  ||
      m952        LAVIPKKAETISNKLFFTQHPKRQTEFTVGQIRQARAE
                        190       200       210
```

The following partial DNA sequence was identified in *N. meningitidis* <SEQ ID 2913>:

```
a952.seq
    1  ATGATGAAGT TCAAATATGT TTTTCTGTTG GCGTGTGTTG TCGTTTCTTT

51  ATCTTATCGT TTGAATGCTG CACCGATGTT TAACGATAAT CCTGTTGTTT

101  ACGGAAAAAT CAAAGTGCAG AGTTGGAAAG AAAGGCGGGA TTTCAATATT
```

-continued
```
151    GTAAAGCAGG ATTTGGATTT TCCTGCGGG GCGGCTTCGG TGGCGACGCT

201    TTTGAACAAT TTTTACGGGC AAACGCTGAC GGAAGAAGAA GTGTTGAAAA

251    AGCTGGATAA GGAGCAGATG CGCGCGTCGT TTGAGGATAT GCGGCGCATT

301    ATGCCAGATT TGGGTTTTGA AGCGAAAGGC TATGCCCTGT CTTTCGAGCA

351    GCTCGCACAG TTGAAAATCC CCGTCATCGT GTATCTGAAA TACCGCAAGG

401    ATGATCATTT CTCGGTATTG CGCGGGATAG ACGGCAATAC GGTTTTGCTT

451    GCCGACCCGT CGCTGGGTCA TGTTTCAATG AGCAGGGCGC AGTTTTNGGA

501    TGCTTGGCAA ACCCGTGAGG GAAATTTGGC AGGTAAGATT TTGGCGGTCG

551    TGCCGAAAAA AGCCGAGACA ATTTCAAATA AATTGTTTTT CACACATCAT

601    CCCAAGCGGC AGACGGAGTT TGCAGTCGGA CAAATCAGGC AAGCACGTGC

651    AGAGTAA
```

This corresponds to the amino acid sequence <SEQ ID 2914; ORF 952.a>:

```
a952.pep
   1   MMKFKYVFLL ACVVVSLSYR LNAAPMFNDN PVVYGKIKVQ SWKERRDFNI

51   VKQDLDFSCG AASVATLLNN FYGQTLTEEE VLKKLDKEQM RASFEDMRRI

101   MPDLGFEAKG YALSFEQLAQ LKIPVIVYLK YRKDDHFSVL RGIDGNTVLL

151   ADPSLGHVSM SRAQFXDAWQ TREGNLAGKI LAVVPKKAET ISNKLFFTHH

201   PKRQTEFAVG QIRQARAE*
```

Computer analysis of this amino acid sequence gave the following results:
Homology with a Predicted ORF from *N. meningitidis*
ORF 952 shows 97.7% identity over a 218 aa overlap with a predicted ORF (ORF 952) from *N. meningitidis*
a952/m952 97.7% identity in 218 aa overlap

```
                   10         20         30         40         50         60
a952.pep   MMKFKYVFLLACVVVSLSYRLNAAPMFNDNPVVYGKIKVQSWKERRDFNIVKQDLDFSCG
           ||||||||||||||||||||||||||||||||||||||||| ||||||||||||||||||
m952       MMKFKYVFLLACVVVSLSYRLNAAPMFNDNPVVYGKIKVQSWKARRDFNIVKQDLDFSCG
                   10         20         30         40         50         60

70         80         90        100        110        120
a952.pep   AASVATLLNNFYGQTLTEEEVLKKLDKEQMRASFEDMRRIMPDLGFEAKGYALSFEQLAQ
           ||||||||||||||||||||||||||||||||||||||||||||||||||||||||||||
m952       AASVATLLNNFYGQTLTEEEVLKKLDKEQMRASFEDMRRIMPDLGFEAKGYALSFEQLAQ
                   70         80         90        100        110        120

130        140        150        160        170        180
a952.pep   LKIPVIVYLKYRKDDHFSVLRGIDGNTVLLADPSLGHVSMSRAQFXDAWQTREGNLAGKI
           |||||||||||||||||||||||||||||||||||||||||||||:|||||||||||||
m952       LKIPVIVYLKYRKDDHFSVLRGIDGNTVLLADPSLGHVSMSRAQFLDAWQTREGNLAGKI
                  130        140        150        160        170        180

190        200        210   219
a952.pep   LAVVPKKAETISNKLFFTHHPKRQTEFAVGQIRQARAEX
           |||:|||||||||||||||:||||||||:|||||||||
m952       LAVIPKKAETISNKLFFTQHPKRQTEFTVGQIRQARAEX
                  190        200        210
```

The following partial DNA sequence was identified in *N. gonorrhoeae* <SEQ ID 2915>:

```
g953.seq
   1   ATGAAAAAAA TCATCTTCGC CGCGCTCGCA GCGGCAGCCG TCGGCACTGC

51   CTCCGCCACC TACAAAGTGG ACGAATATCA CGCCAACGTC CGTTTCGCCA
```

```
-continued
101   TCGACCACTT CAACACCAGC ACCAACGTCG GCGGTTTTTA CGGTCTGACC

151   GGTTCCGTCG AGTTCGATCA AGCAAAACGC GACGGCAAAA TCGACATCAC

201   CATTCCCGTC GCCAACCTGC AAAGCGGTTC GCAACCCTTC ACCGGCCACC

251   TGAAATCCGC CGACATCTTC GATGCCGCTC AATATCCGGA CATCCGCTTC

301   GTTTCCACCA AATTCAACTT CAACGGCAAA AAACTTGTTT CCGTTGACGG

351   CAACCTGACC ATGCGCGGCA AAACCGCCCC CGTCAAACTC AAAGCCGAAA

401   AATTCAACTG CTACCAAAGC CCGATGGCGG AAACCGAAGT TTGCGGCGGC

451   GACTTCAGCA CCACCATCGA CCGCACCAAA TGGGGCGTGG ACTACCTCGT

501   TAACGCCGGT ATGACCAAAA ACGTCCGCAT CGACATCCAA ATCGAAGCTG

551   CAAAACAATA A
```

This corresponds to the amino acid sequence <SEQ ID 2916; ORF 953.ng>:

```
g953.pep
    1   MKKIIFAALA AAAVGTASAT YKVDEYHANV RFAIDHFNTS TNVGGFYGLT

51   GSVEFDQAKR DGKIDITIPV ANLQSGSQPF TGHLKSADIF DAAQYPDIRF

101   VSTKFNFNGK KLVSVDGNLT MRGKTAPVKL KAEKFNCYQS PMAETEVCGG

151   DFSTTIDRTK WGVDYLVNAG MTKNVRIDIQ IEAAKQ*
```

The following partial DNA sequence was identified in *N. meningitidis* <SEQ ID 2917>:

```
m953.seq
    1   ATGAAAAAAA TCATCTTCGC CGCACTCGCA GCCGCCGCCA TCAGTACTGC

51   CTCCGCCGCC ACCTACAAAG TGGACGAATA TCACGCCAAC GCCCGTTTCG

101   CCATCGACCA TTTCAACACC AGCACCAACG TCGGCGGTTT TTACGGTCTG

151   ACCGGTTCCG TCGAGTTCGA CCAAGCAAAA CGCGACGGTA AAATCGACAT

201   CACCATCCCC ATTGCCAACC TGCAAAGCGG TTCGCAACAC TTTACCGACC

251   ACCTGAAATC AGCCGACATC TTCGATGCCG CCCAATATCC GGACATCCGC

301   TTTGTTTCCA CCAAATTCAA CTTCAACGGC AAAAAACTGG TTTCCGTTGA

351   CGGCAACCTG ACCATGCACG GCAAAACCGC CCCCGTCAAA CTCAAAGCCG

401   AAAAATTCAA CTGCTACCAA AGCCCGATGG AGAAAACCGA AGTTTGTGGC

451   GGCGACTTCA GCACCACCAT CGACCGCACC AAATGGGGCA TGGACTACCT

501   CGTTAACGTT GGTATGACCA AAAGCGTCCG CATCGACATC CAAATCGAGG

551   CAGCCAAACA ATAA
```

This corresponds to the amino acid sequence <SEQ ID 2918; ORF 953>:

```
m953.pep
    1   MKKIIFAALA AAAISTASAA TYKVDEYHAN ARFAIDHFNT STNVGGFYGL

51   TGSVEFDQAK RDGKIDITIP IANLQSGSQH FTDHLKSADI FDAAQYPDIR

101   FVSTKFNFNG KKLVSVDGNL TMHGKTAPVK LKAEKFNCYQ SPMEKTEVCG

151   GDFSTTIDRT KWGMDYLVNV GMTKSVRIDI QIEAAKQ*
```

Computer analysis of this amino acid sequence gave the following results:
Homology with a Predicted ORF from *N. gonorrhoeae*
ORF 953 shows 93.0% identity over a 187 aa overlap with a predicted ORF (ORF 953) from *N. gonorrhoeae*
m953/g953 93.0% identity in 187 aa overlap

```
                 10        20        30        40        50        60
m953.pep  MKKIIFAALAAAAISTASAATYKVDEYHANARFAIDHFNTSTNVGGFYGLTGSVEFDQAK
          ||||||||||||::||||  ||||||||||:|||||||||||||||||||||||||||||
g953      MKKIIFAALAAAAVGTASA-TYKVDEYHANVRFAIDHFNTSTNVGGFYGLTGSVEFDQAK
                 10        20        30        40        50

70        80        90       100       110       120
m953.pep  RDGKIDITIPIANLQSGSQHFTDHLKSADIFDAAQYPDIRFVSTKFNFNGKKLVSVDGNL
          ||||||||||:||||||||| ||||||||||||||||||||||||||||||||||||||
g953      RDGKIDITIPVANLQSGSQPFTGHLKSADIFDAAQYPDIRFVSTKFNFNGKKLVSVDGNL
                 60        70        80        90       100       110

130       140       150       160       170       180
m953.pep  TMHGKTAPVKLKAEKFNCYQSPMEKTEVCGGDFSTTIDRTKWGMDYLVNVGMTKSVRIDI
          ||:|||||||||||||||||||||:|||||||||||||||||||:||||:||||:|||||
g953      TMRGKTAPVKLKAEKFNCYQSPMAETEVCGGDFSTTIDRTKWGVDYLVNAGMTKNVRIDI
                120       130       140       150       160       170 m953.pep  QIEAAKQX
          ||||||||
g953      QIEAAKQX
                180
```

The following partial DNA sequence was identified in *N. meningitidis* <SEQ ID 2919>:

```
a953.seq
     1   ATGAAAAAAA TCATCATCGC CGCGCTCGCA GCAGCCGCCA TCGGCACTGC

51   CTCCGCCGCC ACCTACAAAG TGGACGAATA TCACGCCAAC GCCCGTTTCT

101   CTATCGACCA TTTCAACACC AGCACCAACG TCGGCGGTTT TTACGGTCTG

151   ACCGGTTCCG TTGAGTTCGA CCAAGCAAAA CGCGACGGTA AAATCGACAT

201   CACCATCCCC GTTGCCAACC TGCAAAGCGG TTCGCAACAC TTTACCGACC

251   ACCTGAAATC AGCCGACATC TTCGATGCCG CCCAATATCC GGACATCCGC

301   TTTGTTTCCA CCAAATTCAA CTTCAACGGC AAAAAACTGG TTTCCGTTGA

351   CGGCAACCTG ACCATGCACG GCAAAACCGC CCCCGTCAAA CTCAAAGCCG

401   AAAAATTCAA CTGCTACCAA AGCCCGATGT TGAAAACCGA AGTTTGCGGC

451   GGCGACTTCA GCACCACCAT CGACCGCACC AAATGGGGCA TGGACTACCT

501   CGTTAACGTT GGTATGACCA AAAGCGTCCG CATCGACATC CAAATCGAGG

551   CAGCCAAACA ATAA
```

This corresponds to the amino acid sequence <SEQ ID 2920; ORF 953.a>:

```
a953.pep
     1   MKKIIIAALA AAAIGTASAA TYKVDEYHAN ARFSIDHFNT STNVGGFYGL

51   TGSVEFDQAK RDGKIDITIP VANLQSGSQH FTDHLKSADI FDAAQYPDIR

101   FVSTKFNFNG KKLVSVDGNL TMHGKTAPVK LKAEKFNCYQ SPMLKTEVCG

151   GDFSTTIDRT KWGMDYLVNV GMTKSVRIDI QIEAAKQ*
```

Computer analysis of this amino acid sequence gave the following results:
Homology with a Predicted ORF from *N. meningitidis*
ORF 953 shows 97.3% identity over a 187 aa overlap with a predicted ORF (ORF 953) from *N. meningitidis*
a953/m953 97.3% identity in 187 aa overlap

```
                    10        20        30        40        50        60
a953.pep   MKKIIIAALAAAAIGTASAATYKVDEYHANARFSIDHFNTSTNVGGFYGLTGSVEFDQAK
           ||||:||||||||:|||||||||||||||||||:||||||||||||||||||||||||||
m953       MKKIIFAALAAAAISTASAATYKVDEYHANARFAIDHFNTSTNVGGFYGLTGSVEFDQAK
                    10        20        30        40        50        60

70        80        90       100       110       120
a953.pep   RDGKIDITIPVANLQSGSQHFTDHLKSADIFDAAQYPDIRFVSTKFNFNGKKLVSVDGNL
           ||||||||||:|||||||||||||||||||||||||||||||||||||||||||||||||
m953       RDGKIDITIPIANLQSGSQHFTDHLKSADIFDAAQYPDIRFVSTKFNFNGKKLVSVDGNL
                    70        80        90       100       110       120

130       140       150       160       170       180
a953.pep   TMHGKTAPVKLKAEKFNCYQSPMLKTEVCGGDFSTTIDRTKWGMDYLVNVGMTKSVRIDI
           |||||||||||||||||||||||||| |||||||||||||||||||||||||||||||||
m953       TMHGKTAPVKLKAEKFNCYQSPMEKTEVCGGDFSTTIDRTKWGMDYLVNVGMTKSVRIDI
                   130       140       150       160       170       180 a953.pep   QIEAAKQX
           ||||||||
m953       QIEAAKQX
``` g954.seq not found yet
g954.pep not found yet
The following partial DNA sequence was identified in *N. meningitidis* <SEQ ID 2921>:

```
m954.seq
    1    ATGAAAAAGT TTTATTTTGT GCTGCTGGCG TTGGGTTTGG CAGCGTGTGG

51    GCAAGAACAA TCGCAGAAAG CTGATGCGGA GCAGTATTTT TTTGCCAATA

101    AATATCAATT TGCAGATGAG AAACAGGCTT TTTATTTTGA ACGCGCCGCC

151    CGTTTCCGTG TATTGCAACA AGGCCTTGGC GGGGATTTTG AGAGGTTTTT

201    AAAAGGAGAA ATACCTAATC AAGAAAATCT TGCAAAGTAT CGTGAAAATA

251    TTACTCAAGC AGTCGCTTAT TATGCGGACA CGAATGGAGA TGATGACCCA

301    TACCGCGTCT GCAAACAGGC TGCGCAAGAT GCAGAAATCC TGATGAAGAG

351    TATGGTAACA AGCGGTGGAG GCGGTACAAC TGATTTAGAT AAGGAAAGTT

401    ATCAAAATTA CCGAAAATCA ATGCAAGAAT GCCGTAAAAC AATAACGGAA

451    GCTGAAGCCA ATTTGCCGAA AAAATAA
```

This corresponds to the amino acid sequence <SEQ ID 2922; ORF 954>:

```
m954.pep
    1    MKKFYFVLLA LGLAACGQEQ SQKADAEQYF FANKYQFADE KQAFYFERAA

51    RFRVLQQGLG GDFERFLKGE IPNQENLAKY RENITQAVAY YADTNGDDDP

101    YRVCKQAAQD AEILMKSMVT SGGGGTTDLD KESYQNYRKS MQECRKTITE

151    AEANLPKK*
``` a954.seq not found yet
a954.pep not found yet
The following partial DNA sequence was identified in *N. gonorrhoeae* <SEQ ID 2923>:

```
g957.seq (partial)
    1   ATGTTTAAAA AATTCAAACC GGTACTGTTG TCATTTTTTG CACTTGTATT
   51   TGCCTTTTGG CTGGGAACAG GTATTGCCTA TGAGATTAAT CCGCGTTGGT
  101   TTTTGAGCGA TACGGCAACT GAAGTACCTG AAAATCCGAA TGCTTTTGTG
  151   GCGAAACTTG CCCGCCTGTT CCGAAATGCC GACAGGGCGG TTGTCATCGT
  201   GAAGGAATCG ATGAGGACGG AGGAAAGCCT TGCCGGAGCT GTGGATGACG
  251   GTCCGTTGCA GTCGGAGAAG GATTATCTCG CGCTCGCTAT CCGGCTCAGT
  301   CGTTTGAAAG AAAAGGCGAA ATGGTTTCAC GTAACGGAGC AGGAACATGG
  351   GGAAGAGGTT TGGCTGGATT ACTATATCGG CGAGGGCGGT TTGGTTGCGG
  401   TTTCGCTTTC GCAACGCTCG CCGGAAGCGT TTGTTAATGC CGAATATCTG
  451   TATCGGAACG ATCGTCCGTT TTCTGTAAAT GTGTACGGCG GAACGGCTCA
  501   CGGGGAAAAT TATGAAACGA CAGGAGAATA TCGGGTTGTT TGGCAACCGG
  551   ACGGTTCGGT ATTTGATGCG GCGGGGCGCG GAAAAATCGG GAAGATGTT
  601   TATGAGCATT GCCTCGGGTG TTATCAGATG GCCCAGGTAT ATTTGGCGAA
  651   ATACCGGGAT GTCGCGAATG ACGAGCAGAA GGTTTGGGAC TTCCGCGAAG
  701   AGAGCAACCG GATTGCATCG GACTCGCGCG ATTATGTGTT TTATCAGAAT
  751   ATGCGGGAAT TGATGCCCCG GGGGatgaaG gcgaacagtc ttgtggtcgg
  801   ctatgatgcg gacggtCtgc CgcaAAAagt ctattggagt gtcgacaatg
  851   gaaaaaaacc ccaaagtgtc gaatattatt tgaaaaacgg aaatcttttt
  901   attgcccaat cttcgacggt aaccttgaaa acggatggcg taacggcgga
  951   tatgcaaacc tatcatgcgc aacaaacgtt gtatttggat ggg...
```

This corresponds to the amino acid sequence <SEQ ID 2924; ORF 957.ng>:

```
g957.pep (partial)
    1   MFKKFKPVLL SFFALVFAFW LGTGIAYEIN PRWFLSDTAT EVPENPNAFV
   51   AKLARLFRNA DRAVVIVKES MRTEESLAGA VDDGPLQSEK DYLALAIRLS
  101   RLKEKAKWFH VTEQEHGEEV WLDYYIGEGG LVAVSLSQRS PEAFVNAEYL
  151   YRNDRPFSVN VYGGTAHGEN YETTGEYRVV WQPDGSVFDA AGRGKIGEDV
  201   YEHCLGCYQM AQVYLAKYRD VANDEQKVWD FREESNRIAS DSRDYVFYQN
  251   MRELMPRGMK ANSLVVGYDA DGLPQKVYWS VDNGKKPQSV EYYLKNGNLF
  301   IAQSSTVTLK TDGVTADMQT YHAQQTLYLD G...
```
55

The following partial DNA sequence was identified in *N. meningitidis* <SEQ ID 2925>:

```
m957.seq
    1   ATGTTTAAAA AATTCAAACC GGTACTGTTG TCATTTTTTG CACTTGTATT
   51   TGCCTTTTGG CTGGGAACGG GTATTGCCTA TGAGATTAAT CCGCGTTGGT
  101   TTTTGAGCGA TACGGCAACT GAAGTACCTA AAAATCCGAA TGCTTTTGTG
  151   GCGAAACTTG CCCGCCTGTT CCGAAATGCC GACAGGGCGG TTGTCATCGT
```

-continued

```
 201   GAAGGAATCG ATAAGGACGG AGGAAAATCT TGCCGGAACT GTGGATGACG

251   GTCCGTTGCA GTCGGAGAAG GATTATCTCG CGCTCGCTAT CCGGCTCAGT

301   CGTTTGAAAG AAAAGGCGAA ATGGTTTCAC GTAACGGAGC AGGAACATGG

351   GAAAGAGGTT TGGCTGGATT ACCATATCGG CGAGGGCGGT TTGGTTGCGG

401   TTTCGCTTTC GCAACGCTCG CCGGAAGCAT TTGTTAATGC CGAATATCTG

451   TATCGGAACG ATCGTCCGTT TTCTGTAAAT GTGTACGGCG GAACGGTTCA

501   CGGGGAAAAT TATGAAACGA CAGGAGAATA TCGGGTTGTT TGGCAACCAG

551   ACGGTTCGGT ATTTGATGCG GCGGGGCGCG GGAAAATCGG GGAAGATGTT

601   TATGAGCATT GCCTCGGGTG TTATCAGATG GCCCAGGTAT ATTTGGCGAA

651   ATACCGGGAT GTCGCGAATG ACGAGCAGAA GGTTTGGGAC TTCCGCAAAG

701   AGAGCAACCG AATTGCGTCG GACTCGCGCA ATTCTGTGTT TTATCAGAAT

751   ATGCGGGAAT TGATGCCCCG AGGGATGAAG GCGAACAGTC TTGTGGTCGG

801   CTATGATGCG GACGGTCTGC CGCAAAAAGT CTATTGGAGT TTCGACAATG

851   GAAAAAAACG CCAGAGTTTC GAATATTATT TGAAAAACGG AAATCTTTTT

901   ATTGCACAAT CTTCGACGGT AGCATTGAAA GCGGATGGCG TAACGGCGGA

951   TATGCAGACC TATCATGCGC AACAGACGTG GTATTTGGAT GGCGGGCGGA

1001   TTGTCCGCGA AGAGAAACAG GGAGACAGAC TGCCTGATTT TCCTTTGAAC

1051   TTGGAAAATT TGGAAAAAGA GGTGCGCCGT TATGCAGAGG CTGCGGCGAG

1101   ACGTTCGGGC GGCAGGCGCG ACCTTTCTCA CTGA
```

This corresponds to the amino acid sequence <SEQ ID 2926; ORF 957>:

```
m957.pep
   1   MFKKFKPVLL SFFALVFAFW LGTGIAYEIN PRWFLSDTAT EVPKNPNAFV

51   AKLARLFRNA DRAVVIVKES IRTEENLAGT VDDGPLQSEK DYLALAIRLS

101   RLKEKAKWFH VTEQEHGKEV WLDYHIGEGG LVAVSLSQRS PEAFVNAEYL

151   YRNDRPFSVN VYGGTVHGEN YETTGEYRVV WQPDGSVFDA AGRGKIGEDV

201   YEHCLGCYQM AQVYLAKYRD VANDEQKVWD FRKESNRIAS DSRNSVFYQN

251   MRELMPRGMK ANSLVVGYDA DGLPQKVYWS FDNGKKRQSF EYYLKNGNLF

301   IAQSSTVALK ADGVTADMQT YHAQQTWYLD GGRIVREEKQ GDRLPDFPLN

351   LENLEKEVRR YAEAAARRSG GRRDLSH*
```

Computer analysis of this amino acid sequence gave the following results:
Homology with a Predicted ORF from *N. gonorrhoeae*
ORF 957 shows 95.2% identity over a 331 aa overlap with a predicted ORF (ORF 957) from *N. gonorrhoeae*
g957/m957 95.2% identity in 331 aa overlap

```
                 10         20         30         40         50         60
g957.pep  MFKKFKPVLLSFFALVFAFWLGTGIAYEINPRWFLSDTATEVPENPNAFVAKLARLFRNA
          ||||||||||||||||||||||||||||||||||||||||:|||||||||||||||||||
m957      MFKKFKPVLLSFFALVFAFWLGTGIAYEINPRWFLSDTATEVPKNPNAFVAKLARLFRNA
                 10         20         30         40         50         60

70         80         90        100        110        120
g957.pep  DRAVVIVKESMRTEESLAGAVDDGPLQSEKDYLALAIRLSRLKEKAKWFHVTEQEHGEEV
          ||||||||||:||||:|||:||||||||||||||||||||||||||||||||||||||:|
m957      DRAVVIVKESIRTEENLAGTVDDGPLQSEKDYLALAIRLSRLKEKAKWFHVTEQEHGKEV
                 70         80         90        100        110        120
```

-continued

```
                130        140        150        160        170        180
g957.pep  WLDYYIGEGGLVAVSLSQRSPEAFVNAEYLYRNDRPFSVNVYGGTAHGENYETTGEYRVV
          ||||:||||||||||||||||||||||||||||||||||||||:||||||||||||||
m957      WLDYHIGEGGLVAVSLSQRSPEAFVNAEYLYRNDRPFSVNVYGGTVHGENYETTGEYRVV
                130        140        150        160        170        180

190        200        210        220        230        240
g957.pep  WQPDGSVFDAAGRGKIGEDVYEHCLGCYQMAQVYLAKYRDVANDEQKVWDFREESNRIAS
          ||||||||||||||||||||||||||||||||||||||||||||||||||||:|||||||
m957      WQPDGSVFDAAGRGKIGEDVYEHCLGCYQMAQVYLAKYRDVANDEQKVWDFRKESNRIAS
                190        200        210        220        230        240

250        260        270        280        290        300
g957.pep  DSRDYVFYQNMRELMPRGMKANSLVVGYDADGLPQKVYWSVDNGKKPQSVEYYLKNGNLF
          |||: |||||||||||||||||||||||||||||||||| ||||| || ||||||||||
m957      DSRNSVFYQNMRELMPRGMKANSLVVGYDADGLPQKVYWSFDNGKKRQSFEYYLKNGNLF
                250        260        270        280        290        300

310        320        330
g957.pep  IAQSSTVTLKTDGVTADMQTYHAQQTLYLDG
          |||||||:||:|||||||||||||||| ||||
m957      IAQSSTVALKADGVTADMQTYHAQQTWYLDGGRIVREEKQGDRLPDFPLNLENLEKEVRR
                310        320        330        340        350        360 m957      YAEAAARRSGGRRDLSHX
                370
```

The following partial DNA sequence was identified in *N. meningitidis* <SEQ ID 2927>:

```
a957.seq
      1  ATGTTTAAAA AATTCAAACC GGTACTGTTG TCATTTTTTG CACTTGTATT

51  TGCCTTTTGG CTGGGAACGG GTATTGCCTA TGAGATTAAT CCGCGTTGGT

101  TTTTGAGCGA TACGGCAACT GAAAATCCGA ATGCTTTTGT GGCGAAACTT

151  GCCCGCCTGT TCCGAAATGC CGACAGGGCG GTTGTCATCG TGAAGGAATC

201  GATGAGGACG GAGGAAAGTC TTGCCGGAGC TGTGGATGAC GGTCCGTTGC

251  AGTCGGAGAA GGATTATCTT GCACTCGCTG TCCGGCTCAG TCGTTTGAAA

301  GAAAAGGCGA AATGGTTTCA CGTAACGGAG CAGGAACATG GGGAAGAGGT

351  TTGGCTGGAT TACTATATCG GCGAGGGCGG TTTGGTTGCG GTTTCGCTTT

401  CGCAACGCTC GCCGGAAGCG TTTGTTAATG CCGAATATCT GTATCGGAAC

451  GATCGTCCGT TTTCTGTAAA TGTGTACGGC GGAACGGTTC ACGGGGAAAA

501  TTATGAAACG ACAGGAGAAT ATCGGGTTGT TTGGCAACCG GACGGTTCGG

551  TATTTGATGC GTCGGGGCGC GGGAAAATCG GGGAAGATGT TTATGAGCAT

601  TGCCTCGGGT GTTATCAGAT GGCCCAGGTA TATTTGGCGA AATATCGGGA

651  TGTCGCGAAT GATGAGCAGA AGGTTTGGGA CTTCCGCGAA GAGAGTAACC

701  GGATTGCGTC GGACTCGCGC GATTCTGTGT TTTATCAGAA TATGCGGGAA

751  TTGATGCCCC GAGGGATGAA GGCAAACAGT CTTGTGGTCG GCTATGATGC

801  GGACGGTCTG CCGCAGAAAG TCTATTGGAG TTTCGACAAT GGGAAAAAAC

851  GCCAGAGTTT CGAATATTAT TTGAAAAACG GAAATCTTTT TATTGCACAA

901  TCTTCGACGG TAGCATTGAA AGCGGATGGC GTAACGGCGG ATATGCAGAC

951  CTATCATGCG CAACAGACGT GGTATTTAGA TGGCGGGCGG ATTGTCCGCG

1001  AAGAGAAACA GGGGGACAGA CTGCCTGATT TTCCTTTGAA CTTGGAAGAT

1051  TTGGAAAAAG AGGTGAGCCG TTATGCAGAG GCTGCGGCGA GACGTTCGGG

1101  CGGCAGGCGC GACCTTTCTC ACTGA
```

This corresponds to the amino acid sequence <SEQ ID 2928; ORF 957.a>:

```
a957.pep
    1   MFKKFKPVLL SFFALVFAFW LGTGIAYEIN PRWFLSDTAT ENPNAFVAKL

51   ARLFRNADRA VVIVKESMRT EESLAGAVDD GPLQSEKDYL ALAVRLSRLK

101   EKAKWFHVTE QEHGEEVWLD YYIGEGGLVA VSLSQRSPEA FVNAEYLYRN

151   DRPFSVNVYG GTVHGENYET TGEYRVVWQP DGSVFDASGR GKIGEDVYEH

201   CLGCYQMAQV YLAKYRDVAN DEQKVWDFRE ESNRIASDSR DSVFYQNMRE

251   LMPRGMKANS LVVGYDADGL PQKVYWSFDN GKKRQSFEYY LKNGNLFIAQ

301   SSTVALKADG VTADMQTYHA QQTWYLDGGR IVREEKQGDR LPDFPLNLED

351   LEKEVSRYAE AAARRSGGRR DLSH*
```

Computer analysis of this amino acid sequence gave the following results:
Homology with a Predicted ORF from *N. meningitidis*
ORF 957 shows 96.3% identity over a 377 aa overlap with a predicted ORF (ORF 957) from *N. meningitidis*
a957/m957 96.3% identity in 377 aa overlap

```
                    10         20         30         40         50
    a957.pep  MFKKFKPVLLSFFALVFAFWLGTGIAYEINPRWFLSDTATE---NPNAFVAKLARLFRNA
              |||||||||||||||||||||||||||||||||||||||    |||||||||||||||||
    m957      MFKKFKPVLLSFFALVFAFWLGTGIAYEINPRWFLSDTATEVPKNPNAFVAKLARLFRNA
                    10         20         30         40         50         60
                    60         70         80         90        100        110
    a957.pep  DRAVVIVKESMRTEESLAGAVDDGPLQSEKDYLALAVRLSRLKEKAKWFHVTEQEHGEEV
              ||||||||||:||||:|||:||||||||||||||||:|||||||||||||||||||||:||
    m957      DRAVVIVKESIRTEENLAGTVDDGPLQSEKDYLALAIRLSRLKEKAKWFHVTEQEHGKEV
                    70         80         90        100        110        120
                   120        130        140        150        160        170
    a957.pep  WLDYYIGEGGLVAVSLSQRSPEAFVNAEYLYRNDRPFSVNVYGGTVHGENYETTGEYRRV
              ||||:|||||||||||||||||||||||||||||||||||||||||||||||||||||||
    m957      WLDYHIGEGGLVAVSLSQRSPEAFVNAEYLYRNDRPFSVNVYGGTVHGENYETTGEYRRV
                   130        140        150        160        170        180
                   180        190        200        210        220        230
    a957.pep  WQPDGSVFDASGRGKIGEDVYEHCLGCYQMAQVYLAKYRDVANDEQKVWDFREESNRIAS
              ||||||||||:|||||||||||||||||||||||||||||||||||||||||:|||||||
    m957      WQPDGSVFDAAGRGKIGEDVYEHCLGCYQMAQVYLAKYRDVANDEQKVWDFRKESNRIAS
                   190        200        210        220        230        240
                   240        250        260        270        280        290
    a957.pep  DSRDSVFYQNMRELMPRGMKANSLVVGYDADGLPQKVYWSFDNGKKRQSFEYYLKNGNLF
              |||:||||||||||||||||||||||||||||||||||||||||||||||||||||||||
    m957      DSRNSVFYQNMRELMPRGMKANSLVVGYDADGLPQKVYWSFDNGKKRQSFEYYLKNGNLF
                   250        260        270        280        290        300
                   300        310        320        330        340        350
    a957.pep  IAQSSTVALKADGVTADMQTYHAQQTWYLDGGRIVREEKQGDRLPDFPLNLEDLEKEVSR
              ||||||||||||||||||||||||||||||||||||||||||||||||||||:||||| |
    m957      IAQSSTVALKADGVTADMQTYHAQQTWYLDGGRIVREEKQGDRLPDFPLNLENLEKEVRR
                   310        320        330        340        350        360
                   360        370
    a957.pep  YAEAAARRSGGRRDLSHX
              ||||||||||||||||||
    m957      YAEAAARRSGGRRDLSHX
                   370
```

The following partial DNA sequence was identified in *N. gonorrhoeae* <SEQ ID 2929>:

```
g958.seq
    1   TTGGCTCGTT TATTTTCACT CAAACCACTG GTGCTGGCAT TGGGCTTCTG

51   TTTCGGCACG CATTGCGCCG CCGATACCGT TGCGGCGGAA GAGGCGGACG

101   GGCGTGTCGC AGAAGGCGGT GCGCAGGGCG CGTCCGAATC CGCACAAGCT

151   TCCGATTTGA CCCTCGGTTC GACCTGCCTG TTTTGCAGTA ACGAAAGCGG
```

-continued

```
 201  CAGCCCCGAG AGAACCGAAG CCGCCGTCCA AGGCAGCGGC GAAGCATCCG
 251  TCCCCGAAGA CTATACGCGC ATTGTTGCCG ACAGGATGGA AGGACAGTCG
 301  AAGGTTAAGG TGCGCGCGGA AGGAAGCGTT ATCATCGAAC GGGACGGCGC
 351  AGTCCTCAAT ACCGATTGGG CGGATTACGA CCAGTCGGGC GACACCGTTA
 401  CCGTAGGCGA CCGGTTCGCC CTCCAACAGG ACGGTACGCT GATTCGGGGC
 451  GAAACCCTGA CCTACAATCT CGATCAGCAG ACCGGCGAAG CGCACAACGT
 501  CCGTATGGAA CCGAACAAG GCGGACGGCG GCTGCAAAGC GTCAGCCGCA
 551  CCGCCGAAAT GTTGGGCGAA GGGCGTTACA AACTGACGGA AACCCAATTC
 601  AACACCTGTT CCGCCGGAGA TGCCGGCTGG TATGTCAAGG CCGCCTCTGT
 651  CGAAGCCGAT CGGGGAAAAG GCATAGGCGT TGCCAAACAC GCCGCCTTCG
 701  TGTTCGGCGG CGTTCCCCTT TTCTATACGC CTTGGGCGGA CTTCCCGCTT
 751  GACGGCAACC GCAAAAGCGG ACTGCTCGTC CCGTCCGTAT CTGCCGGTTC
 801  GGACGGCGTT TCCCTTTCCG TCCCTATTA TTTCAACCTT GCCCCCAACT
 851  TCGATGCCAC TTTCGCCCCC GGCATTATCG GCGAACGCGG CGCGACGTTT
 901  GACGGACAAA TCCGTTACCT GCGTCCCGAT TACAGCGGAC AGACCGACCT
 951  GACCTGGTTG CCGCACGATA AGAAAAGCGG CAGGAACAAC CGCTATCAGG
1001  CAAAATGGCA GCACCGGCAC GACATTTCCG ACACGCTTCA GGCGGGTGTC
1051  GATTTCAACC AAGTCTCCGA CAGCGGCTAC TACCGCGACT TTTACGGCGG
1101  CGAAGAAATC GCCGGCAACG TCAACCTCAA CCGCCGCGTA TGGCTGGATT
1151  ATGGCGGCAG GGCGGCGGGA GGCAGCCTGA ATGCCGGCCT TTCGGTTCAG
1201  AAATACCAGA CGCTGGCAAA CCAAAGCGGC TACAAAGACG AACCTTACGC
1251  CATCATGCCC CGCCTTTCTG CCGATTGGCA TAAAAACGCA GGCAGGGCGC
1301  AAATCGGCGT GTCCGCACAA TTTACCCGCT TCAGCCACGA CGGCCGCCAA
1351  GACGGCAGCC GACTGGTCGT GTATCCCGGT ATCAAATGGG ATTTCAGCAA
1401  CAGCTGGGGC TACGTCCGCC CCAAACTCGG GCTGCACGCC ACTTATTACA
1451  GCCTCGACAG TTTCGGCGGC AAAGCATCCC GCAGCGTCGG GCGCGTTTTG
1501  CCCGTTGTCA ATATCGACGG CGGCACAACC TTCGAACGCA ATACGCGCCT
1551  GTTCGGCGGC GGAGTCGTGC AAACCATCGA GCCGCGCCTG TTCTACAACT
1601  ATATTCCTGC CAAATCTCAA AACGACCTGC CCAATTTCGA TTCGTCGGAA
1651  AGCAGCTTCG GCTACGGGCA GCTTTTCCGC GAAAACCTCT ATTACGGCAA
1701  CGACCGCATC AACGCCGCCA ACAGCCTTTC CACCGCCGTG CAGAGCCGTA
1751  TTTTGGACGG CGCGACGGGG GAGGAGCGTT CCGCGCCGG TATCGGTCAG
1801  AAATTCTATT TCAAGGATGA TGCGGTGATG CTTGACGGCA GCGTCGGCAA
1851  AAATCCGCGC AGCCGTTCCG ACTGGGTGGC ATTCGCCTCC GGCGGCATAG
1901  GCGGGCGTTT CACCCTCGAC AGCAGCATCC ACTACAACCA AAACGACAAA
1951  CGCGCCGAAC ATTACGCCGT CGGCGCAGGC TACCGCCCCG CCCCCGGAAA
2001  AGTGTTGAAC GCCCGCTACA AATACGGGCG CAACGAAAAA ATCTACCTGC
2051  AGGCGGACGG TTCCTATTTT TACGACAAAC TCAGCCAGCT CGACCTGTCC
2101  GCACAATGGC CGCTGACGCG CAACCTGTCT GCCGTCGTCC GCTACAACTA
2151  CGGTTTTGAA GCCAAAAAAC CGATAGAAAT GCTTGCCGGT GCAGAATACA
```

```
-continued
2201    AAAGCAGTTG CGGCTGCTGG GGCGCGGGCG TGTACGCCCA ACGCTACGTT

2251    ACCGGCGAAA ACACCTACAA AAACGCCGTC TTTTTTTCAC TTCAGTTGAA

2301    AGACCTCAGC AGCGTCGGCA GAAACCCCGC AGGCAGGATG GATGTCGCCG

2351    TTCCCGGCTA CATCCCCGCC CACTCTCTTT CCGCCGGACG CAACAAACGG

2401    CCCTGA
```

This corresponds to the amino acid sequence <SEQ ID 2930; ORF 958.ng>:

```
g958.pep
    1   LARLFSLKPL VLALGFCFGT HCAADTVAAE EADGRVAEGG AQGASESAQA

51   SDLTLGSTCL FCSNESGSPE RTEAAVQGSG EASVPEDYTR IVADRMEGQS

101   KVKVRAEGSV IIERDGAVLN TDWADYDQSG DTVTVGDRFA LQQDGTLIRG

151   ETLTYNLDQQ TGEAHNVRME TEQGGRRLQS VSRTAEMLGE GRYKLTETQF

201   NTCSAGDAGW YVKAASVEAD RGKGIGVAKH AAFVFGGVPL FYTPWADFPL

251   DGNRKSGLLV PSVSAGSDGV SLSVPYYFNL APNFDATFAP GIIGERGATF

301   DGQIRYLRPD YSGQTDLTWL PHDKKSGRNN RYQAKWQHRH DISDTLQAGV

351   DFNQVSDSGY YRDFYGGEEI AGNVNLNRRV WLDYGGRAAG GSLNAGLSVQ

401   KYQTLANQSG YKDEPYAIMP RLSADWHKNA GRAQIGVSAQ FTRFSHDGRQ

451   DGSRLVVYPG IKWDFSNSWG YVRPKLGLHA TYYSLDSFGG KASRSVGRVL

501   PVVNIDGGTT FERNTRLFGG GVVQTIEPRL FYNYIPAKSQ NDLPNFDSSE

551   SSFGYGQLFR ENLYYGNDRI NAANSLSTAV QSRILDGATG EERFRAGIGQ

601   KFYFKDDAVM LDGSVGKNPR SRSDWVAFAS GGIGGRFTLD SSIHYNQNDK

651   RAEHYAVGAG YRPAPGKVLN ARYKYGRNEK IYLQADGSYF YDKLSQLDLS

701   AQWPLTRNLS AVVRYNYGFE AKKPIEMLAG AEYKSSCGCW GAGVYAQRYV

751   TGENTYKNAV FFSLQLKDLS SVGRNPAGRM DVAVPGYIPA HSLSAGRNKR

801   P*
```

The following partial DNA sequence was identified in *N. meningitidis* <SEQ ID 2931>:

```
m958.seq
    1   TTGGCTCGTT TATTTTCACT CAAACCACTG GTGCTGGCAT GGGCCTCTG

51   CTTCGGCACG CATTGCGCCG CCGCCGATGC CGTTGCGGCG GAGGAAACGG

101   ACAATCCGAC CGCCGGAGAA AGCGTTCGGA GCGTGTCCGA ACCCATACAG

151   CCTACCAGCC TGAGCCTCGG TTCGACCTGC CTGTTTTGCA GTAACGAAAG

201   CGGCAGCCCC GAGAGAACCG AAGCCGCCGT CCAAGGCAGC GGCGAAGCAT

251   CCATCCCCGA AGACTATACG CGCATTGTTG CCGACAGGAT GGAAGGACAG

301   TCGCAGGTGC AGGTGCGTGC CGAAGGCAAC GTCGTCGTCG AACGCAACCG

351   GACGACCCTC AATACCGATT GGGCGGATTA CGACCAGTCG GGCGACACCG

401   TTACCGCAGG CGACCGGTTC GCCCTCCAAC AGGACGGTAC GCTGATTCGG
```

-continued

```
 451 GGCGAAACCC TGACCTACAA TCTCGAGCAG CAGACCGGGG AAGCGCACAA
 501 CGTCCGCATG GAAATCGAAC AAGGCGGACG GCGGCTGCAA AGCGTCAGCC
 551 GCACCGCCGA AATGTTGGGC GAAGGGCATT ACAAACTGAC GGAAACCCAA
 601 TTCAACACCT GTTCCGCCGG CGATGCCGGC TGGTATGTCA AGGCAGCCTC
 651 TGTCGAAGCC GATCGGGAAA AAGGCATAGG CGTTGCCAAA CACGCCGCCT
 701 TCGTGTTCGG CGGCGTTCCC ATTTTCTACA CCCCTTGGGC GGACTTCCCG
 751 CTTGACGGCA ACCGCAAAAG CGGCCTGCTT GTTCCCTCAC TGTCCGCCGG
 801 TTCGGACGGC GTTTCCCTTT CCGTTCCCTA TTATTTCAAC CTTGCCCCCA
 851 ATCTCGATGC CACGTTCGCG CCCAGCGTGA TCGGCGAACG CGGCGCGGTC
 901 TTTGACGGGC AGGTACGCTA CCTGCGGCCG GATTATGCCG GCCAGTCCGA
 951 CCTGACCTGG CTGCCGCACG ACAAGAAAAG CGGCAGGAAT AACCGCTATC
1001 AGGCGAAATG GCAGCATCGG CACGACATTT CCGACACGCT TCAGGCGGGT
1051 GTCGATTTCA ACCAAGTCTC CGACAGCGGC TACTACGCG ACTTTTACGG
1101 CAACAAAGAA ATCGCCGGCA ACGTCAACCT CAACCGCCGT GTATGGCTGG
1151 ATTATGGCGG CAGGGCGGCG GGCGGCAGCC TGAATGCCGG CCTTTCGGTT
1201 CTGAAATACC AGACGCTGGC AAACCAAAGC GGCTACAAAG ACAAACCGTA
1251 TGCCCTCATG CCGCGCCTTT CGGTCGAGTG GCGTAAAAAC ACCGGCAGGG
1301 CGCAAATCGG CGTGTCCGCA CAATTTACCC GATTCAGCCA CGACAGCCGC
1351 CAAGACGGCA GCCGCCTGGT CGTCTATCCC GACATCAAAT GGGATTTCAG
1401 CAACAGCTGG GGCTATGTCC GTCCCAAACT CGGACTGCAC GCCACCTATT
1451 ACAGCCTCAA CCGCTTCGGC AGCCAAGAAG CCCGACGCGT CAGCCGCACT
1501 CTGCCCATTG TCAACATCGA CAGCGGCGCA ACTTTTGAGC GGAATACGCG
1551 GATGTTCGGC GGAGAAGTCC TGCAAACCCT CGAGCCGCGC CTGTTCTACA
1601 ACTATATTCC TGCCAAATCC CAAAACGACC TGCCCAATTT CGATTCGTCG
1651 GAAAGCAGCT TCGGCTACGG GCAGCTCTTT CGCGAAAACC TCTATTACGG
1701 CAACGACAGG ATTAACACCG CAAACAGCCT TTCCGCCGCC GTGCAAAGCC
1751 GTATTTTGGA CGGCGCGACG GGGGAAGAGC GTTTCCGCGC CGGCATCGGT
1801 CAGAAATTCT ATTTCAAGGA TGATGCGGTG ATGCTTGACG GCAGCGTCGG
1851 CAAAAAACCG CGCAACCGTT CCGACTGGGT GGCATTTGCC TCCGGCAGCA
1901 TCGGCAGCCG CTTCATCCTC GACAGCAGCA TCCACTACAA CCAAAACGAC
1951 AAACGCGCCG AGAACTACGC CGTCGGTGCA AGCTACCGTC CCGCACAGGG
2001 CAAAGTGCTG AACGCCCGCT ACAAATACGG GCGCAACGAA AAAATCTACC
2051 TGAAGTCCGA CGGTTCCTAT TTTTACGACA AACTCAGCCA GCTCGACCTG
2101 TCCGCACAAT GGCCGCTGAC GCGCAACCTG TCGGCCGTCG TCCGTTACAA
2151 CTACGGTTTT GAAGCCAAAA AACCGATAGA GGTGCTGGCG GGTGCGGAAT
2201 ACAAAAGCAG TTGCGGCTGC TGGGCGCGG GCGTGTACGC CCAACGCTAC
2251 GTTACCGGCG AAAACACCTA CAAAAACGCT GTCTTTTTCT CACTTCAGTT
2301 GAAAGACCTC AGCAGTGTCG GCAGAAACCC CGCAGACAGG ATGGATGTCG
2351 CCGTTCCCGG CTATATCACC GCCCACTCTC TTTCCGCCGG ACGCAACAAA
2401 CGACCCTGA
```

This corresponds to the amino acid sequence <SEQ ID 2932; ORF 958>:

```
m958.pep
    1   LARLFSLKPL VLALGLCFGT HCAAADAVAA EETDNPTAGE SVRSVSEPIQ

51   PTSLSLGSTC LFCSNESGSP ERTEAAVQGS GEASIPEDYT RIVADRMEGQ

101   SQVQVRAEGN VVVERNRTTL NTDWADYDQS GDTVTAGDRF ALQQDGTLIR

151   GETLTYNLEQ QTGEAHNVRM EIEQGGRRLQ SVSRTAEMLG EGHYKLTETQ

201   FNTCSAGDAG WYVKAASVEA DREKGIGVAK HAAFVFGGVP IFYTPWADFP

251   LDGNRKSGLL VPSLSAGSDG VSLSVPYYFN LAPNLDATFA PSVIGERGAV

301   FDGQVRYLRP DYAGQSDLTW LPHDKKSGRN NRYQAKWQHR HDISDTLQAG

351   VDFNQVSDSG YYRDFYGNKE IAGNVNLNRR VWLDYGGRAA GGSLNAGLSV

401   LKYQTLANQS GYKDKPYALM PRLSVEWRKN TGRAQIGVSA QFTRFSHDSR

451   QDGSRLVVYP DIKWDFSNSW GYVRPKLGLH ATYYSLNRFG SQEARRVSRT

501   LPIVNIDSGA TFERNTRMFG GEVLQTLEPR LFYNYIPAKS QNDLPNFDSS

551   ESSFGYGQLF RENLYYGNDR INTANSLSAA VQSRILDGAT GEERFRAGIG

601   QKFYFKDDAV MLDGSVGKKP RNRSDWVAFA SGSIGSRFIL DSSIHYNQND

651   KRAENYAVGA SYRPAQGKVL NARYKYGRNE KIYLKSDGSY FYDKLSQLDL

701   SAQWPLTRNL SAVVRYNYGF EAKKPIEVLA GAEYKSSCGC WGAGVYAQRY

751   VTGENTYKNA VFFSLQLKDL SSVGRNPADR MDVAVPGYIT AHSLSAGRNK

801   RP*
```

Computer analysis of this amino acid sequence gave the following results:
Homology with a Predicted ORF from *N. gonorrhoeae*
ORF 958 shows 89.3% identity over a 802 aa overlap with a predicted ORF (ORF 958) from *N. gonorrhoeae*
m958/g958 89.3% identity in 802 aa overlap

```
                  10         20         30         40         50         60
m958.pep  LARLFSLKPLVLALGLCFGTHCAAADAVAAEETDNPTAGESVRSVSEPIQPTSLSLGSTC
          |||||||||||||||||:|||||||  |:|||||:|:  :|  ::::::||  |  ::|:|||||
g958      LARLFSLKPLVLALGFCFGTHCAA-DTVAAEEADGRVAEGGAQGASESAQASDLTLGSTC
                  10         30         30         40         50

70         80         90        100        110        120
m958.pep  LFCSNESGSPERTEAAVQGSGEASIPEDYTRIVADRMEGQSQVQVRAEGNVVVERNRTTL
          ||||||||||||||||||||||||:|||||||||||||||:|:|||||:|::||:  ::|
g958      LFCSNESGSPERTEAAVQGSGEASVPEDYTRIVADRMEGQSKVKVRAEGSVIIERDGAVL
                  60         70         80         90        100        110

130        140        150        160        170        180
m958.pep  MTDWADYDQSGDTVTAGDRFALQQDGTLIRGETLTYNLEQQTGEAHNVRMEIEQGGRRLQ
          |||||||||||||||:|||||||||||||||||||||||:|||||||||||:||||||||
g958      MTDWADYDQSGDTVTVGDRFALQQDGTLIRGETLTYNLDQQTGEAHNVRMETEQGGRRLQ
                 120        130        140        150        160        170

190        200        210        220        230        240
m958.pep  SVSRTAEMLGEGHYKLTETQFNTCSAGDAGWYVKAASVEADREKGIGVAKHAAFVFGGVP
          |||||||||||||||||||||||||||||||||||||||||||:|||||||||||||||||
g958      SVSRTAEMLGEGHYKLTETQFNTCSAGDAGWYVKAASVEADRGKGIGVAKHAAFVFGGVP
                 180        190        200        210        220        230

250        260        270        280        290        300
m958.pep  IFYTPWADFPLDGNRKSGLLVPSLSAGSDGVSLSVPYYFNLAPNLDATFAPSVIGERGAV
          :|||||||||||||||||||||:|:|||||||||||||||||||:||||:::||||||:
g958      LFYTPWADFPLDGNRKSGLLVPSVSAGSDGVSLSVPYYFNLAPNFDATFAPGIIGERGAT
                 240        250        260        270        280        290

310        320        330        340        350        360
m958.pep  FDGQVRYLRPDYAGQSDLTWLPHDKKSGRNNRYQAKWQHRHDISDTLQAGVDFNQVSDSG
          ||||:||||||||:||||:|||||||||||||||||||||||||||||||||||||||
g958      FDGQIRYLRPDYSGQTDLTWLPHDKKSGRNNRYQAKWQHRHDISDTLQAGVDFNQVSDSG
                 300        310        320        330        340        350
```

-continued

```
                  370       380       390       400       410       420
m958.pep   YYRDFYGNKEIAGNVNLNRRVWLDYGGRAAGGSLNAGLSVLKYQTLANQSGYKDKPYALM
           |||||||::||||||||||||||||||||||||||||||| |||||||||||||:|||:|
g958       YYRDFYGGEEIAGNVNLNRRVWLDYGGRAAGGSLNAGLSVQKYQTLANQSGYKDEPYAIM
        360       370       380       390       400       410

430       440       450       460       470       480
m958.pep   PRLSVEWRKNTGRAQIGVSAQFTRFSHDSRQDGSRLVVYPDIKWDFSNSWGYVRPKLGLH
           ||||::|:||:|||||||||||||||||:||||||||||| |||||||||||||||||||
g958       PRLSADWHKNAGRAQIGVSAQFTRFSHDGRQDGSRLVVYPGIKWDFSNSWGYVRPKLGLH
        420       430       440       450       460       470

490       500       510       520       530       540
m958.pep   ATYYSLNRFGSQEARRVSRTLPIVNIDSGATFERNTRMFGGEVLQTLEPRLFYNYIPAKS
           ||||||: ||:: :| |:|:||:||||:|:|||||||:||| |:||:|||||||||||||
g958       ATYYSLDSFGGKASRSVGRVLPVVNIDGGTTFERNTRLFGGGVVQTIEPRLFYNYIPAKS
        480       490       500       510       520       530

550       560       570       580       590       600
m958.pep   QNDLPNFDSSESSFGYGQLFRENLYYGNDRINTANSLSAAVQSRILDGATGEERFRAGIG
           ||||||||||||||||||||||||||||||||:|||||:|||||||||||||||||||||
g958       QNDLPNFDSSESSFGYGQLFRENLYYGNDRINAANSLSTAVQSRILDGATGEERFRAGIG
        540       550       560       570       580       590

610       620       630       640       650       660
m958.pep   QKFYFKDDAVMLDGSVGKKPRNRSDWVAFASGSIGSRFILDSSIHYNQNDKRAENYAVGA
           ||||||||||||||||||:||:||||||||||:||:|| |||||||||||||||:|||||
g958       QKFYFKDDAVMLDGSVGKNPRSRSDWVAFASGGIGGRFTLDSSIHYNQNDKRAEHYAVGA
        600       610       620       630       640       650

670       680       690       700       710       720
m958.pep   SYRPAQGKVLNARYKYGRNEKIYLKSDGSYFYDKLSQLDLSAQWPLTRNLSAVVRYNYGF
           :|||| ||||||||||||||||||::||||||||||||||||||||||||||||||||||
g958       GYRPAPGKVLNARYKYGRNEKIYLQADGSYFYDKLSQLDLSAQWPLTRNLSAVVRYNYGF
        660       670       680       690       700       710

730       740       750       760       770       780
m958.pep   EAKKPIEVLAGAEYKSSCGCWGAGVYAQRYVTGENTYKNAVFFSLQLKDLSSVGRNPADR
           |||||||:|||||||||||||||||||||||||||||||||||||||||||||||||| |
g958       EAKKPIEMLAGAEYKSSCGCWGAGVYAQRYVTGENTYKNAVFFSLQLKDLSSVGRNPAGR
        720       730       740       750       760       770

790       800
m958.pep   MDVAVPGYITAHSLSAGRNKRP
           ||||||||| ||||||||||||
g958       MDVAVPGYIPAHSLSAGRNKRPX
        780       790       800
```

The following partial DNA sequence was identified in *N. meningitidis* <SEQ ID 2933>:

```
a958.seq
   1  TTGGCTCGTT TATTTTCACT CAAACCACTG GTGCTGGCAT TGGGCTTCTG

51  TTTCGGCACG CATTGCGCCG CCGCCGATGC CGTTGCGGCG GAGGAAACGG

101  ACAATCCGAC CGCCGGAGGA AGCGTTCGGA GCGTGTCCGA ACCCATACAG

151  CCTACCAGCC TGAGCCTCGG TTCGACCTGC CTGTTTTGCA GTAACGAAAG

201  CGGCAGCCCC GAGAGAACCG AAGCCGCCGT CCAAGGCAGC GGCGAAGCAT

251  CCATCCCCGA AGACTATACG CGCATTGTTG CCGACAGGAT GGAAGGACAG

301  TCGCAGGTGC AGGTGCGTGC CGAAGGCAAC GTCGTCGTCG AACGCAATCG

351  GACGACCCTC AATGCCGATT GGGCGGATTA CGACCAGTCG GGCGACACCG

401  TTACCGCAGG CGACCGGTTC GCCCTCCAAC AGGACGGTAC GCTGATTCGG

451  GGCGAAACCC TGACCTACAA TCTCGAGCAG CAGACCGGGG AAGCGCACAA

501  CGTCCGTATG GAAACCGAAC ACGGCGGACG GCGGCTGCAA AGCGTCAGCC

551  GCACCGCCGA AATGTTGGGC GAAGGGCATT ACAAACTGAC GGAAACCCAA

601  TTCAACACCT GTTCCGCCGG CGATGCCGGC TGGTATGTCA AGGCCGCTTC

651  CGTCGAAGCC GATCGGGAAA AAGGCATAGG CGTTGCCAAA CACGCCGCCT

701  TCGTGTTCGG CGGCGTTCCC ATTTTCTACA CCCCTTGGGC GGACTTCCCG

751  CTTGACGGCA ACCGCAAAAG CGGCCTGCTC GTTCCCTCAC TGTCCGCCGG
```

```
-continued
 801   TTCGGACGGC GTTTCCCTTT CCGTTCCCTA TTATTTCAAC CTTGCCCCCA

851   ATCTCGATGC CACGTTCGCG CCCGGCGTGA TCGGCGAACG CGGCGCGGTC

901   TTTGACGGGC AGGTACGCTA CCTGCGGCCG GATTATGCCG GCCAGTCCGA

951   CCTGACCTGG CTGCCGCACG ACAAGAAAAG CGGCAGGAAT AACCGCTATC

1001   AGGCGAAATG GCAGCACCGG CACGACATTT CCGACACGCT TCAGGCGGGT

1051   GTCGATTTCA ACCAAGTCTC CGACAGCGGC TACTACCGCG ACTTTTACGG

1101   CAACAAAGAA ATCGCCGGCA ACGTCAACCT CAACCGCCGT GTATGGCTGG

1151   ATTATGGCGG CAGGGCGGCG GGCGGCAGCC TGAATGCCGG CCTTTCGGTT

1201   CTGAAATACC AGACGCTGGC AAACCAAAGC GGCTACAAAG ACAAACCGTA

1251   TGCCCTGATG CCGCGCCTTT CCGCCGATTG GCGCAAAAAC ACCGGCAGGG

1301   CGCAAATCGG CGTGTCCGCC CAATTTACCC GCTTCAGCCA CGACAGCCGC

1351   CAAGACGGCA GCCGCCTCGT CGTCTATCCC GACATCAAAT GGGATTTCAG

1401   CAACAGCTGG GGTTACGTCC GTCCCAAACT CGGACTGCAC GCCACCTATT

1451   ACAGCCTCAA CCGCTTCGGC AGCCAAGAAG CCCGACGCGT CAGCCGCACT

1501   CTGCCCATCG TCAACATCGA CAGCGGCATG ACCTTCGAAC GCAATACGCG

1551   GATGTTCGGC GGCGGAGTCC TGCAAACCCT CGAGCCGCGC CTGTTCTACA

1601   ACTATATTCC TGCCAAATCC CAAAACGACC TGCCCAATTT CGATTCGTCG

1651   GAAAGCAGCT TCGGCTACGG GCAGCTTTTT CGTGAAAACC TCTATTACGG

1701   CAACGACAGG ATTAACACCG CAAACAGCCT TTCCGCCGCC GTGCAAAGCC

1751   GTATTTTGGA CGGCGCGACG GGGGAAGAGC GTTTCCGCGC CGGCATCGGG

1801   CAGAAATTCT ACTTCAAAAA CGACGCAGTC ATGCTTGACG GCAGTGTCGG

1851   CAAAAAACCG CGCAGCCGTT CCGACTGGGT GGCATTCGCC TCCAGCGGCA

1901   TCGGCAGCCG CTTCATCCTC GACAGCAGCA TCCACTACAA CCAAAACGAC

1951   AAACGCGCCG AGAACTACGC CGTCGGTGCA AGCTACCGTC CCGCACAGGG

2001   CAAAGTGCTG AACGCCCGCT ACAAATACGG GCGCAACGAA AAAATCTACC

2051   TGAAGTCCGA CGGTTCCTAT TTTTACGACA AACTCAGCCA GCTCGACCTG

2101   TCCGCACAAT GGCCGCTGAC GCGCAACCTG TCGGCCGTCG TCCGTTACAA

2151   CTACGGTTTT GAAGCCAAAA AACCGATAGA GGTGCTGGCG GGTGCGGAAT

2201   ACAAAAGCAG TTGCGGCTGC TGGGGCGCGG GCGTGTACGC CCAACGCTAC

2251   GTTACCGGCG AAAACACCTA CAAAAACGCT GTCTTTTTCT CACTTCAGTT

2301   GAAAGACCTC AGCAGTGTCG GCAGAAACCC CGCAGACAGG ATGGATGTCG

2351   CCGTTCCCGG CTATATCCCC GCCCACTCTC TTTCCGCCGG ACGCAACAAA

2401   CGGCCCTGA
```

This corresponds to the amino acid sequence <SEQ ID 2934; ORF 958.a>:

```
a958.pep
   1   LARLFSLKPL VLALGFCFGT HCAAADAVAA EETDNPTAGG SVRSVSEPIQ

51   PTSLSLGSTC LFCSNESGSP ERTEAAVQGS GEASIPEDYT RIVADRMEGQ

101   SQVQVRAEGN VVVERNRTTL NADWADYDQS GDTVTAGDRF ALQQDGTLIR

151   GETLTYNLEQ QTGEAHNVRM ETEHGGRRLQ SVSRTAEMLG EGHYKLTETQ
```

```
201  FNTCSAGDAG WYVKAASVEA DREKGIGVAK HAAFVFGGVP IFYTPWADFP

251  LDGNRKSGLL VPSLSAGSDG VSLSVPYYFN LAPNLDATFA PGVIGERGAV

301  FDGQVRYLRP DYAGQSDLTW LPHDKKSGRN NRYQAKWQHR HDISDTLQAG

351  VDFNQVSDSG YYRDFYGNKE IAGNVNLNRR VWLDYGGRAA GGSLNAGLSV

401  LKYQTLANQS GYKDKPYALM PRLSADWRKN TGRAQIGVSA QFTRFSHDSR

451  QDGSRLVVYP DIKWDFSNSW GYVRPKLGLH ATYYSLNRFG SQEARRVSRT

501  LPIVNIDSGM TFERNTRMFG GGVLQTLEPR LFYNYIPAKS QNDLPNFDSS

551  ESSFGYGQLF RENLYYGNDR INTANSLSAA VQSRILDGAT GEERFRAGIG

601  QKFYFKNDAV MLDGSVGKKP RSRSDWVAFA SSGIGSRFIL DSSIHYNQND

651  KRAENYAVGA SYRPAQGKVL NARYKYGRNE KIYLKSDGSY FYDKLSQLDL

701  SAQWPLTRNL SAVVRYNYGF EAKKPIEVLA GAEYKSSCGC WGAGVYAQRY

751  VTGENTYKNA VFFSLQLKDL SSVGRNPADR MDVAVPGYIP AHSLSAGRNK

801  RP*
```

Computer analysis of this amino acid sequence gave the following results:
Homology with a Predicted ORF from *N. meningitidis*
ORF 957 shows 96.3% identity over a 377 aa overlap with a predicted ORF (ORF 957) from *N. meningitidis*
a958/m958 98.1% identity in 802 aa overlap

```
                  10         20         30         40         50         60
a958.pep  LARLFSLKPLVLALGFCFGTHCAAADAVAAEETDNPTAGGSVRSVSEPIQPTSLSLGSTC
          ||||||||||||||| :||||||||||||||||||||| |||||||||||||||||||||
m958      LARLFSLKPLVLALGLCFGTHCAAADAVAAEETDNPTAGESVRSVSEPIQPTSLSLGSTC
                  10         20         30         40         50         60

70         80         90        100        110        120
a958.pep  LFCSNESGSPERTEAAVQGSGEASIPEDYTRIVADRMEGQSQVQVRAEGNVVVERNRTTL
          ||||||||||||||||||||||||||||||||||||||||||||||||||||||||||||
m958      LFCSNESGSPERTEAAVQGSGEASIPEDYTRIVADRMEGQSQVQVRAEGNVVVERNRTTL
                  70         80         90        100        110

130        140        150        160        170        180
a958.pep  NADWADYDQSGDTVTAGDRFALQQDGTLIRGETLTYNLEQQTGEAHNVRMETEHGGRRLQ
          |:||||||||||||||||||||||||||||||||||||||||||||||||| :||||||
m958      NTDWADYDQSGDTVTAGDRFALQQDGTLIRGETLTYNLEQQTGEAHNVRMEIEQGGRRLQ
                 130        140        150        160        170        180

190        200        210        220        230        240
a958.pep  SVSRTAEMLGEGHYKLTETQFNTCSAGDAGWYVKAASVEADREKGIGVAKHAAFVFGGVP
          ||||||||||||||||||||||||||||||||||||||||||||||||||||||||||||
m958      SVSRTAEMLGEGHYKLTETQFNTCSAGDAGWYVKAASVEADREKGIGVAKHAAFVFGGVP
                 190        200        210        220        230        240

250        260        270        280        290        300
a958.pep  IFYTPWADFPLDGNRKSGLLVPSLSAGSDGVSLSVPYYFNLAPNLDATFAPGVIGERGAV
          ||||||||||||||||||||||||||||||||||||||||||||||||||:||||||||
m958      IFYTPWADFPLDGNRKSGLLVPSLSAGSDGVSLSVPYYFNLAPNLDATFAPSVIGERGAV
                 250        260        270        280        290        300

310        320        330        340        350        360
a958.pep  FDGQVRYLRPDYAGQSDLTWLPHDKKSGRNNRYQAKWQHRHDISDTLQAGVDFNQVSDSG
          ||||||||||||||||||||||||||||||||||||||||||||||||||||||||||||
m958      FDGQVRYLRPDYAGQSDLTWLPHDKKSGRNNRYQAKWQHRHDISDTLQAGVDFNQVSDSG
                 310        320        330        340        350        360

370        380        390        400        410        420
a958.pep  YYRDFYGNKEIAGNVNLNRRVWLDYGGRAAGGSLNAGLSVLKYQTLANQSGYKDKPYALM
          ||||||||||||||||||||||||||||||||||||||||||||||||||||||||||||
m958      YYRDFYGNKEIAGNVNLNRRVWLDYGGRAAGGSLNAGLSVLKYQTLANQSGYKDKPYALM
                 370        380        390        400        410        420

430        440        450        460        470        480
a958.pep  PRLSADWRKNTGRAQIGVSAQFTRFSHDSRQDGSRLVVYPDIKWDFSNSWGYVRPKLGLH
          ||||::||||||||||||||||||||||||||||||||||||||||||||||||||||||
m958      PRLSVEWRKNTGRAQIGVSAQFTRFSHDSRQDGSRLVVYPDIKWDFSNSWGYVRPKLGLH
                 430        440        450        460        470        480
```

```
                   490        500        510        520        530        540
    a958.pep  ATYYSLNRFGSQEARRVSRTLPIVNIDSGMTFERNTRMFGGGVLQTLEPRLFYNYIPAKS
              |||||||||||||||||||||||||||||||| |||||||||| |||||||||||||||
    m958      ATYYSLNRFGSQEARRVSRTLPIVNIDSGATFERNTRMFGGEVLQTLEPRLFYNYIPAKS
                   490        500        510        520        530        540

550        560        570        580        590        600
    a958.pep  QNDLPNFDSSESSFGYGQLFRENLYYGNDRINTANSLSAAVQSRILDGATGEERFRAGIG
              ||||||||||||||||||||||||||||||||||||||||||||||||||||||||||||
    m958      QNDLPNFDSSESSFGYGQLFRENLYYGNDRINTANSLSAAVQSRILDGATGEERFRAGIG
                   550        560        570        580        590        600

610        620        630        640        650        660
    a958.pep  QKFYFKNDAVMLDGSVGKKPRSRSDWVAFASSGIGSRFILDSSIHYNQNDKRAENYAVGA
              ||||| :|||||||||||||| :||||||||| ::||||||||||||||||||||||||
    m958      QKFYFKDDAVMLDGSVGKKPRNRSDWVAFASGSIGSRFILDSSIHYNQNDKRAENYAVGA
                   610        620        630        640        650        660

670        680        690        700        710        720
    m958.pep  SYRPAQGKVLNARYKYGRNEKIYLKSDGSYFYDKLSQLDLSAQWPLTRNLSAVVRYNYGF
              ||||||||||||||||||||||||||||||||||||||||||||||||||||||||||||
    g958      SYRPAQGKVLNARYKYGRNEKIYLKSDGSYFYDKLSQLDLSAQWPLTRNLSAVVRYNYGF
                   670        680        690        700        710        720

730        740        750        760        770        780
    a958.pep  EAKKPIEVLAGAEYKSSCGCWGAGVYAQRYVTGENTYKNAVFFSLQLKDLSSVGRNPADR
              ||||||||||||||||||||||||||||||||||||||||||||||||||||||||||||
    m958      EAKKPIEVLAGAEYKSSCGCWGAGVYAQRYVTGENTYKNAVFFSLQLKDLSSVGRNPADR
                   730        740        750        760        770        780

790        800
    a958.pep  MDVAVPGYIPAHSLSAGRNKRPX
              |||||||| ||||||||||||||
    m958      MDVAVPGYITAHSLSAGRNKRP
                   790        800
```

The following partial DNA sequence was identified in *N. gonorrhoeae* <SEQ ID 2935>:

```
g959.seq
    1   ATGAACATCA AACACCTTCT CTTGACCGCC GCCGCAACCG CACTGTTGGG

51   CATTTCCGCC CCCGCACTCG CCCACCACGA CGGACACGGC GATGACGACC

101   ACGGACACGC CGCACACCAA CACGGCAAAC AAGACAAAAT CATCAGCCGC

151   GCCCAAGCCG AAAAAGCGGC TTGGGCGCGT GTCGGCGGCA AAATCACCGA

201   CATCGATCTC GAACACGACG ACGGCCGTCC GCACTATGAT GTCGAAATCG

251   TCAAAAACGG ACAGGAATAC AAAGTCGTTG TCGATGCCCG TACCGGCCGC

301   GTGATTTCCT CCCGCCGCGA CGACTGA
```

This corresponds to the amino acid sequence <SEQ ID 2936; ORF 959.ng>:

```
g959.pep
    1   MNIKHLLLTA AATALLGISA PALAHHDGHG DDDHGHAAHQ HGKQDKIISR

51   AQAEKAAWAR VGGKITDIDL EHDDGRPHYD VEIVKNGQEY KVVVDARTGR

101   VISSRRDD*
```

The following partial DNA sequence was identified in *N. meningitidis* <SEQ ID 2937>:

```
m959.seq
    1   ATGAACATCA AACACCTTCT CTTGACCTCC GCCGCAACCG CACTGCTGAG

51   CATTTCCGCC CCCGCGCTCG CCCACCACGA CGGACACGGC GATGACGACC

101   ACGGACACGC CGCACACCAA CACAACAAAC AAGACAAAAT CATCAGCCGC

151   GCCCAAGCCG AAAAAGCAGC GTTGGCGCGT GTCGGCGGCA AAATCACCGA

201   CATCGATCTC GAACACGACA ACGGCCGTCC GCACTATGAT GTCGAAATCG
```

-continued

```
251  TCAAAAACGG ACAGGAATAC AAAGTCGTTG TCGATGCCCG TACCGGCCGC

301  GTGATTTCCT CCCGCCGCGA CGACTGA
```

This corresponds to the amino acid sequence <SEQ ID 2938; ORF 959>:

```
m959.pep
   1  MNIKHLLLTS AATALLSISA PALAHHDGHG DDDHGHAAHQ HNKQDKIISR

51  AQAEKAALAR VGGKITDIDL EHDNGRPHYD VEIVKNGQEY KVVVDARTGR

101  VISSRRDD*
```

Computer analysis of this amino acid sequence gave the following results:
Homology with a Predicted ORF from *N. gonorrhoeae*
ORF 959 shows 95.4% identity over a 108 aa overlap with a predicted ORF (ORF 959) from *N. gonorrhoeae*
m959/g959 95.4% identity in 108 aa overlap

```
                  10        20        30        40        50        60
m959.pep  MNIKHLLLTSAATALLSISAPALAHHDGHGDDDHGHAAHQHNKQDKIISRAQAEKAALAR
          ||||||||:||||||:|||||||||||||||||||||||:||||||||||||||||| ||
g959      MNIKHLLLTAAATALLGISAPALAHHDGHGDDDHGHAAHQHGKQDKIISRAQAEKAAWAR
                  10        20        30        40        50        60

70        80        90       100       109
m959.pep  VGGKITDIDLEHDNGRPHYDVEIVKNGQEYKVVVDARTGRVISSRRDDX
          ||||||||||:|||||||||||||||||||||||||||||||||||||
g959      VGGKITDIDLEHDDGRPHYDVEIVKNGQEYKVVVDARTGRVISSRRDDX
                  70        80        90       100
```

The following partial DNA sequence was identified in *N. meningitidis* <SEQ ID 2939>:

```
a959.seq
   1  ATGAACTTCA AACGCCTTCT CTTGACCGCC GCCGCAACCG CACTGATGGG

51  CATTTCCGCC CCCGCACTCG CCCACCACGA CGGACACGGC GATGACGACC

101  ACGGACACGC CGCACACCAA CACAGCAAAC AAGACAAAAT CATCAGCCGC

151  GCCCAAGCCG AAAAAGCAGC GTTGGCGCGT GTCGGCGGCA AAATCACCGA

201  CATCGATCTC GAACACGACA ACGGCCGTCC GCACTATGAT GTCGAAATCG

251  TCAAAAACGG ACAGGAATAC AAAGTCGTTG TCGATGCCCG TACCGGCCGC

301  GTGATTTCCT CCCGCCGCGA CGACTGA
```

This corresponds to the amino acid sequence <SEQ ID 2940; ORF 959.a>:

```
a959.pep
   1  MNFKRLLLTA AATALMGISA PALAHHDGHG DDDHGHAAHQ HSKQDKIISR

51  AQAEKAALAR VGGKITDIDL EHDNGRPHYD VEIVKNGQEY KVVVDARTGR

101  VISSRRDD*
```

Computer analysis of this amino acid sequence gave the following results:
Homology with a Predicted ORF from *N. meningitidis*
ORF 959 shows 94.4% identity over a 108 aa overlap with a predicted ORF (ORF 959) from *N. meningitidis*
a959/m959 94.4% identity in 108 aa overlap

```
                 10        20        30        40        50        60
a959.pep  MNFKRLLLTAAATALMGISAPALAHHDGHGDDDHGHAAHQHSKQDKIISRAQAEKAALAR
          ||:|:||||:|||||::|||||||||||||||||||||||:||||||||||||||||||
m959      MNIKHLLLTSAATALLSISAPALAHHDGHGDDDHGHAAHQHNKQDKIISRAQAEKAALAR
                 10        20        30        40        50        60

70        80        90       100       109
a959.pep  VGGKITDIDLEHDNGRPHYDVEIVKNGQEYKVVVDARTGRVISSRRDDX
          |||||||||||||||||||||||||||||||||||||||||||||||||
m959      VGGKITDIDLEHDNGRPHYDVEIVKNGQEYKVVVDARTGRVISSRRDDX
                 70        80        90       100
``` g960.seq not found yet
g960.pep not found yet
The following partial DNA sequence was identified in *N. meningitidis* <SEQ ID 2941>:

```
m960.seq
    1   ATGCAAGTAA ATATTCAGAT TCCCTGTATG CTGTACAGAC GCGGGAGTGT

51   TAAGCCCCCC TTGTTTGAAG CTCCGCGGCT CCTGCCGAGC TTCACCGACC

101   CCGTTGTGCC CAAGCTCTCT GCTCCCGGCG GCTACATTGT CGACATCCCC

151   AAAGGCAATC TGAAAACCGA AATCGAAAAG CTGGCCAAAC AGCCCGAGTA

201   TGCCTATCTG AAACAGCTCC AAGTAGCGAA AAACGTCAAC TGGAACCAGG

251   TGCAACTGGC TTACGATAAA TGGGACTATA AGCAGGAAGG CTTAACCAGA

301   GCCGGTGCAG CGATTATCGC GCTGGCTGTT ACCGTGGTTA CTGCGGGCGC

351   GGGAGTCGGA GCCGCACTAG GCTTAAACGG CGCAGCCGCA GCAGCGGCCG

401   ATGCCGCCTT TGCCTCACTC GCTTCTCAGG CTTCCGTATC GCTCATCAAC

451   AATAAAGGCG ATGTCGGCAA ACCCTGAAG GAACTGGGCA GAAGCCGCAC

501   GGTAAAAAAT CTGGTTGTAG CGGCGGCAAC GGCAGGCGTA TCCAACAAAC

551   TCGGTGCCTC TTCCCTTGCC ACTTGGAGCG AAACCCCTTG GGTAAACAAC

601   CTCAACGTTA ACCTGGCCAA TGCGGGCAGT GCCGCGCTGA TCAACACCGC

651   TGTTAACGGC GGCAGCCTGA AGACAATCT GGAGGCAAAT ATCCTGGCGG

701   CATTGGTGAA TACCGCGCAT GGGGAGGCGG CGAGTAAGAT CAAAGGACTG

751   GATCAGCACT ATGTCGCCCA CAAAATCGCT CATGCCGTAG CGGGCTGTGC

801   GGCTGCAGCG GCGAATAAGG GCAAATGTCA GGACGGCGCG ATCGGTGCGG

851   CTGTGGGTGA GATTGTCGGG GAGGCTTTGG TTAAAAATAC CGATTTTAGC

901   GATATGACCC CGGAACAATT AGATCTGGAA GTTAAGAAAA TTACCGCCTA

951   TGCCAAACTT GCGGCAGGTA CAGTTGCAGG CGTAACGGGA GGAGATGTCA

1001   ATACTGCTGC ACAAACCGCA CAAAACGCGG TAGAAAATAA TGCGGTTAAA

1051   GCTGTTGTAA CTGCTGCAAA AGTGGTTTAT AAGGTAGCCA GAAAAGGATT

1101   AAAAACGGG AAAATCAACG TTAGAGATTT AAAACAGACG TTGAAAGACG

1151   AAGGTTATAA TTTAGCCGAC AACCTGACCA CCTTATTCGA CGAAACATTG

1201   GATTGGAACG ATGCCAAAGC CGTTATTGAT ATTGTCGTCG GAACAGAGCT

1251   GAATCGCGCT AATAAAGGGG AAGCGGCACA AAAGGTCAAG GAAGTTTTAG
```

```
-continued
1301  AAAAAAATCG TCCTTATATC CCTAATAAAG GTGCTGTACC GAATATGAGT

1351  ACATACATGA AAAATAATCC TTTTGGAAAA CAGCTGGCTC AAATTTCAGA

1401  AAAGACAACG CTTCCGACGC AGCAAGGGCA GTCTGTCTTC TTGGTAAAAA

1451  GAAACCAAGG GTTATTAAAA ACCGGTGATA GGTTTTATTT AGATGGCCAA

1501  CATAAAAATC ATTTAGAGGT TTTTGATAAA AATGGGAACT TTAAGTTTGT

1551  TCTAAATATG GATGGTTCGC TTAACCAAAT GAAAACTGGG GCAGCAAAAG

1601  GTCGTAAATT AAACTTAAAA TAG
```

This corresponds to the amino acid sequence <SEQ ID 2942; ORF 960>:

```
m960.pep
   1  MQVNIQIPCM LYRRGSVKPP LFEAPRLLPS FTDPVVPKLS APGGYIVDIP

51  KGNLKTEIEK LAKQPEYAYL KQLQVAKNVN WNQVQLAYDK WDYKQEGLTR

101  AGAAIIALAV TVVTAGAGVG AALGLNGAAA AADAAFASL ASQASVSLIN

151  NKGDVGKTLK ELGRSRTVKN LVVAAATAGV SNKLGASSLA TWSETPWVNN

201  LNVNLANAGS AALINTAVNG GSLKDNLEAN ILAALVNTAH GEAASKIKGL

251  DQHYVAHKIA HAVAGCAAAA ANKGKCQDGA IGAAVGEIVG EALVKNTDFS

301  DMTPEQLDLE VKKITAYAKL AAGTVAGVTG GDVNTAAQTA QNAVENNAVK

351  AVVTAAKVVY KVARKGLKNG KINVRDLKQT LKDEGYNLAD NLTTLFDETL

401  DWNDAKAVID IVVGTELNRA NKGEAAQKVK EVLEKNRPYI PNKGAVPNMS

451  TYMKNNPFGK QLAQISEKTT LPTQQGQSVF LVKRNQGLLK TGDRFYLDGQ

501  HKNHLEVFDK NGNFKFVLNM DGSLNQMKTG AAKGRKLNLK *
``` a960.seq not found yet
a960.pep not found yet
g961.seq not found yet
g961.pep not found yet
The following partial DNA sequence was identified in *N. meningitidis* <SEQ ID 2943>:

```
m961.seq
   1  ATGAGCATGA AACACTTTCC AGCCAAAGTA CTGACCACAG CCATCCTTGC

51  CACTTTCTGT AGCGGCGCAC TGGCAGCCAC AAGCGACGAC GATGTTAAAA

101  AAGCTGCCAC TGTGGCCATT GTTGCTGCCT ACAACAATGG CCAAGAAATC

151  AACGGTTTCA AGCTGGAGA GACCATCTAC GACATTGGTG AAGACGGCAC

201  AATTACCCAA AAAGACGCAA CTGCAGCCGA TGTTGAAGCC GACGACTTTA

251  AAGGTCTGGG TCTGAAAAAA GTCGTGACTA ACCTGACCAA AACCGTCAAT

301  GAAACAAAC AAAACGTCGA TGCCAAAGTA AAAGCTGCAG AATCTGAAAT

351  AGAAAAGTTA ACAACCAAGT TAGCAGACAC TGATGCCGCT TTAGCAGATA

401  CTGATGCCGC TCTGGATGAA ACCACCAACG CCTTGAATAA ATTGGGAGAA

451  AATATAACGA CATTTGCTGA AGAGACTAAG ACAAATATCG TAAAAATTGA

501  TGAAAAATTA GAAGCCGTGG CTGATACCGT CGACAAGCAT GCCGAAGCAT

551  TCAACGATAT CGCCGATTCA TTGGATGAAA CCAACACTAA GGCAGACGAA

601  GCCGTCAAAA CCGCCAATGA AGCCAAACAG ACGGCCGAAG AAACCAAACA

651  AAACGTCGAT GCCAAAGTAA AAGCTGCAGA AACTGCAGCA GGCAAAGCCG
```

```
-continued
 701  AAGCTGCCGC TGGCACAGCT AATACTGCAG CCGACAAGGC CGAAGCTGTC
 751  GCTGCAAAAG TTACCGACAT CAAAGCTGAT ATCGCTACGA ACAAAGCTGA
 801  TATTGCTAAA AACTCAGCAC GCATCGACAG CTTGGACAAA AACGTAGCTA
 851  ATCTGCGCAA AGAAACCCGC CAAGGCCTTG CAGAACAAGC CGCGCTCTCC
 901  GGCCTGTTCC AACCTTACAA CGTGGGTCGG TTCAATGTAA CGGCTGCAGT
 951  CGGCGGCTAC AAATCCGAAT CGGCAGTCGC CATCGGTACC GGCTTCCGCT
1001  TTACCGAAAA CTTTGCCGCC AAAGCAGGCG TGGCAGTCGG CACTTCGTCC
1051  GGTTCTTCCG CAGCCTACCA TGTCGGCGTC AATTACGAGT GGTAA
```

This corresponds to the amino acid sequence <SEQ ID 940; ORF 2944>:

```
m961.pep
   1  MSMKHFPAKV LTTAILATFC SGALAATSDD DVKKAATVAI VAAYNNGQEI
  51  NGFKAGETIY DIGEDGTITQ KDATAADVEA DDFKGLGLKK VVTNLTKTVN
 101  ENKQNVDAKV KAAESEIEKL TTKLADTDAA LADTDAALDE TTNALNKLGE
 151  NITTFAEETK TNIVKIDEKL EAVADTVDKH AEAFNDIADS LDETNTKADE
 201  AVKTANEAKQ TAEETKQNVD AKVKAAETAA GKAEAAAGTA NTAADKAEAV
 251  AAKVTDIKAD IATNKADIAK NSARIDSLDK NVANLRKETR QGLAEQAALS
 301  GLFQPYNVGR FNVTAAVGGY KSESAVAIGT GFRFTENFAA KAGVAVGTSS
 351  GSSAAYHVGV NYEW*
``` a961.seq not found yet
a961.pep not found yet
g972.seq not found yet
g972.pep not found yet
The following partial DNA sequence was identified in *N. meningitidis* <SEQ ID 2945>:

```
m972.seq
   1  TTGACTAACA GGGGGGGAGC GAAATTAAAA ACCArTTCCA AGAGTAGTGA
  51  ACGAATGAGT GAAGTTGAAT ATTTCTCACA CTTTATATCG GACGGAAAAG
 101  GGAAGCTTTT AGAAATTCCG CAGCGAAGAG GTAAGCAAGA CggGGTTTTT
 151  GTTGATTGGA TTTCATTCAC ATTCCATGAA GATACTTTAC TGAAAGTTTC
 201  CGGTTGCCCT TTATTTTCTG ATGCTGAATA CATGTATGTA TTAAGCAGAA
 251  AGCTGGAAGA AATTCTAGGT TTTGGCATAA CGCGCAAATG CAAATCAAGG
 301  GGCAACAAAT TCTATGAATC CATGTATAGG TTAGGTTCGG ATGATGTTGA
 351  TTATGGAGAG GTGCATTTCG GArGTCAGCG CAATACTGTT TTAGTTGAGT
 401  TGAAAGGTAC TGGTTGCAGC GTTGCAAGTC CGGGTTGGGA GTTGAGGCTA
 451  AAGCAGTTTC TCGATGATTC GATAAGGACA AGAATAACGC GAATTGACCT
 501  AGCACTTGAT TTTTTTGATG GAGAGTACAC GCCGGATCAG GCGTTGTTAG
 551  ATCACGATAA TGGTTTTTTT GATAACAGCA ATCAAAGGCC GAAATCTGAA
 601  ACGATCGGTA CGGCTTGGCG GAATGAGGAC GGGAGCGGCA AGACATTTTA
 651  TGTAGGTCGC AAGAAAAATT CTCGTTTTGT TCGTGTTTAT GAGAAAGGCA
 701  GGCAGCTTGG AGATAAAGAA AGCAAATGGG TAAGGTTCGA GATCCAGTTT
```

```
 751  AATTATGGAG ATATAGAAAT ACCCTTGGAT ATTTTAATAA ATCAGGGTTC

801  GTATTTCTGT GGAGCTTTTC CAATTTGTAG AAAATTTAAA AATATGCCGG

851  TTCCCGAAAG GTTTGATCAG AGAAAGAAAA AGCTTAATTT AACTTTCGAG

901  CATAAATTGC ATTACGCGAA AAACGCGGTT GGAAAACTGG TCAATTTCAT

951  GATTGAAATG GGTTTTGATA ATAGCGAAAT TGTGGAATCT TTAAAGGCAG

1001  ATTCGGGATT TCCCAAAGGA TTAGAACCTG AAAAATATGC TCTGGAAATG

1051  TTAAGGGACG GTTTGAAACA CGGTTTTATT CATGAACAGC CGGATATTGA

1101  TTTGGAAATT GAACTTGATG AATTGGGGGT TATTGCTTTT AAAAATTCTG

1151  ACAAATTCGA TAGGGAAAAA AGGCTTTTTA GTCCTGATTA TGATGTCGAG

1201  AAAGAAAGGA AATATCAGGA ATATTTAAGT AAAGTTTATC ATCAAAATGT

1251  AGATTATGAT TATTTTTAA
```

This corresponds to the amino acid sequence <SEQ ID 2946; ORF 972>:

```
m972.pep
   1  LTNRGGAKLK TXSKSSERMS EVEYFSHFIS DGKGKLLEIP QRRGKQDGVF

51  VDWISFTFHE DTLLKVSGCP LFSDAEYMYV LSRKLEEILG FGITRKCKSR

101  GNKFYESMYR LGSDDVDYGE VHFGXQRNTV LVELKGTGCS VASPGWELRL

151  KQFLDDSIRT RITRIDLALD FFDGEYTPDQ ALLDHDNGFF DNSNQRPKSE

201  TIGTAWRNED GSGKTFYVGR KKNSRFVRVY EKGRQLGDKE SKWVRFEIQF

251  NYGDIEIPLD ILINQGSYFC GAFPICRKFK NMPVPERFDQ RKKKLNLTFE

301  HKLHYAKNAV GKLVNFMIEM GFDNSEIVES LKADSGFPKG LEPEKYALEM

351  LRDGLKHGFI HEQPDIDLEI ELDELGVIAF KNSDKFDREK RLFSPDYDVE

401  KERKYQEYLS KVYHQNVDYD YF*
```

The following partial DNA sequence was identified in *N. meningitidis* <SEQ ID 2947>:

```
a972.seq
   1  TTGACTAACA GGGGGGGAGC GAAATTAAAA ACCAATTCCA AGAGTAGTGA

51  ACGAATGAGT GAAGTTGAAT ATTTCTCACA CTTTATATCG GACGGAAAAG

101  GGAAGCTTTT AGAAATTCCG CAGCGAAGAG GTAAGCAAGA CGGGGTTTTT

151  GTTGATTGGA TTTCATTCAC ATTCCATGAA GATACTTTAC TGAAAGTTTC

201  CGGTTGCCCT TTATTTTCTG ATGCTGAATA CATGTATGTA TTAAGCAGAA

251  AGCTGGAAGA AATTCTAGGT TTTGGCATAA CGCGCAAATG CAAATCAAGG

301  GGCAACAAAT TCTATGAATC CATGTATAGG TTAGGTTCGG ATGATGTTGA

351  TTATGGAGAG GTGCATTTCG GAGGTCAGCG CAATACTGTT TTAGTTGAGT

401  TGAAAGGTAC TGGTTGCAGC GTTGCAAGTC CGGGTTGGGA GTTGAGGCTA

451  AAGCAGTTTC TCGATGATTC GATAAGGACA AGAATAACGC GAATTGACCT

501  AGCACTTGAT TTTTTGATG GAGAGTACAC GCCGGATCAG GCGTTGTTAG

551  ATCACGATAA TGGTTTTTTT GATAACAGCA ATCAAAGGCC GAAATCTGAA

601  ACGATCGGTA CGGCTTGGCG GAATGAGGAC GGGAGCGGCA AGACATTTTA

651  TGTAGGTCGC AAGAAAAATT CTCGTTTTGT TCGTGTTTAT GAGAAAGGCA
```

```
-continued
 701   GGCAGCTTGG AGATAAAGAA AGCAAATGGG TAAGGTTCGA GATCCAGTTT
 751   AATTATGGAG ATATAGAAAT ACCCTTGGAT ATTTTAATAA ATCAGGGTTC
 801   GTATTTCTGT GGAGCTTTTC CAATTTGTAG AAAATTTAAA AATATGCCGG
 851   TTCCCGAAAG GTTTGATCAG AGAAAGAAAA CGCTTAATTT AACTTTCGAG
 901   CATAAATTGC ATTACGCGAA AACGCGGTT GGAAAACTGG TCAATTTCAT
 951   GATTGAAATG GGTTTTGATA ATAGCGAAAT TGTGGAATCT TTAAAGGCAG
1001   ATTCGGGATT TCCCAAAGGA TTAGAACCTG AAAAATATGC TCTGGAAATG
1051   TTAAGGGACG GTTTGAAACA CGGTTTTATT CATGAACAGC CGGATATTGA
1101   TTTGGAAATT GAACTTGATG AATTGGGGGT TATTGCTTTT AAAAATTCTG
1151   ACAAATTCGA TAGGGAAAAA AGGCTTTTTA GTCCTGATTA TGATGTCGAG
1201   AAAGAAAGGA AATATCAGGA ATATTTAAGT AAAGTTTATC ATCAAATGT
1251   AGATTATGAT TATTTTTAA
```

This corresponds to the amino acid sequence <SEQ ID 2948; ORF 972.a>:

```
a972.pep
   1   LTNRGGAKLK TNSKSSERMS EVEYFSHFIS DGKGKLLEIP QRRGKQDGVF
  51   VDWISFTFHE DTLLKVSGCP LFSDAEYMYV LSRKLEEILG FGITRKCKSR
 101   GNKFYESMYR LGSDDVDYGE VHFGGQRNTV LVELKGTGCS VASPGWELRL
 151   KQFLDDSIRT RITRIDLALD FFDGEYTPDQ ALLDHDNGFF DNSNQRPKSE
 201   TIGTAWRNED GSGKTFYVGR KKNSRFVRVY EKGRQLGDKE SKWVRFEIQF
 251   NYGDIEIPLD ILINQGSYFC GAFPICRKFK NMPVPERFDQ RKKTLNLTFE
 301   HKLHYAKNAV GKLVNFMIEM GFDNSEIVES LKADSGFPKG LEPEKYALEM
 351   LRDGLKHGFI HEQPDIDLEI ELDELGVIAF KNSDKFDREK RLFSPDYDVE
 401   KERKYQEYLS KVYHQNVDYD YF*
``` m972/a972 99.3% identity in 422 aa overlap

```
                 10         20         30         40         50         60
m972.pep  LTNRGGAKLKTXSKSSERMSEVEYFSHFISDGKGKLLEIPQRRGKQDGVFVDWISFTFHE
          ||||||||||| ||||||||||||||||||||||||||||||||||||||||||||||||
a972      LTNRGGAKLKTNSKSSERMSEVEYFSHFISDGKGKLLEIPQRRGKQDGVFVDWISFTFHE
                 10         20         30         40         50         60

70         80         90        100        110        120
m972.pep  DTLLKVSGCPLFSDAEYMYVLSRKLEEILGFGITRKCKSRGNKFYESMYRLGSDDVDYGE
          ||||||||||||||||||||||||||||||||||||||||||||||||||||||||||||
a972      DTLLKVSGCPLFSDAEYMYVLSRKLEEILGFGITRKCKSRGNKFYESMYRLGSDDVDYGE
                 70         80         90        100        110        120

130        140        150        160        170        180
m972.pep  VHFGXQRNTVLVELKGTGCSVASPGWELRLKQFLDDSIRTRITRODLALDFFDGEYTPDQ
          |||| |||||||||||||||||||||||||||||||||||||||||||||||||||||||
a972      VHFGGQRNTVLVELKGTGCSVASPGWELRLKQFLDDSIRTRITRODLALDFFDGEYTPDQ
                130        140        150        160        170        180

190        200        210        220        230        240
m972.pep  ALLDHDNGFFDNSNQRPKSETIGTAWRNEDGSGKTFYVGRKKNSRFVRVYEKGRQLGDKE
          ||||||||||||||||||||||||||||||||||||||||||||||||||||||||||||
a972      ALLDHDNGFFDNSNQRPKSETIGTAWRNEDGSGKTFYVGRKKNSRFVRVYEKGRQLGDKE
                190        200        210        220        230        240

250        260        270        280        290        300
m972.pep  SKWVRFEIQFNYGDIEIPLDILINQGSYFCGAFPICRKFKNMPVPERFDQRKKKLNLTFE
          |||||||||||||||||||||||||||||||||||||||||||||||||||||| |||||
a972      SKWVRFEIQFNYGDIEIPLDILINQGSYFCGAFPICRKFKNMPVPERFDQRKKTLNLTFE
                250        260        270        280        290        300
```

```
               310         320         330        340         350         360
m972.pep  HKLHYAKNAVGKLVNFMIEMGFDNSEIVESLKADSGFPKGLEPEKYALEMLRDGLKHGFI
          ||||||||||||||||||||||||||||||||||||||||||||||||||||||||||||
a972      HKLHYAKNAVGKLVNFMIEMGFDNSEIVESLKADSGFPKGLEPEKYALEMLRDGLKHGFI
               310         320         330        340         350         360

370         380         390        400         410         420
m972.pep  HEQPDIDLEIELDELGVIAFKNSDKFDREKRLFSPDYDVEKERKYQEYLSKVYHQNVDYD
          ||||||||||||||||||||||||||||||||||||||||||||||||||||||||||||
a972      HEQPDIDLEIELDELGVIAFKNSDKFDREKRLFSPDYDVEKERKYQEYLSKVYHQNVDYD
               370         380         390        400         410         420 m972.pep  YXF
          |||
a972      YXF
```

The following partial DNA sequence was identified in *N. gonorrhoeae* <SEQ ID 2949>:

```
g973.seq
     1    ATGGACGGCG CACAACCGAA AACAAATTTT TTTGAACGCC TGATTGCCCG 51    actCGCCCGC GAACCCGATT CCGCCGAAGA CGTATTAAAC CTGCTTCGGC

101    AGGCGCACGA ACAGGAAGTT TTTGATGCCG ACACACTGAC CCGGCTGGAA

151    AAAGTATTGG ACTTTGCCGA GCTGGAAGTG CGCGATGCGA TGATTACGCG

201    CAGCCGCATG AACGTATTGA AGAAAACGA CAGCATCGAA CGCATCACCG

251    CCTACGTCAT CGATACCGCC CATTCGCGCT TCCCCGTCAT CGGCGAAGAC

301    AAAGACGAAG TTTTGGGCAT TTTGCACGCC AAAGACCTGC TCAAATATAT

351    GTTCAACCCC GAGCAGTTCC ACCTGAAATC CGTCTTGCGC CCTGCCGTTT

401    TCGTGCCCGA AGGCAAATCT TTGACCGCCC TTTTAAAGA GTTCCGCGAA

451    CAGCGCAACC ATATGGCAAT CGTCATCGAC GAATACGGCG GCACGTCGGG

501    TTTGGTCACC TTTGAAGACA TCATCGAGCa aatcgtcggt gacaTCGAAG

551    ACGAGTTTGA CGAAGACGAA AGCGccgacg acatCCACTC cgTTTccgCC

601    GAACGCTGGC GCATCCacgc ggctaCCGAA ATCGAAGaca TCAACGCCTT

651    TTTCGGTACG GAatacggca gcgaagaagc cgacaccatc ggcggctTGG

701    TCATTCAGGA ATTGGGACAC CTGCCCGTGC GCGGCGAAAA AGTCCTTAtc 751    ggcgGTTTGC agttcaccgt CGCCCGCGCC GACAACCGCC GCCTGCACAC 801    GCTGATGGCG ACCCGCGTGA AGTAAGCAGA GCCTGCCcgc accgccgttT 851    CTGCacAGTT TAG
```

This corresponds to the amino acid sequence <SEQ ID 2950; ORF 973.ng>:

```
g973.pep
     1    MDGAQPKTNF FERLIARLAR EPDSAEDVLN LLRQAHEQEV FDADTLTRLE

51    KVLDFAELEV RDAMITRSRM NVLKENDSIE RITAYVIDTA HSRFPVIGED

101    KDEVLGILHA KDLLKYMFNP EQFHLKSVLR PAVFVPEGKS LTALLKEFRE

151    QRNHMAIVID EYGGTSGLVT FEDIIEQIVG DIEDEFDEDE SADDIHSVSA

201    ERWRIHAATE IEDINAFFGT EYGSEEADTI GGLVIQELGH LPVRGEKVLI

251    GGLQFTVARA DNRRLHTLMA TRVK*
```

The following partial DNA sequence was identified in *N. meningitidis* <SEQ ID 2951>:

```
m973.seq
     1  ATGGACGGCG CACAACCGAA AACGAATTTT TTTGAACGCC TGATTGCCCG
    51  ACTCGCCCGC GAACCCGATT CCGCCGAAGA CGTATTAAAC CTGCTTCGGC
   101  AGGCGCACGA GCAGGAAGTT TTTGATGCGG ATACGCTTTT AAGATTGGAA
   151  AAAGTCCTCG ATTTTTCCGA TTTGGAAGTG CGCGACGCGA TGATTACGCG
   201  CAGCCGTATG AACGTTTTAA AAGAAAACGA CAGCATCGAG CGCATCACCG
   251  CCTACGTTAT CGATACCGCC CATTCGCGCT TCCCCGTCAT CGGCGAAGAC
   301  AAAGACGAAG TTTTGGGCAT TTTGCACGCC AAAGACCTGC TCAAATATAT
   351  GTTTAACCCC GAGCAGTTCC ACCTCAAATC CATTCTCCGC CCCGCCGTCT
   401  TCGTCCCCGA AGGCAAATCG CTGACCGCCC TTTTAAAAGA GTTCCGCGAA
   451  CAGCGCAACC ATATGGCGAT TGTCATCGAC GAATACGGCG GCACATCCGG
   501  CTTGGTCACC TTTGAAGACA TCATCGAGCA AATCGTCGGC GAAATCGAAG
   551  ACGAGTTTGA CGAAGACGAT AGCGCCGACA ATATCCATGC CGTTTCTTCm
   601  GaACGcTGGC GCATCCATGC AGCTACCGAA ATCGAAGACA TCAACACCTT
   651  CTTCGGCACG GAATACAGCA kCGAAGAAGC CGACACCATT GGCGGCCTGG
   701  TCATTCAAGA GTTGGGACAT CTGCCCGTGC GCGGCGAAAA AGTCCTTATC
   751  GGCGGTTTGC AGTTCACCGT CGCACGCGCC GACAACCGCC GCCTGCATAC
   801  GCTGATGGCG ACCCGCGTGA AGTAA
```

This corresponds to the amino acid sequence <SEQ ID 2952; ORF 973>:

```
m973.pep
     1  MDGAQPKTNF FERLIARLAR EPDSAEDVLN LLRQAHEQEV FDADTLLRLE
    51  KVLDFSDLEV RDAMITRSRM NVLKENDSIE RITAYVIDTA HSRFPVIGED
   101  KDEVLGILHA KDLLKYMFNP EQFHLKSILR PAVFVPEGKS LTALLKEFRE
   151  QRNHMAIVID EYGGTSGLVT FEDIIEQIVG EIEDEFDEDD SADNIHAVSS
   201  ERWRIHAATE IEDINTFFGT EYSXEEADTI GGLVIQELGH LPVRGEKVLI
   251  GGLQFTVARA DNRRLHTLMA TRVK*
```

Computer analysis of this amino acid sequence gave the following results:

Homology with a Predicted ORF from *N. gonorrhoeae*

ORF 973 shows 95.6% identity over a 274 aa overlap with a predicted ORF (ORF 973.ng) from *N. gonorrhoeae*:

```
m973/g973
                    10        20        30        40        50        60
m937.pep    MDGAQPKTNFFERLIARLAREPDSAEDVLNLLRQAHEQEVFDADTLLRLEKVLDFSDLEV
            |||||||||||||||||||||||||||||||||||||||||||||| ||||||||::|||
g973        MDGAQPKTNFFERLIARLAREPDSAEDVLNLLRQAHEQEVFDADTLTRLEKVLDFAELEV
                    10        20        30        40        50        60

70        80        90       100       110       120
m973.pep    RDAMITRSRMNVLKENDSIERITAYVIDTAHSRFPVIGEDKDEVLGILHAKDLLKYMFNP
            ||||||||||||||||||||||||||||||||||||||||||||||||||||||||||||
g973        RDAMITRSRMNVLKENDSIERITAYVIDTAHSRFPVIGEDKDEVLGILHAKDLLKYMFNP
                    70        80        90       100       110       120
```

-continued

```
              130        140        150        160        170        180
m973.pep  EQFHLKSILRPAVFVPEGKSLTALLKEFREQRNHMAIVIDEYGGTSGLVTFEDIIEQIVG
          ||||||:||||||||||||||||||||||||||||||||||||||||||||||||||||
g973      EQFHLKSVLRPAVFVPEGKSLTALLKEFREQRNHMAIVIDEYGGTSGLVTFEDIIEQIVG
              130        140        150        160        170        180

190        200        210        220        230        240
m973.pep  EIEDEFDEDDSADNIHAVSSERWRIHAATEIEDINTFFGTEYSXEEADTIGGLVIQELGH
          :||||||||:|||:||:||:||||||||||||||||:|||||: ||||||||||||||||
g973      DIEDEFDEDESADDIHSVSAERWRIHAATEIEDINAFFGTEYGSEEADTIGGLVIQELGH
              190        200        210        220        230        240

250        260        270
m973.pep  LPVRGEKVLIGGLQFTVARADNRRLHTLMATRVKX
          ||||||||||||||||||||||||||||||||||
g973      LPVRGEKVLIGGLQFTVARADNRRLHTLMATRVKX
              250        260        270
```

15

The following partial DNA sequence was identified in *N. meningitidis* <SEQ ID 2953>:

```
a973.seq
    1  ATGGACGGCG CACAACCGAA AACAAATTTT TTTGAACGCC TGATTGCCCG

51  ACTCGCCCGC GAACCCGATT CCGCCGAAGA CGTATTGACC CTGTTGCGCC

101  AAGCGCACGA ACAGGAAGTA TTTGATGCGG ATACGCTTTT AAGATTGGAA

151  AAAGTCCTCG ATTTTTCTGA TTTGGAAGTG CGCGACGCGA TGATTACGCG

201  CAGCCGTATG AACGTTTTAA AGAAAACGA CAGCATCGAA CGCATCACCG

251  CCTACGTTAT CGATACCGCC CATTCGCGCT TCCCCGTCAT CGGTGAAGAC

301  AAAGACGAAG TTTTGGGTAT TTTGCACGCC AAAGACCTGC TCAAATATAT

351  GTTCAACCCC GAGCAGTTCC ACCTCAAATC GATATTGCGC CCTGCCGTCT

401  TCGTCCCCGA AGGCAAATCG CTGACCGCCC TTTTAAAAGA GTTCCGCGAA

451  CAGCGCAACC ATATGGCAAT CGTCATCGAC GAATACGGCG GCACGTCGGG

501  TTTGGTAACT TTTGAAGACA TCATCGAGCA AATCGTCGGC GACATCGAAG

551  ATGAGTTTGA CGAAGACGAA AGCGCGGACA ACATCCACGC CGTTTCCGCC

601  GAACGCTGGC GCATCCACGC GGCTACCGAA ATCGAAGACA TCAACGCCTT

651  TTTCGGCACG GAATACAGCA GCGAAGAAGC CGACACCATC GGCGGCCTGG

701  TCATTCAGGA ATTGGGACAC CTGCCCGTGC GCGGCGAAAA AGTCCTTATC

751  GGCGGTTTGC AGTTCACCGT CGCCCGCGCC GACAACCGCC GCCTGCATAC

801  GCTGATGGCG ACCCGCGTGA AGTAA
```

This corresponds to the amino acid sequence <SEQ ID 2954; ORF 973.a>:

```
a973.pep
    1  MDGAQPKTNF FERLIARLAR EPDSAEDVLT LLRQAHEQEV FDADTLLRLE

51  KVLDFSDLEV RDAMITRSRM NVLKENDSIE RITAYVIDTA HSRFPVIGED

101  KDEVLGILHA KDLLKYMFNP EQFHLKSILR PAVFVPEGKS LTALLKEFRE

151  QRNHMAIVID EYGGTSGLVT FEDIIEQIVG DIEDEFDEDE SADNIHAVSA

201  ERWRIHAATE IEDINAFFGT EYSSEEADTI GGLVIQELGH LPVRGEKVLI

251  GGLQFTVARA DNRRLHTLMA TRVK*
``` m973/a973 97.8% identity in 274 aa overlap

```
                  10        20        30        40        50        60
       m973.pep  MDGAQPKTNFFERLIARLAREPDSAEDVLNLLRQAHEQEVFDADTLLRLEKVLDFSDLEV
                 ||||||||||||||||||||||||||||||:||||||||||||||||||||||||||||
           a973  MDGAQPKTNFFERLIARLAREPDSAEDVLTLLRQAHEQEVFDADTLLRLEKVLDFSDLEV
                         10        20        30        40        50        60

70        80        90       100       110       120
       m973.pep  RDAMITRSRMNVLKENDSIERITAYVIDTAHSRFPVIGEDKDEVLGILHAKDLLKYMFNP
                 ||||||||||||||||||||||||||||||||||||||||||||||||||||||||||||
           a973  RDAMITRSRMNVLKENDSIERITAYVIDTAHSRFPVIGEDKDEVLGILHAKDLLKYMFNP
                         70        80        90       100       110       120

130       140       150       160       170       180
       m973.pep  EQFHLKSILRPAVFVPEGKSLTALLKEFREQRNHMAIVIDEYGGTSGLVTFEDIIEQIVG
                 ||||||||||||||||||||||||||||||||||||||||||||||||||||||||||||
           a973  EQFHLKSILRPAVFVPEGKSLTALLKEFREQRNHMAIVIDEYGGTSGLVTFEDIIEQIVG
                        130       140       150       160       170       180

190       200       210       220       230       240
       m973.pep  EIEDEFDEDDSADNIHAVSSERWRIHAATEIEDINTFFGTEYSXEEADTIGGLVIQELGH
                 :|||||||||:||||||||||:||||||||||||||:|||||| ||||||||||||||||
           a973  DIEDEFDEDESADNIHAVSAERWRIHAATEIEDINAFFGTEYSSEEADTIGGLVIQELGH
                        190       200       210       220       230       240

250       260       270
       m973.pep  LPVRGEKVLIGGLQFTVARADNRRLHTLMATRVKX
                 |||||||||||||||||||||||||||||||||||
           a973  LPVRGEKVLIGGLQFTVARADNRRLHTLMATRVKX
                        250       260       270
```

25

The following partial DNA sequence was identified in *N. gonorrhoeae* <SEQ ID 2955>:

```
g981.seq
    1   ATGAAAAAAT GGATTGCCGC CGCCCTTGCC TGTTCCGCAC TCGCGCTGTC

51   TGCCTGCGGC GGTCAGGGCA AGATGCCGC CGCGCCTGCC GCCAACCCCG

101   GCAAAGTGTA CCGCGTGGCT TCCAACGCCG AGTTTGCCCC CTTTGAATCT

151   TTAGACTCGA AAGGCAATGT CGAAGGTTTC GACGTGGATT TGATGAACGC

201   GATGGCGAAG GCGGGCAATT TTAAAATCGA ATTCAAACAC CAGCCGTGGG

251   ACAGCCTTTT CCCCGCCTTG AACAACGGCG ATGCGGACGT TGTGATGTCG

301   GGCGTAACCA TTACCGACGA CCGCAAACAG TCTATGGATT TCAGCGACCC

351   GTATTTTGAA ATCACCCAAG TCGTCCTCGT TCCGAAAGGC AAAAAAGTAT

401   CTTCTTCCGA AGATTTGAAA AAGATGAACA AAGTCGGCGT GGTTACCGGC

451   CACACGGGCG ATTTCTCCGT TTCCAAACTC TTGGGCAACG ACAATCCGAA

501   AATCGCGCGC TTCGAAAACG TCCCCCTGAT TATCAAGAA CTGGAAAACG

551   GCGGCTTGGA TTCCGTGGTC AGCGACAGCG CGGTCATCGC CAATTATGTG

601   AAAAACAACC CGGCCAAAGG AATGGACTTC GTTACCCTGC CCGACTTCAC

651   CACCGAACAC TACGGCATCG CGGTACGCAA AGGCGACGAA GCAACCGTCA

701   AAATGCTGAA CGATGCGTTG GAAAAAGTAC GCGAAAGCGG CGAATACGAC

751   AAGATCTACG CCAAATATTT TGCCAAAGAG GGCGGACAGG CTGCGAAATA

801   A
```

This corresponds to the amino acid sequence <SEQ ID 2956; ORF 981.ng>:

```
g981.pep
    1   MKKWIAAALA CSALALSACG GQGKDAAAPA ANPGKVYRVA SNAEFAPFES

51   LDSKGNVEGF DVDLMNAMAK AGNFKIEFKH QPWDSLFPAL NNGDADVVMS

101   GVTITDDRKQ SMDFSDPYFE ITQVVLVPKG KKVSSSEDLK KMNKVGVVTG
```

-continued

```
151  HTGDFSVSKL LGNDNPKIAR FENVPLIIKE LENGGLDSVV SDSAVIANYV

201  KNNPAKGMDF VTLPDFTTEH YGIAVRKGDE ATVKMLNDAL EKVRESGEYD

251  KIYAKYFAKE GGQAAK*
```

The following partial DNA sequence was identified in *N. meningitidis* <SEQ ID 2957>:

```
m981.seq
   1  ATGAAAAAAT GGATTGCCGC CGCCCTTGCC TGTTCCGCGC TCGCGCTGTC

51  TGCCTGCGGC GGTCAGGGCA AAGATACCGC CGCGCCTGCC GCCAACCCCG

101  ACAAAGTGTA CCGCGTGGCT TCCAACGCCG AGTTTGCCCC CTTTGAATCT

151  TTAGACTCGA AAGGCAATGT CGAAGGTTTC GATGTGGATT TGATGAACGC

201  GATGGCGAAG GCGGGCAATT TTAAAATCGA ATTCAAACAC CAGCCGTGGG

251  ACAGCCTTTT CCCCGCCTTA ACAACGGCG ATGCGGACGT TGTGATGTCG

301  GGCGTAACCA TTACCGACGA CCGCAAACAG TCTATGGACT TCAGCGACCC

351  GTATTTTGAA ATCACCCAAG TCGTCCTCGT TCCGAAAGGC AAAAAAGTAT

401  CTTCTTCCGA AGATTTGAAA ACATGAACA AAGTCGGCGT GGTAACCGGC

451  TACACGGGCG ATTTCTCCGT ATCCAAACTC TTGGGCAACG ACAATCCGAA

501  AATCGCGCGC TTTGAAAACG TTCCCCTGAT TATCAAAGAA CTGGAAAACG

551  GCGGCTTGGA TTCCGTGGTC AGCGACAGCG CGGTCATCGC CAATTATGTG

601  AAAAACAATC CGGCCAAAGG GATGGACTTC GTTACCCTGC CCGACTTCAC

651  CACCGAACAC TACGGCATCG CGGTACGCAA AGGCGACGAA GCAACCGTCA

701  AAATGCTGAA CGATGCGTTG GAAAAGTAC GCGAAAGCGG CGAATACGAC

751  AAGATTTACG CCAAATATTT TGCAAAAGAA GACGGACAGG CCGCAAAATA

801  A
```

This corresponds to the amino acid sequence <SEQ ID 2958; ORF 981>:

```
m981.pep
   1  MKKWIAAALA CSALALSACG GQGKDTAAPA ANPDKVYRVA SNAEFAPFES

51  LDSKGNVEGF DVDLMNAMAK AGNFKIEFKH QPWDSLFPAL NNGDADVVMS

101  GVTITDDRKQ SMDFSDPYFE ITQVVLVPKG KKVSSSEDLK NMNKVGVVTG

151  YTGDFSVSKL LGNDNPKIAR FENVPLIIKE LENGGLDSVV SDSAVIANYV

201  KNNPAKGMDF VTLPDFTTEH YGIAVRKGDE ATVKMLNDAL EKVRESGEYD

251  KIYAKYFAKE DGQAAK*
``` m981/g981 98.1% identity in 266 aa overlap

```
                 10         20         30         40         50         60
    981.pep  MKKWIAAALACSALALSACGGQGKDTAAPAANPDKVYRVASNAEFAPFESLDSKGNVEGF
             ||||||||||||||||||||||||:||||||||||:||||||||||||||||||||||||
       g981  MKKWIAAALACSALALSACGGQGKDAAAPAANPGKVYRVASNAEFAPFESLDSKGNVEGF
                 10         20         30         40         50         60

70         80         90        100        110        120
    981.pep  DVDLMNAMAKAGNFKIEFKHQPWDSLFPALNNGDADVVMSGVTITDDRKQSMDFSDPYFE
             ||||||||||||||||||||||||||||||||||||||||||||||||||||||||||||
       g981  DVDLMNAMAKAGNFKIEFKHQPWDSLFPALNNGDADVVMSGVTITDDRKQSMDFSDPYFE
                 70         80         90        100        110        120
```

-continued

```
                130       140       150       160       170       180
981.pep    ITQVVLVPKGKKVSSSEDLKNMNKVGVVTGYTGDFSVSKLLGNDNPKIARFENVPLIIKE
           ||||||||||||||||||||:||||||||:|||||||||||||||||||||||||||||
g981       ITQVVLVPKGKKVSSSEDLKKMNKVGVVTGHTGDFSVSKLLGNDNPKIARFENVPLIIKE
                130       140       150       160       170       180

190       200       210       220       230       240
981.pep    LENGGLDSVVSDSAVIANYVKNNPAKGMDFVTLPDFTTEHYGIAVRKGDEATVKMLNDAL
           ||||||||||||||||||||||||||||||||||||||||||||||||||||||||||||
g981       LENGGLDSVVSDSAVIANYVKNNPAKGMDFVTLPDFTTEHYGIAVRKGDEATVKMLNDAL
                190       200       210       220       230       240

250       260
981.pep    EKVRESGEYDKIYAKYFAKEDGQAAKX
           |||||||||||||||||||| ||||||
g981       EKVRESGEYDKIYAKYFAKEGGQAAKX
                250       260
```

The following partial DNA sequence was identified in *N. meningitidis* <SEQ ID 2959>:

```
a981.seq
    1    ATGAAAAAAT GGATTGCCGC CGCCCTTGCC TGTTCCGCGC TCGCGCTGTC

51    TGCCTGCGGC GGTCAGGGTA AGATGCCGC CGCGCCCGCC GCAAATCCCG

101    ACAAAGTGTA CCGCGTGGCT TCCAACGCCG AGTTTGCCCC CTTTGAATCT

151    TTAGACTCGA AAGGCAATGT CGAAGGTTTC GATGTGGATT TGATGAACGC

201    GATGGCGAAG GCGGGCAATT TTAAAATCGA ATTCAAACAC CAGCCGTGGG

251    ACAGCCTTTT CCCCGCCTTG AACAACGGCG ATGCGGACGT TGTGATGTCG

301    GGCGTAACCA TTACCGACGA CCGCAAACAG TCTATGGACT TCAGCGACCC

351    GTATTTTGAA ATCACCCAAG TCGTCCTCGT TCCGAAAGGC AAAAAAATAT

401    CTTCTTCCGA AGATTTGAAA AACATGAACA AAGTCGGCGT GGTAACCGGC

451    TACACGGGCG ATTTCTCCGT ATCCAAACTC TTGGGCAACG ACAACCCGAA

501    AATCGCGCGC TTTGAAAACG TTCCCCTGAT TATCAAAGAA CTGGAAAACG

551    GCGGCTTGGA TTCCGTGGTC AGCGACAGCG CAGTCATCGC CAATTATGTG

601    AAAAACAATC CGACCAAAGG GATGGACTTC GTTACCCTGC CCGACTTCAC

651    CACCGAACAC TACGGCATCG CGGTACGCAA AGGCGACGAA GCAACCGTCA

701    AAATGCTGAA CGATGCGTTG AAAAAAGTAC GCGAAAGCGG CGAATACGAC

751    AAAATCTACG CCAAATATTT TGCAAAAGAA GACGGACAGG CCGCAAAATA

801    A
```

This corresponds to the amino acid sequence <SEQ ID 2960; ORF 981.a>:

```
a981.pep
    1    MKKWIAAALA CSALALSACG GQGKDAAAPA ANPDKVYRVA SNAEFAPFES

51    LDSKGNVEGF DVDLMNAMAK AGNFKIEFKH QPWDSLFPAL NNGDADVVMS

101    GVTITDDRKQ SMDFSDPYFE ITQVVLVPKG KKISSSEDLK NMNKVGVVTG

151    YTGDFSVSKL LGNDNPKIAR FENVPLIIKE LENGGLDSVV SDSAVIANYV

201    KNNPTKGMDF VTLPDFTTEH YGIAVRKGDE ATVKMLNDAL KKVRESGEYD

251    KIYAKYFAKE DGQAAK*
``` m981/a981 98.5% identity in 266 aa overlap

```
              10         20         30         40         50         60
m981.pep  MKKWIAAALACSALALSACGGQGKDTAAPAANPDKVYRVASNAEFAPFESLDSKGNVEGF
          ||||||||||||||||||||||||||| :||||||||||||||||||||||||||||||
a981      MKKWIAAALACSALALSACGGQGKDAAAPAANPDKVYRVASNAEFAPFESLDSKGNVEGF
              10         20         30         40         50         60

70         80         90        100        110        120
m981.pep  DVDLMNAMAKAGNFKIEFKHQPWDSLFPALNNGDADVVMSGVTITDDRKQSMDFSDPYFE
          ||||||||||||||||||||||||||||||||||||||||||||||||||||||||||||
a981      DVDLMNAMAKAGNFKIEFKHQPWDSLFPALNNGDADVVMSGVTITDDRKQSMDFSDPYFE
              70         80         90        100        110        120

130        140        150        160        170        180
m981.pep  ITQVVLVPKGKKVSSSEDLKNMNKVGVVTGYTGDFSVSKLLGNDNPKIARFENVPLIIKE
          ||||||||||||| ||||||||||||||||||||||||||||||||||||||||||||||
a981      ITQVVLVPKGKKISSSEDLKNMNKVGVVTGYTGDFSVSKLLGNDNPKIARFENVPLIIKE
             130        140        150        160        170        180

190        200        210        220        230        240
m981.pep  LENGGLDSVVSDSAVIANYVKNNPAKGMDFVTLPDFTTEHYGIAVRKGDEATVKMLNDAL
          ||||||||||||||||||||||||||| :|||||||||||||||||||||||||||||||
a981      LENGGLDSVVSDSAVIANYVKNNPTKGMDFVTLPDFTTEHYGIAVRKGDEATVKMLNDAL
             190        200        210        220        230        240

250        260
m981.pep  EKVRESGEYDKIYAKYFAKEDGQAAKX
          :||||||||||||||||||||||||||
a981      KKVRESGEYDKIYAKYFAKEDGQAAKX
             250        260
```

The following partial DNA sequence was identified in *N. gonorrhoeae* <SEQ ID 2961>:

```
g982.seq
    1  atcgcatcgc aaaaccttcg attcgacaat cgattcctcc aaaaaatggt
   51  caacggcgTg aatattttgc cggccgcCga ttgggtagcC ttgGGcgcCA
  101  AAGGCCGCAA CGTGGTGGTT GACCGCGCTT TCGGCGGCCC GCACATCACC
  151  AAAGACGGCG TAACCGTCGC CAAAGAAATC GAACTGAAAG ACAAGTTTGA
  201  AAATATGGGC GCGCAAATGG TAAAAGAAGT CGCGTCCAAA ACCAAcgaCg
  251  tagCCGgcga cggtacgact accgCCACCG TATTGGCACA ATCCATCGTT
  301  GCCGAAggcA TGAAATACGT TACCGCCGGC ATGAACCCGA CCGATCTGAA
  351  ACGCGGCATC GACAAAGccg ttgCCGCTtt ggttgAAGAg cTGAAAAACA
  401  TCGCCAAACC TTGCGATACT TCCAAAGAAA TCGCCCAAGT CGGCTCGATT
  451  TCCGCCAACT CCGACGAACA AGtcgGCGCG ATTATCGCCG AAGCGATGGA
  501  AAAAGTCGGC AAAGAAGgcg tgattacCGT TGAAGACGGC AAATCTTTGG
  751  AAAATCTACG CCAAATATTT TGCAAAAGAA GACGGACAGG CCGCAAAATA
  801  A
```

This corresponds to the amino acid sequence <SEQ ID 2960; ORF 981.a>:

```
a981.pep
    1  MKKWIAAALA CSALALSACG GQGKDAAAPA ANPDKVYRVA SNAEFAPFES
   51  LDSKGNVEGF DVDLMNAMAK AGNFKIEFKH QPWDSLFPAL NNGDADVVMS
  101  GVTITDDRKQ SMDFSDPYFE ITQVVLVPKG KKISSSEDLK NMNKVGVVTG
  151  YTGDFSVSKL LGNDNPKIAR FENVPLIIKE LENGGLDSVV SDSAVIANYV
  201  KNNPTKGMDF VTLPDFTTEH YGIAVRKGDE ATVKMLNDAL KKVRESGEYD
  251  KIYAKYFAKE DGQAAK*
``` m981/a981 98.5% identity in 266 aa overlap

```
                   10        20        30        40        50        60
   m981.pep  MKKWIAAALACSALALSACGGQGKDTAAPAANPDKVYRVASNAEFAPFESLDSKGNVEGF
             ||||||||||||||||||||||||:|||||||||||||||||||||||||||||||||||
   a981      MKKWIAAALACSALALSACGGQGKDAAAPAANPDKVYRVASNAEFAPFESLDSKGNVEGF
                   10        20        30        40        50        60

70        80        90       100       110       120
   m981.pep  DVDLMNAMAKAGNFKIEFKHQPWDSLFPALNNGDADVVMSGVTITDDRKQSMDFSDPYFE
             ||||||||||||||||||||||||||||||||||||||||||||||||||||||||||||
   a981      DVDLMNAMAKAGNFKIEFKHQPWDSLFPALNNGDADVVMSGVTITDDRKQSMDFSDPYFE
                   70        80        90       100       110       120

130       140       150       160       170       180
   m981.pep  ITQVVLVPKGKKVSSSEDLKNMNKVGVVTGYTGDFSVSKLLGNDNPKIARFENVPLIIKE
             ||||||||||||| :|||||||||||||||||||||||||||||||||||||||||||||
   a981      ITQVVLVPKGKKISSSEDLKNMNKVGVVTGYTGDFSVSKLLGNDNPKIARFENVPLIIKE
                  130       140       150       160       170       180

190       200       210       220       230       240
   m981.pep  LENGGLDSVVSDSAVIANYVKNNPAKGMDFVTLPDFTTEHYGIAVRKGDEATVKMLNDAL
             ||||||||||||||||||||||||||| :|||||||||||||||||||||||||||||||
   a981      LENGGLDSVVSDSAVIANYVKNNPTKGMDFVTLPDFTTEHYGIAVRKGDEATVKMLNDAL
                  190       200       210       220       230       240

250       260
   m981.pep  EKVRESGEYDKIYAKYFAKEDGQAAKX
             :||||||||||||||||||||||||||
   a981      KKVRESGEYDKIYAKYFAKEDGQAAKX
                  250       260
```

25

The following partial DNA sequence was identified in *N. gonorrhoeae* <SEQ ID 2961>:

```
g982.seq
     1  atcgcatcgc aaaaccttcg attcgacaat cgattcctcc aaaaaatggt
    51  caacggcgTg aatattttgc cggccgcCga ttgggtagcC ttgGGcgcCA
   101  AAGGCCGCAA CGTGGTGGTT GACCGCGCTT TCGGCGGCCC GCACATCACC
   151  AAAGACGGCG TAACCGTCGC CAAAGAAATC GAACTGAAAG ACAAGTTTGA
   201  AAATATGGGC GCGCAAATGG TAAAAGAAGT CGCGTCCAAA ACCAAcgaCg
   251  tagCCGgcga cggtacgact accgCCACCG TATTGGCACA ATCCATCGTT
   301  GCCGAAggcA TGAAATACGT TACCGCCGGC ATGAACCCGA CCGATCTGAA
   351  ACGCGGCATC GACAAAGccg ttgCCGCTtt ggttgAAGAg cTGAAAAACA
   401  TCGCCAAACC TTGCGATACT TCCAAAGAAA TCGCCCAAGT CGGCTCGATT
   451  TCCGCCAACT CCGACGAACA AGtcgGCGCG ATTATCGCCG AAGCGATGGA
   501  AAAAGTCGGC AAAGAAGgcg tgattacCGT TGAAGACGGC AAATCTTTGG
   551  AAAACGAGCT GGACGTGGTT GAAGGTATGC AGTTCGACCG CGGCTACCTG
   601  TCCCCTTACT TTATCAACGA CGCGGAAAAA CAAATCGCCG GTCTGGACAA
   651  TCCGTTTGTT TTGCTGTTCG ACAAAAAAAT CAGCAACATC CGCGACCTGC
   701  TGCCCGTGTT GGAACAAGTG GCGAAAGCCA GCCGCCCGCT GTTGATTATC
   751  GCTGAAGACG TAGAAGGCGA AGCCTTGGCG ACTTTGGTCG TGAACAACAT
   801  CCGCGGCATC CTGAAAACCG TTGCCGTCAA AGCccccggc tTCGGcGACC
   851  GCCGCAAAGC GATgctgcaa gaCATCGCCA TCCTGACcgg cggcgTagtG
   901  ATTtccGAAG Aagtcggcct GTCTTTGGAA AAAgcgactT TGgacgaCTT
   951  Gggtcaaacc aaACGcatCG AAATCGGtga agaaaacact ACCGTCATcg
  1001  acgGCTTCGG CGACGcagcC CAAAtcgaag cgCGTGTTGC CGAAATCCGC
  1051  CAACAAATCG AAACCGCGAC CAGCGATTAC GACAAAGAAA ACTGCAAGA
  1101  GCGCGTTGCC AAACTGGCAG GAGGCGTGGC AGTGATCAAA GTCGGCGCGG
```

-continued

```
1151  CGACCGAAGT CGAAATGAAA GAGAAAAAAG ACCGCGTGGA AGACGCGCTG

1201  CACGCTACCC GCGCAGCCGT TGAAGAAGGC GTGGTTGCAG GCGGCGGCGT

1251  AGCCCTGTTG CGCGCCCGTG CCGCTTTGGA AAACCTGCAC ACCGGCAATG

1301  CCGACCAAGA CGCAGGCGTA CAAATCGTAT TGCGCGCCGT TGAGTCTCCG

1351  CTGCGCCAAA TCGTTGCCAA CGCAGGCGGA GAACCCAGCG TGGTGGTGAA

1401  CAAAGTGTTG GAAGGCAAAG GCAactacgG TTACAACGCa ggctcCGGCG

1451  AATACGgcga CATGATCGGA ATGGGCGTAC TCGACCCTGC CAAAGTAACC

1501  CGTTCCGCGC TGCAACACGC CGCGTCTAtC GCCGGTCTGA TGCTGACGAC

1551  CGACTGCATG ATTGCCGAAA TCCCTGAAGA AAAACCGGCT GTGCCCGATA

1601  TGGGGGGAAT GGGCGGTATG GGCGGCATGA TGTAA
```

This corresponds to the amino acid sequence <SEQ ID 2962; ORF 982.ng>:

```
g982.pep
  1  IASQNLRFDN RFLQKMVNGV NILPAADWVA LGAKGRNVVV DRAFGGPHIT

51  KDGVTVAKEI ELKDKFENMG AQMVKEVASK TNDVAGDGTT TATVLAQSIV

101  AEGMKYVTAG MNPTDLKRGI DKAVAALVEE LKNIAKPCDT SKEIAQVGSI

151  SANSDEQVGA IIAEAMEKVG KEGVITVEDG KSLENELDVV EGMQFDRGYL

201  SPYFINDAEK QIAGLDNPFV LLFDKKISNI RDLLPVLEQV AKASRPLLII

251  AEDVEGEALA TLVVNNIRGI LKTVAVKAPG FGDRRKAMLQ DIAILTGGVV

301  ISEEVGLSLE KATLDDLGQT KRIEIGEENT TVIDGFGDAA QIEARVAEIR

351  QQIETATSDY DKEKLQERVA KLAGGVAVIK VGAATEVEMK EKKDRVEDAL

401  HATRAAVEEG VVAGGGVALL RARAALENLH TGNADQDAGV QIVLRAVESP

451  LRQIVANAGG EPSVVVNKVL EGKGNYGYNA GSGEYGDMIG MGVLDPAKVT

501  RSALQHAASI AGLMLTTDCM IAEIPEEKPA VPDMGGMGGM GGMM*
```

The following partial DNA sequence was identified in *N. meningitidis* <SEQ ID 2963>:

```
m982.seq
  1  ATGGCAGCAA AAGACGTACA GTTCGGCAAT GAAGTCCGTC AAAAAATGGT

51  AAACGGCGTG AACATTCTGG CAAACGCCGT CCGCGTAACC TTGGGCCCCA

101  AAGGTCGCAA CGTAGTCGTT GACCGCGCAT TCGGCGGCCC GCACATCACC

151  AAAGACGGCG TAACCGTCGC CAAAGAAATC GAACTGAAAG ACAAGTTTGA

201  AAATATGGGC GCGCAAATGG TGAAAGAAGT TGCGTCCAAA ACCAACGACG

251  TGGCAGGCGA CGGTACGACT ACCGCCACCG TACTGGCGCA ATCCATCGTT

301  GCCGAAGGTA TGAAATATGT TACCGCAGGT ATGAATCCGA CCGACCTGAA

351  ACGCGGTATC GATAAAGCCG TCGCCGCTTT GGTTGACGAA CTGAAAAACA

401  TCGCCAAACC TTGCGACACT TCTAAAGAAA TCGCCCAAGT CGGCTCTATT

451  TCCGCCAACT CCGACGAACA AGTCGGCGCG ATTATCGCCG AAGCGATGGA

501  AAAAGTCGGC AAAGAAGGCG TGATTACCGT TGAAGACGGC AAGTCTTTGG

551  AAAACGAGCT GGACGTAGTT GAAGGTATGC AGTTCGACCG CGGCTACCTG

601  TCTCCTTACT TCATCAACGA TGCGGAAAAA CAAATCGCTG CTTTGGACAA
```

-continued

```
 651   TCCGTTTGTA TTGTTGTTCG ACAAAAAAAT CAGCAACATC CGCGACCTGC
 701   TGCCTGTTTT GGAACAAGTG GCAAAAGCCA GCCGTCCGCT GTTGATTATC
 751   GCTGAAGACG TAGAAGGCGA AGCCTTGGCG ACTTTGGTCG TGAACAACAT
 801   CCGAGGCATC CTGAAAACCG TTGCCGTCAA AGCCCCTGGC TTCGGCGACC
 851   GCCGCAAAGC GATGTTGCAA GACATCGCCA TCCTGACCGG CGGCGTGGTG
 901   ATTTCCGAAG AAGTCGGTCT GTCTTTGGAA AAAGCGACTT TGGACGACTT
 951   GGGTCAAGCC AAACGCATCG AAATCGGTAA AGAAAACACC ACCATCATCG
1001   ACGGCTTTGG CGACGCAGCC CAAATCGAAG CGCGTGTTGC CGAAATCCGC
1051   CAACAAATCG AAACCGCAAC CAGCGATTAC GACAAAGAAA AACTGCAAGA
1101   GCGCGTGGCT AAATTGGCAG GCGGCGTGGC AGTCATCAAA GTCGGTGCCG
1151   CGACCGAAGT CGAAATGAAA GAGAAAAAAG ACCGCGTGGA AGACGCGCTG
1201   CACGCTACCC GCGCAGCCGT TGAAGAAGGC GTGGTTGCAG GCGGCGGCGT
1251   AGCCCTGTTG CGTGCCCGTG CTGCTTTGGA AAACCTGCAC ACCGGCAATG
1301   CCGACCAAGA CGCAGGCGTA CAAATCGTCT TGCGCGCCGT TGAGTCTCCG
1351   CTGCGCCAAA TCGTTGCCAA CGCAGGCGGC GAACCCAGCG TGGTTGTGAA
1401   CAAAGTATTG GAAGGCAAAG GCAACTACGG TTACAACGCT GGCAGCGGCG
1451   AATACGGCGA TATGATCGAA ATGGGCGTAC TCGACCCCGC CAAAGTAACC
1501   CGTTCTGCGC TGCAACACGC CGCATCTATC GCCGGCTTGA TGCTGACCAC
1551   TGATTGCATG ATCGCTGAAA TCCCCGAAGA CAAACCGGCT GTGCCTGATA
1601   TGGGCGGCAT GGGTGGTATG GGCGGCATGA TGTAA
```

This corresponds to the amino acid sequence <SEQ ID 2964; ORF 982>:

```
m982.seq
   1   ATGGCAGCAA AAGACGTACA GTTCGGCAAT GAAGTCCGTC AAAAAATGGT
  51   AAACGGCGTG AACATTCTGG CAAACGCCGT CCGCGTAACC TTGGGCCCCA
 101   AAGGTCGCAA CGTAGTCGTT GACCGCGCAT TCGGCGGCCC GCACATCACC
 151   AAAGACGGCG TAACCGTCGC CAAAGAAATC GAACTGAAAG ACAAGTTTGA
 201   AAATATGGGC GCGCAAATGG TGAAAGAAGT TGCGTCCAAA ACCAACGACG
 251   TGGCAGGCGA CGGTACGACT ACCGCCACCG TACTGGCGCA ATCCATCGTT
 301   GCCGAAGGTA TGAAATATGT TACCGCAGGT ATGAATCCGA CCGACCTGAA
 351   ACGCGGTATC GATAAAGCCG TCGCCGCTTT GGTTGACGAA CTGAAAAACA
 401   TCGCCAAACC TTGCGACACT TCTAAAGAAA TCGCCCAAGT CGGCTCTATT
 451   TCCGCCAACT CCGACGAACA AGTCGGCGCG ATTATCGCCG AAGCGATGGA
 501   AAAAGTCGGC AAAGAAGGCG TGATTACCGT TGAAGACGGC AAGTCTTTGG
 551   AAAACGAGCT GGACGTAGTT GAAGGTATGC AGTTCGACCG CGGCTACCTG
 601   TCTCCTTACT TCATCAACGA TGCGGAAAAA CAAATCGCTG CTTTGGACAA
 651   TCCGTTTGTA TTGTTGTTCG ACAAAAAAAT CAGCAACATC CGCGACCTGC
 701   TGCCTGTTTT GGAACAAGTG GCAAAAGCCA GCCGTCCGCT GTTGATTATC
 751   GCTGAAGACG TAGAAGGCGA AGCCTTGGCG ACTTTGGTCG TGAACAACAT
 801   CCGAGGCATC CTGAAAACCG TTGCCGTCAA AGCCCCTGGC TTCGGCGACC
```

-continued

```
 851  GCCGCAAAGC GATGTTGCAA GACATCGCCA TCCTGACCGG CGGCGTGGTG
 901  ATTTCCGAAG AAGTCGGTCT GTCTTTGGAA AAAGCGACTT TGGACGACTT
 951  GGGTCAAGCC AAACGCATCG AAATCGGTAA AGAAAACACC ACCATCATCG
1001  ACGGCTTTGG CGACGCAGCC CAAATCGAAG CGCGTGTTGC CGAAATCCGC
1051  CAACAAATCG AAACCGCAAC CAGCGATTAC GACAAAGAAA AACTGCAAGA
1101  GCGCGTGGCT AAATTGGCAG CGGCGTGGC AGTCATCAAA GTCGGTGCCG
1151  CGACCGAAGT CGAAATGAAA GAGAAAAAG ACCGCGTGGA AGACGCGCTG
1201  CACGCTACCC GCGCAGCCGT TGAAGAAGGC GTGGTTGCAG GCGGCGGCGT
1251  AGCCCTGTTG CGTGCCCGTG CTGCTTTGGA AAACCTGCAC ACCGGCAATG
1301  CCGACCAAGA CGCAGGCGTA CAAATCGTCT TGCGCGCCGT TGAGTCTCCG
1351  CTGCGCCAAA TCGTTGCCAA CGCAGGCGGC GAACCCAGCG TGGTTGTGAA
1401  CAAAGTATTG GAAGGCAAAG GCAACTACGG TTACAACGCT GGCAGCGGCG
1451  AATACGGCGA TATGATCGAA ATGGGCGTAC TCGACCCCGC CAAAGTAACC
1501  CGTTCTGCGC TGCAACACGC CGCATCTATC GCCGGCTTGA TGCTGACCAC
1551  TGATTGCATG ATCGCTGAAA TCCCCGAAGA CAAACCGGCT GTGCCTGATA
1601  TGGGCGGCAT GGGTGGTATG GGCGGCATGA TGTAA
```

Computer analysis of this amino acid sequence gave the following results:

Homology with a Predicted ORF from *N. gonorrhoeae* m982/g982 95.8% identity in 544 aa overlap

```
                10         20         30         40         50         60
m982.pep  MAAKDVQFGNEVRQKMVNGVNILANAVRVTLGPKGRNVVVDRAFGGPHITKDGVTVAKEI
          :|:::::| |:  ||||||||| |  |:||  ||||||||||||||||||||||||||||
g982      IASQNLRFDNRFLQKMVNGVNILPAADWVALGAKGRNVVVDRAFGGPHITKDGVTVAKEI
                10         20         30         40         50         60

70         80         90        100        110        120
m982.pep  ELKDKFENMGAQMVKEVASKTNDVAGDGTTTATVLAQSIVAEGMKYVTAGMNPTDLKRGI
          ||||||||||||||||||||||||||||||||||||||||||||||||||||||||||||
g982      ELKDKFENMGAQMVKEVASKTNDVAGDGTTTATVLAQSIVAEGMKYVTAGMNPTDLKRGI
                70         80         90        100        110        120

130        140        150        160        170        180
m982.pep  DKAVAALVDELKNIAKPCDTSKEIAQVGSISANSDEQVGAIIAEAMEKVGKEGVITVEDG
          ||||||||:|||||||||||||||||||||||||||||||||||||||||||||||||||
g982      DKAVAALVEELKNIAKPCDTSKEIAQVGSISANSDEQVGAIIAEAMEKVGKEGVITVEDG
               130        140        150        160        170        180

190        200        210        220        230        240
m982.pep  KSLENELDVVEGMQFDRGYLSPYFINDAEKQIAALDNPFVLLFDKKISNIRDLLPVLEQV
          ||||||||||||||||||||||||||||||||||:|||||||||||||||||||||||||
g982      KSLENELDVVEGMQFDRGYLSPYFINDAEKQIAGLDNPFVLLFDKKISNIRDLLPVLEQV
               190        200        210        220        230        240

250        260        270        280        290        300
m982.pep  AKASRPLLIIAEDVEGEALATLVVNNIRGILKTVAVKAPGFGDRRKAMLQDIAILTGGVV
          ||||||||||||||||||||||||||||||||||||||||||||||||||||||||||||
g982      AKASRPLLIIAEDVEGEALATLVVNNIRGILKTVAVKAPGFGDRRKAMLQDIAILTGGVV
               250        260        270        280        290        300

310        320        330        340        350        360
m982.pep  ISEEVGLSLEKATLDDLGQAKRIEIGKENTTIIDGFGDAAQIEARVAEIRQQIETATSDY
          ||||||||||||||||||||:|||||:||||:||||||||||||||||||||||||||||
g982      ISEEVGLSLEKATLDDLGQTKRIEIGEENTTVIDGFGDAAQIEARVAEIRQQIETATSDY
               310        320        330        340        350        360

370        380        390        400        410        420
m982.pep  DKEKLQERVAKLAGGVAVIKVGAATEVEMKEKKDRVEDALHATRAAVEEGVVAGGGVALL
          ||||||||||||||||||||||||||||||||||||||||||||||||||||||||||||
g982      DKEKLQERVAKLAGGVAVIKVGAATEVEMKEKKDRVEDALHATRAAVEEGVVAGGGVALL
               370        380        390        400        410        420

430        440        450        460        470        480
m982.pep  RARAALENLHTGNADQDAGVQIVLRAVESPLRQIVANAGGEPSVVVNKVLEGKGNYGYNA
          ||||||||||||||||||||||||||||||||||||||||||||||||||||||||||||
g982      RARAALENLHTGNADQDAGVQIVLRAVESPLRQIVANAGGEPSVVVNKVLEGKGNYGYNA
               430        440        450        460        470        480
```

-continued

```
                 490        500        510        520        530        540
m982.pep    GSGEYGDMIEMGVLDPAKVTRSALQHAASIAGLMLTTDCMIAEIPEDKPAVPDMGGMGGM
            ||||||||| ||||||||||||||||||||||||||||||||||||:|||||||||||||
g982        GSGEYGDMIGMGVLDPAKVTRSALQHAASIAGLMLTTDCMIAEIPEEKPAVPDMGGMGGM
                 490        500        510        520        530        540 m982.pep    GGMMX
            |||||
g982        GGMMX
```

The following partial DNA sequence was identified in *N. meningitidis* <SEQ ID 2965>:

```
a982.seq
      1  ATGGCAGCAA AAGACGTACA ATTCGGCAAT GAAGTCCGCC AAAAAATGGT

51  AAACGGCGTG AACATTTTGG CAAACGCCGT GCGCGTAACC TTGGGTCCCA

101  AAGGCCGCAA CGTGGTGGTT GACCGCGCTT TCGGCGGCCC GCACATCACC

151  AAAGACGGCG TAACCGTCGC CAAAGAAATC GAACTGAAAG ACAAGTTTGA

201  AAATATGGGC GCGCAAATGG TGAAAGAAGT CGCGTCCAAA ACCAACGACG

251  TGGCGGGCGA CGGTACGACT ACCGCCACCG TATTGGCGCA ATCCATCGTT

301  GCCGAAGGTA TGAAATACGT TACCGCCGGT ATGAACCCGA CCGACCTGAA

351  ACGCGGTATC GACAAAGCCG TCGCCGCTTT GGTTGAAGAG CTGAAAAACA

401  TCGCCAAACC TTGCGACACT TCTAAAGAAA TCGCCCAAGT CGGCTCTATT

451  TCCGCCAACT CTGACGAACA AGTCGGCGCG ATTATTGCCG AAGCGATGGA

501  AAAAGTCGGC AAAGAAGGCG TGATTACCGT TGAAGACGGC AAATCTTTGG

551  AAAACGAGCT GGACGTGGTT GAAGGTATGC AATTCGACCG CGGCTACCTG

601  TCTCCTTACT TCATCAACGA TGCGGAAAAA CAAATCGCCG GCTTGGACAA

651  TCCGTTTGTA TTGCTGTTCG ACAAAAAAAT CAGCAATATC CGCGACCTGC

701  TGCCTGTTTT GGAACAAGTG GCCAAAGCCA GCCGTCCGCT GTTGATTATC

751  GCTGAAGACG TAGAAGGCGA AGCCTTGGCG ACTTTGGTCG TGAACAACAT

801  CCGCGGCATT CTGAAAACCG TTGCCGTTAA AGCTCCGGGC TTCGGCGACC

851  GCCGCAAAGC GATGCTGCAA GACATCGCTA TCCTGACCGG CGGCACAGTG

901  ATTTCCGAAG AAGTCGGCCT GTCTTTGGAA AAAGCGACTT TGGACGACTT

951  GGGTCAGGCC AAACGCATCG AAATCGGTAA AGAAAACACC ACCATCATCG

1001  ACGGCTTCGG CGACGCAGCC CAAATCGAAG CGCGTGTTGC CGAAATCCGC

1051  CAACAAATCG AAACCGCAAC CAGCGATTAC GACAAAGAAA AACTGCAAGA

1101  GCGCGTTGCC AAACTGGCAG GCGGCGTGGC AGTAATCAAA GTCGGTGCCG

1151  CGACCGAAGT GGAAATGAAA GAGAAAAAAG ACCGCGTGGA AGACGCGCTG

1201  CACGCTACCC GCGCAGCCGT TGAAGAAGGC GTGGTTGCAG GCGGCGGCGT

1251  AGCCCTGTTG CGCGCCCGTG CCGCTCTGGA AAACCTGCAC ACCGGCAATG

1301  CAGACCAAGA CGCAGGCGTA CAAATCGTCT TGCGCGCCGT TGAGTCTCCG

1351  CTGCGCCAAA TCGTTGCCAA CGCAGGCGGC GAACCCAGCG TGGTTGTGAA

1401  CAAAGTGTTG GAAGGCAAAG GCAACTATGG TTACAACGCT GGCAGCGGCG

1451  AATACGGCGA CATGATCGAA ATGGGCGTAC TCGACCCCGC CAAAGTAACC

1501  CGTTCCGCGC TGCAACACGC CGCGTCTATC GCCGGCCTGA TGCTGACCAC
```

-continued

```
1551 AGACTGCATG ATTGCTGAAA TCCCTGAAGA CAAACCGGCT ATGCCTGATA

1601 TGGGCGGCAT GGGTGGTATG GGCGGCATGA TGTAA
```

This corresponds to the amino acid sequence <SEQ ID 2966; ORF 982.a>:

```
a982.pep
   1 MAAKDVQFGN EVRQKMVNGV NILANAVRVT LGPKGRNVVV DRAFGGPHIT

51 KDGVTVAKEI ELKDKFENMG AQMVKEVASK TNDVAGDGTT TATVLAQSIV

101 AEGMKYVTAG MNPTDLKRGI DKAVAALVEE LKNIAKPCDT SKEIAQVGSI

151 SANSDEQVGA IIAEAMEKVG KEGVITVEDG KSLENELDVV EGMQFDRGYL

201 SPYFINDAEK QIAGLDNPFV LLFDKKISNI RDLLPVLEQV AKASRPLLII

251 AEDVEGEALA TLVVNNIRGI LKTVAVKAPG FGDRRKAMLQ DIAILTGGTV

301 ISEEVGLSLE KATLDDLGQA KRIEIGKENT TIIDGFGDAA QIEARVAEIR

351 QQIETATSDY DKEKLQERVA KLAGGVAVIK VGAATEVEMK EKKDRVEDAL

401 HATRAAVEEG VVAGGGVALL RARAALENLH TGNADQDAGV QIVLRAVESP

451 LRQIVANAGG EPSVVVNKVL EGKGNYGYNA GSGEYGDMIE MGVLDPAKVT

501 RSALQHAASI AGLMLTTDCM IAEIPEDKPA MPDMGGMGGM GGMM*
``` m982/a982 99.3% identity in 544 aa overlap

```
                  10         20         30         40         50         60
m982.pep  MAAKDVQFGNEVRQKMVNGVNILANAVRVTLGPKGRNVVVDRAFGGPHITKDGVTVAKEI
          ||||||||||||||||||||||||||||||||||||||||||||||||||||||||||||
a982      MAAKDVQFGNEVRQKMVNGVNILANAVRVTLGPKGRNVVVDRAFGGPHITKDGVTVAKEI
                  10         20         30         40         50         60

70         80         90        100        110        120
m982.pep  ELKDKFENMGAQMVKEVASKTNDVAGDGTTTATVLAQSIVAEGMKYVTAGMNPTDLKRGI
          ||||||||||||||||||||||||||||||||||||||||||||||||||||||||||||
a982      ELKDKFENMGAQMVKEVASKTNDVAGDGTTTATVLAQSIVAEGMKYVTAGMNPTDLKRGI
                  70         80         90        100        110        120

130        140        150        160        170        180
m982.pep  DKAVAALVDELKNIAKPCDTSKEIAQVGSISANSDEQVGAIIAEAMEKVGKEGVITVEDG
          ||||||||:|||||||||||||||||||||||||||||||||||||||||||||||||||
a982      DKAVAALVEELKNIAKPCDTSKEIAQVGSISANSDEQVGAIIAEAMEKVGKEGVITVEDG
                 130        140        150        160        170        180

190        200        210        220        230        240
m982.pep  KSLENELDVVEGMQFDRGYLSPYFINDAEKQIAALDNPFVLLFDKKISNIRDLLPVLEQV
          |||||||||||||||||||||||||||||||||:||||||||||||||||||||||||||
a982      KSLENELDVVEGMQFDRGYLSPYFINDAEKQIAGLDNPFVLLFDKKISNIRDLLPVLEQV
                 190        200        210        220        230        240

250        260        270        280        290        300
m982.pep  AKASRPLLIIAEDVEGEALATLVVNNIRGILKTVAVKAPGFGDRRKAMLQDIAILTGGVV
          |||||||||||||||||||||||||||||||||||||||||||||||||||||||||:|
a982      AKASRPLLIIAEDVEGEALATLVVNNIRGILKTVAVKAPGFGDRRKAMLQDIAILTGGTV
                 250        260        270        280        290        300

310        320        330        340        350        360
m982.pep  ISEEVGLSLEKATLDDLGQAKRIEIGKENTTIIDGFGDAAQIEARVAEIRQQIETATSDY
          ||||||||||||||||||||||||||||||||||||||||||||||||||||||||||||
a982      ISEEVGLSLEKATLDDLGQAKRIEIGKENTTIIDGFGDAAQIEARVAEIRQQIETATSDY
                 310        320        330        340        350        360

370        380        390        400        410        420
m982.pep  DKEKLQERVAKLAGGVAVIKVGAATEVEMKEKKDRVEDALHATRAAVEEGVVAGGGVALL
          ||||||||||||||||||||||||||||||||||||||||||||||||||||||||||||
a982      DKEKLQERVAKLAGGVAVIKVGAATEVEMKEKKDRVEDALHATRAAVEEGVVAGGGVALL
                 370        380        390        400        410        420

430        440        450        460        470        480
m982.pep  RARAALENLHTGNADQDAGVQIVLRAVESPLRQIVANAGGEPSVVVNKVLEGKGNYGYNA
          ||||||||||||||||||||||||||||||||||||||||||||||||||||||||||||
a982      RARAALENLHTGNADQDAGVQIVLRAVESPLRQIVANAGGEPSVVVNKVLEGKGNYGYNA
                 430        440        450        460        470        480
```

-continued

```
              490        500        510        520        530        540
m982.pep   GSGEYGDMIEMGVLDPAKVTRSALQHAASIAGLMLTTDCMIAEIPEDKPAVPDMGGMGGM
           ||||||||||||||||||||||||||||||||||||||||||||:|||||||||
a982       GSGEYGDMIEMGVLDPAKVTRSALQHAASIAGLMLTTDCMIAEIPEDKPAMPDMGGMGGM
              490        500        510        520        530        540 m982.pep   GGMMX
           |||||
a982       GGMMX
```

The following partial DNA sequence was identified in *N. gonorrhoeae* <SEQ ID 2967>:

```
g986.seq
    1   GTGTTCAAAA AATACCAATA CTTCGCTTTG GCGGCACTGT GTGCCGCCTT

51   GCTGGCAGGC TGCGAAAAGG CAGGCAGCTT TTTCGGTGCG GACAAAAAAG

101   AAGCATCCTT CGTAGAACGC ATCGAACACA CCAAAGACGA CGGCAGTGTC

151   AGTATGCTGC TGCCCGACTT TGCCCAACTG GTTCAAAGCG AAGGCCCGGC

201   AGTCGTCAAT ATTCAGGCAG CCCCCGCCCC GCGCACCCAA AACGGCAGCG

251   GCAATGCCGA AACCGATTCC GACCCGCTTG CCGACAGCGA CCCGTTCTAC

301   GAATTTTTCA AACGCCTCGT CCCGAACATG CCCGAAATCC CCCAAGAAGA

351   AGCAGATGAC GGCGGATTGA ACTTCGGTTC GGGCTTCATC ATCAGCAAAA

401   ACGGCTACAT CCTGACCAAT ACCCACGTCG TTGCCGGTAT GGGCAGTATC

451   AAAGTCCTGC TCAACGACAA GCGCGAATAT ACCGCCAAAC TCATCGGTTC

501   GGATGTCCAA TCCGATGTCG CCCTTCTGAA AATCGACGCA ACGGAAGAGC

551   TACCCGTCGT CAAAATCGGC AATCCCAAAA ATTTGAAACC GGGCGAATGG

601   GTCGCTGCCA TCGGCGCGCC CTTCGGCTTT GACAACAGCG TGACCGCCGG

651   CATCGTGTCC GCCAAAGGCA GAAGCCTGCC CAACGAAAgc tACACACCCT

701   TCATCCAAAC CGACGTTGCC ATCAATCCGG GCAATTCCGG CGGCCCGCTG

751   TTCAACTTAA AAGGACAGGt cgTCGGCATC AATTCGCAAA TATACAGCCG

801   CAGCGgcgga ttCATGGGCA TCTCCTTTGC CATCCCGATT GACGTTGCCA

851   TGAATGTCGC CGAACAGCTG AAAAACACCG GCAAAGTCCA ACGCGGACAA

901   CTGGGCGTGA TTATTCAGGA AGTATCCTAC GGTTTGGCAC AGTCGTTCGG

951   TCTGGATAAA GCCAGCGGCG CATTGATTGC CAAAATCCTT CCCGGCAGCC

1001   CCGCAGAACG TGCCGGCCTG CAGGCGGGCG ACATCGTCCT CAGCCTCGAC

1051   GGCGGAGAAA TACGTTCTTC CGGCGACCTT CCCGTCATGG TCGGCGCCAT

1101   TACGCCGGGA AAAGAAGTCA GCCTCGGCGT ATGGCGCAAA GGCGAAGAAA

1151   TCACAATCAA AGCCAAGCTG GGCAACGCCg ccgagcATAC CGGCgcatCA

1201   TCCAAAACAG ATGAAgcccc ctacaccgAA CAGCAATCCG GTACGTTCTC

1251   GGTCGAATCC GCAGGCATTA CCCTTCAGAC ACATACCGAC AGCAGCGGca 1301   aacacctcgt cgtcgtacgg gtttccgacg cggcagaacg cGCAGGCTTA 1351   AGgcgcggcg acgaaatcct cgcggtcggg caagtccccg tcaatgacga 1401   agccgGTTTC cgcaaaGCTA TGGACAAGGC AGGCAAAAAC GTCCCCCTGC 1451   TGGTCAtgcg ccgTGGCAAC ACGCTGTTCA TCGCATTAAA CCTGCAATAA
```

This corresponds to the amino acid sequence <SEQ ID 2968; ORF 986.ng>:

```
g986.pep
     1   VFKKYQYFAL AALCAALLAG CEKAGSFFGA DKKEASFVER IEHTKDDGSV

51   SMLLPDFAQL VQSEGPAVVN IQAAPAPRTQ NGSGNAETDS DPLADSDPFY

101   EFFKRLVPNM PEIPQEEADD GGLNFGSGFI ISKNGYILTN THVVAGMGSI

151   KVLLNDKREY TAKLIGSDVQ SDVALLKIDA TEELPVVKIG NPKNLKPGEW

201   VAAIGAPFGF DNSVTAGIVS AKGRSLPNES YTPFIQTDVA INPGNSGGPL

251   FNLKGQVVGI NSQIYSRSGG FMGISFAIPI DVAMNVAEQL KNTGKVQRGQ

301   LGVIIQEVSY GLAQSFGLDK ASGALIAKIL PGSPAERAGL QAGDIVLSLD

351   GGEIRSSGDL PVMVGAITPG KEVSLGVWRK GEEITIKAKL GNAAEHTGAS

401   SKTDEAPYTE QQSGTFSVES AGITLQTHTD SSGKHLVVVR VSDAAERAGL

451   RRGDEILAVG QVPVNDEAGF RKAMDKAGKN VPLLVMRRGN TLFIALNLQ*
```

The following partial DNA sequence was identified in *N. meningitidis* <SEQ ID 2969>:

```
m986.seq
     1   GTGTTCAAAA AATACCAATA CCTCGCTTTG CAGCACTGT GTGCAGCCTC

51   GCTGGCAGGC TGCGACAAGG CAGGCAGCTT CTTCGTGGCG GACAAAAAAG

101   AAGCATCCTT CGTAGAACGC ATCGAACACA CCAAAGACGA CGGCAGCGTC

151   AGTATGCTGC TGCCCGACTT TGCCCAACTG GTTCAAAGTG AAGGTCCGGC

201   AGTCGTCAAT ATTCAGGCAG CCCCCGCCCC GCGCACCCAA AACGGCAGCG

251   GCAATGCCGA AACGATTCC GACCCGATTG CCGACAACGA CCCGTTCTAC

301   GAATTTTTCA AACGCCTCGT CCCGAATATG CCCGAAATCC CCCAAGAAGA

351   AGCAGATGAC GGCGGATTGA ACTTCGGTTC GGGCTTCATC ATCAGCAAAG

401   ACGGCTACAT CCTGACCAAT ACCCACGTCG TTACCGGCAT GGGCAGTATC

451   AAAGTCCTGC TCAACGACAA GCGCGAATAT ACCGCCAAAC TCATCGGTTC

501   GGATGTCCAA TCCGATGTCG CCCTTCTGAA AATCGACGCA ACGGAAGAGC

551   TGCCCGTCGT CAAAATCGGC AATCCCAAAG ATTTGAAACC GGGCGAATGG

601   GTCGCCGCCA TCGGCGCGCC CTTCGGCTTC GACAACAGCG TGACCGCCGG

651   CATCGTGTCC GCCAAAGGCA GAAGCCTGCC CAACGAAAGC TACACACCCT

701   TCATCCAAAC CGACGTTGCC ATCAATCCGG GCAACTCCGG CGGCCCGCTG

751   TTCAACTTAA AAGGACAGGT CGTCGGCATC AACTCGCAAA TATACAGCCG

801   CAGCGGCGGA TTCATGGGCA TTTCCTTCGC CATCCCGATT GACGTTGCCA

851   TGAATGTCGC CGAACAGCTG AAAAACACCG GCAAAGTCCA ACGCGGACAA

901   CTGGGCGTGA TTATTCAAGA AGTATCCTAC GGTTTGGCAC AATCGTTCGG

951   TTTGGACAAA GCCGGCGGCG CACTGATTGC CAAAATCCTG CCCGGCAGCC

1001   CCGCAGAACG TGCCGGCCTG CAGGCGGGCG ACATCGTCCT CAGCCTCGAC

1051   GGCGGAGAAA TACGTTCTTC CGGCGACCTT CCCGTTATGG TCGGCGCCAT

1101   TACGCCGGGA AAAGAAGTCA GCCTCGGCGT ATGGCGCAAA GGCGAAGAAA

1151   TCACAATCAA AGTCAAGCTG GGCAACGCCG CCGAGCATAT CGGCGCATCA

1201   TCCAAAACAG ATGAAGCCCC CTACACCGAA CAGCAATCCG GTACGTTCTC
```

```
-continued
1251  GGTCGAATCC GCAGGCATTA CCCTTCAGAC ACATACCGAC AGCAGCGGCG

1301  GACACCTCGT CGTCGTACGG GTTTCCGACG CGGCAGAACG CGCAGGCTTG

1351  AGGCGCGGCG ACGAAATTCT TGCCGTCGGG CAAGTCCCCG TCAATGACGA

1401  AGCCGGTTTC CGCAAAGCTA TGGACAAGGC AGGCAAAAAC GTCCCCCTGC

1451  TGATCATGCG CCGTGGCAAC ACGCTGTTTA TCGCATTAAA CCTGCAATAA
```

This corresponds to the amino acid sequence <SEQ ID 2970; ORF 986>:

```
m986.pep..
     1    VFKKYQYLAL AALCAASLAG CDKAGSFFVA DKKEASFVER IEHTKDDGSV

51    SMLLPDFAQL VQSEGPAVVN IQAAPAPRTQ NGSGNAENDS DPIADNDPFY

101    EFFKRLVPNM PEIPQEEADD GGLNFGSGFI ISKDGYILTN THVVTGMGSI

151    KVLLNDKREY TAKLIGSDVQ SDVALLKIDA TEELPVVKIG NPKDLKPGEW

201    VAAIGAPFGF DNSVTAGIVS AKGRSLPNES YTPFIQTDVA INPGNSGGPL

251    FNLKGQVVGI NSQIYSRSGG FMGISFAIPI DVAMNVAEQL KNTGKVQRGQ

301    LGVIIQEVSY GLAQSFGLDK AGGALIAKIL PGSPAERAGL QAGDIVLSLD

351    GGEIRSSGDL PVMVGAITPG KEVSLGVWRK GEEITIKVKL GNAAEHIGAS

401    SKTDEAPYTE QQSGTFSVES AGITLQTHTD SSGGHLVVVR VSDAAERAGL

451    RRGDEILAVG QVPVNDEAGF RKAMDKAGKN VPLLIMRRGN TLFIALNLQ*
```

Computer analysis of this amino acid sequence gave the following results:
Homology with a Predicted ORF from *N. gonorrhoeae*
    m986/g986 97.0% identity in 499 aa overlap

```
                  10         20         30         40         50         60
m986.pep  VFKKYQYLALAALCAASLAGCDKAGSFFVADKKEASFVERIEHTKDDGSVSMLLPDFAQL
          ||||||:||||||||||::|||||:||||||||||||||||||||||||||||||||||
g986      VFKKYQYFALAALCAALLAGCEKAGSFFGADKKEASFVERIEHTKDDGSVSMLLPDFAQL
                  10         20         30         40         50         60

70         80         90        100        110        120
m986.pep  VQSEGPAVVNIQAAPAPRTQNGSGNAENDSDPIADNDPFYEFFKRLVPNMPEIPQEEADD
          ||||||||||||||||||||||||||||:||||::|||||||||||||||||||||||||
g986      VQSEGPAVVNIQAAPAPRTQNGSGNAETDSDPLADSDPFYEFFKRLVPNMPEIPQEEADD
                  70         80         90        100        110        120

130        140        150        160        170        180
m986.pep  GGLNFGSGFIISKDGYILTNTHVVTGMGSIKVLLNDKREYTAKLIGSDVQSDVALLKIDA
          |||||||||||||:||||||||||:|||||||||||||||||||||||||:|||||||||
g986      GGLNFGSGFIISKNGYILTNTHVVAGMGSIKVLLNDKREYTAKLIGSDVQSDVALLKIDA
                 130        140        150        160        170        180

190        200        210        220        230        240
m986.pep  TEELPVVKIGNPKDLKPGEWVAAIGAPFGFDNSVTAGIVSAKGRSLPNESYTPFIQTDVA
          |||||||||||||:||||||||||||||||||||||||||||||||||||||||||||||
g986      TEELPVVKIGNPKNLKPGEWVAAIGAPFGFDNSVTAGIVSAKGRSLPNESYTPFIQTDVA
                 190        200        210        220        230        240

250        260        270        280        290        300
m986.pep  INPGNSGGPLFNLKGQVVGINSQIYSRSGGFMGISFAIPIDVAMNVAEQLKNTGKVQRGQ
          ||||||||||||||||||||||||||||||||||||||||||||||||||||||||||||
g986      INPGNSGGPLFNLKGQVVGINSQIYSRSGGFMGISFAIPIDVAMNVAEQLKNTGKVQRGQ
                 250        260        270        280        290        300

310        320        330        340        350        360
m986.pep  LGVIIQEVSYGLAQSFGLDKAGGALIAKILPGSPAERAGLQAGDIVLSLDGGEIRSSGDL
          ||||||||||||||||||||||:|||||||||||||||||||||||||||||||||||||
g986      LGVIIQEVSYGLAQSFGLDKASGALIAKILPGSPAERAGLQAGDIVLSLDGGEIRSSGDL
                 310        320        330        340        350        360

370        380        390        400        410        420
m986.pep  PVMVGAITPGKEVSLGVWRKGEEITIKVKLGNAAEHIGASSKTDEAPYTEQQSGTFSVES
          ||||||||||||||||||||||||||||:|||||||||||||||||||||||||||||||
g986      PVMVGAITPGKEVSLGVWRKGEEITIKAKLGNAAEHTGASSKTDEAPYTEQQSGTFSVES
                 370        380        390        400        410        420
```

-continued

```
                430         440         450         460         470         480
m986.pep  AGITLQTHTDSSGGHLVVVRVSDAAERAGLRRGDEILAVGQVPVNDEAGFRKAMDKAGKN
          |||||||||||| |||||||||||||||||||||||||||||||||||||||||||||||
g986      AGITLQTHTDSSGKHLVVVRVSDAAERAGLRRGDEILAVGQVPVNDEAGFRKAMDKAGKN
                430         440         450         460         470         480

490         500
m986.pep  VPLLIMRRGNTLFIALNLQX
          ||||:|||||||||||||||
g986      VPLLVMRRGNTLFIALNLQX
                490         500
```

The following partial DNA sequence was identified in *N. meningitidis* <SEQ ID 2971>:

```
a986.seq
     1  GTGTTCAAAA AATACCAATA CCTCGCTTTG GCAGCACTGT GTGCCGCCTC
    51  GCTGGCAGGC TGCGACAAAG CCGGCAGCTT TTTCGGTGCG GACAAAAAAG
   101  AAGCATCCTT TGTAGAACGC ATCAAACACA CCAAAGACGA CGGCAGCGTC
   151  AGTATGCTGC TGCCCGACTT TGTCCAACTG GTTCAAAGCG AAGGCCCGGC
   201  AGTCGTCAAT ATTCAGGCAG CCCCCGCCCC GCGCACCCAA AACGGCAGCA
   251  GCAATGCCGA AACCGATTCC GACCCGCTTG CCGACAGCGA CCCGTTCTAC
   301  GAATTTTTCA AACGCCTCGT CCCGAACATG CCCGAAATCC CCCAAGAAGA
   351  AGCAGATGAC GGNGGATTGA ACTTCGGTTC GGGCTTCATC ATCAGCAAAG
   401  ACGGCTATAT TCTGACCAAT ACGCACGTCG TTACCGGCAT GGGCAGTATC
   451  AAAGTCCTGC TCAACGACAA GCGCGAATAT ACCGCCAAAC TCATCGGTTC
   501  GGATGTCCAA TCCGATGTCG CCCTTCTGAA AATCGACGCA ACGGAAGAGC
   551  TGCCCGTCGT CAAAATCGGC AATCCCAAAG ATTTGAAACC GGGCGAATGG
   601  GTCGCCGCCA TCGGCGCGCC CTTCGGCTTC GACAACAGCG TGACCGCCGG
   651  CNTCGTGTCC GCCAAAGGCA GAAGCCTGCC CAACGAAAGC TACACACCCT
   701  TCATCCAAAC CGACGTTGCC ATCAATCCGG GCAACTCCGG CGGCCCGCTG
   751  TTCAACTTAA AAGGACAGGT CGTCGGCATC AACTCGCAAA TATACAGCCG
   801  CAGCGGCGGA TTCATGGGCA TTTCCTTCGC CATCCCGATT GACGTTGCCA
   851  TGAATGTCGC CGAACAGCTG AAAAACACCG GCAAAGTCCA ACGCGGACAA
   901  CTGGGCGTGA TTATTCAAGA AGTATCCTAC GGTTTGGCAC AATCGTTCGG
   951  TTTGGACAAA GCCGGCGGCG CACTGATTGC CAAAATCCTG CCCGGCAGCC
  1001  CCGCAGAACG TGCCGGCCTG CGGGCGGGCG ACATCGTCCT CAGCCTCGAC
  1051  GGCGGAGAAA TACGTTCTTC CGGCGACCTT CCCGTTATGG TCGGCGCCAT
  1101  TACGCCGGGA AAAGAAGTCA GCCTCGGCGT ATGGCGCAAA GGCGAAGAAA
  1151  TCACAATCAA AGTCAAGCTG GGCAACGCCG CCGAGCATAT CGGCGCATCA
  1201  TCCAAAACAG ATGAAGCCCC CTACACCGAA CAGCAATCCG GTACGTTCTC
  1251  GGTCGAATCC GCAGGCATTA CCCTTCAGAC ACATACCGAC AGCAGCGGCG
  1301  GACACCTCGT CGTCGTACGG GTTTCCGACG CGGCAGAACG CGCAGGCTTG
  1351  AGGCGCGGCG ACGAAATTCT TGCCGTCGGG CAAGTCCCCG TCAATGACGA
  1401  AGCCGGTTTC CGCAAAGCTA TGGACAAGGC AGGCAAAAAC GTCCCCCTGC
  1451  TGATCATGCG CCGTGGCAAC ACGCTGTTTA TCGCATTAAA CCTGCAATAA
```

This corresponds to the amino acid sequence <SEQ ID 2972; ORF 986.a>:

```
a986.pep
    1   VFKKYQYLAL AALCAASLAG CDKAGSFFGA DKKEASFVER IKHTKDDGSV

51   SMLLPDFVQL VQSEGPAVVN IQAAPAPRTQ NGSSNAETDS DPLADSDPFY

101   EFFKRLVPNM PEIPQEEADD GGLNFGSGFI ISKDGYILTN THVVTGMGSI

151   KVLLNDKREY TAKLIGSDVQ SDVALLKIDA TEELPVVKIG NPKDLKPGEW

201   VAAIGAPFGF DNSVTAGXVS AKGRSLPNES YTPFIQTDVA INPGNSGGPL

251   FNLKGQVVGI NSQIYSRSGG FMGISFAIPI DVAMNVAEQL KNTGKVQRGQ

301   LGVIIQEVSY GLAQSFGLDK AGGALIAKIL PGSPAERAGL RAGDIVLSLD

351   GGEIRSSGDL PVMVGAITPG KEVSLGVWRK GEEITIKVKL GNAAEHIGAS

401   SKTDEAPYTE QQSGTFSVES AGITLQTHTD SSGGHLVVVR VSDAAERAGL

451   RRGDEILAVG QVPVNDEAGF RKAMDKAGKN VPLLIMRRGN TLFIALNLQ*
``` m986/a986 98.2% identity in 499 aa overlap

```
                10         20         30         40         50         60
m986.pep  VFKKYQYLALAALCAASLAGCDKAGSFFVADKKEASFVERIEHTKDDGSVSMLLPDFAQL
          ||||||||||||||||||||||||||||  ||||||||||||| |||||||||||||| ||
a986      VFKKYQYLALAALCAASLAGCDKAGSFFGADKKEASFVERIKHTKDDGSVSMLLPDFVQL
                10         20         30         40         50         60

70         80         90        100        110        120
m986.pep  VQSEGPAVVNIQAAPAPRTQNGSGNAENDSDPIADNDPFYEFFKRLVPNMPEIPQEEADD
          |||||||||||||||||||||||:|||:||||:|:||||||||||||||||||||||||
a986      VQSEGPAVVNIQAAPAPRTQNGSSNAETDSDPLADSDPFYEFFKRLVPNMPEIPQEEADD
                70         80         90        100        110        120

130        140        150        160        170        180
m986.pep  GGLNFGSGFIISKDGYILTNTHVVTGMGSIKVLLNDKREYTAKLIGSDVQSDVALLKIDA
          ||||||||||||||||||||||||||||||||||||||||||||||||||||||||||||
a986      GGLNFGSGFIISKDGYILTNTHVVTGMGSIKVLLNDKREYTAKLIGSDVQSDVALLKIDA
               130        140        150        160        170        180

190        200        210        220        230        240
m986.pep  TEELPVVKIGNPKDLKPGEWVAAIGAPFGFDNSVTAGIVSAKGRSLPNESYTPFIQTDVA
          |||||||||||||||||||||||||||||||||||| |||||||||||||||||||||
a986      TEELPVVKIGNPKDLKPGEWVAAIGAPFGFDNSVTAGXVSAKGRSLPNESYTPFIQTDVA
               190        200        210        220        230        240

250        260        270        280        290        300
m986.pep  INPGNSGGPLFNLKGQVVGINSQIYSRSGGFMGISFAIPIDVAMNVAEQLKNTGKVQRGQ
          ||||||||||||||||||||||||||||||||||||||||||||||||||||||||||||
a986      INPGNSGGPLFNLKGQVVGINSQIYSRSGGFMGISFAIPIDVAMNVAEQLKNTGKVQRGQ
               250        260        270        280        290        300

310        320        330        340        350        360
m986.pep  LGVIIQEVSYGLAQSFGLDKAGGALIAKILPGSPAERAGLQAGDIVLSLDGGEIRSSGDL
          |||||||||||||||||||||||||||||||||||||||| |||||||||||||||||
a986      LGVIIQEVSYGLAQSFGLDKAGGALIAKILPGSPAERAGLRAGDIVLSLDGGEIRSSGDL
               310        320        330        340        350        360

370        380        390        400        410        420
m986.pep  PVMVGAITPGKEVSLGVWRKGEEITIKVKLGNAAEHIGASSKTDEAPYTEQQSGTFSVES
          ||||||||||||||||||||||||||||||||||||||||||||||||||||||||||||
a986      PVMVGAITPGKEVSLGVWRKGEEITIKVKLGNAAEHIGASSKTDEAPYTEQQSGTFSVES
               370        380        390        400        410        420

430        440        450        460        470        480
m986.pep  AGITLQTHTDSSGGHLVVVRVSDAAERAGLRRGDEILAVGQVPVNDEAGFRKAMDKAGKN
          ||||||||||||||||||||||||||||||||||||||||||||||||||||||||||||
a986      AGITLQTHTDSSGGHLVVVRVSDAAERAGLRRGDEILAVGQVPVNDEAGFRKAMDKAGKN
               430        440        450        460        470        480

490        500
m986.pep  VPLLIMRRGNTLFIALNLQX
          ||||||||||||||||||||
a986      VPLLIMRRGNTLFIALNLQX
               490        500
```

The following partial DNA sequence was identified in *N. gonorrhoeae* <SEQ ID 2973>:

```
g987.seq
    1   ATGAAAACAC GCAGCCTCAT TTCCCTTTTA TGCCTCCTTC TCTGTTCATG
   51   TTCTTCATGG TTGCCCCCAC TGGAAGAACG GACGGAAAGC CGTCATTTTA
  101   ATACTTCCAA ACCTGTCCTC CTGGACAACA TCCTGCAAAT CCGGCACACC
  151   CCTCATAACA ACGGGCTATC CGACATCTAC CTGCTCGACG ACCCCCACGA
  201   AGCCTTTGCC GCCCGCGCCG CCCTTATCGA ATCTGCCGAA CACAGCCTCG
  251   ATTTGCAATA CTACATTTGG CGCAACGaCA TTTCCGGCAG GCTGCTGTTC
  301   AACCTCATGT ACCTTGCCGC agaacgcGGC GTGCGCGTAC GCCTGCTGTt
  351   ggacgacaAC AACAcgcgcg gcttggacga tctcctGCTC GCCCTCGACA
  401   GCCATCCCAA TAtctaagtG CGCCTGTTCA ACCCCTtcgt CCTACGCAAA
  451   TGGCGCGCAC TCGGCTACCT GACCGACTTC CCCCGCCTCA ACCGCCGCAT
  501   GCACAACAAA TCCTTTACCG CCGACAACCG CGCCACCATA CTCGGCGGAC
  551   GCAATATCGG CGACGAATAC TTCAAAGTCG GTGAGGACAC CGTTTTCGCC
  601   GACCTGGACA TCCTCGCCAC CGGCAGCGTC GTCGGCGAAG TATCGCACGA
  651   CTTCGACCGC TACTGGGCAA GCCATTCCGC CCACAACGCC ACGCGCATCA
  701   TCCGCAGCGG CAACATCGGC AAGGGTCTTC AAGCACTCGG ATACAACGAC
  751   GAAACATCCA GACACGCGCT CCTGCGCTAC CGCGAAACCG TCGAACAGTC
  801   GCCCCTCTAC CAAAAAATAC AGACGGGACG CATCGACTGG CAGAGCGTCC
  851   AAACCCGCCT GATCAGCGAC AGCCCTGCAA AAGGACTCGA CCGCGACCGC
  901   CGCAAACCGC CGATTGCCGG GAGGCTGCAA GACGCGCTCA ACAGCCCGA
  951   AAAAAGCGTC TATCTGGTTT CACCCTATTT CGTCCCTACA AAATCCGGCA
 1001   CAGACGCACT GGCAAAACTG GTGCAGGACG GCATAGACGT TACCGTCCTG
 1051   ACCAACTCGC TACAGGCGAC CGACGTTGCC GCCGTCCATT CCGGCTACGT
 1101   CAAATACCGA AAACCGCTGC TCAAAGCCGG CATCAAACTC TACGAGCTGC
 1151   AACCCAACCA TGCCGTCCCC GCCACAAAAG ACAAAGGCCT GACCGGCAGC
 1201   TCCGTAACCA GCCTGCATGC CAAAACCTTC ATTGTGGacg gCAAACGCAT
 1251   CTTCATCGGC TCATTCAACC TCGACCCCCG TTCCGCACGG CTCAATACCG
 1301   AAATGGGCGT CGTCATCGAA AGCCCCAAAA TCGCAGAACA GATGGAGCGC
 1351   AccctCGCCG AtacCACACC CGAATACGCC TACCGCGTTA CCCTCGACAA
 1401   ACACAACCGC CTGCAATGGC ACGATCCCGC CACCCGAAAA ACCTACCCGA
 1451   ACGAACCCGA AGCCAAACTT TGGAAACGCA TCGCCGCAAA AATCCTATCC
 1501   CTGCTGCCCA TCGAAGGTTT ATTATAG
```

This corresponds to the amino acid sequence <SEQ ID 2974; ORF 987.ng>:

```
g987.pep
    1   MKTRSLISLL CLLLCSCSSW LPPLEERTES RHFNTSKPVL LDNILQIRHT
   51   PHNNGLSDIY LLDDPHEAFA ARAALIESAE HSLDLQYYIW RNDISGRLLF
  101   NLMYLAAERG VRVRLLLDDN NTRGLDDLLL ALDSHPNI*V RLFNPFVLRK
  151   WRALGYLTDF PRLNRRMHNK SFTADNRATI LGGRNIGDEY FKVGEDTVFA
```

-continued

```
201  DLDILATGSV VGEVSHDFDR YWASHSAHNA TRIIRSGNIG KGLQALGYND

251  ETSRHALLRY RETVEQSPLY QKIQTGRIDW QSVQTRLISD SPAKGLDRDR

301  RKPPIAGRLQ DALKQPEKSV YLVSPYFVPT KSGTDALAKL VQDGIDVTVL

351  TNSLQATDVA AVHSGYVKYR KPLLKAGIKL YELQPNHAVP ATKDKGLTGS

401  SVTSLHAKTF IVDGKRIFIG SFNLDPRSAR LNTEMGVVIE SPKIAEQMER

451  TLADTTPEYA YRVTLDKHNR LQWHDPATRK TYPNEPEAKL WKRIAAKILS

501  LLPIEGLL*
```

The following partial DNA sequence was identified in *N. meningitidis* <SEQ ID 2975>:

```
m987.seq
    1  ATGAAAACAC GCAGCCTAAT TTCCCTTTTA TGCCTCCTTC TCTGTTCATG

51  TTCTTCATGG TTGCCCCCAC TGGAAGAACG GACGGAAAGC CGTCATTTCA

101  ATACTTCCAA ACCCGTCCGC CTGGACAACA TCCTGCAAAT CCGGCACACC

151  CCTCATACCA ACGGGCTATC CGATATCTAT CTGTTGAACG ACCCCACGA

201  AGCCTTTGCC GCCCGCGCCG CCCTTATCGA ATCTGCCGAA CACAGCCTCG

251  ATTTGCAATA CTACATCTGG CGCAACGACA TTTCCGGCAG GCTGCTGTTC

301  AACCTCGTGT ACCTTGCCGC AGAACGCGGT GTGCGCGTAC GCCTGCTGTT

351  GGACGACAAC AACACGCGCG GATTGGACGA CCTCCTGCTT GCCCTCGACA

401  GCCATCCCAA TATCGAAGTG CGCCTGTTCA ACCCCTTCGT CTTACGAAAA

451  TGGCGCGCAC TCGGCTACCT GACCGACTTC CCCCGCCTCA ACCGCCGCAT

501  GCACAACAAA TCCTTTACCG CCGACAACCG CGCCACCATA CTCGGCGGAC

551  GCAATATCGG CGACGAATAC TTCAAAGTCG GTGAGGACAC CGTTTTCGCC

601  GATTTGGACA TCCTCGCCAC CGGCAGCGTC GTCGGCGAAG TATCGCACGA

651  CTTCGACCGC TACTGGGCAA GCCATTCCGC CCACAACGCC ACGCGCATCA

701  TCCGCAGCGG CGACATCGGC AAGGGTCTTC AAGCACTCGG ATACAACGAC

751  GAAACGTCCA GACACGCGCT CCTGCGCTAC CGCGAAACCG TCGAACAGTC

801  GCCCCTCTAC CAAAAAATAC AGACAGGATG CATCGACTGG CAGAGCGTCC

851  GAACCCGCCT CATCAGCGAC GACCCTGCAA AAGGACTCGA CCGCGACCGC

901  CGCAAACCGC CGATTGCCGG CGGCTGCAA GACGCGCTCA AACAGCCCGA

951  AAAAAGCGTC TATCTGGTTT CACCCTATTT CGTTCCCACA AAATCCGGCA

1001  CAGACGCACT GGCAAAACTG GTGCAGGACG GCATAGACGT TACCGTTCTG

1051  ACCAACTCGC TGCAGGCGAC CGACGTTGCC GCCGTCCATT CCGGCTATGT

1101  CAAATACCGA AAACCGCTGC TCAAAGCCGG CATCAAACTC TACGAGCTGC

1151  AACCCAACCA TGCCGTCCCC GCCACAAAAG ACAAAGGCCT GACCGGCAGC

1201  TCCGTAACCA GCCTGCACGC CAAAACCTTC ATTGTGGACG GCAAACGCAT

1251  CTTCATCGGT TCGTTCAACC TCGACCCCCG TTCCGCGCGT CTCAACACCG

1301  AAATGGGCGT TGTTATCGAA AGCCCCAAAA TCGCAGAACA GATGGAGCGC

1351  ACCCTTGCCG ATACCACACC CGCCTACGCC TACCGCGTTA CCCTCGACAG

1401  GCACAACCGC CTGCAATGGC ACGATCCCGC CACCCGAAAA ACCTACCCGA
```

```
1451  ACGAACCCGA AGCCAAACTT TGGAAACGCA TCGCCGCAAA AATCCTATCC

1501  CTGCTGCCCA TAGAAGGTTT ATTATAG
```

This corresponds to the amino acid sequence <SEQ ID 2976; ORF 987>:

```
m987.pep
   1  MKTRSLISLL CLLLCSCSSW LPPLEERTES RHFNTSKPVR LDNILQIRHT

51  PHTNGLSDIY LLNDPHEAFA ARAALIESAE HSLDLQYYIW RNDISGRLLF

101  NLVYLAAERG VRVRLLLDDN NTRGLDDLLL ALDSHPNIEV RLFNPFVLRK

151  WRALGYLTDF PRLNRRMHNK SFTADNRATI LGGRNIGDEY FKVGEDTVFA

201  DLDILATGSV VGEVSHDFDR YWASHSAHNA TRIIRSGDIG KGLQALGYND

251  ETSRHALLRY RETVEQSPLY QKIQTGCIDW QSVRTRLISD DPAKGLDRDR

301  RKPPIAGRLQ DALKQPEKSV YLVSPYFVPT KSGTDALAKL VQDGIDVTVL

351  TNSLQATDVA AVHSGYVKYR KPLLKAGIKL YELQPNHAVP ATKDKGLTGS

401  SVTSLHAKTF IVDGKRIFIG SFNLDPRSAR LNTEMGVVIE SPKIAEQMER

451  TLADTTPAYA YRVTLDRHNR LQWHDPATRK TYPNEPEAKL WKRIAAKILS

501  LLPIEGLL*
```

Computer analysis of this amino acid sequence gave the following results:
Homology with a Predicted ORF from *N. gonorrhoeae*
  m987/g987 97.8% identity in 508 aa overlap

```
                  10         20         30         40         50         60
m987.pep  MKTRSLISLLCLLLCSCSSWLPPLEERTESRHFNTSKPVRLDNILQIRHTPHTNGLSDIY
          ||||||||||||||||||||||||||||||||||||||| |||||||||||:|||||||
g987      MKTRSLISLLCLLLCSCSSWLPPLEERTESRHFNTSKPVLLDNILQIRHTPHNNGLSDIY
                  10         20         30         40         50         60

70         80         90        100        110        120
m987.pep  LLNDPHEAFAARAALIESAEHSLDLQYYIWRNDISGRLLFNLVYLAAERGVRVRLLLDDN
          ||:|||||||||||||||||||||||||||||||||||||:|||||||||||||||||||
g987      LLDDPHEAFAARAALIESAEHSLDLQYYIWRNDISGRLLFNLMYLAAERGVRVRLLLDDN
                  70         80         90        100        110        120

130        140        150        160        170        180
m987.pep  NTRGLSSLLLALDSHPNIEVRLFNPFVLRKWRALGYLTDFPRMNRRMHNKSFTADNRATI
          |||||||||||||||||| |||||||||||||||||||||||||||||||||||||||||
g987      NTRGLSSLLLALDSHPNIXVRLFNPFVLRKWRALGYLTDFPRMNRRMHNKSFTADNRATI
                 130        140        150        160        170        180

190        200        210        220        230        240
m987.pep  LGGRNIGDEYFKVGEDTVFADLDILATGSVVGEVSHDFDRYWASHSAHNATRIIRSGDIG
          |||||||||||||||||||||||||||||||||||||||||||||||||||||||:||
g987      LGGRNIGDEYFKVGEDTVFADLDILATGSVVGEVSHDFDRYWASHSAHNATRIIRSGNIG
                 190        200        210        220        230        240

250        260        270        280        290        300
m987.pep  KGLQALGYNDETSRHALLRYRETVEQSPLYQKIQTGCIDWQSVRTRLISDDPAKGLDRDR
          ||||||||||||||||||||||||||||||||||||:||||||:||||||||||||||||
g987      KGLQALGYNDETSRHALLRYRETVEQSPLYQKIQTGRIDWQSVQTRLISDSPAKGLDRDR
                 250        260        270        280        290        300

310        320        330        340        350        360
m987.pep  RKPPIAGRLQDALKQPEKSVYLVSPYFVPTKSGTDALAKLVQDGIDVTVLTNSLQATDVA
          ||||||||||||||||||||||||||||||||||||||||||||||||||||||||||||
g987      RKPPIAGRLQDALKQPEKSVYLVSPYFVPTKSGTDALAKLVQDGIDVTVLTNSLQATDVA
                 310        320        330        340        350        360

370        380        390        400        410        420
m987.pep  AVHSGYVKYRKPLLKAGIKLYELQPNHAVPATKDKGLTGSSVTSLHAKTFIVDGKRIFIG
          ||||||||||||||||||||||||||||||||||||||||||||||||||||||||||||
g987      AVHSGYVKYRKPLLKAGIKLYELQPNHAVPATKDKGLTGSSVTSLHAKTFIVDGKRIFIG
                 370        380        390        400        410        420
```

-continued

```
                430         440         450         460         470         480
m987.pep   SFNLDPRSARLNTEMGVVIESPKIAEQMERTLADTTPAYAYRVTLDRHNRLQWHDPATRK
           |||||||||||||||||||||||||||||||||||| ||||||||:|||||||||||||
g987       SFNLDPRSARLNTEMGVVIESPKIAEQMERTLADTTPEYAYRVTLDKHNRLQWHDPATRK
                430         440         450         460         470         480

490         500      509
m987.pep   TYPNEPEAKLWKRIAAKILSLLPIEGLLX
           |||||||||||||||||||||||||||||
g987       TYPNEPEAKLWKRIAAKILSLLPIEGLLX
                490         500
```

The following partial DNA sequence was identified in *N. meningitidis* <SEQ ID 2977>:

```
a987.seq
   1  ATGAAAACAC GCAGCCTAAT TTCCCTTTTA TGCCTCCTTC TCTGTTCATG
  51  TTCTTCATGG TTGCCCCCAC TGGAAGAACG GACGGAAAGC CGTCATTTCA
 101  ATACTTCCAA ACCCGTCCGC CTGGACAACA TCCTGCAAAT CCGGCACACC
 151  CCTCATACCA ACGGGCTATC CGATATCTAT CTGTTGAACG ACCCCCACGA
 201  AGCCTTTGCC GCCCGCGCCG CCCTTATCGA ATCTGCCGAA CACAGCCTCG
 251  ATTTGCAATA CTACATCTGG CGCAACGACA TTTCCGGCCG ACTGCTGTTC
 301  AACCTCGTGT ACCTTGCCGC AGAACGCGGT GTGCGCGTAC GCCTGCTGTT
 351  GGACGACAAC AACACGCGCG GATTGGACGA CCTCCTGCTC GACCTGGACA
 401  GCCATCCCAA TATCGAAGTG CGCCTGTTCA ACCCCTTCGT CTTACGAAAA
 451  TGGCGCGCAC TCGGCTACCT GACCGACTTC CCCCGCCTCA ACCGCCGCAT
 501  GCACAACAAA TCCTTTACCG CCGACAACCG CGCCACCATA CTCGGCGGAC
 551  GCAATATCGG CGACGAATAC TTCAAAGTCG GTGAGGACAC CGTTTTCGCC
 601  GACCTGGACA TCCTCGCCAC CGGCAGCGTC GTCGGCGAAG TATCGCACGA
 651  CTTCGACCGC TACTGGGCAA GCCATTCCGC CCACAACGCC ACGCGCATCA
 701  TCCGCAGCGG CAACATCGGC AAGGGTCTTC AAGCACTCGG ATACAACGAC
 751  GAAACGTCCA GACACGCGCT CCTGCGCTAC CGCGAAACCG TCGAACAGTC
 801  GCCCCTCTAC CAAAAAATAC AGACAGGACG CATCGACTGG CAGAGCGTCC
 851  AAACCCGCCT CATCAGCGAC GACCCTGCAA AAGGACTCGA CCGCGACCGC
 901  CGCAAACCGC CGATTGCCGG GCGGCTGCAA GACGCGCTCA AACAGCCCGA
 951  AAAAAGCGTC TATCTGGTTT CACCCTATTT CGTCCCCACA AAATCCGGCA
1001  CAGACGCACT GGCAAAACTG GTGCAGGACG GCATAGACGT TACCGTCCTG
1051  ACCAACTCGC TACAGGCGAC CGACGTTGCC GCCGTCCATT CCGGCTATGT
1101  CAAATACCGA AAACCGCTGC TCAAAGCCGG CATCAAACTC TACGAGCTGC
1151  AACCCAACCA TGCCGTCCCT GCCACAAAAG ACAAAGGCCT GACCGGCAGC
1201  TCCGTAACCA GCCTGCATGC CAAAACCTTC ATTGTGGACG GCAAACGCAT
1251  CTTCATCGGC TCATTCAACC TCGACCCCCG TTCCGCACGG CTCAATACTG
1301  AAATGGGCGT TGTTATCGAA AGCCCCAAAA TCGCAGAACA GATGGAGCGC
1351  ACCCTTGCCG ATACCTCACC CGAATACGCC TACCGCGTTA CCCTCGACAG
1401  GCACAACCGC CTGCAATGGC ACGATCCCGC CACCCGAAAA ACCTACCCGA
1451  ACGAACCCGA AGCCAAACTT TGGAAACGCA TCGCCGCAAA AATCCTATCC
1501  CTGCTGCCCA TAGAAAGTTT ATTATAG
```

This corresponds to the amino acid sequence <SEQ ID 550; ORF 2978.a>:

```
a987.pep
    1  MKTRSLISLL CLLLCSCSSW LPPLEERTES RHFNTSKPVR LDNILQIRHT

51  PHTNGLSDIY LLNDPHEAFA ARAALIESAE HSLDLQYYIW RNDISGRLLF

101  NLVYLAAERG VRVRLLLDDN NTRGLDDLLL ALDSHPNIEV RLFNPFVLRK

151  WRALGYLTDF PRLNRRMHNK SFTADNRATI LGGRNIGDEY FKVGEDTVFA

201  DLDILATGSV VGEVSHDFDR YWASHSAHNA TRIIRSGNIG KGLQALGYND

251  ETSRHALLRY RETVEQSPLY QKIQTGRIDW QSVQTRLISD DPAKGLDRDR

301  RKPPIAGRLQ DALKQPEKSV YLVSPYFVPT KSGTDALAKL VQDGIDVTVL

351  TNSLQATDVA AVHSGYVKYR KPLLKAGIKL YELQPNHAVP ATKDKGLTGS

401  SVTSLHAKTF IVDGKRIFIG SFNLDPRSAR LNTEMGVVIE SPKIAEQMER

451  TLADTSPEYA YRVTLDRHNR LQWHDPATRK TYPNEPEAKL WKRIAAKILS

501  LLPIESLL*
``` m987/a987 98.8% identity in 508 aa overlap

```
                 10         20         30         40         50         60
  m987.pep  MKTRSLISLLCLLLCSCSSWLPPLEERTESRHFNTSKPVRLDNILQIRHTPHTNGLSDIY
            ||||||||||||||||||||||||||||||||||||||||||||||||||||||||||||
  a987      MKTRSLISLLCLLLCSCSSWLPPLEERTESRHFNTSKPVRLDNILQIRHTPHTNGLSDIY
                 10         20         30         40         50         60

70         80         90        100        110        120
  m987.pep  LLNDPHEAFAARAALIESAEHSLDLQYYIWRNDISGRLLFNLVYLAAERGVRVRLLLDDN
            ||||||||||||||||||||||||||||||||||||||||||||||||||||||||||||
  a987      LLNDPHEAFAARAALIESAEHSLDLQYYIWRNDISGRLLFNLVYLAAERGVRVRLLLDDN
                 70         80         90        100        110        120

130        140        150        160        170        180
  m987.pep  NTRGLSSLLLALDSHPNIEVRLFNPFVLRKWRALGYLTDFPRMNRRMHNKSFTADNRATI
            ||||||:|||||||||||||||||||||||||||||||||||:|||||||||||||||||
  a987      NTRGLSSLLLALDSHPNIEVRLFNPFVLRKWRALGYLTDFPRMNRRMHNKSFTADNRATI
                130        140        150        160        170        180

190        200        210        220        230        240
  m987.pep  LGGRNIGDEYFKVGEDTVFADLDILATGSVVGEVSHDFDRYWASHSAHNATRIIRSGDIG
            ||||||||||||||||||||||||||||||||||||||||||||||||||||||||:||
  a987      LGGRNIGDEYFKVGEDTVFADLDILATGSVVGEVSHDFDRYWASHSAHNATRIIRSGNIG
                190        200        210        220        230        240

250        260        270        280        290        300
  m987.pep  KGLQALGYNDETSRHALLRYRETVEQSPLYQKIQTGCIDWQSVRTRLISDDPAKGLDRDR
            |||||||||||||||||||||||||||||||||||||:||||||:|||||||||||||||
  a987      KGLQALGYNDETSRHALLRYRETVEQSPLYQKIQTGRIDWQSVQTRLISDDPAKGLDRDR
                250        260        270        280        290        300

310        320        330        340        350        360
  m987.pep  RKPPIAGRLQDALKQPEKSVYLVSPYFVPTKSGTDALAKLVQDGIDVTVLTNSLQATDVA
            ||||||||||||||||||||||||||||||||||||||||||||||||||||||||||||
  a987      RKPPIAGRLQDALKQPEKSVYLVSPYFVPTKSGTDALAKLVQDGIDVTVLTNSLQATDVA
                310        320        330        340        350        360

370        380        390        400        410        420
  m987.pep  AVHSGYVKYRKPLLKAGIKLYELQPNHAVPATKDKGLTGSSVTSLHAKTFIVDGKRIFIG
            ||||||||||||||||||||||||||||||||||||||||||||||||||||||||||||
  a987      AVHSGYVKYRKPLLKAGIKLYELQPNHAVPATKDKGLTGSSVTSLHAKTFIVDGKRIFIG
                370        380        390        400        410        420

430        440        450        460        470        480
  m987.pep  SFNLDPRSARLNTEMGVVIESPKIAEQMERTLADTTPAYAYRVTLDRHNRLQWHDPATRK
            |||||||||||||||||||||||||||||||||||||:|||||||||||||||||||||
  a987      SFNLDPRSARLNTEMGVVIESPKIAEQMERTLADTSPEYAYRVTLDRHNRLQWHDPATRK
                430        440        450        460        470        480

490        500        509
  m987.pep  TYPNEPEAKLWKRIAAKILSLLPIEGLLX
            ||||||||||||||||||||||||:|||
  a987      TYPNEPEAKLWKRIAAKILSLLPIESLLX
                490        500
```

The following partial DNA sequence was identified in *N. gonorrhoeae* <SEQ ID 2979>:

```
g988.seq
    1  ATGAATAAAA ATATTAAATC TTTAAATTTA CGGGAAAAAG ACCCGTTTTT

51  AAGTCGTGAA AAACAGCGTT ATGAACATCC TTTGCCCAGT CGGgaATGGA

101  TAATCGAATT GTTGGAGCGC AAAGGTGTGC CTTCAAAAAT CGAATCGCTT

151  GCACGCGAGC TGTCGATTAC GGAAGacgag tATGTCTTTT TTGAACGCCG

201  TCTGAaggCG atgGCGCGGG AcggtCAGGT TTTAATCAAC CGCCgaggcg

251  CagtTTGCGc gGCggacaag ctgGATTTGG TCAAATGccg Cgtcgaggcg 301  catAAgGAcg gtttcggctt cgcCGTGCCG CTCATGCCGA TGGACGAAGG 351  GGATTTCGTT TTATACGAAC GCCAgatgcg tggTGtcatG CAcggcgaca 401  ccgttACCGT CCGTCCTGCg ggtatggaCC GCAGGGGccg ccgcGAAggg 451  acgtttctGG ATATTGTCGA ACGCGCGCAA AGCAAAGTTG TCGGCCGTTT

501  CTATATGGAT AGGGGCGTGG CGATTTTGGA GCCGGAAGAC AAGCGTCTGA

551  ACCAAAGCAT CGTGTTGGAA CCGGACGGCG TGGCGCGTTT CAAACCCGAA

601  TCCGGTCAGG TTATCGTCGG CAAAATTGAG GTTTATCCCG AGCAAAACCG

651  GCCTGCAGTG GCAAAAATCA TTGAAGTTTT GGGCGATTAT GCCGACAGCG

701  GGATGGAAAt cgAAATTGCC GTGCGCAAGC ATCATTTGCC GCAccgaTTC

751  AGTGAagcgt gtGcCAAATC CGcgaaAAAA ATtcccgacc ATGTACGCAA

801  AAGCGATTTG AAAGGCCGCG TCGATTTGTG CGACCTTCCT TTGGTAACGA

851  TAGACGGCGA AACGGCGCGC GATTTCGACG ACGCGGTGTT TGCCGAAAAA

901  GTCGGACGCA ATTACCGCCT GGTCGTGGCG ATTGCGGATG TCAGCCATTA

951  TGTCCGCCCT GACGATGCGA TTGATGCAGA TGCTCAAGAA CGCAGTACCA

1001  GCGTGTATTT CCCGCGCCGT ATGATTCCGA TGCTGCCGGA AAACCTGTCC

1051  AACGGCATCT GCTCGCTCAA TCCCGATGTC GAGCGTTTGT GTATGGTGTG

1101  CGATATGGTC GTTACCTATG CGGGCAATAT CAAAGAATAC CGCTTCTATC

1151  CCGCCGTGAT GCGCTCTCAT GCCCGCCTGA CCTACAACCA AGTTTGGAAA

1201  TGGCTTTCAG ACGGCATCGG GAATCCGCAC AAAGCCCAAA TCGACACGCT

1251  TTACAAGCTG TTTAAAATTT TGCAGAAAAA ACGTCTGGCG CGCGGGGCGG

1301  TGGAGTTTGA AAGCGTCGAA ACCCAGATGA TTTTCGACGA CAACGGCAAA

1351  ATCGAAAAAA TTGTCCCCGT CGTCCGCAAC gatGCCCACA AGCTGATTGA

1401  AGAATGTATG CTGGCGGCGA ATGTTTGCGC GGCGGATTTT CTGTTGAAAA

1451  ACAAACATAC GGCTTTGTTC CGCAACCATT TGGGCCCCAC GCCCGAAAAA

1501  CTCGCCACCC TGCGCGAGCA GCTCGGTCTG TTGGGGCTTC AACTTGGCGG

1551  CGGCGACAAC CCGTCGCCGA AAGACTATGC CGCGCTTGCC GAACAATTCA

1601  AAGGCAGGCC GGATGCCGAA TTGCTGCAAG TCATGATGTT GCGCTCCATG

1651  CAGCAGGCGG TTTACGAACC GCATTGCGAA GGGCATTTCG GTTTGGCTTA

1701  TGAAGCATAC GCCCACTTTA CCTCGCCCAT CCGCCGCTAT CCCGACCTGA

1751  CCGTCCACCG TGCCATCAAA GCCGTATTGA ACCGGAAAAC CTACACGCCA

1801  AACAAAAGCT GGCAGGCTTT GGGCGTGCAT ACTTCGTTTT GCGAACGCCG

1851  TGCCGACGAT GCTGGCCGCG ATGTGGAAAA CTGGCTGAAA ACTTATTATA

1901  TGCGCGATAA GGTCGGTGAA ATATTTGAAG GcaaaatCtc ccggggtgtg
```

-continued

```
1951   gcaaaTtttg gaATATTTGT CACTTTGGAC GATATccata tcgacggtct 2001   ggtacaTATC AGCGatttgg gcgaAGATTA TTTCaacttc cgccccgAAA

2051   TCATGGCAAT CGAAGGCGAA CGCAGCGGCA TCCGTTTCAA TATGGGGGAC

2101   AGGGTTGCCG TCCGGGTCGC GCGTGCCGAT TTGGATGATG GAAAAATCGA

2151   CTTTGTCCTA ATTGCCGGAG AAAGCGGCAG GCGGCGGAAG GTCAAATTAT

2201   CCGCATCTGC CAAACCGGCA GGGGCGGCGG GGAAAGGGAA ATCGAAAACC

2251   ACCGCCGAGA AAAAAACAGC CCGATGCGGC AAAGTAAGGG GAAGGGGCGT

2301   GCCTGCCGTT GCCGAATCGG GGAAAAAGGC AAAGAAACCG GTTCCGATTA

2351   AGGTCAAAAA ACGGAAAGGC AAATCATAA
```

This corresponds to the amino acid sequence <SEQ ID 2980; ORF 988.ng>:

```
g988.pep
     1   MNKNIKSLNL REKDPFLSRE KQRYEHPLPS REWIIELLER KGVPSKIESL

51   ARELSITEDE YVFFERRLKA MARDGQVLIN RRGAVCAADK LDLVKCRVEA

101   HKDGFGFAVP LMPMDEGDFV LYERQMRGVM HGDTVTVRPA GMDRRGRREG

151   TFLDIVERAQ SKVVGRFYMD RGVAILEPED KRLNQSIVLE PDGVARFKPE

201   SGQVIVGKIE VYPEQNRPAV AKIIEVLGDY ADSGMEIEIA VRKHHLPHRF

251   SEACAKSAKK IPDHVRKSDL KGRVDLCDLP LVTIDGETAR DFDDAVFAEK

301   VGRNYRLVVA IADVSHYVRP DDAIDADAQE RSTSVYFPRR MIPMLPENLS

351   NGICSLNPDV ERLCMVCDMV VTYAGNIKEY RFYPAVMRSH ARLTYNQVWK

401   WLSDGIGNPH KAQIDTLYKL FKILQKKRLA RGAVEFESVE TQMIFDDNGK

451   IEKIVPVVRN DAHKLIEECM LAANVCAADF LLKNKHTALF RNHLGPTPEK

501   LATLREQLGL LGLQLGGGDN PSPKDYAALA EQFKGRPDAE LLQVMMLRSM

551   QQAVYEPHCE GHFGLAYEAY AHFTSPIRRY PDLTVHRAIK AVLNRKTYTP

601   NKSWQALGVH TSFCERRADD AGRDVENWLK TYYMRDKVGE IFEGKISRGV

651   ANFGIFVTLD DIHIDGLVHI SDLGEDYFNF RPEIMAIEGE RSGIRFNMGD

701   RVAVRVARAD LDDGKIDFVL IAGESGRRRK VKLSASAKPA GAAGKGKSKT

751   TAEKKTARCG KVRGRGVPAV AESGKKAKKP VPIKVKKRKG KS*
```

The following partial DNA sequence was identified in *N. meningitidis* <SEQ ID 2981>:

```
m988.seq (partial)
     1   ..ACAGTTCTGG ATATTGTCGA ACGCGCGCAA AGCAAAGTGG TCGGCCGTTT

51     CTATATGGAT AGGGGCGTGG CGATTTTGGA GCCGGAAGAC AAGCGTCTGA

101     ACCAAAGCAT CGTATTGGAA CCGGACGGCG TGGCGCGTTT CAAACCTGAA

151     TCCGGTCAGG TCATCGTCGG CGAAATTGAG GTTTATCCTG AGCAAAACCG

201     GCCGGCAGTG GCAAAAATCA TCGAAGTTTT GGGCGATTAT GCCGACAGCG

251     GCATGGAGAT TGAAATTGCC GTGCGCAAGC ATCATTTGCC GCACCAATTC

301     AGTGAAGCGT GTGCCAAAGC TGCGAAAAAA ATTCCCGTCC ATGTACGCAA

351     AAGCGATTTG AAAGGCCGCG TCGATTTGCG CGACCTGCCT TTGGTAACGA

401     TAGACGGCGA AACGGCGCGC GATTTCGACG ACGCGGTGTT TGCCGAAAAA
```

-continued

```
 451    GTCGGACGCA ATTACCGTCT GGTCGTGGCG ATTGCGGATG TCAGCCATTA
 501    TGTCCGCCCT GACGATGTGA TTGATGCAGA TGCTCAAGAA CGCAGTACCA
 551    GCGTATATTT CCCGCGCCGT GTGATTCCGA TGCTGCCGGA AAACCTGTCT
 601    AACGGCATTT GCTCGCTCAA TCCCGATGTC GAGCGTTTGT GTATGGTGTG
 651    CGATATGGTC GTTACCTATG CGGGCAATAT CAAAGAATAC CGCTTCTACC
 701    CCGCCGTAAT GCGCTCTCAT GCCCGCCTGA CCTACAACCA AGTTTGGAAA
 751    TGGATTTCAG ACGGCATCGA CCATCCGTAC AAAGCCCAAA TCGACACCCT
 801    TTACAAACTC TTCAAAATCC TTCAGAAAAA GCGTTTCGAA CGCGGCGCGG
 851    TGGAGTTTGA AAGCGTCGAA ACCCAGATGA TTTTCGATGA CAACGGCAAA
 901    ATCGAAAAAA TCGTCCCCGT TGTCCGCAAC GATGCCCACA AGCTGATTGA
 951    AGAATGTATG CTGGCGGCGA ATGTTTGCGC AGCGGATTTC CTGTTGAAAA
1001    ACAAGCATAC GGCTTTGTTC CGCAACCATT TGGGCCCCAC GCCCGAAAAA
1051    CTCGCCACCC TGCGCGAGCA GCTCGGTCTG TTGGGGCTTC AACTTGGCGG
1101    CGGCGACAAC CCGTCGCCGA AGACTATGC GCGCTTGTC GAACAATTCA
1151    AAGGCAGACC TGATGCCGAA TTGCTGCAAG TCATGATGTT GCGCTCCATG
1201    CAGCAGGCGG TTTACGAACC GCATTGCGAC GGACACTTTG GTCTTGCCTA
1251    CGAAGCATAC GCCCACTTCA CCTCGCCCAT CCGCCGCTAT CCCGACCTGA
1301    CCGTACACCG CGCCATCAAA GCCGTGTTGA ATCAGCAAAC CTACACGCCA
1351    AAAAAAAGCT GGCAGGCTTT GGGCGTGCAT ACCTCGTTCT GTGAGCGCCG
1401    TGCCGACGAC GCCAGCCGCG ACGTGGAAAA CTGGCTGAAA ACCTATTATA
1451    TGCGCGATAA GGTCGGCGAA GTATTCGAAG GTAAAATCTC CGGCATGACC
1501    AGTTTTGGTA TCTTTGTAAC ACTGGACGGC ATCCACATTG ACGGCTTGGT
1551    GCATATCAGC GATTTGGGCG AAGACTATTT CAACTTCCGC CCCGAAATCA
1601    TGGCAATCGA AGGCGAACGC AGCGGCATCC GTTTCAACAT GGGGGACAGG
1651    GTTGCCGTCC GGGTCGCCCG TGCCGATTTG GATGACGGAA AAATCGATTT
1701    TGTCCTGATT GCCGGGGGGA GCGGCAGGGG GCGGAAAGTT AAATCATCCG
1751    CGTCTGCCAA ACCGGCAGGG ACGGCGGGGA AAGGGAAGCC GAAAACCGCC
1801    GCCGAGAAAA AAACAGCCCG AGGCGGCAAA GTAAGGGGAA GGGGCGCGTC
1851    TGCCGCCGCA GAATCGAGGA AAAAGGCAAA GAAACCGGTT CCGATTAAGG
1901    TAAAAAAACG GAAAGGCAAA TCATAA
```

This corresponds to the amino acid sequence <SEQ ID 2982; ORF 988>:

```
m988.pep (partial)
   1    ..TVLDIVERAQ SKVVGRFYMD RGVAILEPED KRLNQSIVLE PDGVARFKPE
  51    SGQVIVGEIE VYPEQNRPAV AKIIEVLGDY ADSGMEIEIA VRKHHLPHQF
 101    SEACAKAAKK IPVHVRKSDL KGRVDLRDLP LVTIDGETAR DFDDAVFAEK
 151    VGRNYRLVVA IADVSHYVRP DDVIDADAQE RSTSVYFPRR VIPMLPENLS
 201    NGICSLNPDV ERLCMVCDMV VTYAGNIKEY RFYPAVMRSH ARLTYNQVWK
 251    WISDGIDHPY KAQIDTLYKL FKILQKKRFE RGAVEFESVE TQMIFDDNGK
 301    IEKIVPVVRN DAHKLIEECM LAANVCAADF LLKNKHTALF RNHLGPTPEK
```

-continued

```
351    LATLREQLGL LGLQLGGGDN PSPKDYAALV EQFKGRPDAE LLQVMMLRSM

401    QQAVYEPHCD GHFGLAYEAY AHFTSPIRRY PDLTVHRAIK AVLNQQTYTP

451    KKSWQALGVH TSFCERRADD ASRDVENWLK TYYMRDKVGE VFEGKISGMT

501    SFGIFVTLDG IHIDGLVHIS DLGEDYFNFR PEIMAIEGER SGIRFNMGDR

551    VAVRVARADL DDGKIDFVLI AGGSGRGRKV KSSASAKPAG TAGKGKPKTA

601    AEKKTARGGK VRGRGASAAA ESRKKAKKPV PIKVKKRKGK S*
```

Computer analysis of this amino acid sequence gave the following results:
Homology with a Predicted ORF from *N. gonorrhoeae* 15
m988/g988 94.2% identity in 642 aa overlap

```
                              10         20         30
m988.pep                      TVLDIVERAQSKVVGRFYMDRGVAILEPED
                              ||||||||||||||||||||||||||||||
g988     LYERQMRGVMHGDTVTVRPAGMDRRGRREGTFLDIVERAQSKVVGRFYMDRGVAILEPED
             130        140        150        160        170        180

40         50         60         70         80         90
m988.pep  KRLNQSIVLEPDGVARFKPESGQVIVGEIEVYPEQNRPAVAKIIEVLGDYADSGMEIEIA
          ||||||||||||||||||||||||||||||:|||||||||||||||||||||||||||||
g988      KRLNQSIVLEPDGVARFKPESGQVIVGKIEVYPEQNRPAVAKIIEVLGDYADSGMEIEIA
             190        200        210        220        230        240

100        110        120        130        140        150
m988.pep  VRKHHLPHQFSEACAKAAKKIPVHVRKSDLKGRVDLRDLPLVTIDGETARDFDDAVFAEK
          ||||||||:|||||||:||||||:||||||||||||:|||||||||||||||||||||||
g988      VRKHHLPHRFSEACAKSAKKIPDHVRKSDLKGRVDLCDLPLVTIDGETARDFDDAVFAEK
             250        260        270        280        290        300

160        170        180        190        200        210
m988.pep  VGRNYRLVVAIADVSHYVRPDDVIDADAQERSTSVYFPRRVIPMLPENLSNGICSLNPDV
          |||||||||||||||||||||||:||||||||||||||||||:|||||||||||||||||
g988      VGRNYRLVVAIADVSHYVRPDDAIDADAQERSTSVYFPRRMIPMLPENLSNGICSLNPDV
             310        320        330        340        350        360

220        230        240        250        260        270
m988.pep  ERLCMVCDMVVTYAGNIKEYRFYPAVMRSHARLTYNQVWKWISDGIDHPYKAQIDTLYKL
          |||||||||||||||||||||||||||||||||||||||||||:||||  :|:|||||||
g988      ERLCMVCDMVVTYAGNIKEYRFYPAVMRSHARLTYNQVWKWLSDGIGNPHKAQIDTLYKL
             370        380        390        400        410        420

280        290        300        310        320        330
m988.pep  FKILQKKRFERGAVEFESVETQMIFDDNGKIEKIVPVVRNDAHKLIEECMLAANVCAADF
          ||||||||:|||||||||||||||||||||||||||||||||||||||||||||||||||
g988      FKILQKKRLARGAVEFESVETQMIFDDNGKIEKIVPVVRNDAHKLIEECMLAANVCAADF
             430        440        450        460        470        480

340        350        360        370        380        390
m988.pep  LLKNKHTALFRNHLGPTPEKLATLREQLGLLGLQLGGGDNPSPKDYAALVEQFKGRPDAE
          |||||||||||||||||||||||||||||||||||||||||||||||||:||||||||||
g988      LLKNKHTALFRNHLGPTPEKLATLREQLGLLGLQLGGGDNPSPKDYAALAEQFKGRPDAE
             490        500        510        520        530        540

400        410        420        430        440        450
m988.pep  LLQVMMLRSMQQAVYEPHCDGHFGLAYEAYAHFTSPIRRYPDLTVHRAIKAVLNQQTYTP
          ||||||||||||||||||||:|||||||||||||||||||||||||||||||||::|||
g988      LLQVMMLRSMQQAVYEPHCEGHFGLAYEAYAHFTSPIRRYPDLTVHRAIKAVLNRKTYTP
             550        560        570        580        590        600

460        470        480        490        500        509
m988.pep  KKSWQALGVHTSFCERRADDASRDVENWLKTYYMRDKVGEVFEGKIS-GMTSFGIFVTLD
          :|||||||||||||||||||:|||||||||||||||||||:|||||| |::::|||||||
g988      NKSWQALGVHTSFCERRADDAGRDVENWLKTYYMRDKVGEIFEGKISRGVANFGIFVTLD
             610        620        630        640        650        660

510        520        530        540        550        560   569
m988.pep  GIHIDGLVHISDLGEDYFNFRPEIMAIEGERSGIRFNMGDRVAVRVARADLDDGKIDFVL
           ||||||||||||||||||||||||||||||||||||||||||||||||||||||||||
g988      DIHIDGLVHISDLGEDYFNFRPEIMAIEGERSGIRFNMGDRVAVRVARADLDDGKIDFVL
             670        680        690        700        710        720

570        580        590        600        610        620   629
m988.pep  IAGGSGRGRKVKSSASAKPAGTAGKGKPKTAAEKKTARGGKVRGRGASAAAESRKKAKKP
          ||| ||| ||||| |||||||||:||||| ||:|||||| ||:||||:|:|||||||||
g988      IAGESGRRRKVKLSASAKPAGAAGKGKSTTAEKKTARCGKVRGRGVPAVAESGKKAKKP
             730        740        750        760        770        780
```

```
                630       640
m988.pep  VPIKVKKRKGKSX
          ||||||||||||
    g988  VPIKVKKRKGKSX
                790
```

The following partial DNA sequence was identified in *N. meningitidis* <SEQ ID 2983>:

```
a988.seq
   1  ATGAATAAAA ATATTAAATC TTTAAATTTA CGGGAAAAAG ACCCGTTTTT
  51  AAGTCGTGAA AAACAGCGTT ATGAACATCC TTTGCCCAGT CGGGAATGGA
 101  TAATCGAGCT GCTTGAACGT AAAGGCGTAC CATCCAAGAT TGAAGCTTTG
 151  GTACGCGAAT TGTCGATTAA GGAAGAAGAG TACGAATTTT TCGAACGTCG
 201  TCTGAAGGCG ATGGCGCGGG ACGGTCAGGT TTTAATCAAC CGTCGGGGCG
 251  CGGTTTGCGC GGCGGACAAA TTGGATTTGG TCAAATGCCG TGTCAAGGCG
 301  CACAAAGACC GCTTCGGTTT CGCCGTGCCG CTCACGCCCG CCAAAGACGG
 351  TGATTTTGTC TTGTACGAAC GCCAGATGCG CGGCATTATG CACGGCGATA
 401  TTGTCACTGT TCGTCCTGCC GGCATGGACG GTAGGGGCCG CCGCGAAGGG
 451  ACGGTTCTGG ATATTGTCGA ACGCGCGCAA AGCAAAGTGG TCGGCCGTTT
 501  CTANATGGAT AGGGGCGTGG CGATTTTGGA GCCGGAAGAC AAGCGTCTGA
 551  ACCAAAGCAT CGTATTGGAA CCGGACGGCG TGGCGCGTTT CAAACCTGAA
 601  TCCGGTCAGG TCATCGTCGG CGAAATTGAG GTTTATCCTG AGCAAAACCG
 651  GCCGGCAGTG GCAAAAATCA TCGAAGTTTT GGGCGATTAT GCCGACAGCG
 701  GCATGGAGAT TGAAATTGCC GTGCGCAAGC ATCATTTGCC GCACCAATTC
 751  AGTGAAGCGT GTGCCAAAGC CGCGAAAAAA ATTCCCGACC ATGTACGCAA
 801  AAGCGATTTG AAAGGCCGCG TCGATTTGCG CGACCTGCCT TTGGTAACGA
 851  TAGACGGCGA AACGGCTCGA GATTTTGACG ATGCGGTGTT TGCCGAGAAA
 901  ATCGGACGCA ATTACCGTCT GGTCGTGGCG ATTGCCGATG TCAGCCATTA
 951  TGTCCGCCCC GATGACGCTA TCGACACGGA CGCTCAGGAA CGCAGCACCA
1001  GTGTTTACTT CCCGCGCCGC GTGATTCCCA TGTTGCCGGA AAACCTGTCC
1051  AACGGCATCT GCTCGCTCAA TCCTCATGTC GAGCGTTTGT GTGTGGTGTG
1101  CGATATGGTT ATCACTTACG CGGGCAATAT CAAAGAATAC CGCTTCTACC
1151  CCGCCGTGAT GCGCTCTCAT GCCCGCCTGA CCTACAACCA AGTTTGGAAA
1201  TGGCTTTCAG GCGGCATCGA GCATCCGTTC AAAACCCAAA TCGACACGCT
1251  TTACAAACTC TTCAAAATCC TTCAGAAAAA GCGTTTCGAA CGCGGGGCGG
1301  TGGAGTTTGA CAGCATCGAA ACCCAAATGC TTTTCGACGA CAACGGTAAA
1351  ATTGAAAAAA TCGTCCCCGT TGTCCGCAAC GATGCCCACA AGCTGATTGA
1401  AGAATGTATG TTGGCGGCAA ACGTTTGCGC AGCGGATTTT CTGTTGAAAA
1451  ACAAGCATAC CGCATTGTTC CGCAACCATT TGGGGCCCAC GCCCGAAAAA
1501  CTCGCCGCCT TGCGCGAGCA GCTCGGTCTG TTGGGGCTTC AACTTGGCGG
1551  CGGCGACAAC CCGTCGCCGA AGACTATGC CGCGCTTGCC GGACAGTTCA
1601  AAGGCAGGCC GGATGCCGAA TTGCTGCAAG TCATGATGTT GCGCTCCATG
1651  CAACAGGCGG TTTACGAACC GCATTGCGAC GGACACTTTG GTCTTGCCTA
```

```
1701 CGAAGCATAC GCCCACTTCA CCTCGCCCAT CCGCCGCTAT CCCGACCTGA

1751 CCGTACACCG CGCCATCAAA GCCGTGTTGA ATCAGCAAAC CTACACGCCA

1801 AAAAAAAGCT GGCAGGCTTT GGGCGTGCAT ACCTCGTTCT GTGAGCGCCG

1851 TGCCGACGAC GCCAGCCGCG ACGTGGAAAA CTGGCTGAAA ACCTATTATA

1901 TGCGCGATAA GGTCGGCGAA GTATTCGAAG GTAAAATCTC CGGCATGACC

1951 AGTTTTGGTA TCTTTGTAAC ACTGGACGGC ATCCACATTG ACGGCTTGGT

2001 GCATATCAGC GATTTGGGCG AAGACTATTT CAACTTCCGC CCCGAAATCA

2051 TGGCAATCGA AGGCGAACGC AGCGGCATCC GTTTCAACAT GGGGGACAGG

2101 GTTGCCGTCC GGGTCGCCCG TGCCGATTTG GATGACGGAA AAATCGATTT

2151 TGTCCTGATT GCCGGGGGGA GCGGCAGGGG GCGGAAAGTT AAATCATCCG

2201 CGTCTGCCAA ACCGGCAGGG ACGGCGGGGA AAGGGAAGCC GAAAACCGCC

2251 GCCGAGAAAA AAACAGCCCG AGGCGGCAAA GTAAGGGGAA GGGGCGCGTC

2301 TGCCGCCGCA GAATCGAGGA AAAAGGCAAA GAAACCGGTT CCGATTAAGG

2351 TAAAAAAACG GAAAGGCAAA TCATAA
```

This corresponds to the amino acid sequence <SEQ ID 2984; ORF 988.a>:

```
a988.pep
  1 MNKNIKSLNL REKDPFLSRE KQRYEHPLPS REWIIELLER KGVPSKIEAL

51 VRELSIKEEE YEFFERRLKA MARDGQVLIN RRGAVCAADK LDLVKCRVKA

101 HKDRFGFAVP LTPAKDGDFV LYERQMRGIM HGDIVTVRPA GMDGRGRREG

151 TVLDIVERAQ SKVVGRFXMD RGVAILEPED KRLNQSIVLE PDGVARFKPE

201 SGQVIVGEIE VYPEQNRPAV AKIIEVLGDY ADSGMEIEIA VRKHHLPHQF

251 SEACAKAAKK IPDHVRKSDL KGRVDLRDLP LVTIDGETAR DFDDAVFAEK

301 IGRNYRLVVA IADVSHYVRP DDAIDTDAQE RSTSVYFPRR VIPMLPENLS

351 NGICSLNPHV ERLCVVCDMV ITYAGNIKEY RFYPAVMRSH ARLTYNQVWK

401 WLSGGIEHPF KTQIDTLYKL FKILQKKRFE RGAVEFDSIE TQMLFDDNGK

451 IEKIVPVVRN DAHKLIEECM LAANVCAADF LLKNKHTALF RNHLGPTPEK

501 LAALREQLGL LGLQLGGGDN PSPKDYAALA GQFKGRPDAE LLQVMMLRSM

551 QQAVYEPHCD GHFGLAYEAY AHFTSPIRRY PDLTVHRAIK AVLNQQTYTP

601 KKSWQALGVH TSFCERRADD ASRDVENWLK TYYMRDKVGE VFEGKISGMT

651 SFGIFVTLDG IHIDGLVHIS DLGEDYFNFR PEIMAIEGER SGIRFNMGDR

701 VAVRVARADL DDGKIDFVLI AGGSGRGRKV KSSASAKPAG TAGKGKPKTA

751 AEKKTARGGK VRGRGASAAA ESRKKAKKPV PIKVKKRKGK S*
``` m988/a988 97.0% identity in 641 aa overlap

```
                             10        20        30
   m988.pep                  TVLDIVERAQSKVVGRFYMDRGVAILEPED
                             |||||||||||||||||| ||||||||||
       a988   LYERQMRGIMHGDIVTVRPAGMDGRGRREGTVLDIVERAQSKVVGRFXMDRGVAILEPED
                    130       140       150       160       170       180
```

```
              40         50         60         70         80         90
m988.pep  KRLNQSIVLEPDGVARFKPESGQVIVGEIEVYPEQNRPAVAKIIEVLGDYADSGMEIEIA
          ||||||||||||||||||||||||||||||||||||||||||||||||||||||||||||
a988      KRLNQSIVLEPDGVARFKPESGQVIVGEIEVYPEQNRPAVAKIIEVLGDYADSGMEIEIA
              190        200        210        220        230        240

100        110        120        130        140        150
m988.pep  VRKHHLPHQFSEACAKAAKKIPVHVRKSDLKGRVDLRDLPLVTIDGETARDFDDAVFAEK
          ||||||||||||||||||||||| |||||||||||||||||||||||||||||||||||
a988      VRKHHLPHQFSEACAKAAKKIPDHVRKSDLKGRVDLRDLPLVTIDGETARDFDDAVFAEK
              250        260        270        280        290        300

160        170        180        190        200        210
m988.pep  VGRNYRLVVAIADVSHYVRPDDVIDADAQERSTSVYFPRRVIPMLPENLSNGICSLNPDV
          :||||||||||||||||||||||:||:|||||||||||||||||||||||||||||||:|
a988      IGRNYRLVVAIADVSHYVRPDDAIDTDAQERSTSVYFPRRVIPMLPENLSNGICSLNPHV
              310        320        330        340        350        360

220        230        240        250        260        270
m988.pep  ERLCMVCDMVVTYAGNIKEYRFYPAVMRSHARLTYNQVWKISDGIDHPYKAQIDTLYKL
          ||||:|||||:||||||||||||||||||||||||||||||:| ||:||:|:|||||||
a988      ERLCVVCDMVITYAGNIKEYRFYPAVMRSHARLTYNQVWKWLSGGIEHPFKTQIDTLYKL
              370        380        390        400        410        420

280        290        300        310        320        330
m988.pep  FKILQKKRFERGAVEFESVETQMIFDDNGKIEKIVPVVRNDAHKLIEECMLAANVCAADF
          ||||||||||||||||:|:||||:|||||||||||||||||||||||||||||||||||
a988      FKILQKKRFERGAVEFDSIETQMLFDDNGKIEKIVPVVRNDAHKLIEECMLAANVCAADF
              430        440        450        460        470        480

340        350        360        370        380        390
m988.pep  LLKNKHTALFRNHLGPTPEKLATLREQLGLLGLQLGGGDNPSPKDYAALVEQFKGRPDAE
          ||||||||||||||||||||||:|||||||||||||||||||||||||| ||||||||
a988      LLKNKHTALFRNHLGPTPEKLAALREQLGLLGLQLGGGDNPSPKDYAALAGQFKGRPDAE
              490        500        510        520        530        540

400        410        420        430        440        450
m988.pep  LLQVMMLRSMQQAVYEPHCDGHFGLAYEAYAHFTSPIRRYPDLTVHRAIKAVLNQQTYTP
          ||||||||||||||||||||||||||||||||||||||||||||||||||||||||||
a988      LLQVMMLRSMQQAVYEPHCDGHFGLAYEAYAHFTSPIRRYPDLTVHRAIKAVLNQQTYTP
              550        560        570        580        590        600

460        470        480        490        500        510
m988.pep  KKSWQALGVHTSFCERRADDASRDVENWLKTYYMRDKVGEVFEGKISGMTSFGIFVTLDG
          ||||||||||||||||||||||||||||||||||||||||||||||||||||||||||
a988      KKSWQALGVHTSFCERRADDASRDVENWLKTYYMRDKVGEVFEGKISGMTSFGIFVTLDG
              610        620        630        640        650        660

520        530        540        550        560        570
m988.pep  IHIDGLVHISDLGEDYFNFRPEIMAIEGERSGIRFNMGDRVAVRVARADLDDGKIDFVLI
          ||||||||||||||||||||||||||||||||||||||||||||||||||||||||||
a988      IHIDGLVHISDLGEDYFNFRPEIMAIEGERSGIRFNMGDRVAVRVARADLDDGKIDFVLI
              670        680        690        700        710        720

580        590        600        610        620        630
m988.pep  AGGSGRGRKVKSSASAKPAGTAGKGKPKTAAEKKTARGGKVRGRGASAAAESRKKAKKPV
          |||:||||||||:||||||||| ||||:|||||||||:|||||||  ||||||||||||
a988      AGESGRRRKVKLSASAKPAGAAGKGKSKTTAEKKTARCGKVRGRGVPAVAEGRKKAKKPV
              730        740        750        760        770        780

640
m988.pep  PIKVKKRKGKSX
          ||||||||||||
a988      PIKVKKRKGKSX
              790
```

The following partial DNA sequence was identified in *N. gonorrhoeae* <SEQ ID 2985>:

```
g989.seq
    1   ATGACCCCTT TCACACTGAA AAAAACCGTC CTGCTGCTCG GCACTGCCTT

51   TGCCGCCGCA TCTGTCCACG CATCCGGCTA CCACTTCGGC ACACAGTCGG

101   TCAACGCGCA AAGCACGGCA AATGCCGCCG ACGCGTCGAC CATCTTCTAC

151   AATCCCGCCG GCCTGACCAA ACTCGACAGC AGCCAGATTT CCGTCAACGC

201   CAACATCGTG CTGCCCAGCA TTCATTATGA AGCAGATTCC GCCACCGACT

251   TTACCGGGCT TCCCGTCCAA GGTTCTAAAA ACGGCAAAAT CACCAAAACC

301   ACGGTCGCAC CCACATTTA CGGCGCATAC AAAGTCAACG ACAATCTGAC

351   CGTGGGCTTG GCGTGTACG TCCCCTTCGG CTCTGCCACC GAATACGAAA
```

-continued

```
 401   AAGATTCCGT GTTGCGCCAC AACATCAACA AACTCGGTCT GACCAGCATC

451   GCCGTCGAAC CTGTCGCCGC GTGGAAACTC AACGAACGCC ATTCCTTCGG

501   CGCAGGCATC ATCGCCCAAC ATAATTCCGC CGAACTGCGC AAATATGCCG

551   ACTGAGGAAT CCCAAAAAAA GCGCAAATGC TGCAAGCAAC ACCTTCTAAT

601   CCTACTGCCG CTGCTCAAAT CAAGGCCGAC GGACACGCCG ATGTCAAAGG

651   CAGCGATTGG GGCGTCGGCT ACCAACTGGC GTGGATGTGG GACATCAACG

701   ACCGCGCGCG CGTGGGCGTG AACTACCGTT CCAAAGTTTC ACACACGCTC

751   AAAGGCGATG CCGAATGGGC GGCAGACGGC GCGGCGGCGA ACAACAGTG

801   GAATGACAAT ATGCTCACAC CGCTCGGTTA CACGGCGAAT GAAAAAGCCA

851   GTGTCAAAAT CGTAACGCCT GAGTCTTTGT CCGTACACGG CATGTACAAA

901   GTGTCCGACA AGCCGACCT GTTCGGCGAC GTAACTTGGA CGCGCCACAG

951   CCGCTTCAAT AAGGCGGAAC TGTTTTTTGA AAAGAAAAA AATATTGCTA

1001   ATGGCAAAAA ATCCGACCGC ACCACCATCA CCCCCAACTG GCGCAACACC

1051   TACAAAGTCG GCTTGGGCGG TTCTTATCAA ATCAGCGAAC CGCTGCAACT

1101   GCGCGTCGGC ATCGCTTTTG ACAAACCGCC TGTCCGCAAC GCCGACTacC

1151   GCATGAACAG CCTGCCCGAC GGCAACCGCA TCTGGTTCTC CGCCGGCATG

1201   AAATACCATA TCGGCAAAAA CCACGTCGTC GATGCCGCCT ACACCCACAT

1251   CCACATCAAC GACACCAGCT ACCGCACGGC GAAGGCAAGC GGCAACGATG

1301   TGGACAGCAA AGGTGCGTCT TGCGCACGTT TCAAAAACCA CGCCGACATC

1351   ATCGGCCTGC AATACACCTA CAAATTCAAA TAA
```

This corresponds to the amino acid sequence <SEQ ID 2986; ORF 989.ng>:

```
g989.pep
   1   MTPFTLKKTV LLLGTAFAAA SVHASGYHFG TQSVNAQSTA NAADASTIFY

51   NPAGLTKLDS SQISVNANIV LPSIHYEADS ATDFTGLPVQ GSKNGKITKT

101   TVAPHIYGAY KVNDNLTVGL GVYVPFGSAT EYEKDSVLRH NINKLGLTSI

151   AVEPVAAWKL NERHSFGAGI IAQHNSAELR KYAD*GIPKK AQMLQATPSN

201   PTAAAQIKAD GHADVKGSDW GVGYQLAWMW DINDRARVGV NYRSKVSHTL

251   KGDAEWAADG AAAKQQWNDN MLTPLGYTAN EKASVKIVTP ESLSVHGMYK

301   VSDKADLFGD VTWTRHSRFN KAELFFEKEK NIANGKKSDR TTITPNWRNT

351   YKVGLGGSYQ ISEPLQLRVG IAFDKPPVRN ADYRMNSLPD GNRIWFSAGM

401   KYHIGKNHVV DAAYTHIHIN DTSYRTAKAS GNDVDSKGAS CARFKNHADI

451   IGLQYTYKFK *
```

The following partial DNA sequence was identified in *N. meningitidis* <SEQ ID 2987>:

```
m989.seq
   1   ATGACCCCTT CCGCACTGAA AAAAACCGTC CTGCTGCTCG GCACTGCCTT

51   TGCCGCCGCA TCCGTCCACG CATCCGGCTA CCACTTCGGC ACACAGTCGG

101   TCAACGCGCA AAGCACGGCA AATGCCGCCG CCGCAGAAGC C

```
 201  GATTTCCGTC AACGCCAACA TCGTGCTGCC CAGCATTCAT TATGAGGCGG

251  ATTCCGCCAC CGACTTTACC GGGCTTCCCG TCCAAGGTTC GAAAAGCGGC

301  AAAATCACCA AAACCACGGT CGCGCCCCAC ATCTACGGCG CATACAAAGT

351  CAACGACAAT CTGACCGTGG GCTTGGGCGT GTACGTCCCC TTCGGCTCTG

401  CCACCGAATA CGAAAAAGAT TCCGTGTTGC GCCACAACAT CAACAAACTC

451  GGTCTGACCA GCATCGCCGT CGAACCTGTC GCCGCGTGGA AACTCAACGA

501  CCGCCATTCC TTCGGCGCAG GCATCATCGC CAACATACT TCCGCCGAAC

551  TGCGCAAATA TGCCGACTGG GGGATTAAGA GTAAAGCAGA GATATTGACG

601  GCAAAACCGC CCAAACCTAA CGGTGTAGCC GAAGCTGCAA AAATTCAGGC

651  CGACGGACAC GCCGATGTCA AAGGCAGCGA TTGGGGCTTC GGCTACCAAC

701  TGGCGTGGAT GTGGGACATC AACGACCGTG CGCGCGTGGG CGTGAACTAC

751  CGTTCCAAAG TCTCGCACAC GCTCAAAGGC GATGCCGAAT GGGCGGCAGA

801  CGGCGCGGCG GCGAAAGCAA TGTGGAGTAC GATGCTTGCA GCAAACGGCT

851  ACACGGCGAA TGAAAAAGCC CGCGTTAAAA TCGTTACGCC TGAGTCTTTG

901  TCCGTACACG GTATGTACAA AGTGTCCGAT AAAGCCGACC TGTTCGGCGA

951  CGTAACTTGG ACGCGCCACA GCCGCTTCGA TAAGGCGGAA CTGGTTTTTG

1001  AAAAGAAAA AACCGTCGTC AAAGGCAAAT CCGACCGCAC CACCATCACC

1051  CCCAACTGGC GCAACACCTA CAAAGTCGGC TTCGGCGGTT CTTATCAAAT

1101  CAGCGAACCG CTGCAACTGC GCGCCGGCAT CGCTTTTGAC AAATCGCCCG

1151  TCCGCAACGC CGACTACCGC ATGAACAGCC TACCCGACGG CAACCGCATC

1201  TGGTTCTCCG CCGGTATGAA ATACCATATC GGTAAAAACC ACGTCGTCGA

1251  TGCCGCCTAC ACCCACATCC ACATCAACGA CACCAGCTAC CGCACGGCGA

1301  AGGCAAGCGG CAACGATGTG GACAGCAAAG GCGCGTCTTC CGCACGTTTC

1351  AAAAACCACG CCGACATCAT CGGTCTGCAA TACACCTACA AATTCAAATA

1401  A
```

This corresponds to the amino acid sequence <SEQ ID 2988; ORF 989>:

```
m989.pep
   1  MTPSALKKTV LLLGTAFAAA SVHASGYHFG TQSVNAQSTA NAAAAEAADA

51  STIFYNPAGL TKLDSSQISV NANIVLPSIH YEADSATDFT GLPVQGSKSG

101  KITKTTVAPH IYGAYKVNDN LTVGLGVYVP FGSATEYEKD SVLRHNINKL

151  GLTSIAVEPV AAWKLNDRHS FGAGIIAQHT SAELRKYADW GIKSKAEILT

201  AKPPKPNGVA EAAKIQADGH ADVKGSDWGF GYQLAWMWDI NDRARVGVNY

251  RSKVSHTLKG DAEWAADGAA AKAMWSTMLA ANGYTANEKA RVKIVTPESL

301  SVHGMYKVSD KADLFGDVTW TRHSRFDKAE LVFEKEKTVV KGKSDRTTIT

351  PNWRNTYKVG FGGSYQISEP LQLRAGIAFD KSPVRNADYR MNSLPDGNRI

401  WFSAGMKYHI GKNHVVDAAY THIHINDTSY RTAKASGNDV DSKGASSARF

451  KNHADIIGLQ YTYKFK*
```

Computer analysis of this amino acid sequence gave the following results:
Homology with a Predicted ORF from *N. gonorrhoeae*
g989/m989 90.0% identity in 468 aa overlap

```
                  10        20        30        40        50
   g989.pep  MTPFTLKKTVLLLGTAFAAASVHASGYHFGTQSVNAQSTANAA-----DASTIFYNPAGL
             ||| :|||||||||||||||||||||||||||||||||||||     ||||||||||||
   m989      MTPSALKKTVLLLGTAFAAASVHASGYHFGTQSVNAQSTANAAAAEAADASTIFYNPAGL
                  10        20        30        40        50        60

60        70        80        90       100       110
   g989.pep  TKLDSSQISVNANIVLPSIHYEADSATDFTGLPVQGSKNGKITKTTVAPHIYGAYKVNDN
             |||||||||||||||||||||||||||||||||||||:||||||||||||||||||||
   m989      TKLDSSQISVNANIVLPSIHYEADSATDFTGLPVQGSKSGKITKTTVAPHIYGAYKVNDN
                  70        80        90       100       110       120

120       130       140       150       160       170
   g989.pep  LTVGLGVYVPFGSATEYEKDSVLRHNINKLGLTSIAVEPVAAWKLNERHSFGAGIIAQHN
             |||||||||||||||||||||||||||||||||||||||||||||:||||||||||||:
   m989      LTVGLGVYVPFGSATEYEKDSVLRHNINKLGLTSIAVEPVAAWKLNDRHSFGAGIIAQHT
                 130       140       150       160       170       180

180       190       200       210       220       230
   g989.pep  SAELRKYADXGIPKKAQMLQATPSNTPA---AAQIKADGHADVKGSDWGVGYQLAWMWDI
             ||||||||| ||  :|| : | |  : :     ||:|||||||||||| ||||||||||
   m989      SAELRKYADWGIKSKAEILTAKPPKTNGVAEAAKIQADGHADVKGSDWGFGYQLAWMWDI
                 190       200       210       220       230       240

240       250       260       270       280       290
   g989.pep  NDRARVGVNYRSKVSHTLKGDAEWAADGAAAKQQWNDNMLTPLGYTANEKASVKIVTPES
             ||||||||||||||||||||||||||||||||:|: :||: ||||||||||||:|||||
   m989      NDRARVGVNYRSKVSHTLKGDAEWAADGAAAKAMWS-TMLAANGYTANEKARVKIVTPES
                 250       260       270       280       290

300       310       320       330       340       350
   g989.pep  LSVHGMYKVSDKADLFGDVTWTRHSRFNKAELFFEKEKNIANGKKSDRTTITPNWRNTYK
             ||||||||||||||||||||||||||||:||||||||::::||  |||||||||||||
   m989      LSVHGMYKVSDKADLFGDVTWTRHSRFDKAELVFEKEKTVVKGK-SDRTTITPNWRNTYK
             300       310       320       330       340       350

360       370       380       390       400       410
   g989.pep  VGLGGSYQISEPLQLRVGIAFDKPPVRNADYRMNSLPDGNRIWFSAGMKYHIGKNHVVDA
             ||:|||||||||||||| |||||:|||||||||||||||||||||||||||||||||||
   m989      VGFGGSYQISEPLQLRAGIAFDKSPVRNADYRMNSLPDGNRIWFSAGMKYHIGKNHVVDA
             360       370       380       390       400       410

420       430       440       450       460
   g989.pep  AYTHIHINDTSYRTAKASGNDVDSKGASCARFKNHADIIGLQYTYKFKX
             ||||||||||||||||||||||||||||| ||||||||||||||||||
   m989      AYTHIHINDTSYRTAKASGNDVDSKGASSARFKNHADIIGLQYTYKFKX
             420       430       440       450       460
```

40

The following partial DNA sequence was identified in *N. meningitidis* <SEQ ID 2989>:

```
a989.seq
    1    ATGACCCCTT CCGCACTGAA AAAAACCGTC CTACTGCTCG GCACTGCCTT

51    TGCCGCCGCA TCCGCACAAG CCTCCGGCTA CCACTTCGGC ACACAGTCGG

101    TCAACGCGCA AAGCACGGCA AATGCCGCCG CCGCAGAAGC CGCCGACGCA

151    TCGACCATCT TCTACAACCC TGCCGGCCTG ACCAAACTCG ACAGCAGCCA

201    GATTTCCGTC AACGCCAACA TCGTGCTGCC CAGCATTCAT TATGAGGCGG

251    ATTCCGCCAC CGACTTTACC GGGCTTCCCG TCCAAGGTTC GAAAAGCGGC

301    AAAATCACCA AAACCACGGT CGCGCCCCAC ATCTACGGCG CATACAAAGT

351    CAACGACAAT CTGACCGTAG GCTTGGGCGT GTACGTCCCC TTCGGTTCTG

401    CCACCGAATA CGAAAAAGAT TCCGTGTTGC GCCACAACAT CAACAAACTC

451    GGTCTGACCA GCATCGCCGT CGAACCTGTC GCCGCGTGGA AACTCAACGA

501    ACGCCATTCC TTCGGCGCAG GCATCATCGC CCAACATACT TCCGCCGAGC

551    TGCGCAAATA TGCCGACTGG GGGATTATGG AAAAAGCGAA AGCACTAAAA

601    GAAACACCCC CCAATCCAAC TAAAGCCGCC CAAATCAAAG CCGACGGACA
```

```
 651 CGCCGATGTC AAAGGCAGCG ATTGGGCTT  CGGCTACCAA CTGGCGTGGA

701 TGTGGGACAT CAACGACCGT GCGCGCGTGG GCGTGAACTA CCGTTCCAAA

751 GTCTCACACA CGCTCAAAGG CGATGCCGAA TGGGCGGCAG ACGACGCAAT

801 GGCGAAACAG TTATGGGATG CAAACAAACT CGCACTGCTC GGCTACACGC

851 CAAGCGAAAA AGCCCGCGTT AAAATCGTTA CGCCCGAGTC TTTGTCCGTA

901 CACGGTATGT ACAAAGTGTC CGACAAAGCC GACCTGTTCG GCGACGTAAC

951 TTGGACGCGC CACAGCCGCT TCGATAAGGC GGAACTGGTT TTTGAAAAAG

1001 AAAAAACCAT CGTCAACGGC AAATCCGACC GCACCACCAT CACCCCCAAC

1051 TGGCGCAACA CCTACAAAGT CGGCTTCGGC GGTTCTTATC AAATCAGCGA

1101 ACCGCTGCAA CTGCGCGCCG GCATCGCTTT TGACAAATCG CCCGTCCGCA

1151 ACGCCGACTA CCGCATGAAC AGCCTGCCCG ACGGCAACCG CATCTGGTTC

1201 TCCGCCGGCA TGAAATACCA TATCGGCAAA AACCACGTCG TCGATGCCGC

1251 CTACACCCAC ATCCACATCA ACGACACCAG CTACCGCACG GCGAAGGCAA

1301 GCGGCAACGA TGTGGACAGC AAAGGCGCGT CTTCCGCACG TTTCAAAAAC

1351 CACGCCGACA TCATCGGCCT GCAATACACC TACAAATTCA AATAA
```

This corresponds to the amino acid sequence <SEQ ID 2990; ORF 989.a>:

```
a989.pep
   1 MTPSALKKTV LLLGTAFAAA SAQASGYHFG TQSVNAQSTA NAAAAEAADA

51 STIFYNPAGL TKLDSSQISV NANIVLPSIH YEADSATDFT GLPVQGSKSG

101 KITKTTVAPH IYGAYKVNDN LTVGLGVYVP FGSATEYEKD SVLRHNINKL

151 GLTSIAVEPV AAWKLNERHS FGAGIIAQHT SAELRKYADW GIMEKAKALK

201 ETPPNPTKAA QIKADGHADV KGSDWGFGYQ LAWMWDINDR ARVGVNYRSK

251 VSHTLKGDAE WAADDAMAKQ LWDANKLALL GYTPSEKARV KIVTPESLSV

301 HGMYKVSDKA DLFGDVTWTR HSRFDKAELV FEKEKTIVNG KSDRTTITPN

351 WRNTYKVGFG GSYQISEPLQ LRAGIAFDKS PVRNADYRMN SLPDGNRIWF

401 SAGMKYHIGK NHVVDAAYTH IHINDTSYRT AKASGNDVDS KGASSARFKN

451 HADIIGLQYT YKFK*
``` m989/a989 93.1% identity in 467 aa overlap

```
                  10         20         30         40         50         60
m989.pep  MTPFTLKKTVLLLGTAFAAASVHASGYHFGTQSVNAQSTANAAAAEAADASTIFYNPAGL
          ||||||||||||||||||||| ::|||||||||||||||||||||||||||||||||||
a989      MTPFTLKKTVLLLGTAFAAASAQASGYHFGTQSVNAQSTANAAAAEAADASTIFYNPAGL
                  10         20         30         40         50         60

70         80         90        100        110        120
m989.pep  TKLDSSQISVNANIVLPSIHYEADSATDFTGLPVQGSKSGKITKTTVAPHIYGAYKVNDN
          ||||||||||||||||||||||||||||||||||||||||||||||||||||||||||||
a989      TKLDSSQISVNANIVLPSIHYEADSATDFTGLPVQGSKSGKITKTTVAPHIYGAYKVNDN
                  70         80         90        100        110        120

130        140        150        160        170        180
m989.pep  LTVGLGVYVPFGSATEYEKDSVLRHNINKLGLTSIAVEPVAAWKLNDRHSFGAGIIAQHT
          |||||||||||||||||||||||||||||||||||||||||||||:|||||||||||||
a989      LTVGLGVYVPFGSATEYEKDSVLRHNINKLGLTSIAVEPVAAWKLNERHSFGAGIIAQHT
                 130        140        150        160        170        180

190        200        210        220        230        240
m989.pep  SAELRKYADWGIKSKAEILTAKPPKPNGVAEAAKIQADGHADVKGSDWGFGYQLAWMWDI
          ||||||||||||  ||: |   ||:|:    :||:|:|||||||||||||||||||||
a989      SAELRKYADWGIMEKAKALKETPPNPT---KAAQIKADGHADVKGSDWGFGYQLAWMWDI
                 190        200        210        220              230
```

-continued

```
                   250       260       270        280       290       299
m989.pep    NDRARVGVNYRSKVSHTLKGDAEWAADGAAAKAMW-STMLAANGYTANEKARVKIVTPES
            ||||||||||||||||||||||||||| | || :| :: ||  ||| :||||||||||||
a989        NDRARVGVNYRSKVSHTLKGDAEWAADDAMAKQLWDANKLALLGYTPSEKARVKIVTPES
            240       250       260       270       280       290

300       310       320       330       340       350       359
m989.pep    LSVHGMYKVSDKADLFGDVTWTRHSRFDKAELVFEKEKTVVKGKSDRTTITPNWRNTYKV
            |||||||||||||||||||||||||||||||||||||||:|:||||||||||||||||||
a989        LSVHGMYKVSDKADLFGDVTWTRHSRFDKAELVFEKEKTIVNGKSDRTTITPNWRNTYKV
            300       310       320       330       340       350

360       370       380       390       400       410       419
m989.pep    GFGGSYQISEPLQLRAGIAFDKSPVRNADYRMNSLPDGNRIWFSAGMKYHIGKNHVVDAA
            ||||||||||||||||||||||||||||||||||||||||||||||||||||||||||||
a989        GFGGSYQISEPLQLRAGIAFDKSPVRNADYRMNSLPDGNRIWFSAGMKYHIGKNHVVDAA
            360       370       380       390       400       410

420       430       440       450       460
m989.pep    YTHIHINDTSYRTAKASGNDVDSKGASSARFKNHADIIGLQYTYKFKX
            ||||||||||||||||||||||||||||||||||||||||||||||||
a989        YTHIHINDTSYRTAKASGNDVDSKGASSARFKNHADIIGLQYTYKFKX
            420       430       440       450       460
```

The following partial DNA sequence was identified in *N. meningitidis* <SEQ ID 2991>:

```
m990.seq
   1  ATGTTCAGAG CTCAGCTTGG TTCAAATACT CGTTCTACCA AAATCGGCGA

51  CGATGCCGAT TTTTCATTTT CAGACAAGCC GAAACCCGGC ACTTCCCATT

101  ATTTTTCCAG CGGTAAAACC GATCAAAATT CATCCGAATA TGGGTATGAC

151  GAAATCAATA TCCAAGGTAA AAATTACAAT AGCGGCATCC TCGCCGTCGA

201  TAATATGCCC GTTGTCAAAA AATATATTAC AGAGAAGTAT GGGGCTGATT

251  TAAAGCAGGC GGTTAAAAGT CAATTACAGG ATTTATACAA AACAAGACCG

301  GAAGCTTGGG CAGAAAATAA AAAACGGACT GAGGAGGCGT ATATAGCACA

351  GTTTGGAACA AAATTTAGTA CGCTCAAACA GACGATGCCC GATTTAATTA

401  ATAAATTGGT AGAAGATTCC GTACTCACTC CTCATAGTAA TACATCACAG

451  ACTAGTCTCA ACAACATCTT CAATAAAAAA TTACACGTCA AAATCGAAAA

501  CAAATCCCAC GTCGCCGGAC AGGTGTTGGA ACTGACCAAG ATGACGCTGA

551  AAGATTCCCT TTGGGAACCG CGCCGCCATT CCGACATCCA TACGCTGGAA

601  ACTTCCGATA ATGCCCGCAT CCGCCTGAAC ACGAAAGATG AAAAACTGAC

651  CGTCCATAAG GATTATGCGG GCGGCGCGGA TTTCCTGTTC GGCTACGACG

701  TGCGGGAGTC GGACGAACCC GCCCTGACCT TTGAAGACAA AGTCAGCGGA

751  CAATCCGGCG TGGTTTTGGA ACGCCGGCCG GAAAATCTGA AAACGCTCGA

801  CGGGCGCAAA CTGATTGCGG CAAAAACGGC GGATTCCGGT TCGTTTGCGT

851  TTAAACAAAA TTACCGGCAG GGACTGTACG AATTATTGCT CAAGCAATGC

901  GAAGGCGGAT TTTGCTTGGG CGTGCAGCGT TTGGCTATCC CCGAGGCGGA

951  AGCGGTTTTA TATGCCCAAC AGGCTTATGC GGCAAATACT TTGTTTGGGC

1001  TGCGTGCCGC CGACAGGGGC GACGACGTGT ATGCCGCCGA TCCGTCCCGT

1051  CAAAAATTGT GGCTGCGCTT CATCGGCGGC CGGTCGCATC AAAATATACG

1101  GGGCGGCGCG GCTGCGGACG GGTGGCGCAA AGGCGTGCAA ATCGGCGGCG

1151  AGGTGTTTGT ACGGCAAAAT GAAGGCAGCC GACTGGCAAT CGGCGTGATG

1201  GGCGGCAGGG CCGGCCAGCA CGCATCAGTC AACGGCAAAG GCGGTGCGGC

1251  AGGCAGTGAT TTGTATGGTT ATGGCGGGGG TGTTTATGCT GCGTGGCATC
```

-continued

```
1301   AGTTGCGCGA TAAACAAACG GGTGCGTATT TGGACGGCTG GTTGCAATAC

1351   CAACGTTTCA AACACCGCAT CAATGATGAA AACCGTGCGG AACGCTACAA

1401   AACCAAAGGT TGGACGGCTT CTGTCGAAGG CGGCTACAAC GCGCTTGTGG

1451   CGGAAGGCAT TGTCGGAAAA GGCAATAATG TGCGGTTTTA CCTACAACCG

1501   CAGGCGCAGT TTACCTACTT GGGCGTAAAC GGCGGCTTTA CCGACAGCGA

1551   GGGGACGGCG GTCGGACTGC TCGGCAGCGG TCAGTGGCAA AGCCGCGCCG

1601   GCATTCGGGC AAAAACCCGT TTTGCTTTGC GTAACGGTGT CAATCTTCAG

1651   CCTTTTGCCG CTTTTAATGT TTTGCACAGG TCAAATCTT TCGGCGTGGA

1701   AATGGACGGC GAAAAACAGA CGCTGGCAGG CAGGACGGCA CTCGAAGGGC

1751   GGTTCGGTAT TGAAGCCGGT TGGAAAGGCC ATATGTCCGC ACGCATCGGA

1801   TATGGCAAAA GGACGGACGG CGACAAAGAA GCCGCATTGT CGCTCAAATG

1851   GCTGTTTTGA
```

This corresponds to the amino acid sequence <SEQ ID 2992;  
ORF 990>:

```
m990.pep
    1   MFRAQLGSNT RSTKIGDDAD FSFSDKPKPG TSHYFSSGKT DQNSSEYGYD

51   EINIQGKNYN SGILAVDNMP VVKKYITEKY GADLKQAVKS QLQDLYKTRP

101   EAWAENKKRT EEAYIAQFGT KFSTLKQTMP DLINKLVEDS VLTPHSNTSQ

151   TSLNNIFNKK LHVKIENKSH VAGQVLELTK MTLKDSLWEP RRHSDIHTLE

201   TSDNARIRLN TKDEKLTVHK DYAGGADFLF GYDVRESDEP ALTFEDKVSG

251   QSGVVLERRP ENLKTLDGRK LIAAKTADSG SFAFKQNYRQ GLYELLLKQC

301   EGGFCLGVQR LAIPEAEAVL YAQQAYAANT LFGLRAADRG DDVYAADPSR

351   QKLWLRFIGG RSHQNIRGGA AADGWRKGVQ IGGEVFVRQN EGSRLAIGVM

401   GGRAGQHASV NGKGGAAGSD LYGYGGGVYA AWHQLRDKQT GAYLDGWLQY

451   QRFKHRINDE NRAERYKTKG WTASVEGGYN ALVAEGIVGK GNNVRFYLQP

501   QAQFTYLGVN GGFTDSEGTA VGLLGSGQWQ SRAGIRAKTR FALRNGVNLQ

551   PFAAFNVLHR SKSFGVEMDG EKQTLAGRTA LEGRFGIEAG WKGHMSARIG

601   YGKRTDGDKE AALSLKWLF*
```

The following partial DNA sequence was identified in *N. meningitidis* <SEQ ID 2993>:

```
a990.seq
    1   ATGTTCAGAG CTCAGCTTGG TTCAAATACT CGTTCTACCA AAATCGGCGA

51   CGATGCCGAT TTTTCATTTT CAGACAAGCC GAAACCCGGC ACTTCCCATT

101   ATTTTTCCAG CGGTAAAACC GATCAAAATT CATCCGAATA TGGGTATGAC

151   GAAATCAATA TCCAAGGTAA AAACTACAAT AGCGGCATAC TCGCCGTCGA

201   TAATATGCCC GTTGTTAAGA AATATATTAC AGATACTTAC GGGGATAATT

251   TAAAGGATGC GGTTAAGAAG CAATTACAGG ATTTATACAA AACAAGACCC

301   GAAGCTTGGG AAGAAAATAA AAAACGGACT GAGGAGGCGT ATATAGAACA

351   GCTTGGACCA AAATTTAGTA TACTCAAACA GAAAAACCCC GATTTAATTA

401   ATAAATTGGT AGAAGATTCC GTACTCACTC CTCATAGTAA TACATCACAG
```

```
 451  ACTAGTCTCA ACAACATCTT CAATAAAAAA TTACACGTCA AAATCGAAAA

501  CAAATCCCAC GTCGCCGGAC AGGTGTTGGA ACTGACCAAG ATGACGCTGA

551  AAGATTCCCT TTGGGAACCG CGCCGCCATT CCGACATCCA TATGCTGGAA

601  ACTTCCGATA ATGCCCGCAT CCGCCTGAAC ACGAAAGATG AAAAACTGAC

651  CGTCCATAAA GCGTATCAGG GCGGTGCGGA TTTCCTGTTC GGCTACGACG

701  TGCGGGAGTC GGACAAACCC GCCCTGACCT TTGAAGAAAA AGTCAGCGGA

751  CAATCCGGCG TGGTTTTGGA ACGCCGGCCG GAAAATCTGA AAACGCTCGA

801  CGGGCGCAAA CTGATTGCGG CGGAAAAGGC AGACTCTAAT TCGTTTGCGT

851  TTAAACAAAA TTACCGGCAG GGACTGTACG AATTATTGCT CAAGCAATGC

901  GAAGGCGGAT TTTGCTTGGG CGTGCAGCGT TTGGCTATCC CCGAGGCGGA

951  AGCGGTTTTA TATGCCCAAC AGGCTTATGC GGCAAATACT TTGTTCGGGC

1001  TGCGTGCCGC CGACAGGGGC GACGACGTGT ATGCCGCCGA TCCGTCCCGT

1051  CAAAAATTGT GGCTGCGCTT CATCGGCGGC CGGTCGCATC AAAATATACG

1101  GGGCGGCGCG GCTGCGGACG GGCGGCGCAA AGGCGTGCAA ATCGGCGGCG

1151  AGGTGTTTGT ACGGCAAAAT GAAGGCAGCC GGCTGGCAAT CGGCGTGATG

1201  GGCGGCAGGG CTGGCCAGCA CGCATCAGTC AACGGCAAAG GCGGTGCGGC

1251  AGGCAGTTAT TTGCATGGTT ATGGCGGGGG TGTTTATGCT GCGTGGCATC

1301  AGTTGCGCGA TAAACAAACG GGTGCGTATT TGGACGGCTG GTTGCAATAC

1351  CAACGTTTCA ACACCGCAT CAATGATGAA AACCGTGCGG AACGCTACAA

1401  AACCAAAGGT TGGACGGCTT CTGTCGAAGG CGGCTACAAC GCGCTTGTGG

1451  CGGAAGGCGT TGTCGGAAAA GGCAATAATG TGCGGTTTTA CCTGCAACCG

1501  CAGGCGCAGT TTACCTACTT GGGCGTAAAC GGCGGCTTTA CCGACAGCGA

1551  GGGGACGGCG GTCGGACTGC TCGGCAGCGG TCAGTGGCAA AGCCGCGCCG

1601  GCATTCGGGC AAAAACCCGT TTTGCTTTGC GTAACGGTGT CAATCTTCAG

1651  CCTTTTGCCG CTTTTAATGT TTTGCACAGG TCAAAATCTT TCGGCGTGGA

1701  AATGGACGGC GAAAAACAGA CGCTGGCAGG CAGGACGGCG CTCGAAGGGC

1751  GGTTCGGCAT TGAAGCCGGT TGGAAAGGCC ATATGTCCGC ACGCATCGGA

1801  TACGGCAAAA GGACGGACGG CGACAAAGAA GCCGCATTGT CGCTCAAATG

1851  GCTGTTTTGA
```

This corresponds to the amino acid sequence <SEQ ID 2994; ORF 990.a>:

```
a990.pep
    1  MFRAQLGSNT RSTKIGDDAD FSFSDKPKPG TSHYFSSGKT DQNSSEYGYD

51  EINIQGKNYN SGILAVDNMP VVKKYITDTY GDNLKDAVKK QLQDLYKTRP

101  EAWEENKKRT EEAYIEQLGP KFSILKQKNP DLINKLVEDS VLTPHSNTSQ

151  TSLNNIFNKK LHVKIENKSH VAGQVLELTK MTLKDSLWEP RRHSDIHMLE

201  TSDNARIRLN TKDEKLTVHK AYQGGADFLF GYDVRESDKP ALTFEEKVSG

251  QSGVVLERRP ENLKTLDGRK LIAAEKADSN SFAFKQNYRQ GLYELLLKQC

301  EGGFCLGVQR LAIPEAEAVL YAQQAYAANT LFGLRAADRG DDVYAADPSR

351  QKLWLRFIGG RSHQNIRGGA AADGRRKGVQ IGGEVFVRQN EGSRLAIGVM
```

-continued

```
401    GGRAGQHASV NGKGGAAGSY LHGYGGGVYA AWHQLRDKQT GAYLDGWLQY

451    QRFKHRINDE NRAERYKTKG WTASVEGGYN ALVAEGVVGK GNNVRFYLQP

501    QAQFTYLGVN GGFTDSEGTA VGLLGSGQWQ SRAGIRAKTR FALRNGVNLQ

551    PFAAFNVLHR SKSFGVEMDG EKQTLAGRTA LEGRFGIEAG WKGHMSARIG

601    YGKRTDGDKE AALSLK<u>WLF</u>*
``` m990/a990 96.0% identity in 619 aa overlap

```
                   10         20         30         40         50         60
m990.pep   MFRAQLGSNTRSTKIGDDADFSFSDKPKPGTSHYFSSGKTDQNSSEYGYDEINIQGKNYN
           ||||||||||||||||||||||||||||||||||||||||||||||||||||||||||||
a990       MFRAQLGSNTRSTKIGDDADFSFSDKPKPGTSHYFSSGKTDQNSSEYGYDEINIQGKNYN
                   10         20         30         40         50         60
                   70         80         90        100        110        120
m990.pep   SGILAVDNMPVVKKYITEKYGADLKQAVKSQLQDLYKTRPEAWAENKKRTEEAYIAQFGT
           ||||||||||||||||||:  ||  :||:|||||||||||||||  ||||||||||| :|
a990       SGILAVDNMPVVKKYITDTYGDNLKDAVKKQLQDLYKTRPEAWEENKKRTEEAYIEQLGP
                   70         80         90        100        110        120
                  130        140        150        160        170        180
m990.pep   KFSTLKQTMPDLINKLVEDSVLTPHSNTSQTSLNNIFNKKLHVKIENKSHVAGQVLELTK
           |||  |||  ||||||||||||||||||||||||||||||||||||||||||||||||||
a990       KFSILKQKNPDLINKLVEDSVLTPHSNTSQTSLNNIFNKKLHVKIENKSHVAGQVLELTK
                  130        140        150        160        170        180
                  190        200        210        220        230        240
m990.pep   MTLKDSLWEPRRHSDIHTLETSDNARIRLNTKDEKLTVHKDYAGGADFLFGYDVRESDEP
           |||||||||||||||||  |||||||||||||||||||||| | |||||||||||||:|
a990       MTLKDSLWEPRRHSDIHMLETSDNARIRLNTKDEKLTVHKAYQGGADFLFGYDVRESDKP
                  190        200        210        220        230        240
                  250        260        270        280        290        300
m990.pep   ALTFEDKVSGQSGVVLERRPENLKTLDGRKLIAAKTADSGSFAFKQNYRQGLYELLLKQC
           ||||| :||||||||||||||||||||||||||| :||| :|||||||||||||||||||
a990       ALTFEEKVSGQSGVVLERRPENLKTLDGRKLIAAEKADSNSFAFKQNYRQGLYELLLKQC
                  250        260        270        280        290        300
                  310        320        330        340        350        360
m990.pep   EGGFCLGVQRLAIPEAEAVLYAQQAYAANTLFGLRAADRGDDVYAADPSRQKLWLRFIGG
           ||||||||||||||||||||||||||||||||||||||||||||||||||||||||||||
a990       EGGFCLGVQRLAIPEAEAVLYAQQAYAANTLFGLRAADRGDDVYAADPSRQKLWLRFIGG
                  310        320        330        340        350        360
                  370        380        390        400        410        420
m990.pep   RSHQNIRGGAAADGWRKGVQIGGEVFVRQNEGSRLAIGVMGGRAGQHASVNGKGGAAGSD
           ||||||||||||||| |||||||||||||||||||||||||||||||||||||||||||
a990       RSHQNIRGGAAADGRRKGVQIGGEVFVRQNEGSRLAIGVMGGRAGQHASVNGKGGAAGSY
                  370        380        390        400        410        420
                  430        440        450        460        470        480
m990.pep   LYGYGGGVYAAWHQLRDKQTGAYLDGWLQYQRFKHRINDENRAERYKTKGWTASVEGGYN
           |:||||||||||||||||||||||||||||||||||||||||||||||||||||||||||
a990       LHGYGGGVYAAWHQLRDKQTGAYLDGWLQYQRFKHRINDENRAERYKTKGWTASVEGGYN
                  430        440        450        460        470        480
                  490        500        510        520        530        540
m990.pep   ALVAEGIVGKGNNVRFYLQPQAQFTYLGVNGGFTDSEGTAVGLLGSGQWQSRAGIRAKTR
           |||||| :|||||||||||||||||||||||||||||||||||||||||||||||||||
a990       ALVAEGVVGKGNNVRFYLQPQAQFTYLGVNGGFTDSEGTAVGLLGSGQWQSRAGIRAKTR
                  490        500        510        520        530        540
                  550        560        570        580        590        600
m990.pep   FALRNGVNLQPFAAFNVLHRSKSFGVEMDGEKQTLAGRTALEGRFGIEAGWKGHMSARIG
           ||||||||||||||||||||||||||||||||||||||||||||||||||||||||||||
a990       FALRNGVNLQPFAAFNVLHRSKSFGVEMDGEKQTLAGRTALEGRFGIEAGWKGHMSARIG
                  550        560        570        580        590        600
                  610        620
m990.pep   YGKRTDGDKEAALSLKWLFX
           ||||||||||||||||||||
a990       YGKRTDGDKEAALSLKWLFX
                  610        620
```

The following partial DNA sequence was identified in *N. gonorrhoeae* <SEQ ID 2995>:

```
g992.seq
    1    ATGTTCAGAC GGCATCGGCA TTTGAAAAAT ATGCAGATTA AAAAAATCAT

51    GAAATGGCTT CCCGTCGCCC TGTCGCTTTT GGGCGCGTTG GGTTATACGG
```

-continued

```
101  GATATGACAG TGAGGCGGTG CGGACGGCGG TTGCCGTACT CGACGTACTC

151  GGCACTGCAG GGGACGTGGG TTTCGACGCG CCCGTTCGCC GACGGGCATC

201  GGCGAAATCC GGCCACAGCT ACACAGGCAC GGTGTCCAAA GTCTATGACG

251  GCGATACCCT TCACGTCATC GACGGCGACG GCGCGAAACA TAAAATTCGG

301  ATGGCGTATA TCGACGCACC GGAGATGAAA CAGGCTTACG GTACACGTTC

351  GCGCGACAAC CTGCGCGCGG CGGCGGAGGG TAGGAAAGTC AGTGTACGTG

401  TGTTTGAAAC CGACCGCTAT CAGCGCGAAG TGGCGCAGGT ATCCGCCGGC

451  AAAACCGATT TGAACCTGAT GCAGGTGCAG GACGGGGCGG CGTGGCATTA

501  TAAAAGTTAT GCTAAAGAAC AGCAGGATAA GGCGGATTTT GCCGACTATG

551  CCGACGCTCA AATTCAGGCG GAAAGGGAAC GCAAAGGATT GTGGAAAGCT

601  AAAAATCCGC AAGCGCCGTG GGCGTACCGC CGGGCAGGCA GGAGCGGCGG

651  GGGCAATAAG GATTGGATGG ATTCCGTGGG CGAATGGTTG GGCATTTGGT

701  AA
```

This corresponds to the amino acid sequence <SEQ ID 2996 ORF 992.ng>:

```
g992.pep
   1  MFRRHRHLKN MQIKKIMKWL PVALSLLGAL GYTGYDSEAV RTAVAVLDVL

51  GTAGDVGFDA PVRRRASAKS GHSYTGTVSK VYDGDTLHVI DGDGAKHKIR

101  MAYIDAPEMK QAYGTRSRDN LRAAAEGRKV SVRVFETDRY QREVAQVSAG

151  KTDLNLMQVQ DGAAWHYKSY AKEQQDKADF ADYADAQIQA ERERKGLWKA

201  KNPQAPWAYR RAGRSGGGNK DWMDSVGEWL GIW*
```

The following partial DNA sequence was identified in N. meningitidis <SEQ ID 2997>:

```
m992.seq
   1  ATGTTCAGAC GGCATCGGCA TTTGAAAAAT ATGCAGATTA AAAAAATCAT

51  GAAATGGCTT CCCGTCGCCC TGTCGCTTTT GGGTGCGTTG GGTTATACGG

101  GGTACGGCAG CGAGGCGGTG CGGACGGCGG TTGCCGTACT CGACGTACTC

151  GGCGCGGCAG GGGACGCGGG TTCCGACGCG CCCGCCCGCC GCCGAGCATC

201  GGCGAAATCC GGCCACCGCT ACACAGGCAC GGTGTCCAAA GTCTATGACG

251  GCGACACCCT TCACGTTATC GACGGCGACG GCGCGAAACA CAAAATCCGG

301  ATGGCGTATA TCGACGCGCC GGAGATGAAA CAGGCTTACG GCACGCGTTC

351  GCGCGACAAC CTGCGCGCGG CGGCGGAAGG CAGGAAAGTC AGCGTGCGCG

401  TGTTCGATAC CGACCGCTAC CAGCGCGAAG TGGCGCAGGT TTCTGTCGGC

451  AAAACCGATT TGAACCTGAT GCAGGTGCAG GACGGGGCGG CGTGGCATTA

501  TAAAAGTTAT GCTAAAGAAC AGCAGGATAA GGCGGATTTT GCCGATTATG

551  CCGACGCTCA AATTCAGGCG GAAAGGGAAC GCAAAGGATT GTGGAAAGCT

601  AAAAATCCGC AAGCGCCGTG GGCGTACCGC CGAGCAGGCA GGAGCGGCGG

651  GGGCAATAAG GATTGGATGG ATGCCGTGGG CGAATGGTTG GGCATTTGGT

701  AA
```

This corresponds to the amino acid sequence <SEQ ID 2998; ORF 992>:

```
m992.pep
    1   MFRRHRHLKN MQIKKIMKWL PVALSLLGAL GYTGYGSEAV RTAVAVLDVL

51   GAAGDAGSDA PARRRASAKS GHRYTGTVSK VYDGDTLHVI DGDGAKHKIR

101   MAYIDAPEMK QAYGTRSRDN LRAAAEGRKV SVRVFDTDRY QREVAQVSVG

151   KTDLNLMQVQ DGAAWHYKSY AKEQQDKADF ADYADAQIQA ERERKGLWKA

201   KNPQAPWAYR RAGRSGGGNK DWMDAVGEWL GIW*
```

Computer analysis of this amino acid sequence gave the following results:
Homology with a Predicted ORF from *N. gonorrhoeae*
ORF 992 shows 96.1% identity over a 233 aa overlap with a predicted ORF (ORF 992) from *N. gonorrhoeae*
m992/a992 96.1% identity in 233 aa overlap

```
                   10        20        30        40        50        60
  m992.pep  MFRRHRHLKNMQIKKIMKWLPVALSLLGALGYTGYGSEAVRTAVAVLDVLGAAGDAGSDA
            ||||||||||||||||||||||||||||||||||| :|||:| ||
  g992      MFRRHRHLKNMQIKKIMKWLPVALSLLGALGYTGYDSEAVRTAVAVLDVLGTAGDVGFDA
                   10        20        30        40        50        60
                   70        80        90       100       110       120
  m992.pep  PARRRASAKSGHRYTGTVSKVYDGDTLHVIDGDGAKHKIRMAYIDAPEMKQAYGTRSRDN
            |:|||||||||| |||||||||||||||||||||||||||||||||||||||||||||
  g992      PVRRRASAKSGHSYTGTVSKVYDGDTLHVIDGDGAKHKIRMAYIDAPEMKQAYGTRSRDN
                   70        80        90       100       110       120
                  130       140       150       160       170       180
  m992.pep  LRAAAEGRKVSVRVFDTDRYQREVAQVSVGKTDLNLMQVQDGAAWHYKSYAKEQQDKADF
            ||||||||||||||:|||||||||||||:|||||||||||||||||||||||||||||
  g992      LRAAAEGRKVSVRVFETDRYQREVAQVSAGKTDLNLMQVQDGAAWHYKSYAKEQQDKADF
                  130       140       150       160       170       180
                  190       200       210       220       230
  m992.pep  ADYADAQIQAERERKGLWKAKNPQAPWAYRRAGRSGGGNKDWMDAVGEWLGIWX
            |||||||||||||||||||||||||||||||||||||||||||:|||||||||
  g992      ADYADAQIQAERERKGLWKAKNPQAPWAYRRAGRSGGGNKDWMDSVGEWLGIWX
                  190       200       210       220       230
```

The following partial DNA sequence was identified in *N. meningitidis* <SEQ ID 2999>:

```
a992.seq
    1   ATGTTCAGAC GGCATCGGCA TTTGAAAAAT ATGCAGATTA AAAAAATCAT

51   GAAATGGCTT CCCGTCGCCT TGTCGCTTTT GGGTGCGTTG GGTTATACGG

101   GGTACGGCAG CGAGGCGGTG CGGACGGCGG TTGCCGTACT CGACGTACTC

151   GGCGCGGCAG GGGACGCGGG TTCCGACGCG CCCGCCCGCC GCCGAGCATC

201   GGCGAAATCC GGCCACCGCT ACACAGGCAC GGTGTCCAAA GTCTATGACG

251   GCGACACCCT TCACGTTATC GACGGCGACG GCGCGAAACA CAAAATCCGG

301   ATGGCGTATA TCGACGCGCC GGAGATGAAA CAGGCTTACG GCACGCGTTC

351   GCGCGACAAC CTGCGCGCGG CGGCGGAAGG CAGGAAAGTC AGCGTCCGCG

401   TGTTCGACAC CGACCGCTAC CAGCGCGAAG TGGCGCAGGT TTCTGTCGGC

451   AAACCGATT TGAACCTGAT GCAGGTGCAG GACGGGCGG CGTGGCATTA

501   TAAAAGTTAT GCTAAAGAAC AGCAGGATAA GGCGGATTTT GCCGATTATG

551   CCGACGCTCA AATTCAGGCG GAAAGGGAAC GCAAAGGATT GTGGAAAGCT

601   AAAAATCCGC AAGCGCCGTG GGCGTACCGC CGGGCAGGCA GGAGCGGCGG
```

-continued

```
651  GGGCAATAAG GATTGGATGG ATGCCGTGGG CGAATGGTTG GGCATTTGGT

701  AA
```

This corresponds to the amino acid sequence <SEQ ID 3000; ORF 992.a>:

```
a992.pep
  1    MFRRHRHLKN MQIKKIMKWL PVALSLLGAL GYTGYGSEAV RTAVAVLDVL

51    GAAGDAGSDA PARRRASAKS GHRYTGTVSK VYDGDTLHVI DGDGAKHKIR

101    MAYIDAPEMK QAYGTRSRDN LRAAAEGRKV SVRVFDTDRY QREVAQVSVG

151    KTDLNLMQVQ DGAAWHYKSY AKEQQDKADF ADYADAQIQA ERERKGLWKA

201    KNPQAPWAYR RAGRSGGGNK DWMDAVGEWL GIW*
```

Computer analysis of this amino acid sequence gave the following results:
Homology with a Predicted ORF from *N. meningitidis*
ORF 992 shows 100.0% identity over a 233 aa overlap with a predicted ORF (ORF 992) from *N. meningitidis*
a992/m992 100.0% identity in 233 aa overlap

```
                 10         20         30         40         50         60
a992.pep  MFRRHRHLKNMQIKKIMKWLPVALSLLGALGYTGYGSEAVRTAVAVLDVLGAAGDAGSDA
          ||||||||||||||||||||||||||||||||||||||||||||||||||||||||||||
m992      MFRRHRHLKNMQIKKIMKWLPVALSLLGALGYTGYGSEAVRTAVAVLDVLGAAGDAGSDA
                 10         20         30         40         50         60

70         80         90        100        110        120
a992.pep  PARRRASAKSGHRYTGTVSKVYDGDTLHVIDGDGAKHKIRMAYIDAPEMKQAYGTRSRDN
          ||||||||||||||||||||||||||||||||||||||||||||||||||||||||||||
m992      PARRRASAKSGHRYTGTVSKVYDGDTLHVIDGDGAKHKIRMAYIDAPEMKQAYGTRSRDN
                 70         80         90        100        110        120

130        140        150        160        170        180
a992.pep  LRAAAEGRKVSVRVFDTDRYQREVAQVSVGKTDLNLMQVQDGAAWHYKSYAKEQQDKADF
          ||||||||||||||||||||||||||||||||||||||||||||||||||||||||||||
m992      LRAAAEGRKVSVRVFDTDRYQREVAQVSVGKTDLNLMQVQDGAAWHYKSYAKEQQDKADF
                130        140        150        160        170        180

190        200        210        220        230
a992.pep  ADYADAQIQAERERKGLWKAKNPQAPWAYRRAGRSGGGNKDWMDAVGEWLGIWX
          |||||||||||||||||||||||||||||||||||||||||||||||||||||
m992      ADYADAQIQAERERKGLWKAKNPQAPWAYRRAGRSGGGNKDWMDAVGEWLGIWX
                190        200        210        220        230
```

The following partial DNA sequence was identified in *N. gonorrhoeae* <SEQ ID 3001>:

```
g993.seq
  1    CTGAAAGTCG TATTGGGCAG TTTTCAAGGC CCTTTGGATC TGCTGCTCTA

51    CCTTATCCGC AAGCAGAACA TCGATGTTCT CGATATTCCG ATGGTGGAAA

101    TTACCGGGCA GTATCTGCAC TATATTGCCC AAATGGAAGC CTATCAGTTT

151    GATTTGGCGG CGGAATATCT TTTGATGGCG GCAATGCTGA TTGAAATCAA

201    ATCGCGCCTG CTGCTGCCGC GTACCGAAGC CGTCGAAGAC GAAGAGGCCG

251    ACCCGCGTGC CGAGTTGGTG CGCCGTCTGC TTGCCTACGA GCAAATGAAA

301    CTGGCGGCGC AGGGTTTGGA CGCGCTGCCG CGTGCGGGAC GGGATTTCGC

351    GTGGGCTTAC CTGCCGCTGG AAATTGCAGC CGAGACGAAG CTGCCCGAGG

401    TTTACATCGC CGATTTGATG CAGGCATGGT TGGGCATTCT TTCTCGGGCA

451    AAACATACGC GCAGCCACGA AGTAATCCAA GAAACCCTTT CCGTGCGCGC

501    GCAAATGACG GCAATCCTGC GCCGTTTGAA CGAACACGGG ATATGCAGGT
```

```
551  TTCACGCCCT GTTCAATCCC GAACAGGGCG CGGCTTACGT GATCGTCAAC

601  TTCATCGCCC TGTTGGAGCT TGCCAAAGAA GGATTGGTCG AATCGTACA

651  GGAAGACGGT TTCGGAGAAA TCCGAATCAG CCTCAATCAT GAGGGGGCGC

701  ATTCAGACGG CATTTTCGGC ACACGGGGCG GGCGCGATGT GTTCTAA
```

This corresponds to the amino acid sequence <SEQ ID 3002 ORF 993.ng>:

```
g993.pep
   1   LKVVLGSFQG PLDLLLYLIR KQNIDVLDIP MVEITGQYLH YIAQMEAYQF

51   DLAAEYLLMA AMLIEIKSRL LLPRTEAVED EEADPRAELV RRLLAYEQMK

101   LAAQGLDALP RAGRDFAWAY LPLEIAAETK LPEVYIADLM QAWLGILSRA

151   KHTRSHEVIQ ETLSVRAQMT AILRRLNEHG ICRFHALFNP EQGAAYVIVN

201   FIALLELAKE GLVGIVQEDG FGEIRISLNH EGAHSDGIFG TRGGRDVF*
```

The following partial DNA sequence was identified in *N. meningitidis* <SEQ ID 3003>:

```
m993.seq
   1   TTGAAAGTCG TATTGGGCAG CTTCCAAGGC CCTTTGGATC TACTGCTGTA

51   TCTGATCCGC AAACAGAATA TCGACGTACT GGATATTCCG ATGGTGAAGA

101   TTACCGAGCA GTATCTGCAC TACATCGCCC AAATAGAAAC CTATCAGTTT

151   GATTTGGCGG CGGAATATCT TTTGATGGCA GCAATGCTGA TTGAAATCAA

201   ATCGCGCCTG CTGCTGCCGC GTACCGAAAC CGTCGAAGAC GAAGAAGCCG

251   ACCCGCGTGC CGAGTTGGTG CGCCGCCTGC TGGCTTACGA ACAGATGAAG

301   CTGGCGGCGC AGGGTTTGGA CGCGCTGCCC CGAGCCGGAC GGGATTTCGC

351   GTGGGCTTAC CTGCCGCTGG AAATTGCCGT CGAAGCCAAG CTGCCCGAAG

401   TCTATATTAC CGACTTGACG CAAGCGTGGC TGGGTATTTT GTCTCGGGCA

451   AAACACACGC GCAGCCACGA AGTAATCAAA GAAACCATCT CCGTGCGCGC

501   GCAAATGACG GCAATCCTGC GCCGTTTGAA CGGACACGGA ATATGCAGGT

551   TTCACGACCT GTTCAATCCC AAACAGGGCG CGGCTTACGT GGTCGTCAAC

601   TTCATCGCAC TGTTGGAGCT TGCCAAAGAA GGATTGGTCA GATCGTGCA

651   GGAAGACGGT TTCGGAGAAA TCCGAATCAG CCTCAATCAT GAGGGGGCGC

701   ATTCAGACGG CATTTCCGGC ACACGAGGCG GGCGCGATGT GTTCTAA
```

This corresponds to the amino acid sequence <SEQ ID 3004; ORF 993>:

```
m993.pep
   1   LKVVLGSFQG PLDLLLYLIR KQNIDVLDIP MVKITEQYLH YIAQIETYQF

51   DLAAEYLLMA AMLIEIKSRL LLPRTETVED EEADPRAELV RRLLAYEQMK

101   LAAQGLDALP RAGRDFAWAY LPLEIAVEAK LPEVYITDLT QAWLGILSRA

151   KHTRSHEVIK ETISVRAQMT AILRRLNGHG ICRFHDLFNP KQGAAYVVVN

201   FIALLELAKE GLVRIVQEDG FGEIRISLNH EGAHSDGISG TRGGRDVF*
```

Computer analysis of this amino acid sequence gave the following results:

Homology with a Predicted ORF from *N. gonorrhoeae*
ORF 993 shows 93.1% identity over a 248 aa overlap with a predicted ORF (ORF 993) from *N. gonorrhoeae*
m993/g993 93.1% identity in 248 aa overlap

```
                    10        20        30        40        50        60
   m993.pep   LKVVLGSFQGPLDLLLYLIRKQNIDVLDIPMVKITEQYLHYIAQIETYQFDLAAEYLLMA
              ||||||||||||||||||||||||||||||||:|| ||||||||:|:|||||||||||||
   g993       LKVVLGSFQGPLDLLLYLIRKQNIDVLDIPMVEITGQYLHYIAQMEAYQFDLAAEYLLMA
                    10        20        30        40        50        60

70        80        90       100       110       120
   m993.pep   AMLIEIKSRLLLPRTETVEDEEADPRAELVRRLLAYEQMKLAAQGLDALPRAGRDFAWAY
              ||||||||||||||:|||||||||||||||||||||||||||||||||||||||||||||
   g993       AMLIEIKSRLLLPRTEAVEDEEADPRAELVRRLLAYEQMKLAAQGLDALPRAGRDFAWAY
                    70        80        90       100       110       120

130       140       150       160       170       180
   m993.pep   LPLEIAVEAKLPEVYITDLTQAWLGILSRAKHTRSHEVIKETISVRAQMTAILRRLNGHG
              ||||||:|:|||||||:|| ||||||||||||||||||||:||:|||||||||||||| ||
   g993       LPLEIAAETKLPEVYIADLMQAWLGILSRAKHTRSHEVIQETLSVRAQMTAILRRLNEHG
                   130       140       150       160       170       180

190       200       210       220       230       240
   m993.pep   ICRFHDLFNPKQGAAYVVVNFIALLELAKEGLVRIVQEDGFGEIRISLNHEGAHSDGISG
              ||||| ||||:|||||:|||||||||||||||||:||||||||||||||||||||||| |
   g993       ICRFHALFNPEQGAAYVIVNFIALLELAKEGLVGIVQEDGFGEIRISLNHEGAHSDGIFG
                   190       200       210       220       230       240

249
   m993.pep   TRGGRDVFX
              |||||||||
   g993       TRGGRDVFX
                   249
```

The following partial DNA sequence was identified in *N. meningitidis* <SEQ ID 3005>:

```
a993.seq
    1   CTGAAAGTCG TATTGAGCAG TTTTCAAGGC CCTTTGGATC TGCTGCTCTA

51   CCTTATCCGC AAGCAGAACA TCGATGTTCT CGATATTCCG ATGGTGAAGA

101   TTACCGAACA GTATCTGCAC TACATCGCCC AAATAGAAAC CTATCAGTTT

151   GATTTGGCGG CGGAATATCT TTTGATGGCA GCAATGCTGA TTGAAATCAA

201   ATCGCGCCTG CTGCTGCCGC GTACCGAAAC CGTCGAAGAC GAAGAAGCCG

251   ACCCGCGTGC CGAGTTGGTG CGCCGCCTGC TGGCTTACGA GCAGATGAAG

301   CTGGCGGCAC AAGGGTTGGA TGCGCTTCCT CGTGCGGGCC GGGATTTCGC

351   ATGGGCATAC CTGCCACTGG AAATTGCCGT CGAAGCCAAG CTGCCCGAAG

401   TCTATATTAC CGACTTGACG CAGGCGTGGC TGAGTATTTT GTCTCGGGCA

451   AAACATACGC GCAGCCACGA AGTTATCAAA GAAACCATCT CCGTGCGCGC

501   GCAAATGACG GCAATCCTGC GCCGTTTGAA CAAACACGGG ATATGCAGGT

551   TTCACGACCT GTTCAATCCC GAACAGGGCG CGGCTTACGT GGTCGTCAAC

601   TTCATCGCAC TGTTGGAGCT TGCCAAAGAA GGTTTGGTCG AATCGTACA

651   GGAAGTCGGT TTCGGAGAAA TCCGAATCAG CCTCAATCAT GAGGGGGCGC

701   ATTCAGACGG CATTTCCGGC ACACGGGGCG GCGCGATGT GTTCTAA
```

This corresponds to the amino acid sequence <SEQ ID 3006; ORF 993.a>:

```
a993.pep
    1   LKVVLSSFQG PLDLLLYLIR KQNIDVLDIP MVKITEQYLH YIAQIETYQF

51   DLAAEYLLMA AMLIEIKSRL LLPRTETVED EEADPRAELV RRLLAYEQMK
```

-continued

```
101  LAAQGLDALP RAGRDFAWAY LPLEIAVEAK LPEVYITDLT QAWLSILSRA

151  KHTRSHEVIK ETISVRAQMT AILRRLNKHG ICRFHDLFNP EQGAAYVVVN

201  FIALLELAKE GLVGIVQEVG FGEIRISLNH EGAHSDGISG TRGGRDVF*
```

Computer analysis of this amino acid sequence gave the following results:
Homology with a Predicted ORF from *N. meningitidis* [10]
ORF 993 shows 97.6% identity over a 248 aa overlap with a predicted ORF (ORF 993) from *N. meningitidis*
a993/m993 97.6% identity in 248 aa overlap

```
                 10         20         30         40         50         60
a993.pep  LKVVLSSFQGPLDLLLYLIRKQNIDVLDIPMVKITEQYLHYIAQIETYQFDLAAEYLLMA
          |||||:||||||||||||||||||||||||||||||||||||||||||||||||||||
m993      LKVVLGSFQGPLDLLLYLIRKQNIDVLDIPMVKITEQYLHYIAQIETYQFDLAAEYLLMA
                 10         20         30         40         50         60

70         80         90        100        110        120
a993.pep  AMLIEIKSRLLLPRTETVEDEEADPRAELVRRLLAYEQMKLAAQGLDALPRAGRDFAWAY
          ||||||||||||||||||||||||||||||||||||||||||||||||||||||||||
m993      AMLIEIKSRLLLPRTETVEDEEADPRAELVRRLLAYEQMKLAAQGLDALPRAGRDFAWAY
                 70         80         90        100        110        120

130        140        150        160        170        180
a993.pep  LPLEIAVEAKLPEVYITDLTQAWLSILSRAKHTRSHEVIKETISVRAQMTAILRRLNKHG
          ||||||||||||||||||||||||||:|||||||||||||||||||||||||||||| ||
m993      LPLEIAVEAKLPEVYITDLTQAWLGILSRAKHTRSHEVIKETISVRAQMTAILRRLNGHG
                130        140        150        160        170        180

190        200        210        220        230        240
a993.pep  ICRFHDLFNPEQGAAYVVVNFIALLELAKEGLVGIVQEVGFGEIRISLNHEGAHSDGISG
          ||||||||||:||||||||||||||||||||| |||  ||||||||||||||||||||
m993      ICRFHDLFNPKQGAAYVVVNFIALLELAKEGLVRIVQEDGFGEIRISLNHEGAHSDGISG
                190        200        210        220        230        240

249
a993.pep  TRGGRDVFX
          |||||||||
m993      TRGGRDVFX
                249
```

The following partial DNA sequence was identified in *N. gonorrhoeae* <SEQ ID 3007>:

```
g996.seq
    1  ATGAACAGAA GAACCTTCCT CCTCGGCGCA GGCGCGTTGC TTCTTACCGC

51  CTGCGGCAGA AAATCCGCCC GAACCCACGC CAAAATTCCC GAAGGAAGCA

101  CCGTGCTTGC CTTGGGCGAT TCGCTCACCT TCGGCTACGG AGCAAACCCC

151  GGCGAATCCT ACCCCGCGCA ACTGCAAAAA CTGACGGGTT GGAATATTGT

201  CAACGGCGGC GTATCGGGCG ATACGTCCGC GCAAGCCCTA TCGCGCCTGC

251  CCGCGCTGTT GGCACGCAAA CCCAAGCTTG TGATTGTCGG CATAGGCGGC

301  AACGACTTTC TGCGCAAAGT TCCCGAGGAG CAGACCCGCG CCAATATCGC

351  GAAAATCATC GAAACCGTGC AAAAGGAAAA CATTCCCGCC GTCCTCGTCG

401  GCGTGCCGCA CATCACACTG GGCGCGTTGT TCGGGCATTT GAGCGACCAT

451  CCGCTGTATG AGGATTTGTC CGAGGAATAC GGCATTCCGT TGTTCGGCGG

501  CGCGTGGGCG GAAATTTTGG GCAATAATAA TCTGAAATCC GACCAAATCC

551  ACGCCAACGG CAAAGGCTAT CGGAAATTCG CCGAAAATTT GAATCAATTT

601  TTGAGAAAAC ATGGGTTTAG ATAA
```

This corresponds to the amino acid sequence <SEQ ID 3008 ORF 996.ng>:

```
g996.pep
    1   MNRRTFLLGA GALLLTACGR KSARTHAKIP EGSTVLALGD SLTFGYGANP

51   GESYPAQLQK LTGWNIVNGG VSGDTSAQAL SRLPALLARK PKLVIVGIGG

101   NDFLRKVPEE QTRANIAKII ETVQKENIPA VLVGVPHITL GALFGHLSDH

151   PLYEDLSEEY GIPLFGGAWA EILGNNNLKS DQIHANGKGY RKFAENLNQF

201   LRKHGFR*
```

The following partial DNA sequence was identified in *N. meningitidis* <SEQ ID 3009>:

```
m996.seq
    1   ATGAACAGAA GAACCTTCCT CCTCGGCGCA GGCGCGTTGC TGCTTACCGC

51   CTGCGGCAGA AAATCCGCCC GAACCCACGC CAAAATTCCC GAAGGAAGCA

101   CCGTACTTGC CTTGGGCGAT TCGCTTACCT TCGGCTACGG CGCAAACCCT

151   GGCGAATCCT ACCCCGCGCA ACTGCAAAAA CTGACGGGTT GGAATATTGT

201   CAACGGCGGC GTATCGGGCG ATACATCTGC CCAAGCCCTG TCGCGCCTGC

251   CCGCGCTGTT GGCACGCAAA CCCAAGCTTG TGATTGTCGG CATAGGCGGC

301   AACGACTTTC TGCGCAAAGT TCCCAAGGAG CAGACCCGCG CCAATATCGC

351   GAAAATCATC GAAACCGTGC AGAAGGAAAA CATCCCCGCC GTCCTCGTCG

401   GCGTGCCGCA CATCACACTG GGTGCGTTGT TCGGGCATTT GAGCGATCAT

451   CCGCTGTATG AGGATTTGTC CGAGGAATAC GGCATTCCGC TGTTCGGCGG

501   CGCGTGGGCG GAAATTTTGG GCGATAATAA TCTGAAATCC GACCAAATCC

551   ACGCCAACGG CAAAGGCTAT CGGAAATTTG CCGAAGATTT GAATCAATTT

601   TTGAGAAAAC AGGGGTTTAG ATAA
```

This corresponds to the amino acid sequence <SEQ ID 3010; ORF 996>:

```
m996.pep
    1   MNRRTFLLGA GALLLTACGR KSARTHAKIP EGSTVLALGD SLTFGYGANP

51   GESYPAQLQK LTGWNIVNGG VSGDTSAQAL SRLPALLARK PKLVIVGIGG

101   NDFLRKVPKE QTRANIAKII ETVQKENIPA VLVGVPHITL GALFGHLSDH

151   PLYEDLSEEY GIPLFGGAWA EILGDNNLKS DQIHANGKGY RKFAEDLNQF

201   LRKQGFR
```

Computer analysis of this amino acid sequence gave the following results:
Homology with a Predicted ORF from *N. gonorrhoeae*
ORF 996 shows 98.1% identity over a 207 aa overlap with a predicted ORF (ORF 996) from *N. gonorrhoeae*
m996/g996 98.1% identity in 207 aa overlap

```
                   10         20         30         40         50         60
   m996.pep  MNRRTFLLGAGALLLTACGRKSARTHAKIPEGSTVLALGDSLTFGYGANPGESYPAQLQK
             ||||||||||||||||||||||||||||||||||||||||||||||||||||||||||||
   g996      MNRRTFLLGAGALLLTACGRKSARTHAKIPEGSTVLALGDSLTFGYGANPGESYPAQLQK
                   10         20         30         40         50         60
```

```
              70         80         90        100        110        120
m996.pep  LTGWNIVNGGVSGDTSAQALSRLPALLARKPKLVIVGIGGNDFLRKVPKEQTRANIAKII
          ||||||||||||||||||||||||||||||||||||||||||||:|||||||||||||
g996      LTGWNIVNGGVSGDTSAQALSRLPALLARKPKLVIVGIGGNDFLRKVPEEQTRANIAKII
              70         80         90        100        110        120

130        140        150        160        170        180
m996.pep  ETVQKENIPAVLVGVPHITLGALFGHLSDHPLYEDLSEEYGIPLFGGAWAEILGDNNLKS
          |||||||||||||||||||||||||||||||||||||||||||||||||||:|||||
g996      ETVQKENIPAVLVGVPHITLGALFGHLSDHPLYEDLSEEYGIPLFGGAWAEILGNNNLKS
             130        140        150        160        170        180

190        200
m996.pep  DQIHANGKGYRKFAEDLNQFLRKQGFR
          ||||||||||||||:|||||||:|||
g996      DQIHANGKGYRKFAENLNQFLRKHGFRX
             190        200
```

The following partial DNA sequence was identified in *N. meningitidis* <SEQ ID 3011>:

```
a996.seq
    1  ATGAACAGAA GAACCTTCCT CCTCGGCGCA GGCGCGTTGC TCCTTACCGC
   51  CTGCGGCAGA AAATCCGCCC GAACCCACGC CAAAATTCCC GAAGGAAGCA
  101  CCGTACTTGC CTTGGGCGAT TCGCTTACCT TCGGCTACGG CGCAAACCCC
  151  GGCGAATCCT ACCCCGCGCA ACTGCAAAAA CTGACGGGTT GGAATATTGT
  201  CAACGGCGGC GTATCGGGCG ATACATCCGC CCAAGCCCTG TCGCGCCTGC
  251  CCGCGCTGTT GGCACGCAAA CCCAAGCTTG TGATTGTCGG CATAGGCGGC
  301  AACGACTTTC TGCGCAAAGT TCCCAAGGAG CAGACCCGCG CCAATATCGC
  351  GAAAATCATC GAAACCGTGC AGAAGGAAAA CATCCCCGCC GTCCTCGTCG
  401  GCGTGCCGCA CATTACCTTG GGCGCGTTGT TCGGGCATTT GAGCGATCAT
  451  CCGCTGTATG AGGATTTGTC CGAGGAATAC GGCATTCCGC TGTTCGGCGG
  501  CGCGTGGGCG GAAATTTTGG GCGATAATAA TCTGAAATCC GACCAAATCC
  551  ACGCCAACGG CAAAGGCTAT CGGAAATTTG CCGAAGATTT GAATCAATTT
  601  TTGAGAAAAC AGGGGTTTAG ATAA
```

This corresponds to the amino acid sequence <SEQ ID 3012; ORF 996.a>:

```
a996.pep
    1  MNRRTFLLGA GALLLTACGR KSARTHAKIP EGSTVLALGD SLTFGYGANP
   51  GESYPAQLQK LTGWNIVNGG VSGDTSAQAL SRLPALLARK PKLVIVGIGG
  101  NDFLRKVPKE QTRANIAKII ETVQKENIPA VLVGVPHITL GALFGHLSDH
  151  PLYEDLSEEY GIPLFGGAWA EILGDNNLKS DQIHANGKGY RKFAEDLNQF
  201  LRKQGFR*
```

Computer analysis of this amino acid sequence gave the following results:
Homology with a Predicted ORF from *N. meningitidis*
ORF 996 shows 100.0% identity over a 207 aa overlap with a predicted ORF (ORF 996) from *N. meningitidis*
a996/m996 100.0% identity in 207 aa overlap

```
              10         20         30         40         50         60
a996.pep  MNRRTFLLGAGALLLTACGRKSARTHAKIPEGSTVLALGDSLTFGYGANPGESYPAQLQK
          ||||||||||||||||||||||||||||||||||||||||||||||||||||||||||||
m996      MNRRTFLLGAGALLLTACGRKSARTHAKIPEGSTVLALGDSLTFGYGANPGESYPAQLQK
              10         20         30         40         50         60
```

```
                  70         80         90        100        110        120
a996.pep  LTGWNIVNGGVSGDTSAQALSRLPALLARKPKLVIVGIGGNDFLRKVPKEQTRANIAKII
          ||||||||||||||||||||||||||||||||||||||||||||||||||||||||||||
m996      LTGWNIVNGGVSGDTSAQALSRLPALLARKPKLVIVGIGGNDFLRKVPKEQTRANIAKII
                  70         80         90        100        110        120

130        140        150        160        170        180
a996.pep  ETVQKENIPAVLVGVPHITLGALFGHLSDHPLYEDLSEEYGIPLFGGAWAEILGDNNLKS
          ||||||||||||||||||||||||||||||||||||||||||||||||||||||||||||
m996      ETVQKENIPAVLVGVPHITLGALFGHLSDHPLYEDLSEEYGIPLFGGAWAEILGDNNLKS
                 130        140        150        160        170        180

190        200
a996.pep  DQIHANGKGYRKFAEDLNQFLRKQGFRX
          |||||||||||||||||||||||||||
m996      DQIHANGKGYRKFAEDLNQFLRKQGFR
                 190        200
```

15

The following partial DNA sequence was identified in *N. gonorrhoeae* <SEQ ID 3013>:

```
g997.seq (partial)
    1  ATGATGAACA CGCCGCATCC GCGCCCGAAA ATCGCCGTCA TCGGCGCAGG

51  CTGGGCCGGC TTGTCCGCCG CCGTCACCTT GGCGCGGCAC GCCGACGTTA

101  CCCTGTTTGA AGCCGGCCGG CAGGCGGGCG GAAGGGCGCG CACACTGGCC

151  GGAAATACCG ACGGTTTCGG TTTTTTGGAC AACGGGCAGC ACATTTTGCT

201  CGGCGCATAC CGGGGCGTGT TGCGCCTGAT GAAAACCATC GGTTCAGACC

251  CCCGTGCCGC CTTTTTGCGC GTACCGCTGC ACTGGCATAT GCACGGCGGT

301  TTGCAGTTCC GCGCCCTCCC CCTGCCCGCG CCGCTGCATA TTTTGGGCGG

351  CGTGCTGCTT GCCCGGCGCG TACCGTCCGC ATTCAAAGCC AAACTGCTTG

401  CCGATATGTC CGATTTGCAG AAGTCCGCAC GCCTCGGACA GCCCGACACG

451  ACAGTTGCAC AATGGCTGAA ACAGCGGAAC GTGCCGCGTG CCGCCGTAAT

501  GCAGTTTTGG CAGCCCTTGG TCTGGGGCGC GCTCAACACG CCTTTGGAAA

551  CCGCAAGCCT GCGCGTGTTG TGCAACGTTT TGTCCGACGG CGTGCTGACG

601  AAAAAATCCG GCAGCGACTA TCTCCTACCC AAACAGGATT TGGGCGCAAT

651  CGTCGCCGAA CCCGCCTTGG CGGAGCTTCA ACGGCTCGGC GCGGACATCC

701  GCCTCGAAAC GCGCGTATGC CGTCTGAACA CCCTCCCGGA CGGAAAAGTC

751  CTCGTCAACG GCGAAGCCTT CGATGCCGCC ATACTTGCCA CCGCGCCCTA

801  CCACGCCGCC GCGCTCCTGC CCGAAGGCAC GCCCGAACAC GTTCAGACGG

851  CATATCAAAA CCTTCGCTAC CACGCCATCA CCACCGTCTA TCTGCGCTAC

901  GCCGAACCCG TCCGcCTGCc CGCCCCGCTG ACcGGCATtg CCGAcggcAC 951  ggcaCaatgG CTGCTTTgcc cgGGGCAGGC tccggactgc CcccaaAacg 1001  aagTCTCCGC cGTCAttagc GTTTCCGAcc GCGtcggcgC Gtttgcaaac 1051  cga...
```

This corresponds to the amino acid sequence <SEQ ID 3014> ORF 997.ng>:

```
g997.pep (partial)
    1  MMNTPHPRPK IAVIGAGWAG LSAAVTLARH ADVTLFEAGR QAGGRARTLA

51  GNTDGFGFLD NGQHILLGAY RGVLRLMKTI GSDPRAAFLR VPLHWHMHGG

101  LQFRALPLPA PLHILGGVLL ARRVPSAFKA KLLADMSDLQ KSARLGQPDT

151  TVAQWLKQRN VPRAAVMQFW QPLVWGALNT PLETASLRVL CNVLSDGVLT
```

-continued

```
 201  KKSGSDYLLP KQDLGAIVAE PALAELQRLG ADIRLETRVC RLNTLPDGKV

251  LVNGEAFDAA ILATAPYHAA ALLPEGTPEH VQTAYQNLRY HAITTVYLRY

301  AEPVRLPAPL TGIADGTAQW LLCPGQAPDC PQNEVSAVIS VSDRVGAFAN

351  R....
```

The following partial DNA sequence was identified in *N. meningitidis* <SEQ ID 3015>:

```
m997.seq
    1  ATGATGAACA CGCCGCATCC GCGCCCGAAA ATCGCCGTCA TCGGCGCAGG

51  CTGGGCAGGA CTGTCCGCCG CCGTCACCTT GGCGCGGCAC GCCGACGTTA

101  CCCTGTTTGA AGCCGGCCGG CAGGCGGGCG GCAGGGCGCG CACACTGGCC

151  GGAAATACCG ACGGTTTCGG TTTTTTGGAC AACGGGCAGC ACATTTTGCT

201  CGGCGCATAC CGGGGCGTGT TGCGCCTGAT GAAAACCATC GGTTCGGATC

251  CCCGTGCCGC CTTTTTGCGC GTACCGCTGC ACTGGCATAT GCACGGCGGT

301  TTGCAGTTCC GCGCCCTCCC CCTGCCCGCG CCGCTGCATA TTTTGGGCGG

351  CGTGCTGCTT GCCCGGCGTG CACCGACTGC ATTCAAAGCC AAACTGCTTG

401  CCGATATGTC CGATTTGCAG AAGTCCGCAC GCCTCGGACA GCCCGACACG

451  ACAGTGGCGC AATGGCTGAA ACAGCGGAAC GTGCCGCGTG CCGCCGTGAT

501  GCAGTTTTGG CAGCCCTTGG TTTGGGGCGC GCTCAACACG CCTTTGGAAA

551  CCGCAAGCCT GCGCGTGTTG TGCAACGTTT TGTCCGACGG CGTGCTGACG

601  AAAAAATCCG GCAGCGACTA TCTCCTACCC AAGCAGGATT TGGGCGCAAT

651  CGTCGCCGAA CCCGCCTTGG CGGATCTTCA ACGGCTCGGC GCGGACATCC

701  GCCTCGAAAC GCGCGTATGC CGTCTGAACA CCCTCCCGGA CGGGAAAGTG

751  CTCGTCAACG GCGAAGCTTT CGATGCCGCC GTCCCCGCCA CCGCGCCCTA

801  CCACGCCGCC GCGCTCCTGC CCGAAGGCAC GCCCGAACAC GTTCAGACGG

851  CATATCAAAA CCTTCGCTAC CACGCCATCA CCACCGTCTA TCTGCGCTAC

901  GCCGAACCCG TCCGCCTGCC CGCCCCGCTG ACCGGCTTTG CCGACGGCAC

951  GGTGCAATGG CTGCTTTGCC GGGGCAGGCT CGGACTGCCT GAAAACGAAG

1001  TGTCCGCCGT CATCAGCGTT TCCGACCGCG TCGGCGCGTT TGCAAACCGG

1051  GCGTGGGCGG ACAAAGCCCA CGCCGACCTC AAACGCATCC TTCCGCATTT

1101  GGGCGAACCC GAAGCCGTGC GCGTCATCAC CGAAAAACGC GCCACAACCG

1151  CAGCCGATGC CCCGCCGCCG GACTTGTCGT GGTTGCACCG GCACCGCATC

1201  TTCCCCGCCG GCGACTACCT CCACCCGGAC TACCCCGCCA CGCTCGAAGC

1251  CGCCGTACAA TCAGGTTTCG CGTCGGCGGA AGCCTGCCTG CAAAGCCTGA

1301  GCGATGCCGT CTGA
```

This corresponds to the amino acid sequence <SEQ ID 3016; ORF 997>:

```
m997.pep
    1  MMNTPHPRPK IAVIGAGWAG LSAAVTLARH ADVTLFEAGR QAGGRARTLA

51  GNTDGFGFLD NGQHILLGAY RGVLRLMKTI GSDPRAAFLR VPLHWHMHGG

101  LQFRALPLPA PLHILGGVLL ARRAPTAFKA KLLADMSDLQ KSARLGQPDT
```

-continued

```
151  TVAQWLKQRN VPRAAVMQFW QPLVWGALNT PLETASLRVL CNVLSDGVLT

201  KKSGSDYLLP KQDLGAIVAE PALADLQRLG ADIRLETRVC RLNTLPDGKV

251  LVNGEAFDAA VPATAPYHAA ALLPEGTPEH VQTAYQNLRY HAITTVYLRY

301  AEPVRLPAPL TGLADGTVQW LLCRGRLGLP ENEVSAVISV SDRVGAFANR

351  AWADKAHADL KRILPHLGEP EAVRVITEKR ATTAADAPPP DLSWLHRHRI

401  FPAGDYLHPD YPATLEAAVQ SGFASAEACL QSLSDAV*
```

Computer analysis of this amino acid sequence gave the following results:
Homology with a Predicted ORF from *N. gonorrhoeae* 15
ORF 997 shows 96.0% identity over a 351 aa overlap with a predicted ORF (ORF 997) from *N. gonorrhoeae*
g997/m997 96.0% identity in 351 aa overlap

```
                    10         20         30         40         50         60
    g997.pep  MMNTPHPRPKIAVIGAGWAGLSAAVTLARHADVTLFEAGRQAGGRARTLAGNTDGFGFLD
              ||||||||||||||||||||||||||||||||||||||||||||||||||||||||||||
    m997      MMNTPHPRPKIAVIGAGWAGLSAAVTLARHADVTLFEAGRQAGGRARTLAGNTDGFGFLD
                    10         20         30         40         50         60

70         80         90        100        110        120
    g997.pep  NGQHILLGAYRGVLRLMKTIGSDPRAAFLRVPLHWHMHGGLQFRALPLPAPLHILGGVLL
              ||||||||||||||||||||||||||||||||||||||||||||||||||||||||||||
    m997      NGQHILLGAYRGVLRLMKTIGSDPRAAFLRVPLHWHMHGGLQFRALPLPAPLHILGGVLL
                    70         80         90        100        110        120

130        140        150        160        170        180
    g997.pep  ARRVPSAFKAKLLADMSDLQKSARLGQPDTTVAQWLKQRNVPRAAVMQFWQPLVWGALNT
              |||:|||||||||||||||||||||||||||||||||||||||||||||||||||||||
    m997      ARRAPTAFKAKLLADMSDLQKSARLGQPDTTVAQWLKQRNVPRAAVMQFWQPLVWGALNT
                   130        140        150        160        170        180

190        200        210        220        230        240
    g997.pep  PLETASLRVLCNVLSDGVLTKKSGSDYLLPKQDLGAIVAEPALAELQRLGADIRLETRVC
              |||||||||||||||||||||||||||||||||||||||||||:||||||||||||||||
    m997      PLETASLRVLCNVLSDGVLTKKSGSDYLLPKQDLGAIVAEPALADLQRLGADIRLETRVC
                   190        200        210        220        230        240

250        260        270        280        290        300
    g997.pep  RLNTLPDGKVLVNGEAFDAAILATAPYHAAALLPEGTPEHVQTAYQNLRYHAITTVYLRY
              |||||||||||||||||||||:||||||||||||||||||||||||||||||||||||||
    m997      RLNTLPDGKVLVNGEAFDAAVPATAPYHAAALLPEGTPEHVQTAYQNLRYHAITTVYLRY
                   250        260        270        280        290        300

310        320        330        340        350
    g997.pep  AEPVRLPAPLTGIADGTAQWLLCPGQAPDCPQNEVSAVISVSDRVGAFANR
              ||||||||||||:||||:|||||:|::     |:||||||||||||||||||
    m997      AEPVRLPAPLTGLADGTVQWLLCRGRL-GLPENEVSAVISVSDRVGAFANRAWADKAHAD
                   310        320        330        340        350
```

The following partial DNA sequence was identified in *N. meningitidis* <SEQ ID 3017>:

```
a997.seq
    1   ATGATGAACA CGCCGCATCC GCGCCCGAAA ATCGCCGTCA TCGGCGCAGG

51   CTGGGCCGGC TTGTCCGCCG CCGTTACCTT GGCGCGGCAC GCCGACGTTA

101   CCCTGTTTGA AGCCGGCCGG CAGGCGGGCG GCAGGGCGCG CGCACTGGCC

151   GGAAATACCG ACGGTTTCGG TTTTTTGGAC AACGGGCAGC ATATTTTACT

201   CGGCGCATAC CGGGGCGTGT TGCGCCTGAT GAAAACCATC GGTTCAGACC

251   CCCATGCCGC CTTTTTGCGC GTACCGCTGC ACTGGCATAT GCACGGCGGT

301   TTGCAGTTCC GCGCCCTCCC CCTGCCCGCG CCCCTGCATA TTTTGGGCGG

351   CGTGCTGCTT GCCCGGCGCG TACCGTCCGC ATTCAAAGCC AAACTGCTTG

401   CCGATATGTC CGATTTGCAG AAGTCCGCAC GCCTCGGACA GCCCGACACG

451   ACAGTGGCGC AATGGCTGAA ACAGCGGAAC GTGCCGCGTG CCGCCGTAAT
```

```
-continued
 501  GCAGTTTTGG CAGCCCTTGG TTTGGGGCGC GCTCAACACG CCTTTGGAAA
 551  CCGCAAGCCT GCGCGTGTTG TGCAACGTTT TGTCCGACGG CGTGCTGACG
 601  AAAAAATCCG GCAGCGACTA TCTCCTACCC AAACAGGATT TGGGCGCAAT
 651  CGTCGCCGAA CCCGCCTTGG CGGAGCTTCA ACGGCTCGGC GCGGACATCC
 701  GCCTCGAAAC GCGCATATGC CGTCTGAACA CCCTCCCGGA CGGGAAAGTG
 751  CTCGTCAACG GCGAACCTTT CGATGCCGCC GTCCCCGCCA CCGCGCCCTA
 801  CCACGCCGCC GCGCTCCTGC CCGAAGGCAC GCCCGAACAC GTTCAGACGG
 851  CATATCAAAA CCTTCGCTAT CACGCCATCA CCACCGTCTA TCTGCGCTAT
 901  GCCGAACCCG TCCGCTTGCC TGCCCCGCTG ACCGGACTTG CCGACGGCAC
 951  GGTGCAATGG CTGCTTTGCC GGGGCAGGCT CGGACTGCCT GAAAACGAAG
1001  TGTCCGCCGT CATCAGCGTT TCCGACCGCG TCGGCGCGTT TGCAAACCGG
1051  GCGTGGGCGG ACAAAGTTCA CGCCGACCTC AAACGCATCC TTCCGCATTT
1101  GGGCGAACCC GAAGCCGTGC GCGTCATCAC CGAAAAACGC GCCACAACCG
1151  CAGCCGATGC CCCGCCGCCG GATTTGTCGT GGTTGCACCG GCACCGCATC
1201  TTCCCCGCCG GCGACTACCT CCACCCAGAC TACCCCGCCA CGCTCGAAGC
1251  CGCCGTACAA TCAGGTTTCG CGTCGGCGGA AGCCTGCCTG CAAAGCCTGA
1301  GCGATGCCGT CTGA
```

This corresponds to the amino acid sequence <SEQ ID 3018; ORF 997.a>:

```
a997.pep
   1  MMNTPHPRPK IAVIGAGWAG LSAAVTLARH ADVTLFEAGR QAGGRARALA
  51  GNTDGFGFLD NGQHILLGAY RGVLRLMKTI GSDPHAAFLR VPLHWHMHGG
 101  LQFRALPLPA PLHILGGVLL ARRVPSAFKA KLLADMSDLQ KSARLGQPDT
 151  TVAQWLKQRN VPRAAVMQFW QPLVWGALNT PLETASLRVL CNVLSDGVLT
 201  KKSGSDYLLP KQDLGAIVAE PALAELQRLG ADIRLETRIC RLNTLPDGKV
 251  LVNGEPFDAA VPATAPYHAA ALLPEGTPEH VQTAYQNLRY HAITTVYLRY
 301  AEPVRLPAPL TGLADGTVQW LLCRGRLGLP ENEVSAVISV SDRVGAFANR
 351  AWADKVHADL KRILPHLGEP EAVRVITEKR ATTAADAPPP DLSWLHRHRI
 401  FPAGDYLHPD YPATLEAAVQ SGFASAEACL QSLSDAV*
```

Computer analysis of this amino acid sequence gave the following results:
Homology with a Predicted ORF from *N. meningitidis*
ORF 997 shows 98.2% identity over a 437 aa overlap with a predicted ORF (ORF 997) from *N. meningitidis*
a997/m997 98.2% identity in 437 aa overlap

```
                    10         20         30         40         50         60
  a997.pep  MMNTPHPRPKIAVIGAGWAGLSAAVTLARHADVTLFEAGRQAGGRARALAGNTDGFGFLD
            ||||||||||||||||||||||||||||||||||||||||||:|||||||||||||||||
  m997      MMNTPHPRPKIAVIGAGWAGLSAAVTLARHADVTLFEAGRQAGGRARTLAGNTDGFGFLD
                    10         20         30         40         50         60

70         80         90        100        110        120
  a997.pep  NGQHILLGAYRGVLRLMKTIGSDPHAAFLRVPLHWHMHGGLQFRALPLPAPLHILGGVLL
            ||||||||||||||||||||||:|||||||||||||||||||||||||||||||||||||
  m997      NGQHILLGAYRGVLRLMKTIGSDPRAAFLRVPLHWHMHGGLQFRALPLPAPLHILGGVLL
                    70         80         90        100        110        120
```

-continued

```
                    130        140        150        160        170        180
a997.pep  ARRVPSAFKAKLLADMSDLQKSARLGQPDTTVAQWLKQRNVPRAAVMQFWQPLVWGALNT
          |||:|:|||||||||||||||||||||||||||||||||||||||||||||||||||||
m997      ARRAPTAFKAKLLADMSDLQKSARLGQPDTTVAQWLKQRNVPRAAVMQFWQPLVWGALNT
                    130        140        150        160        170        180

190        200        210        220        230        240
a997.pep  PLETASLRVLCNVLSDGVLTKKSGSDYLLPKQDLGAIVAEPALAELQRLGADIRLETRIC
          ||||||||||||||||||||||||||||||||||||||||:||||||||||||||||:|
m997      PLETASLRVLCNVLSDGVLTKKSGSDYLLPKQDLGAIVAEPALADLQRLGADIRLETRVC
                    190        200        210        220        230        240

250        260        270        280        290        300
a997.pep  RLNTLPDGKVLVNGEPFDAAVPATAPYHAAALLPEGTPEHVQTAYQNLRYHAITTVYLRY
          ||||||||||||||| |||||||||||||||||||||||||||||||||||||||||||
m997      RLNTLPDGKVLVNGEAFDAAVPATAPYHAAALLPEGTPEHVQTAYQNLRYHAITTVYLRY
                    250        260        270        280        290        300

310        320        330        340        350        360
a997.pep  AEPVRLPAPLTGLADGTVQWLLCRGRLGLPENEVSAVISVSDRVGAFANRAWADKVHADL
          ||||||||||||||||||||||||||||||||||||||||||||||||||||||:||||
m997      AEPVRLPAPLTGLADGTVQWLLCRGRLGLPENEVSAVISVSDRVGAFANRAWADKAHADL
                    310        320        330        340        350        360

370        380        390        400        410        420
a997.pep  KRILPHLGEPEAVRVITEKRATTAADAPPPDLSWLHRHRIFPAGDYLHPDYPATLEAAVQ
          ||||||||||||||||||||||||||||||||||||||||||||||||||||||||||||
m997      KRILPHLGEPEAVRVITEKRATTAADAPPPDLSWLHRHRIFPAGDYLHPDYPATLEAAVQ
                    370        380        390        400        410        420

430
a997.pep  SGFASAEACLQSLSDAVX
          ||||||||||||||||||
m997      SGFASAEACLQSLSDAVX
                    430
``` g999.seq Not found yet
g999.pep Not found yet
The following partial DNA sequence was identified in *N. meningitidis* <SEQ ID 3019>:

```
m999.seq
     1  ATGAATATGA AAAAATTGAT TTCCGCAATT TGTGTTTCAA TTGTTTTATC

51  AGCCTGCAAC CAACAATCAA AAACGGCACA AGCCGAAGAA CCTGTCCAAA

101  GTATCCAGGC TGCTGATTGT ACCGCCCCAA TGGACATCAC AGTTGAACAA

151  TATCTCATCA ATTTGGAGCA AGCATTTAAA ACTCAGAACG TCTCAACAAA

201  AATCCATAAT AAAAATATTG TCAAGACCGA TTGTGGTTAT GACCTTACTT

251  TGGTAATGGA TTTTGGGGCG ATTGCGCTCA AACTGGACGA GCAGCAAAAA

301  ATTAGAGCTA TCTCAGTAGG CTACATTTTA AAACCGACG GAGAGAAAGG

351  ACAAAATCTA GTCAATAATG CCATAAATGG ATTACACAGT ATTCAGGCAG

401  TTCTGTCTTT AACTACCACA GACAAATTGG GCGAATCGGA AGCAGGAAAA

451  CAACTTTTTA CAGCTTTAAC CGAAGTCGTC AAAGAATCCA ATCAGACAGG

501  AGCAACAGCG CAAAAAGACG TTCCGGCAGA TGGTATTTTA TATAGCGTTG

551  TTTTTGAAAA AGAAACAAAC ACCATTGCAA TAATCGGCAG AAAACAACCC

601  TAA
```

This corresponds to the amino acid sequence <SEQ ID 3020; ORF 999>:

```
m999.pep
     1  MNMKKLISAI CVSIVLSACN QQSKTAQAEE PVQSIQAADC TAPMDITVEQ

51  YLINLEQAFK TQNVSTKIHN KNIVKTDCGY DLTLVMDFGA IALKLDEQQK
```

```
101  IRAISVGYIL KTDGEKGQNL VNNAINGLHS IQAVLSLTTT DKLGESEAGK

151  QLFTALTEVV KESNQTGATA QKDVPADGIL YSVVFEKETN TIAIIGRKQP

*
``` a999.seq Not found yet
a999.pep Not found yet

The foregoing examples are intended to illustrate but not to limit the invention.

SEQUENCE LISTING (4168 sequences)

SEQ ID NO: 1 - DNA, 396 bp, Neisseria gonorrhoeae
atgctgccgcaggggaaggcggcgcggagggtgtcggcgaacgaggtgtccggcagggcttgcgcccggatggtgctggtcatctgccagacgctgccgaaacgcgatactttaaacggctcgggtacgcatactttaccggtttgggcgattttgccgaggtcgttgcgcagcaaatcgacaatcatcacgttttcggcgcggtttttcgggtcggtttgtaactcggcggcgcggcgttcgtcttgtccgtcgcccaaaatcggcgcggtgcctttcatcggttcggtgctgatggtgccgtctgaagcgatgttgaggaagagttcgggcgagaaacacagcgtccacgcggattgcccggcttcatcgggcaggtgggacaatacggcatag

SEQ ID NO: 2 - protein, 131 aa, Neisseria gonorrhoeae
MLPQGKAARRVSANEVSGRACARMVLVICQTLPKRDTLNGSGTHTLPVWAILPRSLRSKSTIITFSARFFGSVCNSAARRSSCPSPKIGAVPFIGSVLMVPSEAMLRKSSGEKHSVHADCPASSGRWDNTA

SEQ ID NO: 3 - DNA, 395 bp, Neisseria meningitidis
atgctgccgcaggggaaggcggcgcggaggatgtcggcgaacgaggtgtgcggcasscttssgcttggayggtgctggtcatctgccaaacgctgccgaaacgcgatactttaaacggttcgggtacgcatactgtgccggtttgggcgattttgccgagatcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccctccgcatcgggcaggtgggacaagacggcatag

SEQ ID NO: 4 - protein, 131 aa, Neisseria meningitidis
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
MLPQGKAARRMSANEVCGXLXAWXVLVICQTLPKRDTLNGSGTHTVPVWAILPRSLRSKSTIITFSARFFGSACNSAARRSSCPSPKIGAVPFIGSVLMVPSEPILRKSSGEKHSVHADCPSASGRWDKTA

SEQ ID NO: 5 - DNA, 396 bp, Neisseria meningitidis
atgctgccgcaggggaaggcggcgcggaggatgtcggcgaacgaggtgtgcggcaaggcttgggcttggatggtgctggtcatctgccaaacgctgccgaaacgcgatactttaaacggttcgggtacgcatactgtgccggtttgggcgattttgccgaggtcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccttgtgcatcgggcaggtgggacaaaacggcatag

SEQ ID NO: 6 - protein, 131 aa, Neisseria meningitidis
MLPQGKAARRMSANEVCGKAWAWMVLVICQTLPKRDTLNGSGTHTVPVWAILPRSLRSKSTIITFSARFFGSACNSAARRSSCPSPKIGAVPFIGSVLMVPSEPILRKSSGEKHSVHADCPCASGRWDKTA

SEQ ID NO: 7 - DNA, 663 bp, Neisseria gonorrhoeae
  misc_feature (529)..(529): n is a, c, g, or t
atggtcgtattcgtggctgaaggcgtattcggtcgcgctgttttgggtcacttggtattgctcttcggtcagggtgcgtttgagttcggcgtcactcggttttttatacgttgccgcgtcgaagcctttgccttgcggtgcggctttggttttgcccggcagcggttcgtcggctttgcggatgtcgatgtggcagtagccgttggggtttttaatcaggtagtcctgatggtattcctcggcgtcgtagaagtttttcagcggttcgttttcaacaacgaggggcagttggtatttttgctgctcgcgtttgagggcggcggcgatgacggctttttcggcggggtcggtgtagtacacgccgctgcggtattgcgtgccggtgtcgttaccctgtttgttgaggctggtcggatcaacgacgcggaaataatattgcaggatgtcgtccaggctgagtttgtcggcatcgtaggtcactttgacggtctcggcatgacccgtatggcggtaggacacttcttcgtanctcgggttttccgtgttgccgttggcgttaccggataccgcgtcaaccacgccgtcgatgcgttggaaataggcttccaagccccaaaagcagccgccggcgaagtaaatggtgcccgtgttcatgattgctga

SEQ ID NO: 8 - protein, 219 aa, Neisseria gonorrhoeae
MVVFVAEGVFGRAVLGHLVLLFGQGAFEFGVTRFFIRCRVEAFALRCGFGFARQRFVGFADVDVAVAVGVFNQVVLMVFLGVVEVFQRFVFNNEGQLVFLLLAFEGGGDDGFFGGVGVVHAAAVLRAGVVTLFVEAGRINDAEIILQDVVQAEFVGIVGHFDGLGMTRMAVGHFFVRVFRVAVGVTGYRVNHAVDALEIGFQAPKAAAGEVNGARVHDC

SEQ ID NO: 9 - DNA, 662 bp, Neisseria meningitidis
atggtcgtattcgtggctgaaggcatattcggtcgcgctgttttgggtaacttgstattgctcttcggtcagggtgcgtttgagttcggcgtcactcggttttttatacgttgccgcgtcgaagcctttgccttgcggggcggtcttggttttgcccggcagcggttcgtcagckttgcggatgtcgatgtggcagtagccgttggggtttttaatcaagtagtcctgatggtattcctcggcatcgtagaagtttttcagcggctcgttttcaacaacgaggggcagttggtatttttgctgctcgcgtttgagggcgkcggcgatgacggctttttcgkcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagcgccggcgaggtaaatggtgcgcgtgttcatgatttttga

SEQ ID NO: 10 - protein, 219 aa, Neisseria meningitidis
  misc_feature (19)..(19): Xaa can be any naturally occurring amino acid
  misc_feature (59)..(59): Xaa can be any naturally occurring amino acid
  misc_feature (107)..(107): Xaa can be any naturally occurring amino acid
  misc_feature (114)..(114): Xaa can be any naturally occurring amino acid
  misc_feature (208)..(208): Xaa can be any naturally occurring amino acid
MVVFVAEGIFGRAVLGNLXLLFGQGAFEFGVTRFFIRCRVEAFALRGGLGFARQRFVSXADVDVAVAVGVFNQVVLMVFLGIVEVFQRLVFNNEGQLVFLLLAFEGXGDDGFFXGVGVVHAAAVLRTGVVALFVEAGRINDAEEILQDVVAEFVGIVGHFDGFGVARMAVGHVFIARIFRVAVGVAGYRVNHAVDALEIGFQAPEAAXGEVNGARVHDF

SEQ ID NO: 11 - DNA, 663 bp, Neisseria meningitidis
atggtcgtattcgtggctgaaggcatattcggtcgcgctgttttgggtaacttggtattgctcttcggtcagggtgcgtttgagttcggcgtcactcggttttttatacgttgccgcgtcgaagcctttgccttgcggtgcggtcttggttttgcccggcagcggttcgtcggctttgcggatatcgatgtggcagtagccgttggggtttttaatcaagtagtcctgatggtattcctcggcatcgtagaagtttttcagcggctcgttttcaacaacgaggggcagttggtatttttgctgctcgcgtttgagggcggcggcgatgacggctttttcggcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagccgccggcgaggtagatggtgcgcgtgttcatgatttttga

SEQ ID NO: 12 - protein, 219 aa, Neisseria meningitidis
MVVFVAEGIFGRAVLGNLVLLFGQGAFEFGVTRFFIRCRVEAFALRCGLGFARQRFVGFADIDVAVAVGVFNQVVLMVFLGIVEVFQRLVFNNEGQLVFLLLAFEGGGDDGFFGGVGVVHAAAVLRTGVVALFVEAGRINDAEEILQDVVAEFVGIVGHFDGFGVARMAVGHVFIARIFRVAVGVAGYRVNHAVDALEIGFQAPEAAAGEVDGARVHDF

SEQ ID NO: 13 - DNA, 777 bp, Neisseria gonorrhoeae
atggtagaacggcatatccagcatttgcggaacggtcatcttcatttgatgcgcccatgccaacaagtgagccaaatgttcggcggcagggcctacgatttccgcgccgataaagcggccggtggctttttcggcatacaggcgcatatggcctttgtttaccagcatcacgcggctgcgaccttgatttttgaacgatacttcgccgatgacaaattcgtcggcttggtattgcgcggcaacctgcgcgtatttcaaaccgacaaagccgatttgcggactggtaaacaccacgccaatggtgctgcggcgcaaaccgctgccgatattcgggtagcggccccgcgttattgcccggcaatcttaccttggtcggcggcttcatgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctgaaacaacggggtcggaaatgccgccgatgattccgcccaaaccgaaaatttcaactttcacacccaaacggtgcaatgcctga

SEQ ID NO: 14 - protein, 258 aa, Neisseria gonorrhoeae
MVERHIQHLRNGHLHLMRPCQQVSQMFGGRAYDFRADKAAGGFFGIQAHMAFVYQHHAAATLIFERYFADDKFVGLVLRGNLRVFQTDKADLRTGKHHANGAAAQTAADIRVAAPRYCPAILPWSAASCSRGSWLDASPAIKICGMLVCMVSGSATGTPRASLSILMFSKPILSTFGRRPTAANIYSATNTPFSPSCSQWTSTLPSASSLTSVLASRCSFNSSPNTAFASSETTGSEMPPMIPPKPKISTFTPKRCNA

SEQ ID NO: 15 - DNA, 774 bp, Neisseria meningitidis
atggtagaacggcatatccagcatttgcggaacggtcatcttcatttgatgtgcccaagccaacaggtgcgccaaatgttcggcggcagggcctacgatttccgcgccgataaagcggccggtggctttttcggcatacaggcgcatatggcctttgttcaccagcatcacgcggctgcggccttggtttttgaacgatacttcgccgatgacaaattcgtcggcttggtattgcgcggcaacctgcgcgtatttcagaccgacaaagccgatttgcggactggtaaacaccacgccgatggtgctgcgccgcaaaccgccgccgatattcgggtagcggccgcgttatcgccggcaatcttgccttggtcggcagcttcatgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctgaaacgacggggtcggaaatgccgccgatgattccgcccaaaccgaaaatttcaactttcacgcccaaacggtgcaatgcctga

SEQ ID NO: 16 - protein, 257 aa, Neisseria meningitidis
MVERHIQHLRNGHLHLMCPSQQVRQMFGGRAYDFRADKAAGGFFGIQAHMAFVHQHHAAAALVFERYFADDKFVGLVLRGNLRVFQTDKADLRTGKHHADGAAPQTAADIRVAAALSPAILPWSAASCSRGSWLDASPAMKICGILVCMVSGSATGTPRASFSILIFSKPILSTFGRRPTAASIYSATNTPFSPSCSQWTSTLPSASSLTSVLASRCSFNSSPNTAFASSETTGSEMPPMIPPKPKISTFTPKRCNA

SEQ ID NO: 17 - DNA, 774 bp, Neisseria meningitidis
atggtagaacggcatatccagcatttgcggaacggtcatcttcatttgatgtgcccaagccaacaggtgcgccaaatgttcggcggccggacctacgatttctgcgccgatgaagcggccggtggctttttcggcatacaggcgcatatggcctttgtttaccagcatcacgcggctgcggccttggtttttgaacgatacttcgccgatgacaaattcgtcggcttggtattgcgcggcaacctgcgcgtatttcaaaccgacaaagccgatttgcggactggtgaacactacgccgatggtgctgcggcgcaaaccgccgccgatattcgggtagcggccgcgttatcgccggcaatcttgccttggtcggcggcttcatgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctgaaacgacggggtcggaaatgccgccgatgatgccacccaaaccgaaaatttcaactttcacgcccaaacggtgcaatgcctga

SEQ ID NO: 18 - protein, 257 aa, Neisseria meningitidis
MVERHIQHLRNGHLHLMCPSQQVRQMFGGRTYDFCADEAAGGFFGIQAHMAFVYQHHAAAALVFERYFADDKFVGLVLRGNLRVFQTDKADLRTGEHYADGAAAQTAADIRVAAALSPAILPWSAASCSRGSWLDASPAIKICGILVCIVSGSATGTPRASFSILMFSKPILSTFGRRPTAASIYSATNTPFSPSCSQWTSTLPSASSLASVLASKCSFNSSPNTAFASSETTGSEMPPMMPPKPKISTFTPKRCNA

SEQ ID NO: 19 - DNA, 1107 bp, Neisseria gonorrhoeae
atggggatggacaatattgatatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacagatttttcggaaaattataaaaaacagcggcaatcgtttgaaacattctttttaagcgaggaagagacaaaacatcaggaaaaaaaagaaaagaaaaaggaaaaggcggaagccaaagcagagaaaaagcgtttgaaggagggcggggagaaatctgccgaaacgcaaaaatcccgcctttttgtgttggattttgacggcgatttgtatgcacacgccgtagaatccttgcgtcatgagattacggcggtgcttttgattgccaagcctgaagatgaggttctgctcagattggaaagtccgggcggcgtggttcacggttacggtttggcggcttcgcagcttaggcgtttgcgcgaacgcaatattccgctgaccgtcgccgtcgataaggtcgcggcaagcggcggctatatgatggcgtgtgtggcggataaaattgtttccgctccgtttgcggtcatcggttcggtgggtgtggtggcggaagtgccgaatatccaccgcctgttgaaaaaacatgatattgatgtggatgtgatgacggcgggcgaatttaagcgcacggttacttttatgggtgaaaatacggaaaagggcaaacagaaattccggcaggaactggaggaaacgcatcagttgttcaagcagtttgtcagtgaaaaccgccccgggttggatattgaaaaaatagcgacgggcgagcattggttcggccggcaggcgttggcgttgaacttgattgacgagatttcgaccagtgatgatttgttgttgaaagcgtttgaaaacaaacaggttatcgaagtgaaatatcaggagaagcgaagcctgatccagcgcattggtttgcaggcggaagcttccgttgaaaagttgtttgccaaacttgtcaaccggcgagcggatgtgatgtag

SEQ ID NO: 20 - protein, 368 aa, Neisseria gonorrhoeae
MGMDNIDMFMPEQEEIQSMWKEILLNYGIFLLELLTVFGAIALIVLAIVQSKKQSESGSVVLTDFSENYKKQRQSFETFFLSEEETKHQEKKEKKKEKAEAKAEKKRLKEGGEKSAETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAVIGSVGVVAEVPNIHRLLKKHDIDVDVMTAGEFKRTVTFMGENTEKGKQKFRQELEETHQLFKQFVSENRPGLDIEKIATGEHWFGRQALALNLIDEISTSDDLLLKAFENKQVIEVKYQEKRSLIQRIGLQAEASVEKLFAKLVNRRADVM

SEQ ID NO: 21 - DNA, 1100 bp, Neisseria meningitidis
  misc_feature (350)..(350): n is a, c, g, or t
  misc_feature (374)..(581): n is a, c, g, or t
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggawagcggcagtgtcgtactgacggatttttcggaaaattataaaaaacagcggcaatcgtttgaagcattctttttaagcggggaagaggcacaacatcaggaaaaagaggaaaagaaaaaggaaaaggcggaagccaaagcagagaaaaacgtttgaaggagggtggggagaaatctgccgaaacgcanaaatcacgcctttttgtgttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagcggcggttatatgatggcgtgtgtggcggataaaattgcttccgctccgtttgcgattgtcggttcggtgggtgtggtggcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 22 - protein, 366 aa, Neisseria meningitidis
  misc_feature (54)..(54): Xaa can be any naturally occurring amino acid
  misc_feature (104)..(104): Xaa can be any naturally occurring amino acid
  misc_feature (117)..(117): Xaa can be any naturally occurring amino acid
  misc_feature (125)..(194): Xaa can be any naturally occurring amino acid
MDNIDMFMPEQEEIQSMWKEILLNYGIFLLELLTVFGAIALIVLAIVQSKKQSXSGSVVLTDFSENYKKQRQSFEAFFLSGEEAQHQEKEEKKKEKAEAKAEKXRLKEGGEKSAETXKSRLFVLXXXXXXXXXXXXXXXXXXXXXXXXXXXXXXXXXXXXXXXXXXXXXXXXXXXXXXXXXXXXXXXXXXXXXXASGGYMMACVADKIASAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 23 - DNA, 1101 bp, Neisseria meningitidis
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacggatttttcggaaaattataaaaaacagcggcaatcgtttgaagcattctttttaagcggggaagaggcaaaacatcaggaaaaagaggaaaagaaaaaggaaaaggcggaagccaaagcagagaaaaagcgtttgaaggagggtggggagaaatcttccgaaacgcaaaaatcccgcctttttgtgttggattttgacggcgatttgtatgcacacgccgtagaatccttgcgtcatgagattacggcggtgcttttgattgccaagcctgaagatgaggttctgcttagattggaaagtccgggcggcgtggttcacggttacggtttggcggcttcgcagcttaggcgtttgcgcgaacgcaatattccgctgaccgtcgccgtcgataaggtggcggcgagcggtggttatatgatggcgtgtgtggcggataaaattgtttccgctccgtttgcgattgtcggttcggtgggtgttgtagcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 24 - protein, 366 aa, Neisseria meningitidis
MDNIDMFMPEQEEIQSMWKEILLNYGIFLLELLTVFGAIALIVLAIVQSKKQSESGSVVLTDFSENYKKQRQSFEAFFLSGEEAKHQEKEEKKKEKAEAKAEKKRLKEGGEKSSETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 25 - DNA, 462 bp, Neisseria gonorrhoeae
atgctgctggtgctggaattttggttcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 26 - protein, 153 aa, Neisseria gonorrhoeae
MLLVLEFWFGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 27 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 28 - protein, 153 aa, Neisseria meningitidis
MLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 29 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 30 - protein, 153 aa, Neisseria meningitidis
MLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 31 - DNA, 867 bp, Neisseria gonorrhoeae
atgtggaaaatgttgaaacacatagccaaaacccaccgcaagcgattgattggcacattttccccggtcggactggaaaaccttttgatgctggggtatccggtgtttggcggctgggcgattaatgccgtgattgcggggagggtgtggcaggcgttgctgtacgctttggttgtatttttgatgtggctggtcggtgcggcacggcggattgccgatacgcgcacgtttacgcggatttataccgaaatcgccgtgccggttgtgttggaacaacggcagcggcaagtcccgcattcagcggtaactgcacgggttgccctgtcgcgtgaatttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 32 - protein, 288 aa, Neisseria gonorrhoeae
MWKMLKHIAKTHRKRLIGTFSPVGLENLLMLGYPVFGGWAINAVIAGRVWQALLYALVVFLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 33 - DNA, 867 bp, Neisseria meningitidis
atgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 34 - protein, 288 aa, Neisseria meningitidis
MWKMLKHIAQTHRKRLIGTFSLVGLENLLMLVYPVFGGRAINAVIAGEVWQALLYALVVLLMWLVGAVRRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 35 - DNA, 843 bp, Neisseria meningitidis
agccaaaaccaccgcaagcgattgattggcacattttttctggtcggactggaaaaccttttgatgctggtgtatccggtgtttggcggctgggcgattaatgccgtgattgcggggcaggcgtggcaggcgttgctgtacgctttggttgtgcttttgatgtggctggtcggtgcggcgcggcggattgccgatacgcgcacgtttacgcggatttataccgaaatcgccgtgccggttgtgttggaacagcggcagcggcaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 36 - protein, 280 aa, Neisseria meningitidis
SQNHRKRLIGTFFLVGLENLLMLVYPVFGGWAINAVIAGQAWQALLYALVVLLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 37 - DNA, 342 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactgtattatgaacaaaccgcacgtcctgctgcacagcatggtcaaaggcatcgacgggacattcaaagtggagcggcaaaacctacgacggatttatgcccgcaaccgccatcagcgatgcggacattgccgccgtcgccacttatatcatgaacgcctttga

SEQ ID NO: 38 - protein, 113 aa, Neisseria gonorrhoeae
MNTTRLPTAFILCCLCAAASAADNSIMTKGQKVYESNCIACHGKKGEGRGTAFPPLFRSDCIMNKPHVLLHSMVKGIDGTFKVERQNLRRIYARNRHQRCGHCRRRHLYHERL

SEQ ID NO: 39 - DNA, 341 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttga

SEQ ID NO: 40 - protein, 113 aa, Neisseria meningitidis
  misc_feature (84)..(84): Xaa can be any naturally occurring amino acid
MNTTRLPTALVLGCFCAAASAADNSIMTKGQKVYESNCVACHGKKGEGRGTMFPPLYRSDFIMKKPQVLLHSMVKGINGTIKVXRQNLQRIHARNRHQRCGHCRRRHLYHERL

SEQ ID NO: 41 - DNA, 341 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttga

SEQ ID NO: 42 - DNA, 341 bp, Neisseria meningitidis; identical to SEQ ID NO: 41

SEQ ID NO: 43 - DNA, 399 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactatattatgaacaaaccgcacgtcctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaggcaaaaaaaac

SEQ ID NO: 44 - protein, 133 aa, Neisseria gonorrhoeae
MNTTRLPTAFILCCLCAAASAADNSIMTKGQKVYESNCIACHGKKGEGRGTAFPPLFRSDYIMNKPHVLLHSMVKGINGTIKVNGKTYNGFMPATAISDADIAAVATYIMNAFDNGGGSVTEKDVKQAKGKKN

SEQ ID NO: 45 - DNA, 402 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaagcaaaaaaaactaa

SEQ ID NO: 46 - protein, 133 aa, Neisseria meningitidis
MNTTRLPTALVLGCFCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKSKKN

SEQ ID NO: 47 - DNA, 396 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttgacaacggcggcggaagcgttaccgaaaaagacgtaaaacaggcaaaaaacaaaaaa

SEQ ID NO: 48 - protein, 132 aa, Neisseria meningitidis
MNTTRLPTALVLGCLCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKNKK

SEQ ID NO: 49 - DNA, 495 bp, Neisseria gonorrhoeae
atgaacaacagacattttgccgtcatcgccttgggcagcaaccttgacaaccccgcacaacaaatacgcggcgcattagacgcgctctcgtcccatcctgacatccggcttgaacaggtttcctcactgtatatgaccgcacctgtcggttacgacaatcagcccgatttcatcaatgccgtctgcaccgtttccaccaccttggacggcattgccctgcttgccgaactcaaccgtatcgaagccgatttcggacgcgaacgcagtttccgcaatgcaccgcgcacattggatttggacattatcgactttgacggcatctccagcgacgacccccgccttaccctgccgcatccgcgcgcgcacgaacgcagtttcgtcatacgccctttggcagaaatcctccctgattttattttgggaaaatacggaaaggttgtcgaattgtcaaaacggctgggcaatcaaggcatccgtcttttaccggacaggtaa

SEQ ID NO: 50 - protein, 164 aa, Neisseria gonorrhoeae
MNNRHFAVIALGSNLDNPAQQIRGALDALSSHPDIRLEQVSSLYMTAPVGYDNQPDFINAVCTVSTTLDGIALLAELNRIEADFGRERSFRNAPRTLDLDIIDFDGISSDDPRLTLPHPRAHERSFVIRPLAEILPDFILGKYGKVVELSKRLGNQGIRLLPDR

SEQ ID NO: 51 - DNA, 497 bp, Neisseria meningitidis
atgaacaacagacattttgccgtcatcgccctgggcagtaatcttgaaaaccctgctcaacaggtacgcgccgcattggacacgctgtcgtcccatcctgacatccgtcttaaacaggcttcctcactgtatatgaccgcgcccgtcggttacgacaatcagcccgattttgtcaatgccgtctgcaccgtttccaccactctggacggcattgccytgcttgccgaactcaaccgtatcgaggctgatttcggacgcgaacgcagcttccgcaacgcgccgcgcacattgkatttggacattatcgactttgacggcatctccagcgacgacacscgactcaccttgccgcatccgcgcgcgcacgaacgcagtttcgtcatccgccctttggcagaaatcctccctgattttgttttaggaaaacacggaaaggttgccgaattgtcaaaacggytgggcaatcaaggtatccgtcttttaccggacaggtaatt

SEQ ID NO: 52 - protein, 164 aa, Neisseria meningitidis
  misc_feature (98)..(98): Xaa can be any naturally occurring amino acid
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLXLDIIDFDGISSDDTRLTLPHPRAHERSFVIRPLAEILPDFVLGKHGKVAELSKRLGNQGIRLLPDR

SEQ ID NO: 53 - DNA, 495 bp, Neisseria meningitidis
atgaacaacagacattttgccgtcatcgccctgggcagtaatcttgaaaaccctgcccaacaggtacgcgccgcattggacacgctgtcgtcccatcctgacatccgtcttaaacaggcttcctcactgtatatgaccgcgcccgtcggttacgacaatcagcccgatttcgtcaatgccgtctgcaccgtttccaccaccttggacggcattgccctgcttgccgaactcaaccgtatcgaagccgatttcggacgcgaacgcagcttccgcaacgcgccgcgcacattggatttggacattatcgactttgacggcatctccagcgacgacccccgactcaccctgccgcatccgcgcgcgcacgaacgcagtttcgtcatacgccctttggcagaaatcctccctgattttattttgggaaaacacggaaaggttgccgaattgtcaaaacggctgggcaatcaaggcatccgtcttttaccggataagtaa

SEQ ID NO: 54 - protein, 164 aa, Neisseria meningitidis
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLDLDIIDFDGISSDDPRLTLPHPRAHERSFVIRPLAEILPDFILGKHGKVAELSKRLGNQGIRLLPDK

SEQ ID NO: 55 - DNA, 261 bp, Neisseria gonorrhoeae
atgccccgcgctgccgtagcctttgagcgtcatcatcacaaaagcaaagccgaacaaaatacccatcgccgcgccgacgcagagatagccgaaggcttcgcggttggaaatcagcacacgcaggcgcgaaaccagtccgtaatggcggtacagctgccgctcgtcgccttttcggataaagtggttgtcgcgttccaagctgttgttcaggcggaaatacaggttttcgctgatggcggcaaaacgtggcaaaagccataa

SEQ ID NO: 56 - protein, 86 aa, Neisseria gonorrhoeae
MPRAAVAFERHHHKSKAEQNTHRRADAEIAEGFAVGNQHTQARNQSVMAVQLPLVAFSDKVVVAFQAVVQAEIQVFADGGKTWQKP

SEQ ID NO: 57 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtacagctgccgccggtcgccttttcggataaagtggttgtcgcgttccaagctgttgttcaggcggaaatacaggttttcgctgatggcggcaaaacgtggcaaaagccataa

SEQ ID NO: 58 - protein, 86 aa, Neisseria meningitidis
MPRAAVAFERHHHKSKAEQNTHRRADAEIAEGFAVGNQHTQARKQSVMAVQLPPVAFSDKVVVAFQAVVQAEIQVFADGGKTWQKP

SEQ ID NO: 59 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtccagctgccgctcgtcgccttttcggataaagtggttgtcgcgttccaagctgttcttcaggcggaaatacaggttttcgctgatggcggcaaaacgtggcaaaagccataa

SEQ ID NO: 60 - protein, 86 aa, Neisseria meningitidis
MPRAAVAFERHHHKSKAEQNTHRRADAEIAEGFAVGNQHTQARKQSVMAVQLPLVAFSDKVVVAFQAVLQAEIQVFADGGKTWQKP

SEQ ID NO: 61 - DNA, 1248 bp, Neisseria gonorrhoeae
atgggttttcctgttcgcaagtttgatgccgtgattgtcggcggtggcggtgcaggtttacgtgcagccctccaattatccaaatccggtttgaattgtgccgttttgtctaaagtgttcccgacccgctcgcataccgtagcggcgcagggcggtatttccgcctctctgggtaatgtgcaggaggaccgttgggactggcacatgtacgataccgtgaaaggttccgactggctgggcgaccaagatgcgattgagtttatgtgtcgcgctgcgcctgaagcggtgattgagttggaacacatgggtatgccttttgaccgcgttgaaagcggcaaaatttatcagcgtcctttcggcggacatactgccgaacatggtaaacgtgcggtagaacgtgcatgtgcggttgccgaccgtaccggtcatgcgatgttgcatactttgtaccaacaaaacgtccgtgccaatacacaattctttgtggaatggacggcgcaagatttgattcgtgatgaaaacggcgatgtcgtcggcgtaaccgccatggaaatggaaacgggcgaagtttatattttccacgccaaggccgtgatgtttgctaccggtggcggcggtcgtatttatgcttcttctaccaatgcttatatgaataccggtgacggtttgggcatttgcgcccgtgcgggcattccgttggaagatatggaattctggcaattccacccgaccggcgtggcgggtgcgggcgtgttgattaccgaaggcgtacgcggcgagggcggtattctgttgaacgccgacggcgaacgctttatggaacgctatgcgccgaccgtaaaagacttggcttctcgcgacgtggtttcacgcgcgatggcgatggaaatctatgaaggtcgcggctgtggtaaaaacaaagaccacgtcttactgaaaatcgaccatatcggtgcagaaaaaattatggaaaaactgccgggcatccgcgagatttccattcagtttgccggtatcgatccgattaaagacccgattccggttgtgccgactacccactatatgatgggcggcattccgaccaattatcacggtgaagttgttgttccgcaaggcgacgagtacgaagtacctgtaaaaggcctgtatgccgcaggtgagtgcgcctgtgcttccgtacacggtgcgaaccgtttgggtacgaactccctgctggacttggtggtgttccgcccaaccccccggtga

SEQ ID NO: 62 - protein, 415 aa, Neisseria gonorrhoeae
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFRPTPR

SEQ ID NO: 63 - DNA, 696 bp, Neisseria meningitidis
  misc_feature (1)..(1): n is a, c, g, or t
  misc_feature (100)..(100): n is a, c, g, or t
ntccaattatccaaatccggtctgaattgtgccgttttgtctaaagtgttcccgacccgttcgcataccgtagcggcgcagggcggtatttccgcctctntgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgyctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccagccgaccggcgtggcgggtgcgggcgtgttgattaccgaa

SEQ ID NO: 64 - protein, 202 aa, Neisseria meningitidis
  misc_feature (1)..(1): Xaa can be any naturally occurring amino acid
  misc_feature (34)..(34): Xaa can be any naturally occurring amino acid
XQLSKSGLNCAVLSKVFPTRSHTVAAQGGISASXGNVQEDRWDWHMYDTVKGSDWLGDQDAIEFMCRAAPEAVIELEHMGMPFDRVESGKIYQRPFCAVADRTGHAMLHTLYQQNVRANTQFFVEWTAQDLIRDENGDVVGVTAMEMETGEVYIFHAKAVMFATGGGGRIYASSTNGIPLEDMEFWQFQPTGVAGAGVLITE

SEQ ID NO: 65 - DNA, 1764 bp, Neisseria meningitidis
  misc_feature (67)..(67): n is a, c, g, or t
  misc_feature (408)..(408): n is a, c, g, or t
atgggctttcctgttcgcaagtttgatgccgtgattgtcggcggtggtggtgcaggtttacgcgcanccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcngttgccgaccgtacaggtcatgcgatgctgcatactttgtaccaacaaaatgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggccgtatttatgcgtcttctaccaatgcctatatgaataccggcgatggtttgggtatttgtgcgcgtgcaggtatcccgttggaagacatggaattctggcaattccacccgaccggcgtggcaggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggtattccgaccaactaccatggcgaagttgtcgttcctcaaggcgacgaatacgaagtgcctgtaaaaggtctgtatgcggcaggtgagtgcgcctgtgcttccgtacacggtgcgaaccgcttgggtacgaactccctgctggacttagtggtattcggtaaagctgccggcgacagcatgattaaattcatcaaagagcaaagcgactggaaacctttgcctgctaatgccggcgaactgacccgccaacgtatcgagcgtttggacaatcaaactgatggtgaaaacgttgatgcattgcgccgcgaactgcaacgctccgtacaattgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctaattgaagtggcgaaagcgactttggtgtctgccgaagcacgtaaagaatcacgcggtgcgcacgcttcagacgaccatcctgagcgcgatgatgaaaactggatgaaacatacgctgtaccattcagatgccaataccttgtcctacaaaccggtgcacaccaagcctttgagcgtggaatacatcaaaccggccaagcgcgtttattga

SEQ ID NO: 66 - protein, 587 aa, Neisseria meningitidis
  misc_feature (23)..(23): Xaa can be any naturally occurring amino acid
MGFPVRKFDAVIVGGGGAGLRAXLQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDANTLSYKPVHTKPLSVEYIKPAKRVY

SEQ ID NO: 67 - DNA, 1248 bp, Neisseria gonorrhoeae; identical to SEQ ID NO: 61

SEQ ID NO: 68 - protein, 415 aa, Neisseria gonorrhoeae; identical to SEQ ID NO: 62

SEQ ID NO: 69 - DNA, 1767 bp, Neisseria meningitidis
atgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatga

SEQ ID NO: 70 - protein, 587 aa, Neisseria meningitidis
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGEDYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDINTLSYKPVHTKPLSVEYIKPAKRVY

SEQ ID NO: 71 - DNA, 1764 bp, Neisseria meningitidis; identical to SEQ ID NO: 65
  misc_feature (67)..(67): n is a, c, g, or t
  misc_feature (408)..(408): n is a, c, g, or t

SEQ ID NO: 72 - protein, 587 aa, Neisseria meningitidis; identical to SEQ ID NO: 66
  misc_feature (23)..(23): Xaa can be any naturally occurring amino acid

SEQ ID NO: 73 - DNA, 543 bp, Neisseria gonorrhoeae
atgaagacacaccgcaagacctgctctgcggtgtgttttgcttttcagacggcatcgaaacccgccgtttccatccgacatcccagcgaggacatcatgagcctgaaaacccgccttaccgaagatatgaaaaccgcgatgcgcgccaaagatcaagtttccctcggcaccatccgcctcatcaatgccgccgtcaaacagtttgaagtagacgaacgcaccgaagccgacgatgccaaaatcaccgccatcctgaccaaaatggtcaaacagcgcaaagacggcgcgaaaatctacactgaagccggccgtcaggatttggcagacaaagaaaacgccgaaatcgacgtgctgcaccgctacctgccgcaaatgctctccgccggcgaaatccgcaccgccgtcgaagcagccgttgccgaaaccggcgcggcaggtatggcggatatgggcaaagtgatggtcgtattgaaaacccgcctcgccggcaaagccgatatgggcgaagtcaacaaaatcttgaaaaccgtactgaccgcctga

SEQ ID NO: 74 - protein, 180 aa, Neisseria gonorrhoeae
MKTHRKTCSAVCFAFQTASKPAVSIRHPSEDIMSLKTRLTEDMKTAMRAKDQVSLGTIRLINAAVKQFEVDERTEADDAKITAILTKMVKQRKDGAKIYTEAGRQDLADKENAEIDVLHRYLPQMLSAGEIRTAVEAAVAETGAAGMADMGKVMVVLKTRLAGKADMGEVNKILKTVLTA

SEQ ID NO: 75 - DNA, 497 bp, Neisseria meningitidis
atgaggacacaccgcaagacctgctctgcggtgtgttttgcttttcagacggcatcgaaacccgccgtttccatccgacatcccagcgaggacatcatgagcctgaaaatccgccttaccgaagacatgaaaaccgcgatgcgcgccaaagaccaagtttccctcggcaccatccgcctcatcaacgccgccgtcaaacagtttgaagtggacgaacgcaccgaagccgacgatgccaaaatcaccgccatcctgaccaaaatggtcaaacagcgaaaagacagcgcgaaaatctacactgaagccggccgtcaggatttggcagacaaagaaaacgccgaaatcgaggtactgcaccgctaccttccccaaatgctttccgccggcgaaatccgtaccgaggtcgaagctgccgttgccgaaaccggcgcggcaggtatggcggatatgggtaaagtcatggggctgctgaaaacccgcctcgcaggtaaagccga

SEQ ID NO: 76 - protein, 165 aa, Neisseria meningitidis
MRTHRKTCSAVCFAFQTASKPAVSIRHPSEDIMSLKIRLTEDMKTAMRAKDQVSLGTIRLINAAVKQFEVDERTEADDAKITAILTKMVKQRKDSAKIYTEAGRQDLADKENAEIEVLHRYLPQMLSAGEIRTEVEAAVAETGAAGMADMGKVMGLLKTRLAGKA

SEQ ID NO: 77 - DNA, 657 bp, Neisseria gonorrhoeae
atgctcgcccgtcgctattttttcaatatccaacccggggcggttttcactgacaaactgcttgaacaactgatgcgtttcctccagttcctgccggaatttctgtttgcccttttccgtattttcacccataaaagtaaccgtgcgcttaaattcgcccgccgtcatcacatccacatcaatatcatgttttttcaacaggcggtggatattcggcacttccgccaccacacccaccgaaccgatgaccgcaaacggagcggaaacaattttatccgccacacacgccatcatatagccgccgcttgccgcgaccttatcgacggcgacggtcagcggaatattgcgttcgcgcaaacgcctaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccgccctccttcaaacgctttttctctgctttggcttccgccttttcctttttcttttcttttttttcctgatgttttgtctcttcctcgcttaa

SEQ ID NO: 78 - protein, 218 aa, Neisseria gonorrhoeae
MLARRYFFNIQPGAVFTDKLLEQLMRFLQFLPEFLFALFRIFTHKSNRALKFARRHHIHINIMFFQQAVDIRHFRHHTHRTDDRKRSGNNFIRHTRHHIAAACRDLIDGDGQRNIAFAQTPKLRSRQTVTVNHAARTFQSEQNLIFRLGNQKHRRNLMTQGFYGVCIQIAVKIQHKKAGFLRFGRFLPALLQTLFLCFGFRLFLFLFFFFLMFCLFLA

SEQ ID NO: 79 - DNA, 657 bp, Neisseria meningitidis
  misc_feature (310)..(519): n is a, c, g, or t
  misc_feature (541)..(541): n is a, c, g, or t
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacacaaaaaggcgtgatttntgcgtttcggcagatttctccccaccctccttcaaacgtttttcctctgctttggcttccgccttttcctttttcttttcctctttttcctgatgttgtgcctcttccccgcttaa

SEQ ID NO: 80 - protein, 217 aa, Neisseria meningitidis
  misc_feature (104)..(173): Xaa can be any naturally occurring amino acid
  misc_feature (180)..(180): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARXXXXXXXXXXXXXXXXXXXXXXXXXXXXXXXXXXXXXXXXXXXXXXXXXXXXXXXXXXXXXXXXXXXXXXQHKKAFXRFGRFLPTLLQTFFLCFGFRLFLFLFLFFLMLCLFPA

SEQ ID NO: 81 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgctacaacacccaccgaaccgacaatcgcaaacggagcggaaacaattttatccgccacacacgccatcatataaccaccgctcgccgccaccttatcgacggcgacggtcagcggaatattgcgttcgcgcaaacgcctaagctgcgaagccgccaaaccgtaaccgtgaaccacgccgcccggactttccaatctaagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggaagatttctccccaccctccttcaaacgctttttctctgctttggcttccgccttttcctttttcttttcctctttttcctgatgttttgcctcttccccgcttaa

SEQ ID NO: 82 - protein, 218 aa, Neisseria meningitidis
MLARCHFLNIQLRAVLADKLLEQLMRFLQFLSEFLFALFRIFTHKSNRALKFARRHHIHINIMFFQQAVDIRYFRYNTHRTDNRKRSGNNFIRHTRHHITTARRHLIDGDGQRNIAFAQTPKLRSRQTVTVNHAARTFQSKQNLIFRLGNQKHRRNLMTQGFYGVCIQIAVKIQHKKAGFLRFGRFLPTLLQTLFLCFGFRLFLFLFLFFLMFCLFPA

SEQ ID NO: 83 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaa

SEQ ID NO: 84 - protein, 218 aa, Neisseria meningitidis
  misc_feature (121)..(121): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARRHLIDGDGQRNIAFAQTXKLRSRQTVTVNHAARTFQSEQNLIFRLGNQKHRRNLMTQGFYGVCIQIAVKIQHKKAGFLRFGRFLPTLLQTLFLCFGFRLFLFLFLFFLMFCLFPA

SEQ ID NO: 85 - DNA, 657 bp, Neisseria meningitidis; identical to SEQ ID NO: 81

SEQ ID NO: 86 - protein, 218 aa, Neisseria meningitidis; identical to SEQ ID NO: 82

SEQ ID NO: 87 - DNA, 318 bp, Neisseria gonorrhoeae
atgcctttgaccatgctgtgcagcaggacgtgcggtttgttcataatacagtccgaccggaaaagcggaggaaacgcagtgccgcgcccttcccctttcttgccgtggcaggcgatgcagttggattcgtacactttttgcccttttgtcatgatgctgttgtcggcggcagaagcggcggcgcagaggcagcacaagatgaaggcggtcggcagtcgggttgtgttcattggcgtttcccctaatgttttgaaaccttgttttttgattttgcctttacggggtgaaaagtttttttggcccaaatccggaatttag

SEQ ID NO: 88 - protein, 105 aa, Neisseria gonorrhoeae
MPLTMLCSRTCGLFIIQSDRKSGGNAVPRPSPFLPWQAMQLDSYTFCPFVMMLLSAAEAAAQRQHKMKAVGSRVVFIGVSPNVLKPCFLILPLRGEKFFWPKSGI

SEQ ID NO: 89 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtag

SEQ ID NO: 90 - protein, 101 aa, Neisseria meningitidis
  misc_feature (21)..(21): Xaa can be any naturally occurring amino acid
  misc_feature (94)..(94): Xaa can be any naturally occurring amino acid
MPLTMLCSSTCGFFMMKSERXSGGNMVPRPSPFLPWQATQLDSYTFCPFVMMLLSAAEAAAQKQPKTRAVGSRVVFIGVSFMFETLLLILRSGXKIFLPNQ

SEQ ID NO: 91 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaggcagcccaagacgagggcggtcggcagtcgggttgtgttcattggtgtttccttaatgtttgaaaccttgttgttgattttgcgtagcgggtgaaagattttcttgccgaatcggtag

SEQ ID NO: 92 - protein, 99 aa, Neisseria meningitidis
MPLTMLCSSTCGFFMMKSERSGGNMVPRPSPFLPWQATQLDSYTFCPFVMMLLSAAEAAAQRQPKTRAVGSRVVFIGVSLMFETLLLILRSGKIFLPNR

SEQ ID NO: 93 - DNA, 375 bp, Neisseria gonorrhoeae
atgcagtatctgattgtcaaatacagccatcaaatcttcgttaccatcaccattttggtattcaacatccgttttttcctactttggaaaaatccagaaaagcccttggtcggcttttggaaagcactgccccacctcaacgacacgatgctgctgtttacgggattgtggctgatgaagattacccatttctccccgttcaacgcgccttggctcggcacaaaaatcctgctcctgttcgcctacatcgcactgggcatggtaatgatgcgcgcccgtccgcgttcgaccaagttctacaccgtttacctgctcgctatgtgttgcatcgcctgcatcgtttaccttgccaaaaccaaagtcctgccattctga

SEQ ID NO: 94 - protein, 124 aa, Neisseria gonorrhoeae
MQYLIVKYSHQIFVTITILVFNIRFFLLWKNPEKPLVGFWKALPHLNDTMLLFTGLWLMKITHFSPFNAPWLGTKILLLFAYIALGMVMMRARPRSTKFYTVYLLAMCCIACIVYLAKTKVLPF

SEQ ID NO: 95 - DNA, 285 bp, Neisseria meningitidis
aaaatcagaaaagccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcgtcgcctgcatcgtttaccttgccaaaaccaaagtcctgcctttctga

SEQ ID NO: 96 - protein, 94 aa, Neisseria meningitidis
KIRKALAGFWKALPHLNDTMLLFTGLWLMKITHFSPFNAPWLGTKILLLLAYIALGMMMMRARPRSTKFYTVYLLAMCCVACIVYLAKTKVLPF

SEQ ID NO: 97 - DNA, 375 bp, Neisseria meningitidis
  misc_feature (79)..(79): n is a, c, g, or t
atgcagtatctgattgtcaaatacagccatcaaatcttcgttaccatcaccattttggtattcaacatccgtgttttcntactttggaaaaatccagaaaagcccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcctcacctgcatcgtttaccttgccaaaaccaaagtcctgcctttctga

SEQ ID NO: 98 - protein, 124 aa, Neisseria meningitidis
  misc_feature (27)..(27): Xaa can be any naturally occurring amino acid
MQYLIVKYSHQIFVTITILVFNIRVFXLWKNPEKPLAGFWKALPHLNDTMLLFTGLWLMKITHFSPFNAPWLGTKILLLLAYIALGMMMMRARPRSTKFYTVYLLAMCCLTCIVYLAKTKVLPF

SEQ ID NO: 99 - DNA, 312 bp, Neisseria gonorrhoeae
atgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctga

SEQ ID NO: 100 - protein, 103 aa, Neisseria gonorrhoeae
MQQGQLVGRVARNKDMRNAGLHGQRIGNGYAARVFVDIDVFQTDIVNVRTATYGCQHIFGNKYAFFAILLPMDFYIAVCVEFDLGFSIQMQFQFFSEHGFRLV

SEQ ID NO: 101 - DNA, 312 bp, Neisseria meningitidis
atgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctga

SEQ ID NO: 102 - protein, 103 aa, Neisseria meningitidis
MQQRQLVGRIACDEDMRNTGLHGQRVGNRYAARIFFDIDIFQTDIVNVRTAAHGCQHIFGNKYAFFAILLPMDFYIAVCIEFDLGFSIQMQFQFFAEHGVRLV

SEQ ID NO: 103 - DNA, 312 bp, Neisseria meningitidis
atgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctga

SEQ ID NO: 104 - protein, 103 aa, Neisseria meningitidis
MQQGQLVGRVARNKDMRNTGLHSQRIGNGYAARIFFDIDVFQTDIVNVRTAAYGCQHIFGNKYAFFAILLPMDFYIAVCVEFGLGFSIQMQFQFFTEHGFRLV

SEQ ID NO: 105 - DNA, 268 bp, Neisseria gonorrhoeae
ctgctggcggccctggtgcttgccgcgtgttcttcgacaaacacactgccagccggcaagaccccggcagacaatatagaaactgccgacctttcggcaagcgttcccacccgccctgccgaaccggaaggaaaaacgctggcagattacggcggctacccgtccgcactggatgcagtgaaacagaacaacgatgcggcagccgccgcctatttggaaaacgcaggagacagcgcgatggcggaaaatgtccgcaaggagtggctga

SEQ ID NO: 106 - protein, 89 aa, Neisseria gonorrhoeae
LLAALVLAACSSTNTLPAGKTPADNIETADLSASVPTRPAEPEGKTLADYGGYPSALDAVKQNNDAAAAAYLENAGDSAMAENVRKEWL

SEQ ID NO: 107 - DNA, 1572 bp, Neisseria meningitidis
atgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaacccgaaagaaaaacgctggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcacgcagacagtggacgctgtttgcacaggaatacgccaaactcgaaccggcagggcgcgcccaagaagtcgaatgctacgccgattcgagccgcaacgactatacgcgtgccgctgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattacggcaaggttgccgaccgccgccaactgaccgacgaccaaatcgagtggtacgcccgcgccgccttgcgcgcccgacgttgggacgagctggcctccgttatctcgcatatgcccgaaaaactgcaaaaaagcccgacctggctctactggctggcacgcagccgcgccgcaacgggcaacacgcaagaggcggaaaaactttacaaacaggcggcagcgacgggcaggaatttttatgcggtgctggcaggggaagaattgggtcggaaaatcgatacgcgcaacaatgtgcccgatgccggcaaaaacagcgtccgccgcatggcggaagacggtgcagtcaaacgcgcactggtactgttccaaaacagccaatctgccggtgatgcaaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttatgggctgattcgtcaggaaagccgcttcgttataggcgcgcaatcccgcgtaggcgcgcaggggctgatgcaggttatgcctgccaccgcgcgcgaaatcgccggcaaaatcggtatggatgccgcacaactttacaccgccgacggg

SEQ ID NO: 108 - protein, 524 aa, Neisseria meningitidis
MYLPSMKHSLPLLAALVLAACSSTNTLPAGKTPADNIETADLSASVPTRPAEPERKTLADYGGYPSALDAVKQKNDAAVAAYLENAGDSAMAENVRNEWLKSLGARRQWTLFAQEYAKLEPAGRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYYGKVADRRQLTDDQIEWYARAALRARRWDELASVISHMPEKLQKSPTWLYWLARSRAATGNTQEAEKLYKQAAATGRNFYAVLAGEELGRKIDTRNNVPDAGKNSVRRMAEDGAVKRALVLFQNSQSAGDAKMRRQAQAEWRFATRGFDEDKLLTAAQTAFDHGFYDMAVNSAERTDRKLNYTLRYISPFKDTVIRHAQNVNVDPAWVYGLIRQESRFVIGAQSRVGAQGLMQVMPATAREIAGKIGMDAAQLYTADG

SEQ ID NO: 109 - DNA, 1851 bp, Neisseria meningitidis
  misc_feature (44)..(44): n is a, c, g, or t
  misc_feature (68)..(68): n is a, c, g, or t
  misc_feature (145)..(145): n is a, c, g, or t
  misc_feature (163)..(163): n is a, c, g, or t
  misc_feature (173)..(173): n is a, c, g, or t
  misc_feature (335)..(335): n is a, c, g, or t
  misc_feature (342)..(342): n is a, c, g, or t
  misc_feature (351)..(351): n is a, c, g, or t
  misc_feature (367)..(367): n is a, c, g, or t
  misc_feature (801)..(801): n is a, c, g, or t
  misc_feature (864)..(865): n is a, c, g, or t
  misc_feature (867)..(868): n is a, c, g, or t
  misc_feature (871)..(873): n is a, c, g, or t
  misc_feature (876)..(877): n is a, c, g, or t
  misc_feature (881)..(881): n is a, c, g, or t
  misc_feature (883)..(883): n is a, c, g, or t
  misc_feature (885)..(885): n is a, c, g, or t
  misc_feature (888)..(889): n is a, c, g, or t
  misc_feature (894)..(895): n is a, c, g, or t
  misc_feature (899)..(900): n is a, c, g, or t
  misc_feature (902)..(902): n is a, c, g, or t
  misc_feature (904)..(904): n is a, c, g, or t
  misc_feature (907)..(910): n is a, c, g, or t
  misc_feature (914)..(915): n is a, c, g, or t
  misc_feature (918)..(918): n is a, c, g, or t
  misc_feature (923)..(928): n is a, c, g, or t
  misc_feature (930)..(930): n is a, c, g, or t
  misc_feature (933)..(933): n is a, c, g, or t
  misc_feature (935)..(936): n is a, c, g, or t
  misc_feature (938)..(939): n is a, c, g, or t
  misc_feature (941)..(941): n is a, c, g, or t
  misc_feature (943)..(943): n is a, c, g, or t
  misc_feature (945)..(946): n is a, c, g, or t
  misc_feature (948)..(948): n is a, c, g, or t
  misc_feature (951)..(952): n is a, c, g, or t
  misc_feature (972)..(972): n is a, c, g, or t
  misc_feature (988)..(988): n is a, c, g, or t
  misc_feature (990)..(990): n is a, c, g, or t
  misc_feature (996)..(996): n is a, c, g, or t
  misc_feature (1002)..(1002): n is a, c, g, or t
  misc_feature (1021)..(1021): n is a, c, g, or t
  misc_feature (1028)..(1028): n is a, c, g, or t
  misc_feature (1041)..(1041): n is a, c, g, or t
  misc_feature (1048)..(1048): n is a, c, g, or t
  misc_feature (1050)..(1050): n is a, c, g, or t
  misc_feature (1070)..(1070): n is a, c, g, or t
  misc_feature (1109)..(1109): n is a, c, g, or t
  misc_feature (1205)..(1205): n is a, c, g, or t
  misc_feature (1363)..(1367): n is a, c, g, or t
  misc_feature (1369)..(1369): n is a, c, g, or t
  misc_feature (1371)..(1371): n is a, c, g, or t
atgtacccaccctctctgaagcattccctgccgctgctggtggncctggtgcttgccgcgtgttcttngacaaacacactgtcagccgacaagaccccggcagacaatatagaaactgccgacctttcggcaagcgttcccaccngccctgccgaacccgaangaaaaacgtnggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcgcgcagacagtggacgctgtntgcacangaatatgcnaaactcgaaccggcanggcgcgcccaagaagtcgaatgctacgccgattcgagccgcaacgactatacgcgtgccgccgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattanggcaaggttgccgaccgccgccaactgaccgacgaccaaatcgagtggtacgcccgcgccgcnntnngcnnncgnngttngnanganntggcnnccgnnancncgnnnntgcnnganaaacnnnnnnanagncnnanntngntnnantgnntggcacgcagccgcgccgcnacgggcaacacgcaanangcgganaaactntacaaacaggcggcagcancgggcangaatttttatgcngtgctgncnggggaagagttggggcgcanaatcgatacgcgcaacaatgtgcccgatgccggcaaaancagcgtcctccgtatggcggaagacggcgcgattaagcgcgcgctggtgctgttccgaaacagccgaaccgccggcgatgcgaaaatgcgccgtcnggctcaggcggaatggcgtttcgccacacgcggcttcgatgaagacaagctgctgaccgccgcgcaaaccgcgttcgaccacggtttttacgatatggcggtcaacagcgcggaacgcaccgaccgcaaactcaactacaccttgcgctacatttcgnnnnntnangacacggtaatccgccacgcgcaaaatgttaatgtcgatccggcgtgggtttacgggctgattcgtcaggaaagccgcttcgttatgggcgcgcaatcccgcgtaggcgcgcaggggctgatgcaggttatgcctgccaccgcgcgcgaaatcgccggcaaaatcggtatggatgccgcacaactttacaccgccgacggcaatatccgtatggggacgtggtatatggcggacaccaaacgccgcctgcaaaacaacgaagtcctcgccaccgcaggctataacgccggtcccggcagggcgcgccgatggcaggcggacacgcccctcgaaggcgcggtatatgccgaaaccatcccgttttccgaaacgcgcgactatgtcaaaaaagtgatggccaatgccgcctactacgcctccctcttcggcgcgccgcacatcccgctcaaacagcgtatgggcattgtccccgcccgctga

SEQ ID NO: 110 - protein, 616 aa, Neisseria meningitidis
  misc_feature (15)..(15): Xaa can be any naturally occurring amino acid
  misc_feature (23)..(23): Xaa can be any naturally occurring amino acid
  misc_feature (49)..(49): Xaa can be any naturally occurring amino acid
  misc_feature (55)..(55): Xaa can be any naturally occurring amino acid
  misc_feature (58)..(58): Xaa can be any naturally occurring amino acid
  misc_feature (112)..(112): Xaa can be any naturally occurring amino acid
  misc_feature (114)..(114): Xaa can be any naturally occurring amino acid
  misc_feature (123)..(123): Xaa can be any naturally occurring amino acid
  misc_feature (267)..(267): Xaa can be any naturally occurring amino acid
  misc_feature (289)..(291): Xaa can be any naturally occurring amino acid
  misc_feature (293)..(297): Xaa can be any naturally occurring amino acid
  misc_feature (299)..(306): Xaa can be any naturally occurring amino acid
  misc_feature (308)..(318): Xaa can be any naturally occurring amino acid
  misc_feature (330)..(330): Xaa can be any naturally occurring amino acid
  misc_feature (332)..(332): Xaa can be any naturally occurring amino acid
  misc_feature (341)..(341): Xaa can be any naturally occurring amino acid
  misc_feature (343)..(343): Xaa can be any naturally occurring amino acid
  misc_feature (350)..(350): Xaa can be any naturally occurring amino acid
  misc_feature (357)..(357): Xaa can be any naturally occurring amino acid
  misc_feature (370)..(370): Xaa can be any naturally occurring amino acid
  misc_feature (402)..(402): Xaa can be any naturally occurring amino acid
  misc_feature (455)..(457): Xaa can be any naturally occurring amino acid
MYPPSLKHSLPLLVXLVLAACSXTNTLSADKTPADNIETADLSASVPTXPAEPEXKTXADYGGYPSALDAVKQKNDAAVAAYLENAGDSAMAENVRNEWLKSLGARRQWTLXAXEYAKLEPAXRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYXGKVADRRQLTDDQIEWYARAAXXXRXXXXXAXXXXXXXXKXXXXXXXXXXXARSRAATGNTQXAXKLYKQAAAXGXNFYAVLXGEELGRXIDTRNNVPDAGKXSVLRMAEDGAIKRALVLFRNSRTAGDAKMRRXAQAEWRFATRGFDEDKLLTAAQTAFDHGFYDMAVNSAERTDRKLNYTLRYISXXXDTVIRHAQNVNVDPAWVYGLIRQESRFVMGAQSRVGAQGLMQVMPATAREIAGKIGMDAAQLYTADGNIRMGTWYMADTKRRLQNNEVLATAGYNAGPGRARRWQADTPLEGAVYAETIPFSETRDYVKKVMANAAYYASLFGAPHIPLKQRMGIVPAR

SEQ ID NO: 111 - DNA, 342 bp, Neisseria gonorrhoeae
atggtagaacgtaaattgaccggtgcccattacggtttgcgcgattgggtaatgcagcgtgcgactgcggttattatgttgatttataccgttgcacttttagtggttctatttgccctgcctaaagaatatccggcatggcaggcattttttagtcaagcttgggtaaaagtatttacccaagtgagctttatcgccgtattcttgcacgcttgggtgggtatccgcgatttgtggatggactatatcaaacccttcggcgtgcgtttgtttttgcaggttgccaccattgtctggctggtcggctgcctcgtgtattcagttaaagtgatttgggggtaa

SEQ ID NO: 112 - protein, 113 aa, Neisseria gonorrhoeae
MVERKLTGAHYGLRDWVMQRATAVIMLIYTVALLVVLFALPKEYPAWQAFFSQAWVKVFTQVSFIAVFLHAWVGIRDLWMDYIKPFGVRLFLQVATIVWLVGCLVYSVKVIWG

SEQ ID NO: 113 - DNA, 342 bp, Neisseria meningitidis
atggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaa

SEQ ID NO: 114 - protein, 113 aa, Neisseria meningitidis
MVERKLTGAHYGLRDWVMQRATAVIMLIYTVALLVVLFSLPKEYSAWQAFFSQTWVKVFTQVSFIAVFLHAWVGIRDLWMDYIKPFGVRLFLQVATIVWLVGCLVYSVKVIWG

SEQ ID NO: 115 - DNA, 342 bp, Neisseria meningitidis
  misc_feature (249)..(249): n is a, c, g, or t
atggtagaacgtaaattgaccggtgcccattacggtttgcgggattgggcgatgcaacgtgcgaccgcggttattatgttgatttataccgttgcacttttagtggttctatttgctctgcctaaagaatattcggcatggcaggcattttttagtcaaacttgggtaaaagtatttacccaagtgagcttcatcgccgtattcttgcacgcttgggtgggtatccgcgatttgtggatggactatatnaaacccttcggcgtgcgtttgtttttgcaggttgccaccatcgtctggctggtcggctgcttggtgtattcaattaaagtaatttgggggtaa

SEQ ID NO: 116 - protein, 113 aa, Neisseria meningitidis
  misc_feature (83)..(83): Xaa can be any naturally occurring amino acid
MVERKLTGAHYGLRDWAMQRATAVIMLIYTVALLVVLFALPKEYSAWQAFFSQTWVKVFTQVSFIAVFLHAWVGIRDLWMDYXKPFGVRLFLQVATIVWLVGCLVYSIKVIWG

SEQ ID NO: 117 - DNA, 1014 bp, Neisseria meningitidis
atgttgaaacaaacgacacttttggcagcttgtaccgccgttgccgctctgttgggcggttgcgccacccaacagcctgctcctgtcattgcaggcaattcaggtatgcagaccgtatcgtctgcgccggtttacaatccttatggcgcaacgccgtacaatgccgctcctgccgccaacgatgcgccgtatgtgccgcccgtgcaaactgcgccggtttattcgcctcctgcttatgttccgccgtctgcacctgccgtttcgggtacatatgttccttcttacgcacccgtcgacatcaacgcggcgacgcatactattgtgcgtggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaaaccgcagccgtagaaagcaggcccgccgtaccggctgccgcgcaaacccctgtgaaacccgccgcgcaaccgcccgttcagtccgcgccgcaacctgccgcgcccgctgcggaaaataaagcggttcccgcccccgcgcccgccccgcaatctcctgccgcttcgccttccggcacgcgttcggtcggcggcattgtttggcagcgtccgacccaaggtaaagtggttgccgatttcggcggcggcaacaagggtgtcgatattgccggcaatgccggacaacccgttttggcggcggctgacggcaaagtggtttatgccggttcaggtttgaggggatacggaaacttggtcatcatccagcacaattcctctttcctgaccgcgtacgggcacaaccaaaaattgctggtcggcgaaggtcagcaggtcaaacgcggtcagcaggttgctttgatgggtaataccgatgcttccagaacgcagcttcatttcgaggtgcgtcaaaacggcaaaccggttaacccgaacagctatatcgcgttctga

SEQ ID NO: 118 - protein, 337 aa, Neisseria meningitidis
MLKQTTLLAACTAVAALLGGCATQQPAPVIAGNSGMQTVSSAPVYNPYGATPYNAAPAANDAPYVPPVQTAPVYSPPAYVPPSAPAVSGTYVPSYAPVDINAATHTIVRGDTVYNISKRYHISQDDFRAWNGMTDNTLSIGQIVKVKPAGYAAPKTAAVESRPAVPAAAQTPVKPAAQPPVQSAPQPAAPAAENKAVPAPAPAPQSPAASPSGTRSVGGIVWQRPTQGKVVADFGGGNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 119 - DNA, 1056 bp, Neisseria gonorrhoeae
gtgccgccggtgcaaagcgcgccggtttatacgcctcctgcttatgttccgccgtctgcacctgccgtttcgggtacatacgttccttcttacgcacccgtcgacatcaacgcggcgacgcatactattgtgcgcggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgcgcaaccgcccgtacagtccgcacccgtcgacattaacgcggcgacgcatactattgtgcgcggcgacacggtgtacaacatttccaaacgctaccatatctctcaagacgatttccgtgcgtggaacggcatgaccgacaatatgttgagcatcggtcagattgttaaagtcaaaccggcaggatatgccgcaccgaaaaccgcagccgtagaaagcaggcccgccgtaccggctgccgtgcaaacccctgtgaaacccgccgcgcaaccgcctgtgcagtccgcgccgcaacctgccgcgcccgctgcggaaaataaagcggttcccgcgcccgccccgcaatctcctgccgcttcgccttccggcacgcgttcggtcggcggcattgtttggcagcgtccgacgcaaggtaaagtggttgccgatttcggcggcaacaacaagggtgtcgatattgccggtaatgcgggacagcccgttttggcggcggctgacggcaaagtggtttatgccggttcaggtttgaggggatacggaaacttggtcatcatccagcataattcttctttcctgaccgcatacgggcacaaccaaaaattgctggtcggcgaggggcagcaggtcaaacgcggtcagcaggttgctttgatgggcaataccgatgcttccagaacgcagcttcatttcgaggtgcgtcaaaacggcaaaccggttaacccgaacagctatatcgcgttctga

SEQ ID NO: 120 - protein, 509 aa, Neisseria meningitidis
MAAADKQLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLEDLRGRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGVPVSDGMETVEIGKGIIRREGEKTAFIAFGSMVAPALAVAGKLNATVADMRFVKPIDEELIVRLARSHDRIVTLEENAEQGGAGSAVLEVLAKHGICKPVLLLGVADTVTGHGDPKKLLDDLGLSAEAVERRVRAWLSDRDAAN

SEQ ID NO: 121 - DNA, 1140 bp, Neisseria gonorrhoeae
atgagccgtttatggttttttgccgtaaaaaacattataatccgccttatttacctattgcccaaggagacacaaatggcactcgtatccatgcgccaactgcttgaccacgccgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattctggcggcagtcgaagaatttccgcacatccccgtcgtgatgcaccaagaccacggcgcatcgcccgacgtgtgccaacgctccatccaactgggcttctcctccgtgatgatggacggctctttgctcgaagacggcaaaaccccttcttcttacgaatacaacgtcaacgccacccgtaccgtcgtcaacttctcccacgcctgcggcgtgtccgtcgaaggcgaaatcggcgtattgggcaacctcgaaaccggcgaagcaggcgaagaagacggagtgggcgcggcaggcaaactctcacacgaccaaatgctcaccagcgttgaagatgccgtgcgtttcgttaaagataccggcgttgacgcattggcgattgccgtcggcaccagccacggcgcatacaaattcacccgtccgcccacaggcgacgtattgcgtatcgaccgcatcaaggaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacctgcgcctcgcttccaccggcgcggtacgccgctaccttgccgaaaacccgtccgactttgatccgcgcaaatacttgggcaaaaccattgaagcgatgaagcaaatctgcctcgaccgttatcttgcgttcggttgcgaaggtcaggcaggcaaaatcaaacctgtttcgttggaaaaaatggcaagccgttatgccaagggcgaattgaaccaaatcgtcaaataa

SEQ ID NO: 122 - protein, 379 aa, Neisseria gonorrhoeae
MSRLWFFAVKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLLEDGKTPSSYEYNVNATRTVVNFSHACGVSVEGEIGVLGNLETGEAGEEDGVGAAGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLGKTIEAMKQICLDRYLAFGCEGQAGKIKPVSLEKMASRYAKGELNQIVK

SEQ ID NO: 123 - DNA, 771 bp, Neisseria meningitidis
atgagctgtttatggttttttgctgtaaaaaacattataatccgccttatttacctattgcccaaggagacacaaatggcactcgtatccatgcgccaactgcttgatcatgctgccgaawacagctacggcytgccggcgttcaacgtcaacaacctcgwacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagtatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgatgcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcac

SEQ ID NO: 124 - protein, 257 aa, Neisseria meningitidis
  misc_feature (41)..(41): Xaa can be any naturally occurring amino acid
  misc_feature (54)..(54): Xaa can be any naturally occurring amino acid
MSCLWFFAVKNIIIRLIYLLPKETQMALVSMRQLLDHAAEXSYGLPAFNVNNLXQMRAIMEAADQVDAPVIVQASAGARKYAGAPFLRHLILAAVEVFPHIPVVMHQDHGASPDVCQRSIQLGFSSVMMDGSLMEDGKTPSSYEYNVNATRTVVNFSHACGVSVEGEIGVLGNLETGDAGEEDGVGAVGKLSHDQMLTSVEDAVCFVKDTGVDALAIAVGTSHGAYKFTRPPTGDVLRIDRIKEIHQALPNTHIVMH

SEQ ID NO: 125 - DNA, 1140 bp, Neisseria meningitidis
atgagccgtttatggttttttgccgcaaaaaacattataatccgccttatttacctattgcccaaggagacacaaatggcactcgtatccatgcgccaactgcttgatcatgctgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattttggcggctgtcgaagaatttccgcacatccccgtcgtgatgcaccaagaccacggcgcatcgcccgacgtgtgccaacgctccatccaactgggcttttcctccgtgatgatggacggctcgctgatggaagacggcaaaaccccttcttcttatgaatacaacgtcaacgccacccgtaccgtggttaatttctcccacgcctgcggcgtatccgttgaaggcgaaatcggcgtattgggcaacctcgaaactggcgaagccggcgaagaagacggtgtaggcgcagtgggcaaactttcccacgaccaaatgctcaccagcgtcgaagatgccgtgcgtttcgttaaagataccggcgttgacgcattggcgattgccgtcggcaccagccacggcgcgtacaaattcacccgtccgcccacaggcgacgtgttgcgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgtaaagtcaacatcgataccgacttgcgccttgcttccaccggcgcggtacgccgctaccttgccgaaaacccgtccgacttcgatccgcgcaaatatttgagcaaaaccattgaagcgatgaagcaaatctgcctcgaccgctacctcgcgttcggttgcgaaggtcaggcaggcaaaatcaaaccggtttccttggaaaaaatggcaaaccgttatgccaagggcgaattgaaccaaatcgtcaaataa

SEQ ID NO: 126 - protein, 379 aa, Neisseria meningitidis
MSRLWFFAAKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMANRYAKGELNQIVK

SEQ ID NO: 127 - DNA, 816 bp, Neisseria gonorrhoeae
atgctgaagccgtgtttggtatacagtgcctgtgcggcggcgttgcctgcgcggacttcgagcagcaggcgttgcgtgccttcgggcagatgtgcgtaccaatattcgagcagggcggacgcaacgccccgtcggcggcattcgggcgcggtggcaatcaggtgcagttcggattcgtcgggcaggttctgccaaacgataaaggcggcaatcctgccgtctttttccgcaaggaaaacctgttcggacggcgaaacaagcgcggactcaaattggcgttgcgtccacgcggacgggttgcagacggtatcgagcgcggccagtgcggcgcagtcggacggtgaggctgggcggatgttcatgttcgtgccttccgttccgcctgttctttggcagtcagggcgattttgttgcggacgtagagcagttcggcgtgtgccgcgccagttgcgggatagccgccgccgagggcgagcgcgagaaaatcggcggcggtcggcatatcgggtttgcctgagaagggcggacggttttccagtgcgaacgcactgccgatgccgtctgaaaagacgtacccctcggggagggcaatgtctgccgccctaccgacttgataatcgctcaaacggcggcggttcagcgtgtcgaaccacgcataaaacacttcgcccatacgcgcgtccgcagcggcgagtatgcagctttgcggcggcggcagcgaggcggcggcatcgagcgtggggatgccgattaaaggcgtgtcgaacggcgttgccaaaccttgcgccacgccgatgccgatacgcagtccggtaa

SEQ ID NO: 128 - protein, 271 aa, Neisseria gonorrhoeae
MLKPCLVYSACAAALPARTSSSRRCVPSGRCAYQYSSRADATPRRRHSGAVAIRCSSDSSGRFCQTIKAAILPSFSARKTCSDGETSADSNWRCVHADGLQTVSSAASAAQSDGEAGRMFMFVPSVPPVLWQSGRFCCGRRAVRRVPRQLRDSRRRGRARENRRRSAYRVCLRRADGFPVRTHCRCRLKRRTPRGGQCLPPYRLDNRSNGGGSACRTTHKTLRPYARPQRRVCSFAAAAARRRHRAWGCRLKACRTALPNLAPRRCRYAVR

SEQ ID NO: 129 - DNA, 815 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgcgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtagcggcaaggatgcagctttgcggcggcggcagcgaggcggcggcatcgagcgagggtacgccgattaagggggtatcaaacggcgttgccaaaccctgagctacaccgatgccgatacgcagtccggtaa

SEQ ID NO: 130 - protein, 270 aa, Neisseria meningitidis
  misc_feature (73)..(73): Xaa can be any naturally occurring amino acid
MLKPCAVYSACAAVLPARTSSSRRCVSSGRCVNQYSSRADAIPWRRHSGAVAIRCSSDSSGRFCQTIKAAIPXSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERPRQGCSFAAAAARRRHRARVRRLRGYQTALPNPELHRCRYAVR

SEQ ID NO: 131 - DNA, 816 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccacgcggacgggttgcagacggcatcgagcgcggcgagtgcggcgcaatcggcataaacggcgcggcggatgttcacaggcgcgccctccgttccgcctgttctttggcagtcaaggcgattttgttgcggacgtagagcagctcggcgtgtgccgcagcgacggcgggaaaaccgccttcagccgccagattgaggaagtcggcggcggtcggcatatcgggtttgcctgagaagggcggacggttttccagcgcgaacgcattgccgatgccgtctgaaaaggcgcatccttccggcagccggatgtctgccgcccgaccgacctgataatcgctcaaacggcggcggttcagcgtgtcgaaccatgcataaaacacttcgcccatacgtgcgtccgcagcggcaaggatgcagctttgcggcggcggcagcgaggcggcggcatcgagcgagggtacgccgattaaaggagtatcaaacggcgttgccaaaccttgcgccacgccgatgccgatacgcagtcccgtaa

SEQ ID NO: 132 - protein, 269 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASAAQSATARRMFTGAPSVPPVLWQSRRFCCGRRAARRVPQRRRENRLQPPDGSRRRSAYRVCLRRADGFPARTHCRCRLKRRILPAAGCLPPDRPDNRSNGGGSACRTMHKTLRPYVRPQRQGCSFAAAAARRRHRARVRRLKEYQTALPNLAPRRCRYAVP

SEQ ID NO: 133 - DNA, 687 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtag

SEQ ID NO: 134 - protein, 228 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERP

SEQ ID NO: 135 - DNA, 642 bp, Neisseria gonorrhoeae
atgactgatttccgccaagatttcctcaaattctccctcgcccaaaatgttttgaaattcggcgaatttaccaccaaagccggacggcggtcgccctatttcttcaatgccggcctcttcaacgacggcgcgtccacgctgcaactggcaaaattctatgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccgcggcgaaggcggcgtgttggtcggcgcgccgcttaaagggcgcgtgctgattatcgacgacgtgatttccgccggcacatccgtacgcgaatcaatcaaactgattgaagcggagggtgcaacccccgccggtgtcgccatcgcgctcgaccgcatggaaaaaggcacgggtaaattgtccgccgttcaggaagtggaaaaacaatacggcctgcccgtcgcccccatcgccagcctgaacgatttgtttatcctgttgcaaaacaaccccgaattcggacagttcctcgaacccgtccgcacctaccgccggcagtacggcgtagaataa

SEQ ID NO: 136 - protein, 213 aa, Neisseria gonorrhoeae
MTDFRQDFLKFSLAQNVLKFGEFTTKAGRRSPYFFNAGLFNDGASTLQLAKFYAQSIIESGIRFDMLFGPAYKGIILAAATAMMLAEKGVNVPFAYNRKEAKDRGEGGVLVGAPLKGRVLIIDDVISAGTSVRESIKLIEAEGATPAGVAIALDRMEKGTGKLSAVQEVEKQYGLPVAPIASLNDLFILLQNNPEFGQFLEPVRTYRRQYGVE

SEQ ID NO: 137 - DNA, 642 bp, Neisseria meningitidis
atgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaraaacaatacggkctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 138 - protein, 213 aa, Neisseria meningitidis
MTDFRQDFLKFSLAQNVLKFGEFTTKAGRRSPYFFNAGLFNDGLSTLQLAKFYAQSIIESGIRFDMLFGPAYKGIILAAATAMMLAEKGVNVPFAYNRKEAKDHGEGGVLVGAPLKGRVLIIDDVISAGTSVRESIKLIEAEGATPAGVAIALDRMEKGTGELSAVQEVEKQYGLPVAPIASLNDLFILLQNNPEFGQFLEPVRAYRRQYGVE

SEQ ID NO: 139 - DNA, 642 bp, Neisseria meningitidis
atgaccgatttccgccaagatttcctcaaattctccctcgcccaaaatgttttgaaattcggcgaattcaccaccaaagccggacggcggtcgccctatttcttcaatgccggcctctttaacgacggcttgtccacgctgcaactggcaaaattttacgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgaccgcatggaaaaaggcacgggtgaattgagcgcggttcaggaagtggaaaaacaatacggcctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 140 - protein, 213 aa, Neisseria meningitidis; identical to SEQ ID NO: 138

SEQ ID NO: 141 - DNA, 492 bp, Neisseria gonorrhoeae
atgccgtccgaaccacctgccgcttcagacggcatcaaaccgacacacaccgagaaaacatcatgcccgcctgtttctgtccgcactgcaaaacccgcctctgggtcaaagaaacccagctcaacgtcgcccaaggcttcgtcgtctgccaaaaatgcgaagggctgtttaaagccaaagaccatctggcaagcacgaaagaacctatattcaacgattggcccgaagctgtttcgggatgtcaaactcgtccaccgcatcggcacgcacgccattagcaagaaacagatgtcccgcgacgaaatcgccgatatcctcaacggcggtacaaccctgcacgatacgccgcccgcaaccgccgctgccgcacctgccgccgcaccgcaggtttccgtaccgcccgcccgtcaggaagggctcaactggactattgcaaccctgttcgcacttatcgtcctcattatgcagctttcctacctcttcatcctatga

SEQ ID NO: 142 - protein, 163 aa, Neisseria gonorrhoeae
MPSEPPAASDGIKPTHTEKTSCPPVSVRTAKPASGSKKPSSTSPKASSSAKNAKGCLKPKTIWQARKNLYSTIGPKLFRDVKLVHRIGTHAISKKQMSRDEIADILNGGTTLHDTPPATAAAAPAAAPQVSVPPARQEGLNWTIATLFALIVLIMQLSYLFIL

SEQ ID NO: 143 - DNA, 513 bp, Neisseria meningitidis
  misc_feature (133)..(237): n is a, c, g, or t
atgccgtccgaaccgccttacgcctcagacggcatcaaacctgacacacacgaggaaataccatgcccgcctgtttctgcccccactgcaaaacccgtctctgggtcaaagaaacccaactcaatgtcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 144 - protein, 170 aa, Neisseria meningitidis
  misc_feature (45)..(79): Xaa can be any naturally occurring amino acid
MPSEPPYASDGIKPDTHEEIPCPPVSAPTAKPVSGSKKPNSMSPXXXXXXXXXXXXXXXXXXXXXXXXXXXXXXXXXXXPEAVSDVKLVHRIGTRAIGKKQISRDEIAGILNGGTTQPDIPPATAATPAAAPQVTVPPAAPARQDGFNWTIATLFALIVLIMQLSYLVIL

SEQ ID NO: 145 - DNA, 497 bp, Neisseria meningitidis
atgccgtctgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggaatgtttaaagccaaagaccatctggcaagcacgaaagaacccatattcaacgatttgcccgaagctgtttcggatgtcaaactcgttcaccgcatcggcacgagcgccatcggcaagaaacagatttcccgtgacgaaatcgccggcatcctcaacggcggcacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 146 - protein, 165 aa, Neisseria meningitidis
  misc_feature (74)..(74): Xaa can be any naturally occurring amino acid
MPSEPPYASDGIKPDTHEEIPCPPVSAPTAKPVSGSKKPNSMSPKASSSAKNAKECLKPKTIWQARKNPYSTIXPEAVSDVKLVHRIGTSAIGKKQISRDEIAGILNGGTTQPDIPPATAATPAAAPQVTVPPAAPARQDGFNWTIATLFALIVLIMQLSYLVIL

SEQ ID NO: 147 - DNA, 1311 bp, Neisseria gonorrhoeae
atgaacgcgcccgacagctttgtcgcccacttccgcgaagccgccccctacatccgccaaatgcgcggcacgacactggtcgccggcatagacggccgcctgctcgaaggcggcaccttaaataagctcgccgccgacatcgggctgttgtcgcaactgggcatccgactcgtcctcatccacggcgcgtaccacttcctcgaccgcctcgccgccgcgcaaggccgcacgccgcattattgccggggtttgcgcgttaccgacgaaacctcgctcggacaggcgcagcagtttgccggcaccgtccgcagccgttttgaagccgcattgtgcggcagcgtttcaggattcgcgcgcgcgccttccgtcccgctcgtatcgggcaacttcctgaccgcccgtccgatgggcgtgattgacggaaccgatatggaatacgcgggggttatccgcaaaaccgacaccgccgccctccgtttccaactcgacgcgggcaatatcgtctggatgccgccgctcgggcattcctacggcggcaaaaccttcaatctcgatatggtgcaggccgccgcttccgtcgccgtctcgcttcaggccgaaaaactcgtttacctgaccctttcagacggcatttcccgccccgacggcacgctcgccgaaaccctctcggcacaggaagcgcaatcgctggcggaacacgccgccagcgaaacccgacgactgatttcgtccgccgttgccgcgctcgaaggcggcgtgcatcgcgtccaaatcctcaacggggccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcgtcctattgcaccgcagccgcgaatacctcgaaaaccacatttccgaattttccatcctcgaacacgacggcgacctgtacggctgtgccgcactcaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagctgcccgaaacgcggcgcaaagactaccgcagcaacggacgaaacccgcatattctggtgcgtcgcctgcaccgctga

SEQ ID NO: 148 - protein, 436 aa, Neisseria gonorrhoeae
MNAPDSFVAHFREAAPYIRQMRGTTLVAGIDGRLLEGGTLNKLAADIGLLSQLGIRLVLIHGAYHFLDRLAAAQGRTPHYCRGLRVTDETSLGQAQQFAGTVRSRFEAALCGSVSGFARAPSVPLVSGNFLTARPMGVIDGTDMEYAGVIRKTDTAALRFQLDAGNIVWMPPLGHSYGGKTFNLDMVQAAASVAVSLQAEKLVYLTLSDGISRPDGTLAETLSAQEAQSLAEHAASETRRLISSAVAALEGGVHRVQILNGAADGSLLQELFTRNGIGTSIAKEAFVSIRQAHSGDIPHIAALIRPLEEQGVLLHRSREYLENHISEFSILEHDGDLYGCAALKTFAEADCGEIACLAVSPQAQDGGYGERLLAHIIDKARGIGISRLFALSTNTGEWFAERGFQTASEDELPETRRKDYRSNGRNPHILVRRLHR

SEQ ID NO: 149 - DNA, 1236 bp, Neisseria meningitidis
  misc_feature (1039)..(1039): n is a, c, g, or t
atgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcgggcaaacgcgacggctgatttcgtccgccgaactcttcacccgcaacggcatcggcacgtccattgccaaagaagccttcgtctccatccggcargcgcaywgggcgacatcccgcacatcgccgccctcatccgcccgctggaagaacagggcatcctgctgcaccgcascgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcagcacaggacggcggctacggcgaacgcntgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctga

SEQ ID NO: 150 - protein, 412 aa, Neisseria meningitidis
  misc_feature (270)..(271): Xaa can be any naturally occurring amino acid
  misc_feature (293)..(293): Xaa can be any naturally occurring amino acid
  misc_feature (339)..(339): Xaa can be any naturally occurring amino acid
  misc_feature (348)..(348): Xaa can be any naturally occurring amino acid
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGQTRRLISSAELFTRNGIGTSIAKEAFVSIRQAHXXDIPHIAALIRPLEEQGILLHRXREYLENHISEFSILEHDGNLYGCAALKTFAEADCGEIACLAVSPQXQDGGYGERXLAHIIDKARGIGISRLFALSTNTGEWFAERGFQTASEDELPETRRKDYRSNGRNSHILVRRLHR

SEQ ID NO: 151 - DNA, 1311 bp, Neisseria meningitidis
atgatcgtgcccgacctctttgtcgcccacttccgcgaagccgccccctacatccgccaaatgcgcggcaaaacgctggtcgccggcatagacgaccgcctgctcgaaggtgataccttaaacaagttcgccgccgacatcgggcttttgtcgcaactgggcatcaggctcgtcctcatccacggcgcgcgccacttcctcgaccgccacgccgccgcgcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttccatctcgatatgcttcaaaccgccgcctccgtcgccgtctcgcttcaggccgaaaaactcgtttacctgaccctttcagacggcatttcccgccccgacggcacgctcgccgtaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacattgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtgcgtcgcctgcaccgctga

SEQ ID NO: 152 - protein, 436 aa, Neisseria meningitidis
MIVPDLFVAHFREAAPYIRQMRGKTLVAGIDDRLLEGDTLNKFAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFHLDMLQTAASVAVSLQAEKLVYLTLSDGISRPDGTLAVTLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 153 - DNA, 465 bp, Neisseria gonorrhoeae
atgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 154 - protein, 154 aa, Neisseria gonorrhoeae
MSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 155 - DNA, 465 bp, Neisseria meningitidis
atcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 156 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 157 - DNA, 465 bp, Neisseria meningitidis
atcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 158 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 159 - DNA, 2016 bp, Neisseria gonorrhoeae
atgaaatcctaccccgacccctaccgccattttgaaaacctcgattccgccgaaacgcaaaacttcgctgctgaagcgaatgccgaaacgcgcgcgcgttttttaaacaacgacaaggcgcgcgcactttcagacggcattttgaatcaaatgcaggacacgcggcagattccgttttgtcaggaacaccgcgcgcggatgtaccatttccatcagaatgcggaatatccgaagggcgtgtaccgcatgtgtacggcggcgacctaccgttccggctatcccgagtggaaaatcctgttttcggtggcggatttcgatgagttgctcggcgacgatgtgtatttgggcggcgtgtcgcacttggtggagcagcccaaccgcgcgctgctgactttgaacaaatcgggcggcgatacggcgtatacgctggaagtggatttggaagcaggggaattggtagagggcggttttcactttccggcaggcaaaaaccatgtgtcgtggcgcgatgaaaacagcgtgtgggtgtgtccggcttgggacgaacgccagttgaccgaatcgggctatccgcgcgaagtgtggctggtggaacgcggcaagagtttcgaggaaagcctgccggcgtaccaaatcgataaaggcgcgatgatggtaaacgcgtggcgttacctcgatccgcagggttcgccgattgatttgattgaagcgtcggacggtttttacaccaagacgtatttgcaggtgtcgtccgaaggcggggcgaaaccgttgaacctgcctaatgattgcgatgtggtcggctatctggcgggacatcttttgctgacgctgcgcaaggactggcaccgcgcgaaccaaagctatccgagtggcgcgttggtggcggtgaaactgaatcggggcgaactcggggcggcgcagcttttgtttgcgcccgatgaaacgcaggcattggaaagcgtggaaacgaccaagcgttttgtggtggcaagcctgctggagaatgtacaaggccgtctgaaagcgtggcggtttgccgacagcaaatggcaggaagccgagttgccgcacctgccctcgggcgcgttggaaatgaccgaccaaccgtggggcggcgacgtggtttatcttgccgccagcgatttcaccacgccgctgacgctgtttgcgctggatttgaacgtgatggaactgaccgtcatgcgcctccagccgcagcagtttgtttcagacggcatcgaagtgcggcagttttgggcggtgtcgtccgacggcgaacgcattccttatttccacgtcggcaaaaacgccgcgcccgacacgccgaccttagtctatgcttacggaggtttcggcattcctgaattgccgcattatctgggcagcgtcggcaaatattggctggaagagggcaatgcctttgtattggcaaacatccgcggcggcggagaattcggcccgcgctggcatcaggcggcgcagggaatcagcaaacacaaaagcgttgatgatttgttggcagtcgtgcgtgatttgtccgaacgcggcatgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 160 - protein, 671 aa, Neisseria gonorrhoeae
MKSYPDPYRHFENLDSAETQNFAAEANAETRARFLNNDKARALSDGILNQMQDTRQIPFCQEHRARMYHFHQNAEYPKGVYRMCTAATYRSGYPEWKILFSVADFDELLGDDVYLGGVSHLVEQPNRALLTLNKSGGDTAYTLEVDLEAGELVEGGFHFPAGKNHVSWRDENSVWVCPAWDERQLTESGYPREVWLVERGKSFEESLPAYQIDKGAMMVNAWRYLDPQGSPIDLIEASDGFYTKTYLQVSSEGGAKPLNLPNDCDVVGYLAGHLLLTLRKDWHRANQSYPSGALVAVKLNRGELGAAQLLFAPDETQALESVETTKRFVVASLLENVQGRLKAWRFADSKWQEAELPHLPSGALEMTDQPWGGDVVYLAASDFTTPLTLFALDLNVMELTVMRLQPQQFVSDGIEVRQFWAVSSDGERIPYFHVGKNAAPDTPTLVYAYGGFGIPELPHYLGSVGKYWLEEGNAFVLANIRGGGEFGPRWHQAAQGISKHKSVDDLLAVVRDLSERGMSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 161 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 162 - protein, 671 aa, Neisseria meningitidis
MKSYPDPYRHFENLDSAETQNFAAEANAETRARFLENDKARALSDGILAQLQDTRQIPFCQEHRARMYHFHQDAEYPKGVYRVCTAATYRSGYPEWKILFSVADFDELLGDDVYLGGVSHLVEQPNRALLTLSKLGSDTAYTLEVDLEAGELVEGGFHFPAGKNHVSWRDENSVWVCPAWNERQLTQSGYPREVWLVERGKSFEESLPVYQIGEDGMMVNAWRYLDPQGSPIDLIEASDGFYTKTYLRVSAEGEAKPLNLPNDCDVVGYLAGHLLLTLRKDWNRANQSYPSGALVAVKLNRGELGAAQLLFAPDETQALESVETTKRFVVASLLENVQGRLKAWRFADGKWQEVELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVRDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 163 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttaaacaacgacaaggcacgcgcattgtctgacggcattttggcgcagttgcaggacacgcggcaaattccgttttgtcaggaacaccgcgcgcggatgtaccatttccatcaagatgcggaatatccgaaaggcgtgtaccgcgtgtgtaccgcggcgacttaccgttcgggctatcctgagtggaaaatcctgttttcggtggcggatttcgacgaattgctcggtgacgatgtatatctaggcggcgtgtcgcacctggtggaacagcccaaccgcgcgttgttaacactgagcaaatcgggcggcgataccgcgtacacgctggaagtggatttggaagcaggggagttggtagaaggcggttttcactttccggcaggcaaaaaccatgtgtcgtggcgcgatgaaaacagcgtgtgggtgtgtccggcttgggacgaacgccagttgaccgaatcgggctatccgcgcgaggtgtggctggtggaacgcggcaagagtttcgaggaaagcctgccggtgtaccaaattgctgaagacggcatgatggtgaacgcgtggcgttacctcgatccgcagggttcgccgattgatttgattgaagcgtctgacggtttttacaccaaaacctatttgcaggtctcagccgaaggcgaagcgaaaccgttaaacctgcccaacgattgcgacgtagtcggctatctggccggacatcttttgctgaccttgcgtaaagactggcaccgcgcgaaccaaagctatccgagtggcgcattggtagcagtaaaattaaaccgcggcgaattgggcgcggcgcagcttttgtttgcgcccaatgaaacgcaggcattggaaagcgtggaaacgaccaagcgttttgtcgtggcgagcctgctggaaaacgtacagggtcgtctgaaagcgtggcgttttactgatggcaaatggcaggaaaccgagttgccgcgcctgccttcgggcgcgttggaaatgaccgaccaaccgtgggggggcgacgtagtttaccttgccgccagcgatttcaccacgccgctgacgctgtttgcattggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgagcgatttgtccgaacgcggtatcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 164 - protein, 671 aa, Neisseria meningitidis
MKSYPDPYRHFENLDSAETQNFAAEANAETRARFLNNDKARALSDGILAQLQDTRQIPFCQEHRARMYHFHQDAEYPKGVYRVCTAATYRSGYPEWKILFSVADFDELLGDDVYLGGVSHLVEQPNRALLTLSKSGGDTAYTLEVDLEAGELVEGGFHFPAGKNHVSWRDENSVWVCPAWDERQLTESGYPREVWLVERGKSFEESLPVYQIAEDGMMVNAWRYLDPQGSPIDLIEASDGFYTKTYLQVSAEGEAKPLNLPNDCDVVGYLAGHLLLTLRKDWHRANQSYPSGALVAVKLNRGELGAAQLLFAPNETQALESVETTKRFVVASLLENVQGRLKAWRFTDGKWQETELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVSDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 165 - DNA, 606 bp, Neisseria gonorrhoeae
atgacgatgatttgcttgcgcttccaagcgttcgtgccgcataccagcgcgttatccaacacttccacggcagccggcccttcctgcccgatggcggcggtgcggtcgatgatgaaaatccagccggggtttttctctttgatgtattcgaaggaaacgggctgcccgtgcccttcgttgcgtaaagattcgtccacgggcggcaggccgatgtcgccgtgtatccaacttgccaaccgcgattgcgtgccgaaggcggacaccttgttgcctgtaaccgacagcaccagcccgcgtcctttgcctttggcggcttcgcgcttttgggcgaacagcgcgtcaatctgcgcattcaattccgccacgcgcgcttccttaccgaaaatccgcgacagggtctccatctgcttctcgccgctggtgcggatattgccgttgtccaccgtcaaatctatggtggtcgcgtttttcgccaactgttcatacgcttccgcacccggcccgccggtaatgacaaactgcggattgtggcggtgcagggattcgcaatcgggctcaaacagcgtccccaccgttgccgccttgtcaaatgcaggctgcaaatag

SEQ ID NO: 166 - protein, 201 aa, Neisseria gonorrhoeae
MTMICLRFQAFVPHTSALSNTSTAAGPSCPMAAVRSMMKIQPGFFSLMYSKETGCPCPSLRKDSSTGGRPMSPCIQLANRDCVPKADTLLPVTDSTSPRPLPLAASRFWANSASICAFNSATRASLPKIRDRVSICFSPLVRILPLSTVKSMVVAFFANCSYASAPGPPVMTNCGLWRCRDSQSGSNSVPTVAALSNAGCK

SEQ ID NO: 167 - DNA, 606 bp, Neisseria meningitidis
atgacgatgatttgcttgcgcttccaagcgttcgtgccgcgtaccagcgcgttatccamtacttcgacagccgccggccyttcytgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 168 - protein, 201 aa, Neisseria meningitidis
  misc_feature (20)..(20): Xaa can be any naturally occurring amino acid
  misc_feature (27)..(27): Xaa can be any naturally occurring amino acid
  misc_feature (174)..(174): Xaa can be any naturally occurring amino acid
  misc_feature (177)..(177): Xaa can be any naturally occurring amino acid
  misc_feature (183)..(183): Xaa can be any naturally occurring amino acid
MTMICLRFQAFVPRTSALSXTSTAAGXSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSXGLXRCRASXSGSNSVPTVAALSNAGCK

SEQ ID NO: 169 - DNA, 606 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 170 - protein, 198 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSGLRCRASSGSNSVPTVAALSNAGCK

SEQ ID NO: 171 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaa

SEQ ID NO: 172 - protein, 173 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTS

SEQ ID NO: 173 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaa

SEQ ID NO: 174 - protein, 173 aa, Neisseria meningitidis; identical to SEQ ID NO: 172

SEQ ID NO: 175 - DNA, 387 bp, Neisseria gonorrhoeae
atggttgtttcaaatcaaaatatctatgccgtcggcccatcagcactttttcacatccgaaggcaaaaatccgtaatgccgcctgaacgcttcgttgaaccgtcccgcgtggcggtagccgcaaaagtgcatcgcggcttggatggtgctgcccgattcgatgagggcgagcgcgtgttccagccgcaggcggcgcaggcgtccggcgacggtttcgccggtttgcgctttgaaatagcgtttcaggtagcattcgttcagcccgacgcggcgggcgatttcggcgatggtcagcgggcgggcgaattcgctgttcaaaatatcggcggcttcgtctatgcgccggcggcggtagccgttgtcgtggcggcggaaggtgaagcgtaa

SEQ ID NO: 176 - protein, 128 aa, Neisseria gonorrhoeae
MVVSNQNIYAVGPSALFHIRRQKSVMPPERFVEPSRVAVAAKVHRGLDGAARFDEGERVFQPQAAQASGDGFAGLRFEIAFQVAFVQPDAAGDFGDGQRAGEFAVQNIGGFVYAPAAVAVVVAAEGEA

SEQ ID NO: 177 - DNA, 390 bp, Neisseria meningitidis
atggttgtttcaaatcaaaatatctatgccgccggcccctcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataa

SEQ ID NO: 178 - protein, 129 aa, Neisseria meningitidis
MVVSNQNIYAAGPSALLHIRRQKSVMPSERFVEPSRVAVAAKVHGGLDGAAGFDEGERVFQPQAAQASGDGFAGLRFEIAFQVAFVQSDAAGDFGDGQRTGEFVLQDVGGFVYAPTAVTVVVAAEGEAQ

SEQ ID NO: 179 - DNA, 390 bp, Neisseria meningitidis; identical to SEQ ID NO: 177

SEQ ID NO: 180 - protein, 129 aa, Neisseria meningitidis; identical to SEQ ID NO: 178

SEQ ID NO: 181 - DNA, 270 bp, Neisseria gonorrhoeae
atgctgcccgaccagagcgtcgagttcttgccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagcccttcgataacggcggtcagctccatgcggttgttggtggtttgcgcttcgccgccgaaaagttctttttcgcggctgccgtagcgcattaa

SEQ ID NO: 182 - protein, 89 aa, Neisseria gonorrhoeae
MLPDQSVEFLPQVVVFDGLFGGGFPAVALPTVYPVFHAVFDVLRVGADDDGAAAFERFQPFDNGGQLHAVVGGLRFAAEKFFFAAAVAH

SEQ ID NO: 183 - DNA, 270 bp, Neisseria meningitidis
atgccgtccgactagagcgtcgagttctttccagaagtcgtcgtttttgacgggctgtttggaggcggttttccagccgttgcgcttccaaccgtgtatccagttttccatgccatttttgacgtattgcgagtcggtgcagatgatgacggtgcagcggcgtttgagcgatttcagtccttcgatgacggcagtcagttccatgcggttgttggtggtttgcgcttcgccgccgaaaagttctttttcgtggctaccgtagcgcaytaa

SEQ ID NO: 184 - protein, 89 aa, Neisseria meningitidis
  misc_feature (5)..(5): Xaa can be any naturally occurring amino acid
MPSDXSVEFFPEVVVFDGLFGGGFPAVALPTVYPVFHAIFDVLRVGADDDGAAAFERFQSFDDGSQFHAVVGGLRFAAEKFFFVATVAH

SEQ ID NO: 185 - DNA, 270 bp, Neisseria meningitidis
gtgccgtccgaccagcgcgtcgagttctttccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagtccttcgatgacggcggtcagttccatacggttgttggtggtttgcgcttcgccgccgaaaagttctttttcgtggctgccgtagcgcattaa

SEQ ID NO: 186 - protein, 89 aa, Neisseria meningitidis
VPSDQRVEFFPQVVVFDGLFGGGFPAVALPTVYPVFHAVFDVLRVGADDDGAAAFERFQSFDDGGQFHTVVGGLRFAAEKFFFVAAVAH

SEQ ID NO: 187 - DNA, 561 bp, Neisseria gonorrhoeae
atgtcggcaatgctgcgtccgacaagcagcccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttataatgtgaagggggatgcgccgttgccgaaaacggtttggacatcgaggcggctgcctgtttcctgcaatgctttttcgtcgatgtcgataacggttacgtcgttgttggtgatggcggcaaggttttgcgcgacggtagaacctacctgcccgttgcctaaaatgaggattttcacggtatgggtcgccgggtga

SEQ ID NO: 188 - protein, 186 aa, Neisseria gonorrhoeae
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARYNVKGDAPLPKTVWTSRRLPVSCNAFSSMSITVTSLLVMAARFCATVEPTCPLPKMRIFTVWVAG

SEQ ID NO: 189 - DNA, 559 bp, Neisseria meningitidis
atgtcggcaatgctgcgtccgacaagcastccgcrsgcgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 190 - protein, 186 aa, Neisseria meningitidis
  misc_feature (10)..(10): Xaa can be any naturally occurring amino acid
  misc_feature (12)..(13): Xaa can be any naturally occurring amino acid
MSAMLRPTSXPXXRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 191 - DNA, 561 bp, Neisseria meningitidis
atgtcggcaatgctgcgtccgacaagcagtccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 192 - protein, 186 aa, Neisseria meningitidis
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 193 - DNA, 930 bp, Neisseria gonorrhoeae
atggtcatcatacaggcgcggcgcggcgggctgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctgtttgccgccgccgccgaaaacatcggggcggtcatacccgaattgcgccccaaagaaaccagcacccgccgcatcatgattgccggcggcggcaacatctgctaccgcctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcgcacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggtgaccacatcatctttttcgtctcgcgccggcgcatcctgaacgaactggagaaactcatccaagtcaaaatgggctttttcggataa

SEQ ID NO: 194 - protein, 309 aa, Neisseria gonorrhoeae
MVIIQARRGGLLVGRSIADIAQDLPDGADCQICAVYRNNRLIVPAPQTVIIEGDEILFAAAAENIGAVIPELRPKETSTRRIMIAGGGNICYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 195 - DNA, 937 bp, Neisseria meningitidis
atggtcatcatacaggcgcgcsygcggastgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaacccaaagaaaccagcccmgmmgcatcatgattkccggcggcggcaacatcggctaccgtctcgccaagcagctcgaacacgcatacaacgtyaaaatcatcgaatgccggccgcgccgtgccgaatggatagccgaaaacctcgacaacaccctcgtcytgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataa

SEQ ID NO: 196 - protein, 312 aa, Neisseria meningitidis
  misc_feature (8)..(9): Xaa can be any naturally occurring amino acid
  misc_feature (11)..(11): Xaa can be any naturally occurring amino acid
  misc_feature (83)..(84): Xaa can be any naturally occurring amino acid
  misc_feature (88)..(88): Xaa can be any naturally occurring amino acid
MVIIQARXXGXLVGRSIADIAQDLPDGADCQICAVYRNNRLIVPAPQTVIIEGDEILFAAAAENIGAVIPELRPKETQRNQPXXIMIXGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 197 - DNA, 930 bp, Neisseria meningitidis
atggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaagtcaaaatgggctttttcggataa

SEQ ID NO: 198 - protein, 309 aa, Neisseria meningitidis
MVIIQARRGGLLVGRSIADIAQDLPDGADCQICAVYRNNRLIVPAPQTVIIEGDEILFAAAAENIGAVIPELRPKETSTRRIMIAGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 199 - DNA, 453 bp, Neisseria gonorrhoeae
atgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 200 - protein, 150 aa, Neisseria gonorrhoeae
MLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 201 - DNA, 453 bp, Neisseria meningitidis
atgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 202 - protein, 150 aa, Neisseria meningitidis
MLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 203 - DNA, 453 bp, Neisseria meningitidis
atgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 204 - protein, 150 aa, Neisseria meningitidis
MLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 205 - DNA, 420 bp, Neisseria gonorrhoeae
atgcgggcgcaggcgtttgatcaaccgttcggtcagctcctgttcggacaggcagaacacttcgcgccggttgacggctttcgggttcaggatattgatttggacgggcatcaacgcctcttccgcaccgccttcgccgttttccgcaaccccgtctgccgccgtaccggattctgccgcatcggcgttttccccgccctcaatctgtgcggtttcaaattcggcactgtcttttttggcatcgaaccggattctccgccgcgattcgatgtgtttttccgaaaccggcatttgcagggaagcctgcgcgttgagccagttttcctgaaggacgatcatcgggtcggtttcgacttcctcgccgcaatcggcaacggcgctgttgtgttcttcctgccatttcttcagatacgcctttaa

SEQ ID NO: 206 - protein, 139 aa, Neisseria gonorrhoeae
MRAQAFDQPFGQLLFGQAEHFAPVDGFRVQDIDLDGHQRLFRTAFAVFRNPVCRRTGFCRIGVFPALNLCGFKFGTVFFGIEPDSPPRFDVFFRNRHLQGSLRVEPVFLKDDHRVGFDFLAAIGNGAVVFFLPFLQIRL

SEQ ID NO: 207 - DNA, 417 bp, Neisseria gonorrhoeae
atgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 208 - protein, 139 aa, Neisseria meningitidis
MRAQAFDQPFGQLLFGQAEHFAPVDGFRVQDIDLDGHQRFFRIVFPVFRNRRLIRAGFCLVGVFPAFNLSGFKFDTVFFGIKPDSPPRFDVFFRNRHLQGSLRVEPVFLKDDHRVGFDFLAAIGNGGIVFLLPFFQIRL

SEQ ID NO: 209 - DNA, 417 bp, Neisseria meningitidis
atgcgggcgcaggcgtttgatcagccgttcggtcagctcctgttcggacaggcagaacacttcgcgccggttgacggctttcgggttcagaatattgatttggacgggcatcaacgcttcttccgcaccgccttcgccgttttccgcaaccccgtctgccgccgtacccgattctgccgcatcggcgttttccccgccttcaatctgtccggtttcaaattcggcactgtcttttttggcatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 210 - protein, 139 aa, Neisseria meningitidis
MRAQAFDQPFGQLLFGQAEHFAPVDGFRVQNIDLDGHQRFFRTAFAVFRNPVCRRTRFCRIGVFPAFNLSGFKFGTVFFGIKPDSPPRFDVFFRNRHLQGSLRVEPVFLKDDHRVGFDFLAAIGNGGIVFLLPFFQIRL

SEQ ID NO: 211 - DNA, 384 bp, Neisseria gonorrhoeae
atgggcgcgggctggtgtcctcccggcatcttgggcatcggcatcggcggcacgcccgaaaaagccgtgttgatggcaaaagaatccctgatgagccacatcgacatccaagaattgcaggaaaaagccgcgtccggggcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgtgtcgaagactga

SEQ ID NO: 212 - protein, 127 aa, Neisseria gonorrhoeae
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVED

SEQ ID NO: 213 - DNA, 298 bp, Neisseria meningitidis
atgggcgcgggctggtgtcctcccggcatcttgggtatcggcatcggcggcagccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccg

SEQ ID NO: 214 - protein, 130 aa, Neisseria meningitidis
  misc_feature (18)..(18): Xaa can be any naturally occurring amino acid
MGAGWCPPGILGIGIGGXAEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDGPI

SEQ ID NO: 215 - DNA, 387 bp, Neisseria meningitidis
atgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggccc

SEQ ID NO: 216 - protein, 129 aa, Neisseria meningitidis
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWP

SEQ ID NO: 217 - DNA, 1524 bp, Neisseria gonorrhoeae
atgaccgttatcaagcaagaagactttattcaaagtatctgcgatgccttccaattcatcagctactaccatccaaaagactacatcgacgcgctttataaggcgtggcagaaggaagaaaatcccgccgccaaagacgcgatgacgcagattttggtcaacagccgtatgtgtgccgaaaacaaccgccccatctgccaagacacaggtatcgcaaccgtcttcctcaaagtcggtatggatgtgcaatgggatgcggacatgagcgtggaaaagatggttaacgaaggcgtacgccgcgcctacacttgggaaggcaacaccctgcgcgcttccgtcctcgccgatccggccggcaaacgccaaaacaccaaagacaacacccccgccgtcatccacatgagcatcgtgccgggcggtaaagtcgaagtaacctgcgcggcaaaaggcggcggctctgaaaacaaatccaaactcgctatgctcaacccttccgacaacatcgtcgattgggtattgaaaaccatcccgacgatgggcgcgggctggtgtcctcccggcatcttgggcatcggcatcggcggcacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgcgtcgaagactgacccgatctgacttacagccccgacaacggcaaacgcgtcgatgtcgataagctgaccaaagaagaagtggcaagctggaaaaccggcgacgtattgctgttgaacggcaaaatcctcaccggccgcgatgccgcgcacaaacgcctcgtcaatatgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 218 - protein, 506 aa, Neisseria gonorrhoeae
MTVIKQEDFIQSICDAFQFISYYHPKDYIDALYKAWQKEENPAAKDAMTQILVNSRMCAENNRPICQDTGIATVFLKVGMDVQWDADMSVEKMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDPDLTYSPDNGKRVDVDKLTKEEVASWKTGDVLLLNGKILTGRDAAHKRLVNMLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 219 - DNA, 1524 bp, Neisseria meningitidis
atgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 220 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMNVQWDADMSVEEMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 221 - DNA, 1524 bp, Neisseria meningitidis
atgaccgtcatcaaacaggaagactttatccaaagcatttgcgatgccttccaattcatcagctactaccatcccaaagactacatcgacgcgctttataaggcgtggcagaaggaagaaaaccccgccgccaaagacgcgatgacgcagattttggtcaacagccgcatgtgtgccgaaaacaaccgccccatctgccaagataccggtatcgcgaccgtgtttttgaaagtcggtatggatgtgcaatgggatgcagacatgagcgtcgaagagatggttaacgaaggcgtgcgccgcgcctacacttgggaaggcaatacgctgcgcgcttccgttctcgccgaccccgccggcaaacgccaaaataccaaagacaacacgcccgccgtcatccatatgagcatcgtgccgggcgacaaagtcgaagtaacctgcgcggcaaaaggcggcggttctgaaaacaaatccaaactcgccatgctcaacccttccgacaacatcgtcgattgggtattgaaaaccattccgaccatgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 222 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMDVQWDADMSVEEMVNEGVRRAYTWEGNTLRASVLADPAGKRQNTKDNTPAVIHMSIVPGDKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 223 - DNA, 360 bp, Neisseria gonorrhoeae
atggctttggtggcggaggaaacggaaatatccgcgccgtgtttcaaaggctgcgagccgacgggcgacagcaggctgttgtccaccaccaagagcgcgccgatgccgtgcgccaattccgccaaggcttccaagtcggccacttcgcccaaggggttggacggcgtttccaaaaacagcagtttggtgttggctttgacggcggctttccattcatttatatcagtcggcgacacgcggctcactccgatgccgaatttggtaacgatgttattgataaagccgacggtcgtgccgaacaggctgcggctggaaaccacatggtcgcccgcctgcaggaaggtgaaaaacgccgcctga

SEQ ID NO: 224 - protein, 119 aa, Neisseria gonorrhoeae
MALVAEETEISAPCFKGCEPTGDSRLLSTTKSAPMPCANSAKASKSATSPKGLDGVSKNSSLVLALTAAFHSFISVGDTRLTPMPNLVTMLLIKPTVVPNRLRLETTWSPACRKVKNAA

SEQ ID NO: 225 - DNA, 360 bp, Neisseria meningitidis; identical to SEQ ID NO: 223

SEQ ID NO: 226 - protein, 119 aa, Neisseria meningitidis; identical to SEQ ID NO: 224

SEQ ID NO: 227 - DNA, 360 bp, Neisseria meningitidis
atggctttggtcgcggaggaaacggaaatatccgcgccgtgtttcaaaggctgagagccgacaggcgacagcaggctgttgtccaccaccaagagcgcgccgatgccgtgcgccaattccgccaaggcttccaagtcggccacttctcccaagggattggacggcgtttccaaaaacagcagtttggtgttggctttgacggcggctttccattcgtttatatcagtcggcgacacgtgactcacttcgatgccgaatttggtaacgatgttattgataaagccgacggtcgtgccgaacaggctgcggctggaaatcacatggtcgcccgcctgcaaaaaggtgaaaaacgccgcctga

SEQ ID NO: 228 - protein, 117 aa, Neisseria meningitidis
MALVAEETEISAPCFKGEPTGDSRLLSTTKSAPMPCANSAKASKSATSPKGLDGVSKNSSLVLALTAAFHSFISVGDTLTSMPNLVTMLLIKPTVVPNRLRLEITWSPACKKVKNAA

SEQ ID NO: 229 - DNA, 387 bp, Neisseria gonorrhoeae
atgtgtatgccatacgcaataagggtttcagacggcatctgccgcatttttccgccgatgccgtctgaaacacgcaatcagcgcgcgagtgcctgtttcaaatcgtcaatcaaatcgccaacatattccaaaccgaccgacaggcgcaccagtccggggcggataccggcggcgagtttttcttcgggctgcatcctgccgtgcgtggttgtccacggattggtgatggtcgagcgcacgtcgccgaggttggcggtacgggaaaagagttccacgactttccacgcggctgcttggtcggcgacttcaaaaccgatgacgatgccgccgccgttttgctgtttgcggataagctccgcctgcggatggtcgggcaatccggtgtag

SEQ ID NO: 230 - protein, 128 aa, Neisseria gonorrhoeae
MCMPYAIRVSDGICRIFPPMPSETRNQRASACFKSSIKSPTYSKPTDRRTSPGRIPAASFSSGCILPCVVVHGLVMVERTSPRLAVREKSSTTFHAAAWSATSKPMTMPPPFCCLRISSACGWSGNPV

SEQ ID NO: 231 - DNA, 387 bp, Neisseria meningitidis
atgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtag

SEQ ID NO: 232 - protein, 128 aa, Neisseria meningitidis
  misc_feature (99)..(99): Xaa can be any naturally occurring amino acid
  misc_feature (121)..(121): Xaa can be any naturally occurring amino acid
MCMPYKIRVSDGICCPMPSETRNQRASACFKSSIKSPTYSKPTDRRTNPGRMLAASFSSGCILPCVVVHGWVMVERTSPRLAVREKSSTPSTTFHAASXSATSKPMTMPPPFCCLRISAAXGWSDNPV

SEQ ID NO: 233 - DNA, 395 bp, Neisseria meningitidis
acgtgtatgtcatataagataagggtttcagacggcatttgcggtgtttttccgccgatgccgtctgaacacgcaatcagcgcgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacggatgggtaatggtcgagcgcacgtcgccgaggttggcggtacgggagaaaagttcgacgccgtccacgactttccacgcggctgcttggtcggcgacttcaaagccgatgacgatgccgccgccgttttgctgtttgcggataagctccgcctgaggatggtcgggtaatccggtgtaa

SEQ ID NO: 234 - protein, 130 aa, Neisseria meningitidis
  misc_feature (24)..(24): Xaa can be any naturally occurring amino acid
TCMSYKIRVSDGICGVFPPMPSEXRNQRASACFKSSIKSPTYSKPTDRRTNPGRMLAASFSSGCILPCVVVHGWVMVERTSPRLAVREKSSTPSTTFHAAAWSATSKPMTMPPPFCCLRISSAGWSGNPV

SEQ ID NO: 235 - DNA, 414 bp, Neisseria gonorrhoeae
atgccgccttacttcatcaccctcttaacgatggaaaatacaaaaagcgcggcgaaaacgcccactacaatccaaccggcttccataccgtccgcttttgcggcttccaaagcgttttttgccgtttcgggcaacgctgcgtttgcctgtgccgccaaagccagcggggcggctgttacaacagccagttttgcgccgtatttacggcaggtgttaataaatttcatgatattttcctttacgaaatttttaaaaaaatgtgtttgcgggctttgtgaaggttttagagaccgcctgccgggcctcttaaacttaatcttctttttcgtagaatccgaaaattacaaattccccgcctatctcttccaatgccgagctaaaagcgtcttcatagctgtcatatttaccggctga

SEQ ID NO: 236 - protein, 137 aa, Neisseria gonorrhoeae
MPPYFITLLTMENTKSAAKTPTTIQPASIPSAFAASKAFFAVSGNAAFACAAKASGAAVTTASFAPYLRQVLINFMIFSFTKFLKKCVCGLCEGFRDRLPGLLNLIFFFVESENYKFPAYLFQCRAKSVFIAVIFTG

SEQ ID NO: 237 - DNA, 411 bp, Neisseria meningitidis
atgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 238 - protein, 136 aa, Neisseria meningitidis
MPSYFITLLTMENTKSAAKMPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 239 - DNA, 411 bp, Neisseria meningitidis
atgccgtcttacttcatcactctcttaacgatggaaaagacaaaaagcgcggcgaaaacgcccactacaatccaaccggcttccataccgtccgcttttgcggcttccaaagcgttttttgctgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 240 - protein, 136 aa, Neisseria meningitidis
MPSYFITLLTMEKTKSAAKTPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 241 - DNA, 828 bp, Neisseria gonorrhoeae
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaaggcattgggcagtttggcgaaagaatacatccatgggaatattttgaggacggacatcaatggcgcacaggaagcctaccgccggtatccgtggattgcgtcggtcatggtgcgccgccgttttcccgatacggttgaggtcgtcctgaccgagcgcaagccggttgcacgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggaatgtcgttttggacaacggcatcaccgtcaggctcggacgggaaaacgagatgaaacgcctccggctttttaccgaagcgtggcagcatctgttgcgtaagaataaaaatcggttatcctatgtggatatgaggtataaggacggattttcagtcccccatgctcccgacggtttacccgaaaaagaatccgaagaatattgggaacaggtttgggacatattacggcctggcgtcggaaacggttcgacgcaaatttcaatcagttataagggcagacgaacaatggaacagcagtaa

SEQ ID NO: 242 - protein, 275 aa, Neisseria gonorrhoeae
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWNVVLDNGITVRLGRENEMKRLRLFTEAWQHLLRKNKNRLSYVDMRYKDGFSVPHAPDGLPEKESEEYWEQVWDILRPGVGNGSTQISISYKGRRTMEQQ

SEQ ID NO: 243 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaagacattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcagcatctgttgcgtaaaaataaaaatcggttatcctatgtggatatgaggtataaggacggattttcagtccgctatgcttccgacggtttacccgaaaaagaatccgaagaatag

SEQ ID NO: 244 - protein, 242 aa, Neisseria meningitidis
MWDNAEAMERLTRWLLVMMAMLLAASGLVWFYNSNHLPVKQVSLKGNLVYSDKKTLGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYASDGLPEKESEE

SEQ ID NO: 245 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctagtttattccgataagaaagcattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgtttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcaacatctgttgcgtaaaaataaaaatcggttatcctatgtggatatgaggtataaggacggattttcagtccgctatgctcccgacggtttacccgaaaaagaatccgaagaatag

SEQ ID NO: 246 - protein, 242 aa, Neisseria meningitidis
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYAPDGLPEKESEE

SEQ ID NO: 247 - DNA, 1359 bp, Neisseria gonorrhoeae
atgaaaccactggacctaaatttcatctgccaagccctcaagcttccgatgccgtctgaaaacaaacccgtgtcgcgcatcgtaaccgacagccgcgatattcgggaaggcgatgtgtttttcgcattggcgggcgggcggtttgacgcgcatgattttgttggaggcgtattgtctgcgggcgcggcggcggttgtggtttcgcgcgaagattgcgcggctttgggcggcgcgttgaaagtcgatgacacgcttgccgcgttgcaaacgttggcgaaggcgtggcgcgataatgtgaacccgtttgtgttcggcattaccggttcgggcggcaagacgacggtgaaggagatgctggctgcggtattgcgccgccgtttcggcgatgatgccgtttcggcgacggcaggcaacttcaacaaccacatcggattgccgctgactttattgaaattaaacgaaaaacaccgctatgccgtgattgaaatgggcatgaaccattttggcgaactggcggttttaacgcaaatcgccaaacccgatgccgctttggtcaacaacgccctgcgcgcccatgtcggatgcggtttcgacggagtgggcgatattgccaaagcgaaaagcgagatttatgcaggcttatgttcagacggcatggcactgattcctcaagaagatgccaatatggctgtcttcaaaacggcaacgtttaatttgaatacgtgcactttcggcgtcgatagcggcgatgtccgcgcggaaaatatcgtgctgaaacctttgtcgtgcgaatttgatttggtgtgcggcgacgagcgcactgccgtggtgctgcctgttcccggccgccacaatgtccacaacgccgccgctgccgccgcgctggctttggctgccggtttgagtttgaacgatgtggcggaaggtttgcaaggcttcagcaacatcaaaggccgtctgaacgtcaaagccggcatcaagggcgcaaccctgattgacgatacttataatgcgaatcccgacagtatgaaagccgcggttgacgtgttggcgcgtatgcctgcgccgcgcattttcgtgatgggcgatatgggcgaactgggcgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgagccacgatttgcccgaacgcgccaccgtgttggtgaaaggttcgcgctttatgcagatggaagaagtggtcgaggcattggaggataagtga

SEQ ID NO: 248 - protein, 452 aa, Neisseria gonorrhoeae
MKPLDLNFICQALKLPMPSENKPVSRIVTDSRDIREGDVFFALAGGRFDAHDFVGGVLSAGAAAVVVSREDCAALGGALKVDDTLAALQTLAKAWRDNVNPFVFGITGSGGKTTVKEMLAAVLRRRFGDDAVSATAGNFNNHIGLPLTLLKLNEKHRYAVIEMGMNHFGELAVLTQIAKPDAALVNNALRAHVGCGFDGVGDIAKAKSEIYAGLCSDGMALIPQEDANMAVFKTATFNLNTCTFGVDSGDVRAENIVLKPLSCEFDLVCGDERTAVVLPVPGRHNVHNAAAAAALALAAGLSLNDVAEGLQGFSNIKGRLNVKAGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLSHDLPERATVLVKGSRFMQMEEVVEALEDK

SEQ ID NO: 249 - DNA, 1368 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgagcggtttgacgcgcatgattttgttgaagacgtattggctgctggtgcggcggcggttgtggtttcgcgcgaagattgtgctgcaatggatggcgcgttgaaagtcgatgacacgcttgccgcattgcaaacgctggcaaaggcgtggcgtgaaaatgtgaatccgtttgtgttcggcattaccggttcgggcggcaagacgacggtgaaggaaatgctggctgcggtattgcgccgccgtttcggcgatgatgccgtgttggcgacggcaggcaacttcaacaaccatatcggattgccgctgactttgttgaagttaaacgaaaaacaccgctatgccgtgattgaaatgggcatgaaccatttcggcgaactggcggttttaacgcamatcgccaaaccaaatgccgcattggtcaacaacgccatgcgcgcccatgtcggctgcggtttcgacggagtgggcgatattgccaaagcgaaaagcgagatttaccaaggtttatgttcagacggcattgcactgattcctcaagaagatgccaatatggctgtcttcaaaacggcaacgcttaatttgaatacgcgcactttcggcatcgatagcggcgatgttcacgcggaaaatattgtgctgaaaccgttgtcgtgcgaatttgatttggtgtgcggcgatgagcgcgccgccgtggtgctgcctgttcccggccgccacaatgtccacaacgccgccgctgccgccgcgctggctttggctgcgggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcgattgacgtgttggcgcgtatgcctgcgccgcgtattttcgtgatgggcgatatgggcgaactgggcgaactgggcgaggacgaagccgccgctatgcacgccgaagtcggcgcgtatgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 250 - protein, 455 aa, Neisseria meningitidis
  misc_feature (176)..(176): Xaa can be any naturally occurring amino acid
MKPLDLNFICQALKLPMPSESKPVSRIVTDSRDIRAGDVFFALAGERFDAHDFVEDVLAAGAAAVVVSREDCAAMDGALKVDDTLAALQTLAKAWRENVNPFVFGITGSGGKTTVKEMLAAVLRRRFGDDAVLATAGNFNNHIGLPLTLLKLNEKHRYAVIEMGMNHFGELAVLTXIAKPNAALVNNAMRAHVGCGFDGVGDIAKAKSEIYQGLCSDGIALIPQEDANMAVFKTATLNLNTRTFGIDSGDVHAENIVLKPLSCEFDLVCGDERAAVVLPVPGRHNVHNAAAAAALALAAGLSLNDVAEGLKGFSNIKGRLNVKSGIKGATLIDDTYNANPDSMKAAIDVLARMPAPRIFVMGDMGELGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 251 - DNA, 1359 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgggcggtttgatgcgcatgattttgttgaagacgtattggctgcgggtgcggcggcggttgtggtttcgcgcgaagattgcgttgcaatggatggcgcgttgaaagtcgatgacacgcttaccgcgttgcaaatgttggcgaaggcgtggcgcgagaatgtgaacccgtttgtgttcggtattaccggctcgggcggcaagacgacggtgaaggaaatgttggctgcggtattgcgccgccgtttcggcgataatgccgttttggcgacggcaggcaacttcaacaaccacatcggattgccgttgactttgttgaaattaaacgaaaaacaccgctatgccgtgattgaaatgggtatgaaccattttggcgaactggcggttttgacacaaatcgccaaacccgatgccgcattggtcaacaacgccatgcgcgcccatgtcggctgcggtttcgacggagtgggcgatattgccaaagcgaaaagcgagatttatcaaggcttatgttcagacggcatggcgctgattcctcaagaagatgccaatatggctgtcttcaaaacggcaacgcttaatttgaatacgcgcactttcggcatcgatagcggcgatgtccacgcggaaaatatcgtgctgaaaccgttgtcgtgcgaatttgatttggtgtgcggcaacgagtgcgcagccgtggttctgcccgttcccggccgccacaatgtccacaacgccgccgccgccgccgcgctgtctttggctgcaggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcggttgacgtgttggcgcgtatgcctgcgccgcgtattttcgtgatgggcgatatgggcgaactgggtgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 252 - protein, 452 aa, Neisseria meningitidis
MKPLDLNFICQALKLPMPSESKPVSRIVTDSRDIRAGDVFFALAGGRFDAHDFVEDVLAAGAAAVVVSREDCVAMDGALKVDDTLTALQMLAKAWRENVNPFVFGITGSGGKTTVKEMLAAVLRRRFGDNAVLATAGNFNNHIGLPLTLLKLNEKHRYAVIEMGMNHFGELAVLTQIAKPDAALVNNAMRAHVGCGFDGVGDIAKAKSEIYQGLCSDGMALIPQEDANMAVFKTATLNLNTRTFGIDSGDVHAENIVLKPLSCEFDLVCGNECAAVVLPVPGRHNVHNAAAAAALSLAAGLSLNDVAEGLKGFSNIKGRLNVKSGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 253 - DNA, 744 bp, Neisseria gonorrhoeae
atgtggttgttgaagttgcctgccgtcgccgaaacggcatcatcgccgaaacggcggcgcaataccgcagccagcatctccttcaccgtcgtcttgccgcccgaaccggtaatgccgaacacaaacgggttcacattatcgcgccacgccttcgccaacgtttgcaacgcggcaagcgtgtcatcgactttcaacgcgccgcccaaagccgcgcaatcttcgcgcgaaaccacaaccgccgccgcgcccgcagacaatacgcctccaacaaaatcatgcgcgtcaaaccgcccgcccgccaatgcgaaaaacacatcgccttcccgaatatcgcggctgtcggttacgatgcgcgacacgggtttgttttcagacggcatcggaagcttgagggcttggcagatgaaatttaggtccagtggtttcatatttgctttcgttaatattcgggcggcggacacatcggtagcggctgatttttttatcgcctgttttgctgtggtaaaacacagattattttcccattctcattcggcattttttctgtacgtatcattttttagacgtatttttagccgatttgccttttcccgcataccacggcgcggggtcgtcggactgtctgtcgataaaggcaaggttattgccttcgcccggcacatcggggacattcccccaaaaatcatagccgtcatcgggcaactcgtcggtttcgatacccgtccaactgccgaatccgcgtaa

SEQ ID NO: 254 - protein, 247 aa, Neisseria gonorrhoeae
MWLLKLPAVAETASSPKRRRNTAASISFTVVLPPEPVMPNTNGFTLSRHAFANVCNAASVSSTFNAPPKAAQSSRETTTAAAPADNTPPTKSCASNRPPANAKNTSPSRISRLSVTMRDTGLFSDGIGSLRAWQMKFRSSGFIFAFVNIRAADTSVAADFFIACFAVVKHRLFSHSHSAFFLYVSFFRRIFSRFAFSRIPRRGVVGLSVDKGKVIAFARHIGDIPPKIIAVIGQLVGFDTRPTAESA

SEQ ID NO: 255 - DNA, 744 bp, Neisseria meningitidis
  misc_feature (4)..(5): n is a, c, g, or t
atgnngttgttgaagttgcctgccgtcgccaacacggcatcatcgccgaaacggcggcgcaataccgcagccagcatttccttcaccgtcgtcttgccgcccgaaccggtaatgccgaacacaaacggattcacattttcacgccacgcctttgccagcgtttgcaatgcggcaagcgtgtcatcgactttcaacgcgccatccattgcagcacaatcttcgcgcgaaaccacaaccgccgccgcaccagcagccaatacgtcttcaacaaaatcatgcgcgtcaaaccgctcgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggsattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 256 - protein, 247 aa, Neisseria meningitidis
  misc_feature (2)..(2): Xaa can be any naturally occurring amino acid
  misc_feature (179)..(179): Xaa can be any naturally occurring amino acid
MXLLKLPAVANTASSPKRRRNTAASISFTVVLPPEPVMPNTNGFTFSRHAFASVCNAASVSSTFNAPSIAAQSSRETTTAAAPAANTSSTKSCASNRSPANAKNTSPARMSRLSVTMRDTGLLSDGIGSLRAWQMKFRSSGFIFTFVNIRAADTSVAADFFIACFAVVKHRLFSHSHSXFFLYVSFFRRIFSRFAFSRIPRRGVVGQSVDKGKVIAFALHIGNIPPKIIAVIGQLVGFDTRPTAESA

SEQ ID NO: 257 - DNA, 744 bp, Neisseria meningitidis
atgtggttgttgaagttgcctgccgtcgccaaaacggcattatcgccgaaacggcggcgcaataccgcagccaacatttccttcaccgtcgtcttgccgcccgagccggtaataccgaacacaaacgggttcacattctcgcgccacgccttcgccaacatttgcaacgcggtaagcgtgtcatcgactttcaacgcgccatccattgcaacgcaatcttcgcgcgaaaccacaaccgccgccgcacccgcagccaatacgtcttcaacaaaatcatgcgcatcaaaccgcccgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggcattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 258 - protein, 247 aa, Neisseria meningitidis
MWLLKLPAVAKTALSPKRRRNTAANISFTVVLPPEPVIPNTNGFTFSRHAFANICNAVSVSSTFNAPSIATQSSRETTTAAAPAANTSSTKSCASNRPPANAKNTSPARMSRLSVTMRDTGLLSDGIGSLRAWQMKFRSSGFIFTFVNIRAADTSVAADFFIACFAVVKHRLFSHSHSAFFLYVSFFRRIFSRFAFSRIPRRGVVGQSVDKGKVIAFALHIGNIPPKIIAVIGQLVGFDTRPTAESA

SEQ ID NO: 259 - DNA, 696 bp, Neisseria gonorrhoeae
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggcgctttggcttcggttgtatttttattattattggcacgcggcttcccgcgcgtttcttcagttgttttactgatttacgtcggcacaaccgccctatatttgccggtcggctggctgtatggtgcgccttcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatctgtgggggtatttgctgacgtaaaaaactataaacgtcgcagcaaaatatggctgaccatattattgactttgattttgtcctgcgcggtgatggagaaaatcgccggcgataaagattggcgagaacctgatgccggcctgttgttgaatattttcgacctgtattacgacttggctttccgcgccggcacaatatgccgccaagcgcgcccacattttggaagcagcaaaaaaagcgtcaacatggcatatccgccaacttgcgcccaagtataa

SEQ ID NO: 260 - protein, 231 aa, Neisseria gonorrhoeae
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSVGVFADVKNYKRRSKIWLTILLTLILSCAVMEKIAGDKDWREPDAGLLLNIFDLYYDLAFRAGTICRQARPHFGSSKKSVNMAYPPTCAQV

SEQ ID NO: 261 - DNA, 694 bp, Neisseria meningitidis
  misc_feature (78)..(104): n is a, c, g, or t
  misc_feature (113)..(113): n is a, c, g, or t
atgaaacaatccgcccgaataaaaatatgaatcagacattactttatacattgggcatttgcgcgcttttaacctttnnnnnnnnnnnnnnnnnnnnnnnnnnntatcacccngaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 262 - protein, 231 aa, Neisseria meningitidis
  misc_feature (9)..(9): Xaa can be any naturally occurring amino acid
  misc_feature (27)..(35): Xaa can be any naturally occurring amino acid
  misc_feature (200)..(200): Xaa can be any naturally occurring amino acid
MKQSARIKXMNQTLLYTLGICALLTFXXXXXXXXXYHPEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSGGVFADVKNYKRRSKIWLTILLTLILSCAVMDKIASDKDLREPDAGLLLNIFDLYYDLAXRAGTICRQARPHFGSSKKSVNMAYPSCCAQV

SEQ ID NO: 263 - DNA, 695 bp, Neisseria meningitidis
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggagatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 264 - protein, 231 aa, Neisseria meningitidis
  misc_feature (201)..(201): Xaa can be any naturally occurring amino acid
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWRYCVSGGVFADVKNYKRRSKIWLTILLTLILSCAVMDKIASDKDLREPDAGLLLNIFDLYYDLASXAGTICRQARPHFGSSKKSVNMAYPSCCAQV

SEQ ID NO: 265 - DNA, 285 bp, Neisseria gonorrhoeae
atgggcaaagggcaggacttcacgcccctgcgcgacgcgttgaaagataaggcaaaaggcgtgttcctgatcggcgtcgatgcgccgcaaatccgccgcgatttggacggctgcggcttgaacctgaccgactgcgtcactttggaagaggcggttcagacggcatacgcccaagccgaagcgggcgatattgtcttgctcagccccgcctgcgcgagtttcgatatgtttaaaggctacgcgcaccgttcggaagtgtttatcgaagcgtttaaggctttgtga

SEQ ID NO: 266 - protein, 94 aa, Neisseria gonorrhoeae
MGKGQDFTPLRDALKDKAKGVFLIGVDAPQIRRDLDGCGLNLTDCVTLEEAVQTAYAQAEAGDIVLLSPACASFDMFKGYAHRSEVFIEAFKAL

SEQ ID NO: 267 - DNA, 285 bp, Neisseria meningitidis
atgggtaaagggcaggacttcacgcccctgcgcgatgcactggtaggcaaggcaaaaggcgtgttcttgattggtgtcgatgcgccgcaaatccgccgcgatttggacggctgcggcttgaatatgaccgactgcgccactttgggagaagccgttcagacggcatatgcccaagccgaagcaggcgatattgtgttgctcagccccgcctgcgcgagctttgatatgttcaaaggctacgcgcaccgttcggaagtgtttatcgaagcgtttaaggctttgtga

SEQ ID NO: 268 - protein, 94 aa, Neisseria meningitidis
MGKGQDFTPLRDALVGKAKGVFLIGVDAPQIRRDLDGCGLNMTDCATLGEAVQTAYAQAEAGDIVLLSPACASFDMFKGYAHRSEVFIEAFKAL

SEQ ID NO: 269 - DNA, 285 bp, Neillia sinensis
atgggcaaagggcaggacttcacgcccctgcgcgacgcgcttgccggcaaggcaaaaggcgtgttcctgatcggtgtcgatgcgccgcaaatccgccgcgatttggacggctgcgatctgaatatgaccgactgcgccactttggaagaagcggttcagaaggcatatgcccaagccgaagcgggcgatatcgtgctgctcagccccgcctgcgcgagtttcgatatgtttaaaggctacgcgcaccgttcggaagtgtttatcggggcgtttaaggctttgtga

SEQ ID NO: 270 - protein, 94 aa, Neisseria meningitidis
MGKGQDFTPLRDALAGKAKGVFLIGVDAPQIRRDLDGCDLNMTDCATLEEAVQKAYAQAEAGDIVLLSPACASFDMFKGYAHRSEVFIGAFKAL

SEQ ID NO: 271 - DNA, 1192 bp, Neisseria gonorrhoeae
atggtggtgctgatgacggcgttcggcctgctgatgatttattcggcttctgtgtatttggcatcgaaggaaggcggcgatcagtttttctatttgaccaggcaggcggggttcgtcgttgccggccttatagcgagcggttttttatggtttctttgcaggatgaggacatggcggcggcttgtgccgtggatttttgccttatccggcctgttgctggtagccgtattgattgccgggcgcgaaatcaatggcgcgacccgttggatacctttgggtccgttgaatttccagccgaccgagctgttcaagctggcagtcatcctttatttggcaagcctgttcacgcgccgtgaagaagtgttgcgcagcatggaaagtttgggttggcagtcgatttggcgggggacggccaacctgattatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattaccgttggaatgctgtttctggcaggattgccgtggaaatatttttttgtcctggtaggcagcgtcttgggtgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgctgaagaattcggcttcttcgggatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatcgattatgaaaaccgccagaaaatgcgcggttaccgggtggagtaaa

SEQ ID NO: 272 - protein, 396 aa, Neisseria gonorrhoeae
MVVLMTAFGLLMIYSASVYLASKEGGDQFFYLTRQAGFVVAGLIASGFLWFLCRMRTWRRLVPWIFALSGLLLVAVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVITVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRQKMRGYRVE

SEQ ID NO: 273 - DNA, 1190 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcagrcacgtcgtgaaacattagaaatgtacggccgtwtccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggkrtccaaagtttcttcaatatcggtgtgaacatcggtgctttgccgamcaaaggyctgacgcygccgtgatgtccwatggcggttcgtcagtctttttcatgctgatcagcatgatgctgctgtkgcgtatagattatgaaaaccgccggaaaatgcgcggttatcgggtggagtaa

SEQ ID NO: 274 - protein, 396 aa, Neisseria meningitidis
  misc_feature (149)..(149): Xaa can be any naturally occurring amino acid
  misc_feature (160)..(160): Xaa can be any naturally occurring amino acid
  misc_feature (339)..(339): Xaa can be any naturally occurring amino acid
  misc_feature (354)..(354): Xaa can be any naturally occurring amino acid
  misc_feature (359)..(359): Xaa can be any naturally occurring amino acid
  misc_feature (361)..(361): Xaa can be any naturally occurring amino acid
  misc_feature (364)..(364): Xaa can be any naturally occurring amino acid
  misc_feature (380)..(380): Xaa can be any naturally occurring amino acid
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQXRRETLEMYGRXRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGXQSFFNIGVNIGALPXKGLTXPXMSXGGSSVFFMLISMMLLXRIDYENRRKMRGYRVE

SEQ ID NO: 275 - DNA, 1191 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatagattatgaaaaccgccggaaaatgcgcggttaccgggtggagtaa

SEQ ID NO: 276 - protein, 396 aa, Neisseria meningitidis
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRRKMRGYRVE

SEQ ID NO: 277 - DNA, 1069 bp, Neisseria gonorrhoeae
atgggcggtaaaacctttatgctgatggcgggcggaacgggcggacacattttcccagctctggctgtggcggattcattgcgcgtgcgcggtcatcatgtaatttggctgggcagcaaggattcgatggaagagcgcatcgtgccgcaatacggcatacgcttggaaacgctggcgattaaaggaatacgcggcaacggcatcaaacgcaagctgatgcttccgtttactctgtacaaaaccgtccgcgaagcgcagcggattatccgcaaacaccgtgtcgagtgcgtcatcggcttcggcggttttgttacctttcccggcggtctggcggcgaaactcttgggcgtgccgattgtgattcacgagcaaaacgccgtggcaggcttgtccaaccgccacctgtcgcgctgggcgaaacgggtgttgtacgcttttccgaaagcgttcagccacgaaggcggtttggtcggcaaccccgtccgcgccgatattagcaacctgcccgtgcctgccgaacgcttccaagggcgcgaaggccgtctgaaaattttggtggtcggcggcagtttgggtgcggacgttttgaacaaaaccgtaccgcaggcgttggcactgctgcctgaagaggtgcgcccgcagatgtaccaccagtcggggcgtaacaagctgggcaatcttcaggcggattatgacgcgttgggcgtgaaagcggaatgcgtggaatttattaccgacatggtgtccgcctaccgtgatgccgatttggtgatttgccgtgccggcgcgctgacgattgccgagttgacggcggcggggctgggcgcgttgttagtgccgtatcctcacgccgttgatgaccatcaaaccgccaacgcgcgtttcatggtgcaggcagaagcggggctgctgttgccgcaaacccagttgacggcggaaaaactcgccgaaatcctcggcagcctcaaccgcgaaaaatgcctcaaatgggcggaaaacgcccgtacgttggcattgccgcacagcgcggatgacgttgccgaagccgcgattgcgtgtgcggcgtaaa

SEQ ID NO: 278 - protein, 355 aa, Neisseria gonorrhoeae
MGGKTFMLMAGGTGGHIFPALAVADSLRVRGHHVIWLGSKDSMEERIVPQYGIRLETLAIKGIRGNGIKRKLMLPFTLYKTVREAQRIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPEEVRPQMYHQSGRNKLGNLQADYDALGVKAECVEFITDMVSAYRDADLVICRAGALTIAELTAAGLGALLVPYPHAVDDHQTANARFMVQAEAGLLLPQTQLTAEKLAEILGSLNREKCLKWAENARTLALPHSADDVAEAAIACAA

SEQ ID NO: 279 - DNA, 1008 bp, Neisseria meningitidis
  misc_feature (688)..(753): n is a, c, g, or t
atgggcggtaaaacctttatgctgawkkcgggcggaacgggcggacatattttccccgcgctggcggtggcggattcattgcgcgcgcgcggccatcatgtgatttggctgggcagcaaggattcgatggaagagcgtatcgtgccgcaatacggcatacgcttggaaacgctggcgattaaaggcgtgcgcggcaacggcatcaaacgcaaactgatgctgccggttactttgtatcaaaccgtccgcgaagcgcagcggattatccgcaaacaccgtgtcgagtgcgtcatcggcttcggcggcttcgttaccttccccggcggtttggcggcgaagctattargcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcatgcattggctttgctgcccgacaatgcgcgtccgcatatgtaccaccaatcgggacggggcaagctgggcatcttgcaggcgnnnnnnnnnnnnnnnnnnnnnnnnnnnnnnnnnnnnnnnnnnnnnnnnnnnnnnnnnnnnnnnnnngcgggattgggtgcgttgttagtgccgtatcctcacgcggttgacgatcaccaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgtggcggaagccgcgattgcgtgtgcggcgtaa

SEQ ID NO: 280 - protein, 335 aa, Neisseria meningitidis
  misc_feature (9)..(10): Xaa can be any naturally occurring amino acid
  misc_feature (116)..(116): Xaa can be any naturally occurring amino acid
  misc_feature (230)..(251): Xaa can be any naturally occurring amino acid
MGGKTFMLXXGGTGGHIFPALAVADSLRARGHHVIWLGSKDSMEERIVPQYGIRLETLAIKGVRGNGIKRKLMLPVTLYQTVREAQRIIRKHRVECVIGFGGFVTFPGGLAAKLLXVPIVIHEQNAVAGLSNRHLSRWAKRVLYAFPKAFSHEGGLVGNPVRADISNLPVPAERFQGREGRLKILVVGGSLGADVLNKTVPHALALLPDNARPHMYHQSGRGKLGILQAXXXXXXXXXXXXXXXXXXXXXXAGLGALLVPYPHAVDDHQTANARFMVQAEAGLLLPQTQLTAEKLAEILGGLNREKCLKWAENARTLALPHSADDVAEAAIACAA

SEQ ID NO: 281 - DNA, 1068 bp, Neisseria meningitidis
atgggcggtaaaacctttatgctgatggcgggcggaacgggcggacatattttccccgcgctggcggtggcggattcattgcgcgcgcgcggccatcatgtaatttggctgggcagcaaggattcgatggaagagcgcatcgtgccgcaatacgacatcctgctcgaaacgctggcgattaaaggcgtgcgcggcaacggcatcaaacgcaagctgatgctgccgtttactttgtatcaaactgtccgcgaagcgcagcagattatccgcaaacaccgtgtcgagtgcgtcatcggcttcggcggcttcgttacctttcccggcggtttggcggcgaagttattaggcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcaggcattggctttgctgcccgacaatgcgcgtccgcagatgtaccaccaatcgggacggggcaagctgggcagcttgcaggcggattacgacgcgctgggcgtgcaagcggaatgcgtggaatttattaccgatatggtgtccgcctaccgcgatgccgatttggtgatttgccgtgccggcgcgctgacgattgccgagttgacggcggcgggattgggtgcgttgttagtgccgtatcctcacgccgttgatgaccatcaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgttgccgaagccgcgattgcgtgtgcggcgtaa

SEQ ID NO: 282 - protein, 355 aa, Neisseria meningitidis
MGGKTFMLMAGGTGGHIFPALAVADSLRARGHHVIWLGSKDSMEERIVPQYDILLETLAIKGVRGNGIKRKLMLPFTLYQTVREAQQIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPDNARPQMYHQSGRGKLGSLQADYDALGVQAECVEFITDMVSAYRDADLVICRAGALTIAELTAAGLGALLVPYPHAVDDHQTANARFMVQAEAGLLLPQTQLTAEKLAEILGGLNREKCLKWAENARTLALPHSADDVAEAAIACAA

SEQ ID NO: 283 - DNA, 1131 bp, Neisseria gonorrhoeae
atgtttttatggctcgcacatttcagcaactggttaaccggtctgaatatttttcaatacaccacattccgcgccgttatggcggcgttgaccgccttggcgttttccctgatgttcggcccgtggacgatacgcaggctgaccgcgctcaaatgcgggcaggcagtgcgtaccgacggcccgcaaacccacctcgtcaaaaacggcacgccgacgatgggcggttcgctgattctgaccgccattaccgtgtccaccctgttgtggggcaactgggcgaacccgtatatctggattctcttgggcgtactgcttgccaccggtgcgctcggtttttacgacgactggcgcaaagtcgtttataaagaccccaacggcgtgtccgccaaattcaaaatggtgtggcagtcaagcgttgccgttatcgccggtttggcattgttttaccttgccgccaattccgccaacaatattttgattgtcccgtttttcaaacaaatcgccctgccgctgggcgtggtcggctttttggtgttgtcttacctgaccatcgtcggcacatccaacgccgtcaacctcaccgacggcttggacggccttgccgccttcccgttcgtcctcgttgccgccgggctcgccattttcgcctacgtcagcggacactaccaattttcccaatacctccagcttccctatgtcgccggcgcgaacgaagtcgctatattctgcaccgccatgtgcggcgcgtgcctcggatttttgtggttcaacgcctatcccgcgcaagtctttatgggcgatgtcggcgcgctggcattgggtgccgcgctcggtaccgttgccgtcatcgtccgccaagaatttgtcctcgtcattatgggcggtctgttcgtcgtagaagccgtgtccgttatgcttcatgtcggctggtacaagaaaaccaaaaaacgcatcttcctgacggcaccgattcatcaccattaccaacttcgatgctggaaagaaacgcaagtcgtcgtccgtttctggattattaccatcgtcgtggttttgataggtttgagtaccctcaaaattcgcggaaactatgccgtccgaacacctttcagacggcatttgaacgcgcaataa

SEQ ID NO: 284 - protein, 376 aa, Neisseria gonorrhoeae
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLAAFPFVLVAAGLAIFAYVSGHYQFSQYLQLPYVAGANEVAIFCTAMCGACLGFLWFNAYPAQVFMGDVGALALGAALGTVAVIVRQEFVLVIMGGLFVVEAVSVMLHVGWYKKTKKRIFLTAPIHHHYQLRCWKETQVVVRFWIITIVVVLIGLSTLKIRGNYAVRTPFRRHLNAQ

SEQ ID NO: 285 - DNA, 1131 bp, Neisseria meningitidis
  misc_feature (29)..(29): n is a, c, g, or t
  misc_feature (49)..(513): n is a, c, g, or t
atgtttttatggctcgcacatttcagcanctggttaaccggtctgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgttatcgtccgccaagagtttgtcctcgtcattatgggcggattatttgtcgtagaagccgtatccgttatgcttcaggttggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacatctttcagacggcatttgaacgcgcaataa

SEQ ID NO: 286 - protein, 376 aa, Neisseria meningitidis
  misc_feature (361)..(361): Xaa can be any naturally occurring amino acid
  misc_feature (366)..(366): Xaa can be any naturally occurring amino acid
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRXTYAVXTSFRRHLNAQ

SEQ ID NO: 287 - DNA, 1131 bp, Neisseria meningitidis
atgtttttatggctcgcacatttcagcaactggttaaccggtctgaatatttttcaatacaccacattccgcgccgtcatggcggcgttgaccgccttggcgttttccctgatgttcggcccgtggacgatacgcaggctgaccgcgctcaaatgcgggcaggcagtgcgtaccgacggtccgcaaacccacctcgtcaaaaacggcacgccgacgatgggcggttcgctgattctgaccgccattaccgtgtccaccctgttgtggggcaactgggcaaacccgtatatctggattctcttgggcgtattgctcgccacgggcgcactcggtttttacgacgactggcgcaaagtcgtctataaagaccccaacggcgtgtccgccaaattcaaaatggtgtggcagtcaagcgttgccattatcgccggtttggcattgttttaccttgccgccaattccgccaacaatattttgattgtcccgttcttcaaacaaatcgccctgccgctgggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgtcatcgtccgccaagagtttgtcctcgtcattatgggcggattatttgtcgtagaagccgtatccgttatgcttcaggtcggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacacctttcagacggcatttgaacgcgcaataa

SEQ ID NO: 288 - protein, 374 aa, Neisseria meningitidis
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAIIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRTYAVTPFRRHLNAQ

SEQ ID NO: 289 - DNA, 450 bp, Neisseria gonorrhoeae
atgccgcccaaaatcacgaagagcgggttttgcaaaccggcaatcgcggcggcggtcgcgccgacattcgtgcctttgctgtcgtcgatgaataccacgccgtttttctcgccgattttttccacacggtgcggcaagccttggaaggttttgacgtgttccagcaatgcttcgcgcggcaaaccgacggcctcgcacaaagccacggcagccataacgttggcggcgttgtgcaaaccttgcagcgggatgtcttgcgtagaaatcaaatcttcattgccttgttttaaacagcccgtcccgcgttccaaccaaaaatcggcttcgtgttccaaggaaaaccgtttcacttcacgccctgcccgtttcatggcgcggcagaacacgtcgtccgcattcaaaacctgcactccatcgccacggaaaatctcggctttggtatgcgcgtag

SEQ ID NO: 290 - protein, 149 aa, Neisseria gonorrhoeae
MPPKITKSGFCKPAIAAAVAPTFVPLLSSMNTTPFFSPIFSTRCGKPWKVLTCSSNASRGKPTASHKATAAITLAALCKPCSGMSCVEIKSSLPCFKQPVPRSNQKSASCSKENRFTSRPARFMARQNTSSAFKTCTPSPRKISALVCA

SEQ ID NO: 291 - DNA, 450 bp, Neisseria meningitidis
atgccgcccaaaatcackawgagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccackgcagccatgacgttagcggcgttgtgcakaccttgcaacggwatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatag

SEQ ID NO: 292 - protein, 149 aa, Neisseria meningitidis
  misc_feature (7)..(7): Xaa can be any naturally occurring amino acid
  misc_feature (79)..(79): Xaa can be any naturally occurring amino acid
MPPKITXSGFCKPAIAAAVAPTFVPLLSSINTTPFFSPIFSTRCGRPWKVLTCSSNASRDKPMASHKATAAMTLAALCXPCNGMSCVTIKSSLPCFRRPVSRSNQKSASCSNENHFTSRPARFIARQNASSAFKTCTPSPRKILALVCA

SEQ ID NO: 293 - DNA, 450 bp, Neisseria meningitidis
atgccgcctaaaatcacgaagagcggattttgcaaaccggcaatcgcggcggcggtcgcaccgacgttcgtgcctttgctgtcgtcgatgaacaccacgccatttttctcgccgattttttccacgcggtgcggcaggccttgaaaggttttgacgtgttcgagcaatgcttcgcgcggcaaaccgacggcttcgcacaaggcaacggcagccatcacgttagtggcgttgtgcaagccttgcagcggaatatcttgcgtggcaatcaaatcttcattgccttgtttcaggcgacctgtctcacgttccaaccaaaaatcggcttcgtattccaacgaaaaccatttcacctcgcgcccggcgcgcttcatcgcacgacagaacgcatcgtccgcattcaaaacctgcacaccgtcgccacggaaaatcttggctttggtatgcgcgtag

SEQ ID NO: 294 - protein, 148 aa, Neisseria meningitidis
MPPKITKSGFCKPAIAAAVAPTFVPLLSSMNTTPFFSPIFSTRCGRPKVLTCSSNASRGKPTASHKATAAITLVALCKPCSGISCVAIKSSLPCFRRPVSRSNQKSASYSNENHFTSRPARFIARQNASSAFKTCTPSPRKILALVCA

SEQ ID NO: 295 - DNA, 356 bp, Neisseria gonorrhoeae
atgcgcgtagtcgagcaaatcgtcgtagcggtcgagatggtcttcggaaatgttcatcaccgtcgccgcagtcgggcgcaggctttcggtgttttccagttggaagctggaaagctcccacacccacacgtccgcctttttgccttcgcgctgcaattctgcctccaagacgggcgtaccgatattgcccgcaatgacggtatccagcccgcacttgatgcagagatagcggaccaggctggttaccgtggttttgccgttgctgccggtaatcgcaatcaccttgtcgccgcggcggttcacaatgtccgccagcaattggatgtcgcctagcacgcgcccgccgttttgcttga

SEQ ID NO: 296 - protein, 118 aa, Neisseria gonorrhoeae
  misc_feature (111)..(111): Xaa can be any naturally occurring amino acid
  misc_feature (114)..(114): Xaa can be any naturally occurring amino acid
MRVVEQIVVAVEMVFGNVHHRRRSRAQAFGVFQLEAGKLPHPHVRLFAFALQFCLQDGRTDIARNDGIQPALDAEIADQAGYRGFAVAAGNRNHLVAAAVHNVRQQLDVAXHAXRRFA

SEQ ID NO: 297 - DNA, 356 bp, Neisseria meningitidis
atgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttga

SEQ ID NO: 298 - protein, 118 aa, Neisseria meningitidis
  misc_feature (114)..(114): Xaa can be any naturally occurring amino acid
MRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHAXRRFA

SEQ ID NO: 299 - DNA, 356 bp, Neisseria meningitidis
atgcgcgtagtcgagcaagtcgtcgtagcggtcgagatggtcttcggaaatgttcagcactgtcgccgcagtcgggcgcaggctttcggtgttttccagttggaaactggaaagctccaacacccacacgtccgcctttttgccttcgcgctgcaattccgcctccaaaaccggcgcgccgatattgcccgcgataacggtatccagcccacacttgatgcagagatagccgaccaggctcgttaccgtggttttgccgttgctgccggtaatcgcaatcaccttgtcgccgcggcggttcacaatgtccgccagcaattcgatgtcgcccaacacgcgtccgccgtttcgcttaa

SEQ ID NO: 300 - protein, 118 aa, Neisseria meningitidis
  misc_feature (114)..(114): Xaa can be any naturally occurring amino acid
MRVVEQVVVAVEMVFGNVQHCRRSRAQAFGVFQLETGKLQHPHVRLFAFALQFRLQNRRADIARDNGIQPTLDAEIADQARYRGFAVAAGNRNHLVAAAVHNVRQQFDVAQHAXRRFA

SEQ ID NO: 301 - DNA, 1380 bp, Neisseria meningitidis
atgacggcgtttgcatttcagacggcatcacaaagccttaaacgcttcgataaacacttccgaacggtgcgcgtagcctttgaacatatcaaagctcgcgcaggcggggctgagcaacacaatatcgcctgcttcggcttgggcatatgccgtctgaacggcttctcccaaagtggcgcagtcggtcatattcaagccgcagccgtccaaatcgcggcggatttgcggcgcatcgacaccaatcaagaacacgccttttgccttgcctaccagtgcatcgcgcaggggcgtgaagtcctgccctttacccatgccgcccaaaatcacgaagagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccacggcagccatgacgttagcggcgttgtgcagaccttgcaacggaatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttgaacgcctcaatatccggctgccgctcgctgatgccgggactgagagccagaatatcgaaaccgttgtccagcgcatctttcagacggcccgtgtaaaacaccaacccgtcaaacatcttaccgatttgcgacacgcgttccggcttcagctccgcatcatacgcagcaacctccgcgccgtttttgcgcaggtaggcaatcatggaaatacccgtaccgccgagtccggcgacgaggatttttttgttttgaaaagtcattttggtttgtcctaa

SEQ ID NO: 302 - protein, 459 aa, Neisseria meningitidis
MTAFAFQTASQSLKRFDKHFRTVRVAFEHIKARAGGAEQHNIACFGLGICRLNGFSQSGAVGHIQAAAVQIAADLRRIDTNQEHAFCLAYQCIAQGREVLPFTHAAQNHEERILQTGNRGGSRADIRAFAVVDKHHAVFLADFFHAVRQALEGFDVFEQCFARQTDGLTQSHGSHDVSGVVQTLQRNVLRDNQIFIALFQAACLAFQPEISFVFQRKPFYLAPGTLHRAAERIVRIQNLHAVATENLGFGMRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHASAVLLERLNIRLPLADAGTESQNIETVVQRIFQTARVKHQPVKHLTDLRHAFRLQLRIIRSNLRAVFAQVGNHGNTRTAESGDEDFFVLKSHFGLS

SEQ ID NO: 303 - DNA, 309 bp, Neisseria gonorrhoeae
atggaaatacccgtgccgccaagtccggcgacgaggatttttttgtttgaaagtcattttggttttgtcctaaaacaaatcatattgggcaggagacgtccgcccttgcccaagccgctttcagacggcatcgcgagccgattaataacccgccttcaggcgttggtcattgtcgcagctgttttggtctccgttttgacaagccttgccaagccattgttgagcgagcgcaaggtcttggcgcacgccgcgtccatcgtaatacatcaagcccaaattgtattgggcttgggcatccccttgttctga

SEQ ID NO: 304 - protein, 102 aa, Neisseria gonorrhoeae
MEIPVPPSPATRIFLFESHFGFVLKQIILGRRRPPLPKPLSDGIASRLITRLQALVIVAAVLVSVLTSLAKPLLSERKVLAHAASIVIHQAQIVLGLGIPLF

SEQ ID NO: 305 - DNA, 306 bp, Neisseria meningitidis
atggaaatacccgtaccgccgagtccggcgacgaggatttttttgtttgaaaagtcattttggtttgtcctaaaacaaatcatattgagcaggagatgtccgcccctgcccaagccgctttcagacggcatcgcgagctgttcaataacccgccttcaggcgttggtcattgtcgcagccgtcttggtctccgttttgacaagccttgccaaaccattcttgtgcaagggcgcggtcttggcgcacgccgcgtctttcggcatacatcacgcccaaattgttttgggcttgggctaccccctgcgc

SEQ ID NO: 306 - protein, 102 aa, Neisseria meningitidis
MEIPVPPSPATRIFLFEKSFWFVLKQIILSRRCPPLPKPLSDGIASCSITRLQALVIVAAVLVSVLTSLAKPFLCKGAVLAHAASFGIHHAQIVLGLGYPLR

SEQ ID NO: 307 - DNA, 288 bp, Neisseria meningitidis
atggaaatacccgtgccgccaagtccggcgacgaggatttttttgttttggaaatcattttggtttgtcctaaaacaaatcatattgagcaggggatgtctgatcctgctcaagccgctttcagacggcatcgcgagctgttcaataacccgctttcaggcgttggtcattgtcgcagctgtcttggtatccgttttgacaagccttgccaagccattcttgtgcaagggcgcggtcttggcgcacgccgcgtctttcggcatacatcacgcccaaattgttttgggc

SEQ ID NO: 308 - protein, 96 aa, Neisseria meningitidis
MEIPVPPSPATRIFLFWKSFWFVLKQIILSRGCLILLKPLSDGIASCSITRFQALVIVAAVLVSVLTSLAKPFLCKGAVLAHAASFGIHHAQIVLG

SEQ ID NO: 309 - DNA, 1521 bp, Neisseria gonorrhoeae
atgttttttatttcaatccgctatatatttgtcagaaaactatggtgcgcaaacggtcagacctttaaaataacgcctttacgcactaaaaaccaaccggaacgcaacattatgatgaaaaatcgagtaagcaacatccattttgtcggtatcggcggcgtcggcatgagcggtatcgccgaagtcttgcacaatttgggctttaaagtttccggttcggatcaggcgcgaaatgccgctaccgagcatttgagcagcctgggcattcaagtttatcccggccataccgcagaacacgttaacggtgcggatgtcgtcgttgcctctaccgccgtcaagaaagaaaatcccgaagttgtcgctgcgttggagcggcaaattcccgttattccgcgcgccttgatgctggcagagctgatgcgcttccgtgacggcatcgccattgccggtacgcacggcaaaaccacgaccaccagcctgaccgcctccatcctcggcgcggcaggactcgaccccactttcgttatcggcggcaaactcaacgccgcaggcaccaacgcccgcttgggcaaaggcgaatacatcgttgccgaagccgacgaatccgatgcctctttcctacatctgaccccgattatgtccgtcgttaccaatatcgacgaagaccatatggatacctacgggcacagcgtcgaaaaactgcatcaggcgtttatcgatttcatccaccgtatgcccttctacggcaaagcctttttgtgtgttgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgctttgctggtggacgattacggacaccaccccgtcgaaatggcggcaacccttgccgctgcacgcggcgcgtatccggaaaaacgtttggtgctcgccttccagccgcaccgctatacccgcacgcgcgatttgtttgaagactttaccaaagtactcaataccgttgatgcgctggtactgaccgaagtttatgccgccggcgaagagccggttgccgccgccgactcccgcgccttggcgcgtgctatccgcgtattgggcaaacttgagccgatttactgcgaaaatgtcgccgacctgccgcaaatgctgatgaatgttttacaggatggcgatgttgtgttgaatatgggtgcgggaagcatcaaccgcgttccttccgcgctgttggaattgtcgaaacagatttga

SEQ ID NO: 310 - protein, 506 aa, Neisseria gonorrhoeae
MFFISIRYIFVRKLWCANGQTFKITPLRTKNQPERNIMMKNRVSNIHFVGIGGVGMSGIAEVLHNLGFKVSGSDQARNAATEHLSSLGIQVYPGHTAEHVNGADVVVASTAVKKENPEVVAALERQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCVDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYPEKRLVLAFQPHRYTRTRDLFEDFTKVLNTVDALVLTEVYAAGEEPVAAADSRALARAIRVLGKLEPIYCENVADLPQMLMNVLQDGDVVLNMGAGSINRVPSALLELSKQI

SEQ ID NO: 311 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagttaccaacatccattttgtcggtatcggcggcgtcggcatgagcggcatcgccgaagtcttgcacaatttgggctttaaagtttccggttcggatcaggcgcgaaatgccgctaccgagcatttgggcagcctgggcattcaagtttatcccggccataccgccgaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcactaacgcccgcttgggcaaaggcgaatacatcgttgccgaagccgacgagtcggatgcatcctttctgcacctgacaccgattatgtccgtcgttaccaatatcgacgaagaccatatggatacctacgggcacagcgtcgaaaaactgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgcgctcttggtggacgactacggacaccaccccgtcgaaatggcggcgacccttgccgccgcacgcggcgcgtatctggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgccgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggcgcgggaagcatcaaccgcgtccccgccgcgctgctggcattgtcgaaacagatttga

SEQ ID NO: 312 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYLEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLALSKQI

SEQ ID NO: 313 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagtgaccaacatccattttgtcggtatcggcggcgtcggcatgagcggtatcgccgaagtcttgcacaatttgggttttaaagtttccggttcggatcaggcgcgaaatgccgctaccgagcatttgggcagcctgggcattcaagtttatcccggccataccgcagaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcaccaacgcccgcttgggcaaaggcgaatacatcgttgccgaagccgacgagtcggatgcatcctttctgcacctgacaccgattatgtccgtcgttaccaatatcgacgaagaccatatggatacctacgggcacagtgttgagaagctgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggtgtcggccgccgcttccaaaaatacggcgacatcaagttgccaaacggtggaaccgcgctcttggtggacgactacggacaccaccccgtcgaaatggcggcgaccctttccgccgcacgcggcgcgtatccggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgctgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggtgcgggaagcatcaaccgcgtccccgccgcgctgctggaattgtcgaaacagatttga

SEQ ID NO: 314 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLSAARGAYPEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLELSKQI

SEQ ID NO: 315 - DNA, 831 bp, Neisseria gonorrhoeae
atgcagaattttggcaaagtggccgtattgatgggtggtttttccagcgaacgagaaatctcgctggacagcggtaccgccattttgaacgccttaaaaagcaaaggcatagacgcatacgccttcgaccctaaggaaacgccgttatccgaactgaaggagcggggctttcagacggcattcaacatccttcacggtacttacggcgaagacggggctgttcagggtgcattggaactgttgggcattccctataccggcagcggtgtcgccgcctccgccatcggcatggacaaataccgctgcaaactgatttggcaggcattgggattacccgttcccgagttcgccgtactgtacgatgataccgatttcgatgccgtcgaagaaaaattgggtctgccgatgtttgtgaagccggcggccgaaggcagcagcgtcggcgtggtaaaagtcaaagaaaaaggccgtctgaaaagcgtttacgaagaattgaaacaccttcaggggcgaaatcattgccgaacgttttatcggcggcggcgaatattcctgccccgtcctgaacggcaaagggctgcccggcatacacatcatccccgcaaccgagttttacgactacgaagccaagtacaaccgagacgacaccatttatcaatgtccttcggaagatttgaccgaagccgaagaaagcctgatgcgcgaactggcggttcgcggcgcacaggcaatcggtgcggaaggctgcgtgcgcgtcgatttcctcaaagataccgacggcaaactctatctgttggaaatcaacaccctgcccggtatgaccggccatag

SEQ ID NO: 316 - protein, 276 aa, Neisseria gonorrhoeae
MQNFGKVAVLMGGFSSEREISLDSGTAILNALKSKGIDAYAFDPKETPLSELKERGFQTAFNILHGTYGEDGAVQGALELLGIPYTGSGVAASAIGMDKYRCKLIWQALGLPVPEFAVLYDDTDFDAVEEKLGLPMFVKPAAEGSSVGVVKVKEKGRLKSVYEELKHLQGRNHCRTFYRRRRIFLPRPERQRAARHTHHPRNRVLRLRSQVQPRRHHLSMSFGRFDRSRRKPDARTGGSRRTGNRCGRLRARRFPQRYRRQTLSVGNQHPARYDRP

SEQ ID NO: 317 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcctaaagaaaccccattgtctgaattgaaggcacaaggttttcagacggcattcaacatccttcacggtacttacggcraagacggggcggttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcattcccgcaaccgagttttacgactacgaagccaagtacaaccgcgacgacaccatttatcaatgtccttcggaagatttgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgacgagccatag

SEQ ID NO: 318 - protein, 276 aa, Neisseria meningitidis
  misc_feature (70)..(70): Xaa can be any naturally occurring amino acid
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGXDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHLQXRNHCRTFYRRRRIFLPRPERQRAARHTHHSRNRVLRLRSQVQPRRHHLSMSFGRFDRSRRKPDARTGGSRRAGNRCGRLRARRFPQRYRRQTLSVGNQHPARYDEP

SEQ ID NO: 319 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcccaaggaaaccccattgtctgaattgaaggcacaaggttttcagacggcattcaacatccttcacggtacttacggcgaagacggggctgttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacactttcagggcgaaatcattgccgaacggtttatcggcggcggcgaatattcctgccctgtgttgaacggcaaaggcctgcccggcatacacatcatccccgcgaccgagttttatgactacgaagccaagtacaaccgcaacgacaccatttatcaatgtccttcggaagatctgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgaccggccatag

SEQ ID NO: 320 - protein, 275 aa, Neisseria meningitidis
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGEDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHFQXRNHCRTVYRRRRIFLPCVERQRPARHTHHPRDRVLLRSQVQPQRHHLSMSFGRSDRSRRKPDARTGGSRRAGNRCGRLRARRFPQRYRRQTLSVGNQHPARYDRP

SEQ ID NO: 321 - DNA, 312 bp, Neisseria gonorrhoeae
atgtattcgcctttgcccaagcgggcgttggtgcctgcggcgttgagtttgccgccgataacgaaagtggggtcgagtcctgccgcgccgaggatggaggcggtcaggctggtggtcgtggttttgccgtgcgtaccggcaatggcgatgccgtcacggaagcgcatcagctctgccagcatcaaggcgcgcggaataacgggaatttgccgctccaacgcagcgacaacttcgggattttctttcttgacggcggtagaggcaacgacgacatccgcaccgttaacgtgttctgcggtatggccgggataa

SEQ ID NO: 322 - protein, 103 aa, Neisseria gonorrhoeae
MYSPLPKRALVPAALSLPPITKVGSSPAAPRMEAVRLVVVVLPCVPAMAMPSRKRISSASIKARGITGICRSNAATTSGFSFLTAVEATTTSAPLTCSAVWPG

SEQ ID NO: 323 - DNA, 312 bp, Neisseria meningitidis
atgtattcgcctttgcccaagcgggcgttagtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttcggcggtatggccgggataa

SEQ ID NO: 324 - protein, 103 aa, Neisseria meningitidis
MYSPLPKRALVPAALSLPPITKVGSSPAAPRMEAVRLVVVVLPCVPAMAMPSRKRINSANIRARGITGICCSNAATTSGFSFLTAVEVTTTSAPLTCSAVWPG

SEQ ID NO: 325 - DNA, 312 bp, Neisseria meningitidis
atgtattcgcctttgcccaagcgggcgttggtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttctgcggtatggccgggataa

SEQ ID NO: 326 - protein, 103 aa, Neisseria meningitidis; identical to SEQ ID NO: 324

SEQ ID NO: 327 - DNA, 375 bp, Neisseria gonorrhoeae
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaacacacaaaaaggctttgccgtagaagggcatacggtggatgaaatcgataaacgcctgatgcagtttttcgacgctgtgcccgtaggtatccatatggtcttcgtcgatattggtaacgacggacataatcggggtcagtgtaggaaagaggcatcggatcgtcggcttcggcaacgatgtattcgcctttgcccaagcgggcgttggtgcctgcggcgttga

SEQ ID NO: 328 - protein, 124 aa, Neisseria gonorrhoeae
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRGQCRKEASDRRLRQRCIRLCPSGRWCLRR

SEQ ID NO: 329 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttagtgcctgcggcgttga

SEQ ID NO: 330 - protein, 124 aa, Neisseria meningitidis
  misc_feature (120)..(120): Xaa can be any naturally occurring amino acid
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRCQCRKDASDRRLRQRCIRLCPSGRXCLRR

SEQ ID NO: 331 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagcttctcaacactgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttggtgcctgcggcgttga

SEQ ID NO: 332 - protein, 124 aa, Neisseria meningitidis
MSFHLNMDGEFHLRADVFDVGGVDVGGIVQTVSSIRFAHFGQNRADVFAVNTQKGFAVEGHTVDEIDKRLMQLLNTVPVGIHMVFVDIGNDGHNRCQCRKDASDRRLRQRCIRLCPSGRWCLRR

SEQ ID NO: 333 - DNA, 375 bp, Neisseria gonorrhoeae
atggccggtcataccgggcagggtgttgatttccaacagatagagtttgccgtcggtatctttgaggaaatcgacgcgcacgcagccttccgcaccgattgcctgtgcgccgcgaaccgccagttcgcgcatcaggctttcttcggcttcggtcaaatcttccgaaggacattgataaatggtgtcgtctcggttgtacttggcttcgtagtcgtaaaactcggttgcggggatgatgtgtatgccgggcagccctttgccgttcaggacggggcaggaatattcgccgccgccgataaaacgttcggcaatgatttcgcccctgaaggtgtttcaattcttcgtaaacgcttttcagacggcctttttctttga

SEQ ID NO: 334 - protein, 124 aa, Neisseria gonorrhoeae
MAGHTGQGVDFQQIEFAVGIFEEIDAHAAFRTDCLCAANRQFAHQAFFGFGQIFRRTLINGVVSVVLGFVVVKLGCGDDVYAGQPFAVQDGAGIFAAADKTFGNDFAPEGVSILRKRFSDGLFL

SEQ ID NO: 335 - DNA, 374 bp, Neisseria meningitidis
atggctcgtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcaaatcttccgaaggacattgataaatggtgtcgtcgcggttgtacttggcttcgtagtcgtaaaactcggttgcgggaatgatgtgtatgccgggcagccctttgccgttcaggacggggcaggaatattcgccgccgccgataaaacgttcggcaatgatttcgccctgaaggtgtttcaattcttcgtaaacgcttttcagacggccttttcctttga

SEQ ID NO: 336 - protein, 124 aa, Neisseria meningitidis
  misc_feature (108)..(108): Xaa can be any naturally occurring amino acid
MARHTGQGVDFQQIEFAVGIFEEIDAHAAFRTDCLRAANRQFAHQAFFGFGQIFRRTLINGVVAVVLGFVVVKLGCGNDVYAGQPFAVQDGAGIFAAADKTFGNDFAXEGVSILRKRFSDGLFL

SEQ ID NO: 337 - DNA, 374 bp, Neisseria meningitidis
atggccggtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcagatcttccgaaggacattgataaatggtgtcgttgcggttgtacttggcttcgtagtcataaaactcggtcgcggggatgatgtgtatgccgggcaggcctttgccgttcaacacagggcaggaatattcgccgccgccgataaaccgttcggcaatgatttcgccctgaaagtgtttcaattcttcgtaaacgcttttcagacggccttttcctttga

SEQ ID NO: 338 - protein, 124 aa, Neisseria meningitidis
  misc_feature (108)..(108): Xaa can be any naturally occurring amino acid
MAGHTGQGVDFQQIEFAVGIFEEIDAHAAFRTDCLRAANRQFAHQAFFGFGQIFRRTLINGVVAVVLGFVVIKLGRGDDVYAGQAFAVQHRAGIFAAADKPFGNDFAXESVSILRKRFSDGLFL

SEQ ID NO: 339 - DNA, 1311 bp, Neisseria gonorrhoeae
atggatatttcaaaacaaacattgctggatagggtttttaacctgaaggcaaacggtacgacggtacgtaccgagttgatggcgggtttgacgacctttttgacgatgtgctacatcgttatcgtcaatcccctgattttgggcgagaccggaatggatatgggggcggtattcgtcgctacctgtatcgcatccgccatcggctgttttgtcatgggttttatcggcaactatccgattgcgcttgccccggggatggggctgaatgcctatttcacctttgccgtcgttaagggtatgggcgtgccttggcaggtggcgttgggtgcggtgttcatttccggtctgattttcatcctgttcagcttttttaaagtcagggaaatgctggtcaacgcactgcctatgggtttgaaaatgtcgattgccgccggtatcggtttgtttttggcactgatttccctgaaaggcgcaggcattatcgttgccaatccggcaaccttggtcggcttgggcgatattcatcagcccagcgcactgttggcattgttcggttttgtcatggtggtcgtattggggtatttccgcgttcaaggcgcaatcatcatcaccattctgacgattaccgtcattgccagcctgatgggtttgaacgagtttcacggcgtggtcggcgaagtaccgggcattgcgccgacctttatgcagatggattttaaaggtctgtttaccgtcagcatggtcagcgtgattttcgtcttcttcttggtcgatttgttcgacagtaccggaacgctggtcggcgtatcccaccgtgccggactgctggtggacggtaagctgccccgcctgaaacgcgcactgcttgcagactctaccgccattgtggcaggtgcggctttgggtacttcttcaaccacgccttatgtggaaagcgcggcgggcgtatcggcaggcggacggaccggcctgacggcggttaccgtcggcgtattgatgctggcgtgtctgatgttctccccattggcgaaaagtgttccggtatttgccaccgcgcccgcactgctttatgtcggcacgcagatgctccgcagtgcgagggacattgattgggacgatatgactgaagccgcgcccgcgttcctgaccattgtcttcatgccgtttacctattcgattgcagacggcatcgccttcggcttcatcagctatgccgtggtcaaacttttgtgtcgccggactggggacgtgccgcctatggtatgggttgttgccgtattgtgggcattgaaattctggtatttgggctga

SEQ ID NO: 340 - protein, 436 aa, Neisseria gonorrhoeae
MDISKQTLLDRVFNLKANGTTVRTELMAGLTTFLTMCYIVIVNPLILGETGMDMGAVFVATCIASAIGCFVMGFIGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFVMVVVLGYFRVQGAIIITILTITVIASLMGLNEFHGVVGEVPGIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPVFATAPALLYVGTQMLRSARDIDWDDMTEAAPAFLTIVFMPFTYSIADGIAFGFISYAVVKLLCRRTGDVPPMVWVVAVLWALKFWYLG

SEQ ID NO: 341 - DNA, 1311 bp, Neisseria meningitidis
atggacacttcaaaacaaacactgttggacgggatttttaagctgaaggcaaacggtackacggtgcgtaccgagttgatggcgggtttgacaacttttttgacgatgtgctacatcgttatcgtcaaccctcygattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgatttttatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggtttgggcgatattcatcagccgtccgcgttgttggcattgttcggttttgctatggtggtcgtattgggacatttccgcgttcaaggcgcaatcatcatcaccatcttgaccattaccgtcattgccagcctgatgggtttgaatgaatttcacggcatcatcggcgaagtaccgagcattgcgccgacttttatgcagatggattttgaaggcctgtttaccgtcagcatggtcagtgtgattttcgtcttcttcttggtcgatctatttgacagtaccggaacgctggtcggcatatcccaccgtgccgggctgctggtggacggtaagctgccccgcctgaaacgcgcactgcttgcagactctaccgccattgtggcaggtgcggctttgggtacttcttccaccacgccttatgtggaaagcgcggcgggcgtatcggcaggcggacggaccggcctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggatattgattgggacgatatgacggaagccgcacctgcgttcctgaccattgttttcatgccgtttacttattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 342 - protein, 436 aa, Neisseria meningitidis
  misc_feature (45)..(45): Xaa can be any naturally occurring amino acid
MDTSKQTLLDGIFKLKANGTTVRTELMAGLTTFLTMCYIVIVNPXILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFEGLFTVSMVSVIFVFFLVDLFDSTGTLVGISHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 343 - DNA, 1311 bp, Neisseria meningitidis
atggacacttcaaaacaaacactgttggacgggatttttaagctgaaggcaaacggtacgacggtgcgtaccgagttgatggcgggtttgacaacttttttgacgatgtgctacatcgttatcgtcaaccctctgattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgattttcatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggcttgggcgatattcatcagccgtccgcgttgttggcactgttcggttttgccatggtggtcgtattgggacatttccgcgttcaaggcgcaatcatcatcaccattttgacgattaccgtcattgccagcctgatgggtttgaacgaatttcacggcatcatcggcgaagtgccgagcattgcgccgacttttatgcagatggattttaaagggttgtttaccgtcagcatggtcagcgtgattttcgtctttttcctagtcgatctgttcgacagtaccggaacactggtcggtgtatcgcatcgtgccggactgctggtggacggtaagctgccccgcctgaaacgcgcactgcttgcagactctaccgctattgtggcaggtgcggctttgggtacttcttcaaccacgccttatgtggaaagtgcggcgggcgtatcggcaggcgggcggacaggtctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggacatcgattgggacgatatgacggaagccgcacccgcattcctgaccattgtcttcatgccgtttacctattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 344 - protein, 436 aa, Neisseria meningitidis
MDTSKQTLLDGIFKLKANGTTVRTELMAGLTTFLTMCYIVIVNPLILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 345 - DNA, 378 bp, Neisseria gonorrhoeae
atgaccgccgacggtctcttcgtcgctttcaacttcaatacgtttgccgttgtgcgaatattgataccagtacagcaggatgctgcccaggctggcgatcagtttgtcggcgatgtcgcgcgcttcgctgtcgggatggctttcgcgttcgggatgaacgcagccgagcatggacacgccggtacgcatcacgtccatcggatgggtatgtgcaggcaggctttccaaaactttaatcacacggataggcaggccgcgcatggatttgagcttggttttataagcggccagctcgaatttgttgggcagatggccgtgaatcagcaagtgtgcgacttcttcaaactcgcatttttgtgccaaattagaatgtcgtaa

SEQ ID NO: 346 - protein, 125 aa, Neisseria gonorrhoeae
MTADGLFVAFNFNTFAVVRILIPVQQDAAQAGDQFVGDVARFAVGMAFAFGMNAAEHGHAGTHHVHRMGMCRQAFQNFNHTDRQAAHGFELGFISGQLEFVGQMAVNQQVCDFFKLAFLCQIRMS

SEQ ID NO: 347 - DNA, 378 bp, Neisseria meningitidis
atgaccgccgatggtctcttcgtcgctttcaacctcaatgcgtttgccgttgtgcgaatattgataccagtacaagaggatgctgccgaggctggcgatcagtttgtcggcgatgtcgcgcgcttcactttccggatggctttcacgttcaggatgaacgcagcccagcatggatacgccggtacgcattacgtccatcggatgggtatgtgcaggcaggctttccaaaactttaatcacacggataggcaggccgcgcatggatttgagcttggttttataagcggccagctcgaatttgttgggcagatggccgtgaatcagcaggtgggcgacttcttcaaactcgcatttttgtgccaaatcagaatgtcgtaa

SEQ ID NO: 348 - protein, 125 aa, Neisseria meningitidis
MTADGLFVAFNLNAFAVVRILIPVQEDAAEAGDQFVGDVARFTFRMAFTFRMNAAQHGYAGTHYVHRMGMCRQAFQNFNHTDRQAAHGFELGFISGQLEFVGQMAVNQQVGDFFKLAFLCQIRMS

SEQ ID NO: 349 - DNA, 378 bp, Neisseria meningitidis; identical to SEQ ID NO: 347

SEQ ID NO: 350 - protein, 125 aa, Neisseria meningitidis; identical to SEQ ID NO: 348

SEQ ID NO: 351 - DNA, 1920 bp, Neisseria gonorrhoeae
atgctgggacgcgcgtccatgatgcgcctgcccgatattgtcggcgtggagctgacgggcaaacggcaggcgggcattactgccacagacatcgtgttggcactgaccgaattcttgcgtaaagagcgcgtggtcggggcgtttgtcgaatttttcggcgagggcgcgagaagcctgtctatcggcgaccgcgcgaccatttccaacatgacgccggagttcggcgcgactgccgccatgttcgccatcgacgcgcaaactattgattatttgaaactgaccggacgtgacgacgcgcaggtgaaattggtggaaacctacgccaaaaccgcaggcttatgggcaggtggcttgaaaaccgccgtttatccgcgcgttttgaaatttgatttgagcagcgtaacgcgcaatatggcaggcccgagcaacccgcacgcgcgttttgccaccgccgatttggcggcgaaagggctggcgaagccttacgaagagccttcagacggccaaatgcctgacggtgcagtgattattgccgcgattacttcgtgtaccaatacttccaacccgcgcaacgttgtcgccgccgcactgttggcacgcaatgccaaccgcctcggcttgaaacgcaaaccttgggtgaaatcttcgtttgccccgggttcaaaagtagccggaatctatttgaaagaagcaggcttgttgcccgaaatggaaaaactcggcttcggtatcgtcgccttcgcatgtaccacctgtaacggcatgagcggcgcgctcgacccgaaaatccaacaagaaatcatcgaccgcgatttgtacgccaccgccgtattgtcaggcaaccgcaacttcgacggccgtatccatccgtatgcgaaacaggctttcctcgcttcgcctcctttggtcgttgcctacgcattggcaggtagcatccgtttcgatattgaaaacgacgtactcggcgttgcagacggccgcgaaatccgcctgaaagatatctggccgacagacgaagaaatcgatgccatcgttgccgaatatgtgaaaccgcaacaattccgcgacatttatatcccgatgtccgacaccggcacagcgcaaaaagcaccaagcccgctgtacgactggcgaccgatgtccacctacatccgccgtccgccctattgggaaggcgcactggcaggggaacgtacattaagaggtatgcgtccgccggcgattttgcccgacaacatcaccaccgaccacatctcgccatccaatgcgattttggccggcagtgccgcaggtgaatatttggcgaaaatgggtttgcctgaagaagacttcaactcttacgcaacccaccgcggcgaccacttgaccgcccaacgcgcaaccttcgccaatccgaaactgtttaacgaaatggtgagaaacgaagacggcagcgtacgccaaggttcgttggcacgcgttgaaccagaaggccaaaccatgcgcatgtgggaagccatcgaaacctatatgaaccgcaaacagccgcttatcatcattgccggtgcggactatggtcaaggctcaagccgcgactgggcggcgaagggcgtgcggctggcgggtgtggaagccatcgccgccgaaggtttcgagcgcatccaccgcaccaacctcatcggcatgggcgtcttgccgctgcaattcaaacccggcaccaaccgccataccctgcaactggacggtacggaaacctacgacgttgtcggcgaacgcacaccgcgctgcggcctgaccctcgtgattcaccgtaaaaacggagaaaccgtcgaagttccggttacctgccgccccgataccgcagaagaagcattggtatatgaagccggcggcgtattgcaacggtttgcacaggactttttggaagggaacgcggcttag

SEQ ID NO: 352 - protein, 639 aa, Neisseria gonorrhoeae
MLGRASMMRLPDIVGVELTGKRQAGITATDIVLALTEFLRKERVVGAFVEFFGEGARSLSIGDRATISNMTPEFGATAAMFAIDAQTIDYLKLTGRDDAQVKLVETYAKTAGLWAGGLKTAVYPRVLKFDLSSVTRNMAGPSNPHARFATADLAAKGLAKPYEEPSDGQMPDGAVIIAAITSCTNTSNPRNVVAAALLARNANRLGLKRKPWVKSSFAPGSKVAGIYLKEAGLLPEMEKLGFGIVAFACTTCNGMSGALDPKIQQEIIDRDLYATAVLSGNRNFDGRIHPYAKQAFLASPPLVVAYALAGSIRFDIENDVLGVADGREIRLKDIWPTDEEIDAIVAEYVKPQQFRDIYIPMSDTGTAQKAPSPLYDWRPMSTYIRRPPYWEGALAGERTLRGMRPPAILPDNITTDHISPSNAILAGSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIAAEGFERIHRTNLIGMGVLPLQFKPGTNRHTLQLDGTETYDVVGERTPRCGLTLVIHRKNGETVEVPVTCRPDTAEEALVYEAGGVLQRFAQDFLEGNAA

SEQ ID NO: 353 - DNA, 1920 bp, Neisseria meningitidis
atgctgggacgcgcgtccatgatgcgcctgcccgatattgtcggcgttgagctgaacggcaaacggcaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatcctcgcgttttgaaatttgatttgagcagcgtaacgcgcaatatggcaggcccaagtaacccgcatgcccgttttgcgaccgccgatttggcggcgaaagggctggcgaagccttacgaagagccttcggacggccaaatgcccgacggctcggtcatcatcgccgcgattaccagttgcaccaacacttccaacccgcgcaacgttgttgccgccgcgctcttggcacgcaatgccaaccgtctcggcttgaaacgcaaaccttgggtgaaatcttcgtttgccccgggttcaaaagtagccgaaatctatttgaaagaagcgggcctgttgcccgaaatggaaaaactcggcttcggtatcgtcgccttcgcctgcaccacctgcaacggcatgagtggcgcgctggatccgaaaatccagaaagaaatcatcgaccgcgatttgtacgccaccgccgtattatcaggcaaccgcaacttcgacggccgtatccacccgtatgcgaaacaggctttcctcgcttcgcctccgttggtcgttgcctacgcgctggcaggcagtatccgtttcgatattgaaaacgacgtactcggcgttgcagacggcaaggaaatccgcctgaaagacatttggcctgccgatgaagaaatcgatgccgtcgttgccgaatatgtgaaaccgcagcagttccgcgatgtgtatgtaccgatgttcgacaccggcacagcgcaaaaagcacccagtccgctgtacgattggcgtccgatgtccacctacatccgccgtccgccttactgggaaggcgcgctggcaggggaacgcacattaagaggtatgcgtccgctggcgattttgcccgacaacatcaccaccgaccacctctcgccgtccaatgcgattttggccgtcagtgccgcaggcgagtatttggcgaaaatgggtttgcctgaagaagacttcaactcttacgcaacccaccgcggcgaccacttgaccgcccaacgcgctaccttcgccaatccgaaactgtttaacgaaatggtgaaaaacgaagacggcagcgtgcgccaaggctcgttcgcccgcgtcgaacccgaaggcgaaaccatgcgcatgtgggaagccatcgaaacctatatgaaccgcaaacagccgctcatcatcattgccggtgcggactatggtcaaggctcaagccgcgactgggctgcaaaaggcgtacgcctcgccggcgtagaagcgattgttgccgaaggcttcgagcgtatccaccgcaccaaccttatcggcatgggcgtgttgccgctgcagttcaaacccgacaccaaccgccataccctgcaactggacggtacggaaacctacgacgtggtcggcgaacgcacaccgcgctgcgacctgaccctcgtgattcaccgtaaaaacggcgaaaccgttgaagttcccgttacctgctgcctcgatactgcagaagaagtattggtatatgaagccggcggcgtgttgcaacggtttgcacaggattttttggaagggaacgcggcttag

SEQ ID NO: 354 - protein, 639 aa, Neisseria meningitidis
MLGRASMMRLPDIVGVELNGKRQAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAAKGLAKPYEEPSDGQMPDGSVIIAAITSCTNTSNPRNVVAAALLARNANRLGLKRKPWVKSSFAPGSKVAEIYLKEAGLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPADEEIDAVVAEYVKPQQFRDVYVPMFDTGTAQKAPSPLYDWRPMSTYIRRPPYWEGALAGERTLRGMRPLAILPDNITTDHLSPSNAILAVSAAGEYLAKMGLPEEDFNSYATHRGDHLTAQRATFANPKLFNEMVKNEDGSVRQGSFARVEPEGETMRMWEAIETYMNRKQPLIIIAGADYGQGSSRDWAAKGVRLAGVEAIVAEGFERIHRTNLIGMGVLPLQFKPDTNRHTLQLDGTETYDVVGERTPRCDLTLVIHRKNGETVEVPVTCCLDTAEEVLVYEAGGVLQRFAQDFLEGNAA

SEQ ID NO: 355 - DNA, 1920 bp, Neisseria meningitidis
atgctgggacgcgcgtccatgatgcgcctgcccgatattgtcggcgttgagctgaacggcaaacggaaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatccgcgcgttttgaaatttgatttgagcagcgtaacgcgcaatatggcaggcccgagcaacccgcacgcgcgttttgcgaccgccgatttggccggcaaaggcttggctaaaccttacgaagagccttcagacggccaaatgcctgacggtgcagtgattattgccgcgattacttcctgtaccaatacttccaatccgcgcaacgttgtcgccgccgcgctgttggcacgcaatgccaaccgcctcggcttgcaacgcaaaccttgggtgaaatcttcgtttgccccgggttcaaaagtagccgaaatctatttgaaagaagcagatctgctgcccgaaatggaaaaactcggcttcggtatcgttgccttcgcatgtaccacctgtaacggcatgagcggcgcgctggatccgaaaatccagaaagaaatcatcgaccgcgatttgtacgccaccgccgtattgtcaggcaaccgcaactttgacggccgtatccatccgtatgcgaaacaggctttcctcgcttcgcctccgttggtcgttgcctacgcgctggcaggcagcatccgtttcgatattgaaaacgacgtactcggcgttgcagacggcaaagaaatccgcctgaaagacatttggcctaccgatgaagaaatcgatgccatcgttgccgaatatgtgaaaccgcagcaatttcgcgacgtttatatcccgatgttcgacaccggcacagcgcaaaaagcaccaagcccgctgtacgactggcgtccaatgtctacctatatccgccgcccaccttactgggaaggcgcactggcaggggaacgcacattaagcggtatgcgtccgctggcgattttgcccgacaacatcaccaccgaccatctctcgccatccaatgcgattttggcaagcagtgccgcaggcgaatatttggcaaaaatgggtttgcctgaagaagacttcaactcttacgcaacccaccgtggcgaccacttgaccgcccaacgcgcaaccttcgccaatccgaaactgtttaacgaaatggtgagaaacgaagacggcagcgtacgccaaggttcgctggcacgcgttgaacccgaaggccaaaccatgcgcatgtgggaagccatcgaaacctatatgaaccgcaaacagccgctcatcatcattgccggcgcggactacggtcaaggctcaagccgcgactgggctgcaaaaggcgtacgcctcgccggcgtggaagcgattgttgccgaaggcttcgagcgtatccaccgcaccaacttgatcggtatgggcgtgttgccgctgcagttcaaaccgggtaccaaccgccacaccctgcaactggacggtacggaaacctacgacgttgtcggcgaacgcacaccgcgctgcgacctgacccttgtgattcaccgtaaaaacggcgagaccgtcgaagtccccattacctgccgcctcgataccgcagaagaagtgttggtatatgaagccggtggcgtattgcaacggtttgcacaggattttttggaagggaacgcggcttag

SEQ ID NO: 356 - protein, 639 aa, Neisseria meningitidis
MLGRASMMRLPDIVGVELNGKRKAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAGKGLAKPYEEPSDGQMPDGAVIIAAITSCTNTSNPRNVVAAALLARNANRLGLQRKPWVKSSFAPGSKVAEIYLKEADLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPTDEEIDAIVAEYVKPQQFRDVYIPMFDTGTAQKAPSPLYDWRPMSTYIRRPPYWEGALAGERTLSGMRPLAILPDNITTDHLSPSNAILASSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIVAEGFERIHRTNLIGMGVLPLQFKPGTNRHTLQLDGTETYDVVGERTPRCDLTLVIHRKNGETVEVPITCRLDTAEEVLVYEAGGVLQRFAQDFLEGNAA

SEQ ID NO: 357 - DNA, 1245 bp, Neisseria gonorrhoeae
atgtccgccaaaactccgtcgctcttcggcggcgcgatgattatcgccgggaaggttatcggcgcaggtatgttccccaaccccaccgccaacttgggggacgggttaataggctcgctgattgtgctgctgtacacctggtttccattctcctccggcgccctcatgattttggaagtcaacacccataacccccgaggggcaagttttgacaccatggtcaaagacctgctcggacgcggctggaacatcatcaacggcatcgccgtcgctttggtcctatacggctcgacctacgcgtacattttagtcggcggtgacctgaccgccaaaggcatcggcagcgcagtaggcggcaaaatttcgctcaccgtcggacaactcgtcttcttcggcatcctcgccttttgcgtatgggcatccgcacgcttggtcgaccgctttaccggcgtcctcatcggcggcatggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccgacatcttcaaatggaacgacagtatgtccgggcggggcaccaaaaccgtcgcgctgaacttcctgccgcccctgatttcctggctgctcctccccaccggcttctttaccgccattggtgcgtccggcctggcggcaaccgtctgggaccaaggcatcatccccgccatgctgctctacgtttccccccaaaaaattggcgcaggcaagacttataaagtttacggcggcttgtggctgatgttagtcttccttttcggcatcgccaacatcgccgcacaggtattgagccaaatggaactcgtccccgtatttaaaggataa

SEQ ID NO: 358 - protein, 414 aa, Neisseria gonorrhoeae
MSAKTPSLFGGAMIIAGKVIGAGMFPNPTANLGDGLIGSLIVLLYTWFPFSSGALMILEVNTHNPRGASFDTMVKDLLGRGWNIINGIAVALVLYGSTYAYILVGGDLTAKGIGSAVGGKISLTVGQLVFFGILAFCVWASARLVDRFTGVLIGGMVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIADIFKWNDSMSGRGTKTVALNFLPPLISWLLLPTGFFTAIGASGLAATVWDQGIIPAMLLYVSPQKIGAGKTYKVYGGLWLMLVFLFGIANIAAQVLSQMELVPVFKG

SEQ ID NO: 359 - DNA, 1242 bp, Neisseria meningitidis
atgcccaacaaaaccccttcactgttcggcggcgcgatgattatcgccggcacggtcatcggcgcaggcatgctcgccaacccgaccgccacatccggcgtatggtttaccggctcgctggccgtgttgctgtacacctggttttctatgctttccagcggcctgatgattttggaagtcaacacccattatccgcacggcgcaagtttcgacacgatggtcaaagacctgctcggacgcggctggaacatcatcaacggcatcgccgtcgccttcgttttatacctgcttacttacgcttatatcttcgtcggcggcgacctgaccgccaaaggcttaggcagcgcggcaggcggcgacgtttcactcaccgtcggacaactcgtcttcttcggcatcctcgccttttgcgtatgggcatccgcacgcttggtcgaccgcttcaccggcgtccttatcggcggcatggtattgacctttatttgggcggccggcgggctgattgccgatgccaagccgtccgtcctcttcgatacccaagcccccgccggcacaaactactggatttacgccgccaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcatctccggccgcaccaaaaccgccgcgctgaccttcctgccgcccctgatttcctgcctgctcttccccaccggcttcgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 360 - protein, 413 aa, Neisseria meningitidis
MPNKTPSLFGGAMIIAGTVIGAGMLANPTATSGVWFTGSLAVLLYTWFSMLSSGLMILEVNTHYPHGASFDTMVKDLLGRGWNIINGIAVAFVLYLLTYAYIFVGGDLTAKGLGSAAGGDVSLTVGQLVFFGILAFCVWASARLVDRFTGVLIGGMVLTFIWAAGGLIADAKPSVLFDTQAPAGTNYWIYAATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSISGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 361 - DNA, 1242 bp, Neisseria meningitidis
  misc_feature (55)..(55): n is a, c, g, or t
  misc_feature (206)..(206): n is a, c, g, or t
  misc_feature (736)..(736): n is a, c, g, or t
  misc_feature (796)..(796): n is a, c, g, or t
  misc_feature (991)..(991): n is a, c, g, or t
  misc_feature (1038)..(1038): n is a, c, g, or t
  misc_feature (1092)..(1092): n is a, c, g, or t
  misc_feature (1183)..(1183): n is a, c, g, or t
  misc_feature (1200)..(1200): n is a, c, g, or t
atgcccaccaaaaccccttcactgttcggcggcgcgatgattatcgccggcacgntcatcggcgcaggtatgctcgccaacccgaccgccacatccggcgtatggtttaccggctcgctggccgtgttgctgtacacctggttttccatgctctccagcggcctgatgattttggaagtcaacacccactacccccacggcgcgancttcgacaccatggttaaagacctgctcggacggagctggaacatcatcaacggcatcgccgtcgccttcgttttatacctgcttacttacgcttatatcttcgtcggcggcgacctgaccgccaaaggcttaggcagcgcggcaggcggcaatgtttcactcaccgtcggacaactcgtcttcttcggcattctcgccttttgcgtatgggcatccgcacgcttggtcgaccgattcaccagcgtcctcatcggcggcatggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaangcaacctgccgcgcaacgagttcgcccccgtgattgccgccgaagggcaagtctccgtcntgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctntaatttcctgcctgctcttccccaccggctttgttaccgccatcggntacgtcggcctggcggcaaccgtctggacaggcatcatccccgccatgctgctntaccgttcgcgcaaaaaattcggcgcaggcaaaacctataaagtttacggcggcttgtggctgatggtttgggtcttccttttcggcatcntcaacatcgccgcacangtattgagccaaatggaactcgtccccgtatttaaaggataa

SEQ ID NO: 362 - protein, 413 aa, Neisseria meningitidis
  misc_feature (19)..(19): Xaa can be any naturally occurring amino acid
  misc_feature (69)..(69): Xaa can be any naturally occurring amino acid
  misc_feature (246)..(246): Xaa can be any naturally occurring amino acid
  misc_feature (266)..(266): Xaa can be any naturally occurring amino acid
  misc_feature (331)..(331): Xaa can be any naturally occurring amino acid
  misc_feature (395)..(395): Xaa can be any naturally occurring amino acid
  misc_feature (400)..(400): Xaa can be any naturally occurring amino acid
MPTKTPSLFGGAMIIAGTXIGAGMLANPTATSGVWFTGSLAVLLYTWFSMLSSGLMILEVNTHYPHGAXFDTMVKDLLGRSWNIINGIAVAFVLYLLTYAYIFVGGDLTAKGLGSAAGGNVSLTVGQLVFFGILAFCVWASARLVDRFTSVLIGGMVLTFIWATGGLIADAKLPVLFDTQAPTGTNYWIYVATALPVCLASFGFHGNVSSLLKYFKGDAPKVAKSIWTGTLIALVIYVLWQTAIQXNLPRNEFAPVIAAEGQVSVXIETLSKFAQTGNMDKILSLFSYMAIATSFLGVTLGLFDYIADIFKWNDSVSGRTKTAALTFLPPXISCLLFPTGFVTAIGYVGLAATVWTGIIPAMLLYRSRKKFGAGKTYKVYGGLWLMVWVFLFGIXNIAAXVLSQMELVPVFKG

SEQ ID NO: 363 - DNA, 870 bp, Neisseria gonorrhoeae
atgtccgcagaaacatacacacaaatcggctgggtaggcttagggcaaatgggtctgcctatggtaacgcggctcttggacggcggcatcgaagtcggcgtatacaaccgctcgcccgacaaaactgcccccatctccgccaaaggagcaaaagtttacggcagcaccgccgaactcgtccgcgcctgccccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcggacccgccaccaacggcacactgctgattctgttcggcggcagcgaagccgttttaaacccgctgcaaaaaatattttcccttgtcggcaaaaaaaccttccatttcggcgatgtcggcaaaggctcgggcgcgaaactcgtcttgaactcgctcttaggcattttcggcgaagcgtacagcgaagcgatgctgatggcgcggcagttcggcatcgataccgacaccatcgtcgaagccatcggcggctcggcaatggactcgcctatgtttcaaacaaaaaaatcactatgggcaaaccgtgagttcccccctgcctttgcactcaaacacgcttccaaagaccttaacctcgccgtcaaagagcttgaacaggcaggcaacaccctgcccgccgtcgaaaccgttgctgccagctaccgcaaagcagttgaagccggctacggcgaacaggacgtttccggcgtttacctgaaattggcagaacactga

SEQ ID NO: 364 - protein, 289 aa, Neisseria gonorrhoeae
MSAETYTQIGWVGLGQMGLPMVTRLLDGGIEVGVYNRSPDKTAPISAKGAKVYGSTAELVRACPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 365 - DNA, 864 bp, Neisseria meningitidis
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaamatcatcgtcaacatgagcaccatctccccgaccgaaaagctcgccgtcaaagcacttgtcgaagcgcagmgacagtttgccgaagcacccgtttccggatcggtcgggcccgccaccaacggcacgctgctgattctgttcggcggcagcgaaccgttttaaacccgctgcaaaaaatattttccctcgtcggcaaaaaaaccttccatttcggcgatgtcggcaaaggttcgggcgcgaaactcgtcttgaactcgctcttgggcattttcggcgaacgtacagcgaasgmtgctgatggcgcggcagttcggcatcgataccgacaccatcgtcgaagccatcggsgactcggcaatggactcgcccatgttccaaaccaaaaaatccctgtgggcaaaccgcgaattcccgmccgmcttcgccctcaaacacgcctccaaagacctcaacctcgccgtcaaagagcttgaacaggcaggcaacaccctgcccgccgtcgaaaccgttgctgccagctaccgcaaagcagtcgaagccggctacgggacacaggacgtttccggcgtttacctgaaactggcagaacactga

SEQ ID NO: 366 - protein, 287 aa, Neisseria meningitidis
  misc_feature (90)..(90): Xaa can be any naturally occurring amino acid
  misc_feature (144)..(144): Xaa can be any naturally occurring amino acid
  misc_feature (174)..(174): Xaa can be any naturally occurring amino acid
  misc_feature (187)..(188): Xaa can be any naturally occurring amino acid
  misc_feature (229)..(230): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGXIIVNMSTISPTEKLAVKALVEAQRQFAEAPVSGSVGPATNGTLLILFGGSEPFXTRCKKYFPSSAKKPSISAMSAKVRARNSSXTRSWAFSANVQRXXLMARQFGIDTDTIVEAIGDSAMDSPMFQTKKSLWANREFPXXFALKHASKDLNLAVKELEQAGNTLPAVETVAASYRKAVEAGYGTQDVSGVYLKLAEH

SEQ ID NO: 367 - DNA, 870 bp, Neisseria meningitidis
atgtccgcaaacgaatacacacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaagcgatgctgatggcgcggcagttcggcatcgataccgacaccatcgtcgaagccatcggcggctcggcaatggactcgcccatgttccaaaccaaaaaatccctgtgggcaaaccgcgaattcccacccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaattggcagaacactga

SEQ ID NO: 368 - protein, 289 aa, Neisseria meningitidis
MSANEYTQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 369 - DNA, 870 bp, Neisseria gonorrhoeae; identical to SEQ ID NO: 363

SEQ ID NO: 370 - protein, 289 aa, Neisseria gonorrhoeae; identical to SEQ ID NO: 364

SEQ ID NO: 371 - DNA, 870 bp, Neisseria meningitidis
  misc_feature (565)..(565): n is a, c, g, or t
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaancgatgctgatggcgcggcagttcggcatcgataccgacaccatcgtcgaagccatcggsgactcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactga

SEQ ID NO: 372 - protein, 289 aa, Neisseria meningitidis
  misc_feature (189)..(189): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEXMLMARQFGIDTDTIVEAIGDSAMDSPMFQTKKSLWANREFPPAFALKHASKDLNLAVKELEQAGNTLPAVETVAASYRKAVEAGYGEQDVSGVYLKLAEH

SEQ ID NO: 373 - DNA, 870 bp, Neisseria meningitidis; identical to SEQ ID NO: 367

SEQ ID NO: 374 - protein, 289 aa, Neisseria meningitidis; identical to SEQ ID NO: 368

SEQ ID NO: 375 - DNA, 513 bp, Neisseria gonorrhoeae
atggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccggacatcttcaaatggaacgacagtatgtccgggcggcaccaaaaccgtcgcgctga

SEQ ID NO: 376 - protein, 170 aa, Neisseria gonorrhoeae
MVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIAGHLQMERQYVRAAPKPSR

SEQ ID NO: 377 - DNA, 510 bp, Neisseria meningitidis
atggtattgacctttatttgggcggccggcgggctgattgccgatgccaagccgtccgtcctcttcgatacccaagcccccgccggcacaaactactggatttacgccgscaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgcccatcttcaaatggaacgacagcatctccgggccgcaccaaaaccgccgcgctga

SEQ ID NO: 378 - protein, 169 aa, Neillia sinensis
  misc_feature (37)..(37): Xaa can be any naturally occurring amino acid
MVLTFIWAAGGLIADAKPSVLFDTQAPAGTNYWIYAXTALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIAHLQMERQHLRAAPKPPR

SEQ ID NO: 379 - DNA, 777 bp, Neisseria meningitidis
atggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtgattgccgccgaagggcaagtctccgtcctgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctctaatttcctgcctgctcttccccaccggctttgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 380 - protein, 258 aa, Neisseria meningitidis
MVLTFIWATGGLIADAKLPVLFDTQAPTGTNYWIYVATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSVSGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 381 - DNA, 519 bp, Neisseria gonorrhoeae
atgttgccgggcttcaaccggatattcaaacggtttgctccaacactcggaacggcgcataaaacgccgcccttcgcgttatcccgaacggggcggctaatcagatcctatcgccataaaaggcggggtttcaaccgaaaaggaattgagatgaataaaaccttgtctattttgccggcggcaatcttactcggcgggtgcgccgccggcggcaacacattcggcagcttagacggcggcacgggtatgggtggcagcatcgtcaaaatgacggtagaaagccaatgccgtgcggaattggacaggcgcagcgaatggcgtttgaccgcgctggcgatgagtgccgaaaaacaggcggaatgggaaaacaagatttgcggctgcgctaccgaagaagcacctaaccagctgaccggcaacgatgtgatgcagatgctgaaccagtccacgcgcaatcaggcacttgccgccctgaccgtcaaaacggtttccgcctgcttcaaacgcctgtaccgctaa

SEQ ID NO: 382 - protein, 172 aa, Neisseria gonorrhoeae
MLPGFNRIFKRFAPTLGTAHKTPPFALSRTGRLIRSYRHKRRGFNRKGIEMNKTLSILPAAILLGGCAAGGNTFGSLDGGTGMGGSIVKMTVESQCRAELDRRSEWRLTALAMSAEKQAEWENKICGCATEEAPNQLTGNDVMQMLNQSTRNQALAALTVKTVSACFKRLYR

SEQ ID NO: 383 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccggaggcggtaacacattcggcagcttagacggtggcacaggcatgggcggcagcatcgtcaaaatggcggttgggagccaatgccgtgcggaattggacaaacgcagcgaatggcgtttgaccgcgctggcgatgagtgccgaaaaacaggcggagtgggaaaacaagatttgcgcttgcgtcgcccaagaagcacccgaacggatgaccggcaacgatgtgatgcagatgctggctccgtccacgcgcaatcaggcacttgccgccctgaccgccaaaacggtttccgcctgcttcaaacacctgtaccgctaa

SEQ ID NO: 384 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVGSQCRAELDKRSEWRLTALAMSAEKQAEWENKICACVAQEAPERMTGNDVMQMLAPSTRNQALAALTAKTVSACFKHLYR

SEQ ID NO: 385 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccgggggcggtaacacattcggcagcttagacggcggcacaggtatgggcggcagcatcgtcaaaatggcggtagaaagccaatgccgtgcggaattgaacaaacgcagcgaatggcgtttgaccgcgctggcgatgagtgccgaaaaacaggcggaatgggaaaacaagatttgcgcttgcgtcgcccaagaagcacccaaccagctgaccggcaacgatgtgatgcagatgctggatccgtccacgcgcaatcaggcacttgccgccctgaccgccaaaacggtttccgcctgcttcaaacacctgtaccgctaa

SEQ ID NO: 386 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVESQCRAELNKRSEWRLTALAMSAEKQAEWENKICACVAQEAPNQLTGNDVMQMLDPSTRNQALAALTAKTVSACFKHLYR

SEQ ID NO: 387 - DNA, 369 bp, Neisseria gonorrhoeae
atgtattatcgccgggttgtggggctatccgatggacttggcgatttggcagccggtattgatcgtaggcgtatgcttaccgcttttggaagcgggcatggaaatgacgcgcaaaggcaaaaccacccaatccgccgccatcgtggtgttctcttccgtctggtcaatccggttttcggctgggcgttgacgatgctgttggataatttgggcttaatcggctgcaaagaacgcagcgcgcaattaggttttgtcggacgagtattgatacccgcagtaggtttcttaatcttgtgtgtggcgatgggtgcggtcgggatgctgcccggtatccctccgtttttggagcagttcaaatctttgggctag

SEQ ID NO: 388 - protein, 122 aa, Neisseria gonorrhoeae
MYYRRVVGLSDGLGDLAAGIDRRRMLTAFGSGHGNDAQRQNHPIRRHRGVLFRLVNPVFGWALTMLLDNLGLIGCKERSAQLGFVGRVLIPAVGFLILCVAMGAVGMLPGIPPFLEQFKSLG

SEQ ID NO: 389 - DNA, 381 bp, Neisseria meningitidis
atgtattatcgccgggttatggggctatccgatggacttggcgatttggcagccggtattgagcgtagccttggtcgtaggcgtatacttaccgcttttggaagcgggcatggaaatgacgcgcaaaggcaaaaccacccaatccgccgccatcgtggtgttctcttccgccttgtcaatccggttttcggctgggcgttgacgatgctgttggataatttgggcttaatcggctgcaaagagcgcagtgcgcaattaggtttcgccggacgcgtgttgatacccgcagtaggtttcttgatcttgtgtgtggcgatgggtgcggtcgggatgctgcccggtatcccgccgtttttggaacacttcaaatctttgggctag

SEQ ID NO: 390 - protein, 126 aa, Neisseria meningitidis
MYYRRVMGLSDGLGDLAAGIERSLGRRRILTAFGSGHGNDAQRQNHPIRRHRGVLFRLVNPVFGWALTMLLDNLGLIGCKERSAQLGFAGRVLIPAVGFLILCVAMGAVGMLPGIPPFLEHFKSLG

SEQ ID NO: 391 - DNA, 381 bp, Neisseria meningitidis
atgtattatcgccgggttgtggggctatccgatggacttggcgatttggcagccggtattgagcgtagccttggtcgtaggcgtatacttaccgcttttggaagcgggcatggaaatgacgcgcaaaggcaaaaccacccaatccgccgccaccgtggtgttctcttccgcttggtcaatccggttttcggctgggcgttgacgatgctgttggataatttgggcttaatcggctgcaaagagcgcagcgcgcaattaggtttcaccggacgcgtattgatacccgtagtaggtttcttgatcttgtgtgtggcgatgggtgcggtcgggatgctgcccggtatcccgccgtttttggagcacttcaaatctttgggctag

SEQ ID NO: 392 - protein, 126 aa, Neisseria meningitidis
MYYRRVVGLSDGLGDLAAGIERSLGRRRILTAFGSGHGNDAQRQNHPIRRHRGVLFRLVNPVFGWALTMLLDNLGLIGCKERSAQLGFTGRVLIPVVGFLILCVAMGAVGMLPGIPPFLEHFKSLG

SEQ ID NO: 393 - DNA, 372 bp, Neisseria gonorrhoeae
  misc_feature (280)..(280): n is a, c, g, or t
  misc_feature (302)..(302): n is a, c, g, or t
  misc_feature (311)..(311): n is a, c, g, or t
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggtttatacagacanatgctggagagctcttcgcgtntcatgcagnttctataactgattccgccgaagactgtctgcctaatacgcctatctcatcggcgctctga

SEQ ID NO: 394 - protein, 120 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFIQTAGELFAHASITDSAEDCLPNTPISSAL

SEQ ID NO: 395 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataycgtcaaatacctttcaaataatcgggacaaactcccctcacctgccgaaatacawaaacgcatcgatgacgcgcttaaagaaktcaaccggyagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 396 - protein, 351 aa, Neisseria meningitidis
  misc_feature (46)..(46): Xaa can be any naturally occurring amino acid
  misc_feature (64)..(64): Xaa can be any naturally occurring amino acid
  misc_feature (74)..(74): Xaa can be any naturally occurring amino acid
  misc_feature (77)..(77): Xaa can be any naturally occurring amino acid
MPSETRLPNFIRVLIFALGFIFLNACSEQTAQTVTLQGETMGTTYXVKYLSNNRDKLPSPAEIXKRIDDALKEXNRXMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 397 - DNA, 1056 bp, Neisseria meningitidis
atgccgtctgaaacacgcctgccgaactttatccgcaccttgatatttgccctgagttttatcttcctgaacgcctgttcggaacaaaccgcgcaaaccgttaccctgcaaggtgaaacgatgggcacgacctataccgtcaaatacctttcaaataatcgggacaaactcccctcacctgccgaaatacaaaagcgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccacctgaaccgcctgacacacggcgcgctggacgtaaccgtcggccccttggtcaacctttggggattcggccccgacaaatccgttacccgtgaaccgtcgccggaacaaatcaaacaagcagcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccttggcgcatcggcatcgaacagcccaacatcgtccaaggcggcaatacgcagattatcgtcccgctgaacaaccgttcgcttgccacttccggcgattaccgtattttccacgtcgataaaagcggcaaacgcctctcccatatcattaatccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 398 - protein, 351 aa, Neisseria meningitidis
MPSETRLPNFIRTLIFALSFIFLNACSEQTAQTVTLQGETMGTTYTVKYLSNNRDKLPSPAEIQKRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKSGKRLSHIINPNNKRPISHNLASISVVADSAMTADGLSTGLFVLGETEALKLAEREKLAVFLIVRDKGGYRTAMSSEFEKLLR

SEQ ID NO: 399 - DNA, 1056 bp, Neisseria gonorrhoeae
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggttcaaccaacacacagccggcaagcccctccgcatttcaagcgatttcgcacacgttaccgccgaagccgtccgcctgaaccgcctgactcacggcgcactggacgtaaccgtcggccctttggtcaacctttgggggttcggccccgacaaatccgttacccgtgaaccgtcgccggaacaaatcaaacaggcggcatcttatacgggcatagacaaaatcattttgcaacaaggcaaagattacgcttccttgagcaaaacccaccccaaagcctatttggatttatcttcgattgccaaaggcttcggcgttgataaagttgcgggcgaactggaaaaatacggcattcaaaattatctggtcgaaatcggcggcgagttgcacggcaaaggcaaaaatgcgcacggcgaaccgtggcgcatcggtatagagcaacccaatatcatccaaggcggcaatacgcagattatcgtcccgctgaacaaccgttcgcttgccacttccggcgattaccgtattttccacgtcgataaaaacggcaaacgcctttcccacatcatcaatcccaacaacaaacgacccatcagccacaacctcgcctccatcagcgtggtctcagacagtgcaatgacggcggacggtttatccacaggattatttgttttaggcgaaaccgaagccttaaggctggcagaacaagaaaaactcgctgttttcctaattgtccgggataaggacggctaccgcaccgccatgtcttccgaatttgccaagctgctccgctaa

SEQ ID NO: 400 - protein, 351 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 401 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataccgtcaaatacctttcaaataatcgggacaaactcccctcacctgccgaaatacaaaaacgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 402 - protein, 351 aa, Neisseria meningitidis
MPSETRLPNFIRVLIFALGFIFLNACSEQTAQTVTLQGETMGTTYTVKYLSNNRDKLPSPAEIQKRIDDALKEVNRQMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 403 - DNA, 1056 bp, Neisseria meningitidis; identical to SEQ ID NO: 397

SEQ ID NO: 404 - protein, 351 aa, Neisseria meningitidis; identical to SEQ ID NO: 398

SEQ ID NO: 405 - DNA, 423 bp, Neisseria gonorrhoeae
atggcttccatcacttcgccgctgcacggggcgcagcaggaatgcagcaagacttttttatgtccgccgggcgggacgagtatggggcggtcaatgtcggtaacggtaggtttgttttgtgtttccattaacttaacaatatctgtcgaatacggtcaaagcggctattttaccagagccgccgaatgtaaaacagggtgtcagggcatcagcccgagctgcctgaacgaacggacggtttgcgaggtaacgataaaatggtcgagcagcgaaacatcaaccagcgacatggcctgtgccagccgccttgtgaacatgatgtcttcctgcgaaggttcaggcgagccgcccggatggttgtgcgcgataatcaggctgtcggcatattcgtccaatgccagtttgacgatttcgcggatgtaa

SEQ ID NO: 406 - protein, 140 aa, Neisseria gonorrhoeae
MASITSPLHGAQQECSKTFLCPPGGTSMGRSMSVTVGLFCVSINLTISVEYGQSGYFTRAAECKTGCQGISPSCLNERTVCEVTIKWSSSETSTSDMACASRLVNMMSSCEGSGEPPGWLCAIIRLSAYSSNASLTISRM

SEQ ID NO: 407 - DNA, 423 bp, Neisseria meningitidis
atggcttccatcacttcgccgctgcacggggcgcacagagaatgcagcaagacttttttatgtccaccgggcgggacgagtatagggcggtcaatgtcggtaacggtaggtttgttttgtgtttccattaacttaacaatatctgttgaatacggttgaagcggctattttatcagagccgccgcatgtaaaacagagtgtcagggcatcaacccgagctgtctgaacgaacagacgctttgcgakgtaacgataaaatggtcgagcagcgacacatcgaccagcgacattgcctgtgccagccgccttgtgaacatgatgtcttcctgcgaargttcsggcgagccgcccggatggttgtgcgcaataatcaggctgtcggcatattcgtccaatgccagtttgacgatttcgcggatgtaa

SEQ ID NO: 408 - protein, 140 aa, Neisseria meningitidis
  misc_feature (53)..(53): Xaa can be any naturally occurring amino acid
  misc_feature (82)..(82): Xaa can be any naturally occurring amino acid
  misc_feature (112)..(112): Xaa can be any naturally occurring amino acid
MASITSPLHGAHRECSKTFLCPPGGTSIGRSMSVTVGLFCVSINLTISVEYGXSGYFIRAAACKTECQGINPSCLNEQTLCXVTIKWSSSDTSTSDIACASRLVNMMSSCEXSGEPPGWLCAIIRLSAYSSNASLTISRM

SEQ ID NO: 409 - DNA, 438 bp, Neisseria gonorrhoeae
atgccggaggcaagcatcgcctccatcacttcgccgctgcacggggcgcaacaggaatgcagcaagacttttttatgtccgccgggcgggacgagtatggggcggtcaatgtcggtaacggtaggtttgttttgtgtttccattaacttaacgatatctgtcgaatacggttgaagcggctattttatcagagccgccgcatgtaaaacagggtgtcagggcatcagcccgagctgcctgaacgaacggacggtttgcgccgttacgataaaatggtcgagcagcgacacatcgaccagcgacattgcctgtgccagccgccttgtgaacatgatgtcttcctgcgaaggttcgggcgagccgcccggatggttgtgcgcgataatcaggctgtcggcatattcgtccaatgccagtttgacaatttcacggatgtaa

SEQ ID NO: 410 - protein, 144 aa, Neisseria gonorrhoeae
MPEASIASITSPLHGAQQECSKTFLCPPGGTSMGRSMSVTVGLFCVSINLTISVEYGSGYFIRAAACKTGCQGISPSCLNERTVCAVTIKWSSSDTSTSDIACASRLVNMMSSCEGSGEPPGWLCAIIRLSAYSSNASLTISRM

SEQ ID NO: 411 - DNA, 2007 bp, Neisseria gonorrhoeae
atggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgctatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagacaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccccccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 412 - protein, 668 aa, Neisseria gonorrhoeae
MVDELDLLPDAVAATLLADIGRYVPDWNLLVSERCNSTVAELVKGVDEVQKLTHFARVDSLATPEERAQQAETMRKMLLAMVTDIRVVLIKLAMRTRTLLFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 413 - DNA, 1476 bp, Neisseria meningitidis
gtgaaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaawyytkcycgtctttccaacacctcgccgaacacgcgcccgawaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 414 - protein, 491 aa, Neisseria meningitidis
  misc_feature (388)..(390): Xaa can be any naturally occurring amino acid
  misc_feature (401)..(401): Xaa can be any naturally occurring amino acid
VKLKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKXXXSFQHLAEHAPXKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 415 - DNA, 2007 bp, Neisseria meningitidis
atggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 416 - protein, 668 aa, Neisseria meningitidis
MVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 417 - DNA, 2214 bp, Neisseria gonorrhoeae
atgaccgccatcagcccgattcaagacacgcaaagcgcgaccctgcaagaattgcgcgaatggttcgacagctactgcgccgctctgccggacaacgataaaaacctcatcggtaccgcatggtcgctggcgcaggaacattatcctgccgatgccgccacgccgtatggcgagccgctgcccgaccacttcctcggcgcggcgcaaatggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgcaatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagaaaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 418 - protein, 737 aa, Neisseria gonorrhoeae
MTAISPIQDTQSATLQELREWFDSYCAALPDNDKNLIGTAWSLAQEHYPADAATPYGEPLPDHFLGAAQMVDELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEEKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 419 - DNA, 2214 bp, Neisseria meningitidis
atgaccgccatcagcccgattcaagacacgcaaagcgcgactctgcaagaattgcgcgaatggttcgacagctactgcgccgctctgccggacaacgataaaaacctcatcggtaccgcatggttgctggcgcaggaacattaccccgccgatgccgccacgccgtatggcgagccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaaaagcccgaaaaataccgcgaaatcgcgctgcttttggacgaaaaacgcaccgaacgcctcgaatacatcgaaaacttcctcaacatcctgcgcggtgaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaaacctgcccgtctttccaacacctcgccgaacacgcgcccgaaaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 420 - protein, 737 aa, Neisseria meningitidis
MTAISPIQDTQSATLQELREWFDSYCAALPDNDKNLIGTAWLLAQEHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQKPEKYREIALLLDEKRTERLEYIENFLNILRGELKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKTCPSFQHLAEHAPEKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 421 - DNA, 2214 bp, Neisseria meningitidis
atgaccgccatcagcccgattcaagacacgcaaagcgcgactctgcaagaattgcgcgaatggttcgacagctactgcaccgcgctgccgaacaacgataaaaaacttgtcttagccgcccgttcgctggcggaagcacattaccccgccgatgccgccacgccgtatggcgaaccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 422 - protein, 737 aa, Neisseria meningitidis
MTAISPIQDTQSATLQELREWFDSYCTALPNNDKKLVLAARSLAEAHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 423 - DNA, 378 bp, Neisseria gonorrhoeae
atgtgcgagttcaaggattttagaagaaacatcccttgttttgaagagtatgacgaaaattcatttattggcaaatggtatgatgacggggtgtgggatgatgaagaatattggaagctggagaatgatttaatcgaggttaggagaaaatatccttatccgatggatataccaagggatattgtgattggaatcggtaccattattgattttttaatggttccaaattgggagctttttgaaattaaagcttccccttggttgcctgatagcgtgggaattcatgaacgttatgaaagattcacaacgatgctccgttatatttttaccgagaaagacatagtcaacgtgcgatttgattattacaacaaaaaatag

SEQ ID NO: 424 - protein, 125 aa, Neisseria gonorrhoeae
MCEFKDFRRNIPCFEEYDENSFIGKWYDDGVWDDEEYWKLENDLIEVRRKYPYPMDIPRDIVIGIGTIIDFLMVPNWELFEIKASPWLPDSVGIHERYERFTTMLRYIFTEKDIVNVRFDYYNKK

SEQ ID NO: 425 - DNA, 378 bp, Neisseria meningitidis
atgtgtgagttcaaggatattataagaaacgttccttattttgaggggtatgacgaaaattcatttattggcaaatggtatgatgacggggtgtgggatgatgaagaatattggaagttggagaatgatttaatcgaggttagaaaaaaatatccttatccgatggacataccaagatatgttgtcattggaatcggtaccattattgatttcttaatggttccaaattggaaactttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 426 - protein, 125 aa, Neisseria meningitidis
MCEFKDIIRNVPYFEGYDENSFIGKWYDDGVWDDEEYWKLENDLIEVRKKYPYPMDIPRYVVIGIGTIIDFLMVPNWKLFEIKASPWLPDSVGIHERYERFTTMLRYIFTEKDIVNVRFDYYNKK

SEQ ID NO: 427 - DNA, 378 bp, Neisseria meningitidis
atgtgtgagttcaaggattttagaagaaacatcccttgttttgaagagtatgacgaaaattcatttattggcaaatggtatgatgacggggtgtgggatgatgaagaatattggaaattggagaatgatttaatcgaggttagaaaaaaatatccttatccgatggatataccaagggatattgtgattggaatcggtaccattattgattttttaatggttccaaattgggagctttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 428 - protein, 125 aa, Neisseria meningitidis
MCEFKDFRRNIPCFEEYDENSFIGKWYDDGVWDDEEYWKLENDLIEVRKKYPYPMDIPRDIVIGIGTIIDFLMVPNWELFEIKASPWLPDSVGIHERYERFTTMLRYIFTEKDIVNVRFDYYNKK

SEQ ID NO: 429 - DNA, 672 bp, Neisseria gonorrhoeae
atgatgaagacttttaaaaatatattttccgccgccattttgtccgccgccctgccgtgcgcgtatgcggcaaggctaccccaatccgccgtgctgcactattccggcagctacggcattcccgccacgatgacatttgaacgcagcggcaatgcttacaaaatcgtttcgacgattaaagtgccgctatacaatatccgtttcgaatccggcggtacggttgtcggcaataccctgcaccctgcctactataaagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccgggtctgaaaatcaccaacggcaaaaaactttattccgtcggcggcctgaataaggcgggtacgggaaaatacagcataggcggcgtggaaaccgaagtcgtcaaatatcgggtgcggcgcggcgacgatacggtaacgtatttcttcgcaccgtccctgaacaatattccggcacaaatcggctataccgacgacggcaaaacctatacgctgaagctcaaatcggtgcagatcaacggacaggccgccaaaccgtaa

SEQ ID NO: 430 - protein, 223 aa, Neisseria gonorrhoeae
MMKTFKNIFSAAILSAALPCAYAARLPQSAVLHYSGSYGIPATMTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 431 - DNA, 669 bp, Neisseria meningitidis
atgatgaagacttttaaaaatatattttccgccgccattttgtccgccgccctgccgtgcgcgtatgcggcagggctgccccaatccgccgtgctgmactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccg

SEQ ID NO: 432 - protein, 223 aa, Neisseria meningitidis
  misc_feature (33)..(33): Xaa can be any naturally occurring amino acid
MMKTFKNIFSAAILSAALPCAYAAGLPQSAVLXYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 433 - DNA, 672 bp, Neisseria meningitidis
atgatgaagacttttaaaaatatattttccgccgccattttgtccgccgccctgccgtgcgcgtatgcggcagggctgccccaatccgccgtgctgcactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 434 - protein, 223 aa, Neisseria meningitidis
MMKTFKNIFSAAILSAALPCAYAAGLPQSAVLHYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 435 - DNA, 1101 bp, Neisseria gonorrhoeae
atggaaacacagctttacatcggcattatgtcgggaaccagtatggacggggcggatgccgtgctggtacggatggacggcggcaaatggctgggcgcggaagggcacgcctttaccccctaccctgaccggttgcgccgcaaattgctggatttgcaggacacaggcacagacgaactgcaccgcagcaggatgttgtcgcaagaactcagccgcctgtacgcgcaaaccgccgccgaactgctgtgcagtcaaaacctcgctccgtgcgacattaccgccctcggctgccacgggcaaaccgtccgacacgcgccggaacacggttacagcatacagcttgccgatttgccgctgctggcggaactgacgcggatttttaccgtcggcgacttccgcagccgcgaccttgctgccggcggacaaggtgcgccgctcgtccccgcctttcacgaagccctgttccgcgatgacagggaaacacgcgtggtactgaacatcggcgggattgccaacatcagcgtactcccccccggcgcacccgccttcggcttcgacacagggccgggcaatatgctgatggacgcgtggacgcaggcacactggcagctgccttacgacaaaaacggtgcaaaggcggcacaaggcaacatattgccgcaactgctcggcaggctgctcgcccacccgtatttctcacaaccccacccaaaaagcacggggcgcgaactgtttgccctaaattggctcgaaacctaccttgacggcggcgaaaaccgatacgacgtattgcggacgctttcccgattcaccgcgcaaaccgtttgggacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatcctcaatgggtggaggcggccgcatttgcgtggttggcggcgtgttggattaaccgcattcccggtagtccgcacaaagcgaccggcgcatccaaaccgtgtattctgggcgcgggatattattattga

SEQ ID NO: 436 - protein, 366 aa, Neisseria gonorrhoeae
METQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVWDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 437 - DNA, 1101 bp, Neisseria meningitidis
  misc_feature (364)..(606): n is a, c, g, or t
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttccttacgacaaaaacggtgcaaagtcggcacaaggcaacatattgccgcaactgctcgacaggctgctcgcccacccgtatttcgcacaacgccaccctaaaagcacggggcgcgaactgtttgccataaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcgacggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 438 - protein, 366 aa, Neisseria meningitidis
  misc_feature (122)..(202): Xaa can be any naturally occurring amino acid
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAXXXXXXXXXXXXXXXXXXXXXXXXXXXXXXXXXXXXXXXXXXXXXXXXXXXXXXXXXXXXXXXXXXXXXXXXXXXXXXXXXQLPYDKNGAKSAQGNILPQLLDRLLAHPYFAQRHPKSTGRELFAINWLETYLDGGENRYDVLRTLSRFTAQTVCDAVSHAAADARQMYICDGGIRNPVLMADLAECFGTRVSLHSTADLNLDPQWVEAAXFAWLAACWINRIPGSPHKATGASKPCILXAGYYY

SEQ ID NO: 439 - DNA, 1101 bp, Neisseria meningitidis
atggaaacacagctttacatcggcatcatgtcgggaaccagcatggacggggcggatgccgtactgatacggatggacggcggcaaatggctgggcgcggaagggcacgcctttaccccctaccccggcaggttacgccgcaaattgctggatttgcaggacacaggcgcggacgaactgcaccgcagcaggatgttgtcgcaagaactcagccgcctgtacgcgcaaaccgccgccgaactgctgtgcagtcaaaacctcgcgccgtccgacattaccgccctcggctgccacgggcaaaccgtcagacacgcgccggaacacagttacagcgtacagcttgccgatttgccgctgctggcggaacggactcagatttttaccgtcggcgacttccgcagccgcgaccttgcggccggcggacaaggcgcgccgctcgtccccgcctttcacgaagccctgttccgcgacgacagggaaacacgcgcggtactgaacatcggcgggattgccaacatcagcgtactcccccccgacgcacccgccttcggcttcgacacaggaccgggcaatatgctgatggacgcgtggatgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgattcaccgcgcaaaccgttttcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatccgcaatgggtagaagccgccgcgttcgcatggatggcggcgtgttgggtcaaccgcattcccggtagtccgcacaaagcaaccggcgcatccaaaccgtgtattctgggcgcgggatattattattga

SEQ ID NO: 440 - protein, 366 aa, Neisseria meningitidis
METQLYIGIMSGTSMDGADAVLIRMDGGKWLGAEGHAFTPYPGRLRRKLLDLQDTGADELHRSRMLSQELSRLYAQTAAELLCSQNLAPSDITALGCHGQTVRHAPEHSYSVQLADLPLLAERTQIFTVGDFRSRDLAAGGQGAPLVPAFHEALFRDDRETRAVLNIGGIANISVLPPDAPAFGFDTGPGNMLMDAWMQAHWQLPYDKNGAKAAQGNILPQLLDRLLAHPYFAQPHPKSTGRELFALNWLETYLDGGENRYDVLRTLSRFTAQTVFDAVSHAAADARQMYICGGGIRNPVLMADLAECFGTRVSLHSTAELNLDPQWVEAAAFAWMAACWVNRIPGSPHKATGASKPCILGAGYYY

SEQ ID NO: 441 - DNA, 1101 bp, Neisseria meningitidis
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcggaacggacgcggatttttaccgtcggcgacttccgcagccgcgaccttgcggccggcggacaaggcgcgccactcgtccccgcctttcacgaagccctgttccgcgacaacagggaaacacgcgcggtactgaacatcggcgggattgccaacatcagcgtactcccccccgacgcacccgccttcggcttcgacacagggccgggcaatatgctgatggacgcgtggacgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 442 - protein, 366 aa, Neisseria meningitidis
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAXFAWLAACWINRIPGSPHKATGASKPCILXAGYYY

SEQ ID NO: 443 - DNA, 1101 bp, Neisseria meningitidis; identical to SEQ ID NO: 439

SEQ ID NO: 444 - protein, 366 aa, Neisseria meningitidis; identical to SEQ ID NO: 440

SEQ ID NO: 445 - DNA, 732 bp, Neisseria gonorrhoeae
atggctttactgagcatccgcaagctgcacaaacaatacggcagcgtaaccgccatccaatccttagacttggacttggaaaaaggcgaagtcatcgtactgctgggcccgtccggctgcggcaaatccaccctcctgcgctgcgtcaacggtttggagccgcaccaaggcggcagcatcgtgatggacggtgtcggcgaattcggcaaagacgtttcctggcaaaccgcccggcaaaaagtcggtatggtctttcaaagtaacgaactgtttgcccacatgaccgtcatcgaaaacatcttcttaggcccggtaaaggaacaaaaccgcgaccgtgccgaagcagaggcgcaagccggcaaactgttggaacgcgtcggactgctagaccgcaaaaacgcctatccgcgcgaactttccggcggtcagaaacagcgcatcgccattgtccgcgccctgtgcctgaatccggaagtcatcctgctggacgaaatcaccgccgcacttgaccccgaaatggtgcgcgaagtcttggaagtggttttggaactcgcccgcgaagggatgagtatgctcatcgtaacccacgaaatggggttcgcacgcaaagttgccgaccgcatcgtctttatggacaaaggcggcatcgtcgaatcgtccgaccccgaaacctttttttccgcaccaaaaagcgaacgcgcccgccaatttctggcaggtatggactactga

SEQ ID NO: 446 - protein, 243 aa, Neisseria gonorrhoeae
MALLSIRKLHKQYGSVTAIQSLDLDLEKGEVIVLLGPSGCGKSTLLRCVNGLEPHQGGSIVMDGVGEFGKDVSWQTARQKVGMVFQSNELFAHMTVIENIFLGPVKEQNRDRAEAEAQAGKLLERVGLLDRKNAYPRELSGGQKQRIAIVRALCLNPEVILLDEITAALDPEMVREVLEVVLELAREGMSMLIVTHEMGFARKVADRIVFMDKGGIVESSDPETFFSAPKSERARQFLAGMDY

SEQ ID NO: 447 - DNA, 762 bp, Neisseria meningitidis
gttgtcatgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcakgcatggtgtttcaacaatacaayctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggatmccatgaaggaattggcgcaagaaggctggaccatggttgtcgttacgcatgaaatcaagttcgccttagaagtggcaaccaccgwcgtcgtgatggacrgcggcgttattgtcgaacaaggcagcccgcaagatttgttcgaccaccccaaacacgaacggacgcggagatttttaagccaaatccaatctaccaagatttga

SEQ ID NO: 448 - protein, 253 aa, Neisseria meningitidis
  misc_feature (89)..(89): Xaa can be any naturally occurring amino acid
  misc_feature (187)..(187): Xaa can be any naturally occurring amino acid
  misc_feature (215)..(215): Xaa can be any naturally occurring amino acid
  misc_feature (220)..(220): Xaa can be any naturally occurring amino acid
VVMIKIRNIHKTFGENTILRGIDLDVCKGQVVVILGPSGSGKTTFLRCLNALEMPEDGQIEFDNERPLKIDFSKKPSKHDILALRRKSXMVFQQYNLFPHKTALENVMEGPVAVQGKPAAQAREEALKLLEKVGLGDKVDLYPYQLSGGQQQRVGIARALAIQPELMLFDEPTSALDPELVQDVLDXMKELAQEGWTMVVVTHEIKFALEVATTXVVMDXGVIVEQGSPQDLFDHPKHERTRRFLSQIQSTKI

SEQ ID NO: 449 - DNA, 762 bp, Neisseria meningitidis
gttgtcatgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 450 - protein, 253 aa, Neisseria meningitidis
VVMIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 451 - DNA, 756 bp, Neisseria gonorrhoeae
atgattaaaatccgcaatatccataagacctttggcgaaaacaccattttgcgcggcatcgatttggatgtgggcaaagggcaggtggtcgtcatcctcgggccttccggctcgggtaaaacaacatttctgcgctgcctaaacgcgttggaaatgcccgaagacggacaaatcgagttcgacaacgcgcggccgttacgcattgatttttccaaaaaaacaagcaaacacgatattttggcactgcgccgcaagtccggaatggtattccaacaatacaacctcttcccgcataaaaccgtgttggaaaacgtgatggaagggccggttgccgtacagggcaagcctgccgcccaagcgcgcgaagaggctttgaaactgctggaaaaagtcggcttgggcgataaagtggatttgtatccctaccagctttccggcggtcagcagcagcgtgtcggtatcgcccgcgcactggcgattcagcctgaattgatgctgtttgacgaacccacttccgcgctggaccccgagttggtgcaagacgtgttggacgccatgaaggaattggcgcgggaaggttggacgatggtcgtcgttacccacgaaatcaagttcacgctggaagttgccacgaacgtcgtcgtgatggacggcggcgttatcgtagagcagggcagcccgaaagagttgttcgaccacctcaaacacgaacggacgcggagatttttaagccaaatccaatctgccaagatttga

SEQ ID NO: 452 - protein, 251 aa, Neisseria gonorrhoeae
MIKIRNIHKTFGENTILRGIDLDVGKGQVVVILGPSGSGKTTFLRCLNALEMPEDGQIEFDNARPLRIDFSKKTSKHDILALRRKSGMVFQQYNLFPHKTVLENVMEGPVAVQGKPAAQAREEALKLLEKVGLGDKVDLYPYQLSGGQQQRVGIARALAIQPELMLFDEPTSALDPELVQDVLDAMKELAREGWTMVVVTHEIKFTLEVATNVVVMDGGVIVEQGSPKELFDHLKHERTRRFLSQIQSAKI

SEQ ID NO: 453 - DNA, 756 bp, Neisseria meningitidis
atgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggataccatgaaggaattggcgcaagaaggctggaccatggttgtcgttacgcatgaaatcaagttcgccttagaagtggcaaccaccgtcgtcgtgatggacggcggcgttattgtcgaacaaggcagcccgcaagatttgttcgaccaccccaaacacgaacggacgcggagatttttaagccaaatccaatctaccaagatttga

SEQ ID NO: 454 - protein, 251 aa, Neisseria meningitidis
MIKIRNIHKTFGENTILRGIDLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLDTMKELAQEGWTMVVVTHEIKFALEVATTVVVMDGGVIVEQGSPQDLFDHPKHERTRRFLSQIQSTKI

SEQ ID NO: 455 - DNA, 756 bp, Neisseria meningitidis
atgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 456 - protein, 251 aa, Neisseria meningitidis
MIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 457 - DNA, 1032 bp, Neisseria gonorrhoeae
atgtcgggcaatgcctcctctccttcatcttccgccgccatcgggctggtttggttcggcgcggcggtatcgattgccgaaatcagcacgggtacgctgctcgcccccttgggctggcagcgcggtctggcggccctgcttttgggtcatgccgtcggcggcgcgctgttttttgcggcggcgtatatcggcgcactgaccggacgcagctcgatggaaagtgtgcgcctgtcgttcggcaaatgcggttcagtgctgttttccgtggcgaatatgctgcaactggccggctggacggcggtgatgatttacgtcggcgcaacggtcagctccgctttgggcaaagtgttgtgggacggcgaatcctttgtctggtgggcattggcaaacggcgcactgatcgtgctgtggctggttttcggcgcacgcagaacgggcgggctgaaaaccgtttcgatgctgctgatgctgcttgccgtgttgtggttgagcgtcgaagtgttcgcttcgtccggcacaaacgccgcgcccgccgtttcagacggcatgaccttcggaacggcagtcgaactgtccgccgtcatgccgctttcctggctgccgctggccgccgactacacgcgccaagcacgccgcccgtttgcggcaaccctgacggcaacgctcgcctatacgctgacgggctgctggatgtatgccttgggtttggcggcggctctgtttaccggagaaaccgacgtggcgaaaatcctgttgggcgcgggcttgggcataacgggcattctggcagtcgtcctctccaccgttaccacaacgtttctcgatacctattccgccggcgcgagtgcgaacaacatttccgcgcgttttgcggaaatacccgtcgctgtcggcgttaccctgatccgcaccgtgcttgccgtcatgctgcccgttaccgaatataaaaacttcctgctgcttatccgctcggtatttgggccgatggcgggtggttttgattgccgacttttttgtcttaaaacggcgtga

SEQ ID NO: 458 - protein, 1 aa, Neisseria gonorrhoeae
C

SEQ ID NO: 459 - DNA, 1029 bp, Neisseria meningitidis
atgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcargtttgggtgcggcaggcattttggcggtcgtcctctccaccgttaccacaacgtttctcgatgcctattccgccggcgcgagtgcgaacaacatttccgcgcgttttgcggaaacacccgtcgctgtcrgcgttaccctgatcggcacggtacttgccgtcatgctgcccgttaccgaatatgaaaacttcctgctgcttatcggctcggtatttgcgccgatggcgggcggttttgattgccgactttttcgtcttgaaacggcgtga

SEQ ID NO: 460 - protein, 342 aa, Neisseria meningitidis
  misc_feature (254)..(254): Xaa can be any naturally occurring amino acid
  misc_feature (297)..(297): Xaa can be any naturally occurring amino acid
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAXLGAAGILAVVLSTVTTTFLDAYSAGASANNISARFAETPVAVXVTLIGTVLAVMLPVTEYENFLLLIGSVFAPMAGGFDCRLFRLETA

SEQ ID NO: 461 - DNA, 1028 bp, Neisseria meningitidis
atgtcgggcaatgcctcctctccttcatcttccgccgccatcgggctgatttggttcggcgcggcggtatcgattgccgaaatcagcacgggtacactgcttgcgcctttgggctggcagcgcggtctggcggctctgcttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcttggctgccgctggccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctgtcgaccgttaccaccacttttctcgatgcctactccgccggcgtaagtgccaacaatatttccgccaaactttcggaaatacccatcgccgttgccgtcgccgttgtcggcacactgcttgccgtcctcctgcccgttaccgaatatgaaaacttcctgctgcttatcggctcggtatttgcgccgatggcggcggttttgattgccgactttttcgtcttgaaacggcgtga

SEQ ID NO: 462 - protein, 342 aa, Neisseria meningitidis
  misc_feature (330)..(330): Xaa can be any naturally occurring amino acid
MSGNASSPSSSAAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAXGFDCRLFRLETA

SEQ ID NO: 463 - DNA, 867 bp, Neisseria gonorrhoeae
atgccgtctgaaaccccaaaggcacgccgccggctttcagacggcatcgcgtccgacaaccataccaaagaatccatcatgctcaccctgtacggcgaaactttcccttcgcggctgctgctcggcacggcggcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 464 - protein, 288 aa, Neisseria gonorrhoeae
MPSETPKARRRLSDGIASDNHTKESIMLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 465 - DNA, 810 bp, Neisseria gonorrhoeae
cactatacaaaggaacccattatgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 466 - protein, 269 aa, Neisseria meningitidis
HYTKEPIMLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 467 - DNA, 819 bp, Neisseria meningitidis
ttgttaatccactatacaaaggaacccattatgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 468 - protein, 272 aa, Neisseria meningitidis
LLIHYTKEPIMLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 469 - DNA, 789 bp, Neisseria gonorrhoeae
atgctcaccctgtacggcgaaactttcccttcgcggctgctgctcggcacggccgcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 470 - protein, 262 aa, Neisseria gonorrhoeae
MLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 471 - DNA, 789 bp, Neisseria meningitidis
atgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 472 - protein, 262 aa, Neisseria meningitidis
MLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 473 - DNA, 789 bp, Neisseria meningitidis
atgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 474 - protein, 262 aa, Neisseria meningitidis
MLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 475 - DNA, 873 bp, Neisseria gonorrhoeae
atggaaatatggaatatgttgaacacttggcccgatgccgtcccgatacgcgcggaggcggccgaatccgtggcggcggtcgcggctttgctgctggcgcgcgcccttctgttgaatatccacttcagacggcatccggatttcggcatcgaaagcaagcggcggtttttggttgccagccgcaatataacgctgcttttggtgctgttttcgctggcatttatctggtcggcgcaaattcaaacgctggctttgtcgatgtttgcggtggcggcggcggtcgtcgtggcgacaaaagaactgattatgtgtctgtcgggcagtattttaaggtctgccacccagcaatactcggtcggcgactatatcgaaatcaacggcctgcgcgggcgcgtggtcgacatcaatctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccattcagcggtatttggaaaacgtgcaggcggaaaaactgtttatcacgcccgccgccaggccgcgcgttacccgcgtaccgtacgacgacaaggcataccgcatcatcgtccgcttcgcctcccccgtttcaaagcggctggaaatccaacaggcggttatggacgaatttttgcgcgtacaataccgcctgttaaatcatcccgccggctccgaaacactttaa

SEQ ID NO: 476 - protein, 290 aa, Neisseria gonorrhoeae
MEIWNMLNTWPDAVPIRAEAAESVAAVAALLLARALLLNIHFRRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRYLENVQAEKLFITPAARPRVTRVPYDDKAYRIIVRFASPVSKRLEIQQAVMDEFLRVQYRLLNHPAGSETL

SEQ ID NO: 477 - DNA, 873 bp, Neisseria meningitidis
atggaaatatggaatatgttggacacttggctcggtgccgtcccgatacgtgcggaggcggtcgaatccgtggcggcggttgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagtattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccatccaacggsatttggaaaacgtgcaggcggaaaaactgtttatcacgcccgccgccagaccgcgcgttacccgcgtgccgtacgatgacaaggcataccgcatcatcgtccgcttcgcttcccccgtttcaaagcggctggaaatccaacaggcggttatggacgaatttttgcgcgtacaataccgcctgttaaatcaccccgccggctccgaaacactttaa

SEQ ID NO: 478 - protein, 290 aa, Neisseria meningitidis
  misc_feature (220)..(220): Xaa can be any naturally occurring amino acid
MEIWNMLDTWLGAVPIRAEAVESVAAVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRXLENVQAEKLFITPAARPRVTRVPYDDKAYRIIVRFASPVSKRLEIQQAVMDEFLRVQYRLLNHPAGSETL

SEQ ID NO: 479 - DNA, 873 bp, Neisseria meningitidis
atggaaatatggaatatgttggacacttggctcggtgccgtcccgatacgtgcggaggcggtcgaatccgtggcggtggtcgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagcattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactacgtcatccatacggtcgaaatcccggttcccatccatttggattcggatgaagccgtatgccgtctgaaagccgtactcgagcccttgtgcgcgccctacatccccgccatccaacggcatttggaaaacgtgcaggcggaaaaactgtttatcacgcccgccgccaaaccgcgcgttacccgcgtgccgtacgatgacaaggcataccgcatcatcgtccgcttcgcctcccccgtttcaaagcggctggaaatccaacaggcggttatggacgaatttttgcgcgtacaataccgcctgttaaattaccccgccggctccgaaacactttaa

SEQ ID NO: 480 - protein, 290 aa, Neisseria meningitidis
MEIWNMLDTWLGAVPIRAEAVESVAVVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRHLENVQAEKLFITPAAKPRVTRVPYDDKAYRIIVRFASPVSKRLEIQQAVMDEFLRVQYRLLNYPAGSETL

SEQ ID NO: 481 - DNA, 2037 bp, Neisseria gonorrhoeae
atgattgacaacgcactgctccacttgggcgaagaaccccgttttaatcaaatccaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtagaatgggacgcggtcgaactgcccagccagtttatggaaaacttcgtttgggaatacaatgtattggcacaaatgtccgcccacgaagaaaccggcgagcccctgccgaaagaactcttcgacaaaatgctcgccgccaaaaacttccagcgcggtatgttcctcgtccggcaaatggagttcgccctcttcgatatgatgatttacagtgaaagcgacgaatgccgtctgaaaaactggcagcaggttttagacagcgtgcgcaaagaagtcgccgtcatccaaccgcccgaatacaaccgcttcgccaacagcttcggccacatcttcgccggcggctattccgcaggctattacagctacgcatgggccgaagtcctcagcaccgatgcctacgccgcctttgaagaaagcgacgacgtcgccgccacaggcaaacgcttctggcaagaaatccttgccgtcggcggctcccgcagcgcggcggaatccttcaaagccttccgcggacgcgaaccgagcatagacgcactgctgcgccaaagcggtttcgacaacgcggcttga

SEQ ID NO: 482 - protein, 678 aa, Neisseria gonorrhoeae
MIDNALLHLGEEPRFNQIQTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRQSGFDNAA

SEQ ID NO: 483 - DNA, 1431 bp, Neisseria meningitidis
  misc_feature (1216)..(1216): n is a, c, g, or t
  misc_feature (1334)..(1334): n is a, c, g, or t
  misc_feature (1347)..(1347): n is a, c, g, or t
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactgcgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccactacgccagcgaaaaactgcgcgaagccaaatacgcgttcagcgaaaccgawgtcaaaaaatayttcccygtcggcaawgtattaaacggactgttcgcccaamtcaaaaaactmtacggcatcggatttaccgaaaaaacygtccccgtctggcacaaagacgtgcgctattktgaattgcaacaaaacggcgaamccataggcggcgtttatatggatttgtacgcacgcgaaggcaaacgcggcggcgcgtggatgaacgactacaaaggccgccgccgtttttcagacggcacgctgcaaytgcccaccgcctacctcgtctgcaacttcgccccacccgtcggcggcagggaagcccgcytgagccacgacgaaatcctcatcctcttccacgaaaccggacacgggctgcaccacctgcttacccaagtggacgaactgggcgtatccggcatcaacggcgtakaatgggacgcggtcgaactgcccagccagtttatggaaaatttcgtttgggaatacaatgtcttggcacaamtgtcagcccacgaagaaaccggcgttcccytgccgaaagaactcttsgacaaawtgctcgccgccaaaaacttccaasgcggcatgttcytsgtccggcaawtggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcagctnattacagctacgcgtgggcggaagtattgagcgcggacgcatacgccgcctttgaagaaagcgacgatgtcgccgccacaggcaaacgcttttggcaggaaatcctcgccgtcggggnatcgcgcagcggngcagaatccttcaaagccttccgcggccgcgaaccgagcatagacgcactcttgcgccacagcggtttcgacaacgcggtctga

SEQ ID NO: 484 - protein, 476 aa, Neisseria meningitidis
  misc_feature (149)..(149): Xaa can be any naturally occurring amino acid
  misc_feature (158)..(158): Xaa can be any naturally occurring amino acid
  misc_feature (167)..(167): Xaa can be any naturally occurring amino acid
  misc_feature (190)..(190): Xaa can be any naturally occurring amino acid
  misc_feature (198)..(198): Xaa can be any naturally occurring amino acid
  misc_feature (289)..(289): Xaa can be any naturally occurring amino acid
  misc_feature (313)..(313): Xaa can be any naturally occurring amino acid
  misc_feature (328)..(328): Xaa can be any naturally occurring amino acid
  misc_feature (331)..(331): Xaa can be any naturally occurring amino acid
  misc_feature (339)..(339): Xaa can be any naturally occurring amino acid
  misc_feature (343)..(343): Xaa can be any naturally occurring amino acid
  misc_feature (347)..(347): Xaa can be any naturally occurring amino acid
  misc_feature (406)..(406): Xaa can be any naturally occurring amino acid
  misc_feature (445)..(445): Xaa can be any naturally occurring amino acid
MTDNALLHLGEEPRFDQIKTEDIKPALQTAIAEAREQIAAIKAQTHTGWANTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 485 - DNA, 2037 bp, Neisseria meningitidis
atgactgacaacgcactgctccatttgggcgaagaaccccgttttgatcaaatcaaaaccgaagacatcaaacccgccctgcaaaccgccattgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcaccgacacgcccgaactgcgcgccgcctacaatgaattaatgcccgaaattaccgtcttcttcaccgaaatcggacaagacatcgagctgtacaaccgcttcaaaaccatcaaaaactcccccgagttcgacaccctctcccacgcgcaaaaaaccaaactcaaccacgatctgcgcgatttcgtcctcagcggcgcggaactgccgcccgaacagcaggcagaattggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgctgccgcgcaaagcgaaggcaaaacaggctacaaaatcggtttgcagattccgcactacctcgccgtcatccaatacgccgacaaccgcaaactgcgcgaacaaatctaccgcgcctacgttacccgcgccagcgagctttcagacgacggcaaattcgacaacaccgccaacatcgaccgcacgctcgaaaacgccctgcaaaccgccaaactgctcggcttcaaaaactacgccgaattgtcgctggcaaccaaaatggcggacacccccgaacaagttttaaacttcctgcacgacctcgcccgccgcgccaaaccctacgccgaaaaagacctcgccgaagtcaaagccttcgcccgcgaaagcctcggcctcgccgatttgcaaccgtgggacttgggctacgccggcgaaaaactgcgcgaagccaaatacgcattcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcaccccgcccgtcggcggcaaagaagcccgcttgagccatgacgaaatcctcaccctcttccacgaaaccggacacggcctgcaccacctgcttacccaagtcgacgaactgggcgtatccggcatcaacggcgtagaatgggacgcagtcgaactgcccagtcagtttatggaaaatttcgtttgggaatacaatgtcttggcgcaaatgtccgcccacgaagaaaccggcgttcccctgccgaaagaactcttcgacaaaatgctcgccgccaaaaacttccaacgcggaatgttcctcgtccgccaaatggagttcgccctctttgatatgatgatttacagcgaagacgacgaaggccgtctgaaaaactggcaacaggttttagacagcgtgcgcaaagaagtcgccgtcgtccgaccgcccgaatacaaccgcttcgccaacagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggacgcgaaccgagcatagacgcactcttgcgccacagcggcttcgacaacgcggcttga

SEQ ID NO: 486 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVTDTPELRAAYNELMPEITVFFTEIGQDIELYNRFKTIKNSPEFDTLSHAQKTKLNHDLRDFVLSGAELPPEQQAELAKLQTEGAQLSAKFSQNVLDATDAFGIYFDDAAPLAGIPEDALAMFAAAAQSEGKTGYKIGLQIPHYLAVIQYADNRKLREQIYRAYVTRASELSDDGKFDNTANIDRTLENALQTAKLLGFKNYAELSLATKMADTPEQVLNFLHDLARRAKPYAEKDLAEVKAFARESLGLADLQPWDLGYAGEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFTPPVGGKEARLSHDEILTLFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKEVAVVRPPEYNRFANSFGHIFAGGYSAGYYSYAWAEVLSADAYAAFEESDDVAATGKRFWQEILAVGGSRSAAESFKAFRGREPSIDALLRHSGFDNAA

SEQ ID NO: 487 - DNA, 1473 bp, Neisseria gonorrhoeae
atgattgacaacgcactgctccacttgggcgaagaaccccgttttaatcaaatcaaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtaaaa

SEQ ID NO: 488 - protein, 491 aa, Neisseria gonorrhoeae
MIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVK

SEQ ID NO: 489 - DNA, 2037 bp, Neisseria meningitidis
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctga

SEQ ID NO: 490 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVADTPELRAVYNELMPEITVFFTEIGQDIELYNRFKTIKNSPEFDTLSPAQKTKLNHDLRDFVLSGAELPPEQQAELAKLQTEGAQLSAKFSQNVLDATDAFGIYFDDAAPLAGIPEDALAMFAAAAQSESKTGYKIGLQIPHYLAVIQYADNRELREQIYRAYVTRASELSDDGKFDNTANIDRTLANALQTAKLLGFKNYAELSLATKMADTPEQVLNFLHDLARRAKPYAEKDLAEVKAFARESLNLADLQPWDLGYASEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFAPPVGGREARLSHDEILILFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKKVAVIQPPEYNRFALSFGHIFAGGYSAGYYSYAWAEVLSADAYAAFEESDDVAATGKRFWQEILAVGGSRSAAESFKAFRGREPSIDALLRHSGFDNAV

SEQ ID NO: 491 - DNA, 2037 bp, Neisseria meningitidis; identical to SEQ ID NO: 485

SEQ ID NO: 492 - protein, 678 aa, Neisseria meningitidis; identical to SEQ ID NO: 486

SEQ ID NO: 493 - DNA, 507 bp, Neisseria gonorrhoeae
atgctttcacctcctcggcgtaaaacggcggcacatcaatcaagccgtctttcatttgcgtgcggaaaaaatgcggcgtgttgccgtgatcaaaatcaatatcgtgcagcatccagcccaaatcgcggtttgcctcgctttccgataacgccgacggcggcagcggttcacccttatccgcgctttcgccatttgccctttcaggctgcgggcataggggcggaacaggcggcggtcgaatcctgtttcatccggacaaacgcgttggcagtcggaaaatccggccggccgtgtcaaataatgcgttactttggccgggtcttgtcctttgtaagcggcggtctttttttgcgcgccatccgcatctgtttgggcgcatggcaaacggcggctgccgtacaatcaaaatgtttggcgatttcatgcagacaggcatccggatgccgcccgacatatcgagccggtttttgcctatccgatttggcggcatttaggccggtaacttga

SEQ ID NO: 494 - protein, 168 aa, Neisseria gonorrhoeae
MLSPPRRKTAAHQSSRLSFACGKNAACCRDQNQYRAASSPNRGLPRFPITPTAAAVHPYPRFRHLPFQAAGIGAEQAAVESCFIRTNALAVGKSGRPCQIMRYFGRVLSFVSGGLFLRAIRICLGAWQTAAAVQSKCLAISCRQASGCRPTYRAGFCLSDLAAFRPVT

SEQ ID NO: 495 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccggctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatccgggtgttgcccaacatattgagccggtttttgcctatccgatttgacggcatttagaccggtaacttga

SEQ ID NO: 496 - protein, 110 aa, Neisseria meningitidis
  misc_feature (69)..(69): Xaa can be any naturally occurring amino acid
  misc_feature (86)..(86): Xaa can be any naturally occurring amino acid
  misc_feature (95)..(95): Xaa can be any naturally occurring amino acid
YLRFHYLPFQAAGIGTEQVAVKSCFIQINTLVVGKFGRLCQIMRYFGRVLFFVSGGLFLRVIPICLSAXQMVAAVQSKCLAISCRXASGCCPTYXAGFCLSDLTAFRPVT

SEQ ID NO: 497 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccagctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatcctggtgttgcccaacatattgagccggtttttgcctatccgatttgacggcatttagaccggtaacttga

SEQ ID NO: 498 - protein, 107 aa, Neisseria meningitidis
YLRFHYLPFQAAGIGTEQVAVKSCFIQINTLVVGKFGQLCQIMRYFGRVLFFVSGGLFLRVIPICLSAQMVAAVQSKCLAISCRASWCCPTYAGFCLSDLTAFRPVT

SEQ ID NO: 499 - DNA, 840 bp, Neisseria gonorrhoeae
atgaaacaactccgcgacaacaaagcccaaggctctgcactgtttacccttgtgagcggtatcgttattgttattgcagtcctttatttcctgattaagctggcgggcagtggatcgttcggcgatgtcgatgccactacggaagcggcaacgcagacccgcatccagcctgtcggacaattgacgatgggtgacggcatccccgtcggcgaacgccaaggcgaacagattttcggcaaaatctgtatccaatgccacgcggcggacagcaatgtgccgaacgctccgaaactggaacacaacggcgactgggcgccgcgtatcgcgcaaggcttcgataccttgttccaacacgcgctgaacggctttaacgccatgcctgccaaaggcggtgcggcagacctgaccgatcaggaactcaaacgggcgattacctacatggcgaataaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacatgcccttgaaggctttaacgcgatgccggccaaaggcggcaatgcaggtttgagcgatgacgaagtcaaagcggctgttgactatatggcaaaccaatccggtgcaaaattctaa

SEQ ID NO: 500 - protein, 279 aa, Neisseria gonorrhoeae
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAADLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 501 - DNA, 619 bp, Neisseria meningitidis
ggcgaacagattttcggcaaaatctgtatccaatgccacgcggcggacagcaatgtgccgaacgctccgaaactggaacacaacggcgattrggcaccgcgtatcggcaaggcttcgataccttgttccaacacgcgctgaacggctttaacgccatgcctgcaaaaggcggtgcggcagacctgaccgatcaggaacttaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcacccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaargcggcaatgcaggtttgagcgatgacgaagtcaaagcggctgttgactatatggcaaaccaatccggtgcaaaattctaa

SEQ ID NO: 502 - protein, 204 aa, Neisseria meningitidis
  misc_feature (31)..(31): Xaa can be any naturally occurring amino acid
  misc_feature (179)..(179): Xaa can be any naturally occurring amino acid
GEQIFGKICIQCHAADSNVPNAPKLEHNGDXAPRIQGFDTLFQHALNGFNAMPAKGGAADLTDQELKRAITYMANKSGGSFPNPDEAAPADNAASGTASAPADSAAPAEAKAEDKGAAPAVGVDGKKVFEATCQVCHGGSIPGIPGIGKKDDWAPRIKKGKETLHKHALEGFNAMPAKXGNAGLSDDEVKAAVDYMANQSGAKF

SEQ ID NO: 503 - DNA, 840 bp, Neisseria meningitidis
atgaaacaactccgcgacaacaaagcccaaggctctgcactgtttacccttgtgagcggtatcgttattgttattgcagtcctttatttcctgattaagctggcgggcagcggctcgttcggcgatgtcgatgccactacggaagcagcaacgcagacccgtatccagcctgtcggacaattgacgatgggcgacggcatccccgtcggcgaacgccaaggcgaacagattttcggcaaaatctgtatccaatgccacgcggcggacagcaatgtgccgaacgctccgaaactggaacacaacggcgattgggcgccgcgtatcgcgcaaggcttcgataccttgttccaacacgcgctgaacggctttaacgccatgcctgccaaaggcggtgcggtagacctgaccgatcaggaactcaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaaggcggcaatgcaggtttgagcgatgacgaagtcaaagcggctgttgactatatggcaaaccaatccggtgcaaaattctaa

SEQ ID NO: 504 - protein, 279 aa, Neisseria meningitidis
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAVDLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 505 - DNA, 378 bp, Neisseria gonorrhoeae
atggaagccttcaaaaccctaatttggattattaatattatttccgctttggccgtcatcgtgttagtattgctccaacacggcaaaggcgcggatgccggcgcgaccttcggatcgggaagcggcagcgcgcaaggcgtattcggctctgccggcaacgccaacttcctcagccgctcgaccgccgttgcagcaacatttttctttgcaacctgcatgggctatggtgtatattcacacccacacgacaaaacacggtttggacttcagcaacatacgacagactcagcaagcacccaaacccgtaagcaataccgaaccttctgcccctgttcctcagcagcagaaataacagtttttcaaatgccgacatggtga

SEQ ID NO: 506 - protein, 125 aa, Neisseria gonorrhoeae
MEAFKTLIWIINIISALAVIVLVLLQHGKGADAGATFGSGSGSAQGVFGSAGNANFLSRSTAVAATFFFATCMGYGVYSHPHDKTRFGLQQHTTDSASTQTRKQYRTFCPCSSAAEITVFQMPTW

SEQ ID NO: 507 - DNA, 114 bp, Neisseria meningitidis
atggaacccttcaaaaccttaatttggattgttaatttaatttccgctttggccgtcttcgtgttagtattgctccaacacggcaaaggcgcggatgccggcgcgactttcgga

SEQ ID NO: 508 - protein, 38 aa, Neisseria meningitidis
MEPFKTLIWIVNLISALAVFVLVLLQHGKGADAGATFG

SEQ ID NO: 509 - DNA, 378 bp, Neisseria meningitidis
atggaagccttcaaaaccctaatttggattgttaatataatttccgctttggccgtcatcgtgttagtattgctccaacacggcaaaggcgcggatgccggcgcgactttcggatcgggaagcggcagcgcgcaaggcgtattcggctctgccggcaacgctaacttcctcagccgctcgaccgccgttgcagcaacatttttctttgcaacctgcatgggctatggtgtatattcacacccacacgacaaaacacggtttggacttcagcaacgtacaacaaactcagcaagcacccaaacccgtaagcaataccgaaccttctgcccctgttcctcagcagcagaaataacagtttttcaaatgccgacatggtga

SEQ ID NO: 510 - protein, 125 aa, Neisseria meningitidis
MEAFKTLIWIVNIISALAVIVLVLLQHGKGADAGATFGSGSGSAQGVFGSAGNANFLSRSTAVAATFFFATCMGYGVYSHPHDKTRFGLQQRTTNSASTQTRKQYRTFCPCSSAAEITVFQMPTW

SEQ ID NO: 511 - DNA, 1596 bp, Neisseria gonorrhoeae
atgtcccaagaaatcctcgaccaagtgcgccgccgccgcacgtttgccatcatctcccaccccgatgcgggtaaaaccacgctgaccgaaaaactgctgctgttttcgggcgcgattcaaagcgcaggcacggtgaaaggtaagaaaaccggcaaattcgccacctccgactggatggacatcgagaagcagcgcggcatttccgtggcatcaagcgtgatgcagttcgactacaaagaccacaccgtcaacctcttggacacgccgggacaccaagacttctccgaagacacctaccgcgttttaaccgcagtggacagcgccttgatggtcatcgacgcggcaaaaggcgtggaagcgcaaaccatcaaactcttgaacgtctgccgcctgcgcgatacgccgattgttaccttcatgaacaaatacgaccgcgaagtgcgcgattctttggaactcttggacgaagtggaagacatcctgcaaatccgctgcgcgcccgttacctggccgatcggtatgggcaaaaacttcaagggcgtgtaccacatcctgaacgacgaaatctatctctttgaagcgggcggcgaacgcctgccgcacgagttcgacatcatcaaaggcataaacaatcccgaattggaacaacgctttccgttggaaatccagcagttgcgcgacgaaatcgaattggtgcaggcggcttccaacgaatttaatctcgacgaatttctcgccggcgaactcacgccagtgttcttcggctctgcgattaacaacttcggcattcaggaaatcctcaattcattgattgactgggcacccgcaccgaaaccgcgcgacgcgaccatgcgcatggtcgggccggacgagccgaaattttccggatttatctttaaaatccaagccaatatggacccgaaacaccgcgaccgtatcgccttcttgcgcgtctgctccggtaaattcgagcgcggcatgaagatgaaacacctgcgtatcaaccgcgaaatcgccgcctccagcgtagtaaccttcatgtcgcacgaccgcgaactggcggaagaagcctacgccggcgacatcatcggcatcccgaaccacggcaacatccaaatcggcgacagcttctccgaaggcgaacaactggcgtttaccggcatcccattcttcgcgcccgaactgttccgcagcgtccgcatcaaaaacccgctgaaaatcaaacaactgcaaaaaggtttgcaacaactcggcgaagaaggtgcggttcaagtattcaaaccgatgagcggcgcggatttgattttgggtgcggtcggcgtgttgcagtttgaagtcgtaacctcacgcctcgccaacgaatacggcgtggaagccgtgttcgacagcgcatccatctggtcggcgcgctgggtatcgtgcgacgacaagaaaaaactggcggaatttgaaaaagccaacgcaggcaacctcgccatcgacgcaggcggcaacctcgcctacctcgcccccaaccgcgtgaatttggggttgacgcaagaacgctggccggacatcgtgttccacgaaacgcgcgaacattcggtcaaactctaa

SEQ ID NO: 512 - protein, 531 aa, Neisseria gonorrhoeae
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVEDILQIRCAPVTWPIGMGKNFKGVYHILNDEIYLFEAGGERLPHEFDIIKGINNPELEQRFPLEIQQLRDEIELVQAASNEFNLDEFLAGELTPVFFGSAINNFGIQEILNSLIDWAPAPKPRDATMRMVGPDEPKFSGFIFKIQANMDPKHRDRIAFLRVCSGKFERGMKMKHLRINREIAASSVVTFMSHDRELAEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 513 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcgggcgcgattcagagcgcgggtacggtaaaaggcaagaaaaccggcaaattcgccacttccgactggatggaaatcgagaagcagcgcggcatttccgtggcatcaagtgtgatgcagttcgattacaaagaccacaccgtcaacctcttggacacgccgggacaccaagacttctccgaagacacctaccgcgttttaaccgccgtggacagcgcattaatggtcatcgacgcggcaaaaggcgtggaagcgcaaaccatcaagctcttaaacgtctgccgcctgcgcgatacaccgattgttacgtttatgaacaaatacgaccgcgaagtgcgcgattccctggaacttttggacgaagtggaaaacattttaaaaatccgctgcgcgcccgttacctggccgatcggtatgggcaaaaacttcaagggcgtgtaccacatcctgaacgatgaaatttatctctttgaagctggcggcgaacgcctgccgcacgagttcgacatcatcaaaggcatcgataatcctgaattggaacaacgctttccgttggaaatccagcagttgcgcgacgaaatcgaattggtgcaggcggcttccaacgagtttaatctcgacgaattcctcgccggcgaactcacgcccgtattcttcggctctgcgattaacaacttcggtattcaggaaatcctcaattcattgattgactgggcgcccgcgccgaaaccgcgcgacgcgaccgtacgtatggtcgagccggacgagccgaagttttccggatttatcttcaaaatccaagccaatatggacccgaaacaccgcgaccgtattgccttcttgcgcgtctgctccggcaaattcgagcgcggcatgaagatgaaacacctgcgtatcaaccgcgaaatcgccgcctccagcgtggttaccttcatgtcgcacgaccgcgagctggttgaagaagcctacgccggcgacattatcggcatcccgaaccacggcaacatccaaatcggcgacagcttctccgaaggcgaacaactggcgttcaccggcatcccattcttcgcacccgaactgttccgcagcgtacgcatcaaaaacccgctgaaaatcaaacaactgcaaaaaggcttgcaacagctcggcgaagaaggcgcggtgcaggtgttcaaaccgatgagcggcgcggatttgattttgggcgcggtcggcgtgttgcagtttgaagtcgttacctcgcgcctcgccaacgaatacggcgtagaagccgtgttcgacagcgcatccatctggtcggcgcgctgggtatcgtgcgacgacaagaaaaaactggctgaatttgaaaaagccaacgcgggcaacctcgccatcgacgcaggcggcaacctcgcctacctcgcccccaaccgcgtgaatttgggactcacgcaagaacgttggccggacatcgtgttccacgaaacacgcgaacattcggtcaaactgtaa

SEQ ID NO: 514 - protein, 531 aa, Neisseria meningitidis
MSQEILDQVRRRRTFAIISHPDAGKTTLTEKLLLFSGAIQSAGTVKGKKTGKFATSDWMEIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVENILKIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIDWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 515 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcaggtgcgattcaaagcgcgggtacggtaaaaggcaagaaaaccggcaaattcgccacctccgactggatggacatcgagaagcagcgcggcatttccgtggcatcaagcgtgatgcagttcgactataaagaccacaccgtcaaccttttggacacgccgggacaccaagacttctccgaagacacctaccgcgttttgaccgccgtcgatagtgccttgatggtcatcgacgcggcaaaaggcgtggaagcgcaaaccatcaaactcttgaacgtctgccgcctgcgcaatacgccgattgttacgttcatgaacaaatacgaccgcgaagtgcgcgattccctggaattgctggacgaagtggaaaacatcctgcaaatccgctgcgcgcccgtaacctggccgatcggcatgggcaaaaacttcaaaggcgtgtaccacatcctgaacgacgaaatctatctctttgaagcgggcggcgaacgcttgccgcacgagttcgacatcatcaaaggcatcgataatcccgaattggaacaacgctttccgttagaaatacagcagttgcgcgacgaaatcgaattggtgcaggcggcttccaacgagttcaatctcgacgaattcctcgccggcgaactcacgcccgtattcttcggctctgcgattaacaacttcggtattcaggaaatcctcaattcattgattgaatgggcgcccgcgccgaaaccacgcgatgcgaccgtgcgtatggtcgagccggacgagccgaagttttccggatttatcttcaaaatccaagccaatatggacccgaaacaccgcgaccgtattgccttcttgcgcgtctgctccggcaaattcgagcgcggcatgaaaatgaaacacctgcgtatcaaccgcgaaatcgccgcctccagcgtggtaaccttcatgtcccacgaccgcgagctggttgaagaagcctacgccggcgacattatcggtatcccaaaccacggcaacatccaaatcggcgacagcttctccgaaggcgaacaactgacgtttaccggcatcccattcttcgcgcccgaactgttccgcagcgttcgcatcaaaaacccgctgaaaatcaagcaactgcaaaaaggtttgcaacagcttggcgaagaaggtgcggtgcaggtgttcaaaccaatgagcggcgcggatttgattttgggcgcggtcggcgtgttgcagtttgaagtcgttacctcgcgccttgccaacgaatacggcgtggaagccgtgttcgacaacgcatccatctggtcggcgcgctgggtatcgtgcgacgacaagaaaaaactggcggaatttgaaaaagccaacgcgggcaacctcgccatcgacgcgggcggcaacctcgcctacctcgcccctaaccgcgtgaatctgggactcacgcaagaacgctggccggacatcgtgttccacgaaacgcgcgagcattcggtcaaactttaa

SEQ ID NO: 516 - protein, 531 aa, Neisseria meningitidis
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRNTPIVTFMNKYDREVRDSLELLDEVENILQIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIEWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLTFTGIPFFAPELFRSVRIKNPLKIKQLQKGLQQLGEEGAVQVFKPMSGADLILGAVGVLQFEVVTSRLANEYGVEAVFDNASIWSARWVSCDDKKKLAEFEKANAGNLAIDAGGNLAYLAPNRVNLGLTQERWPDIVFHETREHSVKL

SEQ ID NO: 517 - DNA, 888 bp, Neisseria gonorrhoeae
atgaaatacaaaagaatcgtatttaaagtcggcacatcttcgattacccgttcggacggcagcctctcgcgcggcaaaatccaaaccatcacccgccagcttgccgcattgcatcatgcgggacacgagctggtcttggtgtcttccggcgcggttgctgcagggttcggcgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgtgccgactttgccgacaaacgccgctaccaaaatgccggcggcgcactttccgtgctgctgcaacgccgcgcgattcccatcatcaatgaaaacgacacggtttcggttgaggagttgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcactcaaacccgattcattggccgaagccgccgaacatcaggcggacggctcgtttttcgtcccccgtgccaaaggtttgcggacacagaagcaatggctggcgttctattccgaaagcgggggcagcgtttatgtggacgaaagtgcggaacacgctttgtccgaacaagggaaagcctgctga

SEQ ID NO: 518 - protein, 295 aa, Neisseria gonorrhoeae
MKYKRIVFKVGTSSITRSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAIPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDSLAEAAEHQADGSFFVPRAKGLRTQKQWLAFYSESGGSVYVDESAEHALSEQGKAC

SEQ ID NO: 519 - DNA, 1110 bp, Neisseria meningitidis
atgaaatacaaaagaatcgtatttaaagtcggcacatcttcgattacccattcggacggcagtctctcgcgcggcaaaatccaaaccatcacctgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcgcaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacacgggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcgctcaaacccgatgcacttgccgaagctgccgaacatcaggcggacggctcgtttttcgtcccccgtgccaaaggtttgcggacgcagaagcaatggctggcgttctattccgaaagccggggcagcgtttatgtggacgaaggtgcggaacacgctttgtccgaacaggggaaaagcctgctgatgtcgggcattgccggaatcgaagggcatttttcccgtatggacaccgtaaccgtgtacagcaaggcaaccaaacagcccctgggcaaagggcgcgtcctgttcggctctgccgccgccgaagacctgctcaaatcgcgtaaggcgaaaggcgtgttcatccatcgggacgactggatttccatcacgcccgaaatacgcctgcttctgaccgaattttag

SEQ ID NO: 520 - protein, 369 aa, Neisseria meningitidis
MKYKRIVFKVGTSSITHSDGSLSRGKIQTITCQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDALAEAAEHQADGSFFVPRAKGLRTQKQWLAFYSESRGSVYVDEGAEHALSEQGKSLLMSGIAGIEGHFSRMDTVTVYSKATKQPLGKGRVLFGSAAAEDLLKSRKAKGVFIHRDDWISITPEIRLLLTEF

SEQ ID NO: 521 - DNA, 1110 bp, Neisseria meningitidis
atgaaatacaaaagaatcgtatttaaagtcggcacatcttcgattacccattcggacggcagtctctcgcgcggcaaaatccaaaccatcacccgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacaggcggtatgctgactaaaatcaaagcggcgacgattgcgaccgagtccggcgtaccggtctatatctgttcctcgctcaaacccgatgcacttgccgaagcggcagataatcaggcggacggctcgtttttcgtcccccgtgccaaaggtttgcggacgcagaagcaatggctggcgttctattccgaaagcaggggcggcgtttatgtggacgaaggtgcggaacacgctttgtccgaacagggaaaaagcctgctgatgtcgggcattgccggaatcgaagggcatttttcccgtatggacaccgtaaccgtgtacagcaaggcaaccaaacagcctttgggcaaagggcgagtcctgttcggctctgccgccgccgaagacctgctcaaattgcgtaaggcgaaaggcgtgttcatccatcgggacgactggatttccatcacgcccgaaatacgcctgcttctgaccgaattttag

SEQ ID NO: 522 - protein, 369 aa, Neisseria meningitidis
MKYKRIVFKVGTSSITHSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIATESGVPVYICSSLKPDALAEAADNQADGSFFVPRAKGLRTQKQWLAFYSESRGGVYVDEGAEHALSEQGKSLLMSGIAGIEGHFSRMDTVTVYSKATKQPLGKGRVLFGSAAAEDLLKLRKAKGVFIHRDDWISITPEIRLLLTEF

SEQ ID NO: 523 - DNA, 672 bp, Neisseria gonorrhoeae
atggaaatccggtttcagacagcatttttacgtttggttcagatgaaaacaaacgcttcaattcttaccgcaacacgccttgtatttcctgccgctgccgcacggacagggatcgttcctgccggttttttccccttccctgcggacggtttgcggtttgttgatgaccgcctgccagtagcggtagatgtctgccagcgcgtaaggcagttcggacgcaagttccgccagctcgccttcggtgaattgcaggcggataacgccgttttcctcttcgtcgtaaatgccgcccactgccatcacggggtaaaacagctcttcaaacgcttcatcatcggcggcttcaaaccaatcggtcggcacaatgtccaaaccgtaaagataggcgttgcaccaagtgtaaaaatcgctgccgccctcgccgtcgtcgtagagccacaaatcgggcagctttttatccgacatcgcggcggttgtttccatcgccattgccaaaaccagccgttcgatttcggaacgttcggcggcggtaaattgcgattcgtcgcccaacacttcgggcagccagtcgagcggtgccaatttgtccggcccgctcaacagcgccgtcataaaaccttgaacctcgtcgcaacgcatcgtgttgccttgttcgcttttggcatccaataa

SEQ ID NO: 524 - protein, 223 aa, Neisseria gonorrhoeae
MEIRFQTAFLRLVQMKTNASILTATRLVFPAAAARTGIVPAGFFPFPADGLRFVDDRLPVAVDVCQRVRQFGRKFRQLAFGELQADNAVFLFVVNAAHCHHGVKQLFKRFIIGGFKPIGRHNVQTVKIGVAPSVKIAAALAVVVEPQIGQLFIRHRGGCFHRHCQNQPFDFGTFGGGKLRFVAQHFGQPVERCQFVRPAQQRRHKTLNLVATHRVALFAFGIQ

SEQ ID NO: 525 - DNA, 732 bp, Neisseria meningitidis
atggaaacaaacgcttcaattcttaccgcaacacgccttgtattttctgccgctgccgcacggacagggatcgttcctgcctgttttttcgccttccctgcggacggtttgcggtttgttgatgactgcctgccagtagcggtagatatccgccaatgcataaggcaactcggattccagttccgccagctcgccttctgtgaattgcagacggatagcgccgttttcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttcaaatgggttttgcgccctattatcgccgcaatgccgtctga

SEQ ID NO: 526 - protein, 243 aa, Neisseria meningitidis
METNASILTATRLVFSAAAARTGIVPACFFAFPADGLRFVDDCLPVAVDIRQCIRQLGFQFRQLAFCELQTDSAVFLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFQMGFAPYYRRNAV

SEQ ID NO: 527 - DNA, 837 bp, Neisseria meningitidis
atggaaacaaacgcttcaattcttaccgcaacacgccttgtattttctgccgctgccgcacggacagggatcgttcctgcctgttttttcgccttccctgcggacggtttgcggcttgttgatgaccgcctgccagtagcggtagatatccgccaatgcataaggcaactcggattccagttccgccagctcgccttctgtgaattgcagacggatagtgccgttgtcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttccaatgggttttgcgccctattatagtggattaaatttaaatcaggacaaggcgacgaagccgcagacagtacaaatagtacggcaaggcgaggcaacgccgtactggtttaaatttaatccactatatcgccgcaatgccgtctga

SEQ ID NO: 528 - protein, 278 aa, Neisseria meningitidis
METNASILTATRLVFSAAAARTGIVPACFFAFPADGLRLVDDRLPVAVDIRQCIRQLGFQFRQLAFCELQTDSAVVLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFPMGFAPYYSGLNLNQDKATKPQTVQIVRQGEATPYWFKFNPLYRRNAV

SEQ ID NO: 529 - DNA, 852 bp, Neisseria gonorrhoeae
atgattatccatcaccaattcgatcccgtcctcatcagtatcggcccgcttgccgtccgctggtatgccttaagctacatcctcggatttattctttttacctttctcggcagaaggcgcatcgcgcaaggcttgtccgtttttaccaaagaatcgctcgacgacttcctgacatggggcattttgggcgtgattttgggcggacgcttgggctatgtcctgttttacaaattctccgactacctcgcccatccgcttgatattttcaaggtatgggaaggcggaatgtcgttccacggcggctttttgggtgtagttattgccatatggttgttcagccgcaagcacggcatcggcttcctcaaactgatggacacggtcgcgccgctcgttccgctgggtctcgcttcgggacgtatcggcaactttatcaacggcgaactttggggacgcattaccgacattaacgcattttgggcaatgggcttcccgcaagcgcattacgaagatgccgaagccgccgcgcacaatccgctttgggcagaatggctgcaacaatacggtatgctgccgcgtcatccctcgcagctttatcagtttgcccttgaaggcatctgcctgttcgccgtcgtttggctgttttccaaaaaaccgcgcccgaccgggcagactgccgcgctttttctcggcggctacggcgtgttccgctttattgccgaatttgcgcgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 530 - protein, 283 aa, Neisseria gonorrhoeae
MIIHHQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFSRKHGIGFLKLMDTVAPLVPLGLASGRIGNFINGELWGRITDINAFWAMGFPQAHYEDAEAAAHNPLWAEWLQQYGMLPRHPSQLYQFALEGICLFAVVWLFSKKPRPTGQTAALFLGGYGVFRFIAEFARQPDDYLGLLTLGLSMGQWLSVPMIVLGIVGFVRFGMKKQH

SEQ ID NO: 531 - DNA, 852 bp, Neisseria meningitidis
atgattacccatccccaattcgatcccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatacggttgttcggccgcaaacacggcatcggcttcctcaaactgatggatacggtcgcaccgctcgttccgctgggtctcgcttcgggacgtatcggcaacttcatcaacggcgaactttggggacgcgttaccgacatcaacgcattttgggcaatgggcttcccgcaggcgcgttacgaagatgccgaagccgccgcgcacaatccgctttgggcagaatggctgcaacaatacggtatgctgccgcgtcatccctcgcagctttatcagtttgcacttgaaggcatctgcctgttcaccgtcatttggctgttctctaaaaaacagcggtcgaccggacaagtcgcctcgctcttcctcggcggctacggcatattccgcttcattgccgaattcgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 532 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIRLFGRKHGIGFLKLMDTVAPLVPLGLASGRIGNFINGELWGRVTDINAFWAMGFPQARYEDAEAAAHNPLWAEWLQQYGMLPRHPSQLYQFALEGICLFTVIWLFSKKQRSTGQVASLFLGGYGIFRFIAEFARQPDDYLGLLTLGLSMGQWLSVPMIVLGIVGFVRFGMKKQH

SEQ ID NO: 533 - DNA, 852 bp, Neisseria meningitidis
atgattacccatccccaattcgaccccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatatggttgttcggtcgcaaacacggcatcggcttcctcaaactgatggacacggtcgcaccgctcgttccactgggtctcgcttcgggacgtatcggcaacttcatcaacggcgaactttggggacgcgttaccgacatcaacgcattttgggcaatgggcttcccgcaggcgcgttacgaagacctcgaagccgccgcgcacaatccgctttgggcagaatggctgcaacaatacggtatgctgccgcgtcatccctcgcagctttatcagtttgcacttgaaggcatctgcctgttcgccgtcgtttggctgttctctaaaaaacagcggccgaccggacaagtcgcctcactcttcctcggcggctacggcatattccgcttcattgccgaatttgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 534 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFGRKHGIGFLKLMDTVAPLVPLGLASGRIGNFINGELWGRVTDINAFWAMGFPQARYEDLEAAAHNPLWAEWLQQYGMLPRHPSQLYQFALEGICLFAVVWLFSKKQRPTGQVASLFLGGYGIFRFIAEFARQPDDYLGLLTLGLSMGQWLSVPMIVLGIVGFVRFGMKKQH

SEQ ID NO: 535 - DNA, 897 bp, Neisseria gonorrhoeae
atggagtttgaaaacattatttccgccgccgacaaggcgcgtatccttgccgaagcactgccttacatccgccggttttccggttcggtcgccgtcatcaagtatggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggcgaatttgtccaaggaatgcgcgttaccgacaaagagacgatggatattgtcgaaatggtattgggcgggcacgtcaacaaggaaatcgtgtcgatgattaacacatatggagggcacgcggtcggcgtgagcgggcgcgacgaccatttcattaaggcgaagaaacttttggtcgatacgcccgaacagaatagcgtggacatcggacaggtcggtacggtggaaagcatcgataccggtttggttaaagggctgatagaacgcggctgcattcccgtcgtcgcccccgtcggcgtaggtgaaaaaggcgaagcgttcaacatcaacgccgatttggtggcaggcaaattggcggaagaattgaacgccgaaaaactcttgatgatgacgaatatcgccggtgtgatggacaaaacgggcaatctgctgaccaaactcacgccgaaacggattgatgggctgattgccgacggcacgctgtatggcggtatgctgccgaaaatcgcttctgcggtcgaagccgccgtcaacggtgtgaaagccacgcacatcatcgacggcaggttgcccaacgcgcttttgctggaaatctttaccgatgccggtatcgggtcgatgattttaggcagaggggaagatgcctga

SEQ ID NO: 536 - protein, 298 aa, Neisseria gonorrhoeae
MEFENIISAADKARILAEALPYIRRFSGSVAVIKYGGNAMTEPALKEGFARDVVLLKLVGIHPVIVHGGGPQINAMLEKVGKKGEFVQGMRVTDKETMDIVEMVLGGHVNKEIVSMINTYGGHAVGVSGRDDHFIKAKKLLVDTPEQNSVDIGQVGTVESIDTGLVKGLIERGCIPVVAPVGVGEKGEAFNINADLVAGKLAEELNAEKLLMMTNIAGVMDKTGNLLTKLTPKRIDGLIADGTLYGGMLPKIASAVEAAVNGVKATHIIDGRLPNALLLEIFTDAGIGSMILGRGEDA

SEQ ID NO: 537 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctga

SEQ ID NO: 538 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRLPNALLLEIFTDAGIGSMILGGGEDA

SEQ ID NO: 539 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggcgtgaaagccacgcatatcatcgacggcagggtgcccaacgcgcttttgctggaaatctttaccgatgccggtatcggttcgatgattttgggcggtggggaagatgcctga

SEQ ID NO: 540 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRVPNALLLEIFTDAGIGSMILGGGEDA

SEQ ID NO: 541 - DNA, 537 bp, Neisseria gonorrhoeae
atgcgaaccacctcaaccttccctacaaaaactttcaaaccggctgccatggcgttagctgttgcaacaacactttctgcctgcttaggcggcggcggaggcggcacttctgctcccgactttaatgcaggcggcaccggtatcggcagcaacagcagggcaacgatagcggaatcagcagcagtatcttacgccggtataaaaaacgaaatgtgcaaagacagaagcatgctctgtgccggtcgggatgacgttgcggttacagacagggatgccaaaatcaaagccccccgaatctgcataccggagacttttcaaacccaaatgaccaatattaagaatatgatcaacctcaaacctgcaattgaagcaggctatacaggacgcggggtagaggtaggtatcgtcgatacaggcgaatccgtcggcagcatatcctttcccgaactgtatggcagaaaagaacacggctataacgaaaattacaaaaacaaattacaaaaactatacggcgtatatgcggaaggaagcgcctga

SEQ ID NO: 542 - protein, 178 aa, Neisseria gonorrhoeae
MRTTSTFPTKTFKPAAMALAVATTLSACLGGGGGGTSAPDFNAGGTGIGSNSRATIAESAAVSYAGIKNEMCKDRSMLCAGRDDVAVTDRDAKIKAPRICIPETFQTQMTNIKNMINLKPAIEAGYTGRGVEVGIVDTGESVGSISFPELYGRKEHGYNENYKNKLQKLYGVYAEGSA

SEQ ID NO: 543 - DNA, 528 bp, Neisseria meningitidis
atgcgaacgaccccaaccttccctacaaaaactttcaaaccgactgccatggcgttagctgttgcaacaacactttctgcctgcttaggcggcggcggaggcggcacttctgcgcccgacttcaatgcaggcggtaccggtatcggcagcaacagcagagcaacaacagcgaaatcagcagcagtatcttacgccggtatcaagaacgaaatgtgcaaagacagaagcatgctctgtgccggtcgggatgacgttgcggttacagacagggatgccaaaatcaatgcccccccccgaatctgcataccggagactttccaaacccaaatgacgcattacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacgaaaaactatacggcgtatatgcggaaggaagcgcctga

SEQ ID NO: 544 - protein, 175 aa, Neisseria meningitidis
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPRICIPETFQTQMTHYKNLINLKPAIEAGYTGRGVEVGIVDTGESVGSISFPELYGRKEHGYNENYEKLYGVYAEGSA

SEQ ID NO: 545 - DNA, 526 bp, Neisseria meningitidis
atgcgaacgaccccaaccttccctacaaaaactttcaaaccggctgccatggcgttagctgttgcaacaacactttctgcctgcttaggcggcggcggaggcggcacttctgcgcccgacttcaatgcaggcggcaccggtatcggcagcaacagcagggcaacaacagcgaaatcagcagcaatatcttacgccggtatcaagaacgaaatgtgcaaagacagaagcatgctctgtgccggtcgggatgacgttgcggttacagacagggatgccaaaatcaatgcccccccccgaatctgcataccggagactttacaaacccaaatgacgcatacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacaaaaactatacggcgtatatgcggaaggaagcgcctga

SEQ ID NO: 546 - protein, 175 aa, Neisseria meningitidis
  misc_feature (113)..(113): Xaa can be any naturally occurring amino acid
  misc_feature (164)..(164): Xaa can be any naturally occurring amino acid
MRTTPTFPTKTFKPAAMALAVATTLSACLGGGGGGTSAPDFNAGGTGIGSNSRATTAKSAAISYAGIKNEMCKDRSMLCAGRDDVAVTDRDAKINAPPRICIPETLQTQMTHXKNLINLKPAIEAGYTGRGVEVGIVDTGESVGSISFPELYGRKEHGYNENYXKLYGVYAEGSA

SEQ ID NO: 547 - DNA, 1365 bp, Neisseria gonorrhoeae
atgtcggcacgcggcaagggggcaggctatctcaacagtaccggacgacatgttcccttcctgagtgccgccaaaatcgggcaggattattctttcttcaaaaatatcaaaaccgacggcggtctgctggcttccctcgacagcgtcgaaaaaacagcgggcagtgaaggcgacacgccgtcctattatgtccgtcgcggcaatgcggcacggactgcttcggcagcggcacattccgcgcccgccggtctgaaacacgccgtagaacagggcggcagcaatctggaaaacctgatggtcgagctggatgcctccgaatcatccgcaacacccgagacggttgaaactgcggtcgccgaccgcacagatatgccgggcatccgcctacggcgcacaactttccgcacagcggcagccgtacagcatgcgaataccgccgacggcgtacgcatcttcaacagtctcgccgctaccgtctatgccgacagtgccgccgcccatgccgatatgcagggacgccgcctgaaagccgtatcggacgggttggaccacaacggtacgggtctgcgcgtcatcgcgcaaacccaacaggacggtggaacgtgggaacagggcggtgtcgaaggcaaaatgcgcggcagtacccaaactatcggcattgccgcgaaaaccggcgaaaatacgacagcagccgccacactgggcataggacgcagcacatggagcgaaaacagtgcaaatgcaaaaaccgacagcattagtctgtttgcaggcatacggcacgatgtgggcgatatcggctatctcaaaggcctgttctcctacggacgctacaaaaacagcatcagccgcagcaccggtgcggatgaatatgcggaaggcagcgtcaacggcacgctgatgcagctgggcgcactgggtggtgtcaacgttccgtttgccgcaacgggagatttgacggttgaaggcggtctgcgccacgacctgctcaaacaggatgcattcgccgaaaaaggcagtgctttgggctggagcggcaacagcctcactgaaggcacactggtcggactcgcgggtctgaaactgtcgcaacccttgagcgataaagccgtcctgtctgcgacggcgggcgtggaacgcgacctgaacggacgcgactacgcggtaacgggcggctttaccggcgcggctgcagcaaccggcaagacgggtgcacgcaatatgccgcacacccgccgggttgccggtctgggggtggatgtcgaattcggcaacggctggaacggcttggcacgttacagctacaccggttccaaacagtacggcaaccacagcggacaaatcggcgtaggctaccggttctga

SEQ ID NO: 548 - protein, 454 aa, Neisseria gonorrhoeae
MSARGKGAGYLNSTGRHVPFLSAAKIGQDYSFFKNIKTDGGLLASLDSVEKTAGSEGDTPSYYVRRGNAARTASAAAHSAPAGLKHAVEQGGSNLENLMVELDASESSATPETVETAVADRTDMPGIRLRRTTFRTAAAVQHANTADGVRIFNSLAATVYADSAAAHADMQGRRLKAVSDGLDHNGTGLRVIAQTQQDGGTWEQGGVEGKMRGSTQTIGIAAKTGENTTAAATLGIGRSTWSENSANAKTDSISLFAGIRHDVGDIGYLKGLFSYGRYKNSISRSTGADEYAEGSVNGTLMQLGALGGVNVPFAATGDLTVEGGLRHDLLKQDAFAEKGSALGWSGNSLTEGTLVGLAGLKLSQPLSDKAVLSATAGVERDLNGRDYAVTGGFTGAAAATGKTGARNMPHTRRVAGLGVDVEFGNGWNGLARYSYTGSKQYGNHSGQIGVGYRF

SEQ ID NO: 549 - DNA, 1365 bp, Neisseria meningitidis
atgtcggcacgcggcaagggggcaggctatctcaacagtaccggacgacgtgttcccttcctgagtgccgccaaaatcgggcaggattattctttcttcacaaacatcgaaaccgacggcggcctgctggcttccctcgacagcgtcgaaaaaacagcgggcagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggcagccgaccgcacagatatgccgggcatccgcccctacggcgcaactttccgcgcagcggcagccgtacagcatgcgaatgccgccgacggtgtacgcatcttcaacagtctcgccgctaccgtctatgccgacagtaccgccgcccatgccgatatgcagggacgccgcctgaaagccgtatcggacgggttggaccacaacggcacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacgcagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcctcactgaaggcacgctggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgtctggttgccggcctgggcgcggatgtcgaattcggcaacggctggaacggcttggcacgttacagctacgccggttccaaacagtacggcaaccacagcggacgagtcggcgtaggctaccggttctga

SEQ ID NO: 550 - protein, 454 aa, Neisseria meningitidis
MSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 551 - DNA, 1365 bp, Neisseria meningitidis
atgtcggcaggcggtaagggggcaggctatctcaaccgtaccggacaacgtgttcccttcctgagtgccgccaaaatcgggcgggattattctttcttcacaaacatcgaaaccgacggcggtctgctggcttccctcgacagcgtcgaaaaaacagcgggtagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggccgccgaccgcacagatatgccgggcatccgcccctacggcgcaactttccgcgcagcggcagccgtacagcatgcgaatgccgccgacggtgtacgcatcttcaacaatctcgccgctaccgtctatgccgacagtaccgccgcccatgccgatatgcagggacgccgcctgaaagccgtatcggacgggttggaccacaacgctacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacacagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcatcactgaaggcacactggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgcctggttgccggtctgggcgcggatgtcgaattcggcaacggctggaacggcttggcacgttacagctacgccggttccaaacagtacggcaaccacagcggacgagtcggcgtaggctaccggttctga

SEQ ID NO: 552 - protein, 454 aa, Neisseria meningitidis
MSAGGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNNLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSITEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 553 - DNA, 1677 bp, Neisseria gonorrhoeae
atgagcttcaaaaccgatgccgaaaccgcccaatcctccaccatgcgcccgattggcgaaattgccgccaagctgggtttgaacgttgacaacattgagccttacggtcattacaaagccaaaatcaatcctgccgaagcgttcaagctgccgcaaaaacaaggcaggctgattttggttaccgccatcaacccgactccggcgggcgaaggcaaaaccaccgtaaccatcggtttggcggacgcattgcgccatatcggcaaagactctgtgattgctttgcgcgagccttctttgggtccggtgttcggcgtgaaaggcggcgcggcaggcggcggctacgcgcaagttttgccgatggaagacatcaacctgcacttcaccggcgacttccacgccatcggtgcggcgaataacctcctcgccgccatgctcgacaaccatatctaccaaggtaacgagttgaacatcgaccccaaacgcgtgctgtggcggcgcgtggtcgatatgaacgaccgccagttgcgcaacatcatcgacggtatgggcaagcctgttgacggcgtgatgcgtcccgacggcttcgacatcaccgtcgcctccgaagtgatggcggtattctgccttgccaaagacatcagcgatttgaaagagcgttttggcaatattctcgtcgcctacgccaaagacggcagccccgtttacgccaaagatttgaaggcacacggcgcgatggcggcattgctaaaagatgcgattaagcccaatttggtgcaaaccatcgaaggcactccggcctttgtacacggcggcccgttcgccaacatcgcccacggctgcaactccgttaccgcaacccgtctggcgaaacaccttgccgattacgccgtaaccgaagcaggcttcggcgcggacttgggtgcggaaaaattctgcgacatcaaatgccgccttgccggtttgaaacctgatgcggcagtcgtcgtggcgactgtccgcgccctgaaatacaacggcggcgtggaacgcgccaaccttggtgaagaaaacctcgaagccttggcaaaaggtttgcccaacctgttgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggcggcgcgggcggcgcggatttggcgcgcaaagtcgtcaatgccatcgacaaccaacctaataacttcggtttcgcctacgatgtcgagttgggcatcaaagacaaaatccgtgcgattgcccaaaaagtgtacggcgcggaagatgtcgatttcagcgcggaagcgtctgccgaaatcgcctcgctggaaaaactgggcttggacaaaatgccgatctgcatggcgaaaacccaatattcattgagcgacaacgccaaactcttgggctgccccgaaggcttccgcatcgccgtacgcggtatcactgtttccgccggcgcgggcttcatcgttgcgttgtgcggcaatatgatgaaaatgccgggcctgccgaaagttccggctgccgagaaaatcgatgtggacgaacacggcgtgattcacggcttgttctga

SEQ ID NO: 554 - protein, 558 aa, Neisseria gonorrhoeae
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 555 - DNA, 1677 bp, Neisseria meningitidis
atgagcttcaaaaccgatgccgaaatcgcccaatcctccaccatgcgcccgattggcgaaattgccgccaagcttggtctgaatgccgacaacattgagccttacggtcattacaaggcgaaaatcaatcctgccgaagcgttcaaactgccgcaaaaacagggcaggctgattttggttaccgccatcaacccgactccggcgggcgaaggcaaaaccaccgtaaccatcggtttggcggacgcgttgcgccacatcggcaaagatgccgtgattgccctgcgcgaaccttctctggggccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggtaaacccgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgacgccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 556 - protein, 558 aa, Neisseria meningitidis
MSFKTDAEIAQSSTMRPIGEIAAKLGLNADNIEPYGHYKAKINPAEAFKLPQKQGRLILVTAINPTPAGEGKTTVTIGLADALRHIGKDAVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDADAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 557 - DNA, 1677 bp, Neisseria meningitidis
atgagtttcaaaaccgatgccgaaatcgcccaatcctccaccatgcgcccgattggcgaaattgccgccaagctgggtttgaacgttgacaacattgagccttacggtcattacaaagccaaaatcaatcctgccgaagcgttcaaactgccgcaaaaacagggcaggctgattttggttaccgccatcaacccgactccggcgggcgaaggtaaaaccaccgtaaccatcggtttggcggacgcattgcgccatatcggcaaagactctgtgattgctttgcgcgagccttctttgggtccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggcaagcctgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 558 - protein, 558 aa, Neisseria meningitidis
MSFKTDAEIAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDSDAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 559 - DNA, 477 bp, Neisseria gonorrhoeae
atgcgtgccgatttcatgtttgccgacaatatgcccgtgcaggtgcgccaacgcgccttctatttcaagttgtcccgttttgccgcgatgccaaatatggtaggcaaaccgctcttcgggcgacaggccggtcagcccggcaaaatgttcggcaacatcctgatgttcgtccgccagcatattgatgcagaggctgccgttttccgacaggatcggaatgattcgcgcactccggtttatgcacagcatcacggtcggcggctcgtcggtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaaccgtcccctatataagaatgctgcacacaaggcatccccccatgtgcagcagttctga

SEQ ID NO: 560 - protein, 158 aa, Neisseria gonorrhoeae
MRADFMFADNMPVQVRQRAFYFKLSRFAAMPNMVGKPLFGRQAGQPGKMFGNILMFVRQHIDAEAAVFRQDRNDSRTPVYAQHHGRRLVGNRRNRRHCNAVTPCRTVCRDDMNACRTGCHRITERSLKSFLQIRHFSPLNRPLYKNAAHKASPHVQQF

SEQ ID NO: 561 - DNA, 477 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtcggtaaccggcgcgaccgccgtcattgtaatgccgtaacgccctgccgcaccgtctgtcgtgatgacatgaacgcctgccgcgcaagatgccatcgcatcacggaacgaagtttgaaaatttttctgcaaatccgccatttttcccctttaaactgtcccctatataagaatgctgcacacaaggcatccccccatgtgcagcagttttga

SEQ ID NO: 562 - protein, 158 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVGNRRDRRHCNAVTPCRTVCRDDMNACRARCHRITERSLKIFLQIRHFSPLNCPLYKNAAHKASPHVQQF

SEQ ID NO: 563 - DNA, 948 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtccgtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaactgtcccctatataagaatgctgcacacaaggcaccccccatgtgcagcagttctgattcaaaaagccgtcggtcggacatttccgcgcgttacggcgtattacgagttcaacgcatcctcgattttggcaagttctgccaacaggtctttaagcagcagcattttctcgcggcccagcacttcctcgatagcgtcgtaacgctcgtccacttcttcgccgatttcctcatacagcttctcgccctcggcagtcagcttcagaaaaacacgtcgttggtcgttggaaggtttcaggcggacaaccaaacccgctttttcaaggcgggtcaggataccggtcaggctggggcgcaaaatgcacgcctgattcgccaaatcttgaaagtccagcgtgccgttttccgccaaaagacggataatccgccattgctgatcggtaatattcgcctgattcagaataggcctgaattgggtcatcagggcttcccttgcctgtatcagaccgatattgatagacgcatgttttga

SEQ ID NO: 564 - protein, 315 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVRNRRNRRHCNAVTPCRTVCRDDMNACRTGCHRITERSLKSFLQIRHFSPLNCPLYKNAAHKAPPMCSSSDSKSRRSDISARYGVLRVQRILDFGKFCQQVFKQQHFLAAQHFLDSVVTLVHFFADFLIQLLALGSQLQKNTSLVVGRFQADNQTRFFKAGQDTGQAGAQNARLIRQILKVQRAVFRQKTDNPPLLIGNIRLIQNRPELGHQGFPCLYQTDIDRRMF

SEQ ID NO: 565 - DNA, 1290 bp, Neisseria gonorrhoeae
atgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtgggctactactcagaccgcacttggaagccgcgcttgggcggccgccgcctgccgtatctgctttacggcacgctgattgcggtcatcgtgatgattttgatgccgaactcgggcagcttcggtttcggctatgcgtcgctggcggccttgtcgttcggcgcgctgatgattgcgctgttggacgtgtcgtcgaatatggcgatgcagccgtttaagatgatggtcggcgatatggtcaacgaggagcagaaaagctacgcctacgggattcaaagtttcttagcgaatacggacgcggttgtggcagcgattctgccgtttgtgttcgcgtatatcggtttggcgaacactgccgagaaaggcgttgtgccacaaaccgtggtcgtagcattctatgtgggtgcggcgttactgattattaccagtgcgttcacaatctccaaagtcaaagaatacgacccggaaacctacgcccgttaccacggcatcgatgtcgccgcgaatcaggaaaaagccaactggttcgaactcttaaaaaccgcgcctaaagtgttttggacggttactccggtacagtttttctgctggttcgccttccggtatatgtggacttactcggcaggcgcgattgcagaaaacgtctggcacactaccgatgcgtcttccgtaggccatcaggaggcgggcaaccggtacggcgttttggcggcggtgtagtcggttgcggcggtgatttgttcgtttattctggcaaaagtaccgaataaataccataaggcgggttatttcggctgtttggctttgggcgcgctcggtttcttctctatcttcttcatctacaatcaatacgcactcatcctgtcttatatcttaatcggcatcgcttgggcgggcattatcacttatccgctgacgattgtggccaacgctttgtcgggcaaacacatggatacttatttgggcctgtttaacggctctgtctgtatgccgcaaatcgtcgcttcgctgttgagtttcgtgcttttcccgatgctgggcggccatcaggcaaccatgttcttggttgcaggcgcagtcttgctgctgggagccttctcagtctgtctgattaaagagatccacggcggggtttga

SEQ ID NO: 566 - protein, 428 aa, Neisseria gonorrhoeae
MLSFGYLGVQTAFTLQSSQMSRIFQTLGADPHNLGWFFILPPLAGMLVQPIVGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAVSVAAVICSFILAKVPNKYHKAGYFGCLALGALGFFSIFFIYNQYALILSYILIGIAWAGIITYPLTIVANALSGKHMDTYLGLFNGSVCMPQIVASLLSFVLFPMLGGHQATMFLVAGAVLLLGAFSVCLIKEIHGGV

SEQ ID NO: 567 - DNA, 1290 bp, Neisseria meningitidis
atgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 568 - protein, 429 aa, Neisseria meningitidis
MLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 569 - DNA, 1290 bp, Neisseria meningitidis
atgctcagtttcggctttctcggcgttcagacggcctttaccctgcaaagctcgcagatgagccgcatcttccagacgctcggtgccgatccgcacagcctcggctggttctttatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcgaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacaatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcctgtttaacggctctatctgtatgccgcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 570 - protein, 429 aa, Neisseria meningitidis
MLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 571 - DNA, 612 bp, Neisseria gonorrhoeae
atgagcgatacccccgctacccgcgatttcggcctgatcgacgggcgggccgtaaccggctatgtgctgtccaaccggcgtggtacgtgcgtcttcgtgctggacttgggcgggattgtgcaggaattttccgttttggcagacggcgtgcgcgaaaaccccgtggtgtcgttcgacgatgcggcttcctatgcggacaatccgtttcagattaacaagcagatagggcgcgtggccggacgcatccgcggtgcggcgttcgacatcaacggtaggacttaccgcgtggaggccaacgaaggcaggaacgcgctgcacggcggttcgcacgggctggccgttacccgtttcaacgcggtggcggcagacggccgacggttatcccaacgatttggatatttcctaccgcttggacgaggacggccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtcttaacggtttcagacggcctcgaagtatttga

SEQ ID NO: 572 - protein, 203 aa, Neisseria gonorrhoeae
MSDTPATRDFGLIDGRAVTGYVLSNRRGTCVFVLDLGGIVQEFSVLADGVRENPVVSFDDAASYADNPFQINKQIGRVAGRIRGAAFDINGRTYRVEANEGRNALHGGSHGLAVTRFNAVAADGRRLSQRFGYFLPLGRGRPAYRYLSRHRARRHGVRPDAAHLLAAGRGPARCGSAYSAGRTYSGRCRKTARLNGFRRPRSI

SEQ ID NO: 573 - DNA, 657 bp, Neisseria meningitidis
atgagcgatacccccgctacccgcgatttcggtctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgatgatgcggcttcctatgcggacaatccgtttcagattaacaaacagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctggcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatatgccggccgatgccgaaaaactgcccgtctcaacggtttcagacgacctcgaagtatttga

SEQ ID NO: 574 - protein, 218 aa, Neisseria meningitidis
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLATVGRRLSQRFGFGYFLPLGRGRPAYRYLSRHRARRHGVRPDAAHLLAAGRGPARCGSAYSAGRTYAGRCRKTARLNGFRRPRSI

SEQ ID NO: 575 - DNA, 656 bp, Neisseria meningitidis
atgagcgatacccccgctacccgcgatttcggcctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgacgatgcggcttcctatgcggacaatccgtttcagattaacaagcagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctgcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtctcaacggtttcagacgacctcgaagtatttga

SEQ ID NO: 576 - protein, 218 aa, Neisseria meningitidis
  misc_feature (134)..(134): Xaa can be any naturally occurring amino acid
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLXTVGRRLSQRFGFGYFLPLGRGRPAYRYLSRHRARRHGVRPDAAHLLAAGRGPARCGSAYSAGRTYSGRCRKTARLNGFRRPRSI

SEQ ID NO: 577 - DNA, 639 bp, Neisseria gonorrhoeae
atgaagcaaatccccctccgccttctccaggtcgtcattgaccacgacaaagtcgaacaatacggactgttcgatttcatgccttgccttcgacagcctcctttggataacttcccgactgtccgtcccgcgccctttgaggcgcgcggcaagcacgtcgaaagaaggcggcaggataaagataccgacagcttccggcagcgcgttgcgaacctgcgccgcgccctgaacgtcgatttccaaaatcacgtcatagcctgccgccgccaacgcattcacgccctccgtgcttgtgccgtaatagttgccgaatacgtctgcgtattccaaaaaagcctcctgcgcgataagcgattcaaactcttctttggaaacaaagtgataatgtacgccgtttgcttcgccttcacgcggcgggcgcgtcgtatgcgacacggaaacgcgcaaaccgttatggtttgccaacagccgcgacaccagcgtggttttgcccgtgccggaagcggccgaaatgataaagatgttgccttttcgataagcggacatattttttacctgtatattttccaaccgattgtatcacaacggacaccctatttcatatttgccgatgcccatattttgccgctattgttttga

SEQ ID NO: 578 - protein, 212 aa, Neisseria gonorrhoeae
MKQIPLRLLQVVIDHDKVEQYGLFDFMPCLRQPPLDNFPTVRPAPFEARGKHVERRRQDKDTDSFRQRVANLRRALNVDFQNHVIACRRQRIHALRACAVIVAEYVCVFQKSLLRDKRFKLFFGNKVIMYAVCFAFTRRARRMRHGNAQTVMVCQQPRHQRGFARAGSGRNDKDVAFSISGHIFYLYIFQPIVSQRTPYFIFADAHILPLLF

SEQ ID NO: 579 - DNA, 639 bp, Neisseria meningitidis
atggcgcaaatcctcctccgctcgcgccaagtcgtcattgaccacgacaaagtcaaacaatacggactgctcgatttcatgccttgccttcgacagcctcctttggataacttcccgactgtccgtcccgcgtccgttgaggcgcgcggcaagtacgtcgaaagaaggcggcaggataaagatgccgacggcttcgggcagcgcgtcgcgaacctgcgccgcgccctgaacgtcgatttccaaaatcacgtcatagcctgccgccgccaacgcattcacaccctccgcgcctgtgccgtaatagttgccaaatacgtcggcgtattccaaaaaagcttcctgcgcgataagcgactcaaactcttctttggaaacaaagtgataatgtacgccgtttgcttcgccttcacgcggcgggcgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaatggacacccagtttcctatttgccgatgcccatattttgccgctattgttttga

SEQ ID NO: 580 - protein, 212 aa, Neisseria meningitidis
MAQILLRSRQVVIDHDKVKQYGLLDFMPCLRQPPLDNFPTVRPASVEARGKYVERRRQDKDADGFGQRVANLRRALNVDFQNHVIACRRQRIHTLRACAVIVAKYVGVFQKSFLRDKRLKLFFGNKVIMYAVCFAFTRRARRVRHGNAQTVMVCQQPRHQRGFARAGSGRNDKDVAFSISGHIFYLYIFQPIVSQWTPSFLFADAHILPLLF

SEQ ID NO: 581 - DNA, 639 bp, Neisseria meningitidis
atggcgcaaatcctcctccgcccgcgccaagtcatcattgaccacgacaaaatcgaacaatacggactgttcgatttcatgccttgccttcgacagcctcctttggataacttcccgactgtccgtcccgcgtccgttgagacgcgcagcaagcacatcgaaagacggcggcaggataaagatgccgacggcttcgggcagcgcatctcgaacctgagccgcgccctgaacgtcgatttccaaaatcacgtcataacctgccgccgccaacgcattcacaccctccgcgcttgtgccgtaatagttgccgaacacgtccgcgtattccaaaaaagcctcctgcgcgataagcgactcaaactcttctttggaaacaaagtgataatgtacgccgtttgcttcgccttcacgcggcggacgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaacggacacccggtttcctatttgccgatgcccatattttgccgctattgttttga

SEQ ID NO: 582 - protein, 212 aa, Neisseria meningitidis
MAQILLRPRQVIIDHDKIEQYGLFDFMPCLRQPPLDNFPTVRPASVETRSKHIERRRQDKDADGFGQRISNLSRALNVDFQNHVITCRRQRIHTLRACAVIVAEHVRVFQKSLLRDKRLKLFFGNKVIMYAVCFAFTRRTRRVRHGNAQTVMVCQQPRHQRGFARAGSGRNDKDVAFSISGHIFYLYIFQPIVSQRTPGFLFADAHILPLLF

SEQ ID NO: 583 - DNA, 522 bp, Neisseria gonorrhoeae
atgcgacgagaagccaaaatggcacaaatcacactcaaacccattgttttatcaattcttttaatcaacacacccctcctcgcccaagcgcatgaaactgagcaatcggtgggcttggaaacggtcagcgtcgtcggcaaaagccgtccgcgcgcgacttcggggctgctgcacacttcgaccgcctccgacaaaatcatctccggcgatactttgcgccaaaaagccgtcaacttgggcgacgctttggacggcgtaccgggcatccacgcttcgcaatacggcggcggcgcatccgctcccgttattcgcggtcaaacgggcagacggattaaagtattgaaccatcacggcgaaacgggcgatatggcggacttttctcccgatcacgccattatggtagataccgccttgtcgcaacaggttgaaatcctgcgcgggccggttacgctcttgtacagctcgggcaatgtggccggggctggtcaatgttgccgatggaaaaatcccccaaaaaatgcc

SEQ ID NO: 584 - protein, 174 aa, Neisseria gonorrhoeae
MRREAKMAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGAGQCCRWKNPPKNA

SEQ ID NO: 585 - DNA, 2205 bp, Neisseria meningitidis
ccgcataaaactgagcaatcggtggatttggaaacggtcagcgtcgtcggcaaaagccgtccgcgcgccacgtcggggctgttgcacacttcgaccgcctccgacaaaatcatctccggcgataccttgcgccaaaaagccgtcaacttgggcgacgctttagacggcgtaccgggcatccacgcttcgcaatacggcggcggcgcgtctgctcccgtcattcgcggtcaaacaggcaggcggattaaagtgttgaaccatcacggcgaaacaggcgatatggcggatttttcgcccgatcacgccattatggtagataccgccttgtcgcaacaggtcgaaatcctgcgcgggccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggttttatcggcgtagcgtacagcgaccgtcgcgaccaatatggtctgcctgcccacagccacgaatacgatgattgccacgccgacatcatctggcaaaagagcttgattaacaaacgctatttacagctttatccgcacctgttgaccgaagaagacatcgattacgacaatccgggcttgagctgcggcttccacgacgacgataatgcacacgcacacacccacagcggcagaccgtggatagacctgcgcaacaaacgctacgaactccgtgccgaatggaagcaaccgttccccggttttgaagccctgcgcgtacacctgaaccgcaacgactaccgccacgacgaaaaagcaggcgatgcagtcgaaaacttttttaacaaccaaacgcaaaacgcccgcatcgagttgcgccaccaacccataggtcgtctgaaaggcagctggggcgtgcaatatttacaacaaaaatccagtgctttatctgccatatccgaagcggttaaacaaccgatgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgagttttaa

SEQ ID NO: 586 - protein, 735 aa, Neisseria meningitidis
PHKTEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 587 - DNA, 2295 bp, Neisseria meningitidis
atgcgacgagaagccaaaatggcacaaactacactcaaacccattgttttatcaattcttttaatcaacacacccctcctctcccaagcgcatggaactgagcaatcagtgggcttggaaacggtcagcgtcgtcggcaaaagccgtccgcgcgccacttcggggctgctgcacacttctaccgcctccgacaaaatcatcagcggcgacaccttgcgacaaaaagccgtcaacttgggtgatgctttagacggcgtaccgggcattcatgcctcgcaatacggcggcggcgcatccgctcccgttattcgcggtcaaacaggcagacggattaaagtgttgaaccatcacggcgaaacgggcgacatggcggacttctctccagaccatgcaatcatggtggacagcgccttgtcgcaacaggtcgaaatcctgcgcggtccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggctttatcggcgcagcatacagcgaccgtcgcgaccaatatggtctgcctgcccacagccacgaatacgatgattgccacgccgacatcatctggcaaaagagtttgattaacaaacgctatttgcagctttatccgcacctgttgaccgaagaagacatcgattacgacaatccgggcttgagctgcggctttcacgacgacgatgatgcacacgcccatgcccacaacggcaaaccttggatagacctgcgcaacaaacgctacgaactccgcgccgaatggaagcaaccgttccccggttttgaagccctgcgcgtacacctgaaccgcaacgactaccgccacgacgaaaaagcaggcgatgcagtagaaaacttttttaacaaccaaacgcaaaacgcccgtatcgagttgcgccaccaacccataggccgtctgaaaggcagctggggcgtgcaatatttgggacaaaaatccagtgctttatctgccacatccgaagcggtcaaacaaccgatgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 588 - protein, 764 aa, Neisseria meningitidis
MRREAKMAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 589 - DNA, 600 bp, Neisseria gonorrhoeae
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtcctgcaaagtgcggaatacttccgccttttggtcgatttgctggtttaccgctatatggatcagaaaatcgacatcgttgccggcttggacgcgcgcggcttcattatcggcgcggcactcgcctaccagctcaacgtcggcttcgtccccatccgcaaaaaaggcaagctgccttttgaaaccgtatcgcaaagctacgcgctcgaatacggggaagctgcggtggaaatccacaccgatgccgtcaaacccggttcgcgcgtcctgctggtcgatgatttggttgccacgggcggcacaatgcttgccgggctggaactgatccgcaaactcggcggggaaattgtcgaagccgccgccattttggaatttaccgaccttcaaggcggcaagaatatccgcgcaagtggcgcgcccttatttaccctgcttcaaaacgaaggctgcatgaaaggctga

SEQ ID NO: 590 - protein, 199 aa, Neisseria gonorrhoeae
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 591 - DNA, 600 bp, Neisseria meningitidis
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 592 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 593 - DNA, 600 bp, Neisseria meningitidis
atggcgttaaaaacatcaaacttggaacacgcaatgctggttcatcccgaagctatgagtgtcggtgcgcttgccgacaaaatccgcaaaatcgaaaactggccgcaaaaaggcatcttattccacgacatcacgcccgtcctgcaaagcgcggaatacttccgacttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttggttgccacgggcggcacgatgcttgccggactggagctgatccgcaaactcggcggggaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 594 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 595 - DNA, 1020 bp, Neisseria gonorrhoeae
atgttgattgacaacaatgtccgccattacagctttttcggtgtagaacaggcaaattgggacaacttcacgcttgaaggcggcgtacgcgtggaaaaacaaaaagcctccatccggtacgacaaagcattgattgatcgagaaaactactacaaccagcccctgcccgacctcggcgcgcaccgccaaaccgcccgctcgttcgcactttcgggcaactggtatttcacgccacaccacaaactcagcctgaccgcctcccatcaggaacgcctgccgtcaacgcaagaactgtacgcacacggcaagcacgtcgccaccaacacctttgaagtcggcaacaaacacctcaacaaagagcgttccaacaatatcgaactcgcgctgggctacaaaggcgaccgctggcaatacaatctggcagcctaccgcaaccgattcggcaactacatttacgcccaaaccttaaacgacggacgcggccccaaatccatcgaagacgacagcgaaatgaagctcgtgcgctacaaccaatccggtgccgacttctacggcgcggaaggcgaaatctacttcaaaccgacaccgcgctaccgcatcggtgtttccggcgactatgtacgaggccgtctgaaaaacctgccgtccctacccggcagggaagatccctacggcaaacgtcccttcatcgcacaagccgaccaaaacgccccccgcattccggctgcgcgcctcggcttccacctgaaaacctcgctaaccgaccgtatcgatgccaatttggactactaccgcgtgttcgcccaaaacaaactcgcccgctacgaaacgcgtacgcccggacaccatatgctcaacctcggtgcaaactaccgccgcaatacgcgctatggcgagtggaattggtacgtcaaagccgacaacctgctcaaccaatccgtttacgcccacagcagcttcctctctgatacgccgcaaatgggccgcagctttgccggcggcgtaaacgtgaagttttaa

SEQ ID NO: 596 - protein, 339 aa, Neisseria gonorrhoeae
MLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYKGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFAGGVNVKF

SEQ ID NO: 597 - DNA, 1020 bp, Neisseria meningitidis
atgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgtgaagttttaa

SEQ ID NO: 598 - protein, 339 aa, Neisseria meningitidis
MLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 599 - DNA, 1020 bp, Neisseria meningitidis
atgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 600 - protein, 339 aa, Neisseria meningitidis
MLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

(The sequence listing continues in the following parts.)

We claim:

1. A method of preparing an immunogenic composition comprising:
   (a) expressing in *E. coli* a polypeptide comprising a fragment of the amino acid sequence of SEQ ID NO: 2534, wherein the fragment comprises 18 or more consecutive amino acids from the amino acid sequence, wherein the polypeptide is immunogenic;
   (b) purifying the polypeptide;
   (c) preparing the immunogenic composition by combining the purified polypeptide with an aluminum salt adjuvant.

2. The method of claim 1, wherein the fragment comprises 20 or more consecutive amino acids from the amino acid sequence of SEQ ID NO: 2534.

3. The method of claim 1, wherein the immunogenic composition further comprises a pharmaceutically acceptable carrier.

4. The method of claim 1, wherein the aluminum salt is aluminum phosphate.

5. The method of claim 3, wherein the aluminum salt is aluminum phosphate.

6. The method of claim 1, wherein the immunogenic composition further comprises a pH buffering agent.

7. The method of claim 5, wherein the immunogenic composition further comprises a pH buffering agent.

8. A method of preparing an immunogenic composition comprising combining a purified polypeptide with an aluminum salt adjuvant, wherein the purified polypeptide was expressed in, and purified from, *E. coli*; comprises a fragment of the amino acid sequence of SEQ ID NO: 2534, wherein the fragment comprises 18 or more consecutive amino acids from the amino acid sequence; and is immunogenic.

9. The method of claim 8, wherein the fragment comprises 20 or more consecutive amino acids from the amino acid sequence of SEQ ID NO: 2534.

10. The method of claim 8, wherein the immunogenic composition further comprises a pharmaceutically acceptable carrier.

11. The method of claim 8, wherein the aluminum salt is aluminum phosphate.

12. The method of claim 10, wherein the aluminum salt is aluminum phosphate.

13. The method of claim 8, wherein the immunogenic composition further comprises a pH buffering agent.

14. The method of claim 12, wherein the immunogenic composition further comprises a pH buffering agent.

* * * * *